US011866727B2

(12) United States Patent
Cowan et al.

(10) Patent No.: US 11,866,727 B2
(45) Date of Patent: Jan. 9, 2024

(54) MATERIALS AND METHODS FOR TREATMENT OF GLYCOGEN STORAGE DISEASE TYPE 1A

(71) Applicant: CRISPR THERAPEUTICS AG

(72) Inventors: Chad Albert Cowan, Cambridge, MA (US); Roman Lvovitch Bogorad, Cambridge, MA (US); Ante Sven Lundberg, Cambridge, MA (US); Kirsten Leah Beaudry, Cambridge, MA (US)

(73) Assignee: CRISPR THERAPEUTICS AG, Zug (CH)

(*) Notice: Subject to any disclaimer, the term of this patent is extended or adjusted under 35 U.S.C. 154(b) by 802 days.

(21) Appl. No.: 15/759,202

(22) PCT Filed: Nov. 7, 2016

(86) PCT No.: PCT/IB2016/001709
§ 371 (c)(1),
(2) Date: Mar. 9, 2018

(87) PCT Pub. No.: WO2017/077386
PCT Pub. Date: May 11, 2017

(65) Prior Publication Data
US 2019/0382798 A1 Dec. 19, 2019

Related U.S. Application Data

(60) Provisional application No. 62/324,113, filed on Apr. 18, 2016, provisional application No. 62/265,678, filed on Dec. 10, 2015, provisional application No. 62/252,208, filed on Nov. 6, 2015.

(51) Int. Cl.
*C12N 9/22* (2006.01)
*C12N 15/90* (2006.01)
*C12N 9/16* (2006.01)
*C12N 15/11* (2006.01)
*A61K 38/00* (2006.01)

(52) U.S. Cl.
CPC ............ *C12N 15/907* (2013.01); *C12N 9/16* (2013.01); *C12N 9/22* (2013.01); *C12N 15/11* (2013.01); *C12Y 301/03009* (2013.01); *A61K 38/00* (2013.01); *C12N 2310/20* (2017.05); *C12N 2800/80* (2013.01)

(58) Field of Classification Search
CPC ....................................................... C12N 9/22
See application file for complete search history.

(56) References Cited

U.S. PATENT DOCUMENTS

| 3,687,808 A | 8/1972 | Merigan, Jr. et al. |
|---|---|---|
| 4,469,863 A | 9/1984 | Ts et al. |
| 4,476,301 A | 10/1984 | Imbach et al. |
| 4,587,044 A | 5/1986 | Miller et al. |
| 4,605,735 A | 8/1986 | Miyoshi et al. |
| 4,667,025 A | 5/1987 | Miyoshi et al. |
| 4,762,779 A | 8/1988 | Snitman |
| 4,789,737 A | 12/1988 | Miyoshi et al. |
| 4,824,941 A | 4/1989 | Gordon et al. |
| 4,828,979 A | 5/1989 | Klevan et al. |
| 4,835,263 A | 5/1989 | Nguyen et al. |
| 4,845,205 A | 7/1989 | Huynh Dinh et al. |
| 4,876,335 A | 10/1989 | Yamane et al. |
| 4,904,582 A | 2/1990 | Tullis |
| 4,948,882 A | 8/1990 | Ruth |
| 4,958,013 A | 9/1990 | Letsinger |
| 5,023,243 A | 6/1991 | Tullis |
| 5,034,506 A | 7/1991 | Summerton et al. |
| 5,082,830 A | 1/1992 | Brakel et al. |
| 5,109,124 A | 4/1992 | Ramachandran et al. |
| 5,112,963 A | 5/1992 | Pieles et al. |
| 5,118,802 A | 6/1992 | Smith et al. |
| 5,130,302 A | 7/1992 | Spielvogel et al. |
| 5,134,066 A | 7/1992 | Rogers et al. |
| 5,138,045 A | 8/1992 | Cook et al. |
| 5,166,315 A | 11/1992 | Summerton et al. |
| 5,173,414 A | 12/1992 | Lebkowski et al. |
| 5,175,273 A | 12/1992 | Bischofberger et al. |
| 5,177,196 A | 1/1993 | Meyer et al. |
| 5,185,444 A | 2/1993 | Summerton et al. |
| 5,188,897 A | 2/1993 | Suhadolnik et al. |

(Continued)

FOREIGN PATENT DOCUMENTS

| WO | WO1993/007883 | 4/1993 |
|---|---|---|
| WO | WO1995/013365 | 5/1995 |

(Continued)

OTHER PUBLICATIONS

Schneller (BMC Medicine, 15(43): 1-12, 2017 (Year: 2017).*
Piccolo (Expert Opinion on Biological Therapy, 1-2, 2020) (Year: 2020).*
Jinek (eLife 2: e00471, 1-9, 2013). (Year: 2013).*
Chou (Hum Mut, 29(7): 921-930, 2008), (Year: 2008).*
Wang (Genet Med, 15(2): 106-114, 2013). (Year: 2013).*
Bali, D. et al., "Glycogen Storage Disease Type I," GeneReviews, 22 pages (2016).
Cristea, S. et al., "In vivo Cleavage of Transgene Donors Promotes Nuclease-Mediated Targeted Integration," Biotechnology and Bioengineering, vol. 110 (3): 871-880 (2013).
International Search Report and Written Opinion, PCT/IB2019/000833, dated Jan. 28, 2020, 19 pages.

(Continued)

*Primary Examiner* — Anoop K Singh
*Assistant Examiner* — David A Montanari
(74) *Attorney, Agent, or Firm* — Sheppard, Mullin, Richter & Hampton LLP

(57) ABSTRACT

The present application provides materials and methods for treating a patient with Glycogen Storage Disease type 1a (GSD1a) both ex vivo and in vivo. In addition, the present application provides materials and methods for modulating the expression, function, and/or activity of the glucose-6-phosphatase, catalytic (G6PC) and/or the glucose-6-phosphatase (G6Pase) protein in a cell by genome editing.

6 Claims, 1298 Drawing Sheets

Specification includes a Sequence Listing.

(56) References Cited

U.S. PATENT DOCUMENTS

| | | |
|---|---|---|
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |
| 5,235,033 A | 8/1993 | Summerton et al. |
| 5,245,022 A | 9/1993 | Weis et al. |
| 5,254,469 A | 10/1993 | Warren et al. |
| 5,258,506 A | 11/1993 | Urdea et al. |
| 5,262,536 A | 11/1993 | Hobbs |
| 5,264,423 A | 11/1993 | Cohen et al. |
| 5,264,562 A | 11/1993 | Matteucci et al. |
| 5,264,564 A | 11/1993 | Matteucci et al. |
| 5,272,250 A | 12/1993 | Spielvogel et al. |
| 5,276,019 A | 1/1994 | Cohen et al. |
| 5,278,302 A | 1/1994 | Caruthers et al. |
| 5,286,717 A | 2/1994 | Cohen et al. |
| 5,292,873 A | 3/1994 | Rokita et al. |
| 5,317,098 A | 5/1994 | Shizuya et al. |
| 5,321,131 A | 6/1994 | Agrawal et al. |
| 5,367,066 A | 11/1994 | Urdea et al. |
| 5,371,241 A | 12/1994 | Brush |
| 5,391,723 A | 2/1995 | Priest |
| 5,399,676 A | 3/1995 | Froehler et al. |
| 5,405,938 A | 4/1995 | Summerton et al. |
| 5,405,939 A | 4/1995 | Suhadolnik et al. |
| 5,414,077 A | 5/1995 | Lin et al. |
| 5,416,203 A | 5/1995 | Letsinger |
| 5,432,272 A | 7/1995 | Benner |
| 5,434,257 A | 7/1995 | Matteucci et al. |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,255 A | 10/1995 | Cook et al. |
| 5,466,677 A | 11/1995 | Baxter et al. |
| 5,470,967 A | 11/1995 | Huie et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,502,177 A | 3/1996 | Matteucci et al. |
| 5,510,475 A | 4/1996 | Agrawal et al. |
| 5,512,439 A | 4/1996 | Hornes et al. |
| 5,512,667 A | 4/1996 | Reed et al. |
| 5,514,785 A | 5/1996 | Van Ness et al. |
| 5,519,126 A | 5/1996 | Hecht |
| 5,525,465 A | 6/1996 | Haralambidis et al. |
| 5,525,711 A | 6/1996 | Hawkins et al. |
| 5,536,821 A | 7/1996 | Agrawal et al. |
| 5,539,082 A | 7/1996 | Nielsen et al. |
| 5,541,306 A | 7/1996 | Agrawal et al. |
| 5,541,307 A | 7/1996 | Cook et al. |
| 5,541,313 A | 7/1996 | Ruth |
| 5,545,730 A | 8/1996 | Urdea et al. |
| 5,550,111 A | 8/1996 | Suhadolnik et al. |
| 5,552,538 A | 9/1996 | Urdea et al. |
| 5,552,540 A | 9/1996 | Haralambidis et al. |
| 5,561,225 A | 10/1996 | Maddry et al. |
| 5,563,253 A | 10/1996 | Agrawal et al. |
| 5,565,552 A | 10/1996 | Magda et al. |
| 5,567,810 A | 10/1996 | Weis et al. |
| 5,571,799 A | 11/1996 | Tkachuk et al. |
| 5,574,142 A | 11/1996 | Meyer et al. |
| 5,578,717 A | 11/1996 | Urdea et al. |
| 5,578,718 A | 11/1996 | Cook et al. |
| 5,580,731 A | 12/1996 | Chang et al. |
| 5,585,481 A | 12/1996 | Arnold et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,595,726 A | 1/1997 | Magda et al. |
| 5,596,086 A | 1/1997 | Matteucci et al. |
| 5,596,091 A | 1/1997 | Switzer |
| 5,597,696 A | 1/1997 | Linn et al. |
| 5,599,923 A | 2/1997 | Sessler et al. |
| 5,599,928 A | 2/1997 | Hemmi et al. |
| 5,602,240 A | 2/1997 | De Mesmaeker et al. |
| 5,608,046 A | 3/1997 | Cook et al. |
| 5,610,289 A | 3/1997 | Cook et al. |
| 5,614,617 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,633,360 A | 5/1997 | Bischofberger et al. |
| 5,658,776 A | 8/1997 | Flotte et al. |
| 5,663,312 A | 9/1997 | Chaturvedula |
| 5,677,437 A | 10/1997 | Teng et al. |
| 5,677,439 A | 10/1997 | Weis et al. |
| 5,681,941 A | 10/1997 | Cook et al. |
| 5,688,941 A | 11/1997 | Cook et al. |
| 5,714,331 A | 2/1998 | Buchardt et al. |
| 5,719,262 A | 2/1998 | Buchardt et al. |
| 5,750,692 A | 5/1998 | Cook et al. |
| 5,763,588 A | 6/1998 | Matteucci et al. |
| 5,786,211 A | 7/1998 | Johnson |
| 5,830,653 A | 11/1998 | Froehler et al. |
| 5,871,982 A | 2/1999 | Wilson et al. |
| 6,005,096 A | 12/1999 | Matteucci et al. |
| 6,258,595 B1 | 7/2001 | Gao et al. |
| 6,287,860 B1 | 9/2001 | Monia et al. |
| 2003/0158403 A1 | 8/2003 | Manoharan et al. |
| 2014/0068797 A1 | 3/2014 | Doudna et al. |
| 2016/0314245 A1* | 10/2016 | Silver .................... G06N 7/005 |
| 2017/0065636 A1* | 3/2017 | Moriarity ........... C07K 14/7051 |
| 2020/0040362 A1 | 2/2020 | Carlo et al. |

FOREIGN PATENT DOCUMENTS

| | | | |
|---|---|---|---|
| WO | WO1995/013392 | 5/1995 | |
| WO | WO1996/017947 | 6/1996 | |
| WO | WO1997/006243 | 2/1997 | |
| WO | WO1997/008298 | 3/1997 | |
| WO | WO1997/009441 | 3/1997 | |
| WO | WO1997/021825 | 6/1997 | |
| WO | WO1999/011764 | 3/1999 | |
| WO | WO2001/083692 | 11/2001 | |
| WO | 2010/029303 A1 | 3/2010 | |
| WO | WO2013/176772 | 11/2013 | |
| WO | 2014/089212 A1 | 6/2014 | |
| WO | WO-2014089212 A1 * | 6/2014 | ................ A61P 1/16 |
| WO | 2015/081101 A1 | 6/2015 | |
| WO | 2017/072590 A1 | 5/2017 | |
| WO | 2017/077386 A1 | 5/2017 | |
| WO | 2018/096356 A1 | 5/2018 | |
| WO | 2019/239361 A1 | 12/2019 | |
| WO | 2020/003006 A2 | 1/2020 | |

OTHER PUBLICATIONS

Leslie, N. et al., "Pompe Disease, Synonyms: Acid Alpha-Glucosidase Deficiency, Acid Maltase Deficiency, GAA Deficiency, Glycogen Storage Disease Type II (GSD II), Glycogenosis Type II," GeneReviews, 26 pages (2007).

Long, C. et al., "Correction of diverse muscular dystrophy mutations in human engineered heart muscle by single-site genome editing," Science Advances, vol. 4(1):eaap9004 (2018).

Long, C. et al., "Postnatal genome editing partially restores dystrophin expression in a mouse model of muscular dystrophy" Science, vol. 351(6271): 400-403 (2016).

Orlando, S. et al., "Zinc-finger nuclease-driven targeted integration into mammalian genomes using donors with limited chromosomal homology," Nucleic Acids Research Advance Access, vol. 38(15): e152-1 (2010).

Renaud, J-P. et al., "Improved Genome Editing Efficiency and Flexibility Using Modified Oligonucleotides with TALEN and CRISPR-Cas9 Nucleases," Cell Reports, vol. 14(9):2263-2272 (2016).

Tabebordbar, M. et al., "In vivo gene editing in dystrophic mouse muscle and muscle stem cells#," Science, vol. 351 (6271): 407-411 (2016).

(56) References Cited

OTHER PUBLICATIONS

Tsai, S et al., "GUIDE-seq enables genome-wide profiling of off-target cleavage by CRISPR-Cas nucleases," Nature Biotechnology, vol. 33(2): 187-197 (2015).
Van Der Wal, E. et al.," Large-Scale Expansion of Human iPSC-Derived Skeletal Muscle Cells for Disease Modeling and Cell-Based Therapeutic Strategies," Stem Cell Reports, vol. 10(6): 1975-1990 (2018).
Yin, H. et al., "Therapeutic genome editing by combined viral and non-viral delivery of CRISPR system components in vivo," Nat Biotechnol., vol. 34(3): 328-333 (2016).
International Preliminary Report on Patentability, PCT/IB2016/001709, dated May 8, 2018, 6 pages.
International Search Report and Written Opinion, PCT/IB2016/001709, dated Mar. 31, 2017, 10 pages.
Landau, D. et al., "In Vivo Zinc Finger Nuclease-mediated Targeted Integration of a Glucose-6-phosphatase Transgene Promotes Survival in Mice With Glycogen Storage Disease Type IA," Molecular Therapy, vol. 24(4): 697-706 (2016).
Landau, D. J. et al., "Zinc Finger Nuclease-Mediated Cleavage of the Rosa26 Locus to Allow Targeted Integration of a Glucose-6-Phosphatase Gene Promotes Survival in Mice With Glycogen Storage Disease Type-IA," Molecular Therapy, vol. 22 (Suppl. 1) p. S7 (2014).
U.S. Appl. No. 16/457,528, filed Jun. 28, 2019, Troy Dean Carlo.
Angart et al., "Design of siRNA therapeutics from the molecular scale," Pharmaceuticals 2013, 6(4), 440-468.
Arion & Canfield, "Glucose-6-phosphatase and type 1 glycogen storage disease: some critical considerations," European Journal of Pediatrics 1993, 152, 7-13.
Barrett et al., "Reliable generation of induced pluripotent stem cells from human lymphoblastoid cell lines," Stem Cells Translational Medicine 2014, 3(12), 1429-1434.
Bartel, "MicroRNAs: target recognition and regulatory functions," Cell 2009, 136(2), 215-233.
Behlke, "Chemical modification of siRNAs for in vivo use," Oligonucleotides 2008, 18(4), 305-320.
Belfort & Bonocora, "Homing endonucleases: from genetic anomalies to programmable genomic clippers," Homing Endonucleases: Methods and Protocols. Methods in Molecular Biology 2014, 1123, 1-26.
Boch et al., "Breaking the code of DNA binding specificity of TAL-type III effectors," Science 2009, 326(5959), 1509-1512.
Boissel & Scharenberg, "Assembly and characterization of megaTALs for hyperspecific genome engineering applications," Chromosomal Mutagenesis 2015, 171-196.
Boissel et al., "megaTALs: a rare-cleaving nuclease architecture for therapeutic genome engineering," Nucleic Acids Research 2014, 42(4), 2591-2601.
Braasch & Corey, "Novel antisense and peptide nucleic acid strategies for controlling gene expression," Biochemistry 2002, 41(14), 4503-4510.
Bramsen & Kjems, "Development of therapeutic-grade small interfering RNAs by chemical engineering," Frontiers in Genetics 2012, vol. 3, Article 154.
Brinkman et al., "Easy quantitative assessment of genome editing by sequence trace decomposition," Nucleic Acids Research 2014, 42(22), in 8 pages.
Budniatzky & Gepstein, "Concise review: reprogramming strategies for cardiovascular regenerative medicine: from induced pluripotent stem cells to direct reprogramming," Stem Cells Translational Medicine 2014, 3(4), 448-457.
Burnett et al., "Current progress of siRNA/shRNA therapeutics in clinical trials," Biotechnology Journal 2011, 6(9), 1130-1146.
Canver et al., "BCL11A enhancer dissection by Cas9-mediated in situ saturating mutagenesis," Nature 2015, 527(7577), 192-197.
Carter, "Adeno-associated virus vectors," Current Opinion in Biotechnology 1992, 3(5), 533-539.
Ceccaldi et al., "Homologous-recombination-deficient tumours are dependent on Pol θ-mediated repair," Nature 2015, 518(7538), 258-262.
Cekaite et al., "Gene expression analysis in blood cells in response to unmodified and 2'-modified siRNAs reveals TLR-dependent and independent effects," Journal of Molecular Biology 2007, 365(1), 90-108.
Cermak et al., "Efficient design and assembly of custom TALEN and other TAL effector-based constructs for DNA targeting," Nucleic Acids Research 2011, 39(12), in 11 pages.
Cermak et al., "Efficient design and assembly of custom TALENs using the Golden Gate platform," Chromosomal Mutagenesis 2015, 133-159.
Chen et al., "Global microRNA depletion suppresses tumor angiogenesis," Genes & Development 2014, 28(10), 1054-1067.
Chernolovskaya & Zenkova, "Chemical modification of siRNA," Current Opinion in Molecular Therapeutics 2010, 12(2), 158-167.
Cho & Greenberg, "Familiar ends with alternative endings," Nature 2015, 518(7538), 174-175.
Chou & Mansfield, "Mutations in the glucose-6-phosphatase-α (G6PC) gene that cause type la glycogen storage disease," Human Mutation 2008, 29(7), 921-930.
Clar et al., "Hepatic lentiviral gene transfer prevents the long-term onset of hepatic tumours of glycogen storage disease type 1a in mice," Human Molecular Genetics 2015, 24(8), 2287-2296.
Clark et al., "A stable cell line carrying adenovirus-inducible rep and cap genes allows for infectivity titration of adeno-associated virus vectors," Gene Therapy 1996, 3, (12), 1124-1132. Abstract Only.
Cox et al., "Therapeutic genome editing: prospects and challenges," Nature Medicine 2015, 21(2), 121-131.
Cradick et al., "COSMID: a web-based tool for identifying and validating CRISPR/Cas off-target sites," Molecular Therapy-Nucleic Acids 2014, 3, in 10 pages.
Cradick et al., "COSMID: CRISPR Search with Mismatches, Insertions and/or Deletions," gatech.edu 2023, in 1 page.
Crooke et al., "Pharmacokinetic properties of several novel oligonucleotide analogs in mice," Journal of Pharmacology and Experimental Therapeutics 1996, 277(2), 923-937. Abstract Only.
De Mesmaeker et al., "Antisense oligonucleotides," Accounts of Chemical Research 1995, 28(9), 366-374.
Deleavey et al., "Chemical modification of siRNA," Current Protocols in Nucleic Acid Chemistry 2009, 39(1), in 22 pages.
Deltcheva et al., "CRISPR RNA maturation by trans-encoded small RNA and host factor RNase III," Nature 2011, 471(7340), 602-607.
Dreier et al., "Development of zinc finger domains for recognition of the 5'-CNN-3' family DNA sequences and their use in the construction of artificial transcription factors," Journal of Biological Chemistry 2005, 280(42), 35588-35597.
Dreier et al., "Development of zinc finger domains for recognition of the 5'-ANN-3' family of DNA sequences and their use in the construction of artificial transcription factors," Journal of Biological Chemistry 2001, 276(31), 29466-29478.
Dreier et al., "Insights into the molecular recognition of the 5'-GNN-3' family of DNA sequences by zinc finger domains," Journal of Molecular Biology 2000, 303(4), 489-502.
Duan et al., "Differentiation and characterization of metabolically functioning hepatocytes from human embryonic stem cells," Stem Cells 2010, 28(4), 674-686.
Ekstein et al., "Mutation frequencies for glycogen storage disease la in the Ashkenazi Jewish population," American Journal of Medical Genetics Part A 2004, 129(2), 162-164.
Englisch & Gauss, "Chemically modified oligonucleotides as probes and inhibitors," Angewandte Chemie International Edition in English 1991, 30(6), 613-629.
European Patent Office, Communication pursuant to Article 94(3) EPC dated Oct. 14, 2019 for European Patent Application No. 16819652.5, in 5 pages.
European Patent Office, Communication pursuant to Article 94(3) EPC dated Oct. 27, 2020 for European Patent Application No. 16819652.5, in 4 pages.

(56) References Cited

OTHER PUBLICATIONS

European Patent Office, Communication pursuant to Article 94(3) EPC dated Mar. 29, 2022 for European Patent Application No. 16819652.5, in 5 pages.

Focosi et al., "Induced pluripotent stem cells in hematology: current and future applications," Blood Cancer Journal 2014, 4(5), in 8 pages.

Fonfara et al., "Phylogeny of Cas9 determines functional exchangeability of dual-RNA and Cas9 among orthologous type II CRISPR-Cas systems," Nucleic Acids Research 2014, 42(4), 2577-2590.

Froissart et al., "Glucose-6-phosphatase deficiency," Orphanet Journal of Rare Diseases 2011, 6(1), 1-12.

Fucini et al., "Adenosine modification may be preferred for reducing siRNA immune stimulation," Nucleic Acid Therapeutics 2012, 22(3), 205-210.

Gaglione & Messere, "Recent progress in chemically modified siRNAs," Mini Reviews in Medicinal Chemistry 2010, 10(7), 578-595.

Gebeyehu et al., "Novel biotinylated nucleotide-analogs for labeling and colorimetric detection of DNA," Nucleic Acids Research 1987, 15(11), 4513-4534.

Guilinger et al., "Fusion of catalytically inactive Cas9 to FokI nuclease improves the specificity of genome modification," Nature Biotechnology 2014, 32(6), 577-582.

Hafez & Hausner, "Homing endonucleases: DNA scissors on a mission," Genome 2012, 55(8), 553-569.

Heasman, "Morpholino oligos: making sense of antisense?," Developmental Biology 2002, 243(2), 209-214.

Hermonat & Muzyczka, "Use of adeno-associated virus as a mammalian DNA cloning vector: transduction of neomycin resistance into mammalian tissue culture cells," Proceedings of the National Academy of Sciences 1984, 81(20), 6466-6470.

Herranz & Cohen, "MicroRNAs and gene regulatory networks: managing the impact of noise in biological systems," Genes & Development 2010, 24(13), 1339-1344.

Herrera et al., "Isolation and characterization of a stem cell population from adult human liver," Stem Cells 2006, 24(12), 2840-2850.

Hu et al., "Physiological roles of asialoglycoprotein receptors (ASGPRs) variants and recent advances in hepatic-targeted delivery of therapeutic molecules via ASGPRs," Protein and Peptide Letters 2014, 21(10), 1025-1030. Abstract Only.

Huangfu et al., "Induction of pluripotent stem cells by defined factors is greatly improved by small-molecule compounds," Nature Biotechnology 2008, 26(7), 795-797.

Jinek et al., "A programmable dual-RNA-guided DNA endonuclease in adaptive bacterial immunity," Science 2012, 337(6096), 816-821.

Judge & Maclachlan, "Overcoming the innate immune response to small interfering RNA," Human Gene Therapy 2008, 19(2), 111-124.

Judge et al., "Design of noninflammatory synthetic siRNA mediating potent gene silencing in vivo," Molecular Therapy 2006, 13(3), 494-505.

Kabanov et al., "A new class of antivirals: antisense oligonucleotides combined with a hydrophobic substituent effectively inhibit influenza virus reproduction and synthesis of virus-specific proteins in MDCK cells," FEBS letters 1990, 259(2), 327-330.

Kajihara et al., "Exon redefinition by a point mutation within exon 5 of the glucose-6-phosphatase gene is the major cause of glycogen storage disease type 1a in Japan," American Journal of Human Genetics 1995, 57(3), 549-555.

Kanasty et al., "Action and reaction: the biological response to siRNA and its delivery vehicles," Molecular Therapy 2012, 20(3), 513-524.

Karikó et al., "Suppression of RNA recognition by Toll-like receptors: the impact of nucleoside modification and the evolutionary origin of RNA," Immunity 2005, 23(2), 165-175.

Kent et al., "Mechanism of microhomology-mediated end-joining promoted by human DNA polymerase θ," Nature Structural & Molecular Biology 2015, 22(3), 230-237.

Kishnani et al., "Canine model and genomic structural organization of glycogen storage disease type Ia (GSD Ia)," Veterinary Pathology 2001, 38(1), 83-91.

Kleinstiver et al., "The I-TevI nuclease and linker domains contribute to the specificity of monomeric TALENs," G3: Genes, Genomes, Genetics 2014, 4(6) 1155-1165.

Koeberl et al., "Emerging therapies for glycogen storage disease type I," Trends in Endocrinology & Metabolism 2009, 20(5), 252-258.

Koeberl et al., "Glycogen storage disease types I and II: treatment updates," Journal of Inherited Metabolic Disease: Official Journal of the Society for the Study of Inborn Errors of Metabolism 2007, 30(2), 159-164.

Kole et al., "RNA therapeutics: beyond RNA interference and antisense oligonucleotides," Nature Reviews Drug Discovery 2012, 11(2), 125-140.

Kormann et al., "Expression of therapeutic proteins after delivery of chemically modified mRNA in mice," Nature biotechnology 2011, 29(2), 154-157.

Lacerra et al., "Restoration of hemoglobin A synthesis in erythroid cells from peripheral blood of thalassemic patients," Proceedings of the National Academy of Sciences 2000, 97(17), 9591-9596.

Laughlin et al., "Cloning of infectious adeno-associated virus genomes in bacterial plasmids," Gene 1983, 23(1), 65-73.

Lebkowski et al., "Adeno-associated virus: a vector system for efficient introduction and integration of DNA into a variety of mammalian cell types," Molecular and Cellular Biology, 1988, 3988-3996.

Lee et al., "Prevention of hepatocellular adenoma and correction of metabolic abnormalities in murine glycogen storage disease type Ia by gene therapy," Hepatology 2012, 56(5), 1719-1729.

Lee et al., "Uncooked cornstarch——efficacy in type I glycogenosis," Archives of Disease in Childhood 1996, 74(6), 546-547.

Lei et al., "Genetic basis of glycogen storage disease type 1a: prevalent mutations at the glucose-6-phosphatase locus," American Journal of Human Genetics 1995, 57(4), 766-771.

Letsinger et al., "Cholesteryl-conjugated oligonucleotides: synthesis, properties, and activity as inhibitors of replication of human immunodeficiency virus in cell culture," Proceedings of the National Academy of Sciences 1989, 86(17), 6553-6556.

Li et al., "Modularly assembled designer TAL effector nucleases for targeted gene knockout and gene replacement in eukaryotes," Nucleic Acids Research 2011, 39(14), 6315-6325.

Liu et al., "Validated zinc finger protein designs for all 16 GNN DNA triplet targets," Journal of Biological Chemistry 2002, 277(6), 3850-3856.

Ma et al., "Highly efficient differentiation of functional hepatocytes from human induced pluripotent stem cells," Stem Cells Translational Medicine 2013, 2(6), 409-419.

Ma et al., "Pol III promoters to express small RNAs: delineation of transcription initiation," Molecular Therapy-Nucleic Acids 2014, 3, in 11 pages.

Maherali & Hochedlinger, "Guidelines and techniques for the generation of induced pluripotent stem cells," Cell Stem Cell 2008, 3(6), 595-605.

Mak et al., "The crystal structure of TAL effector PthXo1 bound to its DNA target," Science 2012, 335(6069), 716-719.

Manoharan et al., "Chemical modifications to improve uptake and bioavailability of antisense oligonucleotides," Annals of the New York Academy of Sciences 1992, 660(1), 306-309.

Manoharan et al., "Cholic acid-oligonucleotide conjugates for antisense applications," Bioorganic & Medicinal Chemistry Letters 1994, 4(8), 1053-1060.

Manoharan et al., "Introduction of a lipophilic thioether tether in the minor groove of nucleic acids for antisense applications," Bioorganic & Medicinal Chemistry Letters 1993, 3(12), 2765-2770.

Manoharan et al., "Lipidic nucleic acids," Tetrahedron Letters 1995, 36(21), 3651-3654.

Manoharan et al., "Oligonucleotide conjugates: alteration of the pharmacokinetic properties of antisense agents," Nucleosides, Nucleotides & Nucleic Acids 1995, 14(3-5), 969-973.

(56) References Cited

OTHER PUBLICATIONS

Maresca et al., "Obligate ligation-gated recombination (ObLiGaRe): custom-designed nuclease-mediated targeted integration through nonhomologous end joining," Genome Research 2013, 23(3), 539-546.
Marson et al., "Wnt signaling promotes reprogramming of somatic cells to pluripotency," Cell Stem Cell 2008, 3(2), 132-135.
Martin, "Ein Neuer Zugang Zu 2' — O — Alkylribonucleosiden Und Eigenschaften Deren Oligonucleotide," Helvetica Chimica Acta 1995, 78(2), 486-504.
Mateos-Gomez et al., "Mammalian polymerase θ promotes alternative NHEJ and suppresses recombination," Nature 2015, 518(7538), 254-257.
McLaughlin et al., "Adeno-associated virus general transduction vectors: analysis of proviral structures," Journal of Virology 1988, 62(6), 1963-1973.
Mishra et al., "Improved leishmanicidal effect of phosphorotioate antisense oligonucleotides by LDL-mediated delivery," Biochimica et Biophysica Acta (BBA)-Gene Structure and Expression 1995, 1264(2), 229-237.
Moscou & Bogdanove, "A simple cipher governs DNA recognition by TAL effectors," Science 2009, 326(5959), 1501-1501.
Mutel et al., "Targeted deletion of liver glucose-6 phosphatase mimics glycogen storage disease type 1a including development of multiple adenomas," Journal of Hepatology 2011, 54(3), 529-537.
Muzyczka, "Use of adeno-associated virus as a general transduction vector for mammalian cells," Viral Expression Vectors 1992, 97-129.
Nasevicius & Ekker, "Effective targeted gene 'knockdown' in zebrafish," Nature Genetics 2000, 26(2), 216-220.
Nielsen et al., "Sequence-selective recognition of DNA by strand displacement with a thymine-substituted polyamide," Science 1991, 254(5037), 1497-1500.
Oberhauser & Wagner, "Effective incorporation of 2'-O-methyl-oligoribonuclectides into liposomes and enhanced cell association through modification with thiocholesterol," Nucleic Acids Research 1992, 20(3), 533-538.
Paul et al., "Increased viral titer through concentration of viral harvests from retroviral packaging lines," Human Gene Therapy 1993, 4(5), 609-615.
Paulk et al., "In vivo selection of transplanted hepatocytes by pharmacological inhibition of fumarylacetoacetate hydrolase in wild-type mice," Molecular Therapy 2012, 20(10), 1981-1987.
Peer & Lieberman, "Special delivery: targeted therapy with small RNAs," Gene Therapy 2011, 18(12), 1127-1133.
Perrin et al., "An experimental rabies vaccine produced with a new BHK-21 suspension cell culture process: use of serum-free medium and perfusion-reactor system," Vaccine 1995, 13(13), 1244-1250.
Pittenger et al., "Multilineage potential of adult human mesenchymal stem cells," Science 1999, 284(5411), 143-147.
Posadas & Carthew, "MicroRNAs and their roles in developmental canalization," Current Opinion in Genetics & Development 2014, 27, 1-6.
Rake et al., "Glycogen storage disease type I: diagnosis, management, clinical course and outcome. Results of the European Study on Glycogen Storage Disease Type I (ESGSD I)," European Journal of Pediatrics 2002, 161, S20-S34.
Saj & Lai, "Control of microRNA biogenesis and transcription by cell signaling pathways," Current Opinion in Genetics & Development 2011, 21(4), 504-510.
Samulski et al., "Cloning of adeno-associated virus into pBR322: rescue of intact virus from the recombinant plasmid in human cells," Proceedings of the National Academy of Sciences 1982, 79(6), 2077-2081.
Samulski et al., "Helper-free stocks of recombinant adeno-associated viruses: normal integration does not require viral gene expression," Journal of Virology 1989, 63(9), 3822-3828.
Sander & Joung, "CRISPR-Cas systems for editing, regulating and targeting genomes, " Nature Biotechnology 2014, 32(4), 347-355.
Sapranauskas et al., "The *Streptococcus thermophilus* CRISPR/Cas system provides immunity in *Escherichia coli*," Nucleic Acids Research 2011, 39(21), 9275-9282.
Sawitza et al., "Bile acids induce hepatic differentiation of mesenchymal stem cells," Scientific Reports 2015, 5(1), in 15 pages.
Segal et al., "Toward controlling gene expression at will: selection and design of zinc finger domains recognizing each of the 5'-GNN-3' DNA target sequences," Proceedings of the National Academy of Sciences 1999, 96(6), 2758-2763.
Selby et al., "Liver transplantation for type I and type IV glycogen storage disease," European Journal of Pediatrics 1993, 152, 71-76.
Senapathy & Carter, "Molecular cloning of adeno-associated virus variant genomes and generation of infectious virus by recombination in mammalian cells," Journal of Biological Chemistry 1984, 259(7), 4661-4666.
Shea et al., "Synthesis, hybridization properties and antiviral activity of lipid-oligodeoxynucleotide conjugates," Nucleic Acids Research 1990, 18(13), 3777-3783.
Shi et al., "A combined chemical and genetic approach for the generation of induced pluripotent stem cells," Cell Stem Cell 2008, 2(6), 525-528.
Soutschek et al., "Therapeutic silencing of an endogenous gene by systemic administration of modified siRNAs," Nature 2004, 432(7014), 173-178.
Steentoft et al., "Precision genome editing: a small revolution for glycobiology," Glycobiology 2014, 24(8), 663-680.
Stemmer et al., "CCTop: an intuitive, flexible and reliable CRISPR/Cas9 target prediction tool," PLOS One 2015, 10(4), in 11 pages.
Stern-Ginossar et al., "Host immune system gene targeting by a viral miRNA," Science 2007, 317(5836), 376-381.
Svinarchuk et al., "Inhibition of HIV proliferation in MT-4 cells by antisense oligonucleotide conjugated to lipophilic groups," Biochimie 1993, 75(1-2), 49-54.
Takahashi & Yamanaka, "Induction of pluripotent stem cells from mouse embryonic and adult fibroblast cultures by defined factors," Cell 2006, 126(4), 663-676.
Takahashi et al., "Induction of pluripotent stem cells from adult human fibroblasts by defined factors," Cell 2007, 131(5), 861-872.
The State Intellectual Property Office of People's Republic of China, the First Office Action dated Jul. 21, 2021 for Chinese Patent Application No. 201680064861.3, in 14 pages.
The State Intellectual Property Office of People's Republic of China, the Second Office Action dated Mar. 3, 2022 for Chinese Patent Application No. 201680064861.3, in 14 pages.
The State Intellectual Property Office of People's Republic of China, the Third Office Action dated Jul. 5 for Chinese Patent Application No. 201680064861.3, in 10 pages.
Tratschin et al., "A human parvovirus, adeno-associated virus, as a eucaryotic vector: transient expression and encapsidation of the procaryotic gene for chloramphenicol acetyltransferase," Molecular and Cellular Biology 1984, 4(10), 2072-2081.
Tratschin et al., "Adeno-associated virus vector for high-frequency integration, expression, and rescue of genes in mammalian cells," Molecular and Cellular Biology 1985, 5(11), 3251-3260.
Tsai et al., "Dimeric CRISPR RNA-guided FokI nucleases for highly specific genome editing," Nature Biotechnology 2014, 32(6), 569-576.
Van Schaftingen & Gerin, "The glucose-6-phosphatase system," Biochemical Journal 2002, 362(3), 513-532.
Volkov et al., "Selective protection of nuclease-sensitive sites in siRNA prolongs silencing effect," Oligonucleotides 2009, 19(2), 191-202.
Wang et al., "Cyclohexene nucleic acids (CeNA): serum stable oligonucleotides that activate RNase H and increase duplex stability with complementary RNA," Journal of the American Chemical Society 2000, 122(36), 8595-8602.
Wang et al., "Rapid and efficient assembly of transcription activator-like effector genes by USER cloning," Journal of Genetics and Genomics 2014, 41(6), 339-347.
Warren et al., "Highly efficient reprogramming to pluripotency and directed differentiation of human cells with synthetic modified mRNA," Cell Stem Cell 2010, 7(5), 618-630.

(56) References Cited

OTHER PUBLICATIONS

Weber et al., "A modular cloning system for standardized assembly of multigene constructs," PLOS One 2011, 6(2), in 11 pages.
Weber et al., "Methylation of human microRNA genes in normal and neoplastic cells," Cell Cycle 2007, 6(9), 1001-1005.
Whitehead et al., "Silencing or stimulation? siRNA delivery and the immune system," Annual Review of Chemical and Biomolecular Engineering 2011, 2, 77-96.
Winkler, "Oligonucleotide conjugates for therapeutic applications," Therapeutic Delivery 2013, 4(7), 791-809.
Wolfs et al., "MegaTevs: single-chain dual nucleases for efficient gene disruption," Nucleic Acids Research 2014, 42(13), 8816-8829.
Zhao et al., "Sequence-specific inhibition of microRNA via CRISPR/CRISPRi system," Scientific Reports 2014, 4(1), in 5 pages.
Zingone et al., "Correction of glycogen storage disease type 1a in a mouse model by gene therapy," Journal of Biological Chemistry 2000, 275(2), 828-832.

\* cited by examiner

Figure 1

| # | Sequence | PAM | Chr | Start | End | Cuts 5' of | Str |
|---|---|---|---|---|---|---|---|
| SEQ ID NO 1 | TGGCGATATCTAGGTAGCCA | CAG | chr19 | 55112666 | 55112685 | 55112682 | + |
| SEQ ID NO 2 | GGCGATATCTAGGTAGCCAC | AGG | chr19 | 55112667 | 55112686 | 55112683 | + |
| SEQ ID NO 3 | CGATATCTAGGTAGCCACAG | GAG | chr19 | 55112669 | 55112688 | 55112685 | + |
| SEQ ID NO 4 | GATATCTAGGTAGCCACAGG | AGG | chr19 | 55112670 | 55112689 | 55112686 | + |
| SEQ ID NO 5 | ATCTAGGTAGCCACAGGAGG | CGG | chr19 | 55112673 | 55112692 | 55112689 | + |
| SEQ ID NO 6 | CCACAGGAGGCGGCCACGTG | CAG | chr19 | 55112683 | 55112702 | 55112699 | + |
| SEQ ID NO 7 | CAGGAGGCGGCCACGTGCAG | TGG | chr19 | 55112686 | 55112705 | 55112702 | + |
| SEQ ID NO 8 | CGGCCACGTGCAGTGGCGTC | CAG | chr19 | 55112693 | 55112712 | 55112709 | + |
| SEQ ID NO 9 | TCCAGCCCTCGTTGTCTGCC | TGG | chr19 | 55112711 | 55112730 | 55112727 | + |
| SEQ ID NO 10 | CTCGTTGTCTGCCTGGTTCA | CAG | chr19 | 55112718 | 55112737 | 55112734 | + |
| SEQ ID NO 11 | GTTGTCTGCCTGGTTCACAG | TGG | chr19 | 55112721 | 55112740 | 55112737 | + |
| SEQ ID NO 12 | CAGTGGCGCCCTGCTCCACC | AAG | chr19 | 55112738 | 55112757 | 55112754 | + |
| SEQ ID NO 13 | TGGCGCCCTGCTCCACCAAG | AAG | chr19 | 55112741 | 55112760 | 55112757 | + |
| SEQ ID NO 14 | ACCAAGAAGCGCACCACCTC | CAG | chr19 | 55112755 | 55112774 | 55112771 | + |
| SEQ ID NO 15 | CCAAGAAGCGCACCACCTCC | AGG | chr19 | 55112756 | 55112775 | 55112772 | + |
| SEQ ID NO 16 | CCTCCAGGTTCTCATCAATG | CAG | chr19 | 55112771 | 55112790 | 55112787 | + |
| SEQ ID NO 17 | CTCCAGGTTCTCATCAATGC | AGG | chr19 | 55112772 | 55112791 | 55112788 | + |
| SEQ ID NO 18 | GGTTCTCATCAATGCAGGCC | TGG | chr19 | 55112777 | 55112796 | 55112793 | + |
| SEQ ID NO 19 | GTTCTCATCAATGCAGGCCT | GGG | chr19 | 55112778 | 55112797 | 55112794 | + |
| SEQ ID NO 20 | TTCTCATCAATGCAGGCCTG | GGG | chr19 | 55112779 | 55112798 | 55112795 | + |
| SEQ ID NO 21 | TCTCATCAATGCAGGCCTGG | GGG | chr19 | 55112780 | 55112799 | 55112796 | + |
| SEQ ID NO 22 | CATCAATGCAGGCCTGGGGG | TGG | chr19 | 55112783 | 55112802 | 55112799 | + |
| SEQ ID NO 23 | ATCAATGCAGGCCTGGGGGT | GGG | chr19 | 55112784 | 55112803 | 55112800 | + |
| SEQ ID NO 24 | GCAGGCCTGGGGGTGGGAAA | CAG | chr19 | 55112790 | 55112809 | 55112806 | + |
| SEQ ID NO 25 | TGGGGGTGGGAAACAGCCGT | CAG | chr19 | 55112797 | 55112816 | 55112813 | + |
| SEQ ID NO 26 | GCCGTCAGCCGCACCTACCC | CAG | chr19 | 55112812 | 55112831 | 55112828 | + |
| SEQ ID NO 27 | AGCCGCACCTACCCCAGCCA | CGG | chr19 | 55112818 | 55112837 | 55112834 | + |
| SEQ ID NO 28 | CTACCCCAGCCACGGTGTCC | CAG | chr19 | 55112826 | 55112845 | 55112842 | + |
| SEQ ID NO 29 | CCCAGCCACGGTGTCCCAGC | AAG | chr19 | 55112830 | 55112849 | 55112846 | + |
| SEQ ID NO 30 | GCCACGGTGTCCCAGCAAGT | CGG | chr19 | 55112834 | 55112853 | 55112850 | + |
| SEQ ID NO 31 | CCACGGTGTCCCAGCAAGTC | GGG | chr19 | 55112835 | 55112854 | 55112851 | + |
| SEQ ID NO 32 | GTCCCAGCAAGTCGGGACTC | CAG | chr19 | 55112842 | 55112861 | 55112858 | + |
| SEQ ID NO 33 | CCCAGCAAGTCGGGACTCCA | GAG | chr19 | 55112844 | 55112863 | 55112860 | + |
| SEQ ID NO 34 | CCAGCAAGTCGGGACTCCAG | AGG | chr19 | 55112845 | 55112864 | 55112861 | + |
| SEQ ID NO 35 | CAGCAAGTCGGGACTCCAGA | GGG | chr19 | 55112846 | 55112865 | 55112862 | + |
| SEQ ID NO 36 | GCAAGTCGGGACTCCAGAGG | GAG | chr19 | 55112848 | 55112867 | 55112864 | + |
| SEQ ID NO 37 | TCCAGAGGGAGCCACGAAAA | CAG | chr19 | 55112860 | 55112879 | 55112876 | + |
| SEQ ID NO 38 | GGGAGCCACGAAAACAGATC | CAG | chr19 | 55112866 | 55112885 | 55112882 | + |
| SEQ ID NO 39 | GGAGCCACGAAAACAGATCC | AGG | chr19 | 55112867 | 55112886 | 55112883 | + |
| SEQ ID NO 40 | GAGCCACGAAAACAGATCCA | GGG | chr19 | 55112868 | 55112887 | 55112884 | + |
| SEQ ID NO 41 | CGAAAACAGATCCAGGGACA | CGG | chr19 | 55112874 | 55112893 | 55112890 | + |
| SEQ ID NO 42 | CAGATCCAGGGACACGGTGC | TAG | chr19 | 55112880 | 55112899 | 55112896 | + |
| SEQ ID NO 43 | AGATCCAGGGACACGGTGCT | AGG | chr19 | 55112881 | 55112900 | 55112897 | + |
| SEQ ID NO 44 | CCAGGGACACGGTGCTAGGA | CAG | chr19 | 55112885 | 55112904 | 55112901 | + |
| SEQ ID NO 45 | GGGACACGGTGCTAGGACAG | TGG | chr19 | 55112888 | 55112907 | 55112904 | + |
| SEQ ID NO 46 | GGACACGGTGCTAGGACAGT | GGG | chr19 | 55112889 | 55112908 | 55112905 | + |
| SEQ ID NO 47 | GACACGGTGCTAGGACAGTG | GGG | chr19 | 55112890 | 55112909 | 55112906 | + |
| SEQ ID NO 48 | CAGTGGGGAAAATGACCCAA | CAG | chr19 | 55112905 | 55112924 | 55112921 | + |

Figure 1 (Cont'd)

| | | | | | | | |
|---|---|---|---|---|---|---|---|
| SEQ ID NO 49 | GAAAATGACCCAACAGCCTC | TGG | chr19 | 55112912 | 55112931 | 55112928 | + |
| SEQ ID NO 50 | ACCCAACAGCCTCTGGCCAC | TGG | chr19 | 55112919 | 55112938 | 55112935 | + |
| SEQ ID NO 51 | CCTCTGGCCACTGGCTGTTT | AAG | chr19 | 55112928 | 55112947 | 55112944 | + |
| SEQ ID NO 52 | CTGGCTGTTTAAGATACGCC | TGG | chr19 | 55112938 | 55112957 | 55112954 | + |
| SEQ ID NO 53 | TTAAGATACGCCTGGTTGCC | CAG | chr19 | 55112946 | 55112965 | 55112962 | + |
| SEQ ID NO 54 | AGATACGCCTGGTTGCCCAG | TGG | chr19 | 55112949 | 55112968 | 55112965 | + |
| SEQ ID NO 55 | ACGCCTGGTTGCCCAGTGGT | CAG | chr19 | 55112953 | 55112972 | 55112969 | + |
| SEQ ID NO 56 | CGCCTGGTTGCCCAGTGGTC | AGG | chr19 | 55112954 | 55112973 | 55112970 | + |
| SEQ ID NO 57 | TGGTTGCCCAGTGGTCAGGC | CGG | chr19 | 55112958 | 55112977 | 55112974 | + |
| SEQ ID NO 58 | TGCCCAGTGGTCAGGCCGGC | CAG | chr19 | 55112962 | 55112981 | 55112978 | + |
| SEQ ID NO 59 | GCCCAGTGGTCAGGCCGGCC | AGG | chr19 | 55112963 | 55112982 | 55112979 | + |
| SEQ ID NO 60 | GGTCAGGCCGGCCAGGCCTT | CAG | chr19 | 55112970 | 55112989 | 55112986 | + |
| SEQ ID NO 61 | CCGGCCAGGCCTTCAGTGCT | CAG | chr19 | 55112977 | 55112996 | 55112993 | + |
| SEQ ID NO 62 | GCCAGGCCTTCAGTGCTCAG | TGG | chr19 | 55112980 | 55112999 | 55112996 | + |
| SEQ ID NO 63 | GTGCTCAGTGGAAACCACGA | AAG | chr19 | 55112992 | 55113011 | 55113008 | + |
| SEQ ID NO 64 | TGCTCAGTGGAAACCACGAA | AGG | chr19 | 55112993 | 55113012 | 55113009 | + |
| SEQ ID NO 65 | GGAAACCACGAAAGGACTCC | TGG | chr19 | 55113001 | 55113020 | 55113017 | + |
| SEQ ID NO 66 | GACTCCTGGCTATCTGCAAA | CAG | chr19 | 55113015 | 55113034 | 55113031 | + |
| SEQ ID NO 67 | ACTCCTGGCTATCTGCAAAC | AGG | chr19 | 55113016 | 55113035 | 55113032 | + |
| SEQ ID NO 68 | CCTGGCTATCTGCAAACAGG | AAG | chr19 | 55113019 | 55113038 | 55113035 | + |
| SEQ ID NO 69 | ATCTGCAAACAGGAAGTGAA | CGG | chr19 | 55113026 | 55113045 | 55113042 | + |
| SEQ ID NO 70 | TCTGCAAACAGGAAGTGAAC | GGG | chr19 | 55113027 | 55113046 | 55113043 | + |
| SEQ ID NO 71 | CTGCAAACAGGAAGTGAACG | GGG | chr19 | 55113028 | 55113047 | 55113044 | + |
| SEQ ID NO 72 | CAAACAGGAAGTGAACGGGG | AAG | chr19 | 55113031 | 55113050 | 55113047 | + |
| SEQ ID NO 73 | AAACAGGAAGTGAACGGGGA | AGG | chr19 | 55113032 | 55113051 | 55113048 | + |
| SEQ ID NO 74 | AACAGGAAGTGAACGGGGAA | GGG | chr19 | 55113033 | 55113052 | 55113049 | + |
| SEQ ID NO 75 | CAGGAAGTGAACGGGGAAGG | GAG | chr19 | 55113035 | 55113054 | 55113051 | + |
| SEQ ID NO 76 | AGGAAGTGAACGGGGAAGGG | AGG | chr19 | 55113036 | 55113055 | 55113052 | + |
| SEQ ID NO 77 | GGAAGTGAACGGGGAAGGGA | GGG | chr19 | 55113037 | 55113056 | 55113053 | + |
| SEQ ID NO 78 | GAAGTGAACGGGGAAGGGAG | GGG | chr19 | 55113038 | 55113057 | 55113054 | + |
| SEQ ID NO 79 | AAGTGAACGGGGAAGGGAGG | GGG | chr19 | 55113039 | 55113058 | 55113055 | + |
| SEQ ID NO 80 | AAGGGAGGGGGCTTCTCATC | TGG | chr19 | 55113051 | 55113070 | 55113067 | + |
| SEQ ID NO 81 | AGGGAGGGGGCTTCTCATCT | GGG | chr19 | 55113052 | 55113071 | 55113068 | + |
| SEQ ID NO 82 | GGGGGCTTCTCATCTGGGTG | CGG | chr19 | 55113057 | 55113076 | 55113073 | + |
| SEQ ID NO 83 | GGGGCTTCTCATCTGGGTGC | GGG | chr19 | 55113058 | 55113077 | 55113074 | + |
| SEQ ID NO 84 | CTGGGTGCGGGAACCCCACA | TGG | chr19 | 55113070 | 55113089 | 55113086 | + |
| SEQ ID NO 85 | GAACCCCACATGGTACCTGT | TAG | chr19 | 55113080 | 55113099 | 55113096 | + |
| SEQ ID NO 86 | CACATGGTACCTGTTAGACA | CGG | chr19 | 55113086 | 55113105 | 55113102 | + |
| SEQ ID NO 87 | AAAACCCCGTCACCACCCA | CAG | chr19 | 55113110 | 55113129 | 55113126 | + |
| SEQ ID NO 88 | AAACCCCGTCACCACCCAC | AGG | chr19 | 55113111 | 55113130 | 55113127 | + |
| SEQ ID NO 89 | CCCCCGTCACCACCCACAGG | TGG | chr19 | 55113114 | 55113133 | 55113130 | + |
| SEQ ID NO 90 | CCACCCACAGGTGGCGCTTC | CAG | chr19 | 55113123 | 55113142 | 55113139 | + |
| SEQ ID NO 91 | CAGGTGGCGCTTCCAGTGCT | CAG | chr19 | 55113130 | 55113149 | 55113146 | + |
| SEQ ID NO 92 | GGCGCTTCCAGTGCTCAGAC | TAG | chr19 | 55113135 | 55113154 | 55113151 | + |
| SEQ ID NO 93 | GCGCTTCCAGTGCTCAGACT | AGG | chr19 | 55113136 | 55113155 | 55113152 | + |
| SEQ ID NO 94 | CGCTTCCAGTGCTCAGACTA | GGG | chr19 | 55113137 | 55113156 | 55113153 | + |
| SEQ ID NO 95 | TTCCAGTGCTCAGACTAGGG | AAG | chr19 | 55113140 | 55113159 | 55113156 | + |
| SEQ ID NO 96 | CCAGTGCTCAGACTAGGGAA | GAG | chr19 | 55113142 | 55113161 | 55113158 | + |
| SEQ ID NO 97 | CAGTGCTCAGACTAGGGAAG | AGG | chr19 | 55113143 | 55113162 | 55113159 | + |

Figure 1 (Cont'd)

| SEQ ID NO 98 | TCAGACTAGGGAAGAGGTTC | CAG | chr19 | 55113149 | 55113168 | 55113165 | + |
| SEQ ID NO 99 | GGTTCCAGCCCCTCCTCCTT | CAG | chr19 | 55113164 | 55113183 | 55113180 | + |
| SEQ ID NO 100 | TTCCAGCCCCTCCTCCTTCA | GAG | chr19 | 55113166 | 55113185 | 55113182 | + |
| SEQ ID NO 101 | AGCCCCTCCTCCTTCAGAGC | CAG | chr19 | 55113170 | 55113189 | 55113186 | + |
| SEQ ID NO 102 | GCCCCTCCTCCTTCAGAGCC | AGG | chr19 | 55113171 | 55113190 | 55113187 | + |
| SEQ ID NO 103 | CCCTCCTCCTTCAGAGCCAG | GAG | chr19 | 55113173 | 55113192 | 55113189 | + |
| SEQ ID NO 104 | TCCTTCAGAGCCAGGAGTCC | TGG | chr19 | 55113179 | 55113198 | 55113195 | + |
| SEQ ID NO 105 | GAGCCAGGAGTCCTGGCCCC | CAG | chr19 | 55113186 | 55113205 | 55113202 | + |
| SEQ ID NO 106 | AGCCCCTCCTGCCTTAAACC | CAG | chr19 | 55113207 | 55113226 | 55113223 | + |
| SEQ ID NO 107 | CCTCCTGCCTTAAACCCAGC | CAG | chr19 | 55113211 | 55113230 | 55113227 | + |
| SEQ ID NO 108 | CTCCTGCCTTAAACCCAGCC | AGG | chr19 | 55113212 | 55113231 | 55113228 | + |
| SEQ ID NO 109 | AAACCCAGCCAGGTCCTTCC | AAG | chr19 | 55113222 | 55113241 | 55113238 | + |
| SEQ ID NO 110 | AACCCAGCCAGGTCCTTCCA | AGG | chr19 | 55113223 | 55113242 | 55113239 | + |
| SEQ ID NO 111 | ACCCAGCCAGGTCCTTCCAA | GGG | chr19 | 55113224 | 55113243 | 55113240 | + |
| SEQ ID NO 112 | GCCAGGTCCTTCCAAGGGTC | AAG | chr19 | 55113229 | 55113248 | 55113245 | + |
| SEQ ID NO 113 | GTCCTTCCAAGGGTCAAGCT | CGG | chr19 | 55113234 | 55113253 | 55113250 | + |
| SEQ ID NO 114 | GTCAAGCTCGGAAACCACCC | CAG | chr19 | 55113246 | 55113265 | 55113262 | + |
| SEQ ID NO 115 | AAGCTCGGAAACCACCCCAG | CAG | chr19 | 55113249 | 55113268 | 55113265 | + |
| SEQ ID NO 116 | CCACCCCAGCAGATACTCTG | CAG | chr19 | 55113260 | 55113279 | 55113276 | + |
| SEQ ID NO 117 | CACCCCAGCAGATACTCTGC | AGG | chr19 | 55113261 | 55113280 | 55113277 | + |
| SEQ ID NO 118 | GCAGATACTCTGCAGGAACG | AAG | chr19 | 55113268 | 55113287 | 55113284 | + |
| SEQ ID NO 119 | ACTCTGCAGGAACGAAGCCG | TGG | chr19 | 55113274 | 55113293 | 55113290 | + |
| SEQ ID NO 120 | CTCTGCAGGAACGAAGCCGT | GGG | chr19 | 55113275 | 55113294 | 55113291 | + |
| SEQ ID NO 121 | CAGGAACGAAGCCGTGGGCC | CAG | chr19 | 55113280 | 55113299 | 55113296 | + |
| SEQ ID NO 122 | AGGAACGAAGCCGTGGGCCC | AGG | chr19 | 55113281 | 55113300 | 55113297 | + |
| SEQ ID NO 123 | GGAACGAAGCCGTGGGCCCA | GGG | chr19 | 55113282 | 55113301 | 55113298 | + |
| SEQ ID NO 124 | GCCGTGGGCCCAGGGCTATG | CAG | chr19 | 55113290 | 55113309 | 55113306 | + |
| SEQ ID NO 125 | CCGTGGGCCCAGGGCTATGC | AGG | chr19 | 55113291 | 55113310 | 55113307 | + |
| SEQ ID NO 126 | CGTGGGCCCAGGGCTATGCA | GGG | chr19 | 55113292 | 55113311 | 55113308 | + |
| SEQ ID NO 127 | GGGCCCAGGGCTATGCAGGG | TGG | chr19 | 55113295 | 55113314 | 55113311 | + |
| SEQ ID NO 128 | GCCCAGGGCTATGCAGGGTG | GAG | chr19 | 55113297 | 55113316 | 55113313 | + |
| SEQ ID NO 129 | CCCAGGGCTATGCAGGGTGG | AGG | chr19 | 55113298 | 55113317 | 55113314 | + |
| SEQ ID NO 130 | AGGGCTATGCAGGGTGGAGG | AAG | chr19 | 55113301 | 55113320 | 55113317 | + |
| SEQ ID NO 131 | GGGCTATGCAGGGTGGAGGA | AGG | chr19 | 55113302 | 55113321 | 55113318 | + |
| SEQ ID NO 132 | GGAGGAAGGCCACCCTGTGC | TGG | chr19 | 55113316 | 55113335 | 55113332 | + |
| SEQ ID NO 133 | GAGGAAGGCCACCCTGTGCT | GGG | chr19 | 55113317 | 55113336 | 55113333 | + |
| SEQ ID NO 134 | AAGGCCACCCTGTGCTGGGA | CAG | chr19 | 55113321 | 55113340 | 55113337 | + |
| SEQ ID NO 135 | ACCCTGTGCTGGGACAGACT | CAG | chr19 | 55113327 | 55113346 | 55113343 | + |
| SEQ ID NO 136 | CCCTGTGCTGGGACAGACTC | AGG | chr19 | 55113328 | 55113347 | 55113344 | + |
| SEQ ID NO 137 | CCTGTGCTGGGACAGACTCA | GGG | chr19 | 55113329 | 55113348 | 55113345 | + |
| SEQ ID NO 138 | CTGTGCTGGGACAGACTCAG | GGG | chr19 | 55113330 | 55113349 | 55113346 | + |
| SEQ ID NO 139 | CTGGGACAGACTCAGGGGCC | TGG | chr19 | 55113335 | 55113354 | 55113351 | + |
| SEQ ID NO 140 | TGGGACAGACTCAGGGGCCT | GGG | chr19 | 55113336 | 55113355 | 55113352 | + |
| SEQ ID NO 141 | GACAGACTCAGGGGCCTGGG | CGG | chr19 | 55113339 | 55113358 | 55113355 | + |
| SEQ ID NO 142 | ACAGACTCAGGGGCCTGGGC | GGG | chr19 | 55113340 | 55113359 | 55113356 | + |
| SEQ ID NO 143 | AGGGGCCTGGGCGGGACTCC | CAG | chr19 | 55113348 | 55113367 | 55113364 | + |
| SEQ ID NO 144 | GGGCCTGGGCGGGACTCCCA | GAG | chr19 | 55113350 | 55113369 | 55113366 | + |
| SEQ ID NO 145 | GGCCTGGGCGGGACTCCCAG | AGG | chr19 | 55113351 | 55113370 | 55113367 | + |
| SEQ ID NO 146 | GCCTGGGCGGGACTCCCAGA | GGG | chr19 | 55113352 | 55113371 | 55113368 | + |

Figure 1 (Cont'd)

| SEQ ID NO 147 | CCTGGGCGGGACTCCCAGAG | GGG | chr19 | 55113353 | 55113372 | 55113369 | + |
| SEQ ID NO 148 | GGCGGGACTCCCAGAGGGGT | GAG | chr19 | 55113357 | 55113376 | 55113373 | + |
| SEQ ID NO 149 | GGACTCCCAGAGGGGTGAGA | CAG | chr19 | 55113361 | 55113380 | 55113377 | + |
| SEQ ID NO 150 | CAGCTGCACACCTGTGTGCC | TGG | chr19 | 55113381 | 55113400 | 55113397 | + |
| SEQ ID NO 151 | AGCTGCACACCTGTGTGCCT | GGG | chr19 | 55113382 | 55113401 | 55113398 | + |
| SEQ ID NO 152 | ACACCTGTGTGCCTGGGCCC | CAG | chr19 | 55113388 | 55113407 | 55113404 | + |
| SEQ ID NO 153 | CACCTGTGTGCCTGGGCCCC | AGG | chr19 | 55113389 | 55113408 | 55113405 | + |
| SEQ ID NO 154 | GGCCCCAGGCTGTCACACTC | CAG | chr19 | 55113403 | 55113422 | 55113419 | + |
| SEQ ID NO 155 | CTGTCACACTCCAGTTCACT | GAG | chr19 | 55113412 | 55113431 | 55113428 | + |
| SEQ ID NO 156 | TGTCACACTCCAGTTCACTG | AGG | chr19 | 55113413 | 55113432 | 55113429 | + |
| SEQ ID NO 157 | TCACTGAGGCCCCTCTGCA | CGG | chr19 | 55113427 | 55113446 | 55113443 | + |
| SEQ ID NO 158 | CACTGAGGCCCCTCTGCAC | GGG | chr19 | 55113428 | 55113447 | 55113444 | + |
| SEQ ID NO 159 | ACTGAGGCCCCTCTGCACG | GGG | chr19 | 55113429 | 55113448 | 55113445 | + |
| SEQ ID NO 160 | CCCCTCTGCACGGGGCCCTG | CAG | chr19 | 55113437 | 55113456 | 55113453 | + |
| SEQ ID NO 161 | TCTGCACGGGGCCCTGCAGC | CAG | chr19 | 55113441 | 55113460 | 55113457 | + |
| SEQ ID NO 162 | CTGCACGGGGCCCTGCAGCC | AGG | chr19 | 55113442 | 55113461 | 55113458 | + |
| SEQ ID NO 163 | TGCACGGGGCCCTGCAGCCA | GGG | chr19 | 55113443 | 55113462 | 55113459 | + |
| SEQ ID NO 164 | GCACGGGGCCCTGCAGCCAG | GGG | chr19 | 55113444 | 55113463 | 55113460 | + |
| SEQ ID NO 165 | CCTGCAGCCAGGGGCTGACA | CGG | chr19 | 55113453 | 55113472 | 55113469 | + |
| SEQ ID NO 166 | CTGCAGCCAGGGGCTGACAC | GGG | chr19 | 55113454 | 55113473 | 55113470 | + |
| SEQ ID NO 167 | ACCGTTTCTCATTCTTCCCT | TAG | chr19 | 55113479 | 55113498 | 55113495 | + |
| SEQ ID NO 168 | CCGTTTCTCATTCTTCCCTT | AGG | chr19 | 55113480 | 55113499 | 55113496 | + |
| SEQ ID NO 169 | CGTTTCTCATTCTTCCCTTA | GGG | chr19 | 55113481 | 55113500 | 55113497 | + |
| SEQ ID NO 170 | GTTTCTCATTCTTCCCTTAG | GGG | chr19 | 55113482 | 55113501 | 55113498 | + |
| SEQ ID NO 171 | TCCCTTAGGGGTCCAAAACT | TGG | chr19 | 55113494 | 55113513 | 55113510 | + |
| SEQ ID NO 172 | CCCTTAGGGGTCCAAAACTT | GGG | chr19 | 55113495 | 55113514 | 55113511 | + |
| SEQ ID NO 173 | CCTTAGGGGTCCAAAACTTG | GGG | chr19 | 55113496 | 55113515 | 55113512 | + |
| SEQ ID NO 174 | CTTAGGGGTCCAAAACTTGG | GGG | chr19 | 55113497 | 55113516 | 55113513 | + |
| SEQ ID NO 175 | TTAGGGGTCCAAAACTTGGG | GGG | chr19 | 55113498 | 55113517 | 55113514 | + |
| SEQ ID NO 176 | TCCAAAACTTGGGGGGACAA | AAG | chr19 | 55113505 | 55113524 | 55113521 | + |
| SEQ ID NO 177 | ACTTGGGGGGACAAAAGCCG | AAG | chr19 | 55113511 | 55113530 | 55113527 | + |
| SEQ ID NO 178 | GGGGGACAAAAGCCGAAGTC | CAG | chr19 | 55113516 | 55113535 | 55113532 | + |
| SEQ ID NO 179 | GGGGACAAAAGCCGAAGTCC | AGG | chr19 | 55113517 | 55113536 | 55113533 | + |
| SEQ ID NO 180 | GGGACAAAAGCCGAAGTCCA | GGG | chr19 | 55113518 | 55113537 | 55113534 | + |
| SEQ ID NO 181 | GGACAAAAGCCGAAGTCCAG | GGG | chr19 | 55113519 | 55113538 | 55113535 | + |
| SEQ ID NO 182 | GACAAAAGCCGAAGTCCAGG | GGG | chr19 | 55113520 | 55113539 | 55113536 | + |
| SEQ ID NO 183 | AAAGCCGAAGTCCAGGGGGT | CGG | chr19 | 55113524 | 55113543 | 55113540 | + |
| SEQ ID NO 184 | AGCCGAAGTCCAGGGGGTCG | GAG | chr19 | 55113526 | 55113545 | 55113542 | + |
| SEQ ID NO 185 | GCCGAAGTCCAGGGGGTCGG | AGG | chr19 | 55113527 | 55113546 | 55113543 | + |
| SEQ ID NO 186 | CGAAGTCCAGGGGGTCGGAG | GAG | chr19 | 55113529 | 55113548 | 55113545 | + |
| SEQ ID NO 187 | GAAGTCCAGGGGGTCGGAGG | AGG | chr19 | 55113530 | 55113549 | 55113546 | + |
| SEQ ID NO 188 | AAGTCCAGGGGGTCGGAGGA | GGG | chr19 | 55113531 | 55113550 | 55113547 | + |
| SEQ ID NO 189 | GTCGGAGGAGGGACTTGCCC | CAG | chr19 | 55113542 | 55113561 | 55113558 | + |
| SEQ ID NO 190 | TCGGAGGAGGGACTTGCCCC | AGG | chr19 | 55113543 | 55113562 | 55113559 | + |
| SEQ ID NO 191 | GGGACTTGCCCCAGGCCTTG | TGG | chr19 | 55113551 | 55113570 | 55113567 | + |
| SEQ ID NO 192 | GCCCCAGGCCTTGTGGACAC | TGG | chr19 | 55113558 | 55113577 | 55113574 | + |
| SEQ ID NO 193 | CCCCAGGCCTTGTGGACACT | GGG | chr19 | 55113559 | 55113578 | 55113575 | + |
| SEQ ID NO 194 | CAGGCCTTGTGGACACTGGG | TGG | chr19 | 55113562 | 55113581 | 55113578 | + |
| SEQ ID NO 195 | AGGCCTTGTGGACACTGGGT | GGG | chr19 | 55113563 | 55113582 | 55113579 | + |

Figure 1 (Cont'd)

| | | | | | | | |
|---|---|---|---|---|---|---|---|
| SEQ ID NO 196 | TGTGGACACTGGGTGGGCTC | CGG | chr19 | 55113569 | 55113588 | 55113585 | + |
| SEQ ID NO 197 | GTGGACACTGGGTGGGCTCC | GGG | chr19 | 55113570 | 55113589 | 55113586 | + |
| SEQ ID NO 198 | GTGGGCTCCGGGACCTGAAC | TGG | chr19 | 55113581 | 55113600 | 55113597 | + |
| SEQ ID NO 199 | GGGCTCCGGGACCTGAACTG | GAG | chr19 | 55113583 | 55113602 | 55113599 | + |
| SEQ ID NO 200 | CCGGGACCTGAACTGGAGCT | GAG | chr19 | 55113588 | 55113607 | 55113604 | + |
| SEQ ID NO 201 | CGGGACCTGAACTGGAGCTG | AGG | chr19 | 55113589 | 55113608 | 55113605 | + |
| SEQ ID NO 202 | GACCTGAACTGGAGCTGAGG | AAG | chr19 | 55113592 | 55113611 | 55113608 | + |
| SEQ ID NO 203 | ACCTGAACTGGAGCTGAGGA | AGG | chr19 | 55113593 | 55113612 | 55113609 | + |
| SEQ ID NO 204 | CTGAACTGGAGCTGAGGAAG | GAG | chr19 | 55113595 | 55113614 | 55113611 | + |
| SEQ ID NO 205 | CTGGAGCTGAGGAAGGAGTG | AAG | chr19 | 55113600 | 55113619 | 55113616 | + |
| SEQ ID NO 206 | AAGGAGTGAAGCTAAACTCC | TAG | chr19 | 55113612 | 55113631 | 55113628 | + |
| SEQ ID NO 207 | AAGCTAAACTCCTAGATCCA | CGG | chr19 | 55113620 | 55113639 | 55113636 | + |
| SEQ ID NO 208 | AGCTAAACTCCTAGATCCAC | GGG | chr19 | 55113621 | 55113640 | 55113637 | + |
| SEQ ID NO 209 | CACGGGATAAATTACCCCCC | AAG | chr19 | 55113638 | 55113657 | 55113654 | + |
| SEQ ID NO 210 | CCAAGTCCCTCACCTCTCCA | AAG | chr19 | 55113656 | 55113675 | 55113672 | + |
| SEQ ID NO 211 | CCTCTCCAAAGCTGCCCATC | TGG | chr19 | 55113668 | 55113687 | 55113684 | + |
| SEQ ID NO 212 | TCTCCAAAGCTGCCCATCTG | GAG | chr19 | 55113670 | 55113689 | 55113686 | + |
| SEQ ID NO 213 | CTCCAAAGCTGCCCATCTGG | AGG | chr19 | 55113671 | 55113690 | 55113687 | + |
| SEQ ID NO 214 | CCAAAGCTGCCCATCTGGAG | GAG | chr19 | 55113673 | 55113692 | 55113689 | + |
| SEQ ID NO 215 | CAAAGCTGCCCATCTGGAGG | AGG | chr19 | 55113674 | 55113693 | 55113690 | + |
| SEQ ID NO 216 | AGCTGCCCATCTGGAGGAGG | CGG | chr19 | 55113677 | 55113696 | 55113693 | + |
| SEQ ID NO 217 | GCTGCCCATCTGGAGGAGGC | GGG | chr19 | 55113678 | 55113697 | 55113694 | + |
| SEQ ID NO 218 | TGCCCATCTGGAGGAGGCGG | GAG | chr19 | 55113680 | 55113699 | 55113696 | + |
| SEQ ID NO 219 | GCCCATCTGGAGGAGGCGGG | AGG | chr19 | 55113681 | 55113700 | 55113697 | + |
| SEQ ID NO 220 | CCCATCTGGAGGAGGCGGGA | GGG | chr19 | 55113682 | 55113701 | 55113698 | + |
| SEQ ID NO 221 | CATCTGGAGGAGGCGGGAGG | GAG | chr19 | 55113684 | 55113703 | 55113700 | + |
| SEQ ID NO 222 | AGGAGGCGGGAGGGAGCTAC | GAG | chr19 | 55113691 | 55113710 | 55113707 | + |
| SEQ ID NO 223 | GGAGGCGGGAGGGAGCTACG | AGG | chr19 | 55113692 | 55113711 | 55113708 | + |
| SEQ ID NO 224 | GAGGCGGGAGGGAGCTACGA | GGG | chr19 | 55113693 | 55113712 | 55113709 | + |
| SEQ ID NO 225 | GGGAGGGAGCTACGAGGGCC | AAG | chr19 | 55113698 | 55113717 | 55113714 | + |
| SEQ ID NO 226 | GAGGGAGCTACGAGGGCCAA | GAG | chr19 | 55113700 | 55113719 | 55113716 | + |
| SEQ ID NO 227 | GCTACGAGGGCCAAGAGCAT | GAG | chr19 | 55113706 | 55113725 | 55113722 | + |
| SEQ ID NO 228 | CTACGAGGGCCAAGAGCATG | AGG | chr19 | 55113707 | 55113726 | 55113723 | + |
| SEQ ID NO 229 | GGGCCAAGAGCATGAGGTCA | TGG | chr19 | 55113713 | 55113732 | 55113729 | + |
| SEQ ID NO 230 | AGCATGAGGTCATGGAAACT | CGG | chr19 | 55113721 | 55113740 | 55113737 | + |
| SEQ ID NO 231 | GCATGAGGTCATGGAAACTC | GGG | chr19 | 55113722 | 55113741 | 55113738 | + |
| SEQ ID NO 232 | TCATGGAAACTCGGGCTGTG | AAG | chr19 | 55113730 | 55113749 | 55113746 | + |
| SEQ ID NO 233 | CATGGAAACTCGGGCTGTGA | AGG | chr19 | 55113731 | 55113750 | 55113747 | + |
| SEQ ID NO 234 | ATGGAAACTCGGGCTGTGAA | GGG | chr19 | 55113732 | 55113751 | 55113748 | + |
| SEQ ID NO 235 | TGGAAACTCGGGCTGTGAAG | GGG | chr19 | 55113733 | 55113752 | 55113749 | + |
| SEQ ID NO 236 | TGAAGGGGCCGCACGTGCCC | TGG | chr19 | 55113748 | 55113767 | 55113764 | + |
| SEQ ID NO 237 | GAAGGGGCCGCACGTGCCCT | GGG | chr19 | 55113749 | 55113768 | 55113765 | + |
| SEQ ID NO 238 | GGCCGCACGTGCCCTGGGAA | CGG | chr19 | 55113754 | 55113773 | 55113770 | + |
| SEQ ID NO 239 | GCCGCACGTGCCCTGGGAAC | GGG | chr19 | 55113755 | 55113774 | 55113771 | + |
| SEQ ID NO 240 | CCCTGGGAACGGGATGAACT | CGG | chr19 | 55113765 | 55113784 | 55113781 | + |
| SEQ ID NO 241 | TCGGCTCGTTTATTTCCACC | CAG | chr19 | 55113784 | 55113803 | 55113800 | + |
| SEQ ID NO 242 | TTATTTCCACCCAGTTGTCA | TGG | chr19 | 55113793 | 55113812 | 55113809 | + |
| SEQ ID NO 243 | CCACCCAGTTGTCATGGCGA | TAG | chr19 | 55113799 | 55113818 | 55113815 | + |
| SEQ ID NO 244 | CACCCAGTTGTCATGGCGAT | AGG | chr19 | 55113800 | 55113819 | 55113816 | + |

Figure 1 (Cont'd)

| | | | | | | | |
|---|---|---|---|---|---|---|---|
| SEQ ID NO 245 | ACCCAGTTGTCATGGCGATA | GGG | chr19 | 55113801 | 55113820 | 55113817 | + |
| SEQ ID NO 246 | CCCAGTTGTCATGGCGATAG | GGG | chr19 | 55113802 | 55113821 | 55113818 | + |
| SEQ ID NO 247 | CAGTTGTCATGGCGATAGGG | GAG | chr19 | 55113804 | 55113823 | 55113820 | + |
| SEQ ID NO 248 | AGTTGTCATGGCGATAGGGG | AGG | chr19 | 55113805 | 55113824 | 55113821 | + |
| SEQ ID NO 249 | GTTGTCATGGCGATAGGGGA | GGG | chr19 | 55113806 | 55113825 | 55113822 | + |
| SEQ ID NO 250 | TTGTCATGGCGATAGGGGAG | GGG | chr19 | 55113807 | 55113826 | 55113823 | + |
| SEQ ID NO 251 | TGTCATGGCGATAGGGGAGG | GGG | chr19 | 55113808 | 55113827 | 55113824 | + |
| SEQ ID NO 252 | GTCATGGCGATAGGGGAGGG | GGG | chr19 | 55113809 | 55113828 | 55113825 | + |
| SEQ ID NO 253 | TGGCGATAGGGGAGGGGGGC | AAG | chr19 | 55113813 | 55113832 | 55113829 | + |
| SEQ ID NO 254 | GGCGATAGGGGAGGGGGGCA | AGG | chr19 | 55113814 | 55113833 | 55113830 | + |
| SEQ ID NO 255 | CGATAGGGGAGGGGGGCAAG | GAG | chr19 | 55113816 | 55113835 | 55113832 | + |
| SEQ ID NO 256 | ATAGGGGAGGGGGGCAAGGA | GAG | chr19 | 55113818 | 55113837 | 55113834 | + |
| SEQ ID NO 257 | GAGGGGGGCAAGGAGAGCAA | TGG | chr19 | 55113824 | 55113843 | 55113840 | + |
| SEQ ID NO 258 | AGGGGGGCAAGGAGAGCAAT | GGG | chr19 | 55113825 | 55113844 | 55113841 | + |
| SEQ ID NO 259 | GCAATGGGCCTTTCCCTTTC | AAG | chr19 | 55113840 | 55113859 | 55113856 | + |
| SEQ ID NO 260 | CAATGGGCCTTTCCCTTTCA | AGG | chr19 | 55113841 | 55113860 | 55113857 | + |
| SEQ ID NO 261 | TTCCCTTTCAAGGACCTGCC | CAG | chr19 | 55113851 | 55113870 | 55113867 | + |
| SEQ ID NO 262 | TTTCAAGGACCTGCCCAGTA | CAG | chr19 | 55113856 | 55113875 | 55113872 | + |
| SEQ ID NO 263 | TTCAAGGACCTGCCCAGTAC | AGG | chr19 | 55113857 | 55113876 | 55113873 | + |
| SEQ ID NO 264 | CAGTACAGGCATCCCTGTGA | AAG | chr19 | 55113871 | 55113890 | 55113887 | + |
| SEQ ID NO 265 | CATCCCTGTGAAAGATGCCT | GAG | chr19 | 55113880 | 55113899 | 55113896 | + |
| SEQ ID NO 266 | ATCCCTGTGAAAGATGCCTG | AGG | chr19 | 55113881 | 55113900 | 55113897 | + |
| SEQ ID NO 267 | TGTGAAAGATGCCTGAGGCC | TGG | chr19 | 55113886 | 55113905 | 55113902 | + |
| SEQ ID NO 268 | GTGAAAGATGCCTGAGGCCT | GGG | chr19 | 55113887 | 55113906 | 55113903 | + |
| SEQ ID NO 269 | GATGCCTGAGGCCTGGGCAC | CAG | chr19 | 55113893 | 55113912 | 55113909 | + |
| SEQ ID NO 270 | ATGCCTGAGGCCTGGGCACC | AGG | chr19 | 55113894 | 55113913 | 55113910 | + |
| SEQ ID NO 271 | TGCCTGAGGCCTGGGCACCA | GGG | chr19 | 55113895 | 55113914 | 55113911 | + |
| SEQ ID NO 272 | GGCCTGGGCACCAGGGACTC | CAG | chr19 | 55113902 | 55113921 | 55113918 | + |
| SEQ ID NO 273 | CCTGGGCACCAGGGACTCCA | GAG | chr19 | 55113904 | 55113923 | 55113920 | + |
| SEQ ID NO 274 | GCACCAGGGACTCCAGAGTC | CAG | chr19 | 55113909 | 55113928 | 55113925 | + |
| SEQ ID NO 275 | CACCAGGGACTCCAGAGTCC | AGG | chr19 | 55113910 | 55113929 | 55113926 | + |
| SEQ ID NO 276 | CAACCCCTCCCCATTCAACC | CAG | chr19 | 55113935 | 55113954 | 55113951 | + |
| SEQ ID NO 277 | AACCCCTCCCCATTCAACCC | AGG | chr19 | 55113936 | 55113955 | 55113952 | + |
| SEQ ID NO 278 | CCCCTCCCCATTCAACCCAG | GAG | chr19 | 55113938 | 55113957 | 55113954 | + |
| SEQ ID NO 279 | CCCTCCCCATTCAACCCAGG | AGG | chr19 | 55113939 | 55113958 | 55113955 | + |
| SEQ ID NO 280 | CCCCATTCAACCCAGGAGGC | CAG | chr19 | 55113943 | 55113962 | 55113959 | + |
| SEQ ID NO 281 | CCCATTCAACCCAGGAGGCC | AGG | chr19 | 55113944 | 55113963 | 55113960 | + |
| SEQ ID NO 282 | CAACCCAGGAGGCCAGGCCC | CAG | chr19 | 55113950 | 55113969 | 55113966 | + |
| SEQ ID NO 283 | GGCCCCAGCCCTTCCGCCCT | CAG | chr19 | 55113965 | 55113984 | 55113981 | + |
| SEQ ID NO 284 | AGCCCTTCCGCCCTCAGATG | AAG | chr19 | 55113971 | 55113990 | 55113987 | + |
| SEQ ID NO 285 | GCCCTTCCGCCCTCAGATGA | AGG | chr19 | 55113972 | 55113991 | 55113988 | + |
| SEQ ID NO 286 | CCTTCCGCCCTCAGATGAAG | GAG | chr19 | 55113974 | 55113993 | 55113990 | + |
| SEQ ID NO 287 | CGCCCTCAGATGAAGGAGTC | CAG | chr19 | 55113979 | 55113998 | 55113995 | + |
| SEQ ID NO 288 | GCCCTCAGATGAAGGAGTCC | AGG | chr19 | 55113980 | 55113999 | 55113996 | + |
| SEQ ID NO 289 | GATGAAGGAGTCCAGGCCCC | CAG | chr19 | 55113987 | 55114006 | 55114003 | + |
| SEQ ID NO 290 | GCCCCAGCCTCTCCCCATT | CAG | chr19 | 55114002 | 55114021 | 55114018 | + |
| SEQ ID NO 291 | AGCCTCTCCCCATTCAGACC | CAG | chr19 | 55114008 | 55114027 | 55114024 | + |
| SEQ ID NO 292 | GCCTCTCCCCATTCAGACCC | AGG | chr19 | 55114009 | 55114028 | 55114025 | + |
| SEQ ID NO 293 | CCTCTCCCCATTCAGACCCA | GGG | chr19 | 55114010 | 55114029 | 55114026 | + |

Figure 1 (Cont'd)

| SEQ ID NO 294 | CTCTCCCCATTCAGACCCAG | GGG | chr19 | 55114011 | 55114030 | 55114027 | + |
| SEQ ID NO 295 | CCCATTCAGACCCAGGGGT | CAG | chr19 | 55114016 | 55114035 | 55114032 | + |
| SEQ ID NO 296 | CCATTCAGACCCAGGGGTCC | AGG | chr19 | 55114017 | 55114036 | 55114033 | + |
| SEQ ID NO 297 | CAGACCCAGGGGTCCAGGCC | CAG | chr19 | 55114022 | 55114041 | 55114038 | + |
| SEQ ID NO 298 | AGGCCCAGCCCCGCCTCCCT | AAG | chr19 | 55114037 | 55114056 | 55114053 | + |
| SEQ ID NO 299 | AGCCCCGCCTCCCTAAGACC | CAG | chr19 | 55114043 | 55114062 | 55114059 | + |
| SEQ ID NO 300 | CCCGCCTCCCTAAGACCCAG | AAG | chr19 | 55114046 | 55114065 | 55114062 | + |
| SEQ ID NO 301 | CTCCCTAAGACCCAGAAGTC | CAG | chr19 | 55114051 | 55114070 | 55114067 | + |
| SEQ ID NO 302 | TCCCTAAGACCCAGAAGTCC | AGG | chr19 | 55114052 | 55114071 | 55114068 | + |
| SEQ ID NO 303 | GACCCAGAAGTCCAGGCCCC | CAG | chr19 | 55114059 | 55114078 | 55114075 | + |
| SEQ ID NO 304 | GCCCCAGCCCCTCCTCCCT | CAG | chr19 | 55114074 | 55114093 | 55114090 | + |
| SEQ ID NO 305 | CCCTCCTCCCTCAGACCCAC | GAG | chr19 | 55114083 | 55114102 | 55114099 | + |
| SEQ ID NO 306 | CTCCCTCAGACCCACGAGTC | CAG | chr19 | 55114088 | 55114107 | 55114104 | + |
| SEQ ID NO 307 | TCCCTCAGACCCACGAGTCC | AGG | chr19 | 55114089 | 55114108 | 55114105 | + |
| SEQ ID NO 308 | AGACCCACGAGTCCAGGCCC | CAG | chr19 | 55114095 | 55114114 | 55114111 | + |
| SEQ ID NO 309 | GGCCCCAGCCCCTCCTCCCT | CGG | chr19 | 55114110 | 55114129 | 55114126 | + |
| SEQ ID NO 310 | AGCCCCTCCTCCCTCGGACC | CAG | chr19 | 55114116 | 55114135 | 55114132 | + |
| SEQ ID NO 311 | GCCCCTCCTCCCTCGGACCC | AGG | chr19 | 55114117 | 55114136 | 55114133 | + |
| SEQ ID NO 312 | CCCTCCTCCCTCGGACCCAG | GAG | chr19 | 55114119 | 55114138 | 55114135 | + |
| SEQ ID NO 313 | CTCCCTCGGACCCAGGAGTC | CAG | chr19 | 55114124 | 55114143 | 55114140 | + |
| SEQ ID NO 314 | TCCCTCGGACCCAGGAGTCC | AGG | chr19 | 55114125 | 55114144 | 55114141 | + |
| SEQ ID NO 315 | GACCCAGGAGTCCAGGCCCC | CAG | chr19 | 55114132 | 55114151 | 55114148 | + |
| SEQ ID NO 316 | GCCCCAGTCCCTCCACCCT | CAG | chr19 | 55114147 | 55114166 | 55114163 | + |
| SEQ ID NO 317 | AGTCCCTCCACCCTCAGACC | CAG | chr19 | 55114153 | 55114172 | 55114169 | + |
| SEQ ID NO 318 | GTCCCTCCACCCTCAGACCC | AGG | chr19 | 55114154 | 55114173 | 55114170 | + |
| SEQ ID NO 319 | CCCTCCACCCTCAGACCCAG | GAG | chr19 | 55114156 | 55114175 | 55114172 | + |
| SEQ ID NO 320 | CACCCTCAGACCCAGGAGTC | CAG | chr19 | 55114161 | 55114180 | 55114177 | + |
| SEQ ID NO 321 | ACCCTCAGACCCAGGAGTCC | AGG | chr19 | 55114162 | 55114181 | 55114178 | + |
| SEQ ID NO 322 | AGACCCAGGAGTCCAGGCCC | CAG | chr19 | 55114168 | 55114187 | 55114184 | + |
| SEQ ID NO 323 | GGCCCCAGCCCCTCCTCCCT | CGG | chr19 | 55114183 | 55114202 | 55114199 | + |
| SEQ ID NO 324 | AGCCCCTCCTCCCTCGGACC | CAG | chr19 | 55114189 | 55114208 | 55114205 | + |
| SEQ ID NO 325 | GCCCCTCCTCCCTCGGACCC | AGG | chr19 | 55114190 | 55114209 | 55114206 | + |
| SEQ ID NO 326 | CCCTCCTCCCTCGGACCCAG | GAG | chr19 | 55114192 | 55114211 | 55114208 | + |
| SEQ ID NO 327 | CTCCCTCGGACCCAGGAGTC | CAG | chr19 | 55114197 | 55114216 | 55114213 | + |
| SEQ ID NO 328 | TCCCTCGGACCCAGGAGTCC | AGG | chr19 | 55114198 | 55114217 | 55114214 | + |
| SEQ ID NO 329 | GGACCCAGGAGTCCAGGCCC | CAG | chr19 | 55114204 | 55114223 | 55114220 | + |
| SEQ ID NO 330 | AGCCCCTCCTCTCTCAAACC | CAG | chr19 | 55114225 | 55114244 | 55114241 | + |
| SEQ ID NO 331 | GCCCCTCCTCTCTCAAACCC | AGG | chr19 | 55114226 | 55114245 | 55114242 | + |
| SEQ ID NO 332 | CCCTCCTCTCTCAAACCCAG | GAG | chr19 | 55114228 | 55114247 | 55114244 | + |
| SEQ ID NO 333 | CTCTCTCAAACCCAGGAGCC | CAG | chr19 | 55114233 | 55114252 | 55114249 | + |
| SEQ ID NO 334 | TCTCTCAAACCCAGGAGCCC | AGG | chr19 | 55114234 | 55114253 | 55114250 | + |
| SEQ ID NO 335 | AACCCAGGAGCCCAGGCCCC | CAG | chr19 | 55114241 | 55114260 | 55114257 | + |
| SEQ ID NO 336 | GCCCCAGCTCTTCTCTGTT | CAG | chr19 | 55114256 | 55114275 | 55114272 | + |
| SEQ ID NO 337 | GCTCTTCTCTGTTCAGCCCT | AAG | chr19 | 55114263 | 55114282 | 55114279 | + |
| SEQ ID NO 338 | CTGTTCAGCCCTAAGAATCC | TGG | chr19 | 55114271 | 55114290 | 55114287 | + |
| SEQ ID NO 339 | AGCCCTAAGAATCCTGGCTC | CAG | chr19 | 55114277 | 55114296 | 55114293 | + |
| SEQ ID NO 340 | GGCTCCAGCCCCTCCTACTC | TAG | chr19 | 55114292 | 55114311 | 55114308 | + |
| SEQ ID NO 341 | TACTCTAGCCCCAACCCCC | TAG | chr19 | 55114307 | 55114326 | 55114323 | + |
| SEQ ID NO 342 | CCCCCAACCCCCTAGCCACT | AAG | chr19 | 55114315 | 55114334 | 55114331 | + |

Figure 1 (Cont'd)

| SEQ ID NO 343 | CCCCAACCCCCTAGCCACTA | AGG | chr19 | 55114316 | 55114335 | 55114332 | + |
| SEQ ID NO 344 | CCCCTAGCCACTAAGGCAAT | TGG | chr19 | 55114323 | 55114342 | 55114339 | + |
| SEQ ID NO 345 | CCCTAGCCACTAAGGCAATT | GGG | chr19 | 55114324 | 55114343 | 55114340 | + |
| SEQ ID NO 346 | CCTAGCCACTAAGGCAATTG | GGG | chr19 | 55114325 | 55114344 | 55114341 | + |
| SEQ ID NO 347 | CCACTAAGGCAATTGGGGT | CAG | chr19 | 55114330 | 55114349 | 55114346 | + |
| SEQ ID NO 348 | CACTAAGGCAATTGGGGTGC | AGG | chr19 | 55114331 | 55114350 | 55114347 | + |
| SEQ ID NO 349 | AGGCAATTGGGGTGCAGGAA | TGG | chr19 | 55114336 | 55114355 | 55114352 | + |
| SEQ ID NO 350 | GGCAATTGGGGTGCAGGAAT | GGG | chr19 | 55114337 | 55114356 | 55114353 | + |
| SEQ ID NO 351 | GCAATTGGGGTGCAGGAATG | GGG | chr19 | 55114338 | 55114357 | 55114354 | + |
| SEQ ID NO 352 | CAATTGGGGTGCAGGAATGG | GGG | chr19 | 55114339 | 55114358 | 55114355 | + |
| SEQ ID NO 353 | TTGGGGTGCAGGAATGGGGG | CAG | chr19 | 55114342 | 55114361 | 55114358 | + |
| SEQ ID NO 354 | TGGGGTGCAGGAATGGGGGC | AGG | chr19 | 55114343 | 55114362 | 55114359 | + |
| SEQ ID NO 355 | GGGGTGCAGGAATGGGGGCA | GGG | chr19 | 55114344 | 55114363 | 55114360 | + |
| SEQ ID NO 356 | CAGGAATGGGGGCAGGGTAC | CAG | chr19 | 55114350 | 55114369 | 55114366 | + |
| SEQ ID NO 357 | GGCAGGGTACCAGCCTCACC | AAG | chr19 | 55114360 | 55114379 | 55114376 | + |
| SEQ ID NO 358 | AGGGTACCAGCCTCACCAAG | TGG | chr19 | 55114363 | 55114382 | 55114379 | + |
| SEQ ID NO 359 | AAGTGGTTGATAAACCCACG | TGG | chr19 | 55114380 | 55114399 | 55114396 | + |
| SEQ ID NO 360 | AGTGGTTGATAAACCCACGT | GGG | chr19 | 55114381 | 55114400 | 55114397 | + |
| SEQ ID NO 361 | GTGGTTGATAAACCCACGTG | GGG | chr19 | 55114382 | 55114401 | 55114398 | + |
| SEQ ID NO 362 | AAACCCACGTGGGGTACCCT | AAG | chr19 | 55114391 | 55114410 | 55114407 | + |
| SEQ ID NO 363 | CGTGGGGTACCCTAAGAACT | TGG | chr19 | 55114398 | 55114417 | 55114414 | + |
| SEQ ID NO 364 | GTGGGGTACCCTAAGAACTT | GGG | chr19 | 55114399 | 55114418 | 55114415 | + |
| SEQ ID NO 365 | GTACCCTAAGAACTTGGGAA | CAG | chr19 | 55114404 | 55114423 | 55114420 | + |
| SEQ ID NO 366 | TAAGAACTTGGGAACAGCCA | CAG | chr19 | 55114410 | 55114429 | 55114426 | + |
| SEQ ID NO 367 | GAACTTGGGAACAGCCACAG | CAG | chr19 | 55114413 | 55114432 | 55114429 | + |
| SEQ ID NO 368 | AACTTGGGAACAGCCACAGC | AGG | chr19 | 55114414 | 55114433 | 55114430 | + |
| SEQ ID NO 369 | ACTTGGGAACAGCCACAGCA | GGG | chr19 | 55114415 | 55114434 | 55114431 | + |
| SEQ ID NO 370 | CTTGGGAACAGCCACAGCAG | GGG | chr19 | 55114416 | 55114435 | 55114432 | + |
| SEQ ID NO 371 | TTGGGAACAGCCACAGCAGG | GGG | chr19 | 55114417 | 55114436 | 55114433 | + |
| SEQ ID NO 372 | TGGGAACAGCCACAGCAGGG | GGG | chr19 | 55114418 | 55114437 | 55114434 | + |
| SEQ ID NO 373 | CACAGCAGGGGGCGATGCT | TGG | chr19 | 55114428 | 55114447 | 55114444 | + |
| SEQ ID NO 374 | ACAGCAGGGGGCGATGCTT | GGG | chr19 | 55114429 | 55114448 | 55114445 | + |
| SEQ ID NO 375 | CAGCAGGGGGCGATGCTTG | GGG | chr19 | 55114430 | 55114449 | 55114446 | + |
| SEQ ID NO 376 | GCGATGCTTGGGGACCTGCC | TGG | chr19 | 55114440 | 55114459 | 55114456 | + |
| SEQ ID NO 377 | GATGCTTGGGGACCTGCCTG | GAG | chr19 | 55114442 | 55114461 | 55114458 | + |
| SEQ ID NO 378 | GCTTGGGGACCTGCCTGGAG | AAG | chr19 | 55114445 | 55114464 | 55114461 | + |
| SEQ ID NO 379 | CTTGGGGACCTGCCTGGAGA | AGG | chr19 | 55114446 | 55114465 | 55114462 | + |
| SEQ ID NO 380 | GACCTGCCTGGAGAAGGATG | CAG | chr19 | 55114452 | 55114471 | 55114468 | + |
| SEQ ID NO 381 | ACCTGCCTGGAGAAGGATGC | AGG | chr19 | 55114453 | 55114472 | 55114469 | + |
| SEQ ID NO 382 | CCTGGAGAAGGATGCAGGAC | GAG | chr19 | 55114458 | 55114477 | 55114474 | + |
| SEQ ID NO 383 | AGGATGCAGGACGAGAAACA | CAG | chr19 | 55114466 | 55114485 | 55114482 | + |
| SEQ ID NO 384 | CAGGACGAGAAACACAGCCC | CAG | chr19 | 55114472 | 55114491 | 55114488 | + |
| SEQ ID NO 385 | AGGACGAGAAACACAGCCCC | AGG | chr19 | 55114473 | 55114492 | 55114489 | + |
| SEQ ID NO 386 | ACGAGAAACACAGCCCCAGG | TGG | chr19 | 55114476 | 55114495 | 55114492 | + |
| SEQ ID NO 387 | GAGAAACACAGCCCCAGGTG | GAG | chr19 | 55114478 | 55114497 | 55114494 | + |
| SEQ ID NO 388 | ACAGCCCCAGGTGGAGAAAC | TGG | chr19 | 55114485 | 55114504 | 55114501 | + |
| SEQ ID NO 389 | CCCCAGGTGGAGAAACTGGC | CGG | chr19 | 55114489 | 55114508 | 55114505 | + |
| SEQ ID NO 390 | CCCAGGTGGAGAAACTGGCC | GGG | chr19 | 55114490 | 55114509 | 55114506 | + |
| SEQ ID NO 391 | GGAGAAACTGGCCGGGAATC | AAG | chr19 | 55114497 | 55114516 | 55114513 | + |

Figure 1 (Cont'd)

| | | | | | | | |
|---|---|---|---|---|---|---|---|
| SEQ ID NO 392 | AGAAACTGGCCGGGAATCAA | GAG | chr19 | 55114499 | 55114518 | 55114515 | + |
| SEQ ID NO 393 | GCCGGGAATCAAGAGTCACC | CAG | chr19 | 55114507 | 55114526 | 55114523 | + |
| SEQ ID NO 394 | CGGGAATCAAGAGTCACCCA | GAG | chr19 | 55114509 | 55114528 | 55114525 | + |
| SEQ ID NO 395 | AATCAAGAGTCACCCAGAGA | CAG | chr19 | 55114513 | 55114532 | 55114529 | + |
| SEQ ID NO 396 | ACCAACCATCCCTGTTTTCC | TAG | chr19 | 55114538 | 55114557 | 55114554 | + |
| SEQ ID NO 397 | CCAACCATCCCTGTTTTCCT | AGG | chr19 | 55114539 | 55114558 | 55114555 | + |
| SEQ ID NO 398 | ATCCCTGTTTTCCTAGGACT | GAG | chr19 | 55114545 | 55114564 | 55114561 | + |
| SEQ ID NO 399 | TCCCTGTTTTCCTAGGACTG | AGG | chr19 | 55114546 | 55114565 | 55114562 | + |
| SEQ ID NO 400 | CCCTGTTTTCCTAGGACTGA | GGG | chr19 | 55114547 | 55114566 | 55114563 | + |
| SEQ ID NO 401 | TTTCCTAGGACTGAGGGTTT | CAG | chr19 | 55114553 | 55114572 | 55114569 | + |
| SEQ ID NO 402 | GAGGGTTTCAGTGCTAAAAC | TAG | chr19 | 55114565 | 55114584 | 55114581 | + |
| SEQ ID NO 403 | AGGGTTTCAGTGCTAAAACT | AGG | chr19 | 55114566 | 55114585 | 55114582 | + |
| SEQ ID NO 404 | GTGCTAAAACTAGGCTGTCC | TGG | chr19 | 55114575 | 55114594 | 55114591 | + |
| SEQ ID NO 405 | TGCTAAAACTAGGCTGTCCT | GGG | chr19 | 55114576 | 55114595 | 55114592 | + |
| SEQ ID NO 406 | ACTAGGCTGTCCTGGGCAAA | CAG | chr19 | 55114583 | 55114602 | 55114599 | + |
| SEQ ID NO 407 | CTGTCCTGGGCAAACAGCAT | AAG | chr19 | 55114589 | 55114608 | 55114605 | + |
| SEQ ID NO 408 | CCTGGGCAAACAGCATAAGC | TGG | chr19 | 55114593 | 55114612 | 55114609 | + |
| SEQ ID NO 409 | TAAGCTGGTCACCCCACACC | CAG | chr19 | 55114608 | 55114627 | 55114624 | + |
| SEQ ID NO 410 | ACCCAGACCTGACCCAAACC | CAG | chr19 | 55114625 | 55114644 | 55114641 | + |
| SEQ ID NO 411 | AACCCAGCTCCCCTGCTTCT | TGG | chr19 | 55114641 | 55114660 | 55114657 | + |
| SEQ ID NO 412 | GCTTCTTGGCCACGTAACCT | GAG | chr19 | 55114655 | 55114674 | 55114671 | + |
| SEQ ID NO 413 | TCTTGGCCACGTAACCTGAG | AAG | chr19 | 55114658 | 55114677 | 55114674 | + |
| SEQ ID NO 414 | CTTGGCCACGTAACCTGAGA | AGG | chr19 | 55114659 | 55114678 | 55114675 | + |
| SEQ ID NO 415 | TTGGCCACGTAACCTGAGAA | GGG | chr19 | 55114660 | 55114679 | 55114676 | + |
| SEQ ID NO 416 | AATCCCTCCTCTCTGAACCC | CAG | chr19 | 55114683 | 55114702 | 55114699 | + |
| SEQ ID NO 417 | CCCAGCCCACCCCAATGCTC | CAG | chr19 | 55114701 | 55114720 | 55114717 | + |
| SEQ ID NO 418 | CCAGCCCACCCCAATGCTCC | AGG | chr19 | 55114702 | 55114721 | 55114718 | + |
| SEQ ID NO 419 | CCCCAATGCTCCAGGCCTCC | TGG | chr19 | 55114710 | 55114729 | 55114726 | + |
| SEQ ID NO 420 | CCCAATGCTCCAGGCCTCCT | GGG | chr19 | 55114711 | 55114730 | 55114727 | + |
| SEQ ID NO 421 | AGGCCTCCTGGGATACCCCG | AAG | chr19 | 55114722 | 55114741 | 55114738 | + |
| SEQ ID NO 422 | GCCTCCTGGGATACCCCGAA | GAG | chr19 | 55114724 | 55114743 | 55114740 | + |
| SEQ ID NO 423 | CCTGGGATACCCCGAAGAGT | GAG | chr19 | 55114728 | 55114747 | 55114744 | + |
| SEQ ID NO 424 | CCCCGAAGAGTGAGTTTGCC | AAG | chr19 | 55114737 | 55114756 | 55114753 | + |
| SEQ ID NO 425 | CGAAGAGTGAGTTTGCCAAG | CAG | chr19 | 55114740 | 55114759 | 55114756 | + |
| SEQ ID NO 426 | TTTGCCAAGCAGTCACCCCA | CAG | chr19 | 55114751 | 55114770 | 55114767 | + |
| SEQ ID NO 427 | CCAAGCAGTCACCCCACAGT | TGG | chr19 | 55114755 | 55114774 | 55114771 | + |
| SEQ ID NO 428 | AAGCAGTCACCCCACAGTTG | GAG | chr19 | 55114757 | 55114776 | 55114773 | + |
| SEQ ID NO 429 | AGCAGTCACCCCACAGTTGG | AGG | chr19 | 55114758 | 55114777 | 55114774 | + |
| SEQ ID NO 430 | CAGTCACCCCACAGTTGGAG | GAG | chr19 | 55114760 | 55114779 | 55114776 | + |
| SEQ ID NO 431 | TTGGAGGAGAATCCACCCAA | AAG | chr19 | 55114774 | 55114793 | 55114790 | + |
| SEQ ID NO 432 | TGGAGGAGAATCCACCCAAA | AGG | chr19 | 55114775 | 55114794 | 55114791 | + |
| SEQ ID NO 433 | AGGAGAATCCACCCAAAAGG | CAG | chr19 | 55114778 | 55114797 | 55114794 | + |
| SEQ ID NO 434 | AATCCACCCAAAAGGCAGCC | TGG | chr19 | 55114783 | 55114802 | 55114799 | + |
| SEQ ID NO 435 | CCACCCAAAAGGCAGCCTGG | TAG | chr19 | 55114786 | 55114805 | 55114802 | + |
| SEQ ID NO 436 | CCAAAAGGCAGCCTGGTAGA | CAG | chr19 | 55114790 | 55114809 | 55114806 | + |
| SEQ ID NO 437 | CAAAAGGCAGCCTGGTAGAC | AGG | chr19 | 55114791 | 55114810 | 55114807 | + |
| SEQ ID NO 438 | AAAAGGCAGCCTGGTAGACA | GGG | chr19 | 55114792 | 55114811 | 55114808 | + |
| SEQ ID NO 439 | GGCAGCCTGGTAGACAGGGC | TGG | chr19 | 55114796 | 55114815 | 55114812 | + |
| SEQ ID NO 440 | GCAGCCTGGTAGACAGGGCT | GGG | chr19 | 55114797 | 55114816 | 55114813 | + |

Figure 1 (Cont'd)

| | | | | | | | |
|---|---|---|---|---|---|---|---|
| SEQ ID NO 441 | CAGCCTGGTAGACAGGGCTG | GGG | chr19 | 55114798 | 55114817 | 55114814 | + |
| SEQ ID NO 442 | CCTGGTAGACAGGGCTGGGG | TGG | chr19 | 55114801 | 55114820 | 55114817 | + |
| SEQ ID NO 443 | AGGGCTGGGGTGGCCTCTCG | TGG | chr19 | 55114811 | 55114830 | 55114827 | + |
| SEQ ID NO 444 | GGGCTGGGGTGGCCTCTCGT | GGG | chr19 | 55114812 | 55114831 | 55114828 | + |
| SEQ ID NO 445 | GGCTGGGGTGGCCTCTCGTG | GGG | chr19 | 55114813 | 55114832 | 55114829 | + |
| SEQ ID NO 446 | GGGTGGCCTCTCGTGGGGTC | CAG | chr19 | 55114818 | 55114837 | 55114834 | + |
| SEQ ID NO 447 | GGTGGCCTCTCGTGGGGTCC | AGG | chr19 | 55114819 | 55114838 | 55114835 | + |
| SEQ ID NO 448 | CCTCTCGTGGGGTCCAGGCC | AAG | chr19 | 55114824 | 55114843 | 55114840 | + |
| SEQ ID NO 449 | CTCGTGGGGTCCAGGCCAAG | TAG | chr19 | 55114827 | 55114846 | 55114843 | + |
| SEQ ID NO 450 | TCGTGGGGTCCAGGCCAAGT | AGG | chr19 | 55114828 | 55114847 | 55114844 | + |
| SEQ ID NO 451 | TGGGGTCCAGGCCAAGTAGG | TGG | chr19 | 55114831 | 55114850 | 55114847 | + |
| SEQ ID NO 452 | TCCAGGCCAAGTAGGTGGCC | TGG | chr19 | 55114836 | 55114855 | 55114852 | + |
| SEQ ID NO 453 | CCAGGCCAAGTAGGTGGCCT | GGG | chr19 | 55114837 | 55114856 | 55114853 | + |
| SEQ ID NO 454 | CAGGCCAAGTAGGTGGCCTG | GGG | chr19 | 55114838 | 55114857 | 55114854 | + |
| SEQ ID NO 455 | AGTAGGTGGCCTGGGGCCTC | TGG | chr19 | 55114845 | 55114864 | 55114861 | + |
| SEQ ID NO 456 | GTAGGTGGCCTGGGGCCTCT | GGG | chr19 | 55114846 | 55114865 | 55114862 | + |
| SEQ ID NO 457 | TAGGTGGCCTGGGGCCTCTG | GGG | chr19 | 55114847 | 55114866 | 55114863 | + |
| SEQ ID NO 458 | AGGTGGCCTGGGGCCTCTGG | GGG | chr19 | 55114848 | 55114867 | 55114864 | + |
| SEQ ID NO 459 | CCTGGGGCCTCTGGGGGATG | CAG | chr19 | 55114854 | 55114873 | 55114870 | + |
| SEQ ID NO 460 | CTGGGGCCTCTGGGGGATGC | AGG | chr19 | 55114855 | 55114874 | 55114871 | + |
| SEQ ID NO 461 | TGGGGCCTCTGGGGGATGCA | GGG | chr19 | 55114856 | 55114875 | 55114872 | + |
| SEQ ID NO 462 | GGGGCCTCTGGGGGATGCAG | GGG | chr19 | 55114857 | 55114876 | 55114873 | + |
| SEQ ID NO 463 | GCCTCTGGGGGATGCAGGGG | AAG | chr19 | 55114860 | 55114879 | 55114876 | + |
| SEQ ID NO 464 | CCTCTGGGGGATGCAGGGGA | AGG | chr19 | 55114861 | 55114880 | 55114877 | + |
| SEQ ID NO 465 | CTCTGGGGGATGCAGGGGAA | GGG | chr19 | 55114862 | 55114881 | 55114878 | + |
| SEQ ID NO 466 | TCTGGGGGATGCAGGGGAAG | GGG | chr19 | 55114863 | 55114882 | 55114879 | + |
| SEQ ID NO 467 | CTGGGGGATGCAGGGGAAGG | GGG | chr19 | 55114864 | 55114883 | 55114880 | + |
| SEQ ID NO 468 | GATGCAGGGGAAGGGGGATG | CAG | chr19 | 55114870 | 55114889 | 55114886 | + |
| SEQ ID NO 469 | ATGCAGGGGAAGGGGGATGC | AGG | chr19 | 55114871 | 55114890 | 55114887 | + |
| SEQ ID NO 470 | TGCAGGGGAAGGGGGATGCA | GGG | chr19 | 55114872 | 55114891 | 55114888 | + |
| SEQ ID NO 471 | GCAGGGGAAGGGGGATGCAG | GGG | chr19 | 55114873 | 55114892 | 55114889 | + |
| SEQ ID NO 472 | GGAAGGGGGATGCAGGGGAA | CGG | chr19 | 55114878 | 55114897 | 55114894 | + |
| SEQ ID NO 473 | GAAGGGGGATGCAGGGGAAC | GGG | chr19 | 55114879 | 55114898 | 55114895 | + |
| SEQ ID NO 474 | AAGGGGGATGCAGGGGAACG | GGG | chr19 | 55114880 | 55114899 | 55114896 | + |
| SEQ ID NO 475 | GATGCAGGGGAACGGGGATG | CAG | chr19 | 55114886 | 55114905 | 55114902 | + |
| SEQ ID NO 476 | ATGCAGGGGAACGGGGATGC | AGG | chr19 | 55114887 | 55114906 | 55114903 | + |
| SEQ ID NO 477 | TGCAGGGGAACGGGGATGCA | GGG | chr19 | 55114888 | 55114907 | 55114904 | + |
| SEQ ID NO 478 | GCAGGGGAACGGGGATGCAG | GGG | chr19 | 55114889 | 55114908 | 55114905 | + |
| SEQ ID NO 479 | GGAACGGGGATGCAGGGGAA | CGG | chr19 | 55114894 | 55114913 | 55114910 | + |
| SEQ ID NO 480 | GAACGGGGATGCAGGGGAAC | GGG | chr19 | 55114895 | 55114914 | 55114911 | + |
| SEQ ID NO 481 | AACGGGGATGCAGGGGAACG | GGG | chr19 | 55114896 | 55114915 | 55114912 | + |
| SEQ ID NO 482 | GGATGCAGGGGAACGGGGCT | CAG | chr19 | 55114901 | 55114920 | 55114917 | + |
| SEQ ID NO 483 | GGGGAACGGGGCTCAGTCTG | AAG | chr19 | 55114908 | 55114927 | 55114924 | + |
| SEQ ID NO 484 | GGAACGGGGCTCAGTCTGAA | GAG | chr19 | 55114910 | 55114929 | 55114926 | + |
| SEQ ID NO 485 | ACGGGGCTCAGTCTGAAGAG | CAG | chr19 | 55114913 | 55114932 | 55114929 | + |
| SEQ ID NO 486 | GGGGCTCAGTCTGAAGAGCA | GAG | chr19 | 55114915 | 55114934 | 55114931 | + |
| SEQ ID NO 487 | CTCAGTCTGAAGAGCAGAGC | CAG | chr19 | 55114919 | 55114938 | 55114935 | + |
| SEQ ID NO 488 | TCAGTCTGAAGAGCAGAGCC | AGG | chr19 | 55114920 | 55114939 | 55114936 | + |
| SEQ ID NO 489 | AGCAGAGCCAGGAACCCCTG | TAG | chr19 | 55114931 | 55114950 | 55114947 | + |

Figure 1 (Cont'd)

| SEQ ID NO 490 | GCAGAGCCAGGAACCCCTGT | AGG | chr19 | 55114932 | 55114951 | 55114948 | + |
| --- | --- | --- | --- | --- | --- | --- | --- |
| SEQ ID NO 491 | CAGAGCCAGGAACCCCTGTA | GGG | chr19 | 55114933 | 55114952 | 55114949 | + |
| SEQ ID NO 492 | AGCCAGGAACCCCTGTAGGG | AAG | chr19 | 55114936 | 55114955 | 55114952 | + |
| SEQ ID NO 493 | GCCAGGAACCCCTGTAGGGA | AGG | chr19 | 55114937 | 55114956 | 55114953 | + |
| SEQ ID NO 494 | CCAGGAACCCCTGTAGGGAA | GGG | chr19 | 55114938 | 55114957 | 55114954 | + |
| SEQ ID NO 495 | CAGGAACCCCTGTAGGGAAG | GGG | chr19 | 55114939 | 55114958 | 55114955 | + |
| SEQ ID NO 496 | GAACCCCTGTAGGGAAGGGG | CAG | chr19 | 55114942 | 55114961 | 55114958 | + |
| SEQ ID NO 497 | AACCCCTGTAGGGAAGGGGC | AGG | chr19 | 55114943 | 55114962 | 55114959 | + |
| SEQ ID NO 498 | CCCCTGTAGGGAAGGGGCAG | GAG | chr19 | 55114945 | 55114964 | 55114961 | + |
| SEQ ID NO 499 | CCTGTAGGGAAGGGGCAGGA | GAG | chr19 | 55114947 | 55114966 | 55114963 | + |
| SEQ ID NO 500 | TAGGGAAGGGGCAGGAGAGC | CAG | chr19 | 55114951 | 55114970 | 55114967 | + |
| SEQ ID NO 501 | AGGGAAGGGGCAGGAGAGCC | AGG | chr19 | 55114952 | 55114971 | 55114968 | + |
| SEQ ID NO 502 | GGGAAGGGGCAGGAGAGCCA | GGG | chr19 | 55114953 | 55114972 | 55114969 | + |
| SEQ ID NO 503 | GGAAGGGGCAGGAGAGCCAG | GGG | chr19 | 55114954 | 55114973 | 55114970 | + |
| SEQ ID NO 504 | GGCAGGAGAGCCAGGGGCAT | GAG | chr19 | 55114960 | 55114979 | 55114976 | + |
| SEQ ID NO 505 | GGAGAGCCAGGGGCATGAGA | TGG | chr19 | 55114964 | 55114983 | 55114980 | + |
| SEQ ID NO 506 | GAGCCAGGGGCATGAGATGG | TGG | chr19 | 55114967 | 55114986 | 55114983 | + |
| SEQ ID NO 507 | AGGGGCATGAGATGGTGGAC | GAG | chr19 | 55114972 | 55114991 | 55114988 | + |
| SEQ ID NO 508 | GGGGCATGAGATGGTGGACG | AGG | chr19 | 55114973 | 55114992 | 55114989 | + |
| SEQ ID NO 509 | GCATGAGATGGTGGACGAGG | AAG | chr19 | 55114976 | 55114995 | 55114992 | + |
| SEQ ID NO 510 | CATGAGATGGTGGACGAGGA | AGG | chr19 | 55114977 | 55114996 | 55114993 | + |
| SEQ ID NO 511 | ATGAGATGGTGGACGAGGAA | GGG | chr19 | 55114978 | 55114997 | 55114994 | + |
| SEQ ID NO 512 | TGAGATGGTGGACGAGGAAG | GGG | chr19 | 55114979 | 55114998 | 55114995 | + |
| SEQ ID NO 513 | GAGATGGTGGACGAGGAAGG | GGG | chr19 | 55114980 | 55114999 | 55114996 | + |
| SEQ ID NO 514 | TGGTGGACGAGGAAGGGGGA | CAG | chr19 | 55114984 | 55115003 | 55115000 | + |
| SEQ ID NO 515 | GGTGGACGAGGAAGGGGGAC | AGG | chr19 | 55114985 | 55115004 | 55115001 | + |
| SEQ ID NO 516 | GTGGACGAGGAAGGGGGACA | GGG | chr19 | 55114986 | 55115005 | 55115002 | + |
| SEQ ID NO 517 | GACGAGGAAGGGGGACAGGG | AAG | chr19 | 55114989 | 55115008 | 55115005 | + |
| SEQ ID NO 518 | GAAGGGGGACAGGGAAGCCT | GAG | chr19 | 55114995 | 55115014 | 55115011 | + |
| SEQ ID NO 519 | GGAAGCCTGAGCGCCTCTCC | TGG | chr19 | 55115007 | 55115026 | 55115023 | + |
| SEQ ID NO 520 | GAAGCCTGAGCGCCTCTCCT | GGG | chr19 | 55115008 | 55115027 | 55115024 | + |
| SEQ ID NO 521 | GCGCCTCTCCTGGGCTTGCC | AAG | chr19 | 55115017 | 55115036 | 55115033 | + |
| SEQ ID NO 522 | CGCCTCTCCTGGGCTTGCCA | AGG | chr19 | 55115018 | 55115037 | 55115034 | + |
| SEQ ID NO 523 | GCTTGCCAAGGACTCAAACC | CAG | chr19 | 55115030 | 55115049 | 55115046 | + |
| SEQ ID NO 524 | TGCCAAGGACTCAAACCCAG | AAG | chr19 | 55115033 | 55115052 | 55115049 | + |
| SEQ ID NO 525 | AGGACTCAAACCCAGAAGCC | CAG | chr19 | 55115038 | 55115057 | 55115054 | + |
| SEQ ID NO 526 | GACTCAAACCCAGAAGCCCA | GAG | chr19 | 55115040 | 55115059 | 55115056 | + |
| SEQ ID NO 527 | TCAAACCCAGAAGCCCAGAG | CAG | chr19 | 55115043 | 55115062 | 55115059 | + |
| SEQ ID NO 528 | CAAACCCAGAAGCCCAGAGC | AGG | chr19 | 55115044 | 55115063 | 55115060 | + |
| SEQ ID NO 529 | AAACCCAGAAGCCCAGAGCA | GGG | chr19 | 55115045 | 55115064 | 55115061 | + |
| SEQ ID NO 530 | AGAAGCCCAGAGCAGGGCCT | TAG | chr19 | 55115051 | 55115070 | 55115067 | + |
| SEQ ID NO 531 | GAAGCCCAGAGCAGGGCCTT | AGG | chr19 | 55115052 | 55115071 | 55115068 | + |
| SEQ ID NO 532 | AAGCCCAGAGCAGGGCCTTA | GGG | chr19 | 55115053 | 55115072 | 55115069 | + |
| SEQ ID NO 533 | CCCAGAGCAGGGCCTTAGGG | AAG | chr19 | 55115056 | 55115075 | 55115072 | + |
| SEQ ID NO 534 | AGAGCAGGGCCTTAGGGAAG | CGG | chr19 | 55115059 | 55115078 | 55115075 | + |
| SEQ ID NO 535 | GAGCAGGGCCTTAGGGAAGC | GGG | chr19 | 55115060 | 55115079 | 55115076 | + |
| SEQ ID NO 536 | AGGGAAGCGGGACCCTGCTC | TGG | chr19 | 55115072 | 55115091 | 55115088 | + |
| SEQ ID NO 537 | GGGAAGCGGGACCCTGCTCT | GGG | chr19 | 55115073 | 55115092 | 55115089 | + |
| SEQ ID NO 538 | AAGCGGGACCCTGCTCTGGG | CGG | chr19 | 55115076 | 55115095 | 55115092 | + |

Figure 1 (Cont'd)

| | | | | | | | |
|---|---|---|---|---|---|---|---|
| SEQ ID NO 539 | GCGGGACCCTGCTCTGGGCG | GAG | chr19 | 55115078 | 55115097 | 55115094 | + |
| SEQ ID NO 540 | CGGGACCCTGCTCTGGGCGG | AGG | chr19 | 55115079 | 55115098 | 55115095 | + |
| SEQ ID NO 541 | CTGGGCGGAGGAATATGTCC | CAG | chr19 | 55115091 | 55115110 | 55115107 | + |
| SEQ ID NO 542 | GCGGAGGAATATGTCCCAGA | TAG | chr19 | 55115095 | 55115114 | 55115111 | + |
| SEQ ID NO 543 | GAATATGTCCCAGATAGCAC | TGG | chr19 | 55115101 | 55115120 | 55115117 | + |
| SEQ ID NO 544 | AATATGTCCCAGATAGCACT | GGG | chr19 | 55115102 | 55115121 | 55115118 | + |
| SEQ ID NO 545 | ATATGTCCCAGATAGCACTG | GGG | chr19 | 55115103 | 55115122 | 55115119 | + |
| SEQ ID NO 546 | GATAGCACTGGGGACTCTTT | AAG | chr19 | 55115113 | 55115132 | 55115129 | + |
| SEQ ID NO 547 | ATAGCACTGGGGACTCTTTA | AGG | chr19 | 55115114 | 55115133 | 55115130 | + |
| SEQ ID NO 548 | CACTGGGGACTCTTTAAGGA | AAG | chr19 | 55115118 | 55115137 | 55115134 | + |
| SEQ ID NO 549 | TGGGGACTCTTTAAGGAAAG | AAG | chr19 | 55115121 | 55115140 | 55115137 | + |
| SEQ ID NO 550 | GGGGACTCTTTAAGGAAAGA | AGG | chr19 | 55115122 | 55115141 | 55115138 | + |
| SEQ ID NO 551 | ACTCTTTAAGGAAAGAAGGA | TGG | chr19 | 55115126 | 55115145 | 55115142 | + |
| SEQ ID NO 552 | TCTTTAAGGAAAGAAGGATG | GAG | chr19 | 55115128 | 55115147 | 55115144 | + |
| SEQ ID NO 553 | TAAGGAAAGAAGGATGGAGA | AAG | chr19 | 55115132 | 55115151 | 55115148 | + |
| SEQ ID NO 554 | AGGAAAGAAGGATGGAGAAA | GAG | chr19 | 55115134 | 55115153 | 55115150 | + |
| SEQ ID NO 555 | AAGAAGGATGGAGAAAGAGA | AAG | chr19 | 55115138 | 55115157 | 55115154 | + |
| SEQ ID NO 556 | AGAAGGATGGAGAAAGAGAA | AGG | chr19 | 55115139 | 55115158 | 55115155 | + |
| SEQ ID NO 557 | GAAGGATGGAGAAAGAGAAA | GGG | chr19 | 55115140 | 55115159 | 55115156 | + |
| SEQ ID NO 558 | AGGATGGAGAAAGAGAAAGG | GAG | chr19 | 55115142 | 55115161 | 55115158 | + |
| SEQ ID NO 559 | ATGGAGAAAGAGAAAGGGAG | TAG | chr19 | 55115145 | 55115164 | 55115161 | + |
| SEQ ID NO 560 | GGAGAAAGAGAAAGGGAGTA | GAG | chr19 | 55115147 | 55115166 | 55115163 | + |
| SEQ ID NO 561 | GAGAAAGAGAAAGGGAGTAG | AGG | chr19 | 55115148 | 55115167 | 55115164 | + |
| SEQ ID NO 562 | AAAGAGAAAGGGAGTAGAGG | CGG | chr19 | 55115151 | 55115170 | 55115167 | + |
| SEQ ID NO 563 | GAGTAGAGGCGGCCACGACC | TGG | chr19 | 55115162 | 55115181 | 55115178 | + |
| SEQ ID NO 564 | GCCACGACCTGGTGAACACC | TAG | chr19 | 55115173 | 55115192 | 55115189 | + |
| SEQ ID NO 565 | CCACGACCTGGTGAACACCT | AGG | chr19 | 55115174 | 55115193 | 55115190 | + |
| SEQ ID NO 566 | TAGGACGCACCATTCTCACA | AAG | chr19 | 55115193 | 55115212 | 55115209 | + |
| SEQ ID NO 567 | AGGACGCACCATTCTCACAA | AGG | chr19 | 55115194 | 55115213 | 55115210 | + |
| SEQ ID NO 568 | GGACGCACCATTCTCACAAA | GGG | chr19 | 55115195 | 55115214 | 55115211 | + |
| SEQ ID NO 569 | ACGCACCATTCTCACAAAGG | GAG | chr19 | 55115197 | 55115216 | 55115213 | + |
| SEQ ID NO 570 | CACAAAGGGAGTTTTCCACA | CGG | chr19 | 55115209 | 55115228 | 55115225 | + |
| SEQ ID NO 571 | GGACACCCCCTCCTCACCA | CAG | chr19 | 55115230 | 55115249 | 55115246 | + |
| SEQ ID NO 572 | CCTCCTCACCACAGCCCTGC | CAG | chr19 | 55115239 | 55115258 | 55115255 | + |
| SEQ ID NO 573 | CTCCTCACCACAGCCCTGCC | AGG | chr19 | 55115240 | 55115259 | 55115256 | + |
| SEQ ID NO 574 | TCACCACAGCCCTGCCAGGA | CGG | chr19 | 55115244 | 55115263 | 55115260 | + |
| SEQ ID NO 575 | CACCACAGCCCTGCCAGGAC | GGG | chr19 | 55115245 | 55115264 | 55115261 | + |
| SEQ ID NO 576 | ACCACAGCCCTGCCAGGACG | GGG | chr19 | 55115246 | 55115265 | 55115262 | + |
| SEQ ID NO 577 | CAGCCCTGCCAGGACGGGGC | TGG | chr19 | 55115250 | 55115269 | 55115266 | + |
| SEQ ID NO 578 | GCCAGGACGGGGCTGGCTAC | TGG | chr19 | 55115257 | 55115276 | 55115273 | + |
| SEQ ID NO 579 | TGGCTACTGGCCTTATCTCA | CAG | chr19 | 55115270 | 55115289 | 55115286 | + |
| SEQ ID NO 580 | GGCTACTGGCCTTATCTCAC | AGG | chr19 | 55115271 | 55115290 | 55115287 | + |
| SEQ ID NO 581 | TCACAGGTAAAACTGACGCA | CGG | chr19 | 55115287 | 55115306 | 55115303 | + |
| SEQ ID NO 582 | ACAGGTAAAACTGACGCACG | GAG | chr19 | 55115289 | 55115308 | 55115305 | + |
| SEQ ID NO 583 | CAGGTAAAACTGACGCACGG | AGG | chr19 | 55115290 | 55115309 | 55115306 | + |
| SEQ ID NO 584 | CACGGAGGAACAATATAAAT | TGG | chr19 | 55115305 | 55115324 | 55115321 | + |
| SEQ ID NO 585 | ACGGAGGAACAATATAAATT | GGG | chr19 | 55115306 | 55115325 | 55115322 | + |
| SEQ ID NO 586 | CGGAGGAACAATATAAATTG | GGG | chr19 | 55115307 | 55115326 | 55115323 | + |
| SEQ ID NO 587 | GAACAATATAAATTGGGGAC | TAG | chr19 | 55115312 | 55115331 | 55115328 | + |

Figure 1 (Cont'd)

| | | | | | | | |
|---|---|---|---|---|---|---|---|
| SEQ ID NO 588 | AATATAAATTGGGGACTAGA | AAG | chr19 | 55115316 | 55115335 | 55115332 | + |
| SEQ ID NO 589 | ATATAAATTGGGGACTAGAA | AGG | chr19 | 55115317 | 55115336 | 55115333 | + |
| SEQ ID NO 590 | AATTGGGGACTAGAAAGGTG | AAG | chr19 | 55115322 | 55115341 | 55115338 | + |
| SEQ ID NO 591 | TTGGGGACTAGAAAGGTGAA | GAG | chr19 | 55115324 | 55115343 | 55115340 | + |
| SEQ ID NO 592 | ACTAGAAAGGTGAAGAGCCA | AAG | chr19 | 55115330 | 55115349 | 55115346 | + |
| SEQ ID NO 593 | GAAAGGTGAAGAGCCAAAGT | TAG | chr19 | 55115334 | 55115353 | 55115350 | + |
| SEQ ID NO 594 | GAAGAGCCAAAGTTAGAACT | CAG | chr19 | 55115341 | 55115360 | 55115357 | + |
| SEQ ID NO 595 | AAGAGCCAAAGTTAGAACTC | AGG | chr19 | 55115342 | 55115361 | 55115358 | + |
| SEQ ID NO 596 | TTCCAAACTGCTTCTCCTCT | TGG | chr19 | 55115388 | 55115407 | 55115404 | + |
| SEQ ID NO 597 | TCCAAACTGCTTCTCCTCTT | GGG | chr19 | 55115389 | 55115408 | 55115405 | + |
| SEQ ID NO 598 | AAACTGCTTCTCCTCTTGGG | AAG | chr19 | 55115392 | 55115411 | 55115408 | + |
| SEQ ID NO 599 | CTTCTCCTCTTGGGAAGTGT | AAG | chr19 | 55115398 | 55115417 | 55115414 | + |
| SEQ ID NO 600 | TTCTCCTCTTGGGAAGTGTA | AGG | chr19 | 55115399 | 55115418 | 55115415 | + |
| SEQ ID NO 601 | TCCTCTTGGGAAGTGTAAGG | AAG | chr19 | 55115402 | 55115421 | 55115418 | + |
| SEQ ID NO 602 | TGGGAAGTGTAAGGAAGCTG | CAG | chr19 | 55115408 | 55115427 | 55115424 | + |
| SEQ ID NO 603 | GTGTAAGGAAGCTGCAGCAC | CAG | chr19 | 55115414 | 55115433 | 55115430 | + |
| SEQ ID NO 604 | TGTAAGGAAGCTGCAGCACC | AGG | chr19 | 55115415 | 55115434 | 55115431 | + |
| SEQ ID NO 605 | GGAAGCTGCAGCACCAGGAT | CAG | chr19 | 55115420 | 55115439 | 55115436 | + |
| SEQ ID NO 606 | CCAGGATCAGTGAAACGCAC | CAG | chr19 | 55115433 | 55115452 | 55115449 | + |
| SEQ ID NO 607 | GATCAGTGAAACGCACCAGA | CGG | chr19 | 55115437 | 55115456 | 55115453 | + |
| SEQ ID NO 608 | AACGCACCAGACGGCCGCGT | CAG | chr19 | 55115446 | 55115465 | 55115462 | + |
| SEQ ID NO 609 | CGCACCAGACGGCCGCGTCA | GAG | chr19 | 55115448 | 55115467 | 55115464 | + |
| SEQ ID NO 610 | ACCAGACGGCCGCGTCAGAG | CAG | chr19 | 55115451 | 55115470 | 55115467 | + |
| SEQ ID NO 611 | ACGGCCGCGTCAGAGCAGCT | CAG | chr19 | 55115456 | 55115475 | 55115472 | + |
| SEQ ID NO 612 | CGGCCGCGTCAGAGCAGCTC | AGG | chr19 | 55115457 | 55115476 | 55115473 | + |
| SEQ ID NO 613 | CGTCAGAGCAGCTCAGGTTC | TGG | chr19 | 55115463 | 55115482 | 55115479 | + |
| SEQ ID NO 614 | GTCAGAGCAGCTCAGGTTCT | GGG | chr19 | 55115464 | 55115483 | 55115480 | + |
| SEQ ID NO 615 | CAGAGCAGCTCAGGTTCTGG | GAG | chr19 | 55115466 | 55115485 | 55115482 | + |
| SEQ ID NO 616 | GAGCAGCTCAGGTTCTGGGA | GAG | chr19 | 55115468 | 55115487 | 55115484 | + |
| SEQ ID NO 617 | AGCAGCTCAGGTTCTGGGAG | AGG | chr19 | 55115469 | 55115488 | 55115485 | + |
| SEQ ID NO 618 | GCAGCTCAGGTTCTGGGAGA | GGG | chr19 | 55115470 | 55115489 | 55115486 | + |
| SEQ ID NO 619 | GCTCAGGTTCTGGGAGAGGG | TAG | chr19 | 55115473 | 55115492 | 55115489 | + |
| SEQ ID NO 620 | GGTTCTGGGAGAGGGTAGCG | CAG | chr19 | 55115478 | 55115497 | 55115494 | + |
| SEQ ID NO 621 | GTTCTGGGAGAGGGTAGCGC | AGG | chr19 | 55115479 | 55115498 | 55115495 | + |
| SEQ ID NO 622 | TTCTGGGAGAGGGTAGCGCA | GGG | chr19 | 55115480 | 55115499 | 55115496 | + |
| SEQ ID NO 623 | TGGGAGAGGGTAGCGCAGGG | TGG | chr19 | 55115483 | 55115502 | 55115499 | + |
| SEQ ID NO 624 | GGTAGCGCAGGGTGGCCACT | GAG | chr19 | 55115491 | 55115510 | 55115507 | + |
| SEQ ID NO 625 | GCAGGGTGGCCACTGAGAAC | CGG | chr19 | 55115497 | 55115516 | 55115513 | + |
| SEQ ID NO 626 | CAGGGTGGCCACTGAGAACC | GGG | chr19 | 55115498 | 55115517 | 55115514 | + |
| SEQ ID NO 627 | GGTGGCCACTGAGAACCGGG | CAG | chr19 | 55115501 | 55115520 | 55115517 | + |
| SEQ ID NO 628 | GTGGCCACTGAGAACCGGGC | AGG | chr19 | 55115502 | 55115521 | 55115518 | + |
| SEQ ID NO 629 | CTTCCCTCCCACCCCTGCC | AAG | chr19 | 55115539 | 55115558 | 55115555 | + |
| SEQ ID NO 630 | CCCTGCCAAGCTCTCCCTCC | CAG | chr19 | 55115552 | 55115571 | 55115568 | + |
| SEQ ID NO 631 | CCTGCCAAGCTCTCCCTCCC | AGG | chr19 | 55115553 | 55115572 | 55115569 | + |
| SEQ ID NO 632 | CTCCCTCCCAGGATCCTCTC | TGG | chr19 | 55115564 | 55115583 | 55115580 | + |
| SEQ ID NO 633 | ATCCTCTCTGGCTCCATCGT | AAG | chr19 | 55115576 | 55115595 | 55115592 | + |
| SEQ ID NO 634 | GCTCCATCGTAAGCAAACCT | TAG | chr19 | 55115586 | 55115605 | 55115602 | + |
| SEQ ID NO 635 | TCCATCGTAAGCAAACCTTA | GAG | chr19 | 55115588 | 55115607 | 55115604 | + |
| SEQ ID NO 636 | CCATCGTAAGCAAACCTTAG | AGG | chr19 | 55115589 | 55115608 | 55115605 | + |

Figure 1 (Cont'd)

| | | | | | | | |
|---|---|---|---|---|---|---|---|
| SEQ ID NO 637 | TAAGCAAACCTTAGAGGTTC | TGG | chr19 | 55115595 | 55115614 | 55115611 | + |
| SEQ ID NO 638 | CAAACCTTAGAGGTTCTGGC | AAG | chr19 | 55115599 | 55115618 | 55115615 | + |
| SEQ ID NO 639 | AAACCTTAGAGGTTCTGGCA | AGG | chr19 | 55115600 | 55115619 | 55115616 | + |
| SEQ ID NO 640 | ACCTTAGAGGTTCTGGCAAG | GAG | chr19 | 55115602 | 55115621 | 55115618 | + |
| SEQ ID NO 641 | CTTAGAGGTTCTGGCAAGGA | GAG | chr19 | 55115604 | 55115623 | 55115620 | + |
| SEQ ID NO 642 | TAGAGGTTCTGGCAAGGAGA | GAG | chr19 | 55115606 | 55115625 | 55115622 | + |
| SEQ ID NO 643 | GGTTCTGGCAAGGAGAGAGA | TGG | chr19 | 55115610 | 55115629 | 55115626 | + |
| SEQ ID NO 644 | GGCAAGGAGAGAGATGGCTC | CAG | chr19 | 55115616 | 55115635 | 55115632 | + |
| SEQ ID NO 645 | GCAAGGAGAGAGATGGCTCC | AGG | chr19 | 55115617 | 55115636 | 55115633 | + |
| SEQ ID NO 646 | AGAGAGATGGCTCCAGGAAA | TGG | chr19 | 55115623 | 55115642 | 55115639 | + |
| SEQ ID NO 647 | GAGAGATGGCTCCAGGAAAT | GGG | chr19 | 55115624 | 55115643 | 55115640 | + |
| SEQ ID NO 648 | AGAGATGGCTCCAGGAAATG | GGG | chr19 | 55115625 | 55115644 | 55115641 | + |
| SEQ ID NO 649 | GAGATGGCTCCAGGAAATGG | GGG | chr19 | 55115626 | 55115645 | 55115642 | + |
| SEQ ID NO 650 | AGGAAATGGGGGTGTGTCAC | CAG | chr19 | 55115637 | 55115656 | 55115653 | + |
| SEQ ID NO 651 | ATGGGGGTGTGTCACCAGAT | AAG | chr19 | 55115642 | 55115661 | 55115658 | + |
| SEQ ID NO 652 | TGGGGGTGTGTCACCAGATA | AGG | chr19 | 55115643 | 55115662 | 55115659 | + |
| SEQ ID NO 653 | CAGATAAGGAATCTGCCTAA | CAG | chr19 | 55115657 | 55115676 | 55115673 | + |
| SEQ ID NO 654 | AGATAAGGAATCTGCCTAAC | AGG | chr19 | 55115658 | 55115677 | 55115674 | + |
| SEQ ID NO 655 | ATAAGGAATCTGCCTAACAG | GAG | chr19 | 55115660 | 55115679 | 55115676 | + |
| SEQ ID NO 656 | TAAGGAATCTGCCTAACAGG | AGG | chr19 | 55115661 | 55115680 | 55115677 | + |
| SEQ ID NO 657 | GGAATCTGCCTAACAGGAGG | TGG | chr19 | 55115664 | 55115683 | 55115680 | + |
| SEQ ID NO 658 | GAATCTGCCTAACAGGAGGT | GGG | chr19 | 55115665 | 55115684 | 55115681 | + |
| SEQ ID NO 659 | AATCTGCCTAACAGGAGGTG | GGG | chr19 | 55115666 | 55115685 | 55115682 | + |
| SEQ ID NO 660 | ATCTGCCTAACAGGAGGTGG | GGG | chr19 | 55115667 | 55115686 | 55115683 | + |
| SEQ ID NO 661 | GCCTAACAGGAGGTGGGGGT | TAG | chr19 | 55115671 | 55115690 | 55115687 | + |
| SEQ ID NO 662 | GTGGGGGTTAGACCCAATAT | CAG | chr19 | 55115683 | 55115702 | 55115699 | + |
| SEQ ID NO 663 | TGGGGGTTAGACCCAATATC | AGG | chr19 | 55115684 | 55115703 | 55115700 | + |
| SEQ ID NO 664 | GGGGTTAGACCCAATATCAG | GAG | chr19 | 55115686 | 55115705 | 55115702 | + |
| SEQ ID NO 665 | TAGACCCAATATCAGGAGAC | TAG | chr19 | 55115691 | 55115710 | 55115707 | + |
| SEQ ID NO 666 | AGACCCAATATCAGGAGACT | AGG | chr19 | 55115692 | 55115711 | 55115708 | + |
| SEQ ID NO 667 | CCCAATATCAGGAGACTAGG | AAG | chr19 | 55115695 | 55115714 | 55115711 | + |
| SEQ ID NO 668 | CCAATATCAGGAGACTAGGA | AGG | chr19 | 55115696 | 55115715 | 55115712 | + |
| SEQ ID NO 669 | AATATCAGGAGACTAGGAAG | GAG | chr19 | 55115698 | 55115717 | 55115714 | + |
| SEQ ID NO 670 | ATATCAGGAGACTAGGAAGG | AGG | chr19 | 55115699 | 55115718 | 55115715 | + |
| SEQ ID NO 671 | ATCAGGAGACTAGGAAGGAG | GAG | chr19 | 55115701 | 55115720 | 55115717 | + |
| SEQ ID NO 672 | TCAGGAGACTAGGAAGGAGG | AGG | chr19 | 55115702 | 55115721 | 55115718 | + |
| SEQ ID NO 673 | GACTAGGAAGGAGGAGGCCT | AAG | chr19 | 55115708 | 55115727 | 55115724 | + |
| SEQ ID NO 674 | ACTAGGAAGGAGGAGGCCTA | AGG | chr19 | 55115709 | 55115728 | 55115725 | + |
| SEQ ID NO 675 | GGAAGGAGGAGGCCTAAGGA | TGG | chr19 | 55115713 | 55115732 | 55115729 | + |
| SEQ ID NO 676 | GAAGGAGGAGGCCTAAGGAT | GGG | chr19 | 55115714 | 55115733 | 55115730 | + |
| SEQ ID NO 677 | AAGGAGGAGGCCTAAGGATG | GGG | chr19 | 55115715 | 55115734 | 55115731 | + |
| SEQ ID NO 678 | TCTGTCACCAATCCTGTCCC | TAG | chr19 | 55115742 | 55115761 | 55115758 | + |
| SEQ ID NO 679 | GTCACCAATCCTGTCCCTAG | TGG | chr19 | 55115745 | 55115764 | 55115761 | + |
| SEQ ID NO 680 | TGTCCCTAGTGGCCCCACTG | TGG | chr19 | 55115756 | 55115775 | 55115772 | + |
| SEQ ID NO 681 | GTCCCTAGTGGCCCCACTGT | GGG | chr19 | 55115757 | 55115776 | 55115773 | + |
| SEQ ID NO 682 | TCCCTAGTGGCCCCACTGTG | GGG | chr19 | 55115758 | 55115777 | 55115774 | + |
| SEQ ID NO 683 | CTAGTGGCCCCACTGTGGGG | TGG | chr19 | 55115761 | 55115780 | 55115777 | + |
| SEQ ID NO 684 | AGTGGCCCCACTGTGGGGTG | GAG | chr19 | 55115763 | 55115782 | 55115779 | + |
| SEQ ID NO 685 | GTGGCCCCACTGTGGGGTGG | AGG | chr19 | 55115764 | 55115783 | 55115780 | + |

Figure 1 (Cont'd)

| SEQ ID NO 686 | TGGCCCCACTGTGGGGTGGA | GGG | chr19 | 55115765 | 55115784 | 55115781 | + |
| SEQ ID NO 687 | GGCCCCACTGTGGGGTGGAG | GGG | chr19 | 55115766 | 55115785 | 55115782 | + |
| SEQ ID NO 688 | CCACTGTGGGGTGGAGGGGA | CAG | chr19 | 55115770 | 55115789 | 55115786 | + |
| SEQ ID NO 689 | GGGGTGGAGGGGACAGATAA | AAG | chr19 | 55115777 | 55115796 | 55115793 | + |
| SEQ ID NO 690 | AGGGGACAGATAAAAGTACC | CAG | chr19 | 55115784 | 55115803 | 55115800 | + |
| SEQ ID NO 691 | CAGATAAAAGTACCCAGAAC | CAG | chr19 | 55115790 | 55115809 | 55115806 | + |
| SEQ ID NO 692 | GATAAAAGTACCCAGAACCA | GAG | chr19 | 55115792 | 55115811 | 55115808 | + |
| SEQ ID NO 693 | AGAACCAGAGCCACATTAAC | CGG | chr19 | 55115805 | 55115824 | 55115821 | + |
| SEQ ID NO 694 | AGAGCCACATTAACCGGCCC | TGG | chr19 | 55115811 | 55115830 | 55115827 | + |
| SEQ ID NO 695 | GAGCCACATTAACCGGCCCT | GGG | chr19 | 55115812 | 55115831 | 55115828 | + |
| SEQ ID NO 696 | TTAACCGGCCCTGGGAATAT | AAG | chr19 | 55115820 | 55115839 | 55115836 | + |
| SEQ ID NO 697 | TAACCGGCCCTGGGAATATA | AGG | chr19 | 55115821 | 55115840 | 55115837 | + |
| SEQ ID NO 698 | CCGGCCCTGGGAATATAAGG | TGG | chr19 | 55115824 | 55115843 | 55115840 | + |
| SEQ ID NO 699 | CTGGGAATATAAGGTGGTCC | CAG | chr19 | 55115830 | 55115849 | 55115846 | + |
| SEQ ID NO 700 | AATATAAGGTGGTCCCAGCT | CGG | chr19 | 55115835 | 55115854 | 55115851 | + |
| SEQ ID NO 701 | ATATAAGGTGGTCCCAGCTC | GGG | chr19 | 55115836 | 55115855 | 55115852 | + |
| SEQ ID NO 702 | TATAAGGTGGTCCCAGCTCG | GGG | chr19 | 55115837 | 55115856 | 55115853 | + |
| SEQ ID NO 703 | GTGGTCCCAGCTCGGGGACA | CAG | chr19 | 55115843 | 55115862 | 55115859 | + |
| SEQ ID NO 704 | TGGTCCCAGCTCGGGGACAC | AGG | chr19 | 55115844 | 55115863 | 55115860 | + |
| SEQ ID NO 705 | GCTCGGGGACACAGGATCCC | TGG | chr19 | 55115852 | 55115871 | 55115868 | + |
| SEQ ID NO 706 | TCGGGGACACAGGATCCCTG | GAG | chr19 | 55115854 | 55115873 | 55115870 | + |
| SEQ ID NO 707 | CGGGGACACAGGATCCCTGG | AGG | chr19 | 55115855 | 55115874 | 55115871 | + |
| SEQ ID NO 708 | GGACACAGGATCCCTGGAGG | CAG | chr19 | 55115858 | 55115877 | 55115874 | + |
| SEQ ID NO 709 | GCAGCAAACATGCTGTCCTG | AAG | chr19 | 55115877 | 55115896 | 55115893 | + |
| SEQ ID NO 710 | GCAAACATGCTGTCCTGAAG | TGG | chr19 | 55115880 | 55115899 | 55115896 | + |
| SEQ ID NO 711 | ATGCTGTCCTGAAGTGGACA | TAG | chr19 | 55115886 | 55115905 | 55115902 | + |
| SEQ ID NO 712 | TGCTGTCCTGAAGTGGACAT | AGG | chr19 | 55115887 | 55115906 | 55115903 | + |
| SEQ ID NO 713 | GCTGTCCTGAAGTGGACATA | GGG | chr19 | 55115888 | 55115907 | 55115904 | + |
| SEQ ID NO 714 | CTGTCCTGAAGTGGACATAG | GGG | chr19 | 55115889 | 55115908 | 55115905 | + |
| SEQ ID NO 715 | CTGAAGTGGACATAGGGGCC | CGG | chr19 | 55115894 | 55115913 | 55115910 | + |
| SEQ ID NO 716 | TGAAGTGGACATAGGGGCCC | GGG | chr19 | 55115895 | 55115914 | 55115911 | + |
| SEQ ID NO 717 | GTGGACATAGGGGCCCGGGT | TGG | chr19 | 55115899 | 55115918 | 55115915 | + |
| SEQ ID NO 718 | GGACATAGGGGCCCGGGTTG | GAG | chr19 | 55115901 | 55115920 | 55115917 | + |
| SEQ ID NO 719 | GACATAGGGGCCCGGGTTGG | AGG | chr19 | 55115902 | 55115921 | 55115918 | + |
| SEQ ID NO 720 | ATAGGGGCCCGGGTTGGAGG | AAG | chr19 | 55115905 | 55115924 | 55115921 | + |
| SEQ ID NO 721 | GGGGCCCGGGTTGGAGGAAG | AAG | chr19 | 55115908 | 55115927 | 55115924 | + |
| SEQ ID NO 722 | CCGGGTTGGAGGAAGAAGAC | TAG | chr19 | 55115913 | 55115932 | 55115929 | + |
| SEQ ID NO 723 | TTGGAGGAAGAAGACTAGCT | GAG | chr19 | 55115918 | 55115937 | 55115934 | + |
| SEQ ID NO 724 | AAGAAGACTAGCTGAGCTCT | CGG | chr19 | 55115925 | 55115944 | 55115941 | + |
| SEQ ID NO 725 | TAGCTGAGCTCTCGGACCCC | TGG | chr19 | 55115933 | 55115952 | 55115949 | + |
| SEQ ID NO 726 | CTGAGCTCTCGGACCCCTGG | AAG | chr19 | 55115936 | 55115955 | 55115952 | + |
| SEQ ID NO 727 | ACCCCTGGAAGATGCCATGA | CAG | chr19 | 55115948 | 55115967 | 55115964 | + |
| SEQ ID NO 728 | CCCCTGGAAGATGCCATGAC | AGG | chr19 | 55115949 | 55115968 | 55115965 | + |
| SEQ ID NO 729 | CCCTGGAAGATGCCATGACA | GGG | chr19 | 55115950 | 55115969 | 55115966 | + |
| SEQ ID NO 730 | CCTGGAAGATGCCATGACAG | GGG | chr19 | 55115951 | 55115970 | 55115967 | + |
| SEQ ID NO 731 | CTGGAAGATGCCATGACAGG | GGG | chr19 | 55115952 | 55115971 | 55115968 | + |
| SEQ ID NO 732 | AAGATGCCATGACAGGGGGC | TGG | chr19 | 55115956 | 55115975 | 55115972 | + |
| SEQ ID NO 733 | ATGCCATGACAGGGGGCTGG | AAG | chr19 | 55115959 | 55115978 | 55115975 | + |
| SEQ ID NO 734 | GCCATGACAGGGGGCTGGAA | GAG | chr19 | 55115961 | 55115980 | 55115977 | + |

Figure 1 (Cont'd)

| | | | | | | | |
|---|---|---|---|---|---|---|---|
| SEQ ID NO 735 | TGACAGGGGGCTGGAAGAGC | TAG | chr19 | 55115965 | 55115984 | 55115981 | + |
| SEQ ID NO 736 | GGGGGCTGGAAGAGCTAGCA | CAG | chr19 | 55115970 | 55115989 | 55115986 | + |
| SEQ ID NO 737 | CTGGAAGAGCTAGCACAGAC | TAG | chr19 | 55115975 | 55115994 | 55115991 | + |
| SEQ ID NO 738 | GGAAGAGCTAGCACAGACTA | GAG | chr19 | 55115977 | 55115996 | 55115993 | + |
| SEQ ID NO 739 | AAGAGCTAGCACAGACTAGA | GAG | chr19 | 55115979 | 55115998 | 55115995 | + |
| SEQ ID NO 740 | AGAGCTAGCACAGACTAGAG | AGG | chr19 | 55115980 | 55115999 | 55115996 | + |
| SEQ ID NO 741 | CTAGCACAGACTAGAGAGGT | AAG | chr19 | 55115984 | 55116003 | 55116000 | + |
| SEQ ID NO 742 | TAGCACAGACTAGAGAGGTA | AGG | chr19 | 55115985 | 55116004 | 55116001 | + |
| SEQ ID NO 743 | AGCACAGACTAGAGAGGTAA | GGG | chr19 | 55115986 | 55116005 | 55116002 | + |
| SEQ ID NO 744 | GCACAGACTAGAGAGGTAAG | GGG | chr19 | 55115987 | 55116006 | 55116003 | + |
| SEQ ID NO 745 | CACAGACTAGAGAGGTAAGG | GGG | chr19 | 55115988 | 55116007 | 55116004 | + |
| SEQ ID NO 746 | ACAGACTAGAGAGGTAAGGG | GGG | chr19 | 55115989 | 55116008 | 55116005 | + |
| SEQ ID NO 747 | GACTAGAGAGGTAAGGGGGG | TAG | chr19 | 55115992 | 55116011 | 55116008 | + |
| SEQ ID NO 748 | ACTAGAGAGGTAAGGGGGGT | AGG | chr19 | 55115993 | 55116012 | 55116009 | + |
| SEQ ID NO 749 | CTAGAGAGGTAAGGGGGGTA | GGG | chr19 | 55115994 | 55116013 | 55116010 | + |
| SEQ ID NO 750 | TAGAGAGGTAAGGGGGGTAG | GGG | chr19 | 55115995 | 55116014 | 55116011 | + |
| SEQ ID NO 751 | GAGAGGTAAGGGGGGTAGGG | GAG | chr19 | 55115997 | 55116016 | 55116013 | + |
| SEQ ID NO 752 | TAGGGGAGCTGCCCAAATGA | AAG | chr19 | 55116012 | 55116031 | 55116028 | + |
| SEQ ID NO 753 | AGGGGAGCTGCCCAAATGAA | AGG | chr19 | 55116013 | 55116032 | 55116029 | + |
| SEQ ID NO 754 | GGGAGCTGCCCAAATGAAAG | GAG | chr19 | 55116015 | 55116034 | 55116031 | + |
| SEQ ID NO 755 | GCTGCCCAAATGAAAGGAGT | GAG | chr19 | 55116019 | 55116038 | 55116035 | + |
| SEQ ID NO 756 | TGCCCAAATGAAAGGAGTGA | GAG | chr19 | 55116021 | 55116040 | 55116037 | + |
| SEQ ID NO 757 | GCCCAAATGAAAGGAGTGAG | AGG | chr19 | 55116022 | 55116041 | 55116038 | + |
| SEQ ID NO 758 | TGAGAGGTGACCCGAATCCA | CAG | chr19 | 55116038 | 55116057 | 55116054 | + |
| SEQ ID NO 759 | GAGAGGTGACCCGAATCCAC | AGG | chr19 | 55116039 | 55116058 | 55116055 | + |
| SEQ ID NO 760 | GAGGTGACCCGAATCCACAG | GAG | chr19 | 55116041 | 55116060 | 55116057 | + |
| SEQ ID NO 761 | GACCCGAATCCACAGGAGAA | CGG | chr19 | 55116046 | 55116065 | 55116062 | + |
| SEQ ID NO 762 | ACCCGAATCCACAGGAGAAC | GGG | chr19 | 55116047 | 55116066 | 55116063 | + |
| SEQ ID NO 763 | CCCGAATCCACAGGAGAACG | GGG | chr19 | 55116048 | 55116067 | 55116064 | + |
| SEQ ID NO 764 | CCACAGGAGAACGGGGTGTC | CAG | chr19 | 55116055 | 55116074 | 55116071 | + |
| SEQ ID NO 765 | CACAGGAGAACGGGGTGTCC | AGG | chr19 | 55116056 | 55116075 | 55116072 | + |
| SEQ ID NO 766 | GAGAACGGGGTGTCCAGGCA | AAG | chr19 | 55116061 | 55116080 | 55116077 | + |
| SEQ ID NO 767 | ACGGGGTGTCCAGGCAAAGA | AAG | chr19 | 55116065 | 55116084 | 55116081 | + |
| SEQ ID NO 768 | GGTGTCCAGGCAAAGAAAGC | AAG | chr19 | 55116069 | 55116088 | 55116085 | + |
| SEQ ID NO 769 | TGTCCAGGCAAAGAAAGCAA | GAG | chr19 | 55116071 | 55116090 | 55116087 | + |
| SEQ ID NO 770 | GTCCAGGCAAAGAAAGCAAG | AGG | chr19 | 55116072 | 55116091 | 55116088 | + |
| SEQ ID NO 771 | AGGCAAAGAAAGCAAGAGGA | TGG | chr19 | 55116076 | 55116095 | 55116092 | + |
| SEQ ID NO 772 | GCAAAGAAAGCAAGAGGATG | GAG | chr19 | 55116078 | 55116097 | 55116094 | + |
| SEQ ID NO 773 | AAAGAAAGCAAGAGGATGGA | GAG | chr19 | 55116080 | 55116099 | 55116096 | + |
| SEQ ID NO 774 | AAGAAAGCAAGAGGATGGAG | AGG | chr19 | 55116081 | 55116100 | 55116097 | + |
| SEQ ID NO 775 | AAAGCAAGAGGATGGAGAGG | TGG | chr19 | 55116084 | 55116103 | 55116100 | + |
| SEQ ID NO 776 | AGAGGATGGAGAGGTGGCTA | AAG | chr19 | 55116090 | 55116109 | 55116106 | + |
| SEQ ID NO 777 | GATGGAGAGGTGGCTAAAGC | CAG | chr19 | 55116094 | 55116113 | 55116110 | + |
| SEQ ID NO 778 | ATGGAGAGGTGGCTAAAGCC | AGG | chr19 | 55116095 | 55116114 | 55116111 | + |
| SEQ ID NO 779 | TGGAGAGGTGGCTAAAGCCA | GGG | chr19 | 55116096 | 55116115 | 55116112 | + |
| SEQ ID NO 780 | GAGAGGTGGCTAAAGCCAGG | GAG | chr19 | 55116098 | 55116117 | 55116114 | + |
| SEQ ID NO 781 | GGTGGCTAAAGCCAGGGAGA | CGG | chr19 | 55116102 | 55116121 | 55116118 | + |
| SEQ ID NO 782 | GTGGCTAAAGCCAGGGAGAC | GGG | chr19 | 55116103 | 55116122 | 55116119 | + |
| SEQ ID NO 783 | TGGCTAAAGCCAGGGAGACG | GGG | chr19 | 55116104 | 55116123 | 55116120 | + |

Figure 1 (Cont'd)

| | | | | | | | |
|---|---|---|---|---|---|---|---|
| SEQ ID NO 784 | GCCAGGGAGACGGGGTACTT | TGG | chr19 | 55116112 | 55116131 | 55116128 | + |
| SEQ ID NO 785 | CCAGGGAGACGGGGTACTTT | GGG | chr19 | 55116113 | 55116132 | 55116129 | + |
| SEQ ID NO 786 | CAGGGAGACGGGGTACTTTG | GGG | chr19 | 55116114 | 55116133 | 55116130 | + |
| SEQ ID NO 787 | CGGGGTACTTTGGGGTTGTC | CAG | chr19 | 55116122 | 55116141 | 55116138 | + |
| SEQ ID NO 788 | TTTGGGGTTGTCCAGAAAAA | CGG | chr19 | 55116130 | 55116149 | 55116146 | + |
| SEQ ID NO 789 | CCAGAAAAACGGTGATGATG | CAG | chr19 | 55116141 | 55116160 | 55116157 | + |
| SEQ ID NO 790 | CAGAAAAACGGTGATGATGC | AGG | chr19 | 55116142 | 55116161 | 55116158 | + |
| SEQ ID NO 791 | CGGTGATGATGCAGGCCTAC | AAG | chr19 | 55116150 | 55116169 | 55116166 | + |
| SEQ ID NO 792 | TGATGATGCAGGCCTACAAG | AAG | chr19 | 55116153 | 55116172 | 55116169 | + |
| SEQ ID NO 793 | GATGATGCAGGCCTACAAGA | AGG | chr19 | 55116154 | 55116173 | 55116170 | + |
| SEQ ID NO 794 | ATGATGCAGGCCTACAAGAA | GGG | chr19 | 55116155 | 55116174 | 55116171 | + |
| SEQ ID NO 795 | TGATGCAGGCCTACAAGAAG | GGG | chr19 | 55116156 | 55116175 | 55116172 | + |
| SEQ ID NO 796 | ATGCAGGCCTACAAGAAGGG | GAG | chr19 | 55116158 | 55116177 | 55116174 | + |
| SEQ ID NO 797 | TGCAGGCCTACAAGAAGGGG | AGG | chr19 | 55116159 | 55116178 | 55116175 | + |
| SEQ ID NO 798 | AGGCCTACAAGAAGGGGAGG | CGG | chr19 | 55116162 | 55116181 | 55116178 | + |
| SEQ ID NO 799 | GGCCTACAAGAAGGGGAGGC | GGG | chr19 | 55116163 | 55116182 | 55116179 | + |
| SEQ ID NO 800 | AAGAAGGGGAGGCGGGACGC | AAG | chr19 | 55116170 | 55116189 | 55116186 | + |
| SEQ ID NO 801 | AGAAGGGGAGGCGGGACGCA | AGG | chr19 | 55116171 | 55116190 | 55116187 | + |
| SEQ ID NO 802 | GAAGGGGAGGCGGGACGCAA | GGG | chr19 | 55116172 | 55116191 | 55116188 | + |
| SEQ ID NO 803 | AGGGGAGGCGGGACGCAAGG | GAG | chr19 | 55116174 | 55116193 | 55116190 | + |
| SEQ ID NO 804 | GACGCAAGGGAGACATCCGT | CGG | chr19 | 55116185 | 55116204 | 55116201 | + |
| SEQ ID NO 805 | CGCAAGGGAGACATCCGTCG | GAG | chr19 | 55116187 | 55116206 | 55116203 | + |
| SEQ ID NO 806 | AAGGGAGACATCCGTCGGAG | AAG | chr19 | 55116190 | 55116209 | 55116206 | + |
| SEQ ID NO 807 | AGGGAGACATCCGTCGGAGA | AGG | chr19 | 55116191 | 55116210 | 55116207 | + |
| SEQ ID NO 808 | CCGTCGGAGAAGGCCATCCT | AAG | chr19 | 55116201 | 55116220 | 55116217 | + |
| SEQ ID NO 809 | AGAAGGCCATCCTAAGAAAC | GAG | chr19 | 55116208 | 55116227 | 55116224 | + |
| SEQ ID NO 810 | AAGGCCATCCTAAGAAACGA | GAG | chr19 | 55116210 | 55116229 | 55116226 | + |
| SEQ ID NO 811 | CCATCCTAAGAAACGAGAGA | TGG | chr19 | 55116214 | 55116233 | 55116230 | + |
| SEQ ID NO 812 | CTAAGAAACGAGAGATGGCA | CAG | chr19 | 55116219 | 55116238 | 55116235 | + |
| SEQ ID NO 813 | TAAGAAACGAGAGATGGCAC | AGG | chr19 | 55116220 | 55116239 | 55116236 | + |
| SEQ ID NO 814 | ACGAGAGATGGCACAGGCCC | CAG | chr19 | 55116226 | 55116245 | 55116242 | + |
| SEQ ID NO 815 | AGAGATGGCACAGGCCCCAG | AAG | chr19 | 55116229 | 55116248 | 55116245 | + |
| SEQ ID NO 816 | GAGATGGCACAGGCCCCAGA | AGG | chr19 | 55116230 | 55116249 | 55116246 | + |
| SEQ ID NO 817 | GATGGCACAGGCCCCAGAAG | GAG | chr19 | 55116232 | 55116251 | 55116248 | + |
| SEQ ID NO 818 | GGCACAGGCCCCAGAAGGAG | AAG | chr19 | 55116235 | 55116254 | 55116251 | + |
| SEQ ID NO 819 | GCACAGGCCCCAGAAGGAGA | AGG | chr19 | 55116236 | 55116255 | 55116252 | + |
| SEQ ID NO 820 | GGCCCCAGAAGGAGAAGGAA | AAG | chr19 | 55116241 | 55116260 | 55116257 | + |
| SEQ ID NO 821 | GCCCCAGAAGGAGAAGGAAA | AGG | chr19 | 55116242 | 55116261 | 55116258 | + |
| SEQ ID NO 822 | CCCCAGAAGGAGAAGGAAAA | GGG | chr19 | 55116243 | 55116262 | 55116259 | + |
| SEQ ID NO 823 | AGGAGAAGGAAAAGGGAACC | CAG | chr19 | 55116250 | 55116269 | 55116266 | + |
| SEQ ID NO 824 | GAAGGAAAAGGGAACCCAGC | GAG | chr19 | 55116254 | 55116273 | 55116270 | + |
| SEQ ID NO 825 | AAAAGGGAACCCAGCGAGTG | AAG | chr19 | 55116259 | 55116278 | 55116275 | + |
| SEQ ID NO 826 | GGGAACCCAGCGAGTGAAGA | CGG | chr19 | 55116263 | 55116282 | 55116279 | + |
| SEQ ID NO 827 | CCCAGCGAGTGAAGACGGCA | TGG | chr19 | 55116268 | 55116287 | 55116284 | + |
| SEQ ID NO 828 | CCAGCGAGTGAAGACGGCAT | GGG | chr19 | 55116269 | 55116288 | 55116285 | + |
| SEQ ID NO 829 | CAGCGAGTGAAGACGGCATG | GGG | chr19 | 55116270 | 55116289 | 55116286 | + |
| SEQ ID NO 830 | GAGTGAAGACGGCATGGGGT | TGG | chr19 | 55116274 | 55116293 | 55116290 | + |
| SEQ ID NO 831 | AGTGAAGACGGCATGGGGTT | GGG | chr19 | 55116275 | 55116294 | 55116291 | + |
| SEQ ID NO 832 | AAGACGGCATGGGGTTGGGT | GAG | chr19 | 55116279 | 55116298 | 55116295 | + |

Figure 1 (Cont'd)

| | | | | | | | |
|---|---|---|---|---|---|---|---|
| SEQ ID NO 833 | AGACGGCATGGGGTTGGGTG | AGG | chr19 | 55116280 | 55116299 | 55116296 | + |
| SEQ ID NO 834 | GACGGCATGGGGTTGGGTGA | GGG | chr19 | 55116281 | 55116300 | 55116297 | + |
| SEQ ID NO 835 | CGGCATGGGGTTGGGTGAGG | GAG | chr19 | 55116283 | 55116302 | 55116299 | + |
| SEQ ID NO 836 | GGCATGGGGTTGGGTGAGGG | AGG | chr19 | 55116284 | 55116303 | 55116300 | + |
| SEQ ID NO 837 | CATGGGGTTGGGTGAGGGAG | GAG | chr19 | 55116286 | 55116305 | 55116302 | + |
| SEQ ID NO 838 | TGGGGTTGGGTGAGGGAGGA | GAG | chr19 | 55116288 | 55116307 | 55116304 | + |
| SEQ ID NO 839 | GGTGAGGGAGGAGAGATGCC | CGG | chr19 | 55116296 | 55116315 | 55116312 | + |
| SEQ ID NO 840 | TGAGGGAGGAGAGATGCCCG | GAG | chr19 | 55116298 | 55116317 | 55116314 | + |
| SEQ ID NO 841 | AGGGAGGAGAGATGCCCGGA | GAG | chr19 | 55116300 | 55116319 | 55116316 | + |
| SEQ ID NO 842 | GGGAGGAGAGATGCCCGGAG | AGG | chr19 | 55116301 | 55116320 | 55116317 | + |
| SEQ ID NO 843 | AGAGATGCCCGGAGAGGACC | CAG | chr19 | 55116307 | 55116326 | 55116323 | + |
| SEQ ID NO 844 | GCCCGGAGAGGACCCAGACA | CGG | chr19 | 55116313 | 55116332 | 55116329 | + |
| SEQ ID NO 845 | CCCGGAGAGGACCCAGACAC | GGG | chr19 | 55116314 | 55116333 | 55116330 | + |
| SEQ ID NO 846 | CCGGAGAGGACCCAGACACG | GGG | chr19 | 55116315 | 55116334 | 55116331 | + |
| SEQ ID NO 847 | GGAGAGGACCCAGACACGGG | GAG | chr19 | 55116317 | 55116336 | 55116333 | + |
| SEQ ID NO 848 | GAGAGGACCCAGACACGGGG | AGG | chr19 | 55116318 | 55116337 | 55116334 | + |
| SEQ ID NO 849 | AGACACGGGGAGGATCCGCT | CAG | chr19 | 55116328 | 55116347 | 55116344 | + |
| SEQ ID NO 850 | ACACGGGGAGGATCCGCTCA | GAG | chr19 | 55116330 | 55116349 | 55116346 | + |
| SEQ ID NO 851 | CACGGGGAGGATCCGCTCAG | AGG | chr19 | 55116331 | 55116350 | 55116347 | + |
| SEQ ID NO 852 | TCCGCTCAGAGGACATCACG | TGG | chr19 | 55116342 | 55116361 | 55116358 | + |
| SEQ ID NO 853 | TCAGAGGACATCACGTGGT | CAG | chr19 | 55116347 | 55116366 | 55116363 | + |
| SEQ ID NO 854 | ACATCACGTGGTGCAGCGCC | GAG | chr19 | 55116354 | 55116373 | 55116370 | + |
| SEQ ID NO 855 | TCACGTGGTGCAGCGCCGAG | AAG | chr19 | 55116357 | 55116376 | 55116373 | + |
| SEQ ID NO 856 | CACGTGGTGCAGCGCCGAGA | AGG | chr19 | 55116358 | 55116377 | 55116374 | + |
| SEQ ID NO 857 | GTGGTGCAGCGCCGAGAAGG | AAG | chr19 | 55116361 | 55116380 | 55116377 | + |
| SEQ ID NO 858 | GCGCCGAGAAGGAAGTGCTC | CGG | chr19 | 55116369 | 55116388 | 55116385 | + |
| SEQ ID NO 859 | CGAGAAGGAAGTGCTCCGGA | AAG | chr19 | 55116373 | 55116392 | 55116389 | + |
| SEQ ID NO 860 | AGAAGGAAGTGCTCCGGAAA | GAG | chr19 | 55116375 | 55116394 | 55116391 | + |
| SEQ ID NO 861 | TGCTCCGGAAAGAGCATCCT | TGG | chr19 | 55116384 | 55116403 | 55116400 | + |
| SEQ ID NO 862 | GCTCCGGAAAGAGCATCCTT | GGG | chr19 | 55116385 | 55116404 | 55116401 | + |
| SEQ ID NO 863 | CCGGAAAGAGCATCCTTGGG | CAG | chr19 | 55116388 | 55116407 | 55116404 | + |
| SEQ ID NO 864 | AGCATCCTTGGGCAGCAACA | CAG | chr19 | 55116396 | 55116415 | 55116412 | + |
| SEQ ID NO 865 | ATCCTTGGGCAGCAACACAG | CAG | chr19 | 55116399 | 55116418 | 55116415 | + |
| SEQ ID NO 866 | CCTTGGGCAGCAACACAGCA | GAG | chr19 | 55116401 | 55116420 | 55116417 | + |
| SEQ ID NO 867 | TTGGGCAGCAACACAGCAGA | GAG | chr19 | 55116403 | 55116422 | 55116419 | + |
| SEQ ID NO 868 | GCAGCAACACAGCAGAGAGC | AAG | chr19 | 55116407 | 55116426 | 55116423 | + |
| SEQ ID NO 869 | CAGCAACACAGCAGAGAGCA | AGG | chr19 | 55116408 | 55116427 | 55116424 | + |
| SEQ ID NO 870 | AGCAACACAGCAGAGAGCAA | GGG | chr19 | 55116409 | 55116428 | 55116425 | + |
| SEQ ID NO 871 | GCAACACAGCAGAGAGCAAG | GGG | chr19 | 55116410 | 55116429 | 55116426 | + |
| SEQ ID NO 872 | ACACAGCAGAGAGCAAGGGG | AAG | chr19 | 55116413 | 55116432 | 55116429 | + |
| SEQ ID NO 873 | ACAGCAGAGAGCAAGGGGAA | GAG | chr19 | 55116415 | 55116434 | 55116431 | + |
| SEQ ID NO 874 | CAGCAGAGAGCAAGGGGAAG | AGG | chr19 | 55116416 | 55116435 | 55116432 | + |
| SEQ ID NO 875 | AGCAGAGAGCAAGGGGAAGA | GGG | chr19 | 55116417 | 55116436 | 55116433 | + |
| SEQ ID NO 876 | CAGAGAGCAAGGGGAAGAGG | GAG | chr19 | 55116419 | 55116438 | 55116435 | + |
| SEQ ID NO 877 | AGAGCAAGGGGAAGAGGGAG | TGG | chr19 | 55116422 | 55116441 | 55116438 | + |
| SEQ ID NO 878 | AGCAAGGGGAAGAGGGAGTG | GAG | chr19 | 55116424 | 55116443 | 55116440 | + |
| SEQ ID NO 879 | GCAAGGGGAAGAGGGAGTGG | AGG | chr19 | 55116425 | 55116444 | 55116441 | + |
| SEQ ID NO 880 | AGGGGAAGAGGGAGTGGAGG | AAG | chr19 | 55116428 | 55116447 | 55116444 | + |
| SEQ ID NO 881 | GAAGAGGGAGTGGAGGAAGA | CGG | chr19 | 55116432 | 55116451 | 55116448 | + |

Figure 1 (Cont'd)

| SEQ ID NO 882 | GTGGAGGAAGACGGAACCTG | AAG | chr19 | 55116441 | 55116460 | 55116457 | + |
| SEQ ID NO 883 | TGGAGGAAGACGGAACCTGA | AGG | chr19 | 55116442 | 55116461 | 55116458 | + |
| SEQ ID NO 884 | GAGGAAGACGGAACCTGAAG | GAG | chr19 | 55116444 | 55116463 | 55116460 | + |
| SEQ ID NO 885 | AGGAAGACGGAACCTGAAGG | AGG | chr19 | 55116445 | 55116464 | 55116461 | + |
| SEQ ID NO 886 | AAGACGGAACCTGAAGGAGG | CGG | chr19 | 55116448 | 55116467 | 55116464 | + |
| SEQ ID NO 887 | ACGGAACCTGAAGGAGGCGG | CAG | chr19 | 55116451 | 55116470 | 55116467 | + |
| SEQ ID NO 888 | CGGAACCTGAAGGAGGCGGC | AGG | chr19 | 55116452 | 55116471 | 55116468 | + |
| SEQ ID NO 889 | GGAACCTGAAGGAGGCGGCA | GGG | chr19 | 55116453 | 55116472 | 55116469 | + |
| SEQ ID NO 890 | ACCTGAAGGAGGCGGCAGGG | AAG | chr19 | 55116456 | 55116475 | 55116472 | + |
| SEQ ID NO 891 | CCTGAAGGAGGCGGCAGGGA | AGG | chr19 | 55116457 | 55116476 | 55116473 | + |
| SEQ ID NO 892 | GGAGGCGGCAGGGAAGGATC | TGG | chr19 | 55116463 | 55116482 | 55116479 | + |
| SEQ ID NO 893 | GAGGCGGCAGGGAAGGATCT | GGG | chr19 | 55116464 | 55116483 | 55116480 | + |
| SEQ ID NO 894 | CGGCAGGGAAGGATCTGGGC | CAG | chr19 | 55116468 | 55116487 | 55116484 | + |
| SEQ ID NO 895 | GGAAGGATCTGGGCCAGCCG | TAG | chr19 | 55116474 | 55116493 | 55116490 | + |
| SEQ ID NO 896 | AAGGATCTGGGCCAGCCGTA | GAG | chr19 | 55116476 | 55116495 | 55116492 | + |
| SEQ ID NO 897 | AGGATCTGGGCCAGCCGTAG | AGG | chr19 | 55116477 | 55116496 | 55116493 | + |
| SEQ ID NO 898 | GGCCAGCCGTAGAGGTGACC | CAG | chr19 | 55116485 | 55116504 | 55116501 | + |
| SEQ ID NO 899 | GCCAGCCGTAGAGGTGACCC | AGG | chr19 | 55116486 | 55116505 | 55116502 | + |
| SEQ ID NO 900 | GTAGAGGTGACCCAGGCCAC | AAG | chr19 | 55116493 | 55116512 | 55116509 | + |
| SEQ ID NO 901 | GTGACCCAGGCCACAAGCTG | CAG | chr19 | 55116499 | 55116518 | 55116515 | + |
| SEQ ID NO 902 | CCCAGGCCACAAGCTGCAGA | CAG | chr19 | 55116503 | 55116522 | 55116519 | + |
| SEQ ID NO 903 | GGCCACAAGCTGCAGACAGA | AAG | chr19 | 55116507 | 55116526 | 55116523 | + |
| SEQ ID NO 904 | CACAAGCTGCAGACAGAAAG | CGG | chr19 | 55116510 | 55116529 | 55116526 | + |
| SEQ ID NO 905 | GCTGCAGACAGAAAGCGGCA | CAG | chr19 | 55116515 | 55116534 | 55116531 | + |
| SEQ ID NO 906 | CTGCAGACAGAAAGCGGCAC | AGG | chr19 | 55116516 | 55116535 | 55116532 | + |
| SEQ ID NO 907 | GACAGAAAGCGGCACAGGCC | CAG | chr19 | 55116521 | 55116540 | 55116537 | + |
| SEQ ID NO 908 | ACAGAAAGCGGCACAGGCCC | AGG | chr19 | 55116522 | 55116541 | 55116538 | + |
| SEQ ID NO 909 | CAGAAAGCGGCACAGGCCCA | GGG | chr19 | 55116523 | 55116542 | 55116539 | + |
| SEQ ID NO 910 | AGAAAGCGGCACAGGCCCAG | GGG | chr19 | 55116524 | 55116543 | 55116540 | + |
| SEQ ID NO 911 | AAAGCGGCACAGGCCCAGGG | GAG | chr19 | 55116526 | 55116545 | 55116542 | + |
| SEQ ID NO 912 | AGCGGCACAGGCCCAGGGGA | GAG | chr19 | 55116528 | 55116547 | 55116544 | + |
| SEQ ID NO 913 | CAGGCCCAGGGGAGAGAATG | CAG | chr19 | 55116535 | 55116554 | 55116551 | + |
| SEQ ID NO 914 | AGGCCCAGGGGAGAGAATGC | AGG | chr19 | 55116536 | 55116555 | 55116552 | + |
| SEQ ID NO 915 | CCAGGGGAGAGAATGCAGGT | CAG | chr19 | 55116540 | 55116559 | 55116556 | + |
| SEQ ID NO 916 | AGGGGAGAGAATGCAGGTCA | GAG | chr19 | 55116542 | 55116561 | 55116558 | + |
| SEQ ID NO 917 | GAGAGAATGCAGGTCAGAGA | AAG | chr19 | 55116546 | 55116565 | 55116562 | + |
| SEQ ID NO 918 | AGAATGCAGGTCAGAGAAAG | CAG | chr19 | 55116549 | 55116568 | 55116565 | + |
| SEQ ID NO 919 | GAATGCAGGTCAGAGAAAGC | AGG | chr19 | 55116550 | 55116569 | 55116566 | + |
| SEQ ID NO 920 | CAGAGAAAGCAGGACCTGCC | TGG | chr19 | 55116560 | 55116579 | 55116576 | + |
| SEQ ID NO 921 | AGAGAAAGCAGGACCTGCCT | GGG | chr19 | 55116561 | 55116580 | 55116577 | + |
| SEQ ID NO 922 | GAAAGCAGGACCTGCCTGGG | AAG | chr19 | 55116564 | 55116583 | 55116580 | + |
| SEQ ID NO 923 | AAAGCAGGACCTGCCTGGGA | AGG | chr19 | 55116565 | 55116584 | 55116581 | + |
| SEQ ID NO 924 | AAGCAGGACCTGCCTGGGAA | GGG | chr19 | 55116566 | 55116585 | 55116582 | + |
| SEQ ID NO 925 | AGCAGGACCTGCCTGGGAAG | GGG | chr19 | 55116567 | 55116586 | 55116583 | + |
| SEQ ID NO 926 | ACCTGCCTGGGAAGGGGAAA | CAG | chr19 | 55116573 | 55116592 | 55116589 | + |
| SEQ ID NO 927 | TGCCTGGGAAGGGGAAACAG | TGG | chr19 | 55116576 | 55116595 | 55116592 | + |
| SEQ ID NO 928 | GCCTGGGAAGGGGAAACAGT | GGG | chr19 | 55116577 | 55116596 | 55116593 | + |
| SEQ ID NO 929 | GGGAAGGGGAAACAGTGGGC | CAG | chr19 | 55116581 | 55116600 | 55116597 | + |
| SEQ ID NO 930 | GAAGGGGAAACAGTGGGCCA | GAG | chr19 | 55116583 | 55116602 | 55116599 | + |

Figure 1 (Cont'd)

| | | | | | | | |
|---|---|---|---|---|---|---|---|
| SEQ ID NO 931 | AAGGGGAAACAGTGGGCCAG | AGG | chr19 | 55116584 | 55116603 | 55116600 | + |
| SEQ ID NO 932 | GGGAAACAGTGGGCCAGAGG | CGG | chr19 | 55116587 | 55116606 | 55116603 | + |
| SEQ ID NO 933 | ACAGTGGGCCAGAGGCGGCG | CAG | chr19 | 55116592 | 55116611 | 55116608 | + |
| SEQ ID NO 934 | GTGGGCCAGAGGCGGCGCAG | AAG | chr19 | 55116595 | 55116614 | 55116611 | + |
| SEQ ID NO 935 | GCCAGAGGCGGCGCAGAAGC | CAG | chr19 | 55116599 | 55116618 | 55116615 | + |
| SEQ ID NO 936 | AGAGGCGGCGCAGAAGCCAG | TAG | chr19 | 55116602 | 55116621 | 55116618 | + |
| SEQ ID NO 937 | AGGCGGCGCAGAAGCCAGTA | GAG | chr19 | 55116604 | 55116623 | 55116620 | + |
| SEQ ID NO 938 | GCAGAAGCCAGTAGAGCTCA | AAG | chr19 | 55116611 | 55116630 | 55116627 | + |
| SEQ ID NO 939 | GAAGCCAGTAGAGCTCAAAG | TGG | chr19 | 55116614 | 55116633 | 55116630 | + |
| SEQ ID NO 940 | CAGTAGAGCTCAAAGTGGTC | CGG | chr19 | 55116619 | 55116638 | 55116635 | + |
| SEQ ID NO 941 | AGCTCAAAGTGGTCCGGACT | CAG | chr19 | 55116625 | 55116644 | 55116641 | + |
| SEQ ID NO 942 | GCTCAAAGTGGTCCGGACTC | AGG | chr19 | 55116626 | 55116645 | 55116642 | + |
| SEQ ID NO 943 | TCAAAGTGGTCCGGACTCAG | GAG | chr19 | 55116628 | 55116647 | 55116644 | + |
| SEQ ID NO 944 | AAAGTGGTCCGGACTCAGGA | GAG | chr19 | 55116630 | 55116649 | 55116646 | + |
| SEQ ID NO 945 | AGTGGTCCGGACTCAGGAGA | GAG | chr19 | 55116632 | 55116651 | 55116648 | + |
| SEQ ID NO 946 | GTCCGGACTCAGGAGAGAGA | CGG | chr19 | 55116636 | 55116655 | 55116652 | + |
| SEQ ID NO 947 | CGGACTCAGGAGAGAGACGG | CAG | chr19 | 55116639 | 55116658 | 55116655 | + |
| SEQ ID NO 948 | CAGGAGAGAGACGGCAGCGT | TAG | chr19 | 55116645 | 55116664 | 55116661 | + |
| SEQ ID NO 949 | GGAGAGAGACGGCAGCGTTA | GAG | chr19 | 55116647 | 55116666 | 55116663 | + |
| SEQ ID NO 950 | GAGAGACGGCAGCGTTAG | AGG | chr19 | 55116648 | 55116667 | 55116664 | + |
| SEQ ID NO 951 | AGAGAGACGGCAGCGTTAGA | GGG | chr19 | 55116649 | 55116668 | 55116665 | + |
| SEQ ID NO 952 | GAGACGGCAGCGTTAGAGGG | CAG | chr19 | 55116652 | 55116671 | 55116668 | + |
| SEQ ID NO 953 | GACGGCAGCGTTAGAGGGCA | GAG | chr19 | 55116654 | 55116673 | 55116670 | + |
| SEQ ID NO 954 | AGCGTTAGAGGGCAGAGTTC | CGG | chr19 | 55116660 | 55116679 | 55116676 | + |
| SEQ ID NO 955 | GTTAGAGGGCAGAGTTCCGG | CGG | chr19 | 55116663 | 55116682 | 55116679 | + |
| SEQ ID NO 956 | AGGGCAGAGTTCCGGCGGCA | CAG | chr19 | 55116668 | 55116687 | 55116684 | + |
| SEQ ID NO 957 | CAGAGTTCCGGCGGCACAGC | AAG | chr19 | 55116672 | 55116691 | 55116688 | + |
| SEQ ID NO 958 | AGAGTTCCGGCGGCACAGCA | AGG | chr19 | 55116673 | 55116692 | 55116689 | + |
| SEQ ID NO 959 | GAGTTCCGGCGGCACAGCAA | GGG | chr19 | 55116674 | 55116693 | 55116690 | + |
| SEQ ID NO 960 | GGCGGCACAGCAAGGGCACT | CGG | chr19 | 55116681 | 55116700 | 55116697 | + |
| SEQ ID NO 961 | GCGGCACAGCAAGGGCACTC | GGG | chr19 | 55116682 | 55116701 | 55116698 | + |
| SEQ ID NO 962 | CGGCACAGCAAGGGCACTCG | GGG | chr19 | 55116683 | 55116702 | 55116699 | + |
| SEQ ID NO 963 | GGCACAGCAAGGGCACTCGG | GGG | chr19 | 55116684 | 55116703 | 55116700 | + |
| SEQ ID NO 964 | CAGCAAGGGCACTCGGGGGC | GAG | chr19 | 55116688 | 55116707 | 55116704 | + |
| SEQ ID NO 965 | GCAAGGGCACTCGGGGGCGA | GAG | chr19 | 55116690 | 55116709 | 55116706 | + |
| SEQ ID NO 966 | CAAGGGCACTCGGGGGCGAG | AGG | chr19 | 55116691 | 55116710 | 55116707 | + |
| SEQ ID NO 967 | AGGGCACTCGGGGGCGAGAG | GAG | chr19 | 55116693 | 55116712 | 55116709 | + |
| SEQ ID NO 968 | GGGCACTCGGGGGCGAGAGG | AGG | chr19 | 55116694 | 55116713 | 55116710 | + |
| SEQ ID NO 969 | GGCACTCGGGGGCGAGAGGA | GGG | chr19 | 55116695 | 55116714 | 55116711 | + |
| SEQ ID NO 970 | ACTCGGGGGCGAGAGGAGGG | CAG | chr19 | 55116698 | 55116717 | 55116714 | + |
| SEQ ID NO 971 | GGCGAGAGGAGGGCAGCGCA | AAG | chr19 | 55116705 | 55116724 | 55116721 | + |
| SEQ ID NO 972 | AGGGCAGCGCAAAGTGACAA | TGG | chr19 | 55116714 | 55116733 | 55116730 | + |
| SEQ ID NO 973 | CAGCGCAAAGTGACAATGGC | CAG | chr19 | 55116718 | 55116737 | 55116734 | + |
| SEQ ID NO 974 | AGCGCAAAGTGACAATGGCC | AGG | chr19 | 55116719 | 55116738 | 55116735 | + |
| SEQ ID NO 975 | GCGCAAAGTGACAATGGCCA | GGG | chr19 | 55116720 | 55116739 | 55116736 | + |
| SEQ ID NO 976 | AAAGTGACAATGGCCAGGGC | CAG | chr19 | 55116724 | 55116743 | 55116740 | + |
| SEQ ID NO 977 | AAGTGACAATGGCCAGGGCC | AGG | chr19 | 55116725 | 55116744 | 55116741 | + |
| SEQ ID NO 978 | TGACAATGGCCAGGGCCAGG | CAG | chr19 | 55116728 | 55116747 | 55116744 | + |
| SEQ ID NO 979 | AATGGCCAGGGCCAGGCAGA | TAG | chr19 | 55116732 | 55116751 | 55116748 | + |

Figure 1 (Cont'd)

| SEQ ID NO 980 | CCAGGGCCAGGCAGATAGAC | CAG | chr19 | 55116737 | 55116756 | 55116753 | + |
| --- | --- | --- | --- | --- | --- | --- | --- |
| SEQ ID NO 981 | CCAGGCAGATAGACCAGACT | GAG | chr19 | 55116743 | 55116762 | 55116759 | + |
| SEQ ID NO 982 | AGATAGACCAGACTGAGCTA | TGG | chr19 | 55116749 | 55116768 | 55116765 | + |
| SEQ ID NO 983 | GATAGACCAGACTGAGCTAT | GGG | chr19 | 55116750 | 55116769 | 55116766 | + |
| SEQ ID NO 984 | TAGACCAGACTGAGCTATGG | GAG | chr19 | 55116752 | 55116771 | 55116768 | + |
| SEQ ID NO 985 | CCAGACTGAGCTATGGGAGC | TGG | chr19 | 55116756 | 55116775 | 55116772 | + |
| SEQ ID NO 986 | CTGAGCTATGGGAGCTGGCT | CAG | chr19 | 55116761 | 55116780 | 55116777 | + |
| SEQ ID NO 987 | TGAGCTATGGGAGCTGGCTC | AGG | chr19 | 55116762 | 55116781 | 55116778 | + |
| SEQ ID NO 988 | TATGGGAGCTGGCTCAGGTT | CAG | chr19 | 55116767 | 55116786 | 55116783 | + |
| SEQ ID NO 989 | ATGGGAGCTGGCTCAGGTTC | AGG | chr19 | 55116768 | 55116787 | 55116784 | + |
| SEQ ID NO 990 | GGGAGCTGGCTCAGGTTCAG | GAG | chr19 | 55116770 | 55116789 | 55116786 | + |
| SEQ ID NO 991 | GAGCTGGCTCAGGTTCAGGA | GAG | chr19 | 55116772 | 55116791 | 55116788 | + |
| SEQ ID NO 992 | AGCTGGCTCAGGTTCAGGAG | AGG | chr19 | 55116773 | 55116792 | 55116789 | + |
| SEQ ID NO 993 | GCTGGCTCAGGTTCAGGAGA | GGG | chr19 | 55116774 | 55116793 | 55116790 | + |
| SEQ ID NO 994 | GGCTCAGGTTCAGGAGAGGG | CAG | chr19 | 55116777 | 55116796 | 55116793 | + |
| SEQ ID NO 995 | GCTCAGGTTCAGGAGAGGGC | AGG | chr19 | 55116778 | 55116797 | 55116794 | + |
| SEQ ID NO 996 | CTCAGGTTCAGGAGAGGGCA | GGG | chr19 | 55116779 | 55116798 | 55116795 | + |
| SEQ ID NO 997 | AGGTTCAGGAGAGGGCAGGG | CAG | chr19 | 55116782 | 55116801 | 55116798 | + |
| SEQ ID NO 998 | GGTTCAGGAGAGGGCAGGGC | AGG | chr19 | 55116783 | 55116802 | 55116799 | + |
| SEQ ID NO 999 | GTTCAGGAGAGGGCAGGGCA | GGG | chr19 | 55116784 | 55116803 | 55116800 | + |
| SEQ ID NO 1000 | CAGGAGAGGGCAGGGCAGGG | AAG | chr19 | 55116787 | 55116806 | 55116803 | + |
| SEQ ID NO 1001 | AGGAGAGGGCAGGGCAGGGA | AGG | chr19 | 55116788 | 55116807 | 55116804 | + |
| SEQ ID NO 1002 | GAGAGGGCAGGGCAGGGAAG | GAG | chr19 | 55116790 | 55116809 | 55116806 | + |
| SEQ ID NO 1003 | GCAGGGCAGGGAAGGAGACA | AAG | chr19 | 55116796 | 55116815 | 55116812 | + |
| SEQ ID NO 1004 | GCAGGGAAGGAGACAAAGTC | CAG | chr19 | 55116801 | 55116820 | 55116817 | + |
| SEQ ID NO 1005 | CAGGGAAGGAGACAAAGTCC | AGG | chr19 | 55116802 | 55116821 | 55116818 | + |
| SEQ ID NO 1006 | AAGGAGACAAAGTCCAGGAC | CGG | chr19 | 55116807 | 55116826 | 55116823 | + |
| SEQ ID NO 1007 | AGACAAAGTCCAGGACCGGC | TGG | chr19 | 55116811 | 55116830 | 55116827 | + |
| SEQ ID NO 1008 | ACAAAGTCCAGGACCGGCTG | GAG | chr19 | 55116813 | 55116832 | 55116829 | + |
| SEQ ID NO 1009 | CAAAGTCCAGGACCGGCTGG | AGG | chr19 | 55116814 | 55116833 | 55116830 | + |
| SEQ ID NO 1010 | AAAGTCCAGGACCGGCTGGA | GGG | chr19 | 55116815 | 55116834 | 55116831 | + |
| SEQ ID NO 1011 | AAGTCCAGGACCGGCTGGAG | GGG | chr19 | 55116816 | 55116835 | 55116832 | + |
| SEQ ID NO 1012 | CGGCTGGAGGGGCTCAACAT | CGG | chr19 | 55116827 | 55116846 | 55116843 | + |
| SEQ ID NO 1013 | CTGGAGGGGCTCAACATCGG | AAG | chr19 | 55116830 | 55116849 | 55116846 | + |
| SEQ ID NO 1014 | GGAGGGGCTCAACATCGGAA | GAG | chr19 | 55116832 | 55116851 | 55116848 | + |
| SEQ ID NO 1015 | GAGGGGCTCAACATCGGAAG | AGG | chr19 | 55116833 | 55116852 | 55116849 | + |
| SEQ ID NO 1016 | AGGGGCTCAACATCGGAAGA | GGG | chr19 | 55116834 | 55116853 | 55116850 | + |
| SEQ ID NO 1017 | GGGGCTCAACATCGGAAGAG | GGG | chr19 | 55116835 | 55116854 | 55116851 | + |
| SEQ ID NO 1018 | GCTCAACATCGGAAGAGGGG | AAG | chr19 | 55116838 | 55116857 | 55116854 | + |
| SEQ ID NO 1019 | ACATCGGAAGAGGGGAAGTC | GAG | chr19 | 55116843 | 55116862 | 55116859 | + |
| SEQ ID NO 1020 | CATCGGAAGAGGGGAAGTCG | AGG | chr19 | 55116844 | 55116863 | 55116860 | + |
| SEQ ID NO 1021 | ATCGGAAGAGGGGAAGTCGA | GGG | chr19 | 55116845 | 55116864 | 55116861 | + |
| SEQ ID NO 1022 | CGGAAGAGGGGAAGTCGAGG | GAG | chr19 | 55116847 | 55116866 | 55116863 | + |
| SEQ ID NO 1023 | GGAAGAGGGGAAGTCGAGGG | AGG | chr19 | 55116848 | 55116867 | 55116864 | + |
| SEQ ID NO 1024 | GAAGAGGGGAAGTCGAGGGA | GGG | chr19 | 55116849 | 55116868 | 55116865 | + |
| SEQ ID NO 1025 | AGGGGAAGTCGAGGGAGGGA | TGG | chr19 | 55116853 | 55116872 | 55116869 | + |
| SEQ ID NO 1026 | GAAGTCGAGGGAGGGATGGT | AAG | chr19 | 55116857 | 55116876 | 55116873 | + |
| SEQ ID NO 1027 | AAGTCGAGGGAGGGATGGTA | AGG | chr19 | 55116858 | 55116877 | 55116874 | + |
| SEQ ID NO 1028 | GTCGAGGGAGGGATGGTAAG | GAG | chr19 | 55116860 | 55116879 | 55116876 | + |

Figure 1 (Cont'd)

| | | | | | | | |
|---|---|---|---|---|---|---|---|
| SEQ ID NO 1029 | TCGAGGGAGGGATGGTAAGG | AGG | chr19 | 55116861 | 55116880 | 55116877 | + |
| SEQ ID NO 1030 | GGATGGTAAGGAGGACTGCA | TGG | chr19 | 55116870 | 55116889 | 55116886 | + |
| SEQ ID NO 1031 | GATGGTAAGGAGGACTGCAT | GGG | chr19 | 55116871 | 55116890 | 55116887 | + |
| SEQ ID NO 1032 | GTAAGGAGGACTGCATGGGT | CAG | chr19 | 55116875 | 55116894 | 55116891 | + |
| SEQ ID NO 1033 | GAGGACTGCATGGGTCAGCA | CAG | chr19 | 55116880 | 55116899 | 55116896 | + |
| SEQ ID NO 1034 | AGGACTGCATGGGTCAGCAC | AGG | chr19 | 55116881 | 55116900 | 55116897 | + |
| SEQ ID NO 1035 | TGGGTCAGCACAGGCTGCCA | AAG | chr19 | 55116890 | 55116909 | 55116906 | + |
| SEQ ID NO 1036 | TCAGCACAGGCTGCCAAAGC | CAG | chr19 | 55116894 | 55116913 | 55116910 | + |
| SEQ ID NO 1037 | CAGCACAGGCTGCCAAAGCC | AGG | chr19 | 55116895 | 55116914 | 55116911 | + |
| SEQ ID NO 1038 | AGCACAGGCTGCCAAAGCCA | GGG | chr19 | 55116896 | 55116915 | 55116912 | + |
| SEQ ID NO 1039 | CAGGCTGCCAAAGCCAGGGC | CAG | chr19 | 55116900 | 55116919 | 55116916 | + |
| SEQ ID NO 1040 | GCCAAAGCCAGGGCCAGTTA | AAG | chr19 | 55116906 | 55116925 | 55116922 | + |
| SEQ ID NO 1041 | CAGTTAAAGCGACTCCAATG | CGG | chr19 | 55116920 | 55116939 | 55116936 | + |
| SEQ ID NO 1042 | TTAAAGCGACTCCAATGCGG | AAG | chr19 | 55116923 | 55116942 | 55116939 | + |
| SEQ ID NO 1043 | AAAGCGACTCCAATGCGGAA | GAG | chr19 | 55116925 | 55116944 | 55116941 | + |
| SEQ ID NO 1044 | AGCGACTCCAATGCGGAAGA | GAG | chr19 | 55116927 | 55116946 | 55116943 | + |
| SEQ ID NO 1045 | GACTCCAATGCGGAAGAGAG | TAG | chr19 | 55116930 | 55116949 | 55116946 | + |
| SEQ ID NO 1046 | ACTCCAATGCGGAAGAGAGT | AGG | chr19 | 55116931 | 55116950 | 55116947 | + |
| SEQ ID NO 1047 | ATGCGGAAGAGAGTAGGTCG | AAG | chr19 | 55116937 | 55116956 | 55116953 | + |
| SEQ ID NO 1048 | TGCGGAAGAGAGTAGGTCGA | AGG | chr19 | 55116938 | 55116957 | 55116954 | + |
| SEQ ID NO 1049 | GCGGAAGAGAGTAGGTCGAA | GGG | chr19 | 55116939 | 55116958 | 55116955 | + |
| SEQ ID NO 1050 | CGGAAGAGAGTAGGTCGAAG | GGG | chr19 | 55116940 | 55116959 | 55116956 | + |
| SEQ ID NO 1051 | GAGAGTAGGTCGAAGGGGAA | TGG | chr19 | 55116945 | 55116964 | 55116961 | + |
| SEQ ID NO 1052 | GTAGGTCGAAGGGGAATGGT | AAG | chr19 | 55116949 | 55116968 | 55116965 | + |
| SEQ ID NO 1053 | TAGGTCGAAGGGGAATGGTA | AGG | chr19 | 55116950 | 55116969 | 55116966 | + |
| SEQ ID NO 1054 | GGTCGAAGGGGAATGGTAAG | GAG | chr19 | 55116952 | 55116971 | 55116968 | + |
| SEQ ID NO 1055 | GTCGAAGGGGAATGGTAAGG | AGG | chr19 | 55116953 | 55116972 | 55116969 | + |
| SEQ ID NO 1056 | AGGGGAATGGTAAGGAGGCC | TGG | chr19 | 55116958 | 55116977 | 55116974 | + |
| SEQ ID NO 1057 | GGGGAATGGTAAGGAGGCCT | GGG | chr19 | 55116959 | 55116978 | 55116975 | + |
| SEQ ID NO 1058 | GGGAATGGTAAGGAGGCCTG | GGG | chr19 | 55116960 | 55116979 | 55116976 | + |
| SEQ ID NO 1059 | AATGGTAAGGAGGCCTGGGG | CAG | chr19 | 55116963 | 55116982 | 55116979 | + |
| SEQ ID NO 1060 | TGGTAAGGAGGCCTGGGGCA | GAG | chr19 | 55116965 | 55116984 | 55116981 | + |
| SEQ ID NO 1061 | TAAGGAGGCCTGGGGCAGAG | TGG | chr19 | 55116968 | 55116987 | 55116984 | + |
| SEQ ID NO 1062 | GAGGCCTGGGGCAGAGTGGT | CAG | chr19 | 55116972 | 55116991 | 55116988 | + |
| SEQ ID NO 1063 | CTGGGGCAGAGTGGTCAGCA | CAG | chr19 | 55116977 | 55116996 | 55116993 | + |
| SEQ ID NO 1064 | GGGGCAGAGTGGTCAGCACA | GAG | chr19 | 55116979 | 55116998 | 55116995 | + |
| SEQ ID NO 1065 | GCAGAGTGGTCAGCACAGAG | TGG | chr19 | 55116982 | 55117001 | 55116998 | + |
| SEQ ID NO 1066 | GTGGTCAGCACAGAGTGGCT | AAG | chr19 | 55116987 | 55117006 | 55117003 | + |
| SEQ ID NO 1067 | CAGCACAGAGTGGCTAAGCC | CAG | chr19 | 55116992 | 55117011 | 55117008 | + |
| SEQ ID NO 1068 | AGCACAGAGTGGCTAAGCCC | AGG | chr19 | 55116993 | 55117012 | 55117009 | + |
| SEQ ID NO 1069 | GCACAGAGTGGCTAAGCCCA | GGG | chr19 | 55116994 | 55117013 | 55117010 | + |
| SEQ ID NO 1070 | AGAGTGGCTAAGCCCAGGGC | CAG | chr19 | 55116998 | 55117017 | 55117014 | + |
| SEQ ID NO 1071 | GCTAAGCCCAGGGCCAGTTG | AAG | chr19 | 55117004 | 55117023 | 55117020 | + |
| SEQ ID NO 1072 | AAGCCCAGGGCCAGTTGAAG | CGG | chr19 | 55117007 | 55117026 | 55117023 | + |
| SEQ ID NO 1073 | CAGTTGAAGCGGCTCCAATT | CGG | chr19 | 55117018 | 55117037 | 55117034 | + |
| SEQ ID NO 1074 | TTGAAGCGGCTCCAATTCGG | AAG | chr19 | 55117021 | 55117040 | 55117037 | + |
| SEQ ID NO 1075 | AAGCGGCTCCAATTCGGAAG | TGG | chr19 | 55117024 | 55117043 | 55117040 | + |
| SEQ ID NO 1076 | AGCGGCTCCAATTCGGAAGT | GGG | chr19 | 55117025 | 55117044 | 55117041 | + |
| SEQ ID NO 1077 | GCGGCTCCAATTCGGAAGTG | GGG | chr19 | 55117026 | 55117045 | 55117042 | + |

Figure 1 (Cont'd)

| SEQ ID NO 1078 | GCTCCAATTCGGAAGTGGGG | TGG | chr19 | 55117029 | 55117048 | 55117045 | + |
| SEQ ID NO 1079 | ATTCGGAAGTGGGGTGGTCG | AAG | chr19 | 55117035 | 55117054 | 55117051 | + |
| SEQ ID NO 1080 | TTCGGAAGTGGGGTGGTCGA | AGG | chr19 | 55117036 | 55117055 | 55117052 | + |
| SEQ ID NO 1081 | TCGGAAGTGGGGTGGTCGAA | GGG | chr19 | 55117037 | 55117056 | 55117053 | + |
| SEQ ID NO 1082 | CGGAAGTGGGGTGGTCGAAG | GGG | chr19 | 55117038 | 55117057 | 55117054 | + |
| SEQ ID NO 1083 | GTGGGGTGGTCGAAGGGGAA | TGG | chr19 | 55117043 | 55117062 | 55117059 | + |
| SEQ ID NO 1084 | GGTGGTCGAAGGGGAATGGT | AAG | chr19 | 55117047 | 55117066 | 55117063 | + |
| SEQ ID NO 1085 | GTGGTCGAAGGGGAATGGTA | AGG | chr19 | 55117048 | 55117067 | 55117064 | + |
| SEQ ID NO 1086 | TGGTCGAAGGGGAATGGTAA | GGG | chr19 | 55117049 | 55117068 | 55117065 | + |
| SEQ ID NO 1087 | GGTCGAAGGGGAATGGTAAG | GGG | chr19 | 55117050 | 55117069 | 55117066 | + |
| SEQ ID NO 1088 | GTCGAAGGGGAATGGTAAGG | GGG | chr19 | 55117051 | 55117070 | 55117067 | + |
| SEQ ID NO 1089 | AGGGGAATGGTAAGGGGGAC | TGG | chr19 | 55117056 | 55117075 | 55117072 | + |
| SEQ ID NO 1090 | GGGGAATGGTAAGGGGGACT | GGG | chr19 | 55117057 | 55117076 | 55117073 | + |
| SEQ ID NO 1091 | AATGGTAAGGGGACTGGGA | CGG | chr19 | 55117061 | 55117080 | 55117077 | + |
| SEQ ID NO 1092 | ATGGTAAGGGGACTGGGAC | GGG | chr19 | 55117062 | 55117081 | 55117078 | + |
| SEQ ID NO 1093 | TGGTAAGGGGACTGGGACG | GGG | chr19 | 55117063 | 55117082 | 55117079 | + |
| SEQ ID NO 1094 | GGGGACTGGGACGGGGTGT | CAG | chr19 | 55117069 | 55117088 | 55117085 | + |
| SEQ ID NO 1095 | ACTGGGACGGGGTGTCAGCA | TAG | chr19 | 55117074 | 55117093 | 55117090 | + |
| SEQ ID NO 1096 | CTGGGACGGGGTGTCAGCAT | AGG | chr19 | 55117075 | 55117094 | 55117091 | + |
| SEQ ID NO 1097 | TGGGACGGGGTGTCAGCATA | GGG | chr19 | 55117076 | 55117095 | 55117092 | + |
| SEQ ID NO 1098 | GACGGGGTGTCAGCATAGGG | TGG | chr19 | 55117079 | 55117098 | 55117095 | + |
| SEQ ID NO 1099 | GGTGTCAGCATAGGGTGGCA | AAG | chr19 | 55117084 | 55117103 | 55117100 | + |
| SEQ ID NO 1100 | CAGCATAGGGTGGCAAAGCC | CAG | chr19 | 55117089 | 55117108 | 55117105 | + |
| SEQ ID NO 1101 | AGCATAGGGTGGCAAAGCCC | AGG | chr19 | 55117090 | 55117109 | 55117106 | + |
| SEQ ID NO 1102 | GCATAGGGTGGCAAAGCCCA | GGG | chr19 | 55117091 | 55117110 | 55117107 | + |
| SEQ ID NO 1103 | AGGGTGGCAAAGCCCAGGGC | CAG | chr19 | 55117095 | 55117114 | 55117111 | + |
| SEQ ID NO 1104 | GGGTGGCAAAGCCCAGGGCC | AGG | chr19 | 55117096 | 55117115 | 55117112 | + |
| SEQ ID NO 1105 | AAGCCCAGGGCCAGGAACGA | CGG | chr19 | 55117104 | 55117123 | 55117120 | + |
| SEQ ID NO 1106 | AGCCCAGGGCCAGGAACGAC | GGG | chr19 | 55117105 | 55117124 | 55117121 | + |
| SEQ ID NO 1107 | GCCCAGGGCCAGGAACGACG | GGG | chr19 | 55117106 | 55117125 | 55117122 | + |
| SEQ ID NO 1108 | CAGGGCCAGGAACGACGGGG | CGG | chr19 | 55117109 | 55117128 | 55117125 | + |
| SEQ ID NO 1109 | CAGGAACGACGGGGCGGATC | GAG | chr19 | 55117115 | 55117134 | 55117131 | + |
| SEQ ID NO 1110 | ACGACGGGGCGGATCGAGAC | TGG | chr19 | 55117120 | 55117139 | 55117136 | + |
| SEQ ID NO 1111 | GGGCGGATCGAGACTGGCAA | CGG | chr19 | 55117126 | 55117145 | 55117142 | + |
| SEQ ID NO 1112 | GGCGGATCGAGACTGGCAAC | GGG | chr19 | 55117127 | 55117146 | 55117143 | + |
| SEQ ID NO 1113 | GCGGATCGAGACTGGCAACG | GGG | chr19 | 55117128 | 55117147 | 55117144 | + |
| SEQ ID NO 1114 | GATCGAGACTGGCAACGGGG | AAG | chr19 | 55117131 | 55117150 | 55117147 | + |
| SEQ ID NO 1115 | ATCGAGACTGGCAACGGGGA | AGG | chr19 | 55117132 | 55117151 | 55117148 | + |
| SEQ ID NO 1116 | CGAGACTGGCAACGGGGAAG | GAG | chr19 | 55117134 | 55117153 | 55117150 | + |
| SEQ ID NO 1117 | GAGACTGGCAACGGGGAAGG | AGG | chr19 | 55117135 | 55117154 | 55117151 | + |
| SEQ ID NO 1118 | AACGGGGAAGGAGGATGCCC | CAG | chr19 | 55117144 | 55117163 | 55117160 | + |
| SEQ ID NO 1119 | ACGGGGAAGGAGGATGCCCC | AGG | chr19 | 55117145 | 55117164 | 55117161 | + |
| SEQ ID NO 1120 | GGGAAGGAGGATGCCCCAGG | TGG | chr19 | 55117148 | 55117167 | 55117164 | + |
| SEQ ID NO 1121 | GGAGGATGCCCCAGGTGGCG | CAG | chr19 | 55117153 | 55117172 | 55117169 | + |
| SEQ ID NO 1122 | GGATGCCCCAGGTGGCGCAG | CAG | chr19 | 55117156 | 55117175 | 55117172 | + |
| SEQ ID NO 1123 | ATGCCCCAGGTGGCGCAGCA | GAG | chr19 | 55117158 | 55117177 | 55117174 | + |
| SEQ ID NO 1124 | TGCCCCAGGTGGCGCAGCAG | AGG | chr19 | 55117159 | 55117178 | 55117175 | + |
| SEQ ID NO 1125 | GCCCCAGGTGGCGCAGCAGA | GGG | chr19 | 55117160 | 55117179 | 55117176 | + |
| SEQ ID NO 1126 | CCAGGTGGCGCAGCAGAGGG | TGG | chr19 | 55117163 | 55117182 | 55117179 | + |

Figure 1 (Cont'd)

| | | | | | | | |
|---|---|---|---|---|---|---|---|
| SEQ ID NO 1127 | GGCGCAGCAGAGGGTGGACC | TGG | chr19 | 55117169 | 55117188 | 55117185 | + |
| SEQ ID NO 1128 | GCAGAGGGTGGACCTGGCCC | CGG | chr19 | 55117175 | 55117194 | 55117191 | + |
| SEQ ID NO 1129 | CAGAGGGTGGACCTGGCCCC | GGG | chr19 | 55117176 | 55117195 | 55117192 | + |
| SEQ ID NO 1130 | GAGGGTGGACCTGGCCCCGG | GAG | chr19 | 55117178 | 55117197 | 55117194 | + |
| SEQ ID NO 1131 | GACCTGGCCCCGGGAGACGC | CGG | chr19 | 55117185 | 55117204 | 55117201 | + |
| SEQ ID NO 1132 | ACCTGGCCCCGGGAGACGCC | GGG | chr19 | 55117186 | 55117205 | 55117202 | + |
| SEQ ID NO 1133 | TGGCCCCGGGAGACGCCGGG | CGG | chr19 | 55117189 | 55117208 | 55117205 | + |
| SEQ ID NO 1134 | GGCCCCGGGAGACGCCGGGC | GGG | chr19 | 55117190 | 55117209 | 55117206 | + |
| SEQ ID NO 1135 | GCCCCGGGAGACGCCGGGCG | GGG | chr19 | 55117191 | 55117210 | 55117207 | + |
| SEQ ID NO 1136 | CCCCGGGAGACGCCGGGCGG | GGG | chr19 | 55117192 | 55117211 | 55117208 | + |
| SEQ ID NO 1137 | CCCGGGAGACGCCGGGCGGG | GGG | chr19 | 55117193 | 55117212 | 55117209 | + |
| SEQ ID NO 1138 | CCGGGCGGGGGCGCTGACC | TGG | chr19 | 55117204 | 55117223 | 55117220 | + |
| SEQ ID NO 1139 | CGGGGGCGCTGACCTGGTG | CAG | chr19 | 55117209 | 55117228 | 55117225 | + |
| SEQ ID NO 1140 | GGGGGCGCTGACCTGGTGC | AGG | chr19 | 55117210 | 55117229 | 55117226 | + |
| SEQ ID NO 1141 | GGGGCGCTGACCTGGTGCA | GGG | chr19 | 55117211 | 55117230 | 55117227 | + |
| SEQ ID NO 1142 | GTGCAGGGCGCTGATACCGT | CGG | chr19 | 55117226 | 55117245 | 55117242 | + |
| SEQ ID NO 1143 | GGCGCTGATACCGTCGGCGT | TGG | chr19 | 55117232 | 55117251 | 55117248 | + |
| SEQ ID NO 1144 | GCTGATACCGTCGGCGTTGG | TGG | chr19 | 55117235 | 55117254 | 55117251 | + |
| SEQ ID NO 1145 | TGATACCGTCGGCGTTGGTG | GAG | chr19 | 55117237 | 55117256 | 55117253 | + |
| SEQ ID NO 1146 | CCGTCGGCGTTGGTGGAGTC | CAG | chr19 | 55117242 | 55117261 | 55117258 | + |
| SEQ ID NO 1147 | GGCGTTGGTGGAGTCCAGCA | CGG | chr19 | 55117247 | 55117266 | 55117263 | + |
| SEQ ID NO 1148 | TGGTGGAGTCCAGCACGGCG | CGG | chr19 | 55117252 | 55117271 | 55117268 | + |
| SEQ ID NO 1149 | GGTGGAGTCCAGCACGGCGC | GGG | chr19 | 55117253 | 55117272 | 55117269 | + |
| SEQ ID NO 1150 | GGAGTCCAGCACGGCGCGGG | CGG | chr19 | 55117256 | 55117275 | 55117272 | + |
| SEQ ID NO 1151 | GAGTCCAGCACGGCGCGGGC | GGG | chr19 | 55117257 | 55117276 | 55117273 | + |
| SEQ ID NO 1152 | TCCAGCACGGCGCGGGCGGG | CGG | chr19 | 55117260 | 55117279 | 55117276 | + |
| SEQ ID NO 1153 | AGCACGGCGCGGGCGGGCGG | CGG | chr19 | 55117263 | 55117282 | 55117279 | + |
| SEQ ID NO 1154 | GGCGCGGGCGGGCGGCGGCG | CGG | chr19 | 55117268 | 55117287 | 55117284 | + |
| SEQ ID NO 1155 | GCGGGCGGGCGGCGGCGCGG | CGG | chr19 | 55117271 | 55117290 | 55117287 | + |
| SEQ ID NO 1156 | CGGGCGGGCGGCGGCGCGGC | GGG | chr19 | 55117272 | 55117291 | 55117288 | + |
| SEQ ID NO 1157 | GGGCGGGCGGCGGCGCGGCG | GGG | chr19 | 55117273 | 55117292 | 55117289 | + |
| SEQ ID NO 1158 | GGCGGCGGCGCGGCGGGGTC | GAG | chr19 | 55117278 | 55117297 | 55117294 | + |
| SEQ ID NO 1159 | CGGCGCGGCGGGGTCGAGCT | CGG | chr19 | 55117283 | 55117302 | 55117299 | + |
| SEQ ID NO 1160 | GGCGGGGTCGAGCTCGGCGC | CGG | chr19 | 55117289 | 55117308 | 55117305 | + |
| SEQ ID NO 1161 | GCGGGGTCGAGCTCGGCGCC | GGG | chr19 | 55117290 | 55117309 | 55117306 | + |
| SEQ ID NO 1162 | CGGGGTCGAGCTCGGCGCCG | GGG | chr19 | 55117291 | 55117310 | 55117307 | + |
| SEQ ID NO 1163 | GTCGAGCTCGGCGCCGGGGC | CAG | chr19 | 55117295 | 55117314 | 55117311 | + |
| SEQ ID NO 1164 | TCGAGCTCGGCGCCGGGGCC | AGG | chr19 | 55117296 | 55117315 | 55117312 | + |
| SEQ ID NO 1165 | CGAGCTCGGCGCCGGGGCCA | GGG | chr19 | 55117297 | 55117316 | 55117313 | + |
| SEQ ID NO 1166 | CTCGGCGCCGGGGCCAGGGT | CGG | chr19 | 55117301 | 55117320 | 55117317 | + |
| SEQ ID NO 1167 | GGCGCCGGGGCCAGGGTCGG | CGG | chr19 | 55117304 | 55117323 | 55117320 | + |
| SEQ ID NO 1168 | GGGCCAGGGTCGGCGGCGCG | CAG | chr19 | 55117311 | 55117330 | 55117327 | + |
| SEQ ID NO 1169 | GGGTCGGCGGCGCGCAGCAT | CAG | chr19 | 55117317 | 55117336 | 55117333 | + |
| SEQ ID NO 1170 | AGCATCAGACGCGCCTCGTC | CAG | chr19 | 55117332 | 55117351 | 55117348 | + |
| SEQ ID NO 1171 | GCATCAGACGCGCCTCGTCC | AGG | chr19 | 55117333 | 55117352 | 55117349 | + |
| SEQ ID NO 1172 | CGTCCAGGTCGCCGCCCGCA | CAG | chr19 | 55117348 | 55117367 | 55117364 | + |
| SEQ ID NO 1173 | GTCCAGGTCGCCGCCCGCAC | AGG | chr19 | 55117349 | 55117368 | 55117365 | + |
| SEQ ID NO 1174 | TCGCCGCCCGCACAGGCCGC | CAG | chr19 | 55117356 | 55117375 | 55117372 | + |
| SEQ ID NO 1175 | CGCCGCCCGCACAGGCCGCC | AGG | chr19 | 55117357 | 55117376 | 55117373 | + |

Figure 1 (Cont'd)

| | | | | | | | |
|---|---|---|---|---|---|---|---|
| SEQ ID NO 1176 | CGCACAGGCCGCCAGGAACT | CGG | chr19 | 55117364 | 55117383 | 55117380 | + |
| SEQ ID NO 1177 | ACAGGCCGCCAGGAACTCGG | CGG | chr19 | 55117367 | 55117386 | 55117383 | + |
| SEQ ID NO 1178 | GGAACTCGGCGGCGCGCTCG | AAG | chr19 | 55117378 | 55117397 | 55117394 | + |
| SEQ ID NO 1179 | ACTCGGCGGCGCGCTCGAAG | CGG | chr19 | 55117381 | 55117400 | 55117397 | + |
| SEQ ID NO 1180 | GGCGGCGCGCTCGAAGCGGA | CGG | chr19 | 55117385 | 55117404 | 55117401 | + |
| SEQ ID NO 1181 | CGCGCTCGAAGCGGACGGTG | CGG | chr19 | 55117390 | 55117409 | 55117406 | + |
| SEQ ID NO 1182 | GCGCTCGAAGCGGACGGTGC | GGG | chr19 | 55117391 | 55117410 | 55117407 | + |
| SEQ ID NO 1183 | CGAAGCGGACGGTGCGGGCG | CGG | chr19 | 55117396 | 55117415 | 55117412 | + |
| SEQ ID NO 1184 | GGTGCGGGCGCGGCGCTCTC | CGG | chr19 | 55117406 | 55117425 | 55117422 | + |
| SEQ ID NO 1185 | GTGCGGGCGCGGCGCTCTCC | GGG | chr19 | 55117407 | 55117426 | 55117423 | + |
| SEQ ID NO 1186 | TGCGGGCGCGGCGCTCTCCG | GGG | chr19 | 55117408 | 55117427 | 55117424 | + |
| SEQ ID NO 1187 | GGCGCGGCGCTCTCCGGGGC | CAG | chr19 | 55117412 | 55117431 | 55117428 | + |
| SEQ ID NO 1188 | GCGCGGCGCTCTCCGGGGCC | AGG | chr19 | 55117413 | 55117432 | 55117429 | + |
| SEQ ID NO 1189 | GCGCTCTCCGGGGCCAGGCT | CGG | chr19 | 55117418 | 55117437 | 55117434 | + |
| SEQ ID NO 1190 | GCCCGCGCCCCCCACTGCCG | CAG | chr19 | 55117446 | 55117465 | 55117462 | + |
| SEQ ID NO 1191 | GCTGCTCCCGTCGCCGCTCC | CGG | chr19 | 55117468 | 55117487 | 55117484 | + |
| SEQ ID NO 1192 | CTGCTCCCGTCGCCGCTCCC | GGG | chr19 | 55117469 | 55117488 | 55117485 | + |
| SEQ ID NO 1193 | CTCCCGTCGCCGCTCCCGGG | CAG | chr19 | 55117472 | 55117491 | 55117488 | + |
| SEQ ID NO 1194 | GCAGCCGCCGCCGCCGCCCC | CGG | chr19 | 55117491 | 55117510 | 55117507 | + |
| SEQ ID NO 1195 | CAGCCGCCGCCGCCGCCCCC | GGG | chr19 | 55117492 | 55117511 | 55117508 | + |
| SEQ ID NO 1196 | CGCCGCCGCCGCCCCCGGGC | CAG | chr19 | 55117496 | 55117515 | 55117512 | + |
| SEQ ID NO 1197 | GCCGCCCCGGGCCAGCCGC | CGG | chr19 | 55117503 | 55117522 | 55117519 | + |
| SEQ ID NO 1198 | CCGCCCCGGGCCAGCCGCC | GGG | chr19 | 55117504 | 55117523 | 55117520 | + |
| SEQ ID NO 1199 | AGCCGCCGGGCCATCCTCTC | CGG | chr19 | 55117517 | 55117536 | 55117533 | + |
| SEQ ID NO 1200 | CATCGCACCGCCCGCCCGCC | CAG | chr19 | 55117541 | 55117560 | 55117557 | + |
| SEQ ID NO 1201 | GCACCGCCCGCCCGCCCAGC | GAG | chr19 | 55117545 | 55117564 | 55117561 | + |
| SEQ ID NO 1202 | CGCCCGCCCGCCCAGCGAGC | GAG | chr19 | 55117549 | 55117568 | 55117565 | + |
| SEQ ID NO 1203 | CGCCCGCCCAGCGAGCGAGC | GAG | chr19 | 55117553 | 55117572 | 55117569 | + |
| SEQ ID NO 1204 | CCAGCGAGCGAGCGAGCGCC | GAG | chr19 | 55117560 | 55117579 | 55117576 | + |
| SEQ ID NO 1205 | TGGTGGCGGCGGTTGGGGCT | CGG | chr19 | 55117581 | 55117600 | 55117584 | - |
| SEQ ID NO 1206 | CTCGGCGCTCGCTCGCTCGC | TGG | chr19 | 55117563 | 55117582 | 55117566 | - |
| SEQ ID NO 1207 | TCGGCGCTCGCTCGCTCGCT | GGG | chr19 | 55117562 | 55117581 | 55117565 | - |
| SEQ ID NO 1208 | GCGCTCGCTCGCTCGCTGGG | CGG | chr19 | 55117559 | 55117578 | 55117562 | - |
| SEQ ID NO 1209 | CGCTCGCTCGCTCGCTGGGC | GGG | chr19 | 55117558 | 55117577 | 55117561 | - |
| SEQ ID NO 1210 | TCGCTCGCTCGCTGGGCGGG | CGG | chr19 | 55117555 | 55117574 | 55117558 | - |
| SEQ ID NO 1211 | CGCTCGCTCGCTGGGCGGGC | GGG | chr19 | 55117554 | 55117573 | 55117557 | - |
| SEQ ID NO 1212 | TCGCTCGCTGGGCGGGCGGG | CGG | chr19 | 55117551 | 55117570 | 55117554 | - |
| SEQ ID NO 1213 | CGGGCGGGCGGTGCGATGTC | CGG | chr19 | 55117539 | 55117558 | 55117542 | - |
| SEQ ID NO 1214 | GGCGGGCGGTGCGATGTCCG | GAG | chr19 | 55117537 | 55117556 | 55117540 | - |
| SEQ ID NO 1215 | CGGGCGGTGCGATGTCCGGA | GAG | chr19 | 55117535 | 55117554 | 55117538 | - |
| SEQ ID NO 1216 | GGGCGGTGCGATGTCCGGAG | AGG | chr19 | 55117534 | 55117553 | 55117537 | - |
| SEQ ID NO 1217 | GGTGCGATGTCCGGAGAGGA | TGG | chr19 | 55117530 | 55117549 | 55117533 | - |
| SEQ ID NO 1218 | GATGTCCGGAGAGGATGGCC | CGG | chr19 | 55117525 | 55117544 | 55117528 | - |
| SEQ ID NO 1219 | GTCCGGAGAGGATGGCCCGG | CGG | chr19 | 55117522 | 55117541 | 55117525 | - |
| SEQ ID NO 1220 | GGAGAGGATGGCCCGGCGGC | TGG | chr19 | 55117518 | 55117537 | 55117521 | - |
| SEQ ID NO 1221 | GGATGGCCCGGCGGCTGGCC | CGG | chr19 | 55117513 | 55117532 | 55117516 | - |
| SEQ ID NO 1222 | GATGGCCCGGCGGCTGGCCC | GGG | chr19 | 55117512 | 55117531 | 55117515 | - |
| SEQ ID NO 1223 | ATGGCCCGGCGGCTGGCCCG | GGG | chr19 | 55117511 | 55117530 | 55117514 | - |
| SEQ ID NO 1224 | TGGCCCGGCGGCTGGCCCGG | GGG | chr19 | 55117510 | 55117529 | 55117513 | - |

Figure 1 (Cont'd)

| | | | | | | | |
|---|---|---|---|---|---|---|---|
| SEQ ID NO 1225 | CCCGGCGGCTGGCCCGGGGG | CGG | chr19 | 55117507 | 55117526 | 55117510 | - |
| SEQ ID NO 1226 | GGCGGCTGGCCCGGGGGCGG | CGG | chr19 | 55117504 | 55117523 | 55117507 | - |
| SEQ ID NO 1227 | GGCTGGCCCGGGGGCGGCGG | CGG | chr19 | 55117501 | 55117520 | 55117504 | - |
| SEQ ID NO 1228 | TGGCCCGGGGGCGGCGGCGG | CGG | chr19 | 55117498 | 55117517 | 55117501 | - |
| SEQ ID NO 1229 | GGGCGGCGGCGGCGGCTGCC | CGG | chr19 | 55117490 | 55117509 | 55117493 | - |
| SEQ ID NO 1230 | GGCGGCGGCGGCGGCTGCCC | GGG | chr19 | 55117489 | 55117508 | 55117492 | - |
| SEQ ID NO 1231 | CGGCGGCGGCGGCTGCCCGG | GAG | chr19 | 55117487 | 55117506 | 55117490 | - |
| SEQ ID NO 1232 | CGGCGGCGGCTGCCCGGGAG | CGG | chr19 | 55117484 | 55117503 | 55117487 | - |
| SEQ ID NO 1233 | CGGCTGCCCGGGAGCGGCGA | CGG | chr19 | 55117478 | 55117497 | 55117481 | - |
| SEQ ID NO 1234 | GGCTGCCCGGGAGCGGCGAC | GGG | chr19 | 55117477 | 55117496 | 55117480 | - |
| SEQ ID NO 1235 | CTGCCCGGGAGCGGCGACGG | GAG | chr19 | 55117475 | 55117494 | 55117478 | - |
| SEQ ID NO 1236 | CCCGGGAGCGGCGACGGGAG | CAG | chr19 | 55117472 | 55117491 | 55117475 | - |
| SEQ ID NO 1237 | AGCGGCGACGGGAGCAGCTG | CGG | chr19 | 55117466 | 55117485 | 55117469 | - |
| SEQ ID NO 1238 | GGCGACGGGAGCAGCTGCGG | CAG | chr19 | 55117463 | 55117482 | 55117466 | - |
| SEQ ID NO 1239 | GACGGGAGCAGCTGCGGCAG | TGG | chr19 | 55117460 | 55117479 | 55117463 | - |
| SEQ ID NO 1240 | ACGGGAGCAGCTGCGGCAGT | GGG | chr19 | 55117459 | 55117478 | 55117462 | - |
| SEQ ID NO 1241 | CGGGAGCAGCTGCGGCAGTG | GGG | chr19 | 55117458 | 55117477 | 55117461 | - |
| SEQ ID NO 1242 | GGGAGCAGCTGCGGCAGTGG | GGG | chr19 | 55117457 | 55117476 | 55117460 | - |
| SEQ ID NO 1243 | GGAGCAGCTGCGGCAGTGGG | GGG | chr19 | 55117456 | 55117475 | 55117459 | - |
| SEQ ID NO 1244 | AGCTGCGGCAGTGGGGGGCG | CGG | chr19 | 55117451 | 55117470 | 55117454 | - |
| SEQ ID NO 1245 | GCTGCGGCAGTGGGGGGCGC | GGG | chr19 | 55117450 | 55117469 | 55117453 | - |
| SEQ ID NO 1246 | GCGGCAGTGGGGGGCGCGGG | CGG | chr19 | 55117447 | 55117466 | 55117450 | - |
| SEQ ID NO 1247 | CGGCAGTGGGGGGCGCGGGC | GGG | chr19 | 55117446 | 55117465 | 55117449 | - |
| SEQ ID NO 1248 | GGGGGGCGCGGGCGGCGCC | GAG | chr19 | 55117439 | 55117458 | 55117442 | - |
| SEQ ID NO 1249 | GCGCGGGCGGGCGCCGAGCC | TGG | chr19 | 55117434 | 55117453 | 55117437 | - |
| SEQ ID NO 1250 | GCGGGCGCCGAGCCTGGCCC | CGG | chr19 | 55117428 | 55117447 | 55117431 | - |
| SEQ ID NO 1251 | GGGCGCCGAGCCTGGCCCCG | GAG | chr19 | 55117426 | 55117445 | 55117429 | - |
| SEQ ID NO 1252 | GCGCCGAGCCTGGCCCCGGA | GAG | chr19 | 55117424 | 55117443 | 55117427 | - |
| SEQ ID NO 1253 | GCGCCCGCACCGTCCGCTTC | GAG | chr19 | 55117397 | 55117416 | 55117400 | - |
| SEQ ID NO 1254 | TCCGCTTCGAGCGCGCCGCC | GAG | chr19 | 55117385 | 55117404 | 55117388 | - |
| SEQ ID NO 1255 | CGAGCGCGCCGCCGAGTTCC | TGG | chr19 | 55117378 | 55117397 | 55117381 | - |
| SEQ ID NO 1256 | GCGCGCCGCCGAGTTCCTGG | CGG | chr19 | 55117375 | 55117394 | 55117378 | - |
| SEQ ID NO 1257 | CGAGTTCCTGGCGGCCTGTG | CGG | chr19 | 55117366 | 55117385 | 55117369 | - |
| SEQ ID NO 1258 | GAGTTCCTGGCGGCCTGTGC | GGG | chr19 | 55117365 | 55117384 | 55117368 | - |
| SEQ ID NO 1259 | TTCCTGGCGGCCTGTGCGGG | CGG | chr19 | 55117362 | 55117381 | 55117365 | - |
| SEQ ID NO 1260 | GGCCTGTGCGGGCGGCGACC | TGG | chr19 | 55117354 | 55117373 | 55117357 | - |
| SEQ ID NO 1261 | GTGCGGGCGGCGACCTGGAC | GAG | chr19 | 55117349 | 55117368 | 55117352 | - |
| SEQ ID NO 1262 | TGCGGGCGGCGACCTGGACG | AGG | chr19 | 55117348 | 55117367 | 55117351 | - |
| SEQ ID NO 1263 | ATGCTGCGCGCCGCCGACCC | TGG | chr19 | 55117317 | 55117336 | 55117320 | - |
| SEQ ID NO 1264 | CGCGCCGCCGACCCTGGCCC | CGG | chr19 | 55117311 | 55117330 | 55117314 | - |
| SEQ ID NO 1265 | CCGACCCTGGCCCCGGCGCC | GAG | chr19 | 55117304 | 55117323 | 55117307 | - |
| SEQ ID NO 1266 | GCCGCCCGCCCGCGCCGTGC | TGG | chr19 | 55117264 | 55117283 | 55117267 | - |
| SEQ ID NO 1267 | CTGGACTCCACCAACGCCGA | CGG | chr19 | 55117245 | 55117264 | 55117248 | - |
| SEQ ID NO 1268 | TCCACCAACGCCGACGGTAT | CAG | chr19 | 55117239 | 55117258 | 55117242 | - |
| SEQ ID NO 1269 | ACGGTATCAGCGCCCTGCAC | CAG | chr19 | 55117226 | 55117245 | 55117229 | - |
| SEQ ID NO 1270 | CGGTATCAGCGCCCTGCACC | AGG | chr19 | 55117225 | 55117244 | 55117228 | - |
| SEQ ID NO 1271 | ATCAGCGCCCTGCACCAGGT | CAG | chr19 | 55117221 | 55117240 | 55117224 | - |
| SEQ ID NO 1272 | CCAGGTCAGCGCCCCCGCC | CGG | chr19 | 55117207 | 55117226 | 55117210 | - |
| SEQ ID NO 1273 | GCCCCCGCCCGGCGTCTCC | CGG | chr19 | 55117197 | 55117216 | 55117200 | - |

Figure 1 (Cont'd)

| SEQ ID NO 1274 | CCCCCCGCCCGGCGTCTCCC | GGG | chr19 | 55117196 | 55117215 | 55117199 | - |
| SEQ ID NO 1275 | CCCCCGCCCGGCGTCTCCCG | GGG | chr19 | 55117195 | 55117214 | 55117198 | - |
| SEQ ID NO 1276 | CGCCCGGCGTCTCCCGGGGC | CAG | chr19 | 55117191 | 55117210 | 55117194 | - |
| SEQ ID NO 1277 | GCCCGGCGTCTCCCGGGGCC | AGG | chr19 | 55117190 | 55117209 | 55117193 | - |
| SEQ ID NO 1278 | CCACCCTCTGCTGCGCCACC | TGG | chr19 | 55117166 | 55117185 | 55117169 | - |
| SEQ ID NO 1279 | CACCCTCTGCTGCGCCACCT | GGG | chr19 | 55117165 | 55117184 | 55117168 | - |
| SEQ ID NO 1280 | ACCCTCTGCTGCGCCACCTG | GGG | chr19 | 55117164 | 55117183 | 55117167 | - |
| SEQ ID NO 1281 | GCATCCTCCTTCCCCGTTGC | CAG | chr19 | 55117142 | 55117161 | 55117145 | - |
| SEQ ID NO 1282 | TCGATCCGCCCCGTCGTTCC | TGG | chr19 | 55117117 | 55117136 | 55117120 | - |
| SEQ ID NO 1283 | CGCCCCGTCGTTCCTGGCCC | TGG | chr19 | 55117111 | 55117130 | 55117114 | - |
| SEQ ID NO 1284 | GCCCCGTCGTTCCTGGCCCT | GGG | chr19 | 55117110 | 55117129 | 55117113 | - |
| SEQ ID NO 1285 | CCTATGCTGACACCCCGTCC | CAG | chr19 | 55117078 | 55117097 | 55117081 | - |
| SEQ ID NO 1286 | CGACCACCCCACTTCCGAAT | TGG | chr19 | 55117035 | 55117054 | 55117038 | - |
| SEQ ID NO 1287 | ACCACCCCACTTCCGAATTG | GAG | chr19 | 55117033 | 55117052 | 55117036 | - |
| SEQ ID NO 1288 | CGAATTGGAGCCGCTTCAAC | TGG | chr19 | 55117020 | 55117039 | 55117023 | - |
| SEQ ID NO 1289 | GGAGCCGCTTCAACTGGCCC | TGG | chr19 | 55117014 | 55117033 | 55117017 | - |
| SEQ ID NO 1290 | GAGCCGCTTCAACTGGCCCT | GGG | chr19 | 55117013 | 55117032 | 55117016 | - |
| SEQ ID NO 1291 | GCTTCAACTGGCCCTGGGCT | TAG | chr19 | 55117008 | 55117027 | 55117011 | - |
| SEQ ID NO 1292 | CTGTGCTGACCACTCTGCCC | CAG | chr19 | 55116980 | 55116999 | 55116983 | - |
| SEQ ID NO 1293 | TGTGCTGACCACTCTGCCCC | AGG | chr19 | 55116979 | 55116998 | 55116982 | - |
| SEQ ID NO 1294 | CGACCTACTCTCTTCCGCAT | TGG | chr19 | 55116937 | 55116956 | 55116940 | - |
| SEQ ID NO 1295 | ACCTACTCTCTTCCGCATTG | GAG | chr19 | 55116935 | 55116954 | 55116938 | - |
| SEQ ID NO 1296 | CGCATTGGAGTCGCTTTAAC | TGG | chr19 | 55116922 | 55116941 | 55116925 | - |
| SEQ ID NO 1297 | GGAGTCGCTTTAACTGGCCC | TGG | chr19 | 55116916 | 55116935 | 55116919 | - |
| SEQ ID NO 1298 | GCTTTAACTGGCCCTGGCTT | TGG | chr19 | 55116910 | 55116929 | 55116913 | - |
| SEQ ID NO 1299 | TTAACTGGCCCTGGCTTTGG | CAG | chr19 | 55116907 | 55116926 | 55116910 | - |
| SEQ ID NO 1300 | GCAGCCTGTGCTGACCCATG | CAG | chr19 | 55116888 | 55116907 | 55116891 | - |
| SEQ ID NO 1301 | ACTTCCCCTCTTCCGATGTT | GAG | chr19 | 55116842 | 55116861 | 55116845 | - |
| SEQ ID NO 1302 | CTTCCGATGTTGAGCCCCTC | CAG | chr19 | 55116833 | 55116852 | 55116836 | - |
| SEQ ID NO 1303 | CGATGTTGAGCCCCTCCAGC | CGG | chr19 | 55116829 | 55116848 | 55116832 | - |
| SEQ ID NO 1304 | TGAGCCCCTCCAGCCGGTCC | TGG | chr19 | 55116823 | 55116842 | 55116826 | - |
| SEQ ID NO 1305 | CCCTGCCCTCTCCTGAACCT | GAG | chr19 | 55116782 | 55116801 | 55116785 | - |
| SEQ ID NO 1306 | GCCCTCTCCTGAACCTGAGC | CAG | chr19 | 55116778 | 55116797 | 55116781 | - |
| SEQ ID NO 1307 | TGAACCTGAGCCAGCTCCCA | TAG | chr19 | 55116769 | 55116788 | 55116772 | - |
| SEQ ID NO 1308 | CTGAGCCAGCTCCCATAGCT | CAG | chr19 | 55116764 | 55116783 | 55116767 | - |
| SEQ ID NO 1309 | CCAGCTCCCATAGCTCAGTC | TGG | chr19 | 55116759 | 55116778 | 55116762 | - |
| SEQ ID NO 1310 | CTCAGTCTGGTCTATCTGCC | TGG | chr19 | 55116746 | 55116765 | 55116749 | - |
| SEQ ID NO 1311 | CTGGTCTATCTGCCTGGCCC | TGG | chr19 | 55116740 | 55116759 | 55116743 | - |
| SEQ ID NO 1312 | GCTGCCCTCCTCTCGCCCCC | GAG | chr19 | 55116702 | 55116721 | 55116705 | - |
| SEQ ID NO 1313 | GAGTGCCCTTGCTGTGCCGC | CGG | chr19 | 55116682 | 55116701 | 55116685 | - |
| SEQ ID NO 1314 | AACGCTGCCGTCTCTCTCCT | GAG | chr19 | 55116646 | 55116665 | 55116649 | - |
| SEQ ID NO 1315 | TGCCGTCTCTCTCCTGAGTC | CGG | chr19 | 55116641 | 55116660 | 55116644 | - |
| SEQ ID NO 1316 | TCCTGAGTCCGGACCACTTT | GAG | chr19 | 55116630 | 55116649 | 55116633 | - |
| SEQ ID NO 1317 | CGGACCACTTTGAGCTCTAC | TGG | chr19 | 55116621 | 55116640 | 55116624 | - |
| SEQ ID NO 1318 | ACTGGCTTCTGCGCCGCCTC | TGG | chr19 | 55116603 | 55116622 | 55116606 | - |
| SEQ ID NO 1319 | GGCCCACTGTTTCCCCTTCC | CAG | chr19 | 55116582 | 55116601 | 55116585 | - |
| SEQ ID NO 1320 | GCCCACTGTTTCCCCTTCCC | AGG | chr19 | 55116581 | 55116600 | 55116584 | - |
| SEQ ID NO 1321 | CACTGTTTCCCCTTCCCAGG | CAG | chr19 | 55116578 | 55116597 | 55116581 | - |
| SEQ ID NO 1322 | ACTGTTTCCCCTTCCCAGGC | AGG | chr19 | 55116577 | 55116596 | 55116580 | - |

Figure 1 (Cont'd)

| | | | | | | | |
|---|---|---|---|---|---|---|---|
| SEQ ID NO 1323 | CTGACCTGCATTCTCTCCCC | TGG | chr19 | 55116543 | 55116562 | 55116546 | - |
| SEQ ID NO 1324 | TGACCTGCATTCTCTCCCCT | GGG | chr19 | 55116542 | 55116561 | 55116545 | - |
| SEQ ID NO 1325 | CCTGTGCCGCTTTCTGTCTG | CAG | chr19 | 55116519 | 55116538 | 55116522 | - |
| SEQ ID NO 1326 | CGCTTTCTGTCTGCAGCTTG | TGG | chr19 | 55116512 | 55116531 | 55116515 | - |
| SEQ ID NO 1327 | TCTGTCTGCAGCTTGTGGCC | TGG | chr19 | 55116507 | 55116526 | 55116510 | - |
| SEQ ID NO 1328 | CTGTCTGCAGCTTGTGGCCT | GGG | chr19 | 55116506 | 55116525 | 55116509 | - |
| SEQ ID NO 1329 | TGTGGCCTGGGTCACCTCTA | CGG | chr19 | 55116494 | 55116513 | 55116497 | - |
| SEQ ID NO 1330 | GCCTGGGTCACCTCTACGGC | TGG | chr19 | 55116490 | 55116509 | 55116493 | - |
| SEQ ID NO 1331 | GGTCACCTCTACGGCTGGCC | CAG | chr19 | 55116485 | 55116504 | 55116488 | - |
| SEQ ID NO 1332 | TCCTTCCCTGCCGCCTCCTT | CAG | chr19 | 55116461 | 55116480 | 55116464 | - |
| SEQ ID NO 1333 | CCTTCCCTGCCGCCTCCTTC | AGG | chr19 | 55116460 | 55116479 | 55116463 | - |
| SEQ ID NO 1334 | TCTCTGCTGTGTTGCTGCCC | AAG | chr19 | 55116405 | 55116424 | 55116408 | - |
| SEQ ID NO 1335 | CTCTGCTGTGTTGCTGCCCA | AGG | chr19 | 55116404 | 55116423 | 55116407 | - |
| SEQ ID NO 1336 | CTGCCCAAGGATGCTCTTTC | CGG | chr19 | 55116391 | 55116410 | 55116394 | - |
| SEQ ID NO 1337 | GCCCAAGGATGCTCTTTCCG | GAG | chr19 | 55116389 | 55116408 | 55116392 | - |
| SEQ ID NO 1338 | TTTCCGGAGCACTTCCTTCT | CGG | chr19 | 55116375 | 55116394 | 55116378 | - |
| SEQ ID NO 1339 | TGCACCACGTGATGTCCTCT | GAG | chr19 | 55116349 | 55116368 | 55116352 | - |
| SEQ ID NO 1340 | ACCACGTGATGTCCTCTGAG | CGG | chr19 | 55116346 | 55116365 | 55116349 | - |
| SEQ ID NO 1341 | GAGCGGATCCTCCCCGTGTC | TGG | chr19 | 55116329 | 55116348 | 55116332 | - |
| SEQ ID NO 1342 | AGCGGATCCTCCCCGTGTCT | GGG | chr19 | 55116328 | 55116347 | 55116331 | - |
| SEQ ID NO 1343 | CCCCGTGTCTGGGTCCTCTC | CGG | chr19 | 55116318 | 55116337 | 55116321 | - |
| SEQ ID NO 1344 | CCCGTGTCTGGGTCCTCTCC | GGG | chr19 | 55116317 | 55116336 | 55116320 | - |
| SEQ ID NO 1345 | CCCATGCCGTCTTCACTCGC | TGG | chr19 | 55116272 | 55116291 | 55116275 | - |
| SEQ ID NO 1346 | CCATGCCGTCTTCACTCGCT | GGG | chr19 | 55116271 | 55116290 | 55116274 | - |
| SEQ ID NO 1347 | TTCCCTTTTCCTTCTCCTTC | TGG | chr19 | 55116248 | 55116267 | 55116251 | - |
| SEQ ID NO 1348 | TCCCTTTTCCTTCTCCTTCT | GGG | chr19 | 55116247 | 55116266 | 55116250 | - |
| SEQ ID NO 1349 | CCCTTTTCCTTCTCCTTCTG | GGG | chr19 | 55116246 | 55116265 | 55116249 | - |
| SEQ ID NO 1350 | CTGTGCCATCTCTCGTTTCT | TAG | chr19 | 55116222 | 55116241 | 55116225 | - |
| SEQ ID NO 1351 | TGTGCCATCTCTCGTTTCTT | AGG | chr19 | 55116221 | 55116240 | 55116224 | - |
| SEQ ID NO 1352 | CCATCTCTCGTTTCTTAGGA | TGG | chr19 | 55116217 | 55116236 | 55116220 | - |
| SEQ ID NO 1353 | CTTAGGATGGCCTTCTCCGA | CGG | chr19 | 55116204 | 55116223 | 55116207 | - |
| SEQ ID NO 1354 | CGTCCCGCCTCCCCTTCTTG | TAG | chr19 | 55116169 | 55116188 | 55116172 | - |
| SEQ ID NO 1355 | GTCCCGCCTCCCCTTCTTGT | AGG | chr19 | 55116168 | 55116187 | 55116171 | - |
| SEQ ID NO 1356 | CTGCATCATCACCGTTTTTC | TGG | chr19 | 55116144 | 55116163 | 55116147 | - |
| SEQ ID NO 1357 | CGTTTTTCTGGACAACCCCA | AAG | chr19 | 55116132 | 55116151 | 55116135 | - |
| SEQ ID NO 1358 | CCCAAAGTACCCCGTCTCCC | TGG | chr19 | 55116116 | 55116135 | 55116119 | - |
| SEQ ID NO 1359 | GTACCCCGTCTCCCTGGCTT | TAG | chr19 | 55116110 | 55116129 | 55116113 | - |
| SEQ ID NO 1360 | ATCCTCTTGCTTTCTTTGCC | TGG | chr19 | 55116077 | 55116096 | 55116080 | - |
| SEQ ID NO 1361 | CTGGACACCCCGTTCTCCTG | TGG | chr19 | 55116058 | 55116077 | 55116061 | - |
| SEQ ID NO 1362 | ACCCCGTTCTCCTGTGGATT | CGG | chr19 | 55116052 | 55116071 | 55116055 | - |
| SEQ ID NO 1363 | CCCCGTTCTCCTGTGGATTC | GGG | chr19 | 55116051 | 55116070 | 55116054 | - |
| SEQ ID NO 1364 | CACCTCTCACTCCTTTCATT | TGG | chr19 | 55116027 | 55116046 | 55116030 | - |
| SEQ ID NO 1365 | ACCTCTCACTCCTTTCATTT | GGG | chr19 | 55116026 | 55116045 | 55116029 | - |
| SEQ ID NO 1366 | TCTCACTCCTTTCATTTGGG | CAG | chr19 | 55116023 | 55116042 | 55116026 | - |
| SEQ ID NO 1367 | CCCTACCCCCTTACCTCTC | TAG | chr19 | 55115997 | 55116016 | 55116000 | - |
| SEQ ID NO 1368 | CTTACCTCTCTAGTCTGTGC | TAG | chr19 | 55115987 | 55116006 | 55115990 | - |
| SEQ ID NO 1369 | CTAGTCTGTGCTAGCTCTTC | CAG | chr19 | 55115978 | 55115997 | 55115981 | - |
| SEQ ID NO 1370 | GCTCTTCCAGCCCCTGTCA | TGG | chr19 | 55115965 | 55115984 | 55115968 | - |
| SEQ ID NO 1371 | CCCCCTGTCATGGCATCTTC | CAG | chr19 | 55115955 | 55115974 | 55115958 | - |

Figure 1 (Cont'd)

| | | | | | | | |
|---|---|---|---|---|---|---|---|
| SEQ ID NO 1372 | CCCCTGTCATGGCATCTTCC | AGG | chr19 | 55115954 | 55115973 | 55115957 | - |
| SEQ ID NO 1373 | CCCTGTCATGGCATCTTCCA | GGG | chr19 | 55115953 | 55115972 | 55115956 | - |
| SEQ ID NO 1374 | CCTGTCATGGCATCTTCCAG | GGG | chr19 | 55115952 | 55115971 | 55115955 | - |
| SEQ ID NO 1375 | ATGGCATCTTCCAGGGGTCC | GAG | chr19 | 55115946 | 55115965 | 55115949 | - |
| SEQ ID NO 1376 | GGCATCTTCCAGGGGTCCGA | GAG | chr19 | 55115944 | 55115963 | 55115947 | - |
| SEQ ID NO 1377 | CTTCCAGGGGTCCGAGAGCT | CAG | chr19 | 55115939 | 55115958 | 55115942 | - |
| SEQ ID NO 1378 | CAGGGGTCCGAGAGCTCAGC | TAG | chr19 | 55115935 | 55115954 | 55115938 | - |
| SEQ ID NO 1379 | CTAGTCTTCTTCCTCCAACC | CGG | chr19 | 55115916 | 55115935 | 55115919 | - |
| SEQ ID NO 1380 | TAGTCTTCTTCCTCCAACCC | GGG | chr19 | 55115915 | 55115934 | 55115918 | - |
| SEQ ID NO 1381 | CCGGGCCCTATGTCCACTT | CAG | chr19 | 55115897 | 55115916 | 55115900 | - |
| SEQ ID NO 1382 | CGGGCCCTATGTCCACTTC | AGG | chr19 | 55115896 | 55115915 | 55115899 | - |
| SEQ ID NO 1383 | CCCTATGTCCACTTCAGGA | CAG | chr19 | 55115892 | 55115911 | 55115895 | - |
| SEQ ID NO 1384 | GACAGCATGTTTGCTGCCTC | CAG | chr19 | 55115874 | 55115893 | 55115877 | - |
| SEQ ID NO 1385 | ACAGCATGTTTGCTGCCTCC | AGG | chr19 | 55115873 | 55115892 | 55115876 | - |
| SEQ ID NO 1386 | CAGCATGTTTGCTGCCTCCA | GGG | chr19 | 55115872 | 55115891 | 55115875 | - |
| SEQ ID NO 1387 | TCCAGGGATCCTGTGTCCCC | GAG | chr19 | 55115856 | 55115875 | 55115859 | - |
| SEQ ID NO 1388 | GGGATCCTGTGTCCCCGAGC | TGG | chr19 | 55115852 | 55115871 | 55115855 | - |
| SEQ ID NO 1389 | GGATCCTGTGTCCCCGAGCT | GGG | chr19 | 55115851 | 55115870 | 55115854 | - |
| SEQ ID NO 1390 | CTGGGACCACCTTATATTCC | CAG | chr19 | 55115833 | 55115852 | 55115836 | - |
| SEQ ID NO 1391 | TGGGACCACCTTATATTCCC | AGG | chr19 | 55115832 | 55115851 | 55115835 | - |
| SEQ ID NO 1392 | GGGACCACCTTATATTCCCA | GGG | chr19 | 55115831 | 55115850 | 55115834 | - |
| SEQ ID NO 1393 | CCACCTTATATTCCCAGGGC | CGG | chr19 | 55115827 | 55115846 | 55115830 | - |
| SEQ ID NO 1394 | ATTCCCAGGGCCGGTTAATG | TGG | chr19 | 55115818 | 55115837 | 55115821 | - |
| SEQ ID NO 1395 | AGGGCCGGTTAATGTGGCTC | TGG | chr19 | 55115812 | 55115831 | 55115815 | - |
| SEQ ID NO 1396 | GGTTAATGTGGCTCTGGTTC | TGG | chr19 | 55115806 | 55115825 | 55115809 | - |
| SEQ ID NO 1397 | GTTAATGTGGCTCTGGTTCT | GGG | chr19 | 55115805 | 55115824 | 55115808 | - |
| SEQ ID NO 1398 | TATCTGTCCCCTCCACCCCA | CAG | chr19 | 55115776 | 55115795 | 55115779 | - |
| SEQ ID NO 1399 | CTGTCCCCTCCACCCCACAG | TGG | chr19 | 55115773 | 55115792 | 55115776 | - |
| SEQ ID NO 1400 | TGTCCCCTCCACCCCACAGT | GGG | chr19 | 55115772 | 55115791 | 55115775 | - |
| SEQ ID NO 1401 | GTCCCCTCCACCCCACAGTG | GGG | chr19 | 55115771 | 55115790 | 55115774 | - |
| SEQ ID NO 1402 | CCACCCCACAGTGGGGCCAC | TAG | chr19 | 55115764 | 55115783 | 55115767 | - |
| SEQ ID NO 1403 | CACCCCACAGTGGGGCCACT | AGG | chr19 | 55115763 | 55115782 | 55115766 | - |
| SEQ ID NO 1404 | ACCCCACAGTGGGGCCACTA | GGG | chr19 | 55115762 | 55115781 | 55115765 | - |
| SEQ ID NO 1405 | CACAGTGGGGCCACTAGGGA | CAG | chr19 | 55115758 | 55115777 | 55115761 | - |
| SEQ ID NO 1406 | ACAGTGGGGCCACTAGGGAC | AGG | chr19 | 55115757 | 55115776 | 55115760 | - |
| SEQ ID NO 1407 | GGGGCCACTAGGGACAGGAT | TGG | chr19 | 55115752 | 55115771 | 55115755 | - |
| SEQ ID NO 1408 | ACTAGGGACAGGATTGGTGA | CAG | chr19 | 55115746 | 55115765 | 55115749 | - |
| SEQ ID NO 1409 | GGACAGGATTGGTGACAGAA | AAG | chr19 | 55115741 | 55115760 | 55115744 | - |
| SEQ ID NO 1410 | TGACAGAAAAGCCCCATCCT | TAG | chr19 | 55115729 | 55115748 | 55115732 | - |
| SEQ ID NO 1411 | GACAGAAAAGCCCCATCCTT | AGG | chr19 | 55115728 | 55115747 | 55115731 | - |
| SEQ ID NO 1412 | TCCTTAGGCCTCCTCCTTCC | TAG | chr19 | 55115713 | 55115732 | 55115716 | - |
| SEQ ID NO 1413 | CCTTCCTAGTCTCCTGATAT | TGG | chr19 | 55115699 | 55115718 | 55115702 | - |
| SEQ ID NO 1414 | CTTCCTAGTCTCCTGATATT | GGG | chr19 | 55115698 | 55115717 | 55115701 | - |
| SEQ ID NO 1415 | GTCTAACCCCACCTCCTGT | TAG | chr19 | 55115676 | 55115695 | 55115679 | - |
| SEQ ID NO 1416 | TCTAACCCCACCTCCTGTT | AGG | chr19 | 55115675 | 55115694 | 55115678 | - |
| SEQ ID NO 1417 | AACCCCCACCTCCTGTTAGG | CAG | chr19 | 55115672 | 55115691 | 55115675 | - |
| SEQ ID NO 1418 | TGTTAGGCAGATTCCTTATC | TGG | chr19 | 55115659 | 55115678 | 55115662 | - |
| SEQ ID NO 1419 | GGTGACACACCCCCATTTCC | TGG | chr19 | 55115638 | 55115657 | 55115641 | - |
| SEQ ID NO 1420 | TGACACACCCCCATTTCCTG | GAG | chr19 | 55115636 | 55115655 | 55115639 | - |

Figure 1 (Cont'd)

| SEQ ID | Sequence | PAM | Chr | Start | End | Cut | Strand |
|---|---|---|---|---|---|---|---|
| SEQ ID NO 1421 | GGAGCCATCTCTCTCCTTGC | CAG | chr19 | 55115617 | 55115636 | 55115620 | - |
| SEQ ID NO 1422 | CTCTCCTTGCCAGAACCTCT | AAG | chr19 | 55115607 | 55115626 | 55115610 | - |
| SEQ ID NO 1423 | TCTCCTTGCCAGAACCTCTA | AGG | chr19 | 55115606 | 55115625 | 55115609 | - |
| SEQ ID NO 1424 | CCTCTAAGGTTTGCTTACGA | TGG | chr19 | 55115592 | 55115611 | 55115595 | - |
| SEQ ID NO 1425 | TCTAAGGTTTGCTTACGATG | GAG | chr19 | 55115590 | 55115609 | 55115593 | - |
| SEQ ID NO 1426 | AGGTTTGCTTACGATGGAGC | CAG | chr19 | 55115586 | 55115605 | 55115589 | - |
| SEQ ID NO 1427 | GTTTGCTTACGATGGAGCCA | GAG | chr19 | 55115584 | 55115603 | 55115587 | - |
| SEQ ID NO 1428 | TTGCTTACGATGGAGCCAGA | GAG | chr19 | 55115582 | 55115601 | 55115585 | - |
| SEQ ID NO 1429 | TGCTTACGATGGAGCCAGAG | AGG | chr19 | 55115581 | 55115600 | 55115584 | - |
| SEQ ID NO 1430 | GATGGAGCCAGAGAGGATCC | TGG | chr19 | 55115574 | 55115593 | 55115577 | - |
| SEQ ID NO 1431 | ATGGAGCCAGAGAGGATCCT | GGG | chr19 | 55115573 | 55115592 | 55115576 | - |
| SEQ ID NO 1432 | GGAGCCAGAGAGGATCCTGG | GAG | chr19 | 55115571 | 55115590 | 55115574 | - |
| SEQ ID NO 1433 | GAGCCAGAGAGGATCCTGGG | AGG | chr19 | 55115570 | 55115589 | 55115573 | - |
| SEQ ID NO 1434 | AGCCAGAGAGGATCCTGGGA | GGG | chr19 | 55115569 | 55115588 | 55115572 | - |
| SEQ ID NO 1435 | CCAGAGAGGATCCTGGGAGG | GAG | chr19 | 55115567 | 55115586 | 55115570 | - |
| SEQ ID NO 1436 | AGAGAGGATCCTGGGAGGGA | GAG | chr19 | 55115565 | 55115584 | 55115568 | - |
| SEQ ID NO 1437 | GGATCCTGGGAGGGAGAGCT | TGG | chr19 | 55115560 | 55115579 | 55115563 | - |
| SEQ ID NO 1438 | TCCTGGGAGGGAGAGCTTGG | CAG | chr19 | 55115557 | 55115576 | 55115560 | - |
| SEQ ID NO 1439 | CCTGGGAGGGAGAGCTTGGC | AGG | chr19 | 55115556 | 55115575 | 55115559 | - |
| SEQ ID NO 1440 | CTGGGAGGGAGAGCTTGGCA | GGG | chr19 | 55115555 | 55115574 | 55115558 | - |
| SEQ ID NO 1441 | TGGGAGGGAGAGCTTGGCAG | GGG | chr19 | 55115554 | 55115573 | 55115557 | - |
| SEQ ID NO 1442 | GGGAGGGAGAGCTTGGCAGG | GGG | chr19 | 55115553 | 55115572 | 55115556 | - |
| SEQ ID NO 1443 | AGGGAGAGCTTGGCAGGGGG | TGG | chr19 | 55115550 | 55115569 | 55115553 | - |
| SEQ ID NO 1444 | GGGAGAGCTTGGCAGGGGGT | GGG | chr19 | 55115549 | 55115568 | 55115552 | - |
| SEQ ID NO 1445 | GAGAGCTTGGCAGGGGGTGG | GAG | chr19 | 55115547 | 55115566 | 55115550 | - |
| SEQ ID NO 1446 | AGAGCTTGGCAGGGGGTGGG | AGG | chr19 | 55115546 | 55115565 | 55115549 | - |
| SEQ ID NO 1447 | GAGCTTGGCAGGGGGTGGGA | GGG | chr19 | 55115545 | 55115564 | 55115548 | - |
| SEQ ID NO 1448 | CTTGGCAGGGGGTGGGAGGG | AAG | chr19 | 55115542 | 55115561 | 55115545 | - |
| SEQ ID NO 1449 | TTGGCAGGGGGTGGGAGGGA | AGG | chr19 | 55115541 | 55115560 | 55115544 | - |
| SEQ ID NO 1450 | TGGCAGGGGGTGGGAGGGAA | GGG | chr19 | 55115540 | 55115559 | 55115543 | - |
| SEQ ID NO 1451 | GGCAGGGGGTGGGAGGGAAG | GGG | chr19 | 55115539 | 55115558 | 55115542 | - |
| SEQ ID NO 1452 | GCAGGGGGTGGGAGGGAAGG | GGG | chr19 | 55115538 | 55115557 | 55115541 | - |
| SEQ ID NO 1453 | CAGGGGGTGGGAGGGAAGGG | GGG | chr19 | 55115537 | 55115556 | 55115540 | - |
| SEQ ID NO 1454 | AGGGGGTGGGAGGGAAGGGG | GGG | chr19 | 55115536 | 55115555 | 55115539 | - |
| SEQ ID NO 1455 | GGGGGGATGCGTGACCTGCC | CGG | chr19 | 55115519 | 55115538 | 55115522 | - |
| SEQ ID NO 1456 | TGCGTGACCTGCCCGGTTCT | CAG | chr19 | 55115512 | 55115531 | 55115515 | - |
| SEQ ID NO 1457 | GTGACCTGCCCGGTTCTCAG | TGG | chr19 | 55115509 | 55115528 | 55115512 | - |
| SEQ ID NO 1458 | CACCCTGCGCTACCCTCTCC | CAG | chr19 | 55115485 | 55115504 | 55115488 | - |
| SEQ ID NO 1459 | GCTACCCTCTCCCAGAACCT | GAG | chr19 | 55115477 | 55115496 | 55115480 | - |
| SEQ ID NO 1460 | GAACCTGAGCTGCTCTGACG | CGG | chr19 | 55115463 | 55115482 | 55115466 | - |
| SEQ ID NO 1461 | GCTGCTCTGACGCGGCCGTC | TGG | chr19 | 55115455 | 55115474 | 55115458 | - |
| SEQ ID NO 1462 | CTGGTGCGTTTCACTGATCC | TGG | chr19 | 55115436 | 55115455 | 55115439 | - |
| SEQ ID NO 1463 | TTTCACTGATCCTGGTGCTG | CAG | chr19 | 55115428 | 55115447 | 55115431 | - |
| SEQ ID NO 1464 | GCAGCTTCCTTACACTTCCC | AAG | chr19 | 55115409 | 55115428 | 55115412 | - |
| SEQ ID NO 1465 | AGCTTCCTTACACTTCCCAA | GAG | chr19 | 55115407 | 55115426 | 55115410 | - |
| SEQ ID NO 1466 | GCTTCCTTACACTTCCCAAG | AGG | chr19 | 55115406 | 55115425 | 55115409 | - |
| SEQ ID NO 1467 | TTCCTTACACTTCCCAAGAG | GAG | chr19 | 55115404 | 55115423 | 55115407 | - |
| SEQ ID NO 1468 | CTTACACTTCCCAAGAGGAG | AAG | chr19 | 55115401 | 55115420 | 55115404 | - |
| SEQ ID NO 1469 | ACACTTCCCAAGAGGAGAAG | CAG | chr19 | 55115398 | 55115417 | 55115401 | - |

Figure 1 (Cont'd)

| SEQ ID | Sequence | Codon | Chr | Start | End | Mid | Strand |
|---|---|---|---|---|---|---|---|
| SEQ ID NO 1470 | TCCCAAGAGGAGAAGCAGTT | TGG | chr19 | 55115393 | 55115412 | 55115396 | - |
| SEQ ID NO 1471 | GCAGTTTGGAAAAACAAAAT | CAG | chr19 | 55115379 | 55115398 | 55115382 | - |
| SEQ ID NO 1472 | TGGAAAAACAAAATCAGAAT | AAG | chr19 | 55115373 | 55115392 | 55115376 | - |
| SEQ ID NO 1473 | AAAACAAAATCAGAATAAGT | TGG | chr19 | 55115369 | 55115388 | 55115372 | - |
| SEQ ID NO 1474 | AATCAGAATAAGTTGGTCCT | GAG | chr19 | 55115362 | 55115381 | 55115365 | - |
| SEQ ID NO 1475 | TTGGTCCTGAGTTCTAACTT | TGG | chr19 | 55115350 | 55115369 | 55115353 | - |
| SEQ ID NO 1476 | ACTTTGGCTCTTCACCTTTC | TAG | chr19 | 55115334 | 55115353 | 55115337 | - |
| SEQ ID NO 1477 | TATATTGTTCCTCCGTGCGT | CAG | chr19 | 55115302 | 55115321 | 55115305 | - |
| SEQ ID NO 1478 | CGTGCGTCAGTTTTACCTGT | GAG | chr19 | 55115289 | 55115308 | 55115292 | - |
| SEQ ID NO 1479 | GTCAGTTTTACCTGTGAGAT | AAG | chr19 | 55115284 | 55115303 | 55115287 | - |
| SEQ ID NO 1480 | TCAGTTTTACCTGTGAGATA | AGG | chr19 | 55115283 | 55115302 | 55115286 | - |
| SEQ ID NO 1481 | TTTTACCTGTGAGATAAGGC | CAG | chr19 | 55115279 | 55115298 | 55115282 | - |
| SEQ ID NO 1482 | TACCTGTGAGATAAGGCCAG | TAG | chr19 | 55115276 | 55115295 | 55115279 | - |
| SEQ ID NO 1483 | TGTGAGATAAGGCCAGTAGC | CAG | chr19 | 55115272 | 55115291 | 55115275 | - |
| SEQ ID NO 1484 | GCCAGTAGCCAGCCCCGTCC | TGG | chr19 | 55115261 | 55115280 | 55115264 | - |
| SEQ ID NO 1485 | AGTAGCCAGCCCCGTCCTGG | CAG | chr19 | 55115258 | 55115277 | 55115261 | - |
| SEQ ID NO 1486 | GTAGCCAGCCCCGTCCTGGC | AGG | chr19 | 55115257 | 55115276 | 55115260 | - |
| SEQ ID NO 1487 | TAGCCAGCCCCGTCCTGGCA | GGG | chr19 | 55115256 | 55115275 | 55115259 | - |
| SEQ ID NO 1488 | GCCCCGTCCTGGCAGGGCTG | TGG | chr19 | 55115250 | 55115269 | 55115253 | - |
| SEQ ID NO 1489 | CGTCCTGGCAGGGCTGTGGT | GAG | chr19 | 55115246 | 55115265 | 55115249 | - |
| SEQ ID NO 1490 | GTCCTGGCAGGGCTGTGGTG | AGG | chr19 | 55115245 | 55115264 | 55115248 | - |
| SEQ ID NO 1491 | CCTGGCAGGGCTGTGGTGAG | GAG | chr19 | 55115243 | 55115262 | 55115246 | - |
| SEQ ID NO 1492 | CTGGCAGGGCTGTGGTGAGG | AGG | chr19 | 55115242 | 55115261 | 55115245 | - |
| SEQ ID NO 1493 | TGGCAGGGCTGTGGTGAGGA | GGG | chr19 | 55115241 | 55115260 | 55115244 | - |
| SEQ ID NO 1494 | GGCAGGGCTGTGGTGAGGAG | GGG | chr19 | 55115240 | 55115259 | 55115243 | - |
| SEQ ID NO 1495 | GCAGGGCTGTGGTGAGGAGG | GGG | chr19 | 55115239 | 55115258 | 55115242 | - |
| SEQ ID NO 1496 | CAGGGCTGTGGTGAGGAGGG | GGG | chr19 | 55115238 | 55115257 | 55115241 | - |
| SEQ ID NO 1497 | TGAGGAGGGGGGTGTCCGTG | TGG | chr19 | 55115227 | 55115246 | 55115230 | - |
| SEQ ID NO 1498 | GTGTGGAAAACTCCCTTTGT | GAG | chr19 | 55115210 | 55115229 | 55115213 | - |
| SEQ ID NO 1499 | GAAAACTCCCTTTGTGAGAA | TGG | chr19 | 55115205 | 55115224 | 55115208 | - |
| SEQ ID NO 1500 | TTTGTGAGAATGGTGCGTCC | TAG | chr19 | 55115195 | 55115214 | 55115198 | - |
| SEQ ID NO 1501 | TTGTGAGAATGGTGCGTCCT | AGG | chr19 | 55115194 | 55115213 | 55115197 | - |
| SEQ ID NO 1502 | GGTGCGTCCTAGGTGTTCAC | CAG | chr19 | 55115184 | 55115203 | 55115187 | - |
| SEQ ID NO 1503 | GTGCGTCCTAGGTGTTCACC | AGG | chr19 | 55115183 | 55115202 | 55115186 | - |
| SEQ ID NO 1504 | CCTAGGTGTTCACCAGGTCG | TGG | chr19 | 55115177 | 55115196 | 55115180 | - |
| SEQ ID NO 1505 | TCTCCATCCTTCTTTCCTTA | AAG | chr19 | 55115132 | 55115151 | 55115135 | - |
| SEQ ID NO 1506 | TCCATCCTTCTTTCCTTAAA | GAG | chr19 | 55115130 | 55115149 | 55115133 | - |
| SEQ ID NO 1507 | TTCTTTCCTTAAAGAGTCCC | CAG | chr19 | 55115123 | 55115142 | 55115126 | - |
| SEQ ID NO 1508 | AAAGAGTCCCCAGTGCTATC | TGG | chr19 | 55115113 | 55115132 | 55115116 | - |
| SEQ ID NO 1509 | AAGAGTCCCCAGTGCTATCT | GGG | chr19 | 55115112 | 55115131 | 55115115 | - |
| SEQ ID NO 1510 | CTGGGACATATTCCTCCGCC | CAG | chr19 | 55115094 | 55115113 | 55115097 | - |
| SEQ ID NO 1511 | GGGACATATTCCTCCGCCCA | GAG | chr19 | 55115092 | 55115111 | 55115095 | - |
| SEQ ID NO 1512 | ACATATTCCTCCGCCCAGAG | CAG | chr19 | 55115089 | 55115108 | 55115092 | - |
| SEQ ID NO 1513 | CATATTCCTCCGCCCAGAGC | AGG | chr19 | 55115088 | 55115107 | 55115091 | - |
| SEQ ID NO 1514 | ATATTCCTCCGCCCAGAGCA | GGG | chr19 | 55115087 | 55115106 | 55115090 | - |
| SEQ ID NO 1515 | GAGCAGGGTCCCGCTTCCCT | AAG | chr19 | 55115072 | 55115091 | 55115075 | - |
| SEQ ID NO 1516 | AGCAGGGTCCCGCTTCCCTA | AGG | chr19 | 55115071 | 55115090 | 55115074 | - |
| SEQ ID NO 1517 | GCTTCCCTAAGGCCCTGCTC | TGG | chr19 | 55115060 | 55115079 | 55115063 | - |
| SEQ ID NO 1518 | CTTCCCTAAGGCCCTGCTCT | GGG | chr19 | 55115059 | 55115078 | 55115062 | - |

Figure 1 (Cont'd)

| SEQ ID NO 1519 | AAGGCCCTGCTCTGGGCTTC | TGG | chr19 | 55115052 | 55115071 | 55115055 | - |
| SEQ ID NO 1520 | AGGCCCTGCTCTGGGCTTCT | GGG | chr19 | 55115051 | 55115070 | 55115054 | - |
| SEQ ID NO 1521 | TGCTCTGGGCTTCTGGGTTT | GAG | chr19 | 55115045 | 55115064 | 55115048 | - |
| SEQ ID NO 1522 | GGCTTCTGGGTTTGAGTCCT | TGG | chr19 | 55115038 | 55115057 | 55115041 | - |
| SEQ ID NO 1523 | TCTGGGTTTGAGTCCTTGGC | AAG | chr19 | 55115034 | 55115053 | 55115037 | - |
| SEQ ID NO 1524 | GTTTGAGTCCTTGGCAAGCC | CAG | chr19 | 55115029 | 55115048 | 55115032 | - |
| SEQ ID NO 1525 | TTTGAGTCCTTGGCAAGCCC | AGG | chr19 | 55115028 | 55115047 | 55115031 | - |
| SEQ ID NO 1526 | TGAGTCCTTGGCAAGCCCAG | GAG | chr19 | 55115026 | 55115045 | 55115029 | - |
| SEQ ID NO 1527 | AGTCCTTGGCAAGCCCAGGA | GAG | chr19 | 55115024 | 55115043 | 55115027 | - |
| SEQ ID NO 1528 | GTCCTTGGCAAGCCCAGGAG | AGG | chr19 | 55115023 | 55115042 | 55115026 | - |
| SEQ ID NO 1529 | GCAAGCCCAGGAGAGGCGCT | CAG | chr19 | 55115016 | 55115035 | 55115019 | - |
| SEQ ID NO 1530 | CAAGCCCAGGAGAGGCGCTC | AGG | chr19 | 55115015 | 55115034 | 55115018 | - |
| SEQ ID NO 1531 | CGTCCACCATCTCATGCCCC | TGG | chr19 | 55114973 | 55114992 | 55114976 | - |
| SEQ ID NO 1532 | GCTCTCCTGCCCCTTCCCTA | CAG | chr19 | 55114951 | 55114970 | 55114954 | - |
| SEQ ID NO 1533 | CTCTCCTGCCCCTTCCCTAC | AGG | chr19 | 55114950 | 55114969 | 55114953 | - |
| SEQ ID NO 1534 | TCTCCTGCCCCTTCCCTACA | GGG | chr19 | 55114949 | 55114968 | 55114952 | - |
| SEQ ID NO 1535 | CTCCTGCCCCTTCCCTACAG | GGG | chr19 | 55114948 | 55114967 | 55114951 | - |
| SEQ ID NO 1536 | CCCTTCCCTACAGGGGTTCC | TGG | chr19 | 55114941 | 55114960 | 55114944 | - |
| SEQ ID NO 1537 | GGGTTCCTGGCTCTGCTCTT | CAG | chr19 | 55114928 | 55114947 | 55114931 | - |
| SEQ ID NO 1538 | CTGGCTCTGCTCTTCAGACT | GAG | chr19 | 55114922 | 55114941 | 55114925 | - |
| SEQ ID NO 1539 | CCCCCTTCCCCTGCATCCCC | CAG | chr19 | 55114867 | 55114886 | 55114870 | - |
| SEQ ID NO 1540 | CCCTTCCCCTGCATCCCCCA | GAG | chr19 | 55114865 | 55114884 | 55114868 | - |
| SEQ ID NO 1541 | CCTTCCCCTGCATCCCCCAG | AGG | chr19 | 55114864 | 55114883 | 55114867 | - |
| SEQ ID NO 1542 | CCTGCATCCCCCAGAGGCCC | CAG | chr19 | 55114858 | 55114877 | 55114861 | - |
| SEQ ID NO 1543 | CTGCATCCCCCAGAGGCCCC | AGG | chr19 | 55114857 | 55114876 | 55114860 | - |
| SEQ ID NO 1544 | GAGGCCCCAGGCCACCTACT | TGG | chr19 | 55114845 | 55114864 | 55114848 | - |
| SEQ ID NO 1545 | CCCAGGCCACCTACTTGGCC | TGG | chr19 | 55114840 | 55114859 | 55114843 | - |
| SEQ ID NO 1546 | CTACTTGGCCTGGACCCCAC | GAG | chr19 | 55114830 | 55114849 | 55114833 | - |
| SEQ ID NO 1547 | ACTTGGCCTGGACCCCACGA | GAG | chr19 | 55114828 | 55114847 | 55114831 | - |
| SEQ ID NO 1548 | CTTGGCCTGGACCCCACGAG | AGG | chr19 | 55114827 | 55114846 | 55114830 | - |
| SEQ ID NO 1549 | GACCCCACGAGAGGCCACCC | CAG | chr19 | 55114818 | 55114837 | 55114821 | - |
| SEQ ID NO 1550 | GCCACCCCAGCCCTGTCTAC | CAG | chr19 | 55114805 | 55114824 | 55114808 | - |
| SEQ ID NO 1551 | CCACCCCAGCCCTGTCTACC | AGG | chr19 | 55114804 | 55114823 | 55114807 | - |
| SEQ ID NO 1552 | CTGTCTACCAGGCTGCCTTT | TGG | chr19 | 55114793 | 55114812 | 55114796 | - |
| SEQ ID NO 1553 | TGTCTACCAGGCTGCCTTTT | GGG | chr19 | 55114792 | 55114811 | 55114795 | - |
| SEQ ID NO 1554 | CTACCAGGCTGCCTTTTGGG | TGG | chr19 | 55114789 | 55114808 | 55114792 | - |
| SEQ ID NO 1555 | GGTGGATTCTCCTCCAACTG | TGG | chr19 | 55114771 | 55114790 | 55114774 | - |
| SEQ ID NO 1556 | GTGGATTCTCCTCCAACTGT | GGG | chr19 | 55114770 | 55114789 | 55114773 | - |
| SEQ ID NO 1557 | TGGATTCTCCTCCAACTGTG | GGG | chr19 | 55114769 | 55114788 | 55114772 | - |
| SEQ ID NO 1558 | CCAACTGTGGGGTGACTGCT | TGG | chr19 | 55114758 | 55114777 | 55114761 | - |
| SEQ ID NO 1559 | TGCTTGGCAAACTCACTCTT | CGG | chr19 | 55114742 | 55114761 | 55114745 | - |
| SEQ ID NO 1560 | GCTTGGCAAACTCACTCTTC | GGG | chr19 | 55114741 | 55114760 | 55114744 | - |
| SEQ ID NO 1561 | CTTGGCAAACTCACTCTTCG | GGG | chr19 | 55114740 | 55114759 | 55114743 | - |
| SEQ ID NO 1562 | ACTCACTCTTCGGGGTATCC | CAG | chr19 | 55114732 | 55114751 | 55114735 | - |
| SEQ ID NO 1563 | CTCACTCTTCGGGGTATCCC | AGG | chr19 | 55114731 | 55114750 | 55114734 | - |
| SEQ ID NO 1564 | CACTCTTCGGGGTATCCCAG | GAG | chr19 | 55114729 | 55114748 | 55114732 | - |
| SEQ ID NO 1565 | ACTCTTCGGGGTATCCCAGG | AGG | chr19 | 55114728 | 55114747 | 55114731 | - |
| SEQ ID NO 1566 | TCGGGGTATCCCAGGAGGCC | TGG | chr19 | 55114723 | 55114742 | 55114726 | - |
| SEQ ID NO 1567 | GGGGTATCCCAGGAGGCCTG | GAG | chr19 | 55114721 | 55114740 | 55114724 | - |

Figure 1 (Cont'd)

| SEQ ID NO 1568 | TCCCAGGAGGCCTGGAGCAT | TGG | chr19 | 55114715 | 55114734 | 55114718 | - |
| --- | --- | --- | --- | --- | --- | --- | --- |
| SEQ ID NO 1569 | CCCAGGAGGCCTGGAGCATT | GGG | chr19 | 55114714 | 55114733 | 55114717 | - |
| SEQ ID NO 1570 | CCAGGAGGCCTGGAGCATTG | GGG | chr19 | 55114713 | 55114732 | 55114716 | - |
| SEQ ID NO 1571 | GGAGGCCTGGAGCATTGGGG | TGG | chr19 | 55114710 | 55114729 | 55114713 | - |
| SEQ ID NO 1572 | GAGGCCTGGAGCATTGGGGT | GGG | chr19 | 55114709 | 55114728 | 55114712 | - |
| SEQ ID NO 1573 | CCTGGAGCATTGGGGTGGGC | TGG | chr19 | 55114705 | 55114724 | 55114708 | - |
| SEQ ID NO 1574 | CTGGAGCATTGGGGTGGGCT | GGG | chr19 | 55114704 | 55114723 | 55114707 | - |
| SEQ ID NO 1575 | TGGAGCATTGGGGTGGGCTG | GGG | chr19 | 55114703 | 55114722 | 55114706 | - |
| SEQ ID NO 1576 | CATTGGGGTGGGCTGGGGTT | CAG | chr19 | 55114698 | 55114717 | 55114701 | - |
| SEQ ID NO 1577 | TTGGGGTGGGCTGGGGTTCA | GAG | chr19 | 55114696 | 55114715 | 55114699 | - |
| SEQ ID NO 1578 | GGGGTGGGCTGGGGTTCAGA | GAG | chr19 | 55114694 | 55114713 | 55114697 | - |
| SEQ ID NO 1579 | GGGTGGGCTGGGGTTCAGAG | AGG | chr19 | 55114693 | 55114712 | 55114696 | - |
| SEQ ID NO 1580 | GTGGGCTGGGGTTCAGAGAG | GAG | chr19 | 55114691 | 55114710 | 55114694 | - |
| SEQ ID NO 1581 | TGGGCTGGGGTTCAGAGAGG | AGG | chr19 | 55114690 | 55114709 | 55114693 | - |
| SEQ ID NO 1582 | GGGCTGGGGTTCAGAGAGGA | GGG | chr19 | 55114689 | 55114708 | 55114692 | - |
| SEQ ID NO 1583 | GAGAGGAGGGATTCCCTTCT | CAG | chr19 | 55114676 | 55114695 | 55114679 | - |
| SEQ ID NO 1584 | AGAGGAGGGATTCCCTTCTC | AGG | chr19 | 55114675 | 55114694 | 55114678 | - |
| SEQ ID NO 1585 | GATTCCCTTCTCAGGTTACG | TGG | chr19 | 55114667 | 55114686 | 55114670 | - |
| SEQ ID NO 1586 | CCTTCTCAGGTTACGTGGCC | AAG | chr19 | 55114662 | 55114681 | 55114665 | - |
| SEQ ID NO 1587 | TCTCAGGTTACGTGGCCAAG | AAG | chr19 | 55114659 | 55114678 | 55114662 | - |
| SEQ ID NO 1588 | CAGGTTACGTGGCCAAGAAG | CAG | chr19 | 55114656 | 55114675 | 55114659 | - |
| SEQ ID NO 1589 | AGGTTACGTGGCCAAGAAGC | AGG | chr19 | 55114655 | 55114674 | 55114658 | - |
| SEQ ID NO 1590 | GGTTACGTGGCCAAGAAGCA | GGG | chr19 | 55114654 | 55114673 | 55114657 | - |
| SEQ ID NO 1591 | GTTACGTGGCCAAGAAGCAG | GGG | chr19 | 55114653 | 55114672 | 55114656 | - |
| SEQ ID NO 1592 | TACGTGGCCAAGAAGCAGGG | GAG | chr19 | 55114651 | 55114670 | 55114654 | - |
| SEQ ID NO 1593 | TGGCCAAGAAGCAGGGGAGC | TGG | chr19 | 55114647 | 55114666 | 55114650 | - |
| SEQ ID NO 1594 | GGCCAAGAAGCAGGGGAGCT | GGG | chr19 | 55114646 | 55114665 | 55114649 | - |
| SEQ ID NO 1595 | AGAAGCAGGGGAGCTGGGTT | TGG | chr19 | 55114641 | 55114660 | 55114644 | - |
| SEQ ID NO 1596 | GAAGCAGGGGAGCTGGGTTT | GGG | chr19 | 55114640 | 55114659 | 55114643 | - |
| SEQ ID NO 1597 | CAGGGGAGCTGGGTTTGGGT | CAG | chr19 | 55114636 | 55114655 | 55114639 | - |
| SEQ ID NO 1598 | AGGGGAGCTGGGTTTGGGTC | AGG | chr19 | 55114635 | 55114654 | 55114638 | - |
| SEQ ID NO 1599 | AGCTGGGTTTGGGTCAGGTC | TGG | chr19 | 55114630 | 55114649 | 55114633 | - |
| SEQ ID NO 1600 | GCTGGGTTTGGGTCAGGTCT | GGG | chr19 | 55114629 | 55114648 | 55114632 | - |
| SEQ ID NO 1601 | GTTTGGGTCAGGTCTGGGTG | TGG | chr19 | 55114624 | 55114643 | 55114627 | - |
| SEQ ID NO 1602 | TTTGGGTCAGGTCTGGGTGT | GGG | chr19 | 55114623 | 55114642 | 55114626 | - |
| SEQ ID NO 1603 | TTGGGTCAGGTCTGGGTGTG | GGG | chr19 | 55114622 | 55114641 | 55114625 | - |
| SEQ ID NO 1604 | AGGTCTGGGTGTGGGGTGAC | CAG | chr19 | 55114615 | 55114634 | 55114618 | - |
| SEQ ID NO 1605 | ACCAGCTTATGCTGTTTGCC | CAG | chr19 | 55114597 | 55114616 | 55114600 | - |
| SEQ ID NO 1606 | CCAGCTTATGCTGTTTGCCC | AGG | chr19 | 55114596 | 55114615 | 55114599 | - |
| SEQ ID NO 1607 | CTTATGCTGTTTGCCCAGGA | CAG | chr19 | 55114592 | 55114611 | 55114595 | - |
| SEQ ID NO 1608 | GCTGTTTGCCCAGGACAGCC | TAG | chr19 | 55114587 | 55114606 | 55114590 | - |
| SEQ ID NO 1609 | TGCCCAGGACAGCCTAGTTT | TAG | chr19 | 55114581 | 55114600 | 55114584 | - |
| SEQ ID NO 1610 | AGTTTTAGCACTGAAACCCT | CAG | chr19 | 55114566 | 55114585 | 55114569 | - |
| SEQ ID NO 1611 | AGCACTGAAACCCTCAGTCC | TAG | chr19 | 55114560 | 55114579 | 55114563 | - |
| SEQ ID NO 1612 | GCACTGAAACCCTCAGTCCT | AGG | chr19 | 55114559 | 55114578 | 55114562 | - |
| SEQ ID NO 1613 | AACCCTCAGTCCTAGGAAAA | CAG | chr19 | 55114552 | 55114571 | 55114555 | - |
| SEQ ID NO 1614 | ACCCTCAGTCCTAGGAAAAC | AGG | chr19 | 55114551 | 55114570 | 55114554 | - |
| SEQ ID NO 1615 | CCCTCAGTCCTAGGAAAACA | GGG | chr19 | 55114550 | 55114569 | 55114553 | - |
| SEQ ID NO 1616 | CAGTCCTAGGAAAACAGGGA | TGG | chr19 | 55114546 | 55114565 | 55114549 | - |

Figure 1 (Cont'd)

| | | | | | | | |
|---|---|---|---|---|---|---|---|
| SEQ ID NO 1617 | CCTAGGAAAACAGGGATGGT | TGG | chr19 | 55114542 | 55114561 | 55114545 | - |
| SEQ ID NO 1618 | GGATGGTTGGTCACTGTCTC | TGG | chr19 | 55114529 | 55114548 | 55114532 | - |
| SEQ ID NO 1619 | GATGGTTGGTCACTGTCTCT | GGG | chr19 | 55114528 | 55114547 | 55114531 | - |
| SEQ ID NO 1620 | TCTGGGTGACTCTTGATTCC | CGG | chr19 | 55114511 | 55114530 | 55114514 | - |
| SEQ ID NO 1621 | GGTGACTCTTGATTCCGGC | CAG | chr19 | 55114507 | 55114526 | 55114510 | - |
| SEQ ID NO 1622 | TCCCGGCCAGTTTCTCCACC | TGG | chr19 | 55114494 | 55114513 | 55114497 | - |
| SEQ ID NO 1623 | CCCGGCCAGTTTCTCCACCT | GGG | chr19 | 55114493 | 55114512 | 55114496 | - |
| SEQ ID NO 1624 | CCGGCCAGTTTCTCCACCTG | GGG | chr19 | 55114492 | 55114511 | 55114495 | - |
| SEQ ID NO 1625 | TCTCGTCCTGCATCCTTCTC | CAG | chr19 | 55114462 | 55114481 | 55114465 | - |
| SEQ ID NO 1626 | CTCGTCCTGCATCCTTCTCC | AGG | chr19 | 55114461 | 55114480 | 55114464 | - |
| SEQ ID NO 1627 | GTCCTGCATCCTTCTCCAGG | CAG | chr19 | 55114458 | 55114477 | 55114461 | - |
| SEQ ID NO 1628 | TCCTGCATCCTTCTCCAGGC | AGG | chr19 | 55114457 | 55114476 | 55114460 | - |
| SEQ ID NO 1629 | CCTTCTCCAGGCAGGTCCCC | AAG | chr19 | 55114449 | 55114468 | 55114452 | - |
| SEQ ID NO 1630 | CAAGCATCGCCCCCCTGCTG | TGG | chr19 | 55114430 | 55114449 | 55114433 | - |
| SEQ ID NO 1631 | CCCCTGCTGTGGCTGTTCCC | AAG | chr19 | 55114419 | 55114438 | 55114422 | - |
| SEQ ID NO 1632 | TGTGGCTGTTCCCAAGTTCT | TAG | chr19 | 55114412 | 55114431 | 55114415 | - |
| SEQ ID NO 1633 | GTGGCTGTTCCCAAGTTCTT | AGG | chr19 | 55114411 | 55114430 | 55114414 | - |
| SEQ ID NO 1634 | TGGCTGTTCCCAAGTTCTTA | GGG | chr19 | 55114410 | 55114429 | 55114413 | - |
| SEQ ID NO 1635 | AGTTCTTAGGGTACCCCACG | TGG | chr19 | 55114398 | 55114417 | 55114401 | - |
| SEQ ID NO 1636 | GTTCTTAGGGTACCCCACGT | GGG | chr19 | 55114397 | 55114416 | 55114400 | - |
| SEQ ID NO 1637 | ACGTGGGTTTATCAACCACT | TGG | chr19 | 55114381 | 55114400 | 55114384 | - |
| SEQ ID NO 1638 | GGGTTTATCAACCACTTGGT | GAG | chr19 | 55114377 | 55114396 | 55114380 | - |
| SEQ ID NO 1639 | GGTTTATCAACCACTTGGTG | AGG | chr19 | 55114376 | 55114395 | 55114379 | - |
| SEQ ID NO 1640 | TATCAACCACTTGGTGAGGC | TGG | chr19 | 55114372 | 55114391 | 55114375 | - |
| SEQ ID NO 1641 | TTCCTGCACCCCAATTGCCT | TAG | chr19 | 55114336 | 55114355 | 55114339 | - |
| SEQ ID NO 1642 | CTGCACCCCAATTGCCTTAG | TGG | chr19 | 55114333 | 55114352 | 55114336 | - |
| SEQ ID NO 1643 | ACCCCAATTGCCTTAGTGGC | TAG | chr19 | 55114329 | 55114348 | 55114332 | - |
| SEQ ID NO 1644 | CCCCAATTGCCTTAGTGGCT | AGG | chr19 | 55114328 | 55114347 | 55114331 | - |
| SEQ ID NO 1645 | CCCAATTGCCTTAGTGGCTA | GGG | chr19 | 55114327 | 55114346 | 55114330 | - |
| SEQ ID NO 1646 | CCAATTGCCTTAGTGGCTAG | GGG | chr19 | 55114326 | 55114345 | 55114329 | - |
| SEQ ID NO 1647 | CAATTGCCTTAGTGGCTAGG | GGG | chr19 | 55114325 | 55114344 | 55114328 | - |
| SEQ ID NO 1648 | TGCCTTAGTGGCTAGGGGGT | TGG | chr19 | 55114321 | 55114340 | 55114324 | - |
| SEQ ID NO 1649 | GCCTTAGTGGCTAGGGGGTT | GGG | chr19 | 55114320 | 55114339 | 55114323 | - |
| SEQ ID NO 1650 | CCTTAGTGGCTAGGGGGTTG | GGG | chr19 | 55114319 | 55114338 | 55114322 | - |
| SEQ ID NO 1651 | CTTAGTGGCTAGGGGGTTGG | GGG | chr19 | 55114318 | 55114337 | 55114321 | - |
| SEQ ID NO 1652 | GTGGCTAGGGGGTTGGGGGC | TAG | chr19 | 55114314 | 55114333 | 55114317 | - |
| SEQ ID NO 1653 | GGCTAGGGGGTTGGGGGCTA | GAG | chr19 | 55114312 | 55114331 | 55114315 | - |
| SEQ ID NO 1654 | TAGGGGGTTGGGGGCTAGAG | TAG | chr19 | 55114309 | 55114328 | 55114312 | - |
| SEQ ID NO 1655 | AGGGGGTTGGGGGCTAGAGT | AGG | chr19 | 55114308 | 55114327 | 55114311 | - |
| SEQ ID NO 1656 | GGGGGTTGGGGGCTAGAGTAG | GAG | chr19 | 55114306 | 55114325 | 55114309 | - |
| SEQ ID NO 1657 | GGGTTGGGGGCTAGAGTAGG | AGG | chr19 | 55114305 | 55114324 | 55114308 | - |
| SEQ ID NO 1658 | GGTTGGGGGCTAGAGTAGGA | GGG | chr19 | 55114304 | 55114323 | 55114307 | - |
| SEQ ID NO 1659 | GTTGGGGGCTAGAGTAGGAG | GGG | chr19 | 55114303 | 55114322 | 55114306 | - |
| SEQ ID NO 1660 | GGGGCTAGAGTAGGAGGGGC | TGG | chr19 | 55114299 | 55114318 | 55114302 | - |
| SEQ ID NO 1661 | GGCTAGAGTAGGAGGGGCTG | GAG | chr19 | 55114297 | 55114316 | 55114300 | - |
| SEQ ID NO 1662 | AGAGTAGGAGGGGCTGGAGC | CAG | chr19 | 55114293 | 55114312 | 55114296 | - |
| SEQ ID NO 1663 | GAGTAGGAGGGGCTGGAGCC | AGG | chr19 | 55114292 | 55114311 | 55114295 | - |
| SEQ ID NO 1664 | GGGGCTGGAGCCAGGATTCT | TAG | chr19 | 55114284 | 55114303 | 55114287 | - |
| SEQ ID NO 1665 | GGGCTGGAGCCAGGATTCTT | AGG | chr19 | 55114283 | 55114302 | 55114286 | - |

Figure 1 (Cont'd)

| | | | | | | | |
|---|---|---|---|---|---|---|---|
| SEQ ID NO 1666 | GGCTGGAGCCAGGATTCTTA | GGG | chr19 | 55114282 | 55114301 | 55114285 | - |
| SEQ ID NO 1667 | CCAGGATTCTTAGGGCTGAA | CAG | chr19 | 55114274 | 55114293 | 55114277 | - |
| SEQ ID NO 1668 | AGGATTCTTAGGGCTGAACA | GAG | chr19 | 55114272 | 55114291 | 55114275 | - |
| SEQ ID NO 1669 | ATTCTTAGGGCTGAACAGAG | AAG | chr19 | 55114269 | 55114288 | 55114272 | - |
| SEQ ID NO 1670 | TCTTAGGGCTGAACAGAGAA | GAG | chr19 | 55114267 | 55114286 | 55114270 | - |
| SEQ ID NO 1671 | AGGGCTGAACAGAGAAGAGC | TGG | chr19 | 55114263 | 55114282 | 55114266 | - |
| SEQ ID NO 1672 | GGGCTGAACAGAGAAGAGCT | GGG | chr19 | 55114262 | 55114281 | 55114265 | - |
| SEQ ID NO 1673 | GGCTGAACAGAGAAGAGCTG | GGG | chr19 | 55114261 | 55114280 | 55114264 | - |
| SEQ ID NO 1674 | GCTGAACAGAGAAGAGCTGG | GGG | chr19 | 55114260 | 55114279 | 55114263 | - |
| SEQ ID NO 1675 | ACAGAGAAGAGCTGGGGGCC | TGG | chr19 | 55114255 | 55114274 | 55114258 | - |
| SEQ ID NO 1676 | CAGAGAAGAGCTGGGGGCCT | GGG | chr19 | 55114254 | 55114273 | 55114257 | - |
| SEQ ID NO 1677 | GAGCTGGGGGCCTGGGCTCC | TGG | chr19 | 55114247 | 55114266 | 55114250 | - |
| SEQ ID NO 1678 | AGCTGGGGGCCTGGGCTCCT | GGG | chr19 | 55114246 | 55114265 | 55114249 | - |
| SEQ ID NO 1679 | GGGCCTGGGCTCCTGGGTTT | GAG | chr19 | 55114240 | 55114259 | 55114243 | - |
| SEQ ID NO 1680 | GCCTGGGCTCCTGGGTTTGA | GAG | chr19 | 55114238 | 55114257 | 55114241 | - |
| SEQ ID NO 1681 | CTGGGCTCCTGGGTTTGAGA | GAG | chr19 | 55114236 | 55114255 | 55114239 | - |
| SEQ ID NO 1682 | TGGGCTCCTGGGTTTGAGAG | AGG | chr19 | 55114235 | 55114254 | 55114238 | - |
| SEQ ID NO 1683 | GGCTCCTGGGTTTGAGAGAG | GAG | chr19 | 55114233 | 55114252 | 55114236 | - |
| SEQ ID NO 1684 | GCTCCTGGGTTTGAGAGAGG | AGG | chr19 | 55114232 | 55114251 | 55114235 | - |
| SEQ ID NO 1685 | CTCCTGGGTTTGAGAGAGGA | GGG | chr19 | 55114231 | 55114250 | 55114234 | - |
| SEQ ID NO 1686 | TCCTGGGTTTGAGAGAGGAG | GGG | chr19 | 55114230 | 55114249 | 55114233 | - |
| SEQ ID NO 1687 | GGGTTTGAGAGAGGAGGGGC | TGG | chr19 | 55114226 | 55114245 | 55114229 | - |
| SEQ ID NO 1688 | GGTTTGAGAGAGGAGGGGCT | GGG | chr19 | 55114225 | 55114244 | 55114228 | - |
| SEQ ID NO 1689 | GTTTGAGAGAGGAGGGGCTG | GGG | chr19 | 55114224 | 55114243 | 55114227 | - |
| SEQ ID NO 1690 | AGAGAGGAGGGGCTGGGGCC | TGG | chr19 | 55114219 | 55114238 | 55114222 | - |
| SEQ ID NO 1691 | GGGGCTGGGGCCTGGACTCC | TGG | chr19 | 55114211 | 55114230 | 55114214 | - |
| SEQ ID NO 1692 | GGGCTGGGGCCTGGACTCCT | GGG | chr19 | 55114210 | 55114229 | 55114213 | - |
| SEQ ID NO 1693 | GGGCCTGGACTCCTGGGTCC | GAG | chr19 | 55114204 | 55114223 | 55114207 | - |
| SEQ ID NO 1694 | GGCCTGGACTCCTGGGTCCG | AGG | chr19 | 55114203 | 55114222 | 55114206 | - |
| SEQ ID NO 1695 | GCCTGGACTCCTGGGTCCGA | GGG | chr19 | 55114202 | 55114221 | 55114205 | - |
| SEQ ID NO 1696 | CTGGACTCCTGGGTCCGAGG | GAG | chr19 | 55114200 | 55114219 | 55114203 | - |
| SEQ ID NO 1697 | TGGACTCCTGGGTCCGAGGG | AGG | chr19 | 55114199 | 55114218 | 55114202 | - |
| SEQ ID NO 1698 | GACTCCTGGGTCCGAGGGAG | GAG | chr19 | 55114197 | 55114216 | 55114200 | - |
| SEQ ID NO 1699 | ACTCCTGGGTCCGAGGGAGG | AGG | chr19 | 55114196 | 55114215 | 55114199 | - |
| SEQ ID NO 1700 | CTCCTGGGTCCGAGGGAGGA | GGG | chr19 | 55114195 | 55114214 | 55114198 | - |
| SEQ ID NO 1701 | TCCTGGGTCCGAGGGAGGAG | GGG | chr19 | 55114194 | 55114213 | 55114197 | - |
| SEQ ID NO 1702 | GGGTCCGAGGGAGGAGGGGC | TGG | chr19 | 55114190 | 55114209 | 55114193 | - |
| SEQ ID NO 1703 | GGTCCGAGGGAGGAGGGGCT | GGG | chr19 | 55114189 | 55114208 | 55114192 | - |
| SEQ ID NO 1704 | GTCCGAGGGAGGAGGGGCTG | GGG | chr19 | 55114188 | 55114207 | 55114191 | - |
| SEQ ID NO 1705 | AGGGAGGAGGGGCTGGGGCC | TGG | chr19 | 55114183 | 55114202 | 55114186 | - |
| SEQ ID NO 1706 | GGGGCTGGGGCCTGGACTCC | TGG | chr19 | 55114175 | 55114194 | 55114178 | - |
| SEQ ID NO 1707 | GGGCTGGGGCCTGGACTCCT | GGG | chr19 | 55114174 | 55114193 | 55114177 | - |
| SEQ ID NO 1708 | GGGCCTGGACTCCTGGGTCT | GAG | chr19 | 55114168 | 55114187 | 55114171 | - |
| SEQ ID NO 1709 | GGCCTGGACTCCTGGGTCTG | AGG | chr19 | 55114167 | 55114186 | 55114170 | - |
| SEQ ID NO 1710 | GCCTGGACTCCTGGGTCTGA | GGG | chr19 | 55114166 | 55114185 | 55114169 | - |
| SEQ ID NO 1711 | TGGACTCCTGGGTCTGAGGG | TGG | chr19 | 55114163 | 55114182 | 55114166 | - |
| SEQ ID NO 1712 | GACTCCTGGGTCTGAGGGTG | GAG | chr19 | 55114161 | 55114180 | 55114164 | - |
| SEQ ID NO 1713 | ACTCCTGGGTCTGAGGGTGG | AGG | chr19 | 55114160 | 55114179 | 55114163 | - |
| SEQ ID NO 1714 | CTCCTGGGTCTGAGGGTGGA | GGG | chr19 | 55114159 | 55114178 | 55114162 | - |

Figure 1 (Cont'd)

| | | | | | | | |
|---|---|---|---|---|---|---|---|
| SEQ ID NO 1715 | GGGTCTGAGGGTGGAGGGAC | TGG | chr19 | 55114154 | 55114173 | 55114157 | - |
| SEQ ID NO 1716 | GGTCTGAGGGTGGAGGGACT | GGG | chr19 | 55114153 | 55114172 | 55114156 | - |
| SEQ ID NO 1717 | GTCTGAGGGTGGAGGGACTG | GGG | chr19 | 55114152 | 55114171 | 55114155 | - |
| SEQ ID NO 1718 | TCTGAGGGTGGAGGGACTGG | GGG | chr19 | 55114151 | 55114170 | 55114154 | - |
| SEQ ID NO 1719 | GGGTGGAGGGACTGGGGCC | TGG | chr19 | 55114146 | 55114165 | 55114149 | - |
| SEQ ID NO 1720 | GGACTGGGGCCTGGACTCC | TGG | chr19 | 55114138 | 55114157 | 55114141 | - |
| SEQ ID NO 1721 | GACTGGGGCCTGGACTCCT | GGG | chr19 | 55114137 | 55114156 | 55114140 | - |
| SEQ ID NO 1722 | GGGCCTGGACTCCTGGGTCC | GAG | chr19 | 55114131 | 55114150 | 55114134 | - |
| SEQ ID NO 1723 | GGCCTGGACTCCTGGGTCCG | AGG | chr19 | 55114130 | 55114149 | 55114133 | - |
| SEQ ID NO 1724 | GCCTGGACTCCTGGGTCCGA | GGG | chr19 | 55114129 | 55114148 | 55114132 | - |
| SEQ ID NO 1725 | CTGGACTCCTGGGTCCGAGG | GAG | chr19 | 55114127 | 55114146 | 55114130 | - |
| SEQ ID NO 1726 | TGGACTCCTGGGTCCGAGGG | AGG | chr19 | 55114126 | 55114145 | 55114129 | - |
| SEQ ID NO 1727 | GACTCCTGGGTCCGAGGGAG | GAG | chr19 | 55114124 | 55114143 | 55114127 | - |
| SEQ ID NO 1728 | ACTCCTGGGTCCGAGGGAGG | AGG | chr19 | 55114123 | 55114142 | 55114126 | - |
| SEQ ID NO 1729 | CTCCTGGGTCCGAGGGAGGA | GGG | chr19 | 55114122 | 55114141 | 55114125 | - |
| SEQ ID NO 1730 | TCCTGGGTCCGAGGGAGGAG | GGG | chr19 | 55114121 | 55114140 | 55114124 | - |
| SEQ ID NO 1731 | GGGTCCGAGGGAGGAGGGGC | TGG | chr19 | 55114117 | 55114136 | 55114120 | - |
| SEQ ID NO 1732 | GGTCCGAGGGAGGAGGGGCT | GGG | chr19 | 55114116 | 55114135 | 55114119 | - |
| SEQ ID NO 1733 | GTCCGAGGGAGGAGGGGCTG | GGG | chr19 | 55114115 | 55114134 | 55114118 | - |
| SEQ ID NO 1734 | AGGGAGGAGGGGCTGGGGCC | TGG | chr19 | 55114110 | 55114129 | 55114113 | - |
| SEQ ID NO 1735 | GGGGCTGGGGCCTGGACTCG | TGG | chr19 | 55114102 | 55114121 | 55114105 | - |
| SEQ ID NO 1736 | GGGCTGGGGCCTGGACTCGT | GGG | chr19 | 55114101 | 55114120 | 55114104 | - |
| SEQ ID NO 1737 | GGGCCTGGACTCGTGGGTCT | GAG | chr19 | 55114095 | 55114114 | 55114098 | - |
| SEQ ID NO 1738 | GGCCTGGACTCGTGGGTCTG | AGG | chr19 | 55114094 | 55114113 | 55114097 | - |
| SEQ ID NO 1739 | GCCTGGACTCGTGGGTCTGA | GGG | chr19 | 55114093 | 55114112 | 55114096 | - |
| SEQ ID NO 1740 | CTGGACTCGTGGGTCTGAGG | GAG | chr19 | 55114091 | 55114110 | 55114094 | - |
| SEQ ID NO 1741 | TGGACTCGTGGGTCTGAGGG | AGG | chr19 | 55114090 | 55114109 | 55114093 | - |
| SEQ ID NO 1742 | GACTCGTGGGTCTGAGGGAG | GAG | chr19 | 55114088 | 55114107 | 55114091 | - |
| SEQ ID NO 1743 | ACTCGTGGGTCTGAGGGAGG | AGG | chr19 | 55114087 | 55114106 | 55114090 | - |
| SEQ ID NO 1744 | CTCGTGGGTCTGAGGGAGGA | GGG | chr19 | 55114086 | 55114105 | 55114089 | - |
| SEQ ID NO 1745 | TCGTGGGTCTGAGGGAGGAG | GGG | chr19 | 55114085 | 55114104 | 55114088 | - |
| SEQ ID NO 1746 | GGGTCTGAGGGAGGAGGGGC | TGG | chr19 | 55114081 | 55114100 | 55114084 | - |
| SEQ ID NO 1747 | GGTCTGAGGGAGGAGGGGCT | GGG | chr19 | 55114080 | 55114099 | 55114083 | - |
| SEQ ID NO 1748 | GTCTGAGGGAGGAGGGGCTG | GGG | chr19 | 55114079 | 55114098 | 55114082 | - |
| SEQ ID NO 1749 | TCTGAGGGAGGAGGGGCTGG | GGG | chr19 | 55114078 | 55114097 | 55114081 | - |
| SEQ ID NO 1750 | GGGAGGAGGGGCTGGGGCC | TGG | chr19 | 55114073 | 55114092 | 55114076 | - |
| SEQ ID NO 1751 | GGGCTGGGGCCTGGACTTC | TGG | chr19 | 55114065 | 55114084 | 55114068 | - |
| SEQ ID NO 1752 | GGCTGGGGCCTGGACTTCT | GGG | chr19 | 55114064 | 55114083 | 55114067 | - |
| SEQ ID NO 1753 | GGGCCTGGACTTCTGGGTCT | TAG | chr19 | 55114058 | 55114077 | 55114061 | - |
| SEQ ID NO 1754 | GGCCTGGACTTCTGGGTCTT | AGG | chr19 | 55114057 | 55114076 | 55114060 | - |
| SEQ ID NO 1755 | GCCTGGACTTCTGGGTCTTA | GGG | chr19 | 55114056 | 55114075 | 55114059 | - |
| SEQ ID NO 1756 | CTGGACTTCTGGGTCTTAGG | GAG | chr19 | 55114054 | 55114073 | 55114057 | - |
| SEQ ID NO 1757 | TGGACTTCTGGGTCTTAGGG | AGG | chr19 | 55114053 | 55114072 | 55114056 | - |
| SEQ ID NO 1758 | ACTTCTGGGTCTTAGGGAGG | CGG | chr19 | 55114050 | 55114069 | 55114053 | - |
| SEQ ID NO 1759 | CTTCTGGGTCTTAGGGAGGC | GGG | chr19 | 55114049 | 55114068 | 55114052 | - |
| SEQ ID NO 1760 | TTCTGGGTCTTAGGGAGGCG | GGG | chr19 | 55114048 | 55114067 | 55114051 | - |
| SEQ ID NO 1761 | GGGTCTTAGGGAGGCGGGGC | TGG | chr19 | 55114044 | 55114063 | 55114047 | - |
| SEQ ID NO 1762 | GGTCTTAGGGAGGCGGGGCT | GGG | chr19 | 55114043 | 55114062 | 55114046 | - |
| SEQ ID NO 1763 | TAGGGAGGCGGGGCTGGGCC | TGG | chr19 | 55114038 | 55114057 | 55114041 | - |

Figure 1 (Cont'd)

| | | | | | | | |
|---|---|---|---|---|---|---|---|
| SEQ ID NO 1764 | CGGGGCTGGGCCTGGACCCC | TGG | chr19 | 55114030 | 55114049 | 55114033 | - |
| SEQ ID NO 1765 | GGGGCTGGGCCTGGACCCCT | GGG | chr19 | 55114029 | 55114048 | 55114032 | - |
| SEQ ID NO 1766 | CCTGGACCCCTGGGTCTGAA | TGG | chr19 | 55114020 | 55114039 | 55114023 | - |
| SEQ ID NO 1767 | CTGGACCCCTGGGTCTGAAT | GGG | chr19 | 55114019 | 55114038 | 55114022 | - |
| SEQ ID NO 1768 | TGGACCCCTGGGTCTGAATG | GGG | chr19 | 55114018 | 55114037 | 55114021 | - |
| SEQ ID NO 1769 | GACCCCTGGGTCTGAATGGG | GAG | chr19 | 55114016 | 55114035 | 55114019 | - |
| SEQ ID NO 1770 | CCCCTGGGTCTGAATGGGGA | GAG | chr19 | 55114014 | 55114033 | 55114017 | - |
| SEQ ID NO 1771 | CCCTGGGTCTGAATGGGGAG | AGG | chr19 | 55114013 | 55114032 | 55114016 | - |
| SEQ ID NO 1772 | GGGTCTGAATGGGGAGAGGC | TGG | chr19 | 55114009 | 55114028 | 55114012 | - |
| SEQ ID NO 1773 | GGTCTGAATGGGGAGAGGCT | GGG | chr19 | 55114008 | 55114027 | 55114011 | - |
| SEQ ID NO 1774 | GTCTGAATGGGGAGAGGCTG | GGG | chr19 | 55114007 | 55114026 | 55114010 | - |
| SEQ ID NO 1775 | TCTGAATGGGGAGAGGCTGG | GGG | chr19 | 55114006 | 55114025 | 55114009 | - |
| SEQ ID NO 1776 | ATGGGGAGAGGCTGGGGGCC | TGG | chr19 | 55114001 | 55114020 | 55114004 | - |
| SEQ ID NO 1777 | GGGCCTGGACTCCTTCATCT | GAG | chr19 | 55113986 | 55114005 | 55113989 | - |
| SEQ ID NO 1778 | GGCCTGGACTCCTTCATCTG | AGG | chr19 | 55113985 | 55114004 | 55113988 | - |
| SEQ ID NO 1779 | GCCTGGACTCCTTCATCTGA | GGG | chr19 | 55113984 | 55114003 | 55113987 | - |
| SEQ ID NO 1780 | TGGACTCCTTCATCTGAGGG | CGG | chr19 | 55113981 | 55114000 | 55113984 | - |
| SEQ ID NO 1781 | ACTCCTTCATCTGAGGGCGG | AAG | chr19 | 55113978 | 55113997 | 55113981 | - |
| SEQ ID NO 1782 | CTCCTTCATCTGAGGGCGGA | AGG | chr19 | 55113977 | 55113996 | 55113980 | - |
| SEQ ID NO 1783 | TCCTTCATCTGAGGGCGGAA | GGG | chr19 | 55113976 | 55113995 | 55113979 | - |
| SEQ ID NO 1784 | TCATCTGAGGGCGGAAGGGC | TGG | chr19 | 55113972 | 55113991 | 55113975 | - |
| SEQ ID NO 1785 | CATCTGAGGGCGGAAGGGCT | GGG | chr19 | 55113971 | 55113990 | 55113974 | - |
| SEQ ID NO 1786 | ATCTGAGGGCGGAAGGGCTG | GGG | chr19 | 55113970 | 55113989 | 55113973 | - |
| SEQ ID NO 1787 | AGGGCGGAAGGGCTGGGGCC | TGG | chr19 | 55113965 | 55113984 | 55113968 | - |
| SEQ ID NO 1788 | AGGGCTGGGGCCTGGCCTCC | TGG | chr19 | 55113957 | 55113976 | 55113960 | - |
| SEQ ID NO 1789 | GGGCTGGGGCCTGGCCTCCT | GGG | chr19 | 55113956 | 55113975 | 55113959 | - |
| SEQ ID NO 1790 | GCCTGGCCTCCTGGGTTGAA | TGG | chr19 | 55113948 | 55113967 | 55113951 | - |
| SEQ ID NO 1791 | CCTGGCCTCCTGGGTTGAAT | GGG | chr19 | 55113947 | 55113966 | 55113950 | - |
| SEQ ID NO 1792 | CTGGCCTCCTGGGTTGAATG | GGG | chr19 | 55113946 | 55113965 | 55113949 | - |
| SEQ ID NO 1793 | GGCCTCCTGGGTTGAATGGG | GAG | chr19 | 55113944 | 55113963 | 55113947 | - |
| SEQ ID NO 1794 | GCCTCCTGGGTTGAATGGGG | AGG | chr19 | 55113943 | 55113962 | 55113946 | - |
| SEQ ID NO 1795 | CCTCCTGGGTTGAATGGGGA | GGG | chr19 | 55113942 | 55113961 | 55113945 | - |
| SEQ ID NO 1796 | CTCCTGGGTTGAATGGGGAG | GGG | chr19 | 55113941 | 55113960 | 55113944 | - |
| SEQ ID NO 1797 | TGGGTTGAATGGGGAGGGGT | TGG | chr19 | 55113937 | 55113956 | 55113940 | - |
| SEQ ID NO 1798 | GGGTTGAATGGGGAGGGGTT | GGG | chr19 | 55113936 | 55113955 | 55113939 | - |
| SEQ ID NO 1799 | GAATGGGGAGGGGTTGGGCC | TGG | chr19 | 55113931 | 55113950 | 55113934 | - |
| SEQ ID NO 1800 | GAGGGGTTGGGCCTGGACTC | TGG | chr19 | 55113924 | 55113943 | 55113927 | - |
| SEQ ID NO 1801 | GGGGTTGGGCCTGGACTCTG | GAG | chr19 | 55113922 | 55113941 | 55113925 | - |
| SEQ ID NO 1802 | GGCCTGGACTCTGGAGTCCC | TGG | chr19 | 55113915 | 55113934 | 55113918 | - |
| SEQ ID NO 1803 | ACTCTGGAGTCCCTGGTGCC | CAG | chr19 | 55113908 | 55113927 | 55113911 | - |
| SEQ ID NO 1804 | CTCTGGAGTCCCTGGTGCCC | AGG | chr19 | 55113907 | 55113926 | 55113910 | - |
| SEQ ID NO 1805 | AGTCCCTGGTGCCCAGGCCT | CAG | chr19 | 55113901 | 55113920 | 55113904 | - |
| SEQ ID NO 1806 | GTCCCTGGTGCCCAGGCCTC | AGG | chr19 | 55113900 | 55113919 | 55113903 | - |
| SEQ ID NO 1807 | CAGGCCTCAGGCATCTTTCA | CAG | chr19 | 55113888 | 55113907 | 55113891 | - |
| SEQ ID NO 1808 | AGGCCTCAGGCATCTTTCAC | AGG | chr19 | 55113887 | 55113906 | 55113890 | - |
| SEQ ID NO 1809 | GGCCTCAGGCATCTTTCACA | GGG | chr19 | 55113886 | 55113905 | 55113889 | - |
| SEQ ID NO 1810 | TTTCACAGGGATGCCTGTAC | TGG | chr19 | 55113873 | 55113892 | 55113876 | - |
| SEQ ID NO 1811 | TTCACAGGGATGCCTGTACT | GGG | chr19 | 55113872 | 55113891 | 55113875 | - |
| SEQ ID NO 1812 | ACAGGGATGCCTGTACTGGG | CAG | chr19 | 55113869 | 55113888 | 55113872 | - |

Figure 1 (Cont'd)

| | | | | | | | |
|---|---|---|---|---|---|---|---|
| SEQ ID NO 1813 | CAGGGATGCCTGTACTGGGC | AGG | chr19 | 55113868 | 55113887 | 55113871 | - |
| SEQ ID NO 1814 | TGTACTGGGCAGGTCCTTGA | AAG | chr19 | 55113858 | 55113877 | 55113861 | - |
| SEQ ID NO 1815 | GTACTGGGCAGGTCCTTGAA | AGG | chr19 | 55113857 | 55113876 | 55113860 | - |
| SEQ ID NO 1816 | TACTGGGCAGGTCCTTGAAA | GGG | chr19 | 55113856 | 55113875 | 55113859 | - |
| SEQ ID NO 1817 | GGGCAGGTCCTTGAAAGGGA | AAG | chr19 | 55113852 | 55113871 | 55113855 | - |
| SEQ ID NO 1818 | GGCAGGTCCTTGAAAGGGAA | AGG | chr19 | 55113851 | 55113870 | 55113854 | - |
| SEQ ID NO 1819 | TCCCCTATCGCCATGACAAC | TGG | chr19 | 55113806 | 55113825 | 55113809 | - |
| SEQ ID NO 1820 | CCCCTATCGCCATGACAACT | GGG | chr19 | 55113805 | 55113824 | 55113808 | - |
| SEQ ID NO 1821 | CTATCGCCATGACAACTGGG | TGG | chr19 | 55113802 | 55113821 | 55113805 | - |
| SEQ ID NO 1822 | ACAACTGGGTGGAAATAAAC | GAG | chr19 | 55113791 | 55113810 | 55113794 | - |
| SEQ ID NO 1823 | TGGGTGGAAATAAACGAGCC | GAG | chr19 | 55113786 | 55113805 | 55113789 | - |
| SEQ ID NO 1824 | AGCCGAGTTCATCCCGTTCC | CAG | chr19 | 55113770 | 55113789 | 55113773 | - |
| SEQ ID NO 1825 | GCCGAGTTCATCCCGTTCCC | AGG | chr19 | 55113769 | 55113788 | 55113772 | - |
| SEQ ID NO 1826 | CCGAGTTCATCCCGTTCCCA | GGG | chr19 | 55113768 | 55113787 | 55113771 | - |
| SEQ ID NO 1827 | TCCCGTTCCCAGGGCACGTG | CGG | chr19 | 55113759 | 55113778 | 55113762 | - |
| SEQ ID NO 1828 | GGGCACGTGCGGCCCCTTCA | CAG | chr19 | 55113748 | 55113767 | 55113751 | - |
| SEQ ID NO 1829 | GTGCGGCCCCTTCACAGCCC | GAG | chr19 | 55113742 | 55113761 | 55113745 | - |
| SEQ ID NO 1830 | TTTCCATGACCTCATGCTCT | TGG | chr19 | 55113719 | 55113738 | 55113722 | - |
| SEQ ID NO 1831 | CCTCATGCTCTTGGCCCTCG | TAG | chr19 | 55113710 | 55113729 | 55113713 | - |
| SEQ ID NO 1832 | TAGCTCCCTCCCGCCTCCTC | CAG | chr19 | 55113690 | 55113709 | 55113693 | - |
| SEQ ID NO 1833 | TCCCTCCCGCCTCCTCCAGA | TGG | chr19 | 55113686 | 55113705 | 55113689 | - |
| SEQ ID NO 1834 | CCCTCCCGCCTCCTCCAGAT | GGG | chr19 | 55113685 | 55113704 | 55113688 | - |
| SEQ ID NO 1835 | TCCGCCTCCTCCAGATGGG | CAG | chr19 | 55113682 | 55113701 | 55113685 | - |
| SEQ ID NO 1836 | CTCCTCCAGATGGGCAGCTT | TGG | chr19 | 55113676 | 55113695 | 55113679 | - |
| SEQ ID NO 1837 | CCTCCAGATGGGCAGCTTTG | GAG | chr19 | 55113674 | 55113693 | 55113677 | - |
| SEQ ID NO 1838 | TCCAGATGGGCAGCTTTGGA | GAG | chr19 | 55113672 | 55113691 | 55113675 | - |
| SEQ ID NO 1839 | CCAGATGGGCAGCTTTGGAG | AGG | chr19 | 55113671 | 55113690 | 55113674 | - |
| SEQ ID NO 1840 | ATGGGCAGCTTTGGAGAGGT | GAG | chr19 | 55113667 | 55113686 | 55113670 | - |
| SEQ ID NO 1841 | TGGGCAGCTTTGGAGAGGTG | AGG | chr19 | 55113666 | 55113685 | 55113669 | - |
| SEQ ID NO 1842 | GGGCAGCTTTGGAGAGGTGA | GGG | chr19 | 55113665 | 55113684 | 55113668 | - |
| SEQ ID NO 1843 | CTTTGGAGAGGTGAGGGACT | TGG | chr19 | 55113659 | 55113678 | 55113662 | - |
| SEQ ID NO 1844 | TTTGGAGAGGTGAGGGACTT | GGG | chr19 | 55113658 | 55113677 | 55113661 | - |
| SEQ ID NO 1845 | TTGGAGAGGTGAGGGACTTG | GGG | chr19 | 55113657 | 55113676 | 55113660 | - |
| SEQ ID NO 1846 | TGGAGAGGTGAGGGACTTGG | GGG | chr19 | 55113656 | 55113675 | 55113659 | - |
| SEQ ID NO 1847 | GGAGAGGTGAGGGACTTGGG | GGG | chr19 | 55113655 | 55113674 | 55113658 | - |
| SEQ ID NO 1848 | TTGGGGGTAATTTATCCCG | TGG | chr19 | 55113640 | 55113659 | 55113643 | - |
| SEQ ID NO 1849 | GGTAATTTATCCCGTGGATC | TAG | chr19 | 55113634 | 55113653 | 55113637 | - |
| SEQ ID NO 1850 | GTAATTTATCCCGTGGATCT | AGG | chr19 | 55113633 | 55113652 | 55113636 | - |
| SEQ ID NO 1851 | AATTTATCCCGTGGATCTAG | GAG | chr19 | 55113631 | 55113650 | 55113634 | - |
| SEQ ID NO 1852 | ATCCCGTGGATCTAGGAGTT | TAG | chr19 | 55113626 | 55113645 | 55113629 | - |
| SEQ ID NO 1853 | GTTTAGCTTCACTCCTTCCT | CAG | chr19 | 55113609 | 55113628 | 55113612 | - |
| SEQ ID NO 1854 | CTTCACTCCTTCCTCAGCTC | CAG | chr19 | 55113603 | 55113622 | 55113606 | - |
| SEQ ID NO 1855 | CTCCTTCCTCAGCTCCAGTT | CAG | chr19 | 55113598 | 55113617 | 55113601 | - |
| SEQ ID NO 1856 | TCCTTCCTCAGCTCCAGTTC | AGG | chr19 | 55113597 | 55113616 | 55113600 | - |
| SEQ ID NO 1857 | CTCAGCTCCAGTTCAGGTCC | CGG | chr19 | 55113591 | 55113610 | 55113594 | - |
| SEQ ID NO 1858 | CAGCTCCAGTTCAGGTCCCG | GAG | chr19 | 55113589 | 55113608 | 55113592 | - |
| SEQ ID NO 1859 | TTCAGGTCCCGGAGCCCACC | CAG | chr19 | 55113580 | 55113599 | 55113583 | - |
| SEQ ID NO 1860 | GGAGCCCACCCAGTGTCCAC | AAG | chr19 | 55113570 | 55113589 | 55113573 | - |
| SEQ ID NO 1861 | GAGCCCACCCAGTGTCCACA | AGG | chr19 | 55113569 | 55113588 | 55113572 | - |

Figure 1 (Cont'd)

| | | | | | | | |
|---|---|---|---|---|---|---|---|
| SEQ ID NO 1862 | CACCCAGTGTCCACAAGGCC | TGG | chr19 | 55113564 | 55113583 | 55113567 | - |
| SEQ ID NO 1863 | ACCCAGTGTCCACAAGGCCT | GGG | chr19 | 55113563 | 55113582 | 55113566 | - |
| SEQ ID NO 1864 | CCCAGTGTCCACAAGGCCTG | GGG | chr19 | 55113562 | 55113581 | 55113565 | - |
| SEQ ID NO 1865 | GTGTCCACAAGGCCTGGGGC | AAG | chr19 | 55113558 | 55113577 | 55113561 | - |
| SEQ ID NO 1866 | AAGTCCCTCCTCCGACCCCC | TGG | chr19 | 55113538 | 55113557 | 55113541 | - |
| SEQ ID NO 1867 | TCCTCCGACCCCCTGGACTT | CGG | chr19 | 55113531 | 55113550 | 55113534 | - |
| SEQ ID NO 1868 | ACTTCGGCTTTTGTCCCCCC | AAG | chr19 | 55113515 | 55113534 | 55113518 | - |
| SEQ ID NO 1869 | GCTTTTGTCCCCCCAAGTTT | TGG | chr19 | 55113509 | 55113528 | 55113512 | - |
| SEQ ID NO 1870 | CCCCCAAGTTTTGGACCCCT | AAG | chr19 | 55113500 | 55113519 | 55113503 | - |
| SEQ ID NO 1871 | CCCCAAGTTTTGGACCCCTA | AGG | chr19 | 55113499 | 55113518 | 55113502 | - |
| SEQ ID NO 1872 | CCCAAGTTTTGGACCCCTAA | GGG | chr19 | 55113498 | 55113517 | 55113501 | - |
| SEQ ID NO 1873 | AAGTTTTGGACCCCTAAGGG | AAG | chr19 | 55113495 | 55113514 | 55113498 | - |
| SEQ ID NO 1874 | TGGACCCCTAAGGGAAGAAT | GAG | chr19 | 55113489 | 55113508 | 55113492 | - |
| SEQ ID NO 1875 | CCTAAGGGAAGAATGAGAAA | CGG | chr19 | 55113483 | 55113502 | 55113486 | - |
| SEQ ID NO 1876 | AAGGGAAGAATGAGAAACGG | TGG | chr19 | 55113480 | 55113499 | 55113483 | - |
| SEQ ID NO 1877 | TGAGAAACGGTGGCCCGTGT | CAG | chr19 | 55113470 | 55113489 | 55113473 | - |
| SEQ ID NO 1878 | CGGTGGCCCGTGTCAGCCCC | TGG | chr19 | 55113463 | 55113482 | 55113466 | - |
| SEQ ID NO 1879 | CCCGTGTCAGCCCCTGGCTG | CAG | chr19 | 55113457 | 55113476 | 55113460 | - |
| SEQ ID NO 1880 | CCGTGTCAGCCCCTGGCTGC | AGG | chr19 | 55113456 | 55113475 | 55113459 | - |
| SEQ ID NO 1881 | CGTGTCAGCCCCTGGCTGCA | GGG | chr19 | 55113455 | 55113474 | 55113458 | - |
| SEQ ID NO 1882 | CCTGGCTGCAGGGCCCCGTG | CAG | chr19 | 55113445 | 55113464 | 55113448 | - |
| SEQ ID NO 1883 | TGGCTGCAGGGCCCCGTGCA | GAG | chr19 | 55113443 | 55113462 | 55113446 | - |
| SEQ ID NO 1884 | GGCTGCAGGGCCCCGTGCAG | AGG | chr19 | 55113442 | 55113461 | 55113445 | - |
| SEQ ID NO 1885 | GCTGCAGGGCCCCGTGCAGA | GGG | chr19 | 55113441 | 55113460 | 55113444 | - |
| SEQ ID NO 1886 | CTGCAGGGCCCCGTGCAGAG | GGG | chr19 | 55113440 | 55113459 | 55113443 | - |
| SEQ ID NO 1887 | TGCAGGGCCCCGTGCAGAGG | GGG | chr19 | 55113439 | 55113458 | 55113442 | - |
| SEQ ID NO 1888 | GCCCCGTGCAGAGGGGGCCT | CAG | chr19 | 55113433 | 55113452 | 55113436 | - |
| SEQ ID NO 1889 | CAGAGGGGGCCTCAGTGAAC | TGG | chr19 | 55113425 | 55113444 | 55113428 | - |
| SEQ ID NO 1890 | GAGGGGGCCTCAGTGAACTG | GAG | chr19 | 55113423 | 55113442 | 55113426 | - |
| SEQ ID NO 1891 | CTCAGTGAACTGGAGTGTGA | CAG | chr19 | 55113415 | 55113434 | 55113418 | - |
| SEQ ID NO 1892 | TGAACTGGAGTGTGACAGCC | TGG | chr19 | 55113410 | 55113429 | 55113413 | - |
| SEQ ID NO 1893 | GAACTGGAGTGTGACAGCCT | GGG | chr19 | 55113409 | 55113428 | 55113412 | - |
| SEQ ID NO 1894 | AACTGGAGTGTGACAGCCTG | GGG | chr19 | 55113408 | 55113427 | 55113411 | - |
| SEQ ID NO 1895 | GAGTGTGACAGCCTGGGGCC | CAG | chr19 | 55113403 | 55113422 | 55113406 | - |
| SEQ ID NO 1896 | AGTGTGACAGCCTGGGGCCC | AGG | chr19 | 55113402 | 55113421 | 55113405 | - |
| SEQ ID NO 1897 | CAGCCTGGGGCCCAGGCACA | CAG | chr19 | 55113395 | 55113414 | 55113398 | - |
| SEQ ID NO 1898 | AGCCTGGGGCCCAGGCACAC | AGG | chr19 | 55113394 | 55113413 | 55113397 | - |
| SEQ ID NO 1899 | GGCCCAGGCACACAGGTGTG | CAG | chr19 | 55113387 | 55113406 | 55113390 | - |
| SEQ ID NO 1900 | GTGCAGCTGTCTCACCCCTC | TGG | chr19 | 55113370 | 55113389 | 55113373 | - |
| SEQ ID NO 1901 | TGCAGCTGTCTCACCCCTCT | GGG | chr19 | 55113369 | 55113388 | 55113372 | - |
| SEQ ID NO 1902 | CAGCTGTCTCACCCCTCTGG | GAG | chr19 | 55113367 | 55113386 | 55113370 | - |
| SEQ ID NO 1903 | ACCCCTCTGGGAGTCCCGCC | CAG | chr19 | 55113357 | 55113376 | 55113360 | - |
| SEQ ID NO 1904 | CCCCTCTGGGAGTCCCGCCC | AGG | chr19 | 55113356 | 55113375 | 55113359 | - |
| SEQ ID NO 1905 | GGAGTCCCGCCCAGGCCCCT | GAG | chr19 | 55113348 | 55113367 | 55113351 | - |
| SEQ ID NO 1906 | CCAGGCCCCTGAGTCTGTCC | CAG | chr19 | 55113338 | 55113357 | 55113341 | - |
| SEQ ID NO 1907 | CCCCTGAGTCTGTCCCAGCA | CAG | chr19 | 55113333 | 55113352 | 55113336 | - |
| SEQ ID NO 1908 | CCCTGAGTCTGTCCCAGCAC | AGG | chr19 | 55113332 | 55113351 | 55113335 | - |
| SEQ ID NO 1909 | CCTGAGTCTGTCCCAGCACA | GGG | chr19 | 55113331 | 55113350 | 55113334 | - |
| SEQ ID NO 1910 | GAGTCTGTCCCAGCACAGGG | TGG | chr19 | 55113328 | 55113347 | 55113331 | - |

Figure 1 (Cont'd)

| | | | | | | | |
|---|---|---|---|---|---|---|---|
| SEQ ID NO 1911 | TGGCCTTCCTCCACCCTGCA | TAG | chr19 | 55113308 | 55113327 | 55113311 | - |
| SEQ ID NO 1912 | TCCTCCACCCTGCATAGCCC | TGG | chr19 | 55113302 | 55113321 | 55113305 | - |
| SEQ ID NO 1913 | CCTCCACCCTGCATAGCCCT | GGG | chr19 | 55113301 | 55113320 | 55113304 | - |
| SEQ ID NO 1914 | CCTGCATAGCCCTGGGCCCA | CGG | chr19 | 55113294 | 55113313 | 55113297 | - |
| SEQ ID NO 1915 | GGCCCACGGCTTCGTTCCTG | CAG | chr19 | 55113280 | 55113299 | 55113283 | - |
| SEQ ID NO 1916 | CCCACGGCTTCGTTCCTGCA | GAG | chr19 | 55113278 | 55113297 | 55113281 | - |
| SEQ ID NO 1917 | CGTTCCTGCAGAGTATCTGC | TGG | chr19 | 55113268 | 55113287 | 55113271 | - |
| SEQ ID NO 1918 | GTTCCTGCAGAGTATCTGCT | GGG | chr19 | 55113267 | 55113286 | 55113270 | - |
| SEQ ID NO 1919 | TTCCTGCAGAGTATCTGCTG | GGG | chr19 | 55113266 | 55113285 | 55113269 | - |
| SEQ ID NO 1920 | CTGCAGAGTATCTGCTGGGG | TGG | chr19 | 55113263 | 55113282 | 55113266 | - |
| SEQ ID NO 1921 | TATCTGCTGGGGTGGTTTCC | GAG | chr19 | 55113255 | 55113274 | 55113258 | - |
| SEQ ID NO 1922 | TGGTTTCCGAGCTTGACCCT | TGG | chr19 | 55113243 | 55113262 | 55113246 | - |
| SEQ ID NO 1923 | TTTCCGAGCTTGACCCTTGG | AAG | chr19 | 55113240 | 55113259 | 55113243 | - |
| SEQ ID NO 1924 | TTCCGAGCTTGACCCTTGGA | AGG | chr19 | 55113239 | 55113258 | 55113242 | - |
| SEQ ID NO 1925 | GCTTGACCCTTGGAAGGACC | TGG | chr19 | 55113233 | 55113252 | 55113236 | - |
| SEQ ID NO 1926 | GACCCTTGGAAGGACCTGGC | TGG | chr19 | 55113229 | 55113248 | 55113232 | - |
| SEQ ID NO 1927 | ACCCTTGGAAGGACCTGGCT | GGG | chr19 | 55113228 | 55113247 | 55113231 | - |
| SEQ ID NO 1928 | GGAAGGACCTGGCTGGGTTT | AAG | chr19 | 55113222 | 55113241 | 55113225 | - |
| SEQ ID NO 1929 | GAAGGACCTGGCTGGGTTTA | AGG | chr19 | 55113221 | 55113240 | 55113224 | - |
| SEQ ID NO 1930 | GGACCTGGCTGGGTTTAAGG | CAG | chr19 | 55113218 | 55113237 | 55113221 | - |
| SEQ ID NO 1931 | GACCTGGCTGGGTTTAAGGC | AGG | chr19 | 55113217 | 55113236 | 55113220 | - |
| SEQ ID NO 1932 | CCTGGCTGGGTTTAAGGCAG | GAG | chr19 | 55113215 | 55113234 | 55113218 | - |
| SEQ ID NO 1933 | CTGGCTGGGTTTAAGGCAGG | AGG | chr19 | 55113214 | 55113233 | 55113217 | - |
| SEQ ID NO 1934 | TGGCTGGGTTTAAGGCAGGA | GGG | chr19 | 55113213 | 55113232 | 55113216 | - |
| SEQ ID NO 1935 | GGCTGGGTTTAAGGCAGGAG | GGG | chr19 | 55113212 | 55113231 | 55113215 | - |
| SEQ ID NO 1936 | GGGTTTAAGGCAGGAGGGGC | TGG | chr19 | 55113208 | 55113227 | 55113211 | - |
| SEQ ID NO 1937 | GGTTTAAGGCAGGAGGGGCT | GGG | chr19 | 55113207 | 55113226 | 55113210 | - |
| SEQ ID NO 1938 | GTTTAAGGCAGGAGGGGCTG | GGG | chr19 | 55113206 | 55113225 | 55113209 | - |
| SEQ ID NO 1939 | TTTAAGGCAGGAGGGGCTGG | GGG | chr19 | 55113205 | 55113224 | 55113208 | - |
| SEQ ID NO 1940 | AGGCAGGAGGGGCTGGGGGC | CAG | chr19 | 55113201 | 55113220 | 55113204 | - |
| SEQ ID NO 1941 | GGCAGGAGGGGCTGGGGGCC | AGG | chr19 | 55113200 | 55113219 | 55113203 | - |
| SEQ ID NO 1942 | GGGCTGGGGGCCAGGACTCC | TGG | chr19 | 55113192 | 55113211 | 55113195 | - |
| SEQ ID NO 1943 | GGCCAGGACTCCTGGCTCTG | AAG | chr19 | 55113184 | 55113203 | 55113187 | - |
| SEQ ID NO 1944 | GCCAGGACTCCTGGCTCTGA | AGG | chr19 | 55113183 | 55113202 | 55113186 | - |
| SEQ ID NO 1945 | CAGGACTCCTGGCTCTGAAG | GAG | chr19 | 55113181 | 55113200 | 55113184 | - |
| SEQ ID NO 1946 | AGGACTCCTGGCTCTGAAGG | AGG | chr19 | 55113180 | 55113199 | 55113183 | - |
| SEQ ID NO 1947 | GACTCCTGGCTCTGAAGGAG | GAG | chr19 | 55113178 | 55113197 | 55113181 | - |
| SEQ ID NO 1948 | ACTCCTGGCTCTGAAGGAGG | AGG | chr19 | 55113177 | 55113196 | 55113180 | - |
| SEQ ID NO 1949 | CTCCTGGCTCTGAAGGAGGA | GGG | chr19 | 55113176 | 55113195 | 55113179 | - |
| SEQ ID NO 1950 | TCCTGGCTCTGAAGGAGGAG | GGG | chr19 | 55113175 | 55113194 | 55113178 | - |
| SEQ ID NO 1951 | GGCTCTGAAGGAGGAGGGGC | TGG | chr19 | 55113171 | 55113190 | 55113174 | - |
| SEQ ID NO 1952 | AGGGGCTGGAACCTCTTCCC | TAG | chr19 | 55113157 | 55113176 | 55113160 | - |
| SEQ ID NO 1953 | TGGAACCTCTTCCCTAGTCT | GAG | chr19 | 55113151 | 55113170 | 55113154 | - |
| SEQ ID NO 1954 | CTCTTCCCTAGTCTGAGCAC | TGG | chr19 | 55113145 | 55113164 | 55113148 | - |
| SEQ ID NO 1955 | TTCCCTAGTCTGAGCACTGG | AAG | chr19 | 55113142 | 55113161 | 55113145 | - |
| SEQ ID NO 1956 | AGCACTGGAAGCGCCACCTG | TGG | chr19 | 55113130 | 55113149 | 55113133 | - |
| SEQ ID NO 1957 | GCACTGGAAGCGCCACCTGT | GGG | chr19 | 55113129 | 55113148 | 55113132 | - |
| SEQ ID NO 1958 | CTGGAAGCGCCACCTGTGGG | TGG | chr19 | 55113126 | 55113145 | 55113129 | - |
| SEQ ID NO 1959 | GCGCCACCTGTGGGTGGTGA | CGG | chr19 | 55113120 | 55113139 | 55113123 | - |

Figure 1 (Cont'd)

| SEQ ID NO | Sequence | PAM | Chr | Start | End | Pos | Strand |
|---|---|---|---|---|---|---|---|
| SEQ ID NO 1960 | CGCCACCTGTGGGTGGTGAC | GGG | chr19 | 55113119 | 55113138 | 55113122 | - |
| SEQ ID NO 1961 | GCCACCTGTGGGTGGTGACG | GGG | chr19 | 55113118 | 55113137 | 55113121 | - |
| SEQ ID NO 1962 | CCACCTGTGGGTGGTGACGG | GGG | chr19 | 55113117 | 55113136 | 55113120 | - |
| SEQ ID NO 1963 | GGGGGTTTTGCCGTGTCTAA | CAG | chr19 | 55113099 | 55113118 | 55113102 | - |
| SEQ ID NO 1964 | GGGGTTTTGCCGTGTCTAAC | AGG | chr19 | 55113098 | 55113117 | 55113101 | - |
| SEQ ID NO 1965 | CGTGTCTAACAGGTACCATG | TGG | chr19 | 55113088 | 55113107 | 55113091 | - |
| SEQ ID NO 1966 | GTGTCTAACAGGTACCATGT | GGG | chr19 | 55113087 | 55113106 | 55113090 | - |
| SEQ ID NO 1967 | TGTCTAACAGGTACCATGTG | GGG | chr19 | 55113086 | 55113105 | 55113089 | - |
| SEQ ID NO 1968 | CCATGTGGGGTTCCCGCACC | CAG | chr19 | 55113073 | 55113092 | 55113076 | - |
| SEQ ID NO 1969 | TGGGGTTCCCGCACCCAGAT | GAG | chr19 | 55113068 | 55113087 | 55113071 | - |
| SEQ ID NO 1970 | GGTTCCCGCACCCAGATGAG | AAG | chr19 | 55113065 | 55113084 | 55113068 | - |
| SEQ ID NO 1971 | CCCCGTTCACTTCCTGTTTG | CAG | chr19 | 55113031 | 55113050 | 55113034 | - |
| SEQ ID NO 1972 | GTTCACTTCCTGTTTGCAGA | TAG | chr19 | 55113027 | 55113046 | 55113030 | - |
| SEQ ID NO 1973 | ACTTCCTGTTTGCAGATAGC | CAG | chr19 | 55113023 | 55113042 | 55113026 | - |
| SEQ ID NO 1974 | CTTCCTGTTTGCAGATAGCC | AGG | chr19 | 55113022 | 55113041 | 55113025 | - |
| SEQ ID NO 1975 | TCCTGTTTGCAGATAGCCAG | GAG | chr19 | 55113020 | 55113039 | 55113023 | - |
| SEQ ID NO 1976 | GATAGCCAGGAGTCCTTTCG | TGG | chr19 | 55113009 | 55113028 | 55113012 | - |
| SEQ ID NO 1977 | GTCCTTTCGTGGTTTCCACT | GAG | chr19 | 55112998 | 55113017 | 55113001 | - |
| SEQ ID NO 1978 | GTGGTTTCCACTGAGCACTG | AAG | chr19 | 55112990 | 55113009 | 55112993 | - |
| SEQ ID NO 1979 | TGGTTTCCACTGAGCACTGA | AGG | chr19 | 55112989 | 55113008 | 55112992 | - |
| SEQ ID NO 1980 | TCCACTGAGCACTGAAGGCC | TGG | chr19 | 55112984 | 55113003 | 55112987 | - |
| SEQ ID NO 1981 | CTGAGCACTGAAGGCCTGGC | CGG | chr19 | 55112980 | 55112999 | 55112983 | - |
| SEQ ID NO 1982 | GGCCTGGCCGGCCTGACCAC | TGG | chr19 | 55112968 | 55112987 | 55112971 | - |
| SEQ ID NO 1983 | GCCTGGCCGGCCTGACCACT | GGG | chr19 | 55112967 | 55112986 | 55112970 | - |
| SEQ ID NO 1984 | CGGCCTGACCACTGGGCAAC | CAG | chr19 | 55112960 | 55112979 | 55112963 | - |
| SEQ ID NO 1985 | GGCCTGACCACTGGGCAACC | AGG | chr19 | 55112959 | 55112978 | 55112962 | - |
| SEQ ID NO 1986 | GCAACCAGGCGTATCTTAAA | CAG | chr19 | 55112945 | 55112964 | 55112948 | - |
| SEQ ID NO 1987 | CCAGGCGTATCTTAAACAGC | CAG | chr19 | 55112941 | 55112960 | 55112944 | - |
| SEQ ID NO 1988 | GGCGTATCTTAAACAGCCAG | TGG | chr19 | 55112938 | 55112957 | 55112941 | - |
| SEQ ID NO 1989 | TATCTTAAACAGCCAGTGGC | CAG | chr19 | 55112934 | 55112953 | 55112937 | - |
| SEQ ID NO 1990 | TCTTAAACAGCCAGTGGCCA | GAG | chr19 | 55112932 | 55112951 | 55112935 | - |
| SEQ ID NO 1991 | CTTAAACAGCCAGTGGCCAG | AGG | chr19 | 55112931 | 55112950 | 55112934 | - |
| SEQ ID NO 1992 | AGCCAGTGGCCAGAGGCTGT | TGG | chr19 | 55112924 | 55112943 | 55112927 | - |
| SEQ ID NO 1993 | GCCAGTGGCCAGAGGCTGTT | GGG | chr19 | 55112923 | 55112942 | 55112926 | - |
| SEQ ID NO 1994 | GGTCATTTTCCCCACTGTCC | TAG | chr19 | 55112902 | 55112921 | 55112905 | - |
| SEQ ID NO 1995 | CTGTCCTAGCACCGTGTCCC | TGG | chr19 | 55112888 | 55112907 | 55112891 | - |
| SEQ ID NO 1996 | TGTCCTGGATCTGTTTTCG | TGG | chr19 | 55112874 | 55112893 | 55112877 | - |
| SEQ ID NO 1997 | TCTGTTTTCGTGGCTCCCTC | TGG | chr19 | 55112864 | 55112883 | 55112867 | - |
| SEQ ID NO 1998 | TGTTTTCGTGGCTCCCTCTG | GAG | chr19 | 55112862 | 55112881 | 55112865 | - |
| SEQ ID NO 1999 | CCTCTGGAGTCCGACTTGC | TGG | chr19 | 55112848 | 55112867 | 55112851 | - |
| SEQ ID NO 2000 | CTCTGGAGTCCGACTTGCT | GGG | chr19 | 55112847 | 55112866 | 55112850 | - |
| SEQ ID NO 2001 | CCCGACTTGCTGGGACACCG | TGG | chr19 | 55112838 | 55112857 | 55112841 | - |
| SEQ ID NO 2002 | ACTTGCTGGGACACCGTGGC | TGG | chr19 | 55112834 | 55112853 | 55112837 | - |
| SEQ ID NO 2003 | CTTGCTGGGACACCGTGGCT | GGG | chr19 | 55112833 | 55112852 | 55112836 | - |
| SEQ ID NO 2004 | TTGCTGGGACACCGTGGCTG | GGG | chr19 | 55112832 | 55112851 | 55112835 | - |
| SEQ ID NO 2005 | CTGGGACACCGTGGCTGGGG | TAG | chr19 | 55112829 | 55112848 | 55112832 | - |
| SEQ ID NO 2006 | TGGGACACCGTGGCTGGGGT | AGG | chr19 | 55112828 | 55112847 | 55112831 | - |
| SEQ ID NO 2007 | CACCGTGGCTGGGGTAGGTG | CGG | chr19 | 55112823 | 55112842 | 55112826 | - |
| SEQ ID NO 2008 | GCTGGGGTAGGTGCGGCTGA | CGG | chr19 | 55112816 | 55112835 | 55112819 | - |

Figure 1 (Cont'd)

| | | | | | | | |
|---|---|---|---|---|---|---|---|
| SEQ ID NO 2009 | TGACGGCTGTTTCCCACCCC | CAG | chr19 | 55112799 | 55112818 | 55112802 | - |
| SEQ ID NO 2010 | GACGGCTGTTTCCCACCCCC | AGG | chr19 | 55112798 | 55112817 | 55112801 | - |
| SEQ ID NO 2011 | ACCCCCAGGCCTGCATTGAT | GAG | chr19 | 55112784 | 55112803 | 55112787 | - |
| SEQ ID NO 2012 | GGCCTGCATTGATGAGAACC | TGG | chr19 | 55112777 | 55112796 | 55112780 | - |
| SEQ ID NO 2013 | CCTGCATTGATGAGAACCTG | GAG | chr19 | 55112775 | 55112794 | 55112778 | - |
| SEQ ID NO 2014 | CTGCATTGATGAGAACCTGG | AGG | chr19 | 55112774 | 55112793 | 55112777 | - |
| SEQ ID NO 2015 | CATTGATGAGAACCTGGAGG | TGG | chr19 | 55112771 | 55112790 | 55112774 | - |
| SEQ ID NO 2016 | CCTGGAGGTGGTGCGCTTCT | TGG | chr19 | 55112759 | 55112778 | 55112762 | - |
| SEQ ID NO 2017 | GGAGGTGGTGCGCTTCTTGG | TGG | chr19 | 55112756 | 55112775 | 55112759 | - |
| SEQ ID NO 2018 | AGGTGGTGCGCTTCTTGGTG | GAG | chr19 | 55112754 | 55112773 | 55112757 | - |
| SEQ ID NO 2019 | TGGTGCGCTTCTTGGTGGAG | CAG | chr19 | 55112751 | 55112770 | 55112754 | - |
| SEQ ID NO 2020 | GGTGCGCTTCTTGGTGGAGC | AGG | chr19 | 55112750 | 55112769 | 55112753 | - |
| SEQ ID NO 2021 | GTGCGCTTCTTGGTGGAGCA | GGG | chr19 | 55112749 | 55112768 | 55112752 | - |
| SEQ ID NO 2022 | AGCAGGGCGCCACTGTGAAC | CAG | chr19 | 55112733 | 55112752 | 55112736 | - |
| SEQ ID NO 2023 | GCAGGGCGCCACTGTGAACC | AGG | chr19 | 55112732 | 55112751 | 55112735 | - |
| SEQ ID NO 2024 | GGGCGCCACTGTGAACCAGG | CAG | chr19 | 55112729 | 55112748 | 55112732 | - |
| SEQ ID NO 2025 | CTGTGAACCAGGCAGACAAC | GAG | chr19 | 55112721 | 55112740 | 55112724 | - |
| SEQ ID NO 2026 | TGTGAACCAGGCAGACAACG | AGG | chr19 | 55112720 | 55112739 | 55112723 | - |
| SEQ ID NO 2027 | GTGAACCAGGCAGACAACGA | GGG | chr19 | 55112719 | 55112738 | 55112722 | - |
| SEQ ID NO 2028 | ACCAGGCAGACAACGAGGGC | TGG | chr19 | 55112715 | 55112734 | 55112718 | - |
| SEQ ID NO 2029 | GGGCTGGACGCCACTGCACG | TGG | chr19 | 55112699 | 55112718 | 55112702 | - |
| SEQ ID NO 2030 | CTGCACGTGGCCGCCTCCTG | TGG | chr19 | 55112686 | 55112705 | 55112689 | - |
| SEQ ID NO 2031 | GGCCGCCTCCTGTGGCTACC | TAG | chr19 | 55112678 | 55112697 | 55112681 | - |
| SEQ ID NO 2032 | TGTGGCTACCTAGATATCGC | CAG | chr19 | 55112668 | 55112687 | 55112671 | - |

Figure 2

| # | Sequence | PAM | Chr | Start | End | Cuts 5' of | Str |
|---|---|---|---|---|---|---|---|
| SEQ ID NO 2033 | GTTCTCATCAATGCAGGCCT | GGGGGT | chr19 | 55112778 | 55112797 | 55112794 | + |
| SEQ ID NO 2034 | GAAGGGAGGGGGCTTCTCAT | CTGGGT | chr19 | 55113050 | 55113069 | 55113066 | + |
| SEQ ID NO 2035 | GCCCCTCCTCCTTCAGAGCC | AGGAGT | chr19 | 55113171 | 55113190 | 55113187 | + |
| SEQ ID NO 2036 | AAACCCAGCCAGGTCCTTCC | AAGGGT | chr19 | 55113222 | 55113241 | 55113238 | + |
| SEQ ID NO 2037 | GCCGTGGGCCCAGGGCTATG | CAGGGT | chr19 | 55113290 | 55113309 | 55113306 | + |
| SEQ ID NO 2038 | GGCCTGGGCGGGACTCCCAG | AGGGGT | chr19 | 55113351 | 55113370 | 55113367 | + |
| SEQ ID NO 2039 | CCGTTTCTCATTCTTCCCTT | AGGGGT | chr19 | 55113480 | 55113499 | 55113496 | + |
| SEQ ID NO 2040 | GGGACAAAAGCCGAAGTCCA | GGGGGT | chr19 | 55113518 | 55113537 | 55113534 | + |
| SEQ ID NO 2041 | TGCCCCAGGCCTTGTGGACA | CTGGGT | chr19 | 55113557 | 55113576 | 55113573 | + |
| SEQ ID NO 2042 | ACCTGAACTGGAGCTGAGGA | AGGAGT | chr19 | 55113593 | 55113612 | 55113609 | + |
| SEQ ID NO 2043 | AAGCTAAACTCCTAGATCCA | CGGGAT | chr19 | 55113620 | 55113639 | 55113636 | + |
| SEQ ID NO 2044 | GGCCGCACGTGCCCTGGGAA | CGGGAT | chr19 | 55113754 | 55113773 | 55113770 | + |
| SEQ ID NO 2045 | GGCCTGGGCACCAGGGACTC | CAGAGT | chr19 | 55113902 | 55113921 | 55113918 | + |
| SEQ ID NO 2046 | GCCCTTCCGCCCTCAGATGA | AGGAGT | chr19 | 55113972 | 55113991 | 55113988 | + |
| SEQ ID NO 2047 | GCCTCTCCCCATTCAGACCC | AGGGGT | chr19 | 55114009 | 55114028 | 55114025 | + |
| SEQ ID NO 2048 | GCCCCTCCTCCCTCAGACCC | ACGAGT | chr19 | 55114081 | 55114100 | 55114097 | + |
| SEQ ID NO 2049 | GCCCCTCCTCCCTCGGACCC | AGGAGT | chr19 | 55114117 | 55114136 | 55114133 | + |
| SEQ ID NO 2050 | GTCCCTCCACCCTCAGACCC | AGGAGT | chr19 | 55114154 | 55114173 | 55114170 | + |
| SEQ ID NO 2051 | GCCCCTCCTCCCTCGGACCC | AGGAGT | chr19 | 55114190 | 55114209 | 55114206 | + |
| SEQ ID NO 2052 | GCTCTTCTCTGTTCAGCCCT | AAGAAT | chr19 | 55114263 | 55114282 | 55114279 | + |
| SEQ ID NO 2053 | CCCCTAGCCACTAAGGCAAT | TGGGGT | chr19 | 55114323 | 55114342 | 55114339 | + |
| SEQ ID NO 2054 | CACTAAGGCAATTGGGGTGC | AGGAAT | chr19 | 55114331 | 55114350 | 55114347 | + |
| SEQ ID NO 2055 | TTGGGGTGCAGGAATGGGGG | CAGGGT | chr19 | 55114342 | 55114361 | 55114358 | + |
| SEQ ID NO 2056 | AAGTGGTTGATAAACCCACG | TGGGGT | chr19 | 55114380 | 55114399 | 55114396 | + |
| SEQ ID NO 2057 | GCTTGGGGACCTGCCTGGAG | AAGGAT | chr19 | 55114445 | 55114464 | 55114461 | + |
| SEQ ID NO 2058 | CCCAGGTGGAGAAACTGGCC | GGGAAT | chr19 | 55114490 | 55114509 | 55114506 | + |
| SEQ ID NO 2059 | GGAGAAACTGGCCGGGAATC | AAGAGT | chr19 | 55114497 | 55114516 | 55114513 | + |
| SEQ ID NO 2060 | ATCCCTGTTTTCCTAGGACT | GAGGGT | chr19 | 55114545 | 55114564 | 55114561 | + |
| SEQ ID NO 2061 | TTGGCCACGTAACCTGAGAA | GGGAAT | chr19 | 55114660 | 55114679 | 55114676 | + |
| SEQ ID NO 2062 | CCCCAATGCTCCAGGCCTCC | TGGGAT | chr19 | 55114710 | 55114729 | 55114726 | + |
| SEQ ID NO 2063 | AGGCCTCCTGGGATACCCCG | AAGAGT | chr19 | 55114722 | 55114741 | 55114738 | + |
| SEQ ID NO 2064 | CTCCTGGGATACCCCGAAGA | GTGAGT | chr19 | 55114726 | 55114745 | 55114742 | + |
| SEQ ID NO 2065 | CAGTCACCCCACAGTTGGAG | GAGAAT | chr19 | 55114760 | 55114779 | 55114776 | + |
| SEQ ID NO 2066 | GGCAGCCTGGTAGACAGGGC | TGGGGT | chr19 | 55114796 | 55114815 | 55114812 | + |
| SEQ ID NO 2067 | AGGGCTGGGGTGGCCTCTCG | TGGGGT | chr19 | 55114811 | 55114830 | 55114827 | + |
| SEQ ID NO 2068 | TAGGTGGCCTGGGGCCTCTG | GGGGAT | chr19 | 55114847 | 55114866 | 55114863 | + |
| SEQ ID NO 2069 | TCTGGGGGATGCAGGGGAAG | GGGGAT | chr19 | 55114863 | 55114882 | 55114879 | + |
| SEQ ID NO 2070 | GAAGGGGGATGCAGGGGAAC | GGGGAT | chr19 | 55114879 | 55114898 | 55114895 | + |
| SEQ ID NO 2071 | CGGGACCCTGCTCTGGGCGG | AGGAAT | chr19 | 55115079 | 55115098 | 55115095 | + |
| SEQ ID NO 2072 | TGGGGACTCTTTAAGGAAAG | AAGGAT | chr19 | 55115121 | 55115140 | 55115137 | + |
| SEQ ID NO 2073 | GAAGGATGGAGAAAGAGAAA | GGGAGT | chr19 | 55115140 | 55115159 | 55115156 | + |
| SEQ ID NO 2074 | GGACGCACCATTCTCACAAA | GGGAGT | chr19 | 55115195 | 55115214 | 55115211 | + |
| SEQ ID NO 2075 | GTGTAAGGAAGCTGCAGCAC | CAGGAT | chr19 | 55115414 | 55115433 | 55115430 | + |
| SEQ ID NO 2076 | GAGCAGCTCAGGTTCTGGGA | GAGGGT | chr19 | 55115468 | 55115487 | 55115484 | + |
| SEQ ID NO 2077 | GGTTCTGGGAGAGGGTAGCG | CAGGGT | chr19 | 55115478 | 55115497 | 55115494 | + |
| SEQ ID NO 2078 | CCCTGCCAAGCTCTCCCTCC | CAGGAT | chr19 | 55115552 | 55115571 | 55115568 | + |
| SEQ ID NO 2079 | GAGAGATGGCTCCAGGAAAT | GGGGGT | chr19 | 55115624 | 55115643 | 55115640 | + |
| SEQ ID NO 2080 | TGGGGGTGTGTCACCAGATA | AGGAAT | chr19 | 55115643 | 55115662 | 55115659 | + |

Figure 2 (Cont'd)

| | | | | | | | |
|---|---|---|---|---|---|---|---|
| SEQ ID NO 2081 | GAATCTGCCTAACAGGAGGT | GGGGGT | chr19 | 55115665 | 55115684 | 55115681 | + |
| SEQ ID NO 2082 | GACTAGGAAGGAGGAGGCCT | AAGGAT | chr19 | 55115708 | 55115727 | 55115724 | + |
| SEQ ID NO 2083 | TGTCCCTAGTGGCCCCACTG | TGGGGT | chr19 | 55115756 | 55115775 | 55115772 | + |
| SEQ ID NO 2084 | GAGCCACATTAACCGGCCCT | GGGAAT | chr19 | 55115812 | 55115831 | 55115828 | + |
| SEQ ID NO 2085 | GTGGTCCCAGCTCGGGGACA | CAGGAT | chr19 | 55115843 | 55115862 | 55115859 | + |
| SEQ ID NO 2086 | CCTGAAGTGGACATAGGGGC | CCGGGT | chr19 | 55115893 | 55115912 | 55115909 | + |
| SEQ ID NO 2087 | GCACAGACTAGAGAGGTAAG | GGGGGT | chr19 | 55115987 | 55116006 | 55116003 | + |
| SEQ ID NO 2088 | AGGGGAGCTGCCCAAATGAA | AGGAGT | chr19 | 55116013 | 55116032 | 55116029 | + |
| SEQ ID NO 2089 | TGAAAGGAGTGAGAGGTGAC | CCGAAT | chr19 | 55116029 | 55116048 | 55116045 | + |
| SEQ ID NO 2090 | GACCCGAATCCACAGGAGAA | CGGGGT | chr19 | 55116046 | 55116065 | 55116062 | + |
| SEQ ID NO 2091 | TGTCCAGGCAAAGAAAGCAA | GAGGAT | chr19 | 55116071 | 55116090 | 55116087 | + |
| SEQ ID NO 2092 | GGTGGCTAAAGCCAGGGAGA | CGGGGT | chr19 | 55116102 | 55116121 | 55116118 | + |
| SEQ ID NO 2093 | GCCAGGGAGACGGGGTACTT | TGGGGT | chr19 | 55116112 | 55116131 | 55116128 | + |
| SEQ ID NO 2094 | GAGAAGGAAAAGGGAACCCA | GCGAGT | chr19 | 55116252 | 55116271 | 55116268 | + |
| SEQ ID NO 2095 | CCCAGCGAGTGAAGACGGCA | TGGGGT | chr19 | 55116268 | 55116287 | 55116284 | + |
| SEQ ID NO 2096 | CGAGTGAAGACGGCATGGGG | TTGGGT | chr19 | 55116273 | 55116292 | 55116289 | + |
| SEQ ID NO 2097 | GGAGAGGACCCAGACACGGG | GAGGAT | chr19 | 55116317 | 55116336 | 55116333 | + |
| SEQ ID NO 2098 | AGCAGAGAGCAAGGGGAAGA | GGGAGT | chr19 | 55116417 | 55116436 | 55116433 | + |
| SEQ ID NO 2099 | ACCTGAAGGAGGCGGCAGGG | AAGGAT | chr19 | 55116456 | 55116475 | 55116472 | + |
| SEQ ID NO 2100 | AGCGGCACAGGCCCAGGGGA | GAGAAT | chr19 | 55116528 | 55116547 | 55116544 | + |
| SEQ ID NO 2101 | GAGACGGCAGCGTTAGAGGG | CAGAGT | chr19 | 55116652 | 55116671 | 55116668 | + |
| SEQ ID NO 2102 | GGAAGAGGGGAAGTCGAGGG | AGGGAT | chr19 | 55116848 | 55116867 | 55116864 | + |
| SEQ ID NO 2103 | GGGATGGTAAGGAGGACTGC | ATGGGT | chr19 | 55116869 | 55116888 | 55116885 | + |
| SEQ ID NO 2104 | AAAGCGACTCCAATGCGGAA | GAGAGT | chr19 | 55116925 | 55116944 | 55116941 | + |
| SEQ ID NO 2105 | CGGAAGAGAGTAGGTCGAAG | GGGAAT | chr19 | 55116940 | 55116959 | 55116956 | + |
| SEQ ID NO 2106 | AATGGTAAGGAGGCCTGGGG | CAGAGT | chr19 | 55116963 | 55116982 | 55116979 | + |
| SEQ ID NO 2107 | CTGGGCAGAGTGGTCAGCA | CAGAGT | chr19 | 55116977 | 55116996 | 55116993 | + |
| SEQ ID NO 2108 | AAGCGGCTCCAATTCGGAAG | TGGGGT | chr19 | 55117024 | 55117043 | 55117040 | + |
| SEQ ID NO 2109 | CGGAAGTGGGGTGGTCGAAG | GGGAAT | chr19 | 55117038 | 55117057 | 55117054 | + |
| SEQ ID NO 2110 | AATGGTAAGGGGGACTGGGA | CGGGGT | chr19 | 55117061 | 55117080 | 55117077 | + |
| SEQ ID NO 2111 | ACTGGGACGGGGTGTCAGCA | TAGGGT | chr19 | 55117074 | 55117093 | 55117090 | + |
| SEQ ID NO 2112 | CCAGGGCCAGGAACGACGGG | GCGGAT | chr19 | 55117108 | 55117127 | 55117124 | + |
| SEQ ID NO 2113 | CGAGACTGGCAACGGGGAAG | GAGGAT | chr19 | 55117134 | 55117153 | 55117150 | + |
| SEQ ID NO 2114 | ATGCCCCAGGTGGCGCAGCA | GAGGGT | chr19 | 55117158 | 55117177 | 55117174 | + |
| SEQ ID NO 2115 | GCTGATACCGTCGGCGTTGG | TGGAGT | chr19 | 55117235 | 55117254 | 55117251 | + |
| SEQ ID NO 2116 | GCGGGCGGGCGGCGGCGCGG | CGGGGT | chr19 | 55117271 | 55117290 | 55117287 | + |
| SEQ ID NO 2117 | GTCGAGCTCGGCGCCGGGGC | CAGGGT | chr19 | 55117295 | 55117314 | 55117311 | + |
| SEQ ID NO 2118 | CGGGCGGTGCGATGTCCGGA | GAGGAT | chr19 | 55117535 | 55117554 | 55117538 | - |
| SEQ ID NO 2119 | CGTCCGCTTCGAGCGCGCCG | CCGAGT | chr19 | 55117387 | 55117406 | 55117390 | - |
| SEQ ID NO 2120 | CCCCTTCGACCACCCCACTT | CCGAAT | chr19 | 55117041 | 55117060 | 55117044 | - |
| SEQ ID NO 2121 | CGACCTACTCTCTTCCGCAT | TGGAGT | chr19 | 55116937 | 55116956 | 55116940 | - |
| SEQ ID NO 2122 | GCGCTGCCCTCCTCTCGCCC | CCGAGT | chr19 | 55116704 | 55116723 | 55116707 | - |
| SEQ ID NO 2123 | CTAACGCTGCCGTCTCTCTC | CTGAGT | chr19 | 55116648 | 55116667 | 55116651 | - |
| SEQ ID NO 2124 | TTCTGTCTGCAGCTTGTGGC | CTGGGT | chr19 | 55116508 | 55116527 | 55116511 | - |
| SEQ ID NO 2125 | TCTCTGCTGTGTTGCTGCCC | AAGGAT | chr19 | 55116405 | 55116424 | 55116408 | - |
| SEQ ID NO 2126 | CACCACGTGATGTCCTCTGA | GCGGAT | chr19 | 55116347 | 55116366 | 55116350 | - |
| SEQ ID NO 2127 | TGAGCGGATCCTCCCCGTGT | CTGGGT | chr19 | 55116330 | 55116349 | 55116333 | - |
| SEQ ID NO 2128 | CCCCATGCCGTCTTCACTCG | CTGGGT | chr19 | 55116273 | 55116292 | 55116276 | - |
| SEQ ID NO 2129 | CTGTGCCATCTCTCGTTTCT | TAGGAT | chr19 | 55116222 | 55116241 | 55116225 | - |

Figure 2 (Cont'd)

| | | | | | | | |
|---|---|---|---|---|---|---|---|
| SEQ ID NO 2130 | TCTTAGGATGGCCTTCTCCG | ACGGAT | chr19 | 55116205 | 55116224 | 55116208 | - |
| SEQ ID NO 2131 | CCTGGACACCCCGTTCTCCT | GTGGAT | chr19 | 55116059 | 55116078 | 55116062 | - |
| SEQ ID NO 2132 | CACCCCGTTCTCCTGTGGAT | TCGGGT | chr19 | 55116053 | 55116072 | 55116056 | - |
| SEQ ID NO 2133 | CCCCTGTCATGGCATCTTCC | AGGGGT | chr19 | 55115954 | 55115973 | 55115957 | - |
| SEQ ID NO 2134 | ACAGCATGTTTGCTGCCTCC | AGGGAT | chr19 | 55115873 | 55115892 | 55115876 | - |
| SEQ ID NO 2135 | CGGTTAATGTGGCTCTGGTT | CTGGGT | chr19 | 55115807 | 55115826 | 55115810 | - |
| SEQ ID NO 2136 | CACAGTGGGGCCACTAGGGA | CAGGAT | chr19 | 55115758 | 55115777 | 55115761 | - |
| SEQ ID NO 2137 | TCCTTCCTAGTCTCCTGATA | TTGGGT | chr19 | 55115700 | 55115719 | 55115703 | - |
| SEQ ID NO 2138 | TTGCTTACGATGGAGCCAGA | GAGGAT | chr19 | 55115582 | 55115601 | 55115585 | - |
| SEQ ID NO 2139 | CTGGGAGGGAGAGCTTGGCA | GGGGGT | chr19 | 55115555 | 55115574 | 55115558 | - |
| SEQ ID NO 2140 | CAGGGGGTGGGAGGGAAGGG | GGGGAT | chr19 | 55115537 | 55115556 | 55115540 | - |
| SEQ ID NO 2141 | GCAGTTTGGAAAAACAAAAT | CAGAAT | chr19 | 55115379 | 55115398 | 55115382 | - |
| SEQ ID NO 2142 | AAAATCAGAATAAGTTGGTC | CTGAGT | chr19 | 55115364 | 55115383 | 55115367 | - |
| SEQ ID NO 2143 | GGCAGGGCTGTGGTGAGGAG | GGGGGT | chr19 | 55115240 | 55115259 | 55115243 | - |
| SEQ ID NO 2144 | GTGTGGAAAACTCCCTTTGT | GAGAAT | chr19 | 55115210 | 55115229 | 55115213 | - |
| SEQ ID NO 2145 | TCTCCATCCTTCTTTCCTTA | AAGAGT | chr19 | 55115132 | 55115151 | 55115135 | - |
| SEQ ID NO 2146 | ACATATTCCTCCGCCCAGAG | CAGGGT | chr19 | 55115089 | 55115108 | 55115092 | - |
| SEQ ID NO 2147 | TAAGGCCCTGCTCTGGGCTT | CTGGGT | chr19 | 55115053 | 55115072 | 55115056 | - |
| SEQ ID NO 2148 | CCTGCTCTGGGCTTCTGGGT | TTGAGT | chr19 | 55115047 | 55115066 | 55115050 | - |
| SEQ ID NO 2149 | CTCTCCTGCCCCTTCCCTAC | AGGGGT | chr19 | 55114950 | 55114969 | 55114953 | - |
| SEQ ID NO 2150 | CCTGTCTACCAGGCTGCCTT | TTGGGT | chr19 | 55114794 | 55114813 | 55114797 | - |
| SEQ ID NO 2151 | TCTACCAGGCTGCCTTTTGG | GTGGAT | chr19 | 55114790 | 55114809 | 55114793 | - |
| SEQ ID NO 2152 | GGTGGATTCTCCTCCAACTG | TGGGGT | chr19 | 55114771 | 55114790 | 55114774 | - |
| SEQ ID NO 2153 | TGCTTGGCAAACTCACTCTT | CGGGGT | chr19 | 55114742 | 55114761 | 55114745 | - |
| SEQ ID NO 2154 | TCCCAGGAGGCCTGGAGCAT | TGGGGT | chr19 | 55114715 | 55114734 | 55114718 | - |
| SEQ ID NO 2155 | CCTGGAGCATTGGGGTGGGC | TGGGGT | chr19 | 55114705 | 55114724 | 55114708 | - |
| SEQ ID NO 2156 | TGGGCTGGGGTTCAGAGAGG | AGGGAT | chr19 | 55114690 | 55114709 | 55114693 | - |
| SEQ ID NO 2157 | GTGGCCAAGAAGCAGGGGAG | CTGGGT | chr19 | 55114648 | 55114667 | 55114651 | - |
| SEQ ID NO 2158 | AAGAAGCAGGGGAGCTGGGT | TTGGGT | chr19 | 55114642 | 55114661 | 55114645 | - |
| SEQ ID NO 2159 | GAGCTGGGTTTGGGTCAGGT | CTGGGT | chr19 | 55114631 | 55114650 | 55114634 | - |
| SEQ ID NO 2160 | GTTTGGGTCAGGTCTGGGTG | TGGGGT | chr19 | 55114624 | 55114643 | 55114627 | - |
| SEQ ID NO 2161 | ACCCTCAGTCCTAGGAAAAC | AGGGAT | chr19 | 55114551 | 55114570 | 55114554 | - |
| SEQ ID NO 2162 | GGGATGGTTGGTCACTGTCT | CTGGGT | chr19 | 55114530 | 55114549 | 55114533 | - |
| SEQ ID NO 2163 | TGTGGCTGTTCCCAAGTTCT | TAGGGT | chr19 | 55114412 | 55114431 | 55114415 | - |
| SEQ ID NO 2164 | AAGTTCTTAGGGTACCCCAC | GTGGGT | chr19 | 55114399 | 55114418 | 55114402 | - |
| SEQ ID NO 2165 | CCCAATTGCCTTAGTGGCTA | GGGGGT | chr19 | 55114327 | 55114346 | 55114330 | - |
| SEQ ID NO 2166 | GTGGCTAGGGGTTGGGGGC | TAGAGT | chr19 | 55114314 | 55114333 | 55114317 | - |
| SEQ ID NO 2167 | AGAGTAGGAGGGGCTGGAGC | CAGGAT | chr19 | 55114293 | 55114312 | 55114296 | - |
| SEQ ID NO 2168 | AGAGCTGGGGGCCTGGGCTC | CTGGGT | chr19 | 55114248 | 55114267 | 55114251 | - |
| SEQ ID NO 2169 | AGGGGCTGGGGCCTGGACTC | CTGGGT | chr19 | 55114212 | 55114231 | 55114215 | - |
| SEQ ID NO 2170 | AGGGGCTGGGGCCTGGACTC | CTGGGT | chr19 | 55114176 | 55114195 | 55114179 | - |
| SEQ ID NO 2171 | GGGCCTGGACTCCTGGGTCT | GAGGGT | chr19 | 55114168 | 55114187 | 55114171 | - |
| SEQ ID NO 2172 | GGGACTGGGGCCTGGACTC | CTGGGT | chr19 | 55114139 | 55114158 | 55114142 | - |
| SEQ ID NO 2173 | AGGGGCTGGGGCCTGGACTC | GTGGGT | chr19 | 55114103 | 55114122 | 55114106 | - |
| SEQ ID NO 2174 | GGGGCTGGGGCCTGGACTT | CTGGGT | chr19 | 55114066 | 55114085 | 55114069 | - |
| SEQ ID NO 2175 | GCGGGCTGGGCCTGGACCC | CTGGGT | chr19 | 55114031 | 55114050 | 55114034 | - |
| SEQ ID NO 2176 | CTGGGCCTGGACCCCTGGGT | CTGAAT | chr19 | 55114025 | 55114044 | 55114028 | - |
| SEQ ID NO 2177 | AAGGGCTGGGGCCTGGCCTC | CTGGGT | chr19 | 55113958 | 55113977 | 55113961 | - |
| SEQ ID NO 2178 | CTGGGGCCTGGCCTCCTGGG | TTGAAT | chr19 | 55113953 | 55113972 | 55113956 | - |

Figure 2 (Cont'd)

| | | | | | | | |
|---|---|---|---|---|---|---|---|
| SEQ ID NO 2179 | GCCTCCTGGGTTGAATGGGG | AGGGGT | chr19 | 55113943 | 55113962 | 55113946 | - |
| SEQ ID NO 2180 | GAGGGGTTGGGCCTGGACTC | TGGAGT | chr19 | 55113924 | 55113943 | 55113927 | - |
| SEQ ID NO 2181 | AGGCCTCAGGCATCTTTCAC | AGGGAT | chr19 | 55113887 | 55113906 | 55113890 | - |
| SEQ ID NO 2182 | CTCCCCTATCGCCATGACAA | CTGGGT | chr19 | 55113807 | 55113826 | 55113810 | - |
| SEQ ID NO 2183 | ACTGGGTGGAAATAAACGAG | CCGAGT | chr19 | 55113788 | 55113807 | 55113791 | - |
| SEQ ID NO 2184 | ACGTGCGGCCCCTTCACAGC | CCGAGT | chr19 | 55113744 | 55113763 | 55113747 | - |
| SEQ ID NO 2185 | TTGGAGAGGTGAGGGACTTG | GGGGGT | chr19 | 55113657 | 55113676 | 55113660 | - |
| SEQ ID NO 2186 | CTTGGGGGGTAATTTATCCC | GTGGAT | chr19 | 55113641 | 55113660 | 55113644 | - |
| SEQ ID NO 2187 | GTAATTTATCCCGTGGATCT | AGGAGT | chr19 | 55113633 | 55113652 | 55113636 | - |
| SEQ ID NO 2188 | AAGTTTTGGACCCCTAAGGG | AAGAAT | chr19 | 55113495 | 55113514 | 55113498 | - |
| SEQ ID NO 2189 | CAGAGGGGGCCTCAGTGAAC | TGGAGT | chr19 | 55113425 | 55113444 | 55113428 | - |
| SEQ ID NO 2190 | TGCAGCTGTCTCACCCCTCT | GGGAGT | chr19 | 55113369 | 55113388 | 55113372 | - |
| SEQ ID NO 2191 | TGGGAGTCCCGCCCAGGCCC | CTGAGT | chr19 | 55113350 | 55113369 | 55113353 | - |
| SEQ ID NO 2192 | CCCCTGAGTCTGTCCCAGCA | CAGGGT | chr19 | 55113333 | 55113352 | 55113336 | - |
| SEQ ID NO 2193 | GGCCCACGGCTTCGTTCCTG | CAGAGT | chr19 | 55113280 | 55113299 | 55113283 | - |
| SEQ ID NO 2194 | CGTTCCTGCAGAGTATCTGC | TGGGGT | chr19 | 55113268 | 55113287 | 55113271 | - |
| SEQ ID NO 2195 | TGACCCTTGGAAGGACCTGG | CTGGGT | chr19 | 55113230 | 55113249 | 55113233 | - |
| SEQ ID NO 2196 | GAGCACTGGAAGCGCCACCT | GTGGGT | chr19 | 55113131 | 55113150 | 55113134 | - |
| SEQ ID NO 2197 | CGCCACCTGTGGGTGGTGAC | GGGGGT | chr19 | 55113119 | 55113138 | 55113122 | - |
| SEQ ID NO 2198 | CGTGTCTAACAGGTACCATG | TGGGGT | chr19 | 55113088 | 55113107 | 55113091 | - |
| SEQ ID NO 2199 | CTTCCTGTTTGCAGATAGCC | AGGAGT | chr19 | 55113022 | 55113041 | 55113025 | - |
| SEQ ID NO 2200 | CAGCCAGTGGCCAGAGGCTG | TTGGGT | chr19 | 55112925 | 55112944 | 55112928 | - |
| SEQ ID NO 2201 | ACTGTCCTAGCACCGTGTCC | CTGGAT | chr19 | 55112889 | 55112908 | 55112892 | - |
| SEQ ID NO 2202 | TCTGTTTTCGTGGCTCCCTC | TGGAGT | chr19 | 55112864 | 55112883 | 55112867 | - |
| SEQ ID NO 2203 | ACTTGCTGGGACACCGTGGC | TGGGGT | chr19 | 55112834 | 55112853 | 55112837 | - |

Figure 3

| # | Sequence | PAM | Chr | Start | End | Cuts 5' of | Str |
|---|---|---|---|---|---|---|---|
| SEQ ID NO 2204 | AGCTCTTCTCTGTTCAGCCC | TAAGAAT | chr19 | 55114262 | 55114281 | 55114278 | + |
| SEQ ID NO 2205 | GCCTGGAGAAGGATGCAGGA | CGAGAAA | chr19 | 55114457 | 55114476 | 55114473 | + |
| SEQ ID NO 2206 | CGAGAAACACAGCCCCAGGT | GGAGAAA | chr19 | 55114477 | 55114496 | 55114493 | + |
| SEQ ID NO 2207 | GCAGTCACCCCACAGTTGGA | GGAGAAT | chr19 | 55114759 | 55114778 | 55114775 | + |
| SEQ ID NO 2208 | CTCTTTAAGGAAAGAAGGAT | GGAGAAA | chr19 | 55115127 | 55115146 | 55115143 | + |
| SEQ ID NO 2209 | AAGGAAAGAAGGATGGAGAA | AGAGAAA | chr19 | 55115133 | 55115152 | 55115149 | + |
| SEQ ID NO 2210 | GGAACAATATAAATTGGGGA | CTAGAAA | chr19 | 55115311 | 55115330 | 55115327 | + |
| SEQ ID NO 2211 | GGAGAACGGGGTGTCCAGGC | AAAGAAA | chr19 | 55116060 | 55116079 | 55116076 | + |
| SEQ ID NO 2212 | ACGGGGTACTTTGGGGTTGT | CCAGAAA | chr19 | 55116121 | 55116140 | 55116137 | + |
| SEQ ID NO 2213 | TCCGTCGGAGAAGGCCATCC | TAAGAAA | chr19 | 55116200 | 55116219 | 55116216 | + |
| SEQ ID NO 2214 | ACCCAGGCCACAAGCTGCAG | ACAGAAA | chr19 | 55116502 | 55116521 | 55116518 | + |
| SEQ ID NO 2215 | AAGCGGCACAGGCCCAGGGG | AGAGAAT | chr19 | 55116527 | 55116546 | 55116543 | + |
| SEQ ID NO 2216 | CAGGGGAGAGAATGCAGGTC | AGAGAAA | chr19 | 55116541 | 55116560 | 55116557 | + |
| SEQ ID NO 2217 | CACTAGGGACAGGATTGGTG | ACAGAAA | chr19 | 55115747 | 55115766 | 55115750 | - |
| SEQ ID NO 2218 | AGCAGTTTGGAAAAACAAAA | TCAGAAT | chr19 | 55115380 | 55115399 | 55115383 | - |
| SEQ ID NO 2219 | CGTGTGGAAAACTCCCTTTG | TGAGAAT | chr19 | 55115211 | 55115230 | 55115214 | - |
| SEQ ID NO 2220 | CAAGTTTTGGACCCCTAAGG | GAAGAAT | chr19 | 55113496 | 55113515 | 55113499 | - |
| SEQ ID NO 2221 | TTGGACCCCTAAGGGAAGAA | TGAGAAA | chr19 | 55113490 | 55113509 | 55113493 | - |

Figure 4

| # | Sequence | PAM | Chr | Start | End | Cuts 5' of | Str |
|---|---|---|---|---|---|---|---|
| SEQ ID NO 2222 | GGGACTCCAGAGGGAGCCAC | GAAAAC | chr19 | 55112855 | 55112874 | 55112871 | + |
| SEQ ID NO 2223 | ATGGTACCTGTTAGACACGG | CAAAAC | chr19 | 55113089 | 55113108 | 55113105 | + |
| SEQ ID NO 2224 | TCATTCTTCCCTTAGGGGTC | CAAAAC | chr19 | 55113487 | 55113506 | 55113503 | + |
| SEQ ID NO 2225 | AGGACTGAGGGTTTCAGTGC | TAAAAC | chr19 | 55114559 | 55114578 | 55114575 | + |
| SEQ ID NO 2226 | TACTGGCCTTATCTCACAGG | TAAAAC | chr19 | 55115274 | 55115293 | 55115290 | + |
| SEQ ID NO 2227 | GGTACTTTGGGGTTGTCCAG | AAAAAC | chr19 | 55116125 | 55116144 | 55116141 | + |
| SEQ ID NO 2228 | CAAGAGGAGAAGCAGTTTGG | AAAAAC | chr19 | 55115390 | 55115409 | 55115393 | - |
| SEQ ID NO 2229 | AGGAGGGGGGTGTCCGTGTG | GAAAAC | chr19 | 55115225 | 55115244 | 55115228 | - |
| SEQ ID NO 2230 | ACTGAAACCCTCAGTCCTAG | GAAAAC | chr19 | 55114557 | 55114576 | 55114560 | - |

Figure 5

| # | Sequence | PAM | Chr | Start | End | Cuts 5' of | Str |
|---|---|---|---|---|---|---|---|
| SEQ ID NO 2231 | CCCAACAGCCTCTGGCCACT | GGCTGTTT | chr19 | 55112920 | 55112939 | 55112936 | + |
| SEQ ID NO 2232 | GGAAGTGAACGGGGAAGGGA | GGGGGCTT | chr19 | 55113037 | 55113056 | 55113053 | + |
| SEQ ID NO 2233 | CCCCCGTCACCACCCACAGG | TGGCGCTT | chr19 | 55113114 | 55113133 | 55113130 | + |
| SEQ ID NO 2234 | AGCCAGGGGCTGACACGGGC | CACCGTTT | chr19 | 55113458 | 55113477 | 55113474 | + |
| SEQ ID NO 2235 | CTGGGAACGGGATGAACTCG | GCTCGTTT | chr19 | 55113767 | 55113786 | 55113783 | + |
| SEQ ID NO 2236 | GAACAGCCACAGCAGGGGGG | CGATGCTT | chr19 | 55114421 | 55114440 | 55114437 | + |
| SEQ ID NO 2237 | CAGAGACAGTGACCAACCAT | CCCTGTTT | chr19 | 55114527 | 55114546 | 55114543 | + |
| SEQ ID NO 2238 | ATCCCTGTTTTCCTAGGACT | GAGGGTTT | chr19 | 55114545 | 55114564 | 55114561 | + |
| SEQ ID NO 2239 | ACCTGACCCAAACCCAGCTC | CCCTGCTT | chr19 | 55114631 | 55114650 | 55114647 | + |
| SEQ ID NO 2240 | CTCCTGGGATACCCCGAAGA | GTGAGTTT | chr19 | 55114726 | 55114745 | 55114742 | + |
| SEQ ID NO 2241 | GGGAAGCCTGAGCGCCTCTC | CTGGGCTT | chr19 | 55115006 | 55115025 | 55115022 | + |
| SEQ ID NO 2242 | GGACGCACCATTCTCACAAA | GGGAGTTT | chr19 | 55115195 | 55115214 | 55115211 | + |
| SEQ ID NO 2243 | TAGAACTCAGGACCAACTTA | TTCTGATT | chr19 | 55115354 | 55115373 | 55115370 | + |
| SEQ ID NO 2244 | TCAGGACCAACTTATTCTGA | TTTTGTTT | chr19 | 55115360 | 55115379 | 55115376 | + |
| SEQ ID NO 2245 | ATTCTGATTTTGTTTTTCCA | AACTGCTT | chr19 | 55115373 | 55115392 | 55115389 | + |
| SEQ ID NO 2246 | GGAAGGAGGAGGCCTAAGGA | TGGGGCTT | chr19 | 55115713 | 55115732 | 55115729 | + |
| SEQ ID NO 2247 | GAGAGCGCCGCGCCCGCACC | GTCCGCTT | chr19 | 55117406 | 55117425 | 55117409 | - |
| SEQ ID NO 2248 | CCGCCCCGTCGTTCCTGGCC | CTGGGCTT | chr19 | 55117112 | 55117131 | 55117115 | - |
| SEQ ID NO 2249 | CCACCCCACTTCCGAATTGG | AGCCGCTT | chr19 | 55117032 | 55117051 | 55117035 | - |
| SEQ ID NO 2250 | TGGAGCCGCTTCAACTGGCC | CTGGGCTT | chr19 | 55117015 | 55117034 | 55117018 | - |
| SEQ ID NO 2251 | CCTACTCTCTTCCGCATTGG | AGTCGCTT | chr19 | 55116934 | 55116953 | 55116937 | - |
| SEQ ID NO 2252 | TTGGAGTCGCTTTAACTGGC | CCTGGCTT | chr19 | 55116918 | 55116937 | 55116921 | - |
| SEQ ID NO 2253 | TCCGGACCACTTTGAGCTCT | ACTGGCTT | chr19 | 55116623 | 55116642 | 55116626 | - |
| SEQ ID NO 2254 | CTTCTGCGCCGCCTCTGGCC | CACTGTTT | chr19 | 55116598 | 55116617 | 55116601 | - |
| SEQ ID NO 2255 | GTTTCCCCTTCCAGGCAGG | TCCTGCTT | chr19 | 55116574 | 55116593 | 55116577 | - |
| SEQ ID NO 2256 | CATTCTCTCCCTGGGCCTG | TGCCGCTT | chr19 | 55116535 | 55116554 | 55116538 | - |
| SEQ ID NO 2257 | GGCCTGTGCCGCTTTCTGTC | TGCAGCTT | chr19 | 55116521 | 55116540 | 55116524 | - |
| SEQ ID NO 2258 | CTTCTGGGGCCTGTGCCATC | TCTCGTTT | chr19 | 55116232 | 55116251 | 55116235 | - |
| SEQ ID NO 2259 | TTCTTGTAGGCCTGCATCAT | CACCGTTT | chr19 | 55116155 | 55116174 | 55116158 | - |
| SEQ ID NO 2260 | ACCCCAAAGTACCCCGTCTC | CCTGGCTT | chr19 | 55116118 | 55116137 | 55116121 | - |
| SEQ ID NO 2261 | CTTTAGCCACCTCTCCATCC | TCTTGCTT | chr19 | 55116093 | 55116112 | 55116096 | - |
| SEQ ID NO 2262 | GCCTGGACACCCCGTTCTCC | TGTGGATT | chr19 | 55116060 | 55116079 | 55116063 | - |
| SEQ ID NO 2263 | CCTATGTCCACTTCAGGACA | GCATGTTT | chr19 | 55115890 | 55115909 | 55115893 | - |
| SEQ ID NO 2264 | CCACAGTGGGGCCACTAGGG | ACAGGATT | chr19 | 55115759 | 55115778 | 55115762 | - |
| SEQ ID NO 2265 | CTAACCCCACCTCCTGTTA | GGCAGATT | chr19 | 55115674 | 55115693 | 55115677 | - |
| SEQ ID NO 2266 | TCTCTCCTTGCCAGAACCTC | TAAGGTTT | chr19 | 55115608 | 55115627 | 55115611 | - |
| SEQ ID NO 2267 | TCCTTGCCAGAACCTCTAAG | GTTTGCTT | chr19 | 55115604 | 55115623 | 55115607 | - |
| SEQ ID NO 2268 | CCAGAGAGGATCCTGGGAGG | GAGAGCTT | chr19 | 55115567 | 55115586 | 55115570 | - |
| SEQ ID NO 2269 | TGCTCTGACGCGGCCGTCTG | GTGCGTTT | chr19 | 55115453 | 55115472 | 55115456 | - |
| SEQ ID NO 2270 | CGTTTCACTGATCCTGGTGC | TGCAGCTT | chr19 | 55115430 | 55115449 | 55115433 | - |
| SEQ ID NO 2271 | TTACACTTCCCAAGAGGAGA | AGCAGTTT | chr19 | 55115400 | 55115419 | 55115403 | - |
| SEQ ID NO 2272 | TTTATATTGTTCCTCCGTGC | GTCAGTTT | chr19 | 55115304 | 55115323 | 55115307 | - |
| SEQ ID NO 2273 | TTCCTCCGCCCAGAGCAGGG | TCCCGCTT | chr19 | 55115084 | 55115103 | 55115087 | - |
| SEQ ID NO 2274 | CGCTTCCCTAAGGCCCTGCT | CTGGGCTT | chr19 | 55115061 | 55115080 | 55115064 | - |
| SEQ ID NO 2275 | TAAGGCCCTGCTCTGGGCTT | CTGGGTTT | chr19 | 55115053 | 55115072 | 55115056 | - |
| SEQ ID NO 2276 | GGCAAGCCCAGGAGAGGCGC | TCAGGCTT | chr19 | 55115017 | 55115036 | 55115020 | - |
| SEQ ID NO 2277 | GTCTACCAGGCTGCCTTTTG | GGTGGATT | chr19 | 55114791 | 55114810 | 55114794 | - |
| SEQ ID NO 2278 | TTCTCCTCCAACTGTGGGGT | GACTGCTT | chr19 | 55114765 | 55114784 | 55114768 | - |

Figure 5 (Cont'd)

| | | | | | | | |
|---|---|---|---|---|---|---|---|
| SEQ ID NO 2279 | GTGGGCTGGGGTTCAGAGAG | GAGGGATT | chr19 | 55114691 | 55114710 | 55114694 | - |
| SEQ ID NO 2280 | GTGGCCAAGAAGCAGGGGAG | CTGGGTTT | chr19 | 55114648 | 55114667 | 55114651 | - |
| SEQ ID NO 2281 | TCAGGTCTGGGTGTGGGGTG | ACCAGCTT | chr19 | 55114617 | 55114636 | 55114620 | - |
| SEQ ID NO 2282 | GGTGTGGGGTGACCAGCTTA | TGCTGTTT | chr19 | 55114608 | 55114627 | 55114611 | - |
| SEQ ID NO 2283 | ATGCTGTTTGCCCAGGACAG | CCTAGTTT | chr19 | 55114589 | 55114608 | 55114592 | - |
| SEQ ID NO 2284 | GGTCACTGTCTCTGGGTGAC | TCTTGATT | chr19 | 55114521 | 55114540 | 55114524 | - |
| SEQ ID NO 2285 | TGGGTGACTCTTGATTCCCG | GCCAGTTT | chr19 | 55114509 | 55114528 | 55114512 | - |
| SEQ ID NO 2286 | GCCAGTTTCTCCACCTGGGG | CTGTGTTT | chr19 | 55114489 | 55114508 | 55114492 | - |
| SEQ ID NO 2287 | AAGTTCTTAGGGTACCCCAC | GTGGGTTT | chr19 | 55114399 | 55114418 | 55114402 | - |
| SEQ ID NO 2288 | TAGAGTAGGAGGGGCTGGAG | CCAGGATT | chr19 | 55114294 | 55114313 | 55114297 | - |
| SEQ ID NO 2289 | AGAGCTGGGGGCCTGGGCTC | CTGGGTTT | chr19 | 55114248 | 55114267 | 55114251 | - |
| SEQ ID NO 2290 | ACGTGCGGCCCCTTCACAGC | CCGAGTTT | chr19 | 55113744 | 55113763 | 55113747 | - |
| SEQ ID NO 2291 | CCTCCCGCCTCCTCCAGATG | GGCAGCTT | chr19 | 55113684 | 55113703 | 55113687 | - |
| SEQ ID NO 2292 | GTAATTTATCCCGTGGATCT | AGGAGTTT | chr19 | 55113633 | 55113652 | 55113636 | - |
| SEQ ID NO 2293 | TTATCCCGTGGATCTAGGAG | TTTAGCTT | chr19 | 55113628 | 55113647 | 55113631 | - |
| SEQ ID NO 2294 | CCTCCTCCGACCCCTGGAC | TTCGGCTT | chr19 | 55113533 | 55113552 | 55113536 | - |
| SEQ ID NO 2295 | GGACTTCGGCTTTTGTCCCC | CCAAGTTT | chr19 | 55113517 | 55113536 | 55113520 | - |
| SEQ ID NO 2296 | ACCCTGCATAGCCCTGGGCC | CACGGCTT | chr19 | 55113296 | 55113315 | 55113299 | - |
| SEQ ID NO 2297 | TCCTGCAGAGTATCTGCTGG | GGTGGTTT | chr19 | 55113265 | 55113284 | 55113268 | - |
| SEQ ID NO 2298 | AGTATCTGCTGGGGTGGTTT | CCGAGCTT | chr19 | 55113257 | 55113276 | 55113260 | - |
| SEQ ID NO 2299 | TGACCCTTGGAAGGACCTGG | CTGGGTTT | chr19 | 55113230 | 55113249 | 55113233 | - |
| SEQ ID NO 2300 | CGCCACCTGTGGGTGGTGAC | GGGGGTTT | chr19 | 55113119 | 55113138 | 55113122 | - |
| SEQ ID NO 2301 | CCCTCCCTTCCCCGTTCACT | TCCTGTTT | chr19 | 55113040 | 55113059 | 55113043 | - |
| SEQ ID NO 2302 | CAGATAGCCAGGAGTCCTTT | CGTGGTTT | chr19 | 55113011 | 55113030 | 55113014 | - |
| SEQ ID NO 2303 | TCCTAGCACCGTGTCCCTGG | ATCTGTTT | chr19 | 55112885 | 55112904 | 55112888 | - |
| SEQ ID NO 2304 | CTGGGGTAGGTGCGGCTGAC | GGCTGTTT | chr19 | 55112815 | 55112834 | 55112818 | - |
| SEQ ID NO 2305 | TTGATGAGAACCTGGAGGTG | GTGCGCTT | chr19 | 55112769 | 55112788 | 55112772 | - |

Figure 6

| # | Sequence | PAM | Chr | Start | End | Cut site 1 (5' of) | Cut site 2 (5' of) | Str |
|---|---|---|---|---|---|---|---|---|
| SEQ ID NO 2306 | GCGATATCTAGGTAGCCACAGG | CTG | chr19 | 55112668 | 55112689 | 55112685 | 55112690 | + |
| SEQ ID NO 2307 | GGTAGCCACAGGAGGCGGCCAC | CTA | chr19 | 55112678 | 55112699 | 55112695 | 55112700 | + |
| SEQ ID NO 2308 | GTTGTCTGCCTGGTTCACAGTG | CTC | chr19 | 55112721 | 55112742 | 55112738 | 55112743 | + |
| SEQ ID NO 2309 | TCTGCCTGGTTCACAGTGGCGC | TTG | chr19 | 55112725 | 55112746 | 55112742 | 55112747 | + |
| SEQ ID NO 2310 | CCTGGTTCACAGTGGCGCCCTG | CTG | chr19 | 55112729 | 55112750 | 55112746 | 55112751 | + |
| SEQ ID NO 2311 | GTTCACAGTGGCGCCCTGCTCC | CTG | chr19 | 55112733 | 55112754 | 55112750 | 55112755 | + |
| SEQ ID NO 2312 | ACAGTGGCGCCCTGCTCCACCA | TTC | chr19 | 55112737 | 55112758 | 55112754 | 55112759 | + |
| SEQ ID NO 2313 | CTCCACCAAGAAGCGCACCACC | CTG | chr19 | 55112751 | 55112772 | 55112768 | 55112773 | + |
| SEQ ID NO 2314 | CACCAAGAAGCGCACCACCTCC | CTC | chr19 | 55112754 | 55112775 | 55112771 | 55112776 | + |
| SEQ ID NO 2315 | CAGGTTCTCATCAATGCAGGCC | CTC | chr19 | 55112775 | 55112796 | 55112792 | 55112797 | + |
| SEQ ID NO 2316 | TCATCAATGCAGGCCTGGGGGT | TTC | chr19 | 55112782 | 55112803 | 55112799 | 55112804 | + |
| SEQ ID NO 2317 | ATCAATGCAGGCCTGGGGGTGG | CTC | chr19 | 55112784 | 55112805 | 55112801 | 55112806 | + |
| SEQ ID NO 2318 | GGGGTGGGAAACAGCCGTCAGC | CTG | chr19 | 55112799 | 55112820 | 55112816 | 55112821 | + |
| SEQ ID NO 2319 | CCCCAGCCACGGTGTCCCAGCA | CTA | chr19 | 55112829 | 55112850 | 55112846 | 55112851 | + |
| SEQ ID NO 2320 | CAGAGGGAGCCACGAAAACAGA | CTC | chr19 | 55112862 | 55112883 | 55112879 | 55112884 | + |
| SEQ ID NO 2321 | GGACAGTGGGGAAAATGACCCA | CTA | chr19 | 55112902 | 55112923 | 55112919 | 55112924 | + |
| SEQ ID NO 2322 | TGGCCACTGGCTGTTTAAGATA | CTC | chr19 | 55112932 | 55112953 | 55112949 | 55112954 | + |
| SEQ ID NO 2323 | GCCACTGGCTGTTTAAGATACG | CTG | chr19 | 55112934 | 55112955 | 55112951 | 55112956 | + |
| SEQ ID NO 2324 | GCTGTTTAAGATACGCCTGGTT | CTG | chr19 | 55112941 | 55112962 | 55112958 | 55112963 | + |
| SEQ ID NO 2325 | TTTAAGATACGCCTGGTTGCCC | CTG | chr19 | 55112945 | 55112966 | 55112962 | 55112967 | + |
| SEQ ID NO 2326 | AAGATACGCCTGGTTGCCCAGT | TTT | chr19 | 55112948 | 55112969 | 55112965 | 55112970 | + |
| SEQ ID NO 2327 | AGATACGCCTGGTTGCCCAGTG | TTA | chr19 | 55112949 | 55112970 | 55112966 | 55112971 | + |
| SEQ ID NO 2328 | GTTGCCCAGTGGTCAGGCCGGC | CTG | chr19 | 55112960 | 55112981 | 55112977 | 55112982 | + |
| SEQ ID NO 2329 | CCCAGTGGTCAGGCCGGCCAGG | TTG | chr19 | 55112964 | 55112985 | 55112981 | 55112986 | + |
| SEQ ID NO 2330 | CAGTGCTCAGTGGAAACCACGA | CTT | chr19 | 55112990 | 55113011 | 55113007 | 55113012 | + |
| SEQ ID NO 2331 | AGTGCTCAGTGGAAACCACGAA | TTC | chr19 | 55112991 | 55113012 | 55113008 | 55113013 | + |
| SEQ ID NO 2332 | AGTGGAAACCACGAAAGGACTC | CTC | chr19 | 55112998 | 55113019 | 55113015 | 55113020 | + |
| SEQ ID NO 2333 | CTGGCTATCTGCAAACAGGAAG | CTC | chr19 | 55113020 | 55113041 | 55113037 | 55113042 | + |
| SEQ ID NO 2334 | GCTATCTGCAAACAGGAAGTGA | CTG | chr19 | 55113023 | 55113044 | 55113040 | 55113045 | + |
| SEQ ID NO 2335 | TCTGCAAACAGGAAGTGAACGG | CTA | chr19 | 55113027 | 55113048 | 55113044 | 55113049 | + |
| SEQ ID NO 2336 | CAAACAGGAAGTGAACGGGAA | CTG | chr19 | 55113031 | 55113052 | 55113048 | 55113053 | + |
| SEQ ID NO 2337 | CTCATCTGGGTGCGGGAACCCC | CTT | chr19 | 55113065 | 55113086 | 55113082 | 55113087 | + |
| SEQ ID NO 2338 | TCATCTGGGTGCGGGAACCCCA | TTC | chr19 | 55113066 | 55113087 | 55113083 | 55113088 | + |
| SEQ ID NO 2339 | ATCTGGGTGCGGGAACCCCACA | CTC | chr19 | 55113068 | 55113089 | 55113085 | 55113090 | + |
| SEQ ID NO 2340 | GGTGCGGGAACCCCACATGGTA | CTG | chr19 | 55113073 | 55113094 | 55113090 | 55113095 | + |
| SEQ ID NO 2341 | TTAGACACGGCAAAACCCCCGT | CTG | chr19 | 55113099 | 55113120 | 55113116 | 55113121 | + |
| SEQ ID NO 2342 | GACACGGCAAAACCCCCGTCAC | TTA | chr19 | 55113102 | 55113123 | 55113119 | 55113124 | + |
| SEQ ID NO 2343 | CCAGTGCTCAGACTAGGGAAGA | CTT | chr19 | 55113142 | 55113163 | 55113159 | 55113164 | + |
| SEQ ID NO 2344 | CAGTGCTCAGACTAGGGAAGAG | TTC | chr19 | 55113143 | 55113164 | 55113160 | 55113165 | + |
| SEQ ID NO 2345 | AGACTAGGGAAGAGGTTCCAGC | CTC | chr19 | 55113151 | 55113172 | 55113168 | 55113173 | + |
| SEQ ID NO 2346 | GGGAAGAGGTTCCAGCCCCTCC | CTA | chr19 | 55113157 | 55113178 | 55113174 | 55113179 | + |
| SEQ ID NO 2347 | CAGCCCCTCCTCCTTCAGAGCC | TTC | chr19 | 55113169 | 55113190 | 55113186 | 55113191 | + |
| SEQ ID NO 2348 | CTCCTTCAGAGCCAGGAGTCCT | CTC | chr19 | 55113178 | 55113199 | 55113195 | 55113200 | + |
| SEQ ID NO 2349 | CTTCAGAGCCAGGAGTCCTGGC | CTC | chr19 | 55113181 | 55113202 | 55113198 | 55113203 | + |
| SEQ ID NO 2350 | CAGAGCCAGGAGTCCTGGCCCC | CTT | chr19 | 55113184 | 55113205 | 55113201 | 55113206 | + |
| SEQ ID NO 2351 | AGAGCCAGGAGTCCTGGCCCCC | TTC | chr19 | 55113185 | 55113206 | 55113202 | 55113207 | + |
| SEQ ID NO 2352 | GCCCCAGCCCCTCCTGCCTTA | CTG | chr19 | 55113201 | 55113222 | 55113218 | 55113223 | + |
| SEQ ID NO 2353 | CTGCCTTAAACCCAGCCAGGTC | CTC | chr19 | 55113215 | 55113236 | 55113232 | 55113237 | + |
| SEQ ID NO 2354 | CCTTAAACCCAGCCAGGTCCTT | CTG | chr19 | 55113218 | 55113239 | 55113235 | 55113240 | + |
| SEQ ID NO 2355 | AAACCCAGCCAGGTCCTTCCAA | CTT | chr19 | 55113222 | 55113243 | 55113239 | 55113244 | + |
| SEQ ID NO 2356 | AACCCAGCCAGGTCCTTCCAAG | TTA | chr19 | 55113223 | 55113244 | 55113240 | 55113245 | + |
| SEQ ID NO 2357 | CCAAGGGTCAAGCTCGGAAACC | CTT | chr19 | 55113240 | 55113261 | 55113257 | 55113262 | + |
| SEQ ID NO 2358 | CAAGGGTCAAGCTCGGAAACCA | TTC | chr19 | 55113241 | 55113262 | 55113258 | 55113263 | + |
| SEQ ID NO 2359 | GGAAACCACCCCAGCAGATACT | CTC | chr19 | 55113255 | 55113276 | 55113272 | 55113277 | + |
| SEQ ID NO 2360 | TGCAGGAACGAAGCCGTGGGCC | CTC | chr19 | 55113278 | 55113299 | 55113295 | 55113300 | + |
| SEQ ID NO 2361 | CAGGAACGAAGCCGTGGGCCCA | CTG | chr19 | 55113280 | 55113301 | 55113297 | 55113302 | + |
| SEQ ID NO 2362 | TGCAGGGTGGAGGAAGGCCACC | CTA | chr19 | 55113308 | 55113329 | 55113325 | 55113330 | + |
| SEQ ID NO 2363 | TGCTGGGACAGACTCAGGGGCC | CTG | chr19 | 55113333 | 55113354 | 55113350 | 55113355 | + |

Figure 6 (Cont'd)

| SEQ ID NO 2364 | GGACAGACTCAGGGGCCTGGGC | CTG | chr19 | 55113338 | 55113359 | 55113355 | 55113360 | + |
| SEQ ID NO 2365 | AGGGGCCTGGGCGGGACTCCCA | CTC | chr19 | 55113348 | 55113369 | 55113365 | 55113370 | + |
| SEQ ID NO 2366 | GGCGGGACTCCCAGAGGGGTGA | CTG | chr19 | 55113357 | 55113378 | 55113374 | 55113379 | + |
| SEQ ID NO 2367 | CCAGAGGGGTGAGACAGCTGCA | CTC | chr19 | 55113367 | 55113388 | 55113384 | 55113389 | + |
| SEQ ID NO 2368 | CACACCTGTGTGCCTGGGCCCC | CTG | chr19 | 55113387 | 55113408 | 55113404 | 55113409 | + |
| SEQ ID NO 2369 | TGTGCCTGGGCCCCAGGCTGTC | CTG | chr19 | 55113395 | 55113416 | 55113412 | 55113417 | + |
| SEQ ID NO 2370 | GGCCCAGGCTGTCACACTCCA | CTG | chr19 | 55113403 | 55113424 | 55113420 | 55113425 | + |
| SEQ ID NO 2371 | TCACACTCCAGTTCACTGAGGC | CTG | chr19 | 55113415 | 55113436 | 55113432 | 55113437 | + |
| SEQ ID NO 2372 | CAGTTCACTGAGGCCCCCTCTG | CTC | chr19 | 55113423 | 55113444 | 55113440 | 55113445 | + |
| SEQ ID NO 2373 | ACTGAGGCCCCTCTGCACGGG | TTC | chr19 | 55113429 | 55113450 | 55113446 | 55113451 | + |
| SEQ ID NO 2374 | AGGCCCCTCTGCACGGGGCCC | CTG | chr19 | 55113433 | 55113454 | 55113450 | 55113455 | + |
| SEQ ID NO 2375 | TGCACGGGGCCCTGCAGCCAGG | CTC | chr19 | 55113443 | 55113464 | 55113460 | 55113465 | + |
| SEQ ID NO 2376 | CACGGGGCCCTGCAGCCAGGGG | CTG | chr19 | 55113445 | 55113466 | 55113462 | 55113467 | + |
| SEQ ID NO 2377 | CAGCCAGGGGCTGACACGGGCC | CTG | chr19 | 55113457 | 55113478 | 55113474 | 55113479 | + |
| SEQ ID NO 2378 | ACACGGGCCACCGTTTCTCATT | CTG | chr19 | 55113470 | 55113491 | 55113487 | 55113492 | + |
| SEQ ID NO 2379 | CTCATTCTTCCCTTAGGGGTCC | TTT | chr19 | 55113486 | 55113507 | 55113503 | 55113508 | + |
| SEQ ID NO 2380 | TCATTCTTCCCTTAGGGGTCCA | TTC | chr19 | 55113487 | 55113508 | 55113504 | 55113509 | + |
| SEQ ID NO 2381 | ATTCTTCCCTTAGGGGTCCAAA | CTC | chr19 | 55113489 | 55113510 | 55113506 | 55113511 | + |
| SEQ ID NO 2382 | TTCCCTTAGGGGTCCAAAACTT | TTC | chr19 | 55113493 | 55113514 | 55113510 | 55113515 | + |
| SEQ ID NO 2383 | CCCTTAGGGGTCCAAAACTTGG | CTT | chr19 | 55113495 | 55113516 | 55113512 | 55113517 | + |
| SEQ ID NO 2384 | CCTTAGGGGTCCAAAACTTGGG | TTC | chr19 | 55113496 | 55113517 | 55113513 | 55113518 | + |
| SEQ ID NO 2385 | AGGGGTCCAAAACTTGGGGGGA | CTT | chr19 | 55113500 | 55113521 | 55113517 | 55113522 | + |
| SEQ ID NO 2386 | GGGGTCCAAAACTTGGGGGGAC | TTA | chr19 | 55113501 | 55113522 | 55113518 | 55113523 | + |
| SEQ ID NO 2387 | GGGGGGACAAAAGCCGAAGTCC | CTT | chr19 | 55113515 | 55113536 | 55113532 | 55113537 | + |
| SEQ ID NO 2388 | GGGGGACAAAAGCCGAAGTCCA | TTG | chr19 | 55113516 | 55113537 | 55113533 | 55113538 | + |
| SEQ ID NO 2389 | GCCCCAGGCCTTGTGGACACTG | CTT | chr19 | 55113558 | 55113579 | 55113575 | 55113580 | + |
| SEQ ID NO 2390 | CCCCAGGCCTTGTGGACACTGG | TTG | chr19 | 55113559 | 55113580 | 55113576 | 55113581 | + |
| SEQ ID NO 2391 | GTGGACACTGGGTGGGCTCCGG | CTT | chr19 | 55113570 | 55113591 | 55113587 | 55113592 | + |
| SEQ ID NO 2392 | TGGACACTGGGTGGGCTCCGGG | TTG | chr19 | 55113571 | 55113592 | 55113588 | 55113593 | + |
| SEQ ID NO 2393 | GGTGGGCTCCGGGACCTGAACT | CTG | chr19 | 55113580 | 55113601 | 55113597 | 55113602 | + |
| SEQ ID NO 2394 | CGGGACCTGAACTGGAGCTGAG | CTC | chr19 | 55113589 | 55113610 | 55113606 | 55113611 | + |
| SEQ ID NO 2395 | AACTGGAGCTGAGGAAGGAGTG | CTG | chr19 | 55113598 | 55113619 | 55113615 | 55113620 | + |
| SEQ ID NO 2396 | GAGCTGAGGAAGGAGTGAAGCT | CTG | chr19 | 55113603 | 55113624 | 55113620 | 55113625 | + |
| SEQ ID NO 2397 | AGGAAGGAGTGAAGCTAAACTC | CTG | chr19 | 55113609 | 55113630 | 55113626 | 55113631 | + |
| SEQ ID NO 2398 | AACTCCTAGATCCACGGGATAA | CTA | chr19 | 55113626 | 55113647 | 55113643 | 55113648 | + |
| SEQ ID NO 2399 | CTAGATCCACGGGATAAATTAC | CTC | chr19 | 55113631 | 55113652 | 55113648 | 55113653 | + |
| SEQ ID NO 2400 | GATCCACGGGATAAATTACCCC | CTA | chr19 | 55113634 | 55113655 | 55113651 | 55113656 | + |
| SEQ ID NO 2401 | CCCCCCAAGTCCCTCACCTCTC | TTA | chr19 | 55113652 | 55113673 | 55113669 | 55113674 | + |
| SEQ ID NO 2402 | ACCTCTCCAAAGCTGCCCATCT | CTC | chr19 | 55113667 | 55113688 | 55113684 | 55113689 | + |
| SEQ ID NO 2403 | TCCAAAGCTGCCCATCTGGAGG | CTC | chr19 | 55113672 | 55113693 | 55113689 | 55113694 | + |
| SEQ ID NO 2404 | CAAAGCTGCCCATCTGGAGGAG | CTC | chr19 | 55113674 | 55113695 | 55113691 | 55113696 | + |
| SEQ ID NO 2405 | CCCATCTGGAGGAGGCGGGAGG | CTG | chr19 | 55113682 | 55113703 | 55113699 | 55113704 | + |
| SEQ ID NO 2406 | GAGGAGGCGGGAGGGAGCTACG | CTG | chr19 | 55113690 | 55113711 | 55113707 | 55113712 | + |
| SEQ ID NO 2407 | CGAGGGCAAGAGCATGAGGTC | CTA | chr19 | 55113710 | 55113731 | 55113727 | 55113732 | + |
| SEQ ID NO 2408 | GGGCTGTGAAGGGGCCGCACGT | CTC | chr19 | 55113742 | 55113763 | 55113759 | 55113764 | + |
| SEQ ID NO 2409 | TGAAGGGGCCGCACGTGCCCTG | CTG | chr19 | 55113748 | 55113769 | 55113765 | 55113770 | + |
| SEQ ID NO 2410 | GGAACGGGATGAACTCGGCTCG | CTG | chr19 | 55113770 | 55113791 | 55113787 | 55113792 | + |
| SEQ ID NO 2411 | GGCTCGTTTATTTCCACCCAGT | CTC | chr19 | 55113786 | 55113807 | 55113803 | 55113808 | + |
| SEQ ID NO 2412 | GTTTATTTCCACCCAGTTGTCA | CTC | chr19 | 55113791 | 55113812 | 55113808 | 55113813 | + |
| SEQ ID NO 2413 | ATTTCCACCCAGTTGTCATGGC | TTT | chr19 | 55113795 | 55113816 | 55113812 | 55113817 | + |
| SEQ ID NO 2414 | TTTCCACCCAGTTGTCATGGCG | TTA | chr19 | 55113796 | 55113817 | 55113813 | 55113818 | + |
| SEQ ID NO 2415 | CCACCCAGTTGTCATGGCGATA | TTT | chr19 | 55113799 | 55113820 | 55113816 | 55113821 | + |
| SEQ ID NO 2416 | CACCCAGTTGTCATGGCGATAG | TTC | chr19 | 55113800 | 55113821 | 55113817 | 55113822 | + |
| SEQ ID NO 2417 | TCATGGCGATAGGGGAGGGGG | TTG | chr19 | 55113810 | 55113831 | 55113827 | 55113832 | + |
| SEQ ID NO 2418 | TCCCTTTCAAGGACCTGCCCAG | CTT | chr19 | 55113852 | 55113873 | 55113869 | 55113874 | + |
| SEQ ID NO 2419 | CCCTTTCAAGGACCTGCCCAGT | TTT | chr19 | 55113853 | 55113874 | 55113870 | 55113875 | + |
| SEQ ID NO 2420 | CCTTTCAAGGACCTGCCCAGTA | TTC | chr19 | 55113854 | 55113875 | 55113871 | 55113876 | + |
| SEQ ID NO 2421 | TCAAGGACCTGCCCAGTACAGG | CTT | chr19 | 55113858 | 55113879 | 55113875 | 55113880 | + |
| SEQ ID NO 2422 | CAAGGACCTGCCCAGTACAGGC | TTT | chr19 | 55113859 | 55113880 | 55113876 | 55113881 | + |

Figure 6 (Cont'd)

| | | | | | | | | |
|---|---|---|---|---|---|---|---|---|
| SEQ ID NO 2423 | AAGGACCTGCCCAGTACAGGCA | TTC | chr19 | 55113860 | 55113881 | 55113877 | 55113882 | + |
| SEQ ID NO 2424 | CCCAGTACAGGCATCCCTGTGA | CTG | chr19 | 55113869 | 55113890 | 55113886 | 55113891 | + |
| SEQ ID NO 2425 | TGAAAGATGCCTGAGGCCTGGG | CTG | chr19 | 55113888 | 55113909 | 55113905 | 55113910 | + |
| SEQ ID NO 2426 | AGGCCTGGGCACCAGGGACTCC | CTG | chr19 | 55113901 | 55113922 | 55113918 | 55113923 | + |
| SEQ ID NO 2427 | GGCACCAGGGACTCCAGAGTCC | CTG | chr19 | 55113908 | 55113929 | 55113925 | 55113930 | + |
| SEQ ID NO 2428 | CAGAGTCCAGGCCCAACCCCTC | CTC | chr19 | 55113922 | 55113943 | 55113939 | 55113944 | + |
| SEQ ID NO 2429 | CCCATTCAACCCAGGAGGCCAG | CTC | chr19 | 55113944 | 55113965 | 55113961 | 55113966 | + |
| SEQ ID NO 2430 | AACCCAGGAGGCCAGGCCCCAG | TTC | chr19 | 55113951 | 55113972 | 55113968 | 55113973 | + |
| SEQ ID NO 2431 | CCGCCCTCAGATGAAGGAGTCC | CTT | chr19 | 55113978 | 55113999 | 55113995 | 55114000 | + |
| SEQ ID NO 2432 | CGCCCTCAGATGAAGGAGTCCA | TTC | chr19 | 55113979 | 55114000 | 55113996 | 55114001 | + |
| SEQ ID NO 2433 | AGATGAAGGAGTCCAGGCCCCC | CTC | chr19 | 55113986 | 55114007 | 55114003 | 55114008 | + |
| SEQ ID NO 2434 | TCCCCATTCAGACCCAGGGGTC | CTC | chr19 | 55114014 | 55114035 | 55114031 | 55114036 | + |
| SEQ ID NO 2435 | CCCATTCAGACCCAGGGGTCCA | CTC | chr19 | 55114016 | 55114037 | 55114033 | 55114038 | + |
| SEQ ID NO 2436 | AGACCCAGGGGTCCAGGCCCAG | TTC | chr19 | 55114023 | 55114044 | 55114040 | 55114045 | + |
| SEQ ID NO 2437 | CCTAAGACCCAGAAGTCCAGGC | CTC | chr19 | 55114054 | 55114075 | 55114071 | 55114076 | + |
| SEQ ID NO 2438 | AGACCCAGAAGTCCAGGCCCCC | CTA | chr19 | 55114058 | 55114079 | 55114075 | 55114080 | + |
| SEQ ID NO 2439 | CTCCCTCAGACCCACGAGTCCA | CTC | chr19 | 55114088 | 55114109 | 55114105 | 55114110 | + |
| SEQ ID NO 2440 | CCTCAGACCCACGAGTCCAGGC | CTC | chr19 | 55114091 | 55114112 | 55114108 | 55114113 | + |
| SEQ ID NO 2441 | AGACCCACGAGTCCAGGCCCCA | CTC | chr19 | 55114095 | 55114116 | 55114112 | 55114117 | + |
| SEQ ID NO 2442 | CTCCCTCGGACCCAGGAGTCCA | CTC | chr19 | 55114124 | 55114145 | 55114141 | 55114146 | + |
| SEQ ID NO 2443 | CCTCGGACCCAGGAGTCCAGGC | CTC | chr19 | 55114127 | 55114148 | 55114144 | 55114149 | + |
| SEQ ID NO 2444 | GGACCCAGGAGTCCAGGCCCCC | CTC | chr19 | 55114131 | 55114152 | 55114148 | 55114153 | + |
| SEQ ID NO 2445 | CACCCTCAGACCCAGGAGTCCA | CTC | chr19 | 55114161 | 55114182 | 55114178 | 55114183 | + |
| SEQ ID NO 2446 | AGACCCAGGAGTCCAGGCCCCA | CTC | chr19 | 55114168 | 55114189 | 55114185 | 55114190 | + |
| SEQ ID NO 2447 | CTCCCTCGGACCCAGGAGTCCA | CTC | chr19 | 55114197 | 55114218 | 55114214 | 55114219 | + |
| SEQ ID NO 2448 | CCTCGGACCCAGGAGTCCAGGC | CTC | chr19 | 55114200 | 55114221 | 55114217 | 55114222 | + |
| SEQ ID NO 2449 | GGACCCAGGAGTCCAGGCCCCA | CTC | chr19 | 55114204 | 55114225 | 55114221 | 55114226 | + |
| SEQ ID NO 2450 | CTCTCTCAAACCCAGGAGCCCA | CTC | chr19 | 55114233 | 55114254 | 55114250 | 55114255 | + |
| SEQ ID NO 2451 | TCTCAAACCCAGGAGCCCAGGC | CTC | chr19 | 55114236 | 55114257 | 55114253 | 55114258 | + |
| SEQ ID NO 2452 | TCAAACCCAGGAGCCCAGGCCC | CTC | chr19 | 55114238 | 55114259 | 55114255 | 55114260 | + |
| SEQ ID NO 2453 | AAACCCAGGAGCCCAGGCCCCC | CTC | chr19 | 55114240 | 55114261 | 55114257 | 55114262 | + |
| SEQ ID NO 2454 | TTCTCTGTTCAGCCCTAAGAAT | CTC | chr19 | 55114267 | 55114288 | 55114284 | 55114289 | + |
| SEQ ID NO 2455 | CTCTGTTCAGCCCTAAGAATCC | CTT | chr19 | 55114269 | 55114290 | 55114286 | 55114291 | + |
| SEQ ID NO 2456 | TCTGTTCAGCCCTAAGAATCCT | TTC | chr19 | 55114270 | 55114291 | 55114287 | 55114292 | + |
| SEQ ID NO 2457 | TGTTCAGCCCTAAGAATCCTGG | CTC | chr19 | 55114272 | 55114293 | 55114289 | 55114294 | + |
| SEQ ID NO 2458 | TTCAGCCCTAAGAATCCTGGCT | CTG | chr19 | 55114274 | 55114295 | 55114291 | 55114296 | + |
| SEQ ID NO 2459 | AGCCCTAAGAATCCTGGCTCCA | TTC | chr19 | 55114277 | 55114298 | 55114294 | 55114299 | + |
| SEQ ID NO 2460 | AGAATCCTGGCTCCAGCCCCTC | CTA | chr19 | 55114284 | 55114305 | 55114301 | 55114306 | + |
| SEQ ID NO 2461 | GCTCCAGCCCCTCCTACTCTAG | CTG | chr19 | 55114293 | 55114314 | 55114310 | 55114315 | + |
| SEQ ID NO 2462 | CAGCCCCTCCTACTCTAGCCCC | CTC | chr19 | 55114297 | 55114318 | 55114314 | 55114319 | + |
| SEQ ID NO 2463 | CTACTCTAGCCCCAACCCCCT | CTC | chr19 | 55114306 | 55114327 | 55114323 | 55114328 | + |
| SEQ ID NO 2464 | CTCTAGCCCCAACCCCCTAGC | CTA | chr19 | 55114309 | 55114330 | 55114326 | 55114331 | + |
| SEQ ID NO 2465 | TAGCCCCAACCCCCTAGCCAC | CTC | chr19 | 55114312 | 55114333 | 55114329 | 55114334 | + |
| SEQ ID NO 2466 | GCCCCAACCCCCTAGCCACTA | CTA | chr19 | 55114314 | 55114335 | 55114331 | 55114336 | + |
| SEQ ID NO 2467 | GCCACTAAGGCAATTGGGGTGC | CTA | chr19 | 55114329 | 55114350 | 55114346 | 55114351 | + |
| SEQ ID NO 2468 | AGGCAATTGGGGTGCAGGAATG | CTA | chr19 | 55114336 | 55114357 | 55114353 | 55114358 | + |
| SEQ ID NO 2469 | GGGTGCAGGAATGGGGCAGGG | TTG | chr19 | 55114345 | 55114366 | 55114362 | 55114367 | + |
| SEQ ID NO 2470 | ACCAAGTGGTTGATAAACCCAC | CTC | chr19 | 55114377 | 55114398 | 55114394 | 55114399 | + |
| SEQ ID NO 2471 | ATAAACCCACGTGGGTACCCT | TTG | chr19 | 55114389 | 55114410 | 55114406 | 55114411 | + |
| SEQ ID NO 2472 | AGAACTTGGGAACAGCCACAGC | CTA | chr19 | 55114412 | 55114433 | 55114429 | 55114434 | + |
| SEQ ID NO 2473 | GGGAACAGCCACAGCAGGGGGG | CTT | chr19 | 55114419 | 55114440 | 55114436 | 55114441 | + |
| SEQ ID NO 2474 | GGAACAGCCACAGCAGGGGGGC | TTG | chr19 | 55114420 | 55114441 | 55114437 | 55114442 | + |
| SEQ ID NO 2475 | GGGGACCTGCCTGGAGAAGGAT | CTT | chr19 | 55114449 | 55114470 | 55114466 | 55114471 | + |
| SEQ ID NO 2476 | GGGACCTGCCTGGAGAAGGATG | TTG | chr19 | 55114450 | 55114471 | 55114467 | 55114472 | + |
| SEQ ID NO 2477 | CCTGGAGAAGGATGCAGGACGA | CTG | chr19 | 55114458 | 55114479 | 55114475 | 55114480 | + |
| SEQ ID NO 2478 | GAGAAGGATGCAGGACGAGAAA | CTG | chr19 | 55114462 | 55114483 | 55114479 | 55114484 | + |
| SEQ ID NO 2479 | GCCGGGAATCAAGAGTCACCCA | CTG | chr19 | 55114507 | 55114528 | 55114524 | 55114529 | + |
| SEQ ID NO 2480 | TTTTCCTAGGACTGAGGGTTTC | CTG | chr19 | 55114552 | 55114573 | 55114569 | 55114574 | + |
| SEQ ID NO 2481 | TCCTAGGACTGAGGGTTTCAGT | TTT | chr19 | 55114555 | 55114576 | 55114572 | 55114577 | + |

Figure 6 (Cont'd)

| | | | | | | | | |
|---|---|---|---|---|---|---|---|---|
| SEQ ID NO 2482 | CCTAGGACTGAGGGTTTCAGTG | TTT | chr19 | 55114556 | 55114577 | 55114573 | 55114578 | + |
| SEQ ID NO 2483 | CTAGGACTGAGGGTTTCAGTGC | TTC | chr19 | 55114557 | 55114578 | 55114574 | 55114579 | + |
| SEQ ID NO 2484 | GGACTGAGGGTTTCAGTGCTAA | CTA | chr19 | 55114560 | 55114581 | 55114577 | 55114582 | + |
| SEQ ID NO 2485 | AGGGTTTCAGTGCTAAAACTAG | CTG | chr19 | 55114566 | 55114587 | 55114583 | 55114588 | + |
| SEQ ID NO 2486 | CAGTGCTAAAACTAGGCTGTCC | TTT | chr19 | 55114573 | 55114594 | 55114590 | 55114595 | + |
| SEQ ID NO 2487 | AGTGCTAAAACTAGGCTGTCCT | TTC | chr19 | 55114574 | 55114595 | 55114591 | 55114596 | + |
| SEQ ID NO 2488 | AAACTAGGCTGTCCTGGGCAAA | CTA | chr19 | 55114581 | 55114602 | 55114598 | 55114603 | + |
| SEQ ID NO 2489 | GGCTGTCCTGGGCAAACAGCAT | CTA | chr19 | 55114587 | 55114608 | 55114604 | 55114609 | + |
| SEQ ID NO 2490 | TCCTGGGCAAACAGCATAAGCT | CTG | chr19 | 55114592 | 55114613 | 55114609 | 55114614 | + |
| SEQ ID NO 2491 | GGCAAACAGCATAAGCTGGTCA | CTG | chr19 | 55114597 | 55114618 | 55114614 | 55114619 | + |
| SEQ ID NO 2492 | GTCACCCCACACCCAGACCTGA | CTG | chr19 | 55114615 | 55114636 | 55114632 | 55114637 | + |
| SEQ ID NO 2493 | ACCCAAACCCAGCTCCCCTGCT | CTG | chr19 | 55114636 | 55114657 | 55114653 | 55114658 | + |
| SEQ ID NO 2494 | CCCTGCTTCTTGGCCACGTAAC | CTC | chr19 | 55114651 | 55114672 | 55114668 | 55114673 | + |
| SEQ ID NO 2495 | CTTCTTGGCCACGTAACCTGAG | CTG | chr19 | 55114656 | 55114677 | 55114673 | 55114678 | + |
| SEQ ID NO 2496 | CTTGGCCACGTAACCTGAGAAG | CTT | chr19 | 55114659 | 55114680 | 55114676 | 55114681 | + |
| SEQ ID NO 2497 | TTGGCCACGTAACCTGAGAAGG | TTC | chr19 | 55114660 | 55114681 | 55114677 | 55114682 | + |
| SEQ ID NO 2498 | GGCCACGTAACCTGAGAAGGGA | CTT | chr19 | 55114662 | 55114683 | 55114679 | 55114684 | + |
| SEQ ID NO 2499 | GCCACGTAACCTGAGAAGGGAA | TTG | chr19 | 55114663 | 55114684 | 55114680 | 55114685 | + |
| SEQ ID NO 2500 | AGAAGGGAATCCCTCCTCTCTG | CTG | chr19 | 55114676 | 55114697 | 55114693 | 55114698 | + |
| SEQ ID NO 2501 | CTCTCTGAACCCCAGCCCACCC | CTC | chr19 | 55114691 | 55114712 | 55114708 | 55114713 | + |
| SEQ ID NO 2502 | TCTGAACCCCAGCCCACCCCAA | CTC | chr19 | 55114694 | 55114715 | 55114711 | 55114716 | + |
| SEQ ID NO 2503 | TGAACCCCAGCCCACCCCAATG | CTC | chr19 | 55114696 | 55114717 | 55114713 | 55114718 | + |
| SEQ ID NO 2504 | AACCCCAGCCCACCCCAATGCT | CTG | chr19 | 55114698 | 55114719 | 55114715 | 55114720 | + |
| SEQ ID NO 2505 | CAGGCCTCCTGGGATACCCCGA | CTC | chr19 | 55114721 | 55114742 | 55114738 | 55114743 | + |
| SEQ ID NO 2506 | CTGGGATACCCCGAAGAGTGAG | CTC | chr19 | 55114729 | 55114750 | 55114746 | 55114751 | + |
| SEQ ID NO 2507 | GGATACCCCGAAGAGTGAGTTT | CTG | chr19 | 55114732 | 55114753 | 55114749 | 55114754 | + |
| SEQ ID NO 2508 | GCCAAGCAGTCACCCCACAGTT | TTT | chr19 | 55114754 | 55114775 | 55114771 | 55114776 | + |
| SEQ ID NO 2509 | CCAAGCAGTCACCCCACAGTTG | TTG | chr19 | 55114755 | 55114776 | 55114772 | 55114777 | + |
| SEQ ID NO 2510 | GAGGAGAATCCACCCAAAAGGC | TTG | chr19 | 55114777 | 55114798 | 55114794 | 55114799 | + |
| SEQ ID NO 2511 | GTAGACAGGGCTGGGGTGGCCT | CTG | chr19 | 55114805 | 55114826 | 55114822 | 55114827 | + |
| SEQ ID NO 2512 | GGGTGGCCTCTCGTGGGGTCCA | CTG | chr19 | 55114818 | 55114839 | 55114835 | 55114840 | + |
| SEQ ID NO 2513 | TCGTGGGGTCCAGGCCAAGTAG | CTC | chr19 | 55114828 | 55114849 | 55114845 | 55114850 | + |
| SEQ ID NO 2514 | GTGGGGTCCAGGCCAAGTAGGT | CTC | chr19 | 55114830 | 55114851 | 55114847 | 55114852 | + |
| SEQ ID NO 2515 | GGGCCTCTGGGGGATGCAGGGG | CTG | chr19 | 55114858 | 55114879 | 55114875 | 55114880 | + |
| SEQ ID NO 2516 | TGGGGATGCAGGGGAAGGGGG | CTC | chr19 | 55114865 | 55114886 | 55114882 | 55114887 | + |
| SEQ ID NO 2517 | GGGGATGCAGGGGAAGGGGGAT | CTG | chr19 | 55114867 | 55114888 | 55114884 | 55114889 | + |
| SEQ ID NO 2518 | AGTCTGAAGAGCAGAGCCAGGA | CTC | chr19 | 55114922 | 55114943 | 55114939 | 55114944 | + |
| SEQ ID NO 2519 | AAGAGCAGAGCCAGGAACCCCT | CTG | chr19 | 55114928 | 55114949 | 55114945 | 55114950 | + |
| SEQ ID NO 2520 | TAGGGAAGGGGCAGGAGAGCCA | CTG | chr19 | 55114951 | 55114972 | 55114968 | 55114973 | + |
| SEQ ID NO 2521 | AGCGCCTCTCCTGGGCTTGCCA | CTG | chr19 | 55115016 | 55115037 | 55115033 | 55115038 | + |
| SEQ ID NO 2522 | TCCTGGGCTTGCCAAGGACTCA | CTC | chr19 | 55115024 | 55115045 | 55115041 | 55115046 | + |
| SEQ ID NO 2523 | CTGGGCTTGCCAAGGACTCAAA | CTC | chr19 | 55115026 | 55115047 | 55115043 | 55115048 | + |
| SEQ ID NO 2524 | GGCTTGCCAAGGACTCAAACCC | CTG | chr19 | 55115029 | 55115050 | 55115046 | 55115051 | + |
| SEQ ID NO 2525 | GCCAAGGACTCAAACCCAGAAG | CTT | chr19 | 55115034 | 55115055 | 55115051 | 55115056 | + |
| SEQ ID NO 2526 | CCAAGGACTCAAACCCAGAAGC | TTG | chr19 | 55115035 | 55115056 | 55115052 | 55115057 | + |
| SEQ ID NO 2527 | AAACCCAGAAGCCCAGAGCAGG | CTC | chr19 | 55115045 | 55115066 | 55115062 | 55115067 | + |
| SEQ ID NO 2528 | AGGGAAGCGGGACCCTGCTCTG | CTT | chr19 | 55115072 | 55115093 | 55115089 | 55115094 | + |
| SEQ ID NO 2529 | GGGAAGCGGGACCCTGCTCTGG | TTA | chr19 | 55115073 | 55115094 | 55115090 | 55115095 | + |
| SEQ ID NO 2530 | CTCTGGGCGGAGGAATATGTCC | CTG | chr19 | 55115089 | 55115110 | 55115106 | 55115111 | + |
| SEQ ID NO 2531 | TGGGCGGAGGAATATGTCCCAG | CTC | chr19 | 55115092 | 55115113 | 55115109 | 55115114 | + |
| SEQ ID NO 2532 | GGCGGAGGAATATGTCCCAGAT | CTG | chr19 | 55115094 | 55115115 | 55115111 | 55115116 | + |
| SEQ ID NO 2533 | GGGACTCTTTAAGGAAAGAAGG | CTG | chr19 | 55115123 | 55115144 | 55115140 | 55115145 | + |
| SEQ ID NO 2534 | TTTAAGGAAAGAAGGATGGAGA | CTC | chr19 | 55115130 | 55115151 | 55115147 | 55115152 | + |
| SEQ ID NO 2535 | TAAGGAAAGAAGGATGGAGAAA | CTT | chr19 | 55115132 | 55115153 | 55115149 | 55115154 | + |
| SEQ ID NO 2536 | AAGGAAAGAAGGATGGAGAAAG | TTT | chr19 | 55115133 | 55115154 | 55115150 | 55115155 | + |
| SEQ ID NO 2537 | AGGAAAGAAGGATGGAGAAAGA | TTA | chr19 | 55115134 | 55115155 | 55115151 | 55115156 | + |
| SEQ ID NO 2538 | GTGAACACCTAGGACGCACCAT | CTG | chr19 | 55115184 | 55115205 | 55115201 | 55115206 | + |
| SEQ ID NO 2539 | GGACGCACCATTCTCACAAAGG | CTA | chr19 | 55115195 | 55115216 | 55115212 | 55115217 | + |
| SEQ ID NO 2540 | TCACAAAGGGAGTTTTCCACAC | TTC | chr19 | 55115208 | 55115229 | 55115225 | 55115230 | + |

Figure 6 (Cont'd)

| | | | | | | | | |
|---|---|---|---|---|---|---|---|---|
| SEQ ID NO 2541 | ACAAAGGGAGTTTTCCACACGG | CTC | chr19 | 55115210 | 55115231 | 55115227 | 55115232 | + |
| SEQ ID NO 2542 | TCCACACGGACACCCCCTCCT | TTT | chr19 | 55115223 | 55115244 | 55115240 | 55115245 | + |
| SEQ ID NO 2543 | CCACACGGACACCCCCTCCTC | TTT | chr19 | 55115224 | 55115245 | 55115241 | 55115246 | + |
| SEQ ID NO 2544 | CACACGGACACCCCCTCCTCA | TTC | chr19 | 55115225 | 55115246 | 55115242 | 55115247 | + |
| SEQ ID NO 2545 | CTCACCACAGCCCTGCCAGGAC | CTC | chr19 | 55115243 | 55115264 | 55115260 | 55115265 | + |
| SEQ ID NO 2546 | ACCACAGCCCTGCCAGGACGGG | CTC | chr19 | 55115246 | 55115267 | 55115263 | 55115268 | + |
| SEQ ID NO 2547 | CCAGGACGGGGCTGGCTACTGG | CTG | chr19 | 55115258 | 55115279 | 55115275 | 55115280 | + |
| SEQ ID NO 2548 | GCTACTGGCCTTATCTCACAGG | CTG | chr19 | 55115272 | 55115293 | 55115289 | 55115294 | + |
| SEQ ID NO 2549 | CTGGCCTTATCTCACAGGTAAA | CTA | chr19 | 55115276 | 55115297 | 55115293 | 55115298 | + |
| SEQ ID NO 2550 | GCCTTATCTCACAGGTAAAACT | CTG | chr19 | 55115279 | 55115300 | 55115296 | 55115301 | + |
| SEQ ID NO 2551 | ATCTCACAGGTAAAACTGACGC | CTT | chr19 | 55115284 | 55115305 | 55115301 | 55115306 | + |
| SEQ ID NO 2552 | TCTCACAGGTAAAACTGACGCA | TTA | chr19 | 55115285 | 55115306 | 55115302 | 55115307 | + |
| SEQ ID NO 2553 | ACAGGTAAAACTGACGCACGGA | CTC | chr19 | 55115289 | 55115310 | 55115306 | 55115311 | + |
| SEQ ID NO 2554 | ACGCACGGAGGAACAATATAAA | CTG | chr19 | 55115302 | 55115323 | 55115319 | 55115324 | + |
| SEQ ID NO 2555 | GGGACTAGAAAGGTGAAGAGCC | TTG | chr19 | 55115327 | 55115348 | 55115344 | 55115349 | + |
| SEQ ID NO 2556 | GAAAGGTGAAGAGCCAAAGTTA | CTA | chr19 | 55115334 | 55115355 | 55115351 | 55115356 | + |
| SEQ ID NO 2557 | GAACTCAGGACCAACTTATTCT | TTA | chr19 | 55115356 | 55115377 | 55115373 | 55115378 | + |
| SEQ ID NO 2558 | AGGACCAACTTATTCTGATTTT | CTC | chr19 | 55115362 | 55115383 | 55115379 | 55115384 | + |
| SEQ ID NO 2559 | ATTCTGATTTTGTTTTTCCAAA | CTT | chr19 | 55115373 | 55115394 | 55115390 | 55115395 | + |
| SEQ ID NO 2560 | TTCTGATTTTGTTTTTCCAAAC | TTA | chr19 | 55115374 | 55115395 | 55115391 | 55115396 | + |
| SEQ ID NO 2561 | TGATTTTGTTTTTCCAAACTGC | TTC | chr19 | 55115377 | 55115398 | 55115394 | 55115399 | + |
| SEQ ID NO 2562 | ATTTTGTTTTTCCAAACTGCTT | CTG | chr19 | 55115379 | 55115400 | 55115396 | 55115401 | + |
| SEQ ID NO 2563 | TGTTTTTCCAAACTGCTTCTCC | TTT | chr19 | 55115383 | 55115404 | 55115400 | 55115405 | + |
| SEQ ID NO 2564 | GTTTTTCCAAACTGCTTCTCCT | TTT | chr19 | 55115384 | 55115405 | 55115401 | 55115406 | + |
| SEQ ID NO 2565 | TTTTTCCAAACTGCTTCTCCTC | TTG | chr19 | 55115385 | 55115406 | 55115402 | 55115407 | + |
| SEQ ID NO 2566 | TTCCAAACTGCTTCTCCTCTTG | TTT | chr19 | 55115388 | 55115409 | 55115405 | 55115410 | + |
| SEQ ID NO 2567 | TCCAAACTGCTTCTCCTCTTGG | TTT | chr19 | 55115389 | 55115410 | 55115406 | 55115411 | + |
| SEQ ID NO 2568 | CCAAACTGCTTCTCCTCTTGGG | TTT | chr19 | 55115390 | 55115411 | 55115407 | 55115412 | + |
| SEQ ID NO 2569 | CAAACTGCTTCTCCTCTTGGGA | TTC | chr19 | 55115391 | 55115412 | 55115408 | 55115413 | + |
| SEQ ID NO 2570 | CTTCTCCTCTTGGGAAGTGTAA | CTG | chr19 | 55115398 | 55115419 | 55115415 | 55115420 | + |
| SEQ ID NO 2571 | CTCCTCTTGGGAAGTGTAAGGA | CTT | chr19 | 55115401 | 55115422 | 55115418 | 55115423 | + |
| SEQ ID NO 2572 | TCCTCTTGGGAAGTGTAAGGAA | TTC | chr19 | 55115402 | 55115423 | 55115419 | 55115424 | + |
| SEQ ID NO 2573 | CTCTTGGGAAGTGTAAGGAAGC | CTC | chr19 | 55115404 | 55115425 | 55115421 | 55115426 | + |
| SEQ ID NO 2574 | TTGGGAAGTGTAAGGAAGCTGC | CTC | chr19 | 55115407 | 55115428 | 55115424 | 55115429 | + |
| SEQ ID NO 2575 | GGGAAGTGTAAGGAAGCTGCAG | CTT | chr19 | 55115409 | 55115430 | 55115426 | 55115431 | + |
| SEQ ID NO 2576 | GGAAGTGTAAGGAAGCTGCAGC | TTG | chr19 | 55115410 | 55115431 | 55115427 | 55115432 | + |
| SEQ ID NO 2577 | CAGCACCAGGATCAGTGAAACG | CTG | chr19 | 55115428 | 55115449 | 55115445 | 55115450 | + |
| SEQ ID NO 2578 | AGGTTCTGGGAGAGGGTAGCGC | CTC | chr19 | 55115477 | 55115498 | 55115494 | 55115499 | + |
| SEQ ID NO 2579 | TGGGAGAGGGTAGCGCAGGGTG | TTC | chr19 | 55115483 | 55115504 | 55115500 | 55115505 | + |
| SEQ ID NO 2580 | GGAGAGGGTAGCGCAGGGTGGC | CTG | chr19 | 55115485 | 55115506 | 55115502 | 55115507 | + |
| SEQ ID NO 2581 | AGAACCGGGCAGGTCACGCATC | CTG | chr19 | 55115512 | 55115533 | 55115529 | 55115534 | + |
| SEQ ID NO 2582 | CCCTCCCACCCCTGCCAAGCT | CTT | chr19 | 55115542 | 55115563 | 55115559 | 55115564 | + |
| SEQ ID NO 2583 | CCTCCCACCCCTGCCAAGCTC | TTC | chr19 | 55115543 | 55115564 | 55115560 | 55115565 | + |
| SEQ ID NO 2584 | CCACCCCTGCCAAGCTCTCCC | CTC | chr19 | 55115547 | 55115568 | 55115564 | 55115569 | + |
| SEQ ID NO 2585 | CCAAGCTCTCCCTCCCAGGATC | CTG | chr19 | 55115557 | 55115578 | 55115574 | 55115579 | + |
| SEQ ID NO 2586 | TCCCTCCCAGGATCCTCTCTGG | CTC | chr19 | 55115565 | 55115586 | 55115582 | 55115587 | + |
| SEQ ID NO 2587 | CCTCCCAGGATCCTCTCTGGCT | CTC | chr19 | 55115567 | 55115588 | 55115584 | 55115589 | + |
| SEQ ID NO 2588 | CCAGGATCCTCTCTGGCTCCAT | CTC | chr19 | 55115571 | 55115592 | 55115588 | 55115593 | + |
| SEQ ID NO 2589 | TCTGGCTCCATCGTAAGCAAAC | CTC | chr19 | 55115582 | 55115603 | 55115599 | 55115604 | + |
| SEQ ID NO 2590 | TGGCTCCATCGTAAGCAAACCT | CTC | chr19 | 55115584 | 55115605 | 55115601 | 55115606 | + |
| SEQ ID NO 2591 | GCTCCATCGTAAGCAAACCTTA | CTG | chr19 | 55115586 | 55115607 | 55115603 | 55115608 | + |
| SEQ ID NO 2592 | CATCGTAAGCAAACCTTAGAGG | CTC | chr19 | 55115590 | 55115611 | 55115607 | 55115612 | + |
| SEQ ID NO 2593 | AGAGGTTCTGGCAAGGAGAGAG | CTT | chr19 | 55115607 | 55115628 | 55115624 | 55115629 | + |
| SEQ ID NO 2594 | GAGGTTCTGGCAAGGAGAGAGA | TTA | chr19 | 55115608 | 55115629 | 55115625 | 55115630 | + |
| SEQ ID NO 2595 | TGGCAAGGAGAGAGATGGCTCC | TTC | chr19 | 55115615 | 55115636 | 55115632 | 55115637 | + |
| SEQ ID NO 2596 | GCAAGGAGAGAGATGGCTCCAG | CTG | chr19 | 55115617 | 55115638 | 55115634 | 55115639 | + |
| SEQ ID NO 2597 | CAGGAAATGGGGGTGTGTCACC | CTC | chr19 | 55115636 | 55115657 | 55115653 | 55115658 | + |
| SEQ ID NO 2598 | CCTAACAGGAGGTGGGGGTTAG | CTG | chr19 | 55115672 | 55115693 | 55115689 | 55115694 | + |
| SEQ ID NO 2599 | ACAGGAGGTGGGGGTTAGACCC | CTA | chr19 | 55115676 | 55115697 | 55115693 | 55115698 | + |

Figure 6 (Cont'd)

| SEQ ID NO | Sequence | | Chr | | | | |
|---|---|---|---|---|---|---|---|
| SEQ ID NO 2600 | GACCCAATATCAGGAGACTAGG | TTA | chr19 | 55115693 | 55115714 | 55115710 | 55115715 | + |
| SEQ ID NO 2601 | GGAAGGAGGAGGCCTAAGGATG | CTA | chr19 | 55115713 | 55115734 | 55115730 | 55115735 | + |
| SEQ ID NO 2602 | AGGATGGGGCTTTTCTGTCACC | CTA | chr19 | 55115729 | 55115750 | 55115746 | 55115751 | + |
| SEQ ID NO 2603 | TTCTGTCACCAATCCTGTCCCT | CTT | chr19 | 55115741 | 55115762 | 55115758 | 55115763 | + |
| SEQ ID NO 2604 | TCTGTCACCAATCCTGTCCCTA | TTT | chr19 | 55115742 | 55115763 | 55115759 | 55115764 | + |
| SEQ ID NO 2605 | CTGTCACCAATCCTGTCCCTAG | TTT | chr19 | 55115743 | 55115764 | 55115760 | 55115765 | + |
| SEQ ID NO 2606 | TGTCACCAATCCTGTCCCTAGT | TTC | chr19 | 55115744 | 55115765 | 55115761 | 55115766 | + |
| SEQ ID NO 2607 | TCACCAATCCTGTCCCTAGTGG | CTG | chr19 | 55115746 | 55115767 | 55115763 | 55115768 | + |
| SEQ ID NO 2608 | TCCCTAGTGGCCCCACTGTGGG | CTG | chr19 | 55115758 | 55115779 | 55115775 | 55115780 | + |
| SEQ ID NO 2609 | GTGGCCCCACTGTGGGGTGGAG | CTA | chr19 | 55115764 | 55115785 | 55115781 | 55115786 | + |
| SEQ ID NO 2610 | TGGGGTGGAGGGGACAGATAAA | CTG | chr19 | 55115776 | 55115797 | 55115793 | 55115798 | + |
| SEQ ID NO 2611 | ACCGGCCCTGGGAATATAAGGT | TTA | chr19 | 55115823 | 55115844 | 55115840 | 55115845 | + |
| SEQ ID NO 2612 | GGAATATAAGGTGGTCCCAGCT | CTG | chr19 | 55115833 | 55115854 | 55115850 | 55115855 | + |
| SEQ ID NO 2613 | GGGGACACAGGATCCCTGGAGG | CTC | chr19 | 55115856 | 55115877 | 55115873 | 55115878 | + |
| SEQ ID NO 2614 | GAGGCAGCAAACATGCTGTCCT | CTG | chr19 | 55115874 | 55115895 | 55115891 | 55115896 | + |
| SEQ ID NO 2615 | TCCTGAAGTGGACATAGGGGCC | CTG | chr19 | 55115892 | 55115913 | 55115909 | 55115914 | + |
| SEQ ID NO 2616 | AAGTGGACATAGGGGCCCGGGT | CTG | chr19 | 55115897 | 55115918 | 55115914 | 55115919 | + |
| SEQ ID NO 2617 | GAGGAAGAAGACTAGCTGAGCT | TTG | chr19 | 55115921 | 55115942 | 55115938 | 55115943 | + |
| SEQ ID NO 2618 | GCTGAGCTCTCGGACCCCTGGA | CTA | chr19 | 55115935 | 55115956 | 55115952 | 55115957 | + |
| SEQ ID NO 2619 | AGCTCTCGGACCCCTGGAAGAT | CTG | chr19 | 55115939 | 55115960 | 55115956 | 55115961 | + |
| SEQ ID NO 2620 | TCGGACCCCTGGAAGATGCCAT | CTC | chr19 | 55115944 | 55115965 | 55115961 | 55115966 | + |
| SEQ ID NO 2621 | GGACCCCTGGAAGATGCCATGA | CTC | chr19 | 55115946 | 55115967 | 55115963 | 55115968 | + |
| SEQ ID NO 2622 | GAAGATGCCATGACAGGGGGCT | CTG | chr19 | 55115955 | 55115976 | 55115972 | 55115977 | + |
| SEQ ID NO 2623 | GAAGAGCTAGCACAGACTAGAG | CTG | chr19 | 55115978 | 55115999 | 55115995 | 55116000 | + |
| SEQ ID NO 2624 | GCACAGACTAGAGAGGTAAGGG | CTA | chr19 | 55115987 | 55116008 | 55116004 | 55116009 | + |
| SEQ ID NO 2625 | GAGAGGTAAGGGGGGTAGGGGA | CTA | chr19 | 55115997 | 55116018 | 55116014 | 55116019 | + |
| SEQ ID NO 2626 | CCCAAATGAAAGGAGTGAGAGG | CTG | chr19 | 55116023 | 55116044 | 55116040 | 55116045 | + |
| SEQ ID NO 2627 | AAGCCAGGGAGACGGGGTACTT | CTA | chr19 | 55116110 | 55116131 | 55116127 | 55116132 | + |
| SEQ ID NO 2628 | TGGGGTTGTCCAGAAAAACGGT | CTT | chr19 | 55116132 | 55116153 | 55116149 | 55116154 | + |
| SEQ ID NO 2629 | GGGGTTGTCCAGAAAAACGGTG | TTT | chr19 | 55116133 | 55116154 | 55116150 | 55116155 | + |
| SEQ ID NO 2630 | GGGTTGTCCAGAAAAACGGTGA | TTG | chr19 | 55116134 | 55116155 | 55116151 | 55116156 | + |
| SEQ ID NO 2631 | TCCAGAAAAACGGTGATGATGC | TTG | chr19 | 55116140 | 55116161 | 55116157 | 55116162 | + |
| SEQ ID NO 2632 | CAAGAAGGGGAGGCGGGACGCA | CTA | chr19 | 55116169 | 55116190 | 55116186 | 55116191 | + |
| SEQ ID NO 2633 | AGAAACGAGAGATGGCACAGGC | CTA | chr19 | 55116222 | 55116243 | 55116239 | 55116244 | + |
| SEQ ID NO 2634 | GGTGAGGGAGGAGAGATGCCCG | TTG | chr19 | 55116296 | 55116317 | 55116313 | 55116318 | + |
| SEQ ID NO 2635 | AGAGGACATCACGTGGTGCAGC | CTC | chr19 | 55116349 | 55116370 | 55116366 | 55116371 | + |
| SEQ ID NO 2636 | CGGAAAGAGCATCCTTGGGCAG | CTC | chr19 | 55116389 | 55116410 | 55116406 | 55116411 | + |
| SEQ ID NO 2637 | GGGCAGCAACACAGCAGAGAGC | CTT | chr19 | 55116405 | 55116426 | 55116422 | 55116427 | + |
| SEQ ID NO 2638 | GGCAGCAACACAGCAGAGAGCA | TTG | chr19 | 55116406 | 55116427 | 55116423 | 55116428 | + |
| SEQ ID NO 2639 | AAGGAGGCGGCAGGGAAGGATC | CTG | chr19 | 55116461 | 55116482 | 55116478 | 55116483 | + |
| SEQ ID NO 2640 | GGCCAGCCGTAGAGGTGACCCA | CTG | chr19 | 55116485 | 55116506 | 55116502 | 55116507 | + |
| SEQ ID NO 2641 | CAGACAGAAAGCGGCACAGGCC | CTG | chr19 | 55116519 | 55116540 | 55116536 | 55116541 | + |
| SEQ ID NO 2642 | CCTGGGAAGGGGAAACAGTGGG | CTG | chr19 | 55116578 | 55116599 | 55116595 | 55116600 | + |
| SEQ ID NO 2643 | GGAAGGGGAAACAGTGGGCCAG | CTG | chr19 | 55116582 | 55116603 | 55116599 | 55116604 | + |
| SEQ ID NO 2644 | AAAGTGGTCCGGACTCAGGAGA | CTC | chr19 | 55116630 | 55116651 | 55116647 | 55116652 | + |
| SEQ ID NO 2645 | AGGAGAGAGACGGCAGCGTTAG | CTC | chr19 | 55116646 | 55116667 | 55116663 | 55116668 | + |
| SEQ ID NO 2646 | GAGGGCAGAGTTCCGGCGGCAC | TTA | chr19 | 55116667 | 55116688 | 55116684 | 55116689 | + |
| SEQ ID NO 2647 | CGGCGGCACAGCAAGGGCACTC | TTC | chr19 | 55116680 | 55116701 | 55116697 | 55116702 | + |
| SEQ ID NO 2648 | GGGGGCGAGAGGAGGGCAGCGC | CTC | chr19 | 55116702 | 55116723 | 55116719 | 55116724 | + |
| SEQ ID NO 2649 | AGCTATGGGAGCTGGCTCAGGT | CTG | chr19 | 55116764 | 55116785 | 55116781 | 55116786 | + |
| SEQ ID NO 2650 | TGGGAGCTGGCTCAGGTTCAGG | CTA | chr19 | 55116769 | 55116790 | 55116786 | 55116791 | + |
| SEQ ID NO 2651 | GCTCAGGTTCAGGAGAGGGCAG | CTG | chr19 | 55116778 | 55116799 | 55116795 | 55116800 | + |
| SEQ ID NO 2652 | AGGTTCAGGAGAGGGCAGGGCA | CTC | chr19 | 55116782 | 55116803 | 55116799 | 55116804 | + |
| SEQ ID NO 2653 | AGGAGAGGGCAGGGCAGGGAAG | TTC | chr19 | 55116788 | 55116809 | 55116805 | 55116810 | + |
| SEQ ID NO 2654 | GAGGGCTCAACATCGGAAGAG | CTG | chr19 | 55116833 | 55116854 | 55116850 | 55116855 | + |
| SEQ ID NO 2655 | AACATCGGAAGAGGGGAAGTCG | CTC | chr19 | 55116842 | 55116863 | 55116859 | 55116864 | + |
| SEQ ID NO 2656 | CATGGGTCAGCACAGGCTGCCA | CTG | chr19 | 55116888 | 55116909 | 55116905 | 55116910 | + |
| SEQ ID NO 2657 | CCAAAGCCAGGGCCAGTTAAAG | CTG | chr19 | 55116907 | 55116928 | 55116924 | 55116929 | + |
| SEQ ID NO 2658 | AAGCGACTCCAATGCGGAAGAG | TTA | chr19 | 55116926 | 55116947 | 55116943 | 55116948 | + |

Figure 6 (Cont'd)

| | | | | | | | | |
|---|---|---|---|---|---|---|---|---|
| SEQ ID NO 2659 | CAATGCGGAAGAGAGTAGGTCG | CTC | chr19 | 55116935 | 55116956 | 55116952 | 55116957 | + |
| SEQ ID NO 2660 | GGGCAGAGTGGTCAGCACAGAG | CTG | chr19 | 55116980 | 55117001 | 55116997 | 55117002 | + |
| SEQ ID NO 2661 | AGCCCAGGGCCAGTTGAAGCGG | CTA | chr19 | 55117008 | 55117029 | 55117025 | 55117030 | + |
| SEQ ID NO 2662 | AAGCGGCTCCAATTCGGAAGTG | TTG | chr19 | 55117024 | 55117045 | 55117041 | 55117046 | + |
| SEQ ID NO 2663 | CAATTCGGAAGTGGGGTGGTCG | CTC | chr19 | 55117033 | 55117054 | 55117050 | 55117055 | + |
| SEQ ID NO 2664 | GGAAGTGGGGTGGTCGAAGGGG | TTC | chr19 | 55117039 | 55117060 | 55117056 | 55117061 | + |
| SEQ ID NO 2665 | GGACGGGGTGTCAGCATAGGGT | CTG | chr19 | 55117078 | 55117099 | 55117095 | 55117100 | + |
| SEQ ID NO 2666 | GCAACGGGGAAGGAGGATGCCC | CTG | chr19 | 55117142 | 55117163 | 55117159 | 55117164 | + |
| SEQ ID NO 2667 | GCCCCGGGAGACGCCGGGCGGG | CTG | chr19 | 55117191 | 55117212 | 55117208 | 55117213 | + |
| SEQ ID NO 2668 | ACCTGGTGCAGGGCGCTGATAC | CTG | chr19 | 55117221 | 55117242 | 55117238 | 55117243 | + |
| SEQ ID NO 2669 | GTGCAGGGCGCTGATACCGTCG | CTG | chr19 | 55117226 | 55117247 | 55117243 | 55117248 | + |
| SEQ ID NO 2670 | ATACCGTCGGCGTTGGTGGAGT | CTG | chr19 | 55117239 | 55117260 | 55117256 | 55117261 | + |
| SEQ ID NO 2671 | GTGGAGTCCAGCACGGCGCGGG | TTG | chr19 | 55117254 | 55117275 | 55117271 | 55117276 | + |
| SEQ ID NO 2672 | GGCGCCGGGGCCAGGGTCGGCG | CTC | chr19 | 55117304 | 55117325 | 55117321 | 55117326 | + |
| SEQ ID NO 2673 | GTCCAGGTCGCCGCCCGCACAG | CTC | chr19 | 55117349 | 55117370 | 55117366 | 55117371 | + |
| SEQ ID NO 2674 | GGCGGCGCGCTCGAAGCGGACG | CTC | chr19 | 55117385 | 55117406 | 55117402 | 55117407 | + |
| SEQ ID NO 2675 | GAAGCGGACGGTGCGGGCGCGG | CTC | chr19 | 55117397 | 55117418 | 55117414 | 55117419 | + |
| SEQ ID NO 2676 | TCCGGGGCCAGGCTCGGCGCCC | CTC | chr19 | 55117424 | 55117445 | 55117441 | 55117446 | + |
| SEQ ID NO 2677 | CGGGGCCAGGCTCGGCGCCCGC | CTC | chr19 | 55117426 | 55117447 | 55117443 | 55117448 | + |
| SEQ ID NO 2678 | GGCGCCCGCCCGCGCCCCCCAC | CTC | chr19 | 55117439 | 55117460 | 55117456 | 55117461 | + |
| SEQ ID NO 2679 | CCGCAGCTGCTCCCGTCGCCGC | CTG | chr19 | 55117463 | 55117484 | 55117480 | 55117485 | + |
| SEQ ID NO 2680 | CTCCCGTCGCCGCTCCCGGGCA | CTG | chr19 | 55117472 | 55117493 | 55117489 | 55117494 | + |
| SEQ ID NO 2681 | CCGTCGCCGCTCCCGGGCAGCC | CTC | chr19 | 55117475 | 55117496 | 55117492 | 55117497 | + |
| SEQ ID NO 2682 | CCGGGCAGCCGCCGCCGCCGCC | CTC | chr19 | 55117487 | 55117508 | 55117504 | 55117509 | + |
| SEQ ID NO 2683 | TCCGGACATCGCACCGCCCGCC | CTC | chr19 | 55117535 | 55117556 | 55117552 | 55117557 | + |
| SEQ ID NO 2684 | CGGACATCGCACCGCCCGCCCG | CTC | chr19 | 55117537 | 55117558 | 55117554 | 55117559 | + |
| SEQ ID NO 2685 | GGGCTCGGCGCTCGCTCGCTCG | TTG | chr19 | 55117564 | 55117585 | 55117569 | 55117564 | - |
| SEQ ID NO 2686 | GGCGCTCGCTCGCTCGCTGGGC | CTC | chr19 | 55117558 | 55117579 | 55117563 | 55117558 | - |
| SEQ ID NO 2687 | GCTCGCTCGCTGGGCGGGCGGG | CTC | chr19 | 55117551 | 55117572 | 55117556 | 55117551 | - |
| SEQ ID NO 2688 | GCTCGCTGGGCGGGCGGGCGGT | CTC | chr19 | 55117547 | 55117568 | 55117552 | 55117547 | - |
| SEQ ID NO 2689 | GCTGGGCGGGCGGGCGGTGCGA | CTC | chr19 | 55117543 | 55117564 | 55117548 | 55117543 | - |
| SEQ ID NO 2690 | GGCGGGCGGGCGGTGCGATGTC | CTG | chr19 | 55117539 | 55117560 | 55117544 | 55117539 | - |
| SEQ ID NO 2691 | GCCCGGGGGCGGCGGCGGCGGC | CTG | chr19 | 55117494 | 55117515 | 55117499 | 55117494 | - |
| SEQ ID NO 2692 | CCCGGGAGCGGCGACGGGAGCA | CTG | chr19 | 55117470 | 55117491 | 55117475 | 55117470 | - |
| SEQ ID NO 2693 | CGGCAGTGGGGGCGCGGGCGG | CTG | chr19 | 55117444 | 55117465 | 55117449 | 55117444 | - |
| SEQ ID NO 2694 | GCCCCGGAGAGCGCCGCGCCCG | CTG | chr19 | 55117410 | 55117431 | 55117415 | 55117410 | - |
| SEQ ID NO 2695 | CGAGCGCGCCGCCGAGTTCCTG | CTT | chr19 | 55117376 | 55117397 | 55117381 | 55117376 | - |
| SEQ ID NO 2696 | GAGCGCGCCGCCGAGTTCCTGG | TTC | chr19 | 55117375 | 55117396 | 55117380 | 55117375 | - |
| SEQ ID NO 2697 | CTGGCGGCCTGTGCGGGCGGCG | TTC | chr19 | 55117357 | 55117378 | 55117362 | 55117357 | - |
| SEQ ID NO 2698 | GCGGCCTGTGCGGGCGGCGACC | CTG | chr19 | 55117354 | 55117375 | 55117359 | 55117354 | - |
| SEQ ID NO 2699 | TGCGGGCGGCGACCTGGACGAG | CTG | chr19 | 55117346 | 55117367 | 55117351 | 55117346 | - |
| SEQ ID NO 2700 | GACGAGGCGCGTCTGATGCTGC | CTG | chr19 | 55117330 | 55117351 | 55117335 | 55117330 | - |
| SEQ ID NO 2701 | ATGCTGCGCGCCGCCGACCCTG | CTG | chr19 | 55117315 | 55117336 | 55117320 | 55117315 | - |
| SEQ ID NO 2702 | CGCGCCGCCGACCCTGGCCCCG | CTG | chr19 | 55117309 | 55117330 | 55117314 | 55117309 | - |
| SEQ ID NO 2703 | GCCCCGGCGCCGAGCTCGACCC | CTG | chr19 | 55117293 | 55117314 | 55117298 | 55117293 | - |
| SEQ ID NO 2704 | GACCCCGCCGCGCCGCCGCCCG | CTC | chr19 | 55117276 | 55117297 | 55117281 | 55117276 | - |
| SEQ ID NO 2705 | GACTCCACCAACGCCGACGGTA | CTG | chr19 | 55117240 | 55117261 | 55117245 | 55117240 | - |
| SEQ ID NO 2706 | CACCAACGCCGACGGTATCAGC | CTC | chr19 | 55117235 | 55117256 | 55117240 | 55117235 | - |
| SEQ ID NO 2707 | CACCAGGTCAGCGCCCCCGCC | CTG | chr19 | 55117207 | 55117228 | 55117212 | 55117207 | - |
| SEQ ID NO 2708 | CCGGGGCCAGGTCCACCCTCTG | CTC | chr19 | 55117176 | 55117197 | 55117181 | 55117176 | - |
| SEQ ID NO 2709 | TGCTGCGCCACCTGGGGCATCC | CTC | chr19 | 55117156 | 55117177 | 55117161 | 55117156 | - |
| SEQ ID NO 2710 | CTGCGCCACCTGGGGCATCCTC | CTG | chr19 | 55117154 | 55117175 | 55117159 | 55117154 | - |
| SEQ ID NO 2711 | CGCCACCTGGGGCATCCTCCTT | CTG | chr19 | 55117151 | 55117172 | 55117156 | 55117151 | - |
| SEQ ID NO 2712 | GGGCATCCTCCTTCCCCGTTGC | CTG | chr19 | 55117142 | 55117163 | 55117147 | 55117142 | - |
| SEQ ID NO 2713 | CTTCCCCGTTGCCAGTCTCGAT | CTC | chr19 | 55117132 | 55117153 | 55117137 | 55117132 | - |
| SEQ ID NO 2714 | CCCCGTTGCCAGTCTCGATCCG | CTT | chr19 | 55117129 | 55117150 | 55117134 | 55117129 | - |
| SEQ ID NO 2715 | CCCGTTGCCAGTCTCGATCCGC | TTC | chr19 | 55117128 | 55117149 | 55117133 | 55117128 | - |
| SEQ ID NO 2716 | CCAGTCTCGATCCGCCCCGTCG | TTG | chr19 | 55117121 | 55117142 | 55117126 | 55117121 | - |
| SEQ ID NO 2717 | GATCCGCCCCGTCGTTCCTGGC | CTC | chr19 | 55117113 | 55117134 | 55117118 | 55117113 | - |

Figure 6 (Cont'd)

| | | | | | | | | |
|---|---|---|---|---|---|---|---|---|
| SEQ ID NO 2718 | CTGGCCCTGGGCTTTGCCACCC | TTC | chr19 | 55117096 | 55117117 | 55117101 | 55117096 | - |
| SEQ ID NO 2719 | GCCCTGGGCTTTGCCACCCTAT | CTG | chr19 | 55117093 | 55117114 | 55117098 | 55117093 | - |
| SEQ ID NO 2720 | GGCTTTGCCACCCTATGCTGAC | CTG | chr19 | 55117087 | 55117108 | 55117092 | 55117087 | - |
| SEQ ID NO 2721 | TGCCACCCTATGCTGACACCCC | CTT | chr19 | 55117082 | 55117103 | 55117087 | 55117082 | - |
| SEQ ID NO 2722 | GCCACCCTATGCTGACACCCCG | TTT | chr19 | 55117081 | 55117102 | 55117086 | 55117081 | - |
| SEQ ID NO 2723 | CCACCCTATGCTGACACCCCGT | TTG | chr19 | 55117080 | 55117101 | 55117085 | 55117080 | - |
| SEQ ID NO 2724 | TGCTGACACCCCGTCCCAGTCC | CTA | chr19 | 55117072 | 55117093 | 55117077 | 55117072 | - |
| SEQ ID NO 2725 | ACACCCCGTCCCAGTCCCCCTT | CTG | chr19 | 55117067 | 55117088 | 55117072 | 55117067 | - |
| SEQ ID NO 2726 | ACCATTCCCCTTCGACCACCCC | CTT | chr19 | 55117045 | 55117066 | 55117050 | 55117045 | - |
| SEQ ID NO 2727 | CCATTCCCCTTCGACCACCCCA | TTA | chr19 | 55117044 | 55117065 | 55117049 | 55117044 | - |
| SEQ ID NO 2728 | CCCTTCGACCACCCCACTTCCG | TTC | chr19 | 55117038 | 55117059 | 55117043 | 55117038 | - |
| SEQ ID NO 2729 | CGACCACCCCACTTCCGAATTG | CTT | chr19 | 55117033 | 55117054 | 55117038 | 55117033 | - |
| SEQ ID NO 2730 | GACCACCCCACTTCCGAATTGG | TTC | chr19 | 55117032 | 55117053 | 55117037 | 55117032 | - |
| SEQ ID NO 2731 | CCGAATTGGAGCCGCTTCAACT | CTT | chr19 | 55117019 | 55117040 | 55117024 | 55117019 | - |
| SEQ ID NO 2732 | CGAATTGGAGCCGCTTCAACTG | TTC | chr19 | 55117018 | 55117039 | 55117023 | 55117018 | - |
| SEQ ID NO 2733 | GAGCCGCTTCAACTGGCCCTGG | TTG | chr19 | 55117011 | 55117032 | 55117016 | 55117011 | - |
| SEQ ID NO 2734 | CAACTGGCCCTGGGCTTAGCCA | CTT | chr19 | 55117002 | 55117023 | 55117007 | 55117002 | - |
| SEQ ID NO 2735 | AACTGGCCCTGGGCTTAGCCAC | TTC | chr19 | 55117001 | 55117022 | 55117006 | 55117001 | - |
| SEQ ID NO 2736 | GCCCTGGGCTTAGCCACTCTGT | CTG | chr19 | 55116996 | 55117017 | 55117001 | 55116996 | - |
| SEQ ID NO 2737 | GGCTTAGCCACTCTGTGCTGAC | CTG | chr19 | 55116990 | 55117011 | 55116995 | 55116990 | - |
| SEQ ID NO 2738 | AGCCACTCTGTGCTGACCACTC | CTT | chr19 | 55116985 | 55117006 | 55116990 | 55116985 | - |
| SEQ ID NO 2739 | GCCACTCTGTGCTGACCACTCT | TTA | chr19 | 55116984 | 55117005 | 55116989 | 55116984 | - |
| SEQ ID NO 2740 | TGTGCTGACCACTCTGCCCCAG | CTC | chr19 | 55116977 | 55116998 | 55116982 | 55116977 | - |
| SEQ ID NO 2741 | TGCTGACCACTCTGCCCCAGGC | CTG | chr19 | 55116975 | 55116996 | 55116980 | 55116975 | - |
| SEQ ID NO 2742 | ACCACTCTGCCCCAGGCCTCCT | CTG | chr19 | 55116970 | 55116991 | 55116975 | 55116970 | - |
| SEQ ID NO 2743 | TGCCCAGGCCTCCTTACCATT | CTC | chr19 | 55116963 | 55116984 | 55116968 | 55116963 | - |
| SEQ ID NO 2744 | CCCCAGGCCTCCTTACCATTCC | CTG | chr19 | 55116961 | 55116982 | 55116966 | 55116961 | - |
| SEQ ID NO 2745 | CTTACCATTCCCCTTCGACCTA | CTC | chr19 | 55116950 | 55116971 | 55116955 | 55116950 | - |
| SEQ ID NO 2746 | ACCATTCCCCTTCGACCTACTC | CTT | chr19 | 55116947 | 55116968 | 55116952 | 55116947 | - |
| SEQ ID NO 2747 | CCATTCCCCTTCGACCTACTCT | TTA | chr19 | 55116946 | 55116967 | 55116951 | 55116946 | - |
| SEQ ID NO 2748 | CCCTTCGACCTACTCTCTTCCG | TTC | chr19 | 55116940 | 55116961 | 55116945 | 55116940 | - |
| SEQ ID NO 2749 | CGACCTACTCTCTTCCGCATTG | CTT | chr19 | 55116935 | 55116956 | 55116940 | 55116935 | - |
| SEQ ID NO 2750 | GACCTACTCTCTTCCGCATTGG | TTC | chr19 | 55116934 | 55116955 | 55116939 | 55116934 | - |
| SEQ ID NO 2751 | CTCTCTTCCGCATTGGAGTCGC | CTA | chr19 | 55116928 | 55116949 | 55116933 | 55116928 | - |
| SEQ ID NO 2752 | TCTTCCGCATTGGAGTCGCTTT | CTC | chr19 | 55116925 | 55116946 | 55116930 | 55116925 | - |
| SEQ ID NO 2753 | TTCCGCATTGGAGTCGCTTTAA | CTC | chr19 | 55116923 | 55116944 | 55116928 | 55116923 | - |
| SEQ ID NO 2754 | CCGCATTGGAGTCGCTTTAACT | CTT | chr19 | 55116921 | 55116942 | 55116926 | 55116921 | - |
| SEQ ID NO 2755 | CGCATTGGAGTCGCTTTAACTG | TTC | chr19 | 55116920 | 55116941 | 55116925 | 55116920 | - |
| SEQ ID NO 2756 | GAGTCGCTTTAACTGGCCCTGG | TTG | chr19 | 55116913 | 55116934 | 55116918 | 55116913 | - |
| SEQ ID NO 2757 | TAACTGGCCCTGGCTTTGGCAG | CTT | chr19 | 55116904 | 55116925 | 55116909 | 55116904 | - |
| SEQ ID NO 2758 | AACTGGCCCTGGCTTTGGCAGC | TTT | chr19 | 55116903 | 55116924 | 55116908 | 55116903 | - |
| SEQ ID NO 2759 | ACTGGCCCTGGCTTTGGCAGCC | TTA | chr19 | 55116902 | 55116923 | 55116907 | 55116902 | - |
| SEQ ID NO 2760 | GCCCTGGCTTTGGCAGCCTGTG | CTG | chr19 | 55116898 | 55116919 | 55116903 | 55116898 | - |
| SEQ ID NO 2761 | GCTTTGGCAGCCTGTGCTGACC | CTG | chr19 | 55116892 | 55116913 | 55116897 | 55116892 | - |
| SEQ ID NO 2762 | TGGCAGCCTGTGCTGACCCATG | CTT | chr19 | 55116888 | 55116909 | 55116893 | 55116888 | - |
| SEQ ID NO 2763 | GGCAGCCTGTGCTGACCCATGC | TTT | chr19 | 55116887 | 55116908 | 55116892 | 55116887 | - |
| SEQ ID NO 2764 | GCAGCCTGTGCTGACCCATGCA | TTG | chr19 | 55116886 | 55116907 | 55116891 | 55116886 | - |
| SEQ ID NO 2765 | TGCTGACCCATGCAGTCCTCCT | CTG | chr19 | 55116878 | 55116899 | 55116883 | 55116878 | - |
| SEQ ID NO 2766 | ACCCATGCAGTCCTCCTTACCA | CTG | chr19 | 55116873 | 55116894 | 55116878 | 55116873 | - |
| SEQ ID NO 2767 | CTTACCATCCCTCCCTCGACTT | CTC | chr19 | 55116858 | 55116879 | 55116863 | 55116858 | - |
| SEQ ID NO 2768 | ACCATCCCTCCCTCGACTTCCC | CTT | chr19 | 55116855 | 55116876 | 55116860 | 55116855 | - |
| SEQ ID NO 2769 | CCATCCCTCCCTCGACTTCCCC | TTA | chr19 | 55116854 | 55116875 | 55116859 | 55116854 | - |
| SEQ ID NO 2770 | CCTCGACTTCCCCTCTTCCGAT | CTC | chr19 | 55116845 | 55116866 | 55116850 | 55116845 | - |
| SEQ ID NO 2771 | GACTTCCCCTCTTCCGATGTTG | CTC | chr19 | 55116841 | 55116862 | 55116846 | 55116841 | - |
| SEQ ID NO 2772 | CCCCTCTTCCGATGTTGAGCCC | CTT | chr19 | 55116836 | 55116857 | 55116841 | 55116836 | - |
| SEQ ID NO 2773 | CCCTCTTCCGATGTTGAGCCCC | TTC | chr19 | 55116835 | 55116856 | 55116840 | 55116835 | - |
| SEQ ID NO 2774 | TTCCGATGTTGAGCCCCTCCAG | CTC | chr19 | 55116830 | 55116851 | 55116835 | 55116830 | - |
| SEQ ID NO 2775 | CCGATGTTGAGCCCCTCCAGCC | CTT | chr19 | 55116828 | 55116849 | 55116833 | 55116828 | - |
| SEQ ID NO 2776 | CGATGTTGAGCCCCTCCAGCCG | TTC | chr19 | 55116827 | 55116848 | 55116832 | 55116827 | - |

Figure 6 (Cont'd)

| | | | | | | | | | |
|---|---|---|---|---|---|---|---|---|---|
| SEQ ID NO 2777 | AGCCCCTCCAGCCGGTCCTGGA | TTG | chr19 | 55116819 | 55116840 | 55116824 | 55116819 | - |
| SEQ ID NO 2778 | CAGCCGGTCCTGGACTTTGTCT | CTC | chr19 | 55116811 | 55116832 | 55116816 | 55116811 | - |
| SEQ ID NO 2779 | GACTTTGTCTCCTTCCCTGCCC | CTG | chr19 | 55116799 | 55116820 | 55116804 | 55116799 | - |
| SEQ ID NO 2780 | TGTCTCCTTCCCTGCCCTGCCC | CTT | chr19 | 55116794 | 55116815 | 55116799 | 55116794 | - |
| SEQ ID NO 2781 | GTCTCCTTCCCTGCCCTGCCCT | TTT | chr19 | 55116793 | 55116814 | 55116798 | 55116793 | - |
| SEQ ID NO 2782 | TCTCCTTCCCTGCCCTGCCCTC | TTG | chr19 | 55116792 | 55116813 | 55116797 | 55116792 | - |
| SEQ ID NO 2783 | CTTCCCTGCCCTGCCCTCTCCT | CTC | chr19 | 55116788 | 55116809 | 55116793 | 55116788 | - |
| SEQ ID NO 2784 | CCCTGCCCTGCCCTCTCCTGAA | CTT | chr19 | 55116785 | 55116806 | 55116790 | 55116785 | - |
| SEQ ID NO 2785 | CCTGCCCTGCCCTCTCCTGAAC | TTC | chr19 | 55116784 | 55116805 | 55116789 | 55116784 | - |
| SEQ ID NO 2786 | CCCTGCCCTCTCCTGAACCTGA | CTG | chr19 | 55116780 | 55116801 | 55116785 | 55116780 | - |
| SEQ ID NO 2787 | CCCTCTCCTGAACCTGAGCCAG | CTG | chr19 | 55116775 | 55116796 | 55116780 | 55116775 | - |
| SEQ ID NO 2788 | TCCTGAACCTGAGCCAGCTCCC | CTC | chr19 | 55116770 | 55116791 | 55116775 | 55116770 | - |
| SEQ ID NO 2789 | CTGAACCTGAGCCAGCTCCCAT | CTC | chr19 | 55116768 | 55116789 | 55116773 | 55116768 | - |
| SEQ ID NO 2790 | AACCTGAGCCAGCTCCCATAGC | CTG | chr19 | 55116765 | 55116786 | 55116770 | 55116765 | - |
| SEQ ID NO 2791 | AGCCAGCTCCCATAGCTCAGTC | CTG | chr19 | 55116759 | 55116780 | 55116764 | 55116759 | - |
| SEQ ID NO 2792 | CCATAGCTCAGTCTGGTCTATC | CTC | chr19 | 55116750 | 55116771 | 55116755 | 55116750 | - |
| SEQ ID NO 2793 | AGTCTGGTCTATCTGCCTGGCC | CTC | chr19 | 55116741 | 55116762 | 55116746 | 55116741 | - |
| SEQ ID NO 2794 | GTCTATCTGCCTGGCCCTGGCC | CTG | chr19 | 55116735 | 55116756 | 55116740 | 55116735 | - |
| SEQ ID NO 2795 | TCTGCCTGGCCCTGGCCATTGT | CTA | chr19 | 55116730 | 55116751 | 55116735 | 55116730 | - |
| SEQ ID NO 2796 | CCTGGCCCTGGCCATTGTCACT | CTG | chr19 | 55116726 | 55116747 | 55116731 | 55116726 | - |
| SEQ ID NO 2797 | GCCCTGGCCATTGTCACTTTGC | CTG | chr19 | 55116722 | 55116743 | 55116727 | 55116722 | - |
| SEQ ID NO 2798 | GCCATTGTCACTTTGCGCTGCC | CTG | chr19 | 55116716 | 55116737 | 55116721 | 55116716 | - |
| SEQ ID NO 2799 | TCACTTTGCGCTGCCCTCCTCT | TTG | chr19 | 55116709 | 55116730 | 55116714 | 55116709 | - |
| SEQ ID NO 2800 | TGCGCTGCCCTCCTCTCGCCCC | CTT | chr19 | 55116703 | 55116724 | 55116708 | 55116703 | - |
| SEQ ID NO 2801 | GCGCTGCCCTCCTCTCGCCCCC | TTT | chr19 | 55116702 | 55116723 | 55116707 | 55116702 | - |
| SEQ ID NO 2802 | CGCTGCCCTCCTCTCGCCCCCG | TTG | chr19 | 55116701 | 55116722 | 55116706 | 55116701 | - |
| SEQ ID NO 2803 | CCCTCCTCTCGCCCCCGAGTGC | CTG | chr19 | 55116696 | 55116717 | 55116701 | 55116696 | - |
| SEQ ID NO 2804 | CTCTCGCCCCCGAGTGCCCTTG | CTC | chr19 | 55116691 | 55116712 | 55116696 | 55116691 | - |
| SEQ ID NO 2805 | TCGCCCCCGAGTGCCCTTGCTG | CTC | chr19 | 55116688 | 55116709 | 55116693 | 55116688 | - |
| SEQ ID NO 2806 | GCCCCCGAGTGCCCTTGCTGTG | CTC | chr19 | 55116686 | 55116707 | 55116691 | 55116686 | - |
| SEQ ID NO 2807 | GCTGTGCCGCCGGAACTCTGCC | CTT | chr19 | 55116670 | 55116691 | 55116675 | 55116670 | - |
| SEQ ID NO 2808 | CTGTGCCGCCGGAACTCTGCCC | TTG | chr19 | 55116669 | 55116690 | 55116674 | 55116669 | - |
| SEQ ID NO 2809 | TGCCGCCGGAACTCTGCCCTCT | CTG | chr19 | 55116666 | 55116687 | 55116671 | 55116666 | - |
| SEQ ID NO 2810 | TGCCCTCTAACGCTGCCGTCTC | CTC | chr19 | 55116652 | 55116673 | 55116657 | 55116652 | - |
| SEQ ID NO 2811 | CCCTCTAACGCTGCCGTCTCTC | CTG | chr19 | 55116650 | 55116671 | 55116655 | 55116650 | - |
| SEQ ID NO 2812 | TAACGCTGCCGTCTCTCTCCTG | CTC | chr19 | 55116645 | 55116666 | 55116650 | 55116645 | - |
| SEQ ID NO 2813 | ACGCTGCCGTCTCTCTCCTGAG | CTA | chr19 | 55116643 | 55116664 | 55116648 | 55116643 | - |
| SEQ ID NO 2814 | CCGTCTCTCTCCTGAGTCCGGA | CTG | chr19 | 55116637 | 55116658 | 55116642 | 55116637 | - |
| SEQ ID NO 2815 | TCTCCTGAGTCCGGACCACTTT | CTC | chr19 | 55116630 | 55116651 | 55116635 | 55116630 | - |
| SEQ ID NO 2816 | TCCTGAGTCCGGACCACTTTGA | CTC | chr19 | 55116628 | 55116649 | 55116633 | 55116628 | - |
| SEQ ID NO 2817 | CTGAGTCCGGACCACTTTGAGC | CTC | chr19 | 55116626 | 55116647 | 55116631 | 55116626 | - |
| SEQ ID NO 2818 | AGTCCGGACCACTTTGAGCTCT | CTG | chr19 | 55116623 | 55116644 | 55116628 | 55116623 | - |
| SEQ ID NO 2819 | TGAGCTCTACTGGCTTCTGCGC | CTT | chr19 | 55116609 | 55116630 | 55116614 | 55116609 | - |
| SEQ ID NO 2820 | GAGCTCTACTGGCTTCTGCGCC | TTT | chr19 | 55116608 | 55116629 | 55116613 | 55116608 | - |
| SEQ ID NO 2821 | AGCTCTACTGGCTTCTGCGCCG | TTG | chr19 | 55116607 | 55116628 | 55116612 | 55116607 | - |
| SEQ ID NO 2822 | TACTGGCTTCTGCGCCGCCTCT | CTC | chr19 | 55116602 | 55116623 | 55116607 | 55116602 | - |
| SEQ ID NO 2823 | CTGGCTTCTGCGCCGCCTCTGG | CTA | chr19 | 55116600 | 55116621 | 55116605 | 55116600 | - |
| SEQ ID NO 2824 | GCTTCTGCGCCGCCTCTGGCCC | CTG | chr19 | 55116597 | 55116618 | 55116602 | 55116597 | - |
| SEQ ID NO 2825 | CTGCGCCGCCTCTGGCCCACTG | CTT | chr19 | 55116593 | 55116614 | 55116598 | 55116593 | - |
| SEQ ID NO 2826 | TGCGCCGCCTCTGGCCCACTGT | TTC | chr19 | 55116592 | 55116613 | 55116597 | 55116592 | - |
| SEQ ID NO 2827 | CGCCGCCTCTGGCCCACTGTTT | CTG | chr19 | 55116590 | 55116611 | 55116595 | 55116590 | - |
| SEQ ID NO 2828 | TGGCCCACTGTTTCCCCTTCCC | CTC | chr19 | 55116581 | 55116602 | 55116586 | 55116581 | - |
| SEQ ID NO 2829 | GCCCACTGTTTCCCCTTCCCAG | CTG | chr19 | 55116579 | 55116600 | 55116584 | 55116579 | - |
| SEQ ID NO 2830 | TTTCCCCTTCCCAGGCAGGTCC | CTG | chr19 | 55116571 | 55116592 | 55116576 | 55116571 | - |
| SEQ ID NO 2831 | CCCCTTCCCAGGCAGGTCCTGC | TTT | chr19 | 55116568 | 55116589 | 55116573 | 55116568 | - |
| SEQ ID NO 2832 | CCCTTCCCAGGCAGGTCCTGCT | TTC | chr19 | 55116567 | 55116588 | 55116572 | 55116567 | - |
| SEQ ID NO 2833 | CCCAGGCAGGTCCTGCTTTCTC | CTT | chr19 | 55116562 | 55116583 | 55116567 | 55116562 | - |
| SEQ ID NO 2834 | CCAGGCAGGTCCTGCTTTCTCT | TTC | chr19 | 55116561 | 55116582 | 55116566 | 55116561 | - |
| SEQ ID NO 2835 | CTTTCTCTGACCTGCATTCTCT | CTG | chr19 | 55116547 | 55116568 | 55116552 | 55116547 | - |

Figure 6 (Cont'd)

| | | | | | | | | |
|---|---|---|---|---|---|---|---|---|
| SEQ ID NO 2836 | TCTCTGACCTGCATTCTCTCCC | CTT | chr19 | 55116544 | 55116565 | 55116549 | 55116544 | - |
| SEQ ID NO 2837 | CTCTGACCTGCATTCTCTCCCC | TTT | chr19 | 55116543 | 55116564 | 55116548 | 55116543 | - |
| SEQ ID NO 2838 | TCTGACCTGCATTCTCTCCCCT | TTC | chr19 | 55116542 | 55116563 | 55116547 | 55116542 | - |
| SEQ ID NO 2839 | TGACCTGCATTCTCTCCCCTGG | CTC | chr19 | 55116540 | 55116561 | 55116545 | 55116540 | - |
| SEQ ID NO 2840 | ACCTGCATTCTCTCCCCTGGGC | CTG | chr19 | 55116538 | 55116559 | 55116543 | 55116538 | - |
| SEQ ID NO 2841 | CATTCTCTCCCCTGGGCCTGTG | CTG | chr19 | 55116533 | 55116554 | 55116538 | 55116533 | - |
| SEQ ID NO 2842 | TCTCCCCTGGGCCTGTGCCGCT | TTC | chr19 | 55116528 | 55116549 | 55116533 | 55116528 | - |
| SEQ ID NO 2843 | TCCCCTGGGCCTGTGCCGCTTT | CTC | chr19 | 55116526 | 55116547 | 55116531 | 55116526 | - |
| SEQ ID NO 2844 | CCCTGGGCCTGTGCCGCTTTCT | CTC | chr19 | 55116524 | 55116545 | 55116529 | 55116524 | - |
| SEQ ID NO 2845 | GGCCTGTGCCGCTTTCTGTCTG | CTG | chr19 | 55116519 | 55116540 | 55116524 | 55116519 | - |
| SEQ ID NO 2846 | TGCCGCTTTCTGTCTGCAGCTT | CTG | chr19 | 55116513 | 55116534 | 55116518 | 55116513 | - |
| SEQ ID NO 2847 | TCTGTCTGCAGCTTGTGGCCTG | CTT | chr19 | 55116505 | 55116526 | 55116510 | 55116505 | - |
| SEQ ID NO 2848 | CTGTCTGCAGCTTGTGGCCTGG | TTT | chr19 | 55116504 | 55116525 | 55116509 | 55116504 | - |
| SEQ ID NO 2849 | TGTCTGCAGCTTGTGGCCTGGG | TTC | chr19 | 55116503 | 55116524 | 55116508 | 55116503 | - |
| SEQ ID NO 2850 | TCTGCAGCTTGTGGCCTGGGTC | CTG | chr19 | 55116501 | 55116522 | 55116506 | 55116501 | - |
| SEQ ID NO 2851 | CAGCTTGTGGCCTGGGTCACCT | CTG | chr19 | 55116497 | 55116518 | 55116502 | 55116497 | - |
| SEQ ID NO 2852 | GTGGCCTGGGTCACCTCTACGG | CTT | chr19 | 55116491 | 55116512 | 55116496 | 55116491 | - |
| SEQ ID NO 2853 | TGGCCTGGGTCACCTCTACGGC | TTG | chr19 | 55116490 | 55116511 | 55116495 | 55116490 | - |
| SEQ ID NO 2854 | GGTCACCTCTACGGCTGGCCCA | CTG | chr19 | 55116483 | 55116504 | 55116488 | 55116483 | - |
| SEQ ID NO 2855 | TACGGCTGGCCCAGATCCTTCC | CTC | chr19 | 55116474 | 55116495 | 55116479 | 55116474 | - |
| SEQ ID NO 2856 | CGGCTGGCCCAGATCCTTCCCT | CTA | chr19 | 55116472 | 55116493 | 55116477 | 55116472 | - |
| SEQ ID NO 2857 | GCCCAGATCCTTCCCTGCCGCC | CTG | chr19 | 55116466 | 55116487 | 55116471 | 55116466 | - |
| SEQ ID NO 2858 | CCCTGCCGCCTCCTTCAGGTTC | CTT | chr19 | 55116454 | 55116475 | 55116459 | 55116454 | - |
| SEQ ID NO 2859 | CCTGCCGCCTCCTTCAGGTTCC | TTC | chr19 | 55116453 | 55116474 | 55116458 | 55116453 | - |
| SEQ ID NO 2860 | CCGCCTCCTTCAGGTTCCGTCT | CTG | chr19 | 55116449 | 55116470 | 55116454 | 55116449 | - |
| SEQ ID NO 2861 | CTTCAGGTTCCGTCTTCCTCCA | CTC | chr19 | 55116442 | 55116463 | 55116447 | 55116442 | - |
| SEQ ID NO 2862 | CAGGTTCCGTCTTCCTCCACTC | CTT | chr19 | 55116439 | 55116460 | 55116444 | 55116439 | - |
| SEQ ID NO 2863 | AGGTTCCGTCTTCCTCCACTCC | TTC | chr19 | 55116438 | 55116459 | 55116443 | 55116438 | - |
| SEQ ID NO 2864 | CGTCTTCCTCCACTCCCTCTTC | TTC | chr19 | 55116432 | 55116453 | 55116437 | 55116432 | - |
| SEQ ID NO 2865 | CCTCCACTCCCTCTTCCCCTTG | CTT | chr19 | 55116426 | 55116447 | 55116431 | 55116426 | - |
| SEQ ID NO 2866 | CTCCACTCCCTCTTCCCCTTGC | TTC | chr19 | 55116425 | 55116446 | 55116430 | 55116425 | - |
| SEQ ID NO 2867 | CACTCCCTCTTCCCCTTGCTCT | CTC | chr19 | 55116422 | 55116443 | 55116427 | 55116422 | - |
| SEQ ID NO 2868 | CCTCTTCCCCTTGCTCTCTGCT | CTC | chr19 | 55116417 | 55116438 | 55116422 | 55116417 | - |
| SEQ ID NO 2869 | TTCCCCTTGCTCTCTGCTGTGT | CTC | chr19 | 55116413 | 55116434 | 55116418 | 55116413 | - |
| SEQ ID NO 2870 | CCCCTTGCTCTCTGCTGTGTTG | CTT | chr19 | 55116411 | 55116432 | 55116416 | 55116411 | - |
| SEQ ID NO 2871 | CCCTTGCTCTCTGCTGTGTTGC | TTC | chr19 | 55116410 | 55116431 | 55116415 | 55116410 | - |
| SEQ ID NO 2872 | GCTCTCTGCTGTGTTGCTGCCC | CTT | chr19 | 55116405 | 55116426 | 55116410 | 55116405 | - |
| SEQ ID NO 2873 | CTCTCTGCTGTGTTGCTGCCCA | TTG | chr19 | 55116404 | 55116425 | 55116409 | 55116404 | - |
| SEQ ID NO 2874 | TCTGCTGTGTTGCTGCCCAAGG | CTC | chr19 | 55116401 | 55116422 | 55116406 | 55116401 | - |
| SEQ ID NO 2875 | TGCTGTGTTGCTGCCCAAGGAT | CTC | chr19 | 55116399 | 55116420 | 55116404 | 55116399 | - |
| SEQ ID NO 2876 | CTGTGTTGCTGCCCAAGGATGC | CTG | chr19 | 55116397 | 55116418 | 55116402 | 55116397 | - |
| SEQ ID NO 2877 | TGTTGCTGCCCAAGGATGCTCT | CTG | chr19 | 55116394 | 55116415 | 55116399 | 55116394 | - |
| SEQ ID NO 2878 | CTGCCCAAGGATGCTCTTTCCG | TTG | chr19 | 55116389 | 55116410 | 55116394 | 55116389 | - |
| SEQ ID NO 2879 | CCCAAGGATGCTCTTTCCGGAG | CTG | chr19 | 55116386 | 55116407 | 55116391 | 55116386 | - |
| SEQ ID NO 2880 | TTTCCGGAGCACTTCCTTCTCG | CTC | chr19 | 55116373 | 55116394 | 55116378 | 55116373 | - |
| SEQ ID NO 2881 | TCCGGAGCACTTCCTTCTCGGC | CTT | chr19 | 55116371 | 55116392 | 55116376 | 55116371 | - |
| SEQ ID NO 2882 | CCGGAGCACTTCCTTCTCGGCG | TTT | chr19 | 55116370 | 55116391 | 55116375 | 55116370 | - |
| SEQ ID NO 2883 | CGGAGCACTTCCTTCTCGGCGC | TTC | chr19 | 55116369 | 55116390 | 55116374 | 55116369 | - |
| SEQ ID NO 2884 | CCTTCTCGGCGCTGCACCACGT | CTT | chr19 | 55116359 | 55116380 | 55116364 | 55116359 | - |
| SEQ ID NO 2885 | CTTCTCGGCGCTGCACCACGTG | TTC | chr19 | 55116358 | 55116379 | 55116363 | 55116358 | - |
| SEQ ID NO 2886 | CTCGGCGCTGCACCACGTGATG | CTT | chr19 | 55116355 | 55116376 | 55116360 | 55116355 | - |
| SEQ ID NO 2887 | TCGGCGCTGCACCACGTGATGT | TTC | chr19 | 55116354 | 55116375 | 55116359 | 55116354 | - |
| SEQ ID NO 2888 | GGCGCTGCACCACGTGATGTCC | CTC | chr19 | 55116352 | 55116373 | 55116357 | 55116352 | - |
| SEQ ID NO 2889 | CACCACGTGATGTCCTCTGAGC | CTG | chr19 | 55116345 | 55116366 | 55116350 | 55116345 | - |
| SEQ ID NO 2890 | TGAGCGGATCCTCCCCGTGTCT | CTC | chr19 | 55116328 | 55116349 | 55116333 | 55116328 | - |
| SEQ ID NO 2891 | AGCGGATCCTCCCCGTGTCTGG | CTG | chr19 | 55116326 | 55116347 | 55116331 | 55116326 | - |
| SEQ ID NO 2892 | CCCGTGTCTGGGTCCTCTCCGG | CTC | chr19 | 55116315 | 55116336 | 55116320 | 55116315 | - |
| SEQ ID NO 2893 | GGTCCTCTCCGGGCATCTCTCC | CTG | chr19 | 55116305 | 55116326 | 55116310 | 55116305 | - |
| SEQ ID NO 2894 | TCCGGGCATCTCTCCTCCCTCA | CTC | chr19 | 55116298 | 55116319 | 55116303 | 55116298 | - |

Figure 6 (Cont'd)

| | | | | | | | | |
|---|---|---|---|---|---|---|---|---|
| SEQ ID NO 2895 | CGGGCATCTCTCCTCCCTCACC | CTC | chr19 | 55116296 | 55116317 | 55116301 | 55116296 | - |
| SEQ ID NO 2896 | TCCTCCCTCACCCAACCCCATG | CTC | chr19 | 55116286 | 55116307 | 55116291 | 55116286 | - |
| SEQ ID NO 2897 | CTCCCTCACCCAACCCCATGCC | CTC | chr19 | 55116284 | 55116305 | 55116289 | 55116284 | - |
| SEQ ID NO 2898 | CCTCACCCAACCCCATGCCGTC | CTC | chr19 | 55116281 | 55116302 | 55116286 | 55116281 | - |
| SEQ ID NO 2899 | ACCCAACCCCATGCCGTCTTCA | CTC | chr19 | 55116277 | 55116298 | 55116282 | 55116277 | - |
| SEQ ID NO 2900 | CACTCGCTGGGTTCCCTTTTCC | CTT | chr19 | 55116257 | 55116278 | 55116262 | 55116257 | - |
| SEQ ID NO 2901 | ACTCGCTGGGTTCCCTTTTCCT | TTC | chr19 | 55116256 | 55116277 | 55116261 | 55116256 | - |
| SEQ ID NO 2902 | GCTGGGTTCCCTTTTCCTTCTC | CTC | chr19 | 55116252 | 55116273 | 55116257 | 55116252 | - |
| SEQ ID NO 2903 | GGTTCCCTTTTCCTTCTCCTTC | CTG | chr19 | 55116248 | 55116269 | 55116253 | 55116248 | - |
| SEQ ID NO 2904 | CCTTTTCCTTCTCCTTCTGGGG | TTC | chr19 | 55116243 | 55116264 | 55116248 | 55116243 | - |
| SEQ ID NO 2905 | TTCCTTCTCCTTCTGGGGCCTG | CTT | chr19 | 55116239 | 55116260 | 55116244 | 55116239 | - |
| SEQ ID NO 2906 | TCCTTCTCCTTCTGGGGCCTGT | TTT | chr19 | 55116238 | 55116259 | 55116243 | 55116238 | - |
| SEQ ID NO 2907 | CCTTCTCCTTCTGGGGCCTGTG | TTT | chr19 | 55116237 | 55116258 | 55116242 | 55116237 | - |
| SEQ ID NO 2908 | CTTCTCCTTCTGGGGCCTGTGC | TTC | chr19 | 55116236 | 55116257 | 55116241 | 55116236 | - |
| SEQ ID NO 2909 | CTCCTTCTGGGGCCTGTGCCAT | CTT | chr19 | 55116233 | 55116254 | 55116238 | 55116233 | - |
| SEQ ID NO 2910 | TCCTTCTGGGGCCTGTGCCATC | TTC | chr19 | 55116232 | 55116253 | 55116237 | 55116232 | - |
| SEQ ID NO 2911 | CTTCTGGGGCCTGTGCCATCTC | CTC | chr19 | 55116230 | 55116251 | 55116235 | 55116230 | - |
| SEQ ID NO 2912 | CTGGGGCCTGTGCCATCTCTCG | CTT | chr19 | 55116227 | 55116248 | 55116232 | 55116227 | - |
| SEQ ID NO 2913 | TGGGGCCTGTGCCATCTCTCGT | TTC | chr19 | 55116226 | 55116247 | 55116231 | 55116226 | - |
| SEQ ID NO 2914 | GGGCCTGTGCCATCTCTCGTTT | CTG | chr19 | 55116224 | 55116245 | 55116229 | 55116224 | - |
| SEQ ID NO 2915 | TGCCATCTCTCGTTTCTTAGGA | CTG | chr19 | 55116217 | 55116238 | 55116222 | 55116217 | - |
| SEQ ID NO 2916 | TCGTTTCTTAGGATGGCCTTCT | CTC | chr19 | 55116208 | 55116229 | 55116213 | 55116208 | - |
| SEQ ID NO 2917 | GTTTCTTAGGATGGCCTTCTCC | CTC | chr19 | 55116206 | 55116227 | 55116211 | 55116206 | - |
| SEQ ID NO 2918 | CTTAGGATGGCCTTCTCCGACG | TTT | chr19 | 55116202 | 55116223 | 55116207 | 55116202 | - |
| SEQ ID NO 2919 | TTAGGATGGCCTTCTCCGACGG | TTC | chr19 | 55116201 | 55116222 | 55116206 | 55116201 | - |
| SEQ ID NO 2920 | AGGATGGCCTTCTCCGACGGAT | CTT | chr19 | 55116199 | 55116220 | 55116204 | 55116199 | - |
| SEQ ID NO 2921 | GGATGGCCTTCTCCGACGGATG | TTA | chr19 | 55116198 | 55116219 | 55116203 | 55116198 | - |
| SEQ ID NO 2922 | CTCCGACGGATGTCTCCCTTGC | CTT | chr19 | 55116188 | 55116209 | 55116193 | 55116188 | - |
| SEQ ID NO 2923 | TCCGACGGATGTCTCCCTTGCG | TTC | chr19 | 55116187 | 55116208 | 55116192 | 55116187 | - |
| SEQ ID NO 2924 | CGACGGATGTCTCCCTTGCGTC | CTC | chr19 | 55116185 | 55116206 | 55116190 | 55116185 | - |
| SEQ ID NO 2925 | CCTTGCGTCCGCCTCCCCTTC | CTC | chr19 | 55116172 | 55116193 | 55116177 | 55116172 | - |
| SEQ ID NO 2926 | GCGTCCGCCTCCCCTTCTTGT | CTT | chr19 | 55116168 | 55116189 | 55116173 | 55116168 | - |
| SEQ ID NO 2927 | CGTCCCGCCTCCCCTTCTTGTA | TTG | chr19 | 55116167 | 55116188 | 55116172 | 55116167 | - |
| SEQ ID NO 2928 | CCCTTCTTGTAGGCCTGCATCA | CTC | chr19 | 55116156 | 55116177 | 55116161 | 55116156 | - |
| SEQ ID NO 2929 | CTTGTAGGCCTGCATCATCACC | CTT | chr19 | 55116151 | 55116172 | 55116156 | 55116151 | - |
| SEQ ID NO 2930 | TTGTAGGCCTGCATCATCACCG | TTC | chr19 | 55116150 | 55116171 | 55116155 | 55116150 | - |
| SEQ ID NO 2931 | GTAGGCCTGCATCATCACCGTT | CTT | chr19 | 55116148 | 55116169 | 55116153 | 55116148 | - |
| SEQ ID NO 2932 | TAGGCCTGCATCATCACCGTTT | TTG | chr19 | 55116147 | 55116168 | 55116152 | 55116147 | - |
| SEQ ID NO 2933 | CATCATCACCGTTTTTCTGGAC | CTG | chr19 | 55116139 | 55116160 | 55116144 | 55116139 | - |
| SEQ ID NO 2934 | TTCTGGACAACCCCAAAGTACC | TTT | chr19 | 55116125 | 55116146 | 55116130 | 55116125 | - |
| SEQ ID NO 2935 | TCTGGACAACCCCAAAGTACCC | TTT | chr19 | 55116124 | 55116145 | 55116129 | 55116124 | - |
| SEQ ID NO 2936 | CTGGACAACCCCAAAGTACCCC | TTT | chr19 | 55116123 | 55116144 | 55116128 | 55116123 | - |
| SEQ ID NO 2937 | TGGACAACCCCAAAGTACCCCG | TTC | chr19 | 55116122 | 55116143 | 55116127 | 55116122 | - |
| SEQ ID NO 2938 | GACAACCCCAAAGTACCCCGTC | CTG | chr19 | 55116120 | 55116141 | 55116125 | 55116120 | - |
| SEQ ID NO 2939 | CCTGGCTTTAGCCACCTCTCCA | CTC | chr19 | 55116096 | 55116117 | 55116101 | 55116096 | - |
| SEQ ID NO 2940 | GCTTTAGCCACCTCTCCATCCT | CTG | chr19 | 55116092 | 55116113 | 55116097 | 55116092 | - |
| SEQ ID NO 2941 | TAGCCACCTCTCCATCCTCTTG | CTT | chr19 | 55116088 | 55116109 | 55116093 | 55116088 | - |
| SEQ ID NO 2942 | AGCCACCTCTCCATCCTCTTGC | TTT | chr19 | 55116087 | 55116108 | 55116092 | 55116087 | - |
| SEQ ID NO 2943 | GCCACCTCTCCATCCTCTTGCT | TTA | chr19 | 55116086 | 55116107 | 55116091 | 55116086 | - |
| SEQ ID NO 2944 | TCCATCCTCTTGCTTTCTTTGC | CTC | chr19 | 55116078 | 55116099 | 55116083 | 55116078 | - |
| SEQ ID NO 2945 | CATCCTCTTGCTTTCTTTGCCT | CTC | chr19 | 55116076 | 55116097 | 55116081 | 55116076 | - |
| SEQ ID NO 2946 | TTGCTTTCTTTGCCTGGACACC | CTC | chr19 | 55116069 | 55116090 | 55116074 | 55116069 | - |
| SEQ ID NO 2947 | GCTTTCTTTGCCTGGACACCCC | CTT | chr19 | 55116067 | 55116088 | 55116072 | 55116067 | - |
| SEQ ID NO 2948 | CTTTCTTTGCCTGGACACCCCG | TTG | chr19 | 55116066 | 55116087 | 55116071 | 55116066 | - |
| SEQ ID NO 2949 | TCTTTGCCTGGACACCCCGTTC | CTT | chr19 | 55116063 | 55116084 | 55116068 | 55116063 | - |
| SEQ ID NO 2950 | CTTTGCCTGGACACCCCGTTCT | TTT | chr19 | 55116062 | 55116083 | 55116067 | 55116062 | - |
| SEQ ID NO 2951 | TTTGCCTGGACACCCCGTTCTC | TTC | chr19 | 55116061 | 55116082 | 55116066 | 55116061 | - |
| SEQ ID NO 2952 | TGCCTGGACACCCCGTTCTCCT | CTT | chr19 | 55116059 | 55116080 | 55116064 | 55116059 | - |
| SEQ ID NO 2953 | GCCTGGACACCCCGTTCTCCTG | TTT | chr19 | 55116058 | 55116079 | 55116063 | 55116058 | - |

Figure 6 (Cont'd)

| SEQ ID NO 2954 | CCTGGACACCCCGTTCTCCTGT | TTG | chr19 | 55116057 | 55116078 | 55116062 | 55116057 | - |
|---|---|---|---|---|---|---|---|---|
| SEQ ID NO 2955 | GACACCCCGTTCTCCTGTGGAT | CTG | chr19 | 55116053 | 55116074 | 55116058 | 55116053 | - |
| SEQ ID NO 2956 | TCCTGTGGATTCGGGTCACCTC | TTC | chr19 | 55116041 | 55116062 | 55116046 | 55116041 | - |
| SEQ ID NO 2957 | CTGTGGATTCGGGTCACCTCTC | CTC | chr19 | 55116039 | 55116060 | 55116044 | 55116039 | - |
| SEQ ID NO 2958 | TGGATTCGGGTCACCTCTCACT | CTG | chr19 | 55116036 | 55116057 | 55116041 | 55116036 | - |
| SEQ ID NO 2959 | GGGTCACCTCTCACTCCTTTCA | TTC | chr19 | 55116029 | 55116050 | 55116034 | 55116029 | - |
| SEQ ID NO 2960 | TCACTCCTTTCATTTGGGCAGC | CTC | chr19 | 55116019 | 55116040 | 55116024 | 55116019 | - |
| SEQ ID NO 2961 | ACTCCTTTCATTTGGGCAGCTC | CTC | chr19 | 55116017 | 55116038 | 55116022 | 55116017 | - |
| SEQ ID NO 2962 | CTTTCATTTGGGCAGCTCCCCT | CTC | chr19 | 55116013 | 55116034 | 55116018 | 55116013 | - |
| SEQ ID NO 2963 | TCATTTGGGCAGCTCCCCTACC | CTT | chr19 | 55116010 | 55116031 | 55116015 | 55116010 | - |
| SEQ ID NO 2964 | CATTTGGGCAGCTCCCCTACCC | TTT | chr19 | 55116009 | 55116030 | 55116014 | 55116009 | - |
| SEQ ID NO 2965 | ATTTGGGCAGCTCCCCTACCCC | TTC | chr19 | 55116008 | 55116029 | 55116013 | 55116008 | - |
| SEQ ID NO 2966 | GGGCAGCTCCCCTACCCCCCTT | TTT | chr19 | 55116004 | 55116025 | 55116009 | 55116004 | - |
| SEQ ID NO 2967 | GGCAGCTCCCCTACCCCCCTTA | TTG | chr19 | 55116003 | 55116024 | 55116008 | 55116003 | - |
| SEQ ID NO 2968 | CCCTACCCCCCTTACCTCTCTA | CTC | chr19 | 55115995 | 55116016 | 55116000 | 55115995 | - |
| SEQ ID NO 2969 | CCCCCCTTACCTCTCTAGTCTG | CTA | chr19 | 55115990 | 55116011 | 55115995 | 55115990 | - |
| SEQ ID NO 2970 | ACCTCTCTAGTCTGTGCTAGCT | CTT | chr19 | 55115982 | 55116003 | 55115987 | 55115982 | - |
| SEQ ID NO 2971 | CCTCTCTAGTCTGTGCTAGCTC | TTA | chr19 | 55115981 | 55116002 | 55115986 | 55115981 | - |
| SEQ ID NO 2972 | TCTAGTCTGTGCTAGCTCTTCC | CTC | chr19 | 55115977 | 55115998 | 55115982 | 55115977 | - |
| SEQ ID NO 2973 | TAGTCTGTGCTAGCTCTTCCAG | CTC | chr19 | 55115975 | 55115996 | 55115980 | 55115975 | - |
| SEQ ID NO 2974 | GTCTGTGCTAGCTCTTCCAGCC | CTA | chr19 | 55115973 | 55115994 | 55115978 | 55115973 | - |
| SEQ ID NO 2975 | TGCTAGCTCTTCCAGCCCCCTG | CTG | chr19 | 55115968 | 55115989 | 55115973 | 55115968 | - |
| SEQ ID NO 2976 | GCTCTTCCAGCCCCCTGTCATG | CTA | chr19 | 55115963 | 55115984 | 55115968 | 55115963 | - |
| SEQ ID NO 2977 | TTCCAGCCCCCTGTCATGGCAT | CTC | chr19 | 55115959 | 55115980 | 55115964 | 55115959 | - |
| SEQ ID NO 2978 | CCAGCCCCCTGTCATGGCATCT | CTT | chr19 | 55115957 | 55115978 | 55115962 | 55115957 | - |
| SEQ ID NO 2979 | CAGCCCCCTGTCATGGCATCTT | TTC | chr19 | 55115956 | 55115977 | 55115961 | 55115956 | - |
| SEQ ID NO 2980 | TCATGGCATCTTCCAGGGGTCC | CTG | chr19 | 55115946 | 55115967 | 55115951 | 55115946 | - |
| SEQ ID NO 2981 | CCAGGGGTCCGAGAGCTCAGCT | CTT | chr19 | 55115934 | 55115955 | 55115939 | 55115934 | - |
| SEQ ID NO 2982 | CAGGGGTCCGAGAGCTCAGCTA | TTC | chr19 | 55115933 | 55115954 | 55115938 | 55115933 | - |
| SEQ ID NO 2983 | AGCTAGTCTTCTTCCTCCAACC | CTC | chr19 | 55115916 | 55115937 | 55115921 | 55115916 | - |
| SEQ ID NO 2984 | GTCTTCTTCCTCCAACCCGGGC | CTA | chr19 | 55115911 | 55115932 | 55115916 | 55115911 | - |
| SEQ ID NO 2985 | CTTCCTCCAACCCGGGCCCCTA | CTT | chr19 | 55115906 | 55115927 | 55115911 | 55115906 | - |
| SEQ ID NO 2986 | TTCCTCCAACCCGGGCCCCTAT | TTC | chr19 | 55115905 | 55115926 | 55115910 | 55115905 | - |
| SEQ ID NO 2987 | CCTCCAACCCGGGCCCCTATGT | CTT | chr19 | 55115903 | 55115924 | 55115908 | 55115903 | - |
| SEQ ID NO 2988 | CTCCAACCCGGGCCCCTATGTC | TTC | chr19 | 55115902 | 55115923 | 55115907 | 55115902 | - |
| SEQ ID NO 2989 | CAACCCGGGCCCCTATGTCCAC | CTC | chr19 | 55115899 | 55115920 | 55115904 | 55115899 | - |
| SEQ ID NO 2990 | TGTCCACTTCAGGACAGCATGT | CTA | chr19 | 55115884 | 55115905 | 55115889 | 55115884 | - |
| SEQ ID NO 2991 | CAGGACAGCATGTTTGCTGCCT | CTT | chr19 | 55115875 | 55115896 | 55115880 | 55115875 | - |
| SEQ ID NO 2992 | AGGACAGCATGTTTGCTGCCTC | TTC | chr19 | 55115874 | 55115895 | 55115879 | 55115874 | - |
| SEQ ID NO 2993 | GCTGCCTCCAGGGATCCTGTGT | TTT | chr19 | 55115860 | 55115881 | 55115865 | 55115860 | - |
| SEQ ID NO 2994 | CTGCCTCCAGGGATCCTGTGTC | TTG | chr19 | 55115859 | 55115880 | 55115864 | 55115859 | - |
| SEQ ID NO 2995 | CCTCCAGGGATCCTGTGTCCCC | CTG | chr19 | 55115856 | 55115877 | 55115861 | 55115856 | - |
| SEQ ID NO 2996 | CAGGGATCCTGTGTCCCGAGC | CTC | chr19 | 55115852 | 55115873 | 55115857 | 55115852 | - |
| SEQ ID NO 2997 | TGTCCCCGAGCTGGGACCACCT | CTG | chr19 | 55115841 | 55115862 | 55115846 | 55115841 | - |
| SEQ ID NO 2998 | GGACCACCTTATATTCCCAGGG | CTG | chr19 | 55115828 | 55115849 | 55115833 | 55115828 | - |
| SEQ ID NO 2999 | ATATTCCCAGGGCCGGTTAATG | CTT | chr19 | 55115818 | 55115839 | 55115823 | 55115818 | - |
| SEQ ID NO 3000 | TATTCCCAGGGCCGGTTAATGT | TTA | chr19 | 55115817 | 55115838 | 55115822 | 55115817 | - |
| SEQ ID NO 3001 | CCAGGGCCGGTTAATGTGGCTC | TTC | chr19 | 55115812 | 55115833 | 55115817 | 55115812 | - |
| SEQ ID NO 3002 | ATGTGGCTCTGGTTCTGGGTAC | TTA | chr19 | 55115799 | 55115820 | 55115804 | 55115799 | - |
| SEQ ID NO 3003 | TGGTTCTGGGTACTTTTATCTG | CTC | chr19 | 55115790 | 55115811 | 55115795 | 55115790 | - |
| SEQ ID NO 3004 | GTTCTGGGTACTTTTATCTGTC | CTG | chr19 | 55115788 | 55115809 | 55115793 | 55115788 | - |
| SEQ ID NO 3005 | TGGGTACTTTTATCTGTCCCCT | TTC | chr19 | 55115784 | 55115805 | 55115789 | 55115784 | - |
| SEQ ID NO 3006 | GGTACTTTTATCTGTCCCCTCC | CTG | chr19 | 55115782 | 55115803 | 55115787 | 55115782 | - |
| SEQ ID NO 3007 | TTATCTGTCCCCTCCACCCCAC | CTT | chr19 | 55115775 | 55115796 | 55115780 | 55115775 | - |
| SEQ ID NO 3008 | TATCTGTCCCCTCCACCCCACA | TTT | chr19 | 55115774 | 55115795 | 55115779 | 55115774 | - |
| SEQ ID NO 3009 | ATCTGTCCCCTCCACCCCACAG | TTT | chr19 | 55115773 | 55115794 | 55115778 | 55115773 | - |
| SEQ ID NO 3010 | TCTGTCCCCTCCACCCCACAGT | TTA | chr19 | 55115772 | 55115793 | 55115777 | 55115772 | - |
| SEQ ID NO 3011 | TCCCCTCCACCCCACAGTGGGG | CTG | chr19 | 55115768 | 55115789 | 55115773 | 55115768 | - |
| SEQ ID NO 3012 | CACCCCACAGTGGGGCCACTAG | CTC | chr19 | 55115761 | 55115782 | 55115766 | 55115761 | - |

Figure 6 (Cont'd)

| | | | | | | | | |
|---|---|---|---|---|---|---|---|---|
| SEQ ID NO 3013 | GGGACAGGATTGGTGACAGAAA | CTA | chr19 | 55115740 | 55115761 | 55115745 | 55115740 | - |
| SEQ ID NO 3014 | GTGACAGAAAAGCCCCATCCTT | TTG | chr19 | 55115728 | 55115749 | 55115733 | 55115728 | - |
| SEQ ID NO 3015 | AGGCCTCCTCCTTCCTAGTCTC | CTT | chr19 | 55115706 | 55115727 | 55115711 | 55115706 | - |
| SEQ ID NO 3016 | GGCCTCCTCCTTCCTAGTCTCC | TTA | chr19 | 55115705 | 55115726 | 55115710 | 55115705 | - |
| SEQ ID NO 3017 | CTCCTTCCTAGTCTCCTGATAT | CTC | chr19 | 55115699 | 55115720 | 55115704 | 55115699 | - |
| SEQ ID NO 3018 | CTTCCTAGTCTCCTGATATTGG | CTC | chr19 | 55115696 | 55115717 | 55115701 | 55115696 | - |
| SEQ ID NO 3019 | CCTAGTCTCCTGATATTGGGTC | CTT | chr19 | 55115693 | 55115714 | 55115698 | 55115693 | - |
| SEQ ID NO 3020 | CTAGTCTCCTGATATTGGGTCT | TTC | chr19 | 55115692 | 55115713 | 55115697 | 55115692 | - |
| SEQ ID NO 3021 | GTCTCCTGATATTGGGTCTAAC | CTA | chr19 | 55115689 | 55115710 | 55115694 | 55115689 | - |
| SEQ ID NO 3022 | CTGATATTGGGTCTAACCCCCA | CTC | chr19 | 55115684 | 55115705 | 55115689 | 55115684 | - |
| SEQ ID NO 3023 | ATATTGGGTCTAACCCCCACCT | CTG | chr19 | 55115681 | 55115702 | 55115686 | 55115681 | - |
| SEQ ID NO 3024 | GGTCTAACCCCCACCTCCTGTT | TTG | chr19 | 55115675 | 55115696 | 55115680 | 55115675 | - |
| SEQ ID NO 3025 | ACCCCCACCTCCTGTTAGGCAG | CTA | chr19 | 55115669 | 55115690 | 55115674 | 55115669 | - |
| SEQ ID NO 3026 | CTGTTAGGCAGATTCCTTATCT | CTC | chr19 | 55115658 | 55115679 | 55115663 | 55115658 | - |
| SEQ ID NO 3027 | TTAGGCAGATTCCTTATCTGGT | CTG | chr19 | 55115655 | 55115676 | 55115660 | 55115655 | - |
| SEQ ID NO 3028 | GGCAGATTCCTTATCTGGTGAC | TTA | chr19 | 55115652 | 55115673 | 55115657 | 55115652 | - |
| SEQ ID NO 3029 | CTTATCTGGTGACACACCCCCA | TTC | chr19 | 55115643 | 55115664 | 55115648 | 55115643 | - |
| SEQ ID NO 3030 | ATCTGGTGACACACCCCCATTT | CTT | chr19 | 55115640 | 55115661 | 55115645 | 55115640 | - |
| SEQ ID NO 3031 | TCTGGTGACACACCCCCATTTC | TTA | chr19 | 55115639 | 55115660 | 55115644 | 55115639 | - |
| SEQ ID NO 3032 | GTGACACACCCCCATTTCCTGG | CTG | chr19 | 55115635 | 55115656 | 55115640 | 55115635 | - |
| SEQ ID NO 3033 | CCTGGAGCCATCTCTCTCCTTG | TTT | chr19 | 55115618 | 55115639 | 55115623 | 55115618 | - |
| SEQ ID NO 3034 | CTGGAGCCATCTCTCTCCTTGC | TTC | chr19 | 55115617 | 55115638 | 55115622 | 55115617 | - |
| SEQ ID NO 3035 | GAGCCATCTCTCTCCTTGCCAG | CTG | chr19 | 55115614 | 55115635 | 55115619 | 55115614 | - |
| SEQ ID NO 3036 | TCTCCTTGCCAGAACCTCTAAG | CTC | chr19 | 55115604 | 55115625 | 55115609 | 55115604 | - |
| SEQ ID NO 3037 | TCCTTGCCAGAACCTCTAAGGT | CTC | chr19 | 55115602 | 55115623 | 55115607 | 55115602 | - |
| SEQ ID NO 3038 | CTTGCCAGAACCTCTAAGGTTT | CTC | chr19 | 55115600 | 55115621 | 55115605 | 55115600 | - |
| SEQ ID NO 3039 | GCCAGAACCTCTAAGGTTTGCT | CTT | chr19 | 55115597 | 55115618 | 55115602 | 55115597 | - |
| SEQ ID NO 3040 | CCAGAACCTCTAAGGTTTGCTT | TTG | chr19 | 55115596 | 55115617 | 55115601 | 55115596 | - |
| SEQ ID NO 3041 | TAAGGTTTGCTTACGATGGAGC | CTC | chr19 | 55115586 | 55115607 | 55115591 | 55115586 | - |
| SEQ ID NO 3042 | AGGTTTGCTTACGATGGAGCCA | CTA | chr19 | 55115584 | 55115605 | 55115589 | 55115584 | - |
| SEQ ID NO 3043 | GCTTACGATGGAGCCAGAGAGG | TTT | chr19 | 55115578 | 55115599 | 55115583 | 55115578 | - |
| SEQ ID NO 3044 | CTTACGATGGAGCCAGAGAGGA | TTG | chr19 | 55115577 | 55115598 | 55115582 | 55115577 | - |
| SEQ ID NO 3045 | ACGATGGAGCCAGAGAGGATCC | CTT | chr19 | 55115574 | 55115595 | 55115579 | 55115574 | - |
| SEQ ID NO 3046 | CGATGGAGCCAGAGAGGATCCT | TTA | chr19 | 55115573 | 55115594 | 55115578 | 55115573 | - |
| SEQ ID NO 3047 | GGAGGGAGAGCTTGGCAGGGGG | CTG | chr19 | 55115550 | 55115571 | 55115555 | 55115550 | - |
| SEQ ID NO 3048 | GGCAGGGGGTGGGAGGGAAGGG | CTT | chr19 | 55115537 | 55115558 | 55115542 | 55115537 | - |
| SEQ ID NO 3049 | GCAGGGGGTGGGAGGGAAGGGG | TTG | chr19 | 55115536 | 55115557 | 55115541 | 55115536 | - |
| SEQ ID NO 3050 | CCCGGTTCTCAGTGGCCACCCT | CTG | chr19 | 55115499 | 55115520 | 55115504 | 55115499 | - |
| SEQ ID NO 3051 | TCAGTGGCCACCCTGCGCTACC | TTC | chr19 | 55115491 | 55115512 | 55115496 | 55115491 | - |
| SEQ ID NO 3052 | AGTGGCCACCCTGCGCTACCCT | CTC | chr19 | 55115489 | 55115510 | 55115494 | 55115489 | - |
| SEQ ID NO 3053 | CGCTACCCTCTCCCAGAACCTG | CTG | chr19 | 55115476 | 55115497 | 55115481 | 55115476 | - |
| SEQ ID NO 3054 | CCCTCTCCCAGAACCTGAGCTG | CTA | chr19 | 55115471 | 55115492 | 55115476 | 55115471 | - |
| SEQ ID NO 3055 | TCCCAGAACCTGAGCTGCTCTG | CTC | chr19 | 55115466 | 55115487 | 55115471 | 55115466 | - |
| SEQ ID NO 3056 | CCAGAACCTGAGCTGCTCTGAC | CTC | chr19 | 55115464 | 55115485 | 55115469 | 55115464 | - |
| SEQ ID NO 3057 | AGCTGCTCTGACGCGGCCGTCT | CTG | chr19 | 55115454 | 55115475 | 55115459 | 55115454 | - |
| SEQ ID NO 3058 | CTCTGACGCGGCCGTCTGGTGC | CTG | chr19 | 55115449 | 55115470 | 55115454 | 55115449 | - |
| SEQ ID NO 3059 | TGACGCGGCCGTCTGGTGCGTT | CTC | chr19 | 55115446 | 55115467 | 55115451 | 55115446 | - |
| SEQ ID NO 3060 | ACGCGGCCGTCTGGTGCGTTTC | CTG | chr19 | 55115444 | 55115465 | 55115449 | 55115444 | - |
| SEQ ID NO 3061 | GTGCGTTTCACTGATCCTGGTG | CTG | chr19 | 55115431 | 55115452 | 55115436 | 55115431 | - |
| SEQ ID NO 3062 | CACTGATCCTGGTGCTGCAGCT | TTT | chr19 | 55115423 | 55115444 | 55115428 | 55115423 | - |
| SEQ ID NO 3063 | ACTGATCCTGGTGCTGCAGCTT | TTC | chr19 | 55115422 | 55115443 | 55115427 | 55115422 | - |
| SEQ ID NO 3064 | ATCCTGGTGCTGCAGCTTCCTT | CTG | chr19 | 55115418 | 55115439 | 55115423 | 55115418 | - |
| SEQ ID NO 3065 | GTGCTGCAGCTTCCTTACACTT | CTG | chr19 | 55115412 | 55115433 | 55115417 | 55115412 | - |
| SEQ ID NO 3066 | CAGCTTCCTTACACTTCCCAAG | CTG | chr19 | 55115406 | 55115427 | 55115411 | 55115406 | - |
| SEQ ID NO 3067 | CCTTACACTTCCCAAGAGGAGA | CTT | chr19 | 55115400 | 55115421 | 55115405 | 55115400 | - |
| SEQ ID NO 3068 | CTTACACTTCCCAAGAGGAGAA | TTC | chr19 | 55115399 | 55115420 | 55115404 | 55115399 | - |
| SEQ ID NO 3069 | ACACTTCCCAAGAGGAGAAGCA | CTT | chr19 | 55115396 | 55115417 | 55115401 | 55115396 | - |
| SEQ ID NO 3070 | CACTTCCCAAGAGGAGAAGCAG | TTA | chr19 | 55115395 | 55115416 | 55115400 | 55115395 | - |
| SEQ ID NO 3071 | CCCAAGAGGAGAAGCAGTTTGG | CTT | chr19 | 55115390 | 55115411 | 55115395 | 55115390 | - |

Figure 6 (Cont'd)

| SEQ ID NO 3072 | CCAAGAGGAGAAGCAGTTTGGA | TTC | chr19 | 55115389 | 55115410 | 55115394 | 55115389 | - |
| SEQ ID NO 3073 | GGAAAAACAAAATCAGAATAAG | TTT | chr19 | 55115370 | 55115391 | 55115375 | 55115370 | - |
| SEQ ID NO 3074 | GAAAAACAAAATCAGAATAAGT | TTG | chr19 | 55115369 | 55115390 | 55115374 | 55115369 | - |
| SEQ ID NO 3075 | GTCCTGAGTTCTAACTTTGGCT | TTG | chr19 | 55115345 | 55115366 | 55115350 | 55115345 | - |
| SEQ ID NO 3076 | AGTTCTAACTTTGGCTCTTCAC | CTG | chr19 | 55115339 | 55115360 | 55115344 | 55115339 | - |
| SEQ ID NO 3077 | TAACTTTGGCTCTTCACCTTTC | TTC | chr19 | 55115334 | 55115355 | 55115339 | 55115334 | - |
| SEQ ID NO 3078 | ACTTTGGCTCTTCACCTTTCTA | CTA | chr19 | 55115332 | 55115353 | 55115337 | 55115332 | - |
| SEQ ID NO 3079 | TGGCTCTTCACCTTTCTAGTCC | CTT | chr19 | 55115328 | 55115349 | 55115333 | 55115328 | - |
| SEQ ID NO 3080 | GGCTCTTCACCTTTCTAGTCCC | TTT | chr19 | 55115327 | 55115348 | 55115332 | 55115327 | - |
| SEQ ID NO 3081 | GCTCTTCACCTTTCTAGTCCCC | TTG | chr19 | 55115326 | 55115347 | 55115331 | 55115326 | - |
| SEQ ID NO 3082 | TTCACCTTTCTAGTCCCCAATT | CTC | chr19 | 55115322 | 55115343 | 55115327 | 55115322 | - |
| SEQ ID NO 3083 | CACCTTTCTAGTCCCCAATTTA | CTT | chr19 | 55115320 | 55115341 | 55115325 | 55115320 | - |
| SEQ ID NO 3084 | ACCTTTCTAGTCCCCAATTTAT | TTC | chr19 | 55115319 | 55115340 | 55115324 | 55115319 | - |
| SEQ ID NO 3085 | TCTAGTCCCCAATTTATATTGT | CTT | chr19 | 55115314 | 55115335 | 55115319 | 55115314 | - |
| SEQ ID NO 3086 | CTAGTCCCCAATTTATATTGTT | TTT | chr19 | 55115313 | 55115334 | 55115318 | 55115313 | - |
| SEQ ID NO 3087 | TAGTCCCCAATTTATATTGTTC | TTC | chr19 | 55115312 | 55115333 | 55115317 | 55115312 | - |
| SEQ ID NO 3088 | GTCCCCAATTTATATTGTTCCT | CTA | chr19 | 55115310 | 55115331 | 55115315 | 55115310 | - |
| SEQ ID NO 3089 | ATATTGTTCCTCCGTGCGTCAG | TTT | chr19 | 55115299 | 55115320 | 55115304 | 55115299 | - |
| SEQ ID NO 3090 | TATTGTTCCTCCGTGCGTCAGT | TTA | chr19 | 55115298 | 55115319 | 55115303 | 55115298 | - |
| SEQ ID NO 3091 | TTCCTCCGTGCGTCAGTTTTAC | TTG | chr19 | 55115293 | 55115314 | 55115298 | 55115293 | - |
| SEQ ID NO 3092 | CTCCGTGCGTCAGTTTTACCTG | TTC | chr19 | 55115290 | 55115311 | 55115295 | 55115290 | - |
| SEQ ID NO 3093 | CGTGCGTCAGTTTTACCTGTGA | CTC | chr19 | 55115287 | 55115308 | 55115292 | 55115287 | - |
| SEQ ID NO 3094 | TACCTGTGAGATAAGGCCAGTA | TTT | chr19 | 55115274 | 55115295 | 55115279 | 55115274 | - |
| SEQ ID NO 3095 | ACCTGTGAGATAAGGCCAGTAG | TTT | chr19 | 55115273 | 55115294 | 55115278 | 55115273 | - |
| SEQ ID NO 3096 | CCTGTGAGATAAGGCCAGTAGC | TTA | chr19 | 55115272 | 55115293 | 55115277 | 55115272 | - |
| SEQ ID NO 3097 | TGAGATAAGGCCAGTAGCCAGC | CTG | chr19 | 55115268 | 55115289 | 55115273 | 55115268 | - |
| SEQ ID NO 3098 | GCAGGGCTGTGGTGAGGAGGGG | CTG | chr19 | 55115237 | 55115258 | 55115242 | 55115237 | - |
| SEQ ID NO 3099 | TGGTGAGGAGGGGGTGTCCGT | CTG | chr19 | 55115228 | 55115249 | 55115233 | 55115228 | - |
| SEQ ID NO 3100 | CCTTTGTGAGAATGGTGCGTCC | CTC | chr19 | 55115195 | 55115216 | 55115200 | 55115195 | - |
| SEQ ID NO 3101 | TGTGAGAATGGTGCGTCCTAGG | CTT | chr19 | 55115191 | 55115212 | 55115196 | 55115191 | - |
| SEQ ID NO 3102 | GTGAGAATGGTGCGTCCTAGGT | TTT | chr19 | 55115190 | 55115211 | 55115195 | 55115190 | - |
| SEQ ID NO 3103 | TGAGAATGGTGCGTCCTAGGTG | TTG | chr19 | 55115189 | 55115210 | 55115194 | 55115189 | - |
| SEQ ID NO 3104 | GGTGTTCACCAGGTCGTGGCCG | CTA | chr19 | 55115171 | 55115192 | 55115176 | 55115171 | - |
| SEQ ID NO 3105 | ACCAGGTCGTGGCCGCCTCTAC | TTC | chr19 | 55115164 | 55115185 | 55115169 | 55115164 | - |
| SEQ ID NO 3106 | TACTCCCTTTCTCTTTCTCCAT | CTC | chr19 | 55115145 | 55115166 | 55115150 | 55115145 | - |
| SEQ ID NO 3107 | CTCCCTTTCTCTTTCTCCATCC | CTA | chr19 | 55115143 | 55115164 | 55115148 | 55115143 | - |
| SEQ ID NO 3108 | CCTTTCTCTTTCTCCATCCTTC | CTC | chr19 | 55115140 | 55115161 | 55115145 | 55115140 | - |
| SEQ ID NO 3109 | TCTCTTTCTCCATCCTTCTTTC | CTT | chr19 | 55115136 | 55115157 | 55115141 | 55115136 | - |
| SEQ ID NO 3110 | CTCTTTCTCCATCCTTCTTTCC | TTT | chr19 | 55115135 | 55115156 | 55115140 | 55115135 | - |
| SEQ ID NO 3111 | TCTTTCTCCATCCTTCTTTCCT | TTC | chr19 | 55115134 | 55115155 | 55115139 | 55115134 | - |
| SEQ ID NO 3112 | TTTCTCCATCCTTCTTTCCTTA | CTC | chr19 | 55115132 | 55115153 | 55115137 | 55115132 | - |
| SEQ ID NO 3113 | TCTCCATCCTTCTTTCCTTAAA | CTT | chr19 | 55115130 | 55115151 | 55115135 | 55115130 | - |
| SEQ ID NO 3114 | CTCCATCCTTCTTTCCTTAAAG | TTT | chr19 | 55115129 | 55115150 | 55115134 | 55115129 | - |
| SEQ ID NO 3115 | TCCATCCTTCTTTCCTTAAAGA | TTC | chr19 | 55115128 | 55115149 | 55115133 | 55115128 | - |
| SEQ ID NO 3116 | CATCCTTCTTTCCTTAAAGAGT | CTC | chr19 | 55115126 | 55115147 | 55115131 | 55115126 | - |
| SEQ ID NO 3117 | CTTTCCTTAAAGAGTCCCCAGT | CTT | chr19 | 55115119 | 55115140 | 55115124 | 55115119 | - |
| SEQ ID NO 3118 | TTTCCTTAAAGAGTCCCCAGTG | TTC | chr19 | 55115118 | 55115139 | 55115123 | 55115118 | - |
| SEQ ID NO 3119 | TCCTTAAAGAGTCCCCAGTGCT | CTT | chr19 | 55115116 | 55115137 | 55115121 | 55115116 | - |
| SEQ ID NO 3120 | CCTTAAAGAGTCCCCAGTGCTA | TTT | chr19 | 55115115 | 55115136 | 55115120 | 55115115 | - |
| SEQ ID NO 3121 | CTTAAAGAGTCCCCAGTGCTAT | TTC | chr19 | 55115114 | 55115135 | 55115119 | 55115114 | - |
| SEQ ID NO 3122 | AAAGAGTCCCCAGTGCTATCTG | CTT | chr19 | 55115111 | 55115132 | 55115116 | 55115111 | - |
| SEQ ID NO 3123 | AAGAGTCCCCAGTGCTATCTGG | TTA | chr19 | 55115110 | 55115131 | 55115115 | 55115110 | - |
| SEQ ID NO 3124 | TCTGGGACATATTCCTCCGCCC | CTA | chr19 | 55115093 | 55115114 | 55115098 | 55115093 | - |
| SEQ ID NO 3125 | GGACATATTCCTCCGCCCAGAG | CTG | chr19 | 55115089 | 55115110 | 55115094 | 55115089 | - |
| SEQ ID NO 3126 | CTCCGCCCAGAGCAGGGTCCCG | TTC | chr19 | 55115079 | 55115100 | 55115084 | 55115079 | - |
| SEQ ID NO 3127 | CGCCCAGAGCAGGGTCCCGCTT | CTC | chr19 | 55115076 | 55115097 | 55115081 | 55115076 | - |
| SEQ ID NO 3128 | CCCTAAGGCCCTGCTCTGGGCT | CTT | chr19 | 55115054 | 55115075 | 55115059 | 55115054 | - |
| SEQ ID NO 3129 | CCTAAGGCCCTGCTCTGGGCTT | TTC | chr19 | 55115053 | 55115074 | 55115058 | 55115053 | - |
| SEQ ID NO 3130 | AGGCCCTGCTCTGGGCTTCTGG | CTA | chr19 | 55115049 | 55115070 | 55115054 | 55115049 | - |

Figure 6 (Cont'd)

| | | | | | | | | |
|---|---|---|---|---|---|---|---|---|
| SEQ ID NO 3131 | CTCTGGGCTTCTGGGTTTGAGT | CTG | chr19 | 55115041 | 55115062 | 55115046 | 55115041 | - |
| SEQ ID NO 3132 | TGGGCTTCTGGGTTTGAGTCCT | CTC | chr19 | 55115038 | 55115059 | 55115043 | 55115038 | - |
| SEQ ID NO 3133 | GGCTTCTGGGTTTGAGTCCTTG | CTG | chr19 | 55115036 | 55115057 | 55115041 | 55115036 | - |
| SEQ ID NO 3134 | CTGGGTTTGAGTCCTTGGCAAG | CTT | chr19 | 55115031 | 55115052 | 55115036 | 55115031 | - |
| SEQ ID NO 3135 | TGGGTTTGAGTCCTTGGCAAGC | TTC | chr19 | 55115030 | 55115051 | 55115035 | 55115030 | - |
| SEQ ID NO 3136 | GGTTTGAGTCCTTGGCAAGCCC | CTG | chr19 | 55115028 | 55115049 | 55115033 | 55115028 | - |
| SEQ ID NO 3137 | GAGTCCTTGGCAAGCCCAGGAG | TTT | chr19 | 55115023 | 55115044 | 55115028 | 55115023 | - |
| SEQ ID NO 3138 | AGTCCTTGGCAAGCCCAGGAGA | TTG | chr19 | 55115022 | 55115043 | 55115027 | 55115022 | - |
| SEQ ID NO 3139 | GGCAAGCCCAGGAGAGGCGCTC | CTT | chr19 | 55115015 | 55115036 | 55115020 | 55115015 | - |
| SEQ ID NO 3140 | GCAAGCCCAGGAGAGGCGCTCA | TTG | chr19 | 55115014 | 55115035 | 55115019 | 55115014 | - |
| SEQ ID NO 3141 | AGGCTTCCCTGTCCCCCTTCCT | CTC | chr19 | 55114993 | 55115014 | 55114998 | 55114993 | - |
| SEQ ID NO 3142 | CCCTGTCCCCCTTCCTCGTCCA | CTT | chr19 | 55114987 | 55115008 | 55114992 | 55114987 | - |
| SEQ ID NO 3143 | CCTGTCCCCCTTCCTCGTCCAC | TTC | chr19 | 55114986 | 55115007 | 55114991 | 55114986 | - |
| SEQ ID NO 3144 | TCCCCCTTCCTCGTCCACCATC | CTG | chr19 | 55114982 | 55115003 | 55114987 | 55114982 | - |
| SEQ ID NO 3145 | CCTCGTCCACCATCTCATGCCC | CTT | chr19 | 55114974 | 55114995 | 55114979 | 55114974 | - |
| SEQ ID NO 3146 | CTCGTCCACCATCTCATGCCCC | TTC | chr19 | 55114973 | 55114994 | 55114978 | 55114973 | - |
| SEQ ID NO 3147 | GTCCACCATCTCATGCCCCTGG | CTC | chr19 | 55114970 | 55114991 | 55114975 | 55114970 | - |
| SEQ ID NO 3148 | ATGCCCCTGGCTCTCCTGCCCC | CTC | chr19 | 55114958 | 55114979 | 55114963 | 55114958 | - |
| SEQ ID NO 3149 | GCTCTCCTGCCCCTTCCCTACA | CTG | chr19 | 55114949 | 55114970 | 55114954 | 55114949 | - |
| SEQ ID NO 3150 | TCCTGCCCCTTCCCTACAGGGG | CTC | chr19 | 55114945 | 55114966 | 55114950 | 55114945 | - |
| SEQ ID NO 3151 | CTGCCCCTTCCCTACAGGGGTT | CTC | chr19 | 55114943 | 55114964 | 55114948 | 55114943 | - |
| SEQ ID NO 3152 | CCCCTTCCCTACAGGGGTTCCT | CTG | chr19 | 55114940 | 55114961 | 55114945 | 55114940 | - |
| SEQ ID NO 3153 | CCCTACAGGGGTTCCTGGCTCT | CTT | chr19 | 55114934 | 55114955 | 55114939 | 55114934 | - |
| SEQ ID NO 3154 | CCTACAGGGGTTCCTGGCTCTG | TTC | chr19 | 55114933 | 55114954 | 55114938 | 55114933 | - |
| SEQ ID NO 3155 | CAGGGGTTCCTGGCTCTGCTCT | CTA | chr19 | 55114929 | 55114950 | 55114934 | 55114929 | - |
| SEQ ID NO 3156 | CTGGCTCTGCTCTTCAGACTGA | TTC | chr19 | 55114920 | 55114941 | 55114925 | 55114920 | - |
| SEQ ID NO 3157 | GCTCTGCTCTTCAGACTGAGCC | CTG | chr19 | 55114917 | 55114938 | 55114922 | 55114917 | - |
| SEQ ID NO 3158 | TGCTCTTCAGACTGAGCCCCGT | CTC | chr19 | 55114913 | 55114934 | 55114918 | 55114913 | - |
| SEQ ID NO 3159 | CTCTTCAGACTGAGCCCCGTTC | CTG | chr19 | 55114911 | 55114932 | 55114916 | 55114911 | - |
| SEQ ID NO 3160 | TTCAGACTGAGCCCCGTTCCCC | CTC | chr19 | 55114908 | 55114929 | 55114913 | 55114908 | - |
| SEQ ID NO 3161 | CAGACTGAGCCCCGTTCCCCTG | CTT | chr19 | 55114906 | 55114927 | 55114911 | 55114906 | - |
| SEQ ID NO 3162 | AGACTGAGCCCCGTTCCCCTGC | TTC | chr19 | 55114905 | 55114926 | 55114910 | 55114905 | - |
| SEQ ID NO 3163 | AGCCCCGTTCCCCTGCATCCCC | CTG | chr19 | 55114899 | 55114920 | 55114904 | 55114899 | - |
| SEQ ID NO 3164 | CCCTGCATCCCCGTTCCCCTGC | TTC | chr19 | 55114889 | 55114910 | 55114894 | 55114889 | - |
| SEQ ID NO 3165 | CATCCCCGTTCCCCTGCATCCC | CTG | chr19 | 55114884 | 55114905 | 55114889 | 55114884 | - |
| SEQ ID NO 3166 | CCCTGCATCCCCCTTCCCCTGC | TTC | chr19 | 55114873 | 55114894 | 55114878 | 55114873 | - |
| SEQ ID NO 3167 | CATCCCCCTTCCCCTGCATCCC | CTG | chr19 | 55114868 | 55114889 | 55114873 | 55114868 | - |
| SEQ ID NO 3168 | CCCCTGCATCCCCCAGAGGCCC | CTT | chr19 | 55114858 | 55114879 | 55114863 | 55114858 | - |
| SEQ ID NO 3169 | CCCTGCATCCCCCAGAGGCCCC | TTC | chr19 | 55114857 | 55114878 | 55114862 | 55114857 | - |
| SEQ ID NO 3170 | CATCCCCCAGAGGCCCCAGGCC | CTG | chr19 | 55114852 | 55114873 | 55114857 | 55114852 | - |
| SEQ ID NO 3171 | CTTGGCCTGGACCCCACGAGAG | CTA | chr19 | 55114825 | 55114846 | 55114830 | 55114825 | - |
| SEQ ID NO 3172 | GGCCTGGACCCCACGAGAGGCC | CTT | chr19 | 55114822 | 55114843 | 55114827 | 55114822 | - |
| SEQ ID NO 3173 | GCCTGGACCCCACGAGAGGCCA | TTG | chr19 | 55114821 | 55114842 | 55114826 | 55114821 | - |
| SEQ ID NO 3174 | GACCCCACGAGAGGCCACCCCA | CTG | chr19 | 55114816 | 55114837 | 55114821 | 55114816 | - |
| SEQ ID NO 3175 | TCTACCAGGCTGCCTTTTGGGT | CTG | chr19 | 55114788 | 55114809 | 55114793 | 55114788 | - |
| SEQ ID NO 3176 | CCAGGCTGCCTTTTGGGTGGAT | CTA | chr19 | 55114784 | 55114805 | 55114789 | 55114784 | - |
| SEQ ID NO 3177 | CCTTTTGGGTGGATTCTCCTCC | CTG | chr19 | 55114776 | 55114797 | 55114781 | 55114776 | - |
| SEQ ID NO 3178 | TTGGGTGGATTCTCCTCCAACT | CTT | chr19 | 55114772 | 55114793 | 55114777 | 55114772 | - |
| SEQ ID NO 3179 | TGGGTGGATTCTCCTCCAACTG | TTT | chr19 | 55114771 | 55114792 | 55114776 | 55114771 | - |
| SEQ ID NO 3180 | GGGTGGATTCTCCTCCAACTGT | TTT | chr19 | 55114770 | 55114791 | 55114775 | 55114770 | - |
| SEQ ID NO 3181 | GGTGGATTCTCCTCCAACTGTG | TTG | chr19 | 55114769 | 55114790 | 55114774 | 55114769 | - |
| SEQ ID NO 3182 | TCCTCCAACTGTGGGGTGACTG | TTC | chr19 | 55114760 | 55114781 | 55114765 | 55114760 | - |
| SEQ ID NO 3183 | CTCCAACTGTGGGGTGACTGCT | CTC | chr19 | 55114758 | 55114779 | 55114763 | 55114758 | - |
| SEQ ID NO 3184 | CAACTGTGGGGTGACTGCTTGG | CTC | chr19 | 55114755 | 55114776 | 55114760 | 55114755 | - |
| SEQ ID NO 3185 | TGGGGTGACTGCTTGGCAAACT | CTG | chr19 | 55114749 | 55114770 | 55114754 | 55114749 | - |
| SEQ ID NO 3186 | CTTGGCAAACTCACTCTTCGGG | CTG | chr19 | 55114738 | 55114759 | 55114743 | 55114738 | - |
| SEQ ID NO 3187 | GGCAAACTCACTCTTCGGGGTA | CTT | chr19 | 55114735 | 55114756 | 55114740 | 55114735 | - |
| SEQ ID NO 3188 | GCAAACTCACTCTTCGGGGTAT | TTG | chr19 | 55114734 | 55114755 | 55114739 | 55114734 | - |
| SEQ ID NO 3189 | ACTCTTCGGGGTATCCCAGGAG | CTC | chr19 | 55114726 | 55114747 | 55114731 | 55114726 | - |

Figure 6 (Cont'd)

| SEQ ID NO 3190 | TTCGGGGTATCCCAGGAGGCCT | CTC | chr19 | 55114722 | 55114743 | 55114727 | 55114722 | - |
|---|---|---|---|---|---|---|---|---|
| SEQ ID NO 3191 | CGGGGTATCCCAGGAGGCCTGG | CTT | chr19 | 55114720 | 55114741 | 55114725 | 55114720 | - |
| SEQ ID NO 3192 | GGGGTATCCCAGGAGGCCTGGA | TTC | chr19 | 55114719 | 55114740 | 55114724 | 55114719 | - |
| SEQ ID NO 3193 | GAGCATTGGGGTGGGCTGGGGT | CTG | chr19 | 55114699 | 55114720 | 55114704 | 55114699 | - |
| SEQ ID NO 3194 | GGGTGGGCTGGGGTTCAGAGAG | TTG | chr19 | 55114691 | 55114712 | 55114696 | 55114691 | - |
| SEQ ID NO 3195 | GGGTTCAGAGAGGAGGGATTCC | CTG | chr19 | 55114681 | 55114702 | 55114686 | 55114681 | - |
| SEQ ID NO 3196 | AGAGAGGAGGGATTCCCTTCTC | TTC | chr19 | 55114675 | 55114696 | 55114680 | 55114675 | - |
| SEQ ID NO 3197 | CCTTCTCAGGTTACGTGGCCAA | TTC | chr19 | 55114660 | 55114681 | 55114665 | 55114660 | - |
| SEQ ID NO 3198 | CTCAGGTTACGTGGCCAAGAAG | CTT | chr19 | 55114656 | 55114677 | 55114661 | 55114656 | - |
| SEQ ID NO 3199 | TCAGGTTACGTGGCCAAGAAGC | TTC | chr19 | 55114655 | 55114676 | 55114660 | 55114655 | - |
| SEQ ID NO 3200 | AGGTTACGTGGCCAAGAAGCAG | CTC | chr19 | 55114653 | 55114674 | 55114658 | 55114653 | - |
| SEQ ID NO 3201 | CGTGGCCAAGAAGCAGGGGAGC | TTA | chr19 | 55114647 | 55114668 | 55114652 | 55114647 | - |
| SEQ ID NO 3202 | GGTTTGGGTCAGGTCTGGGTGT | CTG | chr19 | 55114623 | 55114644 | 55114628 | 55114623 | - |
| SEQ ID NO 3203 | GGGTCAGGTCTGGGTGTGGGGT | TTT | chr19 | 55114618 | 55114639 | 55114623 | 55114618 | - |
| SEQ ID NO 3204 | GGTCAGGTCTGGGTGTGGGGTG | TTG | chr19 | 55114617 | 55114638 | 55114622 | 55114617 | - |
| SEQ ID NO 3205 | GGTGTGGGGTGACCAGCTTATG | CTG | chr19 | 55114606 | 55114627 | 55114611 | 55114606 | - |
| SEQ ID NO 3206 | ATGCTGTTTGCCCAGGACAGCC | CTT | chr19 | 55114587 | 55114608 | 55114592 | 55114587 | - |
| SEQ ID NO 3207 | TGCTGTTTGCCCAGGACAGCCT | TTA | chr19 | 55114586 | 55114607 | 55114591 | 55114586 | - |
| SEQ ID NO 3208 | TTTGCCCAGGACAGCCTAGTTT | CTG | chr19 | 55114581 | 55114602 | 55114586 | 55114581 | - |
| SEQ ID NO 3209 | GCCCAGGACAGCCTAGTTTTAG | TTT | chr19 | 55114578 | 55114599 | 55114583 | 55114578 | - |
| SEQ ID NO 3210 | CCCAGGACAGCCTAGTTTTAGC | TTG | chr19 | 55114577 | 55114598 | 55114582 | 55114577 | - |
| SEQ ID NO 3211 | GTTTTAGCACTGAAACCCTCAG | CTA | chr19 | 55114563 | 55114584 | 55114568 | 55114563 | - |
| SEQ ID NO 3212 | TAGCACTGAAACCCTCAGTCCT | TTT | chr19 | 55114559 | 55114580 | 55114564 | 55114559 | - |
| SEQ ID NO 3213 | AGCACTGAAACCCTCAGTCCTA | TTT | chr19 | 55114558 | 55114579 | 55114563 | 55114558 | - |
| SEQ ID NO 3214 | GCACTGAAACCCTCAGTCCTAG | TTA | chr19 | 55114557 | 55114578 | 55114562 | 55114557 | - |
| SEQ ID NO 3215 | AAACCCTCAGTCCTAGGAAAAC | CTG | chr19 | 55114551 | 55114572 | 55114556 | 55114551 | - |
| SEQ ID NO 3216 | AGTCCTAGGAAAACAGGGATGG | CTC | chr19 | 55114543 | 55114564 | 55114548 | 55114543 | - |
| SEQ ID NO 3217 | GGAAAACAGGGATGGTTGGTCA | CTA | chr19 | 55114536 | 55114557 | 55114541 | 55114536 | - |
| SEQ ID NO 3218 | GTCACTGTCTCTGGGTGACTCT | TTG | chr19 | 55114518 | 55114539 | 55114523 | 55114518 | - |
| SEQ ID NO 3219 | TCTCTGGGTGACTCTTGATTCC | CTG | chr19 | 55114511 | 55114532 | 55114516 | 55114511 | - |
| SEQ ID NO 3220 | TGGGTGACTCTTGATTCCCGGC | CTC | chr19 | 55114507 | 55114528 | 55114512 | 55114507 | - |
| SEQ ID NO 3221 | GGTGACTCTTGATTCCCGGCCA | CTG | chr19 | 55114505 | 55114526 | 55114510 | 55114505 | - |
| SEQ ID NO 3222 | TTGATTCCCGGCCAGTTTCTCC | CTC | chr19 | 55114497 | 55114518 | 55114502 | 55114497 | - |
| SEQ ID NO 3223 | GATTCCCGGCCAGTTTCTCCAC | CTT | chr19 | 55114495 | 55114516 | 55114500 | 55114495 | - |
| SEQ ID NO 3224 | ATTCCCGGCCAGTTTCTCCACC | TTG | chr19 | 55114494 | 55114515 | 55114499 | 55114494 | - |
| SEQ ID NO 3225 | CCGGCCAGTTTCTCCACCTGGG | TTC | chr19 | 55114490 | 55114511 | 55114495 | 55114490 | - |
| SEQ ID NO 3226 | CTCCACCTGGGGCTGTGTTTCT | TTT | chr19 | 55114479 | 55114500 | 55114484 | 55114479 | - |
| SEQ ID NO 3227 | TCCACCTGGGGCTGTGTTTCTC | TTC | chr19 | 55114478 | 55114499 | 55114483 | 55114478 | - |
| SEQ ID NO 3228 | CACCTGGGGCTGTGTTTCTCGT | CTC | chr19 | 55114476 | 55114497 | 55114481 | 55114476 | - |
| SEQ ID NO 3229 | GGGCTGTGTTTCTCGTCCTGCA | CTG | chr19 | 55114470 | 55114491 | 55114475 | 55114470 | - |
| SEQ ID NO 3230 | TGTTTCTCGTCCTGCATCCTTC | CTG | chr19 | 55114464 | 55114485 | 55114469 | 55114464 | - |
| SEQ ID NO 3231 | CTCGTCCTGCATCCTTCTCCAG | TTT | chr19 | 55114459 | 55114480 | 55114464 | 55114459 | - |
| SEQ ID NO 3232 | TCGTCCTGCATCCTTCTCCAGG | TTC | chr19 | 55114458 | 55114479 | 55114463 | 55114458 | - |
| SEQ ID NO 3233 | GTCCTGCATCCTTCTCCAGGCA | CTC | chr19 | 55114456 | 55114477 | 55114461 | 55114456 | - |
| SEQ ID NO 3234 | CATCCTTCTCCAGGCAGGTCCC | CTG | chr19 | 55114450 | 55114471 | 55114455 | 55114450 | - |
| SEQ ID NO 3235 | CTCCAGGCAGGTCCCCAAGCAT | CTT | chr19 | 55114443 | 55114464 | 55114448 | 55114443 | - |
| SEQ ID NO 3236 | TCCAGGCAGGTCCCCAAGCATC | TTC | chr19 | 55114442 | 55114463 | 55114447 | 55114442 | - |
| SEQ ID NO 3237 | CAGGCAGGTCCCCAAGCATCGC | CTC | chr19 | 55114440 | 55114461 | 55114445 | 55114440 | - |
| SEQ ID NO 3238 | CTGTGGCTGTTCCCAAGTTCTT | CTG | chr19 | 55114411 | 55114432 | 55114416 | 55114411 | - |
| SEQ ID NO 3239 | TGGCTGTTCCCAAGTTCTTAGG | CTG | chr19 | 55114408 | 55114429 | 55114413 | 55114408 | - |
| SEQ ID NO 3240 | TTCCCAAGTTCTTAGGGTACCC | CTG | chr19 | 55114402 | 55114423 | 55114407 | 55114402 | - |
| SEQ ID NO 3241 | CCAAGTTCTTAGGGTACCCCAC | TTC | chr19 | 55114399 | 55114420 | 55114404 | 55114399 | - |
| SEQ ID NO 3242 | TTAGGGTACCCCACGTGGGTTT | TTC | chr19 | 55114391 | 55114412 | 55114396 | 55114391 | - |
| SEQ ID NO 3243 | AGGGTACCCCACGTGGGTTTAT | CTT | chr19 | 55114389 | 55114410 | 55114394 | 55114389 | - |
| SEQ ID NO 3244 | GGGTACCCCACGTGGGTTTATC | TTA | chr19 | 55114388 | 55114409 | 55114393 | 55114388 | - |
| SEQ ID NO 3245 | ATCAACCACTTGGTGAGGCTGG | TTT | chr19 | 55114369 | 55114390 | 55114374 | 55114369 | - |
| SEQ ID NO 3246 | TCAACCACTTGGTGAGGCTGGT | TTA | chr19 | 55114368 | 55114389 | 55114373 | 55114368 | - |
| SEQ ID NO 3247 | GGTGAGGCTGGTACCCTGCCCC | CTT | chr19 | 55114358 | 55114379 | 55114363 | 55114358 | - |
| SEQ ID NO 3248 | GTGAGGCTGGTACCCTGCCCCC | TTG | chr19 | 55114357 | 55114378 | 55114362 | 55114357 | - |

Figure 6 (Cont'd)

| | | | | | | | | |
|---|---|---|---|---|---|---|---|---|
| SEQ ID NO 3249 | GTACCCTGCCCCCATTCCTGCA | CTG | chr19 | 55114348 | 55114369 | 55114353 | 55114348 | - |
| SEQ ID NO 3250 | CCCCCATTCCTGCACCCCAATT | CTG | chr19 | 55114340 | 55114361 | 55114345 | 55114340 | - |
| SEQ ID NO 3251 | CTGCACCCCAATTGCCTTAGTG | TTC | chr19 | 55114331 | 55114352 | 55114336 | 55114331 | - |
| SEQ ID NO 3252 | CACCCCAATTGCCTTAGTGGCT | CTG | chr19 | 55114328 | 55114349 | 55114333 | 55114328 | - |
| SEQ ID NO 3253 | CCTTAGTGGCTAGGGGGTTGGG | TTG | chr19 | 55114317 | 55114338 | 55114322 | 55114317 | - |
| SEQ ID NO 3254 | AGTGGCTAGGGGGTTGGGGGCT | CTT | chr19 | 55114313 | 55114334 | 55114318 | 55114313 | - |
| SEQ ID NO 3255 | GTGGCTAGGGGGTTGGGGGCTA | TTA | chr19 | 55114312 | 55114333 | 55114317 | 55114312 | - |
| SEQ ID NO 3256 | GGGGGGTTGGGGGCTAGAGTAGG | CTA | chr19 | 55114305 | 55114326 | 55114310 | 55114305 | - |
| SEQ ID NO 3257 | GGGGCTAGAGTAGGAGGGGCTG | TTG | chr19 | 55114297 | 55114318 | 55114302 | 55114297 | - |
| SEQ ID NO 3258 | GAGTAGGAGGGGCTGGAGCCAG | CTA | chr19 | 55114290 | 55114311 | 55114295 | 55114290 | - |
| SEQ ID NO 3259 | GAGCCAGGATTCTTAGGGCTGA | CTG | chr19 | 55114275 | 55114296 | 55114280 | 55114275 | - |
| SEQ ID NO 3260 | TTAGGGCTGAACAGAGAAGAGC | TTC | chr19 | 55114263 | 55114284 | 55114268 | 55114263 | - |
| SEQ ID NO 3261 | AGGGCTGAACAGAGAAGAGCTG | CTT | chr19 | 55114261 | 55114282 | 55114266 | 55114261 | - |
| SEQ ID NO 3262 | GGGCTGAACAGAGAAGAGCTGG | TTA | chr19 | 55114260 | 55114281 | 55114265 | 55114260 | - |
| SEQ ID NO 3263 | AACAGAGAAGAGCTGGGGGCCT | CTG | chr19 | 55114254 | 55114275 | 55114259 | 55114254 | - |
| SEQ ID NO 3264 | GGGGCCTGGGCTCCTGGGTTTG | CTG | chr19 | 55114239 | 55114260 | 55114244 | 55114239 | - |
| SEQ ID NO 3265 | GGCTCCTGGGTTTGAGAGAGGA | CTG | chr19 | 55114231 | 55114252 | 55114236 | 55114231 | - |
| SEQ ID NO 3266 | CTGGGTTTGAGAGAGGAGGGGC | CTC | chr19 | 55114226 | 55114247 | 55114231 | 55114226 | - |
| SEQ ID NO 3267 | GGTTTGAGAGAGGAGGGGCTGG | CTG | chr19 | 55114223 | 55114244 | 55114228 | 55114223 | - |
| SEQ ID NO 3268 | GAGAGAGGAGGGGCTGGGGCCT | TTT | chr19 | 55114218 | 55114239 | 55114223 | 55114218 | - |
| SEQ ID NO 3269 | AGAGAGGAGGGGCTGGGGCCTG | TTG | chr19 | 55114217 | 55114238 | 55114222 | 55114217 | - |
| SEQ ID NO 3270 | GGGCCTGGACTCCTGGGTCCGA | CTG | chr19 | 55114202 | 55114223 | 55114207 | 55114202 | - |
| SEQ ID NO 3271 | GACTCCTGGGTCCGAGGGAGGA | CTG | chr19 | 55114195 | 55114216 | 55114200 | 55114195 | - |
| SEQ ID NO 3272 | CTGGGTCCGAGGGAGGAGGGGC | CTC | chr19 | 55114190 | 55114211 | 55114195 | 55114190 | - |
| SEQ ID NO 3273 | GGTCCGAGGGAGGAGGGGCTGG | CTG | chr19 | 55114187 | 55114208 | 55114192 | 55114187 | - |
| SEQ ID NO 3274 | GGGCCTGGACTCCTGGGTCTGA | CTG | chr19 | 55114166 | 55114187 | 55114171 | 55114166 | - |
| SEQ ID NO 3275 | GACTCCTGGGTCTGAGGGTGGA | CTG | chr19 | 55114159 | 55114180 | 55114164 | 55114159 | - |
| SEQ ID NO 3276 | CTGGGTCTGAGGGTGGAGGGAC | CTC | chr19 | 55114154 | 55114175 | 55114159 | 55114154 | - |
| SEQ ID NO 3277 | GGTCTGAGGGTGGAGGGACTGG | CTG | chr19 | 55114151 | 55114172 | 55114156 | 55114151 | - |
| SEQ ID NO 3278 | AGGGTGGAGGGACTGGGGCCT | CTG | chr19 | 55114145 | 55114166 | 55114150 | 55114145 | - |
| SEQ ID NO 3279 | GGGGCCTGGACTCCTGGGTCCG | CTG | chr19 | 55114130 | 55114151 | 55114135 | 55114130 | - |
| SEQ ID NO 3280 | GACTCCTGGGTCCGAGGGAGGA | CTG | chr19 | 55114122 | 55114143 | 55114127 | 55114122 | - |
| SEQ ID NO 3281 | CTGGGTCCGAGGGAGGAGGGGC | CTC | chr19 | 55114117 | 55114138 | 55114122 | 55114117 | - |
| SEQ ID NO 3282 | GGTCCGAGGGAGGAGGGGCTGG | CTG | chr19 | 55114114 | 55114135 | 55114119 | 55114114 | - |
| SEQ ID NO 3283 | GGGCCTGGACTCGTGGGTCTGA | CTG | chr19 | 55114093 | 55114114 | 55114098 | 55114093 | - |
| SEQ ID NO 3284 | GACTCGTGGGTCTGAGGGAGGA | CTG | chr19 | 55114086 | 55114107 | 55114091 | 55114086 | - |
| SEQ ID NO 3285 | GTGGGTCTGAGGGAGGAGGGGC | CTC | chr19 | 55114081 | 55114102 | 55114086 | 55114081 | - |
| SEQ ID NO 3286 | AGGGAGGAGGGGCTGGGGCCT | CTG | chr19 | 55114072 | 55114093 | 55114077 | 55114072 | - |
| SEQ ID NO 3287 | GGGGCCTGGACTTCTGGGTCTT | CTG | chr19 | 55114057 | 55114078 | 55114062 | 55114057 | - |
| SEQ ID NO 3288 | GACTTCTGGGTCTTAGGGAGGC | CTG | chr19 | 55114049 | 55114070 | 55114054 | 55114049 | - |
| SEQ ID NO 3289 | CTGGGTCTTAGGGAGGCGGGGC | CTT | chr19 | 55114044 | 55114065 | 55114049 | 55114044 | - |
| SEQ ID NO 3290 | TGGGTCTTAGGGAGGCGGGGCT | TTC | chr19 | 55114043 | 55114064 | 55114048 | 55114043 | - |
| SEQ ID NO 3291 | GGTCTTAGGGAGGCGGGGCTGG | CTG | chr19 | 55114041 | 55114062 | 55114046 | 55114041 | - |
| SEQ ID NO 3292 | AGGGAGGCGGGGCTGGGCCTGG | CTT | chr19 | 55114035 | 55114056 | 55114040 | 55114035 | - |
| SEQ ID NO 3293 | GGGAGGCGGGGCTGGGCCTGGA | TTA | chr19 | 55114034 | 55114055 | 55114039 | 55114034 | - |
| SEQ ID NO 3294 | GGCCTGGACCCCTGGGTCTGAA | CTG | chr19 | 55114020 | 55114041 | 55114025 | 55114020 | - |
| SEQ ID NO 3295 | GACCCCTGGGTCTGAATGGGGA | CTG | chr19 | 55114014 | 55114035 | 55114019 | 55114014 | - |
| SEQ ID NO 3296 | GGTCTGAATGGGGAGAGGCTGG | CTG | chr19 | 55114006 | 55114027 | 55114011 | 55114006 | - |
| SEQ ID NO 3297 | AATGGGGAGAGGCTGGGGGCCT | CTG | chr19 | 55114000 | 55114021 | 55114005 | 55114000 | - |
| SEQ ID NO 3298 | GGGGCCTGGACTCCTTCATCTG | CTG | chr19 | 55113985 | 55114006 | 55113990 | 55113985 | - |
| SEQ ID NO 3299 | GACTCCTTCATCTGAGGGCGGA | CTG | chr19 | 55113977 | 55113998 | 55113982 | 55113977 | - |
| SEQ ID NO 3300 | CTTCATCTGAGGGCGGAAGGGC | CTC | chr19 | 55113972 | 55113993 | 55113977 | 55113972 | - |
| SEQ ID NO 3301 | CATCTGAGGGCGGAAGGGCTGG | CTT | chr19 | 55113969 | 55113990 | 55113974 | 55113969 | - |
| SEQ ID NO 3302 | ATCTGAGGGCGGAAGGGCTGGG | TTC | chr19 | 55113968 | 55113989 | 55113973 | 55113968 | - |
| SEQ ID NO 3303 | AGGGCGGAAGGGCTGGGGCCTG | CTG | chr19 | 55113963 | 55113984 | 55113968 | 55113963 | - |
| SEQ ID NO 3304 | GGGCCTGGCCTCCTGGGTTGAA | CTG | chr19 | 55113948 | 55113969 | 55113953 | 55113948 | - |
| SEQ ID NO 3305 | GCCTCCTGGGTTGAATGGGGAG | CTG | chr19 | 55113941 | 55113962 | 55113946 | 55113941 | - |
| SEQ ID NO 3306 | CTGGGTTGAATGGGGAGGGGTT | CTC | chr19 | 55113936 | 55113957 | 55113941 | 55113936 | - |
| SEQ ID NO 3307 | GGTTGAATGGGGAGGGGTTGGG | CTG | chr19 | 55113933 | 55113954 | 55113938 | 55113933 | - |

Figure 6 (Cont'd)

| | | | | | | | | |
|---|---|---|---|---|---|---|---|---|
| SEQ ID NO 3308 | AATGGGGAGGGGTTGGGCCTGG | TTG | chr19 | 55113928 | 55113949 | 55113933 | 55113928 | - |
| SEQ ID NO 3309 | GGCCTGGACTCTGGAGTCCCTG | TTG | chr19 | 55113913 | 55113934 | 55113918 | 55113913 | - |
| SEQ ID NO 3310 | GACTCTGGAGTCCCTGGTGCCC | CTG | chr19 | 55113907 | 55113928 | 55113912 | 55113907 | - |
| SEQ ID NO 3311 | TGGAGTCCCTGGTGCCCAGGCC | CTC | chr19 | 55113902 | 55113923 | 55113907 | 55113902 | - |
| SEQ ID NO 3312 | GAGTCCCTGGTGCCCAGGCCTC | CTG | chr19 | 55113900 | 55113921 | 55113905 | 55113900 | - |
| SEQ ID NO 3313 | GTGCCCAGGCCTCAGGCATCTT | CTG | chr19 | 55113891 | 55113912 | 55113896 | 55113891 | - |
| SEQ ID NO 3314 | AGGCATCTTTCACAGGGATGCC | CTC | chr19 | 55113878 | 55113899 | 55113883 | 55113878 | - |
| SEQ ID NO 3315 | TCACAGGGATGCCTGTACTGGG | CTT | chr19 | 55113869 | 55113890 | 55113874 | 55113869 | - |
| SEQ ID NO 3316 | CACAGGGATGCCTGTACTGGGC | TTT | chr19 | 55113868 | 55113889 | 55113873 | 55113868 | - |
| SEQ ID NO 3317 | ACAGGGATGCCTGTACTGGGCA | TTC | chr19 | 55113867 | 55113888 | 55113872 | 55113867 | - |
| SEQ ID NO 3318 | TACTGGGCAGGTCCTTGAAAGG | CTG | chr19 | 55113854 | 55113875 | 55113859 | 55113854 | - |
| SEQ ID NO 3319 | GGCAGGTCCTTGAAAGGGAAAG | CTG | chr19 | 55113849 | 55113870 | 55113854 | 55113849 | - |
| SEQ ID NO 3320 | GAAAGGGAAAGGCCCATTGCTC | CTT | chr19 | 55113838 | 55113859 | 55113843 | 55113838 | - |
| SEQ ID NO 3321 | AAAGGGAAAGGCCCATTGCTCT | TTG | chr19 | 55113837 | 55113858 | 55113842 | 55113837 | - |
| SEQ ID NO 3322 | CTCTCCTTGCCCCCCTCCCCTA | TTG | chr19 | 55113819 | 55113840 | 55113824 | 55113819 | - |
| SEQ ID NO 3323 | TCCTTGCCCCCCTCCCCTATCG | CTC | chr19 | 55113816 | 55113837 | 55113821 | 55113816 | - |
| SEQ ID NO 3324 | CTTGCCCCCCTCCCCTATCGCC | CTC | chr19 | 55113814 | 55113835 | 55113819 | 55113814 | - |
| SEQ ID NO 3325 | GCCCCCCTCCCCTATCGCCATG | CTT | chr19 | 55113811 | 55113832 | 55113816 | 55113811 | - |
| SEQ ID NO 3326 | CCCCCCTCCCCTATCGCCATGA | TTG | chr19 | 55113810 | 55113831 | 55113815 | 55113810 | - |
| SEQ ID NO 3327 | CCCTATCGCCATGACAACTGGG | CTC | chr19 | 55113802 | 55113823 | 55113807 | 55113802 | - |
| SEQ ID NO 3328 | TCGCCATGACAACTGGGTGGAA | CTA | chr19 | 55113797 | 55113818 | 55113802 | 55113797 | - |
| SEQ ID NO 3329 | GGTGGAAATAAACGAGCCGAGT | CTG | chr19 | 55113782 | 55113803 | 55113787 | 55113782 | - |
| SEQ ID NO 3330 | ATCCCGTTCCAGGGCACGTGC | TTC | chr19 | 55113758 | 55113779 | 55113763 | 55113758 | - |
| SEQ ID NO 3331 | CCAGGGCACGTGCGGCCCCTTC | TTC | chr19 | 55113749 | 55113770 | 55113754 | 55113749 | - |
| SEQ ID NO 3332 | CACAGCCCGAGTTTCCATGACC | CTT | chr19 | 55113728 | 55113749 | 55113733 | 55113728 | - |
| SEQ ID NO 3333 | ACAGCCCGAGTTTCCATGACCT | TTC | chr19 | 55113727 | 55113748 | 55113732 | 55113727 | - |
| SEQ ID NO 3334 | CCATGACCTCATGCTCTTGGCC | TTT | chr19 | 55113714 | 55113735 | 55113719 | 55113714 | - |
| SEQ ID NO 3335 | CATGACCTCATGCTCTTGGCCC | TTC | chr19 | 55113713 | 55113734 | 55113718 | 55113713 | - |
| SEQ ID NO 3336 | ATGCTCTTGGCCCTCGTAGCTC | CTC | chr19 | 55113704 | 55113725 | 55113709 | 55113704 | - |
| SEQ ID NO 3337 | TTGGCCCTCGTAGCTCCCTCCC | CTC | chr19 | 55113698 | 55113719 | 55113703 | 55113698 | - |
| SEQ ID NO 3338 | GGCCCTCGTAGCTCCCTCCCGC | CTT | chr19 | 55113696 | 55113717 | 55113701 | 55113696 | - |
| SEQ ID NO 3339 | GCCCTCGTAGCTCCCTCCCGCC | TTG | chr19 | 55113695 | 55113716 | 55113700 | 55113695 | - |
| SEQ ID NO 3340 | GTAGCTCCCTCCCGCCTCCTCC | CTC | chr19 | 55113689 | 55113710 | 55113694 | 55113689 | - |
| SEQ ID NO 3341 | CCTCCCGCCTCCTCCAGATGGG | CTC | chr19 | 55113682 | 55113703 | 55113687 | 55113682 | - |
| SEQ ID NO 3342 | CCGCCTCCTCCAGATGGGCAGC | CTC | chr19 | 55113678 | 55113699 | 55113683 | 55113678 | - |
| SEQ ID NO 3343 | CTCCAGATGGGCAGCTTTGGAG | CTC | chr19 | 55113671 | 55113692 | 55113676 | 55113671 | - |
| SEQ ID NO 3344 | CAGATGGGCAGCTTTGGAGAGG | CTC | chr19 | 55113668 | 55113689 | 55113673 | 55113668 | - |
| SEQ ID NO 3345 | TGGAGAGGTGAGGGACTTGGGG | CTT | chr19 | 55113654 | 55113675 | 55113659 | 55113654 | - |
| SEQ ID NO 3346 | GGAGAGGTGAGGGACTTGGGGG | TTT | chr19 | 55113653 | 55113674 | 55113658 | 55113653 | - |
| SEQ ID NO 3347 | GAGAGGTGAGGGACTTGGGGGG | TTG | chr19 | 55113652 | 55113673 | 55113657 | 55113652 | - |
| SEQ ID NO 3348 | GGGGGGTAATTTATCCCGTGGA | CTT | chr19 | 55113636 | 55113657 | 55113641 | 55113636 | - |
| SEQ ID NO 3349 | GGGGGTAATTTATCCCGTGGAT | TTG | chr19 | 55113635 | 55113656 | 55113640 | 55113635 | - |
| SEQ ID NO 3350 | ATCCCGTGGATCTAGGAGTTTA | TTT | chr19 | 55113624 | 55113645 | 55113629 | 55113624 | - |
| SEQ ID NO 3351 | TCCCGTGGATCTAGGAGTTTAG | TTA | chr19 | 55113623 | 55113644 | 55113628 | 55113623 | - |
| SEQ ID NO 3352 | GGAGTTTAGCTTCACTCCTTCC | CTA | chr19 | 55113610 | 55113631 | 55113615 | 55113610 | - |
| SEQ ID NO 3353 | AGCTTCACTCCTTCCTCAGCTC | TTT | chr19 | 55113603 | 55113624 | 55113608 | 55113603 | - |
| SEQ ID NO 3354 | GCTTCACTCCTTCCTCAGCTCC | TTA | chr19 | 55113602 | 55113623 | 55113607 | 55113602 | - |
| SEQ ID NO 3355 | CACTCCTTCCTCAGCTCCAGTT | CTT | chr19 | 55113598 | 55113619 | 55113603 | 55113598 | - |
| SEQ ID NO 3356 | ACTCCTTCCTCAGCTCCAGTTC | TTC | chr19 | 55113597 | 55113618 | 55113602 | 55113597 | - |
| SEQ ID NO 3357 | CTTCCTCAGCTCCAGTTCAGGT | CTC | chr19 | 55113593 | 55113614 | 55113598 | 55113593 | - |
| SEQ ID NO 3358 | CCTCAGCTCCAGTTCAGGTCCC | CTT | chr19 | 55113590 | 55113611 | 55113595 | 55113590 | - |
| SEQ ID NO 3359 | CTCAGCTCCAGTTCAGGTCCCG | TTC | chr19 | 55113589 | 55113610 | 55113594 | 55113589 | - |
| SEQ ID NO 3360 | AGCTCCAGTTCAGGTCCCGGAG | CTC | chr19 | 55113586 | 55113607 | 55113591 | 55113586 | - |
| SEQ ID NO 3361 | CAGTTCAGGTCCCGGAGCCCAC | CTC | chr19 | 55113581 | 55113602 | 55113586 | 55113581 | - |
| SEQ ID NO 3362 | AGGTCCCGGAGCCCACCCAGTG | TTC | chr19 | 55113575 | 55113596 | 55113580 | 55113575 | - |
| SEQ ID NO 3363 | GGGCAAGTCCCTCCTCCGACCC | CTG | chr19 | 55113540 | 55113561 | 55113545 | 55113540 | - |
| SEQ ID NO 3364 | CTCCGACCCCTGGACTTCGGG | CTC | chr19 | 55113527 | 55113548 | 55113532 | 55113527 | - |
| SEQ ID NO 3365 | CGACCCCTGGACTTCGGCTTT | CTC | chr19 | 55113524 | 55113545 | 55113529 | 55113524 | - |
| SEQ ID NO 3366 | GACTTCGGCTTTTGTCCCCCCA | CTG | chr19 | 55113514 | 55113535 | 55113519 | 55113514 | - |

Figure 6 (Cont'd)

| SEQ ID NO 3367 | CGGCTTTTGTCCCCCCAAGTTT | CTT | chr19 | 55113509 | 55113530 | 55113514 | 55113509 | - |
|---|---|---|---|---|---|---|---|---|
| SEQ ID NO 3368 | GGCTTTTGTCCCCCCAAGTTTT | TTC | chr19 | 55113508 | 55113529 | 55113513 | 55113508 | - |
| SEQ ID NO 3369 | TTGTCCCCCCAAGTTTTGGACC | CTT | chr19 | 55113503 | 55113524 | 55113508 | 55113503 | - |
| SEQ ID NO 3370 | TGTCCCCCCAAGTTTTGGACCC | TTT | chr19 | 55113502 | 55113523 | 55113507 | 55113502 | - |
| SEQ ID NO 3371 | GTCCCCCCAAGTTTTGGACCCC | TTT | chr19 | 55113501 | 55113522 | 55113506 | 55113501 | - |
| SEQ ID NO 3372 | TCCCCCCAAGTTTTGGACCCCT | TTG | chr19 | 55113500 | 55113521 | 55113505 | 55113500 | - |
| SEQ ID NO 3373 | TGGACCCCTAAGGGAAGAATGA | TTT | chr19 | 55113487 | 55113508 | 55113492 | 55113487 | - |
| SEQ ID NO 3374 | GGACCCCTAAGGGAAGAATGAG | TTT | chr19 | 55113486 | 55113507 | 55113491 | 55113486 | - |
| SEQ ID NO 3375 | GACCCCTAAGGGAAGAATGAGA | TTG | chr19 | 55113485 | 55113506 | 55113490 | 55113485 | - |
| SEQ ID NO 3376 | AGGGAAGAATGAGAAACGGTGG | CTA | chr19 | 55113477 | 55113498 | 55113482 | 55113477 | - |
| SEQ ID NO 3377 | GCTGCAGGGCCCCGTGCAGAGG | CTG | chr19 | 55113439 | 55113460 | 55113444 | 55113439 | - |
| SEQ ID NO 3378 | CAGGGCCCCGTGCAGAGGGGGC | CTG | chr19 | 55113435 | 55113456 | 55113440 | 55113435 | - |
| SEQ ID NO 3379 | AGTGAACTGGAGTGTGACAGCC | CTC | chr19 | 55113410 | 55113431 | 55113415 | 55113410 | - |
| SEQ ID NO 3380 | GAGTGTGACAGCCTGGGGCCCA | CTG | chr19 | 55113401 | 55113422 | 55113406 | 55113401 | - |
| SEQ ID NO 3381 | GGGCCCAGGCACACAGGTGTGC | CTG | chr19 | 55113386 | 55113407 | 55113391 | 55113386 | - |
| SEQ ID NO 3382 | TCTCACCCCTCTGGGAGTCCCG | CTG | chr19 | 55113359 | 55113380 | 55113364 | 55113359 | - |
| SEQ ID NO 3383 | ACCCCTCTGGGAGTCCCGCCCA | CTC | chr19 | 55113355 | 55113376 | 55113360 | 55113355 | - |
| SEQ ID NO 3384 | TGGGAGTCCCGCCCAGGCCCCT | CTC | chr19 | 55113348 | 55113369 | 55113353 | 55113348 | - |
| SEQ ID NO 3385 | GGAGTCCCGCCCAGGCCCCTGA | CTG | chr19 | 55113346 | 55113367 | 55113351 | 55113346 | - |
| SEQ ID NO 3386 | AGTCTGTCCCAGCACAGGGTGG | CTG | chr19 | 55113325 | 55113346 | 55113330 | 55113325 | - |
| SEQ ID NO 3387 | TCCCAGCACAGGGTGGCCTTCC | CTG | chr19 | 55113319 | 55113340 | 55113324 | 55113319 | - |
| SEQ ID NO 3388 | CCTCCACCCTGCATAGCCCTGG | CTT | chr19 | 55113299 | 55113320 | 55113304 | 55113299 | - |
| SEQ ID NO 3389 | CTCCACCCTGCATAGCCCTGGG | TTC | chr19 | 55113298 | 55113319 | 55113303 | 55113298 | - |
| SEQ ID NO 3390 | CACCCTGCATAGCCCTGGGCCC | CTC | chr19 | 55113295 | 55113316 | 55113300 | 55113295 | - |
| SEQ ID NO 3391 | CATAGCCCTGGGCCCACGGCTT | CTG | chr19 | 55113288 | 55113309 | 55113293 | 55113288 | - |
| SEQ ID NO 3392 | GGCCCACGGCTTCGTTCCTGCA | CTG | chr19 | 55113278 | 55113299 | 55113283 | 55113278 | - |
| SEQ ID NO 3393 | CGTTCCTGCAGAGTATCTGCTG | CTT | chr19 | 55113266 | 55113287 | 55113271 | 55113266 | - |
| SEQ ID NO 3394 | GTTCCTGCAGAGTATCTGCTGG | TTC | chr19 | 55113265 | 55113286 | 55113270 | 55113265 | - |
| SEQ ID NO 3395 | CTGCAGAGTATCTGCTGGGGTG | TTC | chr19 | 55113261 | 55113282 | 55113266 | 55113261 | - |
| SEQ ID NO 3396 | CAGAGTATCTGCTGGGGTGGTT | CTG | chr19 | 55113258 | 55113279 | 55113263 | 55113258 | - |
| SEQ ID NO 3397 | CTGGGGTGGTTTCCGAGCTTGA | CTG | chr19 | 55113247 | 55113268 | 55113252 | 55113247 | - |
| SEQ ID NO 3398 | GGGTGGTTTCCGAGCTTGACCC | CTG | chr19 | 55113244 | 55113265 | 55113249 | 55113244 | - |
| SEQ ID NO 3399 | CCGAGCTTGACCCTTGGAAGGA | TTT | chr19 | 55113235 | 55113256 | 55113240 | 55113235 | - |
| SEQ ID NO 3400 | CGAGCTTGACCCTTGGAAGGAC | TTC | chr19 | 55113234 | 55113255 | 55113239 | 55113234 | - |
| SEQ ID NO 3401 | GACCCTTGGAAGGACCTGGCTG | CTT | chr19 | 55113227 | 55113248 | 55113232 | 55113227 | - |
| SEQ ID NO 3402 | ACCCTTGGAAGGACCTGGCTGG | TTG | chr19 | 55113226 | 55113247 | 55113231 | 55113226 | - |
| SEQ ID NO 3403 | GGAAGGACCTGGCTGGGTTTAA | CTT | chr19 | 55113220 | 55113241 | 55113225 | 55113220 | - |
| SEQ ID NO 3404 | GAAGGACCTGGCTGGGTTTAAG | TTG | chr19 | 55113219 | 55113240 | 55113224 | 55113219 | - |
| SEQ ID NO 3405 | GCTGGGTTTAAGGCAGGAGGGG | CTG | chr19 | 55113209 | 55113230 | 55113214 | 55113209 | - |
| SEQ ID NO 3406 | GGTTTAAGGCAGGAGGGGCTGG | CTG | chr19 | 55113205 | 55113226 | 55113210 | 55113205 | - |
| SEQ ID NO 3407 | AAGGCAGGAGGGGCTGGGGGCC | TTT | chr19 | 55113200 | 55113221 | 55113205 | 55113200 | - |
| SEQ ID NO 3408 | AGGCAGGAGGGGCTGGGGGCCA | TTA | chr19 | 55113199 | 55113220 | 55113204 | 55113199 | - |
| SEQ ID NO 3409 | GGGGCCAGGACTCCTGGCTCTG | CTG | chr19 | 55113184 | 55113205 | 55113189 | 55113184 | - |
| SEQ ID NO 3410 | CTGGCTCTGAAGGAGGAGGGGC | CTC | chr19 | 55113171 | 55113192 | 55113176 | 55113171 | - |
| SEQ ID NO 3411 | GCTCTGAAGGAGGAGGGGCTGG | CTG | chr19 | 55113168 | 55113189 | 55113173 | 55113168 | - |
| SEQ ID NO 3412 | TGAAGGAGGAGGGGCTGGAACC | CTC | chr19 | 55113164 | 55113185 | 55113169 | 55113164 | - |
| SEQ ID NO 3413 | AAGGAGGAGGGGCTGGAACCTC | CTG | chr19 | 55113162 | 55113183 | 55113167 | 55113162 | - |
| SEQ ID NO 3414 | GAACCTCTTCCCTAGTCTGAGC | CTG | chr19 | 55113147 | 55113168 | 55113152 | 55113147 | - |
| SEQ ID NO 3415 | TTCCCTAGTCTGAGCACTGGAA | CTC | chr19 | 55113140 | 55113161 | 55113145 | 55113140 | - |
| SEQ ID NO 3416 | CCCTAGTCTGAGCACTGGAAGC | CTT | chr19 | 55113138 | 55113159 | 55113143 | 55113138 | - |
| SEQ ID NO 3417 | CCTAGTCTGAGCACTGGAAGCG | TTC | chr19 | 55113137 | 55113158 | 55113142 | 55113137 | - |
| SEQ ID NO 3418 | GTCTGAGCACTGGAAGCGCCAC | CTA | chr19 | 55113133 | 55113154 | 55113138 | 55113133 | - |
| SEQ ID NO 3419 | AGCACTGGAAGCGCCACCTGTG | CTG | chr19 | 55113128 | 55113149 | 55113133 | 55113128 | - |
| SEQ ID NO 3420 | GAAGCGCCACCTGTGGGTGGTG | CTG | chr19 | 55113121 | 55113142 | 55113126 | 55113121 | - |
| SEQ ID NO 3421 | TGGGTGGTGACGGGGTTTTGC | CTG | chr19 | 55113108 | 55113129 | 55113113 | 55113108 | - |
| SEQ ID NO 3422 | TGCCGTGTCTAACAGGTACCAT | TTT | chr19 | 55113089 | 55113110 | 55113094 | 55113089 | - |
| SEQ ID NO 3423 | GCCGTGTCTAACAGGTACCATG | TTT | chr19 | 55113088 | 55113109 | 55113093 | 55113088 | - |
| SEQ ID NO 3424 | CCGTGTCTAACAGGTACCATGT | TTG | chr19 | 55113087 | 55113108 | 55113092 | 55113087 | - |
| SEQ ID NO 3425 | ACAGGTACCATGTGGGGTTCCC | CTA | chr19 | 55113078 | 55113099 | 55113083 | 55113078 | - |

Figure 6 (Cont'd)

| SEQ ID NO 3426 | CCGCACCCAGATGAGAAGCCCC | TTC | chr19 | 55113058 | 55113079 | 55113063 | 55113058 | - |
|---|---|---|---|---|---|---|---|---|
| SEQ ID NO 3427 | CCTTCCCCGTTCACTTCCTGTT | CTC | chr19 | 55113033 | 55113054 | 55113038 | 55113033 | - |
| SEQ ID NO 3428 | CCCCGTTCACTTCCTGTTTGCA | CTT | chr19 | 55113029 | 55113050 | 55113034 | 55113029 | - |
| SEQ ID NO 3429 | CCCGTTCACTTCCTGTTTGCAG | TTC | chr19 | 55113028 | 55113049 | 55113033 | 55113028 | - |
| SEQ ID NO 3430 | ACTTCCTGTTTGCAGATAGCCA | TTC | chr19 | 55113021 | 55113042 | 55113026 | 55113021 | - |
| SEQ ID NO 3431 | CCTGTTTGCAGATAGCCAGGAG | CTT | chr19 | 55113017 | 55113038 | 55113022 | 55113017 | - |
| SEQ ID NO 3432 | CTGTTTGCAGATAGCCAGGAGT | TTC | chr19 | 55113016 | 55113037 | 55113021 | 55113016 | - |
| SEQ ID NO 3433 | TTTGCAGATAGCCAGGAGTCCT | CTG | chr19 | 55113013 | 55113034 | 55113018 | 55113013 | - |
| SEQ ID NO 3434 | GCAGATAGCCAGGAGTCCTTTC | TTT | chr19 | 55113010 | 55113031 | 55113015 | 55113010 | - |
| SEQ ID NO 3435 | CAGATAGCCAGGAGTCCTTTCG | TTG | chr19 | 55113009 | 55113030 | 55113014 | 55113009 | - |
| SEQ ID NO 3436 | TCGTGGTTTCCACTGAGCACTG | CTT | chr19 | 55112990 | 55113011 | 55112995 | 55112990 | - |
| SEQ ID NO 3437 | CGTGGTTTCCACTGAGCACTGA | TTT | chr19 | 55112989 | 55113010 | 55112994 | 55112989 | - |
| SEQ ID NO 3438 | GTGGTTTCCACTGAGCACTGAA | TTC | chr19 | 55112988 | 55113009 | 55112993 | 55112988 | - |
| SEQ ID NO 3439 | CCACTGAGCACTGAAGGCCTGG | TTT | chr19 | 55112981 | 55113002 | 55112986 | 55112981 | - |
| SEQ ID NO 3440 | CACTGAGCACTGAAGGCCTGGC | TTC | chr19 | 55112980 | 55113001 | 55112985 | 55112980 | - |
| SEQ ID NO 3441 | AGCACTGAAGGCCTGGCCGGCC | CTG | chr19 | 55112975 | 55112996 | 55112980 | 55112975 | - |
| SEQ ID NO 3442 | AAGGCCTGGCCGGCCTGACCAC | CTG | chr19 | 55112968 | 55112989 | 55112973 | 55112968 | - |
| SEQ ID NO 3443 | GCCGGCCTGACCACTGGGCAAC | CTG | chr19 | 55112960 | 55112981 | 55112965 | 55112960 | - |
| SEQ ID NO 3444 | ACCACTGGGCAACCAGGCGTAT | CTG | chr19 | 55112951 | 55112972 | 55112956 | 55112951 | - |
| SEQ ID NO 3445 | GGCAACCAGGCGTATCTTAAAC | CTG | chr19 | 55112944 | 55112965 | 55112949 | 55112944 | - |
| SEQ ID NO 3446 | AAACAGCCAGTGGCCAGAGGCT | CTT | chr19 | 55112926 | 55112947 | 55112931 | 55112926 | - |
| SEQ ID NO 3447 | AACAGCCAGTGGCCAGAGGCTG | TTA | chr19 | 55112925 | 55112946 | 55112930 | 55112925 | - |
| SEQ ID NO 3448 | TTGGGTCATTTTCCCCACTGTC | CTG | chr19 | 55112903 | 55112924 | 55112908 | 55112903 | - |
| SEQ ID NO 3449 | GGTCATTTTCCCCACTGTCCTA | TTG | chr19 | 55112900 | 55112921 | 55112905 | 55112900 | - |
| SEQ ID NO 3450 | TCCCCACTGTCCTAGCACCGTG | TTT | chr19 | 55112892 | 55112913 | 55112897 | 55112892 | - |
| SEQ ID NO 3451 | CCCCACTGTCCTAGCACCGTGT | TTT | chr19 | 55112891 | 55112912 | 55112896 | 55112891 | - |
| SEQ ID NO 3452 | CCCACTGTCCTAGCACCGTGTC | TTC | chr19 | 55112890 | 55112911 | 55112895 | 55112890 | - |
| SEQ ID NO 3453 | TCCTAGCACCGTGTCCCTGGAT | CTG | chr19 | 55112883 | 55112904 | 55112888 | 55112883 | - |
| SEQ ID NO 3454 | GCACCGTGTCCCTGGATCTGTT | CTA | chr19 | 55112878 | 55112899 | 55112883 | 55112878 | - |
| SEQ ID NO 3455 | GATCTGTTTTCGTGGCTCCCTC | CTG | chr19 | 55112864 | 55112885 | 55112869 | 55112864 | - |
| SEQ ID NO 3456 | TTTTCGTGGCTCCCTCTGGAGT | CTG | chr19 | 55112858 | 55112879 | 55112863 | 55112858 | - |
| SEQ ID NO 3457 | TCGTGGCTCCCTCTGGAGTCCC | TTT | chr19 | 55112855 | 55112876 | 55112860 | 55112855 | - |
| SEQ ID NO 3458 | CGTGGCTCCCTCTGGAGTCCCG | TTT | chr19 | 55112854 | 55112875 | 55112859 | 55112854 | - |
| SEQ ID NO 3459 | GTGGCTCCCTCTGGAGTCCCGA | TTC | chr19 | 55112853 | 55112874 | 55112858 | 55112853 | - |
| SEQ ID NO 3460 | CCTCTGGAGTCCCGACTTGCTG | CTC | chr19 | 55112846 | 55112867 | 55112851 | 55112846 | - |
| SEQ ID NO 3461 | TGGAGTCCCGACTTGCTGGGAC | CTC | chr19 | 55112842 | 55112863 | 55112847 | 55112842 | - |
| SEQ ID NO 3462 | GAGTCCCGACTTGCTGGGACAC | CTG | chr19 | 55112840 | 55112861 | 55112845 | 55112840 | - |
| SEQ ID NO 3463 | GCTGGGACACCGTGGCTGGGGT | CTT | chr19 | 55112828 | 55112849 | 55112833 | 55112828 | - |
| SEQ ID NO 3464 | CTGGGACACCGTGGCTGGGGTA | TTG | chr19 | 55112827 | 55112848 | 55112832 | 55112827 | - |
| SEQ ID NO 3465 | GGACACCGTGGCTGGGGTAGGT | CTG | chr19 | 55112824 | 55112845 | 55112829 | 55112824 | - |
| SEQ ID NO 3466 | GGGTAGGTGCGGCTGACGGCTG | CTG | chr19 | 55112810 | 55112831 | 55112815 | 55112810 | - |
| SEQ ID NO 3467 | ACGGCTGTTTCCCACCCCAGG | CTG | chr19 | 55112795 | 55112816 | 55112800 | 55112795 | - |
| SEQ ID NO 3468 | TTTCCCACCCCAGGCCTGCAT | CTG | chr19 | 55112788 | 55112809 | 55112793 | 55112788 | - |
| SEQ ID NO 3469 | CCCACCCCAGGCCTGCATTGA | TTT | chr19 | 55112785 | 55112806 | 55112790 | 55112785 | - |
| SEQ ID NO 3470 | CCACCCCAGGCCTGCATTGAT | TTC | chr19 | 55112784 | 55112805 | 55112789 | 55112784 | - |
| SEQ ID NO 3471 | CATTGATGAGAACCTGGAGGTG | CTG | chr19 | 55112769 | 55112790 | 55112774 | 55112769 | - |
| SEQ ID NO 3472 | ATGAGAACCTGGAGGTGGTGCG | TTG | chr19 | 55112764 | 55112785 | 55112769 | 55112764 | - |
| SEQ ID NO 3473 | GAGGTGGTGCGCTTCTTGGTGG | CTG | chr19 | 55112753 | 55112774 | 55112758 | 55112753 | - |
| SEQ ID NO 3474 | CTTGGTGGAGCAGGGCGCCACT | CTT | chr19 | 55112739 | 55112760 | 55112744 | 55112739 | - |
| SEQ ID NO 3475 | TTGGTGGAGCAGGGCGCCACTG | TTC | chr19 | 55112738 | 55112759 | 55112743 | 55112738 | - |
| SEQ ID NO 3476 | GGTGGAGCAGGGCGCCACTGTG | CTT | chr19 | 55112736 | 55112757 | 55112741 | 55112736 | - |
| SEQ ID NO 3477 | GTGGAGCAGGGCGCCACTGTGA | TTG | chr19 | 55112735 | 55112756 | 55112740 | 55112735 | - |
| SEQ ID NO 3478 | TGAACCAGGCAGACAACGAGGG | CTG | chr19 | 55112716 | 55112737 | 55112721 | 55112716 | - |
| SEQ ID NO 3479 | GACGCCACTGCACGTGGCCGCC | CTG | chr19 | 55112691 | 55112712 | 55112696 | 55112691 | - |
| SEQ ID NO 3480 | CACGTGGCCGCCTCCTGTGGCT | CTG | chr19 | 55112681 | 55112702 | 55112686 | 55112681 | - |
| SEQ ID NO 3481 | CTGTGGCTACCTAGATATCGCC | CTC | chr19 | 55112667 | 55112688 | 55112672 | 55112667 | - |

Figure 7

| # | Sequence | PAM | Chr | Start | End | Cuts 5' of | Str |
|---|---|---|---|---|---|---|---|
| SEQ ID NO 3482 | TAATTTCCCTCCGTTTGTCC | TAG | chr4 | 73404268 | 73404287 | 73404284 | + |
| SEQ ID NO 3483 | CTGTCAACCCCACACGCCTT | TGG | chr4 | 73404301 | 73404320 | 73404317 | + |
| SEQ ID NO 3484 | CACACGCCTTTGGCACAATG | AAG | chr4 | 73404311 | 73404330 | 73404327 | + |
| SEQ ID NO 3485 | ACGCCTTTGGCACAATGAAG | TGG | chr4 | 73404314 | 73404333 | 73404330 | + |
| SEQ ID NO 3486 | CGCCTTTGGCACAATGAAGT | GGG | chr4 | 73404315 | 73404334 | 73404331 | + |
| SEQ ID NO 3487 | ATTTCCCTTCTTTTTCTCTT | TAG | chr4 | 73404346 | 73404365 | 73404362 | + |
| SEQ ID NO 3488 | CCTTCTTTTTCTCTTTAGCT | CGG | chr4 | 73404351 | 73404370 | 73404367 | + |
| SEQ ID NO 3489 | CTCTTTAGCTCGGCTTATTC | CAG | chr4 | 73404361 | 73404380 | 73404377 | + |
| SEQ ID NO 3490 | TCTTTAGCTCGGCTTATTCC | AGG | chr4 | 73404362 | 73404381 | 73404378 | + |
| SEQ ID NO 3491 | CTTTAGCTCGGCTTATTCCA | GGG | chr4 | 73404363 | 73404382 | 73404379 | + |
| SEQ ID NO 3492 | TTTAGCTCGGCTTATTCCAG | GGG | chr4 | 73404364 | 73404383 | 73404380 | + |
| SEQ ID NO 3493 | TTCCAGGGGTGTGTTTCGTC | GAG | chr4 | 73404378 | 73404397 | 73404394 | + |
| SEQ ID NO 3494 | TGTTTCGTCGAGATGCACGT | AAG | chr4 | 73404389 | 73404408 | 73404405 | + |
| SEQ ID NO 3495 | CAACTTTTATTCTATTTTCC | CAG | chr4 | 73404432 | 73404451 | 73404448 | + |
| SEQ ID NO 3496 | TCTATTTTCCCAGTAAAATA | AAG | chr4 | 73404442 | 73404461 | 73404458 | + |
| SEQ ID NO 3497 | TTCCCAGTAAAATAAAGTTT | TAG | chr4 | 73404448 | 73404467 | 73404464 | + |
| SEQ ID NO 3498 | TAGTAAACTCTGCATCTTTA | AAG | chr4 | 73404468 | 73404487 | 73404484 | + |
| SEQ ID NO 3499 | GCATCTTTAAAGAATTATTT | TGG | chr4 | 73404479 | 73404498 | 73404495 | + |
| SEQ ID NO 3500 | TTTGGCATTTATTTCTAAAA | TGG | chr4 | 73404497 | 73404516 | 73404513 | + |
| SEQ ID NO 3501 | CATTTATTTCTAAAATGGCA | TAG | chr4 | 73404502 | 73404521 | 73404518 | + |
| SEQ ID NO 3502 | CATAGTATTTTGTATTTGTG | AAG | chr4 | 73404520 | 73404539 | 73404536 | + |
| SEQ ID NO 3503 | TTGTATTTGTGAAGTCTTAC | AAG | chr4 | 73404529 | 73404548 | 73404545 | + |
| SEQ ID NO 3504 | TGTATTTGTGAAGTCTTACA | AGG | chr4 | 73404530 | 73404549 | 73404546 | + |
| SEQ ID NO 3505 | TTAATAAAATTCAAACATCC | TAG | chr4 | 73404561 | 73404580 | 73404577 | + |
| SEQ ID NO 3506 | TAATAAAATTCAAACATCCT | AGG | chr4 | 73404562 | 73404581 | 73404578 | + |
| SEQ ID NO 3507 | ATCCTAGGTAAAAAAAAAAA | AAG | chr4 | 73404577 | 73404596 | 73404593 | + |
| SEQ ID NO 3508 | TCCTAGGTAAAAAAAAAAAA | AGG | chr4 | 73404578 | 73404597 | 73404594 | + |
| SEQ ID NO 3509 | AGGTAAAAAAAAAAAAAGGT | CAG | chr4 | 73404582 | 73404601 | 73404598 | + |
| SEQ ID NO 3510 | AAAAAAGGTCAGAATTGTT | TAG | chr4 | 73404592 | 73404611 | 73404608 | + |
| SEQ ID NO 3511 | GTAATTTTCTTTTGCGCACT | AAG | chr4 | 73404620 | 73404639 | 73404636 | + |
| SEQ ID NO 3512 | TAATTTTCTTTTGCGCACTA | AGG | chr4 | 73404621 | 73404640 | 73404637 | + |
| SEQ ID NO 3513 | TTTCTTTTGCGCACTAAGGA | AAG | chr4 | 73404625 | 73404644 | 73404641 | + |
| SEQ ID NO 3514 | TGCGCACTAAGGAAAGTGCA | AAG | chr4 | 73404632 | 73404651 | 73404648 | + |
| SEQ ID NO 3515 | AAGGAAAGTGCAAAGTAACT | TAG | chr4 | 73404640 | 73404659 | 73404656 | + |
| SEQ ID NO 3516 | GGAAAGTGCAAAGTAACTTA | GAG | chr4 | 73404642 | 73404661 | 73404658 | + |
| SEQ ID NO 3517 | TTAGAGTGACTGAAACTTCA | CAG | chr4 | 73404659 | 73404678 | 73404675 | + |
| SEQ ID NO 3518 | GTGACTGAAACTTCACAGAA | TAG | chr4 | 73404664 | 73404683 | 73404680 | + |
| SEQ ID NO 3519 | TGACTGAAACTTCACAGAAT | AGG | chr4 | 73404665 | 73404684 | 73404681 | + |
| SEQ ID NO 3520 | GACTGAAACTTCACAGAATA | GGG | chr4 | 73404666 | 73404685 | 73404682 | + |
| SEQ ID NO 3521 | AACTTCACAGAATAGGGTTG | AAG | chr4 | 73404672 | 73404691 | 73404688 | + |
| SEQ ID NO 3522 | TTGAATTCATAACTATCCCA | AAG | chr4 | 73404696 | 73404715 | 73404712 | + |
| SEQ ID NO 3523 | TGTGCTGTTGATCTCATAAA | TAG | chr4 | 73404761 | 73404780 | 73404777 | + |
| SEQ ID NO 3524 | ATTTATATTTATTTTCATTT | TAG | chr4 | 73404791 | 73404810 | 73404807 | + |
| SEQ ID NO 3525 | TTCATTTAGTCTGTCTTCT | TGG | chr4 | 73404804 | 73404823 | 73404820 | + |
| SEQ ID NO 3526 | GTCTTCTTGGTTGCTGTTGA | TAG | chr4 | 73404817 | 73404836 | 73404833 | + |
| SEQ ID NO 3527 | TTGCTGTTGATAGACACTAA | AAG | chr4 | 73404827 | 73404846 | 73404843 | + |

Figure 7 (Cont'd)

| | | | | | | | |
|---|---|---|---|---|---|---|---|
| SEQ ID NO 3528 | GCTGTTGATAGACACTAAAA | GAG | chr4 | 73404829 | 73404848 | 73404845 | + |
| SEQ ID NO 3529 | GATAGACACTAAAAGAGTAT | TAG | chr4 | 73404835 | 73404854 | 73404851 | + |
| SEQ ID NO 3530 | AAGAGTATTAGATATTATCT | AAG | chr4 | 73404847 | 73404866 | 73404863 | + |
| SEQ ID NO 3531 | TATTATCTAAGTTTGAATAT | AAG | chr4 | 73404859 | 73404878 | 73404875 | + |
| SEQ ID NO 3532 | ATTATCTAAGTTTGAATATA | AGG | chr4 | 73404860 | 73404879 | 73404876 | + |
| SEQ ID NO 3533 | ATATTTAATAATTTTTAAAA | TAG | chr4 | 73404889 | 73404908 | 73404905 | + |
| SEQ ID NO 3534 | AATTTTTAAAATAGTATTCT | TGG | chr4 | 73404898 | 73404917 | 73404914 | + |
| SEQ ID NO 3535 | TTGAATTATTCTTCTGTTTA | AAG | chr4 | 73404924 | 73404943 | 73404940 | + |
| SEQ ID NO 3536 | TGAATTATTCTTCTGTTTAA | AGG | chr4 | 73404925 | 73404944 | 73404941 | + |
| SEQ ID NO 3537 | ATTATTCTTCTGTTTAAAGG | CAG | chr4 | 73404928 | 73404947 | 73404944 | + |
| SEQ ID NO 3538 | ATTCTTCTGTTTAAAGGCAG | AAG | chr4 | 73404931 | 73404950 | 73404947 | + |
| SEQ ID NO 3539 | AAATAATTGAACATCATCCT | GAG | chr4 | 73404954 | 73404973 | 73404970 | + |
| SEQ ID NO 3540 | CATCATCCTGAGTTTTTCTG | TAG | chr4 | 73404965 | 73404984 | 73404981 | + |
| SEQ ID NO 3541 | ATCATCCTGAGTTTTTCTGT | AGG | chr4 | 73404966 | 73404985 | 73404982 | + |
| SEQ ID NO 3542 | CTGAGTTTTTCTGTAGGAAT | CAG | chr4 | 73404972 | 73404991 | 73404988 | + |
| SEQ ID NO 3543 | GAGTTTTTCTGTAGGAATCA | GAG | chr4 | 73404974 | 73404993 | 73404990 | + |
| SEQ ID NO 3544 | TTGAAACAAATGCATAATCT | AAG | chr4 | 73405006 | 73405025 | 73405022 | + |
| SEQ ID NO 3545 | AATGCATAATCTAAGTCAAA | TGG | chr4 | 73405014 | 73405033 | 73405030 | + |
| SEQ ID NO 3546 | CATAATCTAAGTCAAATGGA | AAG | chr4 | 73405018 | 73405037 | 73405034 | + |
| SEQ ID NO 3547 | CAAATGGAAAGAAATATAAA | AAG | chr4 | 73405030 | 73405049 | 73405046 | + |
| SEQ ID NO 3548 | TTATTACTTCTTGTTTTCTT | CAG | chr4 | 73405058 | 73405077 | 73405074 | + |
| SEQ ID NO 3549 | CTTTTTTTTCTTCCCTTGCC | CAG | chr4 | 73405093 | 73405112 | 73405109 | + |
| SEQ ID NO 3550 | TTTCTTCCCTTGCCCAGAC | AAG | chr4 | 73405098 | 73405117 | 73405114 | + |
| SEQ ID NO 3551 | TTCTTCCCTTGCCCAGACAA | GAG | chr4 | 73405100 | 73405119 | 73405116 | + |
| SEQ ID NO 3552 | TCCCTTGCCCAGACAAGAGT | GAG | chr4 | 73405104 | 73405123 | 73405120 | + |
| SEQ ID NO 3553 | CCCTTGCCCAGACAAGAGTG | AGG | chr4 | 73405105 | 73405124 | 73405121 | + |
| SEQ ID NO 3554 | ACAAGAGTGAGGTTGCTCAT | CGG | chr4 | 73405116 | 73405135 | 73405132 | + |
| SEQ ID NO 3555 | TGAGGTTGCTCATCGGTTTA | AAG | chr4 | 73405123 | 73405142 | 73405139 | + |
| SEQ ID NO 3556 | TGCTCATCGGTTTAAAGATT | TGG | chr4 | 73405129 | 73405148 | 73405145 | + |
| SEQ ID NO 3557 | GCTCATCGGTTTAAAGATTT | GGG | chr4 | 73405130 | 73405149 | 73405146 | + |
| SEQ ID NO 3558 | TCATCGGTTTAAAGATTTGG | GAG | chr4 | 73405132 | 73405151 | 73405148 | + |
| SEQ ID NO 3559 | TCGGTTTAAAGATTTGGGAG | AAG | chr4 | 73405135 | 73405154 | 73405151 | + |
| SEQ ID NO 3560 | TTTGGGAGAAGAAAATTTCA | AAG | chr4 | 73405147 | 73405166 | 73405163 | + |
| SEQ ID NO 3561 | TCCCAAATCTTTAAACCGAT | GAG | chr4 | 73405134 | 73405153 | 73405137 | - |
| SEQ ID NO 3562 | TGAGCAACCTCACTCTTGTC | TGG | chr4 | 73405115 | 73405134 | 73405118 | - |
| SEQ ID NO 3563 | GAGCAACCTCACTCTTGTCT | GGG | chr4 | 73405114 | 73405133 | 73405117 | - |
| SEQ ID NO 3564 | AACCTCACTCTTGTCTGGGC | AAG | chr4 | 73405110 | 73405129 | 73405113 | - |
| SEQ ID NO 3565 | ACCTCACTCTTGTCTGGGCA | AGG | chr4 | 73405109 | 73405128 | 73405112 | - |
| SEQ ID NO 3566 | CCTCACTCTTGTCTGGGCAA | GGG | chr4 | 73405108 | 73405127 | 73405111 | - |
| SEQ ID NO 3567 | CACTCTTGTCTGGGCAAGGG | AAG | chr4 | 73405105 | 73405124 | 73405108 | - |
| SEQ ID NO 3568 | CTGGGCAAGGGAAGAAAAAA | AAG | chr4 | 73405096 | 73405115 | 73405099 | - |
| SEQ ID NO 3569 | TGGGCAAGGGAAGAAAAAAA | AGG | chr4 | 73405095 | 73405114 | 73405098 | - |
| SEQ ID NO 3570 | AAAAGGATTGTTAAATACTG | AAG | chr4 | 73405078 | 73405097 | 73405081 | - |
| SEQ ID NO 3571 | TGTTAAATACTGAAGAAAAC | AAG | chr4 | 73405070 | 73405089 | 73405073 | - |
| SEQ ID NO 3572 | TAAATACTGAAGAAAACAAG | AAG | chr4 | 73405067 | 73405086 | 73405070 | - |
| SEQ ID NO 3573 | ATATTTCTTTCCATTTGACT | TAG | chr4 | 73405027 | 73405046 | 73405030 | - |
| SEQ ID NO 3574 | ATGCATTTGTTTCAAAATAT | TGG | chr4 | 73405001 | 73405020 | 73405004 | - |

Figure 7 (Cont'd)

| | | | | | | | |
|---|---|---|---|---|---|---|---|
| SEQ ID NO 3575 | TGCATTTGTTTCAAAATATT | GGG | chr4 | 73405000 | 73405019 | 73405003 | - |
| SEQ ID NO 3576 | ATATTGGGCTCTGATTCCTA | CAG | chr4 | 73404985 | 73405004 | 73404988 | - |
| SEQ ID NO 3577 | CTGATTCCTACAGAAAAACT | CAG | chr4 | 73404975 | 73404994 | 73404978 | - |
| SEQ ID NO 3578 | TGATTCCTACAGAAAAACTC | AGG | chr4 | 73404974 | 73404993 | 73404977 | - |
| SEQ ID NO 3579 | TTATTTCTTCTGCCTTTAAA | CAG | chr4 | 73404940 | 73404959 | 73404943 | - |
| SEQ ID NO 3580 | TTTCTTCTGCCTTTAAACAG | AAG | chr4 | 73404937 | 73404956 | 73404940 | - |
| SEQ ID NO 3581 | AGAAGAATAATTCAATTACC | AAG | chr4 | 73404919 | 73404938 | 73404922 | - |
| SEQ ID NO 3582 | TAAAAATTATTAAATATTTA | TAG | chr4 | 73404886 | 73404905 | 73404889 | - |
| SEQ ID NO 3583 | TATAGCCTTATATTCAAACT | TAG | chr4 | 73404868 | 73404887 | 73404871 | - |
| SEQ ID NO 3584 | GATAATATCTAATACTCTTT | TAG | chr4 | 73404846 | 73404865 | 73404849 | - |
| SEQ ID NO 3585 | ACTCTTTTAGTGTCTATCAA | CAG | chr4 | 73404833 | 73404852 | 73404836 | - |
| SEQ ID NO 3586 | AGTGTCTATCAACAGCAACC | AAG | chr4 | 73404825 | 73404844 | 73404828 | - |
| SEQ ID NO 3587 | GTCTATCAACAGCAACCAAG | AAG | chr4 | 73404822 | 73404841 | 73404825 | - |
| SEQ ID NO 3588 | ATCAACAGCAACCAAGAAGA | CAG | chr4 | 73404818 | 73404837 | 73404821 | - |
| SEQ ID NO 3589 | ATGAAAATAAATATAAATAC | AAG | chr4 | 73404789 | 73404808 | 73404792 | - |
| SEQ ID NO 3590 | TAAATACAAGTTCTATTTAT | GAG | chr4 | 73404776 | 73404795 | 73404779 | - |
| SEQ ID NO 3591 | AGTTCTATTTATGAGATCAA | CAG | chr4 | 73404768 | 73404787 | 73404771 | - |
| SEQ ID NO 3592 | TATTTATGAGATCAACAGCA | CAG | chr4 | 73404763 | 73404782 | 73404766 | - |
| SEQ ID NO 3593 | ATTTATGAGATCAACAGCAC | AGG | chr4 | 73404762 | 73404781 | 73404765 | - |
| SEQ ID NO 3594 | GATCAACAGCACAGGTTTTG | TGG | chr4 | 73404754 | 73404773 | 73404757 | - |
| SEQ ID NO 3595 | GGTTTTGTGGTTTTAAATA | AAG | chr4 | 73404741 | 73404760 | 73404744 | - |
| SEQ ID NO 3596 | TGTGGTTTTAAATAAAGCA | TAG | chr4 | 73404736 | 73404755 | 73404739 | - |
| SEQ ID NO 3597 | TTAAATAAAGCATAGTGCAA | TGG | chr4 | 73404728 | 73404747 | 73404731 | - |
| SEQ ID NO 3598 | ATAAAGCATAGTGCAATGGA | TAG | chr4 | 73404724 | 73404743 | 73404727 | - |
| SEQ ID NO 3599 | TAAAGCATAGTGCAATGGAT | AGG | chr4 | 73404723 | 73404742 | 73404726 | - |
| SEQ ID NO 3600 | TAGTGCAATGGATAGGTCTT | TGG | chr4 | 73404716 | 73404735 | 73404719 | - |
| SEQ ID NO 3601 | AGTGCAATGGATAGGTCTTT | GGG | chr4 | 73404715 | 73404734 | 73404718 | - |
| SEQ ID NO 3602 | CAATGGATAGGTCTTTGGGA | TAG | chr4 | 73404711 | 73404730 | 73404714 | - |
| SEQ ID NO 3603 | ATCTTCAACCCTATTCTGTG | AAG | chr4 | 73404677 | 73404696 | 73404680 | - |
| SEQ ID NO 3604 | AACCCTATTCTGTGAAGTTT | CAG | chr4 | 73404671 | 73404690 | 73404674 | - |
| SEQ ID NO 3605 | TGTGAAGTTTCAGTCACTCT | AAG | chr4 | 73404661 | 73404680 | 73404664 | - |
| SEQ ID NO 3606 | AAGTTACTTTGCACTTTCCT | TAG | chr4 | 73404641 | 73404660 | 73404644 | - |
| SEQ ID NO 3607 | GCACTTTCCTTAGTGCGAA | AAG | chr4 | 73404631 | 73404650 | 73404634 | - |
| SEQ ID NO 3608 | TAGTGCGCAAAAGAAAATTA | CAG | chr4 | 73404621 | 73404640 | 73404624 | - |
| SEQ ID NO 3609 | GACCTTTTTTTTTTTTACC | TAG | chr4 | 73404583 | 73404602 | 73404586 | - |
| SEQ ID NO 3610 | ACCTTTTTTTTTTTTACCT | AGG | chr4 | 73404582 | 73404601 | 73404585 | - |
| SEQ ID NO 3611 | GATGTTGAATTTTATTAAT | AAG | chr4 | 73404560 | 73404579 | 73404563 | - |
| SEQ ID NO 3612 | TATTAATAAGATAACCTTGT | AAG | chr4 | 73404547 | 73404566 | 73404550 | - |
| SEQ ID NO 3613 | TACAAAATACTATGCCATTT | TAG | chr4 | 73404514 | 73404533 | 73404517 | - |
| SEQ ID NO 3614 | AATGCCAAAATAATTCTTTA | AAG | chr4 | 73404486 | 73404505 | 73404489 | - |
| SEQ ID NO 3615 | AAAATAATTCTTTAAAGATG | CAG | chr4 | 73404480 | 73404499 | 73404483 | - |
| SEQ ID NO 3616 | AATAATTCTTTAAAGATGCA | GAG | chr4 | 73404478 | 73404497 | 73404481 | - |
| SEQ ID NO 3617 | TTACTAAAACTTTATTTTAC | TGG | chr4 | 73404454 | 73404473 | 73404457 | - |
| SEQ ID NO 3618 | TACTAAAACTTTATTTTACT | GGG | chr4 | 73404453 | 73404472 | 73404456 | - |
| SEQ ID NO 3619 | ACTTTATTTTACTGGGAAAA | TAG | chr4 | 73404446 | 73404465 | 73404449 | - |
| SEQ ID NO 3620 | TTACTGGGAAAATAGAATAA | AAG | chr4 | 73404438 | 73404457 | 73404441 | - |
| SEQ ID NO 3621 | ATAGAATAAAAGTTGAACAA | TAG | chr4 | 73404427 | 73404446 | 73404430 | - |

Figure 7 (Cont'd)

| SEQ ID NO 3622 | AAAGTTGAACAATAGAAAAA | TGG | chr4 | 73404419 | 73404438 | 73404422 | - |
| SEQ ID NO 3623 | ATCTCGACGAAACACACCCC | TGG | chr4 | 73404383 | 73404402 | 73404386 | - |
| SEQ ID NO 3624 | ACGAAACACACCCCTGGAAT | AAG | chr4 | 73404377 | 73404396 | 73404380 | - |
| SEQ ID NO 3625 | ACACCCCTGGAATAAGCC | GAG | chr4 | 73404372 | 73404391 | 73404375 | - |
| SEQ ID NO 3626 | CCCTGGAATAAGCCGAGCTA | AAG | chr4 | 73404366 | 73404385 | 73404369 | - |
| SEQ ID NO 3627 | CTGGAATAAGCCGAGCTAAA | GAG | chr4 | 73404364 | 73404383 | 73404367 | - |
| SEQ ID NO 3628 | TAAGCCGAGCTAAAGAGAAA | AAG | chr4 | 73404358 | 73404377 | 73404361 | - |
| SEQ ID NO 3629 | GCCGAGCTAAAGAGAAAAAG | AAG | chr4 | 73404355 | 73404374 | 73404358 | - |
| SEQ ID NO 3630 | CCGAGCTAAAGAGAAAAGA | AGG | chr4 | 73404354 | 73404373 | 73404357 | - |
| SEQ ID NO 3631 | CGAGCTAAAGAGAAAAGAA | GGG | chr4 | 73404353 | 73404372 | 73404356 | - |
| SEQ ID NO 3632 | AGAGAAAAGAAGGGAAATA | AAG | chr4 | 73404345 | 73404364 | 73404348 | - |
| SEQ ID NO 3633 | GAGAAAAGAAGGGAAATAA | AGG | chr4 | 73404344 | 73404363 | 73404347 | - |
| SEQ ID NO 3634 | TTACCCACTTCATTGTGCCA | AAG | chr4 | 73404321 | 73404340 | 73404324 | - |
| SEQ ID NO 3635 | TACCCACTTCATTGTGCCAA | AGG | chr4 | 73404320 | 73404339 | 73404323 | - |
| SEQ ID NO 3636 | TTCATTGTGCCAAAGGCGTG | TGG | chr4 | 73404313 | 73404332 | 73404316 | - |
| SEQ ID NO 3637 | TCATTGTGCCAAAGGCGTGT | GGG | chr4 | 73404312 | 73404331 | 73404315 | - |
| SEQ ID NO 3638 | CATTGTGCCAAAGGCGTGTG | GGG | chr4 | 73404311 | 73404330 | 73404314 | - |
| SEQ ID NO 3639 | CCAAAGGCGTGTGGGGTTGA | CAG | chr4 | 73404304 | 73404323 | 73404307 | - |
| SEQ ID NO 3640 | AAGGCGTGTGGGGTTGACAG | AAG | chr4 | 73404301 | 73404320 | 73404304 | - |
| SEQ ID NO 3641 | GGCGTGTGGGGTTGACAGAA | GAG | chr4 | 73404299 | 73404318 | 73404302 | - |
| SEQ ID NO 3642 | GTGGGGTTGACAGAAGAGAA | AAG | chr4 | 73404294 | 73404313 | 73404297 | - |
| SEQ ID NO 3643 | GGTTGACAGAAGAGAAAAGC | TAG | chr4 | 73404290 | 73404309 | 73404293 | - |
| SEQ ID NO 3644 | GTTGACAGAAGAGAAAAGCT | AGG | chr4 | 73404289 | 73404308 | 73404292 | - |
| SEQ ID NO 3645 | AAGAGAAAAGCTAGGACAAA | CGG | chr4 | 73404281 | 73404300 | 73404284 | - |
| SEQ ID NO 3646 | GAGAAAAGCTAGGACAAACG | GAG | chr4 | 73404279 | 73404298 | 73404282 | - |
| SEQ ID NO 3647 | AGAAAAGCTAGGACAAACGG | AGG | chr4 | 73404278 | 73404297 | 73404281 | - |
| SEQ ID NO 3648 | GAAAAGCTAGGACAAACGGA | GGG | chr4 | 73404277 | 73404296 | 73404280 | - |
| SEQ ID NO 3649 | TAGGACAAACGGAGGGAAAT | TAG | chr4 | 73404270 | 73404289 | 73404273 | - |

Figure 8

| # | Sequence | PAM | Chr | Start | End | Cuts 5' of | Str |
|---|---|---|---|---|---|---|---|
| SEQ ID NO 3650 | CACGCCTTTGGCACAATGAA | GTGGGT | chr4 | 73404313 | 73404332 | 73404329 | + |
| SEQ ID NO 3651 | TCTTTAGCTCGGCTTATTCC | AGGGGT | chr4 | 73404362 | 73404381 | 73404378 | + |
| SEQ ID NO 3652 | TAGTAAACTCTGCATCTTTA | AAGAAT | chr4 | 73404468 | 73404487 | 73404484 | + |
| SEQ ID NO 3653 | AGGTAAAAAAAAAAAAAGGT | CAGAAT | chr4 | 73404582 | 73404601 | 73404598 | + |
| SEQ ID NO 3654 | AAGGAAAGTGCAAAGTAACT | TAGAGT | chr4 | 73404640 | 73404659 | 73404656 | + |
| SEQ ID NO 3655 | TTAGAGTGACTGAAACTTCA | CAGAAT | chr4 | 73404659 | 73404678 | 73404675 | + |
| SEQ ID NO 3656 | GTGACTGAAACTTCACAGAA | TAGGGT | chr4 | 73404664 | 73404683 | 73404680 | + |
| SEQ ID NO 3657 | TCACAGAATAGGGTTGAAGA | TTGAAT | chr4 | 73404676 | 73404695 | 73404692 | + |
| SEQ ID NO 3658 | TTGCTGTTGATAGACACTAA | AAGAGT | chr4 | 73404827 | 73404846 | 73404843 | + |
| SEQ ID NO 3659 | GTATTAGATATTATCTAAGT | TTGAAT | chr4 | 73404851 | 73404870 | 73404867 | + |
| SEQ ID NO 3660 | TAAAATAGTATTCTTGGTAA | TTGAAT | chr4 | 73404904 | 73404923 | 73404920 | + |
| SEQ ID NO 3661 | AGAAATAATTGAACATCATC | CTGAGT | chr4 | 73404952 | 73404971 | 73404968 | + |
| SEQ ID NO 3662 | ATCATCCTGAGTTTTTCTGT | AGGAAT | chr4 | 73404966 | 73404985 | 73404982 | + |
| SEQ ID NO 3663 | TTTTCTTCCCTTGCCCAGAC | AAGAGT | chr4 | 73405098 | 73405117 | 73405114 | + |
| SEQ ID NO 3664 | CTGGGCAAGGGAAGAAAAAA | AAGGAT | chr4 | 73405096 | 73405115 | 73405099 | - |
| SEQ ID NO 3665 | CTGATTCCTACAGAAAAACT | CAGGAT | chr4 | 73404975 | 73404994 | 73404978 | - |
| SEQ ID NO 3666 | TTTCTTCTGCCTTTAAACAG | AAGAAT | chr4 | 73404937 | 73404956 | 73404940 | - |
| SEQ ID NO 3667 | AGAAGAATAATTCAATTACC | AAGAAT | chr4 | 73404919 | 73404938 | 73404922 | - |
| SEQ ID NO 3668 | TTTAAATAAAGCATAGTGCA | ATGGAT | chr4 | 73404729 | 73404748 | 73404732 | - |
| SEQ ID NO 3669 | TAGTGCAATGGATAGGTCTT | TGGGAT | chr4 | 73404716 | 73404735 | 73404719 | - |
| SEQ ID NO 3670 | GATAGGTCTTTGGGATAGTT | ATGAAT | chr4 | 73404706 | 73404725 | 73404709 | - |
| SEQ ID NO 3671 | GACCTTTTTTTTTTTTTACC | TAGGAT | chr4 | 73404583 | 73404602 | 73404586 | - |
| SEQ ID NO 3672 | TTTTTTTTTACCTAGGATGT | TTGAAT | chr4 | 73404575 | 73404594 | 73404578 | - |
| SEQ ID NO 3673 | AAAATAATTCTTTAAAGATG | CAGAGT | chr4 | 73404480 | 73404499 | 73404483 | - |
| SEQ ID NO 3674 | ACTTTATTTTACTGGGAAAA | TAGAAT | chr4 | 73404446 | 73404465 | 73404449 | - |
| SEQ ID NO 3675 | AAAAGTTGAACAATAGAAAA | ATGGAT | chr4 | 73404420 | 73404439 | 73404423 | - |
| SEQ ID NO 3676 | ATCTCGACGAAACACACCCC | TGGAAT | chr4 | 73404383 | 73404402 | 73404386 | - |
| SEQ ID NO 3677 | TTCATTGTGCCAAAGGCGTG | TGGGGT | chr4 | 73404313 | 73404332 | 73404316 | - |

Figure 9

| # | Sequence | PAM | Chr | Start | End | Cuts 5' of | Str |
|---|---|---|---|---|---|---|---|
| SEQ ID NO 3678 | GTGTTTCGTCGAGATGCACG | TAAGAAA | chr4 | 73404388 | 73404407 | 73404404 | + |
| SEQ ID NO 3679 | TTAGTAAACTCTGCATCTTT | AAAGAAT | chr4 | 73404467 | 73404486 | 73404483 | + |
| SEQ ID NO 3680 | TAGGTAAAAAAAAAAAAAGG | TCAGAAT | chr4 | 73404581 | 73404600 | 73404597 | + |
| SEQ ID NO 3681 | CTTAGAGTGACTGAAACTTC | ACAGAAT | chr4 | 73404658 | 73404677 | 73404674 | + |
| SEQ ID NO 3682 | TATTCTTCTGTTTAAAGGCA | GAAGAAA | chr4 | 73404930 | 73404949 | 73404946 | + |
| SEQ ID NO 3683 | GCATAATCTAAGTCAAATGG | AAAGAAA | chr4 | 73405017 | 73405036 | 73405033 | + |
| SEQ ID NO 3684 | ATCGGTTTAAAGATTTGGGA | GAAGAAA | chr4 | 73405134 | 73405153 | 73405150 | + |
| SEQ ID NO 3685 | TCACTCTTGTCTGGGCAAGG | GAAGAAA | chr4 | 73405106 | 73405125 | 73405109 | - |
| SEQ ID NO 3686 | AAAAAGGATTGTTAAATACT | GAAGAAA | chr4 | 73405079 | 73405098 | 73405082 | - |
| SEQ ID NO 3687 | AATATTGGGCTCTGATTCCT | ACAGAAA | chr4 | 73404986 | 73405005 | 73404989 | - |
| SEQ ID NO 3688 | ATTTCTTCTGCCTTTAAACA | GAAGAAT | chr4 | 73404938 | 73404957 | 73404941 | - |
| SEQ ID NO 3689 | CAGAAGAATAATTCAATTAC | CAAGAAT | chr4 | 73404920 | 73404939 | 73404923 | - |
| SEQ ID NO 3690 | TGCACTTTCCTTAGTGCGCA | AAAGAAA | chr4 | 73404632 | 73404651 | 73404635 | - |
| SEQ ID NO 3691 | ATACAAAATACTATGCCATT | TTAGAAA | chr4 | 73404515 | 73404534 | 73404518 | - |
| SEQ ID NO 3692 | AACTTTATTTTACTGGGAAA | ATAGAAT | chr4 | 73404447 | 73404466 | 73404450 | - |
| SEQ ID NO 3693 | AATAGAATAAAAGTTGAACA | ATAGAAA | chr4 | 73404428 | 73404447 | 73404431 | - |
| SEQ ID NO 3694 | CCTGGAATAAGCCGAGCTAA | AGAGAAA | chr4 | 73404365 | 73404384 | 73404368 | - |
| SEQ ID NO 3695 | AGGCGTGTGGGGTTGACAGA | AGAGAAA | chr4 | 73404300 | 73404319 | 73404303 | - |

Figure 10

| # | Sequence | PAM | Chr | Start | End | Cuts 5' of | Str |
|---|---|---|---|---|---|---|---|
| SEQ ID NO 3696 | CATTGCACTATGCTTTATTT | AAAAAC | chr4 | 73404726 | 73404745 | 73404742 | + |
| SEQ ID NO 3697 | TATGCTTTATTTAAAAACCA | CAAAAC | chr4 | 73404734 | 73404753 | 73404750 | + |
| SEQ ID NO 3698 | AAGGATTGTTAAATACTGAA | GAAAAC | chr4 | 73405076 | 73405095 | 73405079 | - |
| SEQ ID NO 3699 | TTGGGCTCTGATTCCTACAG | AAAAAC | chr4 | 73404982 | 73405001 | 73404985 | - |
| SEQ ID NO 3700 | TTTAAAGATGCAGAGTTTAC | TAAAAC | chr4 | 73404470 | 73404489 | 73404473 | - |

Figure 11

| # | Sequence | PAM | Chr | Start | End | Cuts 5' of | Str |
|---|---|---|---|---|---|---|---|
| SEQ ID NO 3701 | GTATATTAGTGCTAATTTCC | CTCCGTTT | chr4 | 73404256 | 73404275 | 73404272 | + |
| SEQ ID NO 3702 | GCTAATTTCCCTCCGTTTGT | CCTAGCTT | chr4 | 73404266 | 73404285 | 73404282 | + |
| SEQ ID NO 3703 | TCCCTTCTTTTTCTCTTTAG | CTCGGCTT | chr4 | 73404349 | 73404368 | 73404365 | + |
| SEQ ID NO 3704 | TAGCTCGGCTTATTCCAGGG | GTGTGTTT | chr4 | 73404366 | 73404385 | 73404382 | + |
| SEQ ID NO 3705 | ATTCTATTTTCCCAGTAAAA | TAAAGTTT | chr4 | 73404440 | 73404459 | 73404456 | + |
| SEQ ID NO 3706 | TAAAAAAAAAAAAAGGTCAG | AATTGTTT | chr4 | 73404585 | 73404604 | 73404601 | + |
| SEQ ID NO 3707 | GAAACTTCACAGAATAGGGT | TGAAGATT | chr4 | 73404670 | 73404689 | 73404686 | + |
| SEQ ID NO 3708 | CCAAAGACCTATCCATTGCA | CTATGCTT | chr4 | 73404713 | 73404732 | 73404729 | + |
| SEQ ID NO 3709 | AAAAGAGTATTAGATATTAT | CTAAGTTT | chr4 | 73404845 | 73404864 | 73404861 | + |
| SEQ ID NO 3710 | TCTTGGTAATTGAATTATTC | TTCTGTTT | chr4 | 73404915 | 73404934 | 73404931 | + |
| SEQ ID NO 3711 | AGAAATAATTGAACATCATC | CTGAGTTT | chr4 | 73404952 | 73404971 | 73404968 | + |
| SEQ ID NO 3712 | TAAAAAGTAACATTATTACT | TCTTGTTT | chr4 | 73405046 | 73405065 | 73405062 | + |
| SEQ ID NO 3713 | AGACAAGAGTGAGGTTGCTC | ATCGGTTT | chr4 | 73405114 | 73405133 | 73405130 | + |
| SEQ ID NO 3714 | AGTGAGGTTGCTCATCGGTT | TAAAGATT | chr4 | 73405121 | 73405140 | 73405137 | + |
| SEQ ID NO 3715 | TCTGGGCAAGGGAAGAAAAA | AAAGGATT | chr4 | 73405097 | 73405116 | 73405100 | - |
| SEQ ID NO 3716 | TTATATTTCTTTCCATTTGA | CTTAGATT | chr4 | 73405029 | 73405048 | 73405032 | - |
| SEQ ID NO 3717 | CCATTTGACTTAGATTATGC | ATTTGTTT | chr4 | 73405017 | 73405036 | 73405020 | - |
| SEQ ID NO 3718 | ATTTGTTTCAAAATATTGGG | CTCTGATT | chr4 | 73404997 | 73405016 | 73405000 | - |
| SEQ ID NO 3719 | CTATTTATGAGATCAACAGC | ACAGGTTT | chr4 | 73404764 | 73404783 | 73404767 | - |
| SEQ ID NO 3720 | GAGATCAACAGCACAGGTTT | TGTGGTTT | chr4 | 73404756 | 73404775 | 73404759 | - |
| SEQ ID NO 3721 | CAATCTTCAACCCTATTCTG | TGAAGTTT | chr4 | 73404679 | 73404698 | 73404682 | - |
| SEQ ID NO 3722 | CCTTTTTTTTTTTTTACCTA | GGATGTTT | chr4 | 73404581 | 73404600 | 73404584 | - |
| SEQ ID NO 3723 | AAAATAATTCTTTAAAGATG | CAGAGTTT | chr4 | 73404480 | 73404499 | 73404483 | - |
| SEQ ID NO 3724 | TAAAAGTTGAACAATAGAAA | AATGGATT | chr4 | 73404421 | 73404440 | 73404424 | - |

Figure 12

| # | Sequence | PAM | Chr | Start | End | Cut site 1 (5' of) | Cut site 2 (5' of) | Str |
|---|---|---|---|---|---|---|---|---|
| SEQ ID NO 3725 | GTGCTAATTTCCCTCCGTTTGT | TTA | chr4 | 73404264 | 73404285 | 73404281 | 73404286 | + |
| SEQ ID NO 3726 | ATTTCCCTCCGTTTGTCCTAGC | CTA | chr4 | 73404270 | 73404291 | 73404287 | 73404292 | + |
| SEQ ID NO 3727 | CCCTCCGTTTGTCCTAGCTTTT | TTT | chr4 | 73404274 | 73404295 | 73404291 | 73404296 | + |
| SEQ ID NO 3728 | CCTCCGTTTGTCCTAGCTTTTC | TTC | chr4 | 73404275 | 73404296 | 73404292 | 73404297 | + |
| SEQ ID NO 3729 | CGTTTGTCCTAGCTTTTCTCTT | CTC | chr4 | 73404279 | 73404300 | 73404296 | 73404301 | + |
| SEQ ID NO 3730 | GTCCTAGCTTTTCTCTTCTGTC | TTT | chr4 | 73404284 | 73404305 | 73404301 | 73404306 | + |
| SEQ ID NO 3731 | TCCTAGCTTTTCTCTTCTGTCA | TTG | chr4 | 73404285 | 73404306 | 73404302 | 73404307 | + |
| SEQ ID NO 3732 | GCTTTTCTCTTCTGTCAACCCC | CTA | chr4 | 73404290 | 73404311 | 73404307 | 73404312 | + |
| SEQ ID NO 3733 | TTCTCTTCTGTCAACCCCACAC | CTT | chr4 | 73404294 | 73404315 | 73404311 | 73404316 | + |
| SEQ ID NO 3734 | TCTCTTCTGTCAACCCCACACG | TTT | chr4 | 73404295 | 73404316 | 73404312 | 73404317 | + |
| SEQ ID NO 3735 | CTCTTCTGTCAACCCCACACGC | TTT | chr4 | 73404296 | 73404317 | 73404313 | 73404318 | + |
| SEQ ID NO 3736 | TCTTCTGTCAACCCCACACGCC | TTC | chr4 | 73404297 | 73404318 | 73404314 | 73404319 | + |
| SEQ ID NO 3737 | TTCTGTCAACCCCACACGCCTT | CTC | chr4 | 73404299 | 73404320 | 73404316 | 73404321 | + |
| SEQ ID NO 3738 | CTGTCAACCCCACACGCCTTTG | CTT | chr4 | 73404301 | 73404322 | 73404318 | 73404323 | + |
| SEQ ID NO 3739 | TGTCAACCCCACACGCCTTTGG | TTC | chr4 | 73404302 | 73404323 | 73404319 | 73404324 | + |
| SEQ ID NO 3740 | TCAACCCCACACGCCTTTGGCA | CTG | chr4 | 73404304 | 73404325 | 73404321 | 73404326 | + |
| SEQ ID NO 3741 | TGGCACAATGAAGTGGGTAACC | CTT | chr4 | 73404321 | 73404342 | 73404338 | 73404343 | + |
| SEQ ID NO 3742 | GGCACAATGAAGTGGGTAACCT | TTT | chr4 | 73404322 | 73404343 | 73404339 | 73404344 | + |
| SEQ ID NO 3743 | GCACAATGAAGTGGGTAACCTT | TTG | chr4 | 73404323 | 73404344 | 73404340 | 73404345 | + |
| SEQ ID NO 3744 | TATTTCCCTTCTTTTTCTCTTT | CTT | chr4 | 73404345 | 73404366 | 73404362 | 73404367 | + |
| SEQ ID NO 3745 | ATTTCCCTTCTTTTTCTCTTTA | TTT | chr4 | 73404346 | 73404367 | 73404363 | 73404368 | + |
| SEQ ID NO 3746 | TTTCCCTTCTTTTTCTCTTTAG | TTA | chr4 | 73404347 | 73404368 | 73404364 | 73404369 | + |
| SEQ ID NO 3747 | CCCTTCTTTTTCTCTTTAGCTC | TTT | chr4 | 73404350 | 73404371 | 73404367 | 73404372 | + |
| SEQ ID NO 3748 | CCTTCTTTTTCTCTTTAGCTCG | TTC | chr4 | 73404351 | 73404372 | 73404368 | 73404373 | + |
| SEQ ID NO 3749 | CTTTTTCTCTTTAGCTCGGCTT | CTT | chr4 | 73404355 | 73404376 | 73404372 | 73404377 | + |
| SEQ ID NO 3750 | TTTTTCTCTTTAGCTCGGCTTA | TTC | chr4 | 73404356 | 73404377 | 73404373 | 73404378 | + |
| SEQ ID NO 3751 | TTTCTCTTTAGCTCGGCTTATT | CTT | chr4 | 73404358 | 73404379 | 73404375 | 73404380 | + |
| SEQ ID NO 3752 | TTCTCTTTAGCTCGGCTTATTC | TTT | chr4 | 73404359 | 73404380 | 73404376 | 73404381 | + |
| SEQ ID NO 3753 | TCTCTTTAGCTCGGCTTATTCC | TTT | chr4 | 73404360 | 73404381 | 73404377 | 73404382 | + |
| SEQ ID NO 3754 | CTCTTTAGCTCGGCTTATTCCA | TTT | chr4 | 73404361 | 73404382 | 73404378 | 73404383 | + |
| SEQ ID NO 3755 | TCTTTAGCTCGGCTTATTCCAG | TTC | chr4 | 73404362 | 73404383 | 73404379 | 73404384 | + |
| SEQ ID NO 3756 | TTTAGCTCGGCTTATTCCAGGG | CTC | chr4 | 73404364 | 73404385 | 73404381 | 73404386 | + |
| SEQ ID NO 3757 | TAGCTCGGCTTATTCCAGGGGT | CTT | chr4 | 73404366 | 73404387 | 73404383 | 73404388 | + |
| SEQ ID NO 3758 | AGCTCGGCTTATTCCAGGGGTG | TTT | chr4 | 73404367 | 73404388 | 73404384 | 73404389 | + |
| SEQ ID NO 3759 | GCTCGGCTTATTCCAGGGGTGT | TTA | chr4 | 73404368 | 73404389 | 73404385 | 73404390 | + |
| SEQ ID NO 3760 | GGCTTATTCCAGGGGTGTGTTT | CTC | chr4 | 73404372 | 73404393 | 73404389 | 73404394 | + |
| SEQ ID NO 3761 | ATTCCAGGGGTGTGTTTCGTCG | CTT | chr4 | 73404377 | 73404398 | 73404394 | 73404399 | + |
| SEQ ID NO 3762 | TTCCAGGGGTGTGTTTCGTCGA | TTA | chr4 | 73404378 | 73404399 | 73404395 | 73404400 | + |
| SEQ ID NO 3763 | CAGGGGTGTGTTTCGTCGAGAT | TTC | chr4 | 73404381 | 73404402 | 73404398 | 73404403 | + |
| SEQ ID NO 3764 | CGTCGAGATGCACGTAAGAAAT | TTT | chr4 | 73404394 | 73404415 | 73404411 | 73404416 | + |
| SEQ ID NO 3765 | GTCGAGATGCACGTAAGAAATC | TTC | chr4 | 73404395 | 73404416 | 73404412 | 73404417 | + |
| SEQ ID NO 3766 | TTCTATTGTTCAACTTTTATTC | TTT | chr4 | 73404422 | 73404443 | 73404439 | 73404444 | + |
| SEQ ID NO 3767 | TCTATTGTTCAACTTTTATTCT | TTT | chr4 | 73404423 | 73404444 | 73404440 | 73404445 | + |
| SEQ ID NO 3768 | CTATTGTTCAACTTTTATTCTA | TTT | chr4 | 73404424 | 73404445 | 73404441 | 73404446 | + |
| SEQ ID NO 3769 | TATTGTTCAACTTTTATTCTAT | TTC | chr4 | 73404425 | 73404446 | 73404442 | 73404447 | + |
| SEQ ID NO 3770 | TTGTTCAACTTTTATTCTATTT | CTA | chr4 | 73404427 | 73404448 | 73404444 | 73404449 | + |
| SEQ ID NO 3771 | TTCAACTTTTATTCTATTTTCC | TTG | chr4 | 73404430 | 73404451 | 73404447 | 73404452 | + |
| SEQ ID NO 3772 | AACTTTTATTCTATTTTCCCAG | TTC | chr4 | 73404433 | 73404454 | 73404450 | 73404455 | + |
| SEQ ID NO 3773 | TTATTCTATTTTCCCAGTAAAA | CTT | chr4 | 73404438 | 73404459 | 73404455 | 73404460 | + |
| SEQ ID NO 3774 | TATTCTATTTTCCCAGTAAAAT | TTT | chr4 | 73404439 | 73404460 | 73404456 | 73404461 | + |
| SEQ ID NO 3775 | ATTCTATTTTCCCAGTAAAATA | TTT | chr4 | 73404440 | 73404461 | 73404457 | 73404462 | + |
| SEQ ID NO 3776 | TTCTATTTTCCCAGTAAAATAA | TTA | chr4 | 73404441 | 73404462 | 73404458 | 73404463 | + |
| SEQ ID NO 3777 | TATTTTCCCAGTAAAATAAAGT | TTC | chr4 | 73404444 | 73404465 | 73404461 | 73404466 | + |
| SEQ ID NO 3778 | TTTTCCCAGTAAAATAAAGTTT | CTA | chr4 | 73404446 | 73404467 | 73404463 | 73404468 | + |
| SEQ ID NO 3779 | TCCCAGTAAAATAAAGTTTTAG | TTT | chr4 | 73404449 | 73404470 | 73404466 | 73404471 | + |
| SEQ ID NO 3780 | CCCAGTAAAATAAAGTTTTAGT | TTT | chr4 | 73404450 | 73404471 | 73404467 | 73404472 | + |

Figure 12 (Cont'd)

| SEQ ID | Sequence | | Chr | | | | | |
|---|---|---|---|---|---|---|---|---|
| SEQ ID N O 3781 | CCAGTAAAATAAAGTTTTAGTA | TTC | chr4 | 73404451 | 73404472 | 73404468 | 73404473 | + |
| SEQ ID N O 3782 | TAGTAAACTCTGCATCTTTAAAA | TTT | chr4 | 73404468 | 73404489 | 73404485 | 73404490 | + |
| SEQ ID N O 3783 | AGTAAACTCTGCATCTTTAAAG | TTT | chr4 | 73404469 | 73404490 | 73404486 | 73404491 | + |
| SEQ ID N O 3784 | GTAAACTCTGCATCTTTAAAGA | TTA | chr4 | 73404470 | 73404491 | 73404487 | 73404492 | + |
| SEQ ID N O 3785 | TGCATCTTTAAAGAATTATTTT | CTC | chr4 | 73404478 | 73404499 | 73404495 | 73404500 | + |
| SEQ ID N O 3786 | CATCTTTAAAGAATTATTTTGG | CTG | chr4 | 73404480 | 73404501 | 73404497 | 73404502 | + |
| SEQ ID N O 3787 | TAAAGAATTATTTTGGCATTTA | CTT | chr4 | 73404486 | 73404507 | 73404503 | 73404508 | + |
| SEQ ID N O 3788 | AAAGAATTATTTTGGCATTTAT | TTT | chr4 | 73404487 | 73404508 | 73404504 | 73404509 | + |
| SEQ ID N O 3789 | AAGAATTATTTTGGCATTTATT | TTA | chr4 | 73404488 | 73404509 | 73404505 | 73404510 | + |
| SEQ ID N O 3790 | TTTTGGCATTTATTTCTAAAAT | TTA | chr4 | 73404496 | 73404517 | 73404513 | 73404518 | + |
| SEQ ID N O 3791 | TGGCATTTATTTCTAAAATGGC | TTT | chr4 | 73404499 | 73404520 | 73404516 | 73404521 | + |
| SEQ ID N O 3792 | GGCATTTATTTCTAAAATGGCA | TTT | chr4 | 73404500 | 73404521 | 73404517 | 73404522 | + |
| SEQ ID N O 3793 | GCATTTATTTCTAAAATGGCAT | TTG | chr4 | 73404501 | 73404522 | 73404518 | 73404523 | + |
| SEQ ID N O 3794 | ATTTCTAAAATGGCATAGTATT | TTT | chr4 | 73404507 | 73404528 | 73404524 | 73404529 | + |
| SEQ ID N O 3795 | TTTCTAAAATGGCATAGTATTT | TTA | chr4 | 73404508 | 73404529 | 73404525 | 73404530 | + |
| SEQ ID N O 3796 | CTAAAATGGCATAGTATTTTGT | TTT | chr4 | 73404511 | 73404532 | 73404528 | 73404533 | + |
| SEQ ID N O 3797 | TAAAATGGCATAGTATTTTGTA | TTC | chr4 | 73404512 | 73404533 | 73404529 | 73404534 | + |
| SEQ ID N O 3798 | AAATGGCATAGTATTTTGTATT | CTA | chr4 | 73404514 | 73404535 | 73404531 | 73404536 | + |
| SEQ ID N O 3799 | TGTATTTGTGAAGTCTTACAAG | TTT | chr4 | 73404530 | 73404551 | 73404547 | 73404552 | + |
| SEQ ID N O 3800 | GTATTTGTGAAGTCTTACAAGG | TTT | chr4 | 73404531 | 73404552 | 73404548 | 73404553 | + |
| SEQ ID N O 3801 | TATTTGTGAAGTCTTACAAGGT | TTG | chr4 | 73404532 | 73404553 | 73404549 | 73404554 | + |
| SEQ ID N O 3802 | GTGAAGTCTTACAAGGTTATCT | TTT | chr4 | 73404537 | 73404558 | 73404554 | 73404559 | + |
| SEQ ID N O 3803 | TGAAGTCTTACAAGGTTATCTT | TTG | chr4 | 73404538 | 73404559 | 73404555 | 73404560 | + |
| SEQ ID N O 3804 | ACAAGGTTATCTTATTAATAAA | CTT | chr4 | 73404547 | 73404568 | 73404564 | 73404569 | + |
| SEQ ID N O 3805 | CAAGGTTATCTTATTAATAAAA | TTA | chr4 | 73404548 | 73404569 | 73404565 | 73404570 | + |
| SEQ ID N O 3806 | TCTTATTAATAAAATTCAAACA | TTA | chr4 | 73404556 | 73404577 | 73404573 | 73404578 | + |
| SEQ ID N O 3807 | ATTAATAAAATTCAAACATCCT | CTT | chr4 | 73404560 | 73404581 | 73404577 | 73404582 | + |
| SEQ ID N O 3808 | TTAATAAAATTCAAACATCCTA | TTA | chr4 | 73404561 | 73404582 | 73404578 | 73404583 | + |
| SEQ ID N O 3809 | ATAAAATTCAAACATCCTAGGT | TTA | chr4 | 73404564 | 73404585 | 73404581 | 73404586 | + |
| SEQ ID N O 3810 | AAACATCCTAGGTAAAAAAAAA | TTC | chr4 | 73404573 | 73404594 | 73404590 | 73404595 | + |
| SEQ ID N O 3811 | GGTAAAAAAAAAAAAAGGTCAG | CTA | chr4 | 73404583 | 73404604 | 73404600 | 73404605 | + |
| SEQ ID N O 3812 | TTTAGTGACTGTAATTTTCTTT | TTG | chr4 | 73404610 | 73404631 | 73404627 | 73404632 | + |
| SEQ ID N O 3813 | AGTGACTGTAATTTTCTTTTGC | TTT | chr4 | 73404613 | 73404634 | 73404630 | 73404635 | + |
| SEQ ID N O 3814 | GTGACTGTAATTTTCTTTTGCG | TTA | chr4 | 73404614 | 73404635 | 73404631 | 73404636 | + |
| SEQ ID N O 3815 | TAATTTTCTTTTGCGCACTAAG | CTG | chr4 | 73404621 | 73404642 | 73404638 | 73404643 | + |
| SEQ ID N O 3816 | TCTTTTGCGCACTAAGGAAAGT | TTT | chr4 | 73404627 | 73404648 | 73404644 | 73404649 | + |
| SEQ ID N O 3817 | CTTTTGCGCACTAAGGAAAGTG | TTT | chr4 | 73404628 | 73404649 | 73404645 | 73404650 | + |
| SEQ ID N O 3818 | TTTTGCGCACTAAGGAAAGTGC | TTC | chr4 | 73404629 | 73404650 | 73404646 | 73404651 | + |
| SEQ ID N O 3819 | TTGCGCACTAAGGAAAGTGCAA | CTT | chr4 | 73404631 | 73404652 | 73404648 | 73404653 | + |
| SEQ ID N O 3820 | TGCGCACTAAGGAAAGTGCAAA | TTT | chr4 | 73404632 | 73404653 | 73404649 | 73404654 | + |
| SEQ ID N O 3821 | GCGCACTAAGGAAAGTGCAAAG | TTT | chr4 | 73404633 | 73404654 | 73404650 | 73404655 | + |
| SEQ ID N O 3822 | CGCACTAAGGAAAGTGCAAAGT | TTG | chr4 | 73404634 | 73404655 | 73404651 | 73404656 | + |
| SEQ ID N O 3823 | AGGAAAGTGCAAAGTAACTTAG | CTA | chr4 | 73404641 | 73404662 | 73404658 | 73404663 | + |
| SEQ ID N O 3824 | AGAGTGACTGAAACTTCACAGA | CTT | chr4 | 73404661 | 73404682 | 73404678 | 73404683 | + |
| SEQ ID N O 3825 | GAGTGACTGAAACTTCACAGAA | TTA | chr4 | 73404662 | 73404683 | 73404679 | 73404684 | + |
| SEQ ID N O 3826 | AAACTTCACAGAATAGGGTTGA | CTG | chr4 | 73404671 | 73404692 | 73404688 | 73404693 | + |
| SEQ ID N O 3827 | CACAGAATAGGGTTGAAGATTG | CTT | chr4 | 73404677 | 73404698 | 73404694 | 73404699 | + |
| SEQ ID N O 3828 | ACAGAATAGGGTTGAAGATTGA | TTC | chr4 | 73404678 | 73404699 | 73404695 | 73404700 | + |
| SEQ ID N O 3829 | AAGATTGAATTCATAACTATCC | TTG | chr4 | 73404692 | 73404713 | 73404709 | 73404714 | + |
| SEQ ID N O 3830 | AATTCATAACTATCCCAAAGAC | TTG | chr4 | 73404699 | 73404720 | 73404716 | 73404721 | + |
| SEQ ID N O 3831 | ATAACTATCCCAAAGACCTATC | TTC | chr4 | 73404704 | 73404725 | 73404721 | 73404726 | + |
| SEQ ID N O 3832 | TCCCAAAGACCTATCCATTGCA | CTA | chr4 | 73404711 | 73404732 | 73404728 | 73404733 | + |
| SEQ ID N O 3833 | TCCATTGCACTATGCTTTATTT | CTA | chr4 | 73404724 | 73404745 | 73404741 | 73404746 | + |
| SEQ ID N O 3834 | CACTATGCTTTATTTAAAAACC | TTG | chr4 | 73404731 | 73404752 | 73404748 | 73404753 | + |
| SEQ ID N O 3835 | TGCTTTATTTAAAAACCACAAA | CTA | chr4 | 73404736 | 73404757 | 73404753 | 73404758 | + |
| SEQ ID N O 3836 | TATTTAAAAACCACAAAACCTG | CTT | chr4 | 73404741 | 73404762 | 73404758 | 73404763 | + |
| SEQ ID N O 3837 | ATTTAAAAACCACAAAACCTGT | TTT | chr4 | 73404742 | 73404763 | 73404759 | 73404764 | + |

Figure 12 (Cont'd)

| | | | | | | | | |
|---|---|---|---|---|---|---|---|---|
| SEQ ID N O 3838 | TTTAAAAACCACAAAACCTGTG | TTA | chr4 | 73404743 | 73404764 | 73404760 | 73404765 | + |
| SEQ ID N O 3839 | AAAAACCACAAAACCTGTGCTG | TTT | chr4 | 73404746 | 73404767 | 73404763 | 73404768 | + |
| SEQ ID N O 3840 | AAAACCACAAAACCTGTGCTGT | TTA | chr4 | 73404747 | 73404768 | 73404764 | 73404769 | + |
| SEQ ID N O 3841 | TGCTGTTGATCTCATAAATAGA | CTG | chr4 | 73404763 | 73404784 | 73404780 | 73404785 | + |
| SEQ ID N O 3842 | TTGATCTCATAAATAGAACTTG | CTG | chr4 | 73404768 | 73404789 | 73404785 | 73404790 | + |
| SEQ ID N O 3843 | ATCTCATAAATAGAACTTGTAT | TTG | chr4 | 73404771 | 73404792 | 73404788 | 73404793 | + |
| SEQ ID N O 3844 | ATAAATAGAACTTGTATTTATA | CTC | chr4 | 73404776 | 73404797 | 73404793 | 73404798 | + |
| SEQ ID N O 3845 | GTATTTATATTTATTTTCATTT | CTT | chr4 | 73404789 | 73404810 | 73404806 | 73404811 | + |
| SEQ ID N O 3846 | TATTTATATTTATTTTCATTTT | TTG | chr4 | 73404790 | 73404811 | 73404807 | 73404812 | + |
| SEQ ID N O 3847 | ATATTTATTTTCATTTTAGTCT | TTT | chr4 | 73404795 | 73404816 | 73404812 | 73404817 | + |
| SEQ ID N O 3848 | TATTTATTTTCATTTTAGTCTG | TTA | chr4 | 73404796 | 73404817 | 73404813 | 73404818 | + |
| SEQ ID N O 3849 | ATTTTCATTTTAGTCTGTCTTC | TTT | chr4 | 73404801 | 73404822 | 73404818 | 73404823 | + |
| SEQ ID N O 3850 | TTTTCATTTTAGTCTGTCTTCT | TTA | chr4 | 73404802 | 73404823 | 73404819 | 73404824 | + |
| SEQ ID N O 3851 | TCATTTTAGTCTGTCTTCTTGG | TTT | chr4 | 73404805 | 73404826 | 73404822 | 73404827 | + |
| SEQ ID N O 3852 | CATTTTAGTCTGTCTTCTTGGT | TTT | chr4 | 73404806 | 73404827 | 73404823 | 73404828 | + |
| SEQ ID N O 3853 | ATTTTAGTCTGTCTTCTTGGTT | TTC | chr4 | 73404807 | 73404828 | 73404824 | 73404829 | + |
| SEQ ID N O 3854 | TAGTCTGTCTTCTTGGTTGCTG | TTT | chr4 | 73404811 | 73404832 | 73404828 | 73404833 | + |
| SEQ ID N O 3855 | AGTCTGTCTTCTTGGTTGCTGT | TTT | chr4 | 73404812 | 73404833 | 73404829 | 73404834 | + |
| SEQ ID N O 3856 | GTCTGTCTTCTTGGTTGCTGTT | TTA | chr4 | 73404813 | 73404834 | 73404830 | 73404835 | + |
| SEQ ID N O 3857 | TCTTCTTGGTTGCTGTTGATAG | CTG | chr4 | 73404818 | 73404839 | 73404835 | 73404840 | + |
| SEQ ID N O 3858 | CTTGGTTGCTGTTGATAGACAC | CTT | chr4 | 73404822 | 73404843 | 73404839 | 73404844 | + |
| SEQ ID N O 3859 | TTGGTTGCTGTTGATAGACACT | TTC | chr4 | 73404823 | 73404844 | 73404840 | 73404845 | + |
| SEQ ID N O 3860 | GGTTGCTGTTGATAGACACTAA | CTT | chr4 | 73404825 | 73404846 | 73404842 | 73404847 | + |
| SEQ ID N O 3861 | GTTGCTGTTGATAGACACTAAA | TTG | chr4 | 73404826 | 73404847 | 73404843 | 73404848 | + |
| SEQ ID N O 3862 | CTGTTGATAGACACTAAAAGAG | TTG | chr4 | 73404830 | 73404851 | 73404847 | 73404852 | + |
| SEQ ID N O 3863 | TTGATAGACACTAAAAGAGTAT | CTG | chr4 | 73404833 | 73404854 | 73404850 | 73404855 | + |
| SEQ ID N O 3864 | ATAGACACTAAAAGAGTATTAG | TTG | chr4 | 73404836 | 73404857 | 73404853 | 73404858 | + |
| SEQ ID N O 3865 | AAAGAGTATTAGATATTATCTA | CTA | chr4 | 73404846 | 73404867 | 73404863 | 73404868 | + |
| SEQ ID N O 3866 | GATATTATCTAAGTTTGAATAT | TTA | chr4 | 73404857 | 73404878 | 73404874 | 73404879 | + |
| SEQ ID N O 3867 | TCTAAGTTTGAATATAAGGCTA | TTA | chr4 | 73404864 | 73404885 | 73404881 | 73404886 | + |
| SEQ ID N O 3868 | AGTTTGAATATAAGGCTATAAA | CTA | chr4 | 73404868 | 73404889 | 73404885 | 73404890 | + |
| SEQ ID N O 3869 | GAATATAAGGCTATAAATATTT | TTT | chr4 | 73404873 | 73404894 | 73404890 | 73404895 | + |
| SEQ ID N O 3870 | AATATAAGGCTATAAATATTTA | TTG | chr4 | 73404874 | 73404895 | 73404891 | 73404896 | + |
| SEQ ID N O 3871 | TAAATATTTAATAATTTTTAAA | CTA | chr4 | 73404886 | 73404907 | 73404903 | 73404908 | + |
| SEQ ID N O 3872 | AATAATTTTTAAAATAGTATTC | TTT | chr4 | 73404895 | 73404916 | 73404912 | 73404917 | + |
| SEQ ID N O 3873 | ATAATTTTTAAAATAGTATTCT | TTA | chr4 | 73404896 | 73404917 | 73404913 | 73404918 | + |
| SEQ ID N O 3874 | TTAAAATAGTATTCTTGGTAAT | TTT | chr4 | 73404903 | 73404924 | 73404920 | 73404925 | + |
| SEQ ID N O 3875 | TAAAATAGTATTCTTGGTAATT | TTT | chr4 | 73404904 | 73404925 | 73404921 | 73404926 | + |
| SEQ ID N O 3876 | AAAATAGTATTCTTGGTAATTG | TTT | chr4 | 73404905 | 73404926 | 73404922 | 73404927 | + |
| SEQ ID N O 3877 | AAATAGTATTCTTGGTAATTGA | TTA | chr4 | 73404906 | 73404927 | 73404923 | 73404928 | + |
| SEQ ID N O 3878 | TTGGTAATTGAATTATTCTTCT | TTC | chr4 | 73404917 | 73404938 | 73404934 | 73404939 | + |
| SEQ ID N O 3879 | GGTAATTGAATTATTCTTCTGT | CTT | chr4 | 73404919 | 73404940 | 73404936 | 73404941 | + |
| SEQ ID N O 3880 | GTAATTGAATTATTCTTCTGTT | TTG | chr4 | 73404920 | 73404941 | 73404937 | 73404942 | + |
| SEQ ID N O 3881 | AATTATTCTTCTGTTTAAAGGC | TTG | chr4 | 73404927 | 73404948 | 73404944 | 73404949 | + |
| SEQ ID N O 3882 | TTCTTCTGTTTAAAGGCAGAAG | TTA | chr4 | 73404932 | 73404953 | 73404949 | 73404954 | + |
| SEQ ID N O 3883 | TTCTGTTTAAAGGCAGAAGAAA | TTC | chr4 | 73404935 | 73404956 | 73404952 | 73404957 | + |
| SEQ ID N O 3884 | CTGTTTAAAGGCAGAAGAAATA | CTT | chr4 | 73404937 | 73404958 | 73404954 | 73404959 | + |
| SEQ ID N O 3885 | TGTTTAAAGGCAGAAGAAATAA | TTC | chr4 | 73404938 | 73404959 | 73404955 | 73404960 | + |
| SEQ ID N O 3886 | TTTAAAGGCAGAAGAAATAATT | CTG | chr4 | 73404940 | 73404961 | 73404957 | 73404962 | + |
| SEQ ID N O 3887 | AAAGGCAGAAGAAATAATTGAA | TTT | chr4 | 73404943 | 73404964 | 73404960 | 73404965 | + |
| SEQ ID N O 3888 | AAGGCAGAAGAAATAATTGAAC | TTA | chr4 | 73404944 | 73404965 | 73404961 | 73404966 | + |
| SEQ ID N O 3889 | AACATCATCCTGAGTTTTTCTG | TTG | chr4 | 73404963 | 73404984 | 73404980 | 73404985 | + |
| SEQ ID N O 3890 | AGTTTTTCTGTAGGAATCAGAG | CTG | chr4 | 73404975 | 73404996 | 73404992 | 73404997 | + |
| SEQ ID N O 3891 | TTCTGTAGGAATCAGAGCCCAA | TTT | chr4 | 73404980 | 73405001 | 73404997 | 73405002 | + |
| SEQ ID N O 3892 | TCTGTAGGAATCAGAGCCCAAT | TTT | chr4 | 73404981 | 73405002 | 73404998 | 73405003 | + |
| SEQ ID N O 3893 | CTGTAGGAATCAGAGCCCAATA | TTT | chr4 | 73404982 | 73405003 | 73404999 | 73405004 | + |
| SEQ ID N O 3894 | TGTAGGAATCAGAGCCCAATAT | TTC | chr4 | 73404983 | 73405004 | 73405000 | 73405005 | + |

Figure 12 (Cont'd)

| SEQ ID NO 3895 | TAGGAATCAGAGCCCAATATTT | CTG | chr4 | 73404985 | 73405006 | 73405002 | 73405007 | + |
|---|---|---|---|---|---|---|---|---|
| SEQ ID NO 3896 | TGAAACAAATGCATAATCTAAG | TTT | chr4 | 73405007 | 73405028 | 73405024 | 73405029 | + |
| SEQ ID NO 3897 | GAAACAAATGCATAATCTAAGT | TTT | chr4 | 73405008 | 73405029 | 73405025 | 73405030 | + |
| SEQ ID NO 3898 | AAACAAATGCATAATCTAAGTC | TTG | chr4 | 73405009 | 73405030 | 73405026 | 73405031 | + |
| SEQ ID NO 3899 | AGTCAAATGGAAAGAAATATAA | CTA | chr4 | 73405027 | 73405048 | 73405044 | 73405049 | + |
| SEQ ID NO 3900 | TTACTTCTTGTTTTCTTCAGTA | TTA | chr4 | 73405061 | 73405082 | 73405078 | 73405083 | + |
| SEQ ID NO 3901 | CTTCTTGTTTTCTTCAGTATTT | TTA | chr4 | 73405064 | 73405085 | 73405081 | 73405086 | + |
| SEQ ID NO 3902 | CTTGTTTTCTTCAGTATTTAAC | CTT | chr4 | 73405067 | 73405088 | 73405084 | 73405089 | + |
| SEQ ID NO 3903 | TTGTTTTCTTCAGTATTTAACA | TTC | chr4 | 73405068 | 73405089 | 73405085 | 73405090 | + |
| SEQ ID NO 3904 | GTTTTCTTCAGTATTTAACAAT | CTT | chr4 | 73405070 | 73405091 | 73405087 | 73405092 | + |
| SEQ ID NO 3905 | TTTTCTTCAGTATTTAACAATC | TTG | chr4 | 73405071 | 73405092 | 73405088 | 73405093 | + |
| SEQ ID NO 3906 | TCTTCAGTATTTAACAATCCTT | TTT | chr4 | 73405074 | 73405095 | 73405091 | 73405096 | + |
| SEQ ID NO 3907 | CTTCAGTATTTAACAATCCTTT | TTT | chr4 | 73405075 | 73405096 | 73405092 | 73405097 | + |
| SEQ ID NO 3908 | TTCAGTATTTAACAATCCTTTT | TTC | chr4 | 73405076 | 73405097 | 73405093 | 73405098 | + |
| SEQ ID NO 3909 | CAGTATTTAACAATCCTTTTTT | CTT | chr4 | 73405078 | 73405099 | 73405095 | 73405100 | + |
| SEQ ID NO 3910 | AGTATTTAACAATCCTTTTTTT | TTC | chr4 | 73405079 | 73405100 | 73405096 | 73405101 | + |
| SEQ ID NO 3911 | AACAATCCTTTTTTTCTTCCC | TTT | chr4 | 73405086 | 73405107 | 73405103 | 73405108 | + |
| SEQ ID NO 3912 | ACAATCCTTTTTTTCTTCCCT | TTA | chr4 | 73405087 | 73405108 | 73405104 | 73405109 | + |
| SEQ ID NO 3913 | TTTTTTCTTCCCTTGCCCAGAC | CTT | chr4 | 73405096 | 73405117 | 73405113 | 73405118 | + |
| SEQ ID NO 3914 | TTTTTCTTCCCTTGCCCAGACA | TTT | chr4 | 73405097 | 73405118 | 73405114 | 73405119 | + |
| SEQ ID NO 3915 | TTTTCTTCCCTTGCCCAGACAA | TTT | chr4 | 73405098 | 73405119 | 73405115 | 73405120 | + |
| SEQ ID NO 3916 | TTTCTTCCCTTGCCCAGACAAG | TTT | chr4 | 73405099 | 73405120 | 73405116 | 73405121 | + |
| SEQ ID NO 3917 | TTCTTCCCTTGCCCAGACAAGA | TTT | chr4 | 73405100 | 73405121 | 73405117 | 73405122 | + |
| SEQ ID NO 3918 | TCTTCCCTTGCCCAGACAAGAG | TTT | chr4 | 73405101 | 73405122 | 73405118 | 73405123 | + |
| SEQ ID NO 3919 | CTTCCCTTGCCCAGACAAGAGT | TTT | chr4 | 73405102 | 73405123 | 73405119 | 73405124 | + |
| SEQ ID NO 3920 | TTCCCTTGCCCAGACAAGAGTG | TTC | chr4 | 73405103 | 73405124 | 73405120 | 73405125 | + |
| SEQ ID NO 3921 | CCCTTGCCCAGACAAGAGTGAG | CTT | chr4 | 73405105 | 73405126 | 73405122 | 73405127 | + |
| SEQ ID NO 3922 | CCTTGCCCAGACAAGAGTGAGG | TTC | chr4 | 73405106 | 73405127 | 73405123 | 73405128 | + |
| SEQ ID NO 3923 | GCCCAGACAAGAGTGAGGTTGC | CTT | chr4 | 73405110 | 73405131 | 73405127 | 73405132 | + |
| SEQ ID NO 3924 | CCCAGACAAGAGTGAGGTTGCT | TTG | chr4 | 73405111 | 73405132 | 73405128 | 73405133 | + |
| SEQ ID NO 3925 | CTCATCGGTTTAAAGATTTGGG | TTG | chr4 | 73405131 | 73405152 | 73405148 | 73405153 | + |
| SEQ ID NO 3926 | ATCGGTTTAAAGATTTGGGAGA | CTC | chr4 | 73405134 | 73405155 | 73405151 | 73405156 | + |
| SEQ ID NO 3927 | AAAGATTTGGGAGAAGAAAATT | TTT | chr4 | 73405142 | 73405163 | 73405159 | 73405164 | + |
| SEQ ID NO 3928 | AAGATTTGGGAGAAGAAAATTT | TTA | chr4 | 73405143 | 73405164 | 73405160 | 73405165 | + |
| SEQ ID NO 3929 | GGGAGAAGAAAATTTCAAAGCC | TTT | chr4 | 73405150 | 73405171 | 73405167 | 73405172 | + |
| SEQ ID NO 3930 | GGAGAAGAAAATTTCAAAGCCT | TTG | chr4 | 73405151 | 73405172 | 73405168 | 73405173 | + |
| SEQ ID NO 3931 | TGAAATTTTCTTCTCCCAAATC | CTT | chr4 | 73405145 | 73405166 | 73405150 | 73405145 | - |
| SEQ ID NO 3932 | GAAATTTTCTTCTCCCAAATCT | TTT | chr4 | 73405144 | 73405165 | 73405149 | 73405144 | - |
| SEQ ID NO 3933 | AAATTTTCTTCTCCCAAATCTT | TTG | chr4 | 73405143 | 73405164 | 73405148 | 73405143 | - |
| SEQ ID NO 3934 | TCTTCTCCCAAATCTTTAAACC | TTT | chr4 | 73405137 | 73405158 | 73405142 | 73405137 | - |
| SEQ ID NO 3935 | CTTCTCCCAAATCTTTAAACCG | TTT | chr4 | 73405136 | 73405157 | 73405141 | 73405136 | - |
| SEQ ID NO 3936 | TTCTCCCAAATCTTTAAACCGA | TTC | chr4 | 73405135 | 73405156 | 73405140 | 73405135 | - |
| SEQ ID NO 3937 | CTCCCAAATCTTTAAACCGATG | CTT | chr4 | 73405133 | 73405154 | 73405138 | 73405133 | - |
| SEQ ID NO 3938 | TCCCAAATCTTTAAACCGATGA | TTC | chr4 | 73405132 | 73405153 | 73405137 | 73405132 | - |
| SEQ ID NO 3939 | CCAAATCTTTAAACCGATGAGC | CTC | chr4 | 73405130 | 73405151 | 73405135 | 73405130 | - |
| SEQ ID NO 3940 | TAAACCGATGAGCAACCTCACT | CTT | chr4 | 73405121 | 73405142 | 73405126 | 73405121 | - |
| SEQ ID NO 3941 | AAACCGATGAGCAACCTCACTC | TTT | chr4 | 73405120 | 73405141 | 73405125 | 73405120 | - |
| SEQ ID NO 3942 | AACCGATGAGCAACCTCACTCT | TTA | chr4 | 73405119 | 73405140 | 73405124 | 73405119 | - |
| SEQ ID NO 3943 | ACTCTTGTCTGGGCAAGGGAAG | CTC | chr4 | 73405102 | 73405123 | 73405107 | 73405102 | - |
| SEQ ID NO 3944 | TTGTCTGGGCAAGGGAAGAAAA | CTC | chr4 | 73405098 | 73405119 | 73405103 | 73405098 | - |
| SEQ ID NO 3945 | GTCTGGGCAAGGGAAGAAAAAA | CTT | chr4 | 73405096 | 73405117 | 73405101 | 73405096 | - |
| SEQ ID NO 3946 | TCTGGGCAAGGGAAGAAAAAAA | TTG | chr4 | 73405095 | 73405116 | 73405100 | 73405095 | - |
| SEQ ID NO 3947 | GGCAAGGGAAGAAAAAAAGGA | CTG | chr4 | 73405091 | 73405112 | 73405096 | 73405091 | - |
| SEQ ID NO 3948 | TTAAATACTGAAGAAAACAAGA | TTG | chr4 | 73405066 | 73405087 | 73405071 | 73405066 | - |
| SEQ ID NO 3949 | AATACTGAAGAAAACAAGAAGT | TTA | chr4 | 73405063 | 73405084 | 73405068 | 73405063 | - |
| SEQ ID NO 3950 | AAGAAAACAAGAAGTAATAATG | CTG | chr4 | 73405056 | 73405077 | 73405061 | 73405056 | - |
| SEQ ID NO 3951 | CTTTTTATATTTCTTTCCATTT | TTA | chr4 | 73405031 | 73405052 | 73405036 | 73405031 | - |

Figure 12 (Cont'd)

| SEQ ID NO 3952 | TTTATATTTCTTTCCATTTGAC | CTT | chr4 | 73405028 | 73405049 | 73405033 | 73405028 | - |
|---|---|---|---|---|---|---|---|---|
| SEQ ID NO 3953 | TTATATTTCTTTCCATTTGACT | TTT | chr4 | 73405027 | 73405048 | 73405032 | 73405027 | - |
| SEQ ID NO 3954 | TATATTTCTTTCCATTTGACTT | TTT | chr4 | 73405026 | 73405047 | 73405031 | 73405026 | - |
| SEQ ID NO 3955 | ATATTTCTTTCCATTTGACTTA | TTT | chr4 | 73405025 | 73405046 | 73405030 | 73405025 | - |
| SEQ ID NO 3956 | TATTTCTTTCCATTTGACTTAG | TTA | chr4 | 73405024 | 73405045 | 73405029 | 73405024 | - |
| SEQ ID NO 3957 | CTTTCCATTTGACTTAGATTAT | TTT | chr4 | 73405019 | 73405040 | 73405024 | 73405019 | - |
| SEQ ID NO 3958 | TTTCCATTTGACTTAGATTATG | TTC | chr4 | 73405018 | 73405039 | 73405023 | 73405018 | - |
| SEQ ID NO 3959 | TCCATTTGACTTAGATTATGCA | CTT | chr4 | 73405016 | 73405037 | 73405021 | 73405016 | - |
| SEQ ID NO 3960 | CCATTTGACTTAGATTATGCAT | TTT | chr4 | 73405015 | 73405036 | 73405020 | 73405015 | - |
| SEQ ID NO 3961 | CATTTGACTTAGATTATGCATT | TTC | chr4 | 73405014 | 73405035 | 73405019 | 73405014 | - |
| SEQ ID NO 3962 | GACTTAGATTATGCATTTGTTT | TTT | chr4 | 73405009 | 73405030 | 73405014 | 73405009 | - |
| SEQ ID NO 3963 | ACTTAGATTATGCATTTGTTTC | TTG | chr4 | 73405008 | 73405029 | 73405013 | 73405008 | - |
| SEQ ID NO 3964 | AGATTATGCATTTGTTTCAAAA | CTT | chr4 | 73405004 | 73405025 | 73405009 | 73405004 | - |
| SEQ ID NO 3965 | GATTATGCATTTGTTTCAAAAT | TTA | chr4 | 73405003 | 73405024 | 73405008 | 73405003 | - |
| SEQ ID NO 3966 | TGCATTTGTTTCAAAATATTGG | TTA | chr4 | 73404998 | 73405019 | 73405003 | 73404998 | - |
| SEQ ID NO 3967 | GTTTCAAAATATTGGGCTCTGA | TTT | chr4 | 73404991 | 73405012 | 73404996 | 73404991 | - |
| SEQ ID NO 3968 | TTTCAAAATATTGGGCTCTGAT | TTG | chr4 | 73404990 | 73405011 | 73404995 | 73404990 | - |
| SEQ ID NO 3969 | CAAAATATTGGGCTCTGATTCC | TTT | chr4 | 73404987 | 73405008 | 73404992 | 73404987 | - |
| SEQ ID NO 3970 | AAAATATTGGGCTCTGATTCCT | TTC | chr4 | 73404986 | 73405007 | 73404991 | 73404986 | - |
| SEQ ID NO 3971 | GGCTCTGATTCCTACAGAAAAA | TTG | chr4 | 73404977 | 73404998 | 73404982 | 73404977 | - |
| SEQ ID NO 3972 | TGATTCCTACAGAAAAACTCAG | CTC | chr4 | 73404972 | 73404993 | 73404977 | 73404972 | - |
| SEQ ID NO 3973 | ATTCCTACAGAAAAACTCAGGA | CTG | chr4 | 73404970 | 73404991 | 73404975 | 73404970 | - |
| SEQ ID NO 3974 | CTACAGAAAAACTCAGGATGAT | TTC | chr4 | 73404966 | 73404987 | 73404971 | 73404966 | - |
| SEQ ID NO 3975 | CAGAAAAACTCAGGATGATGTT | CTA | chr4 | 73404963 | 73404984 | 73404968 | 73404963 | - |
| SEQ ID NO 3976 | AGGATGATGTTCAATTATTTCT | CTC | chr4 | 73404952 | 73404973 | 73404957 | 73404952 | - |
| SEQ ID NO 3977 | AATTATTTCTTCTGCCTTTAAA | TTC | chr4 | 73404940 | 73404961 | 73404945 | 73404940 | - |
| SEQ ID NO 3978 | TTTCTTCTGCCTTTAAACAGAA | TTA | chr4 | 73404935 | 73404956 | 73404940 | 73404935 | - |
| SEQ ID NO 3979 | CTTCTGCCTTTAAACAGAAGAA | TTT | chr4 | 73404932 | 73404953 | 73404937 | 73404932 | - |
| SEQ ID NO 3980 | TTCTGCCTTTAAACAGAAGAAT | TTC | chr4 | 73404931 | 73404952 | 73404936 | 73404931 | - |
| SEQ ID NO 3981 | CTGCCTTTAAACAGAAGAATAA | CTT | chr4 | 73404929 | 73404950 | 73404934 | 73404929 | - |
| SEQ ID NO 3982 | TGCCTTTAAACAGAAGAATAAT | TTC | chr4 | 73404928 | 73404949 | 73404933 | 73404928 | - |
| SEQ ID NO 3983 | CCTTTAAACAGAAGAATAATTC | CTG | chr4 | 73404926 | 73404947 | 73404931 | 73404926 | - |
| SEQ ID NO 3984 | TAAACAGAAGAATAATTCAATT | CTT | chr4 | 73404922 | 73404943 | 73404927 | 73404922 | - |
| SEQ ID NO 3985 | AAACAGAAGAATAATTCAATTA | TTT | chr4 | 73404921 | 73404942 | 73404926 | 73404921 | - |
| SEQ ID NO 3986 | AACAGAAGAATAATTCAATTAC | TTA | chr4 | 73404920 | 73404941 | 73404925 | 73404920 | - |
| SEQ ID NO 3987 | AATTACCAAGAATACTATTTTA | TTC | chr4 | 73404904 | 73404925 | 73404909 | 73404904 | - |
| SEQ ID NO 3988 | CCAAGAATACTATTTTAAAAAT | TTA | chr4 | 73404899 | 73404920 | 73404904 | 73404899 | - |
| SEQ ID NO 3989 | TTTTAAAAATTATTAAATATTT | CTA | chr4 | 73404887 | 73404908 | 73404892 | 73404887 | - |
| SEQ ID NO 3990 | TAAAAATTATTAAATATTTATA | TTT | chr4 | 73404884 | 73404905 | 73404889 | 73404884 | - |
| SEQ ID NO 3991 | AAAAATTATTAAATATTTATAG | TTT | chr4 | 73404883 | 73404904 | 73404888 | 73404883 | - |
| SEQ ID NO 3992 | AAAATTATTAAATATTTATAGC | TTA | chr4 | 73404882 | 73404903 | 73404887 | 73404882 | - |
| SEQ ID NO 3993 | TTAAATATTTATAGCCTTATAT | TTA | chr4 | 73404875 | 73404896 | 73404880 | 73404875 | - |
| SEQ ID NO 3994 | AATATTTATAGCCTTATATTCA | TTA | chr4 | 73404872 | 73404893 | 73404877 | 73404872 | - |
| SEQ ID NO 3995 | ATAGCCTTATATTCAAACTTAG | TTT | chr4 | 73404865 | 73404886 | 73404870 | 73404865 | - |
| SEQ ID NO 3996 | TAGCCTTATATTCAAACTTAGA | TTA | chr4 | 73404864 | 73404885 | 73404869 | 73404864 | - |
| SEQ ID NO 3997 | ATATTCAAACTTAGATAATATC | CTT | chr4 | 73404857 | 73404878 | 73404862 | 73404857 | - |
| SEQ ID NO 3998 | TATTCAAACTTAGATAATATCT | TTA | chr4 | 73404856 | 73404877 | 73404861 | 73404856 | - |
| SEQ ID NO 3999 | AAACTTAGATAATATCTAATAC | TTC | chr4 | 73404851 | 73404872 | 73404856 | 73404851 | - |
| SEQ ID NO 4000 | AGATAATATCTAATACTCTTTT | CTT | chr4 | 73404845 | 73404866 | 73404850 | 73404845 | - |
| SEQ ID NO 4001 | GATAATATCTAATACTCTTTTA | TTA | chr4 | 73404844 | 73404865 | 73404849 | 73404844 | - |
| SEQ ID NO 4002 | ATACTCTTTTAGTGTCTATCAA | CTA | chr4 | 73404833 | 73404854 | 73404838 | 73404833 | - |
| SEQ ID NO 4003 | TTTTAGTGTCTATCAACAGCAA | CTC | chr4 | 73404827 | 73404848 | 73404832 | 73404827 | - |
| SEQ ID NO 4004 | TTAGTGTCTATCAACAGCAACC | CTT | chr4 | 73404825 | 73404846 | 73404830 | 73404825 | - |
| SEQ ID NO 4005 | TAGTGTCTATCAACAGCAACCA | TTT | chr4 | 73404824 | 73404845 | 73404829 | 73404824 | - |
| SEQ ID NO 4006 | AGTGTCTATCAACAGCAACCAA | TTT | chr4 | 73404823 | 73404844 | 73404828 | 73404823 | - |
| SEQ ID NO 4007 | GTGTCTATCAACAGCAACCAAG | TTA | chr4 | 73404822 | 73404843 | 73404827 | 73404822 | - |
| SEQ ID NO 4008 | TCAACAGCAACCAAGAAGACAG | CTA | chr4 | 73404815 | 73404836 | 73404820 | 73404815 | - |

Figure 12 (Cont'd)

| | | | | | | | | |
|---|---|---|---|---|---|---|---|---|
| SEQ ID NO 4009 | AAATGAAAATAAATATAAATAC | CTA | chr4 | 73404789 | 73404810 | 73404794 | 73404789 | - |
| SEQ ID NO 4010 | TATTTATGAGATCAACAGCACA | TTC | chr4 | 73404761 | 73404782 | 73404766 | 73404761 | - |
| SEQ ID NO 4011 | TTTATGAGATCAACAGCACAGG | CTA | chr4 | 73404759 | 73404780 | 73404764 | 73404759 | - |
| SEQ ID NO 4012 | ATGAGATCAACAGCACAGGTTT | TTT | chr4 | 73404756 | 73404777 | 73404761 | 73404756 | - |
| SEQ ID NO 4013 | TGAGATCAACAGCACAGGTTTT | TTA | chr4 | 73404755 | 73404776 | 73404760 | 73404755 | - |
| SEQ ID NO 4014 | TGTGGTTTTTAAATAAAGCATA | TTT | chr4 | 73404734 | 73404755 | 73404739 | 73404734 | - |
| SEQ ID NO 4015 | GTGGTTTTTAAATAAAGCATAG | TTT | chr4 | 73404733 | 73404754 | 73404738 | 73404733 | - |
| SEQ ID NO 4016 | TGGTTTTTAAATAAAGCATAGT | TTG | chr4 | 73404732 | 73404753 | 73404737 | 73404732 | - |
| SEQ ID NO 4017 | TTAAATAAAGCATAGTGCAATG | TTT | chr4 | 73404726 | 73404747 | 73404731 | 73404726 | - |
| SEQ ID NO 4018 | TAAATAAAGCATAGTGCAATGG | TTT | chr4 | 73404725 | 73404746 | 73404730 | 73404725 | - |
| SEQ ID NO 4019 | AAATAAAGCATAGTGCAATGGA | TTT | chr4 | 73404724 | 73404745 | 73404729 | 73404724 | - |
| SEQ ID NO 4020 | AATAAAGCATAGTGCAATGGAT | TTA | chr4 | 73404723 | 73404744 | 73404728 | 73404723 | - |
| SEQ ID NO 4021 | TGGGATAGTTATGAATTCAATC | CTT | chr4 | 73404694 | 73404715 | 73404699 | 73404694 | - |
| SEQ ID NO 4022 | GGGATAGTTATGAATTCAATCT | TTT | chr4 | 73404693 | 73404714 | 73404698 | 73404693 | - |
| SEQ ID NO 4023 | GGATAGTTATGAATTCAATCTT | TTG | chr4 | 73404692 | 73404713 | 73404697 | 73404692 | - |
| SEQ ID NO 4024 | TGAATTCAATCTTCAACCCTAT | TTA | chr4 | 73404683 | 73404704 | 73404688 | 73404683 | - |
| SEQ ID NO 4025 | AATCTTCAACCCTATTCTGTGA | TTC | chr4 | 73404676 | 73404697 | 73404681 | 73404676 | - |
| SEQ ID NO 4026 | CAACCCTATTCTGTGAAGTTTC | CTT | chr4 | 73404670 | 73404691 | 73404675 | 73404670 | - |
| SEQ ID NO 4027 | AACCCTATTCTGTGAAGTTTCA | TTC | chr4 | 73404669 | 73404690 | 73404674 | 73404669 | - |
| SEQ ID NO 4028 | TTCTGTGAAGTTTCAGTCACTC | CTA | chr4 | 73404662 | 73404683 | 73404667 | 73404662 | - |
| SEQ ID NO 4029 | TGTGAAGTTTCAGTCACTCTAA | TTC | chr4 | 73404659 | 73404680 | 73404664 | 73404659 | - |
| SEQ ID NO 4030 | TGAAGTTTCAGTCACTCTAAGT | CTG | chr4 | 73404657 | 73404678 | 73404662 | 73404657 | - |
| SEQ ID NO 4031 | CAGTCACTCTAAGTTACTTTGC | TTT | chr4 | 73404649 | 73404670 | 73404654 | 73404649 | - |
| SEQ ID NO 4032 | AGTCACTCTAAGTTACTTTGCA | TTC | chr4 | 73404648 | 73404669 | 73404653 | 73404648 | - |
| SEQ ID NO 4033 | TAAGTTACTTTGCACTTTCCTT | CTC | chr4 | 73404640 | 73404661 | 73404645 | 73404640 | - |
| SEQ ID NO 4034 | AGTTACTTTGCACTTTCCTTAG | CTA | chr4 | 73404638 | 73404659 | 73404643 | 73404638 | - |
| SEQ ID NO 4035 | CTTTGCACTTTCCTTAGTGCGC | TTA | chr4 | 73404633 | 73404654 | 73404638 | 73404633 | - |
| SEQ ID NO 4036 | TGCACTTTCCTTAGTGCGCAAA | CTT | chr4 | 73404630 | 73404651 | 73404635 | 73404630 | - |
| SEQ ID NO 4037 | GCACTTTCCTTAGTGCGCAAAA | TTT | chr4 | 73404629 | 73404650 | 73404634 | 73404629 | - |
| SEQ ID NO 4038 | CACTTTCCTTAGTGCGCAAAAG | TTG | chr4 | 73404628 | 73404649 | 73404633 | 73404628 | - |
| SEQ ID NO 4039 | TCCTTAGTGCGCAAAAGAAAAT | CTT | chr4 | 73404623 | 73404644 | 73404628 | 73404623 | - |
| SEQ ID NO 4040 | CCTTAGTGCGCAAAAGAAAATT | TTT | chr4 | 73404622 | 73404643 | 73404627 | 73404622 | - |
| SEQ ID NO 4041 | CTTAGTGCGCAAAAGAAAATTA | TTC | chr4 | 73404621 | 73404642 | 73404626 | 73404621 | - |
| SEQ ID NO 4042 | AGTGCGCAAAAGAAAATTACAG | CTT | chr4 | 73404618 | 73404639 | 73404623 | 73404618 | - |
| SEQ ID NO 4043 | GTGCGCAAAAGAAAATTACAGT | TTA | chr4 | 73404617 | 73404638 | 73404622 | 73404617 | - |
| SEQ ID NO 4044 | CAGTCACTAAACAATTCTGACC | TTA | chr4 | 73404599 | 73404620 | 73404604 | 73404599 | - |
| SEQ ID NO 4045 | AACAATTCTGACCTTTTTTTTT | CTA | chr4 | 73404590 | 73404611 | 73404595 | 73404590 | - |
| SEQ ID NO 4046 | TGACCTTTTTTTTTTTTACCT | TTC | chr4 | 73404582 | 73404603 | 73404587 | 73404582 | - |
| SEQ ID NO 4047 | ACCTTTTTTTTTTTTTACCTAG | CTG | chr4 | 73404580 | 73404601 | 73404585 | 73404580 | - |
| SEQ ID NO 4048 | TTTTTTTTTTTACCTAGGATGT | CTT | chr4 | 73404575 | 73404596 | 73404580 | 73404575 | - |
| SEQ ID NO 4049 | TTTTTTTTTTACCTAGGATGTT | TTT | chr4 | 73404574 | 73404595 | 73404579 | 73404574 | - |
| SEQ ID NO 4050 | TTTTTTTTTACCTAGGATGTTT | TTT | chr4 | 73404573 | 73404594 | 73404578 | 73404573 | - |
| SEQ ID NO 4051 | TTTTTTTTACCTAGGATGTTTG | TTT | chr4 | 73404572 | 73404593 | 73404577 | 73404572 | - |
| SEQ ID NO 4052 | TTTTTTTACCTAGGATGTTTGA | TTT | chr4 | 73404571 | 73404592 | 73404576 | 73404571 | - |
| SEQ ID NO 4053 | TTTTTTACCTAGGATGTTTGAA | TTT | chr4 | 73404570 | 73404591 | 73404575 | 73404570 | - |
| SEQ ID NO 4054 | TTTTTACCTAGGATGTTTGAAT | TTT | chr4 | 73404569 | 73404590 | 73404574 | 73404569 | - |
| SEQ ID NO 4055 | TTTTACCTAGGATGTTTGAATT | TTT | chr4 | 73404568 | 73404589 | 73404573 | 73404568 | - |
| SEQ ID NO 4056 | TTTACCTAGGATGTTTGAATTT | TTT | chr4 | 73404567 | 73404588 | 73404572 | 73404567 | - |
| SEQ ID NO 4057 | TTACCTAGGATGTTTGAATTTT | TTT | chr4 | 73404566 | 73404587 | 73404571 | 73404566 | - |
| SEQ ID NO 4058 | TACCTAGGATGTTTGAATTTTA | TTT | chr4 | 73404565 | 73404586 | 73404570 | 73404565 | - |
| SEQ ID NO 4059 | ACCTAGGATGTTTGAATTTTAT | TTT | chr4 | 73404564 | 73404585 | 73404569 | 73404564 | - |
| SEQ ID NO 4060 | CCTAGGATGTTTGAATTTTATT | TTA | chr4 | 73404563 | 73404584 | 73404568 | 73404563 | - |
| SEQ ID NO 4061 | GGATGTTTGAATTTTATTAATA | CTA | chr4 | 73404559 | 73404580 | 73404564 | 73404559 | - |
| SEQ ID NO 4062 | GAATTTTATTAATAAGATAACC | TTT | chr4 | 73404551 | 73404572 | 73404556 | 73404551 | - |
| SEQ ID NO 4063 | AATTTTATTAATAAGATAACCT | TTG | chr4 | 73404550 | 73404571 | 73404555 | 73404550 | - |
| SEQ ID NO 4064 | TATTAATAAGATAACCTTGTAA | TTT | chr4 | 73404545 | 73404566 | 73404550 | 73404545 | - |
| SEQ ID NO 4065 | ATTAATAAGATAACCTTGTAAG | TTT | chr4 | 73404544 | 73404565 | 73404549 | 73404544 | - |

Figure 12 (Cont'd)

| SEQ ID NO | Sequence | Codon | Chr | Pos1 | Pos2 | Pos3 | Pos4 | |
|---|---|---|---|---|---|---|---|---|
| SEQ ID N O 4066 | TTAATAAGATAACCTTGTAAGA | TTA | chr4 | 73404543 | 73404564 | 73404548 | 73404543 | - |
| SEQ ID N O 4067 | ATAAGATAACCTTGTAAGACTT | TTA | chr4 | 73404540 | 73404561 | 73404545 | 73404540 | - |
| SEQ ID N O 4068 | GTAAGACTTCACAAATACAAAA | CTT | chr4 | 73404527 | 73404548 | 73404532 | 73404527 | - |
| SEQ ID N O 4069 | TAAGACTTCACAAATACAAAAT | TTG | chr4 | 73404526 | 73404547 | 73404531 | 73404526 | - |
| SEQ ID N O 4070 | CACAAATACAAAATACTATGCC | CTT | chr4 | 73404518 | 73404539 | 73404523 | 73404518 | - |
| SEQ ID N O 4071 | ACAAATACAAAATACTATGCCA | TTC | chr4 | 73404517 | 73404538 | 73404522 | 73404517 | - |
| SEQ ID N O 4072 | TGCCATTTTAGAAATAAATGCC | CTA | chr4 | 73404500 | 73404521 | 73404505 | 73404500 | - |
| SEQ ID N O 4073 | TAGAAATAAATGCCAAAATAAT | TTT | chr4 | 73404492 | 73404513 | 73404497 | 73404492 | - |
| SEQ ID N O 4074 | AGAAATAAATGCCAAAATAATT | TTT | chr4 | 73404491 | 73404512 | 73404496 | 73404491 | - |
| SEQ ID N O 4075 | GAAATAAATGCCAAAATAATTC | TTA | chr4 | 73404490 | 73404511 | 73404495 | 73404490 | - |
| SEQ ID N O 4076 | TTTAAGATGCAGAGTTTACTA | TTC | chr4 | 73404468 | 73404489 | 73404473 | 73404468 | - |
| SEQ ID N O 4077 | TAAAGATGCAGAGTTTACTAAA | CTT | chr4 | 73404466 | 73404487 | 73404471 | 73404466 | - |
| SEQ ID N O 4078 | AAAGATGCAGAGTTTACTAAAA | TTT | chr4 | 73404465 | 73404486 | 73404470 | 73404465 | - |
| SEQ ID N O 4079 | AAGATGCAGAGTTTACTAAAAC | TTA | chr4 | 73404464 | 73404485 | 73404469 | 73404464 | - |
| SEQ ID N O 4080 | ACTAAAACTTTATTTTACTGGG | TTT | chr4 | 73404450 | 73404471 | 73404455 | 73404450 | - |
| SEQ ID N O 4081 | CTAAAACTTTATTTTACTGGGA | TTA | chr4 | 73404449 | 73404470 | 73404454 | 73404449 | - |
| SEQ ID N O 4082 | AAACTTTATTTTACTGGGAAAA | CTA | chr4 | 73404446 | 73404467 | 73404451 | 73404446 | - |
| SEQ ID N O 4083 | TATTTTACTGGGAAAATAGAAT | CTT | chr4 | 73404440 | 73404461 | 73404445 | 73404440 | - |
| SEQ ID N O 4084 | ATTTTACTGGGAAAATAGAATA | TTT | chr4 | 73404439 | 73404460 | 73404444 | 73404439 | - |
| SEQ ID N O 4085 | TTTTACTGGGAAAATAGAATAA | TTA | chr4 | 73404438 | 73404459 | 73404443 | 73404438 | - |
| SEQ ID N O 4086 | TACTGGGAAAATAGAATAAAAG | TTT | chr4 | 73404435 | 73404456 | 73404440 | 73404435 | - |
| SEQ ID N O 4087 | ACTGGGAAAATAGAATAAAAGT | TTT | chr4 | 73404434 | 73404455 | 73404439 | 73404434 | - |
| SEQ ID N O 4088 | CTGGGAAAATAGAATAAAAGTT | TTA | chr4 | 73404433 | 73404454 | 73404438 | 73404433 | - |
| SEQ ID N O 4089 | GGAAAATAGAATAAAAGTTGAA | CTG | chr4 | 73404430 | 73404451 | 73404435 | 73404430 | - |
| SEQ ID N O 4090 | AACAATAGAAAAATGGATTTCT | TTG | chr4 | 73404410 | 73404431 | 73404415 | 73404410 | - |
| SEQ ID N O 4091 | CTTACGTGCATCTCGACGAAAC | TTT | chr4 | 73404390 | 73404411 | 73404395 | 73404390 | - |
| SEQ ID N O 4092 | TTACGTGCATCTCGACGAAACA | TTC | chr4 | 73404389 | 73404410 | 73404394 | 73404389 | - |
| SEQ ID N O 4093 | ACGTGCATCTCGACGAAACACA | CTT | chr4 | 73404387 | 73404408 | 73404392 | 73404387 | - |
| SEQ ID N O 4094 | CGTGCATCTCGACGAAACACAC | TTA | chr4 | 73404386 | 73404407 | 73404391 | 73404386 | - |
| SEQ ID N O 4095 | GACGAAACACACCCCTGGAATA | CTC | chr4 | 73404376 | 73404397 | 73404381 | 73404376 | - |
| SEQ ID N O 4096 | GAATAAGCCGAGCTAAAGAGAA | CTG | chr4 | 73404359 | 73404380 | 73404364 | 73404359 | - |
| SEQ ID N O 4097 | AAGAGAAAAGAAGGGAAATAA | CTA | chr4 | 73404344 | 73404365 | 73404349 | 73404344 | - |
| SEQ ID N O 4098 | CCCACTTCATTGTGCCAAAGGC | TTA | chr4 | 73404316 | 73404337 | 73404321 | 73404316 | - |
| SEQ ID N O 4099 | CATTGTGCCAAAGGCGTGTGGG | CTT | chr4 | 73404309 | 73404330 | 73404314 | 73404309 | - |
| SEQ ID N O 4100 | ATTGTGCCAAAGGCGTGTGGGG | TTC | chr4 | 73404308 | 73404329 | 73404313 | 73404308 | - |
| SEQ ID N O 4101 | TGCCAAAGGCGTGTGGGGTTGA | TTG | chr4 | 73404304 | 73404325 | 73404309 | 73404304 | - |
| SEQ ID N O 4102 | ACAGAAGAGAAAGCTAGGACA | TTG | chr4 | 73404283 | 73404304 | 73404288 | 73404283 | - |
| SEQ ID N O 4103 | GGACAAACGGAGGGAAATTAGC | CTA | chr4 | 73404266 | 73404287 | 73404271 | 73404266 | - |

Figure 13

| # | Sequence | PAM | Chr | Start | End | Cuts 5' of | Str |
|---|---|---|---|---|---|---|---|
| SEQ ID NO 4104 | AATAAATTTACCCAACAAAA | AAG | chr1 | 62597191 | 62597210 | 62597207 | + |
| SEQ ID NO 4105 | AATCTCTTAAAATCATAAAA | AAG | chr1 | 62597231 | 62597250 | 62597247 | + |
| SEQ ID NO 4106 | AAATCATAAAAAAGTAAAAT | TAG | chr1 | 62597240 | 62597259 | 62597256 | + |
| SEQ ID NO 4107 | GTAAAATTAGCTTTTAAAAA | CAG | chr1 | 62597253 | 62597272 | 62597269 | + |
| SEQ ID NO 4108 | TAAAATTAGCTTTTAAAAAC | AGG | chr1 | 62597254 | 62597273 | 62597270 | + |
| SEQ ID NO 4109 | AATTAGCTTTTAAAAACAGG | TAG | chr1 | 62597257 | 62597276 | 62597273 | + |
| SEQ ID NO 4110 | TTAAAAACAGGTAGTCACCA | TAG | chr1 | 62597266 | 62597285 | 62597282 | + |
| SEQ ID NO 4111 | TCACCATAGCATTGAATGTG | TAG | chr1 | 62597280 | 62597299 | 62597296 | + |
| SEQ ID NO 4112 | TGAATGTGTAGTTTATAATA | CAG | chr1 | 62597292 | 62597311 | 62597308 | + |
| SEQ ID NO 4113 | GTGTAGTTTATAATACAGCA | AAG | chr1 | 62597297 | 62597316 | 62597313 | + |
| SEQ ID NO 4114 | ACAATTTCAAATTACCTATT | AAG | chr1 | 62597326 | 62597345 | 62597342 | + |
| SEQ ID NO 4115 | TTTCAAATTACCTATTAAGT | TAG | chr1 | 62597330 | 62597349 | 62597346 | + |
| SEQ ID NO 4116 | CTCATTTCTTTGATTTCATT | TAG | chr1 | 62597356 | 62597375 | 62597372 | + |
| SEQ ID NO 4117 | AGCATTGATCTAACTCAATG | TGG | chr1 | 62597377 | 62597396 | 62597393 | + |
| SEQ ID NO 4118 | ATTGATCTAACTCAATGTGG | AAG | chr1 | 62597380 | 62597399 | 62597396 | + |
| SEQ ID NO 4119 | GATCTAACTCAATGTGGAAG | AAG | chr1 | 62597383 | 62597402 | 62597399 | + |
| SEQ ID NO 4120 | ATCTAACTCAATGTGGAAGA | AGG | chr1 | 62597384 | 62597403 | 62597400 | + |
| SEQ ID NO 4121 | GAAGAAGGTTACATTCGTGC | AAG | chr1 | 62597399 | 62597418 | 62597415 | + |
| SEQ ID NO 4122 | TACATTCGTGCAAGTTAACA | CGG | chr1 | 62597408 | 62597427 | 62597424 | + |
| SEQ ID NO 4123 | CCTACCAACCTTACCTTTTC | TGG | chr1 | 62597452 | 62597471 | 62597468 | + |
| SEQ ID NO 4124 | CTACCAACCTTACCTTTTCT | GGG | chr1 | 62597453 | 62597472 | 62597469 | + |
| SEQ ID NO 4125 | TACCTTTTCTGGGCAAATAT | TGG | chr1 | 62597463 | 62597482 | 62597479 | + |
| SEQ ID NO 4126 | TGGGCAAATATTGGTATATA | TAG | chr1 | 62597472 | 62597491 | 62597488 | + |
| SEQ ID NO 4127 | GGCAAATATTGGTATATATA | GAG | chr1 | 62597474 | 62597493 | 62597490 | + |
| SEQ ID NO 4128 | ATATTGGTATATATAGAGTT | AAG | chr1 | 62597479 | 62597498 | 62597495 | + |
| SEQ ID NO 4129 | TTGGTATATATAGAGTTAAG | AAG | chr1 | 62597482 | 62597501 | 62597498 | + |
| SEQ ID NO 4130 | ATATATAGAGTTAAGAAGTC | TAG | chr1 | 62597487 | 62597506 | 62597503 | + |
| SEQ ID NO 4131 | TATATAGAGTTAAGAAGTCT | AGG | chr1 | 62597488 | 62597507 | 62597504 | + |
| SEQ ID NO 4132 | AAGAAGTCTAGGTCTGCTTC | CAG | chr1 | 62597499 | 62597518 | 62597515 | + |
| SEQ ID NO 4133 | AAGTCTAGGTCTGCTTCCAG | AAG | chr1 | 62597502 | 62597521 | 62597518 | + |
| SEQ ID NO 4134 | GGTCTGCTTCCAGAAGAAAA | CAG | chr1 | 62597509 | 62597528 | 62597525 | + |
| SEQ ID NO 4135 | GTTGCTTGAAATTGAAAATC | AAG | chr1 | 62597538 | 62597557 | 62597554 | + |
| SEQ ID NO 4136 | AGATAAAAATGTTCACAATT | AAG | chr1 | 62597559 | 62597578 | 62597575 | + |
| SEQ ID NO 4137 | CCTTCTTTTATTGTTCCTC | TAG | chr1 | 62597584 | 62597603 | 62597600 | + |
| SEQ ID NO 4138 | GTTCCTCTAGTTATTTCCTC | CAG | chr1 | 62597597 | 62597616 | 62597613 | + |
| SEQ ID NO 4139 | TATTTCCTCCAGAATTGATC | AAG | chr1 | 62597608 | 62597627 | 62597624 | + |
| SEQ ID NO 4140 | ATCATTTGATTCTCTATCTC | CAG | chr1 | 62597638 | 62597657 | 62597654 | + |
| SEQ ID NO 4141 | CATTTGATTCTCTATCTCCA | GAG | chr1 | 62597640 | 62597659 | 62597656 | + |
| SEQ ID NO 4142 | CTATCTCCAGAGCCAAAATC | AAG | chr1 | 62597651 | 62597670 | 62597667 | + |
| SEQ ID NO 4143 | AAAATCAAGATTTGCTATGT | TAG | chr1 | 62597665 | 62597684 | 62597681 | + |
| SEQ ID NO 4144 | GTTAGACGATGTAAAAATTT | TAG | chr1 | 62597683 | 62597702 | 62597699 | + |
| SEQ ID NO 4145 | GATGTAAAAATTTTAGCCAA | TGG | chr1 | 62597690 | 62597709 | 62597706 | + |
| SEQ ID NO 4146 | TTTTAGCCAATGGCCTCCTT | CAG | chr1 | 62597700 | 62597719 | 62597716 | + |
| SEQ ID NO 4147 | AGCCAATGGCCTCCTTCAGT | TGG | chr1 | 62597704 | 62597723 | 62597720 | + |
| SEQ ID NO 4148 | GCCAATGGCCTCCTTCAGTT | GGG | chr1 | 62597705 | 62597724 | 62597721 | + |
| SEQ ID NO 4149 | GGCCTCCTTCAGTTGGGACA | TGG | chr1 | 62597711 | 62597730 | 62597727 | + |

Figure 13 (Cont'd)

| | | | | | | | |
|---|---|---|---|---|---|---|---|
| SEQ ID NO 4150 | TCAGTTGGGACATGGTCTTA | AAG | chr1 | 62597719 | 62597738 | 62597735 | + |
| SEQ ID NO 4151 | GTCTTAAAGACTTTGTCCAT | AAG | chr1 | 62597733 | 62597752 | 62597749 | + |
| SEQ ID NO 4152 | AAGACTTTGTCCATAAGACG | AAG | chr1 | 62597739 | 62597758 | 62597755 | + |
| SEQ ID NO 4153 | AGACTTTGTCCATAAGACGA | AGG | chr1 | 62597740 | 62597759 | 62597756 | + |
| SEQ ID NO 4154 | GACTTTGTCCATAAGACGAA | GGG | chr1 | 62597741 | 62597760 | 62597757 | + |
| SEQ ID NO 4155 | AAAAACTCAACATATTTGAT | CAG | chr1 | 62597784 | 62597803 | 62597800 | + |
| SEQ ID NO 4156 | TATGATCTATCGCTGCAAAC | CAG | chr1 | 62597813 | 62597832 | 62597829 | + |
| SEQ ID NO 4157 | GCTGCAAACCAGTGAAATCA | AAG | chr1 | 62597824 | 62597843 | 62597840 | + |
| SEQ ID NO 4158 | GCAAACCAGTGAAATCAAAG | AAG | chr1 | 62597827 | 62597846 | 62597843 | + |
| SEQ ID NO 4159 | AACCAGTGAAATCAAAGAAG | AAG | chr1 | 62597830 | 62597849 | 62597846 | + |
| SEQ ID NO 4160 | GTGAAATCAAAGAAGAAGAA | AAG | chr1 | 62597835 | 62597854 | 62597851 | + |
| SEQ ID NO 4161 | TGAAATCAAAGAAGAAGAAA | AGG | chr1 | 62597836 | 62597855 | 62597852 | + |
| SEQ ID NO 4162 | AAAGAAGAAGAAAAGGAACT | GAG | chr1 | 62597843 | 62597862 | 62597859 | + |
| SEQ ID NO 4163 | GAAGAAGAAAAGGAACTGAG | AAG | chr1 | 62597846 | 62597865 | 62597862 | + |
| SEQ ID NO 4164 | AAGAACTACATATAAACTAC | AAG | chr1 | 62597866 | 62597885 | 62597882 | + |
| SEQ ID NO 4165 | TAAACTACAAGTCAAAAATG | AAG | chr1 | 62597878 | 62597897 | 62597894 | + |
| SEQ ID NO 4166 | AACTACAAGTCAAAAATGAA | GAG | chr1 | 62597880 | 62597899 | 62597896 | + |
| SEQ ID NO 4167 | ACTACAAGTCAAAAATGAAG | AGG | chr1 | 62597881 | 62597900 | 62597897 | + |
| SEQ ID NO 4168 | AAGTCAAAAATGAAGAGGTA | AAG | chr1 | 62597886 | 62597905 | 62597902 | + |
| SEQ ID NO 4169 | GAACTCAACTCAAAACTTGA | AAG | chr1 | 62597921 | 62597940 | 62597937 | + |
| SEQ ID NO 4170 | CTCAAAACTTGAAAGCCTCC | TAG | chr1 | 62597929 | 62597948 | 62597945 | + |
| SEQ ID NO 4171 | AAAACTTGAAAGCCTCCTAG | AAG | chr1 | 62597932 | 62597951 | 62597948 | + |
| SEQ ID NO 4172 | AAAAATTCTACTTCAACAAA | AAG | chr1 | 62597956 | 62597975 | 62597972 | + |
| SEQ ID NO 4173 | TCAACAAAAGTGAAATATT | TAG | chr1 | 62597968 | 62597987 | 62597984 | + |
| SEQ ID NO 4174 | ACAAAAGTGAAATATTTAG | AAG | chr1 | 62597971 | 62597990 | 62597987 | + |
| SEQ ID NO 4175 | AAAAGTGAAATATTTAGAA | GAG | chr1 | 62597973 | 62597992 | 62597989 | + |
| SEQ ID NO 4176 | TCAAAATCAACCTGAAACTC | CAG | chr1 | 62598013 | 62598032 | 62598029 | + |
| SEQ ID NO 4177 | ACCTGAAACTCCAGAACACC | CAG | chr1 | 62598022 | 62598041 | 62598038 | + |
| SEQ ID NO 4178 | TGAAACTCCAGAACACCCAG | AAG | chr1 | 62598025 | 62598044 | 62598041 | + |
| SEQ ID NO 4179 | CCCAGAAGTAACTTCACTTA | AAG | chr1 | 62598040 | 62598059 | 62598056 | + |
| SEQ ID NO 4180 | GAAGTAACTTCACTTAAAGT | AAG | chr1 | 62598044 | 62598063 | 62598060 | + |
| SEQ ID NO 4181 | GTAACTTCACTTAAAGTAAG | TAG | chr1 | 62598047 | 62598066 | 62598063 | + |
| SEQ ID NO 4182 | CTTAAAGTAAGTAGAAAATA | AAG | chr1 | 62598056 | 62598075 | 62598072 | + |
| SEQ ID NO 4183 | TAAAGTAAGTAGAAAATAAA | GAG | chr1 | 62598058 | 62598077 | 62598074 | + |
| SEQ ID NO 4184 | AAAGTAAGTAGAAAATAAAG | AGG | chr1 | 62598059 | 62598078 | 62598075 | + |
| SEQ ID NO 4185 | AAGTAAGTAGAAAATAAAGA | GGG | chr1 | 62598060 | 62598079 | 62598076 | + |
| SEQ ID NO 4186 | TCATGTTTATGTTTTCAATG | TGG | chr1 | 62598084 | 62598103 | 62598100 | + |
| SEQ ID NO 4187 | CTTTTAAAAAAATATTTCT | AAG | chr1 | 62598109 | 62598128 | 62598125 | + |
| SEQ ID NO 4188 | TTTTAAAAAAATATTTCTA | AGG | chr1 | 62598110 | 62598129 | 62598126 | + |
| SEQ ID NO 4189 | GTTGAAATACTTTTTTTTCC | AAG | chr1 | 62598161 | 62598180 | 62598177 | + |
| SEQ ID NO 4190 | TTTCCAAGAAAAATAATCTC | CAG | chr1 | 62598176 | 62598195 | 62598192 | + |
| SEQ ID NO 4191 | AAATTTCCTATTATAATTTC | AAG | chr1 | 62598205 | 62598224 | 62598221 | + |
| SEQ ID NO 4192 | TTCCTATTATAATTTCAAGT | TAG | chr1 | 62598209 | 62598228 | 62598225 | + |
| SEQ ID NO 4193 | TTTATATGAAAATTACAAAT | CGG | chr1 | 62598279 | 62598298 | 62598295 | + |
| SEQ ID NO 4194 | ATCGGTTAAATTATACAATC | TAG | chr1 | 62598297 | 62598316 | 62598313 | + |
| SEQ ID NO 4195 | TACACTATTGTAAATTACTG | AAG | chr1 | 62598333 | 62598352 | 62598349 | + |
| SEQ ID NO 4196 | ACACTATTGTAAATTACTGA | AGG | chr1 | 62598334 | 62598353 | 62598350 | + |

Figure 13 (Cont'd)

| | | | | | | | |
|---|---|---|---|---|---|---|---|
| SEQ ID NO 4197 | TATTGTAAATTACTGAAGGT | AAG | chr1 | 62598338 | 62598357 | 62598354 | + |
| SEQ ID NO 4198 | AATTACTGAAGGTAAGTAAA | AAG | chr1 | 62598345 | 62598364 | 62598361 | + |
| SEQ ID NO 4199 | AAAAATTTAAAACTATTCTC | CAG | chr1 | 62598373 | 62598392 | 62598389 | + |
| SEQ ID NO 4200 | CTATTCTCCAGTGTTTAAAA | CAG | chr1 | 62598385 | 62598404 | 62598401 | + |
| SEQ ID NO 4201 | TTAAAACAGATTAAATAATA | CAG | chr1 | 62598399 | 62598418 | 62598415 | + |
| SEQ ID NO 4202 | AGATTAAATAATACAGTAAA | TGG | chr1 | 62598406 | 62598425 | 62598422 | + |
| SEQ ID NO 4203 | AAATAATACAGTAAATGGAA | AAG | chr1 | 62598411 | 62598430 | 62598427 | + |
| SEQ ID NO 4204 | TTATTCATATGAAAATATGC | TGG | chr1 | 62598436 | 62598455 | 62598452 | + |
| SEQ ID NO 4205 | TATTCATATGAAAATATGCT | GGG | chr1 | 62598437 | 62598456 | 62598453 | + |
| SEQ ID NO 4206 | TGGGCTTTTCTTTTAATTG | AAG | chr1 | 62598456 | 62598475 | 62598472 | + |
| SEQ ID NO 4207 | TTTTTCTTTTAATTGAAGTT | CAG | chr1 | 62598461 | 62598480 | 62598477 | + |
| SEQ ID NO 4208 | AAGTTCAGAAAATCAAATTT | TAG | chr1 | 62598476 | 62598495 | 62598492 | + |
| SEQ ID NO 4209 | GTTCAGAAAATCAAATTTTA | GAG | chr1 | 62598478 | 62598497 | 62598494 | + |
| SEQ ID NO 4210 | AGAAAATCAAATTTTAGAGA | TAG | chr1 | 62598482 | 62598501 | 62598498 | + |
| SEQ ID NO 4211 | TACAATTTAAATAAAATGTT | AAG | chr1 | 62598505 | 62598524 | 62598521 | + |
| SEQ ID NO 4212 | ACAATTTAAATAAAATGTTA | AGG | chr1 | 62598506 | 62598525 | 62598522 | + |
| SEQ ID NO 4213 | CAAAAATATGTGCTATTTGA | AAG | chr1 | 62598530 | 62598549 | 62598546 | + |
| SEQ ID NO 4214 | AAATATGTGCTATTTGAAAG | AAG | chr1 | 62598533 | 62598552 | 62598549 | + |
| SEQ ID NO 4215 | GCTATTTGAAAGAAGCATAC | AAG | chr1 | 62598541 | 62598560 | 62598557 | + |
| SEQ ID NO 4216 | CTATTTGAAAGAAGCATACA | AGG | chr1 | 62598542 | 62598561 | 62598558 | + |
| SEQ ID NO 4217 | TATTTGAAAGAAGCATACAA | GGG | chr1 | 62598543 | 62598562 | 62598559 | + |
| SEQ ID NO 4218 | ATTTGAAAGAAGCATACAAG | GGG | chr1 | 62598544 | 62598563 | 62598560 | + |
| SEQ ID NO 4219 | TGAAAGAAGCATACAAGGGG | AAG | chr1 | 62598547 | 62598566 | 62598563 | + |
| SEQ ID NO 4220 | GAAAGAAGCATACAAGGGGA | AGG | chr1 | 62598548 | 62598567 | 62598564 | + |
| SEQ ID NO 4221 | TCATTTTTCAAATCCATTAT | TAG | chr1 | 62598583 | 62598602 | 62598599 | + |
| SEQ ID NO 4222 | CCATTATTAGTTTAAAAATT | TAG | chr1 | 62598596 | 62598615 | 62598612 | + |
| SEQ ID NO 4223 | TTTAAAAATTTAGATTATGA | TAG | chr1 | 62598606 | 62598625 | 62598622 | + |
| SEQ ID NO 4224 | TTTAGATTATGATAGTGTTA | CAG | chr1 | 62598614 | 62598633 | 62598630 | + |
| SEQ ID NO 4225 | TTAGATTATGATAGTGTTAC | AGG | chr1 | 62598615 | 62598634 | 62598631 | + |
| SEQ ID NO 4226 | ATAGTGTTACAGGAAATTAA | TAG | chr1 | 62598625 | 62598644 | 62598641 | + |
| SEQ ID NO 4227 | GTTACAGGAAATTAATAGAA | AAG | chr1 | 62598630 | 62598649 | 62598646 | + |
| SEQ ID NO 4228 | CAGGAAATTAATAGAAAAGA | AAG | chr1 | 62598634 | 62598653 | 62598650 | + |
| SEQ ID NO 4229 | GGAAATTAATAGAAAAGAAA | GAG | chr1 | 62598636 | 62598655 | 62598652 | + |
| SEQ ID NO 4230 | GAAATTAATAGAAAAGAAAG | AGG | chr1 | 62598637 | 62598656 | 62598653 | + |
| SEQ ID NO 4231 | TTAATAGAAAAGAAAGAGGA | AAG | chr1 | 62598641 | 62598660 | 62598657 | + |
| SEQ ID NO 4232 | ACCAACCTACTCTCTATATC | CAG | chr1 | 62598673 | 62598692 | 62598689 | + |
| SEQ ID NO 4233 | TCTCTATATCCAGACTTTTG | TAG | chr1 | 62598683 | 62598702 | 62598699 | + |
| SEQ ID NO 4234 | CCAGACTTTTGTAGAAAAAC | AAG | chr1 | 62598692 | 62598711 | 62598708 | + |
| SEQ ID NO 4235 | TTTGTAGAAAACAAGATAA | TAG | chr1 | 62598699 | 62598718 | 62598715 | + |
| SEQ ID NO 4236 | AAAACAAGATAATAGCATCA | AAG | chr1 | 62598707 | 62598726 | 62598723 | + |
| SEQ ID NO 4237 | ATAGCATCAAAGACCTTCTC | CAG | chr1 | 62598718 | 62598737 | 62598734 | + |
| SEQ ID NO 4238 | CAAAGACCTTCTCCAGACCG | TGG | chr1 | 62598725 | 62598744 | 62598741 | + |
| SEQ ID NO 4239 | AGACCTTCTCCAGACCGTGG | AAG | chr1 | 62598728 | 62598747 | 62598744 | + |
| SEQ ID NO 4240 | AATATAAACAATTAAACCAA | CAG | chr1 | 62598754 | 62598773 | 62598770 | + |
| SEQ ID NO 4241 | AAACAATTAAACCAACAGCA | TAG | chr1 | 62598759 | 62598778 | 62598775 | + |
| SEQ ID NO 4242 | CCAACAGCATAGTCAAATAA | AAG | chr1 | 62598770 | 62598789 | 62598786 | + |
| SEQ ID NO 4243 | GCATAGTCAAATAAAAGAAA | TAG | chr1 | 62598776 | 62598795 | 62598792 | + |

Figure 13 (Cont'd)

| | | | | | | | |
|---|---|---|---|---|---|---|---|
| SEQ ID NO 4244 | AAATAAAAGAAATAGAAAAT | CAG | chr1 | 62598784 | 62598803 | 62598800 | + |
| SEQ ID NO 4245 | AATAAAAGAAATAGAAAATC | AGG | chr1 | 62598785 | 62598804 | 62598801 | + |
| SEQ ID NO 4246 | AAAGAAATAGAAAATCAGGT | AAG | chr1 | 62598789 | 62598808 | 62598805 | + |
| SEQ ID NO 4247 | AAATAGAAAATCAGGTAAGT | CAG | chr1 | 62598793 | 62598812 | 62598809 | + |
| SEQ ID NO 4248 | CAGGTAAGTCAGTATTTTAA | TGG | chr1 | 62598804 | 62598823 | 62598820 | + |
| SEQ ID NO 4249 | GGTATGTCCCATCTTTCACA | CAG | chr1 | 62598825 | 62598844 | 62598841 | + |
| SEQ ID NO 4250 | GTATGTCCCATCTTTCACAC | AGG | chr1 | 62598826 | 62598845 | 62598842 | + |
| SEQ ID NO 4251 | TGAATCCTAAAATTATTTAC | AAG | chr1 | 62598862 | 62598881 | 62598878 | + |
| SEQ ID NO 4252 | AATTATTTACAAGCTTTAAC | TGG | chr1 | 62598872 | 62598891 | 62598888 | + |
| SEQ ID NO 4253 | ACAAGCTTTAACTGGATCAT | GAG | chr1 | 62598880 | 62598899 | 62598896 | + |
| SEQ ID NO 4254 | CATGAGTAAAATTATCACAT | CAG | chr1 | 62598897 | 62598916 | 62598913 | + |
| SEQ ID NO 4255 | CAGCATAACTGTTAAAATTG | CAG | chr1 | 62598917 | 62598936 | 62598933 | + |
| SEQ ID NO 4256 | AGCATAACTGTTAAAATTGC | AGG | chr1 | 62598918 | 62598937 | 62598934 | + |
| SEQ ID NO 4257 | TGTTAAAATTGCAGGCTCTG | AAG | chr1 | 62598926 | 62598945 | 62598942 | + |
| SEQ ID NO 4258 | AACTACCTGCATTTAAACCA | TGG | chr1 | 62598955 | 62598974 | 62598971 | + |
| SEQ ID NO 4259 | TACTTCACCCCTTTATCTCT | CAG | chr1 | 62599008 | 62599027 | 62599024 | + |
| SEQ ID NO 4260 | GTTTCCTCACATATACTACA | AAG | chr1 | 62599030 | 62599049 | 62599046 | + |
| SEQ ID NO 4261 | ATATACTACAAAGATAATAA | CAG | chr1 | 62599040 | 62599059 | 62599056 | + |
| SEQ ID NO 4262 | AAAGATAATAACAGAACTTA | TAG | chr1 | 62599049 | 62599068 | 62599065 | + |
| SEQ ID NO 4263 | AAGATAATAACAGAACTTAT | AGG | chr1 | 62599050 | 62599069 | 62599066 | + |
| SEQ ID NO 4264 | AGAACTTATAGGATTATTGT | AAG | chr1 | 62599061 | 62599080 | 62599077 | + |
| SEQ ID NO 4265 | TAAGAAAAAAAATTAATTCA | TAG | chr1 | 62599080 | 62599099 | 62599096 | + |
| SEQ ID NO 4266 | GAAAAAAAATTAATTCATAG | CAG | chr1 | 62599083 | 62599102 | 62599099 | + |
| SEQ ID NO 4267 | CATCTTACTAAAATTCAAAT | TAG | chr1 | 62599113 | 62599132 | 62599129 | + |
| SEQ ID NO 4268 | CTTTGCTCAAAACCACACAA | TAG | chr1 | 62599147 | 62599166 | 62599163 | + |
| SEQ ID NO 4269 | GCTTTCCATTTCACTCATAT | TGG | chr1 | 62599169 | 62599188 | 62599185 | + |
| SEQ ID NO 4270 | TTTCACTCATATTGGCTCTT | TAG | chr1 | 62599177 | 62599196 | 62599193 | + |
| SEQ ID NO 4271 | TCATATTGGCTCTTTAGACC | AAG | chr1 | 62599183 | 62599202 | 62599199 | + |
| SEQ ID NO 4272 | TTGGGTAATCTTGGTCTAAA | GAG | chr1 | 62599195 | 62599214 | 62599198 | - |
| SEQ ID NO 4273 | TTGGTCTAAAGAGCCAATAT | GAG | chr1 | 62599185 | 62599204 | 62599188 | - |
| SEQ ID NO 4274 | AAGAGCCAATATGAGTGAAA | TGG | chr1 | 62599177 | 62599196 | 62599180 | - |
| SEQ ID NO 4275 | GCCAATATGAGTGAAATGGA | AAG | chr1 | 62599173 | 62599192 | 62599176 | - |
| SEQ ID NO 4276 | TGAAATGGAAAGCTATTGTG | TGG | chr1 | 62599162 | 62599181 | 62599165 | - |
| SEQ ID NO 4277 | GAAAGCTATTGTGTGGTTTT | GAG | chr1 | 62599155 | 62599174 | 62599158 | - |
| SEQ ID NO 4278 | CTATTGTGTGGTTTTGAGCA | AAG | chr1 | 62599150 | 62599169 | 62599153 | - |
| SEQ ID NO 4279 | ATTGTGTGGTTTTGAGCAAA | GAG | chr1 | 62599148 | 62599167 | 62599151 | - |
| SEQ ID NO 4280 | ACATGATCTAATTTGAATTT | TAG | chr1 | 62599123 | 62599142 | 62599126 | - |
| SEQ ID NO 4281 | GATCTAATTTGAATTTTAGT | AAG | chr1 | 62599119 | 62599138 | 62599122 | - |
| SEQ ID NO 4282 | GAATTTTAGTAAGATGACAT | TGG | chr1 | 62599109 | 62599128 | 62599112 | - |
| SEQ ID NO 4283 | TTTTCTTACAATAATCCTAT | AAG | chr1 | 62599068 | 62599087 | 62599071 | - |
| SEQ ID NO 4284 | AAGTTCTGTTATTATCTTTG | TAG | chr1 | 62599048 | 62599067 | 62599051 | - |
| SEQ ID NO 4285 | ATTATCTTTGTAGTATATGT | GAG | chr1 | 62599038 | 62599057 | 62599041 | - |
| SEQ ID NO 4286 | TTATCTTTGTAGTATATGTG | AGG | chr1 | 62599037 | 62599056 | 62599040 | - |
| SEQ ID NO 4287 | GTAGTATATGTGAGGAAACT | GAG | chr1 | 62599029 | 62599048 | 62599032 | - |
| SEQ ID NO 4288 | AGTATATGTGAGGAAACTGA | GAG | chr1 | 62599027 | 62599046 | 62599030 | - |
| SEQ ID NO 4289 | TGTGAGGAAACTGAGAGATA | AAG | chr1 | 62599021 | 62599040 | 62599024 | - |
| SEQ ID NO 4290 | GTGAGGAAACTGAGAGATAA | AGG | chr1 | 62599020 | 62599039 | 62599023 | - |

Figure 13 (Cont'd)

| SEQ ID NO | Sequence | PAM | Chr | Start | End | Cut | Strand |
|---|---|---|---|---|---|---|---|
| SEQ ID NO 4291 | TGAGGAAACTGAGAGATAAA | GGG | chr1 | 62599019 | 62599038 | 62599022 | - |
| SEQ ID NO 4292 | GAGGAAACTGAGAGATAAAG | GGG | chr1 | 62599018 | 62599037 | 62599021 | - |
| SEQ ID NO 4293 | AACTGAGAGATAAAGGGGTG | AAG | chr1 | 62599013 | 62599032 | 62599016 | - |
| SEQ ID NO 4294 | AGGGGTGAAGTAATTTATTC | AAG | chr1 | 62599000 | 62599019 | 62599003 | - |
| SEQ ID NO 4295 | GGGGTGAAGTAATTTATTCA | AGG | chr1 | 62598999 | 62599018 | 62599002 | - |
| SEQ ID NO 4296 | AATTTATTCAAGGTCACACA | AAG | chr1 | 62598989 | 62599008 | 62598992 | - |
| SEQ ID NO 4297 | TTCAAGGTCACACAAAGTTT | TAG | chr1 | 62598983 | 62599002 | 62598986 | - |
| SEQ ID NO 4298 | CAAGGTCACACAAAGTTTTA | GAG | chr1 | 62598981 | 62599000 | 62598984 | - |
| SEQ ID NO 4299 | CACACAAAGTTTTAGAGCCA | TGG | chr1 | 62598975 | 62598994 | 62598978 | - |
| SEQ ID NO 4300 | TTAGAGCCATGGTTTAAATG | CAG | chr1 | 62598964 | 62598983 | 62598967 | - |
| SEQ ID NO 4301 | TAGAGCCATGGTTTAAATGC | AGG | chr1 | 62598963 | 62598982 | 62598966 | - |
| SEQ ID NO 4302 | AGCCATGGTTTAAATGCAGG | TAG | chr1 | 62598960 | 62598979 | 62598963 | - |
| SEQ ID NO 4303 | TTTAAATGCAGGTAGTTTAT | TAG | chr1 | 62598952 | 62598971 | 62598955 | - |
| SEQ ID NO 4304 | TGCAGGTAGTTTATTAGCTT | CAG | chr1 | 62598946 | 62598965 | 62598949 | - |
| SEQ ID NO 4305 | CAGGTAGTTTATTAGCTTCA | GAG | chr1 | 62598944 | 62598963 | 62598947 | - |
| SEQ ID NO 4306 | TTCAGAGCCTGCAATTTTAA | CAG | chr1 | 62598928 | 62598947 | 62598931 | - |
| SEQ ID NO 4307 | TGATAATTTTACTCATGATC | CAG | chr1 | 62598894 | 62598913 | 62598897 | - |
| SEQ ID NO 4308 | TTTTACTCATGATCCAGTTA | AAG | chr1 | 62598888 | 62598907 | 62598891 | - |
| SEQ ID NO 4309 | TTAAAGCTTGTAAATAATTT | TAG | chr1 | 62598871 | 62598890 | 62598874 | - |
| SEQ ID NO 4310 | TAAAGCTTGTAAATAATTTT | AGG | chr1 | 62598870 | 62598889 | 62598873 | - |
| SEQ ID NO 4311 | TTGTAAATAATTTTAGGATT | CAG | chr1 | 62598864 | 62598883 | 62598867 | - |
| SEQ ID NO 4312 | TTTAGGATTCAGTGTTTTA | CAG | chr1 | 62598853 | 62598872 | 62598856 | - |
| SEQ ID NO 4313 | GTTTTTACAGACCTGTGTGA | AAG | chr1 | 62598840 | 62598859 | 62598843 | - |
| SEQ ID NO 4314 | TTACAGACCTGTGTGAAAGA | TGG | chr1 | 62598836 | 62598855 | 62598839 | - |
| SEQ ID NO 4315 | TACAGACCTGTGTGAAAGAT | GGG | chr1 | 62598835 | 62598854 | 62598838 | - |
| SEQ ID NO 4316 | CTTTTATTTGACTATGCTGT | TGG | chr1 | 62598773 | 62598792 | 62598776 | - |
| SEQ ID NO 4317 | GTTGGTTTAATTGTTTATAT | TGG | chr1 | 62598755 | 62598774 | 62598758 | - |
| SEQ ID NO 4318 | TTGTTTATATTGGTCTTCCA | CGG | chr1 | 62598745 | 62598764 | 62598748 | - |
| SEQ ID NO 4319 | TATATTGGTCTTCCACGGTC | TGG | chr1 | 62598740 | 62598759 | 62598743 | - |
| SEQ ID NO 4320 | TATTGGTCTTCCACGGTCTG | GAG | chr1 | 62598738 | 62598757 | 62598741 | - |
| SEQ ID NO 4321 | TGGTCTTCCACGGTCTGGAG | AAG | chr1 | 62598735 | 62598754 | 62598738 | - |
| SEQ ID NO 4322 | GGTCTTCCACGGTCTGGAGA | AGG | chr1 | 62598734 | 62598753 | 62598737 | - |
| SEQ ID NO 4323 | ATTATCTTGTTTTCTACAA | AAG | chr1 | 62598700 | 62598719 | 62598703 | - |
| SEQ ID NO 4324 | CTTGTTTTTCTACAAAAGTC | TGG | chr1 | 62598695 | 62598714 | 62598698 | - |
| SEQ ID NO 4325 | TTTCTACAAAAGTCTGGATA | TAG | chr1 | 62598689 | 62598708 | 62598692 | - |
| SEQ ID NO 4326 | TCTACAAAAGTCTGGATATA | GAG | chr1 | 62598687 | 62598706 | 62598690 | - |
| SEQ ID NO 4327 | TACAAAAGTCTGGATATAGA | GAG | chr1 | 62598685 | 62598704 | 62598688 | - |
| SEQ ID NO 4328 | AAAAGTCTGGATATAGAGAG | TAG | chr1 | 62598682 | 62598701 | 62598685 | - |
| SEQ ID NO 4329 | AAAGTCTGGATATAGAGAGT | AGG | chr1 | 62598681 | 62598700 | 62598684 | - |
| SEQ ID NO 4330 | TCTGGATATAGAGAGTAGGT | TGG | chr1 | 62598677 | 62598696 | 62598680 | - |
| SEQ ID NO 4331 | ATAGAGAGTAGGTTGGTTAT | AAG | chr1 | 62598670 | 62598689 | 62598673 | - |
| SEQ ID NO 4332 | CTAAATTTTTAAACTAATAA | TGG | chr1 | 62598599 | 62598618 | 62598602 | - |
| SEQ ID NO 4333 | TGGATTTGAAAAATGAATAT | TGG | chr1 | 62598579 | 62598598 | 62598582 | - |
| SEQ ID NO 4334 | CCTTGTATGCTTCTTTCAAA | TAG | chr1 | 62598545 | 62598564 | 62598548 | - |
| SEQ ID NO 4335 | ATTTTCTGAACTTCAATTAA | AAG | chr1 | 62598469 | 62598488 | 62598472 | - |
| SEQ ID NO 4336 | TGAACTTCAATTAAAAGAAA | AAG | chr1 | 62598463 | 62598482 | 62598466 | - |
| SEQ ID NO 4337 | TTCAATTAAAAGAAAAAGCC | CAG | chr1 | 62598458 | 62598477 | 62598461 | - |

Figure 13 (Cont'd)

| | | | | | | | |
|---|---|---|---|---|---|---|---|
| SEQ ID NO 4338 | ATTTAATCTGTTTTAAACAC | TGG | chr1 | 62598395 | 62598414 | 62598398 | - |
| SEQ ID NO 4339 | TTAATCTGTTTTAAACACTG | GAG | chr1 | 62598393 | 62598412 | 62598396 | - |
| SEQ ID NO 4340 | CTGTTTTAAACACTGGAGAA | TAG | chr1 | 62598388 | 62598407 | 62598391 | - |
| SEQ ID NO 4341 | TTTAACTTTTTACTTACCTT | CAG | chr1 | 62598353 | 62598372 | 62598356 | - |
| SEQ ID NO 4342 | TTACCTTCAGTAATTTACAA | TAG | chr1 | 62598340 | 62598359 | 62598343 | - |
| SEQ ID NO 4343 | TTTACAATAGTGTAATGACA | TAG | chr1 | 62598327 | 62598346 | 62598330 | - |
| SEQ ID NO 4344 | AGTGTAATGACATAGTGTTC | TAG | chr1 | 62598319 | 62598338 | 62598322 | - |
| SEQ ID NO 4345 | TCATATAAAATGCAAATTTT | CAG | chr1 | 62598268 | 62598287 | 62598271 | - |
| SEQ ID NO 4346 | AGTGTTTTCATATATAACAT | TAG | chr1 | 62598247 | 62598266 | 62598250 | - |
| SEQ ID NO 4347 | GTGTTTTCATATATAACATT | AGG | chr1 | 62598246 | 62598265 | 62598249 | - |
| SEQ ID NO 4348 | TGTTTTCATATATAACATTA | GGG | chr1 | 62598245 | 62598264 | 62598248 | - |
| SEQ ID NO 4349 | AAACTAACTTGAAATTATAA | TAG | chr1 | 62598215 | 62598234 | 62598218 | - |
| SEQ ID NO 4350 | AACTAACTTGAAATTATAAT | AGG | chr1 | 62598214 | 62598233 | 62598217 | - |
| SEQ ID NO 4351 | TAATAGGAAATTTTATTTTC | TGG | chr1 | 62598198 | 62598217 | 62598201 | - |
| SEQ ID NO 4352 | ATAGGAAATTTTATTTTCTG | GAG | chr1 | 62598196 | 62598215 | 62598199 | - |
| SEQ ID NO 4353 | TTTCTGGAGATTATTTTTCT | TGG | chr1 | 62598182 | 62598201 | 62598185 | - |
| SEQ ID NO 4354 | ATTATTTTTCTTGGAAAAAA | AAG | chr1 | 62598173 | 62598192 | 62598176 | - |
| SEQ ID NO 4355 | AGTATTTCAACAATGCAACA | AAG | chr1 | 62598152 | 62598171 | 62598155 | - |
| SEQ ID NO 4356 | ATGCAACAAAGTATTTCAAA | TGG | chr1 | 62598140 | 62598159 | 62598143 | - |
| SEQ ID NO 4357 | GTATTTCAAATGGCATGCCT | TAG | chr1 | 62598130 | 62598149 | 62598133 | - |
| SEQ ID NO 4358 | CTTAGAAATATTTTTTTTAA | AAG | chr1 | 62598112 | 62598131 | 62598115 | - |
| SEQ ID NO 4359 | CTTTATTTTCTACTTACTTT | AAG | chr1 | 62598059 | 62598078 | 62598062 | - |
| SEQ ID NO 4360 | TTTTCTACTTACTTTAAGTG | AAG | chr1 | 62598054 | 62598073 | 62598057 | - |
| SEQ ID NO 4361 | ACTTTAAGTGAAGTTACTTC | TGG | chr1 | 62598044 | 62598063 | 62598047 | - |
| SEQ ID NO 4362 | CTTTAAGTGAAGTTACTTCT | GGG | chr1 | 62598043 | 62598062 | 62598046 | - |
| SEQ ID NO 4363 | GAAGTTACTTCTGGGTGTTC | TGG | chr1 | 62598035 | 62598054 | 62598038 | - |
| SEQ ID NO 4364 | AGTTACTTCTGGGTGTTCTG | GAG | chr1 | 62598033 | 62598052 | 62598036 | - |
| SEQ ID NO 4365 | TTCTGGGTGTTCTGGAGTTT | CAG | chr1 | 62598027 | 62598046 | 62598030 | - |
| SEQ ID NO 4366 | TCTGGGTGTTCTGGAGTTTC | AGG | chr1 | 62598026 | 62598045 | 62598029 | - |
| SEQ ID NO 4367 | TTTCAGGTTGATTTGAATT | AAG | chr1 | 62598010 | 62598029 | 62598013 | - |
| SEQ ID NO 4368 | AGGTTGATTTGAATTAAGT | TAG | chr1 | 62598006 | 62598025 | 62598009 | - |
| SEQ ID NO 4369 | TGATTTGAATTAAGTTAGT | TAG | chr1 | 62598002 | 62598021 | 62598005 | - |
| SEQ ID NO 4370 | AAATATTTCACTTTTGTTG | AAG | chr1 | 62597969 | 62597988 | 62597972 | - |
| SEQ ID NO 4371 | TATTTCACTTTTTGTTGAAG | TAG | chr1 | 62597966 | 62597985 | 62597969 | - |
| SEQ ID NO 4372 | TGAAGTAGAATTTTTTCTTC | TAG | chr1 | 62597951 | 62597970 | 62597954 | - |
| SEQ ID NO 4373 | GAAGTAGAATTTTTTCTTCT | AGG | chr1 | 62597950 | 62597969 | 62597953 | - |
| SEQ ID NO 4374 | AGTAGAATTTTTTCTTCTAG | GAG | chr1 | 62597948 | 62597967 | 62597951 | - |
| SEQ ID NO 4375 | GTAGAATTTTTTCTTCTAGG | AGG | chr1 | 62597947 | 62597966 | 62597950 | - |
| SEQ ID NO 4376 | TTTTCTTCTAGGAGGCTTTC | AAG | chr1 | 62597939 | 62597958 | 62597942 | - |
| SEQ ID NO 4377 | CTAGGAGGCTTTCAAGTTTT | GAG | chr1 | 62597932 | 62597951 | 62597935 | - |
| SEQ ID NO 4378 | AGGCTTTCAAGTTTTGAGTT | GAG | chr1 | 62597927 | 62597946 | 62597930 | - |
| SEQ ID NO 4379 | TCAAGTTTTGAGTTGAGTTC | AAG | chr1 | 62597921 | 62597940 | 62597924 | - |
| SEQ ID NO 4380 | ACCTCTTCATTTTTGACTTG | TAG | chr1 | 62597885 | 62597904 | 62597888 | - |
| SEQ ID NO 4381 | TTTGACTTGTAGTTTATATG | TAG | chr1 | 62597874 | 62597893 | 62597877 | - |
| SEQ ID NO 4382 | AGTTTATATGTAGTTCTTCT | CAG | chr1 | 62597864 | 62597883 | 62597867 | - |
| SEQ ID NO 4383 | TTCTTCTTCTTTGATTTCAC | TGG | chr1 | 62597835 | 62597854 | 62597838 | - |
| SEQ ID NO 4384 | TCTTTGATTTCACTGGTTTG | CAG | chr1 | 62597828 | 62597847 | 62597831 | - |

Figure 13 (Cont'd)

| | | | | | | | |
|---|---|---|---|---|---|---|---|
| SEQ ID NO 4385 | ATTTCACTGGTTTGCAGCGA | TAG | chr1 | 62597822 | 62597841 | 62597825 | - |
| SEQ ID NO 4386 | TTGCAGCGATAGATCATAAA | AAG | chr1 | 62597811 | 62597830 | 62597814 | - |
| SEQ ID NO 4387 | AAAGACTGATCAAATATGTT | GAG | chr1 | 62597792 | 62597811 | 62597795 | - |
| SEQ ID NO 4388 | TTTGAAATATGTCATTAATT | TGG | chr1 | 62597767 | 62597786 | 62597770 | - |
| SEQ ID NO 4389 | TAATTTGGCCCTTCGTCTTA | TGG | chr1 | 62597752 | 62597771 | 62597755 | - |
| SEQ ID NO 4390 | GGCCCTTCGTCTTATGGACA | AAG | chr1 | 62597746 | 62597765 | 62597749 | - |
| SEQ ID NO 4391 | GTCTTATGGACAAAGTCTTT | AAG | chr1 | 62597738 | 62597757 | 62597741 | - |
| SEQ ID NO 4392 | TTAAGACCATGTCCCAACTG | AAG | chr1 | 62597720 | 62597739 | 62597723 | - |
| SEQ ID NO 4393 | TAAGACCATGTCCCAACTGA | AGG | chr1 | 62597719 | 62597738 | 62597722 | - |
| SEQ ID NO 4394 | AGACCATGTCCCAACTGAAG | GAG | chr1 | 62597717 | 62597736 | 62597720 | - |
| SEQ ID NO 4395 | GACCATGTCCCAACTGAAGG | AGG | chr1 | 62597716 | 62597735 | 62597719 | - |
| SEQ ID NO 4396 | TCCCAACTGAAGGAGGCCAT | TGG | chr1 | 62597709 | 62597728 | 62597712 | - |
| SEQ ID NO 4397 | AATTTTTACATCGTCTAACA | TAG | chr1 | 62597682 | 62597701 | 62597685 | - |
| SEQ ID NO 4398 | AACATAGCAAATCTTGATTT | TGG | chr1 | 62597666 | 62597685 | 62597669 | - |
| SEQ ID NO 4399 | GCAAATCTTGATTTTGGCTC | TGG | chr1 | 62597660 | 62597679 | 62597663 | - |
| SEQ ID NO 4400 | AAATCTTGATTTTGGCTCTG | GAG | chr1 | 62597658 | 62597677 | 62597661 | - |
| SEQ ID NO 4401 | CTTGATTTTGGCTCTGGAGA | TAG | chr1 | 62597654 | 62597673 | 62597657 | - |
| SEQ ID NO 4402 | TGATTTTGGCTCTGGAGATA | GAG | chr1 | 62597652 | 62597671 | 62597655 | - |
| SEQ ID NO 4403 | TGAATTGTCTTGATCAATTC | TGG | chr1 | 62597619 | 62597638 | 62597622 | - |
| SEQ ID NO 4404 | AATTGTCTTGATCAATTCTG | GAG | chr1 | 62597617 | 62597636 | 62597620 | - |
| SEQ ID NO 4405 | ATTGTCTTGATCAATTCTGG | AGG | chr1 | 62597616 | 62597635 | 62597619 | - |
| SEQ ID NO 4406 | TCAATTCTGGAGGAAATAAC | TAG | chr1 | 62597606 | 62597625 | 62597609 | - |
| SEQ ID NO 4407 | AATTCTGGAGGAAATAACTA | GAG | chr1 | 62597604 | 62597623 | 62597607 | - |
| SEQ ID NO 4408 | ATTCTGGAGGAAATAACTAG | AGG | chr1 | 62597603 | 62597622 | 62597606 | - |
| SEQ ID NO 4409 | ATAACTAGAGGAACAATAAA | AAG | chr1 | 62597591 | 62597610 | 62597594 | - |
| SEQ ID NO 4410 | ACTAGAGGAACAATAAAAAG | AAG | chr1 | 62597588 | 62597607 | 62597591 | - |
| SEQ ID NO 4411 | CTAGAGGAACAATAAAAGA | AGG | chr1 | 62597587 | 62597606 | 62597590 | - |
| SEQ ID NO 4412 | AGAGGAACAATAAAAAGAAG | GAG | chr1 | 62597585 | 62597604 | 62597588 | - |
| SEQ ID NO 4413 | TTATCTTGATTTTCAATTTC | AAG | chr1 | 62597545 | 62597564 | 62597548 | - |
| SEQ ID NO 4414 | ATTTTCAATTTCAAGCAACG | TGG | chr1 | 62597537 | 62597556 | 62597540 | - |
| SEQ ID NO 4415 | AACGTGGAACTGTTTTCTTC | TGG | chr1 | 62597521 | 62597540 | 62597524 | - |
| SEQ ID NO 4416 | GTGGAACTGTTTTCTTCTGG | AAG | chr1 | 62597518 | 62597537 | 62597521 | - |
| SEQ ID NO 4417 | GAACTGTTTTCTTCTGGAAG | CAG | chr1 | 62597515 | 62597534 | 62597518 | - |
| SEQ ID NO 4418 | TTTTCTTCTGGAAGCAGACC | TAG | chr1 | 62597509 | 62597528 | 62597512 | - |
| SEQ ID NO 4419 | TATATATACCAATATTTGCC | CAG | chr1 | 62597474 | 62597493 | 62597477 | - |
| SEQ ID NO 4420 | ATACCAATATTTGCCCAGAA | AAG | chr1 | 62597469 | 62597488 | 62597472 | - |
| SEQ ID NO 4421 | TACCAATATTTGCCCAGAAA | AGG | chr1 | 62597468 | 62597487 | 62597471 | - |
| SEQ ID NO 4422 | AATATTTGCCCAGAAAAGGT | AAG | chr1 | 62597464 | 62597483 | 62597467 | - |
| SEQ ID NO 4423 | ATATTTGCCCAGAAAAGGTA | AGG | chr1 | 62597463 | 62597482 | 62597466 | - |
| SEQ ID NO 4424 | TTGCCCAGAAAAGGTAAGGT | TGG | chr1 | 62597459 | 62597478 | 62597462 | - |
| SEQ ID NO 4425 | CCCAGAAAAGGTAAGGTTGG | TAG | chr1 | 62597456 | 62597475 | 62597459 | - |
| SEQ ID NO 4426 | CCAGAAAAGGTAAGGTTGGT | AGG | chr1 | 62597455 | 62597474 | 62597458 | - |
| SEQ ID NO 4427 | GTAAGGTTGGTAGGTGAACA | TAG | chr1 | 62597446 | 62597465 | 62597449 | - |
| SEQ ID NO 4428 | GGTGAACATAGTTAATCATT | AAG | chr1 | 62597434 | 62597453 | 62597437 | - |
| SEQ ID NO 4429 | ATGTAACCTTCTTCCACATT | GAG | chr1 | 62597393 | 62597412 | 62597396 | - |
| SEQ ID NO 4430 | AACCTTCTTCCACATTGAGT | TAG | chr1 | 62597389 | 62597408 | 62597392 | - |
| SEQ ID NO 4431 | ATCAATGCTAAATGAAATCA | AAG | chr1 | 62597366 | 62597385 | 62597369 | - |

Figure 13 (Cont'd)

| | | | | | | | |
|---|---|---|---|---|---|---|---|
| SEQ ID NO 4432 | CTAAATGAAATCAAAGAAAT | GAG | chr1 | 62597359 | 62597378 | 62597362 | - |
| SEQ ID NO 4433 | GAAATGAGCAACTAACTTAA | TAG | chr1 | 62597344 | 62597363 | 62597347 | - |
| SEQ ID NO 4434 | AAATGAGCAACTAACTTAAT | AGG | chr1 | 62597343 | 62597362 | 62597346 | - |
| SEQ ID NO 4435 | AAACTACACATTCAATGCTA | TGG | chr1 | 62597286 | 62597305 | 62597289 | - |
| SEQ ID NO 4436 | TGGTGACTACCTGTTTTTAA | AAG | chr1 | 62597266 | 62597285 | 62597269 | - |
| SEQ ID NO 4437 | TTTTACTTTTTTATGATTTT | AAG | chr1 | 62597239 | 62597258 | 62597242 | - |
| SEQ ID NO 4438 | TTACTTTTTTATGATTTTAA | GAG | chr1 | 62597237 | 62597256 | 62597240 | - |
| SEQ ID NO 4439 | TATGATTTTAAGAGATTTAC | AAG | chr1 | 62597228 | 62597247 | 62597231 | - |
| SEQ ID NO 4440 | TCAAAAATAAACTTTTTTGT | TGG | chr1 | 62597205 | 62597224 | 62597208 | - |
| SEQ ID NO 4441 | CAAAAATAAACTTTTTTGTT | GGG | chr1 | 62597204 | 62597223 | 62597207 | - |
| SEQ ID NO 4442 | GTTGGGTAAATTTATTATTA | AAG | chr1 | 62597187 | 62597206 | 62597190 | - |
| SEQ ID NO 4443 | GTAAATTTATTATTAAAGTT | GAG | chr1 | 62597182 | 62597201 | 62597185 | - |
| SEQ ID NO 4444 | TAAATTTATTATTAAAGTTG | AGG | chr1 | 62597181 | 62597200 | 62597184 | - |
| SEQ ID NO 4445 | AAATTTATTATTAAAGTTGA | GGG | chr1 | 62597180 | 62597199 | 62597183 | - |
| SEQ ID NO 4446 | AATTTATTATTAAAGTTGAG | GGG | chr1 | 62597179 | 62597198 | 62597182 | - |
| SEQ ID NO 4447 | TATTAAAGTTGAGGGGAAAA | AAG | chr1 | 62597172 | 62597191 | 62597175 | - |
| SEQ ID NO 4448 | GGGGAAAAAAGTAATGAATT | AAG | chr1 | 62597160 | 62597179 | 62597163 | - |

Figure 14

| # | Sequence | PAM | Chr | Start | End | Cuts 5' of | Str |
|---|---|---|---|---|---|---|---|
| SEQ ID NO 4449 | AACAGGTAGTCACCATAGCA | TTGAAT | chr1 | 62597271 | 62597290 | 62597287 | + |
| SEQ ID NO 4450 | TGGGCAAATATTGGTATATA | TAGAGT | chr1 | 62597472 | 62597491 | 62597488 | + |
| SEQ ID NO 4451 | GTTCCTCTAGTTATTTCCTC | CAGAAT | chr1 | 62597597 | 62597616 | 62597613 | + |
| SEQ ID NO 4452 | AAGTCAAAAATGAAGAGGTA | AAGAAT | chr1 | 62597886 | 62597905 | 62597902 | + |
| SEQ ID NO 4453 | TAAAGTAAGTAGAAAATAAA | GAGGGT | chr1 | 62598058 | 62598077 | 62598074 | + |
| SEQ ID NO 4454 | TTCATGTTTATGTTTTCAAT | GTGGAT | chr1 | 62598083 | 62598102 | 62598099 | + |
| SEQ ID NO 4455 | GAAAGAAGCATACAAGGGGA | AGGAAT | chr1 | 62598548 | 62598567 | 62598564 | + |
| SEQ ID NO 4456 | CACACAGGTCTGTAAAAACA | CTGAAT | chr1 | 62598841 | 62598860 | 62598857 | + |
| SEQ ID NO 4457 | AAATTATTTACAAGCTTTAA | CTGGAT | chr1 | 62598871 | 62598890 | 62598887 | + |
| SEQ ID NO 4458 | TTACAAGCTTTAACTGGATC | ATGAGT | chr1 | 62598878 | 62598897 | 62598894 | + |
| SEQ ID NO 4459 | CTCTAAAACTTTGTGTGACC | TTGAAT | chr1 | 62598978 | 62598997 | 62598994 | + |
| SEQ ID NO 4460 | AAAGATAATAACAGAACTTA | TAGGAT | chr1 | 62599049 | 62599068 | 62599065 | + |
| SEQ ID NO 4461 | TCTTGGTCTAAAGAGCCAAT | ATGAGT | chr1 | 62599187 | 62599206 | 62599190 | - |
| SEQ ID NO 4462 | AAAGAGAAACATGATCTAAT | TTGAAT | chr1 | 62599131 | 62599150 | 62599134 | - |
| SEQ ID NO 4463 | GTAAGATGACATTGGCTGCT | ATGAAT | chr1 | 62599101 | 62599120 | 62599104 | - |
| SEQ ID NO 4464 | GTGAGGAAACTGAGAGATAA | AGGGGT | chr1 | 62599020 | 62599039 | 62599023 | - |
| SEQ ID NO 4465 | TTAAAGCTTGTAAATAATTT | TAGGAT | chr1 | 62598871 | 62598890 | 62598874 | - |
| SEQ ID NO 4466 | TCTTGTTTTTCTACAAAAGT | CTGGAT | chr1 | 62598696 | 62598715 | 62598699 | - |
| SEQ ID NO 4467 | TCTACAAAAGTCTGGATATA | GAGAGT | chr1 | 62598687 | 62598706 | 62598690 | - |
| SEQ ID NO 4468 | TCTAAATTTTTAAACTAATA | ATGGAT | chr1 | 62598600 | 62598619 | 62598603 | - |
| SEQ ID NO 4469 | ACTAATAATGGATTTGAAAA | ATGAAT | chr1 | 62598587 | 62598606 | 62598590 | - |
| SEQ ID NO 4470 | AAAGCCCAGCATATTTTCAT | ATGAAT | chr1 | 62598444 | 62598463 | 62598447 | - |
| SEQ ID NO 4471 | TTAATCTGTTTTAAACACTG | GAGAAT | chr1 | 62598393 | 62598412 | 62598396 | - |
| SEQ ID NO 4472 | TACTTTAAGTGAAGTTACTT | CTGGGT | chr1 | 62598045 | 62598064 | 62598048 | - |
| SEQ ID NO 4473 | GAAGTTACTTCTGGGTGTTC | TGGAGT | chr1 | 62598035 | 62598054 | 62598038 | - |
| SEQ ID NO 4474 | TCTGGAGTTTCAGGTTGATT | TTGAAT | chr1 | 62598017 | 62598036 | 62598020 | - |
| SEQ ID NO 4475 | TATTTCACTTTTTGTTGAAG | TAGAAT | chr1 | 62597966 | 62597985 | 62597969 | - |
| SEQ ID NO 4476 | TTCTAGGAGGCTTTCAAGTT | TTGAGT | chr1 | 62597934 | 62597953 | 62597937 | - |
| SEQ ID NO 4477 | GGAGGCTTTCAAGTTTTGAG | TTGAGT | chr1 | 62597929 | 62597948 | 62597932 | - |
| SEQ ID NO 4478 | AAAAAGACTGATCAAATATG | TTGAGT | chr1 | 62597794 | 62597813 | 62597797 | - |
| SEQ ID NO 4479 | TGATTTTGGCTCTGGAGATA | GAGAAT | chr1 | 62597652 | 62597671 | 62597655 | - |
| SEQ ID NO 4480 | TGGAGATAGAGAATCAAATG | ATGAAT | chr1 | 62597640 | 62597659 | 62597643 | - |
| SEQ ID NO 4481 | ATTAAGCCGTGTTAACTTGC | ACGAAT | chr1 | 62597417 | 62597436 | 62597420 | - |
| SEQ ID NO 4482 | GAATGTAACCTTCTTCCACA | TTGAGT | chr1 | 62597395 | 62597414 | 62597398 | - |
| SEQ ID NO 4483 | GTCAAAAATAAACTTTTTTG | TTGGGT | chr1 | 62597206 | 62597225 | 62597209 | - |
| SEQ ID NO 4484 | AAGTTGAGGGGAAAAAAGTA | ATGAAT | chr1 | 62597167 | 62597186 | 62597170 | - |

Figure 15

| # | Sequence | PAM | Chr | Start | End | Cuts 5' of | Str |
|---|---|---|---|---|---|---|---|
| SEQ ID NO 4485 | GAAGTCTAGGTCTGCTTCCA | GAAGAAA | chr1 | 62597501 | 62597520 | 62597517 | + |
| SEQ ID NO 4486 | TGTTCCTCTAGTTATTTCCT | CCAGAAT | chr1 | 62597596 | 62597615 | 62597612 | + |
| SEQ ID NO 4487 | AAACCAGTGAAATCAAAGAA | GAAGAAA | chr1 | 62597829 | 62597848 | 62597845 | + |
| SEQ ID NO 4488 | CAAGTCAAAAATGAAGAGGT | AAAGAAT | chr1 | 62597885 | 62597904 | 62597901 | + |
| SEQ ID NO 4489 | CAAAACTTGAAAGCCTCCTA | GAAGAAA | chr1 | 62597931 | 62597950 | 62597947 | + |
| SEQ ID NO 4490 | AGTAACTTCACTTAAAGTAA | GTAGAAA | chr1 | 62598046 | 62598065 | 62598062 | + |
| SEQ ID NO 4491 | TGTTGAAATACTTTTTTTTC | CAAGAAA | chr1 | 62598160 | 62598179 | 62598176 | + |
| SEQ ID NO 4492 | TTTTCCAAGAAAAATAATCT | CCAGAAA | chr1 | 62598175 | 62598194 | 62598191 | + |
| SEQ ID NO 4493 | CTTTTTCTTTTAATTGAAGT | TCAGAAA | chr1 | 62598460 | 62598479 | 62598476 | + |
| SEQ ID NO 4494 | GATAGTGTTACAGGAAATTA | ATAGAAA | chr1 | 62598624 | 62598643 | 62598640 | + |
| SEQ ID NO 4495 | TGTTACAGGAAATTAATAGA | AAAGAAA | chr1 | 62598629 | 62598648 | 62598645 | + |
| SEQ ID NO 4496 | CTCTCTATATCCAGACTTTT | GTAGAAA | chr1 | 62598682 | 62598701 | 62598698 | + |
| SEQ ID NO 4497 | ACCAACAGCATAGTCAAATA | AAAGAAA | chr1 | 62598769 | 62598788 | 62598785 | + |
| SEQ ID NO 4498 | AGCATAGTCAAATAAAAGAA | ATAGAAA | chr1 | 62598775 | 62598794 | 62598791 | + |
| SEQ ID NO 4499 | CAGAACTTATAGGATTATTG | TAAGAAA | chr1 | 62599060 | 62599079 | 62599076 | + |
| SEQ ID NO 4500 | TATTGTGTGGTTTTGAGCAA | AGAGAAA | chr1 | 62599149 | 62599168 | 62599152 | - |
| SEQ ID NO 4501 | GATTTTCTGAACTTCAATTA | AAAGAAA | chr1 | 62598470 | 62598489 | 62598473 | - |
| SEQ ID NO 4502 | TTTAATCTGTTTTAAACACT | GGAGAAT | chr1 | 62598394 | 62598413 | 62598397 | - |
| SEQ ID NO 4503 | AGTATTTCAAATGGCATGCC | TTAGAAA | chr1 | 62598131 | 62598150 | 62598134 | - |
| SEQ ID NO 4504 | ATATTTCACTTTTTGTTGAA | GTAGAAT | chr1 | 62597967 | 62597986 | 62597970 | - |
| SEQ ID NO 4505 | TTGATTTTGGCTCTGGAGAT | AGAGAAT | chr1 | 62597653 | 62597672 | 62597656 | - |
| SEQ ID NO 4506 | CTATATATACCAATATTTGC | CCAGAAA | chr1 | 62597475 | 62597494 | 62597478 | - |
| SEQ ID NO 4507 | GATCAATGCTAAATGAAATC | AAAGAAA | chr1 | 62597367 | 62597386 | 62597370 | - |

Figure 16

| # | Sequence | PAM | Chr | Start | End | Cuts 5' of | Str |
|---|---|---|---|---|---|---|---|
| SEQ ID NO 4508 | AAAAAGTAAAATTAGCTTTT | AAAAAC | chr1 | 62597248 | 62597267 | 62597264 | + |
| SEQ ID NO 4509 | GTCTAGGTCTGCTTCCAGAA | GAAAAC | chr1 | 62597504 | 62597523 | 62597520 | + |
| SEQ ID NO 4510 | CCAAATTAATGACATATTTC | AAAAAC | chr1 | 62597764 | 62597783 | 62597780 | + |
| SEQ ID NO 4511 | TATGTCACTTGAACTCAACT | CAAAAC | chr1 | 62597911 | 62597930 | 62597927 | + |
| SEQ ID NO 4512 | GTTTCCCTAATGTTATATAT | GAAAAC | chr1 | 62598238 | 62598257 | 62598254 | + |
| SEQ ID NO 4513 | GTAAAAGTTAAAAAAAATT | TAAAAC | chr1 | 62598360 | 62598379 | 62598376 | + |
| SEQ ID NO 4514 | TAAAACTATTCTCCAGTGTT | TAAAAC | chr1 | 62598380 | 62598399 | 62598396 | + |
| SEQ ID NO 4515 | CTATATCCAGACTTTTGTAG | AAAAAC | chr1 | 62598686 | 62598705 | 62598702 | + |
| SEQ ID NO 4516 | CATCTTTCACACAGGTCTGT | AAAAAC | chr1 | 62598834 | 62598853 | 62598850 | + |
| SEQ ID NO 4517 | CTGCATTTAAACCATGGCTC | TAAAAC | chr1 | 62598961 | 62598980 | 62598977 | + |
| SEQ ID NO 4518 | AGATCATGTTTCTCTTTGCT | CAAAAC | chr1 | 62599134 | 62599153 | 62599150 | + |
| SEQ ID NO 4519 | TATATAACATTAGGGAAACA | AAAAAC | chr1 | 62598237 | 62598256 | 62598240 | - |
| SEQ ID NO 4520 | TTTTTTAAAAGATCCACATT | GAAAAC | chr1 | 62598100 | 62598119 | 62598103 | - |

Figure 17

| # | Sequence | PAM | Chr | Start | End | Cuts 5' of | Str |
|---|---|---|---|---|---|---|---|
| SEQ ID NO 4521 | ATAATAAATTTACCCAACAA | AAAAGTTT | chr1 | 62597189 | 62597208 | 62597205 | + |
| SEQ ID NO 4522 | TAAAATCATAAAAAAGTAAA | ATTAGCTT | chr1 | 62597238 | 62597257 | 62597254 | + |
| SEQ ID NO 4523 | AGTCACCATAGCATTGAATG | TGTAGTTT | chr1 | 62597278 | 62597297 | 62597294 | + |
| SEQ ID NO 4524 | ATTAAGTTAGTTGCTCATTT | CTTTGATT | chr1 | 62597343 | 62597362 | 62597359 | + |
| SEQ ID NO 4525 | GTTACATTCGTGCAAGTTAA | CACGGCTT | chr1 | 62597406 | 62597425 | 62597422 | + |
| SEQ ID NO 4526 | TCGTGCAAGTTAACACGGCT | TAATGATT | chr1 | 62597413 | 62597432 | 62597429 | + |
| SEQ ID NO 4527 | TATAGAGTTAAGAAGTCTAG | GTCTGCTT | chr1 | 62597490 | 62597509 | 62597506 | + |
| SEQ ID NO 4528 | TCCAGAAGAAAACAGTTCCA | CGTTGCTT | chr1 | 62597517 | 62597536 | 62597533 | + |
| SEQ ID NO 4529 | ATTGATCAAGACAATTCATC | ATTTGATT | chr1 | 62597621 | 62597640 | 62597637 | + |
| SEQ ID NO 4530 | CTCTATCTCCAGAGCCAAAA | TCAAGATT | chr1 | 62597649 | 62597668 | 62597665 | + |
| SEQ ID NO 4531 | AAGTAGAAAATAAAGAGGGT | TCATGTTT | chr1 | 62598064 | 62598083 | 62598080 | + |
| SEQ ID NO 4532 | AAAATAAAGAGGGTTCATGT | TTATGTTT | chr1 | 62598070 | 62598089 | 62598086 | + |
| SEQ ID NO 4533 | ATTTCCTATTATAATTTCAA | GTTAGTTT | chr1 | 62598207 | 62598226 | 62598223 | + |
| SEQ ID NO 4534 | ATTATAATTTCAAGTTAGTT | TTTTGTTT | chr1 | 62598214 | 62598233 | 62598230 | + |
| SEQ ID NO 4535 | AAAAATTTAAAACTATTCTC | CAGTGTTT | chr1 | 62598373 | 62598392 | 62598389 | + |
| SEQ ID NO 4536 | AACTATTCTCCAGTGTTTAA | AACAGATT | chr1 | 62598383 | 62598402 | 62598399 | + |
| SEQ ID NO 4537 | TTAAATAATACAGTAAATGG | AAAAGATT | chr1 | 62598409 | 62598428 | 62598425 | + |
| SEQ ID NO 4538 | TTTATTCATATGAAAATATG | CTGGGCTT | chr1 | 62598435 | 62598454 | 62598451 | + |
| SEQ ID NO 4539 | ATTCATTTTTCAAATCCATT | ATTAGTTT | chr1 | 62598581 | 62598600 | 62598597 | + |
| SEQ ID NO 4540 | ATCCATTATTAGTTTAAAAA | TTTAGATT | chr1 | 62598594 | 62598613 | 62598610 | + |
| SEQ ID NO 4541 | ACTGAATCCTAAAATTATTT | ACAAGCTT | chr1 | 62598860 | 62598879 | 62598876 | + |
| SEQ ID NO 4542 | ATTACTTCACCCCTTTATCT | CTCAGTTT | chr1 | 62599006 | 62599025 | 62599022 | + |
| SEQ ID NO 4543 | CAAAGATAATAACAGAACTT | ATAGGATT | chr1 | 62599048 | 62599067 | 62599064 | + |
| SEQ ID NO 4544 | TTACTAAAATTCAAATTAGA | TCATGTTT | chr1 | 62599117 | 62599136 | 62599133 | + |
| SEQ ID NO 4545 | CTCTTTGCTCAAAACCACAC | AATAGCTT | chr1 | 62599145 | 62599164 | 62599161 | + |
| SEQ ID NO 4546 | ACTCATATTGGCTCTTTAGA | CCAAGATT | chr1 | 62599181 | 62599200 | 62599197 | + |
| SEQ ID NO 4547 | AGTGAAATGGAAAGCTATTG | TGTGGTTT | chr1 | 62599164 | 62599183 | 62599167 | - |
| SEQ ID NO 4548 | GTAATTTATTCAAGGTCACA | CAAAGTTT | chr1 | 62598991 | 62599010 | 62598994 | - |
| SEQ ID NO 4549 | GTCACACAAAGTTTTAGAGC | CATGGTTT | chr1 | 62598977 | 62598996 | 62598980 | - |
| SEQ ID NO 4550 | AGAGCCATGGTTTAAATGCA | GGTAGTTT | chr1 | 62598962 | 62598981 | 62598965 | - |
| SEQ ID NO 4551 | GGTTTAAATGCAGGTAGTTT | ATTAGCTT | chr1 | 62598954 | 62598973 | 62598957 | - |
| SEQ ID NO 4552 | AATTTTACTCATGATCCAGT | TAAAGCTT | chr1 | 62598890 | 62598909 | 62598893 | - |
| SEQ ID NO 4553 | GTTAAAGCTTGTAAATAATT | TTAGGATT | chr1 | 62598872 | 62598891 | 62598875 | - |
| SEQ ID NO 4554 | TTGTAAATAATTTTAGGATT | CAGTGTTT | chr1 | 62598864 | 62598883 | 62598867 | - |
| SEQ ID NO 4555 | TACCATTAAAATACTGACTT | ACCTGATT | chr1 | 62598809 | 62598828 | 62598812 | - |
| SEQ ID NO 4556 | TTCTTTTATTTGACTATGCT | GTTGGTTT | chr1 | 62598775 | 62598794 | 62598778 | - |
| SEQ ID NO 4557 | TTTGACTATGCTGTTGGTTT | AATTGTTT | chr1 | 62598767 | 62598786 | 62598770 | - |
| SEQ ID NO 4558 | GAAGGTCTTTGATGCTATTA | TCTTGTTT | chr1 | 62598716 | 62598735 | 62598719 | - |
| SEQ ID NO 4559 | TAGAGAGTAGGTTGGTTATA | AGTTGCTT | chr1 | 62598669 | 62598688 | 62598672 | - |
| SEQ ID NO 4560 | ATCTAAATTTTTAAACTAAT | AATGGATT | chr1 | 62598601 | 62598620 | 62598604 | - |
| SEQ ID NO 4561 | ATTGGCAATTCCTTCCCCTT | GTATGCTT | chr1 | 62598561 | 62598580 | 62598564 | - |
| SEQ ID NO 4562 | TAAATTGTACTATCTCTAAA | ATTTGATT | chr1 | 62598494 | 62598513 | 62598497 | - |
| SEQ ID NO 4563 | TCCATTTACTGTATTATTTA | ATCTGTTT | chr1 | 62598410 | 62598429 | 62598413 | - |
| SEQ ID NO 4564 | ATCTGTTTTAAACACTGGAG | AATAGTTT | chr1 | 62598390 | 62598409 | 62598393 | - |
| SEQ ID NO 4565 | ATAGTGTAATGACATAGTGT | TCTAGATT | chr1 | 62598321 | 62598340 | 62598324 | - |
| SEQ ID NO 4566 | TGTTCTAGATTGTATAATTT | AACCGATT | chr1 | 62598304 | 62598323 | 62598307 | - |
| SEQ ID NO 4567 | TCATATAAAATGCAAATTTT | CAGTGTTT | chr1 | 62598268 | 62598287 | 62598271 | - |
| SEQ ID NO 4568 | TAATAGGAAATTTTATTTTC | TGGAGATT | chr1 | 62598198 | 62598217 | 62598201 | - |
| SEQ ID NO 4569 | GAAGTTACTTCTGGGTGTTC | TGGAGTTT | chr1 | 62598035 | 62598054 | 62598038 | - |
| SEQ ID NO 4570 | CTGGGTGTTCTGGAGTTTCA | GGTTGATT | chr1 | 62598025 | 62598044 | 62598028 | - |

Figure 17 (Cont'd)

| | | | | | | | |
|---|---|---|---|---|---|---|---|
| SEQ ID NO 4571 | AAGTAGAATTTTTTCTTCTA | GGAGGCTT | chr1 | 62597949 | 62597968 | 62597952 | - |
| SEQ ID NO 4572 | TTTTTTCTTCTAGGAGGCTT | TCAAGTTT | chr1 | 62597941 | 62597960 | 62597944 | - |
| SEQ ID NO 4573 | TTACCTCTTCATTTTTGACT | TGTAGTTT | chr1 | 62597887 | 62597906 | 62597890 | - |
| SEQ ID NO 4574 | TCTCAGTTCCTTTTCTTCTT | CTTTGATT | chr1 | 62597847 | 62597866 | 62597850 | - |
| SEQ ID NO 4575 | TTTTCTTCTTCTTTGATTTC | ACTGGTTT | chr1 | 62597837 | 62597856 | 62597840 | - |
| SEQ ID NO 4576 | AAAAAGACTGATCAAATATG | TTGAGTTT | chr1 | 62597794 | 62597813 | 62597797 | - |
| SEQ ID NO 4577 | ACATCGTCTAACATAGCAAA | TCTTGATT | chr1 | 62597675 | 62597694 | 62597678 | - |
| SEQ ID NO 4578 | CTAGAGGAACAATAAAAAGA | AGGAGCTT | chr1 | 62597587 | 62597606 | 62597590 | - |
| SEQ ID NO 4579 | CTTAATTGTGAACATTTTTA | TCTTGATT | chr1 | 62597562 | 62597581 | 62597565 | - |
| SEQ ID NO 4580 | TTCAATTTCAAGCAACGTGG | AACTGTTT | chr1 | 62597534 | 62597553 | 62597537 | - |
| SEQ ID NO 4581 | CATTCAATGCTATGGTGACT | ACCTGTTT | chr1 | 62597278 | 62597297 | 62597281 | - |
| SEQ ID NO 4582 | TAAAAGCTAATTTTACTTTT | TTATGATT | chr1 | 62597249 | 62597268 | 62597252 | - |
| SEQ ID NO 4583 | TTTTACTTTTTTATGATTTT | AAGAGATT | chr1 | 62597239 | 62597258 | 62597242 | - |

Figure 18

| # | Sequence | PAM | Chr | Start | End | Cut site 1 (5' of) | Cut site 2 (5' of) | Str |
|---|---|---|---|---|---|---|---|---|
| SEQ ID NO 4584 | AATTCATTACTTTTTTCCCCTC | CTT | chr1 | 62597160 | 62597181 | 62597177 | 62597182 | + |
| SEQ ID NO 4585 | ATTCATTACTTTTTTCCCCTCA | TTA | chr1 | 62597161 | 62597182 | 62597178 | 62597183 | + |
| SEQ ID NO 4586 | ATTACTTTTTTCCCCTCAACTT | TTC | chr1 | 62597165 | 62597186 | 62597182 | 62597187 | + |
| SEQ ID NO 4587 | CTTTTTTCCCCTCAACTTTAAT | TTA | chr1 | 62597169 | 62597190 | 62597186 | 62597191 | + |
| SEQ ID NO 4588 | TTTTCCCCTCAACTTTAATAAT | CTT | chr1 | 62597172 | 62597193 | 62597189 | 62597194 | + |
| SEQ ID NO 4589 | TTTCCCCTCAACTTTAATAATA | TTT | chr1 | 62597173 | 62597194 | 62597190 | 62597195 | + |
| SEQ ID NO 4590 | TTCCCCTCAACTTTAATAATAA | TTT | chr1 | 62597174 | 62597195 | 62597191 | 62597196 | + |
| SEQ ID NO 4591 | TCCCCTCAACTTTAATAATAAA | TTT | chr1 | 62597175 | 62597196 | 62597192 | 62597197 | + |
| SEQ ID NO 4592 | CCCCTCAACTTTAATAATAAAT | TTT | chr1 | 62597176 | 62597197 | 62597193 | 62597198 | + |
| SEQ ID NO 4593 | CCCTCAACTTTAATAATAAATT | TTC | chr1 | 62597177 | 62597198 | 62597194 | 62597199 | + |
| SEQ ID NO 4594 | AACTTTAATAATAAATTTACCC | CTC | chr1 | 62597182 | 62597203 | 62597199 | 62597204 | + |
| SEQ ID NO 4595 | TAATAATAAATTTACCCAACAA | CTT | chr1 | 62597187 | 62597208 | 62597204 | 62597209 | + |
| SEQ ID NO 4596 | AATAATAAATTTACCCAACAAA | TTT | chr1 | 62597188 | 62597209 | 62597205 | 62597210 | + |
| SEQ ID NO 4597 | ATAATAAATTTACCCAACAAAA | TTA | chr1 | 62597189 | 62597210 | 62597206 | 62597211 | + |
| SEQ ID NO 4598 | ACCCAACAAAAAGTTTATTTT | TTT | chr1 | 62597200 | 62597221 | 62597217 | 62597222 | + |
| SEQ ID NO 4599 | CCCAACAAAAAGTTTATTTTT | TTA | chr1 | 62597201 | 62597222 | 62597218 | 62597223 | + |
| SEQ ID NO 4600 | ATTTTTGACTTGTAAATCTCTT | TTT | chr1 | 62597217 | 62597238 | 62597234 | 62597239 | + |
| SEQ ID NO 4601 | TTTTTGACTTGTAAATCTCTTA | TTA | chr1 | 62597218 | 62597239 | 62597235 | 62597240 | + |
| SEQ ID NO 4602 | TTGACTTGTAAATCTCTTAAAA | TTT | chr1 | 62597221 | 62597242 | 62597238 | 62597243 | + |
| SEQ ID NO 4603 | TGACTTGTAAATCTCTTAAAAT | TTT | chr1 | 62597222 | 62597243 | 62597239 | 62597244 | + |
| SEQ ID NO 4604 | GACTTGTAAATCTCTTAAAATC | TTT | chr1 | 62597223 | 62597244 | 62597240 | 62597245 | + |
| SEQ ID NO 4605 | ACTTGTAAATCTCTTAAAATCA | TTG | chr1 | 62597224 | 62597245 | 62597241 | 62597246 | + |
| SEQ ID NO 4606 | GTAAATCTCTTAAAATCATAAA | CTT | chr1 | 62597228 | 62597249 | 62597245 | 62597250 | + |
| SEQ ID NO 4607 | TAAATCTCTTAAAATCATAAAA | TTG | chr1 | 62597229 | 62597250 | 62597246 | 62597251 | + |
| SEQ ID NO 4608 | TTAAAATCATAAAAAAGTAAAA | CTC | chr1 | 62597237 | 62597258 | 62597254 | 62597259 | + |
| SEQ ID NO 4609 | AAAATCATAAAAAAGTAAAATT | CTT | chr1 | 62597239 | 62597260 | 62597256 | 62597261 | + |
| SEQ ID NO 4610 | AAATCATAAAAAAGTAAAATTA | TTA | chr1 | 62597240 | 62597261 | 62597257 | 62597262 | + |
| SEQ ID NO 4611 | GCTTTTAAAAACAGGTAGTCAC | TTA | chr1 | 62597262 | 62597283 | 62597279 | 62597284 | + |
| SEQ ID NO 4612 | TTAAAAACAGGTAGTCACCATA | CTT | chr1 | 62597266 | 62597287 | 62597283 | 62597288 | + |
| SEQ ID NO 4613 | TAAAAACAGGTAGTCACCATAG | TTT | chr1 | 62597267 | 62597288 | 62597284 | 62597289 | + |
| SEQ ID NO 4614 | AAAAACAGGTAGTCACCATAGC | TTT | chr1 | 62597268 | 62597289 | 62597285 | 62597290 | + |
| SEQ ID NO 4615 | AAAACAGGTAGTCACCATAGCA | TTA | chr1 | 62597269 | 62597290 | 62597286 | 62597291 | + |
| SEQ ID NO 4616 | AATGTGTAGTTTATAATACAGC | TTG | chr1 | 62597294 | 62597315 | 62597311 | 62597316 | + |
| SEQ ID NO 4617 | ATAATACAGCAAAGTTAAATAC | TTT | chr1 | 62597306 | 62597327 | 62597323 | 62597328 | + |
| SEQ ID NO 4618 | TAATACAGCAAAGTTAAATACA | TTA | chr1 | 62597307 | 62597328 | 62597324 | 62597329 | + |
| SEQ ID NO 4619 | AATACAATTTCAAATTACCTAT | TTA | chr1 | 62597323 | 62597344 | 62597340 | 62597345 | + |
| SEQ ID NO 4620 | CAAATTACCTATTAAGTTAGTT | TTT | chr1 | 62597333 | 62597354 | 62597350 | 62597355 | + |
| SEQ ID NO 4621 | AAATTACCTATTAAGTTAGTTG | TTC | chr1 | 62597334 | 62597355 | 62597351 | 62597356 | + |
| SEQ ID NO 4622 | CCTATTAAGTTAGTTGCTCATT | TTA | chr1 | 62597340 | 62597361 | 62597357 | 62597362 | + |
| SEQ ID NO 4623 | TTAAGTTAGTTGCTCATTTCTT | CTA | chr1 | 62597344 | 62597365 | 62597361 | 62597366 | + |
| SEQ ID NO 4624 | AGTTAGTTGCTCATTTCTTTGA | TTA | chr1 | 62597347 | 62597368 | 62597364 | 62597369 | + |
| SEQ ID NO 4625 | GTTGCTCATTTCTTTGATTTCA | TTA | chr1 | 62597352 | 62597373 | 62597369 | 62597374 | + |
| SEQ ID NO 4626 | CTCATTTCTTTGATTTCATTTA | TTG | chr1 | 62597356 | 62597377 | 62597373 | 62597378 | + |
| SEQ ID NO 4627 | ATTTCTTTGATTTCATTTAGCA | CTC | chr1 | 62597359 | 62597380 | 62597376 | 62597381 | + |
| SEQ ID NO 4628 | CTTTGATTTCATTTAGCATTGA | TTT | chr1 | 62597363 | 62597384 | 62597380 | 62597385 | + |
| SEQ ID NO 4629 | TTTGATTTCATTTAGCATTGAT | TTC | chr1 | 62597364 | 62597385 | 62597381 | 62597386 | + |
| SEQ ID NO 4630 | TGATTTCATTTAGCATTGATCT | CTT | chr1 | 62597366 | 62597387 | 62597383 | 62597388 | + |
| SEQ ID NO 4631 | GATTTCATTTAGCATTGATCTA | TTT | chr1 | 62597367 | 62597388 | 62597384 | 62597389 | + |
| SEQ ID NO 4632 | ATTTCATTTAGCATTGATCTAA | TTG | chr1 | 62597368 | 62597389 | 62597385 | 62597390 | + |
| SEQ ID NO 4633 | CATTTAGCATTGATCTAACTCA | TTT | chr1 | 62597372 | 62597393 | 62597389 | 62597394 | + |
| SEQ ID NO 4634 | ATTTAGCATTGATCTAACTCAA | TTC | chr1 | 62597373 | 62597394 | 62597390 | 62597395 | + |
| SEQ ID NO 4635 | AGCATTGATCTAACTCAATGTG | TTT | chr1 | 62597377 | 62597398 | 62597394 | 62597399 | + |
| SEQ ID NO 4636 | GCATTGATCTAACTCAATGTGG | TTA | chr1 | 62597378 | 62597399 | 62597395 | 62597400 | + |
| SEQ ID NO 4637 | ATCTAACTCAATGTGGAAGAAG | TTG | chr1 | 62597384 | 62597405 | 62597401 | 62597406 | + |
| SEQ ID NO 4638 | ACTCAATGTGGAAGAAGGTTAC | CTA | chr1 | 62597389 | 62597410 | 62597406 | 62597411 | + |
| SEQ ID NO 4639 | AATGTGGAAGAAGGTTACATTC | CTC | chr1 | 62597393 | 62597414 | 62597410 | 62597415 | + |
| SEQ ID NO 4640 | CATTCGTGCAAGTTAACACGGC | TTA | chr1 | 62597410 | 62597431 | 62597427 | 62597432 | + |

Figure 18 (Cont'd)

| SEQ ID NO 4641 | GTGCAAGTTAACACGGCTTAAT | TTC | chr1 | 62597415 | 62597436 | 62597432 | 62597437 | + |
| SEQ ID NO 4642 | ACACGGCTTAATGATTAACTAT | TTA | chr1 | 62597425 | 62597446 | 62597442 | 62597447 | + |
| SEQ ID NO 4643 | AATGATTAACTATGTTCACCTA | CTT | chr1 | 62597434 | 62597455 | 62597451 | 62597456 | + |
| SEQ ID NO 4644 | ATGATTAACTATGTTCACCTAC | TTA | chr1 | 62597435 | 62597456 | 62597452 | 62597457 | + |
| SEQ ID NO 4645 | ACTATGTTCACCTACCAACCTT | TTA | chr1 | 62597442 | 62597463 | 62597459 | 62597464 | + |
| SEQ ID NO 4646 | TGTTCACCTACCAACCTTACCT | CTA | chr1 | 62597446 | 62597467 | 62597463 | 62597468 | + |
| SEQ ID NO 4647 | ACCTACCAACCTTACCTTTTCT | TTC | chr1 | 62597451 | 62597472 | 62597468 | 62597473 | + |
| SEQ ID NO 4648 | CCAACCTTACCTTTTCTGGGCA | CTA | chr1 | 62597456 | 62597477 | 62597473 | 62597478 | + |
| SEQ ID NO 4649 | ACCTTTTCTGGGCAAATATTGG | CTT | chr1 | 62597464 | 62597485 | 62597481 | 62597486 | + |
| SEQ ID NO 4650 | CCTTTTCTGGGCAAATATTGGT | TTA | chr1 | 62597465 | 62597486 | 62597482 | 62597487 | + |
| SEQ ID NO 4651 | TTCTGGGCAAATATTGGTATAT | CTT | chr1 | 62597469 | 62597490 | 62597486 | 62597491 | + |
| SEQ ID NO 4652 | TCTGGGCAAATATTGGTATATA | TTT | chr1 | 62597470 | 62597491 | 62597487 | 62597492 | + |
| SEQ ID NO 4653 | CTGGGCAAATATTGGTATATAT | TTT | chr1 | 62597471 | 62597492 | 62597488 | 62597493 | + |
| SEQ ID NO 4654 | TGGGCAAATATTGGTATATATA | TTC | chr1 | 62597472 | 62597493 | 62597489 | 62597494 | + |
| SEQ ID NO 4655 | GGCAAATATTGGTATATATAGA | CTG | chr1 | 62597474 | 62597495 | 62597491 | 62597496 | + |
| SEQ ID NO 4656 | GTATATATAGAGTTAAGAAGTC | TTG | chr1 | 62597485 | 62597506 | 62597502 | 62597507 | + |
| SEQ ID NO 4657 | AGAAGTCTAGGTCTGCTTCCAG | TTA | chr1 | 62597500 | 62597521 | 62597517 | 62597522 | + |
| SEQ ID NO 4658 | GGTCTGCTTCCAGAAGAAAACA | CTA | chr1 | 62597509 | 62597530 | 62597526 | 62597531 | + |
| SEQ ID NO 4659 | CTTCCAGAAGAAAACAGTTCCA | CTG | chr1 | 62597515 | 62597536 | 62597532 | 62597537 | + |
| SEQ ID NO 4660 | CCAGAAGAAAACAGTTCCACGT | CTT | chr1 | 62597518 | 62597539 | 62597535 | 62597540 | + |
| SEQ ID NO 4661 | CAGAAGAAAACAGTTCCACGTT | TTC | chr1 | 62597519 | 62597540 | 62597536 | 62597541 | + |
| SEQ ID NO 4662 | CACGTTGCTTGAAATTGAAAAT | TTC | chr1 | 62597535 | 62597556 | 62597552 | 62597557 | + |
| SEQ ID NO 4663 | CTTGAAATTGAAAATCAAGATA | TTG | chr1 | 62597542 | 62597563 | 62597559 | 62597564 | + |
| SEQ ID NO 4664 | GAAATTGAAAATCAAGATAAAA | CTT | chr1 | 62597545 | 62597566 | 62597562 | 62597567 | + |
| SEQ ID NO 4665 | AAATTGAAAATCAAGATAAAAA | TTG | chr1 | 62597546 | 62597567 | 62597563 | 62597568 | + |
| SEQ ID NO 4666 | AAAATCAAGATAAAAATGTTCA | TTG | chr1 | 62597552 | 62597573 | 62597569 | 62597574 | + |
| SEQ ID NO 4667 | ACAATTAAGCTCCTTCTTTTTA | TTC | chr1 | 62597573 | 62597594 | 62597590 | 62597595 | + |
| SEQ ID NO 4668 | AGCTCCTTCTTTTTATTGTTCC | TTA | chr1 | 62597580 | 62597601 | 62597597 | 62597602 | + |
| SEQ ID NO 4669 | CTTCTTTTTATTGTTCCTCTAG | CTC | chr1 | 62597585 | 62597606 | 62597602 | 62597607 | + |
| SEQ ID NO 4670 | CTTTTTATTGTTCCTCTAGTTA | CTT | chr1 | 62597588 | 62597609 | 62597605 | 62597610 | + |
| SEQ ID NO 4671 | TTTTTATTGTTCCTCTAGTTAT | TTC | chr1 | 62597589 | 62597610 | 62597606 | 62597611 | + |
| SEQ ID NO 4672 | TTTATTGTTCCTCTAGTTATTT | CTT | chr1 | 62597591 | 62597612 | 62597608 | 62597613 | + |
| SEQ ID NO 4673 | TTATTGTTCCTCTAGTTATTTC | TTT | chr1 | 62597592 | 62597613 | 62597609 | 62597614 | + |
| SEQ ID NO 4674 | TATTGTTCCTCTAGTTATTTCC | TTT | chr1 | 62597593 | 62597614 | 62597610 | 62597615 | + |
| SEQ ID NO 4675 | ATTGTTCCTCTAGTTATTTCCT | TTT | chr1 | 62597594 | 62597615 | 62597611 | 62597616 | + |
| SEQ ID NO 4676 | TTGTTCCTCTAGTTATTTCCTC | TTA | chr1 | 62597595 | 62597616 | 62597612 | 62597617 | + |
| SEQ ID NO 4677 | TTCCTCTAGTTATTTCCTCCAG | TTG | chr1 | 62597598 | 62597619 | 62597615 | 62597620 | + |
| SEQ ID NO 4678 | CTCTAGTTATTTCCTCCAGAAT | TTC | chr1 | 62597601 | 62597622 | 62597618 | 62597623 | + |
| SEQ ID NO 4679 | TAGTTATTTCCTCCAGAATTGA | CTC | chr1 | 62597604 | 62597625 | 62597621 | 62597626 | + |
| SEQ ID NO 4680 | GTTATTTCCTCCAGAATTGATC | CTA | chr1 | 62597606 | 62597627 | 62597623 | 62597628 | + |
| SEQ ID NO 4681 | TTTCCTCCAGAATTGATCAAGA | TTA | chr1 | 62597610 | 62597631 | 62597627 | 62597632 | + |
| SEQ ID NO 4682 | CCTCCAGAATTGATCAAGACAA | TTT | chr1 | 62597613 | 62597634 | 62597630 | 62597635 | + |
| SEQ ID NO 4683 | CTCCAGAATTGATCAAGACAAT | TTC | chr1 | 62597614 | 62597635 | 62597631 | 62597636 | + |
| SEQ ID NO 4684 | CAGAATTGATCAAGACAATTCA | CTC | chr1 | 62597617 | 62597638 | 62597634 | 62597639 | + |
| SEQ ID NO 4685 | ATCAAGACAATTCATCATTTGA | TTG | chr1 | 62597625 | 62597646 | 62597642 | 62597647 | + |
| SEQ ID NO 4686 | ATCATTTGATTCTCTATCTCCA | TTC | chr1 | 62597638 | 62597659 | 62597655 | 62597660 | + |
| SEQ ID NO 4687 | GATTCTCTATCTCCAGAGCCAA | TTT | chr1 | 62597645 | 62597666 | 62597662 | 62597667 | + |
| SEQ ID NO 4688 | ATTCTCTATCTCCAGAGCCAAA | TTG | chr1 | 62597646 | 62597667 | 62597663 | 62597668 | + |
| SEQ ID NO 4689 | TCTATCTCCAGAGCCAAAATCA | TTC | chr1 | 62597650 | 62597671 | 62597667 | 62597672 | + |
| SEQ ID NO 4690 | TATCTCCAGAGCCAAAATCAAG | CTC | chr1 | 62597652 | 62597673 | 62597669 | 62597674 | + |
| SEQ ID NO 4691 | TCTCCAGAGCCAAAATCAAGAT | CTA | chr1 | 62597654 | 62597675 | 62597671 | 62597676 | + |
| SEQ ID NO 4692 | CAGAGCCAAAATCAAGATTTGC | CTC | chr1 | 62597658 | 62597679 | 62597675 | 62597680 | + |
| SEQ ID NO 4693 | GCTATGTTAGACGATGTAAAAA | TTT | chr1 | 62597678 | 62597699 | 62597695 | 62597700 | + |
| SEQ ID NO 4694 | CTATGTTAGACGATGTAAAAAT | TTG | chr1 | 62597679 | 62597700 | 62597696 | 62597701 | + |
| SEQ ID NO 4695 | TGTTAGACGATGTAAAATTTT | CTA | chr1 | 62597682 | 62597703 | 62597699 | 62597704 | + |
| SEQ ID NO 4696 | GACGATGTAAAAATTTTAGCCA | TTA | chr1 | 62597687 | 62597708 | 62597704 | 62597709 | + |
| SEQ ID NO 4697 | TAGCCAATGGCCTCCTTCAGTT | TTT | chr1 | 62597703 | 62597724 | 62597720 | 62597725 | + |
| SEQ ID NO 4698 | AGCCAATGGCCTCCTTCAGTTG | TTT | chr1 | 62597704 | 62597725 | 62597721 | 62597726 | + |

Figure 18 (Cont'd)

| | | | | | | | | |
|---|---|---|---|---|---|---|---|---|
| SEQ ID NO 4699 | GCCAATGGCCTCCTTCAGTTGG | TTA | chr1 | 62597705 | 62597726 | 62597722 | 62597727 | + |
| SEQ ID NO 4700 | CTTCAGTTGGGACATGGTCTTA | CTC | chr1 | 62597717 | 62597738 | 62597734 | 62597739 | + |
| SEQ ID NO 4701 | CAGTTGGGACATGGTCTTAAAG | CTT | chr1 | 62597720 | 62597741 | 62597737 | 62597742 | + |
| SEQ ID NO 4702 | AGTTGGGACATGGTCTTAAAGA | TTC | chr1 | 62597721 | 62597742 | 62597738 | 62597743 | + |
| SEQ ID NO 4703 | GGACATGGTCTTAAAGACTTTG | TTG | chr1 | 62597726 | 62597747 | 62597743 | 62597748 | + |
| SEQ ID NO 4704 | AAAGACTTTGTCCATAAGACGA | CTT | chr1 | 62597738 | 62597759 | 62597755 | 62597760 | + |
| SEQ ID NO 4705 | AAGACTTTGTCCATAAGACGAA | TTA | chr1 | 62597739 | 62597760 | 62597756 | 62597761 | + |
| SEQ ID NO 4706 | TGTCCATAAGACGAAGGGCCAA | CTT | chr1 | 62597746 | 62597767 | 62597763 | 62597768 | + |
| SEQ ID NO 4707 | GTCCATAAGACGAAGGGCCAAA | TTT | chr1 | 62597747 | 62597768 | 62597764 | 62597769 | + |
| SEQ ID NO 4708 | TCCATAAGACGAAGGGCCAAAT | TTG | chr1 | 62597748 | 62597769 | 62597765 | 62597770 | + |
| SEQ ID NO 4709 | ATGACATATTTCAAAAACTCAA | TTA | chr1 | 62597772 | 62597793 | 62597789 | 62597794 | + |
| SEQ ID NO 4710 | CAAAAACTCAACATATTTGATC | TTT | chr1 | 62597783 | 62597804 | 62597800 | 62597805 | + |
| SEQ ID NO 4711 | AAAAACTCAACATATTTGATCA | TTC | chr1 | 62597784 | 62597805 | 62597801 | 62597806 | + |
| SEQ ID NO 4712 | AACATATTTGATCAGTCTTTTT | CTC | chr1 | 62597792 | 62597813 | 62597809 | 62597814 | + |
| SEQ ID NO 4713 | GATCAGTCTTTTTATGATCTAT | TTT | chr1 | 62597801 | 62597822 | 62597818 | 62597823 | + |
| SEQ ID NO 4714 | ATCAGTCTTTTTATGATCTATC | TTG | chr1 | 62597802 | 62597823 | 62597819 | 62597824 | + |
| SEQ ID NO 4715 | TTTATGATCTATCGCTGCAAAC | CTT | chr1 | 62597811 | 62597832 | 62597828 | 62597833 | + |
| SEQ ID NO 4716 | TTATGATCTATCGCTGCAAACC | TTT | chr1 | 62597812 | 62597833 | 62597829 | 62597834 | + |
| SEQ ID NO 4717 | TATGATCTATCGCTGCAAACCA | TTT | chr1 | 62597813 | 62597834 | 62597830 | 62597835 | + |
| SEQ ID NO 4718 | ATGATCTATCGCTGCAAACCAG | TTT | chr1 | 62597814 | 62597835 | 62597831 | 62597836 | + |
| SEQ ID NO 4719 | TGATCTATCGCTGCAAACCAGT | TTA | chr1 | 62597815 | 62597836 | 62597832 | 62597837 | + |
| SEQ ID NO 4720 | TCGCTGCAAACCAGTGAAATCA | CTA | chr1 | 62597822 | 62597843 | 62597839 | 62597844 | + |
| SEQ ID NO 4721 | CAAACCAGTGAAATCAAAGAAG | CTG | chr1 | 62597828 | 62597849 | 62597845 | 62597850 | + |
| SEQ ID NO 4722 | AGAAGAACTACATATAAACTAC | CTG | chr1 | 62597864 | 62597885 | 62597881 | 62597886 | + |
| SEQ ID NO 4723 | CATATAAACTACAAGTCAAAAA | CTA | chr1 | 62597874 | 62597895 | 62597891 | 62597896 | + |
| SEQ ID NO 4724 | CAAGTCAAAATGAAGAGGTAA | CTA | chr1 | 62597885 | 62597906 | 62597902 | 62597907 | + |
| SEQ ID NO 4725 | GAACTCAACTCAAAACTTGAAA | CTT | chr1 | 62597921 | 62597942 | 62597938 | 62597943 | + |
| SEQ ID NO 4726 | AACTCAACTCAAAACTTGAAAG | TTG | chr1 | 62597922 | 62597943 | 62597939 | 62597944 | + |
| SEQ ID NO 4727 | AACTCAAAACTTGAAAGCCTCC | CTC | chr1 | 62597927 | 62597948 | 62597944 | 62597949 | + |
| SEQ ID NO 4728 | AAAACTTGAAAGCCTCCTAGAA | CTC | chr1 | 62597932 | 62597953 | 62597949 | 62597954 | + |
| SEQ ID NO 4729 | GAAAGCCTCCTAGAAGAAAAAA | CTT | chr1 | 62597939 | 62597960 | 62597956 | 62597961 | + |
| SEQ ID NO 4730 | AAAGCCTCCTAGAAGAAAAAAT | TTG | chr1 | 62597940 | 62597961 | 62597957 | 62597962 | + |
| SEQ ID NO 4731 | CTAGAAGAAAAAATTCTACTTC | CTC | chr1 | 62597948 | 62597969 | 62597965 | 62597970 | + |
| SEQ ID NO 4732 | GAAGAAAAAATTCTACTTCAAC | CTA | chr1 | 62597951 | 62597972 | 62597968 | 62597973 | + |
| SEQ ID NO 4733 | TACTTCAACAAAAAGTGAAATA | TTC | chr1 | 62597964 | 62597985 | 62597981 | 62597986 | + |
| SEQ ID NO 4734 | CTTCAACAAAAAGTGAAATATT | CTA | chr1 | 62597966 | 62597987 | 62597983 | 62597988 | + |
| SEQ ID NO 4735 | CAACAAAAAGTGAAATATTTAG | CTT | chr1 | 62597969 | 62597990 | 62597986 | 62597991 | + |
| SEQ ID NO 4736 | AACAAAAAGTGAAATATTTAGA | TTC | chr1 | 62597970 | 62597991 | 62597987 | 62597992 | + |
| SEQ ID NO 4737 | AGAAGAGCAACTAACTAACTTA | TTT | chr1 | 62597989 | 62598010 | 62598006 | 62598011 | + |
| SEQ ID NO 4738 | GAAGAGCAACTAACTAACTTAA | TTA | chr1 | 62597990 | 62598011 | 62598007 | 62598012 | + |
| SEQ ID NO 4739 | ACTAACTTAATTCAAAATCAAC | CTA | chr1 | 62598002 | 62598023 | 62598019 | 62598024 | + |
| SEQ ID NO 4740 | ACTTAATTCAAAATCAACCTGA | CTA | chr1 | 62598006 | 62598027 | 62598023 | 62598028 | + |
| SEQ ID NO 4741 | AATTCAAAATCAACCTGAAACT | CTT | chr1 | 62598010 | 62598031 | 62598027 | 62598032 | + |
| SEQ ID NO 4742 | ATTCAAAATCAACCTGAAACTC | TTA | chr1 | 62598011 | 62598032 | 62598028 | 62598033 | + |
| SEQ ID NO 4743 | AAAATCAACCTGAAACTCCAGA | TTC | chr1 | 62598015 | 62598036 | 62598032 | 62598037 | + |
| SEQ ID NO 4744 | AAACTCCAGAACACCCAGAAGT | CTG | chr1 | 62598027 | 62598048 | 62598044 | 62598049 | + |
| SEQ ID NO 4745 | CAGAACACCCAGAAGTAACTTC | CTC | chr1 | 62598033 | 62598054 | 62598050 | 62598055 | + |
| SEQ ID NO 4746 | CACTTAAAGTAAGTAGAAAATA | CTT | chr1 | 62598054 | 62598075 | 62598071 | 62598076 | + |
| SEQ ID NO 4747 | ACTTAAAGTAAGTAGAAAATAA | TTC | chr1 | 62598055 | 62598076 | 62598072 | 62598077 | + |
| SEQ ID NO 4748 | AAAGTAAGTAGAAAATAAAGAG | CTT | chr1 | 62598059 | 62598080 | 62598076 | 62598081 | + |
| SEQ ID NO 4749 | AAGTAAGTAGAAAATAAAGAGG | TTA | chr1 | 62598060 | 62598081 | 62598077 | 62598082 | + |
| SEQ ID NO 4750 | ATGTTTATGTTTTCAATGTGGA | TTC | chr1 | 62598086 | 62598107 | 62598103 | 62598108 | + |
| SEQ ID NO 4751 | ATGTTTTCAATGTGGATCTTTT | TTT | chr1 | 62598092 | 62598113 | 62598109 | 62598114 | + |
| SEQ ID NO 4752 | TGTTTTCAATGTGGATCTTTTA | TTA | chr1 | 62598093 | 62598114 | 62598110 | 62598115 | + |
| SEQ ID NO 4753 | TCAATGTGGATCTTTTAAAAAA | TTT | chr1 | 62598098 | 62598119 | 62598115 | 62598120 | + |
| SEQ ID NO 4754 | CAATGTGGATCTTTTAAAAAAA | TTT | chr1 | 62598099 | 62598120 | 62598116 | 62598121 | + |
| SEQ ID NO 4755 | AATGTGGATCTTTTAAAAAAAA | TTC | chr1 | 62598100 | 62598121 | 62598117 | 62598122 | + |
| SEQ ID NO 4756 | TTAAAAAAAATATTTCTAAGGC | CTT | chr1 | 62598112 | 62598133 | 62598129 | 62598134 | + |

Figure 18 (Cont'd)

| | | | | | | | | |
|---|---|---|---|---|---|---|---|---|
| SEQ ID NO 4757 | TAAAAAAAATATTTCTAAGGCA | TTT | chr1 | 62598113 | 62598134 | 62598130 | 62598135 | + |
| SEQ ID NO 4758 | AAAAAAAATATTTCTAAGGCAT | TTT | chr1 | 62598114 | 62598135 | 62598131 | 62598136 | + |
| SEQ ID NO 4759 | AAAAAAATATTTCTAAGGCATG | TTA | chr1 | 62598115 | 62598136 | 62598132 | 62598137 | + |
| SEQ ID NO 4760 | CTAAGGCATGCCATTTGAAATA | TTT | chr1 | 62598127 | 62598148 | 62598144 | 62598149 | + |
| SEQ ID NO 4761 | TAAGGCATGCCATTTGAAATAC | TTC | chr1 | 62598128 | 62598149 | 62598145 | 62598150 | + |
| SEQ ID NO 4762 | AGGCATGCCATTTGAAATACTT | CTA | chr1 | 62598130 | 62598151 | 62598147 | 62598152 | + |
| SEQ ID NO 4763 | GAAATACTTTGTTGCATTGTTG | TTT | chr1 | 62598143 | 62598164 | 62598160 | 62598165 | + |
| SEQ ID NO 4764 | AAATACTTTGTTGCATTGTTGA | TTG | chr1 | 62598144 | 62598165 | 62598161 | 62598166 | + |
| SEQ ID NO 4765 | TGTTGCATTGTTGAAATACTTT | CTT | chr1 | 62598152 | 62598173 | 62598169 | 62598174 | + |
| SEQ ID NO 4766 | GTTGCATTGTTGAAATACTTTT | TTT | chr1 | 62598153 | 62598174 | 62598170 | 62598175 | + |
| SEQ ID NO 4767 | TTGCATTGTTGAAATACTTTTT | TTG | chr1 | 62598154 | 62598175 | 62598171 | 62598176 | + |
| SEQ ID NO 4768 | CATTGTTGAAATACTTTTTTTT | TTG | chr1 | 62598157 | 62598178 | 62598174 | 62598179 | + |
| SEQ ID NO 4769 | TTGAAATACTTTTTTTTCCAAG | TTG | chr1 | 62598162 | 62598183 | 62598179 | 62598184 | + |
| SEQ ID NO 4770 | AAATACTTTTTTTTCCAAGAAA | TTG | chr1 | 62598165 | 62598186 | 62598182 | 62598187 | + |
| SEQ ID NO 4771 | TTTTTTCCAAGAAAAATAATCT | CTT | chr1 | 62598173 | 62598194 | 62598190 | 62598195 | + |
| SEQ ID NO 4772 | TTTTTCCAAGAAAAATAATCTC | TTT | chr1 | 62598174 | 62598195 | 62598191 | 62598196 | + |
| SEQ ID NO 4773 | TTTTCCAAGAAAAATAATCTCC | TTT | chr1 | 62598175 | 62598196 | 62598192 | 62598197 | + |
| SEQ ID NO 4774 | TTTCCAAGAAAAATAATCTCCA | TTT | chr1 | 62598176 | 62598197 | 62598193 | 62598198 | + |
| SEQ ID NO 4775 | TTCCAAGAAAAATAATCTCCAG | TTT | chr1 | 62598177 | 62598198 | 62598194 | 62598199 | + |
| SEQ ID NO 4776 | TCCAAGAAAAATAATCTCCAGA | TTT | chr1 | 62598178 | 62598199 | 62598195 | 62598200 | + |
| SEQ ID NO 4777 | CCAAGAAAAATAATCTCCAGAA | TTT | chr1 | 62598179 | 62598200 | 62598196 | 62598201 | + |
| SEQ ID NO 4778 | CAAGAAAAATAATCTCCAGAAA | TTC | chr1 | 62598180 | 62598201 | 62598197 | 62598202 | + |
| SEQ ID NO 4779 | CAGAAAATAAAATTTCCTATTA | CTC | chr1 | 62598196 | 62598217 | 62598213 | 62598218 | + |
| SEQ ID NO 4780 | CCTATTATAATTTCAAGTTAGT | TTT | chr1 | 62598211 | 62598232 | 62598228 | 62598233 | + |
| SEQ ID NO 4781 | CTATTATAATTTCAAGTTAGTT | TTC | chr1 | 62598212 | 62598233 | 62598229 | 62598234 | + |
| SEQ ID NO 4782 | TTATAATTTCAAGTTAGTTTTT | CTA | chr1 | 62598215 | 62598236 | 62598232 | 62598237 | + |
| SEQ ID NO 4783 | TAATTTCAAGTTAGTTTTTTGT | TTA | chr1 | 62598218 | 62598239 | 62598235 | 62598240 | + |
| SEQ ID NO 4784 | CAAGTTAGTTTTTTGTTTCCCT | TTT | chr1 | 62598224 | 62598245 | 62598241 | 62598246 | + |
| SEQ ID NO 4785 | AAGTTAGTTTTTTGTTTCCCTA | TTC | chr1 | 62598225 | 62598246 | 62598242 | 62598247 | + |
| SEQ ID NO 4786 | GTTTTTTGTTTCCCTAATGTTA | TTA | chr1 | 62598231 | 62598252 | 62598248 | 62598253 | + |
| SEQ ID NO 4787 | TTTGTTTCCCTAATGTTATATA | TTT | chr1 | 62598235 | 62598256 | 62598252 | 62598257 | + |
| SEQ ID NO 4788 | TTGTTTCCCTAATGTTATATAT | TTT | chr1 | 62598236 | 62598257 | 62598253 | 62598258 | + |
| SEQ ID NO 4789 | TGTTTCCCTAATGTTATATATG | TTT | chr1 | 62598237 | 62598258 | 62598254 | 62598259 | + |
| SEQ ID NO 4790 | GTTTCCCTAATGTTATATATGA | TTT | chr1 | 62598238 | 62598259 | 62598255 | 62598260 | + |
| SEQ ID NO 4791 | TTTCCCTAATGTTATATATGAA | TTG | chr1 | 62598239 | 62598260 | 62598256 | 62598261 | + |
| SEQ ID NO 4792 | CCCTAATGTTATATATGAAAAC | TTT | chr1 | 62598242 | 62598263 | 62598259 | 62598264 | + |
| SEQ ID NO 4793 | CCTAATGTTATATATGAAAACA | TTC | chr1 | 62598243 | 62598264 | 62598260 | 62598265 | + |
| SEQ ID NO 4794 | ATGTTATATATGAAAACACTGA | CTA | chr1 | 62598247 | 62598268 | 62598264 | 62598269 | + |
| SEQ ID NO 4795 | TATATGAAAACACTGAAAATTT | TTA | chr1 | 62598253 | 62598274 | 62598270 | 62598275 | + |
| SEQ ID NO 4796 | AAAATTTGCATTTTATATGAAA | CTG | chr1 | 62598268 | 62598289 | 62598285 | 62598290 | + |
| SEQ ID NO 4797 | GCATTTTATATGAAAATTACAA | TTT | chr1 | 62598275 | 62598296 | 62598292 | 62598297 | + |
| SEQ ID NO 4798 | CATTTTATATGAAAATTACAAA | TTG | chr1 | 62598276 | 62598297 | 62598293 | 62598298 | + |
| SEQ ID NO 4799 | TATATGAAAATTACAAATCGGT | TTT | chr1 | 62598281 | 62598302 | 62598298 | 62598303 | + |
| SEQ ID NO 4800 | ATATGAAAATTACAAATCGGTT | TTT | chr1 | 62598282 | 62598303 | 62598299 | 62598304 | + |
| SEQ ID NO 4801 | TATGAAAATTACAAATCGGTTA | TTA | chr1 | 62598283 | 62598304 | 62598300 | 62598305 | + |
| SEQ ID NO 4802 | CAAATCGGTTAAATTATACAAT | TTA | chr1 | 62598294 | 62598315 | 62598311 | 62598316 | + |
| SEQ ID NO 4803 | AATTATACAATCTAGAACACTA | TTA | chr1 | 62598305 | 62598326 | 62598322 | 62598327 | + |
| SEQ ID NO 4804 | TACAATCTAGAACACTATGTCA | TTA | chr1 | 62598310 | 62598331 | 62598327 | 62598332 | + |
| SEQ ID NO 4805 | GAACACTATGTCATTACACTAT | CTA | chr1 | 62598319 | 62598340 | 62598336 | 62598341 | + |
| SEQ ID NO 4806 | TGTCATTACACTATTGTAAATT | CTA | chr1 | 62598327 | 62598348 | 62598344 | 62598349 | + |
| SEQ ID NO 4807 | CACTATTGTAAATTACTGAAGG | TTA | chr1 | 62598335 | 62598356 | 62598352 | 62598357 | + |
| SEQ ID NO 4808 | TTGTAAATTACTGAAGGTAAGT | CTA | chr1 | 62598340 | 62598361 | 62598357 | 62598362 | + |
| SEQ ID NO 4809 | TAAATTACTGAAGGTAAGTAAA | TTG | chr1 | 62598343 | 62598364 | 62598360 | 62598365 | + |
| SEQ ID NO 4810 | CTGAAGGTAAGTAAAAAGTTAA | TTA | chr1 | 62598350 | 62598371 | 62598367 | 62598372 | + |
| SEQ ID NO 4811 | AAGGTAAGTAAAAAGTTAAAAA | CTG | chr1 | 62598353 | 62598374 | 62598370 | 62598375 | + |
| SEQ ID NO 4812 | AAAAAAATTTAAAACTATTCTC | TTA | chr1 | 62598371 | 62598392 | 62598388 | 62598393 | + |
| SEQ ID NO 4813 | AAAACTATTCTCCAGTGTTTAA | TTT | chr1 | 62598381 | 62598402 | 62598398 | 62598403 | + |
| SEQ ID NO 4814 | AAACTATTCTCCAGTGTTTAAA | TTA | chr1 | 62598382 | 62598403 | 62598399 | 62598404 | + |

Figure 18 (Cont'd)

| | | | | | | | | |
|---|---|---|---|---|---|---|---|---|
| SEQ ID NO 4815 | TTCTCCAGTGTTTAAAACAGAT | CTA | chr1 | 62598388 | 62598409 | 62598405 | 62598410 | + |
| SEQ ID NO 4816 | TCCAGTGTTTAAAACAGATTAA | TTC | chr1 | 62598391 | 62598412 | 62598408 | 62598413 | + |
| SEQ ID NO 4817 | CAGTGTTTAAAACAGATTAAAT | CTC | chr1 | 62598393 | 62598414 | 62598410 | 62598415 | + |
| SEQ ID NO 4818 | AAAACAGATTAAATAATACAGT | TTT | chr1 | 62598401 | 62598422 | 62598418 | 62598423 | + |
| SEQ ID NO 4819 | AAACAGATTAAATAATACAGTA | TTA | chr1 | 62598402 | 62598423 | 62598419 | 62598424 | + |
| SEQ ID NO 4820 | AATAATACAGTAAATGGAAAAG | TTA | chr1 | 62598412 | 62598433 | 62598429 | 62598434 | + |
| SEQ ID NO 4821 | ATTCATATGAAAATATGCTGGG | TTT | chr1 | 62598438 | 62598459 | 62598455 | 62598460 | + |
| SEQ ID NO 4822 | TTCATATGAAAATATGCTGGGC | TTA | chr1 | 62598439 | 62598460 | 62598456 | 62598461 | + |
| SEQ ID NO 4823 | ATATGAAAATATGCTGGGCTTT | TTC | chr1 | 62598442 | 62598463 | 62598459 | 62598464 | + |
| SEQ ID NO 4824 | GGCTTTTCTTTTAATTGAAGT | CTG | chr1 | 62598458 | 62598479 | 62598475 | 62598480 | + |
| SEQ ID NO 4825 | TTTCTTTTAATTGAAGTTCAGA | CTT | chr1 | 62598463 | 62598484 | 62598480 | 62598485 | + |
| SEQ ID NO 4826 | TTCTTTTAATTGAAGTTCAGAA | TTT | chr1 | 62598464 | 62598485 | 62598481 | 62598486 | + |
| SEQ ID NO 4827 | TCTTTTAATTGAAGTTCAGAAA | TTT | chr1 | 62598465 | 62598486 | 62598482 | 62598487 | + |
| SEQ ID NO 4828 | CTTTTAATTGAAGTTCAGAAAA | TTT | chr1 | 62598466 | 62598487 | 62598483 | 62598488 | + |
| SEQ ID NO 4829 | TTTTAATTGAAGTTCAGAAAAT | TTC | chr1 | 62598467 | 62598488 | 62598484 | 62598489 | + |
| SEQ ID NO 4830 | TTAATTGAAGTTCAGAAAATCA | CTT | chr1 | 62598469 | 62598490 | 62598486 | 62598491 | + |
| SEQ ID NO 4831 | TAATTGAAGTTCAGAAAATCAA | TTT | chr1 | 62598470 | 62598491 | 62598487 | 62598492 | + |
| SEQ ID NO 4832 | AATTGAAGTTCAGAAAATCAAA | TTT | chr1 | 62598471 | 62598492 | 62598488 | 62598493 | + |
| SEQ ID NO 4833 | ATTGAAGTTCAGAAAATCAAAT | TTA | chr1 | 62598472 | 62598493 | 62598489 | 62598494 | + |
| SEQ ID NO 4834 | AAGTTCAGAAAATCAAATTTTA | TTG | chr1 | 62598476 | 62598497 | 62598493 | 62598498 | + |
| SEQ ID NO 4835 | AGAAAATCAAATTTTAGAGATA | TTC | chr1 | 62598482 | 62598503 | 62598499 | 62598504 | + |
| SEQ ID NO 4836 | TAGAGATAGTACAATTTAAATA | TTT | chr1 | 62598496 | 62598517 | 62598513 | 62598518 | + |
| SEQ ID NO 4837 | AGAGATAGTACAATTTAAATAA | TTT | chr1 | 62598497 | 62598518 | 62598514 | 62598519 | + |
| SEQ ID NO 4838 | GAGATAGTACAATTTAAATAAA | TTA | chr1 | 62598498 | 62598519 | 62598515 | 62598520 | + |
| SEQ ID NO 4839 | AAATAAAATGTTAAGGACAAAA | TTT | chr1 | 62598513 | 62598534 | 62598530 | 62598535 | + |
| SEQ ID NO 4840 | AATAAAATGTTAAGGACAAAAA | TTA | chr1 | 62598514 | 62598535 | 62598531 | 62598536 | + |
| SEQ ID NO 4841 | AGGACAAAAATATGTGCTATTT | TTA | chr1 | 62598526 | 62598547 | 62598543 | 62598548 | + |
| SEQ ID NO 4842 | TTTGAAAGAAGCATACAAGGGG | CTA | chr1 | 62598545 | 62598566 | 62598562 | 62598567 | + |
| SEQ ID NO 4843 | GAAAGAAGCATACAAGGGGAAG | TTT | chr1 | 62598548 | 62598569 | 62598565 | 62598570 | + |
| SEQ ID NO 4844 | AAAGAAGCATACAAGGGGAAGG | TTG | chr1 | 62598549 | 62598570 | 62598566 | 62598571 | + |
| SEQ ID NO 4845 | CCAATATTCATTTTTCAAATCC | TTG | chr1 | 62598576 | 62598597 | 62598593 | 62598598 | + |
| SEQ ID NO 4846 | ATTTTTCAAATCCATTATTAGT | TTC | chr1 | 62598585 | 62598606 | 62598602 | 62598607 | + |
| SEQ ID NO 4847 | TTCAAATCCATTATTAGTTTAA | TTT | chr1 | 62598589 | 62598610 | 62598606 | 62598611 | + |
| SEQ ID NO 4848 | TCAAATCCATTATTAGTTTAAA | TTT | chr1 | 62598590 | 62598611 | 62598607 | 62598612 | + |
| SEQ ID NO 4849 | CAAATCCATTATTAGTTTAAAA | TTT | chr1 | 62598591 | 62598612 | 62598608 | 62598613 | + |
| SEQ ID NO 4850 | AAATCCATTATTAGTTTAAAAA | TTC | chr1 | 62598592 | 62598613 | 62598609 | 62598614 | + |
| SEQ ID NO 4851 | TTAGTTTAAAAATTTAGATTAT | TTA | chr1 | 62598602 | 62598623 | 62598619 | 62598624 | + |
| SEQ ID NO 4852 | GTTTAAAAATTTAGATTATGAT | TTA | chr1 | 62598605 | 62598626 | 62598622 | 62598627 | + |
| SEQ ID NO 4853 | AAAAATTTAGATTATGATAGTG | TTT | chr1 | 62598609 | 62598630 | 62598626 | 62598631 | + |
| SEQ ID NO 4854 | AAAATTTAGATTATGATAGTGT | TTA | chr1 | 62598610 | 62598631 | 62598627 | 62598632 | + |
| SEQ ID NO 4855 | AGATTATGATAGTGTTACAGGA | TTT | chr1 | 62598617 | 62598638 | 62598634 | 62598639 | + |
| SEQ ID NO 4856 | GATTATGATAGTGTTACAGGAA | TTA | chr1 | 62598618 | 62598639 | 62598635 | 62598640 | + |
| SEQ ID NO 4857 | TGATAGTGTTACAGGAAATTAA | TTA | chr1 | 62598623 | 62598644 | 62598640 | 62598645 | + |
| SEQ ID NO 4858 | CAGGAAATTAATAGAAAAGAAA | TTA | chr1 | 62598634 | 62598655 | 62598651 | 62598656 | + |
| SEQ ID NO 4859 | ATAGAAAAGAAAGAGGAAAGCA | TTA | chr1 | 62598644 | 62598665 | 62598661 | 62598666 | + |
| SEQ ID NO 4860 | ATAACCAACCTACTCTCTATAT | CTT | chr1 | 62598670 | 62598691 | 62598687 | 62598692 | + |
| SEQ ID NO 4861 | TAACCAACCTACTCTCTATATC | TTA | chr1 | 62598671 | 62598692 | 62598688 | 62598693 | + |
| SEQ ID NO 4862 | CTCTCTATATCCAGACTTTTGT | CTA | chr1 | 62598682 | 62598703 | 62598699 | 62598704 | + |
| SEQ ID NO 4863 | TCTATATCCAGACTTTTGTAGA | CTC | chr1 | 62598685 | 62598706 | 62598702 | 62598707 | + |
| SEQ ID NO 4864 | TATATCCAGACTTTTGTAGAAA | CTC | chr1 | 62598687 | 62598708 | 62598704 | 62598709 | + |
| SEQ ID NO 4865 | TATCCAGACTTTTGTAGAAAAA | CTA | chr1 | 62598689 | 62598710 | 62598706 | 62598711 | + |
| SEQ ID NO 4866 | TTGTAGAAAACAAGATAATAG | CTT | chr1 | 62598700 | 62598721 | 62598717 | 62598722 | + |
| SEQ ID NO 4867 | TGTAGAAAACAAGATAATAGC | TTT | chr1 | 62598701 | 62598722 | 62598718 | 62598723 | + |
| SEQ ID NO 4868 | GTAGAAAACAAGATAATAGCA | TTT | chr1 | 62598702 | 62598723 | 62598719 | 62598724 | + |
| SEQ ID NO 4869 | TAGAAAACAAGATAATAGCAT | TTG | chr1 | 62598703 | 62598724 | 62598720 | 62598725 | + |
| SEQ ID NO 4870 | CTCCAGACCGTGGAAGACCAAT | CTT | chr1 | 62598735 | 62598756 | 62598752 | 62598757 | + |
| SEQ ID NO 4871 | TCCAGACCGTGGAAGACCAATA | TTC | chr1 | 62598736 | 62598757 | 62598753 | 62598758 | + |
| SEQ ID NO 4872 | CAGACCGTGGAAGACCAATATA | CTC | chr1 | 62598738 | 62598759 | 62598755 | 62598760 | + |

Figure 18 (Cont'd)

| SEQ ID NO 4873 | AACCAACAGCATAGTCAAATAA | TTA | chr1 | 62598768 | 62598789 | 62598785 | 62598790 | + |
|---|---|---|---|---|---|---|---|---|
| SEQ ID NO 4874 | TAATGGTATGTCCCATCTTTCA | TTT | chr1 | 62598821 | 62598842 | 62598838 | 62598843 | + |
| SEQ ID NO 4875 | AATGGTATGTCCCATCTTTCAC | TTT | chr1 | 62598822 | 62598843 | 62598839 | 62598844 | + |
| SEQ ID NO 4876 | ATGGTATGTCCCATCTTTCACA | TTA | chr1 | 62598823 | 62598844 | 62598840 | 62598845 | + |
| SEQ ID NO 4877 | TCACACAGGTCTGTAAAAACAC | CTT | chr1 | 62598840 | 62598861 | 62598857 | 62598862 | + |
| SEQ ID NO 4878 | CACACAGGTCTGTAAAAACACT | TTT | chr1 | 62598841 | 62598862 | 62598858 | 62598863 | + |
| SEQ ID NO 4879 | ACACAGGTCTGTAAAAACACTG | TTC | chr1 | 62598842 | 62598863 | 62598859 | 62598864 | + |
| SEQ ID NO 4880 | TAAAAACACTGAATCCTAAAAT | CTG | chr1 | 62598853 | 62598874 | 62598870 | 62598875 | + |
| SEQ ID NO 4881 | AATCCTAAAATTATTTACAAGC | CTG | chr1 | 62598864 | 62598885 | 62598881 | 62598886 | + |
| SEQ ID NO 4882 | AAATTATTTACAAGCTTTAACT | CTA | chr1 | 62598871 | 62598892 | 62598888 | 62598893 | + |
| SEQ ID NO 4883 | TTTACAAGCTTTAACTGGATCA | TTA | chr1 | 62598877 | 62598898 | 62598894 | 62598899 | + |
| SEQ ID NO 4884 | ACAAGCTTTAACTGGATCATGA | TTT | chr1 | 62598880 | 62598901 | 62598897 | 62598902 | + |
| SEQ ID NO 4885 | CAAGCTTTAACTGGATCATGAG | TTA | chr1 | 62598881 | 62598902 | 62598898 | 62598903 | + |
| SEQ ID NO 4886 | TAACTGGATCATGAGTAAAATT | CTT | chr1 | 62598888 | 62598909 | 62598905 | 62598910 | + |
| SEQ ID NO 4887 | AACTGGATCATGAGTAAAATTA | TTT | chr1 | 62598889 | 62598910 | 62598906 | 62598911 | + |
| SEQ ID NO 4888 | ACTGGATCATGAGTAAAATTAT | TTA | chr1 | 62598890 | 62598911 | 62598907 | 62598912 | + |
| SEQ ID NO 4889 | GATCATGAGTAAAATTATCACA | CTG | chr1 | 62598894 | 62598915 | 62598911 | 62598916 | + |
| SEQ ID NO 4890 | TCACATCAGCATAACTGTTAAA | TTA | chr1 | 62598911 | 62598932 | 62598928 | 62598933 | + |
| SEQ ID NO 4891 | TTAAAATTGCAGGCTCTGAAGC | CTG | chr1 | 62598928 | 62598949 | 62598945 | 62598950 | + |
| SEQ ID NO 4892 | AAATTGCAGGCTCTGAAGCTAA | TTA | chr1 | 62598931 | 62598952 | 62598948 | 62598953 | + |
| SEQ ID NO 4893 | CAGGCTCTGAAGCTAATAAACT | TTG | chr1 | 62598937 | 62598958 | 62598954 | 62598959 | + |
| SEQ ID NO 4894 | TGAAGCTAATAAACTACCTGCA | CTC | chr1 | 62598944 | 62598965 | 62598961 | 62598966 | + |
| SEQ ID NO 4895 | AAGCTAATAAACTACCTGCATT | CTG | chr1 | 62598946 | 62598967 | 62598963 | 62598968 | + |
| SEQ ID NO 4896 | ATAAACTACCTGCATTTAAACC | CTA | chr1 | 62598952 | 62598973 | 62598969 | 62598974 | + |
| SEQ ID NO 4897 | CCTGCATTTAAACCATGGCTCT | CTA | chr1 | 62598960 | 62598981 | 62598977 | 62598982 | + |
| SEQ ID NO 4898 | CATTTAAACCATGGCTCTAAAA | CTG | chr1 | 62598964 | 62598985 | 62598981 | 62598986 | + |
| SEQ ID NO 4899 | AAACCATGGCTCTAAAACTTTG | TTT | chr1 | 62598969 | 62598990 | 62598986 | 62598991 | + |
| SEQ ID NO 4900 | AACCATGGCTCTAAAACTTTGT | TTA | chr1 | 62598970 | 62598991 | 62598987 | 62598992 | + |
| SEQ ID NO 4901 | TAAAACTTTGTGTGACCTTGAA | CTC | chr1 | 62598981 | 62599002 | 62598998 | 62599003 | + |
| SEQ ID NO 4902 | AAACTTTGTGTGACCTTGAATA | CTA | chr1 | 62598983 | 62599004 | 62599000 | 62599005 | + |
| SEQ ID NO 4903 | TGTGTGACCTTGAATAAATTAC | CTT | chr1 | 62598989 | 62599010 | 62599006 | 62599011 | + |
| SEQ ID NO 4904 | GTGTGACCTTGAATAAATTACT | TTT | chr1 | 62598990 | 62599011 | 62599007 | 62599012 | + |
| SEQ ID NO 4905 | TGTGACCTTGAATAAATTACTT | TTG | chr1 | 62598991 | 62599012 | 62599008 | 62599013 | + |
| SEQ ID NO 4906 | GAATAAATTACTTCACCCCTTT | CTT | chr1 | 62599000 | 62599021 | 62599017 | 62599022 | + |
| SEQ ID NO 4907 | AATAAATTACTTCACCCCTTTA | TTG | chr1 | 62599001 | 62599022 | 62599018 | 62599023 | + |
| SEQ ID NO 4908 | CTTCACCCCTTTATCTCTCAGT | TTA | chr1 | 62599010 | 62599031 | 62599027 | 62599032 | + |
| SEQ ID NO 4909 | CACCCCTTTATCTCTCAGTTTC | CTT | chr1 | 62599013 | 62599034 | 62599030 | 62599035 | + |
| SEQ ID NO 4910 | ACCCCTTTATCTCTCAGTTTCC | TTC | chr1 | 62599014 | 62599035 | 62599031 | 62599036 | + |
| SEQ ID NO 4911 | TATCTCTCAGTTTCCTCACATA | CTT | chr1 | 62599021 | 62599042 | 62599038 | 62599043 | + |
| SEQ ID NO 4912 | ATCTCTCAGTTTCCTCACATAT | TTT | chr1 | 62599022 | 62599043 | 62599039 | 62599044 | + |
| SEQ ID NO 4913 | TCTCTCAGTTTCCTCACATATA | TTA | chr1 | 62599023 | 62599044 | 62599040 | 62599045 | + |
| SEQ ID NO 4914 | TCAGTTTCCTCACATATACTAC | CTC | chr1 | 62599027 | 62599048 | 62599044 | 62599049 | + |
| SEQ ID NO 4915 | AGTTTCCTCACATATACTACAA | CTC | chr1 | 62599029 | 62599050 | 62599046 | 62599051 | + |
| SEQ ID NO 4916 | CCTCACATATACTACAAAGATA | TTT | chr1 | 62599034 | 62599055 | 62599051 | 62599056 | + |
| SEQ ID NO 4917 | CTCACATATACTACAAAGATAA | TTC | chr1 | 62599035 | 62599056 | 62599052 | 62599057 | + |
| SEQ ID NO 4918 | ACATATACTACAAAGATAATAA | CTC | chr1 | 62599038 | 62599059 | 62599055 | 62599060 | + |
| SEQ ID NO 4919 | CAAAGATAATAACAGAACTTAT | CTA | chr1 | 62599048 | 62599069 | 62599065 | 62599070 | + |
| SEQ ID NO 4920 | ATAGGATTATTGTAAGAAAAAA | CTT | chr1 | 62599068 | 62599089 | 62599085 | 62599090 | + |
| SEQ ID NO 4921 | TAGGATTATTGTAAGAAAAAAA | TTA | chr1 | 62599069 | 62599090 | 62599086 | 62599091 | + |
| SEQ ID NO 4922 | TTGTAAGAAAAAAATTAATTC | TTA | chr1 | 62599077 | 62599098 | 62599094 | 62599099 | + |
| SEQ ID NO 4923 | TAAGAAAAAAATTAATTCATA | TTG | chr1 | 62599080 | 62599101 | 62599097 | 62599102 | + |
| SEQ ID NO 4924 | ATTCATAGCAGCCAATGTCATC | TTA | chr1 | 62599095 | 62599116 | 62599112 | 62599117 | + |
| SEQ ID NO 4925 | ATAGCAGCCAATGTCATCTTAC | TTC | chr1 | 62599099 | 62599120 | 62599116 | 62599121 | + |
| SEQ ID NO 4926 | ACTAAAATTCAAATTAGATCAT | CTT | chr1 | 62599119 | 62599140 | 62599136 | 62599141 | + |
| SEQ ID NO 4927 | CTAAAATTCAAATTAGATCATG | TTA | chr1 | 62599120 | 62599141 | 62599137 | 62599142 | + |
| SEQ ID NO 4928 | AAATTCAAATTAGATCATGTTT | CTA | chr1 | 62599123 | 62599144 | 62599140 | 62599145 | + |
| SEQ ID NO 4929 | AAATTAGATCATGTTTCTCTTT | TTC | chr1 | 62599129 | 62599150 | 62599146 | 62599151 | + |
| SEQ ID NO 4930 | GATCATGTTTCTCTTTGCTCAA | TTA | chr1 | 62599135 | 62599156 | 62599152 | 62599157 | + |

Figure 18 (Cont'd)

| SEQ ID NO 4931 | CTCTTTGCTCAAAACCACACAA | TTT | chr1 | 62599145 | 62599166 | 62599162 | 62599167 | + |
| SEQ ID NO 4932 | TCTTTGCTCAAAACCACACAAT | TTC | chr1 | 62599146 | 62599167 | 62599163 | 62599168 | + |
| SEQ ID NO 4933 | TTTGCTCAAAACCACACAATAG | CTC | chr1 | 62599148 | 62599169 | 62599165 | 62599170 | + |
| SEQ ID NO 4934 | TGCTCAAAACCACACAATAGCT | CTT | chr1 | 62599150 | 62599171 | 62599167 | 62599172 | + |
| SEQ ID NO 4935 | GCTCAAAACCACACAATAGCTT | TTT | chr1 | 62599151 | 62599172 | 62599168 | 62599173 | + |
| SEQ ID NO 4936 | CTCAAAACCACACAATAGCTTT | TTG | chr1 | 62599152 | 62599173 | 62599169 | 62599174 | + |
| SEQ ID NO 4937 | AAAACCACACAATAGCTTTCCA | CTC | chr1 | 62599155 | 62599176 | 62599172 | 62599177 | + |
| SEQ ID NO 4938 | TCCATTTCACTCATATTGGCTC | CTT | chr1 | 62599173 | 62599194 | 62599190 | 62599195 | + |
| SEQ ID NO 4939 | CCATTTCACTCATATTGGCTCT | TTT | chr1 | 62599174 | 62599195 | 62599191 | 62599196 | + |
| SEQ ID NO 4940 | CATTTCACTCATATTGGCTCTT | TTC | chr1 | 62599175 | 62599196 | 62599192 | 62599197 | + |
| SEQ ID NO 4941 | CACTCATATTGGCTCTTTAGAC | TTT | chr1 | 62599180 | 62599201 | 62599197 | 62599202 | + |
| SEQ ID NO 4942 | ACTCATATTGGCTCTTTAGACC | TTC | chr1 | 62599181 | 62599202 | 62599198 | 62599203 | + |
| SEQ ID NO 4943 | ATATTGGCTCTTTAGACCAAGA | CTC | chr1 | 62599185 | 62599206 | 62599202 | 62599207 | + |
| SEQ ID NO 4944 | GCTCTTTAGACCAAGATTACCC | TTG | chr1 | 62599191 | 62599212 | 62599208 | 62599213 | + |
| SEQ ID NO 4945 | GGTAATCTTGGTCTAAAGAGCC | TTG | chr1 | 62599190 | 62599211 | 62599195 | 62599190 | - |
| SEQ ID NO 4946 | GGTCTAAAGAGCCAATATGAGT | CTT | chr1 | 62599181 | 62599202 | 62599186 | 62599181 | - |
| SEQ ID NO 4947 | GTCTAAAGAGCCAATATGAGTG | TTG | chr1 | 62599180 | 62599201 | 62599185 | 62599180 | - |
| SEQ ID NO 4948 | AAGAGCCAATATGAGTGAAATG | CTA | chr1 | 62599175 | 62599196 | 62599180 | 62599175 | - |
| SEQ ID NO 4949 | TTGTGTGGTTTTGAGCAAAGAG | CTA | chr1 | 62599145 | 62599166 | 62599150 | 62599145 | - |
| SEQ ID NO 4950 | TGTGGTTTTGAGCAAAGAGAAA | TTG | chr1 | 62599142 | 62599163 | 62599147 | 62599142 | - |
| SEQ ID NO 4951 | TGAGCAAAGAGAAACATGATCT | TTT | chr1 | 62599134 | 62599155 | 62599139 | 62599134 | - |
| SEQ ID NO 4952 | GAGCAAAGAGAAACATGATCTA | TTT | chr1 | 62599133 | 62599154 | 62599138 | 62599133 | - |
| SEQ ID NO 4953 | AGCAAAGAGAAACATGATCTAA | TTG | chr1 | 62599132 | 62599153 | 62599137 | 62599132 | - |
| SEQ ID NO 4954 | ATTTGAATTTTAGTAAGATGAC | CTA | chr1 | 62599111 | 62599132 | 62599116 | 62599111 | - |
| SEQ ID NO 4955 | GAATTTTAGTAAGATGACATTG | TTT | chr1 | 62599107 | 62599128 | 62599112 | 62599107 | - |
| SEQ ID NO 4956 | AATTTTAGTAAGATGACATTGG | TTG | chr1 | 62599106 | 62599127 | 62599111 | 62599106 | - |
| SEQ ID NO 4957 | TAGTAAGATGACATTGGCTGCT | TTT | chr1 | 62599101 | 62599122 | 62599106 | 62599101 | - |
| SEQ ID NO 4958 | AGTAAGATGACATTGGCTGCTA | TTT | chr1 | 62599100 | 62599121 | 62599105 | 62599100 | - |
| SEQ ID NO 4959 | GTAAGATGACATTGGCTGCTAT | TTA | chr1 | 62599099 | 62599120 | 62599104 | 62599099 | - |
| SEQ ID NO 4960 | GCTGCTATGAATTAATTTTTTT | TTG | chr1 | 62599085 | 62599106 | 62599090 | 62599085 | - |
| SEQ ID NO 4961 | CTATGAATTAATTTTTTTTCTT | CTG | chr1 | 62599081 | 62599102 | 62599086 | 62599081 | - |
| SEQ ID NO 4962 | TGAATTAATTTTTTTTCTTACA | CTA | chr1 | 62599078 | 62599099 | 62599083 | 62599078 | - |
| SEQ ID NO 4963 | ATTTTTTTTCTTACAATAATCC | TTA | chr1 | 62599071 | 62599092 | 62599076 | 62599071 | - |
| SEQ ID NO 4964 | TTTTTCTTACAATAATCCTATA | TTT | chr1 | 62599067 | 62599088 | 62599072 | 62599067 | - |
| SEQ ID NO 4965 | TTTTCTTACAATAATCCTATAA | TTT | chr1 | 62599066 | 62599087 | 62599071 | 62599066 | - |
| SEQ ID NO 4966 | TTTCTTACAATAATCCTATAAG | TTT | chr1 | 62599065 | 62599086 | 62599070 | 62599065 | - |
| SEQ ID NO 4967 | TTCTTACAATAATCCTATAAGT | TTT | chr1 | 62599064 | 62599085 | 62599069 | 62599064 | - |
| SEQ ID NO 4968 | TCTTACAATAATCCTATAAGTT | TTT | chr1 | 62599063 | 62599084 | 62599068 | 62599063 | - |
| SEQ ID NO 4969 | CTTACAATAATCCTATAAGTTC | TTT | chr1 | 62599062 | 62599083 | 62599067 | 62599062 | - |
| SEQ ID NO 4970 | TTACAATAATCCTATAAGTTCT | TTC | chr1 | 62599061 | 62599082 | 62599066 | 62599061 | - |
| SEQ ID NO 4971 | ACAATAATCCTATAAGTTCTGT | CTT | chr1 | 62599059 | 62599080 | 62599064 | 62599059 | - |
| SEQ ID NO 4972 | CAATAATCCTATAAGTTCTGTT | TTA | chr1 | 62599058 | 62599079 | 62599063 | 62599058 | - |
| SEQ ID NO 4973 | TAAGTTCTGTTATTATCTTTGT | CTA | chr1 | 62599047 | 62599068 | 62599052 | 62599047 | - |
| SEQ ID NO 4974 | TGTTATTATCTTTGTAGTATAT | TTC | chr1 | 62599040 | 62599061 | 62599045 | 62599040 | - |
| SEQ ID NO 4975 | TTATTATCTTTGTAGTATATGT | CTG | chr1 | 62599038 | 62599059 | 62599043 | 62599038 | - |
| SEQ ID NO 4976 | TTATCTTTGTAGTATATGTGAG | TTA | chr1 | 62599035 | 62599056 | 62599040 | 62599035 | - |
| SEQ ID NO 4977 | TCTTTGTAGTATATGTGAGGAA | TTA | chr1 | 62599032 | 62599053 | 62599037 | 62599032 | - |
| SEQ ID NO 4978 | TGTAGTATATGTGAGGAAACTG | CTT | chr1 | 62599028 | 62599049 | 62599033 | 62599028 | - |
| SEQ ID NO 4979 | GTAGTATATGTGAGGAAACTGA | TTT | chr1 | 62599027 | 62599048 | 62599032 | 62599027 | - |
| SEQ ID NO 4980 | TAGTATATGTGAGGAAACTGAG | TTG | chr1 | 62599026 | 62599047 | 62599031 | 62599026 | - |
| SEQ ID NO 4981 | AGAGATAAAGGGGTGAAGTAAT | CTG | chr1 | 62599006 | 62599027 | 62599011 | 62599006 | - |
| SEQ ID NO 4982 | ATTCAAGGTCACACAAAGTTTT | TTT | chr1 | 62598982 | 62599003 | 62598987 | 62598982 | - |
| SEQ ID NO 4983 | TTCAAGGTCACACAAAGTTTTA | TTA | chr1 | 62598981 | 62599002 | 62598986 | 62598981 | - |
| SEQ ID NO 4984 | AAGGTCACACAAAGTTTTAGAG | TTC | chr1 | 62598978 | 62598999 | 62598983 | 62598978 | - |
| SEQ ID NO 4985 | TAGAGCCATGGTTTAAATGCAG | TTT | chr1 | 62598961 | 62598982 | 62598966 | 62598961 | - |
| SEQ ID NO 4986 | AGAGCCATGGTTTAAATGCAGG | TTT | chr1 | 62598960 | 62598981 | 62598965 | 62598960 | - |
| SEQ ID NO 4987 | GAGCCATGGTTTAAATGCAGGT | TTA | chr1 | 62598959 | 62598980 | 62598964 | 62598959 | - |
| SEQ ID NO 4988 | AAATGCAGGTAGTTTATTAGCT | TTT | chr1 | 62598947 | 62598968 | 62598952 | 62598947 | - |

Figure 18 (Cont'd)

| | | | | | | | | |
|---|---|---|---|---|---|---|---|---|
| SEQ ID NO 4989 | AATGCAGGTAGTTTATTAGCTT | TTA | chr1 | 62598946 | 62598967 | 62598951 | 62598946 | - |
| SEQ ID NO 4990 | ATTAGCTTCAGAGCCTGCAATT | TTT | chr1 | 62598932 | 62598953 | 62598937 | 62598932 | - |
| SEQ ID NO 4991 | TTAGCTTCAGAGCCTGCAATTT | TTA | chr1 | 62598931 | 62598952 | 62598936 | 62598931 | - |
| SEQ ID NO 4992 | GCTTCAGAGCCTGCAATTTTAA | TTA | chr1 | 62598928 | 62598949 | 62598933 | 62598928 | - |
| SEQ ID NO 4993 | CAGAGCCTGCAATTTTAACAGT | CTT | chr1 | 62598924 | 62598945 | 62598929 | 62598924 | - |
| SEQ ID NO 4994 | AGAGCCTGCAATTTTAACAGTT | TTC | chr1 | 62598923 | 62598944 | 62598928 | 62598923 | - |
| SEQ ID NO 4995 | CAATTTTAACAGTTATGCTGAT | CTG | chr1 | 62598915 | 62598936 | 62598920 | 62598915 | - |
| SEQ ID NO 4996 | TAACAGTTATGCTGATGTGATA | TTT | chr1 | 62598909 | 62598930 | 62598914 | 62598909 | - |
| SEQ ID NO 4997 | AACAGTTATGCTGATGTGATAA | TTT | chr1 | 62598908 | 62598929 | 62598913 | 62598908 | - |
| SEQ ID NO 4998 | ACAGTTATGCTGATGTGATAAT | TTA | chr1 | 62598907 | 62598928 | 62598912 | 62598907 | - |
| SEQ ID NO 4999 | TGCTGATGTGATAATTTTACTC | TTA | chr1 | 62598900 | 62598921 | 62598905 | 62598900 | - |
| SEQ ID NO 5000 | ATGTGATAATTTTACTCATGAT | CTG | chr1 | 62598895 | 62598916 | 62598900 | 62598895 | - |
| SEQ ID NO 5001 | TACTCATGATCCAGTTAAAGCT | TTT | chr1 | 62598883 | 62598904 | 62598888 | 62598883 | - |
| SEQ ID NO 5002 | ACTCATGATCCAGTTAAAGCTT | TTT | chr1 | 62598882 | 62598903 | 62598887 | 62598882 | - |
| SEQ ID NO 5003 | CTCATGATCCAGTTAAAGCTTG | TTA | chr1 | 62598881 | 62598902 | 62598886 | 62598881 | - |
| SEQ ID NO 5004 | ATGATCCAGTTAAAGCTTGTAA | CTC | chr1 | 62598878 | 62598899 | 62598883 | 62598878 | - |
| SEQ ID NO 5005 | AAGCTTGTAAATAATTTTAGGA | TTA | chr1 | 62598866 | 62598887 | 62598871 | 62598866 | - |
| SEQ ID NO 5006 | GTAAATAATTTTAGGATTCAGT | CTT | chr1 | 62598860 | 62598881 | 62598865 | 62598860 | - |
| SEQ ID NO 5007 | TAAATAATTTTAGGATTCAGTG | TTG | chr1 | 62598859 | 62598880 | 62598864 | 62598859 | - |
| SEQ ID NO 5008 | TAGGATTCAGTGTTTTTACAGA | TTT | chr1 | 62598849 | 62598870 | 62598854 | 62598849 | - |
| SEQ ID NO 5009 | AGGATTCAGTGTTTTTACAGAC | TTT | chr1 | 62598848 | 62598869 | 62598853 | 62598848 | - |
| SEQ ID NO 5010 | GGATTCAGTGTTTTTACAGACC | TTA | chr1 | 62598847 | 62598868 | 62598852 | 62598847 | - |
| SEQ ID NO 5011 | AGTGTTTTTACAGACCTGTGTG | TTC | chr1 | 62598841 | 62598862 | 62598846 | 62598841 | - |
| SEQ ID NO 5012 | TTACAGACCTGTGTGAAAGATG | TTT | chr1 | 62598834 | 62598855 | 62598839 | 62598834 | - |
| SEQ ID NO 5013 | TACAGACCTGTGTGAAAGATGG | TTT | chr1 | 62598833 | 62598854 | 62598838 | 62598833 | - |
| SEQ ID NO 5014 | ACAGACCTGTGTGAAAGATGGG | TTT | chr1 | 62598832 | 62598853 | 62598837 | 62598832 | - |
| SEQ ID NO 5015 | CAGACCTGTGTGAAAGATGGGA | TTA | chr1 | 62598831 | 62598852 | 62598836 | 62598831 | - |
| SEQ ID NO 5016 | TGTGAAAGATGGGACATACCAT | CTG | chr1 | 62598823 | 62598844 | 62598828 | 62598823 | - |
| SEQ ID NO 5017 | AAATACTGACTTACCTGATTTT | TTA | chr1 | 62598799 | 62598820 | 62598804 | 62598799 | - |
| SEQ ID NO 5018 | ACTTACCTGATTTTCTATTTCT | CTG | chr1 | 62598791 | 62598812 | 62598796 | 62598791 | - |
| SEQ ID NO 5019 | ACCTGATTTTCTATTTCTTTTA | CTT | chr1 | 62598787 | 62598808 | 62598792 | 62598787 | - |
| SEQ ID NO 5020 | CCTGATTTTCTATTTCTTTTAT | TTA | chr1 | 62598786 | 62598807 | 62598791 | 62598786 | - |
| SEQ ID NO 5021 | ATTTTCTATTTCTTTTATTTGA | CTG | chr1 | 62598782 | 62598803 | 62598787 | 62598782 | - |
| SEQ ID NO 5022 | TCTATTTCTTTTATTTGACTAT | TTT | chr1 | 62598778 | 62598799 | 62598783 | 62598778 | - |
| SEQ ID NO 5023 | CTATTTCTTTTATTTGACTATG | TTT | chr1 | 62598777 | 62598798 | 62598782 | 62598777 | - |
| SEQ ID NO 5024 | TATTTCTTTTATTTGACTATGC | TTC | chr1 | 62598776 | 62598797 | 62598781 | 62598776 | - |
| SEQ ID NO 5025 | TTTCTTTTATTTGACTATGCTG | CTA | chr1 | 62598774 | 62598795 | 62598779 | 62598774 | - |
| SEQ ID NO 5026 | CTTTTATTTGACTATGCTGTTG | TTT | chr1 | 62598771 | 62598792 | 62598776 | 62598771 | - |
| SEQ ID NO 5027 | TTTTATTTGACTATGCTGTTGG | TTC | chr1 | 62598770 | 62598791 | 62598775 | 62598770 | - |
| SEQ ID NO 5028 | TTATTTGACTATGCTGTTGGTT | CTT | chr1 | 62598768 | 62598789 | 62598773 | 62598768 | - |
| SEQ ID NO 5029 | TATTTGACTATGCTGTTGGTTT | TTT | chr1 | 62598767 | 62598788 | 62598772 | 62598767 | - |
| SEQ ID NO 5030 | ATTTGACTATGCTGTTGGTTTA | TTT | chr1 | 62598766 | 62598787 | 62598771 | 62598766 | - |
| SEQ ID NO 5031 | TTTGACTATGCTGTTGGTTTAA | TTA | chr1 | 62598765 | 62598786 | 62598770 | 62598765 | - |
| SEQ ID NO 5032 | GACTATGCTGTTGGTTTAATTG | TTT | chr1 | 62598762 | 62598783 | 62598767 | 62598762 | - |
| SEQ ID NO 5033 | ACTATGCTGTTGGTTTAATTGT | TTG | chr1 | 62598761 | 62598782 | 62598766 | 62598761 | - |
| SEQ ID NO 5034 | TGCTGTTGGTTTAATTGTTTAT | CTA | chr1 | 62598757 | 62598778 | 62598762 | 62598757 | - |
| SEQ ID NO 5035 | TTGGTTTAATTGTTTATATTGG | CTG | chr1 | 62598752 | 62598773 | 62598757 | 62598752 | - |
| SEQ ID NO 5036 | GTTTAATTGTTTATATTGGTCT | TTG | chr1 | 62598749 | 62598770 | 62598754 | 62598749 | - |
| SEQ ID NO 5037 | AATTGTTTATATTGGTCTTCCA | TTT | chr1 | 62598745 | 62598766 | 62598750 | 62598745 | - |
| SEQ ID NO 5038 | ATTGTTTATATTGGTCTTCCAC | TTA | chr1 | 62598744 | 62598765 | 62598749 | 62598744 | - |
| SEQ ID NO 5039 | TTTATATTGGTCTTCCACGGTC | TTG | chr1 | 62598740 | 62598761 | 62598745 | 62598740 | - |
| SEQ ID NO 5040 | ATATTGGTCTTCCACGGTCTGG | TTT | chr1 | 62598737 | 62598758 | 62598742 | 62598737 | - |
| SEQ ID NO 5041 | TATTGGTCTTCCACGGTCTGGA | TTA | chr1 | 62598736 | 62598757 | 62598741 | 62598736 | - |
| SEQ ID NO 5042 | GTCTTCCACGGTCTGGAGAAGG | TTG | chr1 | 62598731 | 62598752 | 62598736 | 62598731 | - |
| SEQ ID NO 5043 | CCACGGTCTGGAGAAGGTCTTT | CTT | chr1 | 62598726 | 62598747 | 62598731 | 62598726 | - |
| SEQ ID NO 5044 | CACGGTCTGGAGAAGGTCTTTG | TTC | chr1 | 62598725 | 62598746 | 62598730 | 62598725 | - |
| SEQ ID NO 5045 | GAGAAGGTCTTTGATGCTATTA | CTG | chr1 | 62598716 | 62598737 | 62598721 | 62598716 | - |
| SEQ ID NO 5046 | TGATGCTATTATCTTGTTTTTC | CTT | chr1 | 62598705 | 62598726 | 62598710 | 62598705 | - |

Figure 18 (Cont'd)

| | | | | | | | | |
|---|---|---|---|---|---|---|---|---|
| SEQ ID NO 5047 | GATGCTATTATCTTGTTTTTCT | TTT | chr1 | 62598704 | 62598725 | 62598709 | 62598704 | - |
| SEQ ID NO 5048 | ATGCTATTATCTTGTTTTTCTA | TTG | chr1 | 62598703 | 62598724 | 62598708 | 62598703 | - |
| SEQ ID NO 5049 | TTATCTTGTTTTTCTACAAAAG | CTA | chr1 | 62598697 | 62598718 | 62598702 | 62598697 | - |
| SEQ ID NO 5050 | TCTTGTTTTTCTACAAAAGTCT | TTA | chr1 | 62598694 | 62598715 | 62598699 | 62598694 | - |
| SEQ ID NO 5051 | GTTTTTCTACAAAAGTCTGGAT | CTT | chr1 | 62598690 | 62598711 | 62598695 | 62598690 | - |
| SEQ ID NO 5052 | TTTTTCTACAAAAGTCTGGATA | TTG | chr1 | 62598689 | 62598710 | 62598694 | 62598689 | - |
| SEQ ID NO 5053 | TTCTACAAAAGTCTGGATATAG | TTT | chr1 | 62598686 | 62598707 | 62598691 | 62598686 | - |
| SEQ ID NO 5054 | TCTACAAAAGTCTGGATATAGA | TTT | chr1 | 62598685 | 62598706 | 62598690 | 62598685 | - |
| SEQ ID NO 5055 | CTACAAAAGTCTGGATATAGAG | TTT | chr1 | 62598684 | 62598705 | 62598689 | 62598684 | - |
| SEQ ID NO 5056 | TACAAAAGTCTGGATATAGAGA | TTC | chr1 | 62598683 | 62598704 | 62598688 | 62598683 | - |
| SEQ ID NO 5057 | CAAAAGTCTGGATATAGAGAGT | CTA | chr1 | 62598681 | 62598702 | 62598686 | 62598681 | - |
| SEQ ID NO 5058 | GATATAGAGAGTAGGTTGGTTA | CTG | chr1 | 62598671 | 62598692 | 62598676 | 62598671 | - |
| SEQ ID NO 5059 | GTTATAAGTTGCTTTCCTCTTT | TTG | chr1 | 62598653 | 62598674 | 62598658 | 62598653 | - |
| SEQ ID NO 5060 | TAAGTTGCTTTCCTCTTTCTTT | TTA | chr1 | 62598649 | 62598670 | 62598654 | 62598649 | - |
| SEQ ID NO 5061 | CTTTCCTCTTTCTTTTCTATTA | TTG | chr1 | 62598642 | 62598663 | 62598647 | 62598642 | - |
| SEQ ID NO 5062 | TCCTCTTTCTTTTCTATTAATT | CTT | chr1 | 62598639 | 62598660 | 62598644 | 62598639 | - |
| SEQ ID NO 5063 | CCTCTTTCTTTTCTATTAATTT | TTT | chr1 | 62598638 | 62598659 | 62598643 | 62598638 | - |
| SEQ ID NO 5064 | CTCTTTCTTTTCTATTAATTTC | TTC | chr1 | 62598637 | 62598658 | 62598642 | 62598637 | - |
| SEQ ID NO 5065 | TTTCTTTTCTATTAATTTCCTG | CTC | chr1 | 62598634 | 62598655 | 62598639 | 62598634 | - |
| SEQ ID NO 5066 | TCTTTTCTATTAATTTCCTGTA | CTT | chr1 | 62598632 | 62598653 | 62598637 | 62598632 | - |
| SEQ ID NO 5067 | CTTTTCTATTAATTTCCTGTAA | TTT | chr1 | 62598631 | 62598652 | 62598636 | 62598631 | - |
| SEQ ID NO 5068 | TTTTCTATTAATTTCCTGTAAC | TTC | chr1 | 62598630 | 62598651 | 62598635 | 62598630 | - |
| SEQ ID NO 5069 | TTCTATTAATTTCCTGTAACAC | CTT | chr1 | 62598628 | 62598649 | 62598633 | 62598628 | - |
| SEQ ID NO 5070 | TCTATTAATTTCCTGTAACACT | TTT | chr1 | 62598627 | 62598648 | 62598632 | 62598627 | - |
| SEQ ID NO 5071 | CTATTAATTTCCTGTAACACTA | TTT | chr1 | 62598626 | 62598647 | 62598631 | 62598626 | - |
| SEQ ID NO 5072 | TATTAATTTCCTGTAACACTAT | TTC | chr1 | 62598625 | 62598646 | 62598630 | 62598625 | - |
| SEQ ID NO 5073 | TTAATTTCCTGTAACACTATCA | CTA | chr1 | 62598623 | 62598644 | 62598628 | 62598623 | - |
| SEQ ID NO 5074 | ATTTCCTGTAACACTATCATAA | TTA | chr1 | 62598620 | 62598641 | 62598625 | 62598620 | - |
| SEQ ID NO 5075 | CCTGTAACACTATCATAATCTA | TTT | chr1 | 62598616 | 62598637 | 62598621 | 62598616 | - |
| SEQ ID NO 5076 | CTGTAACACTATCATAATCTAA | TTC | chr1 | 62598615 | 62598636 | 62598620 | 62598615 | - |
| SEQ ID NO 5077 | TAACACTATCATAATCTAAATT | CTG | chr1 | 62598612 | 62598633 | 62598617 | 62598612 | - |
| SEQ ID NO 5078 | TCATAATCTAAATTTTTAAACT | CTA | chr1 | 62598604 | 62598625 | 62598609 | 62598604 | - |
| SEQ ID NO 5079 | AATTTTTAAACTAATAATGGAT | CTA | chr1 | 62598594 | 62598615 | 62598599 | 62598594 | - |
| SEQ ID NO 5080 | TTAAACTAATAATGGATTTGAA | TTT | chr1 | 62598589 | 62598610 | 62598594 | 62598589 | - |
| SEQ ID NO 5081 | TAAACTAATAATGGATTTGAAA | TTT | chr1 | 62598588 | 62598609 | 62598593 | 62598588 | - |
| SEQ ID NO 5082 | AAACTAATAATGGATTTGAAAA | TTT | chr1 | 62598587 | 62598608 | 62598592 | 62598587 | - |
| SEQ ID NO 5083 | AACTAATAATGGATTTGAAAAA | TTA | chr1 | 62598586 | 62598607 | 62598591 | 62598586 | - |
| SEQ ID NO 5084 | ATAATGGATTTGAAAATGAAT | CTA | chr1 | 62598581 | 62598602 | 62598586 | 62598581 | - |
| SEQ ID NO 5085 | GAAAATGAATATTGGCAATTC | TTT | chr1 | 62598570 | 62598591 | 62598575 | 62598570 | - |
| SEQ ID NO 5086 | AAAAATGAATATTGGCAATTCC | TTG | chr1 | 62598569 | 62598590 | 62598574 | 62598569 | - |
| SEQ ID NO 5087 | GCAATTCCTTCCCCTTGTATGC | TTG | chr1 | 62598555 | 62598576 | 62598560 | 62598555 | - |
| SEQ ID NO 5088 | CTTCCCCTTGTATGCTTCTTTC | TTC | chr1 | 62598548 | 62598569 | 62598553 | 62598548 | - |
| SEQ ID NO 5089 | CCCCTTGTATGCTTCTTTCAAA | CTT | chr1 | 62598545 | 62598566 | 62598550 | 62598545 | - |
| SEQ ID NO 5090 | CCCTTGTATGCTTCTTTCAAAT | TTC | chr1 | 62598544 | 62598565 | 62598549 | 62598544 | - |
| SEQ ID NO 5091 | GTATGCTTCTTTCAAATAGCAC | CTT | chr1 | 62598539 | 62598560 | 62598544 | 62598539 | - |
| SEQ ID NO 5092 | TATGCTTCTTTCAAATAGCACA | TTG | chr1 | 62598538 | 62598559 | 62598543 | 62598538 | - |
| SEQ ID NO 5093 | CTTTCAAATAGCACATATTTTT | CTT | chr1 | 62598531 | 62598552 | 62598536 | 62598531 | - |
| SEQ ID NO 5094 | TTTCAAATAGCACATATTTTTG | TTC | chr1 | 62598530 | 62598551 | 62598535 | 62598530 | - |
| SEQ ID NO 5095 | TCAAATAGCACATATTTTTGTC | CTT | chr1 | 62598528 | 62598549 | 62598533 | 62598528 | - |
| SEQ ID NO 5096 | CAAATAGCACATATTTTTGTCC | TTT | chr1 | 62598527 | 62598548 | 62598532 | 62598527 | - |
| SEQ ID NO 5097 | AAATAGCACATATTTTTGTCCT | TTC | chr1 | 62598526 | 62598547 | 62598531 | 62598526 | - |
| SEQ ID NO 5098 | TTGTCCTTAACATTTTATTTAA | TTT | chr1 | 62598511 | 62598532 | 62598516 | 62598511 | - |
| SEQ ID NO 5099 | TGTCCTTAACATTTTATTTAAA | TTT | chr1 | 62598510 | 62598531 | 62598515 | 62598510 | - |
| SEQ ID NO 5100 | GTCCTTAACATTTTATTTAAAT | TTT | chr1 | 62598509 | 62598530 | 62598514 | 62598509 | - |
| SEQ ID NO 5101 | TCCTTAACATTTTATTTAAATT | TTG | chr1 | 62598508 | 62598529 | 62598513 | 62598508 | - |
| SEQ ID NO 5102 | AACATTTTATTTAAATTGTACT | CTT | chr1 | 62598503 | 62598524 | 62598508 | 62598503 | - |
| SEQ ID NO 5103 | ACATTTTATTTAAATTGTACTA | TTA | chr1 | 62598502 | 62598523 | 62598507 | 62598502 | - |
| SEQ ID NO 5104 | TATTTAAATTGTACTATCTCTA | TTT | chr1 | 62598496 | 62598517 | 62598501 | 62598496 | - |

Figure 18 (Cont'd)

| SEQ ID NO 5105 | ATTTAAATTGTACTATCTCTAA | TTT | chr1 | 62598495 | 62598516 | 62598500 | 62598495 | - |
|---|---|---|---|---|---|---|---|---|
| SEQ ID NO 5106 | TTTAAATTGTACTATCTCTAAA | TTA | chr1 | 62598494 | 62598515 | 62598499 | 62598494 | - |
| SEQ ID NO 5107 | AAATTGTACTATCTCTAAAATT | TTT | chr1 | 62598491 | 62598512 | 62598496 | 62598491 | - |
| SEQ ID NO 5108 | AATTGTACTATCTCTAAAATTT | TTA | chr1 | 62598490 | 62598511 | 62598495 | 62598490 | - |
| SEQ ID NO 5109 | TACTATCTCTAAAATTTGATTT | TTG | chr1 | 62598485 | 62598506 | 62598490 | 62598485 | - |
| SEQ ID NO 5110 | TCTCTAAAATTTGATTTTCTGA | CTA | chr1 | 62598480 | 62598501 | 62598485 | 62598480 | - |
| SEQ ID NO 5111 | TAAAATTTGATTTTCTGAACTT | CTC | chr1 | 62598476 | 62598497 | 62598481 | 62598476 | - |
| SEQ ID NO 5112 | AAATTTGATTTTCTGAACTTCA | CTA | chr1 | 62598474 | 62598495 | 62598479 | 62598474 | - |
| SEQ ID NO 5113 | GATTTTCTGAACTTCAATTAAA | TTT | chr1 | 62598468 | 62598489 | 62598473 | 62598468 | - |
| SEQ ID NO 5114 | ATTTTCTGAACTTCAATTAAAA | TTG | chr1 | 62598467 | 62598488 | 62598472 | 62598467 | - |
| SEQ ID NO 5115 | TCTGAACTTCAATTAAAAGAAA | TTT | chr1 | 62598463 | 62598484 | 62598468 | 62598463 | - |
| SEQ ID NO 5116 | CTGAACTTCAATTAAAAGAAAA | TTT | chr1 | 62598462 | 62598483 | 62598467 | 62598462 | - |
| SEQ ID NO 5117 | TGAACTTCAATTAAAAGAAAAG | TTC | chr1 | 62598461 | 62598482 | 62598466 | 62598461 | - |
| SEQ ID NO 5118 | AACTTCAATTAAAAGAAAAGC | CTG | chr1 | 62598459 | 62598480 | 62598464 | 62598459 | - |
| SEQ ID NO 5119 | CAATTAAAAGAAAAGCCCAGC | CTT | chr1 | 62598454 | 62598475 | 62598459 | 62598454 | - |
| SEQ ID NO 5120 | AATTAAAAGAAAAGCCCAGCA | TTC | chr1 | 62598453 | 62598474 | 62598458 | 62598453 | - |
| SEQ ID NO 5121 | AAAGAAAAGCCCAGCATATTT | TTA | chr1 | 62598448 | 62598469 | 62598453 | 62598448 | - |
| SEQ ID NO 5122 | TCATATGAATAAATCTTTTCCA | TTT | chr1 | 62598426 | 62598447 | 62598431 | 62598426 | - |
| SEQ ID NO 5123 | CATATGAATAAATCTTTTCCAT | TTT | chr1 | 62598425 | 62598446 | 62598430 | 62598425 | - |
| SEQ ID NO 5124 | ATATGAATAAATCTTTTCCATT | TTC | chr1 | 62598424 | 62598445 | 62598429 | 62598424 | - |
| SEQ ID NO 5125 | TTCCATTTACTGTATTATTTAA | CTT | chr1 | 62598409 | 62598430 | 62598414 | 62598409 | - |
| SEQ ID NO 5126 | TCCATTTACTGTATTATTTAAT | TTT | chr1 | 62598408 | 62598429 | 62598413 | 62598408 | - |
| SEQ ID NO 5127 | CCATTTACTGTATTATTTAATC | TTT | chr1 | 62598407 | 62598428 | 62598412 | 62598407 | - |
| SEQ ID NO 5128 | CATTTACTGTATTATTTAATCT | TTC | chr1 | 62598406 | 62598427 | 62598411 | 62598406 | - |
| SEQ ID NO 5129 | ACTGTATTATTTAATCTGTTTT | TTT | chr1 | 62598401 | 62598422 | 62598406 | 62598401 | - |
| SEQ ID NO 5130 | CTGTATTATTTAATCTGTTTTA | TTA | chr1 | 62598400 | 62598421 | 62598405 | 62598400 | - |
| SEQ ID NO 5131 | TATTATTTAATCTGTTTTAAAC | CTG | chr1 | 62598397 | 62598418 | 62598402 | 62598397 | - |
| SEQ ID NO 5132 | TTTAATCTGTTTTAAACACTGG | TTA | chr1 | 62598392 | 62598413 | 62598397 | 62598392 | - |
| SEQ ID NO 5133 | AATCTGTTTTAAACACTGGAGA | TTT | chr1 | 62598389 | 62598410 | 62598394 | 62598389 | - |
| SEQ ID NO 5134 | ATCTGTTTTAAACACTGGAGAA | TTA | chr1 | 62598388 | 62598409 | 62598393 | 62598388 | - |
| SEQ ID NO 5135 | TTTTAAACACTGGAGAATAGTT | CTG | chr1 | 62598383 | 62598404 | 62598388 | 62598383 | - |
| SEQ ID NO 5136 | TAAACACTGGAGAATAGTTTTA | TTT | chr1 | 62598380 | 62598401 | 62598385 | 62598380 | - |
| SEQ ID NO 5137 | AAACACTGGAGAATAGTTTTAA | TTT | chr1 | 62598379 | 62598400 | 62598384 | 62598379 | - |
| SEQ ID NO 5138 | AACACTGGAGAATAGTTTTAAA | TTA | chr1 | 62598378 | 62598399 | 62598383 | 62598378 | - |
| SEQ ID NO 5139 | GAGAATAGTTTTAAATTTTTTT | CTG | chr1 | 62598371 | 62598392 | 62598376 | 62598371 | - |
| SEQ ID NO 5140 | TAAATTTTTTTAACTTTTTAC | TTT | chr1 | 62598360 | 62598381 | 62598365 | 62598360 | - |
| SEQ ID NO 5141 | AAATTTTTTTAACTTTTTACT | TTT | chr1 | 62598359 | 62598380 | 62598364 | 62598359 | - |
| SEQ ID NO 5142 | AATTTTTTTAACTTTTTACTT | TTA | chr1 | 62598358 | 62598379 | 62598363 | 62598358 | - |
| SEQ ID NO 5143 | TTTTTAACTTTTTACTTACCTT | TTT | chr1 | 62598353 | 62598374 | 62598358 | 62598353 | - |
| SEQ ID NO 5144 | TTTTAACTTTTTACTTACCTTC | TTT | chr1 | 62598352 | 62598373 | 62598357 | 62598352 | - |
| SEQ ID NO 5145 | TTTAACTTTTTACTTACCTTCA | TTT | chr1 | 62598351 | 62598372 | 62598356 | 62598351 | - |
| SEQ ID NO 5146 | TTAACTTTTTACTTACCTTCAG | TTT | chr1 | 62598350 | 62598371 | 62598355 | 62598350 | - |
| SEQ ID NO 5147 | TAACTTTTTACTTACCTTCAGT | TTT | chr1 | 62598349 | 62598370 | 62598354 | 62598349 | - |
| SEQ ID NO 5148 | AACTTTTTACTTACCTTCAGTA | TTT | chr1 | 62598348 | 62598369 | 62598353 | 62598348 | - |
| SEQ ID NO 5149 | ACTTTTTACTTACCTTCAGTAA | TTA | chr1 | 62598347 | 62598368 | 62598352 | 62598347 | - |
| SEQ ID NO 5150 | TTTACTTACCTTCAGTAATTTA | CTT | chr1 | 62598343 | 62598364 | 62598348 | 62598343 | - |
| SEQ ID NO 5151 | TTACTTACCTTCAGTAATTTAC | TTT | chr1 | 62598342 | 62598363 | 62598347 | 62598342 | - |
| SEQ ID NO 5152 | TACTTACCTTCAGTAATTTACA | TTT | chr1 | 62598341 | 62598362 | 62598346 | 62598341 | - |
| SEQ ID NO 5153 | ACTTACCTTCAGTAATTTACAA | TTT | chr1 | 62598340 | 62598361 | 62598345 | 62598340 | - |
| SEQ ID NO 5154 | CTTACCTTCAGTAATTTACAAT | TTA | chr1 | 62598339 | 62598360 | 62598344 | 62598339 | - |
| SEQ ID NO 5155 | ACCTTCAGTAATTTACAATAGT | CTT | chr1 | 62598336 | 62598357 | 62598341 | 62598336 | - |
| SEQ ID NO 5156 | CCTTCAGTAATTTACAATAGTG | TTA | chr1 | 62598335 | 62598356 | 62598340 | 62598335 | - |
| SEQ ID NO 5157 | CAGTAATTTACAATAGTGTAAT | CTT | chr1 | 62598331 | 62598352 | 62598336 | 62598331 | - |
| SEQ ID NO 5158 | AGTAATTTACAATAGTGTAATG | TTC | chr1 | 62598330 | 62598351 | 62598335 | 62598330 | - |
| SEQ ID NO 5159 | ACAATAGTGTAATGACATAGTG | TTT | chr1 | 62598322 | 62598343 | 62598327 | 62598322 | - |
| SEQ ID NO 5160 | CAATAGTGTAATGACATAGTGT | TTA | chr1 | 62598321 | 62598342 | 62598326 | 62598321 | - |
| SEQ ID NO 5161 | TAGATTGTATAATTTAACCGAT | TTC | chr1 | 62598297 | 62598318 | 62598302 | 62598297 | - |
| SEQ ID NO 5162 | GATTGTATAATTTAACCGATTT | CTA | chr1 | 62598295 | 62598316 | 62598300 | 62598295 | - |

Figure 18 (Cont'd)

| | | | | | | | | |
|---|---|---|---|---|---|---|---|---|
| SEQ ID NO 5163 | TATAATTTAACCGATTTGTAAT | TTG | chr1 | 62598290 | 62598311 | 62598295 | 62598290 | - |
| SEQ ID NO 5164 | AACCGATTTGTAATTTTCATAT | TTT | chr1 | 62598282 | 62598303 | 62598287 | 62598282 | - |
| SEQ ID NO 5165 | ACCGATTTGTAATTTTCATATA | TTA | chr1 | 62598281 | 62598302 | 62598286 | 62598281 | - |
| SEQ ID NO 5166 | GTAATTTTCATATAAAATGCAA | TTT | chr1 | 62598273 | 62598294 | 62598278 | 62598273 | - |
| SEQ ID NO 5167 | TAATTTTCATATAAAATGCAAA | TTG | chr1 | 62598272 | 62598293 | 62598277 | 62598272 | - |
| SEQ ID NO 5168 | TCATATAAAATGCAAATTTTCA | TTT | chr1 | 62598266 | 62598287 | 62598271 | 62598266 | - |
| SEQ ID NO 5169 | CATATAAAATGCAAATTTTCAG | TTT | chr1 | 62598265 | 62598286 | 62598270 | 62598265 | - |
| SEQ ID NO 5170 | ATATAAAATGCAAATTTTCAGT | TTC | chr1 | 62598264 | 62598285 | 62598269 | 62598264 | - |
| SEQ ID NO 5171 | TCAGTGTTTTCATATATAACAT | TTT | chr1 | 62598247 | 62598268 | 62598252 | 62598247 | - |
| SEQ ID NO 5172 | CAGTGTTTTCATATATAACATT | TTT | chr1 | 62598246 | 62598267 | 62598251 | 62598246 | - |
| SEQ ID NO 5173 | AGTGTTTTCATATATAACATTA | TTC | chr1 | 62598245 | 62598266 | 62598250 | 62598245 | - |
| SEQ ID NO 5174 | TCATATATAACATTAGGGAAAC | TTT | chr1 | 62598238 | 62598259 | 62598243 | 62598238 | - |
| SEQ ID NO 5175 | CATATATAACATTAGGGAAACA | TTT | chr1 | 62598237 | 62598258 | 62598242 | 62598237 | - |
| SEQ ID NO 5176 | ATATATAACATTAGGGAAACAA | TTC | chr1 | 62598236 | 62598257 | 62598241 | 62598236 | - |
| SEQ ID NO 5177 | GGGAAACAAAAAACTAACTTGA | TTA | chr1 | 62598223 | 62598244 | 62598228 | 62598223 | - |
| SEQ ID NO 5178 | ACTTGAAATTATAATAGGAAAT | CTA | chr1 | 62598207 | 62598228 | 62598212 | 62598207 | - |
| SEQ ID NO 5179 | GAAATTATAATAGGAAATTTTA | CTT | chr1 | 62598203 | 62598224 | 62598208 | 62598203 | - |
| SEQ ID NO 5180 | AAATTATAATAGGAAATTTTAT | TTG | chr1 | 62598202 | 62598223 | 62598207 | 62598202 | - |
| SEQ ID NO 5181 | TAATAGGAAATTTTATTTTCTG | TTA | chr1 | 62598196 | 62598217 | 62598201 | 62598196 | - |
| SEQ ID NO 5182 | TATTTTCTGGAGATTATTTTTC | TTT | chr1 | 62598183 | 62598204 | 62598188 | 62598183 | - |
| SEQ ID NO 5183 | ATTTTCTGGAGATTATTTTTCT | TTT | chr1 | 62598182 | 62598203 | 62598187 | 62598182 | - |
| SEQ ID NO 5184 | TTTTCTGGAGATTATTTTTCTT | TTA | chr1 | 62598181 | 62598202 | 62598186 | 62598181 | - |
| SEQ ID NO 5185 | TCTGGAGATTATTTTTCTTGGA | TTT | chr1 | 62598178 | 62598199 | 62598183 | 62598178 | - |
| SEQ ID NO 5186 | CTGGAGATTATTTTTCTTGGAA | TTT | chr1 | 62598177 | 62598198 | 62598182 | 62598177 | - |
| SEQ ID NO 5187 | TGGAGATTATTTTTCTTGGAAA | TTC | chr1 | 62598176 | 62598197 | 62598181 | 62598176 | - |
| SEQ ID NO 5188 | GAGATTATTTTTCTTGGAAAAA | CTG | chr1 | 62598174 | 62598195 | 62598179 | 62598174 | - |
| SEQ ID NO 5189 | TTTTTCTTGGAAAAAAAGTAT | TTA | chr1 | 62598167 | 62598188 | 62598172 | 62598167 | - |
| SEQ ID NO 5190 | TTCTTGGAAAAAAAGTATTTC | TTT | chr1 | 62598164 | 62598185 | 62598169 | 62598164 | - |
| SEQ ID NO 5191 | TCTTGGAAAAAAAGTATTTCA | TTT | chr1 | 62598163 | 62598184 | 62598168 | 62598163 | - |
| SEQ ID NO 5192 | CTTGGAAAAAAAGTATTTCAA | TTT | chr1 | 62598162 | 62598183 | 62598167 | 62598162 | - |
| SEQ ID NO 5193 | TTGGAAAAAAAGTATTTCAAC | TTC | chr1 | 62598161 | 62598182 | 62598166 | 62598161 | - |
| SEQ ID NO 5194 | GGAAAAAAAGTATTTCAACAA | CTT | chr1 | 62598159 | 62598180 | 62598164 | 62598159 | - |
| SEQ ID NO 5195 | GAAAAAAAGTATTTCAACAAT | TTG | chr1 | 62598158 | 62598179 | 62598163 | 62598158 | - |
| SEQ ID NO 5196 | CAACAATGCAACAAAGTATTTC | TTT | chr1 | 62598143 | 62598164 | 62598148 | 62598143 | - |
| SEQ ID NO 5197 | AACAATGCAACAAAGTATTTCA | TTC | chr1 | 62598142 | 62598163 | 62598147 | 62598142 | - |
| SEQ ID NO 5198 | CAAATGGCATGCCTTAGAAATA | TTT | chr1 | 62598122 | 62598143 | 62598127 | 62598122 | - |
| SEQ ID NO 5199 | AAATGGCATGCCTTAGAAATAT | TTC | chr1 | 62598121 | 62598142 | 62598126 | 62598121 | - |
| SEQ ID NO 5200 | AGAAATATTTTTTTTAAAAGAT | CTT | chr1 | 62598107 | 62598128 | 62598112 | 62598107 | - |
| SEQ ID NO 5201 | GAAATATTTTTTTTAAAAGATC | TTA | chr1 | 62598106 | 62598127 | 62598111 | 62598106 | - |
| SEQ ID NO 5202 | TTTTTAAAAGATCCACATTGAA | TTT | chr1 | 62598097 | 62598118 | 62598102 | 62598097 | - |
| SEQ ID NO 5203 | TTTTAAAAGATCCACATTGAAA | TTT | chr1 | 62598096 | 62598117 | 62598101 | 62598096 | - |
| SEQ ID NO 5204 | TTTAAAAGATCCACATTGAAAA | TTT | chr1 | 62598095 | 62598116 | 62598100 | 62598095 | - |
| SEQ ID NO 5205 | TTAAAAGATCCACATTGAAAAC | TTT | chr1 | 62598094 | 62598115 | 62598099 | 62598094 | - |
| SEQ ID NO 5206 | TAAAAGATCCACATTGAAAACA | TTT | chr1 | 62598093 | 62598114 | 62598098 | 62598093 | - |
| SEQ ID NO 5207 | AAAAGATCCACATTGAAAACAT | TTT | chr1 | 62598092 | 62598113 | 62598097 | 62598092 | - |
| SEQ ID NO 5208 | AAAGATCCACATTGAAAACATA | TTA | chr1 | 62598091 | 62598112 | 62598096 | 62598091 | - |
| SEQ ID NO 5209 | AAAACATAAACATGAACCCTCT | TTG | chr1 | 62598077 | 62598098 | 62598082 | 62598077 | - |
| SEQ ID NO 5210 | TTTATTTTCTACTTACTTTAAG | CTC | chr1 | 62598056 | 62598077 | 62598061 | 62598056 | - |
| SEQ ID NO 5211 | TATTTTCTACTTACTTTAAGTG | CTT | chr1 | 62598054 | 62598075 | 62598059 | 62598054 | - |
| SEQ ID NO 5212 | ATTTTCTACTTACTTTAAGTGA | TTT | chr1 | 62598053 | 62598074 | 62598058 | 62598053 | - |
| SEQ ID NO 5213 | TTTTCTACTTACTTTAAGTGAA | TTA | chr1 | 62598052 | 62598073 | 62598057 | 62598052 | - |
| SEQ ID NO 5214 | TCTACTTACTTTAAGTGAAGTT | TTT | chr1 | 62598049 | 62598070 | 62598054 | 62598049 | - |
| SEQ ID NO 5215 | CTACTTACTTTAAGTGAAGTTA | TTT | chr1 | 62598048 | 62598069 | 62598053 | 62598048 | - |
| SEQ ID NO 5216 | TACTTACTTTAAGTGAAGTTAC | TTC | chr1 | 62598047 | 62598068 | 62598052 | 62598047 | - |
| SEQ ID NO 5217 | CTTACTTTAAGTGAAGTTACTT | CTA | chr1 | 62598045 | 62598066 | 62598050 | 62598045 | - |
| SEQ ID NO 5218 | ACTTTAAGTGAAGTTACTTCTG | CTT | chr1 | 62598042 | 62598063 | 62598047 | 62598042 | - |
| SEQ ID NO 5219 | CTTTAAGTGAAGTTACTTCTGG | TTA | chr1 | 62598041 | 62598062 | 62598046 | 62598041 | - |
| SEQ ID NO 5220 | TAAGTGAAGTTACTTCTGGGTG | CTT | chr1 | 62598038 | 62598059 | 62598043 | 62598038 | - |

Figure 18 (Cont'd)

| | | | | | | | | |
|---|---|---|---|---|---|---|---|---|
| SEQ ID NO 5221 | AAGTGAAGTTACTTCTGGGTGT | TTT | chr1 | 62598037 | 62598058 | 62598042 | 62598037 | - |
| SEQ ID NO 5222 | AGTGAAGTTACTTCTGGGTGTT | TTA | chr1 | 62598036 | 62598057 | 62598041 | 62598036 | - |
| SEQ ID NO 5223 | CTTCTGGGTGTTCTGGAGTTTC | TTA | chr1 | 62598026 | 62598047 | 62598031 | 62598026 | - |
| SEQ ID NO 5224 | CTGGGTGTTCTGGAGTTTCAGG | CTT | chr1 | 62598023 | 62598044 | 62598028 | 62598023 | - |
| SEQ ID NO 5225 | TGGGTGTTCTGGAGTTTCAGGT | TTC | chr1 | 62598022 | 62598043 | 62598027 | 62598022 | - |
| SEQ ID NO 5226 | GGTGTTCTGGAGTTTCAGGTTG | CTG | chr1 | 62598020 | 62598041 | 62598025 | 62598020 | - |
| SEQ ID NO 5227 | TGGAGTTTCAGGTTGATTTTGA | TTC | chr1 | 62598013 | 62598034 | 62598018 | 62598013 | - |
| SEQ ID NO 5228 | GAGTTTCAGGTTGATTTTGAAT | CTG | chr1 | 62598011 | 62598032 | 62598016 | 62598011 | - |
| SEQ ID NO 5229 | CAGGTTGATTTTGAATTAAGTT | TTT | chr1 | 62598005 | 62598026 | 62598010 | 62598005 | - |
| SEQ ID NO 5230 | AGGTTGATTTTGAATTAAGTTA | TTC | chr1 | 62598004 | 62598025 | 62598009 | 62598004 | - |
| SEQ ID NO 5231 | ATTTTGAATTAAGTTAGTTAGT | TTG | chr1 | 62597998 | 62598019 | 62598003 | 62597998 | - |
| SEQ ID NO 5232 | TGAATTAAGTTAGTTAGTTGCT | TTT | chr1 | 62597994 | 62598015 | 62597999 | 62597994 | - |
| SEQ ID NO 5233 | GAATTAAGTTAGTTAGTTGCTC | TTT | chr1 | 62597993 | 62598014 | 62597998 | 62597993 | - |
| SEQ ID NO 5234 | AATTAAGTTAGTTAGTTGCTCT | TTG | chr1 | 62597992 | 62598013 | 62597997 | 62597992 | - |
| SEQ ID NO 5235 | AGTTAGTTAGTTGCTCTTCTAA | TTA | chr1 | 62597987 | 62598008 | 62597992 | 62597987 | - |
| SEQ ID NO 5236 | GTTAGTTGCTCTTCTAAATATT | TTA | chr1 | 62597982 | 62598003 | 62597987 | 62597982 | - |
| SEQ ID NO 5237 | GTTGCTCTTCTAAATATTTCAC | TTA | chr1 | 62597978 | 62597999 | 62597983 | 62597978 | - |
| SEQ ID NO 5238 | CTCTTCTAAATATTTCACTTTT | TTG | chr1 | 62597974 | 62597995 | 62597979 | 62597974 | - |
| SEQ ID NO 5239 | TTCTAAATATTTCACTTTTTGT | CTC | chr1 | 62597971 | 62597992 | 62597976 | 62597971 | - |
| SEQ ID NO 5240 | CTAAATATTTCACTTTTTGTTG | CTT | chr1 | 62597969 | 62597990 | 62597974 | 62597969 | - |
| SEQ ID NO 5241 | TAAATATTTCACTTTTTGTTGA | TTC | chr1 | 62597968 | 62597989 | 62597973 | 62597968 | - |
| SEQ ID NO 5242 | AATATTTCACTTTTTGTTGAAG | CTA | chr1 | 62597966 | 62597987 | 62597971 | 62597966 | - |
| SEQ ID NO 5243 | CACTTTTTGTTGAAGTAGAATT | TTT | chr1 | 62597959 | 62597980 | 62597964 | 62597959 | - |
| SEQ ID NO 5244 | ACTTTTTGTTGAAGTAGAATTT | TTC | chr1 | 62597958 | 62597979 | 62597963 | 62597958 | - |
| SEQ ID NO 5245 | TTTGTTGAAGTAGAATTTTTTC | CTT | chr1 | 62597954 | 62597975 | 62597959 | 62597954 | - |
| SEQ ID NO 5246 | TTGTTGAAGTAGAATTTTTTCT | TTT | chr1 | 62597953 | 62597974 | 62597958 | 62597953 | - |
| SEQ ID NO 5247 | TGTTGAAGTAGAATTTTTTCTT | TTT | chr1 | 62597952 | 62597973 | 62597957 | 62597952 | - |
| SEQ ID NO 5248 | GTTGAAGTAGAATTTTTTCTTC | TTT | chr1 | 62597951 | 62597972 | 62597956 | 62597951 | - |
| SEQ ID NO 5249 | TTGAAGTAGAATTTTTTCTTCT | TTG | chr1 | 62597950 | 62597971 | 62597955 | 62597950 | - |
| SEQ ID NO 5250 | AAGTAGAATTTTTTCTTCTAGG | TTG | chr1 | 62597947 | 62597968 | 62597952 | 62597947 | - |
| SEQ ID NO 5251 | TTTCTTCTAGGAGGCTTTCAAG | TTT | chr1 | 62597936 | 62597957 | 62597941 | 62597936 | - |
| SEQ ID NO 5252 | TTCTTCTAGGAGGCTTTCAAGT | TTT | chr1 | 62597935 | 62597956 | 62597940 | 62597935 | - |
| SEQ ID NO 5253 | TCTTCTAGGAGGCTTTCAAGTT | TTT | chr1 | 62597934 | 62597955 | 62597939 | 62597934 | - |
| SEQ ID NO 5254 | CTTCTAGGAGGCTTTCAAGTTT | TTT | chr1 | 62597933 | 62597954 | 62597938 | 62597933 | - |
| SEQ ID NO 5255 | TTCTAGGAGGCTTTCAAGTTTT | TTC | chr1 | 62597932 | 62597953 | 62597937 | 62597932 | - |
| SEQ ID NO 5256 | CTAGGAGGCTTTCAAGTTTTGA | CTT | chr1 | 62597930 | 62597951 | 62597935 | 62597930 | - |
| SEQ ID NO 5257 | TAGGAGGCTTTCAAGTTTTGAG | TTC | chr1 | 62597929 | 62597950 | 62597934 | 62597929 | - |
| SEQ ID NO 5258 | GGAGGCTTTCAAGTTTTGAGTT | CTA | chr1 | 62597927 | 62597948 | 62597932 | 62597927 | - |
| SEQ ID NO 5259 | TCAAGTTTTGAGTTGAGTTCAA | CTT | chr1 | 62597919 | 62597940 | 62597924 | 62597919 | - |
| SEQ ID NO 5260 | CAAGTTTTGAGTTGAGTTCAAG | TTT | chr1 | 62597918 | 62597939 | 62597923 | 62597918 | - |
| SEQ ID NO 5261 | AAGTTTTGAGTTGAGTTCAAGT | TTC | chr1 | 62597917 | 62597938 | 62597922 | 62597917 | - |
| SEQ ID NO 5262 | TGAGTTGAGTTCAAGTGACATA | TTT | chr1 | 62597911 | 62597932 | 62597916 | 62597911 | - |
| SEQ ID NO 5263 | GAGTTGAGTTCAAGTGACATAT | TTT | chr1 | 62597910 | 62597931 | 62597915 | 62597910 | - |
| SEQ ID NO 5264 | AGTTGAGTTCAAGTGACATATT | TTG | chr1 | 62597909 | 62597930 | 62597914 | 62597909 | - |
| SEQ ID NO 5265 | AGTTCAAGTGACATATTCTTTA | TTG | chr1 | 62597904 | 62597925 | 62597909 | 62597904 | - |
| SEQ ID NO 5266 | AAGTGACATATTCTTTACCTCT | TTC | chr1 | 62597899 | 62597920 | 62597904 | 62597899 | - |
| SEQ ID NO 5267 | TTTACCTCTTCATTTTTGACTT | TTC | chr1 | 62597886 | 62597907 | 62597891 | 62597886 | - |
| SEQ ID NO 5268 | TACCTCTTCATTTTTGACTTGT | CTT | chr1 | 62597884 | 62597905 | 62597889 | 62597884 | - |
| SEQ ID NO 5269 | ACCTCTTCATTTTTGACTTGTA | TTT | chr1 | 62597883 | 62597904 | 62597888 | 62597883 | - |
| SEQ ID NO 5270 | CCTCTTCATTTTTGACTTGTAG | TTA | chr1 | 62597882 | 62597903 | 62597887 | 62597882 | - |
| SEQ ID NO 5271 | TTCATTTTTGACTTGTAGTTTA | CTC | chr1 | 62597878 | 62597899 | 62597883 | 62597878 | - |
| SEQ ID NO 5272 | CATTTTTGACTTGTAGTTTATA | CTT | chr1 | 62597876 | 62597897 | 62597881 | 62597876 | - |
| SEQ ID NO 5273 | ATTTTTGACTTGTAGTTTATAT | TTC | chr1 | 62597875 | 62597896 | 62597880 | 62597875 | - |
| SEQ ID NO 5274 | TTGACTTGTAGTTTATATGTAG | TTT | chr1 | 62597871 | 62597892 | 62597876 | 62597871 | - |
| SEQ ID NO 5275 | TGACTTGTAGTTTATATGTAGT | TTT | chr1 | 62597870 | 62597891 | 62597875 | 62597870 | - |
| SEQ ID NO 5276 | GACTTGTAGTTTATATGTAGTT | TTT | chr1 | 62597869 | 62597890 | 62597874 | 62597869 | - |
| SEQ ID NO 5277 | ACTTGTAGTTTATATGTAGTTC | TTG | chr1 | 62597868 | 62597889 | 62597873 | 62597868 | - |
| SEQ ID NO 5278 | GTAGTTTATATGTAGTTCTTCT | CTT | chr1 | 62597864 | 62597885 | 62597869 | 62597864 | - |

Figure 18 (Cont'd)

| SEQ ID NO 5279 | TAGTTTATATGTAGTTCTTCTC | TTG | chr1 | 62597863 | 62597884 | 62597868 | 62597863 | - |
|---|---|---|---|---|---|---|---|---|
| SEQ ID NO 5280 | ATATGTAGTTCTTCTCAGTTCC | TTT | chr1 | 62597857 | 62597878 | 62597862 | 62597857 | - |
| SEQ ID NO 5281 | TATGTAGTTCTTCTCAGTTCCT | TTA | chr1 | 62597856 | 62597877 | 62597861 | 62597856 | - |
| SEQ ID NO 5282 | TTCTCAGTTCCTTTTCTTCTTC | TTC | chr1 | 62597846 | 62597867 | 62597851 | 62597846 | - |
| SEQ ID NO 5283 | CTCAGTTCCTTTTCTTCTTCTT | CTT | chr1 | 62597844 | 62597865 | 62597849 | 62597844 | - |
| SEQ ID NO 5284 | TCAGTTCCTTTTCTTCTTCTTT | TTC | chr1 | 62597843 | 62597864 | 62597848 | 62597843 | - |
| SEQ ID NO 5285 | AGTTCCTTTTCTTCTTCTTTGA | CTC | chr1 | 62597841 | 62597862 | 62597846 | 62597841 | - |
| SEQ ID NO 5286 | CTTTTCTTCTTCTTTGATTTCA | TTC | chr1 | 62597836 | 62597857 | 62597841 | 62597836 | - |
| SEQ ID NO 5287 | TTCTTCTTCTTTGATTTCACTG | CTT | chr1 | 62597833 | 62597854 | 62597838 | 62597833 | - |
| SEQ ID NO 5288 | TCTTCTTCTTTGATTTCACTGG | TTT | chr1 | 62597832 | 62597853 | 62597837 | 62597832 | - |
| SEQ ID NO 5289 | CTTCTTCTTTGATTTCACTGGT | TTT | chr1 | 62597831 | 62597852 | 62597836 | 62597831 | - |
| SEQ ID NO 5290 | TTCTTCTTTGATTTCACTGGTT | TTC | chr1 | 62597830 | 62597851 | 62597835 | 62597830 | - |
| SEQ ID NO 5291 | CTTCTTTGATTTCACTGGTTTG | CTT | chr1 | 62597828 | 62597849 | 62597833 | 62597828 | - |
| SEQ ID NO 5292 | TTCTTTGATTTCACTGGTTTGC | TTC | chr1 | 62597827 | 62597848 | 62597832 | 62597827 | - |
| SEQ ID NO 5293 | CTTTGATTTCACTGGTTTGCAG | CTT | chr1 | 62597825 | 62597846 | 62597830 | 62597825 | - |
| SEQ ID NO 5294 | TTTGATTTCACTGGTTTGCAGC | TTC | chr1 | 62597824 | 62597845 | 62597829 | 62597824 | - |
| SEQ ID NO 5295 | TGATTTCACTGGTTTGCAGCGA | CTT | chr1 | 62597822 | 62597843 | 62597827 | 62597822 | - |
| SEQ ID NO 5296 | GATTTCACTGGTTTGCAGCGAT | TTT | chr1 | 62597821 | 62597842 | 62597826 | 62597821 | - |
| SEQ ID NO 5297 | ATTTCACTGGTTTGCAGCGATA | TTG | chr1 | 62597820 | 62597841 | 62597825 | 62597820 | - |
| SEQ ID NO 5298 | CACTGGTTTGCAGCGATAGATC | TTT | chr1 | 62597816 | 62597837 | 62597821 | 62597816 | - |
| SEQ ID NO 5299 | ACTGGTTTGCAGCGATAGATCA | TTC | chr1 | 62597815 | 62597836 | 62597820 | 62597815 | - |
| SEQ ID NO 5300 | GTTTGCAGCGATAGATCATAAA | CTG | chr1 | 62597811 | 62597832 | 62597816 | 62597811 | - |
| SEQ ID NO 5301 | GCAGCGATAGATCATAAAAGA | TTT | chr1 | 62597807 | 62597828 | 62597812 | 62597807 | - |
| SEQ ID NO 5302 | CAGCGATAGATCATAAAAGAC | TTG | chr1 | 62597806 | 62597827 | 62597811 | 62597806 | - |
| SEQ ID NO 5303 | ATCAAATATGTTGAGTTTTTGA | CTG | chr1 | 62597782 | 62597803 | 62597787 | 62597782 | - |
| SEQ ID NO 5304 | AGTTTTTGAAATATGTCATTAA | TTG | chr1 | 62597769 | 62597790 | 62597774 | 62597769 | - |
| SEQ ID NO 5305 | TTGAAATATGTCATTAATTTGG | TTT | chr1 | 62597764 | 62597785 | 62597769 | 62597764 | - |
| SEQ ID NO 5306 | TGAAATATGTCATTAATTTGGC | TTT | chr1 | 62597763 | 62597784 | 62597768 | 62597763 | - |
| SEQ ID NO 5307 | GAAATATGTCATTAATTTGGCC | TTT | chr1 | 62597762 | 62597783 | 62597767 | 62597762 | - |
| SEQ ID NO 5308 | AAATATGTCATTAATTTGGCCC | TTG | chr1 | 62597761 | 62597782 | 62597766 | 62597761 | - |
| SEQ ID NO 5309 | ATTTGGCCCTTCGTCTTATGGA | TTA | chr1 | 62597748 | 62597769 | 62597753 | 62597748 | - |
| SEQ ID NO 5310 | GGCCCTTCGTCTTATGGACAAA | TTT | chr1 | 62597744 | 62597765 | 62597749 | 62597744 | - |
| SEQ ID NO 5311 | GCCCTTCGTCTTATGGACAAAG | TTG | chr1 | 62597743 | 62597764 | 62597748 | 62597743 | - |
| SEQ ID NO 5312 | CGTCTTATGGACAAAGTCTTTA | CTT | chr1 | 62597737 | 62597758 | 62597742 | 62597737 | - |
| SEQ ID NO 5313 | GTCTTATGGACAAAGTCTTTAA | TTC | chr1 | 62597736 | 62597757 | 62597741 | 62597736 | - |
| SEQ ID NO 5314 | ATGGACAAAGTCTTTAAGACCA | CTT | chr1 | 62597731 | 62597752 | 62597736 | 62597731 | - |
| SEQ ID NO 5315 | TGGACAAAGTCTTTAAGACCAT | TTA | chr1 | 62597730 | 62597751 | 62597735 | 62597730 | - |
| SEQ ID NO 5316 | TAAGACCATGTCCCAACTGAAG | CTT | chr1 | 62597717 | 62597738 | 62597722 | 62597717 | - |
| SEQ ID NO 5317 | AAGACCATGTCCCAACTGAAGG | TTT | chr1 | 62597716 | 62597737 | 62597721 | 62597716 | - |
| SEQ ID NO 5318 | AGACCATGTCCCAACTGAAGGA | TTA | chr1 | 62597715 | 62597736 | 62597720 | 62597715 | - |
| SEQ ID NO 5319 | AAGGAGGCCATTGGCTAAAATT | CTG | chr1 | 62597698 | 62597719 | 62597703 | 62597698 | - |
| SEQ ID NO 5320 | GCTAAAATTTTTACATCGTCTA | TTG | chr1 | 62597685 | 62597706 | 62597690 | 62597685 | - |
| SEQ ID NO 5321 | AAATTTTTACATCGTCTAACAT | CTA | chr1 | 62597681 | 62597702 | 62597686 | 62597681 | - |
| SEQ ID NO 5322 | TTACATCGTCTAACATAGCAAA | TTT | chr1 | 62597675 | 62597696 | 62597680 | 62597675 | - |
| SEQ ID NO 5323 | TACATCGTCTAACATAGCAAAT | TTT | chr1 | 62597674 | 62597695 | 62597679 | 62597674 | - |
| SEQ ID NO 5324 | ACATCGTCTAACATAGCAAATC | TTT | chr1 | 62597673 | 62597694 | 62597678 | 62597673 | - |
| SEQ ID NO 5325 | CATCGTCTAACATAGCAAATCT | TTA | chr1 | 62597672 | 62597693 | 62597677 | 62597672 | - |
| SEQ ID NO 5326 | ACATAGCAAATCTTGATTTTGG | CTA | chr1 | 62597663 | 62597684 | 62597668 | 62597663 | - |
| SEQ ID NO 5327 | GATTTTGGCTCTGGAGATAGAG | CTT | chr1 | 62597649 | 62597670 | 62597654 | 62597649 | - |
| SEQ ID NO 5328 | ATTTTGGCTCTGGAGATAGAGA | TTG | chr1 | 62597648 | 62597669 | 62597653 | 62597648 | - |
| SEQ ID NO 5329 | TGGCTCTGGAGATAGAGAATCA | TTT | chr1 | 62597644 | 62597665 | 62597649 | 62597644 | - |
| SEQ ID NO 5330 | GGCTCTGGAGATAGAGAATCAA | TTT | chr1 | 62597643 | 62597664 | 62597648 | 62597643 | - |
| SEQ ID NO 5331 | GCTCTGGAGATAGAGAATCAAT | TTG | chr1 | 62597642 | 62597663 | 62597647 | 62597642 | - |
| SEQ ID NO 5332 | TGGAGATAGAGAATCAAATGAT | CTC | chr1 | 62597638 | 62597659 | 62597643 | 62597638 | - |
| SEQ ID NO 5333 | GAGATAGAGAATCAAATGATGA | CTG | chr1 | 62597636 | 62597657 | 62597641 | 62597636 | - |
| SEQ ID NO 5334 | TCTTGATCAATTCTGGAGGAAA | TTG | chr1 | 62597610 | 62597631 | 62597615 | 62597610 | - |
| SEQ ID NO 5335 | GATCAATTCTGGAGGAAATAAC | CTT | chr1 | 62597606 | 62597627 | 62597611 | 62597606 | - |
| SEQ ID NO 5336 | ATCAATTCTGGAGGAAATAACT | TTG | chr1 | 62597605 | 62597626 | 62597610 | 62597605 | - |

Figure 18 (Cont'd)

| | | | | | | | | |
|---|---|---|---|---|---|---|---|---|
| SEQ ID NO 5337 | TGGAGGAAATAACTAGAGGAAC | TTC | chr1 | 62597597 | 62597618 | 62597602 | 62597597 | - |
| SEQ ID NO 5338 | GAGGAAATAACTAGAGGAACAA | CTG | chr1 | 62597595 | 62597616 | 62597600 | 62597595 | - |
| SEQ ID NO 5339 | GAGGAACAATAAAAAGAAGGAG | CTA | chr1 | 62597582 | 62597603 | 62597587 | 62597582 | - |
| SEQ ID NO 5340 | AATTGTGAACATTTTTATCTTG | CTT | chr1 | 62597557 | 62597578 | 62597562 | 62597557 | - |
| SEQ ID NO 5341 | ATTGTGAACATTTTTATCTTGA | TTA | chr1 | 62597556 | 62597577 | 62597561 | 62597556 | - |
| SEQ ID NO 5342 | TGAACATTTTTATCTTGATTTT | TTG | chr1 | 62597552 | 62597573 | 62597557 | 62597552 | - |
| SEQ ID NO 5343 | TTATCTTGATTTTCAATTTCAA | TTT | chr1 | 62597543 | 62597564 | 62597548 | 62597543 | - |
| SEQ ID NO 5344 | TATCTTGATTTTCAATTTCAAG | TTT | chr1 | 62597542 | 62597563 | 62597547 | 62597542 | - |
| SEQ ID NO 5345 | ATCTTGATTTTCAATTTCAAGC | TTT | chr1 | 62597541 | 62597562 | 62597546 | 62597541 | - |
| SEQ ID NO 5346 | TCTTGATTTTCAATTTCAAGCA | TTA | chr1 | 62597540 | 62597561 | 62597545 | 62597540 | - |
| SEQ ID NO 5347 | GATTTTCAATTTCAAGCAACGT | CTT | chr1 | 62597536 | 62597557 | 62597541 | 62597536 | - |
| SEQ ID NO 5348 | ATTTTCAATTTCAAGCAACGTG | TTG | chr1 | 62597535 | 62597556 | 62597540 | 62597535 | - |
| SEQ ID NO 5349 | TCAATTTCAAGCAACGTGGAAC | TTT | chr1 | 62597531 | 62597552 | 62597536 | 62597531 | - |
| SEQ ID NO 5350 | CAATTTCAAGCAACGTGGAACT | TTT | chr1 | 62597530 | 62597551 | 62597535 | 62597530 | - |
| SEQ ID NO 5351 | AATTTCAAGCAACGTGGAACTG | TTC | chr1 | 62597529 | 62597550 | 62597534 | 62597529 | - |
| SEQ ID NO 5352 | CAAGCAACGTGGAACTGTTTTC | TTT | chr1 | 62597524 | 62597545 | 62597529 | 62597524 | - |
| SEQ ID NO 5353 | AAGCAACGTGGAACTGTTTTCT | TTC | chr1 | 62597523 | 62597544 | 62597528 | 62597523 | - |
| SEQ ID NO 5354 | TTTTCTTCTGGAAGCAGACCTA | CTG | chr1 | 62597507 | 62597528 | 62597512 | 62597507 | - |
| SEQ ID NO 5355 | TCTTCTGGAAGCAGACCTAGAC | TTT | chr1 | 62597504 | 62597525 | 62597509 | 62597504 | -- |
| SEQ ID NO 5356 | CTTCTGGAAGCAGACCTAGACT | TTT | chr1 | 62597503 | 62597524 | 62597508 | 62597503 | - |
| SEQ ID NO 5357 | TTCTGGAAGCAGACCTAGACTT | TTC | chr1 | 62597502 | 62597523 | 62597507 | 62597502 | - |
| SEQ ID NO 5358 | CTGGAAGCAGACCTAGACTTCT | CTT | chr1 | 62597500 | 62597521 | 62597505 | 62597500 | - |
| SEQ ID NO 5359 | TGGAAGCAGACCTAGACTTCTT | TTC | chr1 | 62597499 | 62597520 | 62597504 | 62597499 | - |
| SEQ ID NO 5360 | GAAGCAGACCTAGACTTCTTAA | CTG | chr1 | 62597497 | 62597518 | 62597502 | 62597497 | - |
| SEQ ID NO 5361 | GACTTCTTAACTCTATATATAC | CTA | chr1 | 62597485 | 62597506 | 62597490 | 62597485 | - |
| SEQ ID NO 5362 | CTTAACTCTATATATACCAATA | CTT | chr1 | 62597480 | 62597501 | 62597485 | 62597480 | - |
| SEQ ID NO 5363 | TTAACTCTATATATACCAATAT | TTC | chr1 | 62597479 | 62597500 | 62597484 | 62597479 | - |
| SEQ ID NO 5364 | AACTCTATATATACCAATATTT | CTT | chr1 | 62597477 | 62597498 | 62597482 | 62597477 | - |
| SEQ ID NO 5365 | ACTCTATATATACCAATATTTG | TTA | chr1 | 62597476 | 62597497 | 62597481 | 62597476 | - |
| SEQ ID NO 5366 | TATATATACCAATATTTGCCCA | CTC | chr1 | 62597472 | 62597493 | 62597477 | 62597472 | - |
| SEQ ID NO 5367 | TATATACCAATATTTGCCCAGA | CTA | chr1 | 62597470 | 62597491 | 62597475 | 62597470 | - |
| SEQ ID NO 5368 | GCCCAGAAAAGGTAAGGTTGGT | TTT | chr1 | 62597455 | 62597476 | 62597460 | 62597455 | - |
| SEQ ID NO 5369 | CCCAGAAAAGGTAAGGTTGGTA | TTG | chr1 | 62597454 | 62597475 | 62597459 | 62597454 | - |
| SEQ ID NO 5370 | GTAGGTGAACATAGTTAATCAT | TTG | chr1 | 62597435 | 62597456 | 62597440 | 62597435 | - |
| SEQ ID NO 5371 | ATCATTAAGCCGTGTTAACTTG | TTA | chr1 | 62597418 | 62597439 | 62597423 | 62597418 | - |
| SEQ ID NO 5372 | AGCCGTGTTAACTTGCACGAAT | TTA | chr1 | 62597411 | 62597432 | 62597416 | 62597411 | - |
| SEQ ID NO 5373 | ACTTGCACGAATGTAACCTTCT | TTA | chr1 | 62597401 | 62597422 | 62597406 | 62597401 | - |
| SEQ ID NO 5374 | GCACGAATGTAACCTTCTTCCA | CTT | chr1 | 62597397 | 62597418 | 62597402 | 62597397 | - |
| SEQ ID NO 5375 | CACGAATGTAACCTTCTTCCAC | TTG | chr1 | 62597396 | 62597417 | 62597401 | 62597396 | -- |
| SEQ ID NO 5376 | CTTCCACATTGAGTTAGATCAA | CTT | chr1 | 62597381 | 62597402 | 62597386 | 62597381 | - |
| SEQ ID NO 5377 | TTCCACATTGAGTTAGATCAAT | TTC | chr1 | 62597380 | 62597401 | 62597385 | 62597380 | - |
| SEQ ID NO 5378 | CCACATTGAGTTAGATCAATGC | CTT | chr1 | 62597378 | 62597399 | 62597383 | 62597378 | - |
| SEQ ID NO 5379 | CACATTGAGTTAGATCAATGCT | TTC | chr1 | 62597377 | 62597398 | 62597382 | 62597377 | -- |
| SEQ ID NO 5380 | AGTTAGATCAATGCTAAATGAA | TTG | chr1 | 62597370 | 62597391 | 62597375 | 62597370 | - |
| SEQ ID NO 5381 | GATCAATGCTAAATGAAATCAA | TTA | chr1 | 62597365 | 62597386 | 62597370 | 62597365 | - |
| SEQ ID NO 5382 | AATGAATCAAAGAAATGAGCA | CTA | chr1 | 62597354 | 62597375 | 62597359 | 62597354 | - |
| SEQ ID NO 5383 | ACTTAATAGGTAATTTGAAATT | CTA | chr1 | 62597328 | 62597349 | 62597333 | 62597328 | - |
| SEQ ID NO 5384 | AATAGGTAATTTGAAATTGTAT | CTT | chr1 | 62597324 | 62597345 | 62597329 | 62597324 | - |
| SEQ ID NO 5385 | ATAGGTAATTTGAAATTGTATT | TTA | chr1 | 62597323 | 62597344 | 62597328 | 62597323 | - |
| SEQ ID NO 5386 | GAAATTGTATTTAACTTGCTG | TTT | chr1 | 62597312 | 62597333 | 62597317 | 62597312 | - |
| SEQ ID NO 5387 | AAATTGTATTTAACTTTGCTGT | TTG | chr1 | 62597311 | 62597332 | 62597316 | 62597311 | - |
| SEQ ID NO 5388 | TATTTAACTTTGCTGTATTATA | TTG | chr1 | 62597305 | 62597326 | 62597310 | 62597305 | - |
| SEQ ID NO 5389 | AACTTTGCTGTATTATAAACTA | TTT | chr1 | 62597300 | 62597321 | 62597305 | 62597300 | - |
| SEQ ID NO 5390 | ACTTTGCTGTATTATAAACTAC | TTA | chr1 | 62597299 | 62597320 | 62597304 | 62597299 | - |
| SEQ ID NO 5391 | TGCTGTATTATAAACTACACAT | CTT | chr1 | 62597295 | 62597316 | 62597300 | 62597295 | - |
| SEQ ID NO 5392 | GCTGTATTATAAACTACACATT | TTT | chr1 | 62597294 | 62597315 | 62597299 | 62597294 | - |
| SEQ ID NO 5393 | CTGTATTATAAACTACACATTC | TTG | chr1 | 62597293 | 62597314 | 62597298 | 62597293 | - |
| SEQ ID NO 5394 | TATTATAAACTACACATTCAAT | CTG | chr1 | 62597290 | 62597311 | 62597295 | 62597290 | - |

Figure 18 (Cont'd)

| | | | | | | | | |
|---|---|---|---|---|---|---|---|---|
| SEQ ID NO 5395 | TAAACTACACATTCAATGCTAT | TTA | chr1 | 62597285 | 62597306 | 62597290 | 62597285 | - |
| SEQ ID NO 5396 | CACATTCAATGCTATGGTGACT | CTA | chr1 | 62597278 | 62597299 | 62597283 | 62597278 | - |
| SEQ ID NO 5397 | AATGCTATGGTGACTACCTGTT | TTC | chr1 | 62597271 | 62597292 | 62597276 | 62597271 | - |
| SEQ ID NO 5398 | TGGTGACTACCTGTTTTTAAAA | CTA | chr1 | 62597264 | 62597285 | 62597269 | 62597264 | - |
| SEQ ID NO 5399 | CCTGTTTTTAAAAGCTAATTTT | CTA | chr1 | 62597255 | 62597276 | 62597260 | 62597255 | - |
| SEQ ID NO 5400 | TTTTTAAAAGCTAATTTTACTT | CTG | chr1 | 62597251 | 62597272 | 62597256 | 62597251 | - |
| SEQ ID NO 5401 | TTAAAAGCTAATTTTACTTTTT | TTT | chr1 | 62597248 | 62597269 | 62597253 | 62597248 | - |
| SEQ ID NO 5402 | TAAAAGCTAATTTTACTTTTTT | TTT | chr1 | 62597247 | 62597268 | 62597252 | 62597247 | - |
| SEQ ID NO 5403 | AAAAGCTAATTTTACTTTTTTA | TTT | chr1 | 62597246 | 62597267 | 62597251 | 62597246 | - |
| SEQ ID NO 5404 | AAAGCTAATTTTACTTTTTTAT | TTA | chr1 | 62597245 | 62597266 | 62597250 | 62597245 | - |
| SEQ ID NO 5405 | ATTTTACTTTTTTATGATTTTA | CTA | chr1 | 62597238 | 62597259 | 62597243 | 62597238 | - |
| SEQ ID NO 5406 | TACTTTTTTATGATTTTAAGAG | TTT | chr1 | 62597234 | 62597255 | 62597239 | 62597234 | - |
| SEQ ID NO 5407 | ACTTTTTTATGATTTTAAGAGA | TTT | chr1 | 62597233 | 62597254 | 62597238 | 62597233 | - |
| SEQ ID NO 5408 | CTTTTTTATGATTTTAAGAGAT | TTA | chr1 | 62597232 | 62597253 | 62597237 | 62597232 | - |
| SEQ ID NO 5409 | TTTTATGATTTTAAGAGATTTA | CTT | chr1 | 62597229 | 62597250 | 62597234 | 62597229 | - |
| SEQ ID NO 5410 | TTTATGATTTTAAGAGATTTAC | TTT | chr1 | 62597228 | 62597249 | 62597233 | 62597228 | - |
| SEQ ID NO 5411 | TTATGATTTTAAGAGATTTACA | TTT | chr1 | 62597227 | 62597248 | 62597232 | 62597227 | - |
| SEQ ID NO 5412 | TATGATTTTAAGAGATTTACAA | TTT | chr1 | 62597226 | 62597247 | 62597231 | 62597226 | - |
| SEQ ID NO 5413 | ATGATTTTAAGAGATTTACAAG | TTT | chr1 | 62597225 | 62597246 | 62597230 | 62597225 | - |
| SEQ ID NO 5414 | TGATTTTAAGAGATTTACAAGT | TTA | chr1 | 62597224 | 62597245 | 62597229 | 62597224 | - |
| SEQ ID NO 5415 | TAAGAGATTTACAAGTCAAAAA | TTT | chr1 | 62597218 | 62597239 | 62597223 | 62597218 | - |
| SEQ ID NO 5416 | AAGAGATTTACAAGTCAAAAAT | TTT | chr1 | 62597217 | 62597238 | 62597222 | 62597217 | - |
| SEQ ID NO 5417 | AGAGATTTACAAGTCAAAAATA | TTA | chr1 | 62597216 | 62597237 | 62597221 | 62597216 | - |
| SEQ ID NO 5418 | ACAAGTCAAAAATAAACTTTTT | TTT | chr1 | 62597208 | 62597229 | 62597213 | 62597208 | - |
| SEQ ID NO 5419 | CAAGTCAAAAATAAACTTTTTT | TTA | chr1 | 62597207 | 62597228 | 62597212 | 62597207 | - |
| SEQ ID NO 5420 | TTTTGTTGGGTAAATTTATTAT | CTT | chr1 | 62597189 | 62597210 | 62597194 | 62597189 | - |
| SEQ ID NO 5421 | TTTGTTGGGTAAATTTATTATT | TTT | chr1 | 62597188 | 62597209 | 62597193 | 62597188 | - |
| SEQ ID NO 5422 | TTGTTGGGTAAATTTATTATTA | TTT | chr1 | 62597187 | 62597208 | 62597192 | 62597187 | - |
| SEQ ID NO 5423 | TGTTGGGTAAATTTATTATTAA | TTT | chr1 | 62597186 | 62597207 | 62597191 | 62597186 | - |
| SEQ ID NO 5424 | GTTGGGTAAATTTATTATTAAA | TTT | chr1 | 62597185 | 62597206 | 62597190 | 62597185 | - |
| SEQ ID NO 5425 | TTGGGTAAATTTATTATTAAAG | TTG | chr1 | 62597184 | 62597205 | 62597189 | 62597184 | - |
| SEQ ID NO 5426 | GGTAAATTTATTATTAAAGTTG | TTG | chr1 | 62597181 | 62597202 | 62597186 | 62597181 | - |
| SEQ ID NO 5427 | ATTATTAAAGTTGAGGGGAAAA | TTT | chr1 | 62597172 | 62597193 | 62597177 | 62597172 | - |
| SEQ ID NO 5428 | TTATTAAAGTTGAGGGGAAAAA | TTA | chr1 | 62597171 | 62597192 | 62597176 | 62597171 | - |
| SEQ ID NO 5429 | TTAAAGTTGAGGGGAAAAAGT | TTA | chr1 | 62597168 | 62597189 | 62597173 | 62597168 | - |
| SEQ ID NO 5430 | AAGTTGAGGGGAAAAAGTAAT | TTA | chr1 | 62597165 | 62597186 | 62597170 | 62597165 | - |
| SEQ ID NO 5431 | AGGGGAAAAAGTAATGAATTA | TTG | chr1 | 62597159 | 62597180 | 62597164 | 62597159 | - |

Figure 19

| # | Sequence | PAM | Chr | Start | End | Cuts 5' of | Str |
|---|---|---|---|---|---|---|---|
| SEQ ID NO 5432 | TCCCGCCCGCTTGCTGCATC | TGG | chr11 | 116829764 | 116829783 | 116829780 | + |
| SEQ ID NO 5433 | TGCATCTGGACACCCTGCCT | CAG | chr11 | 116829778 | 116829797 | 116829794 | + |
| SEQ ID NO 5434 | GCATCTGGACACCCTGCCTC | AGG | chr11 | 116829779 | 116829798 | 116829795 | + |
| SEQ ID NO 5435 | CCTCAGGCCCTCATCTCCAC | TGG | chr11 | 116829795 | 116829814 | 116829811 | + |
| SEQ ID NO 5436 | AGGCCCTCATCTCCACTGGT | CAG | chr11 | 116829799 | 116829818 | 116829815 | + |
| SEQ ID NO 5437 | CCCTCATCTCCACTGGTCAG | CAG | chr11 | 116829802 | 116829821 | 116829818 | + |
| SEQ ID NO 5438 | CCTCATCTCCACTGGTCAGC | AGG | chr11 | 116829803 | 116829822 | 116829819 | + |
| SEQ ID NO 5439 | GTCAGCAGGTGACCTTTGCC | CAG | chr11 | 116829817 | 116829836 | 116829833 | + |
| SEQ ID NO 5440 | GTGACCTTTGCCCAGCGCCC | TGG | chr11 | 116829825 | 116829844 | 116829841 | + |
| SEQ ID NO 5441 | TGACCTTTGCCCAGCGCCCT | GGG | chr11 | 116829826 | 116829845 | 116829842 | + |
| SEQ ID NO 5442 | TGCCCAGCGCCCTGGGTCCT | CAG | chr11 | 116829833 | 116829852 | 116829849 | + |
| SEQ ID NO 5443 | GTCCTCAGTGCCTGCTGCCC | TGG | chr11 | 116829848 | 116829867 | 116829864 | + |
| SEQ ID NO 5444 | CCTCAGTGCCTGCTGCCCTG | GAG | chr11 | 116829850 | 116829869 | 116829866 | + |
| SEQ ID NO 5445 | GCCCTGGAGATGATATAAAA | CAG | chr11 | 116829864 | 116829883 | 116829880 | + |
| SEQ ID NO 5446 | CCCTGGAGATGATATAAAAC | AGG | chr11 | 116829865 | 116829884 | 116829881 | + |
| SEQ ID NO 5447 | GGAGATGATATAAAACAGGT | CAG | chr11 | 116829869 | 116829888 | 116829885 | + |
| SEQ ID NO 5448 | AACCCTCCTGCCTGTCTGCT | CAG | chr11 | 116829892 | 116829911 | 116829908 | + |
| SEQ ID NO 5449 | CTGTCTGCTCAGTTCATCCC | TAG | chr11 | 116829903 | 116829922 | 116829919 | + |
| SEQ ID NO 5450 | GTCTGCTCAGTTCATCCCTA | GAG | chr11 | 116829905 | 116829924 | 116829921 | + |
| SEQ ID NO 5451 | TCTGCTCAGTTCATCCCTAG | AGG | chr11 | 116829906 | 116829925 | 116829922 | + |
| SEQ ID NO 5452 | GCTCAGTTCATCCCTAGAGG | CAG | chr11 | 116829909 | 116829928 | 116829925 | + |
| SEQ ID NO 5453 | ATCCCTAGAGGCAGCTGCTC | CAG | chr11 | 116829918 | 116829937 | 116829934 | + |
| SEQ ID NO 5454 | TCCCTAGAGGCAGCTGCTCC | AGG | chr11 | 116829919 | 116829938 | 116829935 | + |
| SEQ ID NO 5455 | CTGCTCCAGGTAATGCCCTC | TGG | chr11 | 116829932 | 116829951 | 116829948 | + |
| SEQ ID NO 5456 | TGCTCCAGGTAATGCCCTCT | GGG | chr11 | 116829933 | 116829952 | 116829949 | + |
| SEQ ID NO 5457 | GCTCCAGGTAATGCCCTCTG | GGG | chr11 | 116829934 | 116829953 | 116829950 | + |
| SEQ ID NO 5458 | TCCAGGTAATGCCCTCTGGG | GAG | chr11 | 116829936 | 116829955 | 116829952 | + |
| SEQ ID NO 5459 | CCAGGTAATGCCCTCTGGGG | AGG | chr11 | 116829937 | 116829956 | 116829953 | + |
| SEQ ID NO 5460 | CAGGTAATGCCCTCTGGGGA | GGG | chr11 | 116829938 | 116829957 | 116829954 | + |
| SEQ ID NO 5461 | AGGTAATGCCCTCTGGGGAG | GGG | chr11 | 116829939 | 116829958 | 116829955 | + |
| SEQ ID NO 5462 | AATGCCCTCTGGGGAGGGGA | AAG | chr11 | 116829943 | 116829962 | 116829959 | + |
| SEQ ID NO 5463 | TGCCCTCTGGGGAGGGGAAA | GAG | chr11 | 116829945 | 116829964 | 116829961 | + |
| SEQ ID NO 5464 | GCCCTCTGGGGAGGGGAAAG | AGG | chr11 | 116829946 | 116829965 | 116829962 | + |
| SEQ ID NO 5465 | CCTCTGGGGAGGGGAAAGAG | GAG | chr11 | 116829948 | 116829967 | 116829964 | + |
| SEQ ID NO 5466 | CTCTGGGGAGGGGAAAGAGG | AGG | chr11 | 116829949 | 116829968 | 116829965 | + |
| SEQ ID NO 5467 | TCTGGGGAGGGGAAAGAGGA | GGG | chr11 | 116829950 | 116829969 | 116829966 | + |
| SEQ ID NO 5468 | CTGGGGAGGGGAAAGAGGAG | GGG | chr11 | 116829951 | 116829970 | 116829967 | + |
| SEQ ID NO 5469 | GGGGAGGGGAAAGAGGAGGG | GAG | chr11 | 116829953 | 116829972 | 116829969 | + |
| SEQ ID NO 5470 | GGGAGGGGAAAGAGGAGGGG | AGG | chr11 | 116829954 | 116829973 | 116829970 | + |
| SEQ ID NO 5471 | GAGGGGAAAGAGGAGGGGAG | GAG | chr11 | 116829956 | 116829975 | 116829972 | + |
| SEQ ID NO 5472 | AGGGGAAAGAGGAGGGGAGG | AGG | chr11 | 116829957 | 116829976 | 116829973 | + |
| SEQ ID NO 5473 | AAGAGGAGGGGAGGAGGATG | AAG | chr11 | 116829963 | 116829982 | 116829979 | + |
| SEQ ID NO 5474 | GAGGAGGGGAGGAGGATGAA | GAG | chr11 | 116829965 | 116829984 | 116829981 | + |
| SEQ ID NO 5475 | AGGAGGGGAGGAGGATGAAG | AGG | chr11 | 116829966 | 116829985 | 116829982 | + |
| SEQ ID NO 5476 | GGAGGGGAGGAGGATGAAGA | GGG | chr11 | 116829967 | 116829986 | 116829983 | + |
| SEQ ID NO 5477 | GAGGGGAGGAGGATGAAGAG | GGG | chr11 | 116829968 | 116829987 | 116829984 | + |
| SEQ ID NO 5478 | GGAGGAGGATGAAGAGGGGC | AAG | chr11 | 116829972 | 116829991 | 116829988 | + |
| SEQ ID NO 5479 | AGGAGGATGAAGAGGGGCAA | GAG | chr11 | 116829974 | 116829993 | 116829990 | + |

Figure 19 (Cont'd)

| | | | | | | | |
|---|---|---|---|---|---|---|---|
| SEQ ID NO 5480 | GGAGGATGAAGAGGGGCAAG | AGG | chr11 | 116829975 | 116829994 | 116829991 | + |
| SEQ ID NO 5481 | AGGATGAAGAGGGGCAAGAG | GAG | chr11 | 116829977 | 116829996 | 116829993 | + |
| SEQ ID NO 5482 | GGCAAGAGGAGCTCCCTGCC | CAG | chr11 | 116829989 | 116830008 | 116830005 | + |
| SEQ ID NO 5483 | GAGGAGCTCCCTGCCCAGCC | CAG | chr11 | 116829994 | 116830013 | 116830010 | + |
| SEQ ID NO 5484 | AGCTCCCTGCCCAGCCCAGC | CAG | chr11 | 116829998 | 116830017 | 116830014 | + |
| SEQ ID NO 5485 | CCCTGCCCAGCCCAGCCAGC | AAG | chr11 | 116830002 | 116830021 | 116830018 | + |
| SEQ ID NO 5486 | CCCAGCCCAGCCAGCAAGCC | TGG | chr11 | 116830007 | 116830026 | 116830023 | + |
| SEQ ID NO 5487 | CAGCCCAGCCAGCAAGCCTG | GAG | chr11 | 116830009 | 116830028 | 116830025 | + |
| SEQ ID NO 5488 | CCCAGCCAGCAAGCCTGGAG | AAG | chr11 | 116830012 | 116830031 | 116830028 | + |
| SEQ ID NO 5489 | AAGCCTGGAGAAGCACTTGC | TAG | chr11 | 116830022 | 116830041 | 116830038 | + |
| SEQ ID NO 5490 | GCCTGGAGAAGCACTTGCTA | GAG | chr11 | 116830024 | 116830043 | 116830040 | + |
| SEQ ID NO 5491 | GAGAAGCACTTGCTAGAGCT | AAG | chr11 | 116830029 | 116830048 | 116830045 | + |
| SEQ ID NO 5492 | AGAAGCACTTGCTAGAGCTA | AGG | chr11 | 116830030 | 116830049 | 116830046 | + |
| SEQ ID NO 5493 | AGCACTTGCTAGAGCTAAGG | AAG | chr11 | 116830033 | 116830052 | 116830049 | + |
| SEQ ID NO 5494 | TGCTAGAGCTAAGGAAGCCT | CGG | chr11 | 116830039 | 116830058 | 116830055 | + |
| SEQ ID NO 5495 | CTAGAGCTAAGGAAGCCTCG | GAG | chr11 | 116830041 | 116830060 | 116830057 | + |
| SEQ ID NO 5496 | AGCTAAGGAAGCCTCGGAGC | TGG | chr11 | 116830045 | 116830064 | 116830061 | + |
| SEQ ID NO 5497 | AAGGAAGCCTCGGAGCTGGA | CGG | chr11 | 116830049 | 116830068 | 116830065 | + |
| SEQ ID NO 5498 | AGGAAGCCTCGGAGCTGGAC | GGG | chr11 | 116830050 | 116830069 | 116830066 | + |
| SEQ ID NO 5499 | CCACCCCTCATCATAACCTG | AAG | chr11 | 116830079 | 116830098 | 116830095 | + |
| SEQ ID NO 5500 | TCATCATAACCTGAAGAACA | TGG | chr11 | 116830086 | 116830105 | 116830102 | + |
| SEQ ID NO 5501 | ATCATAACCTGAAGAACATG | GAG | chr11 | 116830088 | 116830107 | 116830104 | + |
| SEQ ID NO 5502 | TCATAACCTGAAGAACATGG | AGG | chr11 | 116830089 | 116830108 | 116830105 | + |
| SEQ ID NO 5503 | ACCTGAAGAACATGGAGGCC | CGG | chr11 | 116830094 | 116830113 | 116830110 | + |
| SEQ ID NO 5504 | CCTGAAGAACATGGAGGCCC | GGG | chr11 | 116830095 | 116830114 | 116830111 | + |
| SEQ ID NO 5505 | TGAAGAACATGGAGGCCCGG | GAG | chr11 | 116830097 | 116830116 | 116830113 | + |
| SEQ ID NO 5506 | GAAGAACATGGAGGCCCGGG | AGG | chr11 | 116830098 | 116830117 | 116830114 | + |
| SEQ ID NO 5507 | AAGAACATGGAGGCCCGGGA | GGG | chr11 | 116830099 | 116830118 | 116830115 | + |
| SEQ ID NO 5508 | AGAACATGGAGGCCCGGGAG | GGG | chr11 | 116830100 | 116830119 | 116830116 | + |
| SEQ ID NO 5509 | GGAGGGGTGTCACTTGCCCA | AAG | chr11 | 116830116 | 116830135 | 116830132 | + |
| SEQ ID NO 5510 | GTCACTTGCCCAAAGCTACA | CAG | chr11 | 116830124 | 116830143 | 116830140 | + |
| SEQ ID NO 5511 | TCACTTGCCCAAAGCTACAC | AGG | chr11 | 116830125 | 116830144 | 116830141 | + |
| SEQ ID NO 5512 | CACTTGCCCAAAGCTACACA | GGG | chr11 | 116830126 | 116830145 | 116830142 | + |
| SEQ ID NO 5513 | ACTTGCCCAAAGCTACACAG | GGG | chr11 | 116830127 | 116830146 | 116830143 | + |
| SEQ ID NO 5514 | CTTGCCCAAAGCTACACAGG | GGG | chr11 | 116830128 | 116830147 | 116830144 | + |
| SEQ ID NO 5515 | GCCCAAAGCTACACAGGGGG | TGG | chr11 | 116830131 | 116830150 | 116830147 | + |
| SEQ ID NO 5516 | CCCAAAGCTACACAGGGGGT | GGG | chr11 | 116830132 | 116830151 | 116830148 | + |
| SEQ ID NO 5517 | CCAAAGCTACACAGGGGGTG | GGG | chr11 | 116830133 | 116830152 | 116830149 | + |
| SEQ ID NO 5518 | AGCTACACAGGGGGTGGGGC | TGG | chr11 | 116830137 | 116830156 | 116830153 | + |
| SEQ ID NO 5519 | TACACAGGGGGTGGGGCTGG | AAG | chr11 | 116830140 | 116830159 | 116830156 | + |
| SEQ ID NO 5520 | ACAGGGGGTGGGGCTGGAAG | TGG | chr11 | 116830143 | 116830162 | 116830159 | + |
| SEQ ID NO 5521 | GTGGGGCTGGAAGTGGCTCC | AAG | chr11 | 116830150 | 116830169 | 116830166 | + |
| SEQ ID NO 5522 | GCTGGAAGTGGCTCCAAGTG | CAG | chr11 | 116830155 | 116830174 | 116830171 | + |
| SEQ ID NO 5523 | CTGGAAGTGGCTCCAAGTGC | AGG | chr11 | 116830156 | 116830175 | 116830172 | + |
| SEQ ID NO 5524 | CAGGTTCCCCCCTCATTCTT | CAG | chr11 | 116830175 | 116830194 | 116830191 | + |
| SEQ ID NO 5525 | AGGTTCCCCCCTCATTCTTC | AGG | chr11 | 116830176 | 116830195 | 116830192 | + |
| SEQ ID NO 5526 | CCCCCCTCATTCTTCAGGCT | TAG | chr11 | 116830181 | 116830200 | 116830197 | + |
| SEQ ID NO 5527 | CCCCCTCATTCTTCAGGCTT | AGG | chr11 | 116830182 | 116830201 | 116830198 | + |
| SEQ ID NO 5528 | CCCCTCATTCTTCAGGCTTA | GGG | chr11 | 116830183 | 116830202 | 116830199 | + |

Figure 19 (Cont'd)

| SEQ ID NO 5529 | TCATTCTTCAGGCTTAGGGC | TGG | chr11 | 116830187 | 116830206 | 116830203 | + |
| SEQ ID NO 5530 | ATTCTTCAGGCTTAGGGCTG | GAG | chr11 | 116830189 | 116830208 | 116830205 | + |
| SEQ ID NO 5531 | TTCTTCAGGCTTAGGGCTGG | AGG | chr11 | 116830190 | 116830209 | 116830206 | + |
| SEQ ID NO 5532 | TTCAGGCTTAGGGCTGGAGG | AAG | chr11 | 116830193 | 116830212 | 116830209 | + |
| SEQ ID NO 5533 | CTTAGGGCTGGAGGAAGCCT | TAG | chr11 | 116830199 | 116830218 | 116830215 | + |
| SEQ ID NO 5534 | GGGCTGGAGGAAGCCTTAGA | CAG | chr11 | 116830203 | 116830222 | 116830219 | + |
| SEQ ID NO 5535 | GGAGGAAGCCTTAGACAGCC | CAG | chr11 | 116830208 | 116830227 | 116830224 | + |
| SEQ ID NO 5536 | TAGACAGCCCAGTCCTACCC | CAG | chr11 | 116830219 | 116830238 | 116830235 | + |
| SEQ ID NO 5537 | CAGCCCAGTCCTACCCCAGA | CAG | chr11 | 116830223 | 116830242 | 116830239 | + |
| SEQ ID NO 5538 | AGCCCAGTCCTACCCCAGAC | AGG | chr11 | 116830224 | 116830243 | 116830240 | + |
| SEQ ID NO 5539 | GCCCAGTCCTACCCCAGACA | GGG | chr11 | 116830225 | 116830244 | 116830241 | + |
| SEQ ID NO 5540 | CTACCCCAGACAGGGAAACT | GAG | chr11 | 116830233 | 116830252 | 116830249 | + |
| SEQ ID NO 5541 | TACCCCAGACAGGGAAACTG | AGG | chr11 | 116830234 | 116830253 | 116830250 | + |
| SEQ ID NO 5542 | CAGACAGGGAAACTGAGGCC | TGG | chr11 | 116830239 | 116830258 | 116830255 | + |
| SEQ ID NO 5543 | GACAGGGAAACTGAGGCCTG | GAG | chr11 | 116830241 | 116830260 | 116830257 | + |
| SEQ ID NO 5544 | CAGGGAAACTGAGGCCTGGA | GAG | chr11 | 116830243 | 116830262 | 116830259 | + |
| SEQ ID NO 5545 | AGGGAAACTGAGGCCTGGAG | AGG | chr11 | 116830244 | 116830263 | 116830260 | + |
| SEQ ID NO 5546 | GGGAAACTGAGGCCTGGAGA | GGG | chr11 | 116830245 | 116830264 | 116830261 | + |
| SEQ ID NO 5547 | AACTGAGGCCTGGAGAGGGC | CAG | chr11 | 116830249 | 116830268 | 116830265 | + |
| SEQ ID NO 5548 | AGAGGGCCAGAAATCACCCA | AAG | chr11 | 116830262 | 116830281 | 116830278 | + |
| SEQ ID NO 5549 | AGAAATCACCCAAAGACACA | CAG | chr11 | 116830270 | 116830289 | 116830286 | + |
| SEQ ID NO 5550 | CCCAAAGACACACAGCATGT | TGG | chr11 | 116830278 | 116830297 | 116830294 | + |
| SEQ ID NO 5551 | AAGACACACAGCATGTTGGC | TGG | chr11 | 116830282 | 116830301 | 116830298 | + |
| SEQ ID NO 5552 | ACACAGCATGTTGGCTGGAC | TGG | chr11 | 116830287 | 116830306 | 116830303 | + |
| SEQ ID NO 5553 | AGCATGTTGGCTGGACTGGA | CGG | chr11 | 116830291 | 116830310 | 116830307 | + |
| SEQ ID NO 5554 | CATGTTGGCTGGACTGGACG | GAG | chr11 | 116830293 | 116830312 | 116830309 | + |
| SEQ ID NO 5555 | TGGCTGGACTGGACGGAGAT | CAG | chr11 | 116830298 | 116830317 | 116830314 | + |
| SEQ ID NO 5556 | GGACTGGACGGAGATCAGTC | CAG | chr11 | 116830303 | 116830322 | 116830319 | + |
| SEQ ID NO 5557 | ACGGAGATCAGTCCAGACCG | CAG | chr11 | 116830310 | 116830329 | 116830326 | + |
| SEQ ID NO 5558 | CGGAGATCAGTCCAGACCGC | AGG | chr11 | 116830311 | 116830330 | 116830327 | + |
| SEQ ID NO 5559 | ACCGCAGGTGCCTTGATGTT | CAG | chr11 | 116830326 | 116830345 | 116830342 | + |
| SEQ ID NO 5560 | AGGTGCCTTGATGTTCAGTC | TGG | chr11 | 116830331 | 116830350 | 116830347 | + |
| SEQ ID NO 5561 | TGCCTTGATGTTCAGTCTGG | TGG | chr11 | 116830334 | 116830353 | 116830350 | + |
| SEQ ID NO 5562 | GCCTTGATGTTCAGTCTGGT | GGG | chr11 | 116830335 | 116830354 | 116830351 | + |
| SEQ ID NO 5563 | CCATCCCACCCACCTCCCTT | TGG | chr11 | 116830367 | 116830386 | 116830383 | + |
| SEQ ID NO 5564 | CATCCCACCCACCTCCCTTT | GGG | chr11 | 116830368 | 116830387 | 116830384 | + |
| SEQ ID NO 5565 | CTCGATCCCTCGCCCCTCAC | CAG | chr11 | 116830392 | 116830411 | 116830408 | + |
| SEQ ID NO 5566 | CCCTCACCAGTCCCCCTTCT | GAG | chr11 | 116830405 | 116830424 | 116830421 | + |
| SEQ ID NO 5567 | CTCACCAGTCCCCCTTCTGA | GAG | chr11 | 116830407 | 116830426 | 116830423 | + |
| SEQ ID NO 5568 | CCCCTTCTGAGAGCCCGTAT | TAG | chr11 | 116830417 | 116830436 | 116830433 | + |
| SEQ ID NO 5569 | CTTCTGAGAGCCCGTATTAG | CAG | chr11 | 116830420 | 116830439 | 116830436 | + |
| SEQ ID NO 5570 | TTCTGAGAGCCCGTATTAGC | AGG | chr11 | 116830421 | 116830440 | 116830437 | + |
| SEQ ID NO 5571 | TCTGAGAGCCCGTATTAGCA | GGG | chr11 | 116830422 | 116830441 | 116830438 | + |
| SEQ ID NO 5572 | TGAGAGCCCGTATTAGCAGG | GAG | chr11 | 116830424 | 116830443 | 116830440 | + |
| SEQ ID NO 5573 | AGCCCGTATTAGCAGGGAGC | CGG | chr11 | 116830428 | 116830447 | 116830444 | + |
| SEQ ID NO 5574 | GAGCCGGCCCTACTCCTTC | TGG | chr11 | 116830444 | 116830463 | 116830460 | + |
| SEQ ID NO 5575 | CCGGCCCTACTCCTTCTGG | CAG | chr11 | 116830447 | 116830466 | 116830463 | + |
| SEQ ID NO 5576 | CCTACTCCTTCTGGCAGACC | CAG | chr11 | 116830453 | 116830472 | 116830469 | + |
| SEQ ID NO 5577 | TCCTTCTGGCAGACCCAGCT | AAG | chr11 | 116830458 | 116830477 | 116830474 | + |

Figure 19 (Cont'd)

| SEQ ID NO | Sequence | | Chr | Start | End | Pos | Strand |
|---|---|---|---|---|---|---|---|
| SEQ ID NO 5578 | CCTTCTGGCAGACCCAGCTA | AGG | chr11 | 116830459 | 116830478 | 116830475 | + |
| SEQ ID NO 5579 | ACCCAGCTAAGGTTCTACCT | TAG | chr11 | 116830470 | 116830489 | 116830486 | + |
| SEQ ID NO 5580 | CCCAGCTAAGGTTCTACCTT | AGG | chr11 | 116830471 | 116830490 | 116830487 | + |
| SEQ ID NO 5581 | CCAGCTAAGGTTCTACCTTA | GGG | chr11 | 116830472 | 116830491 | 116830488 | + |
| SEQ ID NO 5582 | CAGCTAAGGTTCTACCTTAG | GGG | chr11 | 116830473 | 116830492 | 116830489 | + |
| SEQ ID NO 5583 | TAGGGGCCACGCCACCTCCC | CAG | chr11 | 116830490 | 116830509 | 116830506 | + |
| SEQ ID NO 5584 | AGGGGCCACGCCACCTCCCC | AGG | chr11 | 116830491 | 116830510 | 116830507 | + |
| SEQ ID NO 5585 | GGGGCCACGCCACCTCCCCA | GGG | chr11 | 116830492 | 116830511 | 116830508 | + |
| SEQ ID NO 5586 | GGCCACGCCACCTCCCCAGG | GAG | chr11 | 116830494 | 116830513 | 116830510 | + |
| SEQ ID NO 5587 | GCCACGCCACCTCCCCAGGG | AGG | chr11 | 116830495 | 116830514 | 116830511 | + |
| SEQ ID NO 5588 | CCACGCCACCTCCCCAGGGA | GGG | chr11 | 116830496 | 116830515 | 116830512 | + |
| SEQ ID NO 5589 | CACGCCACCTCCCCAGGGAG | GGG | chr11 | 116830497 | 116830516 | 116830513 | + |
| SEQ ID NO 5590 | CACCTCCCCAGGGAGGGGTC | CAG | chr11 | 116830502 | 116830521 | 116830518 | + |
| SEQ ID NO 5591 | CCTCCCCAGGGAGGGGTCCA | GAG | chr11 | 116830504 | 116830523 | 116830520 | + |
| SEQ ID NO 5592 | CTCCCCAGGGAGGGGTCCAG | AGG | chr11 | 116830505 | 116830524 | 116830521 | + |
| SEQ ID NO 5593 | CAGGGAGGGGTCCAGAGGCA | TGG | chr11 | 116830510 | 116830529 | 116830526 | + |
| SEQ ID NO 5594 | AGGGAGGGGTCCAGAGGCAT | GGG | chr11 | 116830511 | 116830530 | 116830527 | + |
| SEQ ID NO 5595 | GGGAGGGGTCCAGAGGCATG | GGG | chr11 | 116830512 | 116830531 | 116830528 | + |
| SEQ ID NO 5596 | GGTCCAGAGGCATGGGGACC | TGG | chr11 | 116830518 | 116830537 | 116830534 | + |
| SEQ ID NO 5597 | GTCCAGAGGCATGGGGACCT | GGG | chr11 | 116830519 | 116830538 | 116830535 | + |
| SEQ ID NO 5598 | TCCAGAGGCATGGGGACCTG | GGG | chr11 | 116830520 | 116830539 | 116830536 | + |
| SEQ ID NO 5599 | GGGACCTGGGGTGCCCCTCA | CAG | chr11 | 116830532 | 116830551 | 116830548 | + |
| SEQ ID NO 5600 | GGACCTGGGGTGCCCCTCAC | AGG | chr11 | 116830533 | 116830552 | 116830549 | + |
| SEQ ID NO 5601 | CCTCACAGGACACTTCCTTG | CAG | chr11 | 116830547 | 116830566 | 116830563 | + |
| SEQ ID NO 5602 | CTCACAGGACACTTCCTTGC | AGG | chr11 | 116830548 | 116830567 | 116830564 | + |
| SEQ ID NO 5603 | AGGACACTTCCTTGCAGGAA | CAG | chr11 | 116830553 | 116830572 | 116830569 | + |
| SEQ ID NO 5604 | GACACTTCCTTGCAGGAACA | GAG | chr11 | 116830555 | 116830574 | 116830571 | + |
| SEQ ID NO 5605 | ACACTTCCTTGCAGGAACAG | AGG | chr11 | 116830556 | 116830575 | 116830572 | + |
| SEQ ID NO 5606 | GCAGGAACAGAGGTGCCATG | CAG | chr11 | 116830566 | 116830585 | 116830582 | + |
| SEQ ID NO 5607 | ACAGAGGTGCCATGCAGCCC | CGG | chr11 | 116830572 | 116830591 | 116830588 | + |
| SEQ ID NO 5608 | CAGAGGTGCCATGCAGCCCC | GGG | chr11 | 116830573 | 116830592 | 116830589 | + |
| SEQ ID NO 5609 | ACTCCTTGTTGTTGCCCTCC | TGG | chr11 | 116830597 | 116830616 | 116830613 | + |
| SEQ ID NO 5610 | TGTTGCCCTCCTGGCGCTCC | TGG | chr11 | 116830606 | 116830625 | 116830622 | + |
| SEQ ID NO 5611 | CGCTCCTGGCCTCTGCCCGT | AAG | chr11 | 116830620 | 116830639 | 116830636 | + |
| SEQ ID NO 5612 | GGCCTCTGCCCGTAAGCACT | TGG | chr11 | 116830627 | 116830646 | 116830643 | + |
| SEQ ID NO 5613 | CTCTGCCCGTAAGCACTTGG | TGG | chr11 | 116830630 | 116830649 | 116830646 | + |
| SEQ ID NO 5614 | TCTGCCCGTAAGCACTTGGT | GGG | chr11 | 116830631 | 116830650 | 116830647 | + |
| SEQ ID NO 5615 | CCGTAAGCACTTGGTGGGAC | TGG | chr11 | 116830636 | 116830655 | 116830652 | + |
| SEQ ID NO 5616 | CGTAAGCACTTGGTGGGACT | GGG | chr11 | 116830637 | 116830656 | 116830653 | + |
| SEQ ID NO 5617 | AGCACTTGGTGGGACTGGGC | TGG | chr11 | 116830641 | 116830660 | 116830657 | + |
| SEQ ID NO 5618 | GCACTTGGTGGGACTGGGCT | GGG | chr11 | 116830642 | 116830661 | 116830658 | + |
| SEQ ID NO 5619 | CACTTGGTGGGACTGGGCTG | GGG | chr11 | 116830643 | 116830662 | 116830659 | + |
| SEQ ID NO 5620 | ACTTGGTGGGACTGGGCTGG | GGG | chr11 | 116830644 | 116830663 | 116830660 | + |
| SEQ ID NO 5621 | TGGTGGGACTGGGCTGGGGG | CAG | chr11 | 116830647 | 116830666 | 116830663 | + |
| SEQ ID NO 5622 | GGTGGGACTGGGCTGGGGGC | AGG | chr11 | 116830648 | 116830667 | 116830664 | + |
| SEQ ID NO 5623 | GTGGGACTGGGCTGGGGGCA | GGG | chr11 | 116830649 | 116830668 | 116830665 | + |
| SEQ ID NO 5624 | GCCCCAGCCCAGTCCCACC | AAG | chr11 | 116830648 | 116830667 | 116830651 | - |
| SEQ ID NO 5625 | CCAGTCCCACCAAGTGCTTA | CGG | chr11 | 116830639 | 116830658 | 116830642 | - |
| SEQ ID NO 5626 | CAGTCCCACCAAGTGCTTAC | GGG | chr11 | 116830638 | 116830657 | 116830641 | - |

Figure 19 (Cont'd)

| SEQ ID NO 5627 | TCCCACCAAGTGCTTACGGG | CAG | chr11 | 116830635 | 116830654 | 116830638 | - |
| SEQ ID NO 5628 | CCACCAAGTGCTTACGGGCA | GAG | chr11 | 116830633 | 116830652 | 116830636 | - |
| SEQ ID NO 5629 | CACCAAGTGCTTACGGGCAG | AGG | chr11 | 116830632 | 116830651 | 116830635 | - |
| SEQ ID NO 5630 | AAGTGCTTACGGGCAGAGGC | CAG | chr11 | 116830628 | 116830647 | 116830631 | - |
| SEQ ID NO 5631 | AGTGCTTACGGGCAGAGGCC | AGG | chr11 | 116830627 | 116830646 | 116830630 | - |
| SEQ ID NO 5632 | TGCTTACGGGCAGAGGCCAG | GAG | chr11 | 116830625 | 116830644 | 116830628 | - |
| SEQ ID NO 5633 | CGGGCAGAGGCCAGGAGCGC | CAG | chr11 | 116830619 | 116830638 | 116830622 | - |
| SEQ ID NO 5634 | GGGCAGAGGCCAGGAGCGCC | AGG | chr11 | 116830618 | 116830637 | 116830621 | - |
| SEQ ID NO 5635 | GCAGAGGCCAGGAGCGCCAG | GAG | chr11 | 116830616 | 116830635 | 116830619 | - |
| SEQ ID NO 5636 | CAGAGGCCAGGAGCGCCAGG | AGG | chr11 | 116830615 | 116830634 | 116830618 | - |
| SEQ ID NO 5637 | AGAGGCCAGGAGCGCCAGGA | GGG | chr11 | 116830614 | 116830633 | 116830617 | - |
| SEQ ID NO 5638 | AGCGCCAGGAGGGCAACAAC | AAG | chr11 | 116830604 | 116830623 | 116830607 | - |
| SEQ ID NO 5639 | GCGCCAGGAGGGCAACAACA | AGG | chr11 | 116830603 | 116830622 | 116830606 | - |
| SEQ ID NO 5640 | GCCAGGAGGGCAACAACAAG | GAG | chr11 | 116830601 | 116830620 | 116830604 | - |
| SEQ ID NO 5641 | GGGCAACAACAAGGAGTACC | CGG | chr11 | 116830594 | 116830613 | 116830597 | - |
| SEQ ID NO 5642 | GGCAACAACAAGGAGTACCC | GGG | chr11 | 116830593 | 116830612 | 116830596 | - |
| SEQ ID NO 5643 | GCAACAACAAGGAGTACCCG | GGG | chr11 | 116830592 | 116830611 | 116830595 | - |
| SEQ ID NO 5644 | AAGGAGTACCCGGGGCTGCA | TGG | chr11 | 116830584 | 116830603 | 116830587 | - |
| SEQ ID NO 5645 | CATGGCACCTCTGTTCCTGC | AAG | chr11 | 116830566 | 116830585 | 116830569 | - |
| SEQ ID NO 5646 | ATGGCACCTCTGTTCCTGCA | AGG | chr11 | 116830565 | 116830584 | 116830568 | - |
| SEQ ID NO 5647 | GCACCTCTGTTCCTGCAAGG | AAG | chr11 | 116830562 | 116830581 | 116830565 | - |
| SEQ ID NO 5648 | CCTGCAAGGAAGTGTCCTGT | GAG | chr11 | 116830551 | 116830570 | 116830554 | - |
| SEQ ID NO 5649 | CTGCAAGGAAGTGTCCTGTG | AGG | chr11 | 116830550 | 116830569 | 116830553 | - |
| SEQ ID NO 5650 | TGCAAGGAAGTGTCCTGTGA | GGG | chr11 | 116830549 | 116830568 | 116830552 | - |
| SEQ ID NO 5651 | GCAAGGAAGTGTCCTGTGAG | GGG | chr11 | 116830548 | 116830567 | 116830551 | - |
| SEQ ID NO 5652 | GTGTCCTGTGAGGGCACCC | CAG | chr11 | 116830540 | 116830559 | 116830543 | - |
| SEQ ID NO 5653 | TGTCCTGTGAGGGCACCCC | AGG | chr11 | 116830539 | 116830558 | 116830542 | - |
| SEQ ID NO 5654 | ACCCCAGGTCCCCATGCCTC | TGG | chr11 | 116830524 | 116830543 | 116830527 | - |
| SEQ ID NO 5655 | CATGCCTCTGGACCCCTCCC | TGG | chr11 | 116830512 | 116830531 | 116830515 | - |
| SEQ ID NO 5656 | ATGCCTCTGGACCCCTCCCT | GGG | chr11 | 116830511 | 116830530 | 116830514 | - |
| SEQ ID NO 5657 | TGCCTCTGGACCCCTCCCTG | GGG | chr11 | 116830510 | 116830529 | 116830513 | - |
| SEQ ID NO 5658 | CCTCTGGACCCCTCCCTGGG | GAG | chr11 | 116830508 | 116830527 | 116830511 | - |
| SEQ ID NO 5659 | CTCTGGACCCCTCCCTGGGG | AGG | chr11 | 116830507 | 116830526 | 116830510 | - |
| SEQ ID NO 5660 | TGGACCCCTCCCTGGGGAGG | TGG | chr11 | 116830504 | 116830523 | 116830507 | - |
| SEQ ID NO 5661 | CCCTCCCTGGGGAGGTGGCG | TGG | chr11 | 116830499 | 116830518 | 116830502 | - |
| SEQ ID NO 5662 | GGGGAGGTGGCGTGGCCCCT | AAG | chr11 | 116830491 | 116830510 | 116830494 | - |
| SEQ ID NO 5663 | GGGAGGTGGCGTGGCCCCTA | AGG | chr11 | 116830490 | 116830509 | 116830493 | - |
| SEQ ID NO 5664 | AGGTGGCGTGGCCCCTAAGG | TAG | chr11 | 116830487 | 116830506 | 116830490 | - |
| SEQ ID NO 5665 | TGGCCCCTAAGGTAGAACCT | TAG | chr11 | 116830479 | 116830498 | 116830482 | - |
| SEQ ID NO 5666 | CCCTAAGGTAGAACCTTAGC | TGG | chr11 | 116830475 | 116830494 | 116830478 | - |
| SEQ ID NO 5667 | CCTAAGGTAGAACCTTAGCT | GGG | chr11 | 116830474 | 116830493 | 116830477 | - |
| SEQ ID NO 5668 | AGAACCTTAGCTGGGTCTGC | CAG | chr11 | 116830466 | 116830485 | 116830469 | - |
| SEQ ID NO 5669 | ACCTTAGCTGGGTCTGCCAG | AAG | chr11 | 116830463 | 116830482 | 116830466 | - |
| SEQ ID NO 5670 | CCTTAGCTGGGTCTGCCAGA | AGG | chr11 | 116830462 | 116830481 | 116830465 | - |
| SEQ ID NO 5671 | TTAGCTGGGTCTGCCAGAAG | GAG | chr11 | 116830460 | 116830479 | 116830463 | - |
| SEQ ID NO 5672 | GCTGGGTCTGCCAGAAGGAG | TAG | chr11 | 116830457 | 116830476 | 116830460 | - |
| SEQ ID NO 5673 | CTGGGTCTGCCAGAAGGAGT | AGG | chr11 | 116830456 | 116830475 | 116830459 | - |
| SEQ ID NO 5674 | TGGGTCTGCCAGAAGGAGTA | GGG | chr11 | 116830455 | 116830474 | 116830458 | - |
| SEQ ID NO 5675 | GGGTCTGCCAGAAGGAGTAG | GGG | chr11 | 116830454 | 116830473 | 116830457 | - |

Figure 19 (Cont'd)

| | | | | | | | |
|---|---|---|---|---|---|---|---|
| SEQ ID NO 5676 | CTGCCAGAAGGAGTAGGGGC | CGG | chr11 | 116830450 | 116830469 | 116830453 | - |
| SEQ ID NO 5677 | GGGCCGGCTCCCTGCTAATA | CGG | chr11 | 116830434 | 116830453 | 116830437 | - |
| SEQ ID NO 5678 | GGCCGGCTCCCTGCTAATAC | GGG | chr11 | 116830433 | 116830452 | 116830436 | - |
| SEQ ID NO 5679 | TCCCTGCTAATACGGGCTCT | CAG | chr11 | 116830426 | 116830445 | 116830429 | - |
| SEQ ID NO 5680 | CTGCTAATACGGGCTCTCAG | AAG | chr11 | 116830423 | 116830442 | 116830426 | - |
| SEQ ID NO 5681 | TGCTAATACGGGCTCTCAGA | AGG | chr11 | 116830422 | 116830441 | 116830425 | - |
| SEQ ID NO 5682 | GCTAATACGGGCTCTCAGAA | GGG | chr11 | 116830421 | 116830440 | 116830424 | - |
| SEQ ID NO 5683 | CTAATACGGGCTCTCAGAAG | GGG | chr11 | 116830420 | 116830439 | 116830423 | - |
| SEQ ID NO 5684 | TAATACGGGCTCTCAGAAGG | GGG | chr11 | 116830419 | 116830438 | 116830422 | - |
| SEQ ID NO 5685 | CGGGCTCTCAGAAGGGGGAC | TGG | chr11 | 116830414 | 116830433 | 116830417 | - |
| SEQ ID NO 5686 | CTCTCAGAAGGGGACTGGT | GAG | chr11 | 116830410 | 116830429 | 116830413 | - |
| SEQ ID NO 5687 | TCTCAGAAGGGGACTGGTG | AGG | chr11 | 116830409 | 116830428 | 116830412 | - |
| SEQ ID NO 5688 | CTCAGAAGGGGACTGGTGA | GGG | chr11 | 116830408 | 116830427 | 116830411 | - |
| SEQ ID NO 5689 | TCAGAAGGGGACTGGTGAG | GGG | chr11 | 116830407 | 116830426 | 116830410 | - |
| SEQ ID NO 5690 | AAGGGGGACTGGTGAGGGGC | GAG | chr11 | 116830403 | 116830422 | 116830406 | - |
| SEQ ID NO 5691 | AGGGGGACTGGTGAGGGGCG | AGG | chr11 | 116830402 | 116830421 | 116830405 | - |
| SEQ ID NO 5692 | GGGGGACTGGTGAGGGGCGA | GGG | chr11 | 116830401 | 116830420 | 116830404 | - |
| SEQ ID NO 5693 | CTGGTGAGGGGCGAGGGATC | GAG | chr11 | 116830395 | 116830414 | 116830398 | - |
| SEQ ID NO 5694 | TGGTGAGGGGCGAGGGATCG | AGG | chr11 | 116830394 | 116830413 | 116830397 | - |
| SEQ ID NO 5695 | GGGCGAGGGATCGAGGCCCA | AAG | chr11 | 116830387 | 116830406 | 116830390 | - |
| SEQ ID NO 5696 | GGCGAGGGATCGAGGCCCAA | AGG | chr11 | 116830386 | 116830405 | 116830389 | - |
| SEQ ID NO 5697 | GCGAGGGATCGAGGCCCAAA | GGG | chr11 | 116830385 | 116830404 | 116830388 | - |
| SEQ ID NO 5698 | GAGGGATCGAGGCCCAAAGG | GAG | chr11 | 116830383 | 116830402 | 116830386 | - |
| SEQ ID NO 5699 | AGGGATCGAGGCCCAAAGGG | AGG | chr11 | 116830382 | 116830401 | 116830385 | - |
| SEQ ID NO 5700 | GATCGAGGCCCAAAGGGAGG | TGG | chr11 | 116830379 | 116830398 | 116830382 | - |
| SEQ ID NO 5701 | ATCGAGGCCCAAAGGGAGGT | GGG | chr11 | 116830378 | 116830397 | 116830381 | - |
| SEQ ID NO 5702 | GAGGCCCAAAGGGAGGTGGG | TGG | chr11 | 116830375 | 116830394 | 116830378 | - |
| SEQ ID NO 5703 | AGGCCCAAAGGGAGGTGGGT | GGG | chr11 | 116830374 | 116830393 | 116830377 | - |
| SEQ ID NO 5704 | CCAAAGGGAGGTGGGTGGGA | TGG | chr11 | 116830370 | 116830389 | 116830373 | - |
| SEQ ID NO 5705 | AAAGGGAGGTGGGTGGGATG | GAG | chr11 | 116830368 | 116830387 | 116830371 | - |
| SEQ ID NO 5706 | GGGAGGTGGGTGGGATGGAG | CAG | chr11 | 116830365 | 116830384 | 116830368 | - |
| SEQ ID NO 5707 | GGATGGAGCAGAAAACCCAC | CAG | chr11 | 116830353 | 116830372 | 116830356 | - |
| SEQ ID NO 5708 | AACCCACCAGACTGAACATC | AAG | chr11 | 116830340 | 116830359 | 116830343 | - |
| SEQ ID NO 5709 | ACCCACCAGACTGAACATCA | AGG | chr11 | 116830339 | 116830358 | 116830342 | - |
| SEQ ID NO 5710 | ACTGAACATCAAGGCACCTG | CGG | chr11 | 116830330 | 116830349 | 116830333 | - |
| SEQ ID NO 5711 | ACATCAAGGCACCTGCGGTC | TGG | chr11 | 116830325 | 116830344 | 116830328 | - |
| SEQ ID NO 5712 | GGTCTGGACTGATCTCCGTC | CAG | chr11 | 116830309 | 116830328 | 116830312 | - |
| SEQ ID NO 5713 | GGACTGATCTCCGTCCAGTC | CAG | chr11 | 116830304 | 116830323 | 116830307 | - |
| SEQ ID NO 5714 | GCCAACATGCTGTGTGTCTT | TGG | chr11 | 116830282 | 116830301 | 116830285 | - |
| SEQ ID NO 5715 | CCAACATGCTGTGTGTCTTT | GGG | chr11 | 116830281 | 116830300 | 116830284 | - |
| SEQ ID NO 5716 | GTGTGTCTTTGGGTGATTTC | TGG | chr11 | 116830271 | 116830290 | 116830274 | - |
| SEQ ID NO 5717 | GGGTGATTTCTGGCCCTCTC | CAG | chr11 | 116830261 | 116830280 | 116830264 | - |
| SEQ ID NO 5718 | GGTGATTTCTGGCCCTCTCC | AGG | chr11 | 116830260 | 116830279 | 116830263 | - |
| SEQ ID NO 5719 | TTCTGGCCCTCTCCAGGCCT | CAG | chr11 | 116830254 | 116830273 | 116830257 | - |
| SEQ ID NO 5720 | CAGGCCTCAGTTTCCCTGTC | TGG | chr11 | 116830241 | 116830260 | 116830244 | - |
| SEQ ID NO 5721 | AGGCCTCAGTTTCCCTGTCT | GGG | chr11 | 116830240 | 116830259 | 116830243 | - |
| SEQ ID NO 5722 | GGCCTCAGTTTCCCTGTCTG | GGG | chr11 | 116830239 | 116830258 | 116830242 | - |
| SEQ ID NO 5723 | CTCAGTTTCCCTGTCTGGGG | TAG | chr11 | 116830236 | 116830255 | 116830239 | - |
| SEQ ID NO 5724 | TCAGTTTCCCTGTCTGGGGT | AGG | chr11 | 116830235 | 116830254 | 116830238 | - |

Figure 19 (Cont'd)

| SEQ ID NO 5725 | TTCCCTGTCTGGGGTAGGAC | TGG | chr11 | 116830230 | 116830249 | 116830233 | - |
|---|---|---|---|---|---|---|---|
| SEQ ID NO 5726 | TCCCTGTCTGGGGTAGGACT | GGG | chr11 | 116830229 | 116830248 | 116830232 | - |
| SEQ ID NO 5727 | GGGGTAGGACTGGGCTGTCT | AAG | chr11 | 116830220 | 116830239 | 116830223 | - |
| SEQ ID NO 5728 | GGGTAGGACTGGGCTGTCTA | AGG | chr11 | 116830219 | 116830238 | 116830222 | - |
| SEQ ID NO 5729 | GGGCTGTCTAAGGCTTCCTC | CAG | chr11 | 116830209 | 116830228 | 116830212 | - |
| SEQ ID NO 5730 | CTAAGGCTTCCTCCAGCCCT | AAG | chr11 | 116830202 | 116830221 | 116830205 | - |
| SEQ ID NO 5731 | TTCCTCCAGCCCTAAGCCTG | AAG | chr11 | 116830195 | 116830214 | 116830198 | - |
| SEQ ID NO 5732 | CAGCCCTAAGCCTGAAGAAT | GAG | chr11 | 116830189 | 116830208 | 116830192 | - |
| SEQ ID NO 5733 | AGCCCTAAGCCTGAAGAATG | AGG | chr11 | 116830188 | 116830207 | 116830191 | - |
| SEQ ID NO 5734 | GCCCTAAGCCTGAAGAATGA | GGG | chr11 | 116830187 | 116830206 | 116830190 | - |
| SEQ ID NO 5735 | CCCTAAGCCTGAAGAATGAG | GGG | chr11 | 116830186 | 116830205 | 116830189 | - |
| SEQ ID NO 5736 | CCTAAGCCTGAAGAATGAGG | GGG | chr11 | 116830185 | 116830204 | 116830188 | - |
| SEQ ID NO 5737 | CTAAGCCTGAAGAATGAGGG | GGG | chr11 | 116830184 | 116830203 | 116830187 | - |
| SEQ ID NO 5738 | ATGAGGGGGAACCTGCACT | TGG | chr11 | 116830171 | 116830190 | 116830174 | - |
| SEQ ID NO 5739 | GAGGGGGAACCTGCACTTG | GAG | chr11 | 116830169 | 116830188 | 116830172 | - |
| SEQ ID NO 5740 | CCTGCACTTGGAGCCACTTC | CAG | chr11 | 116830159 | 116830178 | 116830162 | - |
| SEQ ID NO 5741 | TTCCAGCCCCACCCCTGTG | TAG | chr11 | 116830142 | 116830161 | 116830145 | - |
| SEQ ID NO 5742 | CCCCACCCCTGTGTAGCTT | TGG | chr11 | 116830136 | 116830155 | 116830139 | - |
| SEQ ID NO 5743 | CCCACCCCTGTGTAGCTTT | GGG | chr11 | 116830135 | 116830154 | 116830138 | - |
| SEQ ID NO 5744 | CCCCTGTGTAGCTTTGGGC | AAG | chr11 | 116830131 | 116830150 | 116830134 | - |
| SEQ ID NO 5745 | TGGGCAAGTGACACCCCTCC | CGG | chr11 | 116830116 | 116830135 | 116830119 | - |
| SEQ ID NO 5746 | GGGCAAGTGACACCCCTCCC | GGG | chr11 | 116830115 | 116830134 | 116830118 | - |
| SEQ ID NO 5747 | TCCCGGGCCTCCATGTTCTT | CAG | chr11 | 116830099 | 116830118 | 116830102 | - |
| SEQ ID NO 5748 | CCCGGGCCTCCATGTTCTTC | AGG | chr11 | 116830098 | 116830117 | 116830101 | - |
| SEQ ID NO 5749 | CATGTTCTTCAGGTTATGAT | GAG | chr11 | 116830088 | 116830107 | 116830091 | - |
| SEQ ID NO 5750 | ATGTTCTTCAGGTTATGATG | AGG | chr11 | 116830087 | 116830106 | 116830090 | - |
| SEQ ID NO 5751 | TGTTCTTCAGGTTATGATGA | GGG | chr11 | 116830086 | 116830105 | 116830089 | - |
| SEQ ID NO 5752 | GTTCTTCAGGTTATGATGAG | GGG | chr11 | 116830085 | 116830104 | 116830088 | - |
| SEQ ID NO 5753 | CTTCAGGTTATGATGAGGGG | TGG | chr11 | 116830082 | 116830101 | 116830085 | - |
| SEQ ID NO 5754 | TTCAGGTTATGATGAGGGGT | GGG | chr11 | 116830081 | 116830100 | 116830084 | - |
| SEQ ID NO 5755 | TCAGGTTATGATGAGGGGTG | GGG | chr11 | 116830080 | 116830099 | 116830083 | - |
| SEQ ID NO 5756 | CAGGTTATGATGAGGGGTGG | GGG | chr11 | 116830079 | 116830098 | 116830082 | - |
| SEQ ID NO 5757 | AGGTTATGATGAGGGGTGGG | GGG | chr11 | 116830078 | 116830097 | 116830081 | - |
| SEQ ID NO 5758 | AGGGGTGGGGGGCACCCGTC | CAG | chr11 | 116830067 | 116830086 | 116830070 | - |
| SEQ ID NO 5759 | GGGGGCACCCGTCCAGCTCC | GAG | chr11 | 116830060 | 116830079 | 116830063 | - |
| SEQ ID NO 5760 | GGGGCACCCGTCCAGCTCCG | AGG | chr11 | 116830059 | 116830078 | 116830062 | - |
| SEQ ID NO 5761 | GTCCAGCTCCGAGGCTTCCT | TAG | chr11 | 116830050 | 116830069 | 116830053 | - |
| SEQ ID NO 5762 | CTCCGAGGCTTCCTTAGCTC | TAG | chr11 | 116830044 | 116830063 | 116830047 | - |
| SEQ ID NO 5763 | GAGGCTTCCTTAGCTCTAGC | AAG | chr11 | 116830040 | 116830059 | 116830043 | - |
| SEQ ID NO 5764 | AGCTCTAGCAAGTGCTTCT | CAG | chr11 | 116830029 | 116830048 | 116830032 | - |
| SEQ ID NO 5765 | GCTCTAGCAAGTGCTTCTCC | AGG | chr11 | 116830028 | 116830047 | 116830031 | - |
| SEQ ID NO 5766 | AAGTGCTTCTCCAGGCTTGC | TGG | chr11 | 116830020 | 116830039 | 116830023 | - |
| SEQ ID NO 5767 | GCTTCTCCAGGCTTGCTGGC | TGG | chr11 | 116830016 | 116830035 | 116830019 | - |
| SEQ ID NO 5768 | CTTCTCCAGGCTTGCTGGCT | GGG | chr11 | 116830015 | 116830034 | 116830018 | - |
| SEQ ID NO 5769 | TCCAGGCTTGCTGGCTGGGC | TGG | chr11 | 116830011 | 116830030 | 116830014 | - |
| SEQ ID NO 5770 | CCAGGCTTGCTGGCTGGGCT | GGG | chr11 | 116830010 | 116830029 | 116830013 | - |
| SEQ ID NO 5771 | GGCTTGCTGGCTGGGCTGGG | CAG | chr11 | 116830007 | 116830026 | 116830010 | - |
| SEQ ID NO 5772 | GCTTGCTGGCTGGGCTGGGC | AGG | chr11 | 116830006 | 116830025 | 116830009 | - |
| SEQ ID NO 5773 | CTTGCTGGCTGGGCTGGGCA | GGG | chr11 | 116830005 | 116830024 | 116830008 | - |

Figure 19 (Cont'd)

| SEQ ID NO | Sequence | Codon | Chr | Start | End | Pos | Strand |
|---|---|---|---|---|---|---|---|
| SEQ ID NO 5774 | TGCTGGCTGGGCTGGGCAGG | GAG | chr11 | 116830003 | 116830022 | 116830006 | - |
| SEQ ID NO 5775 | CCCCTCCTCTTTCCCCTCCC | CAG | chr11 | 116829954 | 116829973 | 116829957 | - |
| SEQ ID NO 5776 | CCTCCTCTTTCCCCTCCCCA | GAG | chr11 | 116829952 | 116829971 | 116829955 | - |
| SEQ ID NO 5777 | CTCCTCTTTCCCCTCCCCAG | AGG | chr11 | 116829951 | 116829970 | 116829954 | - |
| SEQ ID NO 5778 | TCCTCTTTCCCCTCCCCAGA | GGG | chr11 | 116829950 | 116829969 | 116829953 | - |
| SEQ ID NO 5779 | CCTCCCAGAGGGCATTACC | TGG | chr11 | 116829940 | 116829959 | 116829943 | - |
| SEQ ID NO 5780 | TCCCAGAGGGCATTACCTG | GAG | chr11 | 116829938 | 116829957 | 116829941 | - |
| SEQ ID NO 5781 | CCAGAGGGCATTACCTGGAG | CAG | chr11 | 116829935 | 116829954 | 116829938 | - |
| SEQ ID NO 5782 | TTACCTGGAGCAGCTGCCTC | TAG | chr11 | 116829925 | 116829944 | 116829928 | - |
| SEQ ID NO 5783 | TACCTGGAGCAGCTGCCTCT | AGG | chr11 | 116829924 | 116829943 | 116829927 | - |
| SEQ ID NO 5784 | ACCTGGAGCAGCTGCCTCTA | GGG | chr11 | 116829923 | 116829942 | 116829926 | - |
| SEQ ID NO 5785 | GCTGCCTCTAGGGATGAACT | GAG | chr11 | 116829913 | 116829932 | 116829916 | - |
| SEQ ID NO 5786 | GCCTCTAGGGATGAACTGAG | CAG | chr11 | 116829910 | 116829929 | 116829913 | - |
| SEQ ID NO 5787 | CTAGGGATGAACTGAGCAGA | CAG | chr11 | 116829906 | 116829925 | 116829909 | - |
| SEQ ID NO 5788 | TAGGGATGAACTGAGCAGAC | AGG | chr11 | 116829905 | 116829924 | 116829908 | - |
| SEQ ID NO 5789 | GGATGAACTGAGCAGACAGG | CAG | chr11 | 116829902 | 116829921 | 116829905 | - |
| SEQ ID NO 5790 | GATGAACTGAGCAGACAGGC | AGG | chr11 | 116829901 | 116829920 | 116829904 | - |
| SEQ ID NO 5791 | TGAACTGAGCAGACAGGCAG | GAG | chr11 | 116829899 | 116829918 | 116829902 | - |
| SEQ ID NO 5792 | GAACTGAGCAGACAGGCAGG | AGG | chr11 | 116829898 | 116829917 | 116829901 | - |
| SEQ ID NO 5793 | AACTGAGCAGACAGGCAGGA | GGG | chr11 | 116829897 | 116829916 | 116829900 | - |
| SEQ ID NO 5794 | GACCTGTTTTATATCATCTC | CAG | chr11 | 116829870 | 116829889 | 116829873 | - |
| SEQ ID NO 5795 | ACCTGTTTTATATCATCTCC | AGG | chr11 | 116829869 | 116829888 | 116829872 | - |
| SEQ ID NO 5796 | CCTGTTTTATATCATCTCCA | GGG | chr11 | 116829868 | 116829887 | 116829871 | - |
| SEQ ID NO 5797 | GTTTTATATCATCTCCAGGG | CAG | chr11 | 116829865 | 116829884 | 116829868 | - |
| SEQ ID NO 5798 | TTATATCATCTCCAGGGCAG | CAG | chr11 | 116829862 | 116829881 | 116829865 | - |
| SEQ ID NO 5799 | TATATCATCTCCAGGGCAGC | AGG | chr11 | 116829861 | 116829880 | 116829864 | - |
| SEQ ID NO 5800 | TCTCCAGGGCAGCAGGCACT | GAG | chr11 | 116829854 | 116829873 | 116829857 | - |
| SEQ ID NO 5801 | CTCCAGGGCAGCAGGCACTG | AGG | chr11 | 116829853 | 116829872 | 116829856 | - |
| SEQ ID NO 5802 | GGCAGCAGGCACTGAGGACC | CAG | chr11 | 116829847 | 116829866 | 116829850 | - |
| SEQ ID NO 5803 | GCAGCAGGCACTGAGGACCC | AGG | chr11 | 116829846 | 116829865 | 116829849 | - |
| SEQ ID NO 5804 | CAGCAGGCACTGAGGACCCA | GGG | chr11 | 116829845 | 116829864 | 116829848 | - |
| SEQ ID NO 5805 | GCACTGAGGACCCAGGGCGC | TGG | chr11 | 116829839 | 116829858 | 116829842 | - |
| SEQ ID NO 5806 | CACTGAGGACCCAGGGCGCT | GGG | chr11 | 116829838 | 116829857 | 116829841 | - |
| SEQ ID NO 5807 | AGGACCCAGGGCGCTGGGCA | AAG | chr11 | 116829833 | 116829852 | 116829836 | - |
| SEQ ID NO 5808 | GGACCCAGGGCGCTGGGCAA | AGG | chr11 | 116829832 | 116829851 | 116829835 | - |
| SEQ ID NO 5809 | GGCAAAGGTCACCTGCTGAC | CAG | chr11 | 116829817 | 116829836 | 116829820 | - |
| SEQ ID NO 5810 | AAAGGTCACCTGCTGACCAG | TGG | chr11 | 116829814 | 116829833 | 116829817 | - |
| SEQ ID NO 5811 | AGGTCACCTGCTGACCAGTG | GAG | chr11 | 116829812 | 116829831 | 116829815 | - |
| SEQ ID NO 5812 | ACCTGCTGACCAGTGGAGAT | GAG | chr11 | 116829807 | 116829826 | 116829810 | - |
| SEQ ID NO 5813 | CCTGCTGACCAGTGGAGATG | AGG | chr11 | 116829806 | 116829825 | 116829809 | - |
| SEQ ID NO 5814 | CTGCTGACCAGTGGAGATGA | GGG | chr11 | 116829805 | 116829824 | 116829808 | - |
| SEQ ID NO 5815 | ACCAGTGGAGATGAGGGCCT | GAG | chr11 | 116829799 | 116829818 | 116829802 | - |
| SEQ ID NO 5816 | CCAGTGGAGATGAGGGCCTG | AGG | chr11 | 116829798 | 116829817 | 116829801 | - |
| SEQ ID NO 5817 | GTGGAGATGAGGGCCTGAGG | CAG | chr11 | 116829795 | 116829814 | 116829798 | - |
| SEQ ID NO 5818 | TGGAGATGAGGGCCTGAGGC | AGG | chr11 | 116829794 | 116829813 | 116829797 | - |
| SEQ ID NO 5819 | GGAGATGAGGGCCTGAGGCA | GGG | chr11 | 116829793 | 116829812 | 116829796 | - |
| SEQ ID NO 5820 | AGGGCCTGAGGCAGGGTGTC | CAG | chr11 | 116829786 | 116829805 | 116829789 | - |
| SEQ ID NO 5821 | TGAGGCAGGGTGTCCAGATG | CAG | chr11 | 116829780 | 116829799 | 116829783 | - |
| SEQ ID NO 5822 | GCAGGGTGTCCAGATGCAGC | AAG | chr11 | 116829776 | 116829795 | 116829779 | - |

Figure 19 (Cont'd)

| | | | | | | | |
|---|---|---|---|---|---|---|---|
| SEQ ID NO 5823 | GGGTGTCCAGATGCAGCAAG | CGG | chr11 | 116829773 | 116829792 | 116829776 | - |
| SEQ ID NO 5824 | GGTGTCCAGATGCAGCAAGC | GGG | chr11 | 116829772 | 116829791 | 116829775 | - |
| SEQ ID NO 5825 | GTCCAGATGCAGCAAGCGGG | CGG | chr11 | 116829769 | 116829788 | 116829772 | - |
| SEQ ID NO 5826 | TCCAGATGCAGCAAGCGGGC | GGG | chr11 | 116829768 | 116829787 | 116829771 | - |
| SEQ ID NO 5827 | CAGATGCAGCAAGCGGGCGG | GAG | chr11 | 116829766 | 116829785 | 116829769 | - |
| SEQ ID NO 5828 | GATGCAGCAAGCGGGCGGGA | GAG | chr11 | 116829764 | 116829783 | 116829767 | - |
| SEQ ID NO 5829 | CAGCAAGCGGGCGGGAGAGT | TGG | chr11 | 116829760 | 116829779 | 116829763 | - |
| SEQ ID NO 5830 | AGCAAGCGGGCGGGAGAGTT | GGG | chr11 | 116829759 | 116829778 | 116829762 | - |
| SEQ ID NO 5831 | CGGGAGAGTTGGGAAATCCC | TAG | chr11 | 116829749 | 116829768 | 116829752 | - |
| SEQ ID NO 5832 | GGGAGAGTTGGGAAATCCCT | AGG | chr11 | 116829748 | 116829767 | 116829751 | - |
| SEQ ID NO 5833 | GAGAGTTGGGAAATCCCTAG | GAG | chr11 | 116829746 | 116829765 | 116829749 | - |
| SEQ ID NO 5834 | TGGGAAATCCCTAGGAGACT | GAG | chr11 | 116829740 | 116829759 | 116829743 | - |

Figure 20

| # | Sequence | PAM | Chr | Start | End | Cuts 5' of | Str |
|---|---|---|---|---|---|---|---|
| SEQ ID NO 5835 | GGTGACCTTTGCCCAGCGCC | CTGGGT | chr11 | 116829824 | 116829843 | 116829840 | + |
| SEQ ID NO 5836 | GAGGGGAAAGAGGAGGGGAG | GAGGAT | chr11 | 116829956 | 116829975 | 116829972 | + |
| SEQ ID NO 5837 | TAAGGAAGCCTCGGAGCTGG | ACGGGT | chr11 | 116830048 | 116830067 | 116830064 | + |
| SEQ ID NO 5838 | GAAGAACATGGAGGCCCGGG | AGGGGT | chr11 | 116830098 | 116830117 | 116830114 | + |
| SEQ ID NO 5839 | CACTTGCCCAAAGCTACACA | GGGGGT | chr11 | 116830126 | 116830145 | 116830142 | + |
| SEQ ID NO 5840 | GTGCCTTGATGTTCAGTCTG | GTGGGT | chr11 | 116830333 | 116830352 | 116830349 | + |
| SEQ ID NO 5841 | GCCACGCCACCTCCCCAGGG | AGGGGT | chr11 | 116830495 | 116830514 | 116830511 | + |
| SEQ ID NO 5842 | GGTCCAGAGGCATGGGGACC | TGGGGT | chr11 | 116830518 | 116830537 | 116830534 | + |
| SEQ ID NO 5843 | AACAGAGGTGCCATGCAGCC | CCGGGT | chr11 | 116830571 | 116830590 | 116830587 | + |
| SEQ ID NO 5844 | TGGTGGGACTGGGCTGGGGG | CAGGGT | chr11 | 116830647 | 116830666 | 116830663 | + |
| SEQ ID NO 5845 | GCGCCAGGAGGGCAACAACA | AGGAGT | chr11 | 116830603 | 116830622 | 116830606 | - |
| SEQ ID NO 5846 | CCCCTAAGGTAGAACCTTAG | CTGGGT | chr11 | 116830476 | 116830495 | 116830479 | - |
| SEQ ID NO 5847 | CCTTAGCTGGGTCTGCCAGA | AGGAGT | chr11 | 116830462 | 116830481 | 116830465 | - |
| SEQ ID NO 5848 | AGGGGGACTGGTGAGGGGCG | AGGGAT | chr11 | 116830402 | 116830421 | 116830405 | - |
| SEQ ID NO 5849 | GGATCGAGGCCCAAAGGGAG | GTGGGT | chr11 | 116830380 | 116830399 | 116830383 | - |
| SEQ ID NO 5850 | GAGGCCCAAAGGGAGGTGGG | TGGGAT | chr11 | 116830375 | 116830394 | 116830378 | - |
| SEQ ID NO 5851 | AGCCAACATGCTGTGTGTCT | TTGGGT | chr11 | 116830283 | 116830302 | 116830286 | - |
| SEQ ID NO 5852 | CAGGCCTCAGTTTCCCTGTC | TGGGGT | chr11 | 116830241 | 116830260 | 116830244 | - |
| SEQ ID NO 5853 | TTCCTCCAGCCCTAAGCCTG | AAGAAT | chr11 | 116830195 | 116830214 | 116830198 | - |
| SEQ ID NO 5854 | ATGTTCTTCAGGTTATGATG | AGGGGT | chr11 | 116830087 | 116830106 | 116830090 | - |
| SEQ ID NO 5855 | TACCTGGAGCAGCTGCCTCT | AGGGAT | chr11 | 116829924 | 116829943 | 116829927 | - |
| SEQ ID NO 5856 | TGAACTGAGCAGACAGGCAG | GAGGGT | chr11 | 116829899 | 116829918 | 116829902 | - |
| SEQ ID NO 5857 | GTGGAGATGAGGGCCTGAGG | CAGGGT | chr11 | 116829795 | 116829814 | 116829798 | - |
| SEQ ID NO 5858 | CAGATGCAGCAAGCGGGCGG | GAGAGT | chr11 | 116829766 | 116829785 | 116829769 | - |
| SEQ ID NO 5859 | GTTGGGAAATCCCTAGGAGA | CTGAGT | chr11 | 116829742 | 116829761 | 116829745 | - |

Figure 21

| # | Sequence | PAM | Chr | Start | End | Cuts 5' of | Str |
|---|---|---|---|---|---|---|---|
| SEQ ID NO 5860 | AAACTGAGGCCTGGAGAGGG | CCAGAAA | chr11 | 116830248 | 116830267 | 116830264 | + |
| SEQ ID NO 5861 | AGGGAGGTGGGTGGGATGGA | GCAGAAA | chr11 | 116830366 | 116830385 | 116830369 | - |
| SEQ ID NO 5862 | CTTCCTCCAGCCCTAAGCCT | GAAGAAT | chr11 | 116830196 | 116830215 | 116830199 | - |

Figure 22

| # | Sequence | PAM | Chr | Start | End | Cuts 5' of | Str |
|---|---|---|---|---|---|---|---|
| SEQ ID NO 5863 | CTGCTGCCCTGGAGATGATA | TAAAAC | chr11 | 116829859 | 116829878 | 116829875 | + |
| SEQ ID NO 5864 | GAGGTGGGTGGGATGGAGCA | GAAAAC | chr11 | 116830363 | 116830382 | 116830366 | - |

Figure 23

| # | Sequence | PAM | Chr | Start | End | Cuts 5' of | Str |
|---|---|---|---|---|---|---|---|
| SEQ ID NO 5865 | AGGGATTTCCCAACTCTCCC | GCCCGCTT | chr11 | 116829748 | 116829767 | 116829764 | + |
| SEQ ID NO 5866 | GCAGGTTCCCCCCTCATTCT | TCAGGCTT | chr11 | 116830174 | 116830193 | 116830190 | + |
| SEQ ID NO 5867 | GTGCCTTGATGTTCAGTCTG | GTGGGTTT | chr11 | 116830333 | 116830352 | 116830349 | + |
| SEQ ID NO 5868 | GCCCCAGCCCAGTCCCACC | AAGTGCTT | chr11 | 116830648 | 116830667 | 116830651 | - |
| SEQ ID NO 5869 | CCAACATGCTGTGTGTCTTT | GGGTGATT | chr11 | 116830281 | 116830300 | 116830284 | - |
| SEQ ID NO 5870 | ATTTCTGGCCCTCTCCAGGC | CTCAGTTT | chr11 | 116830256 | 116830275 | 116830259 | - |
| SEQ ID NO 5871 | TGGGGTAGGACTGGGCTGTC | TAAGGCTT | chr11 | 116830221 | 116830240 | 116830224 | - |
| SEQ ID NO 5872 | ACTTCCAGCCCACCCCCTG | TGTAGCTT | chr11 | 116830144 | 116830163 | 116830147 | - |
| SEQ ID NO 5873 | GGGGGGCACCCGTCCAGCTC | CGAGGCTT | chr11 | 116830061 | 116830080 | 116830064 | - |
| SEQ ID NO 5874 | GAGGCTTCCTTAGCTCTAGC | AAGTGCTT | chr11 | 116830040 | 116830059 | 116830043 | - |
| SEQ ID NO 5875 | TAGCTCTAGCAAGTGCTTCT | CCAGGCTT | chr11 | 116830030 | 116830049 | 116830033 | - |
| SEQ ID NO 5876 | AGACAGGCAGGAGGGTTCTG | ACCTGTTT | chr11 | 116829889 | 116829908 | 116829892 | - |

Figure 24

| # | Sequence | PAM | Chr | Start | End | Cut site 1 (5' of) | Cut site 2 (5' of) | Str |
|---|---|---|---|---|---|---|---|---|
| SEQ ID NO 5877 | AGTCTCCTAGGGATTTCCCAAC | CTC | chr11 | 116829740 | 116829761 | 116829757 | 116829762 | + |
| SEQ ID NO 5878 | CTAGGGATTTCCCAACTCTCCC | CTC | chr11 | 116829746 | 116829767 | 116829763 | 116829768 | + |
| SEQ ID NO 5879 | GGGATTTCCCAACTCTCCCGCC | CTA | chr11 | 116829749 | 116829770 | 116829766 | 116829771 | + |
| SEQ ID NO 5880 | CCCAACTCTCCCGCCCGCTTGC | TTT | chr11 | 116829756 | 116829777 | 116829773 | 116829778 | + |
| SEQ ID NO 5881 | CCAACTCTCCCGCCCGCTTGCT | TTC | chr11 | 116829757 | 116829778 | 116829774 | 116829779 | + |
| SEQ ID NO 5882 | TCCCGCCCGCTTGCTGCATCTG | CTC | chr11 | 116829764 | 116829785 | 116829781 | 116829786 | + |
| SEQ ID NO 5883 | CCGCCCGCTTGCTGCATCTGGA | CTC | chr11 | 116829766 | 116829787 | 116829783 | 116829788 | + |
| SEQ ID NO 5884 | GCTGCATCTGGACACCCTGCCT | CTT | chr11 | 116829776 | 116829797 | 116829793 | 116829798 | + |
| SEQ ID NO 5885 | CTGCATCTGGACACCCTGCCTC | TTG | chr11 | 116829777 | 116829798 | 116829794 | 116829799 | + |
| SEQ ID NO 5886 | CATCTGGACACCCTGCCTCAGG | CTG | chr11 | 116829780 | 116829801 | 116829797 | 116829802 | + |
| SEQ ID NO 5887 | GACACCCTGCCTCAGGCCCTCA | CTG | chr11 | 116829786 | 116829807 | 116829803 | 116829808 | + |
| SEQ ID NO 5888 | CCTCAGGCCCTCATCTCCACTG | CTG | chr11 | 116829795 | 116829816 | 116829812 | 116829817 | + |
| SEQ ID NO 5889 | AGGCCCTCATCTCCACTGGTCA | CTC | chr11 | 116829799 | 116829820 | 116829816 | 116829821 | + |
| SEQ ID NO 5890 | ATCTCCACTGGTCAGCAGGTGA | CTC | chr11 | 116829807 | 116829828 | 116829824 | 116829829 | + |
| SEQ ID NO 5891 | CACTGGTCAGCAGGTGACCTTT | CTC | chr11 | 116829812 | 116829833 | 116829829 | 116829834 | + |
| SEQ ID NO 5892 | GTCAGCAGGTGACCTTTGCCCA | CTG | chr11 | 116829817 | 116829838 | 116829834 | 116829839 | + |
| SEQ ID NO 5893 | TGCCCAGCGCCCTGGGTCCTCA | CTT | chr11 | 116829833 | 116829854 | 116829850 | 116829855 | + |
| SEQ ID NO 5894 | GCCCAGCGCCCTGGGTCCTCAG | TTT | chr11 | 116829834 | 116829855 | 116829851 | 116829856 | + |
| SEQ ID NO 5895 | CCCAGCGCCCTGGGTCCTCAGT | TTG | chr11 | 116829835 | 116829856 | 116829852 | 116829857 | + |
| SEQ ID NO 5896 | GGTCCTCAGTGCCTGCTGCCCT | CTG | chr11 | 116829847 | 116829868 | 116829864 | 116829869 | + |
| SEQ ID NO 5897 | AGTGCCTGCTGCCCTGGAGATG | CTC | chr11 | 116829854 | 116829875 | 116829871 | 116829876 | + |
| SEQ ID NO 5898 | CTGCCCTGGAGATGATATAAAA | CTG | chr11 | 116829862 | 116829883 | 116829879 | 116829884 | + |
| SEQ ID NO 5899 | CCCTGGAGATGATATAAAACAG | CTG | chr11 | 116829865 | 116829886 | 116829882 | 116829887 | + |
| SEQ ID NO 5900 | GAGATGATATAAAACAGGTCAG | CTG | chr11 | 116829870 | 116829891 | 116829887 | 116829892 | + |
| SEQ ID NO 5901 | CTGCCTGTCTGCTCAGTTCATC | CTC | chr11 | 116829899 | 116829920 | 116829916 | 116829921 | + |
| SEQ ID NO 5902 | CCTGTCTGCTCAGTTCATCCCT | CTG | chr11 | 116829902 | 116829923 | 116829919 | 116829924 | + |
| SEQ ID NO 5903 | TCTGCTCAGTTCATCCCTAGAG | CTG | chr11 | 116829906 | 116829927 | 116829923 | 116829928 | + |
| SEQ ID NO 5904 | CTCAGTTCATCCCTAGAGGCAG | CTG | chr11 | 116829910 | 116829931 | 116829927 | 116829932 | + |
| SEQ ID NO 5905 | AGTTCATCCCTAGAGGCAGCTG | CTC | chr11 | 116829913 | 116829934 | 116829930 | 116829935 | + |
| SEQ ID NO 5906 | ATCCCTAGAGGCAGCTGCTCCA | TTC | chr11 | 116829918 | 116829939 | 116829935 | 116829940 | + |
| SEQ ID NO 5907 | GAGGCAGCTGCTCCAGGTAATG | CTA | chr11 | 116829925 | 116829946 | 116829942 | 116829947 | + |
| SEQ ID NO 5908 | CTCCAGGTAATGCCCTCTGGGG | CTG | chr11 | 116829935 | 116829956 | 116829952 | 116829957 | + |
| SEQ ID NO 5909 | CAGGTAATGCCCTCTGGGGAGG | CTC | chr11 | 116829938 | 116829959 | 116829955 | 116829960 | + |
| SEQ ID NO 5910 | TGGGGAGGGGAAAGAGGAGGGG | CTC | chr11 | 116829952 | 116829973 | 116829969 | 116829974 | + |
| SEQ ID NO 5911 | GGGAGGGGAAAGAGGAGGGGAG | CTG | chr11 | 116829954 | 116829975 | 116829971 | 116829976 | + |
| SEQ ID NO 5912 | CCTGCCCAGCCCAGCCAGCAAG | CTC | chr11 | 116830003 | 116830024 | 116830020 | 116830025 | + |
| SEQ ID NO 5913 | CCCAGCCCAGCCAGCAAGCCTG | CTG | chr11 | 116830007 | 116830028 | 116830024 | 116830029 | + |
| SEQ ID NO 5914 | GAGAAGCACTTGCTAGAGCTAA | CTG | chr11 | 116830029 | 116830050 | 116830046 | 116830051 | + |
| SEQ ID NO 5915 | GCTAGAGCTAAGGAAGCCTCGG | CTT | chr11 | 116830040 | 116830061 | 116830057 | 116830062 | + |
| SEQ ID NO 5916 | CTAGAGCTAAGGAAGCCTCGGA | TTG | chr11 | 116830041 | 116830062 | 116830058 | 116830063 | + |
| SEQ ID NO 5917 | GAGCTAAGGAAGCCTCGGAGCT | CTA | chr11 | 116830044 | 116830065 | 116830061 | 116830066 | + |
| SEQ ID NO 5918 | AGGAAGCCTCGGAGCTGGACGG | CTA | chr11 | 116830050 | 116830071 | 116830067 | 116830072 | + |
| SEQ ID NO 5919 | GGAGCTGGACGGGTGCCCCCA | CTC | chr11 | 116830060 | 116830081 | 116830077 | 116830082 | + |
| SEQ ID NO 5920 | GACGGGTGCCCCCCACCCCTCA | CTG | chr11 | 116830067 | 116830088 | 116830084 | 116830089 | + |
| SEQ ID NO 5921 | ATCATAACCTGAAGAACATGGA | CTC | chr11 | 116830088 | 116830109 | 116830105 | 116830110 | + |
| SEQ ID NO 5922 | AAGAACATGGAGGCCCGGGAGG | CTG | chr11 | 116830099 | 116830120 | 116830116 | 116830121 | + |
| SEQ ID NO 5923 | GCCCAAAGCTACACAGGGGGTG | CTT | chr11 | 116830131 | 116830152 | 116830148 | 116830153 | + |
| SEQ ID NO 5924 | CCCAAAGCTACACAGGGGGTGG | TTG | chr11 | 116830132 | 116830153 | 116830149 | 116830154 | + |
| SEQ ID NO 5925 | CACAGGGGGTGGGGCTGGAAGT | CTA | chr11 | 116830142 | 116830163 | 116830159 | 116830164 | + |
| SEQ ID NO 5926 | GAAGTGGCTCCAAGTGCAGGTT | CTG | chr11 | 116830159 | 116830180 | 116830176 | 116830181 | + |
| SEQ ID NO 5927 | CAAGTGCAGGTTCCCCCCTCAT | CTC | chr11 | 116830169 | 116830190 | 116830186 | 116830191 | + |
| SEQ ID NO 5928 | CCCCCTCATTCTTCAGGCTTAG | TTC | chr11 | 116830182 | 116830203 | 116830199 | 116830204 | + |
| SEQ ID NO 5929 | ATTCTTCAGGCTTAGGGCTGGA | CTC | chr11 | 116830189 | 116830210 | 116830206 | 116830211 | + |
| SEQ ID NO 5930 | TTCAGGCTTAGGGCTGGAGGAA | TTC | chr11 | 116830193 | 116830214 | 116830210 | 116830215 | + |
| SEQ ID NO 5931 | CAGGCTTAGGGCTGGAGGAAGC | CTT | chr11 | 116830195 | 116830216 | 116830212 | 116830217 | + |
| SEQ ID NO 5932 | AGGCTTAGGGCTGGAGGAAGCC | TTC | chr11 | 116830196 | 116830217 | 116830213 | 116830218 | + |
| SEQ ID NO 5933 | AGGGCTGGAGGAAGCCTTAGAC | CTT | chr11 | 116830202 | 116830223 | 116830219 | 116830224 | + |
| SEQ ID NO 5934 | GGGCTGGAGGAAGCCTTAGACA | TTA | chr11 | 116830203 | 116830224 | 116830220 | 116830225 | + |
| SEQ ID NO 5935 | GAGGAAGCCTTAGACAGCCCAG | CTG | chr11 | 116830209 | 116830230 | 116830226 | 116830231 | + |

Figure 24 (Cont'd)

| | | | | | | | | |
|---|---|---|---|---|---|---|---|---|
| SEQ ID NO 5936 | AGACAGCCCAGTCCTACCCCAG | CTT | chr11 | 116830220 | 116830241 | 116830237 | 116830242 | + |
| SEQ ID NO 5937 | GACAGCCCAGTCCTACCCCAGA | TTA | chr11 | 116830221 | 116830242 | 116830238 | 116830243 | + |
| SEQ ID NO 5938 | CCCCAGACAGGGAAACTGAGGC | CTA | chr11 | 116830236 | 116830257 | 116830253 | 116830258 | + |
| SEQ ID NO 5939 | AGGCCTGGAGAGGGCCAGAAAT | CTG | chr11 | 116830254 | 116830275 | 116830271 | 116830276 | + |
| SEQ ID NO 5940 | GAGAGGGCCAGAAATCACCCAA | CTG | chr11 | 116830261 | 116830282 | 116830278 | 116830283 | + |
| SEQ ID NO 5941 | GCTGGACTGGACGGAGATCAGT | TTG | chr11 | 116830300 | 116830321 | 116830317 | 116830322 | + |
| SEQ ID NO 5942 | GACTGGACGGAGATCAGTCCAG | CTG | chr11 | 116830304 | 116830325 | 116830321 | 116830326 | + |
| SEQ ID NO 5943 | GACGGAGATCAGTCCAGACCGC | CTG | chr11 | 116830309 | 116830330 | 116830326 | 116830331 | + |
| SEQ ID NO 5944 | GATGTTCAGTCTGGTGGGTTTT | CTT | chr11 | 116830340 | 116830361 | 116830357 | 116830362 | + |
| SEQ ID NO 5945 | ATGTTCAGTCTGGTGGGTTTTC | TTG | chr11 | 116830341 | 116830362 | 116830358 | 116830363 | + |
| SEQ ID NO 5946 | AGTCTGGTGGGTTTTCTGCTCC | TTC | chr11 | 116830347 | 116830368 | 116830364 | 116830369 | + |
| SEQ ID NO 5947 | GTGGGTTTTCTGCTCCATCCCA | CTG | chr11 | 116830353 | 116830374 | 116830370 | 116830375 | + |
| SEQ ID NO 5948 | TCTGCTCCATCCCACCCACCTC | TTT | chr11 | 116830361 | 116830382 | 116830378 | 116830383 | + |
| SEQ ID NO 5949 | CTGCTCCATCCCACCCACCTCC | TTT | chr11 | 116830362 | 116830383 | 116830379 | 116830384 | + |
| SEQ ID NO 5950 | TGCTCCATCCCACCCACCTCCC | TTC | chr11 | 116830363 | 116830384 | 116830380 | 116830385 | + |
| SEQ ID NO 5951 | CTCCATCCCACCCACCTCCCTT | CTG | chr11 | 116830365 | 116830386 | 116830382 | 116830387 | + |
| SEQ ID NO 5952 | CATCCCACCCACCTCCCTTTGG | CTC | chr11 | 116830368 | 116830389 | 116830385 | 116830390 | + |
| SEQ ID NO 5953 | CCTTTGGGCCTCGATCCCTCGC | CTC | chr11 | 116830383 | 116830404 | 116830400 | 116830405 | + |
| SEQ ID NO 5954 | TGGGCCTCGATCCCTCGCCCCT | CTT | chr11 | 116830387 | 116830408 | 116830404 | 116830409 | + |
| SEQ ID NO 5955 | GGGCCTCGATCCCTCGCCCCTC | TTT | chr11 | 116830388 | 116830409 | 116830405 | 116830410 | + |
| SEQ ID NO 5956 | GGCCTCGATCCCTCGCCCCTCA | TTG | chr11 | 116830389 | 116830410 | 116830406 | 116830411 | + |
| SEQ ID NO 5957 | GATCCCTCGCCCCTCACCAGTC | CTC | chr11 | 116830395 | 116830416 | 116830412 | 116830417 | + |
| SEQ ID NO 5958 | GCCCCTCACCAGTCCCCCTTCT | CTC | chr11 | 116830403 | 116830424 | 116830420 | 116830425 | + |
| SEQ ID NO 5959 | ACCAGTCCCCCTTCTGAGAGCC | CTC | chr11 | 116830410 | 116830431 | 116830427 | 116830432 | + |
| SEQ ID NO 5960 | CTGAGAGCCCGTATTAGCAGGG | CTT | chr11 | 116830423 | 116830444 | 116830440 | 116830445 | + |
| SEQ ID NO 5961 | TGAGAGCCCGTATTAGCAGGGA | TTC | chr11 | 116830424 | 116830445 | 116830441 | 116830446 | + |
| SEQ ID NO 5962 | AGAGCCCGTATTAGCAGGGAGC | CTG | chr11 | 116830426 | 116830447 | 116830443 | 116830448 | + |
| SEQ ID NO 5963 | GCAGGGAGCGGCCCCTACTCC | TTA | chr11 | 116830439 | 116830460 | 116830456 | 116830461 | + |
| SEQ ID NO 5964 | CTCCTTCTGGCAGACCCAGCTA | CTA | chr11 | 116830457 | 116830478 | 116830474 | 116830479 | + |
| SEQ ID NO 5965 | CTTCTGGCAGACCCAGCTAAGG | CTC | chr11 | 116830460 | 116830481 | 116830477 | 116830482 | + |
| SEQ ID NO 5966 | CTGGCAGACCCAGCTAAGGTTC | CTT | chr11 | 116830463 | 116830484 | 116830480 | 116830485 | + |
| SEQ ID NO 5967 | TGGCAGACCCAGCTAAGGTTCT | TTC | chr11 | 116830464 | 116830485 | 116830481 | 116830486 | + |
| SEQ ID NO 5968 | GCAGACCCAGCTAAGGTTCTAC | CTG | chr11 | 116830466 | 116830487 | 116830483 | 116830488 | + |
| SEQ ID NO 5969 | AGGTTCTACCTTAGGGGCCACG | CTA | chr11 | 116830479 | 116830500 | 116830496 | 116830501 | + |
| SEQ ID NO 5970 | TACCTTAGGGGCCACGCCACCT | TTC | chr11 | 116830485 | 116830506 | 116830502 | 116830507 | + |
| SEQ ID NO 5971 | CCTTAGGGGCCACGCCACCTCC | CTA | chr11 | 116830487 | 116830508 | 116830504 | 116830509 | + |
| SEQ ID NO 5972 | AGGGGCCACGCCACCTCCCCAG | CTT | chr11 | 116830491 | 116830512 | 116830508 | 116830513 | + |
| SEQ ID NO 5973 | GGGGCCACGCCACCTCCCCAGG | TTA | chr11 | 116830492 | 116830513 | 116830509 | 116830514 | + |
| SEQ ID NO 5974 | CCCAGGGAGGGGTCCAGAGGCA | CTC | chr11 | 116830508 | 116830529 | 116830525 | 116830530 | + |
| SEQ ID NO 5975 | GGGTGCCCCTCACAGGACACTT | CTG | chr11 | 116830540 | 116830561 | 116830557 | 116830562 | + |
| SEQ ID NO 5976 | ACAGGACACTTCCTTGCAGGAA | CTC | chr11 | 116830551 | 116830572 | 116830568 | 116830573 | + |
| SEQ ID NO 5977 | CCTTGCAGGAACAGAGGTGCCA | CTT | chr11 | 116830562 | 116830583 | 116830579 | 116830584 | + |
| SEQ ID NO 5978 | CTTGCAGGAACAGAGGTGCCAT | TTC | chr11 | 116830563 | 116830584 | 116830580 | 116830585 | + |
| SEQ ID NO 5979 | GCAGGAACAGAGGTGCCATGCA | CTT | chr11 | 116830566 | 116830587 | 116830583 | 116830588 | + |
| SEQ ID NO 5980 | CAGGAACAGAGGTGCCATGCAG | TTG | chr11 | 116830567 | 116830588 | 116830584 | 116830589 | + |
| SEQ ID NO 5981 | CTTGTTGTTGCCCTCCTGGCGC | CTC | chr11 | 116830601 | 116830622 | 116830618 | 116830623 | + |
| SEQ ID NO 5982 | GTTGTTGCCCTCCTGGCGCTCC | CTT | chr11 | 116830604 | 116830625 | 116830621 | 116830626 | + |
| SEQ ID NO 5983 | TTGTTGCCCTCCTGGCGCTCCT | TTG | chr11 | 116830605 | 116830626 | 116830622 | 116830627 | + |
| SEQ ID NO 5984 | TTGCCCTCCTGGCGCTCCTGGC | TTG | chr11 | 116830608 | 116830629 | 116830625 | 116830630 | + |
| SEQ ID NO 5985 | CCCTCCTGGCGCTCCTGGCCTC | TTG | chr11 | 116830611 | 116830632 | 116830628 | 116830633 | + |
| SEQ ID NO 5986 | CTGGCGCTCCTGGCCTCTGCCC | CTC | chr11 | 116830616 | 116830637 | 116830633 | 116830638 | + |
| SEQ ID NO 5987 | GCGCTCCTGGCCTCTGCCCGTA | CTG | chr11 | 116830619 | 116830640 | 116830636 | 116830641 | + |
| SEQ ID NO 5988 | CTGGCCTCTGCCCGTAAGCACT | CTC | chr11 | 116830625 | 116830646 | 116830642 | 116830647 | + |
| SEQ ID NO 5989 | GCCTCTGCCCGTAAGCACTTGG | CTG | chr11 | 116830628 | 116830649 | 116830645 | 116830650 | + |
| SEQ ID NO 5990 | TGCCCGTAAGCACTTGGTGGGA | CTC | chr11 | 116830633 | 116830654 | 116830650 | 116830655 | + |
| SEQ ID NO 5991 | CCCGTAAGCACTTGGTGGGACT | CTG | chr11 | 116830635 | 116830656 | 116830652 | 116830657 | + |
| SEQ ID NO 5992 | GGTGGGACTGGGCTGGGGCAG | CTT | chr11 | 116830648 | 116830669 | 116830665 | 116830670 | + |
| SEQ ID NO 5993 | GTGGGACTGGGCTGGGGCAGG | TTG | chr11 | 116830649 | 116830670 | 116830666 | 116830671 | + |
| SEQ ID NO 5994 | CCCCAGCCCAGTCCCACCAAG | CTG | chr11 | 116830645 | 116830666 | 116830650 | 116830645 | - |
| SEQ ID NO 5995 | ACGGGCAGAGGCCAGGAGCGCC | CTT | chr11 | 116830618 | 116830639 | 116830623 | 116830618 | - |

Figure 24 (Cont'd)

| | | | | | | | | |
|---|---|---|---|---|---|---|---|---|
| SEQ ID NO 5996 | CGGGCAGAGGCCAGGAGCGCCA | TTA | chr11 | 116830617 | 116830638 | 116830622 | 116830617 | - |
| SEQ ID NO 5997 | CATGGCACCTCTGTTCCTGCAA | CTG | chr11 | 116830564 | 116830585 | 116830569 | 116830564 | - |
| SEQ ID NO 5998 | TGTTCCTGCAAGGAAGTGTCCT | CTC | chr11 | 116830553 | 116830574 | 116830558 | 116830553 | - |
| SEQ ID NO 5999 | TTCCTGCAAGGAAGTGTCCTGT | CTG | chr11 | 116830551 | 116830572 | 116830556 | 116830551 | - |
| SEQ ID NO 6000 | CTGCAAGGAAGTGTCCTGTGAG | TTC | chr11 | 116830548 | 116830569 | 116830553 | 116830548 | - |
| SEQ ID NO 6001 | CAAGGAAGTGTCCTGTGAGGGG | CTG | chr11 | 116830545 | 116830566 | 116830550 | 116830545 | - |
| SEQ ID NO 6002 | TGAGGGGCACCCCAGGTCCCCA | CTG | chr11 | 116830530 | 116830551 | 116830535 | 116830530 | - |
| SEQ ID NO 6003 | TGGACCCCTCCCTGGGGAGGTG | CTC | chr11 | 116830502 | 116830523 | 116830507 | 116830502 | - |
| SEQ ID NO 6004 | GACCCCTCCCTGGGGAGGTGGC | CTG | chr11 | 116830500 | 116830521 | 116830505 | 116830500 | - |
| SEQ ID NO 6005 | CCTGGGGAGGTGGCGTGGCCCC | CTC | chr11 | 116830492 | 116830513 | 116830497 | 116830492 | - |
| SEQ ID NO 6006 | GGGAGGTGGCGTGGCCCCTAAG | CTG | chr11 | 116830488 | 116830509 | 116830493 | 116830488 | - |
| SEQ ID NO 6007 | AGGTAGAACCTTAGCTGGGTCT | CTA | chr11 | 116830468 | 116830489 | 116830473 | 116830468 | - |
| SEQ ID NO 6008 | AGCTGGGTCTGCCAGAAGGAGT | CTT | chr11 | 116830456 | 116830477 | 116830461 | 116830456 | - |
| SEQ ID NO 6009 | GCTGGGTCTGCCAGAAGGAGTA | TTA | chr11 | 116830455 | 116830476 | 116830460 | 116830455 | - |
| SEQ ID NO 6010 | GGTCTGCCAGAAGGAGTAGGGG | CTG | chr11 | 116830451 | 116830472 | 116830456 | 116830451 | - |
| SEQ ID NO 6011 | CCAGAAGGAGTAGGGGCCGGCT | CTG | chr11 | 116830445 | 116830466 | 116830450 | 116830445 | - |
| SEQ ID NO 6012 | CCTGCTAATACGGGCTCTCAGA | CTC | chr11 | 116830422 | 116830443 | 116830427 | 116830422 | - |
| SEQ ID NO 6013 | CTAATACGGGCTCTCAGAAGGG | CTG | chr11 | 116830418 | 116830439 | 116830423 | 116830418 | - |
| SEQ ID NO 6014 | ATACGGGCTCTCAGAAGGGGGA | CTA | chr11 | 116830415 | 116830436 | 116830420 | 116830415 | - |
| SEQ ID NO 6015 | TCAGAAGGGGGACTGGTGAGGG | CTC | chr11 | 116830405 | 116830426 | 116830410 | 116830405 | - |
| SEQ ID NO 6016 | AGAAGGGGGACTGGTGAGGGGC | CTC | chr11 | 116830403 | 116830424 | 116830408 | 116830403 | - |
| SEQ ID NO 6017 | GTGAGGGGCGAGGGATCGAGGC | CTG | chr11 | 116830390 | 116830411 | 116830395 | 116830390 | - |
| SEQ ID NO 6018 | AACATCAAGGCACCTGCGGTCT | CTG | chr11 | 116830324 | 116830345 | 116830329 | 116830324 | - |
| SEQ ID NO 6019 | CGGTCTGGACTGATCTCCGTCC | CTG | chr11 | 116830308 | 116830329 | 116830313 | 116830308 | - |
| SEQ ID NO 6020 | GACTGATCTCCGTCCAGTCCAG | CTG | chr11 | 116830301 | 116830322 | 116830306 | 116830301 | - |
| SEQ ID NO 6021 | ATCTCCGTCCAGTCCAGCCAAC | CTG | chr11 | 116830296 | 116830317 | 116830301 | 116830296 | - |
| SEQ ID NO 6022 | CGTCCAGTCCAGCCAACATGCT | CTC | chr11 | 116830291 | 116830312 | 116830296 | 116830291 | - |
| SEQ ID NO 6023 | TGTGTCTTTGGGTGATTTCTGG | CTG | chr11 | 116830268 | 116830289 | 116830273 | 116830268 | - |
| SEQ ID NO 6024 | TGGGTGATTTCTGGCCCTCTCC | CTT | chr11 | 116830260 | 116830281 | 116830265 | 116830260 | - |
| SEQ ID NO 6025 | GGGTGATTTCTGGCCCTCTCCA | TTT | chr11 | 116830259 | 116830280 | 116830264 | 116830259 | - |
| SEQ ID NO 6026 | GGTGATTTCTGGCCCTCTCCAG | TTG | chr11 | 116830258 | 116830279 | 116830263 | 116830258 | - |
| SEQ ID NO 6027 | CTGGCCCTCTCCAGGCCTCAGT | TTT | chr11 | 116830250 | 116830271 | 116830255 | 116830250 | - |
| SEQ ID NO 6028 | TGGCCCTCTCCAGGCCTCAGTT | TTC | chr11 | 116830249 | 116830270 | 116830254 | 116830249 | - |
| SEQ ID NO 6029 | GCCCTCTCCAGGCCTCAGTTTC | CTG | chr11 | 116830247 | 116830268 | 116830252 | 116830247 | - |
| SEQ ID NO 6030 | TCCAGGCCTCAGTTTCCTGTC | CTC | chr11 | 116830241 | 116830262 | 116830246 | 116830241 | - |
| SEQ ID NO 6031 | CAGGCCTCAGTTTCCTGTCTG | CTC | chr11 | 116830239 | 116830260 | 116830244 | 116830239 | - |
| SEQ ID NO 6032 | AGTTTCCTGTCTGGGGTAGGA | CTC | chr11 | 116830231 | 116830252 | 116830236 | 116830231 | - |
| SEQ ID NO 6033 | CCCTGTCTGGGGTAGGACTGGG | TTT | chr11 | 116830226 | 116830247 | 116830231 | 116830226 | - |
| SEQ ID NO 6034 | CCTGTCTGGGGTAGGACTGGGC | TTC | chr11 | 116830225 | 116830246 | 116830230 | 116830225 | - |
| SEQ ID NO 6035 | TCTGGGGTAGGACTGGGCTGTC | CTG | chr11 | 116830221 | 116830242 | 116830226 | 116830221 | - |
| SEQ ID NO 6036 | GGGTAGGACTGGGCTGTCTAAG | CTG | chr11 | 116830217 | 116830238 | 116830222 | 116830217 | - |
| SEQ ID NO 6037 | GGCTGTCTAAGGCTTCCTCCAG | CTG | chr11 | 116830206 | 116830227 | 116830211 | 116830206 | - |
| SEQ ID NO 6038 | TCTAAGGCTTCCTCCAGCCCTA | CTG | chr11 | 116830201 | 116830222 | 116830206 | 116830201 | - |
| SEQ ID NO 6039 | AGGCTTCCTCCAGCCCTAAGCC | CTA | chr11 | 116830197 | 116830218 | 116830202 | 116830197 | - |
| SEQ ID NO 6040 | CCTCCAGCCCTAAGCCTGAAGA | CTT | chr11 | 116830191 | 116830212 | 116830196 | 116830191 | - |
| SEQ ID NO 6041 | CTCCAGCCCTAAGCCTGAAGAA | TTC | chr11 | 116830190 | 116830211 | 116830195 | 116830190 | - |
| SEQ ID NO 6042 | CAGCCCTAAGCCTGAAGAATGA | CTC | chr11 | 116830187 | 116830208 | 116830192 | 116830187 | - |
| SEQ ID NO 6043 | AGCCTGAAGAATGAGGGGGGAA | CTA | chr11 | 116830179 | 116830200 | 116830184 | 116830179 | - |
| SEQ ID NO 6044 | AAGAATGAGGGGGGAACCTGCA | CTG | chr11 | 116830173 | 116830194 | 116830178 | 116830173 | - |
| SEQ ID NO 6045 | CACTTGGAGCCACTTCCAGCCC | CTG | chr11 | 116830153 | 116830174 | 116830158 | 116830153 | - |
| SEQ ID NO 6046 | GGAGCCACTTCCAGCCCCACCC | CTT | chr11 | 116830148 | 116830169 | 116830153 | 116830148 | - |
| SEQ ID NO 6047 | GAGCCACTTCCAGCCCCACCCC | TTG | chr11 | 116830147 | 116830168 | 116830152 | 116830147 | - |
| SEQ ID NO 6048 | CCAGCCCCACCCCCTGTGTAGC | CTT | chr11 | 116830138 | 116830159 | 116830143 | 116830138 | - |
| SEQ ID NO 6049 | CAGCCCCACCCCCTGTGTAGCT | TTC | chr11 | 116830137 | 116830158 | 116830142 | 116830137 | - |
| SEQ ID NO 6050 | TGTAGCTTTGGGCAAGTGACAC | CTG | chr11 | 116830122 | 116830143 | 116830127 | 116830122 | - |
| SEQ ID NO 6051 | TGGGCAAGTGACACCCCTCCCG | CTT | chr11 | 116830114 | 116830135 | 116830119 | 116830114 | - |
| SEQ ID NO 6052 | GGGCAAGTGACACCCCTCCCGG | TTT | chr11 | 116830113 | 116830134 | 116830118 | 116830113 | - |
| SEQ ID NO 6053 | GGCAAGTGACACCCCTCCCGGG | TTG | chr11 | 116830112 | 116830133 | 116830117 | 116830112 | - |
| SEQ ID NO 6054 | CCGGGCCTCCATGTTCTTCAGG | CTC | chr11 | 116830095 | 116830116 | 116830100 | 116830095 | - |
| SEQ ID NO 6055 | CATGTTCTTCAGGTTATGATGA | CTC | chr11 | 116830086 | 116830107 | 116830091 | 116830086 | - |

Figure 24 (Cont'd)

| | | | | | | | | |
|---|---|---|---|---|---|---|---|---|
| SEQ ID NO 6056 | TTCAGGTTATGATGAGGGGTGG | TTC | chr11 | 116830079 | 116830100 | 116830084 | 116830079 | - |
| SEQ ID NO 6057 | CAGGTTATGATGAGGGGTGGGG | CTT | chr11 | 116830077 | 116830098 | 116830082 | 116830077 | - |
| SEQ ID NO 6058 | AGGTTATGATGAGGGGTGGGG | TTC | chr11 | 116830076 | 116830097 | 116830081 | 116830076 | - |
| SEQ ID NO 6059 | TGATGAGGGGTGGGGGCACCC | TTA | chr11 | 116830070 | 116830091 | 116830075 | 116830070 | - |
| SEQ ID NO 6060 | CGAGGCTTCCTTAGCTCTAGCA | CTC | chr11 | 116830039 | 116830060 | 116830044 | 116830039 | - |
| SEQ ID NO 6061 | CCTTAGCTCTAGCAAGTGCTTC | CTT | chr11 | 116830031 | 116830052 | 116830036 | 116830031 | - |
| SEQ ID NO 6062 | CTTAGCTCTAGCAAGTGCTTCT | TTC | chr11 | 116830030 | 116830051 | 116830035 | 116830030 | - |
| SEQ ID NO 6063 | AGCTCTAGCAAGTGCTTCTCCA | CTT | chr11 | 116830027 | 116830048 | 116830032 | 116830027 | - |
| SEQ ID NO 6064 | GCTCTAGCAAGTGCTTCTCCAG | TTA | chr11 | 116830026 | 116830047 | 116830031 | 116830026 | - |
| SEQ ID NO 6065 | TAGCAAGTGCTTCTCCAGGCTT | CTC | chr11 | 116830022 | 116830043 | 116830027 | 116830022 | - |
| SEQ ID NO 6066 | GCAAGTGCTTCTCCAGGCTTGC | CTA | chr11 | 116830020 | 116830041 | 116830025 | 116830020 | - |
| SEQ ID NO 6067 | CTCCAGGCTTGCTGGCTGGGCT | CTT | chr11 | 116830010 | 116830031 | 116830015 | 116830010 | - |
| SEQ ID NO 6068 | TCCAGGCTTGCTGGCTGGGCTG | TTC | chr11 | 116830009 | 116830030 | 116830014 | 116830009 | - |
| SEQ ID NO 6069 | CAGGCTTGCTGGCTGGGCTGGG | CTC | chr11 | 116830007 | 116830028 | 116830012 | 116830007 | - |
| SEQ ID NO 6070 | GCTGGCTGGGCTGGGCAGGGAG | CTT | chr11 | 116830000 | 116830021 | 116830005 | 116830000 | - |
| SEQ ID NO 6071 | CTGGCTGGGCTGGGCAGGGAGC | TTG | chr11 | 116829999 | 116830020 | 116830004 | 116829999 | - |
| SEQ ID NO 6072 | GCTGGGCTGGGCAGGGAGCTCC | CTG | chr11 | 116829996 | 116830017 | 116830001 | 116829996 | - |
| SEQ ID NO 6073 | GGCTGGGCAGGGAGCTCCTCTT | CTG | chr11 | 116829992 | 116830013 | 116829997 | 116829992 | - |
| SEQ ID NO 6074 | GGCAGGGAGCTCCTCTTGCCCC | CTG | chr11 | 116829987 | 116830008 | 116829992 | 116829987 | - |
| SEQ ID NO 6075 | CTCTTGCCCCTCTTCATCCTCC | CTC | chr11 | 116829975 | 116829996 | 116829980 | 116829975 | - |
| SEQ ID NO 6076 | TTGCCCCTCTTCATCCTCCTCC | CTC | chr11 | 116829972 | 116829993 | 116829977 | 116829972 | - |
| SEQ ID NO 6077 | GCCCCTCTTCATCCTCCTCCCC | CTT | chr11 | 116829970 | 116829991 | 116829975 | 116829970 | - |
| SEQ ID NO 6078 | CCCCTCTTCATCCTCCTCCCCT | TTG | chr11 | 116829969 | 116829990 | 116829974 | 116829969 | - |
| SEQ ID NO 6079 | TTCATCCTCCTCCCCTCCTCTT | CTC | chr11 | 116829963 | 116829984 | 116829968 | 116829963 | - |
| SEQ ID NO 6080 | CATCCTCCTCCCCTCCTCTTTC | CTT | chr11 | 116829961 | 116829982 | 116829966 | 116829961 | - |
| SEQ ID NO 6081 | ATCCTCCTCCCCTCCTCTTTCC | TTC | chr11 | 116829960 | 116829981 | 116829965 | 116829960 | - |
| SEQ ID NO 6082 | CTCCCCTCCTCTTTCCCCTCCC | CTC | chr11 | 116829954 | 116829975 | 116829959 | 116829954 | - |
| SEQ ID NO 6083 | CCCTCCTCTTTCCCCTCCCCAG | CTC | chr11 | 116829951 | 116829972 | 116829956 | 116829951 | - |
| SEQ ID NO 6084 | CTCTTTCCCCTCCCCAGAGGGC | CTC | chr11 | 116829946 | 116829967 | 116829951 | 116829946 | - |
| SEQ ID NO 6085 | TTTCCCCTCCCCAGAGGGCATT | CTC | chr11 | 116829943 | 116829964 | 116829948 | 116829943 | - |
| SEQ ID NO 6086 | TCCCCTCCCCAGAGGGCATTAC | CTT | chr11 | 116829941 | 116829962 | 116829946 | 116829941 | - |
| SEQ ID NO 6087 | CCCCTCCCCAGAGGGCATTACC | TTT | chr11 | 116829940 | 116829961 | 116829945 | 116829940 | - |
| SEQ ID NO 6088 | CCCTCCCCAGAGGGCATTACCT | TTC | chr11 | 116829939 | 116829960 | 116829944 | 116829939 | - |
| SEQ ID NO 6089 | CCCAGAGGGCATTACCTGGAGC | CTC | chr11 | 116829934 | 116829955 | 116829939 | 116829934 | - |
| SEQ ID NO 6090 | CCTGGAGCAGCTGCCTCTAGGG | TTA | chr11 | 116829920 | 116829941 | 116829925 | 116829920 | - |
| SEQ ID NO 6091 | GAGCAGCTGCCTCTAGGGATGA | CTG | chr11 | 116829916 | 116829937 | 116829921 | 116829916 | - |
| SEQ ID NO 6092 | CCTCTAGGGATGAACTGAGCAG | CTG | chr11 | 116829907 | 116829928 | 116829912 | 116829907 | - |
| SEQ ID NO 6093 | TAGGGATGAACTGAGCAGACAG | CTC | chr11 | 116829903 | 116829924 | 116829908 | 116829903 | - |
| SEQ ID NO 6094 | GGGATGAACTGAGCAGACAGGC | CTA | chr11 | 116829901 | 116829922 | 116829906 | 116829901 | - |
| SEQ ID NO 6095 | AGCAGACAGGCAGGAGGGTTCT | CTG | chr11 | 116829890 | 116829911 | 116829895 | 116829890 | - |
| SEQ ID NO 6096 | TGACCTGTTTTATATCATCTCC | TTC | chr11 | 116829869 | 116829890 | 116829874 | 116829869 | - |
| SEQ ID NO 6097 | ACCTGTTTTATATCATCTCCAG | CTG | chr11 | 116829867 | 116829888 | 116829872 | 116829867 | - |
| SEQ ID NO 6098 | TTTTATATCATCTCCAGGGCAG | CTG | chr11 | 116829862 | 116829883 | 116829867 | 116829862 | - |
| SEQ ID NO 6099 | TATATCATCTCCAGGGCAGCAG | TTT | chr11 | 116829859 | 116829880 | 116829864 | 116829859 | - |
| SEQ ID NO 6100 | ATATCATCTCCAGGGCAGCAGG | TTT | chr11 | 116829858 | 116829879 | 116829863 | 116829858 | - |
| SEQ ID NO 6101 | TATCATCTCCAGGGCAGCAGGC | TTA | chr11 | 116829857 | 116829878 | 116829862 | 116829857 | - |
| SEQ ID NO 6102 | CAGGGCAGCAGGCACTGAGGAC | CTC | chr11 | 116829848 | 116829869 | 116829853 | 116829848 | - |
| SEQ ID NO 6103 | AGGACCCAGGGCGCTGGGCAAA | CTG | chr11 | 116829831 | 116829852 | 116829836 | 116829831 | - |
| SEQ ID NO 6104 | GGCAAAGGTCACCTGCTGACCA | CTG | chr11 | 116829815 | 116829836 | 116829820 | 116829815 | - |
| SEQ ID NO 6105 | CTGACCAGTGGAGATGAGGGCC | CTG | chr11 | 116829800 | 116829821 | 116829805 | 116829800 | - |
| SEQ ID NO 6106 | ACCAGTGGAGATGAGGGCCTGA | CTG | chr11 | 116829797 | 116829818 | 116829802 | 116829797 | - |
| SEQ ID NO 6107 | AGGCAGGGTGTCCAGATGCAGC | CTG | chr11 | 116829776 | 116829797 | 116829781 | 116829776 | - |
| SEQ ID NO 6108 | GGAAATCCCTAGGAGACTGAGT | TTG | chr11 | 116829736 | 116829757 | 116829741 | 116829736 | - |

Figure 25

| # | Sequence | PAM | chr17 | Start | End | Cuts 5' of | Str |
|---|---|---|---|---|---|---|---|
| SEQ ID NO 6109 | TACCCCTTGCCCATCCCTGC | TGG | chr17 | 7108733 | 7108752 | 7108749 | + |
| SEQ ID NO 6110 | GGCCCCGTGACCCTCACTT | TGG | chr17 | 7108754 | 7108773 | 7108770 | + |
| SEQ ID NO 6111 | GCCCCGTGACCCTCACTTT | GGG | chr17 | 7108755 | 7108774 | 7108771 | + |
| SEQ ID NO 6112 | GTGACCCTCACTTTGGGACC | CAG | chr17 | 7108761 | 7108780 | 7108777 | + |
| SEQ ID NO 6113 | CACTTTGGGACCCAGTCACA | CAG | chr17 | 7108769 | 7108788 | 7108785 | + |
| SEQ ID NO 6114 | CCAGTCACACAGATGACCAC | CAG | chr17 | 7108780 | 7108799 | 7108796 | + |
| SEQ ID NO 6115 | GTCACACAGATGACCACCAG | CAG | chr17 | 7108783 | 7108802 | 7108799 | + |
| SEQ ID NO 6116 | ACACAGATGACCACCAGCAG | CAG | chr17 | 7108786 | 7108805 | 7108802 | + |
| SEQ ID NO 6117 | CACAGATGACCACCAGCAGC | AGG | chr17 | 7108787 | 7108806 | 7108803 | + |
| SEQ ID NO 6118 | CCACCAGCAGCAGGATGTTG | AAG | chr17 | 7108796 | 7108815 | 7108812 | + |
| SEQ ID NO 6119 | AGCAGCAGGATGTTGAAGCT | CAG | chr17 | 7108801 | 7108820 | 7108817 | + |
| SEQ ID NO 6120 | GCAGCAGGATGTTGAAGCTC | AGG | chr17 | 7108802 | 7108821 | 7108818 | + |
| SEQ ID NO 6121 | CAGCAGGATGTTGAAGCTCA | GGG | chr17 | 7108803 | 7108822 | 7108819 | + |
| SEQ ID NO 6122 | AGGATGTTGAAGCTCAGGGC | AAG | chr17 | 7108807 | 7108826 | 7108823 | + |
| SEQ ID NO 6123 | ATGTTGAAGCTCAGGGCAAG | CAG | chr17 | 7108810 | 7108829 | 7108826 | + |
| SEQ ID NO 6124 | AGCTCAGGGCAAGCAGACTG | AAG | chr17 | 7108817 | 7108836 | 7108833 | + |
| SEQ ID NO 6125 | TCAGGGCAAGCAGACTGAAG | CAG | chr17 | 7108820 | 7108839 | 7108836 | + |
| SEQ ID NO 6126 | AAGCAGACTGAAGCAGACCA | TGG | chr17 | 7108827 | 7108846 | 7108843 | + |
| SEQ ID NO 6127 | GCAGACTGAAGCAGACCATG | GAG | chr17 | 7108829 | 7108848 | 7108845 | + |
| SEQ ID NO 6128 | GACTGAAGCAGACCATGGAG | CAG | chr17 | 7108832 | 7108851 | 7108848 | + |
| SEQ ID NO 6129 | CTGAAGCAGACCATGGAGCA | GAG | chr17 | 7108834 | 7108853 | 7108850 | + |
| SEQ ID NO 6130 | ATGGAGCAGAGACGCTGTGC | CAG | chr17 | 7108846 | 7108865 | 7108862 | + |
| SEQ ID NO 6131 | TGGAGCAGAGACGCTGTGCC | AGG | chr17 | 7108847 | 7108866 | 7108863 | + |
| SEQ ID NO 6132 | GGAGCAGAGACGCTGTGCCA | GGG | chr17 | 7108848 | 7108867 | 7108864 | + |
| SEQ ID NO 6133 | GAGCAGAGACGCTGTGCCAG | GGG | chr17 | 7108849 | 7108868 | 7108865 | + |
| SEQ ID NO 6134 | AGAGACGCTGTGCCAGGGGC | TGG | chr17 | 7108853 | 7108872 | 7108869 | + |
| SEQ ID NO 6135 | GAGACGCTGTGCCAGGGGCT | GGG | chr17 | 7108854 | 7108873 | 7108870 | + |
| SEQ ID NO 6136 | ACGCTGTGCCAGGGGCTGGG | CAG | chr17 | 7108857 | 7108876 | 7108873 | + |
| SEQ ID NO 6137 | CGCTGTGCCAGGGGCTGGGC | AGG | chr17 | 7108858 | 7108877 | 7108874 | + |
| SEQ ID NO 6138 | CTGTGCCAGGGGCTGGGCAG | GAG | chr17 | 7108860 | 7108879 | 7108876 | + |
| SEQ ID NO 6139 | TGTGCCAGGGGCTGGGCAGG | AGG | chr17 | 7108861 | 7108880 | 7108877 | + |
| SEQ ID NO 6140 | GCCAGGGGCTGGGCAGGAGG | TGG | chr17 | 7108864 | 7108883 | 7108880 | + |
| SEQ ID NO 6141 | CTGGGCAGGAGGTGGCCCTG | TGG | chr17 | 7108872 | 7108891 | 7108888 | + |
| SEQ ID NO 6142 | TGGGCAGGAGGTGGCCCTGT | GGG | chr17 | 7108873 | 7108892 | 7108889 | + |
| SEQ ID NO 6143 | GGCAGGAGGTGGCCCTGTGG | GAG | chr17 | 7108875 | 7108894 | 7108891 | + |
| SEQ ID NO 6144 | CAGGAGGTGGCCCTGTGGGA | GAG | chr17 | 7108877 | 7108896 | 7108893 | + |
| SEQ ID NO 6145 | AGGAGGTGGCCCTGTGGGAG | AGG | chr17 | 7108878 | 7108897 | 7108894 | + |
| SEQ ID NO 6146 | GGAGGTGGCCCTGTGGGAGA | GGG | chr17 | 7108879 | 7108898 | 7108895 | + |
| SEQ ID NO 6147 | GAGGTGGCCCTGTGGGAGAG | GGG | chr17 | 7108880 | 7108899 | 7108896 | + |
| SEQ ID NO 6148 | GCCCTGTGGGAGAGGGGCAT | CAG | chr17 | 7108886 | 7108905 | 7108902 | + |
| SEQ ID NO 6149 | CCCTGTGGGAGAGGGGCATC | AGG | chr17 | 7108887 | 7108906 | 7108903 | + |
| SEQ ID NO 6150 | CTGTGGGAGAGGGGCATCAG | GAG | chr17 | 7108889 | 7108908 | 7108905 | + |
| SEQ ID NO 6151 | GGGAGAGGGGCATCAGGAGC | CGG | chr17 | 7108893 | 7108912 | 7108909 | + |
| SEQ ID NO 6152 | AGAGGGGCATCAGGAGCCGG | CAG | chr17 | 7108896 | 7108915 | 7108912 | + |
| SEQ ID NO 6153 | GGCATCAGGAGCCGGCAGCC | TGG | chr17 | 7108901 | 7108920 | 7108917 | + |
| SEQ ID NO 6154 | GCATCAGGAGCCGGCAGCCT | GGG | chr17 | 7108902 | 7108921 | 7108918 | + |

Figure 25 (Cont'd)

| | | | | | | | |
|---|---|---|---|---|---|---|---|
| SEQ ID NO 6155 | AGGAGCCGGCAGCCTGGGTG | TGG | chr17 | 7108907 | 7108926 | 7108923 | + |
| SEQ ID NO 6156 | GGAGCCGGCAGCCTGGGTGT | GGG | chr17 | 7108908 | 7108927 | 7108924 | + |
| SEQ ID NO 6157 | GAGCCGGCAGCCTGGGTGTG | GGG | chr17 | 7108909 | 7108928 | 7108925 | + |
| SEQ ID NO 6158 | GCCGGCAGCCTGGGTGTGGG | GAG | chr17 | 7108911 | 7108930 | 7108927 | + |
| SEQ ID NO 6159 | GCAGCCTGGGTGTGGGGAGC | CGG | chr17 | 7108915 | 7108934 | 7108931 | + |
| SEQ ID NO 6160 | AGCCTGGGTGTGGGGAGCCG | GAG | chr17 | 7108917 | 7108936 | 7108933 | + |
| SEQ ID NO 6161 | GCCTGGGTGTGGGGAGCCGG | AGG | chr17 | 7108918 | 7108937 | 7108934 | + |
| SEQ ID NO 6162 | CCTGGGTGTGGGGAGCCGGA | GGG | chr17 | 7108919 | 7108938 | 7108935 | + |
| SEQ ID NO 6163 | GTGTGGGGAGCCGGAGGGTA | AAG | chr17 | 7108924 | 7108943 | 7108940 | + |
| SEQ ID NO 6164 | GGGGAGCCGGAGGGTAAAGA | CAG | chr17 | 7108928 | 7108947 | 7108944 | + |
| SEQ ID NO 6165 | GGGAGCCGGAGGGTAAAGAC | AGG | chr17 | 7108929 | 7108948 | 7108945 | + |
| SEQ ID NO 6166 | GGAGCCGGAGGGTAAAGACA | GGG | chr17 | 7108930 | 7108949 | 7108946 | + |
| SEQ ID NO 6167 | AGGGTAAAGACAGGGCACCG | AAG | chr17 | 7108938 | 7108957 | 7108954 | + |
| SEQ ID NO 6168 | AAGACAGGGCACCGAAGCCT | GAG | chr17 | 7108944 | 7108963 | 7108960 | + |
| SEQ ID NO 6169 | AGACAGGGCACCGAAGCCTG | AGG | chr17 | 7108945 | 7108964 | 7108961 | + |
| SEQ ID NO 6170 | ACAGGGCACCGAAGCCTGAG | GAG | chr17 | 7108947 | 7108966 | 7108963 | + |
| SEQ ID NO 6171 | CAGGGCACCGAAGCCTGAGG | AGG | chr17 | 7108948 | 7108967 | 7108964 | + |
| SEQ ID NO 6172 | AAGCCTGAGGAGGCATAACC | TGG | chr17 | 7108958 | 7108977 | 7108974 | + |
| SEQ ID NO 6173 | AGCCTGAGGAGGCATAACCT | GGG | chr17 | 7108959 | 7108978 | 7108975 | + |
| SEQ ID NO 6174 | CTGAGGAGGCATAACCTGGG | CGG | chr17 | 7108962 | 7108981 | 7108978 | + |
| SEQ ID NO 6175 | TGAGGAGGCATAACCTGGGC | GGG | chr17 | 7108963 | 7108982 | 7108979 | + |
| SEQ ID NO 6176 | GAGGAGGCATAACCTGGGCG | GGG | chr17 | 7108964 | 7108983 | 7108980 | + |
| SEQ ID NO 6177 | AGGAGGCATAACCTGGGCGG | GGG | chr17 | 7108965 | 7108984 | 7108981 | + |
| SEQ ID NO 6178 | GGAGGCATAACCTGGGCGGG | GGG | chr17 | 7108966 | 7108985 | 7108982 | + |
| SEQ ID NO 6179 | CATAACCTGGGCGGGGGAT | TGG | chr17 | 7108971 | 7108990 | 7108987 | + |
| SEQ ID NO 6180 | ACCTGGGCGGGGGATTGGT | TGG | chr17 | 7108975 | 7108994 | 7108991 | + |
| SEQ ID NO 6181 | CCTGGGCGGGGGATTGGTT | GGG | chr17 | 7108976 | 7108995 | 7108992 | + |
| SEQ ID NO 6182 | CTGGGCGGGGGATTGGTTG | GGG | chr17 | 7108977 | 7108996 | 7108993 | + |
| SEQ ID NO 6183 | GGGGGGATTGGTTGGGGCCA | TGG | chr17 | 7108983 | 7109002 | 7108999 | + |
| SEQ ID NO 6184 | GGGGGATTGGTTGGGGCCAT | GGG | chr17 | 7108984 | 7109003 | 7109000 | + |
| SEQ ID NO 6185 | GGGGATTGGTTGGGGCCATG | GGG | chr17 | 7108985 | 7109004 | 7109001 | + |
| SEQ ID NO 6186 | GGGATTGGTTGGGGCCATGG | GGG | chr17 | 7108986 | 7109005 | 7109002 | + |
| SEQ ID NO 6187 | GGATTGGTTGGGGCCATGGG | GGG | chr17 | 7108987 | 7109006 | 7109003 | + |
| SEQ ID NO 6188 | GATTGGTTGGGGCCATGGGG | GGG | chr17 | 7108988 | 7109007 | 7109004 | + |
| SEQ ID NO 6189 | ATTGGTTGGGGCCATGGGGG | GGG | chr17 | 7108989 | 7109008 | 7109005 | + |
| SEQ ID NO 6190 | TTGGTTGGGGCCATGGGGGG | GGG | chr17 | 7108990 | 7109009 | 7109006 | + |
| SEQ ID NO 6191 | GCCATGGGGGGGGTCATCA | TAG | chr17 | 7108999 | 7109018 | 7109015 | + |
| SEQ ID NO 6192 | CCATGGGGGGGGTCATCAT | AGG | chr17 | 7109000 | 7109019 | 7109016 | + |
| SEQ ID NO 6193 | GTCATCATAGGCTTTGACCC | CAG | chr17 | 7109012 | 7109031 | 7109028 | + |
| SEQ ID NO 6194 | AGGCTTTGACCCCAGCATTT | GAG | chr17 | 7109020 | 7109039 | 7109036 | + |
| SEQ ID NO 6195 | CATGTATAAATATACACACG | CAG | chr17 | 7109082 | 7109101 | 7109098 | + |
| SEQ ID NO 6196 | ATATACACGCAGCTAATC | TGG | chr17 | 7109091 | 7109110 | 7109107 | + |
| SEQ ID NO 6197 | ACACCCATGCACACGACT | CAG | chr17 | 7109119 | 7109138 | 7109135 | + |
| SEQ ID NO 6198 | CACACCCATGCACACGACTC | AGG | chr17 | 7109120 | 7109139 | 7109136 | + |
| SEQ ID NO 6199 | ACGACTCAGGATATTCACAT | CAG | chr17 | 7109133 | 7109152 | 7109149 | + |
| SEQ ID NO 6200 | ATTCACATCAGCTGTGTGCA | AAG | chr17 | 7109145 | 7109164 | 7109161 | + |
| SEQ ID NO 6201 | CATCAGCTGTGTGCAAAGCC | CGG | chr17 | 7109150 | 7109169 | 7109166 | + |

Figure 25 (Cont'd)

| | | | | | | | |
|---|---|---|---|---|---|---|---|
| SEQ ID NO 6202 | TGTGTGCAAAGCCCGGATCC | TGG | chr17 | 7109157 | 7109176 | 7109173 | + |
| SEQ ID NO 6203 | TGTGCAAAGCCCGGATCCTG | GAG | chr17 | 7109159 | 7109178 | 7109175 | + |
| SEQ ID NO 6204 | CAAAGCCCGGATCCTGGAGC | TGG | chr17 | 7109163 | 7109182 | 7109179 | + |
| SEQ ID NO 6205 | AAAGCCCGGATCCTGGAGCT | GGG | chr17 | 7109164 | 7109183 | 7109180 | + |
| SEQ ID NO 6206 | AAGCCCGGATCCTGGAGCTG | GGG | chr17 | 7109165 | 7109184 | 7109181 | + |
| SEQ ID NO 6207 | AGCCCGGATCCTGGAGCTGG | GGG | chr17 | 7109166 | 7109185 | 7109182 | + |
| SEQ ID NO 6208 | GGATCCTGGAGCTGGGGGAC | TGG | chr17 | 7109171 | 7109190 | 7109187 | + |
| SEQ ID NO 6209 | GATCCTGGAGCTGGGGGACT | GGG | chr17 | 7109172 | 7109191 | 7109188 | + |
| SEQ ID NO 6210 | TCCTGGAGCTGGGGGACTGG | GAG | chr17 | 7109174 | 7109193 | 7109190 | + |
| SEQ ID NO 6211 | CTGGGGGACTGGGAGACGCA | CAG | chr17 | 7109182 | 7109201 | 7109198 | + |
| SEQ ID NO 6212 | TGGGGGACTGGGAGACGCAC | AGG | chr17 | 7109183 | 7109202 | 7109199 | + |
| SEQ ID NO 6213 | GGGGGACTGGGAGACGCACA | GGG | chr17 | 7109184 | 7109203 | 7109200 | + |
| SEQ ID NO 6214 | GGGGACTGGGAGACGCACAG | GGG | chr17 | 7109185 | 7109204 | 7109201 | + |
| SEQ ID NO 6215 | GGGACTGGGAGACGCACAGG | GGG | chr17 | 7109186 | 7109205 | 7109202 | + |
| SEQ ID NO 6216 | ACTGGGAGACGCACAGGGGG | CGG | chr17 | 7109189 | 7109208 | 7109205 | + |
| SEQ ID NO 6217 | CTGGGAGACGCACAGGGGGC | GGG | chr17 | 7109190 | 7109209 | 7109206 | + |
| SEQ ID NO 6218 | TGGGAGACGCACAGGGGGCG | GGG | chr17 | 7109191 | 7109210 | 7109207 | + |
| SEQ ID NO 6219 | GGGAGACGCACAGGGGGCGG | GGG | chr17 | 7109192 | 7109211 | 7109208 | + |
| SEQ ID NO 6220 | GGAGACGCACAGGGGGCGGG | GGG | chr17 | 7109193 | 7109212 | 7109209 | + |
| SEQ ID NO 6221 | GAGACGCACAGGGGGCGGGG | GGG | chr17 | 7109194 | 7109213 | 7109210 | + |
| SEQ ID NO 6222 | ACGCACAGGGGGCGGGGGGG | CAG | chr17 | 7109197 | 7109216 | 7109213 | + |
| SEQ ID NO 6223 | AGGGGGCGGGGGGGCAGACC | CGG | chr17 | 7109203 | 7109222 | 7109219 | + |
| SEQ ID NO 6224 | GGGGCAGACCCGGCCCTGCC | TAG | chr17 | 7109213 | 7109232 | 7109229 | + |
| SEQ ID NO 6225 | GGGCAGACCCGGCCCTGCCT | AGG | chr17 | 7109214 | 7109233 | 7109230 | + |
| SEQ ID NO 6226 | CCTGCCTAGGCACACATCCT | GAG | chr17 | 7109227 | 7109246 | 7109243 | + |
| SEQ ID NO 6227 | GCCTAGGCACACATCCTGAG | AAG | chr17 | 7109230 | 7109249 | 7109246 | + |
| SEQ ID NO 6228 | CCTAGGCACACATCCTGAGA | AGG | chr17 | 7109231 | 7109250 | 7109247 | + |
| SEQ ID NO 6229 | CTAGGCACACATCCTGAGAA | GGG | chr17 | 7109232 | 7109251 | 7109248 | + |
| SEQ ID NO 6230 | TAGGCACACATCCTGAGAAG | GGG | chr17 | 7109233 | 7109252 | 7109249 | + |
| SEQ ID NO 6231 | AGGCACACATCCTGAGAAGG | GGG | chr17 | 7109234 | 7109253 | 7109250 | + |
| SEQ ID NO 6232 | TGAGAAGGGGGATCTGTGAA | TGG | chr17 | 7109246 | 7109265 | 7109262 | + |
| SEQ ID NO 6233 | TGAATGGTTTTCCTCCCATC | CAG | chr17 | 7109262 | 7109281 | 7109278 | + |
| SEQ ID NO 6234 | TGGTTTTCCTCCCATCCAGC | CAG | chr17 | 7109266 | 7109285 | 7109282 | + |
| SEQ ID NO 6235 | TTTTCCTCCCATCCAGCCAG | TGG | chr17 | 7109269 | 7109288 | 7109285 | + |
| SEQ ID NO 6236 | TCCTCCCATCCAGCCAGTGG | CAG | chr17 | 7109272 | 7109291 | 7109288 | + |
| SEQ ID NO 6237 | CTCCCATCCAGCCAGTGGCA | GAG | chr17 | 7109274 | 7109293 | 7109290 | + |
| SEQ ID NO 6238 | TCCCATCCAGCCAGTGGCAG | AGG | chr17 | 7109275 | 7109294 | 7109291 | + |
| SEQ ID NO 6239 | CAGCCAGTGGCAGAGGCCTC | CAG | chr17 | 7109282 | 7109301 | 7109298 | + |
| SEQ ID NO 6240 | CAGAGGCCTCCAGATCACCT | CGG | chr17 | 7109292 | 7109311 | 7109308 | + |
| SEQ ID NO 6241 | AGAGGCCTCCAGATCACCTC | GGG | chr17 | 7109293 | 7109312 | 7109309 | + |
| SEQ ID NO 6242 | CTCCAGATCACCTCGGGCCT | TAG | chr17 | 7109299 | 7109318 | 7109315 | + |
| SEQ ID NO 6243 | ATCACCTCGGGCCTTAGTCT | CAG | chr17 | 7109305 | 7109324 | 7109321 | + |
| SEQ ID NO 6244 | GCCTTAGTCTCAGCTCTTCT | AAG | chr17 | 7109315 | 7109334 | 7109331 | + |
| SEQ ID NO 6245 | CCTTAGTCTCAGCTCTTCTA | AGG | chr17 | 7109316 | 7109335 | 7109332 | + |
| SEQ ID NO 6246 | TTCTAAGGCTCCTGTCCCCT | CAG | chr17 | 7109331 | 7109350 | 7109347 | + |
| SEQ ID NO 6247 | AGGCTCCTGTCCCCTCAGAT | TGG | chr17 | 7109336 | 7109355 | 7109352 | + |
| SEQ ID NO 6248 | GCTCCTGTCCCCTCAGATTG | GAG | chr17 | 7109338 | 7109357 | 7109354 | + |

Figure 25 (Cont'd)

| | | | | | | | |
|---|---|---|---|---|---|---|---|
| SEQ ID NO 6249 | TCCCCTCAGATTGGAGACTC | CAG | chr17 | 7109345 | 7109364 | 7109361 | + |
| SEQ ID NO 6250 | CCTCAGATTGGAGACTCCAG | AAG | chr17 | 7109348 | 7109367 | 7109364 | + |
| SEQ ID NO 6251 | AGATTGGAGACTCCAGAAGC | TGG | chr17 | 7109352 | 7109371 | 7109368 | + |
| SEQ ID NO 6252 | GATTGGAGACTCCAGAAGCT | GGG | chr17 | 7109353 | 7109372 | 7109369 | + |
| SEQ ID NO 6253 | GTTCTTCCTAAAATCCATAC | TGG | chr17 | 7109382 | 7109401 | 7109398 | + |
| SEQ ID NO 6254 | TCCTAAAATCCATACTGGAA | CAG | chr17 | 7109387 | 7109406 | 7109403 | + |
| SEQ ID NO 6255 | TCCCCTGCCAAAATTCCATT | GAG | chr17 | 7109414 | 7109433 | 7109430 | + |
| SEQ ID NO 6256 | TCCATTGAGATCCTTAAATC | TGG | chr17 | 7109428 | 7109447 | 7109444 | + |
| SEQ ID NO 6257 | CCATTGAGATCCTTAAATCT | GGG | chr17 | 7109429 | 7109448 | 7109445 | + |
| SEQ ID NO 6258 | AAATCTGGGTCATTCCACCA | TAG | chr17 | 7109443 | 7109462 | 7109459 | + |
| SEQ ID NO 6259 | TCCACCATAGCCCACTCTCC | AAG | chr17 | 7109456 | 7109475 | 7109472 | + |
| SEQ ID NO 6260 | ACTCTCCAAGCACAACCCTC | CAG | chr17 | 7109469 | 7109488 | 7109485 | + |
| SEQ ID NO 6261 | CTCTCCAAGCACAACCCTCC | AGG | chr17 | 7109470 | 7109489 | 7109486 | + |
| SEQ ID NO 6262 | GTCCTCATCCCCCACCACGC | AAG | chr17 | 7109504 | 7109523 | 7109520 | + |
| SEQ ID NO 6263 | TCCTCATCCCCCACCACGCA | AGG | chr17 | 7109505 | 7109524 | 7109521 | + |
| SEQ ID NO 6264 | ACCACGCAAGGCCTCCTCCC | CAG | chr17 | 7109517 | 7109536 | 7109533 | + |
| SEQ ID NO 6265 | GCCCTTTGCCCTCGCTTCCC | TAG | chr17 | 7109541 | 7109560 | 7109557 | + |
| SEQ ID NO 6266 | CACACTAAATTTGCTCCCCT | CAG | chr17 | 7109575 | 7109594 | 7109591 | + |
| SEQ ID NO 6267 | AAATTTGCTCCCCTCAGCCC | GAG | chr17 | 7109581 | 7109600 | 7109597 | + |
| SEQ ID NO 6268 | AATTTGCTCCCCTCAGCCCG | AGG | chr17 | 7109582 | 7109601 | 7109598 | + |
| SEQ ID NO 6269 | CTCAGCCCGAGGTCATCTCA | CAG | chr17 | 7109593 | 7109612 | 7109609 | + |
| SEQ ID NO 6270 | TCAGCCCGAGGTCATCTCAC | AGG | chr17 | 7109594 | 7109613 | 7109610 | + |
| SEQ ID NO 6271 | TTGATCCATCTGCACCCTGA | CAG | chr17 | 7109632 | 7109651 | 7109648 | + |
| SEQ ID NO 6272 | CACCCACGTCTTCCTGCACA | CAG | chr17 | 7109864 | 7109883 | 7109880 | + |
| SEQ ID NO 6273 | CCCACGTCTTCCTGCACACA | GAG | chr17 | 7109866 | 7109885 | 7109882 | + |
| SEQ ID NO 6274 | CGTCTTCCTGCACACAGAGC | TGG | chr17 | 7109870 | 7109889 | 7109886 | + |
| SEQ ID NO 6275 | GTCTTCCTGCACACAGAGCT | GGG | chr17 | 7109871 | 7109890 | 7109887 | + |
| SEQ ID NO 6276 | GGCTCCCTCTCTGCTGCCTC | CAG | chr17 | 7109892 | 7109911 | 7109908 | + |
| SEQ ID NO 6277 | CTCTGCTGCCTCCAGACC | CAG | chr17 | 7109898 | 7109917 | 7109914 | + |
| SEQ ID NO 6278 | CTCTGCTGCCTCCAGACCCA | GAG | chr17 | 7109900 | 7109919 | 7109916 | + |
| SEQ ID NO 6279 | TGCTGCCTCCAGACCCAGAG | CAG | chr17 | 7109903 | 7109922 | 7109919 | + |
| SEQ ID NO 6280 | CTCCAGACCCAGAGCAGCTC | CAG | chr17 | 7109909 | 7109928 | 7109925 | + |
| SEQ ID NO 6281 | CAGAGCAGCTCCAGTTGTCC | CAG | chr17 | 7109918 | 7109937 | 7109934 | + |
| SEQ ID NO 6282 | GCTCCAGTTGTCCCAGCCCT | GAG | chr17 | 7109925 | 7109944 | 7109941 | + |
| SEQ ID NO 6283 | GCCCTGAGCTCCTCTCTTTG | CAG | chr17 | 7109940 | 7109959 | 7109956 | + |
| SEQ ID NO 6284 | TTGCAGCATCCACCTGCAAA | CAG | chr17 | 7109957 | 7109976 | 7109973 | + |
| SEQ ID NO 6285 | CCTGCAAACAGAACACCTTC | TAG | chr17 | 7109969 | 7109988 | 7109985 | + |
| SEQ ID NO 6286 | CTGCAAACAGAACACCTTCT | AGG | chr17 | 7109970 | 7109989 | 7109986 | + |
| SEQ ID NO 6287 | ACAGAACACCTTCTAGGCCT | TGG | chr17 | 7109976 | 7109995 | 7109992 | + |
| SEQ ID NO 6288 | GGCCTTGGACCCTGACTCTG | TGG | chr17 | 7109991 | 7110010 | 7110007 | + |
| SEQ ID NO 6289 | ATTCCTATCACCCCCGACC | CAG | chr17 | 7110030 | 7110049 | 7110046 | + |
| SEQ ID NO 6290 | CCTATCACCCCCGACCCAG | CAG | chr17 | 7110033 | 7110052 | 7110049 | + |
| SEQ ID NO 6291 | CTATCACCCCCGACCCAGC | AGG | chr17 | 7110034 | 7110053 | 7110050 | + |
| SEQ ID NO 6292 | GACCCAGCAGGACCACATCC | TGG | chr17 | 7110046 | 7110065 | 7110062 | + |
| SEQ ID NO 6293 | ACCCAGCAGGACCACATCCT | GGG | chr17 | 7110047 | 7110066 | 7110063 | + |
| SEQ ID NO 6294 | CCCAGCAGGACCACATCCTG | GGG | chr17 | 7110048 | 7110067 | 7110064 | + |
| SEQ ID NO 6295 | CAGCAGGACCACATCCTGGG | GAG | chr17 | 7110050 | 7110069 | 7110066 | + |

Figure 25 (Cont'd)

| | | | | | | | |
|---|---|---|---|---|---|---|---|
| SEQ ID NO 6296 | AGCAGGACCACATCCTGGGG | AGG | chr17 | 7110051 | 7110070 | 7110067 | + |
| SEQ ID NO 6297 | GACCACATCCTGGGGAGGCT | CAG | chr17 | 7110056 | 7110075 | 7110072 | + |
| SEQ ID NO 6298 | ACATCCTGGGGAGGCTCAGT | CAG | chr17 | 7110060 | 7110079 | 7110076 | + |
| SEQ ID NO 6299 | CATCCTGGGGAGGCTCAGTC | AGG | chr17 | 7110061 | 7110080 | 7110077 | + |
| SEQ ID NO 6300 | ATCCTGGGGAGGCTCAGTCA | GGG | chr17 | 7110062 | 7110081 | 7110078 | + |
| SEQ ID NO 6301 | TCCTGGGGAGGCTCAGTCAG | GGG | chr17 | 7110063 | 7110082 | 7110079 | + |
| SEQ ID NO 6302 | GGGAGGCTCAGTCAGGGGCC | CAG | chr17 | 7110068 | 7110087 | 7110084 | + |
| SEQ ID NO 6303 | GGGCCCAGAATCTTCCTCCC | CAG | chr17 | 7110083 | 7110102 | 7110099 | + |
| SEQ ID NO 6304 | GGCCCAGAATCTTCCTCCCC | AGG | chr17 | 7110084 | 7110103 | 7110100 | + |
| SEQ ID NO 6305 | TCACTTCCTGCCACTGTCCT | GAG | chr17 | 7110107 | 7110126 | 7110123 | + |
| SEQ ID NO 6306 | TTCCTGCCACTGTCCTGAGT | CAG | chr17 | 7110111 | 7110130 | 7110127 | + |
| SEQ ID NO 6307 | GAGTCAGACACTGCCCCTGT | AAG | chr17 | 7110127 | 7110146 | 7110143 | + |
| SEQ ID NO 6308 | ACTCTTCATCTTTTTCACAC | CAG | chr17 | 7110162 | 7110181 | 7110178 | + |
| SEQ ID NO 6309 | GACTTCCACCTTCCCCACTG | CAG | chr17 | 7110186 | 7110205 | 7110202 | + |
| SEQ ID NO 6310 | TTCCCCACTGCAGCCACACT | CAG | chr17 | 7110196 | 7110215 | 7110212 | + |
| SEQ ID NO 6311 | TCCCCACTGCAGCCACACTC | AGG | chr17 | 7110197 | 7110216 | 7110213 | + |
| SEQ ID NO 6312 | ACTCAGGACCCCATTTGACC | CAG | chr17 | 7110213 | 7110232 | 7110229 | + |
| SEQ ID NO 6313 | CTCAGGACCCCATTTGACCC | AGG | chr17 | 7110214 | 7110233 | 7110230 | + |
| SEQ ID NO 6314 | TCAGGACCCCATTTGACCCA | GGG | chr17 | 7110215 | 7110234 | 7110231 | + |
| SEQ ID NO 6315 | AGGACCCCATTTGACCCAGG | GAG | chr17 | 7110217 | 7110236 | 7110233 | + |
| SEQ ID NO 6316 | GGACCCCATTTGACCCAGGG | AGG | chr17 | 7110218 | 7110237 | 7110234 | + |
| SEQ ID NO 6317 | CCACTGCCCACTCCCGCTCT | GAG | chr17 | 7110253 | 7110272 | 7110269 | + |
| SEQ ID NO 6318 | GCCCACTCCCGCTCTGAGCA | CAG | chr17 | 7110258 | 7110277 | 7110274 | + |
| SEQ ID NO 6319 | CTGCCCCACCCCTTCCTCC | AAG | chr17 | 7110298 | 7110317 | 7110314 | + |
| SEQ ID NO 6320 | TGCCCCACCCCTTCCTCCA | AGG | chr17 | 7110299 | 7110318 | 7110315 | + |
| SEQ ID NO 6321 | CCTTTGCATTCCTCTCCATC | CAG | chr17 | 7110322 | 7110341 | 7110338 | + |
| SEQ ID NO 6322 | TTGCATTCCTCTCCATCCAG | AAG | chr17 | 7110325 | 7110344 | 7110341 | + |
| SEQ ID NO 6323 | CCAGAAGCGCTCCATGACCA | CGG | chr17 | 7110341 | 7110360 | 7110357 | + |
| SEQ ID NO 6324 | TGACCACGGTGTTCCCCACC | AAG | chr17 | 7110355 | 7110374 | 7110371 | + |
| SEQ ID NO 6325 | CACGGTGTTCCCCACCAAGC | TGG | chr17 | 7110359 | 7110378 | 7110375 | + |
| SEQ ID NO 6326 | CCCACCAAGCTGGCCCTCCA | TGG | chr17 | 7110369 | 7110388 | 7110385 | + |
| SEQ ID NO 6327 | CAAGCTGGCCCTCCATGGCT | GAG | chr17 | 7110374 | 7110393 | 7110390 | + |
| SEQ ID NO 6328 | GAGTCCCTGACTGCTGTCTT | CAG | chr17 | 7110394 | 7110413 | 7110410 | + |
| SEQ ID NO 6329 | TGTCTTCAGCACCCTCCACT | CAG | chr17 | 7110408 | 7110427 | 7110424 | + |
| SEQ ID NO 6330 | TCTTCAGCACCCTCCACTCA | GAG | chr17 | 7110410 | 7110429 | 7110426 | + |
| SEQ ID NO 6331 | CTTCAGCACCCTCCACTCAG | AGG | chr17 | 7110411 | 7110430 | 7110427 | + |
| SEQ ID NO 6332 | TTCAGCACCCTCCACTCAGA | GGG | chr17 | 7110412 | 7110431 | 7110428 | + |
| SEQ ID NO 6333 | GAGGGTCCTGTCCTGCTTCC | CAG | chr17 | 7110430 | 7110449 | 7110446 | + |
| SEQ ID NO 6334 | GACTTATCAACTCCCAATGC | TGG | chr17 | 7110456 | 7110475 | 7110472 | + |
| SEQ ID NO 6335 | ACTTATCAACTCCCAATGCT | GGG | chr17 | 7110457 | 7110476 | 7110473 | + |
| SEQ ID NO 6336 | ATCAACTCCCAATGCTGGGT | CAG | chr17 | 7110461 | 7110480 | 7110477 | + |
| SEQ ID NO 6337 | CTCCCAATGCTGGGTCAGCC | CAG | chr17 | 7110466 | 7110485 | 7110482 | + |
| SEQ ID NO 6338 | CTGTATATCCACCCTGAAAC | CAG | chr17 | 7110497 | 7110516 | 7110513 | + |
| SEQ ID NO 6339 | CCCTGAAACCAGACTGCCCA | CAG | chr17 | 7110508 | 7110527 | 7110524 | + |
| SEQ ID NO 6340 | CCTGAAACCAGACTGCCCAC | AGG | chr17 | 7110509 | 7110528 | 7110525 | + |
| SEQ ID NO 6341 | CTGAAACCAGACTGCCCACA | GGG | chr17 | 7110510 | 7110529 | 7110526 | + |
| SEQ ID NO 6342 | AAACCAGACTGCCCACAGGG | TAG | chr17 | 7110513 | 7110532 | 7110529 | + |

Figure 25 (Cont'd)

| SEQ ID NO 6343 | AGACTGCCCACAGGGTAGCC | CAG | chr17 | 7110518 | 7110537 | 7110534 | + |
| SEQ ID NO 6344 | GGGTAGCCCAGCTGTGCCTC | CAG | chr17 | 7110530 | 7110549 | 7110546 | + |
| SEQ ID NO 6345 | GGTAGCCCAGCTGTGCCTCC | AGG | chr17 | 7110531 | 7110550 | 7110547 | + |
| SEQ ID NO 6346 | AGCCCAGCTGTGCCTCCAGG | TAG | chr17 | 7110534 | 7110553 | 7110550 | + |
| SEQ ID NO 6347 | CTGTGCCTCCAGGTAGCTCT | GAG | chr17 | 7110541 | 7110560 | 7110557 | + |
| SEQ ID NO 6348 | GTAGCTCTGAGATCATGCAC | CAG | chr17 | 7110553 | 7110572 | 7110569 | + |
| SEQ ID NO 6349 | CCATTTTCTCGTGTGTAAAA | TGG | chr17 | 7110596 | 7110615 | 7110612 | + |
| SEQ ID NO 6350 | ATTTTCTCGTGTGTAAAATG | GAG | chr17 | 7110598 | 7110617 | 7110614 | + |
| SEQ ID NO 6351 | CGTGTGTAAAATGGAGATCA | CAG | chr17 | 7110605 | 7110624 | 7110621 | + |
| SEQ ID NO 6352 | TAAAATGGAGATCACAGTCG | TAG | chr17 | 7110611 | 7110630 | 7110627 | + |
| SEQ ID NO 6353 | CACAGTCGTAGCTACCCGAT | TGG | chr17 | 7110623 | 7110642 | 7110639 | + |
| SEQ ID NO 6354 | AGCTACCCGATTGGATTGCT | CGG | chr17 | 7110632 | 7110651 | 7110648 | + |
| SEQ ID NO 6355 | GATTGGATTGCTCGGATAAT | TAG | chr17 | 7110640 | 7110659 | 7110656 | + |
| SEQ ID NO 6356 | GATTGCTCGGATAATTAGAT | GAG | chr17 | 7110645 | 7110664 | 7110661 | + |
| SEQ ID NO 6357 | AAAATATGTAATGTGCTTCT | TAG | chr17 | 7110670 | 7110689 | 7110686 | + |
| SEQ ID NO 6358 | AAATATGTAATGTGCTTCTT | AGG | chr17 | 7110671 | 7110690 | 7110687 | + |
| SEQ ID NO 6359 | GTAATGTGCTTCTTAGGCAA | AAG | chr17 | 7110677 | 7110696 | 7110693 | + |
| SEQ ID NO 6360 | AGGCAAAGTTTGAACATAA | AAG | chr17 | 7110691 | 7110710 | 7110707 | + |
| SEQ ID NO 6361 | AAAAGTTTGAACATAAAAGA | CAG | chr17 | 7110695 | 7110714 | 7110711 | + |
| SEQ ID NO 6362 | AAAGTTTGAACATAAAAGAC | AGG | chr17 | 7110696 | 7110715 | 7110712 | + |
| SEQ ID NO 6363 | AAGTTTGAACATAAAAGACA | GGG | chr17 | 7110697 | 7110716 | 7110713 | + |
| SEQ ID NO 6364 | ATAAAAGACAGGGTCTGCCC | AAG | chr17 | 7110707 | 7110726 | 7110723 | + |
| SEQ ID NO 6365 | AAGACAGGGTCTGCCCAAGA | TGG | chr17 | 7110711 | 7110730 | 7110727 | + |
| SEQ ID NO 6366 | AGACAGGGTCTGCCCAAGAT | GGG | chr17 | 7110712 | 7110731 | 7110728 | + |
| SEQ ID NO 6367 | CAGGGTCTGCCCAAGATGGG | AAG | chr17 | 7110715 | 7110734 | 7110731 | + |
| SEQ ID NO 6368 | GGGTCTGCCCAAGATGGGAA | GAG | chr17 | 7110717 | 7110736 | 7110733 | + |
| SEQ ID NO 6369 | GGGAAGAGTTCTTCTCTCCC | CAG | chr17 | 7110732 | 7110751 | 7110748 | + |
| SEQ ID NO 6370 | AGAAACAATCAAAACAAAAA | CAG | chr17 | 7110753 | 7110772 | 7110769 | + |
| SEQ ID NO 6371 | AAAACAAAAACAGACAACTA | TAG | chr17 | 7110763 | 7110782 | 7110779 | + |
| SEQ ID NO 6372 | AAACAGACAACTATAGAACA | TGG | chr17 | 7110770 | 7110789 | 7110786 | + |
| SEQ ID NO 6373 | CAGACAACTATAGAACATGG | CAG | chr17 | 7110773 | 7110792 | 7110789 | + |
| SEQ ID NO 6374 | TATAGAACATGGCAGCTTTC | AAG | chr17 | 7110781 | 7110800 | 7110797 | + |
| SEQ ID NO 6375 | CATGGCAGCTTTCAAGACTC | TGG | chr17 | 7110788 | 7110807 | 7110804 | + |
| SEQ ID NO 6376 | GCTTTCAAGACTCTGGACAT | CAG | chr17 | 7110795 | 7110814 | 7110811 | + |
| SEQ ID NO 6377 | CTTTCAAGACTCTGGACATC | AGG | chr17 | 7110796 | 7110815 | 7110812 | + |
| SEQ ID NO 6378 | CAAGACTCTGGACATCAGGC | AAG | chr17 | 7110800 | 7110819 | 7110816 | + |
| SEQ ID NO 6379 | AAGACTCTGGACATCAGGCA | AGG | chr17 | 7110801 | 7110820 | 7110817 | + |
| SEQ ID NO 6380 | GACTCTGGACATCAGGCAAG | GAG | chr17 | 7110803 | 7110822 | 7110819 | + |
| SEQ ID NO 6381 | ACTCTGGACATCAGGCAAGG | AGG | chr17 | 7110804 | 7110823 | 7110820 | + |
| SEQ ID NO 6382 | TCTGGACATCAGGCAAGGAG | GAG | chr17 | 7110806 | 7110825 | 7110822 | + |
| SEQ ID NO 6383 | ACATCAGGCAAGGAGGAGTA | AAG | chr17 | 7110811 | 7110830 | 7110827 | + |
| SEQ ID NO 6384 | AAGGAGGAGTAAAGATCCCT | GAG | chr17 | 7110820 | 7110839 | 7110836 | + |
| SEQ ID NO 6385 | AGGAGGAGTAAAGATCCCTG | AGG | chr17 | 7110821 | 7110840 | 7110837 | + |
| SEQ ID NO 6386 | GGAGGAGTAAAGATCCCTGA | GGG | chr17 | 7110822 | 7110841 | 7110838 | + |
| SEQ ID NO 6387 | AGTAAAGATCCCTGAGGGAT | AAG | chr17 | 7110827 | 7110846 | 7110843 | + |
| SEQ ID NO 6388 | AAAGATCCCTGAGGGATAAG | AAG | chr17 | 7110830 | 7110849 | 7110846 | + |
| SEQ ID NO 6389 | GAGGGATAAGAAGCAAACAA | CAG | chr17 | 7110840 | 7110859 | 7110856 | + |

Figure 25 (Cont'd)

| | | | | | | | |
|---|---|---|---|---|---|---|---|
| SEQ ID NO 6390 | AGGGATAAGAAGCAAACAAC | AGG | chr17 | 7110841 | 7110860 | 7110857 | + |
| SEQ ID NO 6391 | CAGGAACCCTCCGATCACCC | CAG | chr17 | 7110860 | 7110879 | 7110876 | + |
| SEQ ID NO 6392 | GATCACCCCAGCTTACTGTT | TGG | chr17 | 7110872 | 7110891 | 7110888 | + |
| SEQ ID NO 6393 | TCACCCCAGCTTACTGTTTG | GAG | chr17 | 7110874 | 7110893 | 7110890 | + |
| SEQ ID NO 6394 | ACCCCAGCTTACTGTTTGGA | GAG | chr17 | 7110876 | 7110895 | 7110892 | + |
| SEQ ID NO 6395 | CCCAGCTTACTGTTTGGAGA | GAG | chr17 | 7110878 | 7110897 | 7110894 | + |
| SEQ ID NO 6396 | TACTGTTTGGAGAGAGTCTG | CAG | chr17 | 7110885 | 7110904 | 7110901 | + |
| SEQ ID NO 6397 | ACTGTTTGGAGAGAGTCTGC | AGG | chr17 | 7110886 | 7110905 | 7110902 | + |
| SEQ ID NO 6398 | TGGAGAGAGTCTGCAGGTTA | CAG | chr17 | 7110892 | 7110911 | 7110908 | + |
| SEQ ID NO 6399 | GGAGAGAGTCTGCAGGTTAC | AGG | chr17 | 7110893 | 7110912 | 7110909 | + |
| SEQ ID NO 6400 | AGAGTCTGCAGGTTACAGGC | CAG | chr17 | 7110897 | 7110916 | 7110913 | + |
| SEQ ID NO 6401 | GAGTCTGCAGGTTACAGGCC | AGG | chr17 | 7110898 | 7110917 | 7110914 | + |
| SEQ ID NO 6402 | CTGCAGGTTACAGGCCAGGA | AAG | chr17 | 7110902 | 7110921 | 7110918 | + |
| SEQ ID NO 6403 | TGCAGGTTACAGGCCAGGAA | AGG | chr17 | 7110903 | 7110922 | 7110919 | + |
| SEQ ID NO 6404 | GCAGGTTACAGGCCAGGAAA | GGG | chr17 | 7110904 | 7110923 | 7110920 | + |
| SEQ ID NO 6405 | GGTTACAGGCCAGGAAAGGG | AAG | chr17 | 7110907 | 7110926 | 7110923 | + |
| SEQ ID NO 6406 | CAGGCCAGGAAAGGGAAGTC | CAG | chr17 | 7110912 | 7110931 | 7110928 | + |
| SEQ ID NO 6407 | AGGCCAGGAAAGGGAAGTCC | AGG | chr17 | 7110913 | 7110932 | 7110929 | + |
| SEQ ID NO 6408 | CCAGGAAAGGGAAGTCCAGG | CAG | chr17 | 7110916 | 7110935 | 7110932 | + |
| SEQ ID NO 6409 | AGGAAAGGGAAGTCCAGGCA | GAG | chr17 | 7110918 | 7110937 | 7110934 | + |
| SEQ ID NO 6410 | GGGAAGTCCAGGCAGAGCCC | AAG | chr17 | 7110924 | 7110943 | 7110940 | + |
| SEQ ID NO 6411 | GAAGTCCAGGCAGAGCCCAA | GAG | chr17 | 7110926 | 7110945 | 7110942 | + |
| SEQ ID NO 6412 | CCCAAGAGACTCCCCACGTT | GAG | chr17 | 7110941 | 7110960 | 7110957 | + |
| SEQ ID NO 6413 | CCAAGAGACTCCCCACGTTG | AGG | chr17 | 7110942 | 7110961 | 7110958 | + |
| SEQ ID NO 6414 | AAGAGACTCCCCACGTTGAG | GAG | chr17 | 7110944 | 7110963 | 7110960 | + |
| SEQ ID NO 6415 | GACTCCCCACGTTGAGGAGA | TGG | chr17 | 7110948 | 7110967 | 7110964 | + |
| SEQ ID NO 6416 | CTCCCCACGTTGAGGAGATG | GAG | chr17 | 7110950 | 7110969 | 7110966 | + |
| SEQ ID NO 6417 | CACGTTGAGGAGATGGAGCT | GAG | chr17 | 7110955 | 7110974 | 7110971 | + |
| SEQ ID NO 6418 | CGTTGAGGAGATGGAGCTGA | GAG | chr17 | 7110957 | 7110976 | 7110973 | + |
| SEQ ID NO 6419 | GGAGATGGAGCTGAGAGTCC | GAG | chr17 | 7110963 | 7110982 | 7110979 | + |
| SEQ ID NO 6420 | GAGATGGAGCTGAGAGTCCG | AGG | chr17 | 7110964 | 7110983 | 7110980 | + |
| SEQ ID NO 6421 | GATGGAGCTGAGAGTCCGAG | GAG | chr17 | 7110966 | 7110985 | 7110982 | + |
| SEQ ID NO 6422 | CCGAGGAGACCAAAACAATT | AAG | chr17 | 7110981 | 7111000 | 7110997 | + |
| SEQ ID NO 6423 | GAGGAGACCAAAACAATTAA | GAG | chr17 | 7110983 | 7111002 | 7110999 | + |
| SEQ ID NO 6424 | CAAACGATCAAACTGACTCT | AAG | chr17 | 7111008 | 7111027 | 7111024 | + |
| SEQ ID NO 6425 | TAAGTTGCTTAACTGCATCC | CGG | chr17 | 7111027 | 7111046 | 7111043 | + |
| SEQ ID NO 6426 | AGTTGCTTAACTGCATCCCG | GAG | chr17 | 7111029 | 7111048 | 7111045 | + |
| SEQ ID NO 6427 | CTTAACTGCATCCCGGAGCA | AAG | chr17 | 7111034 | 7111053 | 7111050 | + |
| SEQ ID NO 6428 | TGCATCCCGGAGCAAAGCTC | AAG | chr17 | 7111040 | 7111059 | 7111056 | + |
| SEQ ID NO 6429 | GAGCAAAGCTCAAGAACATT | TAG | chr17 | 7111049 | 7111068 | 7111065 | + |
| SEQ ID NO 6430 | GCAAAGCTCAAGAACATTTA | GAG | chr17 | 7111051 | 7111070 | 7111067 | + |
| SEQ ID NO 6431 | CAAAGCTCAAGAACATTTAG | AGG | chr17 | 7111052 | 7111071 | 7111068 | + |
| SEQ ID NO 6432 | TAGAGGAATACAAAAATATC | CAG | chr17 | 7111069 | 7111088 | 7111085 | + |
| SEQ ID NO 6433 | AAAAATATCCAGCACCCAAC | AAG | chr17 | 7111080 | 7111099 | 7111096 | + |
| SEQ ID NO 6434 | AAAATATCCAGCACCCAACA | AGG | chr17 | 7111081 | 7111100 | 7111097 | + |
| SEQ ID NO 6435 | AAGGTGAAATTGACAATGTC | TGG | chr17 | 7111100 | 7111119 | 7111116 | + |
| SEQ ID NO 6436 | GTGAAATTGACAATGTCTGG | CAG | chr17 | 7111103 | 7111122 | 7111119 | + |

Figure 25 (Cont'd)

| | | | | | | | |
|---|---|---|---|---|---|---|---|
| SEQ ID NO 6437 | CAATGTCTGGCAGCCAATCA | AAG | chr17 | 7111113 | 7111132 | 7111129 | + |
| SEQ ID NO 6438 | GGCAGCCAATCAAAGATTAC | AAG | chr17 | 7111121 | 7111140 | 7111137 | + |
| SEQ ID NO 6439 | GCAGCCAATCAAAGATTACA | AGG | chr17 | 7111122 | 7111141 | 7111138 | + |
| SEQ ID NO 6440 | TTACAAGGCATGCAATGAAA | CGG | chr17 | 7111137 | 7111156 | 7111153 | + |
| SEQ ID NO 6441 | TACAAGGCATGCAATGAAAC | GGG | chr17 | 7111138 | 7111157 | 7111154 | + |
| SEQ ID NO 6442 | GGGAAAACACAATGCATAAC | GAG | chr17 | 7111158 | 7111177 | 7111174 | + |
| SEQ ID NO 6443 | GGAAAACACAATGCATAACG | AGG | chr17 | 7111159 | 7111178 | 7111175 | + |
| SEQ ID NO 6444 | AAAACACAATGCATAACGAG | GAG | chr17 | 7111161 | 7111180 | 7111177 | + |
| SEQ ID NO 6445 | AAACACAATGCATAACGAGG | AGG | chr17 | 7111162 | 7111181 | 7111178 | + |
| SEQ ID NO 6446 | AGGAGGTTCATAAATATCAA | AAG | chr17 | 7111179 | 7111198 | 7111195 | + |
| SEQ ID NO 6447 | GAGGTTCATAAATATCAAAA | GAG | chr17 | 7111181 | 7111200 | 7111197 | + |
| SEQ ID NO 6448 | CATAAATATCAAAAGAGATC | CAG | chr17 | 7111187 | 7111206 | 7111203 | + |
| SEQ ID NO 6449 | AAAGAGATCCAGAACTGACA | CGG | chr17 | 7111198 | 7111217 | 7111214 | + |
| SEQ ID NO 6450 | TCCAGAACTGACACGGATGC | TAG | chr17 | 7111205 | 7111224 | 7111221 | + |
| SEQ ID NO 6451 | ACTGACACGGATGCTAGAAT | TAG | chr17 | 7111211 | 7111230 | 7111227 | + |
| SEQ ID NO 6452 | GACACGGATGCTAGAATTAG | CAG | chr17 | 7111214 | 7111233 | 7111230 | + |
| SEQ ID NO 6453 | ACACGGATGCTAGAATTAGC | AGG | chr17 | 7111215 | 7111234 | 7111231 | + |
| SEQ ID NO 6454 | GGATGCTAGAATTAGCAGGC | AAG | chr17 | 7111219 | 7111238 | 7111235 | + |
| SEQ ID NO 6455 | GATGCTAGAATTAGCAGGCA | AGG | chr17 | 7111220 | 7111239 | 7111236 | + |
| SEQ ID NO 6456 | CTAGAATTAGCAGGCAAGGA | TGG | chr17 | 7111224 | 7111243 | 7111240 | + |
| SEQ ID NO 6457 | AGCAGGCAAGGATGGTAAAA | CAG | chr17 | 7111232 | 7111251 | 7111248 | + |
| SEQ ID NO 6458 | GGATGGTAAAACAGATATTA | TAG | chr17 | 7111241 | 7111260 | 7111257 | + |
| SEQ ID NO 6459 | CCCATTATGTTCAAAAAATT | AAG | chr17 | 7111270 | 7111289 | 7111286 | + |
| SEQ ID NO 6460 | ATTATGTTCAAAAAATTAAG | TAG | chr17 | 7111273 | 7111292 | 7111289 | + |
| SEQ ID NO 6461 | CAAAAAATTAAGTAGAATTG | TGG | chr17 | 7111281 | 7111300 | 7111297 | + |
| SEQ ID NO 6462 | AAAAATTAAGTAGAATTGTG | GAG | chr17 | 7111283 | 7111302 | 7111299 | + |
| SEQ ID NO 6463 | AAAATTAAGTAGAATTGTGG | AGG | chr17 | 7111284 | 7111303 | 7111300 | + |
| SEQ ID NO 6464 | TAGAATTGTGGAGGATATTT | AAG | chr17 | 7111293 | 7111312 | 7111309 | + |
| SEQ ID NO 6465 | GAATTGTGGAGGATATTTAA | GAG | chr17 | 7111295 | 7111314 | 7111311 | + |
| SEQ ID NO 6466 | GGAGGATATTTAAGAGTCCC | CAG | chr17 | 7111302 | 7111321 | 7111318 | + |
| SEQ ID NO 6467 | GAGGATATTTAAGAGTCCCC | AGG | chr17 | 7111303 | 7111322 | 7111319 | + |
| SEQ ID NO 6468 | AGAGTCCCCAGGTGAACTTC | TAG | chr17 | 7111314 | 7111333 | 7111330 | + |
| SEQ ID NO 6469 | AGTCCCCAGGTGAACTTCTA | GAG | chr17 | 7111316 | 7111335 | 7111332 | + |
| SEQ ID NO 6470 | TCTGAAATGAAAAACACAC | TGG | chr17 | 7111354 | 7111373 | 7111370 | + |
| SEQ ID NO 6471 | AAATGAAAAACACACTGGC | CAG | chr17 | 7111358 | 7111377 | 7111374 | + |
| SEQ ID NO 6472 | AATGAAAAACACACTGGCC | AGG | chr17 | 7111359 | 7111378 | 7111375 | + |
| SEQ ID NO 6473 | AACACACTGGCCAGGCGCCG | TGG | chr17 | 7111367 | 7111386 | 7111383 | + |
| SEQ ID NO 6474 | CAGGCGCCGTGGCTCACGCC | TGG | chr17 | 7111378 | 7111397 | 7111394 | + |
| SEQ ID NO 6475 | GTGGCTCACGCCTGGAATCC | CAG | chr17 | 7111386 | 7111405 | 7111402 | + |
| SEQ ID NO 6476 | CGCCTGGAATCCCAGCACTG | TGG | chr17 | 7111394 | 7111413 | 7111410 | + |
| SEQ ID NO 6477 | GCCTGGAATCCCAGCACTGT | GGG | chr17 | 7111395 | 7111414 | 7111411 | + |
| SEQ ID NO 6478 | CTGGAATCCCAGCACTGTGG | GAG | chr17 | 7111397 | 7111416 | 7111413 | + |
| SEQ ID NO 6479 | TGGAATCCCAGCACTGTGGG | AGG | chr17 | 7111398 | 7111417 | 7111414 | + |
| SEQ ID NO 6480 | TCCCAGCACTGTGGGAGGCC | AAG | chr17 | 7111403 | 7111422 | 7111419 | + |
| SEQ ID NO 6481 | CCCAGCACTGTGGGAGGCCA | AGG | chr17 | 7111404 | 7111423 | 7111420 | + |
| SEQ ID NO 6482 | AGCACTGTGGGAGGCCAAGG | CGG | chr17 | 7111407 | 7111426 | 7111423 | + |
| SEQ ID NO 6483 | GCACTGTGGGAGGCCAAGGC | GGG | chr17 | 7111408 | 7111427 | 7111424 | + |

Figure 25 (Cont'd)

| | | | | | | | |
|---|---|---|---|---|---|---|---|
| SEQ ID NO 6484 | CTGTGGGAGGCCAAGGCGGG | CAG | chr17 | 7111411 | 7111430 | 7111427 | + |
| SEQ ID NO 6485 | GGCCAAGGCGGGCAGATCAT | GAG | chr17 | 7111419 | 7111438 | 7111435 | + |
| SEQ ID NO 6486 | GCCAAGGCGGGCAGATCATG | AGG | chr17 | 7111420 | 7111439 | 7111436 | + |
| SEQ ID NO 6487 | AGGCGGGCAGATCATGAGGT | CAG | chr17 | 7111424 | 7111443 | 7111440 | + |
| SEQ ID NO 6488 | GGCGGGCAGATCATGAGGTC | AGG | chr17 | 7111425 | 7111444 | 7111441 | + |
| SEQ ID NO 6489 | CGGGCAGATCATGAGGTCAG | GAG | chr17 | 7111427 | 7111446 | 7111443 | + |
| SEQ ID NO 6490 | TCAGGAGATCGACACCATCC | TGG | chr17 | 7111443 | 7111462 | 7111459 | + |
| SEQ ID NO 6491 | CGACACCATCCTGGCTAACA | TGG | chr17 | 7111452 | 7111471 | 7111468 | + |
| SEQ ID NO 6492 | CTACTAAAAATACAAAAAAT | TAG | chr17 | 7111488 | 7111507 | 7111504 | + |
| SEQ ID NO 6493 | TAAAAATACAAAAAATTAGC | CAG | chr17 | 7111492 | 7111511 | 7111508 | + |
| SEQ ID NO 6494 | TACAAAAAATTAGCCAGACG | TGG | chr17 | 7111498 | 7111517 | 7111514 | + |
| SEQ ID NO 6495 | AAAAAATTAGCCAGACGTGG | TGG | chr17 | 7111501 | 7111520 | 7111517 | + |
| SEQ ID NO 6496 | AAATTAGCCAGACGTGGTGG | CAG | chr17 | 7111504 | 7111523 | 7111520 | + |
| SEQ ID NO 6497 | AATTAGCCAGACGTGGTGGC | AGG | chr17 | 7111505 | 7111524 | 7111521 | + |
| SEQ ID NO 6498 | GACGTGGTGGCAGGCGCCTG | TAG | chr17 | 7111514 | 7111533 | 7111530 | + |
| SEQ ID NO 6499 | GTGGCAGGCGCCTGTAGTCC | CAG | chr17 | 7111520 | 7111539 | 7111536 | + |
| SEQ ID NO 6500 | CGCCTGTAGTCCCAGCTACT | CGG | chr17 | 7111528 | 7111547 | 7111544 | + |
| SEQ ID NO 6501 | GCCTGTAGTCCCAGCTACTC | GGG | chr17 | 7111529 | 7111548 | 7111545 | + |
| SEQ ID NO 6502 | CTGTAGTCCCAGCTACTCGG | GAG | chr17 | 7111531 | 7111550 | 7111547 | + |
| SEQ ID NO 6503 | TGTAGTCCCAGCTACTCGGG | AGG | chr17 | 7111532 | 7111551 | 7111548 | + |
| SEQ ID NO 6504 | TCCCAGCTACTCGGGAGGCT | GAG | chr17 | 7111537 | 7111556 | 7111553 | + |
| SEQ ID NO 6505 | CCCAGCTACTCGGGAGGCTG | AGG | chr17 | 7111538 | 7111557 | 7111554 | + |
| SEQ ID NO 6506 | AGCTACTCGGGAGGCTGAGG | CAG | chr17 | 7111541 | 7111560 | 7111557 | + |
| SEQ ID NO 6507 | GCTACTCGGGAGGCTGAGGC | AGG | chr17 | 7111542 | 7111561 | 7111558 | + |
| SEQ ID NO 6508 | TACTCGGGAGGCTGAGGCAG | GAG | chr17 | 7111544 | 7111563 | 7111560 | + |
| SEQ ID NO 6509 | GGGAGGCTGAGGCAGGAGAA | TGG | chr17 | 7111549 | 7111568 | 7111565 | + |
| SEQ ID NO 6510 | GCAGGAGAATGGCATGAACC | CGG | chr17 | 7111560 | 7111579 | 7111576 | + |
| SEQ ID NO 6511 | CAGGAGAATGGCATGAACCC | GGG | chr17 | 7111561 | 7111580 | 7111577 | + |
| SEQ ID NO 6512 | GGAGAATGGCATGAACCCGG | GAG | chr17 | 7111563 | 7111582 | 7111579 | + |
| SEQ ID NO 6513 | GAGAATGGCATGAACCCGGG | AGG | chr17 | 7111564 | 7111583 | 7111580 | + |
| SEQ ID NO 6514 | AATGGCATGAACCCGGGAGG | CAG | chr17 | 7111567 | 7111586 | 7111583 | + |
| SEQ ID NO 6515 | TGGCATGAACCCGGGAGGCA | GAG | chr17 | 7111569 | 7111588 | 7111585 | + |
| SEQ ID NO 6516 | AACCCGGGAGGCAGAGCTTG | CAG | chr17 | 7111576 | 7111595 | 7111592 | + |
| SEQ ID NO 6517 | CGGGAGGCAGAGCTTGCAGT | GAG | chr17 | 7111580 | 7111599 | 7111596 | + |
| SEQ ID NO 6518 | GGCAGAGCTTGCAGTGAGCC | AAG | chr17 | 7111585 | 7111604 | 7111601 | + |
| SEQ ID NO 6519 | AAGATCGCGCCACTGCACTC | CGG | chr17 | 7111605 | 7111624 | 7111621 | + |
| SEQ ID NO 6520 | CGCGCCACTGCACTCCGGCC | TGG | chr17 | 7111610 | 7111629 | 7111626 | + |
| SEQ ID NO 6521 | GCGCCACTGCACTCCGGCCT | GGG | chr17 | 7111611 | 7111630 | 7111627 | + |
| SEQ ID NO 6522 | CTGCACTCCGGCCTGGGCAA | CAG | chr17 | 7111617 | 7111636 | 7111633 | + |
| SEQ ID NO 6523 | GCACTCCGGCCTGGGCAACA | GAG | chr17 | 7111619 | 7111638 | 7111635 | + |
| SEQ ID NO 6524 | TCCGGCCTGGGCAACAGAGC | GAG | chr17 | 7111623 | 7111642 | 7111639 | + |
| SEQ ID NO 6525 | CCGCCTCCAAAAAAAAAAAA | AAG | chr17 | 7111649 | 7111668 | 7111665 | + |
| SEQ ID NO 6526 | TCCAAAAAAAAAAAAAAGAA | AAG | chr17 | 7111654 | 7111673 | 7111670 | + |
| SEQ ID NO 6527 | AAAAAAAAAAAGAAAAGA | AAG | chr17 | 7111658 | 7111677 | 7111674 | + |
| SEQ ID NO 6528 | AAAAAAAGAAAAGAAAGAA | AAG | chr17 | 7111663 | 7111682 | 7111679 | + |
| SEQ ID NO 6529 | AAAGAAAAGAAAAACACAC | TGG | chr17 | 7111677 | 7111696 | 7111693 | + |
| SEQ ID NO 6530 | AAAAGAAAAACACACTGGA | TGG | chr17 | 7111681 | 7111700 | 7111697 | + |

Figure 25 (Cont'd)

| | | | | | | | |
|---|---|---|---|---|---|---|---|
| SEQ ID NO 6531 | AACACACTGGATGGAAATAA | TGG | chr17 | 7111690 | 7111709 | 7111706 | + |
| SEQ ID NO 6532 | ACACTGGATGGAAATAATGG | AAG | chr17 | 7111693 | 7111712 | 7111709 | + |
| SEQ ID NO 6533 | GGATGGAAATAATGGAAGAT | GAG | chr17 | 7111698 | 7111717 | 7111714 | + |
| SEQ ID NO 6534 | ATGGAAGATGAGAAATGCGT | AAG | chr17 | 7111709 | 7111728 | 7111725 | + |
| SEQ ID NO 6535 | AGAAATGCGTAAGAAAAATT | TAG | chr17 | 7111719 | 7111738 | 7111735 | + |
| SEQ ID NO 6536 | GAAATGCGTAAGAAAAATTT | AGG | chr17 | 7111720 | 7111739 | 7111736 | + |
| SEQ ID NO 6537 | AAATGCGTAAGAAAAATTTA | GGG | chr17 | 7111721 | 7111740 | 7111737 | + |
| SEQ ID NO 6538 | GCGTAAGAAAAATTTAGGGC | CAG | chr17 | 7111725 | 7111744 | 7111741 | + |
| SEQ ID NO 6539 | CGTAAGAAAAATTTAGGGCC | AGG | chr17 | 7111726 | 7111745 | 7111742 | + |
| SEQ ID NO 6540 | AAATTTAGGGCCAGGCACTG | TGG | chr17 | 7111734 | 7111753 | 7111750 | + |
| SEQ ID NO 6541 | GTGGATCACATCTGTAATCC | CAG | chr17 | 7111753 | 7111772 | 7111769 | + |
| SEQ ID NO 6542 | CATCTGTAATCCCAGCACTT | TGG | chr17 | 7111761 | 7111780 | 7111777 | + |
| SEQ ID NO 6543 | ATCTGTAATCCCAGCACTTT | GGG | chr17 | 7111762 | 7111781 | 7111778 | + |
| SEQ ID NO 6544 | CTGTAATCCCAGCACTTTGG | GAG | chr17 | 7111764 | 7111783 | 7111780 | + |
| SEQ ID NO 6545 | TGTAATCCCAGCACTTTGGG | AGG | chr17 | 7111765 | 7111784 | 7111781 | + |
| SEQ ID NO 6546 | AGCACTTTGGGAGGTCGACA | CGG | chr17 | 7111774 | 7111793 | 7111790 | + |
| SEQ ID NO 6547 | GCACTTTGGGAGGTCGACAC | GGG | chr17 | 7111775 | 7111794 | 7111791 | + |
| SEQ ID NO 6548 | CACTTTGGGAGGTCGACACG | GGG | chr17 | 7111776 | 7111795 | 7111792 | + |
| SEQ ID NO 6549 | ACTTTGGGAGGTCGACACGG | GGG | chr17 | 7111777 | 7111796 | 7111793 | + |
| SEQ ID NO 6550 | CTTTGGGAGGTCGACACGGG | GGG | chr17 | 7111778 | 7111797 | 7111794 | + |
| SEQ ID NO 6551 | CGACACGGGGGGAATCACTT | GAG | chr17 | 7111789 | 7111808 | 7111805 | + |
| SEQ ID NO 6552 | CGGGGGGAATCACTTGAGCC | CAG | chr17 | 7111794 | 7111813 | 7111810 | + |
| SEQ ID NO 6553 | GGGGGGAATCACTTGAGCCC | AGG | chr17 | 7111795 | 7111814 | 7111811 | + |
| SEQ ID NO 6554 | GGGGAATCACTTGAGCCCAG | GAG | chr17 | 7111797 | 7111816 | 7111813 | + |
| SEQ ID NO 6555 | TCACTTGAGCCCAGGAGCTC | AAG | chr17 | 7111803 | 7111822 | 7111819 | + |
| SEQ ID NO 6556 | TGAGCCCAGGAGCTCAAGAC | TAG | chr17 | 7111808 | 7111827 | 7111824 | + |
| SEQ ID NO 6557 | CCAGGAGCTCAAGACTAGTC | TGG | chr17 | 7111813 | 7111832 | 7111829 | + |
| SEQ ID NO 6558 | CAGGAGCTCAAGACTAGTCT | GGG | chr17 | 7111814 | 7111833 | 7111830 | + |
| SEQ ID NO 6559 | GAGCTCAAGACTAGTCTGGG | CAG | chr17 | 7111817 | 7111836 | 7111833 | + |
| SEQ ID NO 6560 | CAAGACTAGTCTGGGCAGCA | TGG | chr17 | 7111822 | 7111841 | 7111838 | + |
| SEQ ID NO 6561 | CATGGCAAACCCCTCTACA | TGG | chr17 | 7111840 | 7111859 | 7111856 | + |
| SEQ ID NO 6562 | TACAAAAAAAATTTTTAAT | TAG | chr17 | 7111875 | 7111894 | 7111891 | + |
| SEQ ID NO 6563 | AAAAAAAATTTTTAATTAGC | CAG | chr17 | 7111879 | 7111898 | 7111895 | + |
| SEQ ID NO 6564 | AAAAAAATTTTTAATTAGCC | AGG | chr17 | 7111880 | 7111899 | 7111896 | + |
| SEQ ID NO 6565 | AATTTTTAATTAGCCAGGTG | TGG | chr17 | 7111885 | 7111904 | 7111901 | + |
| SEQ ID NO 6566 | GGTGTGGTGCCACATGCCTA | TAG | chr17 | 7111901 | 7111920 | 7111917 | + |
| SEQ ID NO 6567 | GTGCCACATGCCTATAGTCC | CAG | chr17 | 7111907 | 7111926 | 7111923 | + |
| SEQ ID NO 6568 | TGCCTATAGTCCCAGCTACC | TGG | chr17 | 7111915 | 7111934 | 7111931 | + |
| SEQ ID NO 6569 | GCCTATAGTCCCAGCTACCT | GGG | chr17 | 7111916 | 7111935 | 7111932 | + |
| SEQ ID NO 6570 | CTATAGTCCCAGCTACCTGG | GAG | chr17 | 7111918 | 7111937 | 7111934 | + |
| SEQ ID NO 6571 | TATAGTCCCAGCTACCTGGG | AGG | chr17 | 7111919 | 7111938 | 7111935 | + |
| SEQ ID NO 6572 | CCCAGCTACCTGGGAGGCTG | AAG | chr17 | 7111925 | 7111944 | 7111941 | + |
| SEQ ID NO 6573 | AGCTACCTGGGAGGCTGAAG | TGG | chr17 | 7111928 | 7111947 | 7111944 | + |
| SEQ ID NO 6574 | TACCTGGGAGGCTGAAGTGG | AAG | chr17 | 7111931 | 7111950 | 7111947 | + |
| SEQ ID NO 6575 | ACCTGGGAGGCTGAAGTGGA | AGG | chr17 | 7111932 | 7111951 | 7111948 | + |
| SEQ ID NO 6576 | CTGAAGTGGAAGGATCGCCT | GAG | chr17 | 7111942 | 7111961 | 7111958 | + |
| SEQ ID NO 6577 | GTGGAAGGATCGCCTGAGCC | CAG | chr17 | 7111947 | 7111966 | 7111963 | + |

Figure 25 (Cont'd)

| | | | | | | | |
|---|---|---|---|---|---|---|---|
| SEQ ID NO 6578 | TGGAAGGATCGCCTGAGCCC | AGG | chr17 | 7111948 | 7111967 | 7111964 | + |
| SEQ ID NO 6579 | GAAGGATCGCCTGAGCCCAG | GAG | chr17 | 7111950 | 7111969 | 7111966 | + |
| SEQ ID NO 6580 | AAGGATCGCCTGAGCCCAGG | AGG | chr17 | 7111951 | 7111970 | 7111967 | + |
| SEQ ID NO 6581 | GATCGCCTGAGCCCAGGAGG | TGG | chr17 | 7111954 | 7111973 | 7111970 | + |
| SEQ ID NO 6582 | TCGCCTGAGCCCAGGAGGTG | GAG | chr17 | 7111956 | 7111975 | 7111972 | + |
| SEQ ID NO 6583 | CGCCTGAGCCCAGGAGGTGG | AGG | chr17 | 7111957 | 7111976 | 7111973 | + |
| SEQ ID NO 6584 | AGCCCAGGAGGTGGAGGCCA | CAG | chr17 | 7111963 | 7111982 | 7111979 | + |
| SEQ ID NO 6585 | CAGGAGGTGGAGGCCACAGT | GAG | chr17 | 7111967 | 7111986 | 7111983 | + |
| SEQ ID NO 6586 | AGGCCACAGTGAGTTGTGAC | AAG | chr17 | 7111977 | 7111996 | 7111993 | + |
| SEQ ID NO 6587 | TGTGACAAGCTACTGCATTC | CAG | chr17 | 7111991 | 7112010 | 7112007 | + |
| SEQ ID NO 6588 | CAAGCTACTGCATTCCAGCC | TGG | chr17 | 7111996 | 7112015 | 7112012 | + |
| SEQ ID NO 6589 | AAGCTACTGCATTCCAGCCT | GGG | chr17 | 7111997 | 7112016 | 7112013 | + |
| SEQ ID NO 6590 | CTGCATTCCAGCCTGGGCAA | CAG | chr17 | 7112003 | 7112022 | 7112019 | + |
| SEQ ID NO 6591 | GCATTCCAGCCTGGGCAACA | GAG | chr17 | 7112005 | 7112024 | 7112021 | + |
| SEQ ID NO 6592 | TCCAGCCTGGGCAACAGAGT | GAG | chr17 | 7112009 | 7112028 | 7112025 | + |
| SEQ ID NO 6593 | CCTGGGCAACAGAGTGAGAT | GAG | chr17 | 7112014 | 7112033 | 7112030 | + |
| SEQ ID NO 6594 | TGGGCAACAGAGTGAGATGA | GAG | chr17 | 7112016 | 7112035 | 7112032 | + |
| SEQ ID NO 6595 | GGCAACAGAGTGAGATGAGA | GAG | chr17 | 7112018 | 7112037 | 7112034 | + |
| SEQ ID NO 6596 | CAACAGAGTGAGATGAGAGA | GAG | chr17 | 7112020 | 7112039 | 7112036 | + |
| SEQ ID NO 6597 | ACAGAGTGAGATGAGAGAGA | GAG | chr17 | 7112022 | 7112041 | 7112038 | + |
| SEQ ID NO 6598 | AGAGTGAGATGAGAGAGAGA | GAG | chr17 | 7112024 | 7112043 | 7112040 | + |
| SEQ ID NO 6599 | GAGTGAGATGAGAGAGAGAG | AGG | chr17 | 7112025 | 7112044 | 7112041 | + |
| SEQ ID NO 6600 | AGTGAGATGAGAGAGAGAGA | GGG | chr17 | 7112026 | 7112045 | 7112042 | + |
| SEQ ID NO 6601 | GTGAGATGAGAGAGAGAGAG | GGG | chr17 | 7112027 | 7112046 | 7112043 | + |
| SEQ ID NO 6602 | GAGATGAGAGAGAGAGAGGG | GAG | chr17 | 7112029 | 7112048 | 7112045 | + |
| SEQ ID NO 6603 | AGATGAGAGAGAGAGAGGGG | AGG | chr17 | 7112030 | 7112049 | 7112046 | + |
| SEQ ID NO 6604 | GATGAGAGAGAGAGAGGGGA | GGG | chr17 | 7112031 | 7112050 | 7112047 | + |
| SEQ ID NO 6605 | ATGAGAGAGAGAGAGGGGAG | GGG | chr17 | 7112032 | 7112051 | 7112048 | + |
| SEQ ID NO 6606 | AGAGAGAGAGGGGAGGGG | AAG | chr17 | 7112035 | 7112054 | 7112051 | + |
| SEQ ID NO 6607 | AGAGAGGGGAGGGGAAGC | GAG | chr17 | 7112039 | 7112058 | 7112055 | + |
| SEQ ID NO 6608 | GAGAGAGGGGAGGGGAAGCG | AGG | chr17 | 7112040 | 7112059 | 7112056 | + |
| SEQ ID NO 6609 | AGAGAGGGGAGGGGAAGCGA | GGG | chr17 | 7112041 | 7112060 | 7112057 | + |
| SEQ ID NO 6610 | GAGGGGAGGGGAAGCGAGGG | AAG | chr17 | 7112044 | 7112063 | 7112060 | + |
| SEQ ID NO 6611 | AGGGGAGGGGAAGCGAGGGA | AGG | chr17 | 7112045 | 7112064 | 7112061 | + |
| SEQ ID NO 6612 | GAGGGGAAGCGAGGGAAGGA | AAG | chr17 | 7112049 | 7112068 | 7112065 | + |
| SEQ ID NO 6613 | AGGGGAAGCGAGGGAAGGAA | AGG | chr17 | 7112050 | 7112069 | 7112066 | + |
| SEQ ID NO 6614 | GGGAAGCGAGGGAAGGAAAG | GAG | chr17 | 7112052 | 7112071 | 7112068 | + |
| SEQ ID NO 6615 | GGAAGCGAGGGAAGGAAAGG | AGG | chr17 | 7112053 | 7112072 | 7112069 | + |
| SEQ ID NO 6616 | GAAGCGAGGGAAGGAAAGGA | GGG | chr17 | 7112054 | 7112073 | 7112070 | + |
| SEQ ID NO 6617 | AAGCGAGGGAAGGAAAGGAG | GGG | chr17 | 7112055 | 7112074 | 7112071 | + |
| SEQ ID NO 6618 | GCGAGGGAAGGAAAGGAGGG | GAG | chr17 | 7112057 | 7112076 | 7112073 | + |
| SEQ ID NO 6619 | CGAGGGAAGGAAAGGAGGGG | AGG | chr17 | 7112058 | 7112077 | 7112074 | + |
| SEQ ID NO 6620 | GAGGGAAGGAAAGGAGGGGA | GGG | chr17 | 7112059 | 7112078 | 7112075 | + |
| SEQ ID NO 6621 | AGGGAAGGAAAGGAGGGGAG | GGG | chr17 | 7112060 | 7112079 | 7112076 | + |
| SEQ ID NO 6622 | GGAAGGAAAGGAGGGGAGGG | GAG | chr17 | 7112062 | 7112081 | 7112078 | + |
| SEQ ID NO 6623 | GAAGGAAAGGAGGGGAGGGG | AGG | chr17 | 7112063 | 7112082 | 7112079 | + |
| SEQ ID NO 6624 | AAGGAAAGGAGGGGAGGGGA | GGG | chr17 | 7112064 | 7112083 | 7112080 | + |

Figure 25 (Cont'd)

| | | | | | | | |
|---|---|---|---|---|---|---|---|
| SEQ ID NO 6625 | AGGAAAGGAGGGGAGGGGAG | GGG | chr17 | 7112065 | 7112084 | 7112081 | + |
| SEQ ID NO 6626 | GGAAAGGAGGGGAGGGGAGG | GGG | chr17 | 7112066 | 7112085 | 7112082 | + |
| SEQ ID NO 6627 | AAAGGAGGGGAGGGGAGGGG | GAG | chr17 | 7112068 | 7112087 | 7112084 | + |
| SEQ ID NO 6628 | AAGGAGGGGAGGGGAGGGGG | AGG | chr17 | 7112069 | 7112088 | 7112085 | + |
| SEQ ID NO 6629 | AGGAGGGGAGGGGAGGGGGA | GGG | chr17 | 7112070 | 7112089 | 7112086 | + |
| SEQ ID NO 6630 | GGAGGGGAGGGGAGGGGGAG | GGG | chr17 | 7112071 | 7112090 | 7112087 | + |
| SEQ ID NO 6631 | GGGGAGGGGAGGGGGAGGGG | AAG | chr17 | 7112074 | 7112093 | 7112090 | + |
| SEQ ID NO 6632 | GGGAGGGGAGGGGGAGGGGA | AGG | chr17 | 7112075 | 7112094 | 7112091 | + |
| SEQ ID NO 6633 | GGAGGGGAGGGGGAGGGGAA | GGG | chr17 | 7112076 | 7112095 | 7112092 | + |
| SEQ ID NO 6634 | GAGGGGAGGGGGAGGGGAAG | GGG | chr17 | 7112077 | 7112096 | 7112093 | + |
| SEQ ID NO 6635 | GGAGGGGAAGGGGAAAATTT | TAG | chr17 | 7112087 | 7112106 | 7112103 | + |
| SEQ ID NO 6636 | ATTTTAGTTAACTTAATGAA | CAG | chr17 | 7112103 | 7112122 | 7112119 | + |
| SEQ ID NO 6637 | AACTCTATAAAATGAAACAC | TGG | chr17 | 7112130 | 7112149 | 7112146 | + |
| SEQ ID NO 6638 | ACTCTATAAAATGAAACACT | GGG | chr17 | 7112131 | 7112150 | 7112147 | + |
| SEQ ID NO 6639 | TCTATAAAATGAAACACTGG | GAG | chr17 | 7112133 | 7112152 | 7112149 | + |
| SEQ ID NO 6640 | AATGAAACACTGGGAGAAAA | AAG | chr17 | 7112140 | 7112159 | 7112156 | + |
| SEQ ID NO 6641 | GAGAAAAAAGAATTAAAAAA | TGG | chr17 | 7112153 | 7112172 | 7112169 | + |
| SEQ ID NO 6642 | AAAAGAATTAAAAAATGGA | AAG | chr17 | 7112157 | 7112176 | 7112173 | + |
| SEQ ID NO 6643 | AAAGAATTAAAAAATGGAAA | GAG | chr17 | 7112159 | 7112178 | 7112175 | + |
| SEQ ID NO 6644 | TTAAAAAATGGAAAGAGAAT | GAG | chr17 | 7112165 | 7112184 | 7112181 | + |
| SEQ ID NO 6645 | AAAATGGAAAGAGAATGAGT | GAG | chr17 | 7112169 | 7112188 | 7112185 | + |
| SEQ ID NO 6646 | GAAAGAGAATGAGTGAGCTG | TGG | chr17 | 7112175 | 7112194 | 7112191 | + |
| SEQ ID NO 6647 | AAAGAGAATGAGTGAGCTGT | GGG | chr17 | 7112176 | 7112195 | 7112192 | + |
| SEQ ID NO 6648 | TGCATAATTGAAATCTTTAA | AAG | chr17 | 7112211 | 7112230 | 7112227 | + |
| SEQ ID NO 6649 | ATTGAAATCTTTAAAAGAAA | AAG | chr17 | 7112217 | 7112236 | 7112233 | + |
| SEQ ID NO 6650 | TTGAAATCTTTAAAAGAAAA | AGG | chr17 | 7112218 | 7112237 | 7112234 | + |
| SEQ ID NO 6651 | TGAAATCTTTAAAAGAAAAA | GGG | chr17 | 7112219 | 7112238 | 7112235 | + |
| SEQ ID NO 6652 | GAAATCTTTAAAAGAAAAAG | GGG | chr17 | 7112220 | 7112239 | 7112236 | + |
| SEQ ID NO 6653 | AAATCTTTAAAAGAAAAAGG | GGG | chr17 | 7112221 | 7112240 | 7112237 | + |
| SEQ ID NO 6654 | TCTTTAAAAGAAAAAGGGGG | TAG | chr17 | 7112224 | 7112243 | 7112240 | + |
| SEQ ID NO 6655 | TTAAAAGAAAAAGGGGGTAG | CAG | chr17 | 7112227 | 7112246 | 7112243 | + |
| SEQ ID NO 6656 | GGGGGTAGCAGAAAAAAATC | AAG | chr17 | 7112239 | 7112258 | 7112255 | + |
| SEQ ID NO 6657 | GCAGAAAAAAATCAAGTGCT | GAG | chr17 | 7112246 | 7112265 | 7112262 | + |
| SEQ ID NO 6658 | AAAAAATCAAGTGCTGAGAC | AAG | chr17 | 7112251 | 7112270 | 7112267 | + |
| SEQ ID NO 6659 | AAATCAAGTGCTGAGACAAG | TGG | chr17 | 7112254 | 7112273 | 7112270 | + |
| SEQ ID NO 6660 | TCAAGTGCTGAGACAAGTGG | AAG | chr17 | 7112257 | 7112276 | 7112273 | + |
| SEQ ID NO 6661 | GTGCTGAGACAAGTGGAAGA | TGG | chr17 | 7112261 | 7112280 | 7112277 | + |
| SEQ ID NO 6662 | TGCTGAGACAAGTGGAAGAT | GGG | chr17 | 7112262 | 7112281 | 7112278 | + |
| SEQ ID NO 6663 | GACAAGTGGAAGATGGGCCC | CGG | chr17 | 7112268 | 7112287 | 7112284 | + |
| SEQ ID NO 6664 | AGTGGAAGATGGGCCCCGGT | GAG | chr17 | 7112272 | 7112291 | 7112288 | + |
| SEQ ID NO 6665 | GGAAGATGGGCCCCGGTGAG | CAG | chr17 | 7112275 | 7112294 | 7112291 | + |
| SEQ ID NO 6666 | GGCCCCGGTGAGCAGCTGAT | CAG | chr17 | 7112283 | 7112302 | 7112299 | + |
| SEQ ID NO 6667 | GGTGAGCAGCTGATCAGTGT | CAG | chr17 | 7112289 | 7112308 | 7112305 | + |
| SEQ ID NO 6668 | CTCCCATGATGACGTTCCCC | CAG | chr17 | 7112312 | 7112331 | 7112328 | + |
| SEQ ID NO 6669 | TTCCCCAGCCCCACCACC | CGG | chr17 | 7112326 | 7112345 | 7112342 | + |
| SEQ ID NO 6670 | TCCCCAGCCCCACCACCC | GGG | chr17 | 7112327 | 7112346 | 7112343 | + |
| SEQ ID NO 6671 | GCCCCACCACCCGGGCTGC | TGG | chr17 | 7112334 | 7112353 | 7112350 | + |

Figure 25 (Cont'd)

| | | | | | | | |
|---|---|---|---|---|---|---|---|
| SEQ ID NO 6672 | CCCCACCACCCGGGCTGCTG | GAG | chr17 | 7112336 | 7112355 | 7112352 | + |
| SEQ ID NO 6673 | CCCACCACCCGGGCTGCTGG | AGG | chr17 | 7112337 | 7112356 | 7112353 | + |
| SEQ ID NO 6674 | CCACCACCCGGGCTGCTGGA | GGG | chr17 | 7112338 | 7112357 | 7112354 | + |
| SEQ ID NO 6675 | CGGGCTGCTGGAGGGAAATG | CGG | chr17 | 7112346 | 7112365 | 7112362 | + |
| SEQ ID NO 6676 | GTGACTTTGCTACATCCCTT | CAG | chr17 | 7112368 | 7112387 | 7112384 | + |
| SEQ ID NO 6677 | CTTTGCTACATCCCTTCAGA | CGG | chr17 | 7112372 | 7112391 | 7112388 | + |
| SEQ ID NO 6678 | CCCTTCAGACGGTCCCTCAC | TGG | chr17 | 7112383 | 7112402 | 7112399 | + |
| SEQ ID NO 6679 | GGTCCCTCACTGGTGTCCCT | CAG | chr17 | 7112393 | 7112412 | 7112409 | + |
| SEQ ID NO 6680 | GTCCCTCAGCCCATTCGCGT | GAG | chr17 | 7112407 | 7112426 | 7112423 | + |
| SEQ ID NO 6681 | GCTCACTCTCCCATTAATTT | CAG | chr17 | 7112429 | 7112448 | 7112445 | + |
| SEQ ID NO 6682 | CCCATTAATTTCAGAAATCC | TGG | chr17 | 7112438 | 7112457 | 7112454 | + |
| SEQ ID NO 6683 | AGAAATCCTGGCCTCTCTCC | AAG | chr17 | 7112450 | 7112469 | 7112466 | + |
| SEQ ID NO 6684 | ACTCTAAATTCTGTCACCCT | CAG | chr17 | 7112485 | 7112504 | 7112501 | + |
| SEQ ID NO 6685 | CTAAATTCTGTCACCCTCAG | AAG | chr17 | 7112488 | 7112507 | 7112504 | + |
| SEQ ID NO 6686 | TCTGTCACCCTCAGAAGATT | CAG | chr17 | 7112494 | 7112513 | 7112510 | + |
| SEQ ID NO 6687 | GTCACCCTCAGAAGATTCAG | CAG | chr17 | 7112497 | 7112516 | 7112513 | + |
| SEQ ID NO 6688 | CAGCATCCCGTATTCTCTCT | GAG | chr17 | 7112517 | 7112536 | 7112533 | + |
| SEQ ID NO 6689 | TCTGAGTGTTCACTATGTAC | CGG | chr17 | 7112534 | 7112553 | 7112550 | + |
| SEQ ID NO 6690 | CTGAGTGTTCACTATGTACC | GGG | chr17 | 7112535 | 7112554 | 7112551 | + |
| SEQ ID NO 6691 | ACTATGTACCGGGTGCCGTG | TGG | chr17 | 7112545 | 7112564 | 7112561 | + |
| SEQ ID NO 6692 | CTATGTACCGGGTGCCGTGT | GGG | chr17 | 7112546 | 7112565 | 7112562 | + |
| SEQ ID NO 6693 | ACCGGGTGCCGTGTGGGCAC | TGG | chr17 | 7112552 | 7112571 | 7112568 | + |
| SEQ ID NO 6694 | CGGGTGCCGTGTGGGCACTG | GAG | chr17 | 7112554 | 7112573 | 7112570 | + |
| SEQ ID NO 6695 | CCGTGTGGGCACTGGAGTTG | CAG | chr17 | 7112560 | 7112579 | 7112576 | + |
| SEQ ID NO 6696 | GTGTGGGCACTGGAGTTGCA | GAG | chr17 | 7112562 | 7112581 | 7112578 | + |
| SEQ ID NO 6697 | TGTGGGCACTGGAGTTGCAG | AGG | chr17 | 7112563 | 7112582 | 7112579 | + |
| SEQ ID NO 6698 | TGGGCACTGGAGTTGCAGAG | GAG | chr17 | 7112565 | 7112584 | 7112581 | + |
| SEQ ID NO 6699 | GGCACTGGAGTTGCAGAGGA | GAG | chr17 | 7112567 | 7112586 | 7112583 | + |
| SEQ ID NO 6700 | CTGGAGTTGCAGAGGAGAGT | GAG | chr17 | 7112571 | 7112590 | 7112587 | + |
| SEQ ID NO 6701 | TGGAGTTGCAGAGGAGAGTG | AGG | chr17 | 7112572 | 7112591 | 7112588 | + |
| SEQ ID NO 6702 | AGTTGCAGAGGAGAGTGAGG | CGG | chr17 | 7112575 | 7112594 | 7112591 | + |
| SEQ ID NO 6703 | GCAGAGGAGAGTGAGGCGGA | CAG | chr17 | 7112579 | 7112598 | 7112595 | + |
| SEQ ID NO 6704 | CAGAGGAGAGTGAGGCGGAC | AGG | chr17 | 7112580 | 7112599 | 7112596 | + |
| SEQ ID NO 6705 | AGAGGAGAGTGAGGCGGACA | GGG | chr17 | 7112581 | 7112600 | 7112597 | + |
| SEQ ID NO 6706 | GCGGACAGGGCCTCTGCCTG | TGG | chr17 | 7112594 | 7112613 | 7112610 | + |
| SEQ ID NO 6707 | CGGACAGGGCCTCTGCCTGT | GGG | chr17 | 7112595 | 7112614 | 7112611 | + |
| SEQ ID NO 6708 | GGACAGGGCCTCTGCCTGTG | GGG | chr17 | 7112596 | 7112615 | 7112612 | + |
| SEQ ID NO 6709 | CTGCCTGTGGGGACACCGCC | TGG | chr17 | 7112607 | 7112626 | 7112623 | + |
| SEQ ID NO 6710 | CCTGTGGGGACACCGCCTGG | TGG | chr17 | 7112610 | 7112629 | 7112626 | + |
| SEQ ID NO 6711 | CTGTGGGGACACCGCCTGGT | GGG | chr17 | 7112611 | 7112630 | 7112627 | + |
| SEQ ID NO 6712 | TGGGGACACCGCCTGGTGGG | AAG | chr17 | 7112614 | 7112633 | 7112630 | + |
| SEQ ID NO 6713 | ACACCGCCTGGTGGGAAGTC | CAG | chr17 | 7112619 | 7112638 | 7112635 | + |
| SEQ ID NO 6714 | CGCCTGGTGGGAAGTCCAGC | CAG | chr17 | 7112623 | 7112642 | 7112639 | + |
| SEQ ID NO 6715 | GAAGTCCAGCCAGCCCCCTA | CAG | chr17 | 7112633 | 7112652 | 7112649 | + |
| SEQ ID NO 6716 | AGTCCAGCCAGCCCCCTACA | GAG | chr17 | 7112635 | 7112654 | 7112651 | + |
| SEQ ID NO 6717 | TCCAGCCAGCCCCCTACAGA | GAG | chr17 | 7112637 | 7112656 | 7112653 | + |
| SEQ ID NO 6718 | CAGCCAGCCCCCTACAGAGA | GAG | chr17 | 7112639 | 7112658 | 7112655 | + |

Figure 25 (Cont'd)

| | | | | | | | |
|---|---|---|---|---|---|---|---|
| SEQ ID NO 6719 | AGCCAGCCCCCTACAGAGAG | AGG | chr17 | 7112640 | 7112659 | 7112656 | + |
| SEQ ID NO 6720 | CCAGCCCCCTACAGAGAGAG | GAG | chr17 | 7112642 | 7112661 | 7112658 | + |
| SEQ ID NO 6721 | ACAGAGAGAGGAGATGCTAC | TGG | chr17 | 7112652 | 7112671 | 7112668 | + |
| SEQ ID NO 6722 | GAGATGCTACTGGTGTTCCT | GAG | chr17 | 7112662 | 7112681 | 7112678 | + |
| SEQ ID NO 6723 | ATGCTACTGGTGTTCCTGAG | TGG | chr17 | 7112665 | 7112684 | 7112681 | + |
| SEQ ID NO 6724 | TGGTGTTCCTGAGTGGTCCT | CGG | chr17 | 7112672 | 7112691 | 7112688 | + |
| SEQ ID NO 6725 | GGTGTTCCTGAGTGGTCCTC | GGG | chr17 | 7112673 | 7112692 | 7112689 | + |
| SEQ ID NO 6726 | TGTTCCTGAGTGGTCCTCGG | GAG | chr17 | 7112675 | 7112694 | 7112691 | + |
| SEQ ID NO 6727 | GTTCCTGAGTGGTCCTCGGG | AGG | chr17 | 7112676 | 7112695 | 7112692 | + |
| SEQ ID NO 6728 | TTCCTGAGTGGTCCTCGGGA | GGG | chr17 | 7112677 | 7112696 | 7112693 | + |
| SEQ ID NO 6729 | GTCCCCTGCCCTGCCCTGCC | CAG | chr17 | 7112716 | 7112735 | 7112732 | + |
| SEQ ID NO 6730 | TGCCCTGCCCTGCCCAGCAC | CGG | chr17 | 7112722 | 7112741 | 7112738 | + |
| SEQ ID NO 6731 | GCCCAGCACCGGCCCTCCCT | CGG | chr17 | 7112733 | 7112752 | 7112749 | + |
| SEQ ID NO 6732 | AGCACCGGCCCTCCCTCGGT | TGG | chr17 | 7112737 | 7112756 | 7112753 | + |
| SEQ ID NO 6733 | CCGGCCCTCCCTCGGTTGGC | CAG | chr17 | 7112741 | 7112760 | 7112757 | + |
| SEQ ID NO 6734 | CTCCCTCGGTTGGCCAGCCT | CAG | chr17 | 7112747 | 7112766 | 7112763 | + |
| SEQ ID NO 6735 | TCCCTCGGTTGGCCAGCCTC | AGG | chr17 | 7112748 | 7112767 | 7112764 | + |
| SEQ ID NO 6736 | GGTTGGCCAGCCTCAGGAAT | GAG | chr17 | 7112754 | 7112773 | 7112770 | + |
| SEQ ID NO 6737 | GTTGGCCAGCCTCAGGAATG | AGG | chr17 | 7112755 | 7112774 | 7112771 | + |
| SEQ ID NO 6738 | TGGCCAGCCTCAGGAATGAG | GAG | chr17 | 7112757 | 7112776 | 7112773 | + |
| SEQ ID NO 6739 | GAATGAGGAGTCCCTCATTC | CAG | chr17 | 7112770 | 7112789 | 7112786 | + |
| SEQ ID NO 6740 | AGGAGTCCCTCATTCCAGCC | CAG | chr17 | 7112775 | 7112794 | 7112791 | + |
| SEQ ID NO 6741 | AGCTAACCAATCCCCTTCCT | AAG | chr17 | 7112796 | 7112815 | 7112812 | + |
| SEQ ID NO 6742 | CAATCCCCTTCCTAAGCTCC | AAG | chr17 | 7112803 | 7112822 | 7112819 | + |
| SEQ ID NO 6743 | CCCTGCTCCTCCTGCCTCCA | TGG | chr17 | 7112827 | 7112846 | 7112843 | + |
| SEQ ID NO 6744 | CCTCCTGCCTCCATGGAACC | CGG | chr17 | 7112834 | 7112853 | 7112850 | + |
| SEQ ID NO 6745 | ATGGAACCCGGCTCCACCAC | CAG | chr17 | 7112846 | 7112865 | 7112862 | + |
| SEQ ID NO 6746 | ACCTGACACTCCTCCATTCC | TGG | chr17 | 7112878 | 7112897 | 7112894 | + |
| SEQ ID NO 6747 | CTGGCTCTTGCCCTTCTGCC | TAG | chr17 | 7112897 | 7112916 | 7112913 | + |
| SEQ ID NO 6748 | CCCTTCTGCCTAGCACTGCT | CAG | chr17 | 7112907 | 7112926 | 7112923 | + |
| SEQ ID NO 6749 | ACCTTAAAATCTTTTCCCAC | CAG | chr17 | 7112939 | 7112958 | 7112955 | + |
| SEQ ID NO 6750 | AAAATCTTTTCCCACCAGCC | TGG | chr17 | 7112944 | 7112963 | 7112960 | + |
| SEQ ID NO 6751 | AAATCTTTTCCCACCAGCCT | GGG | chr17 | 7112945 | 7112964 | 7112961 | + |
| SEQ ID NO 6752 | TCCCACCAGCCTGGGCAACA | TAG | chr17 | 7112953 | 7112972 | 7112969 | + |
| SEQ ID NO 6753 | ACCAGCCTGGGCAACATAGC | AAG | chr17 | 7112957 | 7112976 | 7112973 | + |
| SEQ ID NO 6754 | AAAAATTTTTTTTAATTTGC | CAG | chr17 | 7112994 | 7113013 | 7113010 | + |
| SEQ ID NO 6755 | AAAATTTTTTTTAATTTGCC | AGG | chr17 | 7112995 | 7113014 | 7113011 | + |
| SEQ ID NO 6756 | TTTTTTTAATTTGCCAGGCA | CAG | chr17 | 7113000 | 7113019 | 7113016 | + |
| SEQ ID NO 6757 | TTTTAATTTGCCAGGCACAG | TGG | chr17 | 7113003 | 7113022 | 7113019 | + |
| SEQ ID NO 6758 | GCACAGTGGTGCACACCTGT | AAG | chr17 | 7113017 | 7113036 | 7113033 | + |
| SEQ ID NO 6759 | ACCTGTAAGTCCTAACTACT | TGG | chr17 | 7113031 | 7113050 | 7113047 | + |
| SEQ ID NO 6760 | CCTGTAAGTCCTAACTACTT | GGG | chr17 | 7113032 | 7113051 | 7113048 | + |
| SEQ ID NO 6761 | TGTAAGTCCTAACTACTTGG | GAG | chr17 | 7113034 | 7113053 | 7113050 | + |
| SEQ ID NO 6762 | GTAAGTCCTAACTACTTGGG | AGG | chr17 | 7113035 | 7113054 | 7113051 | + |
| SEQ ID NO 6763 | TCCTAACTACTTGGGAGGCT | GAG | chr17 | 7113040 | 7113059 | 7113056 | + |
| SEQ ID NO 6764 | CCTAACTACTTGGGAGGCTG | AGG | chr17 | 7113041 | 7113060 | 7113057 | + |
| SEQ ID NO 6765 | AACTACTTGGGAGGCTGAGG | TGG | chr17 | 7113044 | 7113063 | 7113060 | + |

Figure 25 (Cont'd)

| SEQ ID NO 6766 | ACTACTTGGGAGGCTGAGGT | GGG | chr17 | 7113045 | 7113064 | 7113061 | + |
| SEQ ID NO 6767 | TACTTGGGAGGCTGAGGTGG | GAG | chr17 | 7113047 | 7113066 | 7113063 | + |
| SEQ ID NO 6768 | ACTTGGGAGGCTGAGGTGGG | AGG | chr17 | 7113048 | 7113067 | 7113064 | + |
| SEQ ID NO 6769 | GGGAGGCTGAGGTGGGAGGA | TGG | chr17 | 7113052 | 7113071 | 7113068 | + |
| SEQ ID NO 6770 | CTGAGGTGGGAGGATGGCTT | GAG | chr17 | 7113058 | 7113077 | 7113074 | + |
| SEQ ID NO 6771 | GTGGGAGGATGGCTTGAGCC | CAG | chr17 | 7113063 | 7113082 | 7113079 | + |
| SEQ ID NO 6772 | TGGGAGGATGGCTTGAGCCC | AGG | chr17 | 7113064 | 7113083 | 7113080 | + |
| SEQ ID NO 6773 | GGAGGATGGCTTGAGCCCAG | GAG | chr17 | 7113066 | 7113085 | 7113082 | + |
| SEQ ID NO 6774 | TGGCTTGAGCCCAGGAGTTC | GAG | chr17 | 7113072 | 7113091 | 7113088 | + |
| SEQ ID NO 6775 | GGCTTGAGCCCAGGAGTTCG | AGG | chr17 | 7113073 | 7113092 | 7113089 | + |
| SEQ ID NO 6776 | AGCCCAGGAGTTCGAGGTTG | CAG | chr17 | 7113079 | 7113098 | 7113095 | + |
| SEQ ID NO 6777 | CAGGAGTTCGAGGTTGCAGT | GAG | chr17 | 7113083 | 7113102 | 7113099 | + |
| SEQ ID NO 6778 | TCTCTAAAAAAAAAATGTCC | AAG | chr17 | 7113131 | 7113150 | 7113147 | + |
| SEQ ID NO 6779 | AAAAAAATGTCCAAGATACT | TAG | chr17 | 7113139 | 7113158 | 7113155 | + |
| SEQ ID NO 6780 | AAAAAATGTCCAAGATACTT | AGG | chr17 | 7113140 | 7113159 | 7113156 | + |
| SEQ ID NO 6781 | TCCAAGATACTTAGGTCCTT | CAG | chr17 | 7113148 | 7113167 | 7113164 | + |
| SEQ ID NO 6782 | GATACTTAGGTCCTTCAGTC | AAG | chr17 | 7113153 | 7113172 | 7113169 | + |
| SEQ ID NO 6783 | CCTTCAGTCAAGATTTATTA | CAG | chr17 | 7113164 | 7113183 | 7113180 | + |
| SEQ ID NO 6784 | TCAGTCAAGATTTATTACAG | AAG | chr17 | 7113167 | 7113186 | 7113183 | + |
| SEQ ID NO 6785 | CAGTCAAGATTTATTACAGA | AGG | chr17 | 7113168 | 7113187 | 7113184 | + |
| SEQ ID NO 6786 | AGATTTATTACAGAAGGATC | CAG | chr17 | 7113174 | 7113193 | 7113190 | + |
| SEQ ID NO 6787 | GATTTATTACAGAAGGATCC | AGG | chr17 | 7113175 | 7113194 | 7113191 | + |
| SEQ ID NO 6788 | ATTTATTACAGAAGGATCCA | GGG | chr17 | 7113176 | 7113195 | 7113192 | + |
| SEQ ID NO 6789 | TATTACAGAAGGATCCAGGG | AAG | chr17 | 7113179 | 7113198 | 7113195 | + |
| SEQ ID NO 6790 | ATTACAGAAGGATCCAGGGA | AGG | chr17 | 7113180 | 7113199 | 7113196 | + |
| SEQ ID NO 6791 | TTACAGAAGGATCCAGGGAA | GGG | chr17 | 7113181 | 7113200 | 7113197 | + |
| SEQ ID NO 6792 | AAGGATCCAGGGAAGGGTCT | TGG | chr17 | 7113187 | 7113206 | 7113203 | + |
| SEQ ID NO 6793 | AGGATCCAGGGAAGGGTCTT | GGG | chr17 | 7113188 | 7113207 | 7113204 | + |
| SEQ ID NO 6794 | GATCCAGGGAAGGGTCTTGG | GAG | chr17 | 7113190 | 7113209 | 7113206 | + |
| SEQ ID NO 6795 | AGGGAAGGGTCTTGGGAGAT | GAG | chr17 | 7113195 | 7113214 | 7113211 | + |
| SEQ ID NO 6796 | GGAAGGGTCTTGGGAGATGA | GAG | chr17 | 7113197 | 7113216 | 7113213 | + |
| SEQ ID NO 6797 | GAAGGGTCTTGGGAGATGAG | AGG | chr17 | 7113198 | 7113217 | 7113214 | + |
| SEQ ID NO 6798 | AGGGTCTTGGGAGATGAGAG | GAG | chr17 | 7113200 | 7113219 | 7113216 | + |
| SEQ ID NO 6799 | GTCTTGGGAGATGAGAGGAG | CAG | chr17 | 7113203 | 7113222 | 7113219 | + |
| SEQ ID NO 6800 | TCTTGGGAGATGAGAGGAGC | AGG | chr17 | 7113204 | 7113223 | 7113220 | + |
| SEQ ID NO 6801 | CTTGGGAGATGAGAGGAGCA | GGG | chr17 | 7113205 | 7113224 | 7113221 | + |
| SEQ ID NO 6802 | TGAGAGGAGCAGGGATCTTC | CAG | chr17 | 7113214 | 7113233 | 7113230 | + |
| SEQ ID NO 6803 | GAGAGGAGCAGGGATCTTCC | AGG | chr17 | 7113215 | 7113234 | 7113231 | + |
| SEQ ID NO 6804 | CACAACATACACACATGCAC | AAG | chr17 | 7113605 | 7113624 | 7113621 | + |
| SEQ ID NO 6805 | CACAACATACACTCACACAC | AAG | chr17 | 7113642 | 7113661 | 7113658 | + |
| SEQ ID NO 6806 | CATTCACTCACACACACACA | CAG | chr17 | 7113793 | 7113812 | 7113809 | + |
| SEQ ID NO 6807 | TTCACTCACACACACACACA | GAG | chr17 | 7113795 | 7113814 | 7113811 | + |
| SEQ ID NO 6808 | CACACACACACAGAGTCC | CAG | chr17 | 7113801 | 7113820 | 7113817 | + |
| SEQ ID NO 6809 | ATACGTGCACACGCACATAC | GAG | chr17 | 7113849 | 7113868 | 7113865 | + |
| SEQ ID NO 6810 | TACGTGCACACGCACATACG | AGG | chr17 | 7113850 | 7113869 | 7113866 | + |
| SEQ ID NO 6811 | ATACGAGGCACATGTGTTCT | TGG | chr17 | 7113865 | 7113884 | 7113881 | + |
| SEQ ID NO 6812 | TACGAGGCACATGTGTTCTT | GGG | chr17 | 7113866 | 7113885 | 7113882 | + |

Figure 25 (Cont'd)

| | | | | | | | |
|---|---|---|---|---|---|---|---|
| SEQ ID NO 6813 | AGGCACATGTGTTCTTGGGT | TGG | chr17 | 7113870 | 7113889 | 7113886 | + |
| SEQ ID NO 6814 | GGCACATGTGTTCTTGGGTT | GGG | chr17 | 7113871 | 7113890 | 7113887 | + |
| SEQ ID NO 6815 | CACATGTGTTCTTGGGTTGG | GAG | chr17 | 7113873 | 7113892 | 7113889 | + |
| SEQ ID NO 6816 | ACATGTGTTCTTGGGTTGGG | AGG | chr17 | 7113874 | 7113893 | 7113890 | + |
| SEQ ID NO 6817 | ATGTGTTCTTGGGTTGGGAG | GAG | chr17 | 7113876 | 7113895 | 7113892 | + |
| SEQ ID NO 6818 | TGTTCTTGGGTTGGGAGGAG | AAG | chr17 | 7113879 | 7113898 | 7113895 | + |
| SEQ ID NO 6819 | GTTCTTGGGTTGGGAGGAGA | AGG | chr17 | 7113880 | 7113899 | 7113896 | + |
| SEQ ID NO 6820 | TTCTTGGGTTGGGAGGAGAA | GGG | chr17 | 7113881 | 7113900 | 7113897 | + |
| SEQ ID NO 6821 | TTGGGTTGGGAGGAGAAGGG | CAG | chr17 | 7113884 | 7113903 | 7113900 | + |
| SEQ ID NO 6822 | TGGGTTGGGAGGAGAAGGGC | AGG | chr17 | 7113885 | 7113904 | 7113901 | + |
| SEQ ID NO 6823 | GTTGGGAGGAGAAGGGCAGG | CAG | chr17 | 7113888 | 7113907 | 7113904 | + |
| SEQ ID NO 6824 | AAGGGCAGGCAGTTATCTTC | CAG | chr17 | 7113899 | 7113918 | 7113915 | + |
| SEQ ID NO 6825 | TCCAGATCTCCCCACACCTC | TGG | chr17 | 7113917 | 7113936 | 7113933 | + |
| SEQ ID NO 6826 | CCTCTGGCACATGCCTTTCC | TGG | chr17 | 7113933 | 7113952 | 7113949 | + |
| SEQ ID NO 6827 | CTCTGGCACATGCCTTTCCT | GGG | chr17 | 7113934 | 7113953 | 7113950 | + |
| SEQ ID NO 6828 | TCTGGCACATGCCTTTCCTG | GGG | chr17 | 7113935 | 7113954 | 7113951 | + |
| SEQ ID NO 6829 | ACATGCCTTTCCTGGGGTCC | TGG | chr17 | 7113941 | 7113960 | 7113957 | + |
| SEQ ID NO 6830 | CATGCCTTTCCTGGGGTCCT | GGG | chr17 | 7113942 | 7113961 | 7113958 | + |
| SEQ ID NO 6831 | ATGCCTTTCCTGGGGTCCTG | GGG | chr17 | 7113943 | 7113962 | 7113959 | + |
| SEQ ID NO 6832 | CCTTTCCTGGGGTCCTGGGG | TAG | chr17 | 7113946 | 7113965 | 7113962 | + |
| SEQ ID NO 6833 | TCCTGGGGTCCTGGGGTAGA | CAG | chr17 | 7113950 | 7113969 | 7113966 | + |
| SEQ ID NO 6834 | CCTGGGGTCCTGGGGTAGAC | AGG | chr17 | 7113951 | 7113970 | 7113967 | + |
| SEQ ID NO 6835 | GGGGTCCTGGGGTAGACAGG | AAG | chr17 | 7113954 | 7113973 | 7113970 | + |
| SEQ ID NO 6836 | GGGTCCTGGGGTAGACAGGA | AGG | chr17 | 7113955 | 7113974 | 7113971 | + |
| SEQ ID NO 6837 | CCTGGGGTAGACAGGAAGGT | GAG | chr17 | 7113959 | 7113978 | 7113975 | + |
| SEQ ID NO 6838 | CTGGGGTAGACAGGAAGGTG | AGG | chr17 | 7113960 | 7113979 | 7113976 | + |
| SEQ ID NO 6839 | GGTAGACAGGAAGGTGAGGT | GAG | chr17 | 7113964 | 7113983 | 7113980 | + |
| SEQ ID NO 6840 | GTAGACAGGAAGGTGAGGTG | AGG | chr17 | 7113965 | 7113984 | 7113981 | + |
| SEQ ID NO 6841 | TAGACAGGAAGGTGAGGTGA | GGG | chr17 | 7113966 | 7113985 | 7113982 | + |
| SEQ ID NO 6842 | GGAAGGTGAGGTGAGGGAAC | AAG | chr17 | 7113972 | 7113991 | 7113988 | + |
| SEQ ID NO 6843 | AGGTGAGGTGAGGGAACAAG | CGG | chr17 | 7113975 | 7113994 | 7113991 | + |
| SEQ ID NO 6844 | GGTGAGGTGAGGGAACAAGC | GGG | chr17 | 7113976 | 7113995 | 7113992 | + |
| SEQ ID NO 6845 | GTGAGGTGAGGGAACAAGCG | GGG | chr17 | 7113977 | 7113996 | 7113993 | + |
| SEQ ID NO 6846 | TGAGGTGAGGGAACAAGCGG | GGG | chr17 | 7113978 | 7113997 | 7113994 | + |
| SEQ ID NO 6847 | GAGGGAACAAGCGGGGTGT | CGG | chr17 | 7113984 | 7114003 | 7114000 | + |
| SEQ ID NO 6848 | AGGGAACAAGCGGGGTGTC | GGG | chr17 | 7113985 | 7114004 | 7114001 | + |
| SEQ ID NO 6849 | CGGGGGTGTCGGGCCTCCT | CAG | chr17 | 7113995 | 7114014 | 7114011 | + |
| SEQ ID NO 6850 | CCCTCCTCAGTCCCTGTTCA | CAG | chr17 | 7114008 | 7114027 | 7114024 | + |
| SEQ ID NO 6851 | CTCCTCAGTCCCTGTTCACA | GAG | chr17 | 7114010 | 7114029 | 7114026 | + |
| SEQ ID NO 6852 | CTCAGTCCCTGTTCACAGAG | TGG | chr17 | 7114013 | 7114032 | 7114029 | + |
| SEQ ID NO 6853 | TCAGTCCCTGTTCACAGAGT | GGG | chr17 | 7114014 | 7114033 | 7114030 | + |
| SEQ ID NO 6854 | CCCTGTTCACAGAGTGGGT | CGG | chr17 | 7114019 | 7114038 | 7114035 | + |
| SEQ ID NO 6855 | TGTTCACAGAGTGGGTGCGG | CAG | chr17 | 7114022 | 7114041 | 7114038 | + |
| SEQ ID NO 6856 | TTCACAGAGTGGGTGCGGCA | GAG | chr17 | 7114024 | 7114043 | 7114040 | + |
| SEQ ID NO 6857 | TGGGTGCGGCAGAGACCTCA | AAG | chr17 | 7114033 | 7114052 | 7114049 | + |
| SEQ ID NO 6858 | GGGTGCGGCAGAGACCTCAA | AGG | chr17 | 7114034 | 7114053 | 7114050 | + |
| SEQ ID NO 6859 | GGTGCGGCAGAGACCTCAAA | GGG | chr17 | 7114035 | 7114054 | 7114051 | + |

Figure 25 (Cont'd)

| | | | | | | | |
|---|---|---|---|---|---|---|---|
| SEQ ID NO 6860 | CGGCAGAGACCTCAAAGGGA | CAG | chr17 | 7114039 | 7114058 | 7114055 | + |
| SEQ ID NO 6861 | GCAGAGACCTCAAAGGGACA | GAG | chr17 | 7114041 | 7114060 | 7114057 | + |
| SEQ ID NO 6862 | CAAAGGGACAGAGCAATCAT | GAG | chr17 | 7114051 | 7114070 | 7114067 | + |
| SEQ ID NO 6863 | GGACAGAGCAATCATGAGCT | GAG | chr17 | 7114056 | 7114075 | 7114072 | + |
| SEQ ID NO 6864 | AGAGCAATCATGAGCTGAGA | CAG | chr17 | 7114060 | 7114079 | 7114076 | + |
| SEQ ID NO 6865 | AGCAATCATGAGCTGAGACA | GAG | chr17 | 7114062 | 7114081 | 7114078 | + |
| SEQ ID NO 6866 | GCAATCATGAGCTGAGACAG | AGG | chr17 | 7114063 | 7114082 | 7114079 | + |
| SEQ ID NO 6867 | CAATCATGAGCTGAGACAGA | GGG | chr17 | 7114064 | 7114083 | 7114080 | + |
| SEQ ID NO 6868 | AATCATGAGCTGAGACAGAG | GGG | chr17 | 7114065 | 7114084 | 7114081 | + |
| SEQ ID NO 6869 | ATCATGAGCTGAGACAGAGG | GGG | chr17 | 7114066 | 7114085 | 7114082 | + |
| SEQ ID NO 6870 | CATGAGCTGAGACAGAGGGG | GAG | chr17 | 7114068 | 7114087 | 7114084 | + |
| SEQ ID NO 6871 | GCTGAGACAGAGGGGGAGCA | AAG | chr17 | 7114073 | 7114092 | 7114089 | + |
| SEQ ID NO 6872 | ACAGAGGGGGAGCAAAGCCG | CAG | chr17 | 7114079 | 7114098 | 7114095 | + |
| SEQ ID NO 6873 | GCACACTTGCCTTTCAAAAA | TGG | chr17 | 7114107 | 7114126 | 7114123 | + |
| SEQ ID NO 6874 | CAAAAATGGATTTCCTCTCC | TGG | chr17 | 7114121 | 7114140 | 7114137 | + |
| SEQ ID NO 6875 | AAAAATGGATTTCCTCTCCT | GGG | chr17 | 7114122 | 7114141 | 7114138 | + |
| SEQ ID NO 6876 | GGATTTCCTCTCCTGGGATT | CAG | chr17 | 7114128 | 7114147 | 7114144 | + |
| SEQ ID NO 6877 | TCTCCTGGGATTCAGCCTGC | GAG | chr17 | 7114136 | 7114155 | 7114152 | + |
| SEQ ID NO 6878 | GGATTCAGCCTGCGAGTGCC | TGG | chr17 | 7114143 | 7114162 | 7114159 | + |
| SEQ ID NO 6879 | TGCCTGGCCCCTCACCTTGA | TGG | chr17 | 7114159 | 7114178 | 7114175 | + |
| SEQ ID NO 6880 | TGGCCCCTCACCTTGATGGA | AAG | chr17 | 7114163 | 7114182 | 7114179 | + |
| SEQ ID NO 6881 | GGCCCCTCACCTTGATGGAA | AGG | chr17 | 7114164 | 7114183 | 7114180 | + |
| SEQ ID NO 6882 | CCTCACCTTGATGGAAAGGA | TGG | chr17 | 7114168 | 7114187 | 7114184 | + |
| SEQ ID NO 6883 | AAGGATGGTCATTTTCCTCC | GAG | chr17 | 7114183 | 7114202 | 7114199 | + |
| SEQ ID NO 6884 | TGGTCATTTTCCTCCGAGCT | CAG | chr17 | 7114188 | 7114207 | 7114204 | + |
| SEQ ID NO 6885 | TTTCCTCCGAGCTCAGCTGC | TGG | chr17 | 7114195 | 7114214 | 7114211 | + |
| SEQ ID NO 6886 | TCAGCTGCTGGATATCTTGA | AAG | chr17 | 7114207 | 7114226 | 7114223 | + |
| SEQ ID NO 6887 | CTGGATATCTTGAAAGTCCT | TGG | chr17 | 7114214 | 7114233 | 7114230 | + |
| SEQ ID NO 6888 | TTGAAAGTCCTTGGCCATGA | TGG | chr17 | 7114223 | 7114242 | 7114239 | + |
| SEQ ID NO 6889 | TGAAAGTCCTTGGCCATGAT | GGG | chr17 | 7114224 | 7114243 | 7114240 | + |
| SEQ ID NO 6890 | GAAAGTCCTTGGCCATGATG | GGG | chr17 | 7114225 | 7114244 | 7114241 | + |
| SEQ ID NO 6891 | TCCTTGGCCATGATGGGGCC | CGG | chr17 | 7114230 | 7114249 | 7114246 | + |
| SEQ ID NO 6892 | CCTTGGCCATGATGGGGCCC | GGG | chr17 | 7114231 | 7114250 | 7114247 | + |
| SEQ ID NO 6893 | GGCCATGATGGGGCCCGGGC | TGG | chr17 | 7114235 | 7114254 | 7114251 | + |
| SEQ ID NO 6894 | CCATGATGGGGCCCGGGCTG | GAG | chr17 | 7114237 | 7114256 | 7114253 | + |
| SEQ ID NO 6895 | GATGGGGCCCGGGCTGGAGC | TGG | chr17 | 7114241 | 7114260 | 7114257 | + |
| SEQ ID NO 6896 | TGGGGCCCGGGCTGGAGCTG | GAG | chr17 | 7114243 | 7114262 | 7114259 | + |
| SEQ ID NO 6897 | GCCCGGGCTGGAGCTGGAGC | TGG | chr17 | 7114247 | 7114266 | 7114263 | + |
| SEQ ID NO 6898 | CCGGGCTGGAGCTGGAGCTG | GAG | chr17 | 7114249 | 7114268 | 7114265 | + |
| SEQ ID NO 6899 | GCTGGAGCTGGAGCTGGAGC | TGG | chr17 | 7114253 | 7114272 | 7114269 | + |
| SEQ ID NO 6900 | CTGGAGCTGGAGCTGGAGCT | GGG | chr17 | 7114254 | 7114273 | 7114270 | + |
| SEQ ID NO 6901 | AGCTGGAGCTGGAGCTGGGC | TGG | chr17 | 7114258 | 7114277 | 7114274 | + |
| SEQ ID NO 6902 | GCTGGAGCTGGAGCTGGGCT | GGG | chr17 | 7114259 | 7114278 | 7114275 | + |
| SEQ ID NO 6903 | GAGCTGGAGCTGGGCTGGGC | TGG | chr17 | 7114263 | 7114282 | 7114279 | + |
| SEQ ID NO 6904 | AGCTGGAGCTGGGCTGGGCT | GGG | chr17 | 7114264 | 7114283 | 7114280 | + |
| SEQ ID NO 6905 | GAGCTGGGCTGGGCTGGGCT | GAG | chr17 | 7114269 | 7114288 | 7114285 | + |
| SEQ ID NO 6906 | AGCTGGGCTGGGCTGGGCTG | AGG | chr17 | 7114270 | 7114289 | 7114286 | + |

Figure 25 (Cont'd)

| SEQ ID NO 6907 | GGCTGGGCTGAGGTTGCTCT | GAG | chr17 | 7114280 | 7114299 | 7114296 | + |
| SEQ ID NO 6908 | GCTGGGCTGAGGTTGCTCTG | AGG | chr17 | 7114281 | 7114300 | 7114297 | + |
| SEQ ID NO 6909 | CTGGGCTGAGGTTGCTCTGA | GGG | chr17 | 7114282 | 7114301 | 7114298 | + |
| SEQ ID NO 6910 | GCTGAGGTTGCTCTGAGGGC | TGG | chr17 | 7114286 | 7114305 | 7114302 | + |
| SEQ ID NO 6911 | CTGAGGTTGCTCTGAGGGCT | GGG | chr17 | 7114287 | 7114306 | 7114303 | + |
| SEQ ID NO 6912 | TGAGGTTGCTCTGAGGGCTG | GGG | chr17 | 7114288 | 7114307 | 7114304 | + |
| SEQ ID NO 6913 | GTTGCTCTGAGGGCTGGGGC | TGG | chr17 | 7114292 | 7114311 | 7114308 | + |
| SEQ ID NO 6914 | TTGCTCTGAGGGCTGGGGCT | GGG | chr17 | 7114293 | 7114312 | 7114309 | + |
| SEQ ID NO 6915 | TGCTCTGAGGGCTGGGGCTG | GGG | chr17 | 7114294 | 7114313 | 7114310 | + |
| SEQ ID NO 6916 | TCTGAGGGCTGGGGCTGGGG | CAG | chr17 | 7114297 | 7114316 | 7114313 | + |
| SEQ ID NO 6917 | TGAGGGCTGGGGCTGGGGCA | GAG | chr17 | 7114299 | 7114318 | 7114315 | + |
| SEQ ID NO 6918 | GAGGGCTGGGGCTGGGGCAG | AGG | chr17 | 7114300 | 7114319 | 7114316 | + |
| SEQ ID NO 6919 | CTGGGGCTGGGGCAGAGGTG | CAG | chr17 | 7114305 | 7114324 | 7114321 | + |
| SEQ ID NO 6920 | GGCAGAGGTGCAGATTCACG | TGG | chr17 | 7114315 | 7114334 | 7114331 | + |
| SEQ ID NO 6921 | CAGAGGTGCAGATTCACGTG | GAG | chr17 | 7114317 | 7114336 | 7114333 | + |
| SEQ ID NO 6922 | AGAGGTGCAGATTCACGTGG | AGG | chr17 | 7114318 | 7114337 | 7114334 | + |
| SEQ ID NO 6923 | CAGATTCACGTGGAGGTTGA | TGG | chr17 | 7114325 | 7114344 | 7114341 | + |
| SEQ ID NO 6924 | ATTCACGTGGAGGTTGATGG | TGG | chr17 | 7114328 | 7114347 | 7114344 | + |
| SEQ ID NO 6925 | TTCACGTGGAGGTTGATGGT | GGG | chr17 | 7114329 | 7114348 | 7114345 | + |
| SEQ ID NO 6926 | CGTGGAGGTTGATGGTGGGA | TGG | chr17 | 7114333 | 7114352 | 7114349 | + |
| SEQ ID NO 6927 | GTTGATGGTGGGATGGAACG | CAG | chr17 | 7114340 | 7114359 | 7114356 | + |
| SEQ ID NO 6928 | TTGATGGTGGGATGGAACGC | AGG | chr17 | 7114341 | 7114360 | 7114357 | + |
| SEQ ID NO 6929 | TGATGGTGGGATGGAACGCA | GGG | chr17 | 7114342 | 7114361 | 7114358 | + |
| SEQ ID NO 6930 | GGTGGGATGGAACGCAGGGT | CGG | chr17 | 7114346 | 7114365 | 7114362 | + |
| SEQ ID NO 6931 | TGGGATGGAACGCAGGGTCG | GAG | chr17 | 7114348 | 7114367 | 7114364 | + |
| SEQ ID NO 6932 | GGGATGGAACGCAGGGTCGG | AGG | chr17 | 7114349 | 7114368 | 7114365 | + |
| SEQ ID NO 6933 | GGATGGAACGCAGGGTCGGA | GGG | chr17 | 7114350 | 7114369 | 7114366 | + |
| SEQ ID NO 6934 | GATGGAACGCAGGGTCGGAG | GGG | chr17 | 7114351 | 7114370 | 7114367 | + |
| SEQ ID NO 6935 | AACGCAGGGTCGGAGGGGTT | CGG | chr17 | 7114356 | 7114375 | 7114372 | + |
| SEQ ID NO 6936 | ACGCAGGGTCGGAGGGGTTC | GGG | chr17 | 7114357 | 7114376 | 7114373 | + |
| SEQ ID NO 6937 | CGCAGGGTCGGAGGGGTTCG | GGG | chr17 | 7114358 | 7114377 | 7114374 | + |
| SEQ ID NO 6938 | AGGGTCGGAGGGGTTCGGGG | TGG | chr17 | 7114361 | 7114380 | 7114377 | + |
| SEQ ID NO 6939 | GTCGGAGGGGTTCGGGGTGG | TGG | chr17 | 7114364 | 7114383 | 7114380 | + |
| SEQ ID NO 6940 | AGGGGTTCGGGGTGGTGGCC | TGG | chr17 | 7114369 | 7114388 | 7114385 | + |
| SEQ ID NO 6941 | GGGGTTCGGGGTGGTGGCCT | GGG | chr17 | 7114370 | 7114389 | 7114386 | + |
| SEQ ID NO 6942 | GTTCGGGGTGGTGGCCTGGG | TAG | chr17 | 7114373 | 7114392 | 7114389 | + |
| SEQ ID NO 6943 | TTCGGGGTGGTGGCCTGGGT | AGG | chr17 | 7114374 | 7114393 | 7114390 | + |
| SEQ ID NO 6944 | TGGTGGCCTGGGTAGGATCT | GAG | chr17 | 7114381 | 7114400 | 7114397 | + |
| SEQ ID NO 6945 | GGTGGCCTGGGTAGGATCTG | AGG | chr17 | 7114382 | 7114401 | 7114398 | + |
| SEQ ID NO 6946 | GCCTGGGTAGGATCTGAGGT | TGG | chr17 | 7114386 | 7114405 | 7114402 | + |
| SEQ ID NO 6947 | TGCCAACCTCAGATCCTACC | CAG | chr17 | 7114391 | 7114410 | 7114394 | - |
| SEQ ID NO 6948 | GCCAACCTCAGATCCTACCC | AGG | chr17 | 7114390 | 7114409 | 7114393 | - |
| SEQ ID NO 6949 | GTGAATCTGCACCTCTGCCC | CAG | chr17 | 7114314 | 7114333 | 7114317 | - |
| SEQ ID NO 6950 | CTGCACCTCTGCCCCAGCCC | CAG | chr17 | 7114308 | 7114327 | 7114311 | - |
| SEQ ID NO 6951 | TCTGCCCCAGCCCCAGCCCT | CAG | chr17 | 7114301 | 7114320 | 7114304 | - |
| SEQ ID NO 6952 | TGCCCCAGCCCCAGCCCTCA | GAG | chr17 | 7114299 | 7114318 | 7114302 | - |
| SEQ ID NO 6953 | CCCAGCCCTCAGAGCAACCT | CAG | chr17 | 7114290 | 7114309 | 7114293 | - |

Figure 25 (Cont'd)

| | | | | | | | |
|---|---|---|---|---|---|---|---|
| SEQ ID NO 6954 | CCCTCAGAGCAACCTCAGCC | CAG | chr17 | 7114285 | 7114304 | 7114288 | - |
| SEQ ID NO 6955 | AGAGCAACCTCAGCCCAGCC | CAG | chr17 | 7114280 | 7114299 | 7114283 | - |
| SEQ ID NO 6956 | AACCTCAGCCCAGCCCAGCC | CAG | chr17 | 7114275 | 7114294 | 7114278 | - |
| SEQ ID NO 6957 | AGCCCAGCCCAGCCCAGCTC | CAG | chr17 | 7114269 | 7114288 | 7114272 | - |
| SEQ ID NO 6958 | GCCCAGCCCAGCTCCAGCTC | CAG | chr17 | 7114263 | 7114282 | 7114266 | - |
| SEQ ID NO 6959 | CCCAGCTCCAGCTCCAGCTC | CAG | chr17 | 7114257 | 7114276 | 7114260 | - |
| SEQ ID NO 6960 | CTCCAGCTCCAGCTCCAGCC | CGG | chr17 | 7114252 | 7114271 | 7114255 | - |
| SEQ ID NO 6961 | TCCAGCTCCAGCTCCAGCCC | GGG | chr17 | 7114251 | 7114270 | 7114254 | - |
| SEQ ID NO 6962 | CTCCAGCCCGGGCCCCATCA | TGG | chr17 | 7114240 | 7114259 | 7114243 | - |
| SEQ ID NO 6963 | GCCCGGGCCCCATCATGGCC | AAG | chr17 | 7114235 | 7114254 | 7114238 | - |
| SEQ ID NO 6964 | CCCGGGCCCCATCATGGCCA | AGG | chr17 | 7114234 | 7114253 | 7114237 | - |
| SEQ ID NO 6965 | CATCATGGCCAAGGACTTTC | AAG | chr17 | 7114225 | 7114244 | 7114228 | - |
| SEQ ID NO 6966 | CCAAGGACTTTCAAGATATC | CAG | chr17 | 7114217 | 7114236 | 7114220 | - |
| SEQ ID NO 6967 | AGGACTTTCAAGATATCCAG | CAG | chr17 | 7114214 | 7114233 | 7114217 | - |
| SEQ ID NO 6968 | TTTCAAGATATCCAGCAGCT | GAG | chr17 | 7114209 | 7114228 | 7114212 | - |
| SEQ ID NO 6969 | AGATATCCAGCAGCTGAGCT | CGG | chr17 | 7114204 | 7114223 | 7114207 | - |
| SEQ ID NO 6970 | ATATCCAGCAGCTGAGCTCG | GAG | chr17 | 7114202 | 7114221 | 7114205 | - |
| SEQ ID NO 6971 | TATCCAGCAGCTGAGCTCGG | AGG | chr17 | 7114201 | 7114220 | 7114204 | - |
| SEQ ID NO 6972 | AAATGACCATCCTTTCCATC | AAG | chr17 | 7114177 | 7114196 | 7114180 | - |
| SEQ ID NO 6973 | AATGACCATCCTTTCCATCA | AGG | chr17 | 7114176 | 7114195 | 7114179 | - |
| SEQ ID NO 6974 | ACCATCCTTTCCATCAAGGT | GAG | chr17 | 7114172 | 7114191 | 7114175 | - |
| SEQ ID NO 6975 | CCATCCTTTCCATCAAGGTG | AGG | chr17 | 7114171 | 7114190 | 7114174 | - |
| SEQ ID NO 6976 | CATCCTTTCCATCAAGGTGA | GGG | chr17 | 7114170 | 7114189 | 7114173 | - |
| SEQ ID NO 6977 | ATCCTTTCCATCAAGGTGAG | GGG | chr17 | 7114169 | 7114188 | 7114172 | - |
| SEQ ID NO 6978 | TTTCCATCAAGGTGAGGGGC | CAG | chr17 | 7114165 | 7114184 | 7114168 | - |
| SEQ ID NO 6979 | TTCCATCAAGGTGAGGGGCC | AGG | chr17 | 7114164 | 7114183 | 7114167 | - |
| SEQ ID NO 6980 | GGTGAGGGGCCAGGCACTCG | CAG | chr17 | 7114155 | 7114174 | 7114158 | - |
| SEQ ID NO 6981 | GTGAGGGGCCAGGCACTCGC | AGG | chr17 | 7114154 | 7114173 | 7114157 | - |
| SEQ ID NO 6982 | GGCACTCGCAGGCTGAATCC | CAG | chr17 | 7114143 | 7114162 | 7114146 | - |
| SEQ ID NO 6983 | GCACTCGCAGGCTGAATCCC | AGG | chr17 | 7114142 | 7114161 | 7114145 | - |
| SEQ ID NO 6984 | ACTCGCAGGCTGAATCCCAG | GAG | chr17 | 7114140 | 7114159 | 7114143 | - |
| SEQ ID NO 6985 | TCGCAGGCTGAATCCCAGGA | GAG | chr17 | 7114138 | 7114157 | 7114141 | - |
| SEQ ID NO 6986 | CGCAGGCTGAATCCCAGGAG | AGG | chr17 | 7114137 | 7114156 | 7114140 | - |
| SEQ ID NO 6987 | GAGAGGAAATCCATTTTTGA | AAG | chr17 | 7114120 | 7114139 | 7114123 | - |
| SEQ ID NO 6988 | AGAGGAAATCCATTTTTGAA | AGG | chr17 | 7114119 | 7114138 | 7114122 | - |
| SEQ ID NO 6989 | GAAATCCATTTTTGAAAGGC | AAG | chr17 | 7114115 | 7114134 | 7114118 | - |
| SEQ ID NO 6990 | ATTTTTGAAAGGCAAGTGTG | CAG | chr17 | 7114108 | 7114127 | 7114111 | - |
| SEQ ID NO 6991 | AGGCAAGTGTGCAGTTTCTG | CGG | chr17 | 7114099 | 7114118 | 7114102 | - |
| SEQ ID NO 6992 | GCTTTGCTCCCCTCTGTCT | CAG | chr17 | 7114077 | 7114096 | 7114080 | - |
| SEQ ID NO 6993 | CATGATTGCTCTGTCCCTTT | GAG | chr17 | 7114052 | 7114071 | 7114055 | - |
| SEQ ID NO 6994 | ATGATTGCTCTGTCCCTTTG | AGG | chr17 | 7114051 | 7114070 | 7114054 | - |
| SEQ ID NO 6995 | TGCCGCACCCACTCTGTGAA | CAG | chr17 | 7114024 | 7114043 | 7114027 | - |
| SEQ ID NO 6996 | GCCGCACCCACTCTGTGAAC | AGG | chr17 | 7114023 | 7114042 | 7114026 | - |
| SEQ ID NO 6997 | CCGCACCCACTCTGTGAACA | GGG | chr17 | 7114022 | 7114041 | 7114025 | - |
| SEQ ID NO 6998 | CCACTCTGTGAACAGGGACT | GAG | chr17 | 7114016 | 7114035 | 7114019 | - |
| SEQ ID NO 6999 | CACTCTGTGAACAGGGACTG | AGG | chr17 | 7114015 | 7114034 | 7114018 | - |
| SEQ ID NO 7000 | CTCTGTGAACAGGGACTGAG | GAG | chr17 | 7114013 | 7114032 | 7114016 | - |

Figure 25 (Cont'd)

| | | | | | | | |
|---|---|---|---|---|---|---|---|
| SEQ ID NO 7001 | TCTGTGAACAGGGACTGAGG | AGG | chr17 | 7114012 | 7114031 | 7114015 | - |
| SEQ ID NO 7002 | CTGTGAACAGGGACTGAGGA | GGG | chr17 | 7114011 | 7114030 | 7114014 | - |
| SEQ ID NO 7003 | CCTCACCTTCCTGTCTACCC | CAG | chr17 | 7113963 | 7113982 | 7113966 | - |
| SEQ ID NO 7004 | CTCACCTTCCTGTCTACCCC | AGG | chr17 | 7113962 | 7113981 | 7113965 | - |
| SEQ ID NO 7005 | TCCTGTCTACCCCAGGACCC | CAG | chr17 | 7113955 | 7113974 | 7113958 | - |
| SEQ ID NO 7006 | CCTGTCTACCCCAGGACCCC | AGG | chr17 | 7113954 | 7113973 | 7113957 | - |
| SEQ ID NO 7007 | TCTACCCCAGGACCCCAGGA | AAG | chr17 | 7113950 | 7113969 | 7113953 | - |
| SEQ ID NO 7008 | CTACCCCAGGACCCCAGGAA | AGG | chr17 | 7113949 | 7113968 | 7113952 | - |
| SEQ ID NO 7009 | ACCCCAGGAAAGGCATGTGC | CAG | chr17 | 7113939 | 7113958 | 7113942 | - |
| SEQ ID NO 7010 | CCCAGGAAAGGCATGTGCCA | GAG | chr17 | 7113937 | 7113956 | 7113940 | - |
| SEQ ID NO 7011 | CCAGGAAAGGCATGTGCCAG | AGG | chr17 | 7113936 | 7113955 | 7113939 | - |
| SEQ ID NO 7012 | AAAGGCATGTGCCAGAGGTG | TGG | chr17 | 7113931 | 7113950 | 7113934 | - |
| SEQ ID NO 7013 | AAGGCATGTGCCAGAGGTGT | GGG | chr17 | 7113930 | 7113949 | 7113933 | - |
| SEQ ID NO 7014 | AGGCATGTGCCAGAGGTGTG | GGG | chr17 | 7113929 | 7113948 | 7113932 | - |
| SEQ ID NO 7015 | GCATGTGCCAGAGGTGTGGG | GAG | chr17 | 7113927 | 7113946 | 7113930 | - |
| SEQ ID NO 7016 | GCCAGAGGTGTGGGGAGATC | TGG | chr17 | 7113921 | 7113940 | 7113924 | - |
| SEQ ID NO 7017 | AGAGGTGTGGGGAGATCTGG | AAG | chr17 | 7113918 | 7113937 | 7113921 | - |
| SEQ ID NO 7018 | TGCCCTTCTCCTCCCAACCC | AAG | chr17 | 7113886 | 7113905 | 7113889 | - |
| SEQ ID NO 7019 | GTGTGCACGTATGTGCATAT | GAG | chr17 | 7113841 | 7113860 | 7113844 | - |
| SEQ ID NO 7020 | TGTGCACGTATGTGCATATG | AGG | chr17 | 7113840 | 7113859 | 7113843 | - |
| SEQ ID NO 7021 | GTATGTGCATATGAGGAATG | CAG | chr17 | 7113833 | 7113852 | 7113836 | - |
| SEQ ID NO 7022 | GCATATGAGGAATGCAGATT | CAG | chr17 | 7113827 | 7113846 | 7113830 | - |
| SEQ ID NO 7023 | ATGAGGAATGCAGATTCAGC | TGG | chr17 | 7113823 | 7113842 | 7113826 | - |
| SEQ ID NO 7024 | TGAGGAATGCAGATTCAGCT | GGG | chr17 | 7113822 | 7113841 | 7113825 | - |
| SEQ ID NO 7025 | GGGACTCTGTGTGTGTGTGT | GAG | chr17 | 7113802 | 7113821 | 7113805 | - |
| SEQ ID NO 7026 | GTGTGTGTATATGTGCGC | GAG | chr17 | 7113771 | 7113790 | 7113774 | - |
| SEQ ID NO 7027 | GTGTGTGTATATGTGCGCGA | GAG | chr17 | 7113769 | 7113788 | 7113772 | - |
| SEQ ID NO 7028 | TGTGTGTATGTCGTGTATGT | GAG | chr17 | 7113731 | 7113750 | 7113734 | - |
| SEQ ID NO 7029 | TGTGTATGTCGTGTATGTGA | GAG | chr17 | 7113729 | 7113748 | 7113732 | - |
| SEQ ID NO 7030 | GTGTATGTCGTGTATGTGAG | AGG | chr17 | 7113728 | 7113747 | 7113731 | - |
| SEQ ID NO 7031 | TGTATGTCGTGTATGTGAGA | GGG | chr17 | 7113727 | 7113746 | 7113730 | - |
| SEQ ID NO 7032 | TGAGAGGGTATGTTGTGTGT | GAG | chr17 | 7113712 | 7113731 | 7113715 | - |
| SEQ ID NO 7033 | AGAGGGTATGTTGTGTGTGA | GAG | chr17 | 7113710 | 7113729 | 7113713 | - |
| SEQ ID NO 7034 | GTTGTGTGTGTATGTTGTGT | GAG | chr17 | 7113684 | 7113703 | 7113687 | - |
| SEQ ID NO 7035 | GTTGTGTGTATCTTGTGTGT | GAG | chr17 | 7113656 | 7113675 | 7113659 | - |
| SEQ ID NO 7036 | TGCATGTGTGTATGTTGTGC | GAG | chr17 | 7113604 | 7113623 | 7113607 | - |
| SEQ ID NO 7037 | CGAGTGTATGTTGTGTATGT | GAG | chr17 | 7113585 | 7113604 | 7113588 | - |
| SEQ ID NO 7038 | TGTGTATGTATGTTGTGTAT | GAG | chr17 | 7113538 | 7113557 | 7113541 | - |
| SEQ ID NO 7039 | GTTGTGTGTGTATTGTGT | GAG | chr17 | 7113471 | 7113490 | 7113474 | - |
| SEQ ID NO 7040 | TGTATGTTTGTGTGTTGTGT | GAG | chr17 | 7113444 | 7113463 | 7113447 | - |
| SEQ ID NO 7041 | TGCGTGTGTGTATGTTGTGC | GAG | chr17 | 7113407 | 7113426 | 7113410 | - |
| SEQ ID NO 7042 | GTGTTGTGTGTGTATGTTGT | GAG | chr17 | 7113379 | 7113398 | 7113382 | - |
| SEQ ID NO 7043 | GTTATGTATGTTGTGTGTGT | GAG | chr17 | 7113353 | 7113372 | 7113356 | - |
| SEQ ID NO 7044 | TGTGTGTGAGTGTGTTGCGT | GAG | chr17 | 7113340 | 7113359 | 7113343 | - |
| SEQ ID NO 7045 | TGTTGCGTGAGTGTGTGTGT | TAG | chr17 | 7113328 | 7113347 | 7113331 | - |
| SEQ ID NO 7046 | TGTGTGTGTGTGTGTGTGTG | TAG | chr17 | 7113287 | 7113306 | 7113290 | - |
| SEQ ID NO 7047 | TGTGTGTGTGTGTGTGTGTA | GAG | chr17 | 7113285 | 7113304 | 7113288 | - |

Figure 25 (Cont'd)

| | | | | | | | |
|---|---|---|---|---|---|---|---|
| SEQ ID NO 7048 | GTGTGTGTGTGTGTGTAG | AGG | chr17 | 7113284 | 7113303 | 7113287 | - |
| SEQ ID NO 7049 | TGTGTGTGTGTGTAGAGG | TGG | chr17 | 7113281 | 7113300 | 7113284 | - |
| SEQ ID NO 7050 | GTGTGTGTGTGTAGAGGT | GGG | chr17 | 7113280 | 7113299 | 7113283 | - |
| SEQ ID NO 7051 | TGTGTGTGTGTAGAGGTG | GGG | chr17 | 7113279 | 7113298 | 7113282 | - |
| SEQ ID NO 7052 | TGTGTGTAGAGGTGGGGT | GAG | chr17 | 7113275 | 7113294 | 7113278 | - |
| SEQ ID NO 7053 | TGTGTAGAGGTGGGGTGAGT | TGG | chr17 | 7113271 | 7113290 | 7113274 | - |
| SEQ ID NO 7054 | GTGTAGAGGTGGGGTGAGTT | GGG | chr17 | 7113270 | 7113289 | 7113273 | - |
| SEQ ID NO 7055 | AGAGGTGGGGTGAGTTGGGA | TGG | chr17 | 7113266 | 7113285 | 7113269 | - |
| SEQ ID NO 7056 | GAGGTGGGGTGAGTTGGGAT | GGG | chr17 | 7113265 | 7113284 | 7113268 | - |
| SEQ ID NO 7057 | GTGGGGTGAGTTGGGATGGG | TGG | chr17 | 7113262 | 7113281 | 7113265 | - |
| SEQ ID NO 7058 | TGGGGTGAGTTGGGATGGGT | GGG | chr17 | 7113261 | 7113280 | 7113264 | - |
| SEQ ID NO 7059 | GGGGTGAGTTGGGATGGGTG | GGG | chr17 | 7113260 | 7113279 | 7113263 | - |
| SEQ ID NO 7060 | GGGTGAGTTGGGATGGGTGG | GGG | chr17 | 7113259 | 7113278 | 7113262 | - |
| SEQ ID NO 7061 | TTGGGATGGGTGGGGACGT | GAG | chr17 | 7113252 | 7113271 | 7113255 | - |
| SEQ ID NO 7062 | ATGGGTGGGGACGTGAGCA | CAG | chr17 | 7113247 | 7113266 | 7113250 | - |
| SEQ ID NO 7063 | GGGTGGGGACGTGAGCACA | GAG | chr17 | 7113245 | 7113264 | 7113248 | - |
| SEQ ID NO 7064 | GTGGGGACGTGAGCACAGA | GAG | chr17 | 7113243 | 7113262 | 7113246 | - |
| SEQ ID NO 7065 | ACGTGAGCACAGAGAGATCC | TGG | chr17 | 7113236 | 7113255 | 7113239 | - |
| SEQ ID NO 7066 | TGAGCACAGAGAGATCCTGG | AAG | chr17 | 7113233 | 7113252 | 7113236 | - |
| SEQ ID NO 7067 | CCCTGCTCCTCTCATCTCCC | AAG | chr17 | 7113208 | 7113227 | 7113211 | - |
| SEQ ID NO 7068 | CATCTCCCAAGACCCTTCCC | TGG | chr17 | 7113196 | 7113215 | 7113199 | - |
| SEQ ID NO 7069 | TCTGTAATAAATCTTGACTG | AAG | chr17 | 7113168 | 7113187 | 7113171 | - |
| SEQ ID NO 7070 | CTGTAATAAATCTTGACTGA | AGG | chr17 | 7113167 | 7113186 | 7113170 | - |
| SEQ ID NO 7071 | AAATCTTGACTGAAGGACCT | AAG | chr17 | 7113160 | 7113179 | 7113163 | - |
| SEQ ID NO 7072 | ACTGAAGGACCTAAGTATCT | TGG | chr17 | 7113152 | 7113171 | 7113155 | - |
| SEQ ID NO 7073 | TATCTTGGACATTTTTTTTT | TAG | chr17 | 7113137 | 7113156 | 7113140 | - |
| SEQ ID NO 7074 | TCTTGGACATTTTTTTTTTA | GAG | chr17 | 7113135 | 7113154 | 7113138 | - |
| SEQ ID NO 7075 | GGACATTTTTTTTTAGAGA | CAG | chr17 | 7113131 | 7113150 | 7113134 | - |
| SEQ ID NO 7076 | GACATTTTTTTTTAGAGAC | AGG | chr17 | 7113130 | 7113149 | 7113133 | - |
| SEQ ID NO 7077 | CATTTTTTTTTAGAGACAG | GAG | chr17 | 7113128 | 7113147 | 7113131 | - |
| SEQ ID NO 7078 | TTTTTTTAGAGACAGGAGTG | TAG | chr17 | 7113123 | 7113142 | 7113126 | - |
| SEQ ID NO 7079 | TTTTAGAGACAGGAGTGTAG | TGG | chr17 | 7113120 | 7113139 | 7113123 | - |
| SEQ ID NO 7080 | TAGAGACAGGAGTGTAGTGG | CAG | chr17 | 7113117 | 7113136 | 7113120 | - |
| SEQ ID NO 7081 | AGAGACAGGAGTGTAGTGGC | AGG | chr17 | 7113116 | 7113135 | 7113119 | - |
| SEQ ID NO 7082 | GGAGTGTAGTGGCAGGATCA | TAG | chr17 | 7113109 | 7113128 | 7113112 | - |
| SEQ ID NO 7083 | TCACTGCAACCTCGAACTCC | TGG | chr17 | 7113085 | 7113104 | 7113088 | - |
| SEQ ID NO 7084 | CACTGCAACCTCGAACTCCT | GGG | chr17 | 7113084 | 7113103 | 7113087 | - |
| SEQ ID NO 7085 | AACCTCGAACTCCTGGCTC | AAG | chr17 | 7113078 | 7113097 | 7113081 | - |
| SEQ ID NO 7086 | CTCAAGCCATCCTCCCACCT | CAG | chr17 | 7113061 | 7113080 | 7113064 | - |
| SEQ ID NO 7087 | TCCTCCCACCTCAGCCTCCC | AAG | chr17 | 7113052 | 7113071 | 7113055 | - |
| SEQ ID NO 7088 | TCCCACCTCAGCCTCCCAAG | TAG | chr17 | 7113049 | 7113068 | 7113052 | - |
| SEQ ID NO 7089 | ACCTCAGCCTCCCAAGTAGT | TAG | chr17 | 7113045 | 7113064 | 7113048 | - |
| SEQ ID NO 7090 | CCTCAGCCTCCCAAGTAGTT | AGG | chr17 | 7113044 | 7113063 | 7113047 | - |
| SEQ ID NO 7091 | TCCCAAGTAGTTAGGACTTA | CAG | chr17 | 7113036 | 7113055 | 7113039 | - |
| SEQ ID NO 7092 | CCCAAGTAGTTAGGACTTAC | AGG | chr17 | 7113035 | 7113054 | 7113038 | - |
| SEQ ID NO 7093 | CAGGTGTGCACCACTGTGCC | TGG | chr17 | 7113016 | 7113035 | 7113019 | - |
| SEQ ID NO 7094 | GCAAATTAAAAAAAATTTTT | TAG | chr17 | 7112994 | 7113013 | 7112997 | - |

Figure 25 (Cont'd)

| | | | | | | | |
|---|---|---|---|---|---|---|---|
| SEQ ID NO 7095 | AAATTAAAAAAAATTTTTTA | GAG | chr17 | 7112992 | 7113011 | 7112995 | - |
| SEQ ID NO 7096 | AAAAAAATTTTTTAGAGAAA | TGG | chr17 | 7112986 | 7113005 | 7112989 | - |
| SEQ ID NO 7097 | AAAAAATTTTTTAGAGAAAT | GGG | chr17 | 7112985 | 7113004 | 7112988 | - |
| SEQ ID NO 7098 | AAAAATTTTTTAGAGAAATG | GGG | chr17 | 7112984 | 7113003 | 7112987 | - |
| SEQ ID NO 7099 | TGGGGTCTTGCTATGTTGCC | CAG | chr17 | 7112966 | 7112985 | 7112969 | - |
| SEQ ID NO 7100 | GGGGTCTTGCTATGTTGCCC | AGG | chr17 | 7112965 | 7112984 | 7112968 | - |
| SEQ ID NO 7101 | TCTTGCTATGTTGCCCAGGC | TGG | chr17 | 7112961 | 7112980 | 7112964 | - |
| SEQ ID NO 7102 | TGCTATGTTGCCCAGGCTGG | TGG | chr17 | 7112958 | 7112977 | 7112961 | - |
| SEQ ID NO 7103 | GCTATGTTGCCCAGGCTGGT | GGG | chr17 | 7112957 | 7112976 | 7112960 | - |
| SEQ ID NO 7104 | GTTGCCCAGGCTGGTGGGAA | AAG | chr17 | 7112952 | 7112971 | 7112955 | - |
| SEQ ID NO 7105 | GGCTGGTGGGAAAAGATTTT | AAG | chr17 | 7112944 | 7112963 | 7112947 | - |
| SEQ ID NO 7106 | GCTGGTGGGAAAAGATTTTA | AGG | chr17 | 7112943 | 7112962 | 7112946 | - |
| SEQ ID NO 7107 | GTGGGAAAAGATTTTAAGGT | GAG | chr17 | 7112939 | 7112958 | 7112942 | - |
| SEQ ID NO 7108 | GGGAAAAGATTTTAAGGTGA | GAG | chr17 | 7112937 | 7112956 | 7112940 | - |
| SEQ ID NO 7109 | GAAAAGATTTTAAGGTGAGA | GAG | chr17 | 7112935 | 7112954 | 7112938 | - |
| SEQ ID NO 7110 | TTTTAAGGTGAGAGAGATCT | GAG | chr17 | 7112928 | 7112947 | 7112931 | - |
| SEQ ID NO 7111 | TAAGGTGAGAGAGATCTGAG | CAG | chr17 | 7112925 | 7112944 | 7112928 | - |
| SEQ ID NO 7112 | GAGAGAGATCTGAGCAGTGC | TAG | chr17 | 7112919 | 7112938 | 7112922 | - |
| SEQ ID NO 7113 | AGAGAGATCTGAGCAGTGCT | AGG | chr17 | 7112918 | 7112937 | 7112921 | - |
| SEQ ID NO 7114 | GAGATCTGAGCAGTGCTAGG | CAG | chr17 | 7112915 | 7112934 | 7112918 | - |
| SEQ ID NO 7115 | ATCTGAGCAGTGCTAGGCAG | AAG | chr17 | 7112912 | 7112931 | 7112915 | - |
| SEQ ID NO 7116 | TCTGAGCAGTGCTAGGCAGA | AGG | chr17 | 7112911 | 7112930 | 7112914 | - |
| SEQ ID NO 7117 | CTGAGCAGTGCTAGGCAGAA | GGG | chr17 | 7112910 | 7112929 | 7112913 | - |
| SEQ ID NO 7118 | GCAGTGCTAGGCAGAAGGGC | AAG | chr17 | 7112906 | 7112925 | 7112909 | - |
| SEQ ID NO 7119 | AGTGCTAGGCAGAAGGGCAA | GAG | chr17 | 7112904 | 7112923 | 7112907 | - |
| SEQ ID NO 7120 | CTAGGCAGAAGGGCAAGAGC | CAG | chr17 | 7112900 | 7112919 | 7112903 | - |
| SEQ ID NO 7121 | TAGGCAGAAGGGCAAGAGCC | AGG | chr17 | 7112899 | 7112918 | 7112902 | - |
| SEQ ID NO 7122 | AGAAGGGCAAGAGCCAGGAA | TGG | chr17 | 7112894 | 7112913 | 7112897 | - |
| SEQ ID NO 7123 | AAGGGCAAGAGCCAGGAATG | GAG | chr17 | 7112892 | 7112911 | 7112895 | - |
| SEQ ID NO 7124 | AGGGCAAGAGCCAGGAATGG | AGG | chr17 | 7112891 | 7112910 | 7112894 | - |
| SEQ ID NO 7125 | GGCAAGAGCCAGGAATGGAG | GAG | chr17 | 7112889 | 7112908 | 7112892 | - |
| SEQ ID NO 7126 | AGCCAGGAATGGAGGAGTGT | CAG | chr17 | 7112883 | 7112902 | 7112886 | - |
| SEQ ID NO 7127 | GCCAGGAATGGAGGAGTGTC | AGG | chr17 | 7112882 | 7112901 | 7112885 | - |
| SEQ ID NO 7128 | ATGGAGGAGTGTCAGGTGTG | TGG | chr17 | 7112875 | 7112894 | 7112878 | - |
| SEQ ID NO 7129 | TGGAGGAGTGTCAGGTGTGT | GGG | chr17 | 7112874 | 7112893 | 7112877 | - |
| SEQ ID NO 7130 | AGTGTCAGGTGTGTGGGTGC | TGG | chr17 | 7112868 | 7112887 | 7112871 | - |
| SEQ ID NO 7131 | GTCAGGTGTGTGGGTGCTGG | TGG | chr17 | 7112865 | 7112884 | 7112868 | - |
| SEQ ID NO 7132 | AGGTGTGTGGGTGCTGGTGG | TGG | chr17 | 7112862 | 7112881 | 7112865 | - |
| SEQ ID NO 7133 | GTGTGTGGGTGCTGGTGGTG | GAG | chr17 | 7112860 | 7112879 | 7112863 | - |
| SEQ ID NO 7134 | GTGGGTGCTGGTGGTGGAGC | CGG | chr17 | 7112856 | 7112875 | 7112859 | - |
| SEQ ID NO 7135 | TGGGTGCTGGTGGTGGAGCC | GGG | chr17 | 7112855 | 7112874 | 7112858 | - |
| SEQ ID NO 7136 | GGTGGTGGAGCCGGGTTCCA | TGG | chr17 | 7112847 | 7112866 | 7112850 | - |
| SEQ ID NO 7137 | TGGTGGAGCCGGGTTCCATG | GAG | chr17 | 7112845 | 7112864 | 7112848 | - |
| SEQ ID NO 7138 | GGTGGAGCCGGGTTCCATGG | AGG | chr17 | 7112844 | 7112863 | 7112847 | - |
| SEQ ID NO 7139 | GGAGCCGGGTTCCATGGAGG | CAG | chr17 | 7112841 | 7112860 | 7112844 | - |
| SEQ ID NO 7140 | GAGCCGGGTTCCATGGAGGC | AGG | chr17 | 7112840 | 7112859 | 7112843 | - |
| SEQ ID NO 7141 | GCCGGGTTCCATGGAGGCAG | GAG | chr17 | 7112838 | 7112857 | 7112841 | - |

Figure 25 (Cont'd)

| | | | | | | | |
|---|---|---|---|---|---|---|---|
| SEQ ID NO 7142 | CCGGGTTCCATGGAGGCAGG | AGG | chr17 | 7112837 | 7112856 | 7112840 | - |
| SEQ ID NO 7143 | GGGTTCCATGGAGGCAGGAG | GAG | chr17 | 7112835 | 7112854 | 7112838 | - |
| SEQ ID NO 7144 | TTCCATGGAGGCAGGAGGAG | CAG | chr17 | 7112832 | 7112851 | 7112835 | - |
| SEQ ID NO 7145 | TCCATGGAGGCAGGAGGAGC | AGG | chr17 | 7112831 | 7112850 | 7112834 | - |
| SEQ ID NO 7146 | CCATGGAGGCAGGAGGAGCA | GGG | chr17 | 7112830 | 7112849 | 7112833 | - |
| SEQ ID NO 7147 | CATGGAGGCAGGAGGAGCAG | GGG | chr17 | 7112829 | 7112848 | 7112832 | - |
| SEQ ID NO 7148 | AGGCAGGAGGAGCAGGGGCT | TGG | chr17 | 7112824 | 7112843 | 7112827 | - |
| SEQ ID NO 7149 | GCAGGAGGAGCAGGGGCTTG | GAG | chr17 | 7112822 | 7112841 | 7112825 | - |
| SEQ ID NO 7150 | AGGAGCAGGGGCTTGGAGCT | TAG | chr17 | 7112817 | 7112836 | 7112820 | - |
| SEQ ID NO 7151 | GGAGCAGGGGCTTGGAGCTT | AGG | chr17 | 7112816 | 7112835 | 7112819 | - |
| SEQ ID NO 7152 | GCAGGGGCTTGGAGCTTAGG | AAG | chr17 | 7112813 | 7112832 | 7112816 | - |
| SEQ ID NO 7153 | CAGGGGCTTGGAGCTTAGGA | AGG | chr17 | 7112812 | 7112831 | 7112815 | - |
| SEQ ID NO 7154 | AGGGGCTTGGAGCTTAGGAA | GGG | chr17 | 7112811 | 7112830 | 7112814 | - |
| SEQ ID NO 7155 | GGGGCTTGGAGCTTAGGAAG | GGG | chr17 | 7112810 | 7112829 | 7112813 | - |
| SEQ ID NO 7156 | TTGGAGCTTAGGAAGGGGAT | TGG | chr17 | 7112805 | 7112824 | 7112808 | - |
| SEQ ID NO 7157 | AGCTTAGGAAGGGGATTGGT | TAG | chr17 | 7112801 | 7112820 | 7112804 | - |
| SEQ ID NO 7158 | TAGGAAGGGGATTGGTTAGC | TGG | chr17 | 7112797 | 7112816 | 7112800 | - |
| SEQ ID NO 7159 | AGGAAGGGGATTGGTTAGCT | GGG | chr17 | 7112796 | 7112815 | 7112799 | - |
| SEQ ID NO 7160 | AGGGGATTGGTTAGCTGGGC | TGG | chr17 | 7112792 | 7112811 | 7112795 | - |
| SEQ ID NO 7161 | TTGGTTAGCTGGGCTGGAAT | GAG | chr17 | 7112786 | 7112805 | 7112789 | - |
| SEQ ID NO 7162 | TGGTTAGCTGGGCTGGAATG | AGG | chr17 | 7112785 | 7112804 | 7112788 | - |
| SEQ ID NO 7163 | GGTTAGCTGGGCTGGAATGA | GGG | chr17 | 7112784 | 7112803 | 7112787 | - |
| SEQ ID NO 7164 | ATGAGGGACTCCTCATTCCT | GAG | chr17 | 7112768 | 7112787 | 7112771 | - |
| SEQ ID NO 7165 | TGAGGGACTCCTCATTCCTG | AGG | chr17 | 7112767 | 7112786 | 7112770 | - |
| SEQ ID NO 7166 | GGACTCCTCATTCCTGAGGC | TGG | chr17 | 7112763 | 7112782 | 7112766 | - |
| SEQ ID NO 7167 | ATTCCTGAGGCTGGCCAACC | GAG | chr17 | 7112754 | 7112773 | 7112757 | - |
| SEQ ID NO 7168 | TTCCTGAGGCTGGCCAACCG | AGG | chr17 | 7112753 | 7112772 | 7112756 | - |
| SEQ ID NO 7169 | TCCTGAGGCTGGCCAACCGA | GGG | chr17 | 7112752 | 7112771 | 7112755 | - |
| SEQ ID NO 7170 | CTGAGGCTGGCCAACCGAGG | GAG | chr17 | 7112750 | 7112769 | 7112753 | - |
| SEQ ID NO 7171 | TGAGGCTGGCCAACCGAGGG | AGG | chr17 | 7112749 | 7112768 | 7112752 | - |
| SEQ ID NO 7172 | GAGGCTGGCCAACCGAGGGA | GGG | chr17 | 7112748 | 7112767 | 7112751 | - |
| SEQ ID NO 7173 | CTGGCCAACCGAGGGAGGGC | CGG | chr17 | 7112744 | 7112763 | 7112747 | - |
| SEQ ID NO 7174 | AACCGAGGGAGGGCCGGTGC | TGG | chr17 | 7112738 | 7112757 | 7112741 | - |
| SEQ ID NO 7175 | ACCGAGGGAGGGCCGGTGCT | GGG | chr17 | 7112737 | 7112756 | 7112740 | - |
| SEQ ID NO 7176 | GAGGGAGGGCCGGTGCTGGG | CAG | chr17 | 7112734 | 7112753 | 7112737 | - |
| SEQ ID NO 7177 | AGGGAGGGCCGGTGCTGGGC | AGG | chr17 | 7112733 | 7112752 | 7112736 | - |
| SEQ ID NO 7178 | GGGAGGGCCGGTGCTGGGCA | GGG | chr17 | 7112732 | 7112751 | 7112735 | - |
| SEQ ID NO 7179 | AGGGCCGGTGCTGGGCAGGG | CAG | chr17 | 7112729 | 7112748 | 7112732 | - |
| SEQ ID NO 7180 | GGGCCGGTGCTGGGCAGGGC | AGG | chr17 | 7112728 | 7112747 | 7112731 | - |
| SEQ ID NO 7181 | GGCCGGTGCTGGGCAGGGCA | GGG | chr17 | 7112727 | 7112746 | 7112730 | - |
| SEQ ID NO 7182 | CGGTGCTGGGCAGGGCAGGG | CAG | chr17 | 7112724 | 7112743 | 7112727 | - |
| SEQ ID NO 7183 | GGTGCTGGGCAGGGCAGGGC | AGG | chr17 | 7112723 | 7112742 | 7112726 | - |
| SEQ ID NO 7184 | GTGCTGGGCAGGGCAGGGCA | GGG | chr17 | 7112722 | 7112741 | 7112725 | - |
| SEQ ID NO 7185 | TGCTGGGCAGGGCAGGGCAG | GGG | chr17 | 7112721 | 7112740 | 7112724 | - |
| SEQ ID NO 7186 | GGGCAGGGCAGGGCAGGGGA | CAG | chr17 | 7112717 | 7112736 | 7112720 | - |
| SEQ ID NO 7187 | GGCAGGGCAGGGCAGGGGAC | AGG | chr17 | 7112716 | 7112735 | 7112719 | - |
| SEQ ID NO 7188 | CAGGGCAGGGCAGGGGACAG | GAG | chr17 | 7112714 | 7112733 | 7112717 | - |

Figure 25 (Cont'd)

| | | | | | | | |
|---|---|---|---|---|---|---|---|
| SEQ ID NO 7189 | AGGGCAGGGCAGGGGACAGG | AGG | chr17 | 7112713 | 7112732 | 7112716 | - |
| SEQ ID NO 7190 | GGGCAGGGCAGGGGACAGGA | GGG | chr17 | 7112712 | 7112731 | 7112715 | - |
| SEQ ID NO 7191 | AGGGCAGGGGACAGGAGGGA | TAG | chr17 | 7112708 | 7112727 | 7112711 | - |
| SEQ ID NO 7192 | GGGCAGGGGACAGGAGGGAT | AGG | chr17 | 7112707 | 7112726 | 7112710 | - |
| SEQ ID NO 7193 | GCAGGGGACAGGAGGGATAG | GAG | chr17 | 7112705 | 7112724 | 7112708 | - |
| SEQ ID NO 7194 | CAGGGGACAGGAGGGATAGG | AGG | chr17 | 7112704 | 7112723 | 7112707 | - |
| SEQ ID NO 7195 | AGGGATAGGAGGTCCCTCCC | GAG | chr17 | 7112693 | 7112712 | 7112696 | - |
| SEQ ID NO 7196 | GGGATAGGAGGTCCCTCCCG | AGG | chr17 | 7112692 | 7112711 | 7112695 | - |
| SEQ ID NO 7197 | GGTCCCTCCCGAGGACCACT | CAG | chr17 | 7112683 | 7112702 | 7112686 | - |
| SEQ ID NO 7198 | GTCCCTCCCGAGGACCACTC | AGG | chr17 | 7112682 | 7112701 | 7112685 | - |
| SEQ ID NO 7199 | CGAGGACCACTCAGGAACAC | CAG | chr17 | 7112674 | 7112693 | 7112677 | - |
| SEQ ID NO 7200 | GGACCACTCAGGAACACCAG | TAG | chr17 | 7112671 | 7112690 | 7112674 | - |
| SEQ ID NO 7201 | AGTAGCATCTCCTCTCTCTG | TAG | chr17 | 7112653 | 7112672 | 7112656 | - |
| SEQ ID NO 7202 | GTAGCATCTCCTCTCTCTGT | AGG | chr17 | 7112652 | 7112671 | 7112655 | - |
| SEQ ID NO 7203 | TAGCATCTCCTCTCTCTGTA | GGG | chr17 | 7112651 | 7112670 | 7112654 | - |
| SEQ ID NO 7204 | AGCATCTCCTCTCTCTGTAG | GGG | chr17 | 7112650 | 7112669 | 7112653 | - |
| SEQ ID NO 7205 | GCATCTCCTCTCTCTGTAGG | GGG | chr17 | 7112649 | 7112668 | 7112652 | - |
| SEQ ID NO 7206 | CTCCTCTCTGTAGGGGCTGGC | TGG | chr17 | 7112645 | 7112664 | 7112648 | - |
| SEQ ID NO 7207 | TCTCTCTGTAGGGGCTGGC | TGG | chr17 | 7112641 | 7112660 | 7112644 | - |
| SEQ ID NO 7208 | GGGCTGGCTGGACTTCCCAC | CAG | chr17 | 7112629 | 7112648 | 7112632 | - |
| SEQ ID NO 7209 | GGCTGGCTGGACTTCCCACC | AGG | chr17 | 7112628 | 7112647 | 7112631 | - |
| SEQ ID NO 7210 | TGGCTGGACTTCCCACCAGG | CGG | chr17 | 7112625 | 7112644 | 7112628 | - |
| SEQ ID NO 7211 | CCCACCAGGCGGTGTCCCCA | CAG | chr17 | 7112614 | 7112633 | 7112617 | - |
| SEQ ID NO 7212 | CCACCAGGCGGTGTCCCCAC | AGG | chr17 | 7112613 | 7112632 | 7112616 | - |
| SEQ ID NO 7213 | CCAGGCGGTGTCCCCACAGG | CAG | chr17 | 7112610 | 7112629 | 7112613 | - |
| SEQ ID NO 7214 | AGGCGGTGTCCCCACAGGCA | GAG | chr17 | 7112608 | 7112627 | 7112611 | - |
| SEQ ID NO 7215 | GGCGGTGTCCCCACAGGCAG | AGG | chr17 | 7112607 | 7112626 | 7112610 | - |
| SEQ ID NO 7216 | CTCACTCCTCTGCAACTC | CAG | chr17 | 7112574 | 7112593 | 7112577 | - |
| SEQ ID NO 7217 | CTGCAACTCCAGTGCCCACA | CGG | chr17 | 7112563 | 7112582 | 7112566 | - |
| SEQ ID NO 7218 | TCCAGTGCCCACACGGCACC | CGG | chr17 | 7112556 | 7112575 | 7112559 | - |
| SEQ ID NO 7219 | CCCACACGGCACCCGGTACA | TAG | chr17 | 7112549 | 7112568 | 7112552 | - |
| SEQ ID NO 7220 | CCCGGTACATAGTGAACACT | CAG | chr17 | 7112538 | 7112557 | 7112541 | - |
| SEQ ID NO 7221 | CGGTACATAGTGAACACTCA | GAG | chr17 | 7112536 | 7112555 | 7112539 | - |
| SEQ ID NO 7222 | GTACATAGTGAACACTCAGA | GAG | chr17 | 7112534 | 7112553 | 7112537 | - |
| SEQ ID NO 7223 | GTGAACACTCAGAGAGAATA | CGG | chr17 | 7112527 | 7112546 | 7112530 | - |
| SEQ ID NO 7224 | TGAACACTCAGAGAGAATAC | GGG | chr17 | 7112526 | 7112545 | 7112529 | - |
| SEQ ID NO 7225 | GGGATGCTGCTGAATCTTCT | GAG | chr17 | 7112506 | 7112525 | 7112509 | - |
| SEQ ID NO 7226 | GGATGCTGCTGAATCTTCTG | AGG | chr17 | 7112505 | 7112524 | 7112508 | - |
| SEQ ID NO 7227 | GATGCTGCTGAATCTTCTGA | GGG | chr17 | 7112504 | 7112523 | 7112507 | - |
| SEQ ID NO 7228 | GCTGAATCTTCTGAGGGTGA | CAG | chr17 | 7112498 | 7112517 | 7112501 | - |
| SEQ ID NO 7229 | CTTCTGAGGGTGACAGAATT | TAG | chr17 | 7112491 | 7112510 | 7112494 | - |
| SEQ ID NO 7230 | TCTGAGGGTGACAGAATTTA | GAG | chr17 | 7112489 | 7112508 | 7112492 | - |
| SEQ ID NO 7231 | GGTGACAGAATTTAGAGTTT | GAG | chr17 | 7112483 | 7112502 | 7112486 | - |
| SEQ ID NO 7232 | GACAGAATTTAGAGTTTGAG | CAG | chr17 | 7112480 | 7112499 | 7112483 | - |
| SEQ ID NO 7233 | ACAGAATTTAGAGTTTGAGC | AGG | chr17 | 7112479 | 7112498 | 7112482 | - |
| SEQ ID NO 7234 | AGAATTTAGAGTTTGAGCAG | GAG | chr17 | 7112477 | 7112496 | 7112480 | - |
| SEQ ID NO 7235 | GAATTTAGAGTTTGAGCAGG | AGG | chr17 | 7112476 | 7112495 | 7112479 | - |

Figure 25 (Cont'd)

| | | | | | | | |
|---|---|---|---|---|---|---|---|
| SEQ ID NO 7236 | TAGAGTTTGAGCAGGAGGCT | TGG | chr17 | 7112471 | 7112490 | 7112474 | - |
| SEQ ID NO 7237 | GAGTTTGAGCAGGAGGCTTG | GAG | chr17 | 7112469 | 7112488 | 7112472 | - |
| SEQ ID NO 7238 | GTTTGAGCAGGAGGCTTGGA | GAG | chr17 | 7112467 | 7112486 | 7112470 | - |
| SEQ ID NO 7239 | TTGAGCAGGAGGCTTGGAGA | GAG | chr17 | 7112465 | 7112484 | 7112468 | - |
| SEQ ID NO 7240 | TGAGCAGGAGGCTTGGAGAG | AGG | chr17 | 7112464 | 7112483 | 7112467 | - |
| SEQ ID NO 7241 | CAGGAGGCTTGGAGAGAGGC | CAG | chr17 | 7112460 | 7112479 | 7112463 | - |
| SEQ ID NO 7242 | AGGAGGCTTGGAGAGAGGCC | AGG | chr17 | 7112459 | 7112478 | 7112462 | - |
| SEQ ID NO 7243 | GCCAGGATTTCTGAAATTAA | TGG | chr17 | 7112442 | 7112461 | 7112445 | - |
| SEQ ID NO 7244 | CCAGGATTTCTGAAATTAAT | GGG | chr17 | 7112441 | 7112460 | 7112444 | - |
| SEQ ID NO 7245 | AGGATTTCTGAAATTAATGG | GAG | chr17 | 7112439 | 7112458 | 7112442 | - |
| SEQ ID NO 7246 | GATTTCTGAAATTAATGGGA | GAG | chr17 | 7112437 | 7112456 | 7112440 | - |
| SEQ ID NO 7247 | TCTGAAATTAATGGGAGAGT | GAG | chr17 | 7112433 | 7112452 | 7112436 | - |
| SEQ ID NO 7248 | GGAGAGTGAGCTCACGCGAA | TGG | chr17 | 7112420 | 7112439 | 7112423 | - |
| SEQ ID NO 7249 | GAGAGTGAGCTCACGCGAAT | GGG | chr17 | 7112419 | 7112438 | 7112422 | - |
| SEQ ID NO 7250 | TGAGCTCACGCGAATGGGCT | GAG | chr17 | 7112414 | 7112433 | 7112417 | - |
| SEQ ID NO 7251 | GAGCTCACGCGAATGGGCTG | AGG | chr17 | 7112413 | 7112432 | 7112416 | - |
| SEQ ID NO 7252 | AGCTCACGCGAATGGGCTGA | GGG | chr17 | 7112412 | 7112431 | 7112415 | - |
| SEQ ID NO 7253 | GCGAATGGGCTGAGGGACAC | CAG | chr17 | 7112405 | 7112424 | 7112408 | - |
| SEQ ID NO 7254 | ATGGGCTGAGGGACACCAGT | GAG | chr17 | 7112401 | 7112420 | 7112404 | - |
| SEQ ID NO 7255 | TGGGCTGAGGGACACCAGTG | AGG | chr17 | 7112400 | 7112419 | 7112403 | - |
| SEQ ID NO 7256 | GGGCTGAGGGACACCAGTGA | GGG | chr17 | 7112399 | 7112418 | 7112402 | - |
| SEQ ID NO 7257 | CACCAGTGAGGGACCGTCTG | AAG | chr17 | 7112388 | 7112407 | 7112391 | - |
| SEQ ID NO 7258 | ACCAGTGAGGGACCGTCTGA | AGG | chr17 | 7112387 | 7112406 | 7112390 | - |
| SEQ ID NO 7259 | CCAGTGAGGGACCGTCTGAA | GGG | chr17 | 7112386 | 7112405 | 7112389 | - |
| SEQ ID NO 7260 | AGGGACCGTCTGAAGGGATG | TAG | chr17 | 7112380 | 7112399 | 7112383 | - |
| SEQ ID NO 7261 | CCGTCTGAAGGGATGTAGCA | AAG | chr17 | 7112375 | 7112394 | 7112378 | - |
| SEQ ID NO 7262 | AAAGTCACCGCATTTCCCTC | CAG | chr17 | 7112356 | 7112375 | 7112359 | - |
| SEQ ID NO 7263 | GTCACCGCATTTCCCTCCAG | CAG | chr17 | 7112353 | 7112372 | 7112356 | - |
| SEQ ID NO 7264 | CGCATTTCCCTCCAGCAGCC | CGG | chr17 | 7112348 | 7112367 | 7112351 | - |
| SEQ ID NO 7265 | GCATTTCCCTCCAGCAGCCC | GGG | chr17 | 7112347 | 7112366 | 7112350 | - |
| SEQ ID NO 7266 | TTTCCCTCCAGCAGCCCGGG | TGG | chr17 | 7112344 | 7112363 | 7112347 | - |
| SEQ ID NO 7267 | CCCTCCAGCAGCCCGGGTGG | TGG | chr17 | 7112341 | 7112360 | 7112344 | - |
| SEQ ID NO 7268 | CCTCCAGCAGCCCGGGTGGT | GGG | chr17 | 7112340 | 7112359 | 7112343 | - |
| SEQ ID NO 7269 | CTCCAGCAGCCCGGGTGGTG | GGG | chr17 | 7112339 | 7112358 | 7112342 | - |
| SEQ ID NO 7270 | TCCAGCAGCCCGGGTGGTGG | GGG | chr17 | 7112338 | 7112357 | 7112341 | - |
| SEQ ID NO 7271 | GCAGCCCGGGTGGTGGGGGC | TGG | chr17 | 7112334 | 7112353 | 7112337 | - |
| SEQ ID NO 7272 | CAGCCCGGGTGGTGGGGCT | GGG | chr17 | 7112333 | 7112352 | 7112336 | - |
| SEQ ID NO 7273 | AGCCCGGGTGGTGGGGCTG | GGG | chr17 | 7112332 | 7112351 | 7112335 | - |
| SEQ ID NO 7274 | GCCCGGGTGGTGGGGCTGG | GGG | chr17 | 7112331 | 7112350 | 7112334 | - |
| SEQ ID NO 7275 | GGGCTGGGGAACGTCATCA | TGG | chr17 | 7112318 | 7112337 | 7112321 | - |
| SEQ ID NO 7276 | GGCTGGGGAACGTCATCAT | GGG | chr17 | 7112317 | 7112336 | 7112320 | - |
| SEQ ID NO 7277 | CTGGGGAACGTCATCATGG | GAG | chr17 | 7112315 | 7112334 | 7112318 | - |
| SEQ ID NO 7278 | TCATGGGAGCTGACACTGAT | CAG | chr17 | 7112301 | 7112320 | 7112304 | - |
| SEQ ID NO 7279 | GACACTGATCAGCTGCTCAC | CGG | chr17 | 7112290 | 7112309 | 7112293 | - |
| SEQ ID NO 7280 | ACACTGATCAGCTGCTCACC | GGG | chr17 | 7112289 | 7112308 | 7112292 | - |
| SEQ ID NO 7281 | CACTGATCAGCTGCTCACCG | GGG | chr17 | 7112288 | 7112307 | 7112291 | - |
| SEQ ID NO 7282 | GGCCCATCTTCCACTTGTCT | CAG | chr17 | 7112267 | 7112286 | 7112270 | - |

Figure 25 (Cont'd)

| | | | | | | | |
|---|---|---|---|---|---|---|---|
| SEQ ID NO 7283 | GCTACCCCTTTTTCTTTTA | AAG | chr17 | 7112228 | 7112247 | 7112231 | - |
| SEQ ID NO 7284 | ATTTCAATTATGCATGTATT | AAG | chr17 | 7112205 | 7112224 | 7112208 | - |
| SEQ ID NO 7285 | TTTCAATTATGCATGTATTA | AGG | chr17 | 7112204 | 7112223 | 7112207 | - |
| SEQ ID NO 7286 | TTCAATTATGCATGTATTAA | GGG | chr17 | 7112203 | 7112222 | 7112206 | - |
| SEQ ID NO 7287 | TGCATGTATTAAGGGTCCCA | CAG | chr17 | 7112195 | 7112214 | 7112198 | - |
| SEQ ID NO 7288 | TTTTTAATTCTTTTTTCTCC | CAG | chr17 | 7112152 | 7112171 | 7112155 | - |
| SEQ ID NO 7289 | TCTCCCAGTGTTTCATTTTA | TAG | chr17 | 7112137 | 7112156 | 7112140 | - |
| SEQ ID NO 7290 | TCCCAGTGTTTCATTTTATA | GAG | chr17 | 7112135 | 7112154 | 7112138 | - |
| SEQ ID NO 7291 | TAGAGTTATTGCTGTTCATT | AAG | chr17 | 7112117 | 7112136 | 7112120 | - |
| SEQ ID NO 7292 | TCTCATCTCACTCTGTTGCC | CAG | chr17 | 7112018 | 7112037 | 7112021 | - |
| SEQ ID NO 7293 | CTCATCTCACTCTGTTGCCC | AGG | chr17 | 7112017 | 7112036 | 7112020 | - |
| SEQ ID NO 7294 | TCTCACTCTGTTGCCCAGGC | TGG | chr17 | 7112013 | 7112032 | 7112016 | - |
| SEQ ID NO 7295 | CTGTTGCCCAGGCTGGAATG | CAG | chr17 | 7112006 | 7112025 | 7112009 | - |
| SEQ ID NO 7296 | TTGCCCAGGCTGGAATGCAG | TAG | chr17 | 7112003 | 7112022 | 7112006 | - |
| SEQ ID NO 7297 | TAGCTTGTCACAACTCACTG | TGG | chr17 | 7111983 | 7112002 | 7111986 | - |
| SEQ ID NO 7298 | TCACTGTGGCCTCCACCTCC | TGG | chr17 | 7111969 | 7111988 | 7111972 | - |
| SEQ ID NO 7299 | CACTGTGGCCTCCACCTCCT | GGG | chr17 | 7111968 | 7111987 | 7111971 | - |
| SEQ ID NO 7300 | TGGCCTCCACCTCCTGGGCT | CAG | chr17 | 7111963 | 7111982 | 7111966 | - |
| SEQ ID NO 7301 | GGCCTCCACCTCCTGGGCTC | AGG | chr17 | 7111962 | 7111981 | 7111965 | - |
| SEQ ID NO 7302 | CTCAGGCGATCCTTCCACTT | CAG | chr17 | 7111945 | 7111964 | 7111948 | - |
| SEQ ID NO 7303 | ATCCTTCCACTTCAGCCTCC | CAG | chr17 | 7111937 | 7111956 | 7111940 | - |
| SEQ ID NO 7304 | TCCTTCCACTTCAGCCTCCC | AGG | chr17 | 7111936 | 7111955 | 7111939 | - |
| SEQ ID NO 7305 | TTCCACTTCAGCCTCCCAGG | TAG | chr17 | 7111933 | 7111952 | 7111936 | - |
| SEQ ID NO 7306 | ACTTCAGCCTCCCAGGTAGC | TGG | chr17 | 7111929 | 7111948 | 7111932 | - |
| SEQ ID NO 7307 | CTTCAGCCTCCCAGGTAGCT | GGG | chr17 | 7111928 | 7111947 | 7111931 | - |
| SEQ ID NO 7308 | CTCCCAGGTAGCTGGGACTA | TAG | chr17 | 7111921 | 7111940 | 7111924 | - |
| SEQ ID NO 7309 | TCCCAGGTAGCTGGGACTAT | AGG | chr17 | 7111920 | 7111939 | 7111923 | - |
| SEQ ID NO 7310 | TAGCTGGGACTATAGGCATG | TGG | chr17 | 7111913 | 7111932 | 7111916 | - |
| SEQ ID NO 7311 | TAGGCATGTGGCACCACACC | TGG | chr17 | 7111901 | 7111920 | 7111904 | - |
| SEQ ID NO 7312 | TAATTAAAAATTTTTTTTTG | TAG | chr17 | 7111877 | 7111896 | 7111880 | - |
| SEQ ID NO 7313 | ATTAAAAATTTTTTTTGTA | GAG | chr17 | 7111875 | 7111894 | 7111878 | - |
| SEQ ID NO 7314 | AAAATTTTTTTTGTAGAGA | CGG | chr17 | 7111871 | 7111890 | 7111874 | - |
| SEQ ID NO 7315 | GTAGAGACGGTTTTGCCATG | TAG | chr17 | 7111858 | 7111877 | 7111861 | - |
| SEQ ID NO 7316 | AGAGACGGTTTTGCCATGTA | GAG | chr17 | 7111856 | 7111875 | 7111859 | - |
| SEQ ID NO 7317 | GAGACGGTTTTGCCATGTAG | AGG | chr17 | 7111855 | 7111874 | 7111858 | - |
| SEQ ID NO 7318 | AGACGGTTTTGCCATGTAGA | GGG | chr17 | 7111854 | 7111873 | 7111857 | - |
| SEQ ID NO 7319 | GACGGTTTTGCCATGTAGAG | GGG | chr17 | 7111853 | 7111872 | 7111856 | - |
| SEQ ID NO 7320 | AGGGGTTTTGCCATGCTGCC | CAG | chr17 | 7111835 | 7111854 | 7111838 | - |
| SEQ ID NO 7321 | TTTTGCCATGCTGCCCAGAC | TAG | chr17 | 7111830 | 7111849 | 7111833 | - |
| SEQ ID NO 7322 | ATGCTGCCCAGACTAGTCTT | GAG | chr17 | 7111823 | 7111842 | 7111826 | - |
| SEQ ID NO 7323 | CCAGACTAGTCTTGAGCTCC | TGG | chr17 | 7111816 | 7111835 | 7111819 | - |
| SEQ ID NO 7324 | CAGACTAGTCTTGAGCTCCT | GGG | chr17 | 7111815 | 7111834 | 7111818 | - |
| SEQ ID NO 7325 | AGTCTTGAGCTCCTGGGCTC | AAG | chr17 | 7111809 | 7111828 | 7111812 | - |
| SEQ ID NO 7326 | CCCCCCGTGTCGACCTCCCA | AAG | chr17 | 7111781 | 7111800 | 7111784 | - |
| SEQ ID NO 7327 | GTGTCGACCTCCCAAAGTGC | TGG | chr17 | 7111775 | 7111794 | 7111778 | - |
| SEQ ID NO 7328 | TGTCGACCTCCCAAAGTGCT | GGG | chr17 | 7111774 | 7111793 | 7111777 | - |
| SEQ ID NO 7329 | CTCCCAAAGTGCTGGGATTA | CAG | chr17 | 7111767 | 7111786 | 7111770 | - |

Figure 25 (Cont'd)

| | | | | | | | |
|---|---|---|---|---|---|---|---|
| SEQ ID NO 7330 | GGGATTACAGATGTGATCCA | CAG | chr17 | 7111754 | 7111773 | 7111757 | - |
| SEQ ID NO 7331 | CAGATGTGATCCACAGTGCC | TGG | chr17 | 7111747 | 7111766 | 7111750 | - |
| SEQ ID NO 7332 | CATCTTCCATTATTTCCATC | CAG | chr17 | 7111699 | 7111718 | 7111702 | - |
| SEQ ID NO 7333 | TCTTTTCTTTTTTTTTTTTT | TGG | chr17 | 7111658 | 7111677 | 7111661 | - |
| SEQ ID NO 7334 | TTTTCTTTTTTTTTTTTTTG | GAG | chr17 | 7111656 | 7111675 | 7111659 | - |
| SEQ ID NO 7335 | TTTCTTTTTTTTTTTTTTGG | AGG | chr17 | 7111655 | 7111674 | 7111658 | - |
| SEQ ID NO 7336 | CTTTTTTTTTTTTTTGGAGG | CGG | chr17 | 7111652 | 7111671 | 7111655 | - |
| SEQ ID NO 7337 | TTTTTTTTTTTTTGGAGGCG | GAG | chr17 | 7111650 | 7111669 | 7111653 | - |
| SEQ ID NO 7338 | CGGAGTCTCGCTCTGTTGCC | CAG | chr17 | 7111632 | 7111651 | 7111635 | - |
| SEQ ID NO 7339 | GGAGTCTCGCTCTGTTGCCC | AGG | chr17 | 7111631 | 7111650 | 7111634 | - |
| SEQ ID NO 7340 | TCTCGCTCTGTTGCCCAGGC | CGG | chr17 | 7111627 | 7111646 | 7111630 | - |
| SEQ ID NO 7341 | TCGCTCTGTTGCCCAGGCCG | GAG | chr17 | 7111625 | 7111644 | 7111628 | - |
| SEQ ID NO 7342 | CTGTTGCCCAGGCCGGAGTG | CAG | chr17 | 7111620 | 7111639 | 7111623 | - |
| SEQ ID NO 7343 | TTGCCCAGGCCGGAGTGCAG | TGG | chr17 | 7111617 | 7111636 | 7111620 | - |
| SEQ ID NO 7344 | GGAGTGCAGTGGCGCGATCT | TGG | chr17 | 7111606 | 7111625 | 7111609 | - |
| SEQ ID NO 7345 | GCGCGATCTTGGCTCACTGC | AAG | chr17 | 7111595 | 7111614 | 7111598 | - |
| SEQ ID NO 7346 | TCACTGCAAGCTCTGCCTCC | CGG | chr17 | 7111582 | 7111601 | 7111585 | - |
| SEQ ID NO 7347 | CACTGCAAGCTCTGCCTCCC | GGG | chr17 | 7111581 | 7111600 | 7111584 | - |
| SEQ ID NO 7348 | TTCATGCCATTCTCCTGCCT | CAG | chr17 | 7111558 | 7111577 | 7111561 | - |
| SEQ ID NO 7349 | TTCTCCTGCCTCAGCCTCCC | GAG | chr17 | 7111549 | 7111568 | 7111552 | - |
| SEQ ID NO 7350 | TCCTGCCTCAGCCTCCCGAG | TAG | chr17 | 7111546 | 7111565 | 7111549 | - |
| SEQ ID NO 7351 | GCCTCAGCCTCCCGAGTAGC | TGG | chr17 | 7111542 | 7111561 | 7111545 | - |
| SEQ ID NO 7352 | CCTCAGCCTCCCGAGTAGCT | GGG | chr17 | 7111541 | 7111560 | 7111544 | - |
| SEQ ID NO 7353 | CTCCCGAGTAGCTGGGACTA | CAG | chr17 | 7111534 | 7111553 | 7111537 | - |
| SEQ ID NO 7354 | TCCCGAGTAGCTGGGACTAC | AGG | chr17 | 7111533 | 7111552 | 7111536 | - |
| SEQ ID NO 7355 | CAGGCGCCTGCCACCACGTC | TGG | chr17 | 7111514 | 7111533 | 7111517 | - |
| SEQ ID NO 7356 | TGGCTAATTTTTTGTATTTT | TAG | chr17 | 7111494 | 7111513 | 7111497 | - |
| SEQ ID NO 7357 | CTAATTTTTTGTATTTTTAG | TAG | chr17 | 7111491 | 7111510 | 7111494 | - |
| SEQ ID NO 7358 | AATTTTTTGTATTTTTAGTA | GAG | chr17 | 7111489 | 7111508 | 7111492 | - |
| SEQ ID NO 7359 | TTTTGTATTTTTAGTAGAGA | TGG | chr17 | 7111485 | 7111504 | 7111488 | - |
| SEQ ID NO 7360 | TTTGTATTTTTAGTAGAGAT | GGG | chr17 | 7111484 | 7111503 | 7111487 | - |
| SEQ ID NO 7361 | TTGTATTTTTAGTAGAGATG | GGG | chr17 | 7111483 | 7111502 | 7111486 | - |
| SEQ ID NO 7362 | GAGATGGGGTTTCACCATGT | TAG | chr17 | 7111469 | 7111488 | 7111472 | - |
| SEQ ID NO 7363 | TGGGGTTTCACCATGTTAGC | CAG | chr17 | 7111465 | 7111484 | 7111468 | - |
| SEQ ID NO 7364 | GGGGTTTCACCATGTTAGCC | AGG | chr17 | 7111464 | 7111483 | 7111467 | - |
| SEQ ID NO 7365 | TTTCACCATGTTAGCCAGGA | TGG | chr17 | 7111460 | 7111479 | 7111463 | - |
| SEQ ID NO 7366 | ACCTCATGATCTGCCCGCCT | TGG | chr17 | 7111424 | 7111443 | 7111427 | - |
| SEQ ID NO 7367 | CTGCCCGCCTTGGCCTCCCA | CAG | chr17 | 7111414 | 7111433 | 7111417 | - |
| SEQ ID NO 7368 | GCCTTGGCCTCCCACAGTGC | TGG | chr17 | 7111408 | 7111427 | 7111411 | - |
| SEQ ID NO 7369 | CCTTGGCCTCCCACAGTGCT | GGG | chr17 | 7111407 | 7111426 | 7111410 | - |
| SEQ ID NO 7370 | CTCCCACAGTGCTGGGATTC | CAG | chr17 | 7111400 | 7111419 | 7111403 | - |
| SEQ ID NO 7371 | TCCCACAGTGCTGGGATTCC | AGG | chr17 | 7111399 | 7111418 | 7111402 | - |
| SEQ ID NO 7372 | AGTGCTGGGATTCCAGGCGT | GAG | chr17 | 7111393 | 7111412 | 7111396 | - |
| SEQ ID NO 7373 | GGGATTCCAGGCGTGAGCCA | CGG | chr17 | 7111387 | 7111406 | 7111390 | - |
| SEQ ID NO 7374 | CAGGCGTGAGCCACGGCGCC | TGG | chr17 | 7111380 | 7111399 | 7111383 | - |
| SEQ ID NO 7375 | CGTGAGCCACGGCGCCTGGC | CAG | chr17 | 7111376 | 7111395 | 7111379 | - |
| SEQ ID NO 7376 | GCCAGTGTGTTTTTTCATTT | CAG | chr17 | 7111358 | 7111377 | 7111361 | - |

Figure 25 (Cont'd)

| SEQ ID NO 7377 | TTTTTTCATTTCAGACATTG | TAG | chr17 | 7111349 | 7111368 | 7111352 | - |
| SEQ ID NO 7378 | GACATTGTAGTTTTTATCTC | TAG | chr17 | 7111336 | 7111355 | 7111339 | - |
| SEQ ID NO 7379 | ATTGTAGTTTTTATCTCTAG | AAG | chr17 | 7111333 | 7111352 | 7111336 | - |
| SEQ ID NO 7380 | TTTATCTCTAGAAGTTCACC | TGG | chr17 | 7111324 | 7111343 | 7111327 | - |
| SEQ ID NO 7381 | TTATCTCTAGAAGTTCACCT | GGG | chr17 | 7111323 | 7111342 | 7111326 | - |
| SEQ ID NO 7382 | TATCTCTAGAAGTTCACCTG | GGG | chr17 | 7111322 | 7111341 | 7111325 | - |
| SEQ ID NO 7383 | ACTTAATTTTTTGAACATAA | TGG | chr17 | 7111274 | 7111293 | 7111277 | - |
| SEQ ID NO 7384 | CTTAATTTTTTGAACATAAT | GGG | chr17 | 7111273 | 7111292 | 7111276 | - |
| SEQ ID NO 7385 | TTTTTGAACATAATGGGATA | TGG | chr17 | 7111267 | 7111286 | 7111270 | - |
| SEQ ID NO 7386 | CCATCCTTGCCTGCTAATTC | TAG | chr17 | 7111227 | 7111246 | 7111230 | - |
| SEQ ID NO 7387 | GCTAATTCTAGCATCCGTGT | CAG | chr17 | 7111215 | 7111234 | 7111218 | - |
| SEQ ID NO 7388 | TCTAGCATCCGTGTCAGTTC | TGG | chr17 | 7111209 | 7111228 | 7111212 | - |
| SEQ ID NO 7389 | CATGCCTTGTAATCTTTGAT | TGG | chr17 | 7111129 | 7111148 | 7111132 | - |
| SEQ ID NO 7390 | TGTAATCTTTGATTGGCTGC | CAG | chr17 | 7111122 | 7111141 | 7111125 | - |
| SEQ ID NO 7391 | CATTGTCAATTTCACCTTGT | TGG | chr17 | 7111098 | 7111117 | 7111101 | - |
| SEQ ID NO 7392 | ATTGTCAATTTCACCTTGTT | GGG | chr17 | 7111097 | 7111116 | 7111100 | - |
| SEQ ID NO 7393 | AATTTCACCTTGTTGGGTGC | TGG | chr17 | 7111091 | 7111110 | 7111094 | - |
| SEQ ID NO 7394 | GTATTCCTCTAAATGTTCTT | GAG | chr17 | 7111060 | 7111079 | 7111063 | - |
| SEQ ID NO 7395 | AATGTTCTTGAGCTTTGCTC | CGG | chr17 | 7111049 | 7111068 | 7111052 | - |
| SEQ ID NO 7396 | ATGTTCTTGAGCTTTGCTCC | GGG | chr17 | 7111048 | 7111067 | 7111051 | - |
| SEQ ID NO 7397 | TTGAGCTTTGCTCCGGGATG | CAG | chr17 | 7111042 | 7111061 | 7111045 | - |
| SEQ ID NO 7398 | CTTTGCTCCGGGATGCAGTT | AAG | chr17 | 7111037 | 7111056 | 7111040 | - |
| SEQ ID NO 7399 | CGGGATGCAGTTAAGCAACT | TAG | chr17 | 7111029 | 7111048 | 7111032 | - |
| SEQ ID NO 7400 | GGATGCAGTTAAGCAACTTA | GAG | chr17 | 7111027 | 7111046 | 7111030 | - |
| SEQ ID NO 7401 | GCAGTTAAGCAACTTAGAGT | CAG | chr17 | 7111023 | 7111042 | 7111026 | - |
| SEQ ID NO 7402 | GTTGAACTCTTAATTGTTT | TGG | chr17 | 7110993 | 7111012 | 7110996 | - |
| SEQ ID NO 7403 | CTTAATTGTTTTGGTCTCCT | CGG | chr17 | 7110984 | 7111003 | 7110987 | - |
| SEQ ID NO 7404 | TTTTGGTCTCCTCGGACTCT | CAG | chr17 | 7110976 | 7110995 | 7110979 | - |
| SEQ ID NO 7405 | TCAGCTCCATCTCCTCAACG | TGG | chr17 | 7110957 | 7110976 | 7110960 | - |
| SEQ ID NO 7406 | CAGCTCCATCTCCTCAACGT | GGG | chr17 | 7110956 | 7110975 | 7110959 | - |
| SEQ ID NO 7407 | AGCTCCATCTCCTCAACGTG | GGG | chr17 | 7110955 | 7110974 | 7110958 | - |
| SEQ ID NO 7408 | CTCCATCTCCTCAACGTGGG | GAG | chr17 | 7110953 | 7110972 | 7110956 | - |
| SEQ ID NO 7409 | CCTCAACGTGGGGAGTCTCT | TGG | chr17 | 7110945 | 7110964 | 7110948 | - |
| SEQ ID NO 7410 | CTCAACGTGGGGAGTCTCTT | GGG | chr17 | 7110944 | 7110963 | 7110947 | - |
| SEQ ID NO 7411 | GGAGTCTCTTGGGCTCTGCC | TGG | chr17 | 7110934 | 7110953 | 7110937 | - |
| SEQ ID NO 7412 | CTGCCTGGACTTCCCTTTCC | TGG | chr17 | 7110919 | 7110938 | 7110922 | - |
| SEQ ID NO 7413 | CTTTCCTGGCCTGTAACCTG | CAG | chr17 | 7110905 | 7110924 | 7110908 | - |
| SEQ ID NO 7414 | ACCTGCAGACTCTCTCCAAA | CAG | chr17 | 7110890 | 7110909 | 7110893 | - |
| SEQ ID NO 7415 | GCAGACTCTCTCCAAACAGT | AAG | chr17 | 7110886 | 7110905 | 7110889 | - |
| SEQ ID NO 7416 | ACTCTCTCCAAACAGTAAGC | TGG | chr17 | 7110882 | 7110901 | 7110885 | - |
| SEQ ID NO 7417 | CTCTCTCCAAACAGTAAGCT | GGG | chr17 | 7110881 | 7110900 | 7110884 | - |
| SEQ ID NO 7418 | TCTCTCCAAACAGTAAGCTG | GGG | chr17 | 7110880 | 7110899 | 7110883 | - |
| SEQ ID NO 7419 | AAACAGTAAGCTGGGGTGAT | CGG | chr17 | 7110873 | 7110892 | 7110876 | - |
| SEQ ID NO 7420 | ACAGTAAGCTGGGGTGATCG | GAG | chr17 | 7110871 | 7110890 | 7110874 | - |
| SEQ ID NO 7421 | CAGTAAGCTGGGGTGATCGG | AGG | chr17 | 7110870 | 7110889 | 7110873 | - |
| SEQ ID NO 7422 | AGTAAGCTGGGGTGATCGGA | GGG | chr17 | 7110869 | 7110888 | 7110872 | - |
| SEQ ID NO 7423 | GTTGTTTGCTTCTTATCCCT | CAG | chr17 | 7110841 | 7110860 | 7110844 | - |

Figure 25 (Cont'd)

| | | | | | | | |
|---|---|---|---|---|---|---|---|
| SEQ ID NO 7424 | TTGTTTGCTTCTTATCCCTC | AGG | chr17 | 7110840 | 7110859 | 7110843 | - |
| SEQ ID NO 7425 | TGTTTGCTTCTTATCCCTCA | GGG | chr17 | 7110839 | 7110858 | 7110842 | - |
| SEQ ID NO 7426 | ACTCCTCCTTGCCTGATGTC | CAG | chr17 | 7110810 | 7110829 | 7110813 | - |
| SEQ ID NO 7427 | TCCTCCTTGCCTGATGTCCA | GAG | chr17 | 7110808 | 7110827 | 7110811 | - |
| SEQ ID NO 7428 | CCTGATGTCCAGAGTCTTGA | AAG | chr17 | 7110799 | 7110818 | 7110802 | - |
| SEQ ID NO 7429 | TTGAAAGCTGCCATGTTCTA | TAG | chr17 | 7110783 | 7110802 | 7110786 | - |
| SEQ ID NO 7430 | GTTTTTGTTTTGATTGTTTC | TGG | chr17 | 7110754 | 7110773 | 7110757 | - |
| SEQ ID NO 7431 | TTTTTGTTTTGATTGTTTCT | GGG | chr17 | 7110753 | 7110772 | 7110756 | - |
| SEQ ID NO 7432 | TTTTGTTTTGATTGTTTCTG | GGG | chr17 | 7110752 | 7110771 | 7110755 | - |
| SEQ ID NO 7433 | TTGTTTTGATTGTTTCTGGG | GAG | chr17 | 7110750 | 7110769 | 7110753 | - |
| SEQ ID NO 7434 | GTTTTGATTGTTTCTGGGGA | GAG | chr17 | 7110748 | 7110767 | 7110751 | - |
| SEQ ID NO 7435 | TTGATTGTTTCTGGGGAGAG | AAG | chr17 | 7110745 | 7110764 | 7110748 | - |
| SEQ ID NO 7436 | GAGAAGAACTCTTCCCATCT | TGG | chr17 | 7110728 | 7110747 | 7110731 | - |
| SEQ ID NO 7437 | AGAAGAACTCTTCCCATCTT | GGG | chr17 | 7110727 | 7110746 | 7110730 | - |
| SEQ ID NO 7438 | AGAACTCTTCCCATCTTGGG | CAG | chr17 | 7110724 | 7110743 | 7110727 | - |
| SEQ ID NO 7439 | TTATGTTCAAACTTTTGCCT | AAG | chr17 | 7110691 | 7110710 | 7110694 | - |
| SEQ ID NO 7440 | TGTTCAAACTTTTGCCTAAG | AAG | chr17 | 7110688 | 7110707 | 7110691 | - |
| SEQ ID NO 7441 | TTTAACTCATCTAATTATCC | GAG | chr17 | 7110653 | 7110672 | 7110656 | - |
| SEQ ID NO 7442 | AATTATCCGAGCAATCCAAT | CGG | chr17 | 7110641 | 7110660 | 7110644 | - |
| SEQ ID NO 7443 | ATTATCCGAGCAATCCAATC | GGG | chr17 | 7110640 | 7110659 | 7110643 | - |
| SEQ ID NO 7444 | ATCCGAGCAATCCAATCGGG | TAG | chr17 | 7110637 | 7110656 | 7110640 | - |
| SEQ ID NO 7445 | GTGATCTCCATTTTACACAC | GAG | chr17 | 7110606 | 7110625 | 7110609 | - |
| SEQ ID NO 7446 | CCATTTTACACACGAGAAAA | TGG | chr17 | 7110599 | 7110618 | 7110602 | - |
| SEQ ID NO 7447 | TTTTACACACGAGAAAATGG | AAG | chr17 | 7110596 | 7110615 | 7110599 | - |
| SEQ ID NO 7448 | CACACGAGAAAATGGAAGCA | TGG | chr17 | 7110591 | 7110610 | 7110594 | - |
| SEQ ID NO 7449 | CACGAGAAAATGGAAGCATG | GAG | chr17 | 7110589 | 7110608 | 7110592 | - |
| SEQ ID NO 7450 | AGCATGGAGAAATTGAATGC | TGG | chr17 | 7110575 | 7110594 | 7110578 | - |
| SEQ ID NO 7451 | TGAATGCTGGTGCATGATCT | CAG | chr17 | 7110562 | 7110581 | 7110565 | - |
| SEQ ID NO 7452 | AATGCTGGTGCATGATCTCA | GAG | chr17 | 7110560 | 7110579 | 7110563 | - |
| SEQ ID NO 7453 | TGCATGATCTCAGAGCTACC | TGG | chr17 | 7110552 | 7110571 | 7110555 | - |
| SEQ ID NO 7454 | CATGATCTCAGAGCTACCTG | GAG | chr17 | 7110550 | 7110569 | 7110553 | - |
| SEQ ID NO 7455 | ATGATCTCAGAGCTACCTGG | AGG | chr17 | 7110549 | 7110568 | 7110552 | - |
| SEQ ID NO 7456 | CTCAGAGCTACCTGGAGGCA | CAG | chr17 | 7110544 | 7110563 | 7110547 | - |
| SEQ ID NO 7457 | GAGCTACCTGGAGGCACAGC | TGG | chr17 | 7110540 | 7110559 | 7110543 | - |
| SEQ ID NO 7458 | AGCTACCTGGAGGCACAGCT | GGG | chr17 | 7110539 | 7110558 | 7110542 | - |
| SEQ ID NO 7459 | GGCACAGCTGGGCTACCCTG | TGG | chr17 | 7110528 | 7110547 | 7110531 | - |
| SEQ ID NO 7460 | GCACAGCTGGGCTACCCTGT | GGG | chr17 | 7110527 | 7110546 | 7110530 | - |
| SEQ ID NO 7461 | CAGCTGGGCTACCCTGTGGG | CAG | chr17 | 7110524 | 7110543 | 7110527 | - |
| SEQ ID NO 7462 | GGGCTACCCTGTGGGCAGTC | TGG | chr17 | 7110519 | 7110538 | 7110522 | - |
| SEQ ID NO 7463 | CCCTGTGGGCAGTCGGTTT | CAG | chr17 | 7110513 | 7110532 | 7110516 | - |
| SEQ ID NO 7464 | CCTGTGGGCAGTCTGGTTTC | AGG | chr17 | 7110512 | 7110531 | 7110515 | - |
| SEQ ID NO 7465 | CTGTGGGCAGTCTGGTTTCA | GGG | chr17 | 7110511 | 7110530 | 7110514 | - |
| SEQ ID NO 7466 | TGGGCAGTCTGGTTTCAGGG | TGG | chr17 | 7110508 | 7110527 | 7110511 | - |
| SEQ ID NO 7467 | CTGGTTTCAGGGTGGATATA | CAG | chr17 | 7110500 | 7110519 | 7110503 | - |
| SEQ ID NO 7468 | TGGATATACAGACACGTTGC | TGG | chr17 | 7110488 | 7110507 | 7110491 | - |
| SEQ ID NO 7469 | GGATATACAGACACGTTGCT | GGG | chr17 | 7110487 | 7110506 | 7110490 | - |
| SEQ ID NO 7470 | GACACGTTGCTGGGCTGACC | CAG | chr17 | 7110478 | 7110497 | 7110481 | - |

Figure 25 (Cont'd)

| SEQ ID NO 7471 | TTGCTGGGCTGACCCAGCAT | TGG | chr17 | 7110472 | 7110491 | 7110475 | - |
| SEQ ID NO 7472 | TGCTGGGCTGACCCAGCATT | GGG | chr17 | 7110471 | 7110490 | 7110474 | - |
| SEQ ID NO 7473 | CTGGGCTGACCCAGCATTGG | GAG | chr17 | 7110469 | 7110488 | 7110472 | - |
| SEQ ID NO 7474 | ACCCAGCATTGGGAGTTGAT | AAG | chr17 | 7110461 | 7110480 | 7110464 | - |
| SEQ ID NO 7475 | AGCATTGGGAGTTGATAAGT | CGG | chr17 | 7110457 | 7110476 | 7110460 | - |
| SEQ ID NO 7476 | TGGGAGTTGATAAGTCGGAC | TGG | chr17 | 7110452 | 7110471 | 7110455 | - |
| SEQ ID NO 7477 | GGGAGTTGATAAGTCGGACT | GGG | chr17 | 7110451 | 7110470 | 7110454 | - |
| SEQ ID NO 7478 | AGTTGATAAGTCGGACTGGG | AAG | chr17 | 7110448 | 7110467 | 7110451 | - |
| SEQ ID NO 7479 | TGATAAGTCGGACTGGGAAG | CAG | chr17 | 7110445 | 7110464 | 7110448 | - |
| SEQ ID NO 7480 | GATAAGTCGGACTGGGAAGC | AGG | chr17 | 7110444 | 7110463 | 7110447 | - |
| SEQ ID NO 7481 | AGTCGGACTGGGAAGCAGGA | CAG | chr17 | 7110440 | 7110459 | 7110443 | - |
| SEQ ID NO 7482 | GTCGGACTGGGAAGCAGGAC | AGG | chr17 | 7110439 | 7110458 | 7110442 | - |
| SEQ ID NO 7483 | GAAGCAGGACAGGACCCTCT | GAG | chr17 | 7110429 | 7110448 | 7110432 | - |
| SEQ ID NO 7484 | GCAGGACAGGACCCTCTGAG | TGG | chr17 | 7110426 | 7110445 | 7110429 | - |
| SEQ ID NO 7485 | AGGACAGGACCCTCTGAGTG | GAG | chr17 | 7110424 | 7110443 | 7110427 | - |
| SEQ ID NO 7486 | GGACAGGACCCTCTGAGTGG | AGG | chr17 | 7110423 | 7110442 | 7110426 | - |
| SEQ ID NO 7487 | GACAGGACCCTCTGAGTGGA | GGG | chr17 | 7110422 | 7110441 | 7110425 | - |
| SEQ ID NO 7488 | CCTCTGAGTGGAGGGTGCTG | AAG | chr17 | 7110414 | 7110433 | 7110417 | - |
| SEQ ID NO 7489 | TGAGTGGAGGGTGCTGAAGA | CAG | chr17 | 7110410 | 7110429 | 7110413 | - |
| SEQ ID NO 7490 | GTGGAGGGTGCTGAAGACAG | CAG | chr17 | 7110407 | 7110426 | 7110410 | - |
| SEQ ID NO 7491 | AGGGTGCTGAAGACAGCAGT | CAG | chr17 | 7110403 | 7110422 | 7110406 | - |
| SEQ ID NO 7492 | GGGTGCTGAAGACAGCAGTC | AGG | chr17 | 7110402 | 7110421 | 7110405 | - |
| SEQ ID NO 7493 | GGTGCTGAAGACAGCAGTCA | GGG | chr17 | 7110401 | 7110420 | 7110404 | - |
| SEQ ID NO 7494 | GAAGACAGCAGTCAGGGACT | CAG | chr17 | 7110395 | 7110414 | 7110398 | - |
| SEQ ID NO 7495 | AGCAGTCAGGGACTCAGCCA | TGG | chr17 | 7110389 | 7110408 | 7110392 | - |
| SEQ ID NO 7496 | CAGTCAGGGACTCAGCCATG | GAG | chr17 | 7110387 | 7110406 | 7110390 | - |
| SEQ ID NO 7497 | AGTCAGGGACTCAGCCATGG | AGG | chr17 | 7110386 | 7110405 | 7110389 | - |
| SEQ ID NO 7498 | GTCAGGGACTCAGCCATGGA | GGG | chr17 | 7110385 | 7110404 | 7110388 | - |
| SEQ ID NO 7499 | GGGACTCAGCCATGGAGGGC | CAG | chr17 | 7110381 | 7110400 | 7110384 | - |
| SEQ ID NO 7500 | TCAGCCATGGAGGGCCAGCT | TGG | chr17 | 7110376 | 7110395 | 7110379 | - |
| SEQ ID NO 7501 | GCCATGGAGGGCCAGCTTGG | TGG | chr17 | 7110373 | 7110392 | 7110376 | - |
| SEQ ID NO 7502 | CCATGGAGGGCCAGCTTGGT | GGG | chr17 | 7110372 | 7110391 | 7110375 | - |
| SEQ ID NO 7503 | CATGGAGGGCCAGCTTGGTG | GGG | chr17 | 7110371 | 7110390 | 7110374 | - |
| SEQ ID NO 7504 | CAGCTTGGTGGGGAACACCG | TGG | chr17 | 7110361 | 7110380 | 7110364 | - |
| SEQ ID NO 7505 | GGTGGGGAACACCGTGGTCA | TGG | chr17 | 7110355 | 7110374 | 7110358 | - |
| SEQ ID NO 7506 | TGGGGAACACCGTGGTCATG | GAG | chr17 | 7110353 | 7110372 | 7110356 | - |
| SEQ ID NO 7507 | CCGTGGTCATGGAGCGCTTC | TGG | chr17 | 7110344 | 7110363 | 7110347 | - |
| SEQ ID NO 7508 | GGTCATGGAGCGCTTCTGGA | TGG | chr17 | 7110340 | 7110359 | 7110343 | - |
| SEQ ID NO 7509 | TCATGGAGCGCTTCTGGATG | GAG | chr17 | 7110338 | 7110357 | 7110341 | - |
| SEQ ID NO 7510 | ATGGAGCGCTTCTGGATGGA | GAG | chr17 | 7110336 | 7110355 | 7110339 | - |
| SEQ ID NO 7511 | TGGAGCGCTTCTGGATGGAG | AGG | chr17 | 7110335 | 7110354 | 7110338 | - |
| SEQ ID NO 7512 | TCTGGATGGAGAGGAATGCA | AAG | chr17 | 7110326 | 7110345 | 7110329 | - |
| SEQ ID NO 7513 | CTGGATGGAGAGGAATGCAA | AGG | chr17 | 7110325 | 7110344 | 7110328 | - |
| SEQ ID NO 7514 | GGAGAGGAATGCAAAGGCCT | TGG | chr17 | 7110319 | 7110338 | 7110322 | - |
| SEQ ID NO 7515 | AGAGGAATGCAAAGGCCTTG | GAG | chr17 | 7110317 | 7110336 | 7110320 | - |
| SEQ ID NO 7516 | GAGGAATGCAAAGGCCTTGG | AGG | chr17 | 7110316 | 7110335 | 7110319 | - |
| SEQ ID NO 7517 | GAATGCAAAGGCCTTGGAGG | AAG | chr17 | 7110313 | 7110332 | 7110316 | - |

Figure 25 (Cont'd)

| | | | | | | | |
|---|---|---|---|---|---|---|---|
| SEQ ID NO 7518 | AATGCAAAGGCCTTGGAGGA | AGG | chr17 | 7110312 | 7110331 | 7110315 | - |
| SEQ ID NO 7519 | ATGCAAAGGCCTTGGAGGAA | GGG | chr17 | 7110311 | 7110330 | 7110314 | - |
| SEQ ID NO 7520 | TGCAAAGGCCTTGGAGGAAG | GGG | chr17 | 7110310 | 7110329 | 7110313 | - |
| SEQ ID NO 7521 | AAAGGCCTTGGAGGAAGGGG | TGG | chr17 | 7110307 | 7110326 | 7110310 | - |
| SEQ ID NO 7522 | AAGGCCTTGGAGGAAGGGGT | GGG | chr17 | 7110306 | 7110325 | 7110309 | - |
| SEQ ID NO 7523 | AGGCCTTGGAGGAAGGGGTG | GGG | chr17 | 7110305 | 7110324 | 7110308 | - |
| SEQ ID NO 7524 | GGCCTTGGAGGAAGGGGTGG | GGG | chr17 | 7110304 | 7110323 | 7110307 | - |
| SEQ ID NO 7525 | CTTGGAGGAAGGGGTGGGGG | CAG | chr17 | 7110301 | 7110320 | 7110304 | - |
| SEQ ID NO 7526 | GAGGAAGGGGTGGGGGCAGT | GAG | chr17 | 7110297 | 7110316 | 7110300 | - |
| SEQ ID NO 7527 | GGAAGGGGTGGGGGCAGTGA | GAG | chr17 | 7110295 | 7110314 | 7110298 | - |
| SEQ ID NO 7528 | GAAGGGGTGGGGGCAGTGAG | AGG | chr17 | 7110294 | 7110313 | 7110297 | - |
| SEQ ID NO 7529 | AAGGGGTGGGGGCAGTGAGA | GGG | chr17 | 7110293 | 7110312 | 7110296 | - |
| SEQ ID NO 7530 | GGGGTGGGGGCAGTGAGAGG | GAG | chr17 | 7110291 | 7110310 | 7110294 | - |
| SEQ ID NO 7531 | GGGTGGGGGCAGTGAGAGGG | AGG | chr17 | 7110290 | 7110309 | 7110293 | - |
| SEQ ID NO 7532 | GGTGGGGGCAGTGAGAGGGA | GGG | chr17 | 7110289 | 7110308 | 7110292 | - |
| SEQ ID NO 7533 | GGGGGCAGTGAGAGGGAGGG | TGG | chr17 | 7110286 | 7110305 | 7110289 | - |
| SEQ ID NO 7534 | GGGGCAGTGAGAGGGAGGGT | GGG | chr17 | 7110285 | 7110304 | 7110288 | - |
| SEQ ID NO 7535 | GGGCAGTGAGAGGGAGGGTG | GGG | chr17 | 7110284 | 7110303 | 7110287 | - |
| SEQ ID NO 7536 | AGGGAGGGTGGGGCTGTGCT | CAG | chr17 | 7110274 | 7110293 | 7110277 | - |
| SEQ ID NO 7537 | GGAGGGTGGGGCTGTGCTCA | GAG | chr17 | 7110272 | 7110291 | 7110275 | - |
| SEQ ID NO 7538 | GGGTGGGGCTGTGCTCAGAG | CGG | chr17 | 7110269 | 7110288 | 7110272 | - |
| SEQ ID NO 7539 | GGTGGGGCTGTGCTCAGAGC | GGG | chr17 | 7110268 | 7110287 | 7110271 | - |
| SEQ ID NO 7540 | TGGGGCTGTGCTCAGAGCGG | GAG | chr17 | 7110266 | 7110285 | 7110269 | - |
| SEQ ID NO 7541 | GGCTGTGCTCAGAGCGGGAG | TGG | chr17 | 7110263 | 7110282 | 7110266 | - |
| SEQ ID NO 7542 | GCTGTGCTCAGAGCGGGAGT | GGG | chr17 | 7110262 | 7110281 | 7110265 | - |
| SEQ ID NO 7543 | GTGCTCAGAGCGGGAGTGGG | CAG | chr17 | 7110259 | 7110278 | 7110262 | - |
| SEQ ID NO 7544 | CTCAGAGCGGGAGTGGGCAG | TGG | chr17 | 7110256 | 7110275 | 7110259 | - |
| SEQ ID NO 7545 | CAGAGCGGGAGTGGGCAGTG | GAG | chr17 | 7110254 | 7110273 | 7110257 | - |
| SEQ ID NO 7546 | AGAGCGGGAGTGGGCAGTGG | AGG | chr17 | 7110253 | 7110272 | 7110256 | - |
| SEQ ID NO 7547 | GGAGTGGGCAGTGGAGGTGT | CAG | chr17 | 7110247 | 7110266 | 7110250 | - |
| SEQ ID NO 7548 | AGTGGGCAGTGGAGGTGTCA | GAG | chr17 | 7110245 | 7110264 | 7110248 | - |
| SEQ ID NO 7549 | GTGGGCAGTGGAGGTGTCAG | AGG | chr17 | 7110244 | 7110263 | 7110247 | - |
| SEQ ID NO 7550 | GGAGGTGTCAGAGGCCTCCC | TGG | chr17 | 7110235 | 7110254 | 7110238 | - |
| SEQ ID NO 7551 | GAGGTGTCAGAGGCCTCCCT | GGG | chr17 | 7110234 | 7110253 | 7110237 | - |
| SEQ ID NO 7552 | AGAGGCCTCCCTGGGTCAAA | TGG | chr17 | 7110226 | 7110245 | 7110229 | - |
| SEQ ID NO 7553 | GAGGCCTCCCTGGGTCAAAT | GGG | chr17 | 7110225 | 7110244 | 7110228 | - |
| SEQ ID NO 7554 | AGGCCTCCCTGGGTCAAATG | GGG | chr17 | 7110224 | 7110243 | 7110227 | - |
| SEQ ID NO 7555 | CCTGGGTCAAATGGGTCCT | GAG | chr17 | 7110217 | 7110236 | 7110220 | - |
| SEQ ID NO 7556 | GTCAAATGGGTCCTGAGTG | TGG | chr17 | 7110212 | 7110231 | 7110215 | - |
| SEQ ID NO 7557 | TGGGGTCCTGAGTGTGGCT | CAG | chr17 | 7110206 | 7110225 | 7110209 | - |
| SEQ ID NO 7558 | GGTCCTGAGTGTGGCTGCAG | TGG | chr17 | 7110203 | 7110222 | 7110206 | - |
| SEQ ID NO 7559 | GTCCTGAGTGTGGCTGCAGT | GGG | chr17 | 7110202 | 7110221 | 7110205 | - |
| SEQ ID NO 7560 | TCCTGAGTGTGGCTGCAGTG | GGG | chr17 | 7110201 | 7110220 | 7110204 | - |
| SEQ ID NO 7561 | TGAGTGTGGCTGCAGTGGGG | AAG | chr17 | 7110198 | 7110217 | 7110201 | - |
| SEQ ID NO 7562 | GAGTGTGGCTGCAGTGGGGA | AGG | chr17 | 7110197 | 7110216 | 7110200 | - |
| SEQ ID NO 7563 | TGTGGCTGCAGTGGGGAAGG | TGG | chr17 | 7110194 | 7110213 | 7110197 | - |
| SEQ ID NO 7564 | GGCTGCAGTGGGGAAGGTGG | AAG | chr17 | 7110191 | 7110210 | 7110194 | - |

Figure 25 (Cont'd)

| | | | | | | | |
|---|---|---|---|---|---|---|---|
| SEQ ID NO 7565 | GTGGGGAAGGTGGAAGTCAC | TGG | chr17 | 7110184 | 7110203 | 7110187 | - |
| SEQ ID NO 7566 | TGGAAGTCACTGGTGTGAAA | AAG | chr17 | 7110174 | 7110193 | 7110177 | - |
| SEQ ID NO 7567 | TCACTGGTGTGAAAAGATG | AAG | chr17 | 7110168 | 7110187 | 7110171 | - |
| SEQ ID NO 7568 | ACTGGTGTGAAAAGATGAA | GAG | chr17 | 7110166 | 7110185 | 7110169 | - |
| SEQ ID NO 7569 | GTGAAAAGATGAAGAGTTA | TGG | chr17 | 7110160 | 7110179 | 7110163 | - |
| SEQ ID NO 7570 | AAAAGATGAAGAGTTATGGA | CAG | chr17 | 7110156 | 7110175 | 7110159 | - |
| SEQ ID NO 7571 | GAGTTATGGACAGTCACTTA | CAG | chr17 | 7110146 | 7110165 | 7110149 | - |
| SEQ ID NO 7572 | AGTTATGGACAGTCACTTAC | AGG | chr17 | 7110145 | 7110164 | 7110148 | - |
| SEQ ID NO 7573 | GTTATGGACAGTCACTTACA | GGG | chr17 | 7110144 | 7110163 | 7110147 | - |
| SEQ ID NO 7574 | TTATGGACAGTCACTTACAG | GGG | chr17 | 7110143 | 7110162 | 7110146 | - |
| SEQ ID NO 7575 | TGGACAGTCACTTACAGGGG | CAG | chr17 | 7110140 | 7110159 | 7110143 | - |
| SEQ ID NO 7576 | TACAGGGGCAGTGTCTGACT | CAG | chr17 | 7110128 | 7110147 | 7110131 | - |
| SEQ ID NO 7577 | ACAGGGGCAGTGTCTGACTC | AGG | chr17 | 7110127 | 7110146 | 7110130 | - |
| SEQ ID NO 7578 | GGGCAGTGTCTGACTCAGGA | CAG | chr17 | 7110123 | 7110142 | 7110126 | - |
| SEQ ID NO 7579 | CAGTGTCTGACTCAGGACAG | TGG | chr17 | 7110120 | 7110139 | 7110123 | - |
| SEQ ID NO 7580 | TGTCTGACTCAGGACAGTGG | CAG | chr17 | 7110117 | 7110136 | 7110120 | - |
| SEQ ID NO 7581 | GTCTGACTCAGGACAGTGGC | AGG | chr17 | 7110116 | 7110135 | 7110119 | - |
| SEQ ID NO 7582 | TGACTCAGGACAGTGGCAGG | AAG | chr17 | 7110113 | 7110132 | 7110116 | - |
| SEQ ID NO 7583 | GACAGTGGCAGGAAGTGACC | TGG | chr17 | 7110105 | 7110124 | 7110108 | - |
| SEQ ID NO 7584 | ACAGTGGCAGGAAGTGACCT | GGG | chr17 | 7110104 | 7110123 | 7110107 | - |
| SEQ ID NO 7585 | CAGTGGCAGGAAGTGACCTG | GGG | chr17 | 7110103 | 7110122 | 7110106 | - |
| SEQ ID NO 7586 | GTGGCAGGAAGTGACCTGGG | GAG | chr17 | 7110101 | 7110120 | 7110104 | - |
| SEQ ID NO 7587 | TGGCAGGAAGTGACCTGGGG | AGG | chr17 | 7110100 | 7110119 | 7110103 | - |
| SEQ ID NO 7588 | CAGGAAGTGACCTGGGGAGG | AAG | chr17 | 7110097 | 7110116 | 7110100 | - |
| SEQ ID NO 7589 | TGACCTGGGGAGGAAGATTC | TGG | chr17 | 7110090 | 7110109 | 7110093 | - |
| SEQ ID NO 7590 | GACCTGGGGAGGAAGATTCT | GGG | chr17 | 7110089 | 7110108 | 7110092 | - |
| SEQ ID NO 7591 | AAGATTCTGGGCCCCTGACT | GAG | chr17 | 7110077 | 7110096 | 7110080 | - |
| SEQ ID NO 7592 | GGCCCCTGACTGAGCCTCCC | CAG | chr17 | 7110068 | 7110087 | 7110071 | - |
| SEQ ID NO 7593 | GCCCCTGACTGAGCCTCCCC | AGG | chr17 | 7110067 | 7110086 | 7110070 | - |
| SEQ ID NO 7594 | GACTGAGCCTCCCCAGGATG | TGG | chr17 | 7110061 | 7110080 | 7110064 | - |
| SEQ ID NO 7595 | TCCCCAGGATGTGGTCCTGC | TGG | chr17 | 7110052 | 7110071 | 7110055 | - |
| SEQ ID NO 7596 | CCCCAGGATGTGGTCCTGCT | GGG | chr17 | 7110051 | 7110070 | 7110054 | - |
| SEQ ID NO 7597 | AGGATGTGGTCCTGCTGGGT | CGG | chr17 | 7110047 | 7110066 | 7110050 | - |
| SEQ ID NO 7598 | GGATGTGGTCCTGCTGGGTC | GGG | chr17 | 7110046 | 7110065 | 7110049 | - |
| SEQ ID NO 7599 | GATGTGGTCCTGCTGGGTCG | GGG | chr17 | 7110045 | 7110064 | 7110048 | - |
| SEQ ID NO 7600 | ATGTGGTCCTGCTGGGTCGG | GGG | chr17 | 7110044 | 7110063 | 7110047 | - |
| SEQ ID NO 7601 | TGTGGTCCTGCTGGGTCGGG | GGG | chr17 | 7110043 | 7110062 | 7110046 | - |
| SEQ ID NO 7602 | CCTGCTGGGTCGGGGGTGA | TAG | chr17 | 7110037 | 7110056 | 7110040 | - |
| SEQ ID NO 7603 | CTGCTGGGTCGGGGGTGAT | AGG | chr17 | 7110036 | 7110055 | 7110039 | - |
| SEQ ID NO 7604 | GGTCGGGGGTGATAGGAAT | GAG | chr17 | 7110030 | 7110049 | 7110033 | - |
| SEQ ID NO 7605 | CGGGGGTGATAGGAATGAG | AAG | chr17 | 7110027 | 7110046 | 7110030 | - |
| SEQ ID NO 7606 | GGTGATAGGAATGAGAAGAC | AAG | chr17 | 7110022 | 7110041 | 7110025 | - |
| SEQ ID NO 7607 | GTGATAGGAATGAGAAGACA | AGG | chr17 | 7110021 | 7110040 | 7110024 | - |
| SEQ ID NO 7608 | ATAGGAATGAGAAGACAAGG | AAG | chr17 | 7110018 | 7110037 | 7110021 | - |
| SEQ ID NO 7609 | TGAGAAGACAAGGAAGTCCA | CAG | chr17 | 7110011 | 7110030 | 7110014 | - |
| SEQ ID NO 7610 | AGAAGACAAGGAAGTCCACA | GAG | chr17 | 7110009 | 7110028 | 7110012 | - |
| SEQ ID NO 7611 | GACAAGGAAGTCCACAGAGT | CAG | chr17 | 7110005 | 7110024 | 7110008 | - |

Figure 25 (Cont'd)

| | | | | | | | |
|---|---|---|---|---|---|---|---|
| SEQ ID NO 7612 | ACAAGGAAGTCCACAGAGTC | AGG | chr17 | 7110004 | 7110023 | 7110007 | - |
| SEQ ID NO 7613 | CAAGGAAGTCCACAGAGTCA | GGG | chr17 | 7110003 | 7110022 | 7110006 | - |
| SEQ ID NO 7614 | AGTCCACAGAGTCAGGGTCC | AAG | chr17 | 7109997 | 7110016 | 7110000 | - |
| SEQ ID NO 7615 | GTCCACAGAGTCAGGGTCCA | AGG | chr17 | 7109996 | 7110015 | 7109999 | - |
| SEQ ID NO 7616 | CAGAGTCAGGGTCCAAGGCC | TAG | chr17 | 7109991 | 7110010 | 7109994 | - |
| SEQ ID NO 7617 | AGTCAGGGTCCAAGGCCTAG | AAG | chr17 | 7109988 | 7110007 | 7109991 | - |
| SEQ ID NO 7618 | GTCAGGGTCCAAGGCCTAGA | AGG | chr17 | 7109987 | 7110006 | 7109990 | - |
| SEQ ID NO 7619 | CCTAGAAGGTGTTCTGTTTG | CAG | chr17 | 7109973 | 7109992 | 7109976 | - |
| SEQ ID NO 7620 | CTAGAAGGTGTTCTGTTTGC | AGG | chr17 | 7109972 | 7109991 | 7109975 | - |
| SEQ ID NO 7621 | GAAGGTGTTCTGTTTGCAGG | TGG | chr17 | 7109969 | 7109988 | 7109972 | - |
| SEQ ID NO 7622 | GTTTGCAGGTGGATGCTGCA | AAG | chr17 | 7109958 | 7109977 | 7109961 | - |
| SEQ ID NO 7623 | TTGCAGGTGGATGCTGCAAA | GAG | chr17 | 7109956 | 7109975 | 7109959 | - |
| SEQ ID NO 7624 | GCAGGTGGATGCTGCAAAGA | GAG | chr17 | 7109954 | 7109973 | 7109957 | - |
| SEQ ID NO 7625 | CAGGTGGATGCTGCAAAGAG | AGG | chr17 | 7109953 | 7109972 | 7109956 | - |
| SEQ ID NO 7626 | GGTGGATGCTGCAAAGAGAG | GAG | chr17 | 7109951 | 7109970 | 7109954 | - |
| SEQ ID NO 7627 | ATGCTGCAAAGAGAGGAGCT | CAG | chr17 | 7109946 | 7109965 | 7109949 | - |
| SEQ ID NO 7628 | TGCTGCAAAGAGAGGAGCTC | AGG | chr17 | 7109945 | 7109964 | 7109948 | - |
| SEQ ID NO 7629 | GCTGCAAAGAGAGGAGCTCA | GGG | chr17 | 7109944 | 7109963 | 7109947 | - |
| SEQ ID NO 7630 | CAAAGAGAGGAGCTCAGGGC | TGG | chr17 | 7109940 | 7109959 | 7109943 | - |
| SEQ ID NO 7631 | AAAGAGAGGAGCTCAGGGCT | GGG | chr17 | 7109939 | 7109958 | 7109942 | - |
| SEQ ID NO 7632 | GAGCTCAGGGCTGGGACAAC | TGG | chr17 | 7109931 | 7109950 | 7109934 | - |
| SEQ ID NO 7633 | GCTCAGGGCTGGGACAACTG | GAG | chr17 | 7109929 | 7109948 | 7109932 | - |
| SEQ ID NO 7634 | TGGGACAACTGGAGCTGCTC | TGG | chr17 | 7109920 | 7109939 | 7109923 | - |
| SEQ ID NO 7635 | GGGACAACTGGAGCTGCTCT | GGG | chr17 | 7109919 | 7109938 | 7109922 | - |
| SEQ ID NO 7636 | AACTGGAGCTGCTCTGGGTC | TGG | chr17 | 7109914 | 7109933 | 7109917 | - |
| SEQ ID NO 7637 | CTGGAGCTGCTCTGGGTCTG | GAG | chr17 | 7109912 | 7109931 | 7109915 | - |
| SEQ ID NO 7638 | TGGAGCTGCTCTGGGTCTGG | AGG | chr17 | 7109911 | 7109930 | 7109914 | - |
| SEQ ID NO 7639 | AGCTGCTCTGGGTCTGGAGG | CAG | chr17 | 7109908 | 7109927 | 7109911 | - |
| SEQ ID NO 7640 | TGCTCTGGGTCTGGAGGCAG | CAG | chr17 | 7109905 | 7109924 | 7109908 | - |
| SEQ ID NO 7641 | CTCTGGGTCTGGAGGCAGCA | GAG | chr17 | 7109903 | 7109922 | 7109906 | - |
| SEQ ID NO 7642 | CTGGGTCTGGAGGCAGCAGA | GAG | chr17 | 7109901 | 7109920 | 7109904 | - |
| SEQ ID NO 7643 | TGGGTCTGGAGGCAGCAGAG | AGG | chr17 | 7109900 | 7109919 | 7109903 | - |
| SEQ ID NO 7644 | GGGTCTGGAGGCAGCAGAGA | GGG | chr17 | 7109899 | 7109918 | 7109902 | - |
| SEQ ID NO 7645 | GTCTGGAGGCAGCAGAGAGG | GAG | chr17 | 7109897 | 7109916 | 7109900 | - |
| SEQ ID NO 7646 | GAGGCAGCAGAGAGGGAGCC | CAG | chr17 | 7109892 | 7109911 | 7109895 | - |
| SEQ ID NO 7647 | AGGGAGCCCAGCTCTGTGTG | CAG | chr17 | 7109880 | 7109899 | 7109883 | - |
| SEQ ID NO 7648 | GGGAGCCCAGCTCTGTGTGC | AGG | chr17 | 7109879 | 7109898 | 7109882 | - |
| SEQ ID NO 7649 | AGCCCAGCTCTGTGTGCAGG | AAG | chr17 | 7109876 | 7109895 | 7109879 | - |
| SEQ ID NO 7650 | GCTCTGTGTGCAGGAAGACG | TGG | chr17 | 7109870 | 7109889 | 7109873 | - |
| SEQ ID NO 7651 | CTCTGTGTGCAGGAAGACGT | GGG | chr17 | 7109869 | 7109888 | 7109872 | - |
| SEQ ID NO 7652 | GCAGGAAGACGTGGGTGTGT | GAG | chr17 | 7109861 | 7109880 | 7109864 | - |
| SEQ ID NO 7653 | GGTGTGTGAGTGTACGTGTG | TGG | chr17 | 7109848 | 7109867 | 7109851 | - |
| SEQ ID NO 7654 | GTGTGTGAGTGTACGTGTGT | GGG | chr17 | 7109847 | 7109866 | 7109850 | - |
| SEQ ID NO 7655 | GTGTACGTGTGTGGGTGTGT | CAG | chr17 | 7109839 | 7109858 | 7109842 | - |
| SEQ ID NO 7656 | TGTACGTGTGTGGGTGTGTC | AGG | chr17 | 7109838 | 7109857 | 7109841 | - |
| SEQ ID NO 7657 | GTGTGTCAGGTGTGTGTGTG | TGG | chr17 | 7109825 | 7109844 | 7109828 | - |
| SEQ ID NO 7658 | TGTGTCAGGTGTGTGTGTGT | GGG | chr17 | 7109824 | 7109843 | 7109827 | - |

Figure 25 (Cont'd)

| | | | | | | | |
|---|---|---|---|---|---|---|---|
| SEQ ID NO 7659 | TGTCAGGTGTGTGTGTGTGG | GAG | chr17 | 7109822 | 7109841 | 7109825 | - |
| SEQ ID NO 7660 | GTCAGGTGTGTGTGTGTGGG | AGG | chr17 | 7109821 | 7109840 | 7109824 | - |
| SEQ ID NO 7661 | TCAGGTGTGTGTGTGTGGGA | GGG | chr17 | 7109820 | 7109839 | 7109823 | - |
| SEQ ID NO 7662 | AGGTGTGTGTGTGTGGGAGG | GAG | chr17 | 7109818 | 7109837 | 7109821 | - |
| SEQ ID NO 7663 | GGGAGTATGAATGTGTGCAT | TAG | chr17 | 7109800 | 7109819 | 7109803 | - |
| SEQ ID NO 7664 | TAGCATGCATATGCACATGT | GAG | chr17 | 7109780 | 7109799 | 7109783 | - |
| SEQ ID NO 7665 | GCATGCATATGCACATGTGA | GAG | chr17 | 7109778 | 7109797 | 7109781 | - |
| SEQ ID NO 7666 | TGCATATGCACATGTGAGAG | TGG | chr17 | 7109775 | 7109794 | 7109778 | - |
| SEQ ID NO 7667 | GCATATGCACATGTGAGAGT | GGG | chr17 | 7109774 | 7109793 | 7109777 | - |
| SEQ ID NO 7668 | TGCACATGTGAGAGTGGGTA | CAG | chr17 | 7109769 | 7109788 | 7109772 | - |
| SEQ ID NO 7669 | ACATGTGAGAGTGGGTACAG | CAG | chr17 | 7109766 | 7109785 | 7109769 | - |
| SEQ ID NO 7670 | ATGTGAGAGTGGGTACAGCA | GAG | chr17 | 7109764 | 7109783 | 7109767 | - |
| SEQ ID NO 7671 | AGAGTGGGTACAGCAGAGCG | TGG | chr17 | 7109759 | 7109778 | 7109762 | - |
| SEQ ID NO 7672 | GTACAGCAGAGCGTGGTCAT | GAG | chr17 | 7109752 | 7109771 | 7109755 | - |
| SEQ ID NO 7673 | GTGTGCAAATGTGTGTTTTT | GAG | chr17 | 7109728 | 7109747 | 7109731 | - |
| SEQ ID NO 7674 | CAAATGTGTGTTTTTGAGTG | AAG | chr17 | 7109723 | 7109742 | 7109726 | - |
| SEQ ID NO 7675 | TGTGTGTTTTTGAGTGAAGT | GAG | chr17 | 7109719 | 7109738 | 7109722 | - |
| SEQ ID NO 7676 | GAGTGAAGTGAGCAATGTGT | GAG | chr17 | 7109708 | 7109727 | 7109711 | - |
| SEQ ID NO 7677 | TGAGCAATGTGTGAGTGTGT | GAG | chr17 | 7109700 | 7109719 | 7109703 | - |
| SEQ ID NO 7678 | GTGAGTGTGTGAGTGTGTGT | GAG | chr17 | 7109690 | 7109709 | 7109693 | - |
| SEQ ID NO 7679 | GTGAGTGTGTGTGAGTTTGT | GAG | chr17 | 7109682 | 7109701 | 7109685 | - |
| SEQ ID NO 7680 | TGAGTGTGTGTGAGTTTGTG | AGG | chr17 | 7109681 | 7109700 | 7109684 | - |
| SEQ ID NO 7681 | GAGTGTGTGTGAGTTTGTGA | GGG | chr17 | 7109680 | 7109699 | 7109683 | - |
| SEQ ID NO 7682 | GGGCATGTGAATGTGTGTGT | CAG | chr17 | 7109660 | 7109679 | 7109663 | - |
| SEQ ID NO 7683 | AATGTGTGTGTCAGTGCTGT | CAG | chr17 | 7109651 | 7109670 | 7109654 | - |
| SEQ ID NO 7684 | ATGTGTGTGTCAGTGCTGTC | AGG | chr17 | 7109650 | 7109669 | 7109653 | - |
| SEQ ID NO 7685 | TGTGTGTGTCAGTGCTGTCA | GGG | chr17 | 7109649 | 7109668 | 7109652 | - |
| SEQ ID NO 7686 | GTGTCAGTGCTGTCAGGGTG | CAG | chr17 | 7109644 | 7109663 | 7109647 | - |
| SEQ ID NO 7687 | CAGTGCTGTCAGGGTGCAGA | TGG | chr17 | 7109640 | 7109659 | 7109643 | - |
| SEQ ID NO 7688 | TGTCAGGGTGCAGATGGATC | AAG | chr17 | 7109634 | 7109653 | 7109637 | - |
| SEQ ID NO 7689 | GTCAGGGTGCAGATGGATCA | AGG | chr17 | 7109633 | 7109652 | 7109636 | - |
| SEQ ID NO 7690 | TCAGGGTGCAGATGGATCAA | GGG | chr17 | 7109632 | 7109651 | 7109635 | - |
| SEQ ID NO 7691 | CAGGGTGCAGATGGATCAAG | GGG | chr17 | 7109631 | 7109650 | 7109634 | - |
| SEQ ID NO 7692 | GGTGCAGATGGATCAAGGGG | CAG | chr17 | 7109628 | 7109647 | 7109631 | - |
| SEQ ID NO 7693 | GTGCAGATGGATCAAGGGGC | AGG | chr17 | 7109627 | 7109646 | 7109630 | - |
| SEQ ID NO 7694 | GCAGATGGATCAAGGGGCAG | GAG | chr17 | 7109625 | 7109644 | 7109628 | - |
| SEQ ID NO 7695 | AGATGGATCAAGGGGCAGGA | GAG | chr17 | 7109623 | 7109642 | 7109626 | - |
| SEQ ID NO 7696 | GATGGATCAAGGGGCAGGAG | AGG | chr17 | 7109622 | 7109641 | 7109625 | - |
| SEQ ID NO 7697 | GGGGCAGGAGAGGTACCTGT | GAG | chr17 | 7109612 | 7109631 | 7109615 | - |
| SEQ ID NO 7698 | AGGTACCTGTGAGATGACCT | CGG | chr17 | 7109602 | 7109621 | 7109605 | - |
| SEQ ID NO 7699 | GGTACCTGTGAGATGACCTC | GGG | chr17 | 7109601 | 7109620 | 7109604 | - |
| SEQ ID NO 7700 | CTGTGAGATGACCTCGGGCT | GAG | chr17 | 7109596 | 7109615 | 7109599 | - |
| SEQ ID NO 7701 | TGTGAGATGACCTCGGGCTG | AGG | chr17 | 7109595 | 7109614 | 7109598 | - |
| SEQ ID NO 7702 | GTGAGATGACCTCGGGCTGA | GGG | chr17 | 7109594 | 7109613 | 7109597 | - |
| SEQ ID NO 7703 | TGAGATGACCTCGGGCTGAG | GGG | chr17 | 7109593 | 7109612 | 7109596 | - |
| SEQ ID NO 7704 | AGATGACCTCGGGCTGAGGG | GAG | chr17 | 7109591 | 7109610 | 7109594 | - |
| SEQ ID NO 7705 | CGGGCTGAGGGGAGCAAATT | TAG | chr17 | 7109582 | 7109601 | 7109585 | - |

Figure 25 (Cont'd)

| | | | | | | | |
|---|---|---|---|---|---|---|---|
| SEQ ID NO 7706 | TGAGGGGAGCAAATTTAGTG | TGG | chr17 | 7109577 | 7109596 | 7109580 | - |
| SEQ ID NO 7707 | GAGCAAATTTAGTGTGGAAC | GAG | chr17 | 7109571 | 7109590 | 7109574 | - |
| SEQ ID NO 7708 | AGCAAATTTAGTGTGGAACG | AGG | chr17 | 7109570 | 7109589 | 7109573 | - |
| SEQ ID NO 7709 | TTAGTGTGGAACGAGGTTTC | TAG | chr17 | 7109563 | 7109582 | 7109566 | - |
| SEQ ID NO 7710 | TAGTGTGGAACGAGGTTTCT | AGG | chr17 | 7109562 | 7109581 | 7109565 | - |
| SEQ ID NO 7711 | AGTGTGGAACGAGGTTTCTA | GGG | chr17 | 7109561 | 7109580 | 7109564 | - |
| SEQ ID NO 7712 | GTGGAACGAGGTTTCTAGGG | AAG | chr17 | 7109558 | 7109577 | 7109561 | - |
| SEQ ID NO 7713 | AACGAGGTTTCTAGGGAAGC | GAG | chr17 | 7109554 | 7109573 | 7109557 | - |
| SEQ ID NO 7714 | ACGAGGTTTCTAGGGAAGCG | AGG | chr17 | 7109553 | 7109572 | 7109556 | - |
| SEQ ID NO 7715 | CGAGGTTTCTAGGGAAGCGA | GGG | chr17 | 7109552 | 7109571 | 7109555 | - |
| SEQ ID NO 7716 | TTTCTAGGGAAGCGAGGGCA | AAG | chr17 | 7109547 | 7109566 | 7109550 | - |
| SEQ ID NO 7717 | TTCTAGGGAAGCGAGGGCAA | AGG | chr17 | 7109546 | 7109565 | 7109549 | - |
| SEQ ID NO 7718 | TCTAGGGAAGCGAGGGCAAA | GGG | chr17 | 7109545 | 7109564 | 7109548 | - |
| SEQ ID NO 7719 | GAAGCGAGGGCAAAGGGCGC | TGG | chr17 | 7109539 | 7109558 | 7109542 | - |
| SEQ ID NO 7720 | AAGCGAGGGCAAAGGGCGCT | GGG | chr17 | 7109538 | 7109557 | 7109541 | - |
| SEQ ID NO 7721 | AGCGAGGGCAAAGGGCGCTG | GGG | chr17 | 7109537 | 7109556 | 7109540 | - |
| SEQ ID NO 7722 | CGAGGGCAAAGGGCGCTGGG | GAG | chr17 | 7109535 | 7109554 | 7109538 | - |
| SEQ ID NO 7723 | GAGGGCAAAGGGCGCTGGGG | AGG | chr17 | 7109534 | 7109553 | 7109537 | - |
| SEQ ID NO 7724 | GGGCAAAGGGCGCTGGGGAG | GAG | chr17 | 7109532 | 7109551 | 7109535 | - |
| SEQ ID NO 7725 | GGCAAAGGGCGCTGGGGAGG | AGG | chr17 | 7109531 | 7109550 | 7109534 | - |
| SEQ ID NO 7726 | GCTGGGGAGGAGGCCTTGCG | TGG | chr17 | 7109521 | 7109540 | 7109524 | - |
| SEQ ID NO 7727 | GGGGAGGAGGCCTTGCGTGG | TGG | chr17 | 7109518 | 7109537 | 7109521 | - |
| SEQ ID NO 7728 | GGGAGGAGGCCTTGCGTGGT | GGG | chr17 | 7109517 | 7109536 | 7109520 | - |
| SEQ ID NO 7729 | GGAGGAGGCCTTGCGTGGTG | GGG | chr17 | 7109516 | 7109535 | 7109519 | - |
| SEQ ID NO 7730 | GAGGAGGCCTTGCGTGGTGG | GGG | chr17 | 7109515 | 7109534 | 7109518 | - |
| SEQ ID NO 7731 | GGCCTTGCGTGGTGGGGAT | GAG | chr17 | 7109510 | 7109529 | 7109513 | - |
| SEQ ID NO 7732 | GCCTTGCGTGGTGGGGATG | AGG | chr17 | 7109509 | 7109528 | 7109512 | - |
| SEQ ID NO 7733 | GTGGTGGGGATGAGGACAA | CAG | chr17 | 7109502 | 7109521 | 7109505 | - |
| SEQ ID NO 7734 | TGGTGGGGATGAGGACAAC | AGG | chr17 | 7109501 | 7109520 | 7109504 | - |
| SEQ ID NO 7735 | TGGGGGATGAGGACAACAGG | TGG | chr17 | 7109498 | 7109517 | 7109501 | - |
| SEQ ID NO 7736 | GGGGGATGAGGACAACAGGT | GGG | chr17 | 7109497 | 7109516 | 7109500 | - |
| SEQ ID NO 7737 | TGAGGACAACAGGTGGGACC | TGG | chr17 | 7109491 | 7109510 | 7109494 | - |
| SEQ ID NO 7738 | AGGACAACAGGTGGGACCTG | GAG | chr17 | 7109489 | 7109508 | 7109492 | - |
| SEQ ID NO 7739 | GGACAACAGGTGGGACCTGG | AGG | chr17 | 7109488 | 7109507 | 7109491 | - |
| SEQ ID NO 7740 | GACAACAGGTGGGACCTGGA | GGG | chr17 | 7109487 | 7109506 | 7109490 | - |
| SEQ ID NO 7741 | GGGACCTGGAGGGTTGTGCT | TGG | chr17 | 7109477 | 7109496 | 7109480 | - |
| SEQ ID NO 7742 | GACCTGGAGGGTTGTGCTTG | GAG | chr17 | 7109475 | 7109494 | 7109478 | - |
| SEQ ID NO 7743 | CCTGGAGGGTTGTGCTTGGA | GAG | chr17 | 7109473 | 7109492 | 7109476 | - |
| SEQ ID NO 7744 | GGAGGGTTGTGCTTGGAGAG | TGG | chr17 | 7109470 | 7109489 | 7109473 | - |
| SEQ ID NO 7745 | GAGGGTTGTGCTTGGAGAGT | GGG | chr17 | 7109469 | 7109488 | 7109472 | - |
| SEQ ID NO 7746 | TGTGCTTGGAGAGTGGGCTA | TGG | chr17 | 7109463 | 7109482 | 7109466 | - |
| SEQ ID NO 7747 | GCTTGGAGAGTGGGCTATGG | TGG | chr17 | 7109460 | 7109479 | 7109463 | - |
| SEQ ID NO 7748 | TGGGCTATGGTGGAATGACC | CAG | chr17 | 7109450 | 7109469 | 7109453 | - |
| SEQ ID NO 7749 | TGGTGGAATGACCCAGATTT | AAG | chr17 | 7109443 | 7109462 | 7109446 | - |
| SEQ ID NO 7750 | GGTGGAATGACCCAGATTTA | AGG | chr17 | 7109442 | 7109461 | 7109445 | - |
| SEQ ID NO 7751 | CCCAGATTTAAGGATCTCAA | TGG | chr17 | 7109432 | 7109451 | 7109435 | - |
| SEQ ID NO 7752 | TAAGGATCTCAATGGAATTT | TGG | chr17 | 7109424 | 7109443 | 7109427 | - |

Figure 25 (Cont'd)

| SEQ ID NO 7753 | GGATCTCAATGGAATTTTGG | CAG | chr17 | 7109421 | 7109440 | 7109424 | - |
| --- | --- | --- | --- | --- | --- | --- | --- |
| SEQ ID NO 7754 | GATCTCAATGGAATTTTGGC | AGG | chr17 | 7109420 | 7109439 | 7109423 | - |
| SEQ ID NO 7755 | ATCTCAATGGAATTTTGGCA | GGG | chr17 | 7109419 | 7109438 | 7109422 | - |
| SEQ ID NO 7756 | TCTCAATGGAATTTTGGCAG | GGG | chr17 | 7109418 | 7109437 | 7109421 | - |
| SEQ ID NO 7757 | TCAATGGAATTTTGGCAGGG | GAG | chr17 | 7109416 | 7109435 | 7109419 | - |
| SEQ ID NO 7758 | CAATGGAATTTTGGCAGGGG | AGG | chr17 | 7109415 | 7109434 | 7109418 | - |
| SEQ ID NO 7759 | AATGGAATTTTGGCAGGGGA | GGG | chr17 | 7109414 | 7109433 | 7109417 | - |
| SEQ ID NO 7760 | TGGCAGGGGAGGGACTGTTC | CAG | chr17 | 7109404 | 7109423 | 7109407 | - |
| SEQ ID NO 7761 | GGGGAGGGACTGTTCCAGTA | TGG | chr17 | 7109399 | 7109418 | 7109402 | - |
| SEQ ID NO 7762 | GACTGTTCCAGTATGGATTT | TAG | chr17 | 7109392 | 7109411 | 7109395 | - |
| SEQ ID NO 7763 | ACTGTTCCAGTATGGATTTT | AGG | chr17 | 7109391 | 7109410 | 7109394 | - |
| SEQ ID NO 7764 | GTTCCAGTATGGATTTTAGG | AAG | chr17 | 7109388 | 7109407 | 7109391 | - |
| SEQ ID NO 7765 | TATGGATTTTAGGAAGAACA | CAG | chr17 | 7109381 | 7109400 | 7109384 | - |
| SEQ ID NO 7766 | ATGGATTTTAGGAAGAACAC | AGG | chr17 | 7109380 | 7109399 | 7109383 | - |
| SEQ ID NO 7767 | TGGATTTTAGGAAGAACACA | GGG | chr17 | 7109379 | 7109398 | 7109382 | - |
| SEQ ID NO 7768 | TTTAGGAAGAACACAGGGCC | CAG | chr17 | 7109374 | 7109393 | 7109377 | - |
| SEQ ID NO 7769 | AGAACACAGGGCCCAGCTTC | TGG | chr17 | 7109367 | 7109386 | 7109370 | - |
| SEQ ID NO 7770 | AACACAGGGCCCAGCTTCTG | GAG | chr17 | 7109365 | 7109384 | 7109368 | - |
| SEQ ID NO 7771 | GCTTCTGGAGTCTCCAATCT | GAG | chr17 | 7109352 | 7109371 | 7109355 | - |
| SEQ ID NO 7772 | CTTCTGGAGTCTCCAATCTG | AGG | chr17 | 7109351 | 7109370 | 7109354 | - |
| SEQ ID NO 7773 | TTCTGGAGTCTCCAATCTGA | GGG | chr17 | 7109350 | 7109369 | 7109353 | - |
| SEQ ID NO 7774 | TCTGGAGTCTCCAATCTGAG | GGG | chr17 | 7109349 | 7109368 | 7109352 | - |
| SEQ ID NO 7775 | GAGTCTCCAATCTGAGGGGA | CAG | chr17 | 7109345 | 7109364 | 7109348 | - |
| SEQ ID NO 7776 | AGTCTCCAATCTGAGGGGAC | AGG | chr17 | 7109344 | 7109363 | 7109347 | - |
| SEQ ID NO 7777 | TCTCCAATCTGAGGGGACAG | GAG | chr17 | 7109342 | 7109361 | 7109345 | - |
| SEQ ID NO 7778 | ATCTGAGGGGACAGGAGCCT | TAG | chr17 | 7109336 | 7109355 | 7109339 | - |
| SEQ ID NO 7779 | TGAGGGGACAGGAGCCTTAG | AAG | chr17 | 7109333 | 7109352 | 7109336 | - |
| SEQ ID NO 7780 | AGGGGACAGGAGCCTTAGAA | GAG | chr17 | 7109331 | 7109350 | 7109334 | - |
| SEQ ID NO 7781 | ACAGGAGCCTTAGAAGAGCT | GAG | chr17 | 7109326 | 7109345 | 7109329 | - |
| SEQ ID NO 7782 | GCCTTAGAAGAGCTGAGACT | AAG | chr17 | 7109320 | 7109339 | 7109323 | - |
| SEQ ID NO 7783 | CCTTAGAAGAGCTGAGACTA | AGG | chr17 | 7109319 | 7109338 | 7109322 | - |
| SEQ ID NO 7784 | AAGAGCTGAGACTAAGGCCC | GAG | chr17 | 7109313 | 7109332 | 7109316 | - |
| SEQ ID NO 7785 | AGAGCTGAGACTAAGGCCCG | AGG | chr17 | 7109312 | 7109331 | 7109315 | - |
| SEQ ID NO 7786 | GACTAAGGCCCGAGGTGATC | TGG | chr17 | 7109304 | 7109323 | 7109307 | - |
| SEQ ID NO 7787 | CTAAGGCCCGAGGTGATCTG | GAG | chr17 | 7109302 | 7109321 | 7109305 | - |
| SEQ ID NO 7788 | TAAGGCCCGAGGTGATCTGG | AGG | chr17 | 7109301 | 7109320 | 7109304 | - |
| SEQ ID NO 7789 | GATCTGGAGGCCTCTGCCAC | TGG | chr17 | 7109288 | 7109307 | 7109291 | - |
| SEQ ID NO 7790 | TGGAGGCCTCTGCCACTGGC | TGG | chr17 | 7109284 | 7109303 | 7109287 | - |
| SEQ ID NO 7791 | GGCCTCTGCCACTGGCTGGA | TGG | chr17 | 7109280 | 7109299 | 7109283 | - |
| SEQ ID NO 7792 | GCCTCTGCCACTGGCTGGAT | GGG | chr17 | 7109279 | 7109298 | 7109282 | - |
| SEQ ID NO 7793 | CTCTGCCACTGGCTGGATGG | GAG | chr17 | 7109277 | 7109296 | 7109280 | - |
| SEQ ID NO 7794 | TCTGCCACTGGCTGGATGGG | AGG | chr17 | 7109276 | 7109295 | 7109279 | - |
| SEQ ID NO 7795 | GATGGGAGGAAAACCATTCA | CAG | chr17 | 7109262 | 7109281 | 7109265 | - |
| SEQ ID NO 7796 | CATTCACAGATCCCCTTCT | CAG | chr17 | 7109248 | 7109267 | 7109251 | - |
| SEQ ID NO 7797 | ATTCACAGATCCCCTTCTC | AGG | chr17 | 7109247 | 7109266 | 7109250 | - |
| SEQ ID NO 7798 | CCCTTCTCAGGATGTGTGCC | TAG | chr17 | 7109235 | 7109254 | 7109238 | - |
| SEQ ID NO 7799 | CCTTCTCAGGATGTGTGCCT | AGG | chr17 | 7109234 | 7109253 | 7109237 | - |

Figure 25 (Cont'd)

| | | | | | | | |
|---|---|---|---|---|---|---|---|
| SEQ ID NO 7800 | TCTCAGGATGTGTGCCTAGG | CAG | chr17 | 7109231 | 7109250 | 7109234 | - |
| SEQ ID NO 7801 | CTCAGGATGTGTGCCTAGGC | AGG | chr17 | 7109230 | 7109249 | 7109233 | - |
| SEQ ID NO 7802 | TCAGGATGTGTGCCTAGGCA | GGG | chr17 | 7109229 | 7109248 | 7109232 | - |
| SEQ ID NO 7803 | GATGTGTGCCTAGGCAGGGC | CGG | chr17 | 7109225 | 7109244 | 7109228 | - |
| SEQ ID NO 7804 | ATGTGTGCCTAGGCAGGGCC | GGG | chr17 | 7109224 | 7109243 | 7109227 | - |
| SEQ ID NO 7805 | CCCGCCCCTGTGCGTCTCC | CAG | chr17 | 7109193 | 7109212 | 7109196 | - |
| SEQ ID NO 7806 | CTGTGCGTCTCCCAGTCCCC | CAG | chr17 | 7109185 | 7109204 | 7109188 | - |
| SEQ ID NO 7807 | GTCTCCCAGTCCCCAGCTC | CAG | chr17 | 7109179 | 7109198 | 7109182 | - |
| SEQ ID NO 7808 | TCTCCCAGTCCCCAGCTCC | AGG | chr17 | 7109178 | 7109197 | 7109181 | - |
| SEQ ID NO 7809 | AGTCCCCAGCTCCAGGATC | CGG | chr17 | 7109172 | 7109191 | 7109175 | - |
| SEQ ID NO 7810 | GTCCCCAGCTCCAGGATCC | GGG | chr17 | 7109171 | 7109190 | 7109174 | - |
| SEQ ID NO 7811 | CAGGATCCGGGCTTTGCACA | CAG | chr17 | 7109159 | 7109178 | 7109162 | - |
| SEQ ID NO 7812 | ACAGCTGATGTGAATATCCT | GAG | chr17 | 7109140 | 7109159 | 7109143 | - |
| SEQ ID NO 7813 | AATATCCTGAGTCGTGTGCA | TGG | chr17 | 7109128 | 7109147 | 7109131 | - |
| SEQ ID NO 7814 | ATATCCTGAGTCGTGTGCAT | GGG | chr17 | 7109127 | 7109146 | 7109130 | - |
| SEQ ID NO 7815 | GTGCATGGGTGTGTGTGCAC | CAG | chr17 | 7109113 | 7109132 | 7109116 | - |
| SEQ ID NO 7816 | TGGGTGTGTGTGCACCAGAT | TAG | chr17 | 7109108 | 7109127 | 7109111 | - |
| SEQ ID NO 7817 | TGCGTGTGTATATTTATACA | TGG | chr17 | 7109084 | 7109103 | 7109087 | - |
| SEQ ID NO 7818 | TATATTTATACATGGTAATA | TGG | chr17 | 7109076 | 7109095 | 7109079 | - |
| SEQ ID NO 7819 | ATATTTATACATGGTAATAT | GGG | chr17 | 7109075 | 7109094 | 7109078 | - |
| SEQ ID NO 7820 | ATACATGGTAATATGGGTGC | GAG | chr17 | 7109069 | 7109088 | 7109072 | - |
| SEQ ID NO 7821 | TAATATGGGTGCGAGTGTGT | AAG | chr17 | 7109061 | 7109080 | 7109064 | - |
| SEQ ID NO 7822 | ATATGGGTGCGAGTGTGTAA | GAG | chr17 | 7109059 | 7109078 | 7109062 | - |
| SEQ ID NO 7823 | TGTGTGTAATGCTCAAATGC | TGG | chr17 | 7109034 | 7109053 | 7109037 | - |
| SEQ ID NO 7824 | GTGTGTAATGCTCAAATGCT | GGG | chr17 | 7109033 | 7109052 | 7109036 | - |
| SEQ ID NO 7825 | TGTGTAATGCTCAAATGCTG | GGG | chr17 | 7109032 | 7109051 | 7109035 | - |
| SEQ ID NO 7826 | ATGCTCAAATGCTGGGGTCA | AAG | chr17 | 7109026 | 7109045 | 7109029 | - |
| SEQ ID NO 7827 | CCTATGATGACCCCCCCCA | TGG | chr17 | 7109003 | 7109022 | 7109006 | - |
| SEQ ID NO 7828 | CCCCAACCAATCCCCCCGCC | CAG | chr17 | 7108980 | 7108999 | 7108983 | - |
| SEQ ID NO 7829 | CCCAACCAATCCCCCCGCCC | AGG | chr17 | 7108979 | 7108998 | 7108982 | - |
| SEQ ID NO 7830 | CCGCCCAGGTTATGCCTCCT | CAG | chr17 | 7108965 | 7108984 | 7108968 | - |
| SEQ ID NO 7831 | CGCCCAGGTTATGCCTCCTC | AGG | chr17 | 7108964 | 7108983 | 7108967 | - |
| SEQ ID NO 7832 | GGTTATGCCTCCTCAGGCTT | CGG | chr17 | 7108958 | 7108977 | 7108961 | - |
| SEQ ID NO 7833 | GGTGCCCTGTCTTTACCCTC | CGG | chr17 | 7108937 | 7108956 | 7108940 | - |
| SEQ ID NO 7834 | ACCCTCCGGCTCCCCACACC | CAG | chr17 | 7108923 | 7108942 | 7108926 | - |
| SEQ ID NO 7835 | CCCTCCGGCTCCCCACACCC | AGG | chr17 | 7108922 | 7108941 | 7108925 | - |
| SEQ ID NO 7836 | GCTCCCCACACCCAGGCTGC | CGG | chr17 | 7108915 | 7108934 | 7108918 | - |
| SEQ ID NO 7837 | CTCCTGATGCCCCTCTCCCA | CAG | chr17 | 7108892 | 7108911 | 7108895 | - |
| SEQ ID NO 7838 | TCCTGATGCCCCTCTCCCAC | AGG | chr17 | 7108891 | 7108910 | 7108894 | - |
| SEQ ID NO 7839 | CCTGATGCCCCTCTCCCACA | GGG | chr17 | 7108890 | 7108909 | 7108893 | - |
| SEQ ID NO 7840 | CCACAGGGCCACCTCCTGCC | CAG | chr17 | 7108875 | 7108894 | 7108878 | - |
| SEQ ID NO 7841 | GCCACCTCCTGCCCAGCCCC | TGG | chr17 | 7108868 | 7108887 | 7108871 | - |
| SEQ ID NO 7842 | CTCCTGCCCAGCCCCTGGCA | CAG | chr17 | 7108863 | 7108882 | 7108866 | - |
| SEQ ID NO 7843 | GGCACAGCGTCTCTGCTCCA | TGG | chr17 | 7108847 | 7108866 | 7108850 | - |
| SEQ ID NO 7844 | CTCTGCTCCATGGTCTGCTT | CAG | chr17 | 7108837 | 7108856 | 7108840 | - |
| SEQ ID NO 7845 | TGCTTCAGTCTGCTTGCCCT | GAG | chr17 | 7108822 | 7108841 | 7108825 | - |
| SEQ ID NO 7846 | GAGCTTCAACATCCTGCTGC | TGG | chr17 | 7108802 | 7108821 | 7108805 | - |

Figure 25 (Cont'd)

| | | | | | | | |
|---|---|---|---|---|---|---|---|
| SEQ ID NO 7847 | CTTCAACATCCTGCTGCTGG | TGG | chr17 | 7108799 | 7108818 | 7108802 | - |
| SEQ ID NO 7848 | CTGGTGGTCATCTGTGTGAC | TGG | chr17 | 7108783 | 7108802 | 7108786 | - |
| SEQ ID NO 7849 | TGGTGGTCATCTGTGTGACT | GGG | chr17 | 7108782 | 7108801 | 7108785 | - |
| SEQ ID NO 7850 | ATCTGTGTGACTGGGTCCCA | AAG | chr17 | 7108774 | 7108793 | 7108777 | - |
| SEQ ID NO 7851 | GTGTGACTGGGTCCCAAAGT | GAG | chr17 | 7108770 | 7108789 | 7108773 | - |
| SEQ ID NO 7852 | TGTGACTGGGTCCCAAAGTG | AGG | chr17 | 7108769 | 7108788 | 7108772 | - |
| SEQ ID NO 7853 | GTGACTGGGTCCCAAAGTGA | GGG | chr17 | 7108768 | 7108787 | 7108771 | - |
| SEQ ID NO 7854 | GGGTCCCAAAGTGAGGGTCA | CGG | chr17 | 7108762 | 7108781 | 7108765 | - |
| SEQ ID NO 7855 | GGTCCCAAAGTGAGGGTCAC | GGG | chr17 | 7108761 | 7108780 | 7108764 | - |
| SEQ ID NO 7856 | GTCCCAAAGTGAGGGTCACG | GGG | chr17 | 7108760 | 7108779 | 7108763 | - |
| SEQ ID NO 7857 | TCCCAAAGTGAGGGTCACGG | GGG | chr17 | 7108759 | 7108778 | 7108762 | - |
| SEQ ID NO 7858 | AAAGTGAGGGTCACGGGGGC | CAG | chr17 | 7108755 | 7108774 | 7108758 | - |
| SEQ ID NO 7859 | GTGAGGGTCACGGGGGCCAG | CAG | chr17 | 7108752 | 7108771 | 7108755 | - |
| SEQ ID NO 7860 | TGAGGGTCACGGGGGCCAGC | AGG | chr17 | 7108751 | 7108770 | 7108754 | - |
| SEQ ID NO 7861 | GAGGGTCACGGGGGCCAGCA | GGG | chr17 | 7108750 | 7108769 | 7108753 | - |
| SEQ ID NO 7862 | GTCACGGGGGCCAGCAGGGA | TGG | chr17 | 7108746 | 7108765 | 7108749 | - |
| SEQ ID NO 7863 | TCACGGGGGCCAGCAGGGAT | GGG | chr17 | 7108745 | 7108764 | 7108748 | - |
| SEQ ID NO 7864 | GGGGGCCAGCAGGGATGGGC | AAG | chr17 | 7108741 | 7108760 | 7108744 | - |
| SEQ ID NO 7865 | GGGGCCAGCAGGGATGGGCA | AGG | chr17 | 7108740 | 7108759 | 7108743 | - |
| SEQ ID NO 7866 | GGGCCAGCAGGGATGGGCAA | GGG | chr17 | 7108739 | 7108758 | 7108742 | - |
| SEQ ID NO 7867 | GGCCAGCAGGGATGGGCAAG | GGG | chr17 | 7108738 | 7108757 | 7108741 | - |
| SEQ ID NO 7868 | CAGCAGGGATGGGCAAGGGG | TAG | chr17 | 7108735 | 7108754 | 7108738 | - |
| SEQ ID NO 7869 | AGCAGGGATGGGCAAGGGGT | AGG | chr17 | 7108734 | 7108753 | 7108737 | - |
| SEQ ID NO 7870 | GCAGGGATGGGCAAGGGGTA | GGG | chr17 | 7108733 | 7108752 | 7108736 | - |
| SEQ ID NO 7871 | GGATGGGCAAGGGGTAGGGA | AAG | chr17 | 7108729 | 7108748 | 7108732 | - |
| SEQ ID NO 7872 | ATGGGCAAGGGGTAGGGAAA | GAG | chr17 | 7108727 | 7108746 | 7108730 | - |
| SEQ ID NO 7873 | AAGGGGTAGGGAAAGAGACA | TGG | chr17 | 7108721 | 7108740 | 7108724 | - |
| SEQ ID NO 7874 | AGGGGTAGGGAAAGAGACAT | GGG | chr17 | 7108720 | 7108739 | 7108723 | - |
| SEQ ID NO 7875 | GGTAGGGAAAGAGACATGGG | CAG | chr17 | 7108717 | 7108736 | 7108720 | - |
| SEQ ID NO 7876 | AGGGAAAGAGACATGGGCAG | TGG | chr17 | 7108714 | 7108733 | 7108717 | - |

Figure 26

| # | Sequence | PAM | chr17 | Start | End | Cuts 5' of | Str |
|---|---|---|---|---|---|---|---|
| SEQ ID NO 7877 | ACACAGATGACCACCAGCAG | CAGGAT | chr17 | 7108786 | 7108805 | 7108802 | + |
| SEQ ID NO 7878 | GGGCATCAGGAGCCGGCAGC | CTGGGT | chr17 | 7108900 | 7108919 | 7108916 | + |
| SEQ ID NO 7879 | AGCCTGGGTGTGGGGAGCCG | GAGGGT | chr17 | 7108917 | 7108936 | 7108933 | + |
| SEQ ID NO 7880 | AGGAGGCATAACCTGGGCGG | GGGGAT | chr17 | 7108965 | 7108984 | 7108981 | + |
| SEQ ID NO 7881 | GATTGGTTGGGGCCATGGGG | GGGGGT | chr17 | 7108988 | 7109007 | 7109004 | + |
| SEQ ID NO 7882 | ACACACCCATGCACACGACT | CAGGAT | chr17 | 7109119 | 7109138 | 7109135 | + |
| SEQ ID NO 7883 | ACATCAGCTGTGTGCAAAGC | CCGGAT | chr17 | 7109149 | 7109168 | 7109165 | + |
| SEQ ID NO 7884 | TAGGCACACATCCTGAGAAG | GGGGAT | chr17 | 7109233 | 7109252 | 7109249 | + |
| SEQ ID NO 7885 | CATCCTGAGAAGGGGGATCT | GTGAAT | chr17 | 7109241 | 7109260 | 7109257 | + |
| SEQ ID NO 7886 | TTCCATTGAGATCCTTAAAT | CTGGGT | chr17 | 7109427 | 7109446 | 7109443 | + |
| SEQ ID NO 7887 | GGGAGGCTCAGTCAGGGGCC | CAGAAT | chr17 | 7110068 | 7110087 | 7110084 | + |
| SEQ ID NO 7888 | GGTCACTTCCTGCCACTGTC | CTGAGT | chr17 | 7110105 | 7110124 | 7110121 | + |
| SEQ ID NO 7889 | ACCAAGCTGGCCCTCCATGG | CTGAGT | chr17 | 7110372 | 7110391 | 7110388 | + |
| SEQ ID NO 7890 | TCTTCAGCACCCTCCACTCA | GAGGGT | chr17 | 7110410 | 7110429 | 7110426 | + |
| SEQ ID NO 7891 | CGACTTATCAACTCCCAATG | CTGGGT | chr17 | 7110455 | 7110474 | 7110471 | + |
| SEQ ID NO 7892 | CCCTGAAACCAGACTGCCCA | CAGGGT | chr17 | 7110508 | 7110527 | 7110524 | + |
| SEQ ID NO 7893 | TCACAGTCGTAGCTACCCGA | TTGGAT | chr17 | 7110622 | 7110641 | 7110638 | + |
| SEQ ID NO 7894 | TAGCTACCCGATTGGATTGC | TCGGAT | chr17 | 7110631 | 7110650 | 7110647 | + |
| SEQ ID NO 7895 | TGGATTGCTCGGATAATTAG | ATGAGT | chr17 | 7110643 | 7110662 | 7110659 | + |
| SEQ ID NO 7896 | AAAAGTTTGAACATAAAAGA | CAGGGT | chr17 | 7110695 | 7110714 | 7110711 | + |
| SEQ ID NO 7897 | CAGGGTCTGCCCAAGATGGG | AAGAGT | chr17 | 7110715 | 7110734 | 7110731 | + |
| SEQ ID NO 7898 | ACTCTGGACATCAGGCAAGG | AGGAGT | chr17 | 7110804 | 7110823 | 7110820 | + |
| SEQ ID NO 7899 | AGGAGGAGTAAAGATCCCTG | AGGGAT | chr17 | 7110821 | 7110840 | 7110837 | + |
| SEQ ID NO 7900 | ACCCAGCTTACTGTTTGGA | GAGAGT | chr17 | 7110876 | 7110895 | 7110892 | + |
| SEQ ID NO 7901 | CACGTTGAGGAGATGGAGCT | GAGAGT | chr17 | 7110955 | 7110974 | 7110971 | + |
| SEQ ID NO 7902 | CCGAGGAGACCAAAACAATT | AAGAGT | chr17 | 7110981 | 7111000 | 7110997 | + |
| SEQ ID NO 7903 | CAAAGCTCAAGAACATTTAG | AGGAAT | chr17 | 7111052 | 7111071 | 7111068 | + |
| SEQ ID NO 7904 | AAAAGAGATCCAGAACTGAC | ACGGAT | chr17 | 7111197 | 7111216 | 7111213 | + |
| SEQ ID NO 7905 | TCCAGAACTGACACGGATGC | TAGAAT | chr17 | 7111205 | 7111224 | 7111221 | + |
| SEQ ID NO 7906 | GGATGCTAGAATTAGCAGGC | AAGGAT | chr17 | 7111219 | 7111238 | 7111235 | + |
| SEQ ID NO 7907 | ATTATGTTCAAAAAATTAAG | TAGAAT | chr17 | 7111273 | 7111292 | 7111289 | + |
| SEQ ID NO 7908 | AAAAATTAAGTAGAATTGTG | GAGGAT | chr17 | 7111283 | 7111302 | 7111299 | + |
| SEQ ID NO 7909 | TAGAATTGTGGAGGATATTT | AAGAGT | chr17 | 7111293 | 7111312 | 7111309 | + |
| SEQ ID NO 7910 | CAGGCGCCGTGGCTCACGCC | TGGAAT | chr17 | 7111378 | 7111397 | 7111394 | + |
| SEQ ID NO 7911 | TACTCGGGAGGCTGAGGCAG | GAGAAT | chr17 | 7111544 | 7111563 | 7111560 | + |
| SEQ ID NO 7912 | GAAAGAAAAGAAAAAACACA | CTGGAT | chr17 | 7111676 | 7111695 | 7111692 | + |
| SEQ ID NO 7913 | AAAATTTAGGGCCAGGCACT | GTGGAT | chr17 | 7111733 | 7111752 | 7111749 | + |
| SEQ ID NO 7914 | CTTTGGGAGGTCGACACGGG | GGGAAT | chr17 | 7111778 | 7111797 | 7111794 | + |
| SEQ ID NO 7915 | TACCTGGGAGGCTGAAGTGG | AAGGAT | chr17 | 7111931 | 7111950 | 7111947 | + |
| SEQ ID NO 7916 | CCCAGGAGGTGGAGGCCACA | GTGAGT | chr17 | 7111965 | 7111984 | 7111981 | + |
| SEQ ID NO 7917 | CTGCATTCCAGCCTGGGCAA | CAGAGT | chr17 | 7112003 | 7112022 | 7112019 | + |
| SEQ ID NO 7918 | AATGAAACACTGGGAGAAAA | AAGAAT | chr17 | 7112140 | 7112159 | 7112156 | + |
| SEQ ID NO 7919 | AAAGAATTAAAAAATGGAAA | GAGAAT | chr17 | 7112159 | 7112178 | 7112175 | + |
| SEQ ID NO 7920 | AATTAAAAAATGGAAAGAGA | ATGAGT | chr17 | 7112163 | 7112182 | 7112179 | + |
| SEQ ID NO 7921 | TGAAATCTTTAAAAGAAAAA | GGGGGT | chr17 | 7112219 | 7112238 | 7112235 | + |
| SEQ ID NO 7922 | AGCAGCATCCCGTATTCTCT | CTGAGT | chr17 | 7112515 | 7112534 | 7112531 | + |
| SEQ ID NO 7923 | CTCTGAGTGTTCACTATGTA | CCGGGT | chr17 | 7112533 | 7112552 | 7112549 | + |
| SEQ ID NO 7924 | ACCGGGTGCCGTGTGGGCAC | TGGAGT | chr17 | 7112552 | 7112571 | 7112568 | + |

Figure 26 (Cont'd)

| SEQ ID NO 7925 | TGGGCACTGGAGTTGCAGAG | GAGAGT | chr17 | 7112565 | 7112584 | 7112581 | + |
| --- | --- | --- | --- | --- | --- | --- | --- |
| SEQ ID NO 7926 | AGGAGATGCTACTGGTGTTC | CTGAGT | chr17 | 7112660 | 7112679 | 7112676 | + |
| SEQ ID NO 7927 | TCCCTCGGTTGGCCAGCCTC | AGGAAT | chr17 | 7112748 | 7112767 | 7112764 | + |
| SEQ ID NO 7928 | GTTGGCCAGCCTCAGGAATG | AGGAGT | chr17 | 7112755 | 7112774 | 7112771 | + |
| SEQ ID NO 7929 | TACTTGGGAGGCTGAGGTGG | GAGGAT | chr17 | 7113047 | 7113066 | 7113063 | + |
| SEQ ID NO 7930 | TGGGAGGATGGCTTGAGCCC | AGGAGT | chr17 | 7113064 | 7113083 | 7113080 | + |
| SEQ ID NO 7931 | TCAGTCAAGATTTATTACAG | AAGGAT | chr17 | 7113167 | 7113186 | 7113183 | + |
| SEQ ID NO 7932 | TATTACAGAAGGATCCAGGG | AAGGGT | chr17 | 7113179 | 7113198 | 7113195 | + |
| SEQ ID NO 7933 | TCTTGGGAGATGAGAGGAGC | AGGGAT | chr17 | 7113204 | 7113223 | 7113220 | + |
| SEQ ID NO 7934 | TGAGAGGAGCAGGGATCTTC | CAGGAT | chr17 | 7113214 | 7113233 | 7113230 | + |
| SEQ ID NO 7935 | CATTCACTCACACACACACA | CAGAGT | chr17 | 7113793 | 7113812 | 7113809 | + |
| SEQ ID NO 7936 | ACACACACACAGAGTCCCAG | CTGAAT | chr17 | 7113804 | 7113823 | 7113820 | + |
| SEQ ID NO 7937 | CATACGAGGCACATGTGTTC | TTGGGT | chr17 | 7113864 | 7113883 | 7113880 | + |
| SEQ ID NO 7938 | CCTCTGGCACATGCCTTTCC | TGGGGT | chr17 | 7113933 | 7113952 | 7113949 | + |
| SEQ ID NO 7939 | ACATGCCTTTCCTGGGGTCC | TGGGGT | chr17 | 7113941 | 7113960 | 7113957 | + |
| SEQ ID NO 7940 | GGTGAGGTGAGGGAACAAGC | GGGGGT | chr17 | 7113976 | 7113995 | 7113992 | + |
| SEQ ID NO 7941 | CCCTCCTCAGTCCCTGTTCA | CAGAGT | chr17 | 7114008 | 7114027 | 7114024 | + |
| SEQ ID NO 7942 | CCTCAGTCCCTGTTCACAGA | GTGGGT | chr17 | 7114012 | 7114031 | 7114028 | + |
| SEQ ID NO 7943 | TGCACACTTGCCTTTCAAAA | ATGGAT | chr17 | 7114106 | 7114125 | 7114122 | + |
| SEQ ID NO 7944 | CAAAAATGGATTTCCTCTCC | TGGGAT | chr17 | 7114121 | 7114140 | 7114137 | + |
| SEQ ID NO 7945 | CCTCTCCTGGGATTCAGCCT | GCGAGT | chr17 | 7114134 | 7114153 | 7114150 | + |
| SEQ ID NO 7946 | TGGCCCCTCACCTTGATGGA | AAGGAT | chr17 | 7114163 | 7114182 | 7114179 | + |
| SEQ ID NO 7947 | TTTTCCTCCGAGCTCAGCTG | CTGGAT | chr17 | 7114194 | 7114213 | 7114210 | + |
| SEQ ID NO 7948 | ATTCACGTGGAGGTTGATGG | TGGGAT | chr17 | 7114328 | 7114347 | 7114344 | + |
| SEQ ID NO 7949 | GTTGATGGTGGGATGGAACG | CAGGGT | chr17 | 7114340 | 7114359 | 7114356 | + |
| SEQ ID NO 7950 | GGGATGGAACGCAGGGTCGG | AGGGGT | chr17 | 7114349 | 7114368 | 7114365 | + |
| SEQ ID NO 7951 | AACGCAGGGTCGGAGGGGTT | CGGGGT | chr17 | 7114356 | 7114375 | 7114372 | + |
| SEQ ID NO 7952 | GAGGGGTTCGGGGTGGTGGC | CTGGGT | chr17 | 7114368 | 7114387 | 7114384 | + |
| SEQ ID NO 7953 | GTTCGGGGTGGTGGCCTGGG | TAGGAT | chr17 | 7114373 | 7114392 | 7114389 | + |
| SEQ ID NO 7954 | ATCCACCATCAACCTCCAC | GTGAAT | chr17 | 7114334 | 7114353 | 7114337 | - |
| SEQ ID NO 7955 | AGGGGCCAGGCACTCGCAGG | CTGAAT | chr17 | 7114151 | 7114170 | 7114154 | - |
| SEQ ID NO 7956 | TGTGCACGTATGTGCATATG | AGGAAT | chr17 | 7113840 | 7113859 | 7113843 | - |
| SEQ ID NO 7957 | CTGGGACTCTGTGTGTGTGT | GTGAGT | chr17 | 7113804 | 7113823 | 7113807 | - |
| SEQ ID NO 7958 | GACTCTGTGTGTGTGTGTGA | GTGAAT | chr17 | 7113800 | 7113819 | 7113803 | - |
| SEQ ID NO 7959 | TGTGTATGTCGTGTATGTGA | GAGGGT | chr17 | 7113729 | 7113748 | 7113732 | - |
| SEQ ID NO 7960 | TGAGAGGGTATGTTGTGTGT | GAGAGT | chr17 | 7113712 | 7113731 | 7113715 | - |
| SEQ ID NO 7961 | GTGTTGTGTGTGTATGTTGT | GTGAGT | chr17 | 7113686 | 7113705 | 7113689 | - |
| SEQ ID NO 7962 | ATGTTGTGTGTATCTTGTGT | GTGAGT | chr17 | 7113658 | 7113677 | 7113661 | - |
| SEQ ID NO 7963 | TGTGCATGTGTGTATGTTGT | GCGAGT | chr17 | 7113606 | 7113625 | 7113609 | - |
| SEQ ID NO 7964 | TGCGAGTGTATGTTGTGTAT | GTGAGT | chr17 | 7113587 | 7113606 | 7113590 | - |
| SEQ ID NO 7965 | TGTGTGTATGTATGTTGTGT | ATGAGT | chr17 | 7113540 | 7113559 | 7113543 | - |
| SEQ ID NO 7966 | GTGTTGTGTGTGTATTGT | GTGAGT | chr17 | 7113473 | 7113492 | 7113476 | - |
| SEQ ID NO 7967 | TATGTATGTTTGTGTGTTGT | GTGAGT | chr17 | 7113446 | 7113465 | 7113449 | - |
| SEQ ID NO 7968 | TGTGCGTGTGTGTATGTTGT | GCGAGT | chr17 | 7113409 | 7113428 | 7113412 | - |
| SEQ ID NO 7969 | GTGTGTTGTGTGTGTATGTT | GTGAGT | chr17 | 7113381 | 7113400 | 7113384 | - |
| SEQ ID NO 7970 | GTGTTATGTATGTTGTGTGT | GTGAGT | chr17 | 7113355 | 7113374 | 7113358 | - |
| SEQ ID NO 7971 | TGTGTGTGAGTGTGTTGC | GTGAGT | chr17 | 7113342 | 7113361 | 7113345 | - |
| SEQ ID NO 7972 | TGTGTGTGTGTGTAGAGG | TGGGGT | chr17 | 7113281 | 7113300 | 7113284 | - |
| SEQ ID NO 7973 | TGTGTGTGTGTAGAGGTGGG | GTGAGT | chr17 | 7113277 | 7113296 | 7113280 | - |

Figure 26 (Cont'd)

| SEQ ID NO 7974 | TGTGTAGAGGTGGGGTGAGT | TGGGAT | chr17 | 7113271 | 7113290 | 7113274 | - |
| SEQ ID NO 7975 | TAGAGGTGGGGTGAGTTGGG | ATGGGT | chr17 | 7113267 | 7113286 | 7113270 | - |
| SEQ ID NO 7976 | TCATCTCCCAAGACCCTTCC | CTGGAT | chr17 | 7113197 | 7113216 | 7113200 | - |
| SEQ ID NO 7977 | GACATTTTTTTTTTAGAGAC | AGGAGT | chr17 | 7113130 | 7113149 | 7113133 | - |
| SEQ ID NO 7978 | TAGAGACAGGAGTGTAGTGG | CAGGAT | chr17 | 7113117 | 7113136 | 7113120 | - |
| SEQ ID NO 7979 | AAAAAAATTTTTTAGAGAAA | TGGGGT | chr17 | 7112986 | 7113005 | 7112989 | - |
| SEQ ID NO 7980 | TAGGCAGAAGGGCAAGAGCC | AGGAAT | chr17 | 7112899 | 7112918 | 7112902 | - |
| SEQ ID NO 7981 | AGGGCAAGAGCCAGGAATGG | AGGAGT | chr17 | 7112891 | 7112910 | 7112894 | - |
| SEQ ID NO 7982 | AATGGAGGAGTGTCAGGTGT | GTGGGT | chr17 | 7112876 | 7112895 | 7112879 | - |
| SEQ ID NO 7983 | TGTGGGTGCTGGTGGTGGAG | CCGGGT | chr17 | 7112857 | 7112876 | 7112860 | - |
| SEQ ID NO 7984 | AGGGGCTTGGAGCTTAGGAA | GGGGAT | chr17 | 7112811 | 7112830 | 7112814 | - |
| SEQ ID NO 7985 | AGGGGATTGGTTAGCTGGGC | TGGAAT | chr17 | 7112792 | 7112811 | 7112795 | - |
| SEQ ID NO 7986 | AGGGCAGGGCAGGGGACAGG | AGGGAT | chr17 | 7112713 | 7112732 | 7112716 | - |
| SEQ ID NO 7987 | GTACATAGTGAACACTCAGA | GAGAAT | chr17 | 7112534 | 7112553 | 7112537 | - |
| SEQ ID NO 7988 | GTGAACACTCAGAGAGAATA | CGGGAT | chr17 | 7112527 | 7112546 | 7112530 | - |
| SEQ ID NO 7989 | AGAGAGAATACGGGATGCTG | CTGAAT | chr17 | 7112517 | 7112536 | 7112520 | - |
| SEQ ID NO 7990 | GGGATGCTGCTGAATCTTCT | GAGGGT | chr17 | 7112506 | 7112525 | 7112509 | - |
| SEQ ID NO 7991 | GCTGAATCTTCTGAGGGTGA | CAGAAT | chr17 | 7112498 | 7112517 | 7112501 | - |
| SEQ ID NO 7992 | CTTCTGAGGGTGACAGAATT | TAGAGT | chr17 | 7112491 | 7112510 | 7112494 | - |
| SEQ ID NO 7993 | CAGGAGGCTTGGAGAGAGGC | CAGGAT | chr17 | 7112460 | 7112479 | 7112463 | - |
| SEQ ID NO 7994 | AGGATTTCTGAAATTAATGG | GAGAGT | chr17 | 7112439 | 7112458 | 7112442 | - |
| SEQ ID NO 7995 | TAATGGGAGAGTGAGCTCAC | GCGAAT | chr17 | 7112425 | 7112444 | 7112428 | - |
| SEQ ID NO 7996 | ACCAGTGAGGGACCGTCTGA | AGGGAT | chr17 | 7112387 | 7112406 | 7112390 | - |
| SEQ ID NO 7997 | CCGCATTTCCCTCCAGCAGC | CCGGGT | chr17 | 7112349 | 7112368 | 7112352 | - |
| SEQ ID NO 7998 | ATTTCAATTATGCATGTATT | AAGGGT | chr17 | 7112205 | 7112224 | 7112208 | - |
| SEQ ID NO 7999 | TCTCCCAGTGTTTCATTTTA | TAGAGT | chr17 | 7112137 | 7112156 | 7112140 | - |
| SEQ ID NO 8000 | TCTCACTCTGTTGCCCAGGC | TGGAAT | chr17 | 7112013 | 7112032 | 7112016 | - |
| SEQ ID NO 8001 | GAGACGGTTTTGCCATGTAG | AGGGGT | chr17 | 7111855 | 7111874 | 7111858 | - |
| SEQ ID NO 8002 | GTGTCGACCTCCCAAAGTGC | TGGGAT | chr17 | 7111775 | 7111794 | 7111778 | - |
| SEQ ID NO 8003 | CTTTTTTTTTTTTTTGGAGG | CGGAGT | chr17 | 7111652 | 7111671 | 7111655 | - |
| SEQ ID NO 8004 | TCTCGCTCTGTTGCCCAGGC | CGGAGT | chr17 | 7111627 | 7111646 | 7111630 | - |
| SEQ ID NO 8005 | CTCACTGCAAGCTCTGCCTC | CCGGGT | chr17 | 7111583 | 7111602 | 7111586 | - |
| SEQ ID NO 8006 | CATTCTCCTGCCTCAGCCTC | CCGAGT | chr17 | 7111551 | 7111570 | 7111554 | - |
| SEQ ID NO 8007 | TTTTGTATTTTTAGTAGAGA | TGGGGT | chr17 | 7111485 | 7111504 | 7111488 | - |
| SEQ ID NO 8008 | TGGGGTTTCACCATGTTAGC | CAGGAT | chr17 | 7111465 | 7111484 | 7111468 | - |
| SEQ ID NO 8009 | GCCTTGGCCTCCCACAGTGC | TGGGAT | chr17 | 7111408 | 7111427 | 7111411 | - |
| SEQ ID NO 8010 | ACTTAATTTTTTGAACATAA | TGGGAT | chr17 | 7111274 | 7111293 | 7111277 | - |
| SEQ ID NO 8011 | TTCTAGCATCCGTGTCAGTT | CTGGAT | chr17 | 7111210 | 7111229 | 7111213 | - |
| SEQ ID NO 8012 | ACATTGTCAATTTCACCTTG | TTGGGT | chr17 | 7111099 | 7111118 | 7111102 | - |
| SEQ ID NO 8013 | CAATTTCACCTTGTTGGGTG | CTGGAT | chr17 | 7111092 | 7111111 | 7111095 | - |
| SEQ ID NO 8014 | AATGTTCTTGAGCTTTGCTC | CGGGAT | chr17 | 7111049 | 7111068 | 7111052 | - |
| SEQ ID NO 8015 | CGGGATGCAGTTAAGCAACT | TAGAGT | chr17 | 7111029 | 7111048 | 7111032 | - |
| SEQ ID NO 8016 | AGCTCCATCTCCTCAACGTG | GGGAGT | chr17 | 7110955 | 7110974 | 7110958 | - |
| SEQ ID NO 8017 | ACTCTCTCCAAACAGTAAGC | TGGGGT | chr17 | 7110882 | 7110901 | 7110885 | - |
| SEQ ID NO 8018 | ACAGTAAGCTGGGGTGATCG | GAGGGT | chr17 | 7110871 | 7110890 | 7110874 | - |
| SEQ ID NO 8019 | TTGTTTGCTTCTTATCCCTC | AGGGAT | chr17 | 7110840 | 7110859 | 7110843 | - |
| SEQ ID NO 8020 | ACTCCTCCTTGCCTGATGTC | CAGAGT | chr17 | 7110810 | 7110829 | 7110813 | - |
| SEQ ID NO 8021 | TAATTATCCGAGCAATCCAA | TCGGGT | chr17 | 7110642 | 7110661 | 7110645 | - |
| SEQ ID NO 8022 | AAAATGGAAGCATGGAGAAA | TTGAAT | chr17 | 7110583 | 7110602 | 7110586 | - |

Figure 26 (Cont'd)

| SEQ ID NO 8023 | CCCTGTGGGCAGTCTGGTTT | CAGGGT | chr17 | 7110513 | 7110532 | 7110516 | - |
| SEQ ID NO 8024 | GTGGGCAGTCTGGTTTCAGG | GTGGAT | chr17 | 7110509 | 7110528 | 7110512 | - |
| SEQ ID NO 8025 | TGCTGGGCTGACCCAGCATT | GGGAGT | chr17 | 7110471 | 7110490 | 7110474 | - |
| SEQ ID NO 8026 | GGGAAGCAGGACAGGACCCT | CTGAGT | chr17 | 7110431 | 7110450 | 7110434 | - |
| SEQ ID NO 8027 | AGGACAGGACCCTCTGAGTG | GAGGGT | chr17 | 7110424 | 7110443 | 7110427 | - |
| SEQ ID NO 8028 | ACCGTGGTCATGGAGCGCTT | CTGGAT | chr17 | 7110345 | 7110364 | 7110348 | - |
| SEQ ID NO 8029 | TGGAGCGCTTCTGGATGGAG | AGGAAT | chr17 | 7110335 | 7110354 | 7110338 | - |
| SEQ ID NO 8030 | AATGCAAAGGCCTTGGAGGA | AGGGGT | chr17 | 7110312 | 7110331 | 7110315 | - |
| SEQ ID NO 8031 | GGGGTGGGGGCAGTGAGAGG | GAGGGT | chr17 | 7110291 | 7110310 | 7110294 | - |
| SEQ ID NO 8032 | GGTGGGGCTGTGCTCAGAGC | GGGAGT | chr17 | 7110268 | 7110287 | 7110271 | - |
| SEQ ID NO 8033 | TGGAGGTGTCAGAGGCCTCC | CTGGGT | chr17 | 7110236 | 7110255 | 7110239 | - |
| SEQ ID NO 8034 | AGAGGCCTCCCTGGGTCAAA | TGGGGT | chr17 | 7110226 | 7110245 | 7110229 | - |
| SEQ ID NO 8035 | TCCCTGGGTCAAATGGGGTC | CTGAGT | chr17 | 7110219 | 7110238 | 7110222 | - |
| SEQ ID NO 8036 | TCACTGGTGTGAAAAGATG | AAGAGT | chr17 | 7110168 | 7110187 | 7110171 | - |
| SEQ ID NO 8037 | GGCCCTGACTGAGCCTCCC | CAGGAT | chr17 | 7110068 | 7110087 | 7110071 | - |
| SEQ ID NO 8038 | CTCCCAGGATGTGGTCCTG | CTGGGT | chr17 | 7110053 | 7110072 | 7110056 | - |
| SEQ ID NO 8039 | GATGTGGTCCTGCTGGGTCG | GGGGGT | chr17 | 7110045 | 7110064 | 7110048 | - |
| SEQ ID NO 8040 | CTGCTGGGTCGGGGGGTGAT | AGGAAT | chr17 | 7110036 | 7110055 | 7110039 | - |
| SEQ ID NO 8041 | TGAGAAGACAAGGAAGTCCA | CAGAGT | chr17 | 7110011 | 7110030 | 7110014 | - |
| SEQ ID NO 8042 | GACAAGGAAGTCCACAGAGT | CAGGGT | chr17 | 7110005 | 7110024 | 7110008 | - |
| SEQ ID NO 8043 | AGAAGGTGTTCTGTTTGCAG | GTGGAT | chr17 | 7109970 | 7109989 | 7109973 | - |
| SEQ ID NO 8044 | CTGGGACAACTGGAGCTGCT | CTGGGT | chr17 | 7109921 | 7109940 | 7109924 | - |
| SEQ ID NO 8045 | AGCTCTGTGTGCAGGAAGAC | GTGGGT | chr17 | 7109871 | 7109890 | 7109874 | - |
| SEQ ID NO 8046 | GTGCAGGAAGACGTGGGTGT | GTGAGT | chr17 | 7109863 | 7109882 | 7109866 | - |
| SEQ ID NO 8047 | GGGTGTGTGAGTGTACGTGT | GTGGGT | chr17 | 7109849 | 7109868 | 7109852 | - |
| SEQ ID NO 8048 | TCAGGTGTGTGTGTGTGGGA | GGGAGT | chr17 | 7109820 | 7109839 | 7109823 | - |
| SEQ ID NO 8049 | GTGTGTGTGGGAGGGAGT | ATGAAT | chr17 | 7109814 | 7109833 | 7109817 | - |
| SEQ ID NO 8050 | TAGCATGCATATGCACATGT | GAGAGT | chr17 | 7109780 | 7109799 | 7109783 | - |
| SEQ ID NO 8051 | ATGCATATGCACATGTGAGA | GTGGGT | chr17 | 7109776 | 7109795 | 7109779 | - |
| SEQ ID NO 8052 | GGGTACAGCAGAGCGTGGTC | ATGAGT | chr17 | 7109754 | 7109773 | 7109757 | - |
| SEQ ID NO 8053 | GTGTGTGCAAATGTGTGTTT | TTGAGT | chr17 | 7109730 | 7109749 | 7109733 | - |
| SEQ ID NO 8054 | TTGAGTGAAGTGAGCAATGT | GTGAGT | chr17 | 7109710 | 7109729 | 7109713 | - |
| SEQ ID NO 8055 | AGTGAGCAATGTGTGAGTGT | GTGAGT | chr17 | 7109702 | 7109721 | 7109705 | - |
| SEQ ID NO 8056 | GTGTGAGTGTGTGAGTGTGT | GTGAGT | chr17 | 7109692 | 7109711 | 7109695 | - |
| SEQ ID NO 8057 | GTGTGAGTTTGTGAGGGCAT | GTGAAT | chr17 | 7109674 | 7109693 | 7109677 | - |
| SEQ ID NO 8058 | AATGTGTGTCAGTGCTGT | CAGGGT | chr17 | 7109651 | 7109670 | 7109654 | - |
| SEQ ID NO 8059 | TCAGTGCTGTCAGGGTGCAG | ATGGAT | chr17 | 7109641 | 7109660 | 7109644 | - |
| SEQ ID NO 8060 | GGAGGAGGCCTTGCGTGGTG | GGGGAT | chr17 | 7109516 | 7109535 | 7109519 | - |
| SEQ ID NO 8061 | AGGACAACAGGTGGGACCTG | GAGGGT | chr17 | 7109489 | 7109508 | 7109492 | - |
| SEQ ID NO 8062 | GACCTGGAGGGTTGTGCTTG | GAGAGT | chr17 | 7109475 | 7109494 | 7109478 | - |
| SEQ ID NO 8063 | GCTTGGAGAGTGGGCTATGG | TGGAAT | chr17 | 7109460 | 7109479 | 7109463 | - |
| SEQ ID NO 8064 | TGGTGGAATGACCCAGATTT | AAGGAT | chr17 | 7109443 | 7109462 | 7109446 | - |
| SEQ ID NO 8065 | CCCAGATTTAAGGATCTCAA | TGGAAT | chr17 | 7109432 | 7109451 | 7109435 | - |
| SEQ ID NO 8066 | AGGGGAGGGACTGTTCCAGT | ATGGAT | chr17 | 7109400 | 7109419 | 7109403 | - |
| SEQ ID NO 8067 | AGAACACAGGGCCCAGCTTC | TGGAGT | chr17 | 7109367 | 7109386 | 7109370 | - |
| SEQ ID NO 8068 | CTGGAGGCCTCTGCCACTGG | CTGGAT | chr17 | 7109285 | 7109304 | 7109288 | - |
| SEQ ID NO 8069 | CATTCACAGATCCCCCTTCT | CAGGAT | chr17 | 7109248 | 7109267 | 7109251 | - |
| SEQ ID NO 8070 | GGATGTGTGCCTAGGCAGGG | CCGGGT | chr17 | 7109226 | 7109245 | 7109229 | - |
| SEQ ID NO 8071 | GTCTCCCAGTCCCCAGCTC | CAGGAT | chr17 | 7109179 | 7109198 | 7109182 | - |

Figure 26 (Cont'd)

| | | | | | | | |
|---|---|---|---|---|---|---|---|
| SEQ ID NO 8072 | GGGCTTTGCACACAGCTGAT | GTGAAT | chr17 | 7109151 | 7109170 | 7109154 | - |
| SEQ ID NO 8073 | ACACAGCTGATGTGAATATC | CTGAGT | chr17 | 7109142 | 7109161 | 7109145 | - |
| SEQ ID NO 8074 | GAATATCCTGAGTCGTGTGC | ATGGGT | chr17 | 7109129 | 7109148 | 7109132 | - |
| SEQ ID NO 8075 | GTATATTTATACATGGTAAT | ATGGGT | chr17 | 7109077 | 7109096 | 7109080 | - |
| SEQ ID NO 8076 | TTATACATGGTAATATGGGT | GCGAGT | chr17 | 7109071 | 7109090 | 7109074 | - |
| SEQ ID NO 8077 | TAATATGGGTGCGAGTGTGT | AAGAGT | chr17 | 7109061 | 7109080 | 7109064 | - |
| SEQ ID NO 8078 | TGTGTGTAATGCTCAAATGC | TGGGGT | chr17 | 7109034 | 7109053 | 7109037 | - |
| SEQ ID NO 8079 | GCTGGTGGTCATCTGTGTGA | CTGGGT | chr17 | 7108784 | 7108803 | 7108787 | - |
| SEQ ID NO 8080 | GTGTGACTGGGTCCCAAAGT | GAGGGT | chr17 | 7108770 | 7108789 | 7108773 | - |
| SEQ ID NO 8081 | TGAGGGTCACGGGGGCCAGC | AGGGAT | chr17 | 7108751 | 7108770 | 7108754 | - |
| SEQ ID NO 8082 | GGGGCCAGCAGGGATGGGCA | AGGGGT | chr17 | 7108740 | 7108759 | 7108743 | - |

Figure 27

| # | Sequence | PAM | chr17 | Start | End | Cuts 5' of | Str |
|---|---|---|---|---|---|---|---|
| SEQ ID NO 8083 | CGCCCTTTGCCCTCGCTTCC | CTAGAAA | chr17 | 7109540 | 7109559 | 7109556 | + |
| SEQ ID NO 8084 | GGGGAGGCTCAGTCAGGGGC | CCAGAAT | chr17 | 7110067 | 7110086 | 7110083 | + |
| SEQ ID NO 8085 | TGGGAAGAGTTCTTCTCTCC | CCAGAAA | chr17 | 7110731 | 7110750 | 7110747 | + |
| SEQ ID NO 8086 | ATCCAGAACTGACACGGATG | CTAGAAT | chr17 | 7111204 | 7111223 | 7111220 | + |
| SEQ ID NO 8087 | CATTATGTTCAAAAAATTAA | GTAGAAT | chr17 | 7111272 | 7111291 | 7111288 | + |
| SEQ ID NO 8088 | CTACTCGGGAGGCTGAGGCA | GGAGAAT | chr17 | 7111543 | 7111562 | 7111559 | + |
| SEQ ID NO 8089 | TCCGCCTCCAAAAAAAAAAA | AAAGAAA | chr17 | 7111648 | 7111667 | 7111664 | + |
| SEQ ID NO 8090 | CTCCAAAAAAAAAAAAAAGA | AAAGAAA | chr17 | 7111653 | 7111672 | 7111669 | + |
| SEQ ID NO 8091 | AAAAAAAAAAAAAGAAAAG | AAAGAAA | chr17 | 7111657 | 7111676 | 7111673 | + |
| SEQ ID NO 8092 | AAAAAAAAGAAAAGAAAGA | AAAGAAA | chr17 | 7111662 | 7111681 | 7111678 | + |
| SEQ ID NO 8093 | TGGATGGAAATAATGGAAGA | TGAGAAA | chr17 | 7111697 | 7111716 | 7111713 | + |
| SEQ ID NO 8094 | AATGGAAGATGAGAAATGCG | TAAGAAA | chr17 | 7111708 | 7111727 | 7111724 | + |
| SEQ ID NO 8095 | CTCTATAAAATGAAACACTG | GGAGAAA | chr17 | 7112132 | 7112151 | 7112148 | + |
| SEQ ID NO 8096 | AAATGAAACACTGGGAGAAA | AAAGAAT | chr17 | 7112139 | 7112158 | 7112155 | + |
| SEQ ID NO 8097 | AAAAGAATTAAAAAATGGAA | AGAGAAT | chr17 | 7112158 | 7112177 | 7112174 | + |
| SEQ ID NO 8098 | ATGCATAATTGAAATCTTTA | AAAGAAA | chr17 | 7112210 | 7112229 | 7112226 | + |
| SEQ ID NO 8099 | TTTAAAAGAAAAAGGGGGTA | GCAGAAA | chr17 | 7112226 | 7112245 | 7112242 | + |
| SEQ ID NO 8100 | AGCTCACTCTCCCATTAATT | TCAGAAA | chr17 | 7112428 | 7112447 | 7112444 | + |
| SEQ ID NO 8101 | GACAGAGGGGAGCAAAGCC | GCAGAAA | chr17 | 7114078 | 7114097 | 7114094 | + |
| SEQ ID NO 8102 | CAAATTAAAAAAAATTTTTT | AGAGAAA | chr17 | 7112993 | 7113012 | 7112996 | - |
| SEQ ID NO 8103 | GGTACATAGTGAACACTCAG | AGAGAAT | chr17 | 7112535 | 7112554 | 7112538 | - |
| SEQ ID NO 8104 | TGCTGAATCTTCTGAGGGTG | ACAGAAT | chr17 | 7112499 | 7112518 | 7112502 | - |
| SEQ ID NO 8105 | TGTGATCTCCATTTTACACA | CGAGAAA | chr17 | 7110607 | 7110626 | 7110610 | - |
| SEQ ID NO 8106 | ACACGAGAAAATGGAAGCAT | GGAGAAA | chr17 | 7110590 | 7110609 | 7110593 | - |

Figure 28

| # | Sequence | PAM | chr17 | Start | End | Cuts 5' of | Str |
|---|---|---|---|---|---|---|---|
| SEQ ID NO 8107 | ACACATTGCTCACTTCACTC | AAAAAC | chr17 | 7109708 | 7109727 | 7109724 | + |
| SEQ ID NO 8108 | CTTCTCTCCCCAGAAACAAT | CAAAAC | chr17 | 7110742 | 7110761 | 7110758 | + |
| SEQ ID NO 8109 | TCCCCAGAAACAATCAAAAC | AAAAAC | chr17 | 7110748 | 7110767 | 7110764 | + |
| SEQ ID NO 8110 | AGCTGAGAGTCCGAGGAGAC | CAAAAC | chr17 | 7110971 | 7110990 | 7110987 | + |
| SEQ ID NO 8111 | CAAGGCATGCAATGAAACGG | GAAAAC | chr17 | 7111140 | 7111159 | 7111156 | + |
| SEQ ID NO 8112 | GAATTAGCAGGCAAGGATGG | TAAAAC | chr17 | 7111227 | 7111246 | 7111243 | + |
| SEQ ID NO 8113 | CCAGGTGAACTTCTAGAGAT | AAAAAC | chr17 | 7111321 | 7111340 | 7111337 | + |
| SEQ ID NO 8114 | AACTACAATGTCTGAAATGA | AAAAAC | chr17 | 7111344 | 7111363 | 7111360 | + |
| SEQ ID NO 8115 | AAAAGAAAAGAAAGAAAAGA | AAAAAC | chr17 | 7111667 | 7111686 | 7111683 | + |
| SEQ ID NO 8116 | GACTAGTCTGGGCAGCATGG | CAAAAC | chr17 | 7111825 | 7111844 | 7111841 | + |
| SEQ ID NO 8117 | GGCAAAACCCCTCTACATGG | CAAAAC | chr17 | 7111843 | 7111862 | 7111859 | + |
| SEQ ID NO 8118 | TGCCACTGGCTGGATGGGAG | GAAAAC | chr17 | 7109274 | 7109293 | 7109277 | - |

Figure 29

| # | Sequence | PAM | chr17 | Start | End | Cuts 5' of | Str |
|---|---|---|---|---|---|---|---|
| SEQ ID NO 8119 | GAGGAGGCATAACCTGGGCG | GGGGGATT | chr17 | 7108964 | 7108983 | 7108980 | + |
| SEQ ID NO 8120 | GGCCATGGGGGGGGGTCATC | ATAGGCTT | chr17 | 7108998 | 7109017 | 7109014 | + |
| SEQ ID NO 8121 | CCTGAGAAGGGGGATCTGTG | AATGGTTT | chr17 | 7109244 | 7109263 | 7109260 | + |
| SEQ ID NO 8122 | TCTTCTAAGGCTCCTGTCCC | CTCAGATT | chr17 | 7109329 | 7109348 | 7109345 | + |
| SEQ ID NO 8123 | TCCTCCCCAGCGCCCTTTGC | CCTCGCTT | chr17 | 7109530 | 7109549 | 7109546 | + |
| SEQ ID NO 8124 | CCTCCACTCAGAGGGTCCTG | TCCTGCTT | chr17 | 7110420 | 7110439 | 7110436 | + |
| SEQ ID NO 8125 | TGCACCAGCATTCAATTTCT | CCATGCTT | chr17 | 7110568 | 7110587 | 7110584 | + |
| SEQ ID NO 8126 | TGGAGATCACAGTCGTAGCT | ACCCGATT | chr17 | 7110616 | 7110635 | 7110632 | + |
| SEQ ID NO 8127 | ATCACAGTCGTAGCTACCCG | ATTGGATT | chr17 | 7110621 | 7110640 | 7110637 | + |
| SEQ ID NO 8128 | TAGATGAGTTAAAATATGTA | ATGTGCTT | chr17 | 7110660 | 7110679 | 7110676 | + |
| SEQ ID NO 8129 | ATGTAATGTGCTTCTTAGGC | AAAAGTTT | chr17 | 7110675 | 7110694 | 7110691 | + |
| SEQ ID NO 8130 | AACAGACAACTATAGAACAT | GGCAGCTT | chr17 | 7110771 | 7110790 | 7110787 | + |
| SEQ ID NO 8131 | AACAGGAACCCTCCGATCAC | CCCAGCTT | chr17 | 7110858 | 7110877 | 7110874 | + |
| SEQ ID NO 8132 | ACCCTCCGATCACCCCAGCT | TACTGTTT | chr17 | 7110865 | 7110884 | 7110881 | + |
| SEQ ID NO 8133 | AAACGATCAAACTGACTCTA | AGTTGCTT | chr17 | 7111009 | 7111028 | 7111025 | + |
| SEQ ID NO 8134 | GACAATGTCTGGCAGCCAAT | CAAAGATT | chr17 | 7111111 | 7111130 | 7111127 | + |
| SEQ ID NO 8135 | AATGGCATGAACCCGGGAGG | CAGAGCTT | chr17 | 7111567 | 7111586 | 7111583 | + |
| SEQ ID NO 8136 | CTCTAAATTCTGTCACCCTC | AGAAGATT | chr17 | 7112486 | 7112505 | 7112502 | + |
| SEQ ID NO 8137 | TTGGGAGGCTGAGGTGGGAG | GATGGCTT | chr17 | 7113050 | 7113069 | 7113066 | + |
| SEQ ID NO 8138 | AAGATACTTAGGTCCTTCAG | TCAAGATT | chr17 | 7113151 | 7113170 | 7113167 | + |
| SEQ ID NO 8139 | CTGCACACTTGCCTTTCAAA | AATGGATT | chr17 | 7114105 | 7114124 | 7114121 | + |
| SEQ ID NO 8140 | TCAAAAATGGATTTCCTCTC | CTGGGATT | chr17 | 7114120 | 7114139 | 7114136 | + |
| SEQ ID NO 8141 | GGCTGGGGCTGGGGCAGAGG | TGCAGATT | chr17 | 7114303 | 7114322 | 7114319 | + |
| SEQ ID NO 8142 | CCATTTTTGAAAGGCAAGTG | TGCAGTTT | chr17 | 7114110 | 7114129 | 7114113 | - |
| SEQ ID NO 8143 | AAAGGCAAGTGTGCAGTTTC | TGCGGCTT | chr17 | 7114101 | 7114120 | 7114104 | - |
| SEQ ID NO 8144 | TGCTCCCCTCTGTCTCAGC | TCATGATT | chr17 | 7114073 | 7114092 | 7114076 | - |
| SEQ ID NO 8145 | GACTGAGGAGGGCCCGACAC | CCCCGCTT | chr17 | 7114000 | 7114019 | 7114003 | - |
| SEQ ID NO 8146 | ACGTATGTGCATATGAGGAA | TGCAGATT | chr17 | 7113835 | 7113854 | 7113838 | - |
| SEQ ID NO 8147 | TGTGTATTGTGTGAGTGTAT | GTATGTTT | chr17 | 7113463 | 7113482 | 7113466 | - |
| SEQ ID NO 8148 | GTGTGTGTGTTAGTGTGTGT | ATGTGATT | chr17 | 7113318 | 7113337 | 7113321 | - |
| SEQ ID NO 8149 | ATGTTGCCCAGGCTGGTGGG | AAAAGATT | chr17 | 7112954 | 7112973 | 7112957 | - |
| SEQ ID NO 8150 | TCCATGGAGGCAGGAGGAGC | AGGGGCTT | chr17 | 7112831 | 7112850 | 7112834 | - |
| SEQ ID NO 8151 | AGGCAGGAGGAGCAGGGGCT | TGGAGCTT | chr17 | 7112824 | 7112843 | 7112827 | - |
| SEQ ID NO 8152 | CAGGGGCTTGGAGCTTAGGA | AGGGGATT | chr17 | 7112812 | 7112831 | 7112815 | - |
| SEQ ID NO 8153 | CTTCTGAGGGTGACAGAATT | TAGAGTTT | chr17 | 7112491 | 7112510 | 7112494 | - |
| SEQ ID NO 8154 | CAGAATTTAGAGTTTGAGCA | GGAGGCTT | chr17 | 7112478 | 7112497 | 7112481 | - |
| SEQ ID NO 8155 | GCAGGAGGCTTGGAGAGAGG | CCAGGATT | chr17 | 7112461 | 7112480 | 7112464 | - |
| SEQ ID NO 8156 | CATCTTCCACTTGTCTCAGC | ACTTGATT | chr17 | 7112263 | 7112282 | 7112266 | - |
| SEQ ID NO 8157 | CTGCTACCCCCTTTTTCTTT | TAAAGATT | chr17 | 7112230 | 7112249 | 7112233 | - |
| SEQ ID NO 8158 | TTTTTAATTCTTTTTTCTCC | CAGTGTTT | chr17 | 7112152 | 7112171 | 7112155 | - |
| SEQ ID NO 8159 | CCCCTCCCCTCCTTTCCTTC | CCTCGCTT | chr17 | 7112063 | 7112082 | 7112066 | - |
| SEQ ID NO 8160 | TGTTGCCCAGGCTGGAATGC | AGTAGCTT | chr17 | 7112005 | 7112024 | 7112008 | - |
| SEQ ID NO 8161 | TAAAAATTTTTTTTGTAGA | GACGGTTT | chr17 | 7111873 | 7111892 | 7111876 | - |
| SEQ ID NO 8162 | GAGACGGTTTGCCATGTAG | AGGGGTTT | chr17 | 7111855 | 7111874 | 7111858 | - |
| SEQ ID NO 8163 | AGTCTTGAGCTCCTGGGCTC | AAGTGATT | chr17 | 7111809 | 7111828 | 7111812 | - |
| SEQ ID NO 8164 | CGTGTCGACCTCCCAAAGTG | CTGGGATT | chr17 | 7111776 | 7111795 | 7111779 | - |
| SEQ ID NO 8165 | TCTTCCATTATTTCCATCCA | GTGTGTTT | chr17 | 7111697 | 7111716 | 7111700 | - |
| SEQ ID NO 8166 | TTTTGTATTTTTAGTAGAGA | TGGGGTTT | chr17 | 7111485 | 7111504 | 7111488 | - |

Figure 29 (Cont'd)

| | | | | | | | |
|---|---|---|---|---|---|---|---|
| SEQ ID NO 8167 | CGCCTTGGCCTCCCACAGTG | CTGGGATT | chr17 | 7111409 | 7111428 | 7111412 | - |
| SEQ ID NO 8168 | TGAGCCACGGCGCCTGGCCA | GTGTGTTT | chr17 | 7111374 | 7111393 | 7111377 | - |
| SEQ ID NO 8169 | TGTTTTTTCATTTCAGACAT | TGTAGTTT | chr17 | 7111351 | 7111370 | 7111354 | - |
| SEQ ID NO 8170 | TAATGGGATATGGCTATAAT | ATCTGTTT | chr17 | 7111257 | 7111276 | 7111260 | - |
| SEQ ID NO 8171 | ATGAACCTCCTCGTTATGCA | TTGTGTTT | chr17 | 7111170 | 7111189 | 7111173 | - |
| SEQ ID NO 8172 | CCTCGTTATGCATTGTGTTT | TCCCGTTT | chr17 | 7111162 | 7111181 | 7111165 | - |
| SEQ ID NO 8173 | TTCATTGCATGCCTTGTAAT | CTTTGATT | chr17 | 7111136 | 7111155 | 7111139 | - |
| SEQ ID NO 8174 | TTGTATTCCTCTAAATGTTC | TTGAGCTT | chr17 | 7111062 | 7111081 | 7111065 | - |
| SEQ ID NO 8175 | ATGCAGTTAAGCAACTTAGA | GTCAGTTT | chr17 | 7111025 | 7111044 | 7111028 | - |
| SEQ ID NO 8176 | AAGCAACTTAGAGTCAGTTT | GATCGTTT | chr17 | 7111017 | 7111036 | 7111020 | - |
| SEQ ID NO 8177 | GTTTGATCGTTTGAACTCTT | AATTGTTT | chr17 | 7111001 | 7111020 | 7111004 | - |
| SEQ ID NO 8178 | TGGGGTGATCGGAGGGTTCC | TGTTGTTT | chr17 | 7110862 | 7110881 | 7110865 | - |
| SEQ ID NO 8179 | GTGATCGGAGGGTTCCTGTT | GTTTGCTT | chr17 | 7110858 | 7110877 | 7110861 | - |
| SEQ ID NO 8180 | AGCTGCCATGTTCTATAGTT | GTCTGTTT | chr17 | 7110778 | 7110797 | 7110781 | - |
| SEQ ID NO 8181 | CATGTTCTATAGTTGTCTGT | TTTTGTTT | chr17 | 7110772 | 7110791 | 7110775 | - |
| SEQ ID NO 8182 | TCTATAGTTGTCTGTTTTTG | TTTTGATT | chr17 | 7110767 | 7110786 | 7110770 | - |
| SEQ ID NO 8183 | TAGTTGTCTGTTTTTGTTTT | GATTGTTT | chr17 | 7110763 | 7110782 | 7110766 | - |
| SEQ ID NO 8184 | CTGGGCTACCCTGTGGGCAG | TCTGGTTT | chr17 | 7110521 | 7110540 | 7110524 | - |
| SEQ ID NO 8185 | CAGGGACTCAGCCATGGAGG | GCCAGCTT | chr17 | 7110383 | 7110402 | 7110386 | - |
| SEQ ID NO 8186 | TGGGGAACACCGTGGTCATG | GAGCGCTT | chr17 | 7110353 | 7110372 | 7110356 | - |
| SEQ ID NO 8187 | GGCAGGAAGTGACCTGGGGA | GGAAGATT | chr17 | 7110099 | 7110118 | 7110102 | - |
| SEQ ID NO 8188 | GGTCCAAGGCCTAGAAGGTG | TTCTGTTT | chr17 | 7109982 | 7110001 | 7109985 | - |
| SEQ ID NO 8189 | GGTCATGAGTGTGTGCAAAT | GTGTGTTT | chr17 | 7109738 | 7109757 | 7109741 | - |
| SEQ ID NO 8190 | GTGTGAGTGTGTGAGTGTGT | GTGAGTTT | chr17 | 7109692 | 7109711 | 7109695 | - |
| SEQ ID NO 8191 | GGAGCAAATTTAGTGTGGAA | CGAGGTTT | chr17 | 7109572 | 7109591 | 7109575 | - |
| SEQ ID NO 8192 | AACAGGTGGGACCTGGAGGG | TTGTGCTT | chr17 | 7109484 | 7109503 | 7109487 | - |
| SEQ ID NO 8193 | AGTGGGCTATGGTGGAATGA | CCCAGATT | chr17 | 7109452 | 7109471 | 7109455 | - |
| SEQ ID NO 8194 | CAGGGGAGGGACTGTTCCAG | TATGGATT | chr17 | 7109401 | 7109420 | 7109404 | - |
| SEQ ID NO 8195 | ATTTTAGGAAGAACACAGGG | CCCAGCTT | chr17 | 7109376 | 7109395 | 7109379 | - |
| SEQ ID NO 8196 | CAGTCCCCAGCTCCAGGAT | CCGGGCTT | chr17 | 7109173 | 7109192 | 7109176 | - |
| SEQ ID NO 8197 | GTGTGCATGGGTGTGTGTGC | ACCAGATT | chr17 | 7109115 | 7109134 | 7109118 | - |
| SEQ ID NO 8198 | CCCGCCCAGGTTATGCCTCC | TCAGGCTT | chr17 | 7108966 | 7108985 | 7108969 | - |
| SEQ ID NO 8199 | CACAGCGTCTCTGCTCCATG | GTCTGCTT | chr17 | 7108845 | 7108864 | 7108848 | - |
| SEQ ID NO 8200 | CTGCTCCATGGTCTGCTTCA | GTCTGCTT | chr17 | 7108835 | 7108854 | 7108838 | - |
| SEQ ID NO 8201 | TCTGCTTCAGTCTGCTTGCC | CTGAGCTT | chr17 | 7108824 | 7108843 | 7108827 | - |

Figure 30

| # | Sequence | PAM | Chr | Start | End | Cut site 1 (5' of) | Cut site 2 (5' of) | Str |
|---|---|---|---|---|---|---|---|---|
| SEQ ID NO 8202 | CCCATGTCTCTTTCCCTACCCC | CTG | chr17 | 7108717 | 7108738 | 7108734 | 7108739 | + |
| SEQ ID NO 8203 | TTTCCCTACCCCTTGCCCATCC | CTC | chr17 | 7108727 | 7108748 | 7108744 | 7108749 | + |
| SEQ ID NO 8204 | TCCCTACCCCTTGCCCATCCCT | CTT | chr17 | 7108729 | 7108750 | 7108746 | 7108751 | + |
| SEQ ID NO 8205 | CCCTACCCCTTGCCCATCCCTG | TTT | chr17 | 7108730 | 7108751 | 7108747 | 7108752 | + |
| SEQ ID NO 8206 | CCTACCCCTTGCCCATCCCTGC | TTC | chr17 | 7108731 | 7108752 | 7108748 | 7108753 | + |
| SEQ ID NO 8207 | CCCCTTGCCCATCCCTGCTGGC | CTA | chr17 | 7108735 | 7108756 | 7108752 | 7108757 | + |
| SEQ ID NO 8208 | GCCCATCCCTGCTGGCCCCCGT | CTT | chr17 | 7108741 | 7108762 | 7108758 | 7108763 | + |
| SEQ ID NO 8209 | CCCATCCCTGCTGGCCCCCGTG | TTG | chr17 | 7108742 | 7108763 | 7108759 | 7108764 | + |
| SEQ ID NO 8210 | CTGGCCCCCGTGACCCTCACTT | CTG | chr17 | 7108752 | 7108773 | 7108769 | 7108774 | + |
| SEQ ID NO 8211 | GCCCCCGTGACCCTCACTTTGG | CTG | chr17 | 7108755 | 7108776 | 7108772 | 7108777 | + |
| SEQ ID NO 8212 | ACTTTGGGACCCAGTCACACAG | CTC | chr17 | 7108770 | 7108791 | 7108787 | 7108792 | + |
| SEQ ID NO 8213 | TGGGACCCAGTCACACAGATGA | CTT | chr17 | 7108774 | 7108795 | 7108791 | 7108796 | + |
| SEQ ID NO 8214 | GGGACCCAGTCACACAGATGAC | TTT | chr17 | 7108775 | 7108796 | 7108792 | 7108797 | + |
| SEQ ID NO 8215 | GGACCCAGTCACACAGATGACC | TTG | chr17 | 7108776 | 7108797 | 7108793 | 7108798 | + |
| SEQ ID NO 8216 | AAGCTCAGGGCAAGCAGACTGA | TTG | chr17 | 7108816 | 7108837 | 7108833 | 7108838 | + |
| SEQ ID NO 8217 | AGGGCAAGCAGACTGAAGCAGA | CTC | chr17 | 7108822 | 7108843 | 7108839 | 7108844 | + |
| SEQ ID NO 8218 | AAGCAGACCATGGAGCAGAGAC | CTG | chr17 | 7108837 | 7108858 | 7108854 | 7108859 | + |
| SEQ ID NO 8219 | TGCCAGGGGCTGGGCAGGAGGT | CTG | chr17 | 7108863 | 7108884 | 7108880 | 7108885 | + |
| SEQ ID NO 8220 | GGCAGGAGGTGGCCCTGTGGGA | CTG | chr17 | 7108875 | 7108896 | 7108892 | 7108897 | + |
| SEQ ID NO 8221 | TGGGAGAGGGGCATCAGGAGCC | CTG | chr17 | 7108892 | 7108913 | 7108909 | 7108914 | + |
| SEQ ID NO 8222 | GGTGTGGGGAGCCGGAGGGTAA | CTG | chr17 | 7108923 | 7108944 | 7108940 | 7108945 | + |
| SEQ ID NO 8223 | AGGAGGCATAACCTGGGCGGGG | CTG | chr17 | 7108965 | 7108986 | 7108982 | 7108987 | + |
| SEQ ID NO 8224 | GGCGGGGGGATTGGTTGGGGCC | CTG | chr17 | 7108980 | 7109001 | 7108997 | 7109002 | + |
| SEQ ID NO 8225 | GTTGGGGCCATGGGGGGGGGTC | TTG | chr17 | 7108993 | 7109014 | 7109010 | 7109015 | + |
| SEQ ID NO 8226 | GGGCCATGGGGGGGGGTCATCA | TTG | chr17 | 7108997 | 7109018 | 7109014 | 7109019 | + |
| SEQ ID NO 8227 | TGACCCCAGCATTTGAGCATTA | CTT | chr17 | 7109026 | 7109047 | 7109043 | 7109048 | + |
| SEQ ID NO 8228 | GACCCCAGCATTTGAGCATTAC | TTT | chr17 | 7109027 | 7109048 | 7109044 | 7109049 | + |
| SEQ ID NO 8229 | ACCCCAGCATTTGAGCATTACA | TTG | chr17 | 7109028 | 7109049 | 7109045 | 7109050 | + |
| SEQ ID NO 8230 | GAGCATTACACACACACTCTTA | TTT | chr17 | 7109040 | 7109061 | 7109057 | 7109062 | + |
| SEQ ID NO 8231 | AGCATTACACACACACTCTTAC | TTG | chr17 | 7109041 | 7109062 | 7109058 | 7109063 | + |
| SEQ ID NO 8232 | CACACACTCTTACACACTCG | TTA | chr17 | 7109048 | 7109069 | 7109065 | 7109070 | + |
| SEQ ID NO 8233 | TTACACACTCGCACCCATATTA | CTC | chr17 | 7109059 | 7109080 | 7109076 | 7109081 | + |
| SEQ ID NO 8234 | ACACACTCGCACCCATATTACC | CTT | chr17 | 7109061 | 7109082 | 7109078 | 7109083 | + |
| SEQ ID NO 8235 | CACACTCGCACCCATATTACCA | TTA | chr17 | 7109062 | 7109083 | 7109079 | 7109084 | + |
| SEQ ID NO 8236 | GCACCCATATTACCATGTATAA | CTC | chr17 | 7109069 | 7109090 | 7109086 | 7109091 | + |
| SEQ ID NO 8237 | CCATGTATAAATATACACACGC | TTA | chr17 | 7109081 | 7109102 | 7109098 | 7109103 | + |
| SEQ ID NO 8238 | ATCTGGTGCACACACACCCATG | CTA | chr17 | 7109108 | 7109129 | 7109125 | 7109130 | + |
| SEQ ID NO 8239 | GTGCACACACACCCATGCACAC | CTG | chr17 | 7109113 | 7109134 | 7109130 | 7109135 | + |
| SEQ ID NO 8240 | AGGATATTCACATCAGCTGTGT | CTC | chr17 | 7109140 | 7109161 | 7109157 | 7109162 | + |
| SEQ ID NO 8241 | ACATCAGCTGTGTGCAAAGCCC | TTC | chr17 | 7109149 | 7109170 | 7109166 | 7109171 | + |
| SEQ ID NO 8242 | TGTGCAAAGCCCGGATCCTGGA | CTG | chr17 | 7109159 | 7109180 | 7109176 | 7109181 | + |
| SEQ ID NO 8243 | GAGCTGGGGACTGGGAGACGC | CTG | chr17 | 7109179 | 7109200 | 7109196 | 7109201 | + |
| SEQ ID NO 8244 | GGGGACTGGGAGACGCACAGGG | CTG | chr17 | 7109185 | 7109206 | 7109202 | 7109207 | + |
| SEQ ID NO 8245 | GGAGACGCACAGGGGGCGGGG | CTG | chr17 | 7109193 | 7109214 | 7109210 | 7109215 | + |
| SEQ ID NO 8246 | CCTAGGCACACATCCTGAGAAG | CTG | chr17 | 7109231 | 7109252 | 7109248 | 7109253 | + |
| SEQ ID NO 8247 | GGCACACATCCTGAGAAGGGGG | CTA | chr17 | 7109235 | 7109256 | 7109252 | 7109257 | + |
| SEQ ID NO 8248 | AGAAGGGGGATCTGTGAATGGT | CTG | chr17 | 7109248 | 7109269 | 7109265 | 7109270 | + |
| SEQ ID NO 8249 | TGAATGGTTTTCCTCCCATCCA | CTG | chr17 | 7109262 | 7109283 | 7109279 | 7109284 | + |
| SEQ ID NO 8250 | TCCTCCCATCCAGCCAGTGGCA | TTT | chr17 | 7109272 | 7109293 | 7109289 | 7109294 | + |
| SEQ ID NO 8251 | CCTCCCATCCAGCCAGTGGCAG | TTT | chr17 | 7109273 | 7109294 | 7109290 | 7109295 | + |
| SEQ ID NO 8252 | CTCCCATCCAGCCAGTGGCAGA | TTC | chr17 | 7109274 | 7109295 | 7109291 | 7109296 | + |
| SEQ ID NO 8253 | CCATCCAGCCAGTGGCAGAGGC | CTC | chr17 | 7109277 | 7109298 | 7109294 | 7109299 | + |
| SEQ ID NO 8254 | CAGATCACCTCGGGCCTTAGTC | CTC | chr17 | 7109302 | 7109323 | 7109319 | 7109324 | + |
| SEQ ID NO 8255 | GGGCCTTAGTCTCAGCTCTTCT | CTC | chr17 | 7109313 | 7109334 | 7109330 | 7109335 | + |
| SEQ ID NO 8256 | AGTCTCAGCTCTTCTAAGGCTC | CTT | chr17 | 7109320 | 7109341 | 7109337 | 7109342 | + |
| SEQ ID NO 8257 | GTCTCAGCTCTTCTAAGGCTCC | TTA | chr17 | 7109321 | 7109342 | 7109338 | 7109343 | + |
| SEQ ID NO 8258 | AGCTCTTCTAAGGCTCCTGTCC | CTC | chr17 | 7109326 | 7109347 | 7109343 | 7109348 | + |

Figure 30 (Cont'd)

| | | | | | | | | |
|---|---|---|---|---|---|---|---|---|
| SEQ ID NO 8259 | TTCTAAGGCTCCTGTCCCCTCA | CTC | chr17 | 7109331 | 7109352 | 7109348 | 7109353 | + |
| SEQ ID NO 8260 | CTAAGGCTCCTGTCCCCTCAGA | CTT | chr17 | 7109333 | 7109354 | 7109350 | 7109355 | + |
| SEQ ID NO 8261 | TAAGGCTCCTGTCCCCTCAGAT | TTC | chr17 | 7109334 | 7109355 | 7109351 | 7109356 | + |
| SEQ ID NO 8262 | AGGCTCCTGTCCCCTCAGATTG | CTA | chr17 | 7109336 | 7109357 | 7109353 | 7109358 | + |
| SEQ ID NO 8263 | CTGTCCCCTCAGATTGGAGACT | CTC | chr17 | 7109342 | 7109363 | 7109359 | 7109364 | + |
| SEQ ID NO 8264 | TCCCCTCAGATTGGAGACTCCA | CTG | chr17 | 7109345 | 7109366 | 7109362 | 7109367 | + |
| SEQ ID NO 8265 | AGATTGGAGACTCCAGAAGCTG | CTC | chr17 | 7109352 | 7109373 | 7109369 | 7109374 | + |
| SEQ ID NO 8266 | GAGACTCCAGAAGCTGGGCCCT | TTG | chr17 | 7109358 | 7109379 | 7109375 | 7109380 | + |
| SEQ ID NO 8267 | CAGAAGCTGGGCCCTGTGTTCT | CTC | chr17 | 7109365 | 7109386 | 7109382 | 7109387 | + |
| SEQ ID NO 8268 | GGCCCTGTGTTCTTCCTAAAAT | CTG | chr17 | 7109374 | 7109395 | 7109391 | 7109396 | + |
| SEQ ID NO 8269 | TGTTCTTCCTAAAATCCATACT | CTG | chr17 | 7109381 | 7109402 | 7109398 | 7109403 | + |
| SEQ ID NO 8270 | TTCCTAAAATCCATACTGGAAC | TTC | chr17 | 7109386 | 7109407 | 7109403 | 7109408 | + |
| SEQ ID NO 8271 | CCTAAAATCCATACTGGAACAG | CTT | chr17 | 7109388 | 7109409 | 7109405 | 7109410 | + |
| SEQ ID NO 8272 | CTAAAATCCATACTGGAACAGT | TTC | chr17 | 7109389 | 7109410 | 7109406 | 7109411 | + |
| SEQ ID NO 8273 | AAATCCATACTGGAACAGTCCC | CTA | chr17 | 7109392 | 7109413 | 7109409 | 7109414 | + |
| SEQ ID NO 8274 | GAACAGTCCCTCCCCTGCCAAA | CTG | chr17 | 7109404 | 7109425 | 7109421 | 7109426 | + |
| SEQ ID NO 8275 | CCCTGCCAAAATTCCATTGAGA | CTC | chr17 | 7109416 | 7109437 | 7109433 | 7109438 | + |
| SEQ ID NO 8276 | CCAAAATTCCATTGAGATCCTT | CTG | chr17 | 7109421 | 7109442 | 7109438 | 7109443 | + |
| SEQ ID NO 8277 | CATTGAGATCCTTAAATCTGGG | TTC | chr17 | 7109430 | 7109451 | 7109447 | 7109452 | + |
| SEQ ID NO 8278 | AGATCCTTAAATCTGGGTCATT | TTG | chr17 | 7109435 | 7109456 | 7109452 | 7109457 | + |
| SEQ ID NO 8279 | AAATCTGGGTCATTCCACCATA | CTT | chr17 | 7109443 | 7109464 | 7109460 | 7109465 | + |
| SEQ ID NO 8280 | AATCTGGGTCATTCCACCATAG | TTA | chr17 | 7109444 | 7109465 | 7109461 | 7109466 | + |
| SEQ ID NO 8281 | GGTCATTCCACCATAGCCCACT | CTG | chr17 | 7109450 | 7109471 | 7109467 | 7109472 | + |
| SEQ ID NO 8282 | CACCATAGCCCACTCTCCAAGC | TTC | chr17 | 7109458 | 7109479 | 7109475 | 7109480 | + |
| SEQ ID NO 8283 | TCCAAGCACAACCCTCCAGGTC | CTC | chr17 | 7109473 | 7109494 | 7109490 | 7109495 | + |
| SEQ ID NO 8284 | CAAGCACAACCCTCCAGGTCCC | CTC | chr17 | 7109475 | 7109496 | 7109492 | 7109497 | + |
| SEQ ID NO 8285 | CAGGTCCCACCTGTTGTCCTCA | CTC | chr17 | 7109489 | 7109510 | 7109506 | 7109511 | + |
| SEQ ID NO 8286 | TTGTCCTCATCCCCACCACGC | CTG | chr17 | 7109502 | 7109523 | 7109519 | 7109524 | + |
| SEQ ID NO 8287 | TCCTCATCCCCACCACGCAAG | TTG | chr17 | 7109505 | 7109526 | 7109522 | 7109527 | + |
| SEQ ID NO 8288 | ATCCCCACCACGCAAGGCCTC | CTC | chr17 | 7109510 | 7109531 | 7109527 | 7109532 | + |
| SEQ ID NO 8289 | CTCCCCAGCGCCCTTTGCCCTC | CTC | chr17 | 7109532 | 7109553 | 7109549 | 7109554 | + |
| SEQ ID NO 8290 | CCCAGCGCCCTTTGCCCTCGCT | CTC | chr17 | 7109535 | 7109556 | 7109552 | 7109557 | + |
| SEQ ID NO 8291 | TGCCCTCGCTTCCCTAGAAACC | CTT | chr17 | 7109547 | 7109568 | 7109564 | 7109569 | + |
| SEQ ID NO 8292 | GCCCTCGCTTCCCTAGAAACCT | TTT | chr17 | 7109548 | 7109569 | 7109565 | 7109570 | + |
| SEQ ID NO 8293 | CCCTCGCTTCCCTAGAAACCTC | TTG | chr17 | 7109549 | 7109570 | 7109566 | 7109571 | + |
| SEQ ID NO 8294 | GCTTCCCTAGAAACCTCGTTCC | CTC | chr17 | 7109554 | 7109575 | 7109571 | 7109576 | + |
| SEQ ID NO 8295 | CCCTAGAAACCTCGTTCCACAC | CTT | chr17 | 7109558 | 7109579 | 7109575 | 7109580 | + |
| SEQ ID NO 8296 | CCTAGAAACCTCGTTCCACACT | TTC | chr17 | 7109559 | 7109580 | 7109576 | 7109581 | + |
| SEQ ID NO 8297 | GAAACCTCGTTCCACACTAAAT | CTA | chr17 | 7109563 | 7109584 | 7109580 | 7109585 | + |
| SEQ ID NO 8298 | GTTCCACACTAAATTTGCTCCC | CTC | chr17 | 7109571 | 7109592 | 7109588 | 7109593 | + |
| SEQ ID NO 8299 | CACACTAAATTTGCTCCCCTCA | TTC | chr17 | 7109575 | 7109596 | 7109592 | 7109597 | + |
| SEQ ID NO 8300 | AATTTGCTCCCCTCAGCCCGAG | CTA | chr17 | 7109582 | 7109603 | 7109599 | 7109604 | + |
| SEQ ID NO 8301 | GCTCCCCTCAGCCCGAGGTCAT | TTT | chr17 | 7109587 | 7109608 | 7109604 | 7109609 | + |
| SEQ ID NO 8302 | CTCCCCTCAGCCCGAGGTCATC | TTG | chr17 | 7109588 | 7109609 | 7109605 | 7109610 | + |
| SEQ ID NO 8303 | CCCTCAGCCCGAGGTCATCTCA | CTC | chr17 | 7109591 | 7109612 | 7109608 | 7109613 | + |
| SEQ ID NO 8304 | AGCCCGAGGTCATCTCACAGGT | CTC | chr17 | 7109596 | 7109617 | 7109613 | 7109618 | + |
| SEQ ID NO 8305 | ACAGGTACCTCTCCTGCCCCTT | CTC | chr17 | 7109612 | 7109633 | 7109629 | 7109634 | + |
| SEQ ID NO 8306 | TCCTGCCCCTTGATCCATCTGC | CTC | chr17 | 7109623 | 7109644 | 7109640 | 7109645 | + |
| SEQ ID NO 8307 | CTGCCCCTTGATCCATCTGCAC | CTC | chr17 | 7109625 | 7109646 | 7109642 | 7109647 | + |
| SEQ ID NO 8308 | CCCCTTGATCCATCTGCACCCT | CTG | chr17 | 7109628 | 7109649 | 7109645 | 7109650 | + |
| SEQ ID NO 8309 | GATCCATCTGCACCCTGACAGC | CTT | chr17 | 7109634 | 7109655 | 7109651 | 7109656 | + |
| SEQ ID NO 8310 | ATCCATCTGCACCCTGACAGCA | TTG | chr17 | 7109635 | 7109656 | 7109652 | 7109657 | + |
| SEQ ID NO 8311 | CACCCTGACAGCACTGACACAC | CTG | chr17 | 7109644 | 7109665 | 7109661 | 7109666 | + |
| SEQ ID NO 8312 | ACAGCACTGACACACACATTCA | CTG | chr17 | 7109651 | 7109672 | 7109668 | 7109673 | + |
| SEQ ID NO 8313 | ACACACATTCACATGCCCTC | CTG | chr17 | 7109660 | 7109681 | 7109677 | 7109682 | + |
| SEQ ID NO 8314 | ACATGCCCTCACAAACTCACAC | TTC | chr17 | 7109672 | 7109693 | 7109689 | 7109694 | + |
| SEQ ID NO 8315 | ACAAACTCACACACACTCACAC | CTC | chr17 | 7109682 | 7109703 | 7109699 | 7109704 | + |
| SEQ ID NO 8316 | ACACACACTCACACACTCACAC | CTC | chr17 | 7109690 | 7109711 | 7109707 | 7109712 | + |

Figure 30 (Cont'd)

| | | | | | | | | |
|---|---|---|---|---|---|---|---|---|
| SEQ ID NO 8317 | ACACACTCACACATTGCTCACT | CTC | chr17 | 7109700 | 7109721 | 7109717 | 7109722 | + |
| SEQ ID NO 8318 | ACACATTGCTCACTTCACTCAA | CTC | chr17 | 7109708 | 7109729 | 7109725 | 7109730 | + |
| SEQ ID NO 8319 | CTCACTTCACTCAAAAACACAC | TTG | chr17 | 7109716 | 7109737 | 7109733 | 7109738 | + |
| SEQ ID NO 8320 | ACTTCACTCAAAAACACACATT | CTC | chr17 | 7109719 | 7109740 | 7109736 | 7109741 | + |
| SEQ ID NO 8321 | CACTCAAAAACACACATTTGCA | CTT | chr17 | 7109723 | 7109744 | 7109740 | 7109745 | + |
| SEQ ID NO 8322 | ACTCAAAAACACACATTTGCAC | TTC | chr17 | 7109724 | 7109745 | 7109741 | 7109746 | + |
| SEQ ID NO 8323 | AAAAACACACATTTGCACACAC | CTC | chr17 | 7109728 | 7109749 | 7109745 | 7109750 | + |
| SEQ ID NO 8324 | GCACACACTCATGACCACGCTC | TTT | chr17 | 7109742 | 7109763 | 7109759 | 7109764 | + |
| SEQ ID NO 8325 | CACACACTCATGACCACGCTCT | TTG | chr17 | 7109743 | 7109764 | 7109760 | 7109765 | + |
| SEQ ID NO 8326 | ATGACCACGCTCTGCTGTACCC | CTC | chr17 | 7109752 | 7109773 | 7109769 | 7109774 | + |
| SEQ ID NO 8327 | TGCTGTACCCACTCTCACATGT | CTC | chr17 | 7109764 | 7109785 | 7109781 | 7109786 | + |
| SEQ ID NO 8328 | CTGTACCCACTCTCACATGTGC | CTG | chr17 | 7109766 | 7109787 | 7109783 | 7109788 | + |
| SEQ ID NO 8329 | TACCCACTCTCACATGTGCATA | CTG | chr17 | 7109769 | 7109790 | 7109786 | 7109791 | + |
| SEQ ID NO 8330 | TCACATGTGCATATGCATGCTA | CTC | chr17 | 7109778 | 7109799 | 7109795 | 7109800 | + |
| SEQ ID NO 8331 | ACATGTGCATATGCATGCTAAT | CTC | chr17 | 7109780 | 7109801 | 7109797 | 7109802 | + |
| SEQ ID NO 8332 | ATGCACACATTCATACTCCCTC | CTA | chr17 | 7109800 | 7109821 | 7109817 | 7109822 | + |
| SEQ ID NO 8333 | ATACTCCCTCCCACACACACAC | TTC | chr17 | 7109812 | 7109833 | 7109829 | 7109834 | + |
| SEQ ID NO 8334 | CCTCCCACACACACACACCTGA | CTC | chr17 | 7109818 | 7109839 | 7109835 | 7109840 | + |
| SEQ ID NO 8335 | CCACACACACACACCTGACACA | CTC | chr17 | 7109822 | 7109843 | 7109839 | 7109844 | + |
| SEQ ID NO 8336 | ACACACCCACACACGTACACTC | CTG | chr17 | 7109839 | 7109860 | 7109856 | 7109861 | + |
| SEQ ID NO 8337 | ACACACCCACGTCTTCCTGCAC | CTC | chr17 | 7109861 | 7109882 | 7109878 | 7109883 | + |
| SEQ ID NO 8338 | CCTGCACACAGAGCTGGGCTCC | CTT | chr17 | 7109876 | 7109897 | 7109893 | 7109898 | + |
| SEQ ID NO 8339 | CTGCACACAGAGCTGGGCTCCC | TTC | chr17 | 7109877 | 7109898 | 7109894 | 7109899 | + |
| SEQ ID NO 8340 | CACACAGAGCTGGGCTCCCTCT | CTG | chr17 | 7109880 | 7109901 | 7109897 | 7109902 | + |
| SEQ ID NO 8341 | GGCTCCCTCTCTGCTGCCTCCA | CTG | chr17 | 7109892 | 7109913 | 7109909 | 7109914 | + |
| SEQ ID NO 8342 | CCTCTCTGCTGCCTCCAGACCC | CTC | chr17 | 7109897 | 7109918 | 7109914 | 7109919 | + |
| SEQ ID NO 8343 | TCTGCTGCCTCCAGACCCAGAG | CTC | chr17 | 7109901 | 7109922 | 7109918 | 7109923 | + |
| SEQ ID NO 8344 | TGCTGCCTCCAGACCCAGAGCA | CTC | chr17 | 7109903 | 7109924 | 7109920 | 7109925 | + |
| SEQ ID NO 8345 | CTGCCTCCAGACCCAGAGCAGC | CTG | chr17 | 7109905 | 7109926 | 7109922 | 7109927 | + |
| SEQ ID NO 8346 | CCTCCAGACCCAGAGCAGCTCC | CTG | chr17 | 7109908 | 7109929 | 7109925 | 7109930 | + |
| SEQ ID NO 8347 | CAGACCCAGAGCAGCTCCAGTT | CTC | chr17 | 7109912 | 7109933 | 7109929 | 7109934 | + |
| SEQ ID NO 8348 | CAGTTGTCCCAGCCCTGAGCTC | CTC | chr17 | 7109929 | 7109950 | 7109946 | 7109951 | + |
| SEQ ID NO 8349 | TCCCAGCCCTGAGCTCCTCTCT | TTG | chr17 | 7109935 | 7109956 | 7109952 | 7109957 | + |
| SEQ ID NO 8350 | AGCTCCTCTCTTTGCAGCATCC | CTG | chr17 | 7109946 | 7109967 | 7109963 | 7109968 | + |
| SEQ ID NO 8351 | CTCTCTTTGCAGCATCCACCTG | CTC | chr17 | 7109951 | 7109972 | 7109968 | 7109973 | + |
| SEQ ID NO 8352 | TCTTTGCAGCATCCACCTGCAA | CTC | chr17 | 7109954 | 7109975 | 7109971 | 7109976 | + |
| SEQ ID NO 8353 | TTTGCAGCATCCACCTGCAAAC | CTC | chr17 | 7109956 | 7109977 | 7109973 | 7109978 | + |
| SEQ ID NO 8354 | TGCAGCATCCACCTGCAAACAG | CTT | chr17 | 7109958 | 7109979 | 7109975 | 7109980 | + |
| SEQ ID NO 8355 | GCAGCATCCACCTGCAAACAGA | TTT | chr17 | 7109959 | 7109980 | 7109976 | 7109981 | + |
| SEQ ID NO 8356 | CAGCATCCACCTGCAAACAGAA | TTG | chr17 | 7109960 | 7109981 | 7109977 | 7109982 | + |
| SEQ ID NO 8357 | CAAACAGAACACCTTCTAGGCC | CTG | chr17 | 7109973 | 7109994 | 7109990 | 7109995 | + |
| SEQ ID NO 8358 | CTAGGCCTTGGACCCTGACTCT | CTT | chr17 | 7109988 | 7110009 | 7110005 | 7110010 | + |
| SEQ ID NO 8359 | TAGGCCTTGGACCCTGACTCTG | TTC | chr17 | 7109989 | 7110010 | 7110006 | 7110011 | + |
| SEQ ID NO 8360 | GGCCTTGGACCCTGACTCTGTG | CTA | chr17 | 7109991 | 7110012 | 7110008 | 7110013 | + |
| SEQ ID NO 8361 | GGACCCTGACTCTGTGGACTTC | CTT | chr17 | 7109997 | 7110018 | 7110014 | 7110019 | + |
| SEQ ID NO 8362 | GACCCTGACTCTGTGGACTTCC | TTG | chr17 | 7109998 | 7110019 | 7110015 | 7110020 | + |
| SEQ ID NO 8363 | ACTCTGTGGACTTCCTTGTCTT | CTG | chr17 | 7110005 | 7110026 | 7110022 | 7110027 | + |
| SEQ ID NO 8364 | TGTGGACTTCCTTGTCTTCTCA | CTC | chr17 | 7110009 | 7110030 | 7110026 | 7110031 | + |
| SEQ ID NO 8365 | TGGACTTCCTTGTCTTCTCATT | CTG | chr17 | 7110011 | 7110032 | 7110028 | 7110033 | + |
| SEQ ID NO 8366 | CCTTGTCTTCTCATTCCTATCA | CTT | chr17 | 7110018 | 7110039 | 7110035 | 7110040 | + |
| SEQ ID NO 8367 | CTTGTCTTCTCATTCCTATCAC | TTC | chr17 | 7110019 | 7110040 | 7110036 | 7110041 | + |
| SEQ ID NO 8368 | GTCTTCTCATTCCTATCACCCC | CTT | chr17 | 7110022 | 7110043 | 7110039 | 7110044 | + |
| SEQ ID NO 8369 | TCTTCTCATTCCTATCACCCCC | TTG | chr17 | 7110023 | 7110044 | 7110040 | 7110045 | + |
| SEQ ID NO 8370 | CTCATTCCTATCACCCCCGAC | CTT | chr17 | 7110027 | 7110048 | 7110044 | 7110049 | + |
| SEQ ID NO 8371 | TCATTCCTATCACCCCCGACC | TTC | chr17 | 7110028 | 7110049 | 7110045 | 7110050 | + |
| SEQ ID NO 8372 | ATTCCTATCACCCCCGACCCA | CTC | chr17 | 7110030 | 7110051 | 7110047 | 7110052 | + |
| SEQ ID NO 8373 | CTATCACCCCCGACCCAGCAG | TTC | chr17 | 7110034 | 7110055 | 7110051 | 7110056 | + |
| SEQ ID NO 8374 | TCACCCCCGACCCAGCAGGAC | CTA | chr17 | 7110037 | 7110058 | 7110054 | 7110059 | + |

Figure 30 (Cont'd)

| SEQ ID NO 8375 | GGGAGGCTCAGTCAGGGGCCCA | CTG | chr17 | 7110068 | 7110089 | 7110085 | 7110090 | + |
|---|---|---|---|---|---|---|---|---|
| SEQ ID NO 8376 | AGTCAGGGGCCCAGAATCTTCC | CTC | chr17 | 7110077 | 7110098 | 7110094 | 7110099 | + |
| SEQ ID NO 8377 | CCTCCCCAGGTCACTTCCTGCC | CTT | chr17 | 7110097 | 7110118 | 7110114 | 7110119 | + |
| SEQ ID NO 8378 | CTCCCCAGGTCACTTCCTGCCA | TTC | chr17 | 7110098 | 7110119 | 7110115 | 7110120 | + |
| SEQ ID NO 8379 | CCCAGGTCACTTCCTGCCACTG | CTC | chr17 | 7110101 | 7110122 | 7110118 | 7110123 | + |
| SEQ ID NO 8380 | CCTGCCACTGTCCTGAGTCAGA | CTT | chr17 | 7110113 | 7110134 | 7110130 | 7110135 | + |
| SEQ ID NO 8381 | CTGCCACTGTCCTGAGTCAGAC | TTC | chr17 | 7110114 | 7110135 | 7110131 | 7110136 | + |
| SEQ ID NO 8382 | CCACTGTCCTGAGTCAGACACT | CTG | chr17 | 7110117 | 7110138 | 7110134 | 7110139 | + |
| SEQ ID NO 8383 | TCCTGAGTCAGACACTGCCCCT | CTG | chr17 | 7110123 | 7110144 | 7110140 | 7110145 | + |
| SEQ ID NO 8384 | AGTCAGACACTGCCCCTGTAAG | CTG | chr17 | 7110128 | 7110149 | 7110145 | 7110150 | + |
| SEQ ID NO 8385 | CCCCTGTAAGTGACTGTCCATA | CTG | chr17 | 7110140 | 7110161 | 7110157 | 7110162 | + |
| SEQ ID NO 8386 | TAAGTGACTGTCCATAACTCTT | CTG | chr17 | 7110146 | 7110167 | 7110163 | 7110168 | + |
| SEQ ID NO 8387 | TCCATAACTCTTCATCTTTTTC | CTG | chr17 | 7110156 | 7110177 | 7110173 | 7110178 | + |
| SEQ ID NO 8388 | TTCATCTTTTTCACACCAGTGA | CTC | chr17 | 7110166 | 7110187 | 7110183 | 7110188 | + |
| SEQ ID NO 8389 | CATCTTTTTCACACCAGTGACT | CTT | chr17 | 7110168 | 7110189 | 7110185 | 7110190 | + |
| SEQ ID NO 8390 | ATCTTTTTCACACCAGTGACTT | TTC | chr17 | 7110169 | 7110190 | 7110186 | 7110191 | + |
| SEQ ID NO 8391 | TTTCACACCAGTGACTTCCACC | CTT | chr17 | 7110174 | 7110195 | 7110191 | 7110196 | + |
| SEQ ID NO 8392 | TTCACACCAGTGACTTCCACCT | TTT | chr17 | 7110175 | 7110196 | 7110192 | 7110197 | + |
| SEQ ID NO 8393 | TCACACCAGTGACTTCCACCTT | TTT | chr17 | 7110176 | 7110197 | 7110193 | 7110198 | + |
| SEQ ID NO 8394 | CACACCAGTGACTTCCACCTTC | TTT | chr17 | 7110177 | 7110198 | 7110194 | 7110199 | + |
| SEQ ID NO 8395 | ACACCAGTGACTTCCACCTTCC | TTC | chr17 | 7110178 | 7110199 | 7110195 | 7110200 | + |
| SEQ ID NO 8396 | CCACCTTCCCCACTGCAGCCAC | CTT | chr17 | 7110191 | 7110212 | 7110208 | 7110213 | + |
| SEQ ID NO 8397 | CACCTTCCCCACTGCAGCCACA | TTC | chr17 | 7110192 | 7110213 | 7110209 | 7110214 | + |
| SEQ ID NO 8398 | CCCCACTGCAGCCACACTCAGG | CTT | chr17 | 7110198 | 7110219 | 7110215 | 7110220 | + |
| SEQ ID NO 8399 | CCCACTGCAGCCACACTCAGGA | TTC | chr17 | 7110199 | 7110220 | 7110216 | 7110221 | + |
| SEQ ID NO 8400 | CAGCCACACTCAGGACCCCATT | CTG | chr17 | 7110206 | 7110227 | 7110223 | 7110228 | + |
| SEQ ID NO 8401 | AGGACCCCATTTGACCCAGGGA | CTC | chr17 | 7110217 | 7110238 | 7110234 | 7110239 | + |
| SEQ ID NO 8402 | GACCCAGGGAGGCCTCTGACAC | TTT | chr17 | 7110229 | 7110250 | 7110246 | 7110251 | + |
| SEQ ID NO 8403 | ACCCAGGGAGGCCTCTGACACC | TTG | chr17 | 7110230 | 7110251 | 7110247 | 7110252 | + |
| SEQ ID NO 8404 | TGACCTCCACTGCCCACTCC | CTC | chr17 | 7110245 | 7110266 | 7110262 | 7110267 | + |
| SEQ ID NO 8405 | ACACCTCCACTGCCCACTCCCG | CTG | chr17 | 7110247 | 7110268 | 7110264 | 7110269 | + |
| SEQ ID NO 8406 | CACTGCCCACTCCCGCTCTGAG | CTC | chr17 | 7110254 | 7110275 | 7110271 | 7110276 | + |
| SEQ ID NO 8407 | CCCACTCCCGCTCTGAGCACAG | CTG | chr17 | 7110259 | 7110280 | 7110276 | 7110281 | + |
| SEQ ID NO 8408 | CCGCTCTGAGCACAGCCCCACC | CTC | chr17 | 7110266 | 7110287 | 7110283 | 7110288 | + |
| SEQ ID NO 8409 | TGAGCACAGCCCCACCCTCCCT | CTC | chr17 | 7110272 | 7110293 | 7110289 | 7110294 | + |
| SEQ ID NO 8410 | AGCACAGCCCCACCCTCCCTCT | CTG | chr17 | 7110274 | 7110295 | 7110291 | 7110296 | + |
| SEQ ID NO 8411 | CCTCTCACTGCCCCCACCCCTT | CTC | chr17 | 7110291 | 7110312 | 7110308 | 7110313 | + |
| SEQ ID NO 8412 | TCACTGCCCCACCCCTTCCTC | CTC | chr17 | 7110295 | 7110316 | 7110312 | 7110317 | + |
| SEQ ID NO 8413 | ACTGCCCCACCCCTTCCTCCA | CTC | chr17 | 7110297 | 7110318 | 7110314 | 7110319 | + |
| SEQ ID NO 8414 | CCCCCACCCCTTCCTCCAAGGC | CTG | chr17 | 7110301 | 7110322 | 7110318 | 7110323 | + |
| SEQ ID NO 8415 | CCTCCAAGGCCTTTGCATTCCT | CTT | chr17 | 7110313 | 7110334 | 7110330 | 7110335 | + |
| SEQ ID NO 8416 | CTCCAAGGCCTTTGCATTCCTC | TTC | chr17 | 7110314 | 7110335 | 7110331 | 7110336 | + |
| SEQ ID NO 8417 | CAAGGCCTTTGCATTCCTCTCC | CTC | chr17 | 7110317 | 7110338 | 7110334 | 7110339 | + |
| SEQ ID NO 8418 | TGCATTCCTCTCCATCCAGAAG | CTT | chr17 | 7110326 | 7110347 | 7110343 | 7110348 | + |
| SEQ ID NO 8419 | GCATTCCTCTCCATCCAGAAGC | TTT | chr17 | 7110327 | 7110348 | 7110344 | 7110349 | + |
| SEQ ID NO 8420 | CATTCCTCTCCATCCAGAAGCG | TTG | chr17 | 7110328 | 7110349 | 7110345 | 7110350 | + |
| SEQ ID NO 8421 | CTCTCCATCCAGAAGCGCTCCA | TTC | chr17 | 7110333 | 7110354 | 7110350 | 7110355 | + |
| SEQ ID NO 8422 | TCCATCCAGAAGCGCTCCATGA | CTC | chr17 | 7110336 | 7110357 | 7110353 | 7110358 | + |
| SEQ ID NO 8423 | CATCCAGAAGCGCTCCATGACC | CTC | chr17 | 7110338 | 7110359 | 7110355 | 7110360 | + |
| SEQ ID NO 8424 | CATGACCACGGTGTTCCCCACC | CTC | chr17 | 7110353 | 7110374 | 7110370 | 7110375 | + |
| SEQ ID NO 8425 | CCCACCAAGCTGGCCCTCCATG | TTC | chr17 | 7110369 | 7110390 | 7110386 | 7110391 | + |
| SEQ ID NO 8426 | GCCCTCCATGGCTGAGTCCCTG | CTG | chr17 | 7110381 | 7110402 | 7110398 | 7110403 | + |
| SEQ ID NO 8427 | CATGGCTGAGTCCCTGACTGCT | CTC | chr17 | 7110387 | 7110408 | 7110404 | 7110409 | + |
| SEQ ID NO 8428 | AGTCCCTGACTGCTGTCTTCAG | CTG | chr17 | 7110395 | 7110416 | 7110412 | 7110417 | + |
| SEQ ID NO 8429 | ACTGCTGTCTTCAGCACCCTCC | CTG | chr17 | 7110403 | 7110424 | 7110420 | 7110425 | + |
| SEQ ID NO 8430 | CTGTCTTCAGCACCCTCCACTC | CTG | chr17 | 7110407 | 7110428 | 7110424 | 7110429 | + |
| SEQ ID NO 8431 | TCTTCAGCACCCTCCACTCAGA | CTG | chr17 | 7110410 | 7110431 | 7110427 | 7110432 | + |
| SEQ ID NO 8432 | CAGCACCCTCCACTCAGAGGGT | CTT | chr17 | 7110414 | 7110435 | 7110431 | 7110436 | + |

Figure 30 (Cont'd)

| | | | | | | | | |
|---|---|---|---|---|---|---|---|---|
| SEQ ID NO 8433 | AGCACCCTCCACTCAGAGGGTC | TTC | chr17 | 7110415 | 7110436 | 7110432 | 7110437 | + |
| SEQ ID NO 8434 | CACTCAGAGGGTCCTGTCCTGC | CTC | chr17 | 7110424 | 7110445 | 7110441 | 7110446 | + |
| SEQ ID NO 8435 | AGAGGGTCCTGTCCTGCTTCCC | CTC | chr17 | 7110429 | 7110450 | 7110446 | 7110451 | + |
| SEQ ID NO 8436 | TCCTGCTTCCCAGTCCGACTTA | CTG | chr17 | 7110440 | 7110461 | 7110457 | 7110462 | + |
| SEQ ID NO 8437 | CTTCCCAGTCCGACTTATCAAC | CTG | chr17 | 7110445 | 7110466 | 7110462 | 7110467 | + |
| SEQ ID NO 8438 | CCCAGTCCGACTTATCAACTCC | CTT | chr17 | 7110448 | 7110469 | 7110465 | 7110470 | + |
| SEQ ID NO 8439 | CCAGTCCGACTTATCAACTCCC | TTC | chr17 | 7110449 | 7110470 | 7110466 | 7110471 | + |
| SEQ ID NO 8440 | ATCAACTCCCAATGCTGGGTCA | CTT | chr17 | 7110461 | 7110482 | 7110478 | 7110483 | + |
| SEQ ID NO 8441 | TCAACTCCCAATGCTGGGTCAG | TTA | chr17 | 7110462 | 7110483 | 7110479 | 7110484 | + |
| SEQ ID NO 8442 | CCAATGCTGGGTCAGCCCAGCA | CTC | chr17 | 7110469 | 7110490 | 7110486 | 7110491 | + |
| SEQ ID NO 8443 | GGTCAGCCCAGCAACGTGTCTG | CTG | chr17 | 7110478 | 7110499 | 7110495 | 7110500 | + |
| SEQ ID NO 8444 | TATATCCACCCTGAAACCAGAC | CTG | chr17 | 7110500 | 7110521 | 7110517 | 7110522 | + |
| SEQ ID NO 8445 | AAACCAGACTGCCCACAGGGTA | CTG | chr17 | 7110513 | 7110534 | 7110530 | 7110535 | + |
| SEQ ID NO 8446 | CCCACAGGGTAGCCCAGCTGTG | CTG | chr17 | 7110524 | 7110545 | 7110541 | 7110546 | + |
| SEQ ID NO 8447 | TGCCTCCAGGTAGCTCTGAGAT | CTG | chr17 | 7110544 | 7110565 | 7110561 | 7110566 | + |
| SEQ ID NO 8448 | CAGGTAGCTCTGAGATCATGCA | CTC | chr17 | 7110550 | 7110571 | 7110567 | 7110572 | + |
| SEQ ID NO 8449 | TGAGATCATGCACCAGCATTCA | CTC | chr17 | 7110560 | 7110581 | 7110577 | 7110582 | + |
| SEQ ID NO 8450 | AGATCATGCACCAGCATTCAAT | CTG | chr17 | 7110562 | 7110583 | 7110579 | 7110584 | + |
| SEQ ID NO 8451 | AATTTCTCCATGCTTCCATTTT | TTC | chr17 | 7110581 | 7110602 | 7110598 | 7110603 | + |
| SEQ ID NO 8452 | CTCCATGCTTCCATTTTCTCGT | TTT | chr17 | 7110586 | 7110607 | 7110603 | 7110608 | + |
| SEQ ID NO 8453 | TCCATGCTTCCATTTTCTCGTG | TTC | chr17 | 7110587 | 7110608 | 7110604 | 7110609 | + |
| SEQ ID NO 8454 | CATGCTTCCATTTTCTCGTGTG | CTC | chr17 | 7110589 | 7110610 | 7110606 | 7110611 | + |
| SEQ ID NO 8455 | CCATTTTCTCGTGTGTAAAATG | CTT | chr17 | 7110596 | 7110617 | 7110613 | 7110618 | + |
| SEQ ID NO 8456 | CATTTTCTCGTGTGTAAAATGG | TTC | chr17 | 7110597 | 7110618 | 7110614 | 7110619 | + |
| SEQ ID NO 8457 | TCTCGTGTGTAAAATGGAGATC | TTT | chr17 | 7110602 | 7110623 | 7110619 | 7110624 | + |
| SEQ ID NO 8458 | CTCGTGTGTAAAATGGAGATCA | TTT | chr17 | 7110603 | 7110624 | 7110620 | 7110625 | + |
| SEQ ID NO 8459 | TCGTGTGTAAAATGGAGATCAC | TTC | chr17 | 7110604 | 7110625 | 7110621 | 7110626 | + |
| SEQ ID NO 8460 | GTGTGTAAAATGGAGATCACAG | CTC | chr17 | 7110606 | 7110627 | 7110623 | 7110628 | + |
| SEQ ID NO 8461 | CCCGATTGGATTGCTCGGATAA | CTA | chr17 | 7110637 | 7110658 | 7110654 | 7110659 | + |
| SEQ ID NO 8462 | GATTGCTCGGATAATTAGATGA | TTG | chr17 | 7110645 | 7110666 | 7110662 | 7110667 | + |
| SEQ ID NO 8463 | CTCGGATAATTAGATGAGTTAA | TTG | chr17 | 7110650 | 7110671 | 7110667 | 7110672 | + |
| SEQ ID NO 8464 | GGATAATTAGATGAGTTAAAAT | CTC | chr17 | 7110653 | 7110674 | 7110670 | 7110675 | + |
| SEQ ID NO 8465 | GATGAGTTAAAATATGTAATGT | TTA | chr17 | 7110662 | 7110683 | 7110679 | 7110684 | + |
| SEQ ID NO 8466 | AAATATGTAATGTGCTTCTTAG | TTA | chr17 | 7110671 | 7110692 | 7110688 | 7110693 | + |
| SEQ ID NO 8467 | CTTAGGCAAAAGTTTGAACATA | CTT | chr17 | 7110688 | 7110709 | 7110705 | 7110710 | + |
| SEQ ID NO 8468 | TTAGGCAAAAGTTTGAACATAA | TTC | chr17 | 7110689 | 7110710 | 7110706 | 7110711 | + |
| SEQ ID NO 8469 | AGGCAAAAGTTTGAACATAAAA | CTT | chr17 | 7110691 | 7110712 | 7110708 | 7110713 | + |
| SEQ ID NO 8470 | GGCAAAAGTTTGAACATAAAAG | TTA | chr17 | 7110692 | 7110713 | 7110709 | 7110714 | + |
| SEQ ID NO 8471 | GAACATAAAAGACAGGGTCTGC | TTT | chr17 | 7110703 | 7110724 | 7110720 | 7110725 | + |
| SEQ ID NO 8472 | AACATAAAAGACAGGGTCTGCC | TTG | chr17 | 7110704 | 7110725 | 7110721 | 7110726 | + |
| SEQ ID NO 8473 | CCCAAGATGGGAAGAGTTCTTC | CTG | chr17 | 7110724 | 7110745 | 7110741 | 7110746 | + |
| SEQ ID NO 8474 | TTCTCTCCCCAGAAACAATCAA | TTC | chr17 | 7110743 | 7110764 | 7110760 | 7110765 | + |
| SEQ ID NO 8475 | CTCTCCCCAGAAACAATCAAAA | CTT | chr17 | 7110745 | 7110766 | 7110762 | 7110767 | + |
| SEQ ID NO 8476 | TCTCCCCAGAAACAATCAAAAC | TTC | chr17 | 7110746 | 7110767 | 7110763 | 7110768 | + |
| SEQ ID NO 8477 | TCCCCAGAAACAATCAAAACAA | CTC | chr17 | 7110748 | 7110769 | 7110765 | 7110770 | + |
| SEQ ID NO 8478 | CCCAGAAACAATCAAAACAAAA | CTC | chr17 | 7110750 | 7110771 | 7110767 | 7110772 | + |
| SEQ ID NO 8479 | TAGAACATGGCAGCTTTCAAGA | CTA | chr17 | 7110783 | 7110804 | 7110800 | 7110805 | + |
| SEQ ID NO 8480 | TCAAGACTCTGGACATCAGGCA | CTT | chr17 | 7110799 | 7110820 | 7110816 | 7110821 | + |
| SEQ ID NO 8481 | CAAGACTCTGGACATCAGGCAA | TTT | chr17 | 7110800 | 7110821 | 7110817 | 7110822 | + |
| SEQ ID NO 8482 | AAGACTCTGGACATCAGGCAAG | TTC | chr17 | 7110801 | 7110822 | 7110818 | 7110823 | + |
| SEQ ID NO 8483 | TGGACATCAGGCAAGGAGGAGT | CTC | chr17 | 7110808 | 7110829 | 7110825 | 7110830 | + |
| SEQ ID NO 8484 | GACATCAGGCAAGGAGGAGTAA | CTG | chr17 | 7110810 | 7110831 | 7110827 | 7110832 | + |
| SEQ ID NO 8485 | AGGGATAAGAAGCAAACAACAG | CTG | chr17 | 7110841 | 7110862 | 7110858 | 7110863 | + |
| SEQ ID NO 8486 | CGATCACCCCAGCTTACTGTTT | CTC | chr17 | 7110871 | 7110892 | 7110888 | 7110893 | + |
| SEQ ID NO 8487 | ACTGTTTGGAGAGAGTCTGCAG | CTT | chr17 | 7110886 | 7110907 | 7110903 | 7110908 | + |
| SEQ ID NO 8488 | CTGTTTGGAGAGAGTCTGCAGG | TTA | chr17 | 7110887 | 7110908 | 7110904 | 7110909 | + |
| SEQ ID NO 8489 | TTTGGAGAGAGTCTGCAGGTTA | CTG | chr17 | 7110890 | 7110911 | 7110907 | 7110912 | + |
| SEQ ID NO 8490 | GGAGAGAGTCTGCAGGTTACAG | TTT | chr17 | 7110893 | 7110914 | 7110910 | 7110915 | + |

Figure 30 (Cont'd)

| SEQ ID NO 8491 | GAGAGAGTCTGCAGGTTACAGG | TTG | chr17 | 7110894 | 7110915 | 7110911 | 7110916 | + |
|---|---|---|---|---|---|---|---|---|
| SEQ ID NO 8492 | CAGGTTACAGGCCAGGAAAGGG | CTG | chr17 | 7110905 | 7110926 | 7110922 | 7110927 | + |
| SEQ ID NO 8493 | CAGGCCAGGAAAGGGAAGTCCA | TTA | chr17 | 7110912 | 7110933 | 7110929 | 7110934 | + |
| SEQ ID NO 8494 | CCCACGTTGAGGAGATGGAGCT | CTC | chr17 | 7110953 | 7110974 | 7110970 | 7110975 | + |
| SEQ ID NO 8495 | AGGAGATGGAGCTGAGAGTCCG | TTG | chr17 | 7110962 | 7110983 | 7110979 | 7110984 | + |
| SEQ ID NO 8496 | AGAGTCCGAGGAGACCAAAACA | CTG | chr17 | 7110976 | 7110997 | 7110993 | 7110998 | + |
| SEQ ID NO 8497 | AGAGTTCAAACGATCAAACTGA | TTA | chr17 | 7111002 | 7111023 | 7111019 | 7111024 | + |
| SEQ ID NO 8498 | AAACGATCAAACTGACTCTAAG | TTC | chr17 | 7111009 | 7111030 | 7111026 | 7111031 | + |
| SEQ ID NO 8499 | ACTCTAAGTTGCTTAACTGCAT | CTG | chr17 | 7111023 | 7111044 | 7111040 | 7111045 | + |
| SEQ ID NO 8500 | TAAGTTGCTTAACTGCATCCCG | CTC | chr17 | 7111027 | 7111048 | 7111044 | 7111049 | + |
| SEQ ID NO 8501 | AGTTGCTTAACTGCATCCCGGA | CTA | chr17 | 7111029 | 7111050 | 7111046 | 7111051 | + |
| SEQ ID NO 8502 | CTTAACTGCATCCCGGAGCAAA | TTG | chr17 | 7111034 | 7111055 | 7111051 | 7111056 | + |
| SEQ ID NO 8503 | AACTGCATCCCGGAGCAAAGCT | CTT | chr17 | 7111037 | 7111058 | 7111054 | 7111059 | + |
| SEQ ID NO 8504 | ACTGCATCCCGGAGCAAAGCTC | TTA | chr17 | 7111038 | 7111059 | 7111055 | 7111060 | + |
| SEQ ID NO 8505 | CATCCCGGAGCAAAGCTCAAGA | CTG | chr17 | 7111042 | 7111063 | 7111059 | 7111064 | + |
| SEQ ID NO 8506 | AAGAACATTTAGAGGAATACAA | CTC | chr17 | 7111060 | 7111081 | 7111077 | 7111082 | + |
| SEQ ID NO 8507 | AGAGGAATACAAAAATATCCAG | TTT | chr17 | 7111070 | 7111091 | 7111087 | 7111092 | + |
| SEQ ID NO 8508 | GAGGAATACAAAAATATCCAGC | TTA | chr17 | 7111071 | 7111092 | 7111088 | 7111093 | + |
| SEQ ID NO 8509 | ACAATGTCTGGCAGCCAATCAA | TTG | chr17 | 7111112 | 7111133 | 7111129 | 7111134 | + |
| SEQ ID NO 8510 | GCAGCCAATCAAAGATTACAAG | CTG | chr17 | 7111122 | 7111143 | 7111139 | 7111144 | + |
| SEQ ID NO 8511 | CAAGGCATGCAATGAAACGGGA | TTA | chr17 | 7111140 | 7111161 | 7111157 | 7111162 | + |
| SEQ ID NO 8512 | ATAAATATCAAAAGAGATCCAG | TTC | chr17 | 7111188 | 7111209 | 7111205 | 7111210 | + |
| SEQ ID NO 8513 | ACACGGATGCTAGAATTAGCAG | CTG | chr17 | 7111215 | 7111236 | 7111232 | 7111237 | + |
| SEQ ID NO 8514 | GAATTAGCAGGCAAGGATGGTA | CTA | chr17 | 7111227 | 7111248 | 7111244 | 7111249 | + |
| SEQ ID NO 8515 | GCAGGCAAGGATGGTAAAACAG | TTA | chr17 | 7111233 | 7111254 | 7111250 | 7111255 | + |
| SEQ ID NO 8516 | TAGCCATATCCCATTATGTTCA | TTA | chr17 | 7111261 | 7111282 | 7111278 | 7111283 | + |
| SEQ ID NO 8517 | TGTTCAAAAAATTAAGTAGAAT | TTA | chr17 | 7111277 | 7111298 | 7111294 | 7111299 | + |
| SEQ ID NO 8518 | AAAAAATTAAGTAGAATTGTGG | TTC | chr17 | 7111282 | 7111303 | 7111299 | 7111304 | + |
| SEQ ID NO 8519 | AGTAGAATTGTGGAGGATATTT | TTA | chr17 | 7111291 | 7111312 | 7111308 | 7111313 | + |
| SEQ ID NO 8520 | TGGAGGATATTTAAGAGTCCCC | TTG | chr17 | 7111301 | 7111322 | 7111318 | 7111323 | + |
| SEQ ID NO 8521 | AAGAGTCCCCAGGTGAACTTCT | TTT | chr17 | 7111313 | 7111334 | 7111330 | 7111335 | + |
| SEQ ID NO 8522 | AGAGTCCCCAGGTGAACTTCTA | TTA | chr17 | 7111314 | 7111335 | 7111331 | 7111336 | + |
| SEQ ID NO 8523 | CTAGAGATAAAAACTACAATGT | CTT | chr17 | 7111333 | 7111354 | 7111350 | 7111355 | + |
| SEQ ID NO 8524 | TAGAGATAAAAACTACAATGTC | TTC | chr17 | 7111334 | 7111355 | 7111351 | 7111356 | + |
| SEQ ID NO 8525 | GAGATAAAAACTACAATGTCTG | CTA | chr17 | 7111336 | 7111357 | 7111353 | 7111358 | + |
| SEQ ID NO 8526 | CAATGTCTGAAATGAAAAAACA | CTA | chr17 | 7111349 | 7111370 | 7111366 | 7111371 | + |
| SEQ ID NO 8527 | AAATGAAAAAACACACTGGCCA | CTG | chr17 | 7111358 | 7111379 | 7111375 | 7111380 | + |
| SEQ ID NO 8528 | GCCAGGCGCCGTGGCTCACGCC | CTG | chr17 | 7111376 | 7111397 | 7111393 | 7111398 | + |
| SEQ ID NO 8529 | ACGCCTGGAATCCCAGCACTGT | CTC | chr17 | 7111393 | 7111414 | 7111410 | 7111415 | + |
| SEQ ID NO 8530 | GAATCCCAGCACTGTGGGAGGC | CTG | chr17 | 7111400 | 7111421 | 7111417 | 7111422 | + |
| SEQ ID NO 8531 | TGGGAGGCCAAGGCGGGCAGAT | CTG | chr17 | 7111414 | 7111435 | 7111431 | 7111436 | + |
| SEQ ID NO 8532 | GCTAACATGGTGAAACCCCATC | CTG | chr17 | 7111465 | 7111486 | 7111482 | 7111487 | + |
| SEQ ID NO 8533 | ACATGGTGAAACCCCATCTCTA | CTA | chr17 | 7111469 | 7111490 | 7111486 | 7111491 | + |
| SEQ ID NO 8534 | TACTAAAAATACAAAAAATTAG | CTC | chr17 | 7111489 | 7111510 | 7111506 | 7111511 | + |
| SEQ ID NO 8535 | CTAAAAATACAAAAAATTAGCC | CTA | chr17 | 7111491 | 7111512 | 7111508 | 7111513 | + |
| SEQ ID NO 8536 | AAAATACAAAAAATTAGCCAGA | CTA | chr17 | 7111494 | 7111515 | 7111511 | 7111516 | + |
| SEQ ID NO 8537 | GCCAGACGTGGTGGCAGGCGCC | TTA | chr17 | 7111510 | 7111531 | 7111527 | 7111532 | + |
| SEQ ID NO 8538 | TAGTCCCAGCTACTCGGGAGGC | CTG | chr17 | 7111534 | 7111555 | 7111551 | 7111556 | + |
| SEQ ID NO 8539 | CTCGGGAGGCTGAGGCAGGAGA | CTA | chr17 | 7111546 | 7111567 | 7111563 | 7111568 | + |
| SEQ ID NO 8540 | GGGAGGCTGAGGCAGGAGAATG | CTC | chr17 | 7111549 | 7111570 | 7111566 | 7111571 | + |
| SEQ ID NO 8541 | AGGCAGGAGAATGGCATGAACC | CTG | chr17 | 7111558 | 7111579 | 7111575 | 7111580 | + |
| SEQ ID NO 8542 | GCAGTGAGCCAAGATCGCGCCA | CTT | chr17 | 7111595 | 7111616 | 7111612 | 7111617 | + |
| SEQ ID NO 8543 | CAGTGAGCCAAGATCGCGCCAC | TTG | chr17 | 7111596 | 7111617 | 7111613 | 7111618 | + |
| SEQ ID NO 8544 | CACTCCGGCCTGGGCAACAGAG | CTG | chr17 | 7111620 | 7111641 | 7111637 | 7111642 | + |
| SEQ ID NO 8545 | CGGCCTGGGCAACAGAGCGAGA | CTC | chr17 | 7111625 | 7111646 | 7111642 | 7111647 | + |
| SEQ ID NO 8546 | GGCAACAGAGCGAGACTCCGCC | CTG | chr17 | 7111632 | 7111653 | 7111649 | 7111654 | + |
| SEQ ID NO 8547 | CGCCTCCAAAAAAAAAAAAAAG | CTC | chr17 | 7111650 | 7111671 | 7111667 | 7111672 | + |
| SEQ ID NO 8548 | CAAAAAAAAAAAAAGAAAAGA | CTC | chr17 | 7111656 | 7111677 | 7111673 | 7111678 | + |

Figure 30 (Cont'd)

| SEQ ID NO 8549 | GATGGAAATAATGGAAGATGAG | CTG | chr17 | 7111699 | 7111720 | 7111716 | 7111721 | + |
| SEQ ID NO 8550 | AGGGCCAGGCACTGTGGATCAC | TTT | chr17 | 7111740 | 7111761 | 7111757 | 7111762 | + |
| SEQ ID NO 8551 | GGGCCAGGCACTGTGGATCACA | TTA | chr17 | 7111741 | 7111762 | 7111758 | 7111763 | + |
| SEQ ID NO 8552 | TGGATCACATCTGTAATCCCAG | CTG | chr17 | 7111754 | 7111775 | 7111771 | 7111776 | + |
| SEQ ID NO 8553 | TAATCCCAGCACTTTGGGAGGT | CTG | chr17 | 7111767 | 7111788 | 7111784 | 7111789 | + |
| SEQ ID NO 8554 | TGGGAGGTCGACACGGGGGGAA | CTT | chr17 | 7111781 | 7111802 | 7111798 | 7111803 | + |
| SEQ ID NO 8555 | GGGAGGTCGACACGGGGGGAAT | TTT | chr17 | 7111782 | 7111803 | 7111799 | 7111804 | + |
| SEQ ID NO 8556 | GGAGGTCGACACGGGGGGAATC | TTG | chr17 | 7111783 | 7111804 | 7111800 | 7111805 | + |
| SEQ ID NO 8557 | GAGCCCAGGAGCTCAAGACTAG | CTT | chr17 | 7111809 | 7111830 | 7111826 | 7111831 | + |
| SEQ ID NO 8558 | AGCCCAGGAGCTCAAGACTAGT | TTG | chr17 | 7111810 | 7111831 | 7111827 | 7111832 | + |
| SEQ ID NO 8559 | AAGACTAGTCTGGGCAGCATGG | CTC | chr17 | 7111823 | 7111844 | 7111840 | 7111845 | + |
| SEQ ID NO 8560 | GTCTGGGCAGCATGGCAAAACC | CTA | chr17 | 7111830 | 7111851 | 7111847 | 7111852 | + |
| SEQ ID NO 8561 | GGCAGCATGGCAAAACCCCTCT | CTG | chr17 | 7111835 | 7111856 | 7111852 | 7111857 | + |
| SEQ ID NO 8562 | TACATGGCAAAACCGTCTCTAC | CTC | chr17 | 7111856 | 7111877 | 7111873 | 7111878 | + |
| SEQ ID NO 8563 | CATGGCAAAACCGTCTCTACAA | CTA | chr17 | 7111858 | 7111879 | 7111875 | 7111880 | + |
| SEQ ID NO 8564 | TACAAAAAAAAATTTTTAATTA | CTC | chr17 | 7111875 | 7111896 | 7111892 | 7111897 | + |
| SEQ ID NO 8565 | CAAAAAAAAATTTTTAATTAGC | CTA | chr17 | 7111877 | 7111898 | 7111894 | 7111899 | + |
| SEQ ID NO 8566 | TTAATTAGCCAGGTGTGGTGCC | TTT | chr17 | 7111890 | 7111911 | 7111907 | 7111912 | + |
| SEQ ID NO 8567 | TAATTAGCCAGGTGTGGTGCCA | TTT | chr17 | 7111891 | 7111912 | 7111908 | 7111913 | + |
| SEQ ID NO 8568 | AATTAGCCAGGTGTGGTGCCAC | TTT | chr17 | 7111892 | 7111913 | 7111909 | 7111914 | + |
| SEQ ID NO 8569 | ATTAGCCAGGTGTGGTGCCACA | TTA | chr17 | 7111893 | 7111914 | 7111910 | 7111915 | + |
| SEQ ID NO 8570 | GCCAGGTGTGGTGCCACATGCC | TTA | chr17 | 7111897 | 7111918 | 7111914 | 7111919 | + |
| SEQ ID NO 8571 | TAGTCCCAGCTACCTGGGAGGC | CTA | chr17 | 7111921 | 7111942 | 7111938 | 7111943 | + |
| SEQ ID NO 8572 | CCTGGGAGGCTGAAGTGGAAGG | CTA | chr17 | 7111933 | 7111954 | 7111950 | 7111955 | + |
| SEQ ID NO 8573 | GGAGGCTGAAGTGGAAGGATCG | CTG | chr17 | 7111937 | 7111958 | 7111954 | 7111959 | + |
| SEQ ID NO 8574 | AAGTGGAAGGATCGCCTGAGCC | CTG | chr17 | 7111945 | 7111966 | 7111962 | 7111967 | + |
| SEQ ID NO 8575 | AGCCCAGGAGGTGGAGGCCACA | CTG | chr17 | 7111963 | 7111984 | 7111980 | 7111985 | + |
| SEQ ID NO 8576 | TGACAAGCTACTGCATTCCAGC | TTG | chr17 | 7111993 | 7112014 | 7112010 | 7112015 | + |
| SEQ ID NO 8577 | CTGCATTCCAGCCTGGGCAACA | CTA | chr17 | 7112003 | 7112024 | 7112020 | 7112025 | + |
| SEQ ID NO 8578 | CATTCCAGCCTGGGCAACAGAG | CTG | chr17 | 7112006 | 7112027 | 7112023 | 7112028 | + |
| SEQ ID NO 8579 | CAGCCTGGGCAACAGAGTGAGA | TTC | chr17 | 7112011 | 7112032 | 7112028 | 7112033 | + |
| SEQ ID NO 8580 | GGCAACAGAGTGAGATGAGAGA | CTG | chr17 | 7112018 | 7112039 | 7112035 | 7112040 | + |
| SEQ ID NO 8581 | TAGTTAACTTAATGAACAGCAA | TTT | chr17 | 7112107 | 7112128 | 7112124 | 7112129 | + |
| SEQ ID NO 8582 | AGTTAACTTAATGAACAGCAAT | TTT | chr17 | 7112108 | 7112129 | 7112125 | 7112130 | + |
| SEQ ID NO 8583 | GTTAACTTAATGAACAGCAATA | TTA | chr17 | 7112109 | 7112130 | 7112126 | 7112131 | + |
| SEQ ID NO 8584 | ACTTAATGAACAGCAATAACTC | TTA | chr17 | 7112113 | 7112134 | 7112130 | 7112135 | + |
| SEQ ID NO 8585 | AATGAACAGCAATAACTCTATA | CTT | chr17 | 7112117 | 7112138 | 7112134 | 7112139 | + |
| SEQ ID NO 8586 | ATGAACAGCAATAACTCTATAA | TTA | chr17 | 7112118 | 7112139 | 7112135 | 7112140 | + |
| SEQ ID NO 8587 | TATAAAATGAAACACTGGGAGA | CTC | chr17 | 7112135 | 7112156 | 7112152 | 7112157 | + |
| SEQ ID NO 8588 | TAAAATGAAACACTGGGAGAAA | CTA | chr17 | 7112137 | 7112158 | 7112154 | 7112159 | + |
| SEQ ID NO 8589 | GGAGAAAAAGAATTAAAAAAAT | CTG | chr17 | 7112152 | 7112173 | 7112169 | 7112174 | + |
| SEQ ID NO 8590 | AAAAATGGAAAGAGAATGAGTG | TTA | chr17 | 7112168 | 7112189 | 7112185 | 7112190 | + |
| SEQ ID NO 8591 | TGGGACCCTTAATACATGCATA | CTG | chr17 | 7112195 | 7112216 | 7112212 | 7112217 | + |
| SEQ ID NO 8592 | AATACATGCATAATTGAAATCT | CTT | chr17 | 7112205 | 7112226 | 7112222 | 7112227 | + |
| SEQ ID NO 8593 | ATACATGCATAATTGAAATCTT | TTA | chr17 | 7112206 | 7112227 | 7112223 | 7112228 | + |
| SEQ ID NO 8594 | AAATCTTTAAAAGAAAAGGGG | TTG | chr17 | 7112221 | 7112242 | 7112238 | 7112243 | + |
| SEQ ID NO 8595 | TAAAAGAAAAGGGGGTAGCAG | CTT | chr17 | 7112228 | 7112249 | 7112245 | 7112250 | + |
| SEQ ID NO 8596 | AAAAGAAAAGGGGGTAGCAGA | TTT | chr17 | 7112229 | 7112250 | 7112246 | 7112251 | + |
| SEQ ID NO 8597 | AAAGAAAAGGGGGTAGCAGAA | TTA | chr17 | 7112230 | 7112251 | 7112247 | 7112252 | + |
| SEQ ID NO 8598 | AGACAAGTGGAAGATGGGCCCC | CTG | chr17 | 7112267 | 7112288 | 7112284 | 7112289 | + |
| SEQ ID NO 8599 | ATCAGTGTCAGCTCCCATGATG | CTG | chr17 | 7112301 | 7112322 | 7112318 | 7112323 | + |
| SEQ ID NO 8600 | CCATGATGACGTTCCCCCAGCC | CTC | chr17 | 7112315 | 7112336 | 7112332 | 7112337 | + |
| SEQ ID NO 8601 | CCCCAGCCCCCACCACCCGGGC | TTC | chr17 | 7112329 | 7112350 | 7112346 | 7112351 | + |
| SEQ ID NO 8602 | CTGGAGGGAAATGCGGTGACTT | CTG | chr17 | 7112353 | 7112374 | 7112370 | 7112375 | + |
| SEQ ID NO 8603 | GAGGGAAATGCGGTGACTTTGC | CTG | chr17 | 7112356 | 7112377 | 7112373 | 7112378 | + |
| SEQ ID NO 8604 | TGCTACATCCCTTCAGACGGTC | CTT | chr17 | 7112375 | 7112396 | 7112392 | 7112397 | + |
| SEQ ID NO 8605 | GCTACATCCCTTCAGACGGTCC | TTT | chr17 | 7112376 | 7112397 | 7112393 | 7112398 | + |
| SEQ ID NO 8606 | CTACATCCCTTCAGACGGTCCC | TTG | chr17 | 7112377 | 7112398 | 7112394 | 7112399 | + |

Figure 30 (Cont'd)

| SEQ ID NO | Sequence | Codon | Chr | Pos1 | Pos2 | Pos3 | Pos4 | Strand |
|---|---|---|---|---|---|---|---|---|
| SEQ ID NO 8607 | CATCCCTTCAGACGGTCCCTCA | CTA | chr17 | 7112380 | 7112401 | 7112397 | 7112402 | + |
| SEQ ID NO 8608 | CAGACGGTCCCTCACTGGTGTC | CTT | chr17 | 7112388 | 7112409 | 7112405 | 7112410 | + |
| SEQ ID NO 8609 | AGACGGTCCCTCACTGGTGTCC | TTC | chr17 | 7112389 | 7112410 | 7112406 | 7112411 | + |
| SEQ ID NO 8610 | ACTGGTGTCCCTCAGCCCATTC | CTC | chr17 | 7112401 | 7112422 | 7112418 | 7112423 | + |
| SEQ ID NO 8611 | GTGTCCCTCAGCCCATTCGCGT | CTG | chr17 | 7112405 | 7112426 | 7112422 | 7112427 | + |
| SEQ ID NO 8612 | AGCCCATTCGCGTGAGCTCACT | CTC | chr17 | 7112414 | 7112435 | 7112431 | 7112436 | + |
| SEQ ID NO 8613 | GCGTGAGCTCACTCTCCCATTA | TTC | chr17 | 7112423 | 7112444 | 7112440 | 7112445 | + |
| SEQ ID NO 8614 | ACTCTCCCATTAATTTCAGAAA | CTC | chr17 | 7112433 | 7112454 | 7112450 | 7112455 | + |
| SEQ ID NO 8615 | TCCCATTAATTTCAGAAATCCT | CTC | chr17 | 7112437 | 7112458 | 7112454 | 7112459 | + |
| SEQ ID NO 8616 | CCATTAATTTCAGAAATCCTGG | CTC | chr17 | 7112439 | 7112460 | 7112456 | 7112461 | + |
| SEQ ID NO 8617 | ATTTCAGAAATCCTGGCCTCTC | TTA | chr17 | 7112445 | 7112466 | 7112462 | 7112467 | + |
| SEQ ID NO 8618 | CAGAAATCCTGGCCTCTCTCCA | TTT | chr17 | 7112449 | 7112470 | 7112466 | 7112471 | + |
| SEQ ID NO 8619 | AGAAATCCTGGCCTCTCTCCAA | TTC | chr17 | 7112450 | 7112471 | 7112467 | 7112472 | + |
| SEQ ID NO 8620 | GCCTCTCTCCAAGCCTCCTGCT | CTG | chr17 | 7112460 | 7112481 | 7112477 | 7112482 | + |
| SEQ ID NO 8621 | TCTCCAAGCCTCCTGCTCAAAC | CTC | chr17 | 7112465 | 7112486 | 7112482 | 7112487 | + |
| SEQ ID NO 8622 | TCCAAGCCTCCTGCTCAAACTC | CTC | chr17 | 7112467 | 7112488 | 7112484 | 7112489 | + |
| SEQ ID NO 8623 | CAAGCCTCCTGCTCAAACTCTA | CTC | chr17 | 7112469 | 7112490 | 7112486 | 7112491 | + |
| SEQ ID NO 8624 | CTGCTCAAACTCTAAATTCTGT | CTC | chr17 | 7112477 | 7112498 | 7112494 | 7112499 | + |
| SEQ ID NO 8625 | CTCAAACTCTAAATTCTGTCAC | CTG | chr17 | 7112480 | 7112501 | 7112497 | 7112502 | + |
| SEQ ID NO 8626 | AAACTCTAAATTCTGTCACCCT | CTC | chr17 | 7112483 | 7112504 | 7112500 | 7112505 | + |
| SEQ ID NO 8627 | TAAATTCTGTCACCCTCAGAAG | CTC | chr17 | 7112489 | 7112510 | 7112506 | 7112511 | + |
| SEQ ID NO 8628 | AATTCTGTCACCCTCAGAAGAT | CTA | chr17 | 7112491 | 7112512 | 7112508 | 7112513 | + |
| SEQ ID NO 8629 | TGTCACCCTCAGAAGATTCAGC | TTC | chr17 | 7112496 | 7112517 | 7112513 | 7112518 | + |
| SEQ ID NO 8630 | TCACCCTCAGAAGATTCAGCAG | CTG | chr17 | 7112498 | 7112519 | 7112515 | 7112520 | + |
| SEQ ID NO 8631 | AGAAGATTCAGCAGCATCCCGT | CTC | chr17 | 7112506 | 7112527 | 7112523 | 7112528 | + |
| SEQ ID NO 8632 | AGCAGCATCCCGTATTCTCTCT | TTC | chr17 | 7112515 | 7112536 | 7112532 | 7112537 | + |
| SEQ ID NO 8633 | TCTCTGAGTGTTCACTATGTAC | TTC | chr17 | 7112532 | 7112553 | 7112549 | 7112554 | + |
| SEQ ID NO 8634 | TCTGAGTGTTCACTATGTACCG | CTC | chr17 | 7112534 | 7112555 | 7112551 | 7112556 | + |
| SEQ ID NO 8635 | TGAGTGTTCACTATGTACCGGG | CTC | chr17 | 7112536 | 7112557 | 7112553 | 7112558 | + |
| SEQ ID NO 8636 | AGTGTTCACTATGTACCGGGTG | CTG | chr17 | 7112538 | 7112559 | 7112555 | 7112560 | + |
| SEQ ID NO 8637 | ACTATGTACCGGGTGCCGTGTG | TTC | chr17 | 7112545 | 7112566 | 7112562 | 7112567 | + |
| SEQ ID NO 8638 | TGTACCGGGTGCCGTGTGGGCA | CTA | chr17 | 7112549 | 7112570 | 7112566 | 7112571 | + |
| SEQ ID NO 8639 | GAGTTGCAGAGGAGAGTGAGGC | CTG | chr17 | 7112574 | 7112595 | 7112591 | 7112596 | + |
| SEQ ID NO 8640 | CAGAGGAGAGTGAGGCGGACAG | TTG | chr17 | 7112580 | 7112601 | 7112597 | 7112602 | + |
| SEQ ID NO 8641 | TGCCTGTGGGGACACCGCCTGG | CTC | chr17 | 7112608 | 7112629 | 7112625 | 7112630 | + |
| SEQ ID NO 8642 | CCTGTGGGGACACCGCCTGGTG | CTG | chr17 | 7112610 | 7112631 | 7112627 | 7112632 | + |
| SEQ ID NO 8643 | TGGGGACACCGCCTGGTGGGAA | CTG | chr17 | 7112614 | 7112635 | 7112631 | 7112636 | + |
| SEQ ID NO 8644 | GTGGGAAGTCCAGCCAGCCCCC | CTG | chr17 | 7112629 | 7112650 | 7112646 | 7112651 | + |
| SEQ ID NO 8645 | CAGAGAGAGGAGATGCTACTGG | CTA | chr17 | 7112653 | 7112674 | 7112670 | 7112675 | + |
| SEQ ID NO 8646 | CTGGTGTTCCTGAGTGGTCCTC | CTA | chr17 | 7112671 | 7112692 | 7112688 | 7112693 | + |
| SEQ ID NO 8647 | GTGTTCCTGAGTGGTCCTCGGG | CTG | chr17 | 7112674 | 7112695 | 7112691 | 7112696 | + |
| SEQ ID NO 8648 | CTGAGTGGTCCTCGGGAGGGAC | TTC | chr17 | 7112680 | 7112701 | 7112697 | 7112702 | + |
| SEQ ID NO 8649 | AGTGGTCCTCGGGAGGGACCTC | CTG | chr17 | 7112683 | 7112704 | 7112700 | 7112705 | + |
| SEQ ID NO 8650 | GGGAGGGACCTCCTATCCCTCC | CTC | chr17 | 7112693 | 7112714 | 7112710 | 7112715 | + |
| SEQ ID NO 8651 | CTATCCCTCCTGTCCCTGCCC | CTC | chr17 | 7112705 | 7112726 | 7112722 | 7112727 | + |
| SEQ ID NO 8652 | TCCCTCCTGTCCCTGCCCTGC | CTA | chr17 | 7112708 | 7112729 | 7112725 | 7112730 | + |
| SEQ ID NO 8653 | CTGTCCCTGCCCTGCCCTGCC | CTC | chr17 | 7112714 | 7112735 | 7112731 | 7112736 | + |
| SEQ ID NO 8654 | TCCCTGCCCTGCCCTGCCCAG | CTG | chr17 | 7112717 | 7112738 | 7112734 | 7112739 | + |
| SEQ ID NO 8655 | CCCTGCCCTGCCCAGCACCGGC | CTG | chr17 | 7112724 | 7112745 | 7112741 | 7112746 | + |
| SEQ ID NO 8656 | CCCTGCCCAGCACCGGCCCTCC | CTG | chr17 | 7112729 | 7112750 | 7112746 | 7112751 | + |
| SEQ ID NO 8657 | CCCAGCACCGGCCCTCCCTCGG | CTG | chr17 | 7112734 | 7112755 | 7112751 | 7112756 | + |
| SEQ ID NO 8658 | CCTCGGTTGGCCAGCCTCAGGA | CTC | chr17 | 7112750 | 7112771 | 7112767 | 7112772 | + |
| SEQ ID NO 8659 | GGTTGGCCAGCCTCAGGAATGA | CTC | chr17 | 7112754 | 7112775 | 7112771 | 7112776 | + |
| SEQ ID NO 8660 | GCCAGCCTCAGGAATGAGGAGT | TTG | chr17 | 7112759 | 7112780 | 7112776 | 7112781 | + |
| SEQ ID NO 8661 | AGGAATGAGGAGTCCCTCATTC | CTC | chr17 | 7112768 | 7112789 | 7112785 | 7112790 | + |
| SEQ ID NO 8662 | ATTCCAGCCCAGCTAACCAATC | CTC | chr17 | 7112786 | 7112807 | 7112803 | 7112808 | + |
| SEQ ID NO 8663 | CAGCCCAGCTAACCAATCCCCT | TTC | chr17 | 7112790 | 7112811 | 7112807 | 7112812 | + |
| SEQ ID NO 8664 | ACCAATCCCCTTCCTAAGCTCC | CTA | chr17 | 7112801 | 7112822 | 7112818 | 7112823 | + |

Figure 30 (Cont'd)

| | | | | | | | | |
|---|---|---|---|---|---|---|---|---|
| SEQ ID NO 8665 | CCTAAGCTCCAAGCCCCTGCTC | CTT | chr17 | 7112813 | 7112834 | 7112830 | 7112835 | + |
| SEQ ID NO 8666 | CTAAGCTCCAAGCCCCTGCTCC | TTC | chr17 | 7112814 | 7112835 | 7112831 | 7112836 | + |
| SEQ ID NO 8667 | AGCTCCAAGCCCCTGCTCCTCC | CTA | chr17 | 7112817 | 7112838 | 7112834 | 7112839 | + |
| SEQ ID NO 8668 | CAAGCCCCTGCTCCTCCTGCCT | CTC | chr17 | 7112822 | 7112843 | 7112839 | 7112844 | + |
| SEQ ID NO 8669 | CTCCTCCTGCCTCCATGGAACC | CTG | chr17 | 7112832 | 7112853 | 7112849 | 7112854 | + |
| SEQ ID NO 8670 | CTCCTGCCTCCATGGAACCCGG | CTC | chr17 | 7112835 | 7112856 | 7112852 | 7112857 | + |
| SEQ ID NO 8671 | CTGCCTCCATGGAACCCGGCTC | CTC | chr17 | 7112838 | 7112859 | 7112855 | 7112860 | + |
| SEQ ID NO 8672 | CCTCCATGGAACCCGGCTCCAC | CTG | chr17 | 7112841 | 7112862 | 7112858 | 7112863 | + |
| SEQ ID NO 8673 | CATGGAACCCGGCTCCACCACC | CTC | chr17 | 7112845 | 7112866 | 7112862 | 7112867 | + |
| SEQ ID NO 8674 | CACCACCAGCACCCACACACCT | CTC | chr17 | 7112860 | 7112881 | 7112877 | 7112882 | + |
| SEQ ID NO 8675 | ACACTCCTCCATTCCTGGCTCT | CTG | chr17 | 7112883 | 7112904 | 7112900 | 7112905 | + |
| SEQ ID NO 8676 | CTCCATTCCTGGCTCTTGCCCT | CTC | chr17 | 7112889 | 7112910 | 7112906 | 7112911 | + |
| SEQ ID NO 8677 | CATTCCTGGCTCTTGCCCTTCT | CTC | chr17 | 7112892 | 7112913 | 7112909 | 7112914 | + |
| SEQ ID NO 8678 | CTGGCTCTTGCCCTTCTGCCTA | TTC | chr17 | 7112897 | 7112918 | 7112914 | 7112919 | + |
| SEQ ID NO 8679 | GCTCTTGCCCTTCTGCCTAGCA | CTG | chr17 | 7112900 | 7112921 | 7112917 | 7112922 | + |
| SEQ ID NO 8680 | TTGCCCTTCTGCCTAGCACTGC | CTC | chr17 | 7112904 | 7112925 | 7112921 | 7112926 | + |
| SEQ ID NO 8681 | GCCCTTCTGCCTAGCACTGCTC | CTT | chr17 | 7112906 | 7112927 | 7112923 | 7112928 | + |
| SEQ ID NO 8682 | CCCTTCTGCCTAGCACTGCTCA | TTG | chr17 | 7112907 | 7112928 | 7112924 | 7112929 | + |
| SEQ ID NO 8683 | CTGCCTAGCACTGCTCAGATCT | CTT | chr17 | 7112912 | 7112933 | 7112929 | 7112934 | + |
| SEQ ID NO 8684 | TGCCTAGCACTGCTCAGATCTC | TTC | chr17 | 7112913 | 7112934 | 7112930 | 7112935 | + |
| SEQ ID NO 8685 | CCTAGCACTGCTCAGATCTCTC | CTG | chr17 | 7112915 | 7112936 | 7112932 | 7112937 | + |
| SEQ ID NO 8686 | GCACTGCTCAGATCTCTCTCAC | CTA | chr17 | 7112919 | 7112940 | 7112936 | 7112941 | + |
| SEQ ID NO 8687 | CTCAGATCTCTCTCACCTTAAA | CTG | chr17 | 7112925 | 7112946 | 7112942 | 7112947 | + |
| SEQ ID NO 8688 | AGATCTCTCTCACCTTAAAATC | CTC | chr17 | 7112928 | 7112949 | 7112945 | 7112950 | + |
| SEQ ID NO 8689 | TCTCACCTTAAAATCTTTTCCC | CTC | chr17 | 7112935 | 7112956 | 7112952 | 7112957 | + |
| SEQ ID NO 8690 | TCACCTTAAAATCTTTTCCCAC | CTC | chr17 | 7112937 | 7112958 | 7112954 | 7112959 | + |
| SEQ ID NO 8691 | ACCTTAAAATCTTTTCCCACCA | CTC | chr17 | 7112939 | 7112960 | 7112956 | 7112961 | + |
| SEQ ID NO 8692 | AAAATCTTTTCCCACCAGCCTG | CTT | chr17 | 7112944 | 7112965 | 7112961 | 7112966 | + |
| SEQ ID NO 8693 | AAATCTTTTCCCACCAGCCTGG | TTA | chr17 | 7112945 | 7112966 | 7112962 | 7112967 | + |
| SEQ ID NO 8694 | TTCCCACCAGCCTGGGCAACAT | CTT | chr17 | 7112952 | 7112973 | 7112969 | 7112974 | + |
| SEQ ID NO 8695 | TCCCACCAGCCTGGGCAACATA | TTT | chr17 | 7112953 | 7112974 | 7112970 | 7112975 | + |
| SEQ ID NO 8696 | CCCACCAGCCTGGGCAACATAG | TTT | chr17 | 7112954 | 7112975 | 7112971 | 7112976 | + |
| SEQ ID NO 8697 | CCACCAGCCTGGGCAACATAGC | TTC | chr17 | 7112955 | 7112976 | 7112972 | 7112977 | + |
| SEQ ID NO 8698 | GGCAACATAGCAAGACCCCATT | CTG | chr17 | 7112966 | 7112987 | 7112983 | 7112988 | + |
| SEQ ID NO 8699 | CTCTAAAAAATTTTTTTTAATT | TTT | chr17 | 7112989 | 7113010 | 7113006 | 7113011 | + |
| SEQ ID NO 8700 | TCTAAAAAATTTTTTTTAATTT | TTC | chr17 | 7112990 | 7113011 | 7113007 | 7113012 | + |
| SEQ ID NO 8701 | TAAAAAATTTTTTTTAATTTGC | CTC | chr17 | 7112992 | 7113013 | 7113009 | 7113014 | + |
| SEQ ID NO 8702 | AAAAATTTTTTTTAATTTGCCA | CTA | chr17 | 7112994 | 7113015 | 7113011 | 7113016 | + |
| SEQ ID NO 8703 | TTTTTAATTTGCCAGGCACAGT | TTT | chr17 | 7113002 | 7113023 | 7113019 | 7113024 | + |
| SEQ ID NO 8704 | TTTTAATTTGCCAGGCACAGTG | TTT | chr17 | 7113003 | 7113024 | 7113020 | 7113025 | + |
| SEQ ID NO 8705 | TTTAATTTGCCAGGCACAGTGG | TTT | chr17 | 7113004 | 7113025 | 7113021 | 7113026 | + |
| SEQ ID NO 8706 | TTAATTTGCCAGGCACAGTGGT | TTT | chr17 | 7113005 | 7113026 | 7113022 | 7113027 | + |
| SEQ ID NO 8707 | TAATTTGCCAGGCACAGTGGTG | TTT | chr17 | 7113006 | 7113027 | 7113023 | 7113028 | + |
| SEQ ID NO 8708 | AATTTGCCAGGCACAGTGGTGC | TTT | chr17 | 7113007 | 7113028 | 7113024 | 7113029 | + |
| SEQ ID NO 8709 | ATTTGCCAGGCACAGTGGTGCA | TTA | chr17 | 7113008 | 7113029 | 7113025 | 7113030 | + |
| SEQ ID NO 8710 | GCCAGGCACAGTGGTGCACACC | TTT | chr17 | 7113012 | 7113033 | 7113029 | 7113034 | + |
| SEQ ID NO 8711 | CCAGGCACAGTGGTGCACACCT | TTG | chr17 | 7113013 | 7113034 | 7113030 | 7113035 | + |
| SEQ ID NO 8712 | TAAGTCCTAACTACTTGGGAGG | CTG | chr17 | 7113036 | 7113057 | 7113053 | 7113058 | + |
| SEQ ID NO 8713 | ACTACTTGGGAGGCTGAGGTGG | CTA | chr17 | 7113045 | 7113066 | 7113062 | 7113067 | + |
| SEQ ID NO 8714 | CTTGGGAGGCTGAGGTGGGAGG | CTA | chr17 | 7113049 | 7113070 | 7113066 | 7113071 | + |
| SEQ ID NO 8715 | GGGAGGCTGAGGTGGGAGGATG | CTT | chr17 | 7113052 | 7113073 | 7113069 | 7113074 | + |
| SEQ ID NO 8716 | GGAGGCTGAGGTGGGAGGATGG | TTG | chr17 | 7113053 | 7113074 | 7113070 | 7113075 | + |
| SEQ ID NO 8717 | AGGTGGGAGGATGGCTTGAGCC | CTG | chr17 | 7113061 | 7113082 | 7113078 | 7113083 | + |
| SEQ ID NO 8718 | GAGCCCAGGAGTTCGAGGTTGC | CTT | chr17 | 7113078 | 7113099 | 7113095 | 7113100 | + |
| SEQ ID NO 8719 | AGCCCAGGAGTTCGAGGTTGCA | TTG | chr17 | 7113079 | 7113100 | 7113096 | 7113101 | + |
| SEQ ID NO 8720 | GAGGTTGCAGTGAGCTATGATC | TTC | chr17 | 7113092 | 7113113 | 7113109 | 7113114 | + |
| SEQ ID NO 8721 | CAGTGAGCTATGATCCTGCCAC | TTG | chr17 | 7113099 | 7113120 | 7113116 | 7113121 | + |
| SEQ ID NO 8722 | TGATCCTGCCACTACACTCCTG | CTA | chr17 | 7113109 | 7113130 | 7113126 | 7113131 | + |

Figure 30 (Cont'd)

| | | | | | | | | |
|---|---|---|---|---|---|---|---|---|
| SEQ ID NO 8723 | CCACTACACTCCTGTCTCTAAA | CTG | chr17 | 7113117 | 7113138 | 7113134 | 7113139 | + |
| SEQ ID NO 8724 | CACTCCTGTCTCTAAAAAAAAA | CTA | chr17 | 7113123 | 7113144 | 7113140 | 7113145 | + |
| SEQ ID NO 8725 | CTGTCTCTAAAAAAAAAATGTC | CTC | chr17 | 7113128 | 7113149 | 7113145 | 7113150 | + |
| SEQ ID NO 8726 | TCTCTAAAAAAAAAATGTCCAA | CTG | chr17 | 7113131 | 7113152 | 7113148 | 7113153 | + |
| SEQ ID NO 8727 | TAAAAAAAAAATGTCCAAGATA | CTC | chr17 | 7113135 | 7113156 | 7113152 | 7113157 | + |
| SEQ ID NO 8728 | AAAAAAAAATGTCCAAGATACT | CTA | chr17 | 7113137 | 7113158 | 7113154 | 7113159 | + |
| SEQ ID NO 8729 | AGGTCCTTCAGTCAAGATTTAT | CTT | chr17 | 7113160 | 7113181 | 7113177 | 7113182 | + |
| SEQ ID NO 8730 | GGTCCTTCAGTCAAGATTTATT | TTA | chr17 | 7113161 | 7113182 | 7113178 | 7113183 | + |
| SEQ ID NO 8731 | CAGTCAAGATTTATTACAGAAG | CTT | chr17 | 7113168 | 7113189 | 7113185 | 7113190 | + |
| SEQ ID NO 8732 | AGTCAAGATTTATTACAGAAGG | TTC | chr17 | 7113169 | 7113190 | 7113186 | 7113191 | + |
| SEQ ID NO 8733 | ATTACAGAAGGATCCAGGGAAG | TTT | chr17 | 7113180 | 7113201 | 7113197 | 7113202 | + |
| SEQ ID NO 8734 | TTACAGAAGGATCCAGGGAAGG | TTA | chr17 | 7113181 | 7113202 | 7113198 | 7113203 | + |
| SEQ ID NO 8735 | CAGAAGGATCCAGGGAAGGGTC | TTA | chr17 | 7113184 | 7113205 | 7113201 | 7113206 | + |
| SEQ ID NO 8736 | GGGAGATGAGAGGAGCAGGGAT | CTT | chr17 | 7113208 | 7113229 | 7113225 | 7113230 | + |
| SEQ ID NO 8737 | GGAGATGAGAGGAGCAGGGATC | TTG | chr17 | 7113209 | 7113230 | 7113226 | 7113231 | + |
| SEQ ID NO 8738 | CCAGGATCTCTCTGTGCTCACG | CTT | chr17 | 7113233 | 7113254 | 7113250 | 7113255 | + |
| SEQ ID NO 8739 | CAGGATCTCTCTGTGCTCACGT | TTC | chr17 | 7113234 | 7113255 | 7113251 | 7113256 | + |
| SEQ ID NO 8740 | TCTGTGCTCACGTCCCCACCC | CTC | chr17 | 7113243 | 7113264 | 7113260 | 7113265 | + |
| SEQ ID NO 8741 | TGTGCTCACGTCCCCACCCAT | CTC | chr17 | 7113245 | 7113266 | 7113262 | 7113267 | + |
| SEQ ID NO 8742 | TGCTCACGTCCCCACCCATCC | CTG | chr17 | 7113247 | 7113268 | 7113264 | 7113269 | + |
| SEQ ID NO 8743 | ACGTCCCCACCCATCCCAACT | CTC | chr17 | 7113252 | 7113273 | 7113269 | 7113274 | + |
| SEQ ID NO 8744 | ACCCCACCTCTACACACACACA | CTC | chr17 | 7113275 | 7113296 | 7113292 | 7113297 | + |
| SEQ ID NO 8745 | TACACACACACACACACACACA | CTC | chr17 | 7113285 | 7113306 | 7113302 | 7113307 | + |
| SEQ ID NO 8746 | CACACACACACACACACACATA | CTA | chr17 | 7113287 | 7113308 | 7113304 | 7113309 | + |
| SEQ ID NO 8747 | ACACACACACTCACGCAACACA | CTA | chr17 | 7113328 | 7113349 | 7113345 | 7113350 | + |
| SEQ ID NO 8748 | ACGCAACACACTCACACACACA | CTC | chr17 | 7113340 | 7113361 | 7113357 | 7113362 | + |
| SEQ ID NO 8749 | ACACACACAACATACATAACAC | CTC | chr17 | 7113353 | 7113374 | 7113370 | 7113375 | + |
| SEQ ID NO 8750 | ACAACATACACACACAACACAC | CTC | chr17 | 7113379 | 7113400 | 7113396 | 7113401 | + |
| SEQ ID NO 8751 | GCACAACATACACACGCACA | CTC | chr17 | 7113407 | 7113428 | 7113424 | 7113429 | + |
| SEQ ID NO 8752 | ACACAACACACAAACATACATA | CTC | chr17 | 7113444 | 7113465 | 7113461 | 7113466 | + |
| SEQ ID NO 8753 | ACACAATACACACACACAACAC | CTC | chr17 | 7113471 | 7113492 | 7113488 | 7113493 | + |
| SEQ ID NO 8754 | ATACACAACATACATACACACA | CTC | chr17 | 7113538 | 7113559 | 7113555 | 7113560 | + |
| SEQ ID NO 8755 | ACATACACAACATACACTCGCA | CTC | chr17 | 7113585 | 7113606 | 7113602 | 7113607 | + |
| SEQ ID NO 8756 | GCACAACATACACACATGCACA | CTC | chr17 | 7113604 | 7113625 | 7113621 | 7113626 | + |
| SEQ ID NO 8757 | ACACAAGATACACACAACAT | CTC | chr17 | 7113656 | 7113677 | 7113673 | 7113678 | + |
| SEQ ID NO 8758 | ACACAACATACACACACAACAC | CTC | chr17 | 7113684 | 7113705 | 7113701 | 7113706 | + |
| SEQ ID NO 8759 | TCACACACAACATACCCTCTCA | CTC | chr17 | 7113710 | 7113731 | 7113727 | 7113732 | + |
| SEQ ID NO 8760 | ACACCAACATACCCTCTCACA | CTC | chr17 | 7113712 | 7113733 | 7113729 | 7113734 | + |
| SEQ ID NO 8761 | TCACATACACGACATACACACA | CTC | chr17 | 7113729 | 7113750 | 7113746 | 7113751 | + |
| SEQ ID NO 8762 | ACATACGACATACACACACA | CTC | chr17 | 7113731 | 7113752 | 7113748 | 7113753 | + |
| SEQ ID NO 8763 | TCGCGCACATATACACACACAC | CTC | chr17 | 7113769 | 7113790 | 7113786 | 7113791 | + |
| SEQ ID NO 8764 | GCGCACATATACACACACACAA | CTC | chr17 | 7113771 | 7113792 | 7113788 | 7113793 | + |
| SEQ ID NO 8765 | ACTCACACACACACACAGAGTC | TTC | chr17 | 7113798 | 7113819 | 7113815 | 7113820 | + |
| SEQ ID NO 8766 | ACACACACACACAGAGTCCCAG | CTC | chr17 | 7113802 | 7113823 | 7113819 | 7113824 | + |
| SEQ ID NO 8767 | AATCTGCATTCCTCATATGCAC | CTG | chr17 | 7113827 | 7113848 | 7113844 | 7113849 | + |
| SEQ ID NO 8768 | CATTCCTCATATGCACATACGT | CTG | chr17 | 7113833 | 7113854 | 7113850 | 7113855 | + |
| SEQ ID NO 8769 | CTCATATGCACATACGTGCACA | TTC | chr17 | 7113838 | 7113859 | 7113855 | 7113860 | + |
| SEQ ID NO 8770 | ATATGCACATACGTGCACACGC | CTC | chr17 | 7113841 | 7113862 | 7113858 | 7113863 | + |
| SEQ ID NO 8771 | TTGGGTTGGGAGGAGAAGGGCA | TTC | chr17 | 7113884 | 7113905 | 7113901 | 7113906 | + |
| SEQ ID NO 8772 | GGGTTGGGAGGAGAAGGGCAGG | CTT | chr17 | 7113886 | 7113907 | 7113903 | 7113908 | + |
| SEQ ID NO 8773 | GGTTGGGAGGAGAAGGGCAGGC | TTG | chr17 | 7113887 | 7113908 | 7113904 | 7113909 | + |
| SEQ ID NO 8774 | GGAGGAGAAGGGCAGGCAGTTA | TTG | chr17 | 7113892 | 7113913 | 7113909 | 7113914 | + |
| SEQ ID NO 8775 | TCTTCCAGATCTCCCCACACCT | TTA | chr17 | 7113914 | 7113935 | 7113931 | 7113936 | + |
| SEQ ID NO 8776 | CCAGATCTCCCCACACCTCTGG | CTT | chr17 | 7113918 | 7113939 | 7113935 | 7113940 | + |
| SEQ ID NO 8777 | CAGATCTCCCCACACCTCTGGC | TTC | chr17 | 7113919 | 7113940 | 7113936 | 7113941 | + |
| SEQ ID NO 8778 | CCCACACCTCTGGCACATGCCT | CTC | chr17 | 7113927 | 7113948 | 7113944 | 7113949 | + |
| SEQ ID NO 8779 | TGGCACATGCCTTTCCTGGGGT | CTC | chr17 | 7113937 | 7113958 | 7113954 | 7113959 | + |
| SEQ ID NO 8780 | GCACATGCCTTTCCTGGGGTCC | CTG | chr17 | 7113939 | 7113960 | 7113956 | 7113961 | + |

Figure 30 (Cont'd)

| SEQ ID NO 8781 | TCCTGGGGTCCTGGGGTAGACA | CTT | chr17 | 7113950 | 7113971 | 7113967 | 7113972 | + |
|---|---|---|---|---|---|---|---|---|
| SEQ ID NO 8782 | CCTGGGGTCCTGGGGTAGACAG | TTT | chr17 | 7113951 | 7113972 | 7113968 | 7113973 | + |
| SEQ ID NO 8783 | CTGGGGTCCTGGGGTAGACAGG | TTC | chr17 | 7113952 | 7113973 | 7113969 | 7113974 | + |
| SEQ ID NO 8784 | GGGTCCTGGGGTAGACAGGAAG | CTG | chr17 | 7113955 | 7113976 | 7113972 | 7113977 | + |
| SEQ ID NO 8785 | GGGTAGACAGGAAGGTGAGGTG | CTG | chr17 | 7113963 | 7113984 | 7113980 | 7113985 | + |
| SEQ ID NO 8786 | CTCAGTCCCTGTTCACAGAGTG | CTC | chr17 | 7114013 | 7114034 | 7114030 | 7114035 | + |
| SEQ ID NO 8787 | AGTCCCTGTTCACAGAGTGGGT | CTC | chr17 | 7114016 | 7114037 | 7114033 | 7114038 | + |
| SEQ ID NO 8788 | TTCACAGAGTGGGTGCGGCAGA | CTG | chr17 | 7114024 | 7114045 | 7114041 | 7114046 | + |
| SEQ ID NO 8789 | ACAGAGTGGGTGCGGCAGAGAC | TTC | chr17 | 7114027 | 7114048 | 7114044 | 7114049 | + |
| SEQ ID NO 8790 | AAAGGGACAGAGCAATCATGAG | CTC | chr17 | 7114052 | 7114073 | 7114069 | 7114074 | + |
| SEQ ID NO 8791 | AGACAGAGGGGGAGCAAAGCCG | CTG | chr17 | 7114077 | 7114098 | 7114094 | 7114099 | + |
| SEQ ID NO 8792 | CACACTTGCCTTTCAAAAATGG | CTG | chr17 | 7114108 | 7114129 | 7114125 | 7114130 | + |
| SEQ ID NO 8793 | GCCTTTCAAAAATGGATTTCCT | CTT | chr17 | 7114115 | 7114136 | 7114132 | 7114137 | + |
| SEQ ID NO 8794 | CCTTTCAAAAATGGATTTCCTC | TTG | chr17 | 7114116 | 7114137 | 7114133 | 7114138 | + |
| SEQ ID NO 8795 | TCAAAAATGGATTTCCTCTCCT | CTT | chr17 | 7114120 | 7114141 | 7114137 | 7114142 | + |
| SEQ ID NO 8796 | CAAAAATGGATTTCCTCTCCTG | TTT | chr17 | 7114121 | 7114142 | 7114138 | 7114143 | + |
| SEQ ID NO 8797 | AAAAATGGATTTCCTCTCCTGG | TTC | chr17 | 7114122 | 7114143 | 7114139 | 7114144 | + |
| SEQ ID NO 8798 | CCTCTCCTGGGATTCAGCCTGC | TTT | chr17 | 7114134 | 7114155 | 7114151 | 7114156 | + |
| SEQ ID NO 8799 | CTCTCCTGGGATTCAGCCTGCG | TTC | chr17 | 7114135 | 7114156 | 7114152 | 7114157 | + |
| SEQ ID NO 8800 | TCCTGGGATTCAGCCTGCGAGT | CTC | chr17 | 7114138 | 7114159 | 7114155 | 7114160 | + |
| SEQ ID NO 8801 | CTGGGATTCAGCCTGCGAGTGC | CTC | chr17 | 7114140 | 7114161 | 7114157 | 7114162 | + |
| SEQ ID NO 8802 | GGATTCAGCCTGCGAGTGCCTG | CTG | chr17 | 7114143 | 7114164 | 7114160 | 7114165 | + |
| SEQ ID NO 8803 | AGCCTGCGAGTGCCTGGCCCCT | TTC | chr17 | 7114149 | 7114170 | 7114166 | 7114171 | + |
| SEQ ID NO 8804 | CGAGTGCCTGGCCCCTCACCTT | CTG | chr17 | 7114155 | 7114176 | 7114172 | 7114177 | + |
| SEQ ID NO 8805 | GCCCCTCACCTTGATGGAAAGG | CTG | chr17 | 7114165 | 7114186 | 7114182 | 7114187 | + |
| SEQ ID NO 8806 | ACCTTGATGGAAAGGATGGTCA | CTC | chr17 | 7114172 | 7114193 | 7114189 | 7114194 | + |
| SEQ ID NO 8807 | GATGGAAAGGATGGTCATTTTC | CTT | chr17 | 7114177 | 7114198 | 7114194 | 7114199 | + |
| SEQ ID NO 8808 | ATGGAAAGGATGGTCATTTTCC | TTG | chr17 | 7114178 | 7114199 | 7114195 | 7114200 | + |
| SEQ ID NO 8809 | TCCTCCGAGCTCAGCTGCTGGA | TTT | chr17 | 7114197 | 7114218 | 7114214 | 7114219 | + |
| SEQ ID NO 8810 | CCTCCGAGCTCAGCTGCTGGAT | TTT | chr17 | 7114198 | 7114219 | 7114215 | 7114220 | + |
| SEQ ID NO 8811 | CTCCGAGCTCAGCTGCTGGATA | TTC | chr17 | 7114199 | 7114220 | 7114216 | 7114221 | + |
| SEQ ID NO 8812 | CGAGCTCAGCTGCTGGATATCT | CTC | chr17 | 7114202 | 7114223 | 7114219 | 7114224 | + |
| SEQ ID NO 8813 | AGCTGCTGGATATCTTGAAAGT | CTC | chr17 | 7114209 | 7114230 | 7114226 | 7114231 | + |
| SEQ ID NO 8814 | CTGGATATCTTGAAAGTCCTTG | CTG | chr17 | 7114214 | 7114235 | 7114231 | 7114236 | + |
| SEQ ID NO 8815 | GATATCTTGAAAGTCCTTGGCC | CTG | chr17 | 7114217 | 7114238 | 7114234 | 7114239 | + |
| SEQ ID NO 8816 | GAAAGTCCTTGGCCATGATGGG | CTT | chr17 | 7114225 | 7114246 | 7114242 | 7114247 | + |
| SEQ ID NO 8817 | AAAGTCCTTGGCCATGATGGGG | TTG | chr17 | 7114226 | 7114247 | 7114243 | 7114248 | + |
| SEQ ID NO 8818 | GGCCATGATGGGGCCCGGGCTG | CTT | chr17 | 7114235 | 7114256 | 7114252 | 7114257 | + |
| SEQ ID NO 8819 | GCCATGATGGGGCCCGGGCTGG | TTG | chr17 | 7114236 | 7114257 | 7114253 | 7114258 | + |
| SEQ ID NO 8820 | GAGCTGGAGCTGGAGCTGGGCT | CTG | chr17 | 7114257 | 7114278 | 7114274 | 7114279 | + |
| SEQ ID NO 8821 | GAGCTGGAGCTGGGCTGGGCTG | CTG | chr17 | 7114263 | 7114284 | 7114280 | 7114285 | + |
| SEQ ID NO 8822 | GAGCTGGGCTGGGCTGGGCTGA | CTG | chr17 | 7114269 | 7114290 | 7114286 | 7114291 | + |
| SEQ ID NO 8823 | GGCTGGGCTGGGCTGAGGTTGC | CTG | chr17 | 7114275 | 7114296 | 7114292 | 7114297 | + |
| SEQ ID NO 8824 | GGCTGGGCTGAGGTTGCTCTGA | CTG | chr17 | 7114280 | 7114301 | 7114297 | 7114302 | + |
| SEQ ID NO 8825 | GGCTGAGGTTGCTCTGAGGGCT | CTG | chr17 | 7114285 | 7114306 | 7114302 | 7114307 | + |
| SEQ ID NO 8826 | AGGTTGCTCTGAGGGCTGGGGC | CTG | chr17 | 7114290 | 7114311 | 7114307 | 7114312 | + |
| SEQ ID NO 8827 | CTCTGAGGGCTGGGGCTGGGGC | TTG | chr17 | 7114296 | 7114317 | 7114313 | 7114318 | + |
| SEQ ID NO 8828 | TGAGGGCTGGGGCTGGGGCAGA | CTC | chr17 | 7114299 | 7114320 | 7114316 | 7114321 | + |
| SEQ ID NO 8829 | AGGGCTGGGGCTGGGGCAGAGG | CTG | chr17 | 7114301 | 7114322 | 7114318 | 7114323 | + |
| SEQ ID NO 8830 | GGGCTGGGGCAGAGGTGCAGAT | CTG | chr17 | 7114308 | 7114329 | 7114325 | 7114330 | + |
| SEQ ID NO 8831 | GGGCAGAGGTGCAGATTCACGT | CTG | chr17 | 7114314 | 7114335 | 7114331 | 7114336 | + |
| SEQ ID NO 8832 | ACGTGGAGGTTGATGGTGGGAT | TTC | chr17 | 7114332 | 7114353 | 7114349 | 7114354 | + |
| SEQ ID NO 8833 | ATGGTGGGATGGAACGCAGGGT | TTG | chr17 | 7114344 | 7114365 | 7114361 | 7114366 | + |
| SEQ ID NO 8834 | GGGGTGGTGGCCTGGGTAGGAT | TTC | chr17 | 7114377 | 7114398 | 7114394 | 7114399 | + |
| SEQ ID NO 8835 | AGATCCTACCCAGGCCACCACC | CTC | chr17 | 7114379 | 7114400 | 7114384 | 7114379 | − |
| SEQ ID NO 8836 | CCCAGGCCACCACCCCGAACCC | CTA | chr17 | 7114371 | 7114392 | 7114376 | 7114371 | − |
| SEQ ID NO 8837 | CGACCCTGCGTTCCATCCCACC | CTC | chr17 | 7114346 | 7114367 | 7114351 | 7114346 | − |
| SEQ ID NO 8838 | CGTTCCATCCCACCATCAACCT | CTG | chr17 | 7114338 | 7114359 | 7114343 | 7114338 | − |

Figure 30 (Cont'd)

| SEQ ID NO 8839 | CATCCCACCATCAACCTCCACG | TTC | chr17 | 7114333 | 7114354 | 7114338 | 7114333 | - |
|---|---|---|---|---|---|---|---|---|
| SEQ ID NO 8840 | CACGTGAATCTGCACCTCTGCC | CTC | chr17 | 7114315 | 7114336 | 7114320 | 7114315 | - |
| SEQ ID NO 8841 | CACCTCTGCCCCAGCCCCAGCC | CTG | chr17 | 7114303 | 7114324 | 7114308 | 7114303 | - |
| SEQ ID NO 8842 | TGCCCCAGCCCCAGCCCTCAGA | CTC | chr17 | 7114297 | 7114318 | 7114302 | 7114297 | - |
| SEQ ID NO 8843 | CCCCAGCCCCAGCCCTCAGAGC | CTG | chr17 | 7114295 | 7114316 | 7114300 | 7114295 | - |
| SEQ ID NO 8844 | AGAGCAACCTCAGCCCAGCCCA | CTC | chr17 | 7114278 | 7114299 | 7114283 | 7114278 | - |
| SEQ ID NO 8845 | AGCCCAGCCCAGCCCAGCTCCA | CTC | chr17 | 7114267 | 7114288 | 7114272 | 7114267 | - |
| SEQ ID NO 8846 | CAGCTCCAGCTCCAGCCCGGGC | CTC | chr17 | 7114247 | 7114268 | 7114252 | 7114247 | - |
| SEQ ID NO 8847 | CAGCTCCAGCCCGGGCCCCATC | CTC | chr17 | 7114241 | 7114262 | 7114246 | 7114241 | - |
| SEQ ID NO 8848 | CAGCCCGGGCCCCATCATGGCC | CTC | chr17 | 7114235 | 7114256 | 7114240 | 7114235 | - |
| SEQ ID NO 8849 | TCAAGATATCCAGCAGCTGAGC | CTT | chr17 | 7114205 | 7114226 | 7114210 | 7114205 | - |
| SEQ ID NO 8850 | CAAGATATCCAGCAGCTGAGCT | TTT | chr17 | 7114204 | 7114225 | 7114209 | 7114204 | - |
| SEQ ID NO 8851 | AAGATATCCAGCAGCTGAGCTC | TTC | chr17 | 7114203 | 7114224 | 7114208 | 7114203 | - |
| SEQ ID NO 8852 | AGCTCGGAGGAAAATGACCATC | CTG | chr17 | 7114186 | 7114207 | 7114191 | 7114186 | - |
| SEQ ID NO 8853 | GGAGGAAAATGACCATCCTTTC | CTC | chr17 | 7114181 | 7114202 | 7114186 | 7114181 | - |
| SEQ ID NO 8854 | TCCATCAAGGTGAGGGGCCAGG | CTT | chr17 | 7114161 | 7114182 | 7114166 | 7114161 | - |
| SEQ ID NO 8855 | CCATCAAGGTGAGGGGCCAGGC | TTT | chr17 | 7114160 | 7114181 | 7114165 | 7114160 | - |
| SEQ ID NO 8856 | CATCAAGGTGAGGGGCCAGGCA | TTC | chr17 | 7114159 | 7114180 | 7114164 | 7114159 | - |
| SEQ ID NO 8857 | GCAGGCTGAATCCCAGGAGAGG | CTC | chr17 | 7114134 | 7114155 | 7114139 | 7114134 | - |
| SEQ ID NO 8858 | AATCCCAGGAGAGGAAATCCAT | CTG | chr17 | 7114126 | 7114147 | 7114131 | 7114126 | - |
| SEQ ID NO 8859 | TTGAAAGGCAAGTGTGCAGTTT | TTT | chr17 | 7114102 | 7114123 | 7114107 | 7114102 | - |
| SEQ ID NO 8860 | TGAAAGGCAAGTGTGCAGTTTC | TTT | chr17 | 7114101 | 7114122 | 7114106 | 7114101 | - |
| SEQ ID NO 8861 | GAAAGGCAAGTGTGCAGTTTCT | TTT | chr17 | 7114100 | 7114121 | 7114105 | 7114100 | - |
| SEQ ID NO 8862 | AAAGGCAAGTGTGCAGTTTCTG | TTG | chr17 | 7114099 | 7114120 | 7114104 | 7114099 | - |
| SEQ ID NO 8863 | CTGCGGCTTTGCTCCCCCTCTG | TTT | chr17 | 7114080 | 7114101 | 7114085 | 7114080 | - |
| SEQ ID NO 8864 | TGCGGCTTTGCTCCCCCTCTGT | TTC | chr17 | 7114079 | 7114100 | 7114084 | 7114079 | - |
| SEQ ID NO 8865 | CGGCTTTGCTCCCCCTCTGTCT | CTG | chr17 | 7114077 | 7114098 | 7114082 | 7114077 | - |
| SEQ ID NO 8866 | TGCTCCCCCTCTGTCTCAGCTC | CTT | chr17 | 7114071 | 7114092 | 7114076 | 7114071 | - |
| SEQ ID NO 8867 | GCTCCCCCTCTGTCTCAGCTCA | TTT | chr17 | 7114070 | 7114091 | 7114075 | 7114070 | - |
| SEQ ID NO 8868 | CTCCCCCTCTGTCTCAGCTCAT | TTG | chr17 | 7114069 | 7114090 | 7114074 | 7114069 | - |
| SEQ ID NO 8869 | CCCCTCTGTCTCAGCTCATGAT | CTC | chr17 | 7114066 | 7114087 | 7114071 | 7114066 | - |
| SEQ ID NO 8870 | TGTCTCAGCTCATGATTGCTCT | CTC | chr17 | 7114060 | 7114081 | 7114065 | 7114060 | - |
| SEQ ID NO 8871 | TCTCAGCTCATGATTGCTCTGT | CTG | chr17 | 7114058 | 7114079 | 7114063 | 7114058 | - |
| SEQ ID NO 8872 | AGCTCATGATTGCTCTGTCCCT | CTC | chr17 | 7114054 | 7114075 | 7114059 | 7114054 | - |
| SEQ ID NO 8873 | ATGATTGCTCTGTCCCTTTGAG | CTC | chr17 | 7114049 | 7114070 | 7114054 | 7114049 | - |
| SEQ ID NO 8874 | CTCTGTCCCTTTGAGGTCTCTG | TTG | chr17 | 7114042 | 7114063 | 7114047 | 7114042 | - |
| SEQ ID NO 8875 | TGTCCCTTTGAGGTCTCTGCCG | CTC | chr17 | 7114039 | 7114060 | 7114044 | 7114039 | - |
| SEQ ID NO 8876 | TCCCTTTGAGGTCTCTGCCGCA | CTG | chr17 | 7114037 | 7114058 | 7114042 | 7114037 | - |
| SEQ ID NO 8877 | TGAGGTCTCTGCCGCACCCACT | CTT | chr17 | 7114031 | 7114052 | 7114036 | 7114031 | - |
| SEQ ID NO 8878 | GAGGTCTCTGCCGCACCCACTC | TTT | chr17 | 7114030 | 7114051 | 7114035 | 7114030 | - |
| SEQ ID NO 8879 | AGGTCTCTGCCGCACCCACTCT | TTG | chr17 | 7114029 | 7114050 | 7114034 | 7114029 | - |
| SEQ ID NO 8880 | TGCCGCACCCACTCTGTGAACA | CTC | chr17 | 7114022 | 7114043 | 7114027 | 7114022 | - |
| SEQ ID NO 8881 | CCGCACCCACTCTGTGAACAGG | CTG | chr17 | 7114020 | 7114041 | 7114025 | 7114020 | - |
| SEQ ID NO 8882 | TGTGAACAGGGACTGAGGAGGG | CTC | chr17 | 7114008 | 7114029 | 7114013 | 7114008 | - |
| SEQ ID NO 8883 | TGAACAGGGACTGAGGAGGGCC | CTG | chr17 | 7114006 | 7114027 | 7114011 | 7114006 | - |
| SEQ ID NO 8884 | AGGAGGGCCGACACCCCGCT | CTG | chr17 | 7113993 | 7114014 | 7113998 | 7113993 | - |
| SEQ ID NO 8885 | GTTCCCTCACCTCACCTTCCTG | CTT | chr17 | 7113970 | 7113991 | 7113975 | 7113970 | - |
| SEQ ID NO 8886 | TTCCCTCACCTCACCTTCCTGT | TTG | chr17 | 7113969 | 7113990 | 7113974 | 7113969 | - |
| SEQ ID NO 8887 | CCTCACCTCACCTTCCTGTCTA | TTC | chr17 | 7113966 | 7113987 | 7113971 | 7113966 | - |
| SEQ ID NO 8888 | ACCTCACCTTCCTGTCTACCCC | CTC | chr17 | 7113962 | 7113983 | 7113967 | 7113962 | - |
| SEQ ID NO 8889 | ACCTTCCTGTCTACCCCAGGAC | CTC | chr17 | 7113957 | 7113978 | 7113962 | 7113957 | - |
| SEQ ID NO 8890 | CCTGTCTACCCCAGGACCCCAG | CTT | chr17 | 7113952 | 7113973 | 7113957 | 7113952 | - |
| SEQ ID NO 8891 | CTGTCTACCCCAGGACCCCAGG | TTC | chr17 | 7113951 | 7113972 | 7113956 | 7113951 | - |
| SEQ ID NO 8892 | TCTACCCCAGGACCCCAGGAAA | CTG | chr17 | 7113948 | 7113969 | 7113953 | 7113948 | - |
| SEQ ID NO 8893 | CCCCAGGACCCCAGGAAAGGCA | CTA | chr17 | 7113944 | 7113965 | 7113949 | 7113944 | - |
| SEQ ID NO 8894 | GAAGATAACTGCCTGCCCTTCT | CTG | chr17 | 7113897 | 7113918 | 7113902 | 7113897 | - |
| SEQ ID NO 8895 | CCTGCCCTTCTCCTCCCAACCC | CTG | chr17 | 7113886 | 7113907 | 7113891 | 7113886 | - |
| SEQ ID NO 8896 | CCCTTCTCCTCCCAACCCAAGA | CTG | chr17 | 7113882 | 7113903 | 7113887 | 7113882 | - |

Figure 30 (Cont'd)

| | | | | | | | | |
|---|---|---|---|---|---|---|---|---|
| SEQ ID NO 8897 | CTCCTCCCAACCCAAGAACACA | CTT | chr17 | 7113877 | 7113898 | 7113882 | 7113877 | - |
| SEQ ID NO 8898 | TCCTCCCAACCCAAGAACACAT | TTC | chr17 | 7113876 | 7113897 | 7113881 | 7113876 | - |
| SEQ ID NO 8899 | CTCCCAACCCAAGAACACATGT | CTC | chr17 | 7113874 | 7113895 | 7113879 | 7113874 | - |
| SEQ ID NO 8900 | CCAACCCAAGAACACATGTGCC | CTC | chr17 | 7113871 | 7113892 | 7113876 | 7113871 | - |
| SEQ ID NO 8901 | GTATGTGCGTGTGCACGTATGT | CTC | chr17 | 7113847 | 7113868 | 7113852 | 7113847 | - |
| SEQ ID NO 8902 | AGCTGGGACTCTGTGTGTGTGT | TTC | chr17 | 7113804 | 7113825 | 7113809 | 7113804 | - |
| SEQ ID NO 8903 | GGACTCTGTGTGTGTGTGTGAG | CTG | chr17 | 7113799 | 7113820 | 7113804 | 7113799 | - |
| SEQ ID NO 8904 | TGTGTGTGTGTGAGTGAATG | CTC | chr17 | 7113793 | 7113814 | 7113798 | 7113793 | - |
| SEQ ID NO 8905 | TGTGTGTGTGAGTGAATGTT | CTG | chr17 | 7113791 | 7113812 | 7113796 | 7113791 | - |
| SEQ ID NO 8906 | TGTGTGTGTATATGTGCGCGAG | TTG | chr17 | 7113768 | 7113789 | 7113773 | 7113768 | - |
| SEQ ID NO 8907 | TGTGTGTGTATGTCGTGTATGT | TTG | chr17 | 7113731 | 7113752 | 7113736 | 7113731 | - |
| SEQ ID NO 8908 | TGTGTGAGAGTGTGTTGTGTGT | TTG | chr17 | 7113695 | 7113716 | 7113700 | 7113695 | - |
| SEQ ID NO 8909 | TGTGTGTATGTTGTGTGAGTAT | TTG | chr17 | 7113678 | 7113699 | 7113683 | 7113678 | - |
| SEQ ID NO 8910 | TGTGAGTATATGTTGTGTGTAT | TTG | chr17 | 7113665 | 7113686 | 7113670 | 7113665 | - |
| SEQ ID NO 8911 | TGTGTATCTTGTGTGTGAGTGT | TTG | chr17 | 7113650 | 7113671 | 7113655 | 7113650 | - |
| SEQ ID NO 8912 | GTGTGTGAGTGTATGTTGTGTG | CTT | chr17 | 7113640 | 7113661 | 7113645 | 7113640 | - |
| SEQ ID NO 8913 | TGTGTGAGTGTATGTTGTGTGT | TTG | chr17 | 7113639 | 7113660 | 7113644 | 7113639 | - |
| SEQ ID NO 8914 | TGTGTTGTGTGTGTATCTTGTG | TTG | chr17 | 7113622 | 7113643 | 7113627 | 7113622 | - |
| SEQ ID NO 8915 | TGTGTGTATCTTGTGCATGTGT | TTG | chr17 | 7113615 | 7113636 | 7113620 | 7113615 | - |
| SEQ ID NO 8916 | GTGCATGTGTGTATGTTGTGCG | CTT | chr17 | 7113603 | 7113624 | 7113608 | 7113603 | - |
| SEQ ID NO 8917 | TGCATGTGTGTATGTTGTGCGA | TTG | chr17 | 7113602 | 7113623 | 7113607 | 7113602 | - |
| SEQ ID NO 8918 | TGCGAGTGTATGTTGTGTATGT | TTG | chr17 | 7113585 | 7113606 | 7113590 | 7113585 | - |
| SEQ ID NO 8919 | TGTATGTGAGTGTGTGTATGTT | TTG | chr17 | 7113570 | 7113591 | 7113575 | 7113570 | - |
| SEQ ID NO 8920 | TGTATGTTGTGTGTATGTAT | TTG | chr17 | 7113547 | 7113568 | 7113552 | 7113547 | - |
| SEQ ID NO 8921 | TGTATGTATGTTGTGTATGA | TTG | chr17 | 7113536 | 7113557 | 7113541 | 7113536 | - |
| SEQ ID NO 8922 | TGTATGAGTGTGTGTATGTTGT | TTG | chr17 | 7113521 | 7113542 | 7113526 | 7113521 | - |
| SEQ ID NO 8923 | TGTGTGTACGTTGTGTATGT | TTG | chr17 | 7113500 | 7113521 | 7113505 | 7113500 | - |
| SEQ ID NO 8924 | TGTATGTTGTGTGTGTTGTG | TTG | chr17 | 7113485 | 7113506 | 7113490 | 7113485 | - |
| SEQ ID NO 8925 | TGTGTGTGTTGTGTGTGTAT | TTG | chr17 | 7113476 | 7113497 | 7113481 | 7113476 | - |
| SEQ ID NO 8926 | TGTGTGTATTGTGTGAGTGT | TTG | chr17 | 7113465 | 7113486 | 7113470 | 7113465 | - |
| SEQ ID NO 8927 | TGTGAGTGTATGTATGTTTGTG | TTG | chr17 | 7113452 | 7113473 | 7113457 | 7113452 | - |
| SEQ ID NO 8928 | GTGTGTTGTGTGAGTGTTGTGT | TTT | chr17 | 7113433 | 7113454 | 7113438 | 7113433 | - |
| SEQ ID NO 8929 | TGTGTTGTGTGAGTGTTGTGTA | TTG | chr17 | 7113432 | 7113453 | 7113437 | 7113432 | - |
| SEQ ID NO 8930 | TGTGAGTGTTGTGTATGTTGTG | TTG | chr17 | 7113425 | 7113446 | 7113430 | 7113425 | - |
| SEQ ID NO 8931 | TGTATGTTGTGCGTGTGTGTAT | TTG | chr17 | 7113414 | 7113435 | 7113419 | 7113414 | - |
| SEQ ID NO 8932 | TGCGTGTGTGTATGTTGTGCGA | TTG | chr17 | 7113405 | 7113426 | 7113410 | 7113405 | - |
| SEQ ID NO 8933 | TGCGAGTGTGTGTGTTGTGTGT | TTG | chr17 | 7113388 | 7113409 | 7113393 | 7113388 | - |
| SEQ ID NO 8934 | TGTGTGTATGTTGTGAGTGTGT | TTG | chr17 | 7113371 | 7113392 | 7113376 | 7113371 | - |
| SEQ ID NO 8935 | TGAGTGTGTTATGTATGTTGTG | TTG | chr17 | 7113358 | 7113379 | 7113363 | 7113358 | - |
| SEQ ID NO 8936 | TGTATGTTGTGTGTGTGAGTGT | TTA | chr17 | 7113347 | 7113368 | 7113352 | 7113347 | - |
| SEQ ID NO 8937 | TGTGTGTGAGTGTGTTGCGTGA | TTG | chr17 | 7113338 | 7113359 | 7113343 | 7113338 | - |
| SEQ ID NO 8938 | CGTGAGTGTGTGTGTTAGTGTG | TTG | chr17 | 7113321 | 7113342 | 7113326 | 7113321 | - |
| SEQ ID NO 8939 | GTGTGTGTATGTGATTGTATGT | TTA | chr17 | 7113304 | 7113325 | 7113309 | 7113304 | - |
| SEQ ID NO 8940 | TATGTGTGTGTGTGTGTGTGT | TTG | chr17 | 7113287 | 7113308 | 7113292 | 7113287 | - |
| SEQ ID NO 8941 | GGATGGGTGGGGGACGTGAGCA | TTG | chr17 | 7113247 | 7113268 | 7113252 | 7113247 | - |
| SEQ ID NO 8942 | GAAGATCCCTGCTCCTCTCATC | CTG | chr17 | 7113212 | 7113233 | 7113217 | 7113212 | - |
| SEQ ID NO 8943 | CTCCTCTCATCTCCCAAGACCC | CTG | chr17 | 7113201 | 7113222 | 7113206 | 7113201 | - |
| SEQ ID NO 8944 | CTCTCATCTCCCAAGACCCTTC | CTC | chr17 | 7113198 | 7113219 | 7113203 | 7113198 | - |
| SEQ ID NO 8945 | TCATCTCCCAAGACCCTTCCCT | CTC | chr17 | 7113195 | 7113216 | 7113200 | 7113195 | - |
| SEQ ID NO 8946 | ATCTCCCAAGACCCTTCCCTGG | CTC | chr17 | 7113193 | 7113214 | 7113198 | 7113193 | - |
| SEQ ID NO 8947 | CCAAGACCCTTCCCTGGATCCT | CTC | chr17 | 7113188 | 7113209 | 7113193 | 7113188 | - |
| SEQ ID NO 8948 | CCCTGGATCCTTCTGTAATAAA | CTT | chr17 | 7113177 | 7113198 | 7113182 | 7113177 | - |
| SEQ ID NO 8949 | CCTGGATCCTTCTGTAATAAAT | TTC | chr17 | 7113176 | 7113197 | 7113181 | 7113176 | - |
| SEQ ID NO 8950 | GATCCTTCTGTAATAAATCTTG | CTG | chr17 | 7113172 | 7113193 | 7113177 | 7113172 | - |
| SEQ ID NO 8951 | CTGTAATAAATCTTGACTGAAG | CTT | chr17 | 7113165 | 7113186 | 7113170 | 7113165 | - |
| SEQ ID NO 8952 | TGTAATAAATCTTGACTGAAGG | TTC | chr17 | 7113164 | 7113185 | 7113169 | 7113164 | - |
| SEQ ID NO 8953 | TAATAAATCTTGACTGAAGGAC | CTG | chr17 | 7113162 | 7113183 | 7113167 | 7113162 | - |
| SEQ ID NO 8954 | GACTGAAGGACCTAAGTATCTT | CTT | chr17 | 7113151 | 7113172 | 7113156 | 7113151 | - |

Figure 30 (Cont'd)

| SEQ ID NO 8955 | ACTGAAGGACCTAAGTATCTTG | TTG | chr17 | 7113150 | 7113171 | 7113155 | 7113150 | - |
|---|---|---|---|---|---|---|---|---|
| SEQ ID NO 8956 | AAGGACCTAAGTATCTTGGACA | CTG | chr17 | 7113146 | 7113167 | 7113151 | 7113146 | - |
| SEQ ID NO 8957 | AGTATCTTGGACATTTTTTTTT | CTA | chr17 | 7113137 | 7113158 | 7113142 | 7113137 | - |
| SEQ ID NO 8958 | GGACATTTTTTTTTAGAGACA | CTT | chr17 | 7113129 | 7113150 | 7113134 | 7113129 | - |
| SEQ ID NO 8959 | GACATTTTTTTTTAGAGACAG | TTG | chr17 | 7113128 | 7113149 | 7113133 | 7113128 | - |
| SEQ ID NO 8960 | TTTTTTTAGAGACAGGAGTGTA | TTT | chr17 | 7113121 | 7113142 | 7113126 | 7113121 | - |
| SEQ ID NO 8961 | TTTTTTAGAGACAGGAGTGTAG | TTT | chr17 | 7113120 | 7113141 | 7113125 | 7113120 | - |
| SEQ ID NO 8962 | TTTTTAGAGACAGGAGTGTAGT | TTT | chr17 | 7113119 | 7113140 | 7113124 | 7113119 | - |
| SEQ ID NO 8963 | TTTTAGAGACAGGAGTGTAGTG | TTT | chr17 | 7113118 | 7113139 | 7113123 | 7113118 | - |
| SEQ ID NO 8964 | TTTAGAGACAGGAGTGTAGTGG | TTT | chr17 | 7113117 | 7113138 | 7113122 | 7113117 | - |
| SEQ ID NO 8965 | TTAGAGACAGGAGTGTAGTGGC | TTT | chr17 | 7113116 | 7113137 | 7113121 | 7113116 | - |
| SEQ ID NO 8966 | TAGAGACAGGAGTGTAGTGGCA | TTT | chr17 | 7113115 | 7113136 | 7113120 | 7113115 | - |
| SEQ ID NO 8967 | AGAGACAGGAGTGTAGTGGCAG | TTT | chr17 | 7113114 | 7113135 | 7113119 | 7113114 | - |
| SEQ ID NO 8968 | GAGACAGGAGTGTAGTGGCAGG | TTA | chr17 | 7113113 | 7113134 | 7113118 | 7113113 | - |
| SEQ ID NO 8969 | ACTGCAACCTCGAACTCCTGGG | CTC | chr17 | 7113081 | 7113102 | 7113086 | 7113081 | - |
| SEQ ID NO 8970 | CAACCTCGAACTCCTGGGCTCA | CTG | chr17 | 7113077 | 7113098 | 7113082 | 7113077 | - |
| SEQ ID NO 8971 | GAACTCCTGGGCTCAAGCCATC | CTC | chr17 | 7113070 | 7113091 | 7113075 | 7113070 | - |
| SEQ ID NO 8972 | CTGGGCTCAAGCCATCCTCCCA | CTC | chr17 | 7113064 | 7113085 | 7113069 | 7113064 | - |
| SEQ ID NO 8973 | GGCTCAAGCCATCCTCCCACCT | CTG | chr17 | 7113061 | 7113082 | 7113066 | 7113061 | - |
| SEQ ID NO 8974 | AAGCCATCCTCCCACCTCAGCC | CTC | chr17 | 7113056 | 7113077 | 7113061 | 7113056 | - |
| SEQ ID NO 8975 | CCACCTCAGCCTCCCAAGTAGT | CTC | chr17 | 7113045 | 7113066 | 7113050 | 7113045 | - |
| SEQ ID NO 8976 | AGCCTCCCAAGTAGTTAGGACT | CTC | chr17 | 7113038 | 7113059 | 7113043 | 7113038 | - |
| SEQ ID NO 8977 | CCAAGTAGTTAGGACTTACAGG | CTC | chr17 | 7113032 | 7113053 | 7113037 | 7113032 | - |
| SEQ ID NO 8978 | GGACTTACAGGTGTGCACCACT | TTA | chr17 | 7113021 | 7113042 | 7113026 | 7113021 | - |
| SEQ ID NO 8979 | ACAGGTGTGCACCACTGTGCCT | CTT | chr17 | 7113015 | 7113036 | 7113020 | 7113015 | - |
| SEQ ID NO 8980 | CAGGTGTGCACCACTGTGCCTG | TTA | chr17 | 7113014 | 7113035 | 7113019 | 7113014 | - |
| SEQ ID NO 8981 | TGCCTGGCAAATTAAAAAAAAT | CTG | chr17 | 7112998 | 7113019 | 7113003 | 7112998 | - |
| SEQ ID NO 8982 | GCAAATTAAAAAAAATTTTTTA | CTG | chr17 | 7112992 | 7113013 | 7112997 | 7112992 | - |
| SEQ ID NO 8983 | AAAAAAATTTTTTAGAGAAATG | TTA | chr17 | 7112984 | 7113005 | 7112989 | 7112984 | - |
| SEQ ID NO 8984 | TTTAGAGAAATGGGGTCTTGCT | TTT | chr17 | 7112974 | 7112995 | 7112979 | 7112974 | - |
| SEQ ID NO 8985 | TTAGAGAAATGGGGTCTTGCTA | TTT | chr17 | 7112973 | 7112994 | 7112978 | 7112973 | - |
| SEQ ID NO 8986 | TAGAGAAATGGGGTCTTGCTAT | TTT | chr17 | 7112972 | 7112993 | 7112977 | 7112972 | - |
| SEQ ID NO 8987 | AGAGAAATGGGGTCTTGCTATG | TTT | chr17 | 7112971 | 7112992 | 7112976 | 7112971 | - |
| SEQ ID NO 8988 | GAGAAATGGGGTCTTGCTATGT | TTA | chr17 | 7112970 | 7112991 | 7112975 | 7112970 | - |
| SEQ ID NO 8989 | GCTATGTTGCCCAGGCTGGTGG | CTT | chr17 | 7112955 | 7112976 | 7112960 | 7112955 | - |
| SEQ ID NO 8990 | CTATGTTGCCCAGGCTGGTGGG | TTG | chr17 | 7112954 | 7112975 | 7112959 | 7112954 | - |
| SEQ ID NO 8991 | TGTTGCCCAGGCTGGTGGGAAA | CTA | chr17 | 7112951 | 7112972 | 7112956 | 7112951 | - |
| SEQ ID NO 8992 | CCCAGGCTGGTGGGAAAAGATT | TTG | chr17 | 7112946 | 7112967 | 7112951 | 7112946 | - |
| SEQ ID NO 8993 | GTGGGAAAAGATTTTAAGGTGA | CTG | chr17 | 7112937 | 7112958 | 7112942 | 7112937 | - |
| SEQ ID NO 8994 | TAAGGTGAGAGAGATCTGAGCA | TTT | chr17 | 7112923 | 7112944 | 7112928 | 7112923 | - |
| SEQ ID NO 8995 | AAGGTGAGAGAGATCTGAGCAG | TTT | chr17 | 7112922 | 7112943 | 7112927 | 7112922 | - |
| SEQ ID NO 8996 | AGGTGAGAGAGATCTGAGCAGT | TTA | chr17 | 7112921 | 7112942 | 7112926 | 7112921 | - |
| SEQ ID NO 8997 | AGCAGTGCTAGGCAGAAGGGCA | CTG | chr17 | 7112905 | 7112926 | 7112910 | 7112905 | - |
| SEQ ID NO 8998 | GGCAGAAGGGCAAGAGCCAGGA | CTA | chr17 | 7112895 | 7112916 | 7112900 | 7112895 | - |
| SEQ ID NO 8999 | GTGGTGGAGCCGGGTTCCATGG | CTG | chr17 | 7112844 | 7112865 | 7112849 | 7112844 | - |
| SEQ ID NO 9000 | CATGGAGGCAGGAGGAGCAGGG | TTC | chr17 | 7112827 | 7112848 | 7112832 | 7112827 | - |
| SEQ ID NO 9001 | GGAGCTTAGGAAGGGGATTGGT | CTT | chr17 | 7112801 | 7112822 | 7112806 | 7112801 | - |
| SEQ ID NO 9002 | GAGCTTAGGAAGGGGATTGGTT | TTG | chr17 | 7112800 | 7112821 | 7112805 | 7112800 | - |
| SEQ ID NO 9003 | AGGAAGGGGATTGGTTAGCTGG | CTT | chr17 | 7112794 | 7112815 | 7112799 | 7112794 | - |
| SEQ ID NO 9004 | GGAAGGGGATTGGTTAGCTGGG | TTA | chr17 | 7112793 | 7112814 | 7112798 | 7112793 | - |
| SEQ ID NO 9005 | GTTAGCTGGGCTGGAATGAGGG | TTG | chr17 | 7112781 | 7112802 | 7112786 | 7112781 | - |
| SEQ ID NO 9006 | GCTGGGCTGGAATGAGGGACTC | TTA | chr17 | 7112777 | 7112798 | 7112782 | 7112777 | - |
| SEQ ID NO 9007 | GGCTGGAATGAGGGACTCCTCA | CTG | chr17 | 7112773 | 7112794 | 7112778 | 7112773 | - |
| SEQ ID NO 9008 | GAATGAGGGACTCCTCATTCCT | CTG | chr17 | 7112768 | 7112789 | 7112773 | 7112768 | - |
| SEQ ID NO 9009 | CTCATTCCTGAGGCTGGCCAAC | CTC | chr17 | 7112755 | 7112776 | 7112760 | 7112755 | - |
| SEQ ID NO 9010 | ATTCCTGAGGCTGGCCAACCGA | CTC | chr17 | 7112752 | 7112773 | 7112757 | 7112752 | - |
| SEQ ID NO 9011 | CTGAGGCTGGCCAACCGAGGGA | TTC | chr17 | 7112748 | 7112769 | 7112753 | 7112748 | - |
| SEQ ID NO 9012 | AGGCTGGCCAACCGAGGGAGGG | CTG | chr17 | 7112745 | 7112766 | 7112750 | 7112745 | - |

Figure 30 (Cont'd)

| | | | | | | | | |
|---|---|---|---|---|---|---|---|---|
| SEQ ID NO 9013 | GCCAACCGAGGGAGGGCCGGTG | CTG | chr17 | 7112739 | 7112760 | 7112744 | 7112739 | - |
| SEQ ID NO 9014 | GGCAGGGCAGGGCAGGGGACAG | CTG | chr17 | 7112714 | 7112735 | 7112719 | 7112714 | - |
| SEQ ID NO 9015 | CCGAGGACCACTCAGGAACACC | CTC | chr17 | 7112673 | 7112694 | 7112678 | 7112673 | - |
| SEQ ID NO 9016 | AGGAACACCAGTAGCATCTCCT | CTC | chr17 | 7112660 | 7112681 | 7112665 | 7112660 | - |
| SEQ ID NO 9017 | CTCTCTCTGTAGGGGGCTGGCT | CTC | chr17 | 7112640 | 7112661 | 7112645 | 7112640 | - |
| SEQ ID NO 9018 | TCTCTGTAGGGGGCTGGCTGGA | CTC | chr17 | 7112637 | 7112658 | 7112642 | 7112637 | - |
| SEQ ID NO 9019 | TCTGTAGGGGGCTGGCTGGACT | CTC | chr17 | 7112635 | 7112656 | 7112640 | 7112635 | - |
| SEQ ID NO 9020 | TGTAGGGGGCTGGCTGGACTTC | CTC | chr17 | 7112633 | 7112654 | 7112638 | 7112633 | - |
| SEQ ID NO 9021 | TAGGGGGCTGGCTGGACTTCCC | CTG | chr17 | 7112631 | 7112652 | 7112636 | 7112631 | - |
| SEQ ID NO 9022 | GCTGGACTTCCCACCAGGCGGT | CTG | chr17 | 7112621 | 7112642 | 7112626 | 7112621 | - |
| SEQ ID NO 9023 | GACTTCCCACCAGGCGGTGTCC | CTG | chr17 | 7112617 | 7112638 | 7112622 | 7112617 | - |
| SEQ ID NO 9024 | CCCACCAGGCGGTGTCCCCACA | CTT | chr17 | 7112612 | 7112633 | 7112617 | 7112612 | - |
| SEQ ID NO 9025 | CCACCAGGCGGTGTCCCCACAG | TTC | chr17 | 7112611 | 7112632 | 7112616 | 7112611 | - |
| SEQ ID NO 9026 | TCCGCCTCACTCCTCTGCAA | CTG | chr17 | 7112577 | 7112598 | 7112582 | 7112577 | - |
| SEQ ID NO 9027 | ACTCTCCTCTGCAACTCCAGTG | CTC | chr17 | 7112569 | 7112590 | 7112574 | 7112569 | - |
| SEQ ID NO 9028 | TCCTCTGCAACTCCAGTGCCCA | CTC | chr17 | 7112565 | 7112586 | 7112570 | 7112565 | - |
| SEQ ID NO 9029 | CTCTGCAACTCCAGTGCCCACA | CTC | chr17 | 7112563 | 7112584 | 7112568 | 7112563 | - |
| SEQ ID NO 9030 | TGCAACTCCAGTGCCCACACGG | CTC | chr17 | 7112560 | 7112581 | 7112565 | 7112560 | - |
| SEQ ID NO 9031 | CAACTCCAGTGCCCACACGGCA | CTG | chr17 | 7112558 | 7112579 | 7112563 | 7112558 | - |
| SEQ ID NO 9032 | CAGTGCCCACACGGCACCCGGT | CTC | chr17 | 7112552 | 7112573 | 7112557 | 7112552 | - |
| SEQ ID NO 9033 | AGAGAGAATACGGGATGCTGCT | CTC | chr17 | 7112515 | 7112536 | 7112520 | 7112515 | - |
| SEQ ID NO 9034 | CTGAATCTTCTGAGGGTGACAG | CTG | chr17 | 7112495 | 7112516 | 7112500 | 7112495 | - |
| SEQ ID NO 9035 | AATCTTCTGAGGGTGACAGAAT | CTG | chr17 | 7112492 | 7112513 | 7112497 | 7112492 | - |
| SEQ ID NO 9036 | CTGAGGGTGACAGAATTTAGAG | CTT | chr17 | 7112486 | 7112507 | 7112491 | 7112486 | - |
| SEQ ID NO 9037 | TGAGGGTGACAGAATTTAGAGT | TTC | chr17 | 7112485 | 7112506 | 7112490 | 7112485 | - |
| SEQ ID NO 9038 | AGGGTGACAGAATTTAGAGTTT | CTG | chr17 | 7112483 | 7112504 | 7112488 | 7112483 | - |
| SEQ ID NO 9039 | AGAGTTTGAGCAGGAGGCTTGG | TTT | chr17 | 7112468 | 7112489 | 7112473 | 7112468 | - |
| SEQ ID NO 9040 | GAGTTTGAGCAGGAGGCTTGGA | TTA | chr17 | 7112467 | 7112488 | 7112472 | 7112467 | - |
| SEQ ID NO 9041 | GAGCAGGAGGCTTGGAGAGAGG | TTT | chr17 | 7112461 | 7112482 | 7112466 | 7112461 | - |
| SEQ ID NO 9042 | AGCAGGAGGCTTGGAGAGAGGC | TTG | chr17 | 7112460 | 7112481 | 7112465 | 7112460 | - |
| SEQ ID NO 9043 | GGAGAGAGGCCAGGATTTCTGA | CTT | chr17 | 7112448 | 7112469 | 7112453 | 7112448 | - |
| SEQ ID NO 9044 | GAGAGAGGCCAGGATTTCTGAA | TTG | chr17 | 7112447 | 7112468 | 7112452 | 7112447 | - |
| SEQ ID NO 9045 | CTGAAATTAATGGGAGAGTGAG | TTT | chr17 | 7112430 | 7112451 | 7112435 | 7112430 | - |
| SEQ ID NO 9046 | TGAAATTAATGGGAGAGTGAGC | TTC | chr17 | 7112429 | 7112450 | 7112434 | 7112429 | - |
| SEQ ID NO 9047 | AAATTAATGGGAGAGTGAGCTC | CTG | chr17 | 7112427 | 7112448 | 7112432 | 7112427 | - |
| SEQ ID NO 9048 | ATGGGAGAGTGAGCTCACGCGA | TTA | chr17 | 7112421 | 7112442 | 7112426 | 7112421 | - |
| SEQ ID NO 9049 | ACGCGAATGGGCTGAGGGACAC | CTC | chr17 | 7112405 | 7112426 | 7112410 | 7112405 | - |
| SEQ ID NO 9050 | AGGGACACCAGTGAGGGACCGT | CTG | chr17 | 7112391 | 7112412 | 7112396 | 7112391 | - |
| SEQ ID NO 9051 | AAGGGATGTAGCAAAGTCACCG | CTG | chr17 | 7112366 | 7112387 | 7112371 | 7112366 | - |
| SEQ ID NO 9052 | CCCTCCAGCAGCCCGGGTGGTG | TTT | chr17 | 7112339 | 7112360 | 7112344 | 7112339 | - |
| SEQ ID NO 9053 | CCTCCAGCAGCCCGGGTGGTGG | TTC | chr17 | 7112338 | 7112359 | 7112343 | 7112338 | - |
| SEQ ID NO 9054 | CAGCAGCCCGGGTGGTGGGGGC | CTC | chr17 | 7112334 | 7112355 | 7112339 | 7112334 | - |
| SEQ ID NO 9055 | GGGGAACGTCATCATGGGAGCT | CTG | chr17 | 7112310 | 7112331 | 7112315 | 7112310 | - |
| SEQ ID NO 9056 | ACACTGATCAGCTGCTCACCGG | CTG | chr17 | 7112287 | 7112308 | 7112292 | 7112287 | - |
| SEQ ID NO 9057 | ATCAGCTGCTCACCGGGCCCA | CTG | chr17 | 7112281 | 7112302 | 7112286 | 7112281 | - |
| SEQ ID NO 9058 | CTCACCGGGCCCATCTTCCAC | CTG | chr17 | 7112273 | 7112294 | 7112278 | 7112273 | - |
| SEQ ID NO 9059 | ACCGGGCCCATCTTCCACTTG | CTC | chr17 | 7112270 | 7112291 | 7112275 | 7112270 | - |
| SEQ ID NO 9060 | CCACTTGTCTCAGCACTTGATT | CTT | chr17 | 7112255 | 7112276 | 7112260 | 7112255 | - |
| SEQ ID NO 9061 | CACTTGTCTCAGCACTTGATTT | TTC | chr17 | 7112254 | 7112275 | 7112259 | 7112254 | - |
| SEQ ID NO 9062 | GTCTCAGCACTTGATTTTTTC | CTT | chr17 | 7112249 | 7112270 | 7112254 | 7112249 | - |
| SEQ ID NO 9063 | TCTCAGCACTTGATTTTTTCT | TTG | chr17 | 7112248 | 7112269 | 7112253 | 7112248 | - |
| SEQ ID NO 9064 | AGCACTTGATTTTTTCTGCTA | CTC | chr17 | 7112244 | 7112265 | 7112249 | 7112244 | - |
| SEQ ID NO 9065 | GATTTTTTCTGCTACCCCCTT | CTT | chr17 | 7112237 | 7112258 | 7112242 | 7112237 | - |
| SEQ ID NO 9066 | ATTTTTTCTGCTACCCCCTTT | TTG | chr17 | 7112236 | 7112257 | 7112241 | 7112236 | - |
| SEQ ID NO 9067 | TTTTCTGCTACCCCCTTTTCT | TTT | chr17 | 7112232 | 7112253 | 7112237 | 7112232 | - |
| SEQ ID NO 9068 | TTTCTGCTACCCCCTTTTCTT | TTT | chr17 | 7112231 | 7112252 | 7112236 | 7112231 | - |
| SEQ ID NO 9069 | TTCTGCTACCCCCTTTTCTTT | TTT | chr17 | 7112230 | 7112251 | 7112235 | 7112230 | - |
| SEQ ID NO 9070 | TCTGCTACCCCCTTTTCTTTT | TTT | chr17 | 7112229 | 7112250 | 7112234 | 7112229 | - |

Figure 30 (Cont'd)

| SEQ ID NO | Sequence | | Chr | Start | End | Pos1 | Pos2 | |
|---|---|---|---|---|---|---|---|---|
| SEQ ID NO 9071 | CTGCTACCCCCTTTTTCTTTTA | TTT | chr17 | 7112228 | 7112249 | 7112233 | 7112228 | - |
| SEQ ID NO 9072 | TGCTACCCCCTTTTTCTTTTAA | TTC | chr17 | 7112227 | 7112248 | 7112232 | 7112227 | - |
| SEQ ID NO 9073 | CTACCCCCTTTTTCTTTTAAAG | CTG | chr17 | 7112225 | 7112246 | 7112230 | 7112225 | - |
| SEQ ID NO 9074 | CCCCCTTTTTCTTTTAAAGATT | CTA | chr17 | 7112222 | 7112243 | 7112227 | 7112222 | - |
| SEQ ID NO 9075 | TTTCTTTTAAAGATTTCAATTA | CTT | chr17 | 7112215 | 7112236 | 7112220 | 7112215 | - |
| SEQ ID NO 9076 | TTCTTTTAAAGATTTCAATTAT | TTT | chr17 | 7112214 | 7112235 | 7112219 | 7112214 | - |
| SEQ ID NO 9077 | TCTTTTAAAGATTTCAATTATG | TTT | chr17 | 7112213 | 7112234 | 7112218 | 7112213 | - |
| SEQ ID NO 9078 | CTTTTAAAGATTTCAATTATGC | TTT | chr17 | 7112212 | 7112233 | 7112217 | 7112212 | - |
| SEQ ID NO 9079 | TTTTAAAGATTTCAATTATGCA | TTC | chr17 | 7112211 | 7112232 | 7112216 | 7112211 | - |
| SEQ ID NO 9080 | TTAAAGATTTCAATTATGCATG | CTT | chr17 | 7112209 | 7112230 | 7112214 | 7112209 | - |
| SEQ ID NO 9081 | TAAAGATTTCAATTATGCATGT | TTT | chr17 | 7112208 | 7112229 | 7112213 | 7112208 | - |
| SEQ ID NO 9082 | AAAGATTTCAATTATGCATGTA | TTT | chr17 | 7112207 | 7112228 | 7112212 | 7112207 | - |
| SEQ ID NO 9083 | AAGATTTCAATTATGCATGTAT | TTA | chr17 | 7112206 | 7112227 | 7112211 | 7112206 | - |
| SEQ ID NO 9084 | CAATTATGCATGTATTAAGGGT | TTT | chr17 | 7112199 | 7112220 | 7112204 | 7112199 | - |
| SEQ ID NO 9085 | AATTATGCATGTATTAAGGGTC | TTC | chr17 | 7112198 | 7112219 | 7112203 | 7112198 | - |
| SEQ ID NO 9086 | TGCATGTATTAAGGGTCCCACA | TTA | chr17 | 7112193 | 7112214 | 7112198 | 7112193 | - |
| SEQ ID NO 9087 | AGGGTCCCACAGCTCACTCATT | TTA | chr17 | 7112182 | 7112203 | 7112187 | 7112182 | - |
| SEQ ID NO 9088 | ACTCATTCTCTTTCCATTTTTT | CTC | chr17 | 7112167 | 7112188 | 7112172 | 7112167 | - |
| SEQ ID NO 9089 | ATTCTCTTTCCATTTTTTAATT | CTC | chr17 | 7112163 | 7112184 | 7112168 | 7112163 | - |
| SEQ ID NO 9090 | TCTTTCCATTTTTTAATTCTTT | TTC | chr17 | 7112159 | 7112180 | 7112164 | 7112159 | - |
| SEQ ID NO 9091 | TTTCCATTTTTTAATTCTTTTT | CTC | chr17 | 7112157 | 7112178 | 7112162 | 7112157 | - |
| SEQ ID NO 9092 | TCCATTTTTTAATTCTTTTTTC | CTT | chr17 | 7112155 | 7112176 | 7112160 | 7112155 | - |
| SEQ ID NO 9093 | CCATTTTTTAATTCTTTTTTCT | TTT | chr17 | 7112154 | 7112175 | 7112159 | 7112154 | - |
| SEQ ID NO 9094 | CATTTTTTAATTCTTTTTTCTC | TTC | chr17 | 7112153 | 7112174 | 7112158 | 7112153 | - |
| SEQ ID NO 9095 | TTTAATTCTTTTTTCTCCCAGT | TTT | chr17 | 7112148 | 7112169 | 7112153 | 7112148 | - |
| SEQ ID NO 9096 | TTAATTCTTTTTTCTCCCAGTG | TTT | chr17 | 7112147 | 7112168 | 7112152 | 7112147 | - |
| SEQ ID NO 9097 | TAATTCTTTTTTCTCCCAGTGT | TTT | chr17 | 7112146 | 7112167 | 7112151 | 7112146 | - |
| SEQ ID NO 9098 | AATTCTTTTTTCTCCCAGTGTT | TTT | chr17 | 7112145 | 7112166 | 7112150 | 7112145 | - |
| SEQ ID NO 9099 | ATTCTTTTTTCTCCCAGTGTTT | TTA | chr17 | 7112144 | 7112165 | 7112149 | 7112144 | - |
| SEQ ID NO 9100 | TTTTTTCTCCCAGTGTTTCATT | TTC | chr17 | 7112140 | 7112161 | 7112145 | 7112140 | - |
| SEQ ID NO 9101 | TTTTCTCCCAGTGTTTCATTTT | CTT | chr17 | 7112138 | 7112159 | 7112143 | 7112138 | - |
| SEQ ID NO 9102 | TTTCTCCCAGTGTTTCATTTTA | TTT | chr17 | 7112137 | 7112158 | 7112142 | 7112137 | - |
| SEQ ID NO 9103 | TTCTCCCAGTGTTTCATTTTAT | TTT | chr17 | 7112136 | 7112157 | 7112141 | 7112136 | - |
| SEQ ID NO 9104 | TCTCCCAGTGTTTCATTTTATA | TTT | chr17 | 7112135 | 7112156 | 7112140 | 7112135 | - |
| SEQ ID NO 9105 | CTCCCAGTGTTTCATTTTATAG | TTT | chr17 | 7112134 | 7112155 | 7112139 | 7112134 | - |
| SEQ ID NO 9106 | TCCCAGTGTTTCATTTTATAGA | TTC | chr17 | 7112133 | 7112154 | 7112138 | 7112133 | - |
| SEQ ID NO 9107 | CCAGTGTTTCATTTTATAGAGT | CTC | chr17 | 7112131 | 7112152 | 7112136 | 7112131 | - |
| SEQ ID NO 9108 | CATTTTATAGAGTTATTGCTGT | TTT | chr17 | 7112122 | 7112143 | 7112127 | 7112122 | - |
| SEQ ID NO 9109 | ATTTTATAGAGTTATTGCTGTT | TTC | chr17 | 7112121 | 7112142 | 7112126 | 7112121 | - |
| SEQ ID NO 9110 | TATAGAGTTATTGCTGTTCATT | TTT | chr17 | 7112117 | 7112138 | 7112122 | 7112117 | - |
| SEQ ID NO 9111 | ATAGAGTTATTGCTGTTCATTA | TTT | chr17 | 7112116 | 7112137 | 7112121 | 7112116 | - |
| SEQ ID NO 9112 | TAGAGTTATTGCTGTTCATTAA | TTA | chr17 | 7112115 | 7112136 | 7112120 | 7112115 | - |
| SEQ ID NO 9113 | TTGCTGTTCATTAAGTTAACTA | TTA | chr17 | 7112107 | 7112128 | 7112112 | 7112107 | - |
| SEQ ID NO 9114 | CTGTTCATTAAGTTAACTAAAA | TTG | chr17 | 7112104 | 7112125 | 7112109 | 7112104 | - |
| SEQ ID NO 9115 | TTCATTAAGTTAACTAAAATTT | CTG | chr17 | 7112101 | 7112122 | 7112106 | 7112101 | - |
| SEQ ID NO 9116 | ATTAAGTTAACTAAAATTTTCC | TTC | chr17 | 7112098 | 7112119 | 7112103 | 7112098 | - |
| SEQ ID NO 9117 | AGTTAACTAAAATTTTCCCCTT | TTA | chr17 | 7112094 | 7112115 | 7112099 | 7112094 | - |
| SEQ ID NO 9118 | ACTAAAATTTTCCCCTTCCCCT | TTA | chr17 | 7112089 | 7112110 | 7112094 | 7112089 | - |
| SEQ ID NO 9119 | AAATTTTCCCCTTCCCCTCCCC | CTA | chr17 | 7112085 | 7112106 | 7112090 | 7112085 | - |
| SEQ ID NO 9120 | TCCCCTTCCCCTCCCCCTCCCC | TTT | chr17 | 7112079 | 7112100 | 7112084 | 7112079 | - |
| SEQ ID NO 9121 | CCCCTTCCCCTCCCCCTCCCCT | TTT | chr17 | 7112078 | 7112099 | 7112083 | 7112078 | - |
| SEQ ID NO 9122 | CCCTTCCCCTCCCCCTCCCCTC | TTC | chr17 | 7112077 | 7112098 | 7112082 | 7112077 | - |
| SEQ ID NO 9123 | CCCCTCCCCTCCCCTCCCCTC | CTT | chr17 | 7112072 | 7112093 | 7112077 | 7112072 | - |
| SEQ ID NO 9124 | CCCTCCCCCTCCCCTCCCCTCC | TTC | chr17 | 7112071 | 7112092 | 7112076 | 7112071 | - |
| SEQ ID NO 9125 | CCCCTCCCCTCCCCTCCTTTCC | CTC | chr17 | 7112066 | 7112087 | 7112071 | 7112066 | - |
| SEQ ID NO 9126 | CCCTCCCCTCCTTTCCTTCCCT | CTC | chr17 | 7112060 | 7112081 | 7112065 | 7112060 | - |
| SEQ ID NO 9127 | CCCTCCTTTCCTTCCCTCGCTT | CTC | chr17 | 7112055 | 7112076 | 7112060 | 7112055 | - |
| SEQ ID NO 9128 | CTTTCCTTCCCTCGCTTCCCCT | CTC | chr17 | 7112050 | 7112071 | 7112055 | 7112050 | - |

Figure 30 (Cont'd)

| | | | | | | | | |
|---|---|---|---|---|---|---|---|---|
| SEQ ID NO 9129 | TCCTTCCCTCGCTTCCCCTCCC | CTT | chr17 | 7112047 | 7112068 | 7112052 | 7112047 | - |
| SEQ ID NO 9130 | CCTTCCCTCGCTTCCCCTCCCC | TTT | chr17 | 7112046 | 7112067 | 7112051 | 7112046 | - |
| SEQ ID NO 9131 | CTTCCCTCGCTTCCCCTCCCCT | TTC | chr17 | 7112045 | 7112066 | 7112050 | 7112045 | - |
| SEQ ID NO 9132 | CCCTCGCTTCCCCTCCCCTCTC | CTT | chr17 | 7112042 | 7112063 | 7112047 | 7112042 | - |
| SEQ ID NO 9133 | CCTCGCTTCCCCTCCCCTCTCT | TTC | chr17 | 7112041 | 7112062 | 7112046 | 7112041 | - |
| SEQ ID NO 9134 | GCTTCCCCTCCCCTCTCTCTCT | CTC | chr17 | 7112037 | 7112058 | 7112042 | 7112037 | - |
| SEQ ID NO 9135 | CCCCTCCCCTCTCTCTCTCTCA | CTT | chr17 | 7112033 | 7112054 | 7112038 | 7112033 | - |
| SEQ ID NO 9136 | CCCTCCCCTCTCTCTCTCTCAT | TTC | chr17 | 7112032 | 7112053 | 7112037 | 7112032 | - |
| SEQ ID NO 9137 | CCCTCTCTCTCTCATCTCAC | CTC | chr17 | 7112027 | 7112048 | 7112032 | 7112027 | - |
| SEQ ID NO 9138 | TCTCTCTCATCTCACTCTGT | CTC | chr17 | 7112022 | 7112043 | 7112027 | 7112022 | - |
| SEQ ID NO 9139 | TCTCTCATCTCACTCTGTTG | CTC | chr17 | 7112020 | 7112041 | 7112025 | 7112020 | - |
| SEQ ID NO 9140 | TCTCTCATCTCACTCTGTTGCC | CTC | chr17 | 7112018 | 7112039 | 7112023 | 7112018 | - |
| SEQ ID NO 9141 | TCTCATCTCACTCTGTTGCCCA | CTC | chr17 | 7112016 | 7112037 | 7112021 | 7112016 | - |
| SEQ ID NO 9142 | TCATCTCACTCTGTTGCCCAGG | CTC | chr17 | 7112014 | 7112035 | 7112019 | 7112014 | - |
| SEQ ID NO 9143 | ATCTCACTCTGTTGCCCAGGCT | CTC | chr17 | 7112012 | 7112033 | 7112017 | 7112012 | - |
| SEQ ID NO 9144 | ACTCTGTTGCCCAGGCTGGAAT | CTC | chr17 | 7112007 | 7112028 | 7112012 | 7112007 | - |
| SEQ ID NO 9145 | TGTTGCCCAGGCTGGAATGCAG | CTC | chr17 | 7112003 | 7112024 | 7112008 | 7112003 | - |
| SEQ ID NO 9146 | TTGCCCAGGCTGGAATGCAGTA | CTG | chr17 | 7112001 | 7112022 | 7112006 | 7112001 | - |
| SEQ ID NO 9147 | CCCAGGCTGGAATGCAGTAGCT | TTG | chr17 | 7111998 | 7112019 | 7112003 | 7111998 | - |
| SEQ ID NO 9148 | GAATGCAGTAGCTTGTCACAAC | CTG | chr17 | 7111989 | 7112010 | 7111994 | 7111989 | - |
| SEQ ID NO 9149 | GTCACAACTCACTGTGGCCTCC | CTT | chr17 | 7111975 | 7111996 | 7111980 | 7111975 | - |
| SEQ ID NO 9150 | TCACAACTCACTGTGGCCTCCA | TTG | chr17 | 7111974 | 7111995 | 7111979 | 7111974 | - |
| SEQ ID NO 9151 | ACTGTGGCCTCCACCTCCTGGG | CTC | chr17 | 7111965 | 7111986 | 7111970 | 7111965 | - |
| SEQ ID NO 9152 | TGGCCTCCACCTCCTGGGCTCA | CTG | chr17 | 7111961 | 7111982 | 7111966 | 7111961 | - |
| SEQ ID NO 9153 | CACCTCCTGGGCTCAGGCGATC | CTC | chr17 | 7111954 | 7111975 | 7111959 | 7111954 | - |
| SEQ ID NO 9154 | CTGGGCTCAGGCGATCCTTCCA | CTC | chr17 | 7111948 | 7111969 | 7111953 | 7111948 | - |
| SEQ ID NO 9155 | GGCTCAGGCGATCCTTCCACTT | CTG | chr17 | 7111945 | 7111966 | 7111950 | 7111945 | - |
| SEQ ID NO 9156 | AGGCGATCCTTCCACTTCAGCC | CTC | chr17 | 7111940 | 7111961 | 7111945 | 7111940 | - |
| SEQ ID NO 9157 | CCACTTCAGCCTCCCAGGTAGC | CTT | chr17 | 7111929 | 7111950 | 7111934 | 7111929 | - |
| SEQ ID NO 9158 | CACTTCAGCCTCCCAGGTAGCT | TTC | chr17 | 7111928 | 7111949 | 7111933 | 7111928 | - |
| SEQ ID NO 9159 | CAGCCTCCCAGGTAGCTGGGAC | CTT | chr17 | 7111923 | 7111944 | 7111928 | 7111923 | - |
| SEQ ID NO 9160 | AGCCTCCCAGGTAGCTGGGACT | TTC | chr17 | 7111922 | 7111943 | 7111927 | 7111922 | - |
| SEQ ID NO 9161 | CCAGGTAGCTGGGACTATAGGC | CTC | chr17 | 7111916 | 7111937 | 7111921 | 7111916 | - |
| SEQ ID NO 9162 | GGACTATAGGCATGTGGCACCA | CTG | chr17 | 7111905 | 7111926 | 7111910 | 7111905 | - |
| SEQ ID NO 9163 | TAGGCATGTGGCACCACACCTG | CTA | chr17 | 7111899 | 7111920 | 7111904 | 7111899 | - |
| SEQ ID NO 9164 | GCTAATTAAAAATTTTTTTTTG | CTG | chr17 | 7111877 | 7111898 | 7111882 | 7111877 | - |
| SEQ ID NO 9165 | ATTAAAAATTTTTTTTTGTAGA | CTA | chr17 | 7111873 | 7111894 | 7111878 | 7111873 | - |
| SEQ ID NO 9166 | AAAATTTTTTTTTGTAGAGACG | TTA | chr17 | 7111869 | 7111890 | 7111874 | 7111869 | - |
| SEQ ID NO 9167 | TTTTTTGTAGAGACGGTTTTGC | TTT | chr17 | 7111862 | 7111883 | 7111867 | 7111862 | - |
| SEQ ID NO 9168 | TTTTTGTAGAGACGGTTTTGCC | TTT | chr17 | 7111861 | 7111882 | 7111866 | 7111861 | - |
| SEQ ID NO 9169 | TTTTGTAGAGACGGTTTTGCCA | TTT | chr17 | 7111860 | 7111881 | 7111865 | 7111860 | - |
| SEQ ID NO 9170 | TTTGTAGAGACGGTTTTGCCAT | TTT | chr17 | 7111859 | 7111880 | 7111864 | 7111859 | - |
| SEQ ID NO 9171 | TTGTAGAGACGGTTTTGCCATG | TTT | chr17 | 7111858 | 7111879 | 7111863 | 7111858 | - |
| SEQ ID NO 9172 | TGTAGAGACGGTTTTGCCATGT | TTT | chr17 | 7111857 | 7111878 | 7111862 | 7111857 | - |
| SEQ ID NO 9173 | GTAGAGACGGTTTTGCCATGTA | TTT | chr17 | 7111856 | 7111877 | 7111861 | 7111856 | - |
| SEQ ID NO 9174 | TAGAGACGGTTTTGCCATGTAG | TTG | chr17 | 7111855 | 7111876 | 7111860 | 7111855 | - |
| SEQ ID NO 9175 | TGCCATGTAGAGGGGTTTTGCC | TTT | chr17 | 7111843 | 7111864 | 7111848 | 7111843 | - |
| SEQ ID NO 9176 | GCCATGTAGAGGGGTTTTGCCA | TTT | chr17 | 7111842 | 7111863 | 7111847 | 7111842 | - |
| SEQ ID NO 9177 | CCATGTAGAGGGGTTTTGCCAT | TTG | chr17 | 7111841 | 7111862 | 7111846 | 7111841 | - |
| SEQ ID NO 9178 | TGCCATGCTGCCCAGACTAGTC | TTT | chr17 | 7111825 | 7111846 | 7111830 | 7111825 | - |
| SEQ ID NO 9179 | GCCATGCTGCCCAGACTAGTCT | TTT | chr17 | 7111824 | 7111845 | 7111829 | 7111824 | - |
| SEQ ID NO 9180 | CCATGCTGCCCAGACTAGTCTT | TTG | chr17 | 7111823 | 7111844 | 7111828 | 7111823 | - |
| SEQ ID NO 9181 | CCCAGACTAGTCTTGAGCTCCT | CTG | chr17 | 7111815 | 7111836 | 7111820 | 7111815 | - |
| SEQ ID NO 9182 | GTCTTGAGCTCCTGGGCTCAAG | CTA | chr17 | 7111806 | 7111827 | 7111811 | 7111806 | - |
| SEQ ID NO 9183 | GAGCTCCTGGGCTCAAGTGATT | CTT | chr17 | 7111801 | 7111822 | 7111806 | 7111801 | - |
| SEQ ID NO 9184 | AGCTCCTGGGCTCAAGTGATTC | TTG | chr17 | 7111800 | 7111821 | 7111805 | 7111800 | - |
| SEQ ID NO 9185 | CTGGGCTCAAGTGATTCCCCCC | CTC | chr17 | 7111795 | 7111816 | 7111800 | 7111795 | - |
| SEQ ID NO 9186 | GGCTCAAGTGATTCCCCCCGTG | CTG | chr17 | 7111792 | 7111813 | 7111797 | 7111792 | - |

Figure 30 (Cont'd)

| SEQ ID NO 9187 | AAGTGATTCCCCCCGTGTCGAC | CTC | chr17 | 7111787 | 7111808 | 7111792 | 7111787 | - |
|---|---|---|---|---|---|---|---|---|
| SEQ ID NO 9188 | CCCCCGTGTCGACCTCCCAAAG | TTC | chr17 | 7111778 | 7111799 | 7111783 | 7111778 | - |
| SEQ ID NO 9189 | CCAAAGTGCTGGGATTACAGAT | CTC | chr17 | 7111762 | 7111783 | 7111767 | 7111762 | - |
| SEQ ID NO 9190 | GGATTACAGATGTGATCCACAG | CTG | chr17 | 7111751 | 7111772 | 7111756 | 7111751 | - |
| SEQ ID NO 9191 | CAGATGTGATCCACAGTGCCTG | TTA | chr17 | 7111745 | 7111766 | 7111750 | 7111745 | - |
| SEQ ID NO 9192 | GCCCTAAATTTTCTTACGCAT | CTG | chr17 | 7111723 | 7111744 | 7111728 | 7111723 | - |
| SEQ ID NO 9193 | AATTTTTCTTACGCATTTCTCA | CTA | chr17 | 7111717 | 7111738 | 7111722 | 7111717 | - |
| SEQ ID NO 9194 | TTCTTACGCATTTCTCATCTTC | TTT | chr17 | 7111712 | 7111733 | 7111717 | 7111712 | - |
| SEQ ID NO 9195 | TCTTACGCATTTCTCATCTTCC | TTT | chr17 | 7111711 | 7111732 | 7111716 | 7111711 | - |
| SEQ ID NO 9196 | CTTACGCATTTCTCATCTTCCA | TTT | chr17 | 7111710 | 7111731 | 7111715 | 7111710 | - |
| SEQ ID NO 9197 | TTACGCATTTCTCATCTTCCAT | TTC | chr17 | 7111709 | 7111730 | 7111714 | 7111709 | - |
| SEQ ID NO 9198 | ACGCATTTCTCATCTTCCATTA | CTT | chr17 | 7111707 | 7111728 | 7111712 | 7111707 | - |
| SEQ ID NO 9199 | CGCATTTCTCATCTTCCATTAT | TTA | chr17 | 7111706 | 7111727 | 7111711 | 7111706 | - |
| SEQ ID NO 9200 | CTCATCTTCCATTATTTCCATC | TTT | chr17 | 7111699 | 7111720 | 7111704 | 7111699 | - |
| SEQ ID NO 9201 | TCATCTTCCATTATTTCCATCC | TTC | chr17 | 7111698 | 7111719 | 7111703 | 7111698 | - |
| SEQ ID NO 9202 | ATCTTCCATTATTTCCATCCAG | CTC | chr17 | 7111696 | 7111717 | 7111701 | 7111696 | - |
| SEQ ID NO 9203 | CCATTATTTCCATCCAGTGTGT | CTT | chr17 | 7111691 | 7111712 | 7111696 | 7111691 | - |
| SEQ ID NO 9204 | CATTATTTCCATCCAGTGTGTT | TTC | chr17 | 7111690 | 7111711 | 7111695 | 7111690 | - |
| SEQ ID NO 9205 | TTTCCATCCAGTGTGTTTTTTC | TTA | chr17 | 7111685 | 7111706 | 7111690 | 7111685 | - |
| SEQ ID NO 9206 | CCATCCAGTGTGTTTTTTCTTT | TTT | chr17 | 7111682 | 7111703 | 7111687 | 7111682 | - |
| SEQ ID NO 9207 | CATCCAGTGTGTTTTTTCTTTT | TTC | chr17 | 7111681 | 7111702 | 7111686 | 7111681 | - |
| SEQ ID NO 9208 | TTTCTTTTCTTTCTTTTCTTTT | TTT | chr17 | 7111667 | 7111688 | 7111672 | 7111667 | - |
| SEQ ID NO 9209 | TTCTTTTCTTTCTTTTCTTTTT | TTT | chr17 | 7111666 | 7111687 | 7111671 | 7111666 | - |
| SEQ ID NO 9210 | TCTTTTCTTTCTTTTCTTTTTT | TTT | chr17 | 7111665 | 7111686 | 7111670 | 7111665 | - |
| SEQ ID NO 9211 | CTTTTCTTTCTTTTCTTTTTTT | TTT | chr17 | 7111664 | 7111685 | 7111669 | 7111664 | - |
| SEQ ID NO 9212 | TTTTCTTTCTTTTCTTTTTTTT | TTC | chr17 | 7111663 | 7111684 | 7111668 | 7111663 | - |
| SEQ ID NO 9213 | TTCTTTCTTTTCTTTTTTTTTT | CTT | chr17 | 7111661 | 7111682 | 7111666 | 7111661 | - |
| SEQ ID NO 9214 | TCTTTCTTTTCTTTTTTTTTTT | TTT | chr17 | 7111660 | 7111681 | 7111665 | 7111660 | - |
| SEQ ID NO 9215 | CTTTCTTTTCTTTTTTTTTTTT | TTT | chr17 | 7111659 | 7111680 | 7111664 | 7111659 | - |
| SEQ ID NO 9216 | TTTCTTTTCTTTTTTTTTTTTT | TTC | chr17 | 7111658 | 7111679 | 7111663 | 7111658 | - |
| SEQ ID NO 9217 | TCTTTTCTTTTTTTTTTTTTTG | CTT | chr17 | 7111656 | 7111677 | 7111661 | 7111656 | - |
| SEQ ID NO 9218 | CTTTTCTTTTTTTTTTTTTTGG | TTT | chr17 | 7111655 | 7111676 | 7111660 | 7111655 | - |
| SEQ ID NO 9219 | TTTTCTTTTTTTTTTTTTTGGA | TTC | chr17 | 7111654 | 7111675 | 7111659 | 7111654 | - |
| SEQ ID NO 9220 | TTCTTTTTTTTTTTTTTGGAGG | CTT | chr17 | 7111652 | 7111673 | 7111657 | 7111652 | - |
| SEQ ID NO 9221 | TCTTTTTTTTTTTTTTGGAGGC | TTT | chr17 | 7111651 | 7111672 | 7111656 | 7111651 | - |
| SEQ ID NO 9222 | CTTTTTTTTTTTTTTGGAGGCG | TTT | chr17 | 7111650 | 7111671 | 7111655 | 7111650 | - |
| SEQ ID NO 9223 | TTTTTTTTTTTTTGGAGGCGG | TTC | chr17 | 7111649 | 7111670 | 7111654 | 7111649 | - |
| SEQ ID NO 9224 | TTTTTTTTTTTTGGAGGCGGAG | CTT | chr17 | 7111647 | 7111668 | 7111652 | 7111647 | - |
| SEQ ID NO 9225 | TTTTTTTTTTTGGAGGCGGAGT | TTT | chr17 | 7111646 | 7111667 | 7111651 | 7111646 | - |
| SEQ ID NO 9226 | TTTTTTTTTTGGAGGCGGAGTC | TTT | chr17 | 7111645 | 7111666 | 7111650 | 7111645 | - |
| SEQ ID NO 9227 | TTTTTTTTTGGAGGCGGAGTCT | TTT | chr17 | 7111644 | 7111665 | 7111649 | 7111644 | - |
| SEQ ID NO 9228 | TTTTTTTTGGAGGCGGAGTCTC | TTT | chr17 | 7111643 | 7111664 | 7111648 | 7111643 | - |
| SEQ ID NO 9229 | TTTTTTTGGAGGCGGAGTCTCG | TTT | chr17 | 7111642 | 7111663 | 7111647 | 7111642 | - |
| SEQ ID NO 9230 | TTTTTTGGAGGCGGAGTCTCGC | TTT | chr17 | 7111641 | 7111662 | 7111646 | 7111641 | - |
| SEQ ID NO 9231 | TTTTTGGAGGCGGAGTCTCGCT | TTT | chr17 | 7111640 | 7111661 | 7111645 | 7111640 | - |
| SEQ ID NO 9232 | TTTTGGAGGCGGAGTCTCGCTC | TTT | chr17 | 7111639 | 7111660 | 7111644 | 7111639 | - |
| SEQ ID NO 9233 | TTTGGAGGCGGAGTCTCGCTCT | TTT | chr17 | 7111638 | 7111659 | 7111643 | 7111638 | - |
| SEQ ID NO 9234 | TTGGAGGCGGAGTCTCGCTCTG | TTT | chr17 | 7111637 | 7111658 | 7111642 | 7111637 | - |
| SEQ ID NO 9235 | TGGAGGCGGAGTCTCGCTCTGT | TTT | chr17 | 7111636 | 7111657 | 7111641 | 7111636 | - |
| SEQ ID NO 9236 | GGAGGCGGAGTCTCGCTCTGTT | TTT | chr17 | 7111635 | 7111656 | 7111640 | 7111635 | - |
| SEQ ID NO 9237 | GAGGCGGAGTCTCGCTCTGTTG | TTG | chr17 | 7111634 | 7111655 | 7111639 | 7111634 | - |
| SEQ ID NO 9238 | GCTCTGTTGCCCAGGCCGGAGT | CTC | chr17 | 7111621 | 7111642 | 7111626 | 7111621 | - |
| SEQ ID NO 9239 | TGTTGCCCAGGCCGGAGTGCAG | CTC | chr17 | 7111617 | 7111638 | 7111622 | 7111617 | - |
| SEQ ID NO 9240 | TTGCCCAGGCCGGAGTGCAGTG | CTG | chr17 | 7111615 | 7111636 | 7111620 | 7111615 | - |
| SEQ ID NO 9241 | CCCAGGCCGGAGTGCAGTGGCG | TTG | chr17 | 7111612 | 7111633 | 7111617 | 7111612 | - |
| SEQ ID NO 9242 | GGCTCACTGCAAGCTCTGCCTC | CTT | chr17 | 7111583 | 7111604 | 7111588 | 7111583 | - |
| SEQ ID NO 9243 | GCTCACTGCAAGCTCTGCCTCC | TTG | chr17 | 7111582 | 7111603 | 7111587 | 7111582 | - |
| SEQ ID NO 9244 | ACTGCAAGCTCTGCCTCCCGGG | CTC | chr17 | 7111578 | 7111599 | 7111583 | 7111578 | - |

Figure 30 (Cont'd)

| | | | | | | | | |
|---|---|---|---|---|---|---|---|---|
| SEQ ID NO 9245 | CAAGCTCTGCCTCCCGGGTTCA | CTG | chr17 | 7111574 | 7111595 | 7111579 | 7111574 | - |
| SEQ ID NO 9246 | TGCCTCCCGGGTTCATGCCATT | CTC | chr17 | 7111567 | 7111588 | 7111572 | 7111567 | - |
| SEQ ID NO 9247 | CCTCCCGGGTTCATGCCATTCT | CTG | chr17 | 7111565 | 7111586 | 7111570 | 7111565 | - |
| SEQ ID NO 9248 | CCGGGTTCATGCCATTCTCCTG | CTC | chr17 | 7111561 | 7111582 | 7111566 | 7111561 | - |
| SEQ ID NO 9249 | ATGCCATTCTCCTGCCTCAGCC | TTC | chr17 | 7111553 | 7111574 | 7111558 | 7111553 | - |
| SEQ ID NO 9250 | TCCTGCCTCAGCCTCCCGAGTA | TTC | chr17 | 7111544 | 7111565 | 7111549 | 7111544 | - |
| SEQ ID NO 9251 | CTGCCTCAGCCTCCCGAGTAGC | CTC | chr17 | 7111542 | 7111563 | 7111547 | 7111542 | - |
| SEQ ID NO 9252 | CCTCAGCCTCCCGAGTAGCTGG | CTG | chr17 | 7111539 | 7111560 | 7111544 | 7111539 | - |
| SEQ ID NO 9253 | AGCCTCCCGAGTAGCTGGGACT | CTC | chr17 | 7111535 | 7111556 | 7111540 | 7111535 | - |
| SEQ ID NO 9254 | CCGAGTAGCTGGGACTACAGGC | CTC | chr17 | 7111529 | 7111550 | 7111534 | 7111529 | - |
| SEQ ID NO 9255 | GGACTACAGGCGCCTGCCACCA | CTG | chr17 | 7111518 | 7111539 | 7111523 | 7111518 | - |
| SEQ ID NO 9256 | CAGGCGCCTGCCACCACGTCTG | CTA | chr17 | 7111512 | 7111533 | 7111517 | 7111512 | - |
| SEQ ID NO 9257 | CCACCACGTCTGGCTAATTTTT | CTG | chr17 | 7111502 | 7111523 | 7111507 | 7111502 | - |
| SEQ ID NO 9258 | GCTAATTTTTTGTATTTTTAGT | CTG | chr17 | 7111490 | 7111511 | 7111495 | 7111490 | - |
| SEQ ID NO 9259 | ATTTTTTGTATTTTTAGTAGAG | CTA | chr17 | 7111486 | 7111507 | 7111491 | 7111486 | - |
| SEQ ID NO 9260 | TTTGTATTTTTAGTAGAGATGG | TTT | chr17 | 7111482 | 7111503 | 7111487 | 7111482 | - |
| SEQ ID NO 9261 | TTGTATTTTTAGTAGAGATGGG | TTT | chr17 | 7111481 | 7111502 | 7111486 | 7111481 | - |
| SEQ ID NO 9262 | TGTATTTTTAGTAGAGATGGGG | TTT | chr17 | 7111480 | 7111501 | 7111485 | 7111480 | - |
| SEQ ID NO 9263 | GTATTTTTAGTAGAGATGGGGT | TTT | chr17 | 7111479 | 7111500 | 7111484 | 7111479 | - |
| SEQ ID NO 9264 | TATTTTTAGTAGAGATGGGGTT | TTG | chr17 | 7111478 | 7111499 | 7111483 | 7111478 | - |
| SEQ ID NO 9265 | TTAGTAGAGATGGGGTTTCACC | TTT | chr17 | 7111473 | 7111494 | 7111478 | 7111473 | - |
| SEQ ID NO 9266 | TAGTAGAGATGGGGTTTCACCA | TTT | chr17 | 7111472 | 7111493 | 7111477 | 7111472 | - |
| SEQ ID NO 9267 | AGTAGAGATGGGGTTTCACCAT | TTT | chr17 | 7111471 | 7111492 | 7111476 | 7111471 | - |
| SEQ ID NO 9268 | GTAGAGATGGGGTTTCACCATG | TTA | chr17 | 7111470 | 7111491 | 7111475 | 7111470 | - |
| SEQ ID NO 9269 | CACCATGTTAGCCAGGATGGTG | TTT | chr17 | 7111455 | 7111476 | 7111460 | 7111455 | - |
| SEQ ID NO 9270 | ACCATGTTAGCCAGGATGGTGT | TTC | chr17 | 7111454 | 7111475 | 7111459 | 7111454 | - |
| SEQ ID NO 9271 | GCCAGGATGGTGTCGATCTCCT | TTA | chr17 | 7111445 | 7111466 | 7111450 | 7111445 | - |
| SEQ ID NO 9272 | CTGACCTCATGATCTGCCCGCC | CTC | chr17 | 7111425 | 7111446 | 7111430 | 7111425 | - |
| SEQ ID NO 9273 | ACCTCATGATCTGCCCGCCTTG | CTG | chr17 | 7111422 | 7111443 | 7111427 | 7111422 | - |
| SEQ ID NO 9274 | ATGATCTGCCCGCCTTGGCCTC | CTC | chr17 | 7111417 | 7111438 | 7111422 | 7111417 | - |
| SEQ ID NO 9275 | CCCGCCTTGGCCTCCCACAGTG | CTG | chr17 | 7111409 | 7111430 | 7111414 | 7111409 | - |
| SEQ ID NO 9276 | GGCCTCCCACAGTGCTGGGATT | CTT | chr17 | 7111401 | 7111422 | 7111406 | 7111401 | - |
| SEQ ID NO 9277 | GCCTCCCACAGTGCTGGGATTC | TTG | chr17 | 7111400 | 7111421 | 7111405 | 7111400 | - |
| SEQ ID NO 9278 | CCACAGTGCTGGGATTCCAGGC | CTC | chr17 | 7111395 | 7111416 | 7111400 | 7111395 | - |
| SEQ ID NO 9279 | GGATTCCAGGCGTGAGCCACGG | CTG | chr17 | 7111384 | 7111405 | 7111389 | 7111384 | - |
| SEQ ID NO 9280 | CAGGCGTGAGCCACGGCGCCTG | TTC | chr17 | 7111378 | 7111399 | 7111383 | 7111378 | - |
| SEQ ID NO 9281 | GCCAGTGTGTTTTTTCATTTCA | CTG | chr17 | 7111356 | 7111377 | 7111361 | 7111356 | - |
| SEQ ID NO 9282 | TTTCATTTCAGACATTGTAGTT | TTT | chr17 | 7111344 | 7111365 | 7111349 | 7111344 | - |
| SEQ ID NO 9283 | TTCATTTCAGACATTGTAGTTT | TTT | chr17 | 7111343 | 7111364 | 7111348 | 7111343 | - |
| SEQ ID NO 9284 | TCATTTCAGACATTGTAGTTTT | TTT | chr17 | 7111342 | 7111363 | 7111347 | 7111342 | - |
| SEQ ID NO 9285 | CATTTCAGACATTGTAGTTTTT | TTT | chr17 | 7111341 | 7111362 | 7111346 | 7111341 | - |
| SEQ ID NO 9286 | ATTTCAGACATTGTAGTTTTTA | TTC | chr17 | 7111340 | 7111361 | 7111345 | 7111340 | - |
| SEQ ID NO 9287 | CAGACATTGTAGTTTTTATCTC | TTT | chr17 | 7111336 | 7111357 | 7111341 | 7111336 | - |
| SEQ ID NO 9288 | AGACATTGTAGTTTTTATCTCT | TTC | chr17 | 7111335 | 7111356 | 7111340 | 7111335 | - |
| SEQ ID NO 9289 | TAGTTTTTATCTCTAGAAGTTC | TTG | chr17 | 7111327 | 7111348 | 7111332 | 7111327 | - |
| SEQ ID NO 9290 | TTATCTCTAGAAGTTCACCTGG | TTT | chr17 | 7111321 | 7111342 | 7111326 | 7111321 | - |
| SEQ ID NO 9291 | TATCTCTAGAAGTTCACCTGGG | TTT | chr17 | 7111320 | 7111341 | 7111325 | 7111320 | - |
| SEQ ID NO 9292 | ATCTCTAGAAGTTCACCTGGGG | TTT | chr17 | 7111319 | 7111340 | 7111324 | 7111319 | - |
| SEQ ID NO 9293 | TCTCTAGAAGTTCACCTGGGGA | TTA | chr17 | 7111318 | 7111339 | 7111323 | 7111318 | - |
| SEQ ID NO 9294 | TAGAAGTTCACCTGGGGACTCT | CTC | chr17 | 7111314 | 7111335 | 7111319 | 7111314 | - |
| SEQ ID NO 9295 | GAAGTTCACCTGGGGACTCTTA | CTA | chr17 | 7111312 | 7111333 | 7111317 | 7111312 | - |
| SEQ ID NO 9296 | ACCTGGGGACTCTTAAATATCC | TTC | chr17 | 7111305 | 7111326 | 7111310 | 7111305 | - |
| SEQ ID NO 9297 | GGGACTCTTAAATATCCTCCAC | CTG | chr17 | 7111300 | 7111321 | 7111305 | 7111300 | - |
| SEQ ID NO 9298 | TTAAATATCCTCCACAATTCTA | CTC | chr17 | 7111293 | 7111314 | 7111298 | 7111293 | - |
| SEQ ID NO 9299 | AAATATCCTCCACAATTCTACT | CTT | chr17 | 7111291 | 7111312 | 7111296 | 7111291 | - |
| SEQ ID NO 9300 | AATATCCTCCACAATTCTACTT | TTA | chr17 | 7111290 | 7111311 | 7111295 | 7111290 | - |
| SEQ ID NO 9301 | CACAATTCTACTTAATTTTTTG | CTC | chr17 | 7111281 | 7111302 | 7111286 | 7111281 | - |
| SEQ ID NO 9302 | TACTTAATTTTTTGAACATAAT | TTC | chr17 | 7111273 | 7111294 | 7111278 | 7111273 | - |

Figure 30 (Cont'd)

| SEQ ID NO 9303 | CTTAATTTTTTGAACATAATGG | CTA | chr17 | 7111271 | 7111292 | 7111276 | 7111271 | - |
|---|---|---|---|---|---|---|---|---|
| SEQ ID NO 9304 | AATTTTTTGAACATAATGGGAT | CTT | chr17 | 7111268 | 7111289 | 7111273 | 7111268 | - |
| SEQ ID NO 9305 | ATTTTTTGAACATAATGGGATA | TTA | chr17 | 7111267 | 7111288 | 7111272 | 7111267 | - |
| SEQ ID NO 9306 | TTTGAACATAATGGGATATGGC | TTT | chr17 | 7111263 | 7111284 | 7111268 | 7111263 | - |
| SEQ ID NO 9307 | TTGAACATAATGGGATATGGCT | TTT | chr17 | 7111262 | 7111283 | 7111267 | 7111262 | - |
| SEQ ID NO 9308 | TGAACATAATGGGATATGGCTA | TTT | chr17 | 7111261 | 7111282 | 7111266 | 7111261 | - |
| SEQ ID NO 9309 | GAACATAATGGGATATGGCTAT | TTT | chr17 | 7111260 | 7111281 | 7111265 | 7111260 | - |
| SEQ ID NO 9310 | AACATAATGGGATATGGCTATA | TTG | chr17 | 7111259 | 7111280 | 7111264 | 7111259 | - |
| SEQ ID NO 9311 | TAATATCTGTTTTACCATCCTT | CTA | chr17 | 7111239 | 7111260 | 7111244 | 7111239 | - |
| SEQ ID NO 9312 | TTTTACCATCCTTGCCTGCTAA | CTG | chr17 | 7111230 | 7111251 | 7111235 | 7111230 | - |
| SEQ ID NO 9313 | TACCATCCTTGCCTGCTAATTC | TTT | chr17 | 7111227 | 7111248 | 7111232 | 7111227 | - |
| SEQ ID NO 9314 | ACCATCCTTGCCTGCTAATTCT | TTT | chr17 | 7111226 | 7111247 | 7111231 | 7111226 | - |
| SEQ ID NO 9315 | CCATCCTTGCCTGCTAATTCTA | TTA | chr17 | 7111225 | 7111246 | 7111230 | 7111225 | - |
| SEQ ID NO 9316 | GCCTGCTAATTCTAGCATCCGT | CTT | chr17 | 7111217 | 7111238 | 7111222 | 7111217 | - |
| SEQ ID NO 9317 | CCTGCTAATTCTAGCATCCGTG | TTG | chr17 | 7111216 | 7111237 | 7111221 | 7111216 | - |
| SEQ ID NO 9318 | CTAATTCTAGCATCCGTGTCAG | CTG | chr17 | 7111212 | 7111233 | 7111217 | 7111212 | - |
| SEQ ID NO 9319 | ATTCTAGCATCCGTGTCAGTTC | CTA | chr17 | 7111209 | 7111230 | 7111214 | 7111209 | - |
| SEQ ID NO 9320 | TAGCATCCGTGTCAGTTCTGGA | TTC | chr17 | 7111205 | 7111226 | 7111210 | 7111205 | - |
| SEQ ID NO 9321 | GCATCCGTGTCAGTTCTGGATC | CTA | chr17 | 7111203 | 7111224 | 7111208 | 7111203 | - |
| SEQ ID NO 9322 | TGGATCTCTTTTGATATTTATG | TTC | chr17 | 7111187 | 7111208 | 7111192 | 7111187 | - |
| SEQ ID NO 9323 | GATCTCTTTTGATATTTATGAA | CTG | chr17 | 7111185 | 7111206 | 7111190 | 7111185 | - |
| SEQ ID NO 9324 | TTTTGATATTTATGAACCTCCT | CTC | chr17 | 7111179 | 7111200 | 7111184 | 7111179 | - |
| SEQ ID NO 9325 | TTGATATTTATGAACCTCCTCG | CTT | chr17 | 7111177 | 7111198 | 7111182 | 7111177 | - |
| SEQ ID NO 9326 | TGATATTTATGAACCTCCTCGT | TTT | chr17 | 7111176 | 7111197 | 7111181 | 7111176 | - |
| SEQ ID NO 9327 | GATATTTATGAACCTCCTCGTT | TTT | chr17 | 7111175 | 7111196 | 7111180 | 7111175 | - |
| SEQ ID NO 9328 | ATATTTATGAACCTCCTCGTTA | TTG | chr17 | 7111174 | 7111195 | 7111179 | 7111174 | - |
| SEQ ID NO 9329 | ATGAACCTCCTCGTTATGCATT | TTT | chr17 | 7111168 | 7111189 | 7111173 | 7111168 | - |
| SEQ ID NO 9330 | TGAACCTCCTCGTTATGCATTG | TTA | chr17 | 7111167 | 7111188 | 7111172 | 7111167 | - |
| SEQ ID NO 9331 | CTCGTTATGCATTGTGTTTTCC | CTC | chr17 | 7111159 | 7111180 | 7111164 | 7111159 | - |
| SEQ ID NO 9332 | GTTATGCATTGTGTTTTCCCGT | CTC | chr17 | 7111156 | 7111177 | 7111161 | 7111156 | - |
| SEQ ID NO 9333 | TGCATTGTGTTTTCCCGTTTCA | TTA | chr17 | 7111152 | 7111173 | 7111157 | 7111152 | - |
| SEQ ID NO 9334 | TGTTTTCCCGTTTCATTGCATG | TTG | chr17 | 7111145 | 7111166 | 7111150 | 7111145 | - |
| SEQ ID NO 9335 | TCCCGTTTCATTGCATGCCTTG | TTT | chr17 | 7111140 | 7111161 | 7111145 | 7111140 | - |
| SEQ ID NO 9336 | CCCGTTTCATTGCATGCCTTGT | TTT | chr17 | 7111139 | 7111160 | 7111144 | 7111139 | - |
| SEQ ID NO 9337 | CCGTTTCATTGCATGCCTTGTA | TTC | chr17 | 7111138 | 7111159 | 7111143 | 7111138 | - |
| SEQ ID NO 9338 | CATTGCATGCCTTGTAATCTTT | TTT | chr17 | 7111132 | 7111153 | 7111137 | 7111132 | - |
| SEQ ID NO 9339 | ATTGCATGCCTTGTAATCTTTG | TTC | chr17 | 7111131 | 7111152 | 7111136 | 7111131 | - |
| SEQ ID NO 9340 | CATGCCTTGTAATCTTTGATTG | TTG | chr17 | 7111127 | 7111148 | 7111132 | 7111127 | - |
| SEQ ID NO 9341 | GTAATCTTTGATTGGCTGCCAG | CTT | chr17 | 7111119 | 7111140 | 7111124 | 7111119 | - |
| SEQ ID NO 9342 | TAATCTTTGATTGGCTGCCAGA | TTG | chr17 | 7111118 | 7111139 | 7111123 | 7111118 | - |
| SEQ ID NO 9343 | TGATTGGCTGCCAGACATTGTC | CTT | chr17 | 7111111 | 7111132 | 7111116 | 7111111 | - |
| SEQ ID NO 9344 | GATTGGCTGCCAGACATTGTCA | TTT | chr17 | 7111110 | 7111131 | 7111115 | 7111110 | - |
| SEQ ID NO 9345 | ATTGGCTGCCAGACATTGTCAA | TTG | chr17 | 7111109 | 7111130 | 7111114 | 7111109 | - |
| SEQ ID NO 9346 | GCTGCCAGACATTGTCAATTTC | TTG | chr17 | 7111105 | 7111126 | 7111110 | 7111105 | - |
| SEQ ID NO 9347 | CCAGACATTGTCAATTTCACCT | CTG | chr17 | 7111101 | 7111122 | 7111106 | 7111101 | - |
| SEQ ID NO 9348 | TCAATTTCACCTTGTTGGGTGC | TTG | chr17 | 7111091 | 7111112 | 7111096 | 7111091 | - |
| SEQ ID NO 9349 | CACCTTGTTGGGTGCTGGATAT | TTT | chr17 | 7111084 | 7111105 | 7111089 | 7111084 | - |
| SEQ ID NO 9350 | ACCTTGTTGGGTGCTGGATATT | TTC | chr17 | 7111083 | 7111104 | 7111088 | 7111083 | - |
| SEQ ID NO 9351 | GTTGGGTGCTGGATATTTTTGT | CTT | chr17 | 7111078 | 7111099 | 7111083 | 7111078 | - |
| SEQ ID NO 9352 | TTGGGTGCTGGATATTTTTGTA | TTG | chr17 | 7111077 | 7111098 | 7111082 | 7111077 | - |
| SEQ ID NO 9353 | GGTGCTGGATATTTTTGTATTC | TTG | chr17 | 7111074 | 7111095 | 7111079 | 7111074 | - |
| SEQ ID NO 9354 | GATATTTTTGTATTCCTCTAAA | CTG | chr17 | 7111067 | 7111088 | 7111072 | 7111067 | - |
| SEQ ID NO 9355 | TTGTATTCCTCTAAATGTTCTT | TTT | chr17 | 7111060 | 7111081 | 7111065 | 7111060 | - |
| SEQ ID NO 9356 | TGTATTCCTCTAAATGTTCTTG | TTT | chr17 | 7111059 | 7111080 | 7111064 | 7111059 | - |
| SEQ ID NO 9357 | GTATTCCTCTAAATGTTCTTGA | TTT | chr17 | 7111058 | 7111079 | 7111063 | 7111058 | - |
| SEQ ID NO 9358 | TATTCCTCTAAATGTTCTTGAG | TTG | chr17 | 7111057 | 7111078 | 7111062 | 7111057 | - |
| SEQ ID NO 9359 | CTCTAAATGTTCTTGAGCTTTG | TTC | chr17 | 7111052 | 7111073 | 7111057 | 7111052 | - |
| SEQ ID NO 9360 | TAAATGTTCTTGAGCTTTGCTC | CTC | chr17 | 7111049 | 7111070 | 7111054 | 7111049 | - |

Figure 30 (Cont'd)

| SEQ ID NO 9361 | AATGTTCTTGAGCTTTGCTCCG | CTA | chr17 | 7111047 | 7111068 | 7111052 | 7111047 | - |
|---|---|---|---|---|---|---|---|---|
| SEQ ID NO 9362 | TTGAGCTTTGCTCCGGGATGCA | TTC | chr17 | 7111040 | 7111061 | 7111045 | 7111040 | - |
| SEQ ID NO 9363 | GAGCTTTGCTCCGGGATGCAGT | CTT | chr17 | 7111038 | 7111059 | 7111043 | 7111038 | - |
| SEQ ID NO 9364 | AGCTTTGCTCCGGGATGCAGTT | TTG | chr17 | 7111037 | 7111058 | 7111042 | 7111037 | - |
| SEQ ID NO 9365 | TGCTCCGGGATGCAGTTAAGCA | CTT | chr17 | 7111032 | 7111053 | 7111037 | 7111032 | - |
| SEQ ID NO 9366 | GCTCCGGGATGCAGTTAAGCAA | TTT | chr17 | 7111031 | 7111052 | 7111036 | 7111031 | - |
| SEQ ID NO 9367 | CTCCGGGATGCAGTTAAGCAAC | TTG | chr17 | 7111030 | 7111051 | 7111035 | 7111030 | - |
| SEQ ID NO 9368 | CGGGATGCAGTTAAGCAACTTA | CTC | chr17 | 7111027 | 7111048 | 7111032 | 7111027 | - |
| SEQ ID NO 9369 | AGCAACTTAGAGTCAGTTTGAT | TTA | chr17 | 7111014 | 7111035 | 7111019 | 7111014 | - |
| SEQ ID NO 9370 | AGAGTCAGTTTGATCGTTTGAA | CTT | chr17 | 7111006 | 7111027 | 7111011 | 7111006 | - |
| SEQ ID NO 9371 | GAGTCAGTTTGATCGTTTGAAC | TTA | chr17 | 7111005 | 7111026 | 7111010 | 7111005 | - |
| SEQ ID NO 9372 | GATCGTTTGAACTCTTAATTGT | TTT | chr17 | 7110995 | 7111016 | 7111000 | 7110995 | - |
| SEQ ID NO 9373 | ATCGTTTGAACTCTTAATTGTT | TTG | chr17 | 7110994 | 7111015 | 7110999 | 7110994 | - |
| SEQ ID NO 9374 | GAACTCTTAATTGTTTTGGTCT | TTT | chr17 | 7110987 | 7111008 | 7110992 | 7110987 | - |
| SEQ ID NO 9375 | AACTCTTAATTGTTTTGGTCTC | TTG | chr17 | 7110986 | 7111007 | 7110991 | 7110986 | - |
| SEQ ID NO 9376 | TTAATTGTTTTGGTCTCCTCGG | CTC | chr17 | 7110981 | 7111002 | 7110986 | 7110981 | - |
| SEQ ID NO 9377 | AATTGTTTTGGTCTCCTCGGAC | CTT | chr17 | 7110979 | 7111000 | 7110984 | 7110979 | - |
| SEQ ID NO 9378 | ATTGTTTTGGTCTCCTCGGACT | TTA | chr17 | 7110978 | 7110999 | 7110983 | 7110978 | - |
| SEQ ID NO 9379 | TTTTGGTCTCCTCGGACTCTCA | TTG | chr17 | 7110974 | 7110995 | 7110979 | 7110974 | - |
| SEQ ID NO 9380 | TGGTCTCCTCGGACTCTCAGCT | TTT | chr17 | 7110971 | 7110992 | 7110976 | 7110971 | - |
| SEQ ID NO 9381 | GGTCTCCTCGGACTCTCAGCTC | TTT | chr17 | 7110970 | 7110991 | 7110975 | 7110970 | - |
| SEQ ID NO 9382 | GTCTCCTCGGACTCTCAGCTCC | TTG | chr17 | 7110969 | 7110990 | 7110974 | 7110969 | - |
| SEQ ID NO 9383 | CTCGGACTCTCAGCTCCATCTC | CTC | chr17 | 7110964 | 7110985 | 7110969 | 7110964 | - |
| SEQ ID NO 9384 | GGACTCTCAGCTCCATCTCCTC | CTC | chr17 | 7110961 | 7110982 | 7110966 | 7110961 | - |
| SEQ ID NO 9385 | TCAGCTCCATCTCCTCAACGTG | CTC | chr17 | 7110955 | 7110976 | 7110960 | 7110955 | - |
| SEQ ID NO 9386 | AGCTCCATCTCCTCAACGTGGG | CTC | chr17 | 7110953 | 7110974 | 7110958 | 7110953 | - |
| SEQ ID NO 9387 | CATCTCCTCAACGTGGGGAGTC | CTC | chr17 | 7110948 | 7110969 | 7110953 | 7110948 | - |
| SEQ ID NO 9388 | CTCAACGTGGGGAGTCTCTTGG | CTC | chr17 | 7110942 | 7110963 | 7110947 | 7110942 | - |
| SEQ ID NO 9389 | AACGTGGGGAGTCTCTTGGGCT | CTC | chr17 | 7110939 | 7110960 | 7110944 | 7110939 | - |
| SEQ ID NO 9390 | TTGGGCTCTGCCTGGACTTCCC | CTC | chr17 | 7110924 | 7110945 | 7110929 | 7110924 | - |
| SEQ ID NO 9391 | GGGCTCTGCCTGGACTTCCCTT | CTT | chr17 | 7110922 | 7110943 | 7110927 | 7110922 | - |
| SEQ ID NO 9392 | GGCTCTGCCTGGACTTCCCTTT | TTG | chr17 | 7110921 | 7110942 | 7110926 | 7110921 | - |
| SEQ ID NO 9393 | TGCCTGGACTTCCCTTTCCTGG | CTC | chr17 | 7110916 | 7110937 | 7110921 | 7110916 | - |
| SEQ ID NO 9394 | CCTGGACTTCCCTTTCCTGGCC | CTG | chr17 | 7110914 | 7110935 | 7110919 | 7110914 | - |
| SEQ ID NO 9395 | GACTTCCCTTTCCTGGCCTGTA | CTG | chr17 | 7110910 | 7110931 | 7110915 | 7110910 | - |
| SEQ ID NO 9396 | CCCTTTCCTGGCCTGTAACCTG | CTT | chr17 | 7110905 | 7110926 | 7110910 | 7110905 | - |
| SEQ ID NO 9397 | CCTTTCCTGGCCTGTAACCTGC | TTC | chr17 | 7110904 | 7110925 | 7110909 | 7110904 | - |
| SEQ ID NO 9398 | TCCTGGCCTGTAACCTGCAGAC | CTT | chr17 | 7110900 | 7110921 | 7110905 | 7110900 | - |
| SEQ ID NO 9399 | CCTGGCCTGTAACCTGCAGACT | TTT | chr17 | 7110899 | 7110920 | 7110904 | 7110899 | - |
| SEQ ID NO 9400 | CTGGCCTGTAACCTGCAGACTC | TTC | chr17 | 7110898 | 7110919 | 7110903 | 7110898 | - |
| SEQ ID NO 9401 | GCCTGTAACCTGCAGACTCTCT | CTG | chr17 | 7110895 | 7110916 | 7110900 | 7110895 | - |
| SEQ ID NO 9402 | TAACCTGCAGACTCTCTCCAAA | CTG | chr17 | 7110890 | 7110911 | 7110895 | 7110890 | - |
| SEQ ID NO 9403 | CAGACTCTCTCCAAACAGTAAG | CTG | chr17 | 7110883 | 7110904 | 7110888 | 7110883 | - |
| SEQ ID NO 9404 | TCTCCAAACAGTAAGCTGGGGT | CTC | chr17 | 7110876 | 7110897 | 7110881 | 7110876 | - |
| SEQ ID NO 9405 | TCCAAACAGTAAGCTGGGGTGA | CTC | chr17 | 7110874 | 7110895 | 7110879 | 7110874 | - |
| SEQ ID NO 9406 | CAAACAGTAAGCTGGGGTGATC | CTC | chr17 | 7110872 | 7110893 | 7110877 | 7110872 | - |
| SEQ ID NO 9407 | GGGTGATCGGAGGGTTCCTGTT | CTG | chr17 | 7110858 | 7110879 | 7110863 | 7110858 | - |
| SEQ ID NO 9408 | CTGTTGTTGCTTCTTATCCCT | TTC | chr17 | 7110841 | 7110862 | 7110846 | 7110841 | - |
| SEQ ID NO 9409 | TTGTTTGCTTCTTATCCCTCAG | CTG | chr17 | 7110838 | 7110859 | 7110843 | 7110838 | - |
| SEQ ID NO 9410 | TTTGCTTCTTATCCCTCAGGGA | TTG | chr17 | 7110835 | 7110856 | 7110840 | 7110835 | - |
| SEQ ID NO 9411 | GCTTCTTATCCCTCAGGGATCT | TTT | chr17 | 7110832 | 7110853 | 7110837 | 7110832 | - |
| SEQ ID NO 9412 | CTTCTTATCCCTCAGGGATCTT | TTG | chr17 | 7110831 | 7110852 | 7110836 | 7110831 | - |
| SEQ ID NO 9413 | CTTATCCCTCAGGGATCTTTAC | CTT | chr17 | 7110828 | 7110849 | 7110833 | 7110828 | - |
| SEQ ID NO 9414 | TTATCCCTCAGGGATCTTTACT | TTC | chr17 | 7110827 | 7110848 | 7110832 | 7110827 | - |
| SEQ ID NO 9415 | ATCCCTCAGGGATCTTTACTCC | CTT | chr17 | 7110825 | 7110846 | 7110830 | 7110825 | - |
| SEQ ID NO 9416 | TCCCTCAGGGATCTTTACTCCT | TTA | chr17 | 7110824 | 7110845 | 7110829 | 7110824 | - |
| SEQ ID NO 9417 | AGGGATCTTTACTCCTCCTTGC | CTC | chr17 | 7110818 | 7110839 | 7110823 | 7110818 | - |
| SEQ ID NO 9418 | TACTCCTCCTTGCCTGATGTCC | CTT | chr17 | 7110809 | 7110830 | 7110814 | 7110809 | - |

Figure 30 (Cont'd)

| SEQ ID | Sequence | Codon | Chr | Pos1 | Pos2 | Pos3 | Pos4 | |
|---|---|---|---|---|---|---|---|---|
| SEQ ID NO 9419 | ACTCCTCCTTGCCTGATGTCCA | TTT | chr17 | 7110808 | 7110829 | 7110813 | 7110808 | - |
| SEQ ID NO 9420 | CTCCTCCTTGCCTGATGTCCAG | TTA | chr17 | 7110807 | 7110828 | 7110812 | 7110807 | - |
| SEQ ID NO 9421 | CTCCTTGCCTGATGTCCAGAGT | CTC | chr17 | 7110804 | 7110825 | 7110809 | 7110804 | - |
| SEQ ID NO 9422 | CTTGCCTGATGTCCAGAGTCTT | CTC | chr17 | 7110801 | 7110822 | 7110806 | 7110801 | - |
| SEQ ID NO 9423 | GCCTGATGTCCAGAGTCTTGAA | CTT | chr17 | 7110798 | 7110819 | 7110803 | 7110798 | - |
| SEQ ID NO 9424 | CCTGATGTCCAGAGTCTTGAAA | TTG | chr17 | 7110797 | 7110818 | 7110802 | 7110797 | - |
| SEQ ID NO 9425 | ATGTCCAGAGTCTTGAAAGCTG | CTG | chr17 | 7110793 | 7110814 | 7110798 | 7110793 | - |
| SEQ ID NO 9426 | GAAAGCTGCCATGTTCTATAGT | CTT | chr17 | 7110779 | 7110800 | 7110784 | 7110779 | - |
| SEQ ID NO 9427 | AAAGCTGCCATGTTCTATAGTT | TTG | chr17 | 7110778 | 7110799 | 7110783 | 7110778 | - |
| SEQ ID NO 9428 | CCATGTTCTATAGTTGTCTGTT | CTG | chr17 | 7110771 | 7110792 | 7110776 | 7110771 | - |
| SEQ ID NO 9429 | TATAGTTGTCTGTTTTTGTTTT | TTC | chr17 | 7110763 | 7110784 | 7110768 | 7110763 | - |
| SEQ ID NO 9430 | TAGTTGTCTGTTTTTGTTTTGA | CTA | chr17 | 7110761 | 7110782 | 7110766 | 7110761 | - |
| SEQ ID NO 9431 | TCTGTTTTTGTTTTGATTGTTT | TTG | chr17 | 7110755 | 7110776 | 7110760 | 7110755 | - |
| SEQ ID NO 9432 | TTTTTGTTTTGATTGTTTCTGG | CTG | chr17 | 7110751 | 7110772 | 7110756 | 7110751 | - |
| SEQ ID NO 9433 | TTGTTTTGATTGTTTCTGGGGA | TTT | chr17 | 7110748 | 7110769 | 7110753 | 7110748 | - |
| SEQ ID NO 9434 | TGTTTTGATTGTTTCTGGGGAG | TTT | chr17 | 7110747 | 7110768 | 7110752 | 7110747 | - |
| SEQ ID NO 9435 | GTTTTGATTGTTTCTGGGGAGA | TTT | chr17 | 7110746 | 7110767 | 7110751 | 7110746 | - |
| SEQ ID NO 9436 | TTTTGATTGTTTCTGGGGAGAG | TTG | chr17 | 7110745 | 7110766 | 7110750 | 7110745 | - |
| SEQ ID NO 9437 | TGATTGTTTCTGGGGAGAGAAG | TTT | chr17 | 7110742 | 7110763 | 7110747 | 7110742 | - |
| SEQ ID NO 9438 | GATTGTTTCTGGGGAGAGAAGA | TTT | chr17 | 7110741 | 7110762 | 7110746 | 7110741 | - |
| SEQ ID NO 9439 | ATTGTTTCTGGGGAGAGAAGAA | TTG | chr17 | 7110740 | 7110761 | 7110745 | 7110740 | - |
| SEQ ID NO 9440 | TTTCTGGGGAGAGAAGAACTCT | TTG | chr17 | 7110736 | 7110757 | 7110741 | 7110736 | - |
| SEQ ID NO 9441 | CTGGGGAGAGAAGAACTCTTCC | TTT | chr17 | 7110733 | 7110754 | 7110738 | 7110733 | - |
| SEQ ID NO 9442 | TGGGGAGAGAAGAACTCTTCCC | TTC | chr17 | 7110732 | 7110753 | 7110737 | 7110732 | - |
| SEQ ID NO 9443 | GGGAGAGAAGAACTCTTCCCAT | CTG | chr17 | 7110730 | 7110751 | 7110735 | 7110730 | - |
| SEQ ID NO 9444 | TTCCCATCTTGGGCAGACCCTG | CTC | chr17 | 7110715 | 7110736 | 7110720 | 7110715 | - |
| SEQ ID NO 9445 | CCCATCTTGGGCAGACCCTGTC | CTT | chr17 | 7110713 | 7110734 | 7110718 | 7110713 | - |
| SEQ ID NO 9446 | CCATCTTGGGCAGACCCTGTCT | TTC | chr17 | 7110712 | 7110733 | 7110717 | 7110712 | - |
| SEQ ID NO 9447 | GGGCAGACCCTGTCTTTTATGT | CTT | chr17 | 7110705 | 7110726 | 7110710 | 7110705 | - |
| SEQ ID NO 9448 | GGCAGACCCTGTCTTTTATGTT | TTG | chr17 | 7110704 | 7110725 | 7110709 | 7110704 | - |
| SEQ ID NO 9449 | TCTTTTATGTTCAAACTTTTGC | CTG | chr17 | 7110693 | 7110714 | 7110698 | 7110693 | - |
| SEQ ID NO 9450 | TTATGTTCAAACTTTTGCCTAA | CTT | chr17 | 7110689 | 7110710 | 7110694 | 7110689 | - |
| SEQ ID NO 9451 | TATGTTCAAACTTTTGCCTAAG | TTT | chr17 | 7110688 | 7110709 | 7110693 | 7110688 | - |
| SEQ ID NO 9452 | ATGTTCAAACTTTTGCCTAAGA | TTT | chr17 | 7110687 | 7110708 | 7110692 | 7110687 | - |
| SEQ ID NO 9453 | TGTTCAAACTTTTGCCTAAGAA | TTA | chr17 | 7110686 | 7110707 | 7110691 | 7110686 | - |
| SEQ ID NO 9454 | AAACTTTTGCCTAAGAAGCACA | TTC | chr17 | 7110681 | 7110702 | 7110686 | 7110681 | - |
| SEQ ID NO 9455 | TTGCCTAAGAAGCACATTACAT | CTT | chr17 | 7110675 | 7110696 | 7110680 | 7110675 | - |
| SEQ ID NO 9456 | TGCCTAAGAAGCACATTACATA | TTT | chr17 | 7110674 | 7110695 | 7110679 | 7110674 | - |
| SEQ ID NO 9457 | GCCTAAGAAGCACATTACATAT | TTT | chr17 | 7110673 | 7110694 | 7110678 | 7110673 | - |
| SEQ ID NO 9458 | CCTAAGAAGCACATTACATATT | TTG | chr17 | 7110672 | 7110693 | 7110677 | 7110672 | - |
| SEQ ID NO 9459 | AGAAGCACATTACATATTTTAA | CTA | chr17 | 7110668 | 7110689 | 7110673 | 7110668 | - |
| SEQ ID NO 9460 | CATATTTTAACTCATCTAATTA | TTA | chr17 | 7110656 | 7110677 | 7110661 | 7110656 | - |
| SEQ ID NO 9461 | TAACTCATCTAATTATCCGAGC | TTT | chr17 | 7110649 | 7110670 | 7110654 | 7110649 | - |
| SEQ ID NO 9462 | AACTCATCTAATTATCCGAGCA | TTT | chr17 | 7110648 | 7110669 | 7110653 | 7110648 | - |
| SEQ ID NO 9463 | ACTCATCTAATTATCCGAGCAA | TTA | chr17 | 7110647 | 7110668 | 7110652 | 7110647 | - |
| SEQ ID NO 9464 | ATCTAATTATCCGAGCAATCCA | CTC | chr17 | 7110643 | 7110664 | 7110648 | 7110643 | - |
| SEQ ID NO 9465 | ATTATCCGAGCAATCCAATCGG | CTA | chr17 | 7110638 | 7110659 | 7110643 | 7110638 | - |
| SEQ ID NO 9466 | TCCGAGCAATCCAATCGGGTAG | TTA | chr17 | 7110634 | 7110655 | 7110639 | 7110634 | - |
| SEQ ID NO 9467 | CGACTGTGATCTCCATTTTACA | CTA | chr17 | 7110609 | 7110630 | 7110614 | 7110609 | - |
| SEQ ID NO 9468 | TGATCTCCATTTTACACACGAG | CTG | chr17 | 7110603 | 7110624 | 7110608 | 7110603 | - |
| SEQ ID NO 9469 | CATTTTACACACGAGAAAATGG | CTC | chr17 | 7110596 | 7110617 | 7110601 | 7110596 | - |
| SEQ ID NO 9470 | TACACACGAGAAAATGGAAGCA | TTT | chr17 | 7110591 | 7110612 | 7110596 | 7110591 | - |
| SEQ ID NO 9471 | ACACACGAGAAAATGGAAGCAT | TTT | chr17 | 7110590 | 7110611 | 7110595 | 7110590 | - |
| SEQ ID NO 9472 | CACACGAGAAAATGGAAGCATG | TTA | chr17 | 7110589 | 7110610 | 7110594 | 7110589 | - |
| SEQ ID NO 9473 | AATGCTGGTGCATGATCTCAGA | TTG | chr17 | 7110558 | 7110579 | 7110563 | 7110558 | - |
| SEQ ID NO 9474 | GTGCATGATCTCAGAGCTACCT | CTG | chr17 | 7110551 | 7110572 | 7110556 | 7110551 | - |
| SEQ ID NO 9475 | AGAGCTACCTGGAGGCACAGCT | CTC | chr17 | 7110539 | 7110560 | 7110544 | 7110539 | - |
| SEQ ID NO 9476 | CCTGGAGGCACAGCTGGGCTAC | CTA | chr17 | 7110532 | 7110553 | 7110537 | 7110532 | - |

Figure 30 (Cont'd)

| | | | | | | | | |
|---|---|---|---|---|---|---|---|---|
| SEQ ID NO 9477 | GAGGCACAGCTGGGCTACCCTG | CTG | chr17 | 7110528 | 7110549 | 7110533 | 7110528 | - |
| SEQ ID NO 9478 | GGCTACCCTGTGGGCAGTCTGG | CTG | chr17 | 7110516 | 7110537 | 7110521 | 7110516 | - |
| SEQ ID NO 9479 | CCCTGTGGGCAGTCTGGTTTCA | CTA | chr17 | 7110511 | 7110532 | 7110516 | 7110511 | - |
| SEQ ID NO 9480 | TGGGCAGTCTGGTTTCAGGGTG | CTG | chr17 | 7110506 | 7110527 | 7110511 | 7110506 | - |
| SEQ ID NO 9481 | GTTTCAGGGTGGATATACAGAC | CTG | chr17 | 7110495 | 7110516 | 7110500 | 7110495 | - |
| SEQ ID NO 9482 | CAGGGTGGATATACAGACACGT | TTT | chr17 | 7110491 | 7110512 | 7110496 | 7110491 | - |
| SEQ ID NO 9483 | AGGGTGGATATACAGACACGTT | TTC | chr17 | 7110490 | 7110511 | 7110495 | 7110490 | - |
| SEQ ID NO 9484 | CTGGGCTGACCCAGCATTGGGA | TTG | chr17 | 7110467 | 7110488 | 7110472 | 7110467 | - |
| SEQ ID NO 9485 | GGCTGACCCAGCATTGGGAGTT | CTG | chr17 | 7110464 | 7110485 | 7110469 | 7110464 | - |
| SEQ ID NO 9486 | ACCCAGCATTGGGAGTTGATAA | CTG | chr17 | 7110459 | 7110480 | 7110464 | 7110459 | - |
| SEQ ID NO 9487 | GGAGTTGATAAGTCGGACTGGG | TTG | chr17 | 7110448 | 7110469 | 7110453 | 7110448 | - |
| SEQ ID NO 9488 | ATAAGTCGGACTGGGAAGCAGG | TTG | chr17 | 7110441 | 7110462 | 7110446 | 7110441 | - |
| SEQ ID NO 9489 | GGAAGCAGGACAGGACCCTCTG | CTG | chr17 | 7110428 | 7110449 | 7110433 | 7110428 | - |
| SEQ ID NO 9490 | TGAGTGGAGGGTGCTGAAGACA | CTC | chr17 | 7110408 | 7110429 | 7110413 | 7110408 | - |
| SEQ ID NO 9491 | AGTGGAGGGTGCTGAAGACAGC | CTG | chr17 | 7110406 | 7110427 | 7110411 | 7110406 | - |
| SEQ ID NO 9492 | AAGACAGCAGTCAGGGACTCAG | CTG | chr17 | 7110392 | 7110413 | 7110397 | 7110392 | - |
| SEQ ID NO 9493 | AGCCATGGAGGGCCAGCTTGGT | CTC | chr17 | 7110372 | 7110393 | 7110377 | 7110372 | - |
| SEQ ID NO 9494 | GGTGGGGAACACCGTGGTCATG | CTT | chr17 | 7110353 | 7110374 | 7110358 | 7110353 | - |
| SEQ ID NO 9495 | GTGGGGAACACCGTGGTCATGG | TTG | chr17 | 7110352 | 7110373 | 7110357 | 7110352 | - |
| SEQ ID NO 9496 | CTGGATGGAGAGGAATGCAAAG | CTT | chr17 | 7110323 | 7110344 | 7110328 | 7110323 | - |
| SEQ ID NO 9497 | TGGATGGAGAGGAATGCAAAGG | TTC | chr17 | 7110322 | 7110343 | 7110327 | 7110322 | - |
| SEQ ID NO 9498 | GATGGAGAGGAATGCAAAGGCC | CTG | chr17 | 7110320 | 7110341 | 7110325 | 7110320 | - |
| SEQ ID NO 9499 | GGAGGAAGGGGTGGGGGCAGTG | CTT | chr17 | 7110296 | 7110317 | 7110301 | 7110296 | - |
| SEQ ID NO 9500 | GAGGAAGGGTGGGGGCAGTGA | TTG | chr17 | 7110295 | 7110316 | 7110300 | 7110295 | - |
| SEQ ID NO 9501 | TGCTCAGAGCGGGAGTGGGCAG | CTG | chr17 | 7110256 | 7110277 | 7110261 | 7110256 | - |
| SEQ ID NO 9502 | AGAGCGGGAGTGGGCAGTGGAG | CTC | chr17 | 7110251 | 7110272 | 7110256 | 7110251 | - |
| SEQ ID NO 9503 | CCTGGGTCAAATGGGGTCCTGA | CTC | chr17 | 7110215 | 7110236 | 7110220 | 7110215 | - |
| SEQ ID NO 9504 | GGTCAAATGGGGTCCTGAGTGT | CTG | chr17 | 7110211 | 7110232 | 7110216 | 7110211 | - |
| SEQ ID NO 9505 | AGTGTGGCTGCAGTGGGGAAGG | CTG | chr17 | 7110194 | 7110215 | 7110199 | 7110194 | - |
| SEQ ID NO 9506 | CAGTGGGGAAGGTGGAAGTCAC | CTG | chr17 | 7110184 | 7110205 | 7110189 | 7110184 | - |
| SEQ ID NO 9507 | GTGTGAAAAGATGAAGAGTTA | CTG | chr17 | 7110160 | 7110181 | 7110165 | 7110160 | - |
| SEQ ID NO 9508 | TGGACAGTCACTTACAGGGGCA | TTA | chr17 | 7110138 | 7110159 | 7110143 | 7110138 | - |
| SEQ ID NO 9509 | ACAGGGGCAGTGTCTGACTCAG | CTT | chr17 | 7110125 | 7110146 | 7110130 | 7110125 | - |
| SEQ ID NO 9510 | CAGGGGCAGTGTCTGACTCAGG | TTA | chr17 | 7110124 | 7110145 | 7110129 | 7110124 | - |
| SEQ ID NO 9511 | ACTCAGGACAGTGGCAGGAAGT | CTG | chr17 | 7110109 | 7110130 | 7110114 | 7110109 | - |
| SEQ ID NO 9512 | AGGACAGTGGCAGGAAGTGACC | CTC | chr17 | 7110105 | 7110126 | 7110110 | 7110105 | - |
| SEQ ID NO 9513 | GGGAGGAAGATTCTGGGCCCCT | CTG | chr17 | 7110081 | 7110102 | 7110086 | 7110081 | - |
| SEQ ID NO 9514 | TGGGCCCCTGACTGAGCCTCCC | TTC | chr17 | 7110068 | 7110089 | 7110073 | 7110068 | - |
| SEQ ID NO 9515 | GGCCCCTGACTGAGCCTCCCCA | CTG | chr17 | 7110066 | 7110087 | 7110071 | 7110066 | - |
| SEQ ID NO 9516 | ACTGAGCCTCCCCAGGATGTGG | CTG | chr17 | 7110058 | 7110079 | 7110063 | 7110058 | - |
| SEQ ID NO 9517 | AGCCTCCCCAGGATGTGGTCCT | CTG | chr17 | 7110054 | 7110075 | 7110059 | 7110054 | - |
| SEQ ID NO 9518 | CCCAGGATGTGGTCCTGCTGGG | CTC | chr17 | 7110048 | 7110069 | 7110053 | 7110048 | - |
| SEQ ID NO 9519 | CTGGGTCGGGGGTGATAGGAA | CTG | chr17 | 7110031 | 7110052 | 7110036 | 7110031 | - |
| SEQ ID NO 9520 | GGTCGGGGGTGATAGGAATGA | CTG | chr17 | 7110028 | 7110049 | 7110033 | 7110028 | - |
| SEQ ID NO 9521 | GAAGGTGTTCTGTTTGCAGGTG | CTA | chr17 | 7109967 | 7109988 | 7109972 | 7109967 | - |
| SEQ ID NO 9522 | TGTTTGCAGGTGGATGCTGCAA | TTC | chr17 | 7109957 | 7109978 | 7109962 | 7109957 | - |
| SEQ ID NO 9523 | TTTGCAGGTGGATGCTGCAAAG | CTG | chr17 | 7109955 | 7109976 | 7109960 | 7109955 | - |
| SEQ ID NO 9524 | GCAGGTGGATGCTGCAAAGAGA | TTT | chr17 | 7109952 | 7109973 | 7109957 | 7109952 | - |
| SEQ ID NO 9525 | CAGGTGGATGCTGCAAAGAGAG | TTG | chr17 | 7109951 | 7109972 | 7109956 | 7109951 | - |
| SEQ ID NO 9526 | CAAAGAGAGGAGCTCAGGGCTG | CTG | chr17 | 7109938 | 7109959 | 7109943 | 7109938 | - |
| SEQ ID NO 9527 | AGGGCTGGGACAACTGGAGCTG | CTC | chr17 | 7109923 | 7109944 | 7109928 | 7109923 | - |
| SEQ ID NO 9528 | GGACAACTGGAGCTGCTCTGGG | CTG | chr17 | 7109916 | 7109937 | 7109921 | 7109916 | - |
| SEQ ID NO 9529 | GAGCTGCTCTGGGTCTGGAGGC | CTG | chr17 | 7109907 | 7109928 | 7109912 | 7109907 | - |
| SEQ ID NO 9530 | CTCTGGGTCTGGAGGCAGCAGA | CTG | chr17 | 7109901 | 7109922 | 7109906 | 7109901 | - |
| SEQ ID NO 9531 | TGGGTCTGGAGGCAGCAGAGAG | CTC | chr17 | 7109898 | 7109919 | 7109903 | 7109898 | - |
| SEQ ID NO 9532 | GGTCTGGAGGCAGCAGAGAGGG | CTG | chr17 | 7109896 | 7109917 | 7109901 | 7109896 | - |
| SEQ ID NO 9533 | GAGGCAGCAGAGAGGGAGCCCA | CTG | chr17 | 7109890 | 7109911 | 7109895 | 7109890 | - |
| SEQ ID NO 9534 | TGTGTGCAGGAAGACGTGGGTG | CTC | chr17 | 7109864 | 7109885 | 7109869 | 7109864 | - |

Figure 30 (Cont'd)

| | | | | | | | | |
|---|---|---|---|---|---|---|---|---|
| SEQ ID NO 9535 | TGTGCAGGAAGACGTGGGTGTG | CTG | chr17 | 7109862 | 7109883 | 7109867 | 7109862 | - |
| SEQ ID NO 9536 | GCATGCATATGCACATGTGAGA | TTA | chr17 | 7109776 | 7109797 | 7109781 | 7109776 | - |
| SEQ ID NO 9537 | TTGAGTGAAGTGAGCAATGTGT | TTT | chr17 | 7109708 | 7109729 | 7109713 | 7109708 | - |
| SEQ ID NO 9538 | TGAGTGAAGTGAGCAATGTGTG | TTT | chr17 | 7109707 | 7109728 | 7109712 | 7109707 | - |
| SEQ ID NO 9539 | GAGTGAAGTGAGCAATGTGTGA | TTT | chr17 | 7109706 | 7109727 | 7109711 | 7109706 | - |
| SEQ ID NO 9540 | AGTGAAGTGAGCAATGTGTGAG | TTG | chr17 | 7109705 | 7109726 | 7109710 | 7109705 | - |
| SEQ ID NO 9541 | GTGAGGGCATGTGAATGTGTGT | TTT | chr17 | 7109662 | 7109683 | 7109667 | 7109662 | - |
| SEQ ID NO 9542 | TGAGGGCATGTGAATGTGTGTG | TTG | chr17 | 7109661 | 7109682 | 7109666 | 7109661 | - |
| SEQ ID NO 9543 | TCAGGGTGCAGATGGATCAAGG | CTG | chr17 | 7109630 | 7109651 | 7109635 | 7109630 | - |
| SEQ ID NO 9544 | TGAGATGACCTCGGGCTGAGGG | CTG | chr17 | 7109591 | 7109612 | 7109596 | 7109591 | - |
| SEQ ID NO 9545 | GGGCTGAGGGGAGCAAATTTAG | CTC | chr17 | 7109579 | 7109600 | 7109584 | 7109579 | - |
| SEQ ID NO 9546 | AGGGGAGCAAATTTAGTGTGGA | CTG | chr17 | 7109573 | 7109594 | 7109578 | 7109573 | - |
| SEQ ID NO 9547 | AGTGTGGAACGAGGTTTCTAGG | TTT | chr17 | 7109559 | 7109580 | 7109564 | 7109559 | - |
| SEQ ID NO 9548 | GTGTGGAACGAGGTTTCTAGGG | TTA | chr17 | 7109558 | 7109579 | 7109563 | 7109558 | - |
| SEQ ID NO 9549 | CTAGGGAAGCGAGGGCAAAGGG | TTT | chr17 | 7109542 | 7109563 | 7109547 | 7109542 | - |
| SEQ ID NO 9550 | TAGGGAAGCGAGGGCAAAGGGC | TTC | chr17 | 7109541 | 7109562 | 7109546 | 7109541 | - |
| SEQ ID NO 9551 | GGGAAGCGAGGGCAAAGGGCGC | CTA | chr17 | 7109539 | 7109560 | 7109544 | 7109539 | - |
| SEQ ID NO 9552 | GGGAGGAGGCCTTGCGTGGTGG | CTG | chr17 | 7109515 | 7109536 | 7109520 | 7109515 | - |
| SEQ ID NO 9553 | GCGTGGTGGGGGATGAGGACAA | CTT | chr17 | 7109502 | 7109523 | 7109507 | 7109502 | - |
| SEQ ID NO 9554 | CGTGGTGGGGGATGAGGACAAC | TTG | chr17 | 7109501 | 7109522 | 7109506 | 7109501 | - |
| SEQ ID NO 9555 | GAGGGTTGTGCTTGGAGAGTGG | CTG | chr17 | 7109467 | 7109488 | 7109472 | 7109467 | - |
| SEQ ID NO 9556 | TGCTTGGAGAGTGGGCTATGGT | TTG | chr17 | 7109459 | 7109480 | 7109464 | 7109459 | - |
| SEQ ID NO 9557 | GGAGAGTGGGCTATGGTGGAAT | CTT | chr17 | 7109454 | 7109475 | 7109459 | 7109454 | - |
| SEQ ID NO 9558 | GAGAGTGGGCTATGGTGGAATG | TTG | chr17 | 7109453 | 7109474 | 7109458 | 7109453 | - |
| SEQ ID NO 9559 | TGGTGGAATGACCCAGATTTAA | CTA | chr17 | 7109441 | 7109462 | 7109446 | 7109441 | - |
| SEQ ID NO 9560 | AAGGATCTCAATGGAATTTTGG | TTT | chr17 | 7109421 | 7109442 | 7109426 | 7109421 | - |
| SEQ ID NO 9561 | AGGATCTCAATGGAATTTTGGC | TTA | chr17 | 7109420 | 7109441 | 7109425 | 7109420 | - |
| SEQ ID NO 9562 | AATGGAATTTTGGCAGGGGAGG | CTC | chr17 | 7109412 | 7109433 | 7109417 | 7109412 | - |
| SEQ ID NO 9563 | TGGCAGGGGAGGGACTGTTCCA | TTT | chr17 | 7109402 | 7109423 | 7109407 | 7109402 | - |
| SEQ ID NO 9564 | GGCAGGGGAGGGACTGTTCCAG | TTT | chr17 | 7109401 | 7109422 | 7109406 | 7109401 | - |
| SEQ ID NO 9565 | GCAGGGGAGGGACTGTTCCAGT | TTG | chr17 | 7109400 | 7109421 | 7109405 | 7109400 | - |
| SEQ ID NO 9566 | TTCCAGTATGGATTTTAGGAAG | CTG | chr17 | 7109385 | 7109406 | 7109390 | 7109385 | - |
| SEQ ID NO 9567 | CAGTATGGATTTTAGGAAGAAC | TTC | chr17 | 7109382 | 7109403 | 7109387 | 7109382 | - |
| SEQ ID NO 9568 | TAGGAAGAACACAGGGCCCAGC | TTT | chr17 | 7109370 | 7109391 | 7109375 | 7109370 | - |
| SEQ ID NO 9569 | AGGAAGAACACAGGGCCCAGCT | TTT | chr17 | 7109369 | 7109390 | 7109374 | 7109369 | - |
| SEQ ID NO 9570 | GGAAGAACACAGGGCCCAGCTT | TTA | chr17 | 7109368 | 7109389 | 7109373 | 7109368 | - |
| SEQ ID NO 9571 | CTGGAGTCTCCAATCTGAGGGG | CTT | chr17 | 7109346 | 7109367 | 7109351 | 7109346 | - |
| SEQ ID NO 9572 | TGGAGTCTCCAATCTGAGGGGA | TTC | chr17 | 7109345 | 7109366 | 7109350 | 7109345 | - |
| SEQ ID NO 9573 | GAGTCTCCAATCTGAGGGGACA | CTG | chr17 | 7109343 | 7109364 | 7109348 | 7109343 | - |
| SEQ ID NO 9574 | CAATCTGAGGGGACAGGAGCCT | CTC | chr17 | 7109336 | 7109357 | 7109341 | 7109336 | - |
| SEQ ID NO 9575 | AGGGGACAGGAGCCTTAGAAGA | CTG | chr17 | 7109329 | 7109350 | 7109334 | 7109329 | - |
| SEQ ID NO 9576 | AGAAGAGCTGAGACTAAGGCCC | CTT | chr17 | 7109313 | 7109334 | 7109318 | 7109313 | - |
| SEQ ID NO 9577 | GAAGAGCTGAGACTAAGGCCCG | TTA | chr17 | 7109312 | 7109333 | 7109317 | 7109312 | - |
| SEQ ID NO 9578 | AGACTAAGGCCCGAGGTGATCT | CTG | chr17 | 7109303 | 7109324 | 7109308 | 7109303 | - |
| SEQ ID NO 9579 | AGGCCCGAGGTGATCTGGAGGC | CTA | chr17 | 7109297 | 7109318 | 7109302 | 7109297 | - |
| SEQ ID NO 9580 | GAGGCCTCTGCCACTGGCTGGA | CTG | chr17 | 7109280 | 7109301 | 7109285 | 7109280 | - |
| SEQ ID NO 9581 | TGCCACTGGCTGGATGGGAGGA | CTC | chr17 | 7109272 | 7109293 | 7109277 | 7109272 | - |
| SEQ ID NO 9582 | CCACTGGCTGGATGGGAGGAAA | CTG | chr17 | 7109270 | 7109291 | 7109275 | 7109270 | - |
| SEQ ID NO 9583 | GCTGGATGGGAGGAAAACCATT | CTG | chr17 | 7109264 | 7109285 | 7109269 | 7109264 | - |
| SEQ ID NO 9584 | GATGGGAGGAAAACCATTCACA | CTG | chr17 | 7109260 | 7109281 | 7109265 | 7109260 | - |
| SEQ ID NO 9585 | ACAGATCCCCCTTCTCAGGATG | TTC | chr17 | 7109241 | 7109262 | 7109246 | 7109241 | - |
| SEQ ID NO 9586 | CTCAGGATGTGTGCCTAGGCAG | CTT | chr17 | 7109228 | 7109249 | 7109233 | 7109228 | - |
| SEQ ID NO 9587 | TCAGGATGTGTGCCTAGGCAGG | TTC | chr17 | 7109227 | 7109248 | 7109232 | 7109227 | - |
| SEQ ID NO 9588 | AGGATGTGTGCCTAGGCAGGGC | CTC | chr17 | 7109225 | 7109246 | 7109230 | 7109225 | - |
| SEQ ID NO 9589 | GGCAGGGCCGGGTCTGCCCCCC | CTA | chr17 | 7109211 | 7109232 | 7109216 | 7109211 | - |
| SEQ ID NO 9590 | CCCCCCCGCCCCCTGTGCGTCT | CTG | chr17 | 7109195 | 7109216 | 7109200 | 7109195 | - |
| SEQ ID NO 9591 | TGCGTCTCCCAGTCCCCAGCT | CTG | chr17 | 7109180 | 7109201 | 7109185 | 7109180 | - |
| SEQ ID NO 9592 | CCAGTCCCCAGCTCCAGGATC | CTC | chr17 | 7109172 | 7109193 | 7109177 | 7109172 | - |

Figure 30 (Cont'd)

| | | | | | | | | |
|---|---|---|---|---|---|---|---|---|
| SEQ ID NO 9593 | CAGGATCCGGGCTTTGCACACA | CTC | chr17 | 7109157 | 7109178 | 7109162 | 7109157 | - |
| SEQ ID NO 9594 | TGCACACAGCTGATGTGAATAT | CTT | chr17 | 7109143 | 7109164 | 7109148 | 7109143 | - |
| SEQ ID NO 9595 | GCACACAGCTGATGTGAATATC | TTT | chr17 | 7109142 | 7109163 | 7109147 | 7109142 | - |
| SEQ ID NO 9596 | CACACAGCTGATGTGAATATCC | TTG | chr17 | 7109141 | 7109162 | 7109146 | 7109141 | - |
| SEQ ID NO 9597 | ATGTGAATATCCTGAGTCGTGT | CTG | chr17 | 7109131 | 7109152 | 7109136 | 7109131 | - |
| SEQ ID NO 9598 | AGTCGTGTGCATGGGTGTGTGT | CTG | chr17 | 7109117 | 7109138 | 7109122 | 7109117 | - |
| SEQ ID NO 9599 | GCTGCGTGTGTATATTTATACA | TTA | chr17 | 7109084 | 7109105 | 7109089 | 7109084 | - |
| SEQ ID NO 9600 | CGTGTGTATATTTATACATGGT | CTG | chr17 | 7109080 | 7109101 | 7109085 | 7109080 | - |
| SEQ ID NO 9601 | ATACATGGTAATATGGGTGCGA | TTT | chr17 | 7109067 | 7109088 | 7109072 | 7109067 | - |
| SEQ ID NO 9602 | TACATGGTAATATGGGTGCGAG | TTA | chr17 | 7109066 | 7109087 | 7109071 | 7109066 | - |
| SEQ ID NO 9603 | AAATGCTGGGGTCAAAGCCTAT | CTC | chr17 | 7109018 | 7109039 | 7109023 | 7109018 | - |
| SEQ ID NO 9604 | GGGTCAAAGCCTATGATGACCC | CTG | chr17 | 7109010 | 7109031 | 7109015 | 7109010 | - |
| SEQ ID NO 9605 | TGATGACCCCCCCCCATGGCCC | CTA | chr17 | 7108997 | 7109018 | 7109002 | 7108997 | - |
| SEQ ID NO 9606 | TGCCTCCTCAGGCTTCGGTGCC | TTA | chr17 | 7108951 | 7108972 | 7108956 | 7108951 | - |
| SEQ ID NO 9607 | CTCAGGCTTCGGTGCCCTGTCT | CTC | chr17 | 7108945 | 7108966 | 7108950 | 7108945 | - |
| SEQ ID NO 9608 | AGGCTTCGGTGCCCTGTCTTTA | CTC | chr17 | 7108942 | 7108963 | 7108947 | 7108942 | - |
| SEQ ID NO 9609 | CGGTGCCCTGTCTTTACCCTCC | CTT | chr17 | 7108936 | 7108957 | 7108941 | 7108936 | - |
| SEQ ID NO 9610 | GGTGCCCTGTCTTTACCCTCCG | TTC | chr17 | 7108935 | 7108956 | 7108940 | 7108935 | - |
| SEQ ID NO 9611 | TCTTTACCCTCCGGCTCCCCAC | CTG | chr17 | 7108926 | 7108947 | 7108931 | 7108926 | - |
| SEQ ID NO 9612 | TACCCTCCGGCTCCCCACACCC | CTT | chr17 | 7108922 | 7108943 | 7108927 | 7108922 | - |
| SEQ ID NO 9613 | ACCCTCCGGCTCCCCACACCCA | TTT | chr17 | 7108921 | 7108942 | 7108926 | 7108921 | - |
| SEQ ID NO 9614 | CCCTCCGGCTCCCCACACCCAG | TTA | chr17 | 7108920 | 7108941 | 7108925 | 7108920 | - |
| SEQ ID NO 9615 | CGGCTCCCCACACCCAGGCTGC | CTC | chr17 | 7108915 | 7108936 | 7108920 | 7108915 | - |
| SEQ ID NO 9616 | CCCACACCCAGGCTGCCGGCTC | CTC | chr17 | 7108909 | 7108930 | 7108914 | 7108909 | - |
| SEQ ID NO 9617 | CCGGCTCCTGATGCCCCTCTCC | CTG | chr17 | 7108894 | 7108915 | 7108899 | 7108894 | - |
| SEQ ID NO 9618 | CTGATGCCCCTCTCCCACAGGG | CTC | chr17 | 7108887 | 7108908 | 7108892 | 7108887 | - |
| SEQ ID NO 9619 | ATGCCCCTCTCCCACAGGGCCA | CTG | chr17 | 7108884 | 7108905 | 7108889 | 7108884 | - |
| SEQ ID NO 9620 | TCCCACAGGGCCACCTCCTGCC | CTC | chr17 | 7108875 | 7108896 | 7108880 | 7108875 | - |
| SEQ ID NO 9621 | CCACAGGGCCACCTCCTGCCCA | CTC | chr17 | 7108873 | 7108894 | 7108878 | 7108873 | - |
| SEQ ID NO 9622 | CTGCCCAGCCCTGGCACAGCG | CTC | chr17 | 7108858 | 7108879 | 7108863 | 7108858 | - |
| SEQ ID NO 9623 | CCCAGCCCTGGCACAGCGTCT | CTG | chr17 | 7108855 | 7108876 | 7108860 | 7108855 | - |
| SEQ ID NO 9624 | GCACAGCGTCTCTGCTCCATGG | CTG | chr17 | 7108844 | 7108865 | 7108849 | 7108844 | - |
| SEQ ID NO 9625 | TGCTCCATGGTCTGCTTCAGTC | CTC | chr17 | 7108832 | 7108853 | 7108837 | 7108832 | - |
| SEQ ID NO 9626 | CTCCATGGTCTGCTTCAGTCTG | CTG | chr17 | 7108830 | 7108851 | 7108835 | 7108830 | - |
| SEQ ID NO 9627 | CATGGTCTGCTTCAGTCTGCTT | CTC | chr17 | 7108827 | 7108848 | 7108832 | 7108827 | - |
| SEQ ID NO 9628 | CTTCAGTCTGCTTGCCCTGAGC | CTG | chr17 | 7108818 | 7108839 | 7108823 | 7108818 | - |
| SEQ ID NO 9629 | CAGTCTGCTTGCCCTGAGCTT | CTT | chr17 | 7108815 | 7108836 | 7108820 | 7108815 | - |
| SEQ ID NO 9630 | AGTCTGCTTGCCCTGAGCTTCA | TTC | chr17 | 7108814 | 7108835 | 7108819 | 7108814 | - |
| SEQ ID NO 9631 | CTTGCCCTGAGCTTCAACATCC | CTG | chr17 | 7108808 | 7108829 | 7108813 | 7108808 | - |
| SEQ ID NO 9632 | GCCCTGAGCTTCAACATCCTGC | CTT | chr17 | 7108805 | 7108826 | 7108810 | 7108805 | - |
| SEQ ID NO 9633 | CCCTGAGCTTCAACATCCTGCT | TTG | chr17 | 7108804 | 7108825 | 7108809 | 7108804 | - |
| SEQ ID NO 9634 | AGCTTCAACATCCTGCTGCTGG | CTG | chr17 | 7108799 | 7108820 | 7108804 | 7108799 | - |
| SEQ ID NO 9635 | CAACATCCTGCTGCTGGTGGTC | CTT | chr17 | 7108794 | 7108815 | 7108799 | 7108794 | - |
| SEQ ID NO 9636 | AACATCCTGCTGCTGGTGGTCA | TTC | chr17 | 7108793 | 7108814 | 7108798 | 7108793 | - |
| SEQ ID NO 9637 | CTGCTGGTGGTCATCTGTGTGA | CTG | chr17 | 7108784 | 7108805 | 7108789 | 7108784 | - |
| SEQ ID NO 9638 | CTGGTGGTCATCTGTGTGACTG | CTG | chr17 | 7108781 | 7108802 | 7108786 | 7108781 | - |
| SEQ ID NO 9639 | GTGGTCATCTGTGTGACTGGGT | CTG | chr17 | 7108778 | 7108799 | 7108783 | 7108778 | - |
| SEQ ID NO 9640 | TGTGACTGGGTCCCAAAGTGAG | CTG | chr17 | 7108767 | 7108788 | 7108772 | 7108767 | - |
| SEQ ID NO 9641 | GGTCCCAAAGTGAGGGTCACGG | CTG | chr17 | 7108759 | 7108780 | 7108764 | 7108759 | - |

Figure 31

| # | Sequence | PAM | Chr | Start | End | Cuts 5' of | Str |
|---|---|---|---|---|---|---|---|
| SEQ ID NO 9642 | CTTCAGATAGATTATATCTG | GAG | chr3 | 46370142 | 46370161 | 46370158 | + |
| SEQ ID NO 9643 | GATAGATTATATCTGGAGTG | AAG | chr3 | 46370147 | 46370166 | 46370163 | + |
| SEQ ID NO 9644 | AATCCTGCCACCTATGTATC | TGG | chr3 | 46370170 | 46370189 | 46370186 | + |
| SEQ ID NO 9645 | TGCCACCTATGTATCTGGCA | TAG | chr3 | 46370175 | 46370194 | 46370191 | + |
| SEQ ID NO 9646 | CTATGTATCTGGCATAGTGT | GAG | chr3 | 46370181 | 46370200 | 46370197 | + |
| SEQ ID NO 9647 | GAGTCCTCATAAATGCTTAC | TGG | chr3 | 46370201 | 46370220 | 46370217 | + |
| SEQ ID NO 9648 | CATAAATGCTTACTGGTTTG | AAG | chr3 | 46370208 | 46370227 | 46370224 | + |
| SEQ ID NO 9649 | ATAAATGCTTACTGGTTTGA | AGG | chr3 | 46370209 | 46370228 | 46370225 | + |
| SEQ ID NO 9650 | TAAATGCTTACTGGTTTGAA | GGG | chr3 | 46370210 | 46370229 | 46370226 | + |
| SEQ ID NO 9651 | TGGTTTGAAGGGCAACAAAA | TAG | chr3 | 46370221 | 46370240 | 46370237 | + |
| SEQ ID NO 9652 | AAGGGCAACAAAATAGTGAA | CAG | chr3 | 46370228 | 46370247 | 46370244 | + |
| SEQ ID NO 9653 | GGGCAACAAAATAGTGAACA | GAG | chr3 | 46370230 | 46370249 | 46370246 | + |
| SEQ ID NO 9654 | ACAGAGTGAAAATCCCCACT | AAG | chr3 | 46370247 | 46370266 | 46370263 | + |
| SEQ ID NO 9655 | GAAAATCCCCACTAAGATCC | TGG | chr3 | 46370254 | 46370273 | 46370270 | + |
| SEQ ID NO 9656 | AAAATCCCCACTAAGATCCT | GGG | chr3 | 46370255 | 46370274 | 46370271 | + |
| SEQ ID NO 9657 | CCCCACTAAGATCCTGGGTC | CAG | chr3 | 46370260 | 46370279 | 46370276 | + |
| SEQ ID NO 9658 | TAAGATCCTGGGTCCAGAAA | AAG | chr3 | 46370266 | 46370285 | 46370282 | + |
| SEQ ID NO 9659 | ATCCTGGGTCCAGAAAAGA | TGG | chr3 | 46370270 | 46370289 | 46370286 | + |
| SEQ ID NO 9660 | TCCTGGGTCCAGAAAAGAT | GGG | chr3 | 46370271 | 46370290 | 46370287 | + |
| SEQ ID NO 9661 | AAAAAGATGGGAAACCTGTT | TAG | chr3 | 46370283 | 46370302 | 46370299 | + |
| SEQ ID NO 9662 | AACCTGTTTAGCTCACCCGT | GAG | chr3 | 46370295 | 46370314 | 46370311 | + |
| SEQ ID NO 9663 | TTAGCTCACCCGTGAGCCCA | TAG | chr3 | 46370302 | 46370321 | 46370318 | + |
| SEQ ID NO 9664 | AGCCCATAGTTAAAACTCTT | TAG | chr3 | 46370316 | 46370335 | 46370332 | + |
| SEQ ID NO 9665 | AGTTAAAACTCTTTAGACAA | CAG | chr3 | 46370323 | 46370342 | 46370339 | + |
| SEQ ID NO 9666 | GTTAAAACTCTTTAGACAAC | AGG | chr3 | 46370324 | 46370343 | 46370340 | + |
| SEQ ID NO 9667 | CAACAGGTTGTTTCCGTTTA | CAG | chr3 | 46370340 | 46370359 | 46370356 | + |
| SEQ ID NO 9668 | ACAGGTTGTTTCCGTTTACA | GAG | chr3 | 46370342 | 46370361 | 46370358 | + |
| SEQ ID NO 9669 | TTTACAGAGAACAATAATAT | TGG | chr3 | 46370356 | 46370375 | 46370372 | + |
| SEQ ID NO 9670 | TTACAGAGAACAATAATATT | GGG | chr3 | 46370357 | 46370376 | 46370373 | + |
| SEQ ID NO 9671 | CAGAGAACAATAATATTGGG | TGG | chr3 | 46370360 | 46370379 | 46370376 | + |
| SEQ ID NO 9672 | GAACAATAATATTGGGTGGT | GAG | chr3 | 46370364 | 46370383 | 46370380 | + |
| SEQ ID NO 9673 | TTGGGTGGTGAGCATCTGTG | TGG | chr3 | 46370375 | 46370394 | 46370391 | + |
| SEQ ID NO 9674 | TGGGTGGTGAGCATCTGTGT | GGG | chr3 | 46370376 | 46370395 | 46370392 | + |
| SEQ ID NO 9675 | GGGTGGTGAGCATCTGTGTG | GGG | chr3 | 46370377 | 46370396 | 46370393 | + |
| SEQ ID NO 9676 | GGTGGTGAGCATCTGTGTGG | GGG | chr3 | 46370378 | 46370397 | 46370394 | + |
| SEQ ID NO 9677 | GTGAGCATCTGTGTGGGGGT | TGG | chr3 | 46370382 | 46370401 | 46370398 | + |
| SEQ ID NO 9678 | TGAGCATCTGTGTGGGGGTT | GGG | chr3 | 46370383 | 46370402 | 46370399 | + |
| SEQ ID NO 9679 | GAGCATCTGTGTGGGGGTTG | GGG | chr3 | 46370384 | 46370403 | 46370400 | + |
| SEQ ID NO 9680 | CATCTGTGTGGGGGTTGGGG | TGG | chr3 | 46370387 | 46370406 | 46370403 | + |
| SEQ ID NO 9681 | ATCTGTGTGGGGGTTGGGGT | GGG | chr3 | 46370388 | 46370407 | 46370404 | + |
| SEQ ID NO 9682 | GTGTGGGGGTTGGGGTGGGA | TAG | chr3 | 46370392 | 46370411 | 46370408 | + |
| SEQ ID NO 9683 | TGTGGGGGTTGGGGTGGGAT | AGG | chr3 | 46370393 | 46370412 | 46370409 | + |
| SEQ ID NO 9684 | GTGGGGGTTGGGGTGGGATA | GGG | chr3 | 46370394 | 46370413 | 46370410 | + |
| SEQ ID NO 9685 | TGGGGGTTGGGGTGGGATAG | GGG | chr3 | 46370395 | 46370414 | 46370411 | + |
| SEQ ID NO 9686 | TTGGGGTGGGATAGGGGATA | CGG | chr3 | 46370401 | 46370420 | 46370417 | + |
| SEQ ID NO 9687 | TGGGGTGGGATAGGGGATAC | GGG | chr3 | 46370402 | 46370421 | 46370418 | + |

Figure 31 (Cont'd)

| | | | | | | | |
|---|---|---|---|---|---|---|---|
| SEQ ID NO 9688 | GGGGTGGGATAGGGGATACG | GGG | chr3 | 46370403 | 46370422 | 46370419 | + |
| SEQ ID NO 9689 | GGTGGGATAGGGGATACGGG | GAG | chr3 | 46370405 | 46370424 | 46370421 | + |
| SEQ ID NO 9690 | TGGGATAGGGGATACGGGGA | GAG | chr3 | 46370407 | 46370426 | 46370423 | + |
| SEQ ID NO 9691 | GATAGGGGATACGGGGAGAG | TGG | chr3 | 46370410 | 46370429 | 46370426 | + |
| SEQ ID NO 9692 | TAGGGGATACGGGGAGAGTG | GAG | chr3 | 46370412 | 46370431 | 46370428 | + |
| SEQ ID NO 9693 | ATACGGGGAGAGTGGAGAAA | AAG | chr3 | 46370418 | 46370437 | 46370434 | + |
| SEQ ID NO 9694 | TACGGGGAGAGTGGAGAAAA | AGG | chr3 | 46370419 | 46370438 | 46370435 | + |
| SEQ ID NO 9695 | ACGGGGAGAGTGGAGAAAAA | GGG | chr3 | 46370420 | 46370439 | 46370436 | + |
| SEQ ID NO 9696 | CGGGGAGAGTGGAGAAAAAG | GGG | chr3 | 46370421 | 46370440 | 46370437 | + |
| SEQ ID NO 9697 | GAGTGGAGAAAAGGGGACA | CAG | chr3 | 46370427 | 46370446 | 46370443 | + |
| SEQ ID NO 9698 | AGTGGAGAAAAGGGGACAC | AGG | chr3 | 46370428 | 46370447 | 46370444 | + |
| SEQ ID NO 9699 | GTGGAGAAAAGGGGACACA | GGG | chr3 | 46370429 | 46370448 | 46370445 | + |
| SEQ ID NO 9700 | GGGGACACAGGGTTAATGTG | AAG | chr3 | 46370440 | 46370459 | 46370456 | + |
| SEQ ID NO 9701 | CACAGGGTTAATGTGAAGTC | CAG | chr3 | 46370445 | 46370464 | 46370461 | + |
| SEQ ID NO 9702 | ACAGGGTTAATGTGAAGTCC | AGG | chr3 | 46370446 | 46370465 | 46370462 | + |
| SEQ ID NO 9703 | AGGATCCCCCTCTACATTTA | AAG | chr3 | 46370466 | 46370485 | 46370482 | + |
| SEQ ID NO 9704 | TCCCCCTCTACATTTAAAGT | TGG | chr3 | 46370470 | 46370489 | 46370486 | + |
| SEQ ID NO 9705 | TCTACATTTAAAGTTGGTTT | AAG | chr3 | 46370476 | 46370495 | 46370492 | + |
| SEQ ID NO 9706 | CATTTAAAGTTGGTTTAAGT | TGG | chr3 | 46370480 | 46370499 | 46370496 | + |
| SEQ ID NO 9707 | TTTAAGTTGGCTTTAATTAA | TAG | chr3 | 46370493 | 46370512 | 46370509 | + |
| SEQ ID NO 9708 | TTTAATTAATAGCAACTCTT | AAG | chr3 | 46370504 | 46370523 | 46370520 | + |
| SEQ ID NO 9709 | ATAGCAACTCTTAAGATAAT | CAG | chr3 | 46370512 | 46370531 | 46370528 | + |
| SEQ ID NO 9710 | TCAGAATTTTCTTAACCTTT | TAG | chr3 | 46370531 | 46370550 | 46370547 | + |
| SEQ ID NO 9711 | CTTTTAGCCTTACTGTTGAA | AAG | chr3 | 46370547 | 46370566 | 46370563 | + |
| SEQ ID NO 9712 | TGTACAATCATTTGCTTCT | TGG | chr3 | 46370581 | 46370600 | 46370597 | + |
| SEQ ID NO 9713 | CAAATCATTTGCTTCTTGGA | TAG | chr3 | 46370585 | 46370604 | 46370601 | + |
| SEQ ID NO 9714 | TAATTTCTTTTACTAAAATG | TGG | chr3 | 46370608 | 46370627 | 46370624 | + |
| SEQ ID NO 9715 | AATTTCTTTTACTAAAATGT | GGG | chr3 | 46370609 | 46370628 | 46370625 | + |
| SEQ ID NO 9716 | CTAAAATGTGGGCTTTTGAC | TAG | chr3 | 46370620 | 46370639 | 46370636 | + |
| SEQ ID NO 9717 | GATGAATGTAAATGTTCTTC | TAG | chr3 | 46370642 | 46370661 | 46370658 | + |
| SEQ ID NO 9718 | TTATTCTTTATATTTTCTAA | CAG | chr3 | 46370677 | 46370696 | 46370693 | + |
| SEQ ID NO 9719 | ATTTTCTAACAGATTCTGTG | TAG | chr3 | 46370688 | 46370707 | 46370704 | + |
| SEQ ID NO 9720 | TTCTAACAGATTCTGTGTAG | TGG | chr3 | 46370691 | 46370710 | 46370707 | + |
| SEQ ID NO 9721 | TCTAACAGATTCTGTGTAGT | GGG | chr3 | 46370692 | 46370711 | 46370708 | + |
| SEQ ID NO 9722 | CAGATTCTGTGTAGTGGGAT | GAG | chr3 | 46370697 | 46370716 | 46370713 | + |
| SEQ ID NO 9723 | ATTCTGTGTAGTGGGATGAG | CAG | chr3 | 46370700 | 46370719 | 46370716 | + |
| SEQ ID NO 9724 | TCTGTGTAGTGGGATGAGCA | GAG | chr3 | 46370702 | 46370721 | 46370718 | + |
| SEQ ID NO 9725 | AGAACAAAACAAAATAATC | CAG | chr3 | 46370723 | 46370742 | 46370739 | + |
| SEQ ID NO 9726 | CAAAAACAAAATAATCCAGT | GAG | chr3 | 46370727 | 46370746 | 46370743 | + |
| SEQ ID NO 9727 | ACAAAATAATCCAGTGAGAA | AAG | chr3 | 46370732 | 46370751 | 46370748 | + |
| SEQ ID NO 9728 | AAAGCCCGTAAATAAACCTT | CAG | chr3 | 46370751 | 46370770 | 46370767 | + |
| SEQ ID NO 9729 | CCGTAAATAAACCTTCAGAC | CAG | chr3 | 46370756 | 46370775 | 46370772 | + |
| SEQ ID NO 9730 | GTAAATAAACCTTCAGACCA | GAG | chr3 | 46370758 | 46370777 | 46370774 | + |
| SEQ ID NO 9731 | CAGACCAGAGATCTATTCTC | TAG | chr3 | 46370771 | 46370790 | 46370787 | + |
| SEQ ID NO 9732 | TCTATTCTCTAGCTTATTTT | AAG | chr3 | 46370782 | 46370801 | 46370798 | + |
| SEQ ID NO 9733 | TATTTTAAGCTCAACTTAAA | AAG | chr3 | 46370796 | 46370815 | 46370812 | + |
| SEQ ID NO 9734 | TTTAAGCTCAACTTAAAAAG | AAG | chr3 | 46370799 | 46370818 | 46370815 | + |

Figure 31 (Cont'd)

| | | | | | | | |
|---|---|---|---|---|---|---|---|
| SEQ ID NO 9735 | TTAACTCCACCCTCCTTCAA | AAG | chr3 | 46370864 | 46370883 | 46370880 | + |
| SEQ ID NO 9736 | CCACCCTCCTTCAAAAGAAA | CAG | chr3 | 46370870 | 46370889 | 46370886 | + |
| SEQ ID NO 9737 | GTCTATATGATTGATTTGCA | CAG | chr3 | 46370912 | 46370931 | 46370928 | + |
| SEQ ID NO 9738 | ATTGATTTGCACAGCTCATC | TGG | chr3 | 46370921 | 46370940 | 46370937 | + |
| SEQ ID NO 9739 | ATTTGCACAGCTCATCTGGC | CAG | chr3 | 46370925 | 46370944 | 46370941 | + |
| SEQ ID NO 9740 | TGCACAGCTCATCTGGCCAG | AAG | chr3 | 46370928 | 46370947 | 46370944 | + |
| SEQ ID NO 9741 | CACAGCTCATCTGGCCAGAA | GAG | chr3 | 46370930 | 46370949 | 46370946 | + |
| SEQ ID NO 9742 | CTCATCTGGCCAGAAGAGCT | GAG | chr3 | 46370935 | 46370954 | 46370951 | + |
| SEQ ID NO 9743 | TGAGACATCCGTTCCCTAC | AAG | chr3 | 46370954 | 46370973 | 46370970 | + |
| SEQ ID NO 9744 | GAGAGTTTCTTGTAGGGGAA | CGG | chr3 | 46370965 | 46370984 | 46370968 | - |
| SEQ ID NO 9745 | TTGTAGGGGAACGGATGTCT | CAG | chr3 | 46370956 | 46370975 | 46370959 | - |
| SEQ ID NO 9746 | AACGGATGTCTCAGCTCTTC | TGG | chr3 | 46370947 | 46370966 | 46370950 | - |
| SEQ ID NO 9747 | GATGTCTCAGCTCTTCTGGC | CAG | chr3 | 46370943 | 46370962 | 46370946 | - |
| SEQ ID NO 9748 | CTCAGCTCTTCTGGCCAGAT | GAG | chr3 | 46370938 | 46370957 | 46370941 | - |
| SEQ ID NO 9749 | AGCTGTGCAAATCAATCATA | TAG | chr3 | 46370917 | 46370936 | 46370920 | - |
| SEQ ID NO 9750 | GTGCAAATCAATCATATAGA | CAG | chr3 | 46370913 | 46370932 | 46370916 | - |
| SEQ ID NO 9751 | CAATCATATAGACAGTATAA | AAG | chr3 | 46370905 | 46370924 | 46370908 | - |
| SEQ ID NO 9752 | TCATATAGACAGTATAAAAG | TAG | chr3 | 46370902 | 46370921 | 46370905 | - |
| SEQ ID NO 9753 | CATATAGACAGTATAAAAGT | AGG | chr3 | 46370901 | 46370920 | 46370904 | - |
| SEQ ID NO 9754 | AGGAAATGCTGTTTCTTTTG | AAG | chr3 | 46370881 | 46370900 | 46370884 | - |
| SEQ ID NO 9755 | GGAAATGCTGTTTCTTTTGA | AGG | chr3 | 46370880 | 46370899 | 46370883 | - |
| SEQ ID NO 9756 | AAATGCTGTTTCTTTTGAAG | GAG | chr3 | 46370878 | 46370897 | 46370881 | - |
| SEQ ID NO 9757 | AATGCTGTTTCTTTTGAAGG | AGG | chr3 | 46370877 | 46370896 | 46370880 | - |
| SEQ ID NO 9758 | ATGCTGTTTCTTTTGAAGGA | GGG | chr3 | 46370876 | 46370895 | 46370879 | - |
| SEQ ID NO 9759 | CTGTTTCTTTTGAAGGAGGG | TGG | chr3 | 46370873 | 46370892 | 46370876 | - |
| SEQ ID NO 9760 | GTTTCTTTTGAAGGAGGGTG | GAG | chr3 | 46370871 | 46370890 | 46370874 | - |
| SEQ ID NO 9761 | GAGGGTGGAGTTAAATCATT | AAG | chr3 | 46370858 | 46370877 | 46370861 | - |
| SEQ ID NO 9762 | TTAAATCATTAAGTGTATTG | AAG | chr3 | 46370848 | 46370867 | 46370851 | - |
| SEQ ID NO 9763 | TAAATCATTAAGTGTATTGA | AGG | chr3 | 46370847 | 46370866 | 46370850 | - |
| SEQ ID NO 9764 | TTAAGTGTATTGAAGGCGAA | AAG | chr3 | 46370840 | 46370859 | 46370843 | - |
| SEQ ID NO 9765 | GTATTGAAGGCGAAAAGAAT | CAG | chr3 | 46370834 | 46370853 | 46370837 | - |
| SEQ ID NO 9766 | ATTGAAGGCGAAAAGAATCA | GAG | chr3 | 46370832 | 46370851 | 46370835 | - |
| SEQ ID NO 9767 | AGGCGAAAAGAATCAGAGAA | CAG | chr3 | 46370827 | 46370846 | 46370830 | - |
| SEQ ID NO 9768 | AGAGAACAGTTCTTCTTTTT | AAG | chr3 | 46370813 | 46370832 | 46370816 | - |
| SEQ ID NO 9769 | ACAGTTCTTCTTTTTAAGTT | GAG | chr3 | 46370808 | 46370827 | 46370811 | - |
| SEQ ID NO 9770 | TTTTAAGTTGAGCTTAAAAT | AAG | chr3 | 46370797 | 46370816 | 46370800 | - |
| SEQ ID NO 9771 | AAGTTGAGCTTAAAATAAGC | TAG | chr3 | 46370793 | 46370812 | 46370796 | - |
| SEQ ID NO 9772 | GTTGAGCTTAAAATAAGCTA | GAG | chr3 | 46370791 | 46370810 | 46370794 | - |
| SEQ ID NO 9773 | GCTTAAAATAAGCTAGAGAA | TAG | chr3 | 46370786 | 46370805 | 46370789 | - |
| SEQ ID NO 9774 | TAAGCTAGAGAATAGATCTC | TGG | chr3 | 46370778 | 46370797 | 46370781 | - |
| SEQ ID NO 9775 | GAGAATAGATCTCTGGTCTG | AAG | chr3 | 46370771 | 46370790 | 46370774 | - |
| SEQ ID NO 9776 | AGAATAGATCTCTGGTCTGA | AGG | chr3 | 46370770 | 46370789 | 46370773 | - |
| SEQ ID NO 9777 | CTGGTCTGAAGGTTTATTTA | CGG | chr3 | 46370759 | 46370778 | 46370762 | - |
| SEQ ID NO 9778 | TGGTCTGAAGGTTTATTTAC | GGG | chr3 | 46370758 | 46370777 | 46370761 | - |
| SEQ ID NO 9779 | TATTTACGGGCTTTTCTCAC | TGG | chr3 | 46370745 | 46370764 | 46370748 | - |
| SEQ ID NO 9780 | TCTCTGCTCATCCCACTACA | CAG | chr3 | 46370706 | 46370725 | 46370709 | - |
| SEQ ID NO 9781 | TCCCACTACACAGAATCTGT | TAG | chr3 | 46370696 | 46370715 | 46370699 | - |

Figure 31 (Cont'd)

| | | | | | | | |
|---|---|---|---|---|---|---|---|
| SEQ ID NO 9782 | AGAATCTGTTAGAAAATATA | AAG | chr3 | 46370685 | 46370704 | 46370688 | - |
| SEQ ID NO 9783 | GTTAGAAAATATAAAGAATA | AAG | chr3 | 46370678 | 46370697 | 46370681 | - |
| SEQ ID NO 9784 | TTAGAAAATATAAAGAATAA | AGG | chr3 | 46370677 | 46370696 | 46370680 | - |
| SEQ ID NO 9785 | ATATAAAGAATAAAGGATAT | CAG | chr3 | 46370670 | 46370689 | 46370673 | - |
| SEQ ID NO 9786 | ATAAAGAATAAAGGATATCA | GAG | chr3 | 46370668 | 46370687 | 46370671 | - |
| SEQ ID NO 9787 | AGAATAAAGGATATCAGAGC | TAG | chr3 | 46370664 | 46370683 | 46370667 | - |
| SEQ ID NO 9788 | ATAAAGGATATCAGAGCTAG | AAG | chr3 | 46370661 | 46370680 | 46370664 | - |
| SEQ ID NO 9789 | GAAGAACATTTACATTCATC | TAG | chr3 | 46370642 | 46370661 | 46370645 | - |
| SEQ ID NO 9790 | ATTTACATTCATCTAGTCAA | AAG | chr3 | 46370635 | 46370654 | 46370638 | - |
| SEQ ID NO 9791 | CTAGTCAAAAGCCCACATTT | TAG | chr3 | 46370623 | 46370642 | 46370626 | - |
| SEQ ID NO 9792 | AAAAGCCCACATTTTAGTAA | AAG | chr3 | 46370617 | 46370636 | 46370620 | - |
| SEQ ID NO 9793 | AGTAAAAGAAATTACTATCC | AAG | chr3 | 46370602 | 46370621 | 46370605 | - |
| SEQ ID NO 9794 | AAAAGAAATTACTATCCAAG | AAG | chr3 | 46370599 | 46370618 | 46370602 | - |
| SEQ ID NO 9795 | AAGAAGCAAATGATTTGTAC | AAG | chr3 | 46370582 | 46370601 | 46370585 | - |
| SEQ ID NO 9796 | AAATGATTTGTACAAGATCA | CAG | chr3 | 46370575 | 46370594 | 46370578 | - |
| SEQ ID NO 9797 | AATGATTTGTACAAGATCAC | AGG | chr3 | 46370574 | 46370593 | 46370577 | - |
| SEQ ID NO 9798 | ATGATTTGTACAAGATCACA | GGG | chr3 | 46370573 | 46370592 | 46370576 | - |
| SEQ ID NO 9799 | AAGATCACAGGGCTTTTCAA | CAG | chr3 | 46370562 | 46370581 | 46370565 | - |
| SEQ ID NO 9800 | TCACAGGGCTTTTCAACAGT | AAG | chr3 | 46370558 | 46370577 | 46370561 | - |
| SEQ ID NO 9801 | CACAGGGCTTTTCAACAGTA | AGG | chr3 | 46370557 | 46370576 | 46370560 | - |
| SEQ ID NO 9802 | CTTTTCAACAGTAAGGCTAA | AAG | chr3 | 46370550 | 46370569 | 46370553 | - |
| SEQ ID NO 9803 | TTTTCAACAGTAAGGCTAAA | AGG | chr3 | 46370549 | 46370568 | 46370552 | - |
| SEQ ID NO 9804 | AACAGTAAGGCTAAAAGGTT | AAG | chr3 | 46370544 | 46370563 | 46370547 | - |
| SEQ ID NO 9805 | AAGAAAATTCTGATTATCTT | AAG | chr3 | 46370524 | 46370543 | 46370527 | - |
| SEQ ID NO 9806 | GAAAATTCTGATTATCTTAA | GAG | chr3 | 46370522 | 46370541 | 46370525 | - |
| SEQ ID NO 9807 | TTAAGAGTTGCTATTAATTA | AAG | chr3 | 46370506 | 46370525 | 46370509 | - |
| SEQ ID NO 9808 | ACTTAAACCAACTTTAAATG | TAG | chr3 | 46370480 | 46370499 | 46370483 | - |
| SEQ ID NO 9809 | TTAAACCAACTTTAAATGTA | GAG | chr3 | 46370478 | 46370497 | 46370481 | - |
| SEQ ID NO 9810 | TAAACCAACTTTAAATGTAG | AGG | chr3 | 46370477 | 46370496 | 46370480 | - |
| SEQ ID NO 9811 | AAACCAACTTTAAATGTAGA | GGG | chr3 | 46370476 | 46370495 | 46370479 | - |
| SEQ ID NO 9812 | AACCAACTTTAAATGTAGAG | GGG | chr3 | 46370475 | 46370494 | 46370478 | - |
| SEQ ID NO 9813 | ACCAACTTTAAATGTAGAGG | GGG | chr3 | 46370474 | 46370493 | 46370477 | - |
| SEQ ID NO 9814 | TTAAATGTAGAGGGGATCC | TGG | chr3 | 46370467 | 46370486 | 46370470 | - |
| SEQ ID NO 9815 | ATCCCACCCCAACCCCCACA | CAG | chr3 | 46370393 | 46370412 | 46370396 | - |
| SEQ ID NO 9816 | ATATTATTGTTCTCTGTAAA | CGG | chr3 | 46370356 | 46370375 | 46370359 | - |
| SEQ ID NO 9817 | CGGAAACAACCTGTTGTCTA | AAG | chr3 | 46370336 | 46370355 | 46370339 | - |
| SEQ ID NO 9818 | GAAACAACCTGTTGTCTAAA | GAG | chr3 | 46370334 | 46370353 | 46370337 | - |
| SEQ ID NO 9819 | TGTCTAAAGAGTTTTAACTA | TGG | chr3 | 46370322 | 46370341 | 46370325 | - |
| SEQ ID NO 9820 | GTCTAAAGAGTTTTAACTAT | GGG | chr3 | 46370321 | 46370340 | 46370324 | - |
| SEQ ID NO 9821 | GAGTTTTAACTATGGGCTCA | CGG | chr3 | 46370314 | 46370333 | 46370317 | - |
| SEQ ID NO 9822 | AGTTTTAACTATGGGCTCAC | GGG | chr3 | 46370313 | 46370332 | 46370316 | - |
| SEQ ID NO 9823 | TTAACTATGGGCTCACGGGT | GAG | chr3 | 46370309 | 46370328 | 46370312 | - |
| SEQ ID NO 9824 | GGGCTCACGGGTGAGCTAAA | CAG | chr3 | 46370301 | 46370320 | 46370304 | - |
| SEQ ID NO 9825 | GGCTCACGGGTGAGCTAAAC | AGG | chr3 | 46370300 | 46370319 | 46370303 | - |
| SEQ ID NO 9826 | ACAGGTTTCCCATCTTTTTC | TGG | chr3 | 46370282 | 46370301 | 46370285 | - |
| SEQ ID NO 9827 | TTCCCATCTTTTTCTGGACC | CAG | chr3 | 46370276 | 46370295 | 46370279 | - |
| SEQ ID NO 9828 | TCCCATCTTTTTCTGGACCC | AGG | chr3 | 46370275 | 46370294 | 46370278 | - |

Figure 31 (Cont'd)

| | | | | | | | |
|---|---|---|---|---|---|---|---|
| SEQ ID NO 9829 | TTTTTCTGGACCCAGGATCT | TAG | chr3 | 46370268 | 46370287 | 46370271 | - |
| SEQ ID NO 9830 | TTCTGGACCCAGGATCTTAG | TGG | chr3 | 46370265 | 46370284 | 46370268 | - |
| SEQ ID NO 9831 | TCTGGACCCAGGATCTTAGT | GGG | chr3 | 46370264 | 46370283 | 46370267 | - |
| SEQ ID NO 9832 | CTGGACCCAGGATCTTAGTG | GGG | chr3 | 46370263 | 46370282 | 46370266 | - |
| SEQ ID NO 9833 | TATTTTGTTGCCCTTCAAAC | CAG | chr3 | 46370223 | 46370242 | 46370226 | - |
| SEQ ID NO 9834 | TTGTTGCCCTTCAAACCAGT | AAG | chr3 | 46370219 | 46370238 | 46370222 | - |
| SEQ ID NO 9835 | TCAAACCAGTAAGCATTTAT | GAG | chr3 | 46370209 | 46370228 | 46370212 | - |
| SEQ ID NO 9836 | CAAACCAGTAAGCATTTATG | AGG | chr3 | 46370208 | 46370227 | 46370211 | - |
| SEQ ID NO 9837 | TATGAGGACTCACACTATGC | CAG | chr3 | 46370192 | 46370211 | 46370195 | - |
| SEQ ID NO 9838 | CTCACACTATGCCAGATACA | TAG | chr3 | 46370184 | 46370203 | 46370187 | - |
| SEQ ID NO 9839 | TCACACTATGCCAGATACAT | AGG | chr3 | 46370183 | 46370202 | 46370186 | - |
| SEQ ID NO 9840 | CACTATGCCAGATACATAGG | TGG | chr3 | 46370180 | 46370199 | 46370183 | - |
| SEQ ID NO 9841 | TATGCCAGATACATAGGTGG | CAG | chr3 | 46370177 | 46370196 | 46370180 | - |
| SEQ ID NO 9842 | ATGCCAGATACATAGGTGGC | AGG | chr3 | 46370176 | 46370195 | 46370179 | - |
| SEQ ID NO 9843 | GGTGGCAGGATTCTTCACTC | CAG | chr3 | 46370162 | 46370181 | 46370165 | - |
| SEQ ID NO 9844 | CTCCAGATATAATCTATCTG | AAG | chr3 | 46370145 | 46370164 | 46370148 | - |

Figure 32

| # | Sequence | PAM | Chr | Start | End | Cuts 5' of | Str |
|---|---|---|---|---|---|---|---|
| SEQ ID NO 9845 | GATAGATTATATCTGGAGTG | AAGAAT | chr3 | 46370147 | 46370166 | 46370163 | + |
| SEQ ID NO 9846 | ACCTATGTATCTGGCATAGT | GTGAGT | chr3 | 46370179 | 46370198 | 46370195 | + |
| SEQ ID NO 9847 | AAGGGCAACAAAATAGTGAA | CAGAGT | chr3 | 46370228 | 46370247 | 46370244 | + |
| SEQ ID NO 9848 | TGAAAATCCCCACTAAGATC | CTGGGT | chr3 | 46370253 | 46370272 | 46370269 | + |
| SEQ ID NO 9849 | GTTTACAGAGAACAATAATA | TTGGGT | chr3 | 46370355 | 46370374 | 46370371 | + |
| SEQ ID NO 9850 | TGGGTGGTGAGCATCTGTGT | GGGGGT | chr3 | 46370376 | 46370395 | 46370392 | + |
| SEQ ID NO 9851 | GTGAGCATCTGTGTGGGGGT | TGGGGT | chr3 | 46370382 | 46370401 | 46370398 | + |
| SEQ ID NO 9852 | CATCTGTGTGGGGGTTGGGG | TGGGAT | chr3 | 46370387 | 46370406 | 46370403 | + |
| SEQ ID NO 9853 | GTGGGGGTTGGGGTGGGATA | GGGGAT | chr3 | 46370394 | 46370413 | 46370410 | + |
| SEQ ID NO 9854 | GGTGGGATAGGGGATACGGG | GAGAGT | chr3 | 46370405 | 46370424 | 46370421 | + |
| SEQ ID NO 9855 | GAGTGGAGAAAAGGGGACA | CAGGGT | chr3 | 46370427 | 46370446 | 46370443 | + |
| SEQ ID NO 9856 | CACAGGGTTAATGTGAAGTC | CAGGAT | chr3 | 46370445 | 46370464 | 46370461 | + |
| SEQ ID NO 9857 | ATAGCAACTCTTAAGATAAT | CAGAAT | chr3 | 46370512 | 46370531 | 46370528 | + |
| SEQ ID NO 9858 | TTGTACAAATCATTTGCTTC | TTGGAT | chr3 | 46370580 | 46370599 | 46370596 | + |
| SEQ ID NO 9859 | AAATGTGGGCTTTTGACTAG | ATGAAT | chr3 | 46370623 | 46370642 | 46370639 | + |
| SEQ ID NO 9860 | TTCTAACAGATTCTGTGTAG | TGGGAT | chr3 | 46370691 | 46370710 | 46370707 | + |
| SEQ ID NO 9861 | GGAGAGTTTCTTGTAGGGGA | ACGGAT | chr3 | 46370966 | 46370985 | 46370969 | - |
| SEQ ID NO 9862 | AAATGCTGTTTCTTTTGAAG | GAGGGT | chr3 | 46370878 | 46370897 | 46370881 | - |
| SEQ ID NO 9863 | CTGTTTCTTTTGAAGGAGGG | TGGAGT | chr3 | 46370873 | 46370892 | 46370876 | - |
| SEQ ID NO 9864 | TTAAGTGTATTGAAGGCGAA | AAGAAT | chr3 | 46370840 | 46370859 | 46370843 | - |
| SEQ ID NO 9865 | GTTGAGCTTAAAATAAGCTA | GAGAAT | chr3 | 46370791 | 46370810 | 46370794 | - |
| SEQ ID NO 9866 | TTATTTACGGGCTTTTCTCA | CTGGAT | chr3 | 46370746 | 46370765 | 46370749 | - |
| SEQ ID NO 9867 | TCTCTGCTCATCCCACTACA | CAGAAT | chr3 | 46370706 | 46370725 | 46370709 | - |
| SEQ ID NO 9868 | AGAATCTGTTAGAAAATATA | AAGAAT | chr3 | 46370685 | 46370704 | 46370688 | - |
| SEQ ID NO 9869 | GTTAGAAAATATAAAGAATA | AAGGAT | chr3 | 46370678 | 46370697 | 46370681 | - |
| SEQ ID NO 9870 | AAGAAAATTCTGATTATCTT | AAGAGT | chr3 | 46370524 | 46370543 | 46370527 | - |
| SEQ ID NO 9871 | AACCAACTTTAAATGTAGAG | GGGGAT | chr3 | 46370475 | 46370494 | 46370478 | - |
| SEQ ID NO 9872 | CGGAAACAACCTGTTGTCTA | AAGAGT | chr3 | 46370336 | 46370355 | 46370339 | - |
| SEQ ID NO 9873 | AGAGTTTTAACTATGGGCTC | ACGGGT | chr3 | 46370315 | 46370334 | 46370318 | - |
| SEQ ID NO 9874 | TTCCCATCTTTTCTGGACC | CAGGAT | chr3 | 46370276 | 46370295 | 46370279 | - |
| SEQ ID NO 9875 | TCTGGACCCAGGATCTTAGT | GGGGAT | chr3 | 46370264 | 46370283 | 46370267 | - |
| SEQ ID NO 9876 | TATGCCAGATACATAGGTGG | CAGGAT | chr3 | 46370177 | 46370196 | 46370180 | - |

Figure 33

| # | Sequence | PAM | Chr | Start | End | Cuts 5' of | Str |
|---|---|---|---|---|---|---|---|
| SEQ ID NO 9877 | AGATAGATTATATCTGGAGT | GAAGAAT | chr3 | 46370146 | 46370165 | 46370162 | + |
| SEQ ID NO 9878 | TCCCCACTAAGATCCTGGGT | CCAGAAA | chr3 | 46370259 | 46370278 | 46370275 | + |
| SEQ ID NO 9879 | ATAGGGGATACGGGGAGAGT | GGAGAAA | chr3 | 46370411 | 46370430 | 46370427 | + |
| SEQ ID NO 9880 | AATAGCAACTCTTAAGATAA | TCAGAAT | chr3 | 46370511 | 46370530 | 46370527 | + |
| SEQ ID NO 9881 | ACAAAAACAAAATAATCCAG | TGAGAAA | chr3 | 46370726 | 46370745 | 46370742 | + |
| SEQ ID NO 9882 | TTTAACTCCACCCTCCTTCA | AAAGAAA | chr3 | 46370863 | 46370882 | 46370879 | + |
| SEQ ID NO 9883 | CTGAGACATCCGTTCCCCTA | CAAGAAA | chr3 | 46370953 | 46370972 | 46370969 | + |
| SEQ ID NO 9884 | ATTAAGTGTATTGAAGGCGA | AAAGAAT | chr3 | 46370841 | 46370860 | 46370844 | - |
| SEQ ID NO 9885 | AGTTGAGCTTAAAATAAGCT | AGAGAAT | chr3 | 46370792 | 46370811 | 46370795 | - |
| SEQ ID NO 9886 | TTCTCTGCTCATCCCACTAC | ACAGAAT | chr3 | 46370707 | 46370726 | 46370710 | - |
| SEQ ID NO 9887 | ATCCCACTACACAGAATCTG | TTAGAAA | chr3 | 46370697 | 46370716 | 46370700 | - |
| SEQ ID NO 9888 | CAGAATCTGTTAGAAAATAT | AAAGAAT | chr3 | 46370686 | 46370705 | 46370689 | - |
| SEQ ID NO 9889 | CAAAAGCCCACATTTTAGTA | AAAGAAA | chr3 | 46370618 | 46370637 | 46370621 | - |
| SEQ ID NO 9890 | CAACAGTAAGGCTAAAAGGT | TAAGAAA | chr3 | 46370545 | 46370564 | 46370548 | - |

Figure 34

| # | Sequence | PAM | Chr | Start | End | Cuts 5' of | Str |
|---|---|---|---|---|---|---|---|
| SEQ ID NO 9891 | CTCACCCGTGAGCCCATAGT | TAAAAC | chr3 | 46370306 | 46370325 | 46370322 | + |
| SEQ ID NO 9892 | TAGTGGGATGAGCAGAGAAC | AAAAAC | chr3 | 46370708 | 46370727 | 46370724 | + |

Figure 35

| # | Sequence | PAM | Chr | Start | End | Cuts 5' of | Str |
|---|---|---|---|---|---|---|---|
| SEQ ID NO 9893 | GGCATAGTGTGAGTCCTCAT | AAATGCTT | chr3 | 46370191 | 46370210 | 46370207 | + |
| SEQ ID NO 9894 | GTGAGTCCTCATAAATGCTT | ACTGGTTT | chr3 | 46370199 | 46370218 | 46370215 | + |
| SEQ ID NO 9895 | GGTCCAGAAAAAGATGGGAA | ACCTGTTT | chr3 | 46370276 | 46370295 | 46370292 | + |
| SEQ ID NO 9896 | TTAAAACTCTTTAGACAACA | GGTTGTTT | chr3 | 46370325 | 46370344 | 46370341 | + |
| SEQ ID NO 9897 | CTCTTTAGACAACAGGTTGT | TTCCGTTT | chr3 | 46370331 | 46370350 | 46370347 | + |
| SEQ ID NO 9898 | GATCCCCCTCTACATTTAAA | GTTGGTTT | chr3 | 46370468 | 46370487 | 46370484 | + |
| SEQ ID NO 9899 | TACATTTAAAGTTGGTTTAA | GTTGGCTT | chr3 | 46370478 | 46370497 | 46370494 | + |
| SEQ ID NO 9900 | CCTGTGATCTTGTACAAATC | ATTTGCTT | chr3 | 46370571 | 46370590 | 46370587 | + |
| SEQ ID NO 9901 | GTAATTTCTTTTACTAAAAT | GTGGGCTT | chr3 | 46370607 | 46370626 | 46370623 | + |
| SEQ ID NO 9902 | CTTTATTCTTTATATTTTCT | AACAGATT | chr3 | 46370675 | 46370694 | 46370691 | + |
| SEQ ID NO 9903 | TTCAGACCAGAGATCTATTC | TCTAGCTT | chr3 | 46370769 | 46370788 | 46370785 | + |
| SEQ ID NO 9904 | ACTTAAAAAGAAGAACTGTT | CTCTGATT | chr3 | 46370809 | 46370828 | 46370825 | + |
| SEQ ID NO 9905 | CTTTTCGCCTTCAATACACT | TAATGATT | chr3 | 46370837 | 46370856 | 46370853 | + |
| SEQ ID NO 9906 | TTCCTACTTTTATACTGTCT | ATATGATT | chr3 | 46370896 | 46370915 | 46370912 | + |
| SEQ ID NO 9907 | TACTTTTATACTGTCTATAT | GATTGATT | chr3 | 46370900 | 46370919 | 46370916 | + |
| SEQ ID NO 9908 | GACAGTATAAAAGTAGGAAA | TGCTGTTT | chr3 | 46370895 | 46370914 | 46370898 | - |
| SEQ ID NO 9909 | GAACAGTTCTTCTTTTTAAG | TTGAGCTT | chr3 | 46370810 | 46370829 | 46370813 | - |
| SEQ ID NO 9910 | AGAGAATAGATCTCTGGTCT | GAAGGTTT | chr3 | 46370772 | 46370791 | 46370775 | - |
| SEQ ID NO 9911 | TCTGGTCTGAAGGTTTATTT | ACGGGCTT | chr3 | 46370760 | 46370779 | 46370763 | - |
| SEQ ID NO 9912 | TTTATTTACGGGCTTTTCTC | ACTGGATT | chr3 | 46370747 | 46370766 | 46370750 | - |
| SEQ ID NO 9913 | GGGCTTTTCTCACTGGATTA | TTTTGTTT | chr3 | 46370738 | 46370757 | 46370741 | - |
| SEQ ID NO 9914 | GAAATTACTATCCAAGAAGC | AAATGATT | chr3 | 46370595 | 46370614 | 46370598 | - |
| SEQ ID NO 9915 | AAATGATTTGTACAAGATCA | CAGGGCTT | chr3 | 46370575 | 46370594 | 46370578 | - |
| SEQ ID NO 9916 | AGGCTAAAAGGTTAAGAAAA | TTCTGATT | chr3 | 46370537 | 46370556 | 46370540 | - |
| SEQ ID NO 9917 | CGGAAACAACCTGTTGTCTA | AAGAGTTT | chr3 | 46370336 | 46370355 | 46370339 | - |
| SEQ ID NO 9918 | TGGGCTCACGGGTGAGCTAA | ACAGGTTT | chr3 | 46370302 | 46370321 | 46370305 | - |
| SEQ ID NO 9919 | TTCTGGACCCAGGATCTTAG | TGGGGATT | chr3 | 46370265 | 46370284 | 46370268 | - |
| SEQ ID NO 9920 | CTATGCCAGATACATAGGTG | GCAGGATT | chr3 | 46370178 | 46370197 | 46370181 | - |

Figure 36

| # | Sequence | PAM | Chr | Start | End | Cut site 1 (5' of) | Cut site 2 (5' of) | Str |
|---|---|---|---|---|---|---|---|---|
| SEQ ID NO 9921 | CAGATAGATTATATCTGGAGTG | CTT | chr3 | 46370145 | 46370166 | 46370162 | 46370167 | + |
| SEQ ID NO 9922 | AGATAGATTATATCTGGAGTGA | TTC | chr3 | 46370146 | 46370167 | 46370163 | 46370168 | + |
| SEQ ID NO 9923 | TATCTGGAGTGAAGAATCCTGC | TTA | chr3 | 46370156 | 46370177 | 46370173 | 46370178 | + |
| SEQ ID NO 9924 | GAGTGAAGAATCCTGCCACCTA | CTG | chr3 | 46370162 | 46370183 | 46370179 | 46370184 | + |
| SEQ ID NO 9925 | CCACCTATGTATCTGGCATAGT | CTG | chr3 | 46370177 | 46370198 | 46370194 | 46370199 | + |
| SEQ ID NO 9926 | TGTATCTGGCATAGTGTGAGTC | CTA | chr3 | 46370184 | 46370205 | 46370201 | 46370206 | + |
| SEQ ID NO 9927 | GCATAGTGTGAGTCCTCATAAA | CTG | chr3 | 46370192 | 46370213 | 46370209 | 46370214 | + |
| SEQ ID NO 9928 | ATAAATGCTTACTGGTTTGAAG | CTC | chr3 | 46370209 | 46370230 | 46370226 | 46370231 | + |
| SEQ ID NO 9929 | ACTGGTTTGAAGGGCAACAAAA | CTT | chr3 | 46370219 | 46370240 | 46370236 | 46370241 | + |
| SEQ ID NO 9930 | CTGGTTTGAAGGGCAACAAAAT | TTA | chr3 | 46370220 | 46370241 | 46370237 | 46370242 | + |
| SEQ ID NO 9931 | GTTTGAAGGGCAACAAAATAGT | CTG | chr3 | 46370223 | 46370244 | 46370240 | 46370245 | + |
| SEQ ID NO 9932 | GAAGGGCAACAAAATAGTGAAC | TTT | chr3 | 46370227 | 46370248 | 46370244 | 46370249 | + |
| SEQ ID NO 9933 | AAGGGCAACAAAATAGTGAACA | TTG | chr3 | 46370228 | 46370249 | 46370245 | 46370250 | + |
| SEQ ID NO 9934 | AGATCCTGGGTCCAGAAAAAGA | CTA | chr3 | 46370268 | 46370289 | 46370285 | 46370290 | + |
| SEQ ID NO 9935 | GGTCCAGAAAAAGATGGGAAAC | CTG | chr3 | 46370276 | 46370297 | 46370293 | 46370298 | + |
| SEQ ID NO 9936 | TTTAGCTCACCCGTGAGCCCAT | CTG | chr3 | 46370301 | 46370322 | 46370318 | 46370323 | + |
| SEQ ID NO 9937 | AGCTCACCCGTGAGCCCATAGT | TTT | chr3 | 46370304 | 46370325 | 46370321 | 46370326 | + |
| SEQ ID NO 9938 | GCTCACCCGTGAGCCCATAGTT | TTA | chr3 | 46370305 | 46370326 | 46370322 | 46370327 | + |
| SEQ ID NO 9939 | ACCCGTGAGCCCATAGTTAAAA | CTC | chr3 | 46370309 | 46370330 | 46370326 | 46370331 | + |
| SEQ ID NO 9940 | AAACTCTTTAGACAACAGGTTG | TTA | chr3 | 46370328 | 46370349 | 46370345 | 46370350 | + |
| SEQ ID NO 9941 | TTTAGACAACAGGTTGTTTCCG | CTC | chr3 | 46370334 | 46370355 | 46370351 | 46370356 | + |
| SEQ ID NO 9942 | TAGACAACAGGTTGTTTCCGTT | CTT | chr3 | 46370336 | 46370357 | 46370353 | 46370358 | + |
| SEQ ID NO 9943 | AGACAACAGGTTGTTTCCGTTT | TTT | chr3 | 46370337 | 46370358 | 46370354 | 46370359 | + |
| SEQ ID NO 9944 | GACAACAGGTTGTTTCCGTTTA | TTA | chr3 | 46370338 | 46370359 | 46370355 | 46370360 | + |
| SEQ ID NO 9945 | TTTCCGTTACAGAGAACAATA | TTG | chr3 | 46370350 | 46370371 | 46370367 | 46370372 | + |
| SEQ ID NO 9946 | CCGTTACAGAGAACAATAATA | TTT | chr3 | 46370353 | 46370374 | 46370370 | 46370375 | + |
| SEQ ID NO 9947 | CGTTTACAGAGAACAATAATAT | TTC | chr3 | 46370354 | 46370375 | 46370371 | 46370376 | + |
| SEQ ID NO 9948 | ACAGAGAACAATAATATTGGGT | TTT | chr3 | 46370359 | 46370380 | 46370376 | 46370381 | + |
| SEQ ID NO 9949 | CAGAGAACAATAATATTGGGTG | TTA | chr3 | 46370360 | 46370381 | 46370377 | 46370382 | + |
| SEQ ID NO 9950 | GGTGGTGAGCATCTGTGTGGGG | TTG | chr3 | 46370378 | 46370399 | 46370395 | 46370400 | + |
| SEQ ID NO 9951 | TGTGGGGGTTGGGGTGGGATAG | CTG | chr3 | 46370393 | 46370414 | 46370410 | 46370415 | + |
| SEQ ID NO 9952 | GGGTGGGATAGGGGATACGGGG | TTG | chr3 | 46370404 | 46370425 | 46370421 | 46370426 | + |
| SEQ ID NO 9953 | ATGTGAAGTCCAGGATCCCCCT | TTA | chr3 | 46370455 | 46370476 | 46370472 | 46370477 | + |
| SEQ ID NO 9954 | TACATTTAAAGTTGGTTTAAGT | CTC | chr3 | 46370478 | 46370499 | 46370495 | 46370500 | + |
| SEQ ID NO 9955 | CATTTAAAGTTGGTTTAAGTTG | CTA | chr3 | 46370480 | 46370501 | 46370497 | 46370502 | + |
| SEQ ID NO 9956 | AAAGTTGGTTTAAGTTGGCTTT | TTT | chr3 | 46370485 | 46370506 | 46370502 | 46370507 | + |
| SEQ ID NO 9957 | AAGTTGGTTTAAGTTGGCTTTA | TTA | chr3 | 46370486 | 46370507 | 46370503 | 46370508 | + |
| SEQ ID NO 9958 | GTTTAAGTTGGCTTTAATTAAT | TTG | chr3 | 46370492 | 46370513 | 46370509 | 46370514 | + |
| SEQ ID NO 9959 | AAGTTGGCTTTAATTAATAGCA | TTT | chr3 | 46370496 | 46370517 | 46370513 | 46370518 | + |
| SEQ ID NO 9960 | AGTTGGCTTTAATTAATAGCAA | TTA | chr3 | 46370497 | 46370518 | 46370514 | 46370519 | + |
| SEQ ID NO 9961 | GCTTTAATTAATAGCAACTCTT | TTG | chr3 | 46370502 | 46370523 | 46370519 | 46370524 | + |
| SEQ ID NO 9962 | TAATTAATAGCAACTCTTAAGA | CTT | chr3 | 46370506 | 46370527 | 46370523 | 46370528 | + |
| SEQ ID NO 9963 | AATTAATAGCAACTCTTAAGAT | TTT | chr3 | 46370507 | 46370528 | 46370524 | 46370529 | + |
| SEQ ID NO 9964 | ATTAATAGCAACTCTTAAGATA | TTA | chr3 | 46370508 | 46370529 | 46370525 | 46370530 | + |
| SEQ ID NO 9965 | ATAGCAACTCTTAAGATAATCA | TTA | chr3 | 46370512 | 46370533 | 46370529 | 46370534 | + |
| SEQ ID NO 9966 | TTAAGATAATCAGAATTTTCTT | CTC | chr3 | 46370522 | 46370543 | 46370539 | 46370544 | + |
| SEQ ID NO 9967 | AAGATAATCAGAATTTTCTTAA | CTT | chr3 | 46370524 | 46370545 | 46370541 | 46370546 | + |
| SEQ ID NO 9968 | AGATAATCAGAATTTTCTTAAC | TTA | chr3 | 46370525 | 46370546 | 46370542 | 46370547 | + |
| SEQ ID NO 9969 | TCTTAACCTTTTAGCCTTACTG | TTT | chr3 | 46370540 | 46370561 | 46370557 | 46370562 | + |
| SEQ ID NO 9970 | CTTAACCTTTTAGCCTTACTGT | TTT | chr3 | 46370541 | 46370562 | 46370558 | 46370563 | + |
| SEQ ID NO 9971 | TTAACCTTTTAGCCTTACTGTT | TTC | chr3 | 46370542 | 46370563 | 46370559 | 46370564 | + |
| SEQ ID NO 9972 | AACCTTTTAGCCTTACTGTTGA | CTT | chr3 | 46370544 | 46370565 | 46370561 | 46370566 | + |
| SEQ ID NO 9973 | ACCTTTTAGCCTTACTGTTGAA | TTA | chr3 | 46370545 | 46370566 | 46370562 | 46370567 | + |
| SEQ ID NO 9974 | TTAGCCTTACTGTTGAAAAGCC | CTT | chr3 | 46370550 | 46370571 | 46370567 | 46370572 | + |
| SEQ ID NO 9975 | TAGCCTTACTGTTGAAAAGCCC | TTT | chr3 | 46370551 | 46370572 | 46370568 | 46370573 | + |
| SEQ ID NO 9976 | AGCCTTACTGTTGAAAAGCCCT | TTT | chr3 | 46370552 | 46370573 | 46370569 | 46370574 | + |
| SEQ ID NO 9977 | GCCTTACTGTTGAAAAGCCCTG | TTA | chr3 | 46370553 | 46370574 | 46370570 | 46370575 | + |

Figure 36 (Cont'd)

| SEQ ID NO 9978 | ACTGTTGAAAAGCCCTGTGATC | CTT | chr3 | 46370558 | 46370579 | 46370575 | 46370580 | + |
|---|---|---|---|---|---|---|---|---|
| SEQ ID NO 9979 | CTGTTGAAAAGCCCTGTGATCT | TTA | chr3 | 46370559 | 46370580 | 46370576 | 46370581 | + |
| SEQ ID NO 9980 | TTGAAAAGCCCTGTGATCTTGT | CTG | chr3 | 46370562 | 46370583 | 46370579 | 46370584 | + |
| SEQ ID NO 9981 | AAAAGCCCTGTGATCTTGTACA | TTG | chr3 | 46370565 | 46370586 | 46370582 | 46370587 | + |
| SEQ ID NO 9982 | TGATCTTGTACAAATCATTTGC | CTG | chr3 | 46370575 | 46370596 | 46370592 | 46370597 | + |
| SEQ ID NO 9983 | GTACAAATCATTTGCTTCTTGG | CTT | chr3 | 46370582 | 46370603 | 46370599 | 46370604 | + |
| SEQ ID NO 9984 | TACAAATCATTTGCTTCTTGGA | TTG | chr3 | 46370583 | 46370604 | 46370600 | 46370605 | + |
| SEQ ID NO 9985 | GCTTCTTGGATAGTAATTTCTT | TTT | chr3 | 46370595 | 46370616 | 46370612 | 46370617 | + |
| SEQ ID NO 9986 | CTTCTTGGATAGTAATTTCTTT | TTG | chr3 | 46370596 | 46370617 | 46370613 | 46370618 | + |
| SEQ ID NO 9987 | CTTGGATAGTAATTTCTTTTAC | CTT | chr3 | 46370599 | 46370620 | 46370616 | 46370621 | + |
| SEQ ID NO 9988 | TTGGATAGTAATTTCTTTTACT | TTC | chr3 | 46370600 | 46370621 | 46370617 | 46370622 | + |
| SEQ ID NO 9989 | GGATAGTAATTTCTTTTACTAA | CTT | chr3 | 46370602 | 46370623 | 46370619 | 46370624 | + |
| SEQ ID NO 9990 | GATAGTAATTTCTTTTACTAAA | TTG | chr3 | 46370603 | 46370624 | 46370620 | 46370625 | + |
| SEQ ID NO 9991 | CTTTTACTAAAATGTGGGCTTT | TTT | chr3 | 46370614 | 46370635 | 46370631 | 46370636 | + |
| SEQ ID NO 9992 | TTTTACTAAAATGTGGGCTTTT | TTC | chr3 | 46370615 | 46370636 | 46370632 | 46370637 | + |
| SEQ ID NO 9993 | TTACTAAAATGTGGGCTTTTGA | CTT | chr3 | 46370617 | 46370638 | 46370634 | 46370639 | + |
| SEQ ID NO 9994 | TACTAAAATGTGGGCTTTTGAC | TTT | chr3 | 46370618 | 46370639 | 46370635 | 46370640 | + |
| SEQ ID NO 9995 | ACTAAAATGTGGGCTTTTGACT | TTT | chr3 | 46370619 | 46370640 | 46370636 | 46370641 | + |
| SEQ ID NO 9996 | CTAAAATGTGGGCTTTTGACTA | TTA | chr3 | 46370620 | 46370641 | 46370637 | 46370642 | + |
| SEQ ID NO 9997 | AAATGTGGGCTTTTGACTAGAT | CTA | chr3 | 46370623 | 46370644 | 46370640 | 46370645 | + |
| SEQ ID NO 9998 | TTGACTAGATGAATGTAAATGT | CTT | chr3 | 46370635 | 46370656 | 46370652 | 46370657 | + |
| SEQ ID NO 9999 | TGACTAGATGAATGTAAATGTT | TTT | chr3 | 46370636 | 46370657 | 46370653 | 46370658 | + |
| SEQ ID NO 10000 | GACTAGATGAATGTAAATGTTC | TTT | chr3 | 46370637 | 46370658 | 46370654 | 46370659 | + |
| SEQ ID NO 10001 | ACTAGATGAATGTAAATGTTCT | TTG | chr3 | 46370638 | 46370659 | 46370655 | 46370660 | + |
| SEQ ID NO 10002 | GATGAATGTAAATGTTCTTCTA | CTA | chr3 | 46370642 | 46370663 | 46370659 | 46370664 | + |
| SEQ ID NO 10003 | TTCTAGCTCTGATATCCTTTAT | TTC | chr3 | 46370659 | 46370680 | 46370676 | 46370681 | + |
| SEQ ID NO 10004 | CTAGCTCTGATATCCTTTATTC | CTT | chr3 | 46370661 | 46370682 | 46370678 | 46370683 | + |
| SEQ ID NO 10005 | TAGCTCTGATATCCTTTATTCT | TTC | chr3 | 46370662 | 46370683 | 46370679 | 46370684 | + |
| SEQ ID NO 10006 | GCTCTGATATCCTTTATTCTTT | CTA | chr3 | 46370664 | 46370685 | 46370681 | 46370686 | + |
| SEQ ID NO 10007 | TGATATCCTTTATTCTTTATAT | CTC | chr3 | 46370668 | 46370689 | 46370685 | 46370690 | + |
| SEQ ID NO 10008 | ATATCCTTTATTCTTTATATTT | CTG | chr3 | 46370670 | 46370691 | 46370687 | 46370692 | + |
| SEQ ID NO 10009 | TATTCTTTATATTTTCTAACAG | CTT | chr3 | 46370678 | 46370699 | 46370695 | 46370700 | + |
| SEQ ID NO 10010 | ATTCTTTATATTTTCTAACAGA | TTT | chr3 | 46370679 | 46370700 | 46370696 | 46370701 | + |
| SEQ ID NO 10011 | TTCTTTATATTTTCTAACAGAT | TTA | chr3 | 46370680 | 46370701 | 46370697 | 46370702 | + |
| SEQ ID NO 10012 | TTTATATTTTCTAACAGATTCT | TTC | chr3 | 46370683 | 46370704 | 46370700 | 46370705 | + |
| SEQ ID NO 10013 | TATATTTTCTAACAGATTCTGT | CTT | chr3 | 46370685 | 46370706 | 46370702 | 46370707 | + |
| SEQ ID NO 10014 | ATATTTTCTAACAGATTCTGTG | TTT | chr3 | 46370686 | 46370707 | 46370703 | 46370708 | + |
| SEQ ID NO 10015 | TATTTTCTAACAGATTCTGTGT | TTA | chr3 | 46370687 | 46370708 | 46370704 | 46370709 | + |
| SEQ ID NO 10016 | TCTAACAGATTCTGTGTAGTGG | TTT | chr3 | 46370692 | 46370713 | 46370709 | 46370714 | + |
| SEQ ID NO 10017 | CTAACAGATTCTGTGTAGTGGG | TTT | chr3 | 46370693 | 46370714 | 46370710 | 46370715 | + |
| SEQ ID NO 10018 | TAACAGATTCTGTGTAGTGGGA | TTC | chr3 | 46370694 | 46370715 | 46370711 | 46370716 | + |
| SEQ ID NO 10019 | ACAGATTCTGTGTAGTGGGATG | CTA | chr3 | 46370696 | 46370717 | 46370713 | 46370718 | + |
| SEQ ID NO 10020 | TGTGTAGTGGGATGAGCAGAGA | TTC | chr3 | 46370704 | 46370725 | 46370721 | 46370726 | + |
| SEQ ID NO 10021 | TGTAGTGGGATGAGCAGAGAAC | CTG | chr3 | 46370706 | 46370727 | 46370723 | 46370728 | + |
| SEQ ID NO 10022 | CAGACCAGAGATCTATTCTCTA | CTT | chr3 | 46370771 | 46370792 | 46370788 | 46370793 | + |
| SEQ ID NO 10023 | AGACCAGAGATCTATTCTCTAG | TTC | chr3 | 46370772 | 46370793 | 46370789 | 46370794 | + |
| SEQ ID NO 10024 | TTCTCTAGCTTATTTTAAGCTC | CTA | chr3 | 46370786 | 46370807 | 46370803 | 46370808 | + |
| SEQ ID NO 10025 | TCTAGCTTATTTTAAGCTCAAC | TTC | chr3 | 46370789 | 46370810 | 46370806 | 46370811 | + |
| SEQ ID NO 10026 | TAGCTTATTTTAAGCTCAACTT | CTC | chr3 | 46370791 | 46370812 | 46370808 | 46370813 | + |
| SEQ ID NO 10027 | GCTTATTTTAAGCTCAACTTAA | CTA | chr3 | 46370793 | 46370814 | 46370810 | 46370815 | + |
| SEQ ID NO 10028 | ATTTTAAGCTCAACTTAAAAAG | CTT | chr3 | 46370797 | 46370818 | 46370814 | 46370819 | + |
| SEQ ID NO 10029 | TTTTAAGCTCAACTTAAAAAGA | TTA | chr3 | 46370798 | 46370819 | 46370815 | 46370820 | + |
| SEQ ID NO 10030 | TAAGCTCAACTTAAAAAGAAGA | TTT | chr3 | 46370801 | 46370822 | 46370818 | 46370823 | + |
| SEQ ID NO 10031 | AAGCTCAACTTAAAAAGAAGAA | TTT | chr3 | 46370802 | 46370823 | 46370819 | 46370824 | + |
| SEQ ID NO 10032 | AGCTCAACTTAAAAAGAAGAAC | TTA | chr3 | 46370803 | 46370824 | 46370820 | 46370825 | + |
| SEQ ID NO 10033 | AACTTAAAAAGAAGAACTGTTC | CTC | chr3 | 46370808 | 46370829 | 46370825 | 46370830 | + |
| SEQ ID NO 10034 | AAAAGAAGAACTGTTCTCTGA | CTT | chr3 | 46370813 | 46370834 | 46370830 | 46370835 | + |
| SEQ ID NO 10035 | AAAAGAAGAACTGTTCTCTGAT | TTA | chr3 | 46370814 | 46370835 | 46370831 | 46370836 | + |

Figure 36 (Cont'd)

| | | | | | | | | |
|---|---|---|---|---|---|---|---|---|
| SEQ ID NO 10036 | TTCTCTGATTCTTTTCGCCTTC | CTG | chr3 | 46370827 | 46370848 | 46370844 | 46370849 | + |
| SEQ ID NO 10037 | TCTGATTCTTTTCGCCTTCAAT | TTC | chr3 | 46370830 | 46370851 | 46370847 | 46370852 | + |
| SEQ ID NO 10038 | TGATTCTTTTCGCCTTCAATAC | CTC | chr3 | 46370832 | 46370853 | 46370849 | 46370854 | + |
| SEQ ID NO 10039 | ATTCTTTTCGCCTTCAATACAC | CTG | chr3 | 46370834 | 46370855 | 46370851 | 46370856 | + |
| SEQ ID NO 10040 | TTTTCGCCTTCAATACACTTAA | TTC | chr3 | 46370838 | 46370859 | 46370855 | 46370860 | + |
| SEQ ID NO 10041 | TTCGCCTTCAATACACTTAATG | CTT | chr3 | 46370840 | 46370861 | 46370857 | 46370862 | + |
| SEQ ID NO 10042 | TCGCCTTCAATACACTTAATGA | TTT | chr3 | 46370841 | 46370862 | 46370858 | 46370863 | + |
| SEQ ID NO 10043 | CGCCTTCAATACACTTAATGAT | TTT | chr3 | 46370842 | 46370863 | 46370859 | 46370864 | + |
| SEQ ID NO 10044 | GCCTTCAATACACTTAATGATT | TTC | chr3 | 46370843 | 46370864 | 46370860 | 46370865 | + |
| SEQ ID NO 10045 | CAATACACTTAATGATTTAACT | CTT | chr3 | 46370848 | 46370869 | 46370865 | 46370870 | + |
| SEQ ID NO 10046 | AATACACTTAATGATTTAACTC | TTC | chr3 | 46370849 | 46370870 | 46370866 | 46370871 | + |
| SEQ ID NO 10047 | AATGATTTAACTCCACCCTCCT | CTT | chr3 | 46370858 | 46370879 | 46370875 | 46370880 | + |
| SEQ ID NO 10048 | ATGATTTAACTCCACCCTCCTT | TTA | chr3 | 46370859 | 46370880 | 46370876 | 46370881 | + |
| SEQ ID NO 10049 | AACTCCACCCTCCTTCAAAAGA | TTT | chr3 | 46370866 | 46370887 | 46370883 | 46370888 | + |
| SEQ ID NO 10050 | ACTCCACCCTCCTTCAAAAGAA | TTA | chr3 | 46370867 | 46370888 | 46370884 | 46370889 | + |
| SEQ ID NO 10051 | CACCCTCCTTCAAAAGAAACAG | CTC | chr3 | 46370871 | 46370892 | 46370888 | 46370893 | + |
| SEQ ID NO 10052 | CTTCAAAAGAAACAGCATTTCC | CTC | chr3 | 46370878 | 46370899 | 46370895 | 46370900 | + |
| SEQ ID NO 10053 | CAAAAGAAACAGCATTTCCTAC | CTT | chr3 | 46370881 | 46370902 | 46370898 | 46370903 | + |
| SEQ ID NO 10054 | AAAAGAAACAGCATTTCCTACT | TTC | chr3 | 46370882 | 46370903 | 46370899 | 46370904 | + |
| SEQ ID NO 10055 | CCTACTTTTATACTGTCTATAT | TTT | chr3 | 46370898 | 46370919 | 46370915 | 46370920 | + |
| SEQ ID NO 10056 | CTACTTTTATACTGTCTATATG | TTC | chr3 | 46370899 | 46370920 | 46370916 | 46370921 | + |
| SEQ ID NO 10057 | CTTTTATACTGTCTATATGATT | CTA | chr3 | 46370902 | 46370923 | 46370919 | 46370924 | + |
| SEQ ID NO 10058 | TTATACTGTCTATATGATTGAT | CTT | chr3 | 46370905 | 46370926 | 46370922 | 46370927 | + |
| SEQ ID NO 10059 | TATACTGTCTATATGATTGATT | TTT | chr3 | 46370906 | 46370927 | 46370923 | 46370928 | + |
| SEQ ID NO 10060 | ATACTGTCTATATGATTGATTT | TTT | chr3 | 46370907 | 46370928 | 46370924 | 46370929 | + |
| SEQ ID NO 10061 | TACTGTCTATATGATTGATTTG | TTA | chr3 | 46370908 | 46370929 | 46370925 | 46370930 | + |
| SEQ ID NO 10062 | TCTATATGATTGATTTGCACAG | CTG | chr3 | 46370913 | 46370934 | 46370930 | 46370935 | + |
| SEQ ID NO 10063 | TATGATTGATTTGCACAGCTCA | CTA | chr3 | 46370917 | 46370938 | 46370934 | 46370939 | + |
| SEQ ID NO 10064 | ATTTGCACAGCTCATCTGGCCA | TTG | chr3 | 46370925 | 46370946 | 46370942 | 46370947 | + |
| SEQ ID NO 10065 | GCACAGCTCATCTGGCCAGAAG | TTT | chr3 | 46370929 | 46370950 | 46370946 | 46370951 | + |
| SEQ ID NO 10066 | CACAGCTCATCTGGCCAGAAGA | TTG | chr3 | 46370930 | 46370951 | 46370947 | 46370952 | + |
| SEQ ID NO 10067 | ATCTGGCCAGAAGAGCTGAGAC | CTC | chr3 | 46370938 | 46370959 | 46370955 | 46370960 | + |
| SEQ ID NO 10068 | GCCAGAAGAGCTGAGACATCCG | CTG | chr3 | 46370943 | 46370964 | 46370960 | 46370965 | + |
| SEQ ID NO 10069 | AGACATCCGTTCCCTACAAGA | CTG | chr3 | 46370956 | 46370977 | 46370973 | 46370978 | + |
| SEQ ID NO 10070 | CTTGTAGGGGAACGGATGTCTC | TTT | chr3 | 46370955 | 46370976 | 46370960 | 46370955 | - |
| SEQ ID NO 10071 | TTGTAGGGGAACGGATGTCTCA | TTC | chr3 | 46370954 | 46370975 | 46370959 | 46370954 | - |
| SEQ ID NO 10072 | GTAGGGGAACGGATGTCTCAGC | CTT | chr3 | 46370952 | 46370973 | 46370957 | 46370952 | - |
| SEQ ID NO 10073 | TAGGGGAACGGATGTCTCAGCT | TTG | chr3 | 46370951 | 46370972 | 46370956 | 46370951 | - |
| SEQ ID NO 10074 | AGCTCTTCTGGCCAGATGAGCT | CTC | chr3 | 46370933 | 46370954 | 46370938 | 46370933 | - |
| SEQ ID NO 10075 | TTCTGGCCAGATGAGCTGTGCA | CTC | chr3 | 46370928 | 46370949 | 46370933 | 46370928 | - |
| SEQ ID NO 10076 | CTGGCCAGATGAGCTGTGCAAA | CTT | chr3 | 46370926 | 46370947 | 46370931 | 46370926 | - |
| SEQ ID NO 10077 | TGGCCAGATGAGCTGTGCAAAT | TTC | chr3 | 46370925 | 46370946 | 46370930 | 46370925 | - |
| SEQ ID NO 10078 | GCCAGATGAGCTGTGCAAATCA | CTG | chr3 | 46370923 | 46370944 | 46370928 | 46370923 | - |
| SEQ ID NO 10079 | TGCAAATCAATCATATAGACAG | CTG | chr3 | 46370910 | 46370931 | 46370915 | 46370910 | - |
| SEQ ID NO 10080 | TTTCTTTTGAAGGAGGGTGGAG | CTG | chr3 | 46370868 | 46370889 | 46370873 | 46370868 | - |
| SEQ ID NO 10081 | CTTTTGAAGGAGGGTGGAGTTA | TTT | chr3 | 46370865 | 46370886 | 46370870 | 46370865 | - |
| SEQ ID NO 10082 | TTTTGAAGGAGGGTGGAGTTAA | TTC | chr3 | 46370864 | 46370885 | 46370869 | 46370864 | - |
| SEQ ID NO 10083 | TTGAAGGAGGGTGGAGTTAAAT | CTT | chr3 | 46370862 | 46370883 | 46370867 | 46370862 | - |
| SEQ ID NO 10084 | TGAAGGAGGGTGGAGTTAAATC | TTT | chr3 | 46370861 | 46370882 | 46370866 | 46370861 | - |
| SEQ ID NO 10085 | GAAGGAGGGTGGAGTTAAATCA | TTT | chr3 | 46370860 | 46370881 | 46370865 | 46370860 | - |
| SEQ ID NO 10086 | AAGGAGGGTGGAGTTAAATCAT | TTG | chr3 | 46370859 | 46370880 | 46370864 | 46370859 | - |
| SEQ ID NO 10087 | AATCATTAAGTGTATTGAAGGC | TTA | chr3 | 46370843 | 46370864 | 46370848 | 46370843 | - |
| SEQ ID NO 10088 | AGTGTATTGAAGGCGAAAAGAA | TTA | chr3 | 46370835 | 46370856 | 46370840 | 46370835 | - |
| SEQ ID NO 10089 | AAGGCGAAAAGAATCAGAGAAC | TTG | chr3 | 46370826 | 46370847 | 46370831 | 46370826 | - |
| SEQ ID NO 10090 | TTCTTTTTAAGTTGAGCTTAAA | TTC | chr3 | 46370799 | 46370820 | 46370804 | 46370799 | - |
| SEQ ID NO 10091 | CTTTTTAAGTTGAGCTTAAAAT | CTT | chr3 | 46370797 | 46370818 | 46370802 | 46370797 | - |
| SEQ ID NO 10092 | TTTTTAAGTTGAGCTTAAAATA | TTC | chr3 | 46370796 | 46370817 | 46370801 | 46370796 | - |
| SEQ ID NO 10093 | TTTAAGTTGAGCTTAAAATAAG | CTT | chr3 | 46370794 | 46370815 | 46370799 | 46370794 | - |

Figure 36 (Cont'd)

| SEQ ID NO 10094 | TTAAGTTGAGCTTAAAATAAGC | TTT | chr3 | 46370793 | 46370814 | 46370798 | 46370793 | - |
|---|---|---|---|---|---|---|---|---|
| SEQ ID NO 10095 | TAAGTTGAGCTTAAAATAAGCT | TTT | chr3 | 46370792 | 46370813 | 46370797 | 46370792 | - |
| SEQ ID NO 10096 | AAGTTGAGCTTAAAATAAGCTA | TTT | chr3 | 46370791 | 46370812 | 46370796 | 46370791 | - |
| SEQ ID NO 10097 | AGTTGAGCTTAAAATAAGCTAG | TTA | chr3 | 46370790 | 46370811 | 46370795 | 46370790 | - |
| SEQ ID NO 10098 | AGCTTAAAATAAGCTAGAGAAT | TTG | chr3 | 46370785 | 46370806 | 46370790 | 46370785 | - |
| SEQ ID NO 10099 | AAAATAAGCTAGAGAATAGATC | CTT | chr3 | 46370780 | 46370801 | 46370785 | 46370780 | - |
| SEQ ID NO 10100 | AAATAAGCTAGAGAATAGATCT | TTA | chr3 | 46370779 | 46370800 | 46370784 | 46370779 | - |
| SEQ ID NO 10101 | GAGAATAGATCTCTGGTCTGAA | CTA | chr3 | 46370769 | 46370790 | 46370774 | 46370769 | - |
| SEQ ID NO 10102 | TGGTCTGAAGGTTTATTTACGG | CTC | chr3 | 46370756 | 46370777 | 46370761 | 46370756 | - |
| SEQ ID NO 10103 | GTCTGAAGGTTTATTTACGGGC | CTG | chr3 | 46370754 | 46370775 | 46370759 | 46370754 | - |
| SEQ ID NO 10104 | AAGGTTTATTTACGGGCTTTTC | CTG | chr3 | 46370749 | 46370770 | 46370754 | 46370749 | - |
| SEQ ID NO 10105 | ATTTACGGGCTTTTCTCACTGG | TTT | chr3 | 46370742 | 46370763 | 46370747 | 46370742 | - |
| SEQ ID NO 10106 | TTTACGGGCTTTTCTCACTGGA | TTA | chr3 | 46370741 | 46370762 | 46370746 | 46370741 | - |
| SEQ ID NO 10107 | ACGGGCTTTTCTCACTGGATTA | TTT | chr3 | 46370738 | 46370759 | 46370743 | 46370738 | - |
| SEQ ID NO 10108 | CGGGCTTTTCTCACTGGATTAT | TTA | chr3 | 46370737 | 46370758 | 46370742 | 46370737 | - |
| SEQ ID NO 10109 | TTCTCACTGGATTATTTTGTTT | CTT | chr3 | 46370730 | 46370751 | 46370735 | 46370730 | - |
| SEQ ID NO 10110 | TCTCACTGGATTATTTTGTTTT | TTT | chr3 | 46370729 | 46370750 | 46370734 | 46370729 | - |
| SEQ ID NO 10111 | CTCACTGGATTATTTTGTTTTT | TTT | chr3 | 46370728 | 46370749 | 46370733 | 46370728 | - |
| SEQ ID NO 10112 | TCACTGGATTATTTTGTTTTTG | TTC | chr3 | 46370727 | 46370748 | 46370732 | 46370727 | - |
| SEQ ID NO 10113 | ACTGGATTATTTTGTTTTTGTT | CTC | chr3 | 46370725 | 46370746 | 46370730 | 46370725 | - |
| SEQ ID NO 10114 | GATTATTTTGTTTTTGTTCTCT | CTG | chr3 | 46370721 | 46370742 | 46370726 | 46370721 | - |
| SEQ ID NO 10115 | TTTTGTTTTTGTTCTCTGCTCA | TTA | chr3 | 46370716 | 46370737 | 46370721 | 46370716 | - |
| SEQ ID NO 10116 | TGTTTTTGTTCTCTGCTCATCC | TTT | chr3 | 46370713 | 46370734 | 46370718 | 46370713 | - |
| SEQ ID NO 10117 | GTTTTTGTTCTCTGCTCATCCC | TTT | chr3 | 46370712 | 46370733 | 46370717 | 46370712 | - |
| SEQ ID NO 10118 | TTTTTGTTCTCTGCTCATCCCA | TTG | chr3 | 46370711 | 46370732 | 46370716 | 46370711 | - |
| SEQ ID NO 10119 | TTGTTCTCTGCTCATCCCACTA | TTT | chr3 | 46370708 | 46370729 | 46370713 | 46370708 | - |
| SEQ ID NO 10120 | TGTTCTCTGCTCATCCCACTAC | TTT | chr3 | 46370707 | 46370728 | 46370712 | 46370707 | - |
| SEQ ID NO 10121 | GTTCTCTGCTCATCCCACTACA | TTT | chr3 | 46370706 | 46370727 | 46370711 | 46370706 | - |
| SEQ ID NO 10122 | TTCTCTGCTCATCCCACTACAC | TTG | chr3 | 46370705 | 46370726 | 46370710 | 46370705 | - |
| SEQ ID NO 10123 | TCTGCTCATCCCACTACACAGA | TTC | chr3 | 46370702 | 46370723 | 46370707 | 46370702 | - |
| SEQ ID NO 10124 | TGCTCATCCCACTACACAGAAT | CTC | chr3 | 46370700 | 46370721 | 46370705 | 46370700 | - |
| SEQ ID NO 10125 | CTCATCCCACTACACAGAATCT | CTG | chr3 | 46370698 | 46370719 | 46370703 | 46370698 | - |
| SEQ ID NO 10126 | ATCCCACTACACAGAATCTGTT | CTC | chr3 | 46370695 | 46370716 | 46370700 | 46370695 | - |
| SEQ ID NO 10127 | CACAGAATCTGTTAGAAAATAT | CTA | chr3 | 46370686 | 46370707 | 46370691 | 46370686 | - |
| SEQ ID NO 10128 | TTAGAAAATATAAAGAATAAAG | CTG | chr3 | 46370675 | 46370696 | 46370680 | 46370675 | - |
| SEQ ID NO 10129 | GAAAATATAAAGAATAAAGGAT | TTA | chr3 | 46370672 | 46370693 | 46370677 | 46370672 | - |
| SEQ ID NO 10130 | GAAGAACATTTACATTCATCTA | CTA | chr3 | 46370640 | 46370661 | 46370645 | 46370640 | - |
| SEQ ID NO 10131 | ACATTCATCTAGTCAAAAGCCC | TTT | chr3 | 46370629 | 46370650 | 46370634 | 46370629 | - |
| SEQ ID NO 10132 | CATTCATCTAGTCAAAAGCCCA | TTA | chr3 | 46370628 | 46370649 | 46370633 | 46370628 | - |
| SEQ ID NO 10133 | ATCTAGTCAAAAGCCCACATTT | TTC | chr3 | 46370623 | 46370644 | 46370628 | 46370623 | - |
| SEQ ID NO 10134 | GTCAAAAGCCCACATTTTAGTA | CTA | chr3 | 46370618 | 46370639 | 46370623 | 46370618 | - |
| SEQ ID NO 10135 | TAGTAAAAGAAATTACTATCCA | TTT | chr3 | 46370601 | 46370622 | 46370606 | 46370601 | - |
| SEQ ID NO 10136 | AGTAAAAGAAATTACTATCCAA | TTT | chr3 | 46370600 | 46370621 | 46370605 | 46370600 | - |
| SEQ ID NO 10137 | GTAAAAGAAATTACTATCCAAG | TTA | chr3 | 46370599 | 46370620 | 46370604 | 46370599 | - |
| SEQ ID NO 10138 | CTATCCAAGAAGCAAATGATTT | TTA | chr3 | 46370586 | 46370607 | 46370591 | 46370586 | - |
| SEQ ID NO 10139 | TCCAAGAAGCAAATGATTTGTA | CTA | chr3 | 46370583 | 46370604 | 46370588 | 46370583 | - |
| SEQ ID NO 10140 | GTACAAGATCACAGGGCTTTTC | TTT | chr3 | 46370564 | 46370585 | 46370569 | 46370564 | - |
| SEQ ID NO 10141 | TACAAGATCACAGGGCTTTTCA | TTG | chr3 | 46370563 | 46370584 | 46370568 | 46370563 | - |
| SEQ ID NO 10142 | TTCAACAGTAAGGCTAAAAGGT | CTT | chr3 | 46370545 | 46370566 | 46370550 | 46370545 | - |
| SEQ ID NO 10143 | TCAACAGTAAGGCTAAAAGGTT | TTT | chr3 | 46370544 | 46370565 | 46370549 | 46370544 | - |
| SEQ ID NO 10144 | CAACAGTAAGGCTAAAAGGTTA | TTT | chr3 | 46370543 | 46370564 | 46370548 | 46370543 | - |
| SEQ ID NO 10145 | AACAGTAAGGCTAAAAGGTTAA | TTC | chr3 | 46370542 | 46370563 | 46370547 | 46370542 | - |
| SEQ ID NO 10146 | AAAGGTTAAGAAAATTCTGATT | CTA | chr3 | 46370529 | 46370550 | 46370534 | 46370529 | - |
| SEQ ID NO 10147 | AGAAAATTCTGATTATCTTAAG | TTA | chr3 | 46370521 | 46370542 | 46370526 | 46370521 | - |
| SEQ ID NO 10148 | TGATTATCTTAAGAGTTGCTAT | TTC | chr3 | 46370512 | 46370533 | 46370517 | 46370512 | - |
| SEQ ID NO 10149 | ATTATCTTAAGAGTTGCTATTA | CTG | chr3 | 46370510 | 46370531 | 46370515 | 46370510 | - |
| SEQ ID NO 10150 | TCTTAAGAGTTGCTATTAATTA | TTA | chr3 | 46370506 | 46370527 | 46370511 | 46370506 | - |
| SEQ ID NO 10151 | AAGAGTTGCTATTAATTAAAGC | CTT | chr3 | 46370502 | 46370523 | 46370507 | 46370502 | - |

Figure 36 (Cont'd)

| SEQ ID NO 10152 | AGAGTTGCTATTAATTAAAGCC | TTA | chr3 | 46370501 | 46370522 | 46370506 | 46370501 | - |
|---|---|---|---|---|---|---|---|---|
| SEQ ID NO 10153 | CTATTAATTAAAGCCAACTTAA | TTG | chr3 | 46370494 | 46370515 | 46370499 | 46370494 | - |
| SEQ ID NO 10154 | TTAATTAAAGCCAACTTAAACC | CTA | chr3 | 46370491 | 46370512 | 46370496 | 46370491 | - |
| SEQ ID NO 10155 | ATTAAAGCCAACTTAAACCAAC | TTA | chr3 | 46370488 | 46370509 | 46370493 | 46370488 | - |
| SEQ ID NO 10156 | AAGCCAACTTAAACCAACTTTA | TTA | chr3 | 46370484 | 46370505 | 46370489 | 46370484 | - |
| SEQ ID NO 10157 | AAACCAACTTTAAATGTAGAGG | CTT | chr3 | 46370474 | 46370495 | 46370479 | 46370474 | - |
| SEQ ID NO 10158 | AACCAACTTTAAATGTAGAGGG | TTA | chr3 | 46370473 | 46370494 | 46370478 | 46370473 | - |
| SEQ ID NO 10159 | TAAATGTAGAGGGGATCCTGG | CTT | chr3 | 46370464 | 46370485 | 46370469 | 46370464 | - |
| SEQ ID NO 10160 | AAATGTAGAGGGGATCCTGGA | TTT | chr3 | 46370463 | 46370484 | 46370468 | 46370463 | - |
| SEQ ID NO 10161 | AATGTAGAGGGGATCCTGGAC | TTA | chr3 | 46370462 | 46370483 | 46370467 | 46370462 | - |
| SEQ ID NO 10162 | GACTTCACATTAACCCTGTGTC | CTG | chr3 | 46370443 | 46370464 | 46370448 | 46370443 | - |
| SEQ ID NO 10163 | CACATTAACCCTGTGTCCCCTT | CTT | chr3 | 46370438 | 46370459 | 46370443 | 46370438 | - |
| SEQ ID NO 10164 | ACATTAACCCTGTGTCCCCTTT | TTC | chr3 | 46370437 | 46370458 | 46370442 | 46370437 | - |
| SEQ ID NO 10165 | ACCCTGTGTCCCCTTTTTCTCC | TTA | chr3 | 46370431 | 46370452 | 46370436 | 46370431 | - |
| SEQ ID NO 10166 | TGTCCCCTTTTTCTCCACTCTC | CTG | chr3 | 46370425 | 46370446 | 46370430 | 46370425 | - |
| SEQ ID NO 10167 | TTTCTCCACTCTCCCCGTATCC | CTT | chr3 | 46370416 | 46370437 | 46370421 | 46370416 | - |
| SEQ ID NO 10168 | TTCTCCACTCTCCCCGTATCCC | TTT | chr3 | 46370415 | 46370436 | 46370420 | 46370415 | - |
| SEQ ID NO 10169 | TCTCCACTCTCCCCGTATCCCC | TTT | chr3 | 46370414 | 46370435 | 46370419 | 46370414 | - |
| SEQ ID NO 10170 | CTCCACTCTCCCCGTATCCCCT | TTT | chr3 | 46370413 | 46370434 | 46370418 | 46370413 | - |
| SEQ ID NO 10171 | TCCACTCTCCCCGTATCCCCTA | TTC | chr3 | 46370412 | 46370433 | 46370417 | 46370412 | - |
| SEQ ID NO 10172 | CACTCTCCCCGTATCCCCTATC | CTC | chr3 | 46370410 | 46370431 | 46370415 | 46370410 | - |
| SEQ ID NO 10173 | TCCCCGTATCCCCTATCCCACC | CTC | chr3 | 46370405 | 46370426 | 46370410 | 46370405 | - |
| SEQ ID NO 10174 | CCCGTATCCCCTATCCCACCCC | CTC | chr3 | 46370403 | 46370424 | 46370408 | 46370403 | - |
| SEQ ID NO 10175 | TCCCACCCCAACCCCACACAG | CTA | chr3 | 46370390 | 46370411 | 46370395 | 46370390 | - |
| SEQ ID NO 10176 | ACCACCCAATATTATTGTTCTC | CTC | chr3 | 46370362 | 46370383 | 46370367 | 46370362 | - |
| SEQ ID NO 10177 | TTGTTCTCTGTAAACGGAAACA | TTA | chr3 | 46370348 | 46370369 | 46370353 | 46370348 | - |
| SEQ ID NO 10178 | TTCTCTGTAAACGGAAACAACC | TTG | chr3 | 46370345 | 46370366 | 46370350 | 46370345 | - |
| SEQ ID NO 10179 | TCTGTAAACGGAAACAACCTGT | TTC | chr3 | 46370342 | 46370363 | 46370347 | 46370342 | - |
| SEQ ID NO 10180 | TGTAAACGGAAACAACCTGTTG | CTC | chr3 | 46370340 | 46370361 | 46370345 | 46370340 | - |
| SEQ ID NO 10181 | TAAACGGAAACAACCTGTTGTC | CTG | chr3 | 46370338 | 46370359 | 46370343 | 46370338 | - |
| SEQ ID NO 10182 | TTGTCTAAAGAGTTTTAACTAT | CTG | chr3 | 46370321 | 46370342 | 46370326 | 46370321 | - |
| SEQ ID NO 10183 | TCTAAAGAGTTTTAACTATGGG | TTG | chr3 | 46370318 | 46370339 | 46370323 | 46370318 | - |
| SEQ ID NO 10184 | AAGAGTTTTAACTATGGGCTCA | CTA | chr3 | 46370314 | 46370335 | 46370319 | 46370314 | - |
| SEQ ID NO 10185 | TAACTATGGGCTCACGGGTGAG | TTT | chr3 | 46370306 | 46370327 | 46370311 | 46370306 | - |
| SEQ ID NO 10186 | AACTATGGGCTCACGGGTGAGC | TTT | chr3 | 46370305 | 46370326 | 46370310 | 46370305 | - |
| SEQ ID NO 10187 | ACTATGGGCTCACGGGTGAGCT | TTA | chr3 | 46370304 | 46370325 | 46370309 | 46370304 | - |
| SEQ ID NO 10188 | TGGGCTCACGGGTGAGCTAAAC | CTA | chr3 | 46370300 | 46370321 | 46370305 | 46370300 | - |
| SEQ ID NO 10189 | ACGGGTGAGCTAAACAGGTTTC | CTC | chr3 | 46370293 | 46370314 | 46370298 | 46370293 | - |
| SEQ ID NO 10190 | AACAGGTTTCCCATCTTTTTCT | CTA | chr3 | 46370281 | 46370302 | 46370286 | 46370281 | - |
| SEQ ID NO 10191 | CCCATCTTTTTCTGGACCCAGG | TTT | chr3 | 46370272 | 46370293 | 46370277 | 46370272 | - |
| SEQ ID NO 10192 | CCATCTTTTTCTGGACCCAGGA | TTC | chr3 | 46370271 | 46370292 | 46370276 | 46370271 | - |
| SEQ ID NO 10193 | TTTCTGGACCCAGGATCTTAGT | CTT | chr3 | 46370264 | 46370285 | 46370269 | 46370264 | - |
| SEQ ID NO 10194 | TTCTGGACCCAGGATCTTAGTG | TTT | chr3 | 46370263 | 46370284 | 46370268 | 46370263 | - |
| SEQ ID NO 10195 | TCTGGACCCAGGATCTTAGTGG | TTT | chr3 | 46370262 | 46370283 | 46370267 | 46370262 | - |
| SEQ ID NO 10196 | CTGGACCCAGGATCTTAGTGGG | TTT | chr3 | 46370261 | 46370282 | 46370266 | 46370261 | - |
| SEQ ID NO 10197 | TGGACCCAGGATCTTAGTGGGG | TTC | chr3 | 46370260 | 46370281 | 46370265 | 46370260 | - |
| SEQ ID NO 10198 | GACCCAGGATCTTAGTGGGGAT | CTG | chr3 | 46370258 | 46370279 | 46370263 | 46370258 | - |
| SEQ ID NO 10199 | AGTGGGGATTTTCACTCTGTTC | CTT | chr3 | 46370245 | 46370266 | 46370250 | 46370245 | - |
| SEQ ID NO 10200 | GTGGGGATTTTCACTCTGTTCA | TTA | chr3 | 46370244 | 46370265 | 46370249 | 46370244 | - |
| SEQ ID NO 10201 | TCACTCTGTTCACTATTTTGTT | TTT | chr3 | 46370234 | 46370255 | 46370239 | 46370234 | - |
| SEQ ID NO 10202 | CACTCTGTTCACTATTTTGTTG | TTT | chr3 | 46370233 | 46370254 | 46370238 | 46370233 | - |
| SEQ ID NO 10203 | ACTCTGTTCACTATTTTGTTGC | TTC | chr3 | 46370232 | 46370253 | 46370237 | 46370232 | - |
| SEQ ID NO 10204 | TGTTCACTATTTTGTTGCCCTT | CTC | chr3 | 46370228 | 46370249 | 46370233 | 46370228 | - |
| SEQ ID NO 10205 | TTCACTATTTTGTTGCCCTTCA | CTG | chr3 | 46370226 | 46370247 | 46370231 | 46370226 | - |
| SEQ ID NO 10206 | ACTATTTTGTTGCCCTTCAAAC | TTC | chr3 | 46370223 | 46370244 | 46370228 | 46370223 | - |
| SEQ ID NO 10207 | TTTTGTTGCCCTTCAAACCAGT | CTA | chr3 | 46370219 | 46370240 | 46370224 | 46370219 | - |
| SEQ ID NO 10208 | TGTTGCCCTTCAAACCAGTAAG | TTT | chr3 | 46370216 | 46370237 | 46370221 | 46370216 | - |
| SEQ ID NO 10209 | GTTGCCCTTCAAACCAGTAAGC | TTT | chr3 | 46370215 | 46370236 | 46370220 | 46370215 | - |

Figure 36 (Cont'd)

| | | | | | | | | |
|---|---|---|---|---|---|---|---|---|
| SEQ ID NO 10210 | TTGCCCTTCAAACCAGTAAGCA | TTG | chr3 | 46370214 | 46370235 | 46370219 | 46370214 | - |
| SEQ ID NO 10211 | CCCTTCAAACCAGTAAGCATTT | TTG | chr3 | 46370211 | 46370232 | 46370216 | 46370211 | - |
| SEQ ID NO 10212 | CAAACCAGTAAGCATTTATGAG | CTT | chr3 | 46370206 | 46370227 | 46370211 | 46370206 | - |
| SEQ ID NO 10213 | AAACCAGTAAGCATTTATGAGG | TTC | chr3 | 46370205 | 46370226 | 46370210 | 46370205 | - |
| SEQ ID NO 10214 | ATGAGGACTCACACTATGCCAG | TTT | chr3 | 46370189 | 46370210 | 46370194 | 46370189 | - |
| SEQ ID NO 10215 | TGAGGACTCACACTATGCCAGA | TTA | chr3 | 46370188 | 46370209 | 46370193 | 46370188 | - |
| SEQ ID NO 10216 | ACACTATGCCAGATACATAGGT | CTC | chr3 | 46370179 | 46370200 | 46370184 | 46370179 | - |
| SEQ ID NO 10217 | TGCCAGATACATAGGTGGCAGG | CTA | chr3 | 46370173 | 46370194 | 46370178 | 46370173 | - |
| SEQ ID NO 10218 | TTCACTCCAGATATAATCTATC | TTC | chr3 | 46370147 | 46370168 | 46370152 | 46370147 | - |
| SEQ ID NO 10219 | CACTCCAGATATAATCTATCTG | CTT | chr3 | 46370145 | 46370166 | 46370150 | 46370145 | - |
| SEQ ID NO 10220 | ACTCCAGATATAATCTATCTGA | TTC | chr3 | 46370144 | 46370165 | 46370149 | 46370144 | - |

Figure 37

| # | Sequence | PAM | Chr | Start | End | Cuts 5' of | Str |
|---|---|---|---|---|---|---|---|
| SEQ ID NO 10221 | ACTTTCACAATCTGCTAGCA | AAG | chrX | 139530739 | 139530758 | 139530755 | + |
| SEQ ID NO 10222 | CTTTCACAATCTGCTAGCAA | AGG | chrX | 139530740 | 139530759 | 139530756 | + |
| SEQ ID NO 10223 | ATCTGCTAGCAAAGGTTATG | CAG | chrX | 139530748 | 139530767 | 139530764 | + |
| SEQ ID NO 10224 | GCAGCGCGTGAACATGATCA | TGG | chrX | 139530767 | 139530786 | 139530783 | + |
| SEQ ID NO 10225 | GCGCGTGAACATGATCATGG | CAG | chrX | 139530770 | 139530789 | 139530786 | + |
| SEQ ID NO 10226 | CATGATCATGGCAGAATCAC | CAG | chrX | 139530779 | 139530798 | 139530795 | + |
| SEQ ID NO 10227 | ATGATCATGGCAGAATCACC | AGG | chrX | 139530780 | 139530799 | 139530796 | + |
| SEQ ID NO 10228 | CCTCATCACCATCTGCCTTT | TAG | chrX | 139530803 | 139530822 | 139530819 | + |
| SEQ ID NO 10229 | CTCATCACCATCTGCCTTTT | AGG | chrX | 139530804 | 139530823 | 139530820 | + |
| SEQ ID NO 10230 | TGCCTTTTAGGATATCTACT | CAG | chrX | 139530816 | 139530835 | 139530832 | + |
| SEQ ID NO 10231 | TCTACTCAGTGCTGAATGTA | CAG | chrX | 139530830 | 139530849 | 139530846 | + |
| SEQ ID NO 10232 | CTACTCAGTGCTGAATGTAC | AGG | chrX | 139530831 | 139530850 | 139530847 | + |
| SEQ ID NO 10233 | TTCCTTTTTTAAAATACATT | GAG | chrX | 139530859 | 139530878 | 139530875 | + |
| SEQ ID NO 10234 | CATTGAGTATGCTTGCCTTT | TAG | chrX | 139530875 | 139530894 | 139530891 | + |
| SEQ ID NO 10235 | GTATGCTTGCCTTTTAGATA | TAG | chrX | 139530881 | 139530900 | 139530897 | + |
| SEQ ID NO 10236 | ATTTTGATTACATGATTTGA | CAG | chrX | 139530932 | 139530951 | 139530948 | + |
| SEQ ID NO 10237 | ATGATTTGACAGCAATATTG | AAG | chrX | 139530943 | 139530962 | 139530959 | + |
| SEQ ID NO 10238 | GATTTGACAGCAATATTGAA | GAG | chrX | 139530945 | 139530964 | 139530961 | + |
| SEQ ID NO 10239 | AGCAATATTGAAGAGTCTAA | CAG | chrX | 139530953 | 139530972 | 139530969 | + |
| SEQ ID NO 10240 | ATATTGAAGAGTCTAACAGC | CAG | chrX | 139530957 | 139530976 | 139530973 | + |
| SEQ ID NO 10241 | AGAGTCTAACAGCCAGCACG | CAG | chrX | 139530964 | 139530983 | 139530980 | + |
| SEQ ID NO 10242 | GAGTCTAACAGCCAGCACGC | AGG | chrX | 139530965 | 139530984 | 139530981 | + |
| SEQ ID NO 10243 | CTAACAGCCAGCACGCAGGT | TGG | chrX | 139530969 | 139530988 | 139530985 | + |
| SEQ ID NO 10244 | CAGCCAGCACGCAGGTTGGT | AAG | chrX | 139530973 | 139530992 | 139530989 | + |
| SEQ ID NO 10245 | GCACGCAGGTTGGTAAGTAC | TGG | chrX | 139530979 | 139530998 | 139530995 | + |
| SEQ ID NO 10246 | GGTAAGTACTGGTTCTTTGT | TAG | chrX | 139530990 | 139531009 | 139531006 | + |
| SEQ ID NO 10247 | AGTACTGGTTCTTTGTTAGC | TAG | chrX | 139530994 | 139531013 | 139531010 | + |
| SEQ ID NO 10248 | GTACTGGTTCTTTGTTAGCT | AGG | chrX | 139530995 | 139531014 | 139531011 | + |
| SEQ ID NO 10249 | TCTTCATTTTTAAAACTAAA | TAG | chrX | 139531027 | 139531046 | 139531043 | + |
| SEQ ID NO 10250 | TATGTTTAATAAACACTGTT | CAG | chrX | 139531073 | 139531092 | 139531089 | + |
| SEQ ID NO 10251 | ACACTGTTCAGTTCATGATT | TGG | chrX | 139531085 | 139531104 | 139531101 | + |
| SEQ ID NO 10252 | TTTGGTCATGTAATTCCTGT | TAG | chrX | 139531103 | 139531122 | 139531119 | + |
| SEQ ID NO 10253 | TTAGAAAACATTCATCTCCT | TGG | chrX | 139531122 | 139531141 | 139531138 | + |
| SEQ ID NO 10254 | CCTTGGTTTAAAAAAATTAA | AAG | chrX | 139531139 | 139531158 | 139531155 | + |
| SEQ ID NO 10255 | TGGTTTAAAAAAATTAAAAG | TGG | chrX | 139531142 | 139531161 | 139531158 | + |
| SEQ ID NO 10256 | GGTTTAAAAAAATTAAAAGT | GGG | chrX | 139531143 | 139531162 | 139531159 | + |
| SEQ ID NO 10257 | AAATTAAAAGTGGGAAAACA | AAG | chrX | 139531152 | 139531171 | 139531168 | + |
| SEQ ID NO 10258 | AAAGTGGGAAAACAAAGAAA | TAG | chrX | 139531158 | 139531177 | 139531174 | + |
| SEQ ID NO 10259 | GTGGGAAAACAAAGAAATAG | CAG | chrX | 139531161 | 139531180 | 139531177 | + |
| SEQ ID NO 10260 | AACAAAGAAATAGCAGAATA | TAG | chrX | 139531168 | 139531187 | 139531184 | + |
| SEQ ID NO 10261 | ATAACCACATTATTTTGTT | TGG | chrX | 139531200 | 139531219 | 139531216 | + |
| SEQ ID NO 10262 | TTACCACTTTGAAATCAAAA | TGG | chrX | 139531225 | 139531244 | 139531241 | + |
| SEQ ID NO 10263 | TACCACTTTGAAATCAAAAT | GGG | chrX | 139531226 | 139531245 | 139531242 | + |
| SEQ ID NO 10264 | GAAATCAAATGGGAAACAA | AAG | chrX | 139531235 | 139531254 | 139531251 | + |
| SEQ ID NO 10265 | GGAAACAAAGCACAAACAA | TGG | chrX | 139531247 | 139531266 | 139531263 | + |
| SEQ ID NO 10266 | AATGGCCTTATTTACACAAA | AAG | chrX | 139531265 | 139531284 | 139531281 | + |
| SEQ ID NO 10267 | TACACAAAAAGTCTGATTTT | AAG | chrX | 139531277 | 139531296 | 139531293 | + |
| SEQ ID NO 10268 | TTTAAGATATATGACATTTC | AAG | chrX | 139531294 | 139531313 | 139531310 | + |

Figure 37 (Cont'd)

| SEQ ID NO 10269 | TTAAGATATATGACATTTCA | AGG | chrX | 139531295 | 139531314 | 139531311 | + |
| --- | --- | --- | --- | --- | --- | --- | --- |
| SEQ ID NO 10270 | TATATGACATTTCAAGGTTT | CAG | chrX | 139531301 | 139531320 | 139531317 | + |
| SEQ ID NO 10271 | ATGACATTTCAAGGTTTCAG | AAG | chrX | 139531304 | 139531323 | 139531320 | + |
| SEQ ID NO 10272 | AGGTTTCAGAAGTATGTAAT | GAG | chrX | 139531315 | 139531334 | 139531331 | + |
| SEQ ID NO 10273 | GGTTTCAGAAGTATGTAATG | AGG | chrX | 139531316 | 139531335 | 139531332 | + |
| SEQ ID NO 10274 | AATTATATATCTTCAATTTA | AAG | chrX | 139531357 | 139531376 | 139531373 | + |
| SEQ ID NO 10275 | ATATCTTCAATTTAAAGTTT | TAG | chrX | 139531363 | 139531382 | 139531379 | + |
| SEQ ID NO 10276 | AAAGTTTTAGTTAAAACATA | AAG | chrX | 139531376 | 139531395 | 139531392 | + |
| SEQ ID NO 10277 | CATAAAGATTAACCTTTCAT | TAG | chrX | 139531392 | 139531411 | 139531408 | + |
| SEQ ID NO 10278 | AAGATTAACCTTTCATTAGC | AAG | chrX | 139531396 | 139531415 | 139531412 | + |
| SEQ ID NO 10279 | ACCTTTCATTAGCAAGCTGT | TAG | chrX | 139531403 | 139531422 | 139531419 | + |
| SEQ ID NO 10280 | CAAGCTGTTAGTTATCACCA | AAG | chrX | 139531415 | 139531434 | 139531431 | + |
| SEQ ID NO 10281 | GTTATCACCAAAGCTTTTCA | TGG | chrX | 139531425 | 139531444 | 139531441 | + |
| SEQ ID NO 10282 | CACCAAAGCTTTTCATGGAT | TAG | chrX | 139531430 | 139531449 | 139531446 | + |
| SEQ ID NO 10283 | ACCAAAGCTTTTCATGGATT | AGG | chrX | 139531431 | 139531450 | 139531447 | + |
| SEQ ID NO 10284 | TGTCTCTATGTCAAACATCT | TGG | chrX | 139531466 | 139531485 | 139531482 | + |
| SEQ ID NO 10285 | TCTCTATGTCAAACATCTTG | GAG | chrX | 139531468 | 139531487 | 139531484 | + |
| SEQ ID NO 10286 | AACATCTTGGAGTTGATATT | TGG | chrX | 139531479 | 139531498 | 139531495 | + |
| SEQ ID NO 10287 | ACATCTTGGAGTTGATATTT | GGG | chrX | 139531480 | 139531499 | 139531496 | + |
| SEQ ID NO 10288 | CATCTTGGAGTTGATATTTG | GGG | chrX | 139531481 | 139531500 | 139531497 | + |
| SEQ ID NO 10289 | ATTTGGGGAAACACAATACT | CAG | chrX | 139531496 | 139531515 | 139531512 | + |
| SEQ ID NO 10290 | GGGAAACACAATACTCAGTT | GAG | chrX | 139531501 | 139531520 | 139531517 | + |
| SEQ ID NO 10291 | CAATACTCAGTTGAGTTCCC | TAG | chrX | 139531509 | 139531528 | 139531525 | + |
| SEQ ID NO 10292 | AATACTCAGTTGAGTTCCCT | AGG | chrX | 139531510 | 139531529 | 139531526 | + |
| SEQ ID NO 10293 | ATACTCAGTTGAGTTCCCTA | GGG | chrX | 139531511 | 139531530 | 139531527 | + |
| SEQ ID NO 10294 | TACTCAGTTGAGTTCCCTAG | GGG | chrX | 139531512 | 139531531 | 139531528 | + |
| SEQ ID NO 10295 | CTCAGTTGAGTTCCCTAGGG | GAG | chrX | 139531514 | 139531533 | 139531530 | + |
| SEQ ID NO 10296 | TTGAGTTCCCTAGGGGAGAA | AAG | chrX | 139531519 | 139531538 | 139531535 | + |
| SEQ ID NO 10297 | GTTCCCTAGGGGAGAAAAGC | AAG | chrX | 139531523 | 139531542 | 139531539 | + |
| SEQ ID NO 10298 | TAGGGGAGAAAAGCAAGCTT | AAG | chrX | 139531529 | 139531548 | 139531545 | + |
| SEQ ID NO 10299 | CAAGCTTAAGAATTGACATA | AAG | chrX | 139531542 | 139531561 | 139531558 | + |
| SEQ ID NO 10300 | AGCTTAAGAATTGACATAAA | GAG | chrX | 139531544 | 139531563 | 139531560 | + |
| SEQ ID NO 10301 | TTAAGAATTGACATAAAGAG | TAG | chrX | 139531547 | 139531566 | 139531563 | + |
| SEQ ID NO 10302 | TAAGAATTGACATAAAGAGT | AGG | chrX | 139531548 | 139531567 | 139531564 | + |
| SEQ ID NO 10303 | GAATTGACATAAAGAGTAGG | AAG | chrX | 139531551 | 139531570 | 139531567 | + |
| SEQ ID NO 10304 | TGACATAAAGAGTAGGAAGT | TAG | chrX | 139531555 | 139531574 | 139531571 | + |
| SEQ ID NO 10305 | ACTTTGTTTTTTCACAACTA | CAG | chrX | 139531595 | 139531614 | 139531611 | + |
| SEQ ID NO 10306 | CAGTGACTTTATGTATTTCC | CAG | chrX | 139531615 | 139531634 | 139531631 | + |
| SEQ ID NO 10307 | GTGACTTTATGTATTTCCCA | GAG | chrX | 139531617 | 139531636 | 139531633 | + |
| SEQ ID NO 10308 | TGACTTTATGTATTTCCCAG | AGG | chrX | 139531618 | 139531637 | 139531634 | + |
| SEQ ID NO 10309 | CTTTATGTATTTCCCAGAGG | AAG | chrX | 139531621 | 139531640 | 139531637 | + |
| SEQ ID NO 10310 | TTTATGTATTTCCCAGAGGA | AGG | chrX | 139531622 | 139531641 | 139531638 | + |
| SEQ ID NO 10311 | ATTTCCCAGAGGAAGGCATA | CAG | chrX | 139531629 | 139531648 | 139531645 | + |
| SEQ ID NO 10312 | TTTCCCAGAGGAAGGCATAC | AGG | chrX | 139531630 | 139531649 | 139531646 | + |
| SEQ ID NO 10313 | TTCCCAGAGGAAGGCATACA | GGG | chrX | 139531631 | 139531650 | 139531647 | + |
| SEQ ID NO 10314 | CCAGAGGAAGGCATACAGGG | AAG | chrX | 139531634 | 139531653 | 139531650 | + |
| SEQ ID NO 10315 | AGGGAAGAAATTATCCCATT | TGG | chrX | 139531650 | 139531669 | 139531666 | + |
| SEQ ID NO 10316 | AATTATCCCATTTGGACAAA | CAG | chrX | 139531658 | 139531677 | 139531674 | + |
| SEQ ID NO 10317 | GGACAAACAGCATGTTCTCA | CAG | chrX | 139531671 | 139531690 | 139531687 | + |

Figure 37 (Cont'd)

| SEQ ID NO 10318 | GACAAACAGCATGTTCTCAC | AGG | chrX | 139531672 | 139531691 | 139531688 | + |
| SEQ ID NO 10319 | AAACAGCATGTTCTCACAGG | AAG | chrX | 139531675 | 139531694 | 139531691 | + |
| SEQ ID NO 10320 | ACACTTACTTGTCAACTTTC | TAG | chrX | 139531706 | 139531725 | 139531722 | + |
| SEQ ID NO 10321 | CAACTTTCTAGAATCAAATC | TAG | chrX | 139531718 | 139531737 | 139531734 | + |
| SEQ ID NO 10322 | CTTTCTAGAATCAAATCTAG | TAG | chrX | 139531721 | 139531740 | 139531737 | + |
| SEQ ID NO 10323 | GAATCAAATCTAGTAGCTGA | CAG | chrX | 139531728 | 139531747 | 139531744 | + |
| SEQ ID NO 10324 | AATCTAGTAGCTGACAGTAC | CAG | chrX | 139531734 | 139531753 | 139531750 | + |
| SEQ ID NO 10325 | ATCTAGTAGCTGACAGTACC | AGG | chrX | 139531735 | 139531754 | 139531751 | + |
| SEQ ID NO 10326 | GTAGCTGACAGTACCAGGAT | CAG | chrX | 139531740 | 139531759 | 139531756 | + |
| SEQ ID NO 10327 | TAGCTGACAGTACCAGGATC | AGG | chrX | 139531741 | 139531760 | 139531757 | + |
| SEQ ID NO 10328 | AGCTGACAGTACCAGGATCA | GGG | chrX | 139531742 | 139531761 | 139531758 | + |
| SEQ ID NO 10329 | GCTGACAGTACCAGGATCAG | GGG | chrX | 139531743 | 139531762 | 139531759 | + |
| SEQ ID NO 10330 | GGATCAGGGGTGCCAACCCT | AAG | chrX | 139531756 | 139531775 | 139531772 | + |
| SEQ ID NO 10331 | GTGCCAACCCTAAGCACCCC | CAG | chrX | 139531765 | 139531784 | 139531781 | + |
| SEQ ID NO 10332 | CAACCCTAAGCACCCCCAGA | AAG | chrX | 139531769 | 139531788 | 139531785 | + |
| SEQ ID NO 10333 | AGCACCCCCAGAAAGCTGAC | TGG | chrX | 139531777 | 139531796 | 139531793 | + |
| SEQ ID NO 10334 | CAGAAAGCTGACTGGCCCTG | TGG | chrX | 139531785 | 139531804 | 139531801 | + |
| SEQ ID NO 10335 | TGGCCCTGTGGTTCCCACTC | CAG | chrX | 139531797 | 139531816 | 139531813 | + |
| SEQ ID NO 10336 | TCCCACTCCAGACATGATGT | CAG | chrX | 139531809 | 139531828 | 139531825 | + |
| SEQ ID NO 10337 | CATGATGTCAGCTGTGAAAT | CAG | chrX | 139531821 | 139531840 | 139531837 | + |
| SEQ ID NO 10338 | AATAACGATAAAAAAAAATA | CAG | chrX | 139531857 | 139531876 | 139531873 | + |
| SEQ ID NO 10339 | TAACGATAAAAAAAATACA | GAG | chrX | 139531859 | 139531878 | 139531875 | + |
| SEQ ID NO 10340 | AACGATAAAAAAAATACAG | AGG | chrX | 139531860 | 139531879 | 139531876 | + |
| SEQ ID NO 10341 | AAAAAATACAGAGGTTAAAC | TAG | chrX | 139531869 | 139531888 | 139531885 | + |
| SEQ ID NO 10342 | ATACAGAGGTTAAACTAGCA | AAG | chrX | 139531874 | 139531893 | 139531890 | + |
| SEQ ID NO 10343 | AGAGGTTAAACTAGCAAAGT | GAG | chrX | 139531878 | 139531897 | 139531894 | + |
| SEQ ID NO 10344 | TTAAACTAGCAAAGTGAGTA | AAG | chrX | 139531883 | 139531902 | 139531899 | + |
| SEQ ID NO 10345 | CTAGCAAAGTGAGTAAAGTC | AAG | chrX | 139531888 | 139531907 | 139531904 | + |
| SEQ ID NO 10346 | TAGCAAAGTGAGTAAAGTCA | AGG | chrX | 139531889 | 139531908 | 139531905 | + |
| SEQ ID NO 10347 | AGCAAAGTGAGTAAAGTCAA | GGG | chrX | 139531890 | 139531909 | 139531906 | + |
| SEQ ID NO 10348 | GTGAGTAAAGTCAAGGGATA | AAG | chrX | 139531896 | 139531915 | 139531912 | + |
| SEQ ID NO 10349 | AAGGGATAAAGAAAATTTGT | TGG | chrX | 139531908 | 139531927 | 139531924 | + |
| SEQ ID NO 10350 | AATTTGTTGGAAAACTCACA | AAG | chrX | 139531921 | 139531940 | 139531937 | + |
| SEQ ID NO 10351 | TTGTTGGAAAACTCACAAAG | CAG | chrX | 139531924 | 139531943 | 139531940 | + |
| SEQ ID NO 10352 | TGTTGGAAAACTCACAAAGC | AGG | chrX | 139531925 | 139531944 | 139531941 | + |
| SEQ ID NO 10353 | AACTCACAAAGCAGGACATA | AAG | chrX | 139531933 | 139531952 | 139531949 | + |
| SEQ ID NO 10354 | CACAAAGCAGGACATAAAGC | AAG | chrX | 139531937 | 139531956 | 139531953 | + |
| SEQ ID NO 10355 | ACAAAGCAGGACATAAAGCA | AGG | chrX | 139531938 | 139531957 | 139531954 | + |
| SEQ ID NO 10356 | AGGACATAAAGCAAGGCCAT | TAG | chrX | 139531945 | 139531964 | 139531961 | + |
| SEQ ID NO 10357 | GGCCATTAGATATATCTCAT | TAG | chrX | 139531959 | 139531978 | 139531975 | + |
| SEQ ID NO 10358 | TATCTCATTAGTGTGACATC | TGG | chrX | 139531971 | 139531990 | 139531987 | + |
| SEQ ID NO 10359 | ATCTCATTAGTGTGACATCT | GGG | chrX | 139531972 | 139531991 | 139531988 | + |
| SEQ ID NO 10360 | CTCATTAGTGTGACATCTGG | GAG | chrX | 139531974 | 139531993 | 139531990 | + |
| SEQ ID NO 10361 | TCATTAGTGTGACATCTGGG | AGG | chrX | 139531975 | 139531994 | 139531991 | + |
| SEQ ID NO 10362 | GTGTGACATCTGGGAGGACA | AAG | chrX | 139531981 | 139532000 | 139531997 | + |
| SEQ ID NO 10363 | CCAAACCCTTCTTCTATAT | AAG | chrX | 139532007 | 139532026 | 139532023 | + |
| SEQ ID NO 10364 | AACCCTTCTTCTATATAAG | TGG | chrX | 139532010 | 139532029 | 139532026 | + |
| SEQ ID NO 10365 | CTTTCTTCTATATAAGTGGT | GAG | chrX | 139532014 | 139532033 | 139532030 | + |
| SEQ ID NO 10366 | ATATAAGTGGTGAGATGATG | AAG | chrX | 139532023 | 139532042 | 139532039 | + |

Figure 37 (Cont'd)

| SEQ ID NO 10367 | TATAAGTGGTGAGATGATGA | AGG | chrX | 139532024 | 139532043 | 139532040 | + |
| SEQ ID NO 10368 | GGTGAGATGATGAAGGTTGT | AAG | chrX | 139532031 | 139532050 | 139532047 | + |
| SEQ ID NO 10369 | TGAGATGATGAAGGTTGTAA | GAG | chrX | 139532033 | 139532052 | 139532049 | + |
| SEQ ID NO 10370 | GAGATGATGAAGGTTGTAAG | AGG | chrX | 139532034 | 139532053 | 139532050 | + |
| SEQ ID NO 10371 | AGATGATGAAGGTTGTAAGA | GGG | chrX | 139532035 | 139532054 | 139532051 | + |
| SEQ ID NO 10372 | AGAGGGCTTCTGCCCCCTTG | AAG | chrX | 139532052 | 139532071 | 139532068 | + |
| SEQ ID NO 10373 | TTCTGCCCCCTTGAAGACTT | CAG | chrX | 139532059 | 139532078 | 139532075 | + |
| SEQ ID NO 10374 | CCCTTGAAGACTTCAGATGC | TGG | chrX | 139532066 | 139532085 | 139532082 | + |
| SEQ ID NO 10375 | CCTTGAAGACTTCAGATGCT | GGG | chrX | 139532067 | 139532086 | 139532083 | + |
| SEQ ID NO 10376 | CTTGAAGACTTCAGATGCTG | GGG | chrX | 139532068 | 139532087 | 139532084 | + |
| SEQ ID NO 10377 | AAGACTTCAGATGCTGGGGA | AAG | chrX | 139532072 | 139532091 | 139532088 | + |
| SEQ ID NO 10378 | AGACTTCAGATGCTGGGGAA | AGG | chrX | 139532073 | 139532092 | 139532089 | + |
| SEQ ID NO 10379 | TTCAGATGCTGGGGAAGGA | TAG | chrX | 139532077 | 139532096 | 139532093 | + |
| SEQ ID NO 10380 | ATGCTGGGGAAGGATAGAT | AAG | chrX | 139532082 | 139532101 | 139532098 | + |
| SEQ ID NO 10381 | GGGAAAGGATAGATAAGAAT | AAG | chrX | 139532088 | 139532107 | 139532104 | + |
| SEQ ID NO 10382 | GGAAAGGATAGATAAGAATA | AGG | chrX | 139532089 | 139532108 | 139532105 | + |
| SEQ ID NO 10383 | AGATAAGAATAAGGATGAAC | CAG | chrX | 139532098 | 139532117 | 139532114 | + |
| SEQ ID NO 10384 | GATAAGAATAAGGATGAACC | AGG | chrX | 139532099 | 139532118 | 139532115 | + |
| SEQ ID NO 10385 | ATAAGGATGAACCAGGCTTT | TGG | chrX | 139532106 | 139532125 | 139532122 | + |
| SEQ ID NO 10386 | AAGGATGAACCAGGCTTTTG | GAG | chrX | 139532108 | 139532127 | 139532124 | + |
| SEQ ID NO 10387 | TGAACCAGGCTTTTGGAGCC | TGG | chrX | 139532113 | 139532132 | 139532129 | + |
| SEQ ID NO 10388 | GAACCAGGCTTTTGGAGCCT | GGG | chrX | 139532114 | 139532133 | 139532130 | + |
| SEQ ID NO 10389 | GGAGCCTGGGAAATAATGAC | TAG | chrX | 139532127 | 139532146 | 139532143 | + |
| SEQ ID NO 10390 | AATGACTAGCGATAAACCTG | AAG | chrX | 139532141 | 139532160 | 139532157 | + |
| SEQ ID NO 10391 | ATGACTAGCGATAAACCTGA | AGG | chrX | 139532142 | 139532161 | 139532158 | + |
| SEQ ID NO 10392 | TGACTAGCGATAAACCTGAA | GGG | chrX | 139532143 | 139532162 | 139532159 | + |
| SEQ ID NO 10393 | CTAGCGATAAACCTGAAGGG | AAG | chrX | 139532146 | 139532165 | 139532162 | + |
| SEQ ID NO 10394 | GATAAACCTGAAGGGAAGTT | AAG | chrX | 139532151 | 139532170 | 139532167 | + |
| SEQ ID NO 10395 | GAAGTTAAGTATACGATCCC | CAG | chrX | 139532165 | 139532184 | 139532181 | + |
| SEQ ID NO 10396 | TACGATCCCCAGATAATACT | AAG | chrX | 139532176 | 139532195 | 139532192 | + |
| SEQ ID NO 10397 | ACGATCCCCAGATAATACTA | AGG | chrX | 139532177 | 139532196 | 139532193 | + |
| SEQ ID NO 10398 | GATCCCCAGATAATACTAAG | GAG | chrX | 139532179 | 139532198 | 139532195 | + |
| SEQ ID NO 10399 | CCCAGATAATACTAAGGAGA | AAG | chrX | 139532183 | 139532202 | 139532199 | + |
| SEQ ID NO 10400 | CCAGATAATACTAAGGAGAA | AGG | chrX | 139532184 | 139532203 | 139532200 | + |
| SEQ ID NO 10401 | AGAAAGGCAATGTGATTCTG | CAG | chrX | 139532200 | 139532219 | 139532216 | + |
| SEQ ID NO 10402 | ATGTGATTCTGCAGCCATTG | TAG | chrX | 139532209 | 139532228 | 139532225 | + |
| SEQ ID NO 10403 | GATTCTGCAGCCATTGTAGC | CAG | chrX | 139532213 | 139532232 | 139532229 | + |
| SEQ ID NO 10404 | TTCTGCAGCCATTGTAGCCA | GAG | chrX | 139532215 | 139532234 | 139532231 | + |
| SEQ ID NO 10405 | CCATTGTAGCCAGAGATAAT | AAG | chrX | 139532223 | 139532242 | 139532239 | + |
| SEQ ID NO 10406 | GCCAGAGATAATAAGCCCTT | GAG | chrX | 139532231 | 139532250 | 139532247 | + |
| SEQ ID NO 10407 | CCAGAGATAATAAGCCCTTG | AGG | chrX | 139532232 | 139532251 | 139532248 | + |
| SEQ ID NO 10408 | GAGATAATAAGCCCTTGAGG | AAG | chrX | 139532235 | 139532254 | 139532251 | + |
| SEQ ID NO 10409 | AGATAATAAGCCCTTGAGGA | AGG | chrX | 139532236 | 139532255 | 139532252 | + |
| SEQ ID NO 10410 | GATAATAAGCCCTTGAGGAA | GGG | chrX | 139532237 | 139532256 | 139532253 | + |
| SEQ ID NO 10411 | ATAATAAGCCCTTGAGGAAG | GGG | chrX | 139532238 | 139532257 | 139532254 | + |
| SEQ ID NO 10412 | TAAGCCCTTGAGGAAGGGGC | CAG | chrX | 139532242 | 139532261 | 139532258 | + |
| SEQ ID NO 10413 | AAGCCCTTGAGGAAGGGGCC | AGG | chrX | 139532243 | 139532262 | 139532259 | + |
| SEQ ID NO 10414 | AGCCCTTGAGGAAGGGGCCA | GGG | chrX | 139532244 | 139532263 | 139532260 | + |
| SEQ ID NO 10415 | GCCCTTGAGGAAGGGGCCAG | GGG | chrX | 139532245 | 139532264 | 139532261 | + |

Figure 37 (Cont'd)

| | | | | | | | |
|---|---|---|---|---|---|---|---|
| SEQ ID NO 10416 | GGGGCCAGGGGAATTTTTCT | AAG | chrX | 139532257 | 139532276 | 139532273 | + |
| SEQ ID NO 10417 | GGGCCAGGGGAATTTTTCTA | AGG | chrX | 139532258 | 139532277 | 139532274 | + |
| SEQ ID NO 10418 | CAGGGGAATTTTTCTAAGGA | TAG | chrX | 139532262 | 139532281 | 139532278 | + |
| SEQ ID NO 10419 | GGAATTTTTCTAAGGATAGA | CAG | chrX | 139532266 | 139532285 | 139532282 | + |
| SEQ ID NO 10420 | AAGGATAGACAGTATTAATG | CAG | chrX | 139532277 | 139532296 | 139532293 | + |
| SEQ ID NO 10421 | TTCTGCTATTAAACTCTCAT | TGG | chrX | 139532307 | 139532326 | 139532323 | + |
| SEQ ID NO 10422 | AAACTCTCATTGGCTTCTAA | AAG | chrX | 139532317 | 139532336 | 139532333 | + |
| SEQ ID NO 10423 | AACTCTCATTGGCTTCTAAA | AGG | chrX | 139532318 | 139532337 | 139532334 | + |
| SEQ ID NO 10424 | CTCTCATTGGCTTCTAAAAG | GAG | chrX | 139532320 | 139532339 | 139532336 | + |
| SEQ ID NO 10425 | TTGGCTTCTAAAAGGAGTTT | CGG | chrX | 139532326 | 139532345 | 139532342 | + |
| SEQ ID NO 10426 | CTTCTAAAAGGAGTTTCGGT | GAG | chrX | 139532330 | 139532349 | 139532346 | + |
| SEQ ID NO 10427 | GTTTCGGTGAGTGATTTGCT | GAG | chrX | 139532342 | 139532361 | 139532358 | + |
| SEQ ID NO 10428 | GCTGAGATGTTGCATTTTCA | TGG | chrX | 139532359 | 139532378 | 139532375 | + |
| SEQ ID NO 10429 | ATTTTCATGGCTGCTGCCTT | TAG | chrX | 139532372 | 139532391 | 139532388 | + |
| SEQ ID NO 10430 | TTTTCATGGCTGCTGCCTTT | AGG | chrX | 139532373 | 139532392 | 139532389 | + |
| SEQ ID NO 10431 | GCCTTTAGGTATTATTGCAA | CAG | chrX | 139532387 | 139532406 | 139532403 | + |
| SEQ ID NO 10432 | TAGGTATTATTGCAACAGTT | TGG | chrX | 139532392 | 139532411 | 139532408 | + |
| SEQ ID NO 10433 | TTGGAATTTTGAAATTAAAA | CAG | chrX | 139532411 | 139532430 | 139532427 | + |
| SEQ ID NO 10434 | TTAAAACAGTTCTGTAAAAC | CAG | chrX | 139532425 | 139532444 | 139532441 | + |
| SEQ ID NO 10435 | ACAGTTCTGTAAAACCAGTT | TAG | chrX | 139532430 | 139532449 | 139532446 | + |
| SEQ ID NO 10436 | AAAACCAGTTTAGTTTTGTA | AAG | chrX | 139532440 | 139532459 | 139532456 | + |
| SEQ ID NO 10437 | TTTGTAAAGTGTATGCATCA | AAG | chrX | 139532454 | 139532473 | 139532470 | + |
| SEQ ID NO 10438 | CATCAAAGATGTCCTTCATT | CAG | chrX | 139532469 | 139532488 | 139532485 | + |
| SEQ ID NO 10439 | TCCTTCATTCAGACATTACT | GAG | chrX | 139532480 | 139532499 | 139532496 | + |
| SEQ ID NO 10440 | ACATTACTGAGTTACAACTA | TGG | chrX | 139532492 | 139532511 | 139532508 | + |
| SEQ ID NO 10441 | CTGAGTTACAACTATGGTGC | CAG | chrX | 139532498 | 139532517 | 139532514 | + |
| SEQ ID NO 10442 | TGAGTTACAACTATGGTGCC | AGG | chrX | 139532499 | 139532518 | 139532515 | + |
| SEQ ID NO 10443 | TATGGTGCCAGGTACTGTGT | CAG | chrX | 139532510 | 139532529 | 139532526 | + |
| SEQ ID NO 10444 | ATGGTGCCAGGTACTGTGTC | AGG | chrX | 139532511 | 139532530 | 139532527 | + |
| SEQ ID NO 10445 | TGGTGCCAGGTACTGTGTCA | GGG | chrX | 139532512 | 139532531 | 139532528 | + |
| SEQ ID NO 10446 | CAGGTACTGTGTCAGGGTAC | TAG | chrX | 139532518 | 139532537 | 139532534 | + |
| SEQ ID NO 10447 | AGGTACTGTGTCAGGGTACT | AGG | chrX | 139532519 | 139532538 | 139532535 | + |
| SEQ ID NO 10448 | GGTACTGTGTCAGGGTACTA | GGG | chrX | 139532520 | 139532539 | 139532536 | + |
| SEQ ID NO 10449 | GTACTGTGTCAGGGTACTAG | GGG | chrX | 139532521 | 139532540 | 139532537 | + |
| SEQ ID NO 10450 | GTGTCAGGGTACTAGGGGTA | TGG | chrX | 139532526 | 139532545 | 139532542 | + |
| SEQ ID NO 10451 | TGTCAGGGTACTAGGGGTAT | GGG | chrX | 139532527 | 139532546 | 139532543 | + |
| SEQ ID NO 10452 | GTCAGGGTACTAGGGGTATG | GGG | chrX | 139532528 | 139532547 | 139532544 | + |
| SEQ ID NO 10453 | CTAGGGGTATGGGGATAAAC | CAG | chrX | 139532537 | 139532556 | 139532553 | + |
| SEQ ID NO 10454 | CAGACTCCCTCTTTGATCTA | AAG | chrX | 139532557 | 139532576 | 139532573 | + |
| SEQ ID NO 10455 | ACTCCCTCTTTGATCTAAAG | CAG | chrX | 139532560 | 139532579 | 139532576 | + |
| SEQ ID NO 10456 | TCTTTGATCTAAAGCAGCAT | GAG | chrX | 139532566 | 139532585 | 139532582 | + |
| SEQ ID NO 10457 | CTTTGATCTAAAGCAGCATG | AGG | chrX | 139532567 | 139532586 | 139532583 | + |
| SEQ ID NO 10458 | GATCTAAAGCAGCATGAGGC | CAG | chrX | 139532571 | 139532590 | 139532587 | + |
| SEQ ID NO 10459 | ATCTAAAGCAGCATGAGGCC | AGG | chrX | 139532572 | 139532591 | 139532588 | + |
| SEQ ID NO 10460 | AAAGCAGCATGAGGCCAGGT | GAG | chrX | 139532576 | 139532595 | 139532592 | + |
| SEQ ID NO 10461 | AGCAGCATGAGGCCAGGTGA | GAG | chrX | 139532578 | 139532597 | 139532594 | + |
| SEQ ID NO 10462 | GCAGCATGAGGCCAGGTGAG | AGG | chrX | 139532579 | 139532598 | 139532595 | + |
| SEQ ID NO 10463 | TAATGTGATAAAATGTGCAC | TAG | chrX | 139532610 | 139532629 | 139532626 | + |
| SEQ ID NO 10464 | AATGTGATAAAATGTGCACT | AGG | chrX | 139532611 | 139532630 | 139532627 | + |

Figure 37 (Cont'd)

| SEQ ID NO 10465 | TAAAATGTGCACTAGGTACT | AAG | chrX | 139532618 | 139532637 | 139532634 | + |
| SEQ ID NO 10466 | AAAATGTGCACTAGGTACTA | AGG | chrX | 139532619 | 139532638 | 139532635 | + |
| SEQ ID NO 10467 | AAATGTGCACTAGGTACTAA | GGG | chrX | 139532620 | 139532639 | 139532636 | + |
| SEQ ID NO 10468 | CACTAGGTACTAAGGGATCA | TAG | chrX | 139532627 | 139532646 | 139532643 | + |
| SEQ ID NO 10469 | CTAGGTACTAAGGGATCATA | GAG | chrX | 139532629 | 139532648 | 139532645 | + |
| SEQ ID NO 10470 | GTACTAAGGGATCATAGAGA | AAG | chrX | 139532633 | 139532652 | 139532649 | + |
| SEQ ID NO 10471 | TACTAAGGGATCATAGAGAA | AGG | chrX | 139532634 | 139532653 | 139532650 | + |
| SEQ ID NO 10472 | AGAGAAGGAACACATTAAA | TGG | chrX | 139532648 | 139532667 | 139532664 | + |
| SEQ ID NO 10473 | GAGAAAGGAACACATTAAAT | GGG | chrX | 139532649 | 139532668 | 139532665 | + |
| SEQ ID NO 10474 | AGAAAGGAACACATTAAATG | GGG | chrX | 139532650 | 139532669 | 139532666 | + |
| SEQ ID NO 10475 | TTAAATGGGGAAACAATTGA | TAG | chrX | 139532663 | 139532682 | 139532679 | + |
| SEQ ID NO 10476 | AAATGGGGAAACAATTGATA | GAG | chrX | 139532665 | 139532684 | 139532681 | + |
| SEQ ID NO 10477 | ATGGGGAAACAATTGATAGA | GAG | chrX | 139532667 | 139532686 | 139532683 | + |
| SEQ ID NO 10478 | GGGGAAACAATTGATAGAGA | GAG | chrX | 139532669 | 139532688 | 139532685 | + |
| SEQ ID NO 10479 | AGAGAGAATATTTTCATC | TGG | chrX | 139532684 | 139532703 | 139532700 | + |
| SEQ ID NO 10480 | GAGAGAGAATATTTTCATCT | GGG | chrX | 139532685 | 139532704 | 139532701 | + |
| SEQ ID NO 10481 | TATTTTCATCTGGGTCTTAA | AAG | chrX | 139532694 | 139532713 | 139532710 | + |
| SEQ ID NO 10482 | TCATCTGGGTCTTAAAAGAT | GAG | chrX | 139532699 | 139532718 | 139532715 | + |
| SEQ ID NO 10483 | TCTGGGTCTTAAAAGATGAG | TAG | chrX | 139532702 | 139532721 | 139532718 | + |
| SEQ ID NO 10484 | CTGGGTCTTAAAAGATGAGT | AGG | chrX | 139532703 | 139532722 | 139532719 | + |
| SEQ ID NO 10485 | TCTCTTTAAATGTCTGATAT | AAG | chrX | 139532733 | 139532752 | 139532749 | + |
| SEQ ID NO 10486 | CTCTTTAAATGTCTGATATA | AGG | chrX | 139532734 | 139532753 | 139532750 | + |
| SEQ ID NO 10487 | TCTTTAAATGTCTGATATAA | GGG | chrX | 139532735 | 139532754 | 139532751 | + |
| SEQ ID NO 10488 | ATATAAGGGCATTTTATGCA | AAG | chrX | 139532749 | 139532768 | 139532765 | + |
| SEQ ID NO 10489 | ATAAGGGCATTTTATGCAAA | GAG | chrX | 139532751 | 139532770 | 139532767 | + |
| SEQ ID NO 10490 | TAAGGGCATTTTATGCAAAG | AGG | chrX | 139532752 | 139532771 | 139532768 | + |
| SEQ ID NO 10491 | CAAAGAGGATCACTCGTGCA | AAG | chrX | 139532767 | 139532786 | 139532783 | + |
| SEQ ID NO 10492 | GGATCACTCGTGCAAAGACT | CAG | chrX | 139532773 | 139532792 | 139532789 | + |
| SEQ ID NO 10493 | GTGCAAAGACTCAGATTTGC | AAG | chrX | 139532782 | 139532801 | 139532798 | + |
| SEQ ID NO 10494 | ACTCAGATTTGCAAGAACGT | GAG | chrX | 139532790 | 139532809 | 139532806 | + |
| SEQ ID NO 10495 | CTCAGATTTGCAAGAACGTG | AGG | chrX | 139532791 | 139532810 | 139532807 | + |
| SEQ ID NO 10496 | TGCAAGAACGTGAGGTATTT | CAG | chrX | 139532799 | 139532818 | 139532815 | + |
| SEQ ID NO 10497 | GCAAGAACGTGAGGTATTTC | AGG | chrX | 139532800 | 139532819 | 139532816 | + |
| SEQ ID NO 10498 | AAGAACGTGAGGTATTTCAG | GAG | chrX | 139532802 | 139532821 | 139532818 | + |
| SEQ ID NO 10499 | GGTATTTCAGGAGTTTTGTA | TGG | chrX | 139532812 | 139532831 | 139532828 | + |
| SEQ ID NO 10500 | GAGTTTTGTATGGTTCCATA | TGG | chrX | 139532822 | 139532841 | 139532838 | + |
| SEQ ID NO 10501 | GGTTCCATATGGACTATGAC | AAG | chrX | 139532833 | 139532852 | 139532849 | + |
| SEQ ID NO 10502 | CCATATGGACTATGACAAGT | GAG | chrX | 139532837 | 139532856 | 139532853 | + |
| SEQ ID NO 10503 | ATGGACTATGACAAGTGAGA | CAG | chrX | 139532841 | 139532860 | 139532857 | + |
| SEQ ID NO 10504 | TGGACTATGACAAGTGAGAC | AGG | chrX | 139532842 | 139532861 | 139532858 | + |
| SEQ ID NO 10505 | GACAAGTGAGACAGGTAAAC | TAG | chrX | 139532850 | 139532869 | 139532866 | + |
| SEQ ID NO 10506 | ACAAGTGAGACAGGTAAACT | AGG | chrX | 139532851 | 139532870 | 139532867 | + |
| SEQ ID NO 10507 | AGTGAGACAGGTAAACTAGG | CAG | chrX | 139532854 | 139532873 | 139532870 | + |
| SEQ ID NO 10508 | TGAGACAGGTAAACTAGGCA | GAG | chrX | 139532856 | 139532875 | 139532872 | + |
| SEQ ID NO 10509 | ACAGGTAAACTAGGCAGAGC | TGG | chrX | 139532860 | 139532879 | 139532876 | + |
| SEQ ID NO 10510 | AACTAGGCAGAGCTGGTCAT | CAG | chrX | 139532867 | 139532886 | 139532883 | + |
| SEQ ID NO 10511 | GAGCTGGTCATCAGATAATG | AAG | chrX | 139532876 | 139532895 | 139532892 | + |
| SEQ ID NO 10512 | GATAATGAAGTCATTAACCT | AAG | chrX | 139532889 | 139532908 | 139532905 | + |
| SEQ ID NO 10513 | ATAATGAAGTCATTAACCTA | AGG | chrX | 139532890 | 139532909 | 139532906 | + |

Figure 37 (Cont'd)

| | | | | | | | |
|---|---|---|---|---|---|---|---|
| SEQ ID NO 10514 | AATGAAGTCATTAACCTAAG | GAG | chrX | 139532892 | 139532911 | 139532908 | + |
| SEQ ID NO 10515 | AGTCATTAACCTAAGGAGAT | TGG | chrX | 139532897 | 139532916 | 139532913 | + |
| SEQ ID NO 10516 | TTGGACAATAAAATGCAATA | TGG | chrX | 139532916 | 139532935 | 139532932 | + |
| SEQ ID NO 10517 | GGACAATAAAATGCAATATG | GAG | chrX | 139532918 | 139532937 | 139532934 | + |
| SEQ ID NO 10518 | GACAATAAAATGCAATATGG | AGG | chrX | 139532919 | 139532938 | 139532935 | + |
| SEQ ID NO 10519 | AATGCAATATGGAGGTATCG | AAG | chrX | 139532927 | 139532946 | 139532943 | + |
| SEQ ID NO 10520 | AGGTATCGAAGTATAAACAT | AAG | chrX | 139532939 | 139532958 | 139532955 | + |
| SEQ ID NO 10521 | GGTATCGAAGTATAAACATA | AGG | chrX | 139532940 | 139532959 | 139532956 | + |
| SEQ ID NO 10522 | TATCGAAGTATAAACATAAG | GAG | chrX | 139532942 | 139532961 | 139532958 | + |
| SEQ ID NO 10523 | AACATAAGGAGTACCACTGA | TGG | chrX | 139532954 | 139532973 | 139532970 | + |
| SEQ ID NO 10524 | AGTACCACTGATGGCTGATT | TAG | chrX | 139532963 | 139532982 | 139532979 | + |
| SEQ ID NO 10525 | GTACCACTGATGGCTGATTT | AGG | chrX | 139532964 | 139532983 | 139532980 | + |
| SEQ ID NO 10526 | GATGGCTGATTTAGGATGCC | CAG | chrX | 139532972 | 139532991 | 139532988 | + |
| SEQ ID NO 10527 | CTGATTTAGGATGCCCAGTC | TGG | chrX | 139532977 | 139532996 | 139532993 | + |
| SEQ ID NO 10528 | GCAACACGCTAATGAAATGA | TAG | chrX | 139532999 | 139533018 | 139533015 | + |
| SEQ ID NO 10529 | ACACGCTAATGAAATGATAG | TGG | chrX | 139533002 | 139533021 | 139533018 | + |
| SEQ ID NO 10530 | CACGCTAATGAAATGATAGT | GGG | chrX | 139533003 | 139533022 | 139533019 | + |
| SEQ ID NO 10531 | ACGCTAATGAAATGATAGTG | GGG | chrX | 139533004 | 139533023 | 139533020 | + |
| SEQ ID NO 10532 | CGCTAATGAAATGATAGTGG | GGG | chrX | 139533005 | 139533024 | 139533021 | + |
| SEQ ID NO 10533 | CTAATGAAATGATAGTGGGG | GAG | chrX | 139533007 | 139533026 | 139533023 | + |
| SEQ ID NO 10534 | TAATGAAATGATAGTGGGGG | AGG | chrX | 139533008 | 139533027 | 139533024 | + |
| SEQ ID NO 10535 | AATGAAATGATAGTGGGGGA | GGG | chrX | 139533009 | 139533028 | 139533025 | + |
| SEQ ID NO 10536 | ATGAAATGATAGTGGGGGAG | GGG | chrX | 139533010 | 139533029 | 139533026 | + |
| SEQ ID NO 10537 | TGAAATGATAGTGGGGGAGG | GGG | chrX | 139533011 | 139533030 | 139533027 | + |
| SEQ ID NO 10538 | GTGGGGGAGGGGGCCGTACC | AAG | chrX | 139533021 | 139533040 | 139533037 | + |
| SEQ ID NO 10539 | GGAGGGGCCGTACCAAGAC | TAG | chrX | 139533026 | 139533045 | 139533042 | + |
| SEQ ID NO 10540 | GAGGGGCCGTACCAAGACT | AGG | chrX | 139533027 | 139533046 | 139533043 | + |
| SEQ ID NO 10541 | GGGGGCCGTACCAAGACTAG | GAG | chrX | 139533029 | 139533048 | 139533045 | + |
| SEQ ID NO 10542 | GGGCCGTACCAAGACTAGGA | GAG | chrX | 139533031 | 139533050 | 139533047 | + |
| SEQ ID NO 10543 | GCCGTACCAAGACTAGGAGA | GAG | chrX | 139533033 | 139533052 | 139533049 | + |
| SEQ ID NO 10544 | GTACCAAGACTAGGAGAGAG | CAG | chrX | 139533036 | 139533055 | 139533052 | + |
| SEQ ID NO 10545 | GACTAGGAGAGAGCAGTCCT | GAG | chrX | 139533043 | 139533062 | 139533059 | + |
| SEQ ID NO 10546 | GAGACTATTGCAATTATCTG | CGG | chrX | 139533063 | 139533082 | 139533079 | + |
| SEQ ID NO 10547 | AGACTATTGCAATTATCTGC | GGG | chrX | 139533064 | 139533083 | 139533080 | + |
| SEQ ID NO 10548 | ACTATTGCAATTATCTGCGG | GAG | chrX | 139533066 | 139533085 | 139533082 | + |
| SEQ ID NO 10549 | AATTATCTGCGGGAGACATA | AAG | chrX | 139533074 | 139533093 | 139533090 | + |
| SEQ ID NO 10550 | ATTATCTGCGGGAGACATAA | AGG | chrX | 139533075 | 139533094 | 139533091 | + |
| SEQ ID NO 10551 | TCTGCGGGAGACATAAAGGC | TAG | chrX | 139533079 | 139533098 | 139533095 | + |
| SEQ ID NO 10552 | CATAAAGGCTAGAACCTGAA | CAG | chrX | 139533090 | 139533109 | 139533106 | + |
| SEQ ID NO 10553 | AAAGGCTAGAACCTGAACAG | TAG | chrX | 139533093 | 139533112 | 139533109 | + |
| SEQ ID NO 10554 | GGCTAGAACCTGAACAGTAG | CAG | chrX | 139533096 | 139533115 | 139533112 | + |
| SEQ ID NO 10555 | GAACAGTAGCAGTACAAAAA | AAG | chrX | 139533107 | 139533126 | 139533123 | + |
| SEQ ID NO 10556 | ACAGTAGCAGTACAAAAAA | GAG | chrX | 139533109 | 139533128 | 139533125 | + |
| SEQ ID NO 10557 | CAGTAGCAGTACAAAAAAG | AGG | chrX | 139533110 | 139533129 | 139533126 | + |
| SEQ ID NO 10558 | AGTAGCAGTACAAAAAAGA | GGG | chrX | 139533111 | 139533130 | 139533127 | + |
| SEQ ID NO 10559 | GTAGCAGTACAAAAAAGAG | GGG | chrX | 139533112 | 139533131 | 139533128 | + |
| SEQ ID NO 10560 | AGCAGTACAAAAAAGAGGG | GAG | chrX | 139533114 | 139533133 | 139533130 | + |
| SEQ ID NO 10561 | AGGGGAGTTCAAATGATATT | AAG | chrX | 139533130 | 139533149 | 139533146 | + |
| SEQ ID NO 10562 | GGGGAGTTCAAATGATATTA | AGG | chrX | 139533131 | 139533150 | 139533147 | + |

Figure 37 (Cont'd)

| | | | | | | | |
|---|---|---|---|---|---|---|---|
| SEQ ID NO 10563 | GAGTTCAAATGATATTAAGG | AAG | chrX | 139533134 | 139533153 | 139533150 | + |
| SEQ ID NO 10564 | TTCAAATGATATTAAGGAAG | TAG | chrX | 139533137 | 139533156 | 139533153 | + |
| SEQ ID NO 10565 | AAATGATATTAAGGAAGTAG | AAG | chrX | 139533140 | 139533159 | 139533156 | + |
| SEQ ID NO 10566 | TGATATTAAGGAAGTAGAAG | TGG | chrX | 139533143 | 139533162 | 139533159 | + |
| SEQ ID NO 10567 | AGTGGTATGACTTAACCATC | TGG | chrX | 139533161 | 139533180 | 139533177 | + |
| SEQ ID NO 10568 | GTGGTATGACTTAACCATCT | GGG | chrX | 139533162 | 139533181 | 139533178 | + |
| SEQ ID NO 10569 | ATGACTTAACCATCTGGGTA | TGG | chrX | 139533167 | 139533186 | 139533183 | + |
| SEQ ID NO 10570 | ACTTAACCATCTGGGTATGG | AAG | chrX | 139533170 | 139533189 | 139533186 | + |
| SEQ ID NO 10571 | CTTAACCATCTGGGTATGGA | AGG | chrX | 139533171 | 139533190 | 139533187 | + |
| SEQ ID NO 10572 | TTAACCATCTGGGTATGGAA | GGG | chrX | 139533172 | 139533191 | 139533188 | + |
| SEQ ID NO 10573 | TAACCATCTGGGTATGGAAG | GGG | chrX | 139533173 | 139533192 | 139533189 | + |
| SEQ ID NO 10574 | TCTGGGTATGGAAGGGGAAA | TGG | chrX | 139533179 | 139533198 | 139533195 | + |
| SEQ ID NO 10575 | GGTATGGAAGGGGAAATGGC | TAG | chrX | 139533183 | 139533202 | 139533199 | + |
| SEQ ID NO 10576 | TATGGAAGGGGAAATGGCTA | GAG | chrX | 139533185 | 139533204 | 139533201 | + |
| SEQ ID NO 10577 | AGGGGAAATGGCTAGAGTCT | TGG | chrX | 139533191 | 139533210 | 139533207 | + |
| SEQ ID NO 10578 | GGGGAAATGGCTAGAGTCTT | GGG | chrX | 139533192 | 139533211 | 139533208 | + |
| SEQ ID NO 10579 | GGGAAATGGCTAGAGTCTTG | GGG | chrX | 139533193 | 139533212 | 139533209 | + |
| SEQ ID NO 10580 | CTTTGTGTTTGATGTGATTA | TGG | chrX | 139533217 | 139533236 | 139533233 | + |
| SEQ ID NO 10581 | TTTGATGTGATTATGGACCA | CAG | chrX | 139533224 | 139533243 | 139533240 | + |
| SEQ ID NO 10582 | TGGACCACAGAATAATGTCT | AAG | chrX | 139533237 | 139533256 | 139533253 | + |
| SEQ ID NO 10583 | GACCACAGAATAATGTCTAA | GAG | chrX | 139533239 | 139533258 | 139533255 | + |
| SEQ ID NO 10584 | AGAATAATGTCTAAGAGAAC | TGG | chrX | 139533245 | 139533264 | 139533261 | + |
| SEQ ID NO 10585 | GTCTAAGAGAACTGGCTCTT | TAG | chrX | 139533253 | 139533272 | 139533269 | + |
| SEQ ID NO 10586 | TGGCTCTTTAGTCTGACTGC | CAG | chrX | 139533265 | 139533284 | 139533281 | + |
| SEQ ID NO 10587 | GCTCTTTAGTCTGACTGCCA | GAG | chrX | 139533267 | 139533286 | 139533283 | + |
| SEQ ID NO 10588 | AGTCTGAATCCTGAATGTTT | TAG | chrX | 139533288 | 139533307 | 139533304 | + |
| SEQ ID NO 10589 | AATGTTTTAGTATGTTACCT | TGG | chrX | 139533301 | 139533320 | 139533317 | + |
| SEQ ID NO 10590 | ATGTTTTAGTATGTTACCTT | GGG | chrX | 139533302 | 139533321 | 139533318 | + |
| SEQ ID NO 10591 | TTAGTATGTTACCTTGGGCA | AAG | chrX | 139533307 | 139533326 | 139533323 | + |
| SEQ ID NO 10592 | GTTACCTTGGGCAAAGCCCT | TAG | chrX | 139533314 | 139533333 | 139533330 | + |
| SEQ ID NO 10593 | TCTTCCTCATTCATAAAAAT | AAG | chrX | 139533351 | 139533370 | 139533367 | + |
| SEQ ID NO 10594 | CATTCATAAAAATAAGATGA | CAG | chrX | 139533358 | 139533377 | 139533374 | + |
| SEQ ID NO 10595 | AGATGACAGTGCCTATCTCG | TGG | chrX | 139533372 | 139533391 | 139533388 | + |
| SEQ ID NO 10596 | GATGACAGTGCCTATCTCGT | GGG | chrX | 139533373 | 139533392 | 139533389 | + |
| SEQ ID NO 10597 | CTATCTCGTGGGACTTTTGT | GAG | chrX | 139533384 | 139533403 | 139533400 | + |
| SEQ ID NO 10598 | TATCTCGTGGGACTTTTGTG | AGG | chrX | 139533385 | 139533404 | 139533401 | + |
| SEQ ID NO 10599 | GTGGGACTTTTGTGAGGATG | AAG | chrX | 139533391 | 139533410 | 139533407 | + |
| SEQ ID NO 10600 | GACTTTTGTGAGGATGAAGT | GAG | chrX | 139533395 | 139533414 | 139533411 | + |
| SEQ ID NO 10601 | GTGAGGATGAAGTGAGATAA | TGG | chrX | 139533402 | 139533421 | 139533418 | + |
| SEQ ID NO 10602 | GAAGTGAGATAATGGATGCA | AAG | chrX | 139533410 | 139533429 | 139533426 | + |
| SEQ ID NO 10603 | ATAATGGATGCAAAGTTACT | GAG | chrX | 139533418 | 139533437 | 139533434 | + |
| SEQ ID NO 10604 | GGATGCAAAGTTACTGAGCA | CAG | chrX | 139533423 | 139533442 | 139533439 | + |
| SEQ ID NO 10605 | ACTGAGCACAGTGTCCAACA | CAG | chrX | 139533435 | 139533454 | 139533451 | + |
| SEQ ID NO 10606 | GAGCACAGTGTCCAACACAG | CAG | chrX | 139533438 | 139533457 | 139533454 | + |
| SEQ ID NO 10607 | CACAGTGTCCAACACAGCAG | AAG | chrX | 139533441 | 139533460 | 139533457 | + |
| SEQ ID NO 10608 | CAGAAGCATTACATATACAT | TAG | chrX | 139533458 | 139533477 | 139533474 | + |
| SEQ ID NO 10609 | ACATATACATTAGCTATTAC | TGG | chrX | 139533468 | 139533487 | 139533484 | + |
| SEQ ID NO 10610 | ACTGGCTACATTATGATATA | CAG | chrX | 139533486 | 139533505 | 139533502 | + |
| SEQ ID NO 10611 | GCTACATTATGATATACAGT | TAG | chrX | 139533490 | 139533509 | 139533506 | + |

Figure 37 (Cont'd)

| | | | | | | | |
|---|---|---|---|---|---|---|---|
| SEQ ID NO 10612 | CTACATTATGATATACAGTT | AGG | chrX | 139533491 | 139533510 | 139533507 | + |
| SEQ ID NO 10613 | TACATTATGATATACAGTTA | GGG | chrX | 139533492 | 139533511 | 139533508 | + |
| SEQ ID NO 10614 | CATTATGATATACAGTTAGG | GAG | chrX | 139533494 | 139533513 | 139533510 | + |
| SEQ ID NO 10615 | ATGATATACAGTTAGGGAGT | TGG | chrX | 139533498 | 139533517 | 139533514 | + |
| SEQ ID NO 10616 | TATACAGTTAGGGAGTTGGA | AAG | chrX | 139533502 | 139533521 | 139533518 | + |
| SEQ ID NO 10617 | TGGAAAGATAATCTGAAATT | CAG | chrX | 139533518 | 139533537 | 139533534 | + |
| SEQ ID NO 10618 | GGAAAGATAATCTGAAATTC | AGG | chrX | 139533519 | 139533538 | 139533535 | + |
| SEQ ID NO 10619 | AAAGATAATCTGAAATTCAG | GAG | chrX | 139533521 | 139533540 | 139533537 | + |
| SEQ ID NO 10620 | TCAGGAGACGTATCTGACTA | TAG | chrX | 139533537 | 139533556 | 139533553 | + |
| SEQ ID NO 10621 | CAGGAGACGTATCTGACTAT | AGG | chrX | 139533538 | 139533557 | 139533554 | + |
| SEQ ID NO 10622 | AGACGTATCTGACTATAGGT | GAG | chrX | 139533542 | 139533561 | 139533558 | + |
| SEQ ID NO 10623 | TCTGACTATAGGTGAGTATT | TGG | chrX | 139533549 | 139533568 | 139533565 | + |
| SEQ ID NO 10624 | GGAACTCATTGTTCTGTAAA | CAG | chrX | 139533570 | 139533589 | 139533586 | + |
| SEQ ID NO 10625 | ACTCATTGTTCTGTAAACAG | TAG | chrX | 139533573 | 139533592 | 139533589 | + |
| SEQ ID NO 10626 | TGTTCTGTAAACAGTAGTTA | CAG | chrX | 139533579 | 139533598 | 139533595 | + |
| SEQ ID NO 10627 | AGTAGTTACAGCCACGTGTG | TGG | chrX | 139533591 | 139533610 | 139533607 | + |
| SEQ ID NO 10628 | GTAGTTACAGCCACGTGTGT | GGG | chrX | 139533592 | 139533611 | 139533608 | + |
| SEQ ID NO 10629 | CAGCCACGTGTGTGGGCATC | TGG | chrX | 139533599 | 139533618 | 139533615 | + |
| SEQ ID NO 10630 | GCCACGTGTGTGGGCATCTG | GAG | chrX | 139533601 | 139533620 | 139533617 | + |
| SEQ ID NO 10631 | CACGTGTGTGGGCATCTGGA | GAG | chrX | 139533603 | 139533622 | 139533619 | + |
| SEQ ID NO 10632 | TGTGTGGGCATCTGGAGAGT | GAG | chrX | 139533607 | 139533626 | 139533623 | + |
| SEQ ID NO 10633 | GGGCATCTGGAGAGTGAGCA | TGG | chrX | 139533612 | 139533631 | 139533628 | + |
| SEQ ID NO 10634 | AGCATGGATATTGTGATACC | TAG | chrX | 139533628 | 139533647 | 139533644 | + |
| SEQ ID NO 10635 | GGATATTGTGATACCTAGTA | CAG | chrX | 139533633 | 139533652 | 139533649 | + |
| SEQ ID NO 10636 | GTGATACCTAGTACAGTGCC | TGG | chrX | 139533640 | 139533659 | 139533656 | + |
| SEQ ID NO 10637 | ATACCTAGTACAGTGCCTGG | CAG | chrX | 139533643 | 139533662 | 139533659 | + |
| SEQ ID NO 10638 | CCTAGTACAGTGCCTGGCAG | TAG | chrX | 139533646 | 139533665 | 139533662 | + |
| SEQ ID NO 10639 | AGTACAGTGCCTGGCAGTAG | TGG | chrX | 139533649 | 139533668 | 139533665 | + |
| SEQ ID NO 10640 | GGCAGTAGTGGTTGTATGCT | CAG | chrX | 139533661 | 139533680 | 139533677 | + |
| SEQ ID NO 10641 | TGCTCAGTAAATTTTGTTGA | CAG | chrX | 139533677 | 139533696 | 139533693 | + |
| SEQ ID NO 10642 | GCTCAGTAAATTTTGTTGAC | AGG | chrX | 139533678 | 139533697 | 139533694 | + |
| SEQ ID NO 10643 | CTCAGTAAATTTTGTTGACA | GGG | chrX | 139533679 | 139533698 | 139533695 | + |
| SEQ ID NO 10644 | GTAAATTTTGTTGACAGGGT | CAG | chrX | 139533683 | 139533702 | 139533699 | + |
| SEQ ID NO 10645 | TAAATTTTGTTGACAGGGTC | AGG | chrX | 139533684 | 139533703 | 139533700 | + |
| SEQ ID NO 10646 | AAATTTTGTTGACAGGGTCA | GGG | chrX | 139533685 | 139533704 | 139533701 | + |
| SEQ ID NO 10647 | TTTGTTGACAGGGTCAGGGC | CGG | chrX | 139533689 | 139533708 | 139533705 | + |
| SEQ ID NO 10648 | TGACAGGGTCAGGGCCGGAC | TAG | chrX | 139533694 | 139533713 | 139533710 | + |
| SEQ ID NO 10649 | GTCAGGGCCGGACTAGACTG | TGG | chrX | 139533701 | 139533720 | 139533717 | + |
| SEQ ID NO 10650 | GGGCCGGACTAGACTGTGGT | AAG | chrX | 139533705 | 139533724 | 139533721 | + |
| SEQ ID NO 10651 | CGGACTAGACTGTGGTAAGC | AAG | chrX | 139533709 | 139533728 | 139533725 | + |
| SEQ ID NO 10652 | GGACTAGACTGTGGTAAGCA | AGG | chrX | 139533710 | 139533729 | 139533726 | + |
| SEQ ID NO 10653 | ACTGTGGTAAGCAAGGCCTG | TAG | chrX | 139533717 | 139533736 | 139533733 | + |
| SEQ ID NO 10654 | CTGTGGTAAGCAAGGCCTGT | AGG | chrX | 139533718 | 139533737 | 139533734 | + |
| SEQ ID NO 10655 | TGTGGTAAGCAAGGCCTGTA | GGG | chrX | 139533719 | 139533738 | 139533735 | + |
| SEQ ID NO 10656 | TAAATACTTGTATGCCCC | GAG | chrX | 139533744 | 139533763 | 139533760 | + |
| SEQ ID NO 10657 | ATATACTTGTATGCCCCGAG | AAG | chrX | 139533747 | 139533766 | 139533763 | + |
| SEQ ID NO 10658 | ACTTGTATGCCCCGAGAAGT | GAG | chrX | 139533751 | 139533770 | 139533767 | + |
| SEQ ID NO 10659 | CTTGTATGCCCCGAGAAGTG | AGG | chrX | 139533752 | 139533771 | 139533768 | + |
| SEQ ID NO 10660 | TGTGCCCTACATGCCTTGTT | TGG | chrX | 139533788 | 139533807 | 139533804 | + |

Figure 37 (Cont'd)

| | | | | | | | |
|---|---|---|---|---|---|---|---|
| SEQ ID NO 10661 | TGTTTGGTTCACTCTTGTCC | CAG | chrX | 139533804 | 139533823 | 139533820 | + |
| SEQ ID NO 10662 | GTTCACTCTTGTCCCAGCCC | TAG | chrX | 139533810 | 139533829 | 139533826 | + |
| SEQ ID NO 10663 | ACTCTTGTCCCAGCCCTAGC | AAG | chrX | 139533814 | 139533833 | 139533830 | + |
| SEQ ID NO 10664 | CAGCCCTAGCAAGTATATAT | AAG | chrX | 139533824 | 139533843 | 139533840 | + |
| SEQ ID NO 10665 | AGCCCTAGCAAGTATATATA | AGG | chrX | 139533825 | 139533844 | 139533841 | + |
| SEQ ID NO 10666 | CAAGTATATATAAGGTGAAA | AAG | chrX | 139533833 | 139533852 | 139533849 | + |
| SEQ ID NO 10667 | AAGTATATATAAGGTGAAAA | AGG | chrX | 139533834 | 139533853 | 139533850 | + |
| SEQ ID NO 10668 | ATATAAGGTGAAAAGGAAA | AAG | chrX | 139533840 | 139533859 | 139533856 | + |
| SEQ ID NO 10669 | AGGTGAAAAGGAAAAGCT | GAG | chrX | 139533845 | 139533864 | 139533861 | + |
| SEQ ID NO 10670 | GGTGAAAAGGAAAAGCTG | AGG | chrX | 139533846 | 139533865 | 139533862 | + |
| SEQ ID NO 10671 | AAAAAGGAAAAGCTGAGGC | TGG | chrX | 139533850 | 139533869 | 139533866 | + |
| SEQ ID NO 10672 | AAAGGAAAAGCTGAGGCTG | GAG | chrX | 139533852 | 139533871 | 139533868 | + |
| SEQ ID NO 10673 | AAAAGCTGAGGCTGGAGCC | TGG | chrX | 139533857 | 139533876 | 139533873 | + |
| SEQ ID NO 10674 | AAAAGCTGAGGCTGGAGCCT | GGG | chrX | 139533858 | 139533877 | 139533874 | + |
| SEQ ID NO 10675 | AAGCTGAGGCTGGAGCCTGG | GAG | chrX | 139533860 | 139533879 | 139533876 | + |
| SEQ ID NO 10676 | GCTGGAGCCTGGGAGAACCC | TGG | chrX | 139533868 | 139533887 | 139533884 | + |
| SEQ ID NO 10677 | TGGGAGAACCCTGGACATTT | AAG | chrX | 139533877 | 139533896 | 139533893 | + |
| SEQ ID NO 10678 | GGGAGAACCCTGGACATTTA | AGG | chrX | 139533878 | 139533897 | 139533894 | + |
| SEQ ID NO 10679 | GGAGAACCCTGGACATTTAA | GGG | chrX | 139533879 | 139533898 | 139533895 | + |
| SEQ ID NO 10680 | CCCTGGACATTTAAGGGCCA | TGG | chrX | 139533885 | 139533904 | 139533901 | + |
| SEQ ID NO 10681 | CTGGACATTTAAGGGCCATG | GAG | chrX | 139533887 | 139533906 | 139533903 | + |
| SEQ ID NO 10682 | GGACATTTAAGGGCCATGGA | GAG | chrX | 139533889 | 139533908 | 139533905 | + |
| SEQ ID NO 10683 | GACATTTAAGGGCCATGGAG | AGG | chrX | 139533890 | 139533909 | 139533906 | + |
| SEQ ID NO 10684 | TTAAGGGCCATGGAGAGGAA | CAG | chrX | 139533895 | 139533914 | 139533911 | + |
| SEQ ID NO 10685 | TAAGGGCCATGGAGAGGAAC | AGG | chrX | 139533896 | 139533915 | 139533912 | + |
| SEQ ID NO 10686 | AGGGCCATGGAGAGGAACAG | GAG | chrX | 139533898 | 139533917 | 139533914 | + |
| SEQ ID NO 10687 | GAACAGGAGTTAATCAATTC | AAG | chrX | 139533912 | 139533931 | 139533928 | + |
| SEQ ID NO 10688 | GAGTTAATCAATTCAAGTGC | TGG | chrX | 139533918 | 139533937 | 139533934 | + |
| SEQ ID NO 10689 | TAATCAATTCAAGTGCTGGA | TGG | chrX | 139533922 | 139533941 | 139533938 | + |
| SEQ ID NO 10690 | TTCAAGTGCTGGATGGATAA | CAG | chrX | 139533929 | 139533948 | 139533945 | + |
| SEQ ID NO 10691 | TCAAGTGCTGGATGGATAAC | AGG | chrX | 139533930 | 139533949 | 139533946 | + |
| SEQ ID NO 10692 | AAGTGCTGGATGGATAACAG | GAG | chrX | 139533932 | 139533951 | 139533948 | + |
| SEQ ID NO 10693 | GCTGGATGGATAACAGGAGT | TAG | chrX | 139533936 | 139533955 | 139533952 | + |
| SEQ ID NO 10694 | TGGATGGATAACAGGAGTTA | GAG | chrX | 139533938 | 139533957 | 139533954 | + |
| SEQ ID NO 10695 | GGATAACAGGAGTTAGAGCA | AAG | chrX | 139533943 | 139533962 | 139533959 | + |
| SEQ ID NO 10696 | TAACAGGAGTTAGAGCAAAG | CGG | chrX | 139533946 | 139533965 | 139533962 | + |
| SEQ ID NO 10697 | AACAGGAGTTAGAGCAAAGC | GGG | chrX | 139533947 | 139533966 | 139533963 | + |
| SEQ ID NO 10698 | ACAGGAGTTAGAGCAAAGCG | GGG | chrX | 139533948 | 139533967 | 139533964 | + |
| SEQ ID NO 10699 | GTTAGAGCAAAGCGGGGAAC | CAG | chrX | 139533954 | 139533973 | 139533970 | + |
| SEQ ID NO 10700 | AGCAAAGCGGGGAACCAGAA | TAG | chrX | 139533959 | 139533978 | 139533975 | + |
| SEQ ID NO 10701 | CAAAGCGGGAACCAGAATA | GAG | chrX | 139533961 | 139533980 | 139533977 | + |
| SEQ ID NO 10702 | AATAGAGTGATTATTATAAA | AAG | chrX | 139533977 | 139533996 | 139533993 | + |
| SEQ ID NO 10703 | TAGAGTGATTATTATAAAAA | GAG | chrX | 139533979 | 139533998 | 139533995 | + |
| SEQ ID NO 10704 | TATAAAAGAGTTTCCTAAA | AAG | chrX | 139533991 | 139534010 | 139534007 | + |
| SEQ ID NO 10705 | ATAAAAGAGTTTCCTAAAA | AGG | chrX | 139533992 | 139534011 | 139534008 | + |
| SEQ ID NO 10706 | TAAAAGAGTTTCCTAAAAA | GGG | chrX | 139533993 | 139534012 | 139534009 | + |
| SEQ ID NO 10707 | AAAAGAGTTTCCTAAAAAGG | GAG | chrX | 139533995 | 139534014 | 139534011 | + |
| SEQ ID NO 10708 | AAGAGTTTCCTAAAAGGGA | GAG | chrX | 139533997 | 139534016 | 139534013 | + |
| SEQ ID NO 10709 | AAAAGGGAGAGATCAACAAT | TAG | chrX | 139534009 | 139534028 | 139534025 | + |

Figure 37 (Cont'd)

| SEQ ID NO 10710 | ATCAACAATTAGAAATTATT | TAG | chrX | 139534020 | 139534039 | 139534036 | + |
| SEQ ID NO 10711 | CAACAATTAGAAATTATTTA | GAG | chrX | 139534022 | 139534041 | 139534038 | + |
| SEQ ID NO 10712 | CAATTAGAAATTATTTAGAG | CAG | chrX | 139534025 | 139534044 | 139534041 | + |
| SEQ ID NO 10713 | TAGAAATTATTTAGAGCAGC | CAG | chrX | 139534029 | 139534048 | 139534045 | + |
| SEQ ID NO 10714 | ATAAACTCAAAATTATTCTT | TAG | chrX | 139534059 | 139534078 | 139534075 | + |
| SEQ ID NO 10715 | TAAACTCAAAATTATTCTTT | AGG | chrX | 139534060 | 139534079 | 139534076 | + |
| SEQ ID NO 10716 | GTCATTCCTGATTGTGACAA | TAG | chrX | 139534082 | 139534101 | 139534098 | + |
| SEQ ID NO 10717 | TTCATTATATAAATGTGATT | AAG | chrX | 139534109 | 139534128 | 139534125 | + |
| SEQ ID NO 10718 | TCATTATATAAATGTGATTA | AGG | chrX | 139534110 | 139534129 | 139534126 | + |
| SEQ ID NO 10719 | TTATATAAATGTGATTAAGG | AAG | chrX | 139534113 | 139534132 | 139534129 | + |
| SEQ ID NO 10720 | TATATAAATGTGATTAAGGA | AGG | chrX | 139534114 | 139534133 | 139534130 | + |
| SEQ ID NO 10721 | AAATGTGATTAAGGAAGGAA | AAG | chrX | 139534119 | 139534138 | 139534135 | + |
| SEQ ID NO 10722 | ATGTGATTAAGGAAGGAAAA | GAG | chrX | 139534121 | 139534140 | 139534137 | + |
| SEQ ID NO 10723 | AAGGAAGGAAAAGAGCTACA | CAG | chrX | 139534129 | 139534148 | 139534145 | + |
| SEQ ID NO 10724 | GAAGGAAAAGAGCTACACAG | AAG | chrX | 139534132 | 139534151 | 139534148 | + |
| SEQ ID NO 10725 | GAGCTACACAGAAGTTATTA | AAG | chrX | 139534141 | 139534160 | 139534157 | + |
| SEQ ID NO 10726 | GCTACACAGAAGTTATTAAA | GAG | chrX | 139534143 | 139534162 | 139534159 | + |
| SEQ ID NO 10727 | CAGAAGTTATTAAAGAGCTA | AAG | chrX | 139534149 | 139534168 | 139534165 | + |
| SEQ ID NO 10728 | GAAGTTATTAAAGAGCTAAA | GAG | chrX | 139534151 | 139534170 | 139534167 | + |
| SEQ ID NO 10729 | TTAAAGAGCTAAAGAGAATT | GAG | chrX | 139534158 | 139534177 | 139534174 | + |
| SEQ ID NO 10730 | GAGAATTGAGAAATTTAAAA | CAG | chrX | 139534171 | 139534190 | 139534187 | + |
| SEQ ID NO 10731 | AATTGAGAAATTTAAAACAG | AAG | chrX | 139534174 | 139534193 | 139534190 | + |
| SEQ ID NO 10732 | GAGAAATTTAAAACAGAAGA | AAG | chrX | 139534178 | 139534197 | 139534194 | + |
| SEQ ID NO 10733 | AAATTTAAAACAGAAGAAAG | TAG | chrX | 139534181 | 139534200 | 139534197 | + |
| SEQ ID NO 10734 | AATTTAAAACAGAAGAAAGT | AGG | chrX | 139534182 | 139534201 | 139534198 | + |
| SEQ ID NO 10735 | ATTTAAAACAGAAGAAAGTA | GGG | chrX | 139534183 | 139534202 | 139534199 | + |
| SEQ ID NO 10736 | AGAAAGTAGGGCCAACATGA | AAG | chrX | 139534195 | 139534214 | 139534211 | + |
| SEQ ID NO 10737 | GAAAGTAGGGCCAACATGAA | AGG | chrX | 139534196 | 139534215 | 139534212 | + |
| SEQ ID NO 10738 | AAGTAGGGCCAACATGAAAG | GAG | chrX | 139534198 | 139534217 | 139534214 | + |
| SEQ ID NO 10739 | TAGGGCCAACATGAAAGGAG | TAG | chrX | 139534201 | 139534220 | 139534217 | + |
| SEQ ID NO 10740 | AGGGCCAACATGAAAGGAGT | AGG | chrX | 139534202 | 139534221 | 139534218 | + |
| SEQ ID NO 10741 | GGGCCAACATGAAAGGAGTA | GGG | chrX | 139534203 | 139534222 | 139534219 | + |
| SEQ ID NO 10742 | GCCAACATGAAAGGAGTAGG | GAG | chrX | 139534205 | 139534224 | 139534221 | + |
| SEQ ID NO 10743 | ATGAAAGGAGTAGGGAGAAA | AAG | chrX | 139534211 | 139534230 | 139534227 | + |
| SEQ ID NO 10744 | GAAAGGAGTAGGGAGAAAAA | GAG | chrX | 139534213 | 139534232 | 139534229 | + |
| SEQ ID NO 10745 | TAGGGAGAAAAAGAGATAAC | CAG | chrX | 139534221 | 139534240 | 139534237 | + |
| SEQ ID NO 10746 | CTGATCCTGCCAACACCTGT | GAG | chrX | 139534256 | 139534275 | 139534272 | + |
| SEQ ID NO 10747 | TCCTGCCAACACCTGTGAGA | TAG | chrX | 139534260 | 139534279 | 139534276 | + |
| SEQ ID NO 10748 | AACCTAATTTACATTTGACA | AAG | chrX | 139534306 | 139534325 | 139534322 | + |
| SEQ ID NO 10749 | AATTTACATTTGACAAAGTT | AAG | chrX | 139534311 | 139534330 | 139534327 | + |
| SEQ ID NO 10750 | ATTTACATTTGACAAAGTTA | AGG | chrX | 139534312 | 139534331 | 139534328 | + |
| SEQ ID NO 10751 | CATTTGACAAAGTTAAGGTT | CAG | chrX | 139534317 | 139534336 | 139534333 | + |
| SEQ ID NO 10752 | TTTGACAAAGTTAAGGTTCA | GAG | chrX | 139534319 | 139534338 | 139534335 | + |
| SEQ ID NO 10753 | AGAGCTTGTGTGACTTGTCC | AAG | chrX | 139534338 | 139534357 | 139534354 | + |
| SEQ ID NO 10754 | GAGCTTGTGTGACTTGTCCA | AGG | chrX | 139534339 | 139534358 | 139534355 | + |
| SEQ ID NO 10755 | GTGTGACTTGTCCAAGGTCA | CAG | chrX | 139534345 | 139534364 | 139534361 | + |
| SEQ ID NO 10756 | TGTGACTTGTCCAAGGTCAC | AGG | chrX | 139534346 | 139534365 | 139534362 | + |
| SEQ ID NO 10757 | CTTGTCCAAGGTCACAGGTC | TAG | chrX | 139534351 | 139534370 | 139534367 | + |
| SEQ ID NO 10758 | TGTCCAAGGTCACAGGTCTA | GAG | chrX | 139534353 | 139534372 | 139534369 | + |

Figure 37 (Cont'd)

| | | | | | | | |
|---|---|---|---|---|---|---|---|
| SEQ ID NO 10759 | GTCCAAGGTCACAGGTCTAG | AGG | chrX | 139534354 | 139534373 | 139534370 | + |
| SEQ ID NO 10760 | CCAAGGTCACAGGTCTAGAG | GAG | chrX | 139534356 | 139534375 | 139534372 | + |
| SEQ ID NO 10761 | CAAGGTCACAGGTCTAGAGG | AGG | chrX | 139534357 | 139534376 | 139534373 | + |
| SEQ ID NO 10762 | GGTCACAGGTCTAGAGGAGG | CAG | chrX | 139534360 | 139534379 | 139534376 | + |
| SEQ ID NO 10763 | TTCTGTCTGATCTGATTCTA | AAG | chrX | 139534402 | 139534421 | 139534418 | + |
| SEQ ID NO 10764 | TTTCACTCAACCACACTGTA | CAG | chrX | 139534432 | 139534451 | 139534448 | + |
| SEQ ID NO 10765 | ACTCAACCACACTGTACAGT | CAG | chrX | 139534436 | 139534455 | 139534452 | + |
| SEQ ID NO 10766 | GTACAGTCAGCTCTCCTTGT | GAG | chrX | 139534449 | 139534468 | 139534465 | + |
| SEQ ID NO 10767 | AGCTCTCCTTGTGAGTTCCA | CAG | chrX | 139534457 | 139534476 | 139534473 | + |
| SEQ ID NO 10768 | CCTTGTGAGTTCCACAGCCA | CAG | chrX | 139534463 | 139534482 | 139534479 | + |
| SEQ ID NO 10769 | GCCACAGATTCAATTAACTG | CAG | chrX | 139534479 | 139534498 | 139534495 | + |
| SEQ ID NO 10770 | ACTGCAGATCAAAATATTC | AAG | chrX | 139534495 | 139534514 | 139534511 | + |
| SEQ ID NO 10771 | AAAAATATTCAAGAAAAAAA | TGG | chrX | 139534505 | 139534524 | 139534521 | + |
| SEQ ID NO 10772 | ATATTCAAGAAAAAATGGA | TGG | chrX | 139534509 | 139534528 | 139534525 | + |
| SEQ ID NO 10773 | GCATCTCTACTGAACATGTA | CAG | chrX | 139534534 | 139534553 | 139534550 | + |
| SEQ ID NO 10774 | TCATTATTCCCTAAACAATA | CAG | chrX | 139534570 | 139534589 | 139534586 | + |
| SEQ ID NO 10775 | CAGCATAACAACTATTTACA | TAG | chrX | 139534590 | 139534609 | 139534606 | + |
| SEQ ID NO 10776 | ACATAGCATTTACATTGTAT | TAG | chrX | 139534607 | 139534626 | 139534623 | + |
| SEQ ID NO 10777 | TTTACATTGTATTAGCTATT | AAG | chrX | 139534615 | 139534634 | 139534631 | + |
| SEQ ID NO 10778 | TACATTGTATTAGCTATTAA | GAG | chrX | 139534617 | 139534636 | 139534633 | + |
| SEQ ID NO 10779 | ATTAGCTATTAAGAGAAACC | TAG | chrX | 139534625 | 139534644 | 139534641 | + |
| SEQ ID NO 10780 | TAGCTATTAAGAGAAACCTA | GAG | chrX | 139534627 | 139534646 | 139534643 | + |
| SEQ ID NO 10781 | AGAAACCTAGAGATGATTTA | AAG | chrX | 139534638 | 139534657 | 139534654 | + |
| SEQ ID NO 10782 | TAGAGATGATTTAAAGTACA | AAG | chrX | 139534645 | 139534664 | 139534661 | + |
| SEQ ID NO 10783 | AGAGATGATTTAAAGTACAA | AGG | chrX | 139534646 | 139534665 | 139534662 | + |
| SEQ ID NO 10784 | AGATGATTTAAAGTACAAAG | GAG | chrX | 139534648 | 139534667 | 139534664 | + |
| SEQ ID NO 10785 | GATGATTTAAAGTACAAAGG | AGG | chrX | 139534649 | 139534668 | 139534665 | + |
| SEQ ID NO 10786 | AGTACAAAGGAGGATGTGTT | TAG | chrX | 139534659 | 139534678 | 139534675 | + |
| SEQ ID NO 10787 | GTACAAAGGAGGATGTGTTT | AGG | chrX | 139534660 | 139534679 | 139534676 | + |
| SEQ ID NO 10788 | GTGTTTAGGTTATATGCAAA | TAG | chrX | 139534674 | 139534693 | 139534690 | + |
| SEQ ID NO 10789 | TTAGGTTATATGCAAATAGT | AAG | chrX | 139534678 | 139534697 | 139534694 | + |
| SEQ ID NO 10790 | ATAGTAAGCCATTTTATAT | CGG | chrX | 139534693 | 139534712 | 139534709 | + |
| SEQ ID NO 10791 | AGTAAGCCATTTTATATCG | GAG | chrX | 139534695 | 139534714 | 139534711 | + |
| SEQ ID NO 10792 | CATTTTTATATCGGAGACTT | GAG | chrX | 139534702 | 139534721 | 139534718 | + |
| SEQ ID NO 10793 | ATCGGAGACTTGAGCATCCA | CAG | chrX | 139534711 | 139534730 | 139534727 | + |
| SEQ ID NO 10794 | TCCACAGATCTTGATATTTG | CAG | chrX | 139534727 | 139534746 | 139534743 | + |
| SEQ ID NO 10795 | CCACAGATCTTGATATTTGC | AGG | chrX | 139534728 | 139534747 | 139534744 | + |
| SEQ ID NO 10796 | CACAGATCTTGATATTTGCA | GGG | chrX | 139534729 | 139534748 | 139534745 | + |
| SEQ ID NO 10797 | ACAGATCTTGATATTTGCAG | GGG | chrX | 139534730 | 139534749 | 139534746 | + |
| SEQ ID NO 10798 | CAGATCTTGATATTTGCAGG | GGG | chrX | 139534731 | 139534750 | 139534747 | + |
| SEQ ID NO 10799 | GTCTTGCCACCAATTTTCCA | TGG | chrX | 139534753 | 139534772 | 139534769 | + |
| SEQ ID NO 10800 | ACCAATTTTCCATGGATACT | GAG | chrX | 139534761 | 139534780 | 139534777 | + |
| SEQ ID NO 10801 | CCAATTTTCCATGGATACTG | AGG | chrX | 139534762 | 139534781 | 139534778 | + |
| SEQ ID NO 10802 | TACTGAGGAACGACTGTAAA | TGG | chrX | 139534777 | 139534796 | 139534793 | + |
| SEQ ID NO 10803 | GGAACGACTGTAAATGGATG | CAG | chrX | 139534783 | 139534802 | 139534799 | + |
| SEQ ID NO 10804 | GAACGACTGTAAATGGATGC | AGG | chrX | 139534784 | 139534803 | 139534800 | + |
| SEQ ID NO 10805 | ACTGTAAATGGATGCAGGCA | TGG | chrX | 139534789 | 139534808 | 139534805 | + |
| SEQ ID NO 10806 | ATGCAGGCATGGATGCTATT | TAG | chrX | 139534800 | 139534819 | 139534816 | + |
| SEQ ID NO 10807 | TGCAGGCATGGATGCTATTT | AGG | chrX | 139534801 | 139534820 | 139534817 | + |

Figure 37 (Cont'd)

| | | | | | | | |
|---|---|---|---|---|---|---|---|
| SEQ ID NO 10808 | CAGGCATGGATGCTATTTAG | GAG | chrX | 139534803 | 139534822 | 139534819 | + |
| SEQ ID NO 10809 | GGATGCTATTTAGGAGTGTC | CAG | chrX | 139534810 | 139534829 | 139534826 | + |
| SEQ ID NO 10810 | GATGCTATTTAGGAGTGTCC | AGG | chrX | 139534811 | 139534830 | 139534827 | + |
| SEQ ID NO 10811 | ATGCTATTTAGGAGTGTCCA | GGG | chrX | 139534812 | 139534831 | 139534828 | + |
| SEQ ID NO 10812 | ATTTAGGAGTGTCCAGGGCC | AAG | chrX | 139534817 | 139534836 | 139534833 | + |
| SEQ ID NO 10813 | GTGTCCAGGGCCAAGTAAAT | GAG | chrX | 139534825 | 139534844 | 139534841 | + |
| SEQ ID NO 10814 | GGCCAAGTAAATGAGTTGCT | GAG | chrX | 139534833 | 139534852 | 139534849 | + |
| SEQ ID NO 10815 | CAAGTAAATGAGTTGCTGAG | CAG | chrX | 139534836 | 139534855 | 139534852 | + |
| SEQ ID NO 10816 | AGTAAATGAGTTGCTGAGCA | GAG | chrX | 139534838 | 139534857 | 139534854 | + |
| SEQ ID NO 10817 | TAAATGAGTTGCTGAGCAGA | GAG | chrX | 139534840 | 139534859 | 139534856 | + |
| SEQ ID NO 10818 | AAATGAGTTGCTGAGCAGAG | AGG | chrX | 139534841 | 139534860 | 139534857 | + |
| SEQ ID NO 10819 | TGAGTTGCTGAGCAGAGAGG | TGG | chrX | 139534844 | 139534863 | 139534860 | + |
| SEQ ID NO 10820 | GAGTTGCTGAGCAGAGAGGT | GGG | chrX | 139534845 | 139534864 | 139534861 | + |
| SEQ ID NO 10821 | TTGCTGAGCAGAGAGGTGGG | TGG | chrX | 139534848 | 139534867 | 139534864 | + |
| SEQ ID NO 10822 | GCTGAGCAGAGAGGTGGGTG | GAG | chrX | 139534850 | 139534869 | 139534866 | + |
| SEQ ID NO 10823 | CTGAGCAGAGAGGTGGGTGG | AGG | chrX | 139534851 | 139534870 | 139534867 | + |
| SEQ ID NO 10824 | GAGAGGTGGGTGGAGGCTGT | GAG | chrX | 139534858 | 139534877 | 139534874 | + |
| SEQ ID NO 10825 | AGAGGTGGGTGGAGGCTGTG | AGG | chrX | 139534859 | 139534878 | 139534875 | + |
| SEQ ID NO 10826 | GGCTGTGAGGCATCAATATG | TGG | chrX | 139534872 | 139534891 | 139534888 | + |
| SEQ ID NO 10827 | TGTGAGGCATCAATATGTGG | TGG | chrX | 139534875 | 139534894 | 139534891 | + |
| SEQ ID NO 10828 | GGTGGCATCCATCTGCATTT | TGG | chrX | 139534893 | 139534912 | 139534909 | + |
| SEQ ID NO 10829 | TTGGTGATTTTTTTCCTTCA | CAG | chrX | 139534912 | 139534931 | 139534928 | + |
| SEQ ID NO 10830 | TTTTTTTCCTTCACAGTCCT | CGG | chrX | 139534919 | 139534938 | 139534935 | + |
| SEQ ID NO 10831 | CTTCACAGTCCTCGGCTGTC | TGG | chrX | 139534927 | 139534946 | 139534943 | + |
| SEQ ID NO 10832 | TTCACAGTCCTCGGCTGTCT | GGG | chrX | 139534928 | 139534947 | 139534944 | + |
| SEQ ID NO 10833 | ACAGTCCTCGGCTGTCTGGG | AAG | chrX | 139534931 | 139534950 | 139534947 | + |
| SEQ ID NO 10834 | AGTCCTCGGCTGTCTGGGAA | GAG | chrX | 139534933 | 139534952 | 139534949 | + |
| SEQ ID NO 10835 | CCTCGGCTGTCTGGGAAGAG | AAG | chrX | 139534936 | 139534955 | 139534952 | + |
| SEQ ID NO 10836 | CTCGGCTGTCTGGGAAGAGA | AGG | chrX | 139534937 | 139534956 | 139534953 | + |
| SEQ ID NO 10837 | TGTCTGGGAAGAGAAGGATG | AAG | chrX | 139534943 | 139534962 | 139534959 | + |
| SEQ ID NO 10838 | GTCTGGGAAGAGAAGGATGA | AGG | chrX | 139534944 | 139534963 | 139534960 | + |
| SEQ ID NO 10839 | TGGGAAGAGAAGGATGAAGG | CAG | chrX | 139534947 | 139534966 | 139534963 | + |
| SEQ ID NO 10840 | AAGAGAAGGATGAAGGCAGA | TGG | chrX | 139534951 | 139534970 | 139534967 | + |
| SEQ ID NO 10841 | GGCAGATGGCTGCTCCAATT | TAG | chrX | 139534965 | 139534984 | 139534981 | + |
| SEQ ID NO 10842 | GCAGATGGCTGCTCCAATTT | AGG | chrX | 139534966 | 139534985 | 139534982 | + |
| SEQ ID NO 10843 | CAGATGGCTGCTCCAATTTA | GGG | chrX | 139534967 | 139534986 | 139534983 | + |
| SEQ ID NO 10844 | AGATGGCTGCTCCAATTTAG | GGG | chrX | 139534968 | 139534987 | 139534984 | + |
| SEQ ID NO 10845 | GGCTGCTCCAATTTAGGGGC | TAG | chrX | 139534972 | 139534991 | 139534988 | + |
| SEQ ID NO 10846 | GCTGCTCCAATTTAGGGGCT | AGG | chrX | 139534973 | 139534992 | 139534989 | + |
| SEQ ID NO 10847 | CAATTTAGGGGCTAGGATTG | CAG | chrX | 139534980 | 139534999 | 139534996 | + |
| SEQ ID NO 10848 | AATTTAGGGGCTAGGATTGC | AGG | chrX | 139534981 | 139535000 | 139534997 | + |
| SEQ ID NO 10849 | ATTTAGGGGCTAGGATTGCA | GGG | chrX | 139534982 | 139535001 | 139534998 | + |
| SEQ ID NO 10850 | TAGGGGCTAGGATTGCAGGG | TGG | chrX | 139534985 | 139535004 | 139535001 | + |
| SEQ ID NO 10851 | AGGGGCTAGGATTGCAGGGT | GGG | chrX | 139534986 | 139535005 | 139535002 | + |
| SEQ ID NO 10852 | CTAGGATTGCAGGGTGGGCA | CAG | chrX | 139534991 | 139535010 | 139535007 | + |
| SEQ ID NO 10853 | GTGGGCACAGCATTGCAAAC | GAG | chrX | 139535004 | 139535023 | 139535020 | + |
| SEQ ID NO 10854 | CACAGCATTGCAAACGAGTG | AAG | chrX | 139535009 | 139535028 | 139535025 | + |
| SEQ ID NO 10855 | ACAGCATTGCAAACGAGTGA | AGG | chrX | 139535010 | 139535029 | 139535026 | + |
| SEQ ID NO 10856 | GCAAACGAGTGAAGGAAATT | GAG | chrX | 139535018 | 139535037 | 139535034 | + |

Figure 37 (Cont'd)

| | | | | | | | |
|---|---|---|---|---|---|---|---|
| SEQ ID NO 10857 | GTGAAGGAAATTGAGAAATA | TGG | chrX | 139535026 | 139535045 | 139535042 | + |
| SEQ ID NO 10858 | ATTGAGAAATATGGCCAATG | AAG | chrX | 139535035 | 139535054 | 139535051 | + |
| SEQ ID NO 10859 | TGAGAAATATGGCCAATGAA | GAG | chrX | 139535037 | 139535056 | 139535053 | + |
| SEQ ID NO 10860 | ATATGGCCAATGAAGAGTTG | AAG | chrX | 139535043 | 139535062 | 139535059 | + |
| SEQ ID NO 10861 | ATGGCCAATGAAGAGTTGAA | GAG | chrX | 139535045 | 139535064 | 139535061 | + |
| SEQ ID NO 10862 | GGCCAATGAAGAGTTGAAGA | GAG | chrX | 139535047 | 139535066 | 139535063 | + |
| SEQ ID NO 10863 | GCCAATGAAGAGTTGAAGAG | AGG | chrX | 139535048 | 139535067 | 139535064 | + |
| SEQ ID NO 10864 | TGAAGAGTTGAAGAGAGGCC | TGG | chrX | 139535053 | 139535072 | 139535069 | + |
| SEQ ID NO 10865 | AGTTGAAGAGAGGCCTGGCA | TGG | chrX | 139535058 | 139535077 | 139535074 | + |
| SEQ ID NO 10866 | TGAAGAGAGGCCTGGCATGG | TGG | chrX | 139535061 | 139535080 | 139535077 | + |
| SEQ ID NO 10867 | GTGGCTCACACCTATAATCC | CAG | chrX | 139535080 | 139535099 | 139535096 | + |
| SEQ ID NO 10868 | ACCTATAATCCCAGCACTTT | CAG | chrX | 139535089 | 139535108 | 139535105 | + |
| SEQ ID NO 10869 | CTATAATCCCAGCACTTTCA | GAG | chrX | 139535091 | 139535110 | 139535107 | + |
| SEQ ID NO 10870 | TATAATCCCAGCACTTTCAG | AGG | chrX | 139535092 | 139535111 | 139535108 | + |
| SEQ ID NO 10871 | TCCCAGCACTTTCAGAGGCC | CAG | chrX | 139535097 | 139535116 | 139535113 | + |
| SEQ ID NO 10872 | CCCAGCACTTTCAGAGGCCC | AGG | chrX | 139535098 | 139535117 | 139535114 | + |
| SEQ ID NO 10873 | AGCACTTTCAGAGGCCCAGG | CAG | chrX | 139535101 | 139535120 | 139535117 | + |
| SEQ ID NO 10874 | GCACTTTCAGAGGCCCAGGC | AGG | chrX | 139535102 | 139535121 | 139535118 | + |
| SEQ ID NO 10875 | CTTTCAGAGGCCCAGGCAGG | CAG | chrX | 139535105 | 139535124 | 139535121 | + |
| SEQ ID NO 10876 | CCCAGGCAGGCAGATCACTT | GAG | chrX | 139535115 | 139535134 | 139535131 | + |
| SEQ ID NO 10877 | CCAGGCAGGCAGATCACTTG | AGG | chrX | 139535116 | 139535135 | 139535132 | + |
| SEQ ID NO 10878 | GCAGGCAGATCACTTGAGGT | CAG | chrX | 139535120 | 139535139 | 139535136 | + |
| SEQ ID NO 10879 | CAGGCAGATCACTTGAGGTC | AGG | chrX | 139535121 | 139535140 | 139535137 | + |
| SEQ ID NO 10880 | GGCAGATCACTTGAGGTCAG | GAG | chrX | 139535123 | 139535142 | 139535139 | + |
| SEQ ID NO 10881 | TGAGGTCAGGAGTTCGACAC | CAG | chrX | 139535134 | 139535153 | 139535150 | + |
| SEQ ID NO 10882 | TCAGGAGTTCGACACCAGCC | TGG | chrX | 139535139 | 139535158 | 139535155 | + |
| SEQ ID NO 10883 | TCGACACCAGCCTGGCCAAC | AAG | chrX | 139535147 | 139535166 | 139535163 | + |
| SEQ ID NO 10884 | CGACACCAGCCTGGCCAACA | AGG | chrX | 139535148 | 139535167 | 139535164 | + |
| SEQ ID NO 10885 | GCCTGGCCAACAAGGTGAAA | TGG | chrX | 139535156 | 139535175 | 139535172 | + |
| SEQ ID NO 10886 | AAGGTGAAATGGTGAAACCC | CGG | chrX | 139535167 | 139535186 | 139535183 | + |
| SEQ ID NO 10887 | TTTACTAAAAATACAAAAAT | TAG | chrX | 139535191 | 139535210 | 139535207 | + |
| SEQ ID NO 10888 | CTAAAAATACAAAAATTAGC | TGG | chrX | 139535195 | 139535214 | 139535211 | + |
| SEQ ID NO 10889 | TAAAAATACAAAAATTAGCT | GGG | chrX | 139535196 | 139535215 | 139535212 | + |
| SEQ ID NO 10890 | ATACAAAAATTAGCTGGGCA | TGG | chrX | 139535201 | 139535220 | 139535217 | + |
| SEQ ID NO 10891 | CAAAAATTAGCTGGGCATGG | TGG | chrX | 139535204 | 139535223 | 139535220 | + |
| SEQ ID NO 10892 | AAATTAGCTGGGCATGGTGG | CGG | chrX | 139535207 | 139535226 | 139535223 | + |
| SEQ ID NO 10893 | AATTAGCTGGGCATGGTGGC | GGG | chrX | 139535208 | 139535227 | 139535224 | + |
| SEQ ID NO 10894 | GTGGCGGTGCCTGTAATCC | CAG | chrX | 139535223 | 139535242 | 139535239 | + |
| SEQ ID NO 10895 | TGCCTGTAATCCCAGCTACT | TGG | chrX | 139535231 | 139535250 | 139535247 | + |
| SEQ ID NO 10896 | GCCTGTAATCCCAGCTACTT | GGG | chrX | 139535232 | 139535251 | 139535248 | + |
| SEQ ID NO 10897 | CTGTAATCCCAGCTACTTGG | GAG | chrX | 139535234 | 139535253 | 139535250 | + |
| SEQ ID NO 10898 | TGTAATCCCAGCTACTTGGG | AGG | chrX | 139535235 | 139535254 | 139535251 | + |
| SEQ ID NO 10899 | TCCCAGCTACTTGGGAGGCT | GAG | chrX | 139535240 | 139535259 | 139535256 | + |
| SEQ ID NO 10900 | CCCAGCTACTTGGGAGGCTG | AGG | chrX | 139535241 | 139535260 | 139535257 | + |
| SEQ ID NO 10901 | AGCTACTTGGGAGGCTGAGG | CAG | chrX | 139535244 | 139535263 | 139535260 | + |
| SEQ ID NO 10902 | GCTACTTGGGAGGCTGAGGC | AGG | chrX | 139535245 | 139535264 | 139535261 | + |
| SEQ ID NO 10903 | TACTTGGGAGGCTGAGGCAG | GAG | chrX | 139535247 | 139535266 | 139535263 | + |
| SEQ ID NO 10904 | GGGAGGCTGAGGCAGGAGAA | TAG | chrX | 139535252 | 139535271 | 139535268 | + |
| SEQ ID NO 10905 | GCAGGAGAATAGCTTGAACC | TGG | chrX | 139535263 | 139535282 | 139535279 | + |

Figure 37 (Cont'd)

| | | | | | | | |
|---|---|---|---|---|---|---|---|
| SEQ ID NO 10906 | CAGGAGAATAGCTTGAACCT | GGG | chrX | 139535264 | 139535283 | 139535280 | + |
| SEQ ID NO 10907 | GGAGAATAGCTTGAACCTGG | GAG | chrX | 139535266 | 139535285 | 139535282 | + |
| SEQ ID NO 10908 | AATAGCTTGAACCTGGGAGA | TGG | chrX | 139535270 | 139535289 | 139535286 | + |
| SEQ ID NO 10909 | TAGCTTGAACCTGGGAGATG | GAG | chrX | 139535272 | 139535291 | 139535288 | + |
| SEQ ID NO 10910 | AGCTTGAACCTGGGAGATGG | AGG | chrX | 139535273 | 139535292 | 139535289 | + |
| SEQ ID NO 10911 | AACCTGGGAGATGGAGGTTG | CAG | chrX | 139535279 | 139535298 | 139535295 | + |
| SEQ ID NO 10912 | TGGGAGATGGAGGTTGCAGT | GAG | chrX | 139535283 | 139535302 | 139535299 | + |
| SEQ ID NO 10913 | GATGGAGGTTGCAGTGAGCT | GAG | chrX | 139535288 | 139535307 | 139535304 | + |
| SEQ ID NO 10914 | GAGATCGCACCACTGCACTC | CAG | chrX | 139535308 | 139535327 | 139535324 | + |
| SEQ ID NO 10915 | CGCACCACTGCACTCCAGCC | TGG | chrX | 139535313 | 139535332 | 139535329 | + |
| SEQ ID NO 10916 | GCACCACTGCACTCCAGCCT | GGG | chrX | 139535314 | 139535333 | 139535330 | + |
| SEQ ID NO 10917 | CTGCACTCCAGCCTGGGCGA | CAG | chrX | 139535320 | 139535339 | 139535336 | + |
| SEQ ID NO 10918 | GCACTCCAGCCTGGGCGACA | GAG | chrX | 139535322 | 139535341 | 139535338 | + |
| SEQ ID NO 10919 | TCCAGCCTGGGCGACAGAGC | AAG | chrX | 139535326 | 139535345 | 139535342 | + |
| SEQ ID NO 10920 | CAAGACTCTGTCAAAAAAAA | AAG | chrX | 139535345 | 139535364 | 139535361 | + |
| SEQ ID NO 10921 | AGACTCTGTCAAAAAAAAAA | GAG | chrX | 139535347 | 139535366 | 139535363 | + |
| SEQ ID NO 10922 | TGTCAAAAAAAAAAGAGTTG | AAG | chrX | 139535353 | 139535372 | 139535369 | + |
| SEQ ID NO 10923 | TCAAAAAAAAAAGAGTTGAA | GAG | chrX | 139535355 | 139535374 | 139535371 | + |
| SEQ ID NO 10924 | AAAAAAGAGTTGAAGAGAAA | AAG | chrX | 139535361 | 139535380 | 139535377 | + |
| SEQ ID NO 10925 | AGAGTTGAAGAGAAAAGTC | TAG | chrX | 139535366 | 139535385 | 139535382 | + |
| SEQ ID NO 10926 | GAGTTGAAGAGAAAAGTCT | AGG | chrX | 139535367 | 139535386 | 139535383 | + |
| SEQ ID NO 10927 | AAAAGTCTAGGCTAAATTCA | AAG | chrX | 139535379 | 139535398 | 139535395 | + |
| SEQ ID NO 10928 | AGGCTAAATTCAAAGAAAAA | AAG | chrX | 139535387 | 139535406 | 139535403 | + |
| SEQ ID NO 10929 | TAAATTCAAAGAAAAAAGT | GAG | chrX | 139535391 | 139535410 | 139535407 | + |
| SEQ ID NO 10930 | AAGAAAAAAGTGAGCCCAA | AAG | chrX | 139535399 | 139535418 | 139535415 | + |
| SEQ ID NO 10931 | AGAAAAAAGTGAGCCCAAA | AGG | chrX | 139535400 | 139535419 | 139535416 | + |
| SEQ ID NO 10932 | GTGAGCCCAAAAGGAACTTG | CAG | chrX | 139535409 | 139535428 | 139535425 | + |
| SEQ ID NO 10933 | GAGCCCAAAAGGAACTTGCA | GAG | chrX | 139535411 | 139535430 | 139535427 | + |
| SEQ ID NO 10934 | CCAAAAGGAACTTGCAGAGC | AAG | chrX | 139535415 | 139535434 | 139535431 | + |
| SEQ ID NO 10935 | CAAAAGGAACTTGCAGAGCA | AGG | chrX | 139535416 | 139535435 | 139535432 | + |
| SEQ ID NO 10936 | AAAAGGAACTTGCAGAGCAA | GGG | chrX | 139535417 | 139535436 | 139535433 | + |
| SEQ ID NO 10937 | GAACTTGCAGAGCAAGGGAA | AAG | chrX | 139535422 | 139535441 | 139535438 | + |
| SEQ ID NO 10938 | CTTGCAGAGCAAGGGAAAAG | CAG | chrX | 139535425 | 139535444 | 139535441 | + |
| SEQ ID NO 10939 | TTGCAGAGCAAGGGAAAAGC | AGG | chrX | 139535426 | 139535445 | 139535442 | + |
| SEQ ID NO 10940 | TGCAGAGCAAGGGAAAAGCA | GGG | chrX | 139535427 | 139535446 | 139535443 | + |
| SEQ ID NO 10941 | AAGGGAAAAGCAGGGATGTC | AAG | chrX | 139535435 | 139535454 | 139535451 | + |
| SEQ ID NO 10942 | AGGGAAAAGCAGGGATGTCA | AGG | chrX | 139535436 | 139535455 | 139535452 | + |
| SEQ ID NO 10943 | GGGAAAAGCAGGGATGTCAA | GGG | chrX | 139535437 | 139535456 | 139535453 | + |
| SEQ ID NO 10944 | AAGCAGGGATGTCAAGGGAC | TAG | chrX | 139535442 | 139535461 | 139535458 | + |
| SEQ ID NO 10945 | AGGGACTAGAACACTCCATA | AAG | chrX | 139535456 | 139535475 | 139535472 | + |
| SEQ ID NO 10946 | AGAACACTCCATAAAGTGAA | CAG | chrX | 139535463 | 139535482 | 139535479 | + |
| SEQ ID NO 10947 | TGAACAGCTGCAATGAAAAT | AAG | chrX | 139535479 | 139535498 | 139535495 | + |
| SEQ ID NO 10948 | GAACAGCTGCAATGAAAATA | AGG | chrX | 139535480 | 139535499 | 139535496 | + |
| SEQ ID NO 10949 | AACAGCTGCAATGAAAATAA | GGG | chrX | 139535481 | 139535500 | 139535497 | + |
| SEQ ID NO 10950 | AGCTGCAATGAAAATAAGGG | AAG | chrX | 139535484 | 139535503 | 139535500 | + |
| SEQ ID NO 10951 | GCAATGAAAATAAGGGAAGA | AAG | chrX | 139535488 | 139535507 | 139535504 | + |
| SEQ ID NO 10952 | GAAAATAAGGGAAGAAAGTT | TAG | chrX | 139535493 | 139535512 | 139535509 | + |
| SEQ ID NO 10953 | CTTTCCTTTCTCTTCCTTTT | TGG | chrX | 139535546 | 139535565 | 139535562 | + |
| SEQ ID NO 10954 | TTCCTTTCTCTTCCTTTTTG | GAG | chrX | 139535548 | 139535567 | 139535564 | + |

Figure 37 (Cont'd)

| | | | | | | | |
|---|---|---|---|---|---|---|---|
| SEQ ID NO 10955 | TCTTCCTTTTTGGAGTTAAT | CAG | chrX | 139535556 | 139535575 | 139535572 | + |
| SEQ ID NO 10956 | CTTCCTTTTTGGAGTTAATC | AGG | chrX | 139535557 | 139535576 | 139535573 | + |
| SEQ ID NO 10957 | CCTTTTTGGAGTTAATCAGG | AAG | chrX | 139535560 | 139535579 | 139535576 | + |
| SEQ ID NO 10958 | TTTTGGAGTTAATCAGGAAG | TAG | chrX | 139535563 | 139535582 | 139535579 | + |
| SEQ ID NO 10959 | GGAAGTAGTCCCAAATACCC | CAG | chrX | 139535578 | 139535597 | 139535594 | + |
| SEQ ID NO 10960 | GTAGTCCCAAATACCCCAGA | AAG | chrX | 139535582 | 139535601 | 139535598 | + |
| SEQ ID NO 10961 | CCCCAGAAAGTTCATCTTAT | AAG | chrX | 139535595 | 139535614 | 139535611 | + |
| SEQ ID NO 10962 | AAGTTCATCTTATAAGCCCT | TGG | chrX | 139535602 | 139535621 | 139535618 | + |
| SEQ ID NO 10963 | TATAAGCCCTTGGTCCTCTT | GAG | chrX | 139535612 | 139535631 | 139535628 | + |
| SEQ ID NO 10964 | AGCCCTTGGTCCTCTTGAGA | TGG | chrX | 139535616 | 139535635 | 139535632 | + |
| SEQ ID NO 10965 | TGGTCCTCTTGAGATGGTAT | CAG | chrX | 139535622 | 139535641 | 139535638 | + |
| SEQ ID NO 10966 | GATGGTATCAGATATATTGC | TAG | chrX | 139535634 | 139535653 | 139535650 | + |
| SEQ ID NO 10967 | GATATATTGCTAGACCCTTG | AAG | chrX | 139535644 | 139535663 | 139535660 | + |
| SEQ ID NO 10968 | TATTGCTAGACCCTTGAAGA | AAG | chrX | 139535648 | 139535667 | 139535664 | + |
| SEQ ID NO 10969 | ATTGCTAGACCCTTGAAGAA | AGG | chrX | 139535649 | 139535668 | 139535665 | + |
| SEQ ID NO 10970 | CTTGAAGAAAGGAACAACTC | CAG | chrX | 139535660 | 139535679 | 139535676 | + |
| SEQ ID NO 10971 | TTGAAGAAAGGAACAACTCC | AGG | chrX | 139535661 | 139535680 | 139535677 | + |
| SEQ ID NO 10972 | ACAACTCCAGGCAACTTCTT | GAG | chrX | 139535673 | 139535692 | 139535689 | + |
| SEQ ID NO 10973 | CAAACACATGTGTGTGTATA | CAG | chrX | 139535752 | 139535771 | 139535768 | + |
| SEQ ID NO 10974 | AGCCATGCATTCCTTAACAA | TGG | chrX | 139535773 | 139535792 | 139535789 | + |
| SEQ ID NO 10975 | GCCATGCATTCCTTAACAAT | GGG | chrX | 139535774 | 139535793 | 139535790 | + |
| SEQ ID NO 10976 | CCATGCATTCCTTAACAATG | GGG | chrX | 139535775 | 139535794 | 139535791 | + |
| SEQ ID NO 10977 | TAACAATGGGGATATATTCT | GAG | chrX | 139535787 | 139535806 | 139535803 | + |
| SEQ ID NO 10978 | ATTCTGAGAAATGTGTCATT | AAG | chrX | 139535802 | 139535821 | 139535818 | + |
| SEQ ID NO 10979 | TCATCATTGTGCGAACATAA | TAG | chrX | 139535830 | 139535849 | 139535846 | + |
| SEQ ID NO 10980 | ATCATTGTGCGAACATAATA | GAG | chrX | 139535832 | 139535851 | 139535848 | + |
| SEQ ID NO 10981 | TGTACTTACCTAAACCTAAA | TGG | chrX | 139535855 | 139535874 | 139535871 | + |
| SEQ ID NO 10982 | TTACCTAAACCTAAATGGTA | TAG | chrX | 139535860 | 139535879 | 139535876 | + |
| SEQ ID NO 10983 | GGTATAGCTTACTACATACC | TAG | chrX | 139535876 | 139535895 | 139535892 | + |
| SEQ ID NO 10984 | GTATAGCTTACTACATACCT | AGG | chrX | 139535877 | 139535896 | 139535893 | + |
| SEQ ID NO 10985 | ATACCTAGGTTGTATTGATG | TGG | chrX | 139535891 | 139535910 | 139535907 | + |
| SEQ ID NO 10986 | TTGATGTGGCCTATTGCTCC | TAG | chrX | 139535905 | 139535924 | 139535921 | + |
| SEQ ID NO 10987 | TGATGTGGCCTATTGCTCCT | AGG | chrX | 139535906 | 139535925 | 139535922 | + |
| SEQ ID NO 10988 | GCCTATTGCTCCTAGGCTCC | TGG | chrX | 139535913 | 139535932 | 139535929 | + |
| SEQ ID NO 10989 | CCTATTGCTCCTAGGCTCCT | GGG | chrX | 139535914 | 139535933 | 139535930 | + |
| SEQ ID NO 10990 | TCCTGGGCTGCAAACCTGTA | CAG | chrX | 139535930 | 139535949 | 139535946 | + |
| SEQ ID NO 10991 | TGTGACTGTACTGAACACTG | TAG | chrX | 139535955 | 139535974 | 139535971 | + |
| SEQ ID NO 10992 | GTGACTGTACTGAACACTGT | AGG | chrX | 139535956 | 139535975 | 139535972 | + |
| SEQ ID NO 10993 | GTACTGAACACTGTAGGCAA | TGG | chrX | 139535962 | 139535981 | 139535978 | + |
| SEQ ID NO 10994 | AACACTGTAGGCAATGGTAA | CAG | chrX | 139535968 | 139535987 | 139535984 | + |
| SEQ ID NO 10995 | ACTGTAGGCAATGGTAACAG | TGG | chrX | 139535971 | 139535990 | 139535987 | + |
| SEQ ID NO 10996 | GGTATTTGTGTATCTAAACA | TAG | chrX | 139535992 | 139536011 | 139536008 | + |
| SEQ ID NO 10997 | TTGTGTATCTAAACATAGAA | AAG | chrX | 139535997 | 139536016 | 139536013 | + |
| SEQ ID NO 10998 | TGTGTATCTAAACATAGAAA | AGG | chrX | 139535998 | 139536017 | 139536014 | + |
| SEQ ID NO 10999 | ATCTAAACATAGAAAGGTA | CAG | chrX | 139536003 | 139536022 | 139536019 | + |
| SEQ ID NO 11000 | GAAAGGTACAGTGAAAATA | CAG | chrX | 139536014 | 139536033 | 139536030 | + |
| SEQ ID NO 11001 | AATACAGTATTATAACCTTA | TGG | chrX | 139536030 | 139536049 | 139536046 | + |
| SEQ ID NO 11002 | ATACAGTATTATAACCTTAT | GGG | chrX | 139536031 | 139536050 | 139536047 | + |
| SEQ ID NO 11003 | GGGACCACTGTCGTATAATG | TGG | chrX | 139536051 | 139536070 | 139536067 | + |

Figure 37 (Cont'd)

| | | | | | | | |
|---|---|---|---|---|---|---|---|
| SEQ ID NO 11004 | TTGACCAAAATGTCATTGTG | CAG | chrX | 139536081 | 139536100 | 139536097 | + |
| SEQ ID NO 11005 | TATATGTACACACACACACA | TAG | chrX | 139536270 | 139536289 | 139536286 | + |
| SEQ ID NO 11006 | TATGTACACACACACACATA | GAG | chrX | 139536272 | 139536291 | 139536288 | + |
| SEQ ID NO 11007 | TGTACACACACACACATAGA | GAG | chrX | 139536274 | 139536293 | 139536290 | + |
| SEQ ID NO 11008 | TACACACACACACATAGAGA | GAG | chrX | 139536276 | 139536295 | 139536292 | + |
| SEQ ID NO 11009 | CACACACACACATAGAGAGA | GAG | chrX | 139536278 | 139536297 | 139536294 | + |
| SEQ ID NO 11010 | CACACACACATAGAGAGAGA | GAG | chrX | 139536280 | 139536299 | 139536296 | + |
| SEQ ID NO 11011 | CACACACATAGAGAGAGAGA | GAG | chrX | 139536282 | 139536301 | 139536298 | + |
| SEQ ID NO 11012 | CACACATAGAGAGAGAGAGA | GAG | chrX | 139536284 | 139536303 | 139536300 | + |
| SEQ ID NO 11013 | ACACATAGAGAGAGAGAGAG | AGG | chrX | 139536285 | 139536304 | 139536301 | + |
| SEQ ID NO 11014 | ACATAGAGAGAGAGAGAGAG | GAG | chrX | 139536287 | 139536306 | 139536303 | + |
| SEQ ID NO 11015 | ATAGAGAGAGAGAGAGAGGA | GAG | chrX | 139536289 | 139536308 | 139536305 | + |
| SEQ ID NO 11016 | TAGAGAGAGAGAGAGAGGAG | AGG | chrX | 139536290 | 139536309 | 139536306 | + |
| SEQ ID NO 11017 | GAGAGAGAGAGAGAGGAGAG | GAG | chrX | 139536292 | 139536311 | 139536308 | + |
| SEQ ID NO 11018 | GAGAGAGAGAGAGGAGAGGA | GAG | chrX | 139536294 | 139536313 | 139536310 | + |
| SEQ ID NO 11019 | AGAGAGAGAGGAGAGGAGAG | AGG | chrX | 139536295 | 139536314 | 139536311 | + |
| SEQ ID NO 11020 | GAGAGAGAGGAGAGGGAGAGG | AAG | chrX | 139536298 | 139536317 | 139536314 | + |
| SEQ ID NO 11021 | AGAGAGGAGAGGAGAGGA | AGG | chrX | 139536299 | 139536318 | 139536315 | + |
| SEQ ID NO 11022 | AGAGGAGAGGAGAGGAAG | GAG | chrX | 139536301 | 139536320 | 139536317 | + |
| SEQ ID NO 11023 | GAGAGGAGAGGAGAGGAAGG | AGG | chrX | 139536302 | 139536321 | 139536318 | + |
| SEQ ID NO 11024 | AGAGGAGAGGAGAGGAAGGA | GGG | chrX | 139536303 | 139536322 | 139536319 | + |
| SEQ ID NO 11025 | AGGAGAGGAGAGGAAGGAGG | GAG | chrX | 139536305 | 139536324 | 139536321 | + |
| SEQ ID NO 11026 | GGAGAGGAGAGGAAGGAGGG | AGG | chrX | 139536306 | 139536325 | 139536322 | + |
| SEQ ID NO 11027 | GAGAGGAGAGGAAGGAGGGA | GGG | chrX | 139536307 | 139536326 | 139536323 | + |
| SEQ ID NO 11028 | AGGAGAGGAAGGAGGGAGGG | AAG | chrX | 139536310 | 139536329 | 139536326 | + |
| SEQ ID NO 11029 | GGAGAGGAAGGAGGGAGGGA | AGG | chrX | 139536311 | 139536330 | 139536327 | + |
| SEQ ID NO 11030 | AGAGGAAGGAGGGAGGGAAG | GAG | chrX | 139536313 | 139536332 | 139536329 | + |
| SEQ ID NO 11031 | AGGGAAGGAGAAATATGATT | CAG | chrX | 139536326 | 139536345 | 139536342 | + |
| SEQ ID NO 11032 | AAGGAGAAATATGATTCAGA | TAG | chrX | 139536330 | 139536349 | 139536346 | + |
| SEQ ID NO 11033 | GGAGAAATATGATTCAGATA | GAG | chrX | 139536332 | 139536351 | 139536348 | + |
| SEQ ID NO 11034 | AGATAGAGACATCTATCCTC | CAG | chrX | 139536347 | 139536366 | 139536363 | + |
| SEQ ID NO 11035 | ATAGAGACATCTATCCTCCA | GAG | chrX | 139536349 | 139536368 | 139536365 | + |
| SEQ ID NO 11036 | GACATCTATCCTCCAGAGTT | CAG | chrX | 139536354 | 139536373 | 139536370 | + |
| SEQ ID NO 11037 | ACATCTATCCTCCAGAGTTC | AGG | chrX | 139536355 | 139536374 | 139536371 | + |
| SEQ ID NO 11038 | ATCTATCCTCCAGAGTTCAG | GAG | chrX | 139536357 | 139536376 | 139536373 | + |
| SEQ ID NO 11039 | AGAGTTCAGGAGTGTCTCTT | CAG | chrX | 139536368 | 139536387 | 139536384 | + |
| SEQ ID NO 11040 | TCAGGAGTGTCTCTTCAGAC | TAG | chrX | 139536373 | 139536392 | 139536389 | + |
| SEQ ID NO 11041 | CAGGAGTGTCTCTTCAGACT | AGG | chrX | 139536374 | 139536393 | 139536390 | + |
| SEQ ID NO 11042 | GAGTGTCTCTTCAGACTAGG | TAG | chrX | 139536377 | 139536396 | 139536393 | + |
| SEQ ID NO 11043 | CTCTTCAGACTAGGTAGATG | TAG | chrX | 139536383 | 139536402 | 139536399 | + |
| SEQ ID NO 11044 | AAAAAACATATCCTGAATTC | TAG | chrX | 139536411 | 139536430 | 139536427 | + |
| SEQ ID NO 11045 | AAAACATATCCTGAATTCTA | GAG | chrX | 139536413 | 139536432 | 139536429 | + |
| SEQ ID NO 11046 | AACATATCCTGAATTCTAGA | GAG | chrX | 139536415 | 139536434 | 139536431 | + |
| SEQ ID NO 11047 | CCTATAACACTTGCCAACCA | AAG | chrX | 139536458 | 139536477 | 139536474 | + |
| SEQ ID NO 11048 | CTATAACACTTGCCAACCAA | AGG | chrX | 139536459 | 139536478 | 139536475 | + |
| SEQ ID NO 11049 | ATTGCTTTTTAAATTAATG | CAG | chrX | 139536497 | 139536516 | 139536513 | + |
| SEQ ID NO 11050 | AGTGATTTTTCTTTAACATC | TAG | chrX | 139536518 | 139536537 | 139536534 | + |
| SEQ ID NO 11051 | TTTTCTTTAACATCTAGTGA | CAG | chrX | 139536524 | 139536543 | 139536540 | + |
| SEQ ID NO 11052 | TAACATCTAGTGACAGACAC | TGG | chrX | 139536531 | 139536550 | 139536547 | + |

Figure 37 (Cont'd)

| | | | | | | | |
|---|---|---|---|---|---|---|---|
| SEQ ID NO 11053 | AACATCTAGTGACAGACACT | GGG | chrX | 139536532 | 139536551 | 139536548 | + |
| SEQ ID NO 11054 | ACATCTAGTGACAGACACTG | GGG | chrX | 139536533 | 139536552 | 139536549 | + |
| SEQ ID NO 11055 | AGACACTGGGGTCACATTTG | CAG | chrX | 139536545 | 139536564 | 139536561 | + |
| SEQ ID NO 11056 | ACTGGGGTCACATTTGCAGC | TGG | chrX | 139536549 | 139536568 | 139536565 | + |
| SEQ ID NO 11057 | ATTTGCAGCTGGACCATAAT | TAG | chrX | 139536560 | 139536579 | 139536576 | + |
| SEQ ID NO 11058 | TTTGCAGCTGGACCATAATT | AGG | chrX | 139536561 | 139536580 | 139536577 | + |
| SEQ ID NO 11059 | ATAATTAGGCTTCTGTTCTT | CAG | chrX | 139536575 | 139536594 | 139536591 | + |
| SEQ ID NO 11060 | TAATTAGGCTTCTGTTCTTC | AGG | chrX | 139536576 | 139536595 | 139536592 | + |
| SEQ ID NO 11061 | ATTAGGCTTCTGTTCTTCAG | GAG | chrX | 139536578 | 139536597 | 139536594 | + |
| SEQ ID NO 11062 | CTTCAGGAGACATTTGTTCA | AAG | chrX | 139536592 | 139536611 | 139536608 | + |
| SEQ ID NO 11063 | GACATTTGTTCAAAGTCATT | TGG | chrX | 139536600 | 139536619 | 139536616 | + |
| SEQ ID NO 11064 | ACATTTGTTCAAAGTCATTT | GGG | chrX | 139536601 | 139536620 | 139536617 | + |
| SEQ ID NO 11065 | GGGCAACCATATTCTGAAAA | CAG | chrX | 139536621 | 139536640 | 139536637 | + |
| SEQ ID NO 11066 | ACCATATTCTGAAAACAGCC | CAG | chrX | 139536626 | 139536645 | 139536642 | + |
| SEQ ID NO 11067 | TATTCTGAAAACAGCCCAGC | CAG | chrX | 139536630 | 139536649 | 139536646 | + |
| SEQ ID NO 11068 | ATTCTGAAAACAGCCCAGCC | AGG | chrX | 139536631 | 139536650 | 139536647 | + |
| SEQ ID NO 11069 | TTCTGAAAACAGCCCAGCCA | GGG | chrX | 139536632 | 139536651 | 139536648 | + |
| SEQ ID NO 11070 | AAACAGCCCAGCCAGGGTGA | TGG | chrX | 139536638 | 139536657 | 139536654 | + |
| SEQ ID NO 11071 | GGGTGATGGATCACTTTGCA | AAG | chrX | 139536652 | 139536671 | 139536668 | + |
| SEQ ID NO 11072 | ACTTTGCAAAGATCCTCAAT | GAG | chrX | 139536664 | 139536683 | 139536680 | + |
| SEQ ID NO 11073 | ATCCTCAATGAGCTATTTTC | AAG | chrX | 139536675 | 139536694 | 139536691 | + |
| SEQ ID NO 11074 | GCTATTTTCAAGTGATGACA | AAG | chrX | 139536686 | 139536705 | 139536702 | + |
| SEQ ID NO 11075 | TCAAGTGATGACAAAGTGTG | AAG | chrX | 139536693 | 139536712 | 139536709 | + |
| SEQ ID NO 11076 | GTGAAGTTAACCGCTCATTT | GAG | chrX | 139536710 | 139536729 | 139536726 | + |
| SEQ ID NO 11077 | AGAACTTTCTTTTTCATCCA | AAG | chrX | 139536731 | 139536750 | 139536747 | + |
| SEQ ID NO 11078 | AAAGTAAATTCAAATATGAT | TAG | chrX | 139536750 | 139536769 | 139536766 | + |
| SEQ ID NO 11079 | GAAATCTGACCTTTTATTAC | TGG | chrX | 139536772 | 139536791 | 139536788 | + |
| SEQ ID NO 11080 | ACTGGAATTCTCTTGACTAA | AAG | chrX | 139536790 | 139536809 | 139536806 | + |
| SEQ ID NO 11081 | CCTAAATCTCCATGTGTATA | CAG | chrX | 139536831 | 139536850 | 139536847 | + |
| SEQ ID NO 11082 | TCCATGTGTATACAGTACTG | TGG | chrX | 139536839 | 139536858 | 139536855 | + |
| SEQ ID NO 11083 | CCATGTGTATACAGTACTGT | GGG | chrX | 139536840 | 139536859 | 139536856 | + |
| SEQ ID NO 11084 | ACAGTACTGTGGGAACATCA | CAG | chrX | 139536850 | 139536869 | 139536866 | + |
| SEQ ID NO 11085 | TGTGGGAACATCACAGATTT | TGG | chrX | 139536857 | 139536876 | 139536873 | + |
| SEQ ID NO 11086 | GATTTTGGCTCCATGCCCTA | AAG | chrX | 139536872 | 139536891 | 139536888 | + |
| SEQ ID NO 11087 | TTTTGGCTCCATGCCCTAAA | GAG | chrX | 139536874 | 139536893 | 139536890 | + |
| SEQ ID NO 11088 | TCCATGCCCTAAAGAGAAAT | TGG | chrX | 139536881 | 139536900 | 139536897 | + |
| SEQ ID NO 11089 | CCTAAAGAGAAATTGGCTTT | CAG | chrX | 139536888 | 139536907 | 139536904 | + |
| SEQ ID NO 11090 | AAATTGGCTTTCAGATTATT | TGG | chrX | 139536897 | 139536916 | 139536913 | + |
| SEQ ID NO 11091 | GATTATTTGGATTAAAAACA | AAG | chrX | 139536910 | 139536929 | 139536926 | + |
| SEQ ID NO 11092 | TTAAAAACAAAGACTTTCTT | AAG | chrX | 139536921 | 139536940 | 139536937 | + |
| SEQ ID NO 11093 | AAAAACAAAGACTTTCTTAA | GAG | chrX | 139536923 | 139536942 | 139536939 | + |
| SEQ ID NO 11094 | TTTCTTTTTTGCTAAAACTA | AAG | chrX | 139536966 | 139536985 | 139536982 | + |
| SEQ ID NO 11095 | AGAATTATTCTTTTACATTT | CAG | chrX | 139536987 | 139537006 | 139537003 | + |
| SEQ ID NO 11096 | ACGCCAACAAAATTCTGAAT | CGG | chrX | 139537028 | 139537047 | 139537044 | + |
| SEQ ID NO 11097 | ACAAAATTCTGAATCGGCCA | AAG | chrX | 139537034 | 139537053 | 139537050 | + |
| SEQ ID NO 11098 | AAAATTCTGAATCGGCCAAA | GAG | chrX | 139537036 | 139537055 | 139537052 | + |
| SEQ ID NO 11099 | AAATTCTGAATCGGCCAAAG | AGG | chrX | 139537037 | 139537056 | 139537053 | + |
| SEQ ID NO 11100 | TCGGCCAAAGAGGTATAATT | CAG | chrX | 139537047 | 139537066 | 139537063 | + |
| SEQ ID NO 11101 | CGGCCAAAGAGGTATAATTC | AGG | chrX | 139537048 | 139537067 | 139537064 | + |

Figure 37 (Cont'd)

| SEQ ID NO 11102 | GAGGTATAATTCAGGTAAAT | TGG | chrX | 139537056 | 139537075 | 139537072 | + |
|---|---|---|---|---|---|---|---|
| SEQ ID NO 11103 | GTATAATTCAGGTAAATTGG | AAG | chrX | 139537059 | 139537078 | 139537075 | + |
| SEQ ID NO 11104 | ATAATTCAGGTAAATTGGAA | GAG | chrX | 139537061 | 139537080 | 139537077 | + |
| SEQ ID NO 11105 | TAAATTGGAAGAGTTTGTTC | AAG | chrX | 139537071 | 139537090 | 139537087 | + |
| SEQ ID NO 11106 | AAATTGGAAGAGTTTGTTCA | AGG | chrX | 139537072 | 139537091 | 139537088 | + |
| SEQ ID NO 11107 | AATTGGAAGAGTTTGTTCAA | GGG | chrX | 139537073 | 139537092 | 139537089 | + |
| SEQ ID NO 11108 | AGTTTGTTCAAGGGAACCTT | GAG | chrX | 139537082 | 139537101 | 139537098 | + |
| SEQ ID NO 11109 | TTTGTTCAAGGGAACCTTGA | GAG | chrX | 139537084 | 139537103 | 139537100 | + |
| SEQ ID NO 11110 | TGTTCAAGGGAACCTTGAGA | GAG | chrX | 139537086 | 139537105 | 139537102 | + |
| SEQ ID NO 11111 | GAACCTTGAGAGAATGTA | TGG | chrX | 139537095 | 139537114 | 139537111 | + |
| SEQ ID NO 11112 | CCTTGAGAGAGAATGTATGG | AAG | chrX | 139537098 | 139537117 | 139537114 | + |
| SEQ ID NO 11113 | AGAGAATGTATGGAAGAA | AAG | chrX | 139537103 | 139537122 | 139537119 | + |
| SEQ ID NO 11114 | GAATGTATGGAAGAAAAGTG | TAG | chrX | 139537108 | 139537127 | 139537124 | + |
| SEQ ID NO 11115 | GGAAGAAAAGTGTAGTTTTG | AAG | chrX | 139537116 | 139537135 | 139537132 | + |
| SEQ ID NO 11116 | AGAAAAGTGTAGTTTTGAAG | AAG | chrX | 139537119 | 139537138 | 139537135 | + |
| SEQ ID NO 11117 | GTGTAGTTTTGAAGAAGCAC | GAG | chrX | 139537125 | 139537144 | 139537141 | + |
| SEQ ID NO 11118 | TAGTTTTGAAGAAGCACGAG | AAG | chrX | 139537128 | 139537147 | 139537144 | + |
| SEQ ID NO 11119 | GAAGTTTTTGAAAACACTGA | AAG | chrX | 139537147 | 139537166 | 139537163 | + |
| SEQ ID NO 11120 | TCTTCCATACATTCTCTCTC | AAG | chrX | 139537102 | 139537121 | 139537105 | - |
| SEQ ID NO 11121 | CTTCCATACATTCTCTCTCA | AGG | chrX | 139537101 | 139537120 | 139537104 | - |
| SEQ ID NO 11122 | TTACCTGAATTATACCTCTT | TGG | chrX | 139537054 | 139537073 | 139537057 | - |
| SEQ ID NO 11123 | TTATACCTCTTTGGCCGATT | CAG | chrX | 139537045 | 139537064 | 139537048 | - |
| SEQ ID NO 11124 | TGGCCGATTCAGAATTTTGT | TGG | chrX | 139537034 | 139537053 | 139537037 | - |
| SEQ ID NO 11125 | TTGTTGGCGTTTTCATGATC | AAG | chrX | 139537018 | 139537037 | 139537021 | - |
| SEQ ID NO 11126 | CAAGAAAAACTGAAATGTAA | AAG | chrX | 139536999 | 139537018 | 139537002 | - |
| SEQ ID NO 11127 | AATGTAAAAGAATAATTCTT | TAG | chrX | 139536986 | 139537005 | 139536989 | - |
| SEQ ID NO 11128 | AAAGAATAATTCTTTAGTTT | TAG | chrX | 139536980 | 139536999 | 139536983 | - |
| SEQ ID NO 11129 | ATTCTTTAGTTTTAGCAAAA | AAG | chrX | 139536972 | 139536991 | 139536975 | - |
| SEQ ID NO 11130 | ATGAAAATTTTACATCTCTT | AAG | chrX | 139536941 | 139536960 | 139536944 | - |
| SEQ ID NO 11131 | AAATTTTACATCTCTTAAGA | AAG | chrX | 139536937 | 139536956 | 139536940 | - |
| SEQ ID NO 11132 | TTTTAATCCAAATAATCTGA | AAG | chrX | 139536907 | 139536926 | 139536910 | - |
| SEQ ID NO 11133 | TCTGAAAGCCAATTTCTCTT | TAG | chrX | 139536892 | 139536911 | 139536895 | - |
| SEQ ID NO 11134 | CTGAAAGCCAATTTCTCTTT | AGG | chrX | 139536891 | 139536910 | 139536894 | - |
| SEQ ID NO 11135 | TGAAAGCCAATTTCTCTTTA | GGG | chrX | 139536890 | 139536909 | 139536893 | - |
| SEQ ID NO 11136 | GCCAATTTCTCTTTAGGGCA | TGG | chrX | 139536885 | 139536904 | 139536888 | - |
| SEQ ID NO 11137 | CAATTTCTCTTTAGGGCATG | GAG | chrX | 139536883 | 139536902 | 139536886 | - |
| SEQ ID NO 11138 | CAAAATCTGTGATGTTCCCA | CAG | chrX | 139536859 | 139536878 | 139536862 | - |
| SEQ ID NO 11139 | CCCACAGTACTGTATACACA | TGG | chrX | 139536843 | 139536862 | 139536846 | - |
| SEQ ID NO 11140 | CACAGTACTGTATACACATG | GAG | chrX | 139536841 | 139536860 | 139536844 | - |
| SEQ ID NO 11141 | ACTGTATACACATGGAGATT | TAG | chrX | 139536835 | 139536854 | 139536838 | - |
| SEQ ID NO 11142 | CTGTATACACATGGAGATTT | AGG | chrX | 139536834 | 139536853 | 139536837 | - |
| SEQ ID NO 11143 | TTAAAATTCAATTTTACTTT | TAG | chrX | 139536809 | 139536828 | 139536812 | - |
| SEQ ID NO 11144 | ATTCAATTTTACTTTTAGTC | AAG | chrX | 139536804 | 139536823 | 139536807 | - |
| SEQ ID NO 11145 | TCAATTTTACTTTTAGTCAA | GAG | chrX | 139536802 | 139536821 | 139536805 | - |
| SEQ ID NO 11146 | ACTTTTAGTCAAGAGAATTC | CAG | chrX | 139536794 | 139536813 | 139536797 | - |
| SEQ ID NO 11147 | CAAGAGAATTCCAGTAATAA | AAG | chrX | 139536785 | 139536804 | 139536788 | - |
| SEQ ID NO 11148 | AAGAGAATTCCAGTAATAAA | AGG | chrX | 139536784 | 139536803 | 139536787 | - |
| SEQ ID NO 11149 | GAATTCCAGTAATAAAAGGT | CAG | chrX | 139536780 | 139536799 | 139536783 | - |
| SEQ ID NO 11150 | AATCATATTTGAATTTACTT | TGG | chrX | 139536751 | 139536770 | 139536754 | - |

Figure 37 (Cont'd)

| | | | | | | | |
|---|---|---|---|---|---|---|---|
| SEQ ID NO 11151 | TGAATTTACTTTGGATGAAA | AAG | chrX | 139536742 | 139536761 | 139536745 | - |
| SEQ ID NO 11152 | TTTACTTTGGATGAAAAAGA | AAG | chrX | 139536738 | 139536757 | 139536741 | - |
| SEQ ID NO 11153 | GAAAAGAAAGTTCTCAAAT | GAG | chrX | 139536726 | 139536745 | 139536729 | - |
| SEQ ID NO 11154 | AAAGAAAGTTCTCAAATGAG | CGG | chrX | 139536723 | 139536742 | 139536726 | - |
| SEQ ID NO 11155 | ACTTTGTCATCACTTGAAAA | TAG | chrX | 139536690 | 139536709 | 139536693 | - |
| SEQ ID NO 11156 | TCACTTGAAAATAGCTCATT | GAG | chrX | 139536681 | 139536700 | 139536684 | - |
| SEQ ID NO 11157 | CACTTGAAAATAGCTCATTG | AGG | chrX | 139536680 | 139536699 | 139536683 | - |
| SEQ ID NO 11158 | GCTCATTGAGGATCTTTGCA | AAG | chrX | 139536668 | 139536687 | 139536671 | - |
| SEQ ID NO 11159 | TGCAAAGTGATCCATCACCC | TGG | chrX | 139536652 | 139536671 | 139536655 | - |
| SEQ ID NO 11160 | AAGTGATCCATCACCCTGGC | TGG | chrX | 139536648 | 139536667 | 139536651 | - |
| SEQ ID NO 11161 | AGTGATCCATCACCCTGGCT | GGG | chrX | 139536647 | 139536666 | 139536650 | - |
| SEQ ID NO 11162 | CACCCTGGCTGGGCTGTTTT | CAG | chrX | 139536637 | 139536656 | 139536640 | - |
| SEQ ID NO 11163 | GCTGGGCTGTTTTCAGAATA | TGG | chrX | 139536630 | 139536649 | 139536633 | - |
| SEQ ID NO 11164 | CTTTGAACAAATGTCTCCTG | AAG | chrX | 139536595 | 139536614 | 139536598 | - |
| SEQ ID NO 11165 | AACAAATGTCTCCTGAAGAA | CAG | chrX | 139536590 | 139536609 | 139536593 | - |
| SEQ ID NO 11166 | AAATGTCTCCTGAAGAACAG | AAG | chrX | 139536587 | 139536606 | 139536590 | - |
| SEQ ID NO 11167 | GAAGAACAGAAGCCTAATTA | TGG | chrX | 139536576 | 139536595 | 139536579 | - |
| SEQ ID NO 11168 | ACAGAAGCCTAATTATGGTC | CAG | chrX | 139536571 | 139536590 | 139536574 | - |
| SEQ ID NO 11169 | TCCAGCTGCAAATGTGACCC | CAG | chrX | 139536553 | 139536572 | 139536556 | - |
| SEQ ID NO 11170 | GTGACCCCAGTGTCTGTCAC | TAG | chrX | 139536540 | 139536559 | 139536543 | - |
| SEQ ID NO 11171 | GTGTCTGTCACTAGATGTTA | AAG | chrX | 139536531 | 139536550 | 139536534 | - |
| SEQ ID NO 11172 | ATCACTGCATTAATTTAAAA | AAG | chrX | 139536504 | 139536523 | 139536507 | - |
| SEQ ID NO 11173 | TTAATTTAAAAAAGCAATTT | CAG | chrX | 139536495 | 139536514 | 139536498 | - |
| SEQ ID NO 11174 | AAAAAGCAATTTCAGATCAA | CAG | chrX | 139536487 | 139536506 | 139536490 | - |
| SEQ ID NO 11175 | TTTCAGATCAACAGCACCTT | TGG | chrX | 139536478 | 139536497 | 139536481 | - |
| SEQ ID NO 11176 | AGATCAACAGCACCTTTGGT | TGG | chrX | 139536474 | 139536493 | 139536477 | - |
| SEQ ID NO 11177 | CAACAGCACCTTTGGTTGGC | AAG | chrX | 139536470 | 139536489 | 139536473 | - |
| SEQ ID NO 11178 | CCTTTGGTTGGCAAGTGTTA | TAG | chrX | 139536462 | 139536481 | 139536465 | - |
| SEQ ID NO 11179 | CTTTGGTTGGCAAGTGTTAT | AGG | chrX | 139536461 | 139536480 | 139536464 | - |
| SEQ ID NO 11180 | GGCAAGTGTTATAGGAATTG | CAG | chrX | 139536453 | 139536472 | 139536456 | - |
| SEQ ID NO 11181 | TATAGGAATTGCAGTGATTT | AAG | chrX | 139536444 | 139536463 | 139536447 | - |
| SEQ ID NO 11182 | CAGTGATTTAAGCATCTCTC | TAG | chrX | 139536433 | 139536452 | 139536436 | - |
| SEQ ID NO 11183 | TTAAGCATCTCTCTAGAATT | CAG | chrX | 139536426 | 139536445 | 139536429 | - |
| SEQ ID NO 11184 | TAAGCATCTCTCTAGAATTC | AGG | chrX | 139536425 | 139536444 | 139536428 | - |
| SEQ ID NO 11185 | ATTCAGGATATGTTTTTTTT | AAG | chrX | 139536409 | 139536428 | 139536412 | - |
| SEQ ID NO 11186 | TTTTTTAAGCTACATCTACC | TAG | chrX | 139536395 | 139536414 | 139536398 | - |
| SEQ ID NO 11187 | AGCTACATCTACCTAGTCTG | AAG | chrX | 139536388 | 139536407 | 139536391 | - |
| SEQ ID NO 11188 | CTACATCTACCTAGTCTGAA | GAG | chrX | 139536386 | 139536405 | 139536389 | - |
| SEQ ID NO 11189 | GAAGAGACACTCCTGAACTC | TGG | chrX | 139536369 | 139536388 | 139536372 | - |
| SEQ ID NO 11190 | AGAGACACTCCTGAACTCTG | GAG | chrX | 139536367 | 139536386 | 139536370 | - |
| SEQ ID NO 11191 | GAGACACTCCTGAACTCTGG | AGG | chrX | 139536366 | 139536385 | 139536369 | - |
| SEQ ID NO 11192 | CACTCCTGAACTCTGGAGGA | TAG | chrX | 139536362 | 139536381 | 139536365 | - |
| SEQ ID NO 11193 | TATCATATATATATATATAT | GAG | chrX | 139536118 | 139536137 | 139536121 | - |
| SEQ ID NO 11194 | TTTGCTGCACAATGACATTT | TGG | chrX | 139536088 | 139536107 | 139536091 | - |
| SEQ ID NO 11195 | AATGACATTTTGGTCAATGA | TGG | chrX | 139536078 | 139536097 | 139536081 | - |
| SEQ ID NO 11196 | TGATGGACCACATTATACGA | CAG | chrX | 139536061 | 139536080 | 139536064 | - |
| SEQ ID NO 11197 | TGGACCACATTATACGACAG | TGG | chrX | 139536058 | 139536077 | 139536061 | - |
| SEQ ID NO 11198 | TTATACGACAGTGGTCCCAT | AAG | chrX | 139536049 | 139536068 | 139536052 | - |
| SEQ ID NO 11199 | TATACGACAGTGGTCCCATA | AGG | chrX | 139536048 | 139536067 | 139536051 | - |

Figure 37 (Cont'd)

| | | | | | | | |
|---|---|---|---|---|---|---|---|
| SEQ ID NO 11200 | CACTGTACCTTTTCTATGTT | TAG | chrX | 139536008 | 139536027 | 139536011 | - |
| SEQ ID NO 11201 | ACCACTGTTACCATTGCCTA | CAG | chrX | 139535975 | 139535994 | 139535978 | - |
| SEQ ID NO 11202 | TTACCATTGCCTACAGTGTT | CAG | chrX | 139535968 | 139535987 | 139535971 | - |
| SEQ ID NO 11203 | ATTGCCTACAGTGTTCAGTA | CAG | chrX | 139535963 | 139535982 | 139535966 | - |
| SEQ ID NO 11204 | CAGTACAGTCACATGCTGTA | CAG | chrX | 139535948 | 139535967 | 139535951 | - |
| SEQ ID NO 11205 | AGTACAGTCACATGCTGTAC | AGG | chrX | 139535947 | 139535966 | 139535950 | - |
| SEQ ID NO 11206 | TCACATGCTGTACAGGTTTG | CAG | chrX | 139535940 | 139535959 | 139535943 | - |
| SEQ ID NO 11207 | TGCTGTACAGGTTTGCAGCC | CAG | chrX | 139535935 | 139535954 | 139535938 | - |
| SEQ ID NO 11208 | GCTGTACAGGTTTGCAGCCC | AGG | chrX | 139535934 | 139535953 | 139535937 | - |
| SEQ ID NO 11209 | TGTACAGGTTTGCAGCCCAG | GAG | chrX | 139535932 | 139535951 | 139535935 | - |
| SEQ ID NO 11210 | AGGTTTGCAGCCCAGGAGCC | TAG | chrX | 139535927 | 139535946 | 139535930 | - |
| SEQ ID NO 11211 | GGTTTGCAGCCCAGGAGCCT | AGG | chrX | 139535926 | 139535945 | 139535929 | - |
| SEQ ID NO 11212 | TTTGCAGCCCAGGAGCCTAG | GAG | chrX | 139535924 | 139535943 | 139535927 | - |
| SEQ ID NO 11213 | GCCCAGGAGCCTAGGAGCAA | TAG | chrX | 139535918 | 139535937 | 139535921 | - |
| SEQ ID NO 11214 | CCCAGGAGCCTAGGAGCAAT | AGG | chrX | 139535917 | 139535936 | 139535920 | - |
| SEQ ID NO 11215 | TAGGCCACATCAATACAACC | TAG | chrX | 139535898 | 139535917 | 139535901 | - |
| SEQ ID NO 11216 | AGGCCACATCAATACAACCT | AGG | chrX | 139535897 | 139535916 | 139535900 | - |
| SEQ ID NO 11217 | ATCAATACAACCTAGGTATG | TAG | chrX | 139535890 | 139535909 | 139535893 | - |
| SEQ ID NO 11218 | ATACAACCTAGGTATGTAGT | AAG | chrX | 139535886 | 139535905 | 139535889 | - |
| SEQ ID NO 11219 | ATGTAGTAAGCTATACCATT | TAG | chrX | 139535873 | 139535892 | 139535876 | - |
| SEQ ID NO 11220 | TGTAGTAAGCTATACCATTT | AGG | chrX | 139535872 | 139535891 | 139535875 | - |
| SEQ ID NO 11221 | TAAGCTATACCATTTAGGTT | TAG | chrX | 139535867 | 139535886 | 139535870 | - |
| SEQ ID NO 11222 | AAGCTATACCATTTAGGTTT | AGG | chrX | 139535866 | 139535885 | 139535869 | - |
| SEQ ID NO 11223 | TATACCATTTAGGTTTAGGT | AAG | chrX | 139535862 | 139535881 | 139535865 | - |
| SEQ ID NO 11224 | TTGCTTAATGACACATTTCT | CAG | chrX | 139535808 | 139535827 | 139535811 | - |
| SEQ ID NO 11225 | CAGAATATATCCCCATTGTT | AAG | chrX | 139535788 | 139535807 | 139535791 | - |
| SEQ ID NO 11226 | AGAATATATCCCCATTGTTA | AGG | chrX | 139535787 | 139535806 | 139535790 | - |
| SEQ ID NO 11227 | CCCCATTGTTAAGGAATGCA | TGG | chrX | 139535778 | 139535797 | 139535781 | - |
| SEQ ID NO 11228 | TGTATGTATAAAATTAATAA | CAG | chrX | 139535702 | 139535721 | 139535705 | - |
| SEQ ID NO 11229 | GTATGTATAAAATTAATAAC | AGG | chrX | 139535701 | 139535720 | 139535704 | - |
| SEQ ID NO 11230 | TATGTATAAAATTAATAACA | GGG | chrX | 139535700 | 139535719 | 139535703 | - |
| SEQ ID NO 11231 | AAAATTAATAACAGGGACTC | AAG | chrX | 139535693 | 139535712 | 139535696 | - |
| SEQ ID NO 11232 | ATTAATAACAGGGACTCAAG | AAG | chrX | 139535690 | 139535709 | 139535693 | - |
| SEQ ID NO 11233 | CAGGGACTCAAGAAGTTGCC | TGG | chrX | 139535682 | 139535701 | 139535685 | - |
| SEQ ID NO 11234 | GGGACTCAAGAAGTTGCCTG | GAG | chrX | 139535680 | 139535699 | 139535683 | - |
| SEQ ID NO 11235 | CTGGAGTTGTTCCTTTCTTC | AAG | chrX | 139535663 | 139535682 | 139535666 | - |
| SEQ ID NO 11236 | TGGAGTTGTTCCTTTCTTCA | AGG | chrX | 139535662 | 139535681 | 139535665 | - |
| SEQ ID NO 11237 | GGAGTTGTTCCTTTCTTCAA | GGG | chrX | 139535661 | 139535680 | 139535664 | - |
| SEQ ID NO 11238 | TGTTCCTTTCTTCAAGGGTC | TAG | chrX | 139535656 | 139535675 | 139535659 | - |
| SEQ ID NO 11239 | AATATATCTGATACCATCTC | AAG | chrX | 139535632 | 139535651 | 139535635 | - |
| SEQ ID NO 11240 | TATATCTGATACCATCTCAA | GAG | chrX | 139535630 | 139535649 | 139535633 | - |
| SEQ ID NO 11241 | ATATCTGATACCATCTCAAG | AGG | chrX | 139535629 | 139535648 | 139535632 | - |
| SEQ ID NO 11242 | GATACCATCTCAAGAGGACC | AAG | chrX | 139535623 | 139535642 | 139535626 | - |
| SEQ ID NO 11243 | ATACCATCTCAAGAGGACCA | AGG | chrX | 139535622 | 139535641 | 139535625 | - |
| SEQ ID NO 11244 | TACCATCTCAAGAGGACCAA | GGG | chrX | 139535621 | 139535640 | 139535624 | - |
| SEQ ID NO 11245 | CAAGAGGACCAAGGGCTTAT | AAG | chrX | 139535613 | 139535632 | 139535616 | - |
| SEQ ID NO 11246 | GGCTTATAAGATGAACTTTC | TGG | chrX | 139535600 | 139535619 | 139535603 | - |
| SEQ ID NO 11247 | GCTTATAAGATGAACTTTCT | GGG | chrX | 139535599 | 139535618 | 139535602 | - |
| SEQ ID NO 11248 | CTTATAAGATGAACTTTCTG | GGG | chrX | 139535598 | 139535617 | 139535601 | - |

Figure 37 (Cont'd)

| | | | | | | | |
|---|---|---|---|---|---|---|---|
| SEQ ID NO 11249 | GATGAACTTTCTGGGGTATT | TGG | chrX | 139535591 | 139535610 | 139535594 | - |
| SEQ ID NO 11250 | ATGAACTTTCTGGGGTATTT | GGG | chrX | 139535590 | 139535609 | 139535593 | - |
| SEQ ID NO 11251 | ACTTCCTGATTAACTCCAAA | AAG | chrX | 139535564 | 139535583 | 139535567 | - |
| SEQ ID NO 11252 | CTTCCTGATTAACTCCAAAA | AGG | chrX | 139535563 | 139535582 | 139535566 | - |
| SEQ ID NO 11253 | CCTGATTAACTCCAAAAGG | AAG | chrX | 139535560 | 139535579 | 139535563 | - |
| SEQ ID NO 11254 | TGATTAACTCCAAAAGGAA | GAG | chrX | 139535558 | 139535577 | 139535561 | - |
| SEQ ID NO 11255 | TAACTCCAAAAGGAAGAGA | AAG | chrX | 139535554 | 139535573 | 139535557 | - |
| SEQ ID NO 11256 | AACTCCAAAAGGAAGAGAA | AGG | chrX | 139535553 | 139535572 | 139535556 | - |
| SEQ ID NO 11257 | CCAAAAGGAAGAGAAAGGA | AAG | chrX | 139535549 | 139535568 | 139535552 | - |
| SEQ ID NO 11258 | GGAAGAGAAAGGAAAGTAAA | AAG | chrX | 139535542 | 139535561 | 139535545 | - |
| SEQ ID NO 11259 | GAAGAGAAAGGAAAGTAAAA | AGG | chrX | 139535541 | 139535560 | 139535544 | - |
| SEQ ID NO 11260 | AGAAAGGAAAGTAAAAGGA | AAG | chrX | 139535537 | 139535556 | 139535540 | - |
| SEQ ID NO 11261 | GAAAGGAAAGTAAAAGGAA | AGG | chrX | 139535536 | 139535555 | 139535539 | - |
| SEQ ID NO 11262 | GGAAAGTAAAAGGAAAGGA | AAG | chrX | 139535532 | 139535551 | 139535535 | - |
| SEQ ID NO 11263 | TAAAAGGAAAGGAAAGAAA | CGG | chrX | 139535526 | 139535545 | 139535529 | - |
| SEQ ID NO 11264 | AAAAGGAAAGGAAAGAAACG | GAG | chrX | 139535524 | 139535543 | 139535527 | - |
| SEQ ID NO 11265 | TTCTTCCCTTATTTTCATTG | CAG | chrX | 139535489 | 139535508 | 139535492 | - |
| SEQ ID NO 11266 | CATTGCAGCTGTTCACTTTA | TGG | chrX | 139535474 | 139535493 | 139535477 | - |
| SEQ ID NO 11267 | TTGCAGCTGTTCACTTTATG | GAG | chrX | 139535472 | 139535491 | 139535475 | - |
| SEQ ID NO 11268 | GTTCACTTTATGGAGTGTTC | TAG | chrX | 139535464 | 139535483 | 139535467 | - |
| SEQ ID NO 11269 | CTGCTTTTCCCTTGCTCTGC | AAG | chrX | 139535428 | 139535447 | 139535431 | - |
| SEQ ID NO 11270 | CTTGCTCTGCAAGTTCCTTT | TGG | chrX | 139535418 | 139535437 | 139535421 | - |
| SEQ ID NO 11271 | TTGCTCTGCAAGTTCCTTTT | GGG | chrX | 139535417 | 139535436 | 139535420 | - |
| SEQ ID NO 11272 | TCACTTTTTTCTTTGAATT | TAG | chrX | 139535393 | 139535412 | 139535396 | - |
| SEQ ID NO 11273 | TTTTTTCTTTGAATTTAGCC | TAG | chrX | 139535388 | 139535407 | 139535391 | - |
| SEQ ID NO 11274 | TTCAACTCTTTTTTTTTGA | CAG | chrX | 139535355 | 139535374 | 139535358 | - |
| SEQ ID NO 11275 | CAACTCTTTTTTTTTGACA | GAG | chrX | 139535353 | 139535372 | 139535356 | - |
| SEQ ID NO 11276 | CAGAGTCTTGCTCTGTCGCC | CAG | chrX | 139535335 | 139535354 | 139535338 | - |
| SEQ ID NO 11277 | AGAGTCTTGCTCTGTCGCCC | AGG | chrX | 139535334 | 139535353 | 139535337 | - |
| SEQ ID NO 11278 | TCTTGCTCTGTCGCCCAGGC | TGG | chrX | 139535330 | 139535349 | 139535333 | - |
| SEQ ID NO 11279 | TTGCTCTGTCGCCCAGGCTG | GAG | chrX | 139535328 | 139535347 | 139535331 | - |
| SEQ ID NO 11280 | CTGTCGCCCAGGCTGGAGTG | CAG | chrX | 139535323 | 139535342 | 139535326 | - |
| SEQ ID NO 11281 | TCGCCCAGGCTGGAGTGCAG | TGG | chrX | 139535320 | 139535339 | 139535323 | - |
| SEQ ID NO 11282 | GGAGTGCAGTGGTGCGATCT | CAG | chrX | 139535309 | 139535328 | 139535312 | - |
| SEQ ID NO 11283 | TCACTGCAACCTCCATCTCC | CAG | chrX | 139535285 | 139535304 | 139535288 | - |
| SEQ ID NO 11284 | CACTGCAACCTCCATCTCCC | AGG | chrX | 139535284 | 139535303 | 139535287 | - |
| SEQ ID NO 11285 | AACCTCCATCTCCCAGGTTC | AAG | chrX | 139535278 | 139535297 | 139535281 | - |
| SEQ ID NO 11286 | TTCAAGCTATTCTCCTGCCT | CAG | chrX | 139535261 | 139535280 | 139535264 | - |
| SEQ ID NO 11287 | TTCTCCTGCCTCAGCCTCCC | AAG | chrX | 139535252 | 139535271 | 139535255 | - |
| SEQ ID NO 11288 | TCCTGCCTCAGCCTCCCAAG | TAG | chrX | 139535249 | 139535268 | 139535252 | - |
| SEQ ID NO 11289 | GCCTCAGCCTCCCAAGTAGC | TGG | chrX | 139535245 | 139535264 | 139535248 | - |
| SEQ ID NO 11290 | CCTCAGCCTCCCAAGTAGCT | GGG | chrX | 139535244 | 139535263 | 139535247 | - |
| SEQ ID NO 11291 | CTCCCAAGTAGCTGGGATTA | CAG | chrX | 139535237 | 139535256 | 139535240 | - |
| SEQ ID NO 11292 | TCCCAAGTAGCTGGGATTAC | AGG | chrX | 139535236 | 139535255 | 139535239 | - |
| SEQ ID NO 11293 | CAGGCACCCGCCACCATGCC | CAG | chrX | 139535217 | 139535236 | 139535220 | - |
| SEQ ID NO 11294 | CCAGCTAATTTTTGTATTTT | TAG | chrX | 139535198 | 139535217 | 139535201 | - |
| SEQ ID NO 11295 | TAATTTTTGTATTTTTAGTA | AAG | chrX | 139535193 | 139535212 | 139535196 | - |
| SEQ ID NO 11296 | TTTTGTATTTTTAGTAAAGC | CGG | chrX | 139535189 | 139535208 | 139535192 | - |
| SEQ ID NO 11297 | TTTGTATTTTTAGTAAAGCC | GGG | chrX | 139535188 | 139535207 | 139535191 | - |

Figure 37 (Cont'd)

| | | | | | | | |
|---|---|---|---|---|---|---|---|
| SEQ ID NO 11298 | TTGTATTTTTAGTAAAGCCG | GGG | chrX | 139535187 | 139535206 | 139535190 | - |
| SEQ ID NO 11299 | GTTTCACCATTTCACCTTGT | TGG | chrX | 139535165 | 139535184 | 139535168 | - |
| SEQ ID NO 11300 | CACCATTTCACCTTGTTGGC | CAG | chrX | 139535161 | 139535180 | 139535164 | - |
| SEQ ID NO 11301 | ACCATTTCACCTTGTTGGCC | AGG | chrX | 139535160 | 139535179 | 139535163 | - |
| SEQ ID NO 11302 | TTTCACCTTGTTGGCCAGGC | TGG | chrX | 139535156 | 139535175 | 139535159 | - |
| SEQ ID NO 11303 | GGTGTCGAACTCCTGACCTC | AAG | chrX | 139535135 | 139535154 | 139535138 | - |
| SEQ ID NO 11304 | CCTCAAGTGATCTGCCTGCC | TGG | chrX | 139535119 | 139535138 | 139535122 | - |
| SEQ ID NO 11305 | CTCAAGTGATCTGCCTGCCT | GGG | chrX | 139535118 | 139535137 | 139535121 | - |
| SEQ ID NO 11306 | CTGCCTGCCTGGGCCTCTGA | AAG | chrX | 139535108 | 139535127 | 139535111 | - |
| SEQ ID NO 11307 | GCCTGGGCCTCTGAAAGTGC | TGG | chrX | 139535102 | 139535121 | 139535105 | - |
| SEQ ID NO 11308 | CCTGGGCCTCTGAAAGTGCT | GGG | chrX | 139535101 | 139535120 | 139535104 | - |
| SEQ ID NO 11309 | CTCTGAAAGTGCTGGGATTA | TAG | chrX | 139535094 | 139535113 | 139535097 | - |
| SEQ ID NO 11310 | TCTGAAAGTGCTGGGATTAT | AGG | chrX | 139535093 | 139535112 | 139535096 | - |
| SEQ ID NO 11311 | AGTGCTGGGATTATAGGTGT | GAG | chrX | 139535087 | 139535106 | 139535090 | - |
| SEQ ID NO 11312 | ATAGGTGTGAGCCACCATGC | CAG | chrX | 139535075 | 139535094 | 139535078 | - |
| SEQ ID NO 11313 | TAGGTGTGAGCCACCATGCC | AGG | chrX | 139535074 | 139535093 | 139535077 | - |
| SEQ ID NO 11314 | GCCTCTCTTCAACTCTTCAT | TGG | chrX | 139535052 | 139535071 | 139535055 | - |
| SEQ ID NO 11315 | CTGTGCCCACCCTGCAATCC | TAG | chrX | 139534994 | 139535013 | 139534997 | - |
| SEQ ID NO 11316 | TGCAATCCTAGCCCCTAAAT | TGG | chrX | 139534982 | 139535001 | 139534985 | - |
| SEQ ID NO 11317 | CAATCCTAGCCCCTAAATTG | GAG | chrX | 139534980 | 139534999 | 139534983 | - |
| SEQ ID NO 11318 | TCCTAGCCCCTAAATTGGAG | CAG | chrX | 139534977 | 139534996 | 139534980 | - |
| SEQ ID NO 11319 | TGCCTTCATCCTTCTCTTCC | CAG | chrX | 139534949 | 139534968 | 139534952 | - |
| SEQ ID NO 11320 | TTCATCCTTCTCTTCCCAGA | CAG | chrX | 139534945 | 139534964 | 139534948 | - |
| SEQ ID NO 11321 | CCTTCTCTTCCCAGACAGCC | GAG | chrX | 139534940 | 139534959 | 139534943 | - |
| SEQ ID NO 11322 | CTTCTCTTCCCAGACAGCCG | AGG | chrX | 139534939 | 139534958 | 139534942 | - |
| SEQ ID NO 11323 | CCAGACAGCCGAGGACTGTG | AAG | chrX | 139534930 | 139534949 | 139534933 | - |
| SEQ ID NO 11324 | CAGACAGCCGAGGACTGTGA | AGG | chrX | 139534929 | 139534948 | 139534932 | - |
| SEQ ID NO 11325 | GGAAAAAAATCACCAAAATG | CAG | chrX | 139534908 | 139534927 | 139534911 | - |
| SEQ ID NO 11326 | AAAAATCACCAAAATGCAGA | TGG | chrX | 139534904 | 139534923 | 139534907 | - |
| SEQ ID NO 11327 | CACCACATATTGATGCCTCA | CAG | chrX | 139534877 | 139534896 | 139534880 | - |
| SEQ ID NO 11328 | CCTCCACCCACCTCTCTGCT | CAG | chrX | 139534854 | 139534873 | 139534857 | - |
| SEQ ID NO 11329 | TGCTCAGCAACTCATTTACT | TGG | chrX | 139534838 | 139534857 | 139534841 | - |
| SEQ ID NO 11330 | GCAACTCATTTACTTGGCCC | TGG | chrX | 139534832 | 139534851 | 139534835 | - |
| SEQ ID NO 11331 | TGGCCCTGGACACTCCTAAA | TAG | chrX | 139534818 | 139534837 | 139534821 | - |
| SEQ ID NO 11332 | TCCATGCCTGCATCCATTTA | CAG | chrX | 139534793 | 139534812 | 139534796 | - |
| SEQ ID NO 11333 | ATCCATTTACAGTCGTTCCT | CAG | chrX | 139534782 | 139534801 | 139534785 | - |
| SEQ ID NO 11334 | CAGTCGTTCCTCAGTATCCA | TGG | chrX | 139534773 | 139534792 | 139534776 | - |
| SEQ ID NO 11335 | CCTCAGTATCCATGGAAAAT | TGG | chrX | 139534765 | 139534784 | 139534768 | - |
| SEQ ID NO 11336 | CAGTATCCATGGAAAATTGG | TGG | chrX | 139534762 | 139534781 | 139534765 | - |
| SEQ ID NO 11337 | ATCCATGGAAAATTGGTGGC | AAG | chrX | 139534758 | 139534777 | 139534761 | - |
| SEQ ID NO 11338 | CAAGACCCCTGCAAATATC | AAG | chrX | 139534739 | 139534758 | 139534742 | - |
| SEQ ID NO 11339 | CCTGCAAATATCAAGATCTG | TGG | chrX | 139534731 | 139534750 | 139534734 | - |
| SEQ ID NO 11340 | ATCAAGATCTGTGGATGCTC | AAG | chrX | 139534722 | 139534741 | 139534725 | - |
| SEQ ID NO 11341 | TCAAGTCTCCGATATAAAAA | TGG | chrX | 139534704 | 139534723 | 139534707 | - |
| SEQ ID NO 11342 | TTTGTACTTTAAATCATCTC | TAG | chrX | 139534647 | 139534666 | 139534650 | - |
| SEQ ID NO 11343 | TTGTACTTTAAATCATCTCT | AGG | chrX | 139534646 | 139534665 | 139534649 | - |
| SEQ ID NO 11344 | CATCTCTAGGTTTCTCTTAA | TAG | chrX | 139534633 | 139534652 | 139534636 | - |
| SEQ ID NO 11345 | CAATGTAAATGCTATGTAAA | TAG | chrX | 139534604 | 139534623 | 139534607 | - |
| SEQ ID NO 11346 | AGTTGTTATGCTGTATTGTT | TAG | chrX | 139534583 | 139534602 | 139534586 | - |

Figure 37 (Cont'd)

| SEQ ID NO 11347 | GTTGTTATGCTGTATTGTTT | AGG | chrX | 139534582 | 139534601 | 139534585 | - |
| SEQ ID NO 11348 | TTGTTATGCTGTATTGTTTA | GGG | chrX | 139534581 | 139534600 | 139534584 | - |
| SEQ ID NO 11349 | TATTGTTTAGGGAATAATGA | AAG | chrX | 139534570 | 139534589 | 139534573 | - |
| SEQ ID NO 11350 | TAGGGAATAATGAAAGATAA | AAG | chrX | 139534563 | 139534582 | 139534566 | - |
| SEQ ID NO 11351 | GGGAATAATGAAAGATAAAA | GAG | chrX | 139534561 | 139534580 | 139534564 | - |
| SEQ ID NO 11352 | TAAAAGAGTCTGTACATGTT | CAG | chrX | 139534546 | 139534565 | 139534549 | - |
| SEQ ID NO 11353 | AAGAGTCTGTACATGTTCAG | TAG | chrX | 139534543 | 139534562 | 139534546 | - |
| SEQ ID NO 11354 | GAGTCTGTACATGTTCAGTA | GAG | chrX | 139534541 | 139534560 | 139534544 | - |
| SEQ ID NO 11355 | TCTTGAATATTTTTGATCTG | CAG | chrX | 139534499 | 139534518 | 139534502 | - |
| SEQ ID NO 11356 | TCTGCAGTTAATTGAATCTG | TGG | chrX | 139534483 | 139534502 | 139534486 | - |
| SEQ ID NO 11357 | GTTAATTGAATCTGTGGCTG | TGG | chrX | 139534477 | 139534496 | 139534480 | - |
| SEQ ID NO 11358 | TCTGTGGCTGTGGAACTCAC | AAG | chrX | 139534467 | 139534486 | 139534470 | - |
| SEQ ID NO 11359 | CTGTGGCTGTGGAACTCACA | AGG | chrX | 139534466 | 139534485 | 139534469 | - |
| SEQ ID NO 11360 | GTGGCTGTGGAACTCACAAG | GAG | chrX | 139534464 | 139534483 | 139534467 | - |
| SEQ ID NO 11361 | GGCTGTGGAACTCACAAGGA | GAG | chrX | 139534462 | 139534481 | 139534465 | - |
| SEQ ID NO 11362 | CACAAGGAGAGCTGACTGTA | CAG | chrX | 139534450 | 139534469 | 139534453 | - |
| SEQ ID NO 11363 | GGAGAGCTGACTGTACAGTG | TGG | chrX | 139534445 | 139534464 | 139534448 | - |
| SEQ ID NO 11364 | GCTGACTGTACAGTGTGGTT | GAG | chrX | 139534440 | 139534459 | 139534443 | - |
| SEQ ID NO 11365 | AGTGTGGTTGAGTGAAAAAA | CAG | chrX | 139534429 | 139534448 | 139534432 | - |
| SEQ ID NO 11366 | TTGAGTGAAAAAACAGACTT | TAG | chrX | 139534422 | 139534441 | 139534425 | - |
| SEQ ID NO 11367 | GAAAAAACAGACTTTAGAAT | CAG | chrX | 139534416 | 139534435 | 139534419 | - |
| SEQ ID NO 11368 | AACAGACTTTAGAATCAGAT | CAG | chrX | 139534411 | 139534430 | 139534414 | - |
| SEQ ID NO 11369 | GACTTTAGAATCAGATCAGA | CAG | chrX | 139534407 | 139534426 | 139534410 | - |
| SEQ ID NO 11370 | AGAATCAGATCAGACAGAAA | TAG | chrX | 139534401 | 139534420 | 139534404 | - |
| SEQ ID NO 11371 | GAATCAGATCAGACAGAAAT | AGG | chrX | 139534400 | 139534419 | 139534403 | - |
| SEQ ID NO 11372 | GACAGAAATAGGTTTGAATC | AAG | chrX | 139534389 | 139534408 | 139534392 | - |
| SEQ ID NO 11373 | AATCAAGTATCTGCCTCCTC | TAG | chrX | 139534373 | 139534392 | 139534376 | - |
| SEQ ID NO 11374 | CTCCTCTAGACCTGTGACCT | TGG | chrX | 139534359 | 139534378 | 139534362 | - |
| SEQ ID NO 11375 | CTAGACCTGTGACCTTGGAC | AAG | chrX | 139534354 | 139534373 | 139534357 | - |
| SEQ ID NO 11376 | TGACCTTGGACAAGTCACAC | AAG | chrX | 139534345 | 139534364 | 139534348 | - |
| SEQ ID NO 11377 | TAACTTTGTCAAATGTAAAT | TAG | chrX | 139534312 | 139534331 | 139534315 | - |
| SEQ ID NO 11378 | AACTTTGTCAAATGTAAATT | AGG | chrX | 139534311 | 139534330 | 139534314 | - |
| SEQ ID NO 11379 | CAAATGTAAATTAGGTTTAA | CAG | chrX | 139534303 | 139534322 | 139534306 | - |
| SEQ ID NO 11380 | ATGTAAATTAGGTTTAACAG | TAG | chrX | 139534300 | 139534319 | 139534303 | - |
| SEQ ID NO 11381 | AGGTTTAACAGTAGTATAAT | AAG | chrX | 139534291 | 139534310 | 139534294 | - |
| SEQ ID NO 11382 | TAATAAGAATATCTATCTCA | CAG | chrX | 139534275 | 139534294 | 139534278 | - |
| SEQ ID NO 11383 | AATAAGAATATCTATCTCAC | AGG | chrX | 139534274 | 139534293 | 139534277 | - |
| SEQ ID NO 11384 | AATATCTATCTCACAGGTGT | TGG | chrX | 139534268 | 139534287 | 139534271 | - |
| SEQ ID NO 11385 | ATCTATCTCACAGGTGTTGG | CAG | chrX | 139534265 | 139534284 | 139534268 | - |
| SEQ ID NO 11386 | TCTATCTCACAGGTGTTGGC | AGG | chrX | 139534264 | 139534283 | 139534267 | - |
| SEQ ID NO 11387 | CTCACAGGTGTTGGCAGGAT | CAG | chrX | 139534259 | 139534278 | 139534262 | - |
| SEQ ID NO 11388 | CAGGTGTTGGCAGGATCAGT | GAG | chrX | 139534255 | 139534274 | 139534258 | - |
| SEQ ID NO 11389 | GGATCAGTGAGACAATATGC | TGG | chrX | 139534243 | 139534262 | 139534246 | - |
| SEQ ID NO 11390 | TCTCCCTACTCCTTTCATGT | TGG | chrX | 139534209 | 139534228 | 139534212 | - |
| SEQ ID NO 11391 | TTAAATTTCTCAATTCTCTT | TAG | chrX | 139534169 | 139534188 | 139534172 | - |
| SEQ ID NO 11392 | GCTCTTTAATAACTTCTGTG | TAG | chrX | 139534147 | 139534166 | 139534150 | - |
| SEQ ID NO 11393 | GAAATGACTATTGTCACAAT | CAG | chrX | 139534092 | 139534111 | 139534095 | - |
| SEQ ID NO 11394 | AAATGACTATTGTCACAATC | AGG | chrX | 139534091 | 139534110 | 139534094 | - |
| SEQ ID NO 11395 | TCACAATCAGGAATGACCTA | AAG | chrX | 139534079 | 139534098 | 139534082 | - |

Figure 37 (Cont'd)

| | | | | | | | |
|---|---|---|---|---|---|---|---|
| SEQ ID NO 11396 | ATGACCTAAAGAATAATTTT | GAG | chrX | 139534067 | 139534086 | 139534070 | - |
| SEQ ID NO 11397 | TTTTGAGTTTATGTATTTAC | TGG | chrX | 139534051 | 139534070 | 139534054 | - |
| SEQ ID NO 11398 | ATTGTTGATCTCTCCCTTTT | TAG | chrX | 139534009 | 139534028 | 139534012 | - |
| SEQ ID NO 11399 | TTGTTGATCTCTCCCTTTTT | AGG | chrX | 139534008 | 139534027 | 139534011 | - |
| SEQ ID NO 11400 | TTATAATAATCACTCTATTC | TGG | chrX | 139533976 | 139533995 | 139533979 | - |
| SEQ ID NO 11401 | TCTAACTCCTGTTATCCATC | CAG | chrX | 139533940 | 139533959 | 139533943 | - |
| SEQ ID NO 11402 | TTAACTCCTGTTCCTCTCCA | TGG | chrX | 139533905 | 139533924 | 139533908 | - |
| SEQ ID NO 11403 | CTCCATGGCCCTTAAATGTC | CAG | chrX | 139533890 | 139533909 | 139533893 | - |
| SEQ ID NO 11404 | TCCATGGCCCTTAAATGTCC | AGG | chrX | 139533889 | 139533908 | 139533892 | - |
| SEQ ID NO 11405 | CCATGGCCCTTAAATGTCCA | GGG | chrX | 139533888 | 139533907 | 139533891 | - |
| SEQ ID NO 11406 | TTAAATGTCCAGGGTTCTCC | CAG | chrX | 139533879 | 139533898 | 139533882 | - |
| SEQ ID NO 11407 | TAAATGTCCAGGGTTCTCCC | AGG | chrX | 139533878 | 139533897 | 139533881 | - |
| SEQ ID NO 11408 | TCCAGGGTTCTCCCAGGCTC | CAG | chrX | 139533872 | 139533891 | 139533875 | - |
| SEQ ID NO 11409 | GTTCTCCCAGGCTCCAGCCT | CAG | chrX | 139533866 | 139533885 | 139533869 | - |
| SEQ ID NO 11410 | TTCACCTTATATATACTTGC | TAG | chrX | 139533832 | 139533851 | 139533835 | - |
| SEQ ID NO 11411 | TCACCTTATATATACTTGCT | AGG | chrX | 139533831 | 139533850 | 139533834 | - |
| SEQ ID NO 11412 | CACCTTATATATACTTGCTA | GGG | chrX | 139533830 | 139533849 | 139533833 | - |
| SEQ ID NO 11413 | TTATATATACTTGCTAGGGC | TGG | chrX | 139533826 | 139533845 | 139533829 | - |
| SEQ ID NO 11414 | TATATATACTTGCTAGGGCT | GGG | chrX | 139533825 | 139533844 | 139533828 | - |
| SEQ ID NO 11415 | ATACTTGCTAGGGCTGGGAC | AAG | chrX | 139533820 | 139533839 | 139533823 | - |
| SEQ ID NO 11416 | ACTTGCTAGGGCTGGGACAA | GAG | chrX | 139533818 | 139533837 | 139533821 | - |
| SEQ ID NO 11417 | GGGACAAGAGTGAACCAAAC | AAG | chrX | 139533805 | 139533824 | 139533808 | - |
| SEQ ID NO 11418 | GGACAAGAGTGAACCAAACA | AGG | chrX | 139533804 | 139533823 | 139533807 | - |
| SEQ ID NO 11419 | AGTGAACCAAACAAGGCATG | TAG | chrX | 139533797 | 139533816 | 139533800 | - |
| SEQ ID NO 11420 | GTGAACCAAACAAGGCATGT | AGG | chrX | 139533796 | 139533815 | 139533799 | - |
| SEQ ID NO 11421 | TGAACCAAACAAGGCATGTA | GGG | chrX | 139533795 | 139533814 | 139533798 | - |
| SEQ ID NO 11422 | GCATGTAGGGCACAATATTT | AAG | chrX | 139533782 | 139533801 | 139533785 | - |
| SEQ ID NO 11423 | ATGTAGGGCACAATATTTAA | GAG | chrX | 139533780 | 139533799 | 139533783 | - |
| SEQ ID NO 11424 | TGTAGGGCACAATATTTAAG | AGG | chrX | 139533779 | 139533798 | 139533782 | - |
| SEQ ID NO 11425 | TTTAAGAGGTCCTCACTTCT | CGG | chrX | 139533765 | 139533784 | 139533768 | - |
| SEQ ID NO 11426 | TTAAGAGGTCCTCACTTCTC | GGG | chrX | 139533764 | 139533783 | 139533767 | - |
| SEQ ID NO 11427 | TAAGAGGTCCTCACTTCTCG | GGG | chrX | 139533763 | 139533782 | 139533766 | - |
| SEQ ID NO 11428 | CCTCACTTCTCGGGGCATAC | AAG | chrX | 139533755 | 139533774 | 139533758 | - |
| SEQ ID NO 11429 | ACAAGTATATTTATGCCCTA | CAG | chrX | 139533737 | 139533756 | 139533740 | - |
| SEQ ID NO 11430 | CAAGTATATTTATGCCCTAC | AGG | chrX | 139533736 | 139533755 | 139533739 | - |
| SEQ ID NO 11431 | CCTACAGGCCTTGCTTACCA | CAG | chrX | 139533721 | 139533740 | 139533724 | - |
| SEQ ID NO 11432 | AGGCCTTGCTTACCACAGTC | TAG | chrX | 139533716 | 139533735 | 139533719 | - |
| SEQ ID NO 11433 | TTGCTTACCACAGTCTAGTC | CGG | chrX | 139533711 | 139533730 | 139533714 | - |
| SEQ ID NO 11434 | CCCTGTCAACAAAATTTACT | GAG | chrX | 139533682 | 139533701 | 139533685 | - |
| SEQ ID NO 11435 | GAGCATACAACCACTACTGC | CAG | chrX | 139533662 | 139533681 | 139533665 | - |
| SEQ ID NO 11436 | AGCATACAACCACTACTGCC | AGG | chrX | 139533661 | 139533680 | 139533664 | - |
| SEQ ID NO 11437 | ACTACTGCCAGGCACTGTAC | TAG | chrX | 139533650 | 139533669 | 139533653 | - |
| SEQ ID NO 11438 | CTACTGCCAGGCACTGTACT | AGG | chrX | 139533649 | 139533668 | 139533652 | - |
| SEQ ID NO 11439 | CAATATCCATGCTCACTCTC | CAG | chrX | 139533621 | 139533640 | 139533624 | - |
| SEQ ID NO 11440 | TCTCCAGATGCCCACACACG | TGG | chrX | 139533605 | 139533624 | 139533608 | - |
| SEQ ID NO 11441 | GTGGCTGTAACTACTGTTTA | CAG | chrX | 139533586 | 139533605 | 139533589 | - |
| SEQ ID NO 11442 | ACTACTGTTTACAGAACAAT | GAG | chrX | 139533577 | 139533596 | 139533580 | - |
| SEQ ID NO 11443 | GAGTTCCAAATACTCACCTA | TAG | chrX | 139533557 | 139533576 | 139533560 | - |
| SEQ ID NO 11444 | TCCAAATACTCACCTATAGT | CAG | chrX | 139533553 | 139533572 | 139533556 | - |

Figure 37 (Cont'd)

| | | | | | | | |
|---|---|---|---|---|---|---|---|
| SEQ ID NO 11445 | CAGATACGTCTCCTGAATTT | CAG | chrX | 139533533 | 139533552 | 139533536 | - |
| SEQ ID NO 11446 | CCTAACTGTATATCATAATG | TAG | chrX | 139533494 | 139533513 | 139533497 | - |
| SEQ ID NO 11447 | ACTGTATATCATAATGTAGC | CAG | chrX | 139533490 | 139533509 | 139533493 | - |
| SEQ ID NO 11448 | TATCATAATGTAGCCAGTAA | TAG | chrX | 139533484 | 139533503 | 139533487 | - |
| SEQ ID NO 11449 | ATGTAATGCTTCTGCTGTGT | TGG | chrX | 139533452 | 139533471 | 139533455 | - |
| SEQ ID NO 11450 | GCTGTGTTGGACACTGTGCT | CAG | chrX | 139533439 | 139533458 | 139533442 | - |
| SEQ ID NO 11451 | ATCTCACTTCATCCTCACAA | AAG | chrX | 139533400 | 139533419 | 139533403 | - |
| SEQ ID NO 11452 | CATCCTCACAAAAGTCCCAC | GAG | chrX | 139533391 | 139533410 | 139533394 | - |
| SEQ ID NO 11453 | CTCACAAAAGTCCCACGAGA | TAG | chrX | 139533387 | 139533406 | 139533390 | - |
| SEQ ID NO 11454 | TCACAAAAGTCCCACGAGAT | AGG | chrX | 139533386 | 139533405 | 139533389 | - |
| SEQ ID NO 11455 | GTCATCTTATTTTTATGAAT | GAG | chrX | 139533359 | 139533378 | 139533362 | - |
| SEQ ID NO 11456 | TCATCTTATTTTTATGAATG | AGG | chrX | 139533358 | 139533377 | 139533361 | - |
| SEQ ID NO 11457 | TCTTATTTTTATGAATGAGG | AAG | chrX | 139533355 | 139533374 | 139533358 | - |
| SEQ ID NO 11458 | ATTTTTATGAATGAGGAAGA | TAG | chrX | 139533351 | 139533370 | 139533354 | - |
| SEQ ID NO 11459 | GAATGAGGAAGATAGATTCA | TAG | chrX | 139533343 | 139533362 | 139533346 | - |
| SEQ ID NO 11460 | ATGAGGAAGATAGATTCATA | GAG | chrX | 139533341 | 139533360 | 139533344 | - |
| SEQ ID NO 11461 | TGAGGAAGATAGATTCATAG | AGG | chrX | 139533340 | 139533359 | 139533343 | - |
| SEQ ID NO 11462 | AAGATAGATTCATAGAGGCT | AAG | chrX | 139533335 | 139533354 | 139533338 | - |
| SEQ ID NO 11463 | AGATAGATTCATAGAGGCTA | AGG | chrX | 139533334 | 139533353 | 139533337 | - |
| SEQ ID NO 11464 | GATAGATTCATAGAGGCTAA | GGG | chrX | 139533333 | 139533352 | 139533336 | - |
| SEQ ID NO 11465 | AGAGGCTAAGGGCTTTGCCC | AAG | chrX | 139533322 | 139533341 | 139533325 | - |
| SEQ ID NO 11466 | GAGGCTAAGGGCTTTGCCCA | AGG | chrX | 139533321 | 139533340 | 139533324 | - |
| SEQ ID NO 11467 | AGGTAACATACTAAAACATT | CAG | chrX | 139533301 | 139533320 | 139533304 | - |
| SEQ ID NO 11468 | GGTAACATACTAAAACATTC | AGG | chrX | 139533300 | 139533319 | 139533303 | - |
| SEQ ID NO 11469 | ATACTAAAACATTCAGGATT | CAG | chrX | 139533294 | 139533313 | 139533297 | - |
| SEQ ID NO 11470 | AACATTCAGGATTCAGACTC | TGG | chrX | 139533287 | 139533306 | 139533290 | - |
| SEQ ID NO 11471 | ATTCAGGATTCAGACTCTGG | CAG | chrX | 139533284 | 139533303 | 139533287 | - |
| SEQ ID NO 11472 | AGGATTCAGACTCTGGCAGT | CAG | chrX | 139533280 | 139533299 | 139533283 | - |
| SEQ ID NO 11473 | AGACTCTGGCAGTCAGACTA | AAG | chrX | 139533273 | 139533292 | 139533276 | - |
| SEQ ID NO 11474 | ACTCTGGCAGTCAGACTAAA | GAG | chrX | 139533271 | 139533290 | 139533274 | - |
| SEQ ID NO 11475 | TGGCAGTCAGACTAAAGAGC | CAG | chrX | 139533267 | 139533286 | 139533270 | - |
| SEQ ID NO 11476 | GACTAAAGAGCCAGTTCTCT | TAG | chrX | 139533258 | 139533277 | 139533261 | - |
| SEQ ID NO 11477 | TTCTCTTAGACATTATTCTG | TGG | chrX | 139533244 | 139533263 | 139533247 | - |
| SEQ ID NO 11478 | CCATAATCACATCAAACACA | AAG | chrX | 139533220 | 139533239 | 139533223 | - |
| SEQ ID NO 11479 | ACATCAAACACAAAGTCCCC | AAG | chrX | 139533212 | 139533231 | 139533215 | - |
| SEQ ID NO 11480 | ACACAAAGTCCCCAAGACTC | TAG | chrX | 139533205 | 139533224 | 139533208 | - |
| SEQ ID NO 11481 | GCCATTTCCCCTTCCATACC | CAG | chrX | 139533183 | 139533202 | 139533186 | - |
| SEQ ID NO 11482 | TTTCCCCTTCCATACCCAGA | TGG | chrX | 139533179 | 139533198 | 139533182 | - |
| SEQ ID NO 11483 | CCTTCCATACCCAGATGGTT | AAG | chrX | 139533174 | 139533193 | 139533177 | - |
| SEQ ID NO 11484 | TTTTTTGTACTGCTACTGTT | CAG | chrX | 139533108 | 139533127 | 139533111 | - |
| SEQ ID NO 11485 | TTTTTGTACTGCTACTGTTC | AGG | chrX | 139533107 | 139533126 | 139533110 | - |
| SEQ ID NO 11486 | TACTGCTACTGTTCAGGTTC | TAG | chrX | 139533101 | 139533120 | 139533104 | - |
| SEQ ID NO 11487 | TCTAGCCTTTATGTCTCCCG | CAG | chrX | 139533083 | 139533102 | 139533086 | - |
| SEQ ID NO 11488 | TCTCCCGCAGATAATTGCAA | TAG | chrX | 139533070 | 139533089 | 139533073 | - |
| SEQ ID NO 11489 | GCAGATAATTGCAATAGTCT | CAG | chrX | 139533064 | 139533083 | 139533067 | - |
| SEQ ID NO 11490 | CAGATAATTGCAATAGTCTC | AGG | chrX | 139533063 | 139533082 | 139533066 | - |
| SEQ ID NO 11491 | GTCTCAGGACTGCTCTCTCC | TAG | chrX | 139533048 | 139533067 | 139533051 | - |
| SEQ ID NO 11492 | GGACTGCTCTCTCCTAGTCT | TGG | chrX | 139533042 | 139533061 | 139533045 | - |
| SEQ ID NO 11493 | GCTCTCTCCTAGTCTTGGTA | CGG | chrX | 139533037 | 139533056 | 139533040 | - |

Figure 37 (Cont'd)

| SEQ ID NO 11494 | CTCCCCCACTATCATTTCAT | TAG | chrX | 139533010 | 139533029 | 139533013 | - |
|---|---|---|---|---|---|---|---|
| SEQ ID NO 11495 | TCATTTCATTAGCGTGTTGC | CAG | chrX | 139532999 | 139533018 | 139533002 | - |
| SEQ ID NO 11496 | TCATTAGCGTGTTGCCAGAC | TGG | chrX | 139532994 | 139533013 | 139532997 | - |
| SEQ ID NO 11497 | CATTAGCGTGTTGCCAGACT | GGG | chrX | 139532993 | 139533012 | 139532996 | - |
| SEQ ID NO 11498 | CCAGACTGGGCATCCTAAAT | CAG | chrX | 139532980 | 139532999 | 139532983 | - |
| SEQ ID NO 11499 | GGGCATCCTAAATCAGCCAT | CAG | chrX | 139532973 | 139532992 | 139532976 | - |
| SEQ ID NO 11500 | CATCCTAAATCAGCCATCAG | TGG | chrX | 139532970 | 139532989 | 139532973 | - |
| SEQ ID NO 11501 | ATTTTATTGTCCAATCTCCT | TAG | chrX | 139532910 | 139532929 | 139532913 | - |
| SEQ ID NO 11502 | TTTTATTGTCCAATCTCCTT | AGG | chrX | 139532909 | 139532928 | 139532912 | - |
| SEQ ID NO 11503 | TGACTTCATTATCTGATGAC | CAG | chrX | 139532882 | 139532901 | 139532885 | - |
| SEQ ID NO 11504 | ATCTGATGACCAGCTCTGCC | TAG | chrX | 139532872 | 139532891 | 139532875 | - |
| SEQ ID NO 11505 | TTTACCTGTCTCACTTGTCA | TAG | chrX | 139532849 | 139532868 | 139532852 | - |
| SEQ ID NO 11506 | CTCACTTGTCATAGTCCATA | TGG | chrX | 139532840 | 139532859 | 139532843 | - |
| SEQ ID NO 11507 | CCTCACGTTCTTGCAAATCT | GAG | chrX | 139532794 | 139532813 | 139532797 | - |
| SEQ ID NO 11508 | GCAAATCTGAGTCTTTGCAC | GAG | chrX | 139532782 | 139532801 | 139532785 | - |
| SEQ ID NO 11509 | TGCATAAAATGCCCTTATAT | CAG | chrX | 139532749 | 139532768 | 139532752 | - |
| SEQ ID NO 11510 | GCCCTTATATCAGACATTTA | AAG | chrX | 139532739 | 139532758 | 139532742 | - |
| SEQ ID NO 11511 | CCTTATATCAGACATTTAAA | GAG | chrX | 139532737 | 139532756 | 139532740 | - |
| SEQ ID NO 11512 | TTATATCAGACATTTAAAGA | GAG | chrX | 139532735 | 139532754 | 139532738 | - |
| SEQ ID NO 11513 | ATATCAGACATTTAAAGAGA | GAG | chrX | 139532733 | 139532752 | 139532736 | - |
| SEQ ID NO 11514 | AGAACGCCTACTCATCTTTT | AAG | chrX | 139532712 | 139532731 | 139532715 | - |
| SEQ ID NO 11515 | CCTACTCATCTTTTAAGACC | CAG | chrX | 139532706 | 139532725 | 139532709 | - |
| SEQ ID NO 11516 | TTCCTTTCTCTATGATCCCT | TAG | chrX | 139532639 | 139532658 | 139532642 | - |
| SEQ ID NO 11517 | CTCTATGATCCCTTAGTACC | TAG | chrX | 139532632 | 139532651 | 139532635 | - |
| SEQ ID NO 11518 | TTATATTGAAACCTCTCACC | TGG | chrX | 139532593 | 139532612 | 139532596 | - |
| SEQ ID NO 11519 | CACCTGGCCTCATGCTGCTT | TAG | chrX | 139532577 | 139532596 | 139532580 | - |
| SEQ ID NO 11520 | CCTCATGCTGCTTTAGATCA | AAG | chrX | 139532570 | 139532589 | 139532573 | - |
| SEQ ID NO 11521 | TCATGCTGCTTTAGATCAAA | GAG | chrX | 139532568 | 139532587 | 139532571 | - |
| SEQ ID NO 11522 | CATGCTGCTTTAGATCAAAG | AGG | chrX | 139532567 | 139532586 | 139532570 | - |
| SEQ ID NO 11523 | ATGCTGCTTTAGATCAAAGA | GGG | chrX | 139532566 | 139532585 | 139532569 | - |
| SEQ ID NO 11524 | GCTGCTTTAGATCAAAGAGG | GAG | chrX | 139532564 | 139532583 | 139532567 | - |
| SEQ ID NO 11525 | TTTAGATCAAAGAGGGAGTC | TGG | chrX | 139532559 | 139532578 | 139532562 | - |
| SEQ ID NO 11526 | CTGGTTTATCCCCATACCCC | TAG | chrX | 139532540 | 139532559 | 139532543 | - |
| SEQ ID NO 11527 | ATACCCCTAGTACCCTGACA | CAG | chrX | 139532527 | 139532546 | 139532530 | - |
| SEQ ID NO 11528 | TAGTACCCTGACACAGTACC | TGG | chrX | 139532520 | 139532539 | 139532523 | - |
| SEQ ID NO 11529 | TGACACAGTACCTGGCACCA | TAG | chrX | 139532512 | 139532531 | 139532515 | - |
| SEQ ID NO 11530 | CTGGCACCATAGTTGTAACT | CAG | chrX | 139532501 | 139532520 | 139532504 | - |
| SEQ ID NO 11531 | AACTCAGTAATGTCTGAATG | AAG | chrX | 139532485 | 139532504 | 139532488 | - |
| SEQ ID NO 11532 | ACTCAGTAATGTCTGAATGA | AGG | chrX | 139532484 | 139532503 | 139532487 | - |
| SEQ ID NO 11533 | TACACTTTACAAAACTAAAC | TGG | chrX | 139532447 | 139532466 | 139532450 | - |
| SEQ ID NO 11534 | ACAAAACTAAACTGGTTTTA | CAG | chrX | 139532439 | 139532458 | 139532442 | - |
| SEQ ID NO 11535 | AACTGTTGCAATAATACCTA | AAG | chrX | 139532392 | 139532411 | 139532395 | - |
| SEQ ID NO 11536 | ACTGTTGCAATAATACCTAA | AGG | chrX | 139532391 | 139532410 | 139532394 | - |
| SEQ ID NO 11537 | GTTGCAATAATACCTAAAGG | CAG | chrX | 139532388 | 139532407 | 139532391 | - |
| SEQ ID NO 11538 | GCAATAATACCTAAAGGCAG | CAG | chrX | 139532385 | 139532404 | 139532388 | - |
| SEQ ID NO 11539 | GCCATGAAAATGCAACATCT | CAG | chrX | 139532363 | 139532382 | 139532366 | - |
| SEQ ID NO 11540 | TCACTCACCGAAACTCCTTT | TAG | chrX | 139532336 | 139532355 | 139532339 | - |
| SEQ ID NO 11541 | CTCACCGAAACTCCTTTTAG | AAG | chrX | 139532333 | 139532352 | 139532336 | - |
| SEQ ID NO 11542 | AACTCCTTTTAGAAGCCAAT | GAG | chrX | 139532325 | 139532344 | 139532328 | - |

Figure 37 (Cont'd)

| | | | | | | | |
|---|---|---|---|---|---|---|---|
| SEQ ID NO 11543 | CTCCTTTTAGAAGCCAATGA | GAG | chrX | 139532323 | 139532342 | 139532326 | - |
| SEQ ID NO 11544 | AGAAGCCAATGAGAGTTTAA | TAG | chrX | 139532315 | 139532334 | 139532318 | - |
| SEQ ID NO 11545 | AGCCAATGAGAGTTTAATAG | CAG | chrX | 139532312 | 139532331 | 139532315 | - |
| SEQ ID NO 11546 | CAATGAGAGTTTAATAGCAG | AAG | chrX | 139532309 | 139532328 | 139532312 | - |
| SEQ ID NO 11547 | ATGAGAGTTTAATAGCAGAA | GAG | chrX | 139532307 | 139532326 | 139532310 | - |
| SEQ ID NO 11548 | GAGAGTTTAATAGCAGAAGA | GAG | chrX | 139532305 | 139532324 | 139532308 | - |
| SEQ ID NO 11549 | GCATTAATACTGTCTATCCT | TAG | chrX | 139532278 | 139532297 | 139532281 | - |
| SEQ ID NO 11550 | TATCCTTAGAAAAATTCCCC | TGG | chrX | 139532264 | 139532283 | 139532267 | - |
| SEQ ID NO 11551 | ATTCCCCTGGCCCCTTCCTC | AAG | chrX | 139532251 | 139532270 | 139532254 | - |
| SEQ ID NO 11552 | TTCCCCTGGCCCCTTCCTCA | AGG | chrX | 139532250 | 139532269 | 139532253 | - |
| SEQ ID NO 11553 | TCCCCTGGCCCCTTCCTCAA | GGG | chrX | 139532249 | 139532268 | 139532252 | - |
| SEQ ID NO 11554 | CCTCAAGGGCTTATTATCTC | TGG | chrX | 139532235 | 139532254 | 139532238 | - |
| SEQ ID NO 11555 | CTTATTATCTCTGGCTACAA | TGG | chrX | 139532226 | 139532245 | 139532229 | - |
| SEQ ID NO 11556 | ATCTCTGGCTACAATGGCTG | CAG | chrX | 139532220 | 139532239 | 139532223 | - |
| SEQ ID NO 11557 | AATCACATTGCCTTTCTCCT | TAG | chrX | 139532197 | 139532216 | 139532200 | - |
| SEQ ID NO 11558 | CCTTTCTCCTTAGTATTATC | TGG | chrX | 139532187 | 139532206 | 139532190 | - |
| SEQ ID NO 11559 | CTTTCTCCTTAGTATTATCT | GGG | chrX | 139532186 | 139532205 | 139532189 | - |
| SEQ ID NO 11560 | TTTCTCCTTAGTATTATCTG | GGG | chrX | 139532185 | 139532204 | 139532188 | - |
| SEQ ID NO 11561 | TCGTATACTTAACTTCCCTT | CAG | chrX | 139532161 | 139532180 | 139532164 | - |
| SEQ ID NO 11562 | CGTATACTTAACTTCCCTTC | AGG | chrX | 139532160 | 139532179 | 139532163 | - |
| SEQ ID NO 11563 | CTTCCCTTCAGGTTATCGC | TAG | chrX | 139532149 | 139532168 | 139532152 | - |
| SEQ ID NO 11564 | TATCGCTAGTCATTATTTCC | CAG | chrX | 139532135 | 139532154 | 139532138 | - |
| SEQ ID NO 11565 | ATCGCTAGTCATTATTTCCC | AGG | chrX | 139532134 | 139532153 | 139532137 | - |
| SEQ ID NO 11566 | CATTATTTCCCAGGCTCCAA | AAG | chrX | 139532125 | 139532144 | 139532128 | - |
| SEQ ID NO 11567 | TTTCCCAGGCTCCAAAAGCC | TGG | chrX | 139532120 | 139532139 | 139532123 | - |
| SEQ ID NO 11568 | ATTCTTATCTATCCTTTCCC | CAG | chrX | 139532088 | 139532107 | 139532091 | - |
| SEQ ID NO 11569 | TATCCTTTCCCCAGCATCTG | AAG | chrX | 139532079 | 139532098 | 139532082 | - |
| SEQ ID NO 11570 | CCCCAGCATCTGAAGTCTTC | AAG | chrX | 139532071 | 139532090 | 139532074 | - |
| SEQ ID NO 11571 | CCCAGCATCTGAAGTCTTCA | AGG | chrX | 139532070 | 139532089 | 139532073 | - |
| SEQ ID NO 11572 | CCAGCATCTGAAGTCTTCAA | GGG | chrX | 139532069 | 139532088 | 139532072 | - |
| SEQ ID NO 11573 | CAGCATCTGAAGTCTTCAAG | GGG | chrX | 139532068 | 139532087 | 139532071 | - |
| SEQ ID NO 11574 | AGCATCTGAAGTCTTCAAGG | GGG | chrX | 139532067 | 139532086 | 139532070 | - |
| SEQ ID NO 11575 | ATCTGAAGTCTTCAAGGGGG | CAG | chrX | 139532064 | 139532083 | 139532067 | - |
| SEQ ID NO 11576 | TGAAGTCTTCAAGGGGGCAG | AAG | chrX | 139532061 | 139532080 | 139532064 | - |
| SEQ ID NO 11577 | TCATCATCTCACCACTTATA | TAG | chrX | 139532024 | 139532043 | 139532027 | - |
| SEQ ID NO 11578 | TCATCTCACCACTTATATAG | AAG | chrX | 139532021 | 139532040 | 139532024 | - |
| SEQ ID NO 11579 | CTCACCACTTATATAGAAGA | AAG | chrX | 139532017 | 139532036 | 139532020 | - |
| SEQ ID NO 11580 | TCACCACTTATATAGAAGAA | AGG | chrX | 139532016 | 139532035 | 139532019 | - |
| SEQ ID NO 11581 | CACCACTTATATAGAAGAAA | GGG | chrX | 139532015 | 139532034 | 139532018 | - |
| SEQ ID NO 11582 | CTTATATAGAAGAAAGGGTT | TGG | chrX | 139532010 | 139532029 | 139532013 | - |
| SEQ ID NO 11583 | GTTTGGATGCTTTGTCCTCC | CAG | chrX | 139531993 | 139532012 | 139531996 | - |
| SEQ ID NO 11584 | CTCCCAGATGTCACACTAAT | GAG | chrX | 139531977 | 139531996 | 139531980 | - |
| SEQ ID NO 11585 | CACTAATGAGATATATCTAA | TGG | chrX | 139531964 | 139531983 | 139531967 | - |
| SEQ ID NO 11586 | TGCTTTATGTCCTGCTTTGT | GAG | chrX | 139531938 | 139531957 | 139531941 | - |
| SEQ ID NO 11587 | CTTGACTTTACTCACTTTGC | TAG | chrX | 139531891 | 139531910 | 139531894 | - |
| SEQ ID NO 11588 | ATTTTTTTTTTATCGTTATTT | CAG | chrX | 139531856 | 139531875 | 139531859 | - |
| SEQ ID NO 11589 | TTATCGTTATTTCAGCATTT | CAG | chrX | 139531848 | 139531867 | 139531851 | - |
| SEQ ID NO 11590 | AGCATTTCAGTCTGATTTCA | CAG | chrX | 139531835 | 139531854 | 139531838 | - |
| SEQ ID NO 11591 | TTCACAGCTGACATCATGTC | TGG | chrX | 139531819 | 139531838 | 139531822 | - |

Figure 37 (Cont'd)

| SEQ ID NO | Sequence | Codon | Chr | Start | End | Pos | Strand |
|---|---|---|---|---|---|---|---|
| SEQ ID NO 11592 | CACAGCTGACATCATGTCTG | GAG | chrX | 139531817 | 139531836 | 139531820 | - |
| SEQ ID NO 11593 | AGCTGACATCATGTCTGGAG | TGG | chrX | 139531814 | 139531833 | 139531817 | - |
| SEQ ID NO 11594 | GCTGACATCATGTCTGGAGT | GGG | chrX | 139531813 | 139531832 | 139531816 | - |
| SEQ ID NO 11595 | CATGTCTGGAGTGGGAACCA | CAG | chrX | 139531805 | 139531824 | 139531808 | - |
| SEQ ID NO 11596 | ATGTCTGGAGTGGGAACCAC | AGG | chrX | 139531804 | 139531823 | 139531807 | - |
| SEQ ID NO 11597 | TGTCTGGAGTGGGAACCACA | GGG | chrX | 139531803 | 139531822 | 139531806 | - |
| SEQ ID NO 11598 | TGGAGTGGGAACCACAGGGC | CAG | chrX | 139531799 | 139531818 | 139531802 | - |
| SEQ ID NO 11599 | GTGGGAACCACAGGGCCAGT | CAG | chrX | 139531795 | 139531814 | 139531798 | - |
| SEQ ID NO 11600 | CACAGGGCCAGTCAGCTTTC | TGG | chrX | 139531787 | 139531806 | 139531790 | - |
| SEQ ID NO 11601 | ACAGGGCCAGTCAGCTTTCT | GGG | chrX | 139531786 | 139531805 | 139531789 | - |
| SEQ ID NO 11602 | CAGGGCCAGTCAGCTTTCTG | GGG | chrX | 139531785 | 139531804 | 139531788 | - |
| SEQ ID NO 11603 | AGGGCCAGTCAGCTTTCTGG | GGG | chrX | 139531784 | 139531803 | 139531787 | - |
| SEQ ID NO 11604 | GTCAGCTTTCTGGGGGTGCT | TAG | chrX | 139531777 | 139531796 | 139531780 | - |
| SEQ ID NO 11605 | TCAGCTTTCTGGGGGTGCTT | AGG | chrX | 139531776 | 139531795 | 139531779 | - |
| SEQ ID NO 11606 | CAGCTTTCTGGGGGTGCTTA | GGG | chrX | 139531775 | 139531794 | 139531778 | - |
| SEQ ID NO 11607 | TTTCTGGGGGTGCTTAGGGT | TGG | chrX | 139531771 | 139531790 | 139531774 | - |
| SEQ ID NO 11608 | AGGGTTGGCACCCCTGATCC | TGG | chrX | 139531756 | 139531775 | 139531759 | - |
| SEQ ID NO 11609 | ACCCCTGATCCTGGTACTGT | CAG | chrX | 139531747 | 139531766 | 139531750 | - |
| SEQ ID NO 11610 | ATCCTGGTACTGTCAGCTAC | TAG | chrX | 139531740 | 139531759 | 139531743 | - |
| SEQ ID NO 11611 | TCAGCTACTAGATTTGATTC | TAG | chrX | 139531728 | 139531747 | 139531731 | - |
| SEQ ID NO 11612 | CTACTAGATTTGATTCTAGA | AAG | chrX | 139531724 | 139531743 | 139531727 | - |
| SEQ ID NO 11613 | TTTGATTCTAGAAAGTTGAC | AAG | chrX | 139531716 | 139531735 | 139531719 | - |
| SEQ ID NO 11614 | ATTCTAGAAAGTTGACAAGT | AAG | chrX | 139531712 | 139531731 | 139531715 | - |
| SEQ ID NO 11615 | GTGTGATAAATGCTTCCTGT | GAG | chrX | 139531690 | 139531709 | 139531693 | - |
| SEQ ID NO 11616 | GAACATGCTGTTTGTCCAAA | TGG | chrX | 139531668 | 139531687 | 139531671 | - |
| SEQ ID NO 11617 | AACATGCTGTTTGTCCAAAT | GGG | chrX | 139531667 | 139531686 | 139531670 | - |
| SEQ ID NO 11618 | CTTCCTGTATGCCTTCCTC | TGG | chrX | 139531637 | 139531656 | 139531640 | - |
| SEQ ID NO 11619 | TTCCCTGTATGCCTTCCTCT | GGG | chrX | 139531636 | 139531655 | 139531639 | - |
| SEQ ID NO 11620 | CTTCCTCTGGGAAATACATA | AAG | chrX | 139531624 | 139531643 | 139531627 | - |
| SEQ ID NO 11621 | GGAAATACATAAAGTCACTG | TAG | chrX | 139531615 | 139531634 | 139531618 | - |
| SEQ ID NO 11622 | ACTGTAGTTGTGAAAAAACA | AAG | chrX | 139531599 | 139531618 | 139531602 | - |
| SEQ ID NO 11623 | CAAAGTGATATATGTTGCAT | TAG | chrX | 139531581 | 139531600 | 139531584 | - |
| SEQ ID NO 11624 | TACTCTTATGTCAATTCTT | AAG | chrX | 139531549 | 139531568 | 139531552 | - |
| SEQ ID NO 11625 | TTAAGCTTGCTTTTCTCCCC | TAG | chrX | 139531531 | 139531550 | 139531534 | - |
| SEQ ID NO 11626 | TAAGCTTGCTTTTCTCCCCT | AGG | chrX | 139531530 | 139531549 | 139531533 | - |
| SEQ ID NO 11627 | AAGCTTGCTTTTCTCCCCTA | GGG | chrX | 139531529 | 139531548 | 139531532 | - |
| SEQ ID NO 11628 | CTCCCCTAGGGAACTCAACT | GAG | chrX | 139531517 | 139531536 | 139531520 | - |
| SEQ ID NO 11629 | TTTCCCCAAATATCAACTCC | AAG | chrX | 139531487 | 139531506 | 139531490 | - |
| SEQ ID NO 11630 | CAACTCCAAGATGTTTGACA | TAG | chrX | 139531474 | 139531493 | 139531477 | - |
| SEQ ID NO 11631 | ACTCCAAGATGTTTGACATA | GAG | chrX | 139531472 | 139531491 | 139531475 | - |
| SEQ ID NO 11632 | ATTTTTTCCTAATCCATGAA | AAG | chrX | 139531441 | 139531460 | 139531444 | - |
| SEQ ID NO 11633 | TCCTAATCCATGAAAAGCTT | TGG | chrX | 139531435 | 139531454 | 139531438 | - |
| SEQ ID NO 11634 | AAAGCTTTGGTGATAACTAA | CAG | chrX | 139531422 | 139531441 | 139531425 | - |
| SEQ ID NO 11635 | AACTAACAGCTTGCTAATGA | AAG | chrX | 139531408 | 139531427 | 139531411 | - |
| SEQ ID NO 11636 | ACTAACAGCTTGCTAATGAA | AGG | chrX | 139531407 | 139531426 | 139531410 | - |
| SEQ ID NO 11637 | TTAACTAAAACTTTAAATTG | AAG | chrX | 139531370 | 139531389 | 139531373 | - |
| SEQ ID NO 11638 | AGATATATAATTTAAAAAAT | TAG | chrX | 139531349 | 139531368 | 139531352 | - |
| SEQ ID NO 11639 | ATATATAATTTAAAAAATTA | GAG | chrX | 139531347 | 139531366 | 139531350 | - |
| SEQ ID NO 11640 | AATGTCATATATCTTAAAAT | CAG | chrX | 139531292 | 139531311 | 139531295 | - |

Figure 37 (Cont'd)

| SEQ ID NO 11641 | ATCAGACTTTTTGTGTAAAT | AAG | chrX | 139531274 | 139531293 | 139531277 | - |
| SEQ ID NO 11642 | TCAGACTTTTTGTGTAAATA | AGG | chrX | 139531273 | 139531292 | 139531276 | - |
| SEQ ID NO 11643 | TGTTTCCCATTTTGATTTCA | AAG | chrX | 139531234 | 139531253 | 139531237 | - |
| SEQ ID NO 11644 | TTCCCATTTTGATTTCAAAG | TGG | chrX | 139531231 | 139531250 | 139531234 | - |
| SEQ ID NO 11645 | CATTTTGATTTCAAAGTGGT | AAG | chrX | 139531227 | 139531246 | 139531230 | - |
| SEQ ID NO 11646 | AAGTCCAAACAAAAATAATG | TGG | chrX | 139531207 | 139531226 | 139531210 | - |
| SEQ ID NO 11647 | ACTTTTAATTTTTTTAAACC | AAG | chrX | 139531143 | 139531162 | 139531146 | - |
| SEQ ID NO 11648 | CTTTTAATTTTTTTAAACCA | AGG | chrX | 139531142 | 139531161 | 139531145 | - |
| SEQ ID NO 11649 | TTTAATTTTTTTAAACCAAG | GAG | chrX | 139531140 | 139531159 | 139531143 | - |
| SEQ ID NO 11650 | AGGAGATGAATGTTTTCTAA | CAG | chrX | 139531122 | 139531141 | 139531125 | - |
| SEQ ID NO 11651 | GGAGATGAATGTTTTCTAAC | AGG | chrX | 139531121 | 139531140 | 139531124 | - |
| SEQ ID NO 11652 | TGACCAAATCATGAACTGAA | CAG | chrX | 139531091 | 139531110 | 139531094 | - |
| SEQ ID NO 11653 | ATTAAACATAAATGCATCAT | AAG | chrX | 139531063 | 139531082 | 139531066 | - |
| SEQ ID NO 11654 | ATAAGCATTGTCGATCTATT | TAG | chrX | 139531045 | 139531064 | 139531048 | - |
| SEQ ID NO 11655 | TCTATTTAGTTTTAAAAATG | AAG | chrX | 139531031 | 139531050 | 139531034 | - |
| SEQ ID NO 11656 | ATTTAGTTTTAAAAATGAAG | AAG | chrX | 139531028 | 139531047 | 139531031 | - |
| SEQ ID NO 11657 | TAGTTTTAAAAATGAAGAAG | AAG | chrX | 139531025 | 139531044 | 139531028 | - |
| SEQ ID NO 11658 | AAATGAAGAAGAAGAAAACC | TAG | chrX | 139531016 | 139531035 | 139531019 | - |
| SEQ ID NO 11659 | AGAAGAAAACCTAGCTAACA | AAG | chrX | 139531007 | 139531026 | 139531010 | - |
| SEQ ID NO 11660 | AAACCTAGCTAACAAAGAAC | CAG | chrX | 139531001 | 139531020 | 139531004 | - |
| SEQ ID NO 11661 | GTACTTACCAACCTGCGTGC | TGG | chrX | 139530979 | 139530998 | 139530982 | - |
| SEQ ID NO 11662 | CCAACCTGCGTGCTGGCTGT | TAG | chrX | 139530972 | 139530991 | 139530975 | - |
| SEQ ID NO 11663 | CAAATCATGTAATCAAAATT | TAG | chrX | 139530931 | 139530950 | 139530934 | - |
| SEQ ID NO 11664 | CATGTAATCAAAATTTAGTG | AAG | chrX | 139530926 | 139530945 | 139530929 | - |
| SEQ ID NO 11665 | GTAATCAAAATTTAGTGAAG | AAG | chrX | 139530923 | 139530942 | 139530926 | - |
| SEQ ID NO 11666 | TCAAAATTTAGTGAAGAAGA | CAG | chrX | 139530919 | 139530938 | 139530922 | - |
| SEQ ID NO 11667 | TTTAGTGAAGAAGACAGCAT | CAG | chrX | 139530913 | 139530932 | 139530916 | - |
| SEQ ID NO 11668 | TCAGATATTTCTATATCTAA | AAG | chrX | 139530894 | 139530913 | 139530897 | - |
| SEQ ID NO 11669 | CAGATATTTCTATATCTAAA | AGG | chrX | 139530893 | 139530912 | 139530896 | - |
| SEQ ID NO 11670 | TATTTCTATATCTAAAGGC | AAG | chrX | 139530889 | 139530908 | 139530892 | - |
| SEQ ID NO 11671 | ATACTCAATGTATTTTAAAA | AAG | chrX | 139530865 | 139530884 | 139530868 | - |
| SEQ ID NO 11672 | TACTCAATGTATTTTAAAAA | AGG | chrX | 139530864 | 139530883 | 139530867 | - |
| SEQ ID NO 11673 | AGGAAACAAACCTGTACATT | CAG | chrX | 139530844 | 139530863 | 139530847 | - |
| SEQ ID NO 11674 | AAACCTGTACATTCAGCACT | GAG | chrX | 139530837 | 139530856 | 139530840 | - |
| SEQ ID NO 11675 | CCTGTACATTCAGCACTGAG | TAG | chrX | 139530834 | 139530853 | 139530837 | - |
| SEQ ID NO 11676 | GCACTGAGTAGATATCCTAA | AAG | chrX | 139530822 | 139530841 | 139530825 | - |
| SEQ ID NO 11677 | CACTGAGTAGATATCCTAAA | AGG | chrX | 139530821 | 139530840 | 139530824 | - |
| SEQ ID NO 11678 | TGAGTAGATATCCTAAAGG | CAG | chrX | 139530818 | 139530837 | 139530821 | - |
| SEQ ID NO 11679 | TAGATATCCTAAAGGCAGA | TGG | chrX | 139530814 | 139530833 | 139530817 | - |
| SEQ ID NO 11680 | CCTAAAGGCAGATGGTGAT | GAG | chrX | 139530807 | 139530826 | 139530810 | - |
| SEQ ID NO 11681 | CTAAAGGCAGATGGTGATG | AGG | chrX | 139530806 | 139530825 | 139530809 | - |
| SEQ ID NO 11682 | AGGCAGATGGTGATGAGGCC | TGG | chrX | 139530801 | 139530820 | 139530804 | - |
| SEQ ID NO 11683 | ACGCGCTGCATAACCTTTGC | TAG | chrX | 139530756 | 139530775 | 139530759 | - |
| SEQ ID NO 11684 | CGCTGCATAACCTTTGCTAG | CAG | chrX | 139530753 | 139530772 | 139530756 | - |
| SEQ ID NO 11685 | CCTTTGCTAGCAGATTGTGA | AAG | chrX | 139530743 | 139530762 | 139530746 | - |
| SEQ ID NO 11686 | TTGCTAGCAGATTGTGAAAG | TGG | chrX | 139530740 | 139530759 | 139530743 | - |

Figure 38

| # | Sequence | PAM | Chr | Start | End | Cuts 5' of | Str |
|---|---|---|---|---|---|---|---|
| SEQ ID NO 11687 | GCGCGTGAACATGATCATGG | CAGAAT | chrX | 139530770 | 139530789 | 139530786 | + |
| SEQ ID NO 11688 | CCTCATCACCATCTGCCTTT | TAGGAT | chrX | 139530803 | 139530822 | 139530819 | + |
| SEQ ID NO 11689 | TTTAGGATATCTACTCAGTG | CTGAAT | chrX | 139530821 | 139530840 | 139530837 | + |
| SEQ ID NO 11690 | GTTTCCTTTTTTAAAATACA | TTGAGT | chrX | 139530857 | 139530876 | 139530873 | + |
| SEQ ID NO 11691 | ATGATTTGACAGCAATATTG | AAGAGT | chrX | 139530943 | 139530962 | 139530959 | + |
| SEQ ID NO 11692 | GTGGGAAAACAAAGAAATAG | CAGAAT | chrX | 139531161 | 139531180 | 139531177 | + |
| SEQ ID NO 11693 | AGTTATCACCAAAGCTTTTC | ATGGAT | chrX | 139531424 | 139531443 | 139531440 | + |
| SEQ ID NO 11694 | TGTCTCTATGTCAAACATCT | TGGAGT | chrX | 139531466 | 139531485 | 139531482 | + |
| SEQ ID NO 11695 | TGGGGAAACACAATACTCAG | TTGAGT | chrX | 139531499 | 139531518 | 139531515 | + |
| SEQ ID NO 11696 | TAGGGGAGAAAAGCAAGCTT | AAGAAT | chrX | 139531529 | 139531548 | 139531545 | + |
| SEQ ID NO 11697 | CAAGCTTAAGAATTGACATA | AAGAGT | chrX | 139531542 | 139531561 | 139531558 | + |
| SEQ ID NO 11698 | ACACTTACTTGTCAACTTTC | TAGAAT | chrX | 139531706 | 139531725 | 139531722 | + |
| SEQ ID NO 11699 | AATCTAGTAGCTGACAGTAC | CAGGAT | chrX | 139531734 | 139531753 | 139531750 | + |
| SEQ ID NO 11700 | TAGCTGACAGTACCAGGATC | AGGGGT | chrX | 139531741 | 139531760 | 139531757 | + |
| SEQ ID NO 11701 | ACAGAGGTTAAACTAGCAAA | GTGAGT | chrX | 139531876 | 139531895 | 139531892 | + |
| SEQ ID NO 11702 | TAGCAAAGTGAGTAAAGTCA | AGGGAT | chrX | 139531889 | 139531908 | 139531905 | + |
| SEQ ID NO 11703 | AAGACTTCAGATGCTGGGGA | AAGGAT | chrX | 139532072 | 139532091 | 139532088 | + |
| SEQ ID NO 11704 | ATGCTGGGGAAAGGATAGAT | AAGAAT | chrX | 139532082 | 139532101 | 139532098 | + |
| SEQ ID NO 11705 | GGGAAAGGATAGATAAGAAT | AAGGAT | chrX | 139532088 | 139532107 | 139532104 | + |
| SEQ ID NO 11706 | GCCCTTGAGGAAGGGGCCAG | GGGAAT | chrX | 139532245 | 139532264 | 139532261 | + |
| SEQ ID NO 11707 | GGGGCCAGGGGAATTTTTCT | AAGGAT | chrX | 139532257 | 139532276 | 139532273 | + |
| SEQ ID NO 11708 | AACTCTCATTGGCTTCTAAA | AGGAGT | chrX | 139532318 | 139532337 | 139532334 | + |
| SEQ ID NO 11709 | GGCTTCTAAAAGGAGTTTCG | GTGAGT | chrX | 139532328 | 139532347 | 139532344 | + |
| SEQ ID NO 11710 | TAGGTATTATTGCAACAGTT | TGGAAT | chrX | 139532392 | 139532411 | 139532408 | + |
| SEQ ID NO 11711 | TGTCCTTCATTCAGACATTA | CTGAGT | chrX | 139532478 | 139532497 | 139532494 | + |
| SEQ ID NO 11712 | TATGGTGCCAGGTACTGTGT | CAGGGT | chrX | 139532510 | 139532529 | 139532526 | + |
| SEQ ID NO 11713 | AGGTACTGTGTCAGGGTACT | AGGGGT | chrX | 139532519 | 139532538 | 139532535 | + |
| SEQ ID NO 11714 | TGTCAGGGTACTAGGGGTAT | GGGGAT | chrX | 139532527 | 139532546 | 139532543 | + |
| SEQ ID NO 11715 | AAAATGTGCACTAGGTACTA | AGGGAT | chrX | 139532619 | 139532638 | 139532635 | + |
| SEQ ID NO 11716 | GGGGAAACAATTGATAGAGA | GAGAAT | chrX | 139532669 | 139532688 | 139532685 | + |
| SEQ ID NO 11717 | TAGAGAGAATATTTTCAT | CTGGGT | chrX | 139532683 | 139532702 | 139532699 | + |
| SEQ ID NO 11718 | TTTCATCTGGGTCTTAAAAG | ATGAGT | chrX | 139532697 | 139532716 | 139532713 | + |
| SEQ ID NO 11719 | ATAAGGGCATTTTATGCAAA | GAGGAT | chrX | 139532751 | 139532770 | 139532767 | + |
| SEQ ID NO 11720 | GCAAGAACGTGAGGTATTTC | AGGAGT | chrX | 139532800 | 139532819 | 139532816 | + |
| SEQ ID NO 11721 | GGTATCGAAGTATAAACATA | AGGAGT | chrX | 139532940 | 139532959 | 139532956 | + |
| SEQ ID NO 11722 | AGTACCACTGATGGCTGATT | TAGGAT | chrX | 139532963 | 139532982 | 139532979 | + |
| SEQ ID NO 11723 | GTAGCAGTACAAAAAAGAG | GGGAGT | chrX | 139533112 | 139533131 | 139533128 | + |
| SEQ ID NO 11724 | AAGTGGTATGACTTAACCAT | CTGGGT | chrX | 139533160 | 139533179 | 139533176 | + |
| SEQ ID NO 11725 | GGTATGGAAGGGGAAATGGC | TAGAGT | chrX | 139533183 | 139533202 | 139533199 | + |
| SEQ ID NO 11726 | TTTGATGTGATTATGGACCA | CAGAAT | chrX | 139533224 | 139533243 | 139533240 | + |
| SEQ ID NO 11727 | TGGCTCTTTAGTCTGACTGC | CAGAGT | chrX | 139533265 | 139533284 | 139533281 | + |
| SEQ ID NO 11728 | TTTAGTCTGACTGCCAGAGT | CTGAAT | chrX | 139533271 | 139533290 | 139533287 | + |
| SEQ ID NO 11729 | TGACTGCCAGAGTCTGAATC | CTGAAT | chrX | 139533278 | 139533297 | 139533294 | + |
| SEQ ID NO 11730 | GGGCAAAGCCCTTAGCCTCT | ATGAAT | chrX | 139533322 | 139533341 | 139533338 | + |
| SEQ ID NO 11731 | CTATCTCGTGGGACTTTTGT | GAGGAT | chrX | 139533384 | 139533403 | 139533400 | + |
| SEQ ID NO 11732 | TGTGAGGATGAAGTGAGATA | ATGGAT | chrX | 139533401 | 139533420 | 139533417 | + |
| SEQ ID NO 11733 | TACATTATGATATACAGTTA | GGGAGT | chrX | 139533492 | 139533511 | 139533508 | + |
| SEQ ID NO 11734 | GGAGACGTATCTGACTATAG | GTGAGT | chrX | 139533540 | 139533559 | 139533556 | + |

Figure 38 (Cont'd)

| | | | | | | | |
|---|---|---|---|---|---|---|---|
| SEQ ID NO 11735 | GCCACGTGTGTGGGCATCTG | GAGAGT | chrX | 139533601 | 139533620 | 139533617 | + |
| SEQ ID NO 11736 | TGGGCATCTGGAGAGTGAGC | ATGGAT | chrX | 139533611 | 139533630 | 139533627 | + |
| SEQ ID NO 11737 | TGCTCAGTAAATTTTGTTGA | CAGGGT | chrX | 139533677 | 139533696 | 139533693 | + |
| SEQ ID NO 11738 | TAAGGGCCATGGAGAGGAAC | AGGAGT | chrX | 139533896 | 139533915 | 139533912 | + |
| SEQ ID NO 11739 | GGAGTTAATCAATTCAAGTG | CTGGAT | chrX | 139533917 | 139533936 | 139533933 | + |
| SEQ ID NO 11740 | TTAATCAATTCAAGTGCTGG | ATGGAT | chrX | 139533921 | 139533940 | 139533937 | + |
| SEQ ID NO 11741 | TCAAGTGCTGGATGGATAAC | AGGAGT | chrX | 139533930 | 139533949 | 139533946 | + |
| SEQ ID NO 11742 | GTTAGAGCAAAGCGGGGAAC | CAGAAT | chrX | 139533954 | 139533973 | 139533970 | + |
| SEQ ID NO 11743 | AGCAAAGCGGGGAACCAGAA | TAGAGT | chrX | 139533959 | 139533978 | 139533975 | + |
| SEQ ID NO 11744 | AATAGAGTGATTATTATAAA | AAGAGT | chrX | 139533977 | 139533996 | 139533993 | + |
| SEQ ID NO 11745 | GAAGTTATTAAAGAGCTAAA | GAGAAT | chrX | 139534151 | 139534170 | 139534167 | + |
| SEQ ID NO 11746 | GAAAGTAGGGCCAACATGAA | AGGAGT | chrX | 139534196 | 139534215 | 139534212 | + |
| SEQ ID NO 11747 | CTGTACAGTCAGCTCTCCTT | GTGAGT | chrX | 139534447 | 139534466 | 139534463 | + |
| SEQ ID NO 11748 | CAAAAATATTCAAGAAAAAA | ATGGAT | chrX | 139534504 | 139534523 | 139534520 | + |
| SEQ ID NO 11749 | AGATGATTTAAAGTACAAAG | GAGGAT | chrX | 139534648 | 139534667 | 139534664 | + |
| SEQ ID NO 11750 | CACAGATCTTGATATTTGCA | GGGGGT | chrX | 139534729 | 139534748 | 139534745 | + |
| SEQ ID NO 11751 | GGTCTTGCCACCAATTTTCC | ATGGAT | chrX | 139534752 | 139534771 | 139534768 | + |
| SEQ ID NO 11752 | ATACTGAGGAACGACTGTAA | ATGGAT | chrX | 139534776 | 139534795 | 139534792 | + |
| SEQ ID NO 11753 | GACTGTAAATGGATGCAGGC | ATGGAT | chrX | 139534788 | 139534807 | 139534804 | + |
| SEQ ID NO 11754 | TGCAGGCATGGATGCTATTT | AGGAGT | chrX | 139534801 | 139534820 | 139534817 | + |
| SEQ ID NO 11755 | GAGTGTCCAGGGCCAAGTAA | ATGAGT | chrX | 139534823 | 139534842 | 139534839 | + |
| SEQ ID NO 11756 | ATGAGTTGCTGAGCAGAGAG | GTGGGT | chrX | 139534843 | 139534862 | 139534859 | + |
| SEQ ID NO 11757 | CCTCGGCTGTCTGGGAAGAG | AAGGAT | chrX | 139534936 | 139534955 | 139534952 | + |
| SEQ ID NO 11758 | GGCTGCTCCAATTTAGGGGC | TAGGAT | chrX | 139534972 | 139534991 | 139534988 | + |
| SEQ ID NO 11759 | CAATTTAGGGGCTAGGATTG | CAGGGT | chrX | 139534980 | 139534999 | 139534996 | + |
| SEQ ID NO 11760 | GGGTGGGCACAGCATTGCAA | ACGAGT | chrX | 139535002 | 139535021 | 139535018 | + |
| SEQ ID NO 11761 | ATTGAGAAATATGGCCAATG | AAGAGT | chrX | 139535035 | 139535054 | 139535051 | + |
| SEQ ID NO 11762 | CAGGCAGATCACTTGAGGTC | AGGAGT | chrX | 139535121 | 139535140 | 139535137 | + |
| SEQ ID NO 11763 | AAAATTAGCTGGGCATGGTG | GCGGGT | chrX | 139535206 | 139535225 | 139535222 | + |
| SEQ ID NO 11764 | TACTTGGGAGGCTGAGGCAG | GAGAAT | chrX | 139535247 | 139535266 | 139535263 | + |
| SEQ ID NO 11765 | CAAGACTCTGTCAAAAAAAA | AAGAGT | chrX | 139535345 | 139535364 | 139535361 | + |
| SEQ ID NO 11766 | TTGCAGAGCAAGGGAAAAGC | AGGGAT | chrX | 139535426 | 139535445 | 139535442 | + |
| SEQ ID NO 11767 | CTTTCCTTTCTCTTCCTTTT | TGGAGT | chrX | 139535546 | 139535565 | 139535562 | + |
| SEQ ID NO 11768 | GAACAACTCCAGGCAACTTC | TTGAGT | chrX | 139535671 | 139535690 | 139535687 | + |
| SEQ ID NO 11769 | GCCATGCATTCCTTAACAAT | GGGGAT | chrX | 139535774 | 139535793 | 139535790 | + |
| SEQ ID NO 11770 | TCATCATTGTGCGAACATAA | TAGAGT | chrX | 139535830 | 139535849 | 139535846 | + |
| SEQ ID NO 11771 | AGATAGAGACATCTATCCTC | CAGAGT | chrX | 139536347 | 139536366 | 139536363 | + |
| SEQ ID NO 11772 | ACATCTATCCTCCAGAGTTC | AGGAGT | chrX | 139536355 | 139536374 | 139536371 | + |
| SEQ ID NO 11773 | TAGCTTAAAAAAAACATATC | CTGAAT | chrX | 139536403 | 139536422 | 139536419 | + |
| SEQ ID NO 11774 | TAACATCTAGTGACAGACAC | TGGGGT | chrX | 139536531 | 139536550 | 139536547 | + |
| SEQ ID NO 11775 | TATTCTGAAAACAGCCCAGC | CAGGGT | chrX | 139536630 | 139536649 | 139536646 | + |
| SEQ ID NO 11776 | AAAACAGCCCAGCCAGGGTG | ATGGAT | chrX | 139536637 | 139536656 | 139536653 | + |
| SEQ ID NO 11777 | GAAATCTGACCTTTTATTAC | TGGAAT | chrX | 139536772 | 139536791 | 139536788 | + |
| SEQ ID NO 11778 | TCTCTTGACTAAAAGTAAAA | TTGAAT | chrX | 139536798 | 139536817 | 139536814 | + |
| SEQ ID NO 11779 | GAAATTGGCTTTCAGATTAT | TTGGAT | chrX | 139536896 | 139536915 | 139536912 | + |
| SEQ ID NO 11780 | TTTCTTTTTTGCTAAAACTA | AAGAAT | chrX | 139536966 | 139536985 | 139536982 | + |
| SEQ ID NO 11781 | ATGAAAACGCCAACAAAATT | CTGAAT | chrX | 139537022 | 139537041 | 139537038 | + |
| SEQ ID NO 11782 | GTATAATTCAGGTAAATTGG | AAGAGT | chrX | 139537059 | 139537078 | 139537075 | + |
| SEQ ID NO 11783 | TGTTCAAGGGAACCTTGAGA | GAGAAT | chrX | 139537086 | 139537105 | 139537102 | + |

Figure 38 (Cont'd)

| | | | | | | | |
|---|---|---|---|---|---|---|---|
| SEQ ID NO 11784 | AACAAACTCTTCCAATTTAC | CTGAAT | chrX | 139537070 | 139537089 | 139537073 | - |
| SEQ ID NO 11785 | TTATACCTCTTTGGCCGATT | CAGAAT | chrX | 139537045 | 139537064 | 139537048 | - |
| SEQ ID NO 11786 | CAAGAAAAACTGAAATGTAA | AAGAAT | chrX | 139536999 | 139537018 | 139537002 | - |
| SEQ ID NO 11787 | CTGTATACACATGGAGATTT | AGGAAT | chrX | 139536834 | 139536853 | 139536837 | - |
| SEQ ID NO 11788 | TCAATTTTACTTTTAGTCAA | GAGAAT | chrX | 139536802 | 139536821 | 139536805 | - |
| SEQ ID NO 11789 | GGTCAGATTTCTAATCATAT | TTGAAT | chrX | 139536763 | 139536782 | 139536766 | - |
| SEQ ID NO 11790 | TAATCATATTTGAATTTACT | TTGGAT | chrX | 139536752 | 139536771 | 139536755 | - |
| SEQ ID NO 11791 | TCACTTGAAAATAGCTCATT | GAGGAT | chrX | 139536681 | 139536700 | 139536684 | - |
| SEQ ID NO 11792 | CACCCTGGCTGGGCTGTTTT | CAGAAT | chrX | 139536637 | 139536656 | 139536640 | - |
| SEQ ID NO 11793 | CTTTGGTTGGCAAGTGTTAT | AGGAAT | chrX | 139536461 | 139536480 | 139536464 | - |
| SEQ ID NO 11794 | CAGTGATTTAAGCATCTCTC | TAGAAT | chrX | 139536433 | 139536452 | 139536436 | - |
| SEQ ID NO 11795 | TTAAGCATCTCTCTAGAATT | CAGGAT | chrX | 139536426 | 139536445 | 139536429 | - |
| SEQ ID NO 11796 | AGAGACACTCCTGAACTCTG | GAGGAT | chrX | 139536367 | 139536386 | 139536370 | - |
| SEQ ID NO 11797 | TGGAGGATAGATGTCTCTAT | CTGAAT | chrX | 139536349 | 139536368 | 139536352 | - |
| SEQ ID NO 11798 | TTGCTTAATGACACATTTCT | CAGAAT | chrX | 139535808 | 139535827 | 139535811 | - |
| SEQ ID NO 11799 | AGAATATATCCCCATTGTTA | AGGAAT | chrX | 139535787 | 139535806 | 139535790 | - |
| SEQ ID NO 11800 | CAGGGACTCAAGAAGTTGCC | TGGAGT | chrX | 139535682 | 139535701 | 139535685 | - |
| SEQ ID NO 11801 | CTGGAGTTGTTCCTTTCTTC | AAGGGT | chrX | 139535663 | 139535682 | 139535666 | - |
| SEQ ID NO 11802 | GGCTTATAAGATGAACTTTC | TGGGGT | chrX | 139535600 | 139535619 | 139535603 | - |
| SEQ ID NO 11803 | CATTGCAGCTGTTCACTTTA | TGGAGT | chrX | 139535474 | 139535493 | 139535477 | - |
| SEQ ID NO 11804 | TTTGGGCTCACTTTTTTTCT | TTGAAT | chrX | 139535400 | 139535419 | 139535403 | - |
| SEQ ID NO 11805 | TTCAACTCTTTTTTTTTTGA | CAGAGT | chrX | 139535355 | 139535374 | 139535358 | - |
| SEQ ID NO 11806 | TCTTGCTCTGTCGCCCAGGC | TGGAGT | chrX | 139535330 | 139535349 | 139535333 | - |
| SEQ ID NO 11807 | GCCTCAGCCTCCCAAGTAGC | TGGGAT | chrX | 139535245 | 139535264 | 139535248 | - |
| SEQ ID NO 11808 | TTTTGTATTTTTAGTAAAGC | CGGGGT | chrX | 139535189 | 139535208 | 139535192 | - |
| SEQ ID NO 11809 | GCCTGGGCCTCTGAAAGTGC | TGGGAT | chrX | 139535102 | 139535121 | 139535105 | - |
| SEQ ID NO 11810 | AAAAAATCACCAAAATGCAG | ATGGAT | chrX | 139534905 | 139534924 | 139534908 | - |
| SEQ ID NO 11811 | CCCTGCAAATATCAAGATCT | GTGGAT | chrX | 139534732 | 139534751 | 139534735 | - |
| SEQ ID NO 11812 | TTGTTATGCTGTATTGTTTA | GGGAAT | chrX | 139534581 | 139534600 | 139534584 | - |
| SEQ ID NO 11813 | TAGGGAATAATGAAAGATAA | AAGAGT | chrX | 139534563 | 139534582 | 139534566 | - |
| SEQ ID NO 11814 | TGCAACCATCCATTTTTTTC | TTGAAT | chrX | 139534517 | 139534536 | 139534520 | - |
| SEQ ID NO 11815 | TATTTTTGATCTGCAGTTAA | TTGAAT | chrX | 139534492 | 139534511 | 139534495 | - |
| SEQ ID NO 11816 | GAGCTGACTGTACAGTGTGG | TTGAGT | chrX | 139534442 | 139534461 | 139534445 | - |
| SEQ ID NO 11817 | TTGAGTGAAAAAACAGACTT | TAGAAT | chrX | 139534422 | 139534441 | 139534425 | - |
| SEQ ID NO 11818 | CAGATCAGACAGAAATAGGT | TTGAAT | chrX | 139534396 | 139534415 | 139534399 | - |
| SEQ ID NO 11819 | AGGTTTAACAGTAGTATAAT | AAGAAT | chrX | 139534291 | 139534310 | 139534294 | - |
| SEQ ID NO 11820 | ATCTATCTCACAGGTGTTGG | CAGGAT | chrX | 139534265 | 139534284 | 139534268 | - |
| SEQ ID NO 11821 | AAATGACTATTGTCACAATC | AGGAAT | chrX | 139534091 | 139534110 | 139534094 | - |
| SEQ ID NO 11822 | TCACAATCAGGAATGACCTA | AAGAAT | chrX | 139534079 | 139534098 | 139534082 | - |
| SEQ ID NO 11823 | GAATGACCTAAAGAATAATT | TTGAGT | chrX | 139534069 | 139534088 | 139534072 | - |
| SEQ ID NO 11824 | TCCTGTTATCCATCCAGCAC | TTGAAT | chrX | 139533934 | 139533953 | 139533937 | - |
| SEQ ID NO 11825 | CTCCATGGCCCTTAAATGTC | CAGGGT | chrX | 139533890 | 139533909 | 139533893 | - |
| SEQ ID NO 11826 | ATACTTGCTAGGGCTGGGAC | AAGAGT | chrX | 139533820 | 139533839 | 139533823 | - |
| SEQ ID NO 11827 | TAACTACTGTTTACAGAACA | ATGAGT | chrX | 139533579 | 139533598 | 139533582 | - |
| SEQ ID NO 11828 | CCTATAGTCAGATACGTCTC | CTGAAT | chrX | 139533541 | 139533560 | 139533544 | - |
| SEQ ID NO 11829 | GGCACTGTCATCTTATTTTT | ATGAAT | chrX | 139533365 | 139533384 | 139533368 | - |
| SEQ ID NO 11830 | AGGTAACATACTAAAACATT | CAGGAT | chrX | 139533301 | 139533320 | 139533304 | - |
| SEQ ID NO 11831 | TACCTCACGTTCTTGCAAAT | CTGAGT | chrX | 139532796 | 139532815 | 139532799 | - |
| SEQ ID NO 11832 | TTGCAAATCTGAGTCTTTGC | ACGAGT | chrX | 139532784 | 139532803 | 139532787 | - |

Figure 38 (Cont'd)

| | | | | | | | |
|---|---|---|---|---|---|---|---|
| SEQ ID NO 11833 | ATGCTGCTTTAGATCAAAGA | GGGAGT | chrX | 139532566 | 139532585 | 139532569 | - |
| SEQ ID NO 11834 | TAGTTGTAACTCAGTAATGT | CTGAAT | chrX | 139532492 | 139532511 | 139532495 | - |
| SEQ ID NO 11835 | AACTCCTTTTAGAAGCCAAT | GAGAGT | chrX | 139532325 | 139532344 | 139532328 | - |
| SEQ ID NO 11836 | ATGAGAGTTTAATAGCAGAA | GAGAGT | chrX | 139532307 | 139532326 | 139532310 | - |
| SEQ ID NO 11837 | ATCTCTGGCTACAATGGCTG | CAGAAT | chrX | 139532220 | 139532239 | 139532223 | - |
| SEQ ID NO 11838 | CTTTCTCCTTAGTATTATCT | GGGGAT | chrX | 139532186 | 139532205 | 139532189 | - |
| SEQ ID NO 11839 | CTCACCACTTATATAGAAGA | AAGGGT | chrX | 139532017 | 139532036 | 139532020 | - |
| SEQ ID NO 11840 | ACTTATATAGAAGAAAGGGT | TTGGAT | chrX | 139532011 | 139532030 | 139532014 | - |
| SEQ ID NO 11841 | CTTGCTTTATGTCCTGCTTT | GTGAGT | chrX | 139531940 | 139531959 | 139531943 | - |
| SEQ ID NO 11842 | TTCACAGCTGACATCATGTC | TGGAGT | chrX | 139531819 | 139531838 | 139531822 | - |
| SEQ ID NO 11843 | ACAGGGCCAGTCAGCTTTCT | GGGGGT | chrX | 139531786 | 139531805 | 139531789 | - |
| SEQ ID NO 11844 | GTCAGCTTTCTGGGGGTGCT | TAGGGT | chrX | 139531777 | 139531796 | 139531780 | - |
| SEQ ID NO 11845 | GAACATGCTGTTTGTCCAAA | TGGGAT | chrX | 139531668 | 139531687 | 139531671 | - |
| SEQ ID NO 11846 | TTCTCCCCTAGGGAACTCAA | CTGAGT | chrX | 139531519 | 139531538 | 139531522 | - |
| SEQ ID NO 11847 | AATTTTTTTAAACCAAGGAG | ATGAAT | chrX | 139531137 | 139531156 | 139531140 | - |
| SEQ ID NO 11848 | GGAGATGAATGTTTTCTAAC | AGGAAT | chrX | 139531121 | 139531140 | 139531124 | - |
| SEQ ID NO 11849 | ACAAACCTGTACATTCAGCA | CTGAGT | chrX | 139530839 | 139530858 | 139530842 | - |

Figure 39

| # | Sequence | PAM | Chr | Start | End | Cuts 5' of | Str |
|---|---|---|---|---|---|---|---|
| SEQ ID NO 11850 | AGCGCGTGAACATGATCATG | GCAGAAT | chrX | 139530769 | 139530788 | 139530785 | + |
| SEQ ID NO 11851 | AGTATGCTTGCCTTTTAGAT | ATAGAAA | chrX | 139530880 | 139530899 | 139530896 | + |
| SEQ ID NO 11852 | ATTTGGTCATGTAATTCCTG | TTAGAAA | chrX | 139531102 | 139531121 | 139531118 | + |
| SEQ ID NO 11853 | AAAATTAAAAGTGGGAAAAC | AAAGAAA | chrX | 139531151 | 139531170 | 139531167 | + |
| SEQ ID NO 11854 | AGTGGGAAAACAAAGAAATA | GCAGAAT | chrX | 139531160 | 139531179 | 139531176 | + |
| SEQ ID NO 11855 | ACTCAGTTGAGTTCCCTAGG | GGAGAAA | chrX | 139531513 | 139531532 | 139531529 | + |
| SEQ ID NO 11856 | CTAGGGGAGAAAAGCAAGCT | TAAGAAT | chrX | 139531528 | 139531547 | 139531544 | + |
| SEQ ID NO 11857 | CCCAGAGGAAGGCATACAGG | GAAGAAA | chrX | 139531633 | 139531652 | 139531649 | + |
| SEQ ID NO 11858 | CACACTTACTTGTCAACTTT | CTAGAAT | chrX | 139531705 | 139531724 | 139531721 | + |
| SEQ ID NO 11859 | GGTGCCAACCCTAAGCACCC | CCAGAAA | chrX | 139531764 | 139531783 | 139531780 | + |
| SEQ ID NO 11860 | AGTGAGTAAAGTCAAGGGAT | AAAGAAA | chrX | 139531895 | 139531914 | 139531911 | + |
| SEQ ID NO 11861 | GATGCTGGGGAAAGGATAGA | TAAGAAT | chrX | 139532081 | 139532100 | 139532097 | + |
| SEQ ID NO 11862 | CGATCCCCAGATAATACTAA | GGAGAAA | chrX | 139532178 | 139532197 | 139532194 | + |
| SEQ ID NO 11863 | ACTAGGTACTAAGGGATCAT | AGAGAAA | chrX | 139532628 | 139532647 | 139532644 | + |
| SEQ ID NO 11864 | TGGGGAAACAATTGATAGAG | AGAGAAT | chrX | 139532668 | 139532687 | 139532684 | + |
| SEQ ID NO 11865 | GTTTGATGTGATTATGGACC | ACAGAAT | chrX | 139533223 | 139533242 | 139533239 | + |
| SEQ ID NO 11866 | AGTTAGAGCAAAGCGGGGAA | CCAGAAT | chrX | 139533953 | 139533972 | 139533969 | + |
| SEQ ID NO 11867 | AAAAAGGGAGAGATCAACAA | TTAGAAA | chrX | 139534008 | 139534027 | 139534024 | + |
| SEQ ID NO 11868 | AGAAGTTATTAAAGAGCTAA | AGAGAAT | chrX | 139534150 | 139534169 | 139534166 | + |
| SEQ ID NO 11869 | ATTAAAGAGCTAAAGAGAAT | TGAGAAA | chrX | 139534157 | 139534176 | 139534173 | + |
| SEQ ID NO 11870 | GAATTGAGAAATTTAAAACA | GAAGAAA | chrX | 139534173 | 139534192 | 139534189 | + |
| SEQ ID NO 11871 | GGCCAACATGAAAGGAGTAG | GGAGAAA | chrX | 139534204 | 139534223 | 139534220 | + |
| SEQ ID NO 11872 | AACTGCAGATCAAAAATATT | CAAGAAA | chrX | 139534494 | 139534513 | 139534510 | + |
| SEQ ID NO 11873 | TTACATTGTATTAGCTATTA | AGAGAAA | chrX | 139534616 | 139534635 | 139534632 | + |
| SEQ ID NO 11874 | TGCAAACGAGTGAAGGAAAT | TGAGAAA | chrX | 139535017 | 139535036 | 139535033 | + |
| SEQ ID NO 11875 | CTACTTGGGAGGCTGAGGCA | GGAGAAT | chrX | 139535246 | 139535265 | 139535262 | + |
| SEQ ID NO 11876 | GTCAAAAAAAAAGAGTTGA | AGAGAAA | chrX | 139535354 | 139535373 | 139535370 | + |
| SEQ ID NO 11877 | AAAAAGTCTAGGCTAAATTC | AAAGAAA | chrX | 139535378 | 139535397 | 139535394 | + |
| SEQ ID NO 11878 | CAGCTGCAATGAAAATAAGG | GAAGAAA | chrX | 139535483 | 139535502 | 139535499 | + |
| SEQ ID NO 11879 | AGGAAGTAGTCCCAAATACC | CCAGAAA | chrX | 139535577 | 139535596 | 139535593 | + |
| SEQ ID NO 11880 | AGATATATTGCTAGACCCTT | GAAGAAA | chrX | 139535643 | 139535662 | 139535659 | + |
| SEQ ID NO 11881 | TTAACAATGGGGATATATTC | TGAGAAA | chrX | 139535786 | 139535805 | 139535802 | + |
| SEQ ID NO 11882 | TGGTATTTGTGTATCTAAAC | ATAGAAA | chrX | 139535991 | 139536010 | 139536007 | + |
| SEQ ID NO 11883 | GAGAGGAAGGAGGGAGGGAA | GGAGAAA | chrX | 139536312 | 139536331 | 139536328 | + |
| SEQ ID NO 11884 | CAAAGTAAATTCAAATATGA | TTAGAAA | chrX | 139536749 | 139536768 | 139536765 | + |
| SEQ ID NO 11885 | ATTTTGGCTCCATGCCCTAA | AGAGAAA | chrX | 139536873 | 139536892 | 139536889 | + |
| SEQ ID NO 11886 | TTTTCTTTTTTGCTAAAACT | AAAGAAT | chrX | 139536965 | 139536984 | 139536981 | + |
| SEQ ID NO 11887 | TTGTTCAAGGGAACCTTGAG | AGAGAAT | chrX | 139537085 | 139537104 | 139537101 | + |
| SEQ ID NO 11888 | ACCTTGAGAGAGAATGTATG | GAAGAAA | chrX | 139537097 | 139537116 | 139537113 | + |
| SEQ ID NO 11889 | ATTATACCTCTTTGGCCGAT | TCAGAAT | chrX | 139537046 | 139537065 | 139537049 | - |
| SEQ ID NO 11890 | TTTGTTGGCGTTTTCATGAT | CAAGAAA | chrX | 139537019 | 139537038 | 139537022 | - |
| SEQ ID NO 11891 | TCAAGAAAAACTGAAATGTA | AAAGAAT | chrX | 139537000 | 139537019 | 139537003 | - |
| SEQ ID NO 11892 | AATTCTTTAGTTTTAGCAAA | AAAGAAA | chrX | 139536973 | 139536992 | 139536976 | - |
| SEQ ID NO 11893 | CATGAAAATTTTACATCTCT | TAAGAAA | chrX | 139536942 | 139536961 | 139536945 | - |
| SEQ ID NO 11894 | TTCAATTTTACTTTTAGTCA | AGAGAAT | chrX | 139536803 | 139536822 | 139536806 | - |
| SEQ ID NO 11895 | TTGAATTTACTTTGGATGAA | AAAGAAA | chrX | 139536743 | 139536762 | 139536746 | - |
| SEQ ID NO 11896 | TCACCCTGGCTGGGCTGTTT | TCAGAAT | chrX | 139536638 | 139536657 | 139536641 | - |
| SEQ ID NO 11897 | AGTGTCTGTCACTAGATGTT | AAAGAAA | chrX | 139536532 | 139536551 | 139536535 | - |
| SEQ ID NO 11898 | GCAGTGATTTAAGCATCTCT | CTAGAAT | chrX | 139536434 | 139536453 | 139536437 | - |

Figure 39 (Cont'd)

| | | | | | | | |
|---|---|---|---|---|---|---|---|
| SEQ ID NO 11899 | ATTGCTTAATGACACATTTC | TCAGAAT | chrX | 139535809 | 139535828 | 139535812 | - |
| SEQ ID NO 11900 | CTGATTAACTCCAAAAAGGA | AGAGAAA | chrX | 139535559 | 139535578 | 139535562 | - |
| SEQ ID NO 11901 | AGGAAAGTAAAAAGGAAAGG | AAAGAAA | chrX | 139535533 | 139535552 | 139535536 | - |
| SEQ ID NO 11902 | GTTGAGTGAAAAAACAGACT | TTAGAAT | chrX | 139534423 | 139534442 | 139534426 | - |
| SEQ ID NO 11903 | AGACTTTAGAATCAGATCAG | ACAGAAA | chrX | 139534408 | 139534427 | 139534411 | - |
| SEQ ID NO 11904 | TAGGTTTAACAGTAGTATAA | TAAGAAT | chrX | 139534292 | 139534311 | 139534295 | - |
| SEQ ID NO 11905 | GTCACAATCAGGAATGACCT | AAAGAAT | chrX | 139534080 | 139534099 | 139534083 | - |
| SEQ ID NO 11906 | TGCATTAATACTGTCTATCC | TTAGAAA | chrX | 139532279 | 139532298 | 139532282 | - |
| SEQ ID NO 11907 | TATCTCTGGCTACAATGGCT | GCAGAAT | chrX | 139532221 | 139532240 | 139532224 | - |
| SEQ ID NO 11908 | ATCATCTCACCACTTATATA | GAAGAAA | chrX | 139532022 | 139532041 | 139532025 | - |
| SEQ ID NO 11909 | GTCAGCTACTAGATTTGATT | CTAGAAA | chrX | 139531729 | 139531748 | 139531732 | - |
| SEQ ID NO 11910 | TTAGTTTTAAAAATGAAGAA | GAAGAAA | chrX | 139531026 | 139531045 | 139531029 | - |

Figure 40

| # | Sequence | PAM | Chr | Start | End | Cuts 5' of | Str |
|---|---|---|---|---|---|---|---|
| SEQ ID NO 11911 | GTTTTCTTCTTCTTCATTTT | TAAAAC | chrX | 139531017 | 139531036 | 139531033 | + |
| SEQ ID NO 11912 | TGGTCATGTAATTCCTGTTA | GAAAAC | chrX | 139531105 | 139531124 | 139531121 | + |
| SEQ ID NO 11913 | TTTAAAAAAATTAAAAGTGG | GAAAAC | chrX | 139531145 | 139531164 | 139531161 | + |
| SEQ ID NO 11914 | CTTCAATTTAAAGTTTTAGT | TAAAAC | chrX | 139531367 | 139531386 | 139531383 | + |
| SEQ ID NO 11915 | GGGATAAAGAAAATTTGTTG | GAAAAC | chrX | 139531910 | 139531929 | 139531926 | + |
| SEQ ID NO 11916 | ACAGTTTGGAATTTTGAAAT | TAAAAC | chrX | 139532406 | 139532425 | 139532422 | + |
| SEQ ID NO 11917 | TTGAAATTAAAACAGTTCTG | TAAAAC | chrX | 139532419 | 139532438 | 139532435 | + |
| SEQ ID NO 11918 | CTAAAGAGAATTGAGAAATT | TAAAAC | chrX | 139534166 | 139534185 | 139534182 | + |
| SEQ ID NO 11919 | ACACATATATGTATATACAT | GAAAAC | chrX | 139535723 | 139535742 | 139535739 | + |
| SEQ ID NO 11920 | CTAGGTAGATGTAGCTTAAA | AAAAAC | chrX | 139536392 | 139536411 | 139536408 | + |
| SEQ ID NO 11921 | CATTTGGGCAACCATATTCT | GAAAAC | chrX | 139536616 | 139536635 | 139536632 | + |
| SEQ ID NO 11922 | GCTTTCAGATTATTTGGATT | AAAAAC | chrX | 139536903 | 139536922 | 139536919 | + |
| SEQ ID NO 11923 | CATGATGTTTTCTTTTTTGC | TAAAAC | chrX | 139536958 | 139536977 | 139536974 | + |
| SEQ ID NO 11924 | TTTCAGTTTTTCTTGATCAT | GAAAAC | chrX | 139537004 | 139537023 | 139537020 | + |
| SEQ ID NO 11925 | AAGAAGCACGAGAAGTTTTT | GAAAAC | chrX | 139537136 | 139537155 | 139537152 | + |
| SEQ ID NO 11926 | AAAAACTTCTCGTGCTTCTT | CAAAAC | chrX | 139537136 | 139537155 | 139537139 | - |
| SEQ ID NO 11927 | TTGGCGTTTTCATGATCAAG | AAAAAC | chrX | 139537015 | 139537034 | 139537018 | - |
| SEQ ID NO 11928 | TCTTTAGTTTTAGCAAAAAA | GAAAAC | chrX | 139536970 | 139536989 | 139536973 | - |
| SEQ ID NO 11929 | TGTACAGTGTGGTTGAGTGA | AAAAAC | chrX | 139534434 | 139534453 | 139534437 | - |
| SEQ ID NO 11930 | CTTTGCCCAAGGTAACATAC | TAAAAC | chrX | 139533310 | 139533329 | 139533313 | - |
| SEQ ID NO 11931 | ATAGTCCATATGGAACCATA | CAAAAC | chrX | 139532830 | 139532849 | 139532833 | - |
| SEQ ID NO 11932 | TCTTTGATGCATACACTTTA | CAAAAC | chrX | 139532458 | 139532477 | 139532461 | - |
| SEQ ID NO 11933 | TAAAGTCACTGTAGTTGTGA | AAAAAC | chrX | 139531606 | 139531625 | 139531609 | - |
| SEQ ID NO 11934 | GTTAATCTTTATGTTTTAAC | TAAAAC | chrX | 139531385 | 139531404 | 139531388 | - |
| SEQ ID NO 11935 | GTTTTAAAAATGAAGAAGAA | GAAAAC | chrX | 139531023 | 139531042 | 139531026 | - |

Figure 41

| # | Sequence | PAM | Chr | Start | End | Cuts 5' of | Str |
|---|---|---|---|---|---|---|---|
| SEQ ID NO 11936 | ATCTACTCAGTGCTGAATGT | ACAGGTTT | chrX | 139530829 | 139530848 | 139530845 | + |
| SEQ ID NO 11937 | ACTCAGTGCTGAATGTACAG | GTTTGTTT | chrX | 139530833 | 139530852 | 139530849 | + |
| SEQ ID NO 11938 | CCTTTTTTAAAATACATTGA | GTATGCTT | chrX | 139530861 | 139530880 | 139530877 | + |
| SEQ ID NO 11939 | ATGCTGTCTTCTTCACTAAA | TTTTGATT | chrX | 139530913 | 139530932 | 139530929 | + |
| SEQ ID NO 11940 | TTCTTCACTAAATTTTGATT | ACATGATT | chrX | 139530921 | 139530940 | 139530937 | + |
| SEQ ID NO 11941 | AAGTACTGGTTCTTTGTTAG | CTAGGTTT | chrX | 139530993 | 139531012 | 139531009 | + |
| SEQ ID NO 11942 | TTTAAAACTAAATAGATCGA | CAATGCTT | chrX | 139531035 | 139531054 | 139531051 | + |
| SEQ ID NO 11943 | CGACAATGCTTATGATGCAT | TTATGTTT | chrX | 139531052 | 139531071 | 139531068 | + |
| SEQ ID NO 11944 | TTTAATAAACACTGTTCAGT | TCATGATT | chrX | 139531077 | 139531096 | 139531093 | + |
| SEQ ID NO 11945 | TGTTAGAAAACATTCATCTC | CTTGGTTT | chrX | 139531120 | 139531139 | 139531136 | + |
| SEQ ID NO 11946 | AAAAAAAATAACCACATTAT | TTTTGTTT | chrX | 139531193 | 139531212 | 139531209 | + |
| SEQ ID NO 11947 | TGGCCTTATTTACACAAAAA | GTCTGATT | chrX | 139531267 | 139531286 | 139531283 | + |
| SEQ ID NO 11948 | TTTTAAGATATATGACATTT | CAAGGTTT | chrX | 139531293 | 139531312 | 139531309 | + |
| SEQ ID NO 11949 | TAAATTATATATCTTCAATT | TAAAGTTT | chrX | 139531355 | 139531374 | 139531371 | + |
| SEQ ID NO 11950 | TTAAAGTTTTAGTTAAAACA | TAAAGATT | chrX | 139531374 | 139531393 | 139531390 | + |
| SEQ ID NO 11951 | AGCAAGCTGTTAGTTATCAC | CAAAGCTT | chrX | 139531413 | 139531432 | 139531429 | + |
| SEQ ID NO 11952 | TAGTTATCACCAAAGCTTTT | CATGGATT | chrX | 139531423 | 139531442 | 139531439 | + |
| SEQ ID NO 11953 | GAGTTCCCTAGGGGAGAAAA | GCAAGCTT | chrX | 139531521 | 139531540 | 139531537 | + |
| SEQ ID NO 11954 | AGCTAATGCAACATATATCA | CTTTGTTT | chrX | 139531576 | 139531595 | 139531592 | + |
| SEQ ID NO 11955 | TGAGATGATGAAGGTTGTAA | GAGGGCTT | chrX | 139532033 | 139532052 | 139532049 | + |
| SEQ ID NO 11956 | TAGATAAGAATAAGGATGAA | CCAGGCTT | chrX | 139532097 | 139532116 | 139532113 | + |
| SEQ ID NO 11957 | TAATACTAAGGAGAAAGGCA | ATGTGATT | chrX | 139532189 | 139532208 | 139532205 | + |
| SEQ ID NO 11958 | TCTTCTGCTATTAAACTCTC | ATTGGCTT | chrX | 139532305 | 139532324 | 139532321 | + |
| SEQ ID NO 11959 | AACTCTCATTGGCTTCTAAA | AGGAGTTT | chrX | 139532318 | 139532337 | 139532334 | + |
| SEQ ID NO 11960 | CTTCTAAAAGGAGTTTCGGT | GAGTGATT | chrX | 139532330 | 139532349 | 139532346 | + |
| SEQ ID NO 11961 | CTGCCTTTAGGTATTATTGC | AACAGTTT | chrX | 139532385 | 139532404 | 139532401 | + |
| SEQ ID NO 11962 | AATTAAAACAGTTCTGTAAA | ACCAGTTT | chrX | 139532423 | 139532442 | 139532439 | + |
| SEQ ID NO 11963 | AAACAGTTCTGTAAAACCAG | TTTAGTTT | chrX | 139532428 | 139532447 | 139532444 | + |
| SEQ ID NO 11964 | AAGCAGCATGAGGCCAGGTG | AGAGGTTT | chrX | 139532577 | 139532596 | 139532593 | + |
| SEQ ID NO 11965 | GAGGATCACTCGTGCAAAGA | CTCAGATT | chrX | 139532771 | 139532790 | 139532787 | + |
| SEQ ID NO 11966 | GCAAGAACGTGAGGTATTTC | AGGAGTTT | chrX | 139532800 | 139532819 | 139532816 | + |
| SEQ ID NO 11967 | ATAATGAAGTCATTAACCTA | AGGAGATT | chrX | 139532890 | 139532909 | 139532906 | + |
| SEQ ID NO 11968 | ACATAAGGAGTACCACTGAT | GGCTGATT | chrX | 139532955 | 139532974 | 139532971 | + |
| SEQ ID NO 11969 | TGGCTAGAGTCTTGGGGACT | TTGTGTTT | chrX | 139533199 | 139533218 | 139533215 | + |
| SEQ ID NO 11970 | TCTTGGGGACTTTGTGTTTG | ATGTGATT | chrX | 139533208 | 139533227 | 139533224 | + |
| SEQ ID NO 11971 | ACTGCCAGAGTCTGAATCCT | GAATGTTT | chrX | 139533280 | 139533299 | 139533296 | + |
| SEQ ID NO 11972 | TAAATATTGTGCCCTACATG | CCTTGTTT | chrX | 139533781 | 139533800 | 139533797 | + |
| SEQ ID NO 11973 | CAAAGCGGGGAACCAGAATA | GAGTGATT | chrX | 139533961 | 139533980 | 139533977 | + |
| SEQ ID NO 11974 | AATAGAGTGATTATTATAAA | AAGAGTTT | chrX | 139533977 | 139533996 | 139533993 | + |
| SEQ ID NO 11975 | AAAATTATTCTTTAGGTCAT | TCCTGATT | chrX | 139534067 | 139534086 | 139534083 | + |
| SEQ ID NO 11976 | ATAGTCATTTCATTATATAA | ATGTGATT | chrX | 139534101 | 139534120 | 139534117 | + |
| SEQ ID NO 11977 | CATTTGACAAAGTTAAGGTT | CAGAGCTT | chrX | 139534317 | 139534336 | 139534333 | + |
| SEQ ID NO 11978 | CAGGTCTAGAGGAGGCAGAT | ACTTGATT | chrX | 139534365 | 139534384 | 139534381 | + |
| SEQ ID NO 11979 | TTCAAACCTATTTCTGTCTG | ATCTGATT | chrX | 139534391 | 139534410 | 139534407 | + |
| SEQ ID NO 11980 | CTGTCTGATCTGATTCTAAA | GTCTGTTT | chrX | 139534404 | 139534423 | 139534420 | + |
| SEQ ID NO 11981 | CTCCTTGTGAGTTCCACAGC | CACAGATT | chrX | 139534461 | 139534480 | 139534477 | + |
| SEQ ID NO 11982 | AGCTATTAAGAGAAACCTAG | AGATGATT | chrX | 139534628 | 139534647 | 139534644 | + |
| SEQ ID NO 11983 | GATTTAAAGTACAAAGGAGG | ATGTGTTT | chrX | 139534652 | 139534671 | 139534668 | + |
| SEQ ID NO 11984 | GGTGGCATCCATCTGCATTT | TGGTGATT | chrX | 139534893 | 139534912 | 139534909 | + |

Figure 41 (Cont'd)

| | | | | | | | |
|---|---|---|---|---|---|---|---|
| SEQ ID NO 11985 | TGGCTGCTCCAATTTAGGGG | CTAGGATT | chrX | 139534971 | 139534990 | 139534987 | + |
| SEQ ID NO 11986 | ACAAGGTGAAATGGTGAAAC | CCCGGCTT | chrX | 139535165 | 139535184 | 139535181 | + |
| SEQ ID NO 11987 | TTGGGAGGCTGAGGCAGGAG | AATAGCTT | chrX | 139535250 | 139535269 | 139535266 | + |
| SEQ ID NO 11988 | CTGCAATGAAAATAAGGGAA | GAAAGTTT | chrX | 139535486 | 139535505 | 139535502 | + |
| SEQ ID NO 11989 | GGGAAGAAAGTTTAGTTCAT | CTCCGTTT | chrX | 139535501 | 139535520 | 139535517 | + |
| SEQ ID NO 11990 | ACTTACCTAAACCTAAATGG | TATAGCTT | chrX | 139535858 | 139535877 | 139535874 | + |
| SEQ ID NO 11991 | CCAAAATGTCATTGTGCAGC | AAATGATT | chrX | 139536085 | 139536104 | 139536101 | + |
| SEQ ID NO 11992 | AAGGAGGGAGGGAAGGAGAA | ATATGATT | chrX | 139536318 | 139536337 | 139536334 | + |
| SEQ ID NO 11993 | GTCTCTTCAGACTAGGTAGA | TGTAGCTT | chrX | 139536381 | 139536400 | 139536397 | + |
| SEQ ID NO 11994 | ACATATCCTGAATTCTAGAG | AGATGCTT | chrX | 139536416 | 139536435 | 139536432 | + |
| SEQ ID NO 11995 | CAAAGGTGCTGTTGATCTGA | AATTGCTT | chrX | 139536476 | 139536495 | 139536492 | + |
| SEQ ID NO 11996 | ATTGCTTTTTTAAATTAATG | CAGTGATT | chrX | 139536497 | 139536516 | 139536513 | + |
| SEQ ID NO 11997 | CATTTGCAGCTGGACCATAA | TTAGGCTT | chrX | 139536559 | 139536578 | 139536575 | + |
| SEQ ID NO 11998 | TTCATCCAAAGTAAATTCAA | ATATGATT | chrX | 139536743 | 139536762 | 139536759 | + |
| SEQ ID NO 11999 | ATACAGTACTGTGGGAACAT | CACAGATT | chrX | 139536848 | 139536867 | 139536864 | + |
| SEQ ID NO 12000 | GCTCCATGCCCTAAAGAGAA | ATTGGCTT | chrX | 139536879 | 139536898 | 139536895 | + |
| SEQ ID NO 12001 | GCCCTAAAGAGAAATTGGCT | TTCAGATT | chrX | 139536886 | 139536905 | 139536902 | + |
| SEQ ID NO 12002 | AGAAATTGGCTTTCAGATTA | TTTGGATT | chrX | 139536895 | 139536914 | 139536911 | + |
| SEQ ID NO 12003 | TAAGAGATGTAAAATTTTCA | TGATGTTT | chrX | 139536940 | 139536959 | 139536956 | + |
| SEQ ID NO 12004 | AAAGAATTATTCTTTTACAT | TTCAGTTT | chrX | 139536985 | 139537004 | 139537001 | + |
| SEQ ID NO 12005 | GTATAATTCAGGTAAATTGG | AAGAGTTT | chrX | 139537059 | 139537078 | 139537075 | + |
| SEQ ID NO 12006 | GAGAATGTATGGAAGAAAAG | TGTAGTTT | chrX | 139537106 | 139537125 | 139537122 | + |
| SEQ ID NO 12007 | TGTAGTTTTGAAGAAGCACG | AGAAGTTT | chrX | 139537126 | 139537145 | 139537142 | + |
| SEQ ID NO 12008 | TCAGTGTTTTCAAAAACTTC | TCGTGCTT | chrX | 139537147 | 139537166 | 139537150 | - |
| SEQ ID NO 12009 | TACCTGAATTATACCTCTTT | GGCCGATT | chrX | 139537053 | 139537072 | 139537056 | - |
| SEQ ID NO 12010 | TGGCCGATTCAGAATTTTGT | TGGCGTTT | chrX | 139537034 | 139537053 | 139537037 | - |
| SEQ ID NO 12011 | GAAATGTAAAAGAATAATTC | TTTAGTTT | chrX | 139536988 | 139537007 | 139536991 | - |
| SEQ ID NO 12012 | TTTACATCTCTTAAGAAAGT | CTTTGTTT | chrX | 139536933 | 139536952 | 139536936 | - |
| SEQ ID NO 12013 | CCCACAGTACTGTATACACA | TGGAGATT | chrX | 139536843 | 139536862 | 139536846 | - |
| SEQ ID NO 12014 | GAGAATTCCAGTAATAAAAG | GTCAGATT | chrX | 139536782 | 139536801 | 139536785 | - |
| SEQ ID NO 12015 | GTGATCCATCACCCTGGCTG | GGCTGTTT | chrX | 139536646 | 139536665 | 139536649 | - |
| SEQ ID NO 12016 | GGCAAGTGTTATAGGAATTG | CAGTGATT | chrX | 139536453 | 139536472 | 139536456 | - |
| SEQ ID NO 12017 | GCATCTCTAGAATTCAGG | ATATGTTT | chrX | 139536422 | 139536441 | 139536425 | - |
| SEQ ID NO 12018 | GTATTTTCACTGTACCTTTT | CTATGTTT | chrX | 139536015 | 139536034 | 139536018 | - |
| SEQ ID NO 12019 | TCAGTACAGTCACATGCTGT | ACAGGTTT | chrX | 139535949 | 139535968 | 139535952 | - |
| SEQ ID NO 12020 | TATGTAGTAAGCTATACCAT | TTAGGTTT | chrX | 139535874 | 139535893 | 139535877 | - |
| SEQ ID NO 12021 | TTATGTTCGCACAATGATGA | AATTGCTT | chrX | 139535830 | 139535849 | 139535833 | - |
| SEQ ID NO 12022 | GCATGGCTGTATACACACAC | ATGTGTTT | chrX | 139535761 | 139535780 | 139535764 | - |
| SEQ ID NO 12023 | GTATACACACACATGTGTTT | GTGTGTTT | chrX | 139535753 | 139535772 | 139535756 | - |
| SEQ ID NO 12024 | GATACCATCTCAAGAGGACC | AAGGGCTT | chrX | 139535623 | 139535642 | 139535626 | - |
| SEQ ID NO 12025 | CTGGGGTATTTGGGACTACT | TCCTGATT | chrX | 139535581 | 139535600 | 139535584 | - |
| SEQ ID NO 12026 | GTGTTCAGTCCCTTGACAT | CCCTGCTT | chrX | 139535450 | 139535469 | 139535453 | - |
| SEQ ID NO 12027 | TGCCTCAGCCTCCCAAGTAG | CTGGGATT | chrX | 139535246 | 139535265 | 139535249 | - |
| SEQ ID NO 12028 | TTTTGTATTTTAGTAAAGC | CGGGGTTT | chrX | 139535189 | 139535208 | 139535192 | - |
| SEQ ID NO 12029 | TGCCTGGGCCTCTGAAAGTG | CTGGGATT | chrX | 139535103 | 139535122 | 139535106 | - |
| SEQ ID NO 12030 | CATATTTCTCAATTTCCTTC | ACTCGTTT | chrX | 139535028 | 139535047 | 139535031 | - |
| SEQ ID NO 12031 | GCTCAAGTCTCCGATATAAA | AATGGCTT | chrX | 139534706 | 139534725 | 139534709 | - |
| SEQ ID NO 12032 | CTTTGTACTTTAAATCATCT | CTAGGTTT | chrX | 139534648 | 139534667 | 139534651 | - |
| SEQ ID NO 12033 | TGTAAATAGTTGTTATGCTG | TATTGTTT | chrX | 139534590 | 139534609 | 139534593 | - |
| SEQ ID NO 12034 | TAGAATCAGATCAGACAGAA | ATAGGTTT | chrX | 139534402 | 139534421 | 139534405 | - |

Figure 41 (Cont'd)

| | | | | | | | |
|---|---|---|---|---|---|---|---|
| SEQ ID NO 12035 | TTAACTTTGTCAAATGTAAA | TTAGGTTT | chrX | 139534313 | 139534332 | 139534316 | - |
| SEQ ID NO 12036 | TTCATGTTGGCCCTACTTTC | TTCTGTTT | chrX | 139534196 | 139534215 | 139534199 | - |
| SEQ ID NO 12037 | GAATGACCTAAAGAATAATT | TTGAGTTT | chrX | 139534069 | 139534088 | 139534072 | - |
| SEQ ID NO 12038 | ATAATCACTCTATTCTGGTT | CCCCGCTT | chrX | 139533971 | 139533990 | 139533974 | - |
| SEQ ID NO 12039 | TGTTATCCATCCAGCACTTG | AATTGATT | chrX | 139533931 | 139533950 | 139533934 | - |
| SEQ ID NO 12040 | GGGTTCTCCCAGGCTCCAGC | CTCAGCTT | chrX | 139533868 | 139533887 | 139533871 | - |
| SEQ ID NO 12041 | GTATATTTATGCCCTACAGG | CCTTGCTT | chrX | 139533733 | 139533752 | 139533736 | - |
| SEQ ID NO 12042 | CCCACACACGTGGCTGTAAC | TACTGTTT | chrX | 139533595 | 139533614 | 139533598 | - |
| SEQ ID NO 12043 | GTCAGATACGTCTCCTGAAT | TTCAGATT | chrX | 139533535 | 139533554 | 139533538 | - |
| SEQ ID NO 12044 | AGTAATAGCTAATGTATATG | TAATGCTT | chrX | 139533469 | 139533488 | 139533472 | - |
| SEQ ID NO 12045 | TTATTTTTATGAATGAGGAA | GATAGATT | chrX | 139533353 | 139533372 | 139533356 | - |
| SEQ ID NO 12046 | AAGATAGATTCATAGAGGCT | AAGGGCTT | chrX | 139533335 | 139533354 | 139533338 | - |
| SEQ ID NO 12047 | AAGGTAACATACTAAAACAT | TCAGGATT | chrX | 139533302 | 139533321 | 139533305 | - |
| SEQ ID NO 12048 | TCAGCCATCAGTGGTACTCC | TTATGTTT | chrX | 139532961 | 139532980 | 139532964 | - |
| SEQ ID NO 12049 | TTATCTGATGACCAGCTCTG | CCTAGTTT | chrX | 139532874 | 139532893 | 139532877 | - |
| SEQ ID NO 12050 | GAAAATATTCTCTCTCTATC | AATTGTTT | chrX | 139532681 | 139532700 | 139532684 | - |
| SEQ ID NO 12051 | AAACCTCTCACCTGGCCTCA | TGCTGCTT | chrX | 139532585 | 139532604 | 139532588 | - |
| SEQ ID NO 12052 | GCTTTAGATCAAAGAGGGAG | TCTGGTTT | chrX | 139532561 | 139532580 | 139532564 | - |
| SEQ ID NO 12053 | CATACACTTTACAAAACTAA | ACTGGTTT | chrX | 139532449 | 139532468 | 139532452 | - |
| SEQ ID NO 12054 | AAACTAAACTGGTTTTACAG | AACTGTTT | chrX | 139532436 | 139532455 | 139532439 | - |
| SEQ ID NO 12055 | AACTCCTTTTAGAAGCCAAT | GAGAGTTT | chrX | 139532325 | 139532344 | 139532328 | - |
| SEQ ID NO 12056 | ATTCCCCTGGCCCCTTCCTC | AAGGGCTT | chrX | 139532251 | 139532270 | 139532254 | - |
| SEQ ID NO 12057 | ATCGTATACTTAACTTCCCT | TCAGGTTT | chrX | 139532162 | 139532181 | 139532165 | - |
| SEQ ID NO 12058 | CTCACCACTTATATAGAAGA | AAGGGTTT | chrX | 139532017 | 139532036 | 139532020 | - |
| SEQ ID NO 12059 | TTATATAGAAGAAAGGGTTT | GGATGCTT | chrX | 139532009 | 139532028 | 139532012 | - |
| SEQ ID NO 12060 | TAATGAGATATATCTAATGG | CCTTGCTT | chrX | 139531961 | 139531980 | 139531964 | - |
| SEQ ID NO 12061 | TCTAATGGCCTTGCTTTATG | TCCTGCTT | chrX | 139531949 | 139531968 | 139531952 | - |
| SEQ ID NO 12062 | CTTGCTTTATGTCCTGCTTT | GTGAGTTT | chrX | 139531940 | 139531959 | 139531943 | - |
| SEQ ID NO 12063 | CCCTTGACTTTACTCACTTT | GCTAGTTT | chrX | 139531893 | 139531912 | 139531896 | - |
| SEQ ID NO 12064 | ATCGTTATTTCAGCATTTCA | GTCTGATT | chrX | 139531846 | 139531865 | 139531849 | - |
| SEQ ID NO 12065 | GAGTGGGAACCACAGGGCCA | GTCAGCTT | chrX | 139531797 | 139531816 | 139531800 | - |
| SEQ ID NO 12066 | AGGGCCAGTCAGCTTTCTGG | GGGTGCTT | chrX | 139531784 | 139531803 | 139531787 | - |
| SEQ ID NO 12067 | TGATCCTGGTACTGTCAGCT | ACTAGATT | chrX | 139531742 | 139531761 | 139531745 | - |
| SEQ ID NO 12068 | CTGGTACTGTCAGCTACTAG | ATTTGATT | chrX | 139531737 | 139531756 | 139531740 | - |
| SEQ ID NO 12069 | AGTTGACAAGTAAGTGTGAT | AAATGCTT | chrX | 139531703 | 139531722 | 139531706 | - |
| SEQ ID NO 12070 | AAATGCTTCCTGTGAGAACA | TGCTGTTT | chrX | 139531683 | 139531702 | 139531686 | - |
| SEQ ID NO 12071 | CCTACTCTTTATGTCAATTC | TTAAGCTT | chrX | 139531551 | 139531570 | 139531554 | - |
| SEQ ID NO 12072 | CTCTTTATGTCAATTCTTAA | GCTTGCTT | chrX | 139531547 | 139531566 | 139531550 | - |
| SEQ ID NO 12073 | CTAGGGAACTCAACTGAGTA | TTGTGTTT | chrX | 139531512 | 139531531 | 139531515 | - |
| SEQ ID NO 12074 | TTCCCCAAATATCAACTCCA | AGATGTTT | chrX | 139531486 | 139531505 | 139531489 | - |
| SEQ ID NO 12075 | AGATGTTTGACATAGAGACA | AAATGATT | chrX | 139531466 | 139531485 | 139531469 | - |
| SEQ ID NO 12076 | TGATTTTTTCCTAATCCATG | AAAAGCTT | chrX | 139531443 | 139531462 | 139531446 | - |
| SEQ ID NO 12077 | GAAAAGCTTTGGTGATAACT | AACAGCTT | chrX | 139531424 | 139531443 | 139531427 | - |
| SEQ ID NO 12078 | TGCTAATGAAAGGTTAATCT | TTATGTTT | chrX | 139531397 | 139531416 | 139531400 | - |
| SEQ ID NO 12079 | ACTTTTTGTGTAAATAAGGC | CATTGTTT | chrX | 139531269 | 139531288 | 139531272 | - |
| SEQ ID NO 12080 | TGTGTAAATAAGGCCATTGT | TTGTGCTT | chrX | 139531263 | 139531282 | 139531266 | - |
| SEQ ID NO 12081 | AATAAGGCCATTGTTTGTGC | TTTTGTTT | chrX | 139531257 | 139531276 | 139531260 | - |
| SEQ ID NO 12082 | GTTTGTGCTTTTGTTTCCCA | TTTTGATT | chrX | 139531245 | 139531264 | 139531248 | - |
| SEQ ID NO 12083 | TTCACTATATTCTGCTATTT | CTTTGTTT | chrX | 139531175 | 139531194 | 139531178 | - |
| SEQ ID NO 12084 | TTTTTTTAAACCAAGGAGAT | GAATGTTT | chrX | 139531135 | 139531154 | 139531138 | - |

Figure 41 (Cont'd)

| | | | | | | | |
|---|---|---|---|---|---|---|---|
| SEQ ID NO 12085 | TGACCAAATCATGAACTGAA | CAGTGTTT | chrX | 139531091 | 139531110 | 139531094 | - |
| SEQ ID NO 12086 | TCATAAGCATTGTCGATCTA | TTTAGTTT | chrX | 139531047 | 139531066 | 139531050 | - |
| SEQ ID NO 12087 | AGGCAGATGGTGATGAGGCC | TGGTGATT | chrX | 139530801 | 139530820 | 139530804 | - |
| SEQ ID NO 12088 | CGCGCTGCATAACCTTTGCT | AGCAGATT | chrX | 139530755 | 139530774 | 139530758 | - |

Figure 42

| # | Sequence | PAM | Chr | Start | End | Cut site 1 (5' of) | Cut site 2 (5' of) | Str |
|---|---|---|---|---|---|---|---|---|
| SEQ ID NO 12089 | TCACAATCTGCTAGCAAAGGTT | CTT | chrX | 139530743 | 139530764 | 139530760 | 139530765 | + |
| SEQ ID NO 12090 | CACAATCTGCTAGCAAAGGTTA | TTT | chrX | 139530744 | 139530765 | 139530761 | 139530766 | + |
| SEQ ID NO 12091 | ACAATCTGCTAGCAAAGGTTAT | TTC | chrX | 139530745 | 139530766 | 139530762 | 139530767 | + |
| SEQ ID NO 12092 | CTAGCAAAGGTTATGCAGCGCG | CTG | chrX | 139530753 | 139530774 | 139530770 | 139530775 | + |
| SEQ ID NO 12093 | GCAAAGGTTATGCAGCGCGTGA | CTA | chrX | 139530756 | 139530777 | 139530773 | 139530778 | + |
| SEQ ID NO 12094 | TGCAGCGCGTGAACATGATCAT | TTA | chrX | 139530766 | 139530787 | 139530783 | 139530788 | + |
| SEQ ID NO 12095 | ATCACCATCTGCCTTTTAGGAT | CTC | chrX | 139530807 | 139530828 | 139530824 | 139530829 | + |
| SEQ ID NO 12096 | CCTTTTAGGATATCTACTCAGT | CTG | chrX | 139530818 | 139530839 | 139530835 | 139530840 | + |
| SEQ ID NO 12097 | TTAGGATATCTACTCAGTGCTG | CTT | chrX | 139530822 | 139530843 | 139530839 | 139530844 | + |
| SEQ ID NO 12098 | TAGGATATCTACTCAGTGCTGA | TTT | chrX | 139530823 | 139530844 | 139530840 | 139530845 | + |
| SEQ ID NO 12099 | AGGATATCTACTCAGTGCTGAA | TTT | chrX | 139530824 | 139530845 | 139530841 | 139530846 | + |
| SEQ ID NO 12100 | GGATATCTACTCAGTGCTGAAT | TTA | chrX | 139530825 | 139530846 | 139530842 | 139530847 | + |
| SEQ ID NO 12101 | CTCAGTGCTGAATGTACAGGTT | CTA | chrX | 139530834 | 139530855 | 139530851 | 139530856 | + |
| SEQ ID NO 12102 | AGTGCTGAATGTACAGGTTTGT | CTC | chrX | 139530837 | 139530858 | 139530854 | 139530859 | + |
| SEQ ID NO 12103 | AATGTACAGGTTTGTTTCCTTT | CTG | chrX | 139530844 | 139530865 | 139530861 | 139530866 | + |
| SEQ ID NO 12104 | GTTTCCTTTTTAAAATACATT | TTT | chrX | 139530857 | 139530878 | 139530874 | 139530879 | + |
| SEQ ID NO 12105 | TTTCCTTTTTAAAATACATTG | TTG | chrX | 139530858 | 139530879 | 139530875 | 139530880 | + |
| SEQ ID NO 12106 | CCTTTTTTAAAATACATTGAGT | TTT | chrX | 139530861 | 139530882 | 139530878 | 139530883 | + |
| SEQ ID NO 12107 | CTTTTTTAAAATACATTGAGTA | TTC | chrX | 139530862 | 139530883 | 139530879 | 139530884 | + |
| SEQ ID NO 12108 | TTTTAAAATACATTGAGTATGC | CTT | chrX | 139530865 | 139530886 | 139530882 | 139530887 | + |
| SEQ ID NO 12109 | TTTAAAATACATTGAGTATGCT | TTT | chrX | 139530866 | 139530887 | 139530883 | 139530888 | + |
| SEQ ID NO 12110 | TTAAAATACATTGAGTATGCTT | TTT | chrX | 139530867 | 139530888 | 139530884 | 139530889 | + |
| SEQ ID NO 12111 | TAAAATACATTGAGTATGCTTG | TTT | chrX | 139530868 | 139530889 | 139530885 | 139530890 | + |
| SEQ ID NO 12112 | AAAATACATTGAGTATGCTTGC | TTT | chrX | 139530869 | 139530890 | 139530886 | 139530891 | + |
| SEQ ID NO 12113 | AAATACATTGAGTATGCTTGCC | TTA | chrX | 139530870 | 139530891 | 139530887 | 139530892 | + |
| SEQ ID NO 12114 | AGTATGCTTGCCTTTTAGATAT | TTG | chrX | 139530880 | 139530901 | 139530897 | 139530902 | + |
| SEQ ID NO 12115 | GCCTTTTAGATATAGAAATATC | CTT | chrX | 139530889 | 139530910 | 139530906 | 139530911 | + |
| SEQ ID NO 12116 | CCTTTTAGATATAGAAATATCT | TTG | chrX | 139530890 | 139530911 | 139530907 | 139530912 | + |
| SEQ ID NO 12117 | TTAGATATAGAAATATCTGATG | CTT | chrX | 139530894 | 139530915 | 139530911 | 139530916 | + |
| SEQ ID NO 12118 | TAGATATAGAAATATCTGATGC | TTT | chrX | 139530895 | 139530916 | 139530912 | 139530917 | + |
| SEQ ID NO 12119 | AGATATAGAAATATCTGATGCT | TTT | chrX | 139530896 | 139530917 | 139530913 | 139530918 | + |
| SEQ ID NO 12120 | GATATAGAAATATCTGATGCTG | TTA | chrX | 139530897 | 139530918 | 139530914 | 139530919 | + |
| SEQ ID NO 12121 | ATGCTGTCTTCTTCACTAAATT | CTG | chrX | 139530913 | 139530934 | 139530930 | 139530935 | + |
| SEQ ID NO 12122 | TCTTCTTCACTAAATTTTGATT | CTG | chrX | 139530919 | 139530940 | 139530936 | 139530941 | + |
| SEQ ID NO 12123 | CTTCACTAAATTTTGATTACAT | CTT | chrX | 139530923 | 139530944 | 139530940 | 139530945 | + |
| SEQ ID NO 12124 | TTCACTAAATTTTGATTACATG | TTC | chrX | 139530924 | 139530945 | 139530941 | 139530946 | + |
| SEQ ID NO 12125 | CACTAAATTTTGATTACATGAT | CTT | chrX | 139530926 | 139530947 | 139530943 | 139530948 | + |
| SEQ ID NO 12126 | ACTAAATTTTGATTACATGATT | TTC | chrX | 139530927 | 139530948 | 139530944 | 139530949 | + |
| SEQ ID NO 12127 | AATTTTGATTACATGATTTGAC | CTA | chrX | 139530931 | 139530952 | 139530948 | 139530953 | + |
| SEQ ID NO 12128 | TGATTACATGATTTGACAGCAA | TTT | chrX | 139530936 | 139530957 | 139530953 | 139530958 | + |
| SEQ ID NO 12129 | GATTACATGATTTGACAGCAAT | TTT | chrX | 139530937 | 139530958 | 139530954 | 139530959 | + |
| SEQ ID NO 12130 | ATTACATGATTTGACAGCAATA | TTG | chrX | 139530938 | 139530959 | 139530955 | 139530960 | + |
| SEQ ID NO 12131 | CATGATTTGACAGCAATATTGA | TTA | chrX | 139530942 | 139530963 | 139530959 | 139530964 | + |
| SEQ ID NO 12132 | GACAGCAATATTGAAGAGTCTA | TTT | chrX | 139530950 | 139530971 | 139530967 | 139530972 | + |
| SEQ ID NO 12133 | ACAGCAATATTGAAGAGTCTAA | TTG | chrX | 139530951 | 139530972 | 139530968 | 139530973 | + |
| SEQ ID NO 12134 | AAGAGTCTAACAGCCAGCACGC | TTG | chrX | 139530963 | 139530984 | 139530980 | 139530985 | + |
| SEQ ID NO 12135 | ACAGCCAGCACGCAGGTTGGTA | CTA | chrX | 139530972 | 139530993 | 139530989 | 139530994 | + |
| SEQ ID NO 12136 | GTAAGTACTGGTTCTTTGTTAG | TTG | chrX | 139530991 | 139531012 | 139531008 | 139531013 | + |
| SEQ ID NO 12137 | GTTCTTTGTTAGCTAGGTTTTC | CTG | chrX | 139531001 | 139531022 | 139531018 | 139531023 | + |
| SEQ ID NO 12138 | TTTGTTAGCTAGGTTTTCTTCT | TTC | chrX | 139531005 | 139531026 | 139531022 | 139531027 | + |
| SEQ ID NO 12139 | TGTTAGCTAGGTTTTCTTCTTC | CTT | chrX | 139531007 | 139531028 | 139531024 | 139531029 | + |
| SEQ ID NO 12140 | GTTAGCTAGGTTTTCTTCTTCT | TTT | chrX | 139531008 | 139531029 | 139531025 | 139531030 | + |
| SEQ ID NO 12141 | TTAGCTAGGTTTTCTTCTTCTT | TTG | chrX | 139531009 | 139531030 | 139531026 | 139531031 | + |
| SEQ ID NO 12142 | GCTAGGTTTTCTTCTTCTTCAT | TTA | chrX | 139531012 | 139531033 | 139531029 | 139531034 | + |
| SEQ ID NO 12143 | GGTTTTCTTCTTCTTCATTTTT | CTA | chrX | 139531016 | 139531037 | 139531033 | 139531038 | + |
| SEQ ID NO 12144 | TCTTCTTCTTCATTTTTAAAAC | TTT | chrX | 139531021 | 139531042 | 139531038 | 139531043 | + |
| SEQ ID NO 12145 | CTTCTTCTTCATTTTTAAAACT | TTT | chrX | 139531022 | 139531043 | 139531039 | 139531044 | + |
| SEQ ID NO 12146 | TTCTTCTTCATTTTTAAAACTA | TTC | chrX | 139531023 | 139531044 | 139531040 | 139531045 | + |

Figure 42 (Cont'd)

| | | | | | | | | |
|---|---|---|---|---|---|---|---|---|
| SEQ ID NO 12147 | CTTCTTCATTTTTAAAACTAAA | CTT | chrX | 139531025 | 139531046 | 139531042 | 139531047 | + |
| SEQ ID NO 12148 | TTCTTCATTTTTAAAACTAAAT | TTC | chrX | 139531026 | 139531047 | 139531043 | 139531048 | + |
| SEQ ID NO 12149 | CTTCATTTTTAAAACTAAATAG | CTT | chrX | 139531028 | 139531049 | 139531045 | 139531050 | + |
| SEQ ID NO 12150 | TTCATTTTTAAAACTAAATAGA | TTC | chrX | 139531029 | 139531050 | 139531046 | 139531051 | + |
| SEQ ID NO 12151 | CATTTTTAAAACTAAATAGATC | CTT | chrX | 139531031 | 139531052 | 139531048 | 139531053 | + |
| SEQ ID NO 12152 | ATTTTTAAAACTAAATAGATCG | TTC | chrX | 139531032 | 139531053 | 139531049 | 139531054 | + |
| SEQ ID NO 12153 | TTAAAACTAAATAGATCGACAA | TTT | chrX | 139531036 | 139531057 | 139531053 | 139531058 | + |
| SEQ ID NO 12154 | TAAAACTAAATAGATCGACAAT | TTT | chrX | 139531037 | 139531058 | 139531054 | 139531059 | + |
| SEQ ID NO 12155 | AAAACTAAATAGATCGACAATG | TTT | chrX | 139531038 | 139531059 | 139531055 | 139531060 | + |
| SEQ ID NO 12156 | AAACTAAATAGATCGACAATGC | TTA | chrX | 139531039 | 139531060 | 139531056 | 139531061 | + |
| SEQ ID NO 12157 | AATAGATCGACAATGCTTATGA | CTA | chrX | 139531045 | 139531066 | 139531062 | 139531067 | + |
| SEQ ID NO 12158 | ATGATGCATTTATGTTTAATAA | CTT | chrX | 139531063 | 139531084 | 139531080 | 139531085 | + |
| SEQ ID NO 12159 | TGATGCATTTATGTTTAATAAA | TTA | chrX | 139531064 | 139531085 | 139531081 | 139531086 | + |
| SEQ ID NO 12160 | ATGTTTAATAAACACTGTTCAG | TTT | chrX | 139531074 | 139531095 | 139531091 | 139531096 | + |
| SEQ ID NO 12161 | TGTTTAATAAACACTGTTCAGT | TTA | chrX | 139531075 | 139531096 | 139531092 | 139531097 | + |
| SEQ ID NO 12162 | AATAAACACTGTTCAGTTCATG | TTT | chrX | 139531080 | 139531101 | 139531097 | 139531102 | + |
| SEQ ID NO 12163 | ATAAACACTGTTCAGTTCATGA | TTA | chrX | 139531081 | 139531102 | 139531098 | 139531103 | + |
| SEQ ID NO 12164 | TTCAGTTCATGATTTGGTCATG | CTG | chrX | 139531091 | 139531112 | 139531108 | 139531113 | + |
| SEQ ID NO 12165 | AGTTCATGATTTGGTCATGTAA | TTC | chrX | 139531094 | 139531115 | 139531111 | 139531116 | + |
| SEQ ID NO 12166 | ATGATTTGGTCATGTAATTCCT | TTC | chrX | 139531099 | 139531120 | 139531116 | 139531121 | + |
| SEQ ID NO 12167 | GGTCATGTAATTCCTGTTAGAA | TTT | chrX | 139531106 | 139531127 | 139531123 | 139531128 | + |
| SEQ ID NO 12168 | GTCATGTAATTCCTGTTAGAAA | TTG | chrX | 139531107 | 139531128 | 139531124 | 139531129 | + |
| SEQ ID NO 12169 | CTGTTAGAAACATTCATCTCC | TTC | chrX | 139531119 | 139531140 | 139531136 | 139531141 | + |
| SEQ ID NO 12170 | TTAGAAACATTCATCTCCTTG | CTG | chrX | 139531122 | 139531143 | 139531139 | 139531144 | + |
| SEQ ID NO 12171 | GAAAACATTCATCTCCTTGGTT | TTA | chrX | 139531125 | 139531146 | 139531142 | 139531147 | + |
| SEQ ID NO 12172 | ATCTCCTTGGTTTAAAAAAATT | TTC | chrX | 139531135 | 139531156 | 139531152 | 139531157 | + |
| SEQ ID NO 12173 | CTTGGTTTAAAAAAATTAAAAG | CTC | chrX | 139531140 | 139531161 | 139531157 | 139531162 | + |
| SEQ ID NO 12174 | GGTTTAAAAAAATTAAAAGTGG | CTT | chrX | 139531143 | 139531164 | 139531160 | 139531165 | + |
| SEQ ID NO 12175 | GTTTAAAAAAATTAAAAGTGGG | TTG | chrX | 139531144 | 139531165 | 139531161 | 139531166 | + |
| SEQ ID NO 12176 | AAAAAAATTAAAAGTGGGAAAA | TTT | chrX | 139531148 | 139531169 | 139531165 | 139531170 | + |
| SEQ ID NO 12177 | AAAAAATTAAAAGTGGGAAAAC | TTA | chrX | 139531149 | 139531170 | 139531166 | 139531171 | + |
| SEQ ID NO 12178 | AAAGTGGGAAAACAAAGAAATA | TTA | chrX | 139531158 | 139531179 | 139531175 | 139531180 | + |
| SEQ ID NO 12179 | TTTTTGTTTGGACTTACCACTT | TTA | chrX | 139531212 | 139531233 | 139531229 | 139531234 | + |
| SEQ ID NO 12180 | TTGTTTGGACTTACCACTTTGA | TTT | chrX | 139531215 | 139531236 | 139531232 | 139531237 | + |
| SEQ ID NO 12181 | TGTTTGGACTTACCACTTTGAA | TTT | chrX | 139531216 | 139531237 | 139531233 | 139531238 | + |
| SEQ ID NO 12182 | GTTTGGACTTACCACTTTGAAA | TTT | chrX | 139531217 | 139531238 | 139531234 | 139531239 | + |
| SEQ ID NO 12183 | TTTGGACTTACCACTTTGAAAT | TTG | chrX | 139531218 | 139531239 | 139531235 | 139531240 | + |
| SEQ ID NO 12184 | GGACTTACCACTTTGAAATCAA | TTT | chrX | 139531221 | 139531242 | 139531238 | 139531243 | + |
| SEQ ID NO 12185 | GACTTACCACTTTGAAATCAAA | TTG | chrX | 139531222 | 139531243 | 139531239 | 139531244 | + |
| SEQ ID NO 12186 | ACCACTTTGAAATCAAAATGGG | CTT | chrX | 139531227 | 139531248 | 139531244 | 139531249 | + |
| SEQ ID NO 12187 | CCACTTTGAAATCAAAATGGGA | TTA | chrX | 139531228 | 139531249 | 139531245 | 139531250 | + |
| SEQ ID NO 12188 | TGAAATCAAAATGGGAAACAAA | CTT | chrX | 139531234 | 139531255 | 139531251 | 139531256 | + |
| SEQ ID NO 12189 | GAAATCAAAATGGGAAACAAAA | TTT | chrX | 139531235 | 139531256 | 139531252 | 139531257 | + |
| SEQ ID NO 12190 | AAATCAAAATGGGAAACAAAAG | TTG | chrX | 139531236 | 139531257 | 139531253 | 139531258 | + |
| SEQ ID NO 12191 | ATTTACACAAAAGTCTGATTTT | CTT | chrX | 139531274 | 139531295 | 139531291 | 139531296 | + |
| SEQ ID NO 12192 | TTTACACAAAAGTCTGATTTTA | TTA | chrX | 139531275 | 139531296 | 139531292 | 139531297 | + |
| SEQ ID NO 12193 | ACACAAAAGTCTGATTTTAAG | TTT | chrX | 139531278 | 139531299 | 139531295 | 139531300 | + |
| SEQ ID NO 12194 | CACAAAAGTCTGATTTTAAGA | TTA | chrX | 139531279 | 139531300 | 139531296 | 139531301 | + |
| SEQ ID NO 12195 | ATTTTAAGATATATGACATTTC | CTG | chrX | 139531292 | 139531313 | 139531309 | 139531314 | + |
| SEQ ID NO 12196 | TAAGATATATGACATTTCAAGG | TTT | chrX | 139531296 | 139531317 | 139531313 | 139531318 | + |
| SEQ ID NO 12197 | AAGATATATGACATTTCAAGGT | TTT | chrX | 139531297 | 139531318 | 139531314 | 139531319 | + |
| SEQ ID NO 12198 | AGATATATGACATTTCAAGGTT | TTA | chrX | 139531298 | 139531319 | 139531315 | 139531320 | + |
| SEQ ID NO 12199 | CAAGGTTTCAGAAGTATGTAAT | TTT | chrX | 139531313 | 139531334 | 139531330 | 139531335 | + |
| SEQ ID NO 12200 | AAGGTTTCAGAAGTATGTAATG | TTC | chrX | 139531314 | 139531335 | 139531331 | 139531336 | + |
| SEQ ID NO 12201 | CAGAAGTATGTAATGAGGTGTG | TTT | chrX | 139531321 | 139531342 | 139531338 | 139531343 | + |
| SEQ ID NO 12202 | AGAAGTATGTAATGAGGTGTGT | TTC | chrX | 139531322 | 139531343 | 139531339 | 139531344 | + |
| SEQ ID NO 12203 | TAATTTTTAAATTATATATCT | CTC | chrX | 139531347 | 139531368 | 139531364 | 139531369 | + |
| SEQ ID NO 12204 | ATTTTTAAATTATATATCTTC | CTA | chrX | 139531349 | 139531370 | 139531366 | 139531371 | + |
| SEQ ID NO 12205 | TTTAAATTATATATCTTCAATT | TTT | chrX | 139531353 | 139531374 | 139531370 | 139531375 | + |

Figure 42 (Cont'd)

| | | | | | | | | |
|---|---|---|---|---|---|---|---|---|
| SEQ ID NO 12206 | TTAAATTATATATCTTCAATTTT | TTT | chrX | 139531354 | 139531375 | 139531371 | 139531376 | + |
| SEQ ID NO 12207 | TAAATTATATATCTTCAATTTA | TTT | chrX | 139531355 | 139531376 | 139531372 | 139531377 | + |
| SEQ ID NO 12208 | AAATTATATATCTTCAATTTAA | TTT | chrX | 139531356 | 139531377 | 139531373 | 139531378 | + |
| SEQ ID NO 12209 | AATTATATATCTTCAATTTAAA | TTA | chrX | 139531357 | 139531378 | 139531374 | 139531379 | + |
| SEQ ID NO 12210 | TATATCTTCAATTTAAAGTTTT | TTA | chrX | 139531362 | 139531383 | 139531379 | 139531384 | + |
| SEQ ID NO 12211 | CAATTTAAAGTTTTAGTTAAAA | CTT | chrX | 139531370 | 139531391 | 139531387 | 139531392 | + |
| SEQ ID NO 12212 | AATTTAAAGTTTTAGTTAAAAC | TTC | chrX | 139531371 | 139531392 | 139531388 | 139531393 | + |
| SEQ ID NO 12213 | AAAGTTTTAGTTAAAACATAAA | TTT | chrX | 139531376 | 139531397 | 139531393 | 139531398 | + |
| SEQ ID NO 12214 | AAGTTTTAGTTAAAACATAAAG | TTA | chrX | 139531377 | 139531398 | 139531394 | 139531399 | + |
| SEQ ID NO 12215 | TAGTTAAAACATAAAGATTAAC | TTT | chrX | 139531383 | 139531404 | 139531400 | 139531405 | + |
| SEQ ID NO 12216 | AGTTAAAACATAAAGATTAACC | TTT | chrX | 139531384 | 139531405 | 139531401 | 139531406 | + |
| SEQ ID NO 12217 | GTTAAAACATAAAGATTAACCT | TTA | chrX | 139531385 | 139531406 | 139531402 | 139531407 | + |
| SEQ ID NO 12218 | AAACATAAAGATTAACCTTTCA | TTA | chrX | 139531389 | 139531410 | 139531406 | 139531411 | + |
| SEQ ID NO 12219 | ACCTTTCATTAGCAAGCTGTTA | TTA | chrX | 139531403 | 139531424 | 139531420 | 139531425 | + |
| SEQ ID NO 12220 | TCATTAGCAAGCTGTTAGTTAT | CTT | chrX | 139531408 | 139531429 | 139531425 | 139531430 | + |
| SEQ ID NO 12221 | CATTAGCAAGCTGTTAGTTATC | TTT | chrX | 139531409 | 139531430 | 139531426 | 139531431 | + |
| SEQ ID NO 12222 | ATTAGCAAGCTGTTAGTTATCA | TTC | chrX | 139531410 | 139531431 | 139531427 | 139531432 | + |
| SEQ ID NO 12223 | GCAAGCTGTTAGTTATCACCAA | TTA | chrX | 139531414 | 139531435 | 139531431 | 139531436 | + |
| SEQ ID NO 12224 | TTAGTTATCACCAAAGCTTTTC | CTG | chrX | 139531422 | 139531443 | 139531439 | 139531444 | + |
| SEQ ID NO 12225 | GTTATCACCAAAGCTTTTCATG | TTA | chrX | 139531425 | 139531446 | 139531442 | 139531447 | + |
| SEQ ID NO 12226 | TCACCAAAGCTTTTCATGGATT | TTA | chrX | 139531429 | 139531450 | 139531446 | 139531451 | + |
| SEQ ID NO 12227 | TTCATGGATTAGGAAAAAATCA | CTT | chrX | 139531441 | 139531462 | 139531458 | 139531463 | + |
| SEQ ID NO 12228 | TCATGGATTAGGAAAAAATCAT | TTT | chrX | 139531442 | 139531463 | 139531459 | 139531464 | + |
| SEQ ID NO 12229 | CATGGATTAGGAAAAAATCATT | TTT | chrX | 139531443 | 139531464 | 139531460 | 139531465 | + |
| SEQ ID NO 12230 | ATGGATTAGGAAAAAATCATTT | TTC | chrX | 139531444 | 139531465 | 139531461 | 139531466 | + |
| SEQ ID NO 12231 | GGAAAAAATCATTTTGTCTCTA | TTA | chrX | 139531452 | 139531473 | 139531469 | 139531474 | + |
| SEQ ID NO 12232 | TGTCTCTATGTCAAACATCTTG | TTT | chrX | 139531466 | 139531487 | 139531483 | 139531488 | + |
| SEQ ID NO 12233 | GTCTCTATGTCAAACATCTTGG | TTT | chrX | 139531467 | 139531488 | 139531484 | 139531489 | + |
| SEQ ID NO 12234 | TCTCTATGTCAAACATCTTGGA | TTG | chrX | 139531468 | 139531489 | 139531485 | 139531490 | + |
| SEQ ID NO 12235 | TATGTCAAACATCTTGGAGTTG | CTC | chrX | 139531472 | 139531493 | 139531489 | 139531494 | + |
| SEQ ID NO 12236 | TGTCAAACATCTTGGAGTTGAT | CTA | chrX | 139531474 | 139531495 | 139531491 | 139531496 | + |
| SEQ ID NO 12237 | GGAGTTGATATTTGGGGAAACA | CTT | chrX | 139531487 | 139531508 | 139531504 | 139531509 | + |
| SEQ ID NO 12238 | GAGTTGATATTTGGGGAAACAC | TTG | chrX | 139531488 | 139531509 | 139531505 | 139531510 | + |
| SEQ ID NO 12239 | ATATTTGGGGAAACACAATACT | TTG | chrX | 139531494 | 139531515 | 139531511 | 139531516 | + |
| SEQ ID NO 12240 | GGGGAAACACAATACTCAGTTG | TTT | chrX | 139531500 | 139531521 | 139531517 | 139531522 | + |
| SEQ ID NO 12241 | GGGAAACACAATACTCAGTTGA | TTG | chrX | 139531501 | 139531522 | 139531518 | 139531523 | + |
| SEQ ID NO 12242 | AGTTGAGTTCCCTAGGGGAGAA | CTC | chrX | 139531517 | 139531538 | 139531534 | 139531539 | + |
| SEQ ID NO 12243 | AGTTCCCTAGGGGAGAAAAGCA | TTG | chrX | 139531522 | 139531543 | 139531539 | 139531544 | + |
| SEQ ID NO 12244 | CCTAGGGGAGAAAAGCAAGCTT | TTC | chrX | 139531527 | 139531548 | 139531544 | 139531549 | + |
| SEQ ID NO 12245 | GGGGAGAAAAGCAAGCTTAAGA | CTA | chrX | 139531531 | 139531552 | 139531548 | 139531553 | + |
| SEQ ID NO 12246 | AAGAATTGACATAAAGAGTAGG | CTT | chrX | 139531549 | 139531570 | 139531566 | 139531571 | + |
| SEQ ID NO 12247 | AGAATTGACATAAAGAGTAGGA | TTA | chrX | 139531550 | 139531571 | 139531567 | 139531572 | + |
| SEQ ID NO 12248 | ACATAAAGAGTAGGAAGTTAGC | TTG | chrX | 139531557 | 139531578 | 139531574 | 139531579 | + |
| SEQ ID NO 12249 | GCTAATGCAACATATATCACTT | TTA | chrX | 139531577 | 139531598 | 139531594 | 139531599 | + |
| SEQ ID NO 12250 | ATGCAACATATATCACTTTGTT | CTA | chrX | 139531581 | 139531602 | 139531598 | 139531603 | + |
| SEQ ID NO 12251 | TGTTTTTTCACAACTACAGTGA | CTT | chrX | 139531599 | 139531620 | 139531616 | 139531621 | + |
| SEQ ID NO 12252 | GTTTTTTCACAACTACAGTGAC | TTT | chrX | 139531600 | 139531621 | 139531617 | 139531622 | + |
| SEQ ID NO 12253 | TTTTTTCACAACTACAGTGACT | TTG | chrX | 139531601 | 139531622 | 139531618 | 139531623 | + |
| SEQ ID NO 12254 | TTTCACAACTACAGTGACTTTA | TTT | chrX | 139531604 | 139531625 | 139531621 | 139531626 | + |
| SEQ ID NO 12255 | TTCACAACTACAGTGACTTTAT | TTT | chrX | 139531605 | 139531626 | 139531622 | 139531627 | + |
| SEQ ID NO 12256 | TCACAACTACAGTGACTTTATG | TTT | chrX | 139531606 | 139531627 | 139531623 | 139531628 | + |
| SEQ ID NO 12257 | CACAACTACAGTGACTTTATGT | TTT | chrX | 139531607 | 139531628 | 139531624 | 139531629 | + |
| SEQ ID NO 12258 | ACAACTACAGTGACTTTATGTA | TTC | chrX | 139531608 | 139531629 | 139531625 | 139531630 | + |
| SEQ ID NO 12259 | CAGTGACTTTATGTATTTCCCA | CTA | chrX | 139531615 | 139531636 | 139531632 | 139531637 | + |
| SEQ ID NO 12260 | TATGTATTTCCCAGAGGAAGGC | CTT | chrX | 139531624 | 139531645 | 139531641 | 139531646 | + |
| SEQ ID NO 12261 | ATGTATTTCCCAGAGGAAGGCA | TTT | chrX | 139531625 | 139531646 | 139531642 | 139531647 | + |
| SEQ ID NO 12262 | TGTATTTCCCAGAGGAAGGCAT | TTA | chrX | 139531626 | 139531647 | 139531643 | 139531648 | + |
| SEQ ID NO 12263 | CCCAGAGGAAGGCATACAGGGA | TTT | chrX | 139531633 | 139531654 | 139531650 | 139531655 | + |
| SEQ ID NO 12264 | CCAGAGGAAGGCATACAGGGAA | TTC | chrX | 139531634 | 139531655 | 139531651 | 139531656 | + |

Figure 42 (Cont'd)

| | | | | | | | | |
|---|---|---|---|---|---|---|---|---|
| SEQ ID NO 12265 | TCCCATTTGGACAAACAGCATG | TTA | chrX | 139531663 | 139531684 | 139531680 | 139531685 | + |
| SEQ ID NO 12266 | GGACAAACAGCATGTTCTCACA | TTT | chrX | 139531671 | 139531692 | 139531688 | 139531693 | + |
| SEQ ID NO 12267 | GACAAACAGCATGTTCTCACAG | TTG | chrX | 139531672 | 139531693 | 139531689 | 139531694 | + |
| SEQ ID NO 12268 | TCACAGGAAGCATTTATCACAC | TTC | chrX | 139531688 | 139531709 | 139531705 | 139531710 | + |
| SEQ ID NO 12269 | ACAGGAAGCATTTATCACACTT | CTC | chrX | 139531690 | 139531711 | 139531707 | 139531712 | + |
| SEQ ID NO 12270 | ATCACACTTACTTGTCAACTTT | TTT | chrX | 139531703 | 139531724 | 139531720 | 139531725 | + |
| SEQ ID NO 12271 | TCACACTTACTTGTCAACTTTC | TTA | chrX | 139531704 | 139531725 | 139531721 | 139531726 | + |
| SEQ ID NO 12272 | ACTTGTCAACTTTCTAGAATCA | CTT | chrX | 139531712 | 139531733 | 139531729 | 139531734 | + |
| SEQ ID NO 12273 | CTTGTCAACTTTCTAGAATCAA | TTA | chrX | 139531713 | 139531734 | 139531730 | 139531735 | + |
| SEQ ID NO 12274 | GTCAACTTTCTAGAATCAAATC | CTT | chrX | 139531716 | 139531737 | 139531733 | 139531738 | + |
| SEQ ID NO 12275 | TCAACTTTCTAGAATCAAATCT | TTG | chrX | 139531717 | 139531738 | 139531734 | 139531739 | + |
| SEQ ID NO 12276 | TCTAGAATCAAATCTAGTAGCT | CTT | chrX | 139531724 | 139531745 | 139531741 | 139531746 | + |
| SEQ ID NO 12277 | CTAGAATCAAATCTAGTAGCTG | TTT | chrX | 139531725 | 139531746 | 139531742 | 139531747 | + |
| SEQ ID NO 12278 | TAGAATCAAATCTAGTAGCTGA | TTC | chrX | 139531726 | 139531747 | 139531743 | 139531748 | + |
| SEQ ID NO 12279 | GAATCAAATCTAGTAGCTGACA | CTA | chrX | 139531728 | 139531749 | 139531745 | 139531750 | + |
| SEQ ID NO 12280 | GTAGCTGACAGTACCAGGATCA | CTA | chrX | 139531740 | 139531761 | 139531757 | 139531762 | + |
| SEQ ID NO 12281 | ACAGTACCAGGATCAGGGGTGC | CTG | chrX | 139531747 | 139531768 | 139531764 | 139531769 | + |
| SEQ ID NO 12282 | AGCACCCCAGAAAGCTGACTG | CTA | chrX | 139531777 | 139531798 | 139531794 | 139531799 | + |
| SEQ ID NO 12283 | ACTGGCCCTGTGGTTCCCACTC | CTG | chrX | 139531795 | 139531816 | 139531812 | 139531817 | + |
| SEQ ID NO 12284 | GCCCTGTGGTTCCCACTCCAGA | CTG | chrX | 139531799 | 139531820 | 139531816 | 139531821 | + |
| SEQ ID NO 12285 | TGGTTCCCACTCCAGACATGAT | CTG | chrX | 139531805 | 139531826 | 139531822 | 139531827 | + |
| SEQ ID NO 12286 | CCACTCCAGACATGATGTCAGC | TTC | chrX | 139531811 | 139531832 | 139531828 | 139531833 | + |
| SEQ ID NO 12287 | CAGACATGATGTCAGCTGTGAA | CTC | chrX | 139531817 | 139531838 | 139531834 | 139531839 | + |
| SEQ ID NO 12288 | TGAAATCAGACTGAAATGCTGA | CTG | chrX | 139531835 | 139531856 | 139531852 | 139531857 | + |
| SEQ ID NO 12289 | AAATGCTGAAATAACGATAAAA | CTG | chrX | 139531848 | 139531869 | 139531865 | 139531870 | + |
| SEQ ID NO 12290 | AAATAACGATAAAAAAAAATAC | CTG | chrX | 139531856 | 139531877 | 139531873 | 139531878 | + |
| SEQ ID NO 12291 | AACTAGCAAAGTGAGTAAAGTC | TTA | chrX | 139531886 | 139531907 | 139531903 | 139531908 | + |
| SEQ ID NO 12292 | GCAAAGTGAGTAAAGTCAAGGG | CTA | chrX | 139531891 | 139531912 | 139531908 | 139531913 | + |
| SEQ ID NO 12293 | GTTGGAAAACTCACAAAGCAGG | TTT | chrX | 139531926 | 139531947 | 139531943 | 139531948 | + |
| SEQ ID NO 12294 | TTGGAAAACTCACAAAGCAGGA | TTG | chrX | 139531927 | 139531948 | 139531944 | 139531949 | + |
| SEQ ID NO 12295 | GAAAACTCACAAAGCAGGACAT | TTG | chrX | 139531930 | 139531951 | 139531947 | 139531952 | + |
| SEQ ID NO 12296 | ACAAAGCAGGACATAAAGCAAG | CTC | chrX | 139531938 | 139531959 | 139531955 | 139531960 | + |
| SEQ ID NO 12297 | GATATATCTCATTAGTGTGACA | TTA | chrX | 139531967 | 139531988 | 139531984 | 139531989 | + |
| SEQ ID NO 12298 | ATTAGTGTGACATCTGGGAGGA | CTC | chrX | 139531977 | 139531998 | 139531994 | 139531999 | + |
| SEQ ID NO 12299 | GTGTGACATCTGGGAGGACAAA | TTA | chrX | 139531981 | 139532002 | 139531998 | 139532003 | + |
| SEQ ID NO 12300 | GGAGGACAAAGCATCCAAACCC | CTG | chrX | 139531993 | 139532014 | 139532010 | 139532015 | + |
| SEQ ID NO 12301 | TCTTCTATATAAGTGGTGAGAT | CTT | chrX | 139532017 | 139532038 | 139532034 | 139532039 | + |
| SEQ ID NO 12302 | CTTCTATATAAGTGGTGAGATG | TTT | chrX | 139532018 | 139532039 | 139532035 | 139532040 | + |
| SEQ ID NO 12303 | TTCTATATAAGTGGTGAGATGA | TTC | chrX | 139532019 | 139532040 | 139532036 | 139532041 | + |
| SEQ ID NO 12304 | CTATATAAGTGGTGAGATGATG | CTT | chrX | 139532021 | 139532042 | 139532038 | 139532043 | + |
| SEQ ID NO 12305 | TATATAAGTGGTGAGATGATGA | TTC | chrX | 139532022 | 139532043 | 139532039 | 139532044 | + |
| SEQ ID NO 12306 | TATAAGTGGTGAGATGATGAAG | CTA | chrX | 139532024 | 139532045 | 139532041 | 139532046 | + |
| SEQ ID NO 12307 | TAAGAGGGCTTCTGCCCCCTTG | TTG | chrX | 139532050 | 139532071 | 139532067 | 139532072 | + |
| SEQ ID NO 12308 | CTGCCCCCTTGAAGACTTCAGA | CTT | chrX | 139532061 | 139532082 | 139532078 | 139532083 | + |
| SEQ ID NO 12309 | TGCCCCCTTGAAGACTTCAGAT | TTC | chrX | 139532062 | 139532083 | 139532079 | 139532084 | + |
| SEQ ID NO 12310 | CCCCCTTGAAGACTTCAGATGC | CTG | chrX | 139532064 | 139532085 | 139532081 | 139532086 | + |
| SEQ ID NO 12311 | GAAGACTTCAGATGCTGGGGAA | CTT | chrX | 139532071 | 139532092 | 139532088 | 139532093 | + |
| SEQ ID NO 12312 | AAGACTTCAGATGCTGGGGAAA | TTG | chrX | 139532072 | 139532093 | 139532089 | 139532094 | + |
| SEQ ID NO 12313 | CAGATGCTGGGGAAGGATAGA | CTT | chrX | 139532079 | 139532100 | 139532096 | 139532101 | + |
| SEQ ID NO 12314 | AGATGCTGGGGAAGGATAGAT | TTC | chrX | 139532080 | 139532101 | 139532097 | 139532102 | + |
| SEQ ID NO 12315 | GGGAAGGATAGATAAGAATAA | CTG | chrX | 139532088 | 139532109 | 139532105 | 139532110 | + |
| SEQ ID NO 12316 | TTGGAGCCTGGGAAATAATGAC | CTT | chrX | 139532125 | 139532146 | 139532142 | 139532147 | + |
| SEQ ID NO 12317 | TGGAGCCTGGGAAATAATGACT | TTT | chrX | 139532126 | 139532147 | 139532143 | 139532148 | + |
| SEQ ID NO 12318 | GGAGCCTGGGAAATAATGACTA | TTT | chrX | 139532127 | 139532148 | 139532144 | 139532149 | + |
| SEQ ID NO 12319 | GAGCCTGGGAAATAATGACTAG | TTG | chrX | 139532128 | 139532149 | 139532145 | 139532150 | + |
| SEQ ID NO 12320 | GGAAATAATGACTAGCGATAAA | CTG | chrX | 139532135 | 139532156 | 139532152 | 139532157 | + |
| SEQ ID NO 12321 | GCGATAAACCTGAAGGGAAGTT | CTA | chrX | 139532149 | 139532170 | 139532166 | 139532171 | + |
| SEQ ID NO 12322 | AAGGGAAGTTAAGTATACGATC | CTG | chrX | 139532161 | 139532182 | 139532178 | 139532183 | + |
| SEQ ID NO 12323 | AGTATACGATCCCCAGATAATA | TTA | chrX | 139532172 | 139532193 | 139532189 | 139532194 | + |

Figure 42 (Cont'd)

| | | | | | | | | |
|---|---|---|---|---|---|---|---|---|
| SEQ ID NO 12324 | AGGAGAAAGGCAATGTGATTCT | CTA | chrX | 139532197 | 139532218 | 139532214 | 139532219 | + |
| SEQ ID NO 12325 | TGCAGCCATTGTAGCCAGAGAT | TTC | chrX | 139532218 | 139532239 | 139532235 | 139532240 | + |
| SEQ ID NO 12326 | CAGCCATTGTAGCCAGAGATAA | CTG | chrX | 139532220 | 139532241 | 139532237 | 139532242 | + |
| SEQ ID NO 12327 | TAGCCAGAGATAATAAGCCCTT | TTG | chrX | 139532229 | 139532250 | 139532246 | 139532251 | + |
| SEQ ID NO 12328 | GAGGAAGGGGCCAGGGGAATTT | CTT | chrX | 139532251 | 139532272 | 139532268 | 139532273 | + |
| SEQ ID NO 12329 | AGGAAGGGGCCAGGGGAATTTT | TTG | chrX | 139532252 | 139532273 | 139532269 | 139532274 | + |
| SEQ ID NO 12330 | TTCTAAGGATAGACAGTATTAA | TTT | chrX | 139532273 | 139532294 | 139532290 | 139532295 | + |
| SEQ ID NO 12331 | TCTAAGGATAGACAGTATTAAT | TTT | chrX | 139532274 | 139532295 | 139532291 | 139532296 | + |
| SEQ ID NO 12332 | CTAAGGATAGACAGTATTAATG | TTT | chrX | 139532275 | 139532296 | 139532292 | 139532297 | + |
| SEQ ID NO 12333 | TAAGGATAGACAGTATTAATGC | TTC | chrX | 139532276 | 139532297 | 139532293 | 139532298 | + |
| SEQ ID NO 12334 | AGGATAGACAGTATTAATGCAG | CTA | chrX | 139532278 | 139532299 | 139532295 | 139532300 | + |
| SEQ ID NO 12335 | ATGCAGCACTCTCTTCTGCTAT | TTA | chrX | 139532294 | 139532315 | 139532311 | 139532316 | + |
| SEQ ID NO 12336 | TCTTCTGCTATTAAACTCTCAT | CTC | chrX | 139532305 | 139532326 | 139532322 | 139532327 | + |
| SEQ ID NO 12337 | TTCTGCTATTAAACTCTCATTG | CTC | chrX | 139532307 | 139532328 | 139532324 | 139532329 | + |
| SEQ ID NO 12338 | CTGCTATTAAACTCTCATTGGC | CTT | chrX | 139532309 | 139532330 | 139532326 | 139532331 | + |
| SEQ ID NO 12339 | TGCTATTAAACTCTCATTGGCT | TTC | chrX | 139532310 | 139532331 | 139532327 | 139532332 | + |
| SEQ ID NO 12340 | CTATTAAACTCTCATTGGCTTC | CTG | chrX | 139532312 | 139532333 | 139532329 | 139532334 | + |
| SEQ ID NO 12341 | TTAAACTCTCATTGGCTTCTAA | CTA | chrX | 139532315 | 139532336 | 139532332 | 139532337 | + |
| SEQ ID NO 12342 | AACTCTCATTGGCTTCTAAAAG | TTA | chrX | 139532318 | 139532339 | 139532335 | 139532340 | + |
| SEQ ID NO 12343 | TCATTGGCTTCTAAAAGGAGTT | CTC | chrX | 139532323 | 139532344 | 139532340 | 139532345 | + |
| SEQ ID NO 12344 | ATTGGCTTCTAAAAGGAGTTTC | CTC | chrX | 139532325 | 139532346 | 139532342 | 139532347 | + |
| SEQ ID NO 12345 | GCTTCTAAAAGGAGTTTCGGTG | TTG | chrX | 139532329 | 139532350 | 139532346 | 139532351 | + |
| SEQ ID NO 12346 | CTAAAAGGAGTTTCGGTGAGTG | CTT | chrX | 139532333 | 139532354 | 139532350 | 139532355 | + |
| SEQ ID NO 12347 | TAAAAGGAGTTTCGGTGAGTGA | TTC | chrX | 139532334 | 139532355 | 139532351 | 139532356 | + |
| SEQ ID NO 12348 | AAAGGAGTTTCGGTGAGTGATT | CTA | chrX | 139532336 | 139532357 | 139532353 | 139532358 | + |
| SEQ ID NO 12349 | CGGTGAGTGATTTGCTGAGATG | TTT | chrX | 139532346 | 139532367 | 139532363 | 139532368 | + |
| SEQ ID NO 12350 | GGTGAGTGATTTGCTGAGATGT | TTC | chrX | 139532347 | 139532368 | 139532364 | 139532369 | + |
| SEQ ID NO 12351 | GCTGAGATGTTGCATTTTCATG | TTT | chrX | 139532359 | 139532380 | 139532376 | 139532381 | + |
| SEQ ID NO 12352 | CTGAGATGTTGCATTTTCATGG | TTG | chrX | 139532360 | 139532381 | 139532377 | 139532382 | + |
| SEQ ID NO 12353 | AGATGTTGCATTTTCATGGCTG | CTG | chrX | 139532363 | 139532384 | 139532380 | 139532385 | + |
| SEQ ID NO 12354 | CATTTTCATGGCTGCTGCCTTT | TTG | chrX | 139532371 | 139532392 | 139532388 | 139532393 | + |
| SEQ ID NO 12355 | TCATGGCTGCTGCCTTTAGGTA | TTT | chrX | 139532376 | 139532397 | 139532393 | 139532398 | + |
| SEQ ID NO 12356 | CATGGCTGCTGCCTTTAGGTAT | TTT | chrX | 139532377 | 139532398 | 139532394 | 139532399 | + |
| SEQ ID NO 12357 | ATGGCTGCTGCCTTTAGGTATT | TTC | chrX | 139532378 | 139532399 | 139532395 | 139532400 | + |
| SEQ ID NO 12358 | CTGCCTTTAGGTATTATTGCAA | CTG | chrX | 139532385 | 139532406 | 139532402 | 139532407 | + |
| SEQ ID NO 12359 | CCTTTAGGTATTATTGCAACAG | CTG | chrX | 139532388 | 139532409 | 139532405 | 139532410 | + |
| SEQ ID NO 12360 | TAGGTATTATTGCAACAGTTTG | CTT | chrX | 139532392 | 139532413 | 139532409 | 139532414 | + |
| SEQ ID NO 12361 | AGGTATTATTGCAACAGTTTGG | TTT | chrX | 139532393 | 139532414 | 139532410 | 139532415 | + |
| SEQ ID NO 12362 | GGTATTATTGCAACAGTTTGGA | TTA | chrX | 139532394 | 139532415 | 139532411 | 139532416 | + |
| SEQ ID NO 12363 | TTGCAACAGTTTGGAATTTTGA | TTA | chrX | 139532401 | 139532422 | 139532418 | 139532423 | + |
| SEQ ID NO 12364 | CAACAGTTTGGAATTTTGAAAT | TTG | chrX | 139532404 | 139532425 | 139532421 | 139532426 | + |
| SEQ ID NO 12365 | GGAATTTTGAAATTAAAACAGT | TTT | chrX | 139532413 | 139532434 | 139532430 | 139532435 | + |
| SEQ ID NO 12366 | GAATTTTGAAATTAAAACAGTT | TTG | chrX | 139532414 | 139532435 | 139532431 | 139532436 | + |
| SEQ ID NO 12367 | TGAAATTAAAACAGTTCTGTAA | TTT | chrX | 139532420 | 139532441 | 139532437 | 139532442 | + |
| SEQ ID NO 12368 | GAAATTAAAACAGTTCTGTAAA | TTT | chrX | 139532421 | 139532442 | 139532438 | 139532443 | + |
| SEQ ID NO 12369 | AAATTAAAACAGTTCTGTAAAA | TTG | chrX | 139532422 | 139532443 | 139532439 | 139532444 | + |
| SEQ ID NO 12370 | AAACAGTTCTGTAAAACCAGTT | TTA | chrX | 139532428 | 139532449 | 139532445 | 139532450 | + |
| SEQ ID NO 12371 | TGTAAAACCAGTTTAGTTTTGT | TTC | chrX | 139532437 | 139532458 | 139532454 | 139532459 | + |
| SEQ ID NO 12372 | TAAAACCAGTTTAGTTTTGTAA | CTG | chrX | 139532439 | 139532460 | 139532456 | 139532461 | + |
| SEQ ID NO 12373 | AGTTTTGTAAAGTGTATGCATC | TTT | chrX | 139532451 | 139532472 | 139532468 | 139532473 | + |
| SEQ ID NO 12374 | GTTTTGTAAAGTGTATGCATCA | TTA | chrX | 139532452 | 139532473 | 139532469 | 139532474 | + |
| SEQ ID NO 12375 | TGTAAAGTGTATGCATCAAAGA | TTT | chrX | 139532456 | 139532477 | 139532473 | 139532478 | + |
| SEQ ID NO 12376 | GTAAAGTGTATGCATCAAAGAT | TTT | chrX | 139532457 | 139532478 | 139532474 | 139532479 | + |
| SEQ ID NO 12377 | TAAAGTGTATGCATCAAAGATG | TTG | chrX | 139532458 | 139532479 | 139532475 | 139532480 | + |
| SEQ ID NO 12378 | CATTCAGACATTACTGAGTTAC | CTT | chrX | 139532485 | 139532506 | 139532502 | 139532507 | + |
| SEQ ID NO 12379 | ATTCAGACATTACTGAGTTACA | TTC | chrX | 139532486 | 139532507 | 139532503 | 139532508 | + |
| SEQ ID NO 12380 | AGACATTACTGAGTTACAACTA | TTC | chrX | 139532490 | 139532511 | 139532507 | 139532512 | + |
| SEQ ID NO 12381 | CTGAGTTACAACTATGGTGCCA | TTA | chrX | 139532498 | 139532519 | 139532515 | 139532520 | + |
| SEQ ID NO 12382 | AGTTACAACTATGGTGCCAGGT | CTG | chrX | 139532501 | 139532522 | 139532518 | 139532523 | + |

Figure 42 (Cont'd)

| | | | | | | | | |
|---|---|---|---|---|---|---|---|---|
| SEQ ID NO 12383 | CAACTATGGTGCCAGGTACTGT | TTA | chrX | 139532506 | 139532527 | 139532523 | 139532528 | + |
| SEQ ID NO 12384 | TGGTGCCAGGTACTGTGTCAGG | CTA | chrX | 139532512 | 139532533 | 139532529 | 139532534 | + |
| SEQ ID NO 12385 | TGTCAGGGTACTAGGGGTATGG | CTG | chrX | 139532527 | 139532548 | 139532544 | 139532549 | + |
| SEQ ID NO 12386 | GGGGTATGGGGATAAACCAGAC | CTA | chrX | 139532540 | 139532561 | 139532557 | 139532562 | + |
| SEQ ID NO 12387 | CCTCTTTGATCTAAAGCAGCAT | CTC | chrX | 139532564 | 139532585 | 139532581 | 139532586 | + |
| SEQ ID NO 12388 | TTTGATCTAAAGCAGCATGAGG | CTC | chrX | 139532568 | 139532589 | 139532585 | 139532590 | + |
| SEQ ID NO 12389 | TGATCTAAAGCAGCATGAGGCC | CTT | chrX | 139532570 | 139532591 | 139532587 | 139532592 | + |
| SEQ ID NO 12390 | GATCTAAAGCAGCATGAGGCCA | TTT | chrX | 139532571 | 139532592 | 139532588 | 139532593 | + |
| SEQ ID NO 12391 | ATCTAAAGCAGCATGAGGCCAG | TTG | chrX | 139532572 | 139532593 | 139532589 | 139532594 | + |
| SEQ ID NO 12392 | AAGCAGCATGAGGCCAGGTGAG | CTA | chrX | 139532577 | 139532598 | 139532594 | 139532599 | + |
| SEQ ID NO 12393 | CAATATAATGTGATAAAATGTG | TTT | chrX | 139532605 | 139532626 | 139532622 | 139532627 | + |
| SEQ ID NO 12394 | AATATAATGTGATAAAATGTGC | TTC | chrX | 139532606 | 139532627 | 139532623 | 139532628 | + |
| SEQ ID NO 12395 | GGTACTAAGGGATCATAGAGAA | CTA | chrX | 139532632 | 139532653 | 139532649 | 139532654 | + |
| SEQ ID NO 12396 | AGGGATCATAGAGAAAGGAACA | CTA | chrX | 139532639 | 139532660 | 139532656 | 139532661 | + |
| SEQ ID NO 12397 | AATGGGGAAACAATTGATAGAG | TTA | chrX | 139532666 | 139532687 | 139532683 | 139532688 | + |
| SEQ ID NO 12398 | ATAGAGAGAATATTTTCATC | TTG | chrX | 139532682 | 139532703 | 139532699 | 139532704 | + |
| SEQ ID NO 12399 | TCATCTGGGTCTTAAAAGATGA | TTT | chrX | 139532699 | 139532720 | 139532716 | 139532721 | + |
| SEQ ID NO 12400 | CATCTGGGTCTTAAAAGATGAG | TTT | chrX | 139532700 | 139532721 | 139532717 | 139532722 | + |
| SEQ ID NO 12401 | ATCTGGGTCTTAAAAGATGAGT | TTC | chrX | 139532701 | 139532722 | 139532718 | 139532723 | + |
| SEQ ID NO 12402 | GGTCTTAAAAGATGAGTAGGCG | CTG | chrX | 139532706 | 139532727 | 139532723 | 139532728 | + |
| SEQ ID NO 12403 | AAAAGATGAGTAGGCGTTCTCT | CTT | chrX | 139532712 | 139532733 | 139532729 | 139532734 | + |
| SEQ ID NO 12404 | AAAGATGAGTAGGCGTTCTCTC | TTA | chrX | 139532713 | 139532734 | 139532730 | 139532735 | + |
| SEQ ID NO 12405 | TCTCTCTTTAAATGTCTGATAT | TTC | chrX | 139532731 | 139532752 | 139532748 | 139532753 | + |
| SEQ ID NO 12406 | TCTCTTTAAATGTCTGATATAA | CTC | chrX | 139532733 | 139532754 | 139532750 | 139532755 | + |
| SEQ ID NO 12407 | TCTTTAAATGTCTGATATAAGG | CTC | chrX | 139532735 | 139532756 | 139532752 | 139532757 | + |
| SEQ ID NO 12408 | TTTAAATGTCTGATATAAGGGC | CTC | chrX | 139532737 | 139532758 | 139532754 | 139532759 | + |
| SEQ ID NO 12409 | TAAATGTCTGATATAAGGGCAT | CTT | chrX | 139532739 | 139532760 | 139532756 | 139532761 | + |
| SEQ ID NO 12410 | AAATGTCTGATATAAGGGCATT | TTT | chrX | 139532740 | 139532761 | 139532757 | 139532762 | + |
| SEQ ID NO 12411 | AATGTCTGATATAAGGGCATTT | TTA | chrX | 139532741 | 139532762 | 139532758 | 139532763 | + |
| SEQ ID NO 12412 | ATATAAGGGCATTTTATGCAAA | CTG | chrX | 139532749 | 139532770 | 139532766 | 139532771 | + |
| SEQ ID NO 12413 | TATGCAAAGAGGATCACTCGTG | TTT | chrX | 139532763 | 139532784 | 139532780 | 139532785 | + |
| SEQ ID NO 12414 | ATGCAAAGAGGATCACTCGTGC | TTT | chrX | 139532764 | 139532785 | 139532781 | 139532786 | + |
| SEQ ID NO 12415 | TGCAAAGAGGATCACTCGTGCA | TTA | chrX | 139532765 | 139532786 | 139532782 | 139532787 | + |
| SEQ ID NO 12416 | GTGCAAAGACTCAGATTTGCAA | CTC | chrX | 139532782 | 139532803 | 139532799 | 139532804 | + |
| SEQ ID NO 12417 | AGATTTGCAAGAACGTGAGGTA | CTC | chrX | 139532794 | 139532815 | 139532811 | 139532816 | + |
| SEQ ID NO 12418 | GCAAGAACGTGAGGTATTTCAG | TTT | chrX | 139532800 | 139532821 | 139532817 | 139532822 | + |
| SEQ ID NO 12419 | CAAGAACGTGAGGTATTTCAGG | TTG | chrX | 139532801 | 139532822 | 139532818 | 139532823 | + |
| SEQ ID NO 12420 | CAGGAGTTTTGTATGGTTCCAT | TTT | chrX | 139532819 | 139532840 | 139532836 | 139532841 | + |
| SEQ ID NO 12421 | AGGAGTTTTGTATGGTTCCATA | TTC | chrX | 139532820 | 139532841 | 139532837 | 139532842 | + |
| SEQ ID NO 12422 | TGTATGGTTCCATATGGACTAT | TTT | chrX | 139532828 | 139532849 | 139532845 | 139532850 | + |
| SEQ ID NO 12423 | GTATGGTTCCATATGGACTATG | TTT | chrX | 139532829 | 139532850 | 139532846 | 139532851 | + |
| SEQ ID NO 12424 | TATGGTTCCATATGGACTATGA | TTG | chrX | 139532830 | 139532851 | 139532847 | 139532852 | + |
| SEQ ID NO 12425 | CATATGGACTATGACAAGTGAG | TTC | chrX | 139532838 | 139532859 | 139532855 | 139532860 | + |
| SEQ ID NO 12426 | TGACAAGTGAGACAGGTAAACT | CTA | chrX | 139532849 | 139532870 | 139532866 | 139532871 | + |
| SEQ ID NO 12427 | GGCAGAGCTGGTCATCAGATAA | CTA | chrX | 139532872 | 139532893 | 139532889 | 139532894 | + |
| SEQ ID NO 12428 | GTCATCAGATAATGAAGTCATT | CTG | chrX | 139532882 | 139532903 | 139532899 | 139532904 | + |
| SEQ ID NO 12429 | ACCTAAGGAGATTGGACAATAA | TTA | chrX | 139532905 | 139532926 | 139532922 | 139532927 | + |
| SEQ ID NO 12430 | AGGAGATTGGACAATAAAATGC | CTA | chrX | 139532910 | 139532931 | 139532927 | 139532932 | + |
| SEQ ID NO 12431 | GACAATAAAATGCAATATGGAG | TTG | chrX | 139532919 | 139532940 | 139532936 | 139532941 | + |
| SEQ ID NO 12432 | ATGGCTGATTTAGGATGCCCAG | CTG | chrX | 139532973 | 139532994 | 139532990 | 139532995 | + |
| SEQ ID NO 12433 | ATTTAGGATGCCCAGTCTGGCA | CTG | chrX | 139532980 | 139533001 | 139532997 | 139533002 | + |
| SEQ ID NO 12434 | AGGATGCCCAGTCTGGCAACAC | TTT | chrX | 139532984 | 139533005 | 139533001 | 139533006 | + |
| SEQ ID NO 12435 | GGATGCCCAGTCTGGCAACACG | TTA | chrX | 139532985 | 139533006 | 139533002 | 139533007 | + |
| SEQ ID NO 12436 | GCAACACGCTAATGAAATGATA | CTG | chrX | 139532999 | 139533020 | 139533016 | 139533021 | + |
| SEQ ID NO 12437 | ATGAAATGATAGTGGGGAGGG | CTA | chrX | 139533010 | 139533031 | 139533027 | 139533032 | + |
| SEQ ID NO 12438 | GGAGAGAGCAGTCCTGAGACTA | CTA | chrX | 139533048 | 139533069 | 139533065 | 139533070 | + |
| SEQ ID NO 12439 | AGACTATTGCAATTATCTGCGG | CTG | chrX | 139533064 | 139533085 | 139533081 | 139533086 | + |
| SEQ ID NO 12440 | TTGCAATTATCTGCGGGAGACA | CTA | chrX | 139533070 | 139533091 | 139533087 | 139533092 | + |
| SEQ ID NO 12441 | CAATTATCTGCGGGAGACATAA | TTG | chrX | 139533073 | 139533094 | 139533090 | 139533095 | + |

Figure 42 (Cont'd)

| SEQ ID NO 12442 | TCTGCGGGAGACATAAAGGCTA | TTA | chrX | 139533079 | 139533100 | 139533096 | 139533101 | + |
| SEQ ID NO 12443 | CGGGAGACATAAAGGCTAGAAC | CTG | chrX | 139533083 | 139533104 | 139533100 | 139533105 | + |
| SEQ ID NO 12444 | GAACCTGAACAGTAGCAGTACA | CTA | chrX | 139533101 | 139533122 | 139533118 | 139533123 | + |
| SEQ ID NO 12445 | AACAGTAGCAGTACAAAAAAAG | CTG | chrX | 139533108 | 139533129 | 139533125 | 139533130 | + |
| SEQ ID NO 12446 | AAATGATATTAAGGAAGTAGAA | TTC | chrX | 139533140 | 139533161 | 139533157 | 139533162 | + |
| SEQ ID NO 12447 | AGGAAGTAGAAGTGGTATGACT | TTA | chrX | 139533151 | 139533172 | 139533168 | 139533173 | + |
| SEQ ID NO 12448 | AACCATCTGGGTATGGAAGGGG | CTT | chrX | 139533174 | 139533195 | 139533191 | 139533196 | + |
| SEQ ID NO 12449 | ACCATCTGGGTATGGAAGGGGA | TTA | chrX | 139533175 | 139533196 | 139533192 | 139533197 | + |
| SEQ ID NO 12450 | GGTATGGAAGGGGAAATGGCTA | CTG | chrX | 139533183 | 139533204 | 139533200 | 139533205 | + |
| SEQ ID NO 12451 | GAGTCTTGGGGACTTTGTGTTT | CTA | chrX | 139533205 | 139533226 | 139533222 | 139533227 | + |
| SEQ ID NO 12452 | GGGGACTTTGTGTTTGATGTGA | CTT | chrX | 139533212 | 139533233 | 139533229 | 139533234 | + |
| SEQ ID NO 12453 | GGGACTTTGTGTTTGATGTGAT | TTG | chrX | 139533213 | 139533234 | 139533230 | 139533235 | + |
| SEQ ID NO 12454 | TGTGTTTGATGTGATTATGGAC | CTT | chrX | 139533220 | 139533241 | 139533237 | 139533242 | + |
| SEQ ID NO 12455 | GTGTTTGATGTGATTATGGACC | TTT | chrX | 139533221 | 139533242 | 139533238 | 139533243 | + |
| SEQ ID NO 12456 | TGTTTGATGTGATTATGGACCA | TTG | chrX | 139533222 | 139533243 | 139533239 | 139533244 | + |
| SEQ ID NO 12457 | GATGTGATTATGGACCACAGAA | TTT | chrX | 139533227 | 139533248 | 139533244 | 139533249 | + |
| SEQ ID NO 12458 | ATGTGATTATGGACCACAGAAT | TTG | chrX | 139533228 | 139533249 | 139533245 | 139533250 | + |
| SEQ ID NO 12459 | TGGACCACAGAATAATGTCTAA | TTA | chrX | 139533237 | 139533258 | 139533254 | 139533259 | + |
| SEQ ID NO 12460 | AGAGAACTGGCTCTTTAGTCTG | CTA | chrX | 139533258 | 139533279 | 139533275 | 139533280 | + |
| SEQ ID NO 12461 | GCTCTTTAGTCTGACTGCCAGA | CTG | chrX | 139533267 | 139533288 | 139533284 | 139533289 | + |
| SEQ ID NO 12462 | TTTAGTCTGACTGCCAGAGTCT | CTC | chrX | 139533271 | 139533292 | 139533288 | 139533293 | + |
| SEQ ID NO 12463 | TAGTCTGACTGCCAGAGTCTGA | CTT | chrX | 139533273 | 139533294 | 139533290 | 139533295 | + |
| SEQ ID NO 12464 | AGTCTGACTGCCAGAGTCTGAA | TTT | chrX | 139533274 | 139533295 | 139533291 | 139533296 | + |
| SEQ ID NO 12465 | GTCTGACTGCCAGAGTCTGAAT | TTA | chrX | 139533275 | 139533296 | 139533292 | 139533297 | + |
| SEQ ID NO 12466 | ACTGCCAGAGTCTGAATCCTGA | CTG | chrX | 139533280 | 139533301 | 139533297 | 139533302 | + |
| SEQ ID NO 12467 | CCAGAGTCTGAATCCTGAATGT | CTG | chrX | 139533284 | 139533305 | 139533301 | 139533306 | + |
| SEQ ID NO 12468 | AATCCTGAATGTTTTAGTATGT | CTG | chrX | 139533294 | 139533315 | 139533311 | 139533316 | + |
| SEQ ID NO 12469 | AATGTTTTAGTATGTTACCTTG | CTG | chrX | 139533301 | 139533322 | 139533318 | 139533323 | + |
| SEQ ID NO 12470 | TAGTATGTTACCTTGGGCAAAG | TTT | chrX | 139533308 | 139533329 | 139533325 | 139533330 | + |
| SEQ ID NO 12471 | AGTATGTTACCTTGGGCAAAGC | TTT | chrX | 139533309 | 139533330 | 139533326 | 139533331 | + |
| SEQ ID NO 12472 | GTATGTTACCTTGGGCAAAGCC | TTA | chrX | 139533310 | 139533331 | 139533327 | 139533332 | + |
| SEQ ID NO 12473 | CCTTGGGCAAAGCCCTTAGCCT | TTA | chrX | 139533318 | 139533339 | 139533335 | 139533340 | + |
| SEQ ID NO 12474 | GGGCAAAGCCCTTAGCCTCTAT | CTT | chrX | 139533322 | 139533343 | 139533339 | 139533344 | + |
| SEQ ID NO 12475 | GGCAAAGCCCTTAGCCTCTATG | TTG | chrX | 139533323 | 139533344 | 139533340 | 139533345 | + |
| SEQ ID NO 12476 | AGCCTCTATGAATCTATCTTCC | CTT | chrX | 139533335 | 139533356 | 139533352 | 139533357 | + |
| SEQ ID NO 12477 | GCCTCTATGAATCTATCTTCCT | TTA | chrX | 139533336 | 139533357 | 139533353 | 139533358 | + |
| SEQ ID NO 12478 | TATGAATCTATCTTCCTCATTC | CTC | chrX | 139533341 | 139533362 | 139533358 | 139533363 | + |
| SEQ ID NO 12479 | TGAATCTATCTTCCTCATTCAT | CTA | chrX | 139533343 | 139533364 | 139533360 | 139533365 | + |
| SEQ ID NO 12480 | TCTTCCTCATTCATAAAAATAA | CTA | chrX | 139533351 | 139533372 | 139533368 | 139533373 | + |
| SEQ ID NO 12481 | CCTCATTCATAAAAATAAGATG | CTT | chrX | 139533355 | 139533376 | 139533372 | 139533377 | + |
| SEQ ID NO 12482 | CTCATTCATAAAAATAAGATGA | TTC | chrX | 139533356 | 139533377 | 139533373 | 139533378 | + |
| SEQ ID NO 12483 | ATTCATAAAAATAAGATGACAG | CTC | chrX | 139533359 | 139533380 | 139533376 | 139533381 | + |
| SEQ ID NO 12484 | ATAAAAATAAGATGACAGTGCC | TTC | chrX | 139533363 | 139533384 | 139533380 | 139533385 | + |
| SEQ ID NO 12485 | TCTCGTGGGACTTTTGTGAGGA | CTA | chrX | 139533387 | 139533408 | 139533404 | 139533409 | + |
| SEQ ID NO 12486 | GTGGGACTTTTGTGAGGATGAA | CTC | chrX | 139533391 | 139533412 | 139533408 | 139533413 | + |
| SEQ ID NO 12487 | TTGTGAGGATGAAGTGAGATAA | CTT | chrX | 139533400 | 139533421 | 139533417 | 139533422 | + |
| SEQ ID NO 12488 | TGTGAGGATGAAGTGAGATAAT | TTT | chrX | 139533401 | 139533422 | 139533418 | 139533423 | + |
| SEQ ID NO 12489 | GTGAGGATGAAGTGAGATAATG | TTT | chrX | 139533402 | 139533423 | 139533419 | 139533424 | + |
| SEQ ID NO 12490 | TGAGGATGAAGTGAGATAATGG | TTG | chrX | 139533403 | 139533424 | 139533420 | 139533425 | + |
| SEQ ID NO 12491 | CTGAGCACAGTGTCCAACACAG | TTA | chrX | 139533436 | 139533457 | 139533453 | 139533458 | + |
| SEQ ID NO 12492 | AGCACAGTGTCCAACACAGCAG | CTG | chrX | 139533439 | 139533460 | 139533456 | 139533461 | + |
| SEQ ID NO 12493 | CATATACATTAGCTATTACTGG | TTA | chrX | 139533469 | 139533490 | 139533486 | 139533491 | + |
| SEQ ID NO 12494 | GCTATTACTGGCTACATTATGA | TTA | chrX | 139533480 | 139533501 | 139533497 | 139533502 | + |
| SEQ ID NO 12495 | TTACTGGCTACATTATGATATA | CTA | chrX | 139533484 | 139533505 | 139533501 | 139533506 | + |
| SEQ ID NO 12496 | CTGGCTACATTATGATATACAG | TTA | chrX | 139533487 | 139533508 | 139533504 | 139533509 | + |
| SEQ ID NO 12497 | GCTACATTATGATATACAGTTA | CTG | chrX | 139533490 | 139533511 | 139533507 | 139533512 | + |
| SEQ ID NO 12498 | CATTATGATATACAGTTAGGGA | CTA | chrX | 139533494 | 139533515 | 139533511 | 139533516 | + |
| SEQ ID NO 12499 | TGATATACAGTTAGGGAGTTGG | TTA | chrX | 139533499 | 139533520 | 139533516 | 139533521 | + |
| SEQ ID NO 12500 | GGGAGTTGGAAAGATAATCTGA | TTA | chrX | 139533512 | 139533533 | 139533529 | 139533534 | + |

Figure 42 (Cont'd)

| | | | | | | | | |
|---|---|---|---|---|---|---|---|---|
| SEQ ID NO 12501 | GAAAGATAATCTGAAATTCAGG | TTG | chrX | 139533520 | 139533541 | 139533537 | 139533542 | + |
| SEQ ID NO 12502 | AAATTCAGGAGACGTATCTGAC | CTG | chrX | 139533533 | 139533554 | 139533550 | 139533555 | + |
| SEQ ID NO 12503 | AGGAGACGTATCTGACTATAGG | TTC | chrX | 139533539 | 139533560 | 139533556 | 139533561 | + |
| SEQ ID NO 12504 | ACTATAGGTGAGTATTTGGAAC | CTG | chrX | 139533553 | 139533574 | 139533570 | 139533575 | + |
| SEQ ID NO 12505 | TAGGTGAGTATTTGGAACTCAT | CTA | chrX | 139533557 | 139533578 | 139533574 | 139533579 | + |
| SEQ ID NO 12506 | GGAACTCATTGTTCTGTAAACA | TTT | chrX | 139533570 | 139533591 | 139533587 | 139533592 | + |
| SEQ ID NO 12507 | GAACTCATTGTTCTGTAAACAG | TTG | chrX | 139533571 | 139533592 | 139533588 | 139533593 | + |
| SEQ ID NO 12508 | ATTGTTCTGTAAACAGTAGTTA | CTC | chrX | 139533577 | 139533598 | 139533594 | 139533599 | + |
| SEQ ID NO 12509 | TTCTGTAAACAGTAGTTACAGC | TTG | chrX | 139533581 | 139533602 | 139533598 | 139533603 | + |
| SEQ ID NO 12510 | TGTAAACAGTAGTTACAGCCAC | TTC | chrX | 139533584 | 139533605 | 139533601 | 139533606 | + |
| SEQ ID NO 12511 | TAAACAGTAGTTACAGCCACGT | CTG | chrX | 139533586 | 139533607 | 139533603 | 139533608 | + |
| SEQ ID NO 12512 | CAGCCACGTGTGTGGGCATCTG | TTA | chrX | 139533599 | 139533620 | 139533616 | 139533621 | + |
| SEQ ID NO 12513 | GAGAGTGAGCATGGATATTGTG | CTG | chrX | 139533621 | 139533642 | 139533638 | 139533643 | + |
| SEQ ID NO 12514 | TGATACCTAGTACAGTGCCTGG | TTG | chrX | 139533641 | 139533662 | 139533658 | 139533663 | + |
| SEQ ID NO 12515 | GTACAGTGCCTGGCAGTAGTGG | CTA | chrX | 139533650 | 139533671 | 139533667 | 139533672 | + |
| SEQ ID NO 12516 | GCAGTAGTGGTTGTATGCTCAG | CTG | chrX | 139533662 | 139533683 | 139533679 | 139533684 | + |
| SEQ ID NO 12517 | TATGCTCAGTAAATTTTGTTGA | TTG | chrX | 139533675 | 139533696 | 139533692 | 139533697 | + |
| SEQ ID NO 12518 | AGTAAATTTTGTTGACAGGGTC | CTC | chrX | 139533682 | 139533703 | 139533699 | 139533704 | + |
| SEQ ID NO 12519 | TGTTGACAGGGTCAGGGCCGGA | TTT | chrX | 139533691 | 139533712 | 139533708 | 139533713 | + |
| SEQ ID NO 12520 | GTTGACAGGGTCAGGGCCGGAC | TTT | chrX | 139533692 | 139533713 | 139533709 | 139533714 | + |
| SEQ ID NO 12521 | TTGACAGGGTCAGGGCCGGACT | TTG | chrX | 139533693 | 139533714 | 139533710 | 139533715 | + |
| SEQ ID NO 12522 | ACAGGGTCAGGGCCGGACTAGA | TTG | chrX | 139533696 | 139533717 | 139533713 | 139533718 | + |
| SEQ ID NO 12523 | GACTGTGGTAAGCAAGGCCTGT | CTA | chrX | 139533716 | 139533737 | 139533733 | 139533738 | + |
| SEQ ID NO 12524 | TGGTAAGCAAGGCCTGTAGGGC | CTG | chrX | 139533721 | 139533742 | 139533738 | 139533743 | + |
| SEQ ID NO 12525 | TAGGGCATAAATATACTTGTAT | CTG | chrX | 139533737 | 139533758 | 139533754 | 139533759 | + |
| SEQ ID NO 12526 | GTATGCCCCGAGAAGTGAGGAC | CTT | chrX | 139533755 | 139533776 | 139533772 | 139533777 | + |
| SEQ ID NO 12527 | TATGCCCCGAGAAGTGAGGACC | TTG | chrX | 139533756 | 139533777 | 139533773 | 139533778 | + |
| SEQ ID NO 12528 | TTAAATATTGTGCCCTACATGC | CTC | chrX | 139533780 | 139533801 | 139533797 | 139533802 | + |
| SEQ ID NO 12529 | AAATATTGTGCCCTACATGCCT | CTT | chrX | 139533782 | 139533803 | 139533799 | 139533804 | + |
| SEQ ID NO 12530 | AATATTGTGCCCTACATGCCTT | TTA | chrX | 139533783 | 139533804 | 139533800 | 139533805 | + |
| SEQ ID NO 12531 | TGCCCTACATGCCTTGTTTGGT | TTG | chrX | 139533790 | 139533811 | 139533807 | 139533812 | + |
| SEQ ID NO 12532 | CATGCCTTGTTTGGTTCACTCT | CTA | chrX | 139533797 | 139533818 | 139533814 | 139533819 | + |
| SEQ ID NO 12533 | GTTTGGTTCACTCTTGTCCCAG | CTT | chrX | 139533805 | 139533826 | 139533822 | 139533827 | + |
| SEQ ID NO 12534 | TTTGGTTCACTCTTGTCCCAGC | TTG | chrX | 139533806 | 139533827 | 139533823 | 139533828 | + |
| SEQ ID NO 12535 | GGTTCACTCTTGTCCCAGCCCT | TTT | chrX | 139533809 | 139533830 | 139533826 | 139533831 | + |
| SEQ ID NO 12536 | GTTCACTCTTGTCCCAGCCCTA | TTG | chrX | 139533810 | 139533831 | 139533827 | 139533832 | + |
| SEQ ID NO 12537 | ACTCTTGTCCCAGCCCTAGCAA | TTC | chrX | 139533814 | 139533835 | 139533831 | 139533836 | + |
| SEQ ID NO 12538 | TTGTCCCAGCCCTAGCAAGTAT | CTC | chrX | 139533818 | 139533839 | 139533835 | 139533840 | + |
| SEQ ID NO 12539 | GTCCCAGCCCTAGCAAGTATAT | CTT | chrX | 139533820 | 139533841 | 139533837 | 139533842 | + |
| SEQ ID NO 12540 | TCCCAGCCCTAGCAAGTATATA | TTG | chrX | 139533821 | 139533842 | 139533838 | 139533843 | + |
| SEQ ID NO 12541 | GCAAGTATATATAAGGTGAAAA | CTA | chrX | 139533832 | 139533853 | 139533849 | 139533854 | + |
| SEQ ID NO 12542 | AGGCTGGAGCCTGGGAGAACCC | CTG | chrX | 139533866 | 139533887 | 139533883 | 139533888 | + |
| SEQ ID NO 12543 | GAGCCTGGGAGAACCCTGGACA | CTG | chrX | 139533872 | 139533893 | 139533889 | 139533894 | + |
| SEQ ID NO 12544 | GGAGAACCCTGGACATTTAAGG | CTG | chrX | 139533879 | 139533900 | 139533896 | 139533901 | + |
| SEQ ID NO 12545 | GACATTTAAGGGCCATGGAGAG | CTG | chrX | 139533890 | 139533911 | 139533907 | 139533912 | + |
| SEQ ID NO 12546 | AAGGGCCATGGAGAGGAACAGG | TTT | chrX | 139533897 | 139533918 | 139533914 | 139533919 | + |
| SEQ ID NO 12547 | AGGGCCATGGAGAGGAACAGGA | TTA | chrX | 139533898 | 139533919 | 139533915 | 139533920 | + |
| SEQ ID NO 12548 | ATCAATTCAAGTGCTGGATGGA | TTA | chrX | 139533924 | 139533945 | 139533941 | 139533946 | + |
| SEQ ID NO 12549 | AAGTGCTGGATGGATAACAGGA | TTC | chrX | 139533932 | 139533953 | 139533949 | 139533954 | + |
| SEQ ID NO 12550 | GATGGATAACAGGAGTTAGAGC | CTG | chrX | 139533940 | 139533961 | 139533957 | 139533962 | + |
| SEQ ID NO 12551 | GAGCAAAGCGGGGAACCAGAAT | TTA | chrX | 139533958 | 139533979 | 139533975 | 139533980 | + |
| SEQ ID NO 12552 | TTATAAAAGAGTTTCCTAAAA | TTA | chrX | 139533990 | 139534011 | 139534007 | 139534012 | + |
| SEQ ID NO 12553 | TAAAAGAGTTTCCTAAAAAGG | TTA | chrX | 139533993 | 139534014 | 139534010 | 139534015 | + |
| SEQ ID NO 12554 | CCTAAAAGGGAGAGATCAACA | TTT | chrX | 139534005 | 139534026 | 139534022 | 139534027 | + |
| SEQ ID NO 12555 | CTAAAAGGGAGAGATCAACAA | TTC | chrX | 139534006 | 139534027 | 139534023 | 139534028 | + |
| SEQ ID NO 12556 | AAAAGGGAGAGATCAACAATTA | CTA | chrX | 139534009 | 139534030 | 139534026 | 139534031 | + |
| SEQ ID NO 12557 | GAAATTATTTAGAGCAGCCAGT | TTA | chrX | 139534031 | 139534052 | 139534048 | 139534053 | + |
| SEQ ID NO 12558 | TTTAGAGCAGCCAGTAAATACA | TTA | chrX | 139534038 | 139534059 | 139534055 | 139534060 | + |
| SEQ ID NO 12559 | AGAGCAGCCAGTAAATACATAA | TTT | chrX | 139534041 | 139534062 | 139534058 | 139534063 | + |

Figure 42 (Cont'd)

| | | | | | | | | |
|---|---|---|---|---|---|---|---|---|
| SEQ ID NO 12560 | GAGCAGCCAGTAAATACATAAA | TTA | chrX | 139534042 | 139534063 | 139534059 | 139534064 | + |
| SEQ ID NO 12561 | AAAATTATTCTTTAGGTCATTC | CTC | chrX | 139534067 | 139534088 | 139534084 | 139534089 | + |
| SEQ ID NO 12562 | TTCTTTAGGTCATTCCTGATTG | TTA | chrX | 139534074 | 139534095 | 139534091 | 139534096 | + |
| SEQ ID NO 12563 | TTTAGGTCATTCCTGATTGTGA | TTC | chrX | 139534077 | 139534098 | 139534094 | 139534099 | + |
| SEQ ID NO 12564 | TAGGTCATTCCTGATTGTGACA | CTT | chrX | 139534079 | 139534100 | 139534096 | 139534101 | + |
| SEQ ID NO 12565 | AGGTCATTCCTGATTGTGACAA | TTT | chrX | 139534080 | 139534101 | 139534097 | 139534102 | + |
| SEQ ID NO 12566 | GGTCATTCCTGATTGTGACAAT | TTA | chrX | 139534081 | 139534102 | 139534098 | 139534103 | + |
| SEQ ID NO 12567 | CTGATTGTGACAATAGTCATTT | TTC | chrX | 139534089 | 139534110 | 139534106 | 139534111 | + |
| SEQ ID NO 12568 | ATTGTGACAATAGTCATTTCAT | CTG | chrX | 139534092 | 139534113 | 139534109 | 139534114 | + |
| SEQ ID NO 12569 | TGACAATAGTCATTTCATTATA | TTG | chrX | 139534096 | 139534117 | 139534113 | 139534118 | + |
| SEQ ID NO 12570 | CATTATATAAATGTGATTAAGG | TTT | chrX | 139534111 | 139534132 | 139534128 | 139534133 | + |
| SEQ ID NO 12571 | ATTATATAAATGTGATTAAGGA | TTC | chrX | 139534112 | 139534133 | 139534129 | 139534134 | + |
| SEQ ID NO 12572 | TATAAATGTGATTAAGGAAGGA | TTA | chrX | 139534116 | 139534137 | 139534133 | 139534138 | + |
| SEQ ID NO 12573 | AGGAAGGAAAAGAGCTACACAG | TTA | chrX | 139534130 | 139534151 | 139534147 | 139534152 | + |
| SEQ ID NO 12574 | CACAGAAGTTATTAAAGAGCTA | CTA | chrX | 139534147 | 139534168 | 139534164 | 139534169 | + |
| SEQ ID NO 12575 | TTAAAGAGCTAAAGAGAATTGA | TTA | chrX | 139534158 | 139534179 | 139534175 | 139534180 | + |
| SEQ ID NO 12576 | AAGAGCTAAAGAGAATTGAGAA | TTA | chrX | 139534161 | 139534182 | 139534178 | 139534183 | + |
| SEQ ID NO 12577 | AAGAGAATTGAGAAATTTAAAA | CTA | chrX | 139534169 | 139534190 | 139534186 | 139534191 | + |
| SEQ ID NO 12578 | AGAAATTTAAAACAGAAGAAAG | TTG | chrX | 139534179 | 139534200 | 139534196 | 139534201 | + |
| SEQ ID NO 12579 | AAAACAGAAGAAAGTAGGGCCA | TTT | chrX | 139534187 | 139534208 | 139534204 | 139534209 | + |
| SEQ ID NO 12580 | AAACAGAAGAAAGTAGGGCCAA | TTA | chrX | 139534188 | 139534209 | 139534205 | 139534210 | + |
| SEQ ID NO 12581 | TCTCACTGATCCTGCCAACACC | TTG | chrX | 139534251 | 139534272 | 139534268 | 139534273 | + |
| SEQ ID NO 12582 | ACTGATCCTGCCAACACCTGTG | CTC | chrX | 139534255 | 139534276 | 139534272 | 139534277 | + |
| SEQ ID NO 12583 | ATCCTGCCAACACCTGTGAGAT | CTG | chrX | 139534259 | 139534280 | 139534276 | 139534281 | + |
| SEQ ID NO 12584 | CCAACACCTGTGAGATAGATAT | CTG | chrX | 139534265 | 139534286 | 139534282 | 139534287 | + |
| SEQ ID NO 12585 | TGAGATAGATATTCTTATTATA | CTG | chrX | 139534275 | 139534296 | 139534292 | 139534297 | + |
| SEQ ID NO 12586 | TTATTATACTACTGTTAAACCT | TTC | chrX | 139534289 | 139534310 | 139534306 | 139534311 | + |
| SEQ ID NO 12587 | ATTATACTACTGTTAAACCTAA | CTT | chrX | 139534291 | 139534312 | 139534308 | 139534313 | + |
| SEQ ID NO 12588 | TTATACTACTGTTAAACCTAAT | TTA | chrX | 139534292 | 139534313 | 139534309 | 139534314 | + |
| SEQ ID NO 12589 | TACTACTGTTAAACCTAATTTA | TTA | chrX | 139534295 | 139534316 | 139534312 | 139534317 | + |
| SEQ ID NO 12590 | CTGTTAAACCTAATTTACATTT | CTA | chrX | 139534300 | 139534321 | 139534317 | 139534322 | + |
| SEQ ID NO 12591 | TTAAACCTAATTTACATTTGAC | CTG | chrX | 139534303 | 139534324 | 139534320 | 139534325 | + |
| SEQ ID NO 12592 | AACCTAATTTACATTTGACAAA | TTA | chrX | 139534306 | 139534327 | 139534323 | 139534328 | + |
| SEQ ID NO 12593 | ATTTACATTTGACAAAGTTAAG | CTA | chrX | 139534312 | 139534333 | 139534329 | 139534334 | + |
| SEQ ID NO 12594 | ACATTTGACAAAGTTAAGGTTC | TTT | chrX | 139534316 | 139534337 | 139534333 | 139534338 | + |
| SEQ ID NO 12595 | CATTTGACAAAGTTAAGGTTCA | TTA | chrX | 139534317 | 139534338 | 139534334 | 139534339 | + |
| SEQ ID NO 12596 | GACAAAGTTAAGGTTCAGAGCT | TTT | chrX | 139534322 | 139534343 | 139534339 | 139534344 | + |
| SEQ ID NO 12597 | ACAAAGTTAAGGTTCAGAGCTT | TTG | chrX | 139534323 | 139534344 | 139534340 | 139534345 | + |
| SEQ ID NO 12598 | AGGTTCAGAGCTTGTGTGACTT | TTA | chrX | 139534332 | 139534353 | 139534349 | 139534354 | + |
| SEQ ID NO 12599 | AGAGCTTGTGTGACTTGTCCAA | TTC | chrX | 139534338 | 139534359 | 139534355 | 139534360 | + |
| SEQ ID NO 12600 | GTGTGACTTGTCCAAGGTCACA | CTT | chrX | 139534345 | 139534366 | 139534362 | 139534367 | + |
| SEQ ID NO 12601 | TGTGACTTGTCCAAGGTCACAG | TTG | chrX | 139534346 | 139534367 | 139534363 | 139534368 | + |
| SEQ ID NO 12602 | GTCCAAGGTCACAGGTCTAGAG | CTT | chrX | 139534354 | 139534375 | 139534371 | 139534376 | + |
| SEQ ID NO 12603 | TCCAAGGTCACAGGTCTAGAGG | TTG | chrX | 139534355 | 139534376 | 139534372 | 139534377 | + |
| SEQ ID NO 12604 | GAGGAGGCAGATACTTGATTCA | CTA | chrX | 139534373 | 139534394 | 139534390 | 139534395 | + |
| SEQ ID NO 12605 | GATTCAAACCTATTTCTGTCTG | CTT | chrX | 139534389 | 139534410 | 139534406 | 139534411 | + |
| SEQ ID NO 12606 | ATTCAAACCTATTTCTGTCTGA | TTG | chrX | 139534390 | 139534411 | 139534407 | 139534412 | + |
| SEQ ID NO 12607 | AAACCTATTTCTGTCTGATCTG | TTC | chrX | 139534394 | 139534415 | 139534411 | 139534416 | + |
| SEQ ID NO 12608 | TTTCTGTCTGATCTGATTCTAA | CTA | chrX | 139534401 | 139534422 | 139534418 | 139534423 | + |
| SEQ ID NO 12609 | CTGTCTGATCTGATTCTAAAGT | TTT | chrX | 139534404 | 139534425 | 139534421 | 139534426 | + |
| SEQ ID NO 12610 | TGTCTGATCTGATTCTAAAGTC | TTC | chrX | 139534405 | 139534426 | 139534422 | 139534427 | + |
| SEQ ID NO 12611 | TCTGATCTGATTCTAAAGTCTG | CTG | chrX | 139534407 | 139534428 | 139534424 | 139534429 | + |
| SEQ ID NO 12612 | ATCTGATTCTAAAGTCTGTTTT | CTG | chrX | 139534411 | 139534432 | 139534428 | 139534433 | + |
| SEQ ID NO 12613 | ATTCTAAAGTCTGTTTTTTCAC | CTG | chrX | 139534416 | 139534437 | 139534433 | 139534438 | + |
| SEQ ID NO 12614 | TAAAGTCTGTTTTTTCACTCAA | TTC | chrX | 139534420 | 139534441 | 139534437 | 139534442 | + |
| SEQ ID NO 12615 | AAGTCTGTTTTTTCACTCAACC | CTA | chrX | 139534422 | 139534443 | 139534439 | 139534444 | + |
| SEQ ID NO 12616 | TTTTTTCACTCAACCACACTGT | CTG | chrX | 139534429 | 139534450 | 139534446 | 139534451 | + |
| SEQ ID NO 12617 | TTTCACTCAACCACACTGTACA | TTT | chrX | 139534432 | 139534453 | 139534449 | 139534454 | + |
| SEQ ID NO 12618 | TTCACTCAACCACACTGTACAG | TTT | chrX | 139534433 | 139534454 | 139534450 | 139534455 | + |

Figure 42 (Cont'd)

| SEQ ID NO 12619 | TCACTCAACCACACTGTACAGT | TTT | chrX | 139534434 | 139534455 | 139534451 | 139534456 | + |
|---|---|---|---|---|---|---|---|---|
| SEQ ID NO 12620 | CACTCAACCACACTGTACAGTC | TTT | chrX | 139534435 | 139534456 | 139534452 | 139534457 | + |
| SEQ ID NO 12621 | ACTCAACCACACTGTACAGTCA | TTC | chrX | 139534436 | 139534457 | 139534453 | 139534458 | + |
| SEQ ID NO 12622 | AACCACACTGTACAGTCAGCTC | CTC | chrX | 139534440 | 139534461 | 139534457 | 139534462 | + |
| SEQ ID NO 12623 | TACAGTCAGCTCTCCTTGTGAG | CTG | chrX | 139534450 | 139534471 | 139534467 | 139534472 | + |
| SEQ ID NO 12624 | TCCTTGTGAGTTCCACAGCCAC | CTC | chrX | 139534462 | 139534483 | 139534479 | 139534484 | + |
| SEQ ID NO 12625 | CTTGTGAGTTCCACAGCCACAG | CTC | chrX | 139534464 | 139534485 | 139534481 | 139534486 | + |
| SEQ ID NO 12626 | GTGAGTTCCACAGCCACAGATT | CTT | chrX | 139534467 | 139534488 | 139534484 | 139534489 | + |
| SEQ ID NO 12627 | TGAGTTCCACAGCCACAGATTC | TTG | chrX | 139534468 | 139534489 | 139534485 | 139534490 | + |
| SEQ ID NO 12628 | CACAGCCACAGATTCAATTAAC | TTC | chrX | 139534475 | 139534496 | 139534492 | 139534497 | + |
| SEQ ID NO 12629 | AATTAACTGCAGATCAAAAATA | TTC | chrX | 139534490 | 139534511 | 139534507 | 139534512 | + |
| SEQ ID NO 12630 | ACTGCAGATCAAAAATATTCAA | TTA | chrX | 139534495 | 139534516 | 139534512 | 139534517 | + |
| SEQ ID NO 12631 | CAGATCAAAAATATTCAAGAAA | CTG | chrX | 139534499 | 139534520 | 139534516 | 139534521 | + |
| SEQ ID NO 12632 | AAGAAAAAAATGGATGGTTGCA | TTC | chrX | 139534515 | 139534536 | 139534532 | 139534537 | + |
| SEQ ID NO 12633 | CATCTCTACTGAACATGTACAG | TTG | chrX | 139534535 | 139534556 | 139534552 | 139534557 | + |
| SEQ ID NO 12634 | TACTGAACATGTACAGACTCTT | CTC | chrX | 139534541 | 139534562 | 139534558 | 139534563 | + |
| SEQ ID NO 12635 | CTGAACATGTACAGACTCTTTT | CTA | chrX | 139534543 | 139534564 | 139534560 | 139534565 | + |
| SEQ ID NO 12636 | AACATGTACAGACTCTTTTATC | CTG | chrX | 139534546 | 139534567 | 139534563 | 139534568 | + |
| SEQ ID NO 12637 | TTTTATCTTTCATTATTCCCTA | CTC | chrX | 139534561 | 139534582 | 139534578 | 139534583 | + |
| SEQ ID NO 12638 | TTATCTTTCATTATTCCCTAAA | CTT | chrX | 139534563 | 139534584 | 139534580 | 139534585 | + |
| SEQ ID NO 12639 | TATCTTTCATTATTCCCTAAAC | TTT | chrX | 139534564 | 139534585 | 139534581 | 139534586 | + |
| SEQ ID NO 12640 | ATCTTTCATTATTCCCTAAACA | TTT | chrX | 139534565 | 139534586 | 139534582 | 139534587 | + |
| SEQ ID NO 12641 | TCTTTCATTATTCCCTAAACAA | TTA | chrX | 139534566 | 139534587 | 139534583 | 139534588 | + |
| SEQ ID NO 12642 | TCATTATTCCCTAAACAATACA | CTT | chrX | 139534570 | 139534591 | 139534587 | 139534592 | + |
| SEQ ID NO 12643 | CATTATTCCCTAAACAATACAG | TTT | chrX | 139534571 | 139534592 | 139534588 | 139534593 | + |
| SEQ ID NO 12644 | ATTATTCCCTAAACAATACAGC | TTC | chrX | 139534572 | 139534593 | 139534589 | 139534594 | + |
| SEQ ID NO 12645 | TTCCCTAAACAATACAGCATAA | TTA | chrX | 139534576 | 139534597 | 139534593 | 139534598 | + |
| SEQ ID NO 12646 | CCTAAACAATACAGCATAACAA | TTC | chrX | 139534579 | 139534600 | 139534596 | 139534601 | + |
| SEQ ID NO 12647 | AACAATACAGCATAACAACTAT | CTA | chrX | 139534583 | 139534604 | 139534600 | 139534605 | + |
| SEQ ID NO 12648 | TTTACATAGCATTTACATTGTA | CTA | chrX | 139534604 | 139534625 | 139534621 | 139534626 | + |
| SEQ ID NO 12649 | ACATAGCATTTACATTGTATTA | TTT | chrX | 139534607 | 139534628 | 139534624 | 139534629 | + |
| SEQ ID NO 12650 | CATAGCATTTACATTGTATTAG | TTA | chrX | 139534608 | 139534629 | 139534625 | 139534630 | + |
| SEQ ID NO 12651 | ACATTGTATTAGCTATTAAGAG | TTT | chrX | 139534618 | 139534639 | 139534635 | 139534640 | + |
| SEQ ID NO 12652 | CATTGTATTAGCTATTAAGAGA | TTA | chrX | 139534619 | 139534640 | 139534636 | 139534641 | + |
| SEQ ID NO 12653 | TATTAGCTATTAAGAGAAACCT | TTG | chrX | 139534624 | 139534645 | 139534641 | 139534646 | + |
| SEQ ID NO 12654 | GCTATTAAGAGAAACCTAGAGA | TTA | chrX | 139534629 | 139534650 | 139534646 | 139534651 | + |
| SEQ ID NO 12655 | TTAAGAGAAACCTAGAGATGAT | CTA | chrX | 139534633 | 139534654 | 139534650 | 139534655 | + |
| SEQ ID NO 12656 | AGAGAAACCTAGAGATGATTTA | TTA | chrX | 139534636 | 139534657 | 139534653 | 139534658 | + |
| SEQ ID NO 12657 | GAGATGATTTAAAGTACAAAGG | CTA | chrX | 139534647 | 139534668 | 139534664 | 139534669 | + |
| SEQ ID NO 12658 | AAAGTACAAAGGAGGATGTGTT | TTT | chrX | 139534657 | 139534678 | 139534674 | 139534679 | + |
| SEQ ID NO 12659 | AAGTACAAAGGAGGATGTGTTT | TTA | chrX | 139534658 | 139534679 | 139534675 | 139534680 | + |
| SEQ ID NO 12660 | AGGTTATATGCAAATAGTAAGC | TTT | chrX | 139534680 | 139534701 | 139534697 | 139534702 | + |
| SEQ ID NO 12661 | GGTTATATGCAAATAGTAAGCC | TTA | chrX | 139534681 | 139534702 | 139534698 | 139534703 | + |
| SEQ ID NO 12662 | TATGCAAATAGTAAGCCATTTT | TTA | chrX | 139534686 | 139534707 | 139534703 | 139534708 | + |
| SEQ ID NO 12663 | TTATATCGGAGACTTGAGCATC | TTT | chrX | 139534707 | 139534728 | 139534724 | 139534729 | + |
| SEQ ID NO 12664 | TATATCGGAGACTTGAGCATCC | TTT | chrX | 139534708 | 139534729 | 139534725 | 139534730 | + |
| SEQ ID NO 12665 | ATATCGGAGACTTGAGCATCCA | TTT | chrX | 139534709 | 139534730 | 139534726 | 139534731 | + |
| SEQ ID NO 12666 | TATCGGAGACTTGAGCATCCAC | TTA | chrX | 139534710 | 139534731 | 139534727 | 139534732 | + |
| SEQ ID NO 12667 | GAGCATCCACAGATCTTGATAT | CTT | chrX | 139534722 | 139534743 | 139534739 | 139534744 | + |
| SEQ ID NO 12668 | AGCATCCACAGATCTTGATATT | TTG | chrX | 139534723 | 139534744 | 139534740 | 139534745 | + |
| SEQ ID NO 12669 | GATATTTGCAGGGGGTCTTGCC | CTT | chrX | 139534739 | 139534760 | 139534756 | 139534761 | + |
| SEQ ID NO 12670 | ATATTTGCAGGGGGTCTTGCCA | TTG | chrX | 139534740 | 139534761 | 139534757 | 139534762 | + |
| SEQ ID NO 12671 | GCAGGGGGTCTTGCCACCAATT | TTT | chrX | 139534746 | 139534767 | 139534763 | 139534768 | + |
| SEQ ID NO 12672 | CAGGGGGTCTTGCCACCAATTT | TTG | chrX | 139534747 | 139534768 | 139534764 | 139534769 | + |
| SEQ ID NO 12673 | GCCACCAATTTTCCATGGATAC | CTT | chrX | 139534758 | 139534779 | 139534775 | 139534780 | + |
| SEQ ID NO 12674 | CCACCAATTTTCCATGGATACT | TTG | chrX | 139534759 | 139534780 | 139534776 | 139534781 | + |
| SEQ ID NO 12675 | TCCATGGATACTGAGGAACGAC | TTT | chrX | 139534769 | 139534790 | 139534786 | 139534791 | + |
| SEQ ID NO 12676 | CCATGGATACTGAGGAACGACT | TTT | chrX | 139534770 | 139534791 | 139534787 | 139534792 | + |
| SEQ ID NO 12677 | CATGGATACTGAGGAACGACTG | TTC | chrX | 139534771 | 139534792 | 139534788 | 139534793 | + |

Figure 42 (Cont'd)

| | | | | | | | | |
|---|---|---|---|---|---|---|---|---|
| SEQ ID NO 12678 | AGGAACGACTGTAAATGGATGC | CTG | chrX | 139534782 | 139534803 | 139534799 | 139534804 | + |
| SEQ ID NO 12679 | TAAATGGATGCAGGCATGGATG | CTG | chrX | 139534793 | 139534814 | 139534810 | 139534815 | + |
| SEQ ID NO 12680 | TTTAGGAGTGTCCAGGGCCAAG | CTA | chrX | 139534818 | 139534839 | 139534835 | 139534840 | + |
| SEQ ID NO 12681 | AGGAGTGTCCAGGGCCAAGTAA | TTT | chrX | 139534821 | 139534842 | 139534838 | 139534843 | + |
| SEQ ID NO 12682 | GGAGTGTCCAGGGCCAAGTAAA | TTA | chrX | 139534822 | 139534843 | 139534839 | 139534844 | + |
| SEQ ID NO 12683 | CTGAGCAGAGAGGTGGGTGGAG | TTG | chrX | 139534851 | 139534872 | 139534868 | 139534873 | + |
| SEQ ID NO 12684 | AGCAGAGAGGTGGGTGGAGGCT | CTG | chrX | 139534854 | 139534875 | 139534871 | 139534876 | + |
| SEQ ID NO 12685 | TGAGGCATCAATATGTGGTGGC | CTG | chrX | 139534877 | 139534898 | 139534894 | 139534899 | + |
| SEQ ID NO 12686 | CATTTTGGTGATTTTTTCCTT | CTG | chrX | 139534908 | 139534929 | 139534925 | 139534930 | + |
| SEQ ID NO 12687 | TGGTGATTTTTTCCTTCACAG | TTT | chrX | 139534913 | 139534934 | 139534930 | 139534935 | + |
| SEQ ID NO 12688 | GGTGATTTTTTCCTTCACAGT | TTT | chrX | 139534914 | 139534935 | 139534931 | 139534936 | + |
| SEQ ID NO 12689 | GTGATTTTTTCCTTCACAGTC | TTG | chrX | 139534915 | 139534936 | 139534932 | 139534937 | + |
| SEQ ID NO 12690 | TTTTCCTTCACAGTCCTCGGCT | TTT | chrX | 139534922 | 139534943 | 139534939 | 139534944 | + |
| SEQ ID NO 12691 | TTTCCTTCACAGTCCTCGGCTG | TTT | chrX | 139534923 | 139534944 | 139534940 | 139534945 | + |
| SEQ ID NO 12692 | TTCCTTCACAGTCCTCGGCTGT | TTT | chrX | 139534924 | 139534945 | 139534941 | 139534946 | + |
| SEQ ID NO 12693 | TCCTTCACAGTCCTCGGCTGTC | TTT | chrX | 139534925 | 139534946 | 139534942 | 139534947 | + |
| SEQ ID NO 12694 | CCTTCACAGTCCTCGGCTGTCT | TTT | chrX | 139534926 | 139534947 | 139534943 | 139534948 | + |
| SEQ ID NO 12695 | CTTCACAGTCCTCGGCTGTCTG | TTC | chrX | 139534927 | 139534948 | 139534944 | 139534949 | + |
| SEQ ID NO 12696 | CACAGTCCTCGGCTGTCTGGGA | CTT | chrX | 139534930 | 139534951 | 139534947 | 139534952 | + |
| SEQ ID NO 12697 | ACAGTCCTCGGCTGTCTGGGAA | TTC | chrX | 139534931 | 139534952 | 139534948 | 139534953 | + |
| SEQ ID NO 12698 | GGCTGTCTGGGAAGAGAAGGAT | CTC | chrX | 139534940 | 139534961 | 139534957 | 139534962 | + |
| SEQ ID NO 12699 | TCTGGGAAGAGAAGGATGAAGG | CTG | chrX | 139534945 | 139534966 | 139534962 | 139534967 | + |
| SEQ ID NO 12700 | GGAAGAGAAGGATGAAGGCAGA | CTG | chrX | 139534949 | 139534970 | 139534966 | 139534971 | + |
| SEQ ID NO 12701 | CTCCAATTTAGGGGCTAGGATT | CTG | chrX | 139534977 | 139534998 | 139534994 | 139534999 | + |
| SEQ ID NO 12702 | CAATTTAGGGGCTAGGATTGCA | CTC | chrX | 139534980 | 139535001 | 139534997 | 139535002 | + |
| SEQ ID NO 12703 | AGGGGCTAGGATTGCAGGGTGG | TTT | chrX | 139534986 | 139535007 | 139535003 | 139535008 | + |
| SEQ ID NO 12704 | GGGGCTAGGATTGCAGGGTGGG | TTA | chrX | 139534987 | 139535008 | 139535004 | 139535009 | + |
| SEQ ID NO 12705 | GGATTGCAGGGTGGGCACAGCA | CTA | chrX | 139534994 | 139535015 | 139535011 | 139535016 | + |
| SEQ ID NO 12706 | CAGGGTGGGCACAGCATTGCAA | TTG | chrX | 139535000 | 139535021 | 139535017 | 139535022 | + |
| SEQ ID NO 12707 | CAAACGAGTGAAGGAAATTGAG | TTG | chrX | 139535019 | 139535040 | 139535036 | 139535041 | + |
| SEQ ID NO 12708 | AGAAATATGGCCAATGAAGAGT | TTG | chrX | 139535039 | 139535060 | 139535056 | 139535061 | + |
| SEQ ID NO 12709 | AAGAGAGGCCTGGCATGGTGGC | TTG | chrX | 139535063 | 139535084 | 139535080 | 139535085 | + |
| SEQ ID NO 12710 | GCATGGTGGCTCACACCTATAA | CTG | chrX | 139535075 | 139535096 | 139535092 | 139535097 | + |
| SEQ ID NO 12711 | ACACCTATAATCCCAGCACTTT | CTC | chrX | 139535087 | 139535108 | 139535104 | 139535109 | + |
| SEQ ID NO 12712 | TAATCCCAGCACTTTCAGAGGC | CTA | chrX | 139535094 | 139535115 | 139535111 | 139535116 | + |
| SEQ ID NO 12713 | TCAGAGGCCCAGGCAGGCAGAT | CTT | chrX | 139535108 | 139535129 | 139535125 | 139535130 | + |
| SEQ ID NO 12714 | CAGAGGCCCAGGCAGGCAGATC | TTT | chrX | 139535109 | 139535130 | 139535126 | 139535131 | + |
| SEQ ID NO 12715 | AGAGGCCCAGGCAGGCAGATCA | TTC | chrX | 139535110 | 139535131 | 139535127 | 139535132 | + |
| SEQ ID NO 12716 | GAGGTCAGGAGTTCGACACCAG | CTT | chrX | 139535135 | 139535156 | 139535152 | 139535157 | + |
| SEQ ID NO 12717 | AGGTCAGGAGTTCGACACCAGC | TTG | chrX | 139535136 | 139535157 | 139535153 | 139535158 | + |
| SEQ ID NO 12718 | GACACCAGCCTGGCCAACAAGG | TTC | chrX | 139535149 | 139535170 | 139535166 | 139535171 | + |
| SEQ ID NO 12719 | GCCAACAAGGTGAAATGGTGAA | CTG | chrX | 139535161 | 139535182 | 139535178 | 139535183 | + |
| SEQ ID NO 12720 | TACTAAAAATACAAAAATTAGC | CTT | chrX | 139535193 | 139535214 | 139535210 | 139535215 | + |
| SEQ ID NO 12721 | ACTAAAAATACAAAAATTAGCT | TTT | chrX | 139535194 | 139535215 | 139535211 | 139535216 | + |
| SEQ ID NO 12722 | CTAAAAATACAAAAATTAGCTG | TTA | chrX | 139535195 | 139535216 | 139535212 | 139535217 | + |
| SEQ ID NO 12723 | AAAATACAAAAATTAGCTGGGC | CTA | chrX | 139535198 | 139535219 | 139535215 | 139535220 | + |
| SEQ ID NO 12724 | GCTGGGCATGGTGGCGGGTGCC | TTA | chrX | 139535213 | 139535234 | 139535230 | 139535235 | + |
| SEQ ID NO 12725 | GGCATGGTGGCGGGTGCCTGTA | CTG | chrX | 139535217 | 139535238 | 139535234 | 139535239 | + |
| SEQ ID NO 12726 | TAATCCCAGCTACTTGGGAGGC | CTG | chrX | 139535237 | 139535258 | 139535254 | 139535259 | + |
| SEQ ID NO 12727 | CTTGGGAGGCTGAGGCAGGAGA | CTA | chrX | 139535249 | 139535270 | 139535266 | 139535271 | + |
| SEQ ID NO 12728 | GGGAGGCTGAGGCAGGAGAATA | CTT | chrX | 139535252 | 139535273 | 139535269 | 139535274 | + |
| SEQ ID NO 12729 | GGAGGCTGAGGCAGGAGAATAG | TTG | chrX | 139535253 | 139535274 | 139535270 | 139535275 | + |
| SEQ ID NO 12730 | AGGCAGGAGAATAGCTTGAACC | CTG | chrX | 139535261 | 139535282 | 139535278 | 139535283 | + |
| SEQ ID NO 12731 | GAACCTGGGAGATGGAGGTTGC | CTT | chrX | 139535278 | 139535299 | 139535295 | 139535300 | + |
| SEQ ID NO 12732 | AACCTGGGAGATGGAGGTTGCA | TTG | chrX | 139535279 | 139535300 | 139535296 | 139535301 | + |
| SEQ ID NO 12733 | GGAGATGGAGGTTGCAGTGAGC | CTG | chrX | 139535285 | 139535306 | 139535302 | 139535307 | + |
| SEQ ID NO 12734 | CAGTGAGCTGAGATCGCACCAC | TTG | chrX | 139535299 | 139535320 | 139535316 | 139535321 | + |
| SEQ ID NO 12735 | AGATCGCACCACTGCACTCCAG | CTG | chrX | 139535309 | 139535330 | 139535326 | 139535331 | + |
| SEQ ID NO 12736 | CACTCCAGCCTGGGCGACAGAG | CTG | chrX | 139535323 | 139535344 | 139535340 | 139535345 | + |

Figure 42 (Cont'd)

| | | | | | | | | |
|---|---|---|---|---|---|---|---|---|
| SEQ ID NO 12737 | CAGCCTGGGCGACAGAGCAAGA | CTC | chrX | 139535328 | 139535349 | 139535345 | 139535350 | + |
| SEQ ID NO 12738 | GGCGACAGAGCAAGACTCTGTC | CTG | chrX | 139535335 | 139535356 | 139535352 | 139535357 | + |
| SEQ ID NO 12739 | TGTCAAAAAAAAAAGAGTTGAA | CTC | chrX | 139535353 | 139535374 | 139535370 | 139535375 | + |
| SEQ ID NO 12740 | TCAAAAAAAAAAGAGTTGAAGA | CTG | chrX | 139535355 | 139535376 | 139535372 | 139535377 | + |
| SEQ ID NO 12741 | AAGAGAAAAAGTCTAGGCTAAA | TTG | chrX | 139535373 | 139535394 | 139535390 | 139535395 | + |
| SEQ ID NO 12742 | GGCTAAATTCAAAGAAAAAAAG | CTA | chrX | 139535388 | 139535409 | 139535405 | 139535410 | + |
| SEQ ID NO 12743 | AATTCAAAGAAAAAAGTGAGC | CTA | chrX | 139535393 | 139535414 | 139535410 | 139535415 | + |
| SEQ ID NO 12744 | AAAGAAAAAAGTGAGCCCAAA | TTC | chrX | 139535398 | 139535419 | 139535415 | 139535420 | + |
| SEQ ID NO 12745 | GCAGAGCAAGGGAAAAGCAGGG | CTT | chrX | 139535428 | 139535449 | 139535445 | 139535450 | + |
| SEQ ID NO 12746 | CAGAGCAAGGGAAAAGCAGGGA | TTG | chrX | 139535429 | 139535450 | 139535446 | 139535451 | + |
| SEQ ID NO 12747 | GAACACTCCATAAAGTGAACAG | CTA | chrX | 139535464 | 139535485 | 139535481 | 139535486 | + |
| SEQ ID NO 12748 | CATAAAGTGAACAGCTGCAATG | CTC | chrX | 139535472 | 139535493 | 139535489 | 139535494 | + |
| SEQ ID NO 12749 | CAATGAAAATAAGGGAAGAAAG | CTG | chrX | 139535489 | 139535510 | 139535506 | 139535511 | + |
| SEQ ID NO 12750 | AGTTCATCTCCGTTTCTTTCCT | TTT | chrX | 139535514 | 139535535 | 139535531 | 139535536 | + |
| SEQ ID NO 12751 | GTTCATCTCCGTTTCTTTCCTT | TTA | chrX | 139535515 | 139535536 | 139535532 | 139535537 | + |
| SEQ ID NO 12752 | ATCTCCGTTTCTTTCCTTTCCT | TTC | chrX | 139535519 | 139535540 | 139535536 | 139535541 | + |
| SEQ ID NO 12753 | CGTTTCTTTCCTTTCCTTTTTA | CTC | chrX | 139535524 | 139535545 | 139535541 | 139535546 | + |
| SEQ ID NO 12754 | CTTTCCTTTCCTTTTTACTTTC | TTT | chrX | 139535529 | 139535550 | 139535546 | 139535551 | + |
| SEQ ID NO 12755 | TTTCCTTTCCTTTTTACTTTCC | TTC | chrX | 139535530 | 139535551 | 139535547 | 139535552 | + |
| SEQ ID NO 12756 | TCCTTTCCTTTTTACTTTCCTT | CTT | chrX | 139535532 | 139535553 | 139535549 | 139535554 | + |
| SEQ ID NO 12757 | CCTTTCCTTTTTACTTTCCTTT | TTT | chrX | 139535533 | 139535554 | 139535550 | 139535555 | + |
| SEQ ID NO 12758 | CTTTCCTTTTTACTTTCCTTTC | TTC | chrX | 139535534 | 139535555 | 139535551 | 139535556 | + |
| SEQ ID NO 12759 | TCCTTTTTACTTTCCTTTCTCT | CTT | chrX | 139535537 | 139535558 | 139535554 | 139535559 | + |
| SEQ ID NO 12760 | CCTTTTTACTTTCCTTTCTCTT | TTT | chrX | 139535538 | 139535559 | 139535555 | 139535560 | + |
| SEQ ID NO 12761 | CTTTTTACTTTCCTTTCTCTTC | TTC | chrX | 139535539 | 139535560 | 139535556 | 139535561 | + |
| SEQ ID NO 12762 | TTTACTTTCCTTTCTCTTCCTT | CTT | chrX | 139535542 | 139535563 | 139535559 | 139535564 | + |
| SEQ ID NO 12763 | TTACTTTCCTTTCTCTTCCTTT | TTT | chrX | 139535543 | 139535564 | 139535560 | 139535565 | + |
| SEQ ID NO 12764 | TACTTTCCTTTCTCTTCCTTTT | TTT | chrX | 139535544 | 139535565 | 139535561 | 139535566 | + |
| SEQ ID NO 12765 | ACTTTCCTTTCTCTTCCTTTTT | TTT | chrX | 139535545 | 139535566 | 139535562 | 139535567 | + |
| SEQ ID NO 12766 | CTTTCCTTTCTCTTCCTTTTTG | TTA | chrX | 139535546 | 139535567 | 139535563 | 139535568 | + |
| SEQ ID NO 12767 | TCCTTTCTCTTCCTTTTTGGAG | CTT | chrX | 139535549 | 139535570 | 139535566 | 139535571 | + |
| SEQ ID NO 12768 | CCTTTCTCTTCCTTTTTGGAGT | TTT | chrX | 139535550 | 139535571 | 139535567 | 139535572 | + |
| SEQ ID NO 12769 | CTTTCTCTTCCTTTTTGGAGTT | TTC | chrX | 139535551 | 139535572 | 139535568 | 139535573 | + |
| SEQ ID NO 12770 | TCTCTTCCTTTTTGGAGTTAAT | CTT | chrX | 139535554 | 139535575 | 139535571 | 139535576 | + |
| SEQ ID NO 12771 | CTCTTCCTTTTTGGAGTTAATC | TTT | chrX | 139535555 | 139535576 | 139535572 | 139535577 | + |
| SEQ ID NO 12772 | TCTTCCTTTTTGGAGTTAATCA | TTC | chrX | 139535556 | 139535577 | 139535573 | 139535578 | + |
| SEQ ID NO 12773 | TTCCTTTTTGGAGTTAATCAGG | CTC | chrX | 139535558 | 139535579 | 139535575 | 139535580 | + |
| SEQ ID NO 12774 | CCTTTTTGGAGTTAATCAGGAA | CTT | chrX | 139535560 | 139535581 | 139535577 | 139535582 | + |
| SEQ ID NO 12775 | CTTTTTGGAGTTAATCAGGAAG | TTC | chrX | 139535561 | 139535582 | 139535578 | 139535583 | + |
| SEQ ID NO 12776 | TTTGGAGTTAATCAGGAAGTAG | CTT | chrX | 139535564 | 139535585 | 139535581 | 139535586 | + |
| SEQ ID NO 12777 | TTGGAGTTAATCAGGAAGTAGT | TTT | chrX | 139535565 | 139535586 | 139535582 | 139535587 | + |
| SEQ ID NO 12778 | TGGAGTTAATCAGGAAGTAGTC | TTT | chrX | 139535566 | 139535587 | 139535583 | 139535588 | + |
| SEQ ID NO 12779 | GGAGTTAATCAGGAAGTAGTCC | TTT | chrX | 139535567 | 139535588 | 139535584 | 139535589 | + |
| SEQ ID NO 12780 | GAGTTAATCAGGAAGTAGTCCC | TTG | chrX | 139535568 | 139535589 | 139535585 | 139535590 | + |
| SEQ ID NO 12781 | ATCAGGAAGTAGTCCCAAATAC | TTA | chrX | 139535574 | 139535595 | 139535591 | 139535596 | + |
| SEQ ID NO 12782 | ATCTTATAAGCCCTTGGTCCTC | TTC | chrX | 139535608 | 139535629 | 139535625 | 139535630 | + |
| SEQ ID NO 12783 | ATAAGCCCTTGGTCCTCTTGAG | CTT | chrX | 139535613 | 139535634 | 139535630 | 139535635 | + |
| SEQ ID NO 12784 | TAAGCCCTTGGTCCTCTTGAGA | TTA | chrX | 139535614 | 139535635 | 139535631 | 139535636 | + |
| SEQ ID NO 12785 | GGTCCTCTTGAGATGGTATCAG | CTT | chrX | 139535623 | 139535644 | 139535640 | 139535645 | + |
| SEQ ID NO 12786 | GTCCTCTTGAGATGGTATCAGA | TTG | chrX | 139535624 | 139535645 | 139535641 | 139535646 | + |
| SEQ ID NO 12787 | TTGAGATGGTATCAGATATATT | CTC | chrX | 139535630 | 139535651 | 139535647 | 139535652 | + |
| SEQ ID NO 12788 | GAGATGGTATCAGATATATTGC | CTT | chrX | 139535632 | 139535653 | 139535649 | 139535654 | + |
| SEQ ID NO 12789 | AGATGGTATCAGATATATTGCT | TTG | chrX | 139535633 | 139535654 | 139535650 | 139535655 | + |
| SEQ ID NO 12790 | CTAGACCCTTGAAGAAAGGAAC | TTG | chrX | 139535653 | 139535674 | 139535670 | 139535675 | + |
| SEQ ID NO 12791 | GACCCTTGAAGAAAGGAACAAC | CTA | chrX | 139535656 | 139535677 | 139535673 | 139535678 | + |
| SEQ ID NO 12792 | GAAGAAAGGAACAACTCCAGGC | CTT | chrX | 139535663 | 139535684 | 139535680 | 139535685 | + |
| SEQ ID NO 12793 | AAGAAAGGAACAACTCCAGGCA | TTG | chrX | 139535664 | 139535685 | 139535681 | 139535686 | + |
| SEQ ID NO 12794 | CAGGCAACTTCTTGAGTCCCTG | CTC | chrX | 139535680 | 139535701 | 139535697 | 139535702 | + |
| SEQ ID NO 12795 | CTTGAGTCCCTGTTATTAATTT | CTT | chrX | 139535690 | 139535711 | 139535707 | 139535712 | + |

Figure 42 (Cont'd)

| SEQ ID NO 12796 | TTGAGTCCCTGTTATTAATTTT | TTC | chrX | 139535691 | 139535712 | 139535708 | 139535713 | + |
| SEQ ID NO 12797 | GAGTCCCTGTTATTAATTTTAT | CTT | chrX | 139535693 | 139535714 | 139535710 | 139535715 | + |
| SEQ ID NO 12798 | AGTCCCTGTTATTAATTTTATA | TTG | chrX | 139535694 | 139535715 | 139535711 | 139535716 | + |
| SEQ ID NO 12799 | TTATTAATTTTATACATACACA | CTG | chrX | 139535702 | 139535723 | 139535719 | 139535724 | + |
| SEQ ID NO 12800 | TTAATTTTATACATACACACAC | TTA | chrX | 139535705 | 139535726 | 139535722 | 139535727 | + |
| SEQ ID NO 12801 | ATTTTATACATACACACACATA | TTA | chrX | 139535708 | 139535729 | 139535725 | 139535730 | + |
| SEQ ID NO 12802 | TATACATACACACACATATATG | TTT | chrX | 139535712 | 139535733 | 139535729 | 139535734 | + |
| SEQ ID NO 12803 | ATACATACACACATATATGT | TTT | chrX | 139535713 | 139535734 | 139535730 | 139535735 | + |
| SEQ ID NO 12804 | TACATACACACATATATGTA | TTA | chrX | 139535714 | 139535735 | 139535731 | 139535736 | + |
| SEQ ID NO 12805 | CTTAACAATGGGGATATATTCT | TTC | chrX | 139535785 | 139535806 | 139535802 | 139535807 | + |
| SEQ ID NO 12806 | AACAATGGGGATATATTCTGAG | CTT | chrX | 139535788 | 139535809 | 139535805 | 139535810 | + |
| SEQ ID NO 12807 | ACAATGGGGATATATTCTGAGA | TTA | chrX | 139535789 | 139535810 | 139535806 | 139535811 | + |
| SEQ ID NO 12808 | TGAGAAATGTGTCATTAAGCAA | TTC | chrX | 139535806 | 139535827 | 139535823 | 139535828 | + |
| SEQ ID NO 12809 | AGAAATGTGTCATTAAGCAATT | CTG | chrX | 139535808 | 139535829 | 139535825 | 139535830 | + |
| SEQ ID NO 12810 | AGCAATTTCATCATTGTGCGAA | TTA | chrX | 139535823 | 139535844 | 139535840 | 139535845 | + |
| SEQ ID NO 12811 | CATCATTGTGCGAACATAATAG | TTT | chrX | 139535831 | 139535852 | 139535848 | 139535853 | + |
| SEQ ID NO 12812 | ATCATTGTGCGAACATAATAGA | TTC | chrX | 139535832 | 139535853 | 139535849 | 139535854 | + |
| SEQ ID NO 12813 | TGCGAACATAATAGAGTGTACT | TTG | chrX | 139535839 | 139535860 | 139535856 | 139535861 | + |
| SEQ ID NO 12814 | ACCTAAACCTAAATGGTATAGC | CTT | chrX | 139535862 | 139535883 | 139535879 | 139535884 | + |
| SEQ ID NO 12815 | CCTAAACCTAAATGGTATAGCT | TTA | chrX | 139535863 | 139535884 | 139535880 | 139535885 | + |
| SEQ ID NO 12816 | AACCTAAATGGTATAGCTTACT | CTA | chrX | 139535867 | 139535888 | 139535884 | 139535889 | + |
| SEQ ID NO 12817 | AATGGTATAGCTTACTACATAC | CTA | chrX | 139535873 | 139535894 | 139535890 | 139535895 | + |
| SEQ ID NO 12818 | ACTACATACCTAGGTTGTATTG | CTT | chrX | 139535886 | 139535907 | 139535903 | 139535908 | + |
| SEQ ID NO 12819 | CTACATACCTAGGTTGTATTGA | TTA | chrX | 139535887 | 139535908 | 139535904 | 139535909 | + |
| SEQ ID NO 12820 | CATACCTAGGTTGTATTGATGT | CTA | chrX | 139535890 | 139535911 | 139535907 | 139535912 | + |
| SEQ ID NO 12821 | GGTTGTATTGATGTGGCCTATT | CTA | chrX | 139535898 | 139535919 | 139535915 | 139535920 | + |
| SEQ ID NO 12822 | TATTGATGTGGCCTATTGCTCC | TTG | chrX | 139535903 | 139535924 | 139535920 | 139535925 | + |
| SEQ ID NO 12823 | ATGTGGCCTATTGCTCCTAGGC | TTG | chrX | 139535908 | 139535929 | 139535925 | 139535930 | + |
| SEQ ID NO 12824 | TTGCTCCTAGGCTCCTGGGCTG | CTA | chrX | 139535918 | 139535939 | 139535935 | 139535940 | + |
| SEQ ID NO 12825 | CTCCTAGGCTCCTGGGCTGCAA | TTG | chrX | 139535921 | 139535942 | 139535938 | 139535943 | + |
| SEQ ID NO 12826 | CTAGGCTCCTGGGCTGCAAACC | CTC | chrX | 139535924 | 139535945 | 139535941 | 139535946 | + |
| SEQ ID NO 12827 | GGCTCCTGGGCTGCAAACCTGT | CTA | chrX | 139535927 | 139535948 | 139535944 | 139535949 | + |
| SEQ ID NO 12828 | CTGGGCTGCAAACCTGTACAGC | CTC | chrX | 139535932 | 139535953 | 139535949 | 139535954 | + |
| SEQ ID NO 12829 | GGCTGCAAACCTGTACAGCATG | CTG | chrX | 139535935 | 139535956 | 139535952 | 139535957 | + |
| SEQ ID NO 12830 | CAAACCTGTACAGCATGTGACT | CTG | chrX | 139535940 | 139535961 | 139535957 | 139535962 | + |
| SEQ ID NO 12831 | TACAGCATGTGACTGTACTGAA | CTG | chrX | 139535948 | 139535969 | 139535965 | 139535970 | + |
| SEQ ID NO 12832 | TACTGAACACTGTAGGCAATGG | CTG | chrX | 139535963 | 139535984 | 139535980 | 139535985 | + |
| SEQ ID NO 12833 | AACACTGTAGGCAATGGTAACA | CTG | chrX | 139535968 | 139535989 | 139535985 | 139535990 | + |
| SEQ ID NO 12834 | TAGGCAATGGTAACAGTGGTAT | CTG | chrX | 139535975 | 139535996 | 139535992 | 139535997 | + |
| SEQ ID NO 12835 | GTGTATCTAAACATAGAAAGG | TTT | chrX | 139535999 | 139536020 | 139536016 | 139536021 | + |
| SEQ ID NO 12836 | TGTATCTAAACATAGAAAAGGT | TTG | chrX | 139536000 | 139536021 | 139536017 | 139536022 | + |
| SEQ ID NO 12837 | AACATAGAAAAGGTACAGTGAA | CTA | chrX | 139536008 | 139536029 | 139536025 | 139536030 | + |
| SEQ ID NO 12838 | TAACCTTATGGGACCACTGTCG | TTA | chrX | 139536042 | 139536063 | 139536059 | 139536064 | + |
| SEQ ID NO 12839 | ATGGGACCACTGTCGTATAATG | CTT | chrX | 139536049 | 139536070 | 139536066 | 139536071 | + |
| SEQ ID NO 12840 | TGGGACCACTGTCGTATAATGT | TTA | chrX | 139536050 | 139536071 | 139536067 | 139536072 | + |
| SEQ ID NO 12841 | TCGTATAATGTGGTCCATCATT | CTG | chrX | 139536061 | 139536082 | 139536078 | 139536083 | + |
| SEQ ID NO 12842 | ACCAAAATGTCATTGTGCAGCA | TTG | chrX | 139536084 | 139536105 | 139536101 | 139536106 | + |
| SEQ ID NO 12843 | TGCAGCAAATGATTATCTCATA | TTG | chrX | 139536099 | 139536120 | 139536116 | 139536121 | + |
| SEQ ID NO 12844 | TCTCATATATATATATATATGA | TTA | chrX | 139536114 | 139536135 | 139536131 | 139536136 | + |
| SEQ ID NO 12845 | ATATATATATATATGATATG | CTC | chrX | 139536118 | 139536139 | 139536135 | 139536140 | + |
| SEQ ID NO 12846 | AGATAGAGACATCTATCCTCCA | TTC | chrX | 139536347 | 139536368 | 139536364 | 139536369 | + |
| SEQ ID NO 12847 | TCCTCCAGAGTTCAGGAGTGTC | CTA | chrX | 139536362 | 139536383 | 139536379 | 139536384 | + |
| SEQ ID NO 12848 | CAGAGTTCAGGAGTGTCTCTTC | CTC | chrX | 139536367 | 139536388 | 139536384 | 139536389 | + |
| SEQ ID NO 12849 | AGGAGTGTCTCTTCAGACTAGG | TTC | chrX | 139536375 | 139536396 | 139536392 | 139536397 | + |
| SEQ ID NO 12850 | TTCAGACTAGGTAGATGTAGCT | CTC | chrX | 139536386 | 139536407 | 139536403 | 139536408 | + |
| SEQ ID NO 12851 | CAGACTAGGTAGATGTAGCTTA | CTT | chrX | 139536388 | 139536409 | 139536405 | 139536410 | + |
| SEQ ID NO 12852 | AGACTAGGTAGATGTAGCTTAA | TTC | chrX | 139536389 | 139536410 | 139536406 | 139536411 | + |
| SEQ ID NO 12853 | GGTAGATGTAGCTTAAAAAAAA | CTA | chrX | 139536395 | 139536416 | 139536412 | 139536417 | + |
| SEQ ID NO 12854 | AAAAAAAACATATCCTGAATTC | CTT | chrX | 139536409 | 139536430 | 139536426 | 139536431 | + |

Figure 42 (Cont'd)

| SEQ ID NO 12855 | AAAAAAACATATCCTGAATTCT | TTA | chrX | 139536410 | 139536431 | 139536427 | 139536432 | + |
|---|---|---|---|---|---|---|---|---|
| SEQ ID NO 12856 | AATTCTAGAGAGATGCTTAAAT | CTG | chrX | 139536426 | 139536447 | 139536443 | 139536448 | + |
| SEQ ID NO 12857 | TAGAGAGATGCTTAAATCACTG | TTC | chrX | 139536431 | 139536452 | 139536448 | 139536453 | + |
| SEQ ID NO 12858 | GAGAGATGCTTAAATCACTGCA | CTA | chrX | 139536433 | 139536454 | 139536450 | 139536455 | + |
| SEQ ID NO 12859 | AAATCACTGCAATTCCTATAAC | CTT | chrX | 139536444 | 139536465 | 139536461 | 139536466 | + |
| SEQ ID NO 12860 | AATCACTGCAATTCCTATAACA | TTA | chrX | 139536445 | 139536466 | 139536462 | 139536467 | + |
| SEQ ID NO 12861 | CAATTCCTATAACACTTGCCAA | CTG | chrX | 139536453 | 139536474 | 139536470 | 139536475 | + |
| SEQ ID NO 12862 | CTATAACACTTGCCAACCAAAG | TTC | chrX | 139536459 | 139536480 | 139536476 | 139536481 | + |
| SEQ ID NO 12863 | TAACACTTGCCAACCAAAGGTG | CTA | chrX | 139536462 | 139536483 | 139536479 | 139536484 | + |
| SEQ ID NO 12864 | GCCAACCAAAGGTGCTGTTGAT | CTT | chrX | 139536470 | 139536491 | 139536487 | 139536492 | + |
| SEQ ID NO 12865 | CCAACCAAAGGTGCTGTTGATC | TTG | chrX | 139536471 | 139536492 | 139536488 | 139536493 | + |
| SEQ ID NO 12866 | TTGATCTGAAATTGCTTTTTTA | CTG | chrX | 139536487 | 139536508 | 139536504 | 139536509 | + |
| SEQ ID NO 12867 | ATCTGAAATTGCTTTTTTAAAT | TTG | chrX | 139536490 | 139536511 | 139536507 | 139536512 | + |
| SEQ ID NO 12868 | AAATTGCTTTTTTAAATTAATG | CTG | chrX | 139536495 | 139536516 | 139536512 | 139536517 | + |
| SEQ ID NO 12869 | CTTTTTAAATTAATGCAGTGA | TTG | chrX | 139536501 | 139536522 | 139536518 | 139536523 | + |
| SEQ ID NO 12870 | TTTTAAATTAATGCAGTGATTT | CTT | chrX | 139536504 | 139536525 | 139536521 | 139536526 | + |
| SEQ ID NO 12871 | TTTAAATTAATGCAGTGATTTT | TTT | chrX | 139536505 | 139536526 | 139536522 | 139536527 | + |
| SEQ ID NO 12872 | TTAAATTAATGCAGTGATTTTT | TTT | chrX | 139536506 | 139536527 | 139536523 | 139536528 | + |
| SEQ ID NO 12873 | TAAATTAATGCAGTGATTTTTC | TTT | chrX | 139536507 | 139536528 | 139536524 | 139536529 | + |
| SEQ ID NO 12874 | AAATTAATGCAGTGATTTTTCT | TTT | chrX | 139536508 | 139536529 | 139536525 | 139536530 | + |
| SEQ ID NO 12875 | AATTAATGCAGTGATTTTTCTT | TTA | chrX | 139536509 | 139536530 | 139536526 | 139536531 | + |
| SEQ ID NO 12876 | ATGCAGTGATTTTTCTTTAACA | TTA | chrX | 139536514 | 139536535 | 139536531 | 139536536 | + |
| SEQ ID NO 12877 | TTCTTTAACATCTAGTGACAGA | TTT | chrX | 139536526 | 139536547 | 139536543 | 139536548 | + |
| SEQ ID NO 12878 | TCTTTAACATCTAGTGACAGAC | TTT | chrX | 139536527 | 139536548 | 139536544 | 139536549 | + |
| SEQ ID NO 12879 | CTTTAACATCTAGTGACAGACA | TTT | chrX | 139536528 | 139536549 | 139536545 | 139536550 | + |
| SEQ ID NO 12880 | TTTAACATCTAGTGACAGACAC | TTC | chrX | 139536529 | 139536550 | 139536546 | 139536551 | + |
| SEQ ID NO 12881 | TAACATCTAGTGACAGACACTG | CTT | chrX | 139536531 | 139536552 | 139536548 | 139536553 | + |
| SEQ ID NO 12882 | AACATCTAGTGACAGACACTGG | TTT | chrX | 139536532 | 139536553 | 139536549 | 139536554 | + |
| SEQ ID NO 12883 | ACATCTAGTGACAGACACTGGG | TTA | chrX | 139536533 | 139536554 | 139536550 | 139536555 | + |
| SEQ ID NO 12884 | GTGACAGACACTGGGGTCACAT | CTA | chrX | 139536540 | 139536561 | 139536557 | 139536562 | + |
| SEQ ID NO 12885 | GGGTCACATTTGCAGCTGGACC | CTG | chrX | 139536553 | 139536574 | 139536570 | 139536575 | + |
| SEQ ID NO 12886 | GCAGCTGGACCATAATTAGGCT | TTT | chrX | 139536564 | 139536585 | 139536581 | 139536586 | + |
| SEQ ID NO 12887 | CAGCTGGACCATAATTAGGCTT | TTG | chrX | 139536565 | 139536586 | 139536582 | 139536587 | + |
| SEQ ID NO 12888 | GACCATAATTAGGCTTCTGTTC | CTG | chrX | 139536571 | 139536592 | 139536588 | 139536593 | + |
| SEQ ID NO 12889 | GGCTTCTGTTCTTCAGGAGACA | TTA | chrX | 139536582 | 139536603 | 139536599 | 139536604 | + |
| SEQ ID NO 12890 | CTGTTCTTCAGGAGACATTTGT | CTT | chrX | 139536587 | 139536608 | 139536604 | 139536609 | + |
| SEQ ID NO 12891 | TGTTCTTCAGGAGACATTTGTT | TTC | chrX | 139536588 | 139536609 | 139536605 | 139536610 | + |
| SEQ ID NO 12892 | TTCTTCAGGAGACATTTGTTCA | CTG | chrX | 139536590 | 139536611 | 139536607 | 139536612 | + |
| SEQ ID NO 12893 | TTCAGGAGACATTTGTTCAAAG | TTC | chrX | 139536593 | 139536614 | 139536610 | 139536615 | + |
| SEQ ID NO 12894 | CAGGAGACATTTGTTCAAAGTC | CTT | chrX | 139536595 | 139536616 | 139536612 | 139536617 | + |
| SEQ ID NO 12895 | AGGAGACATTTGTTCAAAGTCA | TTC | chrX | 139536596 | 139536617 | 139536613 | 139536618 | + |
| SEQ ID NO 12896 | GTTCAAAGTCATTTGGGCAACC | TTT | chrX | 139536607 | 139536628 | 139536624 | 139536629 | + |
| SEQ ID NO 12897 | TTCAAAGTCATTTGGGCAACCA | TTG | chrX | 139536608 | 139536629 | 139536625 | 139536630 | + |
| SEQ ID NO 12898 | AAAGTCATTTGGGCAACCATAT | TTC | chrX | 139536611 | 139536632 | 139536628 | 139536633 | + |
| SEQ ID NO 12899 | GGGCAACCATATTCTGAAAACA | TTT | chrX | 139536621 | 139536642 | 139536638 | 139536643 | + |
| SEQ ID NO 12900 | GGCAACCATATTCTGAAAACAG | TTG | chrX | 139536622 | 139536643 | 139536639 | 139536644 | + |
| SEQ ID NO 12901 | TGAAAACAGCCCAGCCAGGGTG | TTC | chrX | 139536635 | 139536656 | 139536652 | 139536657 | + |
| SEQ ID NO 12902 | AAAACAGCCCAGCCAGGGTGAT | CTG | chrX | 139536637 | 139536658 | 139536654 | 139536659 | + |
| SEQ ID NO 12903 | TGCAAAGATCCTCAATGAGCTA | CTT | chrX | 139536668 | 139536689 | 139536685 | 139536690 | + |
| SEQ ID NO 12904 | GCAAAGATCCTCAATGAGCTAT | TTT | chrX | 139536669 | 139536690 | 139536686 | 139536691 | + |
| SEQ ID NO 12905 | CAAAGATCCTCAATGAGCTATT | TTG | chrX | 139536670 | 139536691 | 139536687 | 139536692 | + |
| SEQ ID NO 12906 | AATGAGCTATTTTCAAGTGATG | CTC | chrX | 139536681 | 139536702 | 139536698 | 139536703 | + |
| SEQ ID NO 12907 | TTTTCAAGTGATGACAAAGTGT | CTA | chrX | 139536690 | 139536711 | 139536707 | 139536712 | + |
| SEQ ID NO 12908 | TCAAGTGATGACAAAGTGTAA | TTT | chrX | 139536693 | 139536714 | 139536710 | 139536715 | + |
| SEQ ID NO 12909 | CAAGTGATGACAAAGTGTGAAG | TTT | chrX | 139536694 | 139536715 | 139536711 | 139536716 | + |
| SEQ ID NO 12910 | AAGTGATGACAAAGTGTGAAGT | TTC | chrX | 139536695 | 139536716 | 139536712 | 139536717 | + |
| SEQ ID NO 12911 | ACCGCTCATTTGAGAACTTTCT | TTA | chrX | 139536719 | 139536740 | 139536736 | 139536741 | + |
| SEQ ID NO 12912 | ATTTGAGAACTTTCTTTTTCAT | CTC | chrX | 139536726 | 139536747 | 139536743 | 139536748 | + |
| SEQ ID NO 12913 | GAGAACTTTCTTTTTCATCCAA | TTT | chrX | 139536730 | 139536751 | 139536747 | 139536752 | + |

Figure 42 (Cont'd)

| | | | | | | | | |
|---|---|---|---|---|---|---|---|---|
| SEQ ID NO 12914 | AGAACTTTCTTTTTCATCCAAA | TTG | chrX | 139536731 | 139536752 | 139536748 | 139536753 | + |
| SEQ ID NO 12915 | TCTTTTTCATCCAAAGTAAATT | CTT | chrX | 139536738 | 139536759 | 139536755 | 139536760 | + |
| SEQ ID NO 12916 | CTTTTTCATCCAAAGTAAATTC | TTT | chrX | 139536739 | 139536760 | 139536756 | 139536761 | + |
| SEQ ID NO 12917 | TTTTTCATCCAAAGTAAATTCA | TTC | chrX | 139536740 | 139536761 | 139536757 | 139536762 | + |
| SEQ ID NO 12918 | TTTCATCCAAAGTAAATTCAAA | CTT | chrX | 139536742 | 139536763 | 139536759 | 139536764 | + |
| SEQ ID NO 12919 | TTCATCCAAAGTAAATTCAAAT | TTT | chrX | 139536743 | 139536764 | 139536760 | 139536765 | + |
| SEQ ID NO 12920 | TCATCCAAAGTAAATTCAAATA | TTT | chrX | 139536744 | 139536765 | 139536761 | 139536766 | + |
| SEQ ID NO 12921 | CATCCAAAGTAAATTCAAATAT | TTT | chrX | 139536745 | 139536766 | 139536762 | 139536767 | + |
| SEQ ID NO 12922 | ATCCAAAGTAAATTCAAATATG | TTC | chrX | 139536746 | 139536767 | 139536763 | 139536768 | + |
| SEQ ID NO 12923 | AAATATGATTAGAAATCTGACC | TTC | chrX | 139536761 | 139536782 | 139536778 | 139536783 | + |
| SEQ ID NO 12924 | GAAATCTGACCTTTTATTACTG | TTA | chrX | 139536772 | 139536793 | 139536789 | 139536794 | + |
| SEQ ID NO 12925 | ACCTTTTATTACTGGAATTCTC | CTG | chrX | 139536780 | 139536801 | 139536797 | 139536802 | + |
| SEQ ID NO 12926 | TTATTACTGGAATTCTCTTGAC | CTT | chrX | 139536785 | 139536806 | 139536802 | 139536807 | + |
| SEQ ID NO 12927 | TATTACTGGAATTCTCTTGACT | TTT | chrX | 139536786 | 139536807 | 139536803 | 139536808 | + |
| SEQ ID NO 12928 | ATTACTGGAATTCTCTTGACTA | TTT | chrX | 139536787 | 139536808 | 139536804 | 139536809 | + |
| SEQ ID NO 12929 | TTACTGGAATTCTCTTGACTAA | TTA | chrX | 139536788 | 139536809 | 139536805 | 139536810 | + |
| SEQ ID NO 12930 | CTGGAATTCTCTTGACTAAAAG | TTA | chrX | 139536791 | 139536812 | 139536808 | 139536813 | + |
| SEQ ID NO 12931 | GAATTCTCTTGACTAAAAGTAA | CTG | chrX | 139536794 | 139536815 | 139536811 | 139536816 | + |
| SEQ ID NO 12932 | TCTTGACTAAAAGTAAAATTGA | TTC | chrX | 139536800 | 139536821 | 139536817 | 139536822 | + |
| SEQ ID NO 12933 | TTGACTAAAAGTAAAATTGAAT | CTC | chrX | 139536802 | 139536823 | 139536819 | 139536824 | + |
| SEQ ID NO 12934 | GACTAAAAGTAAAATTGAATTT | CTT | chrX | 139536804 | 139536825 | 139536821 | 139536826 | + |
| SEQ ID NO 12935 | ACTAAAAGTAAAATTGAATTTT | TTG | chrX | 139536805 | 139536826 | 139536822 | 139536827 | + |
| SEQ ID NO 12936 | AAAGTAAAATTGAATTTTAATT | CTA | chrX | 139536809 | 139536830 | 139536826 | 139536831 | + |
| SEQ ID NO 12937 | AATTTTAATTCCTAAATCTCCA | TTG | chrX | 139536821 | 139536842 | 139536838 | 139536843 | + |
| SEQ ID NO 12938 | TAATTCCTAAATCTCCATGTGT | TTT | chrX | 139536826 | 139536847 | 139536843 | 139536848 | + |
| SEQ ID NO 12939 | AATTCCTAAATCTCCATGTGTA | TTT | chrX | 139536827 | 139536848 | 139536844 | 139536849 | + |
| SEQ ID NO 12940 | ATTCCTAAATCTCCATGTGTAT | TTA | chrX | 139536828 | 139536849 | 139536845 | 139536850 | + |
| SEQ ID NO 12941 | CTAAATCTCCATGTGTATACAG | TTC | chrX | 139536832 | 139536853 | 139536849 | 139536854 | + |
| SEQ ID NO 12942 | AATCTCCATGTGTATACAGTAC | CTA | chrX | 139536835 | 139536856 | 139536852 | 139536857 | + |
| SEQ ID NO 12943 | CATGTGTATACAGTACTGTGGG | CTC | chrX | 139536841 | 139536862 | 139536858 | 139536863 | + |
| SEQ ID NO 12944 | TGGGAACATCACAGATTTTGGC | CTG | chrX | 139536859 | 139536880 | 139536876 | 139536881 | + |
| SEQ ID NO 12945 | TGGCTCCATGCCCTAAAGAGAA | TTT | chrX | 139536877 | 139536898 | 139536894 | 139536899 | + |
| SEQ ID NO 12946 | GGCTCCATGCCCTAAAGAGAAA | TTT | chrX | 139536878 | 139536899 | 139536895 | 139536900 | + |
| SEQ ID NO 12947 | GCTCCATGCCCTAAAGAGAAAT | TTG | chrX | 139536879 | 139536900 | 139536896 | 139536901 | + |
| SEQ ID NO 12948 | CATGCCCTAAAGAGAAATTGGC | CTC | chrX | 139536883 | 139536904 | 139536900 | 139536905 | + |
| SEQ ID NO 12949 | AAGAGAAATTGGCTTTCAGATT | CTA | chrX | 139536892 | 139536913 | 139536909 | 139536914 | + |
| SEQ ID NO 12950 | GCTTTCAGATTATTTGGATTAA | TTG | chrX | 139536903 | 139536924 | 139536920 | 139536925 | + |
| SEQ ID NO 12951 | TCAGATTATTTGGATTAAAAAC | CTT | chrX | 139536907 | 139536928 | 139536924 | 139536929 | + |
| SEQ ID NO 12952 | CAGATTATTTGGATTAAAAACA | TTT | chrX | 139536908 | 139536929 | 139536925 | 139536930 | + |
| SEQ ID NO 12953 | AGATTATTTGGATTAAAAACAA | TTC | chrX | 139536909 | 139536930 | 139536926 | 139536931 | + |
| SEQ ID NO 12954 | TTTGGATTAAAAACAAAGACTT | TTA | chrX | 139536915 | 139536936 | 139536932 | 139536937 | + |
| SEQ ID NO 12955 | GGATTAAAAACAAAGACTTTCT | TTT | chrX | 139536918 | 139536939 | 139536935 | 139536940 | + |
| SEQ ID NO 12956 | GATTAAAAACAAAGACTTTCTT | TTG | chrX | 139536919 | 139536940 | 139536936 | 139536941 | + |
| SEQ ID NO 12957 | AAAACAAAGACTTTCTTAAGAG | TTA | chrX | 139536924 | 139536945 | 139536941 | 139536946 | + |
| SEQ ID NO 12958 | TCTTAAGAGATGTAAAATTTTC | CTT | chrX | 139536937 | 139536958 | 139536954 | 139536959 | + |
| SEQ ID NO 12959 | CTTAAGAGATGTAAAATTTTCA | TTT | chrX | 139536938 | 139536959 | 139536955 | 139536960 | + |
| SEQ ID NO 12960 | TTAAGAGATGTAAAATTTTCAT | TTC | chrX | 139536939 | 139536960 | 139536956 | 139536961 | + |
| SEQ ID NO 12961 | AAGAGATGTAAAATTTTCATGA | CTT | chrX | 139536941 | 139536962 | 139536958 | 139536963 | + |
| SEQ ID NO 12962 | AGAGATGTAAAATTTTCATGAT | TTA | chrX | 139536942 | 139536963 | 139536959 | 139536964 | + |
| SEQ ID NO 12963 | TCATGATGTTTTCTTTTTGCT | TTT | chrX | 139536957 | 139536978 | 139536974 | 139536979 | + |
| SEQ ID NO 12964 | CATGATGTTTTCTTTTTGCTA | TTT | chrX | 139536958 | 139536979 | 139536975 | 139536980 | + |
| SEQ ID NO 12965 | ATGATGTTTTCTTTTTGCTAA | TTC | chrX | 139536959 | 139536980 | 139536976 | 139536981 | + |
| SEQ ID NO 12966 | TCTTTTTGCTAAAACTAAAGA | TTT | chrX | 139536968 | 139536989 | 139536985 | 139536990 | + |
| SEQ ID NO 12967 | CTTTTTGCTAAAACTAAAGAA | TTT | chrX | 139536969 | 139536990 | 139536986 | 139536991 | + |
| SEQ ID NO 12968 | TTTTTGCTAAAACTAAAGAAT | TTC | chrX | 139536970 | 139536991 | 139536987 | 139536992 | + |
| SEQ ID NO 12969 | TTTGCTAAAACTAAAGAATTA | CTT | chrX | 139536972 | 139536993 | 139536989 | 139536994 | + |
| SEQ ID NO 12970 | TTTGCTAAAACTAAAGAATTAT | TTT | chrX | 139536973 | 139536994 | 139536990 | 139536995 | + |
| SEQ ID NO 12971 | TTGCTAAAACTAAAGAATTATT | TTT | chrX | 139536974 | 139536995 | 139536991 | 139536996 | + |
| SEQ ID NO 12972 | TGCTAAAACTAAAGAATTATTC | TTT | chrX | 139536975 | 139536996 | 139536992 | 139536997 | + |

Figure 42 (Cont'd)

| | | | | | | | | |
|---|---|---|---|---|---|---|---|---|
| SEQ ID NO 12973 | GCTAAAACTAAAGAATTATTCT | TTT | chrX | 139536976 | 139536997 | 139536993 | 139536998 | + |
| SEQ ID NO 12974 | CTAAAACTAAAGAATTATTCTT | TTG | chrX | 139536977 | 139536998 | 139536994 | 139536999 | + |
| SEQ ID NO 12975 | AAACTAAAGAATTATTCTTTTA | CTA | chrX | 139536980 | 139537001 | 139536997 | 139537002 | + |
| SEQ ID NO 12976 | AAGAATTATTCTTTTACATTTC | CTA | chrX | 139536986 | 139537007 | 139537003 | 139537008 | + |
| SEQ ID NO 12977 | TTCTTTTACATTTCAGTTTTTC | TTA | chrX | 139536994 | 139537015 | 139537011 | 139537016 | + |
| SEQ ID NO 12978 | TTTTACATTTCAGTTTTTCTTG | TTC | chrX | 139536997 | 139537018 | 139537014 | 139537019 | + |
| SEQ ID NO 12979 | TTACATTTCAGTTTTTCTTGAT | CTT | chrX | 139536999 | 139537020 | 139537016 | 139537021 | + |
| SEQ ID NO 12980 | TACATTTCAGTTTTTCTTGATC | TTT | chrX | 139537000 | 139537021 | 139537017 | 139537022 | + |
| SEQ ID NO 12981 | ACATTTCAGTTTTTCTTGATCA | TTT | chrX | 139537001 | 139537022 | 139537018 | 139537023 | + |
| SEQ ID NO 12982 | CATTTCAGTTTTTCTTGATCAT | TTA | chrX | 139537002 | 139537023 | 139537019 | 139537024 | + |
| SEQ ID NO 12983 | CAGTTTTTCTTGATCATGAAAA | TTT | chrX | 139537007 | 139537028 | 139537024 | 139537029 | + |
| SEQ ID NO 12984 | AGTTTTTCTTGATCATGAAAAC | TTC | chrX | 139537008 | 139537029 | 139537025 | 139537030 | + |
| SEQ ID NO 12985 | TTCTTGATCATGAAAACGCCAA | TTT | chrX | 139537013 | 139537034 | 139537030 | 139537035 | + |
| SEQ ID NO 12986 | TCTTGATCATGAAAACGCCAAC | TTT | chrX | 139537014 | 139537035 | 139537031 | 139537036 | + |
| SEQ ID NO 12987 | CTTGATCATGAAAACGCCAACA | TTT | chrX | 139537015 | 139537036 | 139537032 | 139537037 | + |
| SEQ ID NO 12988 | TTGATCATGAAAACGCCAACAA | TTC | chrX | 139537016 | 139537037 | 139537033 | 139537038 | + |
| SEQ ID NO 12989 | GATCATGAAAACGCCAACAAAA | CTT | chrX | 139537018 | 139537039 | 139537035 | 139537040 | + |
| SEQ ID NO 12990 | ATCATGAAAACGCCAACAAAAT | TTG | chrX | 139537019 | 139537040 | 139537036 | 139537041 | + |
| SEQ ID NO 12991 | TGAATCGGCCAAAGAGGTATAA | TTC | chrX | 139537043 | 139537064 | 139537060 | 139537065 | + |
| SEQ ID NO 12992 | AATCGGCCAAAGAGGTATAATT | CTG | chrX | 139537045 | 139537066 | 139537062 | 139537067 | + |
| SEQ ID NO 12993 | AGGTAAATTGGAAGAGTTTGTT | TTC | chrX | 139537068 | 139537089 | 139537085 | 139537090 | + |
| SEQ ID NO 12994 | GAAGAGTTTGTTCAAGGGAACC | TTG | chrX | 139537078 | 139537099 | 139537095 | 139537100 | + |
| SEQ ID NO 12995 | GTTCAAGGGAACCTTGAGAGAG | TTT | chrX | 139537087 | 139537108 | 139537104 | 139537109 | + |
| SEQ ID NO 12996 | TTCAAGGGAACCTTGAGAGAGA | TTG | chrX | 139537088 | 139537109 | 139537105 | 139537110 | + |
| SEQ ID NO 12997 | AAGGGAACCTTGAGAGAGAATG | TTC | chrX | 139537091 | 139537112 | 139537108 | 139537113 | + |
| SEQ ID NO 12998 | GAGAGAGAATGTATGGAAGAAA | CTT | chrX | 139537102 | 139537123 | 139537119 | 139537124 | + |
| SEQ ID NO 12999 | AGAGAGAATGTATGGAAGAAAA | TTG | chrX | 139537103 | 139537124 | 139537120 | 139537125 | + |
| SEQ ID NO 13000 | TGAAGAAGCACGAGAAGTTTTT | TTT | chrX | 139537134 | 139537155 | 139537151 | 139537156 | + |
| SEQ ID NO 13001 | GAAGAAGCACGAGAAGTTTTTG | TTT | chrX | 139537135 | 139537156 | 139537152 | 139537157 | + |
| SEQ ID NO 13002 | AAGAAGCACGAGAAGTTTTTGA | TTG | chrX | 139537136 | 139537157 | 139537153 | 139537158 | + |
| SEQ ID NO 13003 | TTTCAGTGTTTTCAAAAACTTC | TTC | chrX | 139537147 | 139537168 | 139537152 | 139537147 | - |
| SEQ ID NO 13004 | TCAGTGTTTTCAAAAACTTCTC | CTT | chrX | 139537145 | 139537166 | 139537150 | 139537145 | - |
| SEQ ID NO 13005 | CAGTGTTTTCAAAAACTTCTCG | TTT | chrX | 139537144 | 139537165 | 139537149 | 139537144 | - |
| SEQ ID NO 13006 | AGTGTTTTCAAAAACTTCTCGT | TTC | chrX | 139537143 | 139537164 | 139537148 | 139537143 | - |
| SEQ ID NO 13007 | TCAAAAACTTCTCGTGCTTCTT | TTT | chrX | 139537136 | 139537157 | 139537141 | 139537136 | - |
| SEQ ID NO 13008 | CAAAAACTTCTCGTGCTTCTTC | TTT | chrX | 139537135 | 139537156 | 139537140 | 139537135 | - |
| SEQ ID NO 13009 | AAAAACTTCTCGTGCTTCTTCA | TTC | chrX | 139537134 | 139537155 | 139537139 | 139537134 | - |
| SEQ ID NO 13010 | CTCGTGCTTCTTCAAAACTACA | CTT | chrX | 139537126 | 139537147 | 139537131 | 139537126 | - |
| SEQ ID NO 13011 | TCGTGCTTCTTCAAAACTACAC | TTC | chrX | 139537125 | 139537146 | 139537130 | 139537125 | - |
| SEQ ID NO 13012 | GTGCTTCTTCAAAACTACACTT | CTC | chrX | 139537123 | 139537144 | 139537128 | 139537123 | - |
| SEQ ID NO 13013 | CTTCAAAACTACACTTTTCTTC | CTT | chrX | 139537117 | 139537138 | 139537122 | 139537117 | - |
| SEQ ID NO 13014 | TTCAAAACTACACTTTTCTTCC | TTC | chrX | 139537116 | 139537137 | 139537121 | 139537116 | - |
| SEQ ID NO 13015 | CAAAACTACACTTTTCTTCCAT | CTT | chrX | 139537114 | 139537135 | 139537119 | 139537114 | - |
| SEQ ID NO 13016 | AAAACTACACTTTTCTTCCATA | TTC | chrX | 139537113 | 139537134 | 139537118 | 139537113 | - |
| SEQ ID NO 13017 | CACTTTTCTTCCATACATTCTC | CTA | chrX | 139537106 | 139537127 | 139537111 | 139537106 | - |
| SEQ ID NO 13018 | TTCTTCCATACATTCTCTCTCA | CTT | chrX | 139537101 | 139537122 | 139537106 | 139537101 | - |
| SEQ ID NO 13019 | TCTTCCATACATTCTCTCTCAA | TTT | chrX | 139537100 | 139537121 | 139537105 | 139537100 | - |
| SEQ ID NO 13020 | CTTCCATACATTCTCTCTCAAG | TTT | chrX | 139537099 | 139537120 | 139537104 | 139537099 | - |
| SEQ ID NO 13021 | TTCCATACATTCTCTCTCAAGG | TTC | chrX | 139537098 | 139537119 | 139537103 | 139537098 | - |
| SEQ ID NO 13022 | CCATACATTCTCTCTCAAGGTT | CTT | chrX | 139537096 | 139537117 | 139537101 | 139537096 | - |
| SEQ ID NO 13023 | CATACATTCTCTCTCAAGGTTC | TTC | chrX | 139537095 | 139537116 | 139537100 | 139537095 | - |
| SEQ ID NO 13024 | TCTCTCAAGGTTCCCTTGAACA | TTC | chrX | 139537086 | 139537107 | 139537091 | 139537086 | - |
| SEQ ID NO 13025 | TCTCAAGGTTCCCTTGAACAAA | CTC | chrX | 139537084 | 139537105 | 139537089 | 139537084 | - |
| SEQ ID NO 13026 | TCAAGGTTCCCTTGAACAAACT | CTC | chrX | 139537082 | 139537103 | 139537087 | 139537082 | - |
| SEQ ID NO 13027 | AAGGTTCCCTTGAACAAACTCT | CTC | chrX | 139537080 | 139537101 | 139537085 | 139537080 | - |
| SEQ ID NO 13028 | CCTTGAACAAACTCTTCCAATT | TTC | chrX | 139537073 | 139537094 | 139537078 | 139537073 | - |
| SEQ ID NO 13029 | GAACAAACTCTTCCAATTTACC | CTT | chrX | 139537069 | 139537090 | 139537074 | 139537069 | - |
| SEQ ID NO 13030 | AACAAACTCTTCCAATTTACCT | TTG | chrX | 139537068 | 139537089 | 139537073 | 139537068 | - |
| SEQ ID NO 13031 | TTCCAATTTACCTGAATTATAC | CTC | chrX | 139537059 | 139537080 | 139537064 | 139537059 | - |

Figure 42 (Cont'd)

| SEQ ID NO 13032 | CCAATTTACCTGAATTATACCT | CTT | chrX | 139537057 | 139537078 | 139537062 | 139537057 | - |
|---|---|---|---|---|---|---|---|---|
| SEQ ID NO 13033 | CAATTTACCTGAATTATACCTC | TTC | chrX | 139537056 | 139537077 | 139537061 | 139537056 | - |
| SEQ ID NO 13034 | ACCTGAATTATACCTCTTTGGC | TTT | chrX | 139537050 | 139537071 | 139537055 | 139537050 | - |
| SEQ ID NO 13035 | CCTGAATTATACCTCTTTGGCC | TTA | chrX | 139537049 | 139537070 | 139537054 | 139537049 | - |
| SEQ ID NO 13036 | AATTATACCTCTTTGGCCGATT | CTG | chrX | 139537045 | 139537066 | 139537050 | 139537045 | - |
| SEQ ID NO 13037 | TACCTCTTTGGCCGATTCAGAA | TTA | chrX | 139537040 | 139537061 | 139537045 | 139537040 | - |
| SEQ ID NO 13038 | TTTGGCCGATTCAGAATTTTGT | CTC | chrX | 139537034 | 139537055 | 139537039 | 139537034 | - |
| SEQ ID NO 13039 | TGGCCGATTCAGAATTTTGTTG | CTT | chrX | 139537032 | 139537053 | 139537037 | 139537032 | - |
| SEQ ID NO 13040 | GGCCGATTCAGAATTTTGTTGG | TTT | chrX | 139537031 | 139537052 | 139537036 | 139537031 | - |
| SEQ ID NO 13041 | GCCGATTCAGAATTTTGTTGGC | TTG | chrX | 139537030 | 139537051 | 139537035 | 139537030 | - |
| SEQ ID NO 13042 | AGAATTTTGTTGGCGTTTTCAT | TTC | chrX | 139537022 | 139537043 | 139537027 | 139537022 | - |
| SEQ ID NO 13043 | TGTTGGCGTTTTCATGATCAAG | TTT | chrX | 139537015 | 139537036 | 139537020 | 139537015 | - |
| SEQ ID NO 13044 | GTTGGCGTTTTCATGATCAAGA | TTT | chrX | 139537014 | 139537035 | 139537019 | 139537014 | - |
| SEQ ID NO 13045 | TTGGCGTTTTCATGATCAAGAA | TTG | chrX | 139537013 | 139537034 | 139537018 | 139537013 | - |
| SEQ ID NO 13046 | GCGTTTTCATGATCAAGAAAAA | TTG | chrX | 139537010 | 139537031 | 139537015 | 139537010 | - |
| SEQ ID NO 13047 | TCATGATCAAGAAAAACTGAAA | TTT | chrX | 139537004 | 139537025 | 139537009 | 139537004 | - |
| SEQ ID NO 13048 | CATGATCAAGAAAAACTGAAAT | TTT | chrX | 139537003 | 139537024 | 139537008 | 139537003 | - |
| SEQ ID NO 13049 | ATGATCAAGAAAAACTGAAATG | TTC | chrX | 139537002 | 139537023 | 139537007 | 139537002 | - |
| SEQ ID NO 13050 | AAATGTAAAAGAATAATTCTTT | CTG | chrX | 139536985 | 139537006 | 139536990 | 139536985 | - |
| SEQ ID NO 13051 | TTTAGTTTTAGCAAAAAGAAA | TTC | chrX | 139536966 | 139536987 | 139536971 | 139536966 | - |
| SEQ ID NO 13052 | TAGTTTTAGCAAAAAGAAAAC | CTT | chrX | 139536964 | 139536985 | 139536969 | 139536964 | - |
| SEQ ID NO 13053 | AGTTTTAGCAAAAAGAAAACA | TTT | chrX | 139536963 | 139536984 | 139536968 | 139536963 | - |
| SEQ ID NO 13054 | GTTTTAGCAAAAAGAAAACAT | TTA | chrX | 139536962 | 139536983 | 139536967 | 139536962 | - |
| SEQ ID NO 13055 | TAGCAAAAAGAAAACATCATG | TTT | chrX | 139536958 | 139536979 | 139536963 | 139536958 | - |
| SEQ ID NO 13056 | AGCAAAAAGAAAACATCATGA | TTT | chrX | 139536957 | 139536978 | 139536962 | 139536957 | - |
| SEQ ID NO 13057 | GCAAAAAGAAAACATCATGAA | TTA | chrX | 139536956 | 139536977 | 139536961 | 139536956 | - |
| SEQ ID NO 13058 | TACATCTCTTAAGAAAGTCTTT | TTT | chrX | 139536929 | 139536950 | 139536934 | 139536929 | - |
| SEQ ID NO 13059 | ACATCTCTTAAGAAAGTCTTTG | TTT | chrX | 139536928 | 139536949 | 139536933 | 139536928 | - |
| SEQ ID NO 13060 | CATCTCTTAAGAAAGTCTTTGT | TTA | chrX | 139536927 | 139536948 | 139536932 | 139536927 | - |
| SEQ ID NO 13061 | TTAAGAAAGTCTTTGTTTTTAA | CTC | chrX | 139536921 | 139536942 | 139536926 | 139536921 | - |
| SEQ ID NO 13062 | AAGAAAGTCTTTGTTTTTAATC | CTT | chrX | 139536919 | 139536940 | 139536924 | 139536919 | - |
| SEQ ID NO 13063 | AGAAAGTCTTTGTTTTTAATCC | TTA | chrX | 139536918 | 139536939 | 139536923 | 139536918 | - |
| SEQ ID NO 13064 | TGTTTTTAATCCAAATAATCTG | CTT | chrX | 139536908 | 139536929 | 139536913 | 139536908 | - |
| SEQ ID NO 13065 | GTTTTTAATCCAAATAATCTGA | TTT | chrX | 139536907 | 139536928 | 139536912 | 139536907 | - |
| SEQ ID NO 13066 | TTTTTAATCCAAATAATCTGAA | TTG | chrX | 139536906 | 139536927 | 139536911 | 139536906 | - |
| SEQ ID NO 13067 | TTAATCCAAATAATCTGAAAGC | TTT | chrX | 139536903 | 139536924 | 139536908 | 139536903 | - |
| SEQ ID NO 13068 | TAATCCAAATAATCTGAAAGCC | TTT | chrX | 139536902 | 139536923 | 139536907 | 139536902 | - |
| SEQ ID NO 13069 | AATCCAAATAATCTGAAAGCCA | TTT | chrX | 139536901 | 139536922 | 139536906 | 139536901 | - |
| SEQ ID NO 13070 | ATCCAAATAATCTGAAAGCCAA | TTA | chrX | 139536900 | 139536921 | 139536905 | 139536900 | - |
| SEQ ID NO 13071 | AAAGCCAATTTCTCTTTAGGGC | CTG | chrX | 139536886 | 139536907 | 139536891 | 139536886 | - |
| SEQ ID NO 13072 | CTCTTTAGGGCATGGAGCCAAA | TTT | chrX | 139536875 | 139536896 | 139536880 | 139536875 | - |
| SEQ ID NO 13073 | TCTTTAGGGCATGGAGCCAAAA | TTC | chrX | 139536874 | 139536895 | 139536879 | 139536874 | - |
| SEQ ID NO 13074 | TTTAGGGCATGGAGCCAAAATC | CTC | chrX | 139536872 | 139536893 | 139536877 | 139536872 | - |
| SEQ ID NO 13075 | TAGGGCATGGAGCCAAAATCTG | CTT | chrX | 139536870 | 139536891 | 139536875 | 139536870 | - |
| SEQ ID NO 13076 | AGGGCATGGAGCCAAAATCTGT | TTT | chrX | 139536869 | 139536890 | 139536874 | 139536869 | - |
| SEQ ID NO 13077 | GGGCATGGAGCCAAAATCTGTG | TTA | chrX | 139536868 | 139536889 | 139536873 | 139536868 | - |
| SEQ ID NO 13078 | TGATGTTCCCACAGTACTGTAT | CTG | chrX | 139536848 | 139536869 | 139536853 | 139536848 | - |
| SEQ ID NO 13079 | CCACAGTACTGTATACACATGG | TTC | chrX | 139536840 | 139536861 | 139536845 | 139536840 | - |
| SEQ ID NO 13080 | TATACACATGGAGATTTAGGAA | CTG | chrX | 139536829 | 139536850 | 139536834 | 139536829 | - |
| SEQ ID NO 13081 | AGGAATTAAAATTCAATTTTAC | TTT | chrX | 139536812 | 139536833 | 139536817 | 139536812 | - |
| SEQ ID NO 13082 | GGAATTAAAATTCAATTTTACT | TTA | chrX | 139536811 | 139536832 | 139536816 | 139536811 | - |
| SEQ ID NO 13083 | AAATTCAATTTTACTTTTAGTC | TTA | chrX | 139536804 | 139536825 | 139536809 | 139536804 | - |
| SEQ ID NO 13084 | AATTTTACTTTTAGTCAAGAGA | TTC | chrX | 139536798 | 139536819 | 139536803 | 139536798 | - |
| SEQ ID NO 13085 | TACTTTTAGTCAAGAGAATTCC | TTT | chrX | 139536793 | 139536814 | 139536798 | 139536793 | - |
| SEQ ID NO 13086 | ACTTTTAGTCAAGAGAATTCCA | TTT | chrX | 139536792 | 139536813 | 139536797 | 139536792 | - |
| SEQ ID NO 13087 | CTTTTAGTCAAGAGAATTCCAG | TTA | chrX | 139536791 | 139536812 | 139536796 | 139536791 | - |
| SEQ ID NO 13088 | TTAGTCAAGAGAATTCCAGTAA | CTT | chrX | 139536788 | 139536809 | 139536793 | 139536788 | - |
| SEQ ID NO 13089 | TAGTCAAGAGAATTCCAGTAAT | TTT | chrX | 139536787 | 139536808 | 139536792 | 139536787 | - |
| SEQ ID NO 13090 | AGTCAAGAGAATTCCAGTAATA | TTT | chrX | 139536786 | 139536807 | 139536791 | 139536786 | - |

Figure 42 (Cont'd)

| | | | | | | | | |
|---|---|---|---|---|---|---|---|---|
| SEQ ID NO 13091 | GTCAAGAGAATTCCAGTAATAA | TTA | chrX | 139536785 | 139536806 | 139536790 | 139536785 | - |
| SEQ ID NO 13092 | CAGTAATAAAAGGTCAGATTTC | TTC | chrX | 139536772 | 139536793 | 139536777 | 139536772 | - |
| SEQ ID NO 13093 | CTAATCATATTTGAATTTACTT | TTT | chrX | 139536751 | 139536772 | 139536756 | 139536751 | - |
| SEQ ID NO 13094 | TAATCATATTTGAATTTACTTT | TTC | chrX | 139536750 | 139536771 | 139536755 | 139536750 | - |
| SEQ ID NO 13095 | ATCATATTTGAATTTACTTTGG | CTA | chrX | 139536748 | 139536769 | 139536753 | 139536748 | - |
| SEQ ID NO 13096 | GAATTTACTTTGGATGAAAAAG | TTT | chrX | 139536739 | 139536760 | 139536744 | 139536739 | - |
| SEQ ID NO 13097 | AATTTACTTTGGATGAAAAAGA | TTG | chrX | 139536738 | 139536759 | 139536743 | 139536738 | - |
| SEQ ID NO 13098 | ACTTTGGATGAAAAAGAAAGTT | TTT | chrX | 139536733 | 139536754 | 139536738 | 139536733 | - |
| SEQ ID NO 13099 | CTTTGGATGAAAAAGAAAGTTC | TTA | chrX | 139536732 | 139536753 | 139536737 | 139536732 | - |
| SEQ ID NO 13100 | TGGATGAAAAAGAAAGTTCTCA | CTT | chrX | 139536729 | 139536750 | 139536734 | 139536729 | - |
| SEQ ID NO 13101 | GGATGAAAAAGAAAGTTCTCAA | TTT | chrX | 139536728 | 139536749 | 139536733 | 139536728 | - |
| SEQ ID NO 13102 | GATGAAAAAGAAAGTTCTCAAA | TTG | chrX | 139536727 | 139536748 | 139536732 | 139536727 | - |
| SEQ ID NO 13103 | TCAAATGAGCGGTTAACTTCAC | TTC | chrX | 139536710 | 139536731 | 139536715 | 139536710 | - |
| SEQ ID NO 13104 | AAATGAGCGGTTAACTTCACAC | CTC | chrX | 139536708 | 139536729 | 139536713 | 139536708 | - |
| SEQ ID NO 13105 | ACTTCACACTTTGTCATCACTT | TTA | chrX | 139536695 | 139536716 | 139536700 | 139536695 | - |
| SEQ ID NO 13106 | CACACTTTGTCATCACTTGAAA | CTT | chrX | 139536691 | 139536712 | 139536696 | 139536691 | - |
| SEQ ID NO 13107 | ACACTTTGTCATCACTTGAAAA | TTC | chrX | 139536690 | 139536711 | 139536695 | 139536690 | - |
| SEQ ID NO 13108 | TGTCATCACTTGAAAATAGCTC | CTT | chrX | 139536684 | 139536705 | 139536689 | 139536684 | - |
| SEQ ID NO 13109 | GTCATCACTTGAAAATAGCTCA | TTT | chrX | 139536683 | 139536704 | 139536688 | 139536683 | - |
| SEQ ID NO 13110 | TCATCACTTGAAAATAGCTCAT | TTG | chrX | 139536682 | 139536703 | 139536687 | 139536682 | - |
| SEQ ID NO 13111 | GAAAATAGCTCATTGAGGATCT | CTT | chrX | 139536673 | 139536694 | 139536678 | 139536673 | - |
| SEQ ID NO 13112 | AAAATAGCTCATTGAGGATCTT | TTG | chrX | 139536672 | 139536693 | 139536677 | 139536672 | - |
| SEQ ID NO 13113 | ATTGAGGATCTTTGCAAAGTGA | CTC | chrX | 139536662 | 139536683 | 139536667 | 139536662 | - |
| SEQ ID NO 13114 | AGGATCTTTGCAAAGTGATCCA | TTG | chrX | 139536658 | 139536679 | 139536663 | 139536658 | - |
| SEQ ID NO 13115 | TGCAAAGTGATCCATCACCCTG | CTT | chrX | 139536650 | 139536671 | 139536655 | 139536650 | - |
| SEQ ID NO 13116 | GCAAAGTGATCCATCACCCTGG | TTT | chrX | 139536649 | 139536670 | 139536654 | 139536649 | - |
| SEQ ID NO 13117 | CAAAGTGATCCATCACCCTGGC | TTG | chrX | 139536648 | 139536669 | 139536653 | 139536648 | - |
| SEQ ID NO 13118 | GCTGGGCTGTTTTCAGAATATG | CTG | chrX | 139536628 | 139536649 | 139536633 | 139536628 | - |
| SEQ ID NO 13119 | GGCTGTTTTCAGAATATGGTTG | CTG | chrX | 139536624 | 139536645 | 139536629 | 139536624 | - |
| SEQ ID NO 13120 | TTTTCAGAATATGGTTGCCCAA | CTG | chrX | 139536619 | 139536640 | 139536624 | 139536619 | - |
| SEQ ID NO 13121 | TCAGAATATGGTTGCCCAAATG | TTT | chrX | 139536616 | 139536637 | 139536621 | 139536616 | - |
| SEQ ID NO 13122 | CAGAATATGGTTGCCCAAATGA | TTT | chrX | 139536615 | 139536636 | 139536620 | 139536615 | - |
| SEQ ID NO 13123 | AGAATATGGTTGCCCAAATGAC | TTC | chrX | 139536614 | 139536635 | 139536619 | 139536614 | - |
| SEQ ID NO 13124 | CCCAAATGACTTTGAACAAATG | TTG | chrX | 139536602 | 139536623 | 139536607 | 139536602 | - |
| SEQ ID NO 13125 | TGAACAAATGTCTCCTGAAGAA | CTT | chrX | 139536590 | 139536611 | 139536595 | 139536590 | - |
| SEQ ID NO 13126 | GAACAAATGTCTCCTGAAGAAC | TTT | chrX | 139536589 | 139536610 | 139536594 | 139536589 | - |
| SEQ ID NO 13127 | AACAAATGTCTCCTGAAGAACA | TTG | chrX | 139536588 | 139536609 | 139536593 | 139536588 | - |
| SEQ ID NO 13128 | CTGAAGAACAGAAGCCTAATTA | CTC | chrX | 139536576 | 139536597 | 139536581 | 139536576 | - |
| SEQ ID NO 13129 | AAGAACAGAAGCCTAATTATGG | CTG | chrX | 139536573 | 139536594 | 139536578 | 139536573 | - |
| SEQ ID NO 13130 | ATTATGGCCAGCTGCAAATGT | CTA | chrX | 139536558 | 139536579 | 139536563 | 139536558 | - |
| SEQ ID NO 13131 | TGGTCCAGCTGCAAATGTGACC | TTA | chrX | 139536554 | 139536575 | 139536559 | 139536554 | - |
| SEQ ID NO 13132 | CAAATGTGACCCAGTGTCTGT | CTG | chrX | 139536543 | 139536564 | 139536548 | 139536543 | - |
| SEQ ID NO 13133 | TCACTAGATGTTAAAGAAAAAT | CTG | chrX | 139536522 | 139536543 | 139536527 | 139536522 | - |
| SEQ ID NO 13134 | GATGTTAAAGAAAAATCACTGC | CTA | chrX | 139536516 | 139536537 | 139536521 | 139536516 | - |
| SEQ ID NO 13135 | AAGAAAAATCACTGCATTAATT | TTA | chrX | 139536509 | 139536530 | 139536514 | 139536509 | - |
| SEQ ID NO 13136 | CATTAATTTAAAAAGCAATTT | CTG | chrX | 139536495 | 139536516 | 139536500 | 139536495 | - |
| SEQ ID NO 13137 | ATTTAAAAAGCAATTTCAGAT | TTA | chrX | 139536490 | 139536511 | 139536495 | 139536490 | - |
| SEQ ID NO 13138 | AAAAAGCAATTTCAGATCAAC | TTT | chrX | 139536486 | 139536507 | 139536491 | 139536486 | - |
| SEQ ID NO 13139 | AAAAGCAATTTCAGATCAACA | TTA | chrX | 139536485 | 139536506 | 139536490 | 139536485 | - |
| SEQ ID NO 13140 | CAGATCAACAGCACCTTTGGTT | TTT | chrX | 139536473 | 139536494 | 139536478 | 139536473 | - |
| SEQ ID NO 13141 | AGATCAACAGCACCTTTGGTTG | TTC | chrX | 139536472 | 139536493 | 139536477 | 139536472 | - |
| SEQ ID NO 13142 | TGGTTGGCAAGTGTTATAGGAA | CTT | chrX | 139536456 | 139536477 | 139536461 | 139536456 | - |
| SEQ ID NO 13143 | GGTTGGCAAGTGTTATAGGAAT | TTT | chrX | 139536455 | 139536476 | 139536460 | 139536455 | - |
| SEQ ID NO 13144 | GTTGGCAAGTGTTATAGGAATT | TTG | chrX | 139536454 | 139536475 | 139536459 | 139536454 | - |
| SEQ ID NO 13145 | GCAAGTGTTATAGGAATTGCAG | TTG | chrX | 139536450 | 139536471 | 139536455 | 139536450 | - |
| SEQ ID NO 13146 | TAGGAATTGCAGTGATTTAAGC | TTA | chrX | 139536440 | 139536461 | 139536445 | 139536440 | - |
| SEQ ID NO 13147 | CAGTGATTTAAGCATCTCTCTA | TTG | chrX | 139536431 | 139536452 | 139536436 | 139536431 | - |
| SEQ ID NO 13148 | AAGCATCTCTCTAGAATTCAGG | TTT | chrX | 139536422 | 139536443 | 139536427 | 139536422 | - |
| SEQ ID NO 13149 | AGCATCTCTCTAGAATTCAGGA | TTA | chrX | 139536421 | 139536442 | 139536426 | 139536421 | - |

Figure 42 (Cont'd)

| | | | | | | | | |
|---|---|---|---|---|---|---|---|---|
| SEQ ID NO 13150 | TCTAGAATTCAGGATATGTTTT | CTC | chrX | 139536413 | 139536434 | 139536418 | 139536413 | - |
| SEQ ID NO 13151 | TAGAATTCAGGATATGTTTTT | CTC | chrX | 139536411 | 139536432 | 139536416 | 139536411 | - |
| SEQ ID NO 13152 | GAATTCAGGATATGTTTTTTTT | CTA | chrX | 139536409 | 139536430 | 139536414 | 139536409 | - |
| SEQ ID NO 13153 | AGGATATGTTTTTTTAAGCTA | TTC | chrX | 139536403 | 139536424 | 139536408 | 139536403 | - |
| SEQ ID NO 13154 | TTTTTAAGCTACATCTACCTAG | TTT | chrX | 139536392 | 139536413 | 139536397 | 139536392 | - |
| SEQ ID NO 13155 | TTTTAAGCTACATCTACCTAGT | TTT | chrX | 139536391 | 139536412 | 139536396 | 139536391 | - |
| SEQ ID NO 13156 | TTTAAGCTACATCTACCTAGTC | TTT | chrX | 139536390 | 139536411 | 139536395 | 139536390 | - |
| SEQ ID NO 13157 | TTAAGCTACATCTACCTAGTCT | TTT | chrX | 139536389 | 139536410 | 139536394 | 139536389 | - |
| SEQ ID NO 13158 | TAAGCTACATCTACCTAGTCTG | TTT | chrX | 139536388 | 139536409 | 139536393 | 139536388 | - |
| SEQ ID NO 13159 | AAGCTACATCTACCTAGTCTGA | TTT | chrX | 139536387 | 139536408 | 139536392 | 139536387 | - |
| SEQ ID NO 13160 | AGCTACATCTACCTAGTCTGAA | TTA | chrX | 139536386 | 139536407 | 139536391 | 139536386 | - |
| SEQ ID NO 13161 | CATCTACCTAGTCTGAAGAGAC | CTA | chrX | 139536381 | 139536402 | 139536386 | 139536381 | - |
| SEQ ID NO 13162 | CCTAGTCTGAAGAGACACTCCT | CTA | chrX | 139536375 | 139536396 | 139536380 | 139536375 | - |
| SEQ ID NO 13163 | GTCTGAAGAGACACTCCTGAAC | CTA | chrX | 139536371 | 139536392 | 139536376 | 139536371 | - |
| SEQ ID NO 13164 | AAGAGACACTCCTGAACTCTGG | CTG | chrX | 139536366 | 139536387 | 139536371 | 139536366 | - |
| SEQ ID NO 13165 | CTGAACTCTGGAGGATAGATGT | CTC | chrX | 139536355 | 139536376 | 139536360 | 139536355 | - |
| SEQ ID NO 13166 | AACTCTGGAGGATAGATGTCTC | CTG | chrX | 139536352 | 139536373 | 139536357 | 139536352 | - |
| SEQ ID NO 13167 | TGGAGGATAGATGTCTCTATCT | CTC | chrX | 139536347 | 139536368 | 139536352 | 139536347 | - |
| SEQ ID NO 13168 | GAGGATAGATGTCTCTATCTGA | CTG | chrX | 139536345 | 139536366 | 139536350 | 139536345 | - |
| SEQ ID NO 13169 | TATCTGAATCATATTTCTCCTT | CTC | chrX | 139536330 | 139536351 | 139536335 | 139536330 | - |
| SEQ ID NO 13170 | TCTGAATCATATTTCTCCTTCC | CTA | chrX | 139536328 | 139536349 | 139536333 | 139536328 | - |
| SEQ ID NO 13171 | AATCATATTTCTCCTTCCCTCC | CTG | chrX | 139536324 | 139536345 | 139536329 | 139536324 | - |
| SEQ ID NO 13172 | CTCCTTCCCTCCCTCCTTCCTC | TTT | chrX | 139536314 | 139536335 | 139536319 | 139536314 | - |
| SEQ ID NO 13173 | TCCTTCCCTCCCTCCTTCCTCT | TTC | chrX | 139536313 | 139536334 | 139536318 | 139536313 | - |
| SEQ ID NO 13174 | CTTCCCTCCCTCCTTCCTCTCC | CTC | chrX | 139536311 | 139536332 | 139536316 | 139536311 | - |
| SEQ ID NO 13175 | CCCTCCCTCCTTCCTCTCCTCT | CTT | chrX | 139536308 | 139536329 | 139536313 | 139536308 | - |
| SEQ ID NO 13176 | CCTCCCTCCTTCCTCTCCTCTC | TTC | chrX | 139536307 | 139536328 | 139536312 | 139536307 | - |
| SEQ ID NO 13177 | CCTCCTTCCTCTCCTCTCCTCT | CTC | chrX | 139536303 | 139536324 | 139536308 | 139536303 | - |
| SEQ ID NO 13178 | CTTCCTCTCCTCTCCTCTCTCT | CTC | chrX | 139536299 | 139536320 | 139536304 | 139536299 | - |
| SEQ ID NO 13179 | CCTCTCCTCTCCTCTCTCTCTC | CTT | chrX | 139536296 | 139536317 | 139536301 | 139536296 | - |
| SEQ ID NO 13180 | CTCTCCTCTCCTCTCTCTCTCT | TTC | chrX | 139536295 | 139536316 | 139536300 | 139536295 | - |
| SEQ ID NO 13181 | TCCTCTCCTCTCTCTCTCTCTC | CTC | chrX | 139536292 | 139536313 | 139536297 | 139536292 | - |
| SEQ ID NO 13182 | CTCTCCTCTCTCTCTCTCTCTA | CTC | chrX | 139536290 | 139536311 | 139536295 | 139536290 | - |
| SEQ ID NO 13183 | TCCTCTCTCTCTCTCTCTATGT | CTC | chrX | 139536287 | 139536308 | 139536292 | 139536287 | - |
| SEQ ID NO 13184 | CTCTCTCTCTCTCTCTATGTGT | CTC | chrX | 139536285 | 139536306 | 139536290 | 139536285 | - |
| SEQ ID NO 13185 | TCTCTCTCTCTATGTGTGTG | CTC | chrX | 139536282 | 139536303 | 139536287 | 139536282 | - |
| SEQ ID NO 13186 | TCTCTCTCTATGTGTGTGTG | CTC | chrX | 139536280 | 139536301 | 139536285 | 139536280 | - |
| SEQ ID NO 13187 | TCTCTCTATGTGTGTGTGTG | CTC | chrX | 139536278 | 139536299 | 139536283 | 139536278 | - |
| SEQ ID NO 13188 | TCTCTCTATGTGTGTGTGTGTA | CTC | chrX | 139536276 | 139536297 | 139536281 | 139536276 | - |
| SEQ ID NO 13189 | TCTCTATGTGTGTGTGTGTACA | CTC | chrX | 139536274 | 139536295 | 139536279 | 139536274 | - |
| SEQ ID NO 13190 | TCTATGTGTGTGTGTGTACATA | CTC | chrX | 139536272 | 139536293 | 139536277 | 139536272 | - |
| SEQ ID NO 13191 | TATGTGTGTGTGTACATATA | CTC | chrX | 139536270 | 139536291 | 139536275 | 139536270 | - |
| SEQ ID NO 13192 | TGTGTGTGTGTACATATATA | CTA | chrX | 139536268 | 139536289 | 139536273 | 139536268 | - |
| SEQ ID NO 13193 | GCTGCACAATGACATTTTGGTC | TTT | chrX | 139536083 | 139536104 | 139536088 | 139536083 | - |
| SEQ ID NO 13194 | CTGCACAATGACATTTTGGTCA | TTG | chrX | 139536082 | 139536103 | 139536087 | 139536082 | - |
| SEQ ID NO 13195 | CACAATGACATTTTGGTCAATG | CTG | chrX | 139536079 | 139536100 | 139536084 | 139536079 | - |
| SEQ ID NO 13196 | TGGTCAATGATGGACCACATTA | TTT | chrX | 139536066 | 139536087 | 139536071 | 139536066 | - |
| SEQ ID NO 13197 | GGTCAATGATGGACCACATTAT | TTT | chrX | 139536065 | 139536086 | 139536070 | 139536065 | - |
| SEQ ID NO 13198 | GTCAATGATGGACCACATTATA | TTG | chrX | 139536064 | 139536085 | 139536069 | 139536064 | - |
| SEQ ID NO 13199 | TACGACAGTGGTCCCATAAGGT | TTA | chrX | 139536044 | 139536065 | 139536049 | 139536044 | - |
| SEQ ID NO 13200 | TAATACTGTATTTTCACTGTAC | TTA | chrX | 139536020 | 139536041 | 139536025 | 139536020 | - |
| SEQ ID NO 13201 | TATTTTCACTGTACCTTTTCTA | CTG | chrX | 139536012 | 139536033 | 139536017 | 139536012 | - |
| SEQ ID NO 13202 | TCACTGTACCTTTTCTATGTTT | TTT | chrX | 139536007 | 139536028 | 139536012 | 139536007 | - |
| SEQ ID NO 13203 | CACTGTACCTTTTCTATGTTTA | TTT | chrX | 139536006 | 139536027 | 139536011 | 139536006 | - |
| SEQ ID NO 13204 | ACTGTACCTTTTCTATGTTTAG | TTC | chrX | 139536005 | 139536026 | 139536010 | 139536005 | - |
| SEQ ID NO 13205 | TACCTTTTCTATGTTTAGATAC | CTG | chrX | 139536001 | 139536022 | 139536006 | 139536001 | - |
| SEQ ID NO 13206 | TTCTATGTTTAGATACACAAAT | CTT | chrX | 139535995 | 139536016 | 139536000 | 139535995 | - |
| SEQ ID NO 13207 | TCTATGTTTAGATACACAAATA | TTT | chrX | 139535994 | 139536015 | 139535999 | 139535994 | - |
| SEQ ID NO 13208 | CTATGTTTAGATACACAAATAC | TTT | chrX | 139535993 | 139536014 | 139535998 | 139535993 | - |

Figure 42 (Cont'd)

| SEQ ID NO 13209 | TATGTTTAGATACACAAATACC | TTC | chrX | 139535992 | 139536013 | 139535997 | 139535992 | - |
|---|---|---|---|---|---|---|---|---|
| SEQ ID NO 13210 | TGTTTAGATACACAAATACCAC | CTA | chrX | 139535990 | 139536011 | 139535995 | 139535990 | - |
| SEQ ID NO 13211 | AGATACACAAATACCACTGTTA | TTT | chrX | 139535985 | 139536006 | 139535990 | 139535985 | - |
| SEQ ID NO 13212 | GATACACAAATACCACTGTTAC | TTA | chrX | 139535984 | 139536005 | 139535989 | 139535984 | - |
| SEQ ID NO 13213 | TTACCATTGCCTACAGTGTTCA | CTG | chrX | 139535966 | 139535987 | 139535971 | 139535966 | - |
| SEQ ID NO 13214 | CCATTGCCTACAGTGTTCAGTA | TTA | chrX | 139535963 | 139535984 | 139535968 | 139535963 | - |
| SEQ ID NO 13215 | CCTACAGTGTTCAGTACAGTCA | TTG | chrX | 139535957 | 139535978 | 139535962 | 139535957 | - |
| SEQ ID NO 13216 | CAGTGTTCAGTACAGTCACATG | CTA | chrX | 139535953 | 139535974 | 139535958 | 139535953 | - |
| SEQ ID NO 13217 | AGTACAGTCACATGCTGTACAG | TTC | chrX | 139535945 | 139535966 | 139535950 | 139535945 | - |
| SEQ ID NO 13218 | TACAGGTTTGCAGCCCAGGAGC | CTG | chrX | 139535928 | 139535949 | 139535933 | 139535928 | - |
| SEQ ID NO 13219 | GCAGCCCAGGAGCCTAGGAGCA | TTT | chrX | 139535919 | 139535940 | 139535924 | 139535919 | - |
| SEQ ID NO 13220 | CAGCCCAGGAGCCTAGGAGCAA | TTG | chrX | 139535918 | 139535939 | 139535923 | 139535918 | - |
| SEQ ID NO 13221 | GGAGCAATAGGCCACATCAATA | CTA | chrX | 139535903 | 139535924 | 139535908 | 139535903 | - |
| SEQ ID NO 13222 | GGTATGTAGTAAGCTATACCAT | CTA | chrX | 139535874 | 139535895 | 139535879 | 139535874 | - |
| SEQ ID NO 13223 | TACCATTTAGGTTTAGGTAAGT | CTA | chrX | 139535858 | 139535879 | 139535863 | 139535858 | - |
| SEQ ID NO 13224 | AGGTTTAGGTAAGTACACTCTA | TTT | chrX | 139535850 | 139535871 | 139535855 | 139535850 | - |
| SEQ ID NO 13225 | GGTTTAGGTAAGTACACTCTAT | TTA | chrX | 139535849 | 139535870 | 139535854 | 139535849 | - |
| SEQ ID NO 13226 | AGGTAAGTACACTCTATTATGT | TTT | chrX | 139535844 | 139535865 | 139535849 | 139535844 | - |
| SEQ ID NO 13227 | GGTAAGTACACTCTATTATGTT | TTA | chrX | 139535843 | 139535864 | 139535848 | 139535843 | - |
| SEQ ID NO 13228 | TATTATGTTCGCACAATGATGA | CTC | chrX | 139535830 | 139535851 | 139535835 | 139535830 | - |
| SEQ ID NO 13229 | TTATGTTCGCACAATGATGAAA | CTA | chrX | 139535828 | 139535849 | 139535833 | 139535828 | - |
| SEQ ID NO 13230 | TGTTCGCACAATGATGAAATTG | TTA | chrX | 139535825 | 139535846 | 139535830 | 139535825 | - |
| SEQ ID NO 13231 | GCACAATGATGAAATTGCTTAA | TTC | chrX | 139535820 | 139535841 | 139535825 | 139535820 | - |
| SEQ ID NO 13232 | CTTAATGACACATTTCTCAGAA | TTG | chrX | 139535803 | 139535824 | 139535808 | 139535803 | - |
| SEQ ID NO 13233 | AATGACACATTTCTCAGAATAT | CTT | chrX | 139535800 | 139535821 | 139535805 | 139535800 | - |
| SEQ ID NO 13234 | ATGACACATTTCTCAGAATATA | TTA | chrX | 139535799 | 139535820 | 139535804 | 139535799 | - |
| SEQ ID NO 13235 | CTCAGAATATATCCCCATTGTT | TTT | chrX | 139535788 | 139535809 | 139535793 | 139535788 | - |
| SEQ ID NO 13236 | TCAGAATATATCCCCATTGTTA | TTC | chrX | 139535787 | 139535808 | 139535792 | 139535787 | - |
| SEQ ID NO 13237 | AGAATATATCCCCATTGTTAAG | CTC | chrX | 139535785 | 139535806 | 139535790 | 139535785 | - |
| SEQ ID NO 13238 | TTAAGGAATGCATGGCTGTATA | TTG | chrX | 139535768 | 139535789 | 139535773 | 139535768 | - |
| SEQ ID NO 13239 | AGGAATGCATGGCTGTATACAC | TTA | chrX | 139535765 | 139535786 | 139535770 | 139535765 | - |
| SEQ ID NO 13240 | TATACACACATGTGTTTGTG | CTG | chrX | 139535750 | 139535771 | 139535755 | 139535750 | - |
| SEQ ID NO 13241 | GTGTGTTTTCATGTATATACAT | TTT | chrX | 139535731 | 139535752 | 139535736 | 139535731 | - |
| SEQ ID NO 13242 | TGTGTTTTCATGTATATACATA | TTG | chrX | 139535730 | 139535751 | 139535735 | 139535730 | - |
| SEQ ID NO 13243 | TCATGTATATACATATATGTGT | TTT | chrX | 139535723 | 139535744 | 139535728 | 139535723 | - |
| SEQ ID NO 13244 | CATGTATATACATATATGTGTG | TTT | chrX | 139535722 | 139535743 | 139535727 | 139535722 | - |
| SEQ ID NO 13245 | ATGTATATACATATATGTGTGT | TTC | chrX | 139535721 | 139535742 | 139535726 | 139535721 | - |
| SEQ ID NO 13246 | ATAACAGGGACTCAAGAAGTTG | TTA | chrX | 139535684 | 139535705 | 139535689 | 139535684 | - |
| SEQ ID NO 13247 | AAGAAGTTGCCTGGAGTTGTTC | CTC | chrX | 139535671 | 139535692 | 139535676 | 139535671 | - |
| SEQ ID NO 13248 | CCTGGAGTTGTTCCTTTCTTCA | TTG | chrX | 139535662 | 139535683 | 139535667 | 139535662 | - |
| SEQ ID NO 13249 | GAGTTGTTCCTTTCTTCAAGGG | CTG | chrX | 139535658 | 139535679 | 139535663 | 139535658 | - |
| SEQ ID NO 13250 | TTCCTTTCTTCAAGGGTCTAGC | TTG | chrX | 139535652 | 139535673 | 139535657 | 139535652 | - |
| SEQ ID NO 13251 | CTTTCTTCAAGGGTCTAGCAAT | TTC | chrX | 139535649 | 139535670 | 139535654 | 139535649 | - |
| SEQ ID NO 13252 | TCTTCAAGGGTCTAGCAATATA | CTT | chrX | 139535646 | 139535667 | 139535651 | 139535646 | - |
| SEQ ID NO 13253 | CTTCAAGGGTCTAGCAATATAT | TTT | chrX | 139535645 | 139535666 | 139535650 | 139535645 | - |
| SEQ ID NO 13254 | TTCAAGGGTCTAGCAATATATC | TTC | chrX | 139535644 | 139535665 | 139535649 | 139535644 | - |
| SEQ ID NO 13255 | CAAGGGTCTAGCAATATATCTG | CTT | chrX | 139535642 | 139535663 | 139535647 | 139535642 | - |
| SEQ ID NO 13256 | AAGGGTCTAGCAATATATCTGA | TTC | chrX | 139535641 | 139535662 | 139535646 | 139535641 | - |
| SEQ ID NO 13257 | GCAATATATCTGATACCATCTC | CTA | chrX | 139535632 | 139535653 | 139535637 | 139535632 | - |
| SEQ ID NO 13258 | ATACCATCTCAAGAGGACCAAG | CTG | chrX | 139535620 | 139535641 | 139535625 | 139535620 | - |
| SEQ ID NO 13259 | AAGAGGACCAAGGGCTTATAAG | CTC | chrX | 139535610 | 139535631 | 139535615 | 139535610 | - |
| SEQ ID NO 13260 | ATAAGATGAACTTTCTGGGGTA | CTT | chrX | 139535593 | 139535614 | 139535598 | 139535593 | - |
| SEQ ID NO 13261 | TAAGATGAACTTTCTGGGGTAT | TTA | chrX | 139535592 | 139535613 | 139535597 | 139535592 | - |
| SEQ ID NO 13262 | TCTGGGGTATTTGGGACTACTT | CTT | chrX | 139535580 | 139535601 | 139535585 | 139535580 | - |
| SEQ ID NO 13263 | CTGGGGTATTTGGGACTACTTC | TTT | chrX | 139535579 | 139535600 | 139535584 | 139535579 | - |
| SEQ ID NO 13264 | TGGGGTATTTGGGACTACTTCC | TTC | chrX | 139535578 | 139535599 | 139535583 | 139535578 | - |
| SEQ ID NO 13265 | GGGTATTTGGGACTACTTCCTG | CTG | chrX | 139535576 | 139535597 | 139535581 | 139535576 | - |
| SEQ ID NO 13266 | GGGACTACTTCCTGATTAACTC | TTT | chrX | 139535568 | 139535589 | 139535573 | 139535568 | - |
| SEQ ID NO 13267 | GGACTACTTCCTGATTAACTCC | TTG | chrX | 139535567 | 139535588 | 139535572 | 139535567 | - |

Figure 42 (Cont'd)

| | | | | | | | | |
|---|---|---|---|---|---|---|---|---|
| SEQ ID NO 13268 | CTTCCTGATTAACTCCAAAAAG | CTA | chrX | 139535561 | 139535582 | 139535566 | 139535561 | - |
| SEQ ID NO 13269 | CCTGATTAACTCCAAAAAGGAA | CTT | chrX | 139535558 | 139535579 | 139535563 | 139535558 | - |
| SEQ ID NO 13270 | CTGATTAACTCCAAAAAGGAAG | TTC | chrX | 139535557 | 139535578 | 139535562 | 139535557 | - |
| SEQ ID NO 13271 | ATTAACTCCAAAAAGGAAGAGA | CTG | chrX | 139535554 | 139535575 | 139535559 | 139535554 | - |
| SEQ ID NO 13272 | ACTCCAAAAAGGAAGAGAAAGG | TTA | chrX | 139535550 | 139535571 | 139535555 | 139535550 | - |
| SEQ ID NO 13273 | CAAAAAGGAAGAGAAAGGAAAG | CTC | chrX | 139535546 | 139535567 | 139535551 | 139535546 | - |
| SEQ ID NO 13274 | AACTTTCTTCCCTTATTTTCAT | CTA | chrX | 139535491 | 139535512 | 139535496 | 139535491 | - |
| SEQ ID NO 13275 | TCTTCCCTTATTTTCATTGCAG | CTT | chrX | 139535486 | 139535507 | 139535491 | 139535486 | - |
| SEQ ID NO 13276 | CTTCCCTTATTTTCATTGCAGC | TTT | chrX | 139535485 | 139535506 | 139535490 | 139535485 | - |
| SEQ ID NO 13277 | TTCCCTTATTTTCATTGCAGCT | TTC | chrX | 139535484 | 139535505 | 139535489 | 139535484 | - |
| SEQ ID NO 13278 | CCCTTATTTTCATTGCAGCTGT | CTT | chrX | 139535482 | 139535503 | 139535487 | 139535482 | - |
| SEQ ID NO 13279 | CCTTATTTTCATTGCAGCTGTT | TTC | chrX | 139535481 | 139535502 | 139535486 | 139535481 | - |
| SEQ ID NO 13280 | ATTTTCATTGCAGCTGTTCACT | CTT | chrX | 139535477 | 139535498 | 139535482 | 139535477 | - |
| SEQ ID NO 13281 | TTTTCATTGCAGCTGTTCACTT | TTA | chrX | 139535476 | 139535497 | 139535481 | 139535476 | - |
| SEQ ID NO 13282 | TCATTGCAGCTGTTCACTTTAT | TTT | chrX | 139535473 | 139535494 | 139535478 | 139535473 | - |
| SEQ ID NO 13283 | CATTGCAGCTGTTCACTTTATG | TTT | chrX | 139535472 | 139535493 | 139535477 | 139535472 | - |
| SEQ ID NO 13284 | ATTGCAGCTGTTCACTTTATGG | TTC | chrX | 139535471 | 139535492 | 139535476 | 139535471 | - |
| SEQ ID NO 13285 | CAGCTGTTCACTTTATGGAGTG | TTG | chrX | 139535467 | 139535488 | 139535472 | 139535467 | - |
| SEQ ID NO 13286 | TTCACTTTATGGAGTGTTCTAG | CTG | chrX | 139535461 | 139535482 | 139535466 | 139535461 | - |
| SEQ ID NO 13287 | ACTTTATGGAGTGTTCTAGTCC | TTC | chrX | 139535458 | 139535479 | 139535463 | 139535458 | - |
| SEQ ID NO 13288 | TATGGAGTGTTCTAGTCCCTTG | CTT | chrX | 139535454 | 139535475 | 139535459 | 139535454 | - |
| SEQ ID NO 13289 | ATGGAGTGTTCTAGTCCCTTGA | TTT | chrX | 139535453 | 139535474 | 139535458 | 139535453 | - |
| SEQ ID NO 13290 | TGGAGTGTTCTAGTCCCTTGAC | TTA | chrX | 139535452 | 139535473 | 139535457 | 139535452 | - |
| SEQ ID NO 13291 | TAGTCCCTTGACATCCCTGCTT | TTC | chrX | 139535442 | 139535463 | 139535447 | 139535442 | - |
| SEQ ID NO 13292 | GTCCCTTGACATCCCTGCTTTT | CTA | chrX | 139535440 | 139535461 | 139535445 | 139535440 | - |
| SEQ ID NO 13293 | GACATCCCTGCTTTTCCCTTGC | CTT | chrX | 139535433 | 139535454 | 139535438 | 139535433 | - |
| SEQ ID NO 13294 | ACATCCCTGCTTTTCCCTTGCT | TTG | chrX | 139535432 | 139535453 | 139535437 | 139535432 | - |
| SEQ ID NO 13295 | CTTTTCCCTTGCTCTGCAAGTT | CTG | chrX | 139535423 | 139535444 | 139535428 | 139535423 | - |
| SEQ ID NO 13296 | TTCCCTTGCTCTGCAAGTTCCT | CTT | chrX | 139535420 | 139535441 | 139535425 | 139535420 | - |
| SEQ ID NO 13297 | TCCCTTGCTCTGCAAGTTCCTT | TTT | chrX | 139535419 | 139535440 | 139535424 | 139535419 | - |
| SEQ ID NO 13298 | CCCTTGCTCTGCAAGTTCCTTT | TTT | chrX | 139535418 | 139535439 | 139535423 | 139535418 | - |
| SEQ ID NO 13299 | CCTTGCTCTGCAAGTTCCTTTT | TTC | chrX | 139535417 | 139535438 | 139535422 | 139535417 | - |
| SEQ ID NO 13300 | GCTCTGCAAGTTCCTTTTGGGC | CTT | chrX | 139535413 | 139535434 | 139535418 | 139535413 | - |
| SEQ ID NO 13301 | CTCTGCAAGTTCCTTTTGGGCT | TTG | chrX | 139535412 | 139535433 | 139535417 | 139535412 | - |
| SEQ ID NO 13302 | TGCAAGTTCCTTTTGGGCTCAC | CTC | chrX | 139535409 | 139535430 | 139535414 | 139535409 | - |
| SEQ ID NO 13303 | CAAGTTCCTTTTGGGCTCACTT | CTG | chrX | 139535407 | 139535428 | 139535412 | 139535407 | - |
| SEQ ID NO 13304 | CTTTTGGGCTCACTTTTTTTCT | TTC | chrX | 139535400 | 139535421 | 139535405 | 139535400 | - |
| SEQ ID NO 13305 | TTGGGCTCACTTTTTTTCTTTG | CTT | chrX | 139535397 | 139535418 | 139535402 | 139535397 | - |
| SEQ ID NO 13306 | TGGGCTCACTTTTTTTCTTTGA | TTT | chrX | 139535396 | 139535417 | 139535401 | 139535396 | - |
| SEQ ID NO 13307 | GGGCTCACTTTTTTTCTTTGAA | TTT | chrX | 139535395 | 139535416 | 139535400 | 139535395 | - |
| SEQ ID NO 13308 | GGCTCACTTTTTTTCTTTGAAT | TTG | chrX | 139535394 | 139535415 | 139535399 | 139535394 | - |
| SEQ ID NO 13309 | ACTTTTTTTCTTTGAATTTAGC | CTC | chrX | 139535389 | 139535410 | 139535394 | 139535389 | - |
| SEQ ID NO 13310 | TTTTTCTTTGAATTTAGCCTAG | CTT | chrX | 139535385 | 139535406 | 139535390 | 139535385 | - |
| SEQ ID NO 13311 | TTTTCTTTGAATTTAGCCTAGA | TTT | chrX | 139535384 | 139535405 | 139535389 | 139535384 | - |
| SEQ ID NO 13312 | TTTCTTTGAATTTAGCCTAGAC | TTT | chrX | 139535383 | 139535404 | 139535388 | 139535383 | - |
| SEQ ID NO 13313 | TTCTTTGAATTTAGCCTAGACT | TTT | chrX | 139535382 | 139535403 | 139535387 | 139535382 | - |
| SEQ ID NO 13314 | TCTTTGAATTTAGCCTAGACTT | TTT | chrX | 139535381 | 139535402 | 139535386 | 139535381 | - |
| SEQ ID NO 13315 | CTTTGAATTTAGCCTAGACTTT | TTT | chrX | 139535380 | 139535401 | 139535385 | 139535380 | - |
| SEQ ID NO 13316 | TTTGAATTTAGCCTAGACTTTT | TTC | chrX | 139535379 | 139535400 | 139535384 | 139535379 | - |
| SEQ ID NO 13317 | TGAATTTAGCCTAGACTTTTTC | CTT | chrX | 139535377 | 139535398 | 139535382 | 139535377 | - |
| SEQ ID NO 13318 | GAATTTAGCCTAGACTTTTTCT | TTT | chrX | 139535376 | 139535397 | 139535381 | 139535376 | - |
| SEQ ID NO 13319 | AATTTAGCCTAGACTTTTTCTC | TTG | chrX | 139535375 | 139535396 | 139535380 | 139535375 | - |
| SEQ ID NO 13320 | AGCCTAGACTTTTTCTCTTCAA | TTT | chrX | 139535370 | 139535391 | 139535375 | 139535370 | - |
| SEQ ID NO 13321 | GCCTAGACTTTTTCTCTTCAAC | TTA | chrX | 139535369 | 139535390 | 139535374 | 139535369 | - |
| SEQ ID NO 13322 | GACTTTTTCTCTTCAACTCTTT | CTA | chrX | 139535364 | 139535385 | 139535369 | 139535364 | - |
| SEQ ID NO 13323 | TTTCTCTTCAACTCTTTTTTTT | CTT | chrX | 139535359 | 139535380 | 139535364 | 139535359 | - |
| SEQ ID NO 13324 | TTCTCTTCAACTCTTTTTTTTT | TTT | chrX | 139535358 | 139535379 | 139535363 | 139535358 | - |
| SEQ ID NO 13325 | TCTCTTCAACTCTTTTTTTTTT | TTT | chrX | 139535357 | 139535378 | 139535362 | 139535357 | - |
| SEQ ID NO 13326 | CTCTTCAACTCTTTTTTTTTTG | TTT | chrX | 139535356 | 139535377 | 139535361 | 139535356 | - |

Figure 42 (Cont'd)

| | | | | | | | | |
|---|---|---|---|---|---|---|---|---|
| SEQ ID NO 13327 | TCTTCAACTCTTTTTTTTTGA | TTC | chrX | 139535355 | 139535376 | 139535360 | 139535355 | - |
| SEQ ID NO 13328 | TTCAACTCTTTTTTTTTGACA | CTC | chrX | 139535353 | 139535374 | 139535358 | 139535353 | - |
| SEQ ID NO 13329 | CAACTCTTTTTTTTTGACAGA | CTT | chrX | 139535351 | 139535372 | 139535356 | 139535351 | - |
| SEQ ID NO 13330 | AACTCTTTTTTTTTGACAGAG | TTC | chrX | 139535350 | 139535371 | 139535355 | 139535350 | - |
| SEQ ID NO 13331 | TTTTTTTTTGACAGAGTCTTG | CTC | chrX | 139535345 | 139535366 | 139535350 | 139535345 | - |
| SEQ ID NO 13332 | TTTTTTTTGACAGAGTCTTGCT | CTT | chrX | 139535343 | 139535364 | 139535348 | 139535343 | - |
| SEQ ID NO 13333 | TTTTTTTGACAGAGTCTTGCTC | TTT | chrX | 139535342 | 139535363 | 139535347 | 139535342 | - |
| SEQ ID NO 13334 | TTTTTTGACAGAGTCTTGCTCT | TTT | chrX | 139535341 | 139535362 | 139535346 | 139535341 | - |
| SEQ ID NO 13335 | TTTTTGACAGAGTCTTGCTCTG | TTT | chrX | 139535340 | 139535361 | 139535345 | 139535340 | - |
| SEQ ID NO 13336 | TTTTGACAGAGTCTTGCTCTGT | TTT | chrX | 139535339 | 139535360 | 139535344 | 139535339 | - |
| SEQ ID NO 13337 | TTTGACAGAGTCTTGCTCTGTC | TTT | chrX | 139535338 | 139535359 | 139535343 | 139535338 | - |
| SEQ ID NO 13338 | TTGACAGAGTCTTGCTCTGTCG | TTT | chrX | 139535337 | 139535358 | 139535342 | 139535337 | - |
| SEQ ID NO 13339 | TGACAGAGTCTTGCTCTGTCGC | TTT | chrX | 139535336 | 139535357 | 139535341 | 139535336 | - |
| SEQ ID NO 13340 | GACAGAGTCTTGCTCTGTCGCC | TTT | chrX | 139535335 | 139535356 | 139535340 | 139535335 | - |
| SEQ ID NO 13341 | ACAGAGTCTTGCTCTGTCGCCC | TTG | chrX | 139535334 | 139535355 | 139535339 | 139535334 | - |
| SEQ ID NO 13342 | GCTCTGTCGCCCAGGCTGGAGT | CTT | chrX | 139535324 | 139535345 | 139535329 | 139535324 | - |
| SEQ ID NO 13343 | CTCTGTCGCCCAGGCTGGAGTG | TTG | chrX | 139535323 | 139535344 | 139535328 | 139535323 | - |
| SEQ ID NO 13344 | TGTCGCCCAGGCTGGAGTGCAG | CTC | chrX | 139535320 | 139535341 | 139535325 | 139535320 | - |
| SEQ ID NO 13345 | TCGCCCAGGCTGGAGTGCAGTG | CTG | chrX | 139535318 | 139535339 | 139535323 | 139535318 | - |
| SEQ ID NO 13346 | GAGTGCAGTGGTGCGATCTCAG | CTG | chrX | 139535306 | 139535327 | 139535311 | 139535306 | - |
| SEQ ID NO 13347 | AGCTCACTGCAACCTCCATCTC | CTC | chrX | 139535286 | 139535307 | 139535291 | 139535286 | - |
| SEQ ID NO 13348 | ACTGCAACCTCCATCTCCCAGG | CTC | chrX | 139535281 | 139535302 | 139535286 | 139535281 | - |
| SEQ ID NO 13349 | CAACCTCCATCTCCCAGGTTCA | CTG | chrX | 139535277 | 139535298 | 139535282 | 139535277 | - |
| SEQ ID NO 13350 | CATCTCCCAGGTTCAAGCTATT | CTC | chrX | 139535270 | 139535291 | 139535275 | 139535270 | - |
| SEQ ID NO 13351 | CCAGGTTCAAGCTATTCTCCTG | CTC | chrX | 139535264 | 139535285 | 139535269 | 139535264 | - |
| SEQ ID NO 13352 | AAGCTATTCTCCTGCCTCAGCC | TTC | chrX | 139535256 | 139535277 | 139535261 | 139535256 | - |
| SEQ ID NO 13353 | TTCTCCTGCCTCAGCCTCCCAA | CTA | chrX | 139535250 | 139535271 | 139535255 | 139535250 | - |
| SEQ ID NO 13354 | TCCTGCCTCAGCCTCCCAAGTA | TTC | chrX | 139535247 | 139535268 | 139535252 | 139535247 | - |
| SEQ ID NO 13355 | CTGCCTCAGCCTCCCAAGTAGC | CTC | chrX | 139535245 | 139535266 | 139535250 | 139535245 | - |
| SEQ ID NO 13356 | CCTCAGCCTCCCAAGTAGCTGG | CTG | chrX | 139535242 | 139535263 | 139535247 | 139535242 | - |
| SEQ ID NO 13357 | AGCCTCCCAAGTAGCTGGGATT | CTC | chrX | 139535238 | 139535259 | 139535243 | 139535238 | - |
| SEQ ID NO 13358 | CCAAGTAGCTGGGATTACAGGC | CTC | chrX | 139535232 | 139535253 | 139535237 | 139535232 | - |
| SEQ ID NO 13359 | GGATTACAGGCACCCGCCACCA | CTG | chrX | 139535221 | 139535242 | 139535226 | 139535221 | - |
| SEQ ID NO 13360 | CAGGCACCCGCCACCATGCCCA | TTA | chrX | 139535215 | 139535236 | 139535220 | 139535215 | - |
| SEQ ID NO 13361 | ATTTTTGTATTTTTAGTAAAGC | CTA | chrX | 139535189 | 139535210 | 139535194 | 139535189 | - |
| SEQ ID NO 13362 | TTGTATTTTTAGTAAAGCCGGG | TTT | chrX | 139535185 | 139535206 | 139535190 | 139535185 | - |
| SEQ ID NO 13363 | TGTATTTTTAGTAAAGCCGGGG | TTT | chrX | 139535184 | 139535205 | 139535189 | 139535184 | - |
| SEQ ID NO 13364 | GTATTTTTAGTAAAGCCGGGGT | TTT | chrX | 139535183 | 139535204 | 139535188 | 139535183 | - |
| SEQ ID NO 13365 | TATTTTTAGTAAAGCCGGGGTT | TTG | chrX | 139535182 | 139535203 | 139535187 | 139535182 | - |
| SEQ ID NO 13366 | TTAGTAAAGCCGGGGTTTCACC | TTT | chrX | 139535177 | 139535198 | 139535182 | 139535177 | - |
| SEQ ID NO 13367 | TAGTAAAGCCGGGGTTTCACCA | TTT | chrX | 139535176 | 139535197 | 139535181 | 139535176 | - |
| SEQ ID NO 13368 | AGTAAAGCCGGGGTTTCACCAT | TTT | chrX | 139535175 | 139535196 | 139535180 | 139535175 | - |
| SEQ ID NO 13369 | GTAAAGCCGGGGTTTCACCATT | TTA | chrX | 139535174 | 139535195 | 139535179 | 139535174 | - |
| SEQ ID NO 13370 | CACCATTTCACCTTGTTGGCCA | TTT | chrX | 139535159 | 139535180 | 139535164 | 139535159 | - |
| SEQ ID NO 13371 | ACCATTTCACCTTGTTGGCCAG | TTC | chrX | 139535158 | 139535179 | 139535163 | 139535158 | - |
| SEQ ID NO 13372 | CACCTTGTTGGCCAGGCTGGTG | TTT | chrX | 139535151 | 139535172 | 139535156 | 139535151 | - |
| SEQ ID NO 13373 | ACCTTGTTGGCCAGGCTGGTGT | TTC | chrX | 139535150 | 139535171 | 139535155 | 139535150 | - |
| SEQ ID NO 13374 | GTTGGCCAGGCTGGTGTCGAAC | CTT | chrX | 139535145 | 139535166 | 139535150 | 139535145 | - |
| SEQ ID NO 13375 | TTGGCCAGGCTGGTGTCGAACT | TTG | chrX | 139535144 | 139535165 | 139535149 | 139535144 | - |
| SEQ ID NO 13376 | GCCAGGCTGGTGTCGAACTCCT | TTG | chrX | 139535141 | 139535162 | 139535146 | 139535141 | - |
| SEQ ID NO 13377 | GTGTCGAACTCCTGACCTCAAG | CTG | chrX | 139535132 | 139535153 | 139535137 | 139535132 | - |
| SEQ ID NO 13378 | CTGACCTCAAGTGATCTGCCTG | CTC | chrX | 139535121 | 139535142 | 139535126 | 139535121 | - |
| SEQ ID NO 13379 | ACCTCAAGTGATCTGCCTGCCT | CTG | chrX | 139535118 | 139535139 | 139535123 | 139535118 | - |
| SEQ ID NO 13380 | AAGTGATCTGCCTGCCTGGGCC | CTC | chrX | 139535113 | 139535134 | 139535118 | 139535113 | - |
| SEQ ID NO 13381 | CCTGCCTGGGCCTCTGAAAGTG | CTG | chrX | 139535103 | 139535124 | 139535108 | 139535103 | - |
| SEQ ID NO 13382 | CCTGGGCCTCTGAAAGTGCTGG | CTG | chrX | 139535099 | 139535120 | 139535104 | 139535099 | - |
| SEQ ID NO 13383 | GGCCTCTGAAAGTGCTGGGATT | CTG | chrX | 139535095 | 139535116 | 139535100 | 139535095 | - |
| SEQ ID NO 13384 | TGAAAGTGCTGGGATTATAGGT | CTC | chrX | 139535089 | 139535110 | 139535094 | 139535089 | - |
| SEQ ID NO 13385 | AAAGTGCTGGGATTATAGGTGT | CTG | chrX | 139535087 | 139535108 | 139535092 | 139535087 | - |

Figure 42 (Cont'd)

| | | | | | | | | |
|---|---|---|---|---|---|---|---|---|
| SEQ ID NO 13386 | GGATTATAGGTGTGAGCCACCA | CTG | chrX | 139535078 | 139535099 | 139535083 | 139535078 | - |
| SEQ ID NO 13387 | TAGGTGTGAGCCACCATGCCAG | TTA | chrX | 139535072 | 139535093 | 139535077 | 139535072 | - |
| SEQ ID NO 13388 | TCTTCAACTCTTCATTGGCCAT | CTC | chrX | 139535045 | 139535066 | 139535050 | 139535045 | - |
| SEQ ID NO 13389 | TTCAACTCTTCATTGGCCATAT | CTC | chrX | 139535043 | 139535064 | 139535048 | 139535043 | - |
| SEQ ID NO 13390 | CAACTCTTCATTGGCCATATTT | CTT | chrX | 139535041 | 139535062 | 139535046 | 139535041 | - |
| SEQ ID NO 13391 | AACTCTTCATTGGCCATATTTC | TTC | chrX | 139535040 | 139535061 | 139535045 | 139535040 | - |
| SEQ ID NO 13392 | TTCATTGGCCATATTTCTCAAT | CTC | chrX | 139535035 | 139535056 | 139535040 | 139535035 | - |
| SEQ ID NO 13393 | CATTGGCCATATTTCTCAATTT | CTT | chrX | 139535033 | 139535054 | 139535038 | 139535033 | - |
| SEQ ID NO 13394 | ATTGGCCATATTTCTCAATTTC | TTC | chrX | 139535032 | 139535053 | 139535037 | 139535032 | - |
| SEQ ID NO 13395 | GCCATATTTCTCAATTTCCTTC | TTG | chrX | 139535028 | 139535049 | 139535033 | 139535028 | - |
| SEQ ID NO 13396 | CTCAATTTCCTTCACTCGTTTG | TTT | chrX | 139535019 | 139535040 | 139535024 | 139535019 | - |
| SEQ ID NO 13397 | TCAATTTCCTTCACTCGTTTGC | TTC | chrX | 139535018 | 139535039 | 139535023 | 139535018 | - |
| SEQ ID NO 13398 | AATTTCCTTCACTCGTTTGCAA | CTC | chrX | 139535016 | 139535037 | 139535021 | 139535016 | - |
| SEQ ID NO 13399 | CCTTCACTCGTTTGCAATGCTG | TTT | chrX | 139535011 | 139535032 | 139535016 | 139535011 | - |
| SEQ ID NO 13400 | CTTCACTCGTTTGCAATGCTGT | TTC | chrX | 139535010 | 139535031 | 139535015 | 139535010 | - |
| SEQ ID NO 13401 | CACTCGTTTGCAATGCTGTGCC | CTT | chrX | 139535007 | 139535028 | 139535012 | 139535007 | - |
| SEQ ID NO 13402 | ACTCGTTTGCAATGCTGTGCCC | TTC | chrX | 139535006 | 139535027 | 139535011 | 139535006 | - |
| SEQ ID NO 13403 | GTTTGCAATGCTGTGCCCACCC | CTC | chrX | 139535002 | 139535023 | 139535007 | 139535002 | - |
| SEQ ID NO 13404 | GCAATGCTGTGCCCACCCTGCA | TTT | chrX | 139534998 | 139535019 | 139535003 | 139534998 | - |
| SEQ ID NO 13405 | CAATGCTGTGCCCACCCTGCAA | TTG | chrX | 139534997 | 139535018 | 139535002 | 139534997 | - |
| SEQ ID NO 13406 | TGCCCACCCTGCAATCCTAGCC | CTG | chrX | 139534989 | 139535010 | 139534994 | 139534989 | - |
| SEQ ID NO 13407 | CAATCCTAGCCCCTAAATTGGA | CTG | chrX | 139534978 | 139534999 | 139534983 | 139534978 | - |
| SEQ ID NO 13408 | GCCCCTAAATTGGAGCAGCCAT | CTA | chrX | 139534970 | 139534991 | 139534975 | 139534970 | - |
| SEQ ID NO 13409 | AATTGGAGCAGCCATCTGCCTT | CTA | chrX | 139534963 | 139534984 | 139534968 | 139534963 | - |
| SEQ ID NO 13410 | GAGCAGCCATCTGCCTTCATCC | TTG | chrX | 139534958 | 139534979 | 139534963 | 139534958 | - |
| SEQ ID NO 13411 | CCTTCATCCTTCTCTTCCCAGA | CTG | chrX | 139534945 | 139534966 | 139534950 | 139534945 | - |
| SEQ ID NO 13412 | CATCCTTCTCTTCCCAGACAGC | CTT | chrX | 139534941 | 139534962 | 139534946 | 139534941 | - |
| SEQ ID NO 13413 | ATCCTTCTCTTCCCAGACAGCC | TTC | chrX | 139534940 | 139534961 | 139534945 | 139534940 | - |
| SEQ ID NO 13414 | CTCTTCCCAGACAGCCGAGGAC | CTT | chrX | 139534934 | 139534955 | 139534939 | 139534934 | - |
| SEQ ID NO 13415 | TCTTCCCAGACAGCCGAGGACT | TTC | chrX | 139534933 | 139534954 | 139534938 | 139534933 | - |
| SEQ ID NO 13416 | TTCCCAGACAGCCGAGGACTGT | CTC | chrX | 139534931 | 139534952 | 139534936 | 139534931 | - |
| SEQ ID NO 13417 | CCCAGACAGCCGAGGACTGTGA | CTT | chrX | 139534929 | 139534950 | 139534934 | 139534929 | - |
| SEQ ID NO 13418 | CCAGACAGCCGAGGACTGTGAA | TTC | chrX | 139534928 | 139534949 | 139534933 | 139534928 | - |
| SEQ ID NO 13419 | TGAAGGAAAAAAATCACCAAAA | CTG | chrX | 139534910 | 139534931 | 139534915 | 139534910 | - |
| SEQ ID NO 13420 | ATGCCTCACAGCCTCCACCCAC | TTG | chrX | 139534863 | 139534884 | 139534868 | 139534863 | - |
| SEQ ID NO 13421 | ACAGCCTCCACCCACCTCTCTG | CTC | chrX | 139534856 | 139534877 | 139534861 | 139534856 | - |
| SEQ ID NO 13422 | CACCCACCTCTCTGCTCAGCAA | CTC | chrX | 139534848 | 139534869 | 139534853 | 139534848 | - |
| SEQ ID NO 13423 | TCTGCTCAGCAACTCATTTACT | CTC | chrX | 139534838 | 139534859 | 139534843 | 139534838 | - |
| SEQ ID NO 13424 | TGCTCAGCAACTCATTTACTTG | CTC | chrX | 139534836 | 139534857 | 139534841 | 139534836 | - |
| SEQ ID NO 13425 | CTCAGCAACTCATTTACTTGGC | CTG | chrX | 139534834 | 139534855 | 139534839 | 139534834 | - |
| SEQ ID NO 13426 | AGCAACTCATTTACTTGGCCCT | CTC | chrX | 139534831 | 139534852 | 139534836 | 139534831 | - |
| SEQ ID NO 13427 | ATTTACTTGGCCCTGGACACTC | CTC | chrX | 139534823 | 139534844 | 139534828 | 139534823 | - |
| SEQ ID NO 13428 | ACTTGGCCCTGGACACTCCTAA | TTT | chrX | 139534819 | 139534840 | 139534824 | 139534819 | - |
| SEQ ID NO 13429 | CTTGGCCCTGGACACTCCTAAA | TTA | chrX | 139534818 | 139534839 | 139534823 | 139534818 | - |
| SEQ ID NO 13430 | GGCCCTGGACACTCCTAAATAG | CTT | chrX | 139534815 | 139534836 | 139534820 | 139534815 | - |
| SEQ ID NO 13431 | GCCCTGGACACTCCTAAATAGC | TTG | chrX | 139534814 | 139534835 | 139534819 | 139534814 | - |
| SEQ ID NO 13432 | GACACTCCTAAATAGCATCCAT | CTG | chrX | 139534808 | 139534829 | 139534813 | 139534808 | - |
| SEQ ID NO 13433 | CTAAATAGCATCCATGCCTGCA | CTC | chrX | 139534801 | 139534822 | 139534806 | 139534801 | - |
| SEQ ID NO 13434 | AATAGCATCCATGCCTGCATCC | CTA | chrX | 139534798 | 139534819 | 139534803 | 139534798 | - |
| SEQ ID NO 13435 | CATCCATTTACAGTCGTTCCTC | CTG | chrX | 139534781 | 139534802 | 139534786 | 139534781 | - |
| SEQ ID NO 13436 | ACAGTCGTTCCTCAGTATCCAT | TTT | chrX | 139534772 | 139534793 | 139534777 | 139534772 | - |
| SEQ ID NO 13437 | CAGTCGTTCCTCAGTATCCATG | TTA | chrX | 139534771 | 139534792 | 139534776 | 139534771 | - |
| SEQ ID NO 13438 | CTCAGTATCCATGGAAAATTGG | TTC | chrX | 139534762 | 139534783 | 139534767 | 139534762 | - |
| SEQ ID NO 13439 | AGTATCCATGGAAAATTGGTGG | CTC | chrX | 139534759 | 139534780 | 139534764 | 139534759 | - |
| SEQ ID NO 13440 | GTGGCAAGACCCCCTGCAAATA | TTG | chrX | 139534741 | 139534762 | 139534746 | 139534741 | - |
| SEQ ID NO 13441 | CAAATATCAAGATCTGTGGATG | CTG | chrX | 139534725 | 139534746 | 139534730 | 139534725 | - |
| SEQ ID NO 13442 | TGGATGCTCAAGTCTCCGATAT | CTG | chrX | 139534709 | 139534730 | 139534714 | 139534709 | - |
| SEQ ID NO 13443 | AAGTCTCCGATATAAAAATGGC | CTC | chrX | 139534700 | 139534721 | 139534705 | 139534700 | - |
| SEQ ID NO 13444 | CGATATAAAAATGGCTTACTAT | CTC | chrX | 139534693 | 139534714 | 139534698 | 139534693 | - |

Figure 42 (Cont'd)

| | | | | | | | | |
|---|---|---|---|---|---|---|---|---|
| SEQ ID NO 13445 | ACTATTTGCATATAACCTAAAC | CTT | chrX | 139534676 | 139534697 | 139534681 | 139534676 | - |
| SEQ ID NO 13446 | CTATTTGCATATAACCTAAACA | TTA | chrX | 139534675 | 139534696 | 139534680 | 139534675 | - |
| SEQ ID NO 13447 | TTTGCATATAACCTAAACACAT | CTA | chrX | 139534672 | 139534693 | 139534677 | 139534672 | - |
| SEQ ID NO 13448 | GCATATAACCTAAACACATCCT | TTT | chrX | 139534669 | 139534690 | 139534674 | 139534669 | - |
| SEQ ID NO 13449 | CATATAACCTAAACACATCCTC | TTG | chrX | 139534668 | 139534689 | 139534673 | 139534668 | - |
| SEQ ID NO 13450 | AACACATCCTCCTTTGTACTTT | CTA | chrX | 139534657 | 139534678 | 139534662 | 139534657 | - |
| SEQ ID NO 13451 | CTTTGTACTTTAAATCATCTCT | CTC | chrX | 139534646 | 139534667 | 139534651 | 139534646 | - |
| SEQ ID NO 13452 | TGTACTTTAAATCATCTCTAGG | CTT | chrX | 139534643 | 139534664 | 139534648 | 139534643 | - |
| SEQ ID NO 13453 | GTACTTTAAATCATCTCTAGGT | TTT | chrX | 139534642 | 139534663 | 139534647 | 139534642 | - |
| SEQ ID NO 13454 | TACTTTAAATCATCTCTAGGTT | TTG | chrX | 139534641 | 139534662 | 139534646 | 139534641 | - |
| SEQ ID NO 13455 | TAAATCATCTCTAGGTTTCTCT | CTT | chrX | 139534636 | 139534657 | 139534641 | 139534636 | - |
| SEQ ID NO 13456 | AAATCATCTCTAGGTTTCTCTT | TTT | chrX | 139534635 | 139534656 | 139534640 | 139534635 | - |
| SEQ ID NO 13457 | AATCATCTCTAGGTTTCTCTTA | TTA | chrX | 139534634 | 139534655 | 139534639 | 139534634 | - |
| SEQ ID NO 13458 | TAGGTTTCTCTTAATAGCTAAT | CTC | chrX | 139534625 | 139534646 | 139534630 | 139534625 | - |
| SEQ ID NO 13459 | GGTTTCTCTTAATAGCTAATAC | CTA | chrX | 139534623 | 139534644 | 139534628 | 139534623 | - |
| SEQ ID NO 13460 | CTCTTAATAGCTAATACAATGT | TTT | chrX | 139534618 | 139534639 | 139534623 | 139534618 | - |
| SEQ ID NO 13461 | TCTTAATAGCTAATACAATGTA | TTC | chrX | 139534617 | 139534638 | 139534622 | 139534617 | - |
| SEQ ID NO 13462 | TTAATAGCTAATACAATGTAAA | CTC | chrX | 139534615 | 139534636 | 139534620 | 139534615 | - |
| SEQ ID NO 13463 | AATAGCTAATACAATGTAAATG | CTT | chrX | 139534613 | 139534634 | 139534618 | 139534613 | - |
| SEQ ID NO 13464 | ATAGCTAATACAATGTAAATGC | TTA | chrX | 139534612 | 139534633 | 139534617 | 139534612 | - |
| SEQ ID NO 13465 | ATACAATGTAAATGCTATGTAA | CTA | chrX | 139534605 | 139534626 | 139534610 | 139534605 | - |
| SEQ ID NO 13466 | TGTAAATAGTTGTTATGCTGTA | CTA | chrX | 139534588 | 139534609 | 139534593 | 139534588 | - |
| SEQ ID NO 13467 | TTATGCTGTATTGTTAGGGAA | TTG | chrX | 139534576 | 139534597 | 139534581 | 139534576 | - |
| SEQ ID NO 13468 | TGCTGTATTGTTAGGGAATAA | TTA | chrX | 139534573 | 139534594 | 139534578 | 139534573 | - |
| SEQ ID NO 13469 | TATTGTTAGGGAATAATGAAA | CTG | chrX | 139534568 | 139534589 | 139534573 | 139534568 | - |
| SEQ ID NO 13470 | TTTAGGGAATAATGAAAGATAA | TTG | chrX | 139534563 | 139534584 | 139534568 | 139534563 | - |
| SEQ ID NO 13471 | AGGGAATAATGAAAGATAAAAG | TTT | chrX | 139534560 | 139534581 | 139534565 | 139534560 | - |
| SEQ ID NO 13472 | GGGAATAATGAAAGATAAAAGA | TTA | chrX | 139534559 | 139534580 | 139534564 | 139534559 | - |
| SEQ ID NO 13473 | TACATGTTCAGTAGAGATGCAA | CTG | chrX | 139534532 | 139534553 | 139534537 | 139534532 | - |
| SEQ ID NO 13474 | AGTAGAGATGCAACCATCCATT | TTC | chrX | 139534523 | 139534544 | 139534528 | 139534523 | - |
| SEQ ID NO 13475 | TTTTCTTGAATATTTTTGATCT | TTT | chrX | 139534500 | 139534521 | 139534505 | 139534500 | - |
| SEQ ID NO 13476 | TTTCTTGAATATTTTTGATCTG | TTT | chrX | 139534499 | 139534520 | 139534504 | 139534499 | - |
| SEQ ID NO 13477 | TTCTTGAATATTTTTGATCTGC | TTT | chrX | 139534498 | 139534519 | 139534503 | 139534498 | - |
| SEQ ID NO 13478 | TCTTGAATATTTTTGATCTGCA | TTT | chrX | 139534497 | 139534518 | 139534502 | 139534497 | - |
| SEQ ID NO 13479 | CTTGAATATTTTTGATCTGCAG | TTT | chrX | 139534496 | 139534517 | 139534501 | 139534496 | - |
| SEQ ID NO 13480 | TTGAATATTTTTGATCTGCAGT | TTC | chrX | 139534495 | 139534516 | 139534500 | 139534495 | - |
| SEQ ID NO 13481 | GAATATTTTTGATCTGCAGTTA | CTT | chrX | 139534493 | 139534514 | 139534498 | 139534493 | - |
| SEQ ID NO 13482 | AATATTTTTGATCTGCAGTTAA | TTG | chrX | 139534492 | 139534513 | 139534497 | 139534492 | - |
| SEQ ID NO 13483 | TTGATCTGCAGTTAATTGAATC | TTT | chrX | 139534485 | 139534506 | 139534490 | 139534485 | - |
| SEQ ID NO 13484 | TGATCTGCAGTTAATTGAATCT | TTT | chrX | 139534484 | 139534505 | 139534489 | 139534484 | - |
| SEQ ID NO 13485 | GATCTGCAGTTAATTGAATCTG | TTT | chrX | 139534483 | 139534504 | 139534488 | 139534483 | - |
| SEQ ID NO 13486 | ATCTGCAGTTAATTGAATCTGT | TTG | chrX | 139534482 | 139534503 | 139534487 | 139534482 | - |
| SEQ ID NO 13487 | CAGTTAATTGAATCTGTGGCTG | CTG | chrX | 139534477 | 139534498 | 139534482 | 139534477 | - |
| SEQ ID NO 13488 | ATTGAATCTGTGGCTGTGGAAC | TTA | chrX | 139534471 | 139534492 | 139534476 | 139534471 | - |
| SEQ ID NO 13489 | AATCTGTGGCTGTGGAACTCAC | TTG | chrX | 139534467 | 139534488 | 139534472 | 139534467 | - |
| SEQ ID NO 13490 | TGGCTGTGGAACTCACAAGGAG | CTG | chrX | 139534461 | 139534482 | 139534466 | 139534461 | - |
| SEQ ID NO 13491 | TGGAACTCACAAGGAGAGCTGA | CTG | chrX | 139534455 | 139534476 | 139534460 | 139534455 | - |
| SEQ ID NO 13492 | ACAAGGAGAGCTGACTGTACAG | CTC | chrX | 139534447 | 139534468 | 139534452 | 139534447 | - |
| SEQ ID NO 13493 | ACTGTACAGTGTGGTTGAGTGA | CTG | chrX | 139534434 | 139534455 | 139534439 | 139534434 | - |
| SEQ ID NO 13494 | TACAGTGTGGTTGAGTGAAAAA | CTG | chrX | 139534430 | 139534451 | 139534435 | 139534430 | - |
| SEQ ID NO 13495 | AGTGAAAAACAGACTTTAGAA | TTG | chrX | 139534417 | 139534438 | 139534422 | 139534417 | - |
| SEQ ID NO 13496 | TAGAATCAGATCAGACAGAAAT | CTT | chrX | 139534400 | 139534421 | 139534405 | 139534400 | - |
| SEQ ID NO 13497 | AGAATCAGATCAGACAGAAATA | TTT | chrX | 139534399 | 139534420 | 139534404 | 139534399 | - |
| SEQ ID NO 13498 | GAATCAGATCAGACAGAAATAG | TTA | chrX | 139534398 | 139534419 | 139534403 | 139534398 | - |
| SEQ ID NO 13499 | GAATCAAGTATCTGCCTCCTCT | TTT | chrX | 139534372 | 139534393 | 139534377 | 139534372 | - |
| SEQ ID NO 13500 | AATCAAGTATCTGCCTCCTCTA | TTG | chrX | 139534371 | 139534392 | 139534376 | 139534371 | - |
| SEQ ID NO 13501 | CCTCCTCTAGACCTGTGACCTT | CTG | chrX | 139534358 | 139534379 | 139534363 | 139534358 | - |
| SEQ ID NO 13502 | CTCTAGACCTGTGACCTTGGAC | CTC | chrX | 139534354 | 139534375 | 139534359 | 139534354 | - |
| SEQ ID NO 13503 | TAGACCTGTGACCTTGGACAAG | CTC | chrX | 139534351 | 139534372 | 139534356 | 139534351 | - |

Figure 42 (Cont'd)

| | | | | | | | | |
|---|---|---|---|---|---|---|---|---|
| SEQ ID NO 13504 | GACCTGTGACCTTGGACAAGTC | CTA | chrX | 139534349 | 139534370 | 139534354 | 139534349 | - |
| SEQ ID NO 13505 | TGACCTTGGACAAGTCACACAA | CTG | chrX | 139534343 | 139534364 | 139534348 | 139534343 | - |
| SEQ ID NO 13506 | GGACAAGTCACACAAGCTCTGA | CTT | chrX | 139534336 | 139534357 | 139534341 | 139534336 | - |
| SEQ ID NO 13507 | GACAAGTCACACAAGCTCTGAA | TTG | chrX | 139534335 | 139534356 | 139534340 | 139534335 | - |
| SEQ ID NO 13508 | TGAACCTTAACTTTGTCAAATG | CTC | chrX | 139534317 | 139534338 | 139534322 | 139534317 | - |
| SEQ ID NO 13509 | AACCTTAACTTTGTCAAATGTA | CTG | chrX | 139534315 | 139534336 | 139534320 | 139534315 | - |
| SEQ ID NO 13510 | AACTTTGTCAAATGTAAATTAG | CTT | chrX | 139534309 | 139534330 | 139534314 | 139534309 | - |
| SEQ ID NO 13511 | ACTTTGTCAAATGTAAATTAGG | TTA | chrX | 139534308 | 139534329 | 139534313 | 139534308 | - |
| SEQ ID NO 13512 | TGTCAAATGTAAATTAGGTTTA | CTT | chrX | 139534304 | 139534325 | 139534309 | 139534304 | - |
| SEQ ID NO 13513 | GTCAAATGTAAATTAGGTTTAA | TTT | chrX | 139534303 | 139534324 | 139534308 | 139534303 | - |
| SEQ ID NO 13514 | TCAAATGTAAATTAGGTTTAAC | TTG | chrX | 139534302 | 139534323 | 139534307 | 139534302 | - |
| SEQ ID NO 13515 | GGTTTAACAGTAGTATAATAAG | TTA | chrX | 139534288 | 139534309 | 139534293 | 139534288 | - |
| SEQ ID NO 13516 | AACAGTAGTATAATAAGAATAT | TTT | chrX | 139534283 | 139534304 | 139534288 | 139534283 | - |
| SEQ ID NO 13517 | ACAGTAGTATAATAAGAATATC | TTA | chrX | 139534282 | 139534303 | 139534287 | 139534282 | - |
| SEQ ID NO 13518 | TCTCACAGGTGTTGGCAGGATC | CTA | chrX | 139534258 | 139534279 | 139534263 | 139534258 | - |
| SEQ ID NO 13519 | ACAGGTGTTGGCAGGATCAGTG | CTC | chrX | 139534254 | 139534275 | 139534259 | 139534254 | - |
| SEQ ID NO 13520 | GCAGGATCAGTGAGACAATATG | TTG | chrX | 139534244 | 139534265 | 139534249 | 139534244 | - |
| SEQ ID NO 13521 | GTTATCTCTTTTTCTCCCTACT | CTG | chrX | 139534219 | 139534240 | 139534224 | 139534219 | - |
| SEQ ID NO 13522 | TCTCTTTTTCTCCCTACTCCTT | TTA | chrX | 139534215 | 139534236 | 139534220 | 139534215 | - |
| SEQ ID NO 13523 | TTTTTCTCCCTACTCCTTTCAT | CTC | chrX | 139534211 | 139534232 | 139534216 | 139534211 | - |
| SEQ ID NO 13524 | TTTCTCCCTACTCCTTTCATGT | CTT | chrX | 139534209 | 139534230 | 139534214 | 139534209 | - |
| SEQ ID NO 13525 | TTCTCCCTACTCCTTTCATGTT | TTT | chrX | 139534208 | 139534229 | 139534213 | 139534208 | - |
| SEQ ID NO 13526 | TCTCCCTACTCCTTTCATGTTG | TTT | chrX | 139534207 | 139534228 | 139534212 | 139534207 | - |
| SEQ ID NO 13527 | CTCCCTACTCCTTTCATGTTGG | TTT | chrX | 139534206 | 139534227 | 139534211 | 139534206 | - |
| SEQ ID NO 13528 | TCCCTACTCCTTTCATGTTGGC | TTC | chrX | 139534205 | 139534226 | 139534210 | 139534205 | - |
| SEQ ID NO 13529 | CCTACTCCTTTCATGTTGGCCC | CTC | chrX | 139534203 | 139534224 | 139534208 | 139534203 | - |
| SEQ ID NO 13530 | CTCCTTTCATGTTGGCCCTACT | CTA | chrX | 139534199 | 139534220 | 139534204 | 139534199 | - |
| SEQ ID NO 13531 | CTTTCATGTTGGCCCTACTTTC | CTC | chrX | 139534196 | 139534217 | 139534201 | 139534196 | - |
| SEQ ID NO 13532 | TCATGTTGGCCCTACTTTCTTC | CTT | chrX | 139534193 | 139534214 | 139534198 | 139534193 | - |
| SEQ ID NO 13533 | CATGTTGGCCCTACTTTCTTCT | TTT | chrX | 139534192 | 139534213 | 139534197 | 139534192 | - |
| SEQ ID NO 13534 | ATGTTGGCCCTACTTTCTTCTG | TTC | chrX | 139534191 | 139534212 | 139534196 | 139534191 | - |
| SEQ ID NO 13535 | GCCCTACTTTCTTCTGTTTTAA | TTG | chrX | 139534185 | 139534206 | 139534190 | 139534185 | - |
| SEQ ID NO 13536 | CTTTCTTCTGTTTTAAATTTCT | CTA | chrX | 139534179 | 139534200 | 139534184 | 139534179 | - |
| SEQ ID NO 13537 | TCTTCTGTTTTAAATTTCTCAA | CTT | chrX | 139534176 | 139534197 | 139534181 | 139534176 | - |
| SEQ ID NO 13538 | CTTCTGTTTTAAATTTCTCAAT | TTT | chrX | 139534175 | 139534196 | 139534180 | 139534175 | - |
| SEQ ID NO 13539 | TTCTGTTTTAAATTTCTCAATT | TTC | chrX | 139534174 | 139534195 | 139534179 | 139534174 | - |
| SEQ ID NO 13540 | CTGTTTTAAATTTCTCAATTCT | CTT | chrX | 139534172 | 139534193 | 139534177 | 139534172 | - |
| SEQ ID NO 13541 | TGTTTTAAATTTCTCAATTCTC | TTC | chrX | 139534171 | 139534192 | 139534176 | 139534171 | - |
| SEQ ID NO 13542 | TTTTAAATTTCTCAATTCTCTT | CTG | chrX | 139534169 | 139534190 | 139534174 | 139534169 | - |
| SEQ ID NO 13543 | TAAATTTCTCAATTCTCTTTAG | TTT | chrX | 139534166 | 139534187 | 139534171 | 139534166 | - |
| SEQ ID NO 13544 | AAATTTCTCAATTCTCTTTAGC | TTT | chrX | 139534165 | 139534186 | 139534170 | 139534165 | - |
| SEQ ID NO 13545 | AATTTCTCAATTCTCTTTAGCT | TTA | chrX | 139534164 | 139534185 | 139534169 | 139534164 | - |
| SEQ ID NO 13546 | CTCAATTCTCTTTAGCTCTTTA | TTT | chrX | 139534159 | 139534180 | 139534164 | 139534159 | - |
| SEQ ID NO 13547 | TCAATTCTCTTTAGCTCTTTAA | TTC | chrX | 139534158 | 139534179 | 139534163 | 139534158 | - |
| SEQ ID NO 13548 | AATTCTCTTTAGCTCTTTAATA | CTC | chrX | 139534156 | 139534177 | 139534161 | 139534156 | - |
| SEQ ID NO 13549 | TCTTTAGCTCTTTAATAACTTC | TTC | chrX | 139534151 | 139534172 | 139534156 | 139534151 | - |
| SEQ ID NO 13550 | TTTAGCTCTTTAATAACTTCTG | CTC | chrX | 139534149 | 139534170 | 139534154 | 139534149 | - |
| SEQ ID NO 13551 | TAGCTCTTTAATAACTTCTGTG | CTT | chrX | 139534147 | 139534168 | 139534152 | 139534147 | - |
| SEQ ID NO 13552 | AGCTCTTTAATAACTTCTGTGT | TTT | chrX | 139534146 | 139534167 | 139534151 | 139534146 | - |
| SEQ ID NO 13553 | GCTCTTTAATAACTTCTGTGTA | TTA | chrX | 139534145 | 139534166 | 139534150 | 139534145 | - |
| SEQ ID NO 13554 | TTTAATAACTTCTGTGTAGCTC | CTC | chrX | 139534141 | 139534162 | 139534146 | 139534141 | - |
| SEQ ID NO 13555 | TAATAACTTCTGTGTAGCTCTT | CTT | chrX | 139534139 | 139534160 | 139534144 | 139534139 | - |
| SEQ ID NO 13556 | AATAACTTCTGTGTAGCTCTTT | TTT | chrX | 139534138 | 139534159 | 139534143 | 139534138 | - |
| SEQ ID NO 13557 | ATAACTTCTGTGTAGCTCTTTT | TTA | chrX | 139534137 | 139534158 | 139534142 | 139534137 | - |
| SEQ ID NO 13558 | CTGTGTAGCTCTTTTCCTTCCT | CTT | chrX | 139534130 | 139534151 | 139534135 | 139534130 | - |
| SEQ ID NO 13559 | TGTGTAGCTCTTTTCCTTCCTT | TTC | chrX | 139534129 | 139534150 | 139534134 | 139534129 | - |
| SEQ ID NO 13560 | TGTAGCTCTTTTCCTTCCTTAA | CTG | chrX | 139534127 | 139534148 | 139534132 | 139534127 | - |
| SEQ ID NO 13561 | TTTTCCTTCCTTAATCACATTT | CTC | chrX | 139534119 | 139534140 | 139534124 | 139534119 | - |
| SEQ ID NO 13562 | TTCCTTCCTTAATCACATTTAT | CTT | chrX | 139534117 | 139534138 | 139534122 | 139534117 | - |

Figure 42 (Cont'd)

| | | | | | | | | |
|---|---|---|---|---|---|---|---|---|
| SEQ ID NO 13563 | TCCTTCCTTAATCACATTTATA | TTT | chrX | 139534116 | 139534137 | 139534121 | 139534116 | - |
| SEQ ID NO 13564 | CCTTCCTTAATCACATTTATAT | TTT | chrX | 139534115 | 139534136 | 139534120 | 139534115 | - |
| SEQ ID NO 13565 | CTTCCTTAATCACATTTATATA | TTC | chrX | 139534114 | 139534135 | 139534119 | 139534114 | - |
| SEQ ID NO 13566 | CCTTAATCACATTTATATAATG | CTT | chrX | 139534111 | 139534132 | 139534116 | 139534111 | - |
| SEQ ID NO 13567 | CTTAATCACATTTATATAATGA | TTC | chrX | 139534110 | 139534131 | 139534115 | 139534110 | - |
| SEQ ID NO 13568 | AATCACATTTATATAATGAAAT | CTT | chrX | 139534107 | 139534128 | 139534112 | 139534107 | - |
| SEQ ID NO 13569 | ATCACATTTATATAATGAAATG | TTA | chrX | 139534106 | 139534127 | 139534111 | 139534106 | - |
| SEQ ID NO 13570 | ATATAATGAAATGACTATTGTC | TTT | chrX | 139534097 | 139534118 | 139534102 | 139534097 | - |
| SEQ ID NO 13571 | TATAATGAAATGACTATTGTCA | TTA | chrX | 139534096 | 139534117 | 139534101 | 139534096 | - |
| SEQ ID NO 13572 | TTGTCACAATCAGGAATGACCT | CTA | chrX | 139534080 | 139534101 | 139534085 | 139534080 | - |
| SEQ ID NO 13573 | TCACAATCAGGAATGACCTAAA | TTG | chrX | 139534077 | 139534098 | 139534082 | 139534077 | - |
| SEQ ID NO 13574 | AAGAATAATTTTGAGTTTATGT | CTA | chrX | 139534057 | 139534078 | 139534062 | 139534057 | - |
| SEQ ID NO 13575 | TGAGTTTATGTATTTACTGGCT | TTT | chrX | 139534046 | 139534067 | 139534051 | 139534046 | - |
| SEQ ID NO 13576 | GAGTTTATGTATTTACTGGCTG | TTT | chrX | 139534045 | 139534066 | 139534050 | 139534045 | - |
| SEQ ID NO 13577 | AGTTTATGTATTTACTGGCTGC | TTG | chrX | 139534044 | 139534065 | 139534049 | 139534044 | - |
| SEQ ID NO 13578 | ATGTATTTACTGGCTGCTCTAA | TTT | chrX | 139534039 | 139534060 | 139534044 | 139534039 | - |
| SEQ ID NO 13579 | TGTATTTACTGGCTGCTCTAAA | TTA | chrX | 139534038 | 139534059 | 139534043 | 139534038 | - |
| SEQ ID NO 13580 | ACTGGCTGCTCTAAATAATTTC | TTT | chrX | 139534031 | 139534052 | 139534036 | 139534031 | - |
| SEQ ID NO 13581 | CTGGCTGCTCTAAATAATTTCT | TTA | chrX | 139534030 | 139534051 | 139534035 | 139534030 | - |
| SEQ ID NO 13582 | GCTGCTCTAAATAATTTCTAAT | CTG | chrX | 139534027 | 139534048 | 139534032 | 139534027 | - |
| SEQ ID NO 13583 | CTCTAAATAATTTCTAATTGTT | CTG | chrX | 139534023 | 139534044 | 139534028 | 139534023 | - |
| SEQ ID NO 13584 | TAAATAATTTCTAATTGTTGAT | CTC | chrX | 139534020 | 139534041 | 139534025 | 139534020 | - |
| SEQ ID NO 13585 | AATAATTTCTAATTGTTGATCT | CTA | chrX | 139534018 | 139534039 | 139534023 | 139534018 | - |
| SEQ ID NO 13586 | CTAATTGTTGATCTCTCCCTTT | TTT | chrX | 139534010 | 139534031 | 139534015 | 139534010 | - |
| SEQ ID NO 13587 | TAATTGTTGATCTCTCCCTTTT | TTC | chrX | 139534009 | 139534030 | 139534014 | 139534009 | - |
| SEQ ID NO 13588 | ATTGTTGATCTCTCCCTTTTTA | CTA | chrX | 139534007 | 139534028 | 139534012 | 139534007 | - |
| SEQ ID NO 13589 | TTGATCTCTCCCTTTTAGGAA | TTG | chrX | 139534003 | 139534024 | 139534008 | 139534003 | - |
| SEQ ID NO 13590 | ATCTCTCCCTTTTAGGAAACT | TTG | chrX | 139534000 | 139534021 | 139534005 | 139534000 | - |
| SEQ ID NO 13591 | TCCCTTTTAGGAAACTCTTTT | CTC | chrX | 139533995 | 139534016 | 139534000 | 139533995 | - |
| SEQ ID NO 13592 | CCTTTTAGGAAACTCTTTTTA | CTC | chrX | 139533993 | 139534014 | 139533998 | 139533993 | - |
| SEQ ID NO 13593 | TTTAGGAAACTCTTTTTATAAT | CTT | chrX | 139533989 | 139534010 | 139533994 | 139533989 | - |
| SEQ ID NO 13594 | TTAGGAAACTCTTTTTATAATA | TTT | chrX | 139533988 | 139534009 | 139533993 | 139533988 | - |
| SEQ ID NO 13595 | TAGGAAACTCTTTTTATAATAA | TTT | chrX | 139533987 | 139534008 | 139533992 | 139533987 | - |
| SEQ ID NO 13596 | AGGAAACTCTTTTTATAATAAT | TTT | chrX | 139533986 | 139534007 | 139533991 | 139533986 | - |
| SEQ ID NO 13597 | GGAAACTCTTTTTATAATAATC | TTA | chrX | 139533985 | 139534006 | 139533990 | 139533985 | - |
| SEQ ID NO 13598 | TTTTTATAATAATCACTCTATT | CTC | chrX | 139533977 | 139533998 | 139533982 | 139533977 | - |
| SEQ ID NO 13599 | TTTTATAATAATCACTCTATTCT | CTT | chrX | 139533975 | 139533996 | 139533980 | 139533975 | - |
| SEQ ID NO 13600 | TTATAATAATCACTCTATTCTG | TTT | chrX | 139533974 | 139533995 | 139533979 | 139533974 | - |
| SEQ ID NO 13601 | TATAATAATCACTCTATTCTGG | TTT | chrX | 139533973 | 139533994 | 139533978 | 139533973 | - |
| SEQ ID NO 13602 | ATAATAATCACTCTATTCTGGT | TTT | chrX | 139533972 | 139533993 | 139533977 | 139533972 | - |
| SEQ ID NO 13603 | TAATAATCACTCTATTCTGGTT | TTA | chrX | 139533971 | 139533992 | 139533976 | 139533971 | - |
| SEQ ID NO 13604 | TATTCTGGTTCCCGCTTTGCT | CTC | chrX | 139533959 | 139533980 | 139533964 | 139533959 | - |
| SEQ ID NO 13605 | TTCTGGTTCCCGCTTTGCTCT | CTA | chrX | 139533957 | 139533978 | 139533962 | 139533957 | - |
| SEQ ID NO 13606 | TGGTTCCCGCTTTGCTCTAAC | TTC | chrX | 139533954 | 139533975 | 139533959 | 139533954 | - |
| SEQ ID NO 13607 | GTTCCCGCTTTGCTCTAACTC | CTG | chrX | 139533952 | 139533973 | 139533957 | 139533952 | - |
| SEQ ID NO 13608 | CCCGCTTTGCTCTAACTCCTGT | TTC | chrX | 139533948 | 139533969 | 139533953 | 139533948 | - |
| SEQ ID NO 13609 | TGCTCTAACTCCTGTTATCCAT | CTT | chrX | 139533941 | 139533962 | 139533946 | 139533941 | - |
| SEQ ID NO 13610 | GCTCTAACTCCTGTTATCCATC | TTT | chrX | 139533940 | 139533961 | 139533945 | 139533940 | - |
| SEQ ID NO 13611 | CTCTAACTCCTGTTATCCATCC | TTG | chrX | 139533939 | 139533960 | 139533944 | 139533939 | - |
| SEQ ID NO 13612 | TAACTCCTGTTATCCATCCAGC | CTC | chrX | 139533936 | 139533957 | 139533941 | 139533936 | - |
| SEQ ID NO 13613 | ACTCCTGTTATCCATCCAGCAC | CTA | chrX | 139533934 | 139533955 | 139533939 | 139533934 | - |
| SEQ ID NO 13614 | CTGTTATCCATCCAGCACTTGA | CTC | chrX | 139533930 | 139533951 | 139533935 | 139533930 | - |
| SEQ ID NO 13615 | TTATCCATCCAGCACTTGAATT | CTG | chrX | 139533927 | 139533948 | 139533932 | 139533927 | - |
| SEQ ID NO 13616 | TCCATCCAGCACTTGAATTGAT | TTA | chrX | 139533924 | 139533945 | 139533929 | 139533924 | - |
| SEQ ID NO 13617 | GAATTGATTAACTCCTGTTCCT | CTT | chrX | 139533910 | 139533931 | 139533915 | 139533910 | - |
| SEQ ID NO 13618 | AATTGATTAACTCCTGTTCCTC | TTG | chrX | 139533909 | 139533930 | 139533914 | 139533909 | - |
| SEQ ID NO 13619 | ATTAACTCCTGTTCCTCTCCAT | TTG | chrX | 139533904 | 139533925 | 139533909 | 139533904 | - |
| SEQ ID NO 13620 | ACTCCTGTTCCTCTCCATGGCC | TTA | chrX | 139533900 | 139533921 | 139533905 | 139533900 | - |
| SEQ ID NO 13621 | CTGTTCCTCTCCATGGCCCTTA | CTC | chrX | 139533896 | 139533917 | 139533901 | 139533896 | - |

Figure 42 (Cont'd)

| | | | | | | | | |
|---|---|---|---|---|---|---|---|---|
| SEQ ID NO 13622 | TTCCTCTCCATGGCCCTTAAAT | CTG | chrX | 139533893 | 139533914 | 139533898 | 139533893 | - |
| SEQ ID NO 13623 | CTCTCCATGGCCCTTAAATGTC | TTC | chrX | 139533890 | 139533911 | 139533895 | 139533890 | - |
| SEQ ID NO 13624 | TCCATGGCCCTTAAATGTCCAG | CTC | chrX | 139533887 | 139533908 | 139533892 | 139533887 | - |
| SEQ ID NO 13625 | CATGGCCCTTAAATGTCCAGGG | CTC | chrX | 139533885 | 139533906 | 139533890 | 139533885 | - |
| SEQ ID NO 13626 | AAATGTCCAGGGTTCTCCCAGG | CTT | chrX | 139533875 | 139533896 | 139533880 | 139533875 | - |
| SEQ ID NO 13627 | AATGTCCAGGGTTCTCCCAGGC | TTA | chrX | 139533874 | 139533895 | 139533879 | 139533874 | - |
| SEQ ID NO 13628 | TCCCAGGCTCCAGCCTCAGCTT | TTC | chrX | 139533860 | 139533881 | 139533865 | 139533860 | - |
| SEQ ID NO 13629 | CCAGGCTCCAGCCTCAGCTTTT | CTC | chrX | 139533858 | 139533879 | 139533863 | 139533858 | - |
| SEQ ID NO 13630 | CAGCCTCAGCTTTTCCTTTTT | CTC | chrX | 139533850 | 139533871 | 139533855 | 139533850 | - |
| SEQ ID NO 13631 | AGCTTTTCCTTTTTCACCTTA | CTC | chrX | 139533843 | 139533864 | 139533848 | 139533843 | - |
| SEQ ID NO 13632 | TTTCCTTTTTCACCTTATATAT | CTT | chrX | 139533838 | 139533859 | 139533843 | 139533838 | - |
| SEQ ID NO 13633 | TTCCTTTTTCACCTTATATATA | TTT | chrX | 139533837 | 139533858 | 139533842 | 139533837 | - |
| SEQ ID NO 13634 | TCCTTTTTCACCTTATATATAC | TTT | chrX | 139533836 | 139533857 | 139533841 | 139533836 | - |
| SEQ ID NO 13635 | CCTTTTTCACCTTATATATACT | TTT | chrX | 139533835 | 139533856 | 139533840 | 139533835 | - |
| SEQ ID NO 13636 | CTTTTTCACCTTATATATACTT | TTC | chrX | 139533834 | 139533855 | 139533839 | 139533834 | - |
| SEQ ID NO 13637 | TTTCACCTTATATATACTTGCT | CTT | chrX | 139533831 | 139533852 | 139533836 | 139533831 | - |
| SEQ ID NO 13638 | TTCACCTTATATATACTTGCTA | TTT | chrX | 139533830 | 139533851 | 139533835 | 139533830 | - |
| SEQ ID NO 13639 | TCACCTTATATATACTTGCTAG | TTT | chrX | 139533829 | 139533850 | 139533834 | 139533829 | - |
| SEQ ID NO 13640 | CACCTTATATATACTTGCTAGG | TTT | chrX | 139533828 | 139533849 | 139533833 | 139533828 | - |
| SEQ ID NO 13641 | ACCTTATATATACTTGCTAGGG | TTC | chrX | 139533827 | 139533848 | 139533832 | 139533827 | - |
| SEQ ID NO 13642 | ATATATACTTGCTAGGGCTGGG | CTT | chrX | 139533822 | 139533843 | 139533827 | 139533822 | - |
| SEQ ID NO 13643 | TATATACTTGCTAGGGCTGGGA | TTA | chrX | 139533821 | 139533842 | 139533826 | 139533821 | - |
| SEQ ID NO 13644 | GCTAGGGCTGGGACAAGAGTGA | CTT | chrX | 139533812 | 139533833 | 139533817 | 139533812 | - |
| SEQ ID NO 13645 | CTAGGGCTGGGACAAGAGTGAA | TTG | chrX | 139533811 | 139533832 | 139533816 | 139533811 | - |
| SEQ ID NO 13646 | GGGCTGGGACAAGAGTGAACCA | CTA | chrX | 139533808 | 139533829 | 139533813 | 139533808 | - |
| SEQ ID NO 13647 | GGACAAGAGTGAACCAAACAAG | CTG | chrX | 139533802 | 139533823 | 139533807 | 139533802 | - |
| SEQ ID NO 13648 | AAGAGGTCCTCACTTCTCGGGG | TTT | chrX | 139533760 | 139533781 | 139533765 | 139533760 | - |
| SEQ ID NO 13649 | AGAGGTCCTCACTTCTCGGGGC | TTA | chrX | 139533759 | 139533780 | 139533764 | 139533759 | - |
| SEQ ID NO 13650 | ACTTCTCGGGGCATACAAGTAT | CTC | chrX | 139533749 | 139533770 | 139533754 | 139533749 | - |
| SEQ ID NO 13651 | CTCGGGGCATACAAGTATATTT | CTT | chrX | 139533745 | 139533766 | 139533750 | 139533745 | - |
| SEQ ID NO 13652 | TCGGGGCATACAAGTATATTTA | TTC | chrX | 139533744 | 139533765 | 139533749 | 139533744 | - |
| SEQ ID NO 13653 | GGGGCATACAAGTATATTTATG | CTC | chrX | 139533742 | 139533763 | 139533747 | 139533742 | - |
| SEQ ID NO 13654 | ATGCCCTACAGGCCTTGCTTAC | TTT | chrX | 139533723 | 139533744 | 139533728 | 139533723 | - |
| SEQ ID NO 13655 | TGCCCTACAGGCCTTGCTTACC | TTA | chrX | 139533722 | 139533743 | 139533727 | 139533722 | - |
| SEQ ID NO 13656 | CAGGCCTTGCTTACCACAGTCT | CTA | chrX | 139533715 | 139533736 | 139533720 | 139533715 | - |
| SEQ ID NO 13657 | GCTTACCACAGTCTAGTCCGGC | CTT | chrX | 139533707 | 139533728 | 139533712 | 139533707 | - |
| SEQ ID NO 13658 | CTTACCACAGTCTAGTCCGGCC | TTG | chrX | 139533706 | 139533727 | 139533711 | 139533706 | - |
| SEQ ID NO 13659 | ACCACAGTCTAGTCCGGCCCTG | CTT | chrX | 139533703 | 139533724 | 139533708 | 139533703 | - |
| SEQ ID NO 13660 | CCACAGTCTAGTCCGGCCCTGT | TTA | chrX | 139533702 | 139533723 | 139533707 | 139533702 | - |
| SEQ ID NO 13661 | GTCCGGCCCTGACCCTGTCAAC | CTA | chrX | 139533692 | 139533713 | 139533697 | 139533692 | - |
| SEQ ID NO 13662 | ACCCTGTCAACAAAATTTACTG | CTG | chrX | 139533681 | 139533702 | 139533686 | 139533681 | - |
| SEQ ID NO 13663 | TCAACAAAATTTACTGAGCATA | CTG | chrX | 139533675 | 139533696 | 139533680 | 139533675 | - |
| SEQ ID NO 13664 | ACTGAGCATACAACCACTACTG | TTT | chrX | 139533663 | 139533684 | 139533668 | 139533663 | - |
| SEQ ID NO 13665 | CTGAGCATACAACCACTACTGC | TTA | chrX | 139533662 | 139533683 | 139533667 | 139533662 | - |
| SEQ ID NO 13666 | AGCATACAACCACTACTGCCAG | CTG | chrX | 139533659 | 139533680 | 139533664 | 139533659 | - |
| SEQ ID NO 13667 | CTGCCAGGCACTGTACTAGGTA | CTA | chrX | 139533644 | 139533665 | 139533649 | 139533644 | - |
| SEQ ID NO 13668 | CCAGGCACTGTACTAGGTATCA | CTG | chrX | 139533641 | 139533662 | 139533646 | 139533641 | - |
| SEQ ID NO 13669 | TACTAGGTATCACAATATCCAT | CTG | chrX | 139533631 | 139533652 | 139533636 | 139533631 | - |
| SEQ ID NO 13670 | GGTATCACAATATCCATGCTCA | CTA | chrX | 139533626 | 139533647 | 139533631 | 139533626 | - |
| SEQ ID NO 13671 | ACTCTCCAGATGCCCACACACG | CTC | chrX | 139533605 | 139533626 | 139533610 | 139533605 | - |
| SEQ ID NO 13672 | TCCAGATGCCCACACACGTGG | CTC | chrX | 139533601 | 139533622 | 139533606 | 139533601 | - |
| SEQ ID NO 13673 | CAGATGCCCACACACGTGGCTG | CTC | chrX | 139533599 | 139533620 | 139533604 | 139533599 | - |
| SEQ ID NO 13674 | TAACTACTGTTTACAGAACAAT | CTG | chrX | 139533577 | 139533598 | 139533582 | 139533577 | - |
| SEQ ID NO 13675 | CTGTTTACAGAACAATGAGTTC | CTA | chrX | 139533571 | 139533592 | 139533576 | 139533571 | - |
| SEQ ID NO 13676 | TTTACAGAACAATGAGTTCCAA | CTG | chrX | 139533568 | 139533589 | 139533573 | 139533568 | - |
| SEQ ID NO 13677 | ACAGAACAATGAGTTCCAAATA | TTT | chrX | 139533565 | 139533586 | 139533570 | 139533565 | - |
| SEQ ID NO 13678 | CAGAACAATGAGTTCCAAATAC | TTA | chrX | 139533564 | 139533585 | 139533569 | 139533564 | - |
| SEQ ID NO 13679 | CAAATACTCACCTATAGTCAGA | TTC | chrX | 139533549 | 139533570 | 139533554 | 139533549 | - |
| SEQ ID NO 13680 | ACCTATAGTCAGATACGTCTCC | CTC | chrX | 139533540 | 139533561 | 139533545 | 139533540 | - |

Figure 42 (Cont'd)

| | | | | | | | | |
|---|---|---|---|---|---|---|---|---|
| SEQ ID NO 13681 | TAGTCAGATACGTCTCCTGAAT | CTA | chrX | 139533535 | 139533556 | 139533540 | 139533535 | - |
| SEQ ID NO 13682 | CTGAATTTCAGATTATCTTTCC | CTC | chrX | 139533519 | 139533540 | 139533524 | 139533519 | - |
| SEQ ID NO 13683 | AATTTCAGATTATCTTTCCAAC | CTG | chrX | 139533516 | 139533537 | 139533521 | 139533516 | - |
| SEQ ID NO 13684 | CAGATTATCTTTCCAACTCCCT | TTT | chrX | 139533511 | 139533532 | 139533516 | 139533511 | - |
| SEQ ID NO 13685 | AGATTATCTTTCCAACTCCCTA | TTC | chrX | 139533510 | 139533531 | 139533515 | 139533510 | - |
| SEQ ID NO 13686 | TCTTTCCAACTCCCTAACTGTA | TTA | chrX | 139533504 | 139533525 | 139533509 | 139533504 | - |
| SEQ ID NO 13687 | TCCAACTCCCTAACTGTATATC | CTT | chrX | 139533500 | 139533521 | 139533505 | 139533500 | - |
| SEQ ID NO 13688 | CCAACTCCCTAACTGTATATCA | TTT | chrX | 139533499 | 139533520 | 139533504 | 139533499 | - |
| SEQ ID NO 13689 | CAACTCCCTAACTGTATATCAT | TTC | chrX | 139533498 | 139533519 | 139533503 | 139533498 | - |
| SEQ ID NO 13690 | CCTAACTGTATATCATAATGTA | CTC | chrX | 139533492 | 139533513 | 139533497 | 139533492 | - |
| SEQ ID NO 13691 | ACTGTATATCATAATGTAGCCA | CTA | chrX | 139533488 | 139533509 | 139533493 | 139533488 | - |
| SEQ ID NO 13692 | TATATCATAATGTAGCCAGTAA | CTG | chrX | 139533484 | 139533505 | 139533489 | 139533484 | - |
| SEQ ID NO 13693 | ATGTATATGTAATGCTTCTGCT | CTA | chrX | 139533456 | 139533477 | 139533461 | 139533456 | - |
| SEQ ID NO 13694 | CTGCTGTGTTGGACACTGTGCT | CTT | chrX | 139533439 | 139533460 | 139533444 | 139533439 | - |
| SEQ ID NO 13695 | TGCTGTGTTGGACACTGTGCTC | TTC | chrX | 139533438 | 139533459 | 139533443 | 139533438 | - |
| SEQ ID NO 13696 | CTGTGTTGGACACTGTGCTCAG | CTG | chrX | 139533436 | 139533457 | 139533441 | 139533436 | - |
| SEQ ID NO 13697 | TGTTGGACACTGTGCTCAGTAA | CTG | chrX | 139533433 | 139533454 | 139533438 | 139533433 | - |
| SEQ ID NO 13698 | GACACTGTGCTCAGTAACTTTG | TTG | chrX | 139533428 | 139533449 | 139533433 | 139533428 | - |
| SEQ ID NO 13699 | TGCTCAGTAACTTTGCATCCAT | CTG | chrX | 139533421 | 139533442 | 139533426 | 139533421 | - |
| SEQ ID NO 13700 | AGTAACTTTGCATCCATTATCT | CTC | chrX | 139533416 | 139533437 | 139533421 | 139533416 | - |
| SEQ ID NO 13701 | TGCATCCATTATCTCACTTCAT | CTT | chrX | 139533408 | 139533429 | 139533413 | 139533408 | - |
| SEQ ID NO 13702 | GCATCCATTATCTCACTTCATC | TTT | chrX | 139533407 | 139533428 | 139533412 | 139533407 | - |
| SEQ ID NO 13703 | CATCCATTATCTCACTTCATCC | TTG | chrX | 139533406 | 139533427 | 139533411 | 139533406 | - |
| SEQ ID NO 13704 | TCTCACTTCATCCTCACAAAAG | TTA | chrX | 139533397 | 139533418 | 139533402 | 139533397 | - |
| SEQ ID NO 13705 | ACTTCATCCTCACAAAAGTCCC | CTC | chrX | 139533393 | 139533414 | 139533398 | 139533393 | - |
| SEQ ID NO 13706 | CATCCTCACAAAAGTCCCACGA | CTT | chrX | 139533389 | 139533410 | 139533394 | 139533389 | - |
| SEQ ID NO 13707 | ATCCTCACAAAAGTCCCACGAG | TTC | chrX | 139533388 | 139533409 | 139533393 | 139533388 | - |
| SEQ ID NO 13708 | ACAAAAGTCCCACGAGATAGGC | CTC | chrX | 139533382 | 139533403 | 139533387 | 139533382 | - |
| SEQ ID NO 13709 | TCATCTTATTTTTATGAATGAG | CTG | chrX | 139533356 | 139533377 | 139533361 | 139533356 | - |
| SEQ ID NO 13710 | ATTTTTATGAATGAGGAAGATA | CTT | chrX | 139533349 | 139533370 | 139533354 | 139533349 | - |
| SEQ ID NO 13711 | TTTTTATGAATGAGGAAGATAG | TTA | chrX | 139533348 | 139533369 | 139533353 | 139533348 | - |
| SEQ ID NO 13712 | TTATGAATGAGGAAGATAGATT | TTT | chrX | 139533345 | 139533366 | 139533350 | 139533345 | - |
| SEQ ID NO 13713 | TATGAATGAGGAAGATAGATTC | TTT | chrX | 139533344 | 139533365 | 139533349 | 139533344 | - |
| SEQ ID NO 13714 | ATGAATGAGGAAGATAGATTCA | TTT | chrX | 139533343 | 139533364 | 139533348 | 139533343 | - |
| SEQ ID NO 13715 | TGAATGAGGAAGATAGATTCAT | TTA | chrX | 139533342 | 139533363 | 139533347 | 139533342 | - |
| SEQ ID NO 13716 | ATAGAGGCTAAGGGCTTTGCCC | TTC | chrX | 139533322 | 139533343 | 139533327 | 139533322 | - |
| SEQ ID NO 13717 | AGGGCTTTGCCCAAGGTAACAT | CTA | chrX | 139533312 | 139533333 | 139533317 | 139533312 | - |
| SEQ ID NO 13718 | TGCCCAAGGTAACATACTAAAA | CTT | chrX | 139533305 | 139533326 | 139533310 | 139533305 | - |
| SEQ ID NO 13719 | GCCCAAGGTAACATACTAAAAC | TTT | chrX | 139533304 | 139533325 | 139533309 | 139533304 | - |
| SEQ ID NO 13720 | CCCAAGGTAACATACTAAAACA | TTG | chrX | 139533303 | 139533324 | 139533308 | 139533303 | - |
| SEQ ID NO 13721 | AAACATTCAGGATTCAGACTCT | CTA | chrX | 139533286 | 139533307 | 139533291 | 139533286 | - |
| SEQ ID NO 13722 | AGGATTCAGACTCTGGCAGTCA | TTC | chrX | 139533278 | 139533299 | 139533283 | 139533278 | - |
| SEQ ID NO 13723 | AGACTCTGGCAGTCAGACTAAA | TTC | chrX | 139533271 | 139533292 | 139533276 | 139533271 | - |
| SEQ ID NO 13724 | TGGCAGTCAGACTAAAGAGCCA | CTC | chrX | 139533265 | 139533286 | 139533270 | 139533265 | - |
| SEQ ID NO 13725 | GCAGTCAGACTAAAGAGCCAGT | CTG | chrX | 139533263 | 139533284 | 139533268 | 139533263 | - |
| SEQ ID NO 13726 | AAGAGCCAGTTCTCTTAGACAT | CTA | chrX | 139533251 | 139533272 | 139533256 | 139533251 | - |
| SEQ ID NO 13727 | TCTTAGACATTATTCTGTGGTC | TTC | chrX | 139533239 | 139533260 | 139533244 | 139533239 | - |
| SEQ ID NO 13728 | TTAGACATTATTCTGTGGTCCA | CTC | chrX | 139533237 | 139533258 | 139533242 | 139533237 | - |
| SEQ ID NO 13729 | AGACATTATTCTGTGGTCCATA | CTT | chrX | 139533235 | 139533256 | 139533240 | 139533235 | - |
| SEQ ID NO 13730 | GACATTATTCTGTGGTCCATAA | TTA | chrX | 139533234 | 139533255 | 139533239 | 139533234 | - |
| SEQ ID NO 13731 | TTCTGTGGTCCATAATCACATC | TTA | chrX | 139533227 | 139533248 | 139533232 | 139533227 | - |
| SEQ ID NO 13732 | TGTGGTCCATAATCACATCAAA | TTC | chrX | 139533224 | 139533245 | 139533229 | 139533224 | - |
| SEQ ID NO 13733 | TGGTCCATAATCACATCAAACA | CTG | chrX | 139533222 | 139533243 | 139533227 | 139533222 | - |
| SEQ ID NO 13734 | TAGCCATTTCCCCTTCCATACC | CTC | chrX | 139533183 | 139533204 | 139533188 | 139533183 | - |
| SEQ ID NO 13735 | GCCATTTCCCCTTCCATACCCA | CTA | chrX | 139533181 | 139533202 | 139533186 | 139533181 | - |
| SEQ ID NO 13736 | CCCCTTCCATACCCAGATGGTT | TTT | chrX | 139533174 | 139533195 | 139533179 | 139533174 | - |
| SEQ ID NO 13737 | CCCTTCCATACCCAGATGGTTA | TTC | chrX | 139533173 | 139533194 | 139533178 | 139533173 | - |
| SEQ ID NO 13738 | CCATACCCAGATGGTTAAGTCA | CTT | chrX | 139533168 | 139533189 | 139533173 | 139533168 | - |
| SEQ ID NO 13739 | CATACCCAGATGGTTAAGTCAT | TTC | chrX | 139533167 | 139533188 | 139533172 | 139533167 | - |

Figure 42 (Cont'd)

| | | | | | | | | |
|---|---|---|---|---|---|---|---|---|
| SEQ ID NO 13740 | AGTCATACCACTTCTACTTCCT | TTA | chrX | 139533151 | 139533172 | 139533156 | 139533151 | - |
| SEQ ID NO 13741 | CTACTTCCTTAATATCATTTGA | CTT | chrX | 139533138 | 139533159 | 139533143 | 139533138 | - |
| SEQ ID NO 13742 | TACTTCCTTAATATCATTTGAA | TTC | chrX | 139533137 | 139533158 | 139533142 | 139533137 | - |
| SEQ ID NO 13743 | CTTCCTTAATATCATTTGAACT | CTA | chrX | 139533135 | 139533156 | 139533140 | 139533135 | - |
| SEQ ID NO 13744 | CCTTAATATCATTTGAACTCCC | CTT | chrX | 139533132 | 139533153 | 139533137 | 139533132 | - |
| SEQ ID NO 13745 | CTTAATATCATTTGAACTCCCC | TTC | chrX | 139533131 | 139533152 | 139533136 | 139533131 | - |
| SEQ ID NO 13746 | AATATCATTTGAACTCCCCTCT | CTT | chrX | 139533128 | 139533149 | 139533133 | 139533128 | - |
| SEQ ID NO 13747 | ATATCATTTGAACTCCCCTCTT | TTA | chrX | 139533127 | 139533148 | 139533132 | 139533127 | - |
| SEQ ID NO 13748 | GAACTCCCCTCTTTTTTTGTAC | TTT | chrX | 139533118 | 139533139 | 139533123 | 139533118 | - |
| SEQ ID NO 13749 | AACTCCCCTCTTTTTTTGTACT | TTG | chrX | 139533117 | 139533138 | 139533122 | 139533117 | - |
| SEQ ID NO 13750 | CCCTCTTTTTTTGTACTGCTAC | CTC | chrX | 139533112 | 139533133 | 139533117 | 139533112 | - |
| SEQ ID NO 13751 | TTTTTTGTACTGCTACTGTTC | CTC | chrX | 139533107 | 139533128 | 139533112 | 139533107 | - |
| SEQ ID NO 13752 | TTTTTGTACTGCTACTGTTCAG | CTT | chrX | 139533105 | 139533126 | 139533110 | 139533105 | - |
| SEQ ID NO 13753 | TTTTGTACTGCTACTGTTCAGG | TTT | chrX | 139533104 | 139533125 | 139533109 | 139533104 | - |
| SEQ ID NO 13754 | TTTGTACTGCTACTGTTCAGGT | TTT | chrX | 139533103 | 139533124 | 139533108 | 139533103 | - |
| SEQ ID NO 13755 | TTGTACTGCTACTGTTCAGGTT | TTT | chrX | 139533102 | 139533123 | 139533107 | 139533102 | - |
| SEQ ID NO 13756 | TGTACTGCTACTGTTCAGGTTC | TTT | chrX | 139533101 | 139533122 | 139533106 | 139533101 | - |
| SEQ ID NO 13757 | GTACTGCTACTGTTCAGGTTCT | TTT | chrX | 139533100 | 139533121 | 139533105 | 139533100 | - |
| SEQ ID NO 13758 | TACTGCTACTGTTCAGGTTCTA | TTG | chrX | 139533099 | 139533120 | 139533104 | 139533099 | - |
| SEQ ID NO 13759 | CTACTGTTCAGGTTCTAGCCTT | CTG | chrX | 139533094 | 139533115 | 139533099 | 139533094 | - |
| SEQ ID NO 13760 | CTGTTCAGGTTCTAGCCTTTAT | CTA | chrX | 139533091 | 139533112 | 139533096 | 139533091 | - |
| SEQ ID NO 13761 | TTCAGGTTCTAGCCTTTATGTC | CTG | chrX | 139533088 | 139533109 | 139533093 | 139533088 | - |
| SEQ ID NO 13762 | AGGTTCTAGCCTTTATGTCTCC | TTC | chrX | 139533085 | 139533106 | 139533090 | 139533085 | - |
| SEQ ID NO 13763 | TAGCCTTTATGTCTCCCGCAGA | TTC | chrX | 139533079 | 139533100 | 139533084 | 139533079 | - |
| SEQ ID NO 13764 | GCCTTTATGTCTCCCGCAGATA | CTA | chrX | 139533077 | 139533098 | 139533082 | 139533077 | - |
| SEQ ID NO 13765 | TATGTCTCCCGCAGATAATTGC | CTT | chrX | 139533072 | 139533093 | 139533077 | 139533072 | - |
| SEQ ID NO 13766 | ATGTCTCCCGCAGATAATTGCA | TTT | chrX | 139533071 | 139533092 | 139533076 | 139533071 | - |
| SEQ ID NO 13767 | TGTCTCCCGCAGATAATTGCAA | TTA | chrX | 139533070 | 139533091 | 139533075 | 139533070 | - |
| SEQ ID NO 13768 | CCGCAGATAATTGCAATAGTCT | CTC | chrX | 139533064 | 139533085 | 139533069 | 139533064 | - |
| SEQ ID NO 13769 | CAATAGTCTCAGGACTGCTCTC | TTG | chrX | 139533051 | 139533072 | 139533056 | 139533051 | - |
| SEQ ID NO 13770 | AGGACTGCTCTCTCCTAGTCTT | CTC | chrX | 139533041 | 139533062 | 139533046 | 139533041 | - |
| SEQ ID NO 13771 | CTCTCTCCTAGTCTTGGTACGG | CTG | chrX | 139533034 | 139533055 | 139533039 | 139533034 | - |
| SEQ ID NO 13772 | TCTCCTAGTCTTGGTACGGCCC | CTC | chrX | 139533031 | 139533052 | 139533036 | 139533031 | - |
| SEQ ID NO 13773 | TCCTAGTCTTGGTACGGCCCCC | CTC | chrX | 139533029 | 139533050 | 139533034 | 139533029 | - |
| SEQ ID NO 13774 | CTAGTCTTGGTACGGCCCCCTC | CTC | chrX | 139533027 | 139533048 | 139533032 | 139533027 | - |
| SEQ ID NO 13775 | GTCTTGGTACGGCCCCCTCCCC | CTA | chrX | 139533024 | 139533045 | 139533029 | 139533024 | - |
| SEQ ID NO 13776 | GGTACGGCCCCCTCCCCCACTA | CTT | chrX | 139533019 | 139533040 | 139533024 | 139533019 | - |
| SEQ ID NO 13777 | GTACGGCCCCCTCCCCCACTAT | TTG | chrX | 139533018 | 139533039 | 139533023 | 139533018 | - |
| SEQ ID NO 13778 | CCCCACTATCATTTCATTAGCG | CTC | chrX | 139533005 | 139533026 | 139533010 | 139533005 | - |
| SEQ ID NO 13779 | TCATTTCATTAGCGTGTTGCCA | CTA | chrX | 139532997 | 139533018 | 139533002 | 139532997 | - |
| SEQ ID NO 13780 | CATTAGCGTGTTGCCAGACTGG | TTT | chrX | 139532991 | 139533012 | 139532996 | 139532991 | - |
| SEQ ID NO 13781 | ATTAGCGTGTTGCCAGACTGGG | TTC | chrX | 139532990 | 139533011 | 139532995 | 139532990 | - |
| SEQ ID NO 13782 | GCGTGTTGCCAGACTGGGCATC | TTA | chrX | 139532986 | 139533007 | 139532991 | 139532986 | - |
| SEQ ID NO 13783 | CCAGACTGGGCATCCTAAATCA | TTG | chrX | 139532978 | 139532999 | 139532983 | 139532978 | - |
| SEQ ID NO 13784 | GGCATCCTAAATCAGCCATCAG | CTG | chrX | 139532970 | 139532991 | 139532975 | 139532970 | - |
| SEQ ID NO 13785 | AATCAGCCATCAGTGGTACTCC | CTA | chrX | 139532961 | 139532982 | 139532966 | 139532961 | - |
| SEQ ID NO 13786 | CTTATGTTTACTTCGATACC | CTC | chrX | 139532940 | 139532961 | 139532945 | 139532940 | - |
| SEQ ID NO 13787 | ATGTTTACTTCGATACCTCC | CTT | chrX | 139532937 | 139532958 | 139532942 | 139532937 | - |
| SEQ ID NO 13788 | TGTTTACTTCGATACCTCCA | TTA | chrX | 139532936 | 139532957 | 139532941 | 139532936 | - |
| SEQ ID NO 13789 | ATACTTCGATACCTCCATATTG | TTT | chrX | 139532931 | 139532952 | 139532936 | 139532931 | - |
| SEQ ID NO 13790 | TACTTCGATACCTCCATATTGC | TTA | chrX | 139532930 | 139532951 | 139532935 | 139532930 | - |
| SEQ ID NO 13791 | CGATACCTCCATATTGCATTTT | CTT | chrX | 139532925 | 139532946 | 139532930 | 139532925 | - |
| SEQ ID NO 13792 | GATACCTCCATATTGCATTTTA | TTC | chrX | 139532924 | 139532945 | 139532929 | 139532924 | - |
| SEQ ID NO 13793 | CATATTGCATTTTATTGTCCAA | CTC | chrX | 139532916 | 139532937 | 139532921 | 139532916 | - |
| SEQ ID NO 13794 | CATTTTATTGTCCAATCTCCTT | TTG | chrX | 139532909 | 139532930 | 139532914 | 139532909 | - |
| SEQ ID NO 13795 | TATTGTCCAATCTCCTTAGGTT | TTT | chrX | 139532904 | 139532925 | 139532909 | 139532904 | - |
| SEQ ID NO 13796 | ATTGTCCAATCTCCTTAGGTTA | TTT | chrX | 139532903 | 139532924 | 139532908 | 139532903 | - |
| SEQ ID NO 13797 | TTGTCCAATCTCCTTAGGTTAA | TTA | chrX | 139532902 | 139532923 | 139532907 | 139532902 | - |
| SEQ ID NO 13798 | TCCAATCTCCTTAGGTTAATGA | TTG | chrX | 139532899 | 139532920 | 139532904 | 139532899 | - |

Figure 42 (Cont'd)

| | | | | | | | | |
|---|---|---|---|---|---|---|---|---|
| SEQ ID NO 13799 | CTTAGGTTAATGACTTCATTAT | CTC | chrX | 139532890 | 139532911 | 139532895 | 139532890 | - |
| SEQ ID NO 13800 | AGGTTAATGACTTCATTATCTG | CTT | chrX | 139532887 | 139532908 | 139532892 | 139532887 | - |
| SEQ ID NO 13801 | GGTTAATGACTTCATTATCTGA | TTA | chrX | 139532886 | 139532907 | 139532891 | 139532886 | - |
| SEQ ID NO 13802 | ATGACTTCATTATCTGATGACC | TTA | chrX | 139532881 | 139532902 | 139532886 | 139532881 | - |
| SEQ ID NO 13803 | CATTATCTGATGACCAGCTCTG | CTT | chrX | 139532874 | 139532895 | 139532879 | 139532874 | - |
| SEQ ID NO 13804 | ATTATCTGATGACCAGCTCTGC | TTC | chrX | 139532873 | 139532894 | 139532878 | 139532873 | - |
| SEQ ID NO 13805 | TCTGATGACCAGCTCTGCCTAG | TTA | chrX | 139532869 | 139532890 | 139532874 | 139532869 | - |
| SEQ ID NO 13806 | ATGACCAGCTCTGCCTAGTTTA | CTG | chrX | 139532865 | 139532886 | 139532870 | 139532865 | - |
| SEQ ID NO 13807 | TGCCTAGTTTACCTGTCTCACT | CTC | chrX | 139532854 | 139532875 | 139532859 | 139532854 | - |
| SEQ ID NO 13808 | CCTAGTTTACCTGTCTCACTTG | CTG | chrX | 139532852 | 139532873 | 139532857 | 139532852 | - |
| SEQ ID NO 13809 | GTTTACCTGTCTCACTTGTCAT | CTA | chrX | 139532848 | 139532869 | 139532853 | 139532848 | - |
| SEQ ID NO 13810 | ACCTGTCTCACTTGTCATAGTC | TTT | chrX | 139532844 | 139532865 | 139532849 | 139532844 | - |
| SEQ ID NO 13811 | CCTGTCTCACTTGTCATAGTCC | TTA | chrX | 139532843 | 139532864 | 139532848 | 139532843 | - |
| SEQ ID NO 13812 | TCTCACTTGTCATAGTCCATAT | CTG | chrX | 139532839 | 139532860 | 139532844 | 139532839 | - |
| SEQ ID NO 13813 | ACTTGTCATAGTCCATATGGAA | CTC | chrX | 139532835 | 139532856 | 139532840 | 139532835 | - |
| SEQ ID NO 13814 | GTCATAGTCCATATGGAACCAT | CTT | chrX | 139532831 | 139532852 | 139532836 | 139532831 | - |
| SEQ ID NO 13815 | TCATAGTCCATATGGAACCATA | TTG | chrX | 139532830 | 139532851 | 139532835 | 139532830 | - |
| SEQ ID NO 13816 | CTGAAATACCTCACGTTCTTGC | CTC | chrX | 139532800 | 139532821 | 139532805 | 139532800 | - |
| SEQ ID NO 13817 | AAATACCTCACGTTCTTGCAAA | CTG | chrX | 139532797 | 139532818 | 139532802 | 139532797 | - |
| SEQ ID NO 13818 | ACGTTCTTGCAAATCTGAGTCT | CTC | chrX | 139532788 | 139532809 | 139532793 | 139532788 | - |
| SEQ ID NO 13819 | TTGCAAATCTGAGTCTTTGCAC | TTC | chrX | 139532782 | 139532803 | 139532787 | 139532782 | - |
| SEQ ID NO 13820 | GCAAATCTGAGTCTTTGCACGA | CTT | chrX | 139532780 | 139532801 | 139532785 | 139532780 | - |
| SEQ ID NO 13821 | CAAATCTGAGTCTTTGCACGAG | TTG | chrX | 139532779 | 139532800 | 139532784 | 139532779 | - |
| SEQ ID NO 13822 | AGTCTTTGCACGAGTGATCCTC | CTG | chrX | 139532771 | 139532792 | 139532776 | 139532771 | - |
| SEQ ID NO 13823 | TGCACGAGTGATCCTCTTTGCA | CTT | chrX | 139532765 | 139532786 | 139532770 | 139532765 | - |
| SEQ ID NO 13824 | GCACGAGTGATCCTCTTTGCAT | TTT | chrX | 139532764 | 139532785 | 139532769 | 139532764 | - |
| SEQ ID NO 13825 | CACGAGTGATCCTCTTTGCATA | TTG | chrX | 139532763 | 139532784 | 139532768 | 139532763 | - |
| SEQ ID NO 13826 | TTTGCATAAAATGCCCTTATAT | CTC | chrX | 139532749 | 139532770 | 139532754 | 139532749 | - |
| SEQ ID NO 13827 | TGCATAAAATGCCCTTATATCA | CTT | chrX | 139532747 | 139532768 | 139532752 | 139532747 | - |
| SEQ ID NO 13828 | GCATAAAATGCCCTTATATCAG | TTT | chrX | 139532746 | 139532767 | 139532751 | 139532746 | - |
| SEQ ID NO 13829 | CATAAAATGCCCTTATATCAGA | TTG | chrX | 139532745 | 139532766 | 139532750 | 139532745 | - |
| SEQ ID NO 13830 | ATATCAGACATTTAAAGAGAGA | CTT | chrX | 139532731 | 139532752 | 139532736 | 139532731 | - |
| SEQ ID NO 13831 | TATCAGACATTTAAAGAGAGAG | TTA | chrX | 139532730 | 139532751 | 139532735 | 139532730 | - |
| SEQ ID NO 13832 | AAAGAGAGAGAACGCCTACTCA | TTT | chrX | 139532718 | 139532739 | 139532723 | 139532718 | - |
| SEQ ID NO 13833 | AAGAGAGAGAACGCCTACTCAT | TTA | chrX | 139532717 | 139532738 | 139532722 | 139532717 | - |
| SEQ ID NO 13834 | CTCATCTTTTAAGACCCAGATG | CTA | chrX | 139532700 | 139532721 | 139532705 | 139532700 | - |
| SEQ ID NO 13835 | ATCTTTTAAGACCCAGATGAAA | CTC | chrX | 139532697 | 139532718 | 139532702 | 139532697 | - |
| SEQ ID NO 13836 | TTAAGACCCAGATGAAAATATT | CTT | chrX | 139532692 | 139532713 | 139532697 | 139532692 | - |
| SEQ ID NO 13837 | TAAGACCCAGATGAAAATATTC | TTT | chrX | 139532691 | 139532712 | 139532696 | 139532691 | - |
| SEQ ID NO 13838 | AAGACCCAGATGAAAATATTCT | TTT | chrX | 139532690 | 139532711 | 139532695 | 139532690 | - |
| SEQ ID NO 13839 | AGACCCAGATGAAAATATTCTC | TTA | chrX | 139532689 | 139532710 | 139532694 | 139532689 | - |
| SEQ ID NO 13840 | TCTCTCTATCAATTGTTTCCCC | TTC | chrX | 139532669 | 139532690 | 139532674 | 139532669 | - |
| SEQ ID NO 13841 | TCTCTATCAATTGTTTCCCCAT | CTC | chrX | 139532667 | 139532688 | 139532672 | 139532667 | - |
| SEQ ID NO 13842 | TCTATCAATTGTTTCCCCATTT | CTC | chrX | 139532665 | 139532686 | 139532670 | 139532665 | - |
| SEQ ID NO 13843 | TATCAATTGTTTCCCCATTTAA | CTC | chrX | 139532663 | 139532684 | 139532668 | 139532663 | - |
| SEQ ID NO 13844 | TCAATTGTTTCCCCATTTAATG | CTA | chrX | 139532661 | 139532682 | 139532666 | 139532661 | - |
| SEQ ID NO 13845 | TTTCCCCATTTAATGTGTTCCT | TTG | chrX | 139532654 | 139532675 | 139532659 | 139532654 | - |
| SEQ ID NO 13846 | CCCCATTTAATGTGTTCCTTTC | TTT | chrX | 139532651 | 139532672 | 139532656 | 139532651 | - |
| SEQ ID NO 13847 | CCCATTTAATGTGTTCCTTTCT | TTC | chrX | 139532650 | 139532671 | 139532655 | 139532650 | - |
| SEQ ID NO 13848 | AATGTGTTCCTTTCTCTATGAT | TTT | chrX | 139532643 | 139532664 | 139532648 | 139532643 | - |
| SEQ ID NO 13849 | ATGTGTTCCTTTCTCTATGATC | TTA | chrX | 139532642 | 139532663 | 139532647 | 139532642 | - |
| SEQ ID NO 13850 | CTTTCTCTATGATCCCTTAGTA | TTC | chrX | 139532634 | 139532655 | 139532639 | 139532634 | - |
| SEQ ID NO 13851 | TCTCTATGATCCCTTAGTACCT | CTT | chrX | 139532631 | 139532652 | 139532636 | 139532631 | - |
| SEQ ID NO 13852 | CTCTATGATCCCTTAGTACCTA | TTT | chrX | 139532630 | 139532651 | 139532635 | 139532630 | - |
| SEQ ID NO 13853 | TCTATGATCCCTTAGTACCTAG | TTC | chrX | 139532629 | 139532650 | 139532634 | 139532629 | - |
| SEQ ID NO 13854 | TATGATCCCTTAGTACCTAGTG | CTC | chrX | 139532627 | 139532648 | 139532632 | 139532627 | - |
| SEQ ID NO 13855 | TGATCCCTTAGTACCTAGTGCA | CTA | chrX | 139532625 | 139532646 | 139532630 | 139532625 | - |
| SEQ ID NO 13856 | AGTACCTAGTGCACATTTTATC | CTT | chrX | 139532616 | 139532637 | 139532621 | 139532616 | - |
| SEQ ID NO 13857 | GTACCTAGTGCACATTTTATCA | TTA | chrX | 139532615 | 139532636 | 139532620 | 139532615 | - |

Figure 42 (Cont'd)

| SEQ ID NO | Sequence | Codon | Chr | Pos1 | Pos2 | Pos3 | Pos4 | |
|---|---|---|---|---|---|---|---|---|
| SEQ ID NO 13858 | GTGCACATTTTATCACATTATA | CTA | chrX | 139532608 | 139532629 | 139532613 | 139532608 | - |
| SEQ ID NO 13859 | TATCACATTATATTGAAACCTC | TTT | chrX | 139532598 | 139532619 | 139532603 | 139532598 | - |
| SEQ ID NO 13860 | ATCACATTATATTGAAACCTCT | TTT | chrX | 139532597 | 139532618 | 139532602 | 139532597 | - |
| SEQ ID NO 13861 | TCACATTATATTGAAACCTCTC | TTA | chrX | 139532596 | 139532617 | 139532601 | 139532596 | - |
| SEQ ID NO 13862 | TATTGAAACCTCTCACCTGGCC | TTA | chrX | 139532588 | 139532609 | 139532593 | 139532588 | - |
| SEQ ID NO 13863 | AAACCTCTCACCTGGCCTCATG | TTG | chrX | 139532583 | 139532604 | 139532588 | 139532583 | - |
| SEQ ID NO 13864 | TCACCTGGCCTCATGCTGCTTT | CTC | chrX | 139532576 | 139532597 | 139532581 | 139532576 | - |
| SEQ ID NO 13865 | ACCTGGCCTCATGCTGCTTTAG | CTC | chrX | 139532574 | 139532595 | 139532579 | 139532574 | - |
| SEQ ID NO 13866 | GCCTCATGCTGCTTTAGATCAA | CTG | chrX | 139532569 | 139532590 | 139532574 | 139532569 | - |
| SEQ ID NO 13867 | ATGCTGCTTTAGATCAAAGAGG | CTC | chrX | 139532564 | 139532585 | 139532569 | 139532564 | - |
| SEQ ID NO 13868 | CTTTAGATCAAAGAGGGAGTCT | CTG | chrX | 139532558 | 139532579 | 139532563 | 139532558 | - |
| SEQ ID NO 13869 | TAGATCAAAGAGGGAGTCTGGT | CTT | chrX | 139532555 | 139532576 | 139532560 | 139532555 | - |
| SEQ ID NO 13870 | AGATCAAAGAGGGAGTCTGGTT | TTT | chrX | 139532554 | 139532575 | 139532559 | 139532554 | - |
| SEQ ID NO 13871 | GATCAAAGAGGGAGTCTGGTTT | TTA | chrX | 139532553 | 139532574 | 139532558 | 139532553 | - |
| SEQ ID NO 13872 | GTTTATCCCCATACCCCTAGTA | CTG | chrX | 139532535 | 139532556 | 139532540 | 139532535 | - |
| SEQ ID NO 13873 | ATCCCCATACCCCTAGTACCCT | TTT | chrX | 139532531 | 139532552 | 139532536 | 139532531 | - |
| SEQ ID NO 13874 | TCCCCATACCCCTAGTACCCTG | TTA | chrX | 139532530 | 139532551 | 139532535 | 139532530 | - |
| SEQ ID NO 13875 | GTACCCTGACACAGTACCTGGC | CTA | chrX | 139532516 | 139532537 | 139532521 | 139532516 | - |
| SEQ ID NO 13876 | ACACAGTACCTGGCACCATAGT | CTG | chrX | 139532508 | 139532529 | 139532513 | 139532508 | - |
| SEQ ID NO 13877 | GCACCATAGTTGTAACTCAGTA | CTG | chrX | 139532496 | 139532517 | 139532501 | 139532496 | - |
| SEQ ID NO 13878 | TAACTCAGTAATGTCTGAATGA | TTG | chrX | 139532484 | 139532505 | 139532489 | 139532484 | - |
| SEQ ID NO 13879 | AGTAATGTCTGAATGAAGGACA | CTC | chrX | 139532478 | 139532499 | 139532483 | 139532478 | - |
| SEQ ID NO 13880 | AATGAAGGACATCTTTGATGCA | CTG | chrX | 139532467 | 139532488 | 139532472 | 139532467 | - |
| SEQ ID NO 13881 | TGATGCATACACTTTACAAAAC | CTT | chrX | 139532452 | 139532473 | 139532457 | 139532452 | - |
| SEQ ID NO 13882 | GATGCATACACTTTACAAAACT | TTT | chrX | 139532451 | 139532472 | 139532456 | 139532451 | - |
| SEQ ID NO 13883 | ATGCATACACTTTACAAAACTA | TTG | chrX | 139532450 | 139532471 | 139532455 | 139532450 | - |
| SEQ ID NO 13884 | TACAAAACTAAACTGGTTTTAC | CTT | chrX | 139532438 | 139532459 | 139532443 | 139532438 | - |
| SEQ ID NO 13885 | ACAAAACTAAACTGGTTTTACA | TTT | chrX | 139532437 | 139532458 | 139532442 | 139532437 | - |
| SEQ ID NO 13886 | CAAAACTAAACTGGTTTTACAG | TTA | chrX | 139532436 | 139532457 | 139532441 | 139532436 | - |
| SEQ ID NO 13887 | AACTGGTTTTACAGAACTGTTT | CTA | chrX | 139532428 | 139532449 | 139532433 | 139532428 | - |
| SEQ ID NO 13888 | GTTTTACAGAACTGTTTTAATT | CTG | chrX | 139532423 | 139532444 | 139532428 | 139532423 | - |
| SEQ ID NO 13889 | TACAGAACTGTTTTAATTTCAA | TTT | chrX | 139532419 | 139532440 | 139532424 | 139532419 | - |
| SEQ ID NO 13890 | ACAGAACTGTTTTAATTTCAAA | TTT | chrX | 139532418 | 139532439 | 139532423 | 139532418 | - |
| SEQ ID NO 13891 | CAGAACTGTTTTAATTTCAAAA | TTA | chrX | 139532417 | 139532438 | 139532422 | 139532417 | - |
| SEQ ID NO 13892 | TTTTAATTTCAAAATTCCAAAC | CTG | chrX | 139532409 | 139532430 | 139532414 | 139532409 | - |
| SEQ ID NO 13893 | TAATTTCAAAATTCCAAACTGT | TTT | chrX | 139532406 | 139532427 | 139532411 | 139532406 | - |
| SEQ ID NO 13894 | AATTTCAAAATTCCAAACTGTT | TTT | chrX | 139532405 | 139532426 | 139532410 | 139532405 | - |
| SEQ ID NO 13895 | ATTTCAAAATTCCAAACTGTTG | TTA | chrX | 139532404 | 139532425 | 139532409 | 139532404 | - |
| SEQ ID NO 13896 | CAAAATTCCAAACTGTTGCAAT | TTT | chrX | 139532400 | 139532421 | 139532405 | 139532400 | - |
| SEQ ID NO 13897 | AAAATTCCAAACTGTTGCAATA | TTC | chrX | 139532399 | 139532420 | 139532404 | 139532399 | - |
| SEQ ID NO 13898 | CAAACTGTTGCAATAATACCTA | TTC | chrX | 139532392 | 139532413 | 139532397 | 139532392 | - |
| SEQ ID NO 13899 | TTGCAATAATACCTAAAGGCAG | CTG | chrX | 139532385 | 139532406 | 139532390 | 139532385 | - |
| SEQ ID NO 13900 | CAATAATACCTAAAGGCAGCAG | TTG | chrX | 139532382 | 139532403 | 139532387 | 139532382 | - |
| SEQ ID NO 13901 | AAGGCAGCAGCCATGAAAATGC | CTA | chrX | 139532370 | 139532391 | 139532375 | 139532370 | - |
| SEQ ID NO 13902 | AGCAAATCACTCACCGAAACTC | CTC | chrX | 139532340 | 139532361 | 139532345 | 139532340 | - |
| SEQ ID NO 13903 | ACCGAAACTCCTTTTAGAAGCC | CTC | chrX | 139532328 | 139532349 | 139532333 | 139532328 | - |
| SEQ ID NO 13904 | CTTTTAGAAGCCAATGAGAGTT | CTC | chrX | 139532318 | 139532339 | 139532323 | 139532318 | - |
| SEQ ID NO 13905 | TTAGAAGCCAATGAGAGTTTAA | CTT | chrX | 139532315 | 139532336 | 139532320 | 139532315 | - |
| SEQ ID NO 13906 | TAGAAGCCAATGAGAGTTTAAT | TTT | chrX | 139532314 | 139532335 | 139532319 | 139532314 | - |
| SEQ ID NO 13907 | AGAAGCCAATGAGAGTTTAATA | TTT | chrX | 139532313 | 139532334 | 139532318 | 139532313 | - |
| SEQ ID NO 13908 | GAAGCCAATGAGAGTTTAATAG | TTA | chrX | 139532312 | 139532333 | 139532317 | 139532312 | - |
| SEQ ID NO 13909 | AATAGCAGAAGAGAGTGCTGCA | TTT | chrX | 139532295 | 139532316 | 139532300 | 139532295 | - |
| SEQ ID NO 13910 | ATAGCAGAAGAGAGTGCTGCAT | TTA | chrX | 139532294 | 139532315 | 139532299 | 139532294 | - |
| SEQ ID NO 13911 | CATTAATACTGTCTATCCTTAG | CTG | chrX | 139532275 | 139532296 | 139532280 | 139532275 | - |
| SEQ ID NO 13912 | ATACTGTCTATCCTTAGAAAAA | TTA | chrX | 139532270 | 139532291 | 139532275 | 139532270 | - |
| SEQ ID NO 13913 | TCTATCCTTAGAAAAATTCCCC | CTG | chrX | 139532264 | 139532285 | 139532269 | 139532264 | - |
| SEQ ID NO 13914 | TCCTTAGAAAAATTCCCCTGGC | CTA | chrX | 139532260 | 139532281 | 139532265 | 139532260 | - |
| SEQ ID NO 13915 | AGAAAAATTCCCCTGGCCCCTT | CTT | chrX | 139532255 | 139532276 | 139532260 | 139532255 | - |
| SEQ ID NO 13916 | GAAAAATTCCCCTGGCCCCTTC | TTA | chrX | 139532254 | 139532275 | 139532259 | 139532254 | - |

Figure 42 (Cont'd)

| | | | | | | | | |
|---|---|---|---|---|---|---|---|---|
| SEQ ID NO 13917 | CCCTGGCCCCTTCCTCAAGGGC | TTC | chrX | 139532245 | 139532266 | 139532250 | 139532245 | - |
| SEQ ID NO 13918 | GCCCCTTCCTCAAGGGCTTATT | CTG | chrX | 139532240 | 139532261 | 139532245 | 139532240 | - |
| SEQ ID NO 13919 | CCTCAAGGGCTTATTATCTCTG | CTT | chrX | 139532233 | 139532254 | 139532238 | 139532233 | - |
| SEQ ID NO 13920 | CTCAAGGGCTTATTATCTCTGG | TTC | chrX | 139532232 | 139532253 | 139532237 | 139532232 | - |
| SEQ ID NO 13921 | AAGGGCTTATTATCTCTGGCTA | CTC | chrX | 139532229 | 139532250 | 139532234 | 139532229 | - |
| SEQ ID NO 13922 | ATTATCTCTGGCTACAATGGCT | CTT | chrX | 139532221 | 139532242 | 139532226 | 139532221 | - |
| SEQ ID NO 13923 | TTATCTCTGGCTACAATGGCTG | TTA | chrX | 139532220 | 139532241 | 139532225 | 139532220 | - |
| SEQ ID NO 13924 | TCTCTGGCTACAATGGCTGCAG | TTA | chrX | 139532217 | 139532238 | 139532222 | 139532217 | - |
| SEQ ID NO 13925 | TGGCTACAATGGCTGCAGAATC | CTC | chrX | 139532213 | 139532234 | 139532218 | 139532213 | - |
| SEQ ID NO 13926 | GCTACAATGGCTGCAGAATCAC | CTG | chrX | 139532211 | 139532232 | 139532216 | 139532211 | - |
| SEQ ID NO 13927 | CAATGGCTGCAGAATCACATTG | CTA | chrX | 139532207 | 139532228 | 139532212 | 139532207 | - |
| SEQ ID NO 13928 | CAGAATCACATTGCCTTTCTCC | CTG | chrX | 139532198 | 139532219 | 139532203 | 139532198 | - |
| SEQ ID NO 13929 | CCTTTCTCCTTAGTATTATCTG | TTG | chrX | 139532185 | 139532206 | 139532190 | 139532185 | - |
| SEQ ID NO 13930 | TCTCCTTAGTATTATCTGGGGA | CTT | chrX | 139532181 | 139532202 | 139532186 | 139532181 | - |
| SEQ ID NO 13931 | CTCCTTAGTATTATCTGGGGAT | TTT | chrX | 139532180 | 139532201 | 139532185 | 139532180 | - |
| SEQ ID NO 13932 | TCCTTAGTATTATCTGGGGATC | TTC | chrX | 139532179 | 139532200 | 139532184 | 139532179 | - |
| SEQ ID NO 13933 | CTTAGTATTATCTGGGGATCGT | CTC | chrX | 139532177 | 139532198 | 139532182 | 139532177 | - |
| SEQ ID NO 13934 | AGTATTATCTGGGGATCGTATA | CTT | chrX | 139532174 | 139532195 | 139532179 | 139532174 | - |
| SEQ ID NO 13935 | GTATTATCTGGGGATCGTATAC | TTA | chrX | 139532173 | 139532194 | 139532178 | 139532173 | - |
| SEQ ID NO 13936 | TCTGGGGATCGTATACTTAACT | TTA | chrX | 139532167 | 139532188 | 139532172 | 139532167 | - |
| SEQ ID NO 13937 | GGGATCGTATACTTAACTTCCC | CTG | chrX | 139532163 | 139532184 | 139532168 | 139532163 | - |
| SEQ ID NO 13938 | AACTTCCCTTCAGGTTTATCGC | CTT | chrX | 139532149 | 139532170 | 139532154 | 139532149 | - |
| SEQ ID NO 13939 | ACTTCCCTTCAGGTTTATCGCT | TTA | chrX | 139532148 | 139532169 | 139532153 | 139532148 | - |
| SEQ ID NO 13940 | CCCTTCAGGTTTATCGCTAGTC | CTT | chrX | 139532144 | 139532165 | 139532149 | 139532144 | - |
| SEQ ID NO 13941 | CCTTCAGGTTTATCGCTAGTCA | TTC | chrX | 139532143 | 139532164 | 139532148 | 139532143 | - |
| SEQ ID NO 13942 | CAGGTTTATCGCTAGTCATTAT | CTT | chrX | 139532139 | 139532160 | 139532144 | 139532139 | - |
| SEQ ID NO 13943 | AGGTTTATCGCTAGTCATTATT | TTC | chrX | 139532138 | 139532159 | 139532143 | 139532138 | - |
| SEQ ID NO 13944 | ATCGCTAGTCATTATTTCCCAG | TTT | chrX | 139532132 | 139532153 | 139532137 | 139532132 | - |
| SEQ ID NO 13945 | TCGCTAGTCATTATTTCCCAGG | TTA | chrX | 139532131 | 139532152 | 139532136 | 139532131 | - |
| SEQ ID NO 13946 | GTCATTATTTCCCAGGCTCCAA | CTA | chrX | 139532125 | 139532146 | 139532130 | 139532125 | - |
| SEQ ID NO 13947 | TTTCCCAGGCTCCAAAAGCCTG | TTA | chrX | 139532118 | 139532139 | 139532123 | 139532118 | - |
| SEQ ID NO 13948 | CCCAGGCTCCAAAAGCCTGGTT | TTT | chrX | 139532115 | 139532136 | 139532120 | 139532115 | - |
| SEQ ID NO 13949 | CCAGGCTCCAAAAGCCTGGTTC | TTC | chrX | 139532114 | 139532135 | 139532119 | 139532114 | - |
| SEQ ID NO 13950 | CAAAAGCCTGGTTCATCCTTAT | CTC | chrX | 139532106 | 139532127 | 139532111 | 139532106 | - |
| SEQ ID NO 13951 | GTTCATCCTTATTCTTATCTAT | CTG | chrX | 139532096 | 139532117 | 139532101 | 139532096 | - |
| SEQ ID NO 13952 | ATCCTTATTCTTATCTATCCTT | TTC | chrX | 139532092 | 139532113 | 139532097 | 139532092 | - |
| SEQ ID NO 13953 | ATTCTTATCTATCCTTTCCCCA | CTT | chrX | 139532086 | 139532107 | 139532091 | 139532086 | - |
| SEQ ID NO 13954 | TTCTTATCTATCCTTTCCCCAG | TTA | chrX | 139532085 | 139532106 | 139532090 | 139532085 | - |
| SEQ ID NO 13955 | TTATCTATCCTTTCCCCAGCAT | TTC | chrX | 139532082 | 139532103 | 139532087 | 139532082 | - |
| SEQ ID NO 13956 | ATCTATCCTTTCCCCAGCATCT | CTT | chrX | 139532080 | 139532101 | 139532085 | 139532080 | - |
| SEQ ID NO 13957 | TCTATCCTTTCCCCAGCATCTG | TTA | chrX | 139532079 | 139532100 | 139532084 | 139532079 | - |
| SEQ ID NO 13958 | TCCTTTCCCCAGCATCTGAAGT | CTA | chrX | 139532075 | 139532096 | 139532080 | 139532075 | - |
| SEQ ID NO 13959 | TCCCCAGCATCTGAAGTCTTCA | CTT | chrX | 139532070 | 139532091 | 139532075 | 139532070 | - |
| SEQ ID NO 13960 | CCCCAGCATCTGAAGTCTTCAA | TTT | chrX | 139532069 | 139532090 | 139532074 | 139532069 | - |
| SEQ ID NO 13961 | CCCAGCATCTGAAGTCTTCAAG | TTC | chrX | 139532068 | 139532089 | 139532073 | 139532068 | - |
| SEQ ID NO 13962 | AAGTCTTCAAGGGGCAGAAGC | CTG | chrX | 139532057 | 139532078 | 139532062 | 139532057 | - |
| SEQ ID NO 13963 | CAAGGGGCAGAAGCCCTCTTA | CTT | chrX | 139532050 | 139532071 | 139532055 | 139532050 | - |
| SEQ ID NO 13964 | AAGGGGGCAGAAGCCCTCTTAC | TTC | chrX | 139532049 | 139532070 | 139532054 | 139532049 | - |
| SEQ ID NO 13965 | TTACAACCTTCATCATCTCACC | CTC | chrX | 139532031 | 139532052 | 139532036 | 139532031 | - |
| SEQ ID NO 13966 | ACAACCTTCATCATCTCACCAC | CTT | chrX | 139532029 | 139532050 | 139532034 | 139532029 | - |
| SEQ ID NO 13967 | CAACCTTCATCATCTCACCACT | TTA | chrX | 139532028 | 139532049 | 139532033 | 139532028 | - |
| SEQ ID NO 13968 | CATCATCTCACCACTTATATAG | CTT | chrX | 139532021 | 139532042 | 139532026 | 139532021 | - |
| SEQ ID NO 13969 | ATCATCTCACCACTTATATAGA | TTC | chrX | 139532020 | 139532041 | 139532025 | 139532020 | - |
| SEQ ID NO 13970 | ACCACTTATATAGAAGAAAGGG | CTC | chrX | 139532012 | 139532033 | 139532017 | 139532012 | - |
| SEQ ID NO 13971 | ATATAGAAGAAAGGGTTTGGAT | CTT | chrX | 139532005 | 139532026 | 139532010 | 139532005 | - |
| SEQ ID NO 13972 | TATAGAAGAAAGGGTTTGGATG | TTA | chrX | 139532004 | 139532025 | 139532009 | 139532004 | - |
| SEQ ID NO 13973 | GGATGCTTTGTCCTCCCAGATG | TTT | chrX | 139531987 | 139532008 | 139531992 | 139531987 | - |
| SEQ ID NO 13974 | GATGCTTTGTCCTCCCAGATGT | TTG | chrX | 139531986 | 139532007 | 139531991 | 139531986 | - |
| SEQ ID NO 13975 | TGTCCTCCCAGATGTCACACTA | CTT | chrX | 139531979 | 139532000 | 139531984 | 139531979 | - |

Figure 42 (Cont'd)

| | | | | | | | | |
|---|---|---|---|---|---|---|---|---|
| SEQ ID NO 13976 | GTCCTCCCAGATGTCACACTAA | TTT | chrX | 139531978 | 139531999 | 139531983 | 139531978 | - |
| SEQ ID NO 13977 | TCCTCCCAGATGTCACACTAAT | TTG | chrX | 139531977 | 139531998 | 139531982 | 139531977 | - |
| SEQ ID NO 13978 | CCAGATGTCACACTAATGAGAT | CTC | chrX | 139531972 | 139531993 | 139531977 | 139531972 | - |
| SEQ ID NO 13979 | ATGAGATATATCTAATGGCCTT | CTA | chrX | 139531957 | 139531978 | 139531962 | 139531957 | - |
| SEQ ID NO 13980 | ATGGCCTTGCTTTATGTCCTGC | CTA | chrX | 139531943 | 139531964 | 139531948 | 139531943 | - |
| SEQ ID NO 13981 | GCTTTATGTCCTGCTTTGTGAG | CTT | chrX | 139531935 | 139531956 | 139531940 | 139531935 | - |
| SEQ ID NO 13982 | CTTTATGTCCTGCTTTGTGAGT | TTG | chrX | 139531934 | 139531955 | 139531939 | 139531934 | - |
| SEQ ID NO 13983 | TATGTCCTGCTTTGTGAGTTTT | CTT | chrX | 139531931 | 139531952 | 139531936 | 139531931 | - |
| SEQ ID NO 13984 | ATGTCCTGCTTTGTGAGTTTTC | TTT | chrX | 139531930 | 139531951 | 139531935 | 139531930 | - |
| SEQ ID NO 13985 | TGTCCTGCTTTGTGAGTTTTCC | TTA | chrX | 139531929 | 139531950 | 139531934 | 139531929 | - |
| SEQ ID NO 13986 | CTTTGTGAGTTTTCCAACAAAT | CTG | chrX | 139531922 | 139531943 | 139531927 | 139531922 | - |
| SEQ ID NO 13987 | TGTGAGTTTTCCAACAAATTTT | CTT | chrX | 139531919 | 139531940 | 139531924 | 139531919 | - |
| SEQ ID NO 13988 | GTGAGTTTTCCAACAAATTTTC | TTT | chrX | 139531918 | 139531939 | 139531923 | 139531918 | - |
| SEQ ID NO 13989 | TGAGTTTTCCAACAAATTTTCT | TTG | chrX | 139531917 | 139531938 | 139531922 | 139531917 | - |
| SEQ ID NO 13990 | TCCAACAAATTTTCTTTATCCC | TTT | chrX | 139531910 | 139531931 | 139531915 | 139531910 | - |
| SEQ ID NO 13991 | CCAACAAATTTTCTTTATCCCT | TTT | chrX | 139531909 | 139531930 | 139531914 | 139531909 | - |
| SEQ ID NO 13992 | CAACAAATTTTCTTTATCCCTT | TTC | chrX | 139531908 | 139531929 | 139531913 | 139531908 | - |
| SEQ ID NO 13993 | TCTTTATCCCTTGACTTTACTC | TTT | chrX | 139531898 | 139531919 | 139531903 | 139531898 | - |
| SEQ ID NO 13994 | CTTTATCCCTTGACTTTACTCA | TTT | chrX | 139531897 | 139531918 | 139531902 | 139531897 | - |
| SEQ ID NO 13995 | TTTATCCCTTGACTTTACTCAC | TTC | chrX | 139531896 | 139531917 | 139531901 | 139531896 | - |
| SEQ ID NO 13996 | TATCCCTTGACTTTACTCACTT | CTT | chrX | 139531894 | 139531915 | 139531899 | 139531894 | - |
| SEQ ID NO 13997 | ATCCCTTGACTTTACTCACTTT | TTT | chrX | 139531893 | 139531914 | 139531898 | 139531893 | - |
| SEQ ID NO 13998 | TCCCTTGACTTTACTCACTTTG | TTA | chrX | 139531892 | 139531913 | 139531897 | 139531892 | - |
| SEQ ID NO 13999 | GACTTTACTCACTTTGCTAGTT | CTT | chrX | 139531886 | 139531907 | 139531891 | 139531886 | - |
| SEQ ID NO 14000 | ACTTTACTCACTTTGCTAGTTT | TTG | chrX | 139531885 | 139531906 | 139531890 | 139531885 | - |
| SEQ ID NO 14001 | TACTCACTTTGCTAGTTTAACC | CTT | chrX | 139531881 | 139531902 | 139531886 | 139531881 | - |
| SEQ ID NO 14002 | ACTCACTTTGCTAGTTTAACCT | TTT | chrX | 139531880 | 139531901 | 139531885 | 139531880 | - |
| SEQ ID NO 14003 | CTCACTTTGCTAGTTTAACCTC | TTA | chrX | 139531879 | 139531900 | 139531884 | 139531879 | - |
| SEQ ID NO 14004 | ACTTTGCTAGTTTAACCTCTGT | CTC | chrX | 139531876 | 139531897 | 139531881 | 139531876 | - |
| SEQ ID NO 14005 | TGCTAGTTTAACCTCTGTATTT | CTT | chrX | 139531872 | 139531893 | 139531877 | 139531872 | - |
| SEQ ID NO 14006 | GCTAGTTTAACCTCTGTATTTT | TTT | chrX | 139531871 | 139531892 | 139531876 | 139531871 | - |
| SEQ ID NO 14007 | CTAGTTTAACCTCTGTATTTTT | TTG | chrX | 139531870 | 139531891 | 139531875 | 139531870 | - |
| SEQ ID NO 14008 | GTTTAACCTCTGTATTTTTTTT | CTA | chrX | 139531867 | 139531888 | 139531872 | 139531867 | - |
| SEQ ID NO 14009 | AACCTCTGTATTTTTTTTTATC | TTT | chrX | 139531863 | 139531884 | 139531868 | 139531863 | - |
| SEQ ID NO 14010 | ACCTCTGTATTTTTTTTTATCG | TTA | chrX | 139531862 | 139531883 | 139531867 | 139531862 | - |
| SEQ ID NO 14011 | TGTATTTTTTTTTATCGTTATT | CTC | chrX | 139531857 | 139531878 | 139531862 | 139531857 | - |
| SEQ ID NO 14012 | TATTTTTTTTTATCGTTATTTC | CTG | chrX | 139531855 | 139531876 | 139531860 | 139531855 | - |
| SEQ ID NO 14013 | TTTTTATCGTTATTTCAGCATT | TTT | chrX | 139531850 | 139531871 | 139531855 | 139531850 | - |
| SEQ ID NO 14014 | TTTTTATCGTTATTTCAGCATT | TTT | chrX | 139531849 | 139531870 | 139531854 | 139531849 | - |
| SEQ ID NO 14015 | TTTTATCGTTATTTCAGCATTT | TTT | chrX | 139531848 | 139531869 | 139531853 | 139531848 | - |
| SEQ ID NO 14016 | TTTATCGTTATTTCAGCATTTC | TTT | chrX | 139531847 | 139531868 | 139531852 | 139531847 | - |
| SEQ ID NO 14017 | TTATCGTTATTTCAGCATTTCA | TTT | chrX | 139531846 | 139531867 | 139531851 | 139531846 | - |
| SEQ ID NO 14018 | TATCGTTATTTCAGCATTTCAG | TTT | chrX | 139531845 | 139531866 | 139531850 | 139531845 | - |
| SEQ ID NO 14019 | ATCGTTATTTCAGCATTTCAGT | TTT | chrX | 139531844 | 139531865 | 139531849 | 139531844 | - |
| SEQ ID NO 14020 | TCGTTATTTCAGCATTTCAGTC | TTA | chrX | 139531843 | 139531864 | 139531848 | 139531843 | - |
| SEQ ID NO 14021 | TTTCAGCATTTCAGTCTGATTT | TTA | chrX | 139531837 | 139531858 | 139531842 | 139531837 | - |
| SEQ ID NO 14022 | CAGCATTTCAGTCTGATTTCAC | TTT | chrX | 139531834 | 139531855 | 139531839 | 139531834 | - |
| SEQ ID NO 14023 | AGCATTTCAGTCTGATTTCACA | TTC | chrX | 139531833 | 139531854 | 139531838 | 139531833 | - |
| SEQ ID NO 14024 | CAGTCTGATTTCACAGCTGACA | TTT | chrX | 139531826 | 139531847 | 139531831 | 139531826 | - |
| SEQ ID NO 14025 | AGTCTGATTTCACAGCTGACAT | TTC | chrX | 139531825 | 139531846 | 139531830 | 139531825 | - |
| SEQ ID NO 14026 | ATTTCACAGCTGACATCATGTC | CTG | chrX | 139531819 | 139531840 | 139531824 | 139531819 | - |
| SEQ ID NO 14027 | CACAGCTGACATCATGTCTGGA | TTT | chrX | 139531815 | 139531836 | 139531820 | 139531815 | - |
| SEQ ID NO 14028 | ACAGCTGACATCATGTCTGGAG | TTC | chrX | 139531814 | 139531835 | 139531819 | 139531814 | - |
| SEQ ID NO 14029 | ACATCATGTCTGGAGTGGGAAC | CTG | chrX | 139531807 | 139531828 | 139531812 | 139531807 | - |
| SEQ ID NO 14030 | GAGTGGGAACCACAGGGCCAGT | CTG | chrX | 139531795 | 139531816 | 139531800 | 139531795 | - |
| SEQ ID NO 14031 | TCTGGGGGTGCTTAGGGTTGGC | CTT | chrX | 139531767 | 139531788 | 139531772 | 139531767 | - |
| SEQ ID NO 14032 | CTGGGGGTGCTTAGGGTTGGCA | TTT | chrX | 139531766 | 139531787 | 139531771 | 139531766 | - |
| SEQ ID NO 14033 | TGGGGGTGCTTAGGGTTGGCAC | TTC | chrX | 139531765 | 139531786 | 139531770 | 139531765 | - |
| SEQ ID NO 14034 | GGGGGTGCTTAGGGTTGGCACCC | CTG | chrX | 139531763 | 139531784 | 139531768 | 139531763 | - |

Figure 42 (Cont'd)

| SEQ ID NO | Sequence | Codon | Chr | Pos1 | Pos2 | Pos3 | Pos4 | |
|---|---|---|---|---|---|---|---|---|
| SEQ ID NO 14035 | AGGGTTGGCACCCCTGATCCTG | CTT | chrX | 139531754 | 139531775 | 139531759 | 139531754 | - |
| SEQ ID NO 14036 | GGGTTGGCACCCCTGATCCTGG | TTA | chrX | 139531753 | 139531774 | 139531758 | 139531753 | - |
| SEQ ID NO 14037 | GCACCCCTGATCCTGGTACTGT | TTG | chrX | 139531747 | 139531768 | 139531752 | 139531747 | - |
| SEQ ID NO 14038 | ATCCTGGTACTGTCAGCTACTA | CTG | chrX | 139531738 | 139531759 | 139531743 | 139531738 | - |
| SEQ ID NO 14039 | GTACTGTCAGCTACTAGATTTG | CTG | chrX | 139531732 | 139531753 | 139531737 | 139531732 | - |
| SEQ ID NO 14040 | TCAGCTACTAGATTTGATTCTA | CTG | chrX | 139531726 | 139531747 | 139531731 | 139531726 | - |
| SEQ ID NO 14041 | CTAGATTTGATTCTAGAAAGTT | CTA | chrX | 139531719 | 139531740 | 139531724 | 139531719 | - |
| SEQ ID NO 14042 | GATTTGATTCTAGAAAGTTGAC | CTA | chrX | 139531716 | 139531737 | 139531721 | 139531716 | - |
| SEQ ID NO 14043 | GATTCTAGAAAGTTGACAAGTA | TTT | chrX | 139531711 | 139531732 | 139531716 | 139531711 | - |
| SEQ ID NO 14044 | ATTCTAGAAAGTTGACAAGTAA | TTG | chrX | 139531710 | 139531731 | 139531715 | 139531710 | - |
| SEQ ID NO 14045 | TAGAAAGTTGACAAGTAAGTGT | TTC | chrX | 139531706 | 139531727 | 139531711 | 139531706 | - |
| SEQ ID NO 14046 | GAAAGTTGACAAGTAAGTGTGA | CTA | chrX | 139531704 | 139531725 | 139531709 | 139531704 | - |
| SEQ ID NO 14047 | ACAAGTAAGTGTGATAAATGCT | TTG | chrX | 139531696 | 139531717 | 139531701 | 139531696 | - |
| SEQ ID NO 14048 | CCTGTGAGAACATGCTGTTTGT | CTT | chrX | 139531673 | 139531694 | 139531678 | 139531673 | - |
| SEQ ID NO 14049 | CTGTGAGAACATGCTGTTTGTC | TTC | chrX | 139531672 | 139531693 | 139531677 | 139531672 | - |
| SEQ ID NO 14050 | TGAGAACATGCTGTTTGTCCAA | CTG | chrX | 139531669 | 139531690 | 139531674 | 139531669 | - |
| SEQ ID NO 14051 | TTTGTCCAAATGGGATAATTTC | CTG | chrX | 139531656 | 139531677 | 139531661 | 139531656 | - |
| SEQ ID NO 14052 | GTCCAAATGGGATAATTTCTTC | TTT | chrX | 139531653 | 139531674 | 139531658 | 139531653 | - |
| SEQ ID NO 14053 | TCCAAATGGGATAATTTCTTCC | TTG | chrX | 139531652 | 139531673 | 139531657 | 139531652 | - |
| SEQ ID NO 14054 | CTTCCCTGTATGCCTTCCTCTG | TTT | chrX | 139531635 | 139531656 | 139531640 | 139531635 | - |
| SEQ ID NO 14055 | TTCCCTGTATGCCTTCCTCTGG | TTC | chrX | 139531634 | 139531655 | 139531639 | 139531634 | - |
| SEQ ID NO 14056 | CCCTGTATGCCTTCCTCTGGGA | CTT | chrX | 139531632 | 139531653 | 139531637 | 139531632 | - |
| SEQ ID NO 14057 | CCTGTATGCCTTCCTCTGGGAA | TTC | chrX | 139531631 | 139531652 | 139531636 | 139531631 | - |
| SEQ ID NO 14058 | TATGCCTTCCTCTGGGAAATAC | CTG | chrX | 139531627 | 139531648 | 139531632 | 139531627 | - |
| SEQ ID NO 14059 | CCTCTGGGAAATACATAAAGTC | CTT | chrX | 139531619 | 139531640 | 139531624 | 139531619 | - |
| SEQ ID NO 14060 | CTCTGGGAAATACATAAAGTCA | TTC | chrX | 139531618 | 139531639 | 139531623 | 139531618 | - |
| SEQ ID NO 14061 | TGGGAAATACATAAAGTCACTG | CTC | chrX | 139531615 | 139531636 | 139531620 | 139531615 | - |
| SEQ ID NO 14062 | GGAAATACATAAAGTCACTGTA | CTG | chrX | 139531613 | 139531634 | 139531618 | 139531613 | - |
| SEQ ID NO 14063 | TAGTTGTGAAAAACAAAGTGA | CTG | chrX | 139531593 | 139531614 | 139531598 | 139531593 | - |
| SEQ ID NO 14064 | TGAAAAACAAAGTGATATATG | TTG | chrX | 139531587 | 139531608 | 139531592 | 139531587 | - |
| SEQ ID NO 14065 | CATTAGCTAACTTCCTACTCTT | TTG | chrX | 139531562 | 139531583 | 139531567 | 139531562 | - |
| SEQ ID NO 14066 | GCTAACTTCCTACTCTTTATGT | TTA | chrX | 139531557 | 139531578 | 139531562 | 139531557 | - |
| SEQ ID NO 14067 | ACTTCCTACTCTTTATGTCAAT | CTA | chrX | 139531553 | 139531574 | 139531558 | 139531553 | - |
| SEQ ID NO 14068 | CCTACTCTTTATGTCAATTCTT | CTT | chrX | 139531549 | 139531570 | 139531554 | 139531549 | - |
| SEQ ID NO 14069 | CTACTCTTTATGTCAATTCTTA | TTC | chrX | 139531548 | 139531569 | 139531553 | 139531548 | - |
| SEQ ID NO 14070 | CTCTTTATGTCAATTCTTAAGC | CTA | chrX | 139531545 | 139531566 | 139531550 | 139531545 | - |
| SEQ ID NO 14071 | TTTATGTCAATTCTTAAGCTTG | CTC | chrX | 139531542 | 139531563 | 139531547 | 139531542 | - |
| SEQ ID NO 14072 | TATGTCAATTCTTAAGCTTGCT | CTT | chrX | 139531540 | 139531561 | 139531545 | 139531540 | - |
| SEQ ID NO 14073 | ATGTCAATTCTTAAGCTTGCTT | TTT | chrX | 139531539 | 139531560 | 139531544 | 139531539 | - |
| SEQ ID NO 14074 | TGTCAATTCTTAAGCTTGCTTT | TTA | chrX | 139531538 | 139531559 | 139531543 | 139531538 | - |
| SEQ ID NO 14075 | TTAAGCTTGCTTTTCTCCCCTA | TTC | chrX | 139531529 | 139531550 | 139531534 | 139531529 | - |
| SEQ ID NO 14076 | AAGCTTGCTTTTCTCCCCTAGG | CTT | chrX | 139531527 | 139531548 | 139531532 | 139531527 | - |
| SEQ ID NO 14077 | AGCTTGCTTTTCTCCCCTAGGG | TTA | chrX | 139531526 | 139531547 | 139531531 | 139531526 | - |
| SEQ ID NO 14078 | GCTTTTCTCCCCTAGGGAACTC | CTT | chrX | 139531521 | 139531542 | 139531526 | 139531521 | - |
| SEQ ID NO 14079 | CTTTTCTCCCCTAGGGAACTCA | TTG | chrX | 139531520 | 139531541 | 139531525 | 139531520 | - |
| SEQ ID NO 14080 | TTCTCCCCTAGGGAACTCAACT | CTT | chrX | 139531517 | 139531538 | 139531522 | 139531517 | - |
| SEQ ID NO 14081 | TCTCCCCTAGGGAACTCAACTG | TTT | chrX | 139531516 | 139531537 | 139531521 | 139531516 | - |
| SEQ ID NO 14082 | CTCCCCTAGGGAACTCAACTGA | TTT | chrX | 139531515 | 139531536 | 139531520 | 139531515 | - |
| SEQ ID NO 14083 | TCCCCTAGGGAACTCAACTGAG | TTC | chrX | 139531514 | 139531535 | 139531519 | 139531514 | - |
| SEQ ID NO 14084 | CCCTAGGGAACTCAACTGAGTA | CTC | chrX | 139531512 | 139531533 | 139531517 | 139531512 | - |
| SEQ ID NO 14085 | GGGAACTCAACTGAGTATTGTG | CTA | chrX | 139531507 | 139531528 | 139531512 | 139531507 | - |
| SEQ ID NO 14086 | AACTGAGTATTGTGTTTCCCCA | CTC | chrX | 139531499 | 139531520 | 139531504 | 139531499 | - |
| SEQ ID NO 14087 | AGTATTGTGTTTCCCCAAATAT | CTG | chrX | 139531494 | 139531515 | 139531499 | 139531494 | - |
| SEQ ID NO 14088 | TGTTTCCCCAAATATCAACTCC | TTG | chrX | 139531487 | 139531508 | 139531492 | 139531487 | - |
| SEQ ID NO 14089 | CCCCAAATATCAACTCCAAGAT | TTT | chrX | 139531482 | 139531503 | 139531487 | 139531482 | - |
| SEQ ID NO 14090 | CCCAAATATCAACTCCAAGATG | TTC | chrX | 139531481 | 139531502 | 139531486 | 139531481 | - |
| SEQ ID NO 14091 | CAAGATGTTTGACATAGAGACA | CTC | chrX | 139531466 | 139531487 | 139531471 | 139531466 | - |
| SEQ ID NO 14092 | GACATAGAGACAAAATGATTTT | TTT | chrX | 139531456 | 139531477 | 139531461 | 139531456 | - |
| SEQ ID NO 14093 | ACATAGAGACAAAATGATTTTT | TTG | chrX | 139531455 | 139531476 | 139531460 | 139531455 | - |

Figure 42 (Cont'd)

| | | | | | | | | |
|---|---|---|---|---|---|---|---|---|
| SEQ ID NO 14094 | TTTCCTAATCCATGAAAAGCTT | TTT | chrX | 139531435 | 139531456 | 139531440 | 139531435 | - |
| SEQ ID NO 14095 | TTCCTAATCCATGAAAAGCTTT | TTT | chrX | 139531434 | 139531455 | 139531439 | 139531434 | - |
| SEQ ID NO 14096 | TCCTAATCCATGAAAAGCTTTG | TTT | chrX | 139531433 | 139531454 | 139531438 | 139531433 | - |
| SEQ ID NO 14097 | CCTAATCCATGAAAAGCTTTGG | TTT | chrX | 139531432 | 139531453 | 139531437 | 139531432 | - |
| SEQ ID NO 14098 | CTAATCCATGAAAAGCTTTGGT | TTC | chrX | 139531431 | 139531452 | 139531436 | 139531431 | - |
| SEQ ID NO 14099 | ATCCATGAAAAGCTTTGGTGAT | CTA | chrX | 139531428 | 139531449 | 139531433 | 139531428 | - |
| SEQ ID NO 14100 | TGGTGATAACTAACAGCTTGCT | CTT | chrX | 139531413 | 139531434 | 139531418 | 139531413 | - |
| SEQ ID NO 14101 | GGTGATAACTAACAGCTTGCTA | TTT | chrX | 139531412 | 139531433 | 139531417 | 139531412 | - |
| SEQ ID NO 14102 | GTGATAACTAACAGCTTGCTAA | TTG | chrX | 139531411 | 139531432 | 139531416 | 139531411 | - |
| SEQ ID NO 14103 | ACAGCTTGCTAATGAAAGGTTA | CTA | chrX | 139531401 | 139531422 | 139531406 | 139531401 | - |
| SEQ ID NO 14104 | GCTAATGAAAGGTTAATCTTTA | CTT | chrX | 139531394 | 139531415 | 139531399 | 139531394 | - |
| SEQ ID NO 14105 | CTAATGAAAGGTTAATCTTTAT | TTG | chrX | 139531393 | 139531414 | 139531398 | 139531393 | - |
| SEQ ID NO 14106 | ATGAAAGGTTAATCTTTATGTT | CTA | chrX | 139531390 | 139531411 | 139531395 | 139531390 | - |
| SEQ ID NO 14107 | ATCTTTATGTTTTAACTAAAAC | TTA | chrX | 139531379 | 139531400 | 139531384 | 139531379 | - |
| SEQ ID NO 14108 | TATGTTTTAACTAAAACTTTAA | CTT | chrX | 139531374 | 139531395 | 139531379 | 139531374 | - |
| SEQ ID NO 14109 | ATGTTTTAACTAAAACTTTAAA | TTT | chrX | 139531373 | 139531394 | 139531378 | 139531373 | - |
| SEQ ID NO 14110 | TGTTTTAACTAAAACTTTAAAT | TTA | chrX | 139531372 | 139531393 | 139531377 | 139531372 | - |
| SEQ ID NO 14111 | TAACTAAAACTTTAAATTGAAG | TTT | chrX | 139531367 | 139531388 | 139531372 | 139531367 | - |
| SEQ ID NO 14112 | AACTAAAACTTTAAATTGAAGA | TTT | chrX | 139531366 | 139531387 | 139531371 | 139531366 | - |
| SEQ ID NO 14113 | ACTAAAACTTTAAATTGAAGAT | TTA | chrX | 139531365 | 139531386 | 139531370 | 139531365 | - |
| SEQ ID NO 14114 | AAACTTTAAATTGAAGATATAT | CTA | chrX | 139531361 | 139531382 | 139531366 | 139531361 | - |
| SEQ ID NO 14115 | TAAATTGAAGATATATAATTTA | CTT | chrX | 139531355 | 139531376 | 139531360 | 139531355 | - |
| SEQ ID NO 14116 | AAATTGAAGATATATAATTTAA | TTT | chrX | 139531354 | 139531375 | 139531359 | 139531354 | - |
| SEQ ID NO 14117 | AATTGAAGATATATAATTTAAA | TTA | chrX | 139531353 | 139531374 | 139531358 | 139531353 | - |
| SEQ ID NO 14118 | AAGATATATAATTTAAAAAATT | TTG | chrX | 139531348 | 139531369 | 139531353 | 139531348 | - |
| SEQ ID NO 14119 | AAAAAATTAGAGACACACCTCA | TTT | chrX | 139531334 | 139531355 | 139531339 | 139531334 | - |
| SEQ ID NO 14120 | AAAAATTAGAGACACACCTCAT | TTA | chrX | 139531333 | 139531354 | 139531338 | 139531333 | - |
| SEQ ID NO 14121 | GAGACACACCTCATTACATACT | TTA | chrX | 139531325 | 139531346 | 139531330 | 139531325 | - |
| SEQ ID NO 14122 | ATTACATACTTCTGAAACCTTG | CTC | chrX | 139531313 | 139531334 | 139531318 | 139531313 | - |
| SEQ ID NO 14123 | CATACTTCTGAAACCTTGAAAT | TTA | chrX | 139531309 | 139531330 | 139531314 | 139531309 | - |
| SEQ ID NO 14124 | CTGAAACCTTGAAATGTCATAT | CTT | chrX | 139531302 | 139531323 | 139531307 | 139531302 | - |
| SEQ ID NO 14125 | TGAAACCTTGAAATGTCATATA | TTC | chrX | 139531301 | 139531322 | 139531306 | 139531301 | - |
| SEQ ID NO 14126 | AAACCTTGAAATGTCATATATC | CTG | chrX | 139531299 | 139531320 | 139531304 | 139531299 | - |
| SEQ ID NO 14127 | GAAATGTCATATATCTTAAAAT | CTT | chrX | 139531292 | 139531313 | 139531297 | 139531292 | - |
| SEQ ID NO 14128 | AAATGTCATATATCTTAAAATC | TTG | chrX | 139531291 | 139531312 | 139531296 | 139531291 | - |
| SEQ ID NO 14129 | AAAATCAGACTTTTTGTGTAAA | CTT | chrX | 139531275 | 139531296 | 139531280 | 139531275 | - |
| SEQ ID NO 14130 | AAATCAGACTTTTTGTGTAAAT | TTA | chrX | 139531274 | 139531295 | 139531279 | 139531274 | - |
| SEQ ID NO 14131 | TTTGTGTAAATAAGGCCATTGT | CTT | chrX | 139531263 | 139531284 | 139531268 | 139531263 | - |
| SEQ ID NO 14132 | TTGTGTAAATAAGGCCATTGTT | TTT | chrX | 139531262 | 139531283 | 139531267 | 139531262 | - |
| SEQ ID NO 14133 | TGTGTAAATAAGGCCATTGTTT | TTT | chrX | 139531261 | 139531282 | 139531266 | 139531261 | - |
| SEQ ID NO 14134 | GTGTAAATAAGGCCATTGTTTG | TTT | chrX | 139531260 | 139531281 | 139531265 | 139531260 | - |
| SEQ ID NO 14135 | TGTAAATAAGGCCATTGTTTGT | TTG | chrX | 139531259 | 139531280 | 139531264 | 139531259 | - |
| SEQ ID NO 14136 | TTTGTGCTTTTGTTTCCCATTT | TTG | chrX | 139531242 | 139531263 | 139531247 | 139531242 | - |
| SEQ ID NO 14137 | GTGCTTTTGTTTCCCATTTTGA | TTT | chrX | 139531239 | 139531260 | 139531244 | 139531239 | - |
| SEQ ID NO 14138 | TGCTTTTGTTTCCCATTTTGAT | TTG | chrX | 139531238 | 139531259 | 139531243 | 139531238 | - |
| SEQ ID NO 14139 | TTGTTTCCCATTTTGATTTCAA | CTT | chrX | 139531233 | 139531254 | 139531238 | 139531233 | - |
| SEQ ID NO 14140 | TGTTTCCCATTTTGATTTCAAA | TTT | chrX | 139531232 | 139531253 | 139531237 | 139531232 | - |
| SEQ ID NO 14141 | GTTTCCCATTTTGATTTCAAAG | TTT | chrX | 139531231 | 139531252 | 139531236 | 139531231 | - |
| SEQ ID NO 14142 | TTTCCCATTTTGATTTCAAAGT | TTG | chrX | 139531230 | 139531251 | 139531235 | 139531230 | - |
| SEQ ID NO 14143 | CCCATTTTGATTTCAAAGTGGT | TTT | chrX | 139531227 | 139531248 | 139531232 | 139531227 | - |
| SEQ ID NO 14144 | CCATTTTGATTTCAAAGTGGTA | TTC | chrX | 139531226 | 139531247 | 139531231 | 139531226 | - |
| SEQ ID NO 14145 | TGATTTCAAAGTGGTAAGTCCA | TTT | chrX | 139531220 | 139531241 | 139531225 | 139531220 | - |
| SEQ ID NO 14146 | GATTTCAAAGTGGTAAGTCCAA | TTT | chrX | 139531219 | 139531240 | 139531224 | 139531219 | - |
| SEQ ID NO 14147 | ATTTCAAAGTGGTAAGTCCAAA | TTG | chrX | 139531218 | 139531239 | 139531223 | 139531218 | - |
| SEQ ID NO 14148 | CAAAGTGGTAAGTCCAAACAAA | TTT | chrX | 139531214 | 139531235 | 139531219 | 139531214 | - |
| SEQ ID NO 14149 | AAAGTGGTAAGTCCAAACAAAA | TTC | chrX | 139531213 | 139531234 | 139531218 | 139531213 | - |
| SEQ ID NO 14150 | TTTTTTTTCACTATATTCTGCT | TTA | chrX | 139531179 | 139531200 | 139531184 | 139531179 | - |
| SEQ ID NO 14151 | TTTTTCACTATATTCTGCTATT | TTT | chrX | 139531176 | 139531197 | 139531181 | 139531176 | - |
| SEQ ID NO 14152 | TTTTCACTATATTCTGCTATTT | TTT | chrX | 139531175 | 139531196 | 139531180 | 139531175 | - |

Figure 42 (Cont'd)

| | | | | | | | | |
|---|---|---|---|---|---|---|---|---|
| SEQ ID NO 14153 | TTTCACTATATTCTGCTATTTC | TTT | chrX | 139531174 | 139531195 | 139531179 | 139531174 | - |
| SEQ ID NO 14154 | TTCACTATATTCTGCTATTTCT | TTT | chrX | 139531173 | 139531194 | 139531178 | 139531173 | - |
| SEQ ID NO 14155 | TCACTATATTCTGCTATTTCTT | TTT | chrX | 139531172 | 139531193 | 139531177 | 139531172 | - |
| SEQ ID NO 14156 | CACTATATTCTGCTATTTCTTT | TTT | chrX | 139531171 | 139531192 | 139531176 | 139531171 | - |
| SEQ ID NO 14157 | ACTATATTCTGCTATTTCTTTG | TTC | chrX | 139531170 | 139531191 | 139531175 | 139531170 | - |
| SEQ ID NO 14158 | TATTCTGCTATTTCTTTGTTTT | CTA | chrX | 139531166 | 139531187 | 139531171 | 139531166 | - |
| SEQ ID NO 14159 | TGCTATTTCTTTGTTTTCCCAC | TTC | chrX | 139531161 | 139531182 | 139531166 | 139531161 | - |
| SEQ ID NO 14160 | CTATTTCTTTGTTTTCCCACTT | CTG | chrX | 139531159 | 139531180 | 139531164 | 139531159 | - |
| SEQ ID NO 14161 | TTTCTTTGTTTTCCCACTTTTA | CTA | chrX | 139531156 | 139531177 | 139531161 | 139531156 | - |
| SEQ ID NO 14162 | CTTTGTTTTCCCACTTTTAATT | TTT | chrX | 139531153 | 139531174 | 139531158 | 139531153 | - |
| SEQ ID NO 14163 | TTTGTTTTCCCACTTTTAATTT | TTC | chrX | 139531152 | 139531173 | 139531157 | 139531152 | - |
| SEQ ID NO 14164 | TGTTTTCCCACTTTTAATTTTT | CTT | chrX | 139531150 | 139531171 | 139531155 | 139531150 | - |
| SEQ ID NO 14165 | GTTTTCCCACTTTTAATTTTTT | TTT | chrX | 139531149 | 139531170 | 139531154 | 139531149 | - |
| SEQ ID NO 14166 | TTTTCCCACTTTTAATTTTTTT | TTG | chrX | 139531148 | 139531169 | 139531153 | 139531148 | - |
| SEQ ID NO 14167 | TCCCACTTTTAATTTTTTTAAA | TTT | chrX | 139531145 | 139531166 | 139531150 | 139531145 | - |
| SEQ ID NO 14168 | CCCACTTTTAATTTTTTTAAAC | TTT | chrX | 139531144 | 139531165 | 139531149 | 139531144 | - |
| SEQ ID NO 14169 | CCACTTTTAATTTTTTTAAACC | TTC | chrX | 139531143 | 139531164 | 139531148 | 139531143 | - |
| SEQ ID NO 14170 | TTAATTTTTTTAAACCAAGGAG | CTT | chrX | 139531137 | 139531158 | 139531142 | 139531137 | - |
| SEQ ID NO 14171 | TAATTTTTTTAAACCAAGGAGA | TTT | chrX | 139531136 | 139531157 | 139531141 | 139531136 | - |
| SEQ ID NO 14172 | AATTTTTTTAAACCAAGGAGAT | TTT | chrX | 139531135 | 139531156 | 139531140 | 139531135 | - |
| SEQ ID NO 14173 | ATTTTTTTAAACCAAGGAGATG | TTA | chrX | 139531134 | 139531155 | 139531139 | 139531134 | - |
| SEQ ID NO 14174 | TTTTAAACCAAGGAGATGAATG | TTT | chrX | 139531130 | 139531151 | 139531135 | 139531130 | - |
| SEQ ID NO 14175 | TTTAAACCAAGGAGATGAATGT | TTT | chrX | 139531129 | 139531150 | 139531134 | 139531129 | - |
| SEQ ID NO 14176 | TTAAACCAAGGAGATGAATGTT | TTT | chrX | 139531128 | 139531149 | 139531133 | 139531128 | - |
| SEQ ID NO 14177 | TAAACCAAGGAGATGAATGTTT | TTT | chrX | 139531127 | 139531148 | 139531132 | 139531127 | - |
| SEQ ID NO 14178 | AAACCAAGGAGATGAATGTTTT | TTT | chrX | 139531126 | 139531147 | 139531131 | 139531126 | - |
| SEQ ID NO 14179 | AACCAAGGAGATGAATGTTTTC | TTA | chrX | 139531125 | 139531146 | 139531130 | 139531125 | - |
| SEQ ID NO 14180 | TCTAACAGGAATTACATGACCA | TTT | chrX | 139531105 | 139531126 | 139531110 | 139531105 | - |
| SEQ ID NO 14181 | CTAACAGGAATTACATGACCAA | TTT | chrX | 139531104 | 139531125 | 139531109 | 139531104 | - |
| SEQ ID NO 14182 | TAACAGGAATTACATGACCAAA | TTC | chrX | 139531103 | 139531124 | 139531108 | 139531103 | - |
| SEQ ID NO 14183 | ACAGGAATTACATGACCAAATC | CTA | chrX | 139531101 | 139531122 | 139531106 | 139531101 | - |
| SEQ ID NO 14184 | CATGACCAAATCATGAACTGAA | TTA | chrX | 139531091 | 139531112 | 139531096 | 139531091 | - |
| SEQ ID NO 14185 | AACAGTGTTTATTAAACATAAA | CTG | chrX | 139531071 | 139531092 | 139531076 | 139531071 | - |
| SEQ ID NO 14186 | ATTAAACATAAATGCATCATAA | TTT | chrX | 139531061 | 139531082 | 139531066 | 139531061 | - |
| SEQ ID NO 14187 | TTAAACATAAATGCATCATAAG | TTA | chrX | 139531060 | 139531081 | 139531065 | 139531060 | - |
| SEQ ID NO 14188 | AACATAAATGCATCATAAGCAT | TTA | chrX | 139531057 | 139531078 | 139531062 | 139531057 | - |
| SEQ ID NO 14189 | TCGATCTATTTAGTTTTAAAAA | TTG | chrX | 139531033 | 139531054 | 139531038 | 139531033 | - |
| SEQ ID NO 14190 | TTTAGTTTTAAAAATGAAGAAG | CTA | chrX | 139531025 | 139531046 | 139531030 | 139531025 | - |
| SEQ ID NO 14191 | AGTTTTAAAAATGAAGAAGAAG | TTT | chrX | 139531022 | 139531043 | 139531027 | 139531022 | - |
| SEQ ID NO 14192 | GTTTTAAAAATGAAGAAGAAGA | TTA | chrX | 139531021 | 139531042 | 139531026 | 139531021 | - |
| SEQ ID NO 14193 | TAAAAATGAAGAAGAAGAAAAC | TTT | chrX | 139531017 | 139531038 | 139531022 | 139531017 | - |
| SEQ ID NO 14194 | AAAAATGAAGAAGAAGAAAACC | TTT | chrX | 139531016 | 139531037 | 139531021 | 139531016 | - |
| SEQ ID NO 14195 | AAAATGAAGAAGAAGAAAACCT | TTA | chrX | 139531015 | 139531036 | 139531020 | 139531015 | - |
| SEQ ID NO 14196 | GCTAACAAAGAACCAGTACTTA | CTA | chrX | 139530992 | 139531013 | 139530997 | 139530992 | - |
| SEQ ID NO 14197 | ACAAAGAACCAGTACTTACCAA | CTA | chrX | 139530988 | 139531009 | 139530993 | 139530988 | - |
| SEQ ID NO 14198 | ACCAACCTGCGTGCTGGCTGTT | CTT | chrX | 139530971 | 139530992 | 139530976 | 139530971 | - |
| SEQ ID NO 14199 | CCAACCTGCGTGCTGGCTGTTA | TTA | chrX | 139530970 | 139530991 | 139530975 | 139530970 | - |
| SEQ ID NO 14200 | CGTGCTGGCTGTTAGACTCTTC | CTG | chrX | 139530962 | 139530983 | 139530967 | 139530962 | - |
| SEQ ID NO 14201 | GCTGTTAGACTCTTCAATATTG | CTG | chrX | 139530955 | 139530976 | 139530960 | 139530955 | - |
| SEQ ID NO 14202 | TTAGACTCTTCAATATTGCTGT | CTG | chrX | 139530951 | 139530972 | 139530956 | 139530951 | - |
| SEQ ID NO 14203 | GACTCTTCAATATTGCTGTCAA | TTA | chrX | 139530948 | 139530969 | 139530953 | 139530948 | - |
| SEQ ID NO 14204 | TTCAATATTGCTGTCAAATCAT | CTC | chrX | 139530943 | 139530964 | 139530948 | 139530943 | - |
| SEQ ID NO 14205 | CAATATTGCTGTCAAATCATGT | CTT | chrX | 139530941 | 139530962 | 139530946 | 139530941 | - |
| SEQ ID NO 14206 | AATATTGCTGTCAAATCATGTA | TTC | chrX | 139530940 | 139530961 | 139530945 | 139530940 | - |
| SEQ ID NO 14207 | CTGTCAAATCATGTAATCAAAA | TTG | chrX | 139530933 | 139530954 | 139530938 | 139530933 | - |
| SEQ ID NO 14208 | TCAAATCATGTAATCAAAATTT | CTG | chrX | 139530930 | 139530951 | 139530935 | 139530930 | - |
| SEQ ID NO 14209 | AGTGAAGAAGACAGCATCAGAT | TTT | chrX | 139530908 | 139530929 | 139530913 | 139530908 | - |
| SEQ ID NO 14210 | GTGAAGAAGACAGCATCAGATA | TTA | chrX | 139530907 | 139530928 | 139530912 | 139530907 | - |
| SEQ ID NO 14211 | CTATATCTAAAAGGCAAGCATA | TTT | chrX | 139530882 | 139530903 | 139530887 | 139530882 | - |

Figure 42 (Cont'd)

| | | | | | | | | |
|---|---|---|---|---|---|---|---|---|
| SEQ ID NO 14212 | TATATCTAAAAGGCAAGCATAC | TTC | chrX | 139530881 | 139530902 | 139530886 | 139530881 | - |
| SEQ ID NO 14213 | TATCTAAAAGGCAAGCATACTC | CTA | chrX | 139530879 | 139530900 | 139530884 | 139530879 | - |
| SEQ ID NO 14214 | AAAGGCAAGCATACTCAATGTA | CTA | chrX | 139530873 | 139530894 | 139530878 | 139530873 | - |
| SEQ ID NO 14215 | AATGTATTTTAAAAAAGGAAAC | CTC | chrX | 139530857 | 139530878 | 139530862 | 139530857 | - |
| SEQ ID NO 14216 | TAAAAAAGGAAACAAACCTGTA | TTT | chrX | 139530848 | 139530869 | 139530853 | 139530848 | - |
| SEQ ID NO 14217 | AAAAAAGGAAACAAACCTGTAC | TTT | chrX | 139530847 | 139530868 | 139530852 | 139530847 | - |
| SEQ ID NO 14218 | AAAAAGGAAACAAACCTGTACA | TTA | chrX | 139530846 | 139530867 | 139530851 | 139530846 | - |
| SEQ ID NO 14219 | TACATTCAGCACTGAGTAGATA | CTG | chrX | 139530828 | 139530849 | 139530833 | 139530828 | - |
| SEQ ID NO 14220 | AGCACTGAGTAGATATCCTAAA | TTC | chrX | 139530821 | 139530842 | 139530826 | 139530821 | - |
| SEQ ID NO 14221 | AGTAGATATCCTAAAAGGCAGA | CTG | chrX | 139530814 | 139530835 | 139530819 | 139530814 | - |
| SEQ ID NO 14222 | AAAGGCAGATGGTGATGAGGCC | CTA | chrX | 139530801 | 139530822 | 139530806 | 139530801 | - |
| SEQ ID NO 14223 | GTGATTCTGCCATGATCATGTT | CTG | chrX | 139530777 | 139530798 | 139530782 | 139530777 | - |
| SEQ ID NO 14224 | TGCCATGATCATGTTCACGCGC | TTC | chrX | 139530770 | 139530791 | 139530775 | 139530770 | - |
| SEQ ID NO 14225 | CCATGATCATGTTCACGCGCTG | CTG | chrX | 139530768 | 139530789 | 139530773 | 139530768 | - |
| SEQ ID NO 14226 | ACGCGCTGCATAACCTTTGCTA | TTC | chrX | 139530754 | 139530775 | 139530759 | 139530754 | - |
| SEQ ID NO 14227 | CATAACCTTTGCTAGCAGATTG | CTG | chrX | 139530746 | 139530767 | 139530751 | 139530746 | - |
| SEQ ID NO 14228 | TGCTAGCAGATTGTGAAAGTGG | CTT | chrX | 139530737 | 139530758 | 139530742 | 139530737 | - |
| SEQ ID NO 14229 | GCTAGCAGATTGTGAAAGTGGT | TTT | chrX | 139530736 | 139530757 | 139530741 | 139530736 | - |

Figure 43

| # | Sequence | PAM | Chr | Start | End | Cuts 5' of | Str |
|---|---|---|---|---|---|---|---|
| SEQ ID NO 14230 | TGCGTCCACTGCTCTTCTGA | CAG | chr12 | 21580363 | 21580382 | 21580379 | + |
| SEQ ID NO 14231 | TCTTCTGACAGCATCATTTA | CAG | chr12 | 21580375 | 21580394 | 21580391 | + |
| SEQ ID NO 14232 | CTTCTGACAGCATCATTTAC | AGG | chr12 | 21580376 | 21580395 | 21580392 | + |
| SEQ ID NO 14233 | AGGTTCACACTGTTCCACCT | GAG | chr12 | 21580396 | 21580415 | 21580412 | + |
| SEQ ID NO 14234 | TTCATATTATGCTCAAAATA | TGG | chr12 | 21580421 | 21580440 | 21580437 | + |
| SEQ ID NO 14235 | TGCTCAAAATATGGACCTAT | CAG | chr12 | 21580430 | 21580449 | 21580446 | + |
| SEQ ID NO 14236 | AATATGGACCTATCAGAAAA | TAG | chr12 | 21580437 | 21580456 | 21580453 | + |
| SEQ ID NO 14237 | CCATTCATCTGCTGTTGTTT | TGG | chr12 | 21580468 | 21580487 | 21580484 | + |
| SEQ ID NO 14238 | TTTGGCCTTTGTCTGAATCA | CAG | chr12 | 21580486 | 21580505 | 21580502 | + |
| SEQ ID NO 14239 | CCTTTGTCTGAATCACAGTA | TAG | chr12 | 21580491 | 21580510 | 21580507 | + |
| SEQ ID NO 14240 | TAGATGCCTCCAACTGTTAA | AAG | chr12 | 21580511 | 21580530 | 21580527 | + |
| SEQ ID NO 14241 | AGATGCCTCCAACTGTTAAA | AGG | chr12 | 21580512 | 21580531 | 21580528 | + |
| SEQ ID NO 14242 | TCCAACTGTTAAAAGGAAAA | AAG | chr12 | 21580519 | 21580538 | 21580535 | + |
| SEQ ID NO 14243 | AAAAGTTTCTATTATCATT | CAG | chr12 | 21580536 | 21580555 | 21580552 | + |
| SEQ ID NO 14244 | AAAAGTTTCTATTATCATTC | AGG | chr12 | 21580537 | 21580556 | 21580553 | + |
| SEQ ID NO 14245 | GTTTCTATTATCATTCAGGT | TAG | chr12 | 21580541 | 21580560 | 21580557 | + |
| SEQ ID NO 14246 | TCAGGTTAGCAATTTGTTTA | AAG | chr12 | 21580555 | 21580574 | 21580571 | + |
| SEQ ID NO 14247 | AGCAATTTGTTTAAAGTAAT | AAG | chr12 | 21580562 | 21580581 | 21580578 | + |
| SEQ ID NO 14248 | GCAATTTGTTTAAAGTAATA | AGG | chr12 | 21580563 | 21580582 | 21580579 | + |
| SEQ ID NO 14249 | CAATTTGTTTAAAGTAATAA | GGG | chr12 | 21580564 | 21580583 | 21580580 | + |
| SEQ ID NO 14250 | TTGTTTAAAGTAATAAGGGA | TGG | chr12 | 21580568 | 21580587 | 21580584 | + |
| SEQ ID NO 14251 | AAGTAATAAGGGATGGAAAT | GAG | chr12 | 21580575 | 21580594 | 21580591 | + |
| SEQ ID NO 14252 | ATAAGGGATGGAAATGAGTT | CAG | chr12 | 21580580 | 21580599 | 21580596 | + |
| SEQ ID NO 14253 | ATGAGTTCAGATTTTTAAAT | TAG | chr12 | 21580593 | 21580612 | 21580609 | + |
| SEQ ID NO 14254 | CAGATTTTTAAATTAGCATT | TAG | chr12 | 21580600 | 21580619 | 21580616 | + |
| SEQ ID NO 14255 | AGATTTTTAAATTAGCATTT | AGG | chr12 | 21580601 | 21580620 | 21580617 | + |
| SEQ ID NO 14256 | ATTAGCATTTAGGATCCACT | AAG | chr12 | 21580611 | 21580630 | 21580627 | + |
| SEQ ID NO 14257 | ATTTAGGATCCACTAAGCCC | AAG | chr12 | 21580617 | 21580636 | 21580633 | + |
| SEQ ID NO 14258 | TTTAGGATCCACTAAGCCCA | AGG | chr12 | 21580618 | 21580637 | 21580634 | + |
| SEQ ID NO 14259 | TATTTACCTTTCAAAATAA | TAG | chr12 | 21580644 | 21580663 | 21580660 | + |
| SEQ ID NO 14260 | ATAGTATTTGACATATTGTT | AAG | chr12 | 21580663 | 21580682 | 21580679 | + |
| SEQ ID NO 14261 | TAGTATTTGACATATTGTTA | AGG | chr12 | 21580664 | 21580683 | 21580680 | + |
| SEQ ID NO 14262 | AGTATTTGACATATTGTTAA | GGG | chr12 | 21580665 | 21580684 | 21580681 | + |
| SEQ ID NO 14263 | TGTTAAGGGACACCAACGAA | TGG | chr12 | 21580679 | 21580698 | 21580695 | + |
| SEQ ID NO 14264 | TCAATTCTGTGCATGTTTTA | AAG | chr12 | 21580714 | 21580733 | 21580730 | + |
| SEQ ID NO 14265 | GCATGTTTTAAAGTCCCTTC | TAG | chr12 | 21580724 | 21580743 | 21580740 | + |
| SEQ ID NO 14266 | CATGTTTTAAAGTCCCTTCT | AGG | chr12 | 21580725 | 21580744 | 21580741 | + |
| SEQ ID NO 14267 | CCTTCTAGGTGCATGTGAAA | TAG | chr12 | 21580739 | 21580758 | 21580755 | + |
| SEQ ID NO 14268 | TCTAGGTGCATGTGAAATAG | CAG | chr12 | 21580742 | 21580761 | 21580758 | + |
| SEQ ID NO 14269 | AGGTGCATGTGAAATAGCAG | CAG | chr12 | 21580745 | 21580764 | 21580761 | + |
| SEQ ID NO 14270 | GGTGCATGTGAAATAGCAGC | AGG | chr12 | 21580746 | 21580765 | 21580762 | + |
| SEQ ID NO 14271 | AGCAGCAGGCTGATGCCGCA | AAG | chr12 | 21580760 | 21580779 | 21580776 | + |
| SEQ ID NO 14272 | CAGCAGGCTGATGCCGCAAA | GAG | chr12 | 21580762 | 21580781 | 21580778 | + |
| SEQ ID NO 14273 | AGCAGGCTGATGCCGCAAAG | AGG | chr12 | 21580763 | 21580782 | 21580779 | + |
| SEQ ID NO 14274 | AAGAGGTCAAATACCTCAAA | AAG | chr12 | 21580780 | 21580799 | 21580796 | + |
| SEQ ID NO 14275 | GGTCAAATACCTCAAAAGA | AAG | chr12 | 21580784 | 21580803 | 21580800 | + |

Figure 43 (Cont'd)

| | | | | | | | |
|---|---|---|---|---|---|---|---|
| SEQ ID NO 14276 | TCAAATACCTCAAAAAGAAA | GAG | chr12 | 21580786 | 21580805 | 21580802 | + |
| SEQ ID NO 14277 | TCAAAAAGAAAGAGTCTGAA | AAG | chr12 | 21580795 | 21580814 | 21580811 | + |
| SEQ ID NO 14278 | AAAGAGTCTGAAAAGACAAT | TGG | chr12 | 21580803 | 21580822 | 21580819 | + |
| SEQ ID NO 14279 | AGAGTCTGAAAAGACAATTG | GAG | chr12 | 21580805 | 21580824 | 21580821 | + |
| SEQ ID NO 14280 | TTGGAGTAACTACTTGCCTA | AAG | chr12 | 21580822 | 21580841 | 21580838 | + |
| SEQ ID NO 14281 | TAACTACTTGCCTAAAGCTC | CAG | chr12 | 21580828 | 21580847 | 21580844 | + |
| SEQ ID NO 14282 | CTAAAGCTCCAGTCACTTTG | TAG | chr12 | 21580839 | 21580858 | 21580855 | + |
| SEQ ID NO 14283 | CCAGTCACTTTGTAGTGTCA | AAG | chr12 | 21580847 | 21580866 | 21580863 | + |
| SEQ ID NO 14284 | TCACTTTGTAGTGTCAAAGT | TAG | chr12 | 21580851 | 21580870 | 21580867 | + |
| SEQ ID NO 14285 | CACTTTGTAGTGTCAAAGTT | AGG | chr12 | 21580852 | 21580871 | 21580868 | + |
| SEQ ID NO 14286 | ATTGTCATCATACATGCCCT | CAG | chr12 | 21580885 | 21580904 | 21580901 | + |
| SEQ ID NO 14287 | GTCATCATACATGCCCTCAG | CAG | chr12 | 21580888 | 21580907 | 21580904 | + |
| SEQ ID NO 14288 | ATCATACATGCCCTCAGCAG | CAG | chr12 | 21580891 | 21580910 | 21580907 | + |
| SEQ ID NO 14289 | CTCTCTTCCTCCTTCTCCTA | CAG | chr12 | 21580927 | 21580946 | 21580943 | + |
| SEQ ID NO 14290 | TCTTCCTCCTTCTCCTACAG | TGG | chr12 | 21580930 | 21580949 | 21580946 | + |
| SEQ ID NO 14291 | CTCCTTCTCCTACAGTGGTC | CAG | chr12 | 21580935 | 21580954 | 21580951 | + |
| SEQ ID NO 14292 | CTTCTCCTACAGTGGTCCAG | AAG | chr12 | 21580938 | 21580957 | 21580954 | + |
| SEQ ID NO 14293 | TTCCTACAGTGGTCCAGA | AGG | chr12 | 21580939 | 21580958 | 21580955 | + |
| SEQ ID NO 14294 | TCTCCTACAGTGGTCCAGAA | GGG | chr12 | 21580940 | 21580959 | 21580956 | + |
| SEQ ID NO 14295 | CTCCTACAGTGGTCCAGAAG | GGG | chr12 | 21580941 | 21580960 | 21580957 | + |
| SEQ ID NO 14296 | ACAGTGGTCCAGAAGGGGCT | CAG | chr12 | 21580946 | 21580965 | 21580962 | + |
| SEQ ID NO 14297 | CAGTGGTCCAGAAGGGGCTC | AGG | chr12 | 21580947 | 21580966 | 21580963 | + |
| SEQ ID NO 14298 | GCTCAGGTATGTTCAAATAA | CAG | chr12 | 21580963 | 21580982 | 21580979 | + |
| SEQ ID NO 14299 | TGTTCAAATAACAGCTGCTG | TGG | chr12 | 21580972 | 21580991 | 21580988 | + |
| SEQ ID NO 14300 | TGCTGTGGTTTTCAATTATG | AAG | chr12 | 21580987 | 21581006 | 21581003 | + |
| SEQ ID NO 14301 | CAATTATGAAGAAATCTCCT | AAG | chr12 | 21580999 | 21581018 | 21581015 | + |
| SEQ ID NO 14302 | AAGAAATCTCCTAAGCTACA | TAG | chr12 | 21581007 | 21581026 | 21581023 | + |
| SEQ ID NO 14303 | ACATAGTCATTTATCTTTTA | AAG | chr12 | 21581024 | 21581043 | 21581040 | + |
| SEQ ID NO 14304 | CATTTATCTTTTAAAGCACC | AAG | chr12 | 21581031 | 21581050 | 21581047 | + |
| SEQ ID NO 14305 | ATCTTTTAAAGCACCAAGCA | AAG | chr12 | 21581036 | 21581055 | 21581052 | + |
| SEQ ID NO 14306 | CAAGCAAAGTACCTTTTGAT | AAG | chr12 | 21581050 | 21581069 | 21581066 | + |
| SEQ ID NO 14307 | AAGCAAAGTACCTTTTGATA | AGG | chr12 | 21581051 | 21581070 | 21581067 | + |
| SEQ ID NO 14308 | GCAAAGTACCTTTTGATAAG | GAG | chr12 | 21581053 | 21581072 | 21581069 | + |
| SEQ ID NO 14309 | TGATAAGGAGAACGTGCTTA | TAG | chr12 | 21581066 | 21581085 | 21581082 | + |
| SEQ ID NO 14310 | AACGTGCTTATAGATGTTCA | TAG | chr12 | 21581076 | 21581095 | 21581092 | + |
| SEQ ID NO 14311 | GTGCTTATAGATGTTCATAG | AAG | chr12 | 21581079 | 21581098 | 21581095 | + |
| SEQ ID NO 14312 | AGATGTTCATAGAAGATGCT | TGG | chr12 | 21581087 | 21581106 | 21581103 | + |
| SEQ ID NO 14313 | ATACGTATTTCATTCTCACA | TGG | chr12 | 21581141 | 21581160 | 21581157 | + |
| SEQ ID NO 14314 | ACATGGTATTTCTCTCTTCC | TAG | chr12 | 21581158 | 21581177 | 21581174 | + |
| SEQ ID NO 14315 | GGTATTTCTCTCTTCCTAGT | AAG | chr12 | 21581162 | 21581181 | 21581178 | + |
| SEQ ID NO 14316 | GTATTTCTCTCTTCCTAGTA | AGG | chr12 | 21581163 | 21581182 | 21581179 | + |
| SEQ ID NO 14317 | TATTTCTCTCTTCCTAGTAA | GGG | chr12 | 21581164 | 21581183 | 21581180 | + |
| SEQ ID NO 14318 | TTTCTCTCTTCCTAGTAAGG | GAG | chr12 | 21581166 | 21581185 | 21581182 | + |
| SEQ ID NO 14319 | TTCTCTCTTCCTAGTAAGGG | AGG | chr12 | 21581167 | 21581186 | 21581183 | + |
| SEQ ID NO 14320 | CTCTCTTCCTAGTAAGGGAG | GAG | chr12 | 21581169 | 21581188 | 21581185 | + |
| SEQ ID NO 14321 | ATGCCCAATTTCTGCCTCCA | AAG | chr12 | 21581212 | 21581231 | 21581228 | + |
| SEQ ID NO 14322 | CCAATTTCTGCCTCCAAAGA | AAG | chr12 | 21581216 | 21581235 | 21581232 | + |

Figure 43 (Cont'd)

| | | | | | | | |
|---|---|---|---|---|---|---|---|
| SEQ ID NO 14323 | ATTTCTGCCTCCAAAGAAAG | AAG | chr12 | 21581219 | 21581238 | 21581235 | + |
| SEQ ID NO 14324 | TCTGCCTCCAAAGAAAGAAG | AAG | chr12 | 21581222 | 21581241 | 21581238 | + |
| SEQ ID NO 14325 | AAAGAAGAAGTAAAAACTAA | AAG | chr12 | 21581235 | 21581254 | 21581251 | + |
| SEQ ID NO 14326 | AAGAAGAAGTAAAAACTAAA | AGG | chr12 | 21581236 | 21581255 | 21581252 | + |
| SEQ ID NO 14327 | AAGAAGTAAAAACTAAAAGG | CAG | chr12 | 21581239 | 21581258 | 21581255 | + |
| SEQ ID NO 14328 | AAAGGCAGAAATGAAATCCA | CAG | chr12 | 21581254 | 21581273 | 21581270 | + |
| SEQ ID NO 14329 | AAGGCAGAAATGAAATCCAC | AGG | chr12 | 21581255 | 21581274 | 21581271 | + |
| SEQ ID NO 14330 | AAATGAAATCCACAGGCAAA | CAG | chr12 | 21581262 | 21581281 | 21581278 | + |
| SEQ ID NO 14331 | AATCCACAGGCAAACAGCCT | GAG | chr12 | 21581268 | 21581287 | 21581284 | + |
| SEQ ID NO 14332 | AACAGCCTGAGACCACATCC | TGG | chr12 | 21581280 | 21581299 | 21581296 | + |
| SEQ ID NO 14333 | ACAGCCTGAGACCACATCCT | GGG | chr12 | 21581281 | 21581300 | 21581297 | + |
| SEQ ID NO 14334 | CTGAGACCACATCCTGGGCC | TGG | chr12 | 21581286 | 21581305 | 21581302 | + |
| SEQ ID NO 14335 | CCACATCCTGGGCCTGGTTA | AAG | chr12 | 21581292 | 21581311 | 21581308 | + |
| SEQ ID NO 14336 | ATCCTGGGCCTGGTTAAAGA | TAG | chr12 | 21581296 | 21581315 | 21581312 | + |
| SEQ ID NO 14337 | TTAAAGATAGACCCCTGACC | TGG | chr12 | 21581309 | 21581328 | 21581325 | + |
| SEQ ID NO 14338 | AGATAGACCCCTGACCTGGC | CAG | chr12 | 21581313 | 21581332 | 21581329 | + |
| SEQ ID NO 14339 | CTGGCCAGTTATGTTATCTA | TAG | chr12 | 21581328 | 21581347 | 21581344 | + |
| SEQ ID NO 14340 | GTTATGTTATCTATAGATTC | CAG | chr12 | 21581335 | 21581354 | 21581351 | + |
| SEQ ID NO 14341 | TATAGATTCCAGACACTGTA | TGG | chr12 | 21581346 | 21581365 | 21581362 | + |
| SEQ ID NO 14342 | ATTCCAGACACTGTATGGAA | AAG | chr12 | 21581351 | 21581370 | 21581367 | + |
| SEQ ID NO 14343 | CCAGACACTGTATGGAAAAG | CAG | chr12 | 21581354 | 21581373 | 21581370 | + |
| SEQ ID NO 14344 | TTCTGTTCCATTCTGATGAC | CAG | chr12 | 21581396 | 21581415 | 21581412 | + |
| SEQ ID NO 14345 | ATTCTGATGACCAGTGCATG | CAG | chr12 | 21581405 | 21581424 | 21581421 | + |
| SEQ ID NO 14346 | TGACCAGTGCATGCAGCCCC | CAG | chr12 | 21581412 | 21581431 | 21581428 | + |
| SEQ ID NO 14347 | CCCCCAGTCATGTACCCCCT | TAG | chr12 | 21581428 | 21581447 | 21581444 | + |
| SEQ ID NO 14348 | CCCAGTCATGTACCCCCTTA | GAG | chr12 | 21581430 | 21581449 | 21581446 | + |
| SEQ ID NO 14349 | ATGTACCCCCTTAGAGTTGT | AAG | chr12 | 21581437 | 21581456 | 21581453 | + |
| SEQ ID NO 14350 | TTAGAGTTGTAAGCCCTTAA | AAG | chr12 | 21581447 | 21581466 | 21581463 | + |
| SEQ ID NO 14351 | TAGAGTTGTAAGCCCTTAAA | AGG | chr12 | 21581448 | 21581467 | 21581464 | + |
| SEQ ID NO 14352 | AGAGTTGTAAGCCCTTAAAA | GGG | chr12 | 21581449 | 21581468 | 21581465 | + |
| SEQ ID NO 14353 | TTGTAAGCCCTTAAAAGGGA | CAG | chr12 | 21581453 | 21581472 | 21581469 | + |
| SEQ ID NO 14354 | TGTAAGCCCTTAAAAGGGAC | AGG | chr12 | 21581454 | 21581473 | 21581470 | + |
| SEQ ID NO 14355 | GGACAGGAATTGCTCACTCT | GAG | chr12 | 21581470 | 21581489 | 21581486 | + |
| SEQ ID NO 14356 | ACAGGAATTGCTCACTCTGA | GAG | chr12 | 21581472 | 21581491 | 21581488 | + |
| SEQ ID NO 14357 | AATTGCTCACTCTGAGAGCT | TGG | chr12 | 21581477 | 21581496 | 21581493 | + |
| SEQ ID NO 14358 | CACTCTGAGAGCTTGGTTGT | TGG | chr12 | 21581484 | 21581503 | 21581500 | + |
| SEQ ID NO 14359 | CTCTGAGAGCTTGGTTGTTG | GAG | chr12 | 21581486 | 21581505 | 21581502 | + |
| SEQ ID NO 14360 | AGCTTGGTTGTTGGAGATGT | GAG | chr12 | 21581493 | 21581512 | 21581509 | + |
| SEQ ID NO 14361 | TGGAGATGTGAGTCTTGCCC | AAG | chr12 | 21581504 | 21581523 | 21581520 | + |
| SEQ ID NO 14362 | GTGAGTCTTGCCCAAGCTCC | CAG | chr12 | 21581511 | 21581530 | 21581527 | + |
| SEQ ID NO 14363 | CCCAAGCTCCAGCCGAATA | AAG | chr12 | 21581521 | 21581540 | 21581537 | + |
| SEQ ID NO 14364 | AAGCCCTTCCTTCTTTAACT | CGG | chr12 | 21581541 | 21581560 | 21581557 | + |
| SEQ ID NO 14365 | CCTTCTTTAACTCGGTGTCT | GAG | chr12 | 21581549 | 21581568 | 21581565 | + |
| SEQ ID NO 14366 | CTTCTTTAACTCGGTGTCTG | AGG | chr12 | 21581550 | 21581569 | 21581566 | + |
| SEQ ID NO 14367 | TTCTTTAACTCGGTGTCTGA | GGG | chr12 | 21581551 | 21581570 | 21581567 | + |
| SEQ ID NO 14368 | TCTTTAACTCGGTGTCTGAG | GGG | chr12 | 21581552 | 21581571 | 21581568 | + |
| SEQ ID NO 14369 | TGTCTGAGGGGTTTTGTATG | CAG | chr12 | 21581564 | 21581583 | 21581580 | + |

Figure 43 (Cont'd)

| | | | | | | | |
|---|---|---|---|---|---|---|---|
| SEQ ID NO 14370 | TGCAGCTTGTCCTGCTACAC | TAG | chr12 | 21581582 | 21581601 | 21581598 | + |
| SEQ ID NO 14371 | GCTACCTCTATTAAAACACA | AAG | chr12 | 21581638 | 21581657 | 21581654 | + |
| SEQ ID NO 14372 | AAACACAAAGCCACAATATA | TGG | chr12 | 21581651 | 21581670 | 21581667 | + |
| SEQ ID NO 14373 | CCACAATATATGGATACATT | TGG | chr12 | 21581661 | 21581680 | 21581677 | + |
| SEQ ID NO 14374 | TTTGGAAAATATGCACACTT | TGG | chr12 | 21581679 | 21581698 | 21581695 | + |
| SEQ ID NO 14375 | AAATATGCACACTTTGGATC | CAG | chr12 | 21581685 | 21581704 | 21581701 | + |
| SEQ ID NO 14376 | ATGCACTTTGGATCCAGC | AAG | chr12 | 21581689 | 21581708 | 21581705 | + |
| SEQ ID NO 14377 | GGATCCAGCAAGTCCACATC | TAG | chr12 | 21581700 | 21581719 | 21581716 | + |
| SEQ ID NO 14378 | CCACATCTAGAAAACCATCC | TGG | chr12 | 21581713 | 21581732 | 21581729 | + |
| SEQ ID NO 14379 | CACATCTAGAAAACCATCCT | GGG | chr12 | 21581714 | 21581733 | 21581730 | + |
| SEQ ID NO 14380 | ACATCTAGAAAACCATCCTG | GGG | chr12 | 21581715 | 21581734 | 21581731 | + |
| SEQ ID NO 14381 | CATCTAGAAAACCATCCTGG | GGG | chr12 | 21581716 | 21581735 | 21581732 | + |
| SEQ ID NO 14382 | AACCATCCTGGGGGAAAATT | AAG | chr12 | 21581725 | 21581744 | 21581741 | + |
| SEQ ID NO 14383 | ACCATCCTGGGGGAAAATTA | AGG | chr12 | 21581726 | 21581745 | 21581742 | + |
| SEQ ID NO 14384 | CATCCTGGGGGAAAATTAAG | GAG | chr12 | 21581728 | 21581747 | 21581744 | + |
| SEQ ID NO 14385 | TCCTGGGGGAAAATTAAGGA | GAG | chr12 | 21581730 | 21581749 | 21581746 | + |
| SEQ ID NO 14386 | AAAATTAAGGAGAGTATGAA | AAG | chr12 | 21581739 | 21581758 | 21581755 | + |
| SEQ ID NO 14387 | AAATTAAGGAGAGTATGAAA | AGG | chr12 | 21581740 | 21581759 | 21581756 | + |
| SEQ ID NO 14388 | TATGAAAGGATGTTTACTA | AAG | chr12 | 21581753 | 21581772 | 21581769 | + |
| SEQ ID NO 14389 | TGTTTACTAAAGCATTATGA | TGG | chr12 | 21581764 | 21581783 | 21581780 | + |
| SEQ ID NO 14390 | GCATTATGATGGCAAAAAAT | TAG | chr12 | 21581775 | 21581794 | 21581791 | + |
| SEQ ID NO 14391 | AGAAACAACTTACACTGAAC | TAG | chr12 | 21581796 | 21581815 | 21581812 | + |
| SEQ ID NO 14392 | GAACTAGTCAACTTACTTAA | CAG | chr12 | 21581812 | 21581831 | 21581828 | + |
| SEQ ID NO 14393 | TAGTCAACTTACTTAACAGA | CAG | chr12 | 21581816 | 21581835 | 21581832 | + |
| SEQ ID NO 14394 | TCAACTTACTTAACAGACAG | AAG | chr12 | 21581819 | 21581838 | 21581835 | + |
| SEQ ID NO 14395 | CAACTTACTTAACAGACAGA | AGG | chr12 | 21581820 | 21581839 | 21581836 | + |
| SEQ ID NO 14396 | TAACAGACAGAAGGCTCAAT | TAG | chr12 | 21581829 | 21581848 | 21581845 | + |
| SEQ ID NO 14397 | CAATTAGCTCATGTGTCAAA | TGG | chr12 | 21581845 | 21581864 | 21581861 | + |
| SEQ ID NO 14398 | AATTAGCTCATGTGTCAAAT | GGG | chr12 | 21581846 | 21581865 | 21581862 | + |
| SEQ ID NO 14399 | ATTAGCTCATGTGTCAAATG | GGG | chr12 | 21581847 | 21581866 | 21581863 | + |
| SEQ ID NO 14400 | TTAGCTCATGTGTCAAATGG | GGG | chr12 | 21581848 | 21581867 | 21581864 | + |
| SEQ ID NO 14401 | AATGGGGGTAAAATAATATT | TAG | chr12 | 21581863 | 21581882 | 21581879 | + |
| SEQ ID NO 14402 | GGGTAAAATAATATTTAGTT | TGG | chr12 | 21581868 | 21581887 | 21581884 | + |
| SEQ ID NO 14403 | GTAAAATAATATTTAGTTTG | GAG | chr12 | 21581870 | 21581889 | 21581886 | + |
| SEQ ID NO 14404 | TAAAATAATATTTAGTTTGG | AGG | chr12 | 21581871 | 21581890 | 21581887 | + |
| SEQ ID NO 14405 | AAAATAATATTTAGTTTGGA | GGG | chr12 | 21581872 | 21581891 | 21581888 | + |
| SEQ ID NO 14406 | TAATATTTAGTTTGGAGGGA | AAG | chr12 | 21581876 | 21581895 | 21581892 | + |
| SEQ ID NO 14407 | ATTTAGTTTGGAGGGAAAGA | CAG | chr12 | 21581880 | 21581899 | 21581896 | + |
| SEQ ID NO 14408 | TTTAGTTTGGAGGGAAAGAC | AGG | chr12 | 21581881 | 21581900 | 21581897 | + |
| SEQ ID NO 14409 | GAGGGAAAGACAGGCTCTAA | AAG | chr12 | 21581890 | 21581909 | 21581906 | + |
| SEQ ID NO 14410 | GGGAAAGACAGGCTCTAAAA | GAG | chr12 | 21581892 | 21581911 | 21581908 | + |
| SEQ ID NO 14411 | GGAAAGACAGGCTCTAAAAG | AGG | chr12 | 21581893 | 21581912 | 21581909 | + |
| SEQ ID NO 14412 | TCTAAAAGAGGATTAAAAAT | TAG | chr12 | 21581905 | 21581924 | 21581921 | + |
| SEQ ID NO 14413 | AGAGGATTAAAAATTAGATG | TGG | chr12 | 21581911 | 21581930 | 21581927 | + |
| SEQ ID NO 14414 | ATTAAAAATTAGATGTGGCC | TAG | chr12 | 21581916 | 21581935 | 21581932 | + |
| SEQ ID NO 14415 | TTAAAAATTAGATGTGGCCT | AGG | chr12 | 21581917 | 21581936 | 21581933 | + |
| SEQ ID NO 14416 | AATTAGATGTGGCCTAGGCA | AAG | chr12 | 21581922 | 21581941 | 21581938 | + |

Figure 43 (Cont'd)

| | | | | | | | |
|---|---|---|---|---|---|---|---|
| SEQ ID NO 14417 | TAGGCAAAGAATTTATGACC | AAG | chr12 | 21581936 | 21581955 | 21581952 | + |
| SEQ ID NO 14418 | AAACACAACAAAAACAAAAA | CAG | chr12 | 21581970 | 21581989 | 21581986 | + |
| SEQ ID NO 14419 | CAAAAACAAAAACAGACAAA | TGG | chr12 | 21581978 | 21581997 | 21581994 | + |
| SEQ ID NO 14420 | AAAAACAAAAACAGACAAAT | GGG | chr12 | 21581979 | 21581998 | 21581995 | + |
| SEQ ID NO 14421 | AAAATGCTTCTGCACCGCAA | AAG | chr12 | 21582015 | 21582034 | 21582031 | + |
| SEQ ID NO 14422 | ACCGCAAAAGACCGAATCAA | CAG | chr12 | 21582028 | 21582047 | 21582044 | + |
| SEQ ID NO 14423 | CGCAAAAGACCGAATCAACA | GAG | chr12 | 21582030 | 21582049 | 21582046 | + |
| SEQ ID NO 14424 | GACCGAATCAACAGAGTAAA | CGG | chr12 | 21582037 | 21582056 | 21582053 | + |
| SEQ ID NO 14425 | CAGAGTAAACGGATAACCTA | CAG | chr12 | 21582048 | 21582067 | 21582064 | + |
| SEQ ID NO 14426 | AAACGGATAACCTACAGAAT | GAG | chr12 | 21582054 | 21582073 | 21582070 | + |
| SEQ ID NO 14427 | GCAAACTATGAATGCAACAA | AAG | chr12 | 21582088 | 21582107 | 21582104 | + |
| SEQ ID NO 14428 | CAAACTATGAATGCAACAAA | AGG | chr12 | 21582089 | 21582108 | 21582105 | + |
| SEQ ID NO 14429 | TGCAACAAAAGGCTAATATA | CAG | chr12 | 21582100 | 21582119 | 21582116 | + |
| SEQ ID NO 14430 | GGCTAATATACAGAATCTAC | AAG | chr12 | 21582110 | 21582129 | 21582126 | + |
| SEQ ID NO 14431 | GCTAATATACAGAATCTACA | AGG | chr12 | 21582111 | 21582130 | 21582127 | + |
| SEQ ID NO 14432 | AACAAAAAACCAACCTCAT | TAG | chr12 | 21582142 | 21582161 | 21582158 | + |
| SEQ ID NO 14433 | AAAAAACCAACCTCATTAGA | AAG | chr12 | 21582146 | 21582165 | 21582162 | + |
| SEQ ID NO 14434 | TCATTAGAAAGTGACTGTGA | TGG | chr12 | 21582158 | 21582177 | 21582174 | + |
| SEQ ID NO 14435 | TGACTGTGATGGTTAATACT | GAG | chr12 | 21582169 | 21582188 | 21582185 | + |
| SEQ ID NO 14436 | ATACTGAGTGTCAACTTGAT | TGG | chr12 | 21582184 | 21582203 | 21582200 | + |
| SEQ ID NO 14437 | GTGTCAACTTGATTGGACTG | AAG | chr12 | 21582191 | 21582210 | 21582207 | + |
| SEQ ID NO 14438 | TGTCAACTTGATTGGACTGA | AGG | chr12 | 21582192 | 21582211 | 21582208 | + |
| SEQ ID NO 14439 | TGATTGGACTGAAGGATGCA | AAG | chr12 | 21582200 | 21582219 | 21582216 | + |
| SEQ ID NO 14440 | AGGATGCAAAGTAATGATCT | TGG | chr12 | 21582212 | 21582231 | 21582228 | + |
| SEQ ID NO 14441 | GGATGCAAAGTAATGATCTT | GGG | chr12 | 21582213 | 21582232 | 21582229 | + |
| SEQ ID NO 14442 | ATGATCTTGGGTGTGTCTGT | GAG | chr12 | 21582225 | 21582244 | 21582241 | + |
| SEQ ID NO 14443 | TGATCTTGGGTGTGTCTGTG | AGG | chr12 | 21582226 | 21582245 | 21582242 | + |
| SEQ ID NO 14444 | GATCTTGGGTGTGTCTGTGA | GGG | chr12 | 21582227 | 21582246 | 21582243 | + |
| SEQ ID NO 14445 | TGTCTGTGAGGGTGTTACCA | AAG | chr12 | 21582238 | 21582257 | 21582254 | + |
| SEQ ID NO 14446 | GTCTGTGAGGGTGTTACCAA | AGG | chr12 | 21582239 | 21582258 | 21582255 | + |
| SEQ ID NO 14447 | CTGTGAGGGTGTTACCAAAG | GAG | chr12 | 21582241 | 21582260 | 21582257 | + |
| SEQ ID NO 14448 | ACCAAAGGAGATTAATATTT | CAG | chr12 | 21582254 | 21582273 | 21582270 | + |
| SEQ ID NO 14449 | AAGGAGATTAATATTTCAGT | CAG | chr12 | 21582258 | 21582277 | 21582274 | + |
| SEQ ID NO 14450 | GAGATTAATATTTCAGTCAG | TGG | chr12 | 21582261 | 21582280 | 21582277 | + |
| SEQ ID NO 14451 | AGATTAATATTTCAGTCAGT | GGG | chr12 | 21582262 | 21582281 | 21582278 | + |
| SEQ ID NO 14452 | TAATATTTCAGTCAGTGGGC | TGG | chr12 | 21582266 | 21582285 | 21582282 | + |
| SEQ ID NO 14453 | AATATTTCAGTCAGTGGGCT | GGG | chr12 | 21582267 | 21582286 | 21582283 | + |
| SEQ ID NO 14454 | ATATTTCAGTCAGTGGGCTG | GGG | chr12 | 21582268 | 21582287 | 21582284 | + |
| SEQ ID NO 14455 | TTTCAGTCAGTGGGCTGGGG | AAG | chr12 | 21582271 | 21582290 | 21582287 | + |
| SEQ ID NO 14456 | TTCAGTCAGTGGGCTGGGGA | AGG | chr12 | 21582272 | 21582291 | 21582288 | + |
| SEQ ID NO 14457 | AGTCAGTGGGCTGGGGAAGG | CAG | chr12 | 21582275 | 21582294 | 21582291 | + |
| SEQ ID NO 14458 | AGGCAGACCCACCCTTAATC | TGG | chr12 | 21582292 | 21582311 | 21582308 | + |
| SEQ ID NO 14459 | GGCAGACCCACCCTTAATCT | GGG | chr12 | 21582293 | 21582312 | 21582309 | + |
| SEQ ID NO 14460 | AGACCCACCCTTAATCTGGG | TGG | chr12 | 21582296 | 21582315 | 21582312 | + |
| SEQ ID NO 14461 | GACCCACCCTTAATCTGGGT | GGG | chr12 | 21582297 | 21582316 | 21582313 | + |
| SEQ ID NO 14462 | CTGGGTGGCACCATCTAAT | CAG | chr12 | 21582311 | 21582330 | 21582327 | + |
| SEQ ID NO 14463 | GGCACCATCTAATCAGTTGC | CAG | chr12 | 21582318 | 21582337 | 21582334 | + |

Figure 43 (Cont'd)

| | | | | | | | |
|---|---|---|---|---|---|---|---|
| SEQ ID NO 14464 | CATCTAATCAGTTGCCAGCA | CAG | chr12 | 21582323 | 21582342 | 21582339 | + |
| SEQ ID NO 14465 | TAATCAGTTGCCAGCACAGC | CAG | chr12 | 21582327 | 21582346 | 21582343 | + |
| SEQ ID NO 14466 | AATCAGTTGCCAGCACAGCC | AGG | chr12 | 21582328 | 21582347 | 21582344 | + |
| SEQ ID NO 14467 | GCCAGCACAGCCAGGATATA | AAG | chr12 | 21582336 | 21582355 | 21582352 | + |
| SEQ ID NO 14468 | AGCACAGCCAGGATATAAAG | CAG | chr12 | 21582339 | 21582358 | 21582355 | + |
| SEQ ID NO 14469 | GCACAGCCAGGATATAAAGC | AGG | chr12 | 21582340 | 21582359 | 21582356 | + |
| SEQ ID NO 14470 | CAGCCAGGATATAAAGCAGG | CAG | chr12 | 21582343 | 21582362 | 21582359 | + |
| SEQ ID NO 14471 | AGCAGGCAGAAAAATGTGAA | AAG | chr12 | 21582357 | 21582376 | 21582373 | + |
| SEQ ID NO 14472 | GCAGGCAGAAAAATGTGAAA | AGG | chr12 | 21582358 | 21582377 | 21582374 | + |
| SEQ ID NO 14473 | GCAGAAAAATGTGAAAGGC | TAG | chr12 | 21582362 | 21582381 | 21582378 | + |
| SEQ ID NO 14474 | AAAATGTGAAAGGCTAGAT | TGG | chr12 | 21582367 | 21582386 | 21582383 | + |
| SEQ ID NO 14475 | GTGAAAGGCTAGATTGGCT | TGG | chr12 | 21582372 | 21582391 | 21582388 | + |
| SEQ ID NO 14476 | GCTAGATTGGCTTGGCATCC | CAG | chr12 | 21582380 | 21582399 | 21582396 | + |
| SEQ ID NO 14477 | CCTACATTTTTCTCCCATGC | TGG | chr12 | 21582403 | 21582422 | 21582419 | + |
| SEQ ID NO 14478 | ATGCTGGATTCTTCCTGCCC | TGG | chr12 | 21582419 | 21582438 | 21582435 | + |
| SEQ ID NO 14479 | TGCCCTGGAACATTGAACTC | CAG | chr12 | 21582434 | 21582453 | 21582450 | + |
| SEQ ID NO 14480 | GCCCTGGAACATTGAACTCC | AGG | chr12 | 21582435 | 21582454 | 21582451 | + |
| SEQ ID NO 14481 | ACATTGAACTCCAGGTTCTT | CAG | chr12 | 21582443 | 21582462 | 21582459 | + |
| SEQ ID NO 14482 | AACTCCAGGTTCTTCAGCTT | TGG | chr12 | 21582449 | 21582468 | 21582465 | + |
| SEQ ID NO 14483 | ACTCCAGGTTCTTCAGCTTT | GGG | chr12 | 21582450 | 21582469 | 21582466 | + |
| SEQ ID NO 14484 | TTCAGCTTTGGGACTCCGAC | TAG | chr12 | 21582461 | 21582480 | 21582477 | + |
| SEQ ID NO 14485 | CGACTAGCTTCCTTGTTCCT | CAG | chr12 | 21582477 | 21582496 | 21582493 | + |
| SEQ ID NO 14486 | TAGCTTCCTTGTTCCTCAGC | TGG | chr12 | 21582481 | 21582500 | 21582497 | + |
| SEQ ID NO 14487 | CTTCCTTGTTCCTCAGCTGG | CAG | chr12 | 21582484 | 21582503 | 21582500 | + |
| SEQ ID NO 14488 | CTTGTTCCTCAGCTGGCAGA | TGG | chr12 | 21582488 | 21582507 | 21582504 | + |
| SEQ ID NO 14489 | AGCTGGCAGATGGCCTGTTT | TGG | chr12 | 21582498 | 21582517 | 21582514 | + |
| SEQ ID NO 14490 | GCTGGCAGATGGCCTGTTTT | GGG | chr12 | 21582499 | 21582518 | 21582515 | + |
| SEQ ID NO 14491 | TTGGGACCTTGTGAACATGT | GAG | chr12 | 21582517 | 21582536 | 21582533 | + |
| SEQ ID NO 14492 | CTACATAATAAACTCTCATA | TAG | chr12 | 21582546 | 21582565 | 21582562 | + |
| SEQ ID NO 14493 | AATAAACTCTCATATAGATA | TAG | chr12 | 21582552 | 21582571 | 21582568 | + |
| SEQ ID NO 14494 | CTCTCATATAGATATAGATA | TAG | chr12 | 21582558 | 21582577 | 21582574 | + |
| SEQ ID NO 14495 | CTCATATAGATATAGATATA | GAG | chr12 | 21582560 | 21582579 | 21582576 | + |
| SEQ ID NO 14496 | TATAGATATAGATATAGAGA | TAG | chr12 | 21582564 | 21582583 | 21582580 | + |
| SEQ ID NO 14497 | TATAGATATAGAGATAGATA | TAG | chr12 | 21582570 | 21582589 | 21582586 | + |
| SEQ ID NO 14498 | TAGATATAGAGATAGATATA | GAG | chr12 | 21582572 | 21582591 | 21582588 | + |
| SEQ ID NO 14499 | TATAGAGATAGATATAGAGA | TAG | chr12 | 21582576 | 21582595 | 21582592 | + |
| SEQ ID NO 14500 | GATAGATATAGAGATAGATA | TAG | chr12 | 21582582 | 21582601 | 21582598 | + |
| SEQ ID NO 14501 | TATAGAGATAGATATAGATA | TAG | chr12 | 21582588 | 21582607 | 21582604 | + |
| SEQ ID NO 14502 | GATAGATATAGATATAGATA | TAG | chr12 | 21582594 | 21582613 | 21582610 | + |
| SEQ ID NO 14503 | TATAGATATAGATATAGATA | TAG | chr12 | 21582600 | 21582619 | 21582616 | + |
| SEQ ID NO 14504 | TATAGATATAGATATAGATA | TAG | chr12 | 21582606 | 21582625 | 21582622 | + |
| SEQ ID NO 14505 | TATAGATATAGATATAGATA | TAG | chr12 | 21582612 | 21582631 | 21582628 | + |
| SEQ ID NO 14506 | CTATTAATTCTGTTTCTCTG | TAG | chr12 | 21582646 | 21582665 | 21582662 | + |
| SEQ ID NO 14507 | TTCTCTGTAGAACCCTAATA | CAG | chr12 | 21582659 | 21582678 | 21582675 | + |
| SEQ ID NO 14508 | TAGAACCCTAATACAGATTT | TGG | chr12 | 21582666 | 21582685 | 21582682 | + |
| SEQ ID NO 14509 | CCTAATACAGATTTTGGTAC | CAG | chr12 | 21582672 | 21582691 | 21582688 | + |
| SEQ ID NO 14510 | CTAATACAGATTTTGGTACC | AGG | chr12 | 21582673 | 21582692 | 21582689 | + |

Figure 43 (Cont'd)

| SEQ ID NO 14511 | AATACAGATTTTGGTACCAG | GAG | chr12 | 21582675 | 21582694 | 21582691 | + |
| --- | --- | --- | --- | --- | --- | --- | --- |
| SEQ ID NO 14512 | ACAGATTTTGGTACCAGGAG | TGG | chr12 | 21582678 | 21582697 | 21582694 | + |
| SEQ ID NO 14513 | TTTGGTACCAGGAGTGGTTC | TAG | chr12 | 21582684 | 21582703 | 21582700 | + |
| SEQ ID NO 14514 | TGGTACCAGGAGTGGTTCTA | GAG | chr12 | 21582686 | 21582705 | 21582702 | + |
| SEQ ID NO 14515 | GGTACCAGGAGTGGTTCTAG | AGG | chr12 | 21582687 | 21582706 | 21582703 | + |
| SEQ ID NO 14516 | CAGGAGTGGTTCTAGAGGAA | CAG | chr12 | 21582692 | 21582711 | 21582708 | + |
| SEQ ID NO 14517 | TTCTAGAGGAACAGAATATT | AAG | chr12 | 21582701 | 21582720 | 21582717 | + |
| SEQ ID NO 14518 | TCTAGAGGAACAGAATATTA | AGG | chr12 | 21582702 | 21582721 | 21582718 | + |
| SEQ ID NO 14519 | GAGGAACAGAATATTAAGGA | TGG | chr12 | 21582706 | 21582725 | 21582722 | + |
| SEQ ID NO 14520 | GGAACAGAATATTAAGGATG | GAG | chr12 | 21582708 | 21582727 | 21582724 | + |
| SEQ ID NO 14521 | TAAGGATGGAGTTCTTTCAT | TGG | chr12 | 21582720 | 21582739 | 21582736 | + |
| SEQ ID NO 14522 | TGGAGTTCTTTCATTGGTTT | TGG | chr12 | 21582726 | 21582745 | 21582742 | + |
| SEQ ID NO 14523 | GGAGTTCTTTCATTGGTTTT | GGG | chr12 | 21582727 | 21582746 | 21582743 | + |
| SEQ ID NO 14524 | GAGTTCTTTCATTGGTTTTG | GGG | chr12 | 21582728 | 21582747 | 21582744 | + |
| SEQ ID NO 14525 | TTCATTGGTTTTGGGGTTTC | TGG | chr12 | 21582735 | 21582754 | 21582751 | + |
| SEQ ID NO 14526 | CATTGGTTTTGGGGTTTCTG | GAG | chr12 | 21582737 | 21582756 | 21582753 | + |
| SEQ ID NO 14527 | GGTTTTGGGGTTTCTGGAGT | TGG | chr12 | 21582741 | 21582760 | 21582757 | + |
| SEQ ID NO 14528 | AGTTGGCTGCTTAATATGAT | TAG | chr12 | 21582758 | 21582777 | 21582774 | + |
| SEQ ID NO 14529 | TGATTAGACCCAAATATGCT | AAG | chr12 | 21582774 | 21582793 | 21582790 | + |
| SEQ ID NO 14530 | GATTAGACCCAAATATGCTA | AGG | chr12 | 21582775 | 21582794 | 21582791 | + |
| SEQ ID NO 14531 | GCTAAGGACTCTTCTTCTAA | TGG | chr12 | 21582791 | 21582810 | 21582807 | + |
| SEQ ID NO 14532 | GGACTCTTCTTCTAATGGTA | TGG | chr12 | 21582796 | 21582815 | 21582812 | + |
| SEQ ID NO 14533 | ACTCTTCTTCTAATGGTATG | GAG | chr12 | 21582798 | 21582817 | 21582814 | + |
| SEQ ID NO 14534 | TGGAGAACACTGATAATCCT | TGG | chr12 | 21582816 | 21582835 | 21582832 | + |
| SEQ ID NO 14535 | AATCCTTGGCATCAATTGTT | TAG | chr12 | 21582830 | 21582849 | 21582846 | + |
| SEQ ID NO 14536 | TCCTTGGCATCAATTGTTTA | GAG | chr12 | 21582832 | 21582851 | 21582848 | + |
| SEQ ID NO 14537 | CTTGGCATCAATTGTTTAGA | GAG | chr12 | 21582834 | 21582853 | 21582850 | + |
| SEQ ID NO 14538 | ACTCTTGATTCAACGCTTGT | GAG | chr12 | 21582881 | 21582900 | 21582897 | + |
| SEQ ID NO 14539 | TCTTGATTCAACGCTTGTGA | GAG | chr12 | 21582883 | 21582902 | 21582899 | + |
| SEQ ID NO 14540 | CTTGATTCAACGCTTGTGAG | AGG | chr12 | 21582884 | 21582903 | 21582900 | + |
| SEQ ID NO 14541 | ATTCAACGCTTGTGAGAGGC | AAG | chr12 | 21582888 | 21582907 | 21582904 | + |
| SEQ ID NO 14542 | TTCAACGCTTGTGAGAGGCA | AGG | chr12 | 21582889 | 21582908 | 21582905 | + |
| SEQ ID NO 14543 | CTTGTGAGAGGCAAGGAATT | TAG | chr12 | 21582896 | 21582915 | 21582912 | + |
| SEQ ID NO 14544 | ATAATACTTTTGACTATATG | TGG | chr12 | 21582930 | 21582949 | 21582946 | + |
| SEQ ID NO 14545 | AATACTTTTGACTATATGTG | GAG | chr12 | 21582932 | 21582951 | 21582948 | + |
| SEQ ID NO 14546 | TTGACTATATGTGGAGAATC | AAG | chr12 | 21582939 | 21582958 | 21582955 | + |
| SEQ ID NO 14547 | TGACTATATGTGGAGAATCA | AGG | chr12 | 21582940 | 21582959 | 21582956 | + |
| SEQ ID NO 14548 | ATGTGGAGAATCAAGGAACA | TAG | chr12 | 21582947 | 21582966 | 21582963 | + |
| SEQ ID NO 14549 | GAGAATCAAGGAACATAGTG | AAG | chr12 | 21582952 | 21582971 | 21582968 | + |
| SEQ ID NO 14550 | ATCAAGGAACATAGTGAAGT | TGG | chr12 | 21582956 | 21582975 | 21582972 | + |
| SEQ ID NO 14551 | AGGAACATAGTGAAGTTGGT | TGG | chr12 | 21582960 | 21582979 | 21582976 | + |
| SEQ ID NO 14552 | GAAGTTGGTTGGTTGCTTGT | AAG | chr12 | 21582971 | 21582990 | 21582987 | + |
| SEQ ID NO 14553 | TTGGTTGCTTGTAAGTTCGC | TGG | chr12 | 21582979 | 21582998 | 21582995 | + |
| SEQ ID NO 14554 | GCTTGTAAGTTCGCTGGACA | AAG | chr12 | 21582985 | 21583004 | 21583001 | + |
| SEQ ID NO 14555 | TTCGCTGGACAAAGTGATGA | AAG | chr12 | 21582994 | 21583013 | 21583010 | + |
| SEQ ID NO 14556 | ATGAAAGAAAATGATGAACT | CAG | chr12 | 21583010 | 21583029 | 21583026 | + |
| SEQ ID NO 14557 | TGAAAGAAAATGATGAACTC | AGG | chr12 | 21583011 | 21583030 | 21583027 | + |

Figure 43 (Cont'd)

| | | | | | | | |
|---|---|---|---|---|---|---|---|
| SEQ ID NO 14558 | AAAGAAAATGATGAACTCAG | GAG | chr12 | 21583013 | 21583032 | 21583029 | + |
| SEQ ID NO 14559 | TCAGGAGTATATCAACTCTC | CAG | chr12 | 21583029 | 21583048 | 21583045 | + |
| SEQ ID NO 14560 | CTTTGTGCCATAATCTTATT | TGG | chr12 | 21583052 | 21583071 | 21583068 | + |
| SEQ ID NO 14561 | TTGTGCCATAATCTTATTTG | GAG | chr12 | 21583054 | 21583073 | 21583070 | + |
| SEQ ID NO 14562 | GTGCCATAATCTTATTTGGA | GAG | chr12 | 21583056 | 21583075 | 21583072 | + |
| SEQ ID NO 14563 | TGCTCACCTTTCACTTCCAC | AAG | chr12 | 21583083 | 21583102 | 21583099 | + |
| SEQ ID NO 14564 | TTCACTTCCACAAGATATCA | CAG | chr12 | 21583092 | 21583111 | 21583108 | + |
| SEQ ID NO 14565 | ACTTCCACAAGATATCACAG | TGG | chr12 | 21583095 | 21583114 | 21583111 | + |
| SEQ ID NO 14566 | TACATTGATGACATGCTGAC | TGG | chr12 | 21583123 | 21583142 | 21583139 | + |
| SEQ ID NO 14567 | GATGACATGCTGACTGGAAC | TAG | chr12 | 21583129 | 21583148 | 21583145 | + |
| SEQ ID NO 14568 | ACATGCTGACTGGAACTAGT | GAG | chr12 | 21583133 | 21583152 | 21583149 | + |
| SEQ ID NO 14569 | GCTGACTGGAACTAGTGAGC | AAG | chr12 | 21583137 | 21583156 | 21583153 | + |
| SEQ ID NO 14570 | GACTGGAACTAGTGAGCAAG | AAG | chr12 | 21583140 | 21583159 | 21583156 | + |
| SEQ ID NO 14571 | TGGAACTAGTGAGCAAGAAG | TAG | chr12 | 21583143 | 21583162 | 21583159 | + |
| SEQ ID NO 14572 | GCAAGAAGTAGCAAACACAC | TGG | chr12 | 21583155 | 21583174 | 21583171 | + |
| SEQ ID NO 14573 | AACACACTGGATTTATTGAT | GAG | chr12 | 21583168 | 21583187 | 21583184 | + |
| SEQ ID NO 14574 | ATTTATTGATGAGACATTTG | TGG | chr12 | 21583178 | 21583197 | 21583194 | + |
| SEQ ID NO 14575 | TTTATTGATGAGACATTTGT | GGG | chr12 | 21583179 | 21583198 | 21583195 | + |
| SEQ ID NO 14576 | TTGATGAGACATTTGTGGGA | CAG | chr12 | 21583183 | 21583202 | 21583199 | + |
| SEQ ID NO 14577 | GATGAGACATTTGTGGGACA | GAG | chr12 | 21583185 | 21583204 | 21583201 | + |
| SEQ ID NO 14578 | ATGAGACATTTGTGGGACAG | AGG | chr12 | 21583186 | 21583205 | 21583202 | + |
| SEQ ID NO 14579 | GACATTTGTGGGACAGAGGA | TGG | chr12 | 21583190 | 21583209 | 21583206 | + |
| SEQ ID NO 14580 | ACATTTGTGGGACAGAGGAT | GGG | chr12 | 21583191 | 21583210 | 21583207 | + |
| SEQ ID NO 14581 | GAAATAAATCTGATTAAATT | CAG | chr12 | 21583213 | 21583232 | 21583229 | + |
| SEQ ID NO 14582 | AAATAAATCTGATTAAATTC | AGG | chr12 | 21583214 | 21583233 | 21583230 | + |
| SEQ ID NO 14583 | AATAAATCTGATTAAATTCA | GGG | chr12 | 21583215 | 21583234 | 21583231 | + |
| SEQ ID NO 14584 | AATTCAGGGACCTTCTACCT | CAG | chr12 | 21583229 | 21583248 | 21583245 | + |
| SEQ ID NO 14585 | TTCTACCTCAGTAAAATTTA | TAG | chr12 | 21583241 | 21583260 | 21583257 | + |
| SEQ ID NO 14586 | TCTACCTCAGTAAAATTTAT | AGG | chr12 | 21583242 | 21583261 | 21583258 | + |
| SEQ ID NO 14587 | CTACCTCAGTAAAATTTATA | GGG | chr12 | 21583243 | 21583262 | 21583259 | + |
| SEQ ID NO 14588 | TACCTCAGTAAAATTTATAG | GGG | chr12 | 21583244 | 21583263 | 21583260 | + |
| SEQ ID NO 14589 | TAAAATTTATAGGGGTCCAA | TGG | chr12 | 21583252 | 21583271 | 21583268 | + |
| SEQ ID NO 14590 | TTTATAGGGGTCCAATGGTT | TGG | chr12 | 21583257 | 21583276 | 21583273 | + |
| SEQ ID NO 14591 | TTATAGGGGTCCAATGGTTT | GGG | chr12 | 21583258 | 21583277 | 21583274 | + |
| SEQ ID NO 14592 | TATAGGGGTCCAATGGTTTG | GGG | chr12 | 21583259 | 21583278 | 21583275 | + |
| SEQ ID NO 14593 | CCAATGGTTTGGGGCTCTTT | GAG | chr12 | 21583268 | 21583287 | 21583284 | + |
| SEQ ID NO 14594 | TCTTTGAGATATTCCTTCTA | AAG | chr12 | 21583283 | 21583302 | 21583299 | + |
| SEQ ID NO 14595 | GAGATATTCCTTCTAAAGTG | AAG | chr12 | 21583288 | 21583307 | 21583304 | + |
| SEQ ID NO 14596 | AGATATTCCTTCTAAAGTGA | AGG | chr12 | 21583289 | 21583308 | 21583305 | + |
| SEQ ID NO 14597 | GAAGGATAATTTGCTGCATT | TGG | chr12 | 21583307 | 21583326 | 21583323 | + |
| SEQ ID NO 14598 | ATTTGGCCACTCTTACAACC | AAG | chr12 | 21583324 | 21583343 | 21583340 | + |
| SEQ ID NO 14599 | CCACTCTTACAACCAAGAAA | TAG | chr12 | 21583330 | 21583349 | 21583346 | + |
| SEQ ID NO 14600 | CACTCTTACAACCAAGAAAT | AGG | chr12 | 21583331 | 21583350 | 21583347 | + |
| SEQ ID NO 14601 | CAAGAAATAGGCACAACGCC | TAG | chr12 | 21583343 | 21583362 | 21583359 | + |
| SEQ ID NO 14602 | GAAATAGGCACAACGCCTAG | TGG | chr12 | 21583346 | 21583365 | 21583362 | + |
| SEQ ID NO 14603 | AAATAGGCACAACGCCTAGT | GGG | chr12 | 21583347 | 21583366 | 21583363 | + |
| SEQ ID NO 14604 | CAACGCCTAGTGGGCCTATT | TGG | chr12 | 21583356 | 21583375 | 21583372 | + |

Figure 43 (Cont'd)

| SEQ ID NO 14605 | TAGTGGGCCTATTTGGATTT | TGG | chr12 | 21583363 | 21583382 | 21583379 | + |
| SEQ ID NO 14606 | GTGGGCCTATTTGGATTTTG | GAG | chr12 | 21583365 | 21583384 | 21583381 | + |
| SEQ ID NO 14607 | TGGGCCTATTTGGATTTTGG | AGG | chr12 | 21583366 | 21583385 | 21583382 | + |
| SEQ ID NO 14608 | GAGGCAACATATTCCTGATT | TGG | chr12 | 21583385 | 21583404 | 21583401 | + |
| SEQ ID NO 14609 | AGGCAACATATTCCTGATTT | GGG | chr12 | 21583386 | 21583405 | 21583402 | + |
| SEQ ID NO 14610 | CTGATTTGGGTGTGTTACTC | TGG | chr12 | 21583399 | 21583418 | 21583415 | + |
| SEQ ID NO 14611 | GTTACTCTGGCCCATTTATC | GAG | chr12 | 21583412 | 21583431 | 21583428 | + |
| SEQ ID NO 14612 | CCATTTATCGAGTGATCCAA | AAG | chr12 | 21583423 | 21583442 | 21583439 | + |
| SEQ ID NO 14613 | CATTTATCGAGTGATCCAAA | AGG | chr12 | 21583424 | 21583443 | 21583440 | + |
| SEQ ID NO 14614 | CGAGTGATCCAAAAGGCTGC | CAG | chr12 | 21583431 | 21583450 | 21583447 | + |
| SEQ ID NO 14615 | TCCAAAAGGCTGCCAGTTTT | GAG | chr12 | 21583438 | 21583457 | 21583454 | + |
| SEQ ID NO 14616 | AAAGGCTGCCAGTTTTGAG | TGG | chr12 | 21583441 | 21583460 | 21583457 | + |
| SEQ ID NO 14617 | AAGGCTGCCAGTTTTGAGTG | GAG | chr12 | 21583443 | 21583462 | 21583459 | + |
| SEQ ID NO 14618 | TGCCAGTTTTGAGTGGAGTC | CAG | chr12 | 21583448 | 21583467 | 21583464 | + |
| SEQ ID NO 14619 | GTTTTGAGTGGAGTCCAGAA | CAG | chr12 | 21583453 | 21583472 | 21583469 | + |
| SEQ ID NO 14620 | TTGAGTGGAGTCCAGAACAG | AAG | chr12 | 21583456 | 21583475 | 21583472 | + |
| SEQ ID NO 14621 | TGAGTGGAGTCCAGAACAGA | AGG | chr12 | 21583457 | 21583476 | 21583473 | + |
| SEQ ID NO 14622 | CAGAACAGAAGGCTCTGCCA | CAG | chr12 | 21583468 | 21583487 | 21583484 | + |
| SEQ ID NO 14623 | AGAACAGAAGGCTCTGCCAC | AGG | chr12 | 21583469 | 21583488 | 21583485 | + |
| SEQ ID NO 14624 | AGAAGGCTCTGCCACAGGTC | CAG | chr12 | 21583474 | 21583493 | 21583490 | + |
| SEQ ID NO 14625 | GAAGGCTCTGCCACAGGTCC | AGG | chr12 | 21583475 | 21583494 | 21583491 | + |
| SEQ ID NO 14626 | ACAGGTCCAGGCTGCTGTGC | AAG | chr12 | 21583487 | 21583506 | 21583503 | + |
| SEQ ID NO 14627 | GTGCAAGCTGCTATGCCACT | TGG | chr12 | 21583503 | 21583522 | 21583519 | + |
| SEQ ID NO 14628 | TGCAAGCTGCTATGCCACTT | GGG | chr12 | 21583504 | 21583523 | 21583520 | + |
| SEQ ID NO 14629 | GCCACTTGGGCCATATGACC | TAG | chr12 | 21583517 | 21583536 | 21583533 | + |
| SEQ ID NO 14630 | ACTTGGGCCATATGACCTAG | CAG | chr12 | 21583520 | 21583539 | 21583536 | + |
| SEQ ID NO 14631 | TAGCAGATCCAATGATGCTT | GAG | chr12 | 21583537 | 21583556 | 21583553 | + |
| SEQ ID NO 14632 | AGCAGATCCAATGATGCTTG | AGG | chr12 | 21583538 | 21583557 | 21583554 | + |
| SEQ ID NO 14633 | TCCAATGATGCTTGAGGTGT | CAG | chr12 | 21583544 | 21583563 | 21583560 | + |
| SEQ ID NO 14634 | GATGCTTGAGGTGTCAGTGC | CAG | chr12 | 21583550 | 21583569 | 21583566 | + |
| SEQ ID NO 14635 | CTTGAGGTGTCAGTGCCAGA | TAG | chr12 | 21583554 | 21583573 | 21583570 | + |
| SEQ ID NO 14636 | TTGAGGTGTCAGTGCCAGAT | AGG | chr12 | 21583555 | 21583574 | 21583571 | + |
| SEQ ID NO 14637 | TGAGGTGTCAGTGCCAGATA | GGG | chr12 | 21583556 | 21583575 | 21583572 | + |
| SEQ ID NO 14638 | TGCCAGATAGGGATGCTGTT | TGG | chr12 | 21583567 | 21583586 | 21583583 | + |
| SEQ ID NO 14639 | CCAGATAGGGATGCTGTTTG | GAG | chr12 | 21583569 | 21583588 | 21583585 | + |
| SEQ ID NO 14640 | GGGATGCTGTTTGGAGCATT | TGG | chr12 | 21583576 | 21583595 | 21583592 | + |
| SEQ ID NO 14641 | ATGCTGTTTGGAGCATTTGG | CAG | chr12 | 21583579 | 21583598 | 21583595 | + |
| SEQ ID NO 14642 | TGCTGTTTGGAGCATTTGGC | AGG | chr12 | 21583580 | 21583599 | 21583596 | + |
| SEQ ID NO 14643 | GCATTTGGCAGGCTGAATCA | CAG | chr12 | 21583591 | 21583610 | 21583607 | + |
| SEQ ID NO 14644 | TTTGGCAGGCTGAATCACAG | CGG | chr12 | 21583594 | 21583613 | 21583610 | + |
| SEQ ID NO 14645 | TGGCAGGCTGAATCACAGCG | GAG | chr12 | 21583596 | 21583615 | 21583612 | + |
| SEQ ID NO 14646 | GCAGGCTGAATCACAGCGG | AGG | chr12 | 21583597 | 21583616 | 21583613 | + |
| SEQ ID NO 14647 | TGAATCACAGCGGAGGCCTC | TAG | chr12 | 21583604 | 21583623 | 21583620 | + |
| SEQ ID NO 14648 | GAATCACAGCGGAGGCCTCT | AGG | chr12 | 21583605 | 21583624 | 21583621 | + |
| SEQ ID NO 14649 | AGCGGAGGCCTCTAGGATTT | TGG | chr12 | 21583612 | 21583631 | 21583628 | + |
| SEQ ID NO 14650 | CGGAGGCCTCTAGGATTTTG | GAG | chr12 | 21583614 | 21583633 | 21583630 | + |
| SEQ ID NO 14651 | GGCCTCTAGGATTTTGGAGC | AAG | chr12 | 21583618 | 21583637 | 21583634 | + |

Figure 43 (Cont'd)

| | | | | | | | |
|---|---|---|---|---|---|---|---|
| SEQ ID NO 14652 | GCCTCTAGGATTTTGGAGCA | AGG | chr12 | 21583619 | 21583638 | 21583635 | + |
| SEQ ID NO 14653 | CAAGGCCCTGCCATCTTCTG | CAG | chr12 | 21583637 | 21583656 | 21583653 | + |
| SEQ ID NO 14654 | TGCAGATAACTACTCTCTTT | TAG | chr12 | 21583655 | 21583674 | 21583671 | + |
| SEQ ID NO 14655 | GCAGATAACTACTCTCTTTT | AGG | chr12 | 21583656 | 21583675 | 21583672 | + |
| SEQ ID NO 14656 | CAGATAACTACTCTCTTTTA | GGG | chr12 | 21583657 | 21583676 | 21583673 | + |
| SEQ ID NO 14657 | GATAACTACTCTCTTTTAGG | GAG | chr12 | 21583659 | 21583678 | 21583675 | + |
| SEQ ID NO 14658 | ACTACTCTCTTTTAGGGAGA | AAG | chr12 | 21583663 | 21583682 | 21583679 | + |
| SEQ ID NO 14659 | TCTTTTAGGGAGAAAGCTCT | TGG | chr12 | 21583670 | 21583689 | 21583686 | + |
| SEQ ID NO 14660 | GAAAGCTCTTGGCCTGTTAC | TGG | chr12 | 21583681 | 21583700 | 21583697 | + |
| SEQ ID NO 14661 | AAAGCTCTTGGCCTGTTACT | GGG | chr12 | 21583682 | 21583701 | 21583698 | + |
| SEQ ID NO 14662 | CTTGGCCTGTTACTGGGCTT | TGG | chr12 | 21583688 | 21583707 | 21583704 | + |
| SEQ ID NO 14663 | GGCCTGTTACTGGGCTTTGG | TGG | chr12 | 21583691 | 21583710 | 21583707 | + |
| SEQ ID NO 14664 | GAAACGAAATATTTGACTAT | GAG | chr12 | 21583713 | 21583732 | 21583729 | + |
| SEQ ID NO 14665 | ATATTTGACTATGAGTCATC | AAG | chr12 | 21583721 | 21583740 | 21583737 | + |
| SEQ ID NO 14666 | CTGAACTGCCTATCATGAAC | TGG | chr12 | 21583756 | 21583775 | 21583772 | + |
| SEQ ID NO 14667 | TGAACTGCCTATCATGAACT | GGG | chr12 | 21583757 | 21583776 | 21583773 | + |
| SEQ ID NO 14668 | TGGGTGCTTTCTGATCCATC | TAG | chr12 | 21583776 | 21583795 | 21583792 | + |
| SEQ ID NO 14669 | TTCTGATCCATCTAGCCATA | AAG | chr12 | 21583784 | 21583803 | 21583800 | + |
| SEQ ID NO 14670 | TGATCCATCTAGCCATAAAG | TGG | chr12 | 21583787 | 21583806 | 21583803 | + |
| SEQ ID NO 14671 | GATCCATCTAGCCATAAAGT | GGG | chr12 | 21583788 | 21583807 | 21583804 | + |
| SEQ ID NO 14672 | GCCATAAAGTGGGCTGTGCA | CAG | chr12 | 21583798 | 21583817 | 21583814 | + |
| SEQ ID NO 14673 | ATAAAGTGGGCTGTGCACAG | CAG | chr12 | 21583801 | 21583820 | 21583817 | + |
| SEQ ID NO 14674 | TGTGCACAGCAGCATTGCAT | CAG | chr12 | 21583812 | 21583831 | 21583828 | + |
| SEQ ID NO 14675 | AGCAGCATTGCATCAGCAAA | TGG | chr12 | 21583819 | 21583838 | 21583835 | + |
| SEQ ID NO 14676 | AGCATTGCATCAGCAAATGG | AAG | chr12 | 21583822 | 21583841 | 21583838 | + |
| SEQ ID NO 14677 | ATTGCATCAGCAAATGGAAG | TGG | chr12 | 21583825 | 21583844 | 21583841 | + |
| SEQ ID NO 14678 | GGAAGTGGTATATATGCGAT | TGG | chr12 | 21583840 | 21583859 | 21583856 | + |
| SEQ ID NO 14679 | GAAGTGGTATATATGCGATT | GGG | chr12 | 21583841 | 21583860 | 21583857 | + |
| SEQ ID NO 14680 | GTATATGCGATTGGGCTT | GAG | chr12 | 21583847 | 21583866 | 21583863 | + |
| SEQ ID NO 14681 | TATATGCGATTGGGCTTGAG | CAG | chr12 | 21583850 | 21583869 | 21583866 | + |
| SEQ ID NO 14682 | TTGGGCTTGAGCAGATCCTG | AAG | chr12 | 21583859 | 21583878 | 21583875 | + |
| SEQ ID NO 14683 | TGGGCTTGAGCAGATCCTGA | AGG | chr12 | 21583860 | 21583879 | 21583876 | + |
| SEQ ID NO 14684 | TGAGCAGATCCTGAAGGCAC | TAG | chr12 | 21583866 | 21583885 | 21583882 | + |
| SEQ ID NO 14685 | CAGATCCTGAAGGCACTAGT | AAG | chr12 | 21583870 | 21583889 | 21583886 | + |
| SEQ ID NO 14686 | AAGGCACTAGTAAGTTACAT | GAG | chr12 | 21583879 | 21583898 | 21583895 | + |
| SEQ ID NO 14687 | CACTAGTAAGTTACATGAGA | AAG | chr12 | 21583883 | 21583902 | 21583899 | + |
| SEQ ID NO 14688 | ACTAGTAAGTTACATGAGAA | AGG | chr12 | 21583884 | 21583903 | 21583900 | + |
| SEQ ID NO 14689 | CTAGTAAGTTACATGAGAAA | GGG | chr12 | 21583885 | 21583904 | 21583901 | + |
| SEQ ID NO 14690 | TAGTAAGTTACATGAGAAAG | GGG | chr12 | 21583886 | 21583905 | 21583902 | + |
| SEQ ID NO 14691 | GAAAGGGGCTCAAATGCCCA | TGG | chr12 | 21583901 | 21583920 | 21583917 | + |
| SEQ ID NO 14692 | ACACACTGCTTTCTCTCCCT | GAG | chr12 | 21583936 | 21583955 | 21583952 | + |
| SEQ ID NO 14693 | TCTCCCTGAGACTGCACCGA | TGG | chr12 | 21583949 | 21583968 | 21583965 | + |
| SEQ ID NO 14694 | AGACTGCACCGATGGTCTCA | TGG | chr12 | 21583957 | 21583976 | 21583973 | + |
| SEQ ID NO 14695 | GACTGCACCGATGGTCTCAT | GGG | chr12 | 21583958 | 21583977 | 21583974 | + |
| SEQ ID NO 14696 | ACTGCACCGATGGTCTCATG | GGG | chr12 | 21583959 | 21583978 | 21583975 | + |
| SEQ ID NO 14697 | TGCACCGATGGTCTCATGGG | GAG | chr12 | 21583961 | 21583980 | 21583977 | + |
| SEQ ID NO 14698 | CATGGGGAGTTCCCTATGAT | CAG | chr12 | 21583975 | 21583994 | 21583991 | + |

Figure 43 (Cont'd)

| SEQ ID NO 14699 | AGTTCCCTATGATCAGCTGA | CAG | chr12 | 21583982 | 21584001 | 21583998 | + |
| SEQ ID NO 14700 | TTCCCTATGATCAGCTGACA | GAG | chr12 | 21583984 | 21584003 | 21584000 | + |
| SEQ ID NO 14701 | TCCCTATGATCAGCTGACAG | AGG | chr12 | 21583985 | 21584004 | 21584001 | + |
| SEQ ID NO 14702 | CTATGATCAGCTGACAGAGG | AAG | chr12 | 21583988 | 21584007 | 21584004 | + |
| SEQ ID NO 14703 | ATGATCAGCTGACAGAGGAA | GAG | chr12 | 21583990 | 21584009 | 21584006 | + |
| SEQ ID NO 14704 | ATCAGCTGACAGAGGAAGAG | AAG | chr12 | 21583993 | 21584012 | 21584009 | + |
| SEQ ID NO 14705 | CTGACAGAGGAAGAGAAGAC | TAG | chr12 | 21583998 | 21584017 | 21584014 | + |
| SEQ ID NO 14706 | TGACAGAGGAAGAGAAGACT | AGG | chr12 | 21583999 | 21584018 | 21584015 | + |
| SEQ ID NO 14707 | AGGAAGAGAAGACTAGGTCC | TGG | chr12 | 21584005 | 21584024 | 21584021 | + |
| SEQ ID NO 14708 | GAAGACTAGGTCCTGGTTCA | CAG | chr12 | 21584012 | 21584031 | 21584028 | + |
| SEQ ID NO 14709 | ACTAGGTCCTGGTTCACAGA | TAG | chr12 | 21584016 | 21584035 | 21584032 | + |
| SEQ ID NO 14710 | AGATAGTTCTGCACGATATG | CAG | chr12 | 21584033 | 21584052 | 21584049 | + |
| SEQ ID NO 14711 | GATAGTTCTGCACGATATGC | AGG | chr12 | 21584034 | 21584053 | 21584050 | + |
| SEQ ID NO 14712 | GATATGCAGGCACCACCCAA | AAG | chr12 | 21584047 | 21584066 | 21584063 | + |
| SEQ ID NO 14713 | ATGCAGGCACCACCCAAAAG | TGG | chr12 | 21584050 | 21584069 | 21584066 | + |
| SEQ ID NO 14714 | AGGCACCACCCAAAAGTGGA | CAG | chr12 | 21584054 | 21584073 | 21584070 | + |
| SEQ ID NO 14715 | CACCCAAAAGTGGACAGCCG | CAG | chr12 | 21584060 | 21584079 | 21584076 | + |
| SEQ ID NO 14716 | AGTGGACAGCCGCAGCACTA | CAG | chr12 | 21584068 | 21584087 | 21584084 | + |
| SEQ ID NO 14717 | GCAGCACTACAGCCCCTTTC | TAG | chr12 | 21584079 | 21584098 | 21584095 | + |
| SEQ ID NO 14718 | CAGCACTACAGCCCCTTTCT | AGG | chr12 | 21584080 | 21584099 | 21584096 | + |
| SEQ ID NO 14719 | CCCTTTCTAGGACATCCCTG | AAG | chr12 | 21584092 | 21584111 | 21584108 | + |
| SEQ ID NO 14720 | CCTTTCTAGGACATCCCTGA | AGG | chr12 | 21584093 | 21584112 | 21584109 | + |
| SEQ ID NO 14721 | AGGACATCCCTGAAGGACAA | CGG | chr12 | 21584100 | 21584119 | 21584116 | + |
| SEQ ID NO 14722 | ATCCCTGAAGGACAACGGTG | AAG | chr12 | 21584105 | 21584124 | 21584121 | + |
| SEQ ID NO 14723 | TCCCTGAAGGACAACGGTGA | AGG | chr12 | 21584106 | 21584125 | 21584122 | + |
| SEQ ID NO 14724 | CCCTGAAGGACAACGGTGAA | GGG | chr12 | 21584107 | 21584126 | 21584123 | + |
| SEQ ID NO 14725 | ACGGTGAAGGGAAATCTTCC | TAG | chr12 | 21584119 | 21584138 | 21584135 | + |
| SEQ ID NO 14726 | TGAAGGGAAATCTTCCTAGT | TGG | chr12 | 21584123 | 21584142 | 21584139 | + |
| SEQ ID NO 14727 | AGGGAAATCTTCCTAGTTGG | CAG | chr12 | 21584126 | 21584145 | 21584142 | + |
| SEQ ID NO 14728 | TTCCTAGTTGGCAGAACTTT | GAG | chr12 | 21584135 | 21584154 | 21584151 | + |
| SEQ ID NO 14729 | CTAGTTGGCAGAACTTTGAG | CAG | chr12 | 21584138 | 21584157 | 21584154 | + |
| SEQ ID NO 14730 | AGAACTTTGAGCAGTGTGCC | TGG | chr12 | 21584147 | 21584166 | 21584163 | + |
| SEQ ID NO 14731 | GCCTGGTTGTGCACTTTGCA | CAG | chr12 | 21584164 | 21584183 | 21584180 | + |
| SEQ ID NO 14732 | TGGTTGTGCACTTTGCACAG | AAG | chr12 | 21584167 | 21584186 | 21584183 | + |
| SEQ ID NO 14733 | GGTTGTGCACTTTGCACAGA | AGG | chr12 | 21584168 | 21584187 | 21584184 | + |
| SEQ ID NO 14734 | TTGTGCACTTTGCACAGAAG | GAG | chr12 | 21584170 | 21584189 | 21584186 | + |
| SEQ ID NO 14735 | ACTTTGCACAGAAGGAGAAA | TGG | chr12 | 21584176 | 21584195 | 21584192 | + |
| SEQ ID NO 14736 | TGCACAGAAGGAGAAATGGC | CAG | chr12 | 21584180 | 21584199 | 21584196 | + |
| SEQ ID NO 14737 | TGCGATTATATACTTATTCA | TGG | chr12 | 21584206 | 21584225 | 21584222 | + |
| SEQ ID NO 14738 | GCGATTATATACTTATTCAT | GGG | chr12 | 21584207 | 21584226 | 21584223 | + |
| SEQ ID NO 14739 | ATATACTTATTCATGGGCTG | TAG | chr12 | 21584213 | 21584232 | 21584229 | + |
| SEQ ID NO 14740 | TTATTCATGGGCTGTAGCCA | AAG | chr12 | 21584219 | 21584238 | 21584235 | + |
| SEQ ID NO 14741 | TATTCATGGGCTGTAGCCAA | AGG | chr12 | 21584220 | 21584239 | 21584236 | + |
| SEQ ID NO 14742 | ATGGGCTGTAGCCAAAGGTT | TGG | chr12 | 21584225 | 21584244 | 21584241 | + |
| SEQ ID NO 14743 | GCTGTAGCCAAAGGTTTGGC | TAG | chr12 | 21584229 | 21584248 | 21584245 | + |
| SEQ ID NO 14744 | TAGCCAAAGGTTTGGCTAGA | TGG | chr12 | 21584233 | 21584252 | 21584249 | + |
| SEQ ID NO 14745 | CAAAGGTTTGGCTAGATGGT | CAG | chr12 | 21584237 | 21584256 | 21584253 | + |

Figure 43 (Cont'd)

| | | | | | | | |
|---|---|---|---|---|---|---|---|
| SEQ ID NO 14746 | AAAGGTTTGGCTAGATGGTC | AGG | chr12 | 21584238 | 21584257 | 21584254 | + |
| SEQ ID NO 14747 | AAGGTTTGGCTAGATGGTCA | GGG | chr12 | 21584239 | 21584258 | 21584255 | + |
| SEQ ID NO 14748 | TGGCTAGATGGTCAGGGACT | TGG | chr12 | 21584245 | 21584264 | 21584261 | + |
| SEQ ID NO 14749 | GATGGTCAGGGACTTGGAAA | AAG | chr12 | 21584251 | 21584270 | 21584267 | + |
| SEQ ID NO 14750 | GGACTTGGAAAAAGCATGAC | TGG | chr12 | 21584260 | 21584279 | 21584276 | + |
| SEQ ID NO 14751 | TGACTGGAAAATTGATGACA | AAG | chr12 | 21584276 | 21584295 | 21584292 | + |
| SEQ ID NO 14752 | AAATTGATGACAAAGAAATT | TGG | chr12 | 21584284 | 21584303 | 21584300 | + |
| SEQ ID NO 14753 | AATTGATGACAAAGAAATTT | GGG | chr12 | 21584285 | 21584304 | 21584301 | + |
| SEQ ID NO 14754 | ATTGATGACAAAGAAATTTG | GGG | chr12 | 21584286 | 21584305 | 21584302 | + |
| SEQ ID NO 14755 | GATGACAAAGAAATTTGGGG | AAG | chr12 | 21584289 | 21584308 | 21584305 | + |
| SEQ ID NO 14756 | TGACAAAGAAATTTGGGGAA | GAG | chr12 | 21584291 | 21584310 | 21584307 | + |
| SEQ ID NO 14757 | GACAAAGAAATTTGGGGAAG | AGG | chr12 | 21584292 | 21584311 | 21584308 | + |
| SEQ ID NO 14758 | AAATTTGGGGAAGAGGTATG | TGG | chr12 | 21584299 | 21584318 | 21584315 | + |
| SEQ ID NO 14759 | TTGGGGAAGAGGTATGTGGA | TGG | chr12 | 21584303 | 21584322 | 21584319 | + |
| SEQ ID NO 14760 | TGTGGATGGACCTCTATGAT | TAG | chr12 | 21584317 | 21584336 | 21584333 | + |
| SEQ ID NO 14761 | ATGATTAGTCAAAAACTACA | AAG | chr12 | 21584332 | 21584351 | 21584348 | + |
| SEQ ID NO 14762 | AAGATATTTTCATCCCATGT | GAG | chr12 | 21584352 | 21584371 | 21584368 | + |
| SEQ ID NO 14763 | CCCATGTGAGTGCTCACCAA | TGG | chr12 | 21584365 | 21584384 | 21584381 | + |
| SEQ ID NO 14764 | CCATGTGAGTGCTCACCAAT | GGG | chr12 | 21584366 | 21584385 | 21584382 | + |
| SEQ ID NO 14765 | TGCTCACCAATGGGTGACCT | CAG | chr12 | 21584375 | 21584394 | 21584391 | + |
| SEQ ID NO 14766 | TCACCAATGGGTGACCTCAG | CAG | chr12 | 21584378 | 21584397 | 21584394 | + |
| SEQ ID NO 14767 | CCAATGGGTGACCTCAGCAG | AAG | chr12 | 21584381 | 21584400 | 21584397 | + |
| SEQ ID NO 14768 | AATGGGTGACCTCAGCAGAA | GAG | chr12 | 21584383 | 21584402 | 21584399 | + |
| SEQ ID NO 14769 | ATGGGTGACCTCAGCAGAAG | AGG | chr12 | 21584384 | 21584403 | 21584400 | + |
| SEQ ID NO 14770 | AGAAGAGGATTTTAATAATC | AAG | chr12 | 21584399 | 21584418 | 21584415 | + |
| SEQ ID NO 14771 | AGAGGATTTTAATAATCAAG | TGG | chr12 | 21584402 | 21584421 | 21584418 | + |
| SEQ ID NO 14772 | GATTTTAATAATCAAGTGGA | TAG | chr12 | 21584406 | 21584425 | 21584422 | + |
| SEQ ID NO 14773 | ATTTTAATAATCAAGTGGAT | AGG | chr12 | 21584407 | 21584426 | 21584423 | + |
| SEQ ID NO 14774 | GGATAGGATGATCAATTCTG | TGG | chr12 | 21584423 | 21584442 | 21584439 | + |
| SEQ ID NO 14775 | TCAATTCTGTGGACACCACT | CAG | chr12 | 21584434 | 21584453 | 21584450 | + |
| SEQ ID NO 14776 | GACACCACTCAGCCTTTTCC | CAG | chr12 | 21584445 | 21584464 | 21584461 | + |
| SEQ ID NO 14777 | ACACCACTCAGCCTTTTCCC | AGG | chr12 | 21584446 | 21584465 | 21584462 | + |
| SEQ ID NO 14778 | CCACTCATGTCATCGTCCAA | TGG | chr12 | 21584469 | 21584488 | 21584485 | + |
| SEQ ID NO 14779 | GTCCAATGGACCCATGAACA | AAG | chr12 | 21584483 | 21584502 | 21584499 | + |
| SEQ ID NO 14780 | CAATGGACCCATGAACAAAG | TGG | chr12 | 21584486 | 21584505 | 21584502 | + |
| SEQ ID NO 14781 | ACCCATGAACAAAGTGGCCA | CAG | chr12 | 21584492 | 21584511 | 21584508 | + |
| SEQ ID NO 14782 | GAACAAAGTGGCCACAGTTG | CAG | chr12 | 21584498 | 21584517 | 21584514 | + |
| SEQ ID NO 14783 | AACAAAGTGGCCACAGTTGC | AGG | chr12 | 21584499 | 21584518 | 21584515 | + |
| SEQ ID NO 14784 | ACAAAGTGGCCACAGTTGCA | GGG | chr12 | 21584500 | 21584519 | 21584516 | + |
| SEQ ID NO 14785 | AGTGGCCACAGTTGCAGGGA | TGG | chr12 | 21584504 | 21584523 | 21584520 | + |
| SEQ ID NO 14786 | GGCCACAGTTGCAGGGATGG | AAG | chr12 | 21584507 | 21584526 | 21584523 | + |
| SEQ ID NO 14787 | GCAGGGATGGAAGTTATGCT | TGG | chr12 | 21584517 | 21584536 | 21584533 | + |
| SEQ ID NO 14788 | CAGGGATGGAAGTTATGCTT | GGG | chr12 | 21584518 | 21584537 | 21584534 | + |
| SEQ ID NO 14789 | ATGGAAGTTATGCTTGGGCT | CAG | chr12 | 21584523 | 21584542 | 21584539 | + |
| SEQ ID NO 14790 | TATGCTTGGGCTCAGCAACA | TGG | chr12 | 21584531 | 21584550 | 21584547 | + |
| SEQ ID NO 14791 | ACATGGACTTCCACTCACCA | AAG | chr12 | 21584548 | 21584567 | 21584564 | + |
| SEQ ID NO 14792 | TCCACTCACCAAAGCTGACC | TGG | chr12 | 21584557 | 21584576 | 21584573 | + |

Figure 43 (Cont'd)

| | | | | | | | |
|---|---|---|---|---|---|---|---|
| SEQ ID NO 14793 | CACCAAAGCTGACCTGGCCA | CAG | chr12 | 21584563 | 21584582 | 21584579 | + |
| SEQ ID NO 14794 | TGGCCACAGCCACTGCTTGC | CAG | chr12 | 21584577 | 21584596 | 21584593 | + |
| SEQ ID NO 14795 | CAGCCACTGCTTGCCAGCAT | CAG | chr12 | 21584583 | 21584602 | 21584599 | + |
| SEQ ID NO 14796 | GCCACTGCTTGCCAGCATCA | GAG | chr12 | 21584585 | 21584604 | 21584601 | + |
| SEQ ID NO 14797 | CAGCATCAGAGACCAACACT | AAG | chr12 | 21584597 | 21584616 | 21584613 | + |
| SEQ ID NO 14798 | CCAACACTAAGCCCTTGATA | TGG | chr12 | 21584609 | 21584628 | 21584625 | + |
| SEQ ID NO 14799 | CTTGATATGGCACCATTCCT | CGG | chr12 | 21584622 | 21584641 | 21584638 | + |
| SEQ ID NO 14800 | TTGATATGGCACCATTCCTC | GGG | chr12 | 21584623 | 21584642 | 21584639 | + |
| SEQ ID NO 14801 | TGATATGGCACCATTCCTCG | GGG | chr12 | 21584624 | 21584643 | 21584640 | + |
| SEQ ID NO 14802 | GCACCATTCCTCGGGGTGAT | CAG | chr12 | 21584631 | 21584650 | 21584647 | + |
| SEQ ID NO 14803 | CATTCCTCGGGGTGATCAGC | CAG | chr12 | 21584635 | 21584654 | 21584651 | + |
| SEQ ID NO 14804 | GGGGTGATCAGCCAGCTACC | TGG | chr12 | 21584643 | 21584662 | 21584659 | + |
| SEQ ID NO 14805 | GTGATCAGCCAGCTACCTGG | TGG | chr12 | 21584646 | 21584665 | 21584662 | + |
| SEQ ID NO 14806 | ATCAGCCAGCTACCTGGTGG | CAG | chr12 | 21584649 | 21584668 | 21584665 | + |
| SEQ ID NO 14807 | TCAGCCAGCTACCTGGTGGC | AGG | chr12 | 21584650 | 21584669 | 21584666 | + |
| SEQ ID NO 14808 | TGGTGGCAGGTTGATTATAT | TGG | chr12 | 21584663 | 21584682 | 21584679 | + |
| SEQ ID NO 14809 | ATATTGGACCTCTTCCATCA | TGG | chr12 | 21584679 | 21584698 | 21584695 | + |
| SEQ ID NO 14810 | TGGACCTCTTCCATCATGGA | AAG | chr12 | 21584683 | 21584702 | 21584699 | + |
| SEQ ID NO 14811 | GGACCTCTTCCATCATGGAA | AGG | chr12 | 21584684 | 21584703 | 21584700 | + |
| SEQ ID NO 14812 | GACCTCTTCCATCATGGAAA | GGG | chr12 | 21584685 | 21584704 | 21584701 | + |
| SEQ ID NO 14813 | CTCTTCCATCATGGAAAGGG | CAG | chr12 | 21584688 | 21584707 | 21584704 | + |
| SEQ ID NO 14814 | CTTCCATCATGGAAAGGGCA | GAG | chr12 | 21584690 | 21584709 | 21584706 | + |
| SEQ ID NO 14815 | TTCCATCATGGAAAGGGCAG | AGG | chr12 | 21584691 | 21584710 | 21584707 | + |
| SEQ ID NO 14816 | GGGCAGAGGCTTGTCCTCAC | TGG | chr12 | 21584705 | 21584724 | 21584721 | + |
| SEQ ID NO 14817 | GAGGCTTGTCCTCACTGGAA | TAG | chr12 | 21584710 | 21584729 | 21584726 | + |
| SEQ ID NO 14818 | ACTGGAATAGACACTTACTC | TGG | chr12 | 21584723 | 21584742 | 21584739 | + |
| SEQ ID NO 14819 | ATAGACACTTACTCTGGATA | TGG | chr12 | 21584729 | 21584748 | 21584745 | + |
| SEQ ID NO 14820 | TAGACACTTACTCTGGATAT | GGG | chr12 | 21584730 | 21584749 | 21584746 | + |
| SEQ ID NO 14821 | CTGAACTCAATGCTTATGCC | AAG | chr12 | 21584763 | 21584782 | 21584779 | + |
| SEQ ID NO 14822 | TATGCCAAGACTACCATCCA | TGG | chr12 | 21584777 | 21584796 | 21584793 | + |
| SEQ ID NO 14823 | GACTACCATCCATGGAATCA | CAG | chr12 | 21584785 | 21584804 | 21584801 | + |
| SEQ ID NO 14824 | GAATGCCGTATCCACTGTCA | TGG | chr12 | 21584807 | 21584826 | 21584823 | + |
| SEQ ID NO 14825 | CACTGTCATGGTATTCCACA | CAG | chr12 | 21584819 | 21584838 | 21584835 | + |
| SEQ ID NO 14826 | ACACAGCATTGCTTCTGACC | AAG | chr12 | 21584836 | 21584855 | 21584852 | + |
| SEQ ID NO 14827 | TGACCAAGCCACTCACTTTA | TGG | chr12 | 21584851 | 21584870 | 21584867 | + |
| SEQ ID NO 14828 | AGCCACTCACTTTATGGCTA | AAG | chr12 | 21584857 | 21584876 | 21584873 | + |
| SEQ ID NO 14829 | CACTCACTTTATGGCTAAAG | AAG | chr12 | 21584860 | 21584879 | 21584876 | + |
| SEQ ID NO 14830 | TTATGGCTAAAGAAGTGTGA | CAG | chr12 | 21584868 | 21584887 | 21584884 | + |
| SEQ ID NO 14831 | TGGCTAAAGAAGTGTGACAG | TGG | chr12 | 21584871 | 21584890 | 21584887 | + |
| SEQ ID NO 14832 | GGCTAAAGAAGTGTGACAGT | GGG | chr12 | 21584872 | 21584891 | 21584888 | + |
| SEQ ID NO 14833 | TGACAGTGGGCTCATGCTCA | TGG | chr12 | 21584885 | 21584904 | 21584901 | + |
| SEQ ID NO 14834 | CTCATGCTCATGGAATTTAC | TGG | chr12 | 21584895 | 21584914 | 21584911 | + |
| SEQ ID NO 14835 | CCATGATCCCTATCATCCTG | AAG | chr12 | 21584923 | 21584942 | 21584939 | + |
| SEQ ID NO 14836 | TGATCCCTATCATCCTGAAG | CAG | chr12 | 21584926 | 21584945 | 21584942 | + |
| SEQ ID NO 14837 | ATCCTGAAGCAGCTTTTGAA | TGG | chr12 | 21584937 | 21584956 | 21584953 | + |
| SEQ ID NO 14838 | AGCTTTTGAATGGCCTTTTG | AAG | chr12 | 21584947 | 21584966 | 21584963 | + |
| SEQ ID NO 14839 | GTCACGATTACAATGCCAAC | TAG | chr12 | 21584969 | 21584988 | 21584985 | + |

Figure 43 (Cont'd)

| | | | | | | | |
|---|---|---|---|---|---|---|---|
| SEQ ID NO 14840 | TCACGATTACAATGCCAACT | AGG | chr12 | 21584970 | 21584989 | 21584986 | + |
| SEQ ID NO 14841 | AACTAGGTGACAATACTTTG | CAG | chr12 | 21584986 | 21585005 | 21585002 | + |
| SEQ ID NO 14842 | ACTAGGTGACAATACTTTGC | AGG | chr12 | 21584987 | 21585006 | 21585003 | + |
| SEQ ID NO 14843 | GTGACAATACTTTGCAGGCC | TGG | chr12 | 21584992 | 21585011 | 21585008 | + |
| SEQ ID NO 14844 | TGACAATACTTTGCAGGCCT | GGG | chr12 | 21584993 | 21585012 | 21585009 | + |
| SEQ ID NO 14845 | GACAATACTTTGCAGGCCTG | GGG | chr12 | 21584994 | 21585013 | 21585010 | + |
| SEQ ID NO 14846 | TACTTTGCAGGCCTGGGGCA | AAG | chr12 | 21584999 | 21585018 | 21585015 | + |
| SEQ ID NO 14847 | AGGCCTGGGGCAAAGTTCTC | CAG | chr12 | 21585007 | 21585026 | 21585023 | + |
| SEQ ID NO 14848 | CCTGGGGCAAAGTTCTCCAG | AAG | chr12 | 21585010 | 21585029 | 21585026 | + |
| SEQ ID NO 14849 | CTGGGGCAAAGTTCTCCAGA | AGG | chr12 | 21585011 | 21585030 | 21585027 | + |
| SEQ ID NO 14850 | AGGCTGTGTATGCTCTGAAT | CAG | chr12 | 21585031 | 21585050 | 21585047 | + |
| SEQ ID NO 14851 | CTGAATCAGTGTCCAATATA | TGG | chr12 | 21585045 | 21585064 | 21585061 | + |
| SEQ ID NO 14852 | ATATGGTACTGTTTCTCCCA | TAG | chr12 | 21585062 | 21585081 | 21585078 | + |
| SEQ ID NO 14853 | GGTACTGTTTCTCCCATAGA | CAG | chr12 | 21585066 | 21585085 | 21585082 | + |
| SEQ ID NO 14854 | GTACTGTTTCTCCCATAGAC | AGG | chr12 | 21585067 | 21585086 | 21585083 | + |
| SEQ ID NO 14855 | TCTCCCATAGACAGGATTCA | CGG | chr12 | 21585075 | 21585094 | 21585091 | + |
| SEQ ID NO 14856 | CTCCCATAGACAGGATTCAC | GGG | chr12 | 21585076 | 21585095 | 21585092 | + |
| SEQ ID NO 14857 | ATAGACAGGATTCACGGGTC | CAG | chr12 | 21585081 | 21585100 | 21585097 | + |
| SEQ ID NO 14858 | TAGACAGGATTCACGGGTCC | AGG | chr12 | 21585082 | 21585101 | 21585098 | + |
| SEQ ID NO 14859 | ATTCACGGGTCCAGGAATCA | AAG | chr12 | 21585090 | 21585109 | 21585106 | + |
| SEQ ID NO 14860 | TTCACGGGTCCAGGAATCAA | AGG | chr12 | 21585091 | 21585110 | 21585107 | + |
| SEQ ID NO 14861 | TCACGGGTCCAGGAATCAAA | GGG | chr12 | 21585092 | 21585111 | 21585108 | + |
| SEQ ID NO 14862 | CGGGTCCAGGAATCAAAGGG | TGG | chr12 | 21585095 | 21585114 | 21585111 | + |
| SEQ ID NO 14863 | GTCCAGGAATCAAAGGGTGG | AAG | chr12 | 21585098 | 21585117 | 21585114 | + |
| SEQ ID NO 14864 | CAGGAATCAAAGGGTGGAAG | TGG | chr12 | 21585101 | 21585120 | 21585117 | + |
| SEQ ID NO 14865 | GAATCAAAGGGTGGAAGTGG | AAG | chr12 | 21585104 | 21585123 | 21585120 | + |
| SEQ ID NO 14866 | TCAAAGGGTGGAAGTGGAAG | TGG | chr12 | 21585107 | 21585126 | 21585123 | + |
| SEQ ID NO 14867 | AAGGGTGGAAGTGGAAGTGG | AAG | chr12 | 21585110 | 21585129 | 21585126 | + |
| SEQ ID NO 14868 | GGTGGAAGTGGAAGTGGAAG | TGG | chr12 | 21585113 | 21585132 | 21585129 | + |
| SEQ ID NO 14869 | GCACCACTCACCATCACCCC | TAG | chr12 | 21585135 | 21585154 | 21585151 | + |
| SEQ ID NO 14870 | CATCACCCCTAGTGTTCCAC | TAG | chr12 | 21585146 | 21585165 | 21585162 | + |
| SEQ ID NO 14871 | ATTTTTGCTTCCTGTTCCCA | TGG | chr12 | 21585173 | 21585192 | 21585189 | + |
| SEQ ID NO 14872 | CCCATGGCATTATGTTCTGC | TGG | chr12 | 21585189 | 21585208 | 21585205 | + |
| SEQ ID NO 14873 | GGCATTATGTTCTGCTGGCT | TAG | chr12 | 21585194 | 21585213 | 21585210 | + |
| SEQ ID NO 14874 | CATTATGTTCTGCTGGCTTA | GAG | chr12 | 21585196 | 21585215 | 21585212 | + |
| SEQ ID NO 14875 | ATTATGTTCTGCTGGCTTAG | AGG | chr12 | 21585197 | 21585216 | 21585213 | + |
| SEQ ID NO 14876 | TTCTGCTGGCTTAGAGGTCT | TAG | chr12 | 21585203 | 21585222 | 21585219 | + |
| SEQ ID NO 14877 | TGGCTTAGAGGTCTTAGTTC | CAG | chr12 | 21585209 | 21585228 | 21585225 | + |
| SEQ ID NO 14878 | GCTTAGAGGTCTTAGTTCCA | GAG | chr12 | 21585211 | 21585230 | 21585227 | + |
| SEQ ID NO 14879 | CTTAGAGGTCTTAGTTCCAG | AGG | chr12 | 21585212 | 21585231 | 21585228 | + |
| SEQ ID NO 14880 | TTAGAGGTCTTAGTTCCAGA | GGG | chr12 | 21585213 | 21585232 | 21585229 | + |
| SEQ ID NO 14881 | AGAGGTCTTAGTTCCAGAGG | GAG | chr12 | 21585215 | 21585234 | 21585231 | + |
| SEQ ID NO 14882 | GAGGTCTTAGTTCCAGAGGG | AGG | chr12 | 21585216 | 21585235 | 21585232 | + |
| SEQ ID NO 14883 | AGAGGGAGGAACACTGCCGC | CAG | chr12 | 21585230 | 21585249 | 21585246 | + |
| SEQ ID NO 14884 | GAGGGAGGAACACTGCCGCC | AGG | chr12 | 21585231 | 21585250 | 21585247 | + |
| SEQ ID NO 14885 | ATTCCATTAAACTGCAAATT | AAG | chr12 | 21585267 | 21585286 | 21585283 | + |
| SEQ ID NO 14886 | TGCAAATTAAGATTGCCACC | TGG | chr12 | 21585279 | 21585298 | 21585295 | + |

Figure 43 (Cont'd)

| | | | | | | | |
|---|---|---|---|---|---|---|---|
| SEQ ID NO 14887 | AGATTGCCACCTGGACACTT | TGG | chr12 | 21585288 | 21585307 | 21585304 | + |
| SEQ ID NO 14888 | GATTGCCACCTGGACACTTT | GGG | chr12 | 21585289 | 21585308 | 21585305 | + |
| SEQ ID NO 14889 | TTTGGGCTCCTCCCACCTTT | AAG | chr12 | 21585306 | 21585325 | 21585322 | + |
| SEQ ID NO 14890 | TCCTCCCACCTTTAAGTCAA | CAG | chr12 | 21585313 | 21585332 | 21585329 | + |
| SEQ ID NO 14891 | CCTCCCACCTTTAAGTCAAC | AGG | chr12 | 21585314 | 21585333 | 21585330 | + |
| SEQ ID NO 14892 | CACCTTTAAGTCAACAGGCT | AAG | chr12 | 21585319 | 21585338 | 21585335 | + |
| SEQ ID NO 14893 | CTTTAAGTCAACAGGCTAAG | AAG | chr12 | 21585322 | 21585341 | 21585338 | + |
| SEQ ID NO 14894 | TTAAGTCAACAGGCTAAGAA | GAG | chr12 | 21585324 | 21585343 | 21585340 | + |
| SEQ ID NO 14895 | AAGTCAACAGGCTAAGAAGA | GAG | chr12 | 21585326 | 21585345 | 21585342 | + |
| SEQ ID NO 14896 | ACAGGCTAAGAAGAGAGTTA | CAG | chr12 | 21585332 | 21585351 | 21585348 | + |
| SEQ ID NO 14897 | TAAGAAGAGAGTTACAGTGT | TGG | chr12 | 21585338 | 21585357 | 21585354 | + |
| SEQ ID NO 14898 | GAGAGTTACAGTGTTGGCTG | CGG | chr12 | 21585344 | 21585363 | 21585360 | + |
| SEQ ID NO 14899 | GTTGGCTGCGGTGATTAACC | CAG | chr12 | 21585356 | 21585375 | 21585372 | + |
| SEQ ID NO 14900 | GGTGATTAACCCAGACTATC | AAG | chr12 | 21585365 | 21585384 | 21585381 | + |
| SEQ ID NO 14901 | CCAGACTATCAAGATGAAAT | CAG | chr12 | 21585375 | 21585394 | 21585391 | + |
| SEQ ID NO 14902 | ATCAGTCTACAACTCCACAA | TGG | chr12 | 21585393 | 21585412 | 21585409 | + |
| SEQ ID NO 14903 | CAGTCTACAACTCCACAATG | GAG | chr12 | 21585395 | 21585414 | 21585411 | + |
| SEQ ID NO 14904 | AGTCTACAACTCCACAATGG | AGG | chr12 | 21585396 | 21585415 | 21585412 | + |
| SEQ ID NO 14905 | TACAACTCCACAATGGAGGT | AAG | chr12 | 21585400 | 21585419 | 21585416 | + |
| SEQ ID NO 14906 | ACAACTCCACAATGGAGGTA | AGG | chr12 | 21585401 | 21585420 | 21585417 | + |
| SEQ ID NO 14907 | ACTCCACAATGGAGGTAAGG | AAG | chr12 | 21585404 | 21585423 | 21585420 | + |
| SEQ ID NO 14908 | GAGGTAAGGAAGCGTATGCA | TGG | chr12 | 21585415 | 21585434 | 21585431 | + |
| SEQ ID NO 14909 | GGAAGCGTATGCATGGAATA | TAG | chr12 | 21585422 | 21585441 | 21585438 | + |
| SEQ ID NO 14910 | GAAGCGTATGCATGGAATAT | AGG | chr12 | 21585423 | 21585442 | 21585439 | + |
| SEQ ID NO 14911 | AGCGTATGCATGGAATATAG | GAG | chr12 | 21585425 | 21585444 | 21585441 | + |
| SEQ ID NO 14912 | ATGGAATATAGGAGATCCAT | TAG | chr12 | 21585434 | 21585453 | 21585450 | + |
| SEQ ID NO 14913 | TGGAATATAGGAGATCCATT | AGG | chr12 | 21585435 | 21585454 | 21585451 | + |
| SEQ ID NO 14914 | GGAATATAGGAGATCCATTA | GGG | chr12 | 21585436 | 21585455 | 21585452 | + |
| SEQ ID NO 14915 | AGATCCATTAGGGTGTCTCT | TAG | chr12 | 21585446 | 21585465 | 21585462 | + |
| SEQ ID NO 14916 | CTCTTAGTTTTACCATGTCC | TGG | chr12 | 21585462 | 21585481 | 21585478 | + |
| SEQ ID NO 14917 | TTTTACCATGTCCTGGAATT | AAG | chr12 | 21585469 | 21585488 | 21585485 | + |
| SEQ ID NO 14918 | TTTACCATGTCCTGGAATTA | AGG | chr12 | 21585470 | 21585489 | 21585486 | + |
| SEQ ID NO 14919 | CCATGTCCTGGAATTAAGGT | CAG | chr12 | 21585474 | 21585493 | 21585490 | + |
| SEQ ID NO 14920 | TGTCCTGGAATTAAGGTCAG | TGG | chr12 | 21585477 | 21585496 | 21585493 | + |
| SEQ ID NO 14921 | GTCCTGGAATTAAGGTCAGT | GGG | chr12 | 21585478 | 21585497 | 21585494 | + |
| SEQ ID NO 14922 | AGGTCAGTGGGAAACTACTA | CAG | chr12 | 21585490 | 21585509 | 21585506 | + |
| SEQ ID NO 14923 | GGTCAGTGGGAAACTACTAC | AGG | chr12 | 21585491 | 21585510 | 21585507 | + |
| SEQ ID NO 14924 | GAAACTACTACAGGCCATTC | CAG | chr12 | 21585500 | 21585519 | 21585516 | + |
| SEQ ID NO 14925 | AAACTACTACAGGCCATTCC | AGG | chr12 | 21585501 | 21585520 | 21585517 | + |
| SEQ ID NO 14926 | CTACTACAGGCCATTCCAGG | CAG | chr12 | 21585504 | 21585523 | 21585520 | + |
| SEQ ID NO 14927 | TACTACAGGCCATTCCAGGC | AGG | chr12 | 21585505 | 21585524 | 21585521 | + |
| SEQ ID NO 14928 | TCCAGGCAGGACTACAAATA | AAG | chr12 | 21585518 | 21585537 | 21585534 | + |
| SEQ ID NO 14929 | CCAGGCAGGACTACAAATAA | AGG | chr12 | 21585519 | 21585538 | 21585535 | + |
| SEQ ID NO 14930 | CAGGACTACAAATAAAGGTT | TGG | chr12 | 21585524 | 21585543 | 21585540 | + |
| SEQ ID NO 14931 | AGGACTACAAATAAAGGTTT | GGG | chr12 | 21585525 | 21585544 | 21585541 | + |
| SEQ ID NO 14932 | AAAGGTTTGGGTCACTCCAC | CAG | chr12 | 21585537 | 21585556 | 21585553 | + |
| SEQ ID NO 14933 | AAGGTTTGGGTCACTCCACC | AGG | chr12 | 21585538 | 21585557 | 21585554 | + |

Figure 43 (Cont'd)

| | | | | | | | |
|---|---|---|---|---|---|---|---|
| SEQ ID NO 14934 | CAGGAAAAAAAAAAAAAAAA | AAG | chr12 | 21585557 | 21585576 | 21585573 | + |
| SEQ ID NO 14935 | AAAAAAAAAAAAAAAAGAC | AAG | chr12 | 21585562 | 21585581 | 21585578 | + |
| SEQ ID NO 14936 | AAAAAAGACAAGACCTGCT | GAG | chr12 | 21585572 | 21585591 | 21585588 | + |
| SEQ ID NO 14937 | AAAAAGACAAGACCTGCTG | AGG | chr12 | 21585573 | 21585592 | 21585589 | + |
| SEQ ID NO 14938 | GACCTGCTGAGGTGCTTGCT | GAG | chr12 | 21585584 | 21585603 | 21585600 | + |
| SEQ ID NO 14939 | ACCTGCTGAGGTGCTTGCTG | AGG | chr12 | 21585585 | 21585604 | 21585601 | + |
| SEQ ID NO 14940 | CCTGCTGAGGTGCTTGCTGA | GGG | chr12 | 21585586 | 21585605 | 21585602 | + |
| SEQ ID NO 14941 | TGAGGTGCTTGCTGAGGGCA | AAG | chr12 | 21585591 | 21585610 | 21585607 | + |
| SEQ ID NO 14942 | GAGGTGCTTGCTGAGGGCAA | AGG | chr12 | 21585592 | 21585611 | 21585608 | + |
| SEQ ID NO 14943 | AGGTGCTTGCTGAGGGCAAA | GGG | chr12 | 21585593 | 21585612 | 21585609 | + |
| SEQ ID NO 14944 | TGCTGAGGGCAAAGGGAATA | CAG | chr12 | 21585600 | 21585619 | 21585616 | + |
| SEQ ID NO 14945 | CAAAGGGAATACAGAATATG | TAG | chr12 | 21585609 | 21585628 | 21585625 | + |
| SEQ ID NO 14946 | AGGGAATACAGAATATGTAG | CAG | chr12 | 21585612 | 21585631 | 21585628 | + |
| SEQ ID NO 14947 | GAATACAGAATATGTAGCAG | AAG | chr12 | 21585615 | 21585634 | 21585631 | + |
| SEQ ID NO 14948 | TACAGAATATGTAGCAGAAG | AAG | chr12 | 21585618 | 21585637 | 21585634 | + |
| SEQ ID NO 14949 | ACAGAATATGTAGCAGAAGA | AGG | chr12 | 21585619 | 21585638 | 21585635 | + |
| SEQ ID NO 14950 | GAATATGTAGCAGAAGAAGG | TAG | chr12 | 21585622 | 21585641 | 21585638 | + |
| SEQ ID NO 14951 | AAGAAGGTAGTCATCAATAC | CAG | chr12 | 21585635 | 21585654 | 21585651 | + |
| SEQ ID NO 14952 | TACGATCACGTGACCAATTG | CAG | chr12 | 21585659 | 21585678 | 21585675 | + |
| SEQ ID NO 14953 | ACGTGACCAATTGCAGATAC | AAG | chr12 | 21585666 | 21585685 | 21585682 | + |
| SEQ ID NO 14954 | CGTGACCAATTGCAGATACA | AGG | chr12 | 21585667 | 21585686 | 21585683 | + |
| SEQ ID NO 14955 | ACAAGGACTGTAATTGTCAT | GAG | chr12 | 21585684 | 21585703 | 21585700 | + |
| SEQ ID NO 14956 | TGTCTGTATACACTTGTACT | AAG | chr12 | 21585740 | 21585759 | 21585756 | + |
| SEQ ID NO 14957 | TTTCCTTTATCATGTGACAT | AAG | chr12 | 21585787 | 21585806 | 21585803 | + |
| SEQ ID NO 14958 | AAGATTTATTGACTTCATAT | CAG | chr12 | 21585807 | 21585826 | 21585823 | + |
| SEQ ID NO 14959 | TTGACTTCATATCAGCATTT | AAG | chr12 | 21585815 | 21585834 | 21585831 | + |
| SEQ ID NO 14960 | ATCAGCATTTAAGTATTGTT | AAG | chr12 | 21585825 | 21585844 | 21585841 | + |
| SEQ ID NO 14961 | GTATTGTTAAGTTTATGTAA | TAG | chr12 | 21585837 | 21585856 | 21585853 | + |
| SEQ ID NO 14962 | TTATGTAATAGCATTTGCAA | TGG | chr12 | 21585849 | 21585868 | 21585865 | + |
| SEQ ID NO 14963 | TATGTAATAGCATTTGCAAT | GGG | chr12 | 21585850 | 21585869 | 21585866 | + |
| SEQ ID NO 14964 | ATGTAATAGCATTTGCAATG | GGG | chr12 | 21585851 | 21585870 | 21585867 | + |
| SEQ ID NO 14965 | ATAGCATTTGCAATGGGGAT | TGG | chr12 | 21585856 | 21585875 | 21585872 | + |
| SEQ ID NO 14966 | GGTGCATTTTCAATTGCACG | AAG | chr12 | 21585877 | 21585896 | 21585893 | + |
| SEQ ID NO 14967 | GTGCATTTTCAATTGCACGA | AGG | chr12 | 21585878 | 21585897 | 21585894 | + |
| SEQ ID NO 14968 | ATTTTCAATTGCACGAAGGA | TAG | chr12 | 21585882 | 21585901 | 21585898 | + |
| SEQ ID NO 14969 | AATTGCACGAAGGATAGTTT | TAG | chr12 | 21585888 | 21585907 | 21585904 | + |
| SEQ ID NO 14970 | GAAGGATAGTTTTAGTATGT | TAG | chr12 | 21585896 | 21585915 | 21585912 | + |
| SEQ ID NO 14971 | AAGGATAGTTTTAGTATGTT | AGG | chr12 | 21585897 | 21585916 | 21585913 | + |
| SEQ ID NO 14972 | CTTATTGTTGTCTTTATTTG | AAG | chr12 | 21585931 | 21585950 | 21585947 | + |
| SEQ ID NO 14973 | TTGAAGATAATGTATGACCT | CAG | chr12 | 21585948 | 21585967 | 21585964 | + |
| SEQ ID NO 14974 | TGAAGATAATGTATGACCTC | AGG | chr12 | 21585949 | 21585968 | 21585965 | + |
| SEQ ID NO 14975 | GAAGATAATGTATGACCTCA | GGG | chr12 | 21585950 | 21585969 | 21585966 | + |
| SEQ ID NO 14976 | AAGATAATGTATGACCTCAG | GGG | chr12 | 21585951 | 21585970 | 21585967 | + |
| SEQ ID NO 14977 | ATGACCTCAGGGGATGTGTA | TAG | chr12 | 21585961 | 21585980 | 21585977 | + |
| SEQ ID NO 14978 | TGACCTCAGGGGATGTGTAT | AGG | chr12 | 21585962 | 21585981 | 21585978 | + |
| SEQ ID NO 14979 | CAGGGGATGTGTATAGGCTC | AAG | chr12 | 21585968 | 21585987 | 21585984 | + |
| SEQ ID NO 14980 | GTGTATAGGCTCAAGTTGAC | AAG | chr12 | 21585976 | 21585995 | 21585992 | + |

Figure 43 (Cont'd)

| | | | | | | | |
|---|---|---|---|---|---|---|---|
| SEQ ID NO 14981 | AGGCTCAAGTTGACAAGCGA | TGG | chr12 | 21585982 | 21586001 | 21585998 | + |
| SEQ ID NO 14982 | GACAAGCGATGGACTTGTGA | TGG | chr12 | 21585993 | 21586012 | 21586009 | + |
| SEQ ID NO 14983 | GACTTGTGATGGTTAATACT | GAG | chr12 | 21586004 | 21586023 | 21586020 | + |
| SEQ ID NO 14984 | ATACTGAGTGTCAACTTGAT | TGG | chr12 | 21586019 | 21586038 | 21586035 | + |
| SEQ ID NO 14985 | GTGTCAACTTGATTGGATTG | AAG | chr12 | 21586026 | 21586045 | 21586042 | + |
| SEQ ID NO 14986 | TGATTGGATTGAAGTGTGCA | AAG | chr12 | 21586035 | 21586054 | 21586051 | + |
| SEQ ID NO 14987 | GTGTGCAAAGTATTGATCCT | GAG | chr12 | 21586048 | 21586067 | 21586064 | + |
| SEQ ID NO 14988 | TTGATCCTGAGTGTGTCTGT | GAG | chr12 | 21586060 | 21586079 | 21586076 | + |
| SEQ ID NO 14989 | TGATCCTGAGTGTGTCTGTG | AGG | chr12 | 21586061 | 21586080 | 21586077 | + |
| SEQ ID NO 14990 | GATCCTGAGTGTGTCTGTGA | GGG | chr12 | 21586062 | 21586081 | 21586078 | + |
| SEQ ID NO 14991 | TGTCTGTGAGGGTATTGCCA | AAG | chr12 | 21586073 | 21586092 | 21586089 | + |
| SEQ ID NO 14992 | GTCTGTGAGGGTATTGCCAA | AGG | chr12 | 21586074 | 21586093 | 21586090 | + |
| SEQ ID NO 14993 | CTGTGAGGGTATTGCCAAAG | GAG | chr12 | 21586076 | 21586095 | 21586092 | + |
| SEQ ID NO 14994 | GCCAAAGGAGATTAACATTT | TAG | chr12 | 21586089 | 21586108 | 21586105 | + |
| SEQ ID NO 14995 | AAGGAGATTAACATTTTAGT | CAG | chr12 | 21586093 | 21586112 | 21586109 | + |
| SEQ ID NO 14996 | GAGATTAACATTTTAGTCAG | TGG | chr12 | 21586096 | 21586115 | 21586112 | + |
| SEQ ID NO 14997 | AGATTAACATTTTAGTCAGT | GGG | chr12 | 21586097 | 21586116 | 21586113 | + |
| SEQ ID NO 14998 | TAACATTTTAGTCAGTGGGC | TGG | chr12 | 21586101 | 21586120 | 21586117 | + |
| SEQ ID NO 14999 | AACATTTTAGTCAGTGGGCT | GGG | chr12 | 21586102 | 21586121 | 21586118 | + |
| SEQ ID NO 15000 | TTTTAGTCAGTGGGCTGGGA | AAG | chr12 | 21586106 | 21586125 | 21586122 | + |
| SEQ ID NO 15001 | TTTAGTCAGTGGGCTGGGAA | AGG | chr12 | 21586107 | 21586126 | 21586123 | + |
| SEQ ID NO 15002 | AGTCAGTGGGCTGGGAAAGG | CAG | chr12 | 21586110 | 21586129 | 21586126 | + |
| SEQ ID NO 15003 | AGGCAGACCCACCCTTAATC | TGG | chr12 | 21586127 | 21586146 | 21586143 | + |
| SEQ ID NO 15004 | GGCAGACCCACCCTTAATCT | GGG | chr12 | 21586128 | 21586147 | 21586144 | + |
| SEQ ID NO 15005 | AGACCCACCCTTAATCTGGG | TGG | chr12 | 21586131 | 21586150 | 21586147 | + |
| SEQ ID NO 15006 | GACCCACCCTTAATCTGGGT | GGG | chr12 | 21586132 | 21586151 | 21586148 | + |
| SEQ ID NO 15007 | CTGGGTGGGCACCATCTAAT | CAG | chr12 | 21586146 | 21586165 | 21586162 | + |
| SEQ ID NO 15008 | GGCACCATCTAATCAGTTGC | CAG | chr12 | 21586153 | 21586172 | 21586169 | + |
| SEQ ID NO 15009 | CATCTAATCAGTTGCCAGTG | TGG | chr12 | 21586158 | 21586177 | 21586174 | + |
| SEQ ID NO 15010 | TAATCAGTTGCCAGTGTGGC | CAG | chr12 | 21586162 | 21586181 | 21586178 | + |
| SEQ ID NO 15011 | AATCAGTTGCCAGTGTGGCC | AGG | chr12 | 21586163 | 21586182 | 21586179 | + |
| SEQ ID NO 15012 | GCCAGTGTGGCCAGGATATA | AAG | chr12 | 21586171 | 21586190 | 21586187 | + |
| SEQ ID NO 15013 | AGTGTGGCCAGGATATAAAG | CAG | chr12 | 21586174 | 21586193 | 21586190 | + |
| SEQ ID NO 15014 | GTGTGGCCAGGATATAAAGC | AGG | chr12 | 21586175 | 21586194 | 21586191 | + |
| SEQ ID NO 15015 | TGGCCAGGATATAAAGCAGG | CAG | chr12 | 21586178 | 21586197 | 21586194 | + |
| SEQ ID NO 15016 | AAAAAACATGTGAAAATCC | TGG | chr12 | 21586202 | 21586221 | 21586218 | + |
| SEQ ID NO 15017 | AACATGTGAAAATCCTGGAC | TGG | chr12 | 21586207 | 21586226 | 21586223 | + |
| SEQ ID NO 15018 | GTGAAAATCCTGGACTGGCT | TAG | chr12 | 21586212 | 21586231 | 21586228 | + |
| SEQ ID NO 15019 | CCTGGACTGGCTTAGCCTCC | AAG | chr12 | 21586220 | 21586239 | 21586236 | + |
| SEQ ID NO 15020 | CCTACATCTTTCTCCCATGC | TGG | chr12 | 21586243 | 21586262 | 21586259 | + |
| SEQ ID NO 15021 | TGCTTCCTGCCCTCAAACAT | TGG | chr12 | 21586267 | 21586286 | 21586283 | + |
| SEQ ID NO 15022 | GCCCTCAAACATTGGACTCC | AAG | chr12 | 21586275 | 21586294 | 21586291 | + |
| SEQ ID NO 15023 | ACATTGGACTCCAAGTCCTT | CAG | chr12 | 21586283 | 21586302 | 21586299 | + |
| SEQ ID NO 15024 | GACTCCAAGTCCTTCAGCTT | TGG | chr12 | 21586289 | 21586308 | 21586305 | + |
| SEQ ID NO 15025 | ACTCCAAGTCCTTCAGCTTT | GGG | chr12 | 21586290 | 21586309 | 21586306 | + |
| SEQ ID NO 15026 | AGTCCTTCAGCTTTGGGACT | TGG | chr12 | 21586296 | 21586315 | 21586312 | + |
| SEQ ID NO 15027 | TTCAGCTTTGGGACTTGGAC | TGG | chr12 | 21586301 | 21586320 | 21586317 | + |

Figure 43 (Cont'd)

| | | | | | | | |
|---|---|---|---|---|---|---|---|
| SEQ ID NO 15028 | CTTCCTTGCTCCTCTGCTTG | CAG | chr12 | 21586324 | 21586343 | 21586340 | + |
| SEQ ID NO 15029 | CTTGCTCCTCTGCTTGCAGA | TGG | chr12 | 21586328 | 21586347 | 21586344 | + |
| SEQ ID NO 15030 | TGCTTGCAGATGGCCTATTG | TGG | chr12 | 21586338 | 21586357 | 21586354 | + |
| SEQ ID NO 15031 | GCTTGCAGATGGCCTATTGT | GGG | chr12 | 21586339 | 21586358 | 21586355 | + |
| SEQ ID NO 15032 | GTGGGACCTTGTGATTGTGT | AAG | chr12 | 21586357 | 21586376 | 21586373 | + |
| SEQ ID NO 15033 | TCTATCTATCTATCTCCTAT | TAG | chr12 | 21586450 | 21586469 | 21586466 | + |
| SEQ ID NO 15034 | TCCTATTAGTTCTGTCTCTC | TAG | chr12 | 21586464 | 21586483 | 21586480 | + |
| SEQ ID NO 15035 | CCTATTAGTTCTGTCTCTCT | AGG | chr12 | 21586465 | 21586484 | 21586481 | + |
| SEQ ID NO 15036 | CTATTAGTTCTGTCTCTCTA | GGG | chr12 | 21586466 | 21586485 | 21586482 | + |
| SEQ ID NO 15037 | CTAGGGAACCCTGACAAATA | CAG | chr12 | 21586483 | 21586502 | 21586499 | + |
| SEQ ID NO 15038 | GGAACCCTGACAAATACAGT | GAG | chr12 | 21586487 | 21586506 | 21586503 | + |
| SEQ ID NO 15039 | CCTGACAAATACAGTGAGCT | CAG | chr12 | 21586492 | 21586511 | 21586508 | + |
| SEQ ID NO 15040 | CTGACAAATACAGTGAGCTC | AGG | chr12 | 21586493 | 21586512 | 21586509 | + |
| SEQ ID NO 15041 | ATACAGTGAGCTCAGGTCCT | GAG | chr12 | 21586500 | 21586519 | 21586516 | + |
| SEQ ID NO 15042 | CAGTGAGCTCAGGTCCTGAG | CAG | chr12 | 21586503 | 21586522 | 21586519 | + |
| SEQ ID NO 15043 | CCTGAGCAGACATTTTCCAA | AAG | chr12 | 21586517 | 21586536 | 21586533 | + |
| SEQ ID NO 15044 | GAGCAGACATTTTCCAAAAG | AAG | chr12 | 21586520 | 21586539 | 21586536 | + |
| SEQ ID NO 15045 | TTTTCCAAAAGAAGACATAC | AAG | chr12 | 21586529 | 21586548 | 21586545 | + |
| SEQ ID NO 15046 | TCCAAAAGAAGACATACAAG | TGG | chr12 | 21586532 | 21586551 | 21586548 | + |
| SEQ ID NO 15047 | GGCCAATAAACGTCAAAAAA | AAG | chr12 | 21586553 | 21586572 | 21586569 | + |
| SEQ ID NO 15048 | AGTTCAACATCACTAATAAT | CAG | chr12 | 21586574 | 21586593 | 21586590 | + |
| SEQ ID NO 15049 | TTCAACATCACTAATAATCA | GAG | chr12 | 21586576 | 21586595 | 21586592 | + |
| SEQ ID NO 15050 | CATATGATACCTCCTTATGC | CAG | chr12 | 21586617 | 21586636 | 21586633 | + |
| SEQ ID NO 15051 | TGATACCTCCTTATGCCAGT | CAG | chr12 | 21586621 | 21586640 | 21586637 | + |
| SEQ ID NO 15052 | CCTCCTTATGCCAGTCAGAA | TGG | chr12 | 21586626 | 21586645 | 21586642 | + |
| SEQ ID NO 15053 | TCAGAATGGCTATCATTATA | AAG | chr12 | 21586640 | 21586659 | 21586656 | + |
| SEQ ID NO 15054 | ATCATTATAAAGTTCAAAAA | CAG | chr12 | 21586651 | 21586670 | 21586667 | + |
| SEQ ID NO 15055 | ATTATAAAGTTCAAAACAG | CAG | chr12 | 21586654 | 21586673 | 21586670 | + |
| SEQ ID NO 15056 | AGTTCAAAACAGCAGATGT | TGG | chr12 | 21586661 | 21586680 | 21586677 | + |
| SEQ ID NO 15057 | CAAAAACAGCAGATGTTGGT | GAG | chr12 | 21586665 | 21586684 | 21586681 | + |
| SEQ ID NO 15058 | AAAAACAGCAGATGTTGGTG | AGG | chr12 | 21586666 | 21586685 | 21586682 | + |
| SEQ ID NO 15059 | AGCAGATGTTGGTGAGGATG | TGG | chr12 | 21586672 | 21586691 | 21586688 | + |
| SEQ ID NO 15060 | CAGATGTTGGTGAGGATGTG | GAG | chr12 | 21586674 | 21586693 | 21586690 | + |
| SEQ ID NO 15061 | GTTGGTGAGGATGTGGAGAC | AAG | chr12 | 21586679 | 21586698 | 21586695 | + |
| SEQ ID NO 15062 | AGAAAATGCTTATACACTGT | TGG | chr12 | 21586700 | 21586719 | 21586716 | + |
| SEQ ID NO 15063 | AATGCTTATACACTGTTGGT | AAG | chr12 | 21586704 | 21586723 | 21586720 | + |
| SEQ ID NO 15064 | CTGTTGGTAAGAATGTAAAT | TAG | chr12 | 21586716 | 21586735 | 21586732 | + |
| SEQ ID NO 15065 | GTAAATTAGTACAAACTTTA | TGG | chr12 | 21586730 | 21586749 | 21586746 | + |
| SEQ ID NO 15066 | AATTAGTACAAACTTTATGG | AAG | chr12 | 21586733 | 21586752 | 21586749 | + |
| SEQ ID NO 15067 | AGTACAAACTTTATGGAAGA | CAG | chr12 | 21586737 | 21586756 | 21586753 | + |
| SEQ ID NO 15068 | ACTTTATGGAAGACAGCATG | AAG | chr12 | 21586744 | 21586763 | 21586760 | + |
| SEQ ID NO 15069 | GACAGCATGAAGATTTCTTA | AAG | chr12 | 21586755 | 21586774 | 21586771 | + |
| SEQ ID NO 15070 | ATGAAGATTTCTTAAAGAAC | TAG | chr12 | 21586761 | 21586780 | 21586777 | + |
| SEQ ID NO 15071 | ATTTCTTAAAGAACTAGAAA | CAG | chr12 | 21586767 | 21586786 | 21586783 | + |
| SEQ ID NO 15072 | CAATCCTGCAATCCCACTAC | TGG | chr12 | 21586800 | 21586819 | 21586816 | + |
| SEQ ID NO 15073 | AATCCTGCAATCCCACTACT | GGG | chr12 | 21586801 | 21586820 | 21586817 | + |
| SEQ ID NO 15074 | TGCAATCCCACTACTGGGTA | TGG | chr12 | 21586806 | 21586825 | 21586822 | + |

Figure 43 (Cont'd)

| | | | | | | | |
|---|---|---|---|---|---|---|---|
| SEQ ID NO 15075 | CACTACTGGGTATGGACCCA | AAG | chr12 | 21586814 | 21586833 | 21586830 | + |
| SEQ ID NO 15076 | TGGGTATGGACCCAAAGTGA | AAG | chr12 | 21586820 | 21586839 | 21586836 | + |
| SEQ ID NO 15077 | GGTATGGACCCAAAGTGAAA | GAG | chr12 | 21586822 | 21586841 | 21586838 | + |
| SEQ ID NO 15078 | TGAAAGAGATCATATTAAAA | AAG | chr12 | 21586837 | 21586856 | 21586853 | + |
| SEQ ID NO 15079 | ATTAAAAAAGATATCTGCAT | TAG | chr12 | 21586850 | 21586869 | 21586866 | + |
| SEQ ID NO 15080 | TATCTGCATTAGTATGTTCA | AAG | chr12 | 21586861 | 21586880 | 21586877 | + |
| SEQ ID NO 15081 | CTGCATTAGTATGTTCAAAG | TAG | chr12 | 21586864 | 21586883 | 21586880 | + |
| SEQ ID NO 15082 | CAAAGTAGCACTGTTCCCAA | TAG | chr12 | 21586879 | 21586898 | 21586895 | + |
| SEQ ID NO 15083 | TAGCACTGTTCCCAATAGCA | AAG | chr12 | 21586884 | 21586903 | 21586900 | + |
| SEQ ID NO 15084 | TGTTCCCAATAGCAAAGATA | TGG | chr12 | 21586890 | 21586909 | 21586906 | + |
| SEQ ID NO 15085 | TCAACCTAAATGTCTACCAA | TGG | chr12 | 21586915 | 21586934 | 21586931 | + |
| SEQ ID NO 15086 | AATGTCTACCAATGGACGAT | TGG | chr12 | 21586923 | 21586942 | 21586939 | + |
| SEQ ID NO 15087 | TACCAATGGACGATTGGATA | AAG | chr12 | 21586929 | 21586948 | 21586945 | + |
| SEQ ID NO 15088 | ACGATTGGATAAAGAAAATG | TGG | chr12 | 21586938 | 21586957 | 21586954 | + |
| SEQ ID NO 15089 | TTATATACATATATATTACT | CAG | chr12 | 21586972 | 21586991 | 21586988 | + |
| SEQ ID NO 15090 | TATATTACTCAGCCATAAAA | AAG | chr12 | 21586983 | 21587002 | 21586999 | + |
| SEQ ID NO 15091 | GAATGAAATCATGTCTTCTC | TAG | chr12 | 21587005 | 21587024 | 21587021 | + |
| SEQ ID NO 15092 | TCATGTCTTCTCTAGAAACA | TGG | chr12 | 21587013 | 21587032 | 21587029 | + |
| SEQ ID NO 15093 | GTCTTCTCTAGAAACATGGT | TAG | chr12 | 21587017 | 21587036 | 21587033 | + |
| SEQ ID NO 15094 | TCTAGAAACATGGTTAGAAC | TGG | chr12 | 21587023 | 21587042 | 21587039 | + |
| SEQ ID NO 15095 | TAGAAACATGGTTAGAACTG | GAG | chr12 | 21587025 | 21587044 | 21587041 | + |
| SEQ ID NO 15096 | AGAAACATGGTTAGAACTGG | AGG | chr12 | 21587026 | 21587045 | 21587042 | + |
| SEQ ID NO 15097 | GAACTGGAGGACATTATCCT | CAG | chr12 | 21587039 | 21587058 | 21587055 | + |
| SEQ ID NO 15098 | TTATCCTCAGTGAAATAACT | CAG | chr12 | 21587052 | 21587071 | 21587068 | + |
| SEQ ID NO 15099 | TCAGTGAAATAACTCAGAAA | CAG | chr12 | 21587058 | 21587077 | 21587074 | + |
| SEQ ID NO 15100 | TGAAATAACTCAGAAACAGA | AAG | chr12 | 21587062 | 21587081 | 21587078 | + |
| SEQ ID NO 15101 | CAGAAACAGAAAGTCAAACA | CAG | chr12 | 21587072 | 21587091 | 21587088 | + |
| SEQ ID NO 15102 | AAACACAGTATGTTCTCATT | TAG | chr12 | 21587087 | 21587106 | 21587103 | + |
| SEQ ID NO 15103 | ACAGTATGTTCTCATTTAGT | GAG | chr12 | 21587091 | 21587110 | 21587107 | + |
| SEQ ID NO 15104 | AGTATGTTCTCATTTAGTGA | GAG | chr12 | 21587093 | 21587112 | 21587109 | + |
| SEQ ID NO 15105 | GTTCTCATTTAGTGAGAGCC | AAG | chr12 | 21587098 | 21587117 | 21587114 | + |
| SEQ ID NO 15106 | CTCATTTAGTGAGAGCCAAG | TGG | chr12 | 21587101 | 21587120 | 21587117 | + |
| SEQ ID NO 15107 | TCATTTAGTGAGAGCCAAGT | GGG | chr12 | 21587102 | 21587121 | 21587118 | + |
| SEQ ID NO 15108 | ATTTAGTGAGAGCCAAGTGG | GAG | chr12 | 21587104 | 21587123 | 21587120 | + |
| SEQ ID NO 15109 | CCAAGTGGGAGCTAAACGAT | GAG | chr12 | 21587116 | 21587135 | 21587132 | + |
| SEQ ID NO 15110 | GTGGGAGCTAAACGATGAGT | AAG | chr12 | 21587120 | 21587139 | 21587136 | + |
| SEQ ID NO 15111 | AGCTAAACGATGAGTAAGCA | TAG | chr12 | 21587125 | 21587144 | 21587141 | + |
| SEQ ID NO 15112 | GATGAGTAAGCATAGACATA | TAG | chr12 | 21587133 | 21587152 | 21587149 | + |
| SEQ ID NO 15113 | AGACATATAGAATGAAATAA | TAG | chr12 | 21587146 | 21587165 | 21587162 | + |
| SEQ ID NO 15114 | GAATGAAATAATAGACACTT | GAG | chr12 | 21587155 | 21587174 | 21587171 | + |
| SEQ ID NO 15115 | AAATAATAGACACTTGAGAC | TAG | chr12 | 21587160 | 21587179 | 21587176 | + |
| SEQ ID NO 15116 | ATAATAGACACTTGAGACTA | GAG | chr12 | 21587162 | 21587181 | 21587178 | + |
| SEQ ID NO 15117 | TAGACACTTGAGACTAGAGA | AAG | chr12 | 21587166 | 21587185 | 21587182 | + |
| SEQ ID NO 15118 | AGACACTTGAGACTAGAGAA | AGG | chr12 | 21587167 | 21587186 | 21587183 | + |
| SEQ ID NO 15119 | CACTTGAGACTAGAGAAAGG | TGG | chr12 | 21587170 | 21587189 | 21587186 | + |
| SEQ ID NO 15120 | ACTTGAGACTAGAGAAAGGT | GGG | chr12 | 21587171 | 21587190 | 21587187 | + |
| SEQ ID NO 15121 | TTGAGACTAGAGAAAGGTGG | GAG | chr12 | 21587173 | 21587192 | 21587189 | + |

Figure 43 (Cont'd)

| | | | | | | | |
|---|---|---|---|---|---|---|---|
| SEQ ID NO 15122 | TGAGACTAGAGAAAGGTGGG | AGG | chr12 | 21587174 | 21587193 | 21587190 | + |
| SEQ ID NO 15123 | ACTAGAGAAAGGTGGGAGGA | TAG | chr12 | 21587178 | 21587197 | 21587194 | + |
| SEQ ID NO 15124 | CTAGAGAAAGGTGGGAGGAT | AGG | chr12 | 21587179 | 21587198 | 21587195 | + |
| SEQ ID NO 15125 | AGAGAAAGGTGGGAGGATAG | GAG | chr12 | 21587181 | 21587200 | 21587197 | + |
| SEQ ID NO 15126 | AAGGTGGGAGGATAGGAGTA | TGG | chr12 | 21587186 | 21587205 | 21587202 | + |
| SEQ ID NO 15127 | TGGGAGGATAGGAGTATGGT | GAG | chr12 | 21587190 | 21587209 | 21587206 | + |
| SEQ ID NO 15128 | GGGAGGATAGGAGTATGGTG | AGG | chr12 | 21587191 | 21587210 | 21587207 | + |
| SEQ ID NO 15129 | TGGTGAGGACTGAAAAACTA | CGG | chr12 | 21587206 | 21587225 | 21587222 | + |
| SEQ ID NO 15130 | AGGACTGAAAAACTACGGAT | TGG | chr12 | 21587211 | 21587230 | 21587227 | + |
| SEQ ID NO 15131 | TGGATACAACATTCACTTTT | CAG | chr12 | 21587231 | 21587250 | 21587247 | + |
| SEQ ID NO 15132 | GGATACAACATTCACTTTTC | AGG | chr12 | 21587232 | 21587251 | 21587248 | + |
| SEQ ID NO 15133 | AACATTCACTTTTCAGGTGA | TGG | chr12 | 21587238 | 21587257 | 21587254 | + |
| SEQ ID NO 15134 | TTCAGGTGATGGTCCACTAA | AAG | chr12 | 21587249 | 21587268 | 21587265 | + |
| SEQ ID NO 15135 | GTGATGGTCCACTAAAAGCT | CAG | chr12 | 21587254 | 21587273 | 21587270 | + |
| SEQ ID NO 15136 | ACTATGCAACATACATATGT | AAG | chr12 | 21587285 | 21587304 | 21587301 | + |
| SEQ ID NO 15137 | CTATGCAACATACATATGTA | AGG | chr12 | 21587286 | 21587305 | 21587302 | + |
| SEQ ID NO 15138 | CATACATATGTAAGGAACCC | GAG | chr12 | 21587294 | 21587313 | 21587310 | + |
| SEQ ID NO 15139 | CCCGAGCTTGTACCCTGATA | CAG | chr12 | 21587311 | 21587330 | 21587327 | + |
| SEQ ID NO 15140 | CCAAATCTCATCTTGAATTG | TAG | chr12 | 21587351 | 21587370 | 21587367 | + |
| SEQ ID NO 15141 | CCCATAATCCTCACGTGTTT | TGG | chr12 | 21587376 | 21587395 | 21587392 | + |
| SEQ ID NO 15142 | CCATAATCCTCACGTGTTGT | GGG | chr12 | 21587377 | 21587396 | 21587393 | + |
| SEQ ID NO 15143 | ATAATCCTCACGTGTTGTGG | GAG | chr12 | 21587379 | 21587398 | 21587395 | + |
| SEQ ID NO 15144 | TAATCCTCACGTGTTGTGGG | AGG | chr12 | 21587380 | 21587399 | 21587396 | + |
| SEQ ID NO 15145 | AATCCTCACGTGTTGTGGGA | GGG | chr12 | 21587381 | 21587400 | 21587397 | + |
| SEQ ID NO 15146 | CACGTGTTGTGGGAGGGATT | TGG | chr12 | 21587387 | 21587406 | 21587403 | + |
| SEQ ID NO 15147 | CGTGTTGTGGGAGGGATTTG | GAG | chr12 | 21587389 | 21587408 | 21587405 | + |
| SEQ ID NO 15148 | GTGTTGTGGGAGGGATTTGG | AGG | chr12 | 21587390 | 21587409 | 21587406 | + |
| SEQ ID NO 15149 | TGTTGTGGGAGGGATTTGGA | GGG | chr12 | 21587391 | 21587410 | 21587407 | + |
| SEQ ID NO 15150 | TTGTGGGAGGGATTTGGAGG | GAG | chr12 | 21587393 | 21587412 | 21587409 | + |
| SEQ ID NO 15151 | TGTGGGAGGGATTTGGAGGG | AGG | chr12 | 21587394 | 21587413 | 21587410 | + |
| SEQ ID NO 15152 | GGAGGGAGGTAATTGAATCA | TAG | chr12 | 21587408 | 21587427 | 21587424 | + |
| SEQ ID NO 15153 | AGGGAGGTAATTGAATCATA | GAG | chr12 | 21587410 | 21587429 | 21587426 | + |
| SEQ ID NO 15154 | GGGAGGTAATTGAATCATAG | AGG | chr12 | 21587411 | 21587430 | 21587427 | + |
| SEQ ID NO 15155 | GAGGTAATTGAATCATAGAG | GAG | chr12 | 21587413 | 21587432 | 21587429 | + |
| SEQ ID NO 15156 | AGGTAATTGAATCATAGAGG | AGG | chr12 | 21587414 | 21587433 | 21587430 | + |
| SEQ ID NO 15157 | CTCTCATGCTCTTCTCGTGA | TAG | chr12 | 21587440 | 21587459 | 21587456 | + |
| SEQ ID NO 15158 | CATGCTCTTCTCGTGATAGT | GAG | chr12 | 21587444 | 21587463 | 21587460 | + |
| SEQ ID NO 15159 | TCGTGATAGTGAGTTCTTAC | AAG | chr12 | 21587454 | 21587473 | 21587470 | + |
| SEQ ID NO 15160 | TGAGTTCTTACAAGATCTGA | TGG | chr12 | 21587463 | 21587482 | 21587479 | + |
| SEQ ID NO 15161 | ACAAGATCTGATGGTTTTAT | AAG | chr12 | 21587472 | 21587491 | 21587488 | + |
| SEQ ID NO 15162 | AGATCTGATGGTTTTATAAG | CGG | chr12 | 21587475 | 21587494 | 21587491 | + |
| SEQ ID NO 15163 | CGGCTTTTCCCCCTTTTGCT | TGG | chr12 | 21587495 | 21587514 | 21587511 | + |
| SEQ ID NO 15164 | CTACTTGCTGCTGCCATGTG | AAG | chr12 | 21587523 | 21587542 | 21587539 | + |
| SEQ ID NO 15165 | CTTGCTGCTGCCATGTGAAG | AAG | chr12 | 21587526 | 21587545 | 21587542 | + |
| SEQ ID NO 15166 | TTGCTGCTGCCATGTGAAGA | AGG | chr12 | 21587527 | 21587546 | 21587543 | + |
| SEQ ID NO 15167 | TCTTCTTCTGCCATGATTGT | AAG | chr12 | 21587561 | 21587580 | 21587577 | + |
| SEQ ID NO 15168 | GCCATGATTGTAAGTTTCCC | GAG | chr12 | 21587570 | 21587589 | 21587586 | + |

Figure 43 (Cont'd)

| | | | | | | | |
|---|---|---|---|---|---|---|---|
| SEQ ID NO 15169 | CCATGATTGTAAGTTTCCCG | AGG | chr12 | 21587571 | 21587590 | 21587587 | + |
| SEQ ID NO 15170 | TAAGTTTCCCGAGGCCTCCC | CAG | chr12 | 21587580 | 21587599 | 21587596 | + |
| SEQ ID NO 15171 | CCGAGGCCTCCCCAGCCCTG | TGG | chr12 | 21587588 | 21587607 | 21587604 | + |
| SEQ ID NO 15172 | CCCCAGCCCTGTGGAACTGT | GAG | chr12 | 21587597 | 21587616 | 21587613 | + |
| SEQ ID NO 15173 | TTTTTTCCTTATAAATTACC | CAG | chr12 | 21587631 | 21587650 | 21587647 | + |
| SEQ ID NO 15174 | CCTTATAAATTACCCAGTCT | CAG | chr12 | 21587637 | 21587656 | 21587653 | + |
| SEQ ID NO 15175 | CTTATAAATTACCCAGTCTC | AGG | chr12 | 21587638 | 21587657 | 21587654 | + |
| SEQ ID NO 15176 | AGTCTCAGGTATGTCTTTAT | AAG | chr12 | 21587652 | 21587671 | 21587668 | + |
| SEQ ID NO 15177 | CTCAGGTATGTCTTTATAAG | CAG | chr12 | 21587655 | 21587674 | 21587671 | + |
| SEQ ID NO 15178 | TAAGCAGCATGATAACGAAC | TAG | chr12 | 21587671 | 21587690 | 21587687 | + |
| SEQ ID NO 15179 | TTTAAAAATATAAAATAAAT | TAG | chr12 | 21587724 | 21587743 | 21587740 | + |
| SEQ ID NO 15180 | ATAAATTAGATCTGATTGAA | AAG | chr12 | 21587738 | 21587757 | 21587754 | + |
| SEQ ID NO 15181 | TAAATTAGATCTGATTGAAA | AGG | chr12 | 21587739 | 21587758 | 21587755 | + |
| SEQ ID NO 15182 | TGATTGAAAAGGCAAAAATT | GAG | chr12 | 21587750 | 21587769 | 21587766 | + |
| SEQ ID NO 15183 | TGAAAAGGCAAAAATTGAGC | AAG | chr12 | 21587754 | 21587773 | 21587770 | + |
| SEQ ID NO 15184 | GCAAGCAAAATATCACTTAA | TGG | chr12 | 21587772 | 21587791 | 21587788 | + |
| SEQ ID NO 15185 | CAAGCAAAATATCACTTAAT | GGG | chr12 | 21587773 | 21587792 | 21587789 | + |
| SEQ ID NO 15186 | AAGCAAAATATCACTTAATG | GGG | chr12 | 21587774 | 21587793 | 21587790 | + |
| SEQ ID NO 15187 | TCACTTAATGGGGTAATTAA | AAG | chr12 | 21587784 | 21587803 | 21587800 | + |
| SEQ ID NO 15188 | CACTTAATGGGGTAATTAAA | AGG | chr12 | 21587785 | 21587804 | 21587801 | + |
| SEQ ID NO 15189 | ACTTAATGGGGTAATTAAAA | GGG | chr12 | 21587786 | 21587805 | 21587802 | + |
| SEQ ID NO 15190 | ATGGGGTAATTAAAAGGGTG | AAG | chr12 | 21587791 | 21587810 | 21587807 | + |
| SEQ ID NO 15191 | AATTAAAAGGGTGAAGAAAT | TGG | chr12 | 21587798 | 21587817 | 21587814 | + |
| SEQ ID NO 15192 | ATTAAAAGGGTGAAGAAATT | GGG | chr12 | 21587799 | 21587818 | 21587815 | + |
| SEQ ID NO 15193 | GGGTGAAGAAATTGGGCAAA | TGG | chr12 | 21587806 | 21587825 | 21587822 | + |
| SEQ ID NO 15194 | ATTGGGCAAATGGATGTCAT | GAG | chr12 | 21587816 | 21587835 | 21587832 | + |
| SEQ ID NO 15195 | TTGGGCAAATGGATGTCATG | AGG | chr12 | 21587817 | 21587836 | 21587833 | + |
| SEQ ID NO 15196 | GGGCAAATGGATGTCATGAG | GAG | chr12 | 21587819 | 21587838 | 21587835 | + |
| SEQ ID NO 15197 | GGCAAATGGATGTCATGAGG | AGG | chr12 | 21587820 | 21587839 | 21587836 | + |
| SEQ ID NO 15198 | ATGTCATGAGGAGGAATTTT | TAG | chr12 | 21587829 | 21587848 | 21587845 | + |
| SEQ ID NO 15199 | TGTCATGAGGAGGAATTTTT | AGG | chr12 | 21587830 | 21587849 | 21587846 | + |
| SEQ ID NO 15200 | CATGAGGAGGAATTTTTAGG | CAG | chr12 | 21587833 | 21587852 | 21587849 | + |
| SEQ ID NO 15201 | TGAGGAGGAATTTTTAGGCA | GAG | chr12 | 21587835 | 21587854 | 21587851 | + |
| SEQ ID NO 15202 | GAGGAGGAATTTTTAGGCAG | AGG | chr12 | 21587836 | 21587855 | 21587852 | + |
| SEQ ID NO 15203 | GAATTTTTAGGCAGAGGTAA | TGG | chr12 | 21587842 | 21587861 | 21587858 | + |
| SEQ ID NO 15204 | TTTTAGGCAGAGGTAATGGT | CAG | chr12 | 21587846 | 21587865 | 21587862 | + |
| SEQ ID NO 15205 | TTAGGCAGAGGTAATGGTCA | GAG | chr12 | 21587848 | 21587867 | 21587864 | + |
| SEQ ID NO 15206 | CAGAGGTAATGGTCAGAGCC | CAG | chr12 | 21587853 | 21587872 | 21587869 | + |
| SEQ ID NO 15207 | AGAGGTAATGGTCAGAGCCC | AGG | chr12 | 21587854 | 21587873 | 21587870 | + |
| SEQ ID NO 15208 | ATGGTCAGAGCCCAGGCCCT | AAG | chr12 | 21587861 | 21587880 | 21587877 | + |
| SEQ ID NO 15209 | TCAGAGCCCAGGCCCTAAGC | TGG | chr12 | 21587865 | 21587884 | 21587881 | + |
| SEQ ID NO 15210 | AGAGCCCAGGCCCTAAGCTG | GAG | chr12 | 21587867 | 21587886 | 21587883 | + |
| SEQ ID NO 15211 | GCCCAGGCCCTAAGCTGGAG | TAG | chr12 | 21587870 | 21587889 | 21587886 | + |
| SEQ ID NO 15212 | CCAGGCCCTAAGCTGGAGTA | GAG | chr12 | 21587872 | 21587891 | 21587888 | + |
| SEQ ID NO 15213 | TAAGCTGGAGTAGAGTGTGC | AAG | chr12 | 21587880 | 21587899 | 21587896 | + |
| SEQ ID NO 15214 | AAGCTGGAGTAGAGTGTGCA | AGG | chr12 | 21587881 | 21587900 | 21587897 | + |
| SEQ ID NO 15215 | TGGAGTAGAGTGTGCAAGGA | AAG | chr12 | 21587885 | 21587904 | 21587901 | + |

Figure 43 (Cont'd)

| SEQ ID NO 15216 | GAGTAGAGTGTGCAAGGAAA | GAG | chr12 | 21587887 | 21587906 | 21587903 | + |
| SEQ ID NO 15217 | AGTGTGCAAGGAAAGAGTAA | TAG | chr12 | 21587893 | 21587912 | 21587909 | + |
| SEQ ID NO 15218 | GTGTGCAAGGAAAGAGTAAT | AGG | chr12 | 21587894 | 21587913 | 21587910 | + |
| SEQ ID NO 15219 | GAAAGAGTAATAGGATTGAA | AAG | chr12 | 21587903 | 21587922 | 21587919 | + |
| SEQ ID NO 15220 | AAAGAGTAATAGGATTGAAA | AGG | chr12 | 21587904 | 21587923 | 21587920 | + |
| SEQ ID NO 15221 | ATAGGATTGAAAAGGATAAC | CAG | chr12 | 21587912 | 21587931 | 21587928 | + |
| SEQ ID NO 15222 | TAGGATTGAAAAGGATAACC | AGG | chr12 | 21587913 | 21587932 | 21587929 | + |
| SEQ ID NO 15223 | GATTGAAAAGGATAACCAGG | TAG | chr12 | 21587916 | 21587935 | 21587932 | + |
| SEQ ID NO 15224 | ATTGAAAAGGATAACCAGGT | AGG | chr12 | 21587917 | 21587936 | 21587933 | + |
| SEQ ID NO 15225 | TGAAAAGGATAACCAGGTAG | GAG | chr12 | 21587919 | 21587938 | 21587935 | + |
| SEQ ID NO 15226 | GAAAAGGATAACCAGGTAGG | AGG | chr12 | 21587920 | 21587939 | 21587936 | + |
| SEQ ID NO 15227 | GATAACCAGGTAGGAGGACA | TAG | chr12 | 21587926 | 21587945 | 21587942 | + |
| SEQ ID NO 15228 | ATAACCAGGTAGGAGGACAT | AGG | chr12 | 21587927 | 21587946 | 21587943 | + |
| SEQ ID NO 15229 | TAACCAGGTAGGAGGACATA | GGG | chr12 | 21587928 | 21587947 | 21587944 | + |
| SEQ ID NO 15230 | ACCAGGTAGGAGGACATAGG | GAG | chr12 | 21587930 | 21587949 | 21587946 | + |
| SEQ ID NO 15231 | CCAGGTAGGAGGACATAGGG | AGG | chr12 | 21587931 | 21587950 | 21587947 | + |
| SEQ ID NO 15232 | CAGGTAGGAGGACATAGGGA | GGG | chr12 | 21587932 | 21587951 | 21587948 | + |
| SEQ ID NO 15233 | AGGTAGGAGGACATAGGGAG | GGG | chr12 | 21587933 | 21587952 | 21587949 | + |
| SEQ ID NO 15234 | AGGAGGACATAGGGAGGGGT | AAG | chr12 | 21587937 | 21587956 | 21587953 | + |
| SEQ ID NO 15235 | GGAGGACATAGGGAGGGGTA | AGG | chr12 | 21587938 | 21587957 | 21587954 | + |
| SEQ ID NO 15236 | GAGGACATAGGGAGGGGTAA | GGG | chr12 | 21587939 | 21587958 | 21587955 | + |
| SEQ ID NO 15237 | AGGACATAGGGAGGGGTAAG | GGG | chr12 | 21587940 | 21587959 | 21587956 | + |
| SEQ ID NO 15238 | GACATAGGGAGGGGTAAGGG | GAG | chr12 | 21587942 | 21587961 | 21587958 | + |
| SEQ ID NO 15239 | ACATAGGGAGGGGTAAGGGG | AGG | chr12 | 21587943 | 21587962 | 21587959 | + |
| SEQ ID NO 15240 | TAGGGAGGGGTAAGGGGAGG | AAG | chr12 | 21587946 | 21587965 | 21587962 | + |
| SEQ ID NO 15241 | GGTAAGGGGAGGAAGACCTC | CAG | chr12 | 21587954 | 21587973 | 21587970 | + |
| SEQ ID NO 15242 | AGGAAGACCTCCAGTAAACT | TAG | chr12 | 21587963 | 21587982 | 21587979 | + |
| SEQ ID NO 15243 | GGAAGACCTCCAGTAAACTT | AGG | chr12 | 21587964 | 21587983 | 21587980 | + |
| SEQ ID NO 15244 | AGACCTCCAGTAAACTTAGG | CAG | chr12 | 21587967 | 21587986 | 21587983 | + |
| SEQ ID NO 15245 | GACCTCCAGTAAACTTAGGC | AGG | chr12 | 21587968 | 21587987 | 21587984 | + |
| SEQ ID NO 15246 | AGGCAGGATATTTCCCGTGA | CAG | chr12 | 21587984 | 21588003 | 21588000 | + |
| SEQ ID NO 15247 | ACTAAATAATAATCACATGT | GAG | chr12 | 21588008 | 21588027 | 21588024 | + |
| SEQ ID NO 15248 | AAATAATCTGTCGATTACTT | GAG | chr12 | 21588038 | 21588057 | 21588054 | + |
| SEQ ID NO 15249 | TTGAGCAATACTTTGTTCAT | GAG | chr12 | 21588056 | 21588075 | 21588072 | + |
| SEQ ID NO 15250 | GCAATACTTTGTTCATGAGC | TAG | chr12 | 21588060 | 21588079 | 21588076 | + |
| SEQ ID NO 15251 | AATACTTTGTTCATGAGCTA | GAG | chr12 | 21588062 | 21588081 | 21588078 | + |
| SEQ ID NO 15252 | CTTTGTTCATGAGCTAGAGC | AAG | chr12 | 21588066 | 21588085 | 21588082 | + |
| SEQ ID NO 15253 | TTTGTTCATGAGCTAGAGCA | AGG | chr12 | 21588067 | 21588086 | 21588083 | + |
| SEQ ID NO 15254 | TTGTTCATGAGCTAGAGCAA | GGG | chr12 | 21588068 | 21588087 | 21588084 | + |
| SEQ ID NO 15255 | TGTTCATGAGCTAGAGCAAG | GGG | chr12 | 21588069 | 21588088 | 21588085 | + |
| SEQ ID NO 15256 | CTAGAGCAAGGGATGACTC | AAG | chr12 | 21588079 | 21588098 | 21588095 | + |
| SEQ ID NO 15257 | AGAAATCCTTTGTGAAATCC | TGG | chr12 | 21588100 | 21588119 | 21588116 | + |
| SEQ ID NO 15258 | AAATCCTTTGTGAAATCCTG | GAG | chr12 | 21588102 | 21588121 | 21588118 | + |
| SEQ ID NO 15259 | AATCCTTTGTGAAATCCTGG | AGG | chr12 | 21588103 | 21588122 | 21588119 | + |
| SEQ ID NO 15260 | TGTGAAATCCTGGAGGTAAT | AAG | chr12 | 21588110 | 21588129 | 21588126 | + |
| SEQ ID NO 15261 | TCCTGGAGGTAATAAGATCC | TGG | chr12 | 21588117 | 21588136 | 21588133 | + |
| SEQ ID NO 15262 | ATCTTCAACTCAATTGCAAA | AAG | chr12 | 21588145 | 21588164 | 21588161 | + |

Figure 43 (Cont'd)

| | | | | | | | |
|---|---|---|---|---|---|---|---|
| SEQ ID NO 15263 | CAAAACATATTCCATTTCAT | CAG | chr12 | 21588215 | 21588234 | 21588231 | + |
| SEQ ID NO 15264 | TATTCCATTTCATCAGACTA | CAG | chr12 | 21588222 | 21588241 | 21588238 | + |
| SEQ ID NO 15265 | ATTCCATTTCATCAGACTAC | AGG | chr12 | 21588223 | 21588242 | 21588239 | + |
| SEQ ID NO 15266 | CATCAGACTACAGGTTTTAA | TAG | chr12 | 21588232 | 21588251 | 21588248 | + |
| SEQ ID NO 15267 | ATTTCTTAAATGTATTATTC | CAG | chr12 | 21588262 | 21588281 | 21588278 | + |
| SEQ ID NO 15268 | CCAGTAACTTATACTTTACA | TAG | chr12 | 21588281 | 21588300 | 21588297 | + |
| SEQ ID NO 15269 | TACATAGTAAATCTTATCAA | TAG | chr12 | 21588297 | 21588316 | 21588313 | + |
| SEQ ID NO 15270 | TTATCAATAGTCACAATCAA | TGG | chr12 | 21588310 | 21588329 | 21588326 | + |
| SEQ ID NO 15271 | AGTCACAATCAATGGTCACA | AAG | chr12 | 21588318 | 21588337 | 21588334 | + |
| SEQ ID NO 15272 | CACAATCAATGGTCACAAAG | TAG | chr12 | 21588321 | 21588340 | 21588337 | + |
| SEQ ID NO 15273 | TCACAAAGTAGAACTTCATC | TGG | chr12 | 21588333 | 21588352 | 21588349 | + |
| SEQ ID NO 15274 | ACAAAGTAGAACTTCATCTG | GAG | chr12 | 21588335 | 21588354 | 21588351 | + |
| SEQ ID NO 15275 | TCATCTGGAGACATTACTTT | TAG | chr12 | 21588348 | 21588367 | 21588364 | + |
| SEQ ID NO 15276 | GGAGACATTACTTTTAGCCT | GAG | chr12 | 21588354 | 21588373 | 21588370 | + |
| SEQ ID NO 15277 | GCCATGCAAAATATACTTTT | TGG | chr12 | 21588376 | 21588395 | 21588392 | + |
| SEQ ID NO 15278 | TTTGGAAAATTGCCCTTTGA | AAG | chr12 | 21588394 | 21588413 | 21588410 | + |
| SEQ ID NO 15279 | TTGGAAAATTGCCCTTTGAA | AGG | chr12 | 21588395 | 21588414 | 21588411 | + |
| SEQ ID NO 15280 | AAAATTGCCCTTTGAAAGGC | GAG | chr12 | 21588399 | 21588418 | 21588415 | + |
| SEQ ID NO 15281 | CTTTGAAAGGCGAGACACAA | AAG | chr12 | 21588408 | 21588427 | 21588424 | + |
| SEQ ID NO 15282 | TTTGAAAGGCGAGACACAAA | AGG | chr12 | 21588409 | 21588428 | 21588425 | + |
| SEQ ID NO 15283 | CAAATGTTGATGCTATTATA | TGG | chr12 | 21588432 | 21588451 | 21588448 | + |
| SEQ ID NO 15284 | ATGCTATTATATGGTACCAA | TAG | chr12 | 21588441 | 21588460 | 21588457 | + |
| SEQ ID NO 15285 | TGCTATTATATGGTACCAAT | AGG | chr12 | 21588442 | 21588461 | 21588458 | + |
| SEQ ID NO 15286 | ATAGGATTCATTAATTTATA | AAG | chr12 | 21588460 | 21588479 | 21588476 | + |
| SEQ ID NO 15287 | TAGGATTCATTAATTTATAA | AGG | chr12 | 21588461 | 21588480 | 21588477 | + |
| SEQ ID NO 15288 | GGATTCATTAATTTATAAAG | GAG | chr12 | 21588463 | 21588482 | 21588479 | + |
| SEQ ID NO 15289 | TTCATTAATTTATAAAGGAG | AAG | chr12 | 21588466 | 21588485 | 21588482 | + |
| SEQ ID NO 15290 | CATTAATTTATAAAGGAGAA | GAG | chr12 | 21588468 | 21588487 | 21588484 | + |
| SEQ ID NO 15291 | CTAATGTAACTCCAAAATGC | AAG | chr12 | 21588491 | 21588510 | 21588507 | + |
| SEQ ID NO 15292 | AATGCAAGCAATTTTCATAT | GAG | chr12 | 21588506 | 21588525 | 21588522 | + |
| SEQ ID NO 15293 | ATTTTCATATGAGTCTACAC | AAG | chr12 | 21588516 | 21588535 | 21588532 | + |
| SEQ ID NO 15294 | TACACAAGCTAATTGTCCTT | AAG | chr12 | 21588531 | 21588550 | 21588547 | + |
| SEQ ID NO 15295 | TCCTTAAGAATTTCATCTTT | AAG | chr12 | 21588546 | 21588565 | 21588562 | + |
| SEQ ID NO 15296 | CCTTAAGAATTTCATCTTTA | AGG | chr12 | 21588547 | 21588566 | 21588563 | + |
| SEQ ID NO 15297 | AGAATTTCATCTTTAAGGAA | AAG | chr12 | 21588552 | 21588571 | 21588568 | + |
| SEQ ID NO 15298 | AAGTTTTTACTGTATCAAA | AAG | chr12 | 21588572 | 21588591 | 21588588 | + |
| SEQ ID NO 15299 | TTTTTACTGTATCAAAAAG | AAG | chr12 | 21588575 | 21588594 | 21588591 | + |
| SEQ ID NO 15300 | AAGAAGTTTAAACTGTCATT | GAG | chr12 | 21588592 | 21588611 | 21588608 | + |
| SEQ ID NO 15301 | AAGTTTAAACTGTCATTGAG | CAG | chr12 | 21588595 | 21588614 | 21588611 | + |
| SEQ ID NO 15302 | GTTTAAACTGTCATTGAGCA | GAG | chr12 | 21588597 | 21588616 | 21588613 | + |
| SEQ ID NO 15303 | ATTGAGCAGAGTCTGATAAT | AAG | chr12 | 21588609 | 21588628 | 21588625 | + |
| SEQ ID NO 15304 | TTGAGCAGAGTCTGATAATA | AGG | chr12 | 21588610 | 21588629 | 21588626 | + |
| SEQ ID NO 15305 | ATAAGGACACTGTCAAATCA | CAG | chr12 | 21588627 | 21588646 | 21588643 | + |
| SEQ ID NO 15306 | GACACTGTCAAATCACAGTT | CAG | chr12 | 21588632 | 21588651 | 21588648 | + |
| SEQ ID NO 15307 | CAGTTCAGATGTTATGTGAT | GAG | chr12 | 21588647 | 21588666 | 21588663 | + |
| SEQ ID NO 15308 | AGTTCAGATGTTATGTGATG | AGG | chr12 | 21588648 | 21588667 | 21588664 | + |
| SEQ ID NO 15309 | CAGATGTTATGTGATGAGGA | CAG | chr12 | 21588652 | 21588671 | 21588668 | + |

Figure 43 (Cont'd)

| | | | | | | | |
|---|---|---|---|---|---|---|---|
| SEQ ID NO 15310 | GTTATGTGATGAGGACAGAA | TAG | chr12 | 21588657 | 21588676 | 21588673 | + |
| SEQ ID NO 15311 | GAGGACAGAATAGAACACAT | GAG | chr12 | 21588667 | 21588686 | 21588683 | + |
| SEQ ID NO 15312 | AGGACAGAATAGAACACATG | AGG | chr12 | 21588668 | 21588687 | 21588684 | + |
| SEQ ID NO 15313 | GACAGAATAGAACACATGAG | GAG | chr12 | 21588670 | 21588689 | 21588686 | + |
| SEQ ID NO 15314 | ACAGAATAGAACACATGAGG | AGG | chr12 | 21588671 | 21588690 | 21588687 | + |
| SEQ ID NO 15315 | GAATAGAACACATGAGGAGG | AAG | chr12 | 21588674 | 21588693 | 21588690 | + |
| SEQ ID NO 15316 | TAGAACACATGAGGAGGAAG | CAG | chr12 | 21588677 | 21588696 | 21588693 | + |
| SEQ ID NO 15317 | GAGGAGGAAGCAGAAACTTC | TAG | chr12 | 21588687 | 21588706 | 21588703 | + |
| SEQ ID NO 15318 | GGAAGCAGAAACTTCTAGAC | TGG | chr12 | 21588692 | 21588711 | 21588708 | + |
| SEQ ID NO 15319 | CAGAAACTTCTAGACTGGAC | AAG | chr12 | 21588697 | 21588716 | 21588713 | + |
| SEQ ID NO 15320 | ACTTCTAGACTGGACAAGAA | CAG | chr12 | 21588702 | 21588721 | 21588718 | + |
| SEQ ID NO 15321 | AACCATCCAACAATAAATCT | AAG | chr12 | 21588738 | 21588757 | 21588754 | + |
| SEQ ID NO 15322 | TGATGTCATCTACTACATCT | AAG | chr12 | 21588772 | 21588791 | 21588788 | + |
| SEQ ID NO 15323 | CTAAGTATTTCCTCAAATTC | TGG | chr12 | 21588790 | 21588809 | 21588806 | + |
| SEQ ID NO 15324 | CCTCAAATTCTGGACAATTT | TAG | chr12 | 21588800 | 21588819 | 21588816 | + |
| SEQ ID NO 15325 | AACCATCAAAATTATTTGTT | GAG | chr12 | 21588824 | 21588843 | 21588840 | + |
| SEQ ID NO 15326 | ACCATCAAAATTATTTGTTG | AGG | chr12 | 21588825 | 21588844 | 21588841 | + |
| SEQ ID NO 15327 | TTGTTGAGGAAAAATAAACT | TAG | chr12 | 21588839 | 21588858 | 21588855 | + |
| SEQ ID NO 15328 | AATAAACTTAGCCAATTTGC | AAG | chr12 | 21588851 | 21588870 | 21588867 | + |
| SEQ ID NO 15329 | ATAAACTTAGCCAATTTGCA | AGG | chr12 | 21588852 | 21588871 | 21588868 | + |
| SEQ ID NO 15330 | TAAACTTAGCCAATTTGCAA | GGG | chr12 | 21588853 | 21588872 | 21588869 | + |
| SEQ ID NO 15331 | TTGCAAGGGCAACTAAAATG | AAG | chr12 | 21588867 | 21588886 | 21588883 | + |
| SEQ ID NO 15332 | AAATGAAGAACTTTTCTTTA | AAG | chr12 | 21588882 | 21588901 | 21588898 | + |
| SEQ ID NO 15333 | AAGAACTTTTCTTTAAAGTG | TGG | chr12 | 21588887 | 21588906 | 21588903 | + |
| SEQ ID NO 15334 | AGAACTTTTCTTTAAAGTGT | GGG | chr12 | 21588888 | 21588907 | 21588904 | + |
| SEQ ID NO 15335 | AACTTTTCTTTAAAGTGTGG | GAG | chr12 | 21588890 | 21588909 | 21588906 | + |
| SEQ ID NO 15336 | AAAGTGTGGGAGTCACATCT | TAG | chr12 | 21588901 | 21588920 | 21588917 | + |
| SEQ ID NO 15337 | CAACATATTTAAATATATCT | AAG | chr12 | 21588924 | 21588943 | 21588940 | + |
| SEQ ID NO 15338 | ACAAAAATGCAAAATTTCCA | AAG | chr12 | 21588968 | 21588987 | 21588984 | + |
| SEQ ID NO 15339 | AAAGAATTTCTCCTCTTCTG | TAG | chr12 | 21588987 | 21589006 | 21589003 | + |
| SEQ ID NO 15340 | TTCTTCATCTTCATCTTTTC | CAG | chr12 | 21589017 | 21589036 | 21589033 | + |
| SEQ ID NO 15341 | TCTTCATCTTCATCTTTTCC | AGG | chr12 | 21589018 | 21589037 | 21589034 | + |
| SEQ ID NO 15342 | TTCATCTTCATCTTTTCCAG | GAG | chr12 | 21589020 | 21589039 | 21589036 | + |
| SEQ ID NO 15343 | TTTCCAGGAGAATATACCAT | AAG | chr12 | 21589033 | 21589052 | 21589049 | + |
| SEQ ID NO 15344 | AATATACCATAAGTTTCTGA | TGG | chr12 | 21589043 | 21589062 | 21589059 | + |
| SEQ ID NO 15345 | TTCTGATGGTACACATTTAT | TAG | chr12 | 21589057 | 21589076 | 21589073 | + |
| SEQ ID NO 15346 | TTGCAACTATGCATCTTACT | CAG | chr12 | 21589121 | 21589140 | 21589137 | + |
| SEQ ID NO 15347 | GCAACTATGCATCTTACTCA | GAG | chr12 | 21589123 | 21589142 | 21589139 | + |
| SEQ ID NO 15348 | CTTAAAACATCCTTGTTTGT | TAG | chr12 | 21589148 | 21589167 | 21589164 | + |
| SEQ ID NO 15349 | TTTCAAATTCATATACACTT | TGG | chr12 | 21589179 | 21589198 | 21589195 | + |
| SEQ ID NO 15350 | CAAATTCATATACACTTTGG | TAG | chr12 | 21589182 | 21589201 | 21589198 | + |
| SEQ ID NO 15351 | GCAAACATTTTTATTTGCTG | AAG | chr12 | 21589207 | 21589226 | 21589223 | + |
| SEQ ID NO 15352 | TTTTATTTGCTGAAGAACAT | AAG | chr12 | 21589215 | 21589234 | 21589231 | + |
| SEQ ID NO 15353 | TTTATTTGCTGAAGAACATA | AGG | chr12 | 21589216 | 21589235 | 21589232 | + |
| SEQ ID NO 15354 | TTATTTGCTGAAGAACATAA | GGG | chr12 | 21589217 | 21589236 | 21589233 | + |
| SEQ ID NO 15355 | TATTTGCTGAAGAACATAAG | GGG | chr12 | 21589218 | 21589237 | 21589234 | + |
| SEQ ID NO 15356 | ATTTGCTGAAGAACATAAGG | GGG | chr12 | 21589219 | 21589238 | 21589235 | + |

Figure 43 (Cont'd)

| | | | | | | | |
|---|---|---|---|---|---|---|---|
| SEQ ID NO 15357 | TGAAGAACATAAGGGGGAAA | TAG | chr12 | 21589225 | 21589244 | 21589241 | + |
| SEQ ID NO 15358 | AAGAACATAAGGGGGAAATA | GAG | chr12 | 21589227 | 21589246 | 21589243 | + |
| SEQ ID NO 15359 | AAATAGAGATTCTTTATTTG | AAG | chr12 | 21589242 | 21589261 | 21589258 | + |
| SEQ ID NO 15360 | AAGAAACAAATGATTTGATT | TGG | chr12 | 21589262 | 21589281 | 21589278 | + |
| SEQ ID NO 15361 | AGAAACAAATGATTTGATTT | GGG | chr12 | 21589263 | 21589282 | 21589279 | + |
| SEQ ID NO 15362 | GATTTGGGAAATGAAATGAA | AAG | chr12 | 21589278 | 21589297 | 21589294 | + |
| SEQ ID NO 15363 | ATGAAATGAAAAGAAAAACA | TAG | chr12 | 21589288 | 21589307 | 21589304 | + |
| SEQ ID NO 15364 | GCTACTTCTTTTACTCATCT | GAG | chr12 | 21589322 | 21589341 | 21589338 | + |
| SEQ ID NO 15365 | CTACTTCTTTTACTCATCTG | AGG | chr12 | 21589323 | 21589342 | 21589339 | + |
| SEQ ID NO 15366 | TTTTACTCATCTGAGGCCTT | CAG | chr12 | 21589330 | 21589349 | 21589346 | + |
| SEQ ID NO 15367 | ACTCATCTGAGGCCTTCAGA | TAG | chr12 | 21589334 | 21589353 | 21589350 | + |
| SEQ ID NO 15368 | CCTTCAGATAGTCCCCCATA | TAG | chr12 | 21589346 | 21589365 | 21589362 | + |
| SEQ ID NO 15369 | GATAGTCCCCCATATAGCCT | TAG | chr12 | 21589352 | 21589371 | 21589368 | + |
| SEQ ID NO 15370 | TAGTCCCCCATATAGCCTTA | GAG | chr12 | 21589354 | 21589373 | 21589370 | + |
| SEQ ID NO 15371 | AAAATATGATTATGCTCTTT | CAG | chr12 | 21589382 | 21589401 | 21589398 | + |
| SEQ ID NO 15372 | ATTATGCTCTTTCAGTCTAT | TAG | chr12 | 21589390 | 21589409 | 21589406 | + |
| SEQ ID NO 15373 | CTATTAGAAATAAAAACATA | AAG | chr12 | 21589406 | 21589425 | 21589422 | + |
| SEQ ID NO 15374 | CATAAAGCTTAAAAAATTTC | AAG | chr12 | 21589422 | 21589441 | 21589438 | + |
| SEQ ID NO 15375 | ATAAAGCTTAAAAAATTTCA | AGG | chr12 | 21589423 | 21589442 | 21589439 | + |
| SEQ ID NO 15376 | TAAAGCTTAAAAAATTTCAA | GGG | chr12 | 21589424 | 21589443 | 21589440 | + |
| SEQ ID NO 15377 | AGCTTAAAAAATTTCAAGGG | AAG | chr12 | 21589427 | 21589446 | 21589443 | + |
| SEQ ID NO 15378 | GCTTAAAAAATTTCAAGGGA | AGG | chr12 | 21589428 | 21589447 | 21589444 | + |
| SEQ ID NO 15379 | CTTAAAAAATTTCAAGGGAA | GGG | chr12 | 21589429 | 21589448 | 21589445 | + |
| SEQ ID NO 15380 | TTAAAAAATTTCAAGGGAAG | GGG | chr12 | 21589430 | 21589449 | 21589446 | + |
| SEQ ID NO 15381 | ATTTCAAGGGAAGGGGCTTG | AAG | chr12 | 21589437 | 21589456 | 21589453 | + |
| SEQ ID NO 15382 | GGGCTTGAAGATTACTGACT | AAG | chr12 | 21589450 | 21589469 | 21589466 | + |
| SEQ ID NO 15383 | GGCTTGAAGATTACTGACTA | AGG | chr12 | 21589451 | 21589470 | 21589467 | + |
| SEQ ID NO 15384 | GCTTGAAGATTACTGACTAA | GGG | chr12 | 21589452 | 21589471 | 21589468 | + |
| SEQ ID NO 15385 | TGAAGATTACTGACTAAGGG | CAG | chr12 | 21589455 | 21589474 | 21589471 | + |
| SEQ ID NO 15386 | TGACACTCACCTCCTCCACA | AAG | chr12 | 21589479 | 21589498 | 21589495 | + |
| SEQ ID NO 15387 | TCCTCCACAAAGAACCAAAA | TAG | chr12 | 21589490 | 21589509 | 21589506 | + |
| SEQ ID NO 15388 | CCACAAAGAACCAAAATAGT | AAG | chr12 | 21589494 | 21589513 | 21589510 | + |
| SEQ ID NO 15389 | CAAAGAACCAAAATAGTAAG | TAG | chr12 | 21589497 | 21589516 | 21589513 | + |
| SEQ ID NO 15390 | GTAAGTAGAAAATCCCACAT | AAG | chr12 | 21589512 | 21589531 | 21589528 | + |
| SEQ ID NO 15391 | AAGTAGAAAATCCCACATAA | GAG | chr12 | 21589514 | 21589533 | 21589530 | + |
| SEQ ID NO 15392 | GTAGAAAATCCCACATAAGA | GAG | chr12 | 21589516 | 21589535 | 21589532 | + |
| SEQ ID NO 15393 | TCCCACATAAGAGAGAATTC | TGG | chr12 | 21589524 | 21589543 | 21589540 | + |
| SEQ ID NO 15394 | GAGAGAATTCTGGAATTCAA | CAG | chr12 | 21589534 | 21589553 | 21589550 | + |
| SEQ ID NO 15395 | GAGAATTCTGGAATTCAACA | GAG | chr12 | 21589536 | 21589555 | 21589552 | + |
| SEQ ID NO 15396 | AATTCTGGAATTCAACAGAG | AAG | chr12 | 21589539 | 21589558 | 21589555 | + |
| SEQ ID NO 15397 | GGAATTCAACAGAGAAGTGA | CAG | chr12 | 21589545 | 21589564 | 21589561 | + |
| SEQ ID NO 15398 | GAATTCAACAGAGAAGTGAC | AGG | chr12 | 21589546 | 21589565 | 21589562 | + |
| SEQ ID NO 15399 | TTCAACAGAGAAGTGACAGG | AAG | chr12 | 21589549 | 21589568 | 21589565 | + |
| SEQ ID NO 15400 | AGAAGTGACAGGAAGCATCT | AAG | chr12 | 21589557 | 21589576 | 21589573 | + |
| SEQ ID NO 15401 | GAAGTGACAGGAAGCATCTA | AGG | chr12 | 21589558 | 21589577 | 21589574 | + |
| SEQ ID NO 15402 | AGGAAGCATCTAAGGCAATG | AAG | chr12 | 21589566 | 21589585 | 21589582 | + |
| SEQ ID NO 15403 | GGAAGCATCTAAGGCAATGA | AGG | chr12 | 21589567 | 21589586 | 21589583 | + |

Figure 43 (Cont'd)

| | | | | | | | |
|---|---|---|---|---|---|---|---|
| SEQ ID NO 15404 | GAAGCATCTAAGGCAATGAA | GGG | chr12 | 21589568 | 21589587 | 21589584 | + |
| SEQ ID NO 15405 | AAGCATCTAAGGCAATGAAG | GGG | chr12 | 21589569 | 21589588 | 21589585 | + |
| SEQ ID NO 15406 | GCATCTAAGGCAATGAAGGG | GAG | chr12 | 21589571 | 21589590 | 21589587 | + |
| SEQ ID NO 15407 | CATCTAAGGCAATGAAGGGG | AGG | chr12 | 21589572 | 21589591 | 21589588 | + |
| SEQ ID NO 15408 | ATCTAAGGCAATGAAGGGGA | GGG | chr12 | 21589573 | 21589592 | 21589589 | + |
| SEQ ID NO 15409 | TAAGGCAATGAAGGGGAGGG | AAG | chr12 | 21589576 | 21589595 | 21589592 | + |
| SEQ ID NO 15410 | GCAATGAAGGGGAGGGAAGC | AAG | chr12 | 21589580 | 21589599 | 21589596 | + |
| SEQ ID NO 15411 | CAATGAAGGGGAGGGAAGCA | AGG | chr12 | 21589581 | 21589600 | 21589597 | + |
| SEQ ID NO 15412 | TGAAGGGGAGGGAAGCAAGG | AAG | chr12 | 21589584 | 21589603 | 21589600 | + |
| SEQ ID NO 15413 | GGGAAGCAAGGAAGCCTACC | CAG | chr12 | 21589593 | 21589612 | 21589609 | + |
| SEQ ID NO 15414 | AAGCAAGGAAGCCTACCCAG | TAG | chr12 | 21589596 | 21589615 | 21589612 | + |
| SEQ ID NO 15415 | AGCAAGGAAGCCTACCCAGT | AGG | chr12 | 21589597 | 21589616 | 21589613 | + |
| SEQ ID NO 15416 | GCAAGGAAGCCTACCCAGTA | GGG | chr12 | 21589598 | 21589617 | 21589614 | + |
| SEQ ID NO 15417 | ACCCAGTAGGGATCCTCTGT | GAG | chr12 | 21589610 | 21589629 | 21589626 | + |
| SEQ ID NO 15418 | CCCAGTAGGGATCCTCTGTG | AGG | chr12 | 21589611 | 21589630 | 21589627 | + |
| SEQ ID NO 15419 | GTAGGGATCCTCTGTGAGGC | CAG | chr12 | 21589615 | 21589634 | 21589631 | + |
| SEQ ID NO 15420 | AGGGATCCTCTGTGAGGCCA | GAG | chr12 | 21589617 | 21589636 | 21589633 | + |
| SEQ ID NO 15421 | GGATCCTCTGTGAGGCCAGA | GAG | chr12 | 21589619 | 21589638 | 21589635 | + |
| SEQ ID NO 15422 | GATCCTCTGTGAGGCCAGAG | AGG | chr12 | 21589620 | 21589639 | 21589636 | + |
| SEQ ID NO 15423 | GTGAGGCCAGAGAGGCTCCC | CAG | chr12 | 21589628 | 21589647 | 21589644 | + |
| SEQ ID NO 15424 | GAGGCTCCCCAGTGCATCGA | AAG | chr12 | 21589639 | 21589658 | 21589655 | + |
| SEQ ID NO 15425 | TCCCCAGTGCATCGAAAGTT | AAG | chr12 | 21589644 | 21589663 | 21589660 | + |
| SEQ ID NO 15426 | AAAGTTAAGTGACTGACTCC | CAG | chr12 | 21589658 | 21589677 | 21589674 | + |
| SEQ ID NO 15427 | GTTAAGTGACTGACTCCCAG | TGG | chr12 | 21589661 | 21589680 | 21589677 | + |
| SEQ ID NO 15428 | AGTGGTCCACATCTGCATTA | TGG | chr12 | 21589679 | 21589698 | 21589695 | + |
| SEQ ID NO 15429 | CACATCTGCATTATGGACTC | CAG | chr12 | 21589686 | 21589705 | 21589702 | + |
| SEQ ID NO 15430 | ACATCTGCATTATGGACTCC | AGG | chr12 | 21589687 | 21589706 | 21589703 | + |
| SEQ ID NO 15431 | ATTATGGACTCCAGGAATCC | TAG | chr12 | 21589695 | 21589714 | 21589711 | + |
| SEQ ID NO 15432 | GACTCCAGGAATCCTAGCCA | CAG | chr12 | 21589701 | 21589720 | 21589717 | + |
| SEQ ID NO 15433 | ACTCCAGGAATCCTAGCCAC | AGG | chr12 | 21589702 | 21589721 | 21589718 | + |
| SEQ ID NO 15434 | TCCAGGAATCCTAGCCACAG | GAG | chr12 | 21589704 | 21589723 | 21589720 | + |
| SEQ ID NO 15435 | CAGGAATCCTAGCCACAGGA | GAG | chr12 | 21589706 | 21589725 | 21589722 | + |
| SEQ ID NO 15436 | AGGAGAGTCCCTTGACCATG | CAG | chr12 | 21589722 | 21589741 | 21589738 | + |
| SEQ ID NO 15437 | GGAGAGTCCCTTGACCATGC | AGG | chr12 | 21589723 | 21589742 | 21589739 | + |
| SEQ ID NO 15438 | CCCTTGACCATGCAGGCCTT | GAG | chr12 | 21589730 | 21589749 | 21589746 | + |
| SEQ ID NO 15439 | GCAGGCCTTGAGACTATCAT | AAG | chr12 | 21589741 | 21589760 | 21589757 | + |
| SEQ ID NO 15440 | CAGGCCTTGAGACTATCATA | AGG | chr12 | 21589742 | 21589761 | 21589758 | + |
| SEQ ID NO 15441 | GACTATCATAAGGAACTGCC | CAG | chr12 | 21589752 | 21589771 | 21589768 | + |
| SEQ ID NO 15442 | AACTGCCCAGCAATCGCACA | AAG | chr12 | 21589765 | 21589784 | 21589781 | + |
| SEQ ID NO 15443 | ACTGCCCAGCAATCGCACAA | AGG | chr12 | 21589766 | 21589785 | 21589782 | + |
| SEQ ID NO 15444 | ATCGCACAAAGGCATTGCTC | CAG | chr12 | 21589777 | 21589796 | 21589793 | + |
| SEQ ID NO 15445 | CGCACAAAGGCATTGCTCCA | GAG | chr12 | 21589779 | 21589798 | 21589795 | + |
| SEQ ID NO 15446 | ACAAAGGCATTGCTCCAGAG | AAG | chr12 | 21589782 | 21589801 | 21589798 | + |
| SEQ ID NO 15447 | CAAAGGCATTGCTCCAGAGA | AGG | chr12 | 21589783 | 21589802 | 21589799 | + |
| SEQ ID NO 15448 | AAGGCATTGCTCCAGAGAAG | GAG | chr12 | 21589785 | 21589804 | 21589801 | + |
| SEQ ID NO 15449 | TCCAGAGAAGGAGCTCTCAC | TGG | chr12 | 21589795 | 21589814 | 21589811 | + |
| SEQ ID NO 15450 | CCAGAGAAGGAGCTCTCACT | GGG | chr12 | 21589796 | 21589815 | 21589812 | + |

Figure 43 (Cont'd)

| | | | | | | | |
|---|---|---|---|---|---|---|---|
| SEQ ID NO 15451 | CCCCTGCCATCCCCATTACT | GAG | chr12 | 21589824 | 21589843 | 21589840 | + |
| SEQ ID NO 15452 | CTGCCATCCCCATTACTGAG | CAG | chr12 | 21589827 | 21589846 | 21589843 | + |
| SEQ ID NO 15453 | CATCCCCATTACTGAGCAGC | AAG | chr12 | 21589831 | 21589850 | 21589847 | + |
| SEQ ID NO 15454 | ATCCCCATTACTGAGCAGCA | AGG | chr12 | 21589832 | 21589851 | 21589848 | + |
| SEQ ID NO 15455 | GAGCAGCAAGGTGCCATTTT | GAG | chr12 | 21589844 | 21589863 | 21589860 | + |
| SEQ ID NO 15456 | GCAGCAAGGTGCCATTTTGA | GAG | chr12 | 21589846 | 21589865 | 21589862 | + |
| SEQ ID NO 15457 | TTTGAGAGCCCAACACCCAC | CAG | chr12 | 21589861 | 21589880 | 21589877 | + |
| SEQ ID NO 15458 | CACCAGATGACATCGTTCCT | CAG | chr12 | 21589878 | 21589897 | 21589894 | + |
| SEQ ID NO 15459 | TCTGCATCTCTACATCCCTG | AAG | chr12 | 21589913 | 21589932 | 21589929 | + |
| SEQ ID NO 15460 | CTGCTGACATCCCCACCCA | CAG | chr12 | 21589938 | 21589957 | 21589954 | + |
| SEQ ID NO 15461 | GACATCCCCACCCACAGCT | GAG | chr12 | 21589943 | 21589962 | 21589959 | + |
| SEQ ID NO 15462 | CCACAGCTGAGTGCTACTGC | TGG | chr12 | 21589955 | 21589974 | 21589971 | + |
| SEQ ID NO 15463 | CTACTGCTGGCTGCTGTCAC | CAG | chr12 | 21589968 | 21589987 | 21589984 | + |
| SEQ ID NO 15464 | TACTGCTGGCTGCTGTCACC | AGG | chr12 | 21589969 | 21589988 | 21589985 | + |
| SEQ ID NO 15465 | ACTGCTGGCTGCTGTCACCA | GGG | chr12 | 21589970 | 21589989 | 21589986 | + |
| SEQ ID NO 15466 | GGCTGCTGTCACCAGGGATA | AAG | chr12 | 21589976 | 21589995 | 21589992 | + |
| SEQ ID NO 15467 | CCAGGGATAAAGTGTGTCAT | TAG | chr12 | 21589987 | 21590006 | 21590003 | + |
| SEQ ID NO 15468 | GGGATAAAGTGTGTCATTAG | AAG | chr12 | 21589990 | 21590009 | 21590006 | + |
| SEQ ID NO 15469 | ATAAAGTGTGTCATTAGAAG | TGG | chr12 | 21589993 | 21590012 | 21590009 | + |
| SEQ ID NO 15470 | GAAGTGGACTCCCCCACCCC | CAG | chr12 | 21590009 | 21590028 | 21590025 | + |
| SEQ ID NO 15471 | GTGGACTCCCCCACCCCCAG | TAG | chr12 | 21590012 | 21590031 | 21590028 | + |
| SEQ ID NO 15472 | GACTCCCCCACCCCCAGTAG | CAG | chr12 | 21590015 | 21590034 | 21590031 | + |
| SEQ ID NO 15473 | ACTCCCCCACCCCCAGTAGC | AGG | chr12 | 21590016 | 21590035 | 21590032 | + |
| SEQ ID NO 15474 | CTCCCCCACCCCCAGTAGCA | GGG | chr12 | 21590017 | 21590036 | 21590033 | + |
| SEQ ID NO 15475 | CAGGGCTGCTACACATTTAT | AAG | chr12 | 21590035 | 21590054 | 21590051 | + |
| SEQ ID NO 15476 | TACACATTTATAAGCTCCCT | AAG | chr12 | 21590044 | 21590063 | 21590060 | + |
| SEQ ID NO 15477 | AGAAAATGCTACCCCACTTG | CAG | chr12 | 21590065 | 21590084 | 21590081 | + |
| SEQ ID NO 15478 | CCCCACTTGCAGCCACCATC | TGG | chr12 | 21590076 | 21590095 | 21590092 | + |
| SEQ ID NO 15479 | CCCACTTGCAGCCACCATCT | GGG | chr12 | 21590077 | 21590096 | 21590093 | + |
| SEQ ID NO 15480 | CCACTTGCAGCCACCATCTG | GGG | chr12 | 21590078 | 21590097 | 21590094 | + |
| SEQ ID NO 15481 | GGGCTGAAACACATGCCCAC | CAG | chr12 | 21590098 | 21590117 | 21590114 | + |
| SEQ ID NO 15482 | GCCCACCAGCAACCCATTTA | TAG | chr12 | 21590112 | 21590131 | 21590128 | + |
| SEQ ID NO 15483 | TTTATAGCTGCTGCCACTGA | AAG | chr12 | 21590128 | 21590147 | 21590144 | + |
| SEQ ID NO 15484 | AACACACCCCGCACCCCTTC | AAG | chr12 | 21590152 | 21590171 | 21590168 | + |
| SEQ ID NO 15485 | CACACCCCGCACCCCTTCAA | GAG | chr12 | 21590154 | 21590173 | 21590170 | + |
| SEQ ID NO 15486 | ACCCCGCACCCCTTCAAGAG | CAG | chr12 | 21590157 | 21590176 | 21590173 | + |
| SEQ ID NO 15487 | CCCCGCACCCCTTCAAGAGC | AGG | chr12 | 21590158 | 21590177 | 21590174 | + |
| SEQ ID NO 15488 | CCCGCACCCCTTCAAGAGCA | GGG | chr12 | 21590159 | 21590178 | 21590175 | + |
| SEQ ID NO 15489 | TCAAGAGCAGGGCAACAATG | CAG | chr12 | 21590170 | 21590189 | 21590186 | + |
| SEQ ID NO 15490 | AGAGCAGGGCAACAATGCAG | TAG | chr12 | 21590173 | 21590192 | 21590189 | + |
| SEQ ID NO 15491 | GCAGTAGCTGCTAATTCACT | CAG | chr12 | 21590189 | 21590208 | 21590205 | + |
| SEQ ID NO 15492 | CAGTAGCTGCTAATTCACTC | AGG | chr12 | 21590190 | 21590209 | 21590206 | + |
| SEQ ID NO 15493 | AATTCACTCAGGCATTCTGC | TGG | chr12 | 21590201 | 21590220 | 21590217 | + |
| SEQ ID NO 15494 | ATTCACTCAGGCATTCTGCT | GGG | chr12 | 21590202 | 21590221 | 21590218 | + |
| SEQ ID NO 15495 | TTCACTCAGGCATTCTGCTG | GGG | chr12 | 21590203 | 21590222 | 21590219 | + |
| SEQ ID NO 15496 | TCACTCAGGCATTCTGCTGG | GGG | chr12 | 21590204 | 21590223 | 21590220 | + |
| SEQ ID NO 15497 | AGGCATTCTGCTGGGGGCCT | GAG | chr12 | 21590210 | 21590229 | 21590226 | + |

Figure 43 (Cont'd)

| | | | | | | | |
|---|---|---|---|---|---|---|---|
| SEQ ID NO 15498 | GGCATTCTGCTGGGGGCCTG | AGG | chr12 | 21590211 | 21590230 | 21590227 | + |
| SEQ ID NO 15499 | GCCTGAGGATCACTCCACTC | CAG | chr12 | 21590226 | 21590245 | 21590242 | + |
| SEQ ID NO 15500 | CACTCCACTCCAGCCTATGA | TAG | chr12 | 21590236 | 21590255 | 21590252 | + |
| SEQ ID NO 15501 | CCACTCCAGCCTATGATAGC | CGG | chr12 | 21590240 | 21590259 | 21590256 | + |
| SEQ ID NO 15502 | CGGTGTCCACACACACCACT | GAG | chr12 | 21590260 | 21590279 | 21590276 | + |
| SEQ ID NO 15503 | TGTCCACACACCACTGAG | TGG | chr12 | 21590263 | 21590282 | 21590279 | + |
| SEQ ID NO 15504 | CACACACCACTGAGTGGCCT | GAG | chr12 | 21590269 | 21590288 | 21590285 | + |
| SEQ ID NO 15505 | ACACACCACTGAGTGGCCTG | AGG | chr12 | 21590270 | 21590289 | 21590286 | + |
| SEQ ID NO 15506 | ACCACTGAGTGGCCTGAGGT | CAG | chr12 | 21590274 | 21590293 | 21590290 | + |
| SEQ ID NO 15507 | CCACTGAGTGGCCTGAGGTC | AGG | chr12 | 21590275 | 21590294 | 21590291 | + |
| SEQ ID NO 15508 | GGCCTGAGGTCAGGAACACC | CAG | chr12 | 21590284 | 21590303 | 21590300 | + |
| SEQ ID NO 15509 | GAGGTCAGGAACACCCAGCC | TGG | chr12 | 21590289 | 21590308 | 21590305 | + |
| SEQ ID NO 15510 | CTTTGCCTTCCTCAATGCCT | AAG | chr12 | 21590312 | 21590331 | 21590328 | + |
| SEQ ID NO 15511 | GCCTTCCTCAATGCCTAAGC | AAG | chr12 | 21590316 | 21590335 | 21590332 | + |
| SEQ ID NO 15512 | CAATGCCTAAGCAAGTTGTC | TGG | chr12 | 21590324 | 21590343 | 21590340 | + |
| SEQ ID NO 15513 | AATGCCTAAGCAAGTTGTCT | GGG | chr12 | 21590325 | 21590344 | 21590341 | + |
| SEQ ID NO 15514 | AAGCAAGTTGTCTGGGAACC | CAG | chr12 | 21590332 | 21590351 | 21590348 | + |
| SEQ ID NO 15515 | GCAAGTTGTCTGGGAACCCA | GAG | chr12 | 21590334 | 21590353 | 21590350 | + |
| SEQ ID NO 15516 | GTTGTCTGGGAACCCAGAGA | CAG | chr12 | 21590338 | 21590357 | 21590354 | + |
| SEQ ID NO 15517 | CTTGTGCCATCCACCATGAC | TGG | chr12 | 21590362 | 21590381 | 21590378 | + |
| SEQ ID NO 15518 | ATCCACCATGACTGGTACCT | AAG | chr12 | 21590370 | 21590389 | 21590386 | + |
| SEQ ID NO 15519 | TGGTACCTAAGCAACCCTCC | CAG | chr12 | 21590382 | 21590401 | 21590398 | + |
| SEQ ID NO 15520 | TACCTAAGCAACCCTCCCAG | AAG | chr12 | 21590385 | 21590404 | 21590401 | + |
| SEQ ID NO 15521 | CCCTCCCAGAAGCCTGATGA | TGG | chr12 | 21590396 | 21590415 | 21590412 | + |
| SEQ ID NO 15522 | CCTCCCAGAAGCCTGATGAT | GGG | chr12 | 21590397 | 21590416 | 21590413 | + |
| SEQ ID NO 15523 | TCTGCCACTGCCATCACAAC | TGG | chr12 | 21590429 | 21590448 | 21590445 | + |
| SEQ ID NO 15524 | CCTCCTGCATGTGCCACCTG | TGG | chr12 | 21590454 | 21590473 | 21590470 | + |
| SEQ ID NO 15525 | CTCCTGCATGTGCCACCTGT | GGG | chr12 | 21590455 | 21590474 | 21590471 | + |
| SEQ ID NO 15526 | ATGTGCCACCTGTGGGTCTG | AAG | chr12 | 21590462 | 21590481 | 21590478 | + |
| SEQ ID NO 15527 | CCACCTGTGGGTCTGAAGAC | TGG | chr12 | 21590467 | 21590486 | 21590483 | + |
| SEQ ID NO 15528 | GGTCTGAAGACTGGCTCATT | CAG | chr12 | 21590476 | 21590495 | 21590492 | + |
| SEQ ID NO 15529 | ACTGGCTCATTCAGCCCTTG | CAG | chr12 | 21590485 | 21590504 | 21590501 | + |
| SEQ ID NO 15530 | CTTGCAGCCACCACCAACAC | CAG | chr12 | 21590501 | 21590520 | 21590517 | + |
| SEQ ID NO 15531 | AGCCACCACCAACACCAGTG | CAG | chr12 | 21590506 | 21590525 | 21590522 | + |
| SEQ ID NO 15532 | CAACACCAGTGCAGACTGCT | TGG | chr12 | 21590515 | 21590534 | 21590531 | + |
| SEQ ID NO 15533 | AACACCAGTGCAGACTGCTT | GGG | chr12 | 21590516 | 21590535 | 21590532 | + |
| SEQ ID NO 15534 | CACCAGTGCAGACTGCTTGG | GAG | chr12 | 21590518 | 21590537 | 21590534 | + |
| SEQ ID NO 15535 | AGTGCAGACTGCTTGGGAGC | CAG | chr12 | 21590522 | 21590541 | 21590538 | + |
| SEQ ID NO 15536 | TGCAGACTGCTTGGGAGCCA | GAG | chr12 | 21590524 | 21590543 | 21590540 | + |
| SEQ ID NO 15537 | GCAGACTGCTTGGGAGCCAG | AGG | chr12 | 21590525 | 21590544 | 21590541 | + |
| SEQ ID NO 15538 | CAGACTGCTTGGGAGCCAGA | GGG | chr12 | 21590526 | 21590545 | 21590542 | + |
| SEQ ID NO 15539 | GGAGCCAGAGGGTTGTCCTG | CAG | chr12 | 21590537 | 21590556 | 21590553 | + |
| SEQ ID NO 15540 | GGGTTGTCCTGCAGTTGCTA | CAG | chr12 | 21590546 | 21590565 | 21590562 | + |
| SEQ ID NO 15541 | CCCACACCACACCCACTGTC | CAG | chr12 | 21590575 | 21590594 | 21590591 | + |
| SEQ ID NO 15542 | ACACCACACCCACTGTCCAG | AAG | chr12 | 21590578 | 21590597 | 21590594 | + |
| SEQ ID NO 15543 | CACCCACTGTCCAGAAGCCT | GAG | chr12 | 21590584 | 21590603 | 21590600 | + |
| SEQ ID NO 15544 | ACCCACTGTCCAGAAGCCTG | AGG | chr12 | 21590585 | 21590604 | 21590601 | + |

Figure 43 (Cont'd)

| | | | | | | | |
|---|---|---|---|---|---|---|---|
| SEQ ID NO 15545 | AAGCCTGAGGACCCACACAC | CAG | chr12 | 21590598 | 21590617 | 21590614 | + |
| SEQ ID NO 15546 | TGAGGACCCACACACCAGCC | CAG | chr12 | 21590603 | 21590622 | 21590619 | + |
| SEQ ID NO 15547 | CACACCAGCCAGTCTACTA | TGG | chr12 | 21590613 | 21590632 | 21590629 | + |
| SEQ ID NO 15548 | TATGGCCACTACTGACACCC | AAG | chr12 | 21590631 | 21590650 | 21590647 | + |
| SEQ ID NO 15549 | ACACCAAGCAAACTGCCTG | AAG | chr12 | 21590645 | 21590664 | 21590661 | + |
| SEQ ID NO 15550 | CACCCAAGCAAACTGCCTGA | AGG | chr12 | 21590646 | 21590665 | 21590662 | + |
| SEQ ID NO 15551 | AGCAAACTGCCTGAAGGCCA | AAG | chr12 | 21590652 | 21590671 | 21590668 | + |
| SEQ ID NO 15552 | GGCCAAAGAATCAACCCAAC | TAG | chr12 | 21590667 | 21590686 | 21590683 | + |
| SEQ ID NO 15553 | CCAACTAGACTCATTACCAT | CAG | chr12 | 21590682 | 21590701 | 21590698 | + |
| SEQ ID NO 15554 | ACCATCAGTGCCAATGTACA | CAG | chr12 | 21590697 | 21590716 | 21590713 | + |
| SEQ ID NO 15555 | AGTGCCAATGTACACAGCCA | TGG | chr12 | 21590703 | 21590722 | 21590719 | + |
| SEQ ID NO 15556 | GTGCCAATGTACACAGCCAT | GGG | chr12 | 21590704 | 21590723 | 21590720 | + |
| SEQ ID NO 15557 | TGCCAATGTACACAGCCATG | GGG | chr12 | 21590705 | 21590724 | 21590721 | + |
| SEQ ID NO 15558 | TGTACACAGCCATGGGGCCC | AAG | chr12 | 21590711 | 21590730 | 21590727 | + |
| SEQ ID NO 15559 | GTACACAGCCATGGGGCCCA | AGG | chr12 | 21590712 | 21590731 | 21590728 | + |
| SEQ ID NO 15560 | ACAGCCATGGGGCCCAAGGA | CAG | chr12 | 21590716 | 21590735 | 21590732 | + |
| SEQ ID NO 15561 | CAGCCATGGGGCCCAAGGAC | AGG | chr12 | 21590717 | 21590736 | 21590733 | + |
| SEQ ID NO 15562 | GGGCCCAAGGACAGGAATGC | TAG | chr12 | 21590725 | 21590744 | 21590741 | + |
| SEQ ID NO 15563 | GGCCCAAGGACAGGAATGCT | AGG | chr12 | 21590726 | 21590745 | 21590742 | + |
| SEQ ID NO 15564 | GCTAGGCCCACCACCACCAC | TGG | chr12 | 21590743 | 21590762 | 21590759 | + |
| SEQ ID NO 15565 | CTAGGCCCACCACCACCACT | GGG | chr12 | 21590744 | 21590763 | 21590760 | + |
| SEQ ID NO 15566 | TAGGCCCACCACCACCACTG | GGG | chr12 | 21590745 | 21590764 | 21590761 | + |
| SEQ ID NO 15567 | CCACCACCACCACTGGGGCC | AAG | chr12 | 21590750 | 21590769 | 21590766 | + |
| SEQ ID NO 15568 | CACCACCACCACTGGGGCCA | AGG | chr12 | 21590751 | 21590770 | 21590767 | + |
| SEQ ID NO 15569 | CCACCACTGGGGCCAAGGAC | TGG | chr12 | 21590756 | 21590775 | 21590772 | + |
| SEQ ID NO 15570 | CCACTTGATATTCTTGTCTC | CAG | chr12 | 21590780 | 21590799 | 21590796 | + |
| SEQ ID NO 15571 | TTCACTAACAAATGCACCCT | AAG | chr12 | 21590821 | 21590840 | 21590837 | + |
| SEQ ID NO 15572 | CTAAGCCACTGAAAAAATCA | CAG | chr12 | 21590839 | 21590858 | 21590855 | + |
| SEQ ID NO 15573 | ACAGACACTGATGATACTGT | TGG | chr12 | 21590858 | 21590877 | 21590874 | + |
| SEQ ID NO 15574 | GACACTGATGATACTGTTGG | CAG | chr12 | 21590861 | 21590880 | 21590877 | + |
| SEQ ID NO 15575 | AGCTGAAAAAAATAATATG | AAG | chr12 | 21590882 | 21590901 | 21590898 | + |
| SEQ ID NO 15576 | ACTATGCTGCTGTATGCACC | TAG | chr12 | 21590905 | 21590924 | 21590921 | + |
| SEQ ID NO 15577 | GCACCTAGAAATCAAAATCA | AAG | chr12 | 21590920 | 21590939 | 21590936 | + |
| SEQ ID NO 15578 | TGCCCTACTCAATCAACACC | AAG | chr12 | 21590943 | 21590962 | 21590959 | + |
| SEQ ID NO 15579 | TCAACACCAAGATACATCTT | CAG | chr12 | 21590955 | 21590974 | 21590971 | + |
| SEQ ID NO 15580 | CAAGATACATCTTCAGAAAA | AAG | chr12 | 21590962 | 21590981 | 21590978 | + |
| SEQ ID NO 15581 | CAAAAACAAATTTACAAAAC | TGG | chr12 | 21590995 | 21591014 | 21591011 | + |
| SEQ ID NO 15582 | AAACAAATTTACAAAACTGG | AAG | chr12 | 21590998 | 21591017 | 21591014 | + |
| SEQ ID NO 15583 | CAAATTTACAAAACTGGAAG | CAG | chr12 | 21591001 | 21591020 | 21591017 | + |
| SEQ ID NO 15584 | GGAAGCAGCAATCATTACAC | CAG | chr12 | 21591016 | 21591035 | 21591032 | + |
| SEQ ID NO 15585 | AGCAATCATTACACCAGATG | CAG | chr12 | 21591022 | 21591041 | 21591038 | + |
| SEQ ID NO 15586 | CAATCATTACACCAGATGCA | GAG | chr12 | 21591024 | 21591043 | 21591040 | + |
| SEQ ID NO 15587 | AGATGCAGAGATATCAATGC | AAG | chr12 | 21591037 | 21591056 | 21591053 | + |
| SEQ ID NO 15588 | AAGAACAAAATAAACATAAA | AAG | chr12 | 21591057 | 21591076 | 21591073 | + |
| SEQ ID NO 15589 | AGAACAAAATAAACATAAAA | AGG | chr12 | 21591058 | 21591077 | 21591074 | + |
| SEQ ID NO 15590 | AAAATAAACATAAAAGGTG | AAG | chr12 | 21591063 | 21591082 | 21591079 | + |
| SEQ ID NO 15591 | GAAGAAATATGACACTTCCA | AAG | chr12 | 21591082 | 21591101 | 21591098 | + |

Figure 43 (Cont'd)

| | | | | | | | |
|---|---|---|---|---|---|---|---|
| SEQ ID NO 15592 | AAGAAATATGACACTTCCAA | AGG | chr12 | 21591083 | 21591102 | 21591099 | + |
| SEQ ID NO 15593 | AAAGGAATTTAATAATTCTT | CAG | chr12 | 21591101 | 21591120 | 21591117 | + |
| SEQ ID NO 15594 | TAATAATTCTTCAGCAACAT | AAG | chr12 | 21591110 | 21591129 | 21591126 | + |
| SEQ ID NO 15595 | AATTCTTCAGCAACATAAGC | CAG | chr12 | 21591114 | 21591133 | 21591130 | + |
| SEQ ID NO 15596 | TCTTCAGCAACATAAGCCAG | TGG | chr12 | 21591117 | 21591136 | 21591133 | + |
| SEQ ID NO 15597 | ACATAAGCCAGTGGAAAAAA | AAG | chr12 | 21591126 | 21591145 | 21591142 | + |
| SEQ ID NO 15598 | AAAAGACATTTATAAAATTC | TGG | chr12 | 21591144 | 21591163 | 21591160 | + |
| SEQ ID NO 15599 | ATTTATAAAATTCTGGAAAA | AAG | chr12 | 21591151 | 21591170 | 21591167 | + |
| SEQ ID NO 15600 | GAATCCAAAATGTTGATATT | AAG | chr12 | 21591173 | 21591192 | 21591189 | + |
| SEQ ID NO 15601 | AATCCAAAATGTTGATATTA | AGG | chr12 | 21591174 | 21591193 | 21591190 | + |
| SEQ ID NO 15602 | CCAAAATGTTGATATTAAGG | AAG | chr12 | 21591177 | 21591196 | 21591193 | + |
| SEQ ID NO 15603 | ATGTTGATATTAAGGAAGCT | CAG | chr12 | 21591182 | 21591201 | 21591198 | + |
| SEQ ID NO 15604 | TGATATTAAGGAAGCTCAGT | GAG | chr12 | 21591186 | 21591205 | 21591202 | + |
| SEQ ID NO 15605 | AAGGAAGCTCAGTGAGACAC | AAG | chr12 | 21591193 | 21591212 | 21591209 | + |
| SEQ ID NO 15606 | GGAAGCTCAGTGAGACACAA | GAG | chr12 | 21591195 | 21591214 | 21591211 | + |
| SEQ ID NO 15607 | CAGTGAGACACAAGAGAACT | CAG | chr12 | 21591202 | 21591221 | 21591218 | + |
| SEQ ID NO 15608 | GAACTCAGATAAACAATAAA | AAG | chr12 | 21591217 | 21591236 | 21591233 | + |
| SEQ ID NO 15609 | GATAAACAATAAAAGAAAT | CAG | chr12 | 21591224 | 21591243 | 21591240 | + |
| SEQ ID NO 15610 | AAGAAATCAGAAAACAATT | CAG | chr12 | 21591237 | 21591256 | 21591253 | + |
| SEQ ID NO 15611 | AGAAATCAGAAAACAATTC | AGG | chr12 | 21591238 | 21591257 | 21591254 | + |
| SEQ ID NO 15612 | AAACAATTCAGGATATGAAT | GAG | chr12 | 21591249 | 21591268 | 21591265 | + |
| SEQ ID NO 15613 | TATGAATGAGAAATTTACCC | AAG | chr12 | 21591262 | 21591281 | 21591278 | + |
| SEQ ID NO 15614 | TGAATGAGAAATTTACCCAA | GAG | chr12 | 21591264 | 21591283 | 21591280 | + |
| SEQ ID NO 15615 | TGAGAAATTTACCCAAGAGA | TAG | chr12 | 21591268 | 21591287 | 21591284 | + |
| SEQ ID NO 15616 | ACCCAAGAGATAGATACAAC | AAG | chr12 | 21591278 | 21591297 | 21591294 | + |
| SEQ ID NO 15617 | TACAACAAGAATGAACCAAA | CAG | chr12 | 21591292 | 21591311 | 21591308 | + |
| SEQ ID NO 15618 | AAACAGAAATTCTGTAACTG | AAG | chr12 | 21591309 | 21591328 | 21591325 | + |
| SEQ ID NO 15619 | ACAGAAATTCTGTAACTGAA | GAG | chr12 | 21591311 | 21591330 | 21591327 | + |
| SEQ ID NO 15620 | GTAACTGAAGAGTTTATTGA | AAG | chr12 | 21591322 | 21591341 | 21591338 | + |
| SEQ ID NO 15621 | ACATTCAAAAACTTCAACAA | TAG | chr12 | 21591356 | 21591375 | 21591372 | + |
| SEQ ID NO 15622 | CAAAAACTTCAACAATAGAT | CAG | chr12 | 21591361 | 21591380 | 21591377 | + |
| SEQ ID NO 15623 | CTTCAACAATAGATCAGATC | AAG | chr12 | 21591367 | 21591386 | 21591383 | + |
| SEQ ID NO 15624 | CAACAATAGATCAGATCAAG | CAG | chr12 | 21591370 | 21591389 | 21591386 | + |
| SEQ ID NO 15625 | CAATAGATCAGATCAAGCAG | AAG | chr12 | 21591373 | 21591392 | 21591389 | + |
| SEQ ID NO 15626 | ATCAAGCAGAAGAAAAATTT | CAG | chr12 | 21591384 | 21591403 | 21591400 | + |
| SEQ ID NO 15627 | AAGAAAAATTTCAGAACTTG | AAG | chr12 | 21591393 | 21591412 | 21591409 | + |
| SEQ ID NO 15628 | AAAATTTCAGAACTTGAAGA | CAG | chr12 | 21591397 | 21591416 | 21591413 | + |
| SEQ ID NO 15629 | AAATTTCAGAACTTGAAGAC | AGG | chr12 | 21591398 | 21591417 | 21591414 | + |
| SEQ ID NO 15630 | GAAGACAGGTCTTTTAAAAT | TAG | chr12 | 21591412 | 21591431 | 21591428 | + |
| SEQ ID NO 15631 | ACAGGTCTTTTAAAATTAGC | TGG | chr12 | 21591416 | 21591435 | 21591432 | + |
| SEQ ID NO 15632 | AAAATTAGCTGGTCAAATGA | TAG | chr12 | 21591427 | 21591446 | 21591443 | + |
| SEQ ID NO 15633 | TTAGCTGGTCAAATGATAGA | AAG | chr12 | 21591431 | 21591450 | 21591447 | + |
| SEQ ID NO 15634 | TAGCTGGTCAAATGATAGAA | AGG | chr12 | 21591432 | 21591451 | 21591448 | + |
| SEQ ID NO 15635 | AATGATAGAAAGGAAAAAAA | AAG | chr12 | 21591442 | 21591461 | 21591458 | + |
| SEQ ID NO 15636 | GGAAAAAAAAGAATGAACA | AAG | chr12 | 21591453 | 21591472 | 21591469 | + |
| SEQ ID NO 15637 | ACAAAGTGTATGTGACATAT | GAG | chr12 | 21591470 | 21591489 | 21591486 | + |
| SEQ ID NO 15638 | CAAAGTGTATGTGACATATG | AGG | chr12 | 21591471 | 21591490 | 21591487 | + |

Figure 43 (Cont'd)

| | | | | | | | |
|---|---|---|---|---|---|---|---|
| SEQ ID NO 15639 | GTGACATATGAGGCACTATA | AAG | chr12 | 21591481 | 21591500 | 21591497 | + |
| SEQ ID NO 15640 | TGAACAAATATTCAAATTTG | CAG | chr12 | 21591504 | 21591523 | 21591520 | + |
| SEQ ID NO 15641 | TATTCAAATTTGCAGTTTCC | CAG | chr12 | 21591512 | 21591531 | 21591528 | + |
| SEQ ID NO 15642 | TCAAATTTGCAGTTTCCCAG | AAG | chr12 | 21591515 | 21591534 | 21591531 | + |
| SEQ ID NO 15643 | CAAATTTGCAGTTTCCCAGA | AGG | chr12 | 21591516 | 21591535 | 21591532 | + |
| SEQ ID NO 15644 | TTGCAGTTTCCCAGAAGGTA | AAG | chr12 | 21591521 | 21591540 | 21591537 | + |
| SEQ ID NO 15645 | GCAGTTTCCCAGAAGGTAAA | GAG | chr12 | 21591523 | 21591542 | 21591539 | + |
| SEQ ID NO 15646 | AGAAGGTAAAGAGAACATGA | AAG | chr12 | 21591533 | 21591552 | 21591549 | + |
| SEQ ID NO 15647 | GAAGGTAAAGAGAACATGAA | AGG | chr12 | 21591534 | 21591553 | 21591550 | + |
| SEQ ID NO 15648 | TAAAGAGAACATGAAAGGTG | TAG | chr12 | 21591539 | 21591558 | 21591555 | + |
| SEQ ID NO 15649 | AAAGAGAACATGAAAGGTGT | AGG | chr12 | 21591540 | 21591559 | 21591556 | + |
| SEQ ID NO 15650 | AAACCTACGTAACAACACAA | TAG | chr12 | 21591563 | 21591582 | 21591579 | + |
| SEQ ID NO 15651 | ACAATAGCTGAAAACTTGTC | AAG | chr12 | 21591579 | 21591598 | 21591595 | + |
| SEQ ID NO 15652 | AGCTGAAAACTTGTCAAGTC | TAG | chr12 | 21591584 | 21591603 | 21591600 | + |
| SEQ ID NO 15653 | GAAAACTTGTCAAGTCTAGC | AAG | chr12 | 21591588 | 21591607 | 21591604 | + |
| SEQ ID NO 15654 | GTCAAGTCTAGCAAGAAATG | TAG | chr12 | 21591596 | 21591615 | 21591612 | + |
| SEQ ID NO 15655 | TAGCAAGAAATGTAGACATC | CAG | chr12 | 21591604 | 21591623 | 21591620 | + |
| SEQ ID NO 15656 | ACATCCAGACAAATGAAAAT | CAG | chr12 | 21591619 | 21591638 | 21591635 | + |
| SEQ ID NO 15657 | CCCAAATAATATAATGCAAA | AAG | chr12 | 21591647 | 21591666 | 21591663 | + |
| SEQ ID NO 15658 | ATGCAAAAGCTCTTCTCCA | CAG | chr12 | 21591660 | 21591679 | 21591676 | + |
| SEQ ID NO 15659 | CTCTTCTCCACAGCACATTA | TAG | chr12 | 21591670 | 21591689 | 21591686 | + |
| SEQ ID NO 15660 | CATTATAGTCAAACTGTCAA | AAG | chr12 | 21591685 | 21591704 | 21591701 | + |
| SEQ ID NO 15661 | AGTCAAACTGTCAAAAGCCA | AAG | chr12 | 21591691 | 21591710 | 21591707 | + |
| SEQ ID NO 15662 | TCAAACTGTCAAAAGCCAAA | GAG | chr12 | 21591693 | 21591712 | 21591709 | + |
| SEQ ID NO 15663 | ACTGTCAAAAGCCAAAGAGT | AAG | chr12 | 21591697 | 21591716 | 21591713 | + |
| SEQ ID NO 15664 | AAAGAGTAAGAACTCTAAAA | CAG | chr12 | 21591710 | 21591729 | 21591726 | + |
| SEQ ID NO 15665 | AGTAAGAACTCTAAAACAGC | AAG | chr12 | 21591714 | 21591733 | 21591730 | + |
| SEQ ID NO 15666 | AAAACAGCAAGCAAAATGTC | TAG | chr12 | 21591726 | 21591745 | 21591742 | + |
| SEQ ID NO 15667 | CAAAATGTCTAGTCACTTAT | AAG | chr12 | 21591737 | 21591756 | 21591753 | + |
| SEQ ID NO 15668 | AAAATGTCTAGTCACTTATA | AGG | chr12 | 21591738 | 21591757 | 21591754 | + |
| SEQ ID NO 15669 | AAATGTCTAGTCACTTATAA | GGG | chr12 | 21591739 | 21591758 | 21591755 | + |
| SEQ ID NO 15670 | ACTTATAAGGGAACTTCCAC | AAG | chr12 | 21591751 | 21591770 | 21591767 | + |
| SEQ ID NO 15671 | GGGAACTTCCACAAGATTAA | CAG | chr12 | 21591759 | 21591778 | 21591775 | + |
| SEQ ID NO 15672 | CCACAAGATTAACAGATTAA | CAG | chr12 | 21591767 | 21591786 | 21591783 | + |
| SEQ ID NO 15673 | CAAGATTAACAGATTAACAG | CAG | chr12 | 21591770 | 21591789 | 21591786 | + |
| SEQ ID NO 15674 | CAGATTAACAGCAGATTTCT | CAG | chr12 | 21591779 | 21591798 | 21591795 | + |
| SEQ ID NO 15675 | ATTAACAGCAGATTTCTCAG | CAG | chr12 | 21591782 | 21591801 | 21591798 | + |
| SEQ ID NO 15676 | ATTTCTCAGCAGAAACCTCA | CAG | chr12 | 21591793 | 21591812 | 21591809 | + |
| SEQ ID NO 15677 | TTTCTCAGCAGAAACCTCAC | AGG | chr12 | 21591794 | 21591813 | 21591810 | + |
| SEQ ID NO 15678 | TCAGCAGAAACCTCACAGGC | CAG | chr12 | 21591798 | 21591817 | 21591814 | + |
| SEQ ID NO 15679 | CAGCAGAAACCTCACAGGCC | AGG | chr12 | 21591799 | 21591818 | 21591815 | + |
| SEQ ID NO 15680 | GCAGAAACCTCACAGGCCAG | GAG | chr12 | 21591801 | 21591820 | 21591817 | + |
| SEQ ID NO 15681 | GAAACCTCACAGGCCAGGAG | AAG | chr12 | 21591804 | 21591823 | 21591820 | + |
| SEQ ID NO 15682 | CCTCACAGGCCAGGAGAAGA | TGG | chr12 | 21591808 | 21591827 | 21591824 | + |
| SEQ ID NO 15683 | CTCACAGGCCAGGAGAAGAT | GGG | chr12 | 21591809 | 21591828 | 21591825 | + |
| SEQ ID NO 15684 | ATGGGATGATATATTCAAAA | TAG | chr12 | 21591827 | 21591846 | 21591843 | + |
| SEQ ID NO 15685 | TGATATATTCAAAATAGTGA | AAG | chr12 | 21591833 | 21591852 | 21591849 | + |

Figure 43 (Cont'd)

| | | | | | | | |
|---|---|---|---|---|---|---|---|
| SEQ ID NO 15686 | TGAAAGAAAAAAATGACACC | AAG | chr12 | 21591850 | 21591869 | 21591866 | + |
| SEQ ID NO 15687 | GAAAGAAAAAAATGACACCA | AGG | chr12 | 21591851 | 21591870 | 21591867 | + |
| SEQ ID NO 15688 | GACACCAAGGATGTTATACC | CAG | chr12 | 21591864 | 21591883 | 21591880 | + |
| SEQ ID NO 15689 | AACATTGTTCTTCAAAAATG | AAG | chr12 | 21591888 | 21591907 | 21591904 | + |
| SEQ ID NO 15690 | ACATTGTTCTTCAAAAATGA | AGG | chr12 | 21591889 | 21591908 | 21591905 | + |
| SEQ ID NO 15691 | AGGATAAATAAAATCTTTTC | TGG | chr12 | 21591909 | 21591928 | 21591925 | + |
| SEQ ID NO 15692 | GGATAAATAAAATCTTTTCT | GGG | chr12 | 21591910 | 21591929 | 21591926 | + |
| SEQ ID NO 15693 | AAATAAAATCTTTTCTGGGC | AAG | chr12 | 21591914 | 21591933 | 21591930 | + |
| SEQ ID NO 15694 | TTCTGGGCAAGAAAAATTTG | AAG | chr12 | 21591926 | 21591945 | 21591942 | + |
| SEQ ID NO 15695 | TCTGGGCAAGAAAAATTTGA | AGG | chr12 | 21591927 | 21591946 | 21591943 | + |
| SEQ ID NO 15696 | TTGAAGGAATTCACTATCAC | TAG | chr12 | 21591943 | 21591962 | 21591959 | + |
| SEQ ID NO 15697 | GGAATTCACTATCACTAGAC | TGG | chr12 | 21591948 | 21591967 | 21591964 | + |
| SEQ ID NO 15698 | TATCACTAGACTGGCTTTAC | AAG | chr12 | 21591957 | 21591976 | 21591973 | + |
| SEQ ID NO 15699 | TGGCTTTACAAGAAATATTT | AAG | chr12 | 21591968 | 21591987 | 21591984 | + |
| SEQ ID NO 15700 | GGCTTTACAAGAAATATTTA | AGG | chr12 | 21591969 | 21591988 | 21591985 | + |
| SEQ ID NO 15701 | GCTTTACAAGAAATATTTAA | GGG | chr12 | 21591970 | 21591989 | 21591986 | + |
| SEQ ID NO 15702 | TTTACAAGAAATATTTAAGG | GAG | chr12 | 21591972 | 21591991 | 21591988 | + |
| SEQ ID NO 15703 | TAAGGGAGTCCTACACATGA | AAG | chr12 | 21591987 | 21592006 | 21592003 | + |
| SEQ ID NO 15704 | AGTCCTACACATGAAAGTGA | CAG | chr12 | 21591993 | 21592012 | 21592009 | + |
| SEQ ID NO 15705 | GTCCTACACATGAAAGTGAC | AGG | chr12 | 21591994 | 21592013 | 21592010 | + |
| SEQ ID NO 15706 | GACAGGACACTGCCATTATG | AAG | chr12 | 21592011 | 21592030 | 21592027 | + |
| SEQ ID NO 15707 | TGCCATTATGAAGACACACA | AAG | chr12 | 21592021 | 21592040 | 21592037 | + |
| SEQ ID NO 15708 | GCCATTATGAAGACACACAA | AGG | chr12 | 21592022 | 21592041 | 21592038 | + |
| SEQ ID NO 15709 | CACAAAGGTATACAACTAAC | TGG | chr12 | 21592037 | 21592056 | 21592053 | + |
| SEQ ID NO 15710 | AAAGGTATACAACTAACTGG | TAG | chr12 | 21592040 | 21592059 | 21592056 | + |
| SEQ ID NO 15711 | AGGTATACAACTAACTGGTA | GAG | chr12 | 21592042 | 21592061 | 21592058 | + |
| SEQ ID NO 15712 | GGTAGAGCAAAACACAAATA | AAG | chr12 | 21592058 | 21592077 | 21592074 | + |
| SEQ ID NO 15713 | AGAGCAAAACACAAATAAAG | AAG | chr12 | 21592061 | 21592080 | 21592077 | + |
| SEQ ID NO 15714 | AGCAAAACACAAATAAAGAA | GAG | chr12 | 21592063 | 21592082 | 21592079 | + |
| SEQ ID NO 15715 | AAACACAAATAAAGAAGAGA | AAG | chr12 | 21592067 | 21592086 | 21592083 | + |
| SEQ ID NO 15716 | GAACTCAAACGTTACCACTA | CAG | chr12 | 21592089 | 21592108 | 21592105 | + |
| SEQ ID NO 15717 | AAACCACAATCATAAATAAT | AAG | chr12 | 21592121 | 21592140 | 21592137 | + |
| SEQ ID NO 15718 | CACAATCATAAATAATAAGA | AAG | chr12 | 21592125 | 21592144 | 21592141 | + |
| SEQ ID NO 15719 | ATCATAAATAATAAGAAAGA | AAG | chr12 | 21592129 | 21592148 | 21592145 | + |
| SEQ ID NO 15720 | TAAATAATAAGAAAGAAAGA | AAG | chr12 | 21592133 | 21592152 | 21592149 | + |
| SEQ ID NO 15721 | TAATAAGAAAGAAAGAAAGA | AAG | chr12 | 21592137 | 21592156 | 21592153 | + |
| SEQ ID NO 15722 | AAGAAAGAAAGAAAGAAAGA | AAG | chr12 | 21592141 | 21592160 | 21592157 | + |
| SEQ ID NO 15723 | GAAAGAAAGAAAGAAAGAAA | GAG | chr12 | 21592143 | 21592162 | 21592159 | + |
| SEQ ID NO 15724 | AAGAAAGAAAGAAAGAAAGA | GAG | chr12 | 21592145 | 21592164 | 21592161 | + |
| SEQ ID NO 15725 | GAAAGAAAGAAAGAAAGAGA | GAG | chr12 | 21592147 | 21592166 | 21592163 | + |
| SEQ ID NO 15726 | AAGAAAGAAAGAAAGAGAGA | GAG | chr12 | 21592149 | 21592168 | 21592165 | + |
| SEQ ID NO 15727 | GAAAGAAAGAAAGAGAGAGA | GAG | chr12 | 21592151 | 21592170 | 21592167 | + |
| SEQ ID NO 15728 | AAGAAAGAAAGAGAGAGAGA | GAG | chr12 | 21592153 | 21592172 | 21592169 | + |
| SEQ ID NO 15729 | GAAAGAAAGAGAGAGAGAGA | GAG | chr12 | 21592155 | 21592174 | 21592171 | + |
| SEQ ID NO 15730 | GAGAGAGAGAGAGAATGA | AAG | chr12 | 21592163 | 21592182 | 21592179 | + |
| SEQ ID NO 15731 | GAGAGAGAGAGAATGAAAGA | AAG | chr12 | 21592167 | 21592186 | 21592183 | + |
| SEQ ID NO 15732 | AGAGAGAATGAAAGAAAGAA | AAG | chr12 | 21592172 | 21592191 | 21592188 | + |

Figure 43 (Cont'd)

| SEQ ID NO 15733 | GAGAGAATGAAAGAAAGAAA | AGG | chr12 | 21592173 | 21592192 | 21592189 | + |
| SEQ ID NO 15734 | AGAATGAAAGAAAGAAAAGG | AAG | chr12 | 21592176 | 21592195 | 21592192 | + |
| SEQ ID NO 15735 | GAATGAAAGAAAGAAAAGGA | AGG | chr12 | 21592177 | 21592196 | 21592193 | + |
| SEQ ID NO 15736 | TGAAAGAAAGAAAAGGAAGG | AAG | chr12 | 21592180 | 21592199 | 21592196 | + |
| SEQ ID NO 15737 | GAAAGAAAGAAAAGGAAGGA | AGG | chr12 | 21592181 | 21592200 | 21592197 | + |
| SEQ ID NO 15738 | AGAAAGAAAAGGAAGGAAGG | AAG | chr12 | 21592184 | 21592203 | 21592200 | + |
| SEQ ID NO 15739 | TAAAAAAAAAACAAAACAAC | CAG | chr12 | 21592230 | 21592249 | 21592246 | + |
| SEQ ID NO 15740 | AAAAAAAAACAAAACAACC | AGG | chr12 | 21592231 | 21592250 | 21592247 | + |
| SEQ ID NO 15741 | CCAGGAATCAATTAACAAAA | TGG | chr12 | 21592249 | 21592268 | 21592265 | + |
| SEQ ID NO 15742 | GGAATCAATTAACAAAATGG | CAG | chr12 | 21592252 | 21592271 | 21592268 | + |
| SEQ ID NO 15743 | GAATCAATTAACAAAATGGC | AGG | chr12 | 21592253 | 21592272 | 21592269 | + |
| SEQ ID NO 15744 | ATTAACAAAATGGCAGGAAT | AAG | chr12 | 21592259 | 21592278 | 21592275 | + |
| SEQ ID NO 15745 | AAGCTCTCACATGTCAATAA | TAG | chr12 | 21592279 | 21592298 | 21592295 | + |
| SEQ ID NO 15746 | ATAATAGCCTTGCATGTAAA | TGG | chr12 | 21592295 | 21592314 | 21592311 | + |
| SEQ ID NO 15747 | TGGATTAAATTGTTACTTGA | AAG | chr12 | 21592315 | 21592334 | 21592331 | + |
| SEQ ID NO 15748 | AAATTGTTACTTGAAAGATA | TAG | chr12 | 21592321 | 21592340 | 21592337 | + |
| SEQ ID NO 15749 | GTTACTTGAAAGATATAGAC | TGG | chr12 | 21592326 | 21592345 | 21592342 | + |
| SEQ ID NO 15750 | AAAGATATAGACTGGCTAAA | TAG | chr12 | 21592334 | 21592353 | 21592350 | + |
| SEQ ID NO 15751 | TTTAAAACAAAAATATGACC | CAG | chr12 | 21592358 | 21592377 | 21592374 | + |
| SEQ ID NO 15752 | CAAAAATATGACCCAGTTGT | AAG | chr12 | 21592365 | 21592384 | 21592381 | + |
| SEQ ID NO 15753 | CCCAGTTGTAAGCTGCCTAT | AAG | chr12 | 21592376 | 21592395 | 21592392 | + |
| SEQ ID NO 15754 | AGAAACTTATCTCACTTGTA | AAG | chr12 | 21592397 | 21592416 | 21592413 | + |
| SEQ ID NO 15755 | CTCACTTGTAAAGATAAATA | TAG | chr12 | 21592407 | 21592426 | 21592423 | + |
| SEQ ID NO 15756 | TAAAGATAAATATAGACTGA | AAG | chr12 | 21592415 | 21592434 | 21592431 | + |
| SEQ ID NO 15757 | AAATATAGACTGAAAGTAAA | AAG | chr12 | 21592422 | 21592441 | 21592438 | + |
| SEQ ID NO 15758 | GACTGAAAGTAAAAGATGA | AAG | chr12 | 21592429 | 21592448 | 21592445 | + |
| SEQ ID NO 15759 | GATGAAAGATCTTCCATACA | AAG | chr12 | 21592444 | 21592463 | 21592460 | + |
| SEQ ID NO 15760 | TGAAAGATCTTCCATACAAA | GAG | chr12 | 21592446 | 21592465 | 21592462 | + |
| SEQ ID NO 15761 | TACAAAGAGAAACCAAAAAT | GAG | chr12 | 21592460 | 21592479 | 21592476 | + |
| SEQ ID NO 15762 | GAGAAACCAAAAATGAGCAA | AAG | chr12 | 21592466 | 21592485 | 21592482 | + |
| SEQ ID NO 15763 | AAACCAAAAATGAGCAAAAG | TAG | chr12 | 21592469 | 21592488 | 21592485 | + |
| SEQ ID NO 15764 | AAAAGTAGTTATACCTATAA | CAG | chr12 | 21592484 | 21592503 | 21592500 | + |
| SEQ ID NO 15765 | GACTTTAAATAAAAACACT | AAG | chr12 | 21592515 | 21592534 | 21592531 | + |
| SEQ ID NO 15766 | CTTTAAATAAAAACACTAA | GAG | chr12 | 21592517 | 21592536 | 21592533 | + |
| SEQ ID NO 15767 | TAAAAAACACTAAGAGACAA | AAG | chr12 | 21592524 | 21592543 | 21592540 | + |
| SEQ ID NO 15768 | AAGTCATTACATAATGATAA | AAG | chr12 | 21592544 | 21592563 | 21592560 | + |
| SEQ ID NO 15769 | AGTCATTACATAATGATAAA | AGG | chr12 | 21592545 | 21592564 | 21592561 | + |
| SEQ ID NO 15770 | TAATGATAAAGGAACAATT | CAG | chr12 | 21592555 | 21592574 | 21592571 | + |
| SEQ ID NO 15771 | GATAAAGGAACAATTCAGC | AAG | chr12 | 21592559 | 21592578 | 21592575 | + |
| SEQ ID NO 15772 | TAAAGGAACAATTCAGCAA | GAG | chr12 | 21592561 | 21592580 | 21592577 | + |
| SEQ ID NO 15773 | TAAACATTCACACTCAACAC | CAG | chr12 | 21592597 | 21592616 | 21592613 | + |
| SEQ ID NO 15774 | AACATTCACACTCAACACCA | GAG | chr12 | 21592599 | 21592618 | 21592615 | + |
| SEQ ID NO 15775 | ACACTCAACACCAGAGCATC | CAG | chr12 | 21592606 | 21592625 | 21592622 | + |
| SEQ ID NO 15776 | CCAGAGCATCCAGATATGTA | AAG | chr12 | 21592616 | 21592635 | 21592632 | + |
| SEQ ID NO 15777 | ATATGTAAAGCAAATGTTAT | TAG | chr12 | 21592629 | 21592648 | 21592645 | + |
| SEQ ID NO 15778 | AGCAAATGTTATTAGATATA | AAG | chr12 | 21592637 | 21592656 | 21592653 | + |
| SEQ ID NO 15779 | GCAAATGTTATTAGATATAA | AGG | chr12 | 21592638 | 21592657 | 21592654 | + |

Figure 43 (Cont'd)

| | | | | | | | |
|---|---|---|---|---|---|---|---|
| SEQ ID NO 15780 | CAAATGTTATTAGATATAAA | GGG | chr12 | 21592639 | 21592658 | 21592655 | + |
| SEQ ID NO 15781 | ATTAGATATAAAGGGTGAAA | TAG | chr12 | 21592647 | 21592666 | 21592663 | + |
| SEQ ID NO 15782 | AATAGAATCCAATACAATAA | TAG | chr12 | 21592665 | 21592684 | 21592681 | + |
| SEQ ID NO 15783 | GAATCCAATACAATAATAGT | TGG | chr12 | 21592669 | 21592688 | 21592685 | + |
| SEQ ID NO 15784 | AATCCAATACAATAATAGTT | GGG | chr12 | 21592670 | 21592689 | 21592686 | + |
| SEQ ID NO 15785 | ATCCAATACAATAATAGTTG | GGG | chr12 | 21592671 | 21592690 | 21592687 | + |
| SEQ ID NO 15786 | GGATTTCAACATTCTAATCT | CAG | chr12 | 21592692 | 21592711 | 21592708 | + |
| SEQ ID NO 15787 | CAACATTCTAATCTCAGCAT | CAG | chr12 | 21592698 | 21592717 | 21592714 | + |
| SEQ ID NO 15788 | ATTCTAATCTCAGCATCAGA | TAG | chr12 | 21592702 | 21592721 | 21592718 | + |
| SEQ ID NO 15789 | TCAGCATCAGATAGATCATC | TAG | chr12 | 21592711 | 21592730 | 21592727 | + |
| SEQ ID NO 15790 | CATCAGATAGATCATCTAGA | CAG | chr12 | 21592715 | 21592734 | 21592731 | + |
| SEQ ID NO 15791 | ATCTAGACAGAAAATTAACA | AAG | chr12 | 21592728 | 21592747 | 21592744 | + |
| SEQ ID NO 15792 | GAAAATTAACAAAGAAACAT | TGG | chr12 | 21592737 | 21592756 | 21592753 | + |
| SEQ ID NO 15793 | ATTGGATTTAAACTTGACTT | TAG | chr12 | 21592755 | 21592774 | 21592771 | + |
| SEQ ID NO 15794 | AAACTTGACTTTAGACCAAA | TGG | chr12 | 21592764 | 21592783 | 21592780 | + |
| SEQ ID NO 15795 | TTACACAATATTTCATCCAA | CAG | chr12 | 21592796 | 21592815 | 21592812 | + |
| SEQ ID NO 15796 | AATATTTCATCCAACAGCTA | CAG | chr12 | 21592802 | 21592821 | 21592818 | + |
| SEQ ID NO 15797 | ACAGAATATATTTATCTCAT | CAG | chr12 | 21592821 | 21592840 | 21592837 | + |
| SEQ ID NO 15798 | TCAGCACATGACGCATTCCC | CAG | chr12 | 21592840 | 21592859 | 21592856 | + |
| SEQ ID NO 15799 | CAGCACATGACGCATTCCCC | AGG | chr12 | 21592841 | 21592860 | 21592857 | + |
| SEQ ID NO 15800 | CCCCAGGATACACCATATGT | TAG | chr12 | 21592857 | 21592876 | 21592873 | + |
| SEQ ID NO 15801 | CACCATATGTTAGAACACAA | AAG | chr12 | 21592867 | 21592886 | 21592883 | + |
| SEQ ID NO 15802 | CATATGTTAGAACACAAAAG | AAG | chr12 | 21592870 | 21592889 | 21592886 | + |
| SEQ ID NO 15803 | GAAATATTTGAAATCATATT | AAG | chr12 | 21592906 | 21592925 | 21592922 | + |
| SEQ ID NO 15804 | AATCATATTAAGCATCTTCT | CAG | chr12 | 21592917 | 21592936 | 21592933 | + |
| SEQ ID NO 15805 | AGCATCTTCTCAGACCACAA | TGG | chr12 | 21592927 | 21592946 | 21592943 | + |
| SEQ ID NO 15806 | AGACCACAATGGAATAAAAC | TAG | chr12 | 21592938 | 21592957 | 21592954 | + |
| SEQ ID NO 15807 | TAAAACTAGAAATCAATAAC | AAG | chr12 | 21592952 | 21592971 | 21592968 | + |
| SEQ ID NO 15808 | TTAAAACCTATACAAATACA | TGG | chr12 | 21592982 | 21593001 | 21592998 | + |
| SEQ ID NO 15809 | TCCTGAATGAACGTTATGTC | AAG | chr12 | 21593021 | 21593040 | 21593037 | + |
| SEQ ID NO 15810 | TGAATGAACGTTATGTCAAG | AAG | chr12 | 21593024 | 21593043 | 21593040 | + |
| SEQ ID NO 15811 | GTTATGTCAAGAAGAAAATT | AAG | chr12 | 21593033 | 21593052 | 21593049 | + |
| SEQ ID NO 15812 | ATGTCAAGAAGAAAATTAAG | AAG | chr12 | 21593036 | 21593055 | 21593052 | + |
| SEQ ID NO 15813 | TGTCAAGAAGAAAATTAAGA | AGG | chr12 | 21593037 | 21593056 | 21593053 | + |
| SEQ ID NO 15814 | ATGAAAATTGAAATACAACA | TAG | chr12 | 21593083 | 21593102 | 21593099 | + |
| SEQ ID NO 15815 | TGAAAATTGAAATACAACAT | AGG | chr12 | 21593084 | 21593103 | 21593100 | + |
| SEQ ID NO 15816 | ATTGAAATACAACATAGGAA | AAG | chr12 | 21593089 | 21593108 | 21593105 | + |
| SEQ ID NO 15817 | ATACAACATAGGAAAAGCCA | TGG | chr12 | 21593095 | 21593114 | 21593111 | + |
| SEQ ID NO 15818 | TACAACATAGGAAAAGCCAT | GGG | chr12 | 21593096 | 21593115 | 21593112 | + |
| SEQ ID NO 15819 | ATAGGAAAAGCCATGGGATA | CAG | chr12 | 21593102 | 21593121 | 21593118 | + |
| SEQ ID NO 15820 | AAAGCCATGGGATACAGCAA | AAG | chr12 | 21593108 | 21593127 | 21593124 | + |
| SEQ ID NO 15821 | GCCATGGGATACAGCAAAAG | CAG | chr12 | 21593111 | 21593130 | 21593127 | + |
| SEQ ID NO 15822 | GATACAGCAAAAGCAGTGCT | AAG | chr12 | 21593118 | 21593137 | 21593134 | + |
| SEQ ID NO 15823 | TACAGCAAAAGCAGTGCTAA | GAG | chr12 | 21593120 | 21593139 | 21593136 | + |
| SEQ ID NO 15824 | CAGCAAAAGCAGTGCTAAGA | GAG | chr12 | 21593122 | 21593141 | 21593138 | + |
| SEQ ID NO 15825 | CAAAAGCAGTGCTAAGAGAG | AAG | chr12 | 21593125 | 21593144 | 21593141 | + |
| SEQ ID NO 15826 | AAACACTTAAATTAAAAACA | TAG | chr12 | 21593157 | 21593176 | 21593173 | + |

Figure 43 (Cont'd)

| | | | | | | | |
|---|---|---|---|---|---|---|---|
| SEQ ID NO 15827 | ACTTAAATTAAAAACATAGA | AAG | chr12 | 21593161 | 21593180 | 21593177 | + |
| SEQ ID NO 15828 | ATCTAATCATGTACCTCAAC | AAG | chr12 | 21593198 | 21593217 | 21593214 | + |
| SEQ ID NO 15829 | AATCATGTACCTCAACAAGC | TAG | chr12 | 21593202 | 21593221 | 21593218 | + |
| SEQ ID NO 15830 | TGTACCTCAACAAGCTAGAA | AAG | chr12 | 21593207 | 21593226 | 21593223 | + |
| SEQ ID NO 15831 | CCTCAACAAGCTAGAAAAGC | AAG | chr12 | 21593211 | 21593230 | 21593227 | + |
| SEQ ID NO 15832 | GCAAGAACAAAACCCAAAAC | TAG | chr12 | 21593229 | 21593248 | 21593245 | + |
| SEQ ID NO 15833 | AGAACAAAACCCAAAACTAG | CAG | chr12 | 21593232 | 21593251 | 21593248 | + |
| SEQ ID NO 15834 | ACAAAACCCAAAACTAGCAG | AAG | chr12 | 21593235 | 21593254 | 21593251 | + |
| SEQ ID NO 15835 | CAAAACCCAAAACTAGCAGA | AGG | chr12 | 21593236 | 21593255 | 21593252 | + |
| SEQ ID NO 15836 | ACCCAAAACTAGCAGAAGGA | AAG | chr12 | 21593240 | 21593259 | 21593256 | + |
| SEQ ID NO 15837 | GCAGAAGGAAAGAAAAAATG | AAG | chr12 | 21593251 | 21593270 | 21593267 | + |
| SEQ ID NO 15838 | AGGAAAGAAAAATGAAGAA | CAG | chr12 | 21593256 | 21593275 | 21593272 | + |
| SEQ ID NO 15839 | AAAGAAAAATGAAGAACAG | AAG | chr12 | 21593259 | 21593278 | 21593275 | + |
| SEQ ID NO 15840 | AACAGAAGAACTTAATGAAA | TAG | chr12 | 21593274 | 21593293 | 21593290 | + |
| SEQ ID NO 15841 | CAGAAGAACTTAATGAAATA | GAG | chr12 | 21593276 | 21593295 | 21593292 | + |
| SEQ ID NO 15842 | AAATAGAGAAAAACAACAAC | AAG | chr12 | 21593291 | 21593310 | 21593307 | + |
| SEQ ID NO 15843 | AATAGAGAAAAACAACAACA | AGG | chr12 | 21593292 | 21593311 | 21593308 | + |
| SEQ ID NO 15844 | ATAGAGAAAAACAACAACAA | GGG | chr12 | 21593293 | 21593312 | 21593309 | + |
| SEQ ID NO 15845 | GAAAAACAACAACAAGGGAT | TAG | chr12 | 21593298 | 21593317 | 21593314 | + |
| SEQ ID NO 15846 | CAAGGGATTAGCAAAATGAA | AAG | chr12 | 21593310 | 21593329 | 21593326 | + |
| SEQ ID NO 15847 | TGAAAAGTTGTTATTTAAAA | AAG | chr12 | 21593326 | 21593345 | 21593342 | + |
| SEQ ID NO 15848 | GTTATTTAAAAAGATAAAA | TGG | chr12 | 21593335 | 21593354 | 21593351 | + |
| SEQ ID NO 15849 | TAAAAAGATAAAATGGATA | TAG | chr12 | 21593341 | 21593360 | 21593357 | + |
| SEQ ID NO 15850 | AGATAAAATGGATATAGCTC | TAG | chr12 | 21593347 | 21593366 | 21593363 | + |
| SEQ ID NO 15851 | AAAATGGATATAGCTCTAGC | TAG | chr12 | 21593351 | 21593370 | 21593367 | + |
| SEQ ID NO 15852 | TAGCTCTAGCTAGACTAACC | AAG | chr12 | 21593361 | 21593380 | 21593377 | + |
| SEQ ID NO 15853 | TAGCTAGACTAACCAAGAAA | AAG | chr12 | 21593367 | 21593386 | 21593383 | + |
| SEQ ID NO 15854 | GCTAGACTAACCAAGAAAAA | GAG | chr12 | 21593369 | 21593388 | 21593385 | + |
| SEQ ID NO 15855 | AGACTAACCAAGAAAAGAG | AAG | chr12 | 21593372 | 21593391 | 21593388 | + |
| SEQ ID NO 15856 | ACTAACCAAGAAAAGAGAA | GAG | chr12 | 21593374 | 21593393 | 21593390 | + |
| SEQ ID NO 15857 | AAAGAGAAGAGACTGAAATA | AAG | chr12 | 21593386 | 21593405 | 21593402 | + |
| SEQ ID NO 15858 | GAGACTGAAATAAAGAAAAT | CAG | chr12 | 21593394 | 21593413 | 21593410 | + |
| SEQ ID NO 15859 | AAAGAAAATCAGAAATAAAA | AAG | chr12 | 21593405 | 21593424 | 21593421 | + |
| SEQ ID NO 15860 | ATATATTACAACCGATACCA | CAG | chr12 | 21593431 | 21593450 | 21593447 | + |
| SEQ ID NO 15861 | TACAACCGATACCACAGAAA | TAG | chr12 | 21593437 | 21593456 | 21593453 | + |
| SEQ ID NO 15862 | CCGATACCACAGAAATAGAA | AAG | chr12 | 21593442 | 21593461 | 21593458 | + |
| SEQ ID NO 15863 | ACAGAAATAGAAAGATTAT | CAG | chr12 | 21593450 | 21593469 | 21593466 | + |
| SEQ ID NO 15864 | AGAAATAGAAAGATTATCA | GAG | chr12 | 21593452 | 21593471 | 21593468 | + |
| SEQ ID NO 15865 | CACTAAAAAACTGAAAAATC | TAG | chr12 | 21593494 | 21593513 | 21593510 | + |
| SEQ ID NO 15866 | CTAAAAACTGAAAAATCTA | GAG | chr12 | 21593496 | 21593515 | 21593512 | + |
| SEQ ID NO 15867 | TAAAAACTGAAAAATCTAG | AGG | chr12 | 21593497 | 21593516 | 21593513 | + |
| SEQ ID NO 15868 | AGAGGAAATTAATAAATTTC | TGG | chr12 | 21593515 | 21593534 | 21593531 | + |
| SEQ ID NO 15869 | CTGGACACATACCACCTACC | AAG | chr12 | 21593534 | 21593553 | 21593550 | + |
| SEQ ID NO 15870 | CCACCTACCAAGATTGAATT | AAG | chr12 | 21593545 | 21593564 | 21593561 | + |
| SEQ ID NO 15871 | CTACCAAGATTGAATTAAGA | AAG | chr12 | 21593549 | 21593568 | 21593565 | + |
| SEQ ID NO 15872 | AAGATTGAATTAAGAAAGAA | TAG | chr12 | 21593554 | 21593573 | 21593570 | + |
| SEQ ID NO 15873 | GAAAGAATAGAAAACCTGAA | CAG | chr12 | 21593567 | 21593586 | 21593583 | + |

Figure 43 (Cont'd)

| | | | | | | | |
|---|---|---|---|---|---|---|---|
| SEQ ID NO 15874 | AATAGAAAACCTGAACAGAC | CAG | chr12 | 21593572 | 21593591 | 21593588 | + |
| SEQ ID NO 15875 | AATGAATAATGAAATTGAAT | CAG | chr12 | 21593596 | 21593615 | 21593612 | + |
| SEQ ID NO 15876 | GAATAATGAAATTGAATCAG | TAG | chr12 | 21593599 | 21593618 | 21593615 | + |
| SEQ ID NO 15877 | GAAATTGAATCAGTAGTAAA | AAG | chr12 | 21593606 | 21593625 | 21593622 | + |
| SEQ ID NO 15878 | TAGTAAAAGTCTCCCAAAA | AAG | chr12 | 21593619 | 21593638 | 21593635 | + |
| SEQ ID NO 15879 | CTCCCAAAAAGAAAATTTC | AAG | chr12 | 21593630 | 21593649 | 21593646 | + |
| SEQ ID NO 15880 | AAAAAGAAAATTTCAAGAC | CAG | chr12 | 21593635 | 21593654 | 21593651 | + |
| SEQ ID NO 15881 | AAGAAAATTTCAAGACCAGA | TGG | chr12 | 21593639 | 21593658 | 21593655 | + |
| SEQ ID NO 15882 | CAAATTTTACCAAACTTTCA | AAG | chr12 | 21593671 | 21593690 | 21593687 | + |
| SEQ ID NO 15883 | AACTTTCAAAGAAAACTAAC | AAG | chr12 | 21593683 | 21593702 | 21593699 | + |
| SEQ ID NO 15884 | AAATTCTTTTAAAAATTAAA | CAG | chr12 | 21593713 | 21593732 | 21593729 | + |
| SEQ ID NO 15885 | AATTCTTTTAAAAATTAAAC | AGG | chr12 | 21593714 | 21593733 | 21593730 | + |
| SEQ ID NO 15886 | TCTTTTAAAAATTAAACAGG | AAG | chr12 | 21593717 | 21593736 | 21593733 | + |
| SEQ ID NO 15887 | CTTTTAAAAATTAAACAGGA | AGG | chr12 | 21593718 | 21593737 | 21593734 | + |
| SEQ ID NO 15888 | TTCTCCCTAACTCATTCTCT | GAG | chr12 | 21593743 | 21593762 | 21593759 | + |
| SEQ ID NO 15889 | TCTCCCTAACTCATTCTCTG | AGG | chr12 | 21593744 | 21593763 | 21593760 | + |
| SEQ ID NO 15890 | CCTAACTCATTCTCTGAGGC | CAG | chr12 | 21593748 | 21593767 | 21593764 | + |
| SEQ ID NO 15891 | TATTATCCTGATTCCATAAC | CAG | chr12 | 21593771 | 21593790 | 21593787 | + |
| SEQ ID NO 15892 | TCCTGATTCCATAACCAGAC | AAG | chr12 | 21593776 | 21593795 | 21593792 | + |
| SEQ ID NO 15893 | CCTGATTCCATAACCAGACA | AGG | chr12 | 21593777 | 21593796 | 21593793 | + |
| SEQ ID NO 15894 | CCATAACCAGACAAGGATGC | AAG | chr12 | 21593784 | 21593803 | 21593800 | + |
| SEQ ID NO 15895 | TGCAAGTAAAATAAAACTG | CAG | chr12 | 21593801 | 21593820 | 21593817 | + |
| SEQ ID NO 15896 | GCAAGTAAAATAAAACTGC | AGG | chr12 | 21593802 | 21593821 | 21593818 | + |
| SEQ ID NO 15897 | CTGCAGGTCAATATCCCTGA | TGG | chr12 | 21593818 | 21593837 | 21593834 | + |
| SEQ ID NO 15898 | TCAATATCCCTGATGGAACA | TAG | chr12 | 21593825 | 21593844 | 21593841 | + |
| SEQ ID NO 15899 | CAATATCCCTGATGGAACAT | AGG | chr12 | 21593826 | 21593845 | 21593842 | + |
| SEQ ID NO 15900 | GAAAATCCTCAACAAAATAC | TAG | chr12 | 21593852 | 21593871 | 21593868 | + |
| SEQ ID NO 15901 | TACTAGCAAACTGAATCCAA | CAG | chr12 | 21593869 | 21593888 | 21593885 | + |
| SEQ ID NO 15902 | GAATCCAACAGTACATCCAA | AAG | chr12 | 21593881 | 21593900 | 21593897 | + |
| SEQ ID NO 15903 | AAAGATAATACACCATGATC | AAG | chr12 | 21593900 | 21593919 | 21593916 | + |
| SEQ ID NO 15904 | GATAATACACCATGATCAAG | TGG | chr12 | 21593903 | 21593922 | 21593919 | + |
| SEQ ID NO 15905 | ATAATACACCATGATCAAGT | GGG | chr12 | 21593904 | 21593923 | 21593920 | + |
| SEQ ID NO 15906 | TGATCAAGTGGGATTTATAC | TAG | chr12 | 21593915 | 21593934 | 21593931 | + |
| SEQ ID NO 15907 | GATCAAGTGGGATTTATACT | AGG | chr12 | 21593916 | 21593935 | 21593932 | + |
| SEQ ID NO 15908 | ATCAAGTGGGATTTATACTA | GGG | chr12 | 21593917 | 21593936 | 21593933 | + |
| SEQ ID NO 15909 | GGGATTTATACTAGGGTTGC | AAG | chr12 | 21593924 | 21593943 | 21593940 | + |
| SEQ ID NO 15910 | TTATACTAGGGTTGCAAGAA | CAG | chr12 | 21593929 | 21593948 | 21593945 | + |
| SEQ ID NO 15911 | TGATACATCACATCAACAAA | AAG | chr12 | 21593968 | 21593987 | 21593984 | + |
| SEQ ID NO 15912 | AAACCATATGATCATCTCAA | TAG | chr12 | 21593996 | 21594015 | 21594012 | + |
| SEQ ID NO 15913 | TATGATCATCTCAATAGATA | CAG | chr12 | 21594002 | 21594021 | 21594018 | + |
| SEQ ID NO 15914 | CATCTCAATAGATACAGAAA | AAG | chr12 | 21594008 | 21594027 | 21594024 | + |
| SEQ ID NO 15915 | TTCATGATAAAAACTATCTG | CAG | chr12 | 21594054 | 21594073 | 21594070 | + |
| SEQ ID NO 15916 | AAACTATCTGCAGCCAATCA | TAG | chr12 | 21594064 | 21594083 | 21594080 | + |
| SEQ ID NO 15917 | CTATCTGCAGCCAATCATAG | AAG | chr12 | 21594067 | 21594086 | 21594083 | + |
| SEQ ID NO 15918 | TATCTGCAGCCAATCATAGA | AGG | chr12 | 21594068 | 21594087 | 21594084 | + |
| SEQ ID NO 15919 | AACATATCTCAATATAATAA | AAG | chr12 | 21594091 | 21594110 | 21594107 | + |
| SEQ ID NO 15920 | AGTCATATATGACAAACCCA | CAG | chr12 | 21594112 | 21594131 | 21594128 | + |

Figure 43 (Cont'd)

| | | | | | | | |
|---|---|---|---|---|---|---|---|
| SEQ ID NO 15921 | CAGCTAACATCATACTGAAT | TGG | chr12 | 21594132 | 21594151 | 21594148 | + |
| SEQ ID NO 15922 | AGCTAACATCATACTGAATT | GGG | chr12 | 21594133 | 21594152 | 21594149 | + |
| SEQ ID NO 15923 | ACATCATACTGAATTGGGAA | AAG | chr12 | 21594138 | 21594157 | 21594154 | + |
| SEQ ID NO 15924 | CATACTGAATTGGGAAAAGC | TGG | chr12 | 21594142 | 21594161 | 21594158 | + |
| SEQ ID NO 15925 | ACTGAATTGGGAAAAGCTGG | AAG | chr12 | 21594145 | 21594164 | 21594161 | + |
| SEQ ID NO 15926 | AAGCTGGAAGCCTTTCCTCT | AAG | chr12 | 21594158 | 21594177 | 21594174 | + |
| SEQ ID NO 15927 | TCTAAGAACTGAAACAAAAT | AAG | chr12 | 21594175 | 21594194 | 21594191 | + |
| SEQ ID NO 15928 | CTAAGAACTGAAACAAAATA | AGG | chr12 | 21594176 | 21594195 | 21594192 | + |
| SEQ ID NO 15929 | ACTCCTATTCAATATAATAC | TGG | chr12 | 21594214 | 21594233 | 21594230 | + |
| SEQ ID NO 15930 | CCTATTCAATATAATACTGG | AAG | chr12 | 21594217 | 21594236 | 21594233 | + |
| SEQ ID NO 15931 | CAATATAATACTGGAAGTCC | TAG | chr12 | 21594223 | 21594242 | 21594239 | + |
| SEQ ID NO 15932 | AATACTGGAAGTCCTAGCCA | CAG | chr12 | 21594229 | 21594248 | 21594245 | + |
| SEQ ID NO 15933 | GAAGTCCTAGCCACAGCTTT | CAG | chr12 | 21594236 | 21594255 | 21594252 | + |
| SEQ ID NO 15934 | AAGTCCTAGCCACAGCTTTC | AGG | chr12 | 21594237 | 21594256 | 21594253 | + |
| SEQ ID NO 15935 | CCTAGCCACAGCTTTCAGGT | CAG | chr12 | 21594241 | 21594260 | 21594257 | + |
| SEQ ID NO 15936 | TAGCCACAGCTTTCAGGTCA | GAG | chr12 | 21594243 | 21594262 | 21594259 | + |
| SEQ ID NO 15937 | CACAGCTTTCAGGTCAGAGA | AAG | chr12 | 21594247 | 21594266 | 21594263 | + |
| SEQ ID NO 15938 | GCTTTCAGGTCAGAGAAAGA | AAG | chr12 | 21594251 | 21594270 | 21594267 | + |
| SEQ ID NO 15939 | TCAGGTCAGAGAAAGAAAGA | AAG | chr12 | 21594255 | 21594274 | 21594271 | + |
| SEQ ID NO 15940 | TCAGAGAAAGAAAGAAAGAA | AAG | chr12 | 21594260 | 21594279 | 21594276 | + |
| SEQ ID NO 15941 | CAGAGAAAGAAAGAAAGAAA | AGG | chr12 | 21594261 | 21594280 | 21594277 | + |
| SEQ ID NO 15942 | AGAAAGAAAAGGCATGCAAA | TAG | chr12 | 21594272 | 21594291 | 21594288 | + |
| SEQ ID NO 15943 | GAAAGAAAAGGCATGCAAAT | AGG | chr12 | 21594273 | 21594292 | 21594289 | + |
| SEQ ID NO 15944 | AAAAGGCATGCAAATAGGAA | AAG | chr12 | 21594278 | 21594297 | 21594294 | + |
| SEQ ID NO 15945 | CATGCAAATAGGAAAAGATG | AAG | chr12 | 21594284 | 21594303 | 21594300 | + |
| SEQ ID NO 15946 | AGTCAAACTGTCCATCTTTC | CAG | chr12 | 21594305 | 21594324 | 21594321 | + |
| SEQ ID NO 15947 | AGATGACATGATTTTATACC | TAG | chr12 | 21594326 | 21594345 | 21594342 | + |
| SEQ ID NO 15948 | ATTTTATACCTAGAAAAACC | AAG | chr12 | 21594336 | 21594355 | 21594352 | + |
| SEQ ID NO 15949 | GAAAAACCAAGACTCCACCA | AAG | chr12 | 21594348 | 21594367 | 21594364 | + |
| SEQ ID NO 15950 | AGACTCCACCAAAGCACTCT | TAG | chr12 | 21594357 | 21594376 | 21594373 | + |
| SEQ ID NO 15951 | TTAGCGCTGAAAAATAAATT | CAG | chr12 | 21594376 | 21594395 | 21594392 | + |
| SEQ ID NO 15952 | GCTGAAAAATAAATTCAGTA | AAG | chr12 | 21594381 | 21594400 | 21594397 | + |
| SEQ ID NO 15953 | AAATAAATTCAGTAAAGTTA | CAG | chr12 | 21594387 | 21594406 | 21594403 | + |
| SEQ ID NO 15954 | AATAAATTCAGTAAAGTTAC | AGG | chr12 | 21594388 | 21594407 | 21594404 | + |
| SEQ ID NO 15955 | TAAATTCAGTAAAGTTACAG | GAG | chr12 | 21594390 | 21594409 | 21594406 | + |
| SEQ ID NO 15956 | AAAGTTACAGGAGACAAAAT | CAG | chr12 | 21594400 | 21594419 | 21594416 | + |
| SEQ ID NO 15957 | ACAAAATCAGCATATGAAAC | AAG | chr12 | 21594413 | 21594432 | 21594429 | + |
| SEQ ID NO 15958 | TCTACACACCAATAATAAAC | TAG | chr12 | 21594443 | 21594462 | 21594459 | + |
| SEQ ID NO 15959 | ACACCAATAATAAACTAGCT | GAG | chr12 | 21594448 | 21594467 | 21594464 | + |
| SEQ ID NO 15960 | CCAATAATAAACTAGCTGAG | AAG | chr12 | 21594451 | 21594470 | 21594467 | + |
| SEQ ID NO 15961 | CAATAATAAACTAGCTGAGA | AGG | chr12 | 21594452 | 21594471 | 21594468 | + |
| SEQ ID NO 15962 | AACTAGCTGAGAAGGAAATT | AAG | chr12 | 21594460 | 21594479 | 21594476 | + |
| SEQ ID NO 15963 | TAGCTGAGAAGGAAATTAAG | AAG | chr12 | 21594463 | 21594482 | 21594479 | + |
| SEQ ID NO 15964 | AGCTGAGAAGGAAATTAAGA | AGG | chr12 | 21594464 | 21594483 | 21594480 | + |
| SEQ ID NO 15965 | GAAGGCAATCCCATTTACAA | TAG | chr12 | 21594482 | 21594501 | 21594498 | + |
| SEQ ID NO 15966 | TAGCTAAAAATAAAATATT | TAG | chr12 | 21594502 | 21594521 | 21594518 | + |
| SEQ ID NO 15967 | AGCTAAAAATAAAATATTT | AGG | chr12 | 21594503 | 21594522 | 21594519 | + |

Figure 43 (Cont'd)

| | | | | | | | |
|---|---|---|---|---|---|---|---|
| SEQ ID NO 15968 | GCTAAAAAATAAAATATTTA | GGG | chr12 | 21594504 | 21594523 | 21594520 | + |
| SEQ ID NO 15969 | ATTTAGGGATAAATTTAACC | AAG | chr12 | 21594519 | 21594538 | 21594535 | + |
| SEQ ID NO 15970 | TTTAGGGATAAATTTAACCA | AGG | chr12 | 21594520 | 21594539 | 21594536 | + |
| SEQ ID NO 15971 | GGAACCGAAAAACCTCTATT | CGG | chr12 | 21594541 | 21594560 | 21594557 | + |
| SEQ ID NO 15972 | AAACTACAAAACACTGATAA | AAG | chr12 | 21594565 | 21594584 | 21594581 | + |
| SEQ ID NO 15973 | ACACTGATAAAAGAATTGAA | AAG | chr12 | 21594575 | 21594594 | 21594591 | + |
| SEQ ID NO 15974 | CACTGATAAAAGAATTGAAA | AGG | chr12 | 21594576 | 21594595 | 21594592 | + |
| SEQ ID NO 15975 | GATAAAAGAATTGAAAAGGA | CAG | chr12 | 21594580 | 21594599 | 21594596 | + |
| SEQ ID NO 15976 | TTGAAAAGGACAGAAACAAA | TGG | chr12 | 21594590 | 21594609 | 21594606 | + |
| SEQ ID NO 15977 | GAAAAGGACAGAAACAAATG | GAG | chr12 | 21594592 | 21594611 | 21594608 | + |
| SEQ ID NO 15978 | AAAGGACAGAAACAAATGGA | GAG | chr12 | 21594594 | 21594613 | 21594610 | + |
| SEQ ID NO 15979 | GGAGAGATATCCTATGTTCA | TGG | chr12 | 21594611 | 21594630 | 21594627 | + |
| SEQ ID NO 15980 | GATATCCTATGTTCATGGAT | CAG | chr12 | 21594616 | 21594635 | 21594632 | + |
| SEQ ID NO 15981 | AAAATTAATATTGTTAAAA | TGG | chr12 | 21594639 | 21594658 | 21594655 | + |
| SEQ ID NO 15982 | TAAAATGGCCATACTACCCA | AAG | chr12 | 21594654 | 21594673 | 21594670 | + |
| SEQ ID NO 15983 | ATACTACCCAAAGCAATCTA | CAG | chr12 | 21594664 | 21594683 | 21594680 | + |
| SEQ ID NO 15984 | CTATATGACCGCTATCAAAA | TAG | chr12 | 21594690 | 21594709 | 21594706 | + |
| SEQ ID NO 15985 | AATAGCAATGTCATTTTTCA | CAG | chr12 | 21594708 | 21594727 | 21594724 | + |
| SEQ ID NO 15986 | AATGTCATTTTTCACAGAAA | TGG | chr12 | 21594714 | 21594733 | 21594730 | + |
| SEQ ID NO 15987 | ATTTGTATGAAATTAAAAAA | TAG | chr12 | 21594752 | 21594771 | 21594768 | + |
| SEQ ID NO 15988 | ATGAAATTAAAAAATAGCTC | CAG | chr12 | 21594758 | 21594777 | 21594774 | + |
| SEQ ID NO 15989 | AAATTAAAAAATAGCTCCAG | TAG | chr12 | 21594761 | 21594780 | 21594777 | + |
| SEQ ID NO 15990 | AAAAATAGCTCCAGTAGCCA | AAG | chr12 | 21594767 | 21594786 | 21594783 | + |
| SEQ ID NO 15991 | CCAAAGTCATCCTGTGAAAA | AAG | chr12 | 21594784 | 21594803 | 21594800 | + |
| SEQ ID NO 15992 | CTGTGAAAAAGAACAATGC | TAG | chr12 | 21594795 | 21594814 | 21594811 | + |
| SEQ ID NO 15993 | GTGAAAAAGAACAATGCTA | GAG | chr12 | 21594797 | 21594816 | 21594813 | + |
| SEQ ID NO 15994 | TGAAAAAGAACAATGCTAG | AGG | chr12 | 21594798 | 21594817 | 21594814 | + |
| SEQ ID NO 15995 | TATCATACTACCTGATTTCA | AAG | chr12 | 21594821 | 21594840 | 21594837 | + |
| SEQ ID NO 15996 | GATTTCAAAGTATATTACAA | AAG | chr12 | 21594834 | 21594853 | 21594850 | + |
| SEQ ID NO 15997 | CAAAGTATATTACAAAGTA | TAG | chr12 | 21594839 | 21594858 | 21594855 | + |
| SEQ ID NO 15998 | AAAGTATATTACAAAGTAT | AGG | chr12 | 21594840 | 21594859 | 21594856 | + |
| SEQ ID NO 15999 | CAAAGTATAGGAACCTAAA | CAG | chr12 | 21594851 | 21594870 | 21594867 | + |
| SEQ ID NO 16000 | AAACAGCATGATACTGACAT | TAG | chr12 | 21594868 | 21594887 | 21594884 | + |
| SEQ ID NO 16001 | GCATGATACTGACATTAGAA | CAG | chr12 | 21594873 | 21594892 | 21594889 | + |
| SEQ ID NO 16002 | CTGACATTAGAACAGACACT | TAG | chr12 | 21594881 | 21594900 | 21594897 | + |
| SEQ ID NO 16003 | AGAACAGACACTTAGACCAA | TGG | chr12 | 21594889 | 21594908 | 21594905 | + |
| SEQ ID NO 16004 | ACAGACACTTAGACCAATGG | AAG | chr12 | 21594892 | 21594911 | 21594908 | + |
| SEQ ID NO 16005 | AGACACTTAGACCAATGGAA | GAG | chr12 | 21594894 | 21594913 | 21594910 | + |
| SEQ ID NO 16006 | CTTAGACCAATGGAAGAGAA | TAG | chr12 | 21594899 | 21594918 | 21594915 | + |
| SEQ ID NO 16007 | TAGACCAATGGAAGAGAATA | GAG | chr12 | 21594901 | 21594920 | 21594917 | + |
| SEQ ID NO 16008 | ATGGAAGAGAATAGAGAACC | TAG | chr12 | 21594908 | 21594927 | 21594924 | + |
| SEQ ID NO 16009 | GAAATGCATCCACATATTTA | TAG | chr12 | 21594930 | 21594949 | 21594946 | + |
| SEQ ID NO 16010 | ATCCACATATTTATAGCCAA | CAG | chr12 | 21594937 | 21594956 | 21594953 | + |
| SEQ ID NO 16011 | TAGCCAACAGATTTTCAACA | AAG | chr12 | 21594950 | 21594969 | 21594966 | + |
| SEQ ID NO 16012 | AGCCAACAGATTTTCAACAA | AGG | chr12 | 21594951 | 21594970 | 21594967 | + |
| SEQ ID NO 16013 | AGATTTTCAACAAAGGTGAC | AAG | chr12 | 21594958 | 21594977 | 21594974 | + |
| SEQ ID NO 16014 | AGGTGACAAGAATATACATT | GAG | chr12 | 21594971 | 21594990 | 21594987 | + |

Figure 43 (Cont'd)

| SEQ ID NO 16015 | GGTGACAAGAATATACATTG | AGG | chr12 | 21594972 | 21594991 | 21594988 | + |
| SEQ ID NO 16016 | ACAAGAATATACATTGAGGA | AAG | chr12 | 21594976 | 21594995 | 21594992 | + |
| SEQ ID NO 16017 | CAAGAATATACATTGAGGAA | AGG | chr12 | 21594977 | 21594996 | 21594993 | + |
| SEQ ID NO 16018 | TATACATTGAGGAAAGGACA | CAG | chr12 | 21594983 | 21595002 | 21594999 | + |
| SEQ ID NO 16019 | GAGGAAAGGACACAGTGTTC | AAG | chr12 | 21594991 | 21595010 | 21595007 | + |
| SEQ ID NO 16020 | AGGACACAGTGTTCAAGAAA | TGG | chr12 | 21594997 | 21595016 | 21595013 | + |
| SEQ ID NO 16021 | AGAAATGGTGCTGAAAAAAT | TGG | chr12 | 21595012 | 21595031 | 21595028 | + |
| SEQ ID NO 16022 | TGAAAAAATTGGATATCCAT | TGG | chr12 | 21595023 | 21595042 | 21595039 | + |
| SEQ ID NO 16023 | CATTGGATATCCATGTGCAA | AAG | chr12 | 21595040 | 21595059 | 21595056 | + |
| SEQ ID NO 16024 | CATGTGCAAAAGAATAAAAC | TGG | chr12 | 21595051 | 21595070 | 21595067 | + |
| SEQ ID NO 16025 | ATAAAACTGGACTGCTGATA | TGG | chr12 | 21595064 | 21595083 | 21595080 | + |
| SEQ ID NO 16026 | ACTGGACTGCTGATATGGTT | TGG | chr12 | 21595069 | 21595088 | 21595085 | + |
| SEQ ID NO 16027 | AAATATAATCCCCAACTTCT | CAG | chr12 | 21595120 | 21595139 | 21595136 | + |
| SEQ ID NO 16028 | AATATAATCCCCAACTTCTC | AGG | chr12 | 21595121 | 21595140 | 21595137 | + |
| SEQ ID NO 16029 | TCCCCAACTTCTCAGGATCT | TGG | chr12 | 21595128 | 21595147 | 21595144 | + |
| SEQ ID NO 16030 | CCAACTTCTCAGGATCTTGG | CGG | chr12 | 21595131 | 21595150 | 21595147 | + |
| SEQ ID NO 16031 | CTTCTCAGGATCTTGGCGGA | TGG | chr12 | 21595135 | 21595154 | 21595151 | + |
| SEQ ID NO 16032 | TTCTCAGGATCTTGGCGGAT | GGG | chr12 | 21595136 | 21595155 | 21595152 | + |
| SEQ ID NO 16033 | CTCAGGATCTTGGCGGATGG | GAG | chr12 | 21595138 | 21595157 | 21595154 | + |
| SEQ ID NO 16034 | TCAGGATCTTGGCGGATGGG | AGG | chr12 | 21595139 | 21595158 | 21595155 | + |
| SEQ ID NO 16035 | GGATCTTGGCGGATGGGAGG | TAG | chr12 | 21595142 | 21595161 | 21595158 | + |
| SEQ ID NO 16036 | GATCTTGGCGGATGGGAGGT | AGG | chr12 | 21595143 | 21595162 | 21595159 | + |
| SEQ ID NO 16037 | TGGCGGATGGGAGGTAGGCC | TAG | chr12 | 21595148 | 21595167 | 21595164 | + |
| SEQ ID NO 16038 | TGGGAGGTAGGCCTAGATTG | CAG | chr12 | 21595155 | 21595174 | 21595171 | + |
| SEQ ID NO 16039 | CCTAGATTGCAGCTCCAACT | CAG | chr12 | 21595166 | 21595185 | 21595182 | + |
| SEQ ID NO 16040 | GATTGCAGCTCCAACTCAGA | TGG | chr12 | 21595170 | 21595189 | 21595186 | + |
| SEQ ID NO 16041 | GCAGCTCCAACTCAGATGGA | CAG | chr12 | 21595174 | 21595193 | 21595190 | + |
| SEQ ID NO 16042 | AGCTCCAACTCAGATGGACA | GAG | chr12 | 21595176 | 21595195 | 21595192 | + |
| SEQ ID NO 16043 | TCCAACTCAGATGGACAGAG | CAG | chr12 | 21595179 | 21595198 | 21595195 | + |
| SEQ ID NO 16044 | CAGATGGACAGAGCAGCATG | TGG | chr12 | 21595186 | 21595205 | 21595202 | + |
| SEQ ID NO 16045 | GATGGACAGAGCAGCATGTG | GAG | chr12 | 21595188 | 21595207 | 21595204 | + |
| SEQ ID NO 16046 | ATGGACAGAGCAGCATGTGG | AGG | chr12 | 21595189 | 21595208 | 21595205 | + |
| SEQ ID NO 16047 | GAGGCTCGCATTGTGAATTT | TAG | chr12 | 21595208 | 21595227 | 21595224 | + |
| SEQ ID NO 16048 | CGCATTGTGAATTTTAGCTG | CAG | chr12 | 21595214 | 21595233 | 21595230 | + |
| SEQ ID NO 16049 | TTGTGAATTTTAGCTGCAGA | TAG | chr12 | 21595218 | 21595237 | 21595234 | + |
| SEQ ID NO 16050 | TTTAGCTGCAGATAGACTGC | AAG | chr12 | 21595226 | 21595245 | 21595242 | + |
| SEQ ID NO 16051 | GATAGACTGCAAGAACAAAC | CAG | chr12 | 21595236 | 21595255 | 21595252 | + |
| SEQ ID NO 16052 | AAGAACAAACCAGCAATCCT | GAG | chr12 | 21595246 | 21595265 | 21595262 | + |
| SEQ ID NO 16053 | GAACAAACCAGCAATCCTGA | GAG | chr12 | 21595248 | 21595267 | 21595264 | + |
| SEQ ID NO 16054 | AACAAACCAGCAATCCTGAG | AGG | chr12 | 21595249 | 21595268 | 21595265 | + |
| SEQ ID NO 16055 | AGCAATCCTGAGAGGACCCA | CAG | chr12 | 21595257 | 21595276 | 21595273 | + |
| SEQ ID NO 16056 | GAGGACCCACAGACCCTCTG | AAG | chr12 | 21595268 | 21595287 | 21595284 | + |
| SEQ ID NO 16057 | AGGACCCACAGACCCTCTGA | AGG | chr12 | 21595269 | 21595288 | 21595285 | + |
| SEQ ID NO 16058 | ACCCACAGACCCTCTGAAGG | AAG | chr12 | 21595272 | 21595291 | 21595288 | + |
| SEQ ID NO 16059 | CACAGACCCTCTGAAGGAAG | TAG | chr12 | 21595275 | 21595294 | 21595291 | + |
| SEQ ID NO 16060 | AAGGAAGTAGATTGCTCCTG | CAG | chr12 | 21595288 | 21595307 | 21595304 | + |
| SEQ ID NO 16061 | AGGAAGTAGATTGCTCCTGC | AGG | chr12 | 21595289 | 21595308 | 21595305 | + |

Figure 43 (Cont'd)

| | | | | | | | | |
|---|---|---|---|---|---|---|---|---|
| SEQ ID NO 16062 | TAGATTGCTCCTGCAGGACC | CAG | chr12 | 21595295 | 21595314 | 21595311 | + |
| SEQ ID NO 16063 | AGATTGCTCCTGCAGGACCC | AGG | chr12 | 21595296 | 21595315 | 21595312 | + |
| SEQ ID NO 16064 | ATTGCTCCTGCAGGACCCAG | GAG | chr12 | 21595298 | 21595317 | 21595314 | + |
| SEQ ID NO 16065 | GGAGACACCCCAAATACTGT | GAG | chr12 | 21595317 | 21595336 | 21595333 | + |
| SEQ ID NO 16066 | TACTGTGAGTGCCCCAACTG | CGG | chr12 | 21595331 | 21595350 | 21595347 | + |
| SEQ ID NO 16067 | TGTGAGTGCCCCAACTGCGG | AAG | chr12 | 21595334 | 21595353 | 21595350 | + |
| SEQ ID NO 16068 | GAGTGCCCCAACTGCGGAAG | TGG | chr12 | 21595337 | 21595356 | 21595353 | + |
| SEQ ID NO 16069 | AGTGCCCCAACTGCGGAAGT | GGG | chr12 | 21595338 | 21595357 | 21595354 | + |
| SEQ ID NO 16070 | CCCCAACTGCGGAAGTGGGA | AAG | chr12 | 21595342 | 21595361 | 21595358 | + |
| SEQ ID NO 16071 | CCCAACTGCGGAAGTGGGAA | AGG | chr12 | 21595343 | 21595362 | 21595359 | + |
| SEQ ID NO 16072 | CCAACTGCGGAAGTGGGAAA | GGG | chr12 | 21595344 | 21595363 | 21595360 | + |
| SEQ ID NO 16073 | AACTGCGGAAGTGGGAAGG | GAG | chr12 | 21595346 | 21595365 | 21595362 | + |
| SEQ ID NO 16074 | TCCTAAACACACTCCCAC | TGG | chr12 | 21595378 | 21595397 | 21595394 | + |
| SEQ ID NO 16075 | CTAAACACACTCCCACTG | GAG | chr12 | 21595380 | 21595399 | 21595396 | + |
| SEQ ID NO 16076 | CACTCCCACTGGAGAAACTG | AAG | chr12 | 21595389 | 21595408 | 21595405 | + |
| SEQ ID NO 16077 | ACTCCCACTGGAGAAACTGA | AGG | chr12 | 21595390 | 21595409 | 21595406 | + |
| SEQ ID NO 16078 | AGAAACTGAAGGTCTGTTTG | TGG | chr12 | 21595401 | 21595420 | 21595417 | + |
| SEQ ID NO 16079 | GAAACTGAAGGTCTGTTTGT | GGG | chr12 | 21595402 | 21595421 | 21595418 | + |
| SEQ ID NO 16080 | AACTGAAGGTCTGTTTGTGG | GAG | chr12 | 21595404 | 21595423 | 21595420 | + |
| SEQ ID NO 16081 | TGAAGGTCTGTTTGTGGGAG | AAG | chr12 | 21595407 | 21595426 | 21595423 | + |
| SEQ ID NO 16082 | GAGAAGTTTCTGACCTTACC | TGG | chr12 | 21595424 | 21595443 | 21595440 | + |
| SEQ ID NO 16083 | GAAGTTTCTGACCTTACCTG | GAG | chr12 | 21595426 | 21595445 | 21595442 | + |
| SEQ ID NO 16084 | TTCTGACCTTACCTGGAGTT | GAG | chr12 | 21595431 | 21595450 | 21595447 | + |
| SEQ ID NO 16085 | TACCTGGAGTTGAGTTAACT | TAG | chr12 | 21595440 | 21595459 | 21595456 | + |
| SEQ ID NO 16086 | CCTGGAGTTGAGTTAACTTA | GAG | chr12 | 21595442 | 21595461 | 21595458 | + |
| SEQ ID NO 16087 | TGGAGTTGAGTTAACTTAGA | GAG | chr12 | 21595444 | 21595463 | 21595460 | + |
| SEQ ID NO 16088 | TTGAGTTAACTTAGAGAGCT | GAG | chr12 | 21595449 | 21595468 | 21595465 | + |
| SEQ ID NO 16089 | TTAGAGAGCTGAGCAAAATA | CAG | chr12 | 21595459 | 21595478 | 21595475 | + |
| SEQ ID NO 16090 | TAGAGAGCTGAGCAAAATAC | AGG | chr12 | 21595460 | 21595479 | 21595476 | + |
| SEQ ID NO 16091 | AGCTGAGCAAAATACAGGTG | TAG | chr12 | 21595465 | 21595484 | 21595481 | + |
| SEQ ID NO 16092 | CTGAGCAAAATACAGGTGTA | GAG | chr12 | 21595467 | 21595486 | 21595483 | + |
| SEQ ID NO 16093 | TGAGCAAAATACAGGTGTAG | AGG | chr12 | 21595468 | 21595487 | 21595484 | + |
| SEQ ID NO 16094 | GCAAAATACAGGTGTAGAGG | AAG | chr12 | 21595471 | 21595490 | 21595487 | + |
| SEQ ID NO 16095 | AAATACAGGTGTAGAGGAAG | CAG | chr12 | 21595474 | 21595493 | 21595490 | + |
| SEQ ID NO 16096 | ACAGGTGTAGAGGAAGCAGT | GAG | chr12 | 21595478 | 21595497 | 21595494 | + |
| SEQ ID NO 16097 | GTGTAGAGGAAGCAGTGAGA | AAG | chr12 | 21595482 | 21595501 | 21595498 | + |
| SEQ ID NO 16098 | TGTAGAGGAAGCAGTGAGAA | AGG | chr12 | 21595483 | 21595502 | 21595499 | + |
| SEQ ID NO 16099 | GGAAGCAGTGAGAAAGGCCC | TGG | chr12 | 21595489 | 21595508 | 21595505 | + |
| SEQ ID NO 16100 | GAAGCAGTGAGAAAGGCCCT | GGG | chr12 | 21595490 | 21595509 | 21595506 | + |
| SEQ ID NO 16101 | AGCAGTGAGAAAGGCCCTGG | GAG | chr12 | 21595492 | 21595511 | 21595508 | + |
| SEQ ID NO 16102 | GAAAGGCCCTGGGAGCTCAC | TGG | chr12 | 21595500 | 21595519 | 21595516 | + |
| SEQ ID NO 16103 | AAAGGCCCTGGGAGCTCACT | GGG | chr12 | 21595501 | 21595520 | 21595517 | + |
| SEQ ID NO 16104 | TGGGAGCTCACTGGGTCCCT | GAG | chr12 | 21595509 | 21595528 | 21595525 | + |
| SEQ ID NO 16105 | GAGCTCACTGGGTCCCTGAG | CAG | chr12 | 21595512 | 21595531 | 21595528 | + |
| SEQ ID NO 16106 | AGCTCACTGGGTCCCTGAGC | AGG | chr12 | 21595513 | 21595532 | 21595529 | + |
| SEQ ID NO 16107 | CTGAGCAGGCCATTCCTGCC | TGG | chr12 | 21595527 | 21595546 | 21595543 | + |
| SEQ ID NO 16108 | CAGGCCATTCCTGCCTGGCA | TAG | chr12 | 21595532 | 21595551 | 21595548 | + |

Figure 43 (Cont'd)

| | | | | | | | |
|---|---|---|---|---|---|---|---|
| SEQ ID NO 16109 | CCATTCCTGCCTGGCATAGC | CAG | chr12 | 21595536 | 21595555 | 21595552 | + |
| SEQ ID NO 16110 | CATTCCTGCCTGGCATAGCC | AGG | chr12 | 21595537 | 21595556 | 21595553 | + |
| SEQ ID NO 16111 | TTACTAACATTGAATGTAAA | TGG | chr12 | 21595568 | 21595587 | 21595584 | + |
| SEQ ID NO 16112 | GGCCTAAATGCTCCACTTAA | AAG | chr12 | 21595589 | 21595608 | 21595605 | + |
| SEQ ID NO 16113 | GCCTAAATGCTCCACTTAAA | AGG | chr12 | 21595590 | 21595609 | 21595606 | + |
| SEQ ID NO 16114 | CCTAAATGCTCCACTTAAAA | GGG | chr12 | 21595591 | 21595610 | 21595607 | + |
| SEQ ID NO 16115 | CTCCACTTAAAAGGGTGAAA | AAG | chr12 | 21595599 | 21595618 | 21595615 | + |
| SEQ ID NO 16116 | TCCACTTAAAAGGGTGAAAA | AGG | chr12 | 21595600 | 21595619 | 21595616 | + |
| SEQ ID NO 16117 | AAAAAGGTATTTCATGCAAA | TGG | chr12 | 21595616 | 21595635 | 21595632 | + |
| SEQ ID NO 16118 | TTCATGCAAATGGCCACCAA | AAG | chr12 | 21595626 | 21595645 | 21595642 | + |
| SEQ ID NO 16119 | TGCAAATGGCCACCAAAAGT | GAG | chr12 | 21595630 | 21595649 | 21595646 | + |
| SEQ ID NO 16120 | AAATGGCCACCAAAAGTGAG | TAG | chr12 | 21595633 | 21595652 | 21595649 | + |
| SEQ ID NO 16121 | AATGGCCACCAAAAGTGAGT | AGG | chr12 | 21595634 | 21595653 | 21595650 | + |
| SEQ ID NO 16122 | AGTAGGCAAAACAAACTTTA | AAG | chr12 | 21595651 | 21595670 | 21595667 | + |
| SEQ ID NO 16123 | CAAAACAAACTTTAAAGCAA | CAG | chr12 | 21595657 | 21595676 | 21595673 | + |
| SEQ ID NO 16124 | AACAAACTTTAAAGCAACAG | CAG | chr12 | 21595660 | 21595679 | 21595676 | + |
| SEQ ID NO 16125 | TTTAAAGCAACAGCAGTTAA | AAG | chr12 | 21595667 | 21595686 | 21595683 | + |
| SEQ ID NO 16126 | TAAAGCAACAGCAGTTAAAA | GAG | chr12 | 21595669 | 21595688 | 21595685 | + |
| SEQ ID NO 16127 | AACAGCAGTTAAAAGAGACA | AAG | chr12 | 21595675 | 21595694 | 21595691 | + |
| SEQ ID NO 16128 | CAGCAGTTAAAAGAGACAAA | GAG | chr12 | 21595677 | 21595696 | 21595693 | + |
| SEQ ID NO 16129 | AGCAGTTAAAAGAGACAAAG | AGG | chr12 | 21595678 | 21595697 | 21595694 | + |
| SEQ ID NO 16130 | GCAGTTAAAAGAGACAAAGA | GGG | chr12 | 21595679 | 21595698 | 21595695 | + |
| SEQ ID NO 16131 | CAAAGAGGGACATTATATAA | TGG | chr12 | 21595693 | 21595712 | 21595709 | + |
| SEQ ID NO 16132 | GGGACATTATATAATGGTAA | AAG | chr12 | 21595699 | 21595718 | 21595715 | + |
| SEQ ID NO 16133 | GGACATTATATAATGGTAAA | AGG | chr12 | 21595700 | 21595719 | 21595716 | + |
| SEQ ID NO 16134 | TGGTAAAAGGCCTTGTCCAA | CAG | chr12 | 21595713 | 21595732 | 21595729 | + |
| SEQ ID NO 16135 | GGTAAAAGGCCTTGTCCAAC | AGG | chr12 | 21595714 | 21595733 | 21595730 | + |
| SEQ ID NO 16136 | AACATATATGCACCTAACAC | TGG | chr12 | 21595754 | 21595773 | 21595770 | + |
| SEQ ID NO 16137 | CATATATGCACCTAACACTG | GAG | chr12 | 21595756 | 21595775 | 21595772 | + |
| SEQ ID NO 16138 | CACTGGAGCTCCCAAATTTA | TAG | chr12 | 21595771 | 21595790 | 21595787 | + |
| SEQ ID NO 16139 | ATTTATAGAACAATTACTAA | TAG | chr12 | 21595786 | 21595805 | 21595802 | + |
| SEQ ID NO 16140 | GAACAATTACTAATAGACCT | AAG | chr12 | 21595793 | 21595812 | 21595809 | + |
| SEQ ID NO 16141 | TACTAATAGACCTAAGAAAT | GAG | chr12 | 21595800 | 21595819 | 21595816 | + |
| SEQ ID NO 16142 | AATAGACCTAAGAAATGAGA | TAG | chr12 | 21595804 | 21595823 | 21595820 | + |
| SEQ ID NO 16143 | GACCTAAGAAATGAGATAGA | CAG | chr12 | 21595808 | 21595827 | 21595824 | + |
| SEQ ID NO 16144 | GATAGACAGCAACACAATAA | TAG | chr12 | 21595822 | 21595841 | 21595838 | + |
| SEQ ID NO 16145 | AGACAGCAACACAATAATAG | TGG | chr12 | 21595825 | 21595844 | 21595841 | + |
| SEQ ID NO 16146 | GACAGCAACACAATAATAGT | GGG | chr12 | 21595826 | 21595845 | 21595842 | + |
| SEQ ID NO 16147 | ACAGCAACACAATAATAGTG | GGG | chr12 | 21595827 | 21595846 | 21595843 | + |
| SEQ ID NO 16148 | CAGCAACACAATAATAGTGG | GGG | chr12 | 21595828 | 21595847 | 21595844 | + |
| SEQ ID NO 16149 | GGACTTCAATACTTCATTGA | CAG | chr12 | 21595849 | 21595868 | 21595865 | + |
| SEQ ID NO 16150 | CAATACTTCATTGACAGCAC | TAG | chr12 | 21595855 | 21595874 | 21595871 | + |
| SEQ ID NO 16151 | ACTTCATTGACAGCACTAGA | CAG | chr12 | 21595859 | 21595878 | 21595875 | + |
| SEQ ID NO 16152 | ACAGCACTAGACAGTTCATC | AAG | chr12 | 21595868 | 21595887 | 21595884 | + |
| SEQ ID NO 16153 | CACTAGACAGTTCATCAAGA | CAG | chr12 | 21595872 | 21595891 | 21595888 | + |
| SEQ ID NO 16154 | AGACAGTTCATCAAGACAGA | AAG | chr12 | 21595876 | 21595895 | 21595892 | + |
| SEQ ID NO 16155 | GAAAGTCAACAAAAAAATAA | TGG | chr12 | 21595894 | 21595913 | 21595910 | + |

Figure 43 (Cont'd)

| SEQ ID NO 16156 | AATGGATTTAAATTATACCT | TAG | chr12 | 21595912 | 21595931 | 21595928 | + |
| SEQ ID NO 16157 | AAATTATACCTTAGAACAAA | TGG | chr12 | 21595921 | 21595940 | 21595937 | + |
| SEQ ID NO 16158 | CTTAGAACAAATGGACTTAA | CAG | chr12 | 21595930 | 21595949 | 21595946 | + |
| SEQ ID NO 16159 | ATGGACTTAACAGTTATATA | CAG | chr12 | 21595940 | 21595959 | 21595956 | + |
| SEQ ID NO 16160 | AACATTTCATCCAATAACCA | CAG | chr12 | 21595963 | 21595982 | 21595979 | + |
| SEQ ID NO 16161 | AGAACACACATTCTATTCAA | CAG | chr12 | 21595984 | 21596003 | 21596000 | + |
| SEQ ID NO 16162 | ACATTCTATTCAACAGCGCG | TGG | chr12 | 21595991 | 21596010 | 21596007 | + |
| SEQ ID NO 16163 | CAGCGCGTGGAAATTTCTCC | AAG | chr12 | 21596004 | 21596023 | 21596020 | + |
| SEQ ID NO 16164 | AGCGCGTGGAAATTTCTCCA | AGG | chr12 | 21596005 | 21596024 | 21596021 | + |
| SEQ ID NO 16165 | GCGTGGAAATTTCTCCAAGG | TAG | chr12 | 21596008 | 21596027 | 21596024 | + |
| SEQ ID NO 16166 | CTCCAAGGTAGACCATATGA | TAG | chr12 | 21596020 | 21596039 | 21596036 | + |
| SEQ ID NO 16167 | TCCAAGGTAGACCATATGAT | AGG | chr12 | 21596021 | 21596040 | 21596037 | + |
| SEQ ID NO 16168 | CATATGATAGGCCATGAAAT | GAG | chr12 | 21596033 | 21596052 | 21596049 | + |
| SEQ ID NO 16169 | AGCCTCAATAAATTTACTAA | CAG | chr12 | 21596054 | 21596073 | 21596070 | + |
| SEQ ID NO 16170 | TTTACTAACAGACCAATAAC | AAG | chr12 | 21596066 | 21596085 | 21596082 | + |
| SEQ ID NO 16171 | ACTAACAGACCAATAACAAG | CAG | chr12 | 21596069 | 21596088 | 21596085 | + |
| SEQ ID NO 16172 | ACAGACCAATAACAAGCAGT | GAG | chr12 | 21596073 | 21596092 | 21596089 | + |
| SEQ ID NO 16173 | AACAAGCAGTGAGATTTAAT | TGG | chr12 | 21596083 | 21596102 | 21596099 | + |
| SEQ ID NO 16174 | AAAAATTACCAACCAAAAAA | AAG | chr12 | 21596112 | 21596131 | 21596128 | + |
| SEQ ID NO 16175 | TTACCAACCAAAAAAAGTT | CAG | chr12 | 21596117 | 21596136 | 21596133 | + |
| SEQ ID NO 16176 | TACCAACCAAAAAAAGTTC | AGG | chr12 | 21596118 | 21596137 | 21596134 | + |
| SEQ ID NO 16177 | ACCAAAAAAAGTTCAGGAC | CAG | chr12 | 21596123 | 21596142 | 21596139 | + |
| SEQ ID NO 16178 | AAAAAAAGTTCAGGACCAGA | TGG | chr12 | 21596127 | 21596146 | 21596143 | + |
| SEQ ID NO 16179 | AGGACCAGATGGATTCACAA | CAG | chr12 | 21596138 | 21596157 | 21596154 | + |
| SEQ ID NO 16180 | GATTCACAACAGAATTCTAC | TAG | chr12 | 21596149 | 21596168 | 21596165 | + |
| SEQ ID NO 16181 | AGAATTCTACTAGACATTCA | AAG | chr12 | 21596159 | 21596178 | 21596175 | + |
| SEQ ID NO 16182 | AATTCTACTAGACATTCAAA | GAG | chr12 | 21596161 | 21596180 | 21596177 | + |
| SEQ ID NO 16183 | ATTCTACTAGACATTCAAAG | AGG | chr12 | 21596162 | 21596181 | 21596178 | + |
| SEQ ID NO 16184 | CTAGACATTCAAAGAGGAAT | TGG | chr12 | 21596168 | 21596187 | 21596184 | + |
| SEQ ID NO 16185 | TCTTTTTGACACTATTCTAC | AAG | chr12 | 21596197 | 21596216 | 21596213 | + |
| SEQ ID NO 16186 | TTTGACACTATTCTACAAGA | CAG | chr12 | 21596201 | 21596220 | 21596217 | + |
| SEQ ID NO 16187 | ACTATTCTACAAGACAGATA | AAG | chr12 | 21596207 | 21596226 | 21596223 | + |
| SEQ ID NO 16188 | ATTCTACAAGACAGATAAAG | AAG | chr12 | 21596210 | 21596229 | 21596226 | + |
| SEQ ID NO 16189 | TTCTACAAGACAGATAAAGA | AGG | chr12 | 21596211 | 21596230 | 21596227 | + |
| SEQ ID NO 16190 | CTGCCCTAATTCATTCTATG | AAG | chr12 | 21596237 | 21596256 | 21596253 | + |
| SEQ ID NO 16191 | CCTAATTCATTCTATGAAGC | CAG | chr12 | 21596241 | 21596260 | 21596257 | + |
| SEQ ID NO 16192 | AGCCAGCATCACACCAAAAC | CAG | chr12 | 21596258 | 21596277 | 21596274 | + |
| SEQ ID NO 16193 | GCCAGCATCACACCAAAACC | AGG | chr12 | 21596259 | 21596278 | 21596275 | + |
| SEQ ID NO 16194 | CCAGCATCACACCAAAACCA | GGG | chr12 | 21596260 | 21596279 | 21596276 | + |
| SEQ ID NO 16195 | GCATCACACCAAAACCAGGG | AAG | chr12 | 21596263 | 21596282 | 21596279 | + |
| SEQ ID NO 16196 | CATCACACCAAAACCAGGGA | AGG | chr12 | 21596264 | 21596283 | 21596280 | + |
| SEQ ID NO 16197 | AGGGAAGGACATAACCAAAA | AAG | chr12 | 21596279 | 21596298 | 21596295 | + |
| SEQ ID NO 16198 | ATAACCAAAAAGAAAACTA | CAG | chr12 | 21596289 | 21596308 | 21596305 | + |
| SEQ ID NO 16199 | AAAAGAAAACTACAGACTGA | TAG | chr12 | 21596297 | 21596316 | 21596313 | + |
| SEQ ID NO 16200 | ACTGATAGCCTTGATGAACA | TAG | chr12 | 21596312 | 21596331 | 21596328 | + |
| SEQ ID NO 16201 | TAAAATCCTTAACAAAATAC | TAG | chr12 | 21596339 | 21596358 | 21596355 | + |
| SEQ ID NO 16202 | AAATTCAACAACATAACAAA | AAG | chr12 | 21596368 | 21596387 | 21596384 | + |

Figure 43 (Cont'd)

| | | | | | | | |
|---|---|---|---|---|---|---|---|
| SEQ ID NO 16203 | AAAGATAATCCACCATGATC | AAG | chr12 | 21596387 | 21596406 | 21596403 | + |
| SEQ ID NO 16204 | GATAATCCACCATGATCAAG | CAG | chr12 | 21596390 | 21596409 | 21596406 | + |
| SEQ ID NO 16205 | ATAATCCACCATGATCAAGC | AGG | chr12 | 21596391 | 21596410 | 21596407 | + |
| SEQ ID NO 16206 | TGATCAAGCAGGTTCCATGC | CAG | chr12 | 21596402 | 21596421 | 21596418 | + |
| SEQ ID NO 16207 | GATCAAGCAGGTTCCATGCC | AGG | chr12 | 21596403 | 21596422 | 21596419 | + |
| SEQ ID NO 16208 | ATCAAGCAGGTTCCATGCCA | GGG | chr12 | 21596404 | 21596423 | 21596420 | + |
| SEQ ID NO 16209 | CAGGTTCCATGCCAGGGATG | CAG | chr12 | 21596410 | 21596429 | 21596426 | + |
| SEQ ID NO 16210 | AGGTTCCATGCCAGGGATGC | AGG | chr12 | 21596411 | 21596430 | 21596427 | + |
| SEQ ID NO 16211 | GGTTCCATGCCAGGGATGCA | GGG | chr12 | 21596412 | 21596431 | 21596428 | + |
| SEQ ID NO 16212 | CCATGCCAGGGATGCAGGGT | TGG | chr12 | 21596416 | 21596435 | 21596432 | + |
| SEQ ID NO 16213 | AGGGTTGGTTTGACATCTGC | AAG | chr12 | 21596431 | 21596450 | 21596447 | + |
| SEQ ID NO 16214 | TTTGACATCTGCAAGTCAAT | AAG | chr12 | 21596439 | 21596458 | 21596455 | + |
| SEQ ID NO 16215 | AGTGTGATACACCACATAAA | CAG | chr12 | 21596460 | 21596479 | 21596476 | + |
| SEQ ID NO 16216 | AAATTACATGATCATCTCAA | TAG | chr12 | 21596495 | 21596514 | 21596511 | + |
| SEQ ID NO 16217 | CATGATCATCTCAATAGATG | CAG | chr12 | 21596501 | 21596520 | 21596517 | + |
| SEQ ID NO 16218 | CATCTCAATAGATGCAGAAA | AAG | chr12 | 21596507 | 21596526 | 21596523 | + |
| SEQ ID NO 16219 | AAAAAGCATTCAACAAAATC | CAG | chr12 | 21596524 | 21596543 | 21596540 | + |
| SEQ ID NO 16220 | ACATTTATGATTAAAATGCT | CAG | chr12 | 21596550 | 21596569 | 21596566 | + |
| SEQ ID NO 16221 | ATTAAAATGCTCAGCAAAAT | CAG | chr12 | 21596559 | 21596578 | 21596575 | + |
| SEQ ID NO 16222 | GCTCAGCAAAATCAGCATAC | AAG | chr12 | 21596567 | 21596586 | 21596583 | + |
| SEQ ID NO 16223 | TCAGCAAAATCAGCATACAA | GAG | chr12 | 21596569 | 21596588 | 21596585 | + |
| SEQ ID NO 16224 | AGCATACAAGAGACATACCT | CAG | chr12 | 21596580 | 21596599 | 21596596 | + |
| SEQ ID NO 16225 | GACATACCTCAGTGTAATAA | AAG | chr12 | 21596591 | 21596610 | 21596607 | + |
| SEQ ID NO 16226 | AGCCATCTGTGACAAACCCA | CAG | chr12 | 21596612 | 21596631 | 21596628 | + |
| SEQ ID NO 16227 | ACAGCCAACATAATATTGAA | TGG | chr12 | 21596631 | 21596650 | 21596647 | + |
| SEQ ID NO 16228 | CAGCCAACATAATATTGAAT | GGG | chr12 | 21596632 | 21596651 | 21596648 | + |
| SEQ ID NO 16229 | AGCCAACATAATATTGAATG | GGG | chr12 | 21596633 | 21596652 | 21596649 | + |
| SEQ ID NO 16230 | ACATAATATTGAATGGGGAA | AAG | chr12 | 21596638 | 21596657 | 21596654 | + |
| SEQ ID NO 16231 | ATTGAATGGGGAAAAGTTGA | AAG | chr12 | 21596645 | 21596664 | 21596661 | + |
| SEQ ID NO 16232 | AAGTTGAAAGCATTCCTCT | GAG | chr12 | 21596658 | 21596677 | 21596674 | + |
| SEQ ID NO 16233 | AAAGCATTCCTCTGAGAAC | TGG | chr12 | 21596664 | 21596683 | 21596680 | + |
| SEQ ID NO 16234 | TTCCCTCTGAGAACTGGAAC | AAG | chr12 | 21596670 | 21596689 | 21596686 | + |
| SEQ ID NO 16235 | TCTGAGAACTGGAACAAGAC | AAG | chr12 | 21596675 | 21596694 | 21596691 | + |
| SEQ ID NO 16236 | CTGAGAACTGGAACAAGACA | AGG | chr12 | 21596676 | 21596695 | 21596692 | + |
| SEQ ID NO 16237 | CTCACCACTCCTCTTCAACA | TAG | chr12 | 21596708 | 21596727 | 21596724 | + |
| SEQ ID NO 16238 | ACTCCTCTTCAACATAGTAC | TGG | chr12 | 21596714 | 21596733 | 21596730 | + |
| SEQ ID NO 16239 | CCTCTTCAACATAGTACTGG | AAG | chr12 | 21596717 | 21596736 | 21596733 | + |
| SEQ ID NO 16240 | CAACATAGTACTGGAAGTCC | TAG | chr12 | 21596723 | 21596742 | 21596739 | + |
| SEQ ID NO 16241 | ATAGTACTGGAAGTCCTAGC | CAG | chr12 | 21596727 | 21596746 | 21596743 | + |
| SEQ ID NO 16242 | TAGTACTGGAAGTCCTAGCC | AGG | chr12 | 21596728 | 21596747 | 21596744 | + |
| SEQ ID NO 16243 | AGTACTGGAAGTCCTAGCCA | GGG | chr12 | 21596729 | 21596748 | 21596745 | + |
| SEQ ID NO 16244 | GAAGTCCTAGCCAGGGCAAT | CAG | chr12 | 21596736 | 21596755 | 21596752 | + |
| SEQ ID NO 16245 | CAGGGCAATCAGACAAAACA | AAG | chr12 | 21596747 | 21596766 | 21596763 | + |
| SEQ ID NO 16246 | TCAGACAAACAAAGAAATA | AAG | chr12 | 21596755 | 21596774 | 21596771 | + |
| SEQ ID NO 16247 | CAGACAAAACAAAGAAATAA | AGG | chr12 | 21596756 | 21596775 | 21596772 | + |
| SEQ ID NO 16248 | AGACAAAACAAAGAAATAAA | GGG | chr12 | 21596757 | 21596776 | 21596773 | + |
| SEQ ID NO 16249 | GAAATAAAGGGCATTCAAAT | CAG | chr12 | 21596769 | 21596788 | 21596785 | + |

Figure 43 (Cont'd)

| | | | | | | | |
|---|---|---|---|---|---|---|---|
| SEQ ID NO 16250 | AAAGGGCATTCAAATCAGTA | AAG | chr12 | 21596774 | 21596793 | 21596790 | + |
| SEQ ID NO 16251 | AGGGCATTCAAATCAGTAAA | GAG | chr12 | 21596776 | 21596795 | 21596792 | + |
| SEQ ID NO 16252 | GGGCATTCAAATCAGTAAAG | AGG | chr12 | 21596777 | 21596796 | 21596793 | + |
| SEQ ID NO 16253 | CATTCAAATCAGTAAAGAGG | AAG | chr12 | 21596780 | 21596799 | 21596796 | + |
| SEQ ID NO 16254 | CATTTACCTTTAAAACCCTA | AAG | chr12 | 21596834 | 21596853 | 21596850 | + |
| SEQ ID NO 16255 | TAAAACCCTAAAGACTCCTC | CAG | chr12 | 21596844 | 21596863 | 21596860 | + |
| SEQ ID NO 16256 | ACCCTAAAGACTCCTCCAGA | AAG | chr12 | 21596848 | 21596867 | 21596864 | + |
| SEQ ID NO 16257 | AGACTCCTCCAGAAAGCTCC | TAG | chr12 | 21596855 | 21596874 | 21596871 | + |
| SEQ ID NO 16258 | CTAGAACTGATAAAATAATT | CAG | chr12 | 21596874 | 21596893 | 21596890 | + |
| SEQ ID NO 16259 | ACTGATAAAATAATTCAGCA | AAG | chr12 | 21596879 | 21596898 | 21596895 | + |
| SEQ ID NO 16260 | AAATAATTCAGCAAAGTTTC | CAG | chr12 | 21596886 | 21596905 | 21596902 | + |
| SEQ ID NO 16261 | TCAGCAAAGTTTCCAGATAC | AAG | chr12 | 21596893 | 21596912 | 21596909 | + |
| SEQ ID NO 16262 | CAAGATGAATGCACACAAAT | CAG | chr12 | 21596912 | 21596931 | 21596928 | + |
| SEQ ID NO 16263 | GTAACTCTTCTATACACCAA | CAG | chr12 | 21596934 | 21596953 | 21596950 | + |
| SEQ ID NO 16264 | ATACACCAACAGCAACCAAA | TGG | chr12 | 21596945 | 21596964 | 21596961 | + |
| SEQ ID NO 16265 | ACACCAACAGCAACCAAATG | GAG | chr12 | 21596947 | 21596966 | 21596963 | + |
| SEQ ID NO 16266 | ACCAAATGGAGAATCAAATC | AAG | chr12 | 21596959 | 21596978 | 21596975 | + |
| SEQ ID NO 16267 | GAACTCAACCCCTTGTACAA | TAG | chr12 | 21596981 | 21597000 | 21596997 | + |
| SEQ ID NO 16268 | TTGTACAATAGATGCAAAAA | TGG | chr12 | 21596993 | 21597012 | 21597009 | + |
| SEQ ID NO 16269 | GCCATATAAAACGTACTCTC | AAG | chr12 | 21597038 | 21597057 | 21597054 | + |
| SEQ ID NO 16270 | TATAAAACGTACTCTCAAGA | TGG | chr12 | 21597042 | 21597061 | 21597058 | + |
| SEQ ID NO 16271 | CGTACTCTCAAGATGGATTA | AAG | chr12 | 21597049 | 21597068 | 21597065 | + |
| SEQ ID NO 16272 | TAAAACTATAAAACTACTAA | AAG | chr12 | 21597088 | 21597107 | 21597104 | + |
| SEQ ID NO 16273 | AAACTACTAAAAGAAAACAT | AAG | chr12 | 21597098 | 21597117 | 21597114 | + |
| SEQ ID NO 16274 | AACTACTAAAAGAAAACATA | AGG | chr12 | 21597099 | 21597118 | 21597115 | + |
| SEQ ID NO 16275 | ACTACTAAAAGAAAACATAA | GGG | chr12 | 21597100 | 21597119 | 21597116 | + |
| SEQ ID NO 16276 | TACTAAAAGAAAACATAAGG | GAG | chr12 | 21597102 | 21597121 | 21597118 | + |
| SEQ ID NO 16277 | AAACATAAGGGAGACACTTC | AAG | chr12 | 21597112 | 21597131 | 21597128 | + |
| SEQ ID NO 16278 | AAGGGAGACACTTCAAGACA | TGG | chr12 | 21597118 | 21597137 | 21597134 | + |
| SEQ ID NO 16279 | GACACTTCAAGACATGGCTT | TGG | chr12 | 21597124 | 21597143 | 21597140 | + |
| SEQ ID NO 16280 | ACACTTCAAGACATGGCTTT | GGG | chr12 | 21597125 | 21597144 | 21597141 | + |
| SEQ ID NO 16281 | TCAAGACATGGCTTTGGGCA | AAG | chr12 | 21597130 | 21597149 | 21597146 | + |
| SEQ ID NO 16282 | GGCTTTGGGCAAAGATTTTA | TGG | chr12 | 21597139 | 21597158 | 21597155 | + |
| SEQ ID NO 16283 | TGGGCAAAGATTTTATGGCC | AAG | chr12 | 21597144 | 21597163 | 21597160 | + |
| SEQ ID NO 16284 | TTTTATGGCCAAGACCTCAA | AAG | chr12 | 21597154 | 21597173 | 21597170 | + |
| SEQ ID NO 16285 | TGGCCAAGACCTCAAAAGCA | CAG | chr12 | 21597159 | 21597178 | 21597175 | + |
| SEQ ID NO 16286 | GGCCAAGACCTCAAAAGCAC | AGG | chr12 | 21597160 | 21597179 | 21597176 | + |
| SEQ ID NO 16287 | CTCAAAAGCACAGGCAACAA | AAG | chr12 | 21597169 | 21597188 | 21597185 | + |
| SEQ ID NO 16288 | ACAGGCAACAAAAGCAAAAA | TAG | chr12 | 21597178 | 21597197 | 21597194 | + |
| SEQ ID NO 16289 | CAAAAGCAAAATAGACAAA | TGG | chr12 | 21597186 | 21597205 | 21597202 | + |
| SEQ ID NO 16290 | AAAAGCAAAATAGACAAAT | GGG | chr12 | 21597187 | 21597206 | 21597203 | + |
| SEQ ID NO 16291 | TAGACAAATGGGACTATATT | AAG | chr12 | 21597198 | 21597217 | 21597214 | + |
| SEQ ID NO 16292 | TAAGCTAAATACATCTGCA | CAG | chr12 | 21597217 | 21597236 | 21597233 | + |
| SEQ ID NO 16293 | TAAAATACATCTGCACAGTA | AAG | chr12 | 21597222 | 21597241 | 21597238 | + |
| SEQ ID NO 16294 | AAAATACATCTGCACAGTAA | AGG | chr12 | 21597223 | 21597242 | 21597239 | + |
| SEQ ID NO 16295 | AGTAAAGGAAACAATCAACA | CAG | chr12 | 21597238 | 21597257 | 21597254 | + |
| SEQ ID NO 16296 | AGGAAACAATCAACACAGTG | AAG | chr12 | 21597243 | 21597262 | 21597259 | + |

Figure 43 (Cont'd)

| | | | | | | | |
|---|---|---|---|---|---|---|---|
| SEQ ID NO 16297 | GAAACAATCAACACAGTGAA | GAG | chr12 | 21597245 | 21597264 | 21597261 | + |
| SEQ ID NO 16298 | AATCAACACAGTGAAGAGAC | AAG | chr12 | 21597250 | 21597269 | 21597266 | + |
| SEQ ID NO 16299 | AGAGACAAGCTGTTGAATGC | GAG | chr12 | 21597264 | 21597283 | 21597280 | + |
| SEQ ID NO 16300 | AATATTTGCATACATTTGAC | AAG | chr12 | 21597289 | 21597308 | 21597305 | + |
| SEQ ID NO 16301 | ATATTTGCATACATTTGACA | AGG | chr12 | 21597290 | 21597309 | 21597306 | + |
| SEQ ID NO 16302 | TTTGACAAGGAATTAATCTC | CAG | chr12 | 21597303 | 21597322 | 21597319 | + |
| SEQ ID NO 16303 | AATTAATCTCCAGAATATAT | AAG | chr12 | 21597313 | 21597332 | 21597329 | + |
| SEQ ID NO 16304 | AAGAAACTCAAACAACTCAA | CAG | chr12 | 21597333 | 21597352 | 21597349 | + |
| SEQ ID NO 16305 | AAACTCAAACAACTCAACAG | TGG | chr12 | 21597336 | 21597355 | 21597352 | + |
| SEQ ID NO 16306 | AAATAATCTCATTAAAAAAT | TGG | chr12 | 21597365 | 21597384 | 21597381 | + |
| SEQ ID NO 16307 | ATCTCATTAAAAAATTGGCA | AAG | chr12 | 21597370 | 21597389 | 21597386 | + |
| SEQ ID NO 16308 | TCTCATTAAAAAATTGGCAA | AGG | chr12 | 21597371 | 21597390 | 21597387 | + |
| SEQ ID NO 16309 | TGGCAAAGGATATTTTTCAA | AAG | chr12 | 21597385 | 21597404 | 21597401 | + |
| SEQ ID NO 16310 | CAAAGGATATTTTTCAAAAG | AAG | chr12 | 21597388 | 21597407 | 21597404 | + |
| SEQ ID NO 16311 | GAAGACATACAAATGCACAA | TGG | chr12 | 21597407 | 21597426 | 21597423 | + |
| SEQ ID NO 16312 | AAGACATACAAATGCACAAT | GGG | chr12 | 21597408 | 21597427 | 21597424 | + |
| SEQ ID NO 16313 | ATACAAATGCACAATGGGTA | TGG | chr12 | 21597413 | 21597432 | 21597429 | + |
| SEQ ID NO 16314 | TACAAATGCACAATGGGTAT | GGG | chr12 | 21597414 | 21597433 | 21597430 | + |
| SEQ ID NO 16315 | ACAAATGCACAATGGGTATG | GGG | chr12 | 21597415 | 21597434 | 21597431 | + |
| SEQ ID NO 16316 | TGCTCAACATTACTAATCAT | CAG | chr12 | 21597442 | 21597461 | 21597458 | + |
| SEQ ID NO 16317 | CTCAACATTACTAATCATCA | GAG | chr12 | 21597444 | 21597463 | 21597460 | + |
| SEQ ID NO 16318 | ATGCAAATCAAAACCACAAT | GAG | chr12 | 21597469 | 21597488 | 21597485 | + |
| SEQ ID NO 16319 | AATGAGATATCATCTTATGC | CAG | chr12 | 21597486 | 21597505 | 21597502 | + |
| SEQ ID NO 16320 | AGATATCATCTTATGCCAGT | TAG | chr12 | 21597490 | 21597509 | 21597506 | + |
| SEQ ID NO 16321 | AATAAATAAATAACACATGC | TGG | chr12 | 21597536 | 21597555 | 21597552 | + |
| SEQ ID NO 16322 | AATAAATAACACATGCTGGC | AAG | chr12 | 21597540 | 21597559 | 21597556 | + |
| SEQ ID NO 16323 | ATAAATAACACATGCTGGCA | AGG | chr12 | 21597541 | 21597560 | 21597557 | + |
| SEQ ID NO 16324 | CACATGCTGGCAAGGATGTG | AAG | chr12 | 21597549 | 21597568 | 21597565 | + |
| SEQ ID NO 16325 | ACATGCTGGCAAGGATGTGA | AGG | chr12 | 21597550 | 21597569 | 21597566 | + |
| SEQ ID NO 16326 | CTGGCAAGGATGTGAAGGAA | AAG | chr12 | 21597555 | 21597574 | 21597571 | + |
| SEQ ID NO 16327 | TGGCAAGGATGTGAAGGAAA | AGG | chr12 | 21597556 | 21597575 | 21597572 | + |
| SEQ ID NO 16328 | TGTGAAGGAAAAGGCACTCG | TAG | chr12 | 21597565 | 21597584 | 21597581 | + |
| SEQ ID NO 16329 | GTGAAGGAAAAGGCACTCGT | AGG | chr12 | 21597566 | 21597585 | 21597582 | + |
| SEQ ID NO 16330 | AAGGCACTCGTAGGCACTAT | TGG | chr12 | 21597575 | 21597594 | 21597591 | + |
| SEQ ID NO 16331 | CACTCGTAGGCACTATTGGT | AAG | chr12 | 21597579 | 21597598 | 21597595 | + |
| SEQ ID NO 16332 | CTATTGGTAAGCATGCAAAT | TAG | chr12 | 21597591 | 21597610 | 21597607 | + |
| SEQ ID NO 16333 | GGTAAGCATGCAAATTAGTA | TAG | chr12 | 21597596 | 21597615 | 21597612 | + |
| SEQ ID NO 16334 | GCAAATTAGTATAGCCACTA | TGG | chr12 | 21597605 | 21597624 | 21597621 | + |
| SEQ ID NO 16335 | CCACTATGGAAAACAATATG | TAG | chr12 | 21597619 | 21597638 | 21597635 | + |
| SEQ ID NO 16336 | CAATATGTAGATTTACCAAA | AAG | chr12 | 21597632 | 21597651 | 21597648 | + |
| SEQ ID NO 16337 | GCTAAAAATTGAACTATCAT | AAG | chr12 | 21597654 | 21597673 | 21597670 | + |
| SEQ ID NO 16338 | AATTGAACTATCATAAGATC | CAG | chr12 | 21597660 | 21597679 | 21597676 | + |
| SEQ ID NO 16339 | AGATCCAGCAATCTTATTAC | TGG | chr12 | 21597675 | 21597694 | 21597691 | + |
| SEQ ID NO 16340 | GATCCAGCAATCTTATTACT | GGG | chr12 | 21597676 | 21597695 | 21597692 | + |
| SEQ ID NO 16341 | TATTACTGGGTATTTATCCA | AAG | chr12 | 21597689 | 21597708 | 21597705 | + |
| SEQ ID NO 16342 | ATTACTGGGTATTTATCCAA | AGG | chr12 | 21597690 | 21597709 | 21597706 | + |
| SEQ ID NO 16343 | TGGGTATTTATCCAAAGGAA | AAG | chr12 | 21597695 | 21597714 | 21597711 | + |

Figure 43 (Cont'd)

| | | | | | | | |
|---|---|---|---|---|---|---|---|
| SEQ ID NO 16344 | TTATCCAAAGGAAAAGAATT | CAG | chr12 | 21597702 | 21597721 | 21597718 | + |
| SEQ ID NO 16345 | AAAGAATTCAGAATAATAAA | CAG | chr12 | 21597714 | 21597733 | 21597730 | + |
| SEQ ID NO 16346 | TCAGAATAATAAACAGATAC | TGG | chr12 | 21597721 | 21597740 | 21597737 | + |
| SEQ ID NO 16347 | TGGTACCACACTGTTTATTG | CAG | chr12 | 21597741 | 21597760 | 21597757 | + |
| SEQ ID NO 16348 | TATTGCAGCACGATTCACAT | TAG | chr12 | 21597756 | 21597775 | 21597772 | + |
| SEQ ID NO 16349 | CAGCACGATTCACATTAGCA | AAG | chr12 | 21597761 | 21597780 | 21597777 | + |
| SEQ ID NO 16350 | GATTCACATTAGCAAAGATA | TGG | chr12 | 21597767 | 21597786 | 21597783 | + |
| SEQ ID NO 16351 | CAAAGATATGGAATCAACCT | AAG | chr12 | 21597779 | 21597798 | 21597795 | + |
| SEQ ID NO 16352 | TCAACCTAAGTGTCCATCAA | TGG | chr12 | 21597792 | 21597811 | 21597808 | + |
| SEQ ID NO 16353 | TGTCCATCAATGGATGAATG | AAG | chr12 | 21597802 | 21597821 | 21597818 | + |
| SEQ ID NO 16354 | ATGGATGAATGAAGAAAATG | TGG | chr12 | 21597811 | 21597830 | 21597827 | + |
| SEQ ID NO 16355 | ATATAAAATCATTTCATTTG | CAG | chr12 | 21597870 | 21597889 | 21597886 | + |
| SEQ ID NO 16356 | TCATTTCATTTGCAGCAACA | TGG | chr12 | 21597878 | 21597897 | 21597894 | + |
| SEQ ID NO 16357 | TGCAGCAACATGGATGAAAC | TGG | chr12 | 21597888 | 21597907 | 21597904 | + |
| SEQ ID NO 16358 | AGCAACATGGATGAAACTGG | AAG | chr12 | 21597891 | 21597910 | 21597907 | + |
| SEQ ID NO 16359 | GTCATTATGTTAAACGAAAT | AAG | chr12 | 21597913 | 21597932 | 21597929 | + |
| SEQ ID NO 16360 | TTATGTTAAACGAAATAAGC | CAG | chr12 | 21597917 | 21597936 | 21597933 | + |
| SEQ ID NO 16361 | TATGTTAAACGAAATAAGCC | AGG | chr12 | 21597918 | 21597937 | 21597934 | + |
| SEQ ID NO 16362 | TAAACGAAATAAGCCAGGCA | TAG | chr12 | 21597923 | 21597942 | 21597939 | + |
| SEQ ID NO 16363 | CGAAATAAGCCAGGCATAGA | AAG | chr12 | 21597927 | 21597946 | 21597943 | + |
| SEQ ID NO 16364 | TGCATGTTCTCACTGATATG | TGG | chr12 | 21597958 | 21597977 | 21597974 | + |
| SEQ ID NO 16365 | GCATGTTCTCACTGATATGT | GGG | chr12 | 21597959 | 21597978 | 21597975 | + |
| SEQ ID NO 16366 | ATGTTCTCACTGATATGTGG | GAG | chr12 | 21597961 | 21597980 | 21597977 | + |
| SEQ ID NO 16367 | CTGATATGTGGGAGCTAAAA | AAG | chr12 | 21597970 | 21597989 | 21597986 | + |
| SEQ ID NO 16368 | CTAAAAAGTTAATATCATG | TAG | chr12 | 21597984 | 21598003 | 21598000 | + |
| SEQ ID NO 16369 | TAAAAAGTTAATATCATGT | AGG | chr12 | 21597985 | 21598004 | 21598001 | + |
| SEQ ID NO 16370 | AAAAGTTAATATCATGTAGG | TAG | chr12 | 21597988 | 21598007 | 21598004 | + |
| SEQ ID NO 16371 | AAGTTAATATCATGTAGGTA | GAG | chr12 | 21597990 | 21598009 | 21598006 | + |
| SEQ ID NO 16372 | GTTAATATCATGTAGGTAGA | GAG | chr12 | 21597992 | 21598011 | 21598008 | + |
| SEQ ID NO 16373 | AATATCATGTAGGTAGAGAG | TAG | chr12 | 21597995 | 21598014 | 21598011 | + |
| SEQ ID NO 16374 | GTAGGTAGAGAGTAGAATGA | CAG | chr12 | 21598003 | 21598022 | 21598019 | + |
| SEQ ID NO 16375 | GAGAGTAGAATGACAGAAAC | CAG | chr12 | 21598010 | 21598029 | 21598026 | + |
| SEQ ID NO 16376 | GAGTAGAATGACAGAAACCA | GAG | chr12 | 21598012 | 21598031 | 21598028 | + |
| SEQ ID NO 16377 | AGTAGAATGACAGAAACCAG | AGG | chr12 | 21598013 | 21598032 | 21598029 | + |
| SEQ ID NO 16378 | AGAATGACAGAAACCAGAGG | TAG | chr12 | 21598016 | 21598035 | 21598032 | + |
| SEQ ID NO 16379 | AATGACAGAAACCAGAGGTA | GAG | chr12 | 21598018 | 21598037 | 21598034 | + |
| SEQ ID NO 16380 | ACAGAAACCAGAGGTAGAGA | AAG | chr12 | 21598022 | 21598041 | 21598038 | + |
| SEQ ID NO 16381 | CAGAAACCAGAGGTAGAGAA | AGG | chr12 | 21598023 | 21598042 | 21598039 | + |
| SEQ ID NO 16382 | AGAGAAGGTGTGTACGTTA | TGG | chr12 | 21598037 | 21598056 | 21598053 | + |
| SEQ ID NO 16383 | GAGAAGGTGTGTACGTTAT | GGG | chr12 | 21598038 | 21598057 | 21598054 | + |
| SEQ ID NO 16384 | GAAAGGTGTGTACGTTATGG | GAG | chr12 | 21598040 | 21598059 | 21598056 | + |
| SEQ ID NO 16385 | AAAGGTGTGTACGTTATGGG | AGG | chr12 | 21598041 | 21598060 | 21598057 | + |
| SEQ ID NO 16386 | GGTGTGTACGTTATGGGAGG | AAG | chr12 | 21598044 | 21598063 | 21598060 | + |
| SEQ ID NO 16387 | GTGTGTACGTTATGGGAGGA | AGG | chr12 | 21598045 | 21598064 | 21598061 | + |
| SEQ ID NO 16388 | TGTGTACGTTATGGGAGGAA | GGG | chr12 | 21598046 | 21598065 | 21598062 | + |
| SEQ ID NO 16389 | TGTACGTTATGGGAGGAAGG | GAG | chr12 | 21598048 | 21598067 | 21598064 | + |
| SEQ ID NO 16390 | TTATGGGAGGAAGGGAGACG | AAG | chr12 | 21598054 | 21598073 | 21598070 | + |

Figure 43 (Cont'd)

| | | | | | | | |
|---|---|---|---|---|---|---|---|
| SEQ ID NO 16391 | ATGGGAGGAAGGGAGACGAA | GAG | chr12 | 21598056 | 21598075 | 21598072 | + |
| SEQ ID NO 16392 | GGAGGAAGGGAGACGAAGAG | AAG | chr12 | 21598059 | 21598078 | 21598075 | + |
| SEQ ID NO 16393 | GAAGGGAGACGAAGAGAAGT | TGG | chr12 | 21598063 | 21598082 | 21598079 | + |
| SEQ ID NO 16394 | GACGAAGAGAAGTTGGTTAA | TGG | chr12 | 21598070 | 21598089 | 21598086 | + |
| SEQ ID NO 16395 | GAGAAGTTGGTTAATGGAAA | CAG | chr12 | 21598076 | 21598095 | 21598092 | + |
| SEQ ID NO 16396 | AGAAGTTGGTTAATGGAAAC | AGG | chr12 | 21598077 | 21598096 | 21598093 | + |
| SEQ ID NO 16397 | AGTTGGTTAATGGAAACAGG | CAG | chr12 | 21598080 | 21598099 | 21598096 | + |
| SEQ ID NO 16398 | GGTTAATGGAAACAGGCAGT | TAG | chr12 | 21598084 | 21598103 | 21598100 | + |
| SEQ ID NO 16399 | AATGGAAACAGGCAGTTAGA | TAG | chr12 | 21598088 | 21598107 | 21598104 | + |
| SEQ ID NO 16400 | GGAAACAGGCAGTTAGATAG | AAG | chr12 | 21598091 | 21598110 | 21598107 | + |
| SEQ ID NO 16401 | GAAACAGGCAGTTAGATAGA | AGG | chr12 | 21598092 | 21598111 | 21598108 | + |
| SEQ ID NO 16402 | GAATATGTTCTGATGTTCAA | TAG | chr12 | 21598114 | 21598133 | 21598130 | + |
| SEQ ID NO 16403 | TGTTCTGATGTTCAATAGCA | AAG | chr12 | 21598119 | 21598138 | 21598135 | + |
| SEQ ID NO 16404 | TCTGATGTTCAATAGCAAAG | TAG | chr12 | 21598122 | 21598141 | 21598138 | + |
| SEQ ID NO 16405 | CTGATGTTCAATAGCAAAGT | AGG | chr12 | 21598123 | 21598142 | 21598139 | + |
| SEQ ID NO 16406 | TGATGTTCAATAGCAAAGTA | GGG | chr12 | 21598124 | 21598143 | 21598140 | + |
| SEQ ID NO 16407 | ATAGCAAAGTAGGGTGATTA | TAG | chr12 | 21598133 | 21598152 | 21598149 | + |
| SEQ ID NO 16408 | ATATATTGTATATTTCAAAA | TAG | chr12 | 21598165 | 21598184 | 21598181 | + |
| SEQ ID NO 16409 | TATTGTATATTTCAAAATAG | TAG | chr12 | 21598168 | 21598187 | 21598184 | + |
| SEQ ID NO 16410 | TGTATATTTCAAAATAGTAG | AAG | chr12 | 21598171 | 21598190 | 21598187 | + |
| SEQ ID NO 16411 | TATTTCAAAATAGTAGAAGA | AAG | chr12 | 21598175 | 21598194 | 21598191 | + |
| SEQ ID NO 16412 | ATTTCAAAATAGTAGAAGAA | AGG | chr12 | 21598176 | 21598195 | 21598192 | + |
| SEQ ID NO 16413 | CTTGAAATGTTCCTAACACA | TAG | chr12 | 21598200 | 21598219 | 21598216 | + |
| SEQ ID NO 16414 | CATAGAAACGATAAATACTT | GAG | chr12 | 21598218 | 21598237 | 21598234 | + |
| SEQ ID NO 16415 | ATAGAAACGATAAATACTTG | AGG | chr12 | 21598219 | 21598238 | 21598235 | + |
| SEQ ID NO 16416 | AACACGTCATATATCAATAA | AAG | chr12 | 21598323 | 21598342 | 21598339 | + |
| SEQ ID NO 16417 | CGTCATATATCAATAAAAGA | AAG | chr12 | 21598327 | 21598346 | 21598343 | + |
| SEQ ID NO 16418 | AAAGAAAGTCGATCTCATAT | TGG | chr12 | 21598342 | 21598361 | 21598358 | + |
| SEQ ID NO 16419 | AAGTCGATCTCATATTGGTT | GAG | chr12 | 21598347 | 21598366 | 21598363 | + |
| SEQ ID NO 16420 | AGTCGATCTCATATTGGTTG | AGG | chr12 | 21598348 | 21598367 | 21598364 | + |
| SEQ ID NO 16421 | ATTGGTTGAGGCCTGATTGT | AAG | chr12 | 21598360 | 21598379 | 21598376 | + |
| SEQ ID NO 16422 | TAAGTAAATCTTTGTCCCTC | CAG | chr12 | 21598379 | 21598398 | 21598395 | + |
| SEQ ID NO 16423 | TCCCTGTACTGTCTTGCTGT | GAG | chr12 | 21598407 | 21598426 | 21598423 | + |
| SEQ ID NO 16424 | CCCTGTACTGTCTTGCTGTG | AGG | chr12 | 21598408 | 21598427 | 21598424 | + |
| SEQ ID NO 16425 | CTGTACTGTCTTGCTGTGAG | GAG | chr12 | 21598410 | 21598429 | 21598426 | + |
| SEQ ID NO 16426 | CTTATATTCCAACACCATTT | TAG | chr12 | 21598451 | 21598470 | 21598467 | + |
| SEQ ID NO 16427 | TCCTCCCCATATTTTTACCT | CGG | chr12 | 21598484 | 21598503 | 21598500 | + |
| SEQ ID NO 16428 | CTCGGTTTTTACTGTTTATA | TAG | chr12 | 21598502 | 21598521 | 21598518 | + |
| SEQ ID NO 16429 | ATATAGCACACTTTGTGCTA | TAG | chr12 | 21598519 | 21598538 | 21598535 | + |
| SEQ ID NO 16430 | CTTTGTGCTATAGTTTACCT | CAG | chr12 | 21598529 | 21598548 | 21598545 | + |
| SEQ ID NO 16431 | CTCAGTTTTTACTATTTATA | AAG | chr12 | 21598547 | 21598566 | 21598563 | + |
| SEQ ID NO 16432 | CCCCAAACTTCTCTCTTAAC | AAG | chr12 | 21598579 | 21598598 | 21598595 | + |
| SEQ ID NO 16433 | AAACTTCTCTCTTAACAAGC | TAG | chr12 | 21598583 | 21598602 | 21598599 | + |
| SEQ ID NO 16434 | CTCTTAACAAGCTAGAATAT | AAG | chr12 | 21598591 | 21598610 | 21598607 | + |
| SEQ ID NO 16435 | GCTAGAATATAAGTGAATGC | AAG | chr12 | 21598601 | 21598620 | 21598617 | + |
| SEQ ID NO 16436 | TAGAATATAAGTGAATGCAA | GAG | chr12 | 21598603 | 21598622 | 21598619 | + |
| SEQ ID NO 16437 | TATAAGTGAATGCAAGAGCA | TAG | chr12 | 21598608 | 21598627 | 21598624 | + |

Figure 43 (Cont'd)

| | | | | | | | |
|---|---|---|---|---|---|---|---|
| SEQ ID NO 16438 | TAAGTGAATGCAAGAGCATA | GAG | chr12 | 21598610 | 21598629 | 21598626 | + |
| SEQ ID NO 16439 | TGAATGCAAGAGCATAGAGA | CAG | chr12 | 21598614 | 21598633 | 21598630 | + |
| SEQ ID NO 16440 | GAATGCAAGAGCATAGAGAC | AGG | chr12 | 21598615 | 21598634 | 21598631 | + |
| SEQ ID NO 16441 | AATGCAAGAGCATAGAGACA | GGG | chr12 | 21598616 | 21598635 | 21598632 | + |
| SEQ ID NO 16442 | TCATTCCTATTTTCATATTT | GAG | chr12 | 21598639 | 21598658 | 21598655 | + |
| SEQ ID NO 16443 | CATTCCTATTTTCATATTTG | AGG | chr12 | 21598640 | 21598659 | 21598656 | + |
| SEQ ID NO 16444 | TCATATTTGAGGTATAAACC | AAG | chr12 | 21598651 | 21598670 | 21598667 | + |
| SEQ ID NO 16445 | CATATTTGAGGTATAAACCA | AGG | chr12 | 21598652 | 21598671 | 21598668 | + |
| SEQ ID NO 16446 | TATTTGAGGTATAAACCAAG | GAG | chr12 | 21598654 | 21598673 | 21598670 | + |
| SEQ ID NO 16447 | TTTTTAAATCTGCAAATAAA | TGG | chr12 | 21598696 | 21598715 | 21598712 | + |
| SEQ ID NO 16448 | GTTTTATTCTGACATTAAAA | AAG | chr12 | 21598718 | 21598737 | 21598734 | + |
| SEQ ID NO 16449 | AATGAATGATCGTTTTACCA | CAG | chr12 | 21598759 | 21598778 | 21598775 | + |
| SEQ ID NO 16450 | ATGATCGTTTTACCACAGCG | TAG | chr12 | 21598764 | 21598783 | 21598780 | + |
| SEQ ID NO 16451 | TGATCGTTTTACCACAGCGT | AGG | chr12 | 21598765 | 21598784 | 21598781 | + |
| SEQ ID NO 16452 | CTTAACCTTCACTTTCAAAC | AAG | chr12 | 21598802 | 21598821 | 21598818 | + |
| SEQ ID NO 16453 | TTTATTGATCTCTATTTTCC | TGG | chr12 | 21598835 | 21598854 | 21598851 | + |
| SEQ ID NO 16454 | TCTATTTTCCTGGAACAACA | TGG | chr12 | 21598845 | 21598864 | 21598861 | + |
| SEQ ID NO 16455 | CTATTTTCCTGGAACAACAT | GGG | chr12 | 21598846 | 21598865 | 21598862 | + |
| SEQ ID NO 16456 | TATTTTCCTGGAACAACATG | GGG | chr12 | 21598847 | 21598866 | 21598863 | + |
| SEQ ID NO 16457 | ATTTTCCTGGAACAACATGG | GGG | chr12 | 21598848 | 21598867 | 21598864 | + |
| SEQ ID NO 16458 | AACAACATGGGGCTATGTT | TAG | chr12 | 21598858 | 21598877 | 21598874 | + |
| SEQ ID NO 16459 | ATGGGGCTATGTTTAGCGT | GAG | chr12 | 21598864 | 21598883 | 21598880 | + |
| SEQ ID NO 16460 | TGGGGGCTATGTTTAGCGTG | AGG | chr12 | 21598865 | 21598884 | 21598881 | + |
| SEQ ID NO 16461 | CTATGTTTAGCGTGAGGACA | AAG | chr12 | 21598871 | 21598890 | 21598887 | + |
| SEQ ID NO 16462 | GTATCACAACTTTCACCTGA | AAG | chr12 | 21598893 | 21598912 | 21598909 | + |
| SEQ ID NO 16463 | ACAACTTTCACCTGAAAGAA | AAG | chr12 | 21598898 | 21598917 | 21598914 | + |
| SEQ ID NO 16464 | TTTCACCTGAAAGAAAAGAT | GAG | chr12 | 21598903 | 21598922 | 21598919 | + |
| SEQ ID NO 16465 | AAAGAAAAGATGAGCTACCA | TGG | chr12 | 21598912 | 21598931 | 21598928 | + |
| SEQ ID NO 16466 | ACCATGGTACATATAACAAT | GAG | chr12 | 21598928 | 21598947 | 21598944 | + |
| SEQ ID NO 16467 | CCATGGTACATATAACAATG | AGG | chr12 | 21598929 | 21598948 | 21598945 | + |
| SEQ ID NO 16468 | TGGTACATATAACAATGAGG | TGG | chr12 | 21598932 | 21598951 | 21598948 | + |
| SEQ ID NO 16469 | AATGAGGTGGTTAAAACTCT | AAG | chr12 | 21598945 | 21598964 | 21598961 | + |
| SEQ ID NO 16470 | TAAAACTCTAAGTCGTCATC | TGG | chr12 | 21598956 | 21598975 | 21598972 | + |
| SEQ ID NO 16471 | TACTAAAAATCACTATTTCA | AAG | chr12 | 21598993 | 21599012 | 21599009 | + |
| SEQ ID NO 16472 | TAAAAATCACTATTTCAAAG | AAG | chr12 | 21598996 | 21599015 | 21599012 | + |
| SEQ ID NO 16473 | ATCACTATTTCAAAGAAGTA | TAG | chr12 | 21599001 | 21599020 | 21599017 | + |
| SEQ ID NO 16474 | TATTTCAAAGAAGTATAGAA | TAG | chr12 | 21599006 | 21599025 | 21599022 | + |
| SEQ ID NO 16475 | AAGAAGTATAGAATAGATAT | CAG | chr12 | 21599013 | 21599032 | 21599029 | + |
| SEQ ID NO 16476 | GAATAGATATCAGCCAAAAT | AAG | chr12 | 21599023 | 21599042 | 21599039 | + |
| SEQ ID NO 16477 | AATAGATATCAGCCAAAATA | AGG | chr12 | 21599024 | 21599043 | 21599040 | + |
| SEQ ID NO 16478 | ATATACATATTATACACATA | TGG | chr12 | 21599134 | 21599153 | 21599150 | + |
| SEQ ID NO 16479 | ATACATATTATACACATATG | GAG | chr12 | 21599136 | 21599155 | 21599152 | + |
| SEQ ID NO 16480 | TTGTATATGCTTAAAAATTA | CAG | chr12 | 21599172 | 21599191 | 21599188 | + |
| SEQ ID NO 16481 | TGCTTAAAAATTACAGACTT | TGG | chr12 | 21599179 | 21599198 | 21599195 | + |
| SEQ ID NO 16482 | TTAAAAATTACAGACTTTGG | AAG | chr12 | 21599182 | 21599201 | 21599198 | + |
| SEQ ID NO 16483 | TGGAAGTCATATGACTATTT | CAG | chr12 | 21599199 | 21599218 | 21599215 | + |
| SEQ ID NO 16484 | TATGACTATTTCAGTGTGTG | TGG | chr12 | 21599208 | 21599227 | 21599224 | + |

Figure 43 (Cont'd)

| | | | | | | | |
|---|---|---|---|---|---|---|---|
| SEQ ID NO 16485 | CACCCTCCTGTTCCAAAACA | CAG | chr12 | 21599241 | 21599260 | 21599257 | + |
| SEQ ID NO 16486 | CCTGTTCCAAAACACAGTTG | CAG | chr12 | 21599247 | 21599266 | 21599263 | + |
| SEQ ID NO 16487 | GTTCCAAAACACAGTTGCAG | AAG | chr12 | 21599250 | 21599269 | 21599266 | + |
| SEQ ID NO 16488 | CCAAAACACAGTTGCAGAAG | CAG | chr12 | 21599253 | 21599272 | 21599269 | + |
| SEQ ID NO 16489 | AAAACACAGTTGCAGAAGCA | GAG | chr12 | 21599255 | 21599274 | 21599271 | + |
| SEQ ID NO 16490 | AAACACAGTTGCAGAAGCAG | AGG | chr12 | 21599256 | 21599275 | 21599272 | + |
| SEQ ID NO 16491 | CACAGTTGCAGAAGCAGAGG | AAG | chr12 | 21599259 | 21599278 | 21599275 | + |
| SEQ ID NO 16492 | AGAGGAAGTCATTATACACT | TAG | chr12 | 21599274 | 21599293 | 21599290 | + |
| SEQ ID NO 16493 | CACTTAGAACATCATTTTAT | AAG | chr12 | 21599290 | 21599309 | 21599306 | + |
| SEQ ID NO 16494 | ACTTAGAACATCATTTTATA | AGG | chr12 | 21599291 | 21599310 | 21599307 | + |
| SEQ ID NO 16495 | TAGAACATCATTTTATAAGG | CAG | chr12 | 21599294 | 21599313 | 21599310 | + |
| SEQ ID NO 16496 | AACATCATTTTATAAGGCAG | CAG | chr12 | 21599297 | 21599316 | 21599313 | + |
| SEQ ID NO 16497 | ACATCATTTTATAAGGCAGC | AGG | chr12 | 21599298 | 21599317 | 21599314 | + |
| SEQ ID NO 16498 | ATTTTATAAGGCAGCAGGTC | TGG | chr12 | 21599303 | 21599322 | 21599319 | + |
| SEQ ID NO 16499 | TTATAAGGCAGCAGGTCTGG | TAG | chr12 | 21599306 | 21599325 | 21599322 | + |
| SEQ ID NO 16500 | TATAAGGCAGCAGGTCTGGT | AGG | chr12 | 21599307 | 21599326 | 21599323 | + |
| SEQ ID NO 16501 | AAGGCAGCAGGTCTGGTAGG | AAG | chr12 | 21599310 | 21599329 | 21599326 | + |
| SEQ ID NO 16502 | AGGCAGCAGGTCTGGTAGGA | AGG | chr12 | 21599311 | 21599330 | 21599327 | + |
| SEQ ID NO 16503 | GCAGCAGGTCTGGTAGGAAG | GAG | chr12 | 21599313 | 21599332 | 21599329 | + |
| SEQ ID NO 16504 | AGGTCTGGTAGGAAGGAGAT | TAG | chr12 | 21599318 | 21599337 | 21599334 | + |
| SEQ ID NO 16505 | GGTCTGGTAGGAAGGAGATT | AGG | chr12 | 21599319 | 21599338 | 21599335 | + |
| SEQ ID NO 16506 | ATTAGGTGCTACTTGTGACA | AAG | chr12 | 21599336 | 21599355 | 21599352 | + |
| SEQ ID NO 16507 | TTAGGTGCTACTTGTGACAA | AGG | chr12 | 21599337 | 21599356 | 21599353 | + |
| SEQ ID NO 16508 | GTGCTACTTGTGACAAAGGT | CAG | chr12 | 21599341 | 21599360 | 21599357 | + |
| SEQ ID NO 16509 | TCAGCAAATATTTGTGTTCC | CAG | chr12 | 21599360 | 21599379 | 21599376 | + |
| SEQ ID NO 16510 | TTGTGTTCCCAGCACTTTTC | TAG | chr12 | 21599371 | 21599390 | 21599387 | + |
| SEQ ID NO 16511 | CCAGCACTTTTCTAGATCCT | CAG | chr12 | 21599379 | 21599398 | 21599395 | + |
| SEQ ID NO 16512 | TAGATCCTCAGTTAAAATCA | AAG | chr12 | 21599391 | 21599410 | 21599407 | + |
| SEQ ID NO 16513 | ATCCTCAGTTAAAATCAAAG | CAG | chr12 | 21599394 | 21599413 | 21599410 | + |
| SEQ ID NO 16514 | AGTTAAAATCAAAGCAGCTG | CAG | chr12 | 21599400 | 21599419 | 21599416 | + |
| SEQ ID NO 16515 | AATCAAAGCAGCTGCAGTCT | TGG | chr12 | 21599406 | 21599425 | 21599422 | + |
| SEQ ID NO 16516 | CAAAGCAGCTGCAGTCTTGG | CAG | chr12 | 21599409 | 21599428 | 21599425 | + |
| SEQ ID NO 16517 | AGCAGCTGCAGTCTTGGCAG | TGG | chr12 | 21599412 | 21599431 | 21599428 | + |
| SEQ ID NO 16518 | GCAGCTGCAGTCTTGGCAGT | GGG | chr12 | 21599413 | 21599432 | 21599429 | + |
| SEQ ID NO 16519 | AGCTGCAGTCTTGGCAGTGG | GAG | chr12 | 21599415 | 21599434 | 21599431 | + |
| SEQ ID NO 16520 | GCTGCAGTCTTGGCAGTGGG | AGG | chr12 | 21599416 | 21599435 | 21599432 | + |
| SEQ ID NO 16521 | GTGATACTCACACTTTGAAC | AAG | chr12 | 21599438 | 21599457 | 21599454 | + |
| SEQ ID NO 16522 | ACCACCTGCACTACCTACAA | TGG | chr12 | 21599461 | 21599480 | 21599477 | + |
| SEQ ID NO 16523 | ACCTGCACTACCTACAATGG | CAG | chr12 | 21599464 | 21599483 | 21599480 | + |
| SEQ ID NO 16524 | GCTCCAAATATTTTATATGA | AAG | chr12 | 21599486 | 21599505 | 21599502 | + |
| SEQ ID NO 16525 | CTCCAAATATTTTATATGAA | AGG | chr12 | 21599487 | 21599506 | 21599503 | + |
| SEQ ID NO 16526 | TCCAAATATTTTATATGAAA | GGG | chr12 | 21599488 | 21599507 | 21599504 | + |
| SEQ ID NO 16527 | CCAAATATTTTATATGAAAG | GGG | chr12 | 21599489 | 21599508 | 21599505 | + |
| SEQ ID NO 16528 | TATTTTATATGAAAGGGGCC | TAG | chr12 | 21599494 | 21599513 | 21599510 | + |
| SEQ ID NO 16529 | ATATGAAAGGGGCCTAGACA | TAG | chr12 | 21599500 | 21599519 | 21599516 | + |
| SEQ ID NO 16530 | GACATAGCATGCTGAATGAA | AAG | chr12 | 21599516 | 21599535 | 21599532 | + |
| SEQ ID NO 16531 | ACATAGCATGCTGAATGAAA | AGG | chr12 | 21599517 | 21599536 | 21599533 | + |

Figure 43 (Cont'd)

| SEQ ID NO 16532 | TAGCATGCTGAATGAAAAGG | AAG | chr12 | 21599520 | 21599539 | 21599536 | + |
| SEQ ID NO 16533 | ATGCTGAATGAAAAGGAAGT | GAG | chr12 | 21599524 | 21599543 | 21599540 | + |
| SEQ ID NO 16534 | CTGAATGAAAAGGAAGTGAG | TAG | chr12 | 21599527 | 21599546 | 21599543 | + |
| SEQ ID NO 16535 | TGAAAAGGAAGTGAGTAGAC | TAG | chr12 | 21599532 | 21599551 | 21599548 | + |
| SEQ ID NO 16536 | GTAGACTAGTGCTTTCCTTG | AAG | chr12 | 21599546 | 21599565 | 21599562 | + |
| SEQ ID NO 16537 | TTCCTTGAAGCTGTGCAACC | AAG | chr12 | 21599559 | 21599578 | 21599575 | + |
| SEQ ID NO 16538 | TGAAGCTGTGCAACCAAGCA | TAG | chr12 | 21599564 | 21599583 | 21599580 | + |
| SEQ ID NO 16539 | AACCAAGCATAGTTTTTACA | TAG | chr12 | 21599575 | 21599594 | 21599591 | + |
| SEQ ID NO 16540 | CATAGATCGTGTGTTTCACA | TGG | chr12 | 21599593 | 21599612 | 21599609 | + |
| SEQ ID NO 16541 | TGTTTCACATGGTGTGATAA | CAG | chr12 | 21599604 | 21599623 | 21599620 | + |
| SEQ ID NO 16542 | ACATGGTGTGATAACAGCTT | GAG | chr12 | 21599610 | 21599629 | 21599626 | + |
| SEQ ID NO 16543 | AGCTTGAGATGCCATTGACA | TGG | chr12 | 21599625 | 21599644 | 21599641 | + |
| SEQ ID NO 16544 | ATGCCATTGACATGGCCCAC | CGG | chr12 | 21599633 | 21599652 | 21599649 | + |
| SEQ ID NO 16545 | GCCCACCGGCTTATCCACAT | CAG | chr12 | 21599647 | 21599666 | 21599663 | + |
| SEQ ID NO 16546 | GGCTTATCCACATCAGTAAT | TAG | chr12 | 21599654 | 21599673 | 21599670 | + |
| SEQ ID NO 16547 | GCTTATCCACATCAGTAATT | AGG | chr12 | 21599655 | 21599674 | 21599671 | + |
| SEQ ID NO 16548 | CTTATCCACATCAGTAATTA | GGG | chr12 | 21599656 | 21599675 | 21599672 | + |
| SEQ ID NO 16549 | CCACATCAGTAATTAGGGCA | AAG | chr12 | 21599661 | 21599680 | 21599677 | + |
| SEQ ID NO 16550 | TACTATGCATCCCGTGATTG | AAG | chr12 | 21599694 | 21599713 | 21599710 | + |
| SEQ ID NO 16551 | TGTGTTTAAAAATGCAATTA | TGG | chr12 | 21599759 | 21599778 | 21599775 | + |
| SEQ ID NO 16552 | TGCAATTATGGACTCATTCA | AAG | chr12 | 21599771 | 21599790 | 21599787 | + |
| SEQ ID NO 16553 | TATGGACTCATTCAAAGTGA | AAG | chr12 | 21599777 | 21599796 | 21599793 | + |
| SEQ ID NO 16554 | GACTCATTCAAAGTGAAAGC | TGG | chr12 | 21599781 | 21599800 | 21599797 | + |
| SEQ ID NO 16555 | AAGCTGGTATGACAATACAT | GAG | chr12 | 21599797 | 21599816 | 21599813 | + |
| SEQ ID NO 16556 | TTTTATGAATAAATTTTATA | AAG | chr12 | 21599832 | 21599851 | 21599848 | + |
| SEQ ID NO 16557 | AATAAATTTTATAAAGAAAT | AAG | chr12 | 21599839 | 21599858 | 21599855 | + |
| SEQ ID NO 16558 | AAGAAATAAGCTAATACCTA | CAG | chr12 | 21599852 | 21599871 | 21599868 | + |
| SEQ ID NO 16559 | GAAATAAGCTAATACCTACA | GAG | chr12 | 21599854 | 21599873 | 21599870 | + |
| SEQ ID NO 16560 | ACAGAGTGTTTATTAAATGC | TAG | chr12 | 21599871 | 21599890 | 21599887 | + |
| SEQ ID NO 16561 | CAGAGTGTTTATTAAATGCT | AGG | chr12 | 21599872 | 21599891 | 21599888 | + |
| SEQ ID NO 16562 | TGTTTATTAAATGCTAGGCA | CAG | chr12 | 21599877 | 21599896 | 21599893 | + |
| SEQ ID NO 16563 | TAAATGCTAGGCACAGTTCT | GAG | chr12 | 21599884 | 21599903 | 21599900 | + |
| SEQ ID NO 16564 | AGTTCTGAGTGATTTACAAC | TGG | chr12 | 21599898 | 21599917 | 21599914 | + |
| SEQ ID NO 16565 | TAATTTTCACAACATTATTA | CAG | chr12 | 21599930 | 21599949 | 21599946 | + |
| SEQ ID NO 16566 | AATTTTCACAACATTATTAC | AGG | chr12 | 21599931 | 21599950 | 21599947 | + |
| SEQ ID NO 16567 | TTTCACAACATTATTACAGG | TAG | chr12 | 21599934 | 21599953 | 21599950 | + |
| SEQ ID NO 16568 | TTACAGGTAGATTTTATATA | TGG | chr12 | 21599947 | 21599966 | 21599963 | + |
| SEQ ID NO 16569 | ACAGGTAGATTTTATATATG | GAG | chr12 | 21599949 | 21599968 | 21599965 | + |
| SEQ ID NO 16570 | ATTTTATATATGGAGAAACT | GAG | chr12 | 21599957 | 21599976 | 21599973 | + |
| SEQ ID NO 16571 | TTTTATATATGGAGAAACTG | AGG | chr12 | 21599958 | 21599977 | 21599974 | + |
| SEQ ID NO 16572 | TATATGGAGAAACTGAGGCA | CAG | chr12 | 21599963 | 21599982 | 21599979 | + |
| SEQ ID NO 16573 | TATGGAGAAACTGAGGCACA | GAG | chr12 | 21599965 | 21599984 | 21599981 | + |
| SEQ ID NO 16574 | TAATAAATCTCAACATTACC | CAG | chr12 | 21599996 | 21600015 | 21600012 | + |
| SEQ ID NO 16575 | AATAAATCTCAACATTACCC | AGG | chr12 | 21599997 | 21600016 | 21600013 | + |
| SEQ ID NO 16576 | TCTCAACATTACCCAGGTGA | TGG | chr12 | 21600003 | 21600022 | 21600019 | + |
| SEQ ID NO 16577 | CAACATTACCCAGGTGATGG | TGG | chr12 | 21600006 | 21600025 | 21600022 | + |
| SEQ ID NO 16578 | ACATTACCCAGGTGATGGTG | GAG | chr12 | 21600008 | 21600027 | 21600024 | + |

Figure 43 (Cont'd)

| | | | | | | | |
|---|---|---|---|---|---|---|---|
| SEQ ID NO 16579 | TACCCAGGTGATGGTGGAGT | TGG | chr12 | 21600012 | 21600031 | 21600028 | + |
| SEQ ID NO 16580 | AGTTGGAATTCCAAATCATG | CAG | chr12 | 21600029 | 21600048 | 21600045 | + |
| SEQ ID NO 16581 | CAAATCATGCAGTCTGACTT | TAG | chr12 | 21600040 | 21600059 | 21600056 | + |
| SEQ ID NO 16582 | ATGCAGTCTGACTTTAGCTG | TAG | chr12 | 21600046 | 21600065 | 21600062 | + |
| SEQ ID NO 16583 | AGTCTGACTTTAGCTGTAGA | CAG | chr12 | 21600050 | 21600069 | 21600066 | + |
| SEQ ID NO 16584 | TGACTTTAGCTGTAGACAGC | AAG | chr12 | 21600054 | 21600073 | 21600070 | + |
| SEQ ID NO 16585 | TTTAGCTGTAGACAGCAAGA | TAG | chr12 | 21600058 | 21600077 | 21600074 | + |
| SEQ ID NO 16586 | GCTGTAGACAGCAAGATAGT | AAG | chr12 | 21600062 | 21600081 | 21600078 | + |
| SEQ ID NO 16587 | AGACAGCAAGATAGTAAGTA | AAG | chr12 | 21600067 | 21600086 | 21600083 | + |
| SEQ ID NO 16588 | GACAGCAAGATAGTAAGTAA | AGG | chr12 | 21600068 | 21600087 | 21600084 | + |
| SEQ ID NO 16589 | CAAGATAGTAAGTAAAGGAA | TGG | chr12 | 21600073 | 21600092 | 21600089 | + |
| SEQ ID NO 16590 | AGATAGTAAGTAAAGGAATG | GAG | chr12 | 21600075 | 21600094 | 21600091 | + |
| SEQ ID NO 16591 | GGAATGGAGCAACAAATTGA | TGG | chr12 | 21600089 | 21600108 | 21600105 | + |
| SEQ ID NO 16592 | TTTTGCTTGTTTGTTTGAAA | CAG | chr12 | 21600122 | 21600141 | 21600138 | + |
| SEQ ID NO 16593 | TTTGCTTGTTTGTTTGAAAC | AGG | chr12 | 21600123 | 21600142 | 21600139 | + |
| SEQ ID NO 16594 | TTGCTTGTTTGTTTGAAACA | GGG | chr12 | 21600124 | 21600143 | 21600140 | + |
| SEQ ID NO 16595 | AGGGTCTCACTCTGTCACCC | CGG | chr12 | 21600143 | 21600162 | 21600159 | + |
| SEQ ID NO 16596 | TCTCACTCTGTCACCCCGGC | TGG | chr12 | 21600147 | 21600166 | 21600163 | + |
| SEQ ID NO 16597 | TCACTCTGTCACCCCGGCTG | GAG | chr12 | 21600149 | 21600168 | 21600165 | + |
| SEQ ID NO 16598 | TCACCCCGGCTGGAGTGCAA | TGG | chr12 | 21600157 | 21600176 | 21600173 | + |
| SEQ ID NO 16599 | TGGTGCAATCTTGCTCACTG | AAG | chr12 | 21600177 | 21600196 | 21600193 | + |
| SEQ ID NO 16600 | CTTGCTCACTGAAGCCTCAC | TAG | chr12 | 21600186 | 21600205 | 21600202 | + |
| SEQ ID NO 16601 | TGAAGCCTCACTAGAACGCC | TGG | chr12 | 21600195 | 21600214 | 21600211 | + |
| SEQ ID NO 16602 | TTCAATTGATCCTCCTGCTT | TAG | chr12 | 21600219 | 21600238 | 21600235 | + |
| SEQ ID NO 16603 | ATCCTCCTGCTTTAGCCTCT | CAG | chr12 | 21600227 | 21600246 | 21600243 | + |
| SEQ ID NO 16604 | TCCTCCTGCTTTAGCCTCTC | AGG | chr12 | 21600228 | 21600247 | 21600244 | + |
| SEQ ID NO 16605 | TCCTGCTTTAGCCTCTCAGG | TAG | chr12 | 21600231 | 21600250 | 21600247 | + |
| SEQ ID NO 16606 | GCTTTAGCCTCTCAGGTAGC | TAG | chr12 | 21600235 | 21600254 | 21600251 | + |
| SEQ ID NO 16607 | CTTTAGCCTCTCAGGTAGCT | AGG | chr12 | 21600236 | 21600255 | 21600252 | + |
| SEQ ID NO 16608 | CTCTCAGGTAGCTAGGACTA | CAG | chr12 | 21600243 | 21600262 | 21600259 | + |
| SEQ ID NO 16609 | TCTCAGGTAGCTAGGACTAC | AGG | chr12 | 21600244 | 21600263 | 21600260 | + |
| SEQ ID NO 16610 | GTAGCTAGGACTACAGGTGT | GAG | chr12 | 21600250 | 21600269 | 21600266 | + |
| SEQ ID NO 16611 | ACTACAGGTGTGAGCCTCCA | TGG | chr12 | 21600259 | 21600278 | 21600275 | + |
| SEQ ID NO 16612 | CAGGTGTGAGCCTCCATGGC | CAG | chr12 | 21600263 | 21600282 | 21600279 | + |
| SEQ ID NO 16613 | TGTGAGCCTCCATGGCCAGC | TAG | chr12 | 21600267 | 21600286 | 21600283 | + |
| SEQ ID NO 16614 | TGAGCCTCCATGGCCAGCTA | GAG | chr12 | 21600269 | 21600288 | 21600285 | + |
| SEQ ID NO 16615 | AGAAATTTTTAAATTTCTG | TAG | chr12 | 21600290 | 21600309 | 21600306 | + |
| SEQ ID NO 16616 | TTTTTAAATTTCTGTAGAAA | CAG | chr12 | 21600296 | 21600315 | 21600312 | + |
| SEQ ID NO 16617 | TTTTAAATTTCTGTAGAAAC | AGG | chr12 | 21600297 | 21600316 | 21600313 | + |
| SEQ ID NO 16618 | TTTAAATTTCTGTAGAAACA | GGG | chr12 | 21600298 | 21600317 | 21600314 | + |
| SEQ ID NO 16619 | CAGGGTCTCCCTATGTTCCC | CAG | chr12 | 21600316 | 21600335 | 21600332 | + |
| SEQ ID NO 16620 | AGGGTCTCCCTATGTTCCCC | AGG | chr12 | 21600317 | 21600336 | 21600333 | + |
| SEQ ID NO 16621 | TCTCCCTATGTTCCCCAGGC | TGG | chr12 | 21600321 | 21600340 | 21600337 | + |
| SEQ ID NO 16622 | CCAGGCTGGTATCCAACTCT | TGG | chr12 | 21600335 | 21600354 | 21600351 | + |
| SEQ ID NO 16623 | CTCAAACAATTCTCCCACCT | CAG | chr12 | 21600359 | 21600378 | 21600375 | + |
| SEQ ID NO 16624 | TCTCCCACCTCAGCCTTGAA | AAG | chr12 | 21600369 | 21600388 | 21600385 | + |
| SEQ ID NO 16625 | CCTCAGCCTTGAAAAGTGTT | GAG | chr12 | 21600376 | 21600395 | 21600392 | + |

Figure 43 (Cont'd)

| | | | | | | | |
|---|---|---|---|---|---|---|---|
| SEQ ID NO 16626 | CTTGAAAAGTGTTGAGATTA | CAG | chr12 | 21600383 | 21600402 | 21600399 | + |
| SEQ ID NO 16627 | TTGAAAAGTGTTGAGATTAC | AGG | chr12 | 21600384 | 21600403 | 21600400 | + |
| SEQ ID NO 16628 | ACAGGTGTGAATCACCATGC | TGG | chr12 | 21600402 | 21600421 | 21600418 | + |
| SEQ ID NO 16629 | CAGGTGTGAATCACCATGCT | GGG | chr12 | 21600403 | 21600422 | 21600419 | + |
| SEQ ID NO 16630 | ATCACCATGCTGGGCCTTGA | TGG | chr12 | 21600412 | 21600431 | 21600428 | + |
| SEQ ID NO 16631 | GGGCCTTGATGGATCTTTAA | AAG | chr12 | 21600423 | 21600442 | 21600439 | + |
| SEQ ID NO 16632 | CCTTGATGGATCTTTAAAAG | TGG | chr12 | 21600426 | 21600445 | 21600442 | + |
| SEQ ID NO 16633 | TGATGGATCTTTAAAAGTGG | TGG | chr12 | 21600429 | 21600448 | 21600445 | + |
| SEQ ID NO 16634 | GATGGATCTTTAAAAGTGGT | GGG | chr12 | 21600430 | 21600449 | 21600446 | + |
| SEQ ID NO 16635 | ATGGATCTTTAAAAGTGGTG | GGG | chr12 | 21600431 | 21600450 | 21600447 | + |
| SEQ ID NO 16636 | TGGATCTTTAAAAGTGGTGG | GGG | chr12 | 21600432 | 21600451 | 21600448 | + |
| SEQ ID NO 16637 | GGATCTTTAAAAGTGGTGGG | GGG | chr12 | 21600433 | 21600452 | 21600449 | + |
| SEQ ID NO 16638 | TCTTTAAAAGTGGTGGGGGG | TAG | chr12 | 21600436 | 21600455 | 21600452 | + |
| SEQ ID NO 16639 | CTTTAAAAGTGGTGGGGGGT | AGG | chr12 | 21600437 | 21600456 | 21600453 | + |
| SEQ ID NO 16640 | TTAAAAGTGGTGGGGGGTAG | GAG | chr12 | 21600439 | 21600458 | 21600455 | + |
| SEQ ID NO 16641 | GTGGTGGGGGGTAGGAGAAA | AAG | chr12 | 21600445 | 21600464 | 21600461 | + |
| SEQ ID NO 16642 | GGTGGGGGGTAGGAGAAAAA | GAG | chr12 | 21600447 | 21600466 | 21600463 | + |
| SEQ ID NO 16643 | GTGGGGGGTAGGAGAAAAAG | AGG | chr12 | 21600448 | 21600467 | 21600464 | + |
| SEQ ID NO 16644 | GGGGGTAGGAGAAAAAGAGG | AAG | chr12 | 21600451 | 21600470 | 21600467 | + |
| SEQ ID NO 16645 | AAAAGAGGAAGAACAAAAA | CAG | chr12 | 21600462 | 21600481 | 21600478 | + |
| SEQ ID NO 16646 | GAACAAAACAGTATCACGA | AAG | chr12 | 21600473 | 21600492 | 21600489 | + |
| SEQ ID NO 16647 | TCACGAAAGATAAACATCGT | TAG | chr12 | 21600487 | 21600506 | 21600503 | + |
| SEQ ID NO 16648 | CACGAAAGATAAACATCGTT | AGG | chr12 | 21600488 | 21600507 | 21600504 | + |
| SEQ ID NO 16649 | AGATAAACATCGTTAGGTCT | CGG | chr12 | 21600494 | 21600513 | 21600510 | + |
| SEQ ID NO 16650 | GATAAACATCGTTAGGTCTC | GGG | chr12 | 21600495 | 21600514 | 21600511 | + |
| SEQ ID NO 16651 | AAACATCGTTAGGTCTCGGG | AAG | chr12 | 21600498 | 21600517 | 21600514 | + |
| SEQ ID NO 16652 | AACATCGTTAGGTCTCGGGA | AGG | chr12 | 21600499 | 21600518 | 21600515 | + |
| SEQ ID NO 16653 | TCGTTAGGTCTCGGGAAGGA | TGG | chr12 | 21600503 | 21600522 | 21600519 | + |
| SEQ ID NO 16654 | CGTTAGGTCTCGGGAAGGAT | GGG | chr12 | 21600504 | 21600523 | 21600520 | + |
| SEQ ID NO 16655 | GGATCCTTTTCATTTTGCTC | TAG | chr12 | 21600525 | 21600544 | 21600541 | + |
| SEQ ID NO 16656 | ATCCTTTTCATTTTGCTCTA | GAG | chr12 | 21600527 | 21600546 | 21600543 | + |
| SEQ ID NO 16657 | TTTCATTTTGCTCTAGAGAA | AAG | chr12 | 21600532 | 21600551 | 21600548 | + |
| SEQ ID NO 16658 | TGCTCTAGAGAAAAGCCATT | TGG | chr12 | 21600540 | 21600559 | 21600556 | + |
| SEQ ID NO 16659 | ACTTCTGTGTTAACAAAAAA | CAG | chr12 | 21600566 | 21600585 | 21600582 | + |
| SEQ ID NO 16660 | TGTGTTAACAAAAAACAGCC | GAG | chr12 | 21600571 | 21600590 | 21600587 | + |
| SEQ ID NO 16661 | GTTAACAAAAACAGCCGAG | TAG | chr12 | 21600574 | 21600593 | 21600590 | + |
| SEQ ID NO 16662 | CAAAAAACAGCCGAGTAGCC | TAG | chr12 | 21600579 | 21600598 | 21600595 | + |
| SEQ ID NO 16663 | AGTAGCCTAGTATTAAACTT | TAG | chr12 | 21600592 | 21600611 | 21600608 | + |
| SEQ ID NO 16664 | TAGCCTAGTATTAAACTTTA | GAG | chr12 | 21600594 | 21600613 | 21600610 | + |
| SEQ ID NO 16665 | CCTAGTATTAAACTTTAGAG | CAG | chr12 | 21600597 | 21600616 | 21600613 | + |
| SEQ ID NO 16666 | TTTAGAGCAGTTGTTCTTTA | CGG | chr12 | 21600610 | 21600629 | 21600626 | + |
| SEQ ID NO 16667 | GTTGTTCTTTACGGCAATTA | CAG | chr12 | 21600619 | 21600638 | 21600635 | + |
| SEQ ID NO 16668 | TTGTTCTTTACGGCAATTAC | AGG | chr12 | 21600620 | 21600639 | 21600636 | + |
| SEQ ID NO 16669 | TGTTCTTTACGGCAATTACA | GGG | chr12 | 21600621 | 21600640 | 21600637 | + |
| SEQ ID NO 16670 | GTTCTTTACGGCAATTACAG | GGG | chr12 | 21600622 | 21600641 | 21600638 | + |
| SEQ ID NO 16671 | ACGGCAATTACAGGGGCCTT | CAG | chr12 | 21600629 | 21600648 | 21600645 | + |
| SEQ ID NO 16672 | CGGCAATTACAGGGGCCTTC | AGG | chr12 | 21600630 | 21600649 | 21600646 | + |

Figure 43 (Cont'd)

| SEQ ID NO 16673 | CAATTACAGGGGCCTTCAGG | AAG | chr12 | 21600633 | 21600652 | 21600649 | + |
| SEQ ID NO 16674 | AGGGGCCTTCAGGAAGCTGA | TGG | chr12 | 21600640 | 21600659 | 21600656 | + |
| SEQ ID NO 16675 | GGCCTTCAGGAAGCTGATGG | AAG | chr12 | 21600643 | 21600662 | 21600659 | + |
| SEQ ID NO 16676 | AGGAAGCTGATGGAAGTGTG | AAG | chr12 | 21600650 | 21600669 | 21600666 | + |
| SEQ ID NO 16677 | GAAGTGTGAAGTCCTCTTCT | CAG | chr12 | 21600662 | 21600681 | 21600678 | + |
| SEQ ID NO 16678 | AGTGTGAAGTCCTCTTCTCA | GAG | chr12 | 21600664 | 21600683 | 21600680 | + |
| SEQ ID NO 16679 | GAAGTCCTCTTCTCAGAGAA | AAG | chr12 | 21600669 | 21600688 | 21600685 | + |
| SEQ ID NO 16680 | ATATACGTGCACCTAATTTT | TAG | chr12 | 21600699 | 21600718 | 21600715 | + |
| SEQ ID NO 16681 | ATTTTTAGATATAATTTCTG | AAG | chr12 | 21600714 | 21600733 | 21600730 | + |
| SEQ ID NO 16682 | TTTTTAGATATAATTTCTGA | AGG | chr12 | 21600715 | 21600734 | 21600731 | + |
| SEQ ID NO 16683 | AGATATAATTTCTGAAGGTT | TAG | chr12 | 21600720 | 21600739 | 21600736 | + |
| SEQ ID NO 16684 | TGAAGGTTTAGAAACTCCTT | GAG | chr12 | 21600732 | 21600751 | 21600748 | + |
| SEQ ID NO 16685 | CCTTGAGTTCACTTATATCA | AAG | chr12 | 21600748 | 21600767 | 21600764 | + |
| SEQ ID NO 16686 | TATATCAAAGTCCTCACCTT | TAG | chr12 | 21600761 | 21600780 | 21600777 | + |
| SEQ ID NO 16687 | CACCTTTAGAACTCCTGTCC | TAG | chr12 | 21600775 | 21600794 | 21600791 | + |
| SEQ ID NO 16688 | CTTTAGAACTCCTGTCCTAG | AAG | chr12 | 21600778 | 21600797 | 21600794 | + |
| SEQ ID NO 16689 | TTAGAACTCCTGTCCTAGAA | GAG | chr12 | 21600780 | 21600799 | 21600796 | + |
| SEQ ID NO 16690 | GAACTCCTGTCCTAGAAGAG | TGG | chr12 | 21600783 | 21600802 | 21600799 | + |
| SEQ ID NO 16691 | TTCCATAACCACTTTGACTC | TAG | chr12 | 21600824 | 21600843 | 21600840 | + |
| SEQ ID NO 16692 | GCCACTTGTACCATGTAATT | CAG | chr12 | 21600867 | 21600886 | 21600883 | + |
| SEQ ID NO 16693 | CACTTGTACCATGTAATTCA | GAG | chr12 | 21600869 | 21600888 | 21600885 | + |
| SEQ ID NO 16694 | ACTTGTACCATGTAATTCAG | AGG | chr12 | 21600870 | 21600889 | 21600886 | + |
| SEQ ID NO 16695 | TACCATGTAATTCAGAGGTG | TAG | chr12 | 21600875 | 21600894 | 21600891 | + |
| SEQ ID NO 16696 | TAATTCAGAGGTGTAGTGTC | AAG | chr12 | 21600882 | 21600901 | 21600898 | + |
| SEQ ID NO 16697 | AGAGGTGTAGTGTCAAGACT | GAG | chr12 | 21600888 | 21600907 | 21600904 | + |
| SEQ ID NO 16698 | GAGGTGTAGTGTCAAGACTG | AGG | chr12 | 21600889 | 21600908 | 21600905 | + |
| SEQ ID NO 16699 | GGTGTAGTGTCAAGACTGAG | GAG | chr12 | 21600891 | 21600910 | 21600907 | + |
| SEQ ID NO 16700 | GTGTAGTGTCAAGACTGAGG | AGG | chr12 | 21600892 | 21600911 | 21600908 | + |
| SEQ ID NO 16701 | TAGTGTCAAGACTGAGGAGG | AAG | chr12 | 21600895 | 21600914 | 21600911 | + |
| SEQ ID NO 16702 | TGTCAAGACTGAGGAGGAAG | CAG | chr12 | 21600898 | 21600917 | 21600914 | + |
| SEQ ID NO 16703 | GTCAAGACTGAGGAGGAAGC | AGG | chr12 | 21600899 | 21600918 | 21600915 | + |
| SEQ ID NO 16704 | GGAAGCAGGTAAATTATGTC | CAG | chr12 | 21600913 | 21600932 | 21600929 | + |
| SEQ ID NO 16705 | AATTATGTCCAGCAATACGT | TGG | chr12 | 21600924 | 21600943 | 21600940 | + |
| SEQ ID NO 16706 | TGTCCAGCAATACGTTGGCT | TAG | chr12 | 21600929 | 21600948 | 21600945 | + |
| SEQ ID NO 16707 | GTCCAGCAATACGTTGGCTT | AGG | chr12 | 21600930 | 21600949 | 21600946 | + |
| SEQ ID NO 16708 | AGGCAAAACAAATTGTTTC | TAG | chr12 | 21600950 | 21600969 | 21600966 | + |
| SEQ ID NO 16709 | AATTGTTTCTAGTCCATTTT | AAG | chr12 | 21600961 | 21600980 | 21600977 | + |
| SEQ ID NO 16710 | TTGTTTCTAGTCCATTTTAA | GAG | chr12 | 21600963 | 21600982 | 21600979 | + |
| SEQ ID NO 16711 | TGTTTCTAGTCCATTTTAAG | AGG | chr12 | 21600964 | 21600983 | 21600980 | + |
| SEQ ID NO 16712 | GTTTCTAGTCCATTTTAAGA | GGG | chr12 | 21600965 | 21600984 | 21600981 | + |
| SEQ ID NO 16713 | TCTAGTCCATTTTAAGAGGG | AAG | chr12 | 21600968 | 21600987 | 21600984 | + |
| SEQ ID NO 16714 | TTAAGAGGGAAGCATTTATT | TAG | chr12 | 21600979 | 21600998 | 21600995 | + |
| SEQ ID NO 16715 | TAAGAGGGAAGCATTTATTT | AGG | chr12 | 21600980 | 21600999 | 21600996 | + |
| SEQ ID NO 16716 | AAGAGGGAAGCATTTATTTA | GGG | chr12 | 21600981 | 21601000 | 21600997 | + |
| SEQ ID NO 16717 | ATTTAGGGACTACATCGCTC | AAG | chr12 | 21600996 | 21601015 | 21601012 | + |
| SEQ ID NO 16718 | CCTTAACATGTTAATTTCTC | CAG | chr12 | 21601092 | 21601111 | 21601108 | + |
| SEQ ID NO 16719 | TTAACATGTTAATTTCTCCA | GAG | chr12 | 21601094 | 21601113 | 21601110 | + |

Figure 43 (Cont'd)

| | | | | | | | |
|---|---|---|---|---|---|---|---|
| SEQ ID NO 16720 | TCCAGAGTTTGTAATGTTCT | GAG | chr12 | 21601110 | 21601129 | 21601126 | + |
| SEQ ID NO 16721 | GAGTTTGTAATGTTCTGAGC | AAG | chr12 | 21601114 | 21601133 | 21601130 | + |
| SEQ ID NO 16722 | ATGTTCTGAGCAAGTGTGTG | CAG | chr12 | 21601123 | 21601142 | 21601139 | + |
| SEQ ID NO 16723 | TTCTGAGCAAGTGTGTGCAG | AAG | chr12 | 21601126 | 21601145 | 21601142 | + |
| SEQ ID NO 16724 | GTGTGCAGAAGAAATGATTG | TAG | chr12 | 21601138 | 21601157 | 21601154 | + |
| SEQ ID NO 16725 | GCAGAAGAAATGATTGTAGT | AAG | chr12 | 21601142 | 21601161 | 21601158 | + |
| SEQ ID NO 16726 | GAAATGATTGTAGTAAGACC | TGG | chr12 | 21601148 | 21601167 | 21601164 | + |
| SEQ ID NO 16727 | AAATGATTGTAGTAAGACCT | GGG | chr12 | 21601149 | 21601168 | 21601165 | + |
| SEQ ID NO 16728 | ATTGTAGTAAGACCTGGGCA | AAG | chr12 | 21601154 | 21601173 | 21601170 | + |
| SEQ ID NO 16729 | TTGTAGTAAGACCTGGGCAA | AGG | chr12 | 21601155 | 21601174 | 21601171 | + |
| SEQ ID NO 16730 | GTAGTAAGACCTGGGCAAAG | GAG | chr12 | 21601157 | 21601176 | 21601173 | + |
| SEQ ID NO 16731 | AGTAAGACCTGGGCAAAGGA | GAG | chr12 | 21601159 | 21601178 | 21601175 | + |
| SEQ ID NO 16732 | TAAGACCTGGGCAAAGGAGA | GAG | chr12 | 21601161 | 21601180 | 21601177 | + |
| SEQ ID NO 16733 | AAACATTTTTCCCCCACATT | TGG | chr12 | 21601185 | 21601204 | 21601201 | + |
| SEQ ID NO 16734 | AACATTTTTCCCCCACATTT | GGG | chr12 | 21601186 | 21601205 | 21601202 | + |
| SEQ ID NO 16735 | TTGGGCAAAACTTTCCATCC | TGG | chr12 | 21601204 | 21601223 | 21601220 | + |
| SEQ ID NO 16736 | TGGGCAAAACTTTCCATCCT | GGG | chr12 | 21601205 | 21601224 | 21601221 | + |
| SEQ ID NO 16737 | TTCCATCCTGGTCACACCA | CAG | chr12 | 21601216 | 21601235 | 21601232 | + |
| SEQ ID NO 16738 | CTCCTCTCCTCTCCCTCAAC | TGG | chr12 | 21601249 | 21601268 | 21601265 | + |
| SEQ ID NO 16739 | TCCTCTCCCTCAACTGGTAA | CAG | chr12 | 21601255 | 21601274 | 21601271 | + |
| SEQ ID NO 16740 | CCAAAACATACCTGACTACT | TAG | chr12 | 21601286 | 21601305 | 21601302 | + |
| SEQ ID NO 16741 | CTTAGTACTTCCCACTACTG | TGG | chr12 | 21601304 | 21601323 | 21601320 | + |
| SEQ ID NO 16742 | GTACTTCCCACTACTGTGGA | TAG | chr12 | 21601308 | 21601327 | 21601324 | + |
| SEQ ID NO 16743 | CACTACTGTGGATAGAATTT | CAG | chr12 | 21601316 | 21601335 | 21601332 | + |
| SEQ ID NO 16744 | CTCATTCATTGTTCATACCC | TGG | chr12 | 21601345 | 21601364 | 21601361 | + |
| SEQ ID NO 16745 | CATTCATTGTTCATACCCTG | GAG | chr12 | 21601347 | 21601366 | 21601363 | + |
| SEQ ID NO 16746 | CCCTGGAGACAAAACTCCTT | AAG | chr12 | 21601362 | 21601381 | 21601378 | + |
| SEQ ID NO 16747 | CCTGGAGACAAAACTCCTTA | AGG | chr12 | 21601363 | 21601382 | 21601379 | + |
| SEQ ID NO 16748 | TAAGGCTATTAACTCCCCCT | GAG | chr12 | 21601381 | 21601400 | 21601397 | + |
| SEQ ID NO 16749 | TCCCCCTGAGCTTCACAATC | TAG | chr12 | 21601394 | 21601413 | 21601410 | + |
| SEQ ID NO 16750 | GCTTCACAATCTAGTCCCTG | CAG | chr12 | 21601403 | 21601422 | 21601419 | + |
| SEQ ID NO 16751 | CTTCACAATCTAGTCCCTGC | AGG | chr12 | 21601404 | 21601423 | 21601420 | + |
| SEQ ID NO 16752 | TCCTCTCCTTTTCCCTCTCT | GAG | chr12 | 21601449 | 21601468 | 21601465 | + |
| SEQ ID NO 16753 | TTCCCTCTGAGCCCCGCT | CAG | chr12 | 21601459 | 21601478 | 21601475 | + |
| SEQ ID NO 16754 | GCCCCGCTCAGATCTTCGAA | CAG | chr12 | 21601471 | 21601490 | 21601487 | + |
| SEQ ID NO 16755 | CCCGCTCAGATCTTCGAACA | GAG | chr12 | 21601473 | 21601492 | 21601489 | + |
| SEQ ID NO 16756 | CAGAGAACACTTCTGCATCT | TGG | chr12 | 21601491 | 21601510 | 21601507 | + |
| SEQ ID NO 16757 | CTTCTGCATCTTGGCATATA | TAG | chr12 | 21601500 | 21601519 | 21601516 | + |
| SEQ ID NO 16758 | GCATATATAGTTCTCTCACA | TAG | chr12 | 21601513 | 21601532 | 21601529 | + |
| SEQ ID NO 16759 | ATAGAACGCTTTCTCCCCTT | TAG | chr12 | 21601532 | 21601551 | 21601548 | + |
| SEQ ID NO 16760 | CCTTTAGCTATTTATCCTTC | AAG | chr12 | 21601548 | 21601567 | 21601564 | + |
| SEQ ID NO 16761 | GCTATTTATCCTTCAAGTGT | CAG | chr12 | 21601554 | 21601573 | 21601570 | + |
| SEQ ID NO 16762 | CAGCTCAAACATCTCATCAT | TAG | chr12 | 21601574 | 21601593 | 21601590 | + |
| SEQ ID NO 16763 | GCTCAAACATCTCATCATTA | GAG | chr12 | 21601576 | 21601595 | 21601592 | + |
| SEQ ID NO 16764 | TCAAACATCTCATCATTAGA | GAG | chr12 | 21601578 | 21601597 | 21601594 | + |
| SEQ ID NO 16765 | CAAACATCTCATCATTAGAG | AGG | chr12 | 21601579 | 21601598 | 21601595 | + |
| SEQ ID NO 16766 | AGAGGTTTTTCCCAAACCTC | TAG | chr12 | 21601597 | 21601616 | 21601613 | + |

Figure 43 (Cont'd)

| | | | | | | | |
|---|---|---|---|---|---|---|---|
| SEQ ID NO 16767 | GAGGTTTTTCCCAAACCTCT | AGG | chr12 | 21601598 | 21601617 | 21601614 | + |
| SEQ ID NO 16768 | TTCCCAAACCTCTAGGTAAC | TAG | chr12 | 21601605 | 21601624 | 21601621 | + |
| SEQ ID NO 16769 | TCCCAAACCTCTAGGTAACT | AGG | chr12 | 21601606 | 21601625 | 21601622 | + |
| SEQ ID NO 16770 | AAACCTCTAGGTAACTAGGT | TAG | chr12 | 21601610 | 21601629 | 21601626 | + |
| SEQ ID NO 16771 | AGAAACCACTCCCCATTCCA | CGG | chr12 | 21601631 | 21601650 | 21601647 | + |
| SEQ ID NO 16772 | CCATTCCACGGTACACTGTA | TAG | chr12 | 21601643 | 21601662 | 21601659 | + |
| SEQ ID NO 16773 | CACGGTACACTGTATAGTCT | TAG | chr12 | 21601649 | 21601668 | 21601665 | + |
| SEQ ID NO 16774 | ACGGTACACTGTATAGTCTT | AGG | chr12 | 21601650 | 21601669 | 21601666 | + |
| SEQ ID NO 16775 | CTGTATAGTCTTAGGACACC | TGG | chr12 | 21601658 | 21601677 | 21601674 | + |
| SEQ ID NO 16776 | CTTAGGACACCTGGTTCCCT | TAG | chr12 | 21601667 | 21601686 | 21601683 | + |
| SEQ ID NO 16777 | TACAAATTTGTCAATTCTTG | AAG | chr12 | 21601739 | 21601758 | 21601755 | + |
| SEQ ID NO 16778 | TTTGTCAATTCTTGAAGATT | AAG | chr12 | 21601745 | 21601764 | 21601761 | + |
| SEQ ID NO 16779 | AATTCTTGAAGATTAAGAAT | CAG | chr12 | 21601751 | 21601770 | 21601767 | + |
| SEQ ID NO 16780 | ACTCTATCTCCCTCGCCTCT | CAG | chr12 | 21601787 | 21601806 | 21601803 | + |
| SEQ ID NO 16781 | TCTCAGTGCCTGATACCTAA | TAG | chr12 | 21601804 | 21601823 | 21601820 | + |
| SEQ ID NO 16782 | ATCCTTACTGAATAATAAAA | TGG | chr12 | 21601838 | 21601857 | 21601854 | + |
| SEQ ID NO 16783 | TAAAATGGATTAATGAATAA | AAG | chr12 | 21601853 | 21601872 | 21601869 | + |
| SEQ ID NO 16784 | GAATAAAAGCAATAAATTTC | AAG | chr12 | 21601867 | 21601886 | 21601883 | + |
| SEQ ID NO 16785 | AATAAAAGCAATAAATTTCA | AGG | chr12 | 21601868 | 21601887 | 21601884 | + |
| SEQ ID NO 16786 | GTTAATATTAATAAATTAAA | AAG | chr12 | 21601890 | 21601909 | 21601906 | + |
| SEQ ID NO 16787 | TTAATATTAATAAATTAAAA | AGG | chr12 | 21601891 | 21601910 | 21601907 | + |
| SEQ ID NO 16788 | AAATTAAAAGGTTATTTTG | AAG | chr12 | 21601902 | 21601921 | 21601918 | + |
| SEQ ID NO 16789 | AAAAGGTTATTTTGAAGTCT | GAG | chr12 | 21601908 | 21601927 | 21601924 | + |
| SEQ ID NO 16790 | TTATTTTGAAGTCTGAGAAT | TAG | chr12 | 21601914 | 21601933 | 21601930 | + |
| SEQ ID NO 16791 | TTTCACGTTCCATTGTTCA | TGG | chr12 | 21601975 | 21601994 | 21601991 | + |
| SEQ ID NO 16792 | TTCACGTTTCCATTGTTCAT | GGG | chr12 | 21601976 | 21601995 | 21601992 | + |
| SEQ ID NO 16793 | ATTGTTCATGGGCAAAATTC | TGG | chr12 | 21601987 | 21602006 | 21602003 | + |
| SEQ ID NO 16794 | GTTCATGGGCAAAATTCTGG | CAG | chr12 | 21601990 | 21602009 | 21602006 | + |
| SEQ ID NO 16795 | ATGGGCAAAATTCTGGCAGC | AAG | chr12 | 21601994 | 21602013 | 21602010 | + |
| SEQ ID NO 16796 | TGGGCAAAATTCTGGCAGCA | AGG | chr12 | 21601995 | 21602014 | 21602011 | + |
| SEQ ID NO 16797 | GGGCAAAATTCTGGCAGCAA | GGG | chr12 | 21601996 | 21602015 | 21602012 | + |
| SEQ ID NO 16798 | CAGCAAGGGATTCTTCTCCT | AAG | chr12 | 21602010 | 21602029 | 21602026 | + |
| SEQ ID NO 16799 | TAAGAAACCTTTTGTTTTCT | TGG | chr12 | 21602029 | 21602048 | 21602045 | + |
| SEQ ID NO 16800 | GAATACATTTCCTTGTTTGC | CAG | chr12 | 21602056 | 21602075 | 21602072 | + |
| SEQ ID NO 16801 | TCCTTGTTTGCCAGAAAACA | TGG | chr12 | 21602065 | 21602084 | 21602081 | + |
| SEQ ID NO 16802 | TGTTTGCCAGAAAACATGGT | AAG | chr12 | 21602069 | 21602088 | 21602085 | + |
| SEQ ID NO 16803 | AGAAAACATGGTAAGATAAC | TGG | chr12 | 21602077 | 21602096 | 21602093 | + |
| SEQ ID NO 16804 | AAAACATGGTAAGATAACTG | GAG | chr12 | 21602079 | 21602098 | 21602095 | + |
| SEQ ID NO 16805 | AACATGGTAAGATAACTGGA | GAG | chr12 | 21602081 | 21602100 | 21602097 | + |
| SEQ ID NO 16806 | TAACATTCATTTTATTCATG | AAG | chr12 | 21602106 | 21602125 | 21602122 | + |
| SEQ ID NO 16807 | TTCATGAAGAAACTGTTATT | CAG | chr12 | 21602120 | 21602139 | 21602136 | + |
| SEQ ID NO 16808 | AAGAAACTGTTATTCAGTTT | AAG | chr12 | 21602126 | 21602145 | 21602142 | + |
| SEQ ID NO 16809 | AGAAACTGTTATTCAGTTTA | AGG | chr12 | 21602127 | 21602146 | 21602143 | + |
| SEQ ID NO 16810 | GAAACTGTTATTCAGTTTAA | GGG | chr12 | 21602128 | 21602147 | 21602144 | + |
| SEQ ID NO 16811 | AAACTGTTATTCAGTTTAAG | GGG | chr12 | 21602129 | 21602148 | 21602145 | + |
| SEQ ID NO 16812 | CAGTTTAAGGGGTTCTTTTT | CAG | chr12 | 21602140 | 21602159 | 21602156 | + |
| SEQ ID NO 16813 | TTAAGGGGTTCTTTTTCAGA | AAG | chr12 | 21602144 | 21602163 | 21602160 | + |

Figure 43 (Cont'd)

| | | | | | | | |
|---|---|---|---|---|---|---|---|
| SEQ ID NO 16814 | GGTTCTTTTTCAGAAAGTTT | CAG | chr12 | 21602150 | 21602169 | 21602166 | + |
| SEQ ID NO 16815 | TCAGAAAGTTTCAGAAATCC | AAG | chr12 | 21602159 | 21602178 | 21602175 | + |
| SEQ ID NO 16816 | AATCCAAGACCTTTGACTGC | AAG | chr12 | 21602174 | 21602193 | 21602190 | + |
| SEQ ID NO 16817 | GTACTGTGTTCTTTCATCTA | TAG | chr12 | 21602196 | 21602215 | 21602212 | + |
| SEQ ID NO 16818 | TACTGTGTTCTTTCATCTAT | AGG | chr12 | 21602197 | 21602216 | 21602213 | + |
| SEQ ID NO 16819 | GGACATTTCCTTTGAAAACT | GAG | chr12 | 21602218 | 21602237 | 21602234 | + |
| SEQ ID NO 16820 | GACATTTCCTTTGAAAACTG | AGG | chr12 | 21602219 | 21602238 | 21602235 | + |
| SEQ ID NO 16821 | AATATTTAATTCTTACATAA | TAG | chr12 | 21602246 | 21602265 | 21602262 | + |
| SEQ ID NO 16822 | ATTCTTACATAATAGTAAAA | AAG | chr12 | 21602254 | 21602273 | 21602270 | + |
| SEQ ID NO 16823 | ATAATAGTAAAAAGTGAAT | TGG | chr12 | 21602262 | 21602281 | 21602278 | + |
| SEQ ID NO 16824 | GTAAAAAGTGAATTGGCCT | TGG | chr12 | 21602268 | 21602287 | 21602284 | + |
| SEQ ID NO 16825 | AAAGTGAATTGGCCTTGGAA | AAG | chr12 | 21602273 | 21602292 | 21602289 | + |
| SEQ ID NO 16826 | CTTGGAAAAGACCTAAATCC | TGG | chr12 | 21602286 | 21602305 | 21602302 | + |
| SEQ ID NO 16827 | AATCAATTTGCTCTATGAAC | TGG | chr12 | 21602350 | 21602369 | 21602366 | + |
| SEQ ID NO 16828 | TCAATTTGCTCTATGAACTG | GAG | chr12 | 21602352 | 21602371 | 21602368 | + |
| SEQ ID NO 16829 | CAATTTGCTCTATGAACTGG | AGG | chr12 | 21602353 | 21602372 | 21602369 | + |
| SEQ ID NO 16830 | ATTTGCTCTATGAACTGGAG | GAG | chr12 | 21602355 | 21602374 | 21602371 | + |
| SEQ ID NO 16831 | TGCTCTATGAACTGGAGGAG | TGG | chr12 | 21602358 | 21602377 | 21602374 | + |
| SEQ ID NO 16832 | GCTCTATGAACTGGAGGAGT | GGG | chr12 | 21602359 | 21602378 | 21602375 | + |
| SEQ ID NO 16833 | GAGTGGGATTCATGATCTCT | AAG | chr12 | 21602375 | 21602394 | 21602391 | + |
| SEQ ID NO 16834 | CATATCACTACTATGAAATG | CAG | chr12 | 21602404 | 21602423 | 21602420 | + |
| SEQ ID NO 16835 | ATATCACTACTATGAAATGC | AGG | chr12 | 21602405 | 21602424 | 21602421 | + |
| SEQ ID NO 16836 | TATCACTACTATGAAATGCA | GGG | chr12 | 21602406 | 21602425 | 21602422 | + |
| SEQ ID NO 16837 | CACTACTATGAAATGCAGGG | AAG | chr12 | 21602409 | 21602428 | 21602425 | + |
| SEQ ID NO 16838 | AATTCAAATCATTAAATTTA | AAG | chr12 | 21602436 | 21602455 | 21602452 | + |
| SEQ ID NO 16839 | CATTAAATTTAAAGAAACTA | TAG | chr12 | 21602445 | 21602464 | 21602461 | + |
| SEQ ID NO 16840 | TAAATTTAAAGAAACTATAG | TGG | chr12 | 21602448 | 21602467 | 21602464 | + |
| SEQ ID NO 16841 | CTATAGTGGCAATGTATTAT | TAG | chr12 | 21602462 | 21602481 | 21602478 | + |
| SEQ ID NO 16842 | TATAGTGGCAATGTATTATT | AGG | chr12 | 21602463 | 21602482 | 21602479 | + |
| SEQ ID NO 16843 | ATGAAAATCTCAAACCATAC | CAG | chr12 | 21602512 | 21602531 | 21602528 | + |
| SEQ ID NO 16844 | TGAAAATCTCAAACCATACC | AGG | chr12 | 21602513 | 21602532 | 21602529 | + |
| SEQ ID NO 16845 | GCTATGATAATATTAAAATA | AAG | chr12 | 21602535 | 21602554 | 21602551 | + |
| SEQ ID NO 16846 | ATTAAAATAAAGATACATTG | AAG | chr12 | 21602546 | 21602565 | 21602562 | + |
| SEQ ID NO 16847 | AACTTGTGTAAATCACATTG | TGG | chr12 | 21602577 | 21602596 | 21602593 | + |
| SEQ ID NO 16848 | ACTTGTGTAAATCACATTGT | GGG | chr12 | 21602578 | 21602597 | 21602594 | + |
| SEQ ID NO 16849 | CTTGTGTAAATCACATTGTG | GGG | chr12 | 21602579 | 21602598 | 21602595 | + |
| SEQ ID NO 16850 | AACACTTCCCTTCCCCTTGA | AAG | chr12 | 21602615 | 21602634 | 21602631 | + |
| SEQ ID NO 16851 | ACACTTCCCTTCCCCTTGAA | AGG | chr12 | 21602616 | 21602635 | 21602632 | + |
| SEQ ID NO 16852 | CACTTCCCTTCCCCTTGAAA | GGG | chr12 | 21602617 | 21602636 | 21602633 | + |
| SEQ ID NO 16853 | TCCCCTTGAAAGGGAAATGA | TAG | chr12 | 21602626 | 21602645 | 21602642 | + |
| SEQ ID NO 16854 | AAAGGGAAATGATAGAAAAT | AAG | chr12 | 21602634 | 21602653 | 21602650 | + |
| SEQ ID NO 16855 | ATGATAGAAAATAAGTATTA | AAG | chr12 | 21602642 | 21602661 | 21602658 | + |
| SEQ ID NO 16856 | TGATAGAAAATAAGTATTAA | AGG | chr12 | 21602643 | 21602662 | 21602659 | + |
| SEQ ID NO 16857 | TAGAAAATAAGTATTAAAGG | CAG | chr12 | 21602646 | 21602665 | 21602662 | + |
| SEQ ID NO 16858 | AATAAGTATTAAAGGCAGCT | TAG | chr12 | 21602651 | 21602670 | 21602667 | + |
| SEQ ID NO 16859 | ATAAGTATTAAAGGCAGCTT | AGG | chr12 | 21602652 | 21602671 | 21602668 | + |
| SEQ ID NO 16860 | TAAGTATTAAAGGCAGCTTA | GGG | chr12 | 21602653 | 21602672 | 21602669 | + |

Figure 43 (Cont'd)

| | | | | | | | |
|---|---|---|---|---|---|---|---|
| SEQ ID NO 16861 | AAGTATTAAAGGCAGCTTAG | GGG | chr12 | 21602654 | 21602673 | 21602670 | + |
| SEQ ID NO 16862 | TTTTCAAAAAAAAATCCATT | GAG | chr12 | 21602691 | 21602710 | 21602707 | + |
| SEQ ID NO 16863 | ATTGAGCATTTTCTATGTAC | CAG | chr12 | 21602708 | 21602727 | 21602724 | + |
| SEQ ID NO 16864 | TTGAGCATTTTCTATGTACC | AGG | chr12 | 21602709 | 21602728 | 21602725 | + |
| SEQ ID NO 16865 | CTATGTACCAGGCACTGTTC | TAG | chr12 | 21602720 | 21602739 | 21602736 | + |
| SEQ ID NO 16866 | CAGGCACTGTTCTAGACCCT | GAG | chr12 | 21602728 | 21602747 | 21602744 | + |
| SEQ ID NO 16867 | ACACACATGCTACTGATTAT | AAG | chr12 | 21602755 | 21602774 | 21602771 | + |
| SEQ ID NO 16868 | ATAAGATCCATAAAATAACT | TAG | chr12 | 21602773 | 21602792 | 21602789 | + |
| SEQ ID NO 16869 | ATAAAATAACTTAGTTTCAC | TGG | chr12 | 21602782 | 21602801 | 21602798 | + |
| SEQ ID NO 16870 | TAGTTTCACTGGCGTGTTCC | CAG | chr12 | 21602793 | 21602812 | 21602809 | + |
| SEQ ID NO 16871 | ACTGGCGTGTTCCCAGTGCC | CAG | chr12 | 21602800 | 21602819 | 21602816 | + |
| SEQ ID NO 16872 | CTGGCGTGTTCCCAGTGCCC | AGG | chr12 | 21602801 | 21602820 | 21602817 | + |
| SEQ ID NO 16873 | TGTTCCCAGTGCCCAGGTAA | CAG | chr12 | 21602807 | 21602826 | 21602823 | + |
| SEQ ID NO 16874 | ATTAATGTTTGTTAAATGAT | GAG | chr12 | 21602836 | 21602855 | 21602852 | + |
| SEQ ID NO 16875 | TGTTTGTTAAATGATGAGAA | AAG | chr12 | 21602841 | 21602860 | 21602857 | + |
| SEQ ID NO 16876 | TTTGTTAAATGATGAGAAAA | GAG | chr12 | 21602843 | 21602862 | 21602859 | + |
| SEQ ID NO 16877 | TTGTTAAATGATGAGAAAAG | AGG | chr12 | 21602844 | 21602863 | 21602860 | + |
| SEQ ID NO 16878 | TAAATGATGAGAAAAGAGGA | AAG | chr12 | 21602848 | 21602867 | 21602864 | + |
| SEQ ID NO 16879 | ATGATGAGAAAAGAGGAAAG | CAG | chr12 | 21602851 | 21602870 | 21602867 | + |
| SEQ ID NO 16880 | ATGAGAAAGAGGAAAGCAG | AAG | chr12 | 21602854 | 21602873 | 21602870 | + |
| SEQ ID NO 16881 | TGAGAAAAGAGGAAAGCAGA | AGG | chr12 | 21602855 | 21602874 | 21602871 | + |
| SEQ ID NO 16882 | GAGAAAAGAGGAAAGCAGAA | GGG | chr12 | 21602856 | 21602875 | 21602872 | + |
| SEQ ID NO 16883 | AGAAAAGAGGAAAGCAGAAG | GGG | chr12 | 21602857 | 21602876 | 21602873 | + |
| SEQ ID NO 16884 | AAAGCAGAAGGGGCTCTGCT | CAG | chr12 | 21602867 | 21602886 | 21602883 | + |
| SEQ ID NO 16885 | AAGCAGAAGGGGCTCTGCTC | AGG | chr12 | 21602868 | 21602887 | 21602884 | + |
| SEQ ID NO 16886 | GAAGGGGCTCTGCTCAGGTG | CAG | chr12 | 21602873 | 21602892 | 21602889 | + |
| SEQ ID NO 16887 | AAGGGGCTCTGCTCAGGTGC | AGG | chr12 | 21602874 | 21602893 | 21602890 | + |
| SEQ ID NO 16888 | CTCAGGTGCAGGAACTTGTG | CAG | chr12 | 21602885 | 21602904 | 21602901 | + |
| SEQ ID NO 16889 | CAGGTGCAGGAACTTGTGCA | GAG | chr12 | 21602887 | 21602906 | 21602903 | + |
| SEQ ID NO 16890 | GAACTTGTGCAGAGATCTT | TGG | chr12 | 21602896 | 21602915 | 21602912 | + |
| SEQ ID NO 16891 | AGATCTTCTGGACTGATTCC | CAG | chr12 | 21602908 | 21602927 | 21602924 | + |
| SEQ ID NO 16892 | GACTGATTCCCAGTGCTAAC | AAG | chr12 | 21602918 | 21602937 | 21602934 | + |
| SEQ ID NO 16893 | CAGTGCTAACAAGTCCCTTC | CAG | chr12 | 21602928 | 21602947 | 21602944 | + |
| SEQ ID NO 16894 | TTCCAGTTTTATCCACCAAT | AAG | chr12 | 21602945 | 21602964 | 21602961 | + |
| SEQ ID NO 16895 | CACCAATAAGCTATGTCCTT | GAG | chr12 | 21602958 | 21602977 | 21602974 | + |
| SEQ ID NO 16896 | TTGAGCTCCTGCCCACTCTC | TAG | chr12 | 21602976 | 21602995 | 21602992 | + |
| SEQ ID NO 16897 | GAGCTCCTGCCCACTCTCTA | GAG | chr12 | 21602978 | 21602997 | 21602994 | + |
| SEQ ID NO 16898 | CTAGAGAAAACTTTTATTTC | AAG | chr12 | 21602995 | 21603014 | 21603011 | + |
| SEQ ID NO 16899 | TAGAGAAAACTTTTATTTCA | AGG | chr12 | 21602996 | 21603015 | 21603012 | + |
| SEQ ID NO 16900 | TTTTATTTCAAGGCATACTC | CGG | chr12 | 21603006 | 21603025 | 21603022 | + |
| SEQ ID NO 16901 | TTTATTTCAAGGCATACTCC | GGG | chr12 | 21603007 | 21603026 | 21603023 | + |
| SEQ ID NO 16902 | ACTCCGGGATTCACATGTGA | TAG | chr12 | 21603022 | 21603041 | 21603038 | + |
| SEQ ID NO 16903 | TCCGGGATTCACATGTGATA | GAG | chr12 | 21603024 | 21603043 | 21603040 | + |
| SEQ ID NO 16904 | GGATTCACATGTGATAGAGA | TGG | chr12 | 21603028 | 21603047 | 21603044 | + |
| SEQ ID NO 16905 | GATAGAGATGGTTCTGTTCC | CAG | chr12 | 21603040 | 21603059 | 21603056 | + |
| SEQ ID NO 16906 | ATAGAGATGGTTCTGTTCCC | AGG | chr12 | 21603041 | 21603060 | 21603057 | + |
| SEQ ID NO 16907 | GGTTCTGTTCCCAGGAACTT | TGG | chr12 | 21603049 | 21603068 | 21603065 | + |

Figure 43 (Cont'd)

| | | | | | | | |
|---|---|---|---|---|---|---|---|
| SEQ ID NO 16908 | GTTCTGTTCCCAGGAACTTT | GGG | chr12 | 21603050 | 21603069 | 21603066 | + |
| SEQ ID NO 16909 | CTTTGGGCATATTTAAAAAC | TGG | chr12 | 21603066 | 21603085 | 21603082 | + |
| SEQ ID NO 16910 | GGCATATTTAAAAACTGGAC | TGG | chr12 | 21603071 | 21603090 | 21603087 | + |
| SEQ ID NO 16911 | GGACTGGAAAAATTTGTGAC | TAG | chr12 | 21603087 | 21603106 | 21603103 | + |
| SEQ ID NO 16912 | GAAAAATTTGTGACTAGAAA | AAG | chr12 | 21603093 | 21603112 | 21603109 | + |
| SEQ ID NO 16913 | AAAAATTTGTGACTAGAAAA | AGG | chr12 | 21603094 | 21603113 | 21603110 | + |
| SEQ ID NO 16914 | TTAAAAACACATGCTCATTT | CAG | chr12 | 21603120 | 21603139 | 21603136 | + |
| SEQ ID NO 16915 | TAAAAACACATGCTCATTTC | AGG | chr12 | 21603121 | 21603140 | 21603137 | + |
| SEQ ID NO 16916 | CACATGCTCATTTCAGGATA | AAG | chr12 | 21603127 | 21603146 | 21603143 | + |
| SEQ ID NO 16917 | ATTTCAGGATAAAGATCTCT | GAG | chr12 | 21603136 | 21603155 | 21603152 | + |
| SEQ ID NO 16918 | TTTCAGGATAAAGATCTCTG | AGG | chr12 | 21603137 | 21603156 | 21603153 | + |
| SEQ ID NO 16919 | GGATAAAGATCTCTGAGGAA | AAG | chr12 | 21603142 | 21603161 | 21603158 | + |
| SEQ ID NO 16920 | AGAATACAAAATAATTTAAA | AAG | chr12 | 21603163 | 21603182 | 21603179 | + |
| SEQ ID NO 16921 | AATAATTTAAAAAGAAACAA | CAG | chr12 | 21603172 | 21603191 | 21603188 | + |
| SEQ ID NO 16922 | TTAAAAGAAACAACAGAAA | CAG | chr12 | 21603178 | 21603197 | 21603194 | + |
| SEQ ID NO 16923 | TAAAAAGAAACAACAGAAAC | AGG | chr12 | 21603179 | 21603198 | 21603195 | + |
| SEQ ID NO 16924 | ATACTTCACTTCTCTGTAAT | AAG | chr12 | 21603212 | 21603231 | 21603228 | + |
| SEQ ID NO 16925 | TACTTCACTTCTCTGTAATA | AGG | chr12 | 21603213 | 21603232 | 21603229 | + |
| SEQ ID NO 16926 | TAATAAGGTTTCTGTCCTCC | TAG | chr12 | 21603228 | 21603247 | 21603244 | + |
| SEQ ID NO 16927 | GATTCTTTCTCACTAAACTA | CAG | chr12 | 21603250 | 21603269 | 21603266 | + |
| SEQ ID NO 16928 | TTCTTTCTCACTAAACTACA | GAG | chr12 | 21603252 | 21603271 | 21603268 | + |
| SEQ ID NO 16929 | CTCACTAAACTACAGAGAAT | AAG | chr12 | 21603258 | 21603277 | 21603274 | + |
| SEQ ID NO 16930 | GCATTCTGTCCACTTCTACA | TAG | chr12 | 21603303 | 21603322 | 21603319 | + |
| SEQ ID NO 16931 | CATTCTGTCCACTTCTACAT | AGG | chr12 | 21603304 | 21603323 | 21603320 | + |
| SEQ ID NO 16932 | TTTTATGAATGCATACACAC | GAG | chr12 | 21603349 | 21603368 | 21603365 | + |
| SEQ ID NO 16933 | ATACACGAGAACTTTGAA | CAG | chr12 | 21603361 | 21603380 | 21603377 | + |
| SEQ ID NO 16934 | ACACGAGAACTTTGAACAGT | TAG | chr12 | 21603365 | 21603384 | 21603381 | + |
| SEQ ID NO 16935 | GAACTTTGAACAGTTAGTAT | AAG | chr12 | 21603371 | 21603390 | 21603387 | + |
| SEQ ID NO 16936 | AACTTTGAACAGTTAGTATA | AGG | chr12 | 21603372 | 21603391 | 21603388 | + |
| SEQ ID NO 16937 | TAAGGTGAATTCTGATTTTT | CAG | chr12 | 21603390 | 21603409 | 21603406 | + |
| SEQ ID NO 16938 | TATATAATGCATTTAATTTT | GAG | chr12 | 21603424 | 21603443 | 21603440 | + |
| SEQ ID NO 16939 | ATTTAATTTTGAGATTATGC | TGG | chr12 | 21603434 | 21603453 | 21603450 | + |
| SEQ ID NO 16940 | GAGATTATGCTGGCTCTGAT | TAG | chr12 | 21603444 | 21603463 | 21603460 | + |
| SEQ ID NO 16941 | TGCTGGCTCTGATTAGCCAA | AAG | chr12 | 21603451 | 21603470 | 21603467 | + |
| SEQ ID NO 16942 | TGGCTCTGATTAGCCAAAAG | AAG | chr12 | 21603454 | 21603473 | 21603470 | + |
| SEQ ID NO 16943 | GGCTCTGATTAGCCAAAAGA | AGG | chr12 | 21603455 | 21603474 | 21603471 | + |
| SEQ ID NO 16944 | TCTGATTAGCCAAAAGAAGG | AAG | chr12 | 21603458 | 21603477 | 21603474 | + |
| SEQ ID NO 16945 | GGAAGTAATATATCACATTC | TGG | chr12 | 21603476 | 21603495 | 21603492 | + |
| SEQ ID NO 16946 | TCACATTCTGGTTATTATTT | CAG | chr12 | 21603488 | 21603507 | 21603504 | + |
| SEQ ID NO 16947 | GGTTATTATTTCAGATCCTT | TAG | chr12 | 21603497 | 21603516 | 21603513 | + |
| SEQ ID NO 16948 | GATCCTTTAGATTACTGTAA | TAG | chr12 | 21603510 | 21603529 | 21603526 | + |
| SEQ ID NO 16949 | TTACTGTAATAGACATGAAA | TAG | chr12 | 21603521 | 21603540 | 21603537 | + |
| SEQ ID NO 16950 | CACAACACATGACATAATTT | CAG | chr12 | 21603578 | 21603597 | 21603594 | + |
| SEQ ID NO 16951 | TCAGATCGTTTAAATCACAC | AAG | chr12 | 21603597 | 21603616 | 21603613 | + |
| SEQ ID NO 16952 | AGTCATCACTGCCATTTACC | CAG | chr12 | 21603618 | 21603637 | 21603634 | + |
| SEQ ID NO 16953 | ACTGCCATTTACCCAGCAAT | CAG | chr12 | 21603625 | 21603644 | 21603641 | + |
| SEQ ID NO 16954 | CCATTTACCCAGCAATCAGT | TGG | chr12 | 21603629 | 21603648 | 21603645 | + |

Figure 43 (Cont'd)

| | | | | | | | |
|---|---|---|---|---|---|---|---|
| SEQ ID NO 16955 | ATCAGTTGGCTTGATTCTTC | AAG | chr12 | 21603643 | 21603662 | 21603659 | + |
| SEQ ID NO 16956 | GCTTGATTCTTCAAGATCTT | GAG | chr12 | 21603651 | 21603670 | 21603667 | + |
| SEQ ID NO 16957 | CTTGATTCTTCAAGATCTTG | AGG | chr12 | 21603652 | 21603671 | 21603668 | + |
| SEQ ID NO 16958 | CTTCAAGATCTTGAGGAACT | CAG | chr12 | 21603659 | 21603678 | 21603675 | + |
| SEQ ID NO 16959 | CTTTGCTAATGTTCCTTCAA | TAG | chr12 | 21603703 | 21603722 | 21603719 | + |
| SEQ ID NO 16960 | TAGTCTTGACACTTTTAAAC | TAG | chr12 | 21603723 | 21603742 | 21603739 | + |
| SEQ ID NO 16961 | GTCTTGACACTTTTAAACTA | GAG | chr12 | 21603725 | 21603744 | 21603741 | + |
| SEQ ID NO 16962 | CTTGACACTTTTAAACTAGA | GAG | chr12 | 21603727 | 21603746 | 21603743 | + |
| SEQ ID NO 16963 | ACTAGAGAGTATAAACCCAC | AAG | chr12 | 21603741 | 21603760 | 21603757 | + |
| SEQ ID NO 16964 | CTAGAGAGTATAAACCCACA | AGG | chr12 | 21603742 | 21603761 | 21603758 | + |
| SEQ ID NO 16965 | GGAATTGTTTTATAATTTTA | CAG | chr12 | 21603763 | 21603782 | 21603779 | + |
| SEQ ID NO 16966 | TTTCAAAATCATTTACATTG | TGG | chr12 | 21603796 | 21603815 | 21603812 | + |
| SEQ ID NO 16967 | CTACCTTGCCTTCTCTTACC | CAG | chr12 | 21603823 | 21603842 | 21603839 | + |
| SEQ ID NO 16968 | TTGCCTTCTCTTACCCAGCA | CAG | chr12 | 21603828 | 21603847 | 21603844 | + |
| SEQ ID NO 16969 | TTCTCTTACCCAGCACAGAT | GAG | chr12 | 21603833 | 21603852 | 21603849 | + |
| SEQ ID NO 16970 | TCTCTTACCCAGCACAGATG | AGG | chr12 | 21603834 | 21603853 | 21603850 | + |
| SEQ ID NO 16971 | TTATTTTATAATTCCTACAT | AAG | chr12 | 21603898 | 21603917 | 21603914 | + |
| SEQ ID NO 16972 | TTATAATTCCTACATAAGCA | TAG | chr12 | 21603903 | 21603922 | 21603919 | + |
| SEQ ID NO 16973 | CCTACATAAGCATAGCATTG | AAG | chr12 | 21603911 | 21603930 | 21603927 | + |
| SEQ ID NO 16974 | AAAAATTACTTTCATTCTGA | AAG | chr12 | 21603936 | 21603955 | 21603952 | + |
| SEQ ID NO 16975 | AAAATTACTTTCATTCTGAA | AGG | chr12 | 21603937 | 21603956 | 21603953 | + |
| SEQ ID NO 16976 | AATTACTTTCATTCTGAAAG | GAG | chr12 | 21603939 | 21603958 | 21603955 | + |
| SEQ ID NO 16977 | CTTTCATTCTGAAAGGAGCA | CAG | chr12 | 21603944 | 21603963 | 21603960 | + |
| SEQ ID NO 16978 | AGCACAGTATTTTGCCTTTT | GAG | chr12 | 21603960 | 21603979 | 21603976 | + |
| SEQ ID NO 16979 | ACAGTATTTTGCCTTTTGAG | AAG | chr12 | 21603963 | 21603982 | 21603979 | + |
| SEQ ID NO 16980 | TGAATTAAAACATTAATTCC | AAG | chr12 | 21603990 | 21604009 | 21604006 | + |
| SEQ ID NO 16981 | TGTGAATATGAAACATTCTT | AAG | chr12 | 21604018 | 21604037 | 21604034 | + |
| SEQ ID NO 16982 | GCATTTCATATAATTACTAA | CAG | chr12 | 21604040 | 21604059 | 21604056 | + |
| SEQ ID NO 16983 | ATATAATTACTAACAGAATG | TAG | chr12 | 21604047 | 21604066 | 21604063 | + |
| SEQ ID NO 16984 | ATAATTACTAACAGAATGTA | GAG | chr12 | 21604049 | 21604068 | 21604065 | + |
| SEQ ID NO 16985 | TACTAACAGAATGTAGAGTT | GAG | chr12 | 21604054 | 21604073 | 21604070 | + |
| SEQ ID NO 16986 | ACTAACAGAATGTAGAGTTG | AGG | chr12 | 21604055 | 21604074 | 21604071 | + |
| SEQ ID NO 16987 | GTAGAGTTGAGGTTTCCAAC | TGG | chr12 | 21604066 | 21604085 | 21604082 | + |
| SEQ ID NO 16988 | TTTAATTATACTATTTTGCT | GAG | chr12 | 21604124 | 21604143 | 21604140 | + |
| SEQ ID NO 16989 | ATTTCTATGTTGTCATAATA | TGG | chr12 | 21604185 | 21604204 | 21604201 | + |
| SEQ ID NO 16990 | TAATTTAAATGCACATTCCA | TGG | chr12 | 21604219 | 21604238 | 21604235 | + |
| SEQ ID NO 16991 | AAATGCACATTCCATGGCAA | TGG | chr12 | 21604225 | 21604244 | 21604241 | + |
| SEQ ID NO 16992 | TCCCTCTTCAACACATACAC | AAG | chr12 | 21604266 | 21604285 | 21604282 | + |
| SEQ ID NO 16993 | CATACACAAGTCTGTATTCA | TAG | chr12 | 21604279 | 21604298 | 21604295 | + |
| SEQ ID NO 16994 | GTATTCATAGCCTGTTGTAA | TAG | chr12 | 21604292 | 21604311 | 21604308 | + |
| SEQ ID NO 16995 | CATAGCCTGTTGTAATAGAC | AAG | chr12 | 21604297 | 21604316 | 21604313 | + |
| SEQ ID NO 16996 | ATAGCCTGTTGTAATAGACA | AGG | chr12 | 21604298 | 21604317 | 21604314 | + |
| SEQ ID NO 16997 | GTAATAGACAAGGTTAAATG | TAG | chr12 | 21604308 | 21604327 | 21604324 | + |
| SEQ ID NO 16998 | TAAATGCTTTCCTCACTCAC | TAG | chr12 | 21604350 | 21604369 | 21604366 | + |
| SEQ ID NO 16999 | TTTCCTCACTCACTAGCAAT | TGG | chr12 | 21604357 | 21604376 | 21604373 | + |
| SEQ ID NO 17000 | CACTAGCAATTGGTTATCAC | TAG | chr12 | 21604367 | 21604386 | 21604383 | + |
| SEQ ID NO 17001 | CTAGCAATTGGTTATCACTA | GAG | chr12 | 21604369 | 21604388 | 21604385 | + |

Figure 43 (Cont'd)

| | | | | | | | |
|---|---|---|---|---|---|---|---|
| SEQ ID NO 17002 | AGCAATTGGTTATCACTAGA | GAG | chr12 | 21604371 | 21604390 | 21604387 | + |
| SEQ ID NO 17003 | AAATCTTACTCTACATTCCT | CAG | chr12 | 21604403 | 21604422 | 21604419 | + |
| SEQ ID NO 17004 | CTCTACATTCCTCAGTCACC | TAG | chr12 | 21604411 | 21604430 | 21604427 | + |
| SEQ ID NO 17005 | CATTCCTCAGTCACCTAGTG | AAG | chr12 | 21604416 | 21604435 | 21604432 | + |
| SEQ ID NO 17006 | ATTCCTCAGTCACCTAGTGA | AGG | chr12 | 21604417 | 21604436 | 21604433 | + |
| SEQ ID NO 17007 | AAGGTGTACTGATCCACCTT | CAG | chr12 | 21604436 | 21604455 | 21604452 | + |
| SEQ ID NO 17008 | AGGTGTACTGATCCACCTTC | AGG | chr12 | 21604437 | 21604456 | 21604453 | + |
| SEQ ID NO 17009 | GTGTACTGATCCACCTTCAG | GAG | chr12 | 21604439 | 21604458 | 21604455 | + |
| SEQ ID NO 17010 | TACTGATCCACCTTCAGGAG | CAG | chr12 | 21604442 | 21604461 | 21604458 | + |
| SEQ ID NO 17011 | GGAGCAGTACAAACCTTTAT | TGG | chr12 | 21604458 | 21604477 | 21604474 | + |
| SEQ ID NO 17012 | ACCTTTATTGGTCACTTCCC | AAG | chr12 | 21604470 | 21604489 | 21604486 | + |
| SEQ ID NO 17013 | TCACTTCCCAAGCAACTTCA | AAG | chr12 | 21604481 | 21604500 | 21604497 | + |
| SEQ ID NO 17014 | ACTTCCCAAGCAACTTCAAA | GAG | chr12 | 21604483 | 21604502 | 21604499 | + |
| SEQ ID NO 17015 | TCCCAAGCAACTTCAAAGAG | CAG | chr12 | 21604486 | 21604505 | 21604502 | + |
| SEQ ID NO 17016 | AAAGAGCAGTAACTCCTCCA | CAG | chr12 | 21604500 | 21604519 | 21604516 | + |
| SEQ ID NO 17017 | AAGAGCAGTAACTCCTCCAC | AGG | chr12 | 21604501 | 21604520 | 21604517 | + |
| SEQ ID NO 17018 | AGCAGTAACTCCTCCACAGG | AAG | chr12 | 21604504 | 21604523 | 21604520 | + |
| SEQ ID NO 17019 | GAAGTTCTTCGACTTCCCAC | TGG | chr12 | 21604523 | 21604542 | 21604539 | + |
| SEQ ID NO 17020 | AAGTTCTTCGACTTCCCACT | GGG | chr12 | 21604524 | 21604543 | 21604540 | + |
| SEQ ID NO 17021 | AGTTCTTCGACTTCCCACTG | GGG | chr12 | 21604525 | 21604544 | 21604541 | + |
| SEQ ID NO 17022 | TCTTCGACTTCCCACTGGGG | AAG | chr12 | 21604528 | 21604547 | 21604544 | + |
| SEQ ID NO 17023 | TCCCACTGGGGAAGCCCACC | CAG | chr12 | 21604537 | 21604556 | 21604553 | + |
| SEQ ID NO 17024 | CCCACTGGGGAAGCCCACCC | AGG | chr12 | 21604538 | 21604557 | 21604554 | + |
| SEQ ID NO 17025 | CCACTGGGGAAGCCCACCCA | GGG | chr12 | 21604539 | 21604558 | 21604555 | + |
| SEQ ID NO 17026 | AAGCCCACCCAGGGATGTTA | CAG | chr12 | 21604548 | 21604567 | 21604564 | + |
| SEQ ID NO 17027 | GCCCACCCAGGGATGTTACA | GAG | chr12 | 21604550 | 21604569 | 21604566 | + |
| SEQ ID NO 17028 | CCACCCAGGGATGTTACAGA | GAG | chr12 | 21604552 | 21604571 | 21604568 | + |
| SEQ ID NO 17029 | CACCCAGGGATGTTACAGAG | AGG | chr12 | 21604553 | 21604572 | 21604569 | + |
| SEQ ID NO 17030 | ACCCAGGGATGTTACAGAGA | GGG | chr12 | 21604554 | 21604573 | 21604570 | + |
| SEQ ID NO 17031 | GGGATGTTACAGAGAGGGAT | CGG | chr12 | 21604559 | 21604578 | 21604575 | + |
| SEQ ID NO 17032 | ACAGAGAGGGATCGGCCTCG | AAG | chr12 | 21604567 | 21604586 | 21604583 | + |
| SEQ ID NO 17033 | GCCTCGAAGCATTCTTCTTA | CAG | chr12 | 21604581 | 21604600 | 21604597 | + |
| SEQ ID NO 17034 | CATTCTTCTTACAGTCCTCC | GAG | chr12 | 21604590 | 21604609 | 21604606 | + |
| SEQ ID NO 17035 | CTTTGAATTCCTGTTTCAAT | TAG | chr12 | 21604617 | 21604636 | 21604633 | + |
| SEQ ID NO 17036 | GTTTCAATTAGTTGTAATCC | CAG | chr12 | 21604629 | 21604648 | 21604645 | + |
| SEQ ID NO 17037 | TTTCAATTAGTTGTAATCCC | AGG | chr12 | 21604630 | 21604649 | 21604646 | + |
| SEQ ID NO 17038 | TCAATTAGTTGTAATCCCAG | GAG | chr12 | 21604632 | 21604651 | 21604648 | + |
| SEQ ID NO 17039 | ATTAGTTGTAATCCCAGGAG | AAG | chr12 | 21604635 | 21604654 | 21604651 | + |
| SEQ ID NO 17040 | TAGTTGTAATCCCAGGAGAA | GAG | chr12 | 21604637 | 21604656 | 21604653 | + |
| SEQ ID NO 17041 | TCCCAGGAGAAGAGAACTTA | CAG | chr12 | 21604646 | 21604665 | 21604662 | + |
| SEQ ID NO 17042 | CCCAGGAGAAGAGAACTTAC | AGG | chr12 | 21604647 | 21604666 | 21604663 | + |
| SEQ ID NO 17043 | AAGAGAACTTACAGGCACAA | AAG | chr12 | 21604655 | 21604674 | 21604671 | + |
| SEQ ID NO 17044 | GAACTTACAGGCACAAAAGT | TAG | chr12 | 21604659 | 21604678 | 21604675 | + |
| SEQ ID NO 17045 | ACTTACAGGCACAAAAGTTA | GAG | chr12 | 21604661 | 21604680 | 21604677 | + |
| SEQ ID NO 17046 | ACAGGCACAAAAGTTAGAGT | TGG | chr12 | 21604665 | 21604684 | 21604681 | + |
| SEQ ID NO 17047 | GGCACAAAAGTTAGAGTTGG | TAG | chr12 | 21604668 | 21604687 | 21604684 | + |
| SEQ ID NO 17048 | CACAAAAGTTAGAGTTGGTA | GAG | chr12 | 21604670 | 21604689 | 21604686 | + |

Figure 43 (Cont'd)

| | | | | | | | | |
|---|---|---|---|---|---|---|---|---|
| SEQ ID NO 17049 | GTTAGAGTTGGTAGAGTTAC | CAG | chr12 | 21604677 | 21604696 | 21604693 | + |
| SEQ ID NO 17050 | TTAGAGTTGGTAGAGTTACC | AGG | chr12 | 21604678 | 21604697 | 21604694 | + |
| SEQ ID NO 17051 | TTGGTAGAGTTACCAGGCTT | TGG | chr12 | 21604684 | 21604703 | 21604700 | + |
| SEQ ID NO 17052 | GTAGAGTTACCAGGCTTTGG | TAG | chr12 | 21604687 | 21604706 | 21604703 | + |
| SEQ ID NO 17053 | CAGGCTTTGGTAGCTTCTCT | TGG | chr12 | 21604697 | 21604716 | 21604713 | + |
| SEQ ID NO 17054 | AGGCTTTGGTAGCTTCTCTT | GGG | chr12 | 21604698 | 21604717 | 21604714 | + |
| SEQ ID NO 17055 | AGCTTCTCTTGGGAATAAAC | TAG | chr12 | 21604708 | 21604727 | 21604724 | + |
| SEQ ID NO 17056 | TTCTCTTGGGAATAAACTAG | TAG | chr12 | 21604711 | 21604730 | 21604727 | + |
| SEQ ID NO 17057 | GAAATCTTATGTGCTTCCCA | CAG | chr12 | 21604737 | 21604756 | 21604753 | + |
| SEQ ID NO 17058 | TGTGCTTCCCACAGAATTCC | TGG | chr12 | 21604746 | 21604765 | 21604762 | + |
| SEQ ID NO 17059 | GCTTCCCACAGAATTCCTGG | TGG | chr12 | 21604749 | 21604768 | 21604765 | + |
| SEQ ID NO 17060 | TCCCACAGAATTCCTGGTGG | AAG | chr12 | 21604752 | 21604771 | 21604768 | + |
| SEQ ID NO 17061 | CCCACAGAATTCCTGGTGGA | AGG | chr12 | 21604753 | 21604772 | 21604769 | + |
| SEQ ID NO 17062 | CACAGAATTCCTGGTGGAAG | GAG | chr12 | 21604755 | 21604774 | 21604771 | + |
| SEQ ID NO 17063 | ACAGAATTCCTGGTGGAAGG | AGG | chr12 | 21604756 | 21604775 | 21604772 | + |
| SEQ ID NO 17064 | CCTCCTCTTTCTCGTCTTTC | TGG | chr12 | 21604786 | 21604805 | 21604802 | + |
| SEQ ID NO 17065 | CTCCTCTTTCTCGTCTTTCT | GGG | chr12 | 21604787 | 21604806 | 21604803 | + |
| SEQ ID NO 17066 | CTCTTTCTCGTCTTTCTGGG | CAG | chr12 | 21604790 | 21604809 | 21604806 | + |
| SEQ ID NO 17067 | TCTTTCTCGTCTTTCTGGGC | AGG | chr12 | 21604791 | 21604810 | 21604807 | + |
| SEQ ID NO 17068 | TCTTTCTGGGCAGGTATTGT | GAG | chr12 | 21604800 | 21604819 | 21604816 | + |
| SEQ ID NO 17069 | CTTTCTGGGCAGGTATTGTG | AGG | chr12 | 21604801 | 21604820 | 21604817 | + |
| SEQ ID NO 17070 | CTGGGCAGGTATTGTGAGGA | CGG | chr12 | 21604805 | 21604824 | 21604821 | + |
| SEQ ID NO 17071 | GAGGACGGTATCTGCCCTGT | CAG | chr12 | 21604820 | 21604839 | 21604836 | + |
| SEQ ID NO 17072 | CCGTCCTCACAATACCTGCC | CAG | chr12 | 21604808 | 21604827 | 21604811 | - |
| SEQ ID NO 17073 | CCTCACAATACCTGCCCAGA | AAG | chr12 | 21604804 | 21604823 | 21604807 | - |
| SEQ ID NO 17074 | CAATACCTGCCCAGAAAGAC | GAG | chr12 | 21604799 | 21604818 | 21604802 | - |
| SEQ ID NO 17075 | ACCTGCCCAGAAAGACGAGA | AAG | chr12 | 21604795 | 21604814 | 21604798 | - |
| SEQ ID NO 17076 | CTGCCCAGAAAGACGAGAAA | GAG | chr12 | 21604793 | 21604812 | 21604796 | - |
| SEQ ID NO 17077 | TGCCCAGAAAGACGAGAAAG | AGG | chr12 | 21604792 | 21604811 | 21604795 | - |
| SEQ ID NO 17078 | CCCAGAAAGACGAGAAAGAG | GAG | chr12 | 21604790 | 21604809 | 21604793 | - |
| SEQ ID NO 17079 | CCAGAAAGACGAGAAAGAGG | AGG | chr12 | 21604789 | 21604808 | 21604792 | - |
| SEQ ID NO 17080 | GAAAGACGAGAAAGAGGAGG | AAG | chr12 | 21604786 | 21604805 | 21604789 | - |
| SEQ ID NO 17081 | GGAAGAATTCCTCCTTCCAC | CAG | chr12 | 21604768 | 21604787 | 21604771 | - |
| SEQ ID NO 17082 | GAAGAATTCCTCCTTCCACC | AGG | chr12 | 21604767 | 21604786 | 21604770 | - |
| SEQ ID NO 17083 | TCCTTCCACCAGGAATTCTG | TGG | chr12 | 21604757 | 21604776 | 21604760 | - |
| SEQ ID NO 17084 | CCTTCCACCAGGAATTCTGT | GGG | chr12 | 21604756 | 21604775 | 21604759 | - |
| SEQ ID NO 17085 | TCCACCAGGAATTCTGTGGG | AAG | chr12 | 21604753 | 21604772 | 21604756 | - |
| SEQ ID NO 17086 | GAATTCTGTGGGAAGCACAT | AAG | chr12 | 21604745 | 21604764 | 21604748 | - |
| SEQ ID NO 17087 | CACATAAGATTTCATGCTAC | TAG | chr12 | 21604730 | 21604749 | 21604733 | - |
| SEQ ID NO 17088 | CATGCTACTAGTTTATTCCC | AAG | chr12 | 21604718 | 21604737 | 21604721 | - |
| SEQ ID NO 17089 | TGCTACTAGTTTATTCCCAA | GAG | chr12 | 21604716 | 21604735 | 21604719 | - |
| SEQ ID NO 17090 | TACTAGTTTATTCCCAAGAG | AAG | chr12 | 21604713 | 21604732 | 21604716 | - |
| SEQ ID NO 17091 | ATTCCCAAGAGAAGCTACCA | AAG | chr12 | 21604704 | 21604723 | 21604707 | - |
| SEQ ID NO 17092 | CAAGAGAAGCTACCAAAGCC | TGG | chr12 | 21604699 | 21604718 | 21604702 | - |
| SEQ ID NO 17093 | ACTCTAACTTTGTGCCTGT | AAG | chr12 | 21604665 | 21604684 | 21604668 | - |
| SEQ ID NO 17094 | GCCTGTAAGTTCTCTTCTCC | TGG | chr12 | 21604651 | 21604670 | 21604654 | - |
| SEQ ID NO 17095 | CCTGTAAGTTCTCTTCTCCT | GGG | chr12 | 21604650 | 21604669 | 21604653 | - |

Figure 43 (Cont'd)

| | | | | | | | |
|---|---|---|---|---|---|---|---|
| SEQ ID NO 17096 | GGGATTACAACTAATTGAAA | CAG | chr12 | 21604630 | 21604649 | 21604633 | - |
| SEQ ID NO 17097 | GGATTACAACTAATTGAAAC | AGG | chr12 | 21604629 | 21604648 | 21604632 | - |
| SEQ ID NO 17098 | CTAATTGAAACAGGAATTCA | AAG | chr12 | 21604620 | 21604639 | 21604623 | - |
| SEQ ID NO 17099 | TAATTGAAACAGGAATTCAA | AGG | chr12 | 21604619 | 21604638 | 21604622 | - |
| SEQ ID NO 17100 | ATTGAAACAGGAATTCAAAG | GAG | chr12 | 21604617 | 21604636 | 21604620 | - |
| SEQ ID NO 17101 | ACAGGAATTCAAAGGAGTCT | CGG | chr12 | 21604611 | 21604630 | 21604614 | - |
| SEQ ID NO 17102 | AGGAATTCAAAGGAGTCTCG | GAG | chr12 | 21604609 | 21604628 | 21604612 | - |
| SEQ ID NO 17103 | GGAATTCAAAGGAGTCTCGG | AGG | chr12 | 21604608 | 21604627 | 21604611 | - |
| SEQ ID NO 17104 | AAGGAGTCTCGGAGGACTGT | AAG | chr12 | 21604600 | 21604619 | 21604603 | - |
| SEQ ID NO 17105 | GAGTCTCGGAGGACTGTAAG | AAG | chr12 | 21604597 | 21604616 | 21604600 | - |
| SEQ ID NO 17106 | GACTGTAAGAAGAATGCTTC | GAG | chr12 | 21604586 | 21604605 | 21604589 | - |
| SEQ ID NO 17107 | ACTGTAAGAAGAATGCTTCG | AGG | chr12 | 21604585 | 21604604 | 21604588 | - |
| SEQ ID NO 17108 | ATCCCTCTGTAACATCCC | TGG | chr12 | 21604559 | 21604578 | 21604562 | - |
| SEQ ID NO 17109 | TCCCTCTGTAACATCCCT | GGG | chr12 | 21604558 | 21604577 | 21604561 | - |
| SEQ ID NO 17110 | CTCTGTAACATCCCTGGG | TGG | chr12 | 21604555 | 21604574 | 21604558 | - |
| SEQ ID NO 17111 | TCTCTGTAACATCCCTGGGT | GGG | chr12 | 21604554 | 21604573 | 21604557 | - |
| SEQ ID NO 17112 | CATCCCTGGGTGGGCTTCCC | CAG | chr12 | 21604545 | 21604564 | 21604548 | - |
| SEQ ID NO 17113 | CCCTGGGTGGGCTTCCCCAG | TGG | chr12 | 21604542 | 21604561 | 21604545 | - |
| SEQ ID NO 17114 | CCTGGGTGGGCTTCCCCAGT | GGG | chr12 | 21604541 | 21604560 | 21604544 | - |
| SEQ ID NO 17115 | GGGTGGGCTTCCCCAGTGGG | AAG | chr12 | 21604538 | 21604557 | 21604541 | - |
| SEQ ID NO 17116 | GCTTCCCCAGTGGGAAGTCG | AAG | chr12 | 21604532 | 21604551 | 21604535 | - |
| SEQ ID NO 17117 | GGAAGTCGAAGAACTTCCTG | TGG | chr12 | 21604520 | 21604539 | 21604523 | - |
| SEQ ID NO 17118 | AAGTCGAAGAACTTCCTGTG | GAG | chr12 | 21604518 | 21604537 | 21604521 | - |
| SEQ ID NO 17119 | AGTCGAAGAACTTCCTGTGG | AGG | chr12 | 21604517 | 21604536 | 21604520 | - |
| SEQ ID NO 17120 | TCGAAGAACTTCCTGTGGAG | GAG | chr12 | 21604515 | 21604534 | 21604518 | - |
| SEQ ID NO 17121 | GGAGGAGTTACTGCTCTTTG | AAG | chr12 | 21604499 | 21604518 | 21604502 | - |
| SEQ ID NO 17122 | TACTGCTCTTTGAAGTTGCT | TGG | chr12 | 21604491 | 21604510 | 21604494 | - |
| SEQ ID NO 17123 | ACTGCTCTTTGAAGTTGCTT | GGG | chr12 | 21604490 | 21604509 | 21604493 | - |
| SEQ ID NO 17124 | GCTCTTTGAAGTTGCTTGGG | AAG | chr12 | 21604487 | 21604506 | 21604490 | - |
| SEQ ID NO 17125 | TGCTTGGGAAGTGACCAATA | AAG | chr12 | 21604475 | 21604494 | 21604478 | - |
| SEQ ID NO 17126 | GCTTGGGAAGTGACCAATAA | AGG | chr12 | 21604474 | 21604493 | 21604477 | - |
| SEQ ID NO 17127 | AAAGGTTTGTACTGCTCCTG | AAG | chr12 | 21604456 | 21604475 | 21604459 | - |
| SEQ ID NO 17128 | AAGGTTTGTACTGCTCCTGA | AGG | chr12 | 21604455 | 21604474 | 21604458 | - |
| SEQ ID NO 17129 | GTTTGTACTGCTCCTGAAGG | TGG | chr12 | 21604452 | 21604471 | 21604455 | - |
| SEQ ID NO 17130 | TACTGCTCCTGAAGGTGGAT | CAG | chr12 | 21604447 | 21604466 | 21604450 | - |
| SEQ ID NO 17131 | GTGGATCAGTACACCTTCAC | TAG | chr12 | 21604433 | 21604452 | 21604436 | - |
| SEQ ID NO 17132 | TGGATCAGTACACCTTCACT | AGG | chr12 | 21604432 | 21604451 | 21604435 | - |
| SEQ ID NO 17133 | TACACCTTCACTAGGTGACT | GAG | chr12 | 21604424 | 21604443 | 21604427 | - |
| SEQ ID NO 17134 | ACACCTTCACTAGGTGACTG | AGG | chr12 | 21604423 | 21604442 | 21604426 | - |
| SEQ ID NO 17135 | CACTAGGTGACTGAGGAATG | TAG | chr12 | 21604416 | 21604435 | 21604419 | - |
| SEQ ID NO 17136 | CTAGGTGACTGAGGAATGTA | GAG | chr12 | 21604414 | 21604433 | 21604417 | - |
| SEQ ID NO 17137 | GTGACTGAGGAATGTAGAGT | AAG | chr12 | 21604410 | 21604429 | 21604413 | - |
| SEQ ID NO 17138 | GAATGTAGAGTAAGATTTCA | CAG | chr12 | 21604401 | 21604420 | 21604404 | - |
| SEQ ID NO 17139 | AGATTTCACAGATAACTCTC | TAG | chr12 | 21604389 | 21604408 | 21604392 | - |
| SEQ ID NO 17140 | CTCTAGTGATAACCAATTGC | TAG | chr12 | 21604372 | 21604391 | 21604375 | - |
| SEQ ID NO 17141 | AGTGATAACCAATTGCTAGT | GAG | chr12 | 21604368 | 21604387 | 21604371 | - |
| SEQ ID NO 17142 | ATAACCAATTGCTAGTGAGT | GAG | chr12 | 21604364 | 21604383 | 21604367 | - |

Figure 43 (Cont'd)

| | | | | | | | |
|---|---|---|---|---|---|---|---|
| SEQ ID NO 17143 | TAACCAATTGCTAGTGAGTG | AGG | chr12 | 21604363 | 21604382 | 21604366 | - |
| SEQ ID NO 17144 | CAATTGCTAGTGAGTGAGGA | AAG | chr12 | 21604359 | 21604378 | 21604362 | - |
| SEQ ID NO 17145 | GAGTGAGGAAAGCATTTAAA | CGG | chr12 | 21604348 | 21604367 | 21604351 | - |
| SEQ ID NO 17146 | ATTTAAACGGAATATATATT | TAG | chr12 | 21604335 | 21604354 | 21604338 | - |
| SEQ ID NO 17147 | TTTAAACGGAATATATATTT | AGG | chr12 | 21604334 | 21604353 | 21604337 | - |
| SEQ ID NO 17148 | TTTAACCTTGTCTATTACAA | CAG | chr12 | 21604306 | 21604325 | 21604309 | - |
| SEQ ID NO 17149 | TTAACCTTGTCTATTACAAC | AGG | chr12 | 21604305 | 21604324 | 21604308 | - |
| SEQ ID NO 17150 | ATTACAACAGGCTATGAATA | CAG | chr12 | 21604293 | 21604312 | 21604296 | - |
| SEQ ID NO 17151 | ACAGACTTGTGTATGTGTTG | AAG | chr12 | 21604274 | 21604293 | 21604277 | - |
| SEQ ID NO 17152 | AGACTTGTGTATGTGTTGAA | GAG | chr12 | 21604272 | 21604291 | 21604275 | - |
| SEQ ID NO 17153 | GACTTGTGTATGTGTTGAAG | AGG | chr12 | 21604271 | 21604290 | 21604274 | - |
| SEQ ID NO 17154 | ACTTGTGTATGTGTTGAAGA | GGG | chr12 | 21604270 | 21604289 | 21604273 | - |
| SEQ ID NO 17155 | TTGTGTATGTGTTGAAGAGG | GAG | chr12 | 21604268 | 21604287 | 21604271 | - |
| SEQ ID NO 17156 | GTATGTGTTGAAGAGGGAGA | AAG | chr12 | 21604264 | 21604283 | 21604267 | - |
| SEQ ID NO 17157 | AGGGAGAAAGTTGAAAATAT | TAG | chr12 | 21604251 | 21604270 | 21604254 | - |
| SEQ ID NO 17158 | GAAAATATTAGCCATTGCCA | TGG | chr12 | 21604239 | 21604258 | 21604242 | - |
| SEQ ID NO 17159 | AAATCCATATTATGACAACA | TAG | chr12 | 21604192 | 21604211 | 21604195 | - |
| SEQ ID NO 17160 | TATGACAACATAGAAATAAA | AAG | chr12 | 21604182 | 21604201 | 21604185 | - |
| SEQ ID NO 17161 | TTTTGTTTTAAAATTTTTCT | CAG | chr12 | 21604145 | 21604164 | 21604148 | - |
| SEQ ID NO 17162 | TAAAATTTTTCTCAGCAAAA | TAG | chr12 | 21604137 | 21604156 | 21604140 | - |
| SEQ ID NO 17163 | TATAATTAAACATTTTATTT | TAG | chr12 | 21604114 | 21604133 | 21604117 | - |
| SEQ ID NO 17164 | ATAATTAAACATTTTATTTT | AGG | chr12 | 21604113 | 21604132 | 21604116 | - |
| SEQ ID NO 17165 | ATTAAACATTTTATTTTAGG | AAG | chr12 | 21604110 | 21604129 | 21604113 | - |
| SEQ ID NO 17166 | TAGGAAGATGTATATGTGAT | TAG | chr12 | 21604094 | 21604113 | 21604097 | - |
| SEQ ID NO 17167 | GATGTATATGTGATTAGAAC | CAG | chr12 | 21604088 | 21604107 | 21604091 | - |
| SEQ ID NO 17168 | TATATGTGATTAGAACCAGT | TGG | chr12 | 21604084 | 21604103 | 21604087 | - |
| SEQ ID NO 17169 | ACCTCAACTCTACATTCTGT | TAG | chr12 | 21604059 | 21604078 | 21604062 | - |
| SEQ ID NO 17170 | AGTAATTATATGAAATGCTT | AAG | chr12 | 21604038 | 21604057 | 21604041 | - |
| SEQ ID NO 17171 | GAATGTTTCATATTCACAAT | TAG | chr12 | 21604016 | 21604035 | 21604019 | - |
| SEQ ID NO 17172 | TTTCATATTCACAATTAGCT | TGG | chr12 | 21604011 | 21604030 | 21604014 | - |
| SEQ ID NO 17173 | TTGGAATTAATGTTTTAATT | CAG | chr12 | 21603992 | 21604011 | 21603995 | - |
| SEQ ID NO 17174 | TGGAATTAATGTTTTAATTC | AGG | chr12 | 21603991 | 21604010 | 21603994 | - |
| SEQ ID NO 17175 | GAATTAATGTTTTAATTCAG | GAG | chr12 | 21603989 | 21604008 | 21603992 | - |
| SEQ ID NO 17176 | TTAATTCAGGAGCTTCTCAA | AAG | chr12 | 21603978 | 21603997 | 21603981 | - |
| SEQ ID NO 17177 | TAATTCAGGAGCTTCTCAAA | AGG | chr12 | 21603977 | 21603996 | 21603980 | - |
| SEQ ID NO 17178 | GCAAAATACTGTGCTCCTTT | CAG | chr12 | 21603955 | 21603974 | 21603958 | - |
| SEQ ID NO 17179 | CTGTGCTCCTTTCAGAATGA | AAG | chr12 | 21603947 | 21603966 | 21603950 | - |
| SEQ ID NO 17180 | TCTTCAATGCTATGCTTATG | TAG | chr12 | 21603915 | 21603934 | 21603918 | - |
| SEQ ID NO 17181 | CTTCAATGCTATGCTTATGT | AGG | chr12 | 21603914 | 21603933 | 21603917 | - |
| SEQ ID NO 17182 | TATGTAGGAATTATAAAATA | AAG | chr12 | 21603899 | 21603918 | 21603902 | - |
| SEQ ID NO 17183 | AAATTGATAAAACAATTTGC | GAG | chr12 | 21603870 | 21603889 | 21603873 | - |
| SEQ ID NO 17184 | TGATAAAACAATTTGCGAGT | GAG | chr12 | 21603866 | 21603885 | 21603869 | - |
| SEQ ID NO 17185 | GATAAAACAATTTGCGAGTG | AGG | chr12 | 21603865 | 21603884 | 21603868 | - |
| SEQ ID NO 17186 | AGGTATAACCTCATCTGTGC | TGG | chr12 | 21603845 | 21603864 | 21603848 | - |
| SEQ ID NO 17187 | GGTATAACCTCATCTGTGCT | GGG | chr12 | 21603844 | 21603863 | 21603847 | - |
| SEQ ID NO 17188 | TAACCTCATCTGTGCTGGGT | AAG | chr12 | 21603840 | 21603859 | 21603843 | - |
| SEQ ID NO 17189 | ACCTCATCTGTGCTGGGTAA | GAG | chr12 | 21603838 | 21603857 | 21603841 | - |

Figure 43 (Cont'd)

| | | | | | | | |
|---|---|---|---|---|---|---|---|
| SEQ ID NO 17190 | TCATCTGTGCTGGGTAAGAG | AAG | chr12 | 21603835 | 21603854 | 21603838 | - |
| SEQ ID NO 17191 | CATCTGTGCTGGGTAAGAGA | AGG | chr12 | 21603834 | 21603853 | 21603837 | - |
| SEQ ID NO 17192 | TGTGCTGGGTAAGAGAAGGC | AAG | chr12 | 21603830 | 21603849 | 21603833 | - |
| SEQ ID NO 17193 | GTGCTGGGTAAGAGAAGGCA | AGG | chr12 | 21603829 | 21603848 | 21603832 | - |
| SEQ ID NO 17194 | CTGGGTAAGAGAAGGCAAGG | TAG | chr12 | 21603826 | 21603845 | 21603829 | - |
| SEQ ID NO 17195 | GGGTAAGAGAAGGCAAGGTA | GAG | chr12 | 21603824 | 21603843 | 21603827 | - |
| SEQ ID NO 17196 | TGTAAATGATTTTGAAAATA | AAG | chr12 | 21603793 | 21603812 | 21603796 | - |
| SEQ ID NO 17197 | AATTATAAAACAATTCCTTG | TGG | chr12 | 21603760 | 21603779 | 21603763 | - |
| SEQ ID NO 17198 | ATTATAAAACAATTCCTTGT | GGG | chr12 | 21603759 | 21603778 | 21603762 | - |
| SEQ ID NO 17199 | CCTTGTGGGTTTATACTCTC | TAG | chr12 | 21603745 | 21603764 | 21603748 | - |
| SEQ ID NO 17200 | GTTTATACTCTCTAGTTTAA | AAG | chr12 | 21603737 | 21603756 | 21603740 | - |
| SEQ ID NO 17201 | CTCTCTAGTTTAAAAGTGTC | AAG | chr12 | 21603730 | 21603749 | 21603733 | - |
| SEQ ID NO 17202 | TAAAAGTGTCAAGACTATTG | AAG | chr12 | 21603720 | 21603739 | 21603723 | - |
| SEQ ID NO 17203 | AAAAGTGTCAAGACTATTGA | AGG | chr12 | 21603719 | 21603738 | 21603722 | - |
| SEQ ID NO 17204 | CAAGACTATTGAAGGAACAT | TAG | chr12 | 21603711 | 21603730 | 21603714 | - |
| SEQ ID NO 17205 | CTATTGAAGGAACATTAGCA | AAG | chr12 | 21603706 | 21603725 | 21603709 | - |
| SEQ ID NO 17206 | AAGGAACATTAGCAAAGAAA | AAG | chr12 | 21603700 | 21603719 | 21603703 | - |
| SEQ ID NO 17207 | CATTAGCAAAGAAAAGTCA | TGG | chr12 | 21603694 | 21603713 | 21603697 | - |
| SEQ ID NO 17208 | AAGAAAAGTCATGGTTTTG | AAG | chr12 | 21603686 | 21603705 | 21603689 | - |
| SEQ ID NO 17209 | AGAAAAGTCATGGTTTTGA | AGG | chr12 | 21603685 | 21603704 | 21603688 | - |
| SEQ ID NO 17210 | AAGTCATGGTTTTGAAGGCT | GAG | chr12 | 21603680 | 21603699 | 21603683 | - |
| SEQ ID NO 17211 | TTTTGAAGGCTGAGTTCCTC | AAG | chr12 | 21603671 | 21603690 | 21603674 | - |
| SEQ ID NO 17212 | CTGAGTTCCTCAAGATCTTG | AAG | chr12 | 21603662 | 21603681 | 21603665 | - |
| SEQ ID NO 17213 | CCTCAAGATCTTGAAGAATC | AAG | chr12 | 21603655 | 21603674 | 21603658 | - |
| SEQ ID NO 17214 | GAATCAAGCCAACTGATTGC | TGG | chr12 | 21603640 | 21603659 | 21603643 | - |
| SEQ ID NO 17215 | AATCAAGCCAACTGATTGCT | GGG | chr12 | 21603639 | 21603658 | 21603642 | - |
| SEQ ID NO 17216 | CCAACTGATTGCTGGGTAAA | TGG | chr12 | 21603632 | 21603651 | 21603635 | - |
| SEQ ID NO 17217 | ACTGATTGCTGGGTAAATGG | CAG | chr12 | 21603629 | 21603648 | 21603632 | - |
| SEQ ID NO 17218 | TTACTATTTCATGTCTATTA | CAG | chr12 | 21603527 | 21603546 | 21603530 | - |
| SEQ ID NO 17219 | ATGTCTATTACAGTAATCTA | AAG | chr12 | 21603517 | 21603536 | 21603520 | - |
| SEQ ID NO 17220 | TGTCTATTACAGTAATCTAA | AGG | chr12 | 21603516 | 21603535 | 21603519 | - |
| SEQ ID NO 17221 | AAAGGATCTGAAATAATAAC | CAG | chr12 | 21603498 | 21603517 | 21603501 | - |
| SEQ ID NO 17222 | GATATATTACTTCCTTCTTT | TGG | chr12 | 21603470 | 21603489 | 21603473 | - |
| SEQ ID NO 17223 | ACTTCCTTCTTTTGGCTAAT | CAG | chr12 | 21603462 | 21603481 | 21603465 | - |
| SEQ ID NO 17224 | TTCCTTCTTTTGGCTAATCA | GAG | chr12 | 21603460 | 21603479 | 21603463 | - |
| SEQ ID NO 17225 | TTCTTTTGGCTAATCAGAGC | CAG | chr12 | 21603456 | 21603475 | 21603459 | - |
| SEQ ID NO 17226 | AAAATTAAATGCATTATATA | TGG | chr12 | 21603424 | 21603443 | 21603427 | - |
| SEQ ID NO 17227 | TGGCATGCATTCTGAAAAAT | CAG | chr12 | 21603404 | 21603423 | 21603407 | - |
| SEQ ID NO 17228 | CACCTTATACTAACTGTTCA | AAG | chr12 | 21603377 | 21603396 | 21603380 | - |
| SEQ ID NO 17229 | ATTCATAAAATCAAAATTAA | AAG | chr12 | 21603339 | 21603358 | 21603342 | - |
| SEQ ID NO 17230 | AAAAGTCAATTTTGCCTATG | TAG | chr12 | 21603321 | 21603340 | 21603324 | - |
| SEQ ID NO 17231 | AGTCAATTTTGCCTATGTAG | AAG | chr12 | 21603318 | 21603337 | 21603321 | - |
| SEQ ID NO 17232 | CAATTTTGCCTATGTAGAAG | TGG | chr12 | 21603315 | 21603334 | 21603318 | - |
| SEQ ID NO 17233 | TTTGCCTATGTAGAAGTGGA | CAG | chr12 | 21603311 | 21603330 | 21603314 | - |
| SEQ ID NO 17234 | GAAGTGGACAGAATGCATAT | AAG | chr12 | 21603299 | 21603318 | 21603302 | - |
| SEQ ID NO 17235 | AGTGGACAGAATGCATATAA | GAG | chr12 | 21603297 | 21603316 | 21603300 | - |
| SEQ ID NO 17236 | AGAATGCATATAAGAGAACA | AAG | chr12 | 21603290 | 21603309 | 21603293 | - |

Figure 43 (Cont'd)

| SEQ ID NO 17237 | GCATATAAGAGAACAAAGCA | CGG | chr12 | 21603285 | 21603304 | 21603288 | - |
| SEQ ID NO 17238 | AAGCACGGTCTTATTCTCTG | TAG | chr12 | 21603270 | 21603289 | 21603273 | - |
| SEQ ID NO 17239 | CGGTCTTATTCTCTGTAGTT | TAG | chr12 | 21603265 | 21603284 | 21603268 | - |
| SEQ ID NO 17240 | CTTATTCTCTGTAGTTTAGT | GAG | chr12 | 21603261 | 21603280 | 21603264 | - |
| SEQ ID NO 17241 | TTCTCTGTAGTTTAGTGAGA | AAG | chr12 | 21603257 | 21603276 | 21603260 | - |
| SEQ ID NO 17242 | TAGTTTAGTGAGAAAGAATC | TAG | chr12 | 21603250 | 21603269 | 21603253 | - |
| SEQ ID NO 17243 | AGTTTAGTGAGAAAGAATCT | AGG | chr12 | 21603249 | 21603268 | 21603252 | - |
| SEQ ID NO 17244 | TTTAGTGAGAAAGAATCTAG | GAG | chr12 | 21603247 | 21603266 | 21603250 | - |
| SEQ ID NO 17245 | TTAGTGAGAAAGAATCTAGG | AGG | chr12 | 21603246 | 21603265 | 21603249 | - |
| SEQ ID NO 17246 | TGAGAAAGAATCTAGGAGGA | CAG | chr12 | 21603242 | 21603261 | 21603245 | - |
| SEQ ID NO 17247 | GGAGGACAGAAACCTTATTA | CAG | chr12 | 21603228 | 21603247 | 21603231 | - |
| SEQ ID NO 17248 | AGGACAGAAACCTTATTACA | GAG | chr12 | 21603226 | 21603245 | 21603229 | - |
| SEQ ID NO 17249 | ACAGAAACCTTATTACAGAG | AAG | chr12 | 21603223 | 21603242 | 21603226 | - |
| SEQ ID NO 17250 | AACCTTATTACAGAGAAGTG | AAG | chr12 | 21603218 | 21603237 | 21603221 | - |
| SEQ ID NO 17251 | TTATTTTGTATTCTTTTCCT | CAG | chr12 | 21603157 | 21603176 | 21603160 | - |
| SEQ ID NO 17252 | ATTTTGTATTCTTTTCCTCA | GAG | chr12 | 21603155 | 21603174 | 21603158 | - |
| SEQ ID NO 17253 | AGAGATCTTTATCCTGAAAT | GAG | chr12 | 21603136 | 21603155 | 21603139 | - |
| SEQ ID NO 17254 | TGTTTTTAATGTCCTTTTTC | TAG | chr12 | 21603109 | 21603128 | 21603112 | - |
| SEQ ID NO 17255 | TTTCTAGTCACAAATTTTTC | CAG | chr12 | 21603093 | 21603112 | 21603096 | - |
| SEQ ID NO 17256 | AGTCACAAATTTTTCCAGTC | CAG | chr12 | 21603088 | 21603107 | 21603091 | - |
| SEQ ID NO 17257 | CCAGTTTTTAAATATGCCCA | AAG | chr12 | 21603069 | 21603088 | 21603072 | - |
| SEQ ID NO 17258 | TTAAATATGCCCAAAGTTCC | TGG | chr12 | 21603062 | 21603081 | 21603065 | - |
| SEQ ID NO 17259 | TAAATATGCCCAAAGTTCCT | GGG | chr12 | 21603061 | 21603080 | 21603064 | - |
| SEQ ID NO 17260 | ATGCCCAAAGTTCCTGGGAA | CAG | chr12 | 21603056 | 21603075 | 21603059 | - |
| SEQ ID NO 17261 | TCTCTATCACATGTGAATCC | CGG | chr12 | 21603028 | 21603047 | 21603031 | - |
| SEQ ID NO 17262 | TCTATCACATGTGAATCCCG | GAG | chr12 | 21603026 | 21603045 | 21603029 | - |
| SEQ ID NO 17263 | CGGAGTATGCCTTGAAATAA | AAG | chr12 | 21603008 | 21603027 | 21603011 | - |
| SEQ ID NO 17264 | CTTGAAATAAAAGTTTTCTC | TAG | chr12 | 21602998 | 21603017 | 21603001 | - |
| SEQ ID NO 17265 | TGAAATAAAAGTTTTCTCTA | GAG | chr12 | 21602996 | 21603015 | 21602999 | - |
| SEQ ID NO 17266 | AAATAAAAGTTTTCTCTAGA | GAG | chr12 | 21602994 | 21603013 | 21602997 | - |
| SEQ ID NO 17267 | TAAAAGTTTTCTCTAGAGAG | TGG | chr12 | 21602991 | 21603010 | 21602994 | - |
| SEQ ID NO 17268 | AAAAGTTTTCTCTAGAGAGT | GGG | chr12 | 21602990 | 21603009 | 21602993 | - |
| SEQ ID NO 17269 | AGTTTTCTCTAGAGAGTGGG | CAG | chr12 | 21602987 | 21603006 | 21602990 | - |
| SEQ ID NO 17270 | GTTTTCTCTAGAGAGTGGGC | AGG | chr12 | 21602986 | 21603005 | 21602989 | - |
| SEQ ID NO 17271 | TTTCTCTAGAGAGTGGGCAG | GAG | chr12 | 21602984 | 21603003 | 21602987 | - |
| SEQ ID NO 17272 | TAGAGAGTGGGCAGGAGCTC | AAG | chr12 | 21602978 | 21602997 | 21602981 | - |
| SEQ ID NO 17273 | AGAGAGTGGGCAGGAGCTCA | AGG | chr12 | 21602977 | 21602996 | 21602980 | - |
| SEQ ID NO 17274 | TGGGCAGGAGCTCAAGGACA | TAG | chr12 | 21602971 | 21602990 | 21602974 | - |
| SEQ ID NO 17275 | AGCTCAAGGACATAGCTTAT | TGG | chr12 | 21602963 | 21602982 | 21602966 | - |
| SEQ ID NO 17276 | TCAAGGACATAGCTTATTGG | TGG | chr12 | 21602960 | 21602979 | 21602963 | - |
| SEQ ID NO 17277 | AGCTTATTGGTGGATAAAAC | TGG | chr12 | 21602950 | 21602969 | 21602953 | - |
| SEQ ID NO 17278 | TTATTGGTGGATAAAACTGG | AAG | chr12 | 21602947 | 21602966 | 21602950 | - |
| SEQ ID NO 17279 | TATTGGTGGATAAAACTGGA | AGG | chr12 | 21602946 | 21602965 | 21602949 | - |
| SEQ ID NO 17280 | ATTGGTGGATAAAACTGGAA | GGG | chr12 | 21602945 | 21602964 | 21602948 | - |
| SEQ ID NO 17281 | TAAAACTGGAAGGGACTTGT | TAG | chr12 | 21602936 | 21602955 | 21602939 | - |
| SEQ ID NO 17282 | TGGAAGGGACTTGTTAGCAC | TGG | chr12 | 21602930 | 21602949 | 21602933 | - |
| SEQ ID NO 17283 | GGAAGGGACTTGTTAGCACT | GGG | chr12 | 21602929 | 21602948 | 21602932 | - |

Figure 43 (Cont'd)

| | | | | | | | |
|---|---|---|---|---|---|---|---|
| SEQ ID NO 17284 | GACTTGTTAGCACTGGGAAT | CAG | chr12 | 21602923 | 21602942 | 21602926 | - |
| SEQ ID NO 17285 | GTTAGCACTGGGAATCAGTC | CAG | chr12 | 21602918 | 21602937 | 21602921 | - |
| SEQ ID NO 17286 | AGCACTGGGAATCAGTCCAG | AAG | chr12 | 21602915 | 21602934 | 21602918 | - |
| SEQ ID NO 17287 | AGTCCAGAAGATCTCTGCAC | AAG | chr12 | 21602902 | 21602921 | 21602905 | - |
| SEQ ID NO 17288 | CTGCACAAGTTCCTGCACCT | GAG | chr12 | 21602888 | 21602907 | 21602891 | - |
| SEQ ID NO 17289 | CACAAGTTCCTGCACCTGAG | CAG | chr12 | 21602885 | 21602904 | 21602888 | - |
| SEQ ID NO 17290 | CAAGTTCCTGCACCTGAGCA | GAG | chr12 | 21602883 | 21602902 | 21602886 | - |
| SEQ ID NO 17291 | CATCATTTAACAAACATTAA | TGG | chr12 | 21602837 | 21602856 | 21602840 | - |
| SEQ ID NO 17292 | TCATTTAACAAACATTAATG | GAG | chr12 | 21602835 | 21602854 | 21602838 | - |
| SEQ ID NO 17293 | ATTAATGGAGCACTGTTACC | TGG | chr12 | 21602822 | 21602841 | 21602825 | - |
| SEQ ID NO 17294 | TTAATGGAGCACTGTTACCT | GGG | chr12 | 21602821 | 21602840 | 21602824 | - |
| SEQ ID NO 17295 | GAGCACTGTTACCTGGGCAC | TGG | chr12 | 21602815 | 21602834 | 21602818 | - |
| SEQ ID NO 17296 | AGCACTGTTACCTGGGCACT | GGG | chr12 | 21602814 | 21602833 | 21602817 | - |
| SEQ ID NO 17297 | CCTGGGCACTGGGAACACGC | CAG | chr12 | 21602804 | 21602823 | 21602807 | - |
| SEQ ID NO 17298 | GGGAACACGCCAGTGAAACT | AAG | chr12 | 21602794 | 21602813 | 21602797 | - |
| SEQ ID NO 17299 | AGTGAAACTAAGTTATTTTA | TGG | chr12 | 21602783 | 21602802 | 21602786 | - |
| SEQ ID NO 17300 | TATTTTATGGATCTTATAAT | CAG | chr12 | 21602770 | 21602789 | 21602773 | - |
| SEQ ID NO 17301 | TTTATGGATCTTATAATCAG | TAG | chr12 | 21602767 | 21602786 | 21602770 | - |
| SEQ ID NO 17302 | AGTAGCATGTGTGTTGATCT | CAG | chr12 | 21602749 | 21602768 | 21602752 | - |
| SEQ ID NO 17303 | GTAGCATGTGTGTTGATCTC | AGG | chr12 | 21602748 | 21602767 | 21602751 | - |
| SEQ ID NO 17304 | TAGCATGTGTGTTGATCTCA | GGG | chr12 | 21602747 | 21602766 | 21602750 | - |
| SEQ ID NO 17305 | TGTGTGTTGATCTCAGGGTC | TAG | chr12 | 21602742 | 21602761 | 21602745 | - |
| SEQ ID NO 17306 | GTTGATCTCAGGGTCTAGAA | CAG | chr12 | 21602737 | 21602756 | 21602740 | - |
| SEQ ID NO 17307 | TCAGGGTCTAGAACAGTGCC | TGG | chr12 | 21602730 | 21602749 | 21602733 | - |
| SEQ ID NO 17308 | CTAGAACAGTGCCTGGTACA | TAG | chr12 | 21602723 | 21602742 | 21602726 | - |
| SEQ ID NO 17309 | GGTACATAGAAAATGCTCAA | TGG | chr12 | 21602709 | 21602728 | 21602712 | - |
| SEQ ID NO 17310 | AAATTTGTTTTTCAACCCCT | AAG | chr12 | 21602672 | 21602691 | 21602675 | - |
| SEQ ID NO 17311 | TTTTCTATCATTTCCCTTTC | AAG | chr12 | 21602633 | 21602652 | 21602636 | - |
| SEQ ID NO 17312 | TTTCTATCATTTCCCTTTCA | AGG | chr12 | 21602632 | 21602651 | 21602635 | - |
| SEQ ID NO 17313 | TTCTATCATTTCCCTTTCAA | GGG | chr12 | 21602631 | 21602650 | 21602634 | - |
| SEQ ID NO 17314 | TCTATCATTTCCCTTTCAAG | GGG | chr12 | 21602630 | 21602649 | 21602633 | - |
| SEQ ID NO 17315 | ATCATTTCCCTTTCAAGGGG | AAG | chr12 | 21602627 | 21602646 | 21602630 | - |
| SEQ ID NO 17316 | TCATTTCCCTTTCAAGGGGA | AGG | chr12 | 21602626 | 21602645 | 21602629 | - |
| SEQ ID NO 17317 | CATTTCCCTTTCAAGGGGAA | GGG | chr12 | 21602625 | 21602644 | 21602628 | - |
| SEQ ID NO 17318 | TTCCCTTTCAAGGGGAAGGG | AAG | chr12 | 21602622 | 21602641 | 21602625 | - |
| SEQ ID NO 17319 | GGGGAAGGGAAGTGTTTTTG | TGG | chr12 | 21602611 | 21602630 | 21602614 | - |
| SEQ ID NO 17320 | GGAAGGGAAGTGTTTTTGTG | GAG | chr12 | 21602609 | 21602628 | 21602612 | - |
| SEQ ID NO 17321 | AAGGGAAGTGTTTTTGTGGA | GAG | chr12 | 21602607 | 21602626 | 21602610 | - |
| SEQ ID NO 17322 | AGGGAAGTGTTTTTGTGGAG | AGG | chr12 | 21602606 | 21602625 | 21602609 | - |
| SEQ ID NO 17323 | CCCCACAATGTGATTTACAC | AAG | chr12 | 21602582 | 21602601 | 21602585 | - |
| SEQ ID NO 17324 | TCTTTATTTTAATATTATCA | TAG | chr12 | 21602539 | 21602558 | 21602542 | - |
| SEQ ID NO 17325 | ATTTTAATATTATCATAGCC | TGG | chr12 | 21602534 | 21602553 | 21602537 | - |
| SEQ ID NO 17326 | AATATTATCATAGCCTGGTA | TGG | chr12 | 21602529 | 21602548 | 21602532 | - |
| SEQ ID NO 17327 | ATCATAGCCTGGTATGGTTT | GAG | chr12 | 21602523 | 21602542 | 21602526 | - |
| SEQ ID NO 17328 | TATGGTTTGAGATTTTCATA | TAG | chr12 | 21602511 | 21602530 | 21602514 | - |
| SEQ ID NO 17329 | GTTTGAGATTTTCATATAGA | TGG | chr12 | 21602507 | 21602526 | 21602510 | - |
| SEQ ID NO 17330 | CTAATAATACATTGCCACTA | TAG | chr12 | 21602465 | 21602484 | 21602468 | - |

Figure 43 (Cont'd)

| | | | | | | | |
|---|---|---|---|---|---|---|---|
| SEQ ID NO 17331 | TTTTACTTCCCTGCATTTCA | TAG | chr12 | 21602417 | 21602436 | 21602420 | - |
| SEQ ID NO 17332 | TACTTCCCTGCATTTCATAG | TAG | chr12 | 21602414 | 21602433 | 21602417 | - |
| SEQ ID NO 17333 | GCATTTCATAGTAGTGATAT | GAG | chr12 | 21602405 | 21602424 | 21602408 | - |
| SEQ ID NO 17334 | CATTTCATAGTAGTGATATG | AGG | chr12 | 21602404 | 21602423 | 21602407 | - |
| SEQ ID NO 17335 | AGTAGTGATATGAGGTATCT | TAG | chr12 | 21602396 | 21602415 | 21602399 | - |
| SEQ ID NO 17336 | TAGTGATATGAGGTATCTTA | GAG | chr12 | 21602394 | 21602413 | 21602397 | - |
| SEQ ID NO 17337 | GATCATGAATCCCACTCCTC | CAG | chr12 | 21602372 | 21602391 | 21602375 | - |
| SEQ ID NO 17338 | AATCCCACTCCTCCAGTTCA | TAG | chr12 | 21602365 | 21602384 | 21602368 | - |
| SEQ ID NO 17339 | TCCCACTCCTCCAGTTCATA | GAG | chr12 | 21602363 | 21602382 | 21602366 | - |
| SEQ ID NO 17340 | TCATAGAGCAAATTGATTCG | TAG | chr12 | 21602348 | 21602367 | 21602351 | - |
| SEQ ID NO 17341 | ATAGAGCAAATTGATTCGTA | GAG | chr12 | 21602346 | 21602365 | 21602349 | - |
| SEQ ID NO 17342 | TAGAGCAAATTGATTCGTAG | AGG | chr12 | 21602345 | 21602364 | 21602348 | - |
| SEQ ID NO 17343 | CGTAGAGGTATTTAATGATC | AAG | chr12 | 21602330 | 21602349 | 21602333 | - |
| SEQ ID NO 17344 | GTATTTAATGATCAAGCAAA | TGG | chr12 | 21602323 | 21602342 | 21602326 | - |
| SEQ ID NO 17345 | TTTAATGATCAAGCAAATGG | CAG | chr12 | 21602320 | 21602339 | 21602323 | - |
| SEQ ID NO 17346 | TAATGATCAAGCAAATGGCA | GAG | chr12 | 21602318 | 21602337 | 21602321 | - |
| SEQ ID NO 17347 | GATCAAGCAAATGGCAGAGT | TAG | chr12 | 21602314 | 21602333 | 21602317 | - |
| SEQ ID NO 17348 | ATCAAGCAAATGGCAGAGTT | AGG | chr12 | 21602313 | 21602332 | 21602316 | - |
| SEQ ID NO 17349 | GCAAATGGCAGAGTTAGGAC | CAG | chr12 | 21602308 | 21602327 | 21602311 | - |
| SEQ ID NO 17350 | CAAATGGCAGAGTTAGGACC | AGG | chr12 | 21602307 | 21602326 | 21602310 | - |
| SEQ ID NO 17351 | GCAGAGTTAGGACCAGGATT | TAG | chr12 | 21602301 | 21602320 | 21602304 | - |
| SEQ ID NO 17352 | CAGAGTTAGGACCAGGATTT | AGG | chr12 | 21602300 | 21602319 | 21602303 | - |
| SEQ ID NO 17353 | CCAGGATTTAGGTCTTTTCC | AAG | chr12 | 21602289 | 21602308 | 21602292 | - |
| SEQ ID NO 17354 | CAGGATTTAGGTCTTTTCCA | AGG | chr12 | 21602288 | 21602307 | 21602291 | - |
| SEQ ID NO 17355 | TCACTTTTTACTATTATGT | AAG | chr12 | 21602260 | 21602279 | 21602263 | - |
| SEQ ID NO 17356 | AGAATTAAATATTAAAACCT | CAG | chr12 | 21602239 | 21602258 | 21602242 | - |
| SEQ ID NO 17357 | TATTAAAACCTCAGTTTTCA | AAG | chr12 | 21602230 | 21602249 | 21602233 | - |
| SEQ ID NO 17358 | ATTAAAACCTCAGTTTTCAA | AGG | chr12 | 21602229 | 21602248 | 21602232 | - |
| SEQ ID NO 17359 | TTTTCAAAGGAAATGTCCTA | TAG | chr12 | 21602216 | 21602235 | 21602219 | - |
| SEQ ID NO 17360 | AGGAAATGTCCTATAGATGA | AAG | chr12 | 21602209 | 21602228 | 21602212 | - |
| SEQ ID NO 17361 | GTCCTATAGATGAAAGAACA | CAG | chr12 | 21602202 | 21602221 | 21602205 | - |
| SEQ ID NO 17362 | ATGAAAGAACACAGTACTTG | CAG | chr12 | 21602193 | 21602212 | 21602196 | - |
| SEQ ID NO 17363 | GAACACAGTACTTGCAGTCA | AAG | chr12 | 21602187 | 21602206 | 21602190 | - |
| SEQ ID NO 17364 | AACACAGTACTTGCAGTCAA | AGG | chr12 | 21602186 | 21602205 | 21602189 | - |
| SEQ ID NO 17365 | GTACTTGCAGTCAAAGGTCT | TGG | chr12 | 21602180 | 21602199 | 21602183 | - |
| SEQ ID NO 17366 | ATTTCTGAAACTTTCTGAAA | AAG | chr12 | 21602157 | 21602176 | 21602160 | - |
| SEQ ID NO 17367 | GAACCCCTTAAACTGAATAA | CAG | chr12 | 21602135 | 21602154 | 21602138 | - |
| SEQ ID NO 17368 | AAAATGAATGTTATACTCTC | CAG | chr12 | 21602099 | 21602118 | 21602102 | - |
| SEQ ID NO 17369 | AGTTATCTTACCATGTTTTC | TGG | chr12 | 21602078 | 21602097 | 21602081 | - |
| SEQ ID NO 17370 | TACCATGTTTTCTGGCAAAC | AAG | chr12 | 21602070 | 21602089 | 21602073 | - |
| SEQ ID NO 17371 | ACCATGTTTTCTGGCAAACA | AGG | chr12 | 21602069 | 21602088 | 21602072 | - |
| SEQ ID NO 17372 | AAGGAAATGTATTCACATCC | AAG | chr12 | 21602050 | 21602069 | 21602053 | - |
| SEQ ID NO 17373 | ATTCACATCCAAGAAAACAA | AAG | chr12 | 21602040 | 21602059 | 21602043 | - |
| SEQ ID NO 17374 | TTCACATCCAAGAAAACAAA | AGG | chr12 | 21602039 | 21602058 | 21602042 | - |
| SEQ ID NO 17375 | CAAGAAAACAAAGGTTTCT | TAG | chr12 | 21602031 | 21602050 | 21602034 | - |
| SEQ ID NO 17376 | AAGAAAACAAAGGTTTCTT | AGG | chr12 | 21602030 | 21602049 | 21602033 | - |
| SEQ ID NO 17377 | GAAAACAAAGGTTTCTTAG | GAG | chr12 | 21602028 | 21602047 | 21602031 | - |

Figure 43 (Cont'd)

| | | | | | | | |
|---|---|---|---|---|---|---|---|
| SEQ ID NO 17378 | AACAAAAGGTTTCTTAGGAG | AAG | chr12 | 21602025 | 21602044 | 21602028 | - |
| SEQ ID NO 17379 | GGAGAAGAATCCCTTGCTGC | CAG | chr12 | 21602009 | 21602028 | 21602012 | - |
| SEQ ID NO 17380 | AGAATTTTGCCCATGAACAA | TGG | chr12 | 21601988 | 21602007 | 21601991 | - |
| SEQ ID NO 17381 | TGGAAACGTGAAAAACATAA | CAG | chr12 | 21601968 | 21601987 | 21601971 | - |
| SEQ ID NO 17382 | ACGTGAAAAACATAACAGAT | GAG | chr12 | 21601963 | 21601982 | 21601966 | - |
| SEQ ID NO 17383 | GTGAAAAACATAACAGATGA | GAG | chr12 | 21601961 | 21601980 | 21601964 | - |
| SEQ ID NO 17384 | GAAAAACATAACAGATGAGA | GAG | chr12 | 21601959 | 21601978 | 21601962 | - |
| SEQ ID NO 17385 | CATAACAGATGAGAGAGTCA | CAG | chr12 | 21601953 | 21601972 | 21601956 | - |
| SEQ ID NO 17386 | ACAGATGAGAGAGTCACAGT | TAG | chr12 | 21601949 | 21601968 | 21601952 | - |
| SEQ ID NO 17387 | GAGAGAGTCACAGTTAGTTT | TGG | chr12 | 21601943 | 21601962 | 21601946 | - |
| SEQ ID NO 17388 | AGAGAGTCACAGTTAGTTTT | GGG | chr12 | 21601942 | 21601961 | 21601945 | - |
| SEQ ID NO 17389 | TAGTTTTGGGTACTAATTCT | CAG | chr12 | 21601929 | 21601948 | 21601932 | - |
| SEQ ID NO 17390 | CATTAATCCATTTTATTATT | CAG | chr12 | 21601848 | 21601867 | 21601851 | - |
| SEQ ID NO 17391 | AATCCATTTTATTATTCAGT | AAG | chr12 | 21601844 | 21601863 | 21601847 | - |
| SEQ ID NO 17392 | ATCCATTTTATTATTCAGTA | AGG | chr12 | 21601843 | 21601862 | 21601846 | - |
| SEQ ID NO 17393 | TTATTCAGTAAGGATTCATC | AAG | chr12 | 21601833 | 21601852 | 21601836 | - |
| SEQ ID NO 17394 | AGGATTCATCAAGTGTCTAT | TAG | chr12 | 21601823 | 21601842 | 21601826 | - |
| SEQ ID NO 17395 | GGATTCATCAAGTGTCTATT | AGG | chr12 | 21601822 | 21601841 | 21601825 | - |
| SEQ ID NO 17396 | ATCAAGTGTCTATTAGGTAT | CAG | chr12 | 21601816 | 21601835 | 21601819 | - |
| SEQ ID NO 17397 | TCAAGTGTCTATTAGGTATC | AGG | chr12 | 21601815 | 21601834 | 21601818 | - |
| SEQ ID NO 17398 | TCTATTAGGTATCAGGCACT | GAG | chr12 | 21601808 | 21601827 | 21601811 | - |
| SEQ ID NO 17399 | TATTAGGTATCAGGCACTGA | GAG | chr12 | 21601806 | 21601825 | 21601809 | - |
| SEQ ID NO 17400 | ATTAGGTATCAGGCACTGAG | AGG | chr12 | 21601805 | 21601824 | 21601808 | - |
| SEQ ID NO 17401 | GGTATCAGGCACTGAGAGGC | GAG | chr12 | 21601801 | 21601820 | 21601804 | - |
| SEQ ID NO 17402 | GTATCAGGCACTGAGAGGCG | AGG | chr12 | 21601800 | 21601819 | 21601803 | - |
| SEQ ID NO 17403 | TATCAGGCACTGAGAGGCGA | GGG | chr12 | 21601799 | 21601818 | 21601802 | - |
| SEQ ID NO 17404 | TCAGGCACTGAGAGGCGAGG | GAG | chr12 | 21601797 | 21601816 | 21601800 | - |
| SEQ ID NO 17405 | GCACTGAGAGGCGAGGGAGA | TAG | chr12 | 21601793 | 21601812 | 21601796 | - |
| SEQ ID NO 17406 | ACTGAGAGGCGAGGGAGATA | GAG | chr12 | 21601791 | 21601810 | 21601794 | - |
| SEQ ID NO 17407 | GAGGCGAGGGAGATAGAGTT | AAG | chr12 | 21601786 | 21601805 | 21601789 | - |
| SEQ ID NO 17408 | GGGAGATAGAGTTAAGAATA | CAG | chr12 | 21601779 | 21601798 | 21601782 | - |
| SEQ ID NO 17409 | AGAACTGATTCTTAATCTTC | AAG | chr12 | 21601758 | 21601777 | 21601761 | - |
| SEQ ID NO 17410 | TTCAAGAATTGACAAATTTG | TAG | chr12 | 21601741 | 21601760 | 21601744 | - |
| SEQ ID NO 17411 | AAGAATTGACAAATTTGTAG | AAG | chr12 | 21601738 | 21601757 | 21601741 | - |
| SEQ ID NO 17412 | AGAATTGACAAATTTGTAGA | AGG | chr12 | 21601737 | 21601756 | 21601740 | - |
| SEQ ID NO 17413 | ATTGACAAATTTGTAGAAGG | TAG | chr12 | 21601734 | 21601753 | 21601737 | - |
| SEQ ID NO 17414 | TAGACATTGAACATACAATA | CAG | chr12 | 21601714 | 21601733 | 21601717 | - |
| SEQ ID NO 17415 | ACAATACAGTCAAATGTGAT | GAG | chr12 | 21601700 | 21601719 | 21601703 | - |
| SEQ ID NO 17416 | CAGTCAAATGTGATGAGTGT | GAG | chr12 | 21601694 | 21601713 | 21601697 | - |
| SEQ ID NO 17417 | AATGTGATGAGTGTGAGACT | AAG | chr12 | 21601688 | 21601707 | 21601691 | - |
| SEQ ID NO 17418 | ATGTGATGAGTGTGAGACTA | AGG | chr12 | 21601687 | 21601706 | 21601690 | - |
| SEQ ID NO 17419 | TGTGATGAGTGTGAGACTAA | GGG | chr12 | 21601686 | 21601705 | 21601689 | - |
| SEQ ID NO 17420 | GAGTGTGAGACTAAGGGAAC | CAG | chr12 | 21601680 | 21601699 | 21601683 | - |
| SEQ ID NO 17421 | AGTGTGAGACTAAGGGAACC | AGG | chr12 | 21601679 | 21601698 | 21601682 | - |
| SEQ ID NO 17422 | CTAAGGGAACCAGGTGTCCT | AAG | chr12 | 21601670 | 21601689 | 21601673 | - |
| SEQ ID NO 17423 | CCAGGTGTCCTAAGACTATA | CAG | chr12 | 21601661 | 21601680 | 21601664 | - |
| SEQ ID NO 17424 | TAAGACTATACAGTGTACCG | TGG | chr12 | 21601651 | 21601670 | 21601654 | - |

Figure 43 (Cont'd)

| | | | | | | | |
|---|---|---|---|---|---|---|---|
| SEQ ID NO 17425 | CTATACAGTGTACCGTGGAA | TGG | chr12 | 21601646 | 21601665 | 21601649 | - |
| SEQ ID NO 17426 | TATACAGTGTACCGTGGAAT | GGG | chr12 | 21601645 | 21601664 | 21601648 | - |
| SEQ ID NO 17427 | ATACAGTGTACCGTGGAATG | GGG | chr12 | 21601644 | 21601663 | 21601647 | - |
| SEQ ID NO 17428 | ACAGTGTACCGTGGAATGGG | GAG | chr12 | 21601642 | 21601661 | 21601645 | - |
| SEQ ID NO 17429 | GTGTACCGTGGAATGGGGAG | TGG | chr12 | 21601639 | 21601658 | 21601642 | - |
| SEQ ID NO 17430 | ATGGGGAGTGGTTTCTAACC | TAG | chr12 | 21601627 | 21601646 | 21601630 | - |
| SEQ ID NO 17431 | TGGTTTCTAACCTAGTTACC | TAG | chr12 | 21601619 | 21601638 | 21601622 | - |
| SEQ ID NO 17432 | GTTTCTAACCTAGTTACCTA | GAG | chr12 | 21601617 | 21601636 | 21601620 | - |
| SEQ ID NO 17433 | TTTCTAACCTAGTTACCTAG | AGG | chr12 | 21601616 | 21601635 | 21601619 | - |
| SEQ ID NO 17434 | AACCTAGTTACCTAGAGGTT | TGG | chr12 | 21601611 | 21601630 | 21601614 | - |
| SEQ ID NO 17435 | ACCTAGTTACCTAGAGGTTT | GGG | chr12 | 21601610 | 21601629 | 21601613 | - |
| SEQ ID NO 17436 | GGAAAAACCTCTCTAATGAT | GAG | chr12 | 21601589 | 21601608 | 21601592 | - |
| SEQ ID NO 17437 | TCTCTAATGATGAGATGTTT | GAG | chr12 | 21601580 | 21601599 | 21601583 | - |
| SEQ ID NO 17438 | GATGTTTGAGCTGACACTTG | AAG | chr12 | 21601567 | 21601586 | 21601570 | - |
| SEQ ID NO 17439 | ATGTTTGAGCTGACACTTGA | AGG | chr12 | 21601566 | 21601585 | 21601569 | - |
| SEQ ID NO 17440 | GCTGACACTTGAAGGATAAA | TAG | chr12 | 21601558 | 21601577 | 21601561 | - |
| SEQ ID NO 17441 | ACTTGAAGGATAAATAGCTA | AAG | chr12 | 21601552 | 21601571 | 21601555 | - |
| SEQ ID NO 17442 | CTTGAAGGATAAATAGCTAA | AGG | chr12 | 21601551 | 21601570 | 21601554 | - |
| SEQ ID NO 17443 | TTGAAGGATAAATAGCTAAA | GGG | chr12 | 21601550 | 21601569 | 21601553 | - |
| SEQ ID NO 17444 | TGAAGGATAAATAGCTAAAG | GGG | chr12 | 21601549 | 21601568 | 21601552 | - |
| SEQ ID NO 17445 | AAGGATAAATAGCTAAAGGG | GAG | chr12 | 21601547 | 21601566 | 21601550 | - |
| SEQ ID NO 17446 | ATAAATAGCTAAAGGGGAGA | AAG | chr12 | 21601543 | 21601562 | 21601546 | - |
| SEQ ID NO 17447 | GGGGAGAAAGCGTTCTATGT | GAG | chr12 | 21601530 | 21601549 | 21601533 | - |
| SEQ ID NO 17448 | GGAGAAAGCGTTCTATGTGA | GAG | chr12 | 21601528 | 21601547 | 21601531 | - |
| SEQ ID NO 17449 | GTGAGAGAACTATATATGCC | AAG | chr12 | 21601512 | 21601531 | 21601515 | - |
| SEQ ID NO 17450 | GAACTATATGCCAAGATG | CAG | chr12 | 21601506 | 21601525 | 21601509 | - |
| SEQ ID NO 17451 | CTATATATGCCAAGATGCAG | AAG | chr12 | 21601503 | 21601522 | 21601506 | - |
| SEQ ID NO 17452 | GCAGAAGTGTTCTCTGTTCG | AAG | chr12 | 21601487 | 21601506 | 21601490 | - |
| SEQ ID NO 17453 | TGTTCTCTGTTCGAAGATCT | GAG | chr12 | 21601480 | 21601499 | 21601483 | - |
| SEQ ID NO 17454 | TCTCTGTTCGAAGATCTGAG | CGG | chr12 | 21601477 | 21601496 | 21601480 | - |
| SEQ ID NO 17455 | CTCTGTTCGAAGATCTGAGC | GGG | chr12 | 21601476 | 21601495 | 21601479 | - |
| SEQ ID NO 17456 | TCTGTTCGAAGATCTGAGCG | GGG | chr12 | 21601475 | 21601494 | 21601478 | - |
| SEQ ID NO 17457 | TCGAAGATCTGAGCGGGGCT | CAG | chr12 | 21601470 | 21601489 | 21601473 | - |
| SEQ ID NO 17458 | GAAGATCTGAGCGGGGCTCA | GAG | chr12 | 21601468 | 21601487 | 21601471 | - |
| SEQ ID NO 17459 | AGATCTGAGCGGGGCTCAGA | GAG | chr12 | 21601466 | 21601485 | 21601469 | - |
| SEQ ID NO 17460 | GATCTGAGCGGGGCTCAGAG | AGG | chr12 | 21601465 | 21601484 | 21601468 | - |
| SEQ ID NO 17461 | ATCTGAGCGGGGCTCAGAGA | GGG | chr12 | 21601464 | 21601483 | 21601467 | - |
| SEQ ID NO 17462 | AGCGGGGCTCAGAGAGGGAA | AAG | chr12 | 21601459 | 21601478 | 21601462 | - |
| SEQ ID NO 17463 | GCGGGGCTCAGAGAGGGAAA | AGG | chr12 | 21601458 | 21601477 | 21601461 | - |
| SEQ ID NO 17464 | GGGGCTCAGAGAGGGAAAAG | GAG | chr12 | 21601456 | 21601475 | 21601459 | - |
| SEQ ID NO 17465 | GGCTCAGAGAGGGAAAAGGA | GAG | chr12 | 21601454 | 21601473 | 21601457 | - |
| SEQ ID NO 17466 | GCTCAGAGAGGGAAAAGGAG | AGG | chr12 | 21601453 | 21601472 | 21601456 | - |
| SEQ ID NO 17467 | TCAGAGAGGGAAAAGGAGAG | GAG | chr12 | 21601451 | 21601470 | 21601454 | - |
| SEQ ID NO 17468 | AGGGAAAAGGAGAGGAGTAT | GAG | chr12 | 21601445 | 21601464 | 21601448 | - |
| SEQ ID NO 17469 | GGAAAAGGAGAGGAGTATGA | GAG | chr12 | 21601443 | 21601462 | 21601446 | - |
| SEQ ID NO 17470 | AAAGGAGAGGAGTATGAGAG | AAG | chr12 | 21601440 | 21601459 | 21601443 | - |
| SEQ ID NO 17471 | GAGAGGAGTATGAGAGAAGA | TGG | chr12 | 21601436 | 21601455 | 21601439 | - |

Figure 43 (Cont'd)

| | | | | | | | |
|---|---|---|---|---|---|---|---|
| SEQ ID NO 17472 | AGAGGAGTATGAGAGAAGAT | GGG | chr12 | 21601435 | 21601454 | 21601438 | - |
| SEQ ID NO 17473 | AGGAGTATGAGAGAAGATGG | GAG | chr12 | 21601433 | 21601452 | 21601436 | - |
| SEQ ID NO 17474 | GAGTATGAGAGAAGATGGGA | GAG | chr12 | 21601431 | 21601450 | 21601434 | - |
| SEQ ID NO 17475 | GAGAAGATGGGAGAGACCTG | CAG | chr12 | 21601423 | 21601442 | 21601426 | - |
| SEQ ID NO 17476 | AGAAGATGGGAGAGACCTGC | AGG | chr12 | 21601422 | 21601441 | 21601425 | - |
| SEQ ID NO 17477 | GAAGATGGGAGAGACCTGCA | GGG | chr12 | 21601421 | 21601440 | 21601424 | - |
| SEQ ID NO 17478 | TGGGAGAGACCTGCAGGGAC | TAG | chr12 | 21601416 | 21601435 | 21601419 | - |
| SEQ ID NO 17479 | CCTGCAGGGACTAGATTGTG | AAG | chr12 | 21601407 | 21601426 | 21601410 | - |
| SEQ ID NO 17480 | AGGGACTAGATTGTGAAGCT | CAG | chr12 | 21601402 | 21601421 | 21601405 | - |
| SEQ ID NO 17481 | GGGACTAGATTGTGAAGCTC | AGG | chr12 | 21601401 | 21601420 | 21601404 | - |
| SEQ ID NO 17482 | GGACTAGATTGTGAAGCTCA | GGG | chr12 | 21601400 | 21601419 | 21601403 | - |
| SEQ ID NO 17483 | GACTAGATTGTGAAGCTCAG | GGG | chr12 | 21601399 | 21601418 | 21601402 | - |
| SEQ ID NO 17484 | ACTAGATTGTGAAGCTCAGG | GGG | chr12 | 21601398 | 21601417 | 21601401 | - |
| SEQ ID NO 17485 | TAGATTGTGAAGCTCAGGGG | GAG | chr12 | 21601396 | 21601415 | 21601399 | - |
| SEQ ID NO 17486 | TGAAGCTCAGGGGGAGTTAA | TAG | chr12 | 21601389 | 21601408 | 21601392 | - |
| SEQ ID NO 17487 | CAGGGGGAGTTAATAGCCTT | AAG | chr12 | 21601382 | 21601401 | 21601385 | - |
| SEQ ID NO 17488 | AGGGGGAGTTAATAGCCTTA | AGG | chr12 | 21601381 | 21601400 | 21601384 | - |
| SEQ ID NO 17489 | GGGGAGTTAATAGCCTTAAG | GAG | chr12 | 21601379 | 21601398 | 21601382 | - |
| SEQ ID NO 17490 | GCCTTAAGGAGTTTTGTCTC | CAG | chr12 | 21601367 | 21601386 | 21601370 | - |
| SEQ ID NO 17491 | CCTTAAGGAGTTTTGTCTCC | AGG | chr12 | 21601366 | 21601385 | 21601369 | - |
| SEQ ID NO 17492 | CTTAAGGAGTTTTGTCTCCA | GGG | chr12 | 21601365 | 21601384 | 21601368 | - |
| SEQ ID NO 17493 | CCAGGGTATGAACAATGAAT | GAG | chr12 | 21601348 | 21601367 | 21601351 | - |
| SEQ ID NO 17494 | CAGGGTATGAACAATGAATG | AGG | chr12 | 21601347 | 21601366 | 21601350 | - |
| SEQ ID NO 17495 | GGGTATGAACAATGAATGAG | GAG | chr12 | 21601345 | 21601364 | 21601348 | - |
| SEQ ID NO 17496 | AGTCACTGAAATTCTATCCA | CAG | chr12 | 21601324 | 21601343 | 21601327 | - |
| SEQ ID NO 17497 | CACTGAAATTCTATCCACAG | TAG | chr12 | 21601321 | 21601340 | 21601324 | - |
| SEQ ID NO 17498 | TGAAATTCTATCCACAGTAG | TGG | chr12 | 21601318 | 21601337 | 21601321 | - |
| SEQ ID NO 17499 | GAAATTCTATCCACAGTAGT | GGG | chr12 | 21601317 | 21601336 | 21601320 | - |
| SEQ ID NO 17500 | ATTCTATCCACAGTAGTGGG | AAG | chr12 | 21601314 | 21601333 | 21601317 | - |
| SEQ ID NO 17501 | CCACAGTAGTGGGAAGTACT | AAG | chr12 | 21601307 | 21601326 | 21601310 | - |
| SEQ ID NO 17502 | CAGTAGTGGGAAGTACTAAG | TAG | chr12 | 21601304 | 21601323 | 21601307 | - |
| SEQ ID NO 17503 | AGTGGGAAGTACTAAGTAGT | CAG | chr12 | 21601300 | 21601319 | 21601303 | - |
| SEQ ID NO 17504 | GTGGGAAGTACTAAGTAGTC | AGG | chr12 | 21601299 | 21601318 | 21601302 | - |
| SEQ ID NO 17505 | CTAAGTAGTCAGGTATGTTT | TGG | chr12 | 21601289 | 21601308 | 21601292 | - |
| SEQ ID NO 17506 | AGTAGTCAGGTATGTTTTGG | AAG | chr12 | 21601286 | 21601305 | 21601289 | - |
| SEQ ID NO 17507 | AGTCAGGTATGTTTTGGAAG | AAG | chr12 | 21601283 | 21601302 | 21601286 | - |
| SEQ ID NO 17508 | TTTGGAAGAAGCACTGTTAC | CAG | chr12 | 21601271 | 21601290 | 21601274 | - |
| SEQ ID NO 17509 | AAGAAGCACTGTTACCAGTT | GAG | chr12 | 21601266 | 21601285 | 21601269 | - |
| SEQ ID NO 17510 | AGAAGCACTGTTACCAGTTG | AGG | chr12 | 21601265 | 21601284 | 21601268 | - |
| SEQ ID NO 17511 | GAAGCACTGTTACCAGTTGA | GGG | chr12 | 21601264 | 21601283 | 21601267 | - |
| SEQ ID NO 17512 | AGCACTGTTACCAGTTGAGG | GAG | chr12 | 21601262 | 21601281 | 21601265 | - |
| SEQ ID NO 17513 | CACTGTTACCAGTTGAGGGA | GAG | chr12 | 21601260 | 21601279 | 21601263 | - |
| SEQ ID NO 17514 | ACTGTTACCAGTTGAGGGAG | AGG | chr12 | 21601259 | 21601278 | 21601262 | - |
| SEQ ID NO 17515 | TGTTACCAGTTGAGGGAGAG | GAG | chr12 | 21601257 | 21601276 | 21601260 | - |
| SEQ ID NO 17516 | TTACCAGTTGAGGGAGAGGA | GAG | chr12 | 21601255 | 21601274 | 21601258 | - |
| SEQ ID NO 17517 | TACCAGTTGAGGGAGAGGAG | AGG | chr12 | 21601254 | 21601273 | 21601257 | - |
| SEQ ID NO 17518 | CCAGTTGAGGGAGAGGAGAG | GAG | chr12 | 21601252 | 21601271 | 21601255 | - |

Figure 43 (Cont'd)

| SEQ ID NO 17519 | CAGTTGAGGGAGAGGAGAGG | AGG | chr12 | 21601251 | 21601270 | 21601254 | - |
| SEQ ID NO 17520 | AGTTGAGGGAGAGGAGAGGA | GGG | chr12 | 21601250 | 21601269 | 21601253 | - |
| SEQ ID NO 17521 | GGAGAGGAGAGGAGGGAAAT | TAG | chr12 | 21601243 | 21601262 | 21601246 | - |
| SEQ ID NO 17522 | AGAGGAGGGAAATTAGACTG | TGG | chr12 | 21601236 | 21601255 | 21601239 | - |
| SEQ ID NO 17523 | AATTAGACTGTGGTGTGACC | CAG | chr12 | 21601226 | 21601245 | 21601229 | - |
| SEQ ID NO 17524 | ATTAGACTGTGGTGTGACCC | AGG | chr12 | 21601225 | 21601244 | 21601228 | - |
| SEQ ID NO 17525 | GACTGTGGTGTGACCCAGGA | TGG | chr12 | 21601221 | 21601240 | 21601224 | - |
| SEQ ID NO 17526 | GTGGTGTGACCCAGGATGGA | AAG | chr12 | 21601217 | 21601236 | 21601220 | - |
| SEQ ID NO 17527 | TGGAAAGTTTTGCCCAAATG | TGG | chr12 | 21601201 | 21601220 | 21601204 | - |
| SEQ ID NO 17528 | GGAAAGTTTTGCCCAAATGT | GGG | chr12 | 21601200 | 21601219 | 21601203 | - |
| SEQ ID NO 17529 | GAAAGTTTTGCCCAAATGTG | GGG | chr12 | 21601199 | 21601218 | 21601202 | - |
| SEQ ID NO 17530 | AAAGTTTTGCCCAAATGTGG | GGG | chr12 | 21601198 | 21601217 | 21601201 | - |
| SEQ ID NO 17531 | TGTTTACTCTCTCCTTTGCC | CAG | chr12 | 21601170 | 21601189 | 21601173 | - |
| SEQ ID NO 17532 | GTTTACTCTCTCCTTTGCCC | AGG | chr12 | 21601169 | 21601188 | 21601172 | - |
| SEQ ID NO 17533 | TTCTTCTGCACACACTTGCT | CAG | chr12 | 21601131 | 21601150 | 21601134 | - |
| SEQ ID NO 17534 | GCTCAGAACATTACAAACTC | TGG | chr12 | 21601114 | 21601133 | 21601117 | - |
| SEQ ID NO 17535 | TCAGAACATTACAAACTCTG | GAG | chr12 | 21601112 | 21601131 | 21601115 | - |
| SEQ ID NO 17536 | TCTGGAGAAATTAACATGTT | AAG | chr12 | 21601096 | 21601115 | 21601099 | - |
| SEQ ID NO 17537 | CTGGAGAAATTAACATGTTA | AGG | chr12 | 21601095 | 21601114 | 21601098 | - |
| SEQ ID NO 17538 | ATTAACATGTTAAGGATATT | TAG | chr12 | 21601087 | 21601106 | 21601090 | - |
| SEQ ID NO 17539 | TTAACATGTTAAGGATATTT | AGG | chr12 | 21601086 | 21601105 | 21601089 | - |
| SEQ ID NO 17540 | GATATTTAGGATCATTAAAA | AAG | chr12 | 21601073 | 21601092 | 21601076 | - |
| SEQ ID NO 17541 | AATGTTGTCACACATAATGA | AAG | chr12 | 21601043 | 21601062 | 21601046 | - |
| SEQ ID NO 17542 | CACATAATGAAAGTTAATTT | AAG | chr12 | 21601033 | 21601052 | 21601036 | - |
| SEQ ID NO 17543 | AAGTTAATTTAAGAATTGTA | AAG | chr12 | 21601023 | 21601042 | 21601026 | - |
| SEQ ID NO 17544 | TTTAAGAATTGTAAAGACTT | GAG | chr12 | 21601016 | 21601035 | 21601019 | - |
| SEQ ID NO 17545 | TTGTAAAGACTTGAGCGATG | TAG | chr12 | 21601008 | 21601027 | 21601011 | - |
| SEQ ID NO 17546 | TAAATGCTTCCCTCTTAAAA | TGG | chr12 | 21600977 | 21600996 | 21600980 | - |
| SEQ ID NO 17547 | GCTTCCCTCTTAAAATGGAC | TAG | chr12 | 21600972 | 21600991 | 21600975 | - |
| SEQ ID NO 17548 | GAAACAATTTGTTTTTGCCT | AAG | chr12 | 21600950 | 21600969 | 21600953 | - |
| SEQ ID NO 17549 | TGCCTAAGCCAACGTATTGC | TGG | chr12 | 21600935 | 21600954 | 21600938 | - |
| SEQ ID NO 17550 | TAATTTACCTGCTTCCTCCT | CAG | chr12 | 21600909 | 21600928 | 21600912 | - |
| SEQ ID NO 17551 | CACTACACCTCTGAATTACA | TGG | chr12 | 21600880 | 21600899 | 21600883 | - |
| SEQ ID NO 17552 | ACCTCTGAATTACATGGTAC | AAG | chr12 | 21600874 | 21600893 | 21600877 | - |
| SEQ ID NO 17553 | TCTGAATTACATGGTACAAG | TGG | chr12 | 21600871 | 21600890 | 21600874 | - |
| SEQ ID NO 17554 | ATTACATGGTACAAGTGGCA | CAG | chr12 | 21600866 | 21600885 | 21600869 | - |
| SEQ ID NO 17555 | TTACATGGTACAAGTGGCAC | AGG | chr12 | 21600865 | 21600884 | 21600868 | - |
| SEQ ID NO 17556 | TACATGGTACAAGTGGCACA | GGG | chr12 | 21600864 | 21600883 | 21600867 | - |
| SEQ ID NO 17557 | ATGGTACAAGTGGCACAGGG | AAG | chr12 | 21600861 | 21600880 | 21600864 | - |
| SEQ ID NO 17558 | AAGTGGCACAGGGAAGAATT | CAG | chr12 | 21600854 | 21600873 | 21600857 | - |
| SEQ ID NO 17559 | CAGGGAAGAATTCAGAAAAC | TAG | chr12 | 21600846 | 21600865 | 21600849 | - |
| SEQ ID NO 17560 | GGGAAGAATTCAGAAAACTA | GAG | chr12 | 21600844 | 21600863 | 21600847 | - |
| SEQ ID NO 17561 | AATTCAGAAAACTAGAGTCA | AAG | chr12 | 21600838 | 21600857 | 21600841 | - |
| SEQ ID NO 17562 | TCAGAAAACTAGAGTCAAAG | TGG | chr12 | 21600835 | 21600854 | 21600838 | - |
| SEQ ID NO 17563 | AACTAGAGTCAAAGTGGTTA | TGG | chr12 | 21600829 | 21600848 | 21600832 | - |
| SEQ ID NO 17564 | TAGAGTCAAAGTGGTTATGG | AAG | chr12 | 21600826 | 21600845 | 21600829 | - |
| SEQ ID NO 17565 | ATGGAAGAAATTATAATAAT | GAG | chr12 | 21600810 | 21600829 | 21600813 | - |

Figure 43 (Cont'd)

| SEQ ID NO 17566 | TAATAATGAGTCCACTCTTC | TAG | chr12 | 21600797 | 21600816 | 21600800 | - |
| SEQ ID NO 17567 | AATAATGAGTCCACTCTTCT | AGG | chr12 | 21600796 | 21600815 | 21600799 | - |
| SEQ ID NO 17568 | ATGAGTCCACTCTTCTAGGA | CAG | chr12 | 21600792 | 21600811 | 21600795 | - |
| SEQ ID NO 17569 | TGAGTCCACTCTTCTAGGAC | AGG | chr12 | 21600791 | 21600810 | 21600794 | - |
| SEQ ID NO 17570 | AGTCCACTCTTCTAGGACAG | GAG | chr12 | 21600789 | 21600808 | 21600792 | - |
| SEQ ID NO 17571 | CTTCTAGGACAGGAGTTCTA | AAG | chr12 | 21600781 | 21600800 | 21600784 | - |
| SEQ ID NO 17572 | TTCTAGGACAGGAGTTCTAA | AGG | chr12 | 21600780 | 21600799 | 21600783 | - |
| SEQ ID NO 17573 | AGGACAGGAGTTCTAAAGGT | GAG | chr12 | 21600776 | 21600795 | 21600779 | - |
| SEQ ID NO 17574 | GGACAGGAGTTCTAAAGGTG | AGG | chr12 | 21600775 | 21600794 | 21600778 | - |
| SEQ ID NO 17575 | AAAGGTGAGGACTTTGATAT | AAG | chr12 | 21600762 | 21600781 | 21600765 | - |
| SEQ ID NO 17576 | ACTTTGATATAAGTGAACTC | AAG | chr12 | 21600752 | 21600771 | 21600755 | - |
| SEQ ID NO 17577 | CTTTGATATAAGTGAACTCA | AGG | chr12 | 21600751 | 21600770 | 21600754 | - |
| SEQ ID NO 17578 | TTGATATAAGTGAACTCAAG | GAG | chr12 | 21600749 | 21600768 | 21600752 | - |
| SEQ ID NO 17579 | TCAAGGAGTTTCTAAACCTT | CAG | chr12 | 21600734 | 21600753 | 21600737 | - |
| SEQ ID NO 17580 | CAGAAATTATATCTAAAAAT | TAG | chr12 | 21600714 | 21600733 | 21600717 | - |
| SEQ ID NO 17581 | AGAAATTATATCTAAAAATT | AGG | chr12 | 21600713 | 21600732 | 21600716 | - |
| SEQ ID NO 17582 | AAAAATTAGGTGCACGTATA | TAG | chr12 | 21600700 | 21600719 | 21600703 | - |
| SEQ ID NO 17583 | AATTAGGTGCACGTATATAG | AAG | chr12 | 21600697 | 21600716 | 21600700 | - |
| SEQ ID NO 17584 | ATATAGAAGTACTTTTCTCT | GAG | chr12 | 21600683 | 21600702 | 21600686 | - |
| SEQ ID NO 17585 | TAGAAGTACTTTTCTCTGAG | AAG | chr12 | 21600680 | 21600699 | 21600683 | - |
| SEQ ID NO 17586 | GAAGTACTTTTCTCTGAGAA | GAG | chr12 | 21600678 | 21600697 | 21600681 | - |
| SEQ ID NO 17587 | AAGTACTTTTCTCTGAGAAG | AGG | chr12 | 21600677 | 21600696 | 21600680 | - |
| SEQ ID NO 17588 | AGAGGACTTCACACTTCCAT | CAG | chr12 | 21600659 | 21600678 | 21600662 | - |
| SEQ ID NO 17589 | ACACTTCCATCAGCTTCCTG | AAG | chr12 | 21600649 | 21600668 | 21600652 | - |
| SEQ ID NO 17590 | CACTTCCATCAGCTTCCTGA | AGG | chr12 | 21600648 | 21600667 | 21600651 | - |
| SEQ ID NO 17591 | AGGCCCTGTAATTGCCGTA | AAG | chr12 | 21600628 | 21600647 | 21600631 | - |
| SEQ ID NO 17592 | CGTAAAGAACAACTGCTCTA | AAG | chr12 | 21600612 | 21600631 | 21600615 | - |
| SEQ ID NO 17593 | ACTGCTCTAAAGTTTAATAC | TAG | chr12 | 21600601 | 21600620 | 21600604 | - |
| SEQ ID NO 17594 | CTGCTCTAAAGTTTAATACT | AGG | chr12 | 21600600 | 21600619 | 21600603 | - |
| SEQ ID NO 17595 | AAGTTTAATACTAGGCTACT | CGG | chr12 | 21600592 | 21600611 | 21600595 | - |
| SEQ ID NO 17596 | TCGGCTGTTTTTTGTTAACA | CAG | chr12 | 21600573 | 21600592 | 21600576 | - |
| SEQ ID NO 17597 | GCTGTTTTTTGTTAACACAG | AAG | chr12 | 21600570 | 21600589 | 21600573 | - |
| SEQ ID NO 17598 | TAACACAGAAGTTTTCCAAA | TGG | chr12 | 21600558 | 21600577 | 21600561 | - |
| SEQ ID NO 17599 | TTTTCCAAATGGCTTTTCTC | TAG | chr12 | 21600547 | 21600566 | 21600550 | - |
| SEQ ID NO 17600 | TTCCAAATGGCTTTTCTCTA | GAG | chr12 | 21600545 | 21600564 | 21600548 | - |
| SEQ ID NO 17601 | TTTCTCTAGAGCAAAATGAA | AAG | chr12 | 21600533 | 21600552 | 21600536 | - |
| SEQ ID NO 17602 | TTCTCTAGAGCAAAATGAAA | AGG | chr12 | 21600532 | 21600551 | 21600535 | - |
| SEQ ID NO 17603 | AAAAGGATCCCATCCTTCCC | GAG | chr12 | 21600515 | 21600534 | 21600518 | - |
| SEQ ID NO 17604 | CCTACCCCCACCACTTTTA | AAG | chr12 | 21600440 | 21600459 | 21600443 | - |
| SEQ ID NO 17605 | ACCACTTTTAAAGATCCATC | AAG | chr12 | 21600430 | 21600449 | 21600433 | - |
| SEQ ID NO 17606 | CCACTTTTAAAGATCCATCA | AGG | chr12 | 21600429 | 21600448 | 21600432 | - |
| SEQ ID NO 17607 | TTTAAAGATCCATCAAGGCC | CAG | chr12 | 21600424 | 21600443 | 21600427 | - |
| SEQ ID NO 17608 | AGATCCATCAAGGCCCAGCA | TGG | chr12 | 21600419 | 21600438 | 21600422 | - |
| SEQ ID NO 17609 | CTGTAATCTCAACACTTTTC | AAG | chr12 | 21600386 | 21600405 | 21600389 | - |
| SEQ ID NO 17610 | TGTAATCTCAACACTTTTCA | AGG | chr12 | 21600385 | 21600404 | 21600388 | - |
| SEQ ID NO 17611 | TCTCAACACTTTTCAAGGCT | GAG | chr12 | 21600380 | 21600399 | 21600383 | - |
| SEQ ID NO 17612 | CTCAACACTTTTCAAGGCTG | AGG | chr12 | 21600379 | 21600398 | 21600382 | - |

Figure 43 (Cont'd)

| | | | | | | | |
|---|---|---|---|---|---|---|---|
| SEQ ID NO 17613 | AACACTTTTCAAGGCTGAGG | TGG | chr12 | 21600376 | 21600395 | 21600379 | - |
| SEQ ID NO 17614 | ACACTTTTCAAGGCTGAGGT | GGG | chr12 | 21600375 | 21600394 | 21600378 | - |
| SEQ ID NO 17615 | ACTTTTCAAGGCTGAGGTGG | GAG | chr12 | 21600373 | 21600392 | 21600376 | - |
| SEQ ID NO 17616 | CTGAGGTGGGAGAATTGTTT | GAG | chr12 | 21600362 | 21600381 | 21600365 | - |
| SEQ ID NO 17617 | TGGGAGAATTGTTTGAGACC | AAG | chr12 | 21600356 | 21600375 | 21600359 | - |
| SEQ ID NO 17618 | GGAGAATTGTTTGAGACCAA | GAG | chr12 | 21600354 | 21600373 | 21600357 | - |
| SEQ ID NO 17619 | AATTGTTTGAGACCAAGAGT | TGG | chr12 | 21600350 | 21600369 | 21600353 | - |
| SEQ ID NO 17620 | TGAGACCAAGAGTTGGATAC | CAG | chr12 | 21600343 | 21600362 | 21600346 | - |
| SEQ ID NO 17621 | CCAAGAGTTGGATACCAGCC | TGG | chr12 | 21600338 | 21600357 | 21600341 | - |
| SEQ ID NO 17622 | CAAGAGTTGGATACCAGCCT | GGG | chr12 | 21600337 | 21600356 | 21600340 | - |
| SEQ ID NO 17623 | AAGAGTTGGATACCAGCCTG | GGG | chr12 | 21600336 | 21600355 | 21600339 | - |
| SEQ ID NO 17624 | GGATACCAGCCTGGGGAACA | TAG | chr12 | 21600329 | 21600348 | 21600332 | - |
| SEQ ID NO 17625 | GATACCAGCCTGGGGAACAT | AGG | chr12 | 21600328 | 21600347 | 21600331 | - |
| SEQ ID NO 17626 | ATACCAGCCTGGGGAACATA | GGG | chr12 | 21600327 | 21600346 | 21600330 | - |
| SEQ ID NO 17627 | ACCAGCCTGGGGAACATAGG | GAG | chr12 | 21600325 | 21600344 | 21600328 | - |
| SEQ ID NO 17628 | ATAGGGAGACCCTGTTTCTA | CAG | chr12 | 21600310 | 21600329 | 21600313 | - |
| SEQ ID NO 17629 | AGAAATTTAAAAAATTTCTC | TAG | chr12 | 21600289 | 21600308 | 21600292 | - |
| SEQ ID NO 17630 | ATTTAAAAAATTTCTCTAGC | TGG | chr12 | 21600285 | 21600304 | 21600288 | - |
| SEQ ID NO 17631 | AAAATTTCTCTAGCTGGCCA | TGG | chr12 | 21600279 | 21600298 | 21600282 | - |
| SEQ ID NO 17632 | AATTTCTCTAGCTGGCCATG | GAG | chr12 | 21600277 | 21600296 | 21600280 | - |
| SEQ ID NO 17633 | ATTTCTCTAGCTGGCCATGG | AGG | chr12 | 21600276 | 21600295 | 21600279 | - |
| SEQ ID NO 17634 | GCCATGGAGGCTCACACCTG | TAG | chr12 | 21600263 | 21600282 | 21600266 | - |
| SEQ ID NO 17635 | GAGGCTCACACCTGTAGTCC | TAG | chr12 | 21600257 | 21600276 | 21600260 | - |
| SEQ ID NO 17636 | ACCTGTAGTCCTAGCTACCT | GAG | chr12 | 21600248 | 21600267 | 21600251 | - |
| SEQ ID NO 17637 | CTGTAGTCCTAGCTACCTGA | GAG | chr12 | 21600246 | 21600265 | 21600249 | - |
| SEQ ID NO 17638 | TGTAGTCCTAGCTACCTGAG | AGG | chr12 | 21600245 | 21600264 | 21600248 | - |
| SEQ ID NO 17639 | CCTAGCTACCTGAGAGGCTA | AAG | chr12 | 21600239 | 21600258 | 21600242 | - |
| SEQ ID NO 17640 | AGCTACCTGAGAGGCTAAAG | CAG | chr12 | 21600236 | 21600255 | 21600239 | - |
| SEQ ID NO 17641 | GCTACCTGAGAGGCTAAAGC | AGG | chr12 | 21600235 | 21600254 | 21600238 | - |
| SEQ ID NO 17642 | TACCTGAGAGGCTAAAGCAG | GAG | chr12 | 21600233 | 21600252 | 21600236 | - |
| SEQ ID NO 17643 | ACCTGAGAGGCTAAAGCAGG | AGG | chr12 | 21600232 | 21600251 | 21600235 | - |
| SEQ ID NO 17644 | GCAGGAGGATCAATTGAATC | CAG | chr12 | 21600217 | 21600236 | 21600220 | - |
| SEQ ID NO 17645 | CAGGAGGATCAATTGAATCC | AGG | chr12 | 21600216 | 21600235 | 21600219 | - |
| SEQ ID NO 17646 | TCAATTGAATCCAGGCGTTC | TAG | chr12 | 21600208 | 21600227 | 21600211 | - |
| SEQ ID NO 17647 | TTGAATCCAGGCGTTCTAGT | GAG | chr12 | 21600204 | 21600223 | 21600207 | - |
| SEQ ID NO 17648 | TGAATCCAGGCGTTCTAGTG | AGG | chr12 | 21600203 | 21600222 | 21600206 | - |
| SEQ ID NO 17649 | CAGGCGTTCTAGTGAGGCTT | CAG | chr12 | 21600197 | 21600216 | 21600200 | - |
| SEQ ID NO 17650 | CGTTCTAGTGAGGCTTCAGT | GAG | chr12 | 21600193 | 21600212 | 21600196 | - |
| SEQ ID NO 17651 | CTAGTGAGGCTTCAGTGAGC | AAG | chr12 | 21600189 | 21600208 | 21600192 | - |
| SEQ ID NO 17652 | AAGATTGCACCATTGCACTC | CAG | chr12 | 21600169 | 21600188 | 21600172 | - |
| SEQ ID NO 17653 | TTGCACCATTGCACTCCAGC | CGG | chr12 | 21600165 | 21600184 | 21600168 | - |
| SEQ ID NO 17654 | TGCACCATTGCACTCCAGCC | GGG | chr12 | 21600164 | 21600183 | 21600167 | - |
| SEQ ID NO 17655 | GCACCATTGCACTCCAGCCG | GGG | chr12 | 21600163 | 21600182 | 21600166 | - |
| SEQ ID NO 17656 | TTGCACTCCAGCCGGGGTGA | CAG | chr12 | 21600157 | 21600176 | 21600160 | - |
| SEQ ID NO 17657 | GCACTCCAGCCGGGGTGACA | GAG | chr12 | 21600155 | 21600174 | 21600158 | - |
| SEQ ID NO 17658 | TCCAGCCGGGGTGACAGAGT | GAG | chr12 | 21600151 | 21600170 | 21600154 | - |
| SEQ ID NO 17659 | AGACCCTGTTTCAAACAAAC | AAG | chr12 | 21600130 | 21600149 | 21600133 | - |

Figure 43 (Cont'd)

| | | | | | | | |
|---|---|---|---|---|---|---|---|
| SEQ ID NO 17660 | TGTTTCAAACAAACAAGCAA | AAG | chr12 | 21600124 | 21600143 | 21600127 | - |
| SEQ ID NO 17661 | AACAAACAAGCAAAAGCAAA | AAG | chr12 | 21600117 | 21600136 | 21600120 | - |
| SEQ ID NO 17662 | ACTTACTATCTTGCTGTCTA | CAG | chr12 | 21600066 | 21600085 | 21600069 | - |
| SEQ ID NO 17663 | TATCTTGCTGTCTACAGCTA | AAG | chr12 | 21600060 | 21600079 | 21600063 | - |
| SEQ ID NO 17664 | TTGCTGTCTACAGCTAAAGT | CAG | chr12 | 21600056 | 21600075 | 21600059 | - |
| SEQ ID NO 17665 | TAAAGTCAGACTGCATGATT | TGG | chr12 | 21600042 | 21600061 | 21600045 | - |
| SEQ ID NO 17666 | ATTCCAACTCCACCATCACC | TGG | chr12 | 21600018 | 21600037 | 21600021 | - |
| SEQ ID NO 17667 | TTCCAACTCCACCATCACCT | GGG | chr12 | 21600017 | 21600036 | 21600020 | - |
| SEQ ID NO 17668 | ACCATCACCTGGGTAATGTT | GAG | chr12 | 21600007 | 21600026 | 21600010 | - |
| SEQ ID NO 17669 | TAATGTTGAGATTTATTACA | TAG | chr12 | 21599994 | 21600013 | 21599997 | - |
| SEQ ID NO 17670 | TACATAGCATCTCTGTGCCT | CAG | chr12 | 21599978 | 21599997 | 21599981 | - |
| SEQ ID NO 17671 | AATAATGTTGTGAAAATTAA | AAG | chr12 | 21599929 | 21599948 | 21599932 | - |
| SEQ ID NO 17672 | GTGAAAATTAAAAGAAATAC | CAG | chr12 | 21599920 | 21599939 | 21599923 | - |
| SEQ ID NO 17673 | AATACCAGTTGTAAATCACT | CAG | chr12 | 21599905 | 21599924 | 21599908 | - |
| SEQ ID NO 17674 | AAATCACTCAGAACTGTGCC | TAG | chr12 | 21599893 | 21599912 | 21599896 | - |
| SEQ ID NO 17675 | AGCATTTAATAAACACTCTG | TAG | chr12 | 21599872 | 21599891 | 21599875 | - |
| SEQ ID NO 17676 | GCATTTAATAAACACTCTGT | AGG | chr12 | 21599871 | 21599890 | 21599874 | - |
| SEQ ID NO 17677 | AATAAACACTCTGTAGGTAT | TAG | chr12 | 21599865 | 21599884 | 21599868 | - |
| SEQ ID NO 17678 | ATAAAATTTATTCATAAAAT | GAG | chr12 | 21599831 | 21599850 | 21599834 | - |
| SEQ ID NO 17679 | TAAAATTTATTCATAAAATG | AGG | chr12 | 21599830 | 21599849 | 21599833 | - |
| SEQ ID NO 17680 | AATTTATTCATAAAATGAGG | AAG | chr12 | 21599827 | 21599846 | 21599830 | - |
| SEQ ID NO 17681 | TATTCATAAAATGAGGAAGT | TAG | chr12 | 21599823 | 21599842 | 21599826 | - |
| SEQ ID NO 17682 | TAGCTCATGTATTGTCATAC | CAG | chr12 | 21599803 | 21599822 | 21599806 | - |
| SEQ ID NO 17683 | TACCAGCTTTCACTTTGAAT | GAG | chr12 | 21599786 | 21599805 | 21599789 | - |
| SEQ ID NO 17684 | ATTGCATTTTTAAACACAAA | AAG | chr12 | 21599757 | 21599776 | 21599760 | - |
| SEQ ID NO 17685 | TGCATTTTTAAACACAAAAA | GAG | chr12 | 21599755 | 21599774 | 21599758 | - |
| SEQ ID NO 17686 | AAACACAAAAGAGAAATAA | TAG | chr12 | 21599746 | 21599765 | 21599749 | - |
| SEQ ID NO 17687 | AACACAAAAGAGAAATAAT | AGG | chr12 | 21599745 | 21599764 | 21599748 | - |
| SEQ ID NO 17688 | CATCAATGTTACTTCAATCA | CGG | chr12 | 21599708 | 21599727 | 21599711 | - |
| SEQ ID NO 17689 | ATCAATGTTACTTCAATCAC | GGG | chr12 | 21599707 | 21599726 | 21599710 | - |
| SEQ ID NO 17690 | TACTTCAATCACGGGATGCA | TAG | chr12 | 21599699 | 21599718 | 21599702 | - |
| SEQ ID NO 17691 | ATCACGGGATGCATAGTAAT | TAG | chr12 | 21599692 | 21599711 | 21599695 | - |
| SEQ ID NO 17692 | TCACGGGATGCATAGTAATT | AGG | chr12 | 21599691 | 21599710 | 21599694 | - |
| SEQ ID NO 17693 | CTTTGCCCTAATTACTGATG | TGG | chr12 | 21599664 | 21599683 | 21599667 | - |
| SEQ ID NO 17694 | CCCTAATTACTGATGTGGAT | AAG | chr12 | 21599659 | 21599678 | 21599662 | - |
| SEQ ID NO 17695 | AATTACTGATGTGGATAAGC | CGG | chr12 | 21599655 | 21599674 | 21599658 | - |
| SEQ ID NO 17696 | TACTGATGTGGATAAGCCGG | TGG | chr12 | 21599652 | 21599671 | 21599655 | - |
| SEQ ID NO 17697 | ACTGATGTGGATAAGCCGGT | GGG | chr12 | 21599651 | 21599670 | 21599654 | - |
| SEQ ID NO 17698 | AAGCCGGTGGGCCATGTCAA | TGG | chr12 | 21599639 | 21599658 | 21599642 | - |
| SEQ ID NO 17699 | GGCCATGTCAATGGCATCTC | AAG | chr12 | 21599630 | 21599649 | 21599633 | - |
| SEQ ID NO 17700 | ATCTATGTAAAACTATGCT | TGG | chr12 | 21599580 | 21599599 | 21599583 | - |
| SEQ ID NO 17701 | AAAAACTATGCTTGGTTGCA | CAG | chr12 | 21599572 | 21599591 | 21599575 | - |
| SEQ ID NO 17702 | ATGCTTGGTTGCACAGCTTC | AAG | chr12 | 21599565 | 21599584 | 21599568 | - |
| SEQ ID NO 17703 | TGCTTGGTTGCACAGCTTCA | AGG | chr12 | 21599564 | 21599583 | 21599567 | - |
| SEQ ID NO 17704 | TGGTTGCACAGCTTCAAGGA | AAG | chr12 | 21599560 | 21599579 | 21599563 | - |
| SEQ ID NO 17705 | CACAGCTTCAAGGAAAGCAC | TAG | chr12 | 21599554 | 21599573 | 21599557 | - |
| SEQ ID NO 17706 | CTACTCACTTCCTTTTCATT | CAG | chr12 | 21599530 | 21599549 | 21599533 | - |

Figure 43 (Cont'd)

| SEQ ID NO 17707 | TTCATTCAGCATGCTATGTC | TAG | chr12 | 21599516 | 21599535 | 21599519 | - |
| --- | --- | --- | --- | --- | --- | --- | --- |
| SEQ ID NO 17708 | TCATTCAGCATGCTATGTCT | AGG | chr12 | 21599515 | 21599534 | 21599518 | - |
| SEQ ID NO 17709 | CCCCTTTCATATAAAATATT | TGG | chr12 | 21599492 | 21599511 | 21599495 | - |
| SEQ ID NO 17710 | CCTTTCATATAAAATATTTG | GAG | chr12 | 21599490 | 21599509 | 21599493 | - |
| SEQ ID NO 17711 | AATATTTGGAGCTGCCATTG | TAG | chr12 | 21599478 | 21599497 | 21599481 | - |
| SEQ ID NO 17712 | ATATTTGGAGCTGCCATTGT | AGG | chr12 | 21599477 | 21599496 | 21599480 | - |
| SEQ ID NO 17713 | TTTGGAGCTGCCATTGTAGG | TAG | chr12 | 21599474 | 21599493 | 21599477 | - |
| SEQ ID NO 17714 | AGCTGCCATTGTAGGTAGTG | CAG | chr12 | 21599469 | 21599488 | 21599472 | - |
| SEQ ID NO 17715 | GCTGCCATTGTAGGTAGTGC | AGG | chr12 | 21599468 | 21599487 | 21599471 | - |
| SEQ ID NO 17716 | GCCATTGTAGGTAGTGCAGG | TGG | chr12 | 21599465 | 21599484 | 21599468 | - |
| SEQ ID NO 17717 | AGTGCAGGTGGTCTTGTTCA | AAG | chr12 | 21599453 | 21599472 | 21599456 | - |
| SEQ ID NO 17718 | GGTGGTCTTGTTCAAAGTGT | GAG | chr12 | 21599447 | 21599466 | 21599450 | - |
| SEQ ID NO 17719 | GAGTATCACCTCCCACTGCC | AAG | chr12 | 21599427 | 21599446 | 21599430 | - |
| SEQ ID NO 17720 | ACCTCCCACTGCCAAGACTG | CAG | chr12 | 21599420 | 21599439 | 21599423 | - |
| SEQ ID NO 17721 | CAGCTGCTTTGATTTTAACT | GAG | chr12 | 21599400 | 21599419 | 21599403 | - |
| SEQ ID NO 17722 | AGCTGCTTTGATTTTAACTG | AGG | chr12 | 21599399 | 21599418 | 21599402 | - |
| SEQ ID NO 17723 | TTTGATTTTAACTGAGGATC | TAG | chr12 | 21599393 | 21599412 | 21599396 | - |
| SEQ ID NO 17724 | TTTTAACTGAGGATCTAGAA | AAG | chr12 | 21599388 | 21599407 | 21599391 | - |
| SEQ ID NO 17725 | CTGAGGATCTAGAAAAGTGC | TGG | chr12 | 21599382 | 21599401 | 21599385 | - |
| SEQ ID NO 17726 | TGAGGATCTAGAAAAGTGCT | GGG | chr12 | 21599381 | 21599400 | 21599384 | - |
| SEQ ID NO 17727 | TATTTGCTGACCTTTGTCAC | AAG | chr12 | 21599350 | 21599369 | 21599353 | - |
| SEQ ID NO 17728 | TTGCTGACCTTTGTCACAAG | TAG | chr12 | 21599347 | 21599366 | 21599350 | - |
| SEQ ID NO 17729 | GCACCTAATCTCCTTCCTAC | CAG | chr12 | 21599325 | 21599344 | 21599328 | - |
| SEQ ID NO 17730 | GCCTTATAAAATGATGTTCT | AAG | chr12 | 21599295 | 21599314 | 21599298 | - |
| SEQ ID NO 17731 | CTGCTTCTGCAACTGTGTTT | TGG | chr12 | 21599256 | 21599275 | 21599259 | - |
| SEQ ID NO 17732 | TCTGCAACTGTGTTTTGGAA | CAG | chr12 | 21599251 | 21599270 | 21599254 | - |
| SEQ ID NO 17733 | CTGCAACTGTGTTTTGGAAC | AGG | chr12 | 21599250 | 21599269 | 21599253 | - |
| SEQ ID NO 17734 | GCAACTGTGTTTTGGAACAG | GAG | chr12 | 21599248 | 21599267 | 21599251 | - |
| SEQ ID NO 17735 | CAACTGTGTTTTGGAACAGG | AGG | chr12 | 21599247 | 21599266 | 21599250 | - |
| SEQ ID NO 17736 | AACTGTGTTTTGGAACAGGA | GGG | chr12 | 21599246 | 21599265 | 21599249 | - |
| SEQ ID NO 17737 | GTGTTTTGGAACAGGAGGGT | GAG | chr12 | 21599242 | 21599261 | 21599245 | - |
| SEQ ID NO 17738 | TTGGAACAGGAGGGTGAGAT | TAG | chr12 | 21599237 | 21599256 | 21599240 | - |
| SEQ ID NO 17739 | GAACAGGAGGGTGAGATTAG | TAG | chr12 | 21599234 | 21599253 | 21599237 | - |
| SEQ ID NO 17740 | AGTAGCCACACACACTGAAA | TAG | chr12 | 21599216 | 21599235 | 21599219 | - |
| SEQ ID NO 17741 | AAATAGTCATATGACTTCCA | AAG | chr12 | 21599199 | 21599218 | 21599202 | - |
| SEQ ID NO 17742 | TTCCAAAGTCTGTAATTTTT | AAG | chr12 | 21599184 | 21599203 | 21599187 | - |
| SEQ ID NO 17743 | ATTTTTAAGCATATACAAAA | TAG | chr12 | 21599170 | 21599189 | 21599173 | - |
| SEQ ID NO 17744 | TATGTGTGTATACATATATA | TAG | chr12 | 21599115 | 21599134 | 21599118 | - |
| SEQ ID NO 17745 | TGTGTGTATACATATATATA | GAG | chr12 | 21599113 | 21599132 | 21599116 | - |
| SEQ ID NO 17746 | TGTGTATACATATATATAGA | GAG | chr12 | 21599111 | 21599130 | 21599114 | - |
| SEQ ID NO 17747 | TGTATACATATATATAGAGA | GAG | chr12 | 21599109 | 21599128 | 21599112 | - |
| SEQ ID NO 17748 | TATACATATATATAGAGAGA | GAG | chr12 | 21599107 | 21599126 | 21599110 | - |
| SEQ ID NO 17749 | CATATATAGAGAGAGAGAGA | CAG | chr12 | 21599103 | 21599122 | 21599106 | - |
| SEQ ID NO 17750 | TATATAGAGAGAGAGAGACA | GAG | chr12 | 21599101 | 21599120 | 21599104 | - |
| SEQ ID NO 17751 | TATATAGAGAGAGAGACAGA | GAG | chr12 | 21599099 | 21599118 | 21599102 | - |
| SEQ ID NO 17752 | TATAGAGAGAGAGACAGAGA | GAG | chr12 | 21599097 | 21599116 | 21599100 | - |
| SEQ ID NO 17753 | GAGAGAGAGACAGAGAGAGA | TGG | chr12 | 21599093 | 21599112 | 21599096 | - |

Figure 43 (Cont'd)

| | | | | | | | |
|---|---|---|---|---|---|---|---|
| SEQ ID NO 17754 | AGAGAGAGACAGAGAGAGAT | GGG | chr12 | 21599092 | 21599111 | 21599095 | - |
| SEQ ID NO 17755 | GAGAGAGACAGAGAGAGATG | GGG | chr12 | 21599091 | 21599110 | 21599094 | - |
| SEQ ID NO 17756 | AGAGAGACAGAGAGAGATGG | GGG | chr12 | 21599090 | 21599109 | 21599093 | - |
| SEQ ID NO 17757 | AGAGACAGAGAGAGATGGGG | GAG | chr12 | 21599088 | 21599107 | 21599091 | - |
| SEQ ID NO 17758 | AGACAGAGAGAGATGGGGGA | GAG | chr12 | 21599086 | 21599105 | 21599089 | - |
| SEQ ID NO 17759 | ACAGAGAGAGATGGGGGAGA | GAG | chr12 | 21599084 | 21599103 | 21599087 | - |
| SEQ ID NO 17760 | AGAGAGAGATGGGGGAGAGA | GAG | chr12 | 21599082 | 21599101 | 21599085 | - |
| SEQ ID NO 17761 | AGAGAGATGGGGGAGAGAGA | GAG | chr12 | 21599080 | 21599099 | 21599083 | - |
| SEQ ID NO 17762 | AGAGATGGGGGAGAGAGAGA | GAG | chr12 | 21599078 | 21599097 | 21599081 | - |
| SEQ ID NO 17763 | AGATGGGGGAGAGAGAGAGA | GAG | chr12 | 21599076 | 21599095 | 21599079 | - |
| SEQ ID NO 17764 | ATGGGGGAGAGAGAGAGAGA | GAG | chr12 | 21599074 | 21599093 | 21599077 | - |
| SEQ ID NO 17765 | GGGAGAGAGAGAGAGAGAGC | GAG | chr12 | 21599070 | 21599089 | 21599073 | - |
| SEQ ID NO 17766 | GAGAGAGAGAGAGAGAGCGA | GAG | chr12 | 21599068 | 21599087 | 21599071 | - |
| SEQ ID NO 17767 | GAGAGAGAGAGAGAGCGAGA | GAG | chr12 | 21599066 | 21599085 | 21599069 | - |
| SEQ ID NO 17768 | GAGAGAGAGAGAGCGAGAGA | GAG | chr12 | 21599064 | 21599083 | 21599067 | - |
| SEQ ID NO 17769 | AGAGAGAGAGAGCGAGAGAG | AGG | chr12 | 21599063 | 21599082 | 21599066 | - |
| SEQ ID NO 17770 | GAGAGAGCGAGAGAGAGAGG | CAG | chr12 | 21599060 | 21599079 | 21599063 | - |
| SEQ ID NO 17771 | GAGAGAGCGAGAGAGAGGCA | GAG | chr12 | 21599058 | 21599077 | 21599061 | - |
| SEQ ID NO 17772 | GAGCGAGAGAGAGGCAGAGA | AAG | chr12 | 21599054 | 21599073 | 21599057 | - |
| SEQ ID NO 17773 | GCGAGAGAGAGGCAGAGAAA | GAG | chr12 | 21599052 | 21599071 | 21599055 | - |
| SEQ ID NO 17774 | AGAGAAAGAGATCCTTATTT | TGG | chr12 | 21599039 | 21599058 | 21599042 | - |
| SEQ ID NO 17775 | TATTCTATACTTCTTTGAAA | TAG | chr12 | 21599008 | 21599027 | 21599011 | - |
| SEQ ID NO 17776 | TTCTTTGAAATAGTGATTTT | TAG | chr12 | 21598998 | 21599017 | 21599001 | - |
| SEQ ID NO 17777 | AATAGTGATTTTTAGTAAAT | TGG | chr12 | 21598990 | 21599009 | 21598993 | - |
| SEQ ID NO 17778 | AGTGATTTTTAGTAAATTGG | CAG | chr12 | 21598987 | 21599006 | 21598990 | - |
| SEQ ID NO 17779 | TAGTAAATTGGCAGTGTTGC | CAG | chr12 | 21598978 | 21598997 | 21598981 | - |
| SEQ ID NO 17780 | AGTGTTGCCAGATGACGACT | TAG | chr12 | 21598966 | 21598985 | 21598969 | - |
| SEQ ID NO 17781 | TGTTGCCAGATGACGACTTA | GAG | chr12 | 21598964 | 21598983 | 21598967 | - |
| SEQ ID NO 17782 | CCTCATTGTTATATGTACCA | TGG | chr12 | 21598932 | 21598951 | 21598935 | - |
| SEQ ID NO 17783 | CATTGTTATATGTACCATGG | TAG | chr12 | 21598929 | 21598948 | 21598932 | - |
| SEQ ID NO 17784 | TGGTAGCTCATCTTTTCTTT | CAG | chr12 | 21598912 | 21598931 | 21598915 | - |
| SEQ ID NO 17785 | GGTAGCTCATCTTTTCTTTC | AGG | chr12 | 21598911 | 21598930 | 21598914 | - |
| SEQ ID NO 17786 | TCATCTTTTCTTTCAGGTGA | AAG | chr12 | 21598905 | 21598924 | 21598908 | - |
| SEQ ID NO 17787 | CTTTGTCCTCACGCTAAACA | TAG | chr12 | 21598874 | 21598893 | 21598877 | - |
| SEQ ID NO 17788 | ACATAGCCCCATGTTGTTC | CAG | chr12 | 21598857 | 21598876 | 21598860 | - |
| SEQ ID NO 17789 | CATAGCCCCATGTTGTTCC | AGG | chr12 | 21598856 | 21598875 | 21598859 | - |
| SEQ ID NO 17790 | CCCATGTTGTTCCAGGAAAA | TAG | chr12 | 21598849 | 21598868 | 21598852 | - |
| SEQ ID NO 17791 | CATGTTGTTCCAGGAAAATA | GAG | chr12 | 21598847 | 21598866 | 21598850 | - |
| SEQ ID NO 17792 | ATAGAGATCAATAAAATACA | AAG | chr12 | 21598830 | 21598849 | 21598833 | - |
| SEQ ID NO 17793 | AATACAAAGTACTTGTTTGA | AAG | chr12 | 21598816 | 21598835 | 21598819 | - |
| SEQ ID NO 17794 | AAAGTACTTGTTTGAAAGTG | AAG | chr12 | 21598811 | 21598830 | 21598814 | - |
| SEQ ID NO 17795 | AAGTACTTGTTTGAAAGTGA | AGG | chr12 | 21598810 | 21598829 | 21598813 | - |
| SEQ ID NO 17796 | CTTGTTTGAAAGTGAAGGTT | AAG | chr12 | 21598805 | 21598824 | 21598808 | - |
| SEQ ID NO 17797 | AAATTCAATGACCTACGCTG | TGG | chr12 | 21598779 | 21598798 | 21598782 | - |
| SEQ ID NO 17798 | GATCATTCATTAATGATATT | AAG | chr12 | 21598750 | 21598769 | 21598753 | - |
| SEQ ID NO 17799 | AGTATTTTCTTTTTTAATGT | CAG | chr12 | 21598729 | 21598748 | 21598732 | - |
| SEQ ID NO 17800 | AGAATAAAACCATTTATTTG | CAG | chr12 | 21598708 | 21598727 | 21598711 | - |

Figure 43 (Cont'd)

| | | | | | | | |
|---|---|---|---|---|---|---|---|
| SEQ ID NO 17801 | TATGTGTATGTAAATCTCCT | TGG | chr12 | 21598672 | 21598691 | 21598675 | - |
| SEQ ID NO 17802 | TTATACCTCAAATATGAAAA | TAG | chr12 | 21598648 | 21598667 | 21598651 | - |
| SEQ ID NO 17803 | TATACCTCAAATATGAAAAT | AGG | chr12 | 21598647 | 21598666 | 21598650 | - |
| SEQ ID NO 17804 | TCTTGCATTCACTTATATTC | TAG | chr12 | 21598605 | 21598624 | 21598608 | - |
| SEQ ID NO 17805 | CACTTATATTCTAGCTTGTT | AAG | chr12 | 21598596 | 21598615 | 21598599 | - |
| SEQ ID NO 17806 | CTTATATTCTAGCTTGTTAA | GAG | chr12 | 21598594 | 21598613 | 21598597 | - |
| SEQ ID NO 17807 | TATATTCTAGCTTGTTAAGA | GAG | chr12 | 21598592 | 21598611 | 21598595 | - |
| SEQ ID NO 17808 | ATTCTAGCTTGTTAAGAGAG | AAG | chr12 | 21598589 | 21598608 | 21598592 | - |
| SEQ ID NO 17809 | AGCTTGTTAAGAGAGAAGTT | TGG | chr12 | 21598584 | 21598603 | 21598587 | - |
| SEQ ID NO 17810 | GCTTGTTAAGAGAGAAGTTT | GGG | chr12 | 21598583 | 21598602 | 21598586 | - |
| SEQ ID NO 17811 | CTTGTTAAGAGAGAAGTTTG | GGG | chr12 | 21598582 | 21598601 | 21598585 | - |
| SEQ ID NO 17812 | GGCAAAATGTGCTTTATAAA | TAG | chr12 | 21598561 | 21598580 | 21598564 | - |
| SEQ ID NO 17813 | CTTTATAAATAGTAAAAACT | GAG | chr12 | 21598550 | 21598569 | 21598553 | - |
| SEQ ID NO 17814 | TTTATAAATAGTAAAAACTG | AGG | chr12 | 21598549 | 21598568 | 21598552 | - |
| SEQ ID NO 17815 | GTAAAAACTGAGGTAAACTA | TAG | chr12 | 21598539 | 21598558 | 21598542 | - |
| SEQ ID NO 17816 | CTGAGGTAAACTATAGCACA | AAG | chr12 | 21598532 | 21598551 | 21598535 | - |
| SEQ ID NO 17817 | CACAAAGTGTGCTATATAAA | CAG | chr12 | 21598516 | 21598535 | 21598519 | - |
| SEQ ID NO 17818 | CTATATAAACAGTAAAAACC | GAG | chr12 | 21598505 | 21598524 | 21598508 | - |
| SEQ ID NO 17819 | TATATAAACAGTAAAAACCG | AGG | chr12 | 21598504 | 21598523 | 21598507 | - |
| SEQ ID NO 17820 | TAAAAACCGAGGTAAAAATA | TGG | chr12 | 21598493 | 21598512 | 21598496 | - |
| SEQ ID NO 17821 | AAAAACCGAGGTAAAAATAT | GGG | chr12 | 21598492 | 21598511 | 21598495 | - |
| SEQ ID NO 17822 | AAAACCGAGGTAAAAATATG | GGG | chr12 | 21598491 | 21598510 | 21598494 | - |
| SEQ ID NO 17823 | AACCGAGGTAAAAATATGGG | GAG | chr12 | 21598489 | 21598508 | 21598492 | - |
| SEQ ID NO 17824 | ACCGAGGTAAAAATATGGGG | AGG | chr12 | 21598488 | 21598507 | 21598491 | - |
| SEQ ID NO 17825 | AAAATATGGGGAGGACAAAA | AAG | chr12 | 21598479 | 21598498 | 21598482 | - |
| SEQ ID NO 17826 | AAATATGGGGAGGACAAAAA | AGG | chr12 | 21598478 | 21598497 | 21598481 | - |
| SEQ ID NO 17827 | AATATGGGGAGGACAAAAAA | GGG | chr12 | 21598477 | 21598496 | 21598480 | - |
| SEQ ID NO 17828 | AGGACAAAAAAGGGCTAAAA | TGG | chr12 | 21598468 | 21598487 | 21598471 | - |
| SEQ ID NO 17829 | AAAAAGGGCTAAAATGGTGT | TGG | chr12 | 21598462 | 21598481 | 21598465 | - |
| SEQ ID NO 17830 | CTAAAATGGTGTTGGAATAT | AAG | chr12 | 21598454 | 21598473 | 21598457 | - |
| SEQ ID NO 17831 | TGGTGTTGGAATATAAGAAA | TAG | chr12 | 21598448 | 21598467 | 21598451 | - |
| SEQ ID NO 17832 | TGTTGGAATATAAGAAATAG | CAG | chr12 | 21598445 | 21598464 | 21598448 | - |
| SEQ ID NO 17833 | AATATAAGAAATAGCAGTAA | AAG | chr12 | 21598439 | 21598458 | 21598442 | - |
| SEQ ID NO 17834 | ATAAGAAATAGCAGTAAAAG | AAG | chr12 | 21598436 | 21598455 | 21598439 | - |
| SEQ ID NO 17835 | GCAGTAAAAGAAGCTCCTCA | CAG | chr12 | 21598426 | 21598445 | 21598429 | - |
| SEQ ID NO 17836 | TAAAAGAAGCTCCTCACAGC | AAG | chr12 | 21598422 | 21598441 | 21598425 | - |
| SEQ ID NO 17837 | AGAAGCTCCTCACAGCAAGA | CAG | chr12 | 21598418 | 21598437 | 21598421 | - |
| SEQ ID NO 17838 | CTCCTCACAGCAAGACAGTA | CAG | chr12 | 21598413 | 21598432 | 21598416 | - |
| SEQ ID NO 17839 | TCCTCACAGCAAGACAGTAC | AGG | chr12 | 21598412 | 21598431 | 21598415 | - |
| SEQ ID NO 17840 | CCTCACAGCAAGACAGTACA | GGG | chr12 | 21598411 | 21598430 | 21598414 | - |
| SEQ ID NO 17841 | AGACAGTACAGGGAAATGTC | TGG | chr12 | 21598401 | 21598420 | 21598404 | - |
| SEQ ID NO 17842 | ACAGTACAGGGAAATGTCTG | GAG | chr12 | 21598399 | 21598418 | 21598402 | - |
| SEQ ID NO 17843 | CAGTACAGGGAAATGTCTGG | AGG | chr12 | 21598398 | 21598417 | 21598401 | - |
| SEQ ID NO 17844 | AGTACAGGGAAATGTCTGGA | GGG | chr12 | 21598397 | 21598416 | 21598400 | - |
| SEQ ID NO 17845 | GGGAAATGTCTGGAGGGACA | AAG | chr12 | 21598391 | 21598410 | 21598394 | - |
| SEQ ID NO 17846 | GACAAAGATTTACTTACAAT | CAG | chr12 | 21598375 | 21598394 | 21598378 | - |
| SEQ ID NO 17847 | ACAAAGATTTACTTACAATC | AGG | chr12 | 21598374 | 21598393 | 21598377 | - |

Figure 43 (Cont'd)

| | | | | | | | |
|---|---|---|---|---|---|---|---|
| SEQ ID NO 17848 | AATCAGGCCTCAACCAATAT | GAG | chr12 | 21598358 | 21598377 | 21598361 | - |
| SEQ ID NO 17849 | TATGACGTGTTTATATGTAT | CAG | chr12 | 21598314 | 21598333 | 21598317 | - |
| SEQ ID NO 17850 | ATGACGTGTTTATATGTATC | AGG | chr12 | 21598313 | 21598332 | 21598316 | - |
| SEQ ID NO 17851 | GCATATAATGTATAATGATC | AAG | chr12 | 21598268 | 21598287 | 21598271 | - |
| SEQ ID NO 17852 | ATAATGTATAATGATCAAGT | CAG | chr12 | 21598264 | 21598283 | 21598267 | - |
| SEQ ID NO 17853 | TAATGTATAATGATCAAGTC | AGG | chr12 | 21598263 | 21598282 | 21598266 | - |
| SEQ ID NO 17854 | TAATGATCAAGTCAGGTATT | TGG | chr12 | 21598256 | 21598275 | 21598259 | - |
| SEQ ID NO 17855 | AATGATCAAGTCAGGTATTT | GGG | chr12 | 21598255 | 21598274 | 21598258 | - |
| SEQ ID NO 17856 | ATGATCAAGTCAGGTATTTG | GGG | chr12 | 21598254 | 21598273 | 21598257 | - |
| SEQ ID NO 17857 | TTTGGGGTATTCATCACCTC | AAG | chr12 | 21598238 | 21598257 | 21598241 | - |
| SEQ ID NO 17858 | TATTTATCGTTTCTATGTGT | TAG | chr12 | 21598215 | 21598234 | 21598218 | - |
| SEQ ID NO 17859 | ATTTATCGTTTCTATGTGTT | AGG | chr12 | 21598214 | 21598233 | 21598217 | - |
| SEQ ID NO 17860 | CTATGTGTTAGGAACATTTC | AAG | chr12 | 21598203 | 21598222 | 21598206 | - |
| SEQ ID NO 17861 | CCTACTTGCTATTGAACAT | CAG | chr12 | 21598126 | 21598145 | 21598129 | - |
| SEQ ID NO 17862 | TACACACCTTTCTCTACCTC | TGG | chr12 | 21598032 | 21598051 | 21598035 | - |
| SEQ ID NO 17863 | CTACATGATATTAACTTTTT | TAG | chr12 | 21597987 | 21598006 | 21597990 | - |
| SEQ ID NO 17864 | CTTTTTTAGCTCCCACATAT | CAG | chr12 | 21597973 | 21597992 | 21597976 | - |
| SEQ ID NO 17865 | TTTAGCTCCCACATATCAGT | GAG | chr12 | 21597969 | 21597988 | 21597972 | - |
| SEQ ID NO 17866 | AAAATTTGTCTTTCTATGCC | TGG | chr12 | 21597939 | 21597958 | 21597942 | - |
| SEQ ID NO 17867 | TCGTTTAACATAATGACTTC | CAG | chr12 | 21597910 | 21597929 | 21597913 | - |
| SEQ ID NO 17868 | GAAATGATTTTATATTTGTA | TGG | chr12 | 21597865 | 21597884 | 21597868 | - |
| SEQ ID NO 17869 | TTTCTTCATTCATCCATTGA | TGG | chr12 | 21597808 | 21597827 | 21597811 | - |
| SEQ ID NO 17870 | TTCATCCATTGATGGACACT | TAG | chr12 | 21597800 | 21597819 | 21597803 | - |
| SEQ ID NO 17871 | TCATCCATTGATGGACACTT | AGG | chr12 | 21597799 | 21597818 | 21597802 | - |
| SEQ ID NO 17872 | GTGAATCGTGCTGCAATAAA | CAG | chr12 | 21597754 | 21597773 | 21597757 | - |
| SEQ ID NO 17873 | TCGTGCTGCAATAAACAGTG | TGG | chr12 | 21597749 | 21597768 | 21597752 | - |
| SEQ ID NO 17874 | TGCAATAAACAGTGTGGTAC | CAG | chr12 | 21597743 | 21597762 | 21597746 | - |
| SEQ ID NO 17875 | TATTCTGAATTCTTTTCCTT | TGG | chr12 | 21597709 | 21597728 | 21597712 | - |
| SEQ ID NO 17876 | TTTTCCTTTGGATAAATACC | CAG | chr12 | 21597697 | 21597716 | 21597700 | - |
| SEQ ID NO 17877 | TTGGATAAATACCCAGTAAT | AAG | chr12 | 21597690 | 21597709 | 21597693 | - |
| SEQ ID NO 17878 | ATACCCAGTAATAAGATTGC | TGG | chr12 | 21597682 | 21597701 | 21597685 | - |
| SEQ ID NO 17879 | AAGATTGCTGGATCTTATGA | TAG | chr12 | 21597670 | 21597689 | 21597673 | - |
| SEQ ID NO 17880 | TCTTATGATAGTTCAATTTT | TAG | chr12 | 21597658 | 21597677 | 21597661 | - |
| SEQ ID NO 17881 | TAGTTCAATTTTTAGCTTTT | TGG | chr12 | 21597650 | 21597669 | 21597653 | - |
| SEQ ID NO 17882 | AATCTACATATTGTTTTCCA | TAG | chr12 | 21597625 | 21597644 | 21597628 | - |
| SEQ ID NO 17883 | CTACATATTGTTTTCCATAG | TGG | chr12 | 21597622 | 21597641 | 21597625 | - |
| SEQ ID NO 17884 | CTAATTTGCATGCTTACCAA | TAG | chr12 | 21597594 | 21597613 | 21597597 | - |
| SEQ ID NO 17885 | TGCTTACCAATAGTGCCTAC | GAG | chr12 | 21597584 | 21597603 | 21597587 | - |
| SEQ ID NO 17886 | CTTTTCCTTCACATCCTTGC | CAG | chr12 | 21597558 | 21597577 | 21597561 | - |
| SEQ ID NO 17887 | TAAATCATGATGATTCTAAC | TGG | chr12 | 21597508 | 21597527 | 21597511 | - |
| SEQ ID NO 17888 | ATGATGATTCTAACTGGCAT | AAG | chr12 | 21597502 | 21597521 | 21597505 | - |
| SEQ ID NO 17889 | CATAAGATGATATCTCATTG | TGG | chr12 | 21597485 | 21597504 | 21597488 | - |
| SEQ ID NO 17890 | ATTTGCATTTCTCTGATGAT | TAG | chr12 | 21597457 | 21597476 | 21597460 | - |
| SEQ ID NO 17891 | CTCTGATGATTAGTAATGTT | GAG | chr12 | 21597447 | 21597466 | 21597450 | - |
| SEQ ID NO 17892 | TCCTTGCCAATTTTTTAAT | GAG | chr12 | 21597375 | 21597394 | 21597378 | - |
| SEQ ID NO 17893 | TTATTTGTTTTTCCACTGTT | GAG | chr12 | 21597351 | 21597370 | 21597354 | - |
| SEQ ID NO 17894 | TTTCCACTGTTGAGTTGTTT | GAG | chr12 | 21597342 | 21597361 | 21597345 | - |

Figure 43 (Cont'd)

| SEQ ID NO 17895 | TTTGAGTTTCTTATATATTC | TGG | chr12 | 21597325 | 21597344 | 21597328 | - |
| SEQ ID NO 17896 | TGAGTTTCTTATATATTCTG | GAG | chr12 | 21597323 | 21597342 | 21597326 | - |
| SEQ ID NO 17897 | AAATATTTTCTCGCATTCAA | CAG | chr12 | 21597276 | 21597295 | 21597279 | - |
| SEQ ID NO 17898 | TGATTGTTTCCTTTACTGTG | CAG | chr12 | 21597235 | 21597254 | 21597238 | - |
| SEQ ID NO 17899 | TTTACTGTGCAGATGTATTT | TAG | chr12 | 21597224 | 21597243 | 21597227 | - |
| SEQ ID NO 17900 | AGATGTATTTAGCTTAATA | TAG | chr12 | 21597214 | 21597233 | 21597217 | - |
| SEQ ID NO 17901 | CTTTTGTTGCCTGTGCTTTT | GAG | chr12 | 21597172 | 21597191 | 21597175 | - |
| SEQ ID NO 17902 | TTTTGTTGCCTGTGCTTTTG | AGG | chr12 | 21597171 | 21597190 | 21597174 | - |
| SEQ ID NO 17903 | TGCCTGTGCTTTTGAGGTCT | TGG | chr12 | 21597165 | 21597184 | 21597168 | - |
| SEQ ID NO 17904 | GGCCATAAAATCTTTGCCCA | AAG | chr12 | 21597144 | 21597163 | 21597147 | - |
| SEQ ID NO 17905 | TTGCCCAAAGCCATGTCTTG | AAG | chr12 | 21597131 | 21597150 | 21597134 | - |
| SEQ ID NO 17906 | GTCTCCCTTATGTTTTCTTT | TAG | chr12 | 21597107 | 21597126 | 21597110 | - |
| SEQ ID NO 17907 | TCCCTTATGTTTTCTTTTAG | TAG | chr12 | 21597104 | 21597123 | 21597107 | - |
| SEQ ID NO 17908 | GTTTTCTTTAGTAGTTTTA | TAG | chr12 | 21597096 | 21597115 | 21597099 | - |
| SEQ ID NO 17909 | TTTAGTAGTTTTATAGTTTT | AAG | chr12 | 21597089 | 21597108 | 21597092 | - |
| SEQ ID NO 17910 | TAGTTTTAAGTTTTATATTT | AAG | chr12 | 21597076 | 21597095 | 21597079 | - |
| SEQ ID NO 17911 | TTAAGTCTTTAATCCATCTT | GAG | chr12 | 21597058 | 21597077 | 21597061 | - |
| SEQ ID NO 17912 | AAGTCTTTAATCCATCTTGA | GAG | chr12 | 21597056 | 21597075 | 21597059 | - |
| SEQ ID NO 17913 | TCTTGAGAGTACGTTTTATA | TGG | chr12 | 21597042 | 21597061 | 21597045 | - |
| SEQ ID NO 17914 | ACGTTTTATATGGCAATAAA | TAG | chr12 | 21597032 | 21597051 | 21597035 | - |
| SEQ ID NO 17915 | CGTTTTATATGGCAATAAAT | AGG | chr12 | 21597031 | 21597050 | 21597034 | - |
| SEQ ID NO 17916 | GTTTTATATGGCAATAAATA | GGG | chr12 | 21597030 | 21597049 | 21597033 | - |
| SEQ ID NO 17917 | TTTTATATGGCAATAAATAG | GGG | chr12 | 21597029 | 21597048 | 21597032 | - |
| SEQ ID NO 17918 | GCAATAAATAGGGGTTGTAT | TAG | chr12 | 21597020 | 21597039 | 21597023 | - |
| SEQ ID NO 17919 | CAATAAATAGGGGTTGTATT | AGG | chr12 | 21597019 | 21597038 | 21597022 | - |
| SEQ ID NO 17920 | CATTTTGCATCTATTGTAC | AAG | chr12 | 21596995 | 21597014 | 21596998 | - |
| SEQ ID NO 17921 | ATTTTGCATCTATTGTACA | AGG | chr12 | 21596994 | 21597013 | 21596997 | - |
| SEQ ID NO 17922 | TTTTGCATCTATTGTACAA | GGG | chr12 | 21596993 | 21597012 | 21596996 | - |
| SEQ ID NO 17923 | TTTGCATCTATTGTACAAG | GGG | chr12 | 21596992 | 21597011 | 21596995 | - |
| SEQ ID NO 17924 | CATCTATTGTACAAGGGGTT | GAG | chr12 | 21596987 | 21597006 | 21596990 | - |
| SEQ ID NO 17925 | TCTTGATTTGATTCTCCATT | TGG | chr12 | 21596963 | 21596982 | 21596966 | - |
| SEQ ID NO 17926 | ATTCTCCATTTGGTTGCTGT | TGG | chr12 | 21596953 | 21596972 | 21596956 | - |
| SEQ ID NO 17927 | ATTTGGTTGCTGTTGGTGTA | TAG | chr12 | 21596946 | 21596965 | 21596949 | - |
| SEQ ID NO 17928 | TGGTTGCTGTTGGTGTATAG | AAG | chr12 | 21596943 | 21596962 | 21596946 | - |
| SEQ ID NO 17929 | GTTGCTGTTGGTGTATAGAA | GAG | chr12 | 21596941 | 21596960 | 21596944 | - |
| SEQ ID NO 17930 | GTGTGCATTCATCTTGTATC | TGG | chr12 | 21596908 | 21596927 | 21596911 | - |
| SEQ ID NO 17931 | ACTTTGCTGAATTATTTTAT | CAG | chr12 | 21596883 | 21596902 | 21596886 | - |
| SEQ ID NO 17932 | CTGAATTATTTTATCAGTTC | TAG | chr12 | 21596877 | 21596896 | 21596880 | - |
| SEQ ID NO 17933 | TGAATTATTTTATCAGTTCT | AGG | chr12 | 21596876 | 21596895 | 21596879 | - |
| SEQ ID NO 17934 | AATTATTTTATCAGTTCTAG | GAG | chr12 | 21596874 | 21596893 | 21596877 | - |
| SEQ ID NO 17935 | TATCAGTTCTAGGAGCTTTC | TGG | chr12 | 21596866 | 21596885 | 21596869 | - |
| SEQ ID NO 17936 | TCAGTTCTAGGAGCTTTCTG | GAG | chr12 | 21596864 | 21596883 | 21596867 | - |
| SEQ ID NO 17937 | CAGTTCTAGGAGCTTTCTGG | AGG | chr12 | 21596863 | 21596882 | 21596866 | - |
| SEQ ID NO 17938 | GTTCTAGGAGCTTTCTGGAG | GAG | chr12 | 21596861 | 21596880 | 21596864 | - |
| SEQ ID NO 17939 | GAGCTTTCTGGAGGAGTCTT | TAG | chr12 | 21596854 | 21596873 | 21596857 | - |
| SEQ ID NO 17940 | AGCTTTCTGGAGGAGTCTTT | AGG | chr12 | 21596853 | 21596872 | 21596856 | - |
| SEQ ID NO 17941 | GCTTTCTGGAGGAGTCTTTA | GGG | chr12 | 21596852 | 21596871 | 21596855 | - |

Figure 43 (Cont'd)

| | | | | | | | |
|---|---|---|---|---|---|---|---|
| SEQ ID NO 17942 | GAGGAGTCTTTAGGGTTTTA | AAG | chr12 | 21596844 | 21596863 | 21596847 | - |
| SEQ ID NO 17943 | AGGAGTCTTTAGGGTTTTAA | AGG | chr12 | 21596843 | 21596862 | 21596846 | - |
| SEQ ID NO 17944 | AAGGTAAATGATCATATCAT | CAG | chr12 | 21596824 | 21596843 | 21596827 | - |
| SEQ ID NO 17945 | ATGATCATATCATCAGCAAA | CAG | chr12 | 21596817 | 21596836 | 21596820 | - |
| SEQ ID NO 17946 | ATATCATCAGCAAACAGTGA | CAG | chr12 | 21596811 | 21596830 | 21596814 | - |
| SEQ ID NO 17947 | TTTGTTTTGTCTGATTGCCC | TGG | chr12 | 21596749 | 21596768 | 21596752 | - |
| SEQ ID NO 17948 | TTTTGTCTGATTGCCCTGGC | TAG | chr12 | 21596745 | 21596764 | 21596748 | - |
| SEQ ID NO 17949 | TTTGTCTGATTGCCCTGGCT | AGG | chr12 | 21596744 | 21596763 | 21596747 | - |
| SEQ ID NO 17950 | ATTGCCCTGGCTAGGACTTC | CAG | chr12 | 21596736 | 21596755 | 21596739 | - |
| SEQ ID NO 17951 | GGACTTCCAGTACTATGTTG | AAG | chr12 | 21596723 | 21596742 | 21596726 | - |
| SEQ ID NO 17952 | ACTTCCAGTACTATGTTGAA | GAG | chr12 | 21596721 | 21596740 | 21596724 | - |
| SEQ ID NO 17953 | CTTCCAGTACTATGTTGAAG | AGG | chr12 | 21596720 | 21596739 | 21596723 | - |
| SEQ ID NO 17954 | TCCAGTACTATGTTGAAGAG | GAG | chr12 | 21596718 | 21596737 | 21596721 | - |
| SEQ ID NO 17955 | AGTACTATGTTGAAGAGGAG | TGG | chr12 | 21596715 | 21596734 | 21596718 | - |
| SEQ ID NO 17956 | CTATGTTGAAGAGGAGTGGT | GAG | chr12 | 21596711 | 21596730 | 21596714 | - |
| SEQ ID NO 17957 | ATGTTGAAGAGGAGTGGTGA | GAG | chr12 | 21596709 | 21596728 | 21596712 | - |
| SEQ ID NO 17958 | TTGAAGAGGAGTGGTGAGAG | TGG | chr12 | 21596706 | 21596725 | 21596709 | - |
| SEQ ID NO 17959 | TGAAGAGGAGTGGTGAGAGT | GGG | chr12 | 21596705 | 21596724 | 21596708 | - |
| SEQ ID NO 17960 | TGGGCATCCTTGTCTTGTTC | CAG | chr12 | 21596686 | 21596705 | 21596689 | - |
| SEQ ID NO 17961 | CCTTGTCTTGTTCCAGTTCT | CAG | chr12 | 21596679 | 21596698 | 21596682 | - |
| SEQ ID NO 17962 | TTGTCTTGTTCCAGTTCTCA | GAG | chr12 | 21596677 | 21596696 | 21596680 | - |
| SEQ ID NO 17963 | TGTCTTGTTCCAGTTCTCAG | AGG | chr12 | 21596676 | 21596695 | 21596679 | - |
| SEQ ID NO 17964 | GTCTTGTTCCAGTTCTCAGA | GGG | chr12 | 21596675 | 21596694 | 21596678 | - |
| SEQ ID NO 17965 | TTCCCCATTCAATATTATGT | TGG | chr12 | 21596638 | 21596657 | 21596641 | - |
| SEQ ID NO 17966 | ATTCAATATTATGTTGGCTG | TGG | chr12 | 21596632 | 21596651 | 21596635 | - |
| SEQ ID NO 17967 | TTCAATATTATGTTGGCTGT | GGG | chr12 | 21596631 | 21596650 | 21596634 | - |
| SEQ ID NO 17968 | TGTTGGCTGTGGGTTTGTCA | CAG | chr12 | 21596621 | 21596640 | 21596624 | - |
| SEQ ID NO 17969 | GGCTGTGGGTTTGTCACAGA | TGG | chr12 | 21596617 | 21596636 | 21596620 | - |
| SEQ ID NO 17970 | CAGATGGCTTTTATTACACT | GAG | chr12 | 21596601 | 21596620 | 21596604 | - |
| SEQ ID NO 17971 | AGATGGCTTTTATTACACTG | AGG | chr12 | 21596600 | 21596619 | 21596603 | - |
| SEQ ID NO 17972 | TCTTGTATGCTGATTTTGCT | GAG | chr12 | 21596571 | 21596590 | 21596574 | - |
| SEQ ID NO 17973 | TTTTAATCATAAATGTATGC | TGG | chr12 | 21596546 | 21596565 | 21596549 | - |
| SEQ ID NO 17974 | ATGCTTTTCTGCATCTATT | GAG | chr12 | 21596513 | 21596532 | 21596516 | - |
| SEQ ID NO 17975 | TGTTTTTAAATCTGTTTATG | TGG | chr12 | 21596474 | 21596493 | 21596477 | - |
| SEQ ID NO 17976 | GTATCACACTTATTGACTTG | CAG | chr12 | 21596450 | 21596469 | 21596453 | - |
| SEQ ID NO 17977 | TCAAACCAACCCTGCATCCC | TGG | chr12 | 21596424 | 21596443 | 21596427 | - |
| SEQ ID NO 17978 | CCAACCCTGCATCCCTGGCA | TGG | chr12 | 21596419 | 21596438 | 21596422 | - |
| SEQ ID NO 17979 | GCATGGAACCTGCTTGATCA | TGG | chr12 | 21596402 | 21596421 | 21596405 | - |
| SEQ ID NO 17980 | TGGAACCTGCTTGATCATGG | TGG | chr12 | 21596399 | 21596418 | 21596402 | - |
| SEQ ID NO 17981 | TTTTGTTATGTTGTTGAATT | TGG | chr12 | 21596369 | 21596388 | 21596372 | - |
| SEQ ID NO 17982 | TGTTGTTGAATTTGGTTATC | TAG | chr12 | 21596361 | 21596380 | 21596364 | - |
| SEQ ID NO 17983 | TGGTTATCTAGTATTTTGTT | AAG | chr12 | 21596349 | 21596368 | 21596352 | - |
| SEQ ID NO 17984 | GGTTATCTAGTATTTTGTTA | AGG | chr12 | 21596348 | 21596367 | 21596351 | - |
| SEQ ID NO 17985 | TAGTATTTTGTTAAGGATTT | TAG | chr12 | 21596341 | 21596360 | 21596344 | - |
| SEQ ID NO 17986 | TTTAGCATCTATGTTCATC | AAG | chr12 | 21596324 | 21596343 | 21596327 | - |
| SEQ ID NO 17987 | TTTAGCATCTATGTTCATCA | AGG | chr12 | 21596323 | 21596342 | 21596326 | - |
| SEQ ID NO 17988 | TCTATGTTCATCAAGGCTAT | CAG | chr12 | 21596316 | 21596335 | 21596319 | - |

Figure 43 (Cont'd)

| | | | | | | | |
|---|---|---|---|---|---|---|---|
| SEQ ID NO 17989 | TCATCAAGGCTATCAGTCTG | TAG | chr12 | 21596309 | 21596328 | 21596312 | - |
| SEQ ID NO 17990 | CAGTCTGTAGTTTTCTTTTT | TGG | chr12 | 21596296 | 21596315 | 21596299 | - |
| SEQ ID NO 17991 | TTTTTGGTTATGTCCTTCCC | TGG | chr12 | 21596280 | 21596299 | 21596283 | - |
| SEQ ID NO 17992 | GTTATGTCCTTCCCTGGTTT | TGG | chr12 | 21596274 | 21596293 | 21596277 | - |
| SEQ ID NO 17993 | CCCTGGTTTTGGTGTGATGC | TGG | chr12 | 21596263 | 21596282 | 21596266 | - |
| SEQ ID NO 17994 | TTGGTGTGATGCTGGCTTCA | TAG | chr12 | 21596255 | 21596274 | 21596258 | - |
| SEQ ID NO 17995 | GCTGGCTTCATAGAATGAAT | TAG | chr12 | 21596245 | 21596264 | 21596248 | - |
| SEQ ID NO 17996 | CTGGCTTCATAGAATGAATT | AGG | chr12 | 21596244 | 21596263 | 21596247 | - |
| SEQ ID NO 17997 | TGGCTTCATAGAATGAATTA | GGG | chr12 | 21596243 | 21596262 | 21596246 | - |
| SEQ ID NO 17998 | CTTCATAGAATGAATTAGGG | CAG | chr12 | 21596240 | 21596259 | 21596243 | - |
| SEQ ID NO 17999 | TTCATAGAATGAATTAGGGC | AGG | chr12 | 21596239 | 21596258 | 21596242 | - |
| SEQ ID NO 18000 | TTCCTTCTTTATCTGTCTTG | TAG | chr12 | 21596216 | 21596235 | 21596219 | - |
| SEQ ID NO 18001 | TCTTTATCTGTCTTGTAGAA | TAG | chr12 | 21596211 | 21596230 | 21596214 | - |
| SEQ ID NO 18002 | TCTTGTAGAATAGTGTCAAA | AAG | chr12 | 21596201 | 21596220 | 21596204 | - |
| SEQ ID NO 18003 | GTAGAATAGTGTCAAAAAGA | TGG | chr12 | 21596197 | 21596216 | 21596200 | - |
| SEQ ID NO 18004 | TAGAATAGTGTCAAAAGAT | GGG | chr12 | 21596196 | 21596215 | 21596199 | - |
| SEQ ID NO 18005 | AGAATAGTGTCAAAAGATG | GGG | chr12 | 21596195 | 21596214 | 21596198 | - |
| SEQ ID NO 18006 | CCAATTCCTCTTTGAATGTC | TAG | chr12 | 21596171 | 21596190 | 21596174 | - |
| SEQ ID NO 18007 | ATTCCTCTTTGAATGTCTAG | TAG | chr12 | 21596168 | 21596187 | 21596171 | - |
| SEQ ID NO 18008 | AATTCTGTTGTGAATCCATC | TGG | chr12 | 21596145 | 21596164 | 21596148 | - |
| SEQ ID NO 18009 | TCTGGTCCTGAACTTTTTTT | TGG | chr12 | 21596127 | 21596146 | 21596130 | - |
| SEQ ID NO 18010 | GTCCTGAACTTTTTTTTGGT | TGG | chr12 | 21596123 | 21596142 | 21596126 | - |
| SEQ ID NO 18011 | TAAATCTCACTGCTTGTTAT | TGG | chr12 | 21596081 | 21596100 | 21596084 | - |
| SEQ ID NO 18012 | ACTGCTTGTTATTGGTCTGT | TAG | chr12 | 21596073 | 21596092 | 21596076 | - |
| SEQ ID NO 18013 | GGTCTGTTAGTAAATTTATT | GAG | chr12 | 21596060 | 21596079 | 21596063 | - |
| SEQ ID NO 18014 | GTCTGTTAGTAAATTTATTG | AGG | chr12 | 21596059 | 21596078 | 21596062 | - |
| SEQ ID NO 18015 | ATTTATTGAGGCTCATTTCA | TGG | chr12 | 21596047 | 21596066 | 21596050 | - |
| SEQ ID NO 18016 | TCATTTCATGGCCTATCATA | TGG | chr12 | 21596035 | 21596054 | 21596038 | - |
| SEQ ID NO 18017 | GCCTATCATATGGTCTACCT | TGG | chr12 | 21596025 | 21596044 | 21596028 | - |
| SEQ ID NO 18018 | CTATCATATGGTCTACCTTG | GAG | chr12 | 21596023 | 21596042 | 21596026 | - |
| SEQ ID NO 18019 | AATTTCCACGCGCTGTTGAA | TAG | chr12 | 21595999 | 21596018 | 21596002 | - |
| SEQ ID NO 18020 | TGAATAGAATGTGTGTTCTG | TGG | chr12 | 21595983 | 21596002 | 21595986 | - |
| SEQ ID NO 18021 | AATGTGTGTTCTGTGGTTAT | TGG | chr12 | 21595976 | 21595995 | 21595979 | - |
| SEQ ID NO 18022 | ATGTTCTGTATATAACTGTT | AAG | chr12 | 21595948 | 21595967 | 21595951 | - |
| SEQ ID NO 18023 | CTGTTAAGTCCATTTGTTCT | AAG | chr12 | 21595933 | 21595952 | 21595936 | - |
| SEQ ID NO 18024 | TGTTAAGTCCATTTGTTCTA | AGG | chr12 | 21595932 | 21595951 | 21595935 | - |
| SEQ ID NO 18025 | TTCTGTCTTGATGAACTGTC | TAG | chr12 | 21595877 | 21595896 | 21595880 | - |
| SEQ ID NO 18026 | ACTGTCTAGTGCTGTCAATG | AAG | chr12 | 21595863 | 21595882 | 21595866 | - |
| SEQ ID NO 18027 | GTGCTGTCAATGAAGTATTG | AAG | chr12 | 21595855 | 21595874 | 21595858 | - |
| SEQ ID NO 18028 | TTGCTGTCTATCTCATTTCT | TAG | chr12 | 21595814 | 21595833 | 21595817 | - |
| SEQ ID NO 18029 | TGCTGTCTATCTCATTTCTT | AGG | chr12 | 21595813 | 21595832 | 21595816 | - |
| SEQ ID NO 18030 | ATCTCATTTCTTAGGTCTAT | TAG | chr12 | 21595805 | 21595824 | 21595808 | - |
| SEQ ID NO 18031 | TAGTAATTGTTCTATAAATT | TGG | chr12 | 21595785 | 21595804 | 21595788 | - |
| SEQ ID NO 18032 | AGTAATTGTTCTATAAATTT | GGG | chr12 | 21595784 | 21595803 | 21595787 | - |
| SEQ ID NO 18033 | TAATTGTTCTATAAATTTGG | GAG | chr12 | 21595782 | 21595801 | 21595785 | - |
| SEQ ID NO 18034 | TTCTATAAATTTGGGAGCTC | CAG | chr12 | 21595776 | 21595795 | 21595779 | - |
| SEQ ID NO 18035 | AAATTTGGGAGCTCCAGTGT | TAG | chr12 | 21595770 | 21595789 | 21595773 | - |

Figure 43 (Cont'd)

| | | | | | | | |
|---|---|---|---|---|---|---|---|
| SEQ ID NO 18036 | AATTTGGGAGCTCCAGTGTT | AGG | chr12 | 21595769 | 21595788 | 21595772 | - |
| SEQ ID NO 18037 | TGTTAGGTGCATATATGTTT | AAG | chr12 | 21595753 | 21595772 | 21595756 | - |
| SEQ ID NO 18038 | AGATTGTGATATTTTCCTGT | TGG | chr12 | 21595732 | 21595751 | 21595735 | - |
| SEQ ID NO 18039 | GTGATATTTTCCTGTTGGAC | AAG | chr12 | 21595727 | 21595746 | 21595730 | - |
| SEQ ID NO 18040 | TGATATTTTCCTGTTGGACA | AGG | chr12 | 21595726 | 21595745 | 21595729 | - |
| SEQ ID NO 18041 | TTTTAACTGCTGTTGCTTTA | AAG | chr12 | 21595669 | 21595688 | 21595672 | - |
| SEQ ID NO 18042 | TTGTTTTGCCTACTCACTTT | TGG | chr12 | 21595645 | 21595664 | 21595648 | - |
| SEQ ID NO 18043 | TTTTGCCTACTCACTTTTGG | TGG | chr12 | 21595642 | 21595661 | 21595645 | - |
| SEQ ID NO 18044 | AATACCTTTTTCACCCTTTT | AAG | chr12 | 21595607 | 21595626 | 21595610 | - |
| SEQ ID NO 18045 | ACCTTTTTCACCCTTTTAAG | TGG | chr12 | 21595604 | 21595623 | 21595607 | - |
| SEQ ID NO 18046 | CTTTTTCACCCTTTTAAGTG | GAG | chr12 | 21595602 | 21595621 | 21595605 | - |
| SEQ ID NO 18047 | ACCCTTTTAAGTGGAGCATT | TAG | chr12 | 21595595 | 21595614 | 21595598 | - |
| SEQ ID NO 18048 | CCCTTTTAAGTGGAGCATTT | AGG | chr12 | 21595594 | 21595613 | 21595597 | - |
| SEQ ID NO 18049 | AGGCCATTTACATTCAATGT | TAG | chr12 | 21595574 | 21595593 | 21595577 | - |
| SEQ ID NO 18050 | ATGTTAGTAATGTAAATGCC | TGG | chr12 | 21595558 | 21595577 | 21595561 | - |
| SEQ ID NO 18051 | ATGTAAATGCCTGGCTATGC | CAG | chr12 | 21595549 | 21595568 | 21595552 | - |
| SEQ ID NO 18052 | TGTAAATGCCTGGCTATGCC | AGG | chr12 | 21595548 | 21595567 | 21595551 | - |
| SEQ ID NO 18053 | AAATGCCTGGCTATGCCAGG | CAG | chr12 | 21595545 | 21595564 | 21595548 | - |
| SEQ ID NO 18054 | AATGCCTGGCTATGCCAGGC | AGG | chr12 | 21595544 | 21595563 | 21595547 | - |
| SEQ ID NO 18055 | CTGGCTATGCCAGGCAGGAA | TGG | chr12 | 21595539 | 21595558 | 21595542 | - |
| SEQ ID NO 18056 | CCAGGCAGGAATGGCCTGCT | CAG | chr12 | 21595530 | 21595549 | 21595533 | - |
| SEQ ID NO 18057 | CAGGCAGGAATGGCCTGCTC | AGG | chr12 | 21595529 | 21595548 | 21595532 | - |
| SEQ ID NO 18058 | AGGCAGGAATGGCCTGCTCA | GGG | chr12 | 21595528 | 21595547 | 21595531 | - |
| SEQ ID NO 18059 | GAATGGCCTGCTCAGGGACC | CAG | chr12 | 21595522 | 21595541 | 21595525 | - |
| SEQ ID NO 18060 | GGCCTGCTCAGGGACCCAGT | GAG | chr12 | 21595518 | 21595537 | 21595521 | - |
| SEQ ID NO 18061 | TCAGGGACCCAGTGAGCTCC | CAG | chr12 | 21595511 | 21595530 | 21595514 | - |
| SEQ ID NO 18062 | CAGGGACCCAGTGAGCTCCC | AGG | chr12 | 21595510 | 21595529 | 21595513 | - |
| SEQ ID NO 18063 | AGGGACCCAGTGAGCTCCCA | GGG | chr12 | 21595509 | 21595528 | 21595512 | - |
| SEQ ID NO 18064 | CTCTACACCTGTATTTTGCT | CAG | chr12 | 21595470 | 21595489 | 21595473 | - |
| SEQ ID NO 18065 | TGTATTTTGCTCAGCTCTCT | AAG | chr12 | 21595461 | 21595480 | 21595464 | - |
| SEQ ID NO 18066 | TCTCTAAGTTAACTCAACTC | CAG | chr12 | 21595446 | 21595465 | 21595449 | - |
| SEQ ID NO 18067 | CTCTAAGTTAACTCAACTCC | AGG | chr12 | 21595445 | 21595464 | 21595448 | - |
| SEQ ID NO 18068 | AAGTTAACTCAACTCCAGGT | AAG | chr12 | 21595441 | 21595460 | 21595444 | - |
| SEQ ID NO 18069 | AGTTAACTCAACTCCAGGTA | AGG | chr12 | 21595440 | 21595459 | 21595443 | - |
| SEQ ID NO 18070 | AACTCAACTCCAGGTAAGGT | CAG | chr12 | 21595436 | 21595455 | 21595439 | - |
| SEQ ID NO 18071 | TCAGAAACTTCTCCCACAAA | CAG | chr12 | 21595417 | 21595436 | 21595420 | - |
| SEQ ID NO 18072 | TTCTCCCACAAACAGACCTT | CAG | chr12 | 21595409 | 21595428 | 21595412 | - |
| SEQ ID NO 18073 | AAACAGACCTTCAGTTTCTC | CAG | chr12 | 21595400 | 21595419 | 21595403 | - |
| SEQ ID NO 18074 | CAGACCTTCAGTTTCTCCAG | TGG | chr12 | 21595397 | 21595416 | 21595400 | - |
| SEQ ID NO 18075 | AGACCTTCAGTTTCTCCAGT | GGG | chr12 | 21595396 | 21595415 | 21595399 | - |
| SEQ ID NO 18076 | ACCTTCAGTTTCTCCAGTGG | GAG | chr12 | 21595394 | 21595413 | 21595397 | - |
| SEQ ID NO 18077 | CTCCAGTGGGAGTGTGTGTT | TAG | chr12 | 21595383 | 21595402 | 21595386 | - |
| SEQ ID NO 18078 | TCCAGTGGGAGTGTGTGTTT | AGG | chr12 | 21595382 | 21595401 | 21595385 | - |
| SEQ ID NO 18079 | CAGTGGGAGTGTGTGTTTAG | GAG | chr12 | 21595380 | 21595399 | 21595383 | - |
| SEQ ID NO 18080 | GTGGGAGTGTGTGTTTAGGA | GAG | chr12 | 21595378 | 21595397 | 21595381 | - |
| SEQ ID NO 18081 | TGGGAGTGTGTGTTTAGGAG | AGG | chr12 | 21595377 | 21595396 | 21595380 | - |
| SEQ ID NO 18082 | GGAGTGTGTGTTTAGGAGAG | GAG | chr12 | 21595375 | 21595394 | 21595378 | - |

Figure 43 (Cont'd)

| SEQ ID NO 18083 | GAGTGTGTGTTTAGGAGAGG | AGG | chr12 | 21595374 | 21595393 | 21595377 | - |
| SEQ ID NO 18084 | ATCTCCCTTTCCCACTTCCG | CAG | chr12 | 21595351 | 21595370 | 21595354 | - |
| SEQ ID NO 18085 | CCCTTTCCCACTTCCGCAGT | TGG | chr12 | 21595347 | 21595366 | 21595350 | - |
| SEQ ID NO 18086 | CCTTTCCCACTTCCGCAGTT | GGG | chr12 | 21595346 | 21595365 | 21595349 | - |
| SEQ ID NO 18087 | CTTTCCCACTTCCGCAGTTG | GGG | chr12 | 21595345 | 21595364 | 21595348 | - |
| SEQ ID NO 18088 | TTCCGCAGTTGGGGCACTCA | CAG | chr12 | 21595336 | 21595355 | 21595339 | - |
| SEQ ID NO 18089 | GTTGGGGCACTCACAGTATT | TGG | chr12 | 21595329 | 21595348 | 21595332 | - |
| SEQ ID NO 18090 | TTGGGGCACTCACAGTATTT | GGG | chr12 | 21595328 | 21595347 | 21595331 | - |
| SEQ ID NO 18091 | TGGGGCACTCACAGTATTTG | GGG | chr12 | 21595327 | 21595346 | 21595330 | - |
| SEQ ID NO 18092 | ACAGTATTTGGGGTGTCTCC | TGG | chr12 | 21595317 | 21595336 | 21595320 | - |
| SEQ ID NO 18093 | CAGTATTTGGGGTGTCTCCT | GGG | chr12 | 21595316 | 21595335 | 21595319 | - |
| SEQ ID NO 18094 | GGGGTGTCTCCTGGGTCCTG | CAG | chr12 | 21595308 | 21595327 | 21595311 | - |
| SEQ ID NO 18095 | GGGTGTCTCCTGGGTCCTGC | AGG | chr12 | 21595307 | 21595326 | 21595310 | - |
| SEQ ID NO 18096 | GTGTCTCCTGGGTCCTGCAG | GAG | chr12 | 21595305 | 21595324 | 21595308 | - |
| SEQ ID NO 18097 | CAGGAGCAATCTACTTCCTT | CAG | chr12 | 21595288 | 21595307 | 21595291 | - |
| SEQ ID NO 18098 | GGAGCAATCTACTTCCTTCA | GAG | chr12 | 21595286 | 21595305 | 21595289 | - |
| SEQ ID NO 18099 | GAGCAATCTACTTCCTTCAG | AGG | chr12 | 21595285 | 21595304 | 21595288 | - |
| SEQ ID NO 18100 | AGCAATCTACTTCCTTCAGA | GGG | chr12 | 21595284 | 21595303 | 21595287 | - |
| SEQ ID NO 18101 | TACTTCCTTCAGAGGGTCTG | TGG | chr12 | 21595277 | 21595296 | 21595280 | - |
| SEQ ID NO 18102 | ACTTCCTTCAGAGGGTCTGT | GGG | chr12 | 21595276 | 21595295 | 21595279 | - |
| SEQ ID NO 18103 | AGAGGGTCTGTGGGTCCTCT | CAG | chr12 | 21595267 | 21595286 | 21595270 | - |
| SEQ ID NO 18104 | GAGGGTCTGTGGGTCCTCTC | AGG | chr12 | 21595266 | 21595285 | 21595269 | - |
| SEQ ID NO 18105 | GTGGGTCCTCTCAGGATTGC | TGG | chr12 | 21595258 | 21595277 | 21595261 | - |
| SEQ ID NO 18106 | GGATTGCTGGTTTGTTCTTG | CAG | chr12 | 21595245 | 21595264 | 21595248 | - |
| SEQ ID NO 18107 | TTGTTCTTGCAGTCTATCTG | CAG | chr12 | 21595234 | 21595253 | 21595237 | - |
| SEQ ID NO 18108 | GCAGCTAAAATTCACAATGC | GAG | chr12 | 21595215 | 21595234 | 21595218 | - |
| SEQ ID NO 18109 | ACATGCTGCTCTGTCCATCT | GAG | chr12 | 21595187 | 21595206 | 21595190 | - |
| SEQ ID NO 18110 | GCTGCTCTGTCCATCTGAGT | TGG | chr12 | 21595183 | 21595202 | 21595186 | - |
| SEQ ID NO 18111 | TGCTCTGTCCATCTGAGTTG | GAG | chr12 | 21595181 | 21595200 | 21595184 | - |
| SEQ ID NO 18112 | TCTGAGTTGGAGCTGCAATC | TAG | chr12 | 21595170 | 21595189 | 21595173 | - |
| SEQ ID NO 18113 | CTGAGTTGGAGCTGCAATCT | AGG | chr12 | 21595169 | 21595188 | 21595172 | - |
| SEQ ID NO 18114 | AGGCCTACCTCCCATCCGCC | AAG | chr12 | 21595149 | 21595168 | 21595152 | - |
| SEQ ID NO 18115 | CTCCCATCCGCCAAGATCCT | GAG | chr12 | 21595141 | 21595160 | 21595144 | - |
| SEQ ID NO 18116 | CCATCCGCCAAGATCCTGAG | AAG | chr12 | 21595138 | 21595157 | 21595141 | - |
| SEQ ID NO 18117 | CCGCCAAGATCCTGAGAAGT | TGG | chr12 | 21595134 | 21595153 | 21595137 | - |
| SEQ ID NO 18118 | CGCCAAGATCCTGAGAAGTT | GGG | chr12 | 21595133 | 21595152 | 21595136 | - |
| SEQ ID NO 18119 | GCCAAGATCCTGAGAAGTTG | GGG | chr12 | 21595132 | 21595151 | 21595135 | - |
| SEQ ID NO 18120 | TGGGGATTATATTTCAACAT | GAG | chr12 | 21595114 | 21595133 | 21595117 | - |
| SEQ ID NO 18121 | TTATATTTCAACATGAGATT | TGG | chr12 | 21595108 | 21595127 | 21595111 | - |
| SEQ ID NO 18122 | ATATTTCAACATGAGATTTG | GAG | chr12 | 21595106 | 21595125 | 21595109 | - |
| SEQ ID NO 18123 | TATTTCAACATGAGATTTGG | AGG | chr12 | 21595105 | 21595124 | 21595108 | - |
| SEQ ID NO 18124 | ATTTCAACATGAGATTTGGA | GGG | chr12 | 21595104 | 21595123 | 21595107 | - |
| SEQ ID NO 18125 | AACAAACATCCAAACCATAT | CAG | chr12 | 21595081 | 21595100 | 21595084 | - |
| SEQ ID NO 18126 | AAACATCCAAACCATATCAG | CAG | chr12 | 21595078 | 21595097 | 21595081 | - |
| SEQ ID NO 18127 | TCCAAACCATATCAGCAGTC | CAG | chr12 | 21595073 | 21595092 | 21595076 | - |
| SEQ ID NO 18128 | CAGTTTTATTCTTTTGCACA | TGG | chr12 | 21595053 | 21595072 | 21595056 | - |
| SEQ ID NO 18129 | TTTTGCACATGGATATCCAA | TGG | chr12 | 21595042 | 21595061 | 21595045 | - |

Figure 43 (Cont'd)

| SEQ ID NO 18130 | CAATGGATATCCAATTTTTT | CAG | chr12 | 21595025 | 21595044 | 21595028 | - |
| SEQ ID NO 18131 | CACCTTTGTTGAAAATCTGT | TGG | chr12 | 21594956 | 21594975 | 21594959 | - |
| SEQ ID NO 18132 | ATCTGTTGGCTATAAATATG | TGG | chr12 | 21594942 | 21594961 | 21594945 | - |
| SEQ ID NO 18133 | TAAATATGTGGATGCATTTC | TAG | chr12 | 21594930 | 21594949 | 21594933 | - |
| SEQ ID NO 18134 | AAATATGTGGATGCATTTCT | AGG | chr12 | 21594929 | 21594948 | 21594932 | - |
| SEQ ID NO 18135 | GGTTCTCTATTCTCTTCCAT | TGG | chr12 | 21594908 | 21594927 | 21594911 | - |
| SEQ ID NO 18136 | CTATTCTCTTCCATTGGTCT | AAG | chr12 | 21594902 | 21594921 | 21594905 | - |
| SEQ ID NO 18137 | CTAAGTGTCTGTTCTAATGT | CAG | chr12 | 21594884 | 21594903 | 21594887 | - |
| SEQ ID NO 18138 | AATGTCAGTATCATGCTGTT | TAG | chr12 | 21594869 | 21594888 | 21594872 | - |
| SEQ ID NO 18139 | ATGTCAGTATCATGCTGTTT | AGG | chr12 | 21594868 | 21594887 | 21594871 | - |
| SEQ ID NO 18140 | TTTGTAATATACTTTGAAAT | CAG | chr12 | 21594835 | 21594854 | 21594838 | - |
| SEQ ID NO 18141 | TTGTAATATACTTTGAAATC | AGG | chr12 | 21594834 | 21594853 | 21594837 | - |
| SEQ ID NO 18142 | TAATATACTTTGAAATCAGG | TAG | chr12 | 21594831 | 21594850 | 21594834 | - |
| SEQ ID NO 18143 | ATCAGGTAGTATGATACCTC | TAG | chr12 | 21594817 | 21594836 | 21594820 | - |
| SEQ ID NO 18144 | CTAGCATTGTTCTTTTTTCA | CAG | chr12 | 21594798 | 21594817 | 21594801 | - |
| SEQ ID NO 18145 | TAGCATTGTTCTTTTTTCAC | AGG | chr12 | 21594797 | 21594816 | 21594800 | - |
| SEQ ID NO 18146 | CTTTTTTCACAGGATGACTT | TGG | chr12 | 21594787 | 21594806 | 21594790 | - |
| SEQ ID NO 18147 | CACAGGATGACTTTGGCTAC | TGG | chr12 | 21594780 | 21594799 | 21594783 | - |
| SEQ ID NO 18148 | CAGGATGACTTTGGCTACTG | GAG | chr12 | 21594778 | 21594797 | 21594781 | - |
| SEQ ID NO 18149 | TTTTAATTTCATACAAATTT | TAG | chr12 | 21594750 | 21594769 | 21594753 | - |
| SEQ ID NO 18150 | ATTTCATACAAATTTTAGAT | TGG | chr12 | 21594745 | 21594764 | 21594748 | - |
| SEQ ID NO 18151 | AAATGACATTGCTATTTTGA | TAG | chr12 | 21594704 | 21594723 | 21594707 | - |
| SEQ ID NO 18152 | TGACATTGCTATTTTGATAG | CGG | chr12 | 21594701 | 21594720 | 21594704 | - |
| SEQ ID NO 18153 | CTATTTTGATAGCGGTCATA | TAG | chr12 | 21594693 | 21594712 | 21594696 | - |
| SEQ ID NO 18154 | TAGCGGTCATATAGAATCTG | TAG | chr12 | 21594684 | 21594703 | 21594687 | - |
| SEQ ID NO 18155 | ATAGAATCTGTAGATTGCTT | TGG | chr12 | 21594674 | 21594693 | 21594677 | - |
| SEQ ID NO 18156 | TAGAATCTGTAGATTGCTTT | GGG | chr12 | 21594673 | 21594692 | 21594676 | - |
| SEQ ID NO 18157 | AATCTGTAGATTGCTTTGGG | TAG | chr12 | 21594670 | 21594689 | 21594673 | - |
| SEQ ID NO 18158 | GTAGATTGCTTTGGGTAGTA | TGG | chr12 | 21594665 | 21594684 | 21594668 | - |
| SEQ ID NO 18159 | ATTTTTCTGATCCATGAACA | TAG | chr12 | 21594625 | 21594644 | 21594628 | - |
| SEQ ID NO 18160 | TTTTTCTGATCCATGAACAT | AGG | chr12 | 21594624 | 21594643 | 21594627 | - |
| SEQ ID NO 18161 | GTCCTTTTCAATTCTTTTAT | CAG | chr12 | 21594581 | 21594600 | 21594584 | - |
| SEQ ID NO 18162 | ATTCTTTTATCAGTGTTTTG | TAG | chr12 | 21594571 | 21594590 | 21594574 | - |
| SEQ ID NO 18163 | GTGTTTTGTAGTTTTCCGAA | TAG | chr12 | 21594559 | 21594578 | 21594562 | - |
| SEQ ID NO 18164 | GTTTTGTAGTTTTCCGAATA | GAG | chr12 | 21594557 | 21594576 | 21594560 | - |
| SEQ ID NO 18165 | TTTTGTAGTTTTCCGAATAG | AGG | chr12 | 21594556 | 21594575 | 21594559 | - |
| SEQ ID NO 18166 | TTTTCCGAATAGAGGTTTTT | CGG | chr12 | 21594548 | 21594567 | 21594551 | - |
| SEQ ID NO 18167 | ATAGAGGTTTTTCGGTTCCT | TGG | chr12 | 21594540 | 21594559 | 21594543 | - |
| SEQ ID NO 18168 | TCCCTAAATATTTTATTTTT | TAG | chr12 | 21594508 | 21594527 | 21594511 | - |
| SEQ ID NO 18169 | TATTTTTTAGCTATTGTAAA | TGG | chr12 | 21594495 | 21594514 | 21594498 | - |
| SEQ ID NO 18170 | ATTTTTTAGCTATTGTAAAT | GGG | chr12 | 21594494 | 21594513 | 21594497 | - |
| SEQ ID NO 18171 | TGCCTCTTAATTTCCTTCT | CAG | chr12 | 21594469 | 21594488 | 21594472 | - |
| SEQ ID NO 18172 | TTCTTAATTTCCTTCTCAGC | TAG | chr12 | 21594465 | 21594484 | 21594468 | - |
| SEQ ID NO 18173 | CTTCTCAGCTAGTTTATTAT | TGG | chr12 | 21594454 | 21594473 | 21594457 | - |
| SEQ ID NO 18174 | GCTAGTTTATTATTGGTGTG | TAG | chr12 | 21594447 | 21594466 | 21594450 | - |
| SEQ ID NO 18175 | ACTTTACTGAATTTATTTTT | CAG | chr12 | 21594385 | 21594404 | 21594388 | - |
| SEQ ID NO 18176 | TGAATTTATTTTTCAGCGCT | AAG | chr12 | 21594378 | 21594397 | 21594381 | - |

Figure 43 (Cont'd)

| SEQ ID NO 18177 | AATTTATTTTTCAGCGCTAA | GAG | chr12 | 21594376 | 21594395 | 21594379 | - |
| SEQ ID NO 18178 | TTTCAGCGCTAAGAGTGCTT | TGG | chr12 | 21594368 | 21594387 | 21594371 | - |
| SEQ ID NO 18179 | CAGCGCTAAGAGTGCTTTGG | TGG | chr12 | 21594365 | 21594384 | 21594368 | - |
| SEQ ID NO 18180 | GCGCTAAGAGTGCTTTGGTG | GAG | chr12 | 21594363 | 21594382 | 21594366 | - |
| SEQ ID NO 18181 | AGAGTGCTTTGGTGGAGTCT | TGG | chr12 | 21594357 | 21594376 | 21594360 | - |
| SEQ ID NO 18182 | TGGTGGAGTCTTGGTTTTTC | TAG | chr12 | 21594348 | 21594367 | 21594351 | - |
| SEQ ID NO 18183 | GGTGGAGTCTTGGTTTTTCT | AGG | chr12 | 21594347 | 21594366 | 21594350 | - |
| SEQ ID NO 18184 | AGGTATAAAATCATGTCATC | TGG | chr12 | 21594327 | 21594346 | 21594330 | - |
| SEQ ID NO 18185 | ATAAAATCATGTCATCTGGA | AAG | chr12 | 21594323 | 21594342 | 21594326 | - |
| SEQ ID NO 18186 | AATCATGTCATCTGGAAAGA | TGG | chr12 | 21594319 | 21594338 | 21594322 | - |
| SEQ ID NO 18187 | ATGTCATCTGGAAAGATGGA | CAG | chr12 | 21594315 | 21594334 | 21594318 | - |
| SEQ ID NO 18188 | TCTTTCTTTCTCTGACCTGA | AAG | chr12 | 21594255 | 21594274 | 21594258 | - |
| SEQ ID NO 18189 | TTTCTCTGACCTGAAAGCTG | TGG | chr12 | 21594249 | 21594268 | 21594252 | - |
| SEQ ID NO 18190 | TCTGACCTGAAAGCTGTGGC | TAG | chr12 | 21594245 | 21594264 | 21594248 | - |
| SEQ ID NO 18191 | CTGACCTGAAAGCTGTGGCT | AGG | chr12 | 21594244 | 21594263 | 21594247 | - |
| SEQ ID NO 18192 | AAAGCTGTGGCTAGGACTTC | CAG | chr12 | 21594236 | 21594255 | 21594239 | - |
| SEQ ID NO 18193 | ACTTCCAGTATTATATTGAA | TAG | chr12 | 21594221 | 21594240 | 21594224 | - |
| SEQ ID NO 18194 | CTTCCAGTATTATATTGAAT | AGG | chr12 | 21594220 | 21594239 | 21594223 | - |
| SEQ ID NO 18195 | TCCAGTATTATATTGAATAG | GAG | chr12 | 21594218 | 21594237 | 21594221 | - |
| SEQ ID NO 18196 | ATTATATTGAATAGGAGTGA | TGG | chr12 | 21594212 | 21594231 | 21594215 | - |
| SEQ ID NO 18197 | ATATTGAATAGGAGTGATGG | AAG | chr12 | 21594209 | 21594228 | 21594212 | - |
| SEQ ID NO 18198 | TTGAATAGGAGTGATGGAAG | TGG | chr12 | 21594206 | 21594225 | 21594209 | - |
| SEQ ID NO 18199 | TGAATAGGAGTGATGGAAGT | GGG | chr12 | 21594205 | 21594224 | 21594208 | - |
| SEQ ID NO 18200 | TGGGCATCCTTATTTTGTTT | CAG | chr12 | 21594186 | 21594205 | 21594189 | - |
| SEQ ID NO 18201 | CCTTATTTTGTTTCAGTTCT | TAG | chr12 | 21594179 | 21594198 | 21594182 | - |
| SEQ ID NO 18202 | TTATTTTGTTTCAGTTCTTA | GAG | chr12 | 21594177 | 21594196 | 21594180 | - |
| SEQ ID NO 18203 | TATTTTGTTTCAGTTCTTAG | AGG | chr12 | 21594176 | 21594195 | 21594179 | - |
| SEQ ID NO 18204 | TTGTTTCAGTTCTTAGAGGA | AAG | chr12 | 21594172 | 21594191 | 21594175 | - |
| SEQ ID NO 18205 | TGTTTCAGTTCTTAGAGGAA | AGG | chr12 | 21594171 | 21594190 | 21594174 | - |
| SEQ ID NO 18206 | GTTCTTAGAGGAAAGGCTTC | CAG | chr12 | 21594164 | 21594183 | 21594167 | - |
| SEQ ID NO 18207 | GCTTCCAGCTTTTCCCAATT | CAG | chr12 | 21594149 | 21594168 | 21594152 | - |
| SEQ ID NO 18208 | TTCCCAATTCAGTATGATGT | TAG | chr12 | 21594138 | 21594157 | 21594141 | - |
| SEQ ID NO 18209 | ATTCAGTATGATGTTAGCTG | TGG | chr12 | 21594132 | 21594151 | 21594135 | - |
| SEQ ID NO 18210 | TTCAGTATGATGTTAGCTGT | GGG | chr12 | 21594131 | 21594150 | 21594134 | - |
| SEQ ID NO 18211 | TATATGACTTTTATTATATT | GAG | chr12 | 21594101 | 21594120 | 21594104 | - |
| SEQ ID NO 18212 | AGATATGTTCCTTCTATGAT | TGG | chr12 | 21594080 | 21594099 | 21594083 | - |
| SEQ ID NO 18213 | GTTCCTTCTATGATTGGCTG | CAG | chr12 | 21594074 | 21594093 | 21594077 | - |
| SEQ ID NO 18214 | CTTCTATGATTGGCTGCAGA | TAG | chr12 | 21594070 | 21594089 | 21594073 | - |
| SEQ ID NO 18215 | TGCAGATAGTTTTTATCATG | AAG | chr12 | 21594056 | 21594075 | 21594059 | - |
| SEQ ID NO 18216 | GCAGATAGTTTTTATCATGA | AGG | chr12 | 21594055 | 21594074 | 21594058 | - |
| SEQ ID NO 18217 | ATACTTTTTCTGTATCTATT | GAG | chr12 | 21594014 | 21594033 | 21594017 | - |
| SEQ ID NO 18218 | TATCTATTGAGATGATCATA | TGG | chr12 | 21594002 | 21594021 | 21594005 | - |
| SEQ ID NO 18219 | TTGAACTGTTCTTGCAACCC | TAG | chr12 | 21593937 | 21593956 | 21593940 | - |
| SEQ ID NO 18220 | GTATAAATCCCACTTGATCA | TGG | chr12 | 21593915 | 21593934 | 21593918 | - |
| SEQ ID NO 18221 | GATCATGGTGTATTATCTTT | TGG | chr12 | 21593900 | 21593919 | 21593903 | - |
| SEQ ID NO 18222 | TTATCTTTTGGATGTACTGT | TGG | chr12 | 21593888 | 21593907 | 21593891 | - |
| SEQ ID NO 18223 | TTTGGATGTACTGTTGGATT | CAG | chr12 | 21593882 | 21593901 | 21593885 | - |

Figure 43 (Cont'd)

| SEQ ID NO 18224 | TACTGTTGGATTCAGTTTGC | TAG | chr12 | 21593874 | 21593893 | 21593877 | - |
| SEQ ID NO 18225 | CAGTTTGCTAGTATTTTGTT | GAG | chr12 | 21593862 | 21593881 | 21593865 | - |
| SEQ ID NO 18226 | AGTTTGCTAGTATTTTGTTG | AGG | chr12 | 21593861 | 21593880 | 21593864 | - |
| SEQ ID NO 18227 | TTTTCACACCTATGTTCCAT | CAG | chr12 | 21593837 | 21593856 | 21593840 | - |
| SEQ ID NO 18228 | TTTCACACCTATGTTCCATC | AGG | chr12 | 21593836 | 21593855 | 21593839 | - |
| SEQ ID NO 18229 | TTCACACCTATGTTCCATCA | GGG | chr12 | 21593835 | 21593854 | 21593838 | - |
| SEQ ID NO 18230 | CCATCAGGGATATTGACCTG | CAG | chr12 | 21593821 | 21593840 | 21593824 | - |
| SEQ ID NO 18231 | TTTTTACTTGCATCCTTGTC | TGG | chr12 | 21593793 | 21593812 | 21593796 | - |
| SEQ ID NO 18232 | CTTGCATCCTTGTCTGGTTA | TGG | chr12 | 21593787 | 21593806 | 21593790 | - |
| SEQ ID NO 18233 | TCCTTGTCTGGTTATGGAAT | CAG | chr12 | 21593781 | 21593800 | 21593784 | - |
| SEQ ID NO 18234 | CCTTGTCTGGTTATGGAATC | AGG | chr12 | 21593780 | 21593799 | 21593783 | - |
| SEQ ID NO 18235 | TTATGGAATCAGGATAATAC | TGG | chr12 | 21593770 | 21593789 | 21593773 | - |
| SEQ ID NO 18236 | AATCAGGATAATACTGGCCT | CAG | chr12 | 21593764 | 21593783 | 21593767 | - |
| SEQ ID NO 18237 | TCAGGATAATACTGGCCTCA | GAG | chr12 | 21593762 | 21593781 | 21593765 | - |
| SEQ ID NO 18238 | TAATACTGGCCTCAGAGAAT | GAG | chr12 | 21593756 | 21593775 | 21593759 | - |
| SEQ ID NO 18239 | ACTGGCCTCAGAGAATGAGT | TAG | chr12 | 21593752 | 21593771 | 21593755 | - |
| SEQ ID NO 18240 | CTGGCCTCAGAGAATGAGTT | AGG | chr12 | 21593751 | 21593770 | 21593754 | - |
| SEQ ID NO 18241 | TGGCCTCAGAGAATGAGTTA | GGG | chr12 | 21593750 | 21593769 | 21593753 | - |
| SEQ ID NO 18242 | GCCTCAGAGAATGAGTTAGG | GAG | chr12 | 21593748 | 21593767 | 21593751 | - |
| SEQ ID NO 18243 | CCTTCCTGTTTAATTTTTAA | AAG | chr12 | 21593721 | 21593740 | 21593724 | - |
| SEQ ID NO 18244 | TTTAATTTTTAAAAGAATTT | AAG | chr12 | 21593713 | 21593732 | 21593716 | - |
| SEQ ID NO 18245 | TTAATTTTTAAAAGAATTTA | AGG | chr12 | 21593712 | 21593731 | 21593715 | - |
| SEQ ID NO 18246 | AATTTTTAAAAGAATTTAAG | GAG | chr12 | 21593710 | 21593729 | 21593713 | - |
| SEQ ID NO 18247 | AAGAATTTAAGGAGACTTGT | TAG | chr12 | 21593701 | 21593720 | 21593704 | - |
| SEQ ID NO 18248 | GACTTGTTAGTTTTCTTTGA | AAG | chr12 | 21593688 | 21593707 | 21593691 | - |
| SEQ ID NO 18249 | GTTAGTTTTCTTTGAAAGTT | TGG | chr12 | 21593683 | 21593702 | 21593686 | - |
| SEQ ID NO 18250 | GAAAGTTTGGTAAAATTTGA | CAG | chr12 | 21593670 | 21593689 | 21593673 | - |
| SEQ ID NO 18251 | TTTGGTAAAATTTGACAGTA | AAG | chr12 | 21593665 | 21593684 | 21593668 | - |
| SEQ ID NO 18252 | AATTTGACAGTAAAGCCATC | TGG | chr12 | 21593657 | 21593676 | 21593660 | - |
| SEQ ID NO 18253 | GGTCTTGAAATTTTCTTTTT | TGG | chr12 | 21593636 | 21593655 | 21593639 | - |
| SEQ ID NO 18254 | GTCTTGAAATTTTCTTTTTT | GGG | chr12 | 21593635 | 21593654 | 21593638 | - |
| SEQ ID NO 18255 | CTTGAAATTTTCTTTTTTGG | GAG | chr12 | 21593633 | 21593652 | 21593636 | - |
| SEQ ID NO 18256 | TCAATTTCATTATTCATTAC | TGG | chr12 | 21593594 | 21593613 | 21593597 | - |
| SEQ ID NO 18257 | TTATTCATTACTGGTCTGTT | CAG | chr12 | 21593585 | 21593604 | 21593588 | - |
| SEQ ID NO 18258 | TATTCATTACTGGTCTGTTC | AGG | chr12 | 21593584 | 21593603 | 21593587 | - |
| SEQ ID NO 18259 | ATTCTTTCTTAATTCAATCT | TGG | chr12 | 21593555 | 21593574 | 21593558 | - |
| SEQ ID NO 18260 | CTTTCTTAATTCAATCTTGG | TAG | chr12 | 21593552 | 21593571 | 21593555 | - |
| SEQ ID NO 18261 | TTTCTTAATTCAATCTTGGT | AGG | chr12 | 21593551 | 21593570 | 21593554 | - |
| SEQ ID NO 18262 | CTTAATTCAATCTTGGTAGG | TGG | chr12 | 21593548 | 21593567 | 21593551 | - |
| SEQ ID NO 18263 | CTTGGTAGGTGGTATGTGTC | CAG | chr12 | 21593537 | 21593556 | 21593540 | - |
| SEQ ID NO 18264 | AGAAATTTATTAATTTCCTC | TAG | chr12 | 21593516 | 21593535 | 21593519 | - |
| SEQ ID NO 18265 | TTAATTTCCTCTAGATTTTT | CAG | chr12 | 21593507 | 21593526 | 21593510 | - |
| SEQ ID NO 18266 | CTCTAGATTTTTCAGTTTTT | TAG | chr12 | 21593499 | 21593518 | 21593502 | - |
| SEQ ID NO 18267 | TTTTTCAGTTTTTTAGTGTA | TGG | chr12 | 21593492 | 21593511 | 21593495 | - |
| SEQ ID NO 18268 | TAGTGTATGGTTGTTCATAA | TAG | chr12 | 21593479 | 21593498 | 21593482 | - |
| SEQ ID NO 18269 | GATAATCTTTTCTATTTCTG | TGG | chr12 | 21593451 | 21593470 | 21593454 | - |
| SEQ ID NO 18270 | CTTTTCTATTTCTGTGGTAT | CGG | chr12 | 21593445 | 21593464 | 21593448 | - |

Figure 43 (Cont'd)

| | | | | | | | |
|---|---|---|---|---|---|---|---|
| SEQ ID NO 18271 | ATTTCTGATTTTCTTTATTT | CAG | chr12 | 21593401 | 21593420 | 21593404 | - |
| SEQ ID NO 18272 | TCAGTCTCTTCTCTTTTTCT | TGG | chr12 | 21593382 | 21593401 | 21593385 | - |
| SEQ ID NO 18273 | TCTCTTCTCTTTTTCTTGGT | TAG | chr12 | 21593378 | 21593397 | 21593381 | - |
| SEQ ID NO 18274 | TCTCTTTTTCTTGGTTAGTC | TAG | chr12 | 21593373 | 21593392 | 21593376 | - |
| SEQ ID NO 18275 | TTTTTCTTGGTTAGTCTAGC | TAG | chr12 | 21593369 | 21593388 | 21593372 | - |
| SEQ ID NO 18276 | TTTCTTGGTTAGTCTAGCTA | GAG | chr12 | 21593367 | 21593386 | 21593370 | - |
| SEQ ID NO 18277 | TTGTTTTTCTCTATTTCATT | AAG | chr12 | 21593287 | 21593306 | 21593290 | - |
| SEQ ID NO 18278 | CATTTTTTCTTTCCTTCTGC | TAG | chr12 | 21593251 | 21593270 | 21593254 | - |
| SEQ ID NO 18279 | TTCTTTCCTTCTGCTAGTTT | TGG | chr12 | 21593245 | 21593264 | 21593248 | - |
| SEQ ID NO 18280 | TCTTTCCTTCTGCTAGTTTT | GGG | chr12 | 21593244 | 21593263 | 21593247 | - |
| SEQ ID NO 18281 | GGGTTTTGTTCTTGCTTTTC | TAG | chr12 | 21593224 | 21593243 | 21593227 | - |
| SEQ ID NO 18282 | TCTTGCTTTTCTAGCTTGTT | GAG | chr12 | 21593215 | 21593234 | 21593218 | - |
| SEQ ID NO 18283 | CTTGCTTTTCTAGCTTGTTG | AGG | chr12 | 21593214 | 21593233 | 21593217 | - |
| SEQ ID NO 18284 | AGCTTGTTGAGGTACATGAT | TAG | chr12 | 21593203 | 21593222 | 21593206 | - |
| SEQ ID NO 18285 | TCTTTCTATGTTTTTAATTT | AAG | chr12 | 21593165 | 21593184 | 21593168 | - |
| SEQ ID NO 18286 | TAATTTAAGTGTTTATTGAT | AAG | chr12 | 21593151 | 21593170 | 21593154 | - |
| SEQ ID NO 18287 | TTATTGATAAGCTTCTCTCT | TAG | chr12 | 21593139 | 21593158 | 21593142 | - |
| SEQ ID NO 18288 | ACTGCTTTTGCTGTATCCCA | TGG | chr12 | 21593115 | 21593134 | 21593118 | - |
| SEQ ID NO 18289 | TTCTTGACATAACGTTCATT | CAG | chr12 | 21593026 | 21593045 | 21593029 | - |
| SEQ ID NO 18290 | TCTTGACATAACGTTCATTC | AGG | chr12 | 21593025 | 21593044 | 21593028 | - |
| SEQ ID NO 18291 | TTGACATAACGTTCATTCAG | GAG | chr12 | 21593023 | 21593042 | 21593026 | - |
| SEQ ID NO 18292 | TTAATTTCCATGTATTTGTA | TAG | chr12 | 21592992 | 21593011 | 21592995 | - |
| SEQ ID NO 18293 | TAATTTCCATGTATTTGTAT | AGG | chr12 | 21592991 | 21593010 | 21592994 | - |
| SEQ ID NO 18294 | ATGTATTTGTATAGGTTTTA | AAG | chr12 | 21592983 | 21593002 | 21592986 | - |
| SEQ ID NO 18295 | TTTTTCTTGTTATTGATTTC | TAG | chr12 | 21592960 | 21592979 | 21592963 | - |
| SEQ ID NO 18296 | TTTCTAGTTTTATTCCATTG | TGG | chr12 | 21592944 | 21592963 | 21592947 | - |
| SEQ ID NO 18297 | GTTTTATTCCATTGTGGTCT | GAG | chr12 | 21592938 | 21592957 | 21592941 | - |
| SEQ ID NO 18298 | TTATTCCATTGTGGTCTGAG | AAG | chr12 | 21592935 | 21592954 | 21592938 | - |
| SEQ ID NO 18299 | TGATTTCAAATATTTCAAAT | TAG | chr12 | 21592902 | 21592921 | 21592905 | - |
| SEQ ID NO 18300 | TCAAATATTTCAAATTAGTT | GAG | chr12 | 21592897 | 21592916 | 21592900 | - |
| SEQ ID NO 18301 | TTCTTTTGTGTTCTAACATA | TGG | chr12 | 21592872 | 21592891 | 21592875 | - |
| SEQ ID NO 18302 | TTCTAACATATGGTGTATCC | TGG | chr12 | 21592862 | 21592881 | 21592865 | - |
| SEQ ID NO 18303 | TCTAACATATGGTGTATCCT | GGG | chr12 | 21592861 | 21592880 | 21592864 | - |
| SEQ ID NO 18304 | CTAACATATGGTGTATCCTG | GGG | chr12 | 21592860 | 21592879 | 21592863 | - |
| SEQ ID NO 18305 | GGAATGCGTCATGTGCTGAT | GAG | chr12 | 21592839 | 21592858 | 21592842 | - |
| SEQ ID NO 18306 | GATGAGATAAATATATTCTG | TAG | chr12 | 21592822 | 21592841 | 21592825 | - |
| SEQ ID NO 18307 | TAAATATATTCTGTAGCTGT | TGG | chr12 | 21592815 | 21592834 | 21592818 | - |
| SEQ ID NO 18308 | ATGAAATATTGTGTAAATGT | TAG | chr12 | 21592792 | 21592811 | 21592795 | - |
| SEQ ID NO 18309 | GTGTAAATGTTAGATCCATT | TGG | chr12 | 21592782 | 21592801 | 21592785 | - |
| SEQ ID NO 18310 | TGTTAGATCCATTTGGTCTA | AAG | chr12 | 21592775 | 21592794 | 21592778 | - |
| SEQ ID NO 18311 | GATCCATTTGGTCTAAAGTC | AAG | chr12 | 21592770 | 21592789 | 21592773 | - |
| SEQ ID NO 18312 | TTCTTTGTTAATTTTCTGTC | TAG | chr12 | 21592733 | 21592752 | 21592736 | - |
| SEQ ID NO 18313 | TAGATGATCTATCTGATGCT | GAG | chr12 | 21592713 | 21592732 | 21592716 | - |
| SEQ ID NO 18314 | GATCTATCTGATGCTGAGAT | TAG | chr12 | 21592708 | 21592727 | 21592711 | - |
| SEQ ID NO 18315 | ATCCCCAACTATTATTGTAT | TGG | chr12 | 21592676 | 21592695 | 21592679 | - |
| SEQ ID NO 18316 | TAACATTTGCTTTACATATC | TGG | chr12 | 21592628 | 21592647 | 21592631 | - |
| SEQ ID NO 18317 | CTTTACATATCTGGATGCTC | TGG | chr12 | 21592619 | 21592638 | 21592622 | - |

Figure 43 (Cont'd)

| | | | | | | | |
|---|---|---|---|---|---|---|---|
| SEQ ID NO 18318 | TATCTGGATGCTCTGGTGTT | GAG | chr12 | 21592612 | 21592631 | 21592615 | - |
| SEQ ID NO 18319 | TGGTGTTGAGTGTGAATGTT | TAG | chr12 | 21592599 | 21592618 | 21592602 | - |
| SEQ ID NO 18320 | ATGTAATGACTTTTGTCTCT | TAG | chr12 | 21592536 | 21592555 | 21592539 | - |
| SEQ ID NO 18321 | CTCTTAGTGTTTTTTATTTA | AAG | chr12 | 21592520 | 21592539 | 21592523 | - |
| SEQ ID NO 18322 | AAAGTCAATTTTATCTGTTA | TAG | chr12 | 21592501 | 21592520 | 21592504 | - |
| SEQ ID NO 18323 | AAGTCAATTTTATCTGTTAT | AGG | chr12 | 21592500 | 21592519 | 21592503 | - |
| SEQ ID NO 18324 | TAACTACTTTTGCTCATTTT | TGG | chr12 | 21592475 | 21592494 | 21592478 | - |
| SEQ ID NO 18325 | ATTTTTGGTTTCTCTTTGTA | TGG | chr12 | 21592460 | 21592479 | 21592463 | - |
| SEQ ID NO 18326 | TTTGGTTTCTCTTTGTATGG | AAG | chr12 | 21592457 | 21592476 | 21592460 | - |
| SEQ ID NO 18327 | ATCTTTCATCTTTTTACTTT | CAG | chr12 | 21592434 | 21592453 | 21592437 | - |
| SEQ ID NO 18328 | CAGTCTATATTTATCTTTAC | AAG | chr12 | 21592414 | 21592433 | 21592417 | - |
| SEQ ID NO 18329 | CTATATTTATCTTTACAAGT | GAG | chr12 | 21592410 | 21592429 | 21592413 | - |
| SEQ ID NO 18330 | TTTATCTTTACAAGTGAGAT | AAG | chr12 | 21592405 | 21592424 | 21592408 | - |
| SEQ ID NO 18331 | CAAGTGAGATAAGTTTCTTA | TAG | chr12 | 21592395 | 21592414 | 21592398 | - |
| SEQ ID NO 18332 | AAGTGAGATAAGTTTCTTAT | AGG | chr12 | 21592394 | 21592413 | 21592397 | - |
| SEQ ID NO 18333 | TGAGATAAGTTTCTTATAGG | CAG | chr12 | 21592391 | 21592410 | 21592394 | - |
| SEQ ID NO 18334 | TCTTATAGGCAGCTTACAAC | TGG | chr12 | 21592380 | 21592399 | 21592383 | - |
| SEQ ID NO 18335 | CTTATAGGCAGCTTACAACT | GGG | chr12 | 21592379 | 21592398 | 21592382 | - |
| SEQ ID NO 18336 | ATTTTTGTTTTAAATCTATT | TAG | chr12 | 21592352 | 21592371 | 21592355 | - |
| SEQ ID NO 18337 | TTGTTTTAAATCTATTTAGC | CAG | chr12 | 21592348 | 21592367 | 21592351 | - |
| SEQ ID NO 18338 | TTAGCCAGTCTATATCTTTC | AAG | chr12 | 21592333 | 21592352 | 21592336 | - |
| SEQ ID NO 18339 | AATTTAATCCATTTACATGC | AAG | chr12 | 21592306 | 21592325 | 21592309 | - |
| SEQ ID NO 18340 | ATTTAATCCATTTACATGCA | AGG | chr12 | 21592305 | 21592324 | 21592308 | - |
| SEQ ID NO 18341 | CAAGGCTATTATTGACATGT | GAG | chr12 | 21592287 | 21592306 | 21592290 | - |
| SEQ ID NO 18342 | AGGCTATTATTGACATGTGA | GAG | chr12 | 21592285 | 21592304 | 21592288 | - |
| SEQ ID NO 18343 | CCATTTTGTTAATTGATTCC | TGG | chr12 | 21592252 | 21592271 | 21592255 | - |
| SEQ ID NO 18344 | TGGTTGTTTTGTTTTTTTTT | TAG | chr12 | 21592232 | 21592251 | 21592235 | - |
| SEQ ID NO 18345 | TTTCTTATTATTTATGATTG | TGG | chr12 | 21592127 | 21592146 | 21592130 | - |
| SEQ ID NO 18346 | TATTATTTATGATTGTGGTT | TGG | chr12 | 21592122 | 21592141 | 21592125 | - |
| SEQ ID NO 18347 | TGTGGTTTGGTGATTTTCTG | TAG | chr12 | 21592109 | 21592128 | 21592112 | - |
| SEQ ID NO 18348 | GGTTTGGTGATTTTCTGTAG | TGG | chr12 | 21592106 | 21592125 | 21592109 | - |
| SEQ ID NO 18349 | TTTCTGTAGTGGTAACGTTT | GAG | chr12 | 21592095 | 21592114 | 21592098 | - |
| SEQ ID NO 18350 | TTATTTGTGTTTTGCTCTAC | CAG | chr12 | 21592059 | 21592078 | 21592062 | - |
| SEQ ID NO 18351 | TTGTGTTTTGCTCTACCAGT | TAG | chr12 | 21592055 | 21592074 | 21592058 | - |
| SEQ ID NO 18352 | ACCTTTGTGTGTCTTCATAA | TGG | chr12 | 21592026 | 21592045 | 21592029 | - |
| SEQ ID NO 18353 | TTTGTGTGTCTTCATAATGG | CAG | chr12 | 21592023 | 21592042 | 21592026 | - |
| SEQ ID NO 18354 | TGTCCTGTCACTTTCATGTG | TAG | chr12 | 21592000 | 21592019 | 21592003 | - |
| SEQ ID NO 18355 | GTCCTGTCACTTTCATGTGT | AGG | chr12 | 21591999 | 21592018 | 21592002 | - |
| SEQ ID NO 18356 | TCCCTTAAATATTTCTTGTA | AAG | chr12 | 21591974 | 21591993 | 21591977 | - |
| SEQ ID NO 18357 | TTAAATATTTCTTGTAAAGC | CAG | chr12 | 21591970 | 21591989 | 21591973 | - |
| SEQ ID NO 18358 | TATTTCTTGTAAAGCCAGTC | TAG | chr12 | 21591965 | 21591984 | 21591968 | - |
| SEQ ID NO 18359 | TTGTAAAGCCAGTCTAGTGA | TAG | chr12 | 21591959 | 21591978 | 21591962 | - |
| SEQ ID NO 18360 | TCCTTCAAATTTTCTTGCC | CAG | chr12 | 21591931 | 21591950 | 21591934 | - |
| SEQ ID NO 18361 | CAAATTTTCTTGCCCAGAA | AAG | chr12 | 21591926 | 21591945 | 21591929 | - |
| SEQ ID NO 18362 | TTATTATCCTTCATTTTTG | AAG | chr12 | 21591900 | 21591919 | 21591903 | - |
| SEQ ID NO 18363 | TTTTTGAAGAACAATGTTGC | TGG | chr12 | 21591886 | 21591905 | 21591889 | - |
| SEQ ID NO 18364 | TTTTGAAGAACAATGTTGCT | GGG | chr12 | 21591885 | 21591904 | 21591888 | - |

Figure 43 (Cont'd)

| | | | | | | | |
|---|---|---|---|---|---|---|---|
| SEQ ID NO 18365 | GTTGCTGGGTATAACATCCT | TGG | chr12 | 21591871 | 21591890 | 21591874 | - |
| SEQ ID NO 18366 | TATATCATCCCATCTTCTCC | TGG | chr12 | 21591820 | 21591839 | 21591823 | - |
| SEQ ID NO 18367 | CCCATCTTCTCCTGGCCTGT | GAG | chr12 | 21591812 | 21591831 | 21591815 | - |
| SEQ ID NO 18368 | CCATCTTCTCCTGGCCTGTG | AGG | chr12 | 21591811 | 21591830 | 21591814 | - |
| SEQ ID NO 18369 | TGGCCTGTGAGGTTTCTGCT | GAG | chr12 | 21591800 | 21591819 | 21591803 | - |
| SEQ ID NO 18370 | CTGTTAATCTGTTAATCTTG | TGG | chr12 | 21591770 | 21591789 | 21591773 | - |
| SEQ ID NO 18371 | TTAATCTGTTAATCTTGTGG | AAG | chr12 | 21591767 | 21591786 | 21591770 | - |
| SEQ ID NO 18372 | TCTTGTGGAAGTTCCCTTAT | AAG | chr12 | 21591755 | 21591774 | 21591758 | - |
| SEQ ID NO 18373 | GAAGTTCCCTTATAAGTGAC | TAG | chr12 | 21591748 | 21591767 | 21591751 | - |
| SEQ ID NO 18374 | AGACATTTTGCTTGCTGTTT | TAG | chr12 | 21591727 | 21591746 | 21591730 | - |
| SEQ ID NO 18375 | ACATTTTGCTTGCTGTTTTA | GAG | chr12 | 21591725 | 21591744 | 21591728 | - |
| SEQ ID NO 18376 | GTTTTAGAGTTCTTACTCTT | TGG | chr12 | 21591711 | 21591730 | 21591714 | - |
| SEQ ID NO 18377 | TCTTACTCTTTGGCTTTTGA | CAG | chr12 | 21591701 | 21591720 | 21591704 | - |
| SEQ ID NO 18378 | AGTTTGACTATAATGTGCTG | TGG | chr12 | 21591680 | 21591699 | 21591683 | - |
| SEQ ID NO 18379 | TTTGACTATAATGTGCTGTG | GAG | chr12 | 21591678 | 21591697 | 21591681 | - |
| SEQ ID NO 18380 | GACTATAATGTGCTGTGGAG | AAG | chr12 | 21591675 | 21591694 | 21591678 | - |
| SEQ ID NO 18381 | CTATAATGTGCTGTGGAGAA | GAG | chr12 | 21591673 | 21591692 | 21591676 | - |
| SEQ ID NO 18382 | GCTTTTGCATTATATTATT | TGG | chr12 | 21591651 | 21591670 | 21591654 | - |
| SEQ ID NO 18383 | CTTTTTGCATTATATTATTT | GGG | chr12 | 21591650 | 21591669 | 21591653 | - |
| SEQ ID NO 18384 | ATTTCTGATTTTCATTTGTC | TGG | chr12 | 21591626 | 21591645 | 21591629 | - |
| SEQ ID NO 18385 | TGGATGTCTACATTTCTTGC | TAG | chr12 | 21591606 | 21591625 | 21591609 | - |
| SEQ ID NO 18386 | CATTTCTTGCTAGACTTGAC | AAG | chr12 | 21591596 | 21591615 | 21591599 | - |
| SEQ ID NO 18387 | TGCTAGACTTGACAAGTTTT | CAG | chr12 | 21591589 | 21591608 | 21591592 | - |
| SEQ ID NO 18388 | TCAGCTATTGTGTTGTTACG | TAG | chr12 | 21591570 | 21591589 | 21591573 | - |
| SEQ ID NO 18389 | CAGCTATTGTGTTGTTACGT | AGG | chr12 | 21591569 | 21591588 | 21591572 | - |
| SEQ ID NO 18390 | TTCATGTTCTCTTTACCTTC | TGG | chr12 | 21591534 | 21591553 | 21591537 | - |
| SEQ ID NO 18391 | TCATGTTCTCTTTACCTTCT | GGG | chr12 | 21591533 | 21591552 | 21591536 | - |
| SEQ ID NO 18392 | TTGAATATTTGTTCACTTTA | TAG | chr12 | 21591499 | 21591518 | 21591502 | - |
| SEQ ID NO 18393 | TTTCCTTTCTATCATTTGAC | CAG | chr12 | 21591438 | 21591457 | 21591441 | - |
| SEQ ID NO 18394 | ATTTGACCAGCTAATTTTAA | AAG | chr12 | 21591425 | 21591444 | 21591428 | - |
| SEQ ID NO 18395 | ATTTTAAAAGACCTGTCTTC | AAG | chr12 | 21591412 | 21591431 | 21591415 | - |
| SEQ ID NO 18396 | CTTGATCTGATCTATTGTTG | AAG | chr12 | 21591370 | 21591389 | 21591373 | - |
| SEQ ID NO 18397 | ATTTCTTCAATAAACTCTT | CAG | chr12 | 21591329 | 21591348 | 21591332 | - |
| SEQ ID NO 18398 | TTCAATAAACTCTTCAGTTA | CAG | chr12 | 21591323 | 21591342 | 21591326 | - |
| SEQ ID NO 18399 | TCAGTTACAGAATTTCTGTT | TGG | chr12 | 21591310 | 21591329 | 21591313 | - |
| SEQ ID NO 18400 | TTCTTGTTGTATCTATCTCT | TGG | chr12 | 21591283 | 21591302 | 21591286 | - |
| SEQ ID NO 18401 | TCTTGTTGTATCTATCTCTT | GGG | chr12 | 21591282 | 21591301 | 21591285 | - |
| SEQ ID NO 18402 | TTTCTTTTTATTGTTTATCT | GAG | chr12 | 21591223 | 21591242 | 21591226 | - |
| SEQ ID NO 18403 | GAGTTCTCTTGTGTCTCACT | GAG | chr12 | 21591203 | 21591222 | 21591206 | - |
| SEQ ID NO 18404 | CTTCCTTAATATCAACATTT | TGG | chr12 | 21591180 | 21591199 | 21591183 | - |
| SEQ ID NO 18405 | ACATTTTGGATTCTTTTTTC | CAG | chr12 | 21591166 | 21591185 | 21591169 | - |
| SEQ ID NO 18406 | TAAATGTCTTTTTTTTCCAC | TGG | chr12 | 21591136 | 21591155 | 21591139 | - |
| SEQ ID NO 18407 | TCCACTGGCTTATGTTGCTG | AAG | chr12 | 21591121 | 21591140 | 21591124 | - |
| SEQ ID NO 18408 | GAAGAATTATTAAATTCCTT | TGG | chr12 | 21591102 | 21591121 | 21591105 | - |
| SEQ ID NO 18409 | GAATTATTAAATTCCTTTGG | AAG | chr12 | 21591099 | 21591118 | 21591102 | - |
| SEQ ID NO 18410 | TGCATTGATATCTCTGCATC | TGG | chr12 | 21591038 | 21591057 | 21591041 | - |
| SEQ ID NO 18411 | GGTGTAATGATTGCTGCTTC | CAG | chr12 | 21591017 | 21591036 | 21591020 | - |

Figure 43 (Cont'd)

| SEQ ID NO 18412 | GTTTTGTAAATTTGTTTTTG | TAG | chr12 | 21590995 | 21591014 | 21590998 | - |
| SEQ ID NO 18413 | TTTTGTAAATTTGTTTTTGT | AGG | chr12 | 21590994 | 21591013 | 21590997 | - |
| SEQ ID NO 18414 | TTTGTAAATTTGTTTTTGTA | GGG | chr12 | 21590993 | 21591012 | 21590996 | - |
| SEQ ID NO 18415 | TTGTAAATTTGTTTTTGTAG | GGG | chr12 | 21590992 | 21591011 | 21590995 | - |
| SEQ ID NO 18416 | TAAATTTGTTTTTGTAGGGG | AAG | chr12 | 21590989 | 21591008 | 21590992 | - |
| SEQ ID NO 18417 | TAGGGGAAGACTTTTTCTG | AAG | chr12 | 21590975 | 21590994 | 21590978 | - |
| SEQ ID NO 18418 | TTTTTTCTGAAGATGTATCT | TGG | chr12 | 21590964 | 21590983 | 21590967 | - |
| SEQ ID NO 18419 | GATGTATCTTGGTGTTGATT | GAG | chr12 | 21590953 | 21590972 | 21590956 | - |
| SEQ ID NO 18420 | GTATCTTGGTGTTGATTGAG | TAG | chr12 | 21590950 | 21590969 | 21590953 | - |
| SEQ ID NO 18421 | TATCTTGGTGTTGATTGAGT | AGG | chr12 | 21590949 | 21590968 | 21590952 | - |
| SEQ ID NO 18422 | ATCTTGGTGTTGATTGAGTA | GGG | chr12 | 21590948 | 21590967 | 21590951 | - |
| SEQ ID NO 18423 | GGCACTTTGATTTTGATTTC | TAG | chr12 | 21590927 | 21590946 | 21590930 | - |
| SEQ ID NO 18424 | GCACTTTGATTTTGATTTCT | AGG | chr12 | 21590926 | 21590945 | 21590929 | - |
| SEQ ID NO 18425 | TTTTGATTTCTAGGTGCATA | CAG | chr12 | 21590917 | 21590936 | 21590920 | - |
| SEQ ID NO 18426 | TGATTTCTAGGTGCATACAG | CAG | chr12 | 21590914 | 21590933 | 21590917 | - |
| SEQ ID NO 18427 | TCTAGGTGCATACAGCAGCA | TAG | chr12 | 21590909 | 21590928 | 21590912 | - |
| SEQ ID NO 18428 | GTCTTCATATTATTTTTTTT | CAG | chr12 | 21590887 | 21590906 | 21590890 | - |
| SEQ ID NO 18429 | TATTTTTTTTCAGCTGCCAA | CAG | chr12 | 21590877 | 21590896 | 21590880 | - |
| SEQ ID NO 18430 | TCAGCTGCCAACAGTATCAT | CAG | chr12 | 21590868 | 21590887 | 21590871 | - |
| SEQ ID NO 18431 | ATCAGTGTCTGTGATTTTTT | CAG | chr12 | 21590850 | 21590869 | 21590853 | - |
| SEQ ID NO 18432 | AGTGTCTGTGATTTTTTCAG | TGG | chr12 | 21590847 | 21590866 | 21590850 | - |
| SEQ ID NO 18433 | CTGTGATTTTTTCAGTGGCT | TAG | chr12 | 21590842 | 21590861 | 21590845 | - |
| SEQ ID NO 18434 | TGTGATTTTTTCAGTGGCTT | AGG | chr12 | 21590841 | 21590860 | 21590844 | - |
| SEQ ID NO 18435 | GTGATTTTTTCAGTGGCTTA | GGG | chr12 | 21590840 | 21590859 | 21590843 | - |
| SEQ ID NO 18436 | GTGGCTTAGGGTGCATTTGT | TAG | chr12 | 21590828 | 21590847 | 21590831 | - |
| SEQ ID NO 18437 | TTAGGGTGCATTTGTTAGTG | AAG | chr12 | 21590823 | 21590842 | 21590826 | - |
| SEQ ID NO 18438 | TAGGGTGCATTTGTTAGTGA | AGG | chr12 | 21590822 | 21590841 | 21590825 | - |
| SEQ ID NO 18439 | GGTGCATTTGTTAGTGAAGG | TGG | chr12 | 21590819 | 21590838 | 21590822 | - |
| SEQ ID NO 18440 | TTGTTAGTGAAGGTGGTGAT | GAG | chr12 | 21590812 | 21590831 | 21590815 | - |
| SEQ ID NO 18441 | TGTTAGTGAAGGTGGTGATG | AGG | chr12 | 21590811 | 21590830 | 21590814 | - |
| SEQ ID NO 18442 | AGGTGGTGATGAGGTTGTGC | TGG | chr12 | 21590802 | 21590821 | 21590805 | - |
| SEQ ID NO 18443 | GTGGTGATGAGGTTGTGCTG | GAG | chr12 | 21590800 | 21590819 | 21590803 | - |
| SEQ ID NO 18444 | GATGAGGTTGTGCTGGAGAC | AAG | chr12 | 21590795 | 21590814 | 21590798 | - |
| SEQ ID NO 18445 | GTGCTGGAGACAAGAATATC | AAG | chr12 | 21590786 | 21590805 | 21590789 | - |
| SEQ ID NO 18446 | CTGGAGACAAGAATATCAAG | TGG | chr12 | 21590783 | 21590802 | 21590786 | - |
| SEQ ID NO 18447 | TGGAGACAAGAATATCAAGT | GGG | chr12 | 21590782 | 21590801 | 21590785 | - |
| SEQ ID NO 18448 | GACAAGAATATCAAGTGGGC | CAG | chr12 | 21590778 | 21590797 | 21590781 | - |
| SEQ ID NO 18449 | ATATCAAGTGGGCCAGTCCT | TGG | chr12 | 21590771 | 21590790 | 21590774 | - |
| SEQ ID NO 18450 | AGTGGGCCAGTCCTTGGCCC | CAG | chr12 | 21590765 | 21590784 | 21590768 | - |
| SEQ ID NO 18451 | GGGCCAGTCCTTGGCCCCAG | TGG | chr12 | 21590762 | 21590781 | 21590765 | - |
| SEQ ID NO 18452 | CCAGTCCTTGGCCCCAGTGG | TGG | chr12 | 21590759 | 21590778 | 21590762 | - |
| SEQ ID NO 18453 | GTCCTTGGCCCCAGTGGTGG | TGG | chr12 | 21590756 | 21590775 | 21590759 | - |
| SEQ ID NO 18454 | CTTGGCCCCAGTGGTGGTGG | TGG | chr12 | 21590753 | 21590772 | 21590756 | - |
| SEQ ID NO 18455 | TTGGCCCCAGTGGTGGTGGT | GGG | chr12 | 21590752 | 21590771 | 21590755 | - |
| SEQ ID NO 18456 | CCCAGTGGTGGTGGTGGGCC | TAG | chr12 | 21590747 | 21590766 | 21590750 | - |
| SEQ ID NO 18457 | GGGCCTAGCATTCCTGTCCT | TGG | chr12 | 21590732 | 21590751 | 21590735 | - |
| SEQ ID NO 18458 | GGCCTAGCATTCCTGTCCTT | GGG | chr12 | 21590731 | 21590750 | 21590734 | - |

Figure 43 (Cont'd)

| | | | | | | | |
|---|---|---|---|---|---|---|---|
| SEQ ID NO 18459 | ATTCCTGTCCTTGGGCCCCA | TGG | chr12 | 21590723 | 21590742 | 21590726 | - |
| SEQ ID NO 18460 | GGCCCCATGGCTGTGTACAT | TGG | chr12 | 21590710 | 21590729 | 21590713 | - |
| SEQ ID NO 18461 | GCTGTGTACATTGGCACTGA | TGG | chr12 | 21590701 | 21590720 | 21590704 | - |
| SEQ ID NO 18462 | ACATTGGCACTGATGGTAAT | GAG | chr12 | 21590694 | 21590713 | 21590697 | - |
| SEQ ID NO 18463 | GGCACTGATGGTAATGAGTC | TAG | chr12 | 21590689 | 21590708 | 21590692 | - |
| SEQ ID NO 18464 | CTGATGGTAATGAGTCTAGT | TGG | chr12 | 21590685 | 21590704 | 21590688 | - |
| SEQ ID NO 18465 | TGATGGTAATGAGTCTAGTT | GGG | chr12 | 21590684 | 21590703 | 21590687 | - |
| SEQ ID NO 18466 | GTCTAGTTGGGTTGATTCTT | TGG | chr12 | 21590672 | 21590691 | 21590675 | - |
| SEQ ID NO 18467 | TGGGTTGATTCTTTGGCCTT | CAG | chr12 | 21590665 | 21590684 | 21590668 | - |
| SEQ ID NO 18468 | GGGTTGATTCTTTGGCCTTC | AGG | chr12 | 21590664 | 21590683 | 21590667 | - |
| SEQ ID NO 18469 | TTGATTCTTTGGCCTTCAGG | CAG | chr12 | 21590661 | 21590680 | 21590664 | - |
| SEQ ID NO 18470 | TGGCCTTCAGGCAGTTTGCT | TGG | chr12 | 21590652 | 21590671 | 21590655 | - |
| SEQ ID NO 18471 | GGCCTTCAGGCAGTTTGCTT | GGG | chr12 | 21590651 | 21590670 | 21590654 | - |
| SEQ ID NO 18472 | CAGGCAGTTTGCTTGGGTGT | CAG | chr12 | 21590645 | 21590664 | 21590648 | - |
| SEQ ID NO 18473 | GCAGTTTGCTTGGGTGTCAG | TAG | chr12 | 21590642 | 21590661 | 21590645 | - |
| SEQ ID NO 18474 | GTTTGCTTGGGTGTCAGTAG | TGG | chr12 | 21590639 | 21590658 | 21590642 | - |
| SEQ ID NO 18475 | TTGGGTGTCAGTAGTGGCCA | TAG | chr12 | 21590633 | 21590652 | 21590636 | - |
| SEQ ID NO 18476 | GGTGTCAGTAGTGGCCATAG | TAG | chr12 | 21590630 | 21590649 | 21590633 | - |
| SEQ ID NO 18477 | CAGTAGTGGCCATAGTAGAC | TGG | chr12 | 21590625 | 21590644 | 21590628 | - |
| SEQ ID NO 18478 | AGTAGTGGCCATAGTAGACT | GGG | chr12 | 21590624 | 21590643 | 21590627 | - |
| SEQ ID NO 18479 | GTGGCCATAGTAGACTGGGC | TGG | chr12 | 21590620 | 21590639 | 21590623 | - |
| SEQ ID NO 18480 | TAGTAGACTGGGCTGGTGTG | TGG | chr12 | 21590613 | 21590632 | 21590616 | - |
| SEQ ID NO 18481 | AGTAGACTGGGCTGGTGTGT | GGG | chr12 | 21590612 | 21590631 | 21590615 | - |
| SEQ ID NO 18482 | TGGGCTGGTGTGTGGGTCCT | CAG | chr12 | 21590605 | 21590624 | 21590608 | - |
| SEQ ID NO 18483 | GGGCTGGTGTGTGGGTCCTC | AGG | chr12 | 21590604 | 21590623 | 21590607 | - |
| SEQ ID NO 18484 | TGTGTGGGTCCTCAGGCTTC | TGG | chr12 | 21590597 | 21590616 | 21590600 | - |
| SEQ ID NO 18485 | TGGGTCCTCAGGCTTCTGGA | CAG | chr12 | 21590593 | 21590612 | 21590596 | - |
| SEQ ID NO 18486 | GTCCTCAGGCTTCTGGACAG | TGG | chr12 | 21590590 | 21590609 | 21590593 | - |
| SEQ ID NO 18487 | TCCTCAGGCTTCTGGACAGT | GGG | chr12 | 21590589 | 21590608 | 21590592 | - |
| SEQ ID NO 18488 | AGGCTTCTGGACAGTGGGTG | TGG | chr12 | 21590584 | 21590603 | 21590587 | - |
| SEQ ID NO 18489 | TCTGGACAGTGGGTGTGGTG | TGG | chr12 | 21590579 | 21590598 | 21590582 | - |
| SEQ ID NO 18490 | CTGGACAGTGGGTGTGGTGT | GGG | chr12 | 21590578 | 21590597 | 21590581 | - |
| SEQ ID NO 18491 | AGTGGGTGTGGTGTGGGTGA | TGG | chr12 | 21590572 | 21590591 | 21590575 | - |
| SEQ ID NO 18492 | TGTGGTGTGGGTGATGGCTG | TAG | chr12 | 21590566 | 21590585 | 21590569 | - |
| SEQ ID NO 18493 | GGTGATGGCTGTAGCAACTG | CAG | chr12 | 21590557 | 21590576 | 21590560 | - |
| SEQ ID NO 18494 | GTGATGGCTGTAGCAACTGC | AGG | chr12 | 21590556 | 21590575 | 21590559 | - |
| SEQ ID NO 18495 | GCAACTGCAGGACAACCCTC | TGG | chr12 | 21590544 | 21590563 | 21590547 | - |
| SEQ ID NO 18496 | AGGACAACCCTCTGGCTCCC | AAG | chr12 | 21590536 | 21590555 | 21590539 | - |
| SEQ ID NO 18497 | ACAACCCTCTGGCTCCCAAG | CAG | chr12 | 21590533 | 21590552 | 21590536 | - |
| SEQ ID NO 18498 | GGCTCCCAAGCAGTCTGCAC | TGG | chr12 | 21590523 | 21590542 | 21590526 | - |
| SEQ ID NO 18499 | CAAGCAGTCTGCACTGGTGT | TGG | chr12 | 21590517 | 21590536 | 21590520 | - |
| SEQ ID NO 18500 | GCAGTCTGCACTGGTGTTGG | TGG | chr12 | 21590514 | 21590533 | 21590517 | - |
| SEQ ID NO 18501 | GTCTGCACTGGTGTTGGTGG | TGG | chr12 | 21590511 | 21590530 | 21590514 | - |
| SEQ ID NO 18502 | CTGGTGTTGGTGGTGGCTGC | AAG | chr12 | 21590504 | 21590523 | 21590507 | - |
| SEQ ID NO 18503 | TGGTGTTGGTGGTGGCTGCA | AGG | chr12 | 21590503 | 21590522 | 21590506 | - |
| SEQ ID NO 18504 | GGTGTTGGTGGTGGCTGCAA | GGG | chr12 | 21590502 | 21590521 | 21590505 | - |
| SEQ ID NO 18505 | GGTGGCTGCAAGGGCTGAAT | GAG | chr12 | 21590493 | 21590512 | 21590496 | - |

Figure 43 (Cont'd)

| | | | | | | | |
|---|---|---|---|---|---|---|---|
| SEQ ID NO 18506 | GCTGCAAGGGCTGAATGAGC | CAG | chr12 | 21590489 | 21590508 | 21590492 | - |
| SEQ ID NO 18507 | GGGCTGAATGAGCCAGTCTT | CAG | chr12 | 21590482 | 21590501 | 21590485 | - |
| SEQ ID NO 18508 | TGAGCCAGTCTTCAGACCCA | CAG | chr12 | 21590474 | 21590493 | 21590477 | - |
| SEQ ID NO 18509 | GAGCCAGTCTTCAGACCCAC | AGG | chr12 | 21590473 | 21590492 | 21590476 | - |
| SEQ ID NO 18510 | CCAGTCTTCAGACCCACAGG | TGG | chr12 | 21590470 | 21590489 | 21590473 | - |
| SEQ ID NO 18511 | AGACCCACAGGTGGCACATG | CAG | chr12 | 21590461 | 21590480 | 21590464 | - |
| SEQ ID NO 18512 | GACCCACAGGTGGCACATGC | AGG | chr12 | 21590460 | 21590479 | 21590463 | - |
| SEQ ID NO 18513 | CCCACAGGTGGCACATGCAG | GAG | chr12 | 21590458 | 21590477 | 21590461 | - |
| SEQ ID NO 18514 | CCACAGGTGGCACATGCAGG | AGG | chr12 | 21590457 | 21590476 | 21590460 | - |
| SEQ ID NO 18515 | GTGGCACATGCAGGAGGTGC | CAG | chr12 | 21590451 | 21590470 | 21590454 | - |
| SEQ ID NO 18516 | GCAGGAGGTGCCAGTTGTGA | TGG | chr12 | 21590442 | 21590461 | 21590445 | - |
| SEQ ID NO 18517 | GGAGGTGCCAGTTGTGATGG | CAG | chr12 | 21590439 | 21590458 | 21590442 | - |
| SEQ ID NO 18518 | GGTGCCAGTTGTGATGGCAG | TGG | chr12 | 21590436 | 21590455 | 21590439 | - |
| SEQ ID NO 18519 | GCCAGTTGTGATGGCAGTGG | CAG | chr12 | 21590433 | 21590452 | 21590436 | - |
| SEQ ID NO 18520 | TTGTGATGGCAGTGGCAGAT | TGG | chr12 | 21590428 | 21590447 | 21590431 | - |
| SEQ ID NO 18521 | TGTGATGGCAGTGGCAGATT | GGG | chr12 | 21590427 | 21590446 | 21590430 | - |
| SEQ ID NO 18522 | GATGGCAGTGGCAGATTGGG | TAG | chr12 | 21590424 | 21590443 | 21590427 | - |
| SEQ ID NO 18523 | ATGGCAGTGGCAGATTGGGT | AGG | chr12 | 21590423 | 21590442 | 21590426 | - |
| SEQ ID NO 18524 | AGATTGGGTAGGCCCATCAT | CAG | chr12 | 21590412 | 21590431 | 21590415 | - |
| SEQ ID NO 18525 | GATTGGGTAGGCCCATCATC | AGG | chr12 | 21590411 | 21590430 | 21590414 | - |
| SEQ ID NO 18526 | TAGGCCCATCATCAGGCTTC | TGG | chr12 | 21590404 | 21590423 | 21590407 | - |
| SEQ ID NO 18527 | AGGCCCATCATCAGGCTTCT | GGG | chr12 | 21590403 | 21590422 | 21590406 | - |
| SEQ ID NO 18528 | GCCCATCATCAGGCTTCTGG | GAG | chr12 | 21590401 | 21590420 | 21590404 | - |
| SEQ ID NO 18529 | CCCATCATCAGGCTTCTGGG | AGG | chr12 | 21590400 | 21590419 | 21590403 | - |
| SEQ ID NO 18530 | CCATCATCAGGCTTCTGGGA | GGG | chr12 | 21590399 | 21590418 | 21590402 | - |
| SEQ ID NO 18531 | AGGCTTCTGGGAGGGTTGCT | TAG | chr12 | 21590391 | 21590410 | 21590394 | - |
| SEQ ID NO 18532 | GGCTTCTGGGAGGGTTGCTT | AGG | chr12 | 21590390 | 21590409 | 21590393 | - |
| SEQ ID NO 18533 | TGGGAGGGTTGCTTAGGTAC | CAG | chr12 | 21590384 | 21590403 | 21590387 | - |
| SEQ ID NO 18534 | GGTTGCTTAGGTACCAGTCA | TGG | chr12 | 21590378 | 21590397 | 21590381 | - |
| SEQ ID NO 18535 | TGCTTAGGTACCAGTCATGG | TGG | chr12 | 21590375 | 21590394 | 21590378 | - |
| SEQ ID NO 18536 | TAGGTACCAGTCATGGTGGA | TGG | chr12 | 21590371 | 21590390 | 21590374 | - |
| SEQ ID NO 18537 | CCAGTCATGGTGGATGGCAC | AAG | chr12 | 21590365 | 21590384 | 21590368 | - |
| SEQ ID NO 18538 | CAGTCATGGTGGATGGCACA | AGG | chr12 | 21590364 | 21590383 | 21590367 | - |
| SEQ ID NO 18539 | GGATGGCACAAGGCTGTCTC | TGG | chr12 | 21590354 | 21590373 | 21590357 | - |
| SEQ ID NO 18540 | GATGGCACAAGGCTGTCTCT | GGG | chr12 | 21590353 | 21590372 | 21590356 | - |
| SEQ ID NO 18541 | CAAGGCTGTCTCTGGGTTCC | CAG | chr12 | 21590346 | 21590365 | 21590349 | - |
| SEQ ID NO 18542 | GGGTTCCCAGACAACTTGCT | TAG | chr12 | 21590333 | 21590352 | 21590336 | - |
| SEQ ID NO 18543 | GGTTCCCAGACAACTTGCTT | AGG | chr12 | 21590332 | 21590351 | 21590335 | - |
| SEQ ID NO 18544 | AGACAACTTGCTTAGGCATT | GAG | chr12 | 21590325 | 21590344 | 21590328 | - |
| SEQ ID NO 18545 | GACAACTTGCTTAGGCATTG | AGG | chr12 | 21590324 | 21590343 | 21590327 | - |
| SEQ ID NO 18546 | AACTTGCTTAGGCATTGAGG | AAG | chr12 | 21590321 | 21590340 | 21590324 | - |
| SEQ ID NO 18547 | ACTTGCTTAGGCATTGAGGA | AGG | chr12 | 21590320 | 21590339 | 21590323 | - |
| SEQ ID NO 18548 | CTTAGGCATTGAGGAAGGCA | AAG | chr12 | 21590315 | 21590334 | 21590318 | - |
| SEQ ID NO 18549 | GGCATTGAGGAAGGCAAAGC | CAG | chr12 | 21590311 | 21590330 | 21590314 | - |
| SEQ ID NO 18550 | GCATTGAGGAAGGCAAAGCC | AGG | chr12 | 21590310 | 21590329 | 21590313 | - |
| SEQ ID NO 18551 | TGAGGAAGGCAAAGCCAGGC | TGG | chr12 | 21590306 | 21590325 | 21590309 | - |
| SEQ ID NO 18552 | GAGGAAGGCAAAGCCAGGCT | GGG | chr12 | 21590305 | 21590324 | 21590308 | - |

Figure 43 (Cont'd)

| SEQ ID NO 18553 | AGGCTGGGTGTTCCTGACCT | CAG | chr12 | 21590290 | 21590309 | 21590293 | - |
| SEQ ID NO 18554 | GGCTGGGTGTTCCTGACCTC | AGG | chr12 | 21590289 | 21590308 | 21590292 | - |
| SEQ ID NO 18555 | GTTCCTGACCTCAGGCCACT | CAG | chr12 | 21590281 | 21590300 | 21590284 | - |
| SEQ ID NO 18556 | CCTGACCTCAGGCCACTCAG | TGG | chr12 | 21590278 | 21590297 | 21590281 | - |
| SEQ ID NO 18557 | AGGCCACTCAGTGGTGTGTG | TGG | chr12 | 21590269 | 21590288 | 21590272 | - |
| SEQ ID NO 18558 | TCAGTGGTGTGTGTGGACAC | CGG | chr12 | 21590262 | 21590281 | 21590265 | - |
| SEQ ID NO 18559 | TGTGTGGACACCGGCTATCA | TAG | chr12 | 21590253 | 21590272 | 21590256 | - |
| SEQ ID NO 18560 | GTGTGGACACCGGCTATCAT | AGG | chr12 | 21590252 | 21590271 | 21590255 | - |
| SEQ ID NO 18561 | GGACACCGGCTATCATAGGC | TGG | chr12 | 21590248 | 21590267 | 21590251 | - |
| SEQ ID NO 18562 | ACACCGGCTATCATAGGCTG | GAG | chr12 | 21590246 | 21590265 | 21590249 | - |
| SEQ ID NO 18563 | CCGGCTATCATAGGCTGGAG | TGG | chr12 | 21590243 | 21590262 | 21590246 | - |
| SEQ ID NO 18564 | GGCTATCATAGGCTGGAGTG | GAG | chr12 | 21590241 | 21590260 | 21590244 | - |
| SEQ ID NO 18565 | GGCTGGAGTGGAGTGATCCT | CAG | chr12 | 21590231 | 21590250 | 21590234 | - |
| SEQ ID NO 18566 | GCTGGAGTGGAGTGATCCTC | AGG | chr12 | 21590230 | 21590249 | 21590233 | - |
| SEQ ID NO 18567 | TGGAGTGATCCTCAGGCCCC | CAG | chr12 | 21590223 | 21590242 | 21590226 | - |
| SEQ ID NO 18568 | AGTGATCCTCAGGCCCCCAG | CAG | chr12 | 21590220 | 21590239 | 21590223 | - |
| SEQ ID NO 18569 | AGGCCCCCAGCAGAATGCCT | GAG | chr12 | 21590210 | 21590229 | 21590213 | - |
| SEQ ID NO 18570 | AGCAGAATGCCTGAGTGAAT | TAG | chr12 | 21590202 | 21590221 | 21590205 | - |
| SEQ ID NO 18571 | AGAATGCCTGAGTGAATTAG | CAG | chr12 | 21590199 | 21590218 | 21590202 | - |
| SEQ ID NO 18572 | GCATTGTTGCCCTGCTCTTG | AAG | chr12 | 21590171 | 21590190 | 21590174 | - |
| SEQ ID NO 18573 | CATTGTTGCCCTGCTCTTGA | AGG | chr12 | 21590170 | 21590189 | 21590173 | - |
| SEQ ID NO 18574 | ATTGTTGCCCTGCTCTTGAA | GGG | chr12 | 21590169 | 21590188 | 21590172 | - |
| SEQ ID NO 18575 | TTGTTGCCCTGCTCTTGAAG | GGG | chr12 | 21590168 | 21590187 | 21590171 | - |
| SEQ ID NO 18576 | GCCCTGCTCTTGAAGGGGTG | CGG | chr12 | 21590163 | 21590182 | 21590166 | - |
| SEQ ID NO 18577 | CCCTGCTCTTGAAGGGGTGC | GGG | chr12 | 21590162 | 21590181 | 21590165 | - |
| SEQ ID NO 18578 | CCTGCTCTTGAAGGGGTGCG | GGG | chr12 | 21590161 | 21590180 | 21590164 | - |
| SEQ ID NO 18579 | GGTGCGGGGTGTGTTGCTTT | CAG | chr12 | 21590147 | 21590166 | 21590150 | - |
| SEQ ID NO 18580 | GCGGGGTGTGTTGCTTTCAG | TGG | chr12 | 21590144 | 21590163 | 21590147 | - |
| SEQ ID NO 18581 | GGGTGTGTTGCTTTCAGTGG | CAG | chr12 | 21590141 | 21590160 | 21590144 | - |
| SEQ ID NO 18582 | TGTGTTGCTTTCAGTGGCAG | CAG | chr12 | 21590138 | 21590157 | 21590141 | - |
| SEQ ID NO 18583 | TCAGTGGCAGCAGCTATAAA | TGG | chr12 | 21590128 | 21590147 | 21590131 | - |
| SEQ ID NO 18584 | CAGTGGCAGCAGCTATAAAT | GGG | chr12 | 21590127 | 21590146 | 21590130 | - |
| SEQ ID NO 18585 | AGCAGCTATAAATGGGTTGC | TGG | chr12 | 21590120 | 21590139 | 21590123 | - |
| SEQ ID NO 18586 | AGCTATAAATGGGTTGCTGG | TGG | chr12 | 21590117 | 21590136 | 21590120 | - |
| SEQ ID NO 18587 | GCTATAAATGGGTTGCTGGT | GGG | chr12 | 21590116 | 21590135 | 21590119 | - |
| SEQ ID NO 18588 | TTGCTGGTGGGCATGTGTTT | CAG | chr12 | 21590104 | 21590123 | 21590107 | - |
| SEQ ID NO 18589 | GTGGGCATGTGTTTCAGCCC | CAG | chr12 | 21590098 | 21590117 | 21590101 | - |
| SEQ ID NO 18590 | GCATGTGTTTCAGCCCCAGA | TGG | chr12 | 21590094 | 21590113 | 21590097 | - |
| SEQ ID NO 18591 | TGTGTTTCAGCCCCAGATGG | TGG | chr12 | 21590091 | 21590110 | 21590094 | - |
| SEQ ID NO 18592 | CAGCCCCAGATGGTGGCTGC | AAG | chr12 | 21590084 | 21590103 | 21590087 | - |
| SEQ ID NO 18593 | CCCCAGATGGTGGCTGCAAG | TGG | chr12 | 21590081 | 21590100 | 21590084 | - |
| SEQ ID NO 18594 | CCCAGATGGTGGCTGCAAGT | GGG | chr12 | 21590080 | 21590099 | 21590083 | - |
| SEQ ID NO 18595 | CCAGATGGTGGCTGCAAGTG | GGG | chr12 | 21590079 | 21590098 | 21590082 | - |
| SEQ ID NO 18596 | GATGGTGGCTGCAAGTGGGG | TAG | chr12 | 21590076 | 21590095 | 21590079 | - |
| SEQ ID NO 18597 | CAAGTGGGGTAGCATTTTCT | TAG | chr12 | 21590065 | 21590084 | 21590068 | - |
| SEQ ID NO 18598 | AAGTGGGGTAGCATTTTCTT | AGG | chr12 | 21590064 | 21590083 | 21590067 | - |
| SEQ ID NO 18599 | AGTGGGGTAGCATTTTCTTA | GGG | chr12 | 21590063 | 21590082 | 21590066 | - |

Figure 43 (Cont'd)

| SEQ ID NO 18600 | TGGGGTAGCATTTTCTTAGG | GAG | chr12 | 21590061 | 21590080 | 21590064 | - |
| SEQ ID NO 18601 | TTAGGGAGCTTATAAATGTG | TAG | chr12 | 21590046 | 21590065 | 21590049 | - |
| SEQ ID NO 18602 | GGGAGCTTATAAATGTGTAG | CAG | chr12 | 21590043 | 21590062 | 21590046 | - |
| SEQ ID NO 18603 | ATGTGTAGCAGCCCTGCTAC | TGG | chr12 | 21590031 | 21590050 | 21590034 | - |
| SEQ ID NO 18604 | TGTGTAGCAGCCCTGCTACT | GGG | chr12 | 21590030 | 21590049 | 21590033 | - |
| SEQ ID NO 18605 | GTGTAGCAGCCCTGCTACTG | GGG | chr12 | 21590029 | 21590048 | 21590032 | - |
| SEQ ID NO 18606 | TGTAGCAGCCCTGCTACTGG | GGG | chr12 | 21590028 | 21590047 | 21590031 | - |
| SEQ ID NO 18607 | AGCAGCCCTGCTACTGGGGG | TGG | chr12 | 21590025 | 21590044 | 21590028 | - |
| SEQ ID NO 18608 | GCAGCCCTGCTACTGGGGGT | GGG | chr12 | 21590024 | 21590043 | 21590027 | - |
| SEQ ID NO 18609 | CAGCCCTGCTACTGGGGGTG | GGG | chr12 | 21590023 | 21590042 | 21590026 | - |
| SEQ ID NO 18610 | AGCCCTGCTACTGGGGGTGG | GGG | chr12 | 21590022 | 21590041 | 21590025 | - |
| SEQ ID NO 18611 | CCCTGCTACTGGGGGTGGGG | GAG | chr12 | 21590020 | 21590039 | 21590023 | - |
| SEQ ID NO 18612 | CTAATGACACACTTTATCCC | TGG | chr12 | 21589990 | 21590009 | 21589993 | - |
| SEQ ID NO 18613 | ACACACTTTATCCCTGGTGA | CAG | chr12 | 21589984 | 21590003 | 21589987 | - |
| SEQ ID NO 18614 | CACTTTATCCCTGGTGACAG | CAG | chr12 | 21589981 | 21590000 | 21589984 | - |
| SEQ ID NO 18615 | TTATCCCTGGTGACAGCAGC | CAG | chr12 | 21589977 | 21589996 | 21589980 | - |
| SEQ ID NO 18616 | TCCCTGGTGACAGCAGCCAG | CAG | chr12 | 21589974 | 21589993 | 21589977 | - |
| SEQ ID NO 18617 | CTGGTGACAGCAGCCAGCAG | TAG | chr12 | 21589971 | 21589990 | 21589974 | - |
| SEQ ID NO 18618 | CAGCAGCCAGCAGTAGCACT | CAG | chr12 | 21589964 | 21589983 | 21589967 | - |
| SEQ ID NO 18619 | CCAGCAGTAGCACTCAGCTG | TGG | chr12 | 21589958 | 21589977 | 21589961 | - |
| SEQ ID NO 18620 | CAGCAGTAGCACTCAGCTGT | GGG | chr12 | 21589957 | 21589976 | 21589960 | - |
| SEQ ID NO 18621 | CAGTAGCACTCAGCTGTGGG | TGG | chr12 | 21589954 | 21589973 | 21589957 | - |
| SEQ ID NO 18622 | AGTAGCACTCAGCTGTGGGT | GGG | chr12 | 21589953 | 21589972 | 21589956 | - |
| SEQ ID NO 18623 | GTAGCACTCAGCTGTGGGTG | GGG | chr12 | 21589952 | 21589971 | 21589955 | - |
| SEQ ID NO 18624 | TAGCACTCAGCTGTGGGTGG | GGG | chr12 | 21589951 | 21589970 | 21589954 | - |
| SEQ ID NO 18625 | CAGCTGTGGGTGGGGATGT | CAG | chr12 | 21589944 | 21589963 | 21589947 | - |
| SEQ ID NO 18626 | CTGTGGGTGGGGATGTCAG | CAG | chr12 | 21589941 | 21589960 | 21589944 | - |
| SEQ ID NO 18627 | GTGGGTGGGGATGTCAGCA | GAG | chr12 | 21589939 | 21589958 | 21589942 | - |
| SEQ ID NO 18628 | GGGGGATGTCAGCAGAGCTT | CAG | chr12 | 21589933 | 21589952 | 21589936 | - |
| SEQ ID NO 18629 | GGGGATGTCAGCAGAGCTTC | AGG | chr12 | 21589932 | 21589951 | 21589935 | - |
| SEQ ID NO 18630 | GGGATGTCAGCAGAGCTTCA | GGG | chr12 | 21589931 | 21589950 | 21589934 | - |
| SEQ ID NO 18631 | TCAGCAGAGCTTCAGGGATG | TAG | chr12 | 21589925 | 21589944 | 21589928 | - |
| SEQ ID NO 18632 | AGCAGAGCTTCAGGGATGTA | GAG | chr12 | 21589923 | 21589942 | 21589926 | - |
| SEQ ID NO 18633 | GCTTCAGGGATGTAGAGATG | CAG | chr12 | 21589917 | 21589936 | 21589920 | - |
| SEQ ID NO 18634 | TGTAGAGATGCAGATGATGT | TGG | chr12 | 21589907 | 21589926 | 21589910 | - |
| SEQ ID NO 18635 | GTAGAGATGCAGATGATGTT | GGG | chr12 | 21589906 | 21589925 | 21589909 | - |
| SEQ ID NO 18636 | TAGAGATGCAGATGATGTTG | GGG | chr12 | 21589905 | 21589924 | 21589908 | - |
| SEQ ID NO 18637 | TGCAGATGATGTTGGGGTCT | GAG | chr12 | 21589899 | 21589918 | 21589902 | - |
| SEQ ID NO 18638 | GCAGATGATGTTGGGGTCTG | AGG | chr12 | 21589898 | 21589917 | 21589901 | - |
| SEQ ID NO 18639 | GTCTGAGGAACGATGTCATC | TGG | chr12 | 21589883 | 21589902 | 21589886 | - |
| SEQ ID NO 18640 | TGAGGAACGATGTCATCTGG | TGG | chr12 | 21589880 | 21589899 | 21589883 | - |
| SEQ ID NO 18641 | GAGGAACGATGTCATCTGGT | GGG | chr12 | 21589879 | 21589898 | 21589882 | - |
| SEQ ID NO 18642 | CGATGTCATCTGGTGGGTGT | TGG | chr12 | 21589873 | 21589892 | 21589876 | - |
| SEQ ID NO 18643 | GATGTCATCTGGTGGGTGTT | GGG | chr12 | 21589872 | 21589891 | 21589875 | - |
| SEQ ID NO 18644 | TGGGTGTTGGGCTCTCAAAA | TGG | chr12 | 21589860 | 21589879 | 21589863 | - |
| SEQ ID NO 18645 | CAAAATGGCACCTTGCTGCT | CAG | chr12 | 21589845 | 21589864 | 21589848 | - |
| SEQ ID NO 18646 | GGCACCTTGCTGCTCAGTAA | TGG | chr12 | 21589839 | 21589858 | 21589842 | - |

Figure 43 (Cont'd)

| SEQ ID NO 18647 | GCACCTTGCTGCTCAGTAAT | GGG | chr12 | 21589838 | 21589857 | 21589841 | - |
| SEQ ID NO 18648 | CACCTTGCTGCTCAGTAATG | GGG | chr12 | 21589837 | 21589856 | 21589840 | - |
| SEQ ID NO 18649 | TTGCTGCTCAGTAATGGGGA | TGG | chr12 | 21589833 | 21589852 | 21589836 | - |
| SEQ ID NO 18650 | CTGCTCAGTAATGGGGATGG | CAG | chr12 | 21589830 | 21589849 | 21589833 | - |
| SEQ ID NO 18651 | TGCTCAGTAATGGGGATGGC | AGG | chr12 | 21589829 | 21589848 | 21589832 | - |
| SEQ ID NO 18652 | GCTCAGTAATGGGGATGGCA | GGG | chr12 | 21589828 | 21589847 | 21589831 | - |
| SEQ ID NO 18653 | CTCAGTAATGGGGATGGCAG | GGG | chr12 | 21589827 | 21589846 | 21589830 | - |
| SEQ ID NO 18654 | AGTAATGGGGATGGCAGGGG | TGG | chr12 | 21589824 | 21589843 | 21589827 | - |
| SEQ ID NO 18655 | GTAATGGGGATGGCAGGGGT | GGG | chr12 | 21589823 | 21589842 | 21589826 | - |
| SEQ ID NO 18656 | GGGATGGCAGGGGTGGGACC | CAG | chr12 | 21589817 | 21589836 | 21589820 | - |
| SEQ ID NO 18657 | TGGCAGGGGTGGGACCCAGT | GAG | chr12 | 21589813 | 21589832 | 21589816 | - |
| SEQ ID NO 18658 | GCAGGGGTGGGACCCAGTGA | GAG | chr12 | 21589811 | 21589830 | 21589814 | - |
| SEQ ID NO 18659 | CCCAGTGAGAGCTCCTTCTC | TGG | chr12 | 21589799 | 21589818 | 21589802 | - |
| SEQ ID NO 18660 | CAGTGAGAGCTCCTTCTCTG | GAG | chr12 | 21589797 | 21589816 | 21589800 | - |
| SEQ ID NO 18661 | CAATGCCTTTGTGCGATTGC | TGG | chr12 | 21589774 | 21589793 | 21589777 | - |
| SEQ ID NO 18662 | AATGCCTTTGTGCGATTGCT | GGG | chr12 | 21589773 | 21589792 | 21589776 | - |
| SEQ ID NO 18663 | GCCTTTGTGCGATTGCTGGG | CAG | chr12 | 21589770 | 21589789 | 21589773 | - |
| SEQ ID NO 18664 | TGCTGGGCAGTTCCTTATGA | TAG | chr12 | 21589757 | 21589776 | 21589760 | - |
| SEQ ID NO 18665 | CAGTTCCTTATGATAGTCTC | AAG | chr12 | 21589750 | 21589769 | 21589753 | - |
| SEQ ID NO 18666 | AGTTCCTTATGATAGTCTCA | AGG | chr12 | 21589749 | 21589768 | 21589752 | - |
| SEQ ID NO 18667 | TGATAGTCTCAAGGCCTGCA | TGG | chr12 | 21589740 | 21589759 | 21589743 | - |
| SEQ ID NO 18668 | GTCTCAAGGCCTGCATGGTC | AAG | chr12 | 21589735 | 21589754 | 21589738 | - |
| SEQ ID NO 18669 | TCTCAAGGCCTGCATGGTCA | AGG | chr12 | 21589734 | 21589753 | 21589737 | - |
| SEQ ID NO 18670 | CTCAAGGCCTGCATGGTCAA | GGG | chr12 | 21589733 | 21589752 | 21589736 | - |
| SEQ ID NO 18671 | ATGGTCAAGGGACTCTCCTG | TGG | chr12 | 21589721 | 21589740 | 21589724 | - |
| SEQ ID NO 18672 | TCAAGGGACTCTCCTGTGGC | TAG | chr12 | 21589717 | 21589736 | 21589720 | - |
| SEQ ID NO 18673 | CAAGGGACTCTCCTGTGGCT | AGG | chr12 | 21589716 | 21589735 | 21589719 | - |
| SEQ ID NO 18674 | TCTCCTGTGGCTAGGATTCC | TGG | chr12 | 21589708 | 21589727 | 21589711 | - |
| SEQ ID NO 18675 | TCCTGTGGCTAGGATTCCTG | GAG | chr12 | 21589706 | 21589725 | 21589709 | - |
| SEQ ID NO 18676 | GATTCCTGGAGTCCATAATG | CAG | chr12 | 21589694 | 21589713 | 21589697 | - |
| SEQ ID NO 18677 | TGGAGTCCATAATGCAGATG | TGG | chr12 | 21589688 | 21589707 | 21589691 | - |
| SEQ ID NO 18678 | ATAATGCAGATGTGGACCAC | TGG | chr12 | 21589680 | 21589699 | 21589683 | - |
| SEQ ID NO 18679 | TAATGCAGATGTGGACCACT | GGG | chr12 | 21589679 | 21589698 | 21589682 | - |
| SEQ ID NO 18680 | ATGCAGATGTGGACCACTGG | GAG | chr12 | 21589677 | 21589696 | 21589680 | - |
| SEQ ID NO 18681 | AGATGTGGACCACTGGGAGT | CAG | chr12 | 21589673 | 21589692 | 21589676 | - |
| SEQ ID NO 18682 | TCACTTAACTTTCGATGCAC | TGG | chr12 | 21589650 | 21589669 | 21589653 | - |
| SEQ ID NO 18683 | CACTTAACTTTCGATGCACT | GGG | chr12 | 21589649 | 21589668 | 21589652 | - |
| SEQ ID NO 18684 | ACTTAACTTTCGATGCACTG | GGG | chr12 | 21589648 | 21589667 | 21589651 | - |
| SEQ ID NO 18685 | TTAACTTTCGATGCACTGGG | GAG | chr12 | 21589646 | 21589665 | 21589649 | - |
| SEQ ID NO 18686 | GATGCACTGGGGAGCCTCTC | TGG | chr12 | 21589637 | 21589656 | 21589640 | - |
| SEQ ID NO 18687 | GGGGAGCCTCTCTGGCCTCA | CAG | chr12 | 21589629 | 21589648 | 21589632 | - |
| SEQ ID NO 18688 | GGAGCCTCTCTGGCCTCACA | GAG | chr12 | 21589627 | 21589646 | 21589630 | - |
| SEQ ID NO 18689 | GAGCCTCTCTGGCCTCACAG | AGG | chr12 | 21589626 | 21589645 | 21589629 | - |
| SEQ ID NO 18690 | GCCTCACAGAGGATCCCTAC | TGG | chr12 | 21589615 | 21589634 | 21589618 | - |
| SEQ ID NO 18691 | CCTCACAGAGGATCCCTACT | GGG | chr12 | 21589614 | 21589633 | 21589617 | - |
| SEQ ID NO 18692 | CACAGAGGATCCCTACTGGG | TAG | chr12 | 21589611 | 21589630 | 21589614 | - |
| SEQ ID NO 18693 | ACAGAGGATCCCTACTGGGT | AGG | chr12 | 21589610 | 21589629 | 21589613 | - |

Figure 43 (Cont'd)

| SEQ ID NO 18694 | TTCCCTCCCCTTCATTGCCT | TAG | chr12 | 21589578 | 21589597 | 21589581 | - |
| SEQ ID NO 18695 | GTCACTTCTCTGTTGAATTC | CAG | chr12 | 21589546 | 21589565 | 21589549 | - |
| SEQ ID NO 18696 | TTCCAGAATTCTCTCTTATG | TGG | chr12 | 21589529 | 21589548 | 21589532 | - |
| SEQ ID NO 18697 | TCCAGAATTCTCTCTTATGT | GGG | chr12 | 21589528 | 21589547 | 21589531 | - |
| SEQ ID NO 18698 | GGATTTTCTACTTACTATTT | TGG | chr12 | 21589507 | 21589526 | 21589510 | - |
| SEQ ID NO 18699 | CTTACTATTTTGGTTCTTTG | TGG | chr12 | 21589497 | 21589516 | 21589500 | - |
| SEQ ID NO 18700 | TACTATTTTGGTTCTTTGTG | GAG | chr12 | 21589495 | 21589514 | 21589498 | - |
| SEQ ID NO 18701 | ACTATTTTGGTTCTTTGTGG | AGG | chr12 | 21589494 | 21589513 | 21589497 | - |
| SEQ ID NO 18702 | TATTTTGGTTCTTTGTGGAG | GAG | chr12 | 21589492 | 21589511 | 21589495 | - |
| SEQ ID NO 18703 | ATTTTGGTTCTTTGTGGAGG | AGG | chr12 | 21589491 | 21589510 | 21589494 | - |
| SEQ ID NO 18704 | TGGTTCTTTGTGGAGGAGGT | GAG | chr12 | 21589487 | 21589506 | 21589490 | - |
| SEQ ID NO 18705 | TTTGTGGAGGAGGTGAGTGT | CAG | chr12 | 21589481 | 21589500 | 21589484 | - |
| SEQ ID NO 18706 | AGGTGAGTGTCAGCTGCCCT | TAG | chr12 | 21589471 | 21589490 | 21589474 | - |
| SEQ ID NO 18707 | GAGTGTCAGCTGCCCTTAGT | CAG | chr12 | 21589467 | 21589486 | 21589470 | - |
| SEQ ID NO 18708 | GCCCTTAGTCAGTAATCTTC | AAG | chr12 | 21589456 | 21589475 | 21589459 | - |
| SEQ ID NO 18709 | CCCTTCCCTTGAAATTTTTT | AAG | chr12 | 21589432 | 21589451 | 21589435 | - |
| SEQ ID NO 18710 | CTTTATGTTTTTATTTCTAA | TAG | chr12 | 21589409 | 21589428 | 21589412 | - |
| SEQ ID NO 18711 | TTTTATTTCTAATAGACTGA | AAG | chr12 | 21589401 | 21589420 | 21589404 | - |
| SEQ ID NO 18712 | TTATTTCTAATAGACTGAAA | GAG | chr12 | 21589399 | 21589418 | 21589402 | - |
| SEQ ID NO 18713 | AATCATATTTTAAACACTCT | AAG | chr12 | 21589373 | 21589392 | 21589376 | - |
| SEQ ID NO 18714 | ATCATATTTTAAACACTCTA | AGG | chr12 | 21589372 | 21589391 | 21589375 | - |
| SEQ ID NO 18715 | TTAAACACTCTAAGGCTATA | TGG | chr12 | 21589364 | 21589383 | 21589367 | - |
| SEQ ID NO 18716 | TAAACACTCTAAGGCTATAT | GGG | chr12 | 21589363 | 21589382 | 21589366 | - |
| SEQ ID NO 18717 | AAACACTCTAAGGCTATATG | GGG | chr12 | 21589362 | 21589381 | 21589365 | - |
| SEQ ID NO 18718 | AACACTCTAAGGCTATATGG | GGG | chr12 | 21589361 | 21589380 | 21589364 | - |
| SEQ ID NO 18719 | GCTATATGGGGGACTATCTG | AAG | chr12 | 21589350 | 21589369 | 21589353 | - |
| SEQ ID NO 18720 | CTATATGGGGGACTATCTGA | AGG | chr12 | 21589349 | 21589368 | 21589352 | - |
| SEQ ID NO 18721 | GGGGGACTATCTGAAGGCCT | CAG | chr12 | 21589343 | 21589362 | 21589346 | - |
| SEQ ID NO 18722 | ACTATCTGAAGGCCTCAGAT | GAG | chr12 | 21589338 | 21589357 | 21589341 | - |
| SEQ ID NO 18723 | TGAAGGCCTCAGATGAGTAA | AAG | chr12 | 21589332 | 21589351 | 21589335 | - |
| SEQ ID NO 18724 | AGGCCTCAGATGAGTAAAAG | AAG | chr12 | 21589329 | 21589348 | 21589332 | - |
| SEQ ID NO 18725 | CCTCAGATGAGTAAAAGAAG | TAG | chr12 | 21589326 | 21589345 | 21589329 | - |
| SEQ ID NO 18726 | GAGTAAAAGAAGTAGCGAAT | TAG | chr12 | 21589318 | 21589337 | 21589321 | - |
| SEQ ID NO 18727 | ATCATTTGTTTCTTCAAATA | AAG | chr12 | 21589256 | 21589275 | 21589259 | - |
| SEQ ID NO 18728 | TATTTCCCCCTTATGTTCTT | CAG | chr12 | 21589227 | 21589246 | 21589230 | - |
| SEQ ID NO 18729 | AAAAATGTTTGCATCTACCA | AAG | chr12 | 21589199 | 21589218 | 21589202 | - |
| SEQ ID NO 18730 | AAATACGTAATCTAACAAAC | AAG | chr12 | 21589162 | 21589181 | 21589165 | - |
| SEQ ID NO 18731 | AATACGTAATCTAACAAACA | AGG | chr12 | 21589161 | 21589180 | 21589164 | - |
| SEQ ID NO 18732 | CTAACAAACAAGGATGTTTT | AAG | chr12 | 21589151 | 21589170 | 21589154 | - |
| SEQ ID NO 18733 | AAGGATGTTTTAAGATCTCT | GAG | chr12 | 21589142 | 21589161 | 21589145 | - |
| SEQ ID NO 18734 | ATGTTTTAAGATCTCTGAGT | AAG | chr12 | 21589138 | 21589157 | 21589141 | - |
| SEQ ID NO 18735 | AGATCTCTGAGTAAGATGCA | TAG | chr12 | 21589130 | 21589149 | 21589133 | - |
| SEQ ID NO 18736 | AGATGCATAGTTGCAAATAA | AAG | chr12 | 21589117 | 21589136 | 21589120 | - |
| SEQ ID NO 18737 | GATGCATAGTTGCAAATAAA | AGG | chr12 | 21589116 | 21589135 | 21589119 | - |
| SEQ ID NO 18738 | TGCATAGTTGCAAATAAAAG | GAG | chr12 | 21589114 | 21589133 | 21589117 | - |
| SEQ ID NO 18739 | TGCAAATAAAAGGAGTTTTC | AAG | chr12 | 21589106 | 21589125 | 21589109 | - |
| SEQ ID NO 18740 | GCAAATAAAAGGAGTTTTCA | AGG | chr12 | 21589105 | 21589124 | 21589108 | - |

Figure 43 (Cont'd)

| SEQ ID NO 18741 | ATCTAATAAATGTGTACCAT | CAG | chr12 | 21589062 | 21589081 | 21589065 | - |
| SEQ ID NO 18742 | TGTGTACCATCAGAAACTTA | TGG | chr12 | 21589052 | 21589071 | 21589055 | - |
| SEQ ID NO 18743 | AAACTTATGGTATATTCTCC | TGG | chr12 | 21589039 | 21589058 | 21589042 | - |
| SEQ ID NO 18744 | TATGGTATATTCTCCTGGAA | AAG | chr12 | 21589034 | 21589053 | 21589037 | - |
| SEQ ID NO 18745 | ATATTCTCCTGGAAAAGATG | AAG | chr12 | 21589028 | 21589047 | 21589031 | - |
| SEQ ID NO 18746 | TCCTGGAAAAGATGAAGATG | AAG | chr12 | 21589022 | 21589041 | 21589025 | - |
| SEQ ID NO 18747 | AAGATGAAGATGAAGAAAAT | AAG | chr12 | 21589014 | 21589033 | 21589017 | - |
| SEQ ID NO 18748 | AGATGAAGAAAATAAGTCTA | CAG | chr12 | 21589007 | 21589026 | 21589010 | - |
| SEQ ID NO 18749 | TGAAGAAAATAAGTCTACAG | AAG | chr12 | 21589004 | 21589023 | 21589007 | - |
| SEQ ID NO 18750 | AAGAAAATAAGTCTACAGAA | GAG | chr12 | 21589002 | 21589021 | 21589005 | - |
| SEQ ID NO 18751 | AGAAAATAAGTCTACAGAAG | AGG | chr12 | 21589001 | 21589020 | 21589004 | - |
| SEQ ID NO 18752 | AAAATAAGTCTACAGAAGAG | GAG | chr12 | 21588999 | 21589018 | 21589002 | - |
| SEQ ID NO 18753 | ACAGAAGAGGAGAAATTCTT | TGG | chr12 | 21588988 | 21589007 | 21588991 | - |
| SEQ ID NO 18754 | TTGGAAATTTTGCATTTTTG | TGG | chr12 | 21588969 | 21588988 | 21588972 | - |
| SEQ ID NO 18755 | AAATTTTGCATTTTTGTGGA | TAG | chr12 | 21588965 | 21588984 | 21588968 | - |
| SEQ ID NO 18756 | TTTTGCATTTTTGTGGATAG | TGG | chr12 | 21588962 | 21588981 | 21588965 | - |
| SEQ ID NO 18757 | TTTTGTGGATAGTGGTTTTG | AAG | chr12 | 21588954 | 21588973 | 21588957 | - |
| SEQ ID NO 18758 | GTGGATAGTGGTTTTGAAGA | AAG | chr12 | 21588950 | 21588969 | 21588953 | - |
| SEQ ID NO 18759 | TAGTGGTTTTGAAGAAAGCT | TAG | chr12 | 21588945 | 21588964 | 21588948 | - |
| SEQ ID NO 18760 | ATATATTTAAATATGTTGCT | AAG | chr12 | 21588922 | 21588941 | 21588925 | - |
| SEQ ID NO 18761 | GATGTGACTCCCACACTTTA | AAG | chr12 | 21588900 | 21588919 | 21588903 | - |
| SEQ ID NO 18762 | GACTCCCACACTTTAAAGAA | AAG | chr12 | 21588895 | 21588914 | 21588898 | - |
| SEQ ID NO 18763 | TAAAGAAAAGTTCTTCATTT | TAG | chr12 | 21588882 | 21588901 | 21588885 | - |
| SEQ ID NO 18764 | TTTTAGTTGCCCTTGCAAAT | TGG | chr12 | 21588865 | 21588884 | 21588868 | - |
| SEQ ID NO 18765 | GTTGCCCTTGCAAATTGGCT | AAG | chr12 | 21588860 | 21588879 | 21588863 | - |
| SEQ ID NO 18766 | TCCTCAACAAATAATTTTGA | TGG | chr12 | 21588829 | 21588848 | 21588832 | - |
| SEQ ID NO 18767 | TGATGGTTTCTAAAATTGTC | CAG | chr12 | 21588812 | 21588831 | 21588815 | - |
| SEQ ID NO 18768 | TCTAAAATTGTCCAGAATTT | GAG | chr12 | 21588804 | 21588823 | 21588807 | - |
| SEQ ID NO 18769 | CTAAAATTGTCCAGAATTTG | AGG | chr12 | 21588803 | 21588822 | 21588806 | - |
| SEQ ID NO 18770 | CCAGAATTTGAGGAAATACT | TAG | chr12 | 21588793 | 21588812 | 21588796 | - |
| SEQ ID NO 18771 | TTTGAGGAAATACTTAGATG | TAG | chr12 | 21588787 | 21588806 | 21588790 | - |
| SEQ ID NO 18772 | GAGGAAATACTTAGATGTAG | TAG | chr12 | 21588784 | 21588803 | 21588787 | - |
| SEQ ID NO 18773 | GACATCAATTTATGTTAACT | TAG | chr12 | 21588759 | 21588778 | 21588762 | - |
| SEQ ID NO 18774 | TGTTAACTTAGATTTATTGT | TGG | chr12 | 21588747 | 21588766 | 21588750 | - |
| SEQ ID NO 18775 | AACTTAGATTTATTGTTGGA | TGG | chr12 | 21588743 | 21588762 | 21588746 | - |
| SEQ ID NO 18776 | AGATTTATTGTTGGATGGTT | AAG | chr12 | 21588738 | 21588757 | 21588741 | - |
| SEQ ID NO 18777 | TAATCATGTCTGTTCTTGTC | CAG | chr12 | 21588714 | 21588733 | 21588717 | - |
| SEQ ID NO 18778 | ATGTCTGTTCTTGTCCAGTC | TAG | chr12 | 21588709 | 21588728 | 21588712 | - |
| SEQ ID NO 18779 | TCTGTTCTTGTCCAGTCTAG | AAG | chr12 | 21588706 | 21588725 | 21588709 | - |
| SEQ ID NO 18780 | ACATCTGAACTGTGATTTGA | CAG | chr12 | 21588639 | 21588658 | 21588642 | - |
| SEQ ID NO 18781 | TTTGACAGTGTCCTTATTAT | CAG | chr12 | 21588624 | 21588643 | 21588627 | - |
| SEQ ID NO 18782 | TATCAGACTCTGCTCAATGA | CAG | chr12 | 21588607 | 21588626 | 21588610 | - |
| SEQ ID NO 18783 | GTTTAAACTTCTTTTTGATA | CAG | chr12 | 21588585 | 21588604 | 21588588 | - |
| SEQ ID NO 18784 | CAGTAAAAAACTTTTCCTTA | AAG | chr12 | 21588565 | 21588584 | 21588568 | - |
| SEQ ID NO 18785 | TCCTTAAAGATGAAATTCTT | AAG | chr12 | 21588551 | 21588570 | 21588554 | - |
| SEQ ID NO 18786 | CCTTAAAGATGAAATTCTTA | AGG | chr12 | 21588550 | 21588569 | 21588553 | - |
| SEQ ID NO 18787 | ATGAAATTCTTAAGGACAAT | TAG | chr12 | 21588542 | 21588561 | 21588545 | - |

Figure 43 (Cont'd)

| | | | | | | | |
|---|---|---|---|---|---|---|---|
| SEQ ID NO 18788 | TTAAGGACAATTAGCTTGTG | TAG | chr12 | 21588533 | 21588552 | 21588536 | - |
| SEQ ID NO 18789 | TATGAAAATTGCTTGCATTT | TGG | chr12 | 21588505 | 21588524 | 21588508 | - |
| SEQ ID NO 18790 | TGAAAATTGCTTGCATTTTG | GAG | chr12 | 21588503 | 21588522 | 21588506 | - |
| SEQ ID NO 18791 | CTTGCATTTTGGAGTTACAT | TAG | chr12 | 21588494 | 21588513 | 21588497 | - |
| SEQ ID NO 18792 | TATAAATTAATGAATCCTAT | TGG | chr12 | 21588460 | 21588479 | 21588463 | - |
| SEQ ID NO 18793 | ATCCTATTGGTACCATATAA | TAG | chr12 | 21588447 | 21588466 | 21588450 | - |
| SEQ ID NO 18794 | CTTTTGTGTCTCGCCTTTCA | AAG | chr12 | 21588411 | 21588430 | 21588414 | - |
| SEQ ID NO 18795 | TTTTGTGTCTCGCCTTTCAA | AGG | chr12 | 21588410 | 21588429 | 21588413 | - |
| SEQ ID NO 18796 | TTTGTGTCTCGCCTTTCAAA | GGG | chr12 | 21588409 | 21588428 | 21588412 | - |
| SEQ ID NO 18797 | TCAAAGGGCAATTTTCCAAA | AAG | chr12 | 21588394 | 21588413 | 21588397 | - |
| SEQ ID NO 18798 | TCCAAAAGTATATTTTGCA | TGG | chr12 | 21588380 | 21588399 | 21588383 | - |
| SEQ ID NO 18799 | AAAGTATATTTTGCATGGCT | CAG | chr12 | 21588375 | 21588394 | 21588378 | - |
| SEQ ID NO 18800 | AAGTATATTTTGCATGGCTC | AGG | chr12 | 21588374 | 21588393 | 21588377 | - |
| SEQ ID NO 18801 | TTTTGCATGGCTCAGGCTAA | AAG | chr12 | 21588367 | 21588386 | 21588370 | - |
| SEQ ID NO 18802 | CAGGCTAAAAGTAATGTCTC | CAG | chr12 | 21588355 | 21588374 | 21588358 | - |
| SEQ ID NO 18803 | AAAAGTAATGTCTCCAGATG | AAG | chr12 | 21588349 | 21588368 | 21588352 | - |
| SEQ ID NO 18804 | CATTGATTGTGACTATTGAT | AAG | chr12 | 21588312 | 21588331 | 21588315 | - |
| SEQ ID NO 18805 | TTGATAAGATTTACTATGTA | AAG | chr12 | 21588297 | 21588316 | 21588300 | - |
| SEQ ID NO 18806 | AGATTTACTATGTAAAGTAT | AAG | chr12 | 21588291 | 21588310 | 21588294 | - |
| SEQ ID NO 18807 | CTATGTAAAGTATAAGTTAC | TGG | chr12 | 21588284 | 21588303 | 21588287 | - |
| SEQ ID NO 18808 | GTTACTGGAATAATACATTT | AAG | chr12 | 21588269 | 21588288 | 21588272 | - |
| SEQ ID NO 18809 | AATAATACATTTAAGAAATA | TAG | chr12 | 21588261 | 21588280 | 21588264 | - |
| SEQ ID NO 18810 | AATACATTTAAGAAATATAG | TAG | chr12 | 21588258 | 21588277 | 21588261 | - |
| SEQ ID NO 18811 | ATAGTAGCTATTAAAACCTG | TAG | chr12 | 21588242 | 21588261 | 21588245 | - |
| SEQ ID NO 18812 | AAACCTGTAGTCTGATGAAA | TGG | chr12 | 21588229 | 21588248 | 21588232 | - |
| SEQ ID NO 18813 | TGAAATGGAATATGTTTTGA | AAG | chr12 | 21588214 | 21588233 | 21588217 | - |
| SEQ ID NO 18814 | ATGGAATATGTTTTGAAAGA | CAG | chr12 | 21588210 | 21588229 | 21588213 | - |
| SEQ ID NO 18815 | GAATATGTTTTGAAAGACAG | CAG | chr12 | 21588207 | 21588226 | 21588210 | - |
| SEQ ID NO 18816 | GAAAGACAGCAGTGAAAAAT | GAG | chr12 | 21588196 | 21588215 | 21588199 | - |
| SEQ ID NO 18817 | AGACAGCAGTGAAAAATGAG | AAG | chr12 | 21588193 | 21588212 | 21588196 | - |
| SEQ ID NO 18818 | AAAAATGAGAAGTAATATAT | AAG | chr12 | 21588182 | 21588201 | 21588185 | - |
| SEQ ID NO 18819 | TAAAATTGCTTTTTGCAATT | GAG | chr12 | 21588156 | 21588175 | 21588159 | - |
| SEQ ID NO 18820 | TGCTTTTTGCAATTGAGTTG | AAG | chr12 | 21588150 | 21588169 | 21588153 | - |
| SEQ ID NO 18821 | ATTGAGTTGAAGATTGATGC | CAG | chr12 | 21588139 | 21588158 | 21588142 | - |
| SEQ ID NO 18822 | TTGAGTTGAAGATTGATGCC | AGG | chr12 | 21588138 | 21588157 | 21588141 | - |
| SEQ ID NO 18823 | TGCCAGGATCTTATTACCTC | CAG | chr12 | 21588122 | 21588141 | 21588125 | - |
| SEQ ID NO 18824 | GCCAGGATCTTATTACCTCC | AGG | chr12 | 21588121 | 21588140 | 21588124 | - |
| SEQ ID NO 18825 | ATTACCTCCAGGATTTCACA | AAG | chr12 | 21588110 | 21588129 | 21588113 | - |
| SEQ ID NO 18826 | TTACCTCCAGGATTTCACAA | AGG | chr12 | 21588109 | 21588128 | 21588112 | - |
| SEQ ID NO 18827 | GATTTCACAAAGGATTTCTT | GAG | chr12 | 21588099 | 21588118 | 21588102 | - |
| SEQ ID NO 18828 | CTTGAGTCATCCCCTTGCTC | TAG | chr12 | 21588082 | 21588101 | 21588085 | - |
| SEQ ID NO 18829 | CTTGCTCTAGCTCATGAACA | AAG | chr12 | 21588069 | 21588088 | 21588072 | - |
| SEQ ID NO 18830 | TCATGAACAAAGTATTGCTC | AAG | chr12 | 21588058 | 21588077 | 21588061 | - |
| SEQ ID NO 18831 | AGTATTGCTCAAGTAATCGA | CAG | chr12 | 21588048 | 21588067 | 21588051 | - |
| SEQ ID NO 18832 | TCTCACATGTGATTATTATT | TAG | chr12 | 21588012 | 21588031 | 21588015 | - |
| SEQ ID NO 18833 | ATTATTATTTAGTGCTGTCA | CGG | chr12 | 21588001 | 21588020 | 21588004 | - |
| SEQ ID NO 18834 | TTATTATTTAGTGCTGTCAC | GGG | chr12 | 21588000 | 21588019 | 21588003 | - |

Figure 43 (Cont'd)

| SEQ ID NO 18835 | TCACGGGAAATATCCTGCCT | AAG | chr12 | 21587984 | 21588003 | 21587987 | - |
| SEQ ID NO 18836 | AATATCCTGCCTAAGTTTAC | TGG | chr12 | 21587976 | 21587995 | 21587979 | - |
| SEQ ID NO 18837 | TATCCTGCCTAAGTTTACTG | GAG | chr12 | 21587974 | 21587993 | 21587977 | - |
| SEQ ID NO 18838 | ATCCTGCCTAAGTTTACTGG | AGG | chr12 | 21587973 | 21587992 | 21587976 | - |
| SEQ ID NO 18839 | CCTCCCTATGTCCTCCTACC | TGG | chr12 | 21587934 | 21587953 | 21587937 | - |
| SEQ ID NO 18840 | TTTCCTTGCACACTCTACTC | CAG | chr12 | 21587887 | 21587906 | 21587890 | - |
| SEQ ID NO 18841 | TTGCACACTCTACTCCAGCT | TAG | chr12 | 21587882 | 21587901 | 21587885 | - |
| SEQ ID NO 18842 | TGCACACTCTACTCCAGCTT | AGG | chr12 | 21587881 | 21587900 | 21587884 | - |
| SEQ ID NO 18843 | GCACACTCTACTCCAGCTTA | GGG | chr12 | 21587880 | 21587899 | 21587883 | - |
| SEQ ID NO 18844 | CTCTACTCCAGCTTAGGGCC | TGG | chr12 | 21587875 | 21587894 | 21587878 | - |
| SEQ ID NO 18845 | TCTACTCCAGCTTAGGGCCT | GGG | chr12 | 21587874 | 21587893 | 21587877 | - |
| SEQ ID NO 18846 | ACCCTTTTAATTACCCCATT | AAG | chr12 | 21587790 | 21587809 | 21587793 | - |
| SEQ ID NO 18847 | TCAATTTTTGCCTTTTCAAT | CAG | chr12 | 21587752 | 21587771 | 21587755 | - |
| SEQ ID NO 18848 | AAAATTTATTTATATATATT | TAG | chr12 | 21587707 | 21587726 | 21587710 | - |
| SEQ ID NO 18849 | ATTTATTTATATATATTTAG | AAG | chr12 | 21587704 | 21587723 | 21587707 | - |
| SEQ ID NO 18850 | TTTATTTATATATATTTAGA | AGG | chr12 | 21587703 | 21587722 | 21587706 | - |
| SEQ ID NO 18851 | TATATTTAGAAGGTATGTAC | TAG | chr12 | 21587693 | 21587712 | 21587696 | - |
| SEQ ID NO 18852 | TCGTTATCATGCTGCTTATA | AAG | chr12 | 21587669 | 21587688 | 21587672 | - |
| SEQ ID NO 18853 | CTGCTTATAAAGACATACCT | GAG | chr12 | 21587658 | 21587677 | 21587661 | - |
| SEQ ID NO 18854 | TATAAAGACATACCTGAGAC | TGG | chr12 | 21587653 | 21587672 | 21587656 | - |
| SEQ ID NO 18855 | ATAAAGACATACCTGAGACT | GGG | chr12 | 21587652 | 21587671 | 21587655 | - |
| SEQ ID NO 18856 | CCTGAGACTGGGTAATTTAT | AAG | chr12 | 21587641 | 21587660 | 21587644 | - |
| SEQ ID NO 18857 | CTGAGACTGGGTAATTTATA | AGG | chr12 | 21587640 | 21587659 | 21587643 | - |
| SEQ ID NO 18858 | AAAAACGTTTAATTGTCTCA | CAG | chr12 | 21587616 | 21587635 | 21587619 | - |
| SEQ ID NO 18859 | TTAATTGTCTCACAGTTCCA | CAG | chr12 | 21587608 | 21587627 | 21587611 | - |
| SEQ ID NO 18860 | TAATTGTCTCACAGTTCCAC | AGG | chr12 | 21587607 | 21587626 | 21587610 | - |
| SEQ ID NO 18861 | AATTGTCTCACAGTTCCACA | GGG | chr12 | 21587606 | 21587625 | 21587609 | - |
| SEQ ID NO 18862 | GTCTCACAGTTCCACAGGGC | TGG | chr12 | 21587602 | 21587621 | 21587605 | - |
| SEQ ID NO 18863 | TCTCACAGTTCCACAGGGCT | GGG | chr12 | 21587601 | 21587620 | 21587604 | - |
| SEQ ID NO 18864 | CTCACAGTTCCACAGGGCTG | GGG | chr12 | 21587600 | 21587619 | 21587603 | - |
| SEQ ID NO 18865 | CACAGTTCCACAGGGCTGGG | GAG | chr12 | 21587598 | 21587617 | 21587601 | - |
| SEQ ID NO 18866 | ACAGTTCCACAGGGCTGGGG | AGG | chr12 | 21587597 | 21587616 | 21587600 | - |
| SEQ ID NO 18867 | CCACAGGGCTGGGGAGGCCT | CGG | chr12 | 21587591 | 21587610 | 21587594 | - |
| SEQ ID NO 18868 | CACAGGGCTGGGGAGGCCTC | GGG | chr12 | 21587590 | 21587609 | 21587593 | - |
| SEQ ID NO 18869 | CCTCGGGAAACTTACAATCA | TGG | chr12 | 21587574 | 21587593 | 21587577 | - |
| SEQ ID NO 18870 | CGGGAAACTTACAATCATGG | CAG | chr12 | 21587571 | 21587590 | 21587574 | - |
| SEQ ID NO 18871 | GAAACTTACAATCATGGCAG | AAG | chr12 | 21587568 | 21587587 | 21587571 | - |
| SEQ ID NO 18872 | ACTTACAATCATGGCAGAAG | AAG | chr12 | 21587565 | 21587584 | 21587568 | - |
| SEQ ID NO 18873 | CAAACATGTCCTTCTTCACA | TGG | chr12 | 21587539 | 21587558 | 21587542 | - |
| SEQ ID NO 18874 | ACATGTCCTTCTTCACATGG | CAG | chr12 | 21587536 | 21587555 | 21587539 | - |
| SEQ ID NO 18875 | TGTCCTTCTTCACATGGCAG | CAG | chr12 | 21587533 | 21587552 | 21587536 | - |
| SEQ ID NO 18876 | CTTCTTCACATGGCAGCAGC | AAG | chr12 | 21587529 | 21587548 | 21587532 | - |
| SEQ ID NO 18877 | CTTCACATGGCAGCAGCAAG | TAG | chr12 | 21587526 | 21587545 | 21587529 | - |
| SEQ ID NO 18878 | CACATGGCAGCAGCAAGTAG | AAG | chr12 | 21587523 | 21587542 | 21587526 | - |
| SEQ ID NO 18879 | CAGCAGCAAGTAGAAGTGCC | AAG | chr12 | 21587516 | 21587535 | 21587519 | - |
| SEQ ID NO 18880 | CAAGTAGAAGTGCCAAGCAA | AAG | chr12 | 21587510 | 21587529 | 21587513 | - |
| SEQ ID NO 18881 | AAGTAGAAGTGCCAAGCAAA | AGG | chr12 | 21587509 | 21587528 | 21587512 | - |

Figure 43 (Cont'd)

| SEQ ID NO 18882 | AGTAGAAGTGCCAAGCAAAA | GGG | chr12 | 21587508 | 21587527 | 21587511 | - |
| SEQ ID NO 18883 | GTAGAAGTGCCAAGCAAAAG | GGG | chr12 | 21587507 | 21587526 | 21587510 | - |
| SEQ ID NO 18884 | TAGAAGTGCCAAGCAAAAGG | GGG | chr12 | 21587506 | 21587525 | 21587509 | - |
| SEQ ID NO 18885 | GTGCCAAGCAAAAGGGGGAA | AAG | chr12 | 21587501 | 21587520 | 21587504 | - |
| SEQ ID NO 18886 | AAAGCCGCTTATAAAACCAT | CAG | chr12 | 21587482 | 21587501 | 21587485 | - |
| SEQ ID NO 18887 | ATAAAACCATCAGATCTTGT | AAG | chr12 | 21587472 | 21587491 | 21587475 | - |
| SEQ ID NO 18888 | TTGTAAGAACTCACTATCAC | GAG | chr12 | 21587456 | 21587475 | 21587459 | - |
| SEQ ID NO 18889 | TAAGAACTCACTATCACGAG | AAG | chr12 | 21587453 | 21587472 | 21587456 | - |
| SEQ ID NO 18890 | AGAACTCACTATCACGAGAA | GAG | chr12 | 21587451 | 21587470 | 21587454 | - |
| SEQ ID NO 18891 | CACTATCACGAGAAGAGCAT | GAG | chr12 | 21587445 | 21587464 | 21587448 | - |
| SEQ ID NO 18892 | CTATCACGAGAAGAGCATGA | GAG | chr12 | 21587443 | 21587462 | 21587446 | - |
| SEQ ID NO 18893 | AAATCCCTCCCACAACACGT | GAG | chr12 | 21587388 | 21587407 | 21587391 | - |
| SEQ ID NO 18894 | AATCCCTCCCACAACACGTG | AGG | chr12 | 21587387 | 21587406 | 21587390 | - |
| SEQ ID NO 18895 | CCCACAACACGTGAGGATTA | TGG | chr12 | 21587380 | 21587399 | 21587383 | - |
| SEQ ID NO 18896 | CCACAACACGTGAGGATTAT | GGG | chr12 | 21587379 | 21587398 | 21587382 | - |
| SEQ ID NO 18897 | GATTATGGGAACTACAATTC | AAG | chr12 | 21587365 | 21587384 | 21587368 | - |
| SEQ ID NO 18898 | TGGGAACTACAATTCAAGAT | GAG | chr12 | 21587360 | 21587379 | 21587363 | - |
| SEQ ID NO 18899 | CTACAATTCAAGATGAGATT | TGG | chr12 | 21587354 | 21587373 | 21587357 | - |
| SEQ ID NO 18900 | TACAATTCAAGATGAGATTT | GGG | chr12 | 21587353 | 21587372 | 21587356 | - |
| SEQ ID NO 18901 | AATTCAAGATGAGATTTGGG | TGG | chr12 | 21587350 | 21587369 | 21587353 | - |
| SEQ ID NO 18902 | ATTCAAGATGAGATTTGGGT | GGG | chr12 | 21587349 | 21587368 | 21587352 | - |
| SEQ ID NO 18903 | TTCAAGATGAGATTTGGGTG | GGG | chr12 | 21587348 | 21587367 | 21587351 | - |
| SEQ ID NO 18904 | ATGAGATTTGGGTGGGGACA | CAG | chr12 | 21587342 | 21587361 | 21587345 | - |
| SEQ ID NO 18905 | ATTTGGGTGGGGACACAGTC | AAG | chr12 | 21587337 | 21587356 | 21587340 | - |
| SEQ ID NO 18906 | GGGACACAGTCAAGCTGTAT | CAG | chr12 | 21587328 | 21587347 | 21587331 | - |
| SEQ ID NO 18907 | GGACACAGTCAAGCTGTATC | AGG | chr12 | 21587327 | 21587346 | 21587330 | - |
| SEQ ID NO 18908 | GACACAGTCAAGCTGTATCA | GGG | chr12 | 21587326 | 21587345 | 21587329 | - |
| SEQ ID NO 18909 | GTCAAGCTGTATCAGGGTAC | AAG | chr12 | 21587320 | 21587339 | 21587323 | - |
| SEQ ID NO 18910 | GCTGTATCAGGGTACAAGCT | CGG | chr12 | 21587315 | 21587334 | 21587318 | - |
| SEQ ID NO 18911 | CTGTATCAGGGTACAAGCTC | GGG | chr12 | 21587314 | 21587333 | 21587317 | - |
| SEQ ID NO 18912 | CCTTACATATGTATGTTGCA | TAG | chr12 | 21587289 | 21587308 | 21587292 | - |
| SEQ ID NO 18913 | TACATATGTATGTTGCATAG | TGG | chr12 | 21587286 | 21587305 | 21587289 | - |
| SEQ ID NO 18914 | ATGTATGTTGCATAGTGGTG | AAG | chr12 | 21587281 | 21587300 | 21587284 | - |
| SEQ ID NO 18915 | GTTGCATAGTGGTGAAGTCT | GAG | chr12 | 21587275 | 21587294 | 21587278 | - |
| SEQ ID NO 18916 | AGTGGTGAAGTCTGAGCTTT | TAG | chr12 | 21587268 | 21587287 | 21587271 | - |
| SEQ ID NO 18917 | GGTGAAGTCTGAGCTTTTAG | TGG | chr12 | 21587265 | 21587284 | 21587268 | - |
| SEQ ID NO 18918 | TTAGTGGACCATCACCTGAA | AAG | chr12 | 21587249 | 21587268 | 21587252 | - |
| SEQ ID NO 18919 | TGAATGTTGTATCCAATCCG | TAG | chr12 | 21587226 | 21587245 | 21587229 | - |
| SEQ ID NO 18920 | GTATCCAATCCGTAGTTTTT | CAG | chr12 | 21587218 | 21587237 | 21587221 | - |
| SEQ ID NO 18921 | CCTATCCTCCCACCTTTCTC | TAG | chr12 | 21587182 | 21587201 | 21587185 | - |
| SEQ ID NO 18922 | TCCCACCTTTCTCTAGTCTC | AAG | chr12 | 21587175 | 21587194 | 21587178 | - |
| SEQ ID NO 18923 | GTCTATGCTTACTCATCGTT | TAG | chr12 | 21587130 | 21587149 | 21587133 | - |
| SEQ ID NO 18924 | CTCATCGTTTAGCTCCCACT | TGG | chr12 | 21587119 | 21587138 | 21587122 | - |
| SEQ ID NO 18925 | CCACTTGGCTCTCACTAAAT | GAG | chr12 | 21587104 | 21587123 | 21587107 | - |
| SEQ ID NO 18926 | GTGTTGACTTTCTGTTTCT | GAG | chr12 | 21587073 | 21587092 | 21587076 | - |
| SEQ ID NO 18927 | TGTTTCTGAGTTATTTCACT | GAG | chr12 | 21587060 | 21587079 | 21587063 | - |
| SEQ ID NO 18928 | GTTTCTGAGTTATTTCACTG | AGG | chr12 | 21587059 | 21587078 | 21587062 | - |

Figure 43 (Cont'd)

| | | | | | | | |
|---|---|---|---|---|---|---|---|
| SEQ ID NO 18929 | TCACTGAGGATAATGTCCTC | CAG | chr12 | 21587045 | 21587064 | 21587048 | - |
| SEQ ID NO 18930 | TCCAGTTCTAACCATGTTTC | TAG | chr12 | 21587027 | 21587046 | 21587030 | - |
| SEQ ID NO 18931 | CAGTTCTAACCATGTTTCTA | GAG | chr12 | 21587025 | 21587044 | 21587028 | - |
| SEQ ID NO 18932 | TTCTAACCATGTTTCTAGAG | AAG | chr12 | 21587022 | 21587041 | 21587025 | - |
| SEQ ID NO 18933 | CATGATTTCATTCTTTTTTA | TGG | chr12 | 21586998 | 21587017 | 21587001 | - |
| SEQ ID NO 18934 | TTTCATTCTTTTTATGGCT | GAG | chr12 | 21586993 | 21587012 | 21586996 | - |
| SEQ ID NO 18935 | TTCTTTATCCAATCGTCCAT | TGG | chr12 | 21586934 | 21586953 | 21586937 | - |
| SEQ ID NO 18936 | TTTATCCAATCGTCCATTGG | TAG | chr12 | 21586931 | 21586950 | 21586934 | - |
| SEQ ID NO 18937 | ATCGTCCATTGGTAGACATT | TAG | chr12 | 21586923 | 21586942 | 21586926 | - |
| SEQ ID NO 18938 | TCGTCCATTGGTAGACATTT | AGG | chr12 | 21586922 | 21586941 | 21586925 | - |
| SEQ ID NO 18939 | TGATTCCATATCTTTGCTAT | TGG | chr12 | 21586898 | 21586917 | 21586901 | - |
| SEQ ID NO 18940 | GATTCCATATCTTTGCTATT | GGG | chr12 | 21586897 | 21586916 | 21586900 | - |
| SEQ ID NO 18941 | CATATCTTTGCTATTGGGAA | CAG | chr12 | 21586892 | 21586911 | 21586895 | - |
| SEQ ID NO 18942 | CTACTTTGAACATACTAATG | CAG | chr12 | 21586867 | 21586886 | 21586870 | - |
| SEQ ID NO 18943 | TAATATGATCTCTTTCACTT | TGG | chr12 | 21586834 | 21586853 | 21586837 | - |
| SEQ ID NO 18944 | AATATGATCTCTTTCACTTT | GGG | chr12 | 21586833 | 21586852 | 21586836 | - |
| SEQ ID NO 18945 | TTTCACTTTGGGTCCATACC | CAG | chr12 | 21586822 | 21586841 | 21586825 | - |
| SEQ ID NO 18946 | CACTTTGGGTCCATACCCAG | TAG | chr12 | 21586819 | 21586838 | 21586822 | - |
| SEQ ID NO 18947 | TTTGGGTCCATACCCAGTAG | TGG | chr12 | 21586816 | 21586835 | 21586819 | - |
| SEQ ID NO 18948 | TTGGGTCCATACCCAGTAGT | GGG | chr12 | 21586815 | 21586834 | 21586818 | - |
| SEQ ID NO 18949 | CATACCCAGTAGTGGGATTG | CAG | chr12 | 21586808 | 21586827 | 21586811 | - |
| SEQ ID NO 18950 | ATACCCAGTAGTGGGATTGC | AGG | chr12 | 21586807 | 21586826 | 21586810 | - |
| SEQ ID NO 18951 | AGTGGGATTGCAGGATTGAA | TGG | chr12 | 21586798 | 21586817 | 21586801 | - |
| SEQ ID NO 18952 | GGGATTGCAGGATTGAATGG | TAG | chr12 | 21586795 | 21586814 | 21586798 | - |
| SEQ ID NO 18953 | TTGAATGGTAGTTCTGTTTC | TAG | chr12 | 21586783 | 21586802 | 21586786 | - |
| SEQ ID NO 18954 | AGTTCTGTTTCTAGTTCTTT | AAG | chr12 | 21586774 | 21586793 | 21586777 | - |
| SEQ ID NO 18955 | TCTTCATGCTGTCTTCCATA | AAG | chr12 | 21586748 | 21586767 | 21586751 | - |
| SEQ ID NO 18956 | CTAATTTACATTCTTACCAA | CAG | chr12 | 21586719 | 21586738 | 21586722 | - |
| SEQ ID NO 18957 | CATTCTTACCAACAGTGTAT | AAG | chr12 | 21586711 | 21586730 | 21586714 | - |
| SEQ ID NO 18958 | GTTTTGAACTTTATAATGA | TAG | chr12 | 21586652 | 21586671 | 21586655 | - |
| SEQ ID NO 18959 | ATAATGATAGCCATTCTGAC | TGG | chr12 | 21586639 | 21586658 | 21586642 | - |
| SEQ ID NO 18960 | ATAGCCATTCTGACTGGCAT | AAG | chr12 | 21586633 | 21586652 | 21586636 | - |
| SEQ ID NO 18961 | TAGCCATTCTGACTGGCATA | AGG | chr12 | 21586632 | 21586651 | 21586635 | - |
| SEQ ID NO 18962 | GCCATTCTGACTGGCATAAG | GAG | chr12 | 21586630 | 21586649 | 21586633 | - |
| SEQ ID NO 18963 | CCATTCTGACTGGCATAAGG | AGG | chr12 | 21586629 | 21586648 | 21586632 | - |
| SEQ ID NO 18964 | TGGCATAAGGAGGTATCATA | TGG | chr12 | 21586619 | 21586638 | 21586622 | - |
| SEQ ID NO 18965 | CATAAGGAGGTATCATATGG | TGG | chr12 | 21586616 | 21586635 | 21586619 | - |
| SEQ ID NO 18966 | AATTTGCATTCTCTGATTAT | TAG | chr12 | 21586589 | 21586608 | 21586592 | - |
| SEQ ID NO 18967 | AACTTTTTTTGACGTTTAT | TGG | chr12 | 21586558 | 21586577 | 21586561 | - |
| SEQ ID NO 18968 | GCCACTTGTATGTCTTCTTT | TGG | chr12 | 21586536 | 21586555 | 21586539 | - |
| SEQ ID NO 18969 | TCTTTTGGAAAATGTCTGCT | CAG | chr12 | 21586521 | 21586540 | 21586524 | - |
| SEQ ID NO 18970 | CTTTTGGAAAATGTCTGCTC | AGG | chr12 | 21586520 | 21586539 | 21586523 | - |
| SEQ ID NO 18971 | AAAATGTCTGCTCAGGACCT | GAG | chr12 | 21586513 | 21586532 | 21586516 | - |
| SEQ ID NO 18972 | CCTGAGCTCACTGTATTTGT | CAG | chr12 | 21586496 | 21586515 | 21586499 | - |
| SEQ ID NO 18973 | CTGAGCTCACTGTATTTGTC | AGG | chr12 | 21586495 | 21586514 | 21586498 | - |
| SEQ ID NO 18974 | TGAGCTCACTGTATTTGTCA | GGG | chr12 | 21586494 | 21586513 | 21586497 | - |
| SEQ ID NO 18975 | CTGTATTTGTCAGGGTTCCC | TAG | chr12 | 21586486 | 21586505 | 21586489 | - |

Figure 43 (Cont'd)

| SEQ ID | Sequence | Codon | Chr | Pos1 | Pos2 | Pos3 | Strand |
|---|---|---|---|---|---|---|---|
| SEQ ID NO 18976 | GTATTTGTCAGGGTTCCCTA | GAG | chr12 | 21586484 | 21586503 | 21586487 | - |
| SEQ ID NO 18977 | ATTTGTCAGGGTTCCCTAGA | GAG | chr12 | 21586482 | 21586501 | 21586485 | - |
| SEQ ID NO 18978 | GTCAGGGTTCCCTAGAGAGA | CAG | chr12 | 21586478 | 21586497 | 21586481 | - |
| SEQ ID NO 18979 | CCCTAGAGAGACAGAACTAA | TAG | chr12 | 21586469 | 21586488 | 21586472 | - |
| SEQ ID NO 18980 | CCTAGAGAGACAGAACTAAT | AGG | chr12 | 21586468 | 21586487 | 21586471 | - |
| SEQ ID NO 18981 | TAGAGAGACAGAACTAATAG | GAG | chr12 | 21586466 | 21586485 | 21586469 | - |
| SEQ ID NO 18982 | GAGACAGAACTAATAGGAGA | TAG | chr12 | 21586462 | 21586481 | 21586465 | - |
| SEQ ID NO 18983 | CAGAACTAATAGGAGATAGA | TAG | chr12 | 21586458 | 21586477 | 21586461 | - |
| SEQ ID NO 18984 | ACTAATAGGAGATAGATAGA | TAG | chr12 | 21586454 | 21586473 | 21586457 | - |
| SEQ ID NO 18985 | ATAGGAGATAGATAGATAGA | TAG | chr12 | 21586450 | 21586469 | 21586453 | - |
| SEQ ID NO 18986 | GAGATAGATAGATAGATAGA | TAG | chr12 | 21586446 | 21586465 | 21586449 | - |
| SEQ ID NO 18987 | TAGATAGATAGATAGATAGA | TAG | chr12 | 21586442 | 21586461 | 21586445 | - |
| SEQ ID NO 18988 | TAGATAGATAGATAGATAGA | TAG | chr12 | 21586438 | 21586457 | 21586441 | - |
| SEQ ID NO 18989 | TAGATAGATAGATAGATAGA | TAG | chr12 | 21586434 | 21586453 | 21586437 | - |
| SEQ ID NO 18990 | TAGATAGATAGATAGATAGA | TAG | chr12 | 21586430 | 21586449 | 21586433 | - |
| SEQ ID NO 18991 | TAGATAGATAGATAGATAGA | TAG | chr12 | 21586426 | 21586445 | 21586429 | - |
| SEQ ID NO 18992 | GATAGATAGATAGATAGATA | TAG | chr12 | 21586420 | 21586439 | 21586423 | - |
| SEQ ID NO 18993 | TAGATAGATAGATATAGATT | TAG | chr12 | 21586414 | 21586433 | 21586417 | - |
| SEQ ID NO 18994 | AGATATAGATTTAGATATAA | AAG | chr12 | 21586405 | 21586424 | 21586408 | - |
| SEQ ID NO 18995 | GATATAGATTTAGATATAAA | AGG | chr12 | 21586404 | 21586423 | 21586407 | - |
| SEQ ID NO 18996 | ATATAGATTTAGATATAAAA | GGG | chr12 | 21586403 | 21586422 | 21586406 | - |
| SEQ ID NO 18997 | ATAGATTTAGATATAAAAGG | GAG | chr12 | 21586401 | 21586420 | 21586404 | - |
| SEQ ID NO 18998 | GATATAAAAGGGAGTTTATT | AAG | chr12 | 21586392 | 21586411 | 21586395 | - |
| SEQ ID NO 18999 | ATAAAAGGGAGTTTATTAAG | TAG | chr12 | 21586389 | 21586408 | 21586392 | - |
| SEQ ID NO 19000 | GTGTTAACTTACACAATCAC | AAG | chr12 | 21586367 | 21586386 | 21586370 | - |
| SEQ ID NO 19001 | TGTTAACTTACACAATCACA | AGG | chr12 | 21586366 | 21586385 | 21586369 | - |
| SEQ ID NO 19002 | ACAATCACAAGGTCCCACAA | TAG | chr12 | 21586355 | 21586374 | 21586358 | - |
| SEQ ID NO 19003 | CAATCACAAGGTCCCACAAT | AGG | chr12 | 21586354 | 21586373 | 21586357 | - |
| SEQ ID NO 19004 | TCCCACAATAGGCCATCTGC | AAG | chr12 | 21586343 | 21586362 | 21586346 | - |
| SEQ ID NO 19005 | CACAATAGGCCATCTGCAAG | CAG | chr12 | 21586340 | 21586359 | 21586343 | - |
| SEQ ID NO 19006 | CAATAGGCCATCTGCAAGCA | GAG | chr12 | 21586338 | 21586357 | 21586341 | - |
| SEQ ID NO 19007 | AATAGGCCATCTGCAAGCAG | AGG | chr12 | 21586337 | 21586356 | 21586340 | - |
| SEQ ID NO 19008 | TAGGCCATCTGCAAGCAGAG | GAG | chr12 | 21586335 | 21586354 | 21586338 | - |
| SEQ ID NO 19009 | CCATCTGCAAGCAGAGGAGC | AAG | chr12 | 21586331 | 21586350 | 21586334 | - |
| SEQ ID NO 19010 | CATCTGCAAGCAGAGGAGCA | AGG | chr12 | 21586330 | 21586349 | 21586333 | - |
| SEQ ID NO 19011 | CTGCAAGCAGAGGAGCAAGG | AAG | chr12 | 21586327 | 21586346 | 21586330 | - |
| SEQ ID NO 19012 | AAGCAGAGGAGCAAGGAAGC | CAG | chr12 | 21586323 | 21586342 | 21586326 | - |
| SEQ ID NO 19013 | AGGAGCAAGGAAGCCAGTCC | AAG | chr12 | 21586317 | 21586336 | 21586320 | - |
| SEQ ID NO 19014 | GGAAGCCAGTCCAAGTCCCA | AAG | chr12 | 21586309 | 21586328 | 21586312 | - |
| SEQ ID NO 19015 | CAGTCCAAGTCCCAAAGCTG | AAG | chr12 | 21586303 | 21586322 | 21586306 | - |
| SEQ ID NO 19016 | AGTCCAAGTCCCAAAGCTGA | AGG | chr12 | 21586302 | 21586321 | 21586305 | - |
| SEQ ID NO 19017 | AGTCCCAAAGCTGAAGGACT | TGG | chr12 | 21586296 | 21586315 | 21586299 | - |
| SEQ ID NO 19018 | TCCCAAAGCTGAAGGACTTG | GAG | chr12 | 21586294 | 21586313 | 21586297 | - |
| SEQ ID NO 19019 | GGACTTGGAGTCCAATGTTT | GAG | chr12 | 21586281 | 21586300 | 21586284 | - |
| SEQ ID NO 19020 | GACTTGGAGTCCAATGTTTG | AGG | chr12 | 21586280 | 21586299 | 21586283 | - |
| SEQ ID NO 19021 | ACTTGGAGTCCAATGTTTGA | GGG | chr12 | 21586279 | 21586298 | 21586282 | - |
| SEQ ID NO 19022 | TGGAGTCCAATGTTTGAGGG | CAG | chr12 | 21586276 | 21586295 | 21586279 | - |

Figure 43 (Cont'd)

| SEQ ID NO 19023 | GGAGTCCAATGTTTGAGGGC | AGG | chr12 | 21586275 | 21586294 | 21586278 | - |
| SEQ ID NO 19024 | GTCCAATGTTTGAGGGCAGG | AAG | chr12 | 21586272 | 21586291 | 21586275 | - |
| SEQ ID NO 19025 | GTTTGAGGGCAGGAAGCATC | CAG | chr12 | 21586265 | 21586284 | 21586268 | - |
| SEQ ID NO 19026 | AGGGCAGGAAGCATCCAGCA | TGG | chr12 | 21586260 | 21586279 | 21586263 | - |
| SEQ ID NO 19027 | GGGCAGGAAGCATCCAGCAT | GGG | chr12 | 21586259 | 21586278 | 21586262 | - |
| SEQ ID NO 19028 | GCAGGAAGCATCCAGCATGG | GAG | chr12 | 21586257 | 21586276 | 21586260 | - |
| SEQ ID NO 19029 | GAAGCATCCAGCATGGGAGA | AAG | chr12 | 21586253 | 21586272 | 21586256 | - |
| SEQ ID NO 19030 | TCCAGCATGGGAGAAAGATG | TAG | chr12 | 21586247 | 21586266 | 21586250 | - |
| SEQ ID NO 19031 | CCAGCATGGGAGAAAGATGT | AGG | chr12 | 21586246 | 21586265 | 21586249 | - |
| SEQ ID NO 19032 | ATGGGAGAAAGATGTAGGCT | TGG | chr12 | 21586241 | 21586260 | 21586244 | - |
| SEQ ID NO 19033 | GGGAGAAAGATGTAGGCTTG | GAG | chr12 | 21586239 | 21586258 | 21586242 | - |
| SEQ ID NO 19034 | GGAGAAAGATGTAGGCTTGG | AGG | chr12 | 21586238 | 21586257 | 21586241 | - |
| SEQ ID NO 19035 | AAGATGTAGGCTTGGAGGCT | AAG | chr12 | 21586233 | 21586252 | 21586236 | - |
| SEQ ID NO 19036 | TGTAGGCTTGGAGGCTAAGC | CAG | chr12 | 21586229 | 21586248 | 21586232 | - |
| SEQ ID NO 19037 | GCTTGGAGGCTAAGCCAGTC | CAG | chr12 | 21586224 | 21586243 | 21586227 | - |
| SEQ ID NO 19038 | CTTGGAGGCTAAGCCAGTCC | AGG | chr12 | 21586223 | 21586242 | 21586226 | - |
| SEQ ID NO 19039 | TTTCTGCCTGCTTTATATCC | TGG | chr12 | 21586184 | 21586203 | 21586187 | - |
| SEQ ID NO 19040 | GCTTTATATCCTGGCCACAC | TGG | chr12 | 21586175 | 21586194 | 21586178 | - |
| SEQ ID NO 19041 | TGGCCACACTGGCAACTGAT | TAG | chr12 | 21586164 | 21586183 | 21586167 | - |
| SEQ ID NO 19042 | CACACTGGCAACTGATTAGA | TGG | chr12 | 21586160 | 21586179 | 21586163 | - |
| SEQ ID NO 19043 | CTGATTAGATGGTGCCCACC | CAG | chr12 | 21586149 | 21586168 | 21586152 | - |
| SEQ ID NO 19044 | AGATGGTGCCCACCCAGATT | AAG | chr12 | 21586143 | 21586162 | 21586146 | - |
| SEQ ID NO 19045 | GATGGTGCCCACCCAGATTA | AGG | chr12 | 21586142 | 21586161 | 21586145 | - |
| SEQ ID NO 19046 | ATGGTGCCCACCCAGATTAA | GGG | chr12 | 21586141 | 21586160 | 21586144 | - |
| SEQ ID NO 19047 | GTGCCCACCCAGATTAAGGG | TGG | chr12 | 21586138 | 21586157 | 21586141 | - |
| SEQ ID NO 19048 | TGCCCACCCAGATTAAGGGT | GGG | chr12 | 21586137 | 21586156 | 21586140 | - |
| SEQ ID NO 19049 | AAGGGTGGGTCTGCCTTTCC | CAG | chr12 | 21586123 | 21586142 | 21586126 | - |
| SEQ ID NO 19050 | ACTAAAATGTTAATCTCCTT | TGG | chr12 | 21586093 | 21586112 | 21586096 | - |
| SEQ ID NO 19051 | CTCCTTTGGCAATACCCTCA | CAG | chr12 | 21586079 | 21586098 | 21586082 | - |
| SEQ ID NO 19052 | AATACCCTCACAGACACACT | CAG | chr12 | 21586069 | 21586088 | 21586072 | - |
| SEQ ID NO 19053 | ATACCCTCACAGACACACTC | AGG | chr12 | 21586068 | 21586087 | 21586071 | - |
| SEQ ID NO 19054 | TTGCACACTTCAATCCAATC | AAG | chr12 | 21586036 | 21586055 | 21586039 | - |
| SEQ ID NO 19055 | AATCCAATCAAGTTGACACT | CAG | chr12 | 21586025 | 21586044 | 21586028 | - |
| SEQ ID NO 19056 | CACTCAGTATTAACCATCAC | AAG | chr12 | 21586009 | 21586028 | 21586012 | - |
| SEQ ID NO 19057 | AGTCCATCGCTTGTCAACTT | GAG | chr12 | 21585988 | 21586007 | 21585991 | - |
| SEQ ID NO 19058 | TGAGCCTATACACATCCCCT | GAG | chr12 | 21585969 | 21585988 | 21585972 | - |
| SEQ ID NO 19059 | GAGCCTATACACATCCCCTG | AGG | chr12 | 21585968 | 21585987 | 21585971 | - |
| SEQ ID NO 19060 | TCATACATTATCTTCAAATA | AAG | chr12 | 21585945 | 21585964 | 21585948 | - |
| SEQ ID NO 19061 | CTTCAAATAAAGACAACAAT | AAG | chr12 | 21585934 | 21585953 | 21585937 | - |
| SEQ ID NO 19062 | AATACTTAAATGCTGATATG | AAG | chr12 | 21585822 | 21585841 | 21585825 | - |
| SEQ ID NO 19063 | AAATCTTATGTCACATGATA | AAG | chr12 | 21585794 | 21585813 | 21585797 | - |
| SEQ ID NO 19064 | AATCTTATGTCACATGATAA | AGG | chr12 | 21585793 | 21585812 | 21585796 | - |
| SEQ ID NO 19065 | ATGTCACATGATAAAGGAAA | AAG | chr12 | 21585787 | 21585806 | 21585790 | - |
| SEQ ID NO 19066 | TGTCACATGATAAAGGAAAA | AGG | chr12 | 21585786 | 21585805 | 21585789 | - |
| SEQ ID NO 19067 | CACATGATAAAGGAAAAAGG | AAG | chr12 | 21585783 | 21585802 | 21585786 | - |
| SEQ ID NO 19068 | GTAAAATGTATATATTTTCT | TAG | chr12 | 21585761 | 21585780 | 21585764 | - |
| SEQ ID NO 19069 | TGTATATATTTTCTTAGTAC | AAG | chr12 | 21585755 | 21585774 | 21585758 | - |

Figure 43 (Cont'd)

| SEQ ID NO | Sequence | Codon | Chr | Pos1 | Pos2 | Pos3 | Strand |
|---|---|---|---|---|---|---|---|
| SEQ ID NO 19070 | TTTCTTAGTACAAGTGTATA | CAG | chr12 | 21585746 | 21585765 | 21585749 | - |
| SEQ ID NO 19071 | TACAAGTGTATACAGACACG | AAG | chr12 | 21585738 | 21585757 | 21585741 | - |
| SEQ ID NO 19072 | ACAAGTGTATACAGACACGA | AGG | chr12 | 21585737 | 21585756 | 21585740 | - |
| SEQ ID NO 19073 | CACGAAGGTGTTTTTAACAA | AAG | chr12 | 21585722 | 21585741 | 21585725 | - |
| SEQ ID NO 19074 | GAAGGTGTTTTTAACAAAAG | AAG | chr12 | 21585719 | 21585738 | 21585722 | - |
| SEQ ID NO 19075 | AAGGTGTTTTTAACAAAAGA | AGG | chr12 | 21585718 | 21585737 | 21585721 | - |
| SEQ ID NO 19076 | GGTGTTTTTAACAAAAGAAG | GAG | chr12 | 21585716 | 21585735 | 21585719 | - |
| SEQ ID NO 19077 | GTGTTTTTAACAAAAGAAGG | AGG | chr12 | 21585715 | 21585734 | 21585718 | - |
| SEQ ID NO 19078 | GGAAATACTCATGACAATTA | CAG | chr12 | 21585694 | 21585713 | 21585697 | - |
| SEQ ID NO 19079 | ACAGTCCTTGTATCTGCAAT | TGG | chr12 | 21585675 | 21585694 | 21585678 | - |
| SEQ ID NO 19080 | TGCAATTGGTCACGTGATCG | TAG | chr12 | 21585661 | 21585680 | 21585664 | - |
| SEQ ID NO 19081 | ATTGGTCACGTGATCGTAGC | TGG | chr12 | 21585657 | 21585676 | 21585660 | - |
| SEQ ID NO 19082 | TTCTGTATTCCCTTTGCCCT | CAG | chr12 | 21585605 | 21585624 | 21585608 | - |
| SEQ ID NO 19083 | GTATTCCCTTTGCCCTCAGC | AAG | chr12 | 21585601 | 21585620 | 21585604 | - |
| SEQ ID NO 19084 | TTTGCCCTCAGCAAGCACCT | CAG | chr12 | 21585593 | 21585612 | 21585596 | - |
| SEQ ID NO 19085 | GCCCTCAGCAAGCACCTCAG | CAG | chr12 | 21585590 | 21585609 | 21585593 | - |
| SEQ ID NO 19086 | CCCTCAGCAAGCACCTCAGC | AGG | chr12 | 21585589 | 21585608 | 21585592 | - |
| SEQ ID NO 19087 | TTTTTTTTTTTTTTTTTTCC | TGG | chr12 | 21585559 | 21585578 | 21585562 | - |
| SEQ ID NO 19088 | TTTTTTTTTTTTTTTCCTGG | TGG | chr12 | 21585556 | 21585575 | 21585559 | - |
| SEQ ID NO 19089 | TTTTTTTTTTTTCCTGGTG | GAG | chr12 | 21585554 | 21585573 | 21585557 | - |
| SEQ ID NO 19090 | GTGACCCAAACCTTTATTTG | TAG | chr12 | 21585532 | 21585551 | 21585535 | - |
| SEQ ID NO 19091 | CCTTTATTTGTAGTCCTGCC | TGG | chr12 | 21585522 | 21585541 | 21585525 | - |
| SEQ ID NO 19092 | ATTTGTAGTCCTGCCTGGAA | TGG | chr12 | 21585517 | 21585536 | 21585520 | - |
| SEQ ID NO 19093 | GTCCTGCCTGGAATGGCCTG | TAG | chr12 | 21585510 | 21585529 | 21585513 | - |
| SEQ ID NO 19094 | CTGCCTGGAATGGCCTGTAG | TAG | chr12 | 21585507 | 21585526 | 21585510 | - |
| SEQ ID NO 19095 | TTTCCCACTGACCTTAATTC | CAG | chr12 | 21585484 | 21585503 | 21585487 | - |
| SEQ ID NO 19096 | TTCCCACTGACCTTAATTCC | AGG | chr12 | 21585483 | 21585502 | 21585486 | - |
| SEQ ID NO 19097 | CTGACCTTAATTCCAGGACA | TGG | chr12 | 21585477 | 21585496 | 21585480 | - |
| SEQ ID NO 19098 | TTCCAGGACATGGTAAAACT | AAG | chr12 | 21585467 | 21585486 | 21585470 | - |
| SEQ ID NO 19099 | CCAGGACATGGTAAAACTAA | GAG | chr12 | 21585465 | 21585484 | 21585468 | - |
| SEQ ID NO 19100 | AAAACTAAGAGACACCCTAA | TGG | chr12 | 21585453 | 21585472 | 21585456 | - |
| SEQ ID NO 19101 | ACGCTTCCTTACCTCCATTG | TGG | chr12 | 21585410 | 21585429 | 21585413 | - |
| SEQ ID NO 19102 | GCTTCCTTACCTCCATTGTG | GAG | chr12 | 21585408 | 21585427 | 21585411 | - |
| SEQ ID NO 19103 | TTACCTCCATTGTGGAGTTG | TAG | chr12 | 21585402 | 21585421 | 21585405 | - |
| SEQ ID NO 19104 | GTAGACTGATTTCATCTTGA | TAG | chr12 | 21585383 | 21585402 | 21585386 | - |
| SEQ ID NO 19105 | CTGATTTCATCTTGATAGTC | TGG | chr12 | 21585378 | 21585397 | 21585381 | - |
| SEQ ID NO 19106 | TGATTTCATCTTGATAGTCT | GGG | chr12 | 21585377 | 21585396 | 21585380 | - |
| SEQ ID NO 19107 | ATAGTCTGGGTTAATCACCG | CAG | chr12 | 21585364 | 21585383 | 21585367 | - |
| SEQ ID NO 19108 | CAACACTGTAACTCTCTTCT | TAG | chr12 | 21585340 | 21585359 | 21585343 | - |
| SEQ ID NO 19109 | CTTCTTAGCCTGTTGACTTA | AAG | chr12 | 21585325 | 21585344 | 21585328 | - |
| SEQ ID NO 19110 | TTCTTAGCCTGTTGACTTAA | AGG | chr12 | 21585324 | 21585343 | 21585327 | - |
| SEQ ID NO 19111 | TTAGCCTGTTGACTTAAAGG | TGG | chr12 | 21585321 | 21585340 | 21585324 | - |
| SEQ ID NO 19112 | TAGCCTGTTGACTTAAAGGT | GGG | chr12 | 21585320 | 21585339 | 21585323 | - |
| SEQ ID NO 19113 | GCCTGTTGACTTAAAGGTGG | GAG | chr12 | 21585318 | 21585337 | 21585321 | - |
| SEQ ID NO 19114 | CCTGTTGACTTAAAGGTGGG | AGG | chr12 | 21585317 | 21585336 | 21585320 | - |
| SEQ ID NO 19115 | TGTTGACTTAAAGGTGGGAG | GAG | chr12 | 21585315 | 21585334 | 21585318 | - |
| SEQ ID NO 19116 | TTAAAGGTGGGAGGAGCCCA | AAG | chr12 | 21585308 | 21585327 | 21585311 | - |

Figure 43 (Cont'd)

| | | | | | | | |
|---|---|---|---|---|---|---|---|
| SEQ ID NO 19117 | TGGGAGGAGCCCAAAGTGTC | CAG | chr12 | 21585301 | 21585320 | 21585304 | - |
| SEQ ID NO 19118 | GGGAGGAGCCCAAAGTGTCC | AGG | chr12 | 21585300 | 21585319 | 21585303 | - |
| SEQ ID NO 19119 | AGGAGCCCAAAGTGTCCAGG | TGG | chr12 | 21585297 | 21585316 | 21585300 | - |
| SEQ ID NO 19120 | CAGGTGGCAATCTTAATTTG | CAG | chr12 | 21585281 | 21585300 | 21585284 | - |
| SEQ ID NO 19121 | AATCTTAATTTGCAGTTTAA | TGG | chr12 | 21585273 | 21585292 | 21585276 | - |
| SEQ ID NO 19122 | GGAATCATTATTGTGTCACC | TGG | chr12 | 21585252 | 21585271 | 21585255 | - |
| SEQ ID NO 19123 | ATCATTATTGTGTCACCTGG | CGG | chr12 | 21585249 | 21585268 | 21585252 | - |
| SEQ ID NO 19124 | ATTATTGTGTCACCTGGCGG | CAG | chr12 | 21585246 | 21585265 | 21585249 | - |
| SEQ ID NO 19125 | GGCGGCAGTGTTCCTCCCTC | TGG | chr12 | 21585231 | 21585250 | 21585234 | - |
| SEQ ID NO 19126 | GTGTTCCTCCCTCTGGAACT | AAG | chr12 | 21585224 | 21585243 | 21585227 | - |
| SEQ ID NO 19127 | CCTCTGGAACTAAGACCTCT | AAG | chr12 | 21585215 | 21585234 | 21585218 | - |
| SEQ ID NO 19128 | TGGAACTAAGACCTCTAAGC | CAG | chr12 | 21585211 | 21585230 | 21585214 | - |
| SEQ ID NO 19129 | AACTAAGACCTCTAAGCCAG | CAG | chr12 | 21585208 | 21585227 | 21585211 | - |
| SEQ ID NO 19130 | GCCAGCAGAACATAATGCCA | TGG | chr12 | 21585193 | 21585212 | 21585196 | - |
| SEQ ID NO 19131 | CCAGCAGAACATAATGCCAT | GGG | chr12 | 21585192 | 21585211 | 21585195 | - |
| SEQ ID NO 19132 | AGAACATAATGCCATGGGAA | CAG | chr12 | 21585187 | 21585206 | 21585190 | - |
| SEQ ID NO 19133 | GAACATAATGCCATGGGAAC | AGG | chr12 | 21585186 | 21585205 | 21585189 | - |
| SEQ ID NO 19134 | CATAATGCCATGGGAACAGG | AAG | chr12 | 21585183 | 21585202 | 21585186 | - |
| SEQ ID NO 19135 | ACAGGAAGCAAAAATTTTGC | TAG | chr12 | 21585168 | 21585187 | 21585171 | - |
| SEQ ID NO 19136 | GGAAGCAAAAATTTTGCTAG | TGG | chr12 | 21585165 | 21585184 | 21585168 | - |
| SEQ ID NO 19137 | AAATTTTGCTAGTGGAACAC | TAG | chr12 | 21585157 | 21585176 | 21585160 | - |
| SEQ ID NO 19138 | AATTTGCTAGTGGAACACT | AGG | chr12 | 21585156 | 21585175 | 21585159 | - |
| SEQ ID NO 19139 | ATTTTGCTAGTGGAACACTA | GGG | chr12 | 21585155 | 21585174 | 21585158 | - |
| SEQ ID NO 19140 | TTTTGCTAGTGGAACACTAG | GGG | chr12 | 21585154 | 21585173 | 21585157 | - |
| SEQ ID NO 19141 | TAGTGGAACACTAGGGGTGA | TGG | chr12 | 21585148 | 21585167 | 21585151 | - |
| SEQ ID NO 19142 | GGAACACTAGGGGTGATGGT | GAG | chr12 | 21585144 | 21585163 | 21585147 | - |
| SEQ ID NO 19143 | ACACTAGGGGTGATGGTGAG | TGG | chr12 | 21585141 | 21585160 | 21585144 | - |
| SEQ ID NO 19144 | CACTTCCACCCTTTGATTCC | TGG | chr12 | 21585103 | 21585122 | 21585106 | - |
| SEQ ID NO 19145 | GGACCCGTGAATCCTGTCTA | TGG | chr12 | 21585082 | 21585101 | 21585085 | - |
| SEQ ID NO 19146 | GACCCGTGAATCCTGTCTAT | GGG | chr12 | 21585081 | 21585100 | 21585084 | - |
| SEQ ID NO 19147 | CCCGTGAATCCTGTCTATGG | GAG | chr12 | 21585079 | 21585098 | 21585082 | - |
| SEQ ID NO 19148 | AATCCTGTCTATGGGAGAAA | CAG | chr12 | 21585073 | 21585092 | 21585076 | - |
| SEQ ID NO 19149 | GGAGAAACAGTACCATATAT | TGG | chr12 | 21585060 | 21585079 | 21585063 | - |
| SEQ ID NO 19150 | CCATATATTGGACACTGATT | CAG | chr12 | 21585048 | 21585067 | 21585051 | - |
| SEQ ID NO 19151 | ATATATTGGACACTGATTCA | GAG | chr12 | 21585046 | 21585065 | 21585049 | - |
| SEQ ID NO 19152 | ACACTGATTCAGAGCATACA | CAG | chr12 | 21585037 | 21585056 | 21585040 | - |
| SEQ ID NO 19153 | TCAGAGCATACACAGCCTTC | TGG | chr12 | 21585029 | 21585048 | 21585032 | - |
| SEQ ID NO 19154 | AGAGCATACACAGCCTTCTG | GAG | chr12 | 21585027 | 21585046 | 21585030 | - |
| SEQ ID NO 19155 | CCTTCTGGAGAACTTTGCCC | CAG | chr12 | 21585014 | 21585033 | 21585017 | - |
| SEQ ID NO 19156 | CTTCTGGAGAACTTTGCCCC | AGG | chr12 | 21585013 | 21585032 | 21585016 | - |
| SEQ ID NO 19157 | AACTTTGCCCCAGGCCTGCA | AAG | chr12 | 21585004 | 21585023 | 21585007 | - |
| SEQ ID NO 19158 | GCCTGCAAAGTATTGTCACC | TAG | chr12 | 21584991 | 21585010 | 21584994 | - |
| SEQ ID NO 19159 | GCAAAGTATTGTCACCTAGT | TGG | chr12 | 21584987 | 21585006 | 21584990 | - |
| SEQ ID NO 19160 | CATTGTAATCGTGACTTCAA | AAG | chr12 | 21584964 | 21584983 | 21584967 | - |
| SEQ ID NO 19161 | ATTGTAATCGTGACTTCAAA | AGG | chr12 | 21584963 | 21584982 | 21584966 | - |
| SEQ ID NO 19162 | GACTTCAAAAGGCCATTCAA | AAG | chr12 | 21584952 | 21584971 | 21584955 | - |
| SEQ ID NO 19163 | AGGCCATTCAAAAGCTGCTT | CAG | chr12 | 21584943 | 21584962 | 21584946 | - |

Figure 43 (Cont'd)

| SEQ ID NO 19164 | GGCCATTCAAAAGCTGCTTC | AGG | chr12 | 21584942 | 21584961 | 21584945 | - |
| SEQ ID NO 19165 | CAAAAGCTGCTTCAGGATGA | TAG | chr12 | 21584935 | 21584954 | 21584938 | - |
| SEQ ID NO 19166 | AAAAGCTGCTTCAGGATGAT | AGG | chr12 | 21584934 | 21584953 | 21584937 | - |
| SEQ ID NO 19167 | AAAGCTGCTTCAGGATGATA | GGG | chr12 | 21584933 | 21584952 | 21584936 | - |
| SEQ ID NO 19168 | CTTCAGGATGATAGGGATCA | TGG | chr12 | 21584926 | 21584945 | 21584929 | - |
| SEQ ID NO 19169 | AGGATGATAGGGATCATGGT | AAG | chr12 | 21584922 | 21584941 | 21584925 | - |
| SEQ ID NO 19170 | GATAGGGATCATGGTAAGAC | CAG | chr12 | 21584917 | 21584936 | 21584920 | - |
| SEQ ID NO 19171 | GTAAGACCAGTAAATTCCAT | GAG | chr12 | 21584904 | 21584923 | 21584907 | - |
| SEQ ID NO 19172 | CCAGTAAATTCCATGAGCAT | GAG | chr12 | 21584898 | 21584917 | 21584901 | - |
| SEQ ID NO 19173 | AGCCCACTGTCACACTTCTT | TAG | chr12 | 21584877 | 21584896 | 21584880 | - |
| SEQ ID NO 19174 | GTCACACTTCTTTAGCCATA | AAG | chr12 | 21584869 | 21584888 | 21584872 | - |
| SEQ ID NO 19175 | CACTTCTTTAGCCATAAAGT | GAG | chr12 | 21584865 | 21584884 | 21584868 | - |
| SEQ ID NO 19176 | TTCTTTAGCCATAAAGTGAG | TGG | chr12 | 21584862 | 21584881 | 21584865 | - |
| SEQ ID NO 19177 | TAGCCATAAAGTGAGTGGCT | TGG | chr12 | 21584857 | 21584876 | 21584860 | - |
| SEQ ID NO 19178 | CATAAAGTGAGTGGCTTGGT | CAG | chr12 | 21584853 | 21584872 | 21584856 | - |
| SEQ ID NO 19179 | AAAGTGAGTGGCTTGGTCAG | AAG | chr12 | 21584850 | 21584869 | 21584853 | - |
| SEQ ID NO 19180 | TGGTCAGAAGCAATGCTGTG | TGG | chr12 | 21584837 | 21584856 | 21584840 | - |
| SEQ ID NO 19181 | TGCTGTGTGGAATACCATGA | CAG | chr12 | 21584824 | 21584843 | 21584827 | - |
| SEQ ID NO 19182 | TGTGTGGAATACCATGACAG | TGG | chr12 | 21584821 | 21584840 | 21584824 | - |
| SEQ ID NO 19183 | GAATACCATGACAGTGGATA | CGG | chr12 | 21584815 | 21584834 | 21584818 | - |
| SEQ ID NO 19184 | TACGGCATTCTGTGATTCCA | TGG | chr12 | 21584797 | 21584816 | 21584800 | - |
| SEQ ID NO 19185 | GCATTCTGTGATTCCATGGA | TGG | chr12 | 21584793 | 21584812 | 21584796 | - |
| SEQ ID NO 19186 | TTCTGTGATTCCATGGATGG | TAG | chr12 | 21584790 | 21584809 | 21584793 | - |
| SEQ ID NO 19187 | GATTCCATGGATGGTAGTCT | TGG | chr12 | 21584784 | 21584803 | 21584787 | - |
| SEQ ID NO 19188 | ATGGATGGTAGTCTTGGCAT | AAG | chr12 | 21584778 | 21584797 | 21584781 | - |
| SEQ ID NO 19189 | GTAGTCTTGGCATAAGCATT | GAG | chr12 | 21584771 | 21584790 | 21584774 | - |
| SEQ ID NO 19190 | CTTGGCATAAGCATTGAGTT | CAG | chr12 | 21584766 | 21584785 | 21584769 | - |
| SEQ ID NO 19191 | TTGGCATAAGCATTGAGTTC | AGG | chr12 | 21584765 | 21584784 | 21584768 | - |
| SEQ ID NO 19192 | ATAAGCATTGAGTTCAGGAT | TGG | chr12 | 21584760 | 21584779 | 21584763 | - |
| SEQ ID NO 19193 | TAAGCATTGAGTTCAGGATT | GGG | chr12 | 21584759 | 21584778 | 21584762 | - |
| SEQ ID NO 19194 | AGGATTGGGAAACCCATATC | CAG | chr12 | 21584745 | 21584764 | 21584748 | - |
| SEQ ID NO 19195 | GATTGGGAAACCCATATCCA | GAG | chr12 | 21584743 | 21584762 | 21584746 | - |
| SEQ ID NO 19196 | GGGAAACCCATATCCAGAGT | AAG | chr12 | 21584739 | 21584758 | 21584742 | - |
| SEQ ID NO 19197 | TCCAGAGTAAGTGTCTATTC | CAG | chr12 | 21584727 | 21584746 | 21584730 | - |
| SEQ ID NO 19198 | GAGTAAGTGTCTATTCCAGT | GAG | chr12 | 21584723 | 21584742 | 21584726 | - |
| SEQ ID NO 19199 | AGTAAGTGTCTATTCCAGTG | AGG | chr12 | 21584722 | 21584741 | 21584725 | - |
| SEQ ID NO 19200 | GTGTCTATTCCAGTGAGGAC | AAG | chr12 | 21584717 | 21584736 | 21584720 | - |
| SEQ ID NO 19201 | AGCCTCTGCCCTTTCCATGA | TGG | chr12 | 21584696 | 21584715 | 21584699 | - |
| SEQ ID NO 19202 | CTCTGCCCTTTCCATGATGG | AAG | chr12 | 21584693 | 21584712 | 21584696 | - |
| SEQ ID NO 19203 | CTGCCCTTTCCATGATGGAA | GAG | chr12 | 21584691 | 21584710 | 21584694 | - |
| SEQ ID NO 19204 | TGCCCTTTCCATGATGGAAG | AGG | chr12 | 21584690 | 21584709 | 21584693 | - |
| SEQ ID NO 19205 | CAATATAATCAACCTGCCAC | CAG | chr12 | 21584665 | 21584684 | 21584668 | - |
| SEQ ID NO 19206 | AATATAATCAACCTGCCACC | AGG | chr12 | 21584664 | 21584683 | 21584667 | - |
| SEQ ID NO 19207 | ATAATCAACCTGCCACCAGG | TAG | chr12 | 21584661 | 21584680 | 21584664 | - |
| SEQ ID NO 19208 | TCAACCTGCCACCAGGTAGC | TGG | chr12 | 21584657 | 21584676 | 21584660 | - |
| SEQ ID NO 19209 | GGTAGCTGGCTGATCACCCC | GAG | chr12 | 21584643 | 21584662 | 21584646 | - |
| SEQ ID NO 19210 | GTAGCTGGCTGATCACCCCG | AGG | chr12 | 21584642 | 21584661 | 21584645 | - |

Figure 43 (Cont'd)

| SEQ ID NO 19211 | TGGCTGATCACCCCGAGGAA | TGG | chr12 | 21584637 | 21584656 | 21584640 | - |
| SEQ ID NO 19212 | CCGAGGAATGGTGCCATATC | AAG | chr12 | 21584625 | 21584644 | 21584628 | - |
| SEQ ID NO 19213 | CGAGGAATGGTGCCATATCA | AGG | chr12 | 21584624 | 21584643 | 21584627 | - |
| SEQ ID NO 19214 | GAGGAATGGTGCCATATCAA | GGG | chr12 | 21584623 | 21584642 | 21584626 | - |
| SEQ ID NO 19215 | ATGGTGCCATATCAAGGGCT | TAG | chr12 | 21584618 | 21584637 | 21584621 | - |
| SEQ ID NO 19216 | CCATATCAAGGGCTTAGTGT | TGG | chr12 | 21584612 | 21584631 | 21584615 | - |
| SEQ ID NO 19217 | TTAGTGTTGGTCTCTGATGC | TGG | chr12 | 21584599 | 21584618 | 21584602 | - |
| SEQ ID NO 19218 | TGTTGGTCTCTGATGCTGGC | AAG | chr12 | 21584595 | 21584614 | 21584598 | - |
| SEQ ID NO 19219 | TGGTCTCTGATGCTGGCAAG | CAG | chr12 | 21584592 | 21584611 | 21584595 | - |
| SEQ ID NO 19220 | TCTCTGATGCTGGCAAGCAG | TGG | chr12 | 21584589 | 21584608 | 21584592 | - |
| SEQ ID NO 19221 | ATGCTGGCAAGCAGTGGCTG | TGG | chr12 | 21584583 | 21584602 | 21584586 | - |
| SEQ ID NO 19222 | TGGCAAGCAGTGGCTGTGGC | CAG | chr12 | 21584579 | 21584598 | 21584582 | - |
| SEQ ID NO 19223 | GGCAAGCAGTGGCTGTGGCC | AGG | chr12 | 21584578 | 21584597 | 21584581 | - |
| SEQ ID NO 19224 | AGCAGTGGCTGTGGCCAGGT | CAG | chr12 | 21584574 | 21584593 | 21584577 | - |
| SEQ ID NO 19225 | GGCTGTGGCCAGGTCAGCTT | TGG | chr12 | 21584568 | 21584587 | 21584571 | - |
| SEQ ID NO 19226 | GTGGCCAGGTCAGCTTTGGT | GAG | chr12 | 21584564 | 21584583 | 21584567 | - |
| SEQ ID NO 19227 | GCCAGGTCAGCTTTGGTGAG | TGG | chr12 | 21584561 | 21584580 | 21584564 | - |
| SEQ ID NO 19228 | AGGTCAGCTTTGGTGAGTGG | AAG | chr12 | 21584558 | 21584577 | 21584561 | - |
| SEQ ID NO 19229 | GAGTGGAAGTCCATGTTGCT | GAG | chr12 | 21584544 | 21584563 | 21584547 | - |
| SEQ ID NO 19230 | AAGTCCATGTTGCTGAGCCC | AAG | chr12 | 21584538 | 21584557 | 21584541 | - |
| SEQ ID NO 19231 | AACTTCCATCCCTGCAACTG | TGG | chr12 | 21584512 | 21584531 | 21584515 | - |
| SEQ ID NO 19232 | AACTGTGGCCACTTTGTTCA | TGG | chr12 | 21584497 | 21584516 | 21584500 | - |
| SEQ ID NO 19233 | ACTGTGGCCACTTTGTTCAT | GGG | chr12 | 21584496 | 21584515 | 21584499 | - |
| SEQ ID NO 19234 | CACTTTGTTCATGGGTCCAT | TGG | chr12 | 21584488 | 21584507 | 21584491 | - |
| SEQ ID NO 19235 | GGTCCATTGGACGATGACAT | GAG | chr12 | 21584475 | 21584494 | 21584478 | - |
| SEQ ID NO 19236 | CCATTGGACGATGACATGAG | TGG | chr12 | 21584472 | 21584491 | 21584475 | - |
| SEQ ID NO 19237 | GGACGATGACATGAGTGGCC | TGG | chr12 | 21584467 | 21584486 | 21584470 | - |
| SEQ ID NO 19238 | GACGATGACATGAGTGGCCT | GGG | chr12 | 21584466 | 21584485 | 21584469 | - |
| SEQ ID NO 19239 | TGACATGAGTGGCCTGGGAA | AAG | chr12 | 21584461 | 21584480 | 21584464 | - |
| SEQ ID NO 19240 | GACATGAGTGGCCTGGGAAA | AGG | chr12 | 21584460 | 21584479 | 21584463 | - |
| SEQ ID NO 19241 | GAGTGGCCTGGGAAAAGGCT | GAG | chr12 | 21584455 | 21584474 | 21584458 | - |
| SEQ ID NO 19242 | TGGCCTGGGAAAAGGCTGAG | TGG | chr12 | 21584452 | 21584471 | 21584455 | - |
| SEQ ID NO 19243 | AAAAGGCTGAGTGGTGTCCA | CAG | chr12 | 21584443 | 21584462 | 21584446 | - |
| SEQ ID NO 19244 | TATTAAAATCCTCTTCTGCT | GAG | chr12 | 21584396 | 21584415 | 21584399 | - |
| SEQ ID NO 19245 | ATTAAAATCCTCTTCTGCTG | AGG | chr12 | 21584395 | 21584414 | 21584398 | - |
| SEQ ID NO 19246 | CTTCTGCTGAGGTCACCCAT | TGG | chr12 | 21584384 | 21584403 | 21584387 | - |
| SEQ ID NO 19247 | TGCTGAGGTCACCCATTGGT | GAG | chr12 | 21584380 | 21584399 | 21584383 | - |
| SEQ ID NO 19248 | CCCATTGGTGAGCACTCACA | TGG | chr12 | 21584369 | 21584388 | 21584372 | - |
| SEQ ID NO 19249 | CCATTGGTGAGCACTCACAT | GGG | chr12 | 21584368 | 21584387 | 21584371 | - |
| SEQ ID NO 19250 | ATGGGATGAAAATATCTTTG | TAG | chr12 | 21584350 | 21584369 | 21584353 | - |
| SEQ ID NO 19251 | TTGTAGTTTTGACTAATCA | TAG | chr12 | 21584333 | 21584352 | 21584336 | - |
| SEQ ID NO 19252 | GTAGTTTTGACTAATCATA | GAG | chr12 | 21584331 | 21584350 | 21584334 | - |
| SEQ ID NO 19253 | TAGTTTTGACTAATCATAG | AGG | chr12 | 21584330 | 21584349 | 21584333 | - |
| SEQ ID NO 19254 | TTTCTTTGTCATCAATTTTC | CAG | chr12 | 21584282 | 21584301 | 21584285 | - |
| SEQ ID NO 19255 | TTTCCAGTCATGCTTTTTCC | AAG | chr12 | 21584266 | 21584285 | 21584269 | - |
| SEQ ID NO 19256 | TTTCCAAGTCCCTGACCATC | TAG | chr12 | 21584251 | 21584270 | 21584254 | - |
| SEQ ID NO 19257 | TGACCATCTAGCCAAACCTT | TGG | chr12 | 21584239 | 21584258 | 21584242 | - |

Figure 43 (Cont'd)

| | | | | | | | |
|---|---|---|---|---|---|---|---|
| SEQ ID NO 19258 | TCTAGCCAAACCTTTGGCTA | CAG | chr12 | 21584233 | 21584252 | 21584236 | - |
| SEQ ID NO 19259 | TTTGGCTACAGCCCATGAAT | AAG | chr12 | 21584221 | 21584240 | 21584224 | - |
| SEQ ID NO 19260 | TAAGTATATAATCGCAAATC | TGG | chr12 | 21584202 | 21584221 | 21584205 | - |
| SEQ ID NO 19261 | GCCATTTCTCCTTCTGTGCA | AAG | chr12 | 21584180 | 21584199 | 21584183 | - |
| SEQ ID NO 19262 | TTCTGTGCAAAGTGCACAAC | CAG | chr12 | 21584169 | 21584188 | 21584172 | - |
| SEQ ID NO 19263 | TCTGTGCAAAGTGCACAACC | AGG | chr12 | 21584168 | 21584187 | 21584171 | - |
| SEQ ID NO 19264 | ACAACCAGGCACACTGCTCA | AAG | chr12 | 21584154 | 21584173 | 21584157 | - |
| SEQ ID NO 19265 | CTGCTCAAAGTTCTGCCAAC | TAG | chr12 | 21584141 | 21584160 | 21584144 | - |
| SEQ ID NO 19266 | TGCTCAAAGTTCTGCCAACT | AGG | chr12 | 21584140 | 21584159 | 21584143 | - |
| SEQ ID NO 19267 | TCAAAGTTCTGCCAACTAGG | AAG | chr12 | 21584137 | 21584156 | 21584140 | - |
| SEQ ID NO 19268 | TTCCCTTCACCGTTGTCCTT | CAG | chr12 | 21584112 | 21584131 | 21584115 | - |
| SEQ ID NO 19269 | TCCCTTCACCGTTGTCCTTC | AGG | chr12 | 21584111 | 21584130 | 21584114 | - |
| SEQ ID NO 19270 | CCCTTCACCGTTGTCCTTCA | GGG | chr12 | 21584110 | 21584129 | 21584113 | - |
| SEQ ID NO 19271 | GTTGTCCTTCAGGGATGTCC | TAG | chr12 | 21584101 | 21584120 | 21584104 | - |
| SEQ ID NO 19272 | TCCTTCAGGGATGTCCTAGA | AAG | chr12 | 21584097 | 21584116 | 21584100 | - |
| SEQ ID NO 19273 | CCTTCAGGGATGTCCTAGAA | AGG | chr12 | 21584096 | 21584115 | 21584099 | - |
| SEQ ID NO 19274 | CTTCAGGGATGTCCTAGAAA | GGG | chr12 | 21584095 | 21584114 | 21584098 | - |
| SEQ ID NO 19275 | TTCAGGGATGTCCTAGAAAG | GGG | chr12 | 21584094 | 21584113 | 21584097 | - |
| SEQ ID NO 19276 | GATGTCCTAGAAAGGGGCTG | TAG | chr12 | 21584088 | 21584107 | 21584091 | - |
| SEQ ID NO 19277 | AGAAAGGGGCTGTAGTGCTG | CGG | chr12 | 21584080 | 21584099 | 21584083 | - |
| SEQ ID NO 19278 | GTGCTGCGGCTGTCCACTTT | TGG | chr12 | 21584066 | 21584085 | 21584069 | - |
| SEQ ID NO 19279 | TGCTGCGGCTGTCCACTTTT | GGG | chr12 | 21584065 | 21584084 | 21584068 | - |
| SEQ ID NO 19280 | TGCGGCTGTCCACTTTTGGG | TGG | chr12 | 21584062 | 21584081 | 21584065 | - |
| SEQ ID NO 19281 | GGTGGTGCCTGCATATCGTG | CAG | chr12 | 21584044 | 21584063 | 21584047 | - |
| SEQ ID NO 19282 | GTGCAGAACTATCTGTGAAC | CAG | chr12 | 21584027 | 21584046 | 21584030 | - |
| SEQ ID NO 19283 | TGCAGAACTATCTGTGAACC | AGG | chr12 | 21584026 | 21584045 | 21584029 | - |
| SEQ ID NO 19284 | ACTATCTGTGAACCAGGACC | TAG | chr12 | 21584020 | 21584039 | 21584023 | - |
| SEQ ID NO 19285 | CTAGTCTTCTCTTCCTCTGT | CAG | chr12 | 21584001 | 21584020 | 21584004 | - |
| SEQ ID NO 19286 | CTTCCTCTGTCAGCTGATCA | TAG | chr12 | 21583991 | 21584010 | 21583994 | - |
| SEQ ID NO 19287 | TTCCTCTGTCAGCTGATCAT | AGG | chr12 | 21583990 | 21584009 | 21583993 | - |
| SEQ ID NO 19288 | TCCTCTGTCAGCTGATCATA | GGG | chr12 | 21583989 | 21584008 | 21583992 | - |
| SEQ ID NO 19289 | GATCATAGGGAACTCCCCAT | GAG | chr12 | 21583976 | 21583995 | 21583979 | - |
| SEQ ID NO 19290 | GGAACTCCCCATGAGACCAT | CGG | chr12 | 21583968 | 21583987 | 21583971 | - |
| SEQ ID NO 19291 | TCCCCATGAGACCATCGGTG | CAG | chr12 | 21583963 | 21583982 | 21583966 | - |
| SEQ ID NO 19292 | TGAGACCATCGGTGCAGTCT | CAG | chr12 | 21583957 | 21583976 | 21583960 | - |
| SEQ ID NO 19293 | GAGACCATCGGTGCAGTCTC | AGG | chr12 | 21583956 | 21583975 | 21583959 | - |
| SEQ ID NO 19294 | AGACCATCGGTGCAGTCTCA | GGG | chr12 | 21583955 | 21583974 | 21583958 | - |
| SEQ ID NO 19295 | ACCATCGGTGCAGTCTCAGG | GAG | chr12 | 21583953 | 21583972 | 21583956 | - |
| SEQ ID NO 19296 | CATCGGTGCAGTCTCAGGGA | GAG | chr12 | 21583951 | 21583970 | 21583954 | - |
| SEQ ID NO 19297 | GGTGCAGTCTCAGGGAGAGA | AAG | chr12 | 21583947 | 21583966 | 21583950 | - |
| SEQ ID NO 19298 | GCAGTCTCAGGGAGAGAAAG | CAG | chr12 | 21583944 | 21583963 | 21583947 | - |
| SEQ ID NO 19299 | AGGGAGAGAAAGCAGTGTGT | CAG | chr12 | 21583936 | 21583955 | 21583939 | - |
| SEQ ID NO 19300 | GGGAGAGAAAGCAGTGTGTC | AGG | chr12 | 21583935 | 21583954 | 21583938 | - |
| SEQ ID NO 19301 | GAGAGAAAGCAGTGTGTCAG | GAG | chr12 | 21583933 | 21583952 | 21583936 | - |
| SEQ ID NO 19302 | AGAAAGCAGTGTGTCAGGAG | TGG | chr12 | 21583930 | 21583949 | 21583933 | - |
| SEQ ID NO 19303 | AAAGCAGTGTGTCAGGAGTG | GAG | chr12 | 21583928 | 21583947 | 21583931 | - |
| SEQ ID NO 19304 | TGTGTCAGGAGTGGAGACCA | TGG | chr12 | 21583921 | 21583940 | 21583924 | - |

Figure 43 (Cont'd)

| SEQ ID NO 19305 | GTGTCAGGAGTGGAGACCAT | GGG | chr12 | 21583920 | 21583939 | 21583923 | - |
| SEQ ID NO 19306 | AGTGGAGACCATGGGCATTT | GAG | chr12 | 21583912 | 21583931 | 21583915 | - |
| SEQ ID NO 19307 | CCCTTTCTCATGTAACTTAC | TAG | chr12 | 21583888 | 21583907 | 21583891 | - |
| SEQ ID NO 19308 | ATGTAACTTACTAGTGCCTT | CAG | chr12 | 21583879 | 21583898 | 21583882 | - |
| SEQ ID NO 19309 | TGTAACTTACTAGTGCCTTC | AGG | chr12 | 21583878 | 21583897 | 21583881 | - |
| SEQ ID NO 19310 | AGTGCCTTCAGGATCTGCTC | AAG | chr12 | 21583867 | 21583886 | 21583870 | - |
| SEQ ID NO 19311 | TGATGCAATGCTGCTGTGCA | CAG | chr12 | 21583814 | 21583833 | 21583817 | - |
| SEQ ID NO 19312 | GCTGTGCACAGCCCACTTTA | TGG | chr12 | 21583802 | 21583821 | 21583805 | - |
| SEQ ID NO 19313 | TGCACAGCCCACTTTATGGC | TAG | chr12 | 21583798 | 21583817 | 21583801 | - |
| SEQ ID NO 19314 | CAGCCCACTTTATGGCTAGA | TGG | chr12 | 21583794 | 21583813 | 21583797 | - |
| SEQ ID NO 19315 | CACTTTATGGCTAGATGGAT | CAG | chr12 | 21583789 | 21583808 | 21583792 | - |
| SEQ ID NO 19316 | TTATGGCTAGATGGATCAGA | AAG | chr12 | 21583785 | 21583804 | 21583788 | - |
| SEQ ID NO 19317 | TAGATGGATCAGAAAGCACC | CAG | chr12 | 21583778 | 21583797 | 21583781 | - |
| SEQ ID NO 19318 | AGAAAGCACCCAGTTCATGA | TAG | chr12 | 21583768 | 21583787 | 21583771 | - |
| SEQ ID NO 19319 | GAAAGCACCCAGTTCATGAT | AGG | chr12 | 21583767 | 21583786 | 21583770 | - |
| SEQ ID NO 19320 | AGCACCCAGTTCATGATAGG | CAG | chr12 | 21583764 | 21583783 | 21583767 | - |
| SEQ ID NO 19321 | CCAGTTCATGATAGGCAGTT | CAG | chr12 | 21583759 | 21583778 | 21583762 | - |
| SEQ ID NO 19322 | CAGTTCATGATAGGCAGTTC | AGG | chr12 | 21583758 | 21583777 | 21583761 | - |
| SEQ ID NO 19323 | GATAGGCAGTTCAGGTCACA | TGG | chr12 | 21583750 | 21583769 | 21583753 | - |
| SEQ ID NO 19324 | CATGGTGACTTGATGACTCA | TAG | chr12 | 21583732 | 21583751 | 21583735 | - |
| SEQ ID NO 19325 | CAAATATTTCGTTTCCACCA | AAG | chr12 | 21583708 | 21583727 | 21583711 | - |
| SEQ ID NO 19326 | ATTTCGTTTCCACCAAAGCC | CAG | chr12 | 21583703 | 21583722 | 21583706 | - |
| SEQ ID NO 19327 | TTTCCACCAAAGCCCAGTAA | CAG | chr12 | 21583697 | 21583716 | 21583700 | - |
| SEQ ID NO 19328 | TTCCACCAAAGCCCAGTAAC | AGG | chr12 | 21583696 | 21583715 | 21583699 | - |
| SEQ ID NO 19329 | CCAAAGCCCAGTAACAGGCC | AAG | chr12 | 21583691 | 21583710 | 21583694 | - |
| SEQ ID NO 19330 | AAAGCCCAGTAACAGGCCAA | GAG | chr12 | 21583689 | 21583708 | 21583692 | - |
| SEQ ID NO 19331 | GCCAAGAGCTTTCTCCCTAA | AAG | chr12 | 21583674 | 21583693 | 21583677 | - |
| SEQ ID NO 19332 | CAAGAGCTTTCTCCCTAAAA | GAG | chr12 | 21583672 | 21583691 | 21583675 | - |
| SEQ ID NO 19333 | AGAGCTTTCTCCCTAAAAGA | GAG | chr12 | 21583670 | 21583689 | 21583673 | - |
| SEQ ID NO 19334 | GCTTTCTCCCTAAAAGAGAG | TAG | chr12 | 21583667 | 21583686 | 21583670 | - |
| SEQ ID NO 19335 | TAAAAGAGAGTAGTTATCTG | CAG | chr12 | 21583657 | 21583676 | 21583660 | - |
| SEQ ID NO 19336 | AAGAGAGTAGTTATCTGCAG | AAG | chr12 | 21583654 | 21583673 | 21583657 | - |
| SEQ ID NO 19337 | GAGTAGTTATCTGCAGAAGA | TGG | chr12 | 21583650 | 21583669 | 21583653 | - |
| SEQ ID NO 19338 | TAGTTATCTGCAGAAGATGG | CAG | chr12 | 21583647 | 21583666 | 21583650 | - |
| SEQ ID NO 19339 | AGTTATCTGCAGAAGATGGC | AGG | chr12 | 21583646 | 21583665 | 21583649 | - |
| SEQ ID NO 19340 | GTTATCTGCAGAAGATGGCA | GGG | chr12 | 21583645 | 21583664 | 21583648 | - |
| SEQ ID NO 19341 | AGGGCCTTGCTCCAAAATCC | TAG | chr12 | 21583626 | 21583645 | 21583629 | - |
| SEQ ID NO 19342 | GGCCTTGCTCCAAAATCCTA | GAG | chr12 | 21583624 | 21583643 | 21583627 | - |
| SEQ ID NO 19343 | GCCTTGCTCCAAAATCCTAG | AGG | chr12 | 21583623 | 21583642 | 21583626 | - |
| SEQ ID NO 19344 | TAGAGGCCTCCGCTGTGATT | CAG | chr12 | 21583606 | 21583625 | 21583609 | - |
| SEQ ID NO 19345 | AGCCTGCCAAATGCTCCAAA | CAG | chr12 | 21583585 | 21583604 | 21583588 | - |
| SEQ ID NO 19346 | CTCCAAACAGCATCCCTATC | TGG | chr12 | 21583572 | 21583591 | 21583575 | - |
| SEQ ID NO 19347 | CTATCTGGCACTGACACCTC | AAG | chr12 | 21583557 | 21583576 | 21583560 | - |
| SEQ ID NO 19348 | ACTGACACCTCAAGCATCAT | TGG | chr12 | 21583548 | 21583567 | 21583551 | - |
| SEQ ID NO 19349 | TCAAGCATCATTGGATCTGC | TAG | chr12 | 21583539 | 21583558 | 21583542 | - |
| SEQ ID NO 19350 | CAAGCATCATTGGATCTGCT | AGG | chr12 | 21583538 | 21583557 | 21583541 | - |
| SEQ ID NO 19351 | ATTGGATCTGCTAGGTCATA | TGG | chr12 | 21583530 | 21583549 | 21583533 | - |

Figure 43 (Cont'd)

| | | | | | | | |
|---|---|---|---|---|---|---|---|
| SEQ ID NO 19352 | TCTGCTAGGTCATATGGCCC | AAG | chr12 | 21583524 | 21583543 | 21583527 | - |
| SEQ ID NO 19353 | GCTAGGTCATATGGCCCAAG | TGG | chr12 | 21583521 | 21583540 | 21583524 | - |
| SEQ ID NO 19354 | GTCATATGGCCCAAGTGGCA | TAG | chr12 | 21583516 | 21583535 | 21583519 | - |
| SEQ ID NO 19355 | ATATGGCCCAAGTGGCATAG | CAG | chr12 | 21583513 | 21583532 | 21583516 | - |
| SEQ ID NO 19356 | AAGTGGCATAGCAGCTTGCA | CAG | chr12 | 21583504 | 21583523 | 21583507 | - |
| SEQ ID NO 19357 | TGGCATAGCAGCTTGCACAG | CAG | chr12 | 21583501 | 21583520 | 21583504 | - |
| SEQ ID NO 19358 | TAGCAGCTTGCACAGCAGCC | TGG | chr12 | 21583496 | 21583515 | 21583499 | - |
| SEQ ID NO 19359 | TGCACAGCAGCCTGGACCTG | TGG | chr12 | 21583488 | 21583507 | 21583491 | - |
| SEQ ID NO 19360 | ACAGCAGCCTGGACCTGTGG | CAG | chr12 | 21583485 | 21583504 | 21583488 | - |
| SEQ ID NO 19361 | AGCAGCCTGGACCTGTGGCA | GAG | chr12 | 21583483 | 21583502 | 21583486 | - |
| SEQ ID NO 19362 | TGTGGCAGAGCCTTCTGTTC | TGG | chr12 | 21583470 | 21583489 | 21583473 | - |
| SEQ ID NO 19363 | TTCTGGACTCCACTCAAAAC | TGG | chr12 | 21583453 | 21583472 | 21583456 | - |
| SEQ ID NO 19364 | TGGACTCCACTCAAAACTGG | CAG | chr12 | 21583450 | 21583469 | 21583453 | - |
| SEQ ID NO 19365 | ACTCAAAACTGGCAGCCTTT | TGG | chr12 | 21583442 | 21583461 | 21583445 | - |
| SEQ ID NO 19366 | CTTTTGGATCACTCGATAAA | TGG | chr12 | 21583426 | 21583445 | 21583429 | - |
| SEQ ID NO 19367 | TTTTGGATCACTCGATAAAT | GGG | chr12 | 21583425 | 21583444 | 21583428 | - |
| SEQ ID NO 19368 | GGATCACTCGATAAATGGGC | CAG | chr12 | 21583421 | 21583440 | 21583424 | - |
| SEQ ID NO 19369 | ATCACTCGATAAATGGGCCA | GAG | chr12 | 21583419 | 21583438 | 21583422 | - |
| SEQ ID NO 19370 | CCAGAGTAACACACCCAAAT | CAG | chr12 | 21583402 | 21583421 | 21583405 | - |
| SEQ ID NO 19371 | CAGAGTAACACACCCAAATC | AGG | chr12 | 21583401 | 21583420 | 21583404 | - |
| SEQ ID NO 19372 | TGTTGCCTCCAAAATCCAAA | TAG | chr12 | 21583374 | 21583393 | 21583377 | - |
| SEQ ID NO 19373 | GTTGCCTCCAAAATCCAAAT | AGG | chr12 | 21583373 | 21583392 | 21583376 | - |
| SEQ ID NO 19374 | CAAAATCCAAATAGGCCCAC | TAG | chr12 | 21583365 | 21583384 | 21583368 | - |
| SEQ ID NO 19375 | AAAATCCAAATAGGCCCACT | AGG | chr12 | 21583364 | 21583383 | 21583367 | - |
| SEQ ID NO 19376 | TAGGCGTTGTGCCTATTTCT | TGG | chr12 | 21583345 | 21583364 | 21583348 | - |
| SEQ ID NO 19377 | TGTGCCTATTTCTTGGTTGT | AAG | chr12 | 21583338 | 21583357 | 21583341 | - |
| SEQ ID NO 19378 | TGCCTATTTCTTGGTTGTAA | GAG | chr12 | 21583336 | 21583355 | 21583339 | - |
| SEQ ID NO 19379 | CTATTTCTTGGTTGTAAGAG | TGG | chr12 | 21583333 | 21583352 | 21583336 | - |
| SEQ ID NO 19380 | GTTGTAAGAGTGGCCAAATG | CAG | chr12 | 21583323 | 21583342 | 21583326 | - |
| SEQ ID NO 19381 | CAGCAAATTATCCTTCACTT | TAG | chr12 | 21583303 | 21583322 | 21583306 | - |
| SEQ ID NO 19382 | CAAATTATCCTTCACTTTAG | AAG | chr12 | 21583300 | 21583319 | 21583303 | - |
| SEQ ID NO 19383 | AAATTATCCTTCACTTTAGA | AGG | chr12 | 21583299 | 21583318 | 21583302 | - |
| SEQ ID NO 19384 | ACTTTAGAAGGAATATCTCA | AAG | chr12 | 21583287 | 21583306 | 21583290 | - |
| SEQ ID NO 19385 | TTTAGAAGGAATATCTCAAA | GAG | chr12 | 21583285 | 21583304 | 21583288 | - |
| SEQ ID NO 19386 | CTCAAAGAGCCCCAAACCAT | TGG | chr12 | 21583271 | 21583290 | 21583274 | - |
| SEQ ID NO 19387 | GGACCCCTATAAATTTTACT | GAG | chr12 | 21583250 | 21583269 | 21583253 | - |
| SEQ ID NO 19388 | GACCCCTATAAATTTTACTG | AGG | chr12 | 21583249 | 21583268 | 21583252 | - |
| SEQ ID NO 19389 | CCCTATAAATTTTACTGAGG | TAG | chr12 | 21583246 | 21583265 | 21583249 | - |
| SEQ ID NO 19390 | TATAAATTTTACTGAGGTAG | AAG | chr12 | 21583243 | 21583262 | 21583246 | - |
| SEQ ID NO 19391 | ATAAATTTTACTGAGGTAGA | AGG | chr12 | 21583242 | 21583261 | 21583245 | - |
| SEQ ID NO 19392 | AGAAGGTCCCTGAATTTAAT | CAG | chr12 | 21583225 | 21583244 | 21583228 | - |
| SEQ ID NO 19393 | AAATGTCTCATCAATAAATC | CAG | chr12 | 21583177 | 21583196 | 21583180 | - |
| SEQ ID NO 19394 | GTTTGCTACTTCTTGCTCAC | TAG | chr12 | 21583151 | 21583170 | 21583154 | - |
| SEQ ID NO 19395 | TACTTCTTGCTCACTAGTTC | CAG | chr12 | 21583145 | 21583164 | 21583148 | - |
| SEQ ID NO 19396 | TCTTGCTCACTAGTTCCAGT | CAG | chr12 | 21583141 | 21583160 | 21583144 | - |
| SEQ ID NO 19397 | TCAGCATGTCATCAATGTAA | TGG | chr12 | 21583122 | 21583141 | 21583125 | - |
| SEQ ID NO 19398 | TGGACCACTGTGATATCTTG | TGG | chr12 | 21583102 | 21583121 | 21583105 | - |

Figure 43 (Cont'd)

| | | | | | | | |
|---|---|---|---|---|---|---|---|
| SEQ ID NO 19399 | ACCACTGTGATATCTTGTGG | AAG | chr12 | 21583099 | 21583118 | 21583102 | - |
| SEQ ID NO 19400 | GTGATATCTTGTGGAAGTGA | AAG | chr12 | 21583093 | 21583112 | 21583096 | - |
| SEQ ID NO 19401 | TGATATCTTGTGGAAGTGAA | AGG | chr12 | 21583092 | 21583111 | 21583095 | - |
| SEQ ID NO 19402 | ATCTTGTGGAAGTGAAAGGT | GAG | chr12 | 21583088 | 21583107 | 21583091 | - |
| SEQ ID NO 19403 | TGTGGAAGTGAAAGGTGAGC | AAG | chr12 | 21583084 | 21583103 | 21583087 | - |
| SEQ ID NO 19404 | TGAGCAAGTTCTCTCCAAAT | AAG | chr12 | 21583069 | 21583088 | 21583072 | - |
| SEQ ID NO 19405 | GTTCTCTCCAAATAAGATTA | TGG | chr12 | 21583062 | 21583081 | 21583065 | - |
| SEQ ID NO 19406 | CCAAATAAGATTATGGCACA | AAG | chr12 | 21583055 | 21583074 | 21583058 | - |
| SEQ ID NO 19407 | ATAAGATTATGGCACAAAGC | TGG | chr12 | 21583051 | 21583070 | 21583054 | - |
| SEQ ID NO 19408 | AAGATTATGGCACAAAGCTG | GAG | chr12 | 21583049 | 21583068 | 21583052 | - |
| SEQ ID NO 19409 | GATTATGGCACAAAGCTGGA | GAG | chr12 | 21583047 | 21583066 | 21583050 | - |
| SEQ ID NO 19410 | TGGAGAGTTGATATACTCCT | GAG | chr12 | 21583031 | 21583050 | 21583034 | - |
| SEQ ID NO 19411 | TTTTCTTTCATCACTTTGTC | CAG | chr12 | 21583001 | 21583020 | 21583004 | - |
| SEQ ID NO 19412 | ACTTTGTCCAGCGAACTTAC | AAG | chr12 | 21582989 | 21583008 | 21582992 | - |
| SEQ ID NO 19413 | GTTCCTTGATTCTCCACATA | TAG | chr12 | 21582946 | 21582965 | 21582949 | - |
| SEQ ID NO 19414 | GATTCTCCACATATAGTCAA | AAG | chr12 | 21582939 | 21582958 | 21582942 | - |
| SEQ ID NO 19415 | AGTCAAAAGTATTATGTATA | CAG | chr12 | 21582925 | 21582944 | 21582928 | - |
| SEQ ID NO 19416 | CAAAAGTATTATGTATACAG | TAG | chr12 | 21582922 | 21582941 | 21582925 | - |
| SEQ ID NO 19417 | CTAAATTCCTTGCCTCTCAC | AAG | chr12 | 21582899 | 21582918 | 21582902 | - |
| SEQ ID NO 19418 | CCTCTCACAAGCGTTGAATC | AAG | chr12 | 21582887 | 21582906 | 21582890 | - |
| SEQ ID NO 19419 | TCTCACAAGCGTTGAATCAA | GAG | chr12 | 21582885 | 21582904 | 21582888 | - |
| SEQ ID NO 19420 | CTCTCTAAACAATTGATGCC | AAG | chr12 | 21582837 | 21582856 | 21582840 | - |
| SEQ ID NO 19421 | TCTCTAAACAATTGATGCCA | AGG | chr12 | 21582836 | 21582855 | 21582839 | - |
| SEQ ID NO 19422 | CAATTGATGCCAAGGATTAT | CAG | chr12 | 21582828 | 21582847 | 21582831 | - |
| SEQ ID NO 19423 | ATCAGTGTTCTCCATACCAT | TAG | chr12 | 21582810 | 21582829 | 21582813 | - |
| SEQ ID NO 19424 | AGTGTTCTCCATACCATTAG | AAG | chr12 | 21582807 | 21582826 | 21582810 | - |
| SEQ ID NO 19425 | GTTCTCCATACCATTAGAAG | AAG | chr12 | 21582804 | 21582823 | 21582807 | - |
| SEQ ID NO 19426 | TCTCCATACCATTAGAAGAA | GAG | chr12 | 21582802 | 21582821 | 21582805 | - |
| SEQ ID NO 19427 | ACCATTAGAAGAAGAGTCCT | TAG | chr12 | 21582795 | 21582814 | 21582798 | - |
| SEQ ID NO 19428 | AGAAGAGTCCTTAGCATATT | TGG | chr12 | 21582786 | 21582805 | 21582789 | - |
| SEQ ID NO 19429 | GAAGAGTCCTTAGCATATTT | GGG | chr12 | 21582785 | 21582804 | 21582788 | - |
| SEQ ID NO 19430 | TATTTGGGTCTAATCATATT | AAG | chr12 | 21582770 | 21582789 | 21582773 | - |
| SEQ ID NO 19431 | TTGGGTCTAATCATATTAAG | CAG | chr12 | 21582767 | 21582786 | 21582770 | - |
| SEQ ID NO 19432 | TCATATTAAGCAGCCAACTC | CAG | chr12 | 21582757 | 21582776 | 21582760 | - |
| SEQ ID NO 19433 | AGAAACCCCAAAACCAATGA | AAG | chr12 | 21582736 | 21582755 | 21582739 | - |
| SEQ ID NO 19434 | TCCTTAATATTCTGTTCCTC | TAG | chr12 | 21582706 | 21582725 | 21582709 | - |
| SEQ ID NO 19435 | TGTTCCTCTAGAACCACTCC | TGG | chr12 | 21582694 | 21582713 | 21582697 | - |
| SEQ ID NO 19436 | CCTGGTACCAAAATCTGTAT | TAG | chr12 | 21582676 | 21582695 | 21582679 | - |
| SEQ ID NO 19437 | CTGGTACCAAAATCTGTATT | AGG | chr12 | 21582675 | 21582694 | 21582678 | - |
| SEQ ID NO 19438 | TGGTACCAAAATCTGTATTA | GGG | chr12 | 21582674 | 21582693 | 21582677 | - |
| SEQ ID NO 19439 | AAATCTGTATTAGGGTTCTA | CAG | chr12 | 21582666 | 21582685 | 21582669 | - |
| SEQ ID NO 19440 | ATCTGTATTAGGGTTCTACA | GAG | chr12 | 21582664 | 21582683 | 21582667 | - |
| SEQ ID NO 19441 | ATTAGGGTTCTACAGAGAAA | CAG | chr12 | 21582658 | 21582677 | 21582661 | - |
| SEQ ID NO 19442 | CTACAGAGAAACAGAATTAA | TAG | chr12 | 21582649 | 21582668 | 21582652 | - |
| SEQ ID NO 19443 | TACAGAGAAACAGAATTAAT | AGG | chr12 | 21582648 | 21582667 | 21582651 | - |
| SEQ ID NO 19444 | CAGAGAAACAGAATTAATAG | GAG | chr12 | 21582646 | 21582665 | 21582649 | - |
| SEQ ID NO 19445 | CTCTATATCTATATCTATAT | GAG | chr12 | 21582563 | 21582582 | 21582566 | - |

Figure 43 (Cont'd)

| | | | | | | | |
|---|---|---|---|---|---|---|---|
| SEQ ID NO 19446 | CTATATCTATATCTATATGA | GAG | chr12 | 21582561 | 21582580 | 21582564 | - |
| SEQ ID NO 19447 | CTATATGAGAGTTTATTATG | TAG | chr12 | 21582549 | 21582568 | 21582552 | - |
| SEQ ID NO 19448 | GTATTGACTCACATGTTCAC | AAG | chr12 | 21582527 | 21582546 | 21582530 | - |
| SEQ ID NO 19449 | TATTGACTCACATGTTCACA | AGG | chr12 | 21582526 | 21582545 | 21582529 | - |
| SEQ ID NO 19450 | ATGTTCACAAGGTCCCAAAA | CAG | chr12 | 21582515 | 21582534 | 21582518 | - |
| SEQ ID NO 19451 | TGTTCACAAGGTCCCAAAAC | AGG | chr12 | 21582514 | 21582533 | 21582517 | - |
| SEQ ID NO 19452 | TCCCAAAACAGGCCATCTGC | CAG | chr12 | 21582503 | 21582522 | 21582506 | - |
| SEQ ID NO 19453 | AAACAGGCCATCTGCCAGCT | GAG | chr12 | 21582498 | 21582517 | 21582501 | - |
| SEQ ID NO 19454 | AACAGGCCATCTGCCAGCTG | AGG | chr12 | 21582497 | 21582516 | 21582500 | - |
| SEQ ID NO 19455 | CCATCTGCCAGCTGAGGAAC | AAG | chr12 | 21582491 | 21582510 | 21582494 | - |
| SEQ ID NO 19456 | CATCTGCCAGCTGAGGAACA | AGG | chr12 | 21582490 | 21582509 | 21582493 | - |
| SEQ ID NO 19457 | CTGCCAGCTGAGGAACAAGG | AAG | chr12 | 21582487 | 21582506 | 21582490 | - |
| SEQ ID NO 19458 | CAGCTGAGGAACAAGGAAGC | TAG | chr12 | 21582483 | 21582502 | 21582486 | - |
| SEQ ID NO 19459 | TGAGGAACAAGGAAGCTAGT | CGG | chr12 | 21582479 | 21582498 | 21582482 | - |
| SEQ ID NO 19460 | AGGAACAAGGAAGCTAGTCG | GAG | chr12 | 21582477 | 21582496 | 21582480 | - |
| SEQ ID NO 19461 | GGAAGCTAGTCGGAGTCCCA | AAG | chr12 | 21582469 | 21582488 | 21582472 | - |
| SEQ ID NO 19462 | TAGTCGGAGTCCCAAAGCTG | AAG | chr12 | 21582463 | 21582482 | 21582466 | - |
| SEQ ID NO 19463 | AGTCCCAAAGCTGAAGAACC | TGG | chr12 | 21582456 | 21582475 | 21582459 | - |
| SEQ ID NO 19464 | TCCCAAAGCTGAAGAACCTG | GAG | chr12 | 21582454 | 21582473 | 21582457 | - |
| SEQ ID NO 19465 | GAACCTGGAGTTCAATGTTC | CAG | chr12 | 21582441 | 21582460 | 21582444 | - |
| SEQ ID NO 19466 | AACCTGGAGTTCAATGTTCC | AGG | chr12 | 21582440 | 21582459 | 21582443 | - |
| SEQ ID NO 19467 | ACCTGGAGTTCAATGTTCCA | GGG | chr12 | 21582439 | 21582458 | 21582442 | - |
| SEQ ID NO 19468 | TGGAGTTCAATGTTCCAGGG | CAG | chr12 | 21582436 | 21582455 | 21582439 | - |
| SEQ ID NO 19469 | GGAGTTCAATGTTCCAGGGC | AGG | chr12 | 21582435 | 21582454 | 21582438 | - |
| SEQ ID NO 19470 | GTTCAATGTTCCAGGGCAGG | AAG | chr12 | 21582432 | 21582451 | 21582435 | - |
| SEQ ID NO 19471 | GTTCCAGGGCAGGAAGAATC | CAG | chr12 | 21582425 | 21582444 | 21582428 | - |
| SEQ ID NO 19472 | AGGGCAGGAAGAATCCAGCA | TGG | chr12 | 21582420 | 21582439 | 21582423 | - |
| SEQ ID NO 19473 | GGGCAGGAAGAATCCAGCAT | GGG | chr12 | 21582419 | 21582438 | 21582422 | - |
| SEQ ID NO 19474 | GCAGGAAGAATCCAGCATGG | GAG | chr12 | 21582417 | 21582436 | 21582420 | - |
| SEQ ID NO 19475 | TCCAGCATGGGAGAAAAATG | TAG | chr12 | 21582407 | 21582426 | 21582410 | - |
| SEQ ID NO 19476 | CCAGCATGGGAGAAAAATGT | AGG | chr12 | 21582406 | 21582425 | 21582409 | - |
| SEQ ID NO 19477 | CATGGGAGAAAAATGTAGGC | TGG | chr12 | 21582402 | 21582421 | 21582405 | - |
| SEQ ID NO 19478 | ATGGGAGAAAAATGTAGGCT | GGG | chr12 | 21582401 | 21582420 | 21582404 | - |
| SEQ ID NO 19479 | AAAATGTAGGCTGGGATGCC | AAG | chr12 | 21582393 | 21582412 | 21582396 | - |
| SEQ ID NO 19480 | GCTGGGATGCCAAGCCAATC | TAG | chr12 | 21582384 | 21582403 | 21582387 | - |
| SEQ ID NO 19481 | TTTCTGCCTGCTTTATATCC | TGG | chr12 | 21582349 | 21582368 | 21582352 | - |
| SEQ ID NO 19482 | GCTTTATATCCTGGCTGTGC | TGG | chr12 | 21582340 | 21582359 | 21582343 | - |
| SEQ ID NO 19483 | TGGCTGTGCTGGCAACTGAT | TAG | chr12 | 21582329 | 21582348 | 21582332 | - |
| SEQ ID NO 19484 | TGTGCTGGCAACTGATTAGA | TGG | chr12 | 21582325 | 21582344 | 21582328 | - |
| SEQ ID NO 19485 | CTGATTAGATGGTGCCCACC | CAG | chr12 | 21582314 | 21582333 | 21582317 | - |
| SEQ ID NO 19486 | AGATGGTGCCCACCCAGATT | AAG | chr12 | 21582308 | 21582327 | 21582311 | - |
| SEQ ID NO 19487 | GATGGTGCCCACCCAGATTA | AGG | chr12 | 21582307 | 21582326 | 21582310 | - |
| SEQ ID NO 19488 | ATGGTGCCCACCCAGATTAA | GGG | chr12 | 21582306 | 21582325 | 21582309 | - |
| SEQ ID NO 19489 | GTGCCCACCCAGATTAAGGG | TGG | chr12 | 21582303 | 21582322 | 21582306 | - |
| SEQ ID NO 19490 | TGCCCACCCAGATTAAGGGT | GGG | chr12 | 21582302 | 21582321 | 21582305 | - |
| SEQ ID NO 19491 | AAGGGTGGGTCTGCCTTCCC | CAG | chr12 | 21582288 | 21582307 | 21582291 | - |
| SEQ ID NO 19492 | ACTGAAATATTAATCTCCTT | TGG | chr12 | 21582258 | 21582277 | 21582261 | - |

Figure 43 (Cont'd)

| SEQ ID NO 19493 | CTCCTTTGGTAACACCCTCA | CAG | chr12 | 21582244 | 21582263 | 21582247 | - |
| SEQ ID NO 19494 | ACACCCTCACAGACACACCC | AAG | chr12 | 21582233 | 21582252 | 21582236 | - |
| SEQ ID NO 19495 | GATCATTACTTTGCATCCTT | CAG | chr12 | 21582211 | 21582230 | 21582214 | - |
| SEQ ID NO 19496 | TTGCATCCTTCAGTCCAATC | AAG | chr12 | 21582201 | 21582220 | 21582204 | - |
| SEQ ID NO 19497 | AGTCCAATCAAGTTGACACT | CAG | chr12 | 21582190 | 21582209 | 21582193 | - |
| SEQ ID NO 19498 | ACACTCAGTATTAACCATCA | CAG | chr12 | 21582175 | 21582194 | 21582178 | - |
| SEQ ID NO 19499 | CATCACAGTCACTTTCTAAT | GAG | chr12 | 21582160 | 21582179 | 21582163 | - |
| SEQ ID NO 19500 | ATCACAGTCACTTTCTAATG | AGG | chr12 | 21582159 | 21582178 | 21582162 | - |
| SEQ ID NO 19501 | CAGTCACTTTCTAATGAGGT | TGG | chr12 | 21582155 | 21582174 | 21582158 | - |
| SEQ ID NO 19502 | AGGTTGGTTTTTTGTTGTT | GAG | chr12 | 21582139 | 21582158 | 21582142 | - |
| SEQ ID NO 19503 | TTTTGTTGTTGAGTTCCTTG | TAG | chr12 | 21582129 | 21582148 | 21582132 | - |
| SEQ ID NO 19504 | TCCTTGTAGATTCTGTATAT | TAG | chr12 | 21582115 | 21582134 | 21582118 | - |
| SEQ ID NO 19505 | TTAGCCTTTTGTTGCATTCA | TAG | chr12 | 21582096 | 21582115 | 21582099 | - |
| SEQ ID NO 19506 | AATTTTTTTTCTCATTCTG | TAG | chr12 | 21582068 | 21582087 | 21582071 | - |
| SEQ ID NO 19507 | ATTTTTTTTTCTCATTCTGT | AGG | chr12 | 21582067 | 21582086 | 21582070 | - |
| SEQ ID NO 19508 | ATCCGTTACTCTGTTGATT | CGG | chr12 | 21582042 | 21582061 | 21582045 | - |
| SEQ ID NO 19509 | TCTGTTGATTCGGTCTTTTG | CGG | chr12 | 21582032 | 21582051 | 21582035 | - |
| SEQ ID NO 19510 | TGATTCGGTCTTTTGCGGT | CAG | chr12 | 21582027 | 21582046 | 21582030 | - |
| SEQ ID NO 19511 | TTCGGTCTTTTGCGGTGCAG | AAG | chr12 | 21582024 | 21582043 | 21582027 | - |
| SEQ ID NO 19512 | TTTGCGGTGCAGAAGCATTT | TAG | chr12 | 21582016 | 21582035 | 21582019 | - |
| SEQ ID NO 19513 | AGAAGCATTTTAGTTTAATT | AAG | chr12 | 21582006 | 21582025 | 21582009 | - |
| SEQ ID NO 19514 | GTTTTTGTTTTTGTTGTGTT | TAG | chr12 | 21581971 | 21581990 | 21581974 | - |
| SEQ ID NO 19515 | TTTTTGTTGTGTTTAGTTTT | GAG | chr12 | 21581964 | 21581983 | 21581967 | - |
| SEQ ID NO 19516 | TTTTGTTGTGTTTAGTTTTG | AGG | chr12 | 21581963 | 21581982 | 21581966 | - |
| SEQ ID NO 19517 | TGTGTTTAGTTTTGAGGACT | TGG | chr12 | 21581957 | 21581976 | 21581960 | - |
| SEQ ID NO 19518 | TTGGTCATAAATTCTTTGCC | TAG | chr12 | 21581938 | 21581957 | 21581941 | - |
| SEQ ID NO 19519 | TGGTCATAAATTCTTTGCCT | AGG | chr12 | 21581937 | 21581956 | 21581940 | - |
| SEQ ID NO 19520 | TCTAATTTTTAATCCTCTTT | TAG | chr12 | 21581909 | 21581928 | 21581912 | - |
| SEQ ID NO 19521 | TAATTTTTAATCCTCTTTTA | GAG | chr12 | 21581907 | 21581926 | 21581910 | - |
| SEQ ID NO 19522 | TTTACCCCCATTTGACACAT | GAG | chr12 | 21581855 | 21581874 | 21581858 | - |
| SEQ ID NO 19523 | ATTTGACACATGAGCTAATT | GAG | chr12 | 21581846 | 21581865 | 21581849 | - |
| SEQ ID NO 19524 | AATTGAGCCTTCTGTCTGTT | AAG | chr12 | 21581830 | 21581849 | 21581833 | - |
| SEQ ID NO 19525 | GAGCCTTCTGTCTGTTAAGT | AAG | chr12 | 21581826 | 21581845 | 21581829 | - |
| SEQ ID NO 19526 | TGTCTGTTAAGTAAGTTGAC | TAG | chr12 | 21581818 | 21581837 | 21581821 | - |
| SEQ ID NO 19527 | GTTAAGTAAGTTGACTAGTT | CAG | chr12 | 21581813 | 21581832 | 21581816 | - |
| SEQ ID NO 19528 | TAAGTTGACTAGTTCAGTGT | AAG | chr12 | 21581807 | 21581826 | 21581810 | - |
| SEQ ID NO 19529 | TTTTTGCCATCATAATGCTT | TAG | chr12 | 21581773 | 21581792 | 21581776 | - |
| SEQ ID NO 19530 | TACTCTCCTTAATTTTCCCC | CAG | chr12 | 21581735 | 21581754 | 21581738 | - |
| SEQ ID NO 19531 | ACTCTCCTTAATTTTCCCCC | AGG | chr12 | 21581734 | 21581753 | 21581737 | - |
| SEQ ID NO 19532 | TCCTTAATTTTCCCCCAGGA | TGG | chr12 | 21581730 | 21581749 | 21581733 | - |
| SEQ ID NO 19533 | TTTCCCCAGGATGGTTTTC | TAG | chr12 | 21581722 | 21581741 | 21581725 | - |
| SEQ ID NO 19534 | CCAGGATGGTTTTCTAGATG | TGG | chr12 | 21581716 | 21581735 | 21581719 | - |
| SEQ ID NO 19535 | TTTTCTAGATGTGGACTTGC | TGG | chr12 | 21581707 | 21581726 | 21581710 | - |
| SEQ ID NO 19536 | ATGTGGACTTGCTGGATCCA | AAG | chr12 | 21581699 | 21581718 | 21581702 | - |
| SEQ ID NO 19537 | CCAAATGTATCCATATATTG | TGG | chr12 | 21581664 | 21581683 | 21581667 | - |
| SEQ ID NO 19538 | ATTGTGGCTTTGTGTTTTAA | TAG | chr12 | 21581648 | 21581667 | 21581651 | - |
| SEQ ID NO 19539 | TGTGGCTTTGTGTTTTAATA | GAG | chr12 | 21581646 | 21581665 | 21581649 | - |

Figure 43 (Cont'd)

| SEQ ID NO | Sequence | | | | | |
|---|---|---|---|---|---|---|
| SEQ ID NO 19540 | GTGGCTTTGTGTTTTAATAG | AGG | chr12 | 21581645 | 21581664 | 21581648 - |
| SEQ ID NO 19541 | GCTTTGTGTTTTAATAGAGG | TAG | chr12 | 21581642 | 21581661 | 21581645 - |
| SEQ ID NO 19542 | TTGTGTTTTAATAGAGGTAG | CAG | chr12 | 21581639 | 21581658 | 21581642 - |
| SEQ ID NO 19543 | AATAGAGGTAGCAGCAATAT | TAG | chr12 | 21581630 | 21581649 | 21581633 - |
| SEQ ID NO 19544 | TAGAGGTAGCAGCAATATTA | GAG | chr12 | 21581628 | 21581647 | 21581631 - |
| SEQ ID NO 19545 | AGAGGTAGCAGCAATATTAG | AGG | chr12 | 21581627 | 21581646 | 21581630 - |
| SEQ ID NO 19546 | AGGTAGCAGCAATATTAGAG | GAG | chr12 | 21581625 | 21581644 | 21581628 - |
| SEQ ID NO 19547 | GTAGCAGCAATATTAGAGGA | GAG | chr12 | 21581623 | 21581642 | 21581626 - |
| SEQ ID NO 19548 | CAATATTAGAGGAGAGAATT | AAG | chr12 | 21581616 | 21581635 | 21581619 - |
| SEQ ID NO 19549 | AATATTAGAGGAGAGAATTA | AGG | chr12 | 21581615 | 21581634 | 21581618 - |
| SEQ ID NO 19550 | AGAGAATTAAGGAACGATTC | TAG | chr12 | 21581604 | 21581623 | 21581607 - |
| SEQ ID NO 19551 | ATTAAGGAACGATTCTAGTG | TAG | chr12 | 21581599 | 21581618 | 21581602 - |
| SEQ ID NO 19552 | AAGGAACGATTCTAGTGTAG | CAG | chr12 | 21581596 | 21581615 | 21581599 - |
| SEQ ID NO 19553 | AGGAACGATTCTAGTGTAGC | AGG | chr12 | 21581595 | 21581614 | 21581598 - |
| SEQ ID NO 19554 | CGATTCTAGTGTAGCAGGAC | AAG | chr12 | 21581590 | 21581609 | 21581593 - |
| SEQ ID NO 19555 | AAGCTGCATACAAAACCCCT | CAG | chr12 | 21581570 | 21581589 | 21581573 - |
| SEQ ID NO 19556 | TACAAAACCCCTCAGACACC | GAG | chr12 | 21581562 | 21581581 | 21581565 - |
| SEQ ID NO 19557 | ACCCCTCAGACACCGAGTTA | AAG | chr12 | 21581556 | 21581575 | 21581559 - |
| SEQ ID NO 19558 | CCTCAGACACCGAGTTAAAG | AAG | chr12 | 21581553 | 21581572 | 21581556 - |
| SEQ ID NO 19559 | CTCAGACACCGAGTTAAAGA | AGG | chr12 | 21581552 | 21581571 | 21581555 - |
| SEQ ID NO 19560 | AGACACCGAGTTAAAGAAGG | AAG | chr12 | 21581549 | 21581568 | 21581552 - |
| SEQ ID NO 19561 | GACACCGAGTTAAAGAAGGA | AGG | chr12 | 21581548 | 21581567 | 21581551 - |
| SEQ ID NO 19562 | ACACCGAGTTAAAGAAGGAA | GGG | chr12 | 21581547 | 21581566 | 21581550 - |
| SEQ ID NO 19563 | AAAGAAGGAAGGGCTTTATT | CGG | chr12 | 21581537 | 21581556 | 21581540 - |
| SEQ ID NO 19564 | AAGGAAGGGCTTTATTCGGC | TGG | chr12 | 21581533 | 21581552 | 21581536 - |
| SEQ ID NO 19565 | AGGAAGGGCTTTATTCGGCT | GGG | chr12 | 21581532 | 21581551 | 21581535 - |
| SEQ ID NO 19566 | GAAGGGCTTTATTCGGCTGG | GAG | chr12 | 21581530 | 21581549 | 21581533 - |
| SEQ ID NO 19567 | GCTTTATTCGGCTGGGAGCT | TGG | chr12 | 21581525 | 21581544 | 21581528 - |
| SEQ ID NO 19568 | CTTTATTCGGCTGGGAGCTT | GGG | chr12 | 21581524 | 21581543 | 21581527 - |
| SEQ ID NO 19569 | ATTCGGCTGGGAGCTTGGGC | AAG | chr12 | 21581520 | 21581539 | 21581523 - |
| SEQ ID NO 19570 | GACTCACATCTCCAACAACC | AAG | chr12 | 21581498 | 21581517 | 21581501 - |
| SEQ ID NO 19571 | ATCTCCAACAACCAAGCTCT | CAG | chr12 | 21581491 | 21581510 | 21581494 - |
| SEQ ID NO 19572 | CTCCAACAACCAAGCTCTCA | GAG | chr12 | 21581489 | 21581508 | 21581492 - |
| SEQ ID NO 19573 | AACAACCAAGCTCTCAGAGT | GAG | chr12 | 21581485 | 21581504 | 21581488 - |
| SEQ ID NO 19574 | GAGCAATTCCTGTCCCTTTT | AAG | chr12 | 21581465 | 21581484 | 21581468 - |
| SEQ ID NO 19575 | AGCAATTCCTGTCCCTTTTA | AGG | chr12 | 21581464 | 21581483 | 21581467 - |
| SEQ ID NO 19576 | GCAATTCCTGTCCCTTTTAA | GGG | chr12 | 21581463 | 21581482 | 21581466 - |
| SEQ ID NO 19577 | TTTTAAGGGCTTACAACTCT | AAG | chr12 | 21581449 | 21581468 | 21581452 - |
| SEQ ID NO 19578 | TTTAAGGGCTTACAACTCTA | AGG | chr12 | 21581448 | 21581467 | 21581451 - |
| SEQ ID NO 19579 | TTAAGGGCTTACAACTCTAA | GGG | chr12 | 21581447 | 21581466 | 21581450 - |
| SEQ ID NO 19580 | TAAGGGCTTACAACTCTAAG | GGG | chr12 | 21581446 | 21581465 | 21581449 - |
| SEQ ID NO 19581 | AAGGGCTTACAACTCTAAGG | GGG | chr12 | 21581445 | 21581464 | 21581448 - |
| SEQ ID NO 19582 | ACTCTAAGGGGTACATGAC | TGG | chr12 | 21581434 | 21581453 | 21581437 - |
| SEQ ID NO 19583 | CTCTAAGGGGTACATGACT | GGG | chr12 | 21581433 | 21581452 | 21581436 - |
| SEQ ID NO 19584 | TCTAAGGGGTACATGACTG | GGG | chr12 | 21581432 | 21581451 | 21581435 - |
| SEQ ID NO 19585 | CTAAGGGGTACATGACTGG | GGG | chr12 | 21581431 | 21581450 | 21581434 - |
| SEQ ID NO 19586 | TGACTGGGGGCTGCATGCAC | TGG | chr12 | 21581418 | 21581437 | 21581421 - |

Figure 43 (Cont'd)

| | | | | | | | |
|---|---|---|---|---|---|---|---|
| SEQ ID NO 19587 | GGGCTGCATGCACTGGTCAT | CAG | chr12 | 21581411 | 21581430 | 21581414 | - |
| SEQ ID NO 19588 | GCATGCACTGGTCATCAGAA | TGG | chr12 | 21581406 | 21581425 | 21581409 | - |
| SEQ ID NO 19589 | CACTGGTCATCAGAATGGAA | CAG | chr12 | 21581401 | 21581420 | 21581404 | - |
| SEQ ID NO 19590 | GTCATCAGAATGGAACAGAA | CAG | chr12 | 21581396 | 21581415 | 21581399 | - |
| SEQ ID NO 19591 | TCATCAGAATGGAACAGAAC | AGG | chr12 | 21581395 | 21581414 | 21581398 | - |
| SEQ ID NO 19592 | CAGAATGGAACAGAACAGGA | CAG | chr12 | 21581391 | 21581410 | 21581394 | - |
| SEQ ID NO 19593 | AGAATGGAACAGAACAGGAC | AGG | chr12 | 21581390 | 21581409 | 21581393 | - |
| SEQ ID NO 19594 | GAATGGAACAGAACAGGACA | GGG | chr12 | 21581389 | 21581408 | 21581392 | - |
| SEQ ID NO 19595 | TTTCACACTGCTTTTCCATA | CAG | chr12 | 21581364 | 21581383 | 21581367 | - |
| SEQ ID NO 19596 | CTGCTTTTCCATACAGTGTC | TGG | chr12 | 21581357 | 21581376 | 21581360 | - |
| SEQ ID NO 19597 | CATACAGTGTCTGGAATCTA | TAG | chr12 | 21581348 | 21581367 | 21581351 | - |
| SEQ ID NO 19598 | GAATCTATAGATAACATAAC | TGG | chr12 | 21581335 | 21581354 | 21581338 | - |
| SEQ ID NO 19599 | CTATAGATAACATAACTGGC | CAG | chr12 | 21581331 | 21581350 | 21581334 | - |
| SEQ ID NO 19600 | TATAGATAACATAACTGGCC | AGG | chr12 | 21581330 | 21581349 | 21581333 | - |
| SEQ ID NO 19601 | GATAACATAACTGGCCAGGT | CAG | chr12 | 21581326 | 21581345 | 21581329 | - |
| SEQ ID NO 19602 | ATAACATAACTGGCCAGGTC | AGG | chr12 | 21581325 | 21581344 | 21581328 | - |
| SEQ ID NO 19603 | TAACATAACTGGCCAGGTCA | GGG | chr12 | 21581324 | 21581343 | 21581327 | - |
| SEQ ID NO 19604 | AACATAACTGGCCAGGTCAG | GGG | chr12 | 21581323 | 21581342 | 21581326 | - |
| SEQ ID NO 19605 | GTCAGGGGTCTATCTTTAAC | CAG | chr12 | 21581308 | 21581327 | 21581311 | - |
| SEQ ID NO 19606 | TCAGGGGTCTATCTTTAACC | AGG | chr12 | 21581307 | 21581326 | 21581310 | - |
| SEQ ID NO 19607 | GGTCTATCTTTAACCAGGCC | CAG | chr12 | 21581302 | 21581321 | 21581305 | - |
| SEQ ID NO 19608 | GTCTATCTTTAACCAGGCCC | AGG | chr12 | 21581301 | 21581320 | 21581304 | - |
| SEQ ID NO 19609 | CTTTAACCAGGCCCAGGATG | TGG | chr12 | 21581295 | 21581314 | 21581298 | - |
| SEQ ID NO 19610 | CCAGGCCCAGGATGTGGTCT | CAG | chr12 | 21581289 | 21581308 | 21581292 | - |
| SEQ ID NO 19611 | CAGGCCCAGGATGTGGTCTC | AGG | chr12 | 21581288 | 21581307 | 21581291 | - |
| SEQ ID NO 19612 | GGTCTCAGGCTGTTTGCCTG | TGG | chr12 | 21581274 | 21581293 | 21581277 | - |
| SEQ ID NO 19613 | TGGATTTCATTTCTGCCTTT | TAG | chr12 | 21581254 | 21581273 | 21581257 | - |
| SEQ ID NO 19614 | GTTTTTACTTCTTCTTTCTT | TGG | chr12 | 21581232 | 21581251 | 21581235 | - |
| SEQ ID NO 19615 | TTTTACTTCTTCTTTCTTTG | GAG | chr12 | 21581230 | 21581249 | 21581233 | - |
| SEQ ID NO 19616 | TTTACTTCTTCTTTCTTTGG | AGG | chr12 | 21581229 | 21581248 | 21581232 | - |
| SEQ ID NO 19617 | ACTTCTTCTTTCTTTGGAGG | CAG | chr12 | 21581226 | 21581245 | 21581229 | - |
| SEQ ID NO 19618 | CTTTCTTTGGAGGCAGAAAT | TGG | chr12 | 21581219 | 21581238 | 21581222 | - |
| SEQ ID NO 19619 | TTTCTTTGGAGGCAGAAATT | GGG | chr12 | 21581218 | 21581237 | 21581221 | - |
| SEQ ID NO 19620 | ATTGGGCATAAAACAATATG | AAG | chr12 | 21581201 | 21581220 | 21581204 | - |
| SEQ ID NO 19621 | TTGGGCATAAAACAATATGA | AGG | chr12 | 21581200 | 21581219 | 21581203 | - |
| SEQ ID NO 19622 | TGGGCATAAAACAATATGAA | GGG | chr12 | 21581199 | 21581218 | 21581202 | - |
| SEQ ID NO 19623 | GCATAAAACAATATGAAGGG | TGG | chr12 | 21581196 | 21581215 | 21581199 | - |
| SEQ ID NO 19624 | AGGGTGGTCTCCTCCCTTAC | TAG | chr12 | 21581180 | 21581199 | 21581183 | - |
| SEQ ID NO 19625 | GGGTGGTCTCCTCCCTTACT | AGG | chr12 | 21581179 | 21581198 | 21581182 | - |
| SEQ ID NO 19626 | TGGTCTCCTCCCTTACTAGG | AAG | chr12 | 21581176 | 21581195 | 21581179 | - |
| SEQ ID NO 19627 | GTCTCCTCCCTTACTAGGAA | GAG | chr12 | 21581174 | 21581193 | 21581177 | - |
| SEQ ID NO 19628 | CTCCTCCCTTACTAGGAAGA | GAG | chr12 | 21581172 | 21581191 | 21581175 | - |
| SEQ ID NO 19629 | GGAAGAGAGAAATACCATGT | GAG | chr12 | 21581158 | 21581177 | 21581161 | - |
| SEQ ID NO 19630 | GAAATACGTATTTGTGTTAT | TGG | chr12 | 21581132 | 21581151 | 21581135 | - |
| SEQ ID NO 19631 | TGTGTTATTGGATTTGACAT | CGG | chr12 | 21581120 | 21581139 | 21581123 | - |
| SEQ ID NO 19632 | GTGTTATTGGATTTGACATC | GGG | chr12 | 21581119 | 21581138 | 21581122 | - |
| SEQ ID NO 19633 | TGTTATTGGATTTGACATCG | GGG | chr12 | 21581118 | 21581137 | 21581121 | - |

Figure 43 (Cont'd)

| | | | | | | | |
|---|---|---|---|---|---|---|---|
| SEQ ID NO 19634 | ATTGGATTTGACATCGGGGT | TGG | chr12 | 21581114 | 21581133 | 21581117 | - |
| SEQ ID NO 19635 | TTTGACATCGGGGTTGGACC | AAG | chr12 | 21581108 | 21581127 | 21581111 | - |
| SEQ ID NO 19636 | CATCTTCTATGAACATCTAT | AAG | chr12 | 21581085 | 21581104 | 21581088 | - |
| SEQ ID NO 19637 | AAGCACGTTCTCCTTATCAA | AAG | chr12 | 21581065 | 21581084 | 21581068 | - |
| SEQ ID NO 19638 | AGCACGTTCTCCTTATCAAA | AGG | chr12 | 21581064 | 21581083 | 21581067 | - |
| SEQ ID NO 19639 | TTATCAAAGGTACTTTGCT | TGG | chr12 | 21581052 | 21581071 | 21581055 | - |
| SEQ ID NO 19640 | TACTTTGCTTGGTGCTTTAA | AAG | chr12 | 21581041 | 21581060 | 21581044 | - |
| SEQ ID NO 19641 | TTAAAAGATAAATGACTATG | TAG | chr12 | 21581025 | 21581044 | 21581028 | - |
| SEQ ID NO 19642 | AGATAAATGACTATGTAGCT | TAG | chr12 | 21581020 | 21581039 | 21581023 | - |
| SEQ ID NO 19643 | GATAAATGACTATGTAGCTT | AGG | chr12 | 21581019 | 21581038 | 21581022 | - |
| SEQ ID NO 19644 | TAAATGACTATGTAGCTTAG | GAG | chr12 | 21581017 | 21581036 | 21581020 | - |
| SEQ ID NO 19645 | TTCTTCATAATTGAAAACCA | CAG | chr12 | 21580992 | 21581011 | 21580995 | - |
| SEQ ID NO 19646 | TTCATAATTGAAAACCACAG | CAG | chr12 | 21580989 | 21581008 | 21580992 | - |
| SEQ ID NO 19647 | GCTGTTATTTGAACATACCT | GAG | chr12 | 21580967 | 21580986 | 21580970 | - |
| SEQ ID NO 19648 | GAACATACCTGAGCCCCTTC | TGG | chr12 | 21580957 | 21580976 | 21580960 | - |
| SEQ ID NO 19649 | GAGCCCCTTCTGGACCACTG | TAG | chr12 | 21580947 | 21580966 | 21580950 | - |
| SEQ ID NO 19650 | AGCCCCTTCTGGACCACTGT | AGG | chr12 | 21580946 | 21580965 | 21580949 | - |
| SEQ ID NO 19651 | CCCCTTCTGGACCACTGTAG | GAG | chr12 | 21580944 | 21580963 | 21580947 | - |
| SEQ ID NO 19652 | CTTCTGGACCACTGTAGGAG | AAG | chr12 | 21580941 | 21580960 | 21580944 | - |
| SEQ ID NO 19653 | TTCTGGACCACTGTAGGAGA | AGG | chr12 | 21580940 | 21580959 | 21580943 | - |
| SEQ ID NO 19654 | CTGGACCACTGTAGGAGAAG | GAG | chr12 | 21580938 | 21580957 | 21580941 | - |
| SEQ ID NO 19655 | TGGACCACTGTAGGAGAAGG | AGG | chr12 | 21580937 | 21580956 | 21580940 | - |
| SEQ ID NO 19656 | ACCACTGTAGGAGAAGGAGG | AAG | chr12 | 21580934 | 21580953 | 21580937 | - |
| SEQ ID NO 19657 | CACTGTAGGAGAAGGAGGAA | GAG | chr12 | 21580932 | 21580951 | 21580935 | - |
| SEQ ID NO 19658 | CTGTAGGAGAAGGAGGAAGA | GAG | chr12 | 21580930 | 21580949 | 21580933 | - |
| SEQ ID NO 19659 | TGTAGGAGAAGGAGGAAGAG | AGG | chr12 | 21580929 | 21580948 | 21580932 | - |
| SEQ ID NO 19660 | AGAAGGAGGAAGAGAGGTGA | AAG | chr12 | 21580923 | 21580942 | 21580926 | - |
| SEQ ID NO 19661 | TGAAAGTGATTTCTGCTGCT | GAG | chr12 | 21580906 | 21580925 | 21580909 | - |
| SEQ ID NO 19662 | GAAAGTGATTTCTGCTGCTG | AGG | chr12 | 21580905 | 21580924 | 21580908 | - |
| SEQ ID NO 19663 | AAAGTGATTTCTGCTGCTGA | GGG | chr12 | 21580904 | 21580923 | 21580907 | - |
| SEQ ID NO 19664 | GAGGGCATGTATGATGACAA | TGG | chr12 | 21580886 | 21580905 | 21580889 | - |
| SEQ ID NO 19665 | AGGGCATGTATGATGACAAT | GGG | chr12 | 21580885 | 21580904 | 21580888 | - |
| SEQ ID NO 19666 | GTCCTAACTTTGACACTACA | AAG | chr12 | 21580857 | 21580876 | 21580860 | - |
| SEQ ID NO 19667 | CTTTGACACTACAAAGTGAC | TGG | chr12 | 21580850 | 21580869 | 21580853 | - |
| SEQ ID NO 19668 | TTGACACTACAAAGTGACTG | GAG | chr12 | 21580848 | 21580867 | 21580851 | - |
| SEQ ID NO 19669 | CTACAAAGTGACTGGAGCTT | TAG | chr12 | 21580842 | 21580861 | 21580845 | - |
| SEQ ID NO 19670 | TACAAAGTGACTGGAGCTTT | AGG | chr12 | 21580841 | 21580860 | 21580844 | - |
| SEQ ID NO 19671 | AAGTGACTGGAGCTTTAGGC | AAG | chr12 | 21580837 | 21580856 | 21580840 | - |
| SEQ ID NO 19672 | TGACTGGAGCTTTAGGCAAG | TAG | chr12 | 21580834 | 21580853 | 21580837 | - |
| SEQ ID NO 19673 | AGTTACTCCAATTGTCTTTT | CAG | chr12 | 21580813 | 21580832 | 21580816 | - |
| SEQ ID NO 19674 | TTTTCAGACTCTTTCTTTTT | GAG | chr12 | 21580797 | 21580816 | 21580800 | - |
| SEQ ID NO 19675 | TTTCAGACTCTTTCTTTTTG | AGG | chr12 | 21580796 | 21580815 | 21580799 | - |
| SEQ ID NO 19676 | TGAGGTATTTGACCTCTTTG | CGG | chr12 | 21580778 | 21580797 | 21580781 | - |
| SEQ ID NO 19677 | ATTTGACCTCTTTGCGGCAT | CAG | chr12 | 21580772 | 21580791 | 21580775 | - |
| SEQ ID NO 19678 | GCTGCTATTTCACATGCACC | TAG | chr12 | 21580746 | 21580765 | 21580749 | - |
| SEQ ID NO 19679 | GCTATTTCACATGCACCTAG | AAG | chr12 | 21580743 | 21580762 | 21580746 | - |
| SEQ ID NO 19680 | CTATTTCACATGCACCTAGA | AGG | chr12 | 21580742 | 21580761 | 21580745 | - |

Figure 43 (Cont'd)

| | | | | | | | |
|---|---|---|---|---|---|---|---|
| SEQ ID NO 19681 | TATTTCACATGCACCTAGAA | GGG | chr12 | 21580741 | 21580760 | 21580744 | - |
| SEQ ID NO 19682 | AAGGGACTTTAAAACATGCA | CAG | chr12 | 21580723 | 21580742 | 21580726 | - |
| SEQ ID NO 19683 | AACATGCACAGAATTGAACA | AAG | chr12 | 21580711 | 21580730 | 21580714 | - |
| SEQ ID NO 19684 | ATGCACAGAATTGAACAAAG | CAG | chr12 | 21580708 | 21580727 | 21580711 | - |
| SEQ ID NO 19685 | ACAAAGCAGTAACCATTCGT | TGG | chr12 | 21580694 | 21580713 | 21580697 | - |
| SEQ ID NO 19686 | TCAAATACTATTATTTTTGA | AAG | chr12 | 21580654 | 21580673 | 21580657 | - |
| SEQ ID NO 19687 | CAAATACTATTATTTTTGAA | AGG | chr12 | 21580653 | 21580672 | 21580656 | - |
| SEQ ID NO 19688 | TTGAAAGGTAAATAAATCCT | TGG | chr12 | 21580638 | 21580657 | 21580641 | - |
| SEQ ID NO 19689 | TGAAAGGTAAATAAATCCTT | GGG | chr12 | 21580637 | 21580656 | 21580640 | - |
| SEQ ID NO 19690 | GGTAAATAAATCCTTGGGCT | TAG | chr12 | 21580632 | 21580651 | 21580635 | - |
| SEQ ID NO 19691 | AAATAAATCCTTGGGCTTAG | TGG | chr12 | 21580629 | 21580648 | 21580632 | - |
| SEQ ID NO 19692 | ATTGCTAACCTGAATGATAA | TAG | chr12 | 21580548 | 21580567 | 21580551 | - |
| SEQ ID NO 19693 | AGAAACTTTTTTCCTTTTAA | CAG | chr12 | 21580527 | 21580546 | 21580530 | - |
| SEQ ID NO 19694 | ACTTTTTTCCTTTTAACAGT | TGG | chr12 | 21580523 | 21580542 | 21580526 | - |
| SEQ ID NO 19695 | TTTTTTCCTTTTAACAGTTG | GAG | chr12 | 21580521 | 21580540 | 21580524 | - |
| SEQ ID NO 19696 | TTTTTCCTTTTAACAGTTGG | AGG | chr12 | 21580520 | 21580539 | 21580523 | - |
| SEQ ID NO 19697 | GAGGCATCTATACTGTGATT | CAG | chr12 | 21580501 | 21580520 | 21580504 | - |
| SEQ ID NO 19698 | TCTATACTGTGATTCAGACA | AAG | chr12 | 21580495 | 21580514 | 21580498 | - |
| SEQ ID NO 19699 | CTATACTGTGATTCAGACAA | AGG | chr12 | 21580494 | 21580513 | 21580497 | - |
| SEQ ID NO 19700 | TCAGACAAAGGCCAAAACAA | CAG | chr12 | 21580482 | 21580501 | 21580485 | - |
| SEQ ID NO 19701 | GACAAAGGCCAAAACAACAG | CAG | chr12 | 21580479 | 21580498 | 21580482 | - |
| SEQ ID NO 19702 | CCAAAACAACAGCAGATGAA | TGG | chr12 | 21580471 | 21580490 | 21580474 | - |
| SEQ ID NO 19703 | CAAAACAACAGCAGATGAAT | GGG | chr12 | 21580470 | 21580489 | 21580473 | - |
| SEQ ID NO 19704 | AAAACAACAGCAGATGAATG | GGG | chr12 | 21580469 | 21580488 | 21580472 | - |
| SEQ ID NO 19705 | AACAACAGCAGATGAATGGG | GAG | chr12 | 21580467 | 21580486 | 21580470 | - |
| SEQ ID NO 19706 | CAACAGCAGATGAATGGGGA | GAG | chr12 | 21580465 | 21580484 | 21580468 | - |
| SEQ ID NO 19707 | GGGAGAGAACTATTTTCTGA | TAG | chr12 | 21580449 | 21580468 | 21580452 | - |
| SEQ ID NO 19708 | GGAGAGAACTATTTTCTGAT | AGG | chr12 | 21580448 | 21580467 | 21580451 | - |
| SEQ ID NO 19709 | TTCTGATAGGTCCATATTTT | GAG | chr12 | 21580435 | 21580454 | 21580438 | - |
| SEQ ID NO 19710 | CATATTTTGAGCATAATATG | AAG | chr12 | 21580423 | 21580442 | 21580426 | - |
| SEQ ID NO 19711 | TTGAGCATAATATGAAGACT | CAG | chr12 | 21580417 | 21580436 | 21580420 | - |
| SEQ ID NO 19712 | TGAGCATAATATGAAGACTC | AGG | chr12 | 21580416 | 21580435 | 21580419 | - |
| SEQ ID NO 19713 | GCATAATATGAAGACTCAGG | TGG | chr12 | 21580413 | 21580432 | 21580416 | - |
| SEQ ID NO 19714 | ATATGAAGACTCAGGTGGAA | CAG | chr12 | 21580408 | 21580427 | 21580411 | - |
| SEQ ID NO 19715 | GAACCTGTAAATGATGCTGT | CAG | chr12 | 21580382 | 21580401 | 21580385 | - |
| SEQ ID NO 19716 | CCTGTAAATGATGCTGTCAG | AAG | chr12 | 21580379 | 21580398 | 21580382 | - |
| SEQ ID NO 19717 | TGTAAATGATGCTGTCAGAA | GAG | chr12 | 21580377 | 21580396 | 21580380 | - |
| SEQ ID NO 19718 | AAATGATGCTGTCAGAAGAG | CAG | chr12 | 21580374 | 21580393 | 21580377 | - |
| SEQ ID NO 19719 | TGATGCTGTCAGAAGAGCAG | TGG | chr12 | 21580371 | 21580390 | 21580374 | - |
| SEQ ID NO 19720 | GAGCAGTGGACGCAATGAAT | AAG | chr12 | 21580357 | 21580376 | 21580360 | - |
| SEQ ID NO 19721 | GTGGACGCAATGAATAAGCA | TGG | chr12 | 21580352 | 21580371 | 21580355 | - |
| SEQ ID NO 19722 | CAATGAATAAGCATGGCTGC | CAG | chr12 | 21580345 | 21580364 | 21580348 | - |

Figure 44

| # | Sequence | PAM | Chr | Start | End | Cuts 5' of | Str |
|---|---|---|---|---|---|---|---|
| SEQ ID NO 19723 | ACAGGTTCACACTGTTCCAC | CTGAGT | chr12 | 21580394 | 21580413 | 21580410 | + |
| SEQ ID NO 19724 | GCTGTTGTTTTGGCCTTTGT | CTGAAT | chr12 | 21580478 | 21580497 | 21580494 | + |
| SEQ ID NO 19725 | GCAATTTGTTTAAAGTAATA | AGGGAT | chr12 | 21580563 | 21580582 | 21580579 | + |
| SEQ ID NO 19726 | TAAAGTAATAAGGGATGGAA | ATGAGT | chr12 | 21580573 | 21580592 | 21580589 | + |
| SEQ ID NO 19727 | CAGATTTTTAAATTAGCATT | TAGGAT | chr12 | 21580600 | 21580619 | 21580616 | + |
| SEQ ID NO 19728 | ATTTAGGATCCACTAAGCCC | AAGGAT | chr12 | 21580617 | 21580636 | 21580633 | + |
| SEQ ID NO 19729 | CATATTGTTAAGGGACACCA | ACGAAT | chr12 | 21580674 | 21580693 | 21580690 | + |
| SEQ ID NO 19730 | GGTCAAATACCTCAAAAAGA | AAGAGT | chr12 | 21580784 | 21580803 | 21580800 | + |
| SEQ ID NO 19731 | AAAGAGTCTGAAAAGACAAT | TGGAGT | chr12 | 21580803 | 21580822 | 21580819 | + |
| SEQ ID NO 19732 | CCCCCAGTCATGTACCCCT | TAGAGT | chr12 | 21581428 | 21581447 | 21581444 | + |
| SEQ ID NO 19733 | TGTAAGCCCTTAAAAGGGAC | AGGAAT | chr12 | 21581454 | 21581473 | 21581470 | + |
| SEQ ID NO 19734 | AGAGCTTGGTTGTTGGAGAT | GTGAGT | chr12 | 21581491 | 21581510 | 21581507 | + |
| SEQ ID NO 19735 | AGTCTTGCCCAAGCTCCCAG | CCGAAT | chr12 | 21581514 | 21581533 | 21581530 | + |
| SEQ ID NO 19736 | CTTCTTTAACTCGGTGTCTG | AGGGGT | chr12 | 21581550 | 21581569 | 21581566 | + |
| SEQ ID NO 19737 | TGCAGCTTGTCCTGCTACAC | TAGAAT | chr12 | 21581582 | 21581601 | 21581598 | + |
| SEQ ID NO 19738 | AAAACACAAAGCCACAATAT | ATGGAT | chr12 | 21581650 | 21581669 | 21581666 | + |
| SEQ ID NO 19739 | ATTTGGAAAATATGCACACT | TTGGAT | chr12 | 21581678 | 21581697 | 21581694 | + |
| SEQ ID NO 19740 | CATCCTGGGGGAAAATTAAG | GAGAGT | chr12 | 21581728 | 21581747 | 21581744 | + |
| SEQ ID NO 19741 | AAAATTAAGGAGAGTATGAA | AAGGAT | chr12 | 21581739 | 21581758 | 21581755 | + |
| SEQ ID NO 19742 | AATTAGCTCATGTGTCAAAT | GGGGGT | chr12 | 21581846 | 21581865 | 21581862 | + |
| SEQ ID NO 19743 | GGGAAAGACAGGCTCTAAAA | GAGGAT | chr12 | 21581892 | 21581911 | 21581908 | + |
| SEQ ID NO 19744 | AATTAGATGTGGCCTAGGCA | AAGAAT | chr12 | 21581922 | 21581941 | 21581938 | + |
| SEQ ID NO 19745 | TGCTTCTGCACCGCAAAAGA | CCGAAT | chr12 | 21582019 | 21582038 | 21582035 | + |
| SEQ ID NO 19746 | ACCGCAAAAGACCGAATCAA | CAGAGT | chr12 | 21582028 | 21582047 | 21582044 | + |
| SEQ ID NO 19747 | AGACCGAATCAACAGAGTAA | ACGGAT | chr12 | 21582036 | 21582055 | 21582052 | + |
| SEQ ID NO 19748 | CAGAGTAAACGGATAACCTA | CAGAAT | chr12 | 21582048 | 21582067 | 21582064 | + |
| SEQ ID NO 19749 | AGAAAAAAAAATTGCAAACT | ATGAAT | chr12 | 21582075 | 21582094 | 21582091 | + |
| SEQ ID NO 19750 | TGCAACAAAAGGCTAATATA | CAGAAT | chr12 | 21582100 | 21582119 | 21582116 | + |
| SEQ ID NO 19751 | AGTGACTGTGATGGTTAATA | CTGAGT | chr12 | 21582167 | 21582186 | 21582183 | + |
| SEQ ID NO 19752 | GTGTCAACTTGATTGGACTG | AAGGAT | chr12 | 21582191 | 21582210 | 21582207 | + |
| SEQ ID NO 19753 | AAGGATGCAAAGTAATGATC | TTGGGT | chr12 | 21582211 | 21582230 | 21582227 | + |
| SEQ ID NO 19754 | ATGATCTTGGGTGTGTCTGT | GAGGGT | chr12 | 21582225 | 21582244 | 21582241 | + |
| SEQ ID NO 19755 | AAGGCAGACCCACCCTTAAT | CTGGGT | chr12 | 21582291 | 21582310 | 21582307 | + |
| SEQ ID NO 19756 | TAATCAGTTGCCAGCACAGC | CAGGAT | chr12 | 21582327 | 21582346 | 21582343 | + |
| SEQ ID NO 19757 | GCCTACATTTTTCTCCCATG | CTGGAT | chr12 | 21582402 | 21582421 | 21582418 | + |
| SEQ ID NO 19758 | TTTTGGGACCTTGTGAACAT | GTGAGT | chr12 | 21582515 | 21582534 | 21582531 | + |
| SEQ ID NO 19759 | CTAATACAGATTTTGGTACC | AGGAGT | chr12 | 21582673 | 21582692 | 21582689 | + |
| SEQ ID NO 19760 | CAGGAGTGGTTCTAGAGGAA | CAGAAT | chr12 | 21582692 | 21582711 | 21582708 | + |
| SEQ ID NO 19761 | TTCTAGAGGAACAGAATATT | AAGGAT | chr12 | 21582701 | 21582720 | 21582717 | + |
| SEQ ID NO 19762 | GAGGAACAGAATATTAAGGA | TGGAGT | chr12 | 21582706 | 21582725 | 21582722 | + |
| SEQ ID NO 19763 | TGGAGTTCTTTCATTGGTTT | TGGGGT | chr12 | 21582726 | 21582745 | 21582742 | + |
| SEQ ID NO 19764 | TTCATTGGTTTTGGGGTTTC | TGGAGT | chr12 | 21582735 | 21582754 | 21582751 | + |
| SEQ ID NO 19765 | TCCTTGGCATCAATTGTTTA | GAGAGT | chr12 | 21582832 | 21582851 | 21582848 | + |
| SEQ ID NO 19766 | TTCAACGCTTGTGAGAGGCA | AGGAAT | chr12 | 21582889 | 21582908 | 21582905 | + |
| SEQ ID NO 19767 | AATACTTTTGACTATATGTG | GAGAAT | chr12 | 21582932 | 21582951 | 21582948 | + |
| SEQ ID NO 19768 | TGAAAGAAAATGATGAACTC | AGGAGT | chr12 | 21583011 | 21583030 | 21583027 | + |
| SEQ ID NO 19769 | AGCAAGAAGTAGCAAACACA | CTGGAT | chr12 | 21583154 | 21583173 | 21583170 | + |

Figure 44 (Cont'd)

| SEQ ID NO 19770 | GATGAGACATTTGTGGGACA | GAGGAT | chr12 | 21583185 | 21583204 | 21583201 | + |
| SEQ ID NO 19771 | TCTACCTCAGTAAAATTTAT | AGGGGT | chr12 | 21583242 | 21583261 | 21583258 | + |
| SEQ ID NO 19772 | GAGATATTCCTTCTAAAGTG | AAGGAT | chr12 | 21583288 | 21583307 | 21583304 | + |
| SEQ ID NO 19773 | ACAACGCCTAGTGGGCCTAT | TTGGAT | chr12 | 21583355 | 21583374 | 21583371 | + |
| SEQ ID NO 19774 | GGAGGCAACATATTCCTGAT | TTGGGT | chr12 | 21583384 | 21583403 | 21583400 | + |
| SEQ ID NO 19775 | GTGTTACTCTGGCCCATTTA | TCGAGT | chr12 | 21583410 | 21583429 | 21583426 | + |
| SEQ ID NO 19776 | GATCCAAAGGCTGCCAGTT | TTGAGT | chr12 | 21583436 | 21583455 | 21583452 | + |
| SEQ ID NO 19777 | AAAAGGCTGCCAGTTTTGAG | TGGAGT | chr12 | 21583441 | 21583460 | 21583457 | + |
| SEQ ID NO 19778 | TTGAGGTGTCAGTGCCAGAT | AGGGAT | chr12 | 21583555 | 21583574 | 21583571 | + |
| SEQ ID NO 19779 | TGTTTGGAGCATTTGGCAGG | CTGAAT | chr12 | 21583583 | 21583602 | 21583599 | + |
| SEQ ID NO 19780 | TGAATCACAGCGGAGGCCTC | TAGGAT | chr12 | 21583604 | 21583623 | 21583620 | + |
| SEQ ID NO 19781 | TGGAAACGAAATATTTGACT | ATGAGT | chr12 | 21583711 | 21583730 | 21583727 | + |
| SEQ ID NO 19782 | CCTGAACTGCCATCATGAA | CTGGGT | chr12 | 21583755 | 21583774 | 21583771 | + |
| SEQ ID NO 19783 | ACTGCACCGATGGTCTCATG | GGGAGT | chr12 | 21583959 | 21583978 | 21583975 | + |
| SEQ ID NO 19784 | GAAATTTGGGGAAGAGGTAT | GTGGAT | chr12 | 21584298 | 21584317 | 21584314 | + |
| SEQ ID NO 19785 | CAAAGATATTTTCATCCCAT | GTGAGT | chr12 | 21584350 | 21584369 | 21584366 | + |
| SEQ ID NO 19786 | TCCCATGTGAGTGCTCACCA | ATGGGT | chr12 | 21584364 | 21584383 | 21584380 | + |
| SEQ ID NO 19787 | AATGGGTGACCTCAGCAGAA | GAGGAT | chr12 | 21584383 | 21584402 | 21584399 | + |
| SEQ ID NO 19788 | AAGAGGATTTTAATAATCAA | GTGGAT | chr12 | 21584401 | 21584420 | 21584417 | + |
| SEQ ID NO 19789 | GATTTTAATAATCAAGTGGA | TAGGAT | chr12 | 21584406 | 21584425 | 21584422 | + |
| SEQ ID NO 19790 | AACAAAGTGGCCACAGTTGC | AGGGAT | chr12 | 21584499 | 21584518 | 21584515 | + |
| SEQ ID NO 19791 | CTTGATATGGCACCATTCCT | CGGGGT | chr12 | 21584622 | 21584641 | 21584638 | + |
| SEQ ID NO 19792 | GGGCAGAGGCTTGTCCTCAC | TGGAAT | chr12 | 21584705 | 21584724 | 21584721 | + |
| SEQ ID NO 19793 | CACTGGAATAGACACTTACT | CTGGAT | chr12 | 21584722 | 21584741 | 21584738 | + |
| SEQ ID NO 19794 | AATAGACACTTACTCTGGAT | ATGGGT | chr12 | 21584728 | 21584747 | 21584744 | + |
| SEQ ID NO 19795 | TATGCCAAGACTACCATCCA | TGGAAT | chr12 | 21584777 | 21584796 | 21584793 | + |
| SEQ ID NO 19796 | GACTACCATCCATGGAATCA | CAGAAT | chr12 | 21584785 | 21584804 | 21584801 | + |
| SEQ ID NO 19797 | TGACAGTGGGCTCATGCTCA | TGGAAT | chr12 | 21584885 | 21584904 | 21584901 | + |
| SEQ ID NO 19798 | CTATCATCCTGAAGCAGCTT | TTGAAT | chr12 | 21584932 | 21584951 | 21584948 | + |
| SEQ ID NO 19799 | TCCAGAAGGCTGTGTATGCT | CTGAAT | chr12 | 21585025 | 21585044 | 21585041 | + |
| SEQ ID NO 19800 | GGTACTGTTTCTCCCATAGA | CAGGAT | chr12 | 21585066 | 21585085 | 21585082 | + |
| SEQ ID NO 19801 | TTCTCCCATAGACAGGATTC | ACGGGT | chr12 | 21585074 | 21585093 | 21585090 | + |
| SEQ ID NO 19802 | TAGACAGGATTCACGGGTCC | AGGAAT | chr12 | 21585082 | 21585101 | 21585098 | + |
| SEQ ID NO 19803 | ATTCACGGGTCCAGGAATCA | AAGGGT | chr12 | 21585090 | 21585109 | 21585106 | + |
| SEQ ID NO 19804 | TTAAGTCAACAGGCTAAGAA | GAGAGT | chr12 | 21585324 | 21585343 | 21585340 | + |
| SEQ ID NO 19805 | GAGGTAAGGAAGCGTATGCA | TGGAAT | chr12 | 21585415 | 21585434 | 21585431 | + |
| SEQ ID NO 19806 | ATGGAATATAGGAGATCCAT | TAGGGT | chr12 | 21585434 | 21585453 | 21585450 | + |
| SEQ ID NO 19807 | CTCTTAGTTTTACCATGTCC | TGGAAT | chr12 | 21585462 | 21585481 | 21585478 | + |
| SEQ ID NO 19808 | GCAGGACTACAAATAAAGGT | TTGGGT | chr12 | 21585523 | 21585542 | 21585539 | + |
| SEQ ID NO 19809 | AGGTGCTTGCTGAGGGCAAA | GGGAAT | chr12 | 21585593 | 21585612 | 21585609 | + |
| SEQ ID NO 19810 | TGCTGAGGGCAAAGGGAATA | CAGAAT | chr12 | 21585600 | 21585619 | 21585616 | + |
| SEQ ID NO 19811 | ATACAAGGACTGTAATTGTC | ATGAGT | chr12 | 21585682 | 21585701 | 21585698 | + |
| SEQ ID NO 19812 | TATGTAATAGCATTTGCAAT | GGGGAT | chr12 | 21585850 | 21585869 | 21585866 | + |
| SEQ ID NO 19813 | GGTGCATTTTCAATTGCACG | AAGGAT | chr12 | 21585877 | 21585896 | 21585893 | + |
| SEQ ID NO 19814 | GAAGATAATGTATGACCTCA | GGGGAT | chr12 | 21585950 | 21585969 | 21585966 | + |
| SEQ ID NO 19815 | TGGACTTGTGATGGTTAATA | CTGAGT | chr12 | 21586002 | 21586021 | 21586018 | + |
| SEQ ID NO 19816 | AATACTGAGTGTCAACTTGA | TTGGAT | chr12 | 21586018 | 21586037 | 21586034 | + |
| SEQ ID NO 19817 | AAGTGTGCAAAGTATTGATC | CTGAGT | chr12 | 21586046 | 21586065 | 21586062 | + |

Figure 44 (Cont'd)

| | | | | | | | |
|---|---|---|---|---|---|---|---|
| SEQ ID NO 19818 | TTGATCCTGAGTGTGTCTGT | GAGGGT | chr12 | 21586060 | 21586079 | 21586076 | + |
| SEQ ID NO 19819 | AAGGCAGACCCACCCTTAAT | CTGGGT | chr12 | 21586126 | 21586145 | 21586142 | + |
| SEQ ID NO 19820 | TAATCAGTTGCCAGTGTGGC | CAGGAT | chr12 | 21586162 | 21586181 | 21586178 | + |
| SEQ ID NO 19821 | GCCTACATCTTTCTCCCATG | CTGGAT | chr12 | 21586242 | 21586261 | 21586258 | + |
| SEQ ID NO 19822 | TTCAACATCACTAATAATCA | GAGAAT | chr12 | 21586576 | 21586595 | 21586592 | + |
| SEQ ID NO 19823 | TGATACCTCCTTATGCCAGT | CAGAAT | chr12 | 21586621 | 21586640 | 21586637 | + |
| SEQ ID NO 19824 | CAAAAACAGCAGATGTTGGT | GAGGAT | chr12 | 21586665 | 21586684 | 21586681 | + |
| SEQ ID NO 19825 | AATGCTTATACACTGTTGGT | AAGAAT | chr12 | 21586704 | 21586723 | 21586720 | + |
| SEQ ID NO 19826 | TCAATCCTGCAATCCCACTA | CTGGGT | chr12 | 21586799 | 21586818 | 21586815 | + |
| SEQ ID NO 19827 | TGTTCCCAATAGCAAAGATA | TGGAAT | chr12 | 21586890 | 21586909 | 21586906 | + |
| SEQ ID NO 19828 | AAATGTCTACCAATGGACGA | TTGGAT | chr12 | 21586922 | 21586941 | 21586938 | + |
| SEQ ID NO 19829 | TATATTACTCAGCCATAAAA | AAGAAT | chr12 | 21586983 | 21587002 | 21586999 | + |
| SEQ ID NO 19830 | AGCCAAGTGGGAGCTAAACG | ATGAGT | chr12 | 21587114 | 21587133 | 21587130 | + |
| SEQ ID NO 19831 | GATGAGTAAGCATAGACATA | TAGAAT | chr12 | 21587133 | 21587152 | 21587149 | + |
| SEQ ID NO 19832 | TTGAGACTAGAGAAAGGTGG | GAGGAT | chr12 | 21587173 | 21587192 | 21587189 | + |
| SEQ ID NO 19833 | CTAGAGAAAGGTGGGAGGAT | AGGAGT | chr12 | 21587179 | 21587198 | 21587195 | + |
| SEQ ID NO 19834 | ATGGTGAGGACTGAAAAACT | ACGGAT | chr12 | 21587205 | 21587224 | 21587221 | + |
| SEQ ID NO 19835 | GAGGACTGAAAAACTACGGA | TTGGAT | chr12 | 21587210 | 21587229 | 21587226 | + |
| SEQ ID NO 19836 | GTCCCCACCCAAATCTCATC | TTGAAT | chr12 | 21587343 | 21587362 | 21587359 | + |
| SEQ ID NO 19837 | TAATCCTCACGTGTTGTGGG | AGGGAT | chr12 | 21587380 | 21587399 | 21587396 | + |
| SEQ ID NO 19838 | AGGGATTTGGAGGGAGGTAA | TTGAAT | chr12 | 21587400 | 21587419 | 21587416 | + |
| SEQ ID NO 19839 | CTCATGCTCTTCTCGTGATA | GTGAGT | chr12 | 21587442 | 21587461 | 21587458 | + |
| SEQ ID NO 19840 | GCAAGCAAAATATCACTTAA | TGGGGT | chr12 | 21587772 | 21587791 | 21587788 | + |
| SEQ ID NO 19841 | TCACTTAATGGGGTAATTAA | AAGGGT | chr12 | 21587784 | 21587803 | 21587800 | + |
| SEQ ID NO 19842 | AGGGTGAAGAAATTGGGCAA | ATGGAT | chr12 | 21587805 | 21587824 | 21587821 | + |
| SEQ ID NO 19843 | GGCAAATGGATGTCATGAGG | AGGAAT | chr12 | 21587820 | 21587839 | 21587836 | + |
| SEQ ID NO 19844 | TCAGAGCCCAGGCCCTAAGC | TGGAGT | chr12 | 21587865 | 21587884 | 21587881 | + |
| SEQ ID NO 19845 | GCCCAGGCCCTAAGCTGGAG | TAGAGT | chr12 | 21587870 | 21587889 | 21587886 | + |
| SEQ ID NO 19846 | TGGAGTAGAGTGTGCAAGGA | AAGAGT | chr12 | 21587885 | 21587904 | 21587901 | + |
| SEQ ID NO 19847 | AGTGTGCAAGGAAAGAGTAA | TAGGAT | chr12 | 21587893 | 21587912 | 21587909 | + |
| SEQ ID NO 19848 | GAAAGAGTAATAGGATTGAA | AAGGAT | chr12 | 21587903 | 21587922 | 21587919 | + |
| SEQ ID NO 19849 | CCAGGTAGGAGGACATAGGG | AGGGGT | chr12 | 21587931 | 21587950 | 21587947 | + |
| SEQ ID NO 19850 | AGACCTCCAGTAAACTTAGG | CAGGAT | chr12 | 21587967 | 21587986 | 21587983 | + |
| SEQ ID NO 19851 | ACTAAATAATAATCACATGT | GAGAAT | chr12 | 21588008 | 21588027 | 21588024 | + |
| SEQ ID NO 19852 | TTGTTCATGAGCTAGAGCAA | GGGGAT | chr12 | 21588068 | 21588087 | 21588084 | + |
| SEQ ID NO 19853 | ATGCTATTATATGGTACCAA | TAGGAT | chr12 | 21588441 | 21588460 | 21588457 | + |
| SEQ ID NO 19854 | AAAATGCAAGCAATTTTCAT | ATGAGT | chr12 | 21588504 | 21588523 | 21588520 | + |
| SEQ ID NO 19855 | TACACAAGCTAATTGTCCTT | AAGAAT | chr12 | 21588531 | 21588550 | 21588547 | + |
| SEQ ID NO 19856 | AAGTTTAAACTGTCATTGAG | CAGAGT | chr12 | 21588595 | 21588614 | 21588611 | + |
| SEQ ID NO 19857 | CAGATGTTATGTGATGAGGA | CAGAAT | chr12 | 21588652 | 21588671 | 21588668 | + |
| SEQ ID NO 19858 | AGAACTTTTCTTTAAAGTGT | GGGAGT | chr12 | 21588888 | 21588907 | 21588904 | + |
| SEQ ID NO 19859 | ACAAAAATGCAAAATTTCCA | AAGAAT | chr12 | 21588968 | 21588987 | 21588984 | + |
| SEQ ID NO 19860 | TTCATCTTCATCTTTTCCAG | GAGAAT | chr12 | 21589020 | 21589039 | 21589036 | + |
| SEQ ID NO 19861 | GATAGTCCCCCATATAGCCT | TAGAGT | chr12 | 21589352 | 21589371 | 21589368 | + |
| SEQ ID NO 19862 | GTAGAAAATCCCACATAAGA | GAGAAT | chr12 | 21589516 | 21589535 | 21589532 | + |
| SEQ ID NO 19863 | TCCCACATAAGAGAGAATTC | TGGAAT | chr12 | 21589524 | 21589543 | 21589540 | + |
| SEQ ID NO 19864 | AGCAAGGAAGCCTACCCAGT | AGGGAT | chr12 | 21589597 | 21589616 | 21589613 | + |
| SEQ ID NO 19865 | ACATCTGCATTATGGACTCC | AGGAAT | chr12 | 21589687 | 21589706 | 21589703 | + |

Figure 44 (Cont'd)

| | | | | | | | |
|---|---|---|---|---|---|---|---|
| SEQ ID NO 19866 | TCCAGGAATCCTAGCCACAG | GAGAGT | chr12 | 21589704 | 21589723 | 21589720 | + |
| SEQ ID NO 19867 | CTCCAGAGAAGGAGCTCTCA | CTGGGT | chr12 | 21589794 | 21589813 | 21589810 | + |
| SEQ ID NO 19868 | CTGACATCCCCCACCCACAG | CTGAGT | chr12 | 21589941 | 21589960 | 21589957 | + |
| SEQ ID NO 19869 | TACTGCTGGCTGCTGTCACC | AGGGAT | chr12 | 21589969 | 21589988 | 21589985 | + |
| SEQ ID NO 19870 | AGGCATTCTGCTGGGGGCCT | GAGGAT | chr12 | 21590210 | 21590229 | 21590226 | + |
| SEQ ID NO 19871 | GCCGGTGTCCACACACACCA | CTGAGT | chr12 | 21590258 | 21590277 | 21590274 | + |
| SEQ ID NO 19872 | ACCTCCTGCATGTGCCACCT | GTGGGT | chr12 | 21590453 | 21590472 | 21590469 | + |
| SEQ ID NO 19873 | TGCAGACTGCTTGGGAGCCA | GAGGGT | chr12 | 21590524 | 21590543 | 21590540 | + |
| SEQ ID NO 19874 | AGCAAACTGCCTGAAGGCCA | AAGAAT | chr12 | 21590652 | 21590671 | 21590668 | + |
| SEQ ID NO 19875 | CAGCCATGGGGCCCAAGGAC | AGGAAT | chr12 | 21590717 | 21590736 | 21590733 | + |
| SEQ ID NO 19876 | AAGAAATATGACACTTCCAA | AGGAAT | chr12 | 21591083 | 21591102 | 21591099 | + |
| SEQ ID NO 19877 | ATTTATAAAATTCTGGAAAA | AAGAAT | chr12 | 21591151 | 21591170 | 21591167 | + |
| SEQ ID NO 19878 | AAGAAATCAGAAAACAATT | CAGGAT | chr12 | 21591237 | 21591256 | 21591253 | + |
| SEQ ID NO 19879 | TCAGAAAACAATTCAGGAT | ATGAAT | chr12 | 21591243 | 21591262 | 21591259 | + |
| SEQ ID NO 19880 | ACCCAAGAGATAGATACAAC | AAGAAT | chr12 | 21591278 | 21591297 | 21591294 | + |
| SEQ ID NO 19881 | AAACAGAAATTCTGTAACTG | AAGAGT | chr12 | 21591309 | 21591328 | 21591325 | + |
| SEQ ID NO 19882 | AATGATAGAAAGGAAAAAAA | AAGAAT | chr12 | 21591442 | 21591461 | 21591458 | + |
| SEQ ID NO 19883 | AGTCAAACTGTCAAAAGCCA | AAGAGT | chr12 | 21591691 | 21591710 | 21591707 | + |
| SEQ ID NO 19884 | CCTCACAGGCCAGGAGAAGA | TGGGAT | chr12 | 21591808 | 21591827 | 21591824 | + |
| SEQ ID NO 19885 | TGAAAGAAAAAATGACACC | AAGGAT | chr12 | 21591850 | 21591869 | 21591866 | + |
| SEQ ID NO 19886 | AACATTGTTCTTCAAAAATG | AAGGAT | chr12 | 21591888 | 21591907 | 21591904 | + |
| SEQ ID NO 19887 | TCTGGGCAAGAAAAATTTGA | AGGAAT | chr12 | 21591927 | 21591946 | 21591943 | + |
| SEQ ID NO 19888 | GCTTTACAAGAAATATTTAA | GGGAGT | chr12 | 21591970 | 21591989 | 21591986 | + |
| SEQ ID NO 19889 | GAAAGAAAGAGAGAGAGAGA | GAGAAT | chr12 | 21592155 | 21592174 | 21592171 | + |
| SEQ ID NO 19890 | AAAAAAAAAACAAAACAACC | AGGAAT | chr12 | 21592231 | 21592250 | 21592247 | + |
| SEQ ID NO 19891 | GAATCAATTAACAAAATGGC | AGGAAT | chr12 | 21592253 | 21592272 | 21592269 | + |
| SEQ ID NO 19892 | AATAATAGCCTTGCATGTAA | ATGGAT | chr12 | 21592294 | 21592313 | 21592310 | + |
| SEQ ID NO 19893 | GATAAAGGAACAATTCAGC | AAGAGT | chr12 | 21592559 | 21592578 | 21592575 | + |
| SEQ ID NO 19894 | AGCAAATGTTATTAGATATA | AAGGGT | chr12 | 21592637 | 21592656 | 21592653 | + |
| SEQ ID NO 19895 | ATTAGATATAAAGGGTGAAA | TAGAAT | chr12 | 21592647 | 21592666 | 21592663 | + |
| SEQ ID NO 19896 | AATCCAATACAATAATAGTT | GGGGAT | chr12 | 21592670 | 21592689 | 21592686 | + |
| SEQ ID NO 19897 | AGAAAATTAACAAAGAAACA | TTGGAT | chr12 | 21592736 | 21592755 | 21592752 | + |
| SEQ ID NO 19898 | TAAACTTGACTTTAGACCAA | ATGGAT | chr12 | 21592763 | 21592782 | 21592779 | + |
| SEQ ID NO 19899 | AATATTTCATCCAACAGCTA | CAGAAT | chr12 | 21592802 | 21592821 | 21592818 | + |
| SEQ ID NO 19900 | TCAGCACATGACGCATTCCC | CAGGAT | chr12 | 21592840 | 21592859 | 21592856 | + |
| SEQ ID NO 19901 | AGCATCTTCTCAGACCACAA | TGGAAT | chr12 | 21592927 | 21592946 | 21592943 | + |
| SEQ ID NO 19902 | GGAAATTAAACAACATGCTC | CTGAAT | chr12 | 21593003 | 21593022 | 21593019 | + |
| SEQ ID NO 19903 | ATACAACATAGGAAAAGCCA | TGGGAT | chr12 | 21593095 | 21593114 | 21593111 | + |
| SEQ ID NO 19904 | AATAGAGAAAACAACAACA | AGGGAT | chr12 | 21593292 | 21593311 | 21593308 | + |
| SEQ ID NO 19905 | TGTTATTTAAAAAGATAAA | ATGGAT | chr12 | 21593334 | 21593353 | 21593350 | + |
| SEQ ID NO 19906 | ACACATACCACCTACCAAGA | TTGAAT | chr12 | 21593538 | 21593557 | 21593554 | + |
| SEQ ID NO 19907 | CTACCAAGATTGAATTAAGA | AAGAAT | chr12 | 21593549 | 21593568 | 21593565 | + |
| SEQ ID NO 19908 | AAAACCTGAACAGACCAGTA | ATGAAT | chr12 | 21593577 | 21593596 | 21593593 | + |
| SEQ ID NO 19909 | ACCAGTAATGAATAATGAAA | TTGAAT | chr12 | 21593590 | 21593609 | 21593606 | + |
| SEQ ID NO 19910 | CTTTTAAAAATTAAACAGGA | AGGAAT | chr12 | 21593718 | 21593737 | 21593734 | + |
| SEQ ID NO 19911 | TCCTGATTCCATAACCAGAC | AAGGAT | chr12 | 21593776 | 21593795 | 21593792 | + |
| SEQ ID NO 19912 | CTCAACAAAATACTAGCAAA | CTGAAT | chr12 | 21593859 | 21593878 | 21593875 | + |
| SEQ ID NO 19913 | GATAATACACCATGATCAAG | TGGGAT | chr12 | 21593903 | 21593922 | 21593919 | + |

Figure 44 (Cont'd)

| SEQ ID NO 19914 | TGATCAAGTGGGATTTATAC | TAGGGT | chr12 | 21593915 | 21593934 | 21593931 | + |
| SEQ ID NO 19915 | AACCCACAGCTAACATCATA | CTGAAT | chr12 | 21594126 | 21594145 | 21594142 | + |
| SEQ ID NO 19916 | TCTAAGAACTGAAACAAAAT | AAGGAT | chr12 | 21594175 | 21594194 | 21594191 | + |
| SEQ ID NO 19917 | AGCTAAAAAATAAAATATTT | AGGGAT | chr12 | 21594503 | 21594522 | 21594519 | + |
| SEQ ID NO 19918 | AAACTACAAAACACTGATAA | AAGAAT | chr12 | 21594565 | 21594584 | 21594581 | + |
| SEQ ID NO 19919 | TGGAGAGATATCCTATGTTC | ATGGAT | chr12 | 21594610 | 21594629 | 21594626 | + |
| SEQ ID NO 19920 | AGACACTTAGACCAATGGAA | GAGAAT | chr12 | 21594894 | 21594913 | 21594910 | + |
| SEQ ID NO 19921 | AGATTTTCAACAAAGGTGAC | AAGAAT | chr12 | 21594958 | 21594977 | 21594974 | + |
| SEQ ID NO 19922 | AAGAAATGGTGCTGAAAAAA | TTGGAT | chr12 | 21595011 | 21595030 | 21595027 | + |
| SEQ ID NO 19923 | CTGAAAAAATTGGATATCCA | TTGGAT | chr12 | 21595022 | 21595041 | 21595038 | + |
| SEQ ID NO 19924 | CATTGGATATCCATGTGCAA | AAGAAT | chr12 | 21595040 | 21595059 | 21595056 | + |
| SEQ ID NO 19925 | AACTGGACTGCTGATATGGT | TTGGAT | chr12 | 21595068 | 21595087 | 21595084 | + |
| SEQ ID NO 19926 | AAATATAATCCCCAACTTCT | CAGGAT | chr12 | 21595120 | 21595139 | 21595136 | + |
| SEQ ID NO 19927 | CCCAACTTCTCAGGATCTTG | GCGGAT | chr12 | 21595130 | 21595149 | 21595146 | + |
| SEQ ID NO 19928 | AGCATGTGGAGGCTCGCATT | GTGAAT | chr12 | 21595200 | 21595219 | 21595216 | + |
| SEQ ID NO 19929 | CAGGAGACACCCCAAATACT | GTGAGT | chr12 | 21595315 | 21595334 | 21595331 | + |
| SEQ ID NO 19930 | GAGAAGTTTCTGACCTTACC | TGGAGT | chr12 | 21595424 | 21595443 | 21595440 | + |
| SEQ ID NO 19931 | GTTTCTGACCTTACCTGGAG | TTGAGT | chr12 | 21595429 | 21595448 | 21595445 | + |
| SEQ ID NO 19932 | AGAAAGGCCCTGGGAGCTCA | CTGGGT | chr12 | 21595499 | 21595518 | 21595515 | + |
| SEQ ID NO 19933 | AGGCATTTACATTACTAACA | TTGAAT | chr12 | 21595557 | 21595576 | 21595573 | + |
| SEQ ID NO 19934 | GGCCTAAATGCTCCACTTAA | AAGGGT | chr12 | 21595589 | 21595608 | 21595605 | + |
| SEQ ID NO 19935 | CATGCAAATGGCCACCAAAA | GTGAGT | chr12 | 21595628 | 21595647 | 21595644 | + |
| SEQ ID NO 19936 | AGAAAGTCAACAAAAAAATA | ATGGAT | chr12 | 21595893 | 21595912 | 21595909 | + |
| SEQ ID NO 19937 | AAAAAAAAGTTCAGGACCAG | ATGGAT | chr12 | 21596126 | 21596145 | 21596142 | + |
| SEQ ID NO 19938 | AGGACCAGATGGATTCACAA | CAGAAT | chr12 | 21596138 | 21596157 | 21596154 | + |
| SEQ ID NO 19939 | ATTCTACTAGACATTCAAAG | AGGAAT | chr12 | 21596162 | 21596181 | 21596178 | + |
| SEQ ID NO 19940 | GATCAAGCAGGTTCCATGCC | AGGGAT | chr12 | 21596403 | 21596422 | 21596419 | + |
| SEQ ID NO 19941 | CAGGTTCCATGCCAGGGATG | CAGGGT | chr12 | 21596410 | 21596429 | 21596426 | + |
| SEQ ID NO 19942 | AACCCACAGCCAACATAATA | TTGAAT | chr12 | 21596626 | 21596645 | 21596642 | + |
| SEQ ID NO 19943 | TCTGAGAACTGGAACAAGAC | AAGGAT | chr12 | 21596675 | 21596694 | 21596691 | + |
| SEQ ID NO 19944 | GCAAAGTTTCCAGATACAAG | ATGAAT | chr12 | 21596896 | 21596915 | 21596912 | + |
| SEQ ID NO 19945 | ACACCAACAGCAACCAAATG | GAGAAT | chr12 | 21596947 | 21596966 | 21596963 | + |
| SEQ ID NO 19946 | ATATAAAACGTACTCTCAAG | ATGGAT | chr12 | 21597041 | 21597060 | 21597057 | + |
| SEQ ID NO 19947 | CACAGTGAAGAGACAAGCTG | TTGAAT | chr12 | 21597256 | 21597275 | 21597272 | + |
| SEQ ID NO 19948 | ATATTTGCATACATTTGACA | AGGAAT | chr12 | 21597290 | 21597309 | 21597306 | + |
| SEQ ID NO 19949 | TTTGACAAGGAATTAATCTC | CAGAAT | chr12 | 21597303 | 21597322 | 21597319 | + |
| SEQ ID NO 19950 | ATCTCATTAAAAAATTGGCA | AAGGAT | chr12 | 21597370 | 21597389 | 21597386 | + |
| SEQ ID NO 19951 | AGAAGACATACAAATGCACA | ATGGGT | chr12 | 21597406 | 21597425 | 21597422 | + |
| SEQ ID NO 19952 | AGATATCATCTTATGCCAGT | TAGAAT | chr12 | 21597490 | 21597509 | 21597506 | + |
| SEQ ID NO 19953 | AATAAATAACACATGCTGGC | AAGGAT | chr12 | 21597540 | 21597559 | 21597556 | + |
| SEQ ID NO 19954 | AAGATCCAGCAATCTTATTA | CTGGGT | chr12 | 21597674 | 21597693 | 21597690 | + |
| SEQ ID NO 19955 | TGGGTATTTATCCAAAGGAA | AAGAAT | chr12 | 21597695 | 21597714 | 21597711 | + |
| SEQ ID NO 19956 | TTATCCAAAGGAAAAGAATT | CAGAAT | chr12 | 21597702 | 21597721 | 21597718 | + |
| SEQ ID NO 19957 | GATTCACATTAGCAAAGATA | TGGAAT | chr12 | 21597767 | 21597786 | 21597783 | + |
| SEQ ID NO 19958 | ATCAACCTAAGTGTCCATCA | ATGGAT | chr12 | 21597791 | 21597810 | 21597807 | + |
| SEQ ID NO 19959 | ACCTAAGTGTCCATCAATGG | ATGAAT | chr12 | 21597795 | 21597814 | 21597811 | + |
| SEQ ID NO 19960 | AATGTGGTGTATACACACAA | TTGAAT | chr12 | 21597827 | 21597846 | 21597843 | + |
| SEQ ID NO 19961 | ATCATTTCATTTGCAGCAAC | ATGGAT | chr12 | 21597877 | 21597896 | 21597893 | + |

Figure 44 (Cont'd)

| | | | | | | | |
|---|---|---|---|---|---|---|---|
| SEQ ID NO 19962 | AAGTTAATATCATGTAGGTA | GAGAGT | chr12 | 21597990 | 21598009 | 21598006 | + |
| SEQ ID NO 19963 | AATATCATGTAGGTAGAGAG | TAGAAT | chr12 | 21597995 | 21598014 | 21598011 | + |
| SEQ ID NO 19964 | GAAACAGGCAGTTAGATAGA | AGGAAT | chr12 | 21598092 | 21598111 | 21598108 | + |
| SEQ ID NO 19965 | TCTGATGTTCAATAGCAAAG | TAGGGT | chr12 | 21598122 | 21598141 | 21598138 | + |
| SEQ ID NO 19966 | AACGATAAATACTTGAGGTG | ATGAAT | chr12 | 21598224 | 21598243 | 21598240 | + |
| SEQ ID NO 19967 | AAACTTCTCTCTTAACAAGC | TAGAAT | chr12 | 21598583 | 21598602 | 21598599 | + |
| SEQ ID NO 19968 | CTTAACAAGCTAGAATATAA | GTGAAT | chr12 | 21598593 | 21598612 | 21598609 | + |
| SEQ ID NO 19969 | TGAATGCAAGAGCATAGAGA | CAGGGT | chr12 | 21598614 | 21598633 | 21598630 | + |
| SEQ ID NO 19970 | GAAAATACTTAATATCATTA | ATGAAT | chr12 | 21598740 | 21598759 | 21598756 | + |
| SEQ ID NO 19971 | TTTTACCACAGCGTAGGTCA | TTGAAT | chr12 | 21598771 | 21598790 | 21598787 | + |
| SEQ ID NO 19972 | ATCACTATTTCAAAGAAGTA | TAGAAT | chr12 | 21599001 | 21599020 | 21599017 | + |
| SEQ ID NO 19973 | GAATAGATATCAGCCAAAAT | AAGGAT | chr12 | 21599023 | 21599042 | 21599039 | + |
| SEQ ID NO 19974 | AGGGGCCTAGACATAGCATG | CTGAAT | chr12 | 21599507 | 21599526 | 21599523 | + |
| SEQ ID NO 19975 | GCATGCTGAATGAAAAGGAA | GTGAGT | chr12 | 21599522 | 21599541 | 21599538 | + |
| SEQ ID NO 19976 | TGAGCTAACTTCCTCATTTT | ATGAAT | chr12 | 21599816 | 21599835 | 21599832 | + |
| SEQ ID NO 19977 | AAGAAATAAGCTAATACCTA | CAGAGT | chr12 | 21599852 | 21599871 | 21599868 | + |
| SEQ ID NO 19978 | ATTAAATGCTAGGCACAGTT | CTGAGT | chr12 | 21599882 | 21599901 | 21599898 | + |
| SEQ ID NO 19979 | CAACATTACCCAGGTGATGG | TGGAGT | chr12 | 21600006 | 21600025 | 21600022 | + |
| SEQ ID NO 19980 | TACCCAGGTGATGGTGGAGT | TGGAAT | chr12 | 21600012 | 21600031 | 21600028 | + |
| SEQ ID NO 19981 | GACAGCAAGATAGTAAGTAA | AGGAAT | chr12 | 21600068 | 21600087 | 21600084 | + |
| SEQ ID NO 19982 | AGGAATGGAGCAACAAATTG | ATGGAT | chr12 | 21600088 | 21600107 | 21600104 | + |
| SEQ ID NO 19983 | TTTTGCTTGTTTGTTTGAAA | CAGGGT | chr12 | 21600122 | 21600141 | 21600138 | + |
| SEQ ID NO 19984 | TCTCACTCTGTCACCCCGGC | TGGAGT | chr12 | 21600147 | 21600166 | 21600163 | + |
| SEQ ID NO 19985 | CTGAAGCCTCACTAGAACGC | CTGGAT | chr12 | 21600194 | 21600213 | 21600210 | + |
| SEQ ID NO 19986 | TTTTTAAATTTCTGTAGAAA | CAGGGT | chr12 | 21600296 | 21600315 | 21600312 | + |
| SEQ ID NO 19987 | AAAGTGTTGAGATTACAGGT | GTGAAT | chr12 | 21600388 | 21600407 | 21600404 | + |
| SEQ ID NO 19988 | AATCACCATGCTGGGCCTTG | ATGGAT | chr12 | 21600411 | 21600430 | 21600427 | + |
| SEQ ID NO 19989 | ATGGATCTTTAAAAGTGGTG | GGGGGT | chr12 | 21600431 | 21600450 | 21600447 | + |
| SEQ ID NO 19990 | AAACATCGTTAGGTCTCGGG | AAGGAT | chr12 | 21600498 | 21600517 | 21600514 | + |
| SEQ ID NO 19991 | TCGTTAGGTCTCGGGAAGGA | TGGGAT | chr12 | 21600503 | 21600522 | 21600519 | + |
| SEQ ID NO 19992 | TCTGTGTTAACAAAAAACAG | CCGAGT | chr12 | 21600569 | 21600588 | 21600585 | + |
| SEQ ID NO 19993 | TCTGAAGGTTTAGAAACTCC | TTGAGT | chr12 | 21600730 | 21600749 | 21600746 | + |
| SEQ ID NO 19994 | CTTTAGAACTCCTGTCCTAG | AAGAGT | chr12 | 21600778 | 21600797 | 21600794 | + |
| SEQ ID NO 19995 | ACCACTTTGACTCTAGTTTT | CTGAAT | chr12 | 21600831 | 21600850 | 21600847 | + |
| SEQ ID NO 19996 | CCTTAACATGTTAATTTCTC | CAGAGT | chr12 | 21601092 | 21601111 | 21601108 | + |
| SEQ ID NO 19997 | AGTAAGACCTGGGCAAAGGA | GAGAGT | chr12 | 21601159 | 21601178 | 21601175 | + |
| SEQ ID NO 19998 | TTTGGGCAAAACTTTCCATC | CTGGGT | chr12 | 21601203 | 21601222 | 21601219 | + |
| SEQ ID NO 19999 | ACTTAGTACTTCCCACTACT | GTGGAT | chr12 | 21601303 | 21601322 | 21601319 | + |
| SEQ ID NO 20000 | GTACTTCCCACTACTGTGGA | TAGAAT | chr12 | 21601308 | 21601327 | 21601324 | + |
| SEQ ID NO 20001 | TTTGTCAATTCTTGAAGATT | AAGAAT | chr12 | 21601745 | 21601764 | 21601761 | + |
| SEQ ID NO 20002 | TGATACCTAATAGACACTTG | ATGAAT | chr12 | 21601814 | 21601833 | 21601830 | + |
| SEQ ID NO 20003 | AGACACTTGATGAATCCTTA | CTGAAT | chr12 | 21601825 | 21601844 | 21601841 | + |
| SEQ ID NO 20004 | AATCCTTACTGAATAATAAA | ATGGAT | chr12 | 21601837 | 21601856 | 21601853 | + |
| SEQ ID NO 20005 | CTGAATAATAAAATGGATTA | ATGAAT | chr12 | 21601845 | 21601864 | 21601861 | + |
| SEQ ID NO 20006 | AAAGGTTATTTTGAAGTCT | GAGAAT | chr12 | 21601908 | 21601927 | 21601924 | + |
| SEQ ID NO 20007 | TGGGCAAAATTCTGGCAGCA | AGGGAT | chr12 | 21601995 | 21602014 | 21602011 | + |
| SEQ ID NO 20008 | CTAAGAAACCTTTTGTTTTC | TTGGAT | chr12 | 21602028 | 21602047 | 21602044 | + |
| SEQ ID NO 20009 | AACCTTTTGTTTTCTTGGAT | GTGAAT | chr12 | 21602034 | 21602053 | 21602050 | + |

Figure 44 (Cont'd)

| | | | | | | | |
|---|---|---|---|---|---|---|---|
| SEQ ID NO 20010 | AAAACATGGTAAGATAACTG | GAGAGT | chr12 | 21602079 | 21602098 | 21602095 | + |
| SEQ ID NO 20011 | AGAAACTGTTATTCAGTTTA | AGGGGT | chr12 | 21602127 | 21602146 | 21602143 | + |
| SEQ ID NO 20012 | TCTTACATAATAGTAAAAAA | GTGAAT | chr12 | 21602256 | 21602275 | 21602272 | + |
| SEQ ID NO 20013 | CTTGATCATTAAATACCTCT | ACGAAT | chr12 | 21602327 | 21602346 | 21602343 | + |
| SEQ ID NO 20014 | CAATTTGCTCTATGAACTGG | AGGAGT | chr12 | 21602353 | 21602372 | 21602369 | + |
| SEQ ID NO 20015 | TGCTCTATGAACTGGAGGAG | TGGGAT | chr12 | 21602358 | 21602377 | 21602374 | + |
| SEQ ID NO 20016 | TATAGTGGCAATGTATTATT | AGGAAT | chr12 | 21602463 | 21602482 | 21602479 | + |
| SEQ ID NO 20017 | ATAAGTATTAAAGGCAGCTT | AGGGGT | chr12 | 21602652 | 21602671 | 21602668 | + |
| SEQ ID NO 20018 | TTTTATTTCAAGGCATACTC | CGGGAT | chr12 | 21603006 | 21603025 | 21603022 | + |
| SEQ ID NO 20019 | TTAAAAACACATGCTCATTT | CAGGAT | chr12 | 21603120 | 21603139 | 21603136 | + |
| SEQ ID NO 20020 | GGATAAAGATCTCTGAGGAA | AAGAAT | chr12 | 21603142 | 21603161 | 21603158 | + |
| SEQ ID NO 20021 | TTCTTTCTCACTAAACTACA | GAGAAT | chr12 | 21603252 | 21603271 | 21603268 | + |
| SEQ ID NO 20022 | TGACTTTTAATTTTGATTTT | ATGAAT | chr12 | 21603333 | 21603352 | 21603349 | + |
| SEQ ID NO 20023 | CTTTGAACAGTTAGTATAAG | GTGAAT | chr12 | 21603374 | 21603393 | 21603390 | + |
| SEQ ID NO 20024 | TAAGGTGAATTCTGATTTTT | CAGAAT | chr12 | 21603390 | 21603409 | 21603406 | + |
| SEQ ID NO 20025 | GTCTTGACACTTTTAAACTA | GAGAGT | chr12 | 21603725 | 21603744 | 21603741 | + |
| SEQ ID NO 20026 | CTAGAGAGTATAAACCCACA | AGGAAT | chr12 | 21603742 | 21603761 | 21603758 | + |
| SEQ ID NO 20027 | TTTTGCCTTTTGAGAAGCTC | CTGAAT | chr12 | 21603969 | 21603988 | 21603985 | + |
| SEQ ID NO 20028 | ACATTAATTCCAAGCTAATT | GTGAAT | chr12 | 21603999 | 21604018 | 21604015 | + |
| SEQ ID NO 20029 | GCATTTCATATAATTACTAA | CAGAAT | chr12 | 21604040 | 21604059 | 21604056 | + |
| SEQ ID NO 20030 | ATATAATTACTAACAGAATG | TAGAGT | chr12 | 21604047 | 21604066 | 21604063 | + |
| SEQ ID NO 20031 | TATTTCTATGTTGTCATAAT | ATGGAT | chr12 | 21604184 | 21604203 | 21604200 | + |
| SEQ ID NO 20032 | CTAGCAATTGGTTATCACTA | GAGAGT | chr12 | 21604369 | 21604388 | 21604385 | + |
| SEQ ID NO 20033 | CCCACTGGGGAAGCCCACCC | AGGGAT | chr12 | 21604538 | 21604557 | 21604554 | + |
| SEQ ID NO 20034 | CACCCAGGGATGTTACAGAG | AGGGAT | chr12 | 21604553 | 21604572 | 21604569 | + |
| SEQ ID NO 20035 | TACAGTCCTCCGAGACTCCT | TTGAAT | chr12 | 21604599 | 21604618 | 21604615 | + |
| SEQ ID NO 20036 | GAACTTACAGGCACAAAAGT | TAGAGT | chr12 | 21604659 | 21604678 | 21604675 | + |
| SEQ ID NO 20037 | GGCACAAAAGTTAGAGTTGG | TAGAGT | chr12 | 21604668 | 21604687 | 21604684 | + |
| SEQ ID NO 20038 | AGGCTTTGGTAGCTTCTCTT | GGGAAT | chr12 | 21604698 | 21604717 | 21604714 | + |
| SEQ ID NO 20039 | GAAATCTTATGTGCTTCCCA | CAGAAT | chr12 | 21604737 | 21604756 | 21604753 | + |
| SEQ ID NO 20040 | ACAGAATTCCTGGTGGAAGG | AGGAAT | chr12 | 21604756 | 21604775 | 21604772 | + |
| SEQ ID NO 20041 | GAAAGACGAGAAAGAGGAGG | AAGAAT | chr12 | 21604786 | 21604805 | 21604789 | - |
| SEQ ID NO 20042 | GAAGAATTCCTCCTTCCACC | AGGAAT | chr12 | 21604767 | 21604786 | 21604770 | - |
| SEQ ID NO 20043 | GCCTGTAAGTTCTCTTCTCC | TGGGAT | chr12 | 21604651 | 21604670 | 21604654 | - |
| SEQ ID NO 20044 | GGATTACAACTAATTGAAAC | AGGAAT | chr12 | 21604629 | 21604648 | 21604632 | - |
| SEQ ID NO 20045 | TAATTGAAACAGGAATTCAA | AGGAGT | chr12 | 21604619 | 21604638 | 21604622 | - |
| SEQ ID NO 20046 | GAGTCTCGGAGGACTGTAAG | AAGAAT | chr12 | 21604597 | 21604616 | 21604600 | - |
| SEQ ID NO 20047 | GATCCCTCTCTGTAACATCC | CTGGGT | chr12 | 21604560 | 21604579 | 21604563 | - |
| SEQ ID NO 20048 | AGTCGAAGAACTTCCTGTGG | AGGAGT | chr12 | 21604517 | 21604536 | 21604520 | - |
| SEQ ID NO 20049 | GGTTTGTACTGCTCCTGAAG | GTGGAT | chr12 | 21604453 | 21604472 | 21604456 | - |
| SEQ ID NO 20050 | ACACCTTCACTAGGTGACTG | AGGAAT | chr12 | 21604423 | 21604442 | 21604426 | - |
| SEQ ID NO 20051 | CACTAGGTGACTGAGGAATG | TAGAGT | chr12 | 21604416 | 21604435 | 21604419 | - |
| SEQ ID NO 20052 | CTAGTGATAACCAATTGCTA | GTGAGT | chr12 | 21604370 | 21604389 | 21604373 | - |
| SEQ ID NO 20053 | GAGTGAGGAAAGCATTTAAA | CGGAAT | chr12 | 21604348 | 21604367 | 21604351 | - |
| SEQ ID NO 20054 | CTTGTCTATTACAACAGGCT | ATGAAT | chr12 | 21604300 | 21604319 | 21604303 | - |
| SEQ ID NO 20055 | GAAAATATTAGCCATTGCCA | TGGAAT | chr12 | 21604239 | 21604258 | 21604242 | - |
| SEQ ID NO 20056 | AGTAATTATATGAAATGCTT | AAGAAT | chr12 | 21604038 | 21604057 | 21604041 | - |
| SEQ ID NO 20057 | TTTCATATTCACAATTAGCT | TGGAAT | chr12 | 21604011 | 21604030 | 21604014 | - |

Figure 44 (Cont'd)

| SEQ ID NO 20058 | GCAAAATACTGTGCTCCTTT | CAGAAT | chr12 | 21603955 | 21603974 | 21603958 | - |
| SEQ ID NO 20059 | CTTCAATGCTATGCTTATGT | AGGAAT | chr12 | 21603914 | 21603933 | 21603917 | - |
| SEQ ID NO 20060 | TCAAATTGATAAAACAATTT | GCGAGT | chr12 | 21603872 | 21603891 | 21603875 | - |
| SEQ ID NO 20061 | GAGGTATAACCTCATCTGTG | CTGGGT | chr12 | 21603846 | 21603865 | 21603849 | - |
| SEQ ID NO 20062 | AAATTATAAAACAATTCCTT | GTGGGT | chr12 | 21603761 | 21603780 | 21603764 | - |
| SEQ ID NO 20063 | AAAAGTCATGGTTTTGAAGG | CTGAGT | chr12 | 21603682 | 21603701 | 21603685 | - |
| SEQ ID NO 20064 | CTGAGTTCCTCAAGATCTTG | AAGAAT | chr12 | 21603662 | 21603681 | 21603665 | - |
| SEQ ID NO 20065 | AGAATCAAGCCAACTGATTG | CTGGGT | chr12 | 21603641 | 21603660 | 21603644 | - |
| SEQ ID NO 20066 | ATGTCTATTACAGTAATCTA | AAGGAT | chr12 | 21603517 | 21603536 | 21603520 | - |
| SEQ ID NO 20067 | AAAGGATCTGAAATAATAAC | CAGAAT | chr12 | 21603498 | 21603517 | 21603501 | - |
| SEQ ID NO 20068 | TGGCATGCATTCTGAAAAAT | CAGAAT | chr12 | 21603404 | 21603423 | 21603407 | - |
| SEQ ID NO 20069 | TTTGCCTATGTAGAAGTGGA | CAGAAT | chr12 | 21603311 | 21603330 | 21603314 | - |
| SEQ ID NO 20070 | TTCTCTGTAGTTTAGTGAGA | AAGAAT | chr12 | 21603257 | 21603276 | 21603260 | - |
| SEQ ID NO 20071 | CAGAACCATCTCTATCACAT | GTGAAT | chr12 | 21603036 | 21603055 | 21603039 | - |
| SEQ ID NO 20072 | TCTCTATCACATGTGAATCC | CGGAGT | chr12 | 21603028 | 21603047 | 21603031 | - |
| SEQ ID NO 20073 | TGAAATAAAAGTTTTCTCTA | GAGAGT | chr12 | 21602996 | 21603015 | 21602999 | - |
| SEQ ID NO 20074 | CTCAAGGACATAGCTTATTG | GTGGAT | chr12 | 21602961 | 21602980 | 21602964 | - |
| SEQ ID NO 20075 | GGAAGGGACTTGTTAGCACT | GGGAAT | chr12 | 21602929 | 21602948 | 21602932 | - |
| SEQ ID NO 20076 | CAGTGAAACTAAGTTATTTT | ATGGAT | chr12 | 21602784 | 21602803 | 21602787 | - |
| SEQ ID NO 20077 | AGTAGCATGTGTGTTGATCT | CAGGGT | chr12 | 21602749 | 21602768 | 21602752 | - |
| SEQ ID NO 20078 | TGGTACATAGAAAATGCTCA | ATGGAT | chr12 | 21602710 | 21602729 | 21602713 | - |
| SEQ ID NO 20079 | GGTTTGAGATTTTCATATAG | ATGGAT | chr12 | 21602508 | 21602527 | 21602511 | - |
| SEQ ID NO 20080 | GTTTCTTTAAATTTAATGAT | TTGAAT | chr12 | 21602443 | 21602462 | 21602446 | - |
| SEQ ID NO 20081 | TATGAGGTATCTTAGAGATC | ATGAAT | chr12 | 21602388 | 21602407 | 21602391 | - |
| SEQ ID NO 20082 | TTTAATGATCAAGCAAATGG | CAGAGT | chr12 | 21602320 | 21602339 | 21602323 | - |
| SEQ ID NO 20083 | GCAAATGGCAGAGTTAGGAC | CAGGAT | chr12 | 21602308 | 21602327 | 21602311 | - |
| SEQ ID NO 20084 | TCACTTTTTTACTATTATGT | AAGAAT | chr12 | 21602260 | 21602279 | 21602263 | - |
| SEQ ID NO 20085 | AGTACTTGCAGTCAAAGGTC | TTGGAT | chr12 | 21602181 | 21602200 | 21602184 | - |
| SEQ ID NO 20086 | CTGAAAAGAACCCCTTAAA | CTGAAT | chr12 | 21602143 | 21602162 | 21602146 | - |
| SEQ ID NO 20087 | AACTGAATAACAGTTTCTTC | ATGAAT | chr12 | 21602125 | 21602144 | 21602128 | - |
| SEQ ID NO 20088 | ACAGTTTCTTCATGAATAAA | ATGAAT | chr12 | 21602116 | 21602135 | 21602119 | - |
| SEQ ID NO 20089 | AACAAAAGGTTTCTTAGGAG | AAGAAT | chr12 | 21602025 | 21602044 | 21602028 | - |
| SEQ ID NO 20090 | GGAGAAGAATCCCTTGCTGC | CAGAAT | chr12 | 21602009 | 21602028 | 21602012 | - |
| SEQ ID NO 20091 | GTGAAAACATAACAGATGA | GAGAGT | chr12 | 21601961 | 21601980 | 21601964 | - |
| SEQ ID NO 20092 | TGAGAGAGTCACAGTTAGTT | TTGGGT | chr12 | 21601944 | 21601963 | 21601947 | - |
| SEQ ID NO 20093 | AATCCATTTTATTATTCAGT | AAGGAT | chr12 | 21601844 | 21601863 | 21601847 | - |
| SEQ ID NO 20094 | GCACTGAGAGGCGAGGGAGA | TAGAGT | chr12 | 21601793 | 21601812 | 21601796 | - |
| SEQ ID NO 20095 | GAGGCGAGGGAGATAGAGTT | AAGAAT | chr12 | 21601786 | 21601805 | 21601789 | - |
| SEQ ID NO 20096 | AGAACTGATTCTTAATCTTC | AAGAAT | chr12 | 21601758 | 21601777 | 21601761 | - |
| SEQ ID NO 20097 | ATACAATACAGTCAAATGTG | ATGAGT | chr12 | 21601702 | 21601721 | 21601705 | - |
| SEQ ID NO 20098 | TAAGACTATACAGTGTACCG | TGGAAT | chr12 | 21601651 | 21601670 | 21601654 | - |
| SEQ ID NO 20099 | ATACAGTGTACCGTGGAATG | GGGAGT | chr12 | 21601644 | 21601663 | 21601647 | - |
| SEQ ID NO 20100 | GATGTTTGAGCTGACACTTG | AAGGAT | chr12 | 21601567 | 21601586 | 21601570 | - |
| SEQ ID NO 20101 | GCTCAGAGAGGGAAAAGGAG | AGGAGT | chr12 | 21601453 | 21601472 | 21601456 | - |
| SEQ ID NO 20102 | ACTAGATTGTGAAGCTCAGG | GGGAGT | chr12 | 21601398 | 21601417 | 21601401 | - |
| SEQ ID NO 20103 | AGGGGGAGTTAATAGCCTTA | AGGAGT | chr12 | 21601381 | 21601400 | 21601384 | - |
| SEQ ID NO 20104 | GCCTTAAGGAGTTTTGTCTC | CAGGGT | chr12 | 21601367 | 21601386 | 21601370 | - |
| SEQ ID NO 20105 | TTGTCTCCAGGGTATGAACA | ATGAAT | chr12 | 21601354 | 21601373 | 21601357 | - |

Figure 44 (Cont'd)

| | | | | | | | |
|---|---|---|---|---|---|---|---|
| SEQ ID NO 20106 | CAGGGTATGAACAATGAATG | AGGAGT | chr12 | 21601347 | 21601366 | 21601350 | - |
| SEQ ID NO 20107 | AATTAGACTGTGGTGTGACC | CAGGAT | chr12 | 21601226 | 21601245 | 21601229 | - |
| SEQ ID NO 20108 | TCTGGAGAAATTAACATGTT | AAGGAT | chr12 | 21601096 | 21601115 | 21601099 | - |
| SEQ ID NO 20109 | ATTAACATGTTAAGGATATT | TAGGAT | chr12 | 21601087 | 21601106 | 21601090 | - |
| SEQ ID NO 20110 | CACATAATGAAAGTTAATTT | AAGAAT | chr12 | 21601033 | 21601052 | 21601036 | - |
| SEQ ID NO 20111 | TCAGTCTTGACACTACACCT | CTGAAT | chr12 | 21600890 | 21600909 | 21600893 | - |
| SEQ ID NO 20112 | ATGGTACAAGTGGCACAGGG | AAGAAT | chr12 | 21600861 | 21600880 | 21600864 | - |
| SEQ ID NO 20113 | CAGGGAAGAATTCAGAAAAC | TAGAGT | chr12 | 21600846 | 21600865 | 21600849 | - |
| SEQ ID NO 20114 | TTATGGAAGAAATTATAATA | ATGAGT | chr12 | 21600812 | 21600831 | 21600815 | - |
| SEQ ID NO 20115 | TGAGTCCACTCTTCTAGGAC | AGGAGT | chr12 | 21600791 | 21600810 | 21600794 | - |
| SEQ ID NO 20116 | CTTTGATATAAGTGAACTCA | AGGAGT | chr12 | 21600751 | 21600770 | 21600754 | - |
| SEQ ID NO 20117 | TTTCTCTAGAGCAAAATGAA | AAGGAT | chr12 | 21600533 | 21600552 | 21600536 | - |
| SEQ ID NO 20118 | ACTTTTCAAGGCTGAGGTGG | GAGAAT | chr12 | 21600373 | 21600392 | 21600376 | - |
| SEQ ID NO 20119 | TGGGAGAATTGTTTGAGACC | AAGAGT | chr12 | 21600356 | 21600375 | 21600359 | - |
| SEQ ID NO 20120 | GAATTGTTTGAGACCAAGAG | TTGGAT | chr12 | 21600351 | 21600370 | 21600354 | - |
| SEQ ID NO 20121 | TACCTGAGAGGCTAAAGCAG | GAGGAT | chr12 | 21600233 | 21600252 | 21600236 | - |
| SEQ ID NO 20122 | GGCTAAAGCAGGAGGATCAA | TTGAAT | chr12 | 21600224 | 21600243 | 21600227 | - |
| SEQ ID NO 20123 | TTGCACCATTGCACTCCAGC | CGGGGT | chr12 | 21600165 | 21600184 | 21600168 | - |
| SEQ ID NO 20124 | TTGCACTCCAGCCGGGGTGA | CAGAGT | chr12 | 21600157 | 21600176 | 21600160 | - |
| SEQ ID NO 20125 | TAAAGTCAGACTGCATGATT | TGGAAT | chr12 | 21600042 | 21600061 | 21600045 | - |
| SEQ ID NO 20126 | AATTCCAACTCCACCATCAC | CTGGGT | chr12 | 21600019 | 21600038 | 21600022 | - |
| SEQ ID NO 20127 | TTGTCATACCAGCTTTCACT | TTGAAT | chr12 | 21599792 | 21599811 | 21599795 | - |
| SEQ ID NO 20128 | CATACCAGCTTTCACTTTGA | ATGAGT | chr12 | 21599788 | 21599807 | 21599791 | - |
| SEQ ID NO 20129 | CATCAATGTTACTTCAATCA | CGGGAT | chr12 | 21599708 | 21599727 | 21599711 | - |
| SEQ ID NO 20130 | ATCACGGGATGCATAGTAAT | TAGGAT | chr12 | 21599692 | 21599711 | 21599695 | - |
| SEQ ID NO 20131 | TCTTTGCCCTAATTACTGAT | GTGGAT | chr12 | 21599665 | 21599684 | 21599668 | - |
| SEQ ID NO 20132 | CAGGTGGTCTTGTTCAAAGT | GTGAGT | chr12 | 21599449 | 21599468 | 21599452 | - |
| SEQ ID NO 20133 | CAGCTGCTTTGATTTTAACT | GAGGAT | chr12 | 21599400 | 21599419 | 21599403 | - |
| SEQ ID NO 20134 | GCAACTGTGTTTTGGAACAG | GAGGGT | chr12 | 21599248 | 21599267 | 21599251 | - |
| SEQ ID NO 20135 | AGTGTTGCCAGATGACGACT | TAGAGT | chr12 | 21598966 | 21598985 | 21598969 | - |
| SEQ ID NO 20136 | AGTATTTTCTTTTTTAATGT | CAGAAT | chr12 | 21598729 | 21598748 | 21598732 | - |
| SEQ ID NO 20137 | TATACCTCAAATATGAAAAT | AGGAAT | chr12 | 21598647 | 21598666 | 21598650 | - |
| SEQ ID NO 20138 | AAAAAGGGCTAAAATGGTGT | TGGAAT | chr12 | 21598462 | 21598481 | 21598465 | - |
| SEQ ID NO 20139 | TAATGATCAAGTCAGGTATT | TGGGGT | chr12 | 21598256 | 21598275 | 21598259 | - |
| SEQ ID NO 20140 | ATGATTTATATTTGTATGG | TTGAAT | chr12 | 21597862 | 21597881 | 21597865 | - |
| SEQ ID NO 20141 | GATTCCATATCTTTGCTAAT | GTGAAT | chr12 | 21597774 | 21597793 | 21597777 | - |
| SEQ ID NO 20142 | ACCAGTATCTGTTTATTATT | CTGAAT | chr12 | 21597725 | 21597744 | 21597728 | - |
| SEQ ID NO 20143 | TTATTCTGAATTCTTTTCCT | TTGGAT | chr12 | 21597710 | 21597729 | 21597713 | - |
| SEQ ID NO 20144 | AATACCCAGTAATAAGATTG | CTGGAT | chr12 | 21597683 | 21597702 | 21597686 | - |
| SEQ ID NO 20145 | CATGCTTACCAATAGTGCCT | ACGAGT | chr12 | 21597586 | 21597605 | 21597589 | - |
| SEQ ID NO 20146 | GATTATTTGTTTTTCCACTG | TTGAGT | chr12 | 21597353 | 21597372 | 21597356 | - |
| SEQ ID NO 20147 | TTTTTCCACTGTTGAGTTGT | TTGAGT | chr12 | 21597344 | 21597363 | 21597347 | - |
| SEQ ID NO 20148 | TTAAGTCTTTAATCCATCTT | GAGAGT | chr12 | 21597058 | 21597077 | 21597061 | - |
| SEQ ID NO 20149 | CGTTTTATATGGCAATAAAT | AGGGGT | chr12 | 21597031 | 21597050 | 21597034 | - |
| SEQ ID NO 20150 | ATTTTTGCATCTATTGTACA | AGGGGT | chr12 | 21596994 | 21597013 | 21596997 | - |
| SEQ ID NO 20151 | TGCATCTATTGTACAAGGGG | TTGAGT | chr12 | 21596989 | 21597008 | 21596992 | - |
| SEQ ID NO 20152 | TGGTTGCTGTTGGTGTATAG | AAGAGT | chr12 | 21596943 | 21596962 | 21596946 | - |
| SEQ ID NO 20153 | TCTTGTATCTGGAAACTTTG | CTGAAT | chr12 | 21596897 | 21596916 | 21596900 | - |

Figure 44 (Cont'd)

| SEQ ID NO 20154 | CAGTTCTAGGAGCTTTCTGG | AGGAGT | chr12 | 21596863 | 21596882 | 21596866 | - |
| SEQ ID NO 20155 | GAGCTTTCTGGAGGAGTCTT | TAGGGT | chr12 | 21596854 | 21596873 | 21596857 | - |
| SEQ ID NO 20156 | TTGACTTCCTCTTTACTGAT | TTGAAT | chr12 | 21596787 | 21596806 | 21596790 | - |
| SEQ ID NO 20157 | CTTCCAGTACTATGTTGAAG | AGGAGT | chr12 | 21596720 | 21596739 | 21596723 | - |
| SEQ ID NO 20158 | CTATGTTGAAGAGGAGTGGT | GAGAGT | chr12 | 21596711 | 21596730 | 21596714 | - |
| SEQ ID NO 20159 | GTCTTGTTCCAGTTCTCAGA | GGGAAT | chr12 | 21596675 | 21596694 | 21596678 | - |
| SEQ ID NO 20160 | CATTCAATATTATGTTGGCT | GTGGGT | chr12 | 21596633 | 21596652 | 21596636 | - |
| SEQ ID NO 20161 | ATTTTAATCATAAATGTATG | CTGGAT | chr12 | 21596547 | 21596566 | 21596550 | - |
| SEQ ID NO 20162 | TAAATGTATGCTGGATTTTG | TTGAAT | chr12 | 21596537 | 21596556 | 21596540 | - |
| SEQ ID NO 20163 | ATGGAACCTGCTTGATCATG | GTGGAT | chr12 | 21596400 | 21596419 | 21596403 | - |
| SEQ ID NO 20164 | ATTATCTTTTTGTTATGTT | TTGAAT | chr12 | 21596376 | 21596395 | 21596379 | - |
| SEQ ID NO 20165 | TGGTTATCTAGTATTTTGTT | AAGGAT | chr12 | 21596349 | 21596368 | 21596352 | - |
| SEQ ID NO 20166 | TTGGTGTGATGCTGGCTTCA | TAGAAT | chr12 | 21596255 | 21596274 | 21596258 | - |
| SEQ ID NO 20167 | TGTGATGCTGGCTTCATAGA | ATGAAT | chr12 | 21596251 | 21596270 | 21596254 | - |
| SEQ ID NO 20168 | TTCCTTCTTTATCTGTCTTG | TAGAAT | chr12 | 21596216 | 21596235 | 21596219 | - |
| SEQ ID NO 20169 | AGATGGGGACCAATTCCTCT | TTGAAT | chr12 | 21596180 | 21596199 | 21596183 | - |
| SEQ ID NO 20170 | ATTCCTCTTTGAATGTCTAG | TAGAAT | chr12 | 21596168 | 21596187 | 21596171 | - |
| SEQ ID NO 20171 | ATGTCTAGTAGAATTCTGTT | GTGAAT | chr12 | 21596156 | 21596175 | 21596159 | - |
| SEQ ID NO 20172 | GGAGAAATTTCCACGCGCTG | TTGAAT | chr12 | 21596004 | 21596023 | 21596007 | - |
| SEQ ID NO 20173 | AATTTCCACGCGCTGTTGAA | TAGAAT | chr12 | 21595999 | 21596018 | 21596002 | - |
| SEQ ID NO 20174 | GAATGTGTGTTCTGTGGTTA | TTGGAT | chr12 | 21595977 | 21595996 | 21595980 | - |
| SEQ ID NO 20175 | AATGCCTGGCTATGCCAGGC | AGGAAT | chr12 | 21595544 | 21595563 | 21595547 | - |
| SEQ ID NO 20176 | AGACCTTCAGTTTCTCCAGT | GGGAGT | chr12 | 21595396 | 21595415 | 21595399 | - |
| SEQ ID NO 20177 | GGAGTGTGTGTTTAGGAGAG | GAGGAT | chr12 | 21595375 | 21595394 | 21595378 | - |
| SEQ ID NO 20178 | GTTGGGGCACTCACAGTATT | TGGGGT | chr12 | 21595329 | 21595348 | 21595332 | - |
| SEQ ID NO 20179 | CACAGTATTTGGGGTGTCTC | CTGGGT | chr12 | 21595318 | 21595337 | 21595321 | - |
| SEQ ID NO 20180 | GGAGCAATCTACTTCCTTCA | GAGGGT | chr12 | 21595286 | 21595305 | 21595289 | - |
| SEQ ID NO 20181 | CTACTTCCTTCAGAGGGTCT | GTGGGT | chr12 | 21595278 | 21595297 | 21595281 | - |
| SEQ ID NO 20182 | AGAGGGTCTGTGGGTCCTCT | CAGGAT | chr12 | 21595267 | 21595286 | 21595270 | - |
| SEQ ID NO 20183 | CCACATGCTGCTCTGTCCAT | CTGAGT | chr12 | 21595189 | 21595208 | 21595192 | - |
| SEQ ID NO 20184 | CGCCAAGATCCTGAGAAGTT | GGGGAT | chr12 | 21595133 | 21595152 | 21595136 | - |
| SEQ ID NO 20185 | CCAGTTTTATTCTTTTGCAC | ATGGAT | chr12 | 21595054 | 21595073 | 21595057 | - |
| SEQ ID NO 20186 | CTTTTGCACATGGATATCCA | ATGGAT | chr12 | 21595043 | 21595062 | 21595046 | - |
| SEQ ID NO 20187 | AATCTGTGGCTATAAATAT | GTGGAT | chr12 | 21594943 | 21594962 | 21594946 | - |
| SEQ ID NO 20188 | CTAGCATTGTTCTTTTTTCA | CAGGAT | chr12 | 21594798 | 21594817 | 21594801 | - |
| SEQ ID NO 20189 | CTATTTTGATAGCGGTCATA | TAGAAT | chr12 | 21594693 | 21594712 | 21594696 | - |
| SEQ ID NO 20190 | TATAGAATCTGTAGATTGCT | TTGGGT | chr12 | 21594675 | 21594694 | 21594678 | - |
| SEQ ID NO 20191 | ATTTTTCTGATCCATGAACA | TAGGAT | chr12 | 21594625 | 21594644 | 21594628 | - |
| SEQ ID NO 20192 | TATCAGTGTTTTGTAGTTTT | CCGAAT | chr12 | 21594564 | 21594583 | 21594567 | - |
| SEQ ID NO 20193 | TATTTTTAGCTATTGTAAA | TGGGAT | chr12 | 21594495 | 21594514 | 21594498 | - |
| SEQ ID NO 20194 | TTTTGTCTCCTGTAACTTTA | CTGAAT | chr12 | 21594399 | 21594418 | 21594402 | - |
| SEQ ID NO 20195 | TGAATTTATTTTCAGCGCT | AAGAGT | chr12 | 21594378 | 21594397 | 21594381 | - |
| SEQ ID NO 20196 | CAGCGCTAAGAGTGCTTTGG | TGGAGT | chr12 | 21594365 | 21594384 | 21594368 | - |
| SEQ ID NO 20197 | CTAGGACTTCCAGTATTATA | TTGAAT | chr12 | 21594226 | 21594245 | 21594229 | - |
| SEQ ID NO 20198 | CTTCCAGTATTATATTGAAT | AGGAGT | chr12 | 21594220 | 21594239 | 21594223 | - |
| SEQ ID NO 20199 | AATTCAGTATGATGTTAGCT | GTGGGT | chr12 | 21594133 | 21594152 | 21594136 | - |
| SEQ ID NO 20200 | GCAGATAGTTTTTATCATGA | AGGAAT | chr12 | 21594055 | 21594074 | 21594058 | - |
| SEQ ID NO 20201 | TGATCATGGTGTATTATCTT | TTGGAT | chr12 | 21593901 | 21593920 | 21593904 | - |

Figure 44 (Cont'd)

| SEQ ID NO | Sequence | | | | | | |
|---|---|---|---|---|---|---|---|
| SEQ ID NO 20202 | ATTATCTTTTGGATGTACTG | TTGGAT | chr12 | 21593889 | 21593908 | 21593892 | - |
| SEQ ID NO 20203 | CAGTTTGCTAGTATTTTGTT | GAGGAT | chr12 | 21593862 | 21593881 | 21593865 | - |
| SEQ ID NO 20204 | TTTCACACCTATGTTCCATC | AGGGAT | chr12 | 21593836 | 21593855 | 21593839 | - |
| SEQ ID NO 20205 | CTTGCATCCTTGTCTGGTTA | TGGAAT | chr12 | 21593787 | 21593806 | 21593790 | - |
| SEQ ID NO 20206 | TCCTTGTCTGGTTATGGAAT | CAGGAT | chr12 | 21593781 | 21593800 | 21593784 | - |
| SEQ ID NO 20207 | TCAGGATAATACTGGCCTCA | GAGAAT | chr12 | 21593762 | 21593781 | 21593765 | - |
| SEQ ID NO 20208 | GATAATACTGGCCTCAGAGA | ATGAGT | chr12 | 21593758 | 21593777 | 21593761 | - |
| SEQ ID NO 20209 | GCCTCAGAGAATGAGTTAGG | GAGAAT | chr12 | 21593748 | 21593767 | 21593751 | - |
| SEQ ID NO 20210 | CCTTCCTGTTTAATTTTTAA | AAGAAT | chr12 | 21593721 | 21593740 | 21593724 | - |
| SEQ ID NO 20211 | TTTCTTTCCTTCTGCTAGTT | TTGGGT | chr12 | 21593246 | 21593265 | 21593249 | - |
| SEQ ID NO 20212 | CTAACATATGGTGTATCCTG | GGGAAT | chr12 | 21592860 | 21592879 | 21592863 | - |
| SEQ ID NO 20213 | ATAAATATATTCTGTAGCTG | TTGGAT | chr12 | 21592816 | 21592835 | 21592819 | - |
| SEQ ID NO 20214 | GATCTATCTGATGCTGAGAT | TAGAAT | chr12 | 21592708 | 21592727 | 21592711 | - |
| SEQ ID NO 20215 | AATCCCCAACTATTATTGTA | TTGGAT | chr12 | 21592677 | 21592696 | 21592680 | - |
| SEQ ID NO 20216 | ATAACATTTGCTTTACATAT | CTGGAT | chr12 | 21592629 | 21592648 | 21592632 | - |
| SEQ ID NO 20217 | CATATCTGGATGCTCTGGTG | TTGAGT | chr12 | 21592614 | 21592633 | 21592617 | - |
| SEQ ID NO 20218 | TGGATGCTCTGGTGTTGAGT | GTGAAT | chr12 | 21592608 | 21592627 | 21592611 | - |
| SEQ ID NO 20219 | TGGTGTTGAGTGTGAATGTT | TAGAAT | chr12 | 21592599 | 21592618 | 21592602 | - |
| SEQ ID NO 20220 | AGAATTGTTATATACTCTTG | CTGAAT | chr12 | 21592578 | 21592597 | 21592581 | - |
| SEQ ID NO 20221 | TTCTTATAGGCAGCTTACAA | CTGGGT | chr12 | 21592381 | 21592400 | 21592384 | - |
| SEQ ID NO 20222 | ATTTTCTGTAGTGGTAACGT | TTGAGT | chr12 | 21592097 | 21592116 | 21592100 | - |
| SEQ ID NO 20223 | GTAAAGCCAGTCTAGTGATA | GTGAAT | chr12 | 21591957 | 21591976 | 21591960 | - |
| SEQ ID NO 20224 | ATTTTTGAAGAACAATGTTG | CTGGGT | chr12 | 21591887 | 21591906 | 21591890 | - |
| SEQ ID NO 20225 | CATTTTTTTCTTTCACTATT | TTGAAT | chr12 | 21591845 | 21591864 | 21591848 | - |
| SEQ ID NO 20226 | AGACATTTTGCTTGCTGTTT | TAGAGT | chr12 | 21591727 | 21591746 | 21591730 | - |
| SEQ ID NO 20227 | CTTTTTGCATTATATTTATTT | GGGAAT | chr12 | 21591650 | 21591669 | 21591653 | - |
| SEQ ID NO 20228 | AATTTCTGATTTTCATTTGT | CTGGAT | chr12 | 21591627 | 21591646 | 21591630 | - |
| SEQ ID NO 20229 | CCTTCTGGGAAACTGCAAAT | TTGAAT | chr12 | 21591519 | 21591538 | 21591522 | - |
| SEQ ID NO 20230 | CTGATCTATTGTTGAAGTTT | TTGAAT | chr12 | 21591364 | 21591383 | 21591367 | - |
| SEQ ID NO 20231 | TTCAATAAACTCTTCAGTTA | CAGAAT | chr12 | 21591323 | 21591342 | 21591326 | - |
| SEQ ID NO 20232 | ATTCTTGTTGTATCTATCTC | TTGGGT | chr12 | 21591284 | 21591303 | 21591287 | - |
| SEQ ID NO 20233 | GTAAATTTCTCATTCATATC | CTGAAT | chr12 | 21591260 | 21591279 | 21591263 | - |
| SEQ ID NO 20234 | GATTTCTTTTATTGTTTAT | CTGAGT | chr12 | 21591225 | 21591244 | 21591228 | - |
| SEQ ID NO 20235 | GCTTCCTTAATATCAACATT | TTGGAT | chr12 | 21591181 | 21591200 | 21591184 | - |
| SEQ ID NO 20236 | ACATTTTGGATTCTTTTTTC | CAGAAT | chr12 | 21591166 | 21591185 | 21591169 | - |
| SEQ ID NO 20237 | TCCACTGGCTTATGTTGCTG | AAGAAT | chr12 | 21591121 | 21591140 | 21591124 | - |
| SEQ ID NO 20238 | AAGATGTATCTTGGTGTTGA | TTGAGT | chr12 | 21590955 | 21590974 | 21590958 | - |
| SEQ ID NO 20239 | CTGTGATTTTTTCAGTGGCT | TAGGGT | chr12 | 21590842 | 21590861 | 21590845 | - |
| SEQ ID NO 20240 | GATGAGGTTGTGCTGGAGAC | AAGAAT | chr12 | 21590795 | 21590814 | 21590798 | - |
| SEQ ID NO 20241 | GTACATTGGCACTGATGGTA | ATGAGT | chr12 | 21590696 | 21590715 | 21590699 | - |
| SEQ ID NO 20242 | ACTGATGGTAATGAGTCTAG | TTGGGT | chr12 | 21590686 | 21590705 | 21590689 | - |
| SEQ ID NO 20243 | TTGGCCTTCAGGCAGTTTGC | TTGGGT | chr12 | 21590653 | 21590672 | 21590656 | - |
| SEQ ID NO 20244 | ATAGTAGACTGGGCTGGTGT | GTGGGT | chr12 | 21590614 | 21590633 | 21590617 | - |
| SEQ ID NO 20245 | GGTCCTCAGGCTTCTGGACA | GTGGGT | chr12 | 21590591 | 21590610 | 21590594 | - |
| SEQ ID NO 20246 | TTCTGGACAGTGGGTGTGGT | GTGGGT | chr12 | 21590580 | 21590599 | 21590583 | - |
| SEQ ID NO 20247 | GTTGGTGGTGGCTGCAAGGG | CTGAAT | chr12 | 21590499 | 21590518 | 21590502 | - |
| SEQ ID NO 20248 | GTTGTGATGGCAGTGGCAGA | TTGGGT | chr12 | 21590429 | 21590448 | 21590432 | - |
| SEQ ID NO 20249 | GCCCATCATCAGGCTTCTGG | GAGGGT | chr12 | 21590401 | 21590420 | 21590404 | - |

Figure 44 (Cont'd)

| SEQ ID NO 20250 | TTGCTTAGGTACCAGTCATG | GTGGAT | chr12 | 21590376 | 21590395 | 21590379 | - |
| SEQ ID NO 20251 | TGGATGGCACAAGGCTGTCT | CTGGGT | chr12 | 21590355 | 21590374 | 21590358 | - |
| SEQ ID NO 20252 | TTGAGGAAGGCAAAGCCAGG | CTGGGT | chr12 | 21590307 | 21590326 | 21590310 | - |
| SEQ ID NO 20253 | GGACACCGGCTATCATAGGC | TGGAGT | chr12 | 21590248 | 21590267 | 21590251 | - |
| SEQ ID NO 20254 | CCGGCTATCATAGGCTGGAG | TGGAGT | chr12 | 21590243 | 21590262 | 21590246 | - |
| SEQ ID NO 20255 | AGTGATCCTCAGGCCCCAG | CAGAAT | chr12 | 21590220 | 21590239 | 21590223 | - |
| SEQ ID NO 20256 | TCAGGCCCCAGCAGAATGC | CTGAGT | chr12 | 21590212 | 21590231 | 21590215 | - |
| SEQ ID NO 20257 | GCCCCAGCAGAATGCCTGA | GTGAAT | chr12 | 21590208 | 21590227 | 21590211 | - |
| SEQ ID NO 20258 | CATTGTTGCCCTGCTCTTGA | AGGGT | chr12 | 21590170 | 21590189 | 21590173 | - |
| SEQ ID NO 20259 | GCCCTGCTCTTGAAGGGGTG | CGGGGT | chr12 | 21590163 | 21590182 | 21590166 | - |
| SEQ ID NO 20260 | TTCAGTGGCAGCAGCTATAA | ATGGGT | chr12 | 21590129 | 21590148 | 21590132 | - |
| SEQ ID NO 20261 | CCCCAGATGGTGGCTGCAAG | TGGGT | chr12 | 21590081 | 21590100 | 21590084 | - |
| SEQ ID NO 20262 | TGTGTAGCAGCCCTGCTACT | GGGGGT | chr12 | 21590030 | 21590049 | 21590033 | - |
| SEQ ID NO 20263 | AGCCCTGCTACTGGGGGTGG | GGGAGT | chr12 | 21590022 | 21590041 | 21590025 | - |
| SEQ ID NO 20264 | GCCAGCAGTAGCACTCAGCT | GTGGGT | chr12 | 21589959 | 21589978 | 21589962 | - |
| SEQ ID NO 20265 | GTAGCACTCAGCTGTGGGTG | GGGGAT | chr12 | 21589952 | 21589971 | 21589955 | - |
| SEQ ID NO 20266 | GGGGATGTCAGCAGAGCTTC | AGGGAT | chr12 | 21589932 | 21589951 | 21589935 | - |
| SEQ ID NO 20267 | TGTAGAGATGCAGATGATGT | TGGGGT | chr12 | 21589907 | 21589926 | 21589910 | - |
| SEQ ID NO 20268 | CTGAGGAACGATGTCATCTG | GTGGGT | chr12 | 21589881 | 21589900 | 21589884 | - |
| SEQ ID NO 20269 | GCACCTTGCTGCTCAGTAAT | GGGGAT | chr12 | 21589838 | 21589857 | 21589841 | - |
| SEQ ID NO 20270 | TGCTCAGTAATGGGGATGGC | AGGGGT | chr12 | 21589829 | 21589848 | 21589832 | - |
| SEQ ID NO 20271 | TCAAGGGACTCTCCTGTGGC | TAGGAT | chr12 | 21589717 | 21589736 | 21589720 | - |
| SEQ ID NO 20272 | TCTCCTGTGGCTAGGATTCC | TGGAGT | chr12 | 21589708 | 21589727 | 21589711 | - |
| SEQ ID NO 20273 | TAATGCAGATGTGGACCACT | GGGAGT | chr12 | 21589679 | 21589698 | 21589682 | - |
| SEQ ID NO 20274 | GGAGCCTCTCTGGCCTCACA | GAGGAT | chr12 | 21589627 | 21589646 | 21589630 | - |
| SEQ ID NO 20275 | GGCCTCACAGAGGATCCCTA | CTGGGT | chr12 | 21589616 | 21589635 | 21589619 | - |
| SEQ ID NO 20276 | TGCTTCCTGTCACTTCTCTG | TTGAAT | chr12 | 21589554 | 21589573 | 21589557 | - |
| SEQ ID NO 20277 | GTCACTTCTCTGTTGAATTC | CAGAAT | chr12 | 21589546 | 21589565 | 21589549 | - |
| SEQ ID NO 20278 | TTCCAGAATTCTCTCTTATG | TGGGAT | chr12 | 21589529 | 21589548 | 21589532 | - |
| SEQ ID NO 20279 | TTTGGTTCTTTGTGGAGGAG | GTGAGT | chr12 | 21589489 | 21589508 | 21589492 | - |
| SEQ ID NO 20280 | GGACTATCTGAAGGCCTCAG | ATGAGT | chr12 | 21589340 | 21589359 | 21589343 | - |
| SEQ ID NO 20281 | TCAGATGAGTAAAAGAAGTA | GCGAAT | chr12 | 21589324 | 21589343 | 21589327 | - |
| SEQ ID NO 20282 | ATCATTTGTTTCTTCAAATA | AAGAAT | chr12 | 21589256 | 21589275 | 21589259 | - |
| SEQ ID NO 20283 | TTGCATCTACCAAAGTGTAT | ATGAAT | chr12 | 21589191 | 21589210 | 21589194 | - |
| SEQ ID NO 20284 | AAATACGTAATCTAACAAAC | AAGGAT | chr12 | 21589162 | 21589181 | 21589165 | - |
| SEQ ID NO 20285 | ACAAGGATGTTTTAAGATCT | CTGAGT | chr12 | 21589144 | 21589163 | 21589147 | - |
| SEQ ID NO 20286 | GATGCATAGTTGCAAATAAA | AGGAGT | chr12 | 21589116 | 21589135 | 21589119 | - |
| SEQ ID NO 20287 | TGCAAATAAAGGAGTTTTC | AAGGAT | chr12 | 21589106 | 21589125 | 21589109 | - |
| SEQ ID NO 20288 | TTTGGAAATTTTGCATTTTT | GTGGAT | chr12 | 21588970 | 21588989 | 21588973 | - |
| SEQ ID NO 20289 | TGATGGTTTCTAAAATTGTC | CAGAAT | chr12 | 21588812 | 21588831 | 21588815 | - |
| SEQ ID NO 20290 | ATGTTAACTTAGATTTATTG | TTGGAT | chr12 | 21588748 | 21588767 | 21588751 | - |
| SEQ ID NO 20291 | TATGAAAATTGCTTGCATTT | TGGAGT | chr12 | 21588505 | 21588524 | 21588508 | - |
| SEQ ID NO 20292 | CTCTTCTCCTTTATAAATTA | ATGAAT | chr12 | 21588471 | 21588490 | 21588474 | - |
| SEQ ID NO 20293 | CTATGTAAAGTATAAGTTAC | TGGAAT | chr12 | 21588284 | 21588303 | 21588287 | - |
| SEQ ID NO 20294 | AAACCTGTAGTCTGATGAAA | TGGAAT | chr12 | 21588229 | 21588248 | 21588232 | - |
| SEQ ID NO 20295 | AATAAAATTGCTTTTTGCAA | TTGAGT | chr12 | 21588158 | 21588177 | 21588161 | - |
| SEQ ID NO 20296 | ATTGAGTTGAAGATTGATGC | CAGGAT | chr12 | 21588139 | 21588158 | 21588142 | - |
| SEQ ID NO 20297 | TGCCAGGATCTTATTACCTC | CAGGAT | chr12 | 21588122 | 21588141 | 21588125 | - |

Figure 44 (Cont'd)

| SEQ ID NO 20298 | ATTACCTCCAGGATTTCACA | AAGGAT | chr12 | 21588110 | 21588129 | 21588113 | - |
| SEQ ID NO 20299 | AGGATTTCACAAAGGATTTC | TTGAGT | chr12 | 21588101 | 21588120 | 21588104 | - |
| SEQ ID NO 20300 | TTATAAAGACATACCTGAGA | CTGGGT | chr12 | 21587654 | 21587673 | 21587657 | - |
| SEQ ID NO 20301 | CACTATCACGAGAAGAGCAT | GAGAGT | chr12 | 21587445 | 21587464 | 21587448 | - |
| SEQ ID NO 20302 | AAATCCCTCCCACAACACGT | GAGGAT | chr12 | 21587388 | 21587407 | 21587391 | - |
| SEQ ID NO 20303 | ACTACAATTCAAGATGAGAT | TTGGGT | chr12 | 21587355 | 21587374 | 21587358 | - |
| SEQ ID NO 20304 | GGGACACAGTCAAGCTGTAT | CAGGGT | chr12 | 21587328 | 21587347 | 21587331 | - |
| SEQ ID NO 20305 | AGCTGTATCAGGGTACAAGC | TCGGGT | chr12 | 21587316 | 21587335 | 21587319 | - |
| SEQ ID NO 20306 | AGTGGACCATCACCTGAAAA | GTGAAT | chr12 | 21587247 | 21587266 | 21587250 | - |
| SEQ ID NO 20307 | CTGTGTTTGACTTTCTGTTT | CTGAGT | chr12 | 21587075 | 21587094 | 21587078 | - |
| SEQ ID NO 20308 | TGTTTCTGAGTTATTTCACT | GAGGAT | chr12 | 21587060 | 21587079 | 21587063 | - |
| SEQ ID NO 20309 | GATTTCATTCTTTTTATGG | CTGAGT | chr12 | 21586995 | 21587014 | 21586998 | - |
| SEQ ID NO 20310 | TTAATATGATCTCTTTCACT | TTGGGT | chr12 | 21586835 | 21586854 | 21586838 | - |
| SEQ ID NO 20311 | TTTGGGTCCATACCCAGTAG | TGGGAT | chr12 | 21586816 | 21586835 | 21586819 | - |
| SEQ ID NO 20312 | CATACCCAGTAGTGGGATTG | CAGGAT | chr12 | 21586808 | 21586827 | 21586811 | - |
| SEQ ID NO 20313 | CCAGTAGTGGGATTGCAGGA | TTGAAT | chr12 | 21586803 | 21586822 | 21586806 | - |
| SEQ ID NO 20314 | CCTGAGCTCACTGTATTTGT | CAGGGT | chr12 | 21586496 | 21586515 | 21586499 | - |
| SEQ ID NO 20315 | ATATAGATTTAGATATAAAA | GGGAGT | chr12 | 21586403 | 21586422 | 21586406 | - |
| SEQ ID NO 20316 | AGTCCCAAAGCTGAAGGACT | TGGAGT | chr12 | 21586296 | 21586315 | 21586299 | - |
| SEQ ID NO 20317 | GCTTGGAGGCTAAGCCAGTC | CAGGAT | chr12 | 21586224 | 21586243 | 21586227 | - |
| SEQ ID NO 20318 | AGATGGTGCCCACCCAGATT | AAGGGT | chr12 | 21586143 | 21586162 | 21586146 | - |
| SEQ ID NO 20319 | GGTGCCCACCCAGATTAAGG | GTGGGT | chr12 | 21586139 | 21586158 | 21586142 | - |
| SEQ ID NO 20320 | AATACCCTCACAGACACACT | CAGGAT | chr12 | 21586069 | 21586088 | 21586072 | - |
| SEQ ID NO 20321 | TTTTTTTTTTTTTTCCTGG | TGGAGT | chr12 | 21585556 | 21585575 | 21585559 | - |
| SEQ ID NO 20322 | CCTTTATTTGTAGTCCTGCC | TGGAAT | chr12 | 21585522 | 21585541 | 21585525 | - |
| SEQ ID NO 20323 | TAAAACTAAGAGACACCCTA | ATGGAT | chr12 | 21585454 | 21585473 | 21585457 | - |
| SEQ ID NO 20324 | ACGCTTCCTTACCTCCATTG | TGGAGT | chr12 | 21585410 | 21585429 | 21585413 | - |
| SEQ ID NO 20325 | ACTGATTTCATCTTGATAGT | CTGGGT | chr12 | 21585379 | 21585398 | 21585382 | - |
| SEQ ID NO 20326 | AATCTTAATTTGCAGTTTAA | TGGAAT | chr12 | 21585273 | 21585292 | 21585276 | - |
| SEQ ID NO 20327 | AATTTTGCTAGTGGAACACT | AGGGGT | chr12 | 21585156 | 21585175 | 21585159 | - |
| SEQ ID NO 20328 | GTGGAACACTAGGGGTGATG | GTGAGT | chr12 | 21585146 | 21585165 | 21585149 | - |
| SEQ ID NO 20329 | ACCCTTTGATTCCTGGACCC | GTGAAT | chr12 | 21585096 | 21585115 | 21585099 | - |
| SEQ ID NO 20330 | AGGCCATTCAAAAGCTGCTT | CAGGAT | chr12 | 21584943 | 21584962 | 21584946 | - |
| SEQ ID NO 20331 | AAAAGCTGCTTCAGGATGAT | AGGGAT | chr12 | 21584934 | 21584953 | 21584937 | - |
| SEQ ID NO 20332 | CACACTTCTTTAGCCATAAA | GTGAGT | chr12 | 21584867 | 21584886 | 21584870 | - |
| SEQ ID NO 20333 | TGGTCAGAAGCAATGCTGTG | TGGAAT | chr12 | 21584837 | 21584856 | 21584840 | - |
| SEQ ID NO 20334 | CTGTGTGGAATACCATGACA | GTGGAT | chr12 | 21584822 | 21584841 | 21584825 | - |
| SEQ ID NO 20335 | ATACGGCATTCTGTGATTCC | ATGGAT | chr12 | 21584798 | 21584817 | 21584801 | - |
| SEQ ID NO 20336 | TGGTAGTCTTGGCATAAGCA | TTGAGT | chr12 | 21584773 | 21584792 | 21584776 | - |
| SEQ ID NO 20337 | CTTGGCATAAGCATTGAGTT | CAGGAT | chr12 | 21584766 | 21584785 | 21584769 | - |
| SEQ ID NO 20338 | AGGATTGGGAAACCCATATC | CAGAGT | chr12 | 21584745 | 21584764 | 21584748 | - |
| SEQ ID NO 20339 | GTAGCTGGCTGATCACCCCG | AGGAAT | chr12 | 21584642 | 21584661 | 21584645 | - |
| SEQ ID NO 20340 | CTGTGGCCAGGTCAGCTTTG | GTGAGT | chr12 | 21584566 | 21584585 | 21584569 | - |
| SEQ ID NO 20341 | CAACTGTGGCCACTTTGTTC | ATGGGT | chr12 | 21584498 | 21584517 | 21584501 | - |
| SEQ ID NO 20342 | TGGGTCCATTGGACGATGAC | ATGAGT | chr12 | 21584477 | 21584496 | 21584480 | - |
| SEQ ID NO 20343 | ATGAGTGGCCTGGGAAAAGG | CTGAGT | chr12 | 21584457 | 21584476 | 21584460 | - |
| SEQ ID NO 20344 | AAAAGGCTGAGTGGTGTCCA | CAGAAT | chr12 | 21584443 | 21584462 | 21584446 | - |
| SEQ ID NO 20345 | CCCATTGGTGAGCACTCACA | TGGGAT | chr12 | 21584369 | 21584388 | 21584372 | - |

Figure 44 (Cont'd)

| SEQ ID NO 20346 | CAAACCTTTGGCTACAGCCC | ATGAAT | chr12 | 21584227 | 21584246 | 21584230 | - |
| SEQ ID NO 20347 | TCCCTTCACCGTTGTCCTTC | AGGGAT | chr12 | 21584111 | 21584130 | 21584114 | - |
| SEQ ID NO 20348 | AGTGCTGCGGCTGTCCACTT | TTGGGT | chr12 | 21584067 | 21584086 | 21584070 | - |
| SEQ ID NO 20349 | GGGAGAGAAAGCAGTGTGTC | AGGAGT | chr12 | 21583935 | 21583954 | 21583938 | - |
| SEQ ID NO 20350 | ATGTAACTTACTAGTGCCTT | CAGGAT | chr12 | 21583879 | 21583898 | 21583882 | - |
| SEQ ID NO 20351 | ACAGCCCACTTTATGGCTAG | ATGGAT | chr12 | 21583795 | 21583814 | 21583798 | - |
| SEQ ID NO 20352 | CAAGAGCTTTCTCCCTAAAA | GAGAGT | chr12 | 21583672 | 21583691 | 21583675 | - |
| SEQ ID NO 20353 | CACTGACACCTCAAGCATCA | TTGGAT | chr12 | 21583549 | 21583568 | 21583552 | - |
| SEQ ID NO 20354 | CACTCAAAACTGGCAGCCTT | TTGGAT | chr12 | 21583443 | 21583462 | 21583446 | - |
| SEQ ID NO 20355 | GGATCACTCGATAAATGGGC | CAGAGT | chr12 | 21583421 | 21583440 | 21583424 | - |
| SEQ ID NO 20356 | CAGAGTAACACACCCAAATC | AGGAAT | chr12 | 21583401 | 21583420 | 21583404 | - |
| SEQ ID NO 20357 | TGTGCCTATTTCTTGGTTGT | AAGAGT | chr12 | 21583338 | 21583357 | 21583341 | - |
| SEQ ID NO 20358 | AAATTATCCTTCACTTTAGA | AGGAAT | chr12 | 21583299 | 21583318 | 21583302 | - |
| SEQ ID NO 20359 | TTTACTGAGGTAGAAGGTCC | CTGAAT | chr12 | 21583236 | 21583255 | 21583239 | - |
| SEQ ID NO 20360 | AAGATTATGGCACAAAGCTG | GAGAGT | chr12 | 21583049 | 21583068 | 21583052 | - |
| SEQ ID NO 20361 | GCTGGAGAGTTGATATACTC | CTGAGT | chr12 | 21583033 | 21583052 | 21583036 | - |
| SEQ ID NO 20362 | TTCCTTGCCTCTCACAAGCG | TTGAAT | chr12 | 21582894 | 21582913 | 21582897 | - |
| SEQ ID NO 20363 | CCTCTCACAAGCGTTGAATC | AAGAGT | chr12 | 21582887 | 21582906 | 21582890 | - |
| SEQ ID NO 20364 | CTCTCTAAACAATTGATGCC | AAGGAT | chr12 | 21582837 | 21582856 | 21582840 | - |
| SEQ ID NO 20365 | GTTCTCCATACCATTAGAAG | AAGAGT | chr12 | 21582804 | 21582823 | 21582807 | - |
| SEQ ID NO 20366 | AAGAAGAGTCCTTAGCATAT | TTGGGT | chr12 | 21582787 | 21582806 | 21582790 | - |
| SEQ ID NO 20367 | CCTGGTACCAAAATCTGTAT | TAGGGT | chr12 | 21582676 | 21582695 | 21582679 | - |
| SEQ ID NO 20368 | ATTAGGGTTCTACAGAGAAA | CAGAAT | chr12 | 21582658 | 21582677 | 21582661 | - |
| SEQ ID NO 20369 | CTCTATATCTATATCTATAT | GAGAGT | chr12 | 21582563 | 21582582 | 21582566 | - |
| SEQ ID NO 20370 | TGAGGAACAAGGAAGCTAGT | CGGAGT | chr12 | 21582479 | 21582498 | 21582482 | - |
| SEQ ID NO 20371 | AGTCCCAAAGCTGAAGAACC | TGGAGT | chr12 | 21582456 | 21582475 | 21582459 | - |
| SEQ ID NO 20372 | GTTCAATGTTCCAGGGCAGG | AAGAAT | chr12 | 21582432 | 21582451 | 21582435 | - |
| SEQ ID NO 20373 | CATGGGAGAAAATGTAGGC | TGGGAT | chr12 | 21582402 | 21582421 | 21582405 | - |
| SEQ ID NO 20374 | AGATGGTGCCCACCCAGATT | AAGGGT | chr12 | 21582308 | 21582327 | 21582311 | - |
| SEQ ID NO 20375 | GGTGCCCACCCAGATTAAGG | GTGGGT | chr12 | 21582304 | 21582323 | 21582307 | - |
| SEQ ID NO 20376 | TGAGGTTGGTTTTTTTGTTG | TTGAGT | chr12 | 21582141 | 21582160 | 21582144 | - |
| SEQ ID NO 20377 | TACTCTCCTTAATTTTCCCC | CAGGAT | chr12 | 21581735 | 21581754 | 21581738 | - |
| SEQ ID NO 20378 | GTTTTCTAGATGTGGACTTG | CTGGAT | chr12 | 21581708 | 21581727 | 21581711 | - |
| SEQ ID NO 20379 | GTAGCAGCAATATTAGAGGA | GAGAAT | chr12 | 21581623 | 21581642 | 21581626 | - |
| SEQ ID NO 20380 | CATACAAAACCCCTCAGACA | CCGAGT | chr12 | 21581564 | 21581583 | 21581567 | - |
| SEQ ID NO 20381 | ATCTCCAACAACCAAGCTCT | CAGAGT | chr12 | 21581491 | 21581510 | 21581494 | - |
| SEQ ID NO 20382 | TTAAGGGCTTACAACTCTAA | GGGGGT | chr12 | 21581447 | 21581466 | 21581450 | - |
| SEQ ID NO 20383 | GGGCTGCATGCACTGGTCAT | CAGAAT | chr12 | 21581411 | 21581430 | 21581414 | - |
| SEQ ID NO 20384 | AGAATGGAACAGAACAGGAC | AGGGAT | chr12 | 21581390 | 21581409 | 21581393 | - |
| SEQ ID NO 20385 | CTGCTTTTCCATACAGTGTC | TGGAAT | chr12 | 21581357 | 21581376 | 21581360 | - |
| SEQ ID NO 20386 | ATAACATAACTGGCCAGGTC | AGGGGT | chr12 | 21581325 | 21581344 | 21581328 | - |
| SEQ ID NO 20387 | GGTCTATCTTTAACCAGGCC | CAGGAT | chr12 | 21581302 | 21581321 | 21581305 | - |
| SEQ ID NO 20388 | TGGTCTCAGGCTGTTTGCCT | GTGGAT | chr12 | 21581275 | 21581294 | 21581278 | - |
| SEQ ID NO 20389 | ATTGGGCATAAAACAATATG | AAGGGT | chr12 | 21581201 | 21581220 | 21581204 | - |
| SEQ ID NO 20390 | GGAAGAGAGAAATACCATGT | GAGAAT | chr12 | 21581158 | 21581177 | 21581161 | - |
| SEQ ID NO 20391 | TGAAATACGTATTTGTGTTA | TTGGAT | chr12 | 21581133 | 21581152 | 21581136 | - |
| SEQ ID NO 20392 | TGTGTTATTGGATTTGACAT | CGGGGT | chr12 | 21581120 | 21581139 | 21581123 | - |
| SEQ ID NO 20393 | TGAGGGCATGTATGATGACA | ATGGGT | chr12 | 21580887 | 21580906 | 21580890 | - |

Figure 44 (Cont'd)

| | | | | | | | |
|---|---|---|---|---|---|---|---|
| SEQ ID NO 20394 | AAGGGACTTTAAAACATGCA | CAGAAT | chr12 | 21580723 | 21580742 | 21580726 | - |
| SEQ ID NO 20395 | TAAATAAATCCTTGGGCTTA | GTGGAT | chr12 | 21580630 | 21580649 | 21580633 | - |
| SEQ ID NO 20396 | ACTTTAAACAAATTGCTAAC | CTGAAT | chr12 | 21580559 | 21580578 | 21580562 | - |
| SEQ ID NO 20397 | AAAGGCCAAAACAACAGCAG | ATGAAT | chr12 | 21580476 | 21580495 | 21580479 | - |
| SEQ ID NO 20398 | TCAGAAGAGCAGTGGACGCA | ATGAAT | chr12 | 21580363 | 21580382 | 21580366 | - |

Figure 45

| # | Sequence | PAM | Chr | Start | End | Cuts 5' of | Str |
|---|---|---|---|---|---|---|---|
| SEQ ID NO 20399 | ATGCTCAAAATATGGACCTA | TCAGAAA | chr12 | 21580429 | 21580448 | 21580445 | + |
| SEQ ID NO 20400 | AAAGAGGTCAAATACCTCAA | AAAGAAA | chr12 | 21580779 | 21580798 | 21580795 | + |
| SEQ ID NO 20401 | CATCATACATGCCCTCAGCA | GCAGAAA | chr12 | 21580890 | 21580909 | 21580906 | + |
| SEQ ID NO 20402 | CTGCTGTGGTTTTCAATTAT | GAAGAAA | chr12 | 21580986 | 21581005 | 21581002 | + |
| SEQ ID NO 20403 | TATGCCCAATTTCTGCCTCC | AAAGAAA | chr12 | 21581211 | 21581230 | 21581227 | + |
| SEQ ID NO 20404 | GAAGAAGTAAAAACTAAAAG | GCAGAAA | chr12 | 21581238 | 21581257 | 21581254 | + |
| SEQ ID NO 20405 | ATGCAGCTTGTCCTGCTACA | CTAGAAT | chr12 | 21581581 | 21581600 | 21581597 | + |
| SEQ ID NO 20406 | TGGATCCAGCAAGTCCACAT | CTAGAAA | chr12 | 21581699 | 21581718 | 21581715 | + |
| SEQ ID NO 20407 | AGCATTATGATGGCAAAAAA | TTAGAAA | chr12 | 21581774 | 21581793 | 21581790 | + |
| SEQ ID NO 20408 | AAATTAGATGTGGCCTAGGC | AAAGAAT | chr12 | 21581921 | 21581940 | 21581937 | + |
| SEQ ID NO 20409 | ACAGAGTAAACGGATAACCT | ACAGAAT | chr12 | 21582047 | 21582066 | 21582063 | + |
| SEQ ID NO 20410 | TAAACGGATAACCTACAGAA | TGAGAAA | chr12 | 21582053 | 21582072 | 21582069 | + |
| SEQ ID NO 20411 | ATGCAACAAAGGCTAATAT | ACAGAAT | chr12 | 21582099 | 21582118 | 21582115 | + |
| SEQ ID NO 20412 | CAACAAAAAAACCAACCTCA | TTAGAAA | chr12 | 21582141 | 21582160 | 21582157 | + |
| SEQ ID NO 20413 | ACAGCCAGGATATAAAGCAG | GCAGAAA | chr12 | 21582342 | 21582361 | 21582358 | + |
| SEQ ID NO 20414 | CCAGGAGTGGTTCTAGAGGA | ACAGAAT | chr12 | 21582691 | 21582710 | 21582707 | + |
| SEQ ID NO 20415 | TAATACTTTTGACTATATGT | GGAGAAT | chr12 | 21582931 | 21582950 | 21582947 | + |
| SEQ ID NO 20416 | GTTCGCTGGACAAAGTGATG | AAAGAAA | chr12 | 21582993 | 21583012 | 21583009 | + |
| SEQ ID NO 20417 | CATTTGGCCACTCTTACAAC | CAAGAAA | chr12 | 21583323 | 21583342 | 21583339 | + |
| SEQ ID NO 20418 | AGATAACTACTCTCTTTTAG | GGAGAAA | chr12 | 21583658 | 21583677 | 21583674 | + |
| SEQ ID NO 20419 | GAAGGCACTAGTAAGTTACA | TGAGAAA | chr12 | 21583878 | 21583897 | 21583894 | + |
| SEQ ID NO 20420 | GTTGTGCACTTTGCACAGAA | GGAGAAA | chr12 | 21584169 | 21584188 | 21584185 | + |
| SEQ ID NO 20421 | ATGACTGGAAAATTGATGAC | AAAGAAA | chr12 | 21584275 | 21584294 | 21584291 | + |
| SEQ ID NO 20422 | AGACTACCATCCATGGAATC | ACAGAAT | chr12 | 21584784 | 21584803 | 21584800 | + |
| SEQ ID NO 20423 | TTGCTGAGGGCAAAGGGAAT | ACAGAAT | chr12 | 21585599 | 21585618 | 21585615 | + |
| SEQ ID NO 20424 | GTGTCTGTATACACTTGTAC | TAAGAAA | chr12 | 21585739 | 21585758 | 21585755 | + |
| SEQ ID NO 20425 | GTGGCCAGGATATAAAGCAG | GCAGAAA | chr12 | 21586177 | 21586196 | 21586193 | + |
| SEQ ID NO 20426 | GTTCAACATCACTAATAATC | AGAGAAT | chr12 | 21586575 | 21586594 | 21586591 | + |
| SEQ ID NO 20427 | ATGATACCTCCTTATGCCAG | TCAGAAT | chr12 | 21586620 | 21586639 | 21586636 | + |
| SEQ ID NO 20428 | TGTTGGTGAGGATGTGGAGA | CAAGAAA | chr12 | 21586678 | 21586697 | 21586694 | + |
| SEQ ID NO 20429 | AAATGCTTATACACTGTTGG | TAAGAAT | chr12 | 21586703 | 21586722 | 21586719 | + |
| SEQ ID NO 20430 | CATGAAGATTTCTTAAAGAA | CTAGAAA | chr12 | 21586760 | 21586779 | 21586776 | + |
| SEQ ID NO 20431 | CTACCAATGGACGATTGGAT | AAAGAAA | chr12 | 21586928 | 21586947 | 21586944 | + |
| SEQ ID NO 20432 | ATATATTACTCAGCCATAAA | AAAGAAT | chr12 | 21586982 | 21587001 | 21586998 | + |
| SEQ ID NO 20433 | AGAATGAAATCATGTCTTCT | CTAGAAA | chr12 | 21587004 | 21587023 | 21587020 | + |
| SEQ ID NO 20434 | ATTATCCTCAGTGAAATAAC | TCAGAAA | chr12 | 21587051 | 21587070 | 21587067 | + |
| SEQ ID NO 20435 | CTCAGTGAAATAACTCAGAA | ACAGAAA | chr12 | 21587057 | 21587076 | 21587073 | + |
| SEQ ID NO 20436 | CGATGAGTAAGCATAGACAT | ATAGAAT | chr12 | 21587132 | 21587151 | 21587148 | + |
| SEQ ID NO 20437 | AATAATAGACACTTGAGACT | AGAGAAA | chr12 | 21587161 | 21587180 | 21587177 | + |
| SEQ ID NO 20438 | AATGGGGTAATTAAAAGGGT | GAAGAAA | chr12 | 21587790 | 21587809 | 21587806 | + |
| SEQ ID NO 20439 | CACTAAATAATAATCACATG | TGAGAAT | chr12 | 21588007 | 21588026 | 21588023 | + |
| SEQ ID NO 20440 | GCTAGAGCAAGGGGATGACT | CAAGAAA | chr12 | 21588078 | 21588097 | 21588094 | + |
| SEQ ID NO 20441 | CTACACAAGCTAATTGTCCT | TAAGAAT | chr12 | 21588530 | 21588549 | 21588546 | + |
| SEQ ID NO 20442 | TCAGATGTTATGTGATGAGG | ACAGAAT | chr12 | 21588651 | 21588670 | 21588667 | + |
| SEQ ID NO 20443 | ATAGAACACATGAGGAGGAA | GCAGAAA | chr12 | 21588676 | 21588695 | 21588692 | + |
| SEQ ID NO 20444 | TCCTCAAATTCTGGACAATT | TTAGAAA | chr12 | 21588799 | 21588818 | 21588815 | + |
| SEQ ID NO 20445 | CACAAAAATGCAAAATTTCC | AAAGAAT | chr12 | 21588967 | 21588986 | 21588983 | + |
| SEQ ID NO 20446 | CTTCATCTTCATCTTTTCCA | GGAGAAT | chr12 | 21589019 | 21589038 | 21589035 | + |

Figure 45 (Cont'd)

| SEQ ID NO 20447 | GAAATAGAGATTCTTTATTT | GAAGAAA | chr12 | 21589241 | 21589260 | 21589257 | + |
| SEQ ID NO 20448 | TGATTTGGGAAATGAAATGA | AAAGAAA | chr12 | 21589277 | 21589296 | 21589293 | + |
| SEQ ID NO 20449 | GATTATGCTCTTTCAGTCTA | TTAGAAA | chr12 | 21589389 | 21589408 | 21589405 | + |
| SEQ ID NO 20450 | ACAAAGAACCAAAATAGTAA | GTAGAAA | chr12 | 21589496 | 21589515 | 21589512 | + |
| SEQ ID NO 20451 | AGTAGAAAATCCCACATAAG | AGAGAAT | chr12 | 21589515 | 21589534 | 21589531 | + |
| SEQ ID NO 20452 | CTACACATTTATAAGCTCCC | TAAGAAA | chr12 | 21590043 | 21590062 | 21590059 | + |
| SEQ ID NO 20453 | AAGCAAACTGCCTGAAGGCC | AAAGAAT | chr12 | 21590651 | 21590670 | 21590667 | + |
| SEQ ID NO 20454 | GACTATGCTGCTGTATGCAC | CTAGAAA | chr12 | 21590904 | 21590923 | 21590920 | + |
| SEQ ID NO 20455 | ATCAACACCAAGATACATCT | TCAGAAA | chr12 | 21590954 | 21590973 | 21590970 | + |
| SEQ ID NO 20456 | CAAAATAAACATAAAAAGGT | GAAGAAA | chr12 | 21591062 | 21591081 | 21591078 | + |
| SEQ ID NO 20457 | CATTTATAAAATTCTGGAAA | AAAGAAT | chr12 | 21591150 | 21591169 | 21591166 | + |
| SEQ ID NO 20458 | AGAACTCAGATAAACAATAA | AAAGAAA | chr12 | 21591216 | 21591235 | 21591232 | + |
| SEQ ID NO 20459 | AGATAAACAATAAAAAGAAA | TCAGAAA | chr12 | 21591223 | 21591242 | 21591239 | + |
| SEQ ID NO 20460 | AAAACAATTCAGGATATGAA | TGAGAAA | chr12 | 21591248 | 21591267 | 21591264 | + |
| SEQ ID NO 20461 | TACCCAAGAGATAGATACAA | CAAGAAT | chr12 | 21591277 | 21591296 | 21591293 | + |
| SEQ ID NO 20462 | ATACAACAAGAATGAACCAA | ACAGAAA | chr12 | 21591291 | 21591310 | 21591307 | + |
| SEQ ID NO 20463 | TGTAACTGAAGAGTTTATTG | AAAGAAA | chr12 | 21591321 | 21591340 | 21591337 | + |
| SEQ ID NO 20464 | ACAATAGATCAGATCAAGCA | GAAGAAA | chr12 | 21591372 | 21591391 | 21591388 | + |
| SEQ ID NO 20465 | TAAAATTAGCTGGTCAAATG | ATAGAAA | chr12 | 21591426 | 21591445 | 21591442 | + |
| SEQ ID NO 20466 | AAATGATAGAAAGGAAAAAA | AAAGAAT | chr12 | 21591441 | 21591460 | 21591457 | + |
| SEQ ID NO 20467 | TGAAAACTTGTCAAGTCTAG | CAAGAAA | chr12 | 21591587 | 21591606 | 21591603 | + |
| SEQ ID NO 20468 | GACATCCAGACAAATGAAAA | TCAGAAA | chr12 | 21591618 | 21591637 | 21591634 | + |
| SEQ ID NO 20469 | GATTAACAGCAGATTTCTCA | GCAGAAA | chr12 | 21591781 | 21591800 | 21591797 | + |
| SEQ ID NO 20470 | ATGATATATTCAAAATAGTG | AAAGAAA | chr12 | 21591832 | 21591851 | 21591848 | + |
| SEQ ID NO 20471 | TAAATAAAATCTTTTCTGGG | CAAGAAA | chr12 | 21591913 | 21591932 | 21591929 | + |
| SEQ ID NO 20472 | CTATCACTAGACTGGCTTTA | CAAGAAA | chr12 | 21591956 | 21591975 | 21591972 | + |
| SEQ ID NO 20473 | GAGCAAAACACAAATAAGA | AGAGAAA | chr12 | 21592062 | 21592081 | 21592078 | + |
| SEQ ID NO 20474 | AGAACTCAAACGTTACCACT | ACAGAAA | chr12 | 21592088 | 21592107 | 21592104 | + |
| SEQ ID NO 20475 | CAAACCACAATCATAAATAA | TAAGAAA | chr12 | 21592120 | 21592139 | 21592136 | + |
| SEQ ID NO 20476 | CCACAATCATAAATAATAAG | AAAGAAA | chr12 | 21592124 | 21592143 | 21592140 | + |
| SEQ ID NO 20477 | AATCATAAATAATAAGAAAG | AAAGAAA | chr12 | 21592128 | 21592147 | 21592144 | + |
| SEQ ID NO 20478 | ATAAATAATAAGAAAGAAAG | AAAGAAA | chr12 | 21592132 | 21592151 | 21592148 | + |
| SEQ ID NO 20479 | ATAATAAGAAAGAAAGAAAG | AAAGAAA | chr12 | 21592136 | 21592155 | 21592152 | + |
| SEQ ID NO 20480 | AGAAAGAAAGAGAGAGAGAG | AGAGAAT | chr12 | 21592154 | 21592173 | 21592170 | + |
| SEQ ID NO 20481 | AGAGAGAGAGAGAGAGAATG | AAAGAAA | chr12 | 21592162 | 21592181 | 21592178 | + |
| SEQ ID NO 20482 | AGAGAGAGAGAGAATGAAAG | AAAGAAA | chr12 | 21592166 | 21592185 | 21592182 | + |
| SEQ ID NO 20483 | AAGAAAGAAAAGGAAGGAAG | GAAGAAA | chr12 | 21592183 | 21592202 | 21592199 | + |
| SEQ ID NO 20484 | ACCCAGTTGTAAGCTGCCTA | TAAGAAA | chr12 | 21592375 | 21592394 | 21592391 | + |
| SEQ ID NO 20485 | ATGAAAGATCTTCCATACAA | AGAGAAA | chr12 | 21592445 | 21592464 | 21592461 | + |
| SEQ ID NO 20486 | TATTAGATATAAAGGGTGAA | ATAGAAT | chr12 | 21592646 | 21592665 | 21592662 | + |
| SEQ ID NO 20487 | GCATCAGATAGATCATCTAG | ACAGAAA | chr12 | 21592714 | 21592733 | 21592730 | + |
| SEQ ID NO 20488 | CATCTAGACAGAAAATTAAC | AAAGAAA | chr12 | 21592727 | 21592746 | 21592743 | + |
| SEQ ID NO 20489 | CAATATTTCATCCAACAGCT | ACAGAAT | chr12 | 21592801 | 21592820 | 21592817 | + |
| SEQ ID NO 20490 | CAGACCACAATGGAATAAAA | CTAGAAA | chr12 | 21592937 | 21592956 | 21592953 | + |
| SEQ ID NO 20491 | ATAAAACTAGAAATCAATAA | CAAGAAA | chr12 | 21592951 | 21592970 | 21592967 | + |
| SEQ ID NO 20492 | CTGAATGAACGTTATGTCAA | GAAGAAA | chr12 | 21593023 | 21593042 | 21593039 | + |
| SEQ ID NO 20493 | TAAACACTTAAATTAAAAAC | ATAGAAA | chr12 | 21593156 | 21593175 | 21593172 | + |
| SEQ ID NO 20494 | TAATCATGTACCTCAACAAG | CTAGAAA | chr12 | 21593201 | 21593220 | 21593217 | + |
| SEQ ID NO 20495 | AACCCAAAACTAGCAGAAGG | AAAGAAA | chr12 | 21593239 | 21593258 | 21593255 | + |

Figure 45 (Cont'd)

| | | | | | | | |
|---|---|---|---|---|---|---|---|
| SEQ ID NO 20496 | ACAGAAGAACTTAATGAAAT | AGAGAAA | chr12 | 21593275 | 21593294 | 21593291 | + |
| SEQ ID NO 20497 | ATAGCTCTAGCTAGACTAAC | CAAGAAA | chr12 | 21593360 | 21593379 | 21593376 | + |
| SEQ ID NO 20498 | AAAAGAGAAGAGACTGAAAT | AAAGAAA | chr12 | 21593385 | 21593404 | 21593401 | + |
| SEQ ID NO 20499 | AGAGACTGAAATAAAGAAAA | TCAGAAA | chr12 | 21593393 | 21593412 | 21593409 | + |
| SEQ ID NO 20500 | TAAAGAAAATCAGAAATAAA | AAAGAAA | chr12 | 21593404 | 21593423 | 21593420 | + |
| SEQ ID NO 20501 | AATATATTACAACCGATACC | ACAGAAA | chr12 | 21593430 | 21593449 | 21593446 | + |
| SEQ ID NO 20502 | TTACAACCGATACCACAGAA | ATAGAAA | chr12 | 21593436 | 21593455 | 21593452 | + |
| SEQ ID NO 20503 | ACCACCTACCAAGATTGAAT | TAAGAAA | chr12 | 21593544 | 21593563 | 21593560 | + |
| SEQ ID NO 20504 | CCTACCAAGATTGAATTAAG | AAAGAAT | chr12 | 21593548 | 21593567 | 21593564 | + |
| SEQ ID NO 20505 | CAAGATTGAATTAAGAAAGA | ATAGAAA | chr12 | 21593553 | 21593572 | 21593569 | + |
| SEQ ID NO 20506 | GTAGTAAAAAGTCTCCCAAA | AAAGAAA | chr12 | 21593618 | 21593637 | 21593634 | + |
| SEQ ID NO 20507 | TCAAATTTTACCAAACTTTC | AAAGAAA | chr12 | 21593670 | 21593689 | 21593686 | + |
| SEQ ID NO 20508 | ATATGATCATCTCAATAGAT | ACAGAAA | chr12 | 21594001 | 21594020 | 21594017 | + |
| SEQ ID NO 20509 | CTAGCCACAGCTTTCAGGTC | AGAGAAA | chr12 | 21594242 | 21594261 | 21594258 | + |
| SEQ ID NO 20510 | CCACAGCTTTCAGGTCAGAG | AAAGAAA | chr12 | 21594246 | 21594265 | 21594262 | + |
| SEQ ID NO 20511 | AGCTTTCAGGTCAGAGAAAG | AAAGAAA | chr12 | 21594250 | 21594269 | 21594266 | + |
| SEQ ID NO 20512 | TTCAGGTCAGAGAAAGAAAG | AAAGAAA | chr12 | 21594254 | 21594273 | 21594270 | + |
| SEQ ID NO 20513 | CAGATGACATGATTTATAC | CTAGAAA | chr12 | 21594325 | 21594344 | 21594341 | + |
| SEQ ID NO 20514 | AAAACTACAAAACACTGATA | AAAGAAT | chr12 | 21594564 | 21594583 | 21594580 | + |
| SEQ ID NO 20515 | TGATAAAAGAATTGAAAAGG | ACAGAAA | chr12 | 21594579 | 21594598 | 21594595 | + |
| SEQ ID NO 20516 | AGATATCCTATGTTCATGGA | TCAGAAA | chr12 | 21594615 | 21594634 | 21594631 | + |
| SEQ ID NO 20517 | AAATAGCAATGTCATTTTTC | ACAGAAA | chr12 | 21594707 | 21594726 | 21594723 | + |
| SEQ ID NO 20518 | CAGACACTTAGACCAATGGA | AGAGAAT | chr12 | 21594893 | 21594912 | 21594909 | + |
| SEQ ID NO 20519 | AATGGAAGAGAATAGAGAAC | CTAGAAA | chr12 | 21594907 | 21594926 | 21594923 | + |
| SEQ ID NO 20520 | CAGATTTTCAACAAAGGTGA | CAAGAAT | chr12 | 21594957 | 21594976 | 21594973 | + |
| SEQ ID NO 20521 | TGAGGAAAGGACACAGTGTT | CAAGAAA | chr12 | 21594990 | 21595009 | 21595006 | + |
| SEQ ID NO 20522 | CCATTGGATATCCATGTGCA | AAAGAAT | chr12 | 21595039 | 21595058 | 21595055 | + |
| SEQ ID NO 20523 | CCTAAACACACACTCCCACT | GGAGAAA | chr12 | 21595379 | 21595398 | 21595395 | + |
| SEQ ID NO 20524 | TACAGGTGTAGAGGAAGCAG | TGAGAAA | chr12 | 21595477 | 21595496 | 21595493 | + |
| SEQ ID NO 20525 | AGAACAATTACTAATAGACC | TAAGAAA | chr12 | 21595792 | 21595811 | 21595808 | + |
| SEQ ID NO 20526 | GCACTAGACAGTTCATCAAG | ACAGAAA | chr12 | 21595871 | 21595890 | 21595887 | + |
| SEQ ID NO 20527 | CAGGACCAGATGGATTCACA | ACAGAAT | chr12 | 21596137 | 21596156 | 21596153 | + |
| SEQ ID NO 20528 | CAGGGAAGGACATAACCAAA | AAAGAAA | chr12 | 21596278 | 21596297 | 21596294 | + |
| SEQ ID NO 20529 | ACATGATCATCTCAATAGAT | GCAGAAA | chr12 | 21596500 | 21596519 | 21596516 | + |
| SEQ ID NO 20530 | CCAGGGCAATCAGACAAAAC | AAAGAAA | chr12 | 21596746 | 21596765 | 21596762 | + |
| SEQ ID NO 20531 | TTAAAACCCTAAAGACTCCT | CCAGAAA | chr12 | 21596843 | 21596862 | 21596859 | + |
| SEQ ID NO 20532 | TACACCAACAGCAACCAAAT | GGAGAAT | chr12 | 21596946 | 21596965 | 21596962 | + |
| SEQ ID NO 20533 | TTAAAACTATAAAACTACTA | AAAGAAA | chr12 | 21597087 | 21597106 | 21597103 | + |
| SEQ ID NO 20534 | AAGAGACAAGCTGTTGAATG | CGAGAAA | chr12 | 21597263 | 21597282 | 21597279 | + |
| SEQ ID NO 20535 | ATTTGACAAGGAATTAATCT | CCAGAAT | chr12 | 21597302 | 21597321 | 21597318 | + |
| SEQ ID NO 20536 | GAATTAATCTCCAGAATATA | TAAGAAA | chr12 | 21597312 | 21597331 | 21597328 | + |
| SEQ ID NO 20537 | GCTCAACATTACTAATCATC | AGAGAAA | chr12 | 21597443 | 21597462 | 21597459 | + |
| SEQ ID NO 20538 | GAGATATCATCTTATGCCAG | TTAGAAT | chr12 | 21597489 | 21597508 | 21597505 | + |
| SEQ ID NO 20539 | CTGGGTATTTATCCAAAGGA | AAAGAAT | chr12 | 21597694 | 21597713 | 21597710 | + |
| SEQ ID NO 20540 | TTTATCCAAAGGAAAAGAAT | TCAGAAT | chr12 | 21597701 | 21597720 | 21597717 | + |
| SEQ ID NO 20541 | GTGTCCATCAATGGATGAAT | GAAGAAA | chr12 | 21597801 | 21597820 | 21597817 | + |
| SEQ ID NO 20542 | TTAAACGAAATAAGCCAGGC | ATAGAAA | chr12 | 21597922 | 21597941 | 21597938 | + |
| SEQ ID NO 20543 | TAATATCATGTAGGTAGAGA | GTAGAAT | chr12 | 21597994 | 21598013 | 21598010 | + |
| SEQ ID NO 20544 | TGTAGGTAGAGAGTAGAATG | ACAGAAA | chr12 | 21598002 | 21598021 | 21598018 | + |

Figure 45 (Cont'd)

| | | | | | | | |
|---|---|---|---|---|---|---|---|
| SEQ ID NO 20545 | GAATGACAGAAACCAGAGGT | AGAGAAA | chr12 | 21598017 | 21598036 | 21598033 | + |
| SEQ ID NO 20546 | TTGTATATTTCAAAATAGTA | GAAGAAA | chr12 | 21598170 | 21598189 | 21598186 | + |
| SEQ ID NO 20547 | TCTTGAAATGTTCCTAACAC | ATAGAAA | chr12 | 21598199 | 21598218 | 21598215 | + |
| SEQ ID NO 20548 | AAACACGTCATATATCAATA | AAAGAAA | chr12 | 21598322 | 21598341 | 21598338 | + |
| SEQ ID NO 20549 | CAAACTTCTCTCTTAACAAG | CTAGAAT | chr12 | 21598582 | 21598601 | 21598598 | + |
| SEQ ID NO 20550 | GGTTTTATTCTGACATTAAA | AAAGAAA | chr12 | 21598717 | 21598736 | 21598733 | + |
| SEQ ID NO 20551 | AGTATCACAACTTTCACCTG | AAAGAAA | chr12 | 21598892 | 21598911 | 21598908 | + |
| SEQ ID NO 20552 | AATCACTATTTCAAAGAAGT | ATAGAAT | chr12 | 21599000 | 21599019 | 21599016 | + |
| SEQ ID NO 20553 | TATACATATTATACACATAT | GGAGAAA | chr12 | 21599135 | 21599154 | 21599151 | + |
| SEQ ID NO 20554 | TCCACATCAGTAATTAGGGC | AAAGAAA | chr12 | 21599660 | 21599679 | 21599676 | + |
| SEQ ID NO 20555 | ATTTTATGAATAAATTTTAT | AAAGAAA | chr12 | 21599831 | 21599850 | 21599847 | + |
| SEQ ID NO 20556 | TACAGGTAGATTTTATATAT | GGAGAAA | chr12 | 21599948 | 21599967 | 21599964 | + |
| SEQ ID NO 20557 | GTGAGCCTCCATGGCCAGCT | AGAGAAA | chr12 | 21600268 | 21600287 | 21600284 | + |
| SEQ ID NO 20558 | GAGAAATTTTTTAAATTTCT | GTAGAAA | chr12 | 21600289 | 21600308 | 21600305 | + |
| SEQ ID NO 20559 | TTTAAAGTGGTGGGGGGTA | GGAGAAA | chr12 | 21600438 | 21600457 | 21600454 | + |
| SEQ ID NO 20560 | GATCCTTTTCATTTTGCTCT | AGAGAAA | chr12 | 21600526 | 21600545 | 21600542 | + |
| SEQ ID NO 20561 | AAGTGTGAAGTCCTCTTCTC | AGAGAAA | chr12 | 21600663 | 21600682 | 21600679 | + |
| SEQ ID NO 20562 | TAGATATAATTTCTGAAGGT | TTAGAAA | chr12 | 21600719 | 21600738 | 21600735 | + |
| SEQ ID NO 20563 | GTTCTGAGCAAGTGTGTGCA | GAAGAAA | chr12 | 21601125 | 21601144 | 21601141 | + |
| SEQ ID NO 20564 | AGTACTTCCCACTACTGTGG | ATAGAAT | chr12 | 21601307 | 21601326 | 21601323 | + |
| SEQ ID NO 20565 | CAAACCTCTAGGTAACTAGG | TTAGAAA | chr12 | 21601609 | 21601628 | 21601625 | + |
| SEQ ID NO 20566 | ATTTGTCAATTCTTGAAGAT | TAAGAAT | chr12 | 21601744 | 21601763 | 21601760 | + |
| SEQ ID NO 20567 | AAAAAGGTTATTTTGAAGTC | TGAGAAT | chr12 | 21601907 | 21601926 | 21601923 | + |
| SEQ ID NO 20568 | GCAGCAAGGGATTCTTCTCC | TAAGAAA | chr12 | 21602009 | 21602028 | 21602025 | + |
| SEQ ID NO 20569 | TGAATACATTTCCTTGTTTG | CCAGAAA | chr12 | 21602055 | 21602074 | 21602071 | + |
| SEQ ID NO 20570 | ATAACATTCATTTTATTCAT | GAAGAAA | chr12 | 21602105 | 21602124 | 21602121 | + |
| SEQ ID NO 20571 | TCAGTTTAAGGGGTTCTTTT | TCAGAAA | chr12 | 21602139 | 21602158 | 21602155 | + |
| SEQ ID NO 20572 | GGGTTCTTTTTCAGAAAGTT | TCAGAAA | chr12 | 21602149 | 21602168 | 21602165 | + |
| SEQ ID NO 20573 | AAATTCAAATCATTAAATTT | AAAGAAA | chr12 | 21602435 | 21602454 | 21602451 | + |
| SEQ ID NO 20574 | TTCCCCTTGAAAGGGAAATG | ATAGAAA | chr12 | 21602625 | 21602644 | 21602641 | + |
| SEQ ID NO 20575 | CATTAATGTTTGTTAAATGA | TGAGAAA | chr12 | 21602835 | 21602854 | 21602851 | + |
| SEQ ID NO 20576 | TGAGCTCCTGCCCACTCTCT | AGAGAAA | chr12 | 21602977 | 21602996 | 21602993 | + |
| SEQ ID NO 20577 | TGGACTGGAAAAATTTGTGA | CTAGAAA | chr12 | 21603086 | 21603105 | 21603102 | + |
| SEQ ID NO 20578 | AGGATAAAGATCTCTGAGGA | AAAGAAT | chr12 | 21603141 | 21603160 | 21603157 | + |
| SEQ ID NO 20579 | AAGAATACAAAATAATTTAA | AAAGAAA | chr12 | 21603162 | 21603181 | 21603178 | + |
| SEQ ID NO 20580 | AAATAATTTAAAAAGAAACA | ACAGAAA | chr12 | 21603171 | 21603190 | 21603187 | + |
| SEQ ID NO 20581 | ATTCTTTCTCACTAAACTAC | AGAGAAT | chr12 | 21603251 | 21603270 | 21603267 | + |
| SEQ ID NO 20582 | ATAAGGTGAATTCTGATTTT | TCAGAAT | chr12 | 21603389 | 21603408 | 21603405 | + |
| SEQ ID NO 20583 | TCCTACATAAGCATAGCATT | GAAGAAA | chr12 | 21603910 | 21603929 | 21603926 | + |
| SEQ ID NO 20584 | AGCATTTCATATAATTACTA | ACAGAAT | chr12 | 21604039 | 21604058 | 21604055 | + |
| SEQ ID NO 20585 | GTTTAATTATACTATTTTGC | TGAGAAA | chr12 | 21604123 | 21604142 | 21604139 | + |
| SEQ ID NO 20586 | TGAAATCTTATGTGCTTCCC | ACAGAAT | chr12 | 21604736 | 21604755 | 21604752 | + |
| SEQ ID NO 20587 | ACCGTCCTCACAATACCTGC | CCAGAAA | chr12 | 21604809 | 21604828 | 21604812 | - |
| SEQ ID NO 20588 | ACAATACCTGCCCAGAAAGA | CGAGAAA | chr12 | 21604800 | 21604819 | 21604803 | - |
| SEQ ID NO 20589 | AGAAAGACGAGAAAGAGGAG | GAAGAAT | chr12 | 21604787 | 21604806 | 21604790 | - |
| SEQ ID NO 20590 | GGAGTCTCGGAGGACTGTAA | GAAGAAT | chr12 | 21604598 | 21604617 | 21604601 | - |
| SEQ ID NO 20591 | CTTGTGTATGTGTTGAAGAG | GGAGAAA | chr12 | 21604269 | 21604288 | 21604272 | - |
| SEQ ID NO 20592 | AAAATCCATATTATGACAAC | ATAGAAA | chr12 | 21604193 | 21604212 | 21604196 | - |
| SEQ ID NO 20593 | TAGTAATTATATGAAATGCT | TAAGAAT | chr12 | 21604039 | 21604058 | 21604042 | - |

Figure 45 (Cont'd)

| | | | | | | | |
|---|---|---|---|---|---|---|---|
| SEQ ID NO 20594 | GGCAAAATACTGTGCTCCTT | TCAGAAT | chr12 | 21603956 | 21603975 | 21603959 | - |
| SEQ ID NO 20595 | TTATGTAGGAATTATAAAAT | AAAGAAA | chr12 | 21603900 | 21603919 | 21603903 | - |
| SEQ ID NO 20596 | ACTATTGAAGGAACATTAGC | AAAGAAA | chr12 | 21603707 | 21603726 | 21603710 | - |
| SEQ ID NO 20597 | GCTGAGTTCCTCAAGATCTT | GAAGAAT | chr12 | 21603663 | 21603682 | 21603666 | - |
| SEQ ID NO 20598 | TAAAGGATCTGAAATAATAA | CCAGAAT | chr12 | 21603499 | 21603518 | 21603502 | - |
| SEQ ID NO 20599 | ATGGCATGCATTCTGAAAAA | TCAGAAT | chr12 | 21603405 | 21603424 | 21603408 | - |
| SEQ ID NO 20600 | TTTTGCCTATGTAGAAGTGG | ACAGAAT | chr12 | 21603312 | 21603331 | 21603315 | - |
| SEQ ID NO 20601 | TCTTATTCTCTGTAGTTTAG | TGAGAAA | chr12 | 21603262 | 21603281 | 21603265 | - |
| SEQ ID NO 20602 | ATTCTCTGTAGTTTAGTGAG | AAAGAAT | chr12 | 21603258 | 21603277 | 21603261 | - |
| SEQ ID NO 20603 | GTGAGAAAGAATCTAGGAGG | ACAGAAA | chr12 | 21603243 | 21603262 | 21603246 | - |
| SEQ ID NO 20604 | TCTAGAACAGTGCCTGGTAC | ATAGAAA | chr12 | 21602724 | 21602743 | 21602727 | - |
| SEQ ID NO 20605 | TTCACTTTTTTACTATTATG | TAAGAAT | chr12 | 21602261 | 21602280 | 21602264 | - |
| SEQ ID NO 20606 | CAAGGAAATGTATTCACATC | CAAGAAA | chr12 | 21602051 | 21602070 | 21602054 | - |
| SEQ ID NO 20607 | AAACAAAAGGTTTCTTAGGA | GAAGAAT | chr12 | 21602026 | 21602045 | 21602029 | - |
| SEQ ID NO 20608 | AGGAGAAGAATCCCTTGCTG | CCAGAAT | chr12 | 21602010 | 21602029 | 21602013 | - |
| SEQ ID NO 20609 | AGAGGCGAGGGAGATAGAGT | TAAGAAT | chr12 | 21601787 | 21601806 | 21601790 | - |
| SEQ ID NO 20610 | CAGAACTGATTCTTAATCTT | CAAGAAT | chr12 | 21601759 | 21601778 | 21601762 | - |
| SEQ ID NO 20611 | GAAGGATAAATAGCTAAAGG | GGAGAAA | chr12 | 21601548 | 21601567 | 21601551 | - |
| SEQ ID NO 20612 | CTCAGAACATTACAAACTCT | GGAGAAA | chr12 | 21601113 | 21601132 | 21601116 | - |
| SEQ ID NO 20613 | ACACATAATGAAAGTTAATT | TAAGAAT | chr12 | 21601034 | 21601053 | 21601037 | - |
| SEQ ID NO 20614 | TGCTTCCCTCTTAAAATGGA | CTAGAAA | chr12 | 21600973 | 21600992 | 21600976 | - |
| SEQ ID NO 20615 | CATGGTACAAGTGGCACAGG | GAAGAAT | chr12 | 21600862 | 21600881 | 21600865 | - |
| SEQ ID NO 20616 | CAAGTGGCACAGGGAAGAAT | TCAGAAA | chr12 | 21600855 | 21600874 | 21600858 | - |
| SEQ ID NO 20617 | CTAGAGTCAAAGTGGTTATG | GAAGAAA | chr12 | 21600827 | 21600846 | 21600830 | - |
| SEQ ID NO 20618 | CTCAAGGAGTTTCTAAACCT | TCAGAAA | chr12 | 21600735 | 21600754 | 21600738 | - |
| SEQ ID NO 20619 | CACTTTTCAAGGCTGAGGTG | GGAGAAT | chr12 | 21600374 | 21600393 | 21600377 | - |
| SEQ ID NO 20620 | CATAGGGAGACCCTGTTTCT | ACAGAAA | chr12 | 21600311 | 21600330 | 21600314 | - |
| SEQ ID NO 20621 | TAATAATGTTGTGAAAATTA | AAAGAAA | chr12 | 21599930 | 21599949 | 21599933 | - |
| SEQ ID NO 20622 | TTGCATTTTTAAACACAAAA | AGAGAAA | chr12 | 21599756 | 21599775 | 21599759 | - |
| SEQ ID NO 20623 | CTTTGATTTTAACTGAGGAT | CTAGAAA | chr12 | 21599394 | 21599413 | 21599397 | - |
| SEQ ID NO 20624 | AGAGAGAGCGAGAGAGAGGC | AGAGAAA | chr12 | 21599059 | 21599078 | 21599062 | - |
| SEQ ID NO 20625 | AAGTATTTTCTTTTTTAATG | TCAGAAT | chr12 | 21598730 | 21598749 | 21598733 | - |
| SEQ ID NO 20626 | GCTAAAATGGTGTTGGAATA | TAAGAAA | chr12 | 21598455 | 21598474 | 21598458 | - |
| SEQ ID NO 20627 | TTTGGTGTGATGCTGGCTTC | ATAGAAT | chr12 | 21596256 | 21596275 | 21596259 | - |
| SEQ ID NO 20628 | GTTCCTTCTTTATCTGTCTT | GTAGAAT | chr12 | 21596217 | 21596236 | 21596220 | - |
| SEQ ID NO 20629 | AATTCCTCTTTGAATGTCTA | GTAGAAT | chr12 | 21596169 | 21596188 | 21596172 | - |
| SEQ ID NO 20630 | CCTATCATATGGTCTACCTT | GGAGAAA | chr12 | 21596024 | 21596043 | 21596027 | - |
| SEQ ID NO 20631 | AAATTTCCACGCGCTGTTGA | ATAGAAT | chr12 | 21596000 | 21596019 | 21596003 | - |
| SEQ ID NO 20632 | TAACTCAACTCCAGGTAAGG | TCAGAAA | chr12 | 21595437 | 21595456 | 21595440 | - |
| SEQ ID NO 20633 | GCTATTTTGATAGCGGTCAT | ATAGAAT | chr12 | 21594694 | 21594713 | 21594697 | - |
| SEQ ID NO 20634 | AGCTAGTTTATTATTGGTGT | GTAGAAA | chr12 | 21594448 | 21594467 | 21594451 | - |
| SEQ ID NO 20635 | ATCAGGATAATACTGGCCTC | AGAGAAT | chr12 | 21593763 | 21593782 | 21593766 | - |
| SEQ ID NO 20636 | GGCCTCAGAGAATGAGTTAG | GGAGAAT | chr12 | 21593749 | 21593768 | 21593752 | - |
| SEQ ID NO 20637 | TCCTTCCTGTTTAATTTTTA | AAAGAAT | chr12 | 21593722 | 21593741 | 21593725 | - |
| SEQ ID NO 20638 | TCTTGGTAGGTGGTATGTGT | CCAGAAA | chr12 | 21593538 | 21593557 | 21593541 | - |
| SEQ ID NO 20639 | TGATCTATCTGATGCTGAGA | TTAGAAT | chr12 | 21592709 | 21592728 | 21592712 | - |
| SEQ ID NO 20640 | CTGGTGTTGAGTGTGAATGT | TTAGAAT | chr12 | 21592600 | 21592619 | 21592603 | - |
| SEQ ID NO 20641 | TTCCTTCAAATTTTTCTTGC | CCAGAAA | chr12 | 21591932 | 21591951 | 21591935 | - |
| SEQ ID NO 20642 | CTGGCCTGTGAGGTTTCTGC | TGAGAAA | chr12 | 21591801 | 21591820 | 21591804 | - |

Figure 45 (Cont'd)

| SEQ ID NO 20643 | TTTCAATAAACTCTTCAGTT | ACAGAAT | chr12 | 21591324 | 21591343 | 21591327 | - |
| --- | --- | --- | --- | --- | --- | --- | --- |
| SEQ ID NO 20644 | AACATTTTGGATTCTTTTTT | CCAGAAT | chr12 | 21591167 | 21591186 | 21591170 | - |
| SEQ ID NO 20645 | TTCCACTGGCTTATGTTGCT | GAAGAAT | chr12 | 21591122 | 21591141 | 21591125 | - |
| SEQ ID NO 20646 | TGATGAGGTTGTGCTGGAGA | CAAGAAT | chr12 | 21590796 | 21590815 | 21590799 | - |
| SEQ ID NO 20647 | GAGTGATCCTCAGGCCCCCA | GCAGAAT | chr12 | 21590221 | 21590240 | 21590224 | - |
| SEQ ID NO 20648 | TGTCACTTCTCTGTTGAATT | CCAGAAT | chr12 | 21589547 | 21589566 | 21589550 | - |
| SEQ ID NO 20649 | AATCATTTGTTTCTTCAAAT | AAAGAAT | chr12 | 21589257 | 21589276 | 21589260 | - |
| SEQ ID NO 20650 | CATCTAATAAATGTGTACCA | TCAGAAA | chr12 | 21589063 | 21589082 | 21589066 | - |
| SEQ ID NO 20651 | CTCCTGGAAAAGATGAAGAT | GAAGAAA | chr12 | 21589023 | 21589042 | 21589026 | - |
| SEQ ID NO 20652 | GAAAATAAGTCTACAGAAGA | GGAGAAA | chr12 | 21589000 | 21589019 | 21589003 | - |
| SEQ ID NO 20653 | TTTTTGTGGATAGTGGTTTT | GAAGAAA | chr12 | 21588955 | 21588974 | 21588958 | - |
| SEQ ID NO 20654 | AGATGTGACTCCCACACTTT | AAAGAAA | chr12 | 21588901 | 21588920 | 21588904 | - |
| SEQ ID NO 20655 | TTGATGGTTTCTAAAATTGT | CCAGAAT | chr12 | 21588813 | 21588832 | 21588816 | - |
| SEQ ID NO 20656 | AGTTACTGGAATAATACATT | TAAGAAA | chr12 | 21588270 | 21588289 | 21588273 | - |
| SEQ ID NO 20657 | AACTTACAATCATGGCAGAA | GAAGAAA | chr12 | 21587566 | 21587585 | 21587569 | - |
| SEQ ID NO 20658 | TAGTTCTGTTTCTAGTTCTT | TAAGAAA | chr12 | 21586775 | 21586794 | 21586778 | - |
| SEQ ID NO 20659 | GGCAGGAAGCATCCAGCATG | GGAGAAA | chr12 | 21586258 | 21586277 | 21586261 | - |
| SEQ ID NO 20660 | ACCCGTGAATCCTGTCTATG | GGAGAAA | chr12 | 21585080 | 21585099 | 21585083 | - |
| SEQ ID NO 20661 | GAAAAGGCTGAGTGGTGTCC | ACAGAAT | chr12 | 21584444 | 21584463 | 21584447 | - |
| SEQ ID NO 20662 | CGTTGTCCTTCAGGGATGTC | CTAGAAA | chr12 | 21584102 | 21584121 | 21584105 | - |
| SEQ ID NO 20663 | CCATCGGTGCAGTCTCAGGG | AGAGAAA | chr12 | 21583952 | 21583971 | 21583955 | - |
| SEQ ID NO 20664 | CCACTTTATGGCTAGATGGA | TCAGAAA | chr12 | 21583790 | 21583809 | 21583793 | - |
| SEQ ID NO 20665 | ATCATATTAAGCAGCCAACT | CCAGAAA | chr12 | 21582758 | 21582777 | 21582761 | - |
| SEQ ID NO 20666 | AATCTGTATTAGGGTTCTAC | AGAGAAA | chr12 | 21582665 | 21582684 | 21582668 | - |
| SEQ ID NO 20667 | TATTAGGGTTCTACAGAGAA | ACAGAAT | chr12 | 21582659 | 21582678 | 21582662 | - |
| SEQ ID NO 20668 | AGTTCAATGTTCCAGGGCAG | GAAGAAT | chr12 | 21582433 | 21582452 | 21582436 | - |
| SEQ ID NO 20669 | GGCAGGAAGAATCCAGCATG | GGAGAAA | chr12 | 21582418 | 21582437 | 21582421 | - |
| SEQ ID NO 20670 | GGTAGCAGCAATATTAGAGG | AGAGAAT | chr12 | 21581624 | 21581643 | 21581627 | - |
| SEQ ID NO 20671 | GGGGCTGCATGCACTGGTCA | TCAGAAT | chr12 | 21581412 | 21581431 | 21581415 | - |
| SEQ ID NO 20672 | TACTTCTTCTTTCTTTGGAG | GCAGAAA | chr12 | 21581227 | 21581246 | 21581230 | - |
| SEQ ID NO 20673 | TCTCCTCCCTTACTAGGAAG | AGAGAAA | chr12 | 21581173 | 21581192 | 21581176 | - |
| SEQ ID NO 20674 | AGGAAGAGAGAAATACCATG | TGAGAAT | chr12 | 21581159 | 21581178 | 21581162 | - |
| SEQ ID NO 20675 | GAAGGGACTTTAAAACATGC | ACAGAAT | chr12 | 21580724 | 21580743 | 21580727 | - |
| SEQ ID NO 20676 | AATTGCTAACCTGAATGATA | ATAGAAA | chr12 | 21580549 | 21580568 | 21580552 | - |

Figure 46

| # | Sequence | PAM | Chr | Start | End | Cuts 5' of | Str |
|---|---|---|---|---|---|---|---|
| SEQ ID NO 20677 | CCTCCAAAGAAAGAAGAAGT | AAAAAC | chr12 | 21581226 | 21581245 | 21581242 | + |
| SEQ ID NO 20678 | AATATTGCTGCTACCTCTAT | TAAAAC | chr12 | 21581629 | 21581648 | 21581645 | + |
| SEQ ID NO 20679 | ATCCAGCAAGTCCACATCTA | GAAAAC | chr12 | 21581702 | 21581721 | 21581718 | + |
| SEQ ID NO 20680 | AGAATTTATGACCAAGTCCT | CAAAAC | chr12 | 21581943 | 21581962 | 21581959 | + |
| SEQ ID NO 20681 | TCCTCAAAACTAAACACAAC | AAAAAC | chr12 | 21581959 | 21581978 | 21581975 | + |
| SEQ ID NO 20682 | AAACTAAACAACAAAAAC | AAAAAC | chr12 | 21581965 | 21581984 | 21581981 | + |
| SEQ ID NO 20683 | TACAAGGAACTCAACAACAA | AAAAAC | chr12 | 21582127 | 21582146 | 21582143 | + |
| SEQ ID NO 20684 | ATGGACCTCTATGATTAGTC | AAAAAC | chr12 | 21584322 | 21584341 | 21584338 | + |
| SEQ ID NO 20685 | TATTTCCTCCTTCTTTTGTT | AAAAAC | chr12 | 21585707 | 21585726 | 21585723 | + |
| SEQ ID NO 20686 | GGATATAAAGCAGGCAGAAA | AAAAAC | chr12 | 21586184 | 21586203 | 21586200 | + |
| SEQ ID NO 20687 | AATAATCAGAGAATGCAAAT | TAAAAC | chr12 | 21586588 | 21586607 | 21586604 | + |
| SEQ ID NO 20688 | TGGCTATCATTATAAAGTTC | AAAAAC | chr12 | 21586646 | 21586665 | 21586662 | + |
| SEQ ID NO 20689 | TAGGAGTATGGTGAGGACTG | AAAAAC | chr12 | 21587198 | 21587217 | 21587214 | + |
| SEQ ID NO 20690 | CATTTTTCACTGCTGTCTTT | CAAAAC | chr12 | 21588195 | 21588214 | 21588211 | + |
| SEQ ID NO 20691 | AAATATATCTAAGCTTTCTT | CAAAAC | chr12 | 21588934 | 21588953 | 21588950 | + |
| SEQ ID NO 20692 | TATTTACATTTTTTATCCTT | GAAAAC | chr12 | 21589086 | 21589105 | 21589102 | + |
| SEQ ID NO 20693 | TGCATCTTACTCAGAGATCT | TAAAAC | chr12 | 21589130 | 21589149 | 21589146 | + |
| SEQ ID NO 20694 | TTGGGAAATGAAATGAAAAG | AAAAAC | chr12 | 21589281 | 21589300 | 21589297 | + |
| SEQ ID NO 20695 | TCTTTCAGTCTATTAGAAAT | AAAAAC | chr12 | 21589397 | 21589416 | 21589413 | + |
| SEQ ID NO 20696 | AGAAAAAGTCTTCCCCTAC | AAAAAC | chr12 | 21590976 | 21590995 | 21590992 | + |
| SEQ ID NO 20697 | CCCCTACAAAAACAAATTTA | CAAAAC | chr12 | 21590989 | 21591008 | 21591005 | + |
| SEQ ID NO 20698 | AAACAATAAAAGAAATCAG | AAAAAC | chr12 | 21591227 | 21591246 | 21591243 | + |
| SEQ ID NO 20699 | AAGAAATACAAAATACATTC | AAAAAC | chr12 | 21591342 | 21591361 | 21591358 | + |
| SEQ ID NO 20700 | TACGTAACAACACAATAGCT | GAAAAC | chr12 | 21591568 | 21591587 | 21591584 | + |
| SEQ ID NO 20701 | AAGCCAAAGAGTAAGAACTC | TAAAAC | chr12 | 21591705 | 21591724 | 21591721 | + |
| SEQ ID NO 20702 | TATACAACTAACTGGTAGAG | CAAAAC | chr12 | 21592045 | 21592064 | 21592061 | + |
| SEQ ID NO 20703 | GAAAAGGAAGGAAGGAAGAA | AAAAAC | chr12 | 21592189 | 21592208 | 21592205 | + |
| SEQ ID NO 20704 | AAGGAAGGAAGAAAAAAACA | CAAAAC | chr12 | 21592196 | 21592215 | 21592212 | + |
| SEQ ID NO 20705 | CAAAACAAACAAACTAAAAA | AAAAAC | chr12 | 21592216 | 21592235 | 21592232 | + |
| SEQ ID NO 20706 | CAAACAAACTAAAAAAAAA | CAAAAC | chr12 | 21592221 | 21592240 | 21592237 | + |
| SEQ ID NO 20707 | ATAGACTGGCTAAATAGATT | TAAAAC | chr12 | 21592340 | 21592359 | 21592356 | + |
| SEQ ID NO 20708 | GATAAAATTGACTTTAAATA | AAAAAC | chr12 | 21592506 | 21592525 | 21592522 | + |
| SEQ ID NO 20709 | CTTCTCAGACCACAATGGAA | TAAAAC | chr12 | 21592932 | 21592951 | 21592948 | + |
| SEQ ID NO 20710 | AACTAGAAATCAATAACAAG | AAAAAC | chr12 | 21592955 | 21592974 | 21592971 | + |
| SEQ ID NO 20711 | ATCAATAACAAGAAAAACTT | TAAAAC | chr12 | 21592963 | 21592982 | 21592979 | + |
| SEQ ID NO 20712 | TATCAATAAACACTTAAATT | AAAAAC | chr12 | 21593150 | 21593169 | 21593166 | + |
| SEQ ID NO 20713 | ACAAGCTAGAAAAGCAAGAA | CAAAAC | chr12 | 21593216 | 21593235 | 21593232 | + |
| SEQ ID NO 20714 | AGAAAAGCAAGAACAAAACC | CAAAAC | chr12 | 21593223 | 21593242 | 21593239 | + |
| SEQ ID NO 20715 | AAGAACTTAATGAAATAGAG | AAAAAC | chr12 | 21593279 | 21593298 | 21593295 | + |
| SEQ ID NO 20716 | TTATGAACAACCATACACTA | AAAAAC | chr12 | 21593479 | 21593498 | 21593495 | + |
| SEQ ID NO 20717 | GATTGAATTAAGAAAGAATA | GAAAAC | chr12 | 21593556 | 21593575 | 21593572 | + |
| SEQ ID NO 20718 | AATTTTACCAAACTTTCAAA | GAAAAC | chr12 | 21593673 | 21593692 | 21593689 | + |
| SEQ ID NO 20719 | GACAAGGATGCAAGTAAAAA | TAAAAC | chr12 | 21593793 | 21593812 | 21593809 | + |
| SEQ ID NO 20720 | ATCACATCAACAAAAAGAAC | AAAAAC | chr12 | 21593974 | 21593993 | 21593990 | + |
| SEQ ID NO 20721 | ATTTAACATTCCTTCATGAT | AAAAAC | chr12 | 21594042 | 21594061 | 21594058 | + |
| SEQ ID NO 20722 | TGACATGATTTTATACCTAG | AAAAAC | chr12 | 21594329 | 21594348 | 21594345 | + |
| SEQ ID NO 20723 | TAAATTTAACCAAGGAACCG | AAAAAC | chr12 | 21594528 | 21594547 | 21594544 | + |

Figure 46 (Cont'd)

| | | | | | | | |
|---|---|---|---|---|---|---|---|
| SEQ ID NO 20724 | AACCGAAAAACCTCTATTCG | GAAAAC | chr12 | 21594543 | 21594562 | 21594559 | + |
| SEQ ID NO 20725 | AACCTCTATTCGGAAAACTA | CAAAAC | chr12 | 21594551 | 21594570 | 21594567 | + |
| SEQ ID NO 20726 | GTCATTTTTCACAGAAATGG | AAAAAC | chr12 | 21594717 | 21594736 | 21594733 | + |
| SEQ ID NO 20727 | GATATCCATGTGCAAAAGAA | TAAAAC | chr12 | 21595045 | 21595064 | 21595061 | + |
| SEQ ID NO 20728 | GGCCACCAAAAGTGAGTAGG | CAAAAC | chr12 | 21595637 | 21595656 | 21595653 | + |
| SEQ ID NO 20729 | CTATGAAGCCAGCATCACAC | CAAAAC | chr12 | 21596252 | 21596271 | 21596268 | + |
| SEQ ID NO 20730 | GGAAGGACATAACCAAAAAA | GAAAAC | chr12 | 21596281 | 21596300 | 21596297 | + |
| SEQ ID NO 20731 | TACACCACATAAACAGATTT | AAAAAC | chr12 | 21596467 | 21596486 | 21596483 | + |
| SEQ ID NO 20732 | TCCTAGCCAGGGCAATCAGA | CAAAAC | chr12 | 21596740 | 21596759 | 21596756 | + |
| SEQ ID NO 20733 | ATGATATGATCATTTACCTT | TAAAAC | chr12 | 21596824 | 21596843 | 21596840 | + |
| SEQ ID NO 20734 | AACCCTATTTATTGCCATA | TAAAAC | chr12 | 21597024 | 21597043 | 21597040 | + |
| SEQ ID NO 20735 | ATGGATTAAAGACTTAAATA | TAAAAC | chr12 | 21597061 | 21597080 | 21597077 | + |
| SEQ ID NO 20736 | AAAGACTTAAATATAAAACT | TAAAAC | chr12 | 21597068 | 21597087 | 21597084 | + |
| SEQ ID NO 20737 | AAATATAAAACTTAAAACTA | TAAAAC | chr12 | 21597076 | 21597095 | 21597092 | + |
| SEQ ID NO 20738 | AAACTATAAAACTACTAAAA | GAAAAC | chr12 | 21597090 | 21597109 | 21597106 | + |
| SEQ ID NO 20739 | CTCAAACAACTCAACAGTGG | AAAAAC | chr12 | 21597339 | 21597358 | 21597355 | + |
| SEQ ID NO 20740 | ATCATCAGAGAAATGCAAAT | CAAAAC | chr12 | 21597457 | 21597476 | 21597473 | + |
| SEQ ID NO 20741 | AAATTAGTATAGCCACTATG | GAAAAC | chr12 | 21597607 | 21597626 | 21597623 | + |
| SEQ ID NO 20742 | AAAGTAGGGTGATTATAGTT | AAAAAC | chr12 | 21598138 | 21598157 | 21598154 | + |
| SEQ ID NO 20743 | ACATATAACAATGAGGTGGT | TAAAAC | chr12 | 21598936 | 21598955 | 21598952 | + |
| SEQ ID NO 20744 | CTAATCTCACCCTCCTGTTC | CAAAAC | chr12 | 21599234 | 21599253 | 21599250 | + |
| SEQ ID NO 20745 | AGGAGAAAAGAGGAAGAAC | AAAAAC | chr12 | 21600457 | 21600476 | 21600473 | + |
| SEQ ID NO 20746 | CTCTAGAGAAAAGCCATTTG | GAAAAC | chr12 | 21600542 | 21600561 | 21600558 | + |
| SEQ ID NO 20747 | GGAAAACTTCTGTGTTAACA | AAAAAC | chr12 | 21600561 | 21600580 | 21600577 | + |
| SEQ ID NO 20748 | AGCAATACGTTGGCTTAGGC | AAAAAC | chr12 | 21600934 | 21600953 | 21600950 | + |
| SEQ ID NO 20749 | ATTTTTCCCCCACATTTGGG | CAAAAC | chr12 | 21601189 | 21601208 | 21601205 | + |
| SEQ ID NO 20750 | ACTGGTAACAGTGCTTCTTC | CAAAAC | chr12 | 21601267 | 21601286 | 21601283 | + |
| SEQ ID NO 20751 | CATTGTTCATACCCTGGAGA | CAAAAC | chr12 | 21601351 | 21601370 | 21601367 | + |
| SEQ ID NO 20752 | GAAGTCTGAGAATTAGTACC | CAAAAC | chr12 | 21601921 | 21601940 | 21601937 | + |
| SEQ ID NO 20753 | ATACATTTCCTTGTTTGCCA | GAAAAC | chr12 | 21602058 | 21602077 | 21602074 | + |
| SEQ ID NO 20754 | ATCTATAGGACATTTCCTTT | GAAAAC | chr12 | 21602211 | 21602230 | 21602227 | + |
| SEQ ID NO 20755 | CATTGTGGGGACCTCTCCAC | AAAAAC | chr12 | 21602592 | 21602611 | 21602608 | + |
| SEQ ID NO 20756 | TAAAGGCAGCTTAGGGGTTG | AAAAAC | chr12 | 21602660 | 21602679 | 21602676 | + |
| SEQ ID NO 20757 | GCTCCTGCCCACTCTCTAGA | GAAAAC | chr12 | 21602980 | 21602999 | 21602996 | + |
| SEQ ID NO 20758 | CAGGAACTTTGGGCATATTT | AAAAAC | chr12 | 21603060 | 21603079 | 21603076 | + |
| SEQ ID NO 20759 | GTGACTAGAAAAAGGACATT | AAAAAC | chr12 | 21603102 | 21603121 | 21603118 | + |
| SEQ ID NO 20760 | ATCTTGAGGAACTCAGCCTT | CAAAAC | chr12 | 21603666 | 21603685 | 21603682 | + |
| SEQ ID NO 20761 | CTTTTGAGAAGCTCCTGAAT | TAAAAC | chr12 | 21603975 | 21603994 | 21603991 | + |
| SEQ ID NO 20762 | TATTTTGCTGAGAAAAATTT | TAAAAC | chr12 | 21604135 | 21604154 | 21604151 | + |
| SEQ ID NO 20763 | AATAAAGAAAATCAAATTGA | TAAAAC | chr12 | 21603883 | 21603902 | 21603886 | - |
| SEQ ID NO 20764 | TAAAGACATCTGTAAAATTA | TAAAAC | chr12 | 21603775 | 21603794 | 21603778 | - |
| SEQ ID NO 20765 | GGACATAGCTTATTGGTGGA | TAAAAC | chr12 | 21602956 | 21602975 | 21602959 | - |
| SEQ ID NO 20766 | ATTATGTAAGAATTAAATAT | TAAAAC | chr12 | 21602247 | 21602266 | 21602250 | - |
| SEQ ID NO 20767 | GGAAATGTATTCACATCCAA | GAAAAC | chr12 | 21602048 | 21602067 | 21602051 | - |
| SEQ ID NO 20768 | CCATGAACAATGGAAACGTG | AAAAAC | chr12 | 21601978 | 21601997 | 21601981 | - |
| SEQ ID NO 20769 | TAGTTACCTAGAGGTTTGGG | AAAAAC | chr12 | 21601607 | 21601626 | 21601610 | - |
| SEQ ID NO 20770 | GTGGCACAGGGAAGAATTCA | GAAAAC | chr12 | 21600852 | 21600871 | 21600855 | - |
| SEQ ID NO 20771 | GTGAAACACACGATCTATGT | AAAAAC | chr12 | 21599592 | 21599611 | 21599595 | - |

Figure 46 (Cont'd)

| | | | | | | | |
|---|---|---|---|---|---|---|---|
| SEQ ID NO 20772 | TTCAATGACCTACGCTGTGG | TAAAAC | chr12 | 21598776 | 21598795 | 21598779 | - |
| SEQ ID NO 20773 | TTTCTTTTTTAATGTCAGAA | TAAAAC | chr12 | 21598724 | 21598743 | 21598727 | - |
| SEQ ID NO 20774 | AAATGTGCTTTATAAATAGT | AAAAAC | chr12 | 21598557 | 21598576 | 21598560 | - |
| SEQ ID NO 20775 | AAGTGTGCTATATAAACAGT | AAAAAC | chr12 | 21598512 | 21598531 | 21598515 | - |
| SEQ ID NO 20776 | TCAAGGATAAAAAATGTAAA | TAAAAC | chr12 | 21589088 | 21589107 | 21589091 | - |
| SEQ ID NO 20777 | AACTTCTTTTTGATACAGTA | AAAAAC | chr12 | 21588580 | 21588599 | 21588583 | - |
| SEQ ID NO 20778 | TTAAGAAATATAGTAGCTAT | TAAAAC | chr12 | 21588251 | 21588270 | 21588254 | - |
| SEQ ID NO 20779 | GACTGGGTAATTTATAAGGA | AAAAAC | chr12 | 21587636 | 21587655 | 21587639 | - |
| SEQ ID NO 20780 | AAAGGGGGAAAAGCCGCTTA | TAAAAC | chr12 | 21587491 | 21587510 | 21587494 | - |
| SEQ ID NO 20781 | CATAATTATGCCTAACATAC | TAAAAC | chr12 | 21585910 | 21585929 | 21585913 | - |
| SEQ ID NO 20782 | ACCTTAATTCCAGGACATGG | TAAAAC | chr12 | 21585474 | 21585493 | 21585477 | - |
| SEQ ID NO 20783 | CTTCTGTTCTGGACTCCACT | CAAAAC | chr12 | 21583459 | 21583478 | 21583462 | - |
| SEQ ID NO 20784 | GCAGCCAACTCCAGAAACCC | CAAAAC | chr12 | 21582748 | 21582767 | 21582751 | - |
| SEQ ID NO 20785 | CTCACATGTTCACAAGGTCC | CAAAAC | chr12 | 21582520 | 21582539 | 21582523 | - |
| SEQ ID NO 20786 | GTAGCAGGACAAGCTGCATA | CAAAAC | chr12 | 21581580 | 21581599 | 21581583 | - |
| SEQ ID NO 20787 | TTGGAGGCAGAAATTGGGCA | TAAAAC | chr12 | 21581213 | 21581232 | 21581216 | - |
| SEQ ID NO 20788 | TAGGAGATTTCTTCATAATT | GAAAAC | chr12 | 21581000 | 21581019 | 21581003 | - |
| SEQ ID NO 20789 | CATGCACCTAGAAGGGACTT | TAAAAC | chr12 | 21580734 | 21580753 | 21580737 | - |
| SEQ ID NO 20790 | ACTGTGATTCAGACAAAGGC | CAAAAC | chr12 | 21580490 | 21580509 | 21580493 | - |

Figure 47

| # | Sequence | PAM | Chr | Start | End | Cuts 5' of | Str |
|---|---|---|---|---|---|---|---|
| SEQ ID NO 20791 | TTCTCTCCCCATTCATCTGC | TGTTGTTT | chr12 | 21580460 | 21580479 | 21580476 | + |
| SEQ ID NO 20792 | CCTCCAACTGTTAAAAGGAA | AAAAGTTT | chr12 | 21580517 | 21580536 | 21580533 | + |
| SEQ ID NO 20793 | TATTATCATTCAGGTTAGCA | ATTTGTTT | chr12 | 21580546 | 21580565 | 21580562 | + |
| SEQ ID NO 20794 | TAATAAGGGATGGAAATGAG | TTCAGATT | chr12 | 21580578 | 21580597 | 21580594 | + |
| SEQ ID NO 20795 | CATTTAGGATCCACTAAGCC | CAAGGATT | chr12 | 21580616 | 21580635 | 21580632 | + |
| SEQ ID NO 20796 | AAGGGACACCAACGAATGGT | TACTGCTT | chr12 | 21580683 | 21580702 | 21580699 | + |
| SEQ ID NO 20797 | ACTGCTTTGTTCAATTCTGT | GCATGTTT | chr12 | 21580704 | 21580723 | 21580720 | + |
| SEQ ID NO 20798 | TATGTTCAAATAACAGCTGC | TGTGGTTT | chr12 | 21580970 | 21580989 | 21580986 | + |
| SEQ ID NO 20799 | AGTACCTTTTGATAAGGAGA | ACGTGCTT | chr12 | 21581057 | 21581076 | 21581073 | + |
| SEQ ID NO 20800 | TGCTTATAGATGTTCATAGA | AGATGCTT | chr12 | 21581080 | 21581099 | 21581096 | + |
| SEQ ID NO 20801 | AGGGAGGAGACCACCCTTCA | TATTGTTT | chr12 | 21581183 | 21581202 | 21581199 | + |
| SEQ ID NO 20802 | ACCTGGCCAGTTATGTTATC | TATAGATT | chr12 | 21581326 | 21581345 | 21581342 | + |
| SEQ ID NO 20803 | GGACAGGAATTGCTCACTCT | GAGAGCTT | chr12 | 21581470 | 21581489 | 21581486 | + |
| SEQ ID NO 20804 | CTTCTTTAACTCGGTGTCTG | AGGGGTTT | chr12 | 21581550 | 21581569 | 21581566 | + |
| SEQ ID NO 20805 | GGTGTCTGAGGGGTTTTGTA | TGCAGCTT | chr12 | 21581562 | 21581581 | 21581578 | + |
| SEQ ID NO 20806 | AATTAAGGAGAGTATGAAAA | GGATGTTT | chr12 | 21581741 | 21581760 | 21581757 | + |
| SEQ ID NO 20807 | CAAATGGGGGTAAAATAATA | TTTAGTTT | chr12 | 21581861 | 21581880 | 21581877 | + |
| SEQ ID NO 20808 | AGGGAAAGACAGGCTCTAAA | AGAGGATT | chr12 | 21581891 | 21581910 | 21581907 | + |
| SEQ ID NO 20809 | AATGGGACTTAATTAAACTA | AAATGCTT | chr12 | 21581996 | 21582015 | 21582012 | + |
| SEQ ID NO 20810 | ATGGTTAATACTGAGTGTCA | ACTTGATT | chr12 | 21582177 | 21582196 | 21582193 | + |
| SEQ ID NO 20811 | GTCTGTGAGGGTGTTACCAA | AGGAGATT | chr12 | 21582239 | 21582258 | 21582255 | + |
| SEQ ID NO 20812 | AGGCAGAAAAATGTGAAAAG | GCTAGATT | chr12 | 21582360 | 21582379 | 21582376 | + |
| SEQ ID NO 20813 | GAAAAATGTGAAAAGGCTAG | ATTGGCTT | chr12 | 21582365 | 21582384 | 21582381 | + |
| SEQ ID NO 20814 | AGCCTACATTTTTCTCCCAT | GCTGGATT | chr12 | 21582401 | 21582420 | 21582417 | + |
| SEQ ID NO 20815 | GAACATTGAACTCCAGGTTC | TTCAGCTT | chr12 | 21582441 | 21582460 | 21582457 | + |
| SEQ ID NO 20816 | TCTTCAGCTTTGGGACTCCG | ACTAGCTT | chr12 | 21582459 | 21582478 | 21582475 | + |
| SEQ ID NO 20817 | TGTTCCTCAGCTGGCAGATG | GCCTGTTT | chr12 | 21582490 | 21582509 | 21582506 | + |
| SEQ ID NO 20818 | AGATATATATCTCCTATTAA | TTCTGTTT | chr12 | 21582633 | 21582652 | 21582649 | + |
| SEQ ID NO 20819 | GTTTCTCTGTAGAACCCTAA | TACAGATT | chr12 | 21582657 | 21582676 | 21582673 | + |
| SEQ ID NO 20820 | ATTAAGGATGGAGTTCTTTC | ATTGGTTT | chr12 | 21582718 | 21582737 | 21582734 | + |
| SEQ ID NO 20821 | TGGAGTTCTTTCATTGGTTT | TGGGGTTT | chr12 | 21582726 | 21582745 | 21582742 | + |
| SEQ ID NO 20822 | GTTTGGGGTTTCTGGAGTT | GGCTGCTT | chr12 | 21582742 | 21582761 | 21582758 | + |
| SEQ ID NO 20823 | TTTCTGGAGTTGGCTGCTTA | ATATGATT | chr12 | 21582751 | 21582770 | 21582767 | + |
| SEQ ID NO 20824 | CACTGATAATCCTTGGCATC | AATTGTTT | chr12 | 21582823 | 21582842 | 21582839 | + |
| SEQ ID NO 20825 | AAAATAAATGCATTTGACAC | TCTTGATT | chr12 | 21582863 | 21582882 | 21582879 | + |
| SEQ ID NO 20826 | TGCATTTGACACTCTTGATT | CAACGCTT | chr12 | 21582871 | 21582890 | 21582887 | + |
| SEQ ID NO 20827 | GGAACATAGTGAAGTTGGTT | GGTTGCTT | chr12 | 21582961 | 21582980 | 21582977 | + |
| SEQ ID NO 20828 | ACTCAGGAGTATATCAACTC | TCCAGCTT | chr12 | 21583027 | 21583046 | 21583043 | + |
| SEQ ID NO 20829 | GAGCAAGAAGTAGCAAACAC | ACTGGATT | chr12 | 21583153 | 21583172 | 21583169 | + |
| SEQ ID NO 20830 | GGACAGAGGATGGGAAATAA | ATCTGATT | chr12 | 21583200 | 21583219 | 21583216 | + |
| SEQ ID NO 20831 | AGTAAAATTTATAGGGGTCC | AATGGTTT | chr12 | 21583250 | 21583269 | 21583266 | + |
| SEQ ID NO 20832 | CACAACGCCTAGTGGGCCTA | TTTGGATT | chr12 | 21583354 | 21583373 | 21583370 | + |
| SEQ ID NO 20833 | GGATTTTGGAGGCAACATAT | TCCTGATT | chr12 | 21583377 | 21583396 | 21583393 | + |
| SEQ ID NO 20834 | ATCGAGTGATCCAAAAGGCT | GCCAGTTT | chr12 | 21583429 | 21583448 | 21583445 | + |
| SEQ ID NO 20835 | ATATGACCTAGCAGATCCAA | TGATGCTT | chr12 | 21583529 | 21583548 | 21583545 | + |
| SEQ ID NO 20836 | GTGTCAGTGCCAGATAGGGA | TGCTGTTT | chr12 | 21583560 | 21583579 | 21583576 | + |
| SEQ ID NO 20837 | CTGAATCACAGCGGAGGCCT | CTAGGATT | chr12 | 21583603 | 21583622 | 21583619 | + |
| SEQ ID NO 20838 | AGAAAGCTCTTGGCCTGTTA | CTGGGCTT | chr12 | 21583680 | 21583699 | 21583696 | + |

Figure 47 (Cont'd)

| SEQ ID NO 20839 | TGAACTGCCTATCATGAACT | GGGTGCTT | chr12 | 21583757 | 21583776 | 21583773 | + |
| SEQ ID NO 20840 | AGCAAATGGAAGTGGTATAT | ATGCGATT | chr12 | 21583833 | 21583852 | 21583849 | + |
| SEQ ID NO 20841 | TGGAAGTGGTATATATGCGA | TTGGGCTT | chr12 | 21583839 | 21583858 | 21583855 | + |
| SEQ ID NO 20842 | CATGGTCTCCACTCCTGACA | CACTGCTT | chr12 | 21583919 | 21583938 | 21583935 | + |
| SEQ ID NO 20843 | TTTGCACAGAAGGAGAAATG | GCCAGATT | chr12 | 21584178 | 21584197 | 21584194 | + |
| SEQ ID NO 20844 | AGAAGGAGAAATGGCCAGAT | TTGCGATT | chr12 | 21584185 | 21584204 | 21584201 | + |
| SEQ ID NO 20845 | CTTATTCATGGGCTGTAGCC | AAAGGTTT | chr12 | 21584218 | 21584237 | 21584234 | + |
| SEQ ID NO 20846 | AGAGGTATGTGGATGGACCT | CTATGATT | chr12 | 21584310 | 21584329 | 21584326 | + |
| SEQ ID NO 20847 | CAATGGGTGACCTCAGCAGA | AGAGGATT | chr12 | 21584382 | 21584401 | 21584398 | + |
| SEQ ID NO 20848 | CACAGTTGCAGGGATGGAAG | TTATGCTT | chr12 | 21584510 | 21584529 | 21584526 | + |
| SEQ ID NO 20849 | AAAGCTGACCTGGCCACAGC | CACTGCTT | chr12 | 21584567 | 21584586 | 21584583 | + |
| SEQ ID NO 20850 | CAGCCAGCTACCTGGTGGCA | GGTTGATT | chr12 | 21584651 | 21584670 | 21584667 | + |
| SEQ ID NO 20851 | TCTTCCATCATGGAAAGGGC | AGAGGCTT | chr12 | 21584689 | 21584708 | 21584705 | + |
| SEQ ID NO 20852 | AATAGACACTTACTCTGGAT | ATGGGTTT | chr12 | 21584728 | 21584747 | 21584744 | + |
| SEQ ID NO 20853 | GGGTTTCCCAATCCTGAACT | CAATGCTT | chr12 | 21584750 | 21584769 | 21584766 | + |
| SEQ ID NO 20854 | TGTCATGGTATTCCACACAG | CATTGCTT | chr12 | 21584822 | 21584841 | 21584838 | + |
| SEQ ID NO 20855 | CATGATCCCTATCATCCTGA | AGCAGCTT | chr12 | 21584924 | 21584943 | 21584940 | + |
| SEQ ID NO 20856 | TTTTGAATGGCCTTTTGAAG | TCACGATT | chr12 | 21584950 | 21584969 | 21584966 | + |
| SEQ ID NO 20857 | AATCAGTGTCCAATATATGG | TACTGTTT | chr12 | 21585048 | 21585067 | 21585064 | + |
| SEQ ID NO 20858 | TGGTACTGTTTCTCCCATAG | ACAGGATT | chr12 | 21585065 | 21585084 | 21585081 | + |
| SEQ ID NO 20859 | TAGTGTTCCACTAGCAAAAT | TTTTGCTT | chr12 | 21585155 | 21585174 | 21585171 | + |
| SEQ ID NO 20860 | TTCCCATGGCATTATGTTCT | GCTGGCTT | chr12 | 21585187 | 21585206 | 21585203 | + |
| SEQ ID NO 20861 | ACTGCCGCCAGGTGACACAA | TAATGATT | chr12 | 21585242 | 21585261 | 21585258 | + |
| SEQ ID NO 20862 | TGATTCCATTAAACTGCAAA | TTAAGATT | chr12 | 21585265 | 21585284 | 21585281 | + |
| SEQ ID NO 20863 | GAGAGTTACAGTGTTGGCTG | CGGTGATT | chr12 | 21585344 | 21585363 | 21585360 | + |
| SEQ ID NO 20864 | GGAGATCCATTAGGGTGTCT | CTTAGTTT | chr12 | 21585444 | 21585463 | 21585460 | + |
| SEQ ID NO 20865 | TTCCAGGCAGGACTACAAAT | AAAGGTTT | chr12 | 21585517 | 21585536 | 21585533 | + |
| SEQ ID NO 20866 | AAAAAAGACAAGACCTGCTG | AGGTGCTT | chr12 | 21585573 | 21585592 | 21585589 | + |
| SEQ ID NO 20867 | TTTTCCTTTATCATGTGAC | ATAAGATT | chr12 | 21585785 | 21585804 | 21585801 | + |
| SEQ ID NO 20868 | ATATCAGCATTTAAGTATTG | TTAAGTTT | chr12 | 21585823 | 21585842 | 21585839 | + |
| SEQ ID NO 20869 | TTATGTAATAGCATTTGCAA | TGGGGATT | chr12 | 21585849 | 21585868 | 21585865 | + |
| SEQ ID NO 20870 | GCATTTCAATTGCACGAAG | GATAGTTT | chr12 | 21585880 | 21585899 | 21585896 | + |
| SEQ ID NO 20871 | ATGGTTAATACTGAGTGTCA | ACTTGATT | chr12 | 21586012 | 21586031 | 21586028 | + |
| SEQ ID NO 20872 | TAATACTGAGTGTCAACTTG | ATTGGATT | chr12 | 21586017 | 21586036 | 21586033 | + |
| SEQ ID NO 20873 | GTCTGTGAGGGTATTGCCAA | AGGAGATT | chr12 | 21586074 | 21586093 | 21586090 | + |
| SEQ ID NO 20874 | AAAACATGTGAAAATCCTGG | ACTGGCTT | chr12 | 21586205 | 21586224 | 21586221 | + |
| SEQ ID NO 20875 | CTACATCTTTCTCCCATGCT | GGATGCTT | chr12 | 21586244 | 21586263 | 21586260 | + |
| SEQ ID NO 20876 | AAACATTGGACTCCAAGTCC | TTCAGCTT | chr12 | 21586281 | 21586300 | 21586297 | + |
| SEQ ID NO 20877 | CCTTCAGCTTTGGGACTTGG | ACTGGCTT | chr12 | 21586299 | 21586318 | 21586315 | + |
| SEQ ID NO 20878 | TTGGACTGGCTTCCTTGCTC | CTCTGCTT | chr12 | 21586315 | 21586334 | 21586331 | + |
| SEQ ID NO 20879 | AGATGGCCTATTGTGGGACC | TTGTGATT | chr12 | 21586345 | 21586364 | 21586361 | + |
| SEQ ID NO 20880 | GTGAGGATGTGGAGACAAGA | AAATGCTT | chr12 | 21586683 | 21586702 | 21586699 | + |
| SEQ ID NO 20881 | AAACTTTATGGAAGACAGCA | TGAAGATT | chr12 | 21586742 | 21586761 | 21586758 | + |
| SEQ ID NO 20882 | CAACCTAAATGTCTACCAAT | GGACGATT | chr12 | 21586916 | 21586935 | 21586932 | + |
| SEQ ID NO 20883 | TATGGTGAGGACTGAAAAAC | TACGGATT | chr12 | 21587204 | 21587223 | 21587220 | + |
| SEQ ID NO 20884 | AACATACATATGTAAGGAAC | CCGAGCTT | chr12 | 21587292 | 21587311 | 21587308 | + |
| SEQ ID NO 20885 | AACCCGAGCTTGTACCCTGA | TACAGCTT | chr12 | 21587309 | 21587328 | 21587325 | + |
| SEQ ID NO 20886 | ATAATCCTCACGTGTTGTGG | GAGGGATT | chr12 | 21587379 | 21587398 | 21587395 | + |
| SEQ ID NO 20887 | AGTGAGTTCTTACAAGATCT | GATGGTTT | chr12 | 21587461 | 21587480 | 21587477 | + |

Figure 47 (Cont'd)

| SEQ ID NO 20888 | CAAGATCTGATGGTTTTATA | AGCGGCTT | chr12 | 21587473 | 21587492 | 21587489 | + |
| SEQ ID NO 20889 | TTATAAGCGGCTTTTCCCCC | TTTTGCTT | chr12 | 21587488 | 21587507 | 21587504 | + |
| SEQ ID NO 20890 | CTGCTGCCATGTGAAGAAGG | ACATGTTT | chr12 | 21587530 | 21587549 | 21587546 | + |
| SEQ ID NO 20891 | TGCCATGTGAAGAAGGACAT | GTTTGTTT | chr12 | 21587534 | 21587553 | 21587550 | + |
| SEQ ID NO 20892 | CATGTTTGTTTCTTCTTCTG | CCATGATT | chr12 | 21587551 | 21587570 | 21587567 | + |
| SEQ ID NO 20893 | TTTCTTCTTCTGCCATGATT | GTAAGTTT | chr12 | 21587559 | 21587578 | 21587575 | + |
| SEQ ID NO 20894 | TGTGGAACTGTGAGACAATT | AAACGTTT | chr12 | 21587606 | 21587625 | 21587622 | + |
| SEQ ID NO 20895 | AAAAATATAAAATAAATTAG | ATCTGATT | chr12 | 21587727 | 21587746 | 21587743 | + |
| SEQ ID NO 20896 | GAGTGTGCAAGGAAAGAGTA | ATAGGATT | chr12 | 21587892 | 21587911 | 21587908 | + |
| SEQ ID NO 20897 | GTGAGAATACACAAATAATC | TGTCGATT | chr12 | 21588026 | 21588045 | 21588042 | + |
| SEQ ID NO 20898 | ATATTCCATTTCATCAGACT | ACAGGTTT | chr12 | 21588221 | 21588240 | 21588237 | + |
| SEQ ID NO 20899 | GATGCTATTATATGGTACCA | ATAGGATT | chr12 | 21588440 | 21588459 | 21588456 | + |
| SEQ ID NO 20900 | TAAGAATTTCATCTTTAAGG | AAAAGTTT | chr12 | 21588550 | 21588569 | 21588566 | + |
| SEQ ID NO 20901 | AGTTTTTTACTGTATCAAAA | AGAAGTTT | chr12 | 21588573 | 21588592 | 21588589 | + |
| SEQ ID NO 20902 | TCTAGACTGGACAAGAACAG | ACATGATT | chr12 | 21588705 | 21588724 | 21588721 | + |
| SEQ ID NO 20903 | AGCAACATATTTAAATATAT | CTAAGCTT | chr12 | 21588922 | 21588941 | 21588938 | + |
| SEQ ID NO 20904 | CTTTTCCAGGAGAATATACC | ATAAGTTT | chr12 | 21589031 | 21589050 | 21589047 | + |
| SEQ ID NO 20905 | TCTGATGGTACACATTTATT | AGATGTTT | chr12 | 21589058 | 21589077 | 21589074 | + |
| SEQ ID NO 20906 | ACTCAGAGATCTTAAAACAT | CCTTGTTT | chr12 | 21589138 | 21589157 | 21589154 | + |
| SEQ ID NO 20907 | ATCTTAAAACATCCTTGTTT | GTTAGATT | chr12 | 21589146 | 21589165 | 21589162 | + |
| SEQ ID NO 20908 | TGAAGAACATAAGGGGGAAA | TAGAGATT | chr12 | 21589225 | 21589244 | 21589241 | + |
| SEQ ID NO 20909 | GATTCTTTATTTGAAGAAAC | AAATGATT | chr12 | 21589249 | 21589268 | 21589265 | + |
| SEQ ID NO 20910 | TTTATTTGAAGAAACAAATG | ATTTGATT | chr12 | 21589254 | 21589273 | 21589270 | + |
| SEQ ID NO 20911 | TAGTCCCCATATAGCCTTA | GAGTGTTT | chr12 | 21589354 | 21589373 | 21589370 | + |
| SEQ ID NO 20912 | ATAGCCTTAGAGTGTTTAAA | ATATGATT | chr12 | 21589365 | 21589384 | 21589381 | + |
| SEQ ID NO 20913 | GTCTATTAGAAATAAAAACA | TAAAGCTT | chr12 | 21589404 | 21589423 | 21589420 | + |
| SEQ ID NO 20914 | GCTTAAAAAATTTCAAGGGA | AGGGCTT | chr12 | 21589428 | 21589447 | 21589444 | + |
| SEQ ID NO 20915 | AAATTTCAAGGGAAGGGGCT | TGAAGATT | chr12 | 21589435 | 21589454 | 21589451 | + |
| SEQ ID NO 20916 | CTGAGGTCAGGAACACCCAG | CCTGGCTT | chr12 | 21590287 | 21590306 | 21590303 | + |
| SEQ ID NO 20917 | CCACCACCAACACCAGTGCA | GACTGCTT | chr12 | 21590508 | 21590527 | 21590524 | + |
| SEQ ID NO 20918 | AAACAGAAATTCTGTAACTG | AAGAGTTT | chr12 | 21591309 | 21591328 | 21591325 | + |
| SEQ ID NO 20919 | AGTGAACAAATATTCAAATT | TGCAGTTT | chr12 | 21591502 | 21591521 | 21591518 | + |
| SEQ ID NO 20920 | TCACTTATAAGGGAACTTCC | ACAAGATT | chr12 | 21591749 | 21591768 | 21591765 | + |
| SEQ ID NO 20921 | AAGGGAACTTCCACAAGATT | AACAGATT | chr12 | 21591757 | 21591776 | 21591773 | + |
| SEQ ID NO 20922 | CACAAGATTAACAGATTAAC | AGCAGATT | chr12 | 21591768 | 21591787 | 21591784 | + |
| SEQ ID NO 20923 | AAGGAATTCACTATCACTAG | ACTGGCTT | chr12 | 21591946 | 21591965 | 21591962 | + |
| SEQ ID NO 20924 | CAATAATAGCCTTGCATGTA | AATGGATT | chr12 | 21592293 | 21592312 | 21592309 | + |
| SEQ ID NO 20925 | TGAAAGATATAGACTGGCTA | AATAGATT | chr12 | 21592332 | 21592351 | 21592348 | + |
| SEQ ID NO 20926 | GAATCCAATACAATAATAGT | TGGGATT | chr12 | 21592669 | 21592688 | 21592685 | + |
| SEQ ID NO 20927 | CAGAAAATTAACAAAGAAAC | ATTGGATT | chr12 | 21592735 | 21592754 | 21592751 | + |
| SEQ ID NO 20928 | AGCAAAAGCAGTGCTAAGAG | AGAAGCTT | chr12 | 21593123 | 21593142 | 21593139 | + |
| SEQ ID NO 20929 | ACACTTAAATTAAAAACATA | GAAAGATT | chr12 | 21593159 | 21593178 | 21593175 | + |
| SEQ ID NO 20930 | AAATAGAGAAAAACAACAAC | AAGGGATT | chr12 | 21593291 | 21593310 | 21593307 | + |
| SEQ ID NO 20931 | AACCGATACCACAGAAATAG | AAAAGATT | chr12 | 21593440 | 21593459 | 21593456 | + |
| SEQ ID NO 20932 | TTCTGGACACATACCACCTA | CCAAGATT | chr12 | 21593532 | 21593551 | 21593548 | + |
| SEQ ID NO 20933 | AAAAGAAAATTTCAAGACCA | GATGGCTT | chr12 | 21593637 | 21593656 | 21593653 | + |
| SEQ ID NO 20934 | ATTCTCTGAGGCCAGTATTA | TCCTGATT | chr12 | 21593756 | 21593775 | 21593772 | + |
| SEQ ID NO 20935 | AGATAATACACCATGATCAA | GTGGGATT | chr12 | 21593902 | 21593921 | 21593918 | + |
| SEQ ID NO 20936 | ATAATACTGGAAGTCCTAGC | CACAGCTT | chr12 | 21594227 | 21594246 | 21594243 | + |

Figure 47 (Cont'd)

| | | | | | | | |
|---|---|---|---|---|---|---|---|
| SEQ ID NO 20937 | ACTGTCCATCTTTCCAGATG | ACATGATT | chr12 | 21594311 | 21594330 | 21594327 | + |
| SEQ ID NO 20938 | AAATCAGCATATGAAACAAG | CAATGTTT | chr12 | 21594416 | 21594435 | 21594432 | + |
| SEQ ID NO 20939 | CCATACTACCCAAAGCAATC | TACAGATT | chr12 | 21594662 | 21594681 | 21594678 | + |
| SEQ ID NO 20940 | AATGCTAGAGGTATCATACT | ACCTGATT | chr12 | 21594810 | 21594829 | 21594826 | + |
| SEQ ID NO 20941 | GCATCCACATATTTATAGCC | AACAGATT | chr12 | 21594935 | 21594954 | 21594951 | + |
| SEQ ID NO 20942 | GAATAAAACTGGACTGCTGA | TATGGTTT | chr12 | 21595062 | 21595081 | 21595078 | + |
| SEQ ID NO 20943 | CTGGACTGCTGATATGGTTT | GGATGTTT | chr12 | 21595070 | 21595089 | 21595086 | + |
| SEQ ID NO 20944 | CTTGGCGGATGGGAGGTAGG | CCTAGATT | chr12 | 21595146 | 21595165 | 21595162 | + |
| SEQ ID NO 20945 | CCCACAGACCCTCTGAAGGA | AGTAGATT | chr12 | 21595273 | 21595292 | 21595289 | + |
| SEQ ID NO 20946 | TCCCACTGGAGAAACTGAAG | GTCTGTTT | chr12 | 21595392 | 21595411 | 21595408 | + |
| SEQ ID NO 20947 | ACTGAAGGTCTGTTTGTGGG | AGAAGTTT | chr12 | 21595405 | 21595424 | 21595421 | + |
| SEQ ID NO 20948 | CAGAAAGTCAACAAAAAAAT | AATGGATT | chr12 | 21595892 | 21595911 | 21595908 | + |
| SEQ ID NO 20949 | TAACAGACCAATAACAAGCA | GTGAGATT | chr12 | 21596071 | 21596090 | 21596087 | + |
| SEQ ID NO 20950 | CAAAAAAAGTTCAGGACCA | GATGGATT | chr12 | 21596125 | 21596144 | 21596141 | + |
| SEQ ID NO 20951 | TTCCATGCCAGGGATGCAGG | GTTGGTTT | chr12 | 21596414 | 21596433 | 21596430 | + |
| SEQ ID NO 20952 | TAAGTGTGATACACCACATA | AACAGATT | chr12 | 21596458 | 21596477 | 21596474 | + |
| SEQ ID NO 20953 | CAACAAAATCCAGCATACAT | TTATGATT | chr12 | 21596534 | 21596553 | 21596550 | + |
| SEQ ID NO 20954 | TAAAGAGGAAGTCAAACTGT | CACTGTTT | chr12 | 21596792 | 21596811 | 21596808 | + |
| SEQ ID NO 20955 | GAACTGATAAAATAATTCAG | CAAAGTTT | chr12 | 21596877 | 21596896 | 21596893 | + |
| SEQ ID NO 20956 | CATATAAAACGTACTCTCAA | GATGGATT | chr12 | 21597040 | 21597059 | 21597056 | + |
| SEQ ID NO 20957 | ATAAGGGAGACACTTCAAGA | CATGGCTT | chr12 | 21597116 | 21597135 | 21597132 | + |
| SEQ ID NO 20958 | CTTCAAGACATGGCTTTGGG | CAAAGATT | chr12 | 21597128 | 21597147 | 21597144 | + |
| SEQ ID NO 20959 | TCTTATGCCAGTTAGAATCA | TCATGATT | chr12 | 21597498 | 21597517 | 21597514 | + |
| SEQ ID NO 20960 | AGCCACTATGGAAAACAATA | TGTAGATT | chr12 | 21597617 | 21597636 | 21597633 | + |
| SEQ ID NO 20961 | ATAAACAGATACTGGTACCA | CACTGTTT | chr12 | 21597729 | 21597748 | 21597745 | + |
| SEQ ID NO 20962 | GTACCACTGTTTATTGCA | GCACGATT | chr12 | 21597743 | 21597762 | 21597759 | + |
| SEQ ID NO 20963 | TGATGTTCAATAGCAAAGTA | GGGTGATT | chr12 | 21598124 | 21598143 | 21598140 | + |
| SEQ ID NO 20964 | TCGATCTCATATTGGTTGAG | GCCTGATT | chr12 | 21598350 | 21598369 | 21598366 | + |
| SEQ ID NO 20965 | CCCTGTACTGTCTTGCTGTG | AGGAGCTT | chr12 | 21598408 | 21598427 | 21598424 | + |
| SEQ ID NO 20966 | TGTCCTCCCCATATTTTTAC | CTCGGTTT | chr12 | 21598482 | 21598501 | 21598498 | + |
| SEQ ID NO 20967 | CATATTTTTACCTCGGTTTT | TACTGTTT | chr12 | 21598491 | 21598510 | 21598507 | + |
| SEQ ID NO 20968 | TTATATAGCACACTTTGTGC | TATAGTTT | chr12 | 21598517 | 21598536 | 21598533 | + |
| SEQ ID NO 20969 | CACTTTGTGCTATAGTTTAC | CTCAGTTT | chr12 | 21598527 | 21598546 | 21598543 | + |
| SEQ ID NO 20970 | CATATTTGAGGTATAAACCA | AGGAGATT | chr12 | 21598652 | 21598671 | 21598668 | + |
| SEQ ID NO 20971 | TATTTTTAAATCTGCAAATA | AATGGTTT | chr12 | 21598694 | 21598713 | 21598710 | + |
| SEQ ID NO 20972 | ACTTAATATCATTAATGAAT | GATCGTTT | chr12 | 21598746 | 21598765 | 21598762 | + |
| SEQ ID NO 20973 | TTCCTGGAACAACATGGGGG | CTATGTTT | chr12 | 21598851 | 21598870 | 21598867 | + |
| SEQ ID NO 20974 | GAGAAATTTCACTATTTTGT | ATATGCTT | chr12 | 21599156 | 21599175 | 21599172 | + |
| SEQ ID NO 20975 | AGGCAGCAGGTCTGGTAGGA | AGGAGATT | chr12 | 21599311 | 21599330 | 21599327 | + |
| SEQ ID NO 20976 | TGAAAAGGAAGTGAGTAGAC | TAGTGCTT | chr12 | 21599532 | 21599551 | 21599548 | + |
| SEQ ID NO 20977 | CTTGAAGCTGTGCAACCAAG | CATAGTTT | chr12 | 21599562 | 21599581 | 21599578 | + |
| SEQ ID NO 20978 | GCATAGTTTTACATAGATC | GTGTGTTT | chr12 | 21599581 | 21599600 | 21599597 | + |
| SEQ ID NO 20979 | TGTGTTTCACATGGTGTGAT | AACAGCTT | chr12 | 21599602 | 21599621 | 21599618 | + |
| SEQ ID NO 20980 | AGATGCCATTGACATGGCCC | ACCGGCTT | chr12 | 21599631 | 21599650 | 21599647 | + |
| SEQ ID NO 20981 | AATCCTAATTACTATGCATC | CCGTGATT | chr12 | 21599685 | 21599704 | 21599701 | + |
| SEQ ID NO 20982 | TTTTCCTATTATTTCTCTTT | TTGTGTTT | chr12 | 21599738 | 21599757 | 21599754 | + |
| SEQ ID NO 20983 | GAAATAAGCTAATACCTACA | GAGTGTTT | chr12 | 21599854 | 21599873 | 21599870 | + |
| SEQ ID NO 20984 | TAAATGCTAGGCACAGTTCT | GAGTGATT | chr12 | 21599884 | 21599903 | 21599900 | + |
| SEQ ID NO 20985 | ATTTTCACAACATTATTACA | GGTAGATT | chr12 | 21599932 | 21599951 | 21599948 | + |

Figure 47 (Cont'd)

| SEQ ID NO 20986 | AGCAACAAATTGATGGATCT | TTTTGCTT | chr12 | 21600096 | 21600115 | 21600112 | + |
| SEQ ID NO 20987 | AAATTGATGGATCTTTTTGC | TTTTGCTT | chr12 | 21600102 | 21600121 | 21600118 | + |
| SEQ ID NO 20988 | TGATGGATCTTTTTGCTTTT | GCTTGTTT | chr12 | 21600106 | 21600125 | 21600122 | + |
| SEQ ID NO 20989 | GGATCTTTTTGCTTTTGCTT | GTTTGTTT | chr12 | 21600110 | 21600129 | 21600126 | + |
| SEQ ID NO 20990 | ACTGAAGCCTCACTAGAACG | CCTGGATT | chr12 | 21600193 | 21600212 | 21600209 | + |
| SEQ ID NO 20991 | CGCCTGGATTCAATTGATCC | TCCTGCTT | chr12 | 21600211 | 21600230 | 21600227 | + |
| SEQ ID NO 20992 | CACCTCAGCCTTGAAAAGTG | TTGAGATT | chr12 | 21600374 | 21600393 | 21600390 | + |
| SEQ ID NO 20993 | AATTTTTAGATATAATTTCT | GAAGGTTT | chr12 | 21600713 | 21600732 | 21600729 | + |
| SEQ ID NO 20994 | TCTTCCATAACCACTTTGAC | TCTAGTTT | chr12 | 21600822 | 21600841 | 21600838 | + |
| SEQ ID NO 20995 | TAAATTATGTCCAGCAATAC | GTTGGCTT | chr12 | 21600922 | 21600941 | 21600938 | + |
| SEQ ID NO 20996 | CGTTGGCTTAGGCAAAAACA | AATTGTTT | chr12 | 21600941 | 21600960 | 21600957 | + |
| SEQ ID NO 20997 | CCTTAACATGTTAATTTCTC | CAGAGTTT | chr12 | 21601092 | 21601111 | 21601108 | + |
| SEQ ID NO 20998 | TGAGCAAGTGTGTGCAGAAG | AAATGATT | chr12 | 21601129 | 21601148 | 21601145 | + |
| SEQ ID NO 20999 | TCCTCTCCCTCAACTGGTAA | CAGTGCTT | chr12 | 21601255 | 21601274 | 21601271 | + |
| SEQ ID NO 21000 | CTTAAGGCTATTAACTCCCC | CTGAGCTT | chr12 | 21601379 | 21601398 | 21601395 | + |
| SEQ ID NO 21001 | ATATATAGTTCTCTCACATA | GAACGCTT | chr12 | 21601515 | 21601534 | 21601531 | + |
| SEQ ID NO 21002 | CTCAAACATCTCATCATTAG | AGAGGTTT | chr12 | 21601577 | 21601596 | 21601593 | + |
| SEQ ID NO 21003 | TCTACAAATTTGTCAATTCT | TGAAGATT | chr12 | 21601737 | 21601756 | 21601753 | + |
| SEQ ID NO 21004 | GAATCCTTACTGAATAATAA | AATGGATT | chr12 | 21601836 | 21601855 | 21601852 | + |
| SEQ ID NO 21005 | AACTGTGACTCTCTCATCTG | TTATGTTT | chr12 | 21601948 | 21601967 | 21601964 | + |
| SEQ ID NO 21006 | TCTCTCATCTGTTATGTTTT | TCACGTTT | chr12 | 21601957 | 21601976 | 21601973 | + |
| SEQ ID NO 21007 | ATGGGCAAAATTCTGGCAGC | AAGGGATT | chr12 | 21601994 | 21602013 | 21602010 | + |
| SEQ ID NO 21008 | GATTCTTCTCCTAAGAAACC | TTTTGTTT | chr12 | 21602018 | 21602037 | 21602034 | + |
| SEQ ID NO 21009 | TCTTGGATGTGAATACATTT | CCTTGTTT | chr12 | 21602046 | 21602065 | 21602062 | + |
| SEQ ID NO 21010 | TATTCATGAAGAAACTGTTA | TTCAGTTT | chr12 | 21602118 | 21602137 | 21602134 | + |
| SEQ ID NO 21011 | GTTTAAGGGGTTCTTTTTCA | GAAAGTTT | chr12 | 21602142 | 21602161 | 21602158 | + |
| SEQ ID NO 21012 | AGGACATTTCCTTTGAAAAC | TGAGGTTT | chr12 | 21602217 | 21602236 | 21602233 | + |
| SEQ ID NO 21013 | ATCCTGGTCCTAACTCTGCC | ATTTGCTT | chr12 | 21602302 | 21602321 | 21602318 | + |
| SEQ ID NO 21014 | TTGCTCTATGAACTGGAGGA | GTGGGATT | chr12 | 21602357 | 21602376 | 21602373 | + |
| SEQ ID NO 21015 | GATAGAAAATAAGTATTAAA | GGCAGCTT | chr12 | 21602644 | 21602663 | 21602660 | + |
| SEQ ID NO 21016 | CCTGAGATCAACACACATGC | TACTGATT | chr12 | 21602745 | 21602764 | 21602761 | + |
| SEQ ID NO 21017 | TTATAAGATCCATAAAATAA | CTTAGTTT | chr12 | 21602771 | 21602790 | 21602787 | + |
| SEQ ID NO 21018 | CCCAGGTAACAGTGCTCCAT | TAATGTTT | chr12 | 21602818 | 21602837 | 21602834 | + |
| SEQ ID NO 21019 | ACTTGTGCAGAGATCTTCTG | GACTGATT | chr12 | 21602898 | 21602917 | 21602914 | + |
| SEQ ID NO 21020 | CCCAGTGCTAACAAGTCCCT | TCCAGTTT | chr12 | 21602926 | 21602945 | 21602942 | + |
| SEQ ID NO 21021 | CTTTTATTTCAAGGCATACT | CCGGGATT | chr12 | 21603005 | 21603024 | 21603021 | + |
| SEQ ID NO 21022 | AATACTTCACTTCTCTGTAA | TAAGGTTT | chr12 | 21603211 | 21603230 | 21603227 | + |
| SEQ ID NO 21023 | TGTAATAAGGTTTCTGTCCT | CCTAGATT | chr12 | 21603226 | 21603245 | 21603242 | + |
| SEQ ID NO 21024 | CTAAACTACAGAGAATAAGA | CCGTGCTT | chr12 | 21603262 | 21603281 | 21603278 | + |
| SEQ ID NO 21025 | TAGGCAAAATTGACTTTTAA | TTTTGATT | chr12 | 21603323 | 21603342 | 21603339 | + |
| SEQ ID NO 21026 | AACAGTTAGTATAAGGTGAA | TTCTGATT | chr12 | 21603379 | 21603398 | 21603395 | + |
| SEQ ID NO 21027 | CATATATAATGCATTTAATT | TTGAGATT | chr12 | 21603422 | 21603441 | 21603438 | + |
| SEQ ID NO 21028 | TAATTTTGAGATTATGCTGG | CTCTGATT | chr12 | 21603437 | 21603456 | 21603453 | + |
| SEQ ID NO 21029 | CTGGTTATTATTTCAGATCC | TTTAGATT | chr12 | 21603495 | 21603514 | 21603511 | + |
| SEQ ID NO 21030 | CAACACATGACATAATTTCA | GATCGTTT | chr12 | 21603580 | 21603599 | 21603596 | + |
| SEQ ID NO 21031 | TGCCATTTACCCAGCAATCA | GTTGGCTT | chr12 | 21603627 | 21603646 | 21603643 | + |
| SEQ ID NO 21032 | ATTTACCCAGCAATCAGTTG | GCTTGATT | chr12 | 21603631 | 21603650 | 21603647 | + |
| SEQ ID NO 21033 | GAGAGTATAAACCCACAAGG | AATTGTTT | chr12 | 21603745 | 21603764 | 21603761 | + |
| SEQ ID NO 21034 | GAGGTTATACCTCACTCGCA | AATTGTTT | chr12 | 21603853 | 21603872 | 21603869 | + |

Figure 47 (Cont'd)

| | | | | | | | |
|---|---|---|---|---|---|---|---|
| SEQ ID NO 21035 | ACTCGCAAATTGTTTTATCA | ATTTGATT | chr12 | 21603866 | 21603885 | 21603882 | + |
| SEQ ID NO 21036 | TTACTAACAGAATGTAGAGT | TGAGGTTT | chr12 | 21604053 | 21604072 | 21604069 | + |
| SEQ ID NO 21037 | ATATACATCTTCCTAAAATA | AAATGTTT | chr12 | 21604099 | 21604118 | 21604115 | + |
| SEQ ID NO 21038 | TTATTTCTATGTTGTCATAA | TATGGATT | chr12 | 21604183 | 21604202 | 21604199 | + |
| SEQ ID NO 21039 | AAATGTAGCCTAAATATATA | TTCCGTTT | chr12 | 21604323 | 21604342 | 21604339 | + |
| SEQ ID NO 21040 | CCTAAATATATATTCCGTTT | AAATGCTT | chr12 | 21604331 | 21604350 | 21604347 | + |
| SEQ ID NO 21041 | CCTCCGAGACTCCTTTGAAT | TCCTGTTT | chr12 | 21604605 | 21604624 | 21604621 | + |
| SEQ ID NO 21042 | AGTTAGAGTTGGTAGAGTTA | CCAGGCTT | chr12 | 21604676 | 21604695 | 21604692 | + |
| SEQ ID NO 21043 | TGGTAGAGTTACCAGGCTTT | GGTAGCTT | chr12 | 21604685 | 21604704 | 21604701 | + |
| SEQ ID NO 21044 | AACTAGTAGCATGAAATCTT | ATGTGCTT | chr12 | 21604725 | 21604744 | 21604741 | + |
| SEQ ID NO 21045 | AGGAATTCTGTGGGAAGCAC | ATAAGATT | chr12 | 21604747 | 21604766 | 21604750 | - |
| SEQ ID NO 21046 | AGCACATAAGATTTCATGCT | ACTAGTTT | chr12 | 21604732 | 21604751 | 21604735 | - |
| SEQ ID NO 21047 | TGCCTGTAAGTTCTCTTCTC | CTGGGATT | chr12 | 21604652 | 21604671 | 21604655 | - |
| SEQ ID NO 21048 | GTCTCGGAGGACTGTAAGAA | GAATGCTT | chr12 | 21604595 | 21604614 | 21604598 | - |
| SEQ ID NO 21049 | CCTCTCTGTAACATCCCTGG | GTGGGCTT | chr12 | 21604556 | 21604575 | 21604559 | - |
| SEQ ID NO 21050 | GAGGAGTTACTGCTCTTTGA | AGTTGCTT | chr12 | 21604498 | 21604517 | 21604501 | - |
| SEQ ID NO 21051 | TTGCTTGGGAAGTGACCAAT | AAAGGTTT | chr12 | 21604476 | 21604495 | 21604479 | - |
| SEQ ID NO 21052 | AGGTGACTGAGGAATGTAGA | GTAAGATT | chr12 | 21604412 | 21604431 | 21604415 | - |
| SEQ ID NO 21053 | AAAAAGTTAATATTTACATT | TTTTGTTT | chr12 | 21604165 | 21604184 | 21604168 | - |
| SEQ ID NO 21054 | TTTATTTTAGGAAGATGTAT | ATGTGATT | chr12 | 21604101 | 21604120 | 21604104 | - |
| SEQ ID NO 21055 | ATTCTGTTAGTAATTATATG | AAATGCTT | chr12 | 21604046 | 21604065 | 21604049 | - |
| SEQ ID NO 21056 | TAATTATATGAAATGCTTAA | GAATGTTT | chr12 | 21604036 | 21604055 | 21604039 | - |
| SEQ ID NO 21057 | AAGAATGTTTCATATTCACA | ATTAGCTT | chr12 | 21604018 | 21604037 | 21604021 | - |
| SEQ ID NO 21058 | ATTCACAATTAGCTTGGAAT | TAATGTTT | chr12 | 21604005 | 21604024 | 21604008 | - |
| SEQ ID NO 21059 | TGGAATTAATGTTTTAATTC | AGGAGCTT | chr12 | 21603991 | 21604010 | 21603994 | - |
| SEQ ID NO 21060 | AGTAATTTTTTCTTCAATG | CTATGCTT | chr12 | 21603926 | 21603945 | 21603929 | - |
| SEQ ID NO 21061 | AAGGTAGAGAACCACAATGT | AAATGATT | chr12 | 21603810 | 21603829 | 21603813 | - |
| SEQ ID NO 21062 | AAATTATAAAACAATTCCTT | GTGGGTTT | chr12 | 21603761 | 21603780 | 21603764 | - |
| SEQ ID NO 21063 | TTCCTTGTGGGTTTATACTC | TCTAGTTT | chr12 | 21603747 | 21603766 | 21603750 | - |
| SEQ ID NO 21064 | AACATTAGCAAAGAAAAAGT | CATGGTTT | chr12 | 21603696 | 21603715 | 21603699 | - |
| SEQ ID NO 21065 | AGATCTTGAAGAATCAAGCC | AACTGATT | chr12 | 21603650 | 21603669 | 21603653 | - |
| SEQ ID NO 21066 | GTAAATGGCAGTGATGACTT | GTGTGATT | chr12 | 21603617 | 21603636 | 21603620 | - |
| SEQ ID NO 21067 | TAACACATTTATTTTCATT | TTGTGTTT | chr12 | 21603553 | 21603572 | 21603556 | - |
| SEQ ID NO 21068 | CAAAGCACGGTCTTATTCTC | TGTAGTTT | chr12 | 21603272 | 21603291 | 21603275 | - |
| SEQ ID NO 21069 | AAGTGAAGTATTTTATGTGT | ACCTGTTT | chr12 | 21603203 | 21603222 | 21603206 | - |
| SEQ ID NO 21070 | ATTTTATGTGTACCTGTTTC | TGTTGTTT | chr12 | 21603194 | 21603213 | 21603197 | - |
| SEQ ID NO 21071 | ATCTTTATCCTGAAATGAGC | ATGTGTTT | chr12 | 21603132 | 21603151 | 21603135 | - |
| SEQ ID NO 21072 | CTAGTCACAAATTTTTCCAG | TCCAGTTT | chr12 | 21603090 | 21603109 | 21603093 | - |
| SEQ ID NO 21073 | CCCGGAGTATGCCTTGAAAT | AAAAGTTT | chr12 | 21603010 | 21603029 | 21603013 | - |
| SEQ ID NO 21074 | AGTGGGCAGGAGCTCAAGGA | CATAGCTT | chr12 | 21602973 | 21602992 | 21602976 | - |
| SEQ ID NO 21075 | CTGCACCTGAGCAGAGCCCC | TTCTGCTT | chr12 | 21602876 | 21602895 | 21602879 | - |
| SEQ ID NO 21076 | CTGGTACATAGAAAATGCTC | AATGGATT | chr12 | 21602711 | 21602730 | 21602714 | - |
| SEQ ID NO 21077 | ATGGATTTTTTTTGAAAAA | ATTTGTTT | chr12 | 21602690 | 21602709 | 21602693 | - |
| SEQ ID NO 21078 | TTCCCTTTCAAGGGGAAGGG | AAGTGTTT | chr12 | 21602622 | 21602641 | 21602625 | - |
| SEQ ID NO 21079 | TTTGTGGAGAGGTCCCCACA | ATGTGATT | chr12 | 21602595 | 21602614 | 21602598 | - |
| SEQ ID NO 21080 | TTAATATTATCATAGCCTGG | TATGGTTT | chr12 | 21602531 | 21602550 | 21602534 | - |
| SEQ ID NO 21081 | TTATCATAGCCTGGTATGGT | TTGAGATT | chr12 | 21602525 | 21602544 | 21602528 | - |
| SEQ ID NO 21082 | TTCATATAGATGGATAATTA | TTGTGTTT | chr12 | 21602497 | 21602516 | 21602500 | - |
| SEQ ID NO 21083 | TCCTAATAATACATTGCCAC | TATAGTTT | chr12 | 21602467 | 21602486 | 21602470 | - |

Figure 47 (Cont'd)

| | | | | | | | |
|---|---|---|---|---|---|---|---|
| SEQ ID NO 21084 | CACTATAGTTTCTTTAAATT | TAATGATT | chr12 | 21602450 | 21602469 | 21602453 | - |
| SEQ ID NO 21085 | CTCCTCCAGTTCATAGAGCA | AATTGATT | chr12 | 21602358 | 21602377 | 21602361 | - |
| SEQ ID NO 21086 | AGCAAATGGCAGAGTTAGGA | CCAGGATT | chr12 | 21602309 | 21602328 | 21602312 | - |
| SEQ ID NO 21087 | TAAGAATTAAATATTAAAAC | CTCAGTTT | chr12 | 21602241 | 21602260 | 21602244 | - |
| SEQ ID NO 21088 | CAGTACTTGCAGTCAAAGGT | CTTGGATT | chr12 | 21602182 | 21602201 | 21602185 | - |
| SEQ ID NO 21089 | AAGAACCCCTTAAACTGAAT | AACAGTTT | chr12 | 21602137 | 21602156 | 21602140 | - |
| SEQ ID NO 21090 | TATACTCCAGTTATCTTA | CCATGTTT | chr12 | 21602088 | 21602107 | 21602091 | - |
| SEQ ID NO 21091 | TATTCACATCCAAGAAAACA | AAAGGTTT | chr12 | 21602041 | 21602060 | 21602044 | - |
| SEQ ID NO 21092 | TAACAGATGAGAGAGTCACA | GTTAGTTT | chr12 | 21601951 | 21601970 | 21601954 | - |
| SEQ ID NO 21093 | TTAATATTAACCTTGAAATT | TATTGCTT | chr12 | 21601881 | 21601900 | 21601884 | - |
| SEQ ID NO 21094 | TAATCCATTTTATTATTCAG | TAAGGATT | chr12 | 21601845 | 21601864 | 21601848 | - |
| SEQ ID NO 21095 | AGATAGAGTTAAGAATACAG | AACTGATT | chr12 | 21601776 | 21601795 | 21601779 | - |
| SEQ ID NO 21096 | CAGTGTACCGTGGAATGGGG | AGTGGTTT | chr12 | 21601641 | 21601660 | 21601644 | - |
| SEQ ID NO 21097 | GGTTTCTAACCTAGTTACCT | AGAGGTTT | chr12 | 21601618 | 21601637 | 21601621 | - |
| SEQ ID NO 21098 | GAAAAACCTCTCTAATGATG | AGATGTTT | chr12 | 21601588 | 21601607 | 21601591 | - |
| SEQ ID NO 21099 | GATGGGAGAGACCTGCAGGG | ACTAGATT | chr12 | 21601418 | 21601437 | 21601421 | - |
| SEQ ID NO 21100 | AGGGGGAGTTAATAGCCTTA | AGGAGTTT | chr12 | 21601381 | 21601400 | 21601384 | - |
| SEQ ID NO 21101 | GGGAAGTACTAAGTAGTCAG | GTATGTTT | chr12 | 21601297 | 21601316 | 21601300 | - |
| SEQ ID NO 21102 | CTGTGGTGTGACCCAGGATG | GAAAGTTT | chr12 | 21601219 | 21601238 | 21601222 | - |
| SEQ ID NO 21103 | TTTGCCCAAATGTGGGGGAA | AAATGTTT | chr12 | 21601193 | 21601212 | 21601196 | - |
| SEQ ID NO 21104 | AGGATATTTAGGATCATTAA | AAAAGTTT | chr12 | 21601075 | 21601094 | 21601078 | - |
| SEQ ID NO 21105 | GAGCGATGTAGTCCCTAAAT | AAATGCTT | chr12 | 21600996 | 21601015 | 21600999 | - |
| SEQ ID NO 21106 | CTTAAAATGGACTAGAAACA | ATTTGTTT | chr12 | 21600964 | 21600983 | 21600967 | - |
| SEQ ID NO 21107 | CGTATTGCTGGACATAATTT | ACCTGCTT | chr12 | 21600923 | 21600942 | 21600926 | - |
| SEQ ID NO 21108 | CTTTGATATAAGTGAACTCA | AGGAGTTT | chr12 | 21600751 | 21600770 | 21600754 | - |
| SEQ ID NO 21109 | GAAGAGGACTTCACACTTCC | ATCAGCTT | chr12 | 21600661 | 21600680 | 21600664 | - |
| SEQ ID NO 21110 | GCCGTAAAGAACAACTGCTC | TAAAGTTT | chr12 | 21600614 | 21600633 | 21600617 | - |
| SEQ ID NO 21111 | AGTTTAATACTAGGCTACTC | GGCTGTTT | chr12 | 21600591 | 21600610 | 21600594 | - |
| SEQ ID NO 21112 | CGGCTGTTTTTTGTTAACAC | AGAAGTTT | chr12 | 21600572 | 21600591 | 21600575 | - |
| SEQ ID NO 21113 | GTTAACACAGAAGTTTTCCA | AATGGCTT | chr12 | 21600560 | 21600579 | 21600563 | - |
| SEQ ID NO 21114 | CCATCCTTCCCGAGACCTAA | CGATGTTT | chr12 | 21600506 | 21600525 | 21600509 | - |
| SEQ ID NO 21115 | ACGATGTTATCTTTCGTGA | TACTGTTT | chr12 | 21600487 | 21600506 | 21600490 | - |
| SEQ ID NO 21116 | AGATCCATCAAGGCCCAGCA | TGGTGATT | chr12 | 21600419 | 21600438 | 21600422 | - |
| SEQ ID NO 21117 | TTTCAAGGCTGAGGTGGGAG | AATTGTTT | chr12 | 21600370 | 21600389 | 21600373 | - |
| SEQ ID NO 21118 | GCCTGGGGAACATAGGGAGA | CCCTGTTT | chr12 | 21600321 | 21600340 | 21600324 | - |
| SEQ ID NO 21119 | ATTGAATCCAGGCGTTCTAG | TGAGGCTT | chr12 | 21600205 | 21600224 | 21600208 | - |
| SEQ ID NO 21120 | TTCTAGTGAGGCTTCAGTGA | GCAAGATT | chr12 | 21600191 | 21600210 | 21600194 | - |
| SEQ ID NO 21121 | GCCGGGGTGACAGAGTGAGA | CCCTGTTT | chr12 | 21600147 | 21600166 | 21600150 | - |
| SEQ ID NO 21122 | TCTACAGCTAAAGTCAGACT | GCATGATT | chr12 | 21600050 | 21600069 | 21600053 | - |
| SEQ ID NO 21123 | CCACCATCACCTGGGTAATG | TTGAGATT | chr12 | 21600009 | 21600028 | 21600012 | - |
| SEQ ID NO 21124 | ATTACATAGCATCTCTGTGC | CTCAGTTT | chr12 | 21599980 | 21599999 | 21599983 | - |
| SEQ ID NO 21125 | TTAATAAACACTCTGTAGGT | ATTAGCTT | chr12 | 21599867 | 21599886 | 21599870 | - |
| SEQ ID NO 21126 | GTTAGCTCATGTATTGTCAT | ACCAGCTT | chr12 | 21599805 | 21599824 | 21599808 | - |
| SEQ ID NO 21127 | AATCACGGGATGCATAGTAA | TTAGGATT | chr12 | 21599693 | 21599712 | 21599696 | - |
| SEQ ID NO 21128 | ACACACGATCTATGTAAAAA | CTATGCTT | chr12 | 21599587 | 21599606 | 21599590 | - |
| SEQ ID NO 21129 | GTAAAACTATGCTTGGTTG | CACAGCTT | chr12 | 21599574 | 21599593 | 21599577 | - |
| SEQ ID NO 21130 | CCTCCCACTGCCAAGACTGC | AGCTGCTT | chr12 | 21599419 | 21599438 | 21599422 | - |
| SEQ ID NO 21131 | CACTGCCAAGACTGCAGCTG | CTTTGATT | chr12 | 21599414 | 21599433 | 21599417 | - |
| SEQ ID NO 21132 | TCTAAGTGTATAATGACTTC | CTCTGCTT | chr12 | 21599278 | 21599297 | 21599281 | - |

Figure 47 (Cont'd)

| SEQ ID NO | Sequence | | chr | Start | End | Pos | Strand |
|---|---|---|---|---|---|---|---|
| SEQ ID NO 21133 | GACTTCCTCTGCTTCTGCAA | CTGTGTTT | chr12 | 21599264 | 21599283 | 21599267 | - |
| SEQ ID NO 21134 | CTGTGTTTTGGAACAGGAGG | GTGAGATT | chr12 | 21599244 | 21599263 | 21599247 | - |
| SEQ ID NO 21135 | TATTCTATACTTCTTTGAAA | TAGTGATT | chr12 | 21599008 | 21599027 | 21599011 | - |
| SEQ ID NO 21136 | AGTGTTGCCAGATGACGACT | TAGAGTTT | chr12 | 21598966 | 21598985 | 21598969 | - |
| SEQ ID NO 21137 | AGATCAATAAAATACAAAGT | ACTTGTTT | chr12 | 21598826 | 21598845 | 21598829 | - |
| SEQ ID NO 21138 | TCAGAATAAAACCATTTATT | TGCAGATT | chr12 | 21598710 | 21598729 | 21598713 | - |
| SEQ ID NO 21139 | TATATGTGTATGTAAATCTC | CTTGGTTT | chr12 | 21598674 | 21598693 | 21598677 | - |
| SEQ ID NO 21140 | GCTCTTGCATTCACTTATAT | TCTAGCTT | chr12 | 21598607 | 21598626 | 21598610 | - |
| SEQ ID NO 21141 | ATATTCTAGCTTGTTAAGAG | AGAAGTTT | chr12 | 21598591 | 21598610 | 21598594 | - |
| SEQ ID NO 21142 | AGAGAGAAGTTTGGGGCAAA | ATGTGCTT | chr12 | 21598575 | 21598594 | 21598578 | - |
| SEQ ID NO 21143 | CAGGGAAATGTCTGGAGGGA | CAAAGATT | chr12 | 21598393 | 21598412 | 21598396 | - |
| SEQ ID NO 21144 | CTTTCTTTTATTGATATATG | ACGTGTTT | chr12 | 21598330 | 21598349 | 21598333 | - |
| SEQ ID NO 21145 | TATTCATCACCTCAAGTATT | TATCGTTT | chr12 | 21598231 | 21598250 | 21598234 | - |
| SEQ ID NO 21146 | CTATTTTGAAATATACAATA | TATTGTTT | chr12 | 21598168 | 21598187 | 21598171 | - |
| SEQ ID NO 21147 | CATATTCCTTCTATCTAACT | GCCTGTTT | chr12 | 21598101 | 21598120 | 21598104 | - |
| SEQ ID NO 21148 | CGTACACACCTTTCTCTACC | TCTGGTTT | chr12 | 21598034 | 21598053 | 21598037 | - |
| SEQ ID NO 21149 | GCAAAATTTGTCTTTCTATG | CCTGGCTT | chr12 | 21597941 | 21597960 | 21597944 | - |
| SEQ ID NO 21150 | GTCTTTCTATGCCTGGCTTA | TTTCGTTT | chr12 | 21597932 | 21597951 | 21597935 | - |
| SEQ ID NO 21151 | TTTCGTTTAACATAATGACT | TCCAGTTT | chr12 | 21597912 | 21597931 | 21597915 | - |
| SEQ ID NO 21152 | CATCCATGTTGCTGCAAATG | AAATGATT | chr12 | 21597884 | 21597903 | 21597887 | - |
| SEQ ID NO 21153 | CATCCATTGATGGACACTTA | GGTTGATT | chr12 | 21597798 | 21597817 | 21597801 | - |
| SEQ ID NO 21154 | ATAAACAGTGTGGTACCAGT | ATCTGTTT | chr12 | 21597739 | 21597758 | 21597742 | - |
| SEQ ID NO 21155 | CTTTGGATAAATACCCAGTA | ATAAGATT | chr12 | 21597692 | 21597711 | 21597695 | - |
| SEQ ID NO 21156 | GATCTTATGATAGTTCAATT | TTTAGCTT | chr12 | 21597660 | 21597679 | 21597663 | - |
| SEQ ID NO 21157 | AGCTTTTTGGTAAATCTACA | TATTGTTT | chr12 | 21597637 | 21597656 | 21597640 | - |
| SEQ ID NO 21158 | CATAGTGGCTATACTAATTT | GCATGCTT | chr12 | 21597607 | 21597626 | 21597610 | - |
| SEQ ID NO 21159 | TTATTAATTTATTTAAATCA | TGATGATT | chr12 | 21597521 | 21597540 | 21597524 | - |
| SEQ ID NO 21160 | GGCATAAGATGATATCTCAT | TGTGGTTT | chr12 | 21597487 | 21597506 | 21597490 | - |
| SEQ ID NO 21161 | AAGATGATATCTCATTGTGG | TTTTGATT | chr12 | 21597482 | 21597501 | 21597485 | - |
| SEQ ID NO 21162 | GGTTTTGATTTGCATTTCTC | TGATGATT | chr12 | 21597464 | 21597483 | 21597467 | - |
| SEQ ID NO 21163 | TATCCTTTGCCAATTTTTTA | ATGAGATT | chr12 | 21597377 | 21597396 | 21597380 | - |
| SEQ ID NO 21164 | GCCAATTTTTTAATGAGATT | ATTTGTTT | chr12 | 21597369 | 21597388 | 21597372 | - |
| SEQ ID NO 21165 | TATTTGTTTTCCACTGTTG | AGTTGTTT | chr12 | 21597350 | 21597369 | 21597353 | - |
| SEQ ID NO 21166 | TTTTCCACTGTTGAGTTGT | TTGAGTTT | chr12 | 21597344 | 21597363 | 21597347 | - |
| SEQ ID NO 21167 | TTTGAGTTTCTTATATATTC | TGGAGATT | chr12 | 21597325 | 21597344 | 21597328 | - |
| SEQ ID NO 21168 | GCAAATATTTTCTCGCATTC | AACAGCTT | chr12 | 21597278 | 21597297 | 21597281 | - |
| SEQ ID NO 21169 | AACAGCTTGTCTCTTCACTG | TGTTGATT | chr12 | 21597258 | 21597277 | 21597261 | - |
| SEQ ID NO 21170 | GCTTGTCTCTTCACTGTGTT | GATTGTTT | chr12 | 21597254 | 21597273 | 21597257 | - |
| SEQ ID NO 21171 | CCTTTACTGTGCAGATGTAT | TTTAGCTT | chr12 | 21597226 | 21597245 | 21597229 | - |
| SEQ ID NO 21172 | ATATAGTCCCATTTGTCTAT | TTTTGCTT | chr12 | 21597197 | 21597216 | 21597200 | - |
| SEQ ID NO 21173 | TCTATTTTGCTTTTGTTGC | CTGTGCTT | chr12 | 21597182 | 21597201 | 21597185 | - |
| SEQ ID NO 21174 | CATGTCTTGAAGTGTCTCCC | TTATGTTT | chr12 | 21597120 | 21597139 | 21597123 | - |
| SEQ ID NO 21175 | TCTCCCTTATGTTTTCTTTT | AGTAGTTT | chr12 | 21597106 | 21597125 | 21597109 | - |
| SEQ ID NO 21176 | ATGTTTTCTTTTAGTAGTTT | TATAGTTT | chr12 | 21597098 | 21597117 | 21597101 | - |
| SEQ ID NO 21177 | CTTTTAGTAGTTTTATAGTT | TTAAGTTT | chr12 | 21597091 | 21597110 | 21597094 | - |
| SEQ ID NO 21178 | GTCTTTAATCCATCTTGAGA | GTACGTTT | chr12 | 21597054 | 21597073 | 21597057 | - |
| SEQ ID NO 21179 | TATTGTACAAGGGGTTGAGT | TCTTGATT | chr12 | 21596983 | 21597002 | 21596986 | - |
| SEQ ID NO 21180 | TACAAGGGGTTGAGTTCTTG | ATTTGATT | chr12 | 21596978 | 21596997 | 21596981 | - |
| SEQ ID NO 21181 | CTGTTGGTGTATAGAAGAGT | TACTGATT | chr12 | 21596937 | 21596956 | 21596940 | - |

Figure 47 (Cont'd)

| SEQ ID NO 21182 | TGAATTATTTTATCAGTTCT | AGGAGCTT | chr12 | 21596876 | 21596895 | 21596879 | - |
| SEQ ID NO 21183 | GAGCTTTCTGGAGGAGTCTT | TAGGGTTT | chr12 | 21596854 | 21596873 | 21596857 | - |
| SEQ ID NO 21184 | TCATATCATCAGCAAACAGT | GACAGTTT | chr12 | 21596813 | 21596832 | 21596816 | - |
| SEQ ID NO 21185 | TGACAGTTTGACTTCCTCTT | TACTGATT | chr12 | 21596794 | 21596813 | 21596797 | - |
| SEQ ID NO 21186 | GATTTGAATGCCCTTTATTT | CTTTGTTT | chr12 | 21596770 | 21596789 | 21596773 | - |
| SEQ ID NO 21187 | GCCCTTTATTTCTTTGTTTT | GTCTGATT | chr12 | 21596761 | 21596780 | 21596764 | - |
| SEQ ID NO 21188 | CTTGTTCCAGTTCTCAGAGG | GAATGCTT | chr12 | 21596673 | 21596692 | 21596676 | - |
| SEQ ID NO 21189 | CATTCAATATTATGTTGGCT | GTGGGTTT | chr12 | 21596633 | 21596652 | 21596636 | - |
| SEQ ID NO 21190 | TTGGCTGTGGGTTTGTCACA | GATGGCTT | chr12 | 21596619 | 21596638 | 21596622 | - |
| SEQ ID NO 21191 | ACTGAGGTATGTCTCTTGTA | TGCTGATT | chr12 | 21596584 | 21596603 | 21596587 | - |
| SEQ ID NO 21192 | CATTTTAATCATAAATGTAT | GCTGGATT | chr12 | 21596548 | 21596567 | 21596551 | - |
| SEQ ID NO 21193 | AATGTATGCTGGATTTTGTT | GAATGCTT | chr12 | 21596535 | 21596554 | 21596538 | - |
| SEQ ID NO 21194 | TATTGAGATGATCATGTAAT | TTTTGTTT | chr12 | 21596497 | 21596516 | 21596500 | - |
| SEQ ID NO 21195 | CATGTAATTTTTGTTTTTAA | ATCTGTTT | chr12 | 21596485 | 21596504 | 21596488 | - |
| SEQ ID NO 21196 | CCCTGCATCCTGGCATGGA | ACCTGCTT | chr12 | 21596415 | 21596434 | 21596418 | - |
| SEQ ID NO 21197 | CATGGAACCTGCTTGATCAT | GGTGGATT | chr12 | 21596401 | 21596420 | 21596404 | - |
| SEQ ID NO 21198 | TTGGTTATCTAGTATTTTGT | TAAGGATT | chr12 | 21596350 | 21596369 | 21596353 | - |
| SEQ ID NO 21199 | GTTCATCAAGGCTATCAGTC | TGTAGTTT | chr12 | 21596311 | 21596330 | 21596314 | - |
| SEQ ID NO 21200 | CTTTTTTGGTTATGTCCTTC | CCTGGTTT | chr12 | 21596282 | 21596301 | 21596285 | - |
| SEQ ID NO 21201 | TTCCCTGGTTTTGGTGTGAT | GCTGGCTT | chr12 | 21596265 | 21596284 | 21596268 | - |
| SEQ ID NO 21202 | TTTAATTACCAATTAAATCT | CACTGCTT | chr12 | 21596094 | 21596113 | 21596097 | - |
| SEQ ID NO 21203 | AGCTCCAGTGTTAGGTGCAT | ATATGTTT | chr12 | 21595761 | 21595780 | 21595764 | - |
| SEQ ID NO 21204 | AGTGTTAGGTGCATATATGT | TTAAGATT | chr12 | 21595755 | 21595774 | 21595758 | - |
| SEQ ID NO 21205 | TCTTTGTCTCTTTTAACTGC | TGTTGCTT | chr12 | 21595679 | 21595698 | 21595682 | - |
| SEQ ID NO 21206 | TCTTTTAACTGCTGTTGCTT | TAAAGTTT | chr12 | 21595671 | 21595690 | 21595674 | - |
| SEQ ID NO 21207 | TTAACTGCTGTTGCTTTAAA | GTTTGTTT | chr12 | 21595667 | 21595686 | 21595670 | - |
| SEQ ID NO 21208 | TGAGCTCCCAGGGCCTTTCT | CACTGCTT | chr12 | 21595499 | 21595518 | 21595502 | - |
| SEQ ID NO 21209 | ACTTCTCCACAAACAGACC | TTCAGTTT | chr12 | 21595411 | 21595430 | 21595414 | - |
| SEQ ID NO 21210 | TCAGTTCTCCAGTGGGAGT | GTGTGTTT | chr12 | 21595390 | 21595409 | 21595393 | - |
| SEQ ID NO 21211 | CAGAGGGTCTGTGGGTCCTC | TCAGGATT | chr12 | 21595268 | 21595287 | 21595271 | - |
| SEQ ID NO 21212 | CTGTGGGTCCTCTCAGGATT | GCTGGTTT | chr12 | 21595260 | 21595279 | 21595263 | - |
| SEQ ID NO 21213 | CCGCCAAGATCCTGAGAAGT | TGGGGATT | chr12 | 21595134 | 21595153 | 21595137 | - |
| SEQ ID NO 21214 | GTTGGGGATTATATTTCAAC | ATGAGATT | chr12 | 21595116 | 21595135 | 21595119 | - |
| SEQ ID NO 21215 | CATCCAAACCATATCAGCAG | TCCAGTTT | chr12 | 21595075 | 21595094 | 21595078 | - |
| SEQ ID NO 21216 | CTGTTCTAATGTCAGTATCA | TGCTGTTT | chr12 | 21594876 | 21594895 | 21594879 | - |
| SEQ ID NO 21217 | TTTTTTAATTTCATACAAAT | TTTAGATT | chr12 | 21594752 | 21594771 | 21594755 | - |
| SEQ ID NO 21218 | TAATTTCATACAAATTTTAG | ATTGGTTT | chr12 | 21594747 | 21594766 | 21594750 | - |
| SEQ ID NO 21219 | GATAGCGGTCATATAGAATC | TGTAGATT | chr12 | 21594686 | 21594705 | 21594689 | - |
| SEQ ID NO 21220 | GCGGTCATATAGAATCTGTA | GATTGCTT | chr12 | 21594682 | 21594701 | 21594685 | - |
| SEQ ID NO 21221 | TGAACATAGGATATCTCTCC | ATTTGTTT | chr12 | 21594611 | 21594630 | 21594614 | - |
| SEQ ID NO 21222 | GTCCTTTTCAATTCTTTTAT | CAGTGTTT | chr12 | 21594581 | 21594600 | 21594584 | - |
| SEQ ID NO 21223 | CAATTCTTTTATCAGTGTTT | TGTAGTTT | chr12 | 21594573 | 21594592 | 21594576 | - |
| SEQ ID NO 21224 | TGTTTTGTAGTTTTCCGAAT | AGAGGTTT | chr12 | 21594558 | 21594577 | 21594561 | - |
| SEQ ID NO 21225 | TTATTTTTAGCTATTGTAA | ATGGGATT | chr12 | 21594496 | 21594515 | 21594499 | - |
| SEQ ID NO 21226 | CCTTCTTAATTTCCTTCTCA | GCTAGTTT | chr12 | 21594467 | 21594486 | 21594470 | - |
| SEQ ID NO 21227 | TTATTATTGGTGTGTAGAAA | CATTGCTT | chr12 | 21594441 | 21594460 | 21594444 | - |
| SEQ ID NO 21228 | TATTGGTGTGTAGAAACATT | GCTTGTTT | chr12 | 21594437 | 21594456 | 21594440 | - |
| SEQ ID NO 21229 | GAAACATTGCTTGTTTCATA | TGCTGATT | chr12 | 21594425 | 21594444 | 21594428 | - |
| SEQ ID NO 21230 | AATTTATTTTTCAGCGCTAA | GAGTGCTT | chr12 | 21594376 | 21594395 | 21594379 | - |

Figure 47 (Cont'd)

| SEQ ID NO 21231 | TAAGAGTGCTTTGGTGGAGT | CTTGGTTT | chr12 | 21594359 | 21594378 | 21594362 | - |
| SEQ ID NO 21232 | TCATGTCATCTGGAAAGATG | GACAGTTT | chr12 | 21594317 | 21594336 | 21594320 | - |
| SEQ ID NO 21233 | GATGGAAGTGGGCATCCTTA | TTTTGTTT | chr12 | 21594194 | 21594213 | 21594197 | - |
| SEQ ID NO 21234 | TTTGTTTCAGTTCTTAGAGG | AAAGGCTT | chr12 | 21594173 | 21594192 | 21594176 | - |
| SEQ ID NO 21235 | CAGTTCTTAGAGGAAAGGCT | TCCAGCTT | chr12 | 21594166 | 21594185 | 21594169 | - |
| SEQ ID NO 21236 | AATTCAGTATGATGTTAGCT | GTGGGTTT | chr12 | 21594133 | 21594152 | 21594136 | - |
| SEQ ID NO 21237 | TATATTGAGATATGTTCCTT | CTATGATT | chr12 | 21594087 | 21594106 | 21594090 | - |
| SEQ ID NO 21238 | TCCTTCTATGATTGGCTGCA | GATAGTTT | chr12 | 21594072 | 21594091 | 21594075 | - |
| SEQ ID NO 21239 | TGTATCTATTGAGATGATCA | TATGGTTT | chr12 | 21594004 | 21594023 | 21594007 | - |
| SEQ ID NO 21240 | TTGATGTGATGTATCACATT | TATTGATT | chr12 | 21593964 | 21593983 | 21593967 | - |
| SEQ ID NO 21241 | TATTATCTTTTGGATGTACT | GTTGGATT | chr12 | 21593890 | 21593909 | 21593893 | - |
| SEQ ID NO 21242 | CTTTTGGATGTACTGTTGGA | TTCAGTTT | chr12 | 21593884 | 21593903 | 21593887 | - |
| SEQ ID NO 21243 | TCAGTTGCTAGTATTTTGT | TGAGGATT | chr12 | 21593863 | 21593882 | 21593866 | - |
| SEQ ID NO 21244 | TTCCATCAGGGATATTGACC | TGCAGTTT | chr12 | 21593823 | 21593842 | 21593826 | - |
| SEQ ID NO 21245 | ATGAGTTAGGGAGAATTCCT | TCCTGTTT | chr12 | 21593738 | 21593757 | 21593741 | - |
| SEQ ID NO 21246 | AAAAGAATTTAAGGAGACTT | GTTAGTTT | chr12 | 21593703 | 21593722 | 21593706 | - |
| SEQ ID NO 21247 | GAGACTTGTTAGTTTTCTTT | GAAAGTTT | chr12 | 21593690 | 21593709 | 21593693 | - |
| SEQ ID NO 21248 | TTTTTGGGAGACTTTTTAC | TACTGATT | chr12 | 21593621 | 21593640 | 21593624 | - |
| SEQ ID NO 21249 | ATTATTCATTACTGGTCTGT | TCAGGTTT | chr12 | 21593586 | 21593605 | 21593589 | - |
| SEQ ID NO 21250 | CCAGAAATTTATTAATTTCC | TCTAGATT | chr12 | 21593518 | 21593537 | 21593521 | - |
| SEQ ID NO 21251 | TATTAATTTCCTCTAGATTT | TTCAGTTT | chr12 | 21593509 | 21593528 | 21593512 | - |
| SEQ ID NO 21252 | TAATATATTTTCTTTTTTAT | TTCTGATT | chr12 | 21593419 | 21593438 | 21593422 | - |
| SEQ ID NO 21253 | TCATTTGCTAATCCCTTGT | TGTTGTTT | chr12 | 21593309 | 21593328 | 21593312 | - |
| SEQ ID NO 21254 | TTCATTTTTCTTTCCTTCT | GCTAGTTT | chr12 | 21593253 | 21593272 | 21593256 | - |
| SEQ ID NO 21255 | TTTCTTTCCTTCTGCTAGTT | TTGGGTTT | chr12 | 21593246 | 21593265 | 21593249 | - |
| SEQ ID NO 21256 | CTGCTAGTTTTGGGTTTTGT | TCTTGCTT | chr12 | 21593235 | 21593254 | 21593238 | - |
| SEQ ID NO 21257 | TTGGGTTTTGTTCTTGCTTT | TCTAGCTT | chr12 | 21593226 | 21593245 | 21593229 | - |
| SEQ ID NO 21258 | CTTTTCTAGCTTGTTGAGGT | ACATGATT | chr12 | 21593210 | 21593229 | 21593213 | - |
| SEQ ID NO 21259 | CTAGCTTGTTGAGGTACATG | ATTAGATT | chr12 | 21593205 | 21593224 | 21593208 | - |
| SEQ ID NO 21260 | ATTATATATTTGAAATCTTT | CTATGTTT | chr12 | 21593180 | 21593199 | 21593183 | - |
| SEQ ID NO 21261 | TCTTTCTATGTTTTTAATTT | AAGTGTTT | chr12 | 21593165 | 21593184 | 21593168 | - |
| SEQ ID NO 21262 | TTTAATTTAAGTGTTTATTG | ATAAGCTT | chr12 | 21593153 | 21593172 | 21593156 | - |
| SEQ ID NO 21263 | TTGATAAGCTTCTCTCTTAG | CACTGCTT | chr12 | 21593136 | 21593155 | 21593139 | - |
| SEQ ID NO 21264 | GCACTGCTTTGCTGTATCC | CATGGCTT | chr12 | 21593117 | 21593136 | 21593120 | - |
| SEQ ID NO 21265 | TATGTTGTATTTCAATTTTC | ATTTGTTT | chr12 | 21593085 | 21593104 | 21593088 | - |
| SEQ ID NO 21266 | TTTCATTTGTTTCAAAAAAT | TTTTGATT | chr12 | 21593069 | 21593088 | 21593072 | - |
| SEQ ID NO 21267 | ATAACGTTCATTCAGGAGCA | TGTTGTTT | chr12 | 21593018 | 21593037 | 21593021 | - |
| SEQ ID NO 21268 | TTTAATTTCCATGTATTTGT | ATAGGTTT | chr12 | 21592993 | 21593012 | 21592996 | - |
| SEQ ID NO 21269 | CCATGTATTTGTATAGGTTT | TAAAGTTT | chr12 | 21592985 | 21593004 | 21592988 | - |
| SEQ ID NO 21270 | GGTTTTAAAGTTTTTCTTGT | TATTGATT | chr12 | 21592970 | 21592989 | 21592973 | - |
| SEQ ID NO 21271 | AGTTTTCTTGTTATTGATT | TCTAGTTT | chr12 | 21592962 | 21592981 | 21592965 | - |
| SEQ ID NO 21272 | TATTCCATTGTGGTCTGAGA | AGATGCTT | chr12 | 21592934 | 21592953 | 21592937 | - |
| SEQ ID NO 21273 | GTGGTCTGAGAAGATGCTTA | ATATGATT | chr12 | 21592925 | 21592944 | 21592928 | - |
| SEQ ID NO 21274 | TAGATCCATTGGTCTAAAG | TCAAGTTT | chr12 | 21592772 | 21592791 | 21592775 | - |
| SEQ ID NO 21275 | TCTAAAGTCAAGTTTAAATC | CAATGTTT | chr12 | 21592759 | 21592778 | 21592762 | - |
| SEQ ID NO 21276 | TCTAGATGATCTATCTGATG | CTGAGATT | chr12 | 21592715 | 21592734 | 21592718 | - |
| SEQ ID NO 21277 | AAATCCCCAACTATTATTGT | ATTGGATT | chr12 | 21592678 | 21592697 | 21592681 | - |
| SEQ ID NO 21278 | CACCCTTTATATCTAATAAC | ATTTGCTT | chr12 | 21592644 | 21592663 | 21592647 | - |
| SEQ ID NO 21279 | GATGCTCTGGTGTTGAGTGT | GAATGTTT | chr12 | 21592606 | 21592625 | 21592609 | - |

Figure 47 (Cont'd)

| | | | | | | | |
|---|---|---|---|---|---|---|---|
| SEQ ID NO 21280 | ATGTAATGACTTTTGTCTCT | TAGTGTTT | chr12 | 21592536 | 21592555 | 21592539 | - |
| SEQ ID NO 21281 | TATAACTACTTTTGCTCATT | TTTGGTTT | chr12 | 21592477 | 21592496 | 21592480 | - |
| SEQ ID NO 21282 | TATTTATCTTTACAAGTGAG | ATAAGTTT | chr12 | 21592407 | 21592426 | 21592410 | - |
| SEQ ID NO 21283 | AGTGAGATAAGTTTCTTATA | GGCAGCTT | chr12 | 21592393 | 21592412 | 21592396 | - |
| SEQ ID NO 21284 | AGCTTACAACTGGGTCATAT | TTTTGTTT | chr12 | 21592370 | 21592389 | 21592373 | - |
| SEQ ID NO 21285 | CAAGGCTATTATTGACATGT | GAGAGCTT | chr12 | 21592287 | 21592306 | 21592290 | - |
| SEQ ID NO 21286 | CTTATTCCTGCCATTTTGTT | AATTGATT | chr12 | 21592262 | 21592281 | 21592265 | - |
| SEQ ID NO 21287 | CATTTTGTTAATTGATTCCT | GGTTGTTT | chr12 | 21592251 | 21592270 | 21592254 | - |
| SEQ ID NO 21288 | TGTTAATTGATTCCTGGTTG | TTTTGTTT | chr12 | 21592246 | 21592265 | 21592249 | - |
| SEQ ID NO 21289 | CCTGGTTGTTTTGTTTTTTT | TTTAGTTT | chr12 | 21592234 | 21592253 | 21592237 | - |
| SEQ ID NO 21290 | GTTGTTTTGTTTTTTTTTTA | GTTTGTTT | chr12 | 21592230 | 21592249 | 21592233 | - |
| SEQ ID NO 21291 | TTTTGTTTTTTTTTAGTTT | GTTTGTTT | chr12 | 21592226 | 21592245 | 21592229 | - |
| SEQ ID NO 21292 | TTTTTTTTAGTTTGTTTGTT | TTGTGTTT | chr12 | 21592219 | 21592238 | 21592222 | - |
| SEQ ID NO 21293 | CTTTCTTTCTTTCTTATTAT | TTATGATT | chr12 | 21592136 | 21592155 | 21592139 | - |
| SEQ ID NO 21294 | TCTTTCTTATTATTTATGAT | TGTGGTTT | chr12 | 21592129 | 21592148 | 21592132 | - |
| SEQ ID NO 21295 | TATTATTTATGATTGTGGTT | TGGTGATT | chr12 | 21592122 | 21592141 | 21592125 | - |
| SEQ ID NO 21296 | TTGGTGATTTCTGTAGTGG | TAACGTTT | chr12 | 21592103 | 21592122 | 21592106 | - |
| SEQ ID NO 21297 | GAGTTCTTTCTCTTCTTTAT | TTGTGTTT | chr12 | 21592075 | 21592094 | 21592078 | - |
| SEQ ID NO 21298 | TTCAAATTTTTCTTGCCCAG | AAAAGATT | chr12 | 21591928 | 21591947 | 21591931 | - |
| SEQ ID NO 21299 | TCCCATCTTCTCCTGGCCTG | TGAGGTTT | chr12 | 21591813 | 21591832 | 21591816 | - |
| SEQ ID NO 21300 | CCCTTATAAGTGACTAGACA | TTTTGCTT | chr12 | 21591742 | 21591761 | 21591745 | - |
| SEQ ID NO 21301 | AAGTGACTAGACATTTTGCT | TGCTGTTT | chr12 | 21591735 | 21591754 | 21591738 | - |
| SEQ ID NO 21302 | CTGTTTAGAGTTCTTACTC | TTTGGCTT | chr12 | 21591713 | 21591732 | 21591716 | - |
| SEQ ID NO 21303 | GTTCTTACTCTTTGGCTTTT | GACAGTTT | chr12 | 21591703 | 21591722 | 21591706 | - |
| SEQ ID NO 21304 | GACTATAATGTGCTGTGGAG | AAGAGCTT | chr12 | 21591675 | 21591694 | 21591678 | - |
| SEQ ID NO 21305 | GCATTATATTATTTGGGAAT | TTCTGATT | chr12 | 21591644 | 21591663 | 21591647 | - |
| SEQ ID NO 21306 | TACATTCTTGCTAGACTTG | ACAAGTTT | chr12 | 21591598 | 21591617 | 21591601 | - |
| SEQ ID NO 21307 | TTCAGCTATTGTGTTGTTAC | GTAGGTTT | chr12 | 21591571 | 21591590 | 21591574 | - |
| SEQ ID NO 21308 | TTCAAGTTCTGAAATTTTTC | TTCTGCTT | chr12 | 21591395 | 21591414 | 21591398 | - |
| SEQ ID NO 21309 | TGCTTGATCTGATCTATTGT | TGAAGTTT | chr12 | 21591372 | 21591391 | 21591375 | - |
| SEQ ID NO 21310 | AAACTCTTCAGTTACAGAAT | TTCTGTTT | chr12 | 21591317 | 21591336 | 21591320 | - |
| SEQ ID NO 21311 | AATTTCTCATTCATATCCTG | AATTGTTT | chr12 | 21591257 | 21591276 | 21591260 | - |
| SEQ ID NO 21312 | ATTCATATCCTGAATTGTTT | TTCTGATT | chr12 | 21591249 | 21591268 | 21591252 | - |
| SEQ ID NO 21313 | TTGTTTTTCTGATTTCTTTT | TATTGTTT | chr12 | 21591235 | 21591254 | 21591238 | - |
| SEQ ID NO 21314 | CTGAGTTCTCTTGTGTCTCA | CTGAGCTT | chr12 | 21591205 | 21591224 | 21591208 | - |
| SEQ ID NO 21315 | AGCTTCCTTAATATCAACAT | TTTGGATT | chr12 | 21591182 | 21591201 | 21591185 | - |
| SEQ ID NO 21316 | TATAAATGTCTTTTTTTTCC | ACTGGCTT | chr12 | 21591138 | 21591157 | 21591141 | - |
| SEQ ID NO 21317 | TGTCATATTTCTTCACCTTT | TTATGTTT | chr12 | 21591076 | 21591095 | 21591079 | - |
| SEQ ID NO 21318 | TGATATCTCTGCATCTGGTG | TAATGATT | chr12 | 21591033 | 21591052 | 21591036 | - |
| SEQ ID NO 21319 | TCTGCATCTGGTGTAATGAT | TGCTGCTT | chr12 | 21591026 | 21591045 | 21591029 | - |
| SEQ ID NO 21320 | CTGGTGTAATGATTGCTGCT | TCCAGTTT | chr12 | 21591019 | 21591038 | 21591022 | - |
| SEQ ID NO 21321 | TGCTGCTTCCAGTTTTGTAA | ATTTGTTT | chr12 | 21591006 | 21591025 | 21591009 | - |
| SEQ ID NO 21322 | TTTCTGAAGATGTATCTTGG | TGTTGATT | chr12 | 21590961 | 21590980 | 21590964 | - |
| SEQ ID NO 21323 | GGTGTTGATTGAGTAGGGCA | CTTTGATT | chr12 | 21590943 | 21590962 | 21590946 | - |
| SEQ ID NO 21324 | GATTGAGTAGGGCACTTTGA | TTTTGATT | chr12 | 21590937 | 21590956 | 21590940 | - |
| SEQ ID NO 21325 | GCCAACAGTATCATCAGTGT | CTGTGATT | chr12 | 21590862 | 21590881 | 21590865 | - |
| SEQ ID NO 21326 | TCAGTGTCTGTGATTTTTTC | AGTGGCTT | chr12 | 21590849 | 21590868 | 21590852 | - |
| SEQ ID NO 21327 | GATGGTAATGAGTCTAGTTG | GGTTGATT | chr12 | 21590683 | 21590702 | 21590686 | - |
| SEQ ID NO 21328 | GGTTGATTCTTTGGCCTTCA | GGCAGTTT | chr12 | 21590663 | 21590682 | 21590666 | - |

Figure 47 (Cont'd)

| SEQ ID NO 21329 | GATTCTTTGGCCTTCAGGCA | GTTTGCTT | chr12 | 21590659 | 21590678 | 21590662 | - |
| SEQ ID NO 21330 | CTGGGCTGGTGTGTGGGTCC | TCAGGCTT | chr12 | 21590606 | 21590625 | 21590609 | - |
| SEQ ID NO 21331 | GTGCCAGTTGTGATGGCAGT | GGCAGATT | chr12 | 21590435 | 21590454 | 21590438 | - |
| SEQ ID NO 21332 | CAGATTGGGTAGGCCCATCA | TCAGGCTT | chr12 | 21590413 | 21590432 | 21590416 | - |
| SEQ ID NO 21333 | CATCATCAGGCTTCTGGGAG | GGTTGCTT | chr12 | 21590398 | 21590417 | 21590401 | - |
| SEQ ID NO 21334 | TGTCTCTGGGTTCCCAGACA | ACTTGCTT | chr12 | 21590340 | 21590359 | 21590343 | - |
| SEQ ID NO 21335 | TCTTGAAGGGGTGCGGGGTG | TGTTGCTT | chr12 | 21590156 | 21590175 | 21590159 | - |
| SEQ ID NO 21336 | TAAATGGGTTGCTGGTGGGC | ATGTGTTT | chr12 | 21590112 | 21590131 | 21590115 | - |
| SEQ ID NO 21337 | AGTGGGGTAGCATTTTCTTA | GGGAGCTT | chr12 | 21590063 | 21590082 | 21590066 | - |
| SEQ ID NO 21338 | CTGTGGGTGGGGGATGTCAG | CAGAGCTT | chr12 | 21589941 | 21589960 | 21589944 | - |
| SEQ ID NO 21339 | TTCTCTGGAGCAATGCCTTT | GTGCGATT | chr12 | 21589784 | 21589803 | 21589787 | - |
| SEQ ID NO 21340 | GTCAAGGGACTCTCCTGTGG | CTAGGATT | chr12 | 21589718 | 21589737 | 21589721 | - |
| SEQ ID NO 21341 | TCACAGAGGATCCCTACTGG | GTAGGCTT | chr12 | 21589612 | 21589631 | 21589615 | - |
| SEQ ID NO 21342 | GATCCCTACTGGGTAGGCTT | CCTTGCTT | chr12 | 21589604 | 21589623 | 21589607 | - |
| SEQ ID NO 21343 | TCCCTCCCCTTCATTGCCTT | AGATGCTT | chr12 | 21589577 | 21589596 | 21589580 | - |
| SEQ ID NO 21344 | ATTCCAGAATTCTCTCTTAT | GTGGGATT | chr12 | 21589530 | 21589549 | 21589533 | - |
| SEQ ID NO 21345 | GCCCCTTCCCTTGAAATTTT | TTAAGCTT | chr12 | 21589434 | 21589453 | 21589437 | - |
| SEQ ID NO 21346 | CCCTTGAAATTTTTTAAGCT | TTATGTTT | chr12 | 21589427 | 21589446 | 21589430 | - |
| SEQ ID NO 21347 | AGAAGTAGCGAATTAGTTAA | CTATGTTT | chr12 | 21589311 | 21589330 | 21589314 | - |
| SEQ ID NO 21348 | TTCATTTCCCAAATCAAATC | ATTTGTTT | chr12 | 21589273 | 21589292 | 21589276 | - |
| SEQ ID NO 21349 | TTATGTTCTTCAGCAAATAA | AAATGTTT | chr12 | 21589217 | 21589236 | 21589220 | - |
| SEQ ID NO 21350 | ATACGTAATCTAACAAACAA | GGATGTTT | chr12 | 21589160 | 21589179 | 21589163 | - |
| SEQ ID NO 21351 | GATGCATAGTTGCAAATAAA | AGGAGTTT | chr12 | 21589116 | 21589135 | 21589119 | - |
| SEQ ID NO 21352 | AATTTTGCATTTTTGTGGAT | AGTGGTTT | chr12 | 21588964 | 21588983 | 21588967 | - |
| SEQ ID NO 21353 | TTGTGGATAGTGGTTTTGAA | GAAAGCTT | chr12 | 21588952 | 21588971 | 21588955 | - |
| SEQ ID NO 21354 | TAGTTGCCCTTGCAAATTGG | CTAAGTTT | chr12 | 21588862 | 21588881 | 21588865 | - |
| SEQ ID NO 21355 | TTTCCTCAACAAATAATTTT | GATGGTTT | chr12 | 21588831 | 21588850 | 21588834 | - |
| SEQ ID NO 21356 | ATGACATCAATTTATGTTAA | CTTAGATT | chr12 | 21588761 | 21588780 | 21588764 | - |
| SEQ ID NO 21357 | TGTCTGTTCTTGTCCAGTCT | AGAAGTTT | chr12 | 21588708 | 21588727 | 21588711 | - |
| SEQ ID NO 21358 | TTCTTGTCCAGTCTAGAAGT | TTCTGCTT | chr12 | 21588702 | 21588721 | 21588705 | - |
| SEQ ID NO 21359 | CTCATCACATAACATCTGAA | CTGTGATT | chr12 | 21588650 | 21588669 | 21588653 | - |
| SEQ ID NO 21360 | ATTATCAGACTCTGCTCAAT | GACAGTTT | chr12 | 21588609 | 21588628 | 21588612 | - |
| SEQ ID NO 21361 | AGATGAAATTCTTAAGGACA | ATTAGCTT | chr12 | 21588544 | 21588563 | 21588547 | - |
| SEQ ID NO 21362 | CTTGTGTAGACTCATATGAA | AATTGCTT | chr12 | 21588519 | 21588538 | 21588522 | - |
| SEQ ID NO 21363 | ATGAAGTTCTACTTTGTGAC | CATTGATT | chr12 | 21588332 | 21588351 | 21588335 | - |
| SEQ ID NO 21364 | ACCATTGATTGTGACTATTG | ATAAGATT | chr12 | 21588314 | 21588333 | 21588317 | - |
| SEQ ID NO 21365 | CTGTAGTCTGATGAAATGGA | ATATGTTT | chr12 | 21588225 | 21588244 | 21588228 | - |
| SEQ ID NO 21366 | AAGTAATATATAAGTAATAA | AATTGCTT | chr12 | 21588173 | 21588192 | 21588176 | - |
| SEQ ID NO 21367 | ATTGCTTTTTGCAATTGAGT | TGAAGATT | chr12 | 21588152 | 21588171 | 21588155 | - |
| SEQ ID NO 21368 | ATGCCAGGATCTTATTACCT | CCAGGATT | chr12 | 21588123 | 21588142 | 21588126 | - |
| SEQ ID NO 21369 | TATTACCTCCAGGATTTCAC | AAAGGATT | chr12 | 21588111 | 21588130 | 21588114 | - |
| SEQ ID NO 21370 | AAAGTATTGCTCAAGTAATC | GACAGATT | chr12 | 21588050 | 21588069 | 21588053 | - |
| SEQ ID NO 21371 | GATTATTTGTGTATTCTCAC | ATGTGATT | chr12 | 21588026 | 21588045 | 21588029 | - |
| SEQ ID NO 21372 | TGTCACGGGAAATATCCTGC | CTAAGTTT | chr12 | 21587986 | 21588005 | 21587989 | - |
| SEQ ID NO 21373 | TCTTTCCTTGCACACTCTAC | TCCAGCTT | chr12 | 21587889 | 21587908 | 21587892 | - |
| SEQ ID NO 21374 | AATTACCCATTAAGTGATA | TTTTGCTT | chr12 | 21587782 | 21587801 | 21587785 | - |
| SEQ ID NO 21375 | TATGTACTAGTTCGTTATCA | TGCTGCTT | chr12 | 21587680 | 21587699 | 21587683 | - |
| SEQ ID NO 21376 | CTGGGTAATTTATAAGGAAA | AAACGTTT | chr12 | 21587634 | 21587653 | 21587637 | - |
| SEQ ID NO 21377 | TGCCAAGCAAAAGGGGGAAA | AGCCGCTT | chr12 | 21587500 | 21587519 | 21587503 | - |

Figure 47 (Cont'd)

| SEQ ID NO 21378 | GAGCATGAGAGTAACCTCCT | CTATGATT | chr12 | 21587431 | 21587450 | 21587434 | - |
| SEQ ID NO 21379 | CAAATCCCTCCCACAACACG | TGAGGATT | chr12 | 21587389 | 21587408 | 21587392 | - |
| SEQ ID NO 21380 | TATGGGAACTACAATTCAAG | ATGAGATT | chr12 | 21587362 | 21587381 | 21587365 | - |
| SEQ ID NO 21381 | ATGTTGCATAGTGGTGAAGT | CTGAGCTT | chr12 | 21587277 | 21587296 | 21587280 | - |
| SEQ ID NO 21382 | AGTGAATGTTGTATCCAATC | CGTAGTTT | chr12 | 21587228 | 21587247 | 21587231 | - |
| SEQ ID NO 21383 | TATTATTTCATTCTATATGT | CTATGCTT | chr12 | 21587148 | 21587167 | 21587151 | - |
| SEQ ID NO 21384 | TCTATATGTCTATGCTTACT | CATCGTTT | chr12 | 21587137 | 21587156 | 21587140 | - |
| SEQ ID NO 21385 | TCTCACTAAATGAGAACATA | CTGTGTTT | chr12 | 21587095 | 21587114 | 21587098 | - |
| SEQ ID NO 21386 | AGAACATACTGTGTTTGACT | TTCTGTTT | chr12 | 21587083 | 21587102 | 21587086 | - |
| SEQ ID NO 21387 | ATAATGTCCTCCAGTTCTAA | CCATGTTT | chr12 | 21587036 | 21587055 | 21587039 | - |
| SEQ ID NO 21388 | TAACCATGTTTCTAGAGAAG | ACATGATT | chr12 | 21587019 | 21587038 | 21587022 | - |
| SEQ ID NO 21389 | CGTCCATTGGTAGACATTTA | GGTTGATT | chr12 | 21586921 | 21586940 | 21586924 | - |
| SEQ ID NO 21390 | CTTTGGGTCCATACCCAGTA | GTGGGATT | chr12 | 21586817 | 21586836 | 21586820 | - |
| SEQ ID NO 21391 | CCATACCCAGTAGTGGGATT | GCAGGATT | chr12 | 21586809 | 21586828 | 21586812 | - |
| SEQ ID NO 21392 | ATTGCAGGATTGAATGGTAG | TTCTGTTT | chr12 | 21586792 | 21586811 | 21586795 | - |
| SEQ ID NO 21393 | AATCTTCATGCTGTCTTCCA | TAAAGTTT | chr12 | 21586750 | 21586769 | 21586753 | - |
| SEQ ID NO 21394 | TCCACATCCTCACCAACATC | TGCTGTTT | chr12 | 21586676 | 21586695 | 21586679 | - |
| SEQ ID NO 21395 | GGCATAAGGAGGTATCATAT | GGTGGTTT | chr12 | 21586618 | 21586637 | 21586621 | - |
| SEQ ID NO 21396 | TGGTGGTTTTAATTTGCATT | CTCTGATT | chr12 | 21586599 | 21586618 | 21586602 | - |
| SEQ ID NO 21397 | AGTGATGTTGAACTTTTTTT | TGACGTTT | chr12 | 21586568 | 21586587 | 21586571 | - |
| SEQ ID NO 21398 | TAGATAGATAGATAGATAGA | TATAGATT | chr12 | 21586422 | 21586441 | 21586425 | - |
| SEQ ID NO 21399 | ATATAGATTTAGATATAAAA | GGGAGTTT | chr12 | 21586403 | 21586422 | 21586406 | - |
| SEQ ID NO 21400 | AAGCTGAAGGACTTGGAGTC | CAATGTTT | chr12 | 21586289 | 21586308 | 21586292 | - |
| SEQ ID NO 21401 | ATCCAGCATGGGAGAAAGAT | GTAGGCTT | chr12 | 21586248 | 21586267 | 21586251 | - |
| SEQ ID NO 21402 | GGCTTGGAGGCTAAGCCAGT | CCAGGATT | chr12 | 21586225 | 21586244 | 21586228 | - |
| SEQ ID NO 21403 | TAAGCCAGTCCAGGATTTTC | ACATGTTT | chr12 | 21586214 | 21586233 | 21586217 | - |
| SEQ ID NO 21404 | TTTTCACATGTTTTTTTTCT | GCCTGCTT | chr12 | 21586199 | 21586218 | 21586202 | - |
| SEQ ID NO 21405 | TATATCCTGGCCACACTGGC | AACTGATT | chr12 | 21586171 | 21586190 | 21586174 | - |
| SEQ ID NO 21406 | AACTGATTAGATGGTGCCCA | CCCAGATT | chr12 | 21586151 | 21586170 | 21586154 | - |
| SEQ ID NO 21407 | AGTATTAACCATCACAAGTC | CATCGCTT | chr12 | 21586004 | 21586023 | 21586007 | - |
| SEQ ID NO 21408 | ACAAGTGTATACAGACACGA | AGGTGTTT | chr12 | 21585737 | 21585756 | 21585740 | - |
| SEQ ID NO 21409 | TCCTGCCTGGAATGGCCTGT | AGTAGTTT | chr12 | 21585509 | 21585528 | 21585512 | - |
| SEQ ID NO 21410 | GGATCTCCTATATTCCATGC | ATACGCTT | chr12 | 21585432 | 21585451 | 21585435 | - |
| SEQ ID NO 21411 | ACCTCCATTGTGGAGTTGTA | GACTGATT | chr12 | 21585400 | 21585419 | 21585403 | - |
| SEQ ID NO 21412 | TCCAGGTGGCAATCTTAATT | TGCAGTTT | chr12 | 21585283 | 21585302 | 21585286 | - |
| SEQ ID NO 21413 | CTTCCACTTCCACTTCCACC | CTTTGATT | chr12 | 21585113 | 21585132 | 21585116 | - |
| SEQ ID NO 21414 | AAACAGTACCATATATTGGA | CACTGATT | chr12 | 21585056 | 21585075 | 21585059 | - |
| SEQ ID NO 21415 | ACTTCAAAAGGCCATTCAAA | AGCTGCTT | chr12 | 21584951 | 21584970 | 21584954 | - |
| SEQ ID NO 21416 | ACTTCTTTAGCCATAAAGTG | AGTGGCTT | chr12 | 21584864 | 21584883 | 21584867 | - |
| SEQ ID NO 21417 | ATGACAGTGGATACGGCATT | CTGTGATT | chr12 | 21584808 | 21584827 | 21584811 | - |
| SEQ ID NO 21418 | TCTTGGCATAAGCATTGAGT | TCAGGATT | chr12 | 21584767 | 21584786 | 21584770 | - |
| SEQ ID NO 21419 | CCGAGGAATGGTGCCATATC | AAGGGCTT | chr12 | 21584625 | 21584644 | 21584628 | - |
| SEQ ID NO 21420 | CAAGCAGTGGCTGTGGCCAG | GTCAGCTT | chr12 | 21584576 | 21584595 | 21584579 | - |
| SEQ ID NO 21421 | CAGAATTGATCATCCTATCC | ACTTGATT | chr12 | 21584423 | 21584442 | 21584426 | - |
| SEQ ID NO 21422 | ACATGGGATGAAAATATCTT | TGTAGTTT | chr12 | 21584352 | 21584371 | 21584355 | - |
| SEQ ID NO 21423 | CTTTGTCATCAATTTTCCAG | TCATGCTT | chr12 | 21584279 | 21584298 | 21584282 | - |
| SEQ ID NO 21424 | GCTCAAAGTTCTGCCAACTA | GGAAGATT | chr12 | 21584139 | 21584158 | 21584142 | - |
| SEQ ID NO 21425 | TGATGACTCATAGTCAAATA | TTTCGTTT | chr12 | 21583722 | 21583741 | 21583725 | - |
| SEQ ID NO 21426 | CCAAAGCCCAGTAACAGGCC | AAGAGCTT | chr12 | 21583691 | 21583710 | 21583694 | - |

Figure 47 (Cont'd)

| | | | | | | | |
|---|---|---|---|---|---|---|---|
| SEQ ID NO 21427 | CAAAATCCTAGAGGCCTCCG | CTGTGATT | chr12 | 21583614 | 21583633 | 21583617 | - |
| SEQ ID NO 21428 | TCATATGGCCCAAGTGGCAT | AGCAGCTT | chr12 | 21583515 | 21583534 | 21583518 | - |
| SEQ ID NO 21429 | GTAGAAGGTCCCTGAATTTA | ATCAGATT | chr12 | 21583227 | 21583246 | 21583230 | - |
| SEQ ID NO 21430 | ATGTCTCATCAATAAATCCA | GTGTGTTT | chr12 | 21583175 | 21583194 | 21583178 | - |
| SEQ ID NO 21431 | GGTGAGCAAGTTCTCTCCAA | ATAAGATT | chr12 | 21583071 | 21583090 | 21583074 | - |
| SEQ ID NO 21432 | CCAACCAACTTCACTATGTT | CCTTGATT | chr12 | 21582963 | 21582982 | 21582966 | - |
| SEQ ID NO 21433 | ACTCTCTAAACAATTGATGC | CAAGGATT | chr12 | 21582838 | 21582857 | 21582841 | - |
| SEQ ID NO 21434 | CTCTATATCTATATCTATAT | GAGAGTTT | chr12 | 21582563 | 21582582 | 21582566 | - |
| SEQ ID NO 21435 | TAGCCTTTTCACATTTTTCT | GCCTGCTT | chr12 | 21582364 | 21582383 | 21582367 | - |
| SEQ ID NO 21436 | TATATCCTGGCTGTGCTGGC | AACTGATT | chr12 | 21582336 | 21582355 | 21582339 | - |
| SEQ ID NO 21437 | AACTGATTAGATGGTGCCCA | CCCAGATT | chr12 | 21582316 | 21582335 | 21582319 | - |
| SEQ ID NO 21438 | CACAGTCACTTTCTAATGAG | GTTGGTTT | chr12 | 21582157 | 21582176 | 21582160 | - |
| SEQ ID NO 21439 | TTTTTTGTTGTTGAGTTCCT | TGTAGATT | chr12 | 21582131 | 21582150 | 21582134 | - |
| SEQ ID NO 21440 | TATTAGCCTTTTGTTGCATT | CATAGTTT | chr12 | 21582098 | 21582117 | 21582101 | - |
| SEQ ID NO 21441 | TTTTTCTCATTCTGTAGGTT | ATCCGTTT | chr12 | 21582062 | 21582081 | 21582065 | - |
| SEQ ID NO 21442 | TGTAGGTTATCCGTTTACTC | TGTTGATT | chr12 | 21582050 | 21582069 | 21582053 | - |
| SEQ ID NO 21443 | CTTTTGCGGTGCAGAAGCAT | TTTAGTTT | chr12 | 21582018 | 21582037 | 21582021 | - |
| SEQ ID NO 21444 | AGTTTAATTAAGTCCCATTT | GTCTGTTT | chr12 | 21581995 | 21582014 | 21581998 | - |
| SEQ ID NO 21445 | ATTAAGTCCCATTTGTCTGT | TTTTGTTT | chr12 | 21581989 | 21582008 | 21581992 | - |
| SEQ ID NO 21446 | TTTGTCTGTTTTTGTTTTTG | TTGTGTTT | chr12 | 21581978 | 21581997 | 21581981 | - |
| SEQ ID NO 21447 | CTGTTTTTGTTTTTGTTGTG | TTTAGTTT | chr12 | 21581973 | 21581992 | 21581976 | - |
| SEQ ID NO 21448 | AAGTTGACTAGTTCAGTGTA | AGTTGTTT | chr12 | 21581806 | 21581825 | 21581809 | - |
| SEQ ID NO 21449 | TTTCTAATTTTTTGCCATCA | TAATGCTT | chr12 | 21581781 | 21581800 | 21581784 | - |
| SEQ ID NO 21450 | TCTCCTTAATTTTCCCCCAG | GATGGTTT | chr12 | 21581732 | 21581751 | 21581735 | - |
| SEQ ID NO 21451 | TTCCAAATGTATCCATATAT | TGTGGCTT | chr12 | 21581666 | 21581685 | 21581669 | - |
| SEQ ID NO 21452 | TGTATCCATATATTGTGGCT | TTGTGTTT | chr12 | 21581659 | 21581678 | 21581662 | - |
| SEQ ID NO 21453 | TATTAGAGGAGAGAATTAAG | GAACGATT | chr12 | 21581613 | 21581632 | 21581616 | - |
| SEQ ID NO 21454 | AGACACCGAGTTAAAGAAGG | AAGGGCTT | chr12 | 21581549 | 21581568 | 21581552 | - |
| SEQ ID NO 21455 | AGGAAGGGCTTTATTCGGCT | GGGAGCTT | chr12 | 21581532 | 21581551 | 21581535 | - |
| SEQ ID NO 21456 | GAGCAATTCCTGTCCCTTTT | AAGGGCTT | chr12 | 21581465 | 21581484 | 21581468 | - |
| SEQ ID NO 21457 | CAGAATGGAACAGAACAGGA | CAGGGATT | chr12 | 21581391 | 21581410 | 21581394 | - |
| SEQ ID NO 21458 | GAACAGGACAGGGATTTTCA | CACTGCTT | chr12 | 21581379 | 21581398 | 21581382 | - |
| SEQ ID NO 21459 | AGGCCCAGGATGTGGTCTCA | GGCTGTTT | chr12 | 21581287 | 21581306 | 21581290 | - |
| SEQ ID NO 21460 | GTGGTCTCAGGCTGTTTGCC | TGTGGATT | chr12 | 21581276 | 21581295 | 21581279 | - |
| SEQ ID NO 21461 | TGTGGATTTCATTTCTGCCT | TTTAGTTT | chr12 | 21581256 | 21581275 | 21581259 | - |
| SEQ ID NO 21462 | ATGAAATACGTATTTGTGTT | ATTGGATT | chr12 | 21581134 | 21581153 | 21581137 | - |
| SEQ ID NO 21463 | GTTCTCCTTATCAAAAGGTA | CTTTGCTT | chr12 | 21581059 | 21581078 | 21581062 | - |
| SEQ ID NO 21464 | TTATCAAAAGGTACTTTGCT | TGGTGCTT | chr12 | 21581052 | 21581071 | 21581055 | - |
| SEQ ID NO 21465 | CTTTAAAAGATAAATGACTA | TGTAGCTT | chr12 | 21581027 | 21581046 | 21581030 | - |
| SEQ ID NO 21466 | GATAAATGACTATGTAGCTT | AGGAGATT | chr12 | 21581019 | 21581038 | 21581022 | - |
| SEQ ID NO 21467 | AGAAGGAGGAAGAGAGGTGA | AAGTGATT | chr12 | 21580923 | 21580942 | 21580926 | - |
| SEQ ID NO 21468 | CTTTGACACTACAAAGTGAC | TGGAGCTT | chr12 | 21580850 | 21580869 | 21580853 | - |
| SEQ ID NO 21469 | TTTGAAAGGTAAATAAATCC | TTGGGCTT | chr12 | 21580639 | 21580658 | 21580642 | - |
| SEQ ID NO 21470 | AACAGTTGGAGGCATCTATA | CTGTGATT | chr12 | 21580509 | 21580528 | 21580512 | - |

Figure 48

| # | Sequence | PAM | Chr | Start | End | Cut site 1 (5' of) | Cut site 2 (5' of) | Str |
|---|---|---|---|---|---|---|---|---|
| SEQ ID NO 21471 | GCAGCCATGCTTATTCATTGCG | CTG | chr12 | 21580345 | 21580366 | 21580362 | 21580367 | + |
| SEQ ID NO 21472 | ATTCATTGCGTCCACTGCTCTT | CTT | chr12 | 21580357 | 21580378 | 21580374 | 21580379 | + |
| SEQ ID NO 21473 | TTCATTGCGTCCACTGCTCTTC | TTA | chr12 | 21580358 | 21580379 | 21580375 | 21580380 | + |
| SEQ ID NO 21474 | ATTGCGTCCACTGCTCTTCTGA | TTC | chr12 | 21580361 | 21580382 | 21580378 | 21580383 | + |
| SEQ ID NO 21475 | CGTCCACTGCTCTTCTGACAGC | TTG | chr12 | 21580365 | 21580386 | 21580382 | 21580387 | + |
| SEQ ID NO 21476 | CTCTTCTGACAGCATCATTTAC | CTG | chr12 | 21580374 | 21580395 | 21580391 | 21580396 | + |
| SEQ ID NO 21477 | TTCTGACAGCATCATTTACAGG | CTC | chr12 | 21580377 | 21580398 | 21580394 | 21580399 | + |
| SEQ ID NO 21478 | CTGACAGCATCATTTACAGGTT | CTT | chr12 | 21580379 | 21580400 | 21580396 | 21580401 | + |
| SEQ ID NO 21479 | TGACAGCATCATTTACAGGTTC | TTC | chr12 | 21580380 | 21580401 | 21580397 | 21580402 | + |
| SEQ ID NO 21480 | ACAGCATCATTTACAGGTTCAC | CTG | chr12 | 21580382 | 21580403 | 21580399 | 21580404 | + |
| SEQ ID NO 21481 | ACAGGTTCACACTGTTCCACCT | TTT | chr12 | 21580394 | 21580415 | 21580411 | 21580416 | + |
| SEQ ID NO 21482 | CAGGTTCACACTGTTCCACCTG | TTA | chr12 | 21580395 | 21580416 | 21580412 | 21580417 | + |
| SEQ ID NO 21483 | ACACTGTTCCACCTGAGTCTTC | TTC | chr12 | 21580402 | 21580423 | 21580419 | 21580424 | + |
| SEQ ID NO 21484 | TTCCACCTGAGTCTTCATATTA | CTG | chr12 | 21580408 | 21580429 | 21580425 | 21580430 | + |
| SEQ ID NO 21485 | CACCTGAGTCTTCATATTATGC | TTC | chr12 | 21580411 | 21580432 | 21580428 | 21580433 | + |
| SEQ ID NO 21486 | AGTCTTCATATTATGCTCAAAA | CTG | chr12 | 21580417 | 21580438 | 21580434 | 21580439 | + |
| SEQ ID NO 21487 | CATATTATGCTCAAAATATGGA | CTT | chr12 | 21580423 | 21580444 | 21580440 | 21580445 | + |
| SEQ ID NO 21488 | ATATTATGCTCAAAATATGGAC | TTC | chr12 | 21580424 | 21580445 | 21580441 | 21580446 | + |
| SEQ ID NO 21489 | TGCTCAAAATATGGACCTATCA | TTA | chr12 | 21580430 | 21580451 | 21580447 | 21580452 | + |
| SEQ ID NO 21490 | AAAATATGGACCTATCAGAAAA | CTC | chr12 | 21580435 | 21580456 | 21580452 | 21580457 | + |
| SEQ ID NO 21491 | TCAGAAAATAGTTCTCTCCCCA | CTA | chr12 | 21580449 | 21580470 | 21580466 | 21580471 | + |
| SEQ ID NO 21492 | TCTCCCCATTCATCTGCTGTTG | TTC | chr12 | 21580463 | 21580484 | 21580480 | 21580485 | + |
| SEQ ID NO 21493 | TCCCCATTCATCTGCTGTTGTT | CTC | chr12 | 21580465 | 21580486 | 21580482 | 21580487 | + |
| SEQ ID NO 21494 | CCCATTCATCTGCTGTTGTTTT | CTC | chr12 | 21580467 | 21580488 | 21580484 | 21580489 | + |
| SEQ ID NO 21495 | ATCTGCTGTTGTTTTGGCCTTT | TTC | chr12 | 21580474 | 21580495 | 21580491 | 21580496 | + |
| SEQ ID NO 21496 | CTGTTGTTTTGGCCTTTGTCTG | CTG | chr12 | 21580479 | 21580500 | 21580496 | 21580501 | + |
| SEQ ID NO 21497 | TTGTTTTGGCCTTTGTCTGAAT | CTG | chr12 | 21580482 | 21580503 | 21580499 | 21580504 | + |
| SEQ ID NO 21498 | TTTTGGCCTTTGTCTGAATCAC | TTG | chr12 | 21580485 | 21580506 | 21580502 | 21580507 | + |
| SEQ ID NO 21499 | TGGCCTTTGTCTGAATCACAGT | TTT | chr12 | 21580488 | 21580509 | 21580505 | 21580510 | + |
| SEQ ID NO 21500 | GGCCTTTGTCTGAATCACAGTA | TTT | chr12 | 21580489 | 21580510 | 21580506 | 21580511 | + |
| SEQ ID NO 21501 | GCCTTTGTCTGAATCACAGTAT | TTG | chr12 | 21580490 | 21580511 | 21580507 | 21580512 | + |
| SEQ ID NO 21502 | TGTCTGAATCACAGTATAGATG | CTT | chr12 | 21580495 | 21580516 | 21580512 | 21580517 | + |
| SEQ ID NO 21503 | GTCTGAATCACAGTATAGATGC | TTT | chr12 | 21580496 | 21580517 | 21580513 | 21580518 | + |
| SEQ ID NO 21504 | TCTGAATCACAGTATAGATGCC | TTG | chr12 | 21580497 | 21580518 | 21580514 | 21580519 | + |
| SEQ ID NO 21505 | AATCACAGTATAGATGCCTCCA | CTG | chr12 | 21580501 | 21580522 | 21580518 | 21580523 | + |
| SEQ ID NO 21506 | CAACTGTTAAAAGGAAAAAAGT | CTC | chr12 | 21580521 | 21580542 | 21580538 | 21580543 | + |
| SEQ ID NO 21507 | TTAAAAGGAAAAAAGTTTCTAT | CTG | chr12 | 21580527 | 21580548 | 21580544 | 21580549 | + |
| SEQ ID NO 21508 | AAAGGAAAAAAGTTTCTATTAT | TTA | chr12 | 21580530 | 21580551 | 21580547 | 21580552 | + |
| SEQ ID NO 21509 | CTATTATCATTCAGGTTAGCAA | TTT | chr12 | 21580545 | 21580566 | 21580562 | 21580567 | + |
| SEQ ID NO 21510 | TATTATCATTCAGGTTAGCAAT | TTC | chr12 | 21580546 | 21580567 | 21580563 | 21580568 | + |
| SEQ ID NO 21511 | TTATCATTCAGGTTAGCAATTT | CTA | chr12 | 21580548 | 21580569 | 21580565 | 21580570 | + |
| SEQ ID NO 21512 | TCATTCAGGTTAGCAATTTGTT | TTA | chr12 | 21580551 | 21580572 | 21580568 | 21580573 | + |
| SEQ ID NO 21513 | AGGTTAGCAATTTGTTTAAAGT | TTC | chr12 | 21580557 | 21580578 | 21580574 | 21580579 | + |
| SEQ ID NO 21514 | GCAATTTGTTTAAAGTAATAAG | TTA | chr12 | 21580563 | 21580584 | 21580580 | 21580585 | + |
| SEQ ID NO 21515 | GTTTAAAGTAATAAGGGATGGA | TTT | chr12 | 21580570 | 21580591 | 21580587 | 21580592 | + |
| SEQ ID NO 21516 | TTTAAAGTAATAAGGGATGGAA | TTG | chr12 | 21580571 | 21580592 | 21580588 | 21580593 | + |
| SEQ ID NO 21517 | AAAGTAATAAGGGATGGAAATG | TTT | chr12 | 21580574 | 21580595 | 21580591 | 21580596 | + |
| SEQ ID NO 21518 | AAGTAATAAGGGATGGAAATGA | TTA | chr12 | 21580575 | 21580596 | 21580592 | 21580597 | + |
| SEQ ID NO 21519 | AGATTTTTAAATTAGCATTTAG | TTC | chr12 | 21580601 | 21580622 | 21580618 | 21580623 | + |
| SEQ ID NO 21520 | TTAAATTAGCATTTAGGATCCA | TTT | chr12 | 21580607 | 21580628 | 21580624 | 21580629 | + |
| SEQ ID NO 21521 | TAAATTAGCATTTAGGATCCAC | TTT | chr12 | 21580608 | 21580629 | 21580625 | 21580630 | + |
| SEQ ID NO 21522 | AAATTAGCATTTAGGATCCACT | TTT | chr12 | 21580609 | 21580630 | 21580626 | 21580631 | + |
| SEQ ID NO 21523 | AATTAGCATTTAGGATCCACTA | TTA | chr12 | 21580610 | 21580631 | 21580627 | 21580632 | + |
| SEQ ID NO 21524 | GCATTTAGGATCCACTAAGCCC | TTA | chr12 | 21580615 | 21580636 | 21580632 | 21580637 | + |
| SEQ ID NO 21525 | AGGATCCACTAAGCCCAAGGAT | TTT | chr12 | 21580621 | 21580642 | 21580638 | 21580643 | + |
| SEQ ID NO 21526 | GGATCCACTAAGCCCAAGGATT | TTA | chr12 | 21580622 | 21580643 | 21580639 | 21580644 | + |
| SEQ ID NO 21527 | AGCCCAAGGATTTATTTACCTT | CTA | chr12 | 21580632 | 21580653 | 21580649 | 21580654 | + |

Figure 48 (Cont'd)

| SEQ ID NO | Sequence | | Chr | Pos1 | Pos2 | Pos3 | Pos4 | Strand |
|---|---|---|---|---|---|---|---|---|
| SEQ ID NO 21528 | ATTTACCTTTCAAAAATAATAG | TTT | chr12 | 21580645 | 21580666 | 21580662 | 21580667 | + |
| SEQ ID NO 21529 | TTTACCTTTCAAAAATAATAGT | TTA | chr12 | 21580646 | 21580667 | 21580663 | 21580668 | + |
| SEQ ID NO 21530 | ACCTTTCAAAAATAATAGTATT | TTT | chr12 | 21580649 | 21580670 | 21580666 | 21580671 | + |
| SEQ ID NO 21531 | CCTTTCAAAAATAATAGTATTT | TTA | chr12 | 21580650 | 21580671 | 21580667 | 21580672 | + |
| SEQ ID NO 21532 | TCAAAAATAATAGTATTTGACA | CTT | chr12 | 21580654 | 21580675 | 21580671 | 21580676 | + |
| SEQ ID NO 21533 | CAAAAATAATAGTATTTGACAT | TTT | chr12 | 21580655 | 21580676 | 21580672 | 21580677 | + |
| SEQ ID NO 21534 | AAAAATAATAGTATTTGACATA | TTC | chr12 | 21580656 | 21580677 | 21580673 | 21580678 | + |
| SEQ ID NO 21535 | GACATATTGTTAAGGGACACCA | TTT | chr12 | 21580672 | 21580693 | 21580689 | 21580694 | + |
| SEQ ID NO 21536 | ACATATTGTTAAGGGACACCAA | TTG | chr12 | 21580673 | 21580694 | 21580690 | 21580695 | + |
| SEQ ID NO 21537 | TTAAGGGACACCAACGAATGGT | TTG | chr12 | 21580681 | 21580702 | 21580698 | 21580703 | + |
| SEQ ID NO 21538 | AGGGACACCAACGAATGGTTAC | TTA | chr12 | 21580684 | 21580705 | 21580701 | 21580706 | + |
| SEQ ID NO 21539 | CTGCTTTGTTCAATTCTGTGCA | TTA | chr12 | 21580705 | 21580726 | 21580722 | 21580727 | + |
| SEQ ID NO 21540 | CTTTGTTCAATTCTGTGCATGT | CTG | chr12 | 21580708 | 21580729 | 21580725 | 21580730 | + |
| SEQ ID NO 21541 | TGTTCAATTCTGTGCATGTTTT | CTT | chr12 | 21580711 | 21580732 | 21580728 | 21580733 | + |
| SEQ ID NO 21542 | GTTCAATTCTGTGCATGTTTTA | TTT | chr12 | 21580712 | 21580733 | 21580729 | 21580734 | + |
| SEQ ID NO 21543 | TTCAATTCTGTGCATGTTTTAA | TTG | chr12 | 21580713 | 21580734 | 21580730 | 21580735 | + |
| SEQ ID NO 21544 | AATTCTGTGCATGTTTTAAAGT | TTC | chr12 | 21580716 | 21580737 | 21580733 | 21580738 | + |
| SEQ ID NO 21545 | TGTGCATGTTTTAAAGTCCCTT | TTC | chr12 | 21580721 | 21580742 | 21580738 | 21580743 | + |
| SEQ ID NO 21546 | TGCATGTTTTAAAGTCCCTTCT | CTG | chr12 | 21580723 | 21580744 | 21580740 | 21580745 | + |
| SEQ ID NO 21547 | TAAAGTCCCTTCTAGGTGCATG | TTT | chr12 | 21580732 | 21580753 | 21580749 | 21580754 | + |
| SEQ ID NO 21548 | AAAGTCCCTTCTAGGTGCATGT | TTT | chr12 | 21580733 | 21580754 | 21580750 | 21580755 | + |
| SEQ ID NO 21549 | AAGTCCCTTCTAGGTGCATGTG | TTA | chr12 | 21580734 | 21580755 | 21580751 | 21580756 | + |
| SEQ ID NO 21550 | CTAGGTGCATGTGAAATAGCAG | CTT | chr12 | 21580743 | 21580764 | 21580760 | 21580765 | + |
| SEQ ID NO 21551 | TAGGTGCATGTGAAATAGCAGC | TTC | chr12 | 21580744 | 21580765 | 21580761 | 21580766 | + |
| SEQ ID NO 21552 | GGTGCATGTGAAATAGCAGCAG | CTA | chr12 | 21580746 | 21580767 | 21580763 | 21580768 | + |
| SEQ ID NO 21553 | ATGCCGCAAAGAGGTCAAATAC | CTG | chr12 | 21580772 | 21580793 | 21580789 | 21580794 | + |
| SEQ ID NO 21554 | AAAAGAAAGAGTCTGAAAAGA | CTC | chr12 | 21580797 | 21580818 | 21580814 | 21580819 | + |
| SEQ ID NO 21555 | AAAAGACAATTGGAGTAACTAC | CTG | chr12 | 21580813 | 21580834 | 21580830 | 21580835 | + |
| SEQ ID NO 21556 | GAGTAACTACTTGCCTAAAGCT | TTG | chr12 | 21580825 | 21580846 | 21580842 | 21580847 | + |
| SEQ ID NO 21557 | CTTGCCTAAAGCTCCAGTCACT | CTA | chr12 | 21580834 | 21580855 | 21580851 | 21580856 | + |
| SEQ ID NO 21558 | GCCTAAAGCTCCAGTCACTTTG | CTT | chr12 | 21580837 | 21580858 | 21580854 | 21580859 | + |
| SEQ ID NO 21559 | CCTAAAGCTCCAGTCACTTTGT | TTG | chr12 | 21580838 | 21580859 | 21580855 | 21580860 | + |
| SEQ ID NO 21560 | AAGCTCCAGTCACTTTGTAGTG | CTA | chr12 | 21580842 | 21580863 | 21580859 | 21580864 | + |
| SEQ ID NO 21561 | CAGTCACTTTGTAGTGTCAAAG | CTC | chr12 | 21580848 | 21580869 | 21580865 | 21580870 | + |
| SEQ ID NO 21562 | TGTAGTGTCAAAGTTAGGACAA | CTT | chr12 | 21580857 | 21580878 | 21580874 | 21580879 | + |
| SEQ ID NO 21563 | GTAGTGTCAAAGTTAGGACAAA | TTT | chr12 | 21580858 | 21580879 | 21580875 | 21580880 | + |
| SEQ ID NO 21564 | TAGTGTCAAAGTTAGGACAAAT | TTG | chr12 | 21580859 | 21580880 | 21580876 | 21580881 | + |
| SEQ ID NO 21565 | GGACAAATACCCATTGTCATCA | TTA | chr12 | 21580873 | 21580894 | 21580890 | 21580895 | + |
| SEQ ID NO 21566 | TCATCATACATGCCCTCAGCAG | TTG | chr12 | 21580889 | 21580910 | 21580906 | 21580911 | + |
| SEQ ID NO 21567 | AGCAGCAGAAATCACTTTCACC | CTC | chr12 | 21580906 | 21580927 | 21580923 | 21580928 | + |
| SEQ ID NO 21568 | TCACCTCTCTTCCTCCTTCTCC | CTT | chr12 | 21580923 | 21580944 | 21580940 | 21580945 | + |
| SEQ ID NO 21569 | CACCTCTCTTCCTCCTTCTCCT | TTT | chr12 | 21580924 | 21580945 | 21580941 | 21580946 | + |
| SEQ ID NO 21570 | ACCTCTCTTCCTCCTTCTCCTA | TTC | chr12 | 21580925 | 21580946 | 21580942 | 21580947 | + |
| SEQ ID NO 21571 | TCTTCCTCCTTCTCCTACAGTG | CTC | chr12 | 21580930 | 21580951 | 21580947 | 21580952 | + |
| SEQ ID NO 21572 | TTCCTCCTTCTCCTACAGTGGT | CTC | chr12 | 21580932 | 21580953 | 21580949 | 21580954 | + |
| SEQ ID NO 21573 | CCTCCTTCTCCTACAGTGGTCC | CTT | chr12 | 21580934 | 21580955 | 21580951 | 21580956 | + |
| SEQ ID NO 21574 | CTCCTTCTCCTACAGTGGTCCA | TTC | chr12 | 21580935 | 21580956 | 21580952 | 21580957 | + |
| SEQ ID NO 21575 | CTTCTCCTACAGTGGTCCAGAA | CTC | chr12 | 21580938 | 21580959 | 21580955 | 21580960 | + |
| SEQ ID NO 21576 | CTCCTACAGTGGTCCAGAAGGG | CTT | chr12 | 21580941 | 21580962 | 21580958 | 21580963 | + |
| SEQ ID NO 21577 | TCCTACAGTGGTCCAGAAGGGG | TTC | chr12 | 21580942 | 21580963 | 21580959 | 21580964 | + |
| SEQ ID NO 21578 | CTACAGTGGTCCAGAAGGGGCT | CTC | chr12 | 21580944 | 21580965 | 21580961 | 21580966 | + |
| SEQ ID NO 21579 | CAGTGGTCCAGAAGGGGCTCAG | CTA | chr12 | 21580947 | 21580968 | 21580964 | 21580969 | + |
| SEQ ID NO 21580 | AGGTATGTTCAAATAACAGCTG | CTC | chr12 | 21580967 | 21580988 | 21580984 | 21580989 | + |
| SEQ ID NO 21581 | AAATAACAGCTGCTGTGGTTTT | TTC | chr12 | 21580977 | 21580998 | 21580994 | 21580999 | + |
| SEQ ID NO 21582 | CTGTGGTTTTCAATTATGAAGA | CTG | chr12 | 21580989 | 21581010 | 21581006 | 21581011 | + |
| SEQ ID NO 21583 | TGGTTTTCAATTATGAAGAAAT | CTG | chr12 | 21580992 | 21581013 | 21581009 | 21581014 | + |
| SEQ ID NO 21584 | TCAATTATGAAGAAATCTCCTA | TTT | chr12 | 21580998 | 21581019 | 21581015 | 21581020 | + |
| SEQ ID NO 21585 | CAATTATGAAGAAATCTCCTAA | TTT | chr12 | 21580999 | 21581020 | 21581016 | 21581021 | + |

Figure 48 (Cont'd)

| SEQ ID NO 21586 | AATTATGAAGAAATCTCCTAAG | TTC | chr12 | 21581000 | 21581021 | 21581017 | 21581022 | + |
| SEQ ID NO 21587 | TGAAGAAATCTCCTAAGCTACA | TTA | chr12 | 21581005 | 21581026 | 21581022 | 21581027 | + |
| SEQ ID NO 21588 | CTAAGCTACATAGTCATTTATC | CTC | chr12 | 21581017 | 21581038 | 21581034 | 21581039 | + |
| SEQ ID NO 21589 | AGCTACATAGTCATTTATCTTT | CTA | chr12 | 21581020 | 21581041 | 21581037 | 21581042 | + |
| SEQ ID NO 21590 | CATAGTCATTTATCTTTTAAAG | CTA | chr12 | 21581025 | 21581046 | 21581042 | 21581047 | + |
| SEQ ID NO 21591 | ATCTTTTAAAGCACCAAGCAAA | TTT | chr12 | 21581036 | 21581057 | 21581053 | 21581058 | + |
| SEQ ID NO 21592 | TCTTTTAAAGCACCAAGCAAAG | TTA | chr12 | 21581037 | 21581058 | 21581054 | 21581059 | + |
| SEQ ID NO 21593 | TTAAAGCACCAAGCAAAGTACC | CTT | chr12 | 21581041 | 21581062 | 21581058 | 21581063 | + |
| SEQ ID NO 21594 | TAAAGCACCAAGCAAAGTACCT | TTT | chr12 | 21581042 | 21581063 | 21581059 | 21581064 | + |
| SEQ ID NO 21595 | AAAGCACCAAGCAAAGTACCTT | TTT | chr12 | 21581043 | 21581064 | 21581060 | 21581065 | + |
| SEQ ID NO 21596 | AAGCACCAAGCAAAGTACCTTT | TTA | chr12 | 21581044 | 21581065 | 21581061 | 21581066 | + |
| SEQ ID NO 21597 | TTGATAAGGAGAACGTGCTTAT | CTT | chr12 | 21581065 | 21581086 | 21581082 | 21581087 | + |
| SEQ ID NO 21598 | TGATAAGGAGAACGTGCTTATA | TTT | chr12 | 21581066 | 21581087 | 21581083 | 21581088 | + |
| SEQ ID NO 21599 | GATAAGGAGAACGTGCTTATAG | TTT | chr12 | 21581067 | 21581088 | 21581084 | 21581089 | + |
| SEQ ID NO 21600 | ATAAGGAGAACGTGCTTATAGA | TTG | chr12 | 21581068 | 21581089 | 21581085 | 21581090 | + |
| SEQ ID NO 21601 | ATAGATGTTCATAGAAGATGCT | CTT | chr12 | 21581085 | 21581106 | 21581102 | 21581107 | + |
| SEQ ID NO 21602 | TAGATGTTCATAGAAGATGCTT | TTA | chr12 | 21581086 | 21581107 | 21581103 | 21581108 | + |
| SEQ ID NO 21603 | ATAGAAGATGCTTGGTCCAACC | TTC | chr12 | 21581095 | 21581116 | 21581112 | 21581117 | + |
| SEQ ID NO 21604 | GGTCCAACCCCGATGTCAAATC | CTT | chr12 | 21581108 | 21581129 | 21581125 | 21581130 | + |
| SEQ ID NO 21605 | GTCCAACCCCGATGTCAAATCC | TTG | chr12 | 21581109 | 21581130 | 21581126 | 21581131 | + |
| SEQ ID NO 21606 | CATTCTCACATGGTATTTCTCT | TTT | chr12 | 21581151 | 21581172 | 21581168 | 21581173 | + |
| SEQ ID NO 21607 | ATTCTCACATGGTATTTCTCTC | TTC | chr12 | 21581152 | 21581173 | 21581169 | 21581174 | + |
| SEQ ID NO 21608 | TCACATGGTATTTCTCTCTTCC | TTC | chr12 | 21581156 | 21581177 | 21581173 | 21581178 | + |
| SEQ ID NO 21609 | ACATGGTATTTCTCTCTTCCTA | CTC | chr12 | 21581158 | 21581179 | 21581175 | 21581180 | + |
| SEQ ID NO 21610 | CTCTCTTCCTAGTAAGGGAGGA | TTT | chr12 | 21581169 | 21581190 | 21581186 | 21581191 | + |
| SEQ ID NO 21611 | TCTCTTCCTAGTAAGGGAGGAG | TTC | chr12 | 21581170 | 21581191 | 21581187 | 21581192 | + |
| SEQ ID NO 21612 | TCTTCCTAGTAAGGGAGGAGAC | CTC | chr12 | 21581172 | 21581193 | 21581189 | 21581194 | + |
| SEQ ID NO 21613 | TTCCTAGTAAGGGAGGAGACCA | CTC | chr12 | 21581174 | 21581195 | 21581191 | 21581196 | + |
| SEQ ID NO 21614 | CCTAGTAAGGGAGGAGACCACC | CTT | chr12 | 21581176 | 21581197 | 21581193 | 21581198 | + |
| SEQ ID NO 21615 | CTAGTAAGGGAGGAGACCACCC | TTC | chr12 | 21581177 | 21581198 | 21581194 | 21581199 | + |
| SEQ ID NO 21616 | GTAAGGGAGGAGACCACCCTTC | CTA | chr12 | 21581180 | 21581201 | 21581197 | 21581202 | + |
| SEQ ID NO 21617 | CATATTGTTTATGCCCAATTT | CTT | chr12 | 21581201 | 21581222 | 21581218 | 21581223 | + |
| SEQ ID NO 21618 | ATATTGTTTATGCCCAATTTC | TTC | chr12 | 21581202 | 21581223 | 21581219 | 21581224 | + |
| SEQ ID NO 21619 | TTTTATGCCCAATTTCTGCCTC | TTG | chr12 | 21581208 | 21581229 | 21581225 | 21581230 | + |
| SEQ ID NO 21620 | TATGCCCAATTTCTGCCTCCAA | TTT | chr12 | 21581211 | 21581232 | 21581228 | 21581233 | + |
| SEQ ID NO 21621 | ATGCCCAATTTCTGCCTCCAAA | TTT | chr12 | 21581212 | 21581233 | 21581229 | 21581234 | + |
| SEQ ID NO 21622 | TGCCCAATTTCTGCCTCCAAAG | TTA | chr12 | 21581213 | 21581234 | 21581230 | 21581235 | + |
| SEQ ID NO 21623 | CTGCCTCCAAAGAAAGAAGAAG | TTT | chr12 | 21581223 | 21581244 | 21581240 | 21581245 | + |
| SEQ ID NO 21624 | TGCCTCCAAAGAAAGAAGAAGT | TTC | chr12 | 21581224 | 21581245 | 21581241 | 21581246 | + |
| SEQ ID NO 21625 | CCTCCAAAGAAAGAAGAAGTAA | CTG | chr12 | 21581226 | 21581247 | 21581243 | 21581248 | + |
| SEQ ID NO 21626 | CAAAGAAAGAAGAAGTAAAAAC | CTC | chr12 | 21581230 | 21581251 | 21581247 | 21581252 | + |
| SEQ ID NO 21627 | AAAGGCAGAAATGAAATCCACA | CTA | chr12 | 21581254 | 21581275 | 21581271 | 21581276 | + |
| SEQ ID NO 21628 | AGACCACATCCTGGGCCTGGTT | CTG | chr12 | 21581289 | 21581310 | 21581306 | 21581311 | + |
| SEQ ID NO 21629 | GGCCTGGTTAAAGATAGACCCC | CTG | chr12 | 21581302 | 21581323 | 21581319 | 21581324 | + |
| SEQ ID NO 21630 | GTTAAAGATAGACCCCTGACCT | CTG | chr12 | 21581308 | 21581329 | 21581325 | 21581330 | + |
| SEQ ID NO 21631 | AAGATAGACCCCTGACCTGGCC | TTA | chr12 | 21581312 | 21581333 | 21581329 | 21581334 | + |
| SEQ ID NO 21632 | ACCTGGCCAGTTATGTTATCTA | CTG | chr12 | 21581326 | 21581347 | 21581343 | 21581348 | + |
| SEQ ID NO 21633 | GCCAGTTATGTTATCTATAGAT | CTG | chr12 | 21581331 | 21581352 | 21581348 | 21581353 | + |
| SEQ ID NO 21634 | TGTTATCTATAGATTCCAGACA | TTA | chr12 | 21581339 | 21581360 | 21581356 | 21581361 | + |
| SEQ ID NO 21635 | TCTATAGATTCCAGACACTGTA | TTA | chr12 | 21581344 | 21581365 | 21581361 | 21581366 | + |
| SEQ ID NO 21636 | TAGATTCCAGACACTGTATGGA | CTA | chr12 | 21581348 | 21581369 | 21581365 | 21581370 | + |
| SEQ ID NO 21637 | CAGACACTGTATGGAAAAGCAG | TTC | chr12 | 21581355 | 21581376 | 21581372 | 21581377 | + |
| SEQ ID NO 21638 | TATGGAAAAGCAGTGTGAAAAT | CTG | chr12 | 21581364 | 21581385 | 21581381 | 21581386 | + |
| SEQ ID NO 21639 | TCCTGTTCTGTTCCATTCTGAT | CTG | chr12 | 21581391 | 21581412 | 21581408 | 21581413 | + |
| SEQ ID NO 21640 | TTCTGTTCCATTCTGATGACCA | CTG | chr12 | 21581396 | 21581417 | 21581413 | 21581418 | + |
| SEQ ID NO 21641 | TGTTCCATTCTGATGACCAGTG | TTC | chr12 | 21581399 | 21581420 | 21581416 | 21581421 | + |
| SEQ ID NO 21642 | TTCCATTCTGATGACCAGTGCA | CTG | chr12 | 21581401 | 21581422 | 21581418 | 21581423 | + |
| SEQ ID NO 21643 | CATTCTGATGACCAGTGCATGC | TTC | chr12 | 21581404 | 21581425 | 21581421 | 21581426 | + |

Figure 48 (Cont'd)

| SEQ ID NO 21644 | TGATGACCAGTGCATGCAGCC | TTC | chr12 | 21581409 | 21581430 | 21581426 | 21581431 | + |
|---|---|---|---|---|---|---|---|---|
| SEQ ID NO 21645 | ATGACCAGTGCATGCAGCCCC | CTG | chr12 | 21581411 | 21581432 | 21581428 | 21581433 | + |
| SEQ ID NO 21646 | AGAGTTGTAAGCCCTTAAAAGG | CTT | chr12 | 21581449 | 21581470 | 21581466 | 21581471 | + |
| SEQ ID NO 21647 | GAGTTGTAAGCCCTTAAAAGGG | TTA | chr12 | 21581450 | 21581471 | 21581467 | 21581472 | + |
| SEQ ID NO 21648 | TAAGCCCTTAAAAGGGACAGGA | TTG | chr12 | 21581456 | 21581477 | 21581473 | 21581478 | + |
| SEQ ID NO 21649 | AAAAGGGACAGGAATTGCTCAC | CTT | chr12 | 21581465 | 21581486 | 21581482 | 21581487 | + |
| SEQ ID NO 21650 | AAAGGGACAGGAATTGCTCACT | TTA | chr12 | 21581466 | 21581487 | 21581483 | 21581488 | + |
| SEQ ID NO 21651 | CTCACTCTGAGAGCTTGGTTGT | TTG | chr12 | 21581482 | 21581503 | 21581499 | 21581504 | + |
| SEQ ID NO 21652 | ACTCTGAGAGCTTGGTTGTTGG | CTC | chr12 | 21581485 | 21581506 | 21581502 | 21581507 | + |
| SEQ ID NO 21653 | TGAGAGCTTGGTTGTTGGAGAT | CTC | chr12 | 21581489 | 21581510 | 21581506 | 21581511 | + |
| SEQ ID NO 21654 | AGAGCTTGGTTGTTGGAGATGT | CTG | chr12 | 21581491 | 21581512 | 21581508 | 21581513 | + |
| SEQ ID NO 21655 | GGTTGTTGGAGATGTGAGTCTT | CTT | chr12 | 21581498 | 21581519 | 21581515 | 21581520 | + |
| SEQ ID NO 21656 | GTTGTTGGAGATGTGAGTCTTG | TTG | chr12 | 21581499 | 21581520 | 21581516 | 21581521 | + |
| SEQ ID NO 21657 | TTGGAGATGTGAGTCTTGCCCA | TTG | chr12 | 21581503 | 21581524 | 21581520 | 21581525 | + |
| SEQ ID NO 21658 | GAGATGTGAGTCTTGCCCAAGC | TTG | chr12 | 21581506 | 21581527 | 21581523 | 21581528 | + |
| SEQ ID NO 21659 | GCCCAAGCTCCCAGCCGAATAA | CTT | chr12 | 21581520 | 21581541 | 21581537 | 21581542 | + |
| SEQ ID NO 21660 | CCCAAGCTCCCAGCCGAATAAA | TTG | chr12 | 21581521 | 21581542 | 21581538 | 21581543 | + |
| SEQ ID NO 21661 | CCAGCCGAATAAAGCCCTTCCT | CTC | chr12 | 21581530 | 21581551 | 21581547 | 21581552 | + |
| SEQ ID NO 21662 | CCTTCTTTAACTCGGTGTCTGA | CTT | chr12 | 21581549 | 21581570 | 21581566 | 21581571 | + |
| SEQ ID NO 21663 | CTTCTTTAACTCGGTGTCTGAG | TTC | chr12 | 21581550 | 21581571 | 21581567 | 21581572 | + |
| SEQ ID NO 21664 | CTTTAACTCGGTGTCTGAGGGG | CTT | chr12 | 21581553 | 21581574 | 21581570 | 21581575 | + |
| SEQ ID NO 21665 | TTTAACTCGGTGTCTGAGGGGT | TTC | chr12 | 21581554 | 21581575 | 21581571 | 21581576 | + |
| SEQ ID NO 21666 | TAACTCGGTGTCTGAGGGGTTT | CTT | chr12 | 21581556 | 21581577 | 21581573 | 21581578 | + |
| SEQ ID NO 21667 | AACTCGGTGTCTGAGGGGTTTT | TTT | chr12 | 21581557 | 21581578 | 21581574 | 21581579 | + |
| SEQ ID NO 21668 | ACTCGGTGTCTGAGGGGTTTTG | TTA | chr12 | 21581558 | 21581579 | 21581575 | 21581580 | + |
| SEQ ID NO 21669 | GGTGTCTGAGGGGTTTTGTATG | CTC | chr12 | 21581562 | 21581583 | 21581579 | 21581584 | + |
| SEQ ID NO 21670 | AGGGGTTTTGTATGCAGCTTGT | CTG | chr12 | 21581570 | 21581591 | 21581587 | 21581592 | + |
| SEQ ID NO 21671 | TGTATGCAGCTTGTCCTGCTAC | TTT | chr12 | 21581578 | 21581599 | 21581595 | 21581600 | + |
| SEQ ID NO 21672 | GTATGCAGCTTGTCCTGCTACA | TTT | chr12 | 21581579 | 21581600 | 21581596 | 21581601 | + |
| SEQ ID NO 21673 | TATGCAGCTTGTCCTGCTACAC | TTG | chr12 | 21581580 | 21581601 | 21581597 | 21581602 | + |
| SEQ ID NO 21674 | GTCCTGCTACACTAGAATCGTT | CTT | chr12 | 21581590 | 21581611 | 21581607 | 21581612 | + |
| SEQ ID NO 21675 | TCCTGCTACACTAGAATCGTTC | TTG | chr12 | 21581591 | 21581612 | 21581608 | 21581613 | + |
| SEQ ID NO 21676 | CTACACTAGAATCGTTCCTTAA | CTG | chr12 | 21581596 | 21581617 | 21581613 | 21581618 | + |
| SEQ ID NO 21677 | CACTAGAATCGTTCCTTAATTC | CTA | chr12 | 21581599 | 21581620 | 21581616 | 21581621 | + |
| SEQ ID NO 21678 | GAATCGTTCCTTAATTCTCTCC | CTA | chr12 | 21581604 | 21581625 | 21581621 | 21581626 | + |
| SEQ ID NO 21679 | CTTAATTCTCTCCTCTAATATT | TTC | chr12 | 21581613 | 21581634 | 21581630 | 21581635 | + |
| SEQ ID NO 21680 | AATTCTCTCCTCTAATATTGCT | CTT | chr12 | 21581616 | 21581637 | 21581633 | 21581638 | + |
| SEQ ID NO 21681 | ATTCTCTCCTCTAATATTGCTG | TTA | chr12 | 21581617 | 21581638 | 21581634 | 21581639 | + |
| SEQ ID NO 21682 | TCTCCTCTAATATTGCTGCTAC | TTC | chr12 | 21581621 | 21581642 | 21581638 | 21581643 | + |
| SEQ ID NO 21683 | TCCTCTAATATTGCTGCTACCT | CTC | chr12 | 21581623 | 21581644 | 21581640 | 21581645 | + |
| SEQ ID NO 21684 | CTCTAATATTGCTGCTACCTCT | CTC | chr12 | 21581625 | 21581646 | 21581642 | 21581647 | + |
| SEQ ID NO 21685 | TAATATTGCTGCTACCTCTATT | CTC | chr12 | 21581628 | 21581649 | 21581645 | 21581650 | + |
| SEQ ID NO 21686 | ATATTGCTGCTACCTCTATTAA | CTA | chr12 | 21581630 | 21581651 | 21581647 | 21581652 | + |
| SEQ ID NO 21687 | CTGCTACCTCTATTAAAACACA | TTG | chr12 | 21581636 | 21581657 | 21581653 | 21581658 | + |
| SEQ ID NO 21688 | CTACCTCTATTAAAACACAAAG | CTG | chr12 | 21581639 | 21581660 | 21581656 | 21581661 | + |
| SEQ ID NO 21689 | CCTCTATTAAAACACAAAGCCA | CTA | chr12 | 21581642 | 21581663 | 21581659 | 21581664 | + |
| SEQ ID NO 21690 | TATTAAAACACAAAGCCACAAT | CTC | chr12 | 21581646 | 21581667 | 21581663 | 21581668 | + |
| SEQ ID NO 21691 | TTAAAACACAAAGCCACAATAT | CTA | chr12 | 21581648 | 21581669 | 21581665 | 21581670 | + |
| SEQ ID NO 21692 | AAACACAAAGCCACAATATATG | TTA | chr12 | 21581651 | 21581672 | 21581668 | 21581673 | + |
| SEQ ID NO 21693 | GGAAAATATGCACACTTTGGAT | TTT | chr12 | 21581682 | 21581703 | 21581699 | 21581704 | + |
| SEQ ID NO 21694 | GAAAATATGCACACTTTGGATC | TTG | chr12 | 21581683 | 21581704 | 21581700 | 21581705 | + |
| SEQ ID NO 21695 | TGGATCCAGCAAGTCCACATCT | CTT | chr12 | 21581699 | 21581720 | 21581716 | 21581721 | + |
| SEQ ID NO 21696 | GGATCCAGCAAGTCCACATCTA | TTT | chr12 | 21581700 | 21581721 | 21581717 | 21581722 | + |
| SEQ ID NO 21697 | GATCCAGCAAGTCCACATCTAG | TTG | chr12 | 21581701 | 21581722 | 21581718 | 21581723 | + |
| SEQ ID NO 21698 | GAAAACCATCCTGGGGGAAAAT | CTA | chr12 | 21581722 | 21581743 | 21581739 | 21581744 | + |
| SEQ ID NO 21699 | GGGGAAAATTAAGGAGAGTATG | CTG | chr12 | 21581735 | 21581756 | 21581752 | 21581757 | + |
| SEQ ID NO 21700 | AGGAGAGTATGAAAAGGATGTT | TTA | chr12 | 21581746 | 21581767 | 21581763 | 21581768 | + |
| SEQ ID NO 21701 | ACTAAAGCATTATGATGGCAAA | TTT | chr12 | 21581769 | 21581790 | 21581786 | 21581791 | + |

Figure 48 (Cont'd)

| SEQ ID NO 21702 | CTAAAGCATTATGATGGCAAAA | TTA | chr12 | 21581770 | 21581791 | 21581787 | 21581792 | + |
| SEQ ID NO 21703 | AAGCATTATGATGGCAAAAAAT | CTA | chr12 | 21581773 | 21581794 | 21581790 | 21581795 | + |
| SEQ ID NO 21704 | TGATGGCAAAAAATTAGAAACA | TTA | chr12 | 21581781 | 21581802 | 21581798 | 21581803 | + |
| SEQ ID NO 21705 | GAAACAACTTACACTGAACTAG | TTA | chr12 | 21581797 | 21581818 | 21581814 | 21581819 | + |
| SEQ ID NO 21706 | ACACTGAACTAGTCAACTTACT | CTT | chr12 | 21581807 | 21581828 | 21581824 | 21581829 | + |
| SEQ ID NO 21707 | CACTGAACTAGTCAACTTACTT | TTA | chr12 | 21581808 | 21581829 | 21581825 | 21581830 | + |
| SEQ ID NO 21708 | AACTAGTCAACTTACTTAACAG | CTG | chr12 | 21581813 | 21581834 | 21581830 | 21581835 | + |
| SEQ ID NO 21709 | GTCAACTTACTTAACAGACAGA | CTA | chr12 | 21581818 | 21581839 | 21581835 | 21581840 | + |
| SEQ ID NO 21710 | ACTTAACAGACAGAAGGCTCAA | CTT | chr12 | 21581826 | 21581847 | 21581843 | 21581848 | + |
| SEQ ID NO 21711 | CTTAACAGACAGAAGGCTCAAT | TTA | chr12 | 21581827 | 21581848 | 21581844 | 21581849 | + |
| SEQ ID NO 21712 | AACAGACAGAAGGCTCAATTAG | CTT | chr12 | 21581830 | 21581851 | 21581847 | 21581852 | + |
| SEQ ID NO 21713 | ACAGACAGAAGGCTCAATTAGC | TTA | chr12 | 21581831 | 21581852 | 21581848 | 21581853 | + |
| SEQ ID NO 21714 | AATTAGCTCATGTGTCAAATGG | CTC | chr12 | 21581846 | 21581867 | 21581863 | 21581868 | + |
| SEQ ID NO 21715 | GCTCATGTGTCAAATGGGGGTA | TTA | chr12 | 21581851 | 21581872 | 21581868 | 21581873 | + |
| SEQ ID NO 21716 | ATGTGTCAAATGGGGGTAAAAT | CTC | chr12 | 21581855 | 21581876 | 21581872 | 21581877 | + |
| SEQ ID NO 21717 | AGTTTGGAGGGAAAGACAGGCT | TTT | chr12 | 21581884 | 21581905 | 21581901 | 21581906 | + |
| SEQ ID NO 21718 | GTTTGGAGGGAAAGACAGGCTC | TTA | chr12 | 21581885 | 21581906 | 21581902 | 21581907 | + |
| SEQ ID NO 21719 | GGAGGGAAAGACAGGCTCTAAA | TTT | chr12 | 21581889 | 21581910 | 21581906 | 21581911 | + |
| SEQ ID NO 21720 | GAGGGAAAGACAGGCTCTAAAA | TTG | chr12 | 21581890 | 21581911 | 21581907 | 21581912 | + |
| SEQ ID NO 21721 | TAAAAGAGGATTAAAAATTAGA | CTC | chr12 | 21581907 | 21581928 | 21581924 | 21581929 | + |
| SEQ ID NO 21722 | AAAGAGGATTAAAAATTAGATG | CTA | chr12 | 21581909 | 21581930 | 21581926 | 21581931 | + |
| SEQ ID NO 21723 | AAAATTAGATGTGGCCTAGGCA | TTA | chr12 | 21581920 | 21581941 | 21581937 | 21581942 | + |
| SEQ ID NO 21724 | GATGTGGCCTAGGCAAAGAATT | TTA | chr12 | 21581927 | 21581948 | 21581944 | 21581949 | + |
| SEQ ID NO 21725 | GGCAAAGAATTTATGACCAAGT | CTA | chr12 | 21581938 | 21581959 | 21581955 | 21581960 | + |
| SEQ ID NO 21726 | ATGACCAAGTCCTCAAAACTAA | TTT | chr12 | 21581950 | 21581971 | 21581967 | 21581972 | + |
| SEQ ID NO 21727 | TGACCAAGTCCTCAAAACTAAA | TTA | chr12 | 21581951 | 21581972 | 21581968 | 21581973 | + |
| SEQ ID NO 21728 | AAAACTAAACACAACAAAAACA | CTC | chr12 | 21581964 | 21581985 | 21581981 | 21581986 | + |
| SEQ ID NO 21729 | AACACAACAAAAACAAAAACAG | CTA | chr12 | 21581971 | 21581992 | 21581988 | 21581993 | + |
| SEQ ID NO 21730 | AATTAAACTAAAATGCTTCTGC | CTT | chr12 | 21582006 | 21582027 | 21582023 | 21582028 | + |
| SEQ ID NO 21731 | ATTAAACTAAAATGCTTCTGCA | TTA | chr12 | 21582007 | 21582028 | 21582024 | 21582029 | + |
| SEQ ID NO 21732 | AACTAAAATGCTTCTGCACCGC | TTA | chr12 | 21582011 | 21582032 | 21582028 | 21582033 | + |
| SEQ ID NO 21733 | AAATGCTTCTGCACCGCAAAAG | CTA | chr12 | 21582016 | 21582037 | 21582033 | 21582038 | + |
| SEQ ID NO 21734 | CTGCACCGCAAAAGACCGAATC | CTT | chr12 | 21582024 | 21582045 | 21582041 | 21582046 | + |
| SEQ ID NO 21735 | TGCACCGCAAAAGACCGAATCA | TTC | chr12 | 21582025 | 21582046 | 21582042 | 21582047 | + |
| SEQ ID NO 21736 | CACCGCAAAAGACCGAATCAAC | CTG | chr12 | 21582027 | 21582048 | 21582044 | 21582049 | + |
| SEQ ID NO 21737 | CAGAATGAGAAAAAAAAATTGC | CTA | chr12 | 21582068 | 21582089 | 21582085 | 21582090 | + |
| SEQ ID NO 21738 | CAAACTATGAATGCAACAAAAG | TTG | chr12 | 21582089 | 21582110 | 21582106 | 21582111 | + |
| SEQ ID NO 21739 | TGAATGCAACAAAAGGCTAATA | CTA | chr12 | 21582096 | 21582117 | 21582113 | 21582118 | + |
| SEQ ID NO 21740 | ATATACAGAATCTACAAGGAAC | CTA | chr12 | 21582115 | 21582136 | 21582132 | 21582137 | + |
| SEQ ID NO 21741 | CAAGGAACTCAACAACAAAAAA | CTA | chr12 | 21582129 | 21582150 | 21582146 | 21582151 | + |
| SEQ ID NO 21742 | AACAACAAAAAACCAACCTCA | CTC | chr12 | 21582139 | 21582160 | 21582156 | 21582161 | + |
| SEQ ID NO 21743 | ATTAGAAAGTGACTGTGATGGT | CTC | chr12 | 21582160 | 21582181 | 21582177 | 21582182 | + |
| SEQ ID NO 21744 | GAAAGTGACTGTGATGGTTAAT | TTA | chr12 | 21582164 | 21582185 | 21582181 | 21582186 | + |
| SEQ ID NO 21745 | TGATGGTTAATACTGAGTGTCA | CTG | chr12 | 21582175 | 21582196 | 21582192 | 21582197 | + |
| SEQ ID NO 21746 | ATACTGAGTGTCAACTTGATTG | TTA | chr12 | 21582184 | 21582205 | 21582201 | 21582206 | + |
| SEQ ID NO 21747 | AGTGTCAACTTGATTGGACTGA | CTG | chr12 | 21582190 | 21582211 | 21582207 | 21582212 | + |
| SEQ ID NO 21748 | GATTGGACTGAAGGATGCAAAG | CTT | chr12 | 21582201 | 21582222 | 21582218 | 21582223 | + |
| SEQ ID NO 21749 | ATTGGACTGAAGGATGCAAAGT | TTG | chr12 | 21582202 | 21582223 | 21582219 | 21582224 | + |
| SEQ ID NO 21750 | GACTGAAGGATGCAAAGTAATG | TTG | chr12 | 21582206 | 21582227 | 21582223 | 21582228 | + |
| SEQ ID NO 21751 | AAGGATGCAAAGTAATGATCTT | CTG | chr12 | 21582211 | 21582232 | 21582228 | 21582233 | + |
| SEQ ID NO 21752 | GGGTGTGTCTGTGAGGGTGTTA | CTT | chr12 | 21582233 | 21582254 | 21582250 | 21582255 | + |
| SEQ ID NO 21753 | GGTGTGTCTGTGAGGGTGTTAC | TTG | chr12 | 21582234 | 21582255 | 21582251 | 21582256 | + |
| SEQ ID NO 21754 | TGAGGGTGTTACCAAAGGAGAT | CTG | chr12 | 21582244 | 21582265 | 21582261 | 21582266 | + |
| SEQ ID NO 21755 | CCAAAGGAGATTAATATTTCAG | TTA | chr12 | 21582255 | 21582276 | 21582272 | 21582277 | + |
| SEQ ID NO 21756 | ATATTTCAGTCAGTGGGCTGGG | TTA | chr12 | 21582268 | 21582289 | 21582285 | 21582290 | + |
| SEQ ID NO 21757 | CAGTCAGTGGGCTGGGGAAGGC | TTT | chr12 | 21582274 | 21582295 | 21582291 | 21582296 | + |
| SEQ ID NO 21758 | AGTCAGTGGGCTGGGGAAGGCA | TTC | chr12 | 21582275 | 21582296 | 21582292 | 21582297 | + |
| SEQ ID NO 21759 | GGGAAGGCAGACCCACCCTTAA | CTG | chr12 | 21582288 | 21582309 | 21582305 | 21582310 | + |

Figure 48 (Cont'd)

| | | | | | | | | |
|---|---|---|---|---|---|---|---|---|
| SEQ ID NO 21760 | AATCTGGGTGGGCACCATCTAA | CTT | chr12 | 21582308 | 21582329 | 21582325 | 21582330 | + |
| SEQ ID NO 21761 | ATCTGGGTGGGCACCATCTAAT | TTA | chr12 | 21582309 | 21582330 | 21582326 | 21582331 | + |
| SEQ ID NO 21762 | GGTGGGCACCATCTAATCAGTT | CTG | chr12 | 21582314 | 21582335 | 21582331 | 21582336 | + |
| SEQ ID NO 21763 | ATCAGTTGCCAGCACAGCCAGG | CTA | chr12 | 21582329 | 21582350 | 21582346 | 21582351 | + |
| SEQ ID NO 21764 | CCAGCACAGCCAGGATATAAAG | TTG | chr12 | 21582337 | 21582358 | 21582354 | 21582359 | + |
| SEQ ID NO 21765 | GATTGGCTTGGCATCCCAGCCT | CTA | chr12 | 21582384 | 21582405 | 21582401 | 21582406 | + |
| SEQ ID NO 21766 | GCTTGGCATCCCAGCCTACATT | TTG | chr12 | 21582389 | 21582410 | 21582406 | 21582411 | + |
| SEQ ID NO 21767 | GGCATCCCAGCCTACATTTTTC | CTT | chr12 | 21582393 | 21582414 | 21582410 | 21582415 | + |
| SEQ ID NO 21768 | GCATCCCAGCCTACATTTTTCT | TTG | chr12 | 21582394 | 21582415 | 21582411 | 21582416 | + |
| SEQ ID NO 21769 | CATTTTTCTCCCATGCTGGATT | CTA | chr12 | 21582407 | 21582428 | 21582424 | 21582429 | + |
| SEQ ID NO 21770 | TTCTCCCATGCTGGATTCTTCC | TTT | chr12 | 21582412 | 21582433 | 21582429 | 21582434 | + |
| SEQ ID NO 21771 | TCTCCCATGCTGGATTCTTCCT | TTT | chr12 | 21582413 | 21582434 | 21582430 | 21582435 | + |
| SEQ ID NO 21772 | CTCCCATGCTGGATTCTTCCTG | TTT | chr12 | 21582414 | 21582435 | 21582431 | 21582436 | + |
| SEQ ID NO 21773 | TCCCATGCTGGATTCTTCCTGC | TTC | chr12 | 21582415 | 21582436 | 21582432 | 21582437 | + |
| SEQ ID NO 21774 | CCATGCTGGATTCTTCCTGCCC | CTC | chr12 | 21582417 | 21582438 | 21582434 | 21582439 | + |
| SEQ ID NO 21775 | GATTCTTCCTGCCCTGGAACAT | CTG | chr12 | 21582425 | 21582446 | 21582442 | 21582447 | + |
| SEQ ID NO 21776 | TTCCTGCCCTGGAACATTGAAC | TTC | chr12 | 21582430 | 21582451 | 21582447 | 21582452 | + |
| SEQ ID NO 21777 | CCTGCCCTGGAACATTGAACTC | CTT | chr12 | 21582432 | 21582453 | 21582449 | 21582454 | + |
| SEQ ID NO 21778 | CTGCCCTGGAACATTGAACTCC | TTC | chr12 | 21582433 | 21582454 | 21582450 | 21582455 | + |
| SEQ ID NO 21779 | CCCTGGAACATTGAACTCCAGG | CTG | chr12 | 21582436 | 21582457 | 21582453 | 21582458 | + |
| SEQ ID NO 21780 | GAACATTGAACTCCAGGTTCTT | CTG | chr12 | 21582441 | 21582462 | 21582458 | 21582463 | + |
| SEQ ID NO 21781 | AACTCCAGGTTCTTCAGCTTTG | TTG | chr12 | 21582449 | 21582470 | 21582466 | 21582471 | + |
| SEQ ID NO 21782 | CAGGTTCTTCAGCTTTGGGACT | CTC | chr12 | 21582454 | 21582475 | 21582471 | 21582476 | + |
| SEQ ID NO 21783 | TTCAGCTTTGGGACTCCGACTA | TTC | chr12 | 21582461 | 21582482 | 21582478 | 21582483 | + |
| SEQ ID NO 21784 | CAGCTTTGGGACTCCGACTAGC | CTT | chr12 | 21582463 | 21582484 | 21582480 | 21582485 | + |
| SEQ ID NO 21785 | AGCTTTGGGACTCCGACTAGCT | TTC | chr12 | 21582464 | 21582485 | 21582481 | 21582486 | + |
| SEQ ID NO 21786 | TGGGACTCCGACTAGCTTCCTT | CTT | chr12 | 21582469 | 21582490 | 21582486 | 21582491 | + |
| SEQ ID NO 21787 | GGGACTCCGACTAGCTTCCTTG | TTT | chr12 | 21582470 | 21582491 | 21582487 | 21582492 | + |
| SEQ ID NO 21788 | GGACTCCGACTAGCTTCCTTGT | TTG | chr12 | 21582471 | 21582492 | 21582488 | 21582493 | + |
| SEQ ID NO 21789 | CGACTAGCTTCCTTGTTCCTCA | CTC | chr12 | 21582477 | 21582498 | 21582494 | 21582499 | + |
| SEQ ID NO 21790 | GCTTCCTTGTTCCTCAGCTGGC | CTA | chr12 | 21582483 | 21582504 | 21582500 | 21582505 | + |
| SEQ ID NO 21791 | CCTTGTTCCTCAGCTGGCAGAT | CTT | chr12 | 21582487 | 21582508 | 21582504 | 21582509 | + |
| SEQ ID NO 21792 | CTTGTTCCTCAGCTGGCAGATG | TTC | chr12 | 21582488 | 21582509 | 21582505 | 21582510 | + |
| SEQ ID NO 21793 | GTTCCTCAGCTGGCAGATGGCC | CTT | chr12 | 21582491 | 21582512 | 21582508 | 21582513 | + |
| SEQ ID NO 21794 | TTCCTCAGCTGGCAGATGGCCT | TTG | chr12 | 21582492 | 21582513 | 21582509 | 21582514 | + |
| SEQ ID NO 21795 | CTCAGCTGGCAGATGGCCTGTT | TTC | chr12 | 21582495 | 21582516 | 21582512 | 21582517 | + |
| SEQ ID NO 21796 | AGCTGGCAGATGGCCTGTTTTG | CTC | chr12 | 21582498 | 21582519 | 21582515 | 21582520 | + |
| SEQ ID NO 21797 | GCAGATGGCCTGTTTTGGGACC | CTG | chr12 | 21582503 | 21582524 | 21582520 | 21582525 | + |
| SEQ ID NO 21798 | TTTTGGGACCTTGTGAACATGT | CTG | chr12 | 21582515 | 21582536 | 21582532 | 21582537 | + |
| SEQ ID NO 21799 | TGGGACCTTGTGAACATGTGAG | TTT | chr12 | 21582518 | 21582539 | 21582535 | 21582540 | + |
| SEQ ID NO 21800 | GGGACCTTGTGAACATGTGAGT | TTT | chr12 | 21582519 | 21582540 | 21582536 | 21582541 | + |
| SEQ ID NO 21801 | GGACCTTGTGAACATGTGAGTC | TTG | chr12 | 21582520 | 21582541 | 21582537 | 21582542 | + |
| SEQ ID NO 21802 | GTGAACATGTGAGTCAATACTA | CTT | chr12 | 21582527 | 21582548 | 21582544 | 21582549 | + |
| SEQ ID NO 21803 | TGAACATGTGAGTCAATACTAC | TTG | chr12 | 21582528 | 21582549 | 21582545 | 21582550 | + |
| SEQ ID NO 21804 | CATAATAAACTCTCATATAGAT | CTA | chr12 | 21582549 | 21582570 | 21582566 | 21582571 | + |
| SEQ ID NO 21805 | TCATATAGATATAGATATAGAG | CTC | chr12 | 21582561 | 21582582 | 21582578 | 21582583 | + |
| SEQ ID NO 21806 | ATATAGATATAGATATAGAGAT | CTC | chr12 | 21582563 | 21582584 | 21582580 | 21582585 | + |
| SEQ ID NO 21807 | CTATTAATTCTGTTTCTCTGTA | CTC | chr12 | 21582646 | 21582667 | 21582663 | 21582668 | + |
| SEQ ID NO 21808 | TTAATTCTGTTTCTCTGTAGAA | CTA | chr12 | 21582649 | 21582670 | 21582666 | 21582671 | + |
| SEQ ID NO 21809 | ATTCTGTTTCTCTGTAGAACCC | TTA | chr12 | 21582652 | 21582673 | 21582669 | 21582674 | + |
| SEQ ID NO 21810 | TGTTTCTCTGTAGAACCCTAAT | TTC | chr12 | 21582656 | 21582677 | 21582673 | 21582678 | + |
| SEQ ID NO 21811 | TTTCTCTGTAGAACCCTAATAC | CTG | chr12 | 21582658 | 21582679 | 21582675 | 21582680 | + |
| SEQ ID NO 21812 | CTCTGTAGAACCCTAATACAGA | TTT | chr12 | 21582661 | 21582682 | 21582678 | 21582683 | + |
| SEQ ID NO 21813 | TCTGTAGAACCCTAATACAGAT | TTC | chr12 | 21582662 | 21582683 | 21582679 | 21582684 | + |
| SEQ ID NO 21814 | TGTAGAACCCTAATACAGATTT | CTC | chr12 | 21582664 | 21582685 | 21582681 | 21582686 | + |
| SEQ ID NO 21815 | TAGAACCCTAATACAGATTTTG | CTG | chr12 | 21582666 | 21582687 | 21582683 | 21582688 | + |
| SEQ ID NO 21816 | ATACAGATTTTGGTACCAGGAG | CTA | chr12 | 21582676 | 21582697 | 21582693 | 21582698 | + |
| SEQ ID NO 21817 | TGGTACCAGGAGTGGTTCTAGA | TTT | chr12 | 21582686 | 21582707 | 21582703 | 21582708 | + |

Figure 48 (Cont'd)

| | | | | | | | | |
|---|---|---|---|---|---|---|---|---|
| SEQ ID NO 21818 | GGTACCAGGAGTGGTTCTAGAG | TTT | chr12 | 21582687 | 21582708 | 21582704 | 21582709 | + |
| SEQ ID NO 21819 | GTACCAGGAGTGGTTCTAGAGG | TTG | chr12 | 21582688 | 21582709 | 21582705 | 21582710 | + |
| SEQ ID NO 21820 | TAGAGGAACAGAATATTAAGGA | TTC | chr12 | 21582704 | 21582725 | 21582721 | 21582726 | + |
| SEQ ID NO 21821 | GAGGAACAGAATATTAAGGATG | CTA | chr12 | 21582706 | 21582727 | 21582723 | 21582728 | + |
| SEQ ID NO 21822 | AGGATGGAGTTCTTTCATTGGT | TTA | chr12 | 21582722 | 21582743 | 21582739 | 21582744 | + |
| SEQ ID NO 21823 | TTTCATTGGTTTTGGGGTTTCT | TTC | chr12 | 21582734 | 21582755 | 21582751 | 21582756 | + |
| SEQ ID NO 21824 | TCATTGGTTTTGGGGTTTCTGG | CTT | chr12 | 21582736 | 21582757 | 21582753 | 21582758 | + |
| SEQ ID NO 21825 | CATTGGTTTTGGGGTTTCTGGA | TTT | chr12 | 21582737 | 21582758 | 21582754 | 21582759 | + |
| SEQ ID NO 21826 | ATTGGTTTTGGGGTTTCTGGAG | TTC | chr12 | 21582738 | 21582759 | 21582755 | 21582760 | + |
| SEQ ID NO 21827 | GTTTTGGGGTTTCTGGAGTTGG | TTG | chr12 | 21582742 | 21582763 | 21582759 | 21582764 | + |
| SEQ ID NO 21828 | TGGGGTTTCTGGAGTTGGCTGC | TTT | chr12 | 21582746 | 21582767 | 21582763 | 21582768 | + |
| SEQ ID NO 21829 | GGGGTTTCTGGAGTTGGCTGCT | TTT | chr12 | 21582747 | 21582768 | 21582764 | 21582769 | + |
| SEQ ID NO 21830 | GGGTTTCTGGAGTTGGCTGCTT | TTG | chr12 | 21582748 | 21582769 | 21582765 | 21582770 | + |
| SEQ ID NO 21831 | CTGGAGTTGGCTGCTTAATATG | TTT | chr12 | 21582754 | 21582775 | 21582771 | 21582776 | + |
| SEQ ID NO 21832 | TGGAGTTGGCTGCTTAATATGA | TTC | chr12 | 21582755 | 21582776 | 21582772 | 21582777 | + |
| SEQ ID NO 21833 | GAGTTGGCTGCTTAATATGATT | CTG | chr12 | 21582757 | 21582778 | 21582774 | 21582779 | + |
| SEQ ID NO 21834 | GCTGCTTAATATGATTAGACCC | TTG | chr12 | 21582763 | 21582784 | 21582780 | 21582785 | + |
| SEQ ID NO 21835 | CTTAATATGATTAGACCCAAAT | CTG | chr12 | 21582767 | 21582788 | 21582784 | 21582789 | + |
| SEQ ID NO 21836 | AATATGATTAGACCCAAATATG | CTT | chr12 | 21582770 | 21582791 | 21582787 | 21582792 | + |
| SEQ ID NO 21837 | ATATGATTAGACCCAAATATGC | TTA | chr12 | 21582771 | 21582792 | 21582788 | 21582793 | + |
| SEQ ID NO 21838 | GACCCAAATATGCTAAGGACTC | TTA | chr12 | 21582780 | 21582801 | 21582797 | 21582802 | + |
| SEQ ID NO 21839 | AGGACTCTTCTTCTAATGGTAT | CTA | chr12 | 21582795 | 21582816 | 21582812 | 21582817 | + |
| SEQ ID NO 21840 | TTCTTCTAATGGTATGGAGAAC | CTC | chr12 | 21582802 | 21582823 | 21582819 | 21582824 | + |
| SEQ ID NO 21841 | CTTCTAATGGTATGGAGAACAC | CTT | chr12 | 21582804 | 21582825 | 21582821 | 21582826 | + |
| SEQ ID NO 21842 | TTCTAATGGTATGGAGAACACT | TTC | chr12 | 21582805 | 21582826 | 21582822 | 21582827 | + |
| SEQ ID NO 21843 | CTAATGGTATGGAGAACACTGA | CTT | chr12 | 21582807 | 21582828 | 21582824 | 21582829 | + |
| SEQ ID NO 21844 | TAATGGTATGGAGAACACTGAT | TTC | chr12 | 21582808 | 21582829 | 21582825 | 21582830 | + |
| SEQ ID NO 21845 | ATGGTATGGAGAACACTGATAA | CTA | chr12 | 21582810 | 21582831 | 21582827 | 21582832 | + |
| SEQ ID NO 21846 | ATAATCCTTGGCATCAATTGTT | CTG | chr12 | 21582828 | 21582849 | 21582845 | 21582850 | + |
| SEQ ID NO 21847 | GGCATCAATTGTTTAGAGAGTT | CTT | chr12 | 21582837 | 21582858 | 21582854 | 21582859 | + |
| SEQ ID NO 21848 | GCATCAATTGTTTAGAGAGTTA | TTG | chr12 | 21582838 | 21582859 | 21582855 | 21582860 | + |
| SEQ ID NO 21849 | TTTAGAGAGTTATGCAAAATAA | TTG | chr12 | 21582848 | 21582869 | 21582865 | 21582870 | + |
| SEQ ID NO 21850 | AGAGAGTTATGCAAAATAAATG | TTT | chr12 | 21582851 | 21582872 | 21582868 | 21582873 | + |
| SEQ ID NO 21851 | GAGAGTTATGCAAAATAAATGC | TTA | chr12 | 21582852 | 21582873 | 21582869 | 21582874 | + |
| SEQ ID NO 21852 | TGCAAAATAAATGCATTTGACA | TTA | chr12 | 21582860 | 21582881 | 21582877 | 21582882 | + |
| SEQ ID NO 21853 | GACACTCTTGATTCAACGCTTG | TTT | chr12 | 21582878 | 21582899 | 21582895 | 21582900 | + |
| SEQ ID NO 21854 | ACACTCTTGATTCAACGCTTGT | TTG | chr12 | 21582879 | 21582900 | 21582896 | 21582901 | + |
| SEQ ID NO 21855 | TTGATTCAACGCTTGTGAGAGG | CTC | chr12 | 21582885 | 21582906 | 21582902 | 21582907 | + |
| SEQ ID NO 21856 | GATTCAACGCTTGTGAGAGGCA | CTT | chr12 | 21582887 | 21582908 | 21582904 | 21582909 | + |
| SEQ ID NO 21857 | ATTCAACGCTTGTGAGAGGCAA | TTG | chr12 | 21582888 | 21582909 | 21582905 | 21582910 | + |
| SEQ ID NO 21858 | AACGCTTGTGAGAGGCAAGGAA | TTC | chr12 | 21582892 | 21582913 | 21582909 | 21582914 | + |
| SEQ ID NO 21859 | GTGAGAGGCAAGGAATTTAGCT | CTT | chr12 | 21582899 | 21582920 | 21582916 | 21582921 | + |
| SEQ ID NO 21860 | TGAGAGGCAAGGAATTTAGCTA | TTG | chr12 | 21582900 | 21582921 | 21582917 | 21582922 | + |
| SEQ ID NO 21861 | AGCTACTGTATACATAATACTT | TTT | chr12 | 21582917 | 21582938 | 21582934 | 21582939 | + |
| SEQ ID NO 21862 | GCTACTGTATACATAATACTTT | TTA | chr12 | 21582918 | 21582939 | 21582935 | 21582940 | + |
| SEQ ID NO 21863 | CTGTATACATAATACTTTTGAC | CTA | chr12 | 21582922 | 21582943 | 21582939 | 21582944 | + |
| SEQ ID NO 21864 | TATACATAATACTTTTGACTAT | CTG | chr12 | 21582925 | 21582946 | 21582942 | 21582947 | + |
| SEQ ID NO 21865 | TTGACTATATGTGGAGAATCAA | CTT | chr12 | 21582939 | 21582960 | 21582956 | 21582961 | + |
| SEQ ID NO 21866 | TGACTATATGTGGAGAATCAAG | TTT | chr12 | 21582940 | 21582961 | 21582957 | 21582962 | + |
| SEQ ID NO 21867 | GACTATATGTGGAGAATCAAGG | TTT | chr12 | 21582941 | 21582962 | 21582958 | 21582963 | + |
| SEQ ID NO 21868 | ACTATATGTGGAGAATCAAGGA | TTG | chr12 | 21582942 | 21582963 | 21582959 | 21582964 | + |
| SEQ ID NO 21869 | TATGTGGAGAATCAAGGAACAT | CTA | chr12 | 21582946 | 21582967 | 21582963 | 21582968 | + |
| SEQ ID NO 21870 | GTTGGTTGCTTGTAAGTTCGCT | TTG | chr12 | 21582978 | 21582999 | 21582995 | 21583000 | + |
| SEQ ID NO 21871 | GTTGCTTGTAAGTTCGCTGGAC | TTG | chr12 | 21582982 | 21583003 | 21582999 | 21583004 | + |
| SEQ ID NO 21872 | CTTGTAAGTTCGCTGGACAAAG | TTG | chr12 | 21582986 | 21583007 | 21583003 | 21583008 | + |
| SEQ ID NO 21873 | GTAAGTTCGCTGGACAAAGTGA | CTT | chr12 | 21582989 | 21583010 | 21583006 | 21583011 | + |
| SEQ ID NO 21874 | TAAGTTCGCTGGACAAAGTGAT | TTG | chr12 | 21582990 | 21583011 | 21583007 | 21583012 | + |
| SEQ ID NO 21875 | GCTGGACAAAGTGATGAAAGAA | TTC | chr12 | 21582997 | 21583018 | 21583014 | 21583019 | + |

Figure 48 (Cont'd)

| | | | | | | | | |
|---|---|---|---|---|---|---|---|---|
| SEQ ID NO 21876 | GACAAAGTGATGAAAGAAAATG | CTG | chr12 | 21583001 | 21583022 | 21583018 | 21583023 | + |
| SEQ ID NO 21877 | AGGAGTATATCAACTCTCCAGC | CTC | chr12 | 21583031 | 21583052 | 21583048 | 21583053 | + |
| SEQ ID NO 21878 | TCCAGCTTTGTGCCATAATCTT | CTC | chr12 | 21583047 | 21583068 | 21583064 | 21583069 | + |
| SEQ ID NO 21879 | CAGCTTTGTGCCATAATCTTAT | CTC | chr12 | 21583049 | 21583070 | 21583066 | 21583071 | + |
| SEQ ID NO 21880 | TGTGCCATAATCTTATTTGGAG | CTT | chr12 | 21583055 | 21583076 | 21583072 | 21583077 | + |
| SEQ ID NO 21881 | GTGCCATAATCTTATTTGGAGA | TTT | chr12 | 21583056 | 21583077 | 21583073 | 21583078 | + |
| SEQ ID NO 21882 | TGCCATAATCTTATTTGGAGAG | TTG | chr12 | 21583057 | 21583078 | 21583074 | 21583079 | + |
| SEQ ID NO 21883 | ATTTGGAGAGAACTTGCTCACC | CTT | chr12 | 21583069 | 21583090 | 21583086 | 21583091 | + |
| SEQ ID NO 21884 | TTTGGAGAGAACTTGCTCACCT | TTA | chr12 | 21583070 | 21583091 | 21583087 | 21583092 | + |
| SEQ ID NO 21885 | GGAGAGAACTTGCTCACCTTTC | TTT | chr12 | 21583073 | 21583094 | 21583090 | 21583095 | + |
| SEQ ID NO 21886 | GAGAGAACTTGCTCACCTTTCA | TTG | chr12 | 21583074 | 21583095 | 21583091 | 21583096 | + |
| SEQ ID NO 21887 | GCTCACCTTTCACTTCCACAAG | CTT | chr12 | 21583084 | 21583105 | 21583101 | 21583106 | + |
| SEQ ID NO 21888 | CTCACCTTTCACTTCCACAAGA | TTG | chr12 | 21583085 | 21583106 | 21583102 | 21583107 | + |
| SEQ ID NO 21889 | ACCTTTCACTTCCACAAGATAT | CTC | chr12 | 21583088 | 21583109 | 21583105 | 21583110 | + |
| SEQ ID NO 21890 | TCACTTCCACAAGATATCACAG | CTT | chr12 | 21583093 | 21583114 | 21583110 | 21583115 | + |
| SEQ ID NO 21891 | CACTTCCACAAGATATCACAGT | TTT | chr12 | 21583094 | 21583115 | 21583111 | 21583116 | + |
| SEQ ID NO 21892 | ACTTCCACAAGATATCACAGTG | TTC | chr12 | 21583095 | 21583116 | 21583112 | 21583117 | + |
| SEQ ID NO 21893 | CCACAAGATATCACAGTGGTCC | CTT | chr12 | 21583099 | 21583120 | 21583116 | 21583121 | + |
| SEQ ID NO 21894 | CACAAGATATCACAGTGGTCCA | TTC | chr12 | 21583100 | 21583121 | 21583117 | 21583122 | + |
| SEQ ID NO 21895 | CATTGATGACATGCTGACTGGA | TTA | chr12 | 21583125 | 21583146 | 21583142 | 21583147 | + |
| SEQ ID NO 21896 | ATGACATGCTGACTGGAACTAG | TTG | chr12 | 21583130 | 21583151 | 21583147 | 21583152 | + |
| SEQ ID NO 21897 | ACTGGAACTAGTGAGCAAGAAG | CTG | chr12 | 21583141 | 21583162 | 21583158 | 21583163 | + |
| SEQ ID NO 21898 | GAACTAGTGAGCAAGAAGTAGC | CTG | chr12 | 21583145 | 21583166 | 21583162 | 21583167 | + |
| SEQ ID NO 21899 | GTGAGCAAGAAGTAGCAAACAC | CTA | chr12 | 21583151 | 21583172 | 21583168 | 21583173 | + |
| SEQ ID NO 21900 | GATTTATTGATGAGACATTTGT | CTG | chr12 | 21583177 | 21583198 | 21583194 | 21583199 | + |
| SEQ ID NO 21901 | ATTGATGAGACATTTGTGGGAC | TTT | chr12 | 21583182 | 21583203 | 21583199 | 21583204 | + |
| SEQ ID NO 21902 | TTGATGAGACATTTGTGGGACA | TTA | chr12 | 21583183 | 21583204 | 21583200 | 21583205 | + |
| SEQ ID NO 21903 | ATGAGACATTTGTGGGACAGAG | TTG | chr12 | 21583186 | 21583207 | 21583203 | 21583208 | + |
| SEQ ID NO 21904 | GTGGGACAGAGGATGGGAAATA | TTT | chr12 | 21583197 | 21583218 | 21583214 | 21583219 | + |
| SEQ ID NO 21905 | TGGGACAGAGGATGGGAAATAA | TTG | chr12 | 21583198 | 21583219 | 21583215 | 21583220 | + |
| SEQ ID NO 21906 | ATTAAATTCAGGGACCTTCTAC | CTG | chr12 | 21583225 | 21583246 | 21583242 | 21583247 | + |
| SEQ ID NO 21907 | AATTCAGGGACCTTCTACCTCA | TTA | chr12 | 21583229 | 21583250 | 21583246 | 21583251 | + |
| SEQ ID NO 21908 | AGGGACCTTCTACCTCAGTAAA | TTC | chr12 | 21583234 | 21583255 | 21583251 | 21583256 | + |
| SEQ ID NO 21909 | CTACCTCAGTAAAATTTATAGG | CTT | chr12 | 21583243 | 21583264 | 21583260 | 21583265 | + |
| SEQ ID NO 21910 | TACCTCAGTAAAATTTATAGGG | TTC | chr12 | 21583244 | 21583265 | 21583261 | 21583266 | + |
| SEQ ID NO 21911 | CCTCAGTAAAATTTATAGGGGT | CTA | chr12 | 21583246 | 21583267 | 21583263 | 21583268 | + |
| SEQ ID NO 21912 | AGTAAAATTTATAGGGGTCCAA | CTC | chr12 | 21583250 | 21583271 | 21583267 | 21583272 | + |
| SEQ ID NO 21913 | ATAGGGGTCCAATGGTTTGGGG | TTT | chr12 | 21583260 | 21583281 | 21583277 | 21583282 | + |
| SEQ ID NO 21914 | TAGGGGTCCAATGGTTTGGGGC | TTA | chr12 | 21583261 | 21583282 | 21583278 | 21583283 | + |
| SEQ ID NO 21915 | GGGGCTCTTTGAGATATTCCTT | TTT | chr12 | 21583278 | 21583299 | 21583295 | 21583300 | + |
| SEQ ID NO 21916 | GGGCTCTTTGAGATATTCCTTC | TTG | chr12 | 21583279 | 21583300 | 21583296 | 21583301 | + |
| SEQ ID NO 21917 | TTTGAGATATTCCTTCTAAAGT | CTC | chr12 | 21583285 | 21583306 | 21583302 | 21583307 | + |
| SEQ ID NO 21918 | TGAGATATTCCTTCTAAAGTGA | CTT | chr12 | 21583287 | 21583308 | 21583304 | 21583309 | + |
| SEQ ID NO 21919 | GAGATATTCCTTCTAAAGTGAA | TTT | chr12 | 21583288 | 21583309 | 21583305 | 21583310 | + |
| SEQ ID NO 21920 | AGATATTCCTTCTAAAGTGAAG | TTG | chr12 | 21583289 | 21583310 | 21583306 | 21583311 | + |
| SEQ ID NO 21921 | CTTCTAAAGTGAAGGATAATTT | TTC | chr12 | 21583297 | 21583318 | 21583314 | 21583319 | + |
| SEQ ID NO 21922 | CTAAAGTGAAGGATAATTTGCT | CTT | chr12 | 21583300 | 21583321 | 21583317 | 21583322 | + |
| SEQ ID NO 21923 | TAAAGTGAAGGATAATTTGCTG | TTC | chr12 | 21583301 | 21583322 | 21583318 | 21583323 | + |
| SEQ ID NO 21924 | AAGTGAAGGATAATTTGCTGCA | CTA | chr12 | 21583303 | 21583324 | 21583320 | 21583325 | + |
| SEQ ID NO 21925 | GCTGCATTTGGCCACTCTTACA | TTT | chr12 | 21583319 | 21583340 | 21583336 | 21583341 | + |
| SEQ ID NO 21926 | CTGCATTTGGCCACTCTTACAA | TTG | chr12 | 21583320 | 21583341 | 21583337 | 21583342 | + |
| SEQ ID NO 21927 | CATTTGGCCACTCTTACAACCA | CTG | chr12 | 21583323 | 21583344 | 21583340 | 21583345 | + |
| SEQ ID NO 21928 | GGCCACTCTTACAACCAAGAAA | TTT | chr12 | 21583328 | 21583349 | 21583345 | 21583350 | + |
| SEQ ID NO 21929 | GCCACTCTTACAACCAAGAAAT | TTG | chr12 | 21583329 | 21583350 | 21583346 | 21583351 | + |
| SEQ ID NO 21930 | TTACAACCAAGAAATAGGCACA | CTC | chr12 | 21583336 | 21583357 | 21583353 | 21583358 | + |
| SEQ ID NO 21931 | ACAACCAAGAAATAGGCACAAC | CTT | chr12 | 21583338 | 21583359 | 21583355 | 21583360 | + |
| SEQ ID NO 21932 | CAACCAAGAAATAGGCACAACG | TTA | chr12 | 21583339 | 21583360 | 21583356 | 21583361 | + |
| SEQ ID NO 21933 | GTGGGCCTATTTGGATTTTGGA | CTA | chr12 | 21583365 | 21583386 | 21583382 | 21583387 | + |

Figure 48 (Cont'd)

| SEQ ID NO 21934 | TTTGGATTTTGGAGGCAACATA | CTA | chr12 | 21583374 | 21583395 | 21583391 | 21583396 | + |
|---|---|---|---|---|---|---|---|---|
| SEQ ID NO 21935 | GGATTTTGGAGGCAACATATTC | TTT | chr12 | 21583377 | 21583398 | 21583394 | 21583399 | + |
| SEQ ID NO 21936 | GATTTTGGAGGCAACATATTCC | TTG | chr12 | 21583378 | 21583399 | 21583395 | 21583400 | + |
| SEQ ID NO 21937 | TGGAGGCAACATATTCCTGATT | TTT | chr12 | 21583383 | 21583404 | 21583400 | 21583405 | + |
| SEQ ID NO 21938 | GGAGGCAACATATTCCTGATTT | TTT | chr12 | 21583384 | 21583405 | 21583401 | 21583406 | + |
| SEQ ID NO 21939 | GAGGCAACATATTCCTGATTTG | TTG | chr12 | 21583385 | 21583406 | 21583402 | 21583407 | + |
| SEQ ID NO 21940 | CTGATTTGGGTGTGTTACTCTG | TTC | chr12 | 21583399 | 21583420 | 21583416 | 21583421 | + |
| SEQ ID NO 21941 | ATTTGGGTGTGTTACTCTGGCC | CTG | chr12 | 21583402 | 21583423 | 21583419 | 21583424 | + |
| SEQ ID NO 21942 | GGGTGTGTTACTCTGGCCCATT | TTT | chr12 | 21583406 | 21583427 | 21583423 | 21583428 | + |
| SEQ ID NO 21943 | GGTGTGTTACTCTGGCCCATTT | TTG | chr12 | 21583407 | 21583428 | 21583424 | 21583429 | + |
| SEQ ID NO 21944 | CTCTGGCCCATTTATCGAGTGA | TTA | chr12 | 21583416 | 21583437 | 21583433 | 21583438 | + |
| SEQ ID NO 21945 | TGGCCCATTTATCGAGTGATCC | CTC | chr12 | 21583419 | 21583440 | 21583436 | 21583441 | + |
| SEQ ID NO 21946 | GCCCATTTATCGAGTGATCCAA | CTG | chr12 | 21583421 | 21583442 | 21583438 | 21583443 | + |
| SEQ ID NO 21947 | ATCGAGTGATCCAAAAGGCTGC | TTT | chr12 | 21583429 | 21583450 | 21583446 | 21583451 | + |
| SEQ ID NO 21948 | TCGAGTGATCCAAAAGGCTGCC | TTA | chr12 | 21583430 | 21583451 | 21583447 | 21583452 | + |
| SEQ ID NO 21949 | CCAGTTTTGAGTGGAGTCCAGA | CTG | chr12 | 21583450 | 21583471 | 21583467 | 21583472 | + |
| SEQ ID NO 21950 | TGAGTGGAGTCCAGAACAGAAG | TTT | chr12 | 21583457 | 21583478 | 21583474 | 21583479 | + |
| SEQ ID NO 21951 | GAGTGGAGTCCAGAACAGAAGG | TTT | chr12 | 21583458 | 21583479 | 21583475 | 21583480 | + |
| SEQ ID NO 21952 | AGTGGAGTCCAGAACAGAAGGC | TTG | chr12 | 21583459 | 21583480 | 21583476 | 21583481 | + |
| SEQ ID NO 21953 | TGCCACAGGTCCAGGCTGCTGT | CTC | chr12 | 21583483 | 21583504 | 21583500 | 21583505 | + |
| SEQ ID NO 21954 | CCACAGGTCCAGGCTGCTGTGC | CTG | chr12 | 21583485 | 21583506 | 21583502 | 21583507 | + |
| SEQ ID NO 21955 | CTGTGCAAGCTGCTATGCCACT | CTG | chr12 | 21583501 | 21583522 | 21583518 | 21583523 | + |
| SEQ ID NO 21956 | TGCAAGCTGCTATGCCACTTGG | CTG | chr12 | 21583504 | 21583525 | 21583521 | 21583526 | + |
| SEQ ID NO 21957 | CTATGCCACTTGGGCCATATGA | CTG | chr12 | 21583513 | 21583534 | 21583530 | 21583535 | + |
| SEQ ID NO 21958 | TGCCACTTGGGCCATATGACCT | CTA | chr12 | 21583516 | 21583537 | 21583533 | 21583538 | + |
| SEQ ID NO 21959 | GGGCCATATGACCTAGCAGATC | CTT | chr12 | 21583524 | 21583545 | 21583541 | 21583546 | + |
| SEQ ID NO 21960 | GGCCATATGACCTAGCAGATCC | TTG | chr12 | 21583525 | 21583546 | 21583542 | 21583547 | + |
| SEQ ID NO 21961 | GCAGATCCAATGATGCTTGAGG | CTA | chr12 | 21583539 | 21583560 | 21583556 | 21583561 | + |
| SEQ ID NO 21962 | GAGGTGTCAGTGCCAGATAGGG | CTT | chr12 | 21583557 | 21583578 | 21583574 | 21583579 | + |
| SEQ ID NO 21963 | AGGTGTCAGTGCCAGATAGGGA | TTG | chr12 | 21583558 | 21583579 | 21583575 | 21583580 | + |
| SEQ ID NO 21964 | TTTGGAGCATTTGGCAGGCTGA | CTG | chr12 | 21583585 | 21583606 | 21583602 | 21583607 | + |
| SEQ ID NO 21965 | GGAGCATTTGGCAGGCTGAATC | TTT | chr12 | 21583588 | 21583609 | 21583605 | 21583610 | + |
| SEQ ID NO 21966 | GAGCATTTGGCAGGCTGAATCA | TTG | chr12 | 21583589 | 21583610 | 21583606 | 21583611 | + |
| SEQ ID NO 21967 | GGCAGGCTGAATCACAGCGGAG | TTT | chr12 | 21583597 | 21583618 | 21583614 | 21583619 | + |
| SEQ ID NO 21968 | GCAGGCTGAATCACAGCGGAGG | TTG | chr12 | 21583598 | 21583619 | 21583615 | 21583620 | + |
| SEQ ID NO 21969 | AATCACAGCGGAGGCCTCTAGG | CTG | chr12 | 21583606 | 21583627 | 21583623 | 21583628 | + |
| SEQ ID NO 21970 | TAGGATTTTGGAGCAAGGCCCT | CTC | chr12 | 21583624 | 21583645 | 21583641 | 21583646 | + |
| SEQ ID NO 21971 | GGATTTTGGAGCAAGGCCCTGC | CTA | chr12 | 21583626 | 21583647 | 21583643 | 21583648 | + |
| SEQ ID NO 21972 | TGGAGCAAGGCCCTGCCATCTT | TTT | chr12 | 21583632 | 21583653 | 21583649 | 21583654 | + |
| SEQ ID NO 21973 | GGAGCAAGGCCCTGCCATCTTC | TTT | chr12 | 21583633 | 21583654 | 21583650 | 21583655 | + |
| SEQ ID NO 21974 | GAGCAAGGCCCTGCCATCTTCT | TTG | chr12 | 21583634 | 21583655 | 21583651 | 21583656 | + |
| SEQ ID NO 21975 | CCATCTTCTGCAGATAACTACT | CTG | chr12 | 21583647 | 21583668 | 21583664 | 21583669 | + |
| SEQ ID NO 21976 | CTGCAGATAACTACTCTCTTTT | CTT | chr12 | 21583654 | 21583675 | 21583671 | 21583676 | + |
| SEQ ID NO 21977 | TGCAGATAACTACTCTCTTTTA | TTC | chr12 | 21583655 | 21583676 | 21583672 | 21583677 | + |
| SEQ ID NO 21978 | CAGATAACTACTCTCTTTTAGG | CTG | chr12 | 21583657 | 21583678 | 21583674 | 21583679 | + |
| SEQ ID NO 21979 | CTCTCTTTTAGGGAGAAAGCTC | CTA | chr12 | 21583667 | 21583688 | 21583684 | 21583689 | + |
| SEQ ID NO 21980 | TCTTTTAGGGAGAAAGCTCTTG | CTC | chr12 | 21583670 | 21583691 | 21583687 | 21583692 | + |
| SEQ ID NO 21981 | TTTTAGGGAGAAAGCTCTTGGC | CTC | chr12 | 21583672 | 21583693 | 21583689 | 21583694 | + |
| SEQ ID NO 21982 | TTAGGGAGAAAGCTCTTGGCCT | CTT | chr12 | 21583674 | 21583695 | 21583691 | 21583696 | + |
| SEQ ID NO 21983 | TAGGGAGAAAGCTCTTGGCCTG | TTT | chr12 | 21583675 | 21583696 | 21583692 | 21583697 | + |
| SEQ ID NO 21984 | AGGGAGAAAGCTCTTGGCCTGT | TTT | chr12 | 21583676 | 21583697 | 21583693 | 21583698 | + |
| SEQ ID NO 21985 | GGGAGAAAGCTCTTGGCCTGTT | TTA | chr12 | 21583677 | 21583698 | 21583694 | 21583699 | + |
| SEQ ID NO 21986 | TTGGCCTGTTACTGGGCTTTGG | CTC | chr12 | 21583689 | 21583710 | 21583706 | 21583711 | + |
| SEQ ID NO 21987 | GGCCTGTTACTGGGCTTTGGTG | CTT | chr12 | 21583691 | 21583712 | 21583708 | 21583713 | + |
| SEQ ID NO 21988 | GCCTGTTACTGGGCTTTGGTGG | TTG | chr12 | 21583692 | 21583713 | 21583709 | 21583714 | + |
| SEQ ID NO 21989 | TTACTGGGCTTTGGTGGAAACG | CTG | chr12 | 21583697 | 21583718 | 21583714 | 21583719 | + |
| SEQ ID NO 21990 | CTGGGCTTTGGTGGAAACGAAA | TTA | chr12 | 21583700 | 21583721 | 21583717 | 21583722 | + |
| SEQ ID NO 21991 | GGCTTTGGTGGAAACGAAATAT | CTG | chr12 | 21583703 | 21583724 | 21583720 | 21583725 | + |

Figure 48 (Cont'd)

| SEQ ID NO 21992 | TGGTGGAAACGAAATATTTGAC | CTT | chr12 | 21583708 | 21583729 | 21583725 | 21583730 | + |
|---|---|---|---|---|---|---|---|---|
| SEQ ID NO 21993 | GGTGGAAACGAAATATTTGACT | TTT | chr12 | 21583709 | 21583730 | 21583726 | 21583731 | + |
| SEQ ID NO 21994 | GTGGAAACGAAATATTTGACTA | TTG | chr12 | 21583710 | 21583731 | 21583727 | 21583732 | + |
| SEQ ID NO 21995 | GACTATGAGTCATCAAGTCACC | TTT | chr12 | 21583727 | 21583748 | 21583744 | 21583749 | + |
| SEQ ID NO 21996 | ACTATGAGTCATCAAGTCACCA | TTG | chr12 | 21583728 | 21583749 | 21583745 | 21583750 | + |
| SEQ ID NO 21997 | TGAGTCATCAAGTCACCATGTG | CTA | chr12 | 21583732 | 21583753 | 21583749 | 21583754 | + |
| SEQ ID NO 21998 | AACTGCCTATCATGAACTGGGT | CTG | chr12 | 21583759 | 21583780 | 21583776 | 21583781 | + |
| SEQ ID NO 21999 | CCTATCATGAACTGGGTGCTTT | CTG | chr12 | 21583764 | 21583785 | 21583781 | 21583786 | + |
| SEQ ID NO 22000 | TCATGAACTGGGTGCTTTCTGA | CTA | chr12 | 21583768 | 21583789 | 21583785 | 21583790 | + |
| SEQ ID NO 22001 | GGTGCTTTCTGATCCATCTAGC | CTG | chr12 | 21583778 | 21583799 | 21583795 | 21583800 | + |
| SEQ ID NO 22002 | TCTGATCCATCTAGCCATAAAG | CTT | chr12 | 21583785 | 21583806 | 21583802 | 21583807 | + |
| SEQ ID NO 22003 | CTGATCCATCTAGCCATAAAGT | TTT | chr12 | 21583786 | 21583807 | 21583803 | 21583808 | + |
| SEQ ID NO 22004 | TGATCCATCTAGCCATAAAGTG | TTC | chr12 | 21583787 | 21583808 | 21583804 | 21583809 | + |
| SEQ ID NO 22005 | ATCCATCTAGCCATAAAGTGGG | CTG | chr12 | 21583789 | 21583810 | 21583806 | 21583811 | + |
| SEQ ID NO 22006 | GCCATAAAGTGGGCTGTGCACA | CTA | chr12 | 21583798 | 21583819 | 21583815 | 21583820 | + |
| SEQ ID NO 22007 | TGCACAGCAGCATTGCATCAGC | CTG | chr12 | 21583814 | 21583835 | 21583831 | 21583836 | + |
| SEQ ID NO 22008 | CATCAGCAAATGGAAGTGGTAT | TTG | chr12 | 21583829 | 21583850 | 21583846 | 21583851 | + |
| SEQ ID NO 22009 | GGCTTGAGCAGATCCTGAAGGC | TTG | chr12 | 21583862 | 21583883 | 21583879 | 21583884 | + |
| SEQ ID NO 22010 | GAGCAGATCCTGAAGGCACTAG | CTT | chr12 | 21583867 | 21583888 | 21583884 | 21583889 | + |
| SEQ ID NO 22011 | AGCAGATCCTGAAGGCACTAGT | TTG | chr12 | 21583868 | 21583889 | 21583885 | 21583890 | + |
| SEQ ID NO 22012 | AAGGCACTAGTAAGTTACATGA | CTG | chr12 | 21583879 | 21583900 | 21583896 | 21583901 | + |
| SEQ ID NO 22013 | GTAAGTTACATGAGAAAGGGGC | CTA | chr12 | 21583888 | 21583909 | 21583905 | 21583910 | + |
| SEQ ID NO 22014 | CATGAGAAAGGGGCTCAAATGC | TTA | chr12 | 21583896 | 21583917 | 21583913 | 21583918 | + |
| SEQ ID NO 22015 | AAATGCCCATGGTCTCCACTCC | CTC | chr12 | 21583912 | 21583933 | 21583929 | 21583934 | + |
| SEQ ID NO 22016 | CACTCCTGACACACTGCTTTCT | CTC | chr12 | 21583928 | 21583949 | 21583945 | 21583950 | + |
| SEQ ID NO 22017 | CTGACACACTGCTTTCTCTCCC | CTC | chr12 | 21583933 | 21583954 | 21583950 | 21583955 | + |
| SEQ ID NO 22018 | ACACACTGCTTTCTCTCCCTGA | CTG | chr12 | 21583936 | 21583957 | 21583953 | 21583958 | + |
| SEQ ID NO 22019 | CTTTCTCTCCCTGAGACTGCAC | CTG | chr12 | 21583944 | 21583965 | 21583961 | 21583966 | + |
| SEQ ID NO 22020 | TCTCTCCCTGAGACTGCACCGA | CTT | chr12 | 21583947 | 21583968 | 21583964 | 21583969 | + |
| SEQ ID NO 22021 | CTCTCCCTGAGACTGCACCGAT | TTT | chr12 | 21583948 | 21583969 | 21583965 | 21583970 | + |
| SEQ ID NO 22022 | TCTCCCTGAGACTGCACCGATG | TTC | chr12 | 21583949 | 21583970 | 21583966 | 21583971 | + |
| SEQ ID NO 22023 | TCCCTGAGACTGCACCGATGGT | CTC | chr12 | 21583951 | 21583972 | 21583968 | 21583973 | + |
| SEQ ID NO 22024 | CCTGAGACTGCACCGATGGTCT | CTC | chr12 | 21583953 | 21583974 | 21583970 | 21583975 | + |
| SEQ ID NO 22025 | AGACTGCACCGATGGTCTCATG | CTG | chr12 | 21583957 | 21583978 | 21583974 | 21583979 | + |
| SEQ ID NO 22026 | CACCGATGGTCTCATGGGGAGT | CTG | chr12 | 21583963 | 21583984 | 21583980 | 21583985 | + |
| SEQ ID NO 22027 | ATGGGGAGTTCCCTATGATCAG | CTC | chr12 | 21583976 | 21583997 | 21583993 | 21583998 | + |
| SEQ ID NO 22028 | CCTATGATCAGCTGACAGAGGA | TTC | chr12 | 21583987 | 21584008 | 21584004 | 21584009 | + |
| SEQ ID NO 22029 | TGATCAGCTGACAGAGGAAGAG | CTA | chr12 | 21583991 | 21584012 | 21584008 | 21584013 | + |
| SEQ ID NO 22030 | ACAGAGGAAGAGAAGACTAGGT | CTG | chr12 | 21584001 | 21584022 | 21584018 | 21584023 | + |
| SEQ ID NO 22031 | GGTCCTGGTTCACAGATAGTTC | CTA | chr12 | 21584020 | 21584041 | 21584037 | 21584042 | + |
| SEQ ID NO 22032 | GTTCACAGATAGTTCTGCACGA | CTG | chr12 | 21584027 | 21584048 | 21584044 | 21584049 | + |
| SEQ ID NO 22033 | ACAGATAGTTCTGCACGATATG | TTC | chr12 | 21584031 | 21584052 | 21584048 | 21584053 | + |
| SEQ ID NO 22034 | TGCACGATATGCAGGCACCACC | TTC | chr12 | 21584042 | 21584063 | 21584059 | 21584064 | + |
| SEQ ID NO 22035 | CACGATATGCAGGCACCACCCA | CTG | chr12 | 21584044 | 21584065 | 21584061 | 21584066 | + |
| SEQ ID NO 22036 | CAGCCCCTTTCTAGGACATCCC | CTA | chr12 | 21584088 | 21584109 | 21584105 | 21584110 | + |
| SEQ ID NO 22037 | TCTAGGACATCCCTGAAGGACA | CTT | chr12 | 21584097 | 21584118 | 21584114 | 21584119 | + |
| SEQ ID NO 22038 | CTAGGACATCCCTGAAGGACAA | TTT | chr12 | 21584098 | 21584119 | 21584115 | 21584120 | + |
| SEQ ID NO 22039 | TAGGACATCCCTGAAGGACAAC | TTC | chr12 | 21584099 | 21584120 | 21584116 | 21584121 | + |
| SEQ ID NO 22040 | GGACATCCCTGAAGGACAACGG | CTA | chr12 | 21584101 | 21584122 | 21584118 | 21584123 | + |
| SEQ ID NO 22041 | AAGGACAACGGTGAAGGGAAAT | CTG | chr12 | 21584112 | 21584133 | 21584129 | 21584134 | + |
| SEQ ID NO 22042 | CCTAGTTGGCAGAACTTTGAGC | CTT | chr12 | 21584137 | 21584158 | 21584154 | 21584159 | + |
| SEQ ID NO 22043 | CTAGTTGGCAGAACTTTGAGCA | TTC | chr12 | 21584138 | 21584159 | 21584155 | 21584160 | + |
| SEQ ID NO 22044 | GTTGGCAGAACTTTGAGCAGTG | CTA | chr12 | 21584141 | 21584162 | 21584158 | 21584163 | + |
| SEQ ID NO 22045 | GCAGAACTTTGAGCAGTGTGCC | TTG | chr12 | 21584145 | 21584166 | 21584162 | 21584167 | + |
| SEQ ID NO 22046 | TGAGCAGTGTGCCTGGTTGTGC | CTT | chr12 | 21584154 | 21584175 | 21584171 | 21584176 | + |
| SEQ ID NO 22047 | GAGCAGTGTGCCTGGTTGTGCA | TTT | chr12 | 21584155 | 21584176 | 21584172 | 21584177 | + |
| SEQ ID NO 22048 | AGCAGTGTGCCTGGTTGTGCAC | TTG | chr12 | 21584156 | 21584177 | 21584173 | 21584178 | + |
| SEQ ID NO 22049 | GTTGTGCACTTTGCACAGAAGG | CTG | chr12 | 21584169 | 21584190 | 21584186 | 21584191 | + |

Figure 48 (Cont'd)

| SEQ ID NO 22050 | TGCACTTTGCACAGAAGGAGAA | TTG | chr12 | 21584173 | 21584194 | 21584190 | 21584195 | + |
| SEQ ID NO 22051 | TGCACAGAAGGAGAAATGGCCA | CTT | chr12 | 21584180 | 21584201 | 21584197 | 21584202 | + |
| SEQ ID NO 22052 | GCACAGAAGGAGAAATGGCCAG | TTT | chr12 | 21584181 | 21584202 | 21584198 | 21584203 | + |
| SEQ ID NO 22053 | CACAGAAGGAGAAATGGCCAGA | TTG | chr12 | 21584182 | 21584203 | 21584199 | 21584204 | + |
| SEQ ID NO 22054 | GCGATTATATACTTATTCATGG | TTT | chr12 | 21584207 | 21584228 | 21584224 | 21584229 | + |
| SEQ ID NO 22055 | CGATTATATACTTATTCATGGG | TTG | chr12 | 21584208 | 21584229 | 21584225 | 21584230 | + |
| SEQ ID NO 22056 | TATACTTATTCATGGGCTGTAG | TTA | chr12 | 21584214 | 21584235 | 21584231 | 21584236 | + |
| SEQ ID NO 22057 | ATTCATGGGCTGTAGCCAAAGG | CTT | chr12 | 21584221 | 21584242 | 21584238 | 21584243 | + |
| SEQ ID NO 22058 | TTCATGGGCTGTAGCCAAAGGT | TTA | chr12 | 21584222 | 21584243 | 21584239 | 21584244 | + |
| SEQ ID NO 22059 | ATGGGCTGTAGCCAAAGGTTTG | TTC | chr12 | 21584225 | 21584246 | 21584242 | 21584247 | + |
| SEQ ID NO 22060 | TAGCCAAAGGTTTGGCTAGATG | CTG | chr12 | 21584233 | 21584254 | 21584250 | 21584255 | + |
| SEQ ID NO 22061 | GGCTAGATGGTCAGGGACTTGG | TTT | chr12 | 21584246 | 21584267 | 21584263 | 21584268 | + |
| SEQ ID NO 22062 | GCTAGATGGTCAGGGACTTGGA | TTG | chr12 | 21584247 | 21584268 | 21584264 | 21584269 | + |
| SEQ ID NO 22063 | GATGGTCAGGGACTTGGAAAAA | CTA | chr12 | 21584251 | 21584272 | 21584268 | 21584273 | + |
| SEQ ID NO 22064 | GGAAAAAGCATGACTGGAAAAT | CTT | chr12 | 21584266 | 21584287 | 21584283 | 21584288 | + |
| SEQ ID NO 22065 | GAAAAAGCATGACTGGAAAATT | TTG | chr12 | 21584267 | 21584288 | 21584284 | 21584289 | + |
| SEQ ID NO 22066 | GAAAATTGATGACAAAGAAATT | CTG | chr12 | 21584282 | 21584303 | 21584299 | 21584304 | + |
| SEQ ID NO 22067 | ATGACAAAGAAATTTGGGGAAG | TTG | chr12 | 21584290 | 21584311 | 21584307 | 21584312 | + |
| SEQ ID NO 22068 | GGGGAAGAGGTATGTGGATGGA | TTT | chr12 | 21584305 | 21584326 | 21584322 | 21584327 | + |
| SEQ ID NO 22069 | GGGAAGAGGTATGTGGATGGAC | TTG | chr12 | 21584306 | 21584327 | 21584323 | 21584328 | + |
| SEQ ID NO 22070 | TATGATTAGTCAAAAACTACAA | CTC | chr12 | 21584331 | 21584352 | 21584348 | 21584353 | + |
| SEQ ID NO 22071 | TGATTAGTCAAAAACTACAAAG | CTA | chr12 | 21584333 | 21584354 | 21584350 | 21584355 | + |
| SEQ ID NO 22072 | GTCAAAAACTACAAAGATATTT | TTA | chr12 | 21584339 | 21584360 | 21584356 | 21584361 | + |
| SEQ ID NO 22073 | CAAAGATATTTTCATCCCATGT | CTA | chr12 | 21584350 | 21584371 | 21584367 | 21584372 | + |
| SEQ ID NO 22074 | TCATCCCATGTGAGTGCTCACC | TTT | chr12 | 21584361 | 21584382 | 21584378 | 21584383 | + |
| SEQ ID NO 22075 | CATCCCATGTGAGTGCTCACCA | TTT | chr12 | 21584362 | 21584383 | 21584379 | 21584384 | + |
| SEQ ID NO 22076 | ATCCCATGTGAGTGCTCACCAA | TTC | chr12 | 21584363 | 21584384 | 21584380 | 21584385 | + |
| SEQ ID NO 22077 | ACCAATGGGTGACCTCAGCAGA | CTC | chr12 | 21584380 | 21584401 | 21584397 | 21584402 | + |
| SEQ ID NO 22078 | AGCAGAAGAGGATTTTAATAAT | CTC | chr12 | 21584396 | 21584417 | 21584413 | 21584418 | + |
| SEQ ID NO 22079 | TAATAATCAAGTGGATAGGATG | TTT | chr12 | 21584411 | 21584432 | 21584428 | 21584433 | + |
| SEQ ID NO 22080 | AATAATCAAGTGGATAGGATGA | TTT | chr12 | 21584412 | 21584433 | 21584429 | 21584434 | + |
| SEQ ID NO 22081 | ATAATCAAGTGGATAGGATGAT | TTA | chr12 | 21584413 | 21584434 | 21584430 | 21584435 | + |
| SEQ ID NO 22082 | TGTGGACACCACTCAGCCTTTT | TTC | chr12 | 21584441 | 21584462 | 21584458 | 21584463 | + |
| SEQ ID NO 22083 | TGGACACCACTCAGCCTTTTCC | CTG | chr12 | 21584443 | 21584464 | 21584460 | 21584465 | + |
| SEQ ID NO 22084 | AGCCTTTTCCCAGGCCACTCAT | CTC | chr12 | 21584455 | 21584476 | 21584472 | 21584477 | + |
| SEQ ID NO 22085 | TTCCCAGGCCACTCATGTCATC | CTT | chr12 | 21584461 | 21584482 | 21584478 | 21584483 | + |
| SEQ ID NO 22086 | TCCCAGGCCACTCATGTCATCG | TTT | chr12 | 21584462 | 21584483 | 21584479 | 21584484 | + |
| SEQ ID NO 22087 | CCCAGGCCACTCATGTCATCGT | TTT | chr12 | 21584463 | 21584484 | 21584480 | 21584485 | + |
| SEQ ID NO 22088 | CCAGGCCACTCATGTCATCGTC | TTC | chr12 | 21584464 | 21584485 | 21584481 | 21584486 | + |
| SEQ ID NO 22089 | ATGTCATCGTCCAATGGACCCA | CTC | chr12 | 21584475 | 21584496 | 21584492 | 21584497 | + |
| SEQ ID NO 22090 | CAGGGATGGAAGTTATGCTTGG | TTG | chr12 | 21584518 | 21584539 | 21584535 | 21584540 | + |
| SEQ ID NO 22091 | TGCTTGGGCTCAGCAACATGGA | TTA | chr12 | 21584533 | 21584554 | 21584550 | 21584555 | + |
| SEQ ID NO 22092 | GGGCTCAGCAACATGGACTTCC | CTT | chr12 | 21584538 | 21584559 | 21584555 | 21584560 | + |
| SEQ ID NO 22093 | GGCTCAGCAACATGGACTTCCA | TTG | chr12 | 21584539 | 21584560 | 21584556 | 21584561 | + |
| SEQ ID NO 22094 | AGCAACATGGACTTCCACTCAC | CTC | chr12 | 21584544 | 21584565 | 21584561 | 21584566 | + |
| SEQ ID NO 22095 | CCACTCACCAAAGCTGACCTGG | CTT | chr12 | 21584558 | 21584579 | 21584575 | 21584580 | + |
| SEQ ID NO 22096 | CACTCACCAAAGCTGACCTGGC | TTC | chr12 | 21584559 | 21584580 | 21584576 | 21584581 | + |
| SEQ ID NO 22097 | ACCAAAGCTGACCTGGCCACAG | CTC | chr12 | 21584564 | 21584585 | 21584581 | 21584586 | + |
| SEQ ID NO 22098 | ACCTGGCCACAGCCACTGCTTG | CTG | chr12 | 21584574 | 21584595 | 21584591 | 21584596 | + |
| SEQ ID NO 22099 | GCCACAGCCACTGCTTGCCAGC | CTG | chr12 | 21584579 | 21584600 | 21584596 | 21584601 | + |
| SEQ ID NO 22100 | CTTGCCAGCATCAGAGACCAAC | CTG | chr12 | 21584592 | 21584613 | 21584609 | 21584614 | + |
| SEQ ID NO 22101 | GCCAGCATCAGAGACCAACACT | CTT | chr12 | 21584595 | 21584616 | 21584612 | 21584617 | + |
| SEQ ID NO 22102 | CCAGCATCAGAGACCAACACTA | TTG | chr12 | 21584596 | 21584617 | 21584613 | 21584618 | + |
| SEQ ID NO 22103 | AGCCCTTGATATGGCACCATTC | CTA | chr12 | 21584618 | 21584639 | 21584635 | 21584640 | + |
| SEQ ID NO 22104 | GATATGGCACCATTCCTCGGGG | CTT | chr12 | 21584625 | 21584646 | 21584642 | 21584647 | + |
| SEQ ID NO 22105 | ATATGGCACCATTCCTCGGGGT | TTG | chr12 | 21584626 | 21584647 | 21584643 | 21584648 | + |
| SEQ ID NO 22106 | CTCGGGGTGATCAGCCAGCTAC | TTC | chr12 | 21584640 | 21584661 | 21584657 | 21584662 | + |
| SEQ ID NO 22107 | GGGGTGATCAGCCAGCTACCTG | CTC | chr12 | 21584643 | 21584664 | 21584660 | 21584665 | + |

Figure 48 (Cont'd)

| SEQ ID NO 22108 | CCTGGTGGCAGGTTGATTATAT | CTA | chr12 | 21584661 | 21584682 | 21584678 | 21584683 | + |
|---|---|---|---|---|---|---|---|---|
| SEQ ID NO 22109 | GTGGCAGGTTGATTATATTGGA | CTG | chr12 | 21584665 | 21584686 | 21584682 | 21584687 | + |
| SEQ ID NO 22110 | ATTATATTGGACCTCTTCCATC | TTG | chr12 | 21584676 | 21584697 | 21584693 | 21584698 | + |
| SEQ ID NO 22111 | TATTGGACCTCTTCCATCATGG | TTA | chr12 | 21584680 | 21584701 | 21584697 | 21584702 | + |
| SEQ ID NO 22112 | GACCTCTTCCATCATGGAAAGG | TTG | chr12 | 21584685 | 21584706 | 21584702 | 21584707 | + |
| SEQ ID NO 22113 | TTCCATCATGGAAAGGGCAGAG | CTC | chr12 | 21584691 | 21584712 | 21584708 | 21584713 | + |
| SEQ ID NO 22114 | CCATCATGGAAAGGGCAGAGGC | CTT | chr12 | 21584693 | 21584714 | 21584710 | 21584715 | + |
| SEQ ID NO 22115 | CATCATGGAAAGGGCAGAGGCT | TTC | chr12 | 21584694 | 21584715 | 21584711 | 21584716 | + |
| SEQ ID NO 22116 | GTCCTCACTGGAATAGACACTT | CTT | chr12 | 21584717 | 21584738 | 21584734 | 21584739 | + |
| SEQ ID NO 22117 | TCCTCACTGGAATAGACACTTA | TTG | chr12 | 21584718 | 21584739 | 21584735 | 21584740 | + |
| SEQ ID NO 22118 | ACTGGAATAGACACTTACTCTG | CTC | chr12 | 21584723 | 21584744 | 21584740 | 21584745 | + |
| SEQ ID NO 22119 | GAATAGACACTTACTCTGGATA | CTG | chr12 | 21584727 | 21584748 | 21584744 | 21584749 | + |
| SEQ ID NO 22120 | ACTCTGGATATGGGTTTCCCAA | CTT | chr12 | 21584739 | 21584760 | 21584756 | 21584761 | + |
| SEQ ID NO 22121 | CTCTGGATATGGGTTTCCCAAT | TTA | chr12 | 21584740 | 21584761 | 21584757 | 21584762 | + |
| SEQ ID NO 22122 | TGGATATGGGTTTCCCAATCCT | CTC | chr12 | 21584743 | 21584764 | 21584760 | 21584765 | + |
| SEQ ID NO 22123 | GATATGGGTTTCCCAATCCTGA | CTG | chr12 | 21584745 | 21584766 | 21584762 | 21584767 | + |
| SEQ ID NO 22124 | CCCAATCCTGAACTCAATGCTT | TTT | chr12 | 21584756 | 21584777 | 21584773 | 21584778 | + |
| SEQ ID NO 22125 | CCAATCCTGAACTCAATGCTTA | TTC | chr12 | 21584757 | 21584778 | 21584774 | 21584779 | + |
| SEQ ID NO 22126 | AACTCAATGCTTATGCCAAGAC | CTG | chr12 | 21584766 | 21584787 | 21584783 | 21584788 | + |
| SEQ ID NO 22127 | AATGCTTATGCCAAGACTACCA | CTC | chr12 | 21584771 | 21584792 | 21584788 | 21584793 | + |
| SEQ ID NO 22128 | ATGCCAAGACTACCATCCATGG | CTT | chr12 | 21584778 | 21584799 | 21584795 | 21584800 | + |
| SEQ ID NO 22129 | TGCCAAGACTACCATCCATGGA | TTA | chr12 | 21584779 | 21584800 | 21584796 | 21584801 | + |
| SEQ ID NO 22130 | CCATCCATGGAATCACAGAATG | CTA | chr12 | 21584790 | 21584811 | 21584807 | 21584812 | + |
| SEQ ID NO 22131 | TCATGGTATTCCACACAGCATT | CTG | chr12 | 21584824 | 21584845 | 21584841 | 21584846 | + |
| SEQ ID NO 22132 | CACACAGCATTGCTTCTGACCA | TTC | chr12 | 21584835 | 21584856 | 21584852 | 21584857 | + |
| SEQ ID NO 22133 | CTTCTGACCAAGCCACTCACTT | TTG | chr12 | 21584847 | 21584868 | 21584864 | 21584869 | + |
| SEQ ID NO 22134 | CTGACCAAGCCACTCACTTTAT | CTT | chr12 | 21584850 | 21584871 | 21584867 | 21584872 | + |
| SEQ ID NO 22135 | TGACCAAGCCACTCACTTTATG | TTC | chr12 | 21584851 | 21584872 | 21584868 | 21584873 | + |
| SEQ ID NO 22136 | ACCAAGCCACTCACTTTATGGC | CTG | chr12 | 21584853 | 21584874 | 21584870 | 21584875 | + |
| SEQ ID NO 22137 | ACTTTATGGCTAAAGAAGTGTG | CTC | chr12 | 21584865 | 21584886 | 21584882 | 21584887 | + |
| SEQ ID NO 22138 | TATGGCTAAAGAAGTGTGACAG | CTT | chr12 | 21584869 | 21584890 | 21584886 | 21584891 | + |
| SEQ ID NO 22139 | ATGGCTAAAGAAGTGTGACAGT | TTT | chr12 | 21584870 | 21584891 | 21584887 | 21584892 | + |
| SEQ ID NO 22140 | TGGCTAAAGAAGTGTGACAGTG | TTA | chr12 | 21584871 | 21584892 | 21584888 | 21584893 | + |
| SEQ ID NO 22141 | AAGAAGTGTGACAGTGGGCTCA | CTA | chr12 | 21584877 | 21584898 | 21584894 | 21584899 | + |
| SEQ ID NO 22142 | ATGCTCATGGAATTTACTGGTC | CTC | chr12 | 21584898 | 21584919 | 21584915 | 21584920 | + |
| SEQ ID NO 22143 | ATGGAATTTACTGGTCTTACCA | CTC | chr12 | 21584904 | 21584925 | 21584921 | 21584926 | + |
| SEQ ID NO 22144 | ACTGGTCTTACCATGATCCCTA | TTT | chr12 | 21584913 | 21584934 | 21584930 | 21584935 | + |
| SEQ ID NO 22145 | CTGGTCTTACCATGATCCCTAT | TTA | chr12 | 21584914 | 21584935 | 21584931 | 21584936 | + |
| SEQ ID NO 22146 | GTCTTACCATGATCCCTATCAT | CTG | chr12 | 21584917 | 21584938 | 21584934 | 21584939 | + |
| SEQ ID NO 22147 | ACCATGATCCCTATCATCCTGA | CTT | chr12 | 21584922 | 21584943 | 21584939 | 21584944 | + |
| SEQ ID NO 22148 | CCATGATCCCTATCATCCTGAA | TTA | chr12 | 21584923 | 21584944 | 21584940 | 21584945 | + |
| SEQ ID NO 22149 | TCATCCTGAAGCAGCTTTTGAA | CTA | chr12 | 21584935 | 21584956 | 21584952 | 21584957 | + |
| SEQ ID NO 22150 | AAGCAGCTTTTGAATGGCCTTT | CTG | chr12 | 21584943 | 21584964 | 21584960 | 21584965 | + |
| SEQ ID NO 22151 | TTGAATGGCCTTTTGAAGTCAC | CTT | chr12 | 21584952 | 21584973 | 21584969 | 21584974 | + |
| SEQ ID NO 22152 | TGAATGGCCTTTTGAAGTCACG | TTT | chr12 | 21584953 | 21584974 | 21584970 | 21584975 | + |
| SEQ ID NO 22153 | GAATGGCCTTTTGAAGTCACGA | TTT | chr12 | 21584954 | 21584975 | 21584971 | 21584976 | + |
| SEQ ID NO 22154 | AATGGCCTTTTGAAGTCACGAT | TTG | chr12 | 21584955 | 21584976 | 21584972 | 21584977 | + |
| SEQ ID NO 22155 | TTGAAGTCACGATTACAATGCC | CTT | chr12 | 21584964 | 21584985 | 21584981 | 21584986 | + |
| SEQ ID NO 22156 | TGAAGTCACGATTACAATGCCA | TTT | chr12 | 21584965 | 21584986 | 21584982 | 21584987 | + |
| SEQ ID NO 22157 | GAAGTCACGATTACAATGCCAA | TTT | chr12 | 21584966 | 21584987 | 21584983 | 21584988 | + |
| SEQ ID NO 22158 | AAGTCACGATTACAATGCCAAC | TTG | chr12 | 21584967 | 21584988 | 21584984 | 21584989 | + |
| SEQ ID NO 22159 | CAATGCCAACTAGGTGACAATA | TTA | chr12 | 21584979 | 21585000 | 21584996 | 21585001 | + |
| SEQ ID NO 22160 | GGTGACAATACTTTGCAGGCCT | CTA | chr12 | 21584991 | 21585012 | 21585008 | 21585013 | + |
| SEQ ID NO 22161 | TGCAGGCCTGGGGCAAAGTTCT | CTT | chr12 | 21585004 | 21585025 | 21585021 | 21585026 | + |
| SEQ ID NO 22162 | GCAGGCCTGGGGCAAAGTTCTC | TTT | chr12 | 21585005 | 21585026 | 21585022 | 21585027 | + |
| SEQ ID NO 22163 | CAGGCCTGGGGCAAAGTTCTCC | TTG | chr12 | 21585006 | 21585027 | 21585023 | 21585028 | + |
| SEQ ID NO 22164 | GGGCAAAGTTCTCCAGAAGGCT | CTG | chr12 | 21585014 | 21585035 | 21585031 | 21585036 | + |
| SEQ ID NO 22165 | TCCAGAAGGCTGTGTATGCTCT | TTC | chr12 | 21585025 | 21585046 | 21585042 | 21585047 | + |

Figure 48 (Cont'd)

| | | | | | | | | |
|---|---|---|---|---|---|---|---|---|
| SEQ ID NO 22166 | CAGAAGGCTGTGTATGCTCTGA | CTC | chr12 | 21585027 | 21585048 | 21585044 | 21585049 | + |
| SEQ ID NO 22167 | TGTATGCTCTGAATCAGTGTCC | CTG | chr12 | 21585037 | 21585058 | 21585054 | 21585059 | + |
| SEQ ID NO 22168 | TGAATCAGTGTCCAATATATGG | CTC | chr12 | 21585046 | 21585067 | 21585063 | 21585068 | + |
| SEQ ID NO 22169 | AATCAGTGTCCAATATATGGTA | CTG | chr12 | 21585048 | 21585069 | 21585065 | 21585070 | + |
| SEQ ID NO 22170 | TTTCTCCCATAGACAGGATTCA | CTG | chr12 | 21585073 | 21585094 | 21585090 | 21585095 | + |
| SEQ ID NO 22171 | CTCCCATAGACAGGATTCACGG | TTT | chr12 | 21585076 | 21585097 | 21585093 | 21585098 | + |
| SEQ ID NO 22172 | TCCCATAGACAGGATTCACGGG | TTC | chr12 | 21585077 | 21585098 | 21585094 | 21585099 | + |
| SEQ ID NO 22173 | CCATAGACAGGATTCACGGGTC | CTC | chr12 | 21585079 | 21585100 | 21585096 | 21585101 | + |
| SEQ ID NO 22174 | ACGGGTCCAGGAATCAAAGGGT | TTC | chr12 | 21585094 | 21585115 | 21585111 | 21585116 | + |
| SEQ ID NO 22175 | ACCATCACCCCTAGTGTTCCAC | CTC | chr12 | 21585144 | 21585165 | 21585161 | 21585166 | + |
| SEQ ID NO 22176 | GTGTTCCACTAGCAAAATTTTT | CTA | chr12 | 21585157 | 21585178 | 21585174 | 21585179 | + |
| SEQ ID NO 22177 | CACTAGCAAAATTTTTGCTTCC | TTC | chr12 | 21585163 | 21585184 | 21585180 | 21585185 | + |
| SEQ ID NO 22178 | GCAAAATTTTTGCTTCCTGTTC | CTA | chr12 | 21585168 | 21585189 | 21585185 | 21585190 | + |
| SEQ ID NO 22179 | TTGCTTCCTGTTCCCATGGCAT | TTT | chr12 | 21585177 | 21585198 | 21585194 | 21585199 | + |
| SEQ ID NO 22180 | TGCTTCCTGTTCCCATGGCATT | TTT | chr12 | 21585178 | 21585199 | 21585195 | 21585200 | + |
| SEQ ID NO 22181 | GCTTCCTGTTCCCATGGCATTA | TTT | chr12 | 21585179 | 21585200 | 21585196 | 21585201 | + |
| SEQ ID NO 22182 | CTTCCTGTTCCCATGGCATTAT | TTG | chr12 | 21585180 | 21585201 | 21585197 | 21585202 | + |
| SEQ ID NO 22183 | CCTGTTCCCATGGCATTATGTT | CTT | chr12 | 21585183 | 21585204 | 21585200 | 21585205 | + |
| SEQ ID NO 22184 | CTGTTCCCATGGCATTATGTTC | TTC | chr12 | 21585184 | 21585205 | 21585201 | 21585206 | + |
| SEQ ID NO 22185 | TTCCCATGGCATTATGTTCTGC | CTG | chr12 | 21585187 | 21585208 | 21585204 | 21585209 | + |
| SEQ ID NO 22186 | CCATGGCATTATGTTCTGCTGG | TTC | chr12 | 21585190 | 21585211 | 21585207 | 21585212 | + |
| SEQ ID NO 22187 | TGTTCTGCTGGCTTAGAGGTCT | TTA | chr12 | 21585201 | 21585222 | 21585218 | 21585223 | + |
| SEQ ID NO 22188 | TGCTGGCTTAGAGGTCTTAGTT | TTC | chr12 | 21585206 | 21585227 | 21585223 | 21585228 | + |
| SEQ ID NO 22189 | CTGGCTTAGAGGTCTTAGTTCC | CTG | chr12 | 21585208 | 21585229 | 21585225 | 21585230 | + |
| SEQ ID NO 22190 | GCTTAGAGGTCTTAGTTCCAGA | CTG | chr12 | 21585211 | 21585232 | 21585228 | 21585233 | + |
| SEQ ID NO 22191 | AGAGGTCTTAGTTCCAGAGGGA | CTT | chr12 | 21585215 | 21585236 | 21585232 | 21585237 | + |
| SEQ ID NO 22192 | GAGGTCTTAGTTCCAGAGGGAG | TTA | chr12 | 21585216 | 21585237 | 21585233 | 21585238 | + |
| SEQ ID NO 22193 | AGTTCCAGAGGGAGGAACACTG | CTT | chr12 | 21585224 | 21585245 | 21585241 | 21585246 | + |
| SEQ ID NO 22194 | GTTCCAGAGGGAGGAACACTGC | TTA | chr12 | 21585225 | 21585246 | 21585242 | 21585247 | + |
| SEQ ID NO 22195 | CAGAGGGAGGAACACTGCCGCC | TTC | chr12 | 21585229 | 21585250 | 21585246 | 21585251 | + |
| SEQ ID NO 22196 | CCGCCAGGTGACACAATAATGA | CTG | chr12 | 21585246 | 21585267 | 21585263 | 21585268 | + |
| SEQ ID NO 22197 | CATTAAACTGCAAATTAAGATT | TTC | chr12 | 21585271 | 21585292 | 21585288 | 21585293 | + |
| SEQ ID NO 22198 | AACTGCAAATTAAGATTGCCAC | TTA | chr12 | 21585276 | 21585297 | 21585293 | 21585298 | + |
| SEQ ID NO 22199 | CAAATTAAGATTGCCACCTGGA | CTG | chr12 | 21585281 | 21585302 | 21585298 | 21585303 | + |
| SEQ ID NO 22200 | AGATTGCCACCTGGACACTTTG | TTA | chr12 | 21585288 | 21585309 | 21585305 | 21585310 | + |
| SEQ ID NO 22201 | CCACCTGGACACTTTGGGCTCC | TTG | chr12 | 21585294 | 21585315 | 21585311 | 21585316 | + |
| SEQ ID NO 22202 | GACACTTTGGGCTCCTCCCACC | CTG | chr12 | 21585301 | 21585322 | 21585318 | 21585323 | + |
| SEQ ID NO 22203 | TGGGCTCCTCCCACCTTTAAGT | CTT | chr12 | 21585308 | 21585329 | 21585325 | 21585330 | + |
| SEQ ID NO 22204 | GGGCTCCTCCCACCTTTAAGTC | TTT | chr12 | 21585309 | 21585330 | 21585326 | 21585331 | + |
| SEQ ID NO 22205 | GGCTCCTCCCACCTTTAAGTCA | TTG | chr12 | 21585310 | 21585331 | 21585327 | 21585332 | + |
| SEQ ID NO 22206 | CTCCCACCTTTAAGTCAACAGG | CTC | chr12 | 21585315 | 21585336 | 21585332 | 21585337 | + |
| SEQ ID NO 22207 | CCACCTTTAAGTCAACAGGCTA | CTC | chr12 | 21585318 | 21585339 | 21585335 | 21585340 | + |
| SEQ ID NO 22208 | TAAGTCAACAGGCTAAGAAGAG | CTT | chr12 | 21585325 | 21585346 | 21585342 | 21585347 | + |
| SEQ ID NO 22209 | AAGTCAACAGGCTAAGAAGAGA | TTT | chr12 | 21585326 | 21585347 | 21585343 | 21585348 | + |
| SEQ ID NO 22210 | AGTCAACAGGCTAAGAAGAGAG | TTA | chr12 | 21585327 | 21585348 | 21585344 | 21585349 | + |
| SEQ ID NO 22211 | AGAAGAGAGTTACAGTGTTGGC | CTA | chr12 | 21585340 | 21585361 | 21585357 | 21585362 | + |
| SEQ ID NO 22212 | CAGTGTTGGCTGCGGTGATTAA | TTA | chr12 | 21585352 | 21585373 | 21585369 | 21585374 | + |
| SEQ ID NO 22213 | GCTGCGGTGATTAACCCAGACT | TTG | chr12 | 21585360 | 21585381 | 21585377 | 21585382 | + |
| SEQ ID NO 22214 | CGGTGATTAACCCAGACTATCA | CTG | chr12 | 21585364 | 21585385 | 21585381 | 21585386 | + |
| SEQ ID NO 22215 | ACCCAGACTATCAAGATGAAAT | TTA | chr12 | 21585373 | 21585394 | 21585390 | 21585395 | + |
| SEQ ID NO 22216 | TCAAGATGAAATCAGTCTACAA | CTA | chr12 | 21585383 | 21585404 | 21585400 | 21585405 | + |
| SEQ ID NO 22217 | CAACTCCACAATGGAGGTAAGG | CTA | chr12 | 21585402 | 21585423 | 21585419 | 21585424 | + |
| SEQ ID NO 22218 | CACAATGGAGGTAAGGAAGCGT | CTC | chr12 | 21585408 | 21585429 | 21585425 | 21585430 | + |
| SEQ ID NO 22219 | GGGTGTCTCTTAGTTTTACCAT | TTA | chr12 | 21585456 | 21585477 | 21585473 | 21585478 | + |
| SEQ ID NO 22220 | TTAGTTTTACCATGTCCTGGAA | CTC | chr12 | 21585465 | 21585486 | 21585482 | 21585487 | + |
| SEQ ID NO 22221 | AGTTTTACCATGTCCTGGAATT | CTT | chr12 | 21585467 | 21585488 | 21585484 | 21585489 | + |
| SEQ ID NO 22222 | GTTTTACCATGTCCTGGAATTA | TTA | chr12 | 21585468 | 21585489 | 21585485 | 21585490 | + |
| SEQ ID NO 22223 | TACCATGTCCTGGAATTAAGGT | TTT | chr12 | 21585472 | 21585493 | 21585489 | 21585494 | + |

Figure 48 (Cont'd)

| SEQ ID NO 22224 | ACCATGTCCTGGAATTAAGGTC | TTT | chr12 | 21585473 | 21585494 | 21585490 | 21585495 | + |
|---|---|---|---|---|---|---|---|---|
| SEQ ID NO 22225 | CCATGTCCTGGAATTAAGGTCA | TTA | chr12 | 21585474 | 21585495 | 21585491 | 21585496 | + |
| SEQ ID NO 22226 | GAATTAAGGTCAGTGGGAAACT | CTG | chr12 | 21585484 | 21585505 | 21585501 | 21585506 | + |
| SEQ ID NO 22227 | AGGTCAGTGGGAAACTACTACA | TTA | chr12 | 21585490 | 21585511 | 21585507 | 21585512 | + |
| SEQ ID NO 22228 | CTACAGGCCATTCCAGGCAGGA | CTA | chr12 | 21585507 | 21585528 | 21585524 | 21585529 | + |
| SEQ ID NO 22229 | CAGGCCATTCCAGGCAGGACTA | CTA | chr12 | 21585510 | 21585531 | 21585527 | 21585532 | + |
| SEQ ID NO 22230 | CAGGCAGGACTACAAATAAAGG | TTC | chr12 | 21585520 | 21585541 | 21585537 | 21585542 | + |
| SEQ ID NO 22231 | CAAATAAAGGTTTGGGTCACTC | CTA | chr12 | 21585532 | 21585553 | 21585549 | 21585554 | + |
| SEQ ID NO 22232 | GGGTCACTCCACCAGGAAAAAA | TTT | chr12 | 21585545 | 21585566 | 21585562 | 21585567 | + |
| SEQ ID NO 22233 | GGTCACTCCACCAGGAAAAAAA | TTG | chr12 | 21585546 | 21585567 | 21585563 | 21585568 | + |
| SEQ ID NO 22234 | CACCAGGAAAAAAAAAAAAAAA | CTC | chr12 | 21585554 | 21585575 | 21585571 | 21585576 | + |
| SEQ ID NO 22235 | CTGAGGTGCTTGCTGAGGGCAA | CTG | chr12 | 21585590 | 21585611 | 21585607 | 21585612 | + |
| SEQ ID NO 22236 | AGGTGCTTGCTGAGGGCAAAGG | CTG | chr12 | 21585593 | 21585614 | 21585610 | 21585615 | + |
| SEQ ID NO 22237 | GCTGAGGGCAAAGGGAATACAG | CTT | chr12 | 21585601 | 21585622 | 21585618 | 21585623 | + |
| SEQ ID NO 22238 | CTGAGGGCAAAGGGAATACAGA | TTG | chr12 | 21585602 | 21585623 | 21585619 | 21585624 | + |
| SEQ ID NO 22239 | AGGGCAAAGGGAATACAGAATA | CTG | chr12 | 21585605 | 21585626 | 21585622 | 21585627 | + |
| SEQ ID NO 22240 | CGATCACGTGACCAATTGCAGA | CTA | chr12 | 21585661 | 21585682 | 21585678 | 21585683 | + |
| SEQ ID NO 22241 | CAGATACAAGGACTGTAATTGT | TTG | chr12 | 21585679 | 21585700 | 21585696 | 21585701 | + |
| SEQ ID NO 22242 | TAATTGTCATGAGTATTTCCTC | CTG | chr12 | 21585694 | 21585715 | 21585711 | 21585716 | + |
| SEQ ID NO 22243 | TCATGAGTATTTCCTCCTTCTT | TTG | chr12 | 21585700 | 21585721 | 21585717 | 21585722 | + |
| SEQ ID NO 22244 | CCTCCTTCTTTTGTTAAAAACA | TTT | chr12 | 21585712 | 21585733 | 21585729 | 21585734 | + |
| SEQ ID NO 22245 | CTCCTTCTTTTGTTAAAAACAC | TTC | chr12 | 21585713 | 21585734 | 21585730 | 21585735 | + |
| SEQ ID NO 22246 | CTTCTTTTGTTAAAAACACCTT | CTC | chr12 | 21585716 | 21585737 | 21585733 | 21585738 | + |
| SEQ ID NO 22247 | CTTTTGTTAAAAACACCTTCGT | CTT | chr12 | 21585719 | 21585740 | 21585736 | 21585741 | + |
| SEQ ID NO 22248 | TTTTGTTAAAAACACCTTCGTG | TTC | chr12 | 21585720 | 21585741 | 21585737 | 21585742 | + |
| SEQ ID NO 22249 | TTGTTAAAAACACCTTCGTGTC | CTT | chr12 | 21585722 | 21585743 | 21585739 | 21585744 | + |
| SEQ ID NO 22250 | TGTTAAAAACACCTTCGTGTCT | TTT | chr12 | 21585723 | 21585744 | 21585740 | 21585745 | + |
| SEQ ID NO 22251 | GTTAAAAACACCTTCGTGTCTG | TTT | chr12 | 21585724 | 21585745 | 21585741 | 21585746 | + |
| SEQ ID NO 22252 | TTAAAAACACCTTCGTGTCTGT | TTG | chr12 | 21585725 | 21585746 | 21585742 | 21585747 | + |
| SEQ ID NO 22253 | AAAACACCTTCGTGTCTGTATA | TTA | chr12 | 21585728 | 21585749 | 21585745 | 21585750 | + |
| SEQ ID NO 22254 | CGTGTCTGTATACACTTGTACT | CTT | chr12 | 21585738 | 21585759 | 21585755 | 21585760 | + |
| SEQ ID NO 22255 | GTGTCTGTATACACTTGTACTA | TTC | chr12 | 21585739 | 21585760 | 21585756 | 21585761 | + |
| SEQ ID NO 22256 | TATACACTTGTACTAAGAAAAT | CTG | chr12 | 21585746 | 21585767 | 21585763 | 21585768 | + |
| SEQ ID NO 22257 | GTACTAAGAAAATATATACATT | CTT | chr12 | 21585755 | 21585776 | 21585772 | 21585777 | + |
| SEQ ID NO 22258 | TACTAAGAAAATATATACATTT | TTG | chr12 | 21585756 | 21585777 | 21585773 | 21585778 | + |
| SEQ ID NO 22259 | AGAAAATATATACATTTTACTT | CTA | chr12 | 21585761 | 21585782 | 21585778 | 21585783 | + |
| SEQ ID NO 22260 | TACTTCCTTTTTCCTTTATCAT | TTT | chr12 | 21585778 | 21585799 | 21585795 | 21585800 | + |
| SEQ ID NO 22261 | ACTTCCTTTTTCCTTTATCATG | TTT | chr12 | 21585779 | 21585800 | 21585796 | 21585801 | + |
| SEQ ID NO 22262 | CTTCCTTTTTCCTTTATCATGT | TTA | chr12 | 21585780 | 21585801 | 21585797 | 21585802 | + |
| SEQ ID NO 22263 | CCTTTTTCCTTTATCATGTGAC | CTT | chr12 | 21585783 | 21585804 | 21585800 | 21585805 | + |
| SEQ ID NO 22264 | CTTTTTCCTTTATCATGTGACA | TTC | chr12 | 21585784 | 21585805 | 21585801 | 21585806 | + |
| SEQ ID NO 22265 | TTTCCTTTATCATGTGACATAA | CTT | chr12 | 21585787 | 21585808 | 21585804 | 21585809 | + |
| SEQ ID NO 22266 | TTCCTTTATCATGTGACATAAG | TTT | chr12 | 21585788 | 21585809 | 21585805 | 21585810 | + |
| SEQ ID NO 22267 | TCCTTTATCATGTGACATAAGA | TTT | chr12 | 21585789 | 21585810 | 21585806 | 21585811 | + |
| SEQ ID NO 22268 | CCTTTATCATGTGACATAAGAT | TTT | chr12 | 21585790 | 21585811 | 21585807 | 21585812 | + |
| SEQ ID NO 22269 | CTTTATCATGTGACATAAGATT | TTC | chr12 | 21585791 | 21585812 | 21585808 | 21585813 | + |
| SEQ ID NO 22270 | TATCATGTGACATAAGATTTAT | CTT | chr12 | 21585794 | 21585815 | 21585811 | 21585816 | + |
| SEQ ID NO 22271 | ATCATGTGACATAAGATTTATT | TTT | chr12 | 21585795 | 21585816 | 21585812 | 21585817 | + |
| SEQ ID NO 22272 | TCATGTGACATAAGATTTATTG | TTA | chr12 | 21585796 | 21585817 | 21585813 | 21585818 | + |
| SEQ ID NO 22273 | ATTGACTTCATATCAGCATTTA | TTT | chr12 | 21585814 | 21585835 | 21585831 | 21585836 | + |
| SEQ ID NO 22274 | TTGACTTCATATCAGCATTTAA | TTA | chr12 | 21585815 | 21585836 | 21585832 | 21585837 | + |
| SEQ ID NO 22275 | ACTTCATATCAGCATTTAAGTA | TTG | chr12 | 21585818 | 21585839 | 21585835 | 21585840 | + |
| SEQ ID NO 22276 | CATATCAGCATTTAAGTATTGT | CTT | chr12 | 21585822 | 21585843 | 21585839 | 21585844 | + |
| SEQ ID NO 22277 | ATATCAGCATTTAAGTATTGTT | TTC | chr12 | 21585823 | 21585844 | 21585840 | 21585845 | + |
| SEQ ID NO 22278 | AAGTATTGTTAAGTTTATGTAA | TTT | chr12 | 21585835 | 21585856 | 21585852 | 21585857 | + |
| SEQ ID NO 22279 | AGTATTGTTAAGTTTATGTAAT | TTA | chr12 | 21585836 | 21585857 | 21585853 | 21585858 | + |
| SEQ ID NO 22280 | TTAAGTTTATGTAATAGCATTT | TTG | chr12 | 21585843 | 21585864 | 21585860 | 21585865 | + |
| SEQ ID NO 22281 | AGTTTATGTAATAGCATTTGCA | TTA | chr12 | 21585846 | 21585867 | 21585863 | 21585868 | + |

Figure 48 (Cont'd)

| SEQ ID NO 22282 | ATGTAATAGCATTTGCAATGGG | TTT | chr12 | 21585851 | 21585872 | 21585868 | 21585873 | + |
|---|---|---|---|---|---|---|---|---|
| SEQ ID NO 22283 | TGTAATAGCATTTGCAATGGGG | TTA | chr12 | 21585852 | 21585873 | 21585869 | 21585874 | + |
| SEQ ID NO 22284 | GCAATGGGGATTGGTGCATTTT | TTT | chr12 | 21585865 | 21585886 | 21585882 | 21585887 | + |
| SEQ ID NO 22285 | CAATGGGGATTGGTGCATTTTC | TTG | chr12 | 21585866 | 21585887 | 21585883 | 21585888 | + |
| SEQ ID NO 22286 | GTGCATTTTCAATTGCACGAAG | TTG | chr12 | 21585878 | 21585899 | 21585895 | 21585900 | + |
| SEQ ID NO 22287 | TCAATTGCACGAAGGATAGTTT | TTT | chr12 | 21585886 | 21585907 | 21585903 | 21585908 | + |
| SEQ ID NO 22288 | CAATTGCACGAAGGATAGTTTT | TTT | chr12 | 21585887 | 21585908 | 21585904 | 21585909 | + |
| SEQ ID NO 22289 | AATTGCACGAAGGATAGTTTTA | TTC | chr12 | 21585888 | 21585909 | 21585905 | 21585910 | + |
| SEQ ID NO 22290 | CACGAAGGATAGTTTTAGTATG | TTG | chr12 | 21585893 | 21585914 | 21585910 | 21585915 | + |
| SEQ ID NO 22291 | TAGTATGTTAGGCATAATTATG | TTT | chr12 | 21585908 | 21585929 | 21585925 | 21585930 | + |
| SEQ ID NO 22292 | AGTATGTTAGGCATAATTATGA | TTT | chr12 | 21585909 | 21585930 | 21585926 | 21585931 | + |
| SEQ ID NO 22293 | GTATGTTAGGCATAATTATGAC | TTA | chr12 | 21585910 | 21585931 | 21585927 | 21585932 | + |
| SEQ ID NO 22294 | GGCATAATTATGACTTATTGTT | TTA | chr12 | 21585918 | 21585939 | 21585935 | 21585940 | + |
| SEQ ID NO 22295 | TGACTTATTGTTGTCTTTATTT | TTA | chr12 | 21585928 | 21585949 | 21585945 | 21585950 | + |
| SEQ ID NO 22296 | ATTGTTGTCTTTATTTGAAGAT | CTT | chr12 | 21585934 | 21585955 | 21585951 | 21585956 | + |
| SEQ ID NO 22297 | TTGTTGTCTTTATTTGAAGATA | TTA | chr12 | 21585935 | 21585956 | 21585952 | 21585957 | + |
| SEQ ID NO 22298 | TTGTCTTTATTTGAAGATAATG | TTG | chr12 | 21585938 | 21585959 | 21585955 | 21585960 | + |
| SEQ ID NO 22299 | TCTTTATTTGAAGATAATGTAT | TTG | chr12 | 21585941 | 21585962 | 21585958 | 21585963 | + |
| SEQ ID NO 22300 | TATTTGAAGATAATGTATGACC | CTT | chr12 | 21585945 | 21585966 | 21585962 | 21585967 | + |
| SEQ ID NO 22301 | ATTTGAAGATAATGTATGACCT | TTT | chr12 | 21585946 | 21585967 | 21585963 | 21585968 | + |
| SEQ ID NO 22302 | TTTGAAGATAATGTATGACCTC | TTA | chr12 | 21585947 | 21585968 | 21585964 | 21585969 | + |
| SEQ ID NO 22303 | GAAGATAATGTATGACCTCAGG | TTT | chr12 | 21585950 | 21585971 | 21585967 | 21585972 | + |
| SEQ ID NO 22304 | AAGATAATGTATGACCTCAGGG | TTG | chr12 | 21585951 | 21585972 | 21585968 | 21585973 | + |
| SEQ ID NO 22305 | AGGGGATGTGTATAGGCTCAAG | CTC | chr12 | 21585969 | 21585990 | 21585986 | 21585991 | + |
| SEQ ID NO 22306 | AAGTTGACAAGCGATGGACTTG | CTC | chr12 | 21585988 | 21586009 | 21586005 | 21586010 | + |
| SEQ ID NO 22307 | ACAAGCGATGGACTTGTGATGG | TTG | chr12 | 21585994 | 21586015 | 21586011 | 21586016 | + |
| SEQ ID NO 22308 | GTGATGGTTAATACTGAGTGTC | CTT | chr12 | 21586009 | 21586030 | 21586026 | 21586031 | + |
| SEQ ID NO 22309 | TGATGGTTAATACTGAGTGTCA | TTG | chr12 | 21586010 | 21586031 | 21586027 | 21586032 | + |
| SEQ ID NO 22310 | ATACTGAGTGTCAACTTGATTG | TTA | chr12 | 21586019 | 21586040 | 21586036 | 21586041 | + |
| SEQ ID NO 22311 | AGTGTCAACTTGATTGGATTGA | CTG | chr12 | 21586025 | 21586046 | 21586042 | 21586047 | + |
| SEQ ID NO 22312 | GATTGGATTGAAGTGTGCAAAG | CTT | chr12 | 21586036 | 21586057 | 21586053 | 21586058 | + |
| SEQ ID NO 22313 | ATTGGATTGAAGTGTGCAAAGT | TTG | chr12 | 21586037 | 21586058 | 21586054 | 21586059 | + |
| SEQ ID NO 22314 | GATTGAAGTGTGCAAAGTATTG | TTG | chr12 | 21586041 | 21586062 | 21586058 | 21586063 | + |
| SEQ ID NO 22315 | AAGTGTGCAAAGTATTGATCCT | TTG | chr12 | 21586046 | 21586067 | 21586063 | 21586068 | + |
| SEQ ID NO 22316 | ATCCTGAGTGTGTCTGTGAGGG | TTG | chr12 | 21586063 | 21586084 | 21586080 | 21586085 | + |
| SEQ ID NO 22317 | AGTGTGTCTGTGAGGGTATTGC | CTG | chr12 | 21586069 | 21586090 | 21586086 | 21586091 | + |
| SEQ ID NO 22318 | TGAGGGTATTGCCAAAGGAGAT | CTG | chr12 | 21586079 | 21586100 | 21586096 | 21586101 | + |
| SEQ ID NO 22319 | CCAAAGGAGATTAACATTTTAG | TTG | chr12 | 21586090 | 21586111 | 21586107 | 21586112 | + |
| SEQ ID NO 22320 | ACATTTTAGTCAGTGGGCTGGG | TTA | chr12 | 21586103 | 21586124 | 21586120 | 21586125 | + |
| SEQ ID NO 22321 | TAGTCAGTGGGCTGGGAAAGGC | TTT | chr12 | 21586109 | 21586130 | 21586126 | 21586131 | + |
| SEQ ID NO 22322 | AGTCAGTGGGCTGGGAAAGGCA | TTT | chr12 | 21586110 | 21586131 | 21586127 | 21586132 | + |
| SEQ ID NO 22323 | GTCAGTGGGCTGGGAAAGGCAG | TTA | chr12 | 21586111 | 21586132 | 21586128 | 21586133 | + |
| SEQ ID NO 22324 | GGAAAGGCAGACCCACCCTTAA | CTG | chr12 | 21586123 | 21586144 | 21586140 | 21586145 | + |
| SEQ ID NO 22325 | AATCTGGGTGGGCACCATCTAA | CTT | chr12 | 21586143 | 21586164 | 21586160 | 21586165 | + |
| SEQ ID NO 22326 | ATCTGGGTGGGCACCATCTAAT | TTA | chr12 | 21586144 | 21586165 | 21586161 | 21586166 | + |
| SEQ ID NO 22327 | GGTGGGCACCATCTAATCAGTT | CTG | chr12 | 21586149 | 21586170 | 21586166 | 21586171 | + |
| SEQ ID NO 22328 | ATCAGTTGCCAGTGTGGCCAGG | CTA | chr12 | 21586164 | 21586185 | 21586181 | 21586186 | + |
| SEQ ID NO 22329 | CCAGTGTGGCCAGGATATAAAG | TTG | chr12 | 21586172 | 21586193 | 21586189 | 21586194 | + |
| SEQ ID NO 22330 | GACTGGCTTAGCCTCCAAGCCT | CTG | chr12 | 21586224 | 21586245 | 21586241 | 21586246 | + |
| SEQ ID NO 22331 | GCTTAGCCTCCAAGCCTACATC | CTG | chr12 | 21586229 | 21586250 | 21586246 | 21586251 | + |
| SEQ ID NO 22332 | AGCCTCCAAGCCTACATCTTTC | CTT | chr12 | 21586233 | 21586254 | 21586250 | 21586255 | + |
| SEQ ID NO 22333 | GCCTCCAAGCCTACATCTTTCT | TTA | chr12 | 21586234 | 21586255 | 21586251 | 21586256 | + |
| SEQ ID NO 22334 | CAAGCCTACATCTTTCTCCCAT | CTC | chr12 | 21586239 | 21586260 | 21586256 | 21586261 | + |
| SEQ ID NO 22335 | CATCTTTCTCCCATGCTGGATG | CTA | chr12 | 21586247 | 21586268 | 21586264 | 21586269 | + |
| SEQ ID NO 22336 | TCTCCCATGCTGGATGCTTCCT | CTT | chr12 | 21586253 | 21586274 | 21586270 | 21586275 | + |
| SEQ ID NO 22337 | CTCCCATGCTGGATGCTTCCTG | TTT | chr12 | 21586254 | 21586275 | 21586271 | 21586276 | + |
| SEQ ID NO 22338 | TCCCATGCTGGATGCTTCCTGC | TTC | chr12 | 21586255 | 21586276 | 21586272 | 21586277 | + |
| SEQ ID NO 22339 | CCATGCTGGATGCTTCCTGCCC | CTC | chr12 | 21586257 | 21586278 | 21586274 | 21586279 | + |

Figure 48 (Cont'd)

| | | | | | | | | |
|---|---|---|---|---|---|---|---|---|
| SEQ ID NO 22340 | GATGCTTCCTGCCCTCAAACAT | CTG | chr12 | 21586265 | 21586286 | 21586282 | 21586287 | + |
| SEQ ID NO 22341 | CCTGCCCTCAAACATTGGACTC | CTT | chr12 | 21586272 | 21586293 | 21586289 | 21586294 | + |
| SEQ ID NO 22342 | CTGCCCTCAAACATTGGACTCC | TTC | chr12 | 21586273 | 21586294 | 21586290 | 21586295 | + |
| SEQ ID NO 22343 | CCCTCAAACATTGGACTCCAAG | CTG | chr12 | 21586276 | 21586297 | 21586293 | 21586298 | + |
| SEQ ID NO 22344 | AAACATTGGACTCCAAGTCCTT | CTC | chr12 | 21586281 | 21586302 | 21586298 | 21586303 | + |
| SEQ ID NO 22345 | GACTCCAAGTCCTTCAGCTTTG | TTG | chr12 | 21586289 | 21586310 | 21586306 | 21586311 | + |
| SEQ ID NO 22346 | CAAGTCCTTCAGCTTTGGGACT | CTC | chr12 | 21586294 | 21586315 | 21586311 | 21586316 | + |
| SEQ ID NO 22347 | CAGCTTTGGGACTTGGACTGGC | CTT | chr12 | 21586303 | 21586324 | 21586320 | 21586325 | + |
| SEQ ID NO 22348 | AGCTTTGGGACTTGGACTGGCT | TTC | chr12 | 21586304 | 21586325 | 21586321 | 21586326 | + |
| SEQ ID NO 22349 | TGGGACTTGGACTGGCTTCCTT | CTT | chr12 | 21586309 | 21586330 | 21586326 | 21586331 | + |
| SEQ ID NO 22350 | GGGACTTGGACTGGCTTCCTTG | TTT | chr12 | 21586310 | 21586331 | 21586327 | 21586332 | + |
| SEQ ID NO 22351 | GGACTTGGACTGGCTTCCTTGC | TTG | chr12 | 21586311 | 21586332 | 21586328 | 21586333 | + |
| SEQ ID NO 22352 | GGACTGGCTTCCTTGCTCCTCT | CTT | chr12 | 21586317 | 21586338 | 21586334 | 21586339 | + |
| SEQ ID NO 22353 | GACTGGCTTCCTTGCTCCTCTG | TTG | chr12 | 21586318 | 21586339 | 21586335 | 21586340 | + |
| SEQ ID NO 22354 | GCTTCCTTGCTCCTCTGCTTGC | CTG | chr12 | 21586323 | 21586344 | 21586340 | 21586345 | + |
| SEQ ID NO 22355 | CCTTGCTCCTCTGCTTGCAGAT | CTT | chr12 | 21586327 | 21586348 | 21586344 | 21586349 | + |
| SEQ ID NO 22356 | CTTGCTCCTCTGCTTGCAGATG | TTC | chr12 | 21586328 | 21586349 | 21586345 | 21586350 | + |
| SEQ ID NO 22357 | GCTCCTCTGCTTGCAGATGGCC | CTT | chr12 | 21586331 | 21586352 | 21586348 | 21586353 | + |
| SEQ ID NO 22358 | CTCCTCTGCTTGCAGATGGCCT | TTG | chr12 | 21586332 | 21586353 | 21586349 | 21586354 | + |
| SEQ ID NO 22359 | CTCTGCTTGCAGATGGCCTATT | CTC | chr12 | 21586335 | 21586356 | 21586352 | 21586357 | + |
| SEQ ID NO 22360 | TGCTTGCAGATGGCCTATTGTG | CTC | chr12 | 21586338 | 21586359 | 21586355 | 21586360 | + |
| SEQ ID NO 22361 | CTTGCAGATGGCCTATTGTGGG | CTG | chr12 | 21586340 | 21586361 | 21586357 | 21586362 | + |
| SEQ ID NO 22362 | GCAGATGGCCTATTGTGGGACC | CTT | chr12 | 21586343 | 21586364 | 21586360 | 21586365 | + |
| SEQ ID NO 22363 | CAGATGGCCTATTGTGGGACCT | TTG | chr12 | 21586344 | 21586365 | 21586361 | 21586366 | + |
| SEQ ID NO 22364 | TTGTGGGACCTTGTGATTGTGT | CTA | chr12 | 21586355 | 21586376 | 21586372 | 21586377 | + |
| SEQ ID NO 22365 | TGGGACCTTGTGATTGTGTAAG | TTG | chr12 | 21586358 | 21586379 | 21586375 | 21586380 | + |
| SEQ ID NO 22366 | GTGATTGTGTAAGTTAACACTA | CTT | chr12 | 21586367 | 21586388 | 21586384 | 21586389 | + |
| SEQ ID NO 22367 | TGATTGTGTAAGTTAACACTAC | TTG | chr12 | 21586368 | 21586389 | 21586385 | 21586390 | + |
| SEQ ID NO 22368 | TGTAAGTTAACACTACTTAATA | TTG | chr12 | 21586374 | 21586395 | 21586391 | 21586396 | + |
| SEQ ID NO 22369 | ACACTACTTAATAAACTCCCTT | TTA | chr12 | 21586383 | 21586404 | 21586400 | 21586405 | + |
| SEQ ID NO 22370 | CTTAATAAACTCCCTTTTATAT | CTA | chr12 | 21586389 | 21586410 | 21586406 | 21586411 | + |
| SEQ ID NO 22371 | AATAAACTCCCTTTTATATCTA | CTT | chr12 | 21586392 | 21586413 | 21586409 | 21586414 | + |
| SEQ ID NO 22372 | ATAAACTCCCTTTTATATCTAA | TTA | chr12 | 21586393 | 21586414 | 21586410 | 21586415 | + |
| SEQ ID NO 22373 | CCTTTTATATCTAAATCTATAT | CTC | chr12 | 21586401 | 21586422 | 21586418 | 21586423 | + |
| SEQ ID NO 22374 | TTATATCTAAATCTATATCTAT | CTT | chr12 | 21586405 | 21586426 | 21586422 | 21586427 | + |
| SEQ ID NO 22375 | TATATCTAAATCTATATCTATC | TTT | chr12 | 21586406 | 21586427 | 21586423 | 21586428 | + |
| SEQ ID NO 22376 | ATATCTAAATCTATATCTATCT | TTT | chr12 | 21586407 | 21586428 | 21586424 | 21586429 | + |
| SEQ ID NO 22377 | TATCTAAATCTATATCTATCTA | TTA | chr12 | 21586408 | 21586429 | 21586425 | 21586430 | + |
| SEQ ID NO 22378 | AATCTATATCTATCTATCTATC | CTA | chr12 | 21586414 | 21586435 | 21586431 | 21586436 | + |
| SEQ ID NO 22379 | TATCTATCTATCTATCTATCTA | CTA | chr12 | 21586420 | 21586441 | 21586437 | 21586442 | + |
| SEQ ID NO 22380 | TCTATCTATCTATCTATCTATC | CTA | chr12 | 21586426 | 21586447 | 21586443 | 21586448 | + |
| SEQ ID NO 22381 | TCTATCTATCTATCTATCTATC | CTA | chr12 | 21586430 | 21586451 | 21586447 | 21586452 | + |
| SEQ ID NO 22382 | TCTATCTATCTATCTATCTATC | CTA | chr12 | 21586434 | 21586455 | 21586451 | 21586456 | + |
| SEQ ID NO 22383 | TCTATCTATCTATCTATCTATC | CTA | chr12 | 21586438 | 21586459 | 21586455 | 21586460 | + |
| SEQ ID NO 22384 | TCTATCTATCTATCTATCTATC | CTA | chr12 | 21586442 | 21586463 | 21586459 | 21586464 | + |
| SEQ ID NO 22385 | TCTATCTATCTATCTATCTCCT | CTA | chr12 | 21586446 | 21586467 | 21586463 | 21586468 | + |
| SEQ ID NO 22386 | TCTATCTATCTATCTCCTATTA | CTA | chr12 | 21586450 | 21586471 | 21586467 | 21586472 | + |
| SEQ ID NO 22387 | TCTATCTATCTCCTATTAGTTC | CTA | chr12 | 21586454 | 21586475 | 21586471 | 21586476 | + |
| SEQ ID NO 22388 | TCTATCTCCTATTAGTTCTGTC | CTA | chr12 | 21586458 | 21586479 | 21586475 | 21586480 | + |
| SEQ ID NO 22389 | TCTCCTATTAGTTCTGTCTCTC | CTA | chr12 | 21586462 | 21586483 | 21586479 | 21586484 | + |
| SEQ ID NO 22390 | CTATTAGTTCTGTCTCTCTAGG | CTC | chr12 | 21586466 | 21586487 | 21586483 | 21586488 | + |
| SEQ ID NO 22391 | TTAGTTCTGTCTCTCTAGGGAA | CTA | chr12 | 21586469 | 21586490 | 21586486 | 21586491 | + |
| SEQ ID NO 22392 | GTTCTGTCTCTCTAGGGAACCC | TTA | chr12 | 21586472 | 21586493 | 21586489 | 21586494 | + |
| SEQ ID NO 22393 | TGTCTCTCTAGGGAACCCTGAC | TTC | chr12 | 21586476 | 21586497 | 21586493 | 21586498 | + |
| SEQ ID NO 22394 | TCTCTCTAGGGAACCCTGACAA | CTG | chr12 | 21586478 | 21586499 | 21586495 | 21586500 | + |
| SEQ ID NO 22395 | TCTAGGGAACCCTGACAAATAC | CTC | chr12 | 21586482 | 21586503 | 21586499 | 21586504 | + |
| SEQ ID NO 22396 | TAGGGAACCCTGACAAATACAG | CTC | chr12 | 21586484 | 21586505 | 21586501 | 21586506 | + |
| SEQ ID NO 22397 | GGGAACCCTGACAAATACAGTG | CTA | chr12 | 21586486 | 21586507 | 21586503 | 21586508 | + |

Figure 48 (Cont'd)

| | | | | | | | | |
|---|---|---|---|---|---|---|---|---|
| SEQ ID NO 22398 | ACAAATACAGTGAGCTCAGGTC | CTG | chr12 | 21586496 | 21586517 | 21586513 | 21586518 | + |
| SEQ ID NO 22399 | AGGTCCTGAGCAGACATTTTCC | CTC | chr12 | 21586513 | 21586534 | 21586530 | 21586535 | + |
| SEQ ID NO 22400 | AGCAGACATTTTCCAAAAGAAG | CTG | chr12 | 21586521 | 21586542 | 21586538 | 21586543 | + |
| SEQ ID NO 22401 | TCCAAAAGAAGACATACAAGTG | TTT | chr12 | 21586532 | 21586553 | 21586549 | 21586554 | + |
| SEQ ID NO 22402 | CCAAAAGAAGACATACAAGTGG | TTT | chr12 | 21586533 | 21586554 | 21586550 | 21586555 | + |
| SEQ ID NO 22403 | CAAAAGAAGACATACAAGTGGC | TTC | chr12 | 21586534 | 21586555 | 21586551 | 21586556 | + |
| SEQ ID NO 22404 | AACATCACTAATAATCAGAGAA | TTC | chr12 | 21586579 | 21586600 | 21586596 | 21586601 | + |
| SEQ ID NO 22405 | ATAATCAGAGAATGCAAATTAA | CTA | chr12 | 21586589 | 21586610 | 21586606 | 21586611 | + |
| SEQ ID NO 22406 | AAACCACCATATGATACCTCCT | TTA | chr12 | 21586610 | 21586631 | 21586627 | 21586632 | + |
| SEQ ID NO 22407 | CTTATGCCAGTCAGAATGGCTA | CTC | chr12 | 21586630 | 21586651 | 21586647 | 21586652 | + |
| SEQ ID NO 22408 | ATGCCAGTCAGAATGGCTATCA | CTT | chr12 | 21586633 | 21586654 | 21586650 | 21586655 | + |
| SEQ ID NO 22409 | TGCCAGTCAGAATGGCTATCAT | TTA | chr12 | 21586634 | 21586655 | 21586651 | 21586656 | + |
| SEQ ID NO 22410 | TCATTATAAAGTTCAAAAACAG | CTA | chr12 | 21586652 | 21586673 | 21586669 | 21586674 | + |
| SEQ ID NO 22411 | TAAAGTTCAAAAACAGCAGATG | TTA | chr12 | 21586658 | 21586679 | 21586675 | 21586680 | + |
| SEQ ID NO 22412 | AAAAACAGCAGATGTTGGTGAG | TTC | chr12 | 21586666 | 21586687 | 21586683 | 21586688 | + |
| SEQ ID NO 22413 | GTGAGGATGTGGAGACAAGAAA | TTG | chr12 | 21586683 | 21586704 | 21586700 | 21586705 | + |
| SEQ ID NO 22414 | ATACACTGTTGGTAAGAATGTA | CTT | chr12 | 21586711 | 21586732 | 21586728 | 21586733 | + |
| SEQ ID NO 22415 | TACACTGTTGGTAAGAATGTAA | TTA | chr12 | 21586712 | 21586733 | 21586729 | 21586734 | + |
| SEQ ID NO 22416 | TTGGTAAGAATGTAAATTAGTA | CTG | chr12 | 21586719 | 21586740 | 21586736 | 21586741 | + |
| SEQ ID NO 22417 | GTAAGAATGTAAATTAGTACAA | TTG | chr12 | 21586722 | 21586743 | 21586739 | 21586744 | + |
| SEQ ID NO 22418 | GTACAAACTTTATGGAAGACAG | TTA | chr12 | 21586738 | 21586759 | 21586755 | 21586760 | + |
| SEQ ID NO 22419 | TATGGAAGACAGCATGAAGATT | CTT | chr12 | 21586748 | 21586769 | 21586765 | 21586770 | + |
| SEQ ID NO 22420 | ATGGAAGACAGCATGAAGATTT | TTT | chr12 | 21586749 | 21586770 | 21586766 | 21586771 | + |
| SEQ ID NO 22421 | TGGAAGACAGCATGAAGATTTC | TTA | chr12 | 21586750 | 21586771 | 21586767 | 21586772 | + |
| SEQ ID NO 22422 | CTTAAAGAACTAGAAACAGAAC | TTT | chr12 | 21586771 | 21586792 | 21586788 | 21586793 | + |
| SEQ ID NO 22423 | TTAAAGAACTAGAAACAGAACT | TTC | chr12 | 21586772 | 21586793 | 21586789 | 21586794 | + |
| SEQ ID NO 22424 | AAAGAACTAGAAACAGAACTAC | CTT | chr12 | 21586774 | 21586795 | 21586791 | 21586796 | + |
| SEQ ID NO 22425 | AAGAACTAGAAACAGAACTACC | TTA | chr12 | 21586775 | 21586796 | 21586792 | 21586797 | + |
| SEQ ID NO 22426 | GAAACAGAACTACCATTCAATC | CTA | chr12 | 21586783 | 21586804 | 21586800 | 21586805 | + |
| SEQ ID NO 22427 | CCATTCAATCCTGCAATCCCAC | CTA | chr12 | 21586795 | 21586816 | 21586812 | 21586817 | + |
| SEQ ID NO 22428 | AATCCTGCAATCCCACTACTGG | TTC | chr12 | 21586801 | 21586822 | 21586818 | 21586823 | + |
| SEQ ID NO 22429 | CAATCCCACTACTGGGTATGGA | CTG | chr12 | 21586808 | 21586829 | 21586825 | 21586830 | + |
| SEQ ID NO 22430 | CTGGGTATGGACCCAAAGTGAA | CTA | chr12 | 21586819 | 21586840 | 21586836 | 21586841 | + |
| SEQ ID NO 22431 | GGTATGGACCCAAAGTGAAAGA | CTG | chr12 | 21586822 | 21586843 | 21586839 | 21586844 | + |
| SEQ ID NO 22432 | AAAAGATATCTGCATTAGTAT | TTA | chr12 | 21586854 | 21586875 | 21586871 | 21586876 | + |
| SEQ ID NO 22433 | CATTAGTATGTTCAAAGTAGCA | CTG | chr12 | 21586867 | 21586888 | 21586884 | 21586889 | + |
| SEQ ID NO 22434 | GTATGTTCAAAGTAGCACTGTT | TTA | chr12 | 21586872 | 21586893 | 21586889 | 21586894 | + |
| SEQ ID NO 22435 | AAAGTAGCACTGTTCCCAATAG | TTC | chr12 | 21586880 | 21586901 | 21586897 | 21586902 | + |
| SEQ ID NO 22436 | TTCCCAATAGCAAAGATATGGA | CTG | chr12 | 21586892 | 21586913 | 21586909 | 21586914 | + |
| SEQ ID NO 22437 | CCAATAGCAAAGATATGGAATC | TTC | chr12 | 21586895 | 21586916 | 21586912 | 21586917 | + |
| SEQ ID NO 22438 | AATGTCTACCAATGGACGATTG | CTA | chr12 | 21586923 | 21586944 | 21586940 | 21586945 | + |
| SEQ ID NO 22439 | CCAATGGACGATTGGATAAAGA | CTA | chr12 | 21586931 | 21586952 | 21586948 | 21586953 | + |
| SEQ ID NO 22440 | GATAAAGAAAATGTGGTGTATA | TTG | chr12 | 21586945 | 21586966 | 21586962 | 21586967 | + |
| SEQ ID NO 22441 | ATATACATATATATTACTCAGC | TTT | chr12 | 21586974 | 21586995 | 21586991 | 21586996 | + |
| SEQ ID NO 22442 | TATACATATATATTACTCAGCC | TTA | chr12 | 21586975 | 21586996 | 21586992 | 21586997 | + |
| SEQ ID NO 22443 | CTCAGCCATAAAAAGAATGAA | TTA | chr12 | 21586990 | 21587011 | 21587007 | 21587012 | + |
| SEQ ID NO 22444 | AGCCATAAAAAGAATGAAATC | CTC | chr12 | 21586993 | 21587014 | 21587010 | 21587015 | + |
| SEQ ID NO 22445 | CTCTAGAAACATGGTTAGAACT | CTT | chr12 | 21587022 | 21587043 | 21587039 | 21587044 | + |
| SEQ ID NO 22446 | TCTAGAAACATGGTTAGAACTG | TTC | chr12 | 21587023 | 21587044 | 21587040 | 21587045 | + |
| SEQ ID NO 22447 | TAGAAACATGGTTAGAACTGGA | CTC | chr12 | 21587025 | 21587046 | 21587042 | 21587047 | + |
| SEQ ID NO 22448 | GAAACATGGTTAGAACTGGAGG | CTA | chr12 | 21587027 | 21587048 | 21587044 | 21587049 | + |
| SEQ ID NO 22449 | GAACTGGAGGACATTATCCTCA | TTA | chr12 | 21587039 | 21587060 | 21587056 | 21587061 | + |
| SEQ ID NO 22450 | GAGGACATTATCCTCAGTGAAA | CTG | chr12 | 21587045 | 21587066 | 21587062 | 21587067 | + |
| SEQ ID NO 22451 | TCCTCAGTGAAATAACTCAGAA | TTA | chr12 | 21587055 | 21587076 | 21587072 | 21587077 | + |
| SEQ ID NO 22452 | AGTGAAATAACTCAGAAACAGA | CTC | chr12 | 21587060 | 21587081 | 21587077 | 21587082 | + |
| SEQ ID NO 22453 | AGAAACAGAAAGTCAAACACAG | CTC | chr12 | 21587073 | 21587094 | 21587090 | 21587095 | + |
| SEQ ID NO 22454 | TCATTTAGTGAGAGCCAAGTGG | TTC | chr12 | 21587102 | 21587123 | 21587119 | 21587124 | + |
| SEQ ID NO 22455 | ATTTAGTGAGAGCCAAGTGGGA | CTC | chr12 | 21587104 | 21587125 | 21587121 | 21587126 | + |

Figure 48 (Cont'd)

| | | | | | | | | |
|---|---|---|---|---|---|---|---|---|
| SEQ ID NO 22456 | AGTGAGAGCCAAGTGGGAGCTA | TTT | chr12 | 21587108 | 21587129 | 21587125 | 21587130 | + |
| SEQ ID NO 22457 | GTGAGAGCCAAGTGGGAGCTAA | TTA | chr12 | 21587109 | 21587130 | 21587126 | 21587131 | + |
| SEQ ID NO 22458 | AACGATGAGTAAGCATAGACAT | CTA | chr12 | 21587130 | 21587151 | 21587147 | 21587152 | + |
| SEQ ID NO 22459 | GAGACTAGAGAAAGGTGGGAGG | CTT | chr12 | 21587175 | 21587196 | 21587192 | 21587197 | + |
| SEQ ID NO 22460 | AGACTAGAGAAAGGTGGGAGGA | TTG | chr12 | 21587176 | 21587197 | 21587193 | 21587198 | + |
| SEQ ID NO 22461 | GAGAAAGGTGGGAGGATAGGAG | CTA | chr12 | 21587182 | 21587203 | 21587199 | 21587204 | + |
| SEQ ID NO 22462 | AAAAACTACGGATTGGATACAA | CTG | chr12 | 21587218 | 21587239 | 21587235 | 21587240 | + |
| SEQ ID NO 22463 | CGGATTGGATACAACATTCACT | CTA | chr12 | 21587226 | 21587247 | 21587243 | 21587248 | + |
| SEQ ID NO 22464 | GATACAACATTCACTTTTCAGG | TTG | chr12 | 21587233 | 21587254 | 21587250 | 21587255 | + |
| SEQ ID NO 22465 | ACTTTTCAGGTGATGGTCCACT | TTC | chr12 | 21587245 | 21587266 | 21587262 | 21587267 | + |
| SEQ ID NO 22466 | TTCAGGTGATGGTCCACTAAAA | CTT | chr12 | 21587249 | 21587270 | 21587266 | 21587271 | + |
| SEQ ID NO 22467 | TCAGGTGATGGTCCACTAAAAG | TTT | chr12 | 21587250 | 21587271 | 21587267 | 21587272 | + |
| SEQ ID NO 22468 | CAGGTGATGGTCCACTAAAAGC | TTT | chr12 | 21587251 | 21587272 | 21587268 | 21587273 | + |
| SEQ ID NO 22469 | AGGTGATGGTCCACTAAAAGCT | TTC | chr12 | 21587252 | 21587273 | 21587269 | 21587274 | + |
| SEQ ID NO 22470 | AAAGCTCAGACTTCACCACTAT | CTA | chr12 | 21587268 | 21587289 | 21587285 | 21587290 | + |
| SEQ ID NO 22471 | AGACTTCACCACTATGCAACAT | CTC | chr12 | 21587275 | 21587296 | 21587292 | 21587297 | + |
| SEQ ID NO 22472 | CACCACTATGCAACATACATAT | CTT | chr12 | 21587281 | 21587302 | 21587298 | 21587303 | + |
| SEQ ID NO 22473 | ACCACTATGCAACATACATATG | TTC | chr12 | 21587282 | 21587303 | 21587299 | 21587304 | + |
| SEQ ID NO 22474 | TGCAACATACATATGTAAGGAA | CTA | chr12 | 21587289 | 21587310 | 21587306 | 21587311 | + |
| SEQ ID NO 22475 | GTACCCTGATACAGCTTGACTG | CTT | chr12 | 21587320 | 21587341 | 21587337 | 21587342 | + |
| SEQ ID NO 22476 | TACCCTGATACAGCTTGACTGT | TTG | chr12 | 21587321 | 21587342 | 21587338 | 21587343 | + |
| SEQ ID NO 22477 | ATACAGCTTGACTGTGTCCCCA | CTG | chr12 | 21587328 | 21587349 | 21587345 | 21587350 | + |
| SEQ ID NO 22478 | GACTGTGTCCCCACCCAAATCT | CTT | chr12 | 21587337 | 21587358 | 21587354 | 21587359 | + |
| SEQ ID NO 22479 | ACTGTGTCCCCACCCAAATCTC | TTG | chr12 | 21587338 | 21587359 | 21587355 | 21587360 | + |
| SEQ ID NO 22480 | TGTCCCCACCCAAATCTCATCT | CTG | chr12 | 21587342 | 21587363 | 21587359 | 21587364 | + |
| SEQ ID NO 22481 | ATCTTGAATTGTAGTTCCCATA | CTC | chr12 | 21587360 | 21587381 | 21587377 | 21587382 | + |
| SEQ ID NO 22482 | GAATTGTAGTTCCCATAATCCT | CTT | chr12 | 21587365 | 21587386 | 21587382 | 21587387 | + |
| SEQ ID NO 22483 | AATTGTAGTTCCCATAATCCTC | TTG | chr12 | 21587366 | 21587387 | 21587383 | 21587388 | + |
| SEQ ID NO 22484 | TAGTTCCCATAATCCTCACGTG | TTG | chr12 | 21587371 | 21587392 | 21587388 | 21587393 | + |
| SEQ ID NO 22485 | CCATAATCCTCACGTGTTGTGG | TTC | chr12 | 21587377 | 21587398 | 21587394 | 21587399 | + |
| SEQ ID NO 22486 | ACGTGTTGTGGGAGGGATTTGG | CTC | chr12 | 21587388 | 21587409 | 21587405 | 21587410 | + |
| SEQ ID NO 22487 | TGGGAGGGATTTGGAGGGAGGT | TTG | chr12 | 21587396 | 21587417 | 21587413 | 21587418 | + |
| SEQ ID NO 22488 | GGAGGGAGGTAATTGAATCATA | TTT | chr12 | 21587408 | 21587429 | 21587425 | 21587430 | + |
| SEQ ID NO 22489 | GAGGGAGGTAATTGAATCATAG | TTG | chr12 | 21587409 | 21587430 | 21587426 | 21587431 | + |
| SEQ ID NO 22490 | AATCATAGAGGAGGTTACTCTC | TTG | chr12 | 21587423 | 21587444 | 21587440 | 21587445 | + |
| SEQ ID NO 22491 | CTCTCATGCTCTTCTCGTGATA | TTA | chr12 | 21587440 | 21587461 | 21587457 | 21587462 | + |
| SEQ ID NO 22492 | TCATGCTCTTCTCGTGATAGTG | CTC | chr12 | 21587443 | 21587464 | 21587460 | 21587465 | + |
| SEQ ID NO 22493 | ATGCTCTTCTCGTGATAGTGAG | CTC | chr12 | 21587445 | 21587466 | 21587462 | 21587467 | + |
| SEQ ID NO 22494 | TTCTCGTGATAGTGAGTTCTTA | CTC | chr12 | 21587451 | 21587472 | 21587468 | 21587473 | + |
| SEQ ID NO 22495 | CTCGTGATAGTGAGTTCTTACA | CTT | chr12 | 21587453 | 21587474 | 21587470 | 21587475 | + |
| SEQ ID NO 22496 | TCGTGATAGTGAGTTCTTACAA | TTC | chr12 | 21587454 | 21587475 | 21587471 | 21587476 | + |
| SEQ ID NO 22497 | GTGATAGTGAGTTCTTACAAGA | CTC | chr12 | 21587456 | 21587477 | 21587473 | 21587478 | + |
| SEQ ID NO 22498 | TTACAAGATCTGATGGTTTTAT | TTC | chr12 | 21587470 | 21587491 | 21587487 | 21587492 | + |
| SEQ ID NO 22499 | ACAAGATCTGATGGTTTTATAA | CTT | chr12 | 21587472 | 21587493 | 21587489 | 21587494 | + |
| SEQ ID NO 22500 | CAAGATCTGATGGTTTTATAAG | TTA | chr12 | 21587473 | 21587494 | 21587490 | 21587495 | + |
| SEQ ID NO 22501 | ATGGTTTTATAAGCGGCTTTTC | CTG | chr12 | 21587482 | 21587503 | 21587499 | 21587504 | + |
| SEQ ID NO 22502 | TATAAGCGGCTTTTCCCCCTTT | TTT | chr12 | 21587489 | 21587510 | 21587506 | 21587511 | + |
| SEQ ID NO 22503 | ATAAGCGGCTTTTCCCCCTTTT | TTT | chr12 | 21587490 | 21587511 | 21587507 | 21587512 | + |
| SEQ ID NO 22504 | TAAGCGGCTTTTCCCCCTTTTG | TTA | chr12 | 21587491 | 21587512 | 21587508 | 21587513 | + |
| SEQ ID NO 22505 | TTCCCCCTTTTGCTTGGCACTT | CTT | chr12 | 21587501 | 21587522 | 21587518 | 21587523 | + |
| SEQ ID NO 22506 | TCCCCCTTTTGCTTGGCACTTC | TTT | chr12 | 21587502 | 21587523 | 21587519 | 21587524 | + |
| SEQ ID NO 22507 | CCCCCTTTTGCTTGGCACTTCT | TTT | chr12 | 21587503 | 21587524 | 21587520 | 21587525 | + |
| SEQ ID NO 22508 | CCCCTTTTGCTTGGCACTTCTA | TTC | chr12 | 21587504 | 21587525 | 21587521 | 21587526 | + |
| SEQ ID NO 22509 | TTGCTTGGCACTTCTACTTGCT | CTT | chr12 | 21587510 | 21587531 | 21587527 | 21587532 | + |
| SEQ ID NO 22510 | TGCTTGGCACTTCTACTTGCTG | TTT | chr12 | 21587511 | 21587532 | 21587528 | 21587533 | + |
| SEQ ID NO 22511 | GCTTGGCACTTCTACTTGCTGC | TTT | chr12 | 21587512 | 21587533 | 21587529 | 21587534 | + |
| SEQ ID NO 22512 | CTTGGCACTTCTACTTGCTGCT | TTG | chr12 | 21587513 | 21587534 | 21587530 | 21587535 | + |
| SEQ ID NO 22513 | GGCACTTCTACTTGCTGCTGCC | CTT | chr12 | 21587516 | 21587537 | 21587533 | 21587538 | + |

Figure 48 (Cont'd)

| SEQ ID NO 22514 | GCACTTCTACTTGCTGCTGCCA | TTG | chr12 | 21587517 | 21587538 | 21587534 | 21587539 | + |
|---|---|---|---|---|---|---|---|---|
| SEQ ID NO 22515 | CTACTTGCTGCTGCCATGTGAA | CTT | chr12 | 21587523 | 21587544 | 21587540 | 21587545 | + |
| SEQ ID NO 22516 | TACTTGCTGCTGCCATGTGAAG | TTC | chr12 | 21587524 | 21587545 | 21587541 | 21587546 | + |
| SEQ ID NO 22517 | CTTGCTGCTGCCATGTGAAGAA | CTA | chr12 | 21587526 | 21587547 | 21587543 | 21587548 | + |
| SEQ ID NO 22518 | GCTGCTGCCATGTGAAGAAGGA | CTT | chr12 | 21587529 | 21587550 | 21587546 | 21587551 | + |
| SEQ ID NO 22519 | CTGCTGCCATGTGAAGAAGGAC | TTG | chr12 | 21587530 | 21587551 | 21587547 | 21587552 | + |
| SEQ ID NO 22520 | CTGCCATGTGAAGAAGGACATG | CTG | chr12 | 21587533 | 21587554 | 21587550 | 21587555 | + |
| SEQ ID NO 22521 | CCATGTGAAGAAGGACATGTTT | CTG | chr12 | 21587536 | 21587557 | 21587553 | 21587558 | + |
| SEQ ID NO 22522 | GTTTCTTCTTCTGCCATGATTG | TTT | chr12 | 21587558 | 21587579 | 21587575 | 21587580 | + |
| SEQ ID NO 22523 | TTTCTTCTTCTGCCATGATTGT | TTG | chr12 | 21587559 | 21587580 | 21587576 | 21587581 | + |
| SEQ ID NO 22524 | CTTCTTCTGCCATGATTGTAAG | TTT | chr12 | 21587562 | 21587583 | 21587579 | 21587584 | + |
| SEQ ID NO 22525 | TTCTTCTGCCATGATTGTAAGT | TTC | chr12 | 21587563 | 21587584 | 21587580 | 21587585 | + |
| SEQ ID NO 22526 | CTTCTGCCATGATTGTAAGTTT | CTT | chr12 | 21587565 | 21587586 | 21587582 | 21587587 | + |
| SEQ ID NO 22527 | TTCTGCCATGATTGTAAGTTTC | TTC | chr12 | 21587566 | 21587587 | 21587583 | 21587588 | + |
| SEQ ID NO 22528 | CTGCCATGATTGTAAGTTTCCC | CTT | chr12 | 21587568 | 21587589 | 21587585 | 21587590 | + |
| SEQ ID NO 22529 | TGCCATGATTGTAAGTTTCCCG | TTC | chr12 | 21587569 | 21587590 | 21587586 | 21587591 | + |
| SEQ ID NO 22530 | CCATGATTGTAAGTTTCCCGAG | CTG | chr12 | 21587571 | 21587592 | 21587588 | 21587593 | + |
| SEQ ID NO 22531 | TAAGTTTCCCGAGGCCTCCCCA | TTG | chr12 | 21587580 | 21587601 | 21587597 | 21587602 | + |
| SEQ ID NO 22532 | CCCGAGGCCTCCCCAGCCCTGT | TTT | chr12 | 21587587 | 21587608 | 21587604 | 21587609 | + |
| SEQ ID NO 22533 | CCGAGGCCTCCCCAGCCCTGTG | TTC | chr12 | 21587588 | 21587609 | 21587605 | 21587610 | + |
| SEQ ID NO 22534 | CCCAGCCCTGTGGAACTGTGAG | CTC | chr12 | 21587598 | 21587619 | 21587615 | 21587620 | + |
| SEQ ID NO 22535 | TGGAACTGTGAGACAATTAAAC | CTG | chr12 | 21587608 | 21587629 | 21587625 | 21587630 | + |
| SEQ ID NO 22536 | TGAGACAATTAAACGTTTTTTC | CTG | chr12 | 21587616 | 21587637 | 21587633 | 21587638 | + |
| SEQ ID NO 22537 | AACGTTTTTTCCTTATAAATTA | TTA | chr12 | 21587627 | 21587648 | 21587644 | 21587649 | + |
| SEQ ID NO 22538 | TTTCCTTATAAATTACCCAGTC | TTT | chr12 | 21587634 | 21587655 | 21587651 | 21587656 | + |
| SEQ ID NO 22539 | TTCCTTATAAATTACCCAGTCT | TTT | chr12 | 21587635 | 21587656 | 21587652 | 21587657 | + |
| SEQ ID NO 22540 | TCCTTATAAATTACCCAGTCTC | TTT | chr12 | 21587636 | 21587657 | 21587653 | 21587658 | + |
| SEQ ID NO 22541 | CCTTATAAATTACCCAGTCTCA | TTT | chr12 | 21587637 | 21587658 | 21587654 | 21587659 | + |
| SEQ ID NO 22542 | CTTATAAATTACCCAGTCTCAG | TTC | chr12 | 21587638 | 21587659 | 21587655 | 21587660 | + |
| SEQ ID NO 22543 | ATAAATTACCCAGTCTCAGGTA | CTT | chr12 | 21587641 | 21587662 | 21587658 | 21587663 | + |
| SEQ ID NO 22544 | TAAATTACCCAGTCTCAGGTAT | TTA | chr12 | 21587642 | 21587663 | 21587659 | 21587664 | + |
| SEQ ID NO 22545 | CCCAGTCTCAGGTATGTCTTTA | TTA | chr12 | 21587649 | 21587670 | 21587666 | 21587671 | + |
| SEQ ID NO 22546 | AGGTATGTCTTTATAAGCAGCA | CTC | chr12 | 21587658 | 21587679 | 21587675 | 21587680 | + |
| SEQ ID NO 22547 | TATAAGCAGCATGATAACGAAC | CTT | chr12 | 21587669 | 21587690 | 21587686 | 21587691 | + |
| SEQ ID NO 22548 | ATAAGCAGCATGATAACGAACT | TTT | chr12 | 21587670 | 21587691 | 21587687 | 21587692 | + |
| SEQ ID NO 22549 | TAAGCAGCATGATAACGAACTA | TTA | chr12 | 21587671 | 21587692 | 21587688 | 21587693 | + |
| SEQ ID NO 22550 | GTACATACCTTCTAAATATATA | CTA | chr12 | 21587693 | 21587714 | 21587710 | 21587715 | + |
| SEQ ID NO 22551 | CTAAATATATATAAATAAATTT | CTT | chr12 | 21587704 | 21587725 | 21587721 | 21587726 | + |
| SEQ ID NO 22552 | TAAATATATATAAATAAATTTT | TTC | chr12 | 21587705 | 21587726 | 21587722 | 21587727 | + |
| SEQ ID NO 22553 | AATATATATAAATAAATTTTAA | CTA | chr12 | 21587707 | 21587728 | 21587724 | 21587729 | + |
| SEQ ID NO 22554 | TAAAAATATAAAATAAATTAGA | TTT | chr12 | 21587726 | 21587747 | 21587743 | 21587748 | + |
| SEQ ID NO 22555 | AAAAATATAAAATAAATTAGAT | TTT | chr12 | 21587727 | 21587748 | 21587744 | 21587749 | + |
| SEQ ID NO 22556 | AAAATATAAAATAAATTAGATC | TTA | chr12 | 21587728 | 21587749 | 21587745 | 21587750 | + |
| SEQ ID NO 22557 | GATCTGATTGAAAAGGCAAAAA | TTA | chr12 | 21587746 | 21587767 | 21587763 | 21587768 | + |
| SEQ ID NO 22558 | ATTGAAAAGGCAAAAATTGAGC | CTG | chr12 | 21587752 | 21587773 | 21587769 | 21587774 | + |
| SEQ ID NO 22559 | AAAAGGCAAAAATTGAGCAAGC | TTG | chr12 | 21587756 | 21587777 | 21587773 | 21587778 | + |
| SEQ ID NO 22560 | AGCAAGCAAAATATCACTTAAT | TTG | chr12 | 21587771 | 21587792 | 21587788 | 21587793 | + |
| SEQ ID NO 22561 | AATGGGGTAATTAAAAGGGTGA | CTT | chr12 | 21587790 | 21587811 | 21587807 | 21587812 | + |
| SEQ ID NO 22562 | ATGGGGTAATTAAAAGGGTGAA | TTA | chr12 | 21587791 | 21587812 | 21587808 | 21587813 | + |
| SEQ ID NO 22563 | AAAGGGTGAAGAAATTGGGCAA | TTA | chr12 | 21587803 | 21587824 | 21587820 | 21587825 | + |
| SEQ ID NO 22564 | GGCAAATGGATGTCATGAGGAG | TTG | chr12 | 21587820 | 21587841 | 21587837 | 21587842 | + |
| SEQ ID NO 22565 | TTAGGCAGAGGTAATGGTCAGA | TTT | chr12 | 21587848 | 21587869 | 21587865 | 21587870 | + |
| SEQ ID NO 22566 | TAGGCAGAGGTAATGGTCAGAG | TTT | chr12 | 21587849 | 21587870 | 21587866 | 21587871 | + |
| SEQ ID NO 22567 | AGGCAGAGGTAATGGTCAGAGC | TTT | chr12 | 21587850 | 21587871 | 21587867 | 21587872 | + |
| SEQ ID NO 22568 | GGCAGAGGTAATGGTCAGAGCC | TTA | chr12 | 21587851 | 21587872 | 21587868 | 21587873 | + |
| SEQ ID NO 22569 | AGCTGGAGTAGAGTGTGCAAGG | CTA | chr12 | 21587882 | 21587903 | 21587899 | 21587904 | + |
| SEQ ID NO 22570 | GAGTAGAGTGTGCAAGGAAAGA | CTG | chr12 | 21587887 | 21587908 | 21587904 | 21587909 | + |
| SEQ ID NO 22571 | AAAAGGATAACCAGGTAGGAGG | TTG | chr12 | 21587921 | 21587942 | 21587938 | 21587943 | + |

Figure 48 (Cont'd)

| | | | | | | | | |
|---|---|---|---|---|---|---|---|---|
| SEQ ID NO 22572 | CAGTAAACTTAGGCAGGATATT | CTC | chr12 | 21587974 | 21587995 | 21587991 | 21587996 | + |
| SEQ ID NO 22573 | AGGCAGGATATTTCCCGTGACA | CTT | chr12 | 21587984 | 21588005 | 21588001 | 21588006 | + |
| SEQ ID NO 22574 | GGCAGGATATTTCCCGTGACAG | TTA | chr12 | 21587985 | 21588006 | 21588002 | 21588007 | + |
| SEQ ID NO 22575 | CCCGTGACAGCACTAAATAATA | TTT | chr12 | 21587997 | 21588018 | 21588014 | 21588019 | + |
| SEQ ID NO 22576 | CCGTGACAGCACTAAATAATAA | TTC | chr12 | 21587998 | 21588019 | 21588015 | 21588020 | + |
| SEQ ID NO 22577 | AATAATAATCACATGTGAGAAT | CTA | chr12 | 21588012 | 21588033 | 21588029 | 21588034 | + |
| SEQ ID NO 22578 | TCGATTACTTGAGCAATACTTT | CTG | chr12 | 21588048 | 21588069 | 21588065 | 21588070 | + |
| SEQ ID NO 22579 | CTTGAGCAATACTTTGTTCATG | TTA | chr12 | 21588055 | 21588076 | 21588072 | 21588077 | + |
| SEQ ID NO 22580 | GAGCAATACTTTGTTCATGAGC | CTT | chr12 | 21588058 | 21588079 | 21588075 | 21588080 | + |
| SEQ ID NO 22581 | AGCAATACTTTGTTCATGAGCT | TTG | chr12 | 21588059 | 21588080 | 21588076 | 21588081 | + |
| SEQ ID NO 22582 | TGTTCATGAGCTAGAGCAAGGG | CTT | chr12 | 21588069 | 21588090 | 21588086 | 21588091 | + |
| SEQ ID NO 22583 | GTTCATGAGCTAGAGCAAGGGG | TTT | chr12 | 21588070 | 21588091 | 21588087 | 21588092 | + |
| SEQ ID NO 22584 | TTCATGAGCTAGAGCAAGGGGA | TTG | chr12 | 21588071 | 21588092 | 21588088 | 21588093 | + |
| SEQ ID NO 22585 | ATGAGCTAGAGCAAGGGGATGA | TTC | chr12 | 21588074 | 21588095 | 21588091 | 21588096 | + |
| SEQ ID NO 22586 | GAGCAAGGGGATGACTCAAGAA | CTA | chr12 | 21588082 | 21588103 | 21588099 | 21588104 | + |
| SEQ ID NO 22587 | AAGAAATCCTTTGTGAAATCCT | CTC | chr12 | 21588099 | 21588120 | 21588116 | 21588121 | + |
| SEQ ID NO 22588 | TGTGAAATCCTGGAGGTAATAA | CTT | chr12 | 21588110 | 21588131 | 21588127 | 21588132 | + |
| SEQ ID NO 22589 | GTGAAATCCTGGAGGTAATAAG | TTT | chr12 | 21588111 | 21588132 | 21588128 | 21588133 | + |
| SEQ ID NO 22590 | TGAAATCCTGGAGGTAATAAGA | TTG | chr12 | 21588112 | 21588133 | 21588129 | 21588134 | + |
| SEQ ID NO 22591 | GAGGTAATAAGATCCTGGCATC | CTG | chr12 | 21588122 | 21588143 | 21588139 | 21588144 | + |
| SEQ ID NO 22592 | GCATCAATCTTCAACTCAATTG | CTG | chr12 | 21588139 | 21588160 | 21588156 | 21588161 | + |
| SEQ ID NO 22593 | CAACTCAATTGCAAAAGCAAT | CTT | chr12 | 21588150 | 21588171 | 21588167 | 21588172 | + |
| SEQ ID NO 22594 | AACTCAATTGCAAAAGCAATT | TTC | chr12 | 21588151 | 21588172 | 21588168 | 21588173 | + |
| SEQ ID NO 22595 | AATTGCAAAAGCAATTTTATT | CTC | chr12 | 21588156 | 21588177 | 21588173 | 21588178 | + |
| SEQ ID NO 22596 | CAAAAGCAATTTTATTACTTA | TTG | chr12 | 21588161 | 21588182 | 21588178 | 21588183 | + |
| SEQ ID NO 22597 | TATTACTTATATATTACTTCTC | TTT | chr12 | 21588174 | 21588195 | 21588191 | 21588196 | + |
| SEQ ID NO 22598 | ATTACTTATATATTACTTCTCA | TTT | chr12 | 21588175 | 21588196 | 21588192 | 21588197 | + |
| SEQ ID NO 22599 | TTACTTATATATTACTTCTCAT | TTA | chr12 | 21588176 | 21588197 | 21588193 | 21588198 | + |
| SEQ ID NO 22600 | CTTATATATTACTTCTCATTTT | TTA | chr12 | 21588179 | 21588200 | 21588196 | 21588201 | + |
| SEQ ID NO 22601 | ATATATTACTTCTCATTTTTCA | CTT | chr12 | 21588182 | 21588203 | 21588199 | 21588204 | + |
| SEQ ID NO 22602 | TATATTACTTCTCATTTTTCAC | TTA | chr12 | 21588183 | 21588204 | 21588200 | 21588205 | + |
| SEQ ID NO 22603 | CTTCTCATTTTTCACTGCTGTC | TTA | chr12 | 21588190 | 21588211 | 21588207 | 21588212 | + |
| SEQ ID NO 22604 | CTCATTTTTCACTGCTGTCTTT | CTT | chr12 | 21588193 | 21588214 | 21588210 | 21588215 | + |
| SEQ ID NO 22605 | TCATTTTTCACTGCTGTCTTTC | TTC | chr12 | 21588194 | 21588215 | 21588211 | 21588216 | + |
| SEQ ID NO 22606 | ATTTTTCACTGCTGTCTTTCAA | CTC | chr12 | 21588196 | 21588217 | 21588213 | 21588218 | + |
| SEQ ID NO 22607 | TTCACTGCTGTCTTTCAAAACA | TTT | chr12 | 21588200 | 21588221 | 21588217 | 21588222 | + |
| SEQ ID NO 22608 | TCACTGCTGTCTTTCAAAACAT | TTT | chr12 | 21588201 | 21588222 | 21588218 | 21588223 | + |
| SEQ ID NO 22609 | CACTGCTGTCTTTCAAAACATA | TTT | chr12 | 21588202 | 21588223 | 21588219 | 21588224 | + |
| SEQ ID NO 22610 | ACTGCTGTCTTTCAAAACATAT | TTC | chr12 | 21588203 | 21588224 | 21588220 | 21588225 | + |
| SEQ ID NO 22611 | CTGTCTTTCAAAACATATTCCA | CTG | chr12 | 21588207 | 21588228 | 21588224 | 21588229 | + |
| SEQ ID NO 22612 | TCTTTCAAAACATATTCCATTT | CTG | chr12 | 21588210 | 21588231 | 21588227 | 21588232 | + |
| SEQ ID NO 22613 | TCAAAACATATTCCATTTCATC | CTT | chr12 | 21588214 | 21588235 | 21588231 | 21588236 | + |
| SEQ ID NO 22614 | CAAAACATATTCCATTTCATCA | TTT | chr12 | 21588215 | 21588236 | 21588232 | 21588237 | + |
| SEQ ID NO 22615 | AAAACATATTCCATTTCATCAG | TTC | chr12 | 21588216 | 21588237 | 21588233 | 21588238 | + |
| SEQ ID NO 22616 | CATTTCATCAGACTACAGGTTT | TTC | chr12 | 21588227 | 21588248 | 21588244 | 21588249 | + |
| SEQ ID NO 22617 | CATCAGACTACAGGTTTTAATA | TTT | chr12 | 21588232 | 21588253 | 21588249 | 21588254 | + |
| SEQ ID NO 22618 | ATCAGACTACAGGTTTTAATAG | TTC | chr12 | 21588233 | 21588254 | 21588250 | 21588255 | + |
| SEQ ID NO 22619 | CAGGTTTTAATAGCTACTATAT | CTA | chr12 | 21588242 | 21588263 | 21588259 | 21588264 | + |
| SEQ ID NO 22620 | TAATAGCTACTATATTTCTTAA | TTT | chr12 | 21588249 | 21588270 | 21588266 | 21588271 | + |
| SEQ ID NO 22621 | AATAGCTACTATATTTCTTAAA | TTT | chr12 | 21588250 | 21588271 | 21588267 | 21588272 | + |
| SEQ ID NO 22622 | ATAGCTACTATATTTCTTAAAT | TTA | chr12 | 21588251 | 21588272 | 21588268 | 21588273 | + |
| SEQ ID NO 22623 | CTATATTTCTTAAATGTATTAT | CTA | chr12 | 21588258 | 21588279 | 21588275 | 21588280 | + |
| SEQ ID NO 22624 | TATTTCTTAAATGTATTATTCC | CTA | chr12 | 21588261 | 21588282 | 21588278 | 21588283 | + |
| SEQ ID NO 22625 | CTTAAATGTATTATTCCAGTAA | TTT | chr12 | 21588266 | 21588287 | 21588283 | 21588288 | + |
| SEQ ID NO 22626 | TTAAATGTATTATTCCAGTAAC | TTC | chr12 | 21588267 | 21588288 | 21588284 | 21588289 | + |
| SEQ ID NO 22627 | AAATGTATTATTCCAGTAACTT | CTT | chr12 | 21588269 | 21588290 | 21588286 | 21588291 | + |
| SEQ ID NO 22628 | AATGTATTATTCCAGTAACTTA | TTA | chr12 | 21588270 | 21588291 | 21588287 | 21588292 | + |
| SEQ ID NO 22629 | TTCCAGTAACTTATACTTTACA | TTA | chr12 | 21588279 | 21588300 | 21588296 | 21588301 | + |

Figure 48 (Cont'd)

| | | | | | | | | |
|---|---|---|---|---|---|---|---|---|
| SEQ ID NO 22630 | CAGTAACTTATACTTTACATAG | TTC | chr12 | 21588282 | 21588303 | 21588299 | 21588304 | + |
| SEQ ID NO 22631 | ATACTTTACATAGTAAATCTTA | CTT | chr12 | 21588291 | 21588312 | 21588308 | 21588313 | + |
| SEQ ID NO 22632 | TACTTTACATAGTAAATCTTAT | TTA | chr12 | 21588292 | 21588313 | 21588309 | 21588314 | + |
| SEQ ID NO 22633 | TACATAGTAAATCTTATCAATA | CTT | chr12 | 21588297 | 21588318 | 21588314 | 21588319 | + |
| SEQ ID NO 22634 | ACATAGTAAATCTTATCAATAG | TTT | chr12 | 21588298 | 21588319 | 21588315 | 21588320 | + |
| SEQ ID NO 22635 | CATAGTAAATCTTATCAATAGT | TTA | chr12 | 21588299 | 21588320 | 21588316 | 21588321 | + |
| SEQ ID NO 22636 | ATCAATAGTCACAATCAATGGT | CTT | chr12 | 21588312 | 21588333 | 21588329 | 21588334 | + |
| SEQ ID NO 22637 | TCAATAGTCACAATCAATGGTC | TTA | chr12 | 21588313 | 21588334 | 21588330 | 21588335 | + |
| SEQ ID NO 22638 | CATCTGGAGACATTACTTTTAG | CTT | chr12 | 21588349 | 21588370 | 21588366 | 21588371 | + |
| SEQ ID NO 22639 | ATCTGGAGACATTACTTTTAGC | TTC | chr12 | 21588350 | 21588371 | 21588367 | 21588372 | + |
| SEQ ID NO 22640 | GAGACATTACTTTTAGCCTGAG | CTG | chr12 | 21588355 | 21588376 | 21588372 | 21588377 | + |
| SEQ ID NO 22641 | CTTTTAGCCTGAGCCATGCAAA | TTA | chr12 | 21588364 | 21588385 | 21588381 | 21588386 | + |
| SEQ ID NO 22642 | TTAGCCTGAGCCATGCAAAATA | CTT | chr12 | 21588367 | 21588388 | 21588384 | 21588389 | + |
| SEQ ID NO 22643 | TAGCCTGAGCCATGCAAAATAT | TTT | chr12 | 21588368 | 21588389 | 21588385 | 21588390 | + |
| SEQ ID NO 22644 | AGCCTGAGCCATGCAAAATATA | TTT | chr12 | 21588369 | 21588390 | 21588386 | 21588391 | + |
| SEQ ID NO 22645 | GCCTGAGCCATGCAAAATATAC | TTA | chr12 | 21588370 | 21588391 | 21588387 | 21588392 | + |
| SEQ ID NO 22646 | AGCCATGCAAAATATACTTTTT | CTG | chr12 | 21588375 | 21588396 | 21588392 | 21588397 | + |
| SEQ ID NO 22647 | TTTGGAAAATTGCCCTTTGAAA | CTT | chr12 | 21588394 | 21588415 | 21588411 | 21588416 | + |
| SEQ ID NO 22648 | TTGGAAAATTGCCCTTTGAAAG | TTT | chr12 | 21588395 | 21588416 | 21588412 | 21588417 | + |
| SEQ ID NO 22649 | TGGAAAATTGCCCTTTGAAAGG | TTT | chr12 | 21588396 | 21588417 | 21588413 | 21588418 | + |
| SEQ ID NO 22650 | GGAAAATTGCCCTTTGAAAGGC | TTT | chr12 | 21588397 | 21588418 | 21588414 | 21588419 | + |
| SEQ ID NO 22651 | GAAAATTGCCCTTTGAAAGGCG | TTG | chr12 | 21588398 | 21588419 | 21588415 | 21588420 | + |
| SEQ ID NO 22652 | CCCTTTGAAAGGCGAGACACAA | TTG | chr12 | 21588406 | 21588427 | 21588423 | 21588428 | + |
| SEQ ID NO 22653 | TGAAAGGCGAGACACAAAAGGC | CTT | chr12 | 21588411 | 21588432 | 21588428 | 21588433 | + |
| SEQ ID NO 22654 | GAAAGGCGAGACACAAAAGGCA | TTT | chr12 | 21588412 | 21588433 | 21588429 | 21588434 | + |
| SEQ ID NO 22655 | AAAGGCGAGACACAAAAGGCAA | TTG | chr12 | 21588413 | 21588434 | 21588430 | 21588435 | + |
| SEQ ID NO 22656 | ATGCTATTATATGGTACCAATA | TTG | chr12 | 21588441 | 21588462 | 21588458 | 21588463 | + |
| SEQ ID NO 22657 | TTATATGGTACCAATAGGATTC | CTA | chr12 | 21588447 | 21588468 | 21588464 | 21588469 | + |
| SEQ ID NO 22658 | TATGGTACCAATAGGATTCATT | TTA | chr12 | 21588450 | 21588471 | 21588467 | 21588472 | + |
| SEQ ID NO 22659 | ATTAATTTATAAAGGAGAAGAG | TTC | chr12 | 21588469 | 21588490 | 21588486 | 21588491 | + |
| SEQ ID NO 22660 | ATTTATAAAGGAGAAGAGCTAA | TTA | chr12 | 21588473 | 21588494 | 21588490 | 21588495 | + |
| SEQ ID NO 22661 | ATAAAGGAGAAGAGCTAATGTA | TTT | chr12 | 21588477 | 21588498 | 21588494 | 21588499 | + |
| SEQ ID NO 22662 | TAAAGGAGAAGAGCTAATGTAA | TTA | chr12 | 21588478 | 21588499 | 21588495 | 21588500 | + |
| SEQ ID NO 22663 | ATGTAACTCCAAAATGCAAGCA | CTA | chr12 | 21588494 | 21588515 | 21588511 | 21588516 | + |
| SEQ ID NO 22664 | CAAAATGCAAGCAATTTTCATA | CTC | chr12 | 21588503 | 21588524 | 21588520 | 21588525 | + |
| SEQ ID NO 22665 | TCATATGAGTCTACACAAGCTA | TTT | chr12 | 21588520 | 21588541 | 21588537 | 21588542 | + |
| SEQ ID NO 22666 | CATATGAGTCTACACAAGCTAA | TTT | chr12 | 21588521 | 21588542 | 21588538 | 21588543 | + |
| SEQ ID NO 22667 | ATATGAGTCTACACAAGCTAAT | TTC | chr12 | 21588522 | 21588543 | 21588539 | 21588544 | + |
| SEQ ID NO 22668 | CACAAGCTAATTGTCCTTAAGA | CTA | chr12 | 21588533 | 21588554 | 21588550 | 21588555 | + |
| SEQ ID NO 22669 | ATTGTCCTTAAGAATTTCATCT | CTA | chr12 | 21588542 | 21588563 | 21588559 | 21588564 | + |
| SEQ ID NO 22670 | TCCTTAAGAATTTCATCTTTAA | TTG | chr12 | 21588546 | 21588567 | 21588563 | 21588568 | + |
| SEQ ID NO 22671 | AAGAATTTCATCTTTAAGGAAA | CTT | chr12 | 21588551 | 21588572 | 21588568 | 21588573 | + |
| SEQ ID NO 22672 | AGAATTTCATCTTTAAGGAAAA | TTA | chr12 | 21588552 | 21588573 | 21588569 | 21588574 | + |
| SEQ ID NO 22673 | CATCTTTAAGGAAAAGTTTTTT | TTT | chr12 | 21588559 | 21588580 | 21588576 | 21588581 | + |
| SEQ ID NO 22674 | ATCTTTAAGGAAAAGTTTTTTA | TTC | chr12 | 21588560 | 21588581 | 21588577 | 21588582 | + |
| SEQ ID NO 22675 | TAAGGAAAAGTTTTTTACTGTA | CTT | chr12 | 21588565 | 21588586 | 21588582 | 21588587 | + |
| SEQ ID NO 22676 | AAGGAAAAGTTTTTTACTGTAT | TTT | chr12 | 21588566 | 21588587 | 21588583 | 21588588 | + |
| SEQ ID NO 22677 | AGGAAAAGTTTTTTACTGTATC | TTA | chr12 | 21588567 | 21588588 | 21588584 | 21588589 | + |
| SEQ ID NO 22678 | TTTACTGTATCAAAAGAAGTT | TTT | chr12 | 21588578 | 21588599 | 21588595 | 21588600 | + |
| SEQ ID NO 22679 | TTACTGTATCAAAAGAAGTTT | TTT | chr12 | 21588579 | 21588600 | 21588596 | 21588601 | + |
| SEQ ID NO 22680 | TACTGTATCAAAAGAAGTTTA | TTT | chr12 | 21588580 | 21588601 | 21588597 | 21588602 | + |
| SEQ ID NO 22681 | ACTGTATCAAAAGAAGTTTAA | TTT | chr12 | 21588581 | 21588602 | 21588598 | 21588603 | + |
| SEQ ID NO 22682 | CTGTATCAAAAGAAGTTTAAA | TTA | chr12 | 21588582 | 21588603 | 21588599 | 21588604 | + |
| SEQ ID NO 22683 | TATCAAAAGAAGTTTAAACTG | CTG | chr12 | 21588585 | 21588606 | 21588602 | 21588607 | + |
| SEQ ID NO 22684 | AAACTGTCATTGAGCAGAGTCT | TTT | chr12 | 21588601 | 21588622 | 21588618 | 21588623 | + |
| SEQ ID NO 22685 | AACTGTCATTGAGCAGAGTCTG | TTA | chr12 | 21588602 | 21588623 | 21588619 | 21588624 | + |
| SEQ ID NO 22686 | TCATTGAGCAGAGTCTGATAAT | CTG | chr12 | 21588607 | 21588628 | 21588624 | 21588629 | + |
| SEQ ID NO 22687 | AGCAGAGTCTGATAATAAGGAC | TTG | chr12 | 21588613 | 21588634 | 21588630 | 21588635 | + |

Figure 48 (Cont'd)

| | | | | | | | | |
|---|---|---|---|---|---|---|---|---|
| SEQ ID NO 22688 | ATAATAAGGACACTGTCAAATC | CTG | chr12 | 21588624 | 21588645 | 21588641 | 21588646 | + |
| SEQ ID NO 22689 | TCAAATCACAGTTCAGATGTTA | CTG | chr12 | 21588639 | 21588660 | 21588656 | 21588661 | + |
| SEQ ID NO 22690 | AGATGTTATGTGATGAGGACAG | TTC | chr12 | 21588653 | 21588674 | 21588670 | 21588675 | + |
| SEQ ID NO 22691 | TGTGATGAGGACAGAATAGAAC | TTA | chr12 | 21588661 | 21588682 | 21588678 | 21588683 | + |
| SEQ ID NO 22692 | CTAGACTGGACAAGAACAGACA | CTT | chr12 | 21588706 | 21588727 | 21588723 | 21588728 | + |
| SEQ ID NO 22693 | TAGACTGGACAAGAACAGACAT | TTC | chr12 | 21588707 | 21588728 | 21588724 | 21588729 | + |
| SEQ ID NO 22694 | GACTGGACAAGAACAGACATGA | CTA | chr12 | 21588709 | 21588730 | 21588726 | 21588731 | + |
| SEQ ID NO 22695 | GACAAGAACAGACATGATTAAC | CTG | chr12 | 21588714 | 21588735 | 21588731 | 21588736 | + |
| SEQ ID NO 22696 | ACTTAACCATCCAACAATAAAT | TTA | chr12 | 21588734 | 21588755 | 21588751 | 21588756 | + |
| SEQ ID NO 22697 | AACCATCCAACAATAAATCTAA | CTT | chr12 | 21588738 | 21588759 | 21588755 | 21588760 | + |
| SEQ ID NO 22698 | ACCATCCAACAATAAATCTAAG | TTA | chr12 | 21588739 | 21588760 | 21588756 | 21588761 | + |
| SEQ ID NO 22699 | AGTTAACATAAATTGATGTCAT | CTA | chr12 | 21588759 | 21588780 | 21588776 | 21588781 | + |
| SEQ ID NO 22700 | ACATAAATTGATGTCATCTACT | TTA | chr12 | 21588764 | 21588785 | 21588781 | 21588786 | + |
| SEQ ID NO 22701 | ATGTCATCTACTACATCTAAGT | TTG | chr12 | 21588774 | 21588795 | 21588791 | 21588796 | + |
| SEQ ID NO 22702 | CTACATCTAAGTATTTCCTCAA | CTA | chr12 | 21588784 | 21588805 | 21588801 | 21588806 | + |
| SEQ ID NO 22703 | CATCTAAGTATTTCCTCAAATT | CTA | chr12 | 21588787 | 21588808 | 21588804 | 21588809 | + |
| SEQ ID NO 22704 | AGTATTTCCTCAAATTCTGGAC | CTA | chr12 | 21588793 | 21588814 | 21588810 | 21588815 | + |
| SEQ ID NO 22705 | CCTCAAATTCTGGACAATTTTA | TTT | chr12 | 21588800 | 21588821 | 21588817 | 21588822 | + |
| SEQ ID NO 22706 | CTCAAATTCTGGACAATTTTAG | TTC | chr12 | 21588801 | 21588822 | 21588818 | 21588823 | + |
| SEQ ID NO 22707 | AAATTCTGGACAATTTTAGAAA | CTC | chr12 | 21588804 | 21588825 | 21588821 | 21588826 | + |
| SEQ ID NO 22708 | TGGACAATTTTAGAAACCATCA | TTC | chr12 | 21588810 | 21588831 | 21588827 | 21588832 | + |
| SEQ ID NO 22709 | GACAATTTTAGAAACCATCAAA | CTG | chr12 | 21588812 | 21588833 | 21588829 | 21588834 | + |
| SEQ ID NO 22710 | TAGAAACCATCAAAATTATTTG | TTT | chr12 | 21588820 | 21588841 | 21588837 | 21588842 | + |
| SEQ ID NO 22711 | AGAAACCATCAAAATTATTTGT | TTT | chr12 | 21588821 | 21588842 | 21588838 | 21588843 | + |
| SEQ ID NO 22712 | GAAACCATCAAAATTATTTGTT | TTA | chr12 | 21588822 | 21588843 | 21588839 | 21588844 | + |
| SEQ ID NO 22713 | TTTGTTGAGGAAAAATAAACTT | TTA | chr12 | 21588838 | 21588859 | 21588855 | 21588860 | + |
| SEQ ID NO 22714 | GTTGAGGAAAAATAAACTTAGC | TTT | chr12 | 21588841 | 21588862 | 21588858 | 21588863 | + |
| SEQ ID NO 22715 | TTGAGGAAAAATAAACTTAGCC | TTG | chr12 | 21588842 | 21588863 | 21588859 | 21588864 | + |
| SEQ ID NO 22716 | AGGAAAAATAAACTTAGCCAAT | TTG | chr12 | 21588845 | 21588866 | 21588862 | 21588867 | + |
| SEQ ID NO 22717 | AGCCAATTTGCAAGGGCAACTA | CTT | chr12 | 21588860 | 21588881 | 21588877 | 21588882 | + |
| SEQ ID NO 22718 | GCCAATTTGCAAGGGCAACTAA | TTA | chr12 | 21588861 | 21588882 | 21588878 | 21588883 | + |
| SEQ ID NO 22719 | GCAAGGGCAACTAAAATGAAGA | TTT | chr12 | 21588869 | 21588890 | 21588886 | 21588891 | + |
| SEQ ID NO 22720 | CAAGGGCAACTAAAATGAAGAA | TTG | chr12 | 21588870 | 21588891 | 21588887 | 21588892 | + |
| SEQ ID NO 22721 | AAATGAAGAACTTTTCTTTAAA | CTA | chr12 | 21588882 | 21588903 | 21588899 | 21588904 | + |
| SEQ ID NO 22722 | TTCTTTAAAGTGTGGGAGTCAC | CTT | chr12 | 21588895 | 21588916 | 21588912 | 21588917 | + |
| SEQ ID NO 22723 | TCTTTAAAGTGTGGGAGTCACA | TTT | chr12 | 21588896 | 21588917 | 21588913 | 21588918 | + |
| SEQ ID NO 22724 | CTTTAAAGTGTGGGAGTCACAT | TTT | chr12 | 21588897 | 21588918 | 21588914 | 21588919 | + |
| SEQ ID NO 22725 | TTTAAAGTGTGGGAGTCACATC | TTC | chr12 | 21588898 | 21588919 | 21588915 | 21588920 | + |
| SEQ ID NO 22726 | TAAAGTGTGGGAGTCACATCTT | CTT | chr12 | 21588900 | 21588921 | 21588917 | 21588922 | + |
| SEQ ID NO 22727 | AAAGTGTGGGAGTCACATCTTA | TTT | chr12 | 21588901 | 21588922 | 21588918 | 21588923 | + |
| SEQ ID NO 22728 | AAGTGTGGGAGTCACATCTTAG | TTA | chr12 | 21588902 | 21588923 | 21588919 | 21588924 | + |
| SEQ ID NO 22729 | AGCAACATATTTAAATATATCT | CTT | chr12 | 21588922 | 21588943 | 21588939 | 21588944 | + |
| SEQ ID NO 22730 | GCAACATATTTAAATATATCTA | TTA | chr12 | 21588923 | 21588944 | 21588940 | 21588945 | + |
| SEQ ID NO 22731 | AAATATATCTAAGCTTTCTTCA | TTT | chr12 | 21588934 | 21588955 | 21588951 | 21588956 | + |
| SEQ ID NO 22732 | AATATATCTAAGCTTTCTTCAA | TTA | chr12 | 21588935 | 21588956 | 21588952 | 21588957 | + |
| SEQ ID NO 22733 | AGCTTTCTTCAAAACCACTATC | CTA | chr12 | 21588945 | 21588966 | 21588962 | 21588967 | + |
| SEQ ID NO 22734 | TCTTCAAAACCACTATCCACAA | CTT | chr12 | 21588950 | 21588971 | 21588967 | 21588972 | + |
| SEQ ID NO 22735 | CTTCAAAACCACTATCCACAAA | TTT | chr12 | 21588951 | 21588972 | 21588968 | 21588973 | + |
| SEQ ID NO 22736 | TTCAAAACCACTATCCACAAAA | TTC | chr12 | 21588952 | 21588973 | 21588969 | 21588974 | + |
| SEQ ID NO 22737 | CAAAACCACTATCCACAAAAAT | CTT | chr12 | 21588954 | 21588975 | 21588971 | 21588976 | + |
| SEQ ID NO 22738 | AAAACCACTATCCACAAAAATG | TTC | chr12 | 21588955 | 21588976 | 21588972 | 21588977 | + |
| SEQ ID NO 22739 | TCCACAAAAATGCAAATTTCC | CTA | chr12 | 21588965 | 21588986 | 21588982 | 21588987 | + |
| SEQ ID NO 22740 | CCAAAGAATTTCTCCTCTTCTG | TTT | chr12 | 21588985 | 21589006 | 21589002 | 21589007 | + |
| SEQ ID NO 22741 | CAAAGAATTTCTCCTCTTCTGT | TTC | chr12 | 21588986 | 21589007 | 21589003 | 21589008 | + |
| SEQ ID NO 22742 | CTCCTCTTCTGTAGACTTATTT | TTT | chr12 | 21588996 | 21589017 | 21589013 | 21589018 | + |
| SEQ ID NO 22743 | TCCTCTTCTGTAGACTTATTTT | TTC | chr12 | 21588997 | 21589018 | 21589014 | 21589019 | + |
| SEQ ID NO 22744 | CTCTTCTGTAGACTTATTTTCT | CTC | chr12 | 21588999 | 21589020 | 21589016 | 21589021 | + |
| SEQ ID NO 22745 | TTCTGTAGACTTATTTTCTTCA | CTC | chr12 | 21589002 | 21589023 | 21589019 | 21589024 | + |

Figure 48 (Cont'd)

| SEQ ID NO 22746 | CTGTAGACTTATTTTCTTCATC | CTT | chr12 | 21589004 | 21589025 | 21589021 | 21589026 | + |
|---|---|---|---|---|---|---|---|---|
| SEQ ID NO 22747 | TGTAGACTTATTTTCTTCATCT | TTC | chr12 | 21589005 | 21589026 | 21589022 | 21589027 | + |
| SEQ ID NO 22748 | TAGACTTATTTTCTTCATCTTC | CTG | chr12 | 21589007 | 21589028 | 21589024 | 21589029 | + |
| SEQ ID NO 22749 | ATTTTCTTCATCTTCATCTTTT | CTT | chr12 | 21589014 | 21589035 | 21589031 | 21589036 | + |
| SEQ ID NO 22750 | TTTTCTTCATCTTCATCTTTTC | TTA | chr12 | 21589015 | 21589036 | 21589032 | 21589037 | + |
| SEQ ID NO 22751 | TCTTCATCTTCATCTTTTCCAG | TTT | chr12 | 21589018 | 21589039 | 21589035 | 21589040 | + |
| SEQ ID NO 22752 | CTTCATCTTCATCTTTTCCAGG | TTT | chr12 | 21589019 | 21589040 | 21589036 | 21589041 | + |
| SEQ ID NO 22753 | TTCATCTTCATCTTTTCCAGGA | TTC | chr12 | 21589020 | 21589041 | 21589037 | 21589042 | + |
| SEQ ID NO 22754 | CATCTTCATCTTTTCCAGGAGA | CTT | chr12 | 21589022 | 21589043 | 21589039 | 21589044 | + |
| SEQ ID NO 22755 | ATCTTCATCTTTTCCAGGAGAA | TTC | chr12 | 21589023 | 21589044 | 21589040 | 21589045 | + |
| SEQ ID NO 22756 | CATCTTTTCCAGGAGAATATAC | CTT | chr12 | 21589028 | 21589049 | 21589045 | 21589050 | + |
| SEQ ID NO 22757 | ATCTTTTCCAGGAGAATATACC | TTC | chr12 | 21589029 | 21589050 | 21589046 | 21589051 | + |
| SEQ ID NO 22758 | TTCCAGGAGAATATACCATAAG | CTT | chr12 | 21589034 | 21589055 | 21589051 | 21589056 | + |
| SEQ ID NO 22759 | TCCAGGAGAATATACCATAAGT | TTT | chr12 | 21589035 | 21589056 | 21589052 | 21589057 | + |
| SEQ ID NO 22760 | CCAGGAGAATATACCATAAGTT | TTT | chr12 | 21589036 | 21589057 | 21589053 | 21589058 | + |
| SEQ ID NO 22761 | CAGGAGAATATACCATAAGTTT | TTC | chr12 | 21589037 | 21589058 | 21589054 | 21589059 | + |
| SEQ ID NO 22762 | CTGATGGTACACATTTATTAGA | TTT | chr12 | 21589059 | 21589080 | 21589076 | 21589081 | + |
| SEQ ID NO 22763 | TGATGGTACACATTTATTAGAT | TTC | chr12 | 21589060 | 21589081 | 21589077 | 21589082 | + |
| SEQ ID NO 22764 | ATGGTACACATTTATTAGATGT | CTG | chr12 | 21589062 | 21589083 | 21589079 | 21589084 | + |
| SEQ ID NO 22765 | ATTAGATGTTTTATTTACATTT | TTT | chr12 | 21589075 | 21589096 | 21589092 | 21589097 | + |
| SEQ ID NO 22766 | TTAGATGTTTTATTTACATTTT | TTA | chr12 | 21589076 | 21589097 | 21589093 | 21589098 | + |
| SEQ ID NO 22767 | GATGTTTTATTTACATTTTTA | TTA | chr12 | 21589079 | 21589100 | 21589096 | 21589101 | + |
| SEQ ID NO 22768 | TATTTACATTTTTTATCCTTGA | TTT | chr12 | 21589086 | 21589107 | 21589103 | 21589108 | + |
| SEQ ID NO 22769 | ATTTACATTTTTTATCCTTGAA | TTT | chr12 | 21589087 | 21589108 | 21589104 | 21589109 | + |
| SEQ ID NO 22770 | TTTACATTTTTTATCCTTGAAA | TTA | chr12 | 21589088 | 21589109 | 21589105 | 21589110 | + |
| SEQ ID NO 22771 | ACATTTTTTATCCTTGAAAACT | TTT | chr12 | 21589091 | 21589112 | 21589108 | 21589113 | + |
| SEQ ID NO 22772 | CATTTTTTATCCTTGAAAACTC | TTA | chr12 | 21589092 | 21589113 | 21589109 | 21589114 | + |
| SEQ ID NO 22773 | TTTATCCTTGAAAACTCCTTTT | TTT | chr12 | 21589097 | 21589118 | 21589114 | 21589119 | + |
| SEQ ID NO 22774 | TTATCCTTGAAAACTCCTTTTA | TTT | chr12 | 21589098 | 21589119 | 21589115 | 21589120 | + |
| SEQ ID NO 22775 | TATCCTTGAAAACTCCTTTTAT | TTT | chr12 | 21589099 | 21589120 | 21589116 | 21589121 | + |
| SEQ ID NO 22776 | ATCCTTGAAAACTCCTTTTATT | TTT | chr12 | 21589100 | 21589121 | 21589117 | 21589122 | + |
| SEQ ID NO 22777 | TCCTTGAAAACTCCTTTTATTT | TTA | chr12 | 21589101 | 21589122 | 21589118 | 21589123 | + |
| SEQ ID NO 22778 | GAAAACTCCTTTTATTTGCAAC | CTT | chr12 | 21589106 | 21589127 | 21589123 | 21589128 | + |
| SEQ ID NO 22779 | AAAACTCCTTTTATTTGCAACT | TTG | chr12 | 21589107 | 21589128 | 21589124 | 21589129 | + |
| SEQ ID NO 22780 | CTTTTATTTGCAACTATGCATC | CTC | chr12 | 21589114 | 21589135 | 21589131 | 21589136 | + |
| SEQ ID NO 22781 | TTATTTGCAACTATGCATCTTA | CTT | chr12 | 21589117 | 21589138 | 21589134 | 21589139 | + |
| SEQ ID NO 22782 | TATTTGCAACTATGCATCTTAC | TTT | chr12 | 21589118 | 21589139 | 21589135 | 21589140 | + |
| SEQ ID NO 22783 | ATTTGCAACTATGCATCTTACT | TTT | chr12 | 21589119 | 21589140 | 21589136 | 21589141 | + |
| SEQ ID NO 22784 | TTTGCAACTATGCATCTTACTC | TTA | chr12 | 21589120 | 21589141 | 21589137 | 21589142 | + |
| SEQ ID NO 22785 | GCAACTATGCATCTTACTCAGA | TTT | chr12 | 21589123 | 21589144 | 21589140 | 21589145 | + |
| SEQ ID NO 22786 | CAACTATGCATCTTACTCAGAG | TTG | chr12 | 21589124 | 21589145 | 21589141 | 21589146 | + |
| SEQ ID NO 22787 | TGCATCTTACTCAGAGATCTTA | CTA | chr12 | 21589130 | 21589151 | 21589147 | 21589152 | + |
| SEQ ID NO 22788 | ACTCAGAGATCTTAAAACATCC | CTT | chr12 | 21589138 | 21589159 | 21589155 | 21589160 | + |
| SEQ ID NO 22789 | CTCAGAGATCTTAAAACATCCT | TTA | chr12 | 21589139 | 21589160 | 21589156 | 21589161 | + |
| SEQ ID NO 22790 | AGAGATCTTAAAACATCCTTGT | CTC | chr12 | 21589142 | 21589163 | 21589159 | 21589164 | + |
| SEQ ID NO 22791 | AAAACATCCTTGTTTGTTAGAT | CTT | chr12 | 21589151 | 21589172 | 21589168 | 21589173 | + |
| SEQ ID NO 22792 | AAACATCCTTGTTTGTTAGATT | TTA | chr12 | 21589152 | 21589173 | 21589169 | 21589174 | + |
| SEQ ID NO 22793 | GTTTGTTAGATTACGTATTTCA | CTT | chr12 | 21589162 | 21589183 | 21589179 | 21589184 | + |
| SEQ ID NO 22794 | TTTGTTAGATTACGTATTTCAA | TTG | chr12 | 21589163 | 21589184 | 21589180 | 21589185 | + |
| SEQ ID NO 22795 | GTTAGATTACGTATTTCAAATT | TTT | chr12 | 21589166 | 21589187 | 21589183 | 21589188 | + |
| SEQ ID NO 22796 | TTAGATTACGTATTTCAAATTC | TTG | chr12 | 21589167 | 21589188 | 21589184 | 21589189 | + |
| SEQ ID NO 22797 | GATTACGTATTTCAAATTCATA | TTA | chr12 | 21589170 | 21589191 | 21589187 | 21589192 | + |
| SEQ ID NO 22798 | CGTATTTCAAATTCATATACAC | TTA | chr12 | 21589175 | 21589196 | 21589192 | 21589197 | + |
| SEQ ID NO 22799 | CAAATTCATATACACTTTGGTA | TTT | chr12 | 21589182 | 21589203 | 21589199 | 21589204 | + |
| SEQ ID NO 22800 | AAATTCATATACACTTTGGTAG | TTC | chr12 | 21589183 | 21589204 | 21589200 | 21589205 | + |
| SEQ ID NO 22801 | ATATACACTTTGGTAGATGCAA | TTC | chr12 | 21589189 | 21589210 | 21589206 | 21589211 | + |
| SEQ ID NO 22802 | TGGTAGATGCAAACATTTTTAT | CTT | chr12 | 21589199 | 21589220 | 21589216 | 21589221 | + |
| SEQ ID NO 22803 | GGTAGATGCAAACATTTTTATT | TTT | chr12 | 21589200 | 21589221 | 21589217 | 21589222 | + |

Figure 48 (Cont'd)

| | | | | | | | | |
|---|---|---|---|---|---|---|---|---|
| SEQ ID NO 22804 | GTAGATGCAAACATTTTTATTT | TTG | chr12 | 21589201 | 21589222 | 21589218 | 21589223 | + |
| SEQ ID NO 22805 | TTATTTGCTGAAGAACATAAGG | TTT | chr12 | 21589217 | 21589238 | 21589234 | 21589239 | + |
| SEQ ID NO 22806 | TATTTGCTGAAGAACATAAGGG | TTT | chr12 | 21589218 | 21589239 | 21589235 | 21589240 | + |
| SEQ ID NO 22807 | ATTTGCTGAAGAACATAAGGGG | TTT | chr12 | 21589219 | 21589240 | 21589236 | 21589241 | + |
| SEQ ID NO 22808 | TTTGCTGAAGAACATAAGGGGG | TTA | chr12 | 21589220 | 21589241 | 21589237 | 21589242 | + |
| SEQ ID NO 22809 | GCTGAAGAACATAAGGGGGAAA | TTT | chr12 | 21589223 | 21589244 | 21589240 | 21589245 | + |
| SEQ ID NO 22810 | CTGAAGAACATAAGGGGGAAAT | TTG | chr12 | 21589224 | 21589245 | 21589241 | 21589246 | + |
| SEQ ID NO 22811 | AAGAACATAAGGGGGAAATAGA | CTG | chr12 | 21589227 | 21589248 | 21589244 | 21589249 | + |
| SEQ ID NO 22812 | TTTATTTGAAGAAACAAATGAT | TTC | chr12 | 21589254 | 21589275 | 21589271 | 21589276 | + |
| SEQ ID NO 22813 | TATTTGAAGAAACAAATGATTT | CTT | chr12 | 21589256 | 21589277 | 21589273 | 21589278 | + |
| SEQ ID NO 22814 | ATTTGAAGAAACAAATGATTTG | TTT | chr12 | 21589257 | 21589278 | 21589274 | 21589279 | + |
| SEQ ID NO 22815 | TTTGAAGAAACAAATGATTTGA | TTA | chr12 | 21589258 | 21589279 | 21589275 | 21589280 | + |
| SEQ ID NO 22816 | GAAGAAACAAATGATTTGATTT | TTT | chr12 | 21589261 | 21589282 | 21589278 | 21589283 | + |
| SEQ ID NO 22817 | AAGAAACAAATGATTTGATTTG | TTG | chr12 | 21589262 | 21589283 | 21589279 | 21589284 | + |
| SEQ ID NO 22818 | GATTTGGGAAATGAAATGAAAA | TTT | chr12 | 21589278 | 21589299 | 21589295 | 21589300 | + |
| SEQ ID NO 22819 | ATTTGGGAAATGAAATGAAAAG | TTG | chr12 | 21589279 | 21589300 | 21589296 | 21589301 | + |
| SEQ ID NO 22820 | GGGAAATGAAATGAAAAGAAAA | TTT | chr12 | 21589283 | 21589304 | 21589300 | 21589305 | + |
| SEQ ID NO 22821 | GGAAATGAAATGAAAAGAAAAA | TTG | chr12 | 21589284 | 21589305 | 21589301 | 21589306 | + |
| SEQ ID NO 22822 | ACTAATTCGCTACTTCTTTTAC | TTA | chr12 | 21589314 | 21589335 | 21589331 | 21589336 | + |
| SEQ ID NO 22823 | ATTCGCTACTTCTTTTACTCAT | CTA | chr12 | 21589318 | 21589339 | 21589335 | 21589340 | + |
| SEQ ID NO 22824 | GCTACTTCTTTTACTCATCTGA | TTC | chr12 | 21589322 | 21589343 | 21589339 | 21589344 | + |
| SEQ ID NO 22825 | CTTCTTTTACTCATCTGAGGCC | CTA | chr12 | 21589326 | 21589347 | 21589343 | 21589348 | + |
| SEQ ID NO 22826 | CTTTTACTCATCTGAGGCCTTC | CTT | chr12 | 21589329 | 21589350 | 21589346 | 21589351 | + |
| SEQ ID NO 22827 | TTTTACTCATCTGAGGCCTTCA | TTC | chr12 | 21589330 | 21589351 | 21589347 | 21589352 | + |
| SEQ ID NO 22828 | TTACTCATCTGAGGCCTTCAGA | CTT | chr12 | 21589332 | 21589353 | 21589349 | 21589354 | + |
| SEQ ID NO 22829 | TACTCATCTGAGGCCTTCAGAT | TTT | chr12 | 21589333 | 21589354 | 21589350 | 21589355 | + |
| SEQ ID NO 22830 | ACTCATCTGAGGCCTTCAGATA | TTT | chr12 | 21589334 | 21589355 | 21589351 | 21589356 | + |
| SEQ ID NO 22831 | CTCATCTGAGGCCTTCAGATAG | TTA | chr12 | 21589335 | 21589356 | 21589352 | 21589357 | + |
| SEQ ID NO 22832 | ATCTGAGGCCTTCAGATAGTCC | CTC | chr12 | 21589338 | 21589359 | 21589355 | 21589360 | + |
| SEQ ID NO 22833 | AGGCCTTCAGATAGTCCCCAT | CTG | chr12 | 21589343 | 21589364 | 21589360 | 21589365 | + |
| SEQ ID NO 22834 | CAGATAGTCCCCCATATAGCCT | CTT | chr12 | 21589350 | 21589371 | 21589367 | 21589372 | + |
| SEQ ID NO 22835 | AGATAGTCCCCCATATAGCCTT | TTC | chr12 | 21589351 | 21589372 | 21589368 | 21589373 | + |
| SEQ ID NO 22836 | AGAGTGTTTAAAATATGATTAT | CTT | chr12 | 21589373 | 21589394 | 21589390 | 21589395 | + |
| SEQ ID NO 22837 | GAGTGTTTAAAATATGATTATG | TTA | chr12 | 21589374 | 21589395 | 21589391 | 21589396 | + |
| SEQ ID NO 22838 | AAAATATGATTATGCTCTTTCA | TTT | chr12 | 21589382 | 21589403 | 21589399 | 21589404 | + |
| SEQ ID NO 22839 | AAATATGATTATGCTCTTTCAG | TTA | chr12 | 21589383 | 21589404 | 21589400 | 21589405 | + |
| SEQ ID NO 22840 | TGCTCTTTCAGTCTATTAGAAA | TTA | chr12 | 21589394 | 21589415 | 21589411 | 21589416 | + |
| SEQ ID NO 22841 | TTTCAGTCTATTAGAAATAAAA | CTC | chr12 | 21589399 | 21589420 | 21589416 | 21589421 | + |
| SEQ ID NO 22842 | TCAGTCTATTAGAAATAAAAAC | CTT | chr12 | 21589401 | 21589422 | 21589418 | 21589423 | + |
| SEQ ID NO 22843 | CAGTCTATTAGAAATAAAAACA | TTT | chr12 | 21589402 | 21589423 | 21589419 | 21589424 | + |
| SEQ ID NO 22844 | AGTCTATTAGAAATAAAAACAT | TTC | chr12 | 21589403 | 21589424 | 21589420 | 21589425 | + |
| SEQ ID NO 22845 | TTAGAAATAAAAACATAAAGCT | CTA | chr12 | 21589409 | 21589430 | 21589426 | 21589431 | + |
| SEQ ID NO 22846 | GAAATAAAAACATAAAGCTTAA | TTA | chr12 | 21589412 | 21589433 | 21589429 | 21589434 | + |
| SEQ ID NO 22847 | AAAAAATTTCAAGGGAAGGGGC | CTT | chr12 | 21589432 | 21589453 | 21589449 | 21589454 | + |
| SEQ ID NO 22848 | AAAAATTTCAAGGGAAGGGGCT | TTA | chr12 | 21589433 | 21589454 | 21589450 | 21589455 | + |
| SEQ ID NO 22849 | CAAGGGAAGGGGCTTGAAGATT | TTT | chr12 | 21589441 | 21589462 | 21589458 | 21589463 | + |
| SEQ ID NO 22850 | AAGGGAAGGGGCTTGAAGATTA | TTC | chr12 | 21589442 | 21589463 | 21589459 | 21589464 | + |
| SEQ ID NO 22851 | GAAGATTACTGACTAAGGGCAG | CTT | chr12 | 21589456 | 21589477 | 21589473 | 21589478 | + |
| SEQ ID NO 22852 | AAGATTACTGACTAAGGGCAGC | TTG | chr12 | 21589457 | 21589478 | 21589474 | 21589479 | + |
| SEQ ID NO 22853 | CTGACTAAGGGCAGCTGACACT | TTA | chr12 | 21589464 | 21589485 | 21589481 | 21589486 | + |
| SEQ ID NO 22854 | ACTAAGGGCAGCTGACACTCAC | CTG | chr12 | 21589467 | 21589488 | 21589484 | 21589489 | + |
| SEQ ID NO 22855 | AGGGCAGCTGACACTCACCTCC | CTA | chr12 | 21589471 | 21589492 | 21589488 | 21589493 | + |
| SEQ ID NO 22856 | ACACTCACCTCCTCCACAAAGA | CTG | chr12 | 21589481 | 21589502 | 21589498 | 21589503 | + |
| SEQ ID NO 22857 | ACCTCCTCCACAAAGAACCAAA | CTC | chr12 | 21589487 | 21589508 | 21589504 | 21589509 | + |
| SEQ ID NO 22858 | CTCCACAAAGAACCAAAATAGT | CTC | chr12 | 21589492 | 21589513 | 21589509 | 21589514 | + |
| SEQ ID NO 22859 | CACAAAGAACCAAAATAGTAAG | CTC | chr12 | 21589495 | 21589516 | 21589512 | 21589517 | + |
| SEQ ID NO 22860 | TGGAATTCAACAGAGAAGTGAC | TTC | chr12 | 21589544 | 21589565 | 21589561 | 21589566 | + |
| SEQ ID NO 22861 | GAATTCAACAGAGAAGTGACAG | CTG | chr12 | 21589546 | 21589567 | 21589563 | 21589568 | + |

Figure 48 (Cont'd)

| | | | | | | | | |
|---|---|---|---|---|---|---|---|---|
| SEQ ID NO 22862 | AACAGAGAAGTGACAGGAAGCA | TTC | chr12 | 21589552 | 21589573 | 21589569 | 21589574 | + |
| SEQ ID NO 22863 | AGGCAATGAAGGGGAGGGAAGC | CTA | chr12 | 21589578 | 21589599 | 21589595 | 21589600 | + |
| SEQ ID NO 22864 | CCCAGTAGGGATCCTCTGTGAG | CTA | chr12 | 21589611 | 21589632 | 21589628 | 21589633 | + |
| SEQ ID NO 22865 | TGTGAGGCCAGAGAGGCTCCCC | CTC | chr12 | 21589627 | 21589648 | 21589644 | 21589649 | + |
| SEQ ID NO 22866 | TGAGGCCAGAGAGGCTCCCCAG | CTG | chr12 | 21589629 | 21589650 | 21589646 | 21589651 | + |
| SEQ ID NO 22867 | CCCAGTGCATCGAAAGTTAAGT | CTC | chr12 | 21589646 | 21589667 | 21589663 | 21589668 | + |
| SEQ ID NO 22868 | AGTGACTGACTCCCAGTGGTCC | TTA | chr12 | 21589665 | 21589686 | 21589682 | 21589687 | + |
| SEQ ID NO 22869 | ACTCCCAGTGGTCCACATCTGC | CTG | chr12 | 21589673 | 21589694 | 21589690 | 21589695 | + |
| SEQ ID NO 22870 | CCAGTGGTCCACATCTGCATTA | CTC | chr12 | 21589677 | 21589698 | 21589694 | 21589699 | + |
| SEQ ID NO 22871 | CATTATGGACTCCAGGAATCCT | CTG | chr12 | 21589694 | 21589715 | 21589711 | 21589716 | + |
| SEQ ID NO 22872 | TGGACTCCAGGAATCCTAGCCA | TTA | chr12 | 21589699 | 21589720 | 21589716 | 21589721 | + |
| SEQ ID NO 22873 | CAGGAATCCTAGCCACAGGAGA | CTC | chr12 | 21589706 | 21589727 | 21589723 | 21589728 | + |
| SEQ ID NO 22874 | GCCACAGGAGAGTCCCTTGACC | CTA | chr12 | 21589717 | 21589738 | 21589734 | 21589739 | + |
| SEQ ID NO 22875 | GACCATGCAGGCCTTGAGACTA | CTT | chr12 | 21589735 | 21589756 | 21589752 | 21589757 | + |
| SEQ ID NO 22876 | ACCATGCAGGCCTTGAGACTAT | TTG | chr12 | 21589736 | 21589757 | 21589753 | 21589758 | + |
| SEQ ID NO 22877 | GAGACTATCATAAGGAACTGCC | CTT | chr12 | 21589750 | 21589771 | 21589767 | 21589772 | + |
| SEQ ID NO 22878 | AGACTATCATAAGGAACTGCCC | TTG | chr12 | 21589751 | 21589772 | 21589768 | 21589773 | + |
| SEQ ID NO 22879 | TCATAAGGAACTGCCCAGCAAT | CTA | chr12 | 21589757 | 21589778 | 21589774 | 21589779 | + |
| SEQ ID NO 22880 | CCCAGCAATCGCACAAAGGCAT | CTG | chr12 | 21589770 | 21589791 | 21589787 | 21589792 | + |
| SEQ ID NO 22881 | CTCCAGAAGGAGCTCTCACT | TTG | chr12 | 21589794 | 21589815 | 21589811 | 21589816 | + |
| SEQ ID NO 22882 | CAGAGAAGGAGCTCTCACTGGG | CTC | chr12 | 21589797 | 21589818 | 21589814 | 21589819 | + |
| SEQ ID NO 22883 | TCACTGGGTCCCACCCCTGCCA | CTC | chr12 | 21589811 | 21589832 | 21589828 | 21589833 | + |
| SEQ ID NO 22884 | ACTGGGTCCCACCCCTGCCATC | CTC | chr12 | 21589813 | 21589834 | 21589830 | 21589835 | + |
| SEQ ID NO 22885 | GGTCCCACCCCTGCCATCCCA | CTG | chr12 | 21589817 | 21589838 | 21589834 | 21589839 | + |
| SEQ ID NO 22886 | CCATCCCATTACTGAGCAGCA | CTG | chr12 | 21589830 | 21589851 | 21589847 | 21589852 | + |
| SEQ ID NO 22887 | CTGAGCAGCAAGGTGCCATTTT | TTA | chr12 | 21589842 | 21589863 | 21589859 | 21589864 | + |
| SEQ ID NO 22888 | AGCAGCAAGGTGCCATTTTGAG | CTG | chr12 | 21589845 | 21589866 | 21589862 | 21589867 | + |
| SEQ ID NO 22889 | TGAGAGCCCAACACCCACCAGA | TTT | chr12 | 21589863 | 21589884 | 21589880 | 21589885 | + |
| SEQ ID NO 22890 | GAGAGCCCAACACCCACCAGAT | TTT | chr12 | 21589864 | 21589885 | 21589881 | 21589886 | + |
| SEQ ID NO 22891 | AGAGCCCAACACCCACCAGATG | TTG | chr12 | 21589865 | 21589886 | 21589882 | 21589887 | + |
| SEQ ID NO 22892 | CTCAGACCCCAACATCATCTGC | TTC | chr12 | 21589896 | 21589917 | 21589913 | 21589918 | + |
| SEQ ID NO 22893 | AGACCCCAACATCATCTGCATC | CTC | chr12 | 21589899 | 21589920 | 21589916 | 21589921 | + |
| SEQ ID NO 22894 | CATCTCTACATCCCTGAAGCTC | CTG | chr12 | 21589917 | 21589938 | 21589934 | 21589939 | + |
| SEQ ID NO 22895 | TACATCCCTGAAGCTCTGCTGA | CTC | chr12 | 21589923 | 21589944 | 21589940 | 21589945 | + |
| SEQ ID NO 22896 | CATCCCTGAAGCTCTGCTGACA | CTA | chr12 | 21589925 | 21589946 | 21589942 | 21589947 | + |
| SEQ ID NO 22897 | AAGCTCTGCTGACATCCCCCAC | CTG | chr12 | 21589933 | 21589954 | 21589950 | 21589955 | + |
| SEQ ID NO 22898 | TGCTGACATCCCCCACCCACAG | CTC | chr12 | 21589939 | 21589960 | 21589956 | 21589961 | + |
| SEQ ID NO 22899 | CTGACATCCCCCACCCACAGCT | CTG | chr12 | 21589941 | 21589962 | 21589958 | 21589963 | + |
| SEQ ID NO 22900 | ACATCCCCCACCCACAGCTGAG | CTG | chr12 | 21589944 | 21589965 | 21589961 | 21589966 | + |
| SEQ ID NO 22901 | AGTGCTACTGCTGGCTGCTGTC | CTG | chr12 | 21589964 | 21589985 | 21589981 | 21589986 | + |
| SEQ ID NO 22902 | CTGCTGGCTGCTGTCACCAGGG | CTA | chr12 | 21589971 | 21589992 | 21589988 | 21589993 | + |
| SEQ ID NO 22903 | CTGGCTGCTGTCACCAGGGATA | CTG | chr12 | 21589974 | 21589995 | 21589991 | 21589996 | + |
| SEQ ID NO 22904 | GCTGCTGTCACCAGGGATAAAG | CTG | chr12 | 21589977 | 21589998 | 21589994 | 21589999 | + |
| SEQ ID NO 22905 | CTGTCACCAGGGATAAAGTGTG | CTG | chr12 | 21589981 | 21590002 | 21589998 | 21590003 | + |
| SEQ ID NO 22906 | TCACCAGGGATAAAGTGTGTCA | CTG | chr12 | 21589984 | 21590005 | 21590001 | 21590006 | + |
| SEQ ID NO 22907 | GAAGTGGACTCCCCCACCCCCA | TTA | chr12 | 21590009 | 21590030 | 21590026 | 21590031 | + |
| SEQ ID NO 22908 | CCCCACCCCCAGTAGCAGGGCT | CTC | chr12 | 21590020 | 21590041 | 21590037 | 21590042 | + |
| SEQ ID NO 22909 | CTACACATTTATAAGCTCCCTA | CTG | chr12 | 21590043 | 21590064 | 21590060 | 21590065 | + |
| SEQ ID NO 22910 | CACATTTATAAGCTCCCTAAGA | CTA | chr12 | 21590046 | 21590067 | 21590063 | 21590068 | + |
| SEQ ID NO 22911 | ATAAGCTCCCTAAGAAAATGCT | TTT | chr12 | 21590053 | 21590074 | 21590070 | 21590075 | + |
| SEQ ID NO 22912 | TAAGCTCCCTAAGAAAATGCTA | TTA | chr12 | 21590054 | 21590075 | 21590071 | 21590076 | + |
| SEQ ID NO 22913 | CCTAAGAAAATGCTACCCCACT | CTC | chr12 | 21590061 | 21590082 | 21590078 | 21590083 | + |
| SEQ ID NO 22914 | AGAAAATGCTACCCCACTTGCA | CTA | chr12 | 21590065 | 21590086 | 21590082 | 21590087 | + |
| SEQ ID NO 22915 | CCCCACTTGCAGCCACCATCTG | CTA | chr12 | 21590076 | 21590097 | 21590093 | 21590098 | + |
| SEQ ID NO 22916 | GCAGCCACCATCTGGGGCTGAA | CTT | chr12 | 21590084 | 21590105 | 21590101 | 21590106 | + |
| SEQ ID NO 22917 | CAGCCACCATCTGGGGCTGAAA | TTG | chr12 | 21590085 | 21590106 | 21590102 | 21590107 | + |
| SEQ ID NO 22918 | GGGCTGAAACACATGCCCACCA | CTG | chr12 | 21590098 | 21590119 | 21590115 | 21590120 | + |
| SEQ ID NO 22919 | AAACACATGCCCACCAGCAACC | CTG | chr12 | 21590104 | 21590125 | 21590121 | 21590126 | + |

Figure 48 (Cont'd)

| SEQ ID NO 22920 | ATAGCTGCTGCCACTGAAAGCA | TTT | chr12 | 21590131 | 21590152 | 21590148 | 21590153 | + |
| SEQ ID NO 22921 | TAGCTGCTGCCACTGAAAGCAA | TTA | chr12 | 21590132 | 21590153 | 21590149 | 21590154 | + |
| SEQ ID NO 22922 | CTGCCACTGAAAGCAACACACC | CTG | chr12 | 21590138 | 21590159 | 21590155 | 21590160 | + |
| SEQ ID NO 22923 | CCACTGAAAGCAACACACCCCG | CTG | chr12 | 21590141 | 21590162 | 21590158 | 21590163 | + |
| SEQ ID NO 22924 | AAAGCAACACACCCCGCACCCC | CTG | chr12 | 21590147 | 21590168 | 21590164 | 21590169 | + |
| SEQ ID NO 22925 | CAAGAGCAGGGCAACAATGCAG | CTT | chr12 | 21590171 | 21590192 | 21590188 | 21590193 | + |
| SEQ ID NO 22926 | AAGAGCAGGGCAACAATGCAGT | TTC | chr12 | 21590172 | 21590193 | 21590189 | 21590194 | + |
| SEQ ID NO 22927 | CTAATTCACTCAGGCATTCTGC | CTG | chr12 | 21590199 | 21590220 | 21590216 | 21590221 | + |
| SEQ ID NO 22928 | ATTCACTCAGGCATTCTGCTGG | CTA | chr12 | 21590202 | 21590223 | 21590219 | 21590224 | + |
| SEQ ID NO 22929 | ACTCAGGCATTCTGCTGGGGGC | TTC | chr12 | 21590206 | 21590227 | 21590223 | 21590228 | + |
| SEQ ID NO 22930 | AGGCATTCTGCTGGGGGCCTGA | CTC | chr12 | 21590210 | 21590231 | 21590227 | 21590232 | + |
| SEQ ID NO 22931 | TGCTGGGGGCCTGAGGATCACT | TTC | chr12 | 21590218 | 21590239 | 21590235 | 21590240 | + |
| SEQ ID NO 22932 | CTGGGGGCCTGAGGATCACTCC | CTG | chr12 | 21590220 | 21590241 | 21590237 | 21590242 | + |
| SEQ ID NO 22933 | GGGGCCTGAGGATCACTCCACT | CTG | chr12 | 21590223 | 21590244 | 21590240 | 21590245 | + |
| SEQ ID NO 22934 | AGGATCACTCCACTCCAGCCTA | CTG | chr12 | 21590231 | 21590252 | 21590248 | 21590253 | + |
| SEQ ID NO 22935 | CACTCCAGCCTATGATAGCCGG | CTC | chr12 | 21590241 | 21590262 | 21590258 | 21590263 | + |
| SEQ ID NO 22936 | CAGCCTATGATAGCCGGTGTCC | CTC | chr12 | 21590246 | 21590267 | 21590263 | 21590268 | + |
| SEQ ID NO 22937 | TGATAGCCGGTGTCCACACACA | CTA | chr12 | 21590253 | 21590274 | 21590270 | 21590275 | + |
| SEQ ID NO 22938 | AGTGGCCTGAGGTCAGGAACAC | CTG | chr12 | 21590281 | 21590302 | 21590298 | 21590303 | + |
| SEQ ID NO 22939 | AGGTCAGGAACACCCAGCCTGG | CTG | chr12 | 21590290 | 21590311 | 21590307 | 21590312 | + |
| SEQ ID NO 22940 | GCTTTGCCTTCCTCAATGCCTA | CTG | chr12 | 21590311 | 21590332 | 21590328 | 21590333 | + |
| SEQ ID NO 22941 | TGCCTTCCTCAATGCCTAAGCA | CTT | chr12 | 21590315 | 21590336 | 21590332 | 21590337 | + |
| SEQ ID NO 22942 | GCCTTCCTCAATGCCTAAGCAA | TTT | chr12 | 21590316 | 21590337 | 21590333 | 21590338 | + |
| SEQ ID NO 22943 | CCTTCCTCAATGCCTAAGCAAG | TTG | chr12 | 21590317 | 21590338 | 21590334 | 21590339 | + |
| SEQ ID NO 22944 | CCTCAATGCCTAAGCAAGTTGT | CTT | chr12 | 21590321 | 21590342 | 21590338 | 21590343 | + |
| SEQ ID NO 22945 | CTCAATGCCTAAGCAAGTTGTC | TTC | chr12 | 21590322 | 21590343 | 21590339 | 21590344 | + |
| SEQ ID NO 22946 | AATGCCTAAGCAAGTTGTCTGG | CTC | chr12 | 21590325 | 21590346 | 21590342 | 21590347 | + |
| SEQ ID NO 22947 | AGCAAGTTGTCTGGGAACCCAG | CTA | chr12 | 21590333 | 21590354 | 21590350 | 21590355 | + |
| SEQ ID NO 22948 | TCTGGGAACCCAGAGACAGCCT | TTG | chr12 | 21590342 | 21590363 | 21590359 | 21590364 | + |
| SEQ ID NO 22949 | GGAACCCAGAGACAGCCTTGTG | CTG | chr12 | 21590346 | 21590367 | 21590363 | 21590368 | + |
| SEQ ID NO 22950 | GTGCCATCCACCATGACTGGTA | CTT | chr12 | 21590365 | 21590386 | 21590382 | 21590387 | + |
| SEQ ID NO 22951 | TGCCATCCACCATGACTGGTAC | TTG | chr12 | 21590366 | 21590387 | 21590383 | 21590388 | + |
| SEQ ID NO 22952 | GTACCTAAGCAACCCTCCCAGA | CTG | chr12 | 21590384 | 21590405 | 21590401 | 21590406 | + |
| SEQ ID NO 22953 | AGCAACCCTCCCAGAAGCCTGA | CTA | chr12 | 21590391 | 21590412 | 21590408 | 21590413 | + |
| SEQ ID NO 22954 | CCAGAAGCCTGATGATGGGCCT | CTC | chr12 | 21590401 | 21590422 | 21590418 | 21590423 | + |
| SEQ ID NO 22955 | ATGATGGGCCTACCCAATCTGC | CTG | chr12 | 21590412 | 21590433 | 21590429 | 21590434 | + |
| SEQ ID NO 22956 | CCCAATCTGCCACTGCCATCAC | CTA | chr12 | 21590424 | 21590445 | 21590441 | 21590446 | + |
| SEQ ID NO 22957 | CCACTGCCATCACAACTGGCAC | CTG | chr12 | 21590433 | 21590454 | 21590450 | 21590455 | + |
| SEQ ID NO 22958 | CCATCACAACTGGCACCTCCTG | CTG | chr12 | 21590439 | 21590460 | 21590456 | 21590461 | + |
| SEQ ID NO 22959 | GCACCTCCTGCATGTGCCACCT | CTG | chr12 | 21590451 | 21590472 | 21590468 | 21590473 | + |
| SEQ ID NO 22960 | CTGCATGTGCCACCTGTGGGTC | CTC | chr12 | 21590458 | 21590479 | 21590475 | 21590480 | + |
| SEQ ID NO 22961 | CATGTGCCACCTGTGGGTCTGA | CTG | chr12 | 21590461 | 21590482 | 21590478 | 21590483 | + |
| SEQ ID NO 22962 | TGGGTCTGAAGACTGGCTCATT | CTG | chr12 | 21590474 | 21590495 | 21590491 | 21590496 | + |
| SEQ ID NO 22963 | AAGACTGGCTCATTCAGCCCTT | CTG | chr12 | 21590482 | 21590503 | 21590499 | 21590504 | + |
| SEQ ID NO 22964 | GCTCATTCAGCCCTTGCAGCCA | CTG | chr12 | 21590489 | 21590510 | 21590506 | 21590511 | + |
| SEQ ID NO 22965 | ATTCAGCCCTTGCAGCCACCAC | CTC | chr12 | 21590493 | 21590514 | 21590510 | 21590515 | + |
| SEQ ID NO 22966 | AGCCCTTGCAGCCACCACCAAC | TTC | chr12 | 21590497 | 21590518 | 21590514 | 21590519 | + |
| SEQ ID NO 22967 | GCAGCCACCACCAACACCAGTG | CTT | chr12 | 21590504 | 21590525 | 21590521 | 21590526 | + |
| SEQ ID NO 22968 | CAGCCACCACCAACACCAGTGC | TTG | chr12 | 21590505 | 21590526 | 21590522 | 21590527 | + |
| SEQ ID NO 22969 | CTTGGGAGCCAGAGGGTTGTCC | CTG | chr12 | 21590533 | 21590554 | 21590550 | 21590555 | + |
| SEQ ID NO 22970 | GGGAGCCAGAGGGTTGTCCTGC | CTT | chr12 | 21590536 | 21590557 | 21590553 | 21590558 | + |
| SEQ ID NO 22971 | GGAGCCAGAGGGTTGTCCTGCA | TTG | chr12 | 21590537 | 21590558 | 21590554 | 21590559 | + |
| SEQ ID NO 22972 | TCCTGCAGTTGCTACAGCCATC | TTG | chr12 | 21590552 | 21590573 | 21590569 | 21590574 | + |
| SEQ ID NO 22973 | CAGTTGCTACAGCCATCACCCA | CTG | chr12 | 21590557 | 21590578 | 21590574 | 21590579 | + |
| SEQ ID NO 22974 | CTACAGCCATCACCCACACCAC | TTG | chr12 | 21590563 | 21590584 | 21590580 | 21590585 | + |
| SEQ ID NO 22975 | CAGCCATCACCCACACCACACC | CTA | chr12 | 21590566 | 21590587 | 21590583 | 21590588 | + |
| SEQ ID NO 22976 | TCCAGAAGCCTGAGGACCCACA | CTG | chr12 | 21590593 | 21590614 | 21590610 | 21590615 | + |
| SEQ ID NO 22977 | AGGACCCACACACCAGCCCAGT | CTG | chr12 | 21590605 | 21590626 | 21590622 | 21590627 | + |

Figure 48 (Cont'd)

| SEQ ID NO | Sequence | Codon | Chr | Pos1 | Pos2 | Pos3 | Pos4 | Strand |
|---|---|---|---|---|---|---|---|---|
| SEQ ID NO 22978 | CTATGGCCACTACTGACACCCA | CTA | chr12 | 21590630 | 21590651 | 21590647 | 21590652 | + |
| SEQ ID NO 22979 | TGGCCACTACTGACACCCAAGC | CTA | chr12 | 21590633 | 21590654 | 21590650 | 21590655 | + |
| SEQ ID NO 22980 | CTGACACCCAAGCAAACTGCCT | CTA | chr12 | 21590642 | 21590663 | 21590659 | 21590664 | + |
| SEQ ID NO 22981 | ACACCCAAGCAAACTGCCTGAA | CTG | chr12 | 21590645 | 21590666 | 21590662 | 21590667 | + |
| SEQ ID NO 22982 | CCTGAAGGCAAAGAATCAACC | CTG | chr12 | 21590661 | 21590682 | 21590678 | 21590683 | + |
| SEQ ID NO 22983 | AAGGCCAAAGAATCAACCCAAC | CTG | chr12 | 21590665 | 21590686 | 21590682 | 21590687 | + |
| SEQ ID NO 22984 | GACTCATTACCATCAGTGCCAA | CTA | chr12 | 21590689 | 21590710 | 21590706 | 21590711 | + |
| SEQ ID NO 22985 | ATTACCATCAGTGCCAATGTAC | CTC | chr12 | 21590694 | 21590715 | 21590711 | 21590716 | + |
| SEQ ID NO 22986 | CCATCAGTGCCAATGTACACAG | TTA | chr12 | 21590698 | 21590719 | 21590715 | 21590720 | + |
| SEQ ID NO 22987 | GGCCACCACCACCACTGGGGC | CTA | chr12 | 21590747 | 21590768 | 21590764 | 21590769 | + |
| SEQ ID NO 22988 | GGGCCAAGGACTGGCCCACTTG | CTG | chr12 | 21590765 | 21590786 | 21590782 | 21590787 | + |
| SEQ ID NO 22989 | GCCCACTTGATATTCTTGTCTC | CTG | chr12 | 21590778 | 21590799 | 21590795 | 21590800 | + |
| SEQ ID NO 22990 | GATATTCTTGTCTCCAGCACAA | CTT | chr12 | 21590786 | 21590807 | 21590803 | 21590808 | + |
| SEQ ID NO 22991 | ATATTCTTGTCTCCAGCACAAC | TTG | chr12 | 21590787 | 21590808 | 21590804 | 21590809 | + |
| SEQ ID NO 22992 | TTGTCTCCAGCACAACCTCATC | TTC | chr12 | 21590793 | 21590814 | 21590810 | 21590815 | + |
| SEQ ID NO 22993 | GTCTCCAGCACAACCTCATCAC | CTT | chr12 | 21590795 | 21590816 | 21590812 | 21590817 | + |
| SEQ ID NO 22994 | TCTCCAGCACAACCTCATCACC | TTG | chr12 | 21590796 | 21590817 | 21590813 | 21590818 | + |
| SEQ ID NO 22995 | CAGCACAACCTCATCACCACCT | CTC | chr12 | 21590800 | 21590821 | 21590817 | 21590822 | + |
| SEQ ID NO 22996 | ATCACCACCTTCACTAACAAAT | CTC | chr12 | 21590812 | 21590833 | 21590829 | 21590834 | + |
| SEQ ID NO 22997 | CACTAACAAATGCACCCTAAGC | CTT | chr12 | 21590823 | 21590844 | 21590840 | 21590845 | + |
| SEQ ID NO 22998 | ACTAACAAATGCACCCTAAGCC | TTC | chr12 | 21590824 | 21590845 | 21590841 | 21590846 | + |
| SEQ ID NO 22999 | ACAAATGCACCCTAAGCCACTG | CTA | chr12 | 21590828 | 21590849 | 21590845 | 21590850 | + |
| SEQ ID NO 23000 | AGCCACTGAAAAAATCACAGAC | CTA | chr12 | 21590842 | 21590863 | 21590859 | 21590864 | + |
| SEQ ID NO 23001 | AAAAAATCACAGACACTGATGA | CTG | chr12 | 21590850 | 21590871 | 21590867 | 21590872 | + |
| SEQ ID NO 23002 | ATGATACTGTTGGCAGCTGAAA | CTG | chr12 | 21590868 | 21590889 | 21590885 | 21590890 | + |
| SEQ ID NO 23003 | TTGGCAGCTGAAAAAAAATAAT | CTG | chr12 | 21590877 | 21590898 | 21590894 | 21590899 | + |
| SEQ ID NO 23004 | GCAGCTGAAAAAAAATAATATG | TTG | chr12 | 21590880 | 21590901 | 21590897 | 21590902 | + |
| SEQ ID NO 23005 | AAAAAAAATAATATGAAGACTA | CTG | chr12 | 21590887 | 21590908 | 21590904 | 21590909 | + |
| SEQ ID NO 23006 | TGCTGCTGTATGCACCTAGAAA | CTA | chr12 | 21590909 | 21590930 | 21590926 | 21590931 | + |
| SEQ ID NO 23007 | CTGTATGCACCTAGAAATCAAA | CTG | chr12 | 21590914 | 21590935 | 21590931 | 21590936 | + |
| SEQ ID NO 23008 | TATGCACCTAGAAATCAAAATC | CTG | chr12 | 21590917 | 21590938 | 21590934 | 21590939 | + |
| SEQ ID NO 23009 | GAAATCAAAATCAAAGTGCCCT | CTA | chr12 | 21590927 | 21590948 | 21590944 | 21590949 | + |
| SEQ ID NO 23010 | CTCAATCAACACCAAGATACAT | CTA | chr12 | 21590950 | 21590971 | 21590967 | 21590972 | + |
| SEQ ID NO 23011 | AATCAACACCAAGATACATCTT | CTC | chr12 | 21590953 | 21590974 | 21590970 | 21590975 | + |
| SEQ ID NO 23012 | CAGAAAAAGTCTTCCCCTACA | CTT | chr12 | 21590975 | 21590996 | 21590992 | 21590997 | + |
| SEQ ID NO 23013 | AGAAAAAGTCTTCCCCTACAA | TTC | chr12 | 21590976 | 21590997 | 21590993 | 21590998 | + |
| SEQ ID NO 23014 | CCCCTACAAAAACAAATTTACA | CTT | chr12 | 21590989 | 21591010 | 21591006 | 21591011 | + |
| SEQ ID NO 23015 | CCCTACAAAAACAAATTTACAA | TTC | chr12 | 21590990 | 21591011 | 21591007 | 21591012 | + |
| SEQ ID NO 23016 | CAAAAACAAATTTACAAAACTG | CTA | chr12 | 21590995 | 21591016 | 21591012 | 21591017 | + |
| SEQ ID NO 23017 | ACAAAACTGGAAGCAGCAATCA | TTT | chr12 | 21591008 | 21591029 | 21591025 | 21591030 | + |
| SEQ ID NO 23018 | CAAAACTGGAAGCAGCAATCAT | TTA | chr12 | 21591009 | 21591030 | 21591026 | 21591031 | + |
| SEQ ID NO 23019 | GAAGCAGCAATCATTACACCAG | CTG | chr12 | 21591017 | 21591038 | 21591034 | 21591039 | + |
| SEQ ID NO 23020 | CACCAGATGCAGAGATATCAAT | TTA | chr12 | 21591033 | 21591054 | 21591050 | 21591055 | + |
| SEQ ID NO 23021 | CCAAAGGAATTTAATAATTCTT | CTT | chr12 | 21591099 | 21591120 | 21591116 | 21591121 | + |
| SEQ ID NO 23022 | CAAAGGAATTTAATAATTCTTC | TTC | chr12 | 21591100 | 21591121 | 21591117 | 21591122 | + |
| SEQ ID NO 23023 | AATAATTCTTCAGCAACATAAG | TTT | chr12 | 21591111 | 21591132 | 21591128 | 21591133 | + |
| SEQ ID NO 23024 | ATAATTCTTCAGCAACATAAGC | TTA | chr12 | 21591112 | 21591133 | 21591129 | 21591134 | + |
| SEQ ID NO 23025 | TTCAGCAACATAAGCCAGTGGA | TTC | chr12 | 21591119 | 21591140 | 21591136 | 21591141 | + |
| SEQ ID NO 23026 | CAGCAACATAAGCCAGTGGAAA | CTT | chr12 | 21591121 | 21591142 | 21591138 | 21591143 | + |
| SEQ ID NO 23027 | AGCAACATAAGCCAGTGGAAAA | TTC | chr12 | 21591122 | 21591143 | 21591139 | 21591144 | + |
| SEQ ID NO 23028 | ATAAAATTCTGGAAAAAGAAT | TTT | chr12 | 21591155 | 21591176 | 21591172 | 21591177 | + |
| SEQ ID NO 23029 | TAAAATTCTGGAAAAAGAATC | TTA | chr12 | 21591156 | 21591177 | 21591173 | 21591178 | + |
| SEQ ID NO 23030 | TGGAAAAAGAATCCAAAATGT | TTC | chr12 | 21591164 | 21591185 | 21591181 | 21591186 | + |
| SEQ ID NO 23031 | GAAAAAGAATCCAAAATGTTG | CTG | chr12 | 21591166 | 21591187 | 21591183 | 21591188 | + |
| SEQ ID NO 23032 | ATATTAAGGAAGCTCAGTGAGA | TTG | chr12 | 21591188 | 21591209 | 21591205 | 21591210 | + |
| SEQ ID NO 23033 | AGGAAGCTCAGTGAGACACAAG | TTA | chr12 | 21591194 | 21591215 | 21591211 | 21591216 | + |
| SEQ ID NO 23034 | AGTGAGACACAAGAGAACTCAG | CTC | chr12 | 21591203 | 21591224 | 21591220 | 21591225 | + |
| SEQ ID NO 23035 | AGATAAACAATAAAAAGAAATC | CTC | chr12 | 21591223 | 21591244 | 21591240 | 21591245 | + |

Figure 48 (Cont'd)

| SEQ ID NO 23036 | AGGATATGAATGAGAAATTTAC | TTC | chr12 | 21591258 | 21591279 | 21591275 | 21591280 | + |
|---|---|---|---|---|---|---|---|---|
| SEQ ID NO 23037 | ACCCAAGAGATAGATACAACAA | TTT | chr12 | 21591278 | 21591299 | 21591295 | 21591300 | + |
| SEQ ID NO 23038 | CCCAAGAGATAGATACAACAAG | TTA | chr12 | 21591279 | 21591300 | 21591296 | 21591301 | + |
| SEQ ID NO 23039 | TGTAACTGAAGAGTTTATTGAA | TTC | chr12 | 21591321 | 21591342 | 21591338 | 21591343 | + |
| SEQ ID NO 23040 | TAACTGAAGAGTTTATTGAAAG | CTG | chr12 | 21591323 | 21591344 | 21591340 | 21591345 | + |
| SEQ ID NO 23041 | AAGAGTTTATTGAAAGAAATAC | CTG | chr12 | 21591329 | 21591350 | 21591346 | 21591351 | + |
| SEQ ID NO 23042 | ATTGAAAGAAATACAAAATACA | TTT | chr12 | 21591337 | 21591358 | 21591354 | 21591359 | + |
| SEQ ID NO 23043 | TTGAAAGAAATACAAAATACAT | TTA | chr12 | 21591338 | 21591359 | 21591355 | 21591360 | + |
| SEQ ID NO 23044 | AAAGAAATACAAAATACATTCA | TTG | chr12 | 21591341 | 21591362 | 21591358 | 21591363 | + |
| SEQ ID NO 23045 | AAAAACTTCAACAATAGATCAG | TTC | chr12 | 21591362 | 21591383 | 21591379 | 21591384 | + |
| SEQ ID NO 23046 | CAACAATAGATCAGATCAAGCA | CTT | chr12 | 21591370 | 21591391 | 21591387 | 21591392 | + |
| SEQ ID NO 23047 | AACAATAGATCAGATCAAGCAG | TTC | chr12 | 21591371 | 21591392 | 21591388 | 21591393 | + |
| SEQ ID NO 23048 | CAGAACTTGAAGACAGGTCTTT | TTT | chr12 | 21591404 | 21591425 | 21591421 | 21591426 | + |
| SEQ ID NO 23049 | AGAACTTGAAGACAGGTCTTTT | TTC | chr12 | 21591405 | 21591426 | 21591422 | 21591427 | + |
| SEQ ID NO 23050 | GAAGACAGGTCTTTTAAAATTA | CTT | chr12 | 21591412 | 21591433 | 21591429 | 21591434 | + |
| SEQ ID NO 23051 | AAGACAGGTCTTTTAAAATTAG | TTG | chr12 | 21591413 | 21591434 | 21591430 | 21591435 | + |
| SEQ ID NO 23052 | TTAAAATTAGCTGGTCAAATGA | CTT | chr12 | 21591425 | 21591446 | 21591442 | 21591447 | + |
| SEQ ID NO 23053 | TAAAATTAGCTGGTCAAATGAT | TTT | chr12 | 21591426 | 21591447 | 21591443 | 21591448 | + |
| SEQ ID NO 23054 | AAAATTAGCTGGTCAAATGATA | TTT | chr12 | 21591427 | 21591448 | 21591444 | 21591449 | + |
| SEQ ID NO 23055 | AAATTAGCTGGTCAAATGATAG | TTA | chr12 | 21591428 | 21591449 | 21591445 | 21591450 | + |
| SEQ ID NO 23056 | GCTGGTCAAATGATAGAAAGGA | TTA | chr12 | 21591434 | 21591455 | 21591451 | 21591456 | + |
| SEQ ID NO 23057 | GTCAAATGATAGAAAGGAAAAA | CTG | chr12 | 21591438 | 21591459 | 21591455 | 21591460 | + |
| SEQ ID NO 23058 | TAAAGTGAACAAATATTCAAAT | CTA | chr12 | 21591499 | 21591520 | 21591516 | 21591521 | + |
| SEQ ID NO 23059 | AAATTTGCAGTTTCCCAGAAGG | TTC | chr12 | 21591517 | 21591538 | 21591534 | 21591539 | + |
| SEQ ID NO 23060 | GCAGTTTCCCAGAAGGTAAAGA | TTT | chr12 | 21591523 | 21591544 | 21591540 | 21591545 | + |
| SEQ ID NO 23061 | CAGTTTCCCAGAAGGTAAAGAG | TTG | chr12 | 21591524 | 21591545 | 21591541 | 21591546 | + |
| SEQ ID NO 23062 | CCCAGAAGGTAAAGAGAACATG | TTT | chr12 | 21591530 | 21591551 | 21591547 | 21591552 | + |
| SEQ ID NO 23063 | CCAGAAGGTAAAGAGAACATGA | TTC | chr12 | 21591531 | 21591552 | 21591548 | 21591553 | + |
| SEQ ID NO 23064 | CGTAACAACACAATAGCTGAAA | CTA | chr12 | 21591570 | 21591591 | 21591587 | 21591592 | + |
| SEQ ID NO 23065 | AAAACTTGTCAAGTCTAGCAAG | CTG | chr12 | 21591589 | 21591610 | 21591606 | 21591611 | + |
| SEQ ID NO 23066 | GTCAAGTCTAGCAAGAAATGTA | CTT | chr12 | 21591596 | 21591617 | 21591613 | 21591618 | + |
| SEQ ID NO 23067 | TCAAGTCTAGCAAGAAATGTAG | TTG | chr12 | 21591597 | 21591618 | 21591614 | 21591619 | + |
| SEQ ID NO 23068 | GCAAGAAATGTAGACATCCAGA | CTA | chr12 | 21591606 | 21591627 | 21591623 | 21591628 | + |
| SEQ ID NO 23069 | CCAAATAATATAATGCAAAAAG | TTC | chr12 | 21591648 | 21591669 | 21591665 | 21591670 | + |
| SEQ ID NO 23070 | TTCTCCACAGCACATTATAGTC | CTC | chr12 | 21591673 | 21591694 | 21591690 | 21591695 | + |
| SEQ ID NO 23071 | CTCCACAGCACATTATAGTCAA | CTT | chr12 | 21591675 | 21591696 | 21591692 | 21591697 | + |
| SEQ ID NO 23072 | TCCACAGCACATTATAGTCAAA | TTC | chr12 | 21591676 | 21591697 | 21591693 | 21591698 | + |
| SEQ ID NO 23073 | CACAGCACATTATAGTCAAACT | CTC | chr12 | 21591678 | 21591699 | 21591695 | 21591700 | + |
| SEQ ID NO 23074 | TAGTCAAACTGTCAAAAGCCAA | TTA | chr12 | 21591690 | 21591711 | 21591707 | 21591712 | + |
| SEQ ID NO 23075 | TCAAAAGCCAAAGAGTAAGAAC | CTG | chr12 | 21591701 | 21591722 | 21591718 | 21591723 | + |
| SEQ ID NO 23076 | TAAAACAGCAAGCAAATGTCT | CTC | chr12 | 21591725 | 21591746 | 21591742 | 21591747 | + |
| SEQ ID NO 23077 | AAACAGCAAGCAAATGTCTAG | CTA | chr12 | 21591727 | 21591748 | 21591744 | 21591749 | + |
| SEQ ID NO 23078 | GTCACTTATAAGGGAACTTCCA | CTA | chr12 | 21591748 | 21591769 | 21591765 | 21591770 | + |
| SEQ ID NO 23079 | ATAAGGGAACTTCCACAAGATT | CTT | chr12 | 21591755 | 21591776 | 21591772 | 21591777 | + |
| SEQ ID NO 23080 | TAAGGGAACTTCCACAAGATTA | TTA | chr12 | 21591756 | 21591777 | 21591773 | 21591778 | + |
| SEQ ID NO 23081 | CCACAAGATTAACAGATTAACA | CTT | chr12 | 21591767 | 21591788 | 21591784 | 21591789 | + |
| SEQ ID NO 23082 | CACAAGATTAACAGATTAACAG | TTC | chr12 | 21591768 | 21591789 | 21591785 | 21591790 | + |
| SEQ ID NO 23083 | ACAGATTAACAGCAGATTTCTC | TTA | chr12 | 21591778 | 21591799 | 21591795 | 21591800 | + |
| SEQ ID NO 23084 | ACAGCAGATTTCTCAGCAGAAA | TTA | chr12 | 21591786 | 21591807 | 21591803 | 21591808 | + |
| SEQ ID NO 23085 | CTCAGCAGAAACCTCACAGGCC | TTT | chr12 | 21591797 | 21591818 | 21591814 | 21591819 | + |
| SEQ ID NO 23086 | TCAGCAGAAACCTCACAGGCCA | TTC | chr12 | 21591798 | 21591819 | 21591815 | 21591820 | + |
| SEQ ID NO 23087 | AGCAGAAACCTCACAGGCCAGG | CTC | chr12 | 21591800 | 21591821 | 21591817 | 21591822 | + |
| SEQ ID NO 23088 | ACAGGCCAGGAGAAGATGGGAT | CTC | chr12 | 21591812 | 21591833 | 21591829 | 21591834 | + |
| SEQ ID NO 23089 | AAAATAGTGAAAGAAAAAAATG | TTC | chr12 | 21591843 | 21591864 | 21591860 | 21591865 | + |
| SEQ ID NO 23090 | TACCCAGCAACATTGTTCTTCA | TTA | chr12 | 21591880 | 21591901 | 21591897 | 21591902 | + |
| SEQ ID NO 23091 | TTCTTCAAAAATGAAGGATAAA | TTG | chr12 | 21591895 | 21591916 | 21591912 | 21591917 | + |
| SEQ ID NO 23092 | TTCAAAAATGAAGGATAAATAA | TTC | chr12 | 21591898 | 21591919 | 21591915 | 21591920 | + |
| SEQ ID NO 23093 | CAAAAATGAAGGATAAATAAAA | CTT | chr12 | 21591900 | 21591921 | 21591917 | 21591922 | + |

Figure 48 (Cont'd)

| SEQ ID NO 23094 | AAAAATGAAGGATAAATAAAAT | TTC | chr12 | 21591901 | 21591922 | 21591918 | 21591923 | + |
| SEQ ID NO 23095 | TTCTGGGCAAGAAAAATTTGAA | CTT | chr12 | 21591926 | 21591947 | 21591943 | 21591948 | + |
| SEQ ID NO 23096 | TCTGGGCAAGAAAAATTTGAAG | TTT | chr12 | 21591927 | 21591948 | 21591944 | 21591949 | + |
| SEQ ID NO 23097 | CTGGGCAAGAAAAATTTGAAGG | TTT | chr12 | 21591928 | 21591949 | 21591945 | 21591950 | + |
| SEQ ID NO 23098 | TGGGCAAGAAAAATTTGAAGGA | TTC | chr12 | 21591929 | 21591950 | 21591946 | 21591951 | + |
| SEQ ID NO 23099 | GGCAAGAAAAATTTGAAGGAAT | CTG | chr12 | 21591931 | 21591952 | 21591948 | 21591953 | + |
| SEQ ID NO 23100 | GAAGGAATTCACTATCACTAGA | TTT | chr12 | 21591945 | 21591966 | 21591962 | 21591967 | + |
| SEQ ID NO 23101 | AAGGAATTCACTATCACTAGAC | TTG | chr12 | 21591946 | 21591967 | 21591963 | 21591968 | + |
| SEQ ID NO 23102 | ACTATCACTAGACTGGCTTTAC | TTC | chr12 | 21591955 | 21591976 | 21591972 | 21591977 | + |
| SEQ ID NO 23103 | TCACTAGACTGGCTTTACAAGA | CTA | chr12 | 21591959 | 21591980 | 21591976 | 21591981 | + |
| SEQ ID NO 23104 | GACTGGCTTTACAAGAAATATT | CTA | chr12 | 21591965 | 21591986 | 21591982 | 21591987 | + |
| SEQ ID NO 23105 | GCTTTACAAGAAATATTTAAGG | CTG | chr12 | 21591970 | 21591991 | 21591987 | 21591992 | + |
| SEQ ID NO 23106 | TACAAGAAATATTTAAGGGAGT | CTT | chr12 | 21591974 | 21591995 | 21591991 | 21591996 | + |
| SEQ ID NO 23107 | ACAAGAAATATTTAAGGGAGTC | TTT | chr12 | 21591975 | 21591996 | 21591992 | 21591997 | + |
| SEQ ID NO 23108 | CAAGAAATATTTAAGGGAGTCC | TTA | chr12 | 21591976 | 21591997 | 21591993 | 21591998 | + |
| SEQ ID NO 23109 | AAGGGAGTCCTACACATGAAAG | TTT | chr12 | 21591988 | 21592009 | 21592005 | 21592010 | + |
| SEQ ID NO 23110 | AGGGAGTCCTACACATGAAAGT | TTA | chr12 | 21591989 | 21592010 | 21592006 | 21592011 | + |
| SEQ ID NO 23111 | CACATGAAAGTGACAGGACACT | CTA | chr12 | 21592000 | 21592021 | 21592017 | 21592022 | + |
| SEQ ID NO 23112 | CCATTATGAAGCACACAAAGG | CTG | chr12 | 21592023 | 21592044 | 21592040 | 21592045 | + |
| SEQ ID NO 23113 | TGAAGACACACAAAGGTATACA | TTA | chr12 | 21592029 | 21592050 | 21592046 | 21592051 | + |
| SEQ ID NO 23114 | ACTGGTAGAGCAAAACACAAAT | CTA | chr12 | 21592055 | 21592076 | 21592072 | 21592077 | + |
| SEQ ID NO 23115 | GTAGAGCAAAACACAAATAAAG | CTG | chr12 | 21592059 | 21592080 | 21592076 | 21592081 | + |
| SEQ ID NO 23116 | AAACGTTACCACTACAGAAAAT | CTC | chr12 | 21592095 | 21592116 | 21592112 | 21592117 | + |
| SEQ ID NO 23117 | CCACTACAGAAAATCACCAAAC | TTA | chr12 | 21592103 | 21592124 | 21592120 | 21592125 | + |
| SEQ ID NO 23118 | CAGAAAATCACCAAACCACAAT | CTA | chr12 | 21592109 | 21592130 | 21592126 | 21592131 | + |
| SEQ ID NO 23119 | AAAAAAAAACAAAACAACCAGG | CTA | chr12 | 21592232 | 21592253 | 21592249 | 21592254 | + |
| SEQ ID NO 23120 | ACAAATGGCAGGAATAAGCTC | TTA | chr12 | 21592263 | 21592284 | 21592280 | 21592285 | + |
| SEQ ID NO 23121 | TCACATGTCAATAATAGCCTTG | CTC | chr12 | 21592285 | 21592306 | 21592302 | 21592307 | + |
| SEQ ID NO 23122 | ACATGTCAATAATAGCCTTGCA | CTC | chr12 | 21592287 | 21592308 | 21592304 | 21592309 | + |
| SEQ ID NO 23123 | GCATGTAAATGGATTAAATTGT | CTT | chr12 | 21592306 | 21592327 | 21592323 | 21592328 | + |
| SEQ ID NO 23124 | CATGTAAATGGATTAAATTGTT | TTG | chr12 | 21592307 | 21592328 | 21592324 | 21592329 | + |
| SEQ ID NO 23125 | AATTGTTACTTGAAAGATATAG | TTA | chr12 | 21592322 | 21592343 | 21592339 | 21592344 | + |
| SEQ ID NO 23126 | TTACTTGAAAGATATAGACTGG | TTG | chr12 | 21592327 | 21592348 | 21592344 | 21592349 | + |
| SEQ ID NO 23127 | CTTGAAAGATATAGACTGGCTA | TTA | chr12 | 21592330 | 21592351 | 21592347 | 21592352 | + |
| SEQ ID NO 23128 | GAAAGATATAGACTGGCTAAAT | CTT | chr12 | 21592333 | 21592354 | 21592350 | 21592355 | + |
| SEQ ID NO 23129 | AAAGATATAGACTGGCTAAATA | TTG | chr12 | 21592334 | 21592355 | 21592351 | 21592356 | + |
| SEQ ID NO 23130 | GCTAAATAGATTTAAAACAAAA | CTG | chr12 | 21592348 | 21592369 | 21592365 | 21592370 | + |
| SEQ ID NO 23131 | AATAGATTTAAAACAAAAATAT | CTA | chr12 | 21592352 | 21592373 | 21592369 | 21592374 | + |
| SEQ ID NO 23132 | AAAACAAAAATATGACCCAGTT | TTT | chr12 | 21592361 | 21592382 | 21592378 | 21592383 | + |
| SEQ ID NO 23133 | AAACAAAAATATGACCCAGTTG | TTA | chr12 | 21592362 | 21592383 | 21592379 | 21592384 | + |
| SEQ ID NO 23134 | TAAGCTGCCTATAAGAAACTTA | TTG | chr12 | 21592384 | 21592405 | 21592401 | 21592406 | + |
| SEQ ID NO 23135 | CCTATAAGAAACTTATCTCACT | CTG | chr12 | 21592391 | 21592412 | 21592408 | 21592413 | + |
| SEQ ID NO 23136 | TAAGAAACTTATCTCACTTGTA | CTA | chr12 | 21592395 | 21592416 | 21592412 | 21592417 | + |
| SEQ ID NO 23137 | ATCTCACTTGTAAAGATAAATA | CTT | chr12 | 21592405 | 21592426 | 21592422 | 21592427 | + |
| SEQ ID NO 23138 | TCTCACTTGTAAAGATAAATAT | TTA | chr12 | 21592406 | 21592427 | 21592423 | 21592428 | + |
| SEQ ID NO 23139 | ACTTGTAAAGATAAATATAGAC | CTC | chr12 | 21592410 | 21592431 | 21592427 | 21592432 | + |
| SEQ ID NO 23140 | GTAAAGATAAATATAGACTGAA | CTT | chr12 | 21592414 | 21592435 | 21592431 | 21592436 | + |
| SEQ ID NO 23141 | TAAAGATAAATATAGACTGAAA | TTG | chr12 | 21592415 | 21592436 | 21592432 | 21592437 | + |
| SEQ ID NO 23142 | AAAGTAAAAGATGAAAGATCT | CTG | chr12 | 21592434 | 21592455 | 21592451 | 21592456 | + |
| SEQ ID NO 23143 | CCATACAAAGAGAAACCAAAAA | CTT | chr12 | 21592457 | 21592478 | 21592474 | 21592479 | + |
| SEQ ID NO 23144 | CATACAAAGAGAAACCAAAAAT | TTC | chr12 | 21592458 | 21592479 | 21592475 | 21592480 | + |
| SEQ ID NO 23145 | TACCTATAACAGATAAAATTGA | TTA | chr12 | 21592495 | 21592516 | 21592512 | 21592517 | + |
| SEQ ID NO 23146 | TAACAGATAAAATTGACTTTAA | CTA | chr12 | 21592501 | 21592522 | 21592518 | 21592523 | + |
| SEQ ID NO 23147 | ACTTTAAATAAAAAACACTAAG | TTG | chr12 | 21592516 | 21592537 | 21592533 | 21592538 | + |
| SEQ ID NO 23148 | TAAATAAAAAACACTAAGAGAC | CTT | chr12 | 21592520 | 21592541 | 21592537 | 21592542 | + |
| SEQ ID NO 23149 | AAATAAAAAACACTAAGAGACA | TTT | chr12 | 21592521 | 21592542 | 21592538 | 21592543 | + |
| SEQ ID NO 23150 | AATAAAAAACACTAAGAGACAA | TTA | chr12 | 21592522 | 21592543 | 21592539 | 21592544 | + |
| SEQ ID NO 23151 | AGAGACAAAAGTCATTACATAA | CTA | chr12 | 21592536 | 21592557 | 21592553 | 21592558 | + |

Figure 48 (Cont'd)

| SEQ ID NO 23152 | CATAATGATAAAAGGAACAATT | TTA | chr12 | 21592553 | 21592574 | 21592570 | 21592575 | + |
| SEQ ID NO 23153 | AGCAAGAGTATATAACAATTCT | TTC | chr12 | 21592576 | 21592597 | 21592593 | 21592598 | + |
| SEQ ID NO 23154 | TAAACATTCACACTCAACACCA | TTC | chr12 | 21592597 | 21592618 | 21592614 | 21592619 | + |
| SEQ ID NO 23155 | AACATTCACACTCAACACCAGA | CTA | chr12 | 21592599 | 21592620 | 21592616 | 21592621 | + |
| SEQ ID NO 23156 | ACACTCAACACCAGAGCATCCA | TTC | chr12 | 21592606 | 21592627 | 21592623 | 21592628 | + |
| SEQ ID NO 23157 | AACACCAGAGCATCCAGATATG | CTC | chr12 | 21592612 | 21592633 | 21592629 | 21592634 | + |
| SEQ ID NO 23158 | TTAGATATAAAGGGTGAAATAG | TTA | chr12 | 21592648 | 21592669 | 21592665 | 21592670 | + |
| SEQ ID NO 23159 | GATATAAAGGGTGAAATAGAAT | TTA | chr12 | 21592651 | 21592672 | 21592668 | 21592673 | + |
| SEQ ID NO 23160 | GGGATTTCAACATTCTAATCTC | TTG | chr12 | 21592691 | 21592712 | 21592708 | 21592713 | + |
| SEQ ID NO 23161 | CAACATTCTAATCTCAGCATCA | TTT | chr12 | 21592698 | 21592719 | 21592715 | 21592720 | + |
| SEQ ID NO 23162 | AACATTCTAATCTCAGCATCAG | TTC | chr12 | 21592699 | 21592720 | 21592716 | 21592721 | + |
| SEQ ID NO 23163 | TAATCTCAGCATCAGATAGATC | TTC | chr12 | 21592706 | 21592727 | 21592723 | 21592728 | + |
| SEQ ID NO 23164 | ATCTCAGCATCAGATAGATCAT | CTA | chr12 | 21592708 | 21592729 | 21592725 | 21592730 | + |
| SEQ ID NO 23165 | AGCATCAGATAGATCATCTAGA | CTC | chr12 | 21592713 | 21592734 | 21592730 | 21592735 | + |
| SEQ ID NO 23166 | GACAGAAAATTAACAAAGAAAC | CTA | chr12 | 21592733 | 21592754 | 21592750 | 21592755 | + |
| SEQ ID NO 23167 | ACAAAGAAACATTGGATTTAAA | TTA | chr12 | 21592745 | 21592766 | 21592762 | 21592767 | + |
| SEQ ID NO 23168 | GATTTAAACTTGACTTTAGACC | TTG | chr12 | 21592759 | 21592780 | 21592776 | 21592781 | + |
| SEQ ID NO 23169 | AAACTTGACTTTAGACCAAATG | TTT | chr12 | 21592764 | 21592785 | 21592781 | 21592786 | + |
| SEQ ID NO 23170 | AACTTGACTTTAGACCAAATGG | TTA | chr12 | 21592765 | 21592786 | 21592782 | 21592787 | + |
| SEQ ID NO 23171 | GACTTTAGACCAAATGGATCTA | CTT | chr12 | 21592770 | 21592791 | 21592787 | 21592792 | + |
| SEQ ID NO 23172 | ACTTTAGACCAAATGGATCTAA | TTG | chr12 | 21592771 | 21592792 | 21592788 | 21592793 | + |
| SEQ ID NO 23173 | TAGACCAAATGGATCTAACATT | CTT | chr12 | 21592775 | 21592796 | 21592792 | 21592797 | + |
| SEQ ID NO 23174 | AGACCAAATGGATCTAACATTT | TTT | chr12 | 21592776 | 21592797 | 21592793 | 21592798 | + |
| SEQ ID NO 23175 | GACCAAATGGATCTAACATTTA | TTA | chr12 | 21592777 | 21592798 | 21592794 | 21592799 | + |
| SEQ ID NO 23176 | ACATTTACACAATATTTCATCC | CTA | chr12 | 21592792 | 21592813 | 21592809 | 21592814 | + |
| SEQ ID NO 23177 | ACACAATATTTCATCCAACAGC | TTT | chr12 | 21592798 | 21592819 | 21592815 | 21592820 | + |
| SEQ ID NO 23178 | CACAATATTTCATCCAACAGCT | TTA | chr12 | 21592799 | 21592820 | 21592816 | 21592821 | + |
| SEQ ID NO 23179 | CATCCAACAGCTACAGAATATA | TTT | chr12 | 21592809 | 21592830 | 21592826 | 21592831 | + |
| SEQ ID NO 23180 | ATCCAACAGCTACAGAATATAT | TTC | chr12 | 21592810 | 21592831 | 21592827 | 21592832 | + |
| SEQ ID NO 23181 | CAGAATATATTTATCTCATCAG | CTA | chr12 | 21592822 | 21592843 | 21592839 | 21592844 | + |
| SEQ ID NO 23182 | ATCTCATCAGCACATGACGCAT | TTT | chr12 | 21592834 | 21592855 | 21592851 | 21592856 | + |
| SEQ ID NO 23183 | TCTCATCAGCACATGACGCATT | TTA | chr12 | 21592835 | 21592856 | 21592852 | 21592857 | + |
| SEQ ID NO 23184 | ATCAGCACATGACGCATTCCCC | CTC | chr12 | 21592839 | 21592860 | 21592856 | 21592861 | + |
| SEQ ID NO 23185 | CCCAGGATACACCATATGTTAG | TTC | chr12 | 21592858 | 21592879 | 21592875 | 21592880 | + |
| SEQ ID NO 23186 | GAACACAAAAGAAGTCTCAACT | TTA | chr12 | 21592879 | 21592900 | 21592896 | 21592901 | + |
| SEQ ID NO 23187 | AACTAATTTGAAATATTTGAAA | CTC | chr12 | 21592897 | 21592918 | 21592914 | 21592919 | + |
| SEQ ID NO 23188 | ATTTGAAATATTTGAAATCATA | CTA | chr12 | 21592902 | 21592923 | 21592919 | 21592924 | + |
| SEQ ID NO 23189 | GAAATATTTGAAATCATATTAA | TTT | chr12 | 21592906 | 21592927 | 21592923 | 21592928 | + |
| SEQ ID NO 23190 | AAATATTTGAAATCATATTAAG | TTG | chr12 | 21592907 | 21592928 | 21592924 | 21592929 | + |
| SEQ ID NO 23191 | GAAATCATATTAAGCATCTTCT | TTT | chr12 | 21592915 | 21592936 | 21592932 | 21592937 | + |
| SEQ ID NO 23192 | AAATCATATTAAGCATCTTCTC | TTG | chr12 | 21592916 | 21592937 | 21592933 | 21592938 | + |
| SEQ ID NO 23193 | AGCATCTTCTCAGACCACAATG | TTA | chr12 | 21592927 | 21592948 | 21592944 | 21592949 | + |
| SEQ ID NO 23194 | CTCAGACCACAATGGAATAAAA | CTT | chr12 | 21592935 | 21592956 | 21592952 | 21592957 | + |
| SEQ ID NO 23195 | TCAGACCACAATGGAATAAAAC | TTC | chr12 | 21592936 | 21592957 | 21592953 | 21592958 | + |
| SEQ ID NO 23196 | AGACCACAATGGAATAAAACTA | CTC | chr12 | 21592938 | 21592959 | 21592955 | 21592960 | + |
| SEQ ID NO 23197 | GAAATCAATAACAAGAAAAACT | CTA | chr12 | 21592960 | 21592981 | 21592977 | 21592982 | + |
| SEQ ID NO 23198 | TAAAACCTATACAAATACATGG | CTT | chr12 | 21592983 | 21593004 | 21593000 | 21593005 | + |
| SEQ ID NO 23199 | AAAACCTATACAAATACATGGA | TTT | chr12 | 21592984 | 21593005 | 21593001 | 21593006 | + |
| SEQ ID NO 23200 | AAACCTATACAAATACATGGAA | TTA | chr12 | 21592985 | 21593006 | 21593002 | 21593007 | + |
| SEQ ID NO 23201 | TACAAATACATGGAAATTAAAC | CTA | chr12 | 21592992 | 21593013 | 21593009 | 21593014 | + |
| SEQ ID NO 23202 | AACAACATGCTCCTGAATGAAC | TTA | chr12 | 21593011 | 21593032 | 21593028 | 21593033 | + |
| SEQ ID NO 23203 | CTGAATGAACGTTATGTCAAGA | CTC | chr12 | 21593023 | 21593044 | 21593040 | 21593045 | + |
| SEQ ID NO 23204 | AATGAACGTTATGTCAAGAAGA | CTG | chr12 | 21593026 | 21593047 | 21593043 | 21593048 | + |
| SEQ ID NO 23205 | TGTCAAGAAGAAAATTAAGAAG | TTA | chr12 | 21593037 | 21593058 | 21593054 | 21593059 | + |
| SEQ ID NO 23206 | AGAAGGAAATCAAAATTTTTTT | TTA | chr12 | 21593054 | 21593075 | 21593071 | 21593076 | + |
| SEQ ID NO 23207 | TTTGAAACAAATGAAAATTGAA | TTT | chr12 | 21593073 | 21593094 | 21593090 | 21593095 | + |
| SEQ ID NO 23208 | TTGAAACAAATGAAAATTGAAA | TTT | chr12 | 21593074 | 21593095 | 21593091 | 21593096 | + |
| SEQ ID NO 23209 | TGAAACAAATGAAAATTGAAAT | TTT | chr12 | 21593075 | 21593096 | 21593092 | 21593097 | + |

Figure 48 (Cont'd)

| | | | | | | | | |
|---|---|---|---|---|---|---|---|---|
| SEQ ID NO 23210 | GAAACAAATGAAAATTGAAATA | TTT | chr12 | 21593076 | 21593097 | 21593093 | 21593098 | + |
| SEQ ID NO 23211 | AAACAAATGAAAATTGAAATAC | TTG | chr12 | 21593077 | 21593098 | 21593094 | 21593099 | + |
| SEQ ID NO 23212 | AAATACAACATAGGAAAAGCCA | TTG | chr12 | 21593093 | 21593114 | 21593110 | 21593115 | + |
| SEQ ID NO 23213 | AGAGAGAAGCTTATCAATAAAC | CTA | chr12 | 21593139 | 21593160 | 21593156 | 21593161 | + |
| SEQ ID NO 23214 | ATCAATAAACACTTAAATTAAA | CTT | chr12 | 21593151 | 21593172 | 21593168 | 21593173 | + |
| SEQ ID NO 23215 | TCAATAAACACTTAAATTAAAA | TTA | chr12 | 21593152 | 21593173 | 21593169 | 21593174 | + |
| SEQ ID NO 23216 | AAATTAAAAACATAGAAAGATT | CTT | chr12 | 21593165 | 21593186 | 21593182 | 21593187 | + |
| SEQ ID NO 23217 | AATTAAAAACATAGAAAGATTT | TTA | chr12 | 21593166 | 21593187 | 21593183 | 21593188 | + |
| SEQ ID NO 23218 | AAAACATAGAAAGATTTCAAAT | TTA | chr12 | 21593171 | 21593192 | 21593188 | 21593193 | + |
| SEQ ID NO 23219 | CAAATATATAATCTAATCATGT | TTT | chr12 | 21593188 | 21593209 | 21593205 | 21593210 | + |
| SEQ ID NO 23220 | AAATATATAATCTAATCATGTA | TTC | chr12 | 21593189 | 21593210 | 21593206 | 21593211 | + |
| SEQ ID NO 23221 | ATCATGTACCTCAACAAGCTAG | CTA | chr12 | 21593203 | 21593224 | 21593220 | 21593225 | + |
| SEQ ID NO 23222 | AACAAGCTAGAAAAGCAAGAAC | CTC | chr12 | 21593215 | 21593236 | 21593232 | 21593237 | + |
| SEQ ID NO 23223 | GAAAAGCAAGAACAAAACCCAA | CTA | chr12 | 21593224 | 21593245 | 21593241 | 21593246 | + |
| SEQ ID NO 23224 | GCAGAAGGAAAGAAAAAATGAA | CTA | chr12 | 21593251 | 21593272 | 21593268 | 21593273 | + |
| SEQ ID NO 23225 | AATGAAATAGAGAAAAACAACA | CTT | chr12 | 21593287 | 21593308 | 21593304 | 21593309 | + |
| SEQ ID NO 23226 | ATGAAATAGAGAAAAACAACAA | TTA | chr12 | 21593288 | 21593309 | 21593305 | 21593310 | + |
| SEQ ID NO 23227 | GCAAAATGAAAAGTTGTTATTT | TTA | chr12 | 21593320 | 21593341 | 21593337 | 21593342 | + |
| SEQ ID NO 23228 | TTATTTAAAAAAGATAAAATGG | TTG | chr12 | 21593336 | 21593357 | 21593353 | 21593358 | + |
| SEQ ID NO 23229 | TTTAAAAAAGATAAAATGGATA | TTA | chr12 | 21593339 | 21593360 | 21593356 | 21593361 | + |
| SEQ ID NO 23230 | AAAAAAGATAAAATGGATATAG | TTT | chr12 | 21593342 | 21593363 | 21593359 | 21593364 | + |
| SEQ ID NO 23231 | AAAAAGATAAAATGGATATAGC | TTA | chr12 | 21593343 | 21593364 | 21593360 | 21593365 | + |
| SEQ ID NO 23232 | TAGCTAGACTAACCAAGAAAAA | CTC | chr12 | 21593367 | 21593388 | 21593384 | 21593389 | + |
| SEQ ID NO 23233 | GCTAGACTAACCAAGAAAAAGA | CTA | chr12 | 21593369 | 21593390 | 21593386 | 21593391 | + |
| SEQ ID NO 23234 | GACTAACCAAGAAAAAGAGAAG | CTA | chr12 | 21593373 | 21593394 | 21593390 | 21593395 | + |
| SEQ ID NO 23235 | ACCAAGAAAAGAGAAGAGACT | CTA | chr12 | 21593378 | 21593399 | 21593395 | 21593400 | + |
| SEQ ID NO 23236 | AAATAAAGAAAATCAGAAATAA | CTG | chr12 | 21593401 | 21593422 | 21593418 | 21593423 | + |
| SEQ ID NO 23237 | CAACCGATACCACAGAAATAGA | TTA | chr12 | 21593439 | 21593460 | 21593456 | 21593461 | + |
| SEQ ID NO 23238 | TCAGAGACTATTATGAACAACC | TTA | chr12 | 21593469 | 21593490 | 21593486 | 21593491 | + |
| SEQ ID NO 23239 | TTATGAACAACCATACACTAAA | CTA | chr12 | 21593479 | 21593500 | 21593496 | 21593501 | + |
| SEQ ID NO 23240 | TGAACAACCATACACTAAAAAA | TTA | chr12 | 21593482 | 21593503 | 21593499 | 21593504 | + |
| SEQ ID NO 23241 | AAAAACTGAAAAATCTAGAGGA | CTA | chr12 | 21593499 | 21593520 | 21593516 | 21593521 | + |
| SEQ ID NO 23242 | AAAAATCTAGAGGAAATTAATA | CTG | chr12 | 21593507 | 21593528 | 21593524 | 21593529 | + |
| SEQ ID NO 23243 | GAGGAAATTAATAAATTTCTGG | CTA | chr12 | 21593516 | 21593537 | 21593533 | 21593538 | + |
| SEQ ID NO 23244 | ATAAATTTCTGGACACATACCA | TTA | chr12 | 21593526 | 21593547 | 21593543 | 21593548 | + |
| SEQ ID NO 23245 | CTGGACACATACCACCTACCAA | TTT | chr12 | 21593534 | 21593555 | 21593551 | 21593556 | + |
| SEQ ID NO 23246 | TGGACACATACCACCTACCAAG | TTC | chr12 | 21593535 | 21593556 | 21593552 | 21593557 | + |
| SEQ ID NO 23247 | GACACATACCACCTACCAAGAT | CTG | chr12 | 21593537 | 21593558 | 21593554 | 21593559 | + |
| SEQ ID NO 23248 | CCAAGATTGAATTAAGAAAGAA | CTA | chr12 | 21593552 | 21593573 | 21593569 | 21593574 | + |
| SEQ ID NO 23249 | AATTAAGAAAGAATAGAAAACC | TTG | chr12 | 21593561 | 21593582 | 21593578 | 21593583 | + |
| SEQ ID NO 23250 | AGAAAGAATAGAAAACCTGAAC | TTA | chr12 | 21593566 | 21593587 | 21593583 | 21593588 | + |
| SEQ ID NO 23251 | AACAGACCAGTAATGAATAATG | CTG | chr12 | 21593585 | 21593606 | 21593602 | 21593607 | + |
| SEQ ID NO 23252 | AATCAGTAGTAAAAAGTCTCCC | TTG | chr12 | 21593613 | 21593634 | 21593630 | 21593635 | + |
| SEQ ID NO 23253 | CCAAAAAAGAAAATTTCAAGAC | CTC | chr12 | 21593633 | 21593654 | 21593650 | 21593655 | + |
| SEQ ID NO 23254 | CAAGACCAGATGGCTTTACTGT | TTT | chr12 | 21593649 | 21593670 | 21593666 | 21593671 | + |
| SEQ ID NO 23255 | AAGACCAGATGGCTTTACTGTC | TTC | chr12 | 21593650 | 21593671 | 21593667 | 21593672 | + |
| SEQ ID NO 23256 | TACTGTCAAATTTTACCAAACT | CTT | chr12 | 21593665 | 21593686 | 21593682 | 21593687 | + |
| SEQ ID NO 23257 | ACTGTCAAATTTTACCAAACTT | TTT | chr12 | 21593666 | 21593687 | 21593683 | 21593688 | + |
| SEQ ID NO 23258 | CTGTCAAATTTTACCAAACTTT | TTA | chr12 | 21593667 | 21593688 | 21593684 | 21593689 | + |
| SEQ ID NO 23259 | TCAAATTTTACCAAACTTTCAA | CTG | chr12 | 21593670 | 21593691 | 21593687 | 21593692 | + |
| SEQ ID NO 23260 | TACCAAACTTTCAAAGAAAACT | TTT | chr12 | 21593678 | 21593699 | 21593695 | 21593700 | + |
| SEQ ID NO 23261 | ACCAAACTTTCAAAGAAAACTA | TTT | chr12 | 21593679 | 21593700 | 21593696 | 21593701 | + |
| SEQ ID NO 23262 | CCAAACTTTCAAAGAAAACTAA | TTA | chr12 | 21593680 | 21593701 | 21593697 | 21593702 | + |
| SEQ ID NO 23263 | TCAAAGAAAACTAACAAGTCTC | CTT | chr12 | 21593688 | 21593709 | 21593705 | 21593710 | + |
| SEQ ID NO 23264 | CAAAGAAAACTAACAAGTCTCC | TTT | chr12 | 21593689 | 21593710 | 21593706 | 21593711 | + |
| SEQ ID NO 23265 | AAAGAAAACTAACAAGTCTCCT | TTC | chr12 | 21593690 | 21593711 | 21593707 | 21593712 | + |
| SEQ ID NO 23266 | ACAAGTCTCCTTAAATTCTTTT | CTA | chr12 | 21593701 | 21593722 | 21593718 | 21593723 | + |
| SEQ ID NO 23267 | CTTAAATTCTTTTAAAAATTAA | CTC | chr12 | 21593710 | 21593731 | 21593727 | 21593732 | + |

Figure 48 (Cont'd)

| SEQ ID NO 23268 | AAATTCTTTTAAAAATTAAACA | CTT | chr12 | 21593713 | 21593734 | 21593730 | 21593735 | + |
|---|---|---|---|---|---|---|---|---|
| SEQ ID NO 23269 | AATTCTTTTAAAAATTAAACAG | TTA | chr12 | 21593714 | 21593735 | 21593731 | 21593736 | + |
| SEQ ID NO 23270 | TTTTAAAAATTAAACAGGAAGG | TTC | chr12 | 21593719 | 21593740 | 21593736 | 21593741 | + |
| SEQ ID NO 23271 | TTAAAAATTAAACAGGAAGGAA | CTT | chr12 | 21593721 | 21593742 | 21593738 | 21593743 | + |
| SEQ ID NO 23272 | TAAAAATTAAACAGGAAGGAAT | TTT | chr12 | 21593722 | 21593743 | 21593739 | 21593744 | + |
| SEQ ID NO 23273 | AAAAATTAAACAGGAAGGAATT | TTT | chr12 | 21593723 | 21593744 | 21593740 | 21593745 | + |
| SEQ ID NO 23274 | AAAATTAAACAGGAAGGAATTC | TTA | chr12 | 21593724 | 21593745 | 21593741 | 21593746 | + |
| SEQ ID NO 23275 | AACAGGAAGGAATTCTCCCTAA | TTA | chr12 | 21593731 | 21593752 | 21593748 | 21593753 | + |
| SEQ ID NO 23276 | TCCCTAACTCATTCTCTGAGGC | TTC | chr12 | 21593746 | 21593767 | 21593763 | 21593768 | + |
| SEQ ID NO 23277 | CCTAACTCATTCTCTGAGGCCA | CTC | chr12 | 21593748 | 21593769 | 21593765 | 21593770 | + |
| SEQ ID NO 23278 | ACTCATTCTCTGAGGCCAGTAT | CTA | chr12 | 21593752 | 21593773 | 21593769 | 21593774 | + |
| SEQ ID NO 23279 | ATTCTCTGAGGCCAGTATTATC | CTC | chr12 | 21593756 | 21593777 | 21593773 | 21593778 | + |
| SEQ ID NO 23280 | TCTGAGGCCAGTATTATCCTGA | TTC | chr12 | 21593760 | 21593781 | 21593777 | 21593782 | + |
| SEQ ID NO 23281 | TGAGGCCAGTATTATCCTGATT | CTC | chr12 | 21593762 | 21593783 | 21593779 | 21593784 | + |
| SEQ ID NO 23282 | AGGCCAGTATTATCCTGATTCC | CTG | chr12 | 21593764 | 21593785 | 21593781 | 21593786 | + |
| SEQ ID NO 23283 | TCCTGATTCCATAACCAGACAA | TTA | chr12 | 21593776 | 21593797 | 21593793 | 21593798 | + |
| SEQ ID NO 23284 | ATTCCATAACCAGACAAGGATG | CTG | chr12 | 21593781 | 21593802 | 21593798 | 21593803 | + |
| SEQ ID NO 23285 | CATAACCAGACAAGGATGCAAG | TTC | chr12 | 21593785 | 21593806 | 21593802 | 21593807 | + |
| SEQ ID NO 23286 | CAGGTCAATATCCCTGATGGAA | CTG | chr12 | 21593821 | 21593842 | 21593838 | 21593843 | + |
| SEQ ID NO 23287 | ATGGAACATAGGTGTGAAAATC | CTG | chr12 | 21593837 | 21593858 | 21593854 | 21593859 | + |
| SEQ ID NO 23288 | AACAAAATACTAGCAAACTGAA | CTC | chr12 | 21593862 | 21593883 | 21593879 | 21593884 | + |
| SEQ ID NO 23289 | GCAAACTGAATCCAACAGTACA | CTA | chr12 | 21593874 | 21593895 | 21593891 | 21593896 | + |
| SEQ ID NO 23290 | AATCCAACAGTACATCCAAAAG | CTG | chr12 | 21593882 | 21593903 | 21593899 | 21593904 | + |
| SEQ ID NO 23291 | ATACTAGGGTTGCAAGAACAGT | TTT | chr12 | 21593931 | 21593952 | 21593948 | 21593953 | + |
| SEQ ID NO 23292 | TACTAGGGTTGCAAGAACAGTT | TTA | chr12 | 21593932 | 21593953 | 21593949 | 21593954 | + |
| SEQ ID NO 23293 | GGGTTGCAAGAACAGTTCAAAT | CTA | chr12 | 21593937 | 21593958 | 21593954 | 21593959 | + |
| SEQ ID NO 23294 | CAAGAACAGTTCAAATCAATAA | TTG | chr12 | 21593943 | 21593964 | 21593960 | 21593965 | + |
| SEQ ID NO 23295 | AAATCAATAAATGTGATACATC | TTC | chr12 | 21593955 | 21593976 | 21593972 | 21593977 | + |
| SEQ ID NO 23296 | AATAGATACAGAAAAGTATTT | CTC | chr12 | 21594014 | 21594035 | 21594031 | 21594036 | + |
| SEQ ID NO 23297 | GATAAAATTTAACATTCCTTCA | TTT | chr12 | 21594036 | 21594057 | 21594053 | 21594058 | + |
| SEQ ID NO 23298 | ATAAAATTTAACATTCCTTCAT | TTG | chr12 | 21594037 | 21594058 | 21594054 | 21594059 | + |
| SEQ ID NO 23299 | AACATTCCTTCATGATAAAAAC | TTT | chr12 | 21594046 | 21594067 | 21594063 | 21594068 | + |
| SEQ ID NO 23300 | ACATTCCTTCATGATAAAAACT | TTA | chr12 | 21594047 | 21594068 | 21594064 | 21594069 | + |
| SEQ ID NO 23301 | CTTCATGATAAAAACTATCTGC | TTC | chr12 | 21594053 | 21594074 | 21594070 | 21594075 | + |
| SEQ ID NO 23302 | CATGATAAAAACTATCTGCAGC | CTT | chr12 | 21594056 | 21594077 | 21594073 | 21594078 | + |
| SEQ ID NO 23303 | ATGATAAAAACTATCTGCAGCC | TTC | chr12 | 21594057 | 21594078 | 21594074 | 21594079 | + |
| SEQ ID NO 23304 | TCTGCAGCCAATCATAGAAGGA | CTA | chr12 | 21594070 | 21594091 | 21594087 | 21594092 | + |
| SEQ ID NO 23305 | CAGCCAATCATAGAAGGAACAT | CTG | chr12 | 21594074 | 21594095 | 21594091 | 21594096 | + |
| SEQ ID NO 23306 | AATATAATAAAGTCATATATG | CTC | chr12 | 21594101 | 21594122 | 21594118 | 21594123 | + |
| SEQ ID NO 23307 | ACATCATACTGAATTGGGAAAA | CTA | chr12 | 21594138 | 21594159 | 21594155 | 21594160 | + |
| SEQ ID NO 23308 | AATTGGGAAAAGCTGGAAGCCT | CTG | chr12 | 21594149 | 21594170 | 21594166 | 21594171 | + |
| SEQ ID NO 23309 | GGAAAAGCTGGAAGCCTTTCCT | TTG | chr12 | 21594154 | 21594175 | 21594171 | 21594176 | + |
| SEQ ID NO 23310 | GAAGCCTTTCCTCTAAGAACTG | CTG | chr12 | 21594164 | 21594185 | 21594181 | 21594186 | + |
| SEQ ID NO 23311 | TCCTCTAAGAACTGAAACAAAA | CTT | chr12 | 21594172 | 21594193 | 21594189 | 21594194 | + |
| SEQ ID NO 23312 | CCTCTAAGAACTGAAACAAAAT | TTT | chr12 | 21594173 | 21594194 | 21594190 | 21594195 | + |
| SEQ ID NO 23313 | CTCTAAGAACTGAAACAAAATA | TTC | chr12 | 21594174 | 21594195 | 21594191 | 21594196 | + |
| SEQ ID NO 23314 | TAAGAACTGAAACAAAATAAGG | CTC | chr12 | 21594177 | 21594198 | 21594194 | 21594199 | + |
| SEQ ID NO 23315 | AGAACTGAAACAAAATAAGGAT | CTA | chr12 | 21594179 | 21594200 | 21594196 | 21594201 | + |
| SEQ ID NO 23316 | AAACAAAATAAGGATGCCCACT | CTG | chr12 | 21594186 | 21594207 | 21594203 | 21594208 | + |
| SEQ ID NO 23317 | CCATCACTCCTATTCAATATAA | CTT | chr12 | 21594209 | 21594230 | 21594226 | 21594231 | + |
| SEQ ID NO 23318 | CATCACTCCTATTCAATATAAT | TTC | chr12 | 21594210 | 21594231 | 21594227 | 21594232 | + |
| SEQ ID NO 23319 | CTATTCAATATAATACTGGAAG | CTC | chr12 | 21594218 | 21594239 | 21594235 | 21594240 | + |
| SEQ ID NO 23320 | TTCAATATAATACTGGAAGTCC | CTA | chr12 | 21594221 | 21594242 | 21594238 | 21594243 | + |
| SEQ ID NO 23321 | AATATAATACTGGAAGTCCTAG | TTC | chr12 | 21594224 | 21594245 | 21594241 | 21594246 | + |
| SEQ ID NO 23322 | GAAGTCCTAGCCACAGCTTTCA | CTG | chr12 | 21594236 | 21594257 | 21594253 | 21594258 | + |
| SEQ ID NO 23323 | GCCACAGCTTTCAGGTCAGAGA | CTA | chr12 | 21594245 | 21594266 | 21594262 | 21594267 | + |
| SEQ ID NO 23324 | TCAGGTCAGAGAAAGAAAGAAA | CTT | chr12 | 21594255 | 21594276 | 21594272 | 21594277 | + |
| SEQ ID NO 23325 | CAGGTCAGAGAAAGAAAGAAAG | TTT | chr12 | 21594256 | 21594277 | 21594273 | 21594278 | + |

Figure 48 (Cont'd)

| | | | | | | | | |
|---|---|---|---|---|---|---|---|---|
| SEQ ID NO 23326 | AGGTCAGAGAAAGAAAGAAAGA | TTC | chr12 | 21594257 | 21594278 | 21594274 | 21594279 | + |
| SEQ ID NO 23327 | TCCATCTTTCCAGATGACATGA | CTG | chr12 | 21594315 | 21594336 | 21594332 | 21594337 | + |
| SEQ ID NO 23328 | TCCAGATGACATGATTTTATAC | CTT | chr12 | 21594323 | 21594344 | 21594340 | 21594345 | + |
| SEQ ID NO 23329 | CCAGATGACATGATTTTATACC | TTT | chr12 | 21594324 | 21594345 | 21594341 | 21594346 | + |
| SEQ ID NO 23330 | CAGATGACATGATTTTATACCT | TTC | chr12 | 21594325 | 21594346 | 21594342 | 21594347 | + |
| SEQ ID NO 23331 | TATACCTAGAAAAACCAAGACT | TTT | chr12 | 21594340 | 21594361 | 21594357 | 21594362 | + |
| SEQ ID NO 23332 | ATACCTAGAAAAACCAAGACTC | TTT | chr12 | 21594341 | 21594362 | 21594358 | 21594363 | + |
| SEQ ID NO 23333 | TACCTAGAAAAACCAAGACTCC | TTA | chr12 | 21594342 | 21594363 | 21594359 | 21594364 | + |
| SEQ ID NO 23334 | GAAAAACCAAGACTCCACCAAA | CTA | chr12 | 21594348 | 21594369 | 21594365 | 21594370 | + |
| SEQ ID NO 23335 | CACCAAAGCACTCTTAGCGCTG | CTC | chr12 | 21594363 | 21594384 | 21594380 | 21594385 | + |
| SEQ ID NO 23336 | TTAGCGCTGAAAAATAAATTCA | CTC | chr12 | 21594376 | 21594397 | 21594393 | 21594398 | + |
| SEQ ID NO 23337 | AGCGCTGAAAAATAAATTCAGT | CTT | chr12 | 21594378 | 21594399 | 21594395 | 21594400 | + |
| SEQ ID NO 23338 | GCGCTGAAAAATAAATTCAGTA | TTA | chr12 | 21594379 | 21594400 | 21594396 | 21594401 | + |
| SEQ ID NO 23339 | AAAAATAAATTCAGTAAAGTTA | CTG | chr12 | 21594385 | 21594406 | 21594402 | 21594407 | + |
| SEQ ID NO 23340 | AGTAAAGTTACAGGAGACAAAA | TTC | chr12 | 21594397 | 21594418 | 21594414 | 21594419 | + |
| SEQ ID NO 23341 | CAGGAGACAAAATCAGCATATG | TTA | chr12 | 21594407 | 21594428 | 21594424 | 21594429 | + |
| SEQ ID NO 23342 | CTACACCAATAATAAACTAG | TTT | chr12 | 21594444 | 21594465 | 21594461 | 21594466 | + |
| SEQ ID NO 23343 | TACACACCAATAATAAACTAGC | TTC | chr12 | 21594445 | 21594466 | 21594462 | 21594467 | + |
| SEQ ID NO 23344 | CACACCAATAATAAACTAGCTG | CTA | chr12 | 21594447 | 21594468 | 21594464 | 21594469 | + |
| SEQ ID NO 23345 | GCTGAGAAGGAAATTAAGAAGG | CTA | chr12 | 21594465 | 21594486 | 21594482 | 21594487 | + |
| SEQ ID NO 23346 | AGAAGGAAATTAAGAAGGCAAT | CTG | chr12 | 21594469 | 21594490 | 21594486 | 21594491 | + |
| SEQ ID NO 23347 | AGAAGGCAATCCCATTTACAAT | TTA | chr12 | 21594481 | 21594502 | 21594498 | 21594503 | + |
| SEQ ID NO 23348 | ACAATAGCTAAAAATAAAATA | TTT | chr12 | 21594498 | 21594519 | 21594515 | 21594520 | + |
| SEQ ID NO 23349 | CAATAGCTAAAAATAAAATAT | TTA | chr12 | 21594499 | 21594520 | 21594516 | 21594521 | + |
| SEQ ID NO 23350 | AAAAATAAAATATTTAGGGATA | CTA | chr12 | 21594508 | 21594529 | 21594525 | 21594530 | + |
| SEQ ID NO 23351 | AGGGATAAATTTAACCAAGGAA | TTT | chr12 | 21594523 | 21594544 | 21594540 | 21594545 | + |
| SEQ ID NO 23352 | GGGATAAATTTAACCAAGGAAC | TTA | chr12 | 21594524 | 21594545 | 21594541 | 21594546 | + |
| SEQ ID NO 23353 | AACCAAGGAACCGAAAAACCTC | TTT | chr12 | 21594535 | 21594556 | 21594552 | 21594557 | + |
| SEQ ID NO 23354 | ACCAAGGAACCGAAAAACCTCT | TTA | chr12 | 21594536 | 21594557 | 21594553 | 21594558 | + |
| SEQ ID NO 23355 | TATTCGGAAAACTACAAAACAC | CTC | chr12 | 21594557 | 21594578 | 21594574 | 21594579 | + |
| SEQ ID NO 23356 | TTCGGAAAACTACAAAACACTG | CTA | chr12 | 21594559 | 21594580 | 21594576 | 21594581 | + |
| SEQ ID NO 23357 | GGAAAACTACAAAACACTGATA | TTC | chr12 | 21594562 | 21594583 | 21594579 | 21594584 | + |
| SEQ ID NO 23358 | CAAAACACTGATAAAAGAATTG | CTA | chr12 | 21594571 | 21594592 | 21594588 | 21594593 | + |
| SEQ ID NO 23359 | ATAAAAGAATTGAAAAGGACAG | CTG | chr12 | 21594581 | 21594602 | 21594598 | 21594603 | + |
| SEQ ID NO 23360 | AAAAGGACAGAAACAAATGGAG | TTG | chr12 | 21594593 | 21594614 | 21594610 | 21594615 | + |
| SEQ ID NO 23361 | TGTTCATGGATCAGAAAAATTA | CTA | chr12 | 21594625 | 21594646 | 21594642 | 21594647 | + |
| SEQ ID NO 23362 | ATGGATCAGAAAAATTAATATT | TTC | chr12 | 21594630 | 21594651 | 21594647 | 21594652 | + |
| SEQ ID NO 23363 | ATATTGTAAAATGGCCATACT | TTA | chr12 | 21594647 | 21594668 | 21594664 | 21594669 | + |
| SEQ ID NO 23364 | TTAAAATGGCCATACTACCCAA | TTG | chr12 | 21594653 | 21594674 | 21594670 | 21594675 | + |
| SEQ ID NO 23365 | AAATGGCCATACTACCCAAAGC | TTA | chr12 | 21594656 | 21594677 | 21594673 | 21594678 | + |
| SEQ ID NO 23366 | CCCAAAGCAATCTACAGATTCT | CTA | chr12 | 21594670 | 21594691 | 21594687 | 21594692 | + |
| SEQ ID NO 23367 | CAGATTCTATATGACCGCTATC | CTA | chr12 | 21594684 | 21594705 | 21594701 | 21594706 | + |
| SEQ ID NO 23368 | TATATGACCGCTATCAAAATAG | TTC | chr12 | 21594691 | 21594712 | 21594708 | 21594713 | + |
| SEQ ID NO 23369 | TATGACCGCTATCAAAATAGCA | CTA | chr12 | 21594693 | 21594714 | 21594710 | 21594715 | + |
| SEQ ID NO 23370 | TCAAAATAGCAATGTCATTTTT | CTA | chr12 | 21594704 | 21594725 | 21594721 | 21594726 | + |
| SEQ ID NO 23371 | TTCACAGAAATGGAAAACCAA | TTT | chr12 | 21594724 | 21594745 | 21594741 | 21594746 | + |
| SEQ ID NO 23372 | TCACAGAAATGGAAAACCAAT | TTT | chr12 | 21594725 | 21594746 | 21594742 | 21594747 | + |
| SEQ ID NO 23373 | CACAGAAATGGAAAACCAATC | TTT | chr12 | 21594726 | 21594747 | 21594743 | 21594748 | + |
| SEQ ID NO 23374 | ACAGAAATGGAAAACCAATCT | TTC | chr12 | 21594727 | 21594748 | 21594744 | 21594749 | + |
| SEQ ID NO 23375 | AAATTTGTATGAAATTAAAAAA | CTA | chr12 | 21594750 | 21594771 | 21594767 | 21594772 | + |
| SEQ ID NO 23376 | GTATGAAATTAAAAAATAGCT | TTT | chr12 | 21594756 | 21594777 | 21594773 | 21594778 | + |
| SEQ ID NO 23377 | TATGAAATTAAAAAATAGCTCC | TTG | chr12 | 21594757 | 21594778 | 21594774 | 21594779 | + |
| SEQ ID NO 23378 | AAAAATAGCTCCAGTAGCCAAA | TTA | chr12 | 21594767 | 21594788 | 21594784 | 21594789 | + |
| SEQ ID NO 23379 | CAGTAGCCAAAGTCATCCTGTG | CTC | chr12 | 21594778 | 21594799 | 21594795 | 21594800 | + |
| SEQ ID NO 23380 | TGAAAAAGAACAATGCTAGAG | CTG | chr12 | 21594798 | 21594819 | 21594815 | 21594820 | + |
| SEQ ID NO 23381 | GAGGTATCATACTACCTGATTT | CTA | chr12 | 21594817 | 21594838 | 21594834 | 21594839 | + |
| SEQ ID NO 23382 | CCTGATTTCAAAGTATATTACA | CTA | chr12 | 21594831 | 21594852 | 21594848 | 21594853 | + |
| SEQ ID NO 23383 | ATTTCAAAGTATATTACAAAAG | CTG | chr12 | 21594835 | 21594856 | 21594852 | 21594857 | + |

Figure 48 (Cont'd)

| | | | | | | | | |
|---|---|---|---|---|---|---|---|---|
| SEQ ID NO 23384 | CAAAGTATATTACAAAAGTATA | TTT | chr12 | 21594839 | 21594860 | 21594856 | 21594861 | + |
| SEQ ID NO 23385 | AAAGTATATTACAAAAGTATAG | TTC | chr12 | 21594840 | 21594861 | 21594857 | 21594862 | + |
| SEQ ID NO 23386 | CAAAAGTATAGGAACCTAAACA | TTA | chr12 | 21594851 | 21594872 | 21594868 | 21594873 | + |
| SEQ ID NO 23387 | AACAGCATGATACTGACATTAG | CTA | chr12 | 21594869 | 21594890 | 21594886 | 21594891 | + |
| SEQ ID NO 23388 | ACATTAGAACAGACACTTAGAC | CTG | chr12 | 21594884 | 21594905 | 21594901 | 21594906 | + |
| SEQ ID NO 23389 | GAACAGACACTTAGACCAATGG | TTA | chr12 | 21594890 | 21594911 | 21594907 | 21594912 | + |
| SEQ ID NO 23390 | AGACCAATGGAAGAGAATAGAG | CTT | chr12 | 21594902 | 21594923 | 21594919 | 21594924 | + |
| SEQ ID NO 23391 | GACCAATGGAAGAGAATAGAGA | TTA | chr12 | 21594903 | 21594924 | 21594920 | 21594925 | + |
| SEQ ID NO 23392 | GAAATGCATCCACATATTTATA | CTA | chr12 | 21594930 | 21594951 | 21594947 | 21594952 | + |
| SEQ ID NO 23393 | ATAGCCAACAGATTTTCAACAA | TTT | chr12 | 21594949 | 21594970 | 21594966 | 21594971 | + |
| SEQ ID NO 23394 | TAGCCAACAGATTTTCAACAAA | TTA | chr12 | 21594950 | 21594971 | 21594967 | 21594972 | + |
| SEQ ID NO 23395 | TCAACAAAGGTGACAAGAATAT | TTT | chr12 | 21594964 | 21594985 | 21594981 | 21594986 | + |
| SEQ ID NO 23396 | CAACAAAGGTGACAAGAATATA | TTT | chr12 | 21594965 | 21594986 | 21594982 | 21594987 | + |
| SEQ ID NO 23397 | AACAAAGGTGACAAGAATATAC | TTC | chr12 | 21594966 | 21594987 | 21594983 | 21594988 | + |
| SEQ ID NO 23398 | AGGAAAGGACACAGTGTTCAAG | TTG | chr12 | 21594992 | 21595013 | 21595009 | 21595014 | + |
| SEQ ID NO 23399 | AAGAAATGGTGCTGAAAAAATT | TTC | chr12 | 21595011 | 21595032 | 21595028 | 21595033 | + |
| SEQ ID NO 23400 | AAAAAATTGGATATCCATTGGA | CTG | chr12 | 21595025 | 21595046 | 21595042 | 21595047 | + |
| SEQ ID NO 23401 | GATATCCATTGGATATCCATGT | TTG | chr12 | 21595034 | 21595055 | 21595051 | 21595056 | + |
| SEQ ID NO 23402 | GATATCCATGTGCAAAAGAATA | TTG | chr12 | 21595045 | 21595066 | 21595062 | 21595067 | + |
| SEQ ID NO 23403 | GACTGCTGATATGGTTTGGATG | CTG | chr12 | 21595073 | 21595094 | 21595090 | 21595095 | + |
| SEQ ID NO 23404 | CTGATATGGTTTGGATGTTTGT | CTG | chr12 | 21595078 | 21595099 | 21595095 | 21595100 | + |
| SEQ ID NO 23405 | ATATGGTTTGGATGTTTGTTCC | CTG | chr12 | 21595081 | 21595102 | 21595098 | 21595103 | + |
| SEQ ID NO 23406 | GGATGTTTGTTCCCTCCAAATC | TTT | chr12 | 21595090 | 21595111 | 21595107 | 21595112 | + |
| SEQ ID NO 23407 | GATGTTTGTTCCCTCCAAATCT | TTG | chr12 | 21595091 | 21595112 | 21595108 | 21595113 | + |
| SEQ ID NO 23408 | GTTCCCTCCAAATCTCATGTTG | TTT | chr12 | 21595098 | 21595119 | 21595115 | 21595120 | + |
| SEQ ID NO 23409 | TTCCCTCCAAATCTCATGTTGA | TTG | chr12 | 21595099 | 21595120 | 21595116 | 21595121 | + |
| SEQ ID NO 23410 | CCTCCAAATCTCATGTTGAAAT | TTC | chr12 | 21595102 | 21595123 | 21595119 | 21595124 | + |
| SEQ ID NO 23411 | CAAATCTCATGTTGAAATATAA | CTC | chr12 | 21595106 | 21595127 | 21595123 | 21595128 | + |
| SEQ ID NO 23412 | ATGTTGAAATATAATCCCCAAC | CTC | chr12 | 21595114 | 21595135 | 21595131 | 21595136 | + |
| SEQ ID NO 23413 | AAATATAATCCCCAACTTCTCA | TTG | chr12 | 21595120 | 21595141 | 21595137 | 21595142 | + |
| SEQ ID NO 23414 | CTCAGGATCTTGGCGGATGGGA | CTT | chr12 | 21595138 | 21595159 | 21595155 | 21595160 | + |
| SEQ ID NO 23415 | TCAGGATCTTGGCGGATGGGAG | TTC | chr12 | 21595139 | 21595160 | 21595156 | 21595161 | + |
| SEQ ID NO 23416 | AGGATCTTGGCGGATGGGAGGT | CTC | chr12 | 21595141 | 21595162 | 21595158 | 21595163 | + |
| SEQ ID NO 23417 | GGCGGATGGGAGGTAGGCCTAG | CTT | chr12 | 21595149 | 21595170 | 21595166 | 21595171 | + |
| SEQ ID NO 23418 | GCGGATGGGAGGTAGGCCTAGA | TTG | chr12 | 21595150 | 21595171 | 21595167 | 21595172 | + |
| SEQ ID NO 23419 | GATTGCAGCTCCAACTCAGATG | CTA | chr12 | 21595170 | 21595191 | 21595187 | 21595192 | + |
| SEQ ID NO 23420 | CAGCTCCAACTCAGATGGACAG | TTG | chr12 | 21595175 | 21595196 | 21595192 | 21595197 | + |
| SEQ ID NO 23421 | CAACTCAGATGGACAGAGCAGC | CTC | chr12 | 21595181 | 21595202 | 21595198 | 21595203 | + |
| SEQ ID NO 23422 | AGATGGACAGAGCAGCATGTGG | CTC | chr12 | 21595187 | 21595208 | 21595204 | 21595209 | + |
| SEQ ID NO 23423 | GCATTGTGAATTTTAGCTGCAG | CTC | chr12 | 21595215 | 21595236 | 21595232 | 21595237 | + |
| SEQ ID NO 23424 | TGAATTTTAGCTGCAGATAGAC | TTG | chr12 | 21595221 | 21595242 | 21595238 | 21595243 | + |
| SEQ ID NO 23425 | TAGCTGCAGATAGACTGCAAGA | TTT | chr12 | 21595228 | 21595249 | 21595245 | 21595250 | + |
| SEQ ID NO 23426 | AGCTGCAGATAGACTGCAAGAA | TTT | chr12 | 21595229 | 21595250 | 21595246 | 21595251 | + |
| SEQ ID NO 23427 | GCTGCAGATAGACTGCAAGAAC | TTA | chr12 | 21595230 | 21595251 | 21595247 | 21595252 | + |
| SEQ ID NO 23428 | CAGATAGACTGCAAGAACAAAC | CTG | chr12 | 21595234 | 21595255 | 21595251 | 21595256 | + |
| SEQ ID NO 23429 | CAAGAACAAACCAGCAATCCTG | CTG | chr12 | 21595245 | 21595266 | 21595262 | 21595267 | + |
| SEQ ID NO 23430 | AGAGGACCCACAGACCCTCTGA | CTG | chr12 | 21595267 | 21595288 | 21595284 | 21595289 | + |
| SEQ ID NO 23431 | TGAAGGAAGTAGATTGCTCCTG | CTC | chr12 | 21595286 | 21595307 | 21595303 | 21595308 | + |
| SEQ ID NO 23432 | AAGGAAGTAGATTGCTCCTGCA | CTG | chr12 | 21595288 | 21595309 | 21595305 | 21595310 | + |
| SEQ ID NO 23433 | CTCCTGCAGGACCCAGGAGACA | TTG | chr12 | 21595302 | 21595323 | 21595319 | 21595324 | + |
| SEQ ID NO 23434 | CTGCAGGACCCAGGAGACACCC | CTC | chr12 | 21595305 | 21595326 | 21595322 | 21595327 | + |
| SEQ ID NO 23435 | CAGGACCCAGGAGACACCCCAA | CTG | chr12 | 21595308 | 21595329 | 21595325 | 21595330 | + |
| SEQ ID NO 23436 | TGAGTGCCCAACTGCGGAAGT | CTG | chr12 | 21595336 | 21595357 | 21595353 | 21595358 | + |
| SEQ ID NO 23437 | CGGAAGTGGGAAGGGAGATCC | CTG | chr12 | 21595351 | 21595372 | 21595368 | 21595373 | + |
| SEQ ID NO 23438 | CTCTCCTAAACACACACTCCCA | CTC | chr12 | 21595375 | 21595396 | 21595392 | 21595397 | + |
| SEQ ID NO 23439 | TCCTAAACACACACTCCCACTG | CTC | chr12 | 21595378 | 21595399 | 21595395 | 21595400 | + |
| SEQ ID NO 23440 | CTAAACACACACTCCCACTGGA | CTC | chr12 | 21595380 | 21595401 | 21595397 | 21595402 | + |
| SEQ ID NO 23441 | AACACACACTCCCACTGGAGAA | CTA | chr12 | 21595383 | 21595404 | 21595400 | 21595405 | + |

Figure 48 (Cont'd)

| SEQ ID | Sequence | Codon | Chr | Pos1 | Pos2 | Pos3 | Pos4 | Strand |
|---|---|---|---|---|---|---|---|---|
| SEQ ID NO 23442 | CCACTGGAGAAACTGAAGGTCT | CTC | chr12 | 21595394 | 21595415 | 21595411 | 21595416 | + |
| SEQ ID NO 23443 | GAGAAACTGAAGGTCTGTTTGT | CTG | chr12 | 21595400 | 21595421 | 21595417 | 21595422 | + |
| SEQ ID NO 23444 | AAGGTCTGTTTGTGGGAGAAGT | CTG | chr12 | 21595409 | 21595430 | 21595426 | 21595431 | + |
| SEQ ID NO 23445 | TTTGTGGGAGAAGTTTCTGACC | CTG | chr12 | 21595417 | 21595438 | 21595434 | 21595439 | + |
| SEQ ID NO 23446 | GTGGGAGAAGTTTCTGACCTTA | TTT | chr12 | 21595420 | 21595441 | 21595437 | 21595442 | + |
| SEQ ID NO 23447 | TGGGAGAAGTTTCTGACCTTAC | TTG | chr12 | 21595421 | 21595442 | 21595438 | 21595443 | + |
| SEQ ID NO 23448 | CTGACCTTACCTGGAGTTGAGT | TTT | chr12 | 21595433 | 21595454 | 21595450 | 21595455 | + |
| SEQ ID NO 23449 | TGACCTTACCTGGAGTTGAGTT | TTC | chr12 | 21595434 | 21595455 | 21595451 | 21595456 | + |
| SEQ ID NO 23450 | ACCTTACCTGGAGTTGAGTTAA | CTG | chr12 | 21595436 | 21595457 | 21595453 | 21595458 | + |
| SEQ ID NO 23451 | ACCTGGAGTTGAGTTAACTTAG | CTT | chr12 | 21595441 | 21595462 | 21595458 | 21595463 | + |
| SEQ ID NO 23452 | CCTGGAGTTGAGTTAACTTAGA | TTA | chr12 | 21595442 | 21595463 | 21595459 | 21595464 | + |
| SEQ ID NO 23453 | GAGTTGAGTTAACTTAGAGAGC | CTG | chr12 | 21595446 | 21595467 | 21595463 | 21595468 | + |
| SEQ ID NO 23454 | AGTTAACTTAGAGAGCTGAGCA | TTG | chr12 | 21595452 | 21595473 | 21595469 | 21595474 | + |
| SEQ ID NO 23455 | ACTTAGAGAGCTGAGCAAAATA | TTA | chr12 | 21595457 | 21595478 | 21595474 | 21595479 | + |
| SEQ ID NO 23456 | AGAGAGCTGAGCAAAATACAGG | CTT | chr12 | 21595461 | 21595482 | 21595478 | 21595483 | + |
| SEQ ID NO 23457 | GAGAGCTGAGCAAAATACAGGT | TTA | chr12 | 21595462 | 21595483 | 21595479 | 21595484 | + |
| SEQ ID NO 23458 | AGCAAAATACAGGTGTAGAGGA | CTG | chr12 | 21595470 | 21595491 | 21595487 | 21595492 | + |
| SEQ ID NO 23459 | GGAGCTCACTGGGTCCCTGAGC | CTG | chr12 | 21595511 | 21595532 | 21595528 | 21595533 | + |
| SEQ ID NO 23460 | ACTGGGTCCCTGAGCAGGCCAT | CTC | chr12 | 21595518 | 21595539 | 21595535 | 21595540 | + |
| SEQ ID NO 23461 | GGTCCCTGAGCAGGCCATTCCT | CTG | chr12 | 21595522 | 21595543 | 21595539 | 21595544 | + |
| SEQ ID NO 23462 | AGCAGGCCATTCCTGCCTGGCA | CTG | chr12 | 21595530 | 21595551 | 21595547 | 21595552 | + |
| SEQ ID NO 23463 | CTGCCTGGCATAGCCAGGCATT | TTC | chr12 | 21595542 | 21595563 | 21595559 | 21595564 | + |
| SEQ ID NO 23464 | CCTGGCATAGCCAGGCATTTAC | CTG | chr12 | 21595545 | 21595566 | 21595562 | 21595567 | + |
| SEQ ID NO 23465 | GCATAGCCAGGCATTTACATTA | CTG | chr12 | 21595549 | 21595570 | 21595566 | 21595571 | + |
| SEQ ID NO 23466 | ACATTACTAACATTGAATGTAA | TTT | chr12 | 21595565 | 21595586 | 21595582 | 21595587 | + |
| SEQ ID NO 23467 | CATTACTAACATTGAATGTAAA | TTA | chr12 | 21595566 | 21595587 | 21595583 | 21595588 | + |
| SEQ ID NO 23468 | CTAACATTGAATGTAAATGGCC | TTA | chr12 | 21595571 | 21595592 | 21595588 | 21595593 | + |
| SEQ ID NO 23469 | ACATTGAATGTAAATGGCCTAA | CTA | chr12 | 21595574 | 21595595 | 21595591 | 21595596 | + |
| SEQ ID NO 23470 | AATGTAAATGGCCTAAATGCTC | TTG | chr12 | 21595580 | 21595601 | 21595597 | 21595602 | + |
| SEQ ID NO 23471 | AATGCTCCACTTAAAGGGTGA | CTA | chr12 | 21595595 | 21595616 | 21595612 | 21595617 | + |
| SEQ ID NO 23472 | CACTTAAAGGGTGAAAAAGGT | CTC | chr12 | 21595602 | 21595623 | 21595619 | 21595624 | + |
| SEQ ID NO 23473 | AAAAGGGTGAAAAAGGTATTTC | CTT | chr12 | 21595607 | 21595628 | 21595624 | 21595629 | + |
| SEQ ID NO 23474 | AAAGGGTGAAAAAGGTATTTCA | TTA | chr12 | 21595608 | 21595629 | 21595625 | 21595630 | + |
| SEQ ID NO 23475 | CATGCAAATGGCCACCAAAAGT | TTT | chr12 | 21595628 | 21595649 | 21595645 | 21595650 | + |
| SEQ ID NO 23476 | ATGCAAATGGCCACCAAAAGTG | TTC | chr12 | 21595629 | 21595650 | 21595646 | 21595651 | + |
| SEQ ID NO 23477 | TAAAGCAACAGCAGTTAAAAGA | CTT | chr12 | 21595669 | 21595690 | 21595686 | 21595691 | + |
| SEQ ID NO 23478 | AAAGCAACAGCAGTTAAAAGAG | TTT | chr12 | 21595670 | 21595691 | 21595687 | 21595692 | + |
| SEQ ID NO 23479 | AAGCAACAGCAGTTAAAAGAGA | TTA | chr12 | 21595671 | 21595692 | 21595688 | 21595693 | + |
| SEQ ID NO 23480 | AAAAGAGACAAAGAGGGACATTA | TTA | chr12 | 21595686 | 21595707 | 21595703 | 21595708 | + |
| SEQ ID NO 23481 | TATAATGGTAAAAGGCCTTGTC | TTA | chr12 | 21595708 | 21595729 | 21595725 | 21595730 | + |
| SEQ ID NO 23482 | GTCCAACAGGAAAATATCACAA | CTT | chr12 | 21595727 | 21595748 | 21595744 | 21595749 | + |
| SEQ ID NO 23483 | TCCAACAGGAAAATATCACAAT | TTG | chr12 | 21595728 | 21595749 | 21595745 | 21595750 | + |
| SEQ ID NO 23484 | AAACATATATGCACCTAACACT | CTT | chr12 | 21595753 | 21595774 | 21595770 | 21595775 | + |
| SEQ ID NO 23485 | AACATATATGCACCTAACACTG | TTA | chr12 | 21595754 | 21595775 | 21595771 | 21595776 | + |
| SEQ ID NO 23486 | ACACTGGAGCTCCCAAATTTAT | CTA | chr12 | 21595770 | 21595791 | 21595787 | 21595792 | + |
| SEQ ID NO 23487 | GAGCTCCCAAATTTATAGAACA | CTG | chr12 | 21595776 | 21595797 | 21595793 | 21595798 | + |
| SEQ ID NO 23488 | CCAAATTTATAGAACAATTACT | CTC | chr12 | 21595782 | 21595803 | 21595799 | 21595804 | + |
| SEQ ID NO 23489 | ATAGAACAATTACTAATAGACC | TTT | chr12 | 21595790 | 21595811 | 21595807 | 21595812 | + |
| SEQ ID NO 23490 | TAGAACAATTACTAATAGACCT | TTA | chr12 | 21595791 | 21595812 | 21595808 | 21595813 | + |
| SEQ ID NO 23491 | CTAATAGACCTAAGAAATGAGA | TTA | chr12 | 21595802 | 21595823 | 21595819 | 21595824 | + |
| SEQ ID NO 23492 | ATAGACCTAAGAAATGAGATAG | CTA | chr12 | 21595805 | 21595826 | 21595822 | 21595827 | + |
| SEQ ID NO 23493 | AGAAATGAGATAGCAGCAACA | CTA | chr12 | 21595814 | 21595835 | 21595831 | 21595836 | + |
| SEQ ID NO 23494 | CAATACTTCATTGACAGCACTA | CTT | chr12 | 21595855 | 21595876 | 21595872 | 21595877 | + |
| SEQ ID NO 23495 | AATACTTCATTGACAGCACTAG | TTC | chr12 | 21595856 | 21595877 | 21595873 | 21595878 | + |
| SEQ ID NO 23496 | CATTGACAGCACTAGACAGTTC | CTT | chr12 | 21595863 | 21595884 | 21595880 | 21595885 | + |
| SEQ ID NO 23497 | ATTGACAGCACTAGACAGTTCA | TTC | chr12 | 21595864 | 21595885 | 21595881 | 21595886 | + |
| SEQ ID NO 23498 | ACAGCACTAGACAGTTCATCAA | TTG | chr12 | 21595868 | 21595889 | 21595885 | 21595890 | + |
| SEQ ID NO 23499 | GACAGTTCATCAAGACAGAAAG | CTA | chr12 | 21595877 | 21595898 | 21595894 | 21595899 | + |

Figure 48 (Cont'd)

| | | | | | | | | |
|---|---|---|---|---|---|---|---|---|
| SEQ ID NO 23500 | ATCAAGACAGAAAGTCAACAAA | TTC | chr12 | 21595885 | 21595906 | 21595902 | 21595907 | + |
| SEQ ID NO 23501 | AAATTATACCTTAGAACAAATG | TTT | chr12 | 21595921 | 21595942 | 21595938 | 21595943 | + |
| SEQ ID NO 23502 | AATTATACCTTAGAACAAATGG | TTA | chr12 | 21595922 | 21595943 | 21595939 | 21595944 | + |
| SEQ ID NO 23503 | TACCTTAGAACAAATGGACTTA | TTA | chr12 | 21595927 | 21595948 | 21595944 | 21595949 | + |
| SEQ ID NO 23504 | AGAACAAATGGACTTAACAGTT | CTT | chr12 | 21595933 | 21595954 | 21595950 | 21595955 | + |
| SEQ ID NO 23505 | GAACAAATGGACTTAACAGTTA | TTA | chr12 | 21595934 | 21595955 | 21595951 | 21595956 | + |
| SEQ ID NO 23506 | AACAGTTATATACAGAACATTT | CTT | chr12 | 21595948 | 21595969 | 21595965 | 21595970 | + |
| SEQ ID NO 23507 | ACAGTTATATACAGAACATTTC | TTA | chr12 | 21595949 | 21595970 | 21595966 | 21595971 | + |
| SEQ ID NO 23508 | TATACAGAACATTTCATCCAAT | TTA | chr12 | 21595956 | 21595977 | 21595973 | 21595978 | + |
| SEQ ID NO 23509 | CATCCAATAACCACAGAACACA | TTT | chr12 | 21595970 | 21595991 | 21595987 | 21595992 | + |
| SEQ ID NO 23510 | ATCCAATAACCACAGAACACAC | TTC | chr12 | 21595971 | 21595992 | 21595988 | 21595993 | + |
| SEQ ID NO 23511 | TATTCAACAGCGCGTGGAAATT | TTC | chr12 | 21595997 | 21596018 | 21596014 | 21596019 | + |
| SEQ ID NO 23512 | TTCAACAGCGCGTGGAAATTTC | CTA | chr12 | 21595999 | 21596020 | 21596016 | 21596021 | + |
| SEQ ID NO 23513 | AACAGCGCGTGGAAATTTCTCC | TTC | chr12 | 21596002 | 21596023 | 21596019 | 21596024 | + |
| SEQ ID NO 23514 | CTCCAAGGTAGACCATATGATA | TTT | chr12 | 21596020 | 21596041 | 21596037 | 21596042 | + |
| SEQ ID NO 23515 | TCCAAGGTAGACCATATGATAG | TTC | chr12 | 21596021 | 21596042 | 21596038 | 21596043 | + |
| SEQ ID NO 23516 | CAAGGTAGACCATATGATAGGC | CTC | chr12 | 21596023 | 21596044 | 21596040 | 21596045 | + |
| SEQ ID NO 23517 | AATAAATTTACTAACAGACCAA | CTC | chr12 | 21596060 | 21596081 | 21596077 | 21596082 | + |
| SEQ ID NO 23518 | ACTAACAGACCAATAACAAGCA | TTT | chr12 | 21596069 | 21596090 | 21596086 | 21596091 | + |
| SEQ ID NO 23519 | CTAACAGACCAATAACAAGCAG | TTA | chr12 | 21596070 | 21596091 | 21596087 | 21596092 | + |
| SEQ ID NO 23520 | ACAGACCAATAACAAGCAGTGA | CTA | chr12 | 21596073 | 21596094 | 21596090 | 21596095 | + |
| SEQ ID NO 23521 | AATTGGTAATTAAAAAATTACC | TTT | chr12 | 21596100 | 21596121 | 21596117 | 21596122 | + |
| SEQ ID NO 23522 | ATTGGTAATTAAAAAATTACCA | TTA | chr12 | 21596101 | 21596122 | 21596118 | 21596123 | + |
| SEQ ID NO 23523 | GTAATTAAAAAATTACCAACCA | TTG | chr12 | 21596105 | 21596126 | 21596122 | 21596127 | + |
| SEQ ID NO 23524 | AAAAATTACCAACCAAAAAAAA | TTA | chr12 | 21596112 | 21596133 | 21596129 | 21596134 | + |
| SEQ ID NO 23525 | CCAACCAAAAAAAAGTTCAGGA | TTA | chr12 | 21596120 | 21596141 | 21596137 | 21596142 | + |
| SEQ ID NO 23526 | AGGACCAGATGGATTCACAACA | TTC | chr12 | 21596138 | 21596159 | 21596155 | 21596160 | + |
| SEQ ID NO 23527 | ACAACAGAATTCTACTAGACAT | TTC | chr12 | 21596154 | 21596175 | 21596171 | 21596176 | + |
| SEQ ID NO 23528 | TACTAGACATTCAAAGAGGAAT | TTC | chr12 | 21596166 | 21596187 | 21596183 | 21596188 | + |
| SEQ ID NO 23529 | CTAGACATTCAAAGAGGAATTG | CTA | chr12 | 21596168 | 21596189 | 21596185 | 21596190 | + |
| SEQ ID NO 23530 | GACATTCAAAGAGGAATTGGTC | CTA | chr12 | 21596171 | 21596192 | 21596188 | 21596193 | + |
| SEQ ID NO 23531 | AAAGAGGAATTGGTCCCCATCT | TTC | chr12 | 21596178 | 21596199 | 21596195 | 21596200 | + |
| SEQ ID NO 23532 | GTCCCCATCTTTTTGACACTAT | TTG | chr12 | 21596190 | 21596211 | 21596207 | 21596212 | + |
| SEQ ID NO 23533 | TTTGACACTATTCTACAAGACA | CTT | chr12 | 21596201 | 21596222 | 21596218 | 21596223 | + |
| SEQ ID NO 23534 | TTGACACTATTCTACAAGACAG | TTT | chr12 | 21596202 | 21596223 | 21596219 | 21596224 | + |
| SEQ ID NO 23535 | TGACACTATTCTACAAGACAGA | TTT | chr12 | 21596203 | 21596224 | 21596220 | 21596225 | + |
| SEQ ID NO 23536 | GACACTATTCTACAAGACAGAT | TTT | chr12 | 21596204 | 21596225 | 21596221 | 21596226 | + |
| SEQ ID NO 23537 | ACACTATTCTACAAGACAGATA | TTG | chr12 | 21596205 | 21596226 | 21596222 | 21596227 | + |
| SEQ ID NO 23538 | TTCTACAAGACAGATAAAGAAG | CTA | chr12 | 21596211 | 21596232 | 21596228 | 21596233 | + |
| SEQ ID NO 23539 | TACAAGACAGATAAAGAAGGAA | TTC | chr12 | 21596214 | 21596235 | 21596231 | 21596236 | + |
| SEQ ID NO 23540 | CAAGACAGATAAAGAAGGAACC | CTA | chr12 | 21596216 | 21596237 | 21596233 | 21596238 | + |
| SEQ ID NO 23541 | CCCTAATTCATTCTATGAAGCC | CTG | chr12 | 21596240 | 21596261 | 21596257 | 21596262 | + |
| SEQ ID NO 23542 | ATTCATTCTATGAAGCCAGCAT | CTA | chr12 | 21596245 | 21596266 | 21596262 | 21596267 | + |
| SEQ ID NO 23543 | ATTCTATGAAGCCAGCATCACA | TTC | chr12 | 21596249 | 21596270 | 21596266 | 21596271 | + |
| SEQ ID NO 23544 | TATGAAGCCAGCATCACACCAA | TTC | chr12 | 21596253 | 21596274 | 21596270 | 21596275 | + |
| SEQ ID NO 23545 | TGAAGCCAGCATCACACCAAAA | CTA | chr12 | 21596255 | 21596276 | 21596272 | 21596277 | + |
| SEQ ID NO 23546 | CAGACTGATAGCCTTGATGAAC | CTA | chr12 | 21596309 | 21596330 | 21596326 | 21596331 | + |
| SEQ ID NO 23547 | ATAGCCTTGATGAACATAGATG | CTG | chr12 | 21596316 | 21596337 | 21596333 | 21596338 | + |
| SEQ ID NO 23548 | GATGAACATAGATGCTAAAATC | CTT | chr12 | 21596324 | 21596345 | 21596341 | 21596346 | + |
| SEQ ID NO 23549 | ATGAACATAGATGCTAAAATCC | TTG | chr12 | 21596325 | 21596346 | 21596342 | 21596347 | + |
| SEQ ID NO 23550 | AAATCCTTAACAAAATACTAGA | CTA | chr12 | 21596341 | 21596362 | 21596358 | 21596363 | + |
| SEQ ID NO 23551 | AACAAAATACTAGATAACCAAA | CTT | chr12 | 21596349 | 21596370 | 21596366 | 21596371 | + |
| SEQ ID NO 23552 | ACAAAATACTAGATAACCAAAT | TTA | chr12 | 21596350 | 21596371 | 21596367 | 21596372 | + |
| SEQ ID NO 23553 | GATAACCAAATTCAACAACATA | CTA | chr12 | 21596361 | 21596382 | 21596378 | 21596383 | + |
| SEQ ID NO 23554 | AACAACATAACAAAAAGATAAT | TTC | chr12 | 21596374 | 21596395 | 21596391 | 21596396 | + |
| SEQ ID NO 23555 | CATGCCAGGGATGCAGGGTTGG | TTC | chr12 | 21596417 | 21596438 | 21596434 | 21596439 | + |
| SEQ ID NO 23556 | GTTTGACATCTGCAAGTCAATA | TTG | chr12 | 21596438 | 21596459 | 21596455 | 21596460 | + |
| SEQ ID NO 23557 | GACATCTGCAAGTCAATAAGTG | TTT | chr12 | 21596442 | 21596463 | 21596459 | 21596464 | + |

Figure 48 (Cont'd)

| | | | | | | | | |
|---|---|---|---|---|---|---|---|---|
| SEQ ID NO 23558 | ACATCTGCAAGTCAATAAGTGT | TTG | chr12 | 21596443 | 21596464 | 21596460 | 21596465 | + |
| SEQ ID NO 23559 | CAAGTCAATAAGTGTGATACAC | CTG | chr12 | 21596450 | 21596471 | 21596467 | 21596472 | + |
| SEQ ID NO 23560 | AAAAACAAAAATTACATGATCA | TTT | chr12 | 21596487 | 21596508 | 21596504 | 21596509 | + |
| SEQ ID NO 23561 | AAAACAAAAATTACATGATCAT | TTA | chr12 | 21596488 | 21596509 | 21596505 | 21596510 | + |
| SEQ ID NO 23562 | CATGATCATCTCAATAGATGCA | TTA | chr12 | 21596501 | 21596522 | 21596518 | 21596523 | + |
| SEQ ID NO 23563 | AATAGATGCAGAAAAAGCATTC | CTC | chr12 | 21596513 | 21596534 | 21596530 | 21596535 | + |
| SEQ ID NO 23564 | AACAAAATCCAGCATACATTTA | TTC | chr12 | 21596535 | 21596556 | 21596552 | 21596557 | + |
| SEQ ID NO 23565 | ATGATTAAAATGCTCAGCAAAA | TTT | chr12 | 21596556 | 21596577 | 21596573 | 21596578 | + |
| SEQ ID NO 23566 | TGATTAAAATGCTCAGCAAAAT | TTA | chr12 | 21596557 | 21596578 | 21596574 | 21596579 | + |
| SEQ ID NO 23567 | AAATGCTCAGCAAAATCAGCAT | TTA | chr12 | 21596563 | 21596584 | 21596580 | 21596585 | + |
| SEQ ID NO 23568 | AGCAAAATCAGCATACAAGAGA | CTC | chr12 | 21596571 | 21596592 | 21596588 | 21596593 | + |
| SEQ ID NO 23569 | AGTGTAATAAAAGCCATCTGTG | CTC | chr12 | 21596601 | 21596622 | 21596618 | 21596623 | + |
| SEQ ID NO 23570 | TGACAAACCCACAGCCAACATA | CTG | chr12 | 21596621 | 21596642 | 21596638 | 21596643 | + |
| SEQ ID NO 23571 | AATGGGGAAAAGTTGAAAGCAT | TTG | chr12 | 21596649 | 21596670 | 21596666 | 21596671 | + |
| SEQ ID NO 23572 | AAAGCATTCCCTCTGAGAACTG | TTG | chr12 | 21596664 | 21596685 | 21596681 | 21596686 | + |
| SEQ ID NO 23573 | CCTCTGAGAACTGGAACAAGAC | TTC | chr12 | 21596673 | 21596694 | 21596690 | 21596695 | + |
| SEQ ID NO 23574 | TGAGAACTGGAACAAGACAAGG | CTC | chr12 | 21596677 | 21596698 | 21596694 | 21596699 | + |
| SEQ ID NO 23575 | AGAACTGGAACAAGACAAGGAT | CTG | chr12 | 21596679 | 21596700 | 21596696 | 21596701 | + |
| SEQ ID NO 23576 | GAACAAGACAAGGATGCCCACT | CTG | chr12 | 21596686 | 21596707 | 21596703 | 21596708 | + |
| SEQ ID NO 23577 | TCACCACTCCTCTTCAACATAG | CTC | chr12 | 21596709 | 21596730 | 21596726 | 21596731 | + |
| SEQ ID NO 23578 | ACCACTCCTCTTCAACATAGTA | CTC | chr12 | 21596711 | 21596732 | 21596728 | 21596733 | + |
| SEQ ID NO 23579 | CTCTTCAACATAGTACTGGAAG | CTC | chr12 | 21596718 | 21596739 | 21596735 | 21596740 | + |
| SEQ ID NO 23580 | TTCAACATAGTACTGGAAGTCC | CTC | chr12 | 21596721 | 21596742 | 21596738 | 21596743 | + |
| SEQ ID NO 23581 | CAACATAGTACTGGAAGTCCTA | CTT | chr12 | 21596723 | 21596744 | 21596740 | 21596745 | + |
| SEQ ID NO 23582 | AACATAGTACTGGAAGTCCTAG | TTC | chr12 | 21596724 | 21596745 | 21596741 | 21596746 | + |
| SEQ ID NO 23583 | GAAGTCCTAGCCAGGGCAATCA | CTG | chr12 | 21596736 | 21596757 | 21596753 | 21596758 | + |
| SEQ ID NO 23584 | GCCAGGGCAATCAGACAAAACA | CTA | chr12 | 21596745 | 21596766 | 21596762 | 21596767 | + |
| SEQ ID NO 23585 | AAATCAGTAAAGAGGAAGTCAA | TTC | chr12 | 21596785 | 21596806 | 21596802 | 21596807 | + |
| SEQ ID NO 23586 | TCACTGTTTGCTGATGATATGA | CTG | chr12 | 21596811 | 21596832 | 21596828 | 21596833 | + |
| SEQ ID NO 23587 | TTTGCTGATGATATGATCATTT | CTG | chr12 | 21596817 | 21596838 | 21596834 | 21596839 | + |
| SEQ ID NO 23588 | GCTGATGATATGATCATTTACC | TTT | chr12 | 21596820 | 21596841 | 21596837 | 21596842 | + |
| SEQ ID NO 23589 | CTGATGATATGATCATTTACCT | TTG | chr12 | 21596821 | 21596842 | 21596838 | 21596843 | + |
| SEQ ID NO 23590 | ATGATATGATCATTTACCTTTA | CTG | chr12 | 21596824 | 21596845 | 21596841 | 21596846 | + |
| SEQ ID NO 23591 | ACCTTTAAAACCCTAAAGACTC | TTT | chr12 | 21596839 | 21596860 | 21596856 | 21596861 | + |
| SEQ ID NO 23592 | CCTTTAAAACCCTAAAGACTCC | TTA | chr12 | 21596840 | 21596861 | 21596857 | 21596862 | + |
| SEQ ID NO 23593 | TAAAACCCTAAAGACTCCTCCA | CTT | chr12 | 21596844 | 21596865 | 21596861 | 21596866 | + |
| SEQ ID NO 23594 | AAAACCCTAAAGACTCCTCCAG | TTT | chr12 | 21596845 | 21596866 | 21596862 | 21596867 | + |
| SEQ ID NO 23595 | AAACCCTAAAGACTCCTCCAGA | TTA | chr12 | 21596846 | 21596867 | 21596863 | 21596868 | + |
| SEQ ID NO 23596 | AAGACTCCTCCAGAAAGCTCCT | CTA | chr12 | 21596854 | 21596875 | 21596871 | 21596876 | + |
| SEQ ID NO 23597 | CTCCAGAAAGCTCCTAGAACTG | CTC | chr12 | 21596861 | 21596882 | 21596878 | 21596883 | + |
| SEQ ID NO 23598 | CAGAAAGCTCCTAGAACTGATA | CTC | chr12 | 21596864 | 21596885 | 21596881 | 21596886 | + |
| SEQ ID NO 23599 | CTAGAACTGATAAAATAATTCA | CTC | chr12 | 21596874 | 21596895 | 21596891 | 21596896 | + |
| SEQ ID NO 23600 | GAACTGATAAAATAATTCAGCA | CTA | chr12 | 21596877 | 21596898 | 21596894 | 21596899 | + |
| SEQ ID NO 23601 | ATAAAATAATTCAGCAAAGTTT | CTG | chr12 | 21596883 | 21596904 | 21596900 | 21596905 | + |
| SEQ ID NO 23602 | AGCAAAGTTTCCAGATACAAGA | TTC | chr12 | 21596895 | 21596916 | 21596912 | 21596917 | + |
| SEQ ID NO 23603 | CCAGATACAAGATGAATGCACA | TTT | chr12 | 21596905 | 21596926 | 21596922 | 21596927 | + |
| SEQ ID NO 23604 | CAGATACAAGATGAATGCACAC | TTC | chr12 | 21596906 | 21596927 | 21596923 | 21596928 | + |
| SEQ ID NO 23605 | TTCTATACACCAACAGCAACCA | CTC | chr12 | 21596941 | 21596962 | 21596958 | 21596963 | + |
| SEQ ID NO 23606 | CTATACACCAACAGCAACCAAA | CTT | chr12 | 21596943 | 21596964 | 21596960 | 21596965 | + |
| SEQ ID NO 23607 | TATACACCAACAGCAACCAAAT | TTC | chr12 | 21596944 | 21596965 | 21596961 | 21596966 | + |
| SEQ ID NO 23608 | TACACCAACAGCAACCAAATGG | CTA | chr12 | 21596946 | 21596967 | 21596963 | 21596968 | + |
| SEQ ID NO 23609 | AACCCCTTGTACAATAGATGCA | CTC | chr12 | 21596987 | 21597008 | 21597004 | 21597009 | + |
| SEQ ID NO 23610 | GTACAATAGATGCAAAAATGGC | CTT | chr12 | 21596995 | 21597016 | 21597012 | 21597017 | + |
| SEQ ID NO 23611 | TACAATAGATGCAAAAATGGCC | TTG | chr12 | 21596996 | 21597017 | 21597013 | 21597018 | + |
| SEQ ID NO 23612 | ATACAACCCCTATTTATTGCCA | CTA | chr12 | 21597020 | 21597041 | 21597037 | 21597042 | + |
| SEQ ID NO 23613 | TTTATTGCCATATAAAACGTAC | CTA | chr12 | 21597032 | 21597053 | 21597049 | 21597054 | + |
| SEQ ID NO 23614 | ATTGCCATATAAAACGTACTCT | TTT | chr12 | 21597035 | 21597056 | 21597052 | 21597057 | + |
| SEQ ID NO 23615 | TTGCCATATAAAACGTACTCTC | TTA | chr12 | 21597036 | 21597057 | 21597053 | 21597058 | + |

Figure 48 (Cont'd)

| | | | | | | | | |
|---|---|---|---|---|---|---|---|---|
| SEQ ID NO 23616 | CCATATAAAACGTACTCTCAAG | TTG | chr12 | 21597039 | 21597060 | 21597056 | 21597061 | + |
| SEQ ID NO 23617 | TCAAGATGGATTAAAGACTTAA | CTC | chr12 | 21597056 | 21597077 | 21597073 | 21597078 | + |
| SEQ ID NO 23618 | AAGATGGATTAAAGACTTAAAT | CTC | chr12 | 21597058 | 21597079 | 21597075 | 21597080 | + |
| SEQ ID NO 23619 | AAGACTTAAATATAAAACTTAA | TTA | chr12 | 21597069 | 21597090 | 21597086 | 21597091 | + |
| SEQ ID NO 23620 | AAATATAAAACTTAAAACTATA | CTT | chr12 | 21597076 | 21597097 | 21597093 | 21597098 | + |
| SEQ ID NO 23621 | AATATAAAACTTAAAACTATAA | TTA | chr12 | 21597077 | 21597098 | 21597094 | 21597099 | + |
| SEQ ID NO 23622 | AAAACTATAAAACTACTAAAAG | CTT | chr12 | 21597089 | 21597110 | 21597106 | 21597111 | + |
| SEQ ID NO 23623 | AAACTATAAAACTACTAAAAGA | TTA | chr12 | 21597090 | 21597111 | 21597107 | 21597112 | + |
| SEQ ID NO 23624 | TAAAACTACTAAAAGAAAACAT | CTA | chr12 | 21597096 | 21597117 | 21597113 | 21597118 | + |
| SEQ ID NO 23625 | CTAAAAGAAAACATAAGGGAGA | CTA | chr12 | 21597104 | 21597125 | 21597121 | 21597126 | + |
| SEQ ID NO 23626 | AAAGAAAACATAAGGGAGACAC | CTA | chr12 | 21597107 | 21597128 | 21597124 | 21597129 | + |
| SEQ ID NO 23627 | CAAGACATGGCTTTGGGCAAAG | CTT | chr12 | 21597131 | 21597152 | 21597148 | 21597153 | + |
| SEQ ID NO 23628 | AAGACATGGCTTTGGGCAAAGA | TTC | chr12 | 21597132 | 21597153 | 21597149 | 21597154 | + |
| SEQ ID NO 23629 | TGGGCAAAGATTTTATGGCCAA | CTT | chr12 | 21597144 | 21597165 | 21597161 | 21597166 | + |
| SEQ ID NO 23630 | GGGCAAAGATTTTATGGCCAAG | TTT | chr12 | 21597145 | 21597166 | 21597162 | 21597167 | + |
| SEQ ID NO 23631 | GGCAAAGATTTTATGGCCAAGA | TTG | chr12 | 21597146 | 21597167 | 21597163 | 21597168 | + |
| SEQ ID NO 23632 | TATGGCCAAGACCTCAAAAGCA | TTT | chr12 | 21597157 | 21597178 | 21597174 | 21597179 | + |
| SEQ ID NO 23633 | ATGGCCAAGACCTCAAAAGCAC | TTT | chr12 | 21597158 | 21597179 | 21597175 | 21597180 | + |
| SEQ ID NO 23634 | TGGCCAAGACCTCAAAAGCACA | TTA | chr12 | 21597159 | 21597180 | 21597176 | 21597181 | + |
| SEQ ID NO 23635 | AAAAGCACAGGCAACAAAAGCA | CTC | chr12 | 21597172 | 21597193 | 21597189 | 21597194 | + |
| SEQ ID NO 23636 | TATTAAGCTAAAATACATCTGC | CTA | chr12 | 21597214 | 21597235 | 21597231 | 21597236 | + |
| SEQ ID NO 23637 | AGCTAAAATACATCTGCACAGT | TTA | chr12 | 21597219 | 21597240 | 21597236 | 21597241 | + |
| SEQ ID NO 23638 | AAATACATCTGCACAGTAAAGG | CTA | chr12 | 21597224 | 21597245 | 21597241 | 21597246 | + |
| SEQ ID NO 23639 | CACAGTAAAGGAAACAATCAAC | CTG | chr12 | 21597235 | 21597256 | 21597252 | 21597257 | + |
| SEQ ID NO 23640 | TTGAATGCGAGAAAATATTTGC | CTG | chr12 | 21597276 | 21597297 | 21597293 | 21597298 | + |
| SEQ ID NO 23641 | AATGCGAGAAAATATTTGCATA | TTG | chr12 | 21597279 | 21597300 | 21597296 | 21597301 | + |
| SEQ ID NO 23642 | GCATACATTTGACAAGGAATTA | TTT | chr12 | 21597296 | 21597317 | 21597313 | 21597318 | + |
| SEQ ID NO 23643 | CATACATTTGACAAGGAATTAA | TTG | chr12 | 21597297 | 21597318 | 21597314 | 21597319 | + |
| SEQ ID NO 23644 | GACAAGGAATTAATCTCCAGAA | TTT | chr12 | 21597306 | 21597327 | 21597323 | 21597328 | + |
| SEQ ID NO 23645 | ACAAGGAATTAATCTCCAGAAT | TTG | chr12 | 21597307 | 21597328 | 21597324 | 21597329 | + |
| SEQ ID NO 23646 | ATCTCCAGAATATATAAGAAAC | TTA | chr12 | 21597318 | 21597339 | 21597335 | 21597340 | + |
| SEQ ID NO 23647 | CAGAATATATAAGAAACTCAAA | CTC | chr12 | 21597323 | 21597344 | 21597340 | 21597345 | + |
| SEQ ID NO 23648 | AAACAACTCAACAGTGGAAAAA | CTC | chr12 | 21597342 | 21597363 | 21597359 | 21597364 | + |
| SEQ ID NO 23649 | AACAGTGGAAAAACAAATAATC | CTC | chr12 | 21597351 | 21597372 | 21597368 | 21597373 | + |
| SEQ ID NO 23650 | ATTAAAAAATTGGCAAAGGATA | CTC | chr12 | 21597375 | 21597396 | 21597392 | 21597397 | + |
| SEQ ID NO 23651 | AAAAATTGGCAAAGGATATTTT | TTA | chr12 | 21597379 | 21597400 | 21597396 | 21597401 | + |
| SEQ ID NO 23652 | GCAAAGGATATTTTCAAAAGA | TTG | chr12 | 21597387 | 21597408 | 21597404 | 21597409 | + |
| SEQ ID NO 23653 | TTCAAAAGAAGACATACAAATG | TTT | chr12 | 21597400 | 21597421 | 21597417 | 21597422 | + |
| SEQ ID NO 23654 | TCAAAAGAAGACATACAAATGC | TTT | chr12 | 21597401 | 21597422 | 21597418 | 21597423 | + |
| SEQ ID NO 23655 | CAAAAGAAGACATACAAATGCA | TTT | chr12 | 21597402 | 21597423 | 21597419 | 21597424 | + |
| SEQ ID NO 23656 | AAAAGAAGACATACAAATGCAC | TTC | chr12 | 21597403 | 21597424 | 21597420 | 21597425 | + |
| SEQ ID NO 23657 | CTCAACATTACTAATCATCAGA | TTG | chr12 | 21597444 | 21597465 | 21597461 | 21597466 | + |
| SEQ ID NO 23658 | AACATTACTAATCATCAGAGAA | CTC | chr12 | 21597447 | 21597468 | 21597464 | 21597469 | + |
| SEQ ID NO 23659 | CTAATCATCAGAGAAATGCAAA | TTA | chr12 | 21597454 | 21597475 | 21597471 | 21597476 | + |
| SEQ ID NO 23660 | ATCATCAGAGAAATGCAAATCA | CTA | chr12 | 21597457 | 21597478 | 21597474 | 21597479 | + |
| SEQ ID NO 23661 | ATGCCAGTTAGAATCATCATGA | CTT | chr12 | 21597502 | 21597523 | 21597519 | 21597524 | + |
| SEQ ID NO 23662 | TGCCAGTTAGAATCATCATGAT | TTA | chr12 | 21597503 | 21597524 | 21597520 | 21597525 | + |
| SEQ ID NO 23663 | GAATCATCATGATTTAAATAAA | TTA | chr12 | 21597512 | 21597533 | 21597529 | 21597534 | + |
| SEQ ID NO 23664 | AAATAAATTAATAAATAAATAA | TTT | chr12 | 21597527 | 21597548 | 21597544 | 21597549 | + |
| SEQ ID NO 23665 | AATAAATTAATAAATAAATAAC | TTA | chr12 | 21597528 | 21597549 | 21597545 | 21597550 | + |
| SEQ ID NO 23666 | ATAAATAAATAACACATGCTGG | TTA | chr12 | 21597537 | 21597558 | 21597554 | 21597559 | + |
| SEQ ID NO 23667 | GCAAGGATGTGAAGGAAAAGGC | CTG | chr12 | 21597558 | 21597579 | 21597575 | 21597580 | + |
| SEQ ID NO 23668 | GTAGGCACTATTGGTAAGCATG | CTC | chr12 | 21597584 | 21597605 | 21597601 | 21597606 | + |
| SEQ ID NO 23669 | TTGGTAAGCATGCAAATTAGTA | CTA | chr12 | 21597594 | 21597615 | 21597611 | 21597616 | + |
| SEQ ID NO 23670 | GTAAGCATGCAAATTAGTATAG | TTG | chr12 | 21597597 | 21597618 | 21597614 | 21597619 | + |
| SEQ ID NO 23671 | GTATAGCCACTATGGAAAACAA | TTA | chr12 | 21597613 | 21597634 | 21597630 | 21597635 | + |
| SEQ ID NO 23672 | TGGAAAACAATATGTAGATTTA | CTA | chr12 | 21597625 | 21597646 | 21597642 | 21597647 | + |
| SEQ ID NO 23673 | ACCAAAAAGCTAAAAATTGAAC | TTT | chr12 | 21597646 | 21597667 | 21597663 | 21597668 | + |

Figure 48 (Cont'd)

| SEQ ID NO | Sequence | | | | | | |
|---|---|---|---|---|---|---|---|
| SEQ ID NO 23674 | CCAAAAAGCTAAAAATTGAACT | TTA | chr12 | 21597647 | 21597668 | 21597664 | 21597669 | + |
| SEQ ID NO 23675 | AAAATTGAACTATCATAAGATC | CTA | chr12 | 21597658 | 21597679 | 21597675 | 21597680 | + |
| SEQ ID NO 23676 | AACTATCATAAGATCCAGCAAT | TTG | chr12 | 21597665 | 21597686 | 21597682 | 21597687 | + |
| SEQ ID NO 23677 | TCATAAGATCCAGCAATCTTAT | CTA | chr12 | 21597670 | 21597691 | 21597687 | 21597692 | + |
| SEQ ID NO 23678 | ATTACTGGGTATTTATCCAAAG | CTT | chr12 | 21597690 | 21597711 | 21597707 | 21597712 | + |
| SEQ ID NO 23679 | TTACTGGGTATTTATCCAAAGG | TTA | chr12 | 21597691 | 21597712 | 21597708 | 21597713 | + |
| SEQ ID NO 23680 | CTGGGTATTTATCCAAAGGAAA | TTA | chr12 | 21597694 | 21597715 | 21597711 | 21597716 | + |
| SEQ ID NO 23681 | GGTATTTATCCAAAGGAAAAGA | CTG | chr12 | 21597697 | 21597718 | 21597714 | 21597719 | + |
| SEQ ID NO 23682 | ATCCAAAGGAAAAGAATTCAGA | TTT | chr12 | 21597704 | 21597725 | 21597721 | 21597726 | + |
| SEQ ID NO 23683 | TCCAAAGGAAAAGAATTCAGAA | TTA | chr12 | 21597705 | 21597726 | 21597722 | 21597727 | + |
| SEQ ID NO 23684 | AGAATAATAAACAGATACTGGT | TTC | chr12 | 21597723 | 21597744 | 21597740 | 21597745 | + |
| SEQ ID NO 23685 | GTACCACACTGTTTATTGCAGC | CTG | chr12 | 21597743 | 21597764 | 21597760 | 21597765 | + |
| SEQ ID NO 23686 | TTTATTGCAGCACGATTCACAT | CTG | chr12 | 21597754 | 21597775 | 21597771 | 21597776 | + |
| SEQ ID NO 23687 | ATTGCAGCACGATTCACATTAG | TTT | chr12 | 21597757 | 21597778 | 21597774 | 21597779 | + |
| SEQ ID NO 23688 | TTGCAGCACGATTCACATTAGC | TTA | chr12 | 21597758 | 21597779 | 21597775 | 21597780 | + |
| SEQ ID NO 23689 | CAGCACGATTCACATTAGCAAA | TTG | chr12 | 21597761 | 21597782 | 21597778 | 21597783 | + |
| SEQ ID NO 23690 | ACATTAGCAAAGATATGGAATC | TTC | chr12 | 21597772 | 21597793 | 21597789 | 21597794 | + |
| SEQ ID NO 23691 | GCAAAGATATGGAATCAACCTA | TTA | chr12 | 21597778 | 21597799 | 21597795 | 21597800 | + |
| SEQ ID NO 23692 | AGTGTCCATCAATGGATGAATG | CTA | chr12 | 21597800 | 21597821 | 21597817 | 21597822 | + |
| SEQ ID NO 23693 | AATATTATTCAACCATACAAAT | TTG | chr12 | 21597850 | 21597871 | 21597867 | 21597872 | + |
| SEQ ID NO 23694 | TTCAACCATACAAATATAAAAT | TTA | chr12 | 21597857 | 21597878 | 21597874 | 21597879 | + |
| SEQ ID NO 23695 | AACCATACAAATATAAAATCAT | TTC | chr12 | 21597860 | 21597881 | 21597877 | 21597882 | + |
| SEQ ID NO 23696 | CATTTGCAGCAACATGGATGAA | TTT | chr12 | 21597884 | 21597905 | 21597901 | 21597906 | + |
| SEQ ID NO 23697 | ATTTGCAGCAACATGGATGAAA | TTC | chr12 | 21597885 | 21597906 | 21597902 | 21597907 | + |
| SEQ ID NO 23698 | GCAGCAACATGGATGAAACTGG | TTT | chr12 | 21597889 | 21597910 | 21597906 | 21597911 | + |
| SEQ ID NO 23699 | CAGCAACATGGATGAAACTGGA | TTG | chr12 | 21597890 | 21597911 | 21597907 | 21597912 | + |
| SEQ ID NO 23700 | GAAGTCATTATGTTAAACGAAA | CTG | chr12 | 21597910 | 21597931 | 21597927 | 21597932 | + |
| SEQ ID NO 23701 | TGTTAAACGAAATAAGCCAGGC | TTA | chr12 | 21597920 | 21597941 | 21597937 | 21597942 | + |
| SEQ ID NO 23702 | AACGAAATAAGCCAGGCATAGA | TTA | chr12 | 21597925 | 21597946 | 21597942 | 21597947 | + |
| SEQ ID NO 23703 | TGCATGTTCTCACTGATATGTG | TTT | chr12 | 21597958 | 21597979 | 21597975 | 21597980 | + |
| SEQ ID NO 23704 | GCATGTTCTCACTGATATGTGG | TTT | chr12 | 21597959 | 21597980 | 21597976 | 21597981 | + |
| SEQ ID NO 23705 | CATGTTCTCACTGATATGTGGG | TTG | chr12 | 21597960 | 21597981 | 21597977 | 21597982 | + |
| SEQ ID NO 23706 | TCACTGATATGTGGGAGCTAAA | TTC | chr12 | 21597967 | 21597988 | 21597984 | 21597989 | + |
| SEQ ID NO 23707 | ACTGATATGTGGGAGCTAAAAA | CTC | chr12 | 21597969 | 21597990 | 21597986 | 21597991 | + |
| SEQ ID NO 23708 | ATATGTGGGAGCTAAAAAGTT | CTG | chr12 | 21597973 | 21597994 | 21597990 | 21597995 | + |
| SEQ ID NO 23709 | AAAAGTTAATATCATGTAGGT | CTA | chr12 | 21597987 | 21598008 | 21598004 | 21598009 | + |
| SEQ ID NO 23710 | ATATCATGTAGGTAGAGAGTAG | TTA | chr12 | 21597996 | 21598017 | 21598013 | 21598018 | + |
| SEQ ID NO 23711 | TGGGAGGAAGGGAGACGAAGAG | TTA | chr12 | 21598057 | 21598078 | 21598074 | 21598079 | + |
| SEQ ID NO 23712 | GTTAATGGAAACAGGCAGTTAG | TTG | chr12 | 21598085 | 21598106 | 21598102 | 21598107 | + |
| SEQ ID NO 23713 | ATGGAAACAGGCAGTTAGATAG | TTA | chr12 | 21598089 | 21598110 | 21598106 | 21598111 | + |
| SEQ ID NO 23714 | GATAGAAGGAATATGTTCTGAT | TTA | chr12 | 21598106 | 21598127 | 21598123 | 21598128 | + |
| SEQ ID NO 23715 | TGATGTTCAATAGCAAAGTAGG | TTC | chr12 | 21598124 | 21598145 | 21598141 | 21598146 | + |
| SEQ ID NO 23716 | ATGTTCAATAGCAAAGTAGGGT | CTG | chr12 | 21598126 | 21598147 | 21598143 | 21598148 | + |
| SEQ ID NO 23717 | AATAGCAAAGTAGGGTGATTAT | TTC | chr12 | 21598132 | 21598153 | 21598149 | 21598154 | + |
| SEQ ID NO 23718 | TAGTTAAAAACAATATATTGTA | TTA | chr12 | 21598153 | 21598174 | 21598170 | 21598175 | + |
| SEQ ID NO 23719 | AAAACAATATATTGTATATTTC | TTA | chr12 | 21598159 | 21598180 | 21598176 | 21598181 | + |
| SEQ ID NO 23720 | TATATTTCAAAATAGTAGAAGA | TTG | chr12 | 21598173 | 21598194 | 21598190 | 21598195 | + |
| SEQ ID NO 23721 | CAAAATAGTAGAAGAAAGGTCT | TTT | chr12 | 21598180 | 21598201 | 21598197 | 21598202 | + |
| SEQ ID NO 23722 | AAAATAGTAGAAGAAAGGTCTT | TTC | chr12 | 21598181 | 21598202 | 21598198 | 21598203 | + |
| SEQ ID NO 23723 | GAAATGTTCCTAACACATAGAA | CTT | chr12 | 21598203 | 21598224 | 21598220 | 21598225 | + |
| SEQ ID NO 23724 | AAATGTTCCTAACACATAGAAA | TTG | chr12 | 21598204 | 21598225 | 21598221 | 21598226 | + |
| SEQ ID NO 23725 | CTAACACATAGAAACGATAAAT | TTC | chr12 | 21598212 | 21598233 | 21598229 | 21598234 | + |
| SEQ ID NO 23726 | ACACATAGAAACGATAAATACT | CTA | chr12 | 21598215 | 21598236 | 21598232 | 21598237 | + |
| SEQ ID NO 23727 | GAGGTGATGAATACCCCAAATA | CTT | chr12 | 21598238 | 21598259 | 21598255 | 21598260 | + |
| SEQ ID NO 23728 | AGGTGATGAATACCCCAAATAC | TTG | chr12 | 21598239 | 21598260 | 21598256 | 21598261 | + |
| SEQ ID NO 23729 | ACTTGATCATTATACATTATAT | CTG | chr12 | 21598264 | 21598285 | 21598281 | 21598286 | + |
| SEQ ID NO 23730 | GATCATTATACATTATATGCAT | CTT | chr12 | 21598268 | 21598289 | 21598285 | 21598290 | + |
| SEQ ID NO 23731 | ATCATTATACATTATATGCATG | TTG | chr12 | 21598269 | 21598290 | 21598286 | 21598291 | + |

Figure 48 (Cont'd)

| SEQ ID NO 23732 | TACATTATATGCATGTAACAAA | TTA | chr12 | 21598276 | 21598297 | 21598293 | 21598298 | + |
|---|---|---|---|---|---|---|---|---|
| SEQ ID NO 23733 | TATGCATGTAACAAAATGTCAC | TTA | chr12 | 21598283 | 21598304 | 21598300 | 21598305 | + |
| SEQ ID NO 23734 | ATACATATAAACACGTCATATA | CTG | chr12 | 21598314 | 21598335 | 21598331 | 21598336 | + |
| SEQ ID NO 23735 | ATATTGGTTGAGGCCTGATTGT | CTC | chr12 | 21598358 | 21598379 | 21598375 | 21598380 | + |
| SEQ ID NO 23736 | GTTGAGGCCTGATTGTAAGTAA | TTG | chr12 | 21598364 | 21598385 | 21598381 | 21598386 | + |
| SEQ ID NO 23737 | AGGCCTGATTGTAAGTAAATCT | TTG | chr12 | 21598368 | 21598389 | 21598385 | 21598390 | + |
| SEQ ID NO 23738 | ATTGTAAGTAAATCTTTGTCCC | CTG | chr12 | 21598375 | 21598396 | 21598392 | 21598397 | + |
| SEQ ID NO 23739 | TAAGTAAATCTTTGTCCCTCCA | TTG | chr12 | 21598379 | 21598400 | 21598396 | 21598401 | + |
| SEQ ID NO 23740 | TGTCCCTCCAGACATTTCCCTG | CTT | chr12 | 21598391 | 21598412 | 21598408 | 21598413 | + |
| SEQ ID NO 23741 | GTCCCTCCAGACATTTCCCTGT | TTT | chr12 | 21598392 | 21598413 | 21598409 | 21598414 | + |
| SEQ ID NO 23742 | TCCCTCCAGACATTTCCCTGTA | TTG | chr12 | 21598393 | 21598414 | 21598410 | 21598415 | + |
| SEQ ID NO 23743 | CAGACATTTCCCTGTACTGTCT | CTC | chr12 | 21598399 | 21598420 | 21598416 | 21598421 | + |
| SEQ ID NO 23744 | CCCTGTACTGTCTTGCTGTGAG | TTT | chr12 | 21598408 | 21598429 | 21598425 | 21598430 | + |
| SEQ ID NO 23745 | CCTGTACTGTCTTGCTGTGAGG | TTC | chr12 | 21598409 | 21598430 | 21598426 | 21598431 | + |
| SEQ ID NO 23746 | TACTGTCTTGCTGTGAGGAGCT | CTG | chr12 | 21598413 | 21598434 | 21598430 | 21598435 | + |
| SEQ ID NO 23747 | TCTTGCTGTGAGGAGCTTCTTT | CTG | chr12 | 21598418 | 21598439 | 21598435 | 21598440 | + |
| SEQ ID NO 23748 | GCTGTGAGGAGCTTCTTTTACT | CTT | chr12 | 21598422 | 21598443 | 21598439 | 21598444 | + |
| SEQ ID NO 23749 | CTGTGAGGAGCTTCTTTTACTG | TTG | chr12 | 21598423 | 21598444 | 21598440 | 21598445 | + |
| SEQ ID NO 23750 | TGAGGAGCTTCTTTTACTGCTA | CTG | chr12 | 21598426 | 21598447 | 21598443 | 21598448 | + |
| SEQ ID NO 23751 | CTTTTACTGCTATTTCTTATAT | CTT | chr12 | 21598436 | 21598457 | 21598453 | 21598458 | + |
| SEQ ID NO 23752 | TTTTACTGCTATTTCTTATATT | TTC | chr12 | 21598437 | 21598458 | 21598454 | 21598459 | + |
| SEQ ID NO 23753 | TTACTGCTATTTCTTATATTCC | CTT | chr12 | 21598439 | 21598460 | 21598456 | 21598461 | + |
| SEQ ID NO 23754 | TACTGCTATTTCTTATATTCCA | TTT | chr12 | 21598440 | 21598461 | 21598457 | 21598462 | + |
| SEQ ID NO 23755 | ACTGCTATTTCTTATATTCCAA | TTT | chr12 | 21598441 | 21598462 | 21598458 | 21598463 | + |
| SEQ ID NO 23756 | CTGCTATTTCTTATATTCCAAC | TTA | chr12 | 21598442 | 21598463 | 21598459 | 21598464 | + |
| SEQ ID NO 23757 | CTATTTCTTATATTCCAACACC | CTG | chr12 | 21598445 | 21598466 | 21598462 | 21598467 | + |
| SEQ ID NO 23758 | TTTCTTATATTCCAACACCATT | CTA | chr12 | 21598448 | 21598469 | 21598465 | 21598470 | + |
| SEQ ID NO 23759 | CTTATATTCCAACACCATTTTA | TTT | chr12 | 21598451 | 21598472 | 21598468 | 21598473 | + |
| SEQ ID NO 23760 | TTATATTCCAACACCATTTTAG | TTC | chr12 | 21598452 | 21598473 | 21598469 | 21598474 | + |
| SEQ ID NO 23761 | ATATTCCAACACCATTTTAGCC | CTT | chr12 | 21598454 | 21598475 | 21598471 | 21598476 | + |
| SEQ ID NO 23762 | TATTCCAACACCATTTTAGCCC | TTA | chr12 | 21598455 | 21598476 | 21598472 | 21598477 | + |
| SEQ ID NO 23763 | CAACACCATTTTAGCCCTTTTT | TTC | chr12 | 21598460 | 21598481 | 21598477 | 21598482 | + |
| SEQ ID NO 23764 | TAGCCCTTTTTGTCCTCCCCA | TTT | chr12 | 21598471 | 21598492 | 21598488 | 21598493 | + |
| SEQ ID NO 23765 | AGCCCTTTTTGTCCTCCCCAT | TTT | chr12 | 21598472 | 21598493 | 21598489 | 21598494 | + |
| SEQ ID NO 23766 | GCCCTTTTTGTCCTCCCCATA | TTA | chr12 | 21598473 | 21598494 | 21598490 | 21598495 | + |
| SEQ ID NO 23767 | TTTTGTCCTCCCCATATTTTTA | CTT | chr12 | 21598479 | 21598500 | 21598496 | 21598501 | + |
| SEQ ID NO 23768 | TTTGTCCTCCCCATATTTTTAC | TTT | chr12 | 21598480 | 21598501 | 21598497 | 21598502 | + |
| SEQ ID NO 23769 | TTGTCCTCCCCATATTTTTACC | TTT | chr12 | 21598481 | 21598502 | 21598498 | 21598503 | + |
| SEQ ID NO 23770 | TGTCCTCCCCATATTTTTACCT | TTT | chr12 | 21598482 | 21598503 | 21598499 | 21598504 | + |
| SEQ ID NO 23771 | GTCCTCCCCATATTTTTACCTC | TTT | chr12 | 21598483 | 21598504 | 21598500 | 21598505 | + |
| SEQ ID NO 23772 | TCCTCCCCATATTTTTACCTCG | TTG | chr12 | 21598484 | 21598505 | 21598501 | 21598506 | + |
| SEQ ID NO 23773 | CCCATATTTTTACCTCGGTTTT | CTC | chr12 | 21598489 | 21598510 | 21598506 | 21598511 | + |
| SEQ ID NO 23774 | TTACCTCGGTTTTTACTGTTTA | TTT | chr12 | 21598498 | 21598519 | 21598515 | 21598520 | + |
| SEQ ID NO 23775 | TACCTCGGTTTTTACTGTTTAT | TTT | chr12 | 21598499 | 21598520 | 21598516 | 21598521 | + |
| SEQ ID NO 23776 | ACCTCGGTTTTTACTGTTTATA | TTT | chr12 | 21598500 | 21598521 | 21598517 | 21598522 | + |
| SEQ ID NO 23777 | CCTCGGTTTTTACTGTTTATAT | TTA | chr12 | 21598501 | 21598522 | 21598518 | 21598523 | + |
| SEQ ID NO 23778 | GGTTTTTACTGTTTATATAGCA | CTC | chr12 | 21598505 | 21598526 | 21598522 | 21598527 | + |
| SEQ ID NO 23779 | TTACTGTTTATATAGCACACTT | TTT | chr12 | 21598510 | 21598531 | 21598527 | 21598532 | + |
| SEQ ID NO 23780 | TACTGTTTATATAGCACACTTT | TTT | chr12 | 21598511 | 21598532 | 21598528 | 21598533 | + |
| SEQ ID NO 23781 | ACTGTTTATATAGCACACTTTG | TTT | chr12 | 21598512 | 21598533 | 21598529 | 21598534 | + |
| SEQ ID NO 23782 | CTGTTTATATAGCACACTTTGT | TTA | chr12 | 21598513 | 21598534 | 21598530 | 21598535 | + |
| SEQ ID NO 23783 | TTTATATAGCACACTTTGTGCT | CTG | chr12 | 21598516 | 21598537 | 21598533 | 21598538 | + |
| SEQ ID NO 23784 | ATATAGCACACTTTGTGCTATA | TTT | chr12 | 21598519 | 21598540 | 21598536 | 21598541 | + |
| SEQ ID NO 23785 | TATAGCACACTTTGTGCTATAG | TTA | chr12 | 21598520 | 21598541 | 21598537 | 21598542 | + |
| SEQ ID NO 23786 | TGTGCTATAGTTTACCTCAGTT | CTT | chr12 | 21598532 | 21598553 | 21598549 | 21598554 | + |
| SEQ ID NO 23787 | GTGCTATAGTTTACCTCAGTTT | TTT | chr12 | 21598533 | 21598554 | 21598550 | 21598555 | + |
| SEQ ID NO 23788 | TGCTATAGTTTACCTCAGTTTT | TTG | chr12 | 21598534 | 21598555 | 21598551 | 21598556 | + |
| SEQ ID NO 23789 | TAGTTTACCTCAGTTTTTACTA | CTA | chr12 | 21598539 | 21598560 | 21598556 | 21598561 | + |

Figure 48 (Cont'd)

| SEQ ID NO 23790 | ACCTCAGTTTTTACTATTTATA | TTT | chr12 | 21598545 | 21598566 | 21598562 | 21598567 | + |
|---|---|---|---|---|---|---|---|---|
| SEQ ID NO 23791 | CCTCAGTTTTTACTATTTATAA | TTA | chr12 | 21598546 | 21598567 | 21598563 | 21598568 | + |
| SEQ ID NO 23792 | AGTTTTTACTATTTATAAAGCA | CTC | chr12 | 21598550 | 21598571 | 21598567 | 21598572 | + |
| SEQ ID NO 23793 | TTACTATTTATAAAGCACATTT | TTT | chr12 | 21598555 | 21598576 | 21598572 | 21598577 | + |
| SEQ ID NO 23794 | TACTATTTATAAAGCACATTTT | TTT | chr12 | 21598556 | 21598577 | 21598573 | 21598578 | + |
| SEQ ID NO 23795 | ACTATTTATAAAGCACATTTTG | TTT | chr12 | 21598557 | 21598578 | 21598574 | 21598579 | + |
| SEQ ID NO 23796 | CTATTTATAAAGCACATTTTGC | TTA | chr12 | 21598558 | 21598579 | 21598575 | 21598580 | + |
| SEQ ID NO 23797 | TTTATAAAGCACATTTTGCCCC | CTA | chr12 | 21598561 | 21598582 | 21598578 | 21598583 | + |
| SEQ ID NO 23798 | ATAAAGCACATTTTGCCCCAAA | TTT | chr12 | 21598564 | 21598585 | 21598581 | 21598586 | + |
| SEQ ID NO 23799 | TAAAGCACATTTTGCCCCAAAC | TTA | chr12 | 21598565 | 21598586 | 21598582 | 21598587 | + |
| SEQ ID NO 23800 | TGCCCCAAACTTCTCTCTTAAC | TTT | chr12 | 21598577 | 21598598 | 21598594 | 21598599 | + |
| SEQ ID NO 23801 | GCCCCAAACTTCTCTCTTAACA | TTT | chr12 | 21598578 | 21598599 | 21598595 | 21598600 | + |
| SEQ ID NO 23802 | CCCCAAACTTCTCTCTTAACAA | TTG | chr12 | 21598579 | 21598600 | 21598596 | 21598601 | + |
| SEQ ID NO 23803 | CTCTCTTAACAAGCTAGAATAT | CTT | chr12 | 21598589 | 21598610 | 21598606 | 21598611 | + |
| SEQ ID NO 23804 | TCTCTTAACAAGCTAGAATATA | TTC | chr12 | 21598590 | 21598611 | 21598607 | 21598612 | + |
| SEQ ID NO 23805 | TCTTAACAAGCTAGAATATAAG | CTC | chr12 | 21598592 | 21598613 | 21598609 | 21598614 | + |
| SEQ ID NO 23806 | TTAACAAGCTAGAATATAAGTG | CTC | chr12 | 21598594 | 21598615 | 21598611 | 21598616 | + |
| SEQ ID NO 23807 | AACAAGCTAGAATATAAGTGAA | CTT | chr12 | 21598596 | 21598617 | 21598613 | 21598618 | + |
| SEQ ID NO 23808 | ACAAGCTAGAATATAAGTGAAT | TTA | chr12 | 21598597 | 21598618 | 21598614 | 21598619 | + |
| SEQ ID NO 23809 | GAATATAAGTGAATGCAAGAGC | CTA | chr12 | 21598605 | 21598626 | 21598622 | 21598627 | + |
| SEQ ID NO 23810 | CTATTTTCATATTTGAGGTATA | TTC | chr12 | 21598645 | 21598666 | 21598662 | 21598667 | + |
| SEQ ID NO 23811 | TTTTCATATTTGAGGTATAAAC | CTA | chr12 | 21598648 | 21598669 | 21598665 | 21598670 | + |
| SEQ ID NO 23812 | TCATATTTGAGGTATAAACCAA | TTT | chr12 | 21598651 | 21598672 | 21598668 | 21598673 | + |
| SEQ ID NO 23813 | CATATTTGAGGTATAAACCAAG | TTT | chr12 | 21598652 | 21598673 | 21598669 | 21598674 | + |
| SEQ ID NO 23814 | ATATTTGAGGTATAAACCAAGG | TTC | chr12 | 21598653 | 21598674 | 21598670 | 21598675 | + |
| SEQ ID NO 23815 | GAGGTATAAACCAAGGAGATTT | TTT | chr12 | 21598659 | 21598680 | 21598676 | 21598681 | + |
| SEQ ID NO 23816 | AGGTATAAACCAAGGAGATTTA | TTG | chr12 | 21598660 | 21598681 | 21598677 | 21598682 | + |
| SEQ ID NO 23817 | ACATACACATATATATTTTTAA | TTT | chr12 | 21598681 | 21598702 | 21598698 | 21598703 | + |
| SEQ ID NO 23818 | CATACACATATATATTTTTAAA | TTA | chr12 | 21598682 | 21598703 | 21598699 | 21598704 | + |
| SEQ ID NO 23819 | TTAAATCTGCAAATAAATGGTT | TTT | chr12 | 21598699 | 21598720 | 21598716 | 21598721 | + |
| SEQ ID NO 23820 | TAAATCTGCAAATAAATGGTTT | TTT | chr12 | 21598700 | 21598721 | 21598717 | 21598722 | + |
| SEQ ID NO 23821 | AAATCTGCAAATAAATGGTTTT | TTT | chr12 | 21598701 | 21598722 | 21598718 | 21598723 | + |
| SEQ ID NO 23822 | AATCTGCAAATAAATGGTTTTA | TTA | chr12 | 21598702 | 21598723 | 21598719 | 21598724 | + |
| SEQ ID NO 23823 | CAAATAAATGGTTTTATTCTGA | CTG | chr12 | 21598708 | 21598729 | 21598725 | 21598730 | + |
| SEQ ID NO 23824 | TATTCTGACATTAAAAAGAAA | TTT | chr12 | 21598722 | 21598743 | 21598739 | 21598744 | + |
| SEQ ID NO 23825 | ATTCTGACATTAAAAAGAAAA | TTT | chr12 | 21598723 | 21598744 | 21598740 | 21598745 | + |
| SEQ ID NO 23826 | TTCTGACATTAAAAAGAAAAT | TTA | chr12 | 21598724 | 21598745 | 21598741 | 21598746 | + |
| SEQ ID NO 23827 | TGACATTAAAAAGAAAATACT | TTC | chr12 | 21598727 | 21598748 | 21598744 | 21598749 | + |
| SEQ ID NO 23828 | ACATTAAAAAGAAAATACTTA | CTG | chr12 | 21598729 | 21598750 | 21598746 | 21598751 | + |
| SEQ ID NO 23829 | AAAAAGAAAATACTTAATATCA | TTA | chr12 | 21598735 | 21598756 | 21598752 | 21598757 | + |
| SEQ ID NO 23830 | AATATCATTAATGAATGATCGT | CTT | chr12 | 21598750 | 21598771 | 21598767 | 21598772 | + |
| SEQ ID NO 23831 | ATATCATTAATGAATGATCGTT | TTA | chr12 | 21598751 | 21598772 | 21598768 | 21598773 | + |
| SEQ ID NO 23832 | ATGAATGATCGTTTTACCACAG | TTA | chr12 | 21598760 | 21598781 | 21598777 | 21598782 | + |
| SEQ ID NO 23833 | TACCACAGCGTAGGTCATTGAA | TTT | chr12 | 21598774 | 21598795 | 21598791 | 21598796 | + |
| SEQ ID NO 23834 | ACCACAGCGTAGGTCATTGAAT | TTT | chr12 | 21598775 | 21598796 | 21598792 | 21598797 | + |
| SEQ ID NO 23835 | CCACAGCGTAGGTCATTGAATT | TTA | chr12 | 21598776 | 21598797 | 21598793 | 21598798 | + |
| SEQ ID NO 23836 | AATTTGAACTTAACCTTCACTT | TTG | chr12 | 21598794 | 21598815 | 21598811 | 21598816 | + |
| SEQ ID NO 23837 | GAACTTAACCTTCACTTTCAAA | TTT | chr12 | 21598799 | 21598820 | 21598816 | 21598821 | + |
| SEQ ID NO 23838 | AACTTAACCTTCACTTTCAAAC | TTG | chr12 | 21598800 | 21598821 | 21598817 | 21598822 | + |
| SEQ ID NO 23839 | AACCTTCACTTTCAAACAAGTA | CTT | chr12 | 21598805 | 21598826 | 21598822 | 21598827 | + |
| SEQ ID NO 23840 | ACCTTCACTTTCAAACAAGTAC | TTA | chr12 | 21598806 | 21598827 | 21598823 | 21598828 | + |
| SEQ ID NO 23841 | CACTTTCAAACAAGTACTTTGT | CTT | chr12 | 21598811 | 21598832 | 21598828 | 21598833 | + |
| SEQ ID NO 23842 | ACTTTCAAACAAGTACTTTGTA | TTC | chr12 | 21598812 | 21598833 | 21598829 | 21598834 | + |
| SEQ ID NO 23843 | TCAAACAAGTACTTTGTATTTT | CTT | chr12 | 21598816 | 21598837 | 21598833 | 21598838 | + |
| SEQ ID NO 23844 | CAAACAAGTACTTTGTATTTTA | TTT | chr12 | 21598817 | 21598838 | 21598834 | 21598839 | + |
| SEQ ID NO 23845 | AAACAAGTACTTTGTATTTTAT | TTC | chr12 | 21598818 | 21598839 | 21598835 | 21598840 | + |
| SEQ ID NO 23846 | TGTATTTTATTGATCTCTATTT | CTT | chr12 | 21598830 | 21598851 | 21598847 | 21598852 | + |
| SEQ ID NO 23847 | GTATTTTATTGATCTCTATTTT | TTT | chr12 | 21598831 | 21598852 | 21598848 | 21598853 | + |

Figure 48 (Cont'd)

| | | | | | | | | |
|---|---|---|---|---|---|---|---|---|
| SEQ ID NO 23848 | TATTTTATTGATCTCTATTTTC | TTG | chr12 | 21598832 | 21598853 | 21598849 | 21598854 | + |
| SEQ ID NO 23849 | TATTGATCTCTATTTTCCTGGA | TTT | chr12 | 21598837 | 21598858 | 21598854 | 21598859 | + |
| SEQ ID NO 23850 | ATTGATCTCTATTTTCCTGGAA | TTT | chr12 | 21598838 | 21598859 | 21598855 | 21598860 | + |
| SEQ ID NO 23851 | TTGATCTCTATTTTCCTGGAAC | TTA | chr12 | 21598839 | 21598860 | 21598856 | 21598861 | + |
| SEQ ID NO 23852 | ATCTCTATTTTCCTGGAACAAC | TTG | chr12 | 21598842 | 21598863 | 21598859 | 21598864 | + |
| SEQ ID NO 23853 | TATTTTCCTGGAACAACATGGG | CTC | chr12 | 21598847 | 21598868 | 21598864 | 21598869 | + |
| SEQ ID NO 23854 | TTTTCCTGGAACAACATGGGGG | CTA | chr12 | 21598849 | 21598870 | 21598866 | 21598871 | + |
| SEQ ID NO 23855 | TCCTGGAACAACATGGGGGCTA | TTT | chr12 | 21598852 | 21598873 | 21598869 | 21598874 | + |
| SEQ ID NO 23856 | CCTGGAACAACATGGGGGCTAT | TTT | chr12 | 21598853 | 21598874 | 21598870 | 21598875 | + |
| SEQ ID NO 23857 | CTGGAACAACATGGGGGCTATG | TTC | chr12 | 21598854 | 21598875 | 21598871 | 21598876 | + |
| SEQ ID NO 23858 | GAACAACATGGGGGCTATGTTT | CTG | chr12 | 21598857 | 21598878 | 21598874 | 21598879 | + |
| SEQ ID NO 23859 | TGTTTAGCGTGAGGACAAAGTA | CTA | chr12 | 21598874 | 21598895 | 21598891 | 21598896 | + |
| SEQ ID NO 23860 | AGCGTGAGGACAAAGTATCACA | TTT | chr12 | 21598879 | 21598900 | 21598896 | 21598901 | + |
| SEQ ID NO 23861 | GCGTGAGGACAAAGTATCACAA | TTA | chr12 | 21598880 | 21598901 | 21598897 | 21598902 | + |
| SEQ ID NO 23862 | TCACCTGAAAGAAAAGATGAGC | CTT | chr12 | 21598905 | 21598926 | 21598922 | 21598927 | + |
| SEQ ID NO 23863 | CACCTGAAAGAAAAGATGAGCT | TTT | chr12 | 21598906 | 21598927 | 21598923 | 21598928 | + |
| SEQ ID NO 23864 | ACCTGAAAGAAAAGATGAGCTA | TTC | chr12 | 21598907 | 21598928 | 21598924 | 21598929 | + |
| SEQ ID NO 23865 | AAAGAAAAGATGAGCTACCATG | CTG | chr12 | 21598912 | 21598933 | 21598929 | 21598934 | + |
| SEQ ID NO 23866 | CCATGGTACATATAACAATGAG | CTA | chr12 | 21598929 | 21598950 | 21598946 | 21598951 | + |
| SEQ ID NO 23867 | AAACTCTAAGTCGTCATCTGGC | TTA | chr12 | 21598958 | 21598979 | 21598975 | 21598980 | + |
| SEQ ID NO 23868 | TAAGTCGTCATCTGGCAACACT | CTC | chr12 | 21598964 | 21598985 | 21598981 | 21598986 | + |
| SEQ ID NO 23869 | AGTCGTCATCTGGCAACACTGC | CTA | chr12 | 21598966 | 21598987 | 21598983 | 21598988 | + |
| SEQ ID NO 23870 | GCAACACTGCCAATTTACTAAA | CTG | chr12 | 21598978 | 21598999 | 21598995 | 21599000 | + |
| SEQ ID NO 23871 | CCAATTTACTAAAAATCACTAT | CTG | chr12 | 21598987 | 21599008 | 21599004 | 21599009 | + |
| SEQ ID NO 23872 | ACTAAAAATCACTATTTCAAAG | TTT | chr12 | 21598994 | 21599015 | 21599011 | 21599016 | + |
| SEQ ID NO 23873 | CTAAAAATCACTATTTCAAAGA | TTA | chr12 | 21598995 | 21599016 | 21599012 | 21599017 | + |
| SEQ ID NO 23874 | AAAATCACTATTTCAAAGAAGT | CTA | chr12 | 21598998 | 21599019 | 21599015 | 21599020 | + |
| SEQ ID NO 23875 | TTTCAAAGAAGTATAGAATAGA | CTA | chr12 | 21599008 | 21599029 | 21599025 | 21599030 | + |
| SEQ ID NO 23876 | CAAAGAAGTATAGAATAGATAT | TTT | chr12 | 21599011 | 21599032 | 21599028 | 21599033 | + |
| SEQ ID NO 23877 | AAAGAAGTATAGAATAGATATC | TTC | chr12 | 21599012 | 21599033 | 21599029 | 21599034 | + |
| SEQ ID NO 23878 | TTTCTGCCTCTCTCTCGCTC | CTC | chr12 | 21599052 | 21599073 | 21599069 | 21599074 | + |
| SEQ ID NO 23879 | TCTCTGCCTCTCTCTCGCTCTC | CTT | chr12 | 21599054 | 21599075 | 21599071 | 21599076 | + |
| SEQ ID NO 23880 | CTCTGCCTCTCTCTCGCTCTCT | TTT | chr12 | 21599055 | 21599076 | 21599072 | 21599077 | + |
| SEQ ID NO 23881 | TCTGCCTCTCTCTCGCTCTCTC | TTC | chr12 | 21599056 | 21599077 | 21599073 | 21599078 | + |
| SEQ ID NO 23882 | TGCCTCTCTCTCGCTCTCTCTC | CTC | chr12 | 21599058 | 21599079 | 21599075 | 21599080 | + |
| SEQ ID NO 23883 | CCTCTCTCTCGCTCTCTCTCTC | CTG | chr12 | 21599060 | 21599081 | 21599077 | 21599082 | + |
| SEQ ID NO 23884 | TCTCTCGCTCTCTCTCTCTCTC | CTC | chr12 | 21599064 | 21599085 | 21599081 | 21599086 | + |
| SEQ ID NO 23885 | TCTCGCTCTCTCTCTCTCTCTC | CTC | chr12 | 21599066 | 21599087 | 21599083 | 21599088 | + |
| SEQ ID NO 23886 | TCGCTCTCTCTCTCTCTCTCCC | CTC | chr12 | 21599068 | 21599089 | 21599085 | 21599090 | + |
| SEQ ID NO 23887 | GCTCTCTCTCTCTCTCTCCCCC | CTC | chr12 | 21599070 | 21599091 | 21599087 | 21599092 | + |
| SEQ ID NO 23888 | TCTCTCTCTCTCTCCCCCATCT | CTC | chr12 | 21599074 | 21599095 | 21599091 | 21599096 | + |
| SEQ ID NO 23889 | TCTCTCTCTCTCCCCCATCTCT | CTC | chr12 | 21599076 | 21599097 | 21599093 | 21599098 | + |
| SEQ ID NO 23890 | TCTCTCTCTCCCCCATCTCTCT | CTC | chr12 | 21599078 | 21599099 | 21599095 | 21599100 | + |
| SEQ ID NO 23891 | TCTCTCTCCCCCATCTCTCTCT | CTC | chr12 | 21599080 | 21599101 | 21599097 | 21599102 | + |
| SEQ ID NO 23892 | TCTCTCCCCCATCTCTCTCTGT | CTC | chr12 | 21599082 | 21599103 | 21599099 | 21599104 | + |
| SEQ ID NO 23893 | TCTCCCCCATCTCTCTCTGTCT | CTC | chr12 | 21599084 | 21599105 | 21599101 | 21599106 | + |
| SEQ ID NO 23894 | TCCCCCATCTCTCTCTGTCTCT | CTC | chr12 | 21599086 | 21599107 | 21599103 | 21599108 | + |
| SEQ ID NO 23895 | CCCCATCTCTCTCTGTCTCTCT | CTC | chr12 | 21599088 | 21599109 | 21599105 | 21599110 | + |
| SEQ ID NO 23896 | TCTCTGTCTCTCTCTATATA | CTC | chr12 | 21599097 | 21599118 | 21599114 | 21599119 | + |
| SEQ ID NO 23897 | TCTGTCTCTCTCTATATATA | CTC | chr12 | 21599099 | 21599120 | 21599116 | 21599121 | + |
| SEQ ID NO 23898 | TGTCTCTCTCTATATATATG | CTC | chr12 | 21599101 | 21599122 | 21599118 | 21599123 | + |
| SEQ ID NO 23899 | TCTCTCTCTATATATATGTA | CTG | chr12 | 21599103 | 21599124 | 21599120 | 21599125 | + |
| SEQ ID NO 23900 | TCTCTCTATATATATGTATACA | CTC | chr12 | 21599107 | 21599128 | 21599124 | 21599129 | + |
| SEQ ID NO 23901 | TCTCTATATATATGTATACACA | CTC | chr12 | 21599109 | 21599130 | 21599126 | 21599131 | + |
| SEQ ID NO 23902 | TCTATATATATGTATACACACA | CTC | chr12 | 21599111 | 21599132 | 21599128 | 21599133 | + |
| SEQ ID NO 23903 | TATATATATGTATACACACATA | CTC | chr12 | 21599113 | 21599134 | 21599130 | 21599135 | + |
| SEQ ID NO 23904 | TATATATGTATACACACATATA | CTA | chr12 | 21599115 | 21599136 | 21599132 | 21599137 | + |
| SEQ ID NO 23905 | TACACATATGGAGAAATTTCAC | TTA | chr12 | 21599146 | 21599167 | 21599163 | 21599168 | + |

Figure 48 (Cont'd)

| | | | | | | | | |
|---|---|---|---|---|---|---|---|---|
| SEQ ID NO 23906 | CACTATTTTGTATATGCTTAAAA | TTT | chr12 | 21599165 | 21599186 | 21599182 | 21599187 | + |
| SEQ ID NO 23907 | ACTATTTTGTATATGCTTAAAAA | TTC | chr12 | 21599166 | 21599187 | 21599183 | 21599188 | + |
| SEQ ID NO 23908 | TTTTGTATATGCTTAAAAATTA | CTA | chr12 | 21599170 | 21599191 | 21599187 | 21599192 | + |
| SEQ ID NO 23909 | TGTATATGCTTAAAAATTACAG | TTT | chr12 | 21599173 | 21599194 | 21599190 | 21599195 | + |
| SEQ ID NO 23910 | GTATATGCTTAAAAATTACAGA | TTT | chr12 | 21599174 | 21599195 | 21599191 | 21599196 | + |
| SEQ ID NO 23911 | TATATGCTTAAAAATTACAGAC | TTG | chr12 | 21599175 | 21599196 | 21599192 | 21599197 | + |
| SEQ ID NO 23912 | AAAAATTACAGACTTTGGAAGT | CTT | chr12 | 21599184 | 21599205 | 21599201 | 21599206 | + |
| SEQ ID NO 23913 | AAAATTACAGACTTTGGAAGTC | TTA | chr12 | 21599185 | 21599206 | 21599202 | 21599207 | + |
| SEQ ID NO 23914 | CAGACTTTGGAAGTCATATGAC | TTA | chr12 | 21599192 | 21599213 | 21599209 | 21599214 | + |
| SEQ ID NO 23915 | TGGAAGTCATATGACTATTTCA | CTT | chr12 | 21599199 | 21599220 | 21599216 | 21599221 | + |
| SEQ ID NO 23916 | GGAAGTCATATGACTATTTCAG | TTT | chr12 | 21599200 | 21599221 | 21599217 | 21599222 | + |
| SEQ ID NO 23917 | GAAGTCATATGACTATTTCAGT | TTG | chr12 | 21599201 | 21599222 | 21599218 | 21599223 | + |
| SEQ ID NO 23918 | TTTCAGTGTGTGTGGCTACTAA | CTA | chr12 | 21599216 | 21599237 | 21599233 | 21599238 | + |
| SEQ ID NO 23919 | CAGTGTGTGTGGCTACTAATCT | TTT | chr12 | 21599219 | 21599240 | 21599236 | 21599241 | + |
| SEQ ID NO 23920 | AGTGTGTGTGGCTACTAATCTC | TTC | chr12 | 21599220 | 21599241 | 21599237 | 21599242 | + |
| SEQ ID NO 23921 | CTAATCTCACCCTCCTGTTCCA | CTA | chr12 | 21599234 | 21599255 | 21599251 | 21599256 | + |
| SEQ ID NO 23922 | ATCTCACCCTCCTGTTCCAAAA | CTA | chr12 | 21599237 | 21599258 | 21599254 | 21599259 | + |
| SEQ ID NO 23923 | ACCCTCCTGTTCCAAAACACAG | CTC | chr12 | 21599242 | 21599263 | 21599259 | 21599264 | + |
| SEQ ID NO 23924 | CTGTTCCAAAACACAGTTGCAG | CTC | chr12 | 21599248 | 21599269 | 21599265 | 21599270 | + |
| SEQ ID NO 23925 | TTCCAAAACACAGTTGCAGAAG | CTG | chr12 | 21599251 | 21599272 | 21599268 | 21599273 | + |
| SEQ ID NO 23926 | CAAAACACAGTTGCAGAAGCAG | TTC | chr12 | 21599254 | 21599275 | 21599271 | 21599276 | + |
| SEQ ID NO 23927 | CAGAAGCAGAGGAAGTCATTAT | TTG | chr12 | 21599267 | 21599288 | 21599284 | 21599289 | + |
| SEQ ID NO 23928 | TACACTTAGAACATCATTTTAT | TTA | chr12 | 21599288 | 21599309 | 21599305 | 21599310 | + |
| SEQ ID NO 23929 | AGAACATCATTTTATAAGGCAG | CTT | chr12 | 21599295 | 21599316 | 21599312 | 21599317 | + |
| SEQ ID NO 23930 | GAACATCATTTTATAAGGCAGC | TTA | chr12 | 21599296 | 21599317 | 21599313 | 21599318 | + |
| SEQ ID NO 23931 | TATAAGGCAGCAGGTCTGGTAG | TTT | chr12 | 21599307 | 21599328 | 21599324 | 21599329 | + |
| SEQ ID NO 23932 | ATAAGGCAGCAGGTCTGGTAGG | TTT | chr12 | 21599308 | 21599329 | 21599325 | 21599330 | + |
| SEQ ID NO 23933 | TAAGGCAGCAGGTCTGGTAGGA | TTA | chr12 | 21599309 | 21599330 | 21599326 | 21599331 | + |
| SEQ ID NO 23934 | GTAGGAAGGAGATTAGGTGCTA | CTG | chr12 | 21599325 | 21599346 | 21599342 | 21599347 | + |
| SEQ ID NO 23935 | GGTGCTACTTGTGACAAAGGTC | TTA | chr12 | 21599340 | 21599361 | 21599357 | 21599362 | + |
| SEQ ID NO 23936 | CTTGTGACAAAGGTCAGCAAAT | CTA | chr12 | 21599347 | 21599368 | 21599364 | 21599369 | + |
| SEQ ID NO 23937 | GTGACAAAGGTCAGCAAATATT | CTT | chr12 | 21599350 | 21599371 | 21599367 | 21599372 | + |
| SEQ ID NO 23938 | TGACAAAGGTCAGCAAATATTT | TTG | chr12 | 21599351 | 21599372 | 21599368 | 21599373 | + |
| SEQ ID NO 23939 | GTGTTCCAGCACTTTTCTAGA | TTT | chr12 | 21599373 | 21599394 | 21599390 | 21599395 | + |
| SEQ ID NO 23940 | TGTTCCAGCACTTTTCTAGAT | TTG | chr12 | 21599374 | 21599395 | 21599391 | 21599396 | + |
| SEQ ID NO 23941 | CCAGCACTTTTCTAGATCCTCA | TTC | chr12 | 21599379 | 21599400 | 21599396 | 21599401 | + |
| SEQ ID NO 23942 | TTCTAGATCCTCAGTTAAAATC | CTT | chr12 | 21599388 | 21599409 | 21599405 | 21599410 | + |
| SEQ ID NO 23943 | TCTAGATCCTCAGTTAAAATCA | TTT | chr12 | 21599389 | 21599410 | 21599406 | 21599411 | + |
| SEQ ID NO 23944 | CTAGATCCTCAGTTAAAATCAA | TTT | chr12 | 21599390 | 21599411 | 21599407 | 21599412 | + |
| SEQ ID NO 23945 | TAGATCCTCAGTTAAAATCAAA | TTC | chr12 | 21599391 | 21599412 | 21599408 | 21599413 | + |
| SEQ ID NO 23946 | GATCCTCAGTTAAAATCAAAGC | CTA | chr12 | 21599393 | 21599414 | 21599410 | 21599415 | + |
| SEQ ID NO 23947 | AGTTAAAATCAAAGCAGCTGCA | CTC | chr12 | 21599400 | 21599421 | 21599417 | 21599422 | + |
| SEQ ID NO 23948 | AAATCAAAGCAGCTGCAGTCTT | TTA | chr12 | 21599405 | 21599426 | 21599422 | 21599427 | + |
| SEQ ID NO 23949 | CAGTCTTGGCAGTGGGAGGTGA | CTG | chr12 | 21599420 | 21599441 | 21599437 | 21599442 | + |
| SEQ ID NO 23950 | GGCAGTGGGAGGTGATACTCAC | CTT | chr12 | 21599427 | 21599448 | 21599444 | 21599449 | + |
| SEQ ID NO 23951 | GCAGTGGGAGGTGATACTCACA | TTG | chr12 | 21599428 | 21599449 | 21599445 | 21599450 | + |
| SEQ ID NO 23952 | ACACTTTGAACAAGACCACCTG | CTC | chr12 | 21599447 | 21599468 | 21599464 | 21599469 | + |
| SEQ ID NO 23953 | TGAACAAGACCACCTGCACTAC | CTT | chr12 | 21599453 | 21599474 | 21599470 | 21599475 | + |
| SEQ ID NO 23954 | GAACAAGACCACCTGCACTACC | TTT | chr12 | 21599454 | 21599475 | 21599471 | 21599476 | + |
| SEQ ID NO 23955 | AACAAGACCACCTGCACTACCT | TTG | chr12 | 21599455 | 21599476 | 21599472 | 21599477 | + |
| SEQ ID NO 23956 | CACTACCTACAATGGCAGCTCC | CTG | chr12 | 21599469 | 21599490 | 21599486 | 21599491 | + |
| SEQ ID NO 23957 | CCTACAATGGCAGCTCCAAATA | CTA | chr12 | 21599474 | 21599495 | 21599491 | 21599496 | + |
| SEQ ID NO 23958 | CAATGGCAGCTCCAAATATTTT | CTA | chr12 | 21599478 | 21599499 | 21599495 | 21599500 | + |
| SEQ ID NO 23959 | CAAATATTTTATATGAAAGGGG | CTC | chr12 | 21599490 | 21599511 | 21599507 | 21599512 | + |
| SEQ ID NO 23960 | TATATGAAAGGGGCCTAGACAT | TTT | chr12 | 21599499 | 21599520 | 21599516 | 21599521 | + |
| SEQ ID NO 23961 | ATATGAAAGGGGCCTAGACATA | TTT | chr12 | 21599500 | 21599521 | 21599517 | 21599522 | + |
| SEQ ID NO 23962 | TATGAAAGGGGCCTAGACATAG | TTA | chr12 | 21599501 | 21599522 | 21599518 | 21599523 | + |
| SEQ ID NO 23963 | GACATAGCATGCTGAATGAAAA | CTA | chr12 | 21599516 | 21599537 | 21599533 | 21599538 | + |

Figure 48 (Cont'd)

| | | | | | | | | |
|---|---|---|---|---|---|---|---|---|
| SEQ ID NO 23964 | AATGAAAAGGAAGTGAGTAGAC | CTG | chr12 | 21599530 | 21599551 | 21599547 | 21599552 | + |
| SEQ ID NO 23965 | GTGCTTTCCTTGAAGCTGTGCA | CTA | chr12 | 21599554 | 21599575 | 21599571 | 21599576 | + |
| SEQ ID NO 23966 | TCCTTGAAGCTGTGCAACCAAG | CTT | chr12 | 21599560 | 21599581 | 21599577 | 21599582 | + |
| SEQ ID NO 23967 | CCTTGAAGCTGTGCAACCAAGC | TTT | chr12 | 21599561 | 21599582 | 21599578 | 21599583 | + |
| SEQ ID NO 23968 | CTTGAAGCTGTGCAACCAAGCA | TTC | chr12 | 21599562 | 21599583 | 21599579 | 21599584 | + |
| SEQ ID NO 23969 | GAAGCTGTGCAACCAAGCATAG | CTT | chr12 | 21599565 | 21599586 | 21599582 | 21599587 | + |
| SEQ ID NO 23970 | AAGCTGTGCAACCAAGCATAGT | TTG | chr12 | 21599566 | 21599587 | 21599583 | 21599588 | + |
| SEQ ID NO 23971 | TGCAACCAAGCATAGTTTTTAC | CTG | chr12 | 21599572 | 21599593 | 21599589 | 21599594 | + |
| SEQ ID NO 23972 | TTACATAGATCGTGTGTTTCAC | TTT | chr12 | 21599590 | 21599611 | 21599607 | 21599612 | + |
| SEQ ID NO 23973 | TACATAGATCGTGTGTTTCACA | TTT | chr12 | 21599591 | 21599612 | 21599608 | 21599613 | + |
| SEQ ID NO 23974 | ACATAGATCGTGTGTTTCACAT | TTT | chr12 | 21599592 | 21599613 | 21599609 | 21599614 | + |
| SEQ ID NO 23975 | CATAGATCGTGTGTTTCACATG | TTA | chr12 | 21599593 | 21599614 | 21599610 | 21599615 | + |
| SEQ ID NO 23976 | CACATGGTGTGATAACAGCTTG | TTT | chr12 | 21599609 | 21599630 | 21599626 | 21599631 | + |
| SEQ ID NO 23977 | ACATGGTGTGATAACAGCTTGA | TTC | chr12 | 21599610 | 21599631 | 21599627 | 21599632 | + |
| SEQ ID NO 23978 | GAGATGCCATTGACATGGCCCA | CTT | chr12 | 21599630 | 21599651 | 21599647 | 21599652 | + |
| SEQ ID NO 23979 | AGATGCCATTGACATGGCCCAC | TTG | chr12 | 21599631 | 21599652 | 21599648 | 21599653 | + |
| SEQ ID NO 23980 | ACATGGCCCACCGGCTTATCCA | TTG | chr12 | 21599642 | 21599663 | 21599659 | 21599664 | + |
| SEQ ID NO 23981 | ATCCACATCAGTAATTAGGGCA | CTT | chr12 | 21599659 | 21599680 | 21599676 | 21599681 | + |
| SEQ ID NO 23982 | TCCACATCAGTAATTAGGGCAA | TTA | chr12 | 21599660 | 21599681 | 21599677 | 21599682 | + |
| SEQ ID NO 23983 | GGGCAAAGAAATCCTAATTACT | TTA | chr12 | 21599676 | 21599697 | 21599693 | 21599698 | + |
| SEQ ID NO 23984 | ATTACTATGCATCCCGTGATTG | CTA | chr12 | 21599692 | 21599713 | 21599709 | 21599714 | + |
| SEQ ID NO 23985 | CTATGCATCCCGTGATTGAAGT | TTA | chr12 | 21599696 | 21599717 | 21599713 | 21599718 | + |
| SEQ ID NO 23986 | TGCATCCCGTGATTGAAGTAAC | CTA | chr12 | 21599699 | 21599720 | 21599716 | 21599721 | + |
| SEQ ID NO 23987 | AAGTAACATTGATGTATACATA | TTG | chr12 | 21599714 | 21599735 | 21599731 | 21599736 | + |
| SEQ ID NO 23988 | ATGTATACATATTTTTTCCTAT | TTG | chr12 | 21599725 | 21599746 | 21599742 | 21599747 | + |
| SEQ ID NO 23989 | TTTCCTATTATTTCTCTTTTTG | TTT | chr12 | 21599739 | 21599760 | 21599756 | 21599761 | + |
| SEQ ID NO 23990 | TTCCTATTATTTCTCTTTTTGT | TTT | chr12 | 21599740 | 21599761 | 21599757 | 21599762 | + |
| SEQ ID NO 23991 | TCCTATTATTTCTCTTTTTGTG | TTT | chr12 | 21599741 | 21599762 | 21599758 | 21599763 | + |
| SEQ ID NO 23992 | CCTATTATTTCTCTTTTTGTGT | TTT | chr12 | 21599742 | 21599763 | 21599759 | 21599764 | + |
| SEQ ID NO 23993 | CTATTATTTCTCTTTTTGTGTT | TTC | chr12 | 21599743 | 21599764 | 21599760 | 21599765 | + |
| SEQ ID NO 23994 | TTATTTCTCTTTTTGTGTTTAA | CTA | chr12 | 21599746 | 21599767 | 21599763 | 21599768 | + |
| SEQ ID NO 23995 | TTTCTCTTTTTGTGTTTAAAAA | TTA | chr12 | 21599749 | 21599770 | 21599766 | 21599771 | + |
| SEQ ID NO 23996 | CTCTTTTTGTGTTTAAAAATGC | TTT | chr12 | 21599752 | 21599773 | 21599769 | 21599774 | + |
| SEQ ID NO 23997 | TCTTTTTGTGTTTAAAAATGCA | TTC | chr12 | 21599753 | 21599774 | 21599770 | 21599775 | + |
| SEQ ID NO 23998 | TTTTTGTGTTTAAAAATGCAAT | CTC | chr12 | 21599755 | 21599776 | 21599772 | 21599777 | + |
| SEQ ID NO 23999 | TTTGTGTTTAAAAATGCAATTA | CTT | chr12 | 21599757 | 21599778 | 21599774 | 21599779 | + |
| SEQ ID NO 24000 | TTGTGTTTAAAAATGCAATTAT | TTT | chr12 | 21599758 | 21599779 | 21599775 | 21599780 | + |
| SEQ ID NO 24001 | TGTGTTTAAAAATGCAATTATG | TTT | chr12 | 21599759 | 21599780 | 21599776 | 21599781 | + |
| SEQ ID NO 24002 | GTGTTTAAAAATGCAATTATGG | TTT | chr12 | 21599760 | 21599781 | 21599777 | 21599782 | + |
| SEQ ID NO 24003 | TGTTTAAAAATGCAATTATGGA | TTG | chr12 | 21599761 | 21599782 | 21599778 | 21599783 | + |
| SEQ ID NO 24004 | AAAAATGCAATTATGGACTCAT | TTT | chr12 | 21599766 | 21599787 | 21599783 | 21599788 | + |
| SEQ ID NO 24005 | AAAATGCAATTATGGACTCATT | TTA | chr12 | 21599767 | 21599788 | 21599784 | 21599789 | + |
| SEQ ID NO 24006 | TGGACTCATTCAAAGTGAAAGC | TTA | chr12 | 21599779 | 21599800 | 21599796 | 21599801 | + |
| SEQ ID NO 24007 | ATTCAAAGTGAAAGCTGGTATG | CTC | chr12 | 21599786 | 21599807 | 21599803 | 21599808 | + |
| SEQ ID NO 24008 | AAAGTGAAAGCTGGTATGACAA | TTC | chr12 | 21599790 | 21599811 | 21599807 | 21599812 | + |
| SEQ ID NO 24009 | GTATGACAATACATGAGCTAAC | CTG | chr12 | 21599803 | 21599824 | 21599820 | 21599825 | + |
| SEQ ID NO 24010 | ACTTCCTCATTTTATGAATAAA | CTA | chr12 | 21599823 | 21599844 | 21599840 | 21599845 | + |
| SEQ ID NO 24011 | CCTCATTTTATGAATAAATTTT | CTT | chr12 | 21599827 | 21599848 | 21599844 | 21599849 | + |
| SEQ ID NO 24012 | CTCATTTTATGAATAAATTTTA | TTC | chr12 | 21599828 | 21599849 | 21599845 | 21599850 | + |
| SEQ ID NO 24013 | ATTTTATGAATAAATTTTATAA | CTC | chr12 | 21599831 | 21599852 | 21599848 | 21599853 | + |
| SEQ ID NO 24014 | TATGAATAAATTTTATAAAGAA | TTT | chr12 | 21599835 | 21599856 | 21599852 | 21599857 | + |
| SEQ ID NO 24015 | ATGAATAAATTTTATAAAGAAA | TTT | chr12 | 21599836 | 21599857 | 21599853 | 21599858 | + |
| SEQ ID NO 24016 | TGAATAAATTTTATAAAGAAAT | TTA | chr12 | 21599837 | 21599858 | 21599854 | 21599859 | + |
| SEQ ID NO 24017 | TATAAAGAAATAAGCTAATACC | TTT | chr12 | 21599848 | 21599869 | 21599865 | 21599870 | + |
| SEQ ID NO 24018 | ATAAAGAAATAAGCTAATACCT | TTT | chr12 | 21599849 | 21599870 | 21599866 | 21599871 | + |
| SEQ ID NO 24019 | TAAAGAAATAAGCTAATACCTA | TTA | chr12 | 21599850 | 21599871 | 21599867 | 21599872 | + |
| SEQ ID NO 24020 | ATACCTACAGAGTGTTTATTAA | CTA | chr12 | 21599865 | 21599886 | 21599882 | 21599887 | + |
| SEQ ID NO 24021 | CAGAGTGTTTATTAAATGCTAG | CTA | chr12 | 21599872 | 21599893 | 21599889 | 21599894 | + |

Figure 48 (Cont'd)

| SEQ ID NO 24022 | ATTAAATGCTAGGCACAGTTCT | TTT | chr12 | 21599882 | 21599903 | 21599899 | 21599904 | + |
|---|---|---|---|---|---|---|---|---|
| SEQ ID NO 24023 | TTAAATGCTAGGCACAGTTCTG | TTA | chr12 | 21599883 | 21599904 | 21599900 | 21599905 | + |
| SEQ ID NO 24024 | AATGCTAGGCACAGTTCTGAGT | TTA | chr12 | 21599886 | 21599907 | 21599903 | 21599908 | + |
| SEQ ID NO 24025 | GGCACAGTTCTGAGTGATTTAC | CTA | chr12 | 21599893 | 21599914 | 21599910 | 21599915 | + |
| SEQ ID NO 24026 | TGAGTGATTTACAACTGGTATT | TTC | chr12 | 21599903 | 21599924 | 21599920 | 21599925 | + |
| SEQ ID NO 24027 | AGTGATTTACAACTGGTATTTC | CTG | chr12 | 21599905 | 21599926 | 21599922 | 21599927 | + |
| SEQ ID NO 24028 | ACAACTGGTATTTCTTTTAATT | TTT | chr12 | 21599913 | 21599934 | 21599930 | 21599935 | + |
| SEQ ID NO 24029 | CAACTGGTATTTCTTTTAATTT | TTA | chr12 | 21599914 | 21599935 | 21599931 | 21599936 | + |
| SEQ ID NO 24030 | GTATTTCTTTTAATTTTCACAA | CTG | chr12 | 21599920 | 21599941 | 21599937 | 21599942 | + |
| SEQ ID NO 24031 | CTTTTAATTTTCACAACATTAT | TTT | chr12 | 21599926 | 21599947 | 21599943 | 21599948 | + |
| SEQ ID NO 24032 | TTTTAATTTTCACAACATTATT | TTC | chr12 | 21599927 | 21599948 | 21599944 | 21599949 | + |
| SEQ ID NO 24033 | TTAATTTTCACAACATTATTAC | CTT | chr12 | 21599929 | 21599950 | 21599946 | 21599951 | + |
| SEQ ID NO 24034 | TAATTTTCACAACATTATTACA | TTT | chr12 | 21599930 | 21599951 | 21599947 | 21599952 | + |
| SEQ ID NO 24035 | AATTTTCACAACATTATTACAG | TTT | chr12 | 21599931 | 21599952 | 21599948 | 21599953 | + |
| SEQ ID NO 24036 | ATTTTCACAACATTATTACAGG | TTA | chr12 | 21599932 | 21599953 | 21599949 | 21599954 | + |
| SEQ ID NO 24037 | TCACAACATTATTACAGGTAGA | TTT | chr12 | 21599936 | 21599957 | 21599953 | 21599958 | + |
| SEQ ID NO 24038 | CACAACATTATTACAGGTAGAT | TTT | chr12 | 21599937 | 21599958 | 21599954 | 21599959 | + |
| SEQ ID NO 24039 | ACAACATTATTACAGGTAGATT | TTC | chr12 | 21599938 | 21599959 | 21599955 | 21599960 | + |
| SEQ ID NO 24040 | TTACAGGTAGATTTTATATATG | TTA | chr12 | 21599947 | 21599968 | 21599964 | 21599969 | + |
| SEQ ID NO 24041 | CAGGTAGATTTTATATATGGAG | TTA | chr12 | 21599950 | 21599971 | 21599967 | 21599972 | + |
| SEQ ID NO 24042 | TATATATGGAGAAACTGAGGCA | TTT | chr12 | 21599961 | 21599982 | 21599978 | 21599983 | + |
| SEQ ID NO 24043 | ATATATGGAGAAACTGAGGCAC | TTT | chr12 | 21599962 | 21599983 | 21599979 | 21599984 | + |
| SEQ ID NO 24044 | TATATGGAGAAACTGAGGCACA | TTA | chr12 | 21599963 | 21599984 | 21599980 | 21599985 | + |
| SEQ ID NO 24045 | AGGCACAGAGATGCTATGTAAT | CTG | chr12 | 21599978 | 21599999 | 21599995 | 21600000 | + |
| SEQ ID NO 24046 | TGTAATAAATCTCAACATTACC | CTA | chr12 | 21599994 | 21600015 | 21600011 | 21600016 | + |
| SEQ ID NO 24047 | AACATTACCCAGGTGATGGTGG | CTC | chr12 | 21600007 | 21600028 | 21600024 | 21600029 | + |
| SEQ ID NO 24048 | CCCAGGTGATGGTGGAGTTGGA | TTA | chr12 | 21600014 | 21600035 | 21600031 | 21600036 | + |
| SEQ ID NO 24049 | GAATTCCAAATCATGCAGTCTG | TTG | chr12 | 21600034 | 21600055 | 21600051 | 21600056 | + |
| SEQ ID NO 24050 | CAAATCATGCAGTCTGACTTTA | TTC | chr12 | 21600040 | 21600061 | 21600057 | 21600062 | + |
| SEQ ID NO 24051 | ACTTTAGCTGTAGACAGCAAGA | CTG | chr12 | 21600056 | 21600077 | 21600073 | 21600078 | + |
| SEQ ID NO 24052 | TAGCTGTAGACAGCAAGATAGT | CTT | chr12 | 21600060 | 21600081 | 21600077 | 21600082 | + |
| SEQ ID NO 24053 | AGCTGTAGACAGCAAGATAGTA | TTT | chr12 | 21600061 | 21600082 | 21600078 | 21600083 | + |
| SEQ ID NO 24054 | GCTGTAGACAGCAAGATAGTAA | TTA | chr12 | 21600062 | 21600083 | 21600079 | 21600084 | + |
| SEQ ID NO 24055 | TAGACAGCAAGATAGTAAGTAA | CTG | chr12 | 21600066 | 21600087 | 21600083 | 21600088 | + |
| SEQ ID NO 24056 | ATGGATCTTTTTGCTTTTGCTT | TTG | chr12 | 21600108 | 21600129 | 21600125 | 21600130 | + |
| SEQ ID NO 24057 | TTTGCTTTTGCTTGTTTGTTTG | CTT | chr12 | 21600117 | 21600138 | 21600134 | 21600139 | + |
| SEQ ID NO 24058 | TTGCTTTTGCTTGTTTGTTTGA | TTT | chr12 | 21600118 | 21600139 | 21600135 | 21600140 | + |
| SEQ ID NO 24059 | TGCTTTTGCTTGTTTGTTTGAA | TTT | chr12 | 21600119 | 21600140 | 21600136 | 21600141 | + |
| SEQ ID NO 24060 | GCTTTTGCTTGTTTGTTTGAAA | TTT | chr12 | 21600120 | 21600141 | 21600137 | 21600142 | + |
| SEQ ID NO 24061 | CTTTTGCTTGTTTGTTTGAAAC | TTG | chr12 | 21600121 | 21600142 | 21600138 | 21600143 | + |
| SEQ ID NO 24062 | TTGCTTGTTTGTTTGAAACAGG | CTT | chr12 | 21600124 | 21600145 | 21600141 | 21600146 | + |
| SEQ ID NO 24063 | TGCTTGTTTGTTTGAAACAGGG | TTT | chr12 | 21600125 | 21600146 | 21600142 | 21600147 | + |
| SEQ ID NO 24064 | GCTTGTTTGTTTGAAACAGGGT | TTT | chr12 | 21600126 | 21600147 | 21600143 | 21600148 | + |
| SEQ ID NO 24065 | CTTGTTTGTTTGAAACAGGGTC | TTG | chr12 | 21600127 | 21600148 | 21600144 | 21600149 | + |
| SEQ ID NO 24066 | GTTTGTTTGAAACAGGGTCTCA | CTT | chr12 | 21600130 | 21600151 | 21600147 | 21600152 | + |
| SEQ ID NO 24067 | TTTGTTTGAAACAGGGTCTCAC | TTG | chr12 | 21600131 | 21600152 | 21600148 | 21600153 | + |
| SEQ ID NO 24068 | GTTTGAAACAGGGTCTCACTCT | TTT | chr12 | 21600134 | 21600155 | 21600151 | 21600156 | + |
| SEQ ID NO 24069 | TTTGAAACAGGGTCTCACTCTG | TTG | chr12 | 21600135 | 21600156 | 21600152 | 21600157 | + |
| SEQ ID NO 24070 | GAAACAGGGTCTCACTCTGTCA | TTT | chr12 | 21600138 | 21600159 | 21600155 | 21600160 | + |
| SEQ ID NO 24071 | AAACAGGGTCTCACTCTGTCAC | TTG | chr12 | 21600139 | 21600160 | 21600156 | 21600161 | + |
| SEQ ID NO 24072 | ACTCTGTCACCCCGGCTGGAGT | CTC | chr12 | 21600151 | 21600172 | 21600168 | 21600173 | + |
| SEQ ID NO 24073 | TGTCACCCCGGCTGGAGTGCAA | CTC | chr12 | 21600155 | 21600176 | 21600172 | 21600177 | + |
| SEQ ID NO 24074 | TCACCCCGGCTGGAGTGCAATG | CTG | chr12 | 21600157 | 21600178 | 21600174 | 21600179 | + |
| SEQ ID NO 24075 | GAGTGCAATGGTGCAATCTTGC | CTG | chr12 | 21600169 | 21600190 | 21600186 | 21600191 | + |
| SEQ ID NO 24076 | GCTCACTGAAGCCTCACTAGAA | CTT | chr12 | 21600189 | 21600210 | 21600206 | 21600211 | + |
| SEQ ID NO 24077 | CTCACTGAAGCCTCACTAGAAC | TTG | chr12 | 21600190 | 21600211 | 21600207 | 21600212 | + |
| SEQ ID NO 24078 | ACTGAAGCCTCACTAGAACGCC | CTC | chr12 | 21600193 | 21600214 | 21600210 | 21600215 | + |
| SEQ ID NO 24079 | AAGCCTCACTAGAACGCCTGGA | CTG | chr12 | 21600197 | 21600218 | 21600214 | 21600219 | + |

Figure 48 (Cont'd)

| | | | | | | | | |
|---|---|---|---|---|---|---|---|---|
| SEQ ID NO 24080 | ACTAGAACGCCTGGATTCAATT | CTC | chr12 | 21600204 | 21600225 | 21600221 | 21600226 | + |
| SEQ ID NO 24081 | GAACGCCTGGATTCAATTGATC | CTA | chr12 | 21600208 | 21600229 | 21600225 | 21600230 | + |
| SEQ ID NO 24082 | GATTCAATTGATCCTCCTGCTT | CTG | chr12 | 21600217 | 21600238 | 21600234 | 21600239 | + |
| SEQ ID NO 24083 | AATTGATCCTCCTGCTTTAGCC | TTC | chr12 | 21600222 | 21600243 | 21600239 | 21600244 | + |
| SEQ ID NO 24084 | ATCCTCCTGCTTTAGCCTCTCA | TTG | chr12 | 21600227 | 21600248 | 21600244 | 21600249 | + |
| SEQ ID NO 24085 | CTGCTTTAGCCTCTCAGGTAGC | CTC | chr12 | 21600233 | 21600254 | 21600250 | 21600255 | + |
| SEQ ID NO 24086 | CTTTAGCCTCTCAGGTAGCTAG | CTG | chr12 | 21600236 | 21600257 | 21600253 | 21600258 | + |
| SEQ ID NO 24087 | TAGCCTCTCAGGTAGCTAGGAC | CTT | chr12 | 21600239 | 21600260 | 21600256 | 21600261 | + |
| SEQ ID NO 24088 | AGCCTCTCAGGTAGCTAGGACT | TTT | chr12 | 21600240 | 21600261 | 21600257 | 21600262 | + |
| SEQ ID NO 24089 | GCCTCTCAGGTAGCTAGGACTA | TTA | chr12 | 21600241 | 21600262 | 21600258 | 21600263 | + |
| SEQ ID NO 24090 | TCAGGTAGCTAGGACTACAGGT | CTC | chr12 | 21600246 | 21600267 | 21600263 | 21600268 | + |
| SEQ ID NO 24091 | AGGTAGCTAGGACTACAGGTGT | CTC | chr12 | 21600248 | 21600269 | 21600265 | 21600270 | + |
| SEQ ID NO 24092 | GGACTACAGGTGTGAGCCTCCA | CTA | chr12 | 21600257 | 21600278 | 21600274 | 21600279 | + |
| SEQ ID NO 24093 | CAGGTGTGAGCCTCCATGGCCA | CTA | chr12 | 21600263 | 21600284 | 21600280 | 21600285 | + |
| SEQ ID NO 24094 | CATGGCCAGCTAGAGAAATTTT | CTC | chr12 | 21600277 | 21600298 | 21600294 | 21600299 | + |
| SEQ ID NO 24095 | GAGAAATTTTTTAAATTTCTGT | CTA | chr12 | 21600289 | 21600310 | 21600306 | 21600311 | + |
| SEQ ID NO 24096 | TTTAAATTTCTGTAGAAACAGG | TTT | chr12 | 21600298 | 21600319 | 21600315 | 21600320 | + |
| SEQ ID NO 24097 | TTAAATTTCTGTAGAAACAGGG | TTT | chr12 | 21600299 | 21600320 | 21600316 | 21600321 | + |
| SEQ ID NO 24098 | TAAATTTCTGTAGAAACAGGGT | TTT | chr12 | 21600300 | 21600321 | 21600317 | 21600322 | + |
| SEQ ID NO 24099 | AAATTTCTGTAGAAACAGGGTC | TTT | chr12 | 21600301 | 21600322 | 21600318 | 21600323 | + |
| SEQ ID NO 24100 | AATTTCTGTAGAAACAGGGTCT | TTA | chr12 | 21600302 | 21600323 | 21600319 | 21600324 | + |
| SEQ ID NO 24101 | CTGTAGAAACAGGGTCTCCCTA | TTT | chr12 | 21600307 | 21600328 | 21600324 | 21600329 | + |
| SEQ ID NO 24102 | TGTAGAAACAGGGTCTCCCTAT | TTC | chr12 | 21600308 | 21600329 | 21600325 | 21600330 | + |
| SEQ ID NO 24103 | TAGAAACAGGGTCTCCCTATGT | CTG | chr12 | 21600310 | 21600331 | 21600327 | 21600332 | + |
| SEQ ID NO 24104 | CCTATGTTCCCAGGCTGGTAT | CTC | chr12 | 21600325 | 21600346 | 21600342 | 21600347 | + |
| SEQ ID NO 24105 | TGTTCCCAGGCTGGTATCCAA | CTA | chr12 | 21600329 | 21600350 | 21600346 | 21600351 | + |
| SEQ ID NO 24106 | CCCAGGCTGGTATCCAACTCTT | TTC | chr12 | 21600334 | 21600355 | 21600351 | 21600356 | + |
| SEQ ID NO 24107 | GTATCCAACTCTTGGTCTCAAA | CTG | chr12 | 21600343 | 21600364 | 21600360 | 21600365 | + |
| SEQ ID NO 24108 | TTGGTCTCAAACAATTCTCCCA | CTC | chr12 | 21600354 | 21600375 | 21600371 | 21600376 | + |
| SEQ ID NO 24109 | GGTCTCAAACAATTCTCCCACC | CTT | chr12 | 21600356 | 21600377 | 21600373 | 21600378 | + |
| SEQ ID NO 24110 | GTCTCAAACAATTCTCCCACCT | TTG | chr12 | 21600357 | 21600378 | 21600374 | 21600379 | + |
| SEQ ID NO 24111 | AAACAATTCTCCCACCTCAGCC | CTC | chr12 | 21600362 | 21600383 | 21600379 | 21600384 | + |
| SEQ ID NO 24112 | TCCCACCTCAGCCTTGAAAAGT | TTC | chr12 | 21600371 | 21600392 | 21600388 | 21600393 | + |
| SEQ ID NO 24113 | CCACCTCAGCCTTGAAAAGTGT | CTC | chr12 | 21600373 | 21600394 | 21600390 | 21600395 | + |
| SEQ ID NO 24114 | AGCCTTGAAAAGTGTTGAGATT | CTC | chr12 | 21600380 | 21600401 | 21600397 | 21600402 | + |
| SEQ ID NO 24115 | GAAAAGTGTTGAGATTACAGGT | CTT | chr12 | 21600386 | 21600407 | 21600403 | 21600408 | + |
| SEQ ID NO 24116 | AAAAGTGTTGAGATTACAGGTG | TTG | chr12 | 21600387 | 21600408 | 21600404 | 21600409 | + |
| SEQ ID NO 24117 | AGATTACAGGTGTGAATCACCA | TTG | chr12 | 21600397 | 21600418 | 21600414 | 21600419 | + |
| SEQ ID NO 24118 | CAGGTGTGAATCACCATGCTGG | TTA | chr12 | 21600403 | 21600424 | 21600420 | 21600425 | + |
| SEQ ID NO 24119 | GGCCTTGATGGATCTTTAAAAG | CTG | chr12 | 21600424 | 21600445 | 21600441 | 21600446 | + |
| SEQ ID NO 24120 | GATGGATCTTTAAAAGTGGTGG | CTT | chr12 | 21600430 | 21600451 | 21600447 | 21600452 | + |
| SEQ ID NO 24121 | ATGGATCTTTAAAAGTGGTGGG | TTG | chr12 | 21600431 | 21600452 | 21600448 | 21600453 | + |
| SEQ ID NO 24122 | TAAAAGTGGTGGGGGGTAGGAG | CTT | chr12 | 21600440 | 21600461 | 21600457 | 21600462 | + |
| SEQ ID NO 24123 | AAAAGTGGTGGGGGGTAGGAGA | TTT | chr12 | 21600441 | 21600462 | 21600458 | 21600463 | + |
| SEQ ID NO 24124 | AAAGTGGTGGGGGGTAGGAGAA | TTA | chr12 | 21600442 | 21600463 | 21600459 | 21600464 | + |
| SEQ ID NO 24125 | GGTCTCGGGAAGGATGGGATCC | TTA | chr12 | 21600509 | 21600530 | 21600526 | 21600531 | + |
| SEQ ID NO 24126 | GGGAAGGATGGGATCCTTTTCA | CTC | chr12 | 21600515 | 21600536 | 21600532 | 21600537 | + |
| SEQ ID NO 24127 | TTCATTTTGCTCTAGAGAAAAG | CTT | chr12 | 21600533 | 21600554 | 21600550 | 21600555 | + |
| SEQ ID NO 24128 | TCATTTTGCTCTAGAGAAAAGC | TTT | chr12 | 21600534 | 21600555 | 21600551 | 21600556 | + |
| SEQ ID NO 24129 | CATTTTGCTCTAGAGAAAAGCC | TTT | chr12 | 21600535 | 21600556 | 21600552 | 21600557 | + |
| SEQ ID NO 24130 | ATTTTGCTCTAGAGAAAAGCCA | TTC | chr12 | 21600536 | 21600557 | 21600553 | 21600558 | + |
| SEQ ID NO 24131 | TGCTCTAGAGAAAGCCATTTG | TTT | chr12 | 21600540 | 21600561 | 21600557 | 21600562 | + |
| SEQ ID NO 24132 | GCTCTAGAGAAAAGCCATTTGG | TTT | chr12 | 21600541 | 21600562 | 21600558 | 21600563 | + |
| SEQ ID NO 24133 | CTCTAGAGAAAAGCCATTTGGA | TTG | chr12 | 21600542 | 21600563 | 21600559 | 21600564 | + |
| SEQ ID NO 24134 | TAGAGAAAAGCCATTTGGAAAA | CTC | chr12 | 21600545 | 21600566 | 21600562 | 21600567 | + |
| SEQ ID NO 24135 | GAGAAAAGCCATTTGGAAAACT | CTA | chr12 | 21600547 | 21600568 | 21600564 | 21600569 | + |
| SEQ ID NO 24136 | GGAAAACTTCTGTGTTAACAAA | TTT | chr12 | 21600561 | 21600582 | 21600578 | 21600583 | + |
| SEQ ID NO 24137 | GAAAACTTCTGTGTTAACAAAA | TTG | chr12 | 21600562 | 21600583 | 21600579 | 21600584 | + |

Figure 48 (Cont'd)

| | | | | | | | | |
|---|---|---|---|---|---|---|---|---|
| SEQ ID NO 24138 | CTGTGTTAACAAAAAACAGCCG | CTT | chr12 | 21600570 | 21600591 | 21600587 | 21600592 | + |
| SEQ ID NO 24139 | TGTGTTAACAAAAAACAGCCGA | TTC | chr12 | 21600571 | 21600592 | 21600588 | 21600593 | + |
| SEQ ID NO 24140 | TGTTAACAAAAAACAGCCGAGT | CTG | chr12 | 21600573 | 21600594 | 21600590 | 21600595 | + |
| SEQ ID NO 24141 | ACAAAAAACAGCCGAGTAGCCT | TTA | chr12 | 21600578 | 21600599 | 21600595 | 21600600 | + |
| SEQ ID NO 24142 | GTATTAAACTTTAGAGCAGTTG | CTA | chr12 | 21600601 | 21600622 | 21600618 | 21600623 | + |
| SEQ ID NO 24143 | AACTTTAGAGCAGTTGTTCTTT | TTA | chr12 | 21600607 | 21600628 | 21600624 | 21600629 | + |
| SEQ ID NO 24144 | TAGAGCAGTTGTTCTTTACGGC | CTT | chr12 | 21600612 | 21600633 | 21600629 | 21600634 | + |
| SEQ ID NO 24145 | AGAGCAGTTGTTCTTTACGGCA | TTT | chr12 | 21600613 | 21600634 | 21600630 | 21600635 | + |
| SEQ ID NO 24146 | GAGCAGTTGTTCTTTACGGCAA | TTA | chr12 | 21600614 | 21600635 | 21600631 | 21600636 | + |
| SEQ ID NO 24147 | TTCTTTACGGCAATTACAGGGG | TTG | chr12 | 21600623 | 21600644 | 21600640 | 21600645 | + |
| SEQ ID NO 24148 | TTTACGGCAATTACAGGGGCCT | TTC | chr12 | 21600626 | 21600647 | 21600643 | 21600648 | + |
| SEQ ID NO 24149 | TACGGCAATTACAGGGGCCTTC | CTT | chr12 | 21600628 | 21600649 | 21600645 | 21600650 | + |
| SEQ ID NO 24150 | ACGGCAATTACAGGGGCCTTCA | TTT | chr12 | 21600629 | 21600650 | 21600646 | 21600651 | + |
| SEQ ID NO 24151 | CGGCAATTACAGGGGCCTTCAG | TTA | chr12 | 21600630 | 21600651 | 21600647 | 21600652 | + |
| SEQ ID NO 24152 | CAGGGGCCTTCAGGAAGCTGAT | TTA | chr12 | 21600639 | 21600660 | 21600656 | 21600661 | + |
| SEQ ID NO 24153 | CAGGAAGCTGATGGAAGTGTGA | CTT | chr12 | 21600649 | 21600670 | 21600666 | 21600671 | + |
| SEQ ID NO 24154 | AGGAAGCTGATGGAAGTGTGAA | TTC | chr12 | 21600650 | 21600671 | 21600667 | 21600672 | + |
| SEQ ID NO 24155 | ATGGAAGTGTGAAGTCCTCTTC | CTG | chr12 | 21600659 | 21600680 | 21600676 | 21600681 | + |
| SEQ ID NO 24156 | TTCTCAGAGAAAGTACTTCTA | CTC | chr12 | 21600678 | 21600699 | 21600695 | 21600700 | + |
| SEQ ID NO 24157 | CTCAGAGAAAGTACTTCTATA | CTT | chr12 | 21600680 | 21600701 | 21600697 | 21600702 | + |
| SEQ ID NO 24158 | TCAGAGAAAGTACTTCTATAT | TTC | chr12 | 21600681 | 21600702 | 21600698 | 21600703 | + |
| SEQ ID NO 24159 | AGAGAAAGTACTTCTATATAC | CTC | chr12 | 21600683 | 21600704 | 21600700 | 21600705 | + |
| SEQ ID NO 24160 | CTATATACGTGCACCTAATTTT | CTT | chr12 | 21600697 | 21600718 | 21600714 | 21600719 | + |
| SEQ ID NO 24161 | TATATACGTGCACCTAATTTTT | TTC | chr12 | 21600698 | 21600719 | 21600715 | 21600720 | + |
| SEQ ID NO 24162 | TATACGTGCACCTAATTTTTAG | CTA | chr12 | 21600700 | 21600721 | 21600717 | 21600722 | + |
| SEQ ID NO 24163 | ATTTTTAGATATAATTTCTGAA | CTA | chr12 | 21600714 | 21600735 | 21600731 | 21600736 | + |
| SEQ ID NO 24164 | TTAGATATAATTTCTGAAGGTT | TTT | chr12 | 21600718 | 21600739 | 21600735 | 21600740 | + |
| SEQ ID NO 24165 | TAGATATAATTTCTGAAGGTTT | TTT | chr12 | 21600719 | 21600740 | 21600736 | 21600741 | + |
| SEQ ID NO 24166 | AGATATAATTTCTGAAGGTTTA | TTT | chr12 | 21600720 | 21600741 | 21600737 | 21600742 | + |
| SEQ ID NO 24167 | GATATAATTTCTGAAGGTTTAG | TTA | chr12 | 21600721 | 21600742 | 21600738 | 21600743 | + |
| SEQ ID NO 24168 | CTGAAGGTTTAGAAACTCCTTG | TTT | chr12 | 21600731 | 21600752 | 21600748 | 21600753 | + |
| SEQ ID NO 24169 | TGAAGGTTTAGAAACTCCTTGA | TTC | chr12 | 21600732 | 21600753 | 21600749 | 21600754 | + |
| SEQ ID NO 24170 | AAGGTTTAGAAACTCCTTGAGT | CTG | chr12 | 21600734 | 21600755 | 21600751 | 21600756 | + |
| SEQ ID NO 24171 | AGAAACTCCTTGAGTTCACTTA | TTT | chr12 | 21600741 | 21600762 | 21600758 | 21600763 | + |
| SEQ ID NO 24172 | GAAACTCCTTGAGTTCACTTAT | TTA | chr12 | 21600742 | 21600763 | 21600759 | 21600764 | + |
| SEQ ID NO 24173 | CTTGAGTTCACTTATATCAAAG | CTC | chr12 | 21600749 | 21600770 | 21600766 | 21600771 | + |
| SEQ ID NO 24174 | GAGTTCACTTATATCAAAGTCC | CTT | chr12 | 21600752 | 21600773 | 21600769 | 21600774 | + |
| SEQ ID NO 24175 | AGTTCACTTATATCAAAGTCCT | TTG | chr12 | 21600753 | 21600774 | 21600770 | 21600775 | + |
| SEQ ID NO 24176 | ACTTATATCAAAGTCCTCACCT | TTC | chr12 | 21600758 | 21600779 | 21600775 | 21600780 | + |
| SEQ ID NO 24177 | ATATCAAAGTCCTCACCTTTAG | CTT | chr12 | 21600762 | 21600783 | 21600779 | 21600784 | + |
| SEQ ID NO 24178 | TATCAAAGTCCTCACCTTTAGA | TTA | chr12 | 21600763 | 21600784 | 21600780 | 21600785 | + |
| SEQ ID NO 24179 | ACCTTTAGAACTCCTGTCCTAG | CTC | chr12 | 21600776 | 21600797 | 21600793 | 21600798 | + |
| SEQ ID NO 24180 | TAGAACTCCTGTCCTAGAAGAG | CTT | chr12 | 21600781 | 21600802 | 21600798 | 21600803 | + |
| SEQ ID NO 24181 | AGAACTCCTGTCCTAGAAGAGT | TTT | chr12 | 21600782 | 21600803 | 21600799 | 21600804 | + |
| SEQ ID NO 24182 | GAACTCCTGTCCTAGAAGAGTG | TTA | chr12 | 21600783 | 21600804 | 21600800 | 21600805 | + |
| SEQ ID NO 24183 | CTGTCCTAGAAGAGTGGACTCA | CTC | chr12 | 21600789 | 21600810 | 21600806 | 21600811 | + |
| SEQ ID NO 24184 | TCCTAGAAGAGTGGACTCATTA | CTG | chr12 | 21600792 | 21600813 | 21600809 | 21600814 | + |
| SEQ ID NO 24185 | GAAGAGTGGACTCATTATTATA | CTA | chr12 | 21600797 | 21600818 | 21600814 | 21600819 | + |
| SEQ ID NO 24186 | ATTATTATAATTTCTTCCATAA | CTC | chr12 | 21600810 | 21600831 | 21600827 | 21600832 | + |
| SEQ ID NO 24187 | TTATAATTTCTTCCATAACCAC | TTA | chr12 | 21600814 | 21600835 | 21600831 | 21600836 | + |
| SEQ ID NO 24188 | TAATTTCTTCCATAACCACTTT | TTA | chr12 | 21600817 | 21600838 | 21600834 | 21600839 | + |
| SEQ ID NO 24189 | CTTCCATAACCACTTTGACTCT | TTT | chr12 | 21600823 | 21600844 | 21600840 | 21600845 | + |
| SEQ ID NO 24190 | TTCCATAACCACTTTGACTCTA | TTC | chr12 | 21600824 | 21600845 | 21600841 | 21600846 | + |
| SEQ ID NO 24191 | CCATAACCACTTTGACTCTAGT | CTT | chr12 | 21600826 | 21600847 | 21600843 | 21600848 | + |
| SEQ ID NO 24192 | CATAACCACTTTGACTCTAGTT | TTC | chr12 | 21600827 | 21600848 | 21600844 | 21600849 | + |
| SEQ ID NO 24193 | TGACTCTAGTTTTCTGAATTCT | CTT | chr12 | 21600838 | 21600859 | 21600855 | 21600860 | + |
| SEQ ID NO 24194 | GACTCTAGTTTTCTGAATTCTT | TTT | chr12 | 21600839 | 21600860 | 21600856 | 21600861 | + |
| SEQ ID NO 24195 | ACTCTAGTTTTCTGAATTCTTC | TTG | chr12 | 21600840 | 21600861 | 21600857 | 21600862 | + |

Figure 48 (Cont'd)

| | | | | | | | | |
|---|---|---|---|---|---|---|---|---|
| SEQ ID NO 24196 | TAGTTTTCTGAATTCTTCCCTG | CTC | chr12 | 21600844 | 21600865 | 21600861 | 21600866 | + |
| SEQ ID NO 24197 | GTTTTCTGAATTCTTCCCTGT | CTA | chr12 | 21600846 | 21600867 | 21600863 | 21600868 | + |
| SEQ ID NO 24198 | TCTGAATTCTTCCCTGTGCCAC | TTT | chr12 | 21600850 | 21600871 | 21600867 | 21600872 | + |
| SEQ ID NO 24199 | CTGAATTCTTCCCTGTGCCACT | TTT | chr12 | 21600851 | 21600872 | 21600868 | 21600873 | + |
| SEQ ID NO 24200 | TGAATTCTTCCCTGTGCCACTT | TTC | chr12 | 21600852 | 21600873 | 21600869 | 21600874 | + |
| SEQ ID NO 24201 | AATTCTTCCCTGTGCCACTTGT | CTG | chr12 | 21600854 | 21600875 | 21600871 | 21600876 | + |
| SEQ ID NO 24202 | TTCCCTGTGCCACTTGTACCAT | TTC | chr12 | 21600859 | 21600880 | 21600876 | 21600881 | + |
| SEQ ID NO 24203 | CCCTGTGCCACTTGTACCATGT | CTT | chr12 | 21600861 | 21600882 | 21600878 | 21600883 | + |
| SEQ ID NO 24204 | CCTGTGCCACTTGTACCATGTA | TTC | chr12 | 21600862 | 21600883 | 21600879 | 21600884 | + |
| SEQ ID NO 24205 | TGCCACTTGTACCATGTAATTC | CTG | chr12 | 21600866 | 21600887 | 21600883 | 21600888 | + |
| SEQ ID NO 24206 | GTACCATGTAATTCAGAGGTGT | CTT | chr12 | 21600874 | 21600895 | 21600891 | 21600896 | + |
| SEQ ID NO 24207 | TACCATGTAATTCAGAGGTGTA | TTG | chr12 | 21600875 | 21600896 | 21600892 | 21600897 | + |
| SEQ ID NO 24208 | AGAGGTGTAGTGTCAAGACTGA | TTC | chr12 | 21600888 | 21600909 | 21600905 | 21600910 | + |
| SEQ ID NO 24209 | AGGAGGAAGCAGGTAAATTATG | CTG | chr12 | 21600909 | 21600930 | 21600926 | 21600931 | + |
| SEQ ID NO 24210 | TGTCCAGCAATACGTTGGCTTA | TTA | chr12 | 21600929 | 21600950 | 21600946 | 21600951 | + |
| SEQ ID NO 24211 | GCTTAGGCAAAAACAAATTGTT | TTG | chr12 | 21600946 | 21600967 | 21600963 | 21600968 | + |
| SEQ ID NO 24212 | AGGCAAAAACAAATTGTTTCTA | CTT | chr12 | 21600950 | 21600971 | 21600967 | 21600972 | + |
| SEQ ID NO 24213 | GGCAAAAACAAATTGTTTCTAG | TTA | chr12 | 21600951 | 21600972 | 21600968 | 21600973 | + |
| SEQ ID NO 24214 | TTTCTAGTCCATTTTAAGAGGG | TTG | chr12 | 21600966 | 21600987 | 21600983 | 21600988 | + |
| SEQ ID NO 24215 | CTAGTCCATTTTAAGAGGGAAG | TTT | chr12 | 21600969 | 21600990 | 21600986 | 21600991 | + |
| SEQ ID NO 24216 | TAGTCCATTTTAAGAGGGAAGC | TTC | chr12 | 21600970 | 21600991 | 21600987 | 21600992 | + |
| SEQ ID NO 24217 | GTCCATTTTAAGAGGGAAGCAT | CTA | chr12 | 21600972 | 21600993 | 21600989 | 21600994 | + |
| SEQ ID NO 24218 | TAAGAGGGAAGCATTTATTTAG | TTT | chr12 | 21600980 | 21601001 | 21600997 | 21601002 | + |
| SEQ ID NO 24219 | AAGAGGGAAGCATTTATTTAGG | TTT | chr12 | 21600981 | 21601002 | 21600998 | 21601003 | + |
| SEQ ID NO 24220 | AGAGGGAAGCATTTATTTAGGG | TTA | chr12 | 21600982 | 21601003 | 21600999 | 21601004 | + |
| SEQ ID NO 24221 | ATTTAGGGACTACATCGCTCAA | TTT | chr12 | 21600996 | 21601017 | 21601013 | 21601018 | + |
| SEQ ID NO 24222 | TTTAGGGACTACATCGCTCAAG | TTA | chr12 | 21600997 | 21601018 | 21601014 | 21601019 | + |
| SEQ ID NO 24223 | AGGGACTACATCGCTCAAGTCT | TTT | chr12 | 21601000 | 21601021 | 21601017 | 21601022 | + |
| SEQ ID NO 24224 | GGGACTACATCGCTCAAGTCTT | TTA | chr12 | 21601001 | 21601022 | 21601018 | 21601023 | + |
| SEQ ID NO 24225 | CATCGCTCAAGTCTTACAATT | CTA | chr12 | 21601008 | 21601029 | 21601025 | 21601030 | + |
| SEQ ID NO 24226 | AAGTCTTACAATTCTTAAATT | CTC | chr12 | 21601016 | 21601037 | 21601033 | 21601038 | + |
| SEQ ID NO 24227 | TACAATTCTTAAATTAACTTTC | CTT | chr12 | 21601023 | 21601044 | 21601040 | 21601045 | + |
| SEQ ID NO 24228 | ACAATTCTTAAATTAACTTTCA | TTT | chr12 | 21601024 | 21601045 | 21601041 | 21601046 | + |
| SEQ ID NO 24229 | CAATTCTTAAATTAACTTTCAT | TTA | chr12 | 21601025 | 21601046 | 21601042 | 21601047 | + |
| SEQ ID NO 24230 | TTAAATTAACTTTCATTATGTG | TTC | chr12 | 21601031 | 21601052 | 21601048 | 21601053 | + |
| SEQ ID NO 24231 | AAATTAACTTTCATTATGTGTG | CTT | chr12 | 21601033 | 21601054 | 21601050 | 21601055 | + |
| SEQ ID NO 24232 | AATTAACTTTCATTATGTGTGA | TTA | chr12 | 21601034 | 21601055 | 21601051 | 21601056 | + |
| SEQ ID NO 24233 | ACTTTCATTATGTGTGACAACA | TTA | chr12 | 21601039 | 21601060 | 21601056 | 21601061 | + |
| SEQ ID NO 24234 | TCATTATGTGTGACAACATTTA | CTT | chr12 | 21601043 | 21601064 | 21601060 | 21601065 | + |
| SEQ ID NO 24235 | CATTATGTGTGACAACATTTAT | TTT | chr12 | 21601044 | 21601065 | 21601061 | 21601066 | + |
| SEQ ID NO 24236 | ATTATGTGTGACAACATTTATT | TTC | chr12 | 21601045 | 21601066 | 21601062 | 21601067 | + |
| SEQ ID NO 24237 | TGTGTGACAACATTTATTAAAC | TTA | chr12 | 21601049 | 21601070 | 21601066 | 21601071 | + |
| SEQ ID NO 24238 | ATTAAACTTTTTAATGATCCT | TTT | chr12 | 21601064 | 21601085 | 21601081 | 21601086 | + |
| SEQ ID NO 24239 | TTAAACTTTTTAATGATCCTA | TTA | chr12 | 21601065 | 21601086 | 21601082 | 21601087 | + |
| SEQ ID NO 24240 | AACTTTTTAATGATCCTAAAT | TTA | chr12 | 21601068 | 21601089 | 21601085 | 21601090 | + |
| SEQ ID NO 24241 | TTTTAATGATCCTAAATATCCT | CTT | chr12 | 21601073 | 21601094 | 21601090 | 21601095 | + |
| SEQ ID NO 24242 | TTTAATGATCCTAAATATCCTT | TTT | chr12 | 21601074 | 21601095 | 21601091 | 21601096 | + |
| SEQ ID NO 24243 | TTAATGATCCTAAATATCCTTA | TTT | chr12 | 21601075 | 21601096 | 21601092 | 21601097 | + |
| SEQ ID NO 24244 | TAATGATCCTAAATATCCTTAA | TTT | chr12 | 21601076 | 21601097 | 21601093 | 21601098 | + |
| SEQ ID NO 24245 | AATGATCCTAAATATCCTTAAC | TTT | chr12 | 21601077 | 21601098 | 21601094 | 21601099 | + |
| SEQ ID NO 24246 | ATGATCCTAAATATCCTTAACA | TTA | chr12 | 21601078 | 21601099 | 21601095 | 21601100 | + |
| SEQ ID NO 24247 | AATATCCTTAACATGTTAATTT | CTA | chr12 | 21601087 | 21601108 | 21601104 | 21601109 | + |
| SEQ ID NO 24248 | AACATGTTAATTTCTCCAGAGT | CTT | chr12 | 21601096 | 21601117 | 21601113 | 21601118 | + |
| SEQ ID NO 24249 | ACATGTTAATTTCTCCAGAGTT | TTA | chr12 | 21601097 | 21601118 | 21601114 | 21601119 | + |
| SEQ ID NO 24250 | ATTTCTCCAGAGTTTGTAATGT | TTA | chr12 | 21601105 | 21601126 | 21601122 | 21601127 | + |
| SEQ ID NO 24251 | CTCCAGAGTTTGTAATGTTCTG | TTT | chr12 | 21601109 | 21601130 | 21601126 | 21601131 | + |
| SEQ ID NO 24252 | TCCAGAGTTTGTAATGTTCTGA | TTC | chr12 | 21601110 | 21601131 | 21601127 | 21601132 | + |
| SEQ ID NO 24253 | CAGAGTTTGTAATGTTCTGAGC | CTC | chr12 | 21601112 | 21601133 | 21601129 | 21601134 | + |

Figure 48 (Cont'd)

| | | | | | | | | |
|---|---|---|---|---|---|---|---|---|
| SEQ ID NO 24254 | GTAATGTTCTGAGCAAGTGTGT | TTT | chr12 | 21601120 | 21601141 | 21601137 | 21601142 | + |
| SEQ ID NO 24255 | TAATGTTCTGAGCAAGTGTGTG | TTG | chr12 | 21601121 | 21601142 | 21601138 | 21601143 | + |
| SEQ ID NO 24256 | TGAGCAAGTGTGTGCAGAAGAA | TTC | chr12 | 21601129 | 21601150 | 21601146 | 21601151 | + |
| SEQ ID NO 24257 | AGCAAGTGTGTGCAGAAGAAAT | CTG | chr12 | 21601131 | 21601152 | 21601148 | 21601153 | + |
| SEQ ID NO 24258 | TAGTAAGACCTGGGCAAAGGAG | TTG | chr12 | 21601158 | 21601179 | 21601175 | 21601180 | + |
| SEQ ID NO 24259 | GGCAAAGGAGAGAGTAAACATT | CTG | chr12 | 21601170 | 21601191 | 21601187 | 21601192 | + |
| SEQ ID NO 24260 | TTCCCCCACATTTGGGCAAAAC | TTT | chr12 | 21601193 | 21601214 | 21601210 | 21601215 | + |
| SEQ ID NO 24261 | TCCCCCACATTTGGGCAAAACT | TTT | chr12 | 21601194 | 21601215 | 21601211 | 21601216 | + |
| SEQ ID NO 24262 | CCCCCACATTTGGGCAAAACTT | TTT | chr12 | 21601195 | 21601216 | 21601212 | 21601217 | + |
| SEQ ID NO 24263 | CCCCACATTTGGGCAAAACTTT | TTC | chr12 | 21601196 | 21601217 | 21601213 | 21601218 | + |
| SEQ ID NO 24264 | GGGCAAAACTTTCCATCCTGGG | TTT | chr12 | 21601206 | 21601227 | 21601223 | 21601228 | + |
| SEQ ID NO 24265 | GGCAAAACTTTCCATCCTGGGT | TTG | chr12 | 21601207 | 21601228 | 21601224 | 21601229 | + |
| SEQ ID NO 24266 | TCCATCCTGGGTCACACCACAG | CTT | chr12 | 21601217 | 21601238 | 21601234 | 21601239 | + |
| SEQ ID NO 24267 | CCATCCTGGGTCACACCACAGT | TTT | chr12 | 21601218 | 21601239 | 21601235 | 21601240 | + |
| SEQ ID NO 24268 | CATCCTGGGTCACACCACAGTC | TTC | chr12 | 21601219 | 21601240 | 21601236 | 21601241 | + |
| SEQ ID NO 24269 | GGTCACACCACAGTCTAATTTC | CTG | chr12 | 21601226 | 21601247 | 21601243 | 21601248 | + |
| SEQ ID NO 24270 | ATTTCCCTCCTCTCCTCTCCCT | CTA | chr12 | 21601243 | 21601264 | 21601260 | 21601265 | + |
| SEQ ID NO 24271 | CCCTCCTCTCCTCTCCCTCAAC | TTT | chr12 | 21601247 | 21601268 | 21601264 | 21601269 | + |
| SEQ ID NO 24272 | CCTCCTCTCCTCTCCCTCAACT | TTC | chr12 | 21601248 | 21601269 | 21601265 | 21601270 | + |
| SEQ ID NO 24273 | CTCTCCTCTCCCTCAACTGGTA | CTC | chr12 | 21601252 | 21601273 | 21601269 | 21601274 | + |
| SEQ ID NO 24274 | TCCTCTCCCTCAACTGGTAACA | CTC | chr12 | 21601255 | 21601276 | 21601272 | 21601277 | + |
| SEQ ID NO 24275 | CTCTCCCTCAACTGGTAACAGT | CTC | chr12 | 21601257 | 21601278 | 21601274 | 21601279 | + |
| SEQ ID NO 24276 | TCCCTCAACTGGTAACAGTGCT | CTC | chr12 | 21601260 | 21601281 | 21601277 | 21601282 | + |
| SEQ ID NO 24277 | CCTCAACTGGTAACAGTGCTTC | CTC | chr12 | 21601262 | 21601283 | 21601279 | 21601284 | + |
| SEQ ID NO 24278 | AACTGGTAACAGTGCTTCTTCC | CTC | chr12 | 21601266 | 21601287 | 21601283 | 21601288 | + |
| SEQ ID NO 24279 | GTAACAGTGCTTCTTCCAAAAC | CTG | chr12 | 21601271 | 21601292 | 21601288 | 21601293 | + |
| SEQ ID NO 24280 | CTTCCAAAACATACCTGACTAC | CTT | chr12 | 21601283 | 21601304 | 21601300 | 21601305 | + |
| SEQ ID NO 24281 | TTCCAAAACATACCTGACTACT | TTC | chr12 | 21601284 | 21601305 | 21601301 | 21601306 | + |
| SEQ ID NO 24282 | CCAAAACATACCTGACTACTTA | CTT | chr12 | 21601286 | 21601307 | 21601303 | 21601308 | + |
| SEQ ID NO 24283 | CAAAACATACCTGACTACTTAG | TTC | chr12 | 21601287 | 21601308 | 21601304 | 21601309 | + |
| SEQ ID NO 24284 | ACTACTTAGTACTTCCCACTAC | CTG | chr12 | 21601300 | 21601321 | 21601317 | 21601322 | + |
| SEQ ID NO 24285 | CTTAGTACTTCCCACTACTGTG | CTA | chr12 | 21601304 | 21601325 | 21601321 | 21601326 | + |
| SEQ ID NO 24286 | AGTACTTCCCACTACTGTGGAT | CTT | chr12 | 21601307 | 21601328 | 21601324 | 21601329 | + |
| SEQ ID NO 24287 | GTACTTCCCACTACTGTGGATA | TTA | chr12 | 21601308 | 21601329 | 21601325 | 21601330 | + |
| SEQ ID NO 24288 | CCCACTACTGTGGATAGAATTT | CTT | chr12 | 21601314 | 21601335 | 21601331 | 21601336 | + |
| SEQ ID NO 24289 | CCACTACTGTGGATAGAATTTC | TTC | chr12 | 21601315 | 21601336 | 21601332 | 21601337 | + |
| SEQ ID NO 24290 | CTGTGGATAGAATTTCAGTGAC | CTA | chr12 | 21601321 | 21601342 | 21601338 | 21601343 | + |
| SEQ ID NO 24291 | TGGATAGAATTTCAGTGACTCC | CTG | chr12 | 21601324 | 21601345 | 21601341 | 21601346 | + |
| SEQ ID NO 24292 | CAGTGACTCCTCATTCATTGTT | TTT | chr12 | 21601336 | 21601357 | 21601353 | 21601358 | + |
| SEQ ID NO 24293 | AGTGACTCCTCATTCATTGTTC | TTC | chr12 | 21601337 | 21601358 | 21601354 | 21601359 | + |
| SEQ ID NO 24294 | CTCATTCATTGTTCATACCCTG | CTC | chr12 | 21601345 | 21601366 | 21601362 | 21601367 | + |
| SEQ ID NO 24295 | ATTCATTGTTCATACCCTGGAG | CTC | chr12 | 21601348 | 21601369 | 21601365 | 21601370 | + |
| SEQ ID NO 24296 | ATTGTTCATACCCTGGAGACAA | TTC | chr12 | 21601352 | 21601373 | 21601369 | 21601374 | + |
| SEQ ID NO 24297 | TTCATACCCTGGAGACAAAACT | TTG | chr12 | 21601356 | 21601377 | 21601373 | 21601378 | + |
| SEQ ID NO 24298 | ATACCCTGGAGACAAAACTCCT | TTC | chr12 | 21601359 | 21601380 | 21601376 | 21601381 | + |
| SEQ ID NO 24299 | GAGACAAAACTCCTTAAGGCTA | CTG | chr12 | 21601367 | 21601388 | 21601384 | 21601389 | + |
| SEQ ID NO 24300 | CTTAAGGCTATTAACTCCCCCT | CTC | chr12 | 21601379 | 21601400 | 21601396 | 21601401 | + |
| SEQ ID NO 24301 | AAGGCTATTAACTCCCCCTGAG | CTT | chr12 | 21601382 | 21601403 | 21601399 | 21601404 | + |
| SEQ ID NO 24302 | AGGCTATTAACTCCCCCTGAGC | TTA | chr12 | 21601383 | 21601404 | 21601400 | 21601405 | + |
| SEQ ID NO 24303 | TTAACTCCCCCTGAGCTTCACA | CTA | chr12 | 21601389 | 21601410 | 21601406 | 21601411 | + |
| SEQ ID NO 24304 | ACTCCCCCTGAGCTTCACAATC | TTA | chr12 | 21601392 | 21601413 | 21601409 | 21601414 | + |
| SEQ ID NO 24305 | CCCCTGAGCTTCACAATCTAGT | CTC | chr12 | 21601396 | 21601417 | 21601413 | 21601418 | + |
| SEQ ID NO 24306 | AGCTTCACAATCTAGTCCCTGC | CTG | chr12 | 21601402 | 21601423 | 21601419 | 21601424 | + |
| SEQ ID NO 24307 | CACAATCTAGTCCCTGCAGGTC | CTT | chr12 | 21601407 | 21601428 | 21601424 | 21601429 | + |
| SEQ ID NO 24308 | ACAATCTAGTCCCTGCAGGTCT | TTC | chr12 | 21601408 | 21601429 | 21601425 | 21601430 | + |
| SEQ ID NO 24309 | GTCCCTGCAGGTCTCTCCCATC | CTA | chr12 | 21601416 | 21601437 | 21601433 | 21601438 | + |
| SEQ ID NO 24310 | CAGGTCTCTCCCATCTTCTCTC | CTG | chr12 | 21601423 | 21601444 | 21601440 | 21601445 | + |
| SEQ ID NO 24311 | TCCCATCTTCTCTCATACTCCT | CTC | chr12 | 21601431 | 21601452 | 21601448 | 21601453 | + |

Figure 48 (Cont'd)

| | | | | | | | | |
|---|---|---|---|---|---|---|---|---|
| SEQ ID NO 24312 | CCATCTTCTCTCATACTCCTCT | CTC | chr12 | 21601433 | 21601454 | 21601450 | 21601455 | + |
| SEQ ID NO 24313 | CTCTCATACTCCTCTCCTTTTC | CTT | chr12 | 21601440 | 21601461 | 21601457 | 21601462 | + |
| SEQ ID NO 24314 | TCTCATACTCCTCTCCTTTTCC | TTC | chr12 | 21601441 | 21601462 | 21601458 | 21601463 | + |
| SEQ ID NO 24315 | TCATACTCCTCTCCTTTTCCCT | CTC | chr12 | 21601443 | 21601464 | 21601460 | 21601465 | + |
| SEQ ID NO 24316 | ATACTCCTCTCCTTTTCCCTCT | CTC | chr12 | 21601445 | 21601466 | 21601462 | 21601467 | + |
| SEQ ID NO 24317 | CTCTCCTTTTCCCTCTCTGAGC | CTC | chr12 | 21601451 | 21601472 | 21601468 | 21601473 | + |
| SEQ ID NO 24318 | TCCTTTTCCCTCTCTGAGCCCC | CTC | chr12 | 21601454 | 21601475 | 21601471 | 21601476 | + |
| SEQ ID NO 24319 | CTTTTCCCTCTCTGAGCCCCGC | CTC | chr12 | 21601456 | 21601477 | 21601473 | 21601478 | + |
| SEQ ID NO 24320 | TTCCCTCTCTGAGCCCCGCTCA | CTT | chr12 | 21601459 | 21601480 | 21601476 | 21601481 | + |
| SEQ ID NO 24321 | TCCCTCTCTGAGCCCCGCTCAG | TTT | chr12 | 21601460 | 21601481 | 21601477 | 21601482 | + |
| SEQ ID NO 24322 | CCCTCTCTGAGCCCCGCTCAGA | TTT | chr12 | 21601461 | 21601482 | 21601478 | 21601483 | + |
| SEQ ID NO 24323 | CCTCTCTGAGCCCCGCTCAGAT | TTC | chr12 | 21601462 | 21601483 | 21601479 | 21601484 | + |
| SEQ ID NO 24324 | TCTGAGCCCCGCTCAGATCTTC | CTC | chr12 | 21601466 | 21601487 | 21601483 | 21601488 | + |
| SEQ ID NO 24325 | TGAGCCCCGCTCAGATCTTCGA | CTC | chr12 | 21601468 | 21601489 | 21601485 | 21601490 | + |
| SEQ ID NO 24326 | AGCCCCGCTCAGATCTTCGAAC | CTG | chr12 | 21601470 | 21601491 | 21601487 | 21601492 | + |
| SEQ ID NO 24327 | AGATCTTCGAACAGAGAACACT | CTC | chr12 | 21601480 | 21601501 | 21601497 | 21601502 | + |
| SEQ ID NO 24328 | CGAACAGAGAACACTTCTGCAT | CTT | chr12 | 21601487 | 21601508 | 21601504 | 21601509 | + |
| SEQ ID NO 24329 | GAACAGAGAACACTTCTGCATC | TTC | chr12 | 21601488 | 21601509 | 21601505 | 21601510 | + |
| SEQ ID NO 24330 | CTGCATCTTGGCATATATAGTT | CTT | chr12 | 21601503 | 21601524 | 21601520 | 21601525 | + |
| SEQ ID NO 24331 | TGCATCTTGGCATATATAGTTC | TTC | chr12 | 21601504 | 21601525 | 21601521 | 21601526 | + |
| SEQ ID NO 24332 | CATCTTGGCATATATAGTTCTC | CTG | chr12 | 21601506 | 21601527 | 21601523 | 21601528 | + |
| SEQ ID NO 24333 | GGCATATATAGTTCTCTCACAT | CTT | chr12 | 21601512 | 21601533 | 21601529 | 21601534 | + |
| SEQ ID NO 24334 | GCATATATAGTTCTCTCACATA | TTG | chr12 | 21601513 | 21601534 | 21601530 | 21601535 | + |
| SEQ ID NO 24335 | TCTCACATAGAACGCTTTCTCC | TTC | chr12 | 21601526 | 21601547 | 21601543 | 21601548 | + |
| SEQ ID NO 24336 | TCACATAGAACGCTTTCTCCCC | CTC | chr12 | 21601528 | 21601549 | 21601545 | 21601550 | + |
| SEQ ID NO 24337 | ACATAGAACGCTTTCTCCCCTT | CTC | chr12 | 21601530 | 21601551 | 21601547 | 21601552 | + |
| SEQ ID NO 24338 | TCTCCCCTTTAGCTATTTATCC | CTT | chr12 | 21601543 | 21601564 | 21601560 | 21601565 | + |
| SEQ ID NO 24339 | CTCCCCTTTAGCTATTTATCCT | TTT | chr12 | 21601544 | 21601565 | 21601561 | 21601566 | + |
| SEQ ID NO 24340 | TCCCCTTTAGCTATTTATCCTT | TTC | chr12 | 21601545 | 21601566 | 21601562 | 21601567 | + |
| SEQ ID NO 24341 | CCCTTTAGCTATTTATCCTTCA | CTC | chr12 | 21601547 | 21601568 | 21601564 | 21601569 | + |
| SEQ ID NO 24342 | TAGCTATTTATCCTTCAAGTGT | CTT | chr12 | 21601552 | 21601573 | 21601569 | 21601574 | + |
| SEQ ID NO 24343 | AGCTATTTATCCTTCAAGTGTC | TTT | chr12 | 21601553 | 21601574 | 21601570 | 21601575 | + |
| SEQ ID NO 24344 | GCTATTTATCCTTCAAGTGTCA | TTA | chr12 | 21601554 | 21601575 | 21601571 | 21601576 | + |
| SEQ ID NO 24345 | TTTATCCTTCAAGTGTCAGCTC | CTA | chr12 | 21601558 | 21601579 | 21601575 | 21601580 | + |
| SEQ ID NO 24346 | ATCCTTCAAGTGTCAGCTCAAA | TTT | chr12 | 21601561 | 21601582 | 21601578 | 21601583 | + |
| SEQ ID NO 24347 | TCCTTCAAGTGTCAGCTCAAAC | TTA | chr12 | 21601562 | 21601583 | 21601579 | 21601584 | + |
| SEQ ID NO 24348 | CAAGTGTCAGCTCAAACATCTC | CTT | chr12 | 21601567 | 21601588 | 21601584 | 21601589 | + |
| SEQ ID NO 24349 | AAGTGTCAGCTCAAACATCTCA | TTC | chr12 | 21601568 | 21601589 | 21601585 | 21601590 | + |
| SEQ ID NO 24350 | AAACATCTCATCATTAGAGAGG | CTC | chr12 | 21601580 | 21601601 | 21601597 | 21601602 | + |
| SEQ ID NO 24351 | ATCATTAGAGAGGTTTTTCCCA | CTC | chr12 | 21601589 | 21601610 | 21601606 | 21601611 | + |
| SEQ ID NO 24352 | GAGAGGTTTTTCCCAAACCTCT | TTA | chr12 | 21601596 | 21601617 | 21601613 | 21601618 | + |
| SEQ ID NO 24353 | TTCCCAAACCTCTAGGTAACTA | TTT | chr12 | 21601605 | 21601626 | 21601622 | 21601627 | + |
| SEQ ID NO 24354 | TCCCAAACCTCTAGGTAACTAG | TTT | chr12 | 21601606 | 21601627 | 21601623 | 21601628 | + |
| SEQ ID NO 24355 | CCCAAACCTCTAGGTAACTAGG | TTT | chr12 | 21601607 | 21601628 | 21601624 | 21601629 | + |
| SEQ ID NO 24356 | CCAAACCTCTAGGTAACTAGGT | TTC | chr12 | 21601608 | 21601629 | 21601625 | 21601630 | + |
| SEQ ID NO 24357 | TAGGTAACTAGGTTAGAAACCA | CTC | chr12 | 21601617 | 21601638 | 21601634 | 21601639 | + |
| SEQ ID NO 24358 | GGTAACTAGGTTAGAAACCACT | CTA | chr12 | 21601619 | 21601640 | 21601636 | 21601641 | + |
| SEQ ID NO 24359 | GGTTAGAAACCACTCCCCATTC | CTA | chr12 | 21601627 | 21601648 | 21601644 | 21601649 | + |
| SEQ ID NO 24360 | GAAACCACTCCCCATTCCACGG | TTA | chr12 | 21601632 | 21601653 | 21601649 | 21601654 | + |
| SEQ ID NO 24361 | CCCATTCCACGGTACACTGTAT | CTC | chr12 | 21601642 | 21601663 | 21601659 | 21601664 | + |
| SEQ ID NO 24362 | CACGGTACACTGTATAGTCTTA | TTC | chr12 | 21601649 | 21601670 | 21601666 | 21601671 | + |
| SEQ ID NO 24363 | TATAGTCTTAGGACACCTGGTT | CTG | chr12 | 21601661 | 21601682 | 21601678 | 21601683 | + |
| SEQ ID NO 24364 | AGGACACCTGGTTCCCTTAGTC | CTT | chr12 | 21601670 | 21601691 | 21601687 | 21601692 | + |
| SEQ ID NO 24365 | GGACACCTGGTTCCCTTAGTCT | TTA | chr12 | 21601671 | 21601692 | 21601688 | 21601693 | + |
| SEQ ID NO 24366 | GTTCCCTTAGTCTCACACTCAT | CTG | chr12 | 21601680 | 21601701 | 21601697 | 21601702 | + |
| SEQ ID NO 24367 | CCTTAGTCTCACACTCATCACA | TTC | chr12 | 21601684 | 21601705 | 21601701 | 21601706 | + |
| SEQ ID NO 24368 | AGTCTCACACTCATCACATTTG | CTT | chr12 | 21601688 | 21601709 | 21601705 | 21601710 | + |
| SEQ ID NO 24369 | GTCTCACACTCATCACATTTGA | TTA | chr12 | 21601689 | 21601710 | 21601706 | 21601711 | + |

Figure 48 (Cont'd)

| SEQ ID NO 24370 | ACACTCATCACATTTGACTGTA | CTC | chr12 | 21601694 | 21601715 | 21601711 | 21601716 | + |
| SEQ ID NO 24371 | ATCACATTTGACTGTATTGTAT | CTC | chr12 | 21601700 | 21601721 | 21601717 | 21601722 | + |
| SEQ ID NO 24372 | GACTGTATTGTATGTTCAATGT | TTT | chr12 | 21601709 | 21601730 | 21601726 | 21601731 | + |
| SEQ ID NO 24373 | ACTGTATTGTATGTTCAATGTC | TTG | chr12 | 21601710 | 21601731 | 21601727 | 21601732 | + |
| SEQ ID NO 24374 | TATTGTATGTTCAATGTCTACC | CTG | chr12 | 21601714 | 21601735 | 21601731 | 21601736 | + |
| SEQ ID NO 24375 | TATGTTCAATGTCTACCTTCTA | TTG | chr12 | 21601719 | 21601740 | 21601736 | 21601741 | + |
| SEQ ID NO 24376 | AATGTCTACCTTCTACAAATTT | TTC | chr12 | 21601726 | 21601747 | 21601743 | 21601748 | + |
| SEQ ID NO 24377 | CCTTCTACAAATTTGTCAATTC | CTA | chr12 | 21601734 | 21601755 | 21601751 | 21601756 | + |
| SEQ ID NO 24378 | CTACAAATTTGTCAATTCTTGA | CTT | chr12 | 21601738 | 21601759 | 21601755 | 21601760 | + |
| SEQ ID NO 24379 | TACAAATTTGTCAATTCTTGAA | TTC | chr12 | 21601739 | 21601760 | 21601756 | 21601761 | + |
| SEQ ID NO 24380 | CAAATTTGTCAATTCTTGAAGA | CTA | chr12 | 21601741 | 21601762 | 21601758 | 21601763 | + |
| SEQ ID NO 24381 | GTCAATTCTTGAAGATTAAGAA | TTT | chr12 | 21601748 | 21601769 | 21601765 | 21601770 | + |
| SEQ ID NO 24382 | TCAATTCTTGAAGATTAAGAAT | TTG | chr12 | 21601749 | 21601770 | 21601766 | 21601771 | + |
| SEQ ID NO 24383 | TTGAAGATTAAGAATCAGTTCT | TTC | chr12 | 21601756 | 21601777 | 21601773 | 21601778 | + |
| SEQ ID NO 24384 | GAAGATTAAGAATCAGTTCTGT | CTT | chr12 | 21601758 | 21601779 | 21601775 | 21601780 | + |
| SEQ ID NO 24385 | AAGATTAAGAATCAGTTCTGTA | TTG | chr12 | 21601759 | 21601780 | 21601776 | 21601781 | + |
| SEQ ID NO 24386 | AGAATCAGTTCTGTATTCTTAA | TTA | chr12 | 21601766 | 21601787 | 21601783 | 21601788 | + |
| SEQ ID NO 24387 | TGTATTCTTAACTCTATCTCCC | TTC | chr12 | 21601777 | 21601798 | 21601794 | 21601799 | + |
| SEQ ID NO 24388 | TATTCTTAACTCTATCTCCCTC | CTG | chr12 | 21601779 | 21601800 | 21601796 | 21601801 | + |
| SEQ ID NO 24389 | TTAACTCTATCTCCCTCGCCTC | TTC | chr12 | 21601784 | 21601805 | 21601801 | 21601806 | + |
| SEQ ID NO 24390 | AACTCTATCTCCCTCGCCTCTC | CTT | chr12 | 21601786 | 21601807 | 21601803 | 21601808 | + |
| SEQ ID NO 24391 | ACTCTATCTCCCTCGCCTCTCA | TTA | chr12 | 21601787 | 21601808 | 21601804 | 21601809 | + |
| SEQ ID NO 24392 | TATCTCCCTCGCCTCTCAGTGC | CTC | chr12 | 21601791 | 21601812 | 21601808 | 21601813 | + |
| SEQ ID NO 24393 | TCTCCCTCGCCTCTCAGTGCCT | CTA | chr12 | 21601793 | 21601814 | 21601810 | 21601815 | + |
| SEQ ID NO 24394 | CCTCGCCTCTCAGTGCCTGATA | CTC | chr12 | 21601797 | 21601818 | 21601814 | 21601819 | + |
| SEQ ID NO 24395 | GCCTCTCAGTGCCTGATACCTA | CTC | chr12 | 21601801 | 21601822 | 21601818 | 21601823 | + |
| SEQ ID NO 24396 | TCAGTGCCTGATACCTAATAGA | CTC | chr12 | 21601806 | 21601827 | 21601823 | 21601828 | + |
| SEQ ID NO 24397 | AGTGCCTGATACCTAATAGACA | CTC | chr12 | 21601808 | 21601829 | 21601825 | 21601830 | + |
| SEQ ID NO 24398 | ATACCTAATAGACACTTGATGA | CTG | chr12 | 21601816 | 21601837 | 21601833 | 21601838 | + |
| SEQ ID NO 24399 | ATAGACACTTGATGAATCCTTA | CTA | chr12 | 21601823 | 21601844 | 21601840 | 21601845 | + |
| SEQ ID NO 24400 | GATGAATCCTTACTGAATAATA | CTT | chr12 | 21601833 | 21601854 | 21601850 | 21601855 | + |
| SEQ ID NO 24401 | ATGAATCCTTACTGAATAATAA | TTG | chr12 | 21601834 | 21601855 | 21601851 | 21601856 | + |
| SEQ ID NO 24402 | ACTGAATAATAAAATGGATTAA | CTT | chr12 | 21601844 | 21601865 | 21601861 | 21601866 | + |
| SEQ ID NO 24403 | CTGAATAATAAAATGGATTAAT | TTA | chr12 | 21601845 | 21601866 | 21601862 | 21601867 | + |
| SEQ ID NO 24404 | AATAATAAAATGGATTAATGAA | CTG | chr12 | 21601848 | 21601869 | 21601865 | 21601870 | + |
| SEQ ID NO 24405 | ATGAATAAAGCAATAAATTTC | TTA | chr12 | 21601865 | 21601886 | 21601882 | 21601887 | + |
| SEQ ID NO 24406 | CAAGGTTAATATTAATAAATTA | TTT | chr12 | 21601886 | 21601907 | 21601903 | 21601908 | + |
| SEQ ID NO 24407 | AAGGTTAATATTAATAAATTAA | TTC | chr12 | 21601887 | 21601908 | 21601904 | 21601909 | + |
| SEQ ID NO 24408 | ATATTAATAAATTAAAAGGTT | TTA | chr12 | 21601894 | 21601915 | 21601911 | 21601916 | + |
| SEQ ID NO 24409 | ATAAATTAAAAGGTTATTTTG | TTA | chr12 | 21601900 | 21601921 | 21601917 | 21601922 | + |
| SEQ ID NO 24410 | AAAAGGTTATTTTGAAGTCTGA | TTA | chr12 | 21601908 | 21601929 | 21601925 | 21601930 | + |
| SEQ ID NO 24411 | TTTTGAAGTCTGAGAATTAGTA | TTA | chr12 | 21601917 | 21601938 | 21601934 | 21601939 | + |
| SEQ ID NO 24412 | TGAAGTCTGAGAATTAGTACCC | TTT | chr12 | 21601920 | 21601941 | 21601937 | 21601942 | + |
| SEQ ID NO 24413 | GAAGTCTGAGAATTAGTACCCA | TTT | chr12 | 21601921 | 21601942 | 21601938 | 21601943 | + |
| SEQ ID NO 24414 | AAGTCTGAGAATTAGTACCCAA | TTG | chr12 | 21601922 | 21601943 | 21601939 | 21601944 | + |
| SEQ ID NO 24415 | AGAATTAGTACCCAAAACTAAC | CTG | chr12 | 21601929 | 21601950 | 21601946 | 21601951 | + |
| SEQ ID NO 24416 | GTACCCAAAACTAACTGTGACT | TTA | chr12 | 21601936 | 21601957 | 21601953 | 21601958 | + |
| SEQ ID NO 24417 | ACTGTGACTCTCTCATCTGTTA | CTA | chr12 | 21601949 | 21601970 | 21601966 | 21601971 | + |
| SEQ ID NO 24418 | TGACTCTCTCATCTGTTATGTT | CTG | chr12 | 21601953 | 21601974 | 21601970 | 21601975 | + |
| SEQ ID NO 24419 | TCTCATCTGTTATGTTTTCAC | CTC | chr12 | 21601959 | 21601980 | 21601976 | 21601981 | + |
| SEQ ID NO 24420 | TCATCTGTTATGTTTTCACGT | CTC | chr12 | 21601961 | 21601982 | 21601978 | 21601983 | + |
| SEQ ID NO 24421 | ATCTGTTATGTTTTCACGTTT | CTC | chr12 | 21601963 | 21601984 | 21601980 | 21601985 | + |
| SEQ ID NO 24422 | TTATGTTTTCACGTTTCCATT | CTG | chr12 | 21601968 | 21601989 | 21601985 | 21601990 | + |
| SEQ ID NO 24423 | TGTTTTTCACGTTTCCATTGTT | TTA | chr12 | 21601971 | 21601992 | 21601988 | 21601993 | + |
| SEQ ID NO 24424 | TTCACGTTTCCATTGTTCATGG | TTT | chr12 | 21601976 | 21601997 | 21601993 | 21601998 | + |
| SEQ ID NO 24425 | TCACGTTTCCATTGTTCATGGG | TTT | chr12 | 21601977 | 21601998 | 21601994 | 21601999 | + |
| SEQ ID NO 24426 | CACGTTTCCATTGTTCATGGGC | TTT | chr12 | 21601978 | 21601999 | 21601995 | 21602000 | + |
| SEQ ID NO 24427 | ACGTTTCCATTGTTCATGGGCA | TTC | chr12 | 21601979 | 21602000 | 21601996 | 21602001 | + |

Figure 48 (Cont'd)

| | | | | | | | | | |
|---|---|---|---|---|---|---|---|---|---|
| SEQ ID NO 24428 | CCATTGTTCATGGGCAAAATTC | TTT | chr12 | 21601985 | 21602006 | 21602002 | 21602007 | + |
| SEQ ID NO 24429 | CATTGTTCATGGGCAAAATTCT | TTC | chr12 | 21601986 | 21602007 | 21602003 | 21602008 | + |
| SEQ ID NO 24430 | TTCATGGGCAAAATTCTGGCAG | TTG | chr12 | 21601991 | 21602012 | 21602008 | 21602013 | + |
| SEQ ID NO 24431 | ATGGGCAAAATTCTGGCAGCAA | TTC | chr12 | 21601994 | 21602015 | 21602011 | 21602016 | + |
| SEQ ID NO 24432 | TGGCAGCAAGGGATTCTTCTCC | TTC | chr12 | 21602007 | 21602028 | 21602024 | 21602029 | + |
| SEQ ID NO 24433 | GCAGCAAGGGATTCTTCTCCTA | CTG | chr12 | 21602009 | 21602030 | 21602026 | 21602031 | + |
| SEQ ID NO 24434 | TTCTCCTAAGAAACCTTTTGTT | TTC | chr12 | 21602023 | 21602044 | 21602040 | 21602045 | + |
| SEQ ID NO 24435 | CTCCTAAGAAACCTTTTGTTTT | CTT | chr12 | 21602025 | 21602046 | 21602042 | 21602047 | + |
| SEQ ID NO 24436 | TCCTAAGAAACCTTTTGTTTTC | TTC | chr12 | 21602026 | 21602047 | 21602043 | 21602048 | + |
| SEQ ID NO 24437 | CTAAGAAACCTTTTGTTTTCTT | CTC | chr12 | 21602028 | 21602049 | 21602045 | 21602050 | + |
| SEQ ID NO 24438 | AGAAACCTTTTGTTTTCTTGGA | CTA | chr12 | 21602031 | 21602052 | 21602048 | 21602053 | + |
| SEQ ID NO 24439 | TTGTTTTCTTGGATGTGAATAC | CTT | chr12 | 21602040 | 21602061 | 21602057 | 21602062 | + |
| SEQ ID NO 24440 | TGTTTTCTTGGATGTGAATACA | TTT | chr12 | 21602041 | 21602062 | 21602058 | 21602063 | + |
| SEQ ID NO 24441 | GTTTTCTTGGATGTGAATACAT | TTT | chr12 | 21602042 | 21602063 | 21602059 | 21602064 | + |
| SEQ ID NO 24442 | TTTTCTTGGATGTGAATACATT | TTG | chr12 | 21602043 | 21602064 | 21602060 | 21602065 | + |
| SEQ ID NO 24443 | TCTTGGATGTGAATACATTTCC | TTT | chr12 | 21602046 | 21602067 | 21602063 | 21602068 | + |
| SEQ ID NO 24444 | CTTGGATGTGAATACATTTCCT | TTT | chr12 | 21602047 | 21602068 | 21602064 | 21602069 | + |
| SEQ ID NO 24445 | TTGGATGTGAATACATTTCCTT | TTC | chr12 | 21602048 | 21602069 | 21602065 | 21602070 | + |
| SEQ ID NO 24446 | GGATGTGAATACATTTCCTTGT | CTT | chr12 | 21602050 | 21602071 | 21602067 | 21602072 | + |
| SEQ ID NO 24447 | GATGTGAATACATTTCCTTGTT | TTG | chr12 | 21602051 | 21602072 | 21602068 | 21602073 | + |
| SEQ ID NO 24448 | CCTTGTTTGCCAGAAAACATGG | TTT | chr12 | 21602066 | 21602087 | 21602083 | 21602088 | + |
| SEQ ID NO 24449 | CTTGTTTGCCAGAAAACATGGT | TTC | chr12 | 21602067 | 21602088 | 21602084 | 21602089 | + |
| SEQ ID NO 24450 | GTTTGCCAGAAAACATGGTAAG | CTT | chr12 | 21602070 | 21602091 | 21602087 | 21602092 | + |
| SEQ ID NO 24451 | TTTGCCAGAAAACATGGTAAGA | TTG | chr12 | 21602071 | 21602092 | 21602088 | 21602093 | + |
| SEQ ID NO 24452 | GCCAGAAAACATGGTAAGATAA | TTT | chr12 | 21602074 | 21602095 | 21602091 | 21602096 | + |
| SEQ ID NO 24453 | CCAGAAAACATGGTAAGATAAC | TTG | chr12 | 21602075 | 21602096 | 21602092 | 21602097 | + |
| SEQ ID NO 24454 | GAGAGTATAACATTCATTTTAT | CTG | chr12 | 21602099 | 21602120 | 21602116 | 21602121 | + |
| SEQ ID NO 24455 | ATTTTATTCATGAAGAAACTGT | TTC | chr12 | 21602114 | 21602135 | 21602131 | 21602136 | + |
| SEQ ID NO 24456 | TATTCATGAAGAAACTGTTATT | TTT | chr12 | 21602118 | 21602139 | 21602135 | 21602140 | + |
| SEQ ID NO 24457 | ATTCATGAAGAAACTGTTATTC | TTT | chr12 | 21602119 | 21602140 | 21602136 | 21602141 | + |
| SEQ ID NO 24458 | TTCATGAAGAAACTGTTATTCA | TTA | chr12 | 21602120 | 21602141 | 21602137 | 21602142 | + |
| SEQ ID NO 24459 | ATGAAGAAACTGTTATTCAGTT | TTC | chr12 | 21602123 | 21602144 | 21602140 | 21602145 | + |
| SEQ ID NO 24460 | TTATTCAGTTTAAGGGGTTCTT | CTG | chr12 | 21602135 | 21602156 | 21602152 | 21602157 | + |
| SEQ ID NO 24461 | TCAGTTTAAGGGGTTCTTTTT | TTA | chr12 | 21602138 | 21602159 | 21602155 | 21602160 | + |
| SEQ ID NO 24462 | AGTTTAAGGGGTTCTTTTTCAG | TTC | chr12 | 21602141 | 21602162 | 21602158 | 21602163 | + |
| SEQ ID NO 24463 | AAGGGGTTCTTTTTCAGAAAGT | TTT | chr12 | 21602146 | 21602167 | 21602163 | 21602168 | + |
| SEQ ID NO 24464 | AGGGGTTCTTTTTCAGAAAGTT | TTA | chr12 | 21602147 | 21602168 | 21602164 | 21602169 | + |
| SEQ ID NO 24465 | TTTTTCAGAAAGTTTCAGAAAT | TTC | chr12 | 21602155 | 21602176 | 21602172 | 21602177 | + |
| SEQ ID NO 24466 | TTTCAGAAAGTTTCAGAAATCC | CTT | chr12 | 21602157 | 21602178 | 21602174 | 21602179 | + |
| SEQ ID NO 24467 | TTCAGAAAGTTTCAGAAATCCA | TTT | chr12 | 21602158 | 21602179 | 21602175 | 21602180 | + |
| SEQ ID NO 24468 | TCAGAAAGTTTCAGAAATCCAA | TTT | chr12 | 21602159 | 21602180 | 21602176 | 21602181 | + |
| SEQ ID NO 24469 | CAGAAAGTTTCAGAAATCCAAG | TTT | chr12 | 21602160 | 21602181 | 21602177 | 21602182 | + |
| SEQ ID NO 24470 | AGAAAGTTTCAGAAATCCAAGA | TTC | chr12 | 21602161 | 21602182 | 21602178 | 21602183 | + |
| SEQ ID NO 24471 | CAGAAATCCAAGACCTTTGACT | TTT | chr12 | 21602170 | 21602191 | 21602187 | 21602192 | + |
| SEQ ID NO 24472 | AGAAATCCAAGACCTTTGACTG | TTC | chr12 | 21602171 | 21602192 | 21602188 | 21602193 | + |
| SEQ ID NO 24473 | TGACTGCAAGTACTGTGTTCTT | CTT | chr12 | 21602187 | 21602208 | 21602204 | 21602209 | + |
| SEQ ID NO 24474 | GACTGCAAGTACTGTGTTCTTT | TTT | chr12 | 21602188 | 21602209 | 21602205 | 21602210 | + |
| SEQ ID NO 24475 | ACTGCAAGTACTGTGTTCTTTC | TTG | chr12 | 21602189 | 21602210 | 21602206 | 21602211 | + |
| SEQ ID NO 24476 | CAAGTACTGTGTTCTTTCATCT | CTG | chr12 | 21602193 | 21602214 | 21602210 | 21602215 | + |
| SEQ ID NO 24477 | TGTTCTTTCATCTATAGGACAT | CTG | chr12 | 21602202 | 21602223 | 21602219 | 21602224 | + |
| SEQ ID NO 24478 | TTTCATCTATAGGACATTTCCT | TTC | chr12 | 21602207 | 21602228 | 21602224 | 21602229 | + |
| SEQ ID NO 24479 | TCATCTATAGGACATTTCCTTT | CTT | chr12 | 21602209 | 21602230 | 21602226 | 21602231 | + |
| SEQ ID NO 24480 | CATCTATAGGACATTTCCTTTG | TTT | chr12 | 21602210 | 21602231 | 21602227 | 21602232 | + |
| SEQ ID NO 24481 | ATCTATAGGACATTTCCTTTGA | TTC | chr12 | 21602211 | 21602232 | 21602228 | 21602233 | + |
| SEQ ID NO 24482 | TAGGACATTTCCTTTGAAAACT | CTA | chr12 | 21602216 | 21602237 | 21602233 | 21602238 | + |
| SEQ ID NO 24483 | CCTTTGAAAACTGAGGTTTTAA | TTT | chr12 | 21602226 | 21602247 | 21602243 | 21602248 | + |
| SEQ ID NO 24484 | CTTTGAAAACTGAGGTTTTAAT | TTC | chr12 | 21602227 | 21602248 | 21602244 | 21602249 | + |
| SEQ ID NO 24485 | TGAAAACTGAGGTTTTAATATT | CTT | chr12 | 21602230 | 21602251 | 21602247 | 21602252 | + |

Figure 48 (Cont'd)

| SEQ ID NO 24486 | GAAAACTGAGGTTTTAATATTT | TTT | chr12 | 21602231 | 21602252 | 21602248 | 21602253 | + |
|---|---|---|---|---|---|---|---|---|
| SEQ ID NO 24487 | AAAACTGAGGTTTTAATATTTA | TTG | chr12 | 21602232 | 21602253 | 21602249 | 21602254 | + |
| SEQ ID NO 24488 | AGGTTTTAATATTTAATTCTTA | CTG | chr12 | 21602239 | 21602260 | 21602256 | 21602261 | + |
| SEQ ID NO 24489 | TAATATTTAATTCTTACATAAT | TTT | chr12 | 21602245 | 21602266 | 21602262 | 21602267 | + |
| SEQ ID NO 24490 | AATATTTAATTCTTACATAATA | TTT | chr12 | 21602246 | 21602267 | 21602263 | 21602268 | + |
| SEQ ID NO 24491 | ATATTTAATTCTTACATAATAG | TTA | chr12 | 21602247 | 21602268 | 21602264 | 21602269 | + |
| SEQ ID NO 24492 | AATTCTTACATAATAGTAAAAA | TTT | chr12 | 21602253 | 21602274 | 21602270 | 21602275 | + |
| SEQ ID NO 24493 | ATTCTTACATAATAGTAAAAAA | TTA | chr12 | 21602254 | 21602275 | 21602271 | 21602276 | + |
| SEQ ID NO 24494 | TTACATAATAGTAAAAAAGTGA | TTC | chr12 | 21602258 | 21602279 | 21602275 | 21602280 | + |
| SEQ ID NO 24495 | ACATAATAGTAAAAAAGTGAAT | CTT | chr12 | 21602260 | 21602281 | 21602277 | 21602282 | + |
| SEQ ID NO 24496 | CATAATAGTAAAAAAGTGAATT | TTA | chr12 | 21602261 | 21602282 | 21602278 | 21602283 | + |
| SEQ ID NO 24497 | GCCTTGGAAAAGACCTAAATCC | TTG | chr12 | 21602284 | 21602305 | 21602301 | 21602306 | + |
| SEQ ID NO 24498 | GGAAAAGACCTAAATCCTGGTC | CTT | chr12 | 21602289 | 21602310 | 21602306 | 21602311 | + |
| SEQ ID NO 24499 | GAAAAGACCTAAATCCTGGTCC | TTG | chr12 | 21602290 | 21602311 | 21602307 | 21602312 | + |
| SEQ ID NO 24500 | AATCCTGGTCCTAACTCTGCCA | CTA | chr12 | 21602301 | 21602322 | 21602318 | 21602323 | + |
| SEQ ID NO 24501 | GTCCTAACTCTGCCATTTGCTT | CTG | chr12 | 21602308 | 21602329 | 21602325 | 21602330 | + |
| SEQ ID NO 24502 | ACTCTGCCATTTGCTTGATCAT | CTA | chr12 | 21602314 | 21602335 | 21602331 | 21602336 | + |
| SEQ ID NO 24503 | TGCCATTTGCTTGATCATTAAA | CTC | chr12 | 21602318 | 21602339 | 21602335 | 21602340 | + |
| SEQ ID NO 24504 | CCATTTGCTTGATCATTAAATA | CTG | chr12 | 21602320 | 21602341 | 21602337 | 21602342 | + |
| SEQ ID NO 24505 | GCTTGATCATTAAATACCTCTA | TTT | chr12 | 21602326 | 21602347 | 21602343 | 21602348 | + |
| SEQ ID NO 24506 | CTTGATCATTAAATACCTCTAC | TTG | chr12 | 21602327 | 21602348 | 21602344 | 21602349 | + |
| SEQ ID NO 24507 | GATCATTAAATACCTCTACGAA | CTT | chr12 | 21602330 | 21602351 | 21602347 | 21602352 | + |
| SEQ ID NO 24508 | ATCATTAAATACCTCTACGAAT | TTG | chr12 | 21602331 | 21602352 | 21602348 | 21602353 | + |
| SEQ ID NO 24509 | AATACCTCTACGAATCAATTTG | TTA | chr12 | 21602338 | 21602359 | 21602355 | 21602360 | + |
| SEQ ID NO 24510 | TACGAATCAATTTGCTCTATGA | CTC | chr12 | 21602346 | 21602367 | 21602363 | 21602368 | + |
| SEQ ID NO 24511 | CGAATCAATTTGCTCTATGAAC | CTA | chr12 | 21602348 | 21602369 | 21602365 | 21602370 | + |
| SEQ ID NO 24512 | GCTCTATGAACTGGAGGAGTGG | TTT | chr12 | 21602359 | 21602380 | 21602376 | 21602381 | + |
| SEQ ID NO 24513 | CTCTATGAACTGGAGGAGTGGG | TTG | chr12 | 21602360 | 21602381 | 21602377 | 21602382 | + |
| SEQ ID NO 24514 | TATGAACTGGAGGAGTGGGATT | CTC | chr12 | 21602363 | 21602384 | 21602380 | 21602385 | + |
| SEQ ID NO 24515 | TGAACTGGAGGAGTGGGATTCA | CTA | chr12 | 21602365 | 21602386 | 21602382 | 21602387 | + |
| SEQ ID NO 24516 | GAGGAGTGGGATTCATGATCTC | CTG | chr12 | 21602372 | 21602393 | 21602389 | 21602394 | + |
| SEQ ID NO 24517 | ATGATCTCTAAGATACCTCATA | TTC | chr12 | 21602386 | 21602407 | 21602403 | 21602408 | + |
| SEQ ID NO 24518 | TAAGATACCTCATATCACTACT | CTC | chr12 | 21602394 | 21602415 | 21602411 | 21602416 | + |
| SEQ ID NO 24519 | AGATACCTCATATCACTACTAT | CTA | chr12 | 21602396 | 21602417 | 21602413 | 21602418 | + |
| SEQ ID NO 24520 | ATATCACTACTATGAAATGCAG | CTC | chr12 | 21602405 | 21602426 | 21602422 | 21602427 | + |
| SEQ ID NO 24521 | CTATGAAATGCAGGGAAGTAAA | CTA | chr12 | 21602414 | 21602435 | 21602431 | 21602436 | + |
| SEQ ID NO 24522 | TGAAATGCAGGGAAGTAAAAAT | CTA | chr12 | 21602417 | 21602438 | 21602434 | 21602439 | + |
| SEQ ID NO 24523 | AAATCATTAAATTTAAAGAAAC | TTC | chr12 | 21602441 | 21602462 | 21602458 | 21602463 | + |
| SEQ ID NO 24524 | AATTTAAAGAAACTATAGTGGC | TTA | chr12 | 21602450 | 21602471 | 21602467 | 21602472 | + |
| SEQ ID NO 24525 | AAAGAAACTATAGTGGCAATGT | TTT | chr12 | 21602455 | 21602476 | 21602472 | 21602477 | + |
| SEQ ID NO 24526 | AAGAAACTATAGTGGCAATGTA | TTA | chr12 | 21602456 | 21602477 | 21602473 | 21602478 | + |
| SEQ ID NO 24527 | TAGTGGCAATGTATTATTAGGA | CTA | chr12 | 21602465 | 21602486 | 21602482 | 21602487 | + |
| SEQ ID NO 24528 | TTAGGAATAAACACAATAATTA | TTA | chr12 | 21602481 | 21602502 | 21602498 | 21602503 | + |
| SEQ ID NO 24529 | GGAATAAACACAATAATTATCC | TTA | chr12 | 21602484 | 21602505 | 21602501 | 21602506 | + |
| SEQ ID NO 24530 | TCCATCTATATGAAAATCTCAA | TTA | chr12 | 21602503 | 21602524 | 21602520 | 21602525 | + |
| SEQ ID NO 24531 | TATGAAAATCTCAAACCATACC | CTA | chr12 | 21602511 | 21602532 | 21602528 | 21602533 | + |
| SEQ ID NO 24532 | AAACCATACCAGGCTATGATAA | CTC | chr12 | 21602523 | 21602544 | 21602540 | 21602545 | + |
| SEQ ID NO 24533 | TGATAATATTAAAATAAAGATA | CTA | chr12 | 21602539 | 21602560 | 21602556 | 21602561 | + |
| SEQ ID NO 24534 | AAATAAAGATACATTGAAGATG | TTA | chr12 | 21602550 | 21602571 | 21602567 | 21602572 | + |
| SEQ ID NO 24535 | AAGATGATATCAACTTGTGTAA | TTG | chr12 | 21602566 | 21602587 | 21602583 | 21602588 | + |
| SEQ ID NO 24536 | GTGTAAATCACATTGTGGGGAC | CTT | chr12 | 21602582 | 21602603 | 21602599 | 21602604 | + |
| SEQ ID NO 24537 | TGTAAATCACATTGTGGGGACC | TTG | chr12 | 21602583 | 21602604 | 21602600 | 21602605 | + |
| SEQ ID NO 24538 | TGGGGACCTCTCCACAAAAACA | TTG | chr12 | 21602597 | 21602618 | 21602614 | 21602619 | + |
| SEQ ID NO 24539 | TCCACAAAAACACTTCCCTTCC | CTC | chr12 | 21602607 | 21602628 | 21602624 | 21602629 | + |
| SEQ ID NO 24540 | CACAAAAACACTTCCCTTCCCC | CTC | chr12 | 21602609 | 21602630 | 21602626 | 21602631 | + |
| SEQ ID NO 24541 | CCCTTCCCCTTGAAAGGGAAAT | CTT | chr12 | 21602622 | 21602643 | 21602639 | 21602644 | + |
| SEQ ID NO 24542 | CCTTCCCCTTGAAAGGGAAATG | TTC | chr12 | 21602623 | 21602644 | 21602640 | 21602645 | + |
| SEQ ID NO 24543 | CCCCTTGAAAGGGAAATGATAG | CTT | chr12 | 21602627 | 21602648 | 21602644 | 21602649 | + |

Figure 48 (Cont'd)

| SEQ ID NO 24544 | CCCTTGAAAGGGAAATGATAGA | TTC | chr12 | 21602628 | 21602649 | 21602645 | 21602650 | + |
| SEQ ID NO 24545 | GAAAGGGAAATGATAGAAAATA | CTT | chr12 | 21602633 | 21602654 | 21602650 | 21602655 | + |
| SEQ ID NO 24546 | AAAGGGAAATGATAGAAAATAA | TTG | chr12 | 21602634 | 21602655 | 21602651 | 21602656 | + |
| SEQ ID NO 24547 | AAGGCAGCTTAGGGGTTGAAAA | TTA | chr12 | 21602662 | 21602683 | 21602679 | 21602684 | + |
| SEQ ID NO 24548 | AGGGGTTGAAAAACAAATTTTT | CTT | chr12 | 21602672 | 21602693 | 21602689 | 21602694 | + |
| SEQ ID NO 24549 | GGGGTTGAAAAACAAATTTTTT | TTA | chr12 | 21602673 | 21602694 | 21602690 | 21602695 | + |
| SEQ ID NO 24550 | AAAAACAAATTTTTTCAAAAAA | TTG | chr12 | 21602680 | 21602701 | 21602697 | 21602702 | + |
| SEQ ID NO 24551 | TTTCAAAAAAAAATCCATTGAG | TTT | chr12 | 21602692 | 21602713 | 21602709 | 21602714 | + |
| SEQ ID NO 24552 | TTCAAAAAAAAATCCATTGAGC | TTT | chr12 | 21602693 | 21602714 | 21602710 | 21602715 | + |
| SEQ ID NO 24553 | TCAAAAAAAAATCCATTGAGCA | TTT | chr12 | 21602694 | 21602715 | 21602711 | 21602716 | + |
| SEQ ID NO 24554 | CAAAAAAAAATCCATTGAGCAT | TTT | chr12 | 21602695 | 21602716 | 21602712 | 21602717 | + |
| SEQ ID NO 24555 | AAAAAAAAATCCATTGAGCATT | TTC | chr12 | 21602696 | 21602717 | 21602713 | 21602718 | + |
| SEQ ID NO 24556 | AGCATTTTCTATGTACCAGGCA | TTG | chr12 | 21602712 | 21602733 | 21602729 | 21602734 | + |
| SEQ ID NO 24557 | TCTATGTACCAGGCACTGTTCT | TTT | chr12 | 21602719 | 21602740 | 21602736 | 21602741 | + |
| SEQ ID NO 24558 | CTATGTACCAGGCACTGTTCTA | TTT | chr12 | 21602720 | 21602741 | 21602737 | 21602742 | + |
| SEQ ID NO 24559 | TATGTACCAGGCACTGTTCTAG | TTC | chr12 | 21602721 | 21602742 | 21602738 | 21602743 | + |
| SEQ ID NO 24560 | TGTACCAGGCACTGTTCTAGAC | CTA | chr12 | 21602723 | 21602744 | 21602740 | 21602745 | + |
| SEQ ID NO 24561 | TTCTAGACCCTGAGATCAACAC | CTG | chr12 | 21602737 | 21602758 | 21602754 | 21602759 | + |
| SEQ ID NO 24562 | TAGACCCTGAGATCAACACACA | TTC | chr12 | 21602740 | 21602761 | 21602757 | 21602762 | + |
| SEQ ID NO 24563 | GACCCTGAGATCAACACACATG | CTA | chr12 | 21602742 | 21602763 | 21602759 | 21602764 | + |
| SEQ ID NO 24564 | AGATCAACACACATGCTACTGA | CTG | chr12 | 21602749 | 21602770 | 21602766 | 21602771 | + |
| SEQ ID NO 24565 | CTGATTATAAGATCCATAAAAT | CTA | chr12 | 21602767 | 21602788 | 21602784 | 21602789 | + |
| SEQ ID NO 24566 | ATTATAAGATCCATAAAATAAC | CTG | chr12 | 21602770 | 21602791 | 21602787 | 21602792 | + |
| SEQ ID NO 24567 | TAAGATCCATAAAATAACTTAG | TTA | chr12 | 21602774 | 21602795 | 21602791 | 21602796 | + |
| SEQ ID NO 24568 | AGTTTCACTGGCGTGTTCCCAG | CTT | chr12 | 21602794 | 21602815 | 21602811 | 21602816 | + |
| SEQ ID NO 24569 | GTTTCACTGGCGTGTTCCCAGT | TTA | chr12 | 21602795 | 21602816 | 21602812 | 21602817 | + |
| SEQ ID NO 24570 | CACTGGCGTGTTCCCAGTGCCC | TTT | chr12 | 21602799 | 21602820 | 21602816 | 21602821 | + |
| SEQ ID NO 24571 | ACTGGCGTGTTCCCAGTGCCCA | TTC | chr12 | 21602800 | 21602821 | 21602817 | 21602822 | + |
| SEQ ID NO 24572 | GCGTGTTCCCAGTGCCCAGGTA | CTG | chr12 | 21602804 | 21602825 | 21602821 | 21602826 | + |
| SEQ ID NO 24573 | CCAGTGCCCAGGTAACAGTGCT | TTC | chr12 | 21602812 | 21602833 | 21602829 | 21602834 | + |
| SEQ ID NO 24574 | CATTAATGTTTGTTAAATGATG | CTC | chr12 | 21602835 | 21602856 | 21602852 | 21602857 | + |
| SEQ ID NO 24575 | ATGTTTGTTAAATGATGAGAAA | TTA | chr12 | 21602840 | 21602861 | 21602857 | 21602862 | + |
| SEQ ID NO 24576 | GTTAAATGATGAGAAAGAGGA | TTT | chr12 | 21602846 | 21602867 | 21602863 | 21602868 | + |
| SEQ ID NO 24577 | TTAAATGATGAGAAAGAGGAA | TTG | chr12 | 21602847 | 21602868 | 21602864 | 21602869 | + |
| SEQ ID NO 24578 | AATGATGAGAAAGAGGAAAGC | TTA | chr12 | 21602850 | 21602871 | 21602867 | 21602872 | + |
| SEQ ID NO 24579 | TGCTCAGGTGCAGGAACTTGTG | CTC | chr12 | 21602883 | 21602904 | 21602900 | 21602905 | + |
| SEQ ID NO 24580 | CTCAGGTGCAGGAACTTGTGCA | CTG | chr12 | 21602885 | 21602906 | 21602902 | 21602907 | + |
| SEQ ID NO 24581 | AGGTGCAGGAACTTGTGCAGAG | CTC | chr12 | 21602888 | 21602909 | 21602905 | 21602910 | + |
| SEQ ID NO 24582 | GTGCAGAGATCTTCTGGACTGA | CTT | chr12 | 21602902 | 21602923 | 21602919 | 21602924 | + |
| SEQ ID NO 24583 | TGCAGAGATCTTCTGGACTGAT | TTG | chr12 | 21602903 | 21602924 | 21602920 | 21602925 | + |
| SEQ ID NO 24584 | CTGGACTGATTCCCAGTGCTAA | CTT | chr12 | 21602915 | 21602936 | 21602932 | 21602937 | + |
| SEQ ID NO 24585 | TGGACTGATTCCCAGTGCTAAC | TTC | chr12 | 21602916 | 21602937 | 21602933 | 21602938 | + |
| SEQ ID NO 24586 | GACTGATTCCCAGTGCTAACAA | CTG | chr12 | 21602918 | 21602939 | 21602935 | 21602940 | + |
| SEQ ID NO 24587 | ATTCCCAGTGCTAACAAGTCCC | CTG | chr12 | 21602923 | 21602944 | 21602940 | 21602945 | + |
| SEQ ID NO 24588 | CCAGTGCTAACAAGTCCCTTCC | TTC | chr12 | 21602927 | 21602948 | 21602944 | 21602949 | + |
| SEQ ID NO 24589 | ACAAGTCCCTTCCAGTTTTATC | CTA | chr12 | 21602936 | 21602957 | 21602953 | 21602958 | + |
| SEQ ID NO 24590 | CCAGTTTTATCCACCAATAAGC | CTT | chr12 | 21602947 | 21602968 | 21602964 | 21602969 | + |
| SEQ ID NO 24591 | CAGTTTTATCCACCAATAAGCT | TTC | chr12 | 21602948 | 21602969 | 21602965 | 21602970 | + |
| SEQ ID NO 24592 | TATCCACCAATAAGCTATGTCC | TTT | chr12 | 21602954 | 21602975 | 21602971 | 21602976 | + |
| SEQ ID NO 24593 | ATCCACCAATAAGCTATGTCCT | TTT | chr12 | 21602955 | 21602976 | 21602972 | 21602977 | + |
| SEQ ID NO 24594 | TCCACCAATAAGCTATGTCCTT | TTA | chr12 | 21602956 | 21602977 | 21602973 | 21602978 | + |
| SEQ ID NO 24595 | TGTCCTTGAGCTCCTGCCCACT | CTA | chr12 | 21602971 | 21602992 | 21602988 | 21602993 | + |
| SEQ ID NO 24596 | GAGCTCCTGCCCACTCTCTAGA | CTT | chr12 | 21602978 | 21602999 | 21602995 | 21603000 | + |
| SEQ ID NO 24597 | AGCTCCTGCCCACTCTCTAGAG | TTG | chr12 | 21602979 | 21603000 | 21602996 | 21603001 | + |
| SEQ ID NO 24598 | CTGCCCACTCTCTAGAGAAAAC | CTC | chr12 | 21602984 | 21603005 | 21603001 | 21603006 | + |
| SEQ ID NO 24599 | CCCACTCTCTAGAGAAAACTTT | CTG | chr12 | 21602987 | 21603008 | 21603004 | 21603009 | + |
| SEQ ID NO 24600 | TCTAGAGAAAACTTTTATTTCA | CTC | chr12 | 21602994 | 21603015 | 21603011 | 21603016 | + |
| SEQ ID NO 24601 | TAGAGAAAACTTTTATTTCAAG | CTC | chr12 | 21602996 | 21603017 | 21603013 | 21603018 | + |

Figure 48 (Cont'd)

| | | | | | | | | |
|---|---|---|---|---|---|---|---|---|
| SEQ ID NO 24602 | GAGAAAACTTTTATTTCAAGGC | CTA | chr12 | 21602998 | 21603019 | 21603015 | 21603020 | + |
| SEQ ID NO 24603 | TTATTTCAAGGCATACTCCGGG | CTT | chr12 | 21603008 | 21603029 | 21603025 | 21603030 | + |
| SEQ ID NO 24604 | TATTTCAAGGCATACTCCGGGA | TTT | chr12 | 21603009 | 21603030 | 21603026 | 21603031 | + |
| SEQ ID NO 24605 | ATTTCAAGGCATACTCCGGGAT | TTT | chr12 | 21603010 | 21603031 | 21603027 | 21603032 | + |
| SEQ ID NO 24606 | TTTCAAGGCATACTCCGGGATT | TTA | chr12 | 21603011 | 21603032 | 21603028 | 21603033 | + |
| SEQ ID NO 24607 | CAAGGCATACTCCGGGATTCAC | TTT | chr12 | 21603014 | 21603035 | 21603031 | 21603036 | + |
| SEQ ID NO 24608 | AAGGCATACTCCGGGATTCACA | TTC | chr12 | 21603015 | 21603036 | 21603032 | 21603037 | + |
| SEQ ID NO 24609 | CGGGATTCACATGTGATAGAGA | CTC | chr12 | 21603026 | 21603047 | 21603043 | 21603048 | + |
| SEQ ID NO 24610 | ACATGTGATAGAGATGGTTCTG | TTC | chr12 | 21603034 | 21603055 | 21603051 | 21603056 | + |
| SEQ ID NO 24611 | TGTTCCCAGGAACTTTGGGCAT | TTC | chr12 | 21603054 | 21603075 | 21603071 | 21603076 | + |
| SEQ ID NO 24612 | TTCCCAGGAACTTTGGGCATAT | CTG | chr12 | 21603056 | 21603077 | 21603073 | 21603078 | + |
| SEQ ID NO 24613 | CCAGGAACTTTGGGCATATTTA | TTC | chr12 | 21603059 | 21603080 | 21603076 | 21603081 | + |
| SEQ ID NO 24614 | TGGGCATATTTAAAAACTGGAC | CTT | chr12 | 21603069 | 21603090 | 21603086 | 21603091 | + |
| SEQ ID NO 24615 | GGGCATATTTAAAAACTGGACT | TTT | chr12 | 21603070 | 21603091 | 21603087 | 21603092 | + |
| SEQ ID NO 24616 | GGCATATTTAAAAACTGGACTG | TTG | chr12 | 21603071 | 21603092 | 21603088 | 21603093 | + |
| SEQ ID NO 24617 | AAAAACTGGACTGGAAAAATTT | TTT | chr12 | 21603080 | 21603101 | 21603097 | 21603102 | + |
| SEQ ID NO 24618 | AAAACTGGACTGGAAAAATTTG | TTA | chr12 | 21603081 | 21603102 | 21603098 | 21603103 | + |
| SEQ ID NO 24619 | GACTGGAAAAATTTGTGACTAG | CTG | chr12 | 21603088 | 21603109 | 21603105 | 21603110 | + |
| SEQ ID NO 24620 | GAAAAATTTGTGACTAGAAAAA | CTG | chr12 | 21603093 | 21603114 | 21603110 | 21603115 | + |
| SEQ ID NO 24621 | GTGACTAGAAAAAGGACATTAA | TTT | chr12 | 21603102 | 21603123 | 21603119 | 21603124 | + |
| SEQ ID NO 24622 | TGACTAGAAAAAGGACATTAAA | TTG | chr12 | 21603103 | 21603124 | 21603120 | 21603125 | + |
| SEQ ID NO 24623 | GAAAAAGGACATTAAAAACACA | CTA | chr12 | 21603109 | 21603130 | 21603126 | 21603131 | + |
| SEQ ID NO 24624 | AAAACACATGCTCATTTCAGGA | TTA | chr12 | 21603123 | 21603144 | 21603140 | 21603145 | + |
| SEQ ID NO 24625 | ATTTCAGGATAAAGATCTCTGA | CTC | chr12 | 21603136 | 21603157 | 21603153 | 21603158 | + |
| SEQ ID NO 24626 | CAGGATAAAGATCTCTGAGGAA | TTT | chr12 | 21603140 | 21603161 | 21603157 | 21603162 | + |
| SEQ ID NO 24627 | AGGATAAAGATCTCTGAGGAAA | TTC | chr12 | 21603141 | 21603162 | 21603158 | 21603163 | + |
| SEQ ID NO 24628 | TGAGGAAAGAATACAAAATAA | CTC | chr12 | 21603155 | 21603176 | 21603172 | 21603177 | + |
| SEQ ID NO 24629 | AGGAAAAGAATACAAAATAATT | CTG | chr12 | 21603157 | 21603178 | 21603174 | 21603179 | + |
| SEQ ID NO 24630 | AAAAGAAACAACAGAAACAGG | TTT | chr12 | 21603180 | 21603201 | 21603197 | 21603202 | + |
| SEQ ID NO 24631 | AAAAGAAACAACAGAAACAGGT | TTA | chr12 | 21603181 | 21603202 | 21603198 | 21603203 | + |
| SEQ ID NO 24632 | CACTTCTCTGTAATAAGGTTTC | CTT | chr12 | 21603218 | 21603239 | 21603235 | 21603240 | + |
| SEQ ID NO 24633 | ACTTCTCTGTAATAAGGTTTCT | TTC | chr12 | 21603219 | 21603240 | 21603236 | 21603241 | + |
| SEQ ID NO 24634 | CTCTGTAATAAGGTTTCTGTCC | CTT | chr12 | 21603223 | 21603244 | 21603240 | 21603245 | + |
| SEQ ID NO 24635 | TCTGTAATAAGGTTTCTGTCCT | TTC | chr12 | 21603224 | 21603245 | 21603241 | 21603246 | + |
| SEQ ID NO 24636 | TGTAATAAGGTTTCTGTCCTCC | CTC | chr12 | 21603226 | 21603247 | 21603243 | 21603248 | + |
| SEQ ID NO 24637 | TAATAAGGTTTCTGTCCTCCTA | CTG | chr12 | 21603228 | 21603249 | 21603245 | 21603250 | + |
| SEQ ID NO 24638 | CTGTCCTCCTAGATTCTTTCTC | TTT | chr12 | 21603239 | 21603260 | 21603256 | 21603261 | + |
| SEQ ID NO 24639 | TGTCCTCCTAGATTCTTTCTCA | TTC | chr12 | 21603240 | 21603261 | 21603257 | 21603262 | + |
| SEQ ID NO 24640 | TCCTCCTAGATTCTTTCTCACT | CTG | chr12 | 21603242 | 21603263 | 21603259 | 21603264 | + |
| SEQ ID NO 24641 | CTAGATTCTTTCTCACTAAACT | CTC | chr12 | 21603247 | 21603268 | 21603264 | 21603269 | + |
| SEQ ID NO 24642 | GATTCTTTCTCACTAAACTACA | CTA | chr12 | 21603250 | 21603271 | 21603267 | 21603272 | + |
| SEQ ID NO 24643 | TTTCTCACTAAACTACAGAGAA | TTC | chr12 | 21603255 | 21603276 | 21603272 | 21603277 | + |
| SEQ ID NO 24644 | TCTCACTAAACTACAGAGAATA | CTT | chr12 | 21603257 | 21603278 | 21603274 | 21603279 | + |
| SEQ ID NO 24645 | CTCACTAAACTACAGAGAATAA | TTT | chr12 | 21603258 | 21603279 | 21603275 | 21603280 | + |
| SEQ ID NO 24646 | TCACTAAACTACAGAGAATAAG | TTC | chr12 | 21603259 | 21603280 | 21603276 | 21603281 | + |
| SEQ ID NO 24647 | ACTAAACTACAGAGAATAAGAC | CTC | chr12 | 21603261 | 21603282 | 21603278 | 21603283 | + |
| SEQ ID NO 24648 | AACTACAGAGAATAAGACCGTG | CTA | chr12 | 21603265 | 21603286 | 21603282 | 21603287 | + |
| SEQ ID NO 24649 | CAGAGAATAAGACCGTGCTTTG | CTA | chr12 | 21603270 | 21603291 | 21603287 | 21603292 | + |
| SEQ ID NO 24650 | TGTTCTCTTATATGCATTCTGT | CTT | chr12 | 21603290 | 21603311 | 21603307 | 21603312 | + |
| SEQ ID NO 24651 | GTTCTCTTATATGCATTCTGTC | TTT | chr12 | 21603291 | 21603312 | 21603308 | 21603313 | + |
| SEQ ID NO 24652 | TTCTCTTATATGCATTCTGTCC | TTG | chr12 | 21603292 | 21603313 | 21603309 | 21603314 | + |
| SEQ ID NO 24653 | TCTTATATGCATTCTGTCCACT | TTC | chr12 | 21603295 | 21603316 | 21603312 | 21603317 | + |
| SEQ ID NO 24654 | TTATATGCATTCTGTCCACTTC | CTC | chr12 | 21603297 | 21603318 | 21603314 | 21603319 | + |
| SEQ ID NO 24655 | ATATGCATTCTGTCCACTTCTA | CTT | chr12 | 21603299 | 21603320 | 21603316 | 21603321 | + |
| SEQ ID NO 24656 | TATGCATTCTGTCCACTTCTAC | TTA | chr12 | 21603300 | 21603321 | 21603317 | 21603322 | + |
| SEQ ID NO 24657 | TGTCCACTTCTACATAGGCAAA | TTC | chr12 | 21603309 | 21603330 | 21603326 | 21603331 | + |
| SEQ ID NO 24658 | TCCACTTCTACATAGGCAAAAT | CTG | chr12 | 21603311 | 21603332 | 21603328 | 21603333 | + |
| SEQ ID NO 24659 | CTACATAGGCAAAATTGACTTT | CTT | chr12 | 21603318 | 21603339 | 21603335 | 21603340 | + |

Figure 48 (Cont'd)

| | | | | | | | | |
|---|---|---|---|---|---|---|---|---|
| SEQ ID NO 24660 | TACATAGGCAAAATTGACTTTT | TTC | chr12 | 21603319 | 21603340 | 21603336 | 21603341 | + |
| SEQ ID NO 24661 | CATAGGCAAAATTGACTTTTAA | CTA | chr12 | 21603321 | 21603342 | 21603338 | 21603343 | + |
| SEQ ID NO 24662 | ACTTTTAATTTTGATTTTATGA | TTG | chr12 | 21603335 | 21603356 | 21603352 | 21603357 | + |
| SEQ ID NO 24663 | TTAATTTTGATTTTATGAATGC | CTT | chr12 | 21603339 | 21603360 | 21603356 | 21603361 | + |
| SEQ ID NO 24664 | TAATTTTGATTTTATGAATGCA | TTT | chr12 | 21603340 | 21603361 | 21603357 | 21603362 | + |
| SEQ ID NO 24665 | AATTTTGATTTTATGAATGCAT | TTT | chr12 | 21603341 | 21603362 | 21603358 | 21603363 | + |
| SEQ ID NO 24666 | ATTTTGATTTTATGAATGCATA | TTA | chr12 | 21603342 | 21603363 | 21603359 | 21603364 | + |
| SEQ ID NO 24667 | TGATTTTATGAATGCATACACA | TTT | chr12 | 21603346 | 21603367 | 21603363 | 21603368 | + |
| SEQ ID NO 24668 | GATTTTATGAATGCATACACAC | TTT | chr12 | 21603347 | 21603368 | 21603364 | 21603369 | + |
| SEQ ID NO 24669 | ATTTTATGAATGCATACACACG | TTG | chr12 | 21603348 | 21603369 | 21603365 | 21603370 | + |
| SEQ ID NO 24670 | TATGAATGCATACACACGAGAA | TTT | chr12 | 21603352 | 21603373 | 21603369 | 21603374 | + |
| SEQ ID NO 24671 | ATGAATGCATACACACGAGAAC | TTT | chr12 | 21603353 | 21603374 | 21603370 | 21603375 | + |
| SEQ ID NO 24672 | TGAATGCATACACACGAGAACT | TTA | chr12 | 21603354 | 21603375 | 21603371 | 21603376 | + |
| SEQ ID NO 24673 | TGAACAGTTAGTATAAGGTGAA | CTT | chr12 | 21603377 | 21603398 | 21603394 | 21603399 | + |
| SEQ ID NO 24674 | GAACAGTTAGTATAAGGTGAAT | TTT | chr12 | 21603378 | 21603399 | 21603395 | 21603400 | + |
| SEQ ID NO 24675 | AACAGTTAGTATAAGGTGAATT | TTG | chr12 | 21603379 | 21603400 | 21603396 | 21603401 | + |
| SEQ ID NO 24676 | GTATAAGGTGAATTCTGATTTT | TTA | chr12 | 21603387 | 21603408 | 21603404 | 21603409 | + |
| SEQ ID NO 24677 | TGATTTTTCAGAATGCATGCCA | TTC | chr12 | 21603402 | 21603423 | 21603419 | 21603424 | + |
| SEQ ID NO 24678 | ATTTTTCAGAATGCATGCCATA | CTG | chr12 | 21603404 | 21603425 | 21603421 | 21603426 | + |
| SEQ ID NO 24679 | TTCAGAATGCATGCCATATATA | TTT | chr12 | 21603408 | 21603429 | 21603425 | 21603430 | + |
| SEQ ID NO 24680 | TCAGAATGCATGCCATATATAA | TTT | chr12 | 21603409 | 21603430 | 21603426 | 21603431 | + |
| SEQ ID NO 24681 | CAGAATGCATGCCATATATAAT | TTT | chr12 | 21603410 | 21603431 | 21603427 | 21603432 | + |
| SEQ ID NO 24682 | AGAATGCATGCCATATATAATG | TTC | chr12 | 21603411 | 21603432 | 21603428 | 21603433 | + |
| SEQ ID NO 24683 | AATTTTGAGATTATGCTGGCTC | TTT | chr12 | 21603438 | 21603459 | 21603455 | 21603460 | + |
| SEQ ID NO 24684 | ATTTTGAGATTATGCTGGCTCT | TTA | chr12 | 21603439 | 21603460 | 21603456 | 21603461 | + |
| SEQ ID NO 24685 | TGAGATTATGCTGGCTCTGATT | TTT | chr12 | 21603443 | 21603464 | 21603460 | 21603465 | + |
| SEQ ID NO 24686 | GAGATTATGCTGGCTCTGATTA | TTT | chr12 | 21603444 | 21603465 | 21603461 | 21603466 | + |
| SEQ ID NO 24687 | AGATTATGCTGGCTCTGATTAG | TTG | chr12 | 21603445 | 21603466 | 21603462 | 21603467 | + |
| SEQ ID NO 24688 | TGCTGGCTCTGATTAGCCAAAA | TTA | chr12 | 21603451 | 21603472 | 21603468 | 21603473 | + |
| SEQ ID NO 24689 | GCTCTGATTAGCCAAAAGAAGG | CTG | chr12 | 21603456 | 21603477 | 21603473 | 21603478 | + |
| SEQ ID NO 24690 | TGATTAGCCAAAAGAAGGAAGT | CTC | chr12 | 21603460 | 21603481 | 21603477 | 21603482 | + |
| SEQ ID NO 24691 | ATTAGCCAAAAGAAGGAAGTAA | CTG | chr12 | 21603462 | 21603483 | 21603479 | 21603484 | + |
| SEQ ID NO 24692 | GCCAAAAGAAGGAAGTAATATA | TTA | chr12 | 21603466 | 21603487 | 21603483 | 21603488 | + |
| SEQ ID NO 24693 | TGGTTATTATTTCAGATCCTTT | TTC | chr12 | 21603496 | 21603517 | 21603513 | 21603518 | + |
| SEQ ID NO 24694 | GTTATTATTTCAGATCCTTTAG | CTG | chr12 | 21603498 | 21603519 | 21603515 | 21603520 | + |
| SEQ ID NO 24695 | TTATTTCAGATCCTTTAGATTA | TTA | chr12 | 21603502 | 21603523 | 21603519 | 21603524 | + |
| SEQ ID NO 24696 | TTTCAGATCCTTTAGATTACTG | TTA | chr12 | 21603505 | 21603526 | 21603522 | 21603527 | + |
| SEQ ID NO 24697 | CAGATCCTTTAGATTACTGTAA | TTT | chr12 | 21603508 | 21603529 | 21603525 | 21603530 | + |
| SEQ ID NO 24698 | AGATCCTTTAGATTACTGTAAT | TTC | chr12 | 21603509 | 21603530 | 21603526 | 21603531 | + |
| SEQ ID NO 24699 | TAGATTACTGTAATAGACATGA | CTT | chr12 | 21603517 | 21603538 | 21603534 | 21603539 | + |
| SEQ ID NO 24700 | AGATTACTGTAATAGACATGAA | TTT | chr12 | 21603518 | 21603539 | 21603535 | 21603540 | + |
| SEQ ID NO 24701 | GATTACTGTAATAGACATGAAA | TTA | chr12 | 21603519 | 21603540 | 21603536 | 21603541 | + |
| SEQ ID NO 24702 | CTGTAATAGACATGAAATAGTA | TTA | chr12 | 21603524 | 21603545 | 21603541 | 21603546 | + |
| SEQ ID NO 24703 | TAATAGACATGAAATAGTAAAC | CTG | chr12 | 21603527 | 21603548 | 21603544 | 21603549 | + |
| SEQ ID NO 24704 | TATATCACAACACATGACATAA | TTA | chr12 | 21603573 | 21603594 | 21603590 | 21603595 | + |
| SEQ ID NO 24705 | CAGATCGTTTAAATCACACAAG | TTT | chr12 | 21603598 | 21603619 | 21603615 | 21603620 | + |
| SEQ ID NO 24706 | AGATCGTTTAAATCACACAAGT | TTC | chr12 | 21603599 | 21603620 | 21603616 | 21603621 | + |
| SEQ ID NO 24707 | AAATCACACAAGTCATCACTGC | TTT | chr12 | 21603608 | 21603629 | 21603625 | 21603630 | + |
| SEQ ID NO 24708 | AATCACACAAGTCATCACTGCC | TTA | chr12 | 21603609 | 21603630 | 21603626 | 21603631 | + |
| SEQ ID NO 24709 | CCATTTACCCAGCAATCAGTTG | CTG | chr12 | 21603629 | 21603650 | 21603646 | 21603651 | + |
| SEQ ID NO 24710 | ACCCAGCAATCAGTTGGCTTGA | TTT | chr12 | 21603635 | 21603656 | 21603652 | 21603657 | + |
| SEQ ID NO 24711 | CCCAGCAATCAGTTGGCTTGAT | TTA | chr12 | 21603636 | 21603657 | 21603653 | 21603658 | + |
| SEQ ID NO 24712 | GCTTGATTCTTCAAGATCTTGA | TTG | chr12 | 21603651 | 21603672 | 21603668 | 21603673 | + |
| SEQ ID NO 24713 | GATTCTTCAAGATCTTGAGGAA | CTT | chr12 | 21603655 | 21603676 | 21603672 | 21603677 | + |
| SEQ ID NO 24714 | ATTCTTCAAGATCTTGAGGAAC | TTG | chr12 | 21603656 | 21603677 | 21603673 | 21603678 | + |
| SEQ ID NO 24715 | TTCAAGATCTTGAGGAACTCAG | TTC | chr12 | 21603660 | 21603681 | 21603677 | 21603682 | + |
| SEQ ID NO 24716 | CAAGATCTTGAGGAACTCAGCC | CTT | chr12 | 21603662 | 21603683 | 21603679 | 21603684 | + |
| SEQ ID NO 24717 | AAGATCTTGAGGAACTCAGCCT | TTC | chr12 | 21603663 | 21603684 | 21603680 | 21603685 | + |

Figure 48 (Cont'd)

| | | | | | | | | |
|---|---|---|---|---|---|---|---|---|
| SEQ ID NO 24718 | GAGGAACTCAGCCTTCAAAACC | CTT | chr12 | 21603671 | 21603692 | 21603688 | 21603693 | + |
| SEQ ID NO 24719 | AGGAACTCAGCCTTCAAAACCA | TTG | chr12 | 21603672 | 21603693 | 21603689 | 21603694 | + |
| SEQ ID NO 24720 | AGCCTTCAAAACCATGACTTTT | CTC | chr12 | 21603680 | 21603701 | 21603697 | 21603702 | + |
| SEQ ID NO 24721 | CAAAACCATGACTTTTTCTTTG | CTT | chr12 | 21603686 | 21603707 | 21603703 | 21603708 | + |
| SEQ ID NO 24722 | AAAACCATGACTTTTTCTTTGC | TTC | chr12 | 21603687 | 21603708 | 21603704 | 21603709 | + |
| SEQ ID NO 24723 | TTTCTTTGCTAATGTTCCTTCA | CTT | chr12 | 21603700 | 21603721 | 21603717 | 21603722 | + |
| SEQ ID NO 24724 | TTCTTTGCTAATGTTCCTTCAA | TTT | chr12 | 21603701 | 21603722 | 21603718 | 21603723 | + |
| SEQ ID NO 24725 | TCTTTGCTAATGTTCCTTCAAT | TTT | chr12 | 21603702 | 21603723 | 21603719 | 21603724 | + |
| SEQ ID NO 24726 | CTTTGCTAATGTTCCTTCAATA | TTT | chr12 | 21603703 | 21603724 | 21603720 | 21603725 | + |
| SEQ ID NO 24727 | TTTGCTAATGTTCCTTCAATAG | TTC | chr12 | 21603704 | 21603725 | 21603721 | 21603726 | + |
| SEQ ID NO 24728 | TGCTAATGTTCCTTCAATAGTC | CTT | chr12 | 21603706 | 21603727 | 21603723 | 21603728 | + |
| SEQ ID NO 24729 | GCTAATGTTCCTTCAATAGTCT | TTT | chr12 | 21603707 | 21603728 | 21603724 | 21603729 | + |
| SEQ ID NO 24730 | CTAATGTTCCTTCAATAGTCTT | TTG | chr12 | 21603708 | 21603729 | 21603725 | 21603730 | + |
| SEQ ID NO 24731 | ATGTTCCTTCAATAGTCTTGAC | CTA | chr12 | 21603711 | 21603732 | 21603728 | 21603733 | + |
| SEQ ID NO 24732 | CTTCAATAGTCTTGACACTTTT | TTC | chr12 | 21603717 | 21603738 | 21603734 | 21603739 | + |
| SEQ ID NO 24733 | CAATAGTCTTGACACTTTTAAA | CTT | chr12 | 21603720 | 21603741 | 21603737 | 21603742 | + |
| SEQ ID NO 24734 | AATAGTCTTGACACTTTTAAAC | TTC | chr12 | 21603721 | 21603742 | 21603738 | 21603743 | + |
| SEQ ID NO 24735 | GACACTTTTAAACTAGAGAGTA | CTT | chr12 | 21603730 | 21603751 | 21603747 | 21603752 | + |
| SEQ ID NO 24736 | ACACTTTTAAACTAGAGAGTAT | TTG | chr12 | 21603731 | 21603752 | 21603748 | 21603753 | + |
| SEQ ID NO 24737 | TTAAACTAGAGAGTATAAACCC | CTT | chr12 | 21603737 | 21603758 | 21603754 | 21603759 | + |
| SEQ ID NO 24738 | TAAACTAGAGAGTATAAACCCA | TTT | chr12 | 21603738 | 21603759 | 21603755 | 21603760 | + |
| SEQ ID NO 24739 | AAACTAGAGAGTATAAACCCAC | TTT | chr12 | 21603739 | 21603760 | 21603756 | 21603761 | + |
| SEQ ID NO 24740 | AACTAGAGAGTATAAACCCACA | TTA | chr12 | 21603740 | 21603761 | 21603757 | 21603762 | + |
| SEQ ID NO 24741 | GAGAGTATAAACCCACAAGGAA | CTA | chr12 | 21603745 | 21603766 | 21603762 | 21603767 | + |
| SEQ ID NO 24742 | TTTTATAATTTTACAGATGTCT | TTG | chr12 | 21603770 | 21603791 | 21603787 | 21603792 | + |
| SEQ ID NO 24743 | TATAATTTTACAGATGTCTTTA | TTT | chr12 | 21603773 | 21603794 | 21603790 | 21603795 | + |
| SEQ ID NO 24744 | ATAATTTTACAGATGTCTTTAT | TTT | chr12 | 21603774 | 21603795 | 21603791 | 21603796 | + |
| SEQ ID NO 24745 | TAATTTTACAGATGTCTTTATT | TTA | chr12 | 21603775 | 21603796 | 21603792 | 21603797 | + |
| SEQ ID NO 24746 | TACAGATGTCTTTATTTTCAAA | TTT | chr12 | 21603781 | 21603802 | 21603798 | 21603803 | + |
| SEQ ID NO 24747 | ACAGATGTCTTTATTTTCAAAA | TTT | chr12 | 21603782 | 21603803 | 21603799 | 21603804 | + |
| SEQ ID NO 24748 | CAGATGTCTTTATTTTCAAAAT | TTA | chr12 | 21603783 | 21603804 | 21603800 | 21603805 | + |
| SEQ ID NO 24749 | TATTTTCAAAATCATTTACATT | CTT | chr12 | 21603793 | 21603814 | 21603810 | 21603815 | + |
| SEQ ID NO 24750 | ATTTTCAAAATCATTTACATTG | TTT | chr12 | 21603794 | 21603815 | 21603811 | 21603816 | + |
| SEQ ID NO 24751 | TTTTCAAAATCATTTACATTGT | TTA | chr12 | 21603795 | 21603816 | 21603812 | 21603817 | + |
| SEQ ID NO 24752 | TCAAAATCATTTACATTGTGGT | TTT | chr12 | 21603798 | 21603819 | 21603815 | 21603820 | + |
| SEQ ID NO 24753 | CAAAATCATTTACATTGTGGTT | TTT | chr12 | 21603799 | 21603820 | 21603816 | 21603821 | + |
| SEQ ID NO 24754 | AAAATCATTTACATTGTGGTTC | TTC | chr12 | 21603800 | 21603821 | 21603817 | 21603822 | + |
| SEQ ID NO 24755 | ACATTGTGGTTCTCTACCTTGC | TTT | chr12 | 21603810 | 21603831 | 21603827 | 21603832 | + |
| SEQ ID NO 24756 | CATTGTGGTTCTCTACCTTGCC | TTA | chr12 | 21603811 | 21603832 | 21603828 | 21603833 | + |
| SEQ ID NO 24757 | TGGTTCTCTACCTTGCCTTCTC | TTG | chr12 | 21603816 | 21603837 | 21603833 | 21603838 | + |
| SEQ ID NO 24758 | TCTACCTTGCCTTCTCTTACCC | TTC | chr12 | 21603822 | 21603843 | 21603839 | 21603844 | + |
| SEQ ID NO 24759 | TACCTTGCCTTCTCTTACCCAG | CTC | chr12 | 21603824 | 21603845 | 21603841 | 21603846 | + |
| SEQ ID NO 24760 | CCTTGCCTTCTCTTACCCAGCA | CTA | chr12 | 21603826 | 21603847 | 21603843 | 21603848 | + |
| SEQ ID NO 24761 | GCCTTCTCTTACCCAGCACAGA | CTT | chr12 | 21603830 | 21603851 | 21603847 | 21603852 | + |
| SEQ ID NO 24762 | CCTTCTCTTACCCAGCACAGAT | TTG | chr12 | 21603831 | 21603852 | 21603848 | 21603853 | + |
| SEQ ID NO 24763 | CTCTTACCCAGCACAGATGAGG | CTT | chr12 | 21603835 | 21603856 | 21603852 | 21603857 | + |
| SEQ ID NO 24764 | TCTTACCCAGCACAGATGAGGT | TTC | chr12 | 21603836 | 21603857 | 21603853 | 21603858 | + |
| SEQ ID NO 24765 | TTACCCAGCACAGATGAGGTTA | CTC | chr12 | 21603838 | 21603859 | 21603855 | 21603860 | + |
| SEQ ID NO 24766 | ACCCAGCACAGATGAGGTTATA | CTT | chr12 | 21603840 | 21603861 | 21603857 | 21603862 | + |
| SEQ ID NO 24767 | CCCAGCACAGATGAGGTTATAC | TTA | chr12 | 21603841 | 21603862 | 21603858 | 21603863 | + |
| SEQ ID NO 24768 | TACCTCACTCGCAAATTGTTTT | TTA | chr12 | 21603860 | 21603881 | 21603877 | 21603882 | + |
| SEQ ID NO 24769 | ACTCGCAAATTGTTTTATCAAT | CTC | chr12 | 21603866 | 21603887 | 21603883 | 21603888 | + |
| SEQ ID NO 24770 | GCAAATTGTTTTATCAATTTGA | CTC | chr12 | 21603870 | 21603891 | 21603887 | 21603892 | + |
| SEQ ID NO 24771 | TTTTATCAATTTGATTTTCTTT | TTG | chr12 | 21603878 | 21603899 | 21603895 | 21603900 | + |
| SEQ ID NO 24772 | TATCAATTTGATTTTCTTTATT | TTT | chr12 | 21603881 | 21603902 | 21603898 | 21603903 | + |
| SEQ ID NO 24773 | ATCAATTTGATTTTCTTTATTT | TTT | chr12 | 21603882 | 21603903 | 21603899 | 21603904 | + |
| SEQ ID NO 24774 | TCAATTTGATTTTCTTTATTTT | TTA | chr12 | 21603883 | 21603904 | 21603900 | 21603905 | + |
| SEQ ID NO 24775 | GATTTTCTTTATTTTATAATTC | TTT | chr12 | 21603890 | 21603911 | 21603907 | 21603912 | + |

Figure 48 (Cont'd)

| SEQ ID NO 24776 | ATTTTCTTTATTTTATAATTCC | TTG | chr12 | 21603891 | 21603912 | 21603908 | 21603913 | + |
| SEQ ID NO 24777 | TCTTTATTTTATAATTCCTACA | TTT | chr12 | 21603895 | 21603916 | 21603912 | 21603917 | + |
| SEQ ID NO 24778 | CTTTATTTTATAATTCCTACAT | TTT | chr12 | 21603896 | 21603917 | 21603913 | 21603918 | + |
| SEQ ID NO 24779 | TTTATTTTATAATTCCTACATA | TTC | chr12 | 21603897 | 21603918 | 21603914 | 21603919 | + |
| SEQ ID NO 24780 | TATTTTATAATTCCTACATAAG | CTT | chr12 | 21603899 | 21603920 | 21603916 | 21603921 | + |
| SEQ ID NO 24781 | ATTTTATAATTCCTACATAAGC | TTT | chr12 | 21603900 | 21603921 | 21603917 | 21603922 | + |
| SEQ ID NO 24782 | TTTTATAATTCCTACATAAGCA | TTA | chr12 | 21603901 | 21603922 | 21603918 | 21603923 | + |
| SEQ ID NO 24783 | TATAATTCCTACATAAGCATAG | TTT | chr12 | 21603904 | 21603925 | 21603921 | 21603926 | + |
| SEQ ID NO 24784 | ATAATTCCTACATAAGCATAGC | TTT | chr12 | 21603905 | 21603926 | 21603922 | 21603927 | + |
| SEQ ID NO 24785 | TAATTCCTACATAAGCATAGCA | TTA | chr12 | 21603906 | 21603927 | 21603923 | 21603928 | + |
| SEQ ID NO 24786 | CTACATAAGCATAGCATTGAAG | TTC | chr12 | 21603912 | 21603933 | 21603929 | 21603934 | + |
| SEQ ID NO 24787 | CATAAGCATAGCATTGAAGAAA | CTA | chr12 | 21603915 | 21603936 | 21603932 | 21603937 | + |
| SEQ ID NO 24788 | AAGAAAAAATTACTTTCATTC | TTG | chr12 | 21603931 | 21603952 | 21603948 | 21603953 | + |
| SEQ ID NO 24789 | CTTTCATTCTGAAAGGAGCACA | TTA | chr12 | 21603944 | 21603965 | 21603961 | 21603966 | + |
| SEQ ID NO 24790 | TCATTCTGAAAGGAGCACAGTA | CTT | chr12 | 21603947 | 21603968 | 21603964 | 21603969 | + |
| SEQ ID NO 24791 | CATTCTGAAAGGAGCACAGTAT | TTT | chr12 | 21603948 | 21603969 | 21603965 | 21603970 | + |
| SEQ ID NO 24792 | ATTCTGAAAGGAGCACAGTATT | TTC | chr12 | 21603949 | 21603970 | 21603966 | 21603971 | + |
| SEQ ID NO 24793 | TGAAAGGAGCACAGTATTTTGC | TTC | chr12 | 21603953 | 21603974 | 21603970 | 21603975 | + |
| SEQ ID NO 24794 | AAAGGAGCACAGTATTTTGCCT | CTG | chr12 | 21603955 | 21603976 | 21603972 | 21603977 | + |
| SEQ ID NO 24795 | TGCCTTTTGAGAAGCTCCTGAA | TTT | chr12 | 21603972 | 21603993 | 21603989 | 21603994 | + |
| SEQ ID NO 24796 | GCCTTTTGAGAAGCTCCTGAAT | TTT | chr12 | 21603973 | 21603994 | 21603990 | 21603995 | + |
| SEQ ID NO 24797 | CCTTTTGAGAAGCTCCTGAATT | TTG | chr12 | 21603974 | 21603995 | 21603991 | 21603996 | + |
| SEQ ID NO 24798 | TTGAGAAGCTCCTGAATTAAAA | CTT | chr12 | 21603978 | 21603999 | 21603995 | 21604000 | + |
| SEQ ID NO 24799 | TGAGAAGCTCCTGAATTAAAAC | TTT | chr12 | 21603979 | 21604000 | 21603996 | 21604001 | + |
| SEQ ID NO 24800 | GAGAAGCTCCTGAATTAAAACA | TTT | chr12 | 21603980 | 21604001 | 21603997 | 21604002 | + |
| SEQ ID NO 24801 | AGAAGCTCCTGAATTAAAACAT | TTG | chr12 | 21603981 | 21604002 | 21603998 | 21604003 | + |
| SEQ ID NO 24802 | CTGAATTAAAACATTAATTCCA | CTC | chr12 | 21603989 | 21604010 | 21604006 | 21604011 | + |
| SEQ ID NO 24803 | AATTAAAACATTAATTCCAAGC | CTG | chr12 | 21603992 | 21604013 | 21604009 | 21604014 | + |
| SEQ ID NO 24804 | AAACATTAATTCCAAGCTAATT | TTA | chr12 | 21603997 | 21604018 | 21604014 | 21604019 | + |
| SEQ ID NO 24805 | ATTCCAAGCTAATTGTGAATAT | TTA | chr12 | 21604005 | 21604026 | 21604022 | 21604027 | + |
| SEQ ID NO 24806 | CAAGCTAATTGTGAATATGAAA | TTC | chr12 | 21604009 | 21604030 | 21604026 | 21604031 | + |
| SEQ ID NO 24807 | ATTGTGAATATGAAACATTCTT | CTA | chr12 | 21604016 | 21604037 | 21604033 | 21604038 | + |
| SEQ ID NO 24808 | TGAATATGAAACATTCTTAAGC | TTG | chr12 | 21604020 | 21604041 | 21604037 | 21604042 | + |
| SEQ ID NO 24809 | TTAAGCATTTCATATAATTACT | TTC | chr12 | 21604036 | 21604057 | 21604053 | 21604058 | + |
| SEQ ID NO 24810 | AAGCATTTCATATAATTACTAA | CTT | chr12 | 21604038 | 21604059 | 21604055 | 21604060 | + |
| SEQ ID NO 24811 | AGCATTTCATATAATTACTAAC | TTA | chr12 | 21604039 | 21604060 | 21604056 | 21604061 | + |
| SEQ ID NO 24812 | CATATAATTACTAACAGAATGT | TTT | chr12 | 21604046 | 21604067 | 21604063 | 21604068 | + |
| SEQ ID NO 24813 | ATATAATTACTAACAGAATGTA | TTC | chr12 | 21604047 | 21604068 | 21604064 | 21604069 | + |
| SEQ ID NO 24814 | CTAACAGAATGTAGAGTTGAGG | TTA | chr12 | 21604056 | 21604077 | 21604073 | 21604078 | + |
| SEQ ID NO 24815 | ACAGAATGTAGAGTTGAGGTTT | CTA | chr12 | 21604059 | 21604080 | 21604076 | 21604081 | + |
| SEQ ID NO 24816 | AGGTTTCCAACTGGTTCTAATC | TTG | chr12 | 21604075 | 21604096 | 21604092 | 21604097 | + |
| SEQ ID NO 24817 | CCAACTGGTTCTAATCACATAT | TTT | chr12 | 21604081 | 21604102 | 21604098 | 21604103 | + |
| SEQ ID NO 24818 | CAACTGGTTCTAATCACATATA | TTC | chr12 | 21604082 | 21604103 | 21604099 | 21604104 | + |
| SEQ ID NO 24819 | GTTCTAATCACATATACATCTT | CTG | chr12 | 21604088 | 21604109 | 21604105 | 21604110 | + |
| SEQ ID NO 24820 | TAATCACATATACATCTTCCTA | TTC | chr12 | 21604092 | 21604113 | 21604109 | 21604114 | + |
| SEQ ID NO 24821 | ATCACATATACATCTTCCTAAA | CTA | chr12 | 21604094 | 21604115 | 21604111 | 21604116 | + |
| SEQ ID NO 24822 | CCTAAAATAAATGTTTAATTA | CTT | chr12 | 21604110 | 21604131 | 21604127 | 21604132 | + |
| SEQ ID NO 24823 | CTAAAATAAATGTTTAATTAT | TTC | chr12 | 21604111 | 21604132 | 21604128 | 21604133 | + |
| SEQ ID NO 24824 | AAATAAATGTTTAATTATACT | CTA | chr12 | 21604114 | 21604135 | 21604131 | 21604136 | + |
| SEQ ID NO 24825 | AATTATACTATTTTGCTGAGAA | TTT | chr12 | 21604127 | 21604148 | 21604144 | 21604149 | + |
| SEQ ID NO 24826 | ATTATACTATTTTGCTGAGAAA | TTA | chr12 | 21604128 | 21604149 | 21604145 | 21604150 | + |
| SEQ ID NO 24827 | TACTATTTTGCTGAGAAAATT | TTA | chr12 | 21604132 | 21604153 | 21604149 | 21604154 | + |
| SEQ ID NO 24828 | TTTTGCTGAGAAAATTTTAAA | CTA | chr12 | 21604137 | 21604158 | 21604154 | 21604159 | + |
| SEQ ID NO 24829 | TGCTGAGAAAATTTTAAAACA | TTT | chr12 | 21604140 | 21604161 | 21604157 | 21604162 | + |
| SEQ ID NO 24830 | GCTGAGAAAATTTTAAAACAA | TTT | chr12 | 21604141 | 21604162 | 21604158 | 21604163 | + |
| SEQ ID NO 24831 | CTGAGAAAATTTTAAAACAAA | TTG | chr12 | 21604142 | 21604163 | 21604159 | 21604164 | + |
| SEQ ID NO 24832 | AGAAAATTTTAAAACAAAAAA | CTG | chr12 | 21604145 | 21604166 | 21604162 | 21604167 | + |
| SEQ ID NO 24833 | TAAAACAAAAAATGTAAATATT | TTT | chr12 | 21604155 | 21604176 | 21604172 | 21604177 | + |

Figure 48 (Cont'd)

| | | | | | | | | |
|---|---|---|---|---|---|---|---|---|
| SEQ ID NO 24834 | AAAACAAAAAATGTAAATATTA | TTT | chr12 | 21604156 | 21604177 | 21604173 | 21604178 | + |
| SEQ ID NO 24835 | AAACAAAAAATGTAAATATTAA | TTA | chr12 | 21604157 | 21604178 | 21604174 | 21604179 | + |
| SEQ ID NO 24836 | ACTTTTTATTTCTATGTTGTCA | TTA | chr12 | 21604178 | 21604199 | 21604195 | 21604200 | + |
| SEQ ID NO 24837 | TTTATTTCTATGTTGTCATAAT | CTT | chr12 | 21604182 | 21604203 | 21604199 | 21604204 | + |
| SEQ ID NO 24838 | TTATTTCTATGTTGTCATAATA | TTT | chr12 | 21604183 | 21604204 | 21604200 | 21604205 | + |
| SEQ ID NO 24839 | TATTTCTATGTTGTCATAATAT | TTT | chr12 | 21604184 | 21604205 | 21604201 | 21604206 | + |
| SEQ ID NO 24840 | ATTTCTATGTTGTCATAATATG | TTT | chr12 | 21604185 | 21604206 | 21604202 | 21604207 | + |
| SEQ ID NO 24841 | TTTCTATGTTGTCATAATATGG | TTA | chr12 | 21604186 | 21604207 | 21604203 | 21604208 | + |
| SEQ ID NO 24842 | CTATGTTGTCATAATATGGATT | TTT | chr12 | 21604189 | 21604210 | 21604206 | 21604211 | + |
| SEQ ID NO 24843 | TATGTTGTCATAATATGGATTT | TTC | chr12 | 21604190 | 21604211 | 21604207 | 21604212 | + |
| SEQ ID NO 24844 | TGTTGTCATAATATGGATTTTA | CTA | chr12 | 21604192 | 21604213 | 21604209 | 21604214 | + |
| SEQ ID NO 24845 | TCATAATATGGATTTTAAATTT | TTG | chr12 | 21604197 | 21604218 | 21604214 | 21604219 | + |
| SEQ ID NO 24846 | TAAATTTTAATTTAAATGCACA | TTT | chr12 | 21604212 | 21604233 | 21604229 | 21604234 | + |
| SEQ ID NO 24847 | AAATTTTAATTTAAATGCACAT | TTT | chr12 | 21604213 | 21604234 | 21604230 | 21604235 | + |
| SEQ ID NO 24848 | AATTTTAATTTAAATGCACATT | TTA | chr12 | 21604214 | 21604235 | 21604231 | 21604236 | + |
| SEQ ID NO 24849 | TAATTTAAATGCACATTCCATG | TTT | chr12 | 21604219 | 21604240 | 21604236 | 21604241 | + |
| SEQ ID NO 24850 | AATTTAAATGCACATTCCATGG | TTT | chr12 | 21604220 | 21604241 | 21604237 | 21604242 | + |
| SEQ ID NO 24851 | ATTTAAATGCACATTCCATGGC | TTA | chr12 | 21604221 | 21604242 | 21604238 | 21604243 | + |
| SEQ ID NO 24852 | AAATGCACATTCCATGGCAATG | TTT | chr12 | 21604225 | 21604246 | 21604242 | 21604247 | + |
| SEQ ID NO 24853 | AATGCACATTCCATGGCAATGG | TTA | chr12 | 21604226 | 21604247 | 21604243 | 21604248 | + |
| SEQ ID NO 24854 | CATGGCAATGGCTAATATTTTC | TTC | chr12 | 21604237 | 21604258 | 21604254 | 21604259 | + |
| SEQ ID NO 24855 | ATATTTTCAACTTTCTCCCTCT | CTA | chr12 | 21604251 | 21604272 | 21604268 | 21604273 | + |
| SEQ ID NO 24856 | TCAACTTTCTCCCTCTTCAACA | TTT | chr12 | 21604257 | 21604278 | 21604274 | 21604279 | + |
| SEQ ID NO 24857 | CAACTTTCTCCCTCTTCAACAC | TTT | chr12 | 21604258 | 21604279 | 21604275 | 21604280 | + |
| SEQ ID NO 24858 | AACTTTCTCCCTCTTCAACACA | TTC | chr12 | 21604259 | 21604280 | 21604276 | 21604281 | + |
| SEQ ID NO 24859 | TCTCCCTCTTCAACACATACAC | CTT | chr12 | 21604264 | 21604285 | 21604281 | 21604286 | + |
| SEQ ID NO 24860 | CTCCCTCTTCAACACATACACA | TTT | chr12 | 21604265 | 21604286 | 21604282 | 21604287 | + |
| SEQ ID NO 24861 | TCCCTCTTCAACACATACACAA | TTC | chr12 | 21604266 | 21604287 | 21604283 | 21604288 | + |
| SEQ ID NO 24862 | CCTCTTCAACACATACACAAGT | CTC | chr12 | 21604268 | 21604289 | 21604285 | 21604290 | + |
| SEQ ID NO 24863 | TTCAACACATACACAAGTCTGT | CTC | chr12 | 21604272 | 21604293 | 21604289 | 21604294 | + |
| SEQ ID NO 24864 | CAACACATACACAAGTCTGTAT | CTT | chr12 | 21604274 | 21604295 | 21604291 | 21604296 | + |
| SEQ ID NO 24865 | AACACATACACAAGTCTGTATT | TTC | chr12 | 21604275 | 21604296 | 21604292 | 21604297 | + |
| SEQ ID NO 24866 | TATTCATAGCCTGTTGTAATAG | CTG | chr12 | 21604293 | 21604314 | 21604310 | 21604315 | + |
| SEQ ID NO 24867 | ATAGCCTGTTGTAATAGACAAG | TTC | chr12 | 21604298 | 21604319 | 21604315 | 21604320 | + |
| SEQ ID NO 24868 | TTGTAATAGACAAGGTTAAATG | CTG | chr12 | 21604306 | 21604327 | 21604323 | 21604328 | + |
| SEQ ID NO 24869 | TAATAGACAAGGTTAAATGTAG | TTG | chr12 | 21604309 | 21604330 | 21604326 | 21604331 | + |
| SEQ ID NO 24870 | AATGTAGCCTAAATATATATTC | TTA | chr12 | 21604324 | 21604345 | 21604341 | 21604346 | + |
| SEQ ID NO 24871 | AATATATATTCCGTTTAAATGC | CTA | chr12 | 21604335 | 21604356 | 21604352 | 21604357 | + |
| SEQ ID NO 24872 | CGTTTAAATGCTTTCCTCACTC | TTC | chr12 | 21604346 | 21604367 | 21604363 | 21604368 | + |
| SEQ ID NO 24873 | AAATGCTTTCCTCACTCACTAG | TTT | chr12 | 21604351 | 21604372 | 21604368 | 21604373 | + |
| SEQ ID NO 24874 | AATGCTTTCCTCACTCACTAGC | TTA | chr12 | 21604352 | 21604373 | 21604369 | 21604374 | + |
| SEQ ID NO 24875 | TCCTCACTCACTAGCAATTGGT | CTT | chr12 | 21604359 | 21604380 | 21604376 | 21604381 | + |
| SEQ ID NO 24876 | CCTCACTCACTAGCAATTGGTT | TTT | chr12 | 21604360 | 21604381 | 21604377 | 21604382 | + |
| SEQ ID NO 24877 | CTCACTCACTAGCAATTGGTTA | TTC | chr12 | 21604361 | 21604382 | 21604378 | 21604383 | + |
| SEQ ID NO 24878 | ACTCACTAGCAATTGGTTATCA | CTC | chr12 | 21604364 | 21604385 | 21604381 | 21604386 | + |
| SEQ ID NO 24879 | ACTAGCAATTGGTTATCACTAG | CTC | chr12 | 21604368 | 21604389 | 21604385 | 21604390 | + |
| SEQ ID NO 24880 | GCAATTGGTTATCACTAGAGAG | CTA | chr12 | 21604372 | 21604393 | 21604389 | 21604394 | + |
| SEQ ID NO 24881 | GTTATCACTAGAGAGTTATCTG | TTG | chr12 | 21604379 | 21604400 | 21604396 | 21604401 | + |
| SEQ ID NO 24882 | TCACTAGAGAGTTATCTGTGAA | TTA | chr12 | 21604383 | 21604404 | 21604400 | 21604405 | + |
| SEQ ID NO 24883 | GAGAGTTATCTGTGAAATCTTA | CTA | chr12 | 21604389 | 21604410 | 21604406 | 21604411 | + |
| SEQ ID NO 24884 | TCTGTGAAATCTTACTCTACAT | TTA | chr12 | 21604397 | 21604418 | 21604414 | 21604419 | + |
| SEQ ID NO 24885 | TGAAATCTTACTCTACATTCCT | CTG | chr12 | 21604401 | 21604422 | 21604418 | 21604423 | + |
| SEQ ID NO 24886 | ACTCTACATTCCTCAGTCACCT | CTT | chr12 | 21604410 | 21604431 | 21604427 | 21604432 | + |
| SEQ ID NO 24887 | CTCTACATTCCTCAGTCACCTA | TTA | chr12 | 21604411 | 21604432 | 21604428 | 21604433 | + |
| SEQ ID NO 24888 | TACATTCCTCAGTCACCTAGTG | CTC | chr12 | 21604414 | 21604435 | 21604431 | 21604436 | + |
| SEQ ID NO 24889 | CATTCCTCAGTCACCTAGTGAA | CTA | chr12 | 21604416 | 21604437 | 21604433 | 21604438 | + |
| SEQ ID NO 24890 | CTCAGTCACCTAGTGAAGGTGT | TTC | chr12 | 21604421 | 21604442 | 21604438 | 21604443 | + |
| SEQ ID NO 24891 | AGTCACCTAGTGAAGGTGTACT | CTC | chr12 | 21604424 | 21604445 | 21604441 | 21604446 | + |

Figure 48 (Cont'd)

| | | | | | | | | |
|---|---|---|---|---|---|---|---|---|
| SEQ ID NO 24892 | GTGAAGGTGTACTGATCCACCT | CTA | chr12 | 21604433 | 21604454 | 21604450 | 21604455 | + |
| SEQ ID NO 24893 | ATCCACCTTCAGGAGCAGTACA | CTG | chr12 | 21604447 | 21604468 | 21604464 | 21604469 | + |
| SEQ ID NO 24894 | CAGGAGCAGTACAAACCTTTAT | CTT | chr12 | 21604456 | 21604477 | 21604473 | 21604478 | + |
| SEQ ID NO 24895 | AGGAGCAGTACAAACCTTTATT | TTC | chr12 | 21604457 | 21604478 | 21604474 | 21604479 | + |
| SEQ ID NO 24896 | TATTGGTCACTTCCCAAGCAAC | CTT | chr12 | 21604475 | 21604496 | 21604492 | 21604497 | + |
| SEQ ID NO 24897 | ATTGGTCACTTCCCAAGCAACT | TTT | chr12 | 21604476 | 21604497 | 21604493 | 21604498 | + |
| SEQ ID NO 24898 | TTGGTCACTTCCCAAGCAACTT | TTA | chr12 | 21604477 | 21604498 | 21604494 | 21604499 | + |
| SEQ ID NO 24899 | GTCACTTCCCAAGCAACTTCAA | TTG | chr12 | 21604480 | 21604501 | 21604497 | 21604502 | + |
| SEQ ID NO 24900 | CCCAAGCAACTTCAAAGAGCAG | CTT | chr12 | 21604487 | 21604508 | 21604504 | 21604509 | + |
| SEQ ID NO 24901 | CCAAGCAACTTCAAAGAGCAGT | TTC | chr12 | 21604488 | 21604509 | 21604505 | 21604510 | + |
| SEQ ID NO 24902 | CAAAGAGCAGTAACTCCTCCAC | CTT | chr12 | 21604499 | 21604520 | 21604516 | 21604521 | + |
| SEQ ID NO 24903 | AAAGAGCAGTAACTCCTCCACA | TTC | chr12 | 21604500 | 21604521 | 21604517 | 21604522 | + |
| SEQ ID NO 24904 | CTCCACAGGAAGTTCTTCGACT | CTC | chr12 | 21604515 | 21604536 | 21604532 | 21604537 | + |
| SEQ ID NO 24905 | CACAGGAAGTTCTTCGACTTCC | CTC | chr12 | 21604518 | 21604539 | 21604535 | 21604540 | + |
| SEQ ID NO 24906 | TTCGACTTCCCACTGGGGAAGC | TTC | chr12 | 21604530 | 21604551 | 21604547 | 21604552 | + |
| SEQ ID NO 24907 | CGACTTCCCACTGGGGAAGCCC | CTT | chr12 | 21604532 | 21604553 | 21604549 | 21604554 | + |
| SEQ ID NO 24908 | GACTTCCCACTGGGGAAGCCCA | TTC | chr12 | 21604533 | 21604554 | 21604550 | 21604555 | + |
| SEQ ID NO 24909 | CCCACTGGGGAAGCCCACCCAG | CTT | chr12 | 21604538 | 21604559 | 21604555 | 21604560 | + |
| SEQ ID NO 24910 | CCACTGGGGAAGCCCACCCAGG | TTC | chr12 | 21604539 | 21604560 | 21604556 | 21604561 | + |
| SEQ ID NO 24911 | GGGAAGCCCACCCAGGGATGTT | CTG | chr12 | 21604545 | 21604566 | 21604562 | 21604567 | + |
| SEQ ID NO 24912 | CAGAGAGGGATCGGCCTCGAAG | TTA | chr12 | 21604568 | 21604589 | 21604585 | 21604590 | + |
| SEQ ID NO 24913 | GAAGCATTCTTCTTACAGTCCT | CTC | chr12 | 21604586 | 21604607 | 21604603 | 21604608 | + |
| SEQ ID NO 24914 | TTCTTACAGTCCTCCGAGACTC | TTC | chr12 | 21604595 | 21604616 | 21604612 | 21604617 | + |
| SEQ ID NO 24915 | CTTACAGTCCTCCGAGACTCCT | CTT | chr12 | 21604597 | 21604618 | 21604614 | 21604619 | + |
| SEQ ID NO 24916 | TTACAGTCCTCCGAGACTCCTT | TTC | chr12 | 21604598 | 21604619 | 21604615 | 21604620 | + |
| SEQ ID NO 24917 | ACAGTCCTCCGAGACTCCTTTG | CTT | chr12 | 21604600 | 21604621 | 21604617 | 21604622 | + |
| SEQ ID NO 24918 | CAGTCCTCCGAGACTCCTTTGA | TTA | chr12 | 21604601 | 21604622 | 21604618 | 21604623 | + |
| SEQ ID NO 24919 | CGAGACTCCTTTGAATTCCTGT | CTC | chr12 | 21604609 | 21604630 | 21604626 | 21604631 | + |
| SEQ ID NO 24920 | CTTTGAATTCCTGTTTCAATTA | CTC | chr12 | 21604617 | 21604638 | 21604634 | 21604639 | + |
| SEQ ID NO 24921 | TGAATTCCTGTTTCAATTAGTT | CTT | chr12 | 21604620 | 21604641 | 21604637 | 21604642 | + |
| SEQ ID NO 24922 | GAATTCCTGTTTCAATTAGTTG | TTT | chr12 | 21604621 | 21604642 | 21604638 | 21604643 | + |
| SEQ ID NO 24923 | AATTCCTGTTTCAATTAGTTGT | TTG | chr12 | 21604622 | 21604643 | 21604639 | 21604644 | + |
| SEQ ID NO 24924 | CTGTTTCAATTAGTTGTAATCC | TTC | chr12 | 21604627 | 21604648 | 21604644 | 21604649 | + |
| SEQ ID NO 24925 | TTTCAATTAGTTGTAATCCCAG | CTG | chr12 | 21604630 | 21604651 | 21604647 | 21604652 | + |
| SEQ ID NO 24926 | CAATTAGTTGTAATCCCAGGAG | TTT | chr12 | 21604633 | 21604654 | 21604650 | 21604655 | + |
| SEQ ID NO 24927 | AATTAGTTGTAATCCCAGGAGA | TTC | chr12 | 21604634 | 21604655 | 21604651 | 21604656 | + |
| SEQ ID NO 24928 | GTTGTAATCCCAGGAGAAGAGA | TTA | chr12 | 21604639 | 21604660 | 21604656 | 21604661 | + |
| SEQ ID NO 24929 | TAATCCCAGGAGAAGAGAACTT | TTG | chr12 | 21604643 | 21604664 | 21604660 | 21604665 | + |
| SEQ ID NO 24930 | ACAGGCACAAAAGTTAGAGTTG | CTT | chr12 | 21604665 | 21604686 | 21604682 | 21604687 | + |
| SEQ ID NO 24931 | CAGGCACAAAAGTTAGAGTTGG | TTA | chr12 | 21604666 | 21604687 | 21604683 | 21604688 | + |
| SEQ ID NO 24932 | GAGTTGGTAGAGTTACCAGGCT | TTA | chr12 | 21604681 | 21604702 | 21604698 | 21604703 | + |
| SEQ ID NO 24933 | GTAGAGTTACCAGGCTTTGGTA | TTG | chr12 | 21604687 | 21604708 | 21604704 | 21604709 | + |
| SEQ ID NO 24934 | CCAGGCTTTGGTAGCTTCTCTT | TTA | chr12 | 21604696 | 21604717 | 21604713 | 21604718 | + |
| SEQ ID NO 24935 | TGGTAGCTTCTCTTGGGAATAA | CTT | chr12 | 21604704 | 21604725 | 21604721 | 21604726 | + |
| SEQ ID NO 24936 | GGTAGCTTCTCTTGGGAATAAA | TTT | chr12 | 21604705 | 21604726 | 21604722 | 21604727 | + |
| SEQ ID NO 24937 | GTAGCTTCTCTTGGGAATAAAC | TTG | chr12 | 21604706 | 21604727 | 21604723 | 21604728 | + |
| SEQ ID NO 24938 | CTCTTGGGAATAAACTAGTAGC | CTT | chr12 | 21604713 | 21604734 | 21604730 | 21604735 | + |
| SEQ ID NO 24939 | TCTTGGGAATAAACTAGTAGCA | TTC | chr12 | 21604714 | 21604735 | 21604731 | 21604736 | + |
| SEQ ID NO 24940 | TTGGGAATAAACTAGTAGCATG | CTC | chr12 | 21604716 | 21604737 | 21604733 | 21604738 | + |
| SEQ ID NO 24941 | GGGAATAAACTAGTAGCATGAA | CTT | chr12 | 21604718 | 21604739 | 21604735 | 21604740 | + |
| SEQ ID NO 24942 | GGAATAAACTAGTAGCATGAAA | TTG | chr12 | 21604719 | 21604740 | 21604736 | 21604741 | + |
| SEQ ID NO 24943 | GTAGCATGAAATCTTATGTGCT | CTA | chr12 | 21604730 | 21604751 | 21604747 | 21604752 | + |
| SEQ ID NO 24944 | ATGTGCTTCCCACAGAATTCCT | CTT | chr12 | 21604745 | 21604766 | 21604762 | 21604767 | + |
| SEQ ID NO 24945 | TGTGCTTCCCACAGAATTCCTG | TTA | chr12 | 21604746 | 21604767 | 21604763 | 21604768 | + |
| SEQ ID NO 24946 | CCCACAGAATTCCTGGTGGAAG | CTT | chr12 | 21604753 | 21604774 | 21604770 | 21604775 | + |
| SEQ ID NO 24947 | CCACAGAATTCCTGGTGGAAGG | TTC | chr12 | 21604754 | 21604775 | 21604771 | 21604776 | + |
| SEQ ID NO 24948 | CTGGTGGAAGGAGGAATTCTTC | TTC | chr12 | 21604765 | 21604786 | 21604782 | 21604787 | + |
| SEQ ID NO 24949 | GTGGAAGGAGGAATTCTTCCTC | CTG | chr12 | 21604768 | 21604789 | 21604785 | 21604790 | + |

Figure 48 (Cont'd)

| | | | | | | | | |
|---|---|---|---|---|---|---|---|---|
| SEQ ID NO 24950 | TTCCTCCTCTTTCTCGTCTTTC | TTC | chr12 | 21604784 | 21604805 | 21604801 | 21604806 | + |
| SEQ ID NO 24951 | CCTCCTCTTTCTCGTCTTTCTG | CTT | chr12 | 21604786 | 21604807 | 21604803 | 21604808 | + |
| SEQ ID NO 24952 | CTCCTCTTTCTCGTCTTTCTGG | TTC | chr12 | 21604787 | 21604808 | 21604804 | 21604809 | + |
| SEQ ID NO 24953 | CTCTTTCTCGTCTTTCTGGGCA | CTC | chr12 | 21604790 | 21604811 | 21604807 | 21604812 | + |
| SEQ ID NO 24954 | TTTCTCGTCTTTCTGGGCAGGT | CTC | chr12 | 21604793 | 21604814 | 21604810 | 21604815 | + |
| SEQ ID NO 24955 | TCTCGTCTTTCTGGGCAGGTAT | CTT | chr12 | 21604795 | 21604816 | 21604812 | 21604817 | + |
| SEQ ID NO 24956 | CTCGTCTTTCTGGGCAGGTATT | TTT | chr12 | 21604796 | 21604817 | 21604813 | 21604818 | + |
| SEQ ID NO 24957 | TCGTCTTTCTGGGCAGGTATTG | TTC | chr12 | 21604797 | 21604818 | 21604814 | 21604819 | + |
| SEQ ID NO 24958 | GTCTTTCTGGGCAGGTATTGTG | CTC | chr12 | 21604799 | 21604820 | 21604816 | 21604821 | + |
| SEQ ID NO 24959 | TCTGGGCAGGTATTGTGAGGAC | CTT | chr12 | 21604804 | 21604825 | 21604821 | 21604826 | + |
| SEQ ID NO 24960 | CTGGGCAGGTATTGTGAGGACG | TTT | chr12 | 21604805 | 21604826 | 21604822 | 21604827 | + |
| SEQ ID NO 24961 | TGGGCAGGTATTGTGAGGACGG | TTC | chr12 | 21604806 | 21604827 | 21604823 | 21604828 | + |
| SEQ ID NO 24962 | GGCAGGTATTGTGAGGACGGTA | CTG | chr12 | 21604808 | 21604829 | 21604825 | 21604830 | + |
| SEQ ID NO 24963 | TGAGGACGGTATCTGCCCTGTC | TTG | chr12 | 21604819 | 21604840 | 21604836 | 21604841 | + |
| SEQ ID NO 24964 | ACAGGGCAGATACCGTCCTCAC | CTG | chr12 | 21604818 | 21604839 | 21604823 | 21604818 | - |
| SEQ ID NO 24965 | ACAATACCTGCCCAGAAAGACG | CTC | chr12 | 21604798 | 21604819 | 21604803 | 21604798 | - |
| SEQ ID NO 24966 | CCCAGAAAGACGAGAAAGAGGA | CTG | chr12 | 21604788 | 21604809 | 21604793 | 21604788 | - |
| SEQ ID NO 24967 | CTCCTTCCACCAGGAATTCTGT | TTC | chr12 | 21604756 | 21604777 | 21604761 | 21604756 | - |
| SEQ ID NO 24968 | CTTCCACCAGGAATTCTGTGGG | CTC | chr12 | 21604753 | 21604774 | 21604758 | 21604753 | - |
| SEQ ID NO 24969 | CCACCAGGAATTCTGTGGGAAG | CTT | chr12 | 21604750 | 21604771 | 21604755 | 21604750 | - |
| SEQ ID NO 24970 | CACCAGGAATTCTGTGGGAAGC | TTC | chr12 | 21604749 | 21604770 | 21604754 | 21604749 | - |
| SEQ ID NO 24971 | TGTGGGAAGCACATAAGATTTC | TTC | chr12 | 21604737 | 21604758 | 21604742 | 21604737 | - |
| SEQ ID NO 24972 | TGGGAAGCACATAAGATTTCAT | CTG | chr12 | 21604735 | 21604756 | 21604740 | 21604735 | - |
| SEQ ID NO 24973 | CATGCTACTAGTTTATTCCCAA | TTT | chr12 | 21604716 | 21604737 | 21604721 | 21604716 | - |
| SEQ ID NO 24974 | ATGCTACTAGTTTATTCCCAAG | TTC | chr12 | 21604715 | 21604736 | 21604720 | 21604715 | - |
| SEQ ID NO 24975 | CTAGTTTATTCCCAAGAGAAGC | CTA | chr12 | 21604709 | 21604730 | 21604714 | 21604709 | - |
| SEQ ID NO 24976 | GTTTATTCCCAAGAGAAGCTAC | CTA | chr12 | 21604706 | 21604727 | 21604711 | 21604706 | - |
| SEQ ID NO 24977 | ATTCCCAAGAGAAGCTACCAAA | TTT | chr12 | 21604702 | 21604723 | 21604707 | 21604702 | - |
| SEQ ID NO 24978 | TTCCCAAGAGAAGCTACCAAAG | TTA | chr12 | 21604701 | 21604722 | 21604706 | 21604701 | - |
| SEQ ID NO 24979 | CCAAGAGAAGCTACCAAAGCCT | TTC | chr12 | 21604698 | 21604719 | 21604703 | 21604698 | - |
| SEQ ID NO 24980 | CCAAAGCCTGGTAACTCTACCA | CTA | chr12 | 21604685 | 21604706 | 21604690 | 21604685 | - |
| SEQ ID NO 24981 | GTAACTCTACCAACTCTAACTT | CTG | chr12 | 21604675 | 21604696 | 21604680 | 21604675 | - |
| SEQ ID NO 24982 | TACCAACTCTAACTTTTGTGCC | CTC | chr12 | 21604668 | 21604689 | 21604673 | 21604668 | - |
| SEQ ID NO 24983 | CCAACTCTAACTTTTGTGCCTG | CTA | chr12 | 21604666 | 21604687 | 21604671 | 21604666 | - |
| SEQ ID NO 24984 | TAACTTTTGTGCCTGTAAGTTC | CTC | chr12 | 21604659 | 21604680 | 21604664 | 21604659 | - |
| SEQ ID NO 24985 | ACTTTTGTGCCTGTAAGTTCTC | CTA | chr12 | 21604657 | 21604678 | 21604662 | 21604657 | - |
| SEQ ID NO 24986 | TTGTGCCTGTAAGTTCTCTTCT | CTT | chr12 | 21604653 | 21604674 | 21604658 | 21604653 | - |
| SEQ ID NO 24987 | TGTGCCTGTAAGTTCTCTTCTC | TTT | chr12 | 21604652 | 21604673 | 21604657 | 21604652 | - |
| SEQ ID NO 24988 | GTGCCTGTAAGTTCTCTTCTCC | TTT | chr12 | 21604651 | 21604672 | 21604656 | 21604651 | - |
| SEQ ID NO 24989 | TGCCTGTAAGTTCTCTTCTCCT | TTG | chr12 | 21604650 | 21604671 | 21604655 | 21604650 | - |
| SEQ ID NO 24990 | TAAGTTCTCTTCTCCTGGGATT | CTG | chr12 | 21604644 | 21604665 | 21604649 | 21604644 | - |
| SEQ ID NO 24991 | TCTTCTCCTGGGATTACAACTA | TTC | chr12 | 21604637 | 21604658 | 21604642 | 21604637 | - |
| SEQ ID NO 24992 | TTCTCCTGGGATTACAACTAAT | CTC | chr12 | 21604635 | 21604656 | 21604640 | 21604635 | - |
| SEQ ID NO 24993 | CTCCTGGGATTACAACTAATTG | CTT | chr12 | 21604633 | 21604654 | 21604638 | 21604633 | - |
| SEQ ID NO 24994 | TCCTGGGATTACAACTAATTGA | TTC | chr12 | 21604632 | 21604653 | 21604637 | 21604632 | - |
| SEQ ID NO 24995 | CTGGGATTACAACTAATTGAAA | CTC | chr12 | 21604630 | 21604651 | 21604635 | 21604630 | - |
| SEQ ID NO 24996 | GGATTACAACTAATTGAAACAG | CTG | chr12 | 21604627 | 21604648 | 21604632 | 21604627 | - |
| SEQ ID NO 24997 | CAACTAATTGAAACAGGAATTC | TTA | chr12 | 21604621 | 21604642 | 21604626 | 21604621 | - |
| SEQ ID NO 24998 | ATTGAAACAGGAATTCAAAGGA | CTA | chr12 | 21604615 | 21604636 | 21604620 | 21604615 | - |
| SEQ ID NO 24999 | AAACAGGAATTCAAAGGAGTCT | TTG | chr12 | 21604611 | 21604632 | 21604616 | 21604611 | - |
| SEQ ID NO 25000 | AAAGGAGTCTCGGAGGACTGTA | TTC | chr12 | 21604599 | 21604620 | 21604604 | 21604599 | - |
| SEQ ID NO 25001 | GGAGGACTGTAAGAAGAATGCT | CTC | chr12 | 21604588 | 21604609 | 21604593 | 21604588 | - |
| SEQ ID NO 25002 | TAAGAAGAATGCTTCGAGGCCG | CTG | chr12 | 21604579 | 21604600 | 21604584 | 21604579 | - |
| SEQ ID NO 25003 | CGAGGCCGATCCCTCTCTGTAA | CTT | chr12 | 21604565 | 21604586 | 21604570 | 21604565 | - |
| SEQ ID NO 25004 | GAGGCCGATCCCTCTCTGTAAC | TTC | chr12 | 21604564 | 21604585 | 21604569 | 21604564 | - |
| SEQ ID NO 25005 | TCTGTAACATCCCTGGGTGGGC | CTC | chr12 | 21604550 | 21604571 | 21604555 | 21604550 | - |
| SEQ ID NO 25006 | TGTAACATCCCTGGGTGGGCTT | CTC | chr12 | 21604548 | 21604569 | 21604553 | 21604548 | - |
| SEQ ID NO 25007 | TAACATCCCTGGGTGGGCTTCC | CTG | chr12 | 21604546 | 21604567 | 21604551 | 21604546 | - |

Figure 48 (Cont'd)

| | | | | | | | | |
|---|---|---|---|---|---|---|---|---|
| SEQ ID NO 25008 | GGTGGGCTTCCCCAGTGGGAAG | CTG | chr12 | 21604535 | 21604556 | 21604540 | 21604535 | - |
| SEQ ID NO 25009 | CCCCAGTGGGAAGTCGAAGAAC | CTT | chr12 | 21604526 | 21604547 | 21604531 | 21604526 | - |
| SEQ ID NO 25010 | CCCAGTGGGAAGTCGAAGAACT | TTC | chr12 | 21604525 | 21604546 | 21604530 | 21604525 | - |
| SEQ ID NO 25011 | CCTGTGGAGGAGTTACTGCTCT | CTT | chr12 | 21604502 | 21604523 | 21604507 | 21604502 | - |
| SEQ ID NO 25012 | CTGTGGAGGAGTTACTGCTCTT | TTC | chr12 | 21604501 | 21604522 | 21604506 | 21604501 | - |
| SEQ ID NO 25013 | TGGAGGAGTTACTGCTCTTTGA | CTG | chr12 | 21604498 | 21604519 | 21604503 | 21604498 | - |
| SEQ ID NO 25014 | CTGCTCTTTGAAGTTGCTTGGG | TTA | chr12 | 21604487 | 21604508 | 21604492 | 21604487 | - |
| SEQ ID NO 25015 | CTCTTTGAAGTTGCTTGGGAAG | CTG | chr12 | 21604484 | 21604505 | 21604489 | 21604484 | - |
| SEQ ID NO 25016 | TTTGAAGTTGCTTGGGAAGTGA | CTC | chr12 | 21604481 | 21604502 | 21604486 | 21604481 | - |
| SEQ ID NO 25017 | TGAAGTTGCTTGGGAAGTGACC | CTT | chr12 | 21604479 | 21604500 | 21604484 | 21604479 | - |
| SEQ ID NO 25018 | GAAGTTGCTTGGGAAGTGACCA | TTT | chr12 | 21604478 | 21604499 | 21604483 | 21604478 | - |
| SEQ ID NO 25019 | AAGTTGCTTGGGAAGTGACCAA | TTG | chr12 | 21604477 | 21604498 | 21604482 | 21604477 | - |
| SEQ ID NO 25020 | CTTGGGAAGTGACCAATAAAGG | TTG | chr12 | 21604471 | 21604492 | 21604476 | 21604471 | - |
| SEQ ID NO 25021 | GGGAAGTGACCAATAAAGGTTT | CTT | chr12 | 21604468 | 21604489 | 21604473 | 21604468 | - |
| SEQ ID NO 25022 | GGAAGTGACCAATAAAGGTTTG | TTG | chr12 | 21604467 | 21604488 | 21604472 | 21604467 | - |
| SEQ ID NO 25023 | GTACTGCTCCTGAAGGTGGATC | TTT | chr12 | 21604446 | 21604467 | 21604451 | 21604446 | - |
| SEQ ID NO 25024 | TACTGCTCCTGAAGGTGGATCA | TTG | chr12 | 21604445 | 21604466 | 21604450 | 21604445 | - |
| SEQ ID NO 25025 | CTCCTGAAGGTGGATCAGTACA | CTG | chr12 | 21604440 | 21604461 | 21604445 | 21604440 | - |
| SEQ ID NO 25026 | CTGAAGGTGGATCAGTACACCT | CTC | chr12 | 21604437 | 21604458 | 21604442 | 21604437 | - |
| SEQ ID NO 25027 | AAGGTGGATCAGTACACCTTCA | CTG | chr12 | 21604434 | 21604455 | 21604439 | 21604434 | - |
| SEQ ID NO 25028 | CACTAGGTGACTGAGGAATGTA | CTT | chr12 | 21604414 | 21604435 | 21604419 | 21604414 | - |
| SEQ ID NO 25029 | ACTAGGTGACTGAGGAATGTAG | TTC | chr12 | 21604413 | 21604434 | 21604418 | 21604413 | - |
| SEQ ID NO 25030 | GGTGACTGAGGAATGTAGAGTA | CTA | chr12 | 21604409 | 21604430 | 21604414 | 21604409 | - |
| SEQ ID NO 25031 | AGGAATGTAGAGTAAGATTTCA | CTG | chr12 | 21604401 | 21604422 | 21604406 | 21604401 | - |
| SEQ ID NO 25032 | CACAGATAACTCTCTAGTGATA | TTT | chr12 | 21604381 | 21604402 | 21604386 | 21604381 | - |
| SEQ ID NO 25033 | ACAGATAACTCTCTAGTGATAA | TTC | chr12 | 21604380 | 21604401 | 21604385 | 21604380 | - |
| SEQ ID NO 25034 | TCTAGTGATAACCAATTGCTAG | CTC | chr12 | 21604369 | 21604390 | 21604374 | 21604369 | - |
| SEQ ID NO 25035 | TAGTGATAACCAATTGCTAGTG | CTC | chr12 | 21604367 | 21604388 | 21604372 | 21604367 | - |
| SEQ ID NO 25036 | GTGATAACCAATTGCTAGTGAG | CTA | chr12 | 21604365 | 21604386 | 21604370 | 21604365 | - |
| SEQ ID NO 25037 | CTAGTGAGTGAGGAAAGCATTT | TTG | chr12 | 21604351 | 21604372 | 21604356 | 21604351 | - |
| SEQ ID NO 25038 | GTGAGTGAGGAAAGCATTTAAA | CTA | chr12 | 21604348 | 21604369 | 21604353 | 21604348 | - |
| SEQ ID NO 25039 | AAACGGAATATATATTTAGGCT | TTT | chr12 | 21604329 | 21604350 | 21604334 | 21604329 | - |
| SEQ ID NO 25040 | AACGGAATATATATTTAGGCTA | TTA | chr12 | 21604328 | 21604349 | 21604333 | 21604328 | - |
| SEQ ID NO 25041 | AGGCTACATTTAACCTTGTCTA | TTT | chr12 | 21604312 | 21604333 | 21604317 | 21604312 | - |
| SEQ ID NO 25042 | GGCTACATTTAACCTTGTCTAT | TTA | chr12 | 21604311 | 21604332 | 21604316 | 21604311 | - |
| SEQ ID NO 25043 | CATTTAACCTTGTCTATTACAA | CTA | chr12 | 21604306 | 21604327 | 21604311 | 21604306 | - |
| SEQ ID NO 25044 | AACCTTGTCTATTACAACAGGC | TTT | chr12 | 21604301 | 21604322 | 21604306 | 21604301 | - |
| SEQ ID NO 25045 | ACCTTGTCTATTACAACAGGCT | TTA | chr12 | 21604300 | 21604321 | 21604305 | 21604300 | - |
| SEQ ID NO 25046 | GTCTATTACAACAGGCTATGAA | CTT | chr12 | 21604295 | 21604316 | 21604300 | 21604295 | - |
| SEQ ID NO 25047 | TCTATTACAACAGGCTATGAAT | TTG | chr12 | 21604294 | 21604315 | 21604299 | 21604294 | - |
| SEQ ID NO 25048 | TTACAACAGGCTATGAATACAG | CTA | chr12 | 21604290 | 21604311 | 21604295 | 21604290 | - |
| SEQ ID NO 25049 | CAACAGGCTATGAATACAGACT | TTA | chr12 | 21604287 | 21604308 | 21604292 | 21604287 | - |
| SEQ ID NO 25050 | TGAATACAGACTTGTGTATGTG | CTA | chr12 | 21604277 | 21604298 | 21604282 | 21604277 | - |
| SEQ ID NO 25051 | GTGTATGTGTTGAAGAGGGAGA | CTT | chr12 | 21604264 | 21604285 | 21604269 | 21604264 | - |
| SEQ ID NO 25052 | TGTATGTGTTGAAGAGGGAGAA | TTG | chr12 | 21604263 | 21604284 | 21604268 | 21604263 | - |
| SEQ ID NO 25053 | AAGAGGGAGAAAGTTGAAAATA | TTG | chr12 | 21604252 | 21604273 | 21604257 | 21604252 | - |
| SEQ ID NO 25054 | AAAATATTAGCCATTGCCATGG | TTG | chr12 | 21604236 | 21604257 | 21604241 | 21604236 | - |
| SEQ ID NO 25055 | GCCATTGCCATGGAATGTGCAT | TTA | chr12 | 21604227 | 21604248 | 21604232 | 21604227 | - |
| SEQ ID NO 25056 | CCATGGAATGTGCATTTAAATT | TTG | chr12 | 21604220 | 21604241 | 21604225 | 21604220 | - |
| SEQ ID NO 25057 | AAATTAAAATTTAAAATCCATA | TTT | chr12 | 21604203 | 21604224 | 21604208 | 21604203 | - |
| SEQ ID NO 25058 | AATTAAAATTTAAAATCCATAT | TTA | chr12 | 21604202 | 21604223 | 21604207 | 21604202 | - |
| SEQ ID NO 25059 | AAATTTAAAATCCATATTATGA | TTA | chr12 | 21604197 | 21604218 | 21604202 | 21604197 | - |
| SEQ ID NO 25060 | AAAATCCATATTATGACAACAT | TTT | chr12 | 21604191 | 21604212 | 21604196 | 21604191 | - |
| SEQ ID NO 25061 | AAATCCATATTATGACAACATA | TTA | chr12 | 21604190 | 21604211 | 21604195 | 21604190 | - |
| SEQ ID NO 25062 | TGACAACATAGAAATAAAAAGT | TTA | chr12 | 21604178 | 21604199 | 21604183 | 21604178 | - |
| SEQ ID NO 25063 | ATATTTACATTTTTTGTTTTAA | TTA | chr12 | 21604154 | 21604175 | 21604159 | 21604154 | - |
| SEQ ID NO 25064 | ACATTTTTTGTTTAAAATTTT | TTT | chr12 | 21604148 | 21604169 | 21604153 | 21604148 | - |
| SEQ ID NO 25065 | CATTTTTTGTTTTAAAATTTTT | TTA | chr12 | 21604147 | 21604168 | 21604152 | 21604147 | - |

Figure 48 (Cont'd)

| SEQ ID NO 25066 | TTTGTTTTAAAATTTTTCTCAG | TTT | chr12 | 21604142 | 21604163 | 21604147 | 21604142 | - |
|---|---|---|---|---|---|---|---|---|
| SEQ ID NO 25067 | TTGTTTTAAAATTTTTCTCAGC | TTT | chr12 | 21604141 | 21604162 | 21604146 | 21604141 | - |
| SEQ ID NO 25068 | TGTTTTAAAATTTTTCTCAGCA | TTT | chr12 | 21604140 | 21604161 | 21604145 | 21604140 | - |
| SEQ ID NO 25069 | GTTTTAAAATTTTTCTCAGCAA | TTT | chr12 | 21604139 | 21604160 | 21604144 | 21604139 | - |
| SEQ ID NO 25070 | TTTTAAAATTTTTCTCAGCAAA | TTG | chr12 | 21604138 | 21604159 | 21604143 | 21604138 | - |
| SEQ ID NO 25071 | TAAAATTTTTCTCAGCAAAATA | TTT | chr12 | 21604135 | 21604156 | 21604140 | 21604135 | - |
| SEQ ID NO 25072 | AAAATTTTTCTCAGCAAAATAG | TTT | chr12 | 21604134 | 21604155 | 21604139 | 21604134 | - |
| SEQ ID NO 25073 | AAATTTTTCTCAGCAAAATAGT | TTA | chr12 | 21604133 | 21604154 | 21604138 | 21604133 | - |
| SEQ ID NO 25074 | TTCTCAGCAAAATAGTATAATT | TTT | chr12 | 21604127 | 21604148 | 21604132 | 21604127 | - |
| SEQ ID NO 25075 | TCTCAGCAAAATAGTATAATTA | TTT | chr12 | 21604126 | 21604147 | 21604131 | 21604126 | - |
| SEQ ID NO 25076 | CTCAGCAAAATAGTATAATTAA | TTT | chr12 | 21604125 | 21604146 | 21604130 | 21604125 | - |
| SEQ ID NO 25077 | TCAGCAAAATAGTATAATTAAA | TTC | chr12 | 21604124 | 21604145 | 21604129 | 21604124 | - |
| SEQ ID NO 25078 | AGCAAAATAGTATAATTAAACA | CTC | chr12 | 21604122 | 21604143 | 21604127 | 21604122 | - |
| SEQ ID NO 25079 | AACATTTTATTTAGGAAGATG | TTA | chr12 | 21604104 | 21604125 | 21604109 | 21604104 | - |
| SEQ ID NO 25080 | TATTTTAGGAAGATGTATATGT | TTT | chr12 | 21604097 | 21604118 | 21604102 | 21604097 | - |
| SEQ ID NO 25081 | ATTTTAGGAAGATGTATATGTG | TTT | chr12 | 21604096 | 21604117 | 21604101 | 21604096 | - |
| SEQ ID NO 25082 | TTTTAGGAAGATGTATATGTGA | TTA | chr12 | 21604095 | 21604116 | 21604100 | 21604095 | - |
| SEQ ID NO 25083 | TAGGAAGATGTATATGTGATTA | TTT | chr12 | 21604092 | 21604113 | 21604097 | 21604092 | - |
| SEQ ID NO 25084 | AGGAAGATGTATATGTGATTAG | TTT | chr12 | 21604091 | 21604112 | 21604096 | 21604091 | - |
| SEQ ID NO 25085 | GGAAGATGTATATGTGATTAGA | TTA | chr12 | 21604090 | 21604111 | 21604095 | 21604090 | - |
| SEQ ID NO 25086 | GAACCAGTTGGAAACCTCAACT | TTA | chr12 | 21604070 | 21604091 | 21604075 | 21604070 | - |
| SEQ ID NO 25087 | GAAACCTCAACTCTACATTCTG | TTG | chr12 | 21604060 | 21604081 | 21604065 | 21604060 | - |
| SEQ ID NO 25088 | AACTCTACATTCTGTTAGTAAT | CTC | chr12 | 21604052 | 21604073 | 21604057 | 21604052 | - |
| SEQ ID NO 25089 | TACATTCTGTTAGTAATTATAT | CTC | chr12 | 21604047 | 21604068 | 21604052 | 21604047 | - |
| SEQ ID NO 25090 | CATTCTGTTAGTAATTATATGA | CTA | chr12 | 21604045 | 21604066 | 21604050 | 21604045 | - |
| SEQ ID NO 25091 | TGTTAGTAATTATATGAAATGC | TTC | chr12 | 21604040 | 21604061 | 21604045 | 21604040 | - |
| SEQ ID NO 25092 | TTAGTAATTATATGAAATGCTT | CTG | chr12 | 21604038 | 21604059 | 21604043 | 21604038 | - |
| SEQ ID NO 25093 | GTAATTATATGAAATGCTTAAG | TTA | chr12 | 21604035 | 21604056 | 21604040 | 21604035 | - |
| SEQ ID NO 25094 | TATGAAATGCTTAAGAATGTTT | TTA | chr12 | 21604028 | 21604049 | 21604033 | 21604028 | - |
| SEQ ID NO 25095 | AAGAATGTTTCATATTCACAAT | CTT | chr12 | 21604016 | 21604037 | 21604021 | 21604016 | - |
| SEQ ID NO 25096 | AGAATGTTTCATATTCACAATT | TTA | chr12 | 21604015 | 21604036 | 21604020 | 21604015 | - |
| SEQ ID NO 25097 | CATATTCACAATTAGCTTGGAA | TTT | chr12 | 21604006 | 21604027 | 21604011 | 21604006 | - |
| SEQ ID NO 25098 | ATATTCACAATTAGCTTGGAAT | TTC | chr12 | 21604005 | 21604026 | 21604010 | 21604005 | - |
| SEQ ID NO 25099 | ACAATTAGCTTGGAATTAATGT | TTC | chr12 | 21603999 | 21604020 | 21604004 | 21603999 | - |
| SEQ ID NO 25100 | GCTTGGAATTAATGTTTTAATT | TTA | chr12 | 21603992 | 21604013 | 21603997 | 21603992 | - |
| SEQ ID NO 25101 | GGAATTAATGTTTTAATTCAGG | CTT | chr12 | 21603988 | 21604009 | 21603993 | 21603988 | - |
| SEQ ID NO 25102 | GAATTAATGTTTTAATTCAGGA | TTG | chr12 | 21603987 | 21604008 | 21603992 | 21603987 | - |
| SEQ ID NO 25103 | ATGTTTTAATTCAGGAGCTTCT | TTA | chr12 | 21603981 | 21604002 | 21603986 | 21603981 | - |
| SEQ ID NO 25104 | TAATTCAGGAGCTTCTCAAAAG | TTT | chr12 | 21603975 | 21603996 | 21603980 | 21603975 | - |
| SEQ ID NO 25105 | AATTCAGGAGCTTCTCAAAAGG | TTT | chr12 | 21603974 | 21603995 | 21603979 | 21603974 | - |
| SEQ ID NO 25106 | ATTCAGGAGCTTCTCAAAAGGC | TTA | chr12 | 21603973 | 21603994 | 21603978 | 21603973 | - |
| SEQ ID NO 25107 | AGGAGCTTCTCAAAAGGCAAAA | TTC | chr12 | 21603969 | 21603990 | 21603974 | 21603969 | - |
| SEQ ID NO 25108 | CTCAAAAGGCAAAATACTGTGC | CTT | chr12 | 21603961 | 21603982 | 21603966 | 21603961 | - |
| SEQ ID NO 25109 | TCAAAAGGCAAAATACTGTGCT | TTC | chr12 | 21603960 | 21603981 | 21603965 | 21603960 | - |
| SEQ ID NO 25110 | AAAAGGCAAAATACTGTGCTCC | CTC | chr12 | 21603958 | 21603979 | 21603963 | 21603958 | - |
| SEQ ID NO 25111 | TGCTCCTTTCAGAATGAAAGTA | CTG | chr12 | 21603942 | 21603963 | 21603947 | 21603942 | - |
| SEQ ID NO 25112 | CTTTCAGAATGAAAGTAATTTT | CTC | chr12 | 21603937 | 21603958 | 21603942 | 21603937 | - |
| SEQ ID NO 25113 | TCAGAATGAAAGTAATTTTTTT | CTT | chr12 | 21603934 | 21603955 | 21603939 | 21603934 | - |
| SEQ ID NO 25114 | CAGAATGAAAGTAATTTTTTTC | TTT | chr12 | 21603933 | 21603954 | 21603938 | 21603933 | - |
| SEQ ID NO 25115 | AGAATGAAAGTAATTTTTTTCT | TTC | chr12 | 21603932 | 21603953 | 21603937 | 21603932 | - |
| SEQ ID NO 25116 | TTTTCTTCAATGCTATGCTTAT | TTT | chr12 | 21603916 | 21603937 | 21603921 | 21603916 | - |
| SEQ ID NO 25117 | TTTCTTCAATGCTATGCTTATG | TTT | chr12 | 21603915 | 21603936 | 21603920 | 21603915 | - |
| SEQ ID NO 25118 | TTCTTCAATGCTATGCTTATGT | TTT | chr12 | 21603914 | 21603935 | 21603919 | 21603914 | - |
| SEQ ID NO 25119 | TCTTCAATGCTATGCTTATGTA | TTT | chr12 | 21603913 | 21603934 | 21603918 | 21603913 | - |
| SEQ ID NO 25120 | CTTCAATGCTATGCTTATGTAG | TTT | chr12 | 21603912 | 21603933 | 21603917 | 21603912 | - |
| SEQ ID NO 25121 | TTCAATGCTATGCTTATGTAGG | TTC | chr12 | 21603911 | 21603932 | 21603916 | 21603911 | - |
| SEQ ID NO 25122 | CAATGCTATGCTTATGTAGGAA | CTT | chr12 | 21603909 | 21603930 | 21603914 | 21603909 | - |
| SEQ ID NO 25123 | AATGCTATGCTTATGTAGGAAT | TTC | chr12 | 21603908 | 21603929 | 21603913 | 21603908 | - |

Figure 48 (Cont'd)

| | | | | | | | | |
|---|---|---|---|---|---|---|---|---|
| SEQ ID NO 25124 | TGCTTATGTAGGAATTATAAAA | CTA | chr12 | 21603901 | 21603922 | 21603906 | 21603901 | - |
| SEQ ID NO 25125 | ATGTAGGAATTATAAAATAAAG | CTT | chr12 | 21603896 | 21603917 | 21603901 | 21603896 | - |
| SEQ ID NO 25126 | TGTAGGAATTATAAAATAAAGA | TTA | chr12 | 21603895 | 21603916 | 21603900 | 21603895 | - |
| SEQ ID NO 25127 | TAAAATAAAGAAAATCAAATTG | TTA | chr12 | 21603884 | 21603905 | 21603889 | 21603884 | - |
| SEQ ID NO 25128 | ATAAAACAATTTGCGAGTGAGG | TTG | chr12 | 21603862 | 21603883 | 21603867 | 21603862 | - |
| SEQ ID NO 25129 | GCGAGTGAGGTATAACCTCATC | TTT | chr12 | 21603850 | 21603871 | 21603855 | 21603850 | - |
| SEQ ID NO 25130 | CGAGTGAGGTATAACCTCATCT | TTG | chr12 | 21603849 | 21603870 | 21603854 | 21603849 | - |
| SEQ ID NO 25131 | ATCTGTGCTGGGTAAGAGAAGG | CTC | chr12 | 21603831 | 21603852 | 21603836 | 21603831 | - |
| SEQ ID NO 25132 | TGCTGGGTAAGAGAAGGCAAGG | CTG | chr12 | 21603826 | 21603847 | 21603831 | 21603826 | - |
| SEQ ID NO 25133 | GGTAAGAGAAGGCAAGGTAGAG | CTG | chr12 | 21603821 | 21603842 | 21603826 | 21603821 | - |
| SEQ ID NO 25134 | TGAAAATAAAGACATCTGTAAA | TTT | chr12 | 21603779 | 21603800 | 21603784 | 21603779 | - |
| SEQ ID NO 25135 | GAAAATAAAGACATCTGTAAAA | TTT | chr12 | 21603778 | 21603799 | 21603783 | 21603778 | - |
| SEQ ID NO 25136 | AAAATAAAGACATCTGTAAAAT | TTG | chr12 | 21603777 | 21603798 | 21603782 | 21603777 | - |
| SEQ ID NO 25137 | TAAAATTATAAAACAATTCCTT | CTG | chr12 | 21603761 | 21603782 | 21603766 | 21603761 | - |
| SEQ ID NO 25138 | TAAAACAATTCCTTGTGGGTTT | TTA | chr12 | 21603753 | 21603774 | 21603758 | 21603753 | - |
| SEQ ID NO 25139 | CTTGTGGGTTTATACTCTCTAG | TTC | chr12 | 21603742 | 21603763 | 21603747 | 21603742 | - |
| SEQ ID NO 25140 | GTGGGTTTATACTCTCTAGTTT | CTT | chr12 | 21603739 | 21603760 | 21603744 | 21603739 | - |
| SEQ ID NO 25141 | TGGGTTTATACTCTCTAGTTTA | TTG | chr12 | 21603738 | 21603759 | 21603743 | 21603738 | - |
| SEQ ID NO 25142 | ATACTCTCTAGTTTAAAAGTGT | TTT | chr12 | 21603731 | 21603752 | 21603736 | 21603731 | - |
| SEQ ID NO 25143 | TACTCTCTAGTTTAAAAGTGTC | TTA | chr12 | 21603730 | 21603751 | 21603735 | 21603730 | - |
| SEQ ID NO 25144 | TCTAGTTTAAAAGTGTCAAGAC | CTC | chr12 | 21603725 | 21603746 | 21603730 | 21603725 | - |
| SEQ ID NO 25145 | TAGTTTAAAAGTGTCAAGACTA | CTC | chr12 | 21603723 | 21603744 | 21603728 | 21603723 | - |
| SEQ ID NO 25146 | GTTTAAAAGTGTCAAGACTATT | CTA | chr12 | 21603721 | 21603742 | 21603726 | 21603721 | - |
| SEQ ID NO 25147 | AAAAGTGTCAAGACTATTGAAG | TTT | chr12 | 21603717 | 21603738 | 21603722 | 21603717 | - |
| SEQ ID NO 25148 | AAAGTGTCAAGACTATTGAAGG | TTA | chr12 | 21603716 | 21603737 | 21603721 | 21603716 | - |
| SEQ ID NO 25149 | TTGAAGGAACATTAGCAAAGAA | CTA | chr12 | 21603701 | 21603722 | 21603706 | 21603701 | - |
| SEQ ID NO 25150 | AAGGAACATTAGCAAAGAAAAA | TTG | chr12 | 21603698 | 21603719 | 21603703 | 21603698 | - |
| SEQ ID NO 25151 | GCAAAGAAAAAGTCATGGTTTT | TTA | chr12 | 21603687 | 21603708 | 21603692 | 21603687 | - |
| SEQ ID NO 25152 | TGAAGGCTGAGTTCCTCAAGAT | TTT | chr12 | 21603666 | 21603687 | 21603671 | 21603666 | - |
| SEQ ID NO 25153 | GAAGGCTGAGTTCCTCAAGATC | TTT | chr12 | 21603665 | 21603686 | 21603670 | 21603665 | - |
| SEQ ID NO 25154 | AAGGCTGAGTTCCTCAAGATCT | TTG | chr12 | 21603664 | 21603685 | 21603669 | 21603664 | - |
| SEQ ID NO 25155 | AGTTCCTCAAGATCTTGAAGAA | CTG | chr12 | 21603657 | 21603678 | 21603662 | 21603657 | - |
| SEQ ID NO 25156 | CTCAAGATCTTGAAGAATCAAG | TTC | chr12 | 21603652 | 21603673 | 21603657 | 21603652 | - |
| SEQ ID NO 25157 | AAGATCTTGAAGAATCAAGCCA | CTC | chr12 | 21603649 | 21603670 | 21603654 | 21603649 | - |
| SEQ ID NO 25158 | GAAGAATCAAGCCAACTGATTG | CTT | chr12 | 21603641 | 21603662 | 21603646 | 21603641 | - |
| SEQ ID NO 25159 | AAGAATCAAGCCAACTGATTGC | TTG | chr12 | 21603640 | 21603661 | 21603645 | 21603640 | - |
| SEQ ID NO 25160 | ATTGCTGGGTAAATGGCAGTGA | CTG | chr12 | 21603623 | 21603644 | 21603628 | 21603623 | - |
| SEQ ID NO 25161 | CTGGGTAAATGGCAGTGATGAC | TTG | chr12 | 21603619 | 21603640 | 21603624 | 21603619 | - |
| SEQ ID NO 25162 | GGTAAATGGCAGTGATGACTTG | CTG | chr12 | 21603616 | 21603637 | 21603621 | 21603616 | - |
| SEQ ID NO 25163 | GTGTGATTTAAACGATCTGAAA | CTT | chr12 | 21603595 | 21603616 | 21603600 | 21603595 | - |
| SEQ ID NO 25164 | TGTGATTTAAACGATCTGAAAT | TTG | chr12 | 21603594 | 21603615 | 21603599 | 21603594 | - |
| SEQ ID NO 25165 | AAACGATCTGAAATTATGTCAT | TTT | chr12 | 21603586 | 21603607 | 21603591 | 21603586 | - |
| SEQ ID NO 25166 | AACGATCTGAAATTATGTCATG | TTA | chr12 | 21603585 | 21603606 | 21603590 | 21603585 | - |
| SEQ ID NO 25167 | AAATTATGTCATGTGTTGTGAT | CTG | chr12 | 21603576 | 21603597 | 21603581 | 21603576 | - |
| SEQ ID NO 25168 | TGTCATGTGTTGTGATATATAA | TTA | chr12 | 21603570 | 21603591 | 21603575 | 21603570 | - |
| SEQ ID NO 25169 | TGATATATAACACATTTATTTT | TTG | chr12 | 21603558 | 21603579 | 21603563 | 21603558 | - |
| SEQ ID NO 25170 | ATTTTTCATTTGTGTTTACTA | TTT | chr12 | 21603541 | 21603562 | 21603546 | 21603541 | - |
| SEQ ID NO 25171 | TTTTTCATTTGTGTTTACTAT | TTA | chr12 | 21603540 | 21603561 | 21603545 | 21603540 | - |
| SEQ ID NO 25172 | TTCATTTGTGTTTACTATTTC | TTT | chr12 | 21603537 | 21603558 | 21603542 | 21603537 | - |
| SEQ ID NO 25173 | TCATTTGTGTTTACTATTTCA | TTT | chr12 | 21603536 | 21603557 | 21603541 | 21603536 | - |
| SEQ ID NO 25174 | CATTTGTGTTTACTATTTCAT | TTT | chr12 | 21603535 | 21603556 | 21603540 | 21603535 | - |
| SEQ ID NO 25175 | ATTTTGTGTTTACTATTTCATG | TTC | chr12 | 21603534 | 21603555 | 21603539 | 21603534 | - |
| SEQ ID NO 25176 | TGTGTTTACTATTTCATGTCTA | TTT | chr12 | 21603530 | 21603551 | 21603535 | 21603530 | - |
| SEQ ID NO 25177 | GTGTTTACTATTTCATGTCTAT | TTT | chr12 | 21603529 | 21603550 | 21603534 | 21603529 | - |
| SEQ ID NO 25178 | TGTTTACTATTTCATGTCTATT | TTG | chr12 | 21603528 | 21603549 | 21603533 | 21603528 | - |
| SEQ ID NO 25179 | ACTATTTCATGTCTATTACAGT | TTT | chr12 | 21603523 | 21603544 | 21603528 | 21603523 | - |
| SEQ ID NO 25180 | CTATTTCATGTCTATTACAGTA | TTA | chr12 | 21603522 | 21603543 | 21603527 | 21603522 | - |
| SEQ ID NO 25181 | TTTCATGTCTATTACAGTAATC | CTA | chr12 | 21603519 | 21603540 | 21603524 | 21603519 | - |

Figure 48 (Cont'd)

| | | | | | | | | |
|---|---|---|---|---|---|---|---|---|
| SEQ ID NO 25182 | CATGTCTATTACAGTAATCTAA | TTT | chr12 | 21603516 | 21603537 | 21603521 | 21603516 | - |
| SEQ ID NO 25183 | ATGTCTATTACAGTAATCTAAA | TTC | chr12 | 21603515 | 21603536 | 21603520 | 21603515 | - |
| SEQ ID NO 25184 | TTACAGTAATCTAAAGGATCTG | CTA | chr12 | 21603508 | 21603529 | 21603513 | 21603508 | - |
| SEQ ID NO 25185 | CAGTAATCTAAAGGATCTGAAA | TTA | chr12 | 21603505 | 21603526 | 21603510 | 21603505 | - |
| SEQ ID NO 25186 | AAGGATCTGAAATAATAACCAG | CTA | chr12 | 21603495 | 21603516 | 21603500 | 21603495 | - |
| SEQ ID NO 25187 | AAATAATAACCAGAATGTGATA | CTG | chr12 | 21603486 | 21603507 | 21603491 | 21603486 | - |
| SEQ ID NO 25188 | CTTCCTTCTTTTGGCTAATCAG | TTA | chr12 | 21603459 | 21603480 | 21603464 | 21603459 | - |
| SEQ ID NO 25189 | CCTTCTTTTGGCTAATCAGAGC | CTT | chr12 | 21603456 | 21603477 | 21603461 | 21603456 | - |
| SEQ ID NO 25190 | CTTCTTTTGGCTAATCAGAGCC | TTC | chr12 | 21603455 | 21603476 | 21603460 | 21603455 | - |
| SEQ ID NO 25191 | CTTTTGGCTAATCAGAGCCAGC | CTT | chr12 | 21603452 | 21603473 | 21603457 | 21603452 | - |
| SEQ ID NO 25192 | TTTTGGCTAATCAGAGCCAGCA | TTC | chr12 | 21603451 | 21603472 | 21603456 | 21603451 | - |
| SEQ ID NO 25193 | TTGGCTAATCAGAGCCAGCATA | CTT | chr12 | 21603449 | 21603470 | 21603454 | 21603449 | - |
| SEQ ID NO 25194 | TGGCTAATCAGAGCCAGCATAA | TTT | chr12 | 21603448 | 21603469 | 21603453 | 21603448 | - |
| SEQ ID NO 25195 | GGCTAATCAGAGCCAGCATAAT | TTT | chr12 | 21603447 | 21603468 | 21603452 | 21603447 | - |
| SEQ ID NO 25196 | GCTAATCAGAGCCAGCATAATC | TTG | chr12 | 21603446 | 21603467 | 21603451 | 21603446 | - |
| SEQ ID NO 25197 | ATCAGAGCCAGCATAATCTCAA | CTA | chr12 | 21603442 | 21603463 | 21603447 | 21603442 | - |
| SEQ ID NO 25198 | AAAATTAAATGCATTATATATG | CTC | chr12 | 21603422 | 21603443 | 21603427 | 21603422 | - |
| SEQ ID NO 25199 | AATGCATTATATATGGCATGCA | TTA | chr12 | 21603415 | 21603436 | 21603420 | 21603415 | - |
| SEQ ID NO 25200 | TATATGGCATGCATTCTGAAAA | TTA | chr12 | 21603406 | 21603427 | 21603411 | 21603406 | - |
| SEQ ID NO 25201 | TGAAAAATCAGAATTCACCTTA | TTC | chr12 | 21603390 | 21603411 | 21603395 | 21603390 | - |
| SEQ ID NO 25202 | AAAAATCAGAATTCACCTTATA | CTG | chr12 | 21603388 | 21603409 | 21603393 | 21603388 | - |
| SEQ ID NO 25203 | ACCTTATACTAACTGTTCAAAG | TTC | chr12 | 21603374 | 21603395 | 21603379 | 21603374 | - |
| SEQ ID NO 25204 | ATACTAACTGTTCAAAGTTCTC | CTT | chr12 | 21603369 | 21603390 | 21603374 | 21603369 | - |
| SEQ ID NO 25205 | TACTAACTGTTCAAAGTTCTCG | TTA | chr12 | 21603368 | 21603389 | 21603373 | 21603368 | - |
| SEQ ID NO 25206 | ACTGTTCAAAGTTCTCGTGTGT | CTA | chr12 | 21603363 | 21603384 | 21603368 | 21603363 | - |
| SEQ ID NO 25207 | TTCAAAGTTCTCGTGTGTATGC | CTG | chr12 | 21603359 | 21603380 | 21603364 | 21603359 | - |
| SEQ ID NO 25208 | AAAGTTCTCGTGTGTATGCATT | TTC | chr12 | 21603356 | 21603377 | 21603361 | 21603356 | - |
| SEQ ID NO 25209 | TCGTGTGTATGCATTCATAAAA | TTC | chr12 | 21603349 | 21603370 | 21603354 | 21603349 | - |
| SEQ ID NO 25210 | GTGTGTATGCATTCATAAAATC | CTC | chr12 | 21603347 | 21603368 | 21603352 | 21603347 | - |
| SEQ ID NO 25211 | ATAAAATCAAATTAAAAGTCA | TTC | chr12 | 21603333 | 21603354 | 21603338 | 21603333 | - |
| SEQ ID NO 25212 | AAAGTCAATTTTGCCTATGTAG | TTA | chr12 | 21603318 | 21603339 | 21603323 | 21603318 | - |
| SEQ ID NO 25213 | TGCCTATGTAGAAGTGGACAGA | TTT | chr12 | 21603307 | 21603328 | 21603312 | 21603307 | - |
| SEQ ID NO 25214 | GCCTATGTAGAAGTGGACAGAA | TTT | chr12 | 21603306 | 21603327 | 21603311 | 21603306 | - |
| SEQ ID NO 25215 | CCTATGTAGAAGTGGACAGAAT | TTG | chr12 | 21603305 | 21603326 | 21603310 | 21603305 | - |
| SEQ ID NO 25216 | TGTAGAAGTGGACAGAATGCAT | CTA | chr12 | 21603301 | 21603322 | 21603306 | 21603301 | - |
| SEQ ID NO 25217 | ATTCTCTGTAGTTTAGTGAGAA | CTT | chr12 | 21603256 | 21603277 | 21603261 | 21603256 | - |
| SEQ ID NO 25218 | TTCTCTGTAGTTTAGTGAGAAA | TTA | chr12 | 21603255 | 21603276 | 21603260 | 21603255 | - |
| SEQ ID NO 25219 | TCTGTAGTTTAGTGAGAAAGAA | TTC | chr12 | 21603252 | 21603273 | 21603257 | 21603252 | - |
| SEQ ID NO 25220 | TGTAGTTTAGTGAGAAAGAATC | CTC | chr12 | 21603250 | 21603271 | 21603255 | 21603250 | - |
| SEQ ID NO 25221 | TAGTTTAGTGAGAAAGAATCTA | CTG | chr12 | 21603248 | 21603269 | 21603253 | 21603248 | - |
| SEQ ID NO 25222 | AGTGAGAAAGAATCTAGGAGGA | TTT | chr12 | 21603242 | 21603263 | 21603247 | 21603242 | - |
| SEQ ID NO 25223 | GTGAGAAAGAATCTAGGAGGAC | TTA | chr12 | 21603241 | 21603262 | 21603246 | 21603241 | - |
| SEQ ID NO 25224 | GGAGGACAGAAACCTTATTACA | CTA | chr12 | 21603226 | 21603247 | 21603231 | 21603226 | - |
| SEQ ID NO 25225 | ATTACAGAGAAGTGAAGTATTT | CTT | chr12 | 21603210 | 21603231 | 21603215 | 21603210 | - |
| SEQ ID NO 25226 | TTACAGAGAAGTGAAGTATTTT | TTA | chr12 | 21603209 | 21603230 | 21603214 | 21603209 | - |
| SEQ ID NO 25227 | CAGAGAAGTGAAGTATTTTATG | TTA | chr12 | 21603206 | 21603227 | 21603211 | 21603206 | - |
| SEQ ID NO 25228 | TATGTGTACCTGTTTCTGTTGT | TTT | chr12 | 21603188 | 21603209 | 21603193 | 21603188 | - |
| SEQ ID NO 25229 | ATGTGTACCTGTTTCTGTTGTT | TTT | chr12 | 21603187 | 21603208 | 21603192 | 21603187 | - |
| SEQ ID NO 25230 | TGTGTACCTGTTTCTGTTGTTT | TTA | chr12 | 21603186 | 21603207 | 21603191 | 21603186 | - |
| SEQ ID NO 25231 | TTTCTGTTGTTTCTTTTTAAAT | CTG | chr12 | 21603176 | 21603197 | 21603181 | 21603176 | - |
| SEQ ID NO 25232 | CTGTTGTTTCTTTTTAAATTAT | TTT | chr12 | 21603173 | 21603194 | 21603178 | 21603173 | - |
| SEQ ID NO 25233 | TGTTGTTTCTTTTTAAATTATT | TTC | chr12 | 21603172 | 21603193 | 21603177 | 21603172 | - |
| SEQ ID NO 25234 | TTGTTTCTTTTTAAATTATTTT | CTG | chr12 | 21603170 | 21603191 | 21603175 | 21603170 | - |
| SEQ ID NO 25235 | TTTCTTTTTAAATTATTTTGTA | TTG | chr12 | 21603167 | 21603188 | 21603172 | 21603167 | - |
| SEQ ID NO 25236 | CTTTTTAAATTATTTTGTATTC | TTT | chr12 | 21603164 | 21603185 | 21603169 | 21603164 | - |
| SEQ ID NO 25237 | TTTTTAAATTATTTTGTATTCT | TTC | chr12 | 21603163 | 21603184 | 21603168 | 21603163 | - |
| SEQ ID NO 25238 | TTTAAATTATTTTGTATTCTTT | CTT | chr12 | 21603161 | 21603182 | 21603166 | 21603161 | - |
| SEQ ID NO 25239 | TTAAATTATTTTGTATTCTTTT | TTT | chr12 | 21603160 | 21603181 | 21603165 | 21603160 | - |

Figure 48 (Cont'd)

| | | | | | | | | |
|---|---|---|---|---|---|---|---|---|
| SEQ ID NO 25240 | TAAATTATTTTGTATTCTTTTC | TTT | chr12 | 21603159 | 21603180 | 21603164 | 21603159 | - |
| SEQ ID NO 25241 | AAATTATTTTGTATTCTTTTCC | TTT | chr12 | 21603158 | 21603179 | 21603163 | 21603158 | - |
| SEQ ID NO 25242 | AATTATTTTGTATTCTTTTCCT | TTA | chr12 | 21603157 | 21603178 | 21603162 | 21603157 | - |
| SEQ ID NO 25243 | TTTTGTATTCTTTTCCTCAGAG | TTA | chr12 | 21603152 | 21603173 | 21603157 | 21603152 | - |
| SEQ ID NO 25244 | TGTATTCTTTTCCTCAGAGATC | TTT | chr12 | 21603149 | 21603170 | 21603154 | 21603149 | - |
| SEQ ID NO 25245 | GTATTCTTTTCCTCAGAGATCT | TTT | chr12 | 21603148 | 21603169 | 21603153 | 21603148 | - |
| SEQ ID NO 25246 | TATTCTTTTCCTCAGAGATCTT | TTG | chr12 | 21603147 | 21603168 | 21603152 | 21603147 | - |
| SEQ ID NO 25247 | TTTTCCTCAGAGATCTTTATCC | TTC | chr12 | 21603142 | 21603163 | 21603147 | 21603142 | - |
| SEQ ID NO 25248 | TTCCTCAGAGATCTTTATCCTG | CTT | chr12 | 21603140 | 21603161 | 21603145 | 21603140 | - |
| SEQ ID NO 25249 | TCCTCAGAGATCTTTATCCTGA | TTT | chr12 | 21603139 | 21603160 | 21603144 | 21603139 | - |
| SEQ ID NO 25250 | CCTCAGAGATCTTTATCCTGAA | TTT | chr12 | 21603138 | 21603159 | 21603143 | 21603138 | - |
| SEQ ID NO 25251 | CTCAGAGATCTTTATCCTGAAA | TTC | chr12 | 21603137 | 21603158 | 21603142 | 21603137 | - |
| SEQ ID NO 25252 | AGAGATCTTTATCCTGAAATGA | CTC | chr12 | 21603134 | 21603155 | 21603139 | 21603134 | - |
| SEQ ID NO 25253 | TATCCTGAAATGAGCATGTGTT | CTT | chr12 | 21603125 | 21603146 | 21603130 | 21603125 | - |
| SEQ ID NO 25254 | ATCCTGAAATGAGCATGTGTTT | TTT | chr12 | 21603124 | 21603145 | 21603129 | 21603124 | - |
| SEQ ID NO 25255 | TCCTGAAATGAGCATGTGTTTT | TTA | chr12 | 21603123 | 21603144 | 21603128 | 21603123 | - |
| SEQ ID NO 25256 | AAATGAGCATGTGTTTTTAATG | CTG | chr12 | 21603118 | 21603139 | 21603123 | 21603118 | - |
| SEQ ID NO 25257 | TTAATGTCCTTTTTCTAGTCAC | TTT | chr12 | 21603102 | 21603123 | 21603107 | 21603102 | - |
| SEQ ID NO 25258 | TAATGTCCTTTTTCTAGTCACA | TTT | chr12 | 21603101 | 21603122 | 21603106 | 21603101 | - |
| SEQ ID NO 25259 | AATGTCCTTTTTCTAGTCACAA | TTT | chr12 | 21603100 | 21603121 | 21603105 | 21603100 | - |
| SEQ ID NO 25260 | ATGTCCTTTTTCTAGTCACAAA | TTA | chr12 | 21603099 | 21603120 | 21603104 | 21603099 | - |
| SEQ ID NO 25261 | TTTCTAGTCACAAATTTTTCCA | CTT | chr12 | 21603091 | 21603112 | 21603096 | 21603091 | - |
| SEQ ID NO 25262 | TTCTAGTCACAAATTTTTCCAG | TTT | chr12 | 21603090 | 21603111 | 21603095 | 21603090 | - |
| SEQ ID NO 25263 | TCTAGTCACAAATTTTTCCAGT | TTT | chr12 | 21603089 | 21603110 | 21603094 | 21603089 | - |
| SEQ ID NO 25264 | CTAGTCACAAATTTTTCCAGTC | TTT | chr12 | 21603088 | 21603109 | 21603093 | 21603088 | - |
| SEQ ID NO 25265 | TAGTCACAAATTTTTCCAGTCC | TTC | chr12 | 21603087 | 21603108 | 21603092 | 21603087 | - |
| SEQ ID NO 25266 | GTCACAAATTTTTCCAGTCCAG | CTA | chr12 | 21603085 | 21603106 | 21603090 | 21603085 | - |
| SEQ ID NO 25267 | TTCCAGTCCAGTTTTTAAATAT | TTT | chr12 | 21603074 | 21603095 | 21603079 | 21603074 | - |
| SEQ ID NO 25268 | TCCAGTCCAGTTTTTAAATATG | TTT | chr12 | 21603073 | 21603094 | 21603078 | 21603073 | - |
| SEQ ID NO 25269 | CCAGTCCAGTTTTTAAATATGC | TTT | chr12 | 21603072 | 21603093 | 21603077 | 21603072 | - |
| SEQ ID NO 25270 | CAGTCCAGTTTTTAAATATGCC | TTC | chr12 | 21603071 | 21603092 | 21603076 | 21603071 | - |
| SEQ ID NO 25271 | TTAAATATGCCCAAAGTTCCTG | TTT | chr12 | 21603060 | 21603081 | 21603065 | 21603060 | - |
| SEQ ID NO 25272 | TAAATATGCCCAAAGTTCCTGG | TTT | chr12 | 21603059 | 21603080 | 21603064 | 21603059 | - |
| SEQ ID NO 25273 | AAATATGCCCAAAGTTCCTGGG | TTT | chr12 | 21603058 | 21603079 | 21603063 | 21603058 | - |
| SEQ ID NO 25274 | AATATGCCCAAAGTTCCTGGGA | TTA | chr12 | 21603057 | 21603078 | 21603062 | 21603057 | - |
| SEQ ID NO 25275 | CTGGGAACAGAACCATCTCTAT | TTC | chr12 | 21603041 | 21603062 | 21603046 | 21603041 | - |
| SEQ ID NO 25276 | GGAACAGAACCATCTCTATCAC | CTG | chr12 | 21603038 | 21603059 | 21603043 | 21603038 | - |
| SEQ ID NO 25277 | TATCACATGTGAATCCCGGAGT | CTC | chr12 | 21603022 | 21603043 | 21603027 | 21603022 | - |
| SEQ ID NO 25278 | TCACATGTGAATCCCGGAGTAT | CTA | chr12 | 21603020 | 21603041 | 21603025 | 21603020 | - |
| SEQ ID NO 25279 | GAAATAAAGTTTTCTCTAGAG | CTT | chr12 | 21602993 | 21603014 | 21602998 | 21602993 | - |
| SEQ ID NO 25280 | AAATAAAGTTTTCTCTAGAGA | TTG | chr12 | 21602992 | 21603013 | 21602997 | 21602992 | - |
| SEQ ID NO 25281 | TCTCTAGAGAGTGGGCAGGAGC | TTT | chr12 | 21602980 | 21603001 | 21602985 | 21602980 | - |
| SEQ ID NO 25282 | CTCTAGAGAGTGGGCAGGAGCT | TTT | chr12 | 21602979 | 21603000 | 21602984 | 21602979 | - |
| SEQ ID NO 25283 | TCTAGAGAGTGGGCAGGAGCTC | TTC | chr12 | 21602978 | 21602999 | 21602983 | 21602978 | - |
| SEQ ID NO 25284 | TAGAGAGTGGGCAGGAGCTCAA | CTC | chr12 | 21602976 | 21602997 | 21602981 | 21602976 | - |
| SEQ ID NO 25285 | GAGAGTGGGCAGGAGCTCAAGG | CTA | chr12 | 21602974 | 21602995 | 21602979 | 21602974 | - |
| SEQ ID NO 25286 | AAGGACATAGCTTATTGGTGGA | CTC | chr12 | 21602956 | 21602977 | 21602961 | 21602956 | - |
| SEQ ID NO 25287 | ATTGGTGGATAAAACTGGAAGG | CTT | chr12 | 21602943 | 21602964 | 21602948 | 21602943 | - |
| SEQ ID NO 25288 | TTGGTGGATAAAACTGGAAGGG | TTA | chr12 | 21602942 | 21602963 | 21602947 | 21602942 | - |
| SEQ ID NO 25289 | GTGGATAAAACTGGAAGGGACT | TTG | chr12 | 21602939 | 21602960 | 21602944 | 21602939 | - |
| SEQ ID NO 25290 | GAAGGGACTTGTTAGCACTGGG | CTG | chr12 | 21602926 | 21602947 | 21602931 | 21602926 | - |
| SEQ ID NO 25291 | GTTAGCACTGGGAATCAGTCCA | CTT | chr12 | 21602916 | 21602937 | 21602921 | 21602916 | - |
| SEQ ID NO 25292 | TTAGCACTGGGAATCAGTCCAG | TTG | chr12 | 21602915 | 21602936 | 21602920 | 21602915 | - |
| SEQ ID NO 25293 | GCACTGGGAATCAGTCCAGAAG | TTA | chr12 | 21602912 | 21602933 | 21602917 | 21602912 | - |
| SEQ ID NO 25294 | GGAATCAGTCCAGAAGATCTCT | CTG | chr12 | 21602906 | 21602927 | 21602911 | 21602906 | - |
| SEQ ID NO 25295 | TGCACAAGTTCCTGCACCTGAG | CTC | chr12 | 21602885 | 21602906 | 21602890 | 21602885 | - |
| SEQ ID NO 25296 | CACAAGTTCCTGCACCTGAGCA | CTG | chr12 | 21602883 | 21602904 | 21602888 | 21602883 | - |
| SEQ ID NO 25297 | CTGCACCTGAGCAGAGCCCCTT | TTC | chr12 | 21602874 | 21602895 | 21602879 | 21602874 | - |

Figure 48 (Cont'd)

| SEQ ID NO | Sequence | Codon | Chr | Pos1 | Pos2 | Pos3 | Pos4 | - |
|---|---|---|---|---|---|---|---|---|
| SEQ ID NO 25298 | CACCTGAGCAGAGCCCCTTCTG | CTG | chr12 | 21602871 | 21602892 | 21602876 | 21602871 | - |
| SEQ ID NO 25299 | AGCAGAGCCCCTTCTGCTTTCC | CTG | chr12 | 21602865 | 21602886 | 21602870 | 21602865 | - |
| SEQ ID NO 25300 | CTGCTTTCCTCTTTTCTCATCA | CTT | chr12 | 21602852 | 21602873 | 21602857 | 21602852 | - |
| SEQ ID NO 25301 | TGCTTTCCTCTTTTCTCATCAT | TTC | chr12 | 21602851 | 21602872 | 21602856 | 21602851 | - |
| SEQ ID NO 25302 | CTTTCCTCTTTTCTCATCATTT | CTG | chr12 | 21602849 | 21602870 | 21602854 | 21602849 | - |
| SEQ ID NO 25303 | TCCTCTTTTCTCATCATTTAAC | CTT | chr12 | 21602846 | 21602867 | 21602851 | 21602846 | - |
| SEQ ID NO 25304 | CCTCTTTTCTCATCATTTAACA | TTT | chr12 | 21602845 | 21602866 | 21602850 | 21602845 | - |
| SEQ ID NO 25305 | CTCTTTTCTCATCATTTAACAA | TTC | chr12 | 21602844 | 21602865 | 21602849 | 21602844 | - |
| SEQ ID NO 25306 | TTTTCTCATCATTTAACAAACA | CTC | chr12 | 21602841 | 21602862 | 21602846 | 21602841 | - |
| SEQ ID NO 25307 | TTCTCATCATTTAACAAACATT | CTT | chr12 | 21602839 | 21602860 | 21602844 | 21602839 | - |
| SEQ ID NO 25308 | TCTCATCATTTAACAAACATTA | TTT | chr12 | 21602838 | 21602859 | 21602843 | 21602838 | - |
| SEQ ID NO 25309 | CTCATCATTTAACAAACATTAA | TTT | chr12 | 21602837 | 21602858 | 21602842 | 21602837 | - |
| SEQ ID NO 25310 | TCATCATTTAACAAACATTAAT | TTC | chr12 | 21602836 | 21602857 | 21602841 | 21602836 | - |
| SEQ ID NO 25311 | ATCATTTAACAAACATTAATGG | CTC | chr12 | 21602834 | 21602855 | 21602839 | 21602834 | - |
| SEQ ID NO 25312 | AACAAACATTAATGGAGCACTG | TTT | chr12 | 21602827 | 21602848 | 21602832 | 21602827 | - |
| SEQ ID NO 25313 | ACAAACATTAATGGAGCACTGT | TTA | chr12 | 21602826 | 21602847 | 21602831 | 21602826 | - |
| SEQ ID NO 25314 | ATGGAGCACTGTTACCTGGGCA | TTA | chr12 | 21602816 | 21602837 | 21602821 | 21602816 | - |
| SEQ ID NO 25315 | TTACCTGGGCACTGGGAACACG | CTG | chr12 | 21602805 | 21602826 | 21602810 | 21602805 | - |
| SEQ ID NO 25316 | CCTGGGCACTGGGAACACGCCA | TTA | chr12 | 21602802 | 21602823 | 21602807 | 21602802 | - |
| SEQ ID NO 25317 | GGCACTGGGAACACGCCAGTGA | CTG | chr12 | 21602798 | 21602819 | 21602803 | 21602798 | - |
| SEQ ID NO 25318 | GGAACACGCCAGTGAAACTAAG | CTG | chr12 | 21602791 | 21602812 | 21602796 | 21602791 | - |
| SEQ ID NO 25319 | AGTTATTTTATGGATCTTATAA | CTA | chr12 | 21602771 | 21602792 | 21602776 | 21602771 | - |
| SEQ ID NO 25320 | TTTTATGGATCTTATAATCAGT | TTA | chr12 | 21602766 | 21602787 | 21602771 | 21602766 | - |
| SEQ ID NO 25321 | TATGGATCTTATAATCAGTAGC | TTT | chr12 | 21602763 | 21602784 | 21602768 | 21602763 | - |
| SEQ ID NO 25322 | ATGGATCTTATAATCAGTAGCA | TTT | chr12 | 21602762 | 21602783 | 21602767 | 21602762 | - |
| SEQ ID NO 25323 | TGGATCTTATAATCAGTAGCAT | TTA | chr12 | 21602761 | 21602782 | 21602766 | 21602761 | - |
| SEQ ID NO 25324 | ATAATCAGTAGCATGTGTGTTG | CTT | chr12 | 21602753 | 21602774 | 21602758 | 21602753 | - |
| SEQ ID NO 25325 | TAATCAGTAGCATGTGTGTTGA | TTA | chr12 | 21602752 | 21602773 | 21602757 | 21602752 | - |
| SEQ ID NO 25326 | ATCTCAGGGTCTAGAACAGTGC | TTG | chr12 | 21602731 | 21602752 | 21602736 | 21602731 | - |
| SEQ ID NO 25327 | AGGGTCTAGAACAGTGCCTGGT | CTC | chr12 | 21602726 | 21602747 | 21602731 | 21602726 | - |
| SEQ ID NO 25328 | GAACAGTGCCTGGTACATAGAA | CTA | chr12 | 21602718 | 21602739 | 21602723 | 21602718 | - |
| SEQ ID NO 25329 | GTACATAGAAAATGCTCAATGG | CTG | chr12 | 21602706 | 21602727 | 21602711 | 21602706 | - |
| SEQ ID NO 25330 | AATGGATTTTTTTTTGAAAAAA | CTC | chr12 | 21602689 | 21602710 | 21602694 | 21602689 | - |
| SEQ ID NO 25331 | TTTTTTGAAAAAATTTGTTTTT | TTT | chr12 | 21602680 | 21602701 | 21602685 | 21602680 | - |
| SEQ ID NO 25332 | TTTTTGAAAAAATTTGTTTTTC | TTT | chr12 | 21602679 | 21602700 | 21602684 | 21602679 | - |
| SEQ ID NO 25333 | TTTTGAAAAAATTTGTTTTTCA | TTT | chr12 | 21602678 | 21602699 | 21602683 | 21602678 | - |
| SEQ ID NO 25334 | TTTGAAAAAATTTGTTTTTCAA | TTT | chr12 | 21602677 | 21602698 | 21602682 | 21602677 | - |
| SEQ ID NO 25335 | TTGAAAAAATTTGTTTTTCAAC | TTT | chr12 | 21602676 | 21602697 | 21602681 | 21602676 | - |
| SEQ ID NO 25336 | TGAAAAAATTTGTTTTTCAACC | TTT | chr12 | 21602675 | 21602696 | 21602680 | 21602675 | - |
| SEQ ID NO 25337 | GAAAAAATTTGTTTTTCAACCC | TTT | chr12 | 21602674 | 21602695 | 21602679 | 21602674 | - |
| SEQ ID NO 25338 | AAAAAATTTGTTTTTCAACCCC | TTG | chr12 | 21602673 | 21602694 | 21602678 | 21602673 | - |
| SEQ ID NO 25339 | GTTTTTCAACCCCTAAGCTGCC | TTT | chr12 | 21602664 | 21602685 | 21602669 | 21602664 | - |
| SEQ ID NO 25340 | TTTTTCAACCCCTAAGCTGCCT | TTG | chr12 | 21602663 | 21602684 | 21602668 | 21602663 | - |
| SEQ ID NO 25341 | TTCAACCCCTAAGCTGCCTTTA | TTT | chr12 | 21602660 | 21602681 | 21602665 | 21602660 | - |
| SEQ ID NO 25342 | TCAACCCCTAAGCTGCCTTTAA | TTT | chr12 | 21602659 | 21602680 | 21602664 | 21602659 | - |
| SEQ ID NO 25343 | CAACCCCTAAGCTGCCTTTAAT | TTT | chr12 | 21602658 | 21602679 | 21602663 | 21602658 | - |
| SEQ ID NO 25344 | AACCCCTAAGCTGCCTTTAATA | TTC | chr12 | 21602657 | 21602678 | 21602662 | 21602657 | - |
| SEQ ID NO 25345 | AGCTGCCTTTAATACTTATTTT | CTA | chr12 | 21602649 | 21602670 | 21602654 | 21602649 | - |
| SEQ ID NO 25346 | CCTTTAATACTTATTTTCTATC | CTG | chr12 | 21602644 | 21602665 | 21602649 | 21602644 | - |
| SEQ ID NO 25347 | TAATACTTATTTTCTATCATTT | CTT | chr12 | 21602640 | 21602661 | 21602645 | 21602640 | - |
| SEQ ID NO 25348 | AATACTTATTTTCTATCATTTC | TTT | chr12 | 21602639 | 21602660 | 21602644 | 21602639 | - |
| SEQ ID NO 25349 | ATACTTATTTTCTATCATTTCC | TTA | chr12 | 21602638 | 21602659 | 21602643 | 21602638 | - |
| SEQ ID NO 25350 | ATTTTCTATCATTTCCCTTTCA | CTT | chr12 | 21602632 | 21602653 | 21602637 | 21602632 | - |
| SEQ ID NO 25351 | TTTTCTATCATTTCCCTTTCAA | TTA | chr12 | 21602631 | 21602652 | 21602636 | 21602631 | - |
| SEQ ID NO 25352 | TCTATCATTTCCCTTTCAAGGG | TTT | chr12 | 21602628 | 21602649 | 21602633 | 21602628 | - |
| SEQ ID NO 25353 | CTATCATTTCCCTTTCAAGGGG | TTT | chr12 | 21602627 | 21602648 | 21602632 | 21602627 | - |
| SEQ ID NO 25354 | TATCATTTCCCTTTCAAGGGGA | TTC | chr12 | 21602626 | 21602647 | 21602631 | 21602626 | - |
| SEQ ID NO 25355 | TCATTTCCCTTTCAAGGGGAAG | CTA | chr12 | 21602624 | 21602645 | 21602629 | 21602624 | - |

Figure 48 (Cont'd)

| SEQ ID NO 25356 | CCCTTTCAAGGGGAAGGGAAGT | TTT | chr12 | 21602618 | 21602639 | 21602623 | 21602618 | - |
|---|---|---|---|---|---|---|---|---|
| SEQ ID NO 25357 | CCTTTCAAGGGGAAGGGAAGTG | TTC | chr12 | 21602617 | 21602638 | 21602622 | 21602617 | - |
| SEQ ID NO 25358 | TCAAGGGGAAGGGAAGTGTTTT | CTT | chr12 | 21602613 | 21602634 | 21602618 | 21602613 | - |
| SEQ ID NO 25359 | CAAGGGGAAGGGAAGTGTTTTT | TTT | chr12 | 21602612 | 21602633 | 21602617 | 21602612 | - |
| SEQ ID NO 25360 | AAGGGGAAGGGAAGTGTTTTTG | TTC | chr12 | 21602611 | 21602632 | 21602616 | 21602611 | - |
| SEQ ID NO 25361 | TTGTGGAGAGGTCCCCACAATG | TTT | chr12 | 21602592 | 21602613 | 21602597 | 21602592 | - |
| SEQ ID NO 25362 | TGTGGAGAGGTCCCCACAATGT | TTT | chr12 | 21602591 | 21602612 | 21602596 | 21602591 | - |
| SEQ ID NO 25363 | GTGGAGAGGTCCCCACAATGTG | TTT | chr12 | 21602590 | 21602611 | 21602595 | 21602590 | - |
| SEQ ID NO 25364 | TGGAGAGGTCCCCACAATGTGA | TTG | chr12 | 21602589 | 21602610 | 21602594 | 21602589 | - |
| SEQ ID NO 25365 | ACACAAGTTGATATCATCTTCA | TTT | chr12 | 21602564 | 21602585 | 21602569 | 21602564 | - |
| SEQ ID NO 25366 | CACAAGTTGATATCATCTTCAA | TTA | chr12 | 21602563 | 21602584 | 21602568 | 21602563 | - |
| SEQ ID NO 25367 | ATATCATCTTCAATGTATCTTT | TTG | chr12 | 21602554 | 21602575 | 21602559 | 21602554 | - |
| SEQ ID NO 25368 | CAATGTATCTTTATTTTAATAT | CTT | chr12 | 21602544 | 21602565 | 21602549 | 21602544 | - |
| SEQ ID NO 25369 | AATGTATCTTTATTTTAATATT | TTC | chr12 | 21602543 | 21602564 | 21602548 | 21602543 | - |
| SEQ ID NO 25370 | TATTTTAATATTATCATAGCCT | CTT | chr12 | 21602533 | 21602554 | 21602538 | 21602533 | - |
| SEQ ID NO 25371 | ATTTTAATATTATCATAGCCTG | TTT | chr12 | 21602532 | 21602553 | 21602537 | 21602532 | - |
| SEQ ID NO 25372 | TTTTAATATTATCATAGCCTGG | TTA | chr12 | 21602531 | 21602552 | 21602536 | 21602531 | - |
| SEQ ID NO 25373 | TAATATTATCATAGCCTGGTAT | TTT | chr12 | 21602528 | 21602549 | 21602533 | 21602528 | - |
| SEQ ID NO 25374 | AATATTATCATAGCCTGGTATG | TTT | chr12 | 21602527 | 21602548 | 21602532 | 21602527 | - |
| SEQ ID NO 25375 | ATATTATCATAGCCTGGTATGG | TTA | chr12 | 21602526 | 21602547 | 21602531 | 21602526 | - |
| SEQ ID NO 25376 | TCATAGCCTGGTATGGTTTGAG | TTA | chr12 | 21602520 | 21602541 | 21602525 | 21602520 | - |
| SEQ ID NO 25377 | GTATGGTTTGAGATTTTCATAT | CTG | chr12 | 21602510 | 21602531 | 21602515 | 21602510 | - |
| SEQ ID NO 25378 | GAGATTTTCATATAGATGGATA | TTT | chr12 | 21602501 | 21602522 | 21602506 | 21602501 | - |
| SEQ ID NO 25379 | AGATTTTCATATAGATGGATAA | TTG | chr12 | 21602500 | 21602521 | 21602505 | 21602500 | - |
| SEQ ID NO 25380 | TCATATAGATGGATAATTATTG | TTT | chr12 | 21602494 | 21602515 | 21602499 | 21602494 | - |
| SEQ ID NO 25381 | CATATAGATGGATAATTATTGT | TTT | chr12 | 21602493 | 21602514 | 21602498 | 21602493 | - |
| SEQ ID NO 25382 | ATATAGATGGATAATTATTGTG | TTC | chr12 | 21602492 | 21602513 | 21602497 | 21602492 | - |
| SEQ ID NO 25383 | TTGTGTTATTCCTAATAATAC | TTA | chr12 | 21602475 | 21602496 | 21602480 | 21602475 | - |
| SEQ ID NO 25384 | TGTTTATTCCTAATAATACATT | TTG | chr12 | 21602472 | 21602493 | 21602477 | 21602472 | - |
| SEQ ID NO 25385 | ATTCCTAATAATACATTGCCAC | TTT | chr12 | 21602467 | 21602488 | 21602472 | 21602467 | - |
| SEQ ID NO 25386 | TTCCTAATAATACATTGCCACT | TTA | chr12 | 21602466 | 21602487 | 21602471 | 21602466 | - |
| SEQ ID NO 25387 | CTAATAATACATTGCCACTATA | TTC | chr12 | 21602463 | 21602484 | 21602468 | 21602463 | - |
| SEQ ID NO 25388 | ATAATACATTGCCACTATAGTT | CTA | chr12 | 21602460 | 21602481 | 21602465 | 21602460 | - |
| SEQ ID NO 25389 | CCACTATAGTTTCTTTAAATTT | TTG | chr12 | 21602449 | 21602470 | 21602454 | 21602449 | - |
| SEQ ID NO 25390 | TAGTTTCTTTAAATTTAATGAT | CTA | chr12 | 21602443 | 21602464 | 21602448 | 21602443 | - |
| SEQ ID NO 25391 | CTTTAAATTTAATGATTTGAAT | TTT | chr12 | 21602437 | 21602458 | 21602442 | 21602437 | - |
| SEQ ID NO 25392 | TTTAAATTTAATGATTTGAATT | TTC | chr12 | 21602436 | 21602457 | 21602441 | 21602436 | - |
| SEQ ID NO 25393 | TAAATTTAATGATTTGAATTTT | CTT | chr12 | 21602434 | 21602455 | 21602439 | 21602434 | - |
| SEQ ID NO 25394 | AAATTTAATGATTTGAATTTTT | TTT | chr12 | 21602433 | 21602454 | 21602438 | 21602433 | - |
| SEQ ID NO 25395 | AATTTAATGATTTGAATTTTTA | TTA | chr12 | 21602432 | 21602453 | 21602437 | 21602432 | - |
| SEQ ID NO 25396 | AATGATTTGAATTTTTACTTCC | TTT | chr12 | 21602427 | 21602448 | 21602432 | 21602427 | - |
| SEQ ID NO 25397 | ATGATTTGAATTTTTACTTCCC | TTA | chr12 | 21602426 | 21602447 | 21602431 | 21602426 | - |
| SEQ ID NO 25398 | GAATTTTTACTTCCCTGCATTT | TTT | chr12 | 21602419 | 21602440 | 21602424 | 21602419 | - |
| SEQ ID NO 25399 | AATTTTTACTTCCCTGCATTTC | TTG | chr12 | 21602418 | 21602439 | 21602423 | 21602418 | - |
| SEQ ID NO 25400 | TTACTTCCCTGCATTTCATAGT | TTT | chr12 | 21602413 | 21602434 | 21602418 | 21602413 | - |
| SEQ ID NO 25401 | TACTTCCCTGCATTTCATAGTA | TTT | chr12 | 21602412 | 21602433 | 21602417 | 21602412 | - |
| SEQ ID NO 25402 | ACTTCCCTGCATTTCATAGTAG | TTT | chr12 | 21602411 | 21602432 | 21602416 | 21602411 | - |
| SEQ ID NO 25403 | CTTCCCTGCATTTCATAGTAGT | TTA | chr12 | 21602410 | 21602431 | 21602415 | 21602410 | - |
| SEQ ID NO 25404 | CCCTGCATTTCATAGTAGTGAT | CTT | chr12 | 21602407 | 21602428 | 21602412 | 21602407 | - |
| SEQ ID NO 25405 | CCTGCATTTCATAGTAGTGATA | TTC | chr12 | 21602406 | 21602427 | 21602411 | 21602406 | - |
| SEQ ID NO 25406 | CATTTCATAGTAGTGATATGAG | CTG | chr12 | 21602402 | 21602423 | 21602407 | 21602402 | - |
| SEQ ID NO 25407 | CATAGTAGTGATATGAGGTATC | TTT | chr12 | 21602397 | 21602418 | 21602402 | 21602397 | - |
| SEQ ID NO 25408 | ATAGTAGTGATATGAGGTATCT | TTC | chr12 | 21602396 | 21602417 | 21602401 | 21602396 | - |
| SEQ ID NO 25409 | AGAGATCATGAATCCCACTCCT | CTT | chr12 | 21602373 | 21602394 | 21602378 | 21602373 | - |
| SEQ ID NO 25410 | GAGATCATGAATCCCACTCCTC | TTA | chr12 | 21602372 | 21602393 | 21602377 | 21602372 | - |
| SEQ ID NO 25411 | CTCCAGTTCATAGAGCAAATTG | CTC | chr12 | 21602353 | 21602374 | 21602358 | 21602353 | - |
| SEQ ID NO 25412 | CAGTTCATAGAGCAAATTGATT | CTC | chr12 | 21602350 | 21602371 | 21602355 | 21602350 | - |
| SEQ ID NO 25413 | ATAGAGCAAATTGATTCGTAGA | TTC | chr12 | 21602344 | 21602365 | 21602349 | 21602344 | - |

Figure 48 (Cont'd)

| SEQ ID NO 25414 | ATTCGTAGAGGTATTTAATGAT | TTG | chr12 | 21602331 | 21602352 | 21602336 | 21602331 | - |
|---|---|---|---|---|---|---|---|---|
| SEQ ID NO 25415 | GTAGAGGTATTTAATGATCAAG | TTC | chr12 | 21602327 | 21602348 | 21602332 | 21602327 | - |
| SEQ ID NO 25416 | AATGATCAAGCAAATGGCAGAG | TTT | chr12 | 21602315 | 21602336 | 21602320 | 21602315 | - |
| SEQ ID NO 25417 | ATGATCAAGCAAATGGCAGAGT | TTA | chr12 | 21602314 | 21602335 | 21602319 | 21602314 | - |
| SEQ ID NO 25418 | GGACCAGGATTTAGGTCTTTTC | TTA | chr12 | 21602290 | 21602311 | 21602295 | 21602290 | - |
| SEQ ID NO 25419 | AGGTCTTTTCCAAGGCCAATTC | TTT | chr12 | 21602278 | 21602299 | 21602283 | 21602278 | - |
| SEQ ID NO 25420 | GGTCTTTTCCAAGGCCAATTCA | TTA | chr12 | 21602277 | 21602298 | 21602282 | 21602277 | - |
| SEQ ID NO 25421 | TTCCAAGGCCAATTCACTTTTT | CTT | chr12 | 21602271 | 21602292 | 21602276 | 21602271 | - |
| SEQ ID NO 25422 | TCCAAGGCCAATTCACTTTTTT | TTT | chr12 | 21602270 | 21602291 | 21602275 | 21602270 | - |
| SEQ ID NO 25423 | CCAAGGCCAATTCACTTTTTTA | TTT | chr12 | 21602269 | 21602290 | 21602274 | 21602269 | - |
| SEQ ID NO 25424 | CAAGGCCAATTCACTTTTTTAC | TTC | chr12 | 21602268 | 21602289 | 21602273 | 21602268 | - |
| SEQ ID NO 25425 | ACTTTTTTACTATTATGTAAGA | TTC | chr12 | 21602256 | 21602277 | 21602261 | 21602256 | - |
| SEQ ID NO 25426 | TTTTACTATTATGTAAGAATTA | CTT | chr12 | 21602252 | 21602273 | 21602257 | 21602252 | - |
| SEQ ID NO 25427 | TTTACTATTATGTAAGAATTAA | TTT | chr12 | 21602251 | 21602272 | 21602256 | 21602251 | - |
| SEQ ID NO 25428 | TTACTATTATGTAAGAATTAAA | TTT | chr12 | 21602250 | 21602271 | 21602255 | 21602250 | - |
| SEQ ID NO 25429 | TACTATTATGTAAGAATTAAAT | TTT | chr12 | 21602249 | 21602270 | 21602254 | 21602249 | - |
| SEQ ID NO 25430 | ACTATTATGTAAGAATTAAATA | TTT | chr12 | 21602248 | 21602269 | 21602253 | 21602248 | - |
| SEQ ID NO 25431 | CTATTATGTAAGAATTAAATAT | TTA | chr12 | 21602247 | 21602268 | 21602252 | 21602247 | - |
| SEQ ID NO 25432 | TTATGTAAGAATTAAATATTAA | CTA | chr12 | 21602244 | 21602265 | 21602249 | 21602244 | - |
| SEQ ID NO 25433 | TGTAAGAATTAAATATTAAAAC | TTA | chr12 | 21602241 | 21602262 | 21602246 | 21602241 | - |
| SEQ ID NO 25434 | AATATTAAAACCTCAGTTTTCA | TTA | chr12 | 21602230 | 21602251 | 21602235 | 21602230 | - |
| SEQ ID NO 25435 | AAACCTCAGTTTTCAAAGGAAA | TTA | chr12 | 21602223 | 21602244 | 21602228 | 21602223 | - |
| SEQ ID NO 25436 | AGTTTTCAAAGGAAATGTCCTA | CTC | chr12 | 21602216 | 21602237 | 21602221 | 21602216 | - |
| SEQ ID NO 25437 | TCAAAGGAAATGTCCTATAGAT | TTT | chr12 | 21602211 | 21602232 | 21602216 | 21602211 | - |
| SEQ ID NO 25438 | CAAAGGAAATGTCCTATAGATG | TTT | chr12 | 21602210 | 21602231 | 21602215 | 21602210 | - |
| SEQ ID NO 25439 | AAAGGAAATGTCCTATAGATGA | TTC | chr12 | 21602209 | 21602230 | 21602214 | 21602209 | - |
| SEQ ID NO 25440 | TAGATGAAGAACACAGTACTT | CTA | chr12 | 21602194 | 21602215 | 21602199 | 21602194 | - |
| SEQ ID NO 25441 | GCAGTCAAAGGTCTTGGATTTC | CTT | chr12 | 21602172 | 21602193 | 21602177 | 21602172 | - |
| SEQ ID NO 25442 | CAGTCAAAGGTCTTGGATTTCT | TTG | chr12 | 21602171 | 21602192 | 21602176 | 21602171 | - |
| SEQ ID NO 25443 | GGATTTCTGAAACTTTCTGAAA | CTT | chr12 | 21602157 | 21602178 | 21602162 | 21602157 | - |
| SEQ ID NO 25444 | GATTTCTGAAACTTTCTGAAAA | TTG | chr12 | 21602156 | 21602177 | 21602161 | 21602156 | - |
| SEQ ID NO 25445 | CTGAAACTTTCTGAAAAGAAC | TTT | chr12 | 21602151 | 21602172 | 21602156 | 21602151 | - |
| SEQ ID NO 25446 | TGAAACTTTCTGAAAAGAACC | TTC | chr12 | 21602150 | 21602171 | 21602155 | 21602150 | - |
| SEQ ID NO 25447 | AAACTTTCTGAAAAGAACCCC | CTG | chr12 | 21602148 | 21602169 | 21602153 | 21602148 | - |
| SEQ ID NO 25448 | TCTGAAAAGAACCCCTTAAAC | CTT | chr12 | 21602142 | 21602163 | 21602147 | 21602142 | - |
| SEQ ID NO 25449 | CTGAAAAGAACCCCTTAAACT | TTT | chr12 | 21602141 | 21602162 | 21602146 | 21602141 | - |
| SEQ ID NO 25450 | TGAAAAGAACCCCTTAAACTG | TTC | chr12 | 21602140 | 21602161 | 21602145 | 21602140 | - |
| SEQ ID NO 25451 | AAAAGAACCCCTTAAACTGAA | CTG | chr12 | 21602138 | 21602159 | 21602143 | 21602138 | - |
| SEQ ID NO 25452 | AAACTGAATAACAGTTTCTTCA | CTT | chr12 | 21602124 | 21602145 | 21602129 | 21602124 | - |
| SEQ ID NO 25453 | AACTGAATAACAGTTTCTTCAT | TTA | chr12 | 21602123 | 21602144 | 21602128 | 21602123 | - |
| SEQ ID NO 25454 | AATAACAGTTTCTTCATGAATA | CTG | chr12 | 21602118 | 21602139 | 21602123 | 21602118 | - |
| SEQ ID NO 25455 | CTTCATGAATAAAATGAATGTT | TTT | chr12 | 21602107 | 21602128 | 21602112 | 21602107 | - |
| SEQ ID NO 25456 | TTCATGAATAAAATGAATGTTA | TTC | chr12 | 21602106 | 21602127 | 21602111 | 21602106 | - |
| SEQ ID NO 25457 | CATGAATAAAATGAATGTTATA | CTT | chr12 | 21602104 | 21602125 | 21602109 | 21602104 | - |
| SEQ ID NO 25458 | ATGAATAAAATGAATGTTATAC | TTC | chr12 | 21602103 | 21602124 | 21602108 | 21602103 | - |
| SEQ ID NO 25459 | TACTCCAGTTATCTTACCAT | TTA | chr12 | 21602084 | 21602105 | 21602089 | 21602084 | - |
| SEQ ID NO 25460 | TCCAGTTATCTTACCATGTTTT | CTC | chr12 | 21602079 | 21602100 | 21602084 | 21602079 | - |
| SEQ ID NO 25461 | CAGTTATCTTACCATGTTTTCT | CTC | chr12 | 21602077 | 21602098 | 21602082 | 21602077 | - |
| SEQ ID NO 25462 | TCTTACCATGTTTTCTGGCAAA | TTA | chr12 | 21602071 | 21602092 | 21602076 | 21602071 | - |
| SEQ ID NO 25463 | ACCATGTTTTCTGGCAAACAAG | CTT | chr12 | 21602067 | 21602088 | 21602072 | 21602067 | - |
| SEQ ID NO 25464 | CCATGTTTTCTGGCAAACAAGG | TTA | chr12 | 21602066 | 21602087 | 21602071 | 21602066 | - |
| SEQ ID NO 25465 | TCTGGCAAACAAGGAAATGTAT | TTT | chr12 | 21602058 | 21602079 | 21602063 | 21602058 | - |
| SEQ ID NO 25466 | CTGGCAAACAAGGAAATGTATT | TTT | chr12 | 21602057 | 21602078 | 21602062 | 21602057 | - |
| SEQ ID NO 25467 | TGGCAAACAAGGAAATGTATTC | TTC | chr12 | 21602056 | 21602077 | 21602061 | 21602056 | - |
| SEQ ID NO 25468 | GCAAACAAGGAAATGTATTCAC | CTG | chr12 | 21602054 | 21602075 | 21602059 | 21602054 | - |
| SEQ ID NO 25469 | ACATCCAAGAAAACAAAGGTT | TTC | chr12 | 21602034 | 21602055 | 21602039 | 21602034 | - |
| SEQ ID NO 25470 | CTTAGGAGAAGAATCCCTTGCT | TTT | chr12 | 21602011 | 21602032 | 21602016 | 21602011 | - |
| SEQ ID NO 25471 | TTAGGAGAAGAATCCCTTGCTG | TTC | chr12 | 21602010 | 21602031 | 21602015 | 21602010 | - |

Figure 48 (Cont'd)

| | | | | | | | | |
|---|---|---|---|---|---|---|---|---|
| SEQ ID NO 25472 | AGGAGAAGAATCCCTTGCTGCC | CTT | chr12 | 21602008 | 21602029 | 21602013 | 21602008 | - |
| SEQ ID NO 25473 | GGAGAAGAATCCCTTGCTGCCA | TTA | chr12 | 21602007 | 21602028 | 21602012 | 21602007 | - |
| SEQ ID NO 25474 | GCTGCCAGAATTTTGCCCATGA | CTT | chr12 | 21601992 | 21602013 | 21601997 | 21601992 | - |
| SEQ ID NO 25475 | CTGCCAGAATTTTGCCCATGAA | TTG | chr12 | 21601991 | 21602012 | 21601996 | 21601991 | - |
| SEQ ID NO 25476 | CCAGAATTTTGCCCATGAACAA | CTG | chr12 | 21601988 | 21602009 | 21601993 | 21601988 | - |
| SEQ ID NO 25477 | TGCCCATGAACAATGGAAACGT | TTT | chr12 | 21601979 | 21602000 | 21601984 | 21601979 | - |
| SEQ ID NO 25478 | GCCCATGAACAATGGAAACGTG | TTT | chr12 | 21601978 | 21601999 | 21601983 | 21601978 | - |
| SEQ ID NO 25479 | CCCATGAACAATGGAAACGTGA | TTG | chr12 | 21601977 | 21601998 | 21601982 | 21601977 | - |
| SEQ ID NO 25480 | GTTTTGGGTACTAATTCTCAGA | TTA | chr12 | 21601925 | 21601946 | 21601930 | 21601925 | - |
| SEQ ID NO 25481 | TGGGTACTAATTCTCAGACTTC | TTT | chr12 | 21601921 | 21601942 | 21601926 | 21601921 | - |
| SEQ ID NO 25482 | GGGTACTAATTCTCAGACTTCA | TTT | chr12 | 21601920 | 21601941 | 21601925 | 21601920 | - |
| SEQ ID NO 25483 | GGTACTAATTCTCAGACTTCAA | TTG | chr12 | 21601919 | 21601940 | 21601924 | 21601919 | - |
| SEQ ID NO 25484 | ATTCTCAGACTTCAAAATAACC | CTA | chr12 | 21601912 | 21601933 | 21601917 | 21601912 | - |
| SEQ ID NO 25485 | TCAGACTTCAAAATAACCTTTT | TTC | chr12 | 21601908 | 21601929 | 21601913 | 21601908 | - |
| SEQ ID NO 25486 | AGACTTCAAAATAACCTTTTTA | CTC | chr12 | 21601906 | 21601927 | 21601911 | 21601906 | - |
| SEQ ID NO 25487 | CAAAATAACCTTTTTAATTTAT | CTT | chr12 | 21601900 | 21601921 | 21601905 | 21601900 | - |
| SEQ ID NO 25488 | AAAATAACCTTTTTAATTTATT | TTC | chr12 | 21601899 | 21601920 | 21601904 | 21601899 | - |
| SEQ ID NO 25489 | TTTAATTTATTAATATTAACCT | CTT | chr12 | 21601888 | 21601909 | 21601893 | 21601888 | - |
| SEQ ID NO 25490 | TTAATTTATTAATATTAACCTT | TTT | chr12 | 21601887 | 21601908 | 21601892 | 21601887 | - |
| SEQ ID NO 25491 | TAATTTATTAATATTAACCTTG | TTT | chr12 | 21601886 | 21601907 | 21601891 | 21601886 | - |
| SEQ ID NO 25492 | AATTTATTAATATTAACCTTGA | TTT | chr12 | 21601885 | 21601906 | 21601890 | 21601885 | - |
| SEQ ID NO 25493 | ATTTATTAATATTAACCTTGAA | TTA | chr12 | 21601884 | 21601905 | 21601889 | 21601884 | - |
| SEQ ID NO 25494 | ATTAATATTAACCTTGAAATTT | TTT | chr12 | 21601880 | 21601901 | 21601885 | 21601880 | - |
| SEQ ID NO 25495 | TTAATATTAACCTTGAAATTTA | TTA | chr12 | 21601879 | 21601900 | 21601884 | 21601879 | - |
| SEQ ID NO 25496 | ATATTAACCTTGAAATTTATTG | TTA | chr12 | 21601876 | 21601897 | 21601881 | 21601876 | - |
| SEQ ID NO 25497 | ACCTTGAAATTTATTGCTTTTA | TTA | chr12 | 21601870 | 21601891 | 21601875 | 21601870 | - |
| SEQ ID NO 25498 | GAAATTTATTGCTTTTATTCAT | CTT | chr12 | 21601865 | 21601886 | 21601870 | 21601865 | - |
| SEQ ID NO 25499 | AAATTTATTGCTTTTATTCATT | TTG | chr12 | 21601864 | 21601885 | 21601869 | 21601864 | - |
| SEQ ID NO 25500 | ATTGCTTTTATTCATTAATCCA | TTT | chr12 | 21601858 | 21601879 | 21601863 | 21601858 | - |
| SEQ ID NO 25501 | TTGCTTTTATTCATTAATCCAT | TTA | chr12 | 21601857 | 21601878 | 21601862 | 21601857 | - |
| SEQ ID NO 25502 | CTTTTATTCATTAATCCATTTT | TTG | chr12 | 21601854 | 21601875 | 21601859 | 21601854 | - |
| SEQ ID NO 25503 | TTATTCATTAATCCATTTTATT | CTT | chr12 | 21601851 | 21601872 | 21601856 | 21601851 | - |
| SEQ ID NO 25504 | TATTCATTAATCCATTTTATTA | TTT | chr12 | 21601850 | 21601871 | 21601855 | 21601850 | - |
| SEQ ID NO 25505 | ATTCATTAATCCATTTTATTAT | TTT | chr12 | 21601849 | 21601870 | 21601854 | 21601849 | - |
| SEQ ID NO 25506 | TTCATTAATCCATTTTATTATT | TTA | chr12 | 21601848 | 21601869 | 21601853 | 21601848 | - |
| SEQ ID NO 25507 | ATTAATCCATTTTATTATTCAG | TTC | chr12 | 21601845 | 21601866 | 21601850 | 21601845 | - |
| SEQ ID NO 25508 | ATCCATTTTATTATTCAGTAAG | TTA | chr12 | 21601841 | 21601862 | 21601846 | 21601841 | - |
| SEQ ID NO 25509 | TATTATTCAGTAAGGATTCATC | TTT | chr12 | 21601833 | 21601854 | 21601838 | 21601833 | - |
| SEQ ID NO 25510 | ATTATTCAGTAAGGATTCATCA | TTT | chr12 | 21601832 | 21601853 | 21601837 | 21601832 | - |
| SEQ ID NO 25511 | TTATTCAGTAAGGATTCATCAA | TTA | chr12 | 21601831 | 21601852 | 21601836 | 21601831 | - |
| SEQ ID NO 25512 | TTCAGTAAGGATTCATCAAGTG | TTA | chr12 | 21601828 | 21601849 | 21601833 | 21601828 | - |
| SEQ ID NO 25513 | AGTAAGGATTCATCAAGTGTCT | TTC | chr12 | 21601825 | 21601846 | 21601830 | 21601825 | - |
| SEQ ID NO 25514 | ATCAAGTGTCTATTAGGTATCA | TTC | chr12 | 21601814 | 21601835 | 21601819 | 21601814 | - |
| SEQ ID NO 25515 | TTAGGTATCAGGCACTGAGAGG | CTA | chr12 | 21601802 | 21601823 | 21601807 | 21601802 | - |
| SEQ ID NO 25516 | GGTATCAGGCACTGAGAGGCGA | TTA | chr12 | 21601799 | 21601820 | 21601804 | 21601799 | - |
| SEQ ID NO 25517 | AGAGGCGAGGGAGATAGAGTTA | CTG | chr12 | 21601785 | 21601806 | 21601790 | 21601785 | - |
| SEQ ID NO 25518 | AGAATACAGAACTGATTCTTAA | TTA | chr12 | 21601763 | 21601784 | 21601768 | 21601763 | - |
| SEQ ID NO 25519 | ATTCTTAATCTTCAAGAATTGA | CTG | chr12 | 21601749 | 21601770 | 21601754 | 21601749 | - |
| SEQ ID NO 25520 | TTAATCTTCAAGAATTGACAAA | TTC | chr12 | 21601745 | 21601766 | 21601750 | 21601745 | - |
| SEQ ID NO 25521 | AATCTTCAAGAATTGACAAATT | CTT | chr12 | 21601743 | 21601764 | 21601748 | 21601743 | - |
| SEQ ID NO 25522 | ATCTTCAAGAATTGACAAATTT | TTA | chr12 | 21601742 | 21601763 | 21601747 | 21601742 | - |
| SEQ ID NO 25523 | CAAGAATTGACAAATTTGTAGA | CTT | chr12 | 21601737 | 21601758 | 21601742 | 21601737 | - |
| SEQ ID NO 25524 | AAGAATTGACAAATTTGTAGAA | TTC | chr12 | 21601736 | 21601757 | 21601741 | 21601736 | - |
| SEQ ID NO 25525 | ACAAATTTGTAGAAGGTAGACA | TTG | chr12 | 21601728 | 21601749 | 21601733 | 21601728 | - |
| SEQ ID NO 25526 | GTAGAAGGTAGACATTGAACAT | TTT | chr12 | 21601720 | 21601741 | 21601725 | 21601720 | - |
| SEQ ID NO 25527 | TAGAAGGTAGACATTGAACATA | TTG | chr12 | 21601719 | 21601740 | 21601724 | 21601719 | - |
| SEQ ID NO 25528 | AACATACAATACAGTCAAATGT | TTG | chr12 | 21601703 | 21601724 | 21601708 | 21601703 | - |
| SEQ ID NO 25529 | AGGGAACCAGGTGTCCTAAGAC | CTA | chr12 | 21601665 | 21601686 | 21601670 | 21601665 | - |

Figure 48 (Cont'd)

| SEQ ID NO 25530 | AGACTATACAGTGTACCGTGGA | CTA | chr12 | 21601647 | 21601668 | 21601652 | 21601647 | - |
|---|---|---|---|---|---|---|---|---|
| SEQ ID NO 25531 | TACAGTGTACCGTGGAATGGGG | CTA | chr12 | 21601641 | 21601662 | 21601646 | 21601641 | - |
| SEQ ID NO 25532 | CTAACCTAGTTACCTAGAGGTT | TTT | chr12 | 21601611 | 21601632 | 21601616 | 21601611 | - |
| SEQ ID NO 25533 | TAACCTAGTTACCTAGAGGTTT | TTC | chr12 | 21601610 | 21601631 | 21601615 | 21601610 | - |
| SEQ ID NO 25534 | ACCTAGTTACCTAGAGGTTTGG | CTA | chr12 | 21601608 | 21601629 | 21601613 | 21601608 | - |
| SEQ ID NO 25535 | GTTACCTAGAGGTTTGGGAAAA | CTA | chr12 | 21601603 | 21601624 | 21601608 | 21601603 | - |
| SEQ ID NO 25536 | CCTAGAGGTTTGGGAAAAACCT | TTA | chr12 | 21601599 | 21601620 | 21601604 | 21601599 | - |
| SEQ ID NO 25537 | GAGGTTTGGGAAAAACCTCTCT | CTA | chr12 | 21601595 | 21601616 | 21601600 | 21601595 | - |
| SEQ ID NO 25538 | GGGAAAAACCTCTCTAATGATG | TTT | chr12 | 21601588 | 21601609 | 21601593 | 21601588 | - |
| SEQ ID NO 25539 | GGAAAAACCTCTCTAATGATGA | TTG | chr12 | 21601587 | 21601608 | 21601592 | 21601587 | - |
| SEQ ID NO 25540 | TCTAATGATGAGATGTTTGAGC | CTC | chr12 | 21601576 | 21601597 | 21601581 | 21601576 | - |
| SEQ ID NO 25541 | TAATGATGAGATGTTTGAGCTG | CTC | chr12 | 21601574 | 21601595 | 21601579 | 21601574 | - |
| SEQ ID NO 25542 | ATGATGAGATGTTTGAGCTGAC | CTA | chr12 | 21601572 | 21601593 | 21601577 | 21601572 | - |
| SEQ ID NO 25543 | GAGCTGACACTTGAAGGATAAA | TTT | chr12 | 21601558 | 21601579 | 21601563 | 21601558 | - |
| SEQ ID NO 25544 | AGCTGACACTTGAAGGATAAAT | TTG | chr12 | 21601557 | 21601578 | 21601562 | 21601557 | - |
| SEQ ID NO 25545 | ACACTTGAAGGATAAATAGCTA | CTG | chr12 | 21601552 | 21601573 | 21601557 | 21601552 | - |
| SEQ ID NO 25546 | GAAGGATAAATAGCTAAAGGGG | CTT | chr12 | 21601546 | 21601567 | 21601551 | 21601546 | - |
| SEQ ID NO 25547 | AAGGATAAATAGCTAAAGGGGA | TTG | chr12 | 21601545 | 21601566 | 21601550 | 21601545 | - |
| SEQ ID NO 25548 | AAGGGGAGAAAGCGTTCTATGT | CTA | chr12 | 21601530 | 21601551 | 21601535 | 21601530 | - |
| SEQ ID NO 25549 | TATGTGAGAGAACTATATATGC | TTC | chr12 | 21601513 | 21601534 | 21601518 | 21601513 | - |
| SEQ ID NO 25550 | TGTGAGAGAACTATATATGCCA | CTA | chr12 | 21601511 | 21601532 | 21601516 | 21601511 | - |
| SEQ ID NO 25551 | TATATGCCAAGATGCAGAAGTG | CTA | chr12 | 21601498 | 21601519 | 21601503 | 21601498 | - |
| SEQ ID NO 25552 | TCTGTTCGAAGATCTGAGCGGG | TTC | chr12 | 21601473 | 21601494 | 21601478 | 21601473 | - |
| SEQ ID NO 25553 | TGTTCGAAGATCTGAGCGGGGC | CTC | chr12 | 21601471 | 21601492 | 21601476 | 21601471 | - |
| SEQ ID NO 25554 | TTCGAAGATCTGAGCGGGGCTC | CTG | chr12 | 21601469 | 21601490 | 21601474 | 21601469 | - |
| SEQ ID NO 25555 | GAAGATCTGAGCGGGGCTCAGA | TTC | chr12 | 21601466 | 21601487 | 21601471 | 21601466 | - |
| SEQ ID NO 25556 | AGCGGGGCTCAGAGAGGGAAAA | CTG | chr12 | 21601457 | 21601478 | 21601462 | 21601457 | - |
| SEQ ID NO 25557 | AGAGAGGGAAAAGGAGAGGAGT | CTC | chr12 | 21601447 | 21601468 | 21601452 | 21601447 | - |
| SEQ ID NO 25558 | CAGGGACTAGATTGTGAAGCTC | CTG | chr12 | 21601401 | 21601422 | 21601406 | 21601401 | - |
| SEQ ID NO 25559 | GATTGTGAAGCTCAGGGGGAGT | CTA | chr12 | 21601392 | 21601413 | 21601397 | 21601392 | - |
| SEQ ID NO 25560 | TGAAGCTCAGGGGGAGTTAATA | TTG | chr12 | 21601387 | 21601408 | 21601392 | 21601387 | - |
| SEQ ID NO 25561 | AGGGGGAGTTAATAGCCTTAAG | CTC | chr12 | 21601379 | 21601400 | 21601384 | 21601379 | - |
| SEQ ID NO 25562 | ATAGCCTTAAGGAGTTTTGTCT | TTA | chr12 | 21601368 | 21601389 | 21601373 | 21601368 | - |
| SEQ ID NO 25563 | AAGGAGTTTTGTCTCCAGGGTA | CTT | chr12 | 21601360 | 21601381 | 21601365 | 21601360 | - |
| SEQ ID NO 25564 | AGGAGTTTTGTCTCCAGGGTAT | TTA | chr12 | 21601359 | 21601380 | 21601364 | 21601359 | - |
| SEQ ID NO 25565 | TGTCTCCAGGGTATGAACAATG | TTT | chr12 | 21601351 | 21601372 | 21601356 | 21601351 | - |
| SEQ ID NO 25566 | GTCTCCAGGGTATGAACAATGA | TTT | chr12 | 21601350 | 21601371 | 21601355 | 21601350 | - |
| SEQ ID NO 25567 | TCTCCAGGGTATGAACAATGAA | TTG | chr12 | 21601349 | 21601370 | 21601354 | 21601349 | - |
| SEQ ID NO 25568 | CAGGGTATGAACAATGAATGAG | CTC | chr12 | 21601345 | 21601366 | 21601350 | 21601345 | - |
| SEQ ID NO 25569 | AAATTCTATCCACAGTAGTGGG | CTG | chr12 | 21601314 | 21601335 | 21601319 | 21601314 | - |
| SEQ ID NO 25570 | TATCCACAGTAGTGGGAAGTAC | TTC | chr12 | 21601308 | 21601329 | 21601313 | 21601308 | - |
| SEQ ID NO 25571 | TCCACAGTAGTGGGAAGTACTA | CTA | chr12 | 21601306 | 21601327 | 21601311 | 21601306 | - |
| SEQ ID NO 25572 | AGTAGTCAGGTATGTTTTGGAA | CTA | chr12 | 21601284 | 21601305 | 21601289 | 21601284 | - |
| SEQ ID NO 25573 | TGGAAGAAGCACTGTTACCAGT | TTT | chr12 | 21601267 | 21601288 | 21601272 | 21601267 | - |
| SEQ ID NO 25574 | GGAAGAAGCACTGTTACCAGTT | TTT | chr12 | 21601266 | 21601287 | 21601271 | 21601266 | - |
| SEQ ID NO 25575 | GAAGAAGCACTGTTACCAGTTG | TTG | chr12 | 21601265 | 21601286 | 21601270 | 21601265 | - |
| SEQ ID NO 25576 | TTACCAGTTGAGGGAGAGGAGA | CTG | chr12 | 21601253 | 21601274 | 21601258 | 21601253 | - |
| SEQ ID NO 25577 | CCAGTTGAGGGAGAGGAGAGGA | TTA | chr12 | 21601250 | 21601271 | 21601255 | 21601250 | - |
| SEQ ID NO 25578 | AGGGAGAGGAGAGGAGGGAAAT | TTG | chr12 | 21601243 | 21601264 | 21601248 | 21601243 | - |
| SEQ ID NO 25579 | GACTGTGGTGTGACCCAGGATG | TTA | chr12 | 21601219 | 21601240 | 21601224 | 21601219 | - |
| SEQ ID NO 25580 | TGGTGTGACCCAGGATGGAAAG | CTG | chr12 | 21601214 | 21601235 | 21601219 | 21601214 | - |
| SEQ ID NO 25581 | TGCCCAAATGTGGGGGAAAAAT | TTT | chr12 | 21601189 | 21601210 | 21601194 | 21601189 | - |
| SEQ ID NO 25582 | GCCCAAATGTGGGGGAAAAATG | TTT | chr12 | 21601188 | 21601209 | 21601193 | 21601188 | - |
| SEQ ID NO 25583 | CCCAAATGTGGGGGAAAAATGT | TTG | chr12 | 21601187 | 21601208 | 21601192 | 21601187 | - |
| SEQ ID NO 25584 | ACTCTCTCCTTTGCCCAGGTCT | TTT | chr12 | 21601163 | 21601184 | 21601168 | 21601163 | - |
| SEQ ID NO 25585 | CTCTCTCCTTTGCCCAGGTCTT | TTA | chr12 | 21601162 | 21601183 | 21601167 | 21601162 | - |
| SEQ ID NO 25586 | TCTCCTTTGCCCAGGTCTTACT | CTC | chr12 | 21601159 | 21601180 | 21601164 | 21601159 | - |
| SEQ ID NO 25587 | TCCTTTGCCCAGGTCTTACTAC | CTC | chr12 | 21601157 | 21601178 | 21601162 | 21601157 | - |

Figure 48 (Cont'd)

| SEQ ID NO 25588 | CTTTGCCCAGGTCTTACTACAA | CTC | chr12 | 21601155 | 21601176 | 21601160 | 21601155 | - |
|---|---|---|---|---|---|---|---|---|
| SEQ ID NO 25589 | TGCCCAGGTCTTACTACAATCA | CTT | chr12 | 21601152 | 21601173 | 21601157 | 21601152 | - |
| SEQ ID NO 25590 | GCCCAGGTCTTACTACAATCAT | TTT | chr12 | 21601151 | 21601172 | 21601156 | 21601151 | - |
| SEQ ID NO 25591 | CCCAGGTCTTACTACAATCATT | TTG | chr12 | 21601150 | 21601171 | 21601155 | 21601150 | - |
| SEQ ID NO 25592 | ACTACAATCATTTCTTCTGCAC | CTT | chr12 | 21601140 | 21601161 | 21601145 | 21601140 | - |
| SEQ ID NO 25593 | CTACAATCATTTCTTCTGCACA | TTA | chr12 | 21601139 | 21601160 | 21601144 | 21601139 | - |
| SEQ ID NO 25594 | CAATCATTTCTTCTGCACACAC | CTA | chr12 | 21601136 | 21601157 | 21601141 | 21601136 | - |
| SEQ ID NO 25595 | CTTCTGCACACACTTGCTCAGA | TTT | chr12 | 21601127 | 21601148 | 21601132 | 21601127 | - |
| SEQ ID NO 25596 | TTCTGCACACACTTGCTCAGAA | TTC | chr12 | 21601126 | 21601147 | 21601131 | 21601126 | - |
| SEQ ID NO 25597 | CTGCACACACTTGCTCAGAACA | CTT | chr12 | 21601124 | 21601145 | 21601129 | 21601124 | - |
| SEQ ID NO 25598 | TGCACACACTTGCTCAGAACAT | TTC | chr12 | 21601123 | 21601144 | 21601128 | 21601123 | - |
| SEQ ID NO 25599 | CACACACTTGCTCAGAACATTA | CTG | chr12 | 21601121 | 21601142 | 21601126 | 21601121 | - |
| SEQ ID NO 25600 | GCTCAGAACATTACAAACTCTG | CTT | chr12 | 21601112 | 21601133 | 21601117 | 21601112 | - |
| SEQ ID NO 25601 | CTCAGAACATTACAAACTCTGG | TTG | chr12 | 21601111 | 21601132 | 21601116 | 21601111 | - |
| SEQ ID NO 25602 | AGAACATTACAAACTCTGGAGA | CTC | chr12 | 21601108 | 21601129 | 21601113 | 21601108 | - |
| SEQ ID NO 25603 | CAAACTCTGGAGAAATTAACAT | TTA | chr12 | 21601099 | 21601120 | 21601104 | 21601099 | - |
| SEQ ID NO 25604 | TGGAGAAATTAACATGTTAAGG | CTC | chr12 | 21601092 | 21601113 | 21601097 | 21601092 | - |
| SEQ ID NO 25605 | GAGAAATTAACATGTTAAGGAT | CTG | chr12 | 21601090 | 21601111 | 21601095 | 21601090 | - |
| SEQ ID NO 25606 | ACATGTTAAGGATATTTAGGAT | TTA | chr12 | 21601081 | 21601102 | 21601086 | 21601081 | - |
| SEQ ID NO 25607 | AGGATATTTAGGATCATTAAAA | TTA | chr12 | 21601073 | 21601094 | 21601078 | 21601073 | - |
| SEQ ID NO 25608 | AGGATCATTAAAAAAGTTTAAT | TTT | chr12 | 21601064 | 21601085 | 21601069 | 21601064 | - |
| SEQ ID NO 25609 | GGATCATTAAAAAAGTTTAATA | TTA | chr12 | 21601063 | 21601084 | 21601068 | 21601063 | - |
| SEQ ID NO 25610 | AAAAAGTTTAATAAATGTTGTC | TTA | chr12 | 21601054 | 21601075 | 21601059 | 21601054 | - |
| SEQ ID NO 25611 | AATAAATGTTGTCACACATAAT | TTT | chr12 | 21601045 | 21601066 | 21601050 | 21601045 | - |
| SEQ ID NO 25612 | ATAAATGTTGTCACACATAATG | TTA | chr12 | 21601044 | 21601065 | 21601049 | 21601044 | - |
| SEQ ID NO 25613 | TCACACATAATGAAAGTTAATT | TTG | chr12 | 21601034 | 21601055 | 21601039 | 21601034 | - |
| SEQ ID NO 25614 | ATTTAAGAATTGTAAAGACTTG | TTA | chr12 | 21601015 | 21601036 | 21601020 | 21601015 | - |
| SEQ ID NO 25615 | AAGAATTGTAAAGACTTGAGCG | TTT | chr12 | 21601011 | 21601032 | 21601016 | 21601011 | - |
| SEQ ID NO 25616 | AGAATTGTAAAGACTTGAGCGA | TTA | chr12 | 21601010 | 21601031 | 21601015 | 21601010 | - |
| SEQ ID NO 25617 | TAAAGACTTGAGCGATGTAGTC | TTG | chr12 | 21601003 | 21601024 | 21601008 | 21601003 | - |
| SEQ ID NO 25618 | GAGCGATGTAGTCCCTAAATAA | CTT | chr12 | 21600994 | 21601015 | 21600999 | 21600994 | - |
| SEQ ID NO 25619 | AGCGATGTAGTCCCTAAATAAA | TTG | chr12 | 21600993 | 21601014 | 21600998 | 21600993 | - |
| SEQ ID NO 25620 | AATAAATGCTTCCCTCTTAAAA | CTA | chr12 | 21600977 | 21600998 | 21600982 | 21600977 | - |
| SEQ ID NO 25621 | CCCTCTTAAAATGGACTAGAAA | CTT | chr12 | 21600966 | 21600987 | 21600971 | 21600966 | - |
| SEQ ID NO 25622 | CCTCTTAAAATGGACTAGAAAC | TTC | chr12 | 21600965 | 21600986 | 21600970 | 21600965 | - |
| SEQ ID NO 25623 | TTAAAATGGACTAGAAACAATT | CTC | chr12 | 21600961 | 21600982 | 21600966 | 21600961 | - |
| SEQ ID NO 25624 | AAAATGGACTAGAAACAATTTG | CTT | chr12 | 21600959 | 21600980 | 21600964 | 21600959 | - |
| SEQ ID NO 25625 | AAATGGACTAGAAACAATTTGT | TTA | chr12 | 21600958 | 21600979 | 21600963 | 21600958 | - |
| SEQ ID NO 25626 | GAAACAATTTGTTTTTGCCTAA | CTA | chr12 | 21600948 | 21600969 | 21600953 | 21600948 | - |
| SEQ ID NO 25627 | GTTTTTGCCTAAGCCAACGTAT | TTT | chr12 | 21600938 | 21600959 | 21600943 | 21600938 | - |
| SEQ ID NO 25628 | TTTTTGCCTAAGCCAACGTATT | TTG | chr12 | 21600937 | 21600958 | 21600942 | 21600937 | - |
| SEQ ID NO 25629 | TTGCCTAAGCCAACGTATTGCT | TTT | chr12 | 21600934 | 21600955 | 21600939 | 21600934 | - |
| SEQ ID NO 25630 | TGCCTAAGCCAACGTATTGCTG | TTT | chr12 | 21600933 | 21600954 | 21600938 | 21600933 | - |
| SEQ ID NO 25631 | GCCTAAGCCAACGTATTGCTGG | TTT | chr12 | 21600932 | 21600953 | 21600937 | 21600932 | - |
| SEQ ID NO 25632 | CCTAAGCCAACGTATTGCTGGA | TTG | chr12 | 21600931 | 21600952 | 21600936 | 21600931 | - |
| SEQ ID NO 25633 | AGCCAACGTATTGCTGGACATA | CTA | chr12 | 21600927 | 21600948 | 21600932 | 21600927 | - |
| SEQ ID NO 25634 | CTGGACATAATTTACCTGCTTC | TTG | chr12 | 21600914 | 21600935 | 21600919 | 21600914 | - |
| SEQ ID NO 25635 | GACATAATTTACCTGCTTCCTC | CTG | chr12 | 21600911 | 21600932 | 21600916 | 21600911 | - |
| SEQ ID NO 25636 | ACCTGCTTCCTCCTCAGTCTTG | TTT | chr12 | 21600901 | 21600922 | 21600906 | 21600901 | - |
| SEQ ID NO 25637 | CCTGCTTCCTCCTCAGTCTTGA | TTA | chr12 | 21600900 | 21600921 | 21600905 | 21600900 | - |
| SEQ ID NO 25638 | CTTCCTCCTCAGTCTTGACACT | CTG | chr12 | 21600896 | 21600917 | 21600901 | 21600896 | - |
| SEQ ID NO 25639 | CCTCCTCAGTCTTGACACTACA | CTT | chr12 | 21600893 | 21600914 | 21600898 | 21600893 | - |
| SEQ ID NO 25640 | CTCCTCAGTCTTGACACTACAC | TTC | chr12 | 21600892 | 21600913 | 21600897 | 21600892 | - |
| SEQ ID NO 25641 | CTCAGTCTTGACACTACACCTC | CTC | chr12 | 21600889 | 21600910 | 21600894 | 21600889 | - |
| SEQ ID NO 25642 | AGTCTTGACACTACACCTCTGA | CTC | chr12 | 21600886 | 21600907 | 21600891 | 21600886 | - |
| SEQ ID NO 25643 | GACACTACACCTCTGAATTACA | CTT | chr12 | 21600880 | 21600901 | 21600885 | 21600880 | - |
| SEQ ID NO 25644 | ACACTACACCTCTGAATTACAT | TTG | chr12 | 21600879 | 21600900 | 21600884 | 21600879 | - |
| SEQ ID NO 25645 | CACCTCTGAATTACATGGTACA | CTA | chr12 | 21600873 | 21600894 | 21600878 | 21600873 | - |

Figure 48 (Cont'd)

| SEQ ID NO 25646 | TGAATTACATGGTACAAGTGGC | CTC | chr12 | 21600867 | 21600888 | 21600872 | 21600867 | - |
|---|---|---|---|---|---|---|---|---|
| SEQ ID NO 25647 | AATTACATGGTACAAGTGGCAC | CTG | chr12 | 21600865 | 21600886 | 21600870 | 21600865 | - |
| SEQ ID NO 25648 | CATGGTACAAGTGGCACAGGGA | TTA | chr12 | 21600860 | 21600881 | 21600865 | 21600860 | - |
| SEQ ID NO 25649 | AGAAAACTAGAGTCAAAGTGGT | TTC | chr12 | 21600831 | 21600852 | 21600836 | 21600831 | - |
| SEQ ID NO 25650 | GAGTCAAAGTGGTTATGGAAGA | CTA | chr12 | 21600822 | 21600843 | 21600827 | 21600822 | - |
| SEQ ID NO 25651 | TGGAAGAAATTATAATAATGAG | TTA | chr12 | 21600807 | 21600828 | 21600812 | 21600807 | - |
| SEQ ID NO 25652 | TAATAATGAGTCCACTCTTCTA | TTA | chr12 | 21600795 | 21600816 | 21600800 | 21600795 | - |
| SEQ ID NO 25653 | TTCTAGGACAGGAGTTCTAAAG | CTC | chr12 | 21600778 | 21600799 | 21600783 | 21600778 | - |
| SEQ ID NO 25654 | CTAGGACAGGAGTTCTAAAGGT | CTT | chr12 | 21600776 | 21600797 | 21600781 | 21600776 | - |
| SEQ ID NO 25655 | TAGGACAGGAGTTCTAAAGGTG | TTC | chr12 | 21600775 | 21600796 | 21600780 | 21600775 | - |
| SEQ ID NO 25656 | GGACAGGAGTTCTAAAGGTGAG | CTA | chr12 | 21600773 | 21600794 | 21600778 | 21600773 | - |
| SEQ ID NO 25657 | TAAAGGTGAGGACTTTGATATA | TTC | chr12 | 21600761 | 21600782 | 21600766 | 21600761 | - |
| SEQ ID NO 25658 | AAGGTGAGGACTTTGATATAAG | CTA | chr12 | 21600759 | 21600780 | 21600764 | 21600759 | - |
| SEQ ID NO 25659 | TGATATAAGTGAACTCAAGGAG | CTT | chr12 | 21600746 | 21600767 | 21600751 | 21600746 | - |
| SEQ ID NO 25660 | GATATAAGTGAACTCAAGGAGT | TTT | chr12 | 21600745 | 21600766 | 21600750 | 21600745 | - |
| SEQ ID NO 25661 | ATATAAGTGAACTCAAGGAGTT | TTG | chr12 | 21600744 | 21600765 | 21600749 | 21600744 | - |
| SEQ ID NO 25662 | AAGGAGTTTCTAAACCTTCAGA | CTC | chr12 | 21600730 | 21600751 | 21600735 | 21600730 | - |
| SEQ ID NO 25663 | CTAAACCTTCAGAAATTATATC | TTT | chr12 | 21600721 | 21600742 | 21600726 | 21600721 | - |
| SEQ ID NO 25664 | TAAACCTTCAGAAATTATATCT | TTC | chr12 | 21600720 | 21600741 | 21600725 | 21600720 | - |
| SEQ ID NO 25665 | AACCTTCAGAAATTATATCTAA | CTA | chr12 | 21600718 | 21600739 | 21600723 | 21600718 | - |
| SEQ ID NO 25666 | CAGAAATTATATCTAAAAATTA | CTT | chr12 | 21600712 | 21600733 | 21600717 | 21600712 | - |
| SEQ ID NO 25667 | AGAAATTATATCTAAAAATTAG | TTC | chr12 | 21600711 | 21600732 | 21600716 | 21600711 | - |
| SEQ ID NO 25668 | TATCTAAAAATTAGGTGCACGT | TTA | chr12 | 21600703 | 21600724 | 21600708 | 21600703 | - |
| SEQ ID NO 25669 | AAAATTAGGTGCACGTATATAG | CTA | chr12 | 21600697 | 21600718 | 21600702 | 21600697 | - |
| SEQ ID NO 25670 | GGTGCACGTATATAGAAGTACT | TTA | chr12 | 21600690 | 21600711 | 21600695 | 21600690 | - |
| SEQ ID NO 25671 | TTCTCTGAGAAGAGGACTTCAC | CTT | chr12 | 21600667 | 21600688 | 21600672 | 21600667 | - |
| SEQ ID NO 25672 | TCTCTGAGAAGAGGACTTCACA | TTT | chr12 | 21600666 | 21600687 | 21600671 | 21600666 | - |
| SEQ ID NO 25673 | CTCTGAGAAGAGGACTTCACAC | TTT | chr12 | 21600665 | 21600686 | 21600670 | 21600665 | - |
| SEQ ID NO 25674 | TCTGAGAAGAGGACTTCACACT | TTC | chr12 | 21600664 | 21600685 | 21600669 | 21600664 | - |
| SEQ ID NO 25675 | TGAGAAGAGGACTTCACACTTC | CTC | chr12 | 21600662 | 21600683 | 21600667 | 21600662 | - |
| SEQ ID NO 25676 | AGAAGAGGACTTCACACTTCCA | CTG | chr12 | 21600660 | 21600681 | 21600665 | 21600660 | - |
| SEQ ID NO 25677 | CACACTTCCATCAGCTTCCTGA | CTT | chr12 | 21600648 | 21600669 | 21600653 | 21600648 | - |
| SEQ ID NO 25678 | ACACTTCCATCAGCTTCCTGAA | TTC | chr12 | 21600647 | 21600668 | 21600652 | 21600647 | - |
| SEQ ID NO 25679 | CCATCAGCTTCCTGAAGGCCCC | CTT | chr12 | 21600641 | 21600662 | 21600646 | 21600641 | - |
| SEQ ID NO 25680 | CATCAGCTTCCTGAAGGCCCCT | TTC | chr12 | 21600640 | 21600661 | 21600645 | 21600640 | - |
| SEQ ID NO 25681 | CCTGAAGGCCCCTGTAATTGCC | CTT | chr12 | 21600631 | 21600652 | 21600636 | 21600631 | - |
| SEQ ID NO 25682 | CTGAAGGCCCCTGTAATTGCCG | TTC | chr12 | 21600630 | 21600651 | 21600635 | 21600630 | - |
| SEQ ID NO 25683 | AAGGCCCCTGTAATTGCCGTAA | CTG | chr12 | 21600627 | 21600648 | 21600632 | 21600627 | - |
| SEQ ID NO 25684 | TAATTGCCGTAAAGAACAACTG | CTG | chr12 | 21600617 | 21600638 | 21600622 | 21600617 | - |
| SEQ ID NO 25685 | CCGTAAAGAACAACTGCTCTAA | TTG | chr12 | 21600611 | 21600632 | 21600616 | 21600611 | - |
| SEQ ID NO 25686 | CTCTAAAGTTTAATACTAGGCT | CTG | chr12 | 21600595 | 21600616 | 21600600 | 21600595 | - |
| SEQ ID NO 25687 | TAAAGTTTAATACTAGGCTACT | CTC | chr12 | 21600592 | 21600613 | 21600597 | 21600592 | - |
| SEQ ID NO 25688 | AAGTTTAATACTAGGCTACTCG | CTA | chr12 | 21600590 | 21600611 | 21600595 | 21600590 | - |
| SEQ ID NO 25689 | AATACTAGGCTACTCGGCTGTT | TTT | chr12 | 21600584 | 21600605 | 21600589 | 21600584 | - |
| SEQ ID NO 25690 | ATACTAGGCTACTCGGCTGTTT | TTA | chr12 | 21600583 | 21600604 | 21600588 | 21600583 | - |
| SEQ ID NO 25691 | GGCTACTCGGCTGTTTTTTGTT | CTA | chr12 | 21600577 | 21600598 | 21600582 | 21600577 | - |
| SEQ ID NO 25692 | CTCGGCTGTTTTTTGTTAACAC | CTA | chr12 | 21600572 | 21600593 | 21600577 | 21600572 | - |
| SEQ ID NO 25693 | GGCTGTTTTTTGTTAACACAGA | CTC | chr12 | 21600569 | 21600590 | 21600574 | 21600569 | - |
| SEQ ID NO 25694 | TTTTTTGTTAACACAGAAGTTT | CTG | chr12 | 21600564 | 21600585 | 21600569 | 21600564 | - |
| SEQ ID NO 25695 | TTTGTTAACACAGAAGTTTTCC | TTT | chr12 | 21600561 | 21600582 | 21600566 | 21600561 | - |
| SEQ ID NO 25696 | TTGTTAACACAGAAGTTTTCCA | TTT | chr12 | 21600560 | 21600581 | 21600565 | 21600560 | - |
| SEQ ID NO 25697 | TGTTAACACAGAAGTTTTCCAA | TTT | chr12 | 21600559 | 21600580 | 21600564 | 21600559 | - |
| SEQ ID NO 25698 | GTTAACACAGAAGTTTTCCAAA | TTT | chr12 | 21600558 | 21600579 | 21600563 | 21600558 | - |
| SEQ ID NO 25699 | TTAACACAGAAGTTTTCCAAAT | TTG | chr12 | 21600557 | 21600578 | 21600562 | 21600557 | - |
| SEQ ID NO 25700 | ACACAGAAGTTTTCCAAATGGC | TTA | chr12 | 21600554 | 21600575 | 21600559 | 21600554 | - |
| SEQ ID NO 25701 | TCCAAATGGCTTTTCTCTAGAG | TTT | chr12 | 21600542 | 21600563 | 21600547 | 21600542 | - |
| SEQ ID NO 25702 | CCAAATGGCTTTTCTCTAGAGC | TTT | chr12 | 21600541 | 21600562 | 21600546 | 21600541 | - |
| SEQ ID NO 25703 | CAAATGGCTTTTCTCTAGAGCA | TTC | chr12 | 21600540 | 21600561 | 21600545 | 21600540 | - |

Figure 48 (Cont'd)

| SEQ ID NO 25704 | TTCTCTAGAGCAAAATGAAAAG | CTT | chr12 | 21600530 | 21600551 | 21600535 | 21600530 | - |
| SEQ ID NO 25705 | TCTCTAGAGCAAAATGAAAAGG | TTT | chr12 | 21600529 | 21600550 | 21600534 | 21600529 | - |
| SEQ ID NO 25706 | CTCTAGAGCAAAATGAAAAGGA | TTT | chr12 | 21600528 | 21600549 | 21600533 | 21600528 | - |
| SEQ ID NO 25707 | TCTAGAGCAAAATGAAAAGGAT | TTC | chr12 | 21600527 | 21600548 | 21600532 | 21600527 | - |
| SEQ ID NO 25708 | TAGAGCAAAATGAAAAGGATCC | CTC | chr12 | 21600525 | 21600546 | 21600530 | 21600525 | - |
| SEQ ID NO 25709 | GAGCAAAATGAAAAGGATCCCA | CTA | chr12 | 21600523 | 21600544 | 21600528 | 21600523 | - |
| SEQ ID NO 25710 | CCCGAGACCTAACGATGTTTAT | CTT | chr12 | 21600496 | 21600517 | 21600501 | 21600496 | - |
| SEQ ID NO 25711 | CCGAGACCTAACGATGTTTATC | TTC | chr12 | 21600495 | 21600516 | 21600500 | 21600495 | - |
| SEQ ID NO 25712 | ACGATGTTTATCTTTCGTGATA | CTA | chr12 | 21600485 | 21600506 | 21600490 | 21600485 | - |
| SEQ ID NO 25713 | ATCTTTCGTGATACTGTTTTTG | TTT | chr12 | 21600476 | 21600497 | 21600481 | 21600476 | - |
| SEQ ID NO 25714 | TCTTTCGTGATACTGTTTTTGT | TTA | chr12 | 21600475 | 21600496 | 21600480 | 21600475 | - |
| SEQ ID NO 25715 | TCGTGATACTGTTTTTGTTCTT | CTT | chr12 | 21600471 | 21600492 | 21600476 | 21600471 | - |
| SEQ ID NO 25716 | CGTGATACTGTTTTTGTTCTTC | TTT | chr12 | 21600470 | 21600491 | 21600475 | 21600470 | - |
| SEQ ID NO 25717 | GTGATACTGTTTTTGTTCTTCC | TTC | chr12 | 21600469 | 21600490 | 21600474 | 21600469 | - |
| SEQ ID NO 25718 | TTTTTGTTCTTCCTCTTTTTCT | CTG | chr12 | 21600460 | 21600481 | 21600465 | 21600460 | - |
| SEQ ID NO 25719 | TTGTTCTTCCTCTTTTTCTCCT | TTT | chr12 | 21600457 | 21600478 | 21600462 | 21600457 | - |
| SEQ ID NO 25720 | TGTTCTTCCTCTTTTTCTCCTA | TTT | chr12 | 21600456 | 21600477 | 21600461 | 21600456 | - |
| SEQ ID NO 25721 | GTTCTTCCTCTTTTTCTCCTAC | TTT | chr12 | 21600455 | 21600476 | 21600460 | 21600455 | - |
| SEQ ID NO 25722 | TTCTTCCTCTTTTTCTCCTACC | TTG | chr12 | 21600454 | 21600475 | 21600459 | 21600454 | - |
| SEQ ID NO 25723 | TTCCTCTTTTTCTCCTACCCCC | TTC | chr12 | 21600451 | 21600472 | 21600456 | 21600451 | - |
| SEQ ID NO 25724 | CCTCTTTTTCTCCTACCCCCCA | CTT | chr12 | 21600449 | 21600470 | 21600454 | 21600449 | - |
| SEQ ID NO 25725 | CTCTTTTTCTCCTACCCCCCAC | TTC | chr12 | 21600448 | 21600469 | 21600453 | 21600448 | - |
| SEQ ID NO 25726 | TTTTTCTCCTACCCCCCACCAC | CTC | chr12 | 21600445 | 21600466 | 21600450 | 21600445 | - |
| SEQ ID NO 25727 | TTTCTCCTACCCCCCACCACTT | CTT | chr12 | 21600443 | 21600464 | 21600448 | 21600443 | - |
| SEQ ID NO 25728 | TTCTCCTACCCCCCACCACTTT | TTT | chr12 | 21600442 | 21600463 | 21600447 | 21600442 | - |
| SEQ ID NO 25729 | TCTCCTACCCCCCACCACTTTT | TTT | chr12 | 21600441 | 21600462 | 21600446 | 21600441 | - |
| SEQ ID NO 25730 | CTCCTACCCCCCACCACTTTTA | TTT | chr12 | 21600440 | 21600461 | 21600445 | 21600440 | - |
| SEQ ID NO 25731 | TCCTACCCCCCACCACTTTTAA | TTC | chr12 | 21600439 | 21600460 | 21600444 | 21600439 | - |
| SEQ ID NO 25732 | CTACCCCCCACCACTTTTAAAG | CTC | chr12 | 21600437 | 21600458 | 21600442 | 21600437 | - |
| SEQ ID NO 25733 | CCCCCCACCACTTTTAAAGATC | CTA | chr12 | 21600434 | 21600455 | 21600439 | 21600434 | - |
| SEQ ID NO 25734 | TTAAAGATCCATCAAGGCCCAG | CTT | chr12 | 21600421 | 21600442 | 21600426 | 21600421 | - |
| SEQ ID NO 25735 | TAAAGATCCATCAAGGCCCAGC | TTT | chr12 | 21600420 | 21600441 | 21600425 | 21600420 | - |
| SEQ ID NO 25736 | AAAGATCCATCAAGGCCCAGCA | TTT | chr12 | 21600419 | 21600440 | 21600424 | 21600419 | - |
| SEQ ID NO 25737 | AAGATCCATCAAGGCCCAGCAT | TTA | chr12 | 21600418 | 21600439 | 21600423 | 21600418 | - |
| SEQ ID NO 25738 | ACACCTGTAATCTCAACACTTT | TTC | chr12 | 21600388 | 21600409 | 21600393 | 21600388 | - |
| SEQ ID NO 25739 | TAATCTCAACACTTTTCAAGGC | CTG | chr12 | 21600381 | 21600402 | 21600386 | 21600381 | - |
| SEQ ID NO 25740 | AACACTTTTCAAGGCTGAGGTG | CTC | chr12 | 21600374 | 21600395 | 21600379 | 21600374 | - |
| SEQ ID NO 25741 | TTCAAGGCTGAGGTGGGAGAAT | CTT | chr12 | 21600367 | 21600388 | 21600372 | 21600367 | - |
| SEQ ID NO 25742 | TCAAGGCTGAGGTGGGAGAATT | TTT | chr12 | 21600366 | 21600387 | 21600371 | 21600366 | - |
| SEQ ID NO 25743 | CAAGGCTGAGGTGGGAGAATTG | TTT | chr12 | 21600365 | 21600386 | 21600370 | 21600365 | - |
| SEQ ID NO 25744 | AAGGCTGAGGTGGGAGAATTGT | TTC | chr12 | 21600364 | 21600385 | 21600369 | 21600364 | - |
| SEQ ID NO 25745 | AGGTGGGAGAATTGTTTGAGAC | CTG | chr12 | 21600357 | 21600378 | 21600362 | 21600357 | - |
| SEQ ID NO 25746 | TTTGAGACCAAGAGTTGGATAC | TTG | chr12 | 21600343 | 21600364 | 21600348 | 21600343 | - |
| SEQ ID NO 25747 | GAGACCAAGAGTTGGATACCAG | TTT | chr12 | 21600340 | 21600361 | 21600345 | 21600340 | - |
| SEQ ID NO 25748 | AGACCAAGAGTTGGATACCAGC | TTG | chr12 | 21600339 | 21600360 | 21600344 | 21600339 | - |
| SEQ ID NO 25749 | GATACCAGCCTGGGGAACATAG | TTG | chr12 | 21600326 | 21600347 | 21600331 | 21600326 | - |
| SEQ ID NO 25750 | GGGAACATAGGGAGACCCTGTT | CTG | chr12 | 21600314 | 21600335 | 21600319 | 21600314 | - |
| SEQ ID NO 25751 | TTTCTACAGAAATTTAAAAAAT | CTG | chr12 | 21600294 | 21600315 | 21600299 | 21600294 | - |
| SEQ ID NO 25752 | CTACAGAAATTTAAAAAATTTC | TTT | chr12 | 21600291 | 21600312 | 21600296 | 21600291 | - |
| SEQ ID NO 25753 | TACAGAAATTTAAAAAATTTCT | TTC | chr12 | 21600290 | 21600311 | 21600295 | 21600290 | - |
| SEQ ID NO 25754 | CAGAAATTTAAAAAATTTCTCT | CTA | chr12 | 21600288 | 21600309 | 21600293 | 21600288 | - |
| SEQ ID NO 25755 | AAAAAATTTCTCTAGCTGGCCA | TTT | chr12 | 21600279 | 21600300 | 21600284 | 21600279 | - |
| SEQ ID NO 25756 | AAAAATTTCTCTAGCTGGCCAT | TTA | chr12 | 21600278 | 21600299 | 21600283 | 21600278 | - |
| SEQ ID NO 25757 | CTCTAGCTGGCCATGGAGGCTC | TTT | chr12 | 21600270 | 21600291 | 21600275 | 21600270 | - |
| SEQ ID NO 25758 | TCTAGCTGGCCATGGAGGCTCA | TTC | chr12 | 21600269 | 21600290 | 21600274 | 21600269 | - |
| SEQ ID NO 25759 | TAGCTGGCCATGGAGGCTCACA | CTC | chr12 | 21600267 | 21600288 | 21600272 | 21600267 | - |
| SEQ ID NO 25760 | GCTGGCCATGGAGGCTCACACC | CTA | chr12 | 21600265 | 21600286 | 21600270 | 21600265 | - |
| SEQ ID NO 25761 | GCCATGGAGGCTCACACCTGTA | CTG | chr12 | 21600261 | 21600282 | 21600266 | 21600261 | - |

Figure 48 (Cont'd)

| | | | | | | | | |
|---|---|---|---|---|---|---|---|---|
| SEQ ID NO 25762 | ACACCTGTAGTCCTAGCTACCT | CTC | chr12 | 21600248 | 21600269 | 21600253 | 21600248 | - |
| SEQ ID NO 25763 | TAGTCCTAGCTACCTGAGAGGC | CTG | chr12 | 21600241 | 21600262 | 21600246 | 21600241 | - |
| SEQ ID NO 25764 | GCTACCTGAGAGGCTAAAGCAG | CTA | chr12 | 21600233 | 21600254 | 21600238 | 21600233 | - |
| SEQ ID NO 25765 | CCTGAGAGGCTAAAGCAGGAGG | CTA | chr12 | 21600229 | 21600250 | 21600234 | 21600229 | - |
| SEQ ID NO 25766 | AGAGGCTAAAGCAGGAGGATCA | CTG | chr12 | 21600225 | 21600246 | 21600230 | 21600225 | - |
| SEQ ID NO 25767 | AAGCAGGAGGATCAATTGAATC | CTA | chr12 | 21600217 | 21600238 | 21600222 | 21600217 | - |
| SEQ ID NO 25768 | AATCCAGGCGTTCTAGTGAGGC | TTG | chr12 | 21600199 | 21600220 | 21600204 | 21600199 | - |
| SEQ ID NO 25769 | TAGTGAGGCTTCAGTGAGCAAG | TTC | chr12 | 21600186 | 21600207 | 21600191 | 21600186 | - |
| SEQ ID NO 25770 | GTGAGGCTTCAGTGAGCAAGAT | CTA | chr12 | 21600184 | 21600205 | 21600189 | 21600184 | - |
| SEQ ID NO 25771 | CAGTGAGCAAGATTGCACCATT | CTT | chr12 | 21600175 | 21600196 | 21600180 | 21600175 | - |
| SEQ ID NO 25772 | AGTGAGCAAGATTGCACCATTG | TTC | chr12 | 21600174 | 21600195 | 21600179 | 21600174 | - |
| SEQ ID NO 25773 | CACCATTGCACTCCAGCCGGGG | TTG | chr12 | 21600160 | 21600181 | 21600165 | 21600160 | - |
| SEQ ID NO 25774 | CACTCCAGCCGGGGTGACAGAG | TTG | chr12 | 21600152 | 21600173 | 21600157 | 21600152 | - |
| SEQ ID NO 25775 | CAGCCGGGGTGACAGAGTGAGA | CTC | chr12 | 21600147 | 21600168 | 21600152 | 21600147 | - |
| SEQ ID NO 25776 | TTTCAAACAAACAAGCAAAAGC | CTG | chr12 | 21600120 | 21600141 | 21600125 | 21600120 | - |
| SEQ ID NO 25777 | CAAACAAACAAGCAAAAGCAAA | TTT | chr12 | 21600117 | 21600138 | 21600122 | 21600117 | - |
| SEQ ID NO 25778 | AAACAAACAAGCAAAAGCAAAA | TTC | chr12 | 21600116 | 21600137 | 21600121 | 21600116 | - |
| SEQ ID NO 25779 | GTTGCTCCATTCCTTTACTTAC | TTT | chr12 | 21600080 | 21600101 | 21600085 | 21600080 | - |
| SEQ ID NO 25780 | TTGCTCCATTCCTTTACTTACT | TTG | chr12 | 21600079 | 21600100 | 21600084 | 21600079 | - |
| SEQ ID NO 25781 | CTCCATTCCTTTACTTACTATC | TTG | chr12 | 21600076 | 21600097 | 21600081 | 21600076 | - |
| SEQ ID NO 25782 | CATTCCTTTACTTACTATCTTG | CTC | chr12 | 21600073 | 21600094 | 21600078 | 21600073 | - |
| SEQ ID NO 25783 | CTTTACTTACTATCTTGCTGTC | TTC | chr12 | 21600068 | 21600089 | 21600073 | 21600068 | - |
| SEQ ID NO 25784 | TACTTACTATCTTGCTGTCTAC | CTT | chr12 | 21600065 | 21600086 | 21600070 | 21600065 | - |
| SEQ ID NO 25785 | ACTTACTATCTTGCTGTCTACA | TTT | chr12 | 21600064 | 21600085 | 21600069 | 21600064 | - |
| SEQ ID NO 25786 | CTTACTATCTTGCTGTCTACAG | TTA | chr12 | 21600063 | 21600084 | 21600068 | 21600063 | - |
| SEQ ID NO 25787 | ACTATCTTGCTGTCTACAGCTA | CTT | chr12 | 21600060 | 21600081 | 21600065 | 21600060 | - |
| SEQ ID NO 25788 | CTATCTTGCTGTCTACAGCTAA | TTA | chr12 | 21600059 | 21600080 | 21600064 | 21600059 | - |
| SEQ ID NO 25789 | TCTTGCTGTCTACAGCTAAAGT | CTA | chr12 | 21600056 | 21600077 | 21600061 | 21600056 | - |
| SEQ ID NO 25790 | GCTGTCTACAGCTAAAGTCAGA | CTT | chr12 | 21600052 | 21600073 | 21600057 | 21600052 | - |
| SEQ ID NO 25791 | CTGTCTACAGCTAAAGTCAGAC | TTG | chr12 | 21600051 | 21600072 | 21600056 | 21600051 | - |
| SEQ ID NO 25792 | TCTACAGCTAAAGTCAGACTGC | CTG | chr12 | 21600048 | 21600069 | 21600053 | 21600048 | - |
| SEQ ID NO 25793 | CAGCTAAAGTCAGACTGCATGA | CTA | chr12 | 21600044 | 21600065 | 21600049 | 21600044 | - |
| SEQ ID NO 25794 | AAGTCAGACTGCATGATTTGGA | CTA | chr12 | 21600038 | 21600059 | 21600043 | 21600038 | - |
| SEQ ID NO 25795 | CATGATTTGGAATTCCAACTCC | CTG | chr12 | 21600027 | 21600048 | 21600032 | 21600027 | - |
| SEQ ID NO 25796 | GGAATTCCAACTCCACCATCAC | TTT | chr12 | 21600019 | 21600040 | 21600024 | 21600019 | - |
| SEQ ID NO 25797 | GAATTCCAACTCCACCATCACC | TTG | chr12 | 21600018 | 21600039 | 21600023 | 21600018 | - |
| SEQ ID NO 25798 | CAACTCCACCATCACCTGGGTA | TTC | chr12 | 21600012 | 21600033 | 21600017 | 21600012 | - |
| SEQ ID NO 25799 | CACCATCACCTGGGTAATGTTG | CTC | chr12 | 21600006 | 21600027 | 21600011 | 21600006 | - |
| SEQ ID NO 25800 | GGTAATGTTGAGATTTATTACA | CTG | chr12 | 21599994 | 21600015 | 21599999 | 21599994 | - |
| SEQ ID NO 25801 | AGATTTATTACATAGCATCTCT | TTG | chr12 | 21599984 | 21600005 | 21599989 | 21599984 | - |
| SEQ ID NO 25802 | ATTACATAGCATCTCTGTGCCT | TTT | chr12 | 21599978 | 21599999 | 21599983 | 21599978 | - |
| SEQ ID NO 25803 | TTACATAGCATCTCTGTGCCTC | TTA | chr12 | 21599977 | 21599998 | 21599982 | 21599977 | - |
| SEQ ID NO 25804 | CATAGCATCTCTGTGCCTCAGT | TTA | chr12 | 21599974 | 21599995 | 21599979 | 21599974 | - |
| SEQ ID NO 25805 | TGTGCCTCAGTTTCTCCATATA | CTC | chr12 | 21599963 | 21599984 | 21599968 | 21599963 | - |
| SEQ ID NO 25806 | TGCCTCAGTTTCTCCATATATA | CTG | chr12 | 21599961 | 21599982 | 21599966 | 21599961 | - |
| SEQ ID NO 25807 | AGTTTCTCCATATATAAAATCT | CTC | chr12 | 21599955 | 21599976 | 21599960 | 21599955 | - |
| SEQ ID NO 25808 | CTCCATATATAAAATCTACCTG | TTT | chr12 | 21599950 | 21599971 | 21599955 | 21599950 | - |
| SEQ ID NO 25809 | TCCATATATAAAATCTACCTGT | TTC | chr12 | 21599949 | 21599970 | 21599954 | 21599949 | - |
| SEQ ID NO 25810 | CATATATAAAATCTACCTGTAA | CTC | chr12 | 21599947 | 21599968 | 21599952 | 21599947 | - |
| SEQ ID NO 25811 | CCTGTAATAATGTTGTGAAAAT | CTA | chr12 | 21599932 | 21599953 | 21599937 | 21599932 | - |
| SEQ ID NO 25812 | TAATAATGTTGTGAAAATTAAA | CTG | chr12 | 21599928 | 21599949 | 21599933 | 21599928 | - |
| SEQ ID NO 25813 | TGAAAATTAAAAGAAATACCAG | TTG | chr12 | 21599917 | 21599938 | 21599922 | 21599917 | - |
| SEQ ID NO 25814 | AAAGAAATACCAGTTGTAAATC | TTA | chr12 | 21599908 | 21599929 | 21599913 | 21599908 | - |
| SEQ ID NO 25815 | TAAATCACTCAGAACTGTGCCT | TTG | chr12 | 21599892 | 21599913 | 21599897 | 21599892 | - |
| SEQ ID NO 25816 | AGAACTGTGCCTAGCATTTAAT | CTC | chr12 | 21599882 | 21599903 | 21599887 | 21599882 | - |
| SEQ ID NO 25817 | TGCCTAGCATTTAATAAACACT | CTG | chr12 | 21599875 | 21599896 | 21599880 | 21599875 | - |
| SEQ ID NO 25818 | GCATTTAATAAACACTCTGTAG | CTA | chr12 | 21599869 | 21599890 | 21599874 | 21599869 | - |
| SEQ ID NO 25819 | AATAAACACTCTGTAGGTATTA | TTT | chr12 | 21599863 | 21599884 | 21599868 | 21599863 | - |

Figure 48 (Cont'd)

| SEQ ID NO 25820 | ATAAACACTCTGTAGGTATTAG | TTA | chr12 | 21599862 | 21599883 | 21599867 | 21599862 | - |
|---|---|---|---|---|---|---|---|---|
| SEQ ID NO 25821 | TGTAGGTATTAGCTTATTTCTT | CTC | chr12 | 21599852 | 21599873 | 21599857 | 21599852 | - |
| SEQ ID NO 25822 | TAGGTATTAGCTTATTTCTTTA | CTG | chr12 | 21599850 | 21599871 | 21599855 | 21599850 | - |
| SEQ ID NO 25823 | GCTTATTTCTTTATAAAATTTA | TTA | chr12 | 21599841 | 21599862 | 21599846 | 21599841 | - |
| SEQ ID NO 25824 | ATTTCTTTATAAAATTTATTCA | CTT | chr12 | 21599837 | 21599858 | 21599842 | 21599837 | - |
| SEQ ID NO 25825 | TTTCTTTATAAAATTTATTCAT | TTA | chr12 | 21599836 | 21599857 | 21599841 | 21599836 | - |
| SEQ ID NO 25826 | CTTTATAAAATTTATTCATAAA | TTT | chr12 | 21599833 | 21599854 | 21599838 | 21599833 | - |
| SEQ ID NO 25827 | TTTATAAAATTTATTCATAAAA | TTC | chr12 | 21599832 | 21599853 | 21599837 | 21599832 | - |
| SEQ ID NO 25828 | TATAAAATTTATTCATAAAATG | CTT | chr12 | 21599830 | 21599851 | 21599835 | 21599830 | - |
| SEQ ID NO 25829 | ATAAAATTTATTCATAAAATGA | TTT | chr12 | 21599829 | 21599850 | 21599834 | 21599829 | - |
| SEQ ID NO 25830 | TAAAATTTATTCATAAAATGAG | TTA | chr12 | 21599828 | 21599849 | 21599833 | 21599828 | - |
| SEQ ID NO 25831 | ATTCATAAAATGAGGAAGTTAG | TTT | chr12 | 21599820 | 21599841 | 21599825 | 21599820 | - |
| SEQ ID NO 25832 | TTCATAAAATGAGGAAGTTAGC | TTA | chr12 | 21599819 | 21599840 | 21599824 | 21599819 | - |
| SEQ ID NO 25833 | ATAAAATGAGGAAGTTAGCTCA | TTC | chr12 | 21599816 | 21599837 | 21599821 | 21599816 | - |
| SEQ ID NO 25834 | GCTCATGTATTGTCATACCAGC | TTA | chr12 | 21599799 | 21599820 | 21599804 | 21599799 | - |
| SEQ ID NO 25835 | ATGTATTGTCATACCAGCTTTC | CTC | chr12 | 21599795 | 21599816 | 21599800 | 21599795 | - |
| SEQ ID NO 25836 | TCATACCAGCTTTCACTTTGAA | TTG | chr12 | 21599787 | 21599808 | 21599792 | 21599787 | - |
| SEQ ID NO 25837 | TCACTTTGAATGAGTCCATAAT | CTT | chr12 | 21599775 | 21599796 | 21599780 | 21599775 | - |
| SEQ ID NO 25838 | CACTTTGAATGAGTCCATAATT | TTT | chr12 | 21599774 | 21599795 | 21599779 | 21599774 | - |
| SEQ ID NO 25839 | ACTTTGAATGAGTCCATAATTG | TTC | chr12 | 21599773 | 21599794 | 21599778 | 21599773 | - |
| SEQ ID NO 25840 | TGAATGAGTCCATAATTGCATT | CTT | chr12 | 21599769 | 21599790 | 21599774 | 21599769 | - |
| SEQ ID NO 25841 | GAATGAGTCCATAATTGCATTT | TTT | chr12 | 21599768 | 21599789 | 21599773 | 21599768 | - |
| SEQ ID NO 25842 | AATGAGTCCATAATTGCATTTT | TTG | chr12 | 21599767 | 21599788 | 21599772 | 21599767 | - |
| SEQ ID NO 25843 | CATTTTTAAACACAAAAGAGA | TTG | chr12 | 21599751 | 21599772 | 21599756 | 21599751 | - |
| SEQ ID NO 25844 | TTAAACACAAAAGAGAAATAA | TTT | chr12 | 21599746 | 21599767 | 21599751 | 21599746 | - |
| SEQ ID NO 25845 | TAAACACAAAAGAGAAATAAT | TTT | chr12 | 21599745 | 21599766 | 21599750 | 21599745 | - |
| SEQ ID NO 25846 | AAACACAAAAGAGAAATAATA | TTT | chr12 | 21599744 | 21599765 | 21599749 | 21599744 | - |
| SEQ ID NO 25847 | AACACAAAAGAGAAATAATAG | TTA | chr12 | 21599743 | 21599764 | 21599748 | 21599743 | - |
| SEQ ID NO 25848 | CTTCAATCACGGGATGCATAGT | TTA | chr12 | 21599695 | 21599716 | 21599700 | 21599695 | - |
| SEQ ID NO 25849 | CAATCACGGGATGCATAGTAAT | CTT | chr12 | 21599692 | 21599713 | 21599697 | 21599692 | - |
| SEQ ID NO 25850 | AATCACGGGATGCATAGTAATT | TTC | chr12 | 21599691 | 21599712 | 21599696 | 21599691 | - |
| SEQ ID NO 25851 | GGATTTCTTTGCCCTAATTACT | TTA | chr12 | 21599668 | 21599689 | 21599673 | 21599668 | - |
| SEQ ID NO 25852 | CTTTGCCCTAATTACTGATGTG | TTT | chr12 | 21599662 | 21599683 | 21599667 | 21599662 | - |
| SEQ ID NO 25853 | TTTGCCCTAATTACTGATGTGG | TTC | chr12 | 21599661 | 21599682 | 21599666 | 21599661 | - |
| SEQ ID NO 25854 | TGCCCTAATTACTGATGTGGAT | CTT | chr12 | 21599659 | 21599680 | 21599664 | 21599659 | - |
| SEQ ID NO 25855 | GCCCTAATTACTGATGTGGATA | TTT | chr12 | 21599658 | 21599679 | 21599663 | 21599658 | - |
| SEQ ID NO 25856 | CCCTAATTACTGATGTGGATAA | TTG | chr12 | 21599657 | 21599678 | 21599662 | 21599657 | - |
| SEQ ID NO 25857 | ATTACTGATGTGGATAAGCCGG | CTA | chr12 | 21599652 | 21599673 | 21599657 | 21599652 | - |
| SEQ ID NO 25858 | CTGATGTGGATAAGCCGGTGGG | TTA | chr12 | 21599648 | 21599669 | 21599653 | 21599648 | - |
| SEQ ID NO 25859 | ATGTGGATAAGCCGGTGGCCA | CTG | chr12 | 21599645 | 21599666 | 21599650 | 21599645 | - |
| SEQ ID NO 25860 | AAGCTGTTATCACACCATGTGA | CTC | chr12 | 21599608 | 21599629 | 21599613 | 21599608 | - |
| SEQ ID NO 25861 | TTATCACACCATGTGAAACACA | CTG | chr12 | 21599602 | 21599623 | 21599607 | 21599602 | - |
| SEQ ID NO 25862 | TCACACCATGTGAAACACACGA | TTA | chr12 | 21599599 | 21599620 | 21599604 | 21599599 | - |
| SEQ ID NO 25863 | TGTAAAAACTATGCTTGGTTGC | CTA | chr12 | 21599573 | 21599594 | 21599578 | 21599573 | - |
| SEQ ID NO 25864 | TGCTTGGTTGCACAGCTTCAAG | CTA | chr12 | 21599562 | 21599583 | 21599567 | 21599562 | - |
| SEQ ID NO 25865 | GGTTGCACAGCTTCAAGGAAAG | CTT | chr12 | 21599557 | 21599578 | 21599562 | 21599557 | - |
| SEQ ID NO 25866 | GTTGCACAGCTTCAAGGAAAGC | TTG | chr12 | 21599556 | 21599577 | 21599561 | 21599556 | - |
| SEQ ID NO 25867 | CACAGCTTCAAGGAAAGCACTA | TTG | chr12 | 21599552 | 21599573 | 21599557 | 21599552 | - |
| SEQ ID NO 25868 | CAAGGAAAGCACTAGTCTACTC | CTT | chr12 | 21599544 | 21599565 | 21599549 | 21599544 | - |
| SEQ ID NO 25869 | AAGGAAAGCACTAGTCTACTCA | TTC | chr12 | 21599543 | 21599564 | 21599548 | 21599543 | - |
| SEQ ID NO 25870 | GTCTACTCACTTCCTTTTCATT | CTA | chr12 | 21599530 | 21599551 | 21599535 | 21599530 | - |
| SEQ ID NO 25871 | CTCACTTCCTTTTCATTCAGCA | CTA | chr12 | 21599525 | 21599546 | 21599530 | 21599525 | - |
| SEQ ID NO 25872 | ACTTCCTTTTCATTCAGCATGC | CTC | chr12 | 21599522 | 21599543 | 21599527 | 21599522 | - |
| SEQ ID NO 25873 | CCTTTTCATTCAGCATGCTATG | CTT | chr12 | 21599518 | 21599539 | 21599523 | 21599518 | - |
| SEQ ID NO 25874 | CTTTTCATTCAGCATGCTATGT | TTC | chr12 | 21599517 | 21599538 | 21599522 | 21599517 | - |
| SEQ ID NO 25875 | TTCATTCAGCATGCTATGTCTA | CTT | chr12 | 21599514 | 21599535 | 21599519 | 21599514 | - |
| SEQ ID NO 25876 | TCATTCAGCATGCTATGTCTAG | TTT | chr12 | 21599513 | 21599534 | 21599518 | 21599513 | - |
| SEQ ID NO 25877 | CATTCAGCATGCTATGTCTAGG | TTT | chr12 | 21599512 | 21599533 | 21599517 | 21599512 | - |

Figure 48 (Cont'd)

| SEQ ID NO | Sequence | Codon | Chr | Pos1 | Pos2 | Pos3 | Pos4 | |
|---|---|---|---|---|---|---|---|---|
| SEQ ID NO 25878 | ATTCAGCATGCTATGTCTAGGC | TTC | chr12 | 21599511 | 21599532 | 21599516 | 21599511 | - |
| SEQ ID NO 25879 | AGCATGCTATGTCTAGGCCCCT | TTC | chr12 | 21599507 | 21599528 | 21599512 | 21599507 | - |
| SEQ ID NO 25880 | TGTCTAGGCCCCTTTCATATAA | CTA | chr12 | 21599498 | 21599519 | 21599503 | 21599498 | - |
| SEQ ID NO 25881 | GGCCCCTTTCATATAAAATATT | CTA | chr12 | 21599492 | 21599513 | 21599497 | 21599492 | - |
| SEQ ID NO 25882 | TCATATAAAATATTTGGAGCTG | CTT | chr12 | 21599484 | 21599505 | 21599489 | 21599484 | - |
| SEQ ID NO 25883 | CATATAAAATATTTGGAGCTGC | TTT | chr12 | 21599483 | 21599504 | 21599488 | 21599483 | - |
| SEQ ID NO 25884 | ATATAAAATATTTGGAGCTGCC | TTC | chr12 | 21599482 | 21599503 | 21599487 | 21599482 | - |
| SEQ ID NO 25885 | GGAGCTGCCATTGTAGGTAGTG | TTT | chr12 | 21599469 | 21599490 | 21599474 | 21599469 | - |
| SEQ ID NO 25886 | GAGCTGCCATTGTAGGTAGTGC | TTG | chr12 | 21599468 | 21599489 | 21599473 | 21599468 | - |
| SEQ ID NO 25887 | CCATTGTAGGTAGTGCAGGTGG | CTG | chr12 | 21599462 | 21599483 | 21599467 | 21599462 | - |
| SEQ ID NO 25888 | TAGGTAGTGCAGGTGGTCTTGT | TTG | chr12 | 21599456 | 21599477 | 21599461 | 21599456 | - |
| SEQ ID NO 25889 | GTTCAAAGTGTGAGTATCACCT | CTT | chr12 | 21599436 | 21599457 | 21599441 | 21599436 | - |
| SEQ ID NO 25890 | TTCAAAGTGTGAGTATCACCTC | TTG | chr12 | 21599435 | 21599456 | 21599440 | 21599435 | - |
| SEQ ID NO 25891 | AAAGTGTGAGTATCACCTCCCA | TTC | chr12 | 21599432 | 21599453 | 21599437 | 21599432 | - |
| SEQ ID NO 25892 | CCACTGCCAAGACTGCAGCTGC | CTC | chr12 | 21599413 | 21599434 | 21599418 | 21599413 | - |
| SEQ ID NO 25893 | CCAAGACTGCAGCTGCTTTGAT | CTG | chr12 | 21599407 | 21599428 | 21599412 | 21599407 | - |
| SEQ ID NO 25894 | CAGCTGCTTTGATTTTAACTGA | CTG | chr12 | 21599398 | 21599419 | 21599403 | 21599398 | - |
| SEQ ID NO 25895 | CTTTGATTTTAACTGAGGATCT | CTG | chr12 | 21599392 | 21599413 | 21599397 | 21599392 | - |
| SEQ ID NO 25896 | TGATTTTAACTGAGGATCTAGA | CTT | chr12 | 21599389 | 21599410 | 21599394 | 21599389 | - |
| SEQ ID NO 25897 | GATTTTAACTGAGGATCTAGAA | TTT | chr12 | 21599388 | 21599409 | 21599393 | 21599388 | - |
| SEQ ID NO 25898 | ATTTTAACTGAGGATCTAGAAA | TTG | chr12 | 21599387 | 21599408 | 21599392 | 21599387 | - |
| SEQ ID NO 25899 | TAACTGAGGATCTAGAAAAGTG | TTT | chr12 | 21599383 | 21599404 | 21599388 | 21599383 | - |
| SEQ ID NO 25900 | AACTGAGGATCTAGAAAAGTGC | TTT | chr12 | 21599382 | 21599403 | 21599387 | 21599382 | - |
| SEQ ID NO 25901 | ACTGAGGATCTAGAAAAGTGCT | TTA | chr12 | 21599381 | 21599402 | 21599386 | 21599381 | - |
| SEQ ID NO 25902 | AGGATCTAGAAAAGTGCTGGGA | CTG | chr12 | 21599377 | 21599398 | 21599382 | 21599377 | - |
| SEQ ID NO 25903 | GAAAAGTGCTGGGAACACAAAT | CTA | chr12 | 21599369 | 21599390 | 21599374 | 21599369 | - |
| SEQ ID NO 25904 | GGAACACAAATATTTGCTGACC | CTG | chr12 | 21599358 | 21599379 | 21599363 | 21599358 | - |
| SEQ ID NO 25905 | GCTGACCTTTGTCACAAGTAGC | TTT | chr12 | 21599343 | 21599364 | 21599348 | 21599343 | - |
| SEQ ID NO 25906 | CTGACCTTTGTCACAAGTAGCA | TTG | chr12 | 21599342 | 21599363 | 21599347 | 21599342 | - |
| SEQ ID NO 25907 | ACCTTTGTCACAAGTAGCACCT | CTG | chr12 | 21599339 | 21599360 | 21599344 | 21599339 | - |
| SEQ ID NO 25908 | TGTCACAAGTAGCACCTAATCT | CTT | chr12 | 21599334 | 21599355 | 21599339 | 21599334 | - |
| SEQ ID NO 25909 | GTCACAAGTAGCACCTAATCTC | TTT | chr12 | 21599333 | 21599354 | 21599338 | 21599333 | - |
| SEQ ID NO 25910 | TCACAAGTAGCACCTAATCTCC | TTG | chr12 | 21599332 | 21599353 | 21599337 | 21599332 | - |
| SEQ ID NO 25911 | ATCTCCTTCCTACCAGACCTGC | CTA | chr12 | 21599316 | 21599337 | 21599321 | 21599316 | - |
| SEQ ID NO 25912 | CTTCCTACCAGACCTGCTGCCT | CTC | chr12 | 21599311 | 21599332 | 21599316 | 21599311 | - |
| SEQ ID NO 25913 | CCTACCAGACCTGCTGCCTTAT | CTT | chr12 | 21599308 | 21599329 | 21599313 | 21599308 | - |
| SEQ ID NO 25914 | CTACCAGACCTGCTGCCTTATA | TTC | chr12 | 21599307 | 21599328 | 21599312 | 21599307 | - |
| SEQ ID NO 25915 | CCAGACCTGCTGCCTTATAAAA | CTA | chr12 | 21599304 | 21599325 | 21599309 | 21599304 | - |
| SEQ ID NO 25916 | CTGCCTTATAAAATGATGTTCT | CTG | chr12 | 21599295 | 21599316 | 21599300 | 21599295 | - |
| SEQ ID NO 25917 | CCTTATAAAATGATGTTCTAAG | CTG | chr12 | 21599292 | 21599313 | 21599297 | 21599292 | - |
| SEQ ID NO 25918 | ATAAAATGATGTTCTAAGTGTA | CTT | chr12 | 21599288 | 21599309 | 21599293 | 21599288 | - |
| SEQ ID NO 25919 | TAAAATGATGTTCTAAGTGTAT | TTA | chr12 | 21599287 | 21599308 | 21599292 | 21599287 | - |
| SEQ ID NO 25920 | TAAGTGTATAATGACTTCCTCT | TTC | chr12 | 21599274 | 21599295 | 21599279 | 21599274 | - |
| SEQ ID NO 25921 | AGTGTATAATGACTTCCTCTGC | CTA | chr12 | 21599272 | 21599293 | 21599277 | 21599272 | - |
| SEQ ID NO 25922 | CCTCTGCTTCTGCAACTGTGTT | CTT | chr12 | 21599257 | 21599278 | 21599262 | 21599257 | - |
| SEQ ID NO 25923 | CTCTGCTTCTGCAACTGTGTTT | TTC | chr12 | 21599256 | 21599277 | 21599261 | 21599256 | - |
| SEQ ID NO 25924 | TGCTTCTGCAACTGTGTTTTGG | CTC | chr12 | 21599253 | 21599274 | 21599258 | 21599253 | - |
| SEQ ID NO 25925 | CTTCTGCAACTGTGTTTTGGAA | CTG | chr12 | 21599251 | 21599272 | 21599256 | 21599251 | - |
| SEQ ID NO 25926 | CTGCAACTGTGTTTTGGAACAG | CTT | chr12 | 21599248 | 21599269 | 21599253 | 21599248 | - |
| SEQ ID NO 25927 | TGCAACTGTGTTTTGGAACAGG | TTC | chr12 | 21599247 | 21599268 | 21599252 | 21599247 | - |
| SEQ ID NO 25928 | CAACTGTGTTTTGGAACAGGAG | CTG | chr12 | 21599245 | 21599266 | 21599250 | 21599245 | - |
| SEQ ID NO 25929 | TGTTTTGGAACAGGAGGGTGAG | CTG | chr12 | 21599239 | 21599260 | 21599244 | 21599239 | - |
| SEQ ID NO 25930 | TGGAACAGGAGGGTGAGATTAG | TTT | chr12 | 21599234 | 21599255 | 21599239 | 21599234 | - |
| SEQ ID NO 25931 | GGAACAGGAGGGTGAGATTAGT | TTT | chr12 | 21599233 | 21599254 | 21599238 | 21599233 | - |
| SEQ ID NO 25932 | GAACAGGAGGGTGAGATTAGTA | TTG | chr12 | 21599232 | 21599253 | 21599237 | 21599232 | - |
| SEQ ID NO 25933 | GTAGCCACACACACTGAAATAG | TTA | chr12 | 21599213 | 21599234 | 21599218 | 21599213 | - |
| SEQ ID NO 25934 | AAATAGTCATATGACTTCCAAA | CTG | chr12 | 21599197 | 21599218 | 21599202 | 21599197 | - |
| SEQ ID NO 25935 | CCAAAGTCTGTAATTTTTAAGC | CTT | chr12 | 21599180 | 21599201 | 21599185 | 21599180 | - |

Figure 48 (Cont'd)

| SEQ ID NO 25936 | CAAAGTCTGTAATTTTTAAGCA | TTC | chr12 | 21599179 | 21599200 | 21599184 | 21599179 | - |
|---|---|---|---|---|---|---|---|---|
| SEQ ID NO 25937 | TAATTTTTAAGCATATACAAAA | CTG | chr12 | 21599170 | 21599191 | 21599175 | 21599170 | - |
| SEQ ID NO 25938 | TTAAGCATATACAAAATAGTGA | TTT | chr12 | 21599164 | 21599185 | 21599169 | 21599164 | - |
| SEQ ID NO 25939 | TAAGCATATACAAAATAGTGAA | TTT | chr12 | 21599163 | 21599184 | 21599168 | 21599163 | - |
| SEQ ID NO 25940 | AAGCATATACAAAATAGTGAAA | TTT | chr12 | 21599162 | 21599183 | 21599167 | 21599162 | - |
| SEQ ID NO 25941 | AGCATATACAAAATAGTGAAAT | TTA | chr12 | 21599161 | 21599182 | 21599166 | 21599161 | - |
| SEQ ID NO 25942 | CTCCATATGTGTATAATATGTA | TTT | chr12 | 21599137 | 21599158 | 21599142 | 21599137 | - |
| SEQ ID NO 25943 | TCCATATGTGTATAATATGTAT | TTC | chr12 | 21599136 | 21599157 | 21599141 | 21599136 | - |
| SEQ ID NO 25944 | CATATGTGTATAATATGTATAT | CTC | chr12 | 21599134 | 21599155 | 21599139 | 21599134 | - |
| SEQ ID NO 25945 | ATTTTGGCTGATATCTATTCTA | CTT | chr12 | 21599021 | 21599042 | 21599026 | 21599021 | - |
| SEQ ID NO 25946 | TTTTGGCTGATATCTATTCTAT | TTA | chr12 | 21599020 | 21599041 | 21599025 | 21599020 | - |
| SEQ ID NO 25947 | TGGCTGATATCTATTCTATACT | TTT | chr12 | 21599017 | 21599038 | 21599022 | 21599017 | - |
| SEQ ID NO 25948 | GGCTGATATCTATTCTATACTT | TTT | chr12 | 21599016 | 21599037 | 21599021 | 21599016 | - |
| SEQ ID NO 25949 | GCTGATATCTATTCTATACTTC | TTG | chr12 | 21599015 | 21599036 | 21599020 | 21599015 | - |
| SEQ ID NO 25950 | ATATCTATTCTATACTTCTTTG | CTG | chr12 | 21599011 | 21599032 | 21599016 | 21599011 | - |
| SEQ ID NO 25951 | TTCTATACTTCTTTGAAATAGT | CTA | chr12 | 21599004 | 21599025 | 21599009 | 21599004 | - |
| SEQ ID NO 25952 | TATACTTCTTTGAAATAGTGAT | TTC | chr12 | 21599001 | 21599022 | 21599006 | 21599001 | - |
| SEQ ID NO 25953 | TACTTCTTTGAAATAGTGATTT | CTA | chr12 | 21598999 | 21599020 | 21599004 | 21598999 | - |
| SEQ ID NO 25954 | CTTTGAAATAGTGATTTTTAGT | CTT | chr12 | 21598994 | 21599015 | 21598999 | 21598994 | - |
| SEQ ID NO 25955 | TTTGAAATAGTGATTTTTAGTA | TTC | chr12 | 21598993 | 21599014 | 21598998 | 21598993 | - |
| SEQ ID NO 25956 | TGAAATAGTGATTTTTAGTAAA | CTT | chr12 | 21598991 | 21599012 | 21598996 | 21598991 | - |
| SEQ ID NO 25957 | GAAATAGTGATTTTTAGTAAAT | TTT | chr12 | 21598990 | 21599011 | 21598995 | 21598990 | - |
| SEQ ID NO 25958 | AAATAGTGATTTTTAGTAAATT | TTG | chr12 | 21598989 | 21599010 | 21598994 | 21598989 | - |
| SEQ ID NO 25959 | TTAGTAAATTGGCAGTGTTGCC | TTT | chr12 | 21598977 | 21598998 | 21598982 | 21598977 | - |
| SEQ ID NO 25960 | TAGTAAATTGGCAGTGTTGCCA | TTT | chr12 | 21598976 | 21598997 | 21598981 | 21598976 | - |
| SEQ ID NO 25961 | AGTAAATTGGCAGTGTTGCCAG | TTT | chr12 | 21598975 | 21598996 | 21598980 | 21598975 | - |
| SEQ ID NO 25962 | GTAAATTGGCAGTGTTGCCAGA | TTA | chr12 | 21598974 | 21598995 | 21598979 | 21598974 | - |
| SEQ ID NO 25963 | GCAGTGTTGCCAGATGACGACT | TTG | chr12 | 21598966 | 21598987 | 21598971 | 21598966 | - |
| SEQ ID NO 25964 | CCAGATGACGACTTAGAGTTTT | TTG | chr12 | 21598957 | 21598978 | 21598962 | 21598957 | - |
| SEQ ID NO 25965 | AGAGTTTTAACCACCTCATTGT | CTT | chr12 | 21598943 | 21598964 | 21598948 | 21598943 | - |
| SEQ ID NO 25966 | GAGTTTTAACCACCTCATTGTT | TTA | chr12 | 21598942 | 21598963 | 21598947 | 21598942 | - |
| SEQ ID NO 25967 | TAACCACCTCATTGTTATATGT | TTT | chr12 | 21598936 | 21598957 | 21598941 | 21598936 | - |
| SEQ ID NO 25968 | AACCACCTCATTGTTATATGTA | TTT | chr12 | 21598935 | 21598956 | 21598940 | 21598935 | - |
| SEQ ID NO 25969 | ACCACCTCATTGTTATATGTAC | TTA | chr12 | 21598934 | 21598955 | 21598939 | 21598934 | - |
| SEQ ID NO 25970 | ATTGTTATATGTACCATGGTAG | CTC | chr12 | 21598926 | 21598947 | 21598931 | 21598926 | - |
| SEQ ID NO 25971 | TTATATGTACCATGGTAGCTCA | TTG | chr12 | 21598922 | 21598943 | 21598927 | 21598922 | - |
| SEQ ID NO 25972 | TATGTACCATGGTAGCTCATCT | TTA | chr12 | 21598919 | 21598940 | 21598924 | 21598919 | - |
| SEQ ID NO 25973 | ATCTTTTCTTTCAGGTGAAAGT | CTC | chr12 | 21598901 | 21598922 | 21598906 | 21598901 | - |
| SEQ ID NO 25974 | TTCTTTCAGGTGAAAGTTGTGA | CTT | chr12 | 21598896 | 21598917 | 21598901 | 21598896 | - |
| SEQ ID NO 25975 | TCTTTCAGGTGAAAGTTGTGAT | TTT | chr12 | 21598895 | 21598916 | 21598900 | 21598895 | - |
| SEQ ID NO 25976 | CTTTCAGGTGAAAGTTGTGATA | TTT | chr12 | 21598894 | 21598915 | 21598899 | 21598894 | - |
| SEQ ID NO 25977 | TTTCAGGTGAAAGTTGTGATAC | TTC | chr12 | 21598893 | 21598914 | 21598898 | 21598893 | - |
| SEQ ID NO 25978 | TCAGGTGAAAGTTGTGATACTT | CTT | chr12 | 21598891 | 21598912 | 21598896 | 21598891 | - |
| SEQ ID NO 25979 | CAGGTGAAAGTTGTGATACTTT | TTT | chr12 | 21598890 | 21598911 | 21598895 | 21598890 | - |
| SEQ ID NO 25980 | AGGTGAAAGTTGTGATACTTTG | TTC | chr12 | 21598889 | 21598910 | 21598894 | 21598889 | - |
| SEQ ID NO 25981 | TGATACTTTGTCCTCACGCTAA | TTG | chr12 | 21598877 | 21598898 | 21598882 | 21598877 | - |
| SEQ ID NO 25982 | TGTCCTCACGCTAAACATAGCC | CTT | chr12 | 21598869 | 21598890 | 21598874 | 21598869 | - |
| SEQ ID NO 25983 | GTCCTCACGCTAAACATAGCCC | TTT | chr12 | 21598868 | 21598889 | 21598873 | 21598868 | - |
| SEQ ID NO 25984 | TCCTCACGCTAAACATAGCCCC | TTG | chr12 | 21598867 | 21598888 | 21598872 | 21598867 | - |
| SEQ ID NO 25985 | ACGCTAAACATAGCCCCATGT | CTC | chr12 | 21598862 | 21598883 | 21598867 | 21598862 | - |
| SEQ ID NO 25986 | AACATAGCCCCATGTTGTTCC | CTA | chr12 | 21598856 | 21598877 | 21598861 | 21598856 | - |
| SEQ ID NO 25987 | TTCCAGGAAAATAGAGATCAAT | TTG | chr12 | 21598838 | 21598859 | 21598843 | 21598838 | - |
| SEQ ID NO 25988 | CAGGAAAATAGAGATCAATAAA | TTC | chr12 | 21598835 | 21598856 | 21598840 | 21598835 | - |
| SEQ ID NO 25989 | GTTTGAAAGTGAAGGTTAAGTT | CTT | chr12 | 21598800 | 21598821 | 21598805 | 21598800 | - |
| SEQ ID NO 25990 | TTTGAAAGTGAAGGTTAAGTTC | TTG | chr12 | 21598799 | 21598820 | 21598804 | 21598799 | - |
| SEQ ID NO 25991 | GAAAGTGAAGGTTAAGTTCAAA | TTT | chr12 | 21598796 | 21598817 | 21598801 | 21598796 | - |
| SEQ ID NO 25992 | AAAGTGAAGGTTAAGTTCAAAT | TTG | chr12 | 21598795 | 21598816 | 21598800 | 21598795 | - |
| SEQ ID NO 25993 | AGTTCAAATTCAATGACCTACG | TTA | chr12 | 21598782 | 21598803 | 21598787 | 21598782 | - |

Figure 48 (Cont'd)

| | | | | | | | | |
|---|---|---|---|---|---|---|---|---|
| SEQ ID NO 25994 | AAATTCAATGACCTACGCTGTG | TTC | chr12 | 21598777 | 21598798 | 21598782 | 21598777 | - |
| SEQ ID NO 25995 | AATGACCTACGCTGTGGTAAAA | TTC | chr12 | 21598771 | 21598792 | 21598776 | 21598771 | - |
| SEQ ID NO 25996 | CGCTGTGGTAAAACGATCATTC | CTA | chr12 | 21598762 | 21598783 | 21598767 | 21598762 | - |
| SEQ ID NO 25997 | TGGTAAAACGATCATTCATTAA | CTG | chr12 | 21598757 | 21598778 | 21598762 | 21598757 | - |
| SEQ ID NO 25998 | ATTAATGATATTAAGTATTTTC | TTC | chr12 | 21598740 | 21598761 | 21598745 | 21598740 | - |
| SEQ ID NO 25999 | ATGATATTAAGTATTTTCTTTT | TTA | chr12 | 21598736 | 21598757 | 21598741 | 21598736 | - |
| SEQ ID NO 26000 | AGTATTTTCTTTTTTAATGTCA | TTA | chr12 | 21598727 | 21598748 | 21598732 | 21598727 | - |
| SEQ ID NO 26001 | TCTTTTTTAATGTCAGAATAAA | TTT | chr12 | 21598720 | 21598741 | 21598725 | 21598720 | - |
| SEQ ID NO 26002 | CTTTTTTAATGTCAGAATAAAA | TTT | chr12 | 21598719 | 21598740 | 21598724 | 21598719 | - |
| SEQ ID NO 26003 | TTTTTTAATGTCAGAATAAAAC | TTC | chr12 | 21598718 | 21598739 | 21598723 | 21598718 | - |
| SEQ ID NO 26004 | TTTTAATGTCAGAATAAAACCA | CTT | chr12 | 21598716 | 21598737 | 21598721 | 21598716 | - |
| SEQ ID NO 26005 | TTTAATGTCAGAATAAAACCAT | TTT | chr12 | 21598715 | 21598736 | 21598720 | 21598715 | - |
| SEQ ID NO 26006 | TTAATGTCAGAATAAAACCATT | TTT | chr12 | 21598714 | 21598735 | 21598719 | 21598714 | - |
| SEQ ID NO 26007 | TAATGTCAGAATAAAACCATTT | TTT | chr12 | 21598713 | 21598734 | 21598718 | 21598713 | - |
| SEQ ID NO 26008 | AATGTCAGAATAAAACCATTTA | TTT | chr12 | 21598712 | 21598733 | 21598717 | 21598712 | - |
| SEQ ID NO 26009 | ATGTCAGAATAAAACCATTTAT | TTA | chr12 | 21598711 | 21598732 | 21598716 | 21598711 | - |
| SEQ ID NO 26010 | ATTTGCAGATTTAAAAATATAT | TTT | chr12 | 21598691 | 21598712 | 21598696 | 21598691 | - |
| SEQ ID NO 26011 | TTTGCAGATTTAAAAATATATA | TTA | chr12 | 21598690 | 21598711 | 21598695 | 21598690 | - |
| SEQ ID NO 26012 | GCAGATTTAAAAATATATATGT | TTT | chr12 | 21598687 | 21598708 | 21598692 | 21598687 | - |
| SEQ ID NO 26013 | CAGATTTAAAAATATATATGTG | TTG | chr12 | 21598686 | 21598707 | 21598691 | 21598686 | - |
| SEQ ID NO 26014 | AAAAATATATATGTGTATGTAA | TTT | chr12 | 21598679 | 21598700 | 21598684 | 21598679 | - |
| SEQ ID NO 26015 | AAAATATATATGTGTATGTAAA | TTA | chr12 | 21598678 | 21598699 | 21598683 | 21598678 | - |
| SEQ ID NO 26016 | CTTGGTTTATACCTCAAATATG | CTC | chr12 | 21598652 | 21598673 | 21598657 | 21598652 | - |
| SEQ ID NO 26017 | GGTTTATACCTCAAATATGAAA | CTT | chr12 | 21598649 | 21598670 | 21598654 | 21598649 | - |
| SEQ ID NO 26018 | GTTTATACCTCAAATATGAAAA | TTG | chr12 | 21598648 | 21598669 | 21598653 | 21598648 | - |
| SEQ ID NO 26019 | ATACCTCAAATATGAAAATAGG | TTT | chr12 | 21598644 | 21598665 | 21598649 | 21598644 | - |
| SEQ ID NO 26020 | TACCTCAAATATGAAAATAGGA | TTA | chr12 | 21598643 | 21598664 | 21598648 | 21598643 | - |
| SEQ ID NO 26021 | AAATATGAAAATAGGAATGACC | CTC | chr12 | 21598637 | 21598658 | 21598642 | 21598637 | - |
| SEQ ID NO 26022 | TCTCTATGCTCTTGCATTCACT | CTG | chr12 | 21598612 | 21598633 | 21598617 | 21598612 | - |
| SEQ ID NO 26023 | TATGCTCTTGCATTCACTTATA | CTC | chr12 | 21598608 | 21598629 | 21598613 | 21598608 | - |
| SEQ ID NO 26024 | TGCTCTTGCATTCACTTATATT | CTA | chr12 | 21598606 | 21598627 | 21598611 | 21598606 | - |
| SEQ ID NO 26025 | TTGCATTCACTTATATTCTAGC | CTC | chr12 | 21598601 | 21598622 | 21598606 | 21598601 | - |
| SEQ ID NO 26026 | GCATTCACTTATATTCTAGCTT | CTT | chr12 | 21598599 | 21598620 | 21598604 | 21598599 | - |
| SEQ ID NO 26027 | CATTCACTTATATTCTAGCTTG | TTG | chr12 | 21598598 | 21598619 | 21598603 | 21598598 | - |
| SEQ ID NO 26028 | ACTTATATTCTAGCTTGTTAAG | TTC | chr12 | 21598593 | 21598614 | 21598598 | 21598593 | - |
| SEQ ID NO 26029 | ATATTCTAGCTTGTTAAGAGAG | CTT | chr12 | 21598589 | 21598610 | 21598594 | 21598589 | - |
| SEQ ID NO 26030 | TATTCTAGCTTGTTAAGAGAGA | TTA | chr12 | 21598588 | 21598609 | 21598593 | 21598588 | - |
| SEQ ID NO 26031 | TAGCTTGTTAAGAGAGAAGTTT | TTC | chr12 | 21598583 | 21598604 | 21598588 | 21598583 | - |
| SEQ ID NO 26032 | GCTTGTTAAGAGAGAAGTTTGG | CTA | chr12 | 21598581 | 21598602 | 21598586 | 21598581 | - |
| SEQ ID NO 26033 | GTTAAGAGAGAAGTTTGGGGCA | CTT | chr12 | 21598577 | 21598598 | 21598582 | 21598577 | - |
| SEQ ID NO 26034 | TTAAGAGAGAAGTTTGGGGCAA | TTG | chr12 | 21598576 | 21598597 | 21598581 | 21598576 | - |
| SEQ ID NO 26035 | AGAGAGAAGTTTGGGGCAAAAT | TTA | chr12 | 21598573 | 21598594 | 21598578 | 21598573 | - |
| SEQ ID NO 26036 | GGGGCAAAATGTGCTTTATAAA | TTT | chr12 | 21598561 | 21598582 | 21598566 | 21598561 | - |
| SEQ ID NO 26037 | GGGCAAAATGTGCTTTATAAAT | TTG | chr12 | 21598560 | 21598581 | 21598565 | 21598560 | - |
| SEQ ID NO 26038 | TATAAATAGTAAAAACTGAGGT | CTT | chr12 | 21598545 | 21598566 | 21598550 | 21598545 | - |
| SEQ ID NO 26039 | ATAAATAGTAAAAACTGAGGTA | TTT | chr12 | 21598544 | 21598565 | 21598549 | 21598544 | - |
| SEQ ID NO 26040 | TAAATAGTAAAAACTGAGGTAA | TTA | chr12 | 21598543 | 21598564 | 21598548 | 21598543 | - |
| SEQ ID NO 26041 | AGGTAAACTATAGCACAAAGTG | CTG | chr12 | 21598527 | 21598548 | 21598532 | 21598527 | - |
| SEQ ID NO 26042 | TAGCACAAAGTGTGCTATATAA | CTA | chr12 | 21598517 | 21598538 | 21598522 | 21598517 | - |
| SEQ ID NO 26043 | TATAAACAGTAAAAACCGAGGT | CTA | chr12 | 21598500 | 21598521 | 21598505 | 21598500 | - |
| SEQ ID NO 26044 | AAATGGTGTTGGAATATAAGAA | CTA | chr12 | 21598449 | 21598470 | 21598454 | 21598449 | - |
| SEQ ID NO 26045 | GAATATAAGAAATAGCAGTAAA | TTG | chr12 | 21598438 | 21598459 | 21598443 | 21598438 | - |
| SEQ ID NO 26046 | CTCACAGCAAGACAGTACAGGG | CTC | chr12 | 21598408 | 21598429 | 21598413 | 21598408 | - |
| SEQ ID NO 26047 | ACAGCAAGACAGTACAGGGAAA | CTC | chr12 | 21598405 | 21598426 | 21598410 | 21598405 | - |
| SEQ ID NO 26048 | GAGGGACAAAGATTTACTTACA | CTG | chr12 | 21598377 | 21598398 | 21598382 | 21598377 | - |
| SEQ ID NO 26049 | ACTTACAATCAGGCCTCAACCA | TTT | chr12 | 21598362 | 21598383 | 21598367 | 21598362 | - |
| SEQ ID NO 26050 | CTTACAATCAGGCCTCAACCAA | TTA | chr12 | 21598361 | 21598382 | 21598366 | 21598361 | - |
| SEQ ID NO 26051 | ACAATCAGGCCTCAACCAATAT | CTT | chr12 | 21598358 | 21598379 | 21598363 | 21598358 | - |

Figure 48 (Cont'd)

| | | | | | | | | |
|---|---|---|---|---|---|---|---|---|
| SEQ ID NO 26052 | CAATCAGGCCTCAACCAATATG | TTA | chr12 | 21598357 | 21598378 | 21598362 | 21598357 | - |
| SEQ ID NO 26053 | AACCAATATGAGATCGACTTTC | CTC | chr12 | 21598345 | 21598366 | 21598350 | 21598345 | - |
| SEQ ID NO 26054 | TCTTTTATTGATATATGACGTG | CTT | chr12 | 21598325 | 21598346 | 21598330 | 21598325 | - |
| SEQ ID NO 26055 | CTTTTATTGATATATGACGTGT | TTT | chr12 | 21598324 | 21598345 | 21598329 | 21598324 | - |
| SEQ ID NO 26056 | TTTTATTGATATATGACGTGTT | TTC | chr12 | 21598323 | 21598344 | 21598328 | 21598323 | - |
| SEQ ID NO 26057 | TTATTGATATATGACGTGTTTA | CTT | chr12 | 21598321 | 21598342 | 21598326 | 21598321 | - |
| SEQ ID NO 26058 | TATTGATATATGACGTGTTTAT | TTT | chr12 | 21598320 | 21598341 | 21598325 | 21598320 | - |
| SEQ ID NO 26059 | ATTGATATATGACGTGTTTATA | TTT | chr12 | 21598319 | 21598340 | 21598324 | 21598319 | - |
| SEQ ID NO 26060 | TTGATATATGACGTGTTTATAT | TTA | chr12 | 21598318 | 21598339 | 21598323 | 21598318 | - |
| SEQ ID NO 26061 | ATATATGACGTGTTTATATGTA | TTG | chr12 | 21598315 | 21598336 | 21598320 | 21598315 | - |
| SEQ ID NO 26062 | ATATGTATCAGGTACATGTGAC | TTT | chr12 | 21598300 | 21598321 | 21598305 | 21598300 | - |
| SEQ ID NO 26063 | TATGTATCAGGTACATGTGACA | TTA | chr12 | 21598299 | 21598320 | 21598304 | 21598299 | - |
| SEQ ID NO 26064 | TGTTACATGCATATAATGTATA | TTT | chr12 | 21598274 | 21598295 | 21598279 | 21598274 | - |
| SEQ ID NO 26065 | GTTACATGCATATAATGTATAA | TTT | chr12 | 21598273 | 21598294 | 21598278 | 21598273 | - |
| SEQ ID NO 26066 | TTACATGCATATAATGTATAAT | TTG | chr12 | 21598272 | 21598293 | 21598277 | 21598272 | - |
| SEQ ID NO 26067 | CATGCATATAATGTATAATGAT | TTA | chr12 | 21598269 | 21598290 | 21598274 | 21598269 | - |
| SEQ ID NO 26068 | GGGGTATTCATCACCTCAAGTA | TTT | chr12 | 21598233 | 21598254 | 21598238 | 21598233 | - |
| SEQ ID NO 26069 | GGGTATTCATCACCTCAAGTAT | TTG | chr12 | 21598232 | 21598253 | 21598237 | 21598232 | - |
| SEQ ID NO 26070 | ATCACCTCAAGTATTTATCGTT | TTC | chr12 | 21598224 | 21598245 | 21598229 | 21598224 | - |
| SEQ ID NO 26071 | AAGTATTTATCGTTTCTATGTG | CTC | chr12 | 21598216 | 21598237 | 21598221 | 21598216 | - |
| SEQ ID NO 26072 | ATCGTTTCTATGTGTTAGGAAC | TTT | chr12 | 21598208 | 21598229 | 21598213 | 21598208 | - |
| SEQ ID NO 26073 | TCGTTTCTATGTGTTAGGAACA | TTA | chr12 | 21598207 | 21598228 | 21598212 | 21598207 | - |
| SEQ ID NO 26074 | CTATGTGTTAGGAACATTTCAA | TTT | chr12 | 21598201 | 21598222 | 21598206 | 21598201 | - |
| SEQ ID NO 26075 | TATGTGTTAGGAACATTTCAAG | TTC | chr12 | 21598200 | 21598221 | 21598205 | 21598200 | - |
| SEQ ID NO 26076 | TGTGTTAGGAACATTTCAAGAC | CTA | chr12 | 21598198 | 21598219 | 21598203 | 21598198 | - |
| SEQ ID NO 26077 | GGAACATTTCAAGACCTTTCTT | TTA | chr12 | 21598191 | 21598212 | 21598196 | 21598191 | - |
| SEQ ID NO 26078 | CAAGACCTTTCTTCTACTATTT | TTT | chr12 | 21598182 | 21598203 | 21598187 | 21598182 | - |
| SEQ ID NO 26079 | AAGACCTTTCTTCTACTATTTT | TTC | chr12 | 21598181 | 21598202 | 21598186 | 21598181 | - |
| SEQ ID NO 26080 | TCTTCTACTATTTTGAAATATA | CTT | chr12 | 21598173 | 21598194 | 21598178 | 21598173 | - |
| SEQ ID NO 26081 | CTTCTACTATTTTGAAATATAC | TTT | chr12 | 21598172 | 21598193 | 21598177 | 21598172 | - |
| SEQ ID NO 26082 | TTCTACTATTTTGAAATATACA | TTC | chr12 | 21598171 | 21598192 | 21598176 | 21598171 | - |
| SEQ ID NO 26083 | CTACTATTTTGAAATATACAAT | CTT | chr12 | 21598169 | 21598190 | 21598174 | 21598169 | - |
| SEQ ID NO 26084 | TACTATTTTGAAATATACAATA | TTC | chr12 | 21598168 | 21598189 | 21598173 | 21598168 | - |
| SEQ ID NO 26085 | CTATTTTGAAATATACAATATA | CTA | chr12 | 21598166 | 21598187 | 21598171 | 21598166 | - |
| SEQ ID NO 26086 | TTTTGAAATATACAATATATTG | CTA | chr12 | 21598163 | 21598184 | 21598168 | 21598163 | - |
| SEQ ID NO 26087 | TGAAATATACAATATATTGTTT | TTT | chr12 | 21598160 | 21598181 | 21598165 | 21598160 | - |
| SEQ ID NO 26088 | GAAATATACAATATATTGTTTT | TTT | chr12 | 21598159 | 21598180 | 21598164 | 21598159 | - |
| SEQ ID NO 26089 | AAATATACAATATATTGTTTTT | TTG | chr12 | 21598158 | 21598179 | 21598163 | 21598158 | - |
| SEQ ID NO 26090 | TTTTTAACTATAATCACCCTAC | TTG | chr12 | 21598141 | 21598162 | 21598146 | 21598141 | - |
| SEQ ID NO 26091 | TTAACTATAATCACCCTACTTT | TTT | chr12 | 21598138 | 21598159 | 21598143 | 21598138 | - |
| SEQ ID NO 26092 | TAACTATAATCACCCTACTTTG | TTT | chr12 | 21598137 | 21598158 | 21598142 | 21598137 | - |
| SEQ ID NO 26093 | AACTATAATCACCCTACTTTGC | TTT | chr12 | 21598136 | 21598157 | 21598141 | 21598136 | - |
| SEQ ID NO 26094 | ACTATAATCACCCTACTTTGCT | TTA | chr12 | 21598135 | 21598156 | 21598140 | 21598135 | - |
| SEQ ID NO 26095 | TAATCACCCTACTTTGCTATTG | CTA | chr12 | 21598131 | 21598152 | 21598136 | 21598131 | - |
| SEQ ID NO 26096 | CTTTGCTATTGAACATCAGAAC | CTA | chr12 | 21598120 | 21598141 | 21598125 | 21598120 | - |
| SEQ ID NO 26097 | TGCTATTGAACATCAGAACATA | CTT | chr12 | 21598117 | 21598138 | 21598122 | 21598117 | - |
| SEQ ID NO 26098 | GCTATTGAACATCAGAACATAT | TTT | chr12 | 21598116 | 21598137 | 21598121 | 21598116 | - |
| SEQ ID NO 26099 | CTATTGAACATCAGAACATATT | TTG | chr12 | 21598115 | 21598136 | 21598120 | 21598115 | - |
| SEQ ID NO 26100 | TTGAACATCAGAACATATTCCT | CTA | chr12 | 21598112 | 21598133 | 21598117 | 21598112 | - |
| SEQ ID NO 26101 | AACATCAGAACATATTCCTTCT | TTG | chr12 | 21598109 | 21598130 | 21598114 | 21598109 | - |
| SEQ ID NO 26102 | CTTCTATCTAACTGCCTGTTTC | TTC | chr12 | 21598092 | 21598113 | 21598097 | 21598092 | - |
| SEQ ID NO 26103 | CTATCTAACTGCCTGTTTCCAT | CTT | chr12 | 21598089 | 21598110 | 21598094 | 21598089 | - |
| SEQ ID NO 26104 | TATCTAACTGCCTGTTTCCATT | TTC | chr12 | 21598088 | 21598109 | 21598093 | 21598088 | - |
| SEQ ID NO 26105 | TCTAACTGCCTGTTTCCATTAA | CTA | chr12 | 21598086 | 21598107 | 21598091 | 21598086 | - |
| SEQ ID NO 26106 | ACTGCCTGTTTCCATTAACCAA | CTA | chr12 | 21598082 | 21598103 | 21598087 | 21598082 | - |
| SEQ ID NO 26107 | CCTGTTTCCATTAACCAACTTC | CTG | chr12 | 21598078 | 21598099 | 21598083 | 21598078 | - |
| SEQ ID NO 26108 | TTTCCATTAACCAACTTCTCTT | CTG | chr12 | 21598074 | 21598095 | 21598079 | 21598074 | - |
| SEQ ID NO 26109 | CCATTAACCAACTTCTCTTCGT | TTT | chr12 | 21598071 | 21598092 | 21598076 | 21598071 | - |

Figure 48 (Cont'd)

| | | | | | | | | |
|---|---|---|---|---|---|---|---|---|
| SEQ ID NO 26110 | CATTAACCAACTTCTCTTCGTC | TTC | chr12 | 21598070 | 21598091 | 21598075 | 21598070 | - |
| SEQ ID NO 26111 | ACCAACTTCTCTTCGTCTCCCT | TTA | chr12 | 21598065 | 21598086 | 21598070 | 21598065 | - |
| SEQ ID NO 26112 | CTCTTCGTCTCCCTTCCTCCCA | CTT | chr12 | 21598057 | 21598078 | 21598062 | 21598057 | - |
| SEQ ID NO 26113 | TCTTCGTCTCCCTTCCTCCCAT | TTC | chr12 | 21598056 | 21598077 | 21598061 | 21598056 | - |
| SEQ ID NO 26114 | TTCGTCTCCCTTCCTCCCATAA | CTC | chr12 | 21598054 | 21598075 | 21598059 | 21598054 | - |
| SEQ ID NO 26115 | CGTCTCCCTTCCTCCCATAACG | CTT | chr12 | 21598052 | 21598073 | 21598057 | 21598052 | - |
| SEQ ID NO 26116 | GTCTCCCTTCCTCCCATAACGT | TTC | chr12 | 21598051 | 21598072 | 21598056 | 21598051 | - |
| SEQ ID NO 26117 | CCTTCCTCCCATAACGTACACA | CTC | chr12 | 21598046 | 21598067 | 21598051 | 21598046 | - |
| SEQ ID NO 26118 | CCTCCCATAACGTACACACCTT | CTT | chr12 | 21598042 | 21598063 | 21598047 | 21598042 | - |
| SEQ ID NO 26119 | CTCCCATAACGTACACACCTTT | TTC | chr12 | 21598041 | 21598062 | 21598046 | 21598041 | - |
| SEQ ID NO 26120 | CCATAACGTACACACCTTTCTC | CTC | chr12 | 21598038 | 21598059 | 21598043 | 21598038 | - |
| SEQ ID NO 26121 | TCTCTACCTCTGGTTTCTGTCA | CTT | chr12 | 21598020 | 21598041 | 21598025 | 21598020 | - |
| SEQ ID NO 26122 | CTCTACCTCTGGTTTCTGTCAT | TTT | chr12 | 21598019 | 21598040 | 21598024 | 21598019 | - |
| SEQ ID NO 26123 | TCTACCTCTGGTTTCTGTCATT | TTC | chr12 | 21598018 | 21598039 | 21598023 | 21598018 | - |
| SEQ ID NO 26124 | TACCTCTGGTTTCTGTCATTCT | CTC | chr12 | 21598016 | 21598037 | 21598021 | 21598016 | - |
| SEQ ID NO 26125 | CCTCTGGTTTCTGTCATTCTAC | CTA | chr12 | 21598014 | 21598035 | 21598019 | 21598014 | - |
| SEQ ID NO 26126 | TGGTTTCTGTCATTCTACTCTC | CTC | chr12 | 21598010 | 21598031 | 21598015 | 21598010 | - |
| SEQ ID NO 26127 | GTTTCTGTCATTCTACTCTCTA | CTG | chr12 | 21598008 | 21598029 | 21598013 | 21598008 | - |
| SEQ ID NO 26128 | CTGTCATTCTACTCTCTACCTA | TTT | chr12 | 21598004 | 21598025 | 21598009 | 21598004 | - |
| SEQ ID NO 26129 | TGTCATTCTACTCTCTACCTAC | TTC | chr12 | 21598003 | 21598024 | 21598008 | 21598003 | - |
| SEQ ID NO 26130 | TCATTCTACTCTCTACCTACAT | CTG | chr12 | 21598001 | 21598022 | 21598006 | 21598001 | - |
| SEQ ID NO 26131 | TACTCTCTACCTACATGATATT | TTC | chr12 | 21597995 | 21598016 | 21598000 | 21597995 | - |
| SEQ ID NO 26132 | CTCTCTACCTACATGATATTAA | CTA | chr12 | 21597993 | 21598014 | 21597998 | 21597993 | - |
| SEQ ID NO 26133 | TCTACCTACATGATATTAACTT | CTC | chr12 | 21597990 | 21598011 | 21597995 | 21597990 | - |
| SEQ ID NO 26134 | TACCTACATGATATTAACTTTT | CTC | chr12 | 21597988 | 21598009 | 21597993 | 21597988 | - |
| SEQ ID NO 26135 | CCTACATGATATTAACTTTTTT | CTA | chr12 | 21597986 | 21598007 | 21597991 | 21597986 | - |
| SEQ ID NO 26136 | CATGATATTAACTTTTTTAGCT | CTA | chr12 | 21597982 | 21598003 | 21597987 | 21597982 | - |
| SEQ ID NO 26137 | ACTTTTTTAGCTCCCACATATC | TTA | chr12 | 21597972 | 21597993 | 21597977 | 21597972 | - |
| SEQ ID NO 26138 | TTTTAGCTCCCACATATCAGTG | CTT | chr12 | 21597968 | 21597989 | 21597973 | 21597968 | - |
| SEQ ID NO 26139 | TTTAGCTCCCACATATCAGTGA | TTT | chr12 | 21597967 | 21597988 | 21597972 | 21597967 | - |
| SEQ ID NO 26140 | TTAGCTCCCACATATCAGTGAG | TTT | chr12 | 21597966 | 21597987 | 21597971 | 21597966 | - |
| SEQ ID NO 26141 | TAGCTCCCACATATCAGTGAGA | TTT | chr12 | 21597965 | 21597986 | 21597970 | 21597965 | - |
| SEQ ID NO 26142 | AGCTCCCACATATCAGTGAGAA | TTT | chr12 | 21597964 | 21597985 | 21597969 | 21597964 | - |
| SEQ ID NO 26143 | GCTCCCACATATCAGTGAGAAC | TTA | chr12 | 21597963 | 21597984 | 21597968 | 21597963 | - |
| SEQ ID NO 26144 | CCACATATCAGTGAGAACATGC | CTC | chr12 | 21597959 | 21597980 | 21597964 | 21597959 | - |
| SEQ ID NO 26145 | GTCTTTCTATGCCTGGCTTATT | TTT | chr12 | 21597930 | 21597951 | 21597935 | 21597930 | - |
| SEQ ID NO 26146 | TCTTTCTATGCCTGGCTTATTT | TTG | chr12 | 21597929 | 21597950 | 21597934 | 21597929 | - |
| SEQ ID NO 26147 | TCTATGCCTGGCTTATTTCGTT | CTT | chr12 | 21597925 | 21597946 | 21597930 | 21597925 | - |
| SEQ ID NO 26148 | CTATGCCTGGCTTATTTCGTTT | TTT | chr12 | 21597924 | 21597945 | 21597929 | 21597924 | - |
| SEQ ID NO 26149 | TATGCCTGGCTTATTTCGTTTA | TTC | chr12 | 21597923 | 21597944 | 21597928 | 21597923 | - |
| SEQ ID NO 26150 | TGCCTGGCTTATTTCGTTTAAC | CTA | chr12 | 21597921 | 21597942 | 21597926 | 21597921 | - |
| SEQ ID NO 26151 | GCTTATTTCGTTTAACATAATG | CTG | chr12 | 21597915 | 21597936 | 21597920 | 21597915 | - |
| SEQ ID NO 26152 | ATTTCGTTTAACATAATGACTT | CTT | chr12 | 21597911 | 21597932 | 21597916 | 21597911 | - |
| SEQ ID NO 26153 | TTTCGTTTAACATAATGACTTC | TTA | chr12 | 21597910 | 21597931 | 21597915 | 21597910 | - |
| SEQ ID NO 26154 | CGTTTAACATAATGACTTCCAG | TTT | chr12 | 21597907 | 21597928 | 21597912 | 21597907 | - |
| SEQ ID NO 26155 | GTTTAACATAATGACTTCCAGT | TTC | chr12 | 21597906 | 21597927 | 21597911 | 21597906 | - |
| SEQ ID NO 26156 | AACATAATGACTTCCAGTTTCA | TTT | chr12 | 21597902 | 21597923 | 21597907 | 21597902 | - |
| SEQ ID NO 26157 | ACATAATGACTTCCAGTTTCAT | TTA | chr12 | 21597901 | 21597922 | 21597906 | 21597901 | - |
| SEQ ID NO 26158 | CCAGTTTCATCCATGTTGCTGC | CTT | chr12 | 21597889 | 21597910 | 21597894 | 21597889 | - |
| SEQ ID NO 26159 | CAGTTTCATCCATGTTGCTGCA | TTC | chr12 | 21597888 | 21597909 | 21597893 | 21597888 | - |
| SEQ ID NO 26160 | CATCCATGTTGCTGCAAATGAA | TTT | chr12 | 21597882 | 21597903 | 21597887 | 21597882 | - |
| SEQ ID NO 26161 | ATCCATGTTGCTGCAAATGAAA | TTC | chr12 | 21597881 | 21597902 | 21597886 | 21597881 | - |
| SEQ ID NO 26162 | CTGCAAATGAAATGATTTTATA | TTG | chr12 | 21597871 | 21597892 | 21597876 | 21597871 | - |
| SEQ ID NO 26163 | CAAATGAAATGATTTTATATTT | CTG | chr12 | 21597868 | 21597889 | 21597873 | 21597868 | - |
| SEQ ID NO 26164 | TATATTTGTATGGTTGAATAAT | TTT | chr12 | 21597853 | 21597874 | 21597858 | 21597853 | - |
| SEQ ID NO 26165 | ATATTTGTATGGTTGAATAATA | TTT | chr12 | 21597852 | 21597873 | 21597857 | 21597852 | - |
| SEQ ID NO 26166 | TATTTGTATGGTTGAATAATAT | TTA | chr12 | 21597851 | 21597872 | 21597856 | 21597851 | - |
| SEQ ID NO 26167 | GTATGGTTGAATAATATTCAAT | TTT | chr12 | 21597846 | 21597867 | 21597851 | 21597846 | - |

Figure 48 (Cont'd)

| SEQ ID NO 26168 | TATGGTTGAATAATATTCAATT | TTG | chr12 | 21597845 | 21597866 | 21597850 | 21597845 | - |
|---|---|---|---|---|---|---|---|---|
| SEQ ID NO 26169 | AATAATATTCAATTGTGTGTAT | TTG | chr12 | 21597837 | 21597858 | 21597842 | 21597837 | - |
| SEQ ID NO 26170 | AATTGTGTGTATACACCACATT | TTC | chr12 | 21597827 | 21597848 | 21597832 | 21597827 | - |
| SEQ ID NO 26171 | TGTGTATACACCACATTTTCTT | TTG | chr12 | 21597822 | 21597843 | 21597827 | 21597822 | - |
| SEQ ID NO 26172 | TCTTCATTCATCCATTGATGGA | TTT | chr12 | 21597804 | 21597825 | 21597809 | 21597804 | - |
| SEQ ID NO 26173 | CTTCATTCATCCATTGATGGAC | TTT | chr12 | 21597803 | 21597824 | 21597808 | 21597803 | - |
| SEQ ID NO 26174 | TTCATTCATCCATTGATGGACA | TTC | chr12 | 21597802 | 21597823 | 21597807 | 21597802 | - |
| SEQ ID NO 26175 | CATTCATCCATTGATGGACACT | CTT | chr12 | 21597800 | 21597821 | 21597805 | 21597800 | - |
| SEQ ID NO 26176 | ATTCATCCATTGATGGACACTT | TTC | chr12 | 21597799 | 21597820 | 21597804 | 21597799 | - |
| SEQ ID NO 26177 | ATCCATTGATGGACACTTAGGT | TTC | chr12 | 21597795 | 21597816 | 21597800 | 21597795 | - |
| SEQ ID NO 26178 | ATGGACACTTAGGTTGATTCCA | TTG | chr12 | 21597787 | 21597808 | 21597792 | 21597787 | - |
| SEQ ID NO 26179 | AGGTTGATTCCATATCTTTGCT | CTT | chr12 | 21597777 | 21597798 | 21597782 | 21597777 | - |
| SEQ ID NO 26180 | GGTTGATTCCATATCTTTGCTA | TTA | chr12 | 21597776 | 21597797 | 21597781 | 21597776 | - |
| SEQ ID NO 26181 | ATTCCATATCTTTGCTAATGTG | TTG | chr12 | 21597771 | 21597792 | 21597776 | 21597771 | - |
| SEQ ID NO 26182 | CATATCTTTGCTAATGTGAATC | TTC | chr12 | 21597767 | 21597788 | 21597772 | 21597767 | - |
| SEQ ID NO 26183 | TGCTAATGTGAATCGTGCTGCA | CTT | chr12 | 21597759 | 21597780 | 21597764 | 21597759 | - |
| SEQ ID NO 26184 | GCTAATGTGAATCGTGCTGCAA | TTT | chr12 | 21597758 | 21597779 | 21597763 | 21597758 | - |
| SEQ ID NO 26185 | CTAATGTGAATCGTGCTGCAAT | TTG | chr12 | 21597757 | 21597778 | 21597762 | 21597757 | - |
| SEQ ID NO 26186 | ATGTGAATCGTGCTGCAATAAA | CTA | chr12 | 21597754 | 21597775 | 21597759 | 21597754 | - |
| SEQ ID NO 26187 | CAATAAACAGTGTGGTACCAGT | CTG | chr12 | 21597739 | 21597760 | 21597744 | 21597739 | - |
| SEQ ID NO 26188 | TTTATTATTCTGAATTCTTTTC | CTG | chr12 | 21597712 | 21597733 | 21597717 | 21597712 | - |
| SEQ ID NO 26189 | ATTATTCTGAATTCTTTTCCTT | TTT | chr12 | 21597709 | 21597730 | 21597714 | 21597709 | - |
| SEQ ID NO 26190 | TTATTCTGAATTCTTTTCCTTT | TTA | chr12 | 21597708 | 21597729 | 21597713 | 21597708 | - |
| SEQ ID NO 26191 | TTCTGAATTCTTTTCCTTTGGA | TTA | chr12 | 21597705 | 21597726 | 21597710 | 21597705 | - |
| SEQ ID NO 26192 | TGAATTCTTTTCCTTTGGATAA | TTC | chr12 | 21597702 | 21597723 | 21597707 | 21597702 | - |
| SEQ ID NO 26193 | AATTCTTTTCCTTTGGATAAAT | CTG | chr12 | 21597700 | 21597721 | 21597705 | 21597700 | - |
| SEQ ID NO 26194 | TTTTCCTTTGGATAAATACCCA | TTC | chr12 | 21597695 | 21597716 | 21597700 | 21597695 | - |
| SEQ ID NO 26195 | TTCCTTTGGATAAATACCCAGT | CTT | chr12 | 21597693 | 21597714 | 21597698 | 21597693 | - |
| SEQ ID NO 26196 | TCCTTTGGATAAATACCCAGTA | TTT | chr12 | 21597692 | 21597713 | 21597697 | 21597692 | - |
| SEQ ID NO 26197 | CCTTTGGATAAATACCCAGTAA | TTT | chr12 | 21597691 | 21597712 | 21597696 | 21597691 | - |
| SEQ ID NO 26198 | CTTTGGATAAATACCCAGTAAT | TTC | chr12 | 21597690 | 21597711 | 21597695 | 21597690 | - |
| SEQ ID NO 26199 | TGGATAAATACCCAGTAATAAG | CTT | chr12 | 21597687 | 21597708 | 21597692 | 21597687 | - |
| SEQ ID NO 26200 | GGATAAATACCCAGTAATAAGA | TTT | chr12 | 21597686 | 21597707 | 21597691 | 21597686 | - |
| SEQ ID NO 26201 | GATAAATACCCAGTAATAAGAT | TTG | chr12 | 21597685 | 21597706 | 21597690 | 21597685 | - |
| SEQ ID NO 26202 | CTGGATCTTATGATAGTTCAAT | TTG | chr12 | 21597661 | 21597682 | 21597666 | 21597661 | - |
| SEQ ID NO 26203 | GATCTTATGATAGTTCAATTTT | CTG | chr12 | 21597658 | 21597679 | 21597663 | 21597658 | - |
| SEQ ID NO 26204 | ATGATAGTTCAATTTTTAGCTT | CTT | chr12 | 21597652 | 21597673 | 21597657 | 21597652 | - |
| SEQ ID NO 26205 | TGATAGTTCAATTTTTAGCTTT | TTA | chr12 | 21597651 | 21597672 | 21597656 | 21597651 | - |
| SEQ ID NO 26206 | AATTTTTAGCTTTTTGGTAAAT | TTC | chr12 | 21597642 | 21597663 | 21597647 | 21597642 | - |
| SEQ ID NO 26207 | TTAGCTTTTTGGTAAATCTACA | TTT | chr12 | 21597637 | 21597658 | 21597642 | 21597637 | - |
| SEQ ID NO 26208 | TAGCTTTTTGGTAAATCTACAT | TTT | chr12 | 21597636 | 21597657 | 21597641 | 21597636 | - |
| SEQ ID NO 26209 | AGCTTTTTGGTAAATCTACATA | TTT | chr12 | 21597635 | 21597656 | 21597640 | 21597635 | - |
| SEQ ID NO 26210 | GCTTTTTGGTAAATCTACATAT | TTA | chr12 | 21597634 | 21597655 | 21597639 | 21597634 | - |
| SEQ ID NO 26211 | TTTGGTAAATCTACATATTGTT | CTT | chr12 | 21597630 | 21597651 | 21597635 | 21597630 | - |
| SEQ ID NO 26212 | TTGGTAAATCTACATATTGTTT | TTT | chr12 | 21597629 | 21597650 | 21597634 | 21597629 | - |
| SEQ ID NO 26213 | TGGTAAATCTACATATTGTTTT | TTT | chr12 | 21597628 | 21597649 | 21597633 | 21597628 | - |
| SEQ ID NO 26214 | GGTAAATCTACATATTGTTTTC | TTT | chr12 | 21597627 | 21597648 | 21597632 | 21597627 | - |
| SEQ ID NO 26215 | GTAAATCTACATATTGTTTTCC | TTG | chr12 | 21597626 | 21597647 | 21597631 | 21597626 | - |
| SEQ ID NO 26216 | CATATTGTTTTCCATAGTGGCT | CTA | chr12 | 21597617 | 21597638 | 21597622 | 21597617 | - |
| SEQ ID NO 26217 | TTTTCCATAGTGGCTATACTAA | TTG | chr12 | 21597610 | 21597631 | 21597615 | 21597610 | - |
| SEQ ID NO 26218 | TCCATAGTGGCTATACTAATTT | TTT | chr12 | 21597607 | 21597628 | 21597612 | 21597607 | - |
| SEQ ID NO 26219 | CCATAGTGGCTATACTAATTTG | TTT | chr12 | 21597606 | 21597627 | 21597611 | 21597606 | - |
| SEQ ID NO 26220 | CATAGTGGCTATACTAATTTGC | TTC | chr12 | 21597605 | 21597626 | 21597610 | 21597605 | - |
| SEQ ID NO 26221 | TACTAATTTGCATGCTTACCAA | CTA | chr12 | 21597594 | 21597615 | 21597599 | 21597594 | - |
| SEQ ID NO 26222 | ATTTGCATGCTTACCAATAGTG | CTA | chr12 | 21597589 | 21597610 | 21597594 | 21597589 | - |
| SEQ ID NO 26223 | GCATGCTTACCAATAGTGCCTA | TTT | chr12 | 21597585 | 21597606 | 21597590 | 21597585 | - |
| SEQ ID NO 26224 | CATGCTTACCAATAGTGCCTAC | TTG | chr12 | 21597584 | 21597605 | 21597589 | 21597584 | - |
| SEQ ID NO 26225 | ACCAATAGTGCCTACGAGTGCC | CTT | chr12 | 21597577 | 21597598 | 21597582 | 21597577 | - |

Figure 48 (Cont'd)

| | | | | | | | | | |
|---|---|---|---|---|---|---|---|---|---|
| SEQ ID NO 26226 | CCAATAGTGCCTACGAGTGCCT | TTA | chr12 | 21597576 | 21597597 | 21597581 | 21597576 | - |
| SEQ ID NO 26227 | CGAGTGCCTTTTCCTTCACATC | CTA | chr12 | 21597563 | 21597584 | 21597568 | 21597563 | - |
| SEQ ID NO 26228 | TTCCTTCACATCCTTGCCAGCA | CTT | chr12 | 21597553 | 21597574 | 21597558 | 21597553 | - |
| SEQ ID NO 26229 | TCCTTCACATCCTTGCCAGCAT | TTT | chr12 | 21597552 | 21597573 | 21597557 | 21597552 | - |
| SEQ ID NO 26230 | CCTTCACATCCTTGCCAGCATG | TTT | chr12 | 21597551 | 21597572 | 21597556 | 21597551 | - |
| SEQ ID NO 26231 | CTTCACATCCTTGCCAGCATGT | TTC | chr12 | 21597550 | 21597571 | 21597555 | 21597550 | - |
| SEQ ID NO 26232 | CACATCCTTGCCAGCATGTGTT | CTT | chr12 | 21597547 | 21597568 | 21597552 | 21597547 | - |
| SEQ ID NO 26233 | ACATCCTTGCCAGCATGTGTTA | TTC | chr12 | 21597546 | 21597567 | 21597551 | 21597546 | - |
| SEQ ID NO 26234 | GCCAGCATGTGTTATTTATTTA | CTT | chr12 | 21597538 | 21597559 | 21597543 | 21597538 | - |
| SEQ ID NO 26235 | CCAGCATGTGTTATTTATTTAT | TTG | chr12 | 21597537 | 21597558 | 21597542 | 21597537 | - |
| SEQ ID NO 26236 | TTTATTTATTAATTTATTTAAA | TTA | chr12 | 21597524 | 21597545 | 21597529 | 21597524 | - |
| SEQ ID NO 26237 | ATTTATTAATTTATTTAAATCA | TTT | chr12 | 21597521 | 21597542 | 21597526 | 21597521 | - |
| SEQ ID NO 26238 | TTTATTAATTTATTTAAATCAT | TTA | chr12 | 21597520 | 21597541 | 21597525 | 21597520 | - |
| SEQ ID NO 26239 | ATTAATTTATTTAAATCATGAT | TTT | chr12 | 21597517 | 21597538 | 21597522 | 21597517 | - |
| SEQ ID NO 26240 | TTAATTTATTTAAATCATGATG | TTA | chr12 | 21597516 | 21597537 | 21597521 | 21597516 | - |
| SEQ ID NO 26241 | ATTTATTTAAATCATGATGATT | TTA | chr12 | 21597513 | 21597534 | 21597518 | 21597513 | - |
| SEQ ID NO 26242 | ATTTAAATCATGATGATTCTAA | TTT | chr12 | 21597509 | 21597530 | 21597514 | 21597509 | - |
| SEQ ID NO 26243 | TTTAAATCATGATGATTCTAAC | TTA | chr12 | 21597508 | 21597529 | 21597513 | 21597508 | - |
| SEQ ID NO 26244 | AAATCATGATGATTCTAACTGG | TTT | chr12 | 21597505 | 21597526 | 21597510 | 21597505 | - |
| SEQ ID NO 26245 | AATCATGATGATTCTAACTGGC | TTA | chr12 | 21597504 | 21597525 | 21597509 | 21597504 | - |
| SEQ ID NO 26246 | TAACTGGCATAAGATGATATCT | TTC | chr12 | 21597490 | 21597511 | 21597495 | 21597490 | - |
| SEQ ID NO 26247 | ACTGGCATAAGATGATATCTCA | CTA | chr12 | 21597488 | 21597509 | 21597493 | 21597488 | - |
| SEQ ID NO 26248 | GCATAAGATGATATCTCATTGT | CTG | chr12 | 21597484 | 21597505 | 21597489 | 21597484 | - |
| SEQ ID NO 26249 | ATTGTGGTTTTGATTTGCATTT | CTC | chr12 | 21597467 | 21597488 | 21597472 | 21597467 | - |
| SEQ ID NO 26250 | TGGTTTTGATTTGCATTTCTCT | TTG | chr12 | 21597463 | 21597484 | 21597468 | 21597463 | - |
| SEQ ID NO 26251 | TGATTTGCATTTCTCTGATGAT | TTT | chr12 | 21597457 | 21597478 | 21597462 | 21597457 | - |
| SEQ ID NO 26252 | GATTTGCATTTCTCTGATGATT | TTT | chr12 | 21597456 | 21597477 | 21597461 | 21597456 | - |
| SEQ ID NO 26253 | ATTTGCATTTCTCTGATGATTA | TTG | chr12 | 21597455 | 21597476 | 21597460 | 21597455 | - |
| SEQ ID NO 26254 | GCATTTCTCTGATGATTAGTAA | TTT | chr12 | 21597451 | 21597472 | 21597456 | 21597451 | - |
| SEQ ID NO 26255 | CATTTCTCTGATGATTAGTAAT | TTG | chr12 | 21597450 | 21597471 | 21597455 | 21597450 | - |
| SEQ ID NO 26256 | CTCTGATGATTAGTAATGTTGA | TTT | chr12 | 21597445 | 21597466 | 21597450 | 21597445 | - |
| SEQ ID NO 26257 | TCTGATGATTAGTAATGTTGAG | TTC | chr12 | 21597444 | 21597465 | 21597449 | 21597444 | - |
| SEQ ID NO 26258 | TGATGATTAGTAATGTTGAGCA | CTC | chr12 | 21597442 | 21597463 | 21597447 | 21597442 | - |
| SEQ ID NO 26259 | ATGATTAGTAATGTTGAGCAAT | CTG | chr12 | 21597440 | 21597461 | 21597445 | 21597440 | - |
| SEQ ID NO 26260 | GTAATGTTGAGCAATTTCCCCA | TTA | chr12 | 21597433 | 21597454 | 21597438 | 21597433 | - |
| SEQ ID NO 26261 | AGCAATTTCCCCATACCCATTG | TTG | chr12 | 21597424 | 21597445 | 21597429 | 21597424 | - |
| SEQ ID NO 26262 | CCCCATACCCATTGTGCATTTG | TTT | chr12 | 21597416 | 21597437 | 21597421 | 21597416 | - |
| SEQ ID NO 26263 | CCCATACCCATTGTGCATTTGT | TTC | chr12 | 21597415 | 21597436 | 21597420 | 21597415 | - |
| SEQ ID NO 26264 | TGCATTTGTATGTCTTCTTTTG | TTG | chr12 | 21597402 | 21597423 | 21597407 | 21597402 | - |
| SEQ ID NO 26265 | GTATGTCTTCTTTTGAAAAATA | TTT | chr12 | 21597395 | 21597416 | 21597400 | 21597395 | - |
| SEQ ID NO 26266 | TATGTCTTCTTTTGAAAAATAT | TTG | chr12 | 21597394 | 21597415 | 21597399 | 21597394 | - |
| SEQ ID NO 26267 | CTTTTGAAAAATATCCTTTGCC | CTT | chr12 | 21597386 | 21597407 | 21597391 | 21597386 | - |
| SEQ ID NO 26268 | TTTTGAAAAATATCCTTTGCCA | TTC | chr12 | 21597385 | 21597406 | 21597390 | 21597385 | - |
| SEQ ID NO 26269 | TTGAAAAATATCCTTTGCCAAT | CTT | chr12 | 21597383 | 21597404 | 21597388 | 21597383 | - |
| SEQ ID NO 26270 | TGAAAAATATCCTTTGCCAATT | TTT | chr12 | 21597382 | 21597403 | 21597387 | 21597382 | - |
| SEQ ID NO 26271 | GAAAAATATCCTTTGCCAATTT | TTT | chr12 | 21597381 | 21597402 | 21597386 | 21597381 | - |
| SEQ ID NO 26272 | AAAAATATCCTTTGCCAATTTT | TTG | chr12 | 21597380 | 21597401 | 21597385 | 21597380 | - |
| SEQ ID NO 26273 | TGCCAATTTTTTAATGAGATTA | CTT | chr12 | 21597368 | 21597389 | 21597373 | 21597368 | - |
| SEQ ID NO 26274 | GCCAATTTTTTAATGAGATTAT | TTT | chr12 | 21597367 | 21597388 | 21597372 | 21597367 | - |
| SEQ ID NO 26275 | CCAATTTTTTAATGAGATTATT | TTG | chr12 | 21597366 | 21597387 | 21597371 | 21597366 | - |
| SEQ ID NO 26276 | TTTAATGAGATTATTTGTTTTT | TTT | chr12 | 21597359 | 21597380 | 21597364 | 21597359 | - |
| SEQ ID NO 26277 | TTAATGAGATTATTTGTTTTTC | TTT | chr12 | 21597358 | 21597379 | 21597363 | 21597358 | - |
| SEQ ID NO 26278 | TAATGAGATTATTTGTTTTTCC | TTT | chr12 | 21597357 | 21597378 | 21597362 | 21597357 | - |
| SEQ ID NO 26279 | AATGAGATTATTTGTTTTTCCA | TTT | chr12 | 21597356 | 21597377 | 21597361 | 21597356 | - |
| SEQ ID NO 26280 | ATGAGATTATTTGTTTTTCCAC | TTA | chr12 | 21597355 | 21597376 | 21597360 | 21597355 | - |
| SEQ ID NO 26281 | TTTGTTTTTCCACTGTTGAGTT | TTA | chr12 | 21597346 | 21597367 | 21597351 | 21597346 | - |
| SEQ ID NO 26282 | GTTTTTCCACTGTTGAGTTGTT | TTT | chr12 | 21597343 | 21597364 | 21597348 | 21597343 | - |
| SEQ ID NO 26283 | TTTTTCCACTGTTGAGTTGTTT | TTG | chr12 | 21597342 | 21597363 | 21597347 | 21597342 | - |

Figure 48 (Cont'd)

| | | | | | | | | |
|---|---|---|---|---|---|---|---|---|
| SEQ ID NO 26284 | TTCCACTGTTGAGTTGTTTGAG | TTT | chr12 | 21597339 | 21597360 | 21597344 | 21597339 | - |
| SEQ ID NO 26285 | TCCACTGTTGAGTTGTTTGAGT | TTT | chr12 | 21597338 | 21597359 | 21597343 | 21597338 | - |
| SEQ ID NO 26286 | CCACTGTTGAGTTGTTTGAGTT | TTT | chr12 | 21597337 | 21597358 | 21597342 | 21597337 | - |
| SEQ ID NO 26287 | CACTGTTGAGTTGTTTGAGTTT | TTC | chr12 | 21597336 | 21597357 | 21597341 | 21597336 | - |
| SEQ ID NO 26288 | TTGAGTTGTTTGAGTTTCTTAT | CTG | chr12 | 21597331 | 21597352 | 21597336 | 21597331 | - |
| SEQ ID NO 26289 | AGTTGTTTGAGTTTCTTATATA | TTG | chr12 | 21597328 | 21597349 | 21597333 | 21597328 | - |
| SEQ ID NO 26290 | TTTGAGTTTCTTATATATTCTG | TTG | chr12 | 21597323 | 21597344 | 21597328 | 21597323 | - |
| SEQ ID NO 26291 | GAGTTTCTTATATATTCTGGAG | TTT | chr12 | 21597320 | 21597341 | 21597325 | 21597320 | - |
| SEQ ID NO 26292 | AGTTTCTTATATATTCTGGAGA | TTG | chr12 | 21597319 | 21597340 | 21597324 | 21597319 | - |
| SEQ ID NO 26293 | CTTATATATTCTGGAGATTAAT | TTT | chr12 | 21597314 | 21597335 | 21597319 | 21597314 | - |
| SEQ ID NO 26294 | TTATATATTCTGGAGATTAATT | TTC | chr12 | 21597313 | 21597334 | 21597318 | 21597313 | - |
| SEQ ID NO 26295 | ATATATTCTGGAGATTAATTCC | CTT | chr12 | 21597311 | 21597332 | 21597316 | 21597311 | - |
| SEQ ID NO 26296 | TATATTCTGGAGATTAATTCCT | TTA | chr12 | 21597310 | 21597331 | 21597315 | 21597310 | - |
| SEQ ID NO 26297 | TGGAGATTAATTCCTTGTCAAA | TTC | chr12 | 21597303 | 21597324 | 21597308 | 21597303 | - |
| SEQ ID NO 26298 | GAGATTAATTCCTTGTCAAATG | CTG | chr12 | 21597301 | 21597322 | 21597306 | 21597301 | - |
| SEQ ID NO 26299 | ATTCCTTGTCAAATGTATGCAA | TTA | chr12 | 21597294 | 21597315 | 21597299 | 21597294 | - |
| SEQ ID NO 26300 | CTTGTCAAATGTATGCAAATAT | TTC | chr12 | 21597290 | 21597311 | 21597295 | 21597290 | - |
| SEQ ID NO 26301 | GTCAAATGTATGCAAATATTTT | CTT | chr12 | 21597287 | 21597308 | 21597292 | 21597287 | - |
| SEQ ID NO 26302 | TCAAATGTATGCAAATATTTTC | TTG | chr12 | 21597286 | 21597307 | 21597291 | 21597286 | - |
| SEQ ID NO 26303 | TCTCGCATTCAACAGCTTGTCT | TTT | chr12 | 21597266 | 21597287 | 21597271 | 21597266 | - |
| SEQ ID NO 26304 | CTCGCATTCAACAGCTTGTCTC | TTT | chr12 | 21597265 | 21597286 | 21597270 | 21597265 | - |
| SEQ ID NO 26305 | TCGCATTCAACAGCTTGTCTCT | TTC | chr12 | 21597264 | 21597285 | 21597269 | 21597264 | - |
| SEQ ID NO 26306 | GCATTCAACAGCTTGTCTCTTC | CTC | chr12 | 21597262 | 21597283 | 21597267 | 21597262 | - |
| SEQ ID NO 26307 | AACAGCTTGTCTCTTCACTGTG | TTC | chr12 | 21597256 | 21597277 | 21597261 | 21597256 | - |
| SEQ ID NO 26308 | GTCTCTTCACTGTGTTGATTGT | CTT | chr12 | 21597248 | 21597269 | 21597253 | 21597248 | - |
| SEQ ID NO 26309 | TCTCTTCACTGTGTTGATTGTT | TTG | chr12 | 21597247 | 21597268 | 21597252 | 21597247 | - |
| SEQ ID NO 26310 | TTCACTGTGTTGATTGTTTCCT | CTC | chr12 | 21597243 | 21597264 | 21597248 | 21597243 | - |
| SEQ ID NO 26311 | CACTGTGTTGATTGTTTCCTTT | CTT | chr12 | 21597241 | 21597262 | 21597246 | 21597241 | - |
| SEQ ID NO 26312 | ACTGTGTTGATTGTTTCCTTTA | TTC | chr12 | 21597240 | 21597261 | 21597245 | 21597240 | - |
| SEQ ID NO 26313 | TGTTGATTGTTTCCTTTACTGT | CTG | chr12 | 21597236 | 21597257 | 21597241 | 21597236 | - |
| SEQ ID NO 26314 | ATTGTTTCCTTTACTGTGCAGA | TTG | chr12 | 21597231 | 21597252 | 21597236 | 21597231 | - |
| SEQ ID NO 26315 | TTTCCTTTACTGTGCAGATGTA | TTG | chr12 | 21597227 | 21597248 | 21597232 | 21597227 | - |
| SEQ ID NO 26316 | CCTTTACTGTGCAGATGTATTT | TTT | chr12 | 21597224 | 21597245 | 21597229 | 21597224 | - |
| SEQ ID NO 26317 | CTTTACTGTGCAGATGTATTTT | TTC | chr12 | 21597223 | 21597244 | 21597228 | 21597223 | - |
| SEQ ID NO 26318 | TACTGTGCAGATGTATTTTAGC | CTT | chr12 | 21597220 | 21597241 | 21597225 | 21597220 | - |
| SEQ ID NO 26319 | ACTGTGCAGATGTATTTTAGCT | TTT | chr12 | 21597219 | 21597240 | 21597224 | 21597219 | - |
| SEQ ID NO 26320 | CTGTGCAGATGTATTTTAGCTT | TTA | chr12 | 21597218 | 21597239 | 21597223 | 21597218 | - |
| SEQ ID NO 26321 | TGCAGATGTATTTTAGCTTAAT | CTG | chr12 | 21597215 | 21597236 | 21597220 | 21597215 | - |
| SEQ ID NO 26322 | TAGCTTAATATAGTCCCATTTG | TTT | chr12 | 21597202 | 21597223 | 21597207 | 21597202 | - |
| SEQ ID NO 26323 | AGCTTAATATAGTCCCATTTGT | TTT | chr12 | 21597201 | 21597222 | 21597206 | 21597201 | - |
| SEQ ID NO 26324 | GCTTAATATAGTCCCATTTGTC | TTA | chr12 | 21597200 | 21597221 | 21597205 | 21597200 | - |
| SEQ ID NO 26325 | AATATAGTCCCATTTGTCTATT | CTT | chr12 | 21597196 | 21597217 | 21597201 | 21597196 | - |
| SEQ ID NO 26326 | ATATAGTCCCATTTGTCTATTT | TTA | chr12 | 21597195 | 21597216 | 21597200 | 21597195 | - |
| SEQ ID NO 26327 | GTCTATTTTGCTTTTGTTGCC | TTT | chr12 | 21597181 | 21597202 | 21597186 | 21597181 | - |
| SEQ ID NO 26328 | TCTATTTTGCTTTTGTTGCCT | TTG | chr12 | 21597180 | 21597201 | 21597185 | 21597180 | - |
| SEQ ID NO 26329 | TTTTTGCTTTTGTTGCCTGTGC | CTA | chr12 | 21597176 | 21597197 | 21597181 | 21597176 | - |
| SEQ ID NO 26330 | TTGCTTTTGTTGCCTGTGCTTT | TTT | chr12 | 21597173 | 21597194 | 21597178 | 21597173 | - |
| SEQ ID NO 26331 | TGCTTTTGTTGCCTGTGCTTTT | TTT | chr12 | 21597172 | 21597193 | 21597177 | 21597172 | - |
| SEQ ID NO 26332 | GCTTTTGTTGCCTGTGCTTTTG | TTT | chr12 | 21597171 | 21597192 | 21597176 | 21597171 | - |
| SEQ ID NO 26333 | CTTTTGTTGCCTGTGCTTTTGA | TTG | chr12 | 21597170 | 21597191 | 21597175 | 21597170 | - |
| SEQ ID NO 26334 | TTGTTGCCTGTGCTTTTGAGGT | CTT | chr12 | 21597167 | 21597188 | 21597172 | 21597167 | - |
| SEQ ID NO 26335 | TGTTGCCTGTGCTTTTGAGGTC | TTT | chr12 | 21597166 | 21597187 | 21597171 | 21597166 | - |
| SEQ ID NO 26336 | GTTGCCTGTGCTTTTGAGGTCT | TTT | chr12 | 21597165 | 21597186 | 21597170 | 21597165 | - |
| SEQ ID NO 26337 | TTGCCTGTGCTTTTGAGGTCTT | TTG | chr12 | 21597164 | 21597185 | 21597169 | 21597164 | - |
| SEQ ID NO 26338 | CCTGTGCTTTTGAGGTCTTGGC | TTG | chr12 | 21597161 | 21597182 | 21597166 | 21597161 | - |
| SEQ ID NO 26339 | TGCTTTTGAGGTCTTGGCCATA | CTG | chr12 | 21597157 | 21597178 | 21597162 | 21597157 | - |
| SEQ ID NO 26340 | TTGAGGTCTTGGCCATAAAATC | CTT | chr12 | 21597152 | 21597173 | 21597157 | 21597152 | - |
| SEQ ID NO 26341 | TGAGGTCTTGGCCATAAAATCT | TTT | chr12 | 21597151 | 21597172 | 21597156 | 21597151 | - |

Figure 48 (Cont'd)

| SEQ ID NO 26342 | GAGGTCTTGGCCATAAAATCTT | TTT | chr12 | 21597150 | 21597171 | 21597155 | 21597150 | - |
|---|---|---|---|---|---|---|---|---|
| SEQ ID NO 26343 | AGGTCTTGGCCATAAAATCTTT | TTG | chr12 | 21597149 | 21597170 | 21597154 | 21597149 | - |
| SEQ ID NO 26344 | GGCCATAAAATCTTTGCCCAAA | CTT | chr12 | 21597142 | 21597163 | 21597147 | 21597142 | - |
| SEQ ID NO 26345 | GCCATAAAATCTTTGCCCAAAG | TTG | chr12 | 21597141 | 21597162 | 21597146 | 21597141 | - |
| SEQ ID NO 26346 | TGCCCAAAGCCATGTCTTGAAG | CTT | chr12 | 21597128 | 21597149 | 21597133 | 21597128 | - |
| SEQ ID NO 26347 | GCCCAAAGCCATGTCTTGAAGT | TTT | chr12 | 21597127 | 21597148 | 21597132 | 21597127 | - |
| SEQ ID NO 26348 | CCCAAAGCCATGTCTTGAAGTG | TTG | chr12 | 21597126 | 21597147 | 21597131 | 21597126 | - |
| SEQ ID NO 26349 | GAAGTGTCTCCCTTATGTTTTC | CTT | chr12 | 21597110 | 21597131 | 21597115 | 21597110 | - |
| SEQ ID NO 26350 | AAGTGTCTCCCTTATGTTTTCT | TTG | chr12 | 21597109 | 21597130 | 21597114 | 21597109 | - |
| SEQ ID NO 26351 | CCTTATGTTTTCTTTTAGTAGT | CTC | chr12 | 21597100 | 21597121 | 21597105 | 21597100 | - |
| SEQ ID NO 26352 | ATGTTTTCTTTTAGTAGTTTTA | CTT | chr12 | 21597096 | 21597117 | 21597101 | 21597096 | - |
| SEQ ID NO 26353 | TGTTTTCTTTTAGTAGTTTTAT | TTA | chr12 | 21597095 | 21597116 | 21597100 | 21597095 | - |
| SEQ ID NO 26354 | TCTTTTAGTAGTTTTATAGTTT | TTT | chr12 | 21597090 | 21597111 | 21597095 | 21597090 | - |
| SEQ ID NO 26355 | CTTTTAGTAGTTTTATAGTTTT | TTT | chr12 | 21597089 | 21597110 | 21597094 | 21597089 | - |
| SEQ ID NO 26356 | TTTTAGTAGTTTTATAGTTTTA | TTC | chr12 | 21597088 | 21597109 | 21597093 | 21597088 | - |
| SEQ ID NO 26357 | TTAGTAGTTTTATAGTTTTAAG | CTT | chr12 | 21597086 | 21597107 | 21597091 | 21597086 | - |
| SEQ ID NO 26358 | TAGTAGTTTTATAGTTTTAAGT | TTT | chr12 | 21597085 | 21597106 | 21597090 | 21597085 | - |
| SEQ ID NO 26359 | AGTAGTTTTATAGTTTTAAGTT | TTT | chr12 | 21597084 | 21597105 | 21597089 | 21597084 | - |
| SEQ ID NO 26360 | GTAGTTTTATAGTTTTAAGTTT | TTA | chr12 | 21597083 | 21597104 | 21597088 | 21597083 | - |
| SEQ ID NO 26361 | TATAGTTTTAAGTTTTATATTT | TTT | chr12 | 21597076 | 21597097 | 21597081 | 21597076 | - |
| SEQ ID NO 26362 | ATAGTTTTAAGTTTTATATTTA | TTT | chr12 | 21597075 | 21597096 | 21597080 | 21597075 | - |
| SEQ ID NO 26363 | TAGTTTTAAGTTTTATATTTAA | TTA | chr12 | 21597074 | 21597095 | 21597079 | 21597074 | - |
| SEQ ID NO 26364 | TAAGTTTTATATTTAAGTCTTT | TTT | chr12 | 21597068 | 21597089 | 21597073 | 21597068 | - |
| SEQ ID NO 26365 | AAGTTTTATATTTAAGTCTTTA | TTT | chr12 | 21597067 | 21597088 | 21597072 | 21597067 | - |
| SEQ ID NO 26366 | AGTTTTATATTTAAGTCTTTAA | TTA | chr12 | 21597066 | 21597087 | 21597071 | 21597066 | - |
| SEQ ID NO 26367 | TATATTTAAGTCTTTAATCCAT | TTT | chr12 | 21597061 | 21597082 | 21597066 | 21597061 | - |
| SEQ ID NO 26368 | ATATTTAAGTCTTTAATCCATC | TTT | chr12 | 21597060 | 21597081 | 21597065 | 21597060 | - |
| SEQ ID NO 26369 | TATTTAAGTCTTTAATCCATCT | TTA | chr12 | 21597059 | 21597080 | 21597064 | 21597059 | - |
| SEQ ID NO 26370 | AAGTCTTTAATCCATCTTGAGA | TTT | chr12 | 21597054 | 21597075 | 21597059 | 21597054 | - |
| SEQ ID NO 26371 | AGTCTTTAATCCATCTTGAGAG | TTA | chr12 | 21597053 | 21597074 | 21597058 | 21597053 | - |
| SEQ ID NO 26372 | TAATCCATCTTGAGAGTACGTT | CTT | chr12 | 21597047 | 21597068 | 21597052 | 21597047 | - |
| SEQ ID NO 26373 | AATCCATCTTGAGAGTACGTTT | TTT | chr12 | 21597046 | 21597067 | 21597051 | 21597046 | - |
| SEQ ID NO 26374 | ATCCATCTTGAGAGTACGTTTT | TTA | chr12 | 21597045 | 21597066 | 21597050 | 21597045 | - |
| SEQ ID NO 26375 | GAGAGTACGTTTTATATGGCAA | CTT | chr12 | 21597036 | 21597057 | 21597041 | 21597036 | - |
| SEQ ID NO 26376 | AGAGTACGTTTTATATGGCAAT | TTG | chr12 | 21597035 | 21597056 | 21597040 | 21597035 | - |
| SEQ ID NO 26377 | TATATGGCAATAAATAGGGGTT | TTT | chr12 | 21597024 | 21597045 | 21597029 | 21597024 | - |
| SEQ ID NO 26378 | ATATGGCAATAAATAGGGGTTG | TTT | chr12 | 21597023 | 21597044 | 21597028 | 21597023 | - |
| SEQ ID NO 26379 | TATGGCAATAAATAGGGGTTGT | TTA | chr12 | 21597022 | 21597043 | 21597027 | 21597022 | - |
| SEQ ID NO 26380 | TATTAGGCCATTTTTGCATCTA | TTG | chr12 | 21597001 | 21597022 | 21597006 | 21597001 | - |
| SEQ ID NO 26381 | GGCCATTTTTGCATCTATTGTA | TTA | chr12 | 21596996 | 21597017 | 21597001 | 21596996 | - |
| SEQ ID NO 26382 | TTGCATCTATTGTACAAGGGGT | TTT | chr12 | 21596988 | 21597009 | 21596993 | 21596988 | - |
| SEQ ID NO 26383 | TGCATCTATTGTACAAGGGGTT | TTT | chr12 | 21596987 | 21597008 | 21596992 | 21596987 | - |
| SEQ ID NO 26384 | GCATCTATTGTACAAGGGGTTG | TTT | chr12 | 21596986 | 21597007 | 21596991 | 21596986 | - |
| SEQ ID NO 26385 | CATCTATTGTACAAGGGGTTGA | TTG | chr12 | 21596985 | 21597006 | 21596990 | 21596985 | - |
| SEQ ID NO 26386 | TTGTACAAGGGGTTGAGTTCTT | CTA | chr12 | 21596979 | 21597000 | 21596984 | 21596979 | - |
| SEQ ID NO 26387 | TACAAGGGGTTGAGTTCTTGAT | TTG | chr12 | 21596976 | 21596997 | 21596981 | 21596976 | - |
| SEQ ID NO 26388 | AGTTCTTGATTTGATTCTCCAT | TTG | chr12 | 21596964 | 21596985 | 21596969 | 21596964 | - |
| SEQ ID NO 26389 | TTGATTTGATTCTCCATTTGGT | TTC | chr12 | 21596959 | 21596980 | 21596964 | 21596959 | - |
| SEQ ID NO 26390 | GATTTGATTCTCCATTTGGTTG | CTT | chr12 | 21596957 | 21596978 | 21596962 | 21596957 | - |
| SEQ ID NO 26391 | ATTTGATTCTCCATTTGGTTGC | TTG | chr12 | 21596956 | 21596977 | 21596961 | 21596956 | - |
| SEQ ID NO 26392 | GATTCTCCATTTGGTTGCTGTT | TTT | chr12 | 21596952 | 21596973 | 21596957 | 21596952 | - |
| SEQ ID NO 26393 | ATTCTCCATTTGGTTGCTGTTG | TTG | chr12 | 21596951 | 21596972 | 21596956 | 21596951 | - |
| SEQ ID NO 26394 | TCCATTTGGTTGCTGTTGGTGT | TTC | chr12 | 21596947 | 21596968 | 21596952 | 21596947 | - |
| SEQ ID NO 26395 | CATTTGGTTGCTGTTGGTGTAT | CTC | chr12 | 21596945 | 21596966 | 21596950 | 21596945 | - |
| SEQ ID NO 26396 | GGTTGCTGTTGGTGTATAGAAG | TTT | chr12 | 21596940 | 21596961 | 21596945 | 21596940 | - |
| SEQ ID NO 26397 | GTTGCTGTTGGTGTATAGAAGA | TTG | chr12 | 21596939 | 21596960 | 21596944 | 21596939 | - |
| SEQ ID NO 26398 | CTGTTGGTGTATAGAAGAGTTA | TTG | chr12 | 21596935 | 21596956 | 21596940 | 21596935 | - |
| SEQ ID NO 26399 | TTGGTGTATAGAAGAGTTACTG | CTG | chr12 | 21596932 | 21596953 | 21596937 | 21596932 | - |

Figure 48 (Cont'd)

| SEQ ID NO | Sequence | | | | | | |
|---|---|---|---|---|---|---|---|
| SEQ ID NO 26400 | GTGTATAGAAGAGTTACTGATT | TTG | chr12 | 21596929 | 21596950 | 21596934 | 21596929 | - |
| SEQ ID NO 26401 | CTGATTTGTGTGCATTCATCTT | TTA | chr12 | 21596913 | 21596934 | 21596918 | 21596913 | - |
| SEQ ID NO 26402 | ATTTGTGTGCATTCATCTTGTA | CTG | chr12 | 21596910 | 21596931 | 21596915 | 21596910 | - |
| SEQ ID NO 26403 | GTGTGCATTCATCTTGTATCTG | TTT | chr12 | 21596906 | 21596927 | 21596911 | 21596906 | - |
| SEQ ID NO 26404 | TGTGCATTCATCTTGTATCTGG | TTG | chr12 | 21596905 | 21596926 | 21596910 | 21596905 | - |
| SEQ ID NO 26405 | ATCTTGTATCTGGAAACTTTGC | TTC | chr12 | 21596896 | 21596917 | 21596901 | 21596896 | - |
| SEQ ID NO 26406 | GTATCTGGAAACTTTGCTGAAT | CTT | chr12 | 21596891 | 21596912 | 21596896 | 21596891 | - |
| SEQ ID NO 26407 | TATCTGGAAACTTTGCTGAATT | TTG | chr12 | 21596890 | 21596911 | 21596895 | 21596890 | - |
| SEQ ID NO 26408 | GAAACTTTGCTGAATTATTTTA | CTG | chr12 | 21596884 | 21596905 | 21596889 | 21596884 | - |
| SEQ ID NO 26409 | TGCTGAATTATTTTATCAGTTC | CTT | chr12 | 21596877 | 21596898 | 21596882 | 21596877 | - |
| SEQ ID NO 26410 | GCTGAATTATTTTATCAGTTCT | TTT | chr12 | 21596876 | 21596897 | 21596881 | 21596876 | - |
| SEQ ID NO 26411 | CTGAATTATTTTATCAGTTCTA | TTG | chr12 | 21596875 | 21596896 | 21596880 | 21596875 | - |
| SEQ ID NO 26412 | AATTATTTTATCAGTTCTAGGA | CTG | chr12 | 21596872 | 21596893 | 21596877 | 21596872 | - |
| SEQ ID NO 26413 | TTTTATCAGTTCTAGGAGCTTT | TTA | chr12 | 21596867 | 21596888 | 21596872 | 21596867 | - |
| SEQ ID NO 26414 | TATCAGTTCTAGGAGCTTTCTG | TTT | chr12 | 21596864 | 21596885 | 21596869 | 21596864 | - |
| SEQ ID NO 26415 | ATCAGTTCTAGGAGCTTTCTGG | TTT | chr12 | 21596863 | 21596884 | 21596868 | 21596863 | - |
| SEQ ID NO 26416 | TCAGTTCTAGGAGCTTTCTGGA | TTA | chr12 | 21596862 | 21596883 | 21596867 | 21596862 | - |
| SEQ ID NO 26417 | TAGGAGCTTTCTGGAGGAGTCT | TTC | chr12 | 21596855 | 21596876 | 21596860 | 21596855 | - |
| SEQ ID NO 26418 | GGAGCTTTCTGGAGGAGTCTTT | CTA | chr12 | 21596853 | 21596874 | 21596858 | 21596853 | - |
| SEQ ID NO 26419 | TCTGGAGGAGTCTTTAGGGTTT | CTT | chr12 | 21596846 | 21596867 | 21596851 | 21596846 | - |
| SEQ ID NO 26420 | CTGGAGGAGTCTTTAGGGTTTT | TTT | chr12 | 21596845 | 21596866 | 21596850 | 21596845 | - |
| SEQ ID NO 26421 | TGGAGGAGTCTTTAGGGTTTTA | TTC | chr12 | 21596844 | 21596865 | 21596849 | 21596844 | - |
| SEQ ID NO 26422 | GAGGAGTCTTTAGGGTTTTAAA | CTG | chr12 | 21596842 | 21596863 | 21596847 | 21596842 | - |
| SEQ ID NO 26423 | TAGGGTTTTAAAGGTAAATGAT | CTT | chr12 | 21596832 | 21596853 | 21596837 | 21596832 | - |
| SEQ ID NO 26424 | AGGGTTTTAAAGGTAAATGATC | TTT | chr12 | 21596831 | 21596852 | 21596836 | 21596831 | - |
| SEQ ID NO 26425 | GGGTTTTAAAGGTAAATGATCA | TTA | chr12 | 21596830 | 21596851 | 21596835 | 21596830 | - |
| SEQ ID NO 26426 | TAAAGGTAAATGATCATATCAT | TTT | chr12 | 21596824 | 21596845 | 21596829 | 21596824 | - |
| SEQ ID NO 26427 | AAAGGTAAATGATCATATCATC | TTT | chr12 | 21596823 | 21596844 | 21596828 | 21596823 | - |
| SEQ ID NO 26428 | AAGGTAAATGATCATATCATCA | TTA | chr12 | 21596822 | 21596843 | 21596827 | 21596822 | - |
| SEQ ID NO 26429 | GACTTCCTCTTTACTGATTTGA | TTT | chr12 | 21596783 | 21596804 | 21596788 | 21596783 | - |
| SEQ ID NO 26430 | ACTTCCTCTTTACTGATTTGAA | TTG | chr12 | 21596782 | 21596803 | 21596787 | 21596782 | - |
| SEQ ID NO 26431 | CCTCTTTACTGATTTGAATGCC | CTT | chr12 | 21596778 | 21596799 | 21596783 | 21596778 | - |
| SEQ ID NO 26432 | CTCTTTACTGATTTGAATGCCC | TTC | chr12 | 21596777 | 21596798 | 21596782 | 21596777 | - |
| SEQ ID NO 26433 | TTTACTGATTTGAATGCCCTTT | CTC | chr12 | 21596774 | 21596795 | 21596779 | 21596774 | - |
| SEQ ID NO 26434 | TACTGATTTGAATGCCCTTTAT | CTT | chr12 | 21596772 | 21596793 | 21596777 | 21596772 | - |
| SEQ ID NO 26435 | ACTGATTTGAATGCCCTTTATT | TTT | chr12 | 21596771 | 21596792 | 21596776 | 21596771 | - |
| SEQ ID NO 26436 | CTGATTTGAATGCCCTTTATTT | TTA | chr12 | 21596770 | 21596791 | 21596775 | 21596770 | - |
| SEQ ID NO 26437 | ATTTGAATGCCCTTTATTTCTT | CTG | chr12 | 21596767 | 21596788 | 21596772 | 21596767 | - |
| SEQ ID NO 26438 | GAATGCCCTTTATTTCTTTGTT | TTT | chr12 | 21596763 | 21596784 | 21596768 | 21596763 | - |
| SEQ ID NO 26439 | AATGCCCTTTATTTCTTTGTTT | TTG | chr12 | 21596762 | 21596783 | 21596767 | 21596762 | - |
| SEQ ID NO 26440 | TATTTCTTTGTTTTGTCTGATT | CTT | chr12 | 21596753 | 21596774 | 21596758 | 21596753 | - |
| SEQ ID NO 26441 | ATTTCTTTGTTTTGTCTGATTG | TTT | chr12 | 21596752 | 21596773 | 21596757 | 21596752 | - |
| SEQ ID NO 26442 | TTTCTTTGTTTTGTCTGATTGC | TTA | chr12 | 21596751 | 21596772 | 21596756 | 21596751 | - |
| SEQ ID NO 26443 | CTTTGTTTTGTCTGATTGCCCT | TTT | chr12 | 21596748 | 21596769 | 21596753 | 21596748 | - |
| SEQ ID NO 26444 | TTTGTTTTGTCTGATTGCCCTG | TTC | chr12 | 21596747 | 21596768 | 21596752 | 21596747 | - |
| SEQ ID NO 26445 | TGTTTTGTCTGATTGCCCTGGC | CTT | chr12 | 21596745 | 21596766 | 21596750 | 21596745 | - |
| SEQ ID NO 26446 | GTTTTGTCTGATTGCCCTGGCT | TTT | chr12 | 21596744 | 21596765 | 21596749 | 21596744 | - |
| SEQ ID NO 26447 | TTTTGTCTGATTGCCCTGGCTA | TTG | chr12 | 21596743 | 21596764 | 21596748 | 21596743 | - |
| SEQ ID NO 26448 | TGTCTGATTGCCCTGGCTAGGA | TTT | chr12 | 21596740 | 21596761 | 21596745 | 21596740 | - |
| SEQ ID NO 26449 | GTCTGATTGCCCTGGCTAGGAC | TTT | chr12 | 21596739 | 21596760 | 21596744 | 21596739 | - |
| SEQ ID NO 26450 | TCTGATTGCCCTGGCTAGGACT | TTG | chr12 | 21596738 | 21596759 | 21596743 | 21596738 | - |
| SEQ ID NO 26451 | ATTGCCCTGGCTAGGACTTCCA | CTG | chr12 | 21596734 | 21596755 | 21596739 | 21596734 | - |
| SEQ ID NO 26452 | CCCTGGCTAGGACTTCCAGTAC | TTG | chr12 | 21596730 | 21596751 | 21596735 | 21596730 | - |
| SEQ ID NO 26453 | GCTAGGACTTCCAGTACTATGT | CTG | chr12 | 21596725 | 21596746 | 21596730 | 21596725 | - |
| SEQ ID NO 26454 | GGACTTCCAGTACTATGTTGAA | CTA | chr12 | 21596721 | 21596742 | 21596726 | 21596721 | - |
| SEQ ID NO 26455 | CCAGTACTATGTTGAAGAGGAG | CTT | chr12 | 21596715 | 21596736 | 21596720 | 21596715 | - |
| SEQ ID NO 26456 | CAGTACTATGTTGAAGAGGAGT | TTC | chr12 | 21596714 | 21596735 | 21596719 | 21596714 | - |
| SEQ ID NO 26457 | TGTTGAAGAGGAGTGGTGAGAG | CTA | chr12 | 21596706 | 21596727 | 21596711 | 21596706 | - |

Figure 48 (Cont'd)

| | | | | | | | | |
|---|---|---|---|---|---|---|---|---|
| SEQ ID NO 26458 | AAGAGGAGTGGTGAGAGTGGGC | TTG | chr12 | 21596701 | 21596722 | 21596706 | 21596701 | - |
| SEQ ID NO 26459 | GTCTTGTTCCAGTTCTCAGAGG | CTT | chr12 | 21596673 | 21596694 | 21596678 | 21596673 | - |
| SEQ ID NO 26460 | TCTTGTTCCAGTTCTCAGAGGG | TTG | chr12 | 21596672 | 21596693 | 21596677 | 21596672 | - |
| SEQ ID NO 26461 | GTTCCAGTTCTCAGAGGGAATG | CTT | chr12 | 21596668 | 21596689 | 21596673 | 21596668 | - |
| SEQ ID NO 26462 | TTCCAGTTCTCAGAGGGAATGC | TTG | chr12 | 21596667 | 21596688 | 21596672 | 21596667 | - |
| SEQ ID NO 26463 | CAGTTCTCAGAGGGAATGCTTT | TTC | chr12 | 21596664 | 21596685 | 21596669 | 21596664 | - |
| SEQ ID NO 26464 | TCAGAGGGAATGCTTTCAACTT | TTC | chr12 | 21596658 | 21596679 | 21596663 | 21596658 | - |
| SEQ ID NO 26465 | AGAGGGAATGCTTTCAACTTTT | CTC | chr12 | 21596656 | 21596677 | 21596661 | 21596656 | - |
| SEQ ID NO 26466 | TCAACTTTTCCCCATTCAATAT | CTT | chr12 | 21596643 | 21596664 | 21596648 | 21596643 | - |
| SEQ ID NO 26467 | CAACTTTTCCCCATTCAATATT | TTT | chr12 | 21596642 | 21596663 | 21596647 | 21596642 | - |
| SEQ ID NO 26468 | AACTTTTCCCCATTCAATATTA | TTC | chr12 | 21596641 | 21596662 | 21596646 | 21596641 | - |
| SEQ ID NO 26469 | TTCCCCATTCAATATTATGTTG | CTT | chr12 | 21596636 | 21596657 | 21596641 | 21596636 | - |
| SEQ ID NO 26470 | TCCCCATTCAATATTATGTTGG | TTT | chr12 | 21596635 | 21596656 | 21596640 | 21596635 | - |
| SEQ ID NO 26471 | CCCCATTCAATATTATGTTGGC | TTT | chr12 | 21596634 | 21596655 | 21596639 | 21596634 | - |
| SEQ ID NO 26472 | CCCATTCAATATTATGTTGGCT | TTC | chr12 | 21596633 | 21596654 | 21596638 | 21596633 | - |
| SEQ ID NO 26473 | AATATTATGTTGGCTGTGGGTT | TTC | chr12 | 21596626 | 21596647 | 21596631 | 21596626 | - |
| SEQ ID NO 26474 | TGTTGGCTGTGGGTTTGTCACA | TTA | chr12 | 21596619 | 21596640 | 21596624 | 21596619 | - |
| SEQ ID NO 26475 | GCTGTGGGTTTGTCACAGATGG | TTG | chr12 | 21596614 | 21596635 | 21596619 | 21596614 | - |
| SEQ ID NO 26476 | TGGGTTTGTCACAGATGGCTTT | CTG | chr12 | 21596610 | 21596631 | 21596615 | 21596610 | - |
| SEQ ID NO 26477 | GTCACAGATGGCTTTTATTACA | TTT | chr12 | 21596603 | 21596624 | 21596608 | 21596603 | - |
| SEQ ID NO 26478 | TCACAGATGGCTTTTATTACAC | TTG | chr12 | 21596602 | 21596623 | 21596607 | 21596602 | - |
| SEQ ID NO 26479 | TTATTACACTGAGGTATGTCTC | CTT | chr12 | 21596589 | 21596610 | 21596594 | 21596589 | - |
| SEQ ID NO 26480 | TATTACACTGAGGTATGTCTCT | TTT | chr12 | 21596588 | 21596609 | 21596593 | 21596588 | - |
| SEQ ID NO 26481 | ATTACACTGAGGTATGTCTCTT | TTT | chr12 | 21596587 | 21596608 | 21596592 | 21596587 | - |
| SEQ ID NO 26482 | TTACACTGAGGTATGTCTCTTG | TTA | chr12 | 21596586 | 21596607 | 21596591 | 21596586 | - |
| SEQ ID NO 26483 | CACTGAGGTATGTCTCTTGTAT | TTA | chr12 | 21596583 | 21596604 | 21596588 | 21596583 | - |
| SEQ ID NO 26484 | AGGTATGTCTCTTGTATGCTGA | CTG | chr12 | 21596578 | 21596599 | 21596583 | 21596578 | - |
| SEQ ID NO 26485 | TTGTATGCTGATTTTGCTGAGC | CTC | chr12 | 21596567 | 21596588 | 21596572 | 21596567 | - |
| SEQ ID NO 26486 | GTATGCTGATTTTGCTGAGCAT | CTT | chr12 | 21596565 | 21596586 | 21596570 | 21596565 | - |
| SEQ ID NO 26487 | TATGCTGATTTTGCTGAGCATT | TTG | chr12 | 21596564 | 21596585 | 21596569 | 21596564 | - |
| SEQ ID NO 26488 | ATTTTGCTGAGCATTTTAATCA | CTG | chr12 | 21596557 | 21596578 | 21596562 | 21596557 | - |
| SEQ ID NO 26489 | TGCTGAGCATTTTAATCATAAA | TTT | chr12 | 21596553 | 21596574 | 21596558 | 21596553 | - |
| SEQ ID NO 26490 | GCTGAGCATTTTAATCATAAAT | TTT | chr12 | 21596552 | 21596573 | 21596557 | 21596552 | - |
| SEQ ID NO 26491 | CTGAGCATTTTAATCATAAATG | TTG | chr12 | 21596551 | 21596572 | 21596556 | 21596551 | - |
| SEQ ID NO 26492 | AGCATTTTAATCATAAATGTAT | CTG | chr12 | 21596548 | 21596569 | 21596553 | 21596548 | - |
| SEQ ID NO 26493 | TAATCATAAATGTATGCTGGAT | TTT | chr12 | 21596541 | 21596562 | 21596546 | 21596541 | - |
| SEQ ID NO 26494 | AATCATAAATGTATGCTGGATT | TTT | chr12 | 21596540 | 21596561 | 21596545 | 21596540 | - |
| SEQ ID NO 26495 | ATCATAAATGTATGCTGGATTT | TTA | chr12 | 21596539 | 21596560 | 21596544 | 21596539 | - |
| SEQ ID NO 26496 | GATTTGTTGAATGCTTTTTCT | CTG | chr12 | 21596522 | 21596543 | 21596527 | 21596522 | - |
| SEQ ID NO 26497 | TGTTGAATGCTTTTTCTGCATC | TTT | chr12 | 21596517 | 21596538 | 21596522 | 21596517 | - |
| SEQ ID NO 26498 | GTTGAATGCTTTTTCTGCATCT | TTT | chr12 | 21596516 | 21596537 | 21596521 | 21596516 | - |
| SEQ ID NO 26499 | TTGAATGCTTTTTCTGCATCTA | TTG | chr12 | 21596515 | 21596536 | 21596520 | 21596515 | - |
| SEQ ID NO 26500 | AATGCTTTTTCTGCATCTATTG | TTG | chr12 | 21596512 | 21596533 | 21596517 | 21596512 | - |
| SEQ ID NO 26501 | TTTCTGCATCTATTGAGATGAT | CTT | chr12 | 21596505 | 21596526 | 21596510 | 21596505 | - |
| SEQ ID NO 26502 | TTCTGCATCTATTGAGATGATC | TTT | chr12 | 21596504 | 21596525 | 21596509 | 21596504 | - |
| SEQ ID NO 26503 | TCTGCATCTATTGAGATGATCA | TTT | chr12 | 21596503 | 21596524 | 21596508 | 21596503 | - |
| SEQ ID NO 26504 | CTGCATCTATTGAGATGATCAT | TTT | chr12 | 21596502 | 21596523 | 21596507 | 21596502 | - |
| SEQ ID NO 26505 | TGCATCTATTGAGATGATCATG | TTC | chr12 | 21596501 | 21596522 | 21596506 | 21596501 | - |
| SEQ ID NO 26506 | CATCTATTGAGATGATCATGTA | CTG | chr12 | 21596499 | 21596520 | 21596504 | 21596499 | - |
| SEQ ID NO 26507 | TTGAGATGATCATGTAATTTTT | CTA | chr12 | 21596493 | 21596514 | 21596498 | 21596493 | - |
| SEQ ID NO 26508 | AGATGATCATGTAATTTTTGTT | TTG | chr12 | 21596490 | 21596511 | 21596495 | 21596490 | - |
| SEQ ID NO 26509 | TTGTTTTAAATCTGTTTATGT | TTT | chr12 | 21596473 | 21596494 | 21596478 | 21596473 | - |
| SEQ ID NO 26510 | TGTTTTAAATCTGTTTATGTG | TTT | chr12 | 21596472 | 21596493 | 21596477 | 21596472 | - |
| SEQ ID NO 26511 | GTTTTAAATCTGTTTATGTGG | TTT | chr12 | 21596471 | 21596492 | 21596476 | 21596471 | - |
| SEQ ID NO 26512 | TTTTAAATCTGTTTATGTGGT | TTG | chr12 | 21596470 | 21596491 | 21596475 | 21596470 | - |
| SEQ ID NO 26513 | TTAAATCTGTTTATGTGGTGTA | TTT | chr12 | 21596467 | 21596488 | 21596472 | 21596467 | - |
| SEQ ID NO 26514 | TAAATCTGTTTATGTGGTGTAT | TTT | chr12 | 21596466 | 21596487 | 21596471 | 21596466 | - |
| SEQ ID NO 26515 | AAATCTGTTTATGTGGTGTATC | TTT | chr12 | 21596465 | 21596486 | 21596470 | 21596465 | - |

Figure 48 (Cont'd)

| SEQ ID NO | Sequence | | | | | | |
|---|---|---|---|---|---|---|---|
| SEQ ID NO 26516 | AATCTGTTTATGTGGTGTATCA | TTA | chr12 | 21596464 | 21596485 | 21596469 | 21596464 | - |
| SEQ ID NO 26517 | TTTATGTGGTGTATCACACTTA | CTG | chr12 | 21596458 | 21596479 | 21596463 | 21596458 | - |
| SEQ ID NO 26518 | ATGTGGTGTATCACACTTATTG | TTT | chr12 | 21596455 | 21596476 | 21596460 | 21596455 | - |
| SEQ ID NO 26519 | TGTGGTGTATCACACTTATTGA | TTA | chr12 | 21596454 | 21596475 | 21596459 | 21596454 | - |
| SEQ ID NO 26520 | ATTGACTTGCAGATGTCAAACC | CTT | chr12 | 21596437 | 21596458 | 21596442 | 21596437 | - |
| SEQ ID NO 26521 | TTGACTTGCAGATGTCAAACCA | TTA | chr12 | 21596436 | 21596457 | 21596441 | 21596436 | - |
| SEQ ID NO 26522 | ACTTGCAGATGTCAAACCAACC | TTG | chr12 | 21596433 | 21596454 | 21596438 | 21596433 | - |
| SEQ ID NO 26523 | GCAGATGTCAAACCAACCCTGC | CTT | chr12 | 21596429 | 21596450 | 21596434 | 21596429 | - |
| SEQ ID NO 26524 | CAGATGTCAAACCAACCCTGCA | TTG | chr12 | 21596428 | 21596449 | 21596433 | 21596428 | - |
| SEQ ID NO 26525 | CATCCCTGGCATGGAACCTGCT | CTG | chr12 | 21596408 | 21596429 | 21596413 | 21596408 | - |
| SEQ ID NO 26526 | GCATGGAACCTGCTTGATCATG | CTG | chr12 | 21596400 | 21596421 | 21596405 | 21596400 | - |
| SEQ ID NO 26527 | CTTGATCATGGTGGATTATCTT | CTG | chr12 | 21596388 | 21596409 | 21596393 | 21596388 | - |
| SEQ ID NO 26528 | GATCATGGTGGATTATCTTTTT | CTT | chr12 | 21596385 | 21596406 | 21596390 | 21596385 | - |
| SEQ ID NO 26529 | ATCATGGTGGATTATCTTTTTG | TTG | chr12 | 21596384 | 21596405 | 21596389 | 21596384 | - |
| SEQ ID NO 26530 | TCTTTTTGTTATGTTGTTGAAT | TTA | chr12 | 21596370 | 21596391 | 21596375 | 21596370 | - |
| SEQ ID NO 26531 | TTTGTTATGTTGTTGAATTTGG | CTT | chr12 | 21596366 | 21596387 | 21596371 | 21596366 | - |
| SEQ ID NO 26532 | TTGTTATGTTGTTGAATTTGGT | TTT | chr12 | 21596365 | 21596386 | 21596370 | 21596365 | - |
| SEQ ID NO 26533 | TGTTATGTTGTTGAATTTGGTT | TTT | chr12 | 21596364 | 21596385 | 21596369 | 21596364 | - |
| SEQ ID NO 26534 | GTTATGTTGTTGAATTTGGTTA | TTT | chr12 | 21596363 | 21596384 | 21596368 | 21596363 | - |
| SEQ ID NO 26535 | TTATGTTGTTGAATTTGGTTAT | TTG | chr12 | 21596362 | 21596383 | 21596367 | 21596362 | - |
| SEQ ID NO 26536 | TGTTGTTGAATTTGGTTATCTA | TTA | chr12 | 21596359 | 21596380 | 21596364 | 21596359 | - |
| SEQ ID NO 26537 | TTGAATTTGGTTATCTAGTATT | TTG | chr12 | 21596354 | 21596375 | 21596359 | 21596354 | - |
| SEQ ID NO 26538 | AATTTGGTTATCTAGTATTTTG | TTG | chr12 | 21596351 | 21596372 | 21596356 | 21596351 | - |
| SEQ ID NO 26539 | GGTTATCTAGTATTTTGTTAAG | TTT | chr12 | 21596346 | 21596367 | 21596351 | 21596346 | - |
| SEQ ID NO 26540 | GTTATCTAGTATTTTGTTAAGG | TTG | chr12 | 21596345 | 21596366 | 21596350 | 21596345 | - |
| SEQ ID NO 26541 | TCTAGTATTTTGTTAAGGATTT | TTA | chr12 | 21596341 | 21596362 | 21596346 | 21596341 | - |
| SEQ ID NO 26542 | GTATTTTGTTAAGGATTTTAGC | CTA | chr12 | 21596337 | 21596358 | 21596342 | 21596337 | - |
| SEQ ID NO 26543 | TGTTAAGGATTTTAGCATCTAT | TTT | chr12 | 21596331 | 21596352 | 21596336 | 21596331 | - |
| SEQ ID NO 26544 | GTTAAGGATTTTAGCATCTATG | TTT | chr12 | 21596330 | 21596351 | 21596335 | 21596330 | - |
| SEQ ID NO 26545 | TTAAGGATTTTAGCATCTATGT | TTG | chr12 | 21596329 | 21596350 | 21596334 | 21596329 | - |
| SEQ ID NO 26546 | AGGATTTTAGCATCTATGTTCA | TTA | chr12 | 21596326 | 21596347 | 21596331 | 21596326 | - |
| SEQ ID NO 26547 | TAGCATCTATGTTCATCAAGGC | TTT | chr12 | 21596319 | 21596340 | 21596324 | 21596319 | - |
| SEQ ID NO 26548 | AGCATCTATGTTCATCAAGGCT | TTT | chr12 | 21596318 | 21596339 | 21596323 | 21596318 | - |
| SEQ ID NO 26549 | GCATCTATGTTCATCAAGGCTA | TTA | chr12 | 21596317 | 21596338 | 21596322 | 21596317 | - |
| SEQ ID NO 26550 | TGTTCATCAAGGCTATCAGTCT | CTA | chr12 | 21596310 | 21596331 | 21596315 | 21596310 | - |
| SEQ ID NO 26551 | ATCAAGGCTATCAGTCTGTAGT | TTC | chr12 | 21596305 | 21596326 | 21596310 | 21596305 | - |
| SEQ ID NO 26552 | TCAGTCTGTAGTTTTCTTTTTT | CTA | chr12 | 21596295 | 21596316 | 21596300 | 21596295 | - |
| SEQ ID NO 26553 | TAGTTTTCTTTTTTGGTTATGT | CTG | chr12 | 21596287 | 21596308 | 21596292 | 21596287 | - |
| SEQ ID NO 26554 | TCTTTTTTGGTTATGTCCTTCC | TTT | chr12 | 21596281 | 21596302 | 21596286 | 21596281 | - |
| SEQ ID NO 26555 | CTTTTTTGGTTATGTCCTTCCC | TTT | chr12 | 21596280 | 21596301 | 21596285 | 21596280 | - |
| SEQ ID NO 26556 | TTTTTTGGTTATGTCCTTCCCT | TTC | chr12 | 21596279 | 21596300 | 21596284 | 21596279 | - |
| SEQ ID NO 26557 | TTTTGGTTATGTCCTTCCCTGG | CTT | chr12 | 21596277 | 21596298 | 21596282 | 21596277 | - |
| SEQ ID NO 26558 | TTTGGTTATGTCCTTCCCTGGT | TTT | chr12 | 21596276 | 21596297 | 21596281 | 21596276 | - |
| SEQ ID NO 26559 | TTGGTTATGTCCTTCCCTGGTT | TTT | chr12 | 21596275 | 21596296 | 21596280 | 21596275 | - |
| SEQ ID NO 26560 | TGGTTATGTCCTTCCCTGGTTT | TTT | chr12 | 21596274 | 21596295 | 21596279 | 21596274 | - |
| SEQ ID NO 26561 | GGTTATGTCCTTCCCTGGTTTT | TTT | chr12 | 21596273 | 21596294 | 21596278 | 21596273 | - |
| SEQ ID NO 26562 | GTTATGTCCTTCCCTGGTTTTG | TTG | chr12 | 21596272 | 21596293 | 21596277 | 21596272 | - |
| SEQ ID NO 26563 | TGTCCTTCCCTGGTTTTGGTGT | TTA | chr12 | 21596268 | 21596289 | 21596273 | 21596268 | - |
| SEQ ID NO 26564 | CCCTGGTTTTGGTGTGATGCTG | CTT | chr12 | 21596261 | 21596282 | 21596266 | 21596261 | - |
| SEQ ID NO 26565 | CCTGGTTTTGGTGTGATGCTGG | TTC | chr12 | 21596260 | 21596281 | 21596265 | 21596260 | - |
| SEQ ID NO 26566 | GTTTTGGTGTGATGCTGGCTTC | CTG | chr12 | 21596256 | 21596277 | 21596261 | 21596256 | - |
| SEQ ID NO 26567 | TGGTGTGATGCTGGCTTCATAG | TTT | chr12 | 21596252 | 21596273 | 21596257 | 21596252 | - |
| SEQ ID NO 26568 | GGTGTGATGCTGGCTTCATAGA | TTT | chr12 | 21596251 | 21596272 | 21596256 | 21596251 | - |
| SEQ ID NO 26569 | GTGTGATGCTGGCTTCATAGAA | TTG | chr12 | 21596250 | 21596271 | 21596255 | 21596250 | - |
| SEQ ID NO 26570 | GCTTCATAGAATGAATTAGGGC | CTG | chr12 | 21596239 | 21596260 | 21596244 | 21596239 | - |
| SEQ ID NO 26571 | CATAGAATGAATTAGGGCAGGT | CTT | chr12 | 21596235 | 21596256 | 21596240 | 21596235 | - |
| SEQ ID NO 26572 | ATAGAATGAATTAGGGCAGGTT | TTC | chr12 | 21596234 | 21596255 | 21596239 | 21596234 | - |
| SEQ ID NO 26573 | GGGCAGGTTCCTTCTTTATCTG | TTA | chr12 | 21596221 | 21596242 | 21596226 | 21596221 | - |

Figure 48 (Cont'd)

| | | | | | | | | |
|---|---|---|---|---|---|---|---|---|
| SEQ ID NO 26574 | CTTCTTTATCTGTCTTGTAGAA | TTC | chr12 | 21596211 | 21596232 | 21596216 | 21596211 | - |
| SEQ ID NO 26575 | CTTTATCTGTCTTGTAGAATAG | CTT | chr12 | 21596208 | 21596229 | 21596213 | 21596208 | - |
| SEQ ID NO 26576 | TTTATCTGTCTTGTAGAATAGT | TTC | chr12 | 21596207 | 21596228 | 21596212 | 21596207 | - |
| SEQ ID NO 26577 | TATCTGTCTTGTAGAATAGTGT | CTT | chr12 | 21596205 | 21596226 | 21596210 | 21596205 | - |
| SEQ ID NO 26578 | ATCTGTCTTGTAGAATAGTGTC | TTT | chr12 | 21596204 | 21596225 | 21596209 | 21596204 | - |
| SEQ ID NO 26579 | TCTGTCTTGTAGAATAGTGTCA | TTA | chr12 | 21596203 | 21596224 | 21596208 | 21596203 | - |
| SEQ ID NO 26580 | TCTTGTAGAATAGTGTCAAAAA | CTG | chr12 | 21596199 | 21596220 | 21596204 | 21596199 | - |
| SEQ ID NO 26581 | GTAGAATAGTGTCAAAAAGATG | CTT | chr12 | 21596195 | 21596216 | 21596200 | 21596195 | - |
| SEQ ID NO 26582 | TAGAATAGTGTCAAAAAGATGG | TTG | chr12 | 21596194 | 21596215 | 21596199 | 21596194 | - |
| SEQ ID NO 26583 | CTCTTTGAATGTCTAGTAGAAT | TTC | chr12 | 21596162 | 21596183 | 21596167 | 21596162 | - |
| SEQ ID NO 26584 | TTTGAATGTCTAGTAGAATTCT | CTC | chr12 | 21596159 | 21596180 | 21596164 | 21596159 | - |
| SEQ ID NO 26585 | TGAATGTCTAGTAGAATTCTGT | CTT | chr12 | 21596157 | 21596178 | 21596162 | 21596157 | - |
| SEQ ID NO 26586 | GAATGTCTAGTAGAATTCTGTT | TTT | chr12 | 21596156 | 21596177 | 21596161 | 21596156 | - |
| SEQ ID NO 26587 | AATGTCTAGTAGAATTCTGTTG | TTG | chr12 | 21596155 | 21596176 | 21596160 | 21596155 | - |
| SEQ ID NO 26588 | GTAGAATTCTGTTGTGAATCCA | CTA | chr12 | 21596147 | 21596168 | 21596152 | 21596147 | - |
| SEQ ID NO 26589 | TGTTGTGAATCCATCTGGTCCT | TTC | chr12 | 21596138 | 21596159 | 21596143 | 21596138 | - |
| SEQ ID NO 26590 | TTGTGAATCCATCTGGTCCTGA | CTG | chr12 | 21596136 | 21596157 | 21596141 | 21596136 | - |
| SEQ ID NO 26591 | TGAATCCATCTGGTCCTGAACT | TTG | chr12 | 21596133 | 21596154 | 21596138 | 21596133 | - |
| SEQ ID NO 26592 | GTCCTGAACTTTTTTTTGGTTG | CTG | chr12 | 21596121 | 21596142 | 21596126 | 21596121 | - |
| SEQ ID NO 26593 | AACTTTTTTTTGGTTGGTAATT | CTG | chr12 | 21596115 | 21596136 | 21596120 | 21596115 | - |
| SEQ ID NO 26594 | TTTTTTGGTTGGTAATTTTTTA | CTT | chr12 | 21596110 | 21596131 | 21596115 | 21596110 | - |
| SEQ ID NO 26595 | TTTTTGGTTGGTAATTTTTTAA | TTT | chr12 | 21596109 | 21596130 | 21596114 | 21596109 | - |
| SEQ ID NO 26596 | TTTTGGTTGGTAATTTTTTAAT | TTT | chr12 | 21596108 | 21596129 | 21596113 | 21596108 | - |
| SEQ ID NO 26597 | TTTGGTTGGTAATTTTTTAATT | TTT | chr12 | 21596107 | 21596128 | 21596112 | 21596107 | - |
| SEQ ID NO 26598 | TTGGTTGGTAATTTTTTAATTA | TTT | chr12 | 21596106 | 21596127 | 21596111 | 21596106 | - |
| SEQ ID NO 26599 | TGGTTGGTAATTTTTTAATTAC | TTT | chr12 | 21596105 | 21596126 | 21596110 | 21596105 | - |
| SEQ ID NO 26600 | GGTTGGTAATTTTTTAATTACC | TTT | chr12 | 21596104 | 21596125 | 21596109 | 21596104 | - |
| SEQ ID NO 26601 | GTTGGTAATTTTTTAATTACCA | TTG | chr12 | 21596103 | 21596124 | 21596108 | 21596103 | - |
| SEQ ID NO 26602 | GTAATTTTTTAATTACCAATTA | TTG | chr12 | 21596099 | 21596120 | 21596104 | 21596099 | - |
| SEQ ID NO 26603 | TTTAATTACCAATTAAATCTCA | TTT | chr12 | 21596092 | 21596113 | 21596097 | 21596092 | - |
| SEQ ID NO 26604 | TTAATTACCAATTAAATCTCAC | TTT | chr12 | 21596091 | 21596112 | 21596096 | 21596091 | - |
| SEQ ID NO 26605 | TAATTACCAATTAAATCTCACT | TTT | chr12 | 21596090 | 21596111 | 21596095 | 21596090 | - |
| SEQ ID NO 26606 | AATTACCAATTAAATCTCACTG | TTT | chr12 | 21596089 | 21596110 | 21596094 | 21596089 | - |
| SEQ ID NO 26607 | ATTACCAATTAAATCTCACTGC | TTA | chr12 | 21596088 | 21596109 | 21596093 | 21596088 | - |
| SEQ ID NO 26608 | CCAATTAAATCTCACTGCTTGT | TTA | chr12 | 21596084 | 21596105 | 21596089 | 21596084 | - |
| SEQ ID NO 26609 | AATCTCACTGCTTGTTATTGGT | TTA | chr12 | 21596077 | 21596098 | 21596082 | 21596077 | - |
| SEQ ID NO 26610 | ACTGCTTGTTATTGGTCTGTTA | CTC | chr12 | 21596071 | 21596092 | 21596076 | 21596071 | - |
| SEQ ID NO 26611 | CTTGTTATTGGTCTGTTAGTAA | CTG | chr12 | 21596067 | 21596088 | 21596072 | 21596067 | - |
| SEQ ID NO 26612 | GTTATTGGTCTGTTAGTAAATT | CTT | chr12 | 21596064 | 21596085 | 21596069 | 21596064 | - |
| SEQ ID NO 26613 | TTATTGGTCTGTTAGTAAATTT | TTG | chr12 | 21596063 | 21596084 | 21596068 | 21596063 | - |
| SEQ ID NO 26614 | TTGGTCTGTTAGTAAATTTATT | TTA | chr12 | 21596060 | 21596081 | 21596065 | 21596060 | - |
| SEQ ID NO 26615 | GTCTGTTAGTAAATTTATTGAG | TTG | chr12 | 21596057 | 21596078 | 21596062 | 21596057 | - |
| SEQ ID NO 26616 | TTAGTAAATTTATTGAGGCTCA | CTG | chr12 | 21596052 | 21596073 | 21596057 | 21596052 | - |
| SEQ ID NO 26617 | GTAAATTTATTGAGGCTCATTT | TTA | chr12 | 21596049 | 21596070 | 21596054 | 21596049 | - |
| SEQ ID NO 26618 | ATTGAGGCTCATTTCATGGCCT | TTT | chr12 | 21596041 | 21596062 | 21596046 | 21596041 | - |
| SEQ ID NO 26619 | TTGAGGCTCATTTCATGGCCTA | TTA | chr12 | 21596040 | 21596061 | 21596045 | 21596040 | - |
| SEQ ID NO 26620 | AGGCTCATTTCATGGCCTATCA | TTG | chr12 | 21596037 | 21596058 | 21596042 | 21596037 | - |
| SEQ ID NO 26621 | ATTTCATGGCCTATCATATGGT | CTC | chr12 | 21596031 | 21596052 | 21596036 | 21596031 | - |
| SEQ ID NO 26622 | CATGGCCTATCATATGGTCTAC | TTT | chr12 | 21596027 | 21596048 | 21596032 | 21596027 | - |
| SEQ ID NO 26623 | ATGGCCTATCATATGGTCTACC | TTC | chr12 | 21596026 | 21596047 | 21596031 | 21596026 | - |
| SEQ ID NO 26624 | TCATATGGTCTACCTTGGAGAA | CTA | chr12 | 21596018 | 21596039 | 21596023 | 21596018 | - |
| SEQ ID NO 26625 | CCTTGGAGAAATTTCCACGCGC | CTA | chr12 | 21596006 | 21596027 | 21596011 | 21596006 | - |
| SEQ ID NO 26626 | GGAGAAATTTCCACGCGCTGTT | CTT | chr12 | 21596002 | 21596023 | 21596007 | 21596002 | - |
| SEQ ID NO 26627 | GAGAAATTTCCACGCGCTGTTG | TTG | chr12 | 21596001 | 21596022 | 21596006 | 21596001 | - |
| SEQ ID NO 26628 | CCACGCGCTGTTGAATAGAATG | TTT | chr12 | 21595992 | 21596013 | 21595997 | 21595992 | - |
| SEQ ID NO 26629 | CACGCGCTGTTGAATAGAATGT | TTC | chr12 | 21595991 | 21596012 | 21595996 | 21595991 | - |
| SEQ ID NO 26630 | TTGAATAGAATGTGTGTTCTGT | CTG | chr12 | 21595982 | 21596003 | 21595987 | 21595982 | - |
| SEQ ID NO 26631 | AATAGAATGTGTGTTCTGTGGT | TTG | chr12 | 21595979 | 21596000 | 21595984 | 21595979 | - |

Figure 48 (Cont'd)

| | | | | | | | | |
|---|---|---|---|---|---|---|---|---|
| SEQ ID NO 26632 | TGTGGTTATTGGATGAAATGTT | TTC | chr12 | 21595963 | 21595984 | 21595968 | 21595963 | - |
| SEQ ID NO 26633 | TGGTTATTGGATGAAATGTTCT | CTG | chr12 | 21595961 | 21595982 | 21595966 | 21595961 | - |
| SEQ ID NO 26634 | TTGGATGAAATGTTCTGTATAT | TTA | chr12 | 21595955 | 21595976 | 21595960 | 21595955 | - |
| SEQ ID NO 26635 | GATGAAATGTTCTGTATATAAC | TTG | chr12 | 21595952 | 21595973 | 21595957 | 21595952 | - |
| SEQ ID NO 26636 | TGTATATAACTGTTAAGTCCAT | TTC | chr12 | 21595940 | 21595961 | 21595945 | 21595940 | - |
| SEQ ID NO 26637 | TATATAACTGTTAAGTCCATTT | CTG | chr12 | 21595938 | 21595959 | 21595943 | 21595938 | - |
| SEQ ID NO 26638 | TTAAGTCCATTTGTTCTAAGGT | CTG | chr12 | 21595928 | 21595949 | 21595933 | 21595928 | - |
| SEQ ID NO 26639 | AGTCCATTTGTTCTAAGGTATA | TTA | chr12 | 21595925 | 21595946 | 21595930 | 21595925 | - |
| SEQ ID NO 26640 | GTTCTAAGGTATAATTTAAATC | TTT | chr12 | 21595916 | 21595937 | 21595921 | 21595916 | - |
| SEQ ID NO 26641 | TTCTAAGGTATAATTTAAATCC | TTG | chr12 | 21595915 | 21595936 | 21595920 | 21595915 | - |
| SEQ ID NO 26642 | TAAGGTATAATTTAAATCCATT | TTC | chr12 | 21595912 | 21595933 | 21595917 | 21595912 | - |
| SEQ ID NO 26643 | AGGTATAATTTAAATCCATTAT | CTA | chr12 | 21595910 | 21595931 | 21595915 | 21595910 | - |
| SEQ ID NO 26644 | AAATCCATTATTTTTTGTTGA | TTT | chr12 | 21595899 | 21595920 | 21595904 | 21595899 | - |
| SEQ ID NO 26645 | AATCCATTATTTTTTTGTTGAC | TTA | chr12 | 21595898 | 21595919 | 21595903 | 21595898 | - |
| SEQ ID NO 26646 | TTTTTTTGTTGACTTTCTGTCT | TTA | chr12 | 21595889 | 21595910 | 21595894 | 21595889 | - |
| SEQ ID NO 26647 | TTTTGTTGACTTTCTGTCTTGA | TTT | chr12 | 21595886 | 21595907 | 21595891 | 21595886 | - |
| SEQ ID NO 26648 | TTTGTTGACTTTCTGTCTTGAT | TTT | chr12 | 21595885 | 21595906 | 21595890 | 21595885 | - |
| SEQ ID NO 26649 | TTGTTGACTTTCTGTCTTGATG | TTT | chr12 | 21595884 | 21595905 | 21595889 | 21595884 | - |
| SEQ ID NO 26650 | TGTTGACTTTCTGTCTTGATGA | TTT | chr12 | 21595883 | 21595904 | 21595888 | 21595883 | - |
| SEQ ID NO 26651 | GTTGACTTTCTGTCTTGATGAA | TTT | chr12 | 21595882 | 21595903 | 21595887 | 21595882 | - |
| SEQ ID NO 26652 | TTGACTTTCTGTCTTGATGAAC | TTG | chr12 | 21595881 | 21595902 | 21595886 | 21595881 | - |
| SEQ ID NO 26653 | ACTTTCTGTCTTGATGAACTGT | TTG | chr12 | 21595878 | 21595899 | 21595883 | 21595878 | - |
| SEQ ID NO 26654 | TCTGTCTTGATGAACTGTCTAG | CTT | chr12 | 21595874 | 21595895 | 21595879 | 21595874 | - |
| SEQ ID NO 26655 | CTGTCTTGATGAACTGTCTAGT | TTT | chr12 | 21595873 | 21595894 | 21595878 | 21595873 | - |
| SEQ ID NO 26656 | TGTCTTGATGAACTGTCTAGTG | TTC | chr12 | 21595872 | 21595893 | 21595877 | 21595872 | - |
| SEQ ID NO 26657 | TCTTGATGAACTGTCTAGTGCT | CTG | chr12 | 21595870 | 21595891 | 21595875 | 21595870 | - |
| SEQ ID NO 26658 | GATGAACTGTCTAGTGCTGTCA | CTT | chr12 | 21595866 | 21595887 | 21595871 | 21595866 | - |
| SEQ ID NO 26659 | ATGAACTGTCTAGTGCTGTCAA | TTG | chr12 | 21595865 | 21595886 | 21595870 | 21595865 | - |
| SEQ ID NO 26660 | TCTAGTGCTGTCAATGAAGTAT | CTG | chr12 | 21595857 | 21595878 | 21595862 | 21595857 | - |
| SEQ ID NO 26661 | GTGCTGTCAATGAAGTATTGAA | CTA | chr12 | 21595853 | 21595874 | 21595858 | 21595853 | - |
| SEQ ID NO 26662 | TCAATGAAGTATTGAAGTCCCC | CTG | chr12 | 21595847 | 21595868 | 21595852 | 21595847 | - |
| SEQ ID NO 26663 | AAGTCCCCACTATTATTGTGT | TTG | chr12 | 21595833 | 21595854 | 21595838 | 21595833 | - |
| SEQ ID NO 26664 | TTATTGTGTTGCTGTCTATCTC | CTA | chr12 | 21595820 | 21595841 | 21595825 | 21595820 | - |
| SEQ ID NO 26665 | TTGTGTTGCTGTCTATCTCATT | TTA | chr12 | 21595817 | 21595838 | 21595822 | 21595817 | - |
| SEQ ID NO 26666 | TGTTGCTGTCTATCTCATTTCT | TTG | chr12 | 21595814 | 21595835 | 21595819 | 21595814 | - |
| SEQ ID NO 26667 | CTGTCTATCTCATTTCTTAGGT | TTG | chr12 | 21595809 | 21595830 | 21595814 | 21595809 | - |
| SEQ ID NO 26668 | TCTATCTCATTTCTTAGGTCTA | CTG | chr12 | 21595806 | 21595827 | 21595811 | 21595806 | - |
| SEQ ID NO 26669 | TCTCATTTCTTAGGTCTATTAG | CTA | chr12 | 21595802 | 21595823 | 21595807 | 21595802 | - |
| SEQ ID NO 26670 | ATTTCTTAGGTCTATTAGTAAT | CTC | chr12 | 21595798 | 21595819 | 21595803 | 21595798 | - |
| SEQ ID NO 26671 | CTTAGGTCTATTAGTAATTGTT | TTT | chr12 | 21595794 | 21595815 | 21595799 | 21595794 | - |
| SEQ ID NO 26672 | TTAGGTCTATTAGTAATTGTTC | TTC | chr12 | 21595793 | 21595814 | 21595798 | 21595793 | - |
| SEQ ID NO 26673 | AGGTCTATTAGTAATTGTTCTA | CTT | chr12 | 21595791 | 21595812 | 21595796 | 21595791 | - |
| SEQ ID NO 26674 | GGTCTATTAGTAATTGTTCTAT | TTA | chr12 | 21595790 | 21595811 | 21595795 | 21595790 | - |
| SEQ ID NO 26675 | TTAGTAATTGTTCTATAAATTT | CTA | chr12 | 21595784 | 21595805 | 21595789 | 21595784 | - |
| SEQ ID NO 26676 | GTAATTGTTCTATAAATTTGGG | TTA | chr12 | 21595781 | 21595802 | 21595786 | 21595781 | - |
| SEQ ID NO 26677 | TTCTATAAATTTGGGAGCTCCA | TTG | chr12 | 21595774 | 21595795 | 21595779 | 21595774 | - |
| SEQ ID NO 26678 | TATAAATTTGGGAGCTCCAGTG | TTC | chr12 | 21595771 | 21595792 | 21595776 | 21595771 | - |
| SEQ ID NO 26679 | TAAATTTGGGAGCTCCAGTGTT | CTA | chr12 | 21595769 | 21595790 | 21595774 | 21595769 | - |
| SEQ ID NO 26680 | GGGAGCTCCAGTGTTAGGTGCA | TTT | chr12 | 21595762 | 21595783 | 21595767 | 21595762 | - |
| SEQ ID NO 26681 | GGAGCTCCAGTGTTAGGTGCAT | TTG | chr12 | 21595761 | 21595782 | 21595766 | 21595761 | - |
| SEQ ID NO 26682 | CAGTGTTAGGTGCATATATGTT | CTC | chr12 | 21595754 | 21595775 | 21595759 | 21595754 | - |
| SEQ ID NO 26683 | GGTGCATATATGTTTAAGATTG | TTA | chr12 | 21595746 | 21595767 | 21595751 | 21595746 | - |
| SEQ ID NO 26684 | AAGATTGTGATATTTTCCTGTT | TTT | chr12 | 21595731 | 21595752 | 21595736 | 21595731 | - |
| SEQ ID NO 26685 | AGATTGTGATATTTTCCTGTTG | TTA | chr12 | 21595730 | 21595751 | 21595735 | 21595730 | - |
| SEQ ID NO 26686 | TGATATTTTCCTGTTGGACAAG | TTG | chr12 | 21595724 | 21595745 | 21595729 | 21595724 | - |
| SEQ ID NO 26687 | TCCTGTTGGACAAGGCCTTTTA | TTT | chr12 | 21595716 | 21595737 | 21595721 | 21595716 | - |
| SEQ ID NO 26688 | CCTGTTGGACAAGGCCTTTTAC | TTT | chr12 | 21595715 | 21595736 | 21595720 | 21595715 | - |
| SEQ ID NO 26689 | CTGTTGGACAAGGCCTTTTACC | TTC | chr12 | 21595714 | 21595735 | 21595719 | 21595714 | - |

Figure 48 (Cont'd)

| SEQ ID NO 26690 | TTGGACAAGGCCTTTTACCATT | CTG | chr12 | 21595711 | 21595732 | 21595716 | 21595711 | - |
|---|---|---|---|---|---|---|---|---|
| SEQ ID NO 26691 | GACAAGGCCTTTTACCATTATA | TTG | chr12 | 21595708 | 21595729 | 21595713 | 21595708 | - |
| SEQ ID NO 26692 | TTACCATTATATAATGTCCCTC | CTT | chr12 | 21595697 | 21595718 | 21595702 | 21595697 | - |
| SEQ ID NO 26693 | TACCATTATATAATGTCCCTCT | TTT | chr12 | 21595696 | 21595717 | 21595701 | 21595696 | - |
| SEQ ID NO 26694 | ACCATTATATAATGTCCCTCTT | TTT | chr12 | 21595695 | 21595716 | 21595700 | 21595695 | - |
| SEQ ID NO 26695 | CCATTATATAATGTCCCTCTTT | TTA | chr12 | 21595694 | 21595715 | 21595699 | 21595694 | - |
| SEQ ID NO 26696 | TATAATGTCCCTCTTTGTCTCT | TTA | chr12 | 21595688 | 21595709 | 21595693 | 21595688 | - |
| SEQ ID NO 26697 | TTTGTCTCTTTTAACTGCTGTT | CTC | chr12 | 21595675 | 21595696 | 21595680 | 21595675 | - |
| SEQ ID NO 26698 | TGTCTCTTTTAACTGCTGTTGC | CTT | chr12 | 21595673 | 21595694 | 21595678 | 21595673 | - |
| SEQ ID NO 26699 | GTCTCTTTTAACTGCTGTTGCT | TTT | chr12 | 21595672 | 21595693 | 21595677 | 21595672 | - |
| SEQ ID NO 26700 | TCTCTTTTAACTGCTGTTGCTT | TTG | chr12 | 21595671 | 21595692 | 21595676 | 21595671 | - |
| SEQ ID NO 26701 | TTTTAACTGCTGTTGCTTTAAA | CTC | chr12 | 21595667 | 21595688 | 21595672 | 21595667 | - |
| SEQ ID NO 26702 | TTAACTGCTGTTGCTTTAAAGT | CTT | chr12 | 21595665 | 21595686 | 21595670 | 21595665 | - |
| SEQ ID NO 26703 | TAACTGCTGTTGCTTTAAAGTT | TTT | chr12 | 21595664 | 21595685 | 21595669 | 21595664 | - |
| SEQ ID NO 26704 | AACTGCTGTTGCTTTAAAGTTT | TTT | chr12 | 21595663 | 21595684 | 21595668 | 21595663 | - |
| SEQ ID NO 26705 | ACTGCTGTTGCTTTAAAGTTTG | TTA | chr12 | 21595662 | 21595683 | 21595667 | 21595662 | - |
| SEQ ID NO 26706 | CTGTTGCTTTAAAGTTTGTTTT | CTG | chr12 | 21595658 | 21595679 | 21595663 | 21595658 | - |
| SEQ ID NO 26707 | TTGCTTTAAAGTTTGTTTTGCC | CTG | chr12 | 21595655 | 21595676 | 21595660 | 21595655 | - |
| SEQ ID NO 26708 | CTTTAAAGTTTGTTTTGCCTAC | TTG | chr12 | 21595652 | 21595673 | 21595657 | 21595652 | - |
| SEQ ID NO 26709 | TAAAGTTTGTTTTGCCTACTCA | CTT | chr12 | 21595649 | 21595670 | 21595654 | 21595649 | - |
| SEQ ID NO 26710 | AAAGTTTGTTTTGCCTACTCAC | TTT | chr12 | 21595648 | 21595669 | 21595653 | 21595648 | - |
| SEQ ID NO 26711 | AAGTTTGTTTTGCCTACTCACT | TTA | chr12 | 21595647 | 21595668 | 21595652 | 21595647 | - |
| SEQ ID NO 26712 | GTTTTGCCTACTCACTTTTGGT | TTT | chr12 | 21595641 | 21595662 | 21595646 | 21595641 | - |
| SEQ ID NO 26713 | TTTTGCCTACTCACTTTTGGTG | TTG | chr12 | 21595640 | 21595661 | 21595645 | 21595640 | - |
| SEQ ID NO 26714 | TGCCTACTCACTTTTGGTGCC | TTT | chr12 | 21595637 | 21595658 | 21595642 | 21595637 | - |
| SEQ ID NO 26715 | GCCTACTCACTTTTGGTGGCCA | TTT | chr12 | 21595636 | 21595657 | 21595641 | 21595636 | - |
| SEQ ID NO 26716 | CCTACTCACTTTTGGTGGCCAT | TTG | chr12 | 21595635 | 21595656 | 21595640 | 21595635 | - |
| SEQ ID NO 26717 | CTCACTTTTGGTGGCCATTTGC | CTA | chr12 | 21595631 | 21595652 | 21595636 | 21595631 | - |
| SEQ ID NO 26718 | ACTTTTGGTGGCCATTTGCATG | CTC | chr12 | 21595628 | 21595649 | 21595633 | 21595628 | - |
| SEQ ID NO 26719 | TTGGTGGCCATTTGCATGAAAT | CTT | chr12 | 21595624 | 21595645 | 21595629 | 21595624 | - |
| SEQ ID NO 26720 | TGGTGGCCATTTGCATGAAATA | TTT | chr12 | 21595623 | 21595644 | 21595628 | 21595623 | - |
| SEQ ID NO 26721 | GGTGGCCATTTGCATGAAATAC | TTT | chr12 | 21595622 | 21595643 | 21595627 | 21595622 | - |
| SEQ ID NO 26722 | GTGGCCATTTGCATGAAATACC | TTG | chr12 | 21595621 | 21595642 | 21595626 | 21595621 | - |
| SEQ ID NO 26723 | GCATGAAATACCTTTTTCACCC | TTT | chr12 | 21595611 | 21595632 | 21595616 | 21595611 | - |
| SEQ ID NO 26724 | CATGAAATACCTTTTTCACCCT | TTG | chr12 | 21595610 | 21595631 | 21595615 | 21595610 | - |
| SEQ ID NO 26725 | TTTCACCCTTTTAAGTGGAGCA | CTT | chr12 | 21595597 | 21595618 | 21595602 | 21595597 | - |
| SEQ ID NO 26726 | TTCACCCTTTTAAGTGGAGCAT | TTT | chr12 | 21595596 | 21595617 | 21595601 | 21595596 | - |
| SEQ ID NO 26727 | TCACCCTTTTAAGTGGAGCATT | TTT | chr12 | 21595595 | 21595616 | 21595600 | 21595595 | - |
| SEQ ID NO 26728 | CACCCTTTTAAGTGGAGCATTT | TTT | chr12 | 21595594 | 21595615 | 21595599 | 21595594 | - |
| SEQ ID NO 26729 | ACCCTTTTAAGTGGAGCATTTA | TTC | chr12 | 21595593 | 21595614 | 21595598 | 21595593 | - |
| SEQ ID NO 26730 | TTAAGTGGAGCATTTAGGCCAT | CTT | chr12 | 21595587 | 21595608 | 21595592 | 21595587 | - |
| SEQ ID NO 26731 | TAAGTGGAGCATTTAGGCCATT | TTT | chr12 | 21595586 | 21595607 | 21595591 | 21595586 | - |
| SEQ ID NO 26732 | AAGTGGAGCATTTAGGCCATTT | TTT | chr12 | 21595585 | 21595606 | 21595590 | 21595585 | - |
| SEQ ID NO 26733 | AGTGGAGCATTTAGGCCATTTA | TTA | chr12 | 21595584 | 21595605 | 21595589 | 21595584 | - |
| SEQ ID NO 26734 | AGGCCATTTACATTCAATGTTA | TTT | chr12 | 21595572 | 21595593 | 21595577 | 21595572 | - |
| SEQ ID NO 26735 | GGCCATTTACATTCAATGTTAG | TTA | chr12 | 21595571 | 21595592 | 21595576 | 21595571 | - |
| SEQ ID NO 26736 | ACATTCAATGTTAGTAATGTAA | TTT | chr12 | 21595563 | 21595584 | 21595568 | 21595563 | - |
| SEQ ID NO 26737 | CATTCAATGTTAGTAATGTAAA | TTA | chr12 | 21595562 | 21595583 | 21595567 | 21595562 | - |
| SEQ ID NO 26738 | AATGTTAGTAATGTAAATGCCT | TTC | chr12 | 21595557 | 21595578 | 21595562 | 21595557 | - |
| SEQ ID NO 26739 | GTAATGTAAATGCCTGGCTATG | TTA | chr12 | 21595550 | 21595571 | 21595555 | 21595550 | - |
| SEQ ID NO 26740 | GCTATGCCAGGCAGGAATGGCC | CTG | chr12 | 21595534 | 21595555 | 21595539 | 21595534 | - |
| SEQ ID NO 26741 | TGCCAGGCAGGAATGGCCTGCT | CTA | chr12 | 21595530 | 21595551 | 21595535 | 21595530 | - |
| SEQ ID NO 26742 | CTCAGGGACCCAGTGAGCTCCA | CTG | chr12 | 21595510 | 21595531 | 21595515 | 21595510 | - |
| SEQ ID NO 26743 | AGGGACCCAGTGAGCTCCAGG | CTC | chr12 | 21595507 | 21595528 | 21595512 | 21595507 | - |
| SEQ ID NO 26744 | CCAGGGCCTTTCTCACTGCTTC | CTC | chr12 | 21595490 | 21595511 | 21595495 | 21595490 | - |
| SEQ ID NO 26745 | TCTCACTGCTTCCTCTACACCT | CTT | chr12 | 21595480 | 21595501 | 21595485 | 21595480 | - |
| SEQ ID NO 26746 | CTCACTGCTTCCTCTACACCTG | TTT | chr12 | 21595479 | 21595500 | 21595484 | 21595479 | - |
| SEQ ID NO 26747 | TCACTGCTTCCTCTACACCTGT | TTC | chr12 | 21595478 | 21595499 | 21595483 | 21595478 | - |

Figure 48 (Cont'd)

| SEQ ID NO 26748 | ACTGCTTCCTCTACACCTGTAT | CTC | chr12 | 21595476 | 21595497 | 21595481 | 21595476 | - |
|---|---|---|---|---|---|---|---|---|
| SEQ ID NO 26749 | CTTCCTCTACACCTGTATTTTG | CTG | chr12 | 21595472 | 21595493 | 21595477 | 21595472 | - |
| SEQ ID NO 26750 | CCTCTACACCTGTATTTTGCTC | CTT | chr12 | 21595469 | 21595490 | 21595474 | 21595469 | - |
| SEQ ID NO 26751 | CTCTACACCTGTATTTTGCTCA | TTC | chr12 | 21595468 | 21595489 | 21595473 | 21595468 | - |
| SEQ ID NO 26752 | TACACCTGTATTTTGCTCAGCT | CTC | chr12 | 21595465 | 21595486 | 21595470 | 21595465 | - |
| SEQ ID NO 26753 | CACCTGTATTTTGCTCAGCTCT | CTA | chr12 | 21595463 | 21595484 | 21595468 | 21595463 | - |
| SEQ ID NO 26754 | TATTTTGCTCAGCTCTCTAAGT | CTG | chr12 | 21595457 | 21595478 | 21595462 | 21595457 | - |
| SEQ ID NO 26755 | TGCTCAGCTCTCTAAGTTAACT | TTT | chr12 | 21595452 | 21595473 | 21595457 | 21595452 | - |
| SEQ ID NO 26756 | GCTCAGCTCTCTAAGTTAACTC | TTT | chr12 | 21595451 | 21595472 | 21595456 | 21595451 | - |
| SEQ ID NO 26757 | CTCAGCTCTCTAAGTTAACTCA | TTG | chr12 | 21595450 | 21595471 | 21595455 | 21595450 | - |
| SEQ ID NO 26758 | AGCTCTCTAAGTTAACTCAACT | CTC | chr12 | 21595447 | 21595468 | 21595452 | 21595447 | - |
| SEQ ID NO 26759 | TCTAAGTTAACTCAACTCCAGG | CTC | chr12 | 21595442 | 21595463 | 21595447 | 21595442 | - |
| SEQ ID NO 26760 | TAAGTTAACTCAACTCCAGGTA | CTC | chr12 | 21595440 | 21595461 | 21595445 | 21595440 | - |
| SEQ ID NO 26761 | AGTTAACTCAACTCCAGGTAAG | CTA | chr12 | 21595438 | 21595459 | 21595443 | 21595438 | - |
| SEQ ID NO 26762 | ACTCAACTCCAGGTAAGGTCAG | TTA | chr12 | 21595433 | 21595454 | 21595438 | 21595433 | - |
| SEQ ID NO 26763 | AACTCCAGGTAAGGTCAGAAAC | CTC | chr12 | 21595429 | 21595450 | 21595434 | 21595429 | - |
| SEQ ID NO 26764 | CAGGTAAGGTCAGAAACTTCTC | CTC | chr12 | 21595424 | 21595445 | 21595429 | 21595424 | - |
| SEQ ID NO 26765 | CTCCCACAAACAGACCTTCAGT | CTT | chr12 | 21595405 | 21595426 | 21595410 | 21595405 | - |
| SEQ ID NO 26766 | TCCCACAAACAGACCTTCAGTT | TTC | chr12 | 21595404 | 21595425 | 21595409 | 21595404 | - |
| SEQ ID NO 26767 | CCACAAACAGACCTTCAGTTTC | CTC | chr12 | 21595402 | 21595423 | 21595407 | 21595402 | - |
| SEQ ID NO 26768 | CAGTTTCTCCAGTGGGAGTGTG | CTT | chr12 | 21595387 | 21595408 | 21595392 | 21595387 | - |
| SEQ ID NO 26769 | AGTTTCTCCAGTGGGAGTGTGT | TTC | chr12 | 21595386 | 21595407 | 21595391 | 21595386 | - |
| SEQ ID NO 26770 | CTCCAGTGGGAGTGTGTGTTTA | TTT | chr12 | 21595381 | 21595402 | 21595386 | 21595381 | - |
| SEQ ID NO 26771 | TCCAGTGGGAGTGTGTGTTTAG | TTC | chr12 | 21595380 | 21595401 | 21595385 | 21595380 | - |
| SEQ ID NO 26772 | CAGTGGGAGTGTGTGTTTAGGA | CTC | chr12 | 21595378 | 21595399 | 21595383 | 21595378 | - |
| SEQ ID NO 26773 | AGGAGAGGAGGATCTCCCTTTC | TTT | chr12 | 21595360 | 21595381 | 21595365 | 21595360 | - |
| SEQ ID NO 26774 | GGAGAGGAGGATCTCCCTTTCC | TTA | chr12 | 21595359 | 21595380 | 21595364 | 21595359 | - |
| SEQ ID NO 26775 | CCTTTCCCACTTCCGCAGTTGG | CTC | chr12 | 21595344 | 21595365 | 21595349 | 21595344 | - |
| SEQ ID NO 26776 | TCCCACTTCCGCAGTTGGGGCA | CTT | chr12 | 21595340 | 21595361 | 21595345 | 21595340 | - |
| SEQ ID NO 26777 | CCCACTTCCGCAGTTGGGGCAC | TTT | chr12 | 21595339 | 21595360 | 21595344 | 21595339 | - |
| SEQ ID NO 26778 | CCACTTCCGCAGTTGGGGCACT | TTC | chr12 | 21595338 | 21595359 | 21595343 | 21595338 | - |
| SEQ ID NO 26779 | CCGCAGTTGGGGCACTCACAGT | CTT | chr12 | 21595332 | 21595353 | 21595337 | 21595332 | - |
| SEQ ID NO 26780 | CGCAGTTGGGGCACTCACAGTA | TTC | chr12 | 21595331 | 21595352 | 21595336 | 21595331 | - |
| SEQ ID NO 26781 | GGGCACTCACAGTATTTGGGGT | TTG | chr12 | 21595323 | 21595344 | 21595328 | 21595323 | - |
| SEQ ID NO 26782 | ACAGTATTTGGGGTGTCTCCTG | CTC | chr12 | 21595315 | 21595336 | 21595320 | 21595315 | - |
| SEQ ID NO 26783 | GGGGTGTCTCCTGGGTCCTGCA | TTT | chr12 | 21595306 | 21595327 | 21595311 | 21595306 | - |
| SEQ ID NO 26784 | GGGTGTCTCCTGGGTCCTGCAG | TTG | chr12 | 21595305 | 21595326 | 21595310 | 21595305 | - |
| SEQ ID NO 26785 | CTGGGTCCTGCAGGAGCAATCT | CTC | chr12 | 21595296 | 21595317 | 21595301 | 21595296 | - |
| SEQ ID NO 26786 | GGTCCTGCAGGAGCAATCTACT | CTG | chr12 | 21595293 | 21595314 | 21595298 | 21595293 | - |
| SEQ ID NO 26787 | CAGGAGCAATCTACTTCCTTCA | CTG | chr12 | 21595286 | 21595307 | 21595291 | 21595286 | - |
| SEQ ID NO 26788 | CTTCCTTCAGAGGGTCTGTGGG | CTA | chr12 | 21595273 | 21595294 | 21595278 | 21595273 | - |
| SEQ ID NO 26789 | CCTTCAGAGGGTCTGTGGGTCC | CTT | chr12 | 21595270 | 21595291 | 21595275 | 21595270 | - |
| SEQ ID NO 26790 | CTTCAGAGGGTCTGTGGGTCCT | TTC | chr12 | 21595269 | 21595290 | 21595274 | 21595269 | - |
| SEQ ID NO 26791 | CAGAGGGTCTGTGGGTCCTCTC | CTT | chr12 | 21595266 | 21595287 | 21595271 | 21595266 | - |
| SEQ ID NO 26792 | AGAGGGTCTGTGGGTCCTCTCA | TTC | chr12 | 21595265 | 21595286 | 21595270 | 21595265 | - |
| SEQ ID NO 26793 | TGGGTCCTCTCAGGATTGCTGG | CTG | chr12 | 21595255 | 21595276 | 21595260 | 21595255 | - |
| SEQ ID NO 26794 | TCAGGATTGCTGGTTTGTTCTT | CTC | chr12 | 21595246 | 21595267 | 21595251 | 21595246 | - |
| SEQ ID NO 26795 | AGGATTGCTGGTTTGTTCTTGC | CTC | chr12 | 21595244 | 21595265 | 21595249 | 21595244 | - |
| SEQ ID NO 26796 | CTGGTTTGTTCTTGCAGTCTAT | TTG | chr12 | 21595237 | 21595258 | 21595242 | 21595237 | - |
| SEQ ID NO 26797 | GTTTGTTCTTGCAGTCTATCTG | CTG | chr12 | 21595234 | 21595255 | 21595239 | 21595234 | - |
| SEQ ID NO 26798 | GTTCTTGCAGTCTATCTGCAGC | TTT | chr12 | 21595230 | 21595251 | 21595235 | 21595230 | - |
| SEQ ID NO 26799 | TTCTTGCAGTCTATCTGCAGCT | TTG | chr12 | 21595229 | 21595250 | 21595234 | 21595229 | - |
| SEQ ID NO 26800 | TTGCAGTCTATCTGCAGCTAAA | TTC | chr12 | 21595226 | 21595247 | 21595231 | 21595226 | - |
| SEQ ID NO 26801 | GCAGTCTATCTGCAGCTAAAAT | CTT | chr12 | 21595224 | 21595245 | 21595229 | 21595224 | - |
| SEQ ID NO 26802 | CAGTCTATCTGCAGCTAAAATT | TTG | chr12 | 21595223 | 21595244 | 21595228 | 21595223 | - |
| SEQ ID NO 26803 | TCTGCAGCTAAAATTCACAATG | CTA | chr12 | 21595216 | 21595237 | 21595221 | 21595216 | - |
| SEQ ID NO 26804 | CAGCTAAAATTCACAATGCGAG | CTG | chr12 | 21595212 | 21595233 | 21595217 | 21595212 | - |
| SEQ ID NO 26805 | AAATTCACAATGCGAGCCTCCA | CTA | chr12 | 21595206 | 21595227 | 21595211 | 21595206 | - |

Figure 48 (Cont'd)

| SEQ ID NO 26806 | ACAATGCGAGCCTCCACATGCT | TTC | chr12 | 21595200 | 21595221 | 21595205 | 21595200 | - |
| SEQ ID NO 26807 | CACATGCTGCTCTGTCCATCTG | CTC | chr12 | 21595186 | 21595207 | 21595191 | 21595186 | - |
| SEQ ID NO 26808 | CTCTGTCCATCTGAGTTGGAGC | CTG | chr12 | 21595177 | 21595198 | 21595182 | 21595177 | - |
| SEQ ID NO 26809 | TGTCCATCTGAGTTGGAGCTGC | CTC | chr12 | 21595174 | 21595195 | 21595179 | 21595174 | - |
| SEQ ID NO 26810 | TCCATCTGAGTTGGAGCTGCAA | CTG | chr12 | 21595172 | 21595193 | 21595177 | 21595172 | - |
| SEQ ID NO 26811 | AGTTGGAGCTGCAATCTAGGCC | CTG | chr12 | 21595164 | 21595185 | 21595169 | 21595164 | - |
| SEQ ID NO 26812 | GAGCTGCAATCTAGGCCTACCT | TTG | chr12 | 21595159 | 21595180 | 21595164 | 21595159 | - |
| SEQ ID NO 26813 | CAATCTAGGCCTACCTCCCATC | CTG | chr12 | 21595153 | 21595174 | 21595158 | 21595153 | - |
| SEQ ID NO 26814 | GGCCTACCTCCCATCCGCCAAG | CTA | chr12 | 21595146 | 21595167 | 21595151 | 21595146 | - |
| SEQ ID NO 26815 | CCTCCCATCCGCCAAGATCCTG | CTA | chr12 | 21595140 | 21595161 | 21595145 | 21595140 | - |
| SEQ ID NO 26816 | CCATCCGCCAAGATCCTGAGAA | CTC | chr12 | 21595136 | 21595157 | 21595141 | 21595136 | - |
| SEQ ID NO 26817 | AGAAGTTGGGGATTATATTTCA | CTG | chr12 | 21595118 | 21595139 | 21595123 | 21595118 | - |
| SEQ ID NO 26818 | GGGATTATATTTCAACATGAGA | TTG | chr12 | 21595110 | 21595131 | 21595115 | 21595110 | - |
| SEQ ID NO 26819 | TATTTCAACATGAGATTTGGAG | TTA | chr12 | 21595103 | 21595124 | 21595108 | 21595103 | - |
| SEQ ID NO 26820 | CAACATGAGATTTGGAGGGAAC | TTT | chr12 | 21595098 | 21595119 | 21595103 | 21595098 | - |
| SEQ ID NO 26821 | AACATGAGATTTGGAGGGAACA | TTC | chr12 | 21595097 | 21595118 | 21595102 | 21595097 | - |
| SEQ ID NO 26822 | GGAGGGAACAAACATCCAAACC | TTT | chr12 | 21595085 | 21595106 | 21595090 | 21595085 | - |
| SEQ ID NO 26823 | GAGGGAACAAACATCCAAACCA | TTG | chr12 | 21595084 | 21595105 | 21595089 | 21595084 | - |
| SEQ ID NO 26824 | TATTCTTTTGCACATGGATATC | TTT | chr12 | 21595045 | 21595066 | 21595050 | 21595045 | - |
| SEQ ID NO 26825 | ATTCTTTTGCACATGGATATCC | TTT | chr12 | 21595044 | 21595065 | 21595049 | 21595044 | - |
| SEQ ID NO 26826 | TTCTTTTGCACATGGATATCCA | TTA | chr12 | 21595043 | 21595064 | 21595048 | 21595043 | - |
| SEQ ID NO 26827 | TTTTGCACATGGATATCCAATG | TTC | chr12 | 21595040 | 21595061 | 21595045 | 21595040 | - |
| SEQ ID NO 26828 | TTGCACATGGATATCCAATGGA | CTT | chr12 | 21595038 | 21595059 | 21595043 | 21595038 | - |
| SEQ ID NO 26829 | TGCACATGGATATCCAATGGAT | TTT | chr12 | 21595037 | 21595058 | 21595042 | 21595037 | - |
| SEQ ID NO 26830 | GCACATGGATATCCAATGGATA | TTT | chr12 | 21595036 | 21595057 | 21595041 | 21595036 | - |
| SEQ ID NO 26831 | CACATGGATATCCAATGGATAT | TTG | chr12 | 21595035 | 21595056 | 21595040 | 21595035 | - |
| SEQ ID NO 26832 | TTTCAGCACCATTTCTTGAACA | TTT | chr12 | 21595006 | 21595027 | 21595011 | 21595006 | - |
| SEQ ID NO 26833 | TTCAGCACCATTTCTTGAACAC | TTT | chr12 | 21595005 | 21595026 | 21595010 | 21595005 | - |
| SEQ ID NO 26834 | TCAGCACCATTTCTTGAACACT | TTT | chr12 | 21595004 | 21595025 | 21595009 | 21595004 | - |
| SEQ ID NO 26835 | CAGCACCATTTCTTGAACACTG | TTT | chr12 | 21595003 | 21595024 | 21595008 | 21595003 | - |
| SEQ ID NO 26836 | AGCACCATTTCTTGAACACTGT | TTC | chr12 | 21595002 | 21595023 | 21595007 | 21595002 | - |
| SEQ ID NO 26837 | CTTGAACACTGTGTCCTTTCCT | TTT | chr12 | 21594992 | 21595013 | 21594997 | 21594992 | - |
| SEQ ID NO 26838 | TTGAACACTGTGTCCTTTCCTC | TTC | chr12 | 21594991 | 21595012 | 21594996 | 21594991 | - |
| SEQ ID NO 26839 | GAACACTGTGTCCTTTCCTCAA | CTT | chr12 | 21594989 | 21595010 | 21594994 | 21594989 | - |
| SEQ ID NO 26840 | AACACTGTGTCCTTTCCTCAAT | TTG | chr12 | 21594988 | 21595009 | 21594993 | 21594988 | - |
| SEQ ID NO 26841 | TGTCCTTTCCTCAATGTATATT | CTG | chr12 | 21594981 | 21595002 | 21594986 | 21594981 | - |
| SEQ ID NO 26842 | TCCTCAATGTATATTCTTGTCA | CTT | chr12 | 21594974 | 21595995 | 21594979 | 21594974 | - |
| SEQ ID NO 26843 | CCTCAATGTATATTCTTGTCAC | TTT | chr12 | 21594973 | 21595994 | 21594978 | 21594973 | - |
| SEQ ID NO 26844 | CTCAATGTATATTCTTGTCACC | TTC | chr12 | 21594972 | 21594993 | 21594977 | 21594972 | - |
| SEQ ID NO 26845 | AATGTATATTCTTGTCACCTTT | CTC | chr12 | 21594969 | 21594990 | 21594974 | 21594969 | - |
| SEQ ID NO 26846 | TTGTCACCTTTGTTGAAAATCT | TTC | chr12 | 21594958 | 21594979 | 21594963 | 21594958 | - |
| SEQ ID NO 26847 | GTCACCTTTGTTGAAAATCTGT | CTT | chr12 | 21594956 | 21594977 | 21594961 | 21594956 | - |
| SEQ ID NO 26848 | TCACCTTTGTTGAAAATCTGTT | TTG | chr12 | 21594955 | 21594976 | 21594960 | 21594955 | - |
| SEQ ID NO 26849 | TGTTGAAAATCTGTTGGCTATA | CTT | chr12 | 21594948 | 21594969 | 21594953 | 21594948 | - |
| SEQ ID NO 26850 | GTTGAAAATCTGTTGGCTATAA | TTT | chr12 | 21594947 | 21594968 | 21594952 | 21594947 | - |
| SEQ ID NO 26851 | TTGAAAATCTGTTGGCTATAAA | TTG | chr12 | 21594946 | 21594967 | 21594951 | 21594946 | - |
| SEQ ID NO 26852 | AAAATCTGTTGGCTATAAATAT | TTG | chr12 | 21594943 | 21594964 | 21594948 | 21594943 | - |
| SEQ ID NO 26853 | TTGGCTATAAATATGTGGATGC | CTG | chr12 | 21594935 | 21594956 | 21594940 | 21594935 | - |
| SEQ ID NO 26854 | GCTATAAATATGTGGATGCATT | TTG | chr12 | 21594932 | 21594953 | 21594937 | 21594932 | - |
| SEQ ID NO 26855 | TAAATATGTGGATGCATTTCTA | CTA | chr12 | 21594928 | 21594949 | 21594933 | 21594928 | - |
| SEQ ID NO 26856 | CTAGGTTCTCTATTCTCTTCCA | TTT | chr12 | 21594909 | 21594930 | 21594914 | 21594909 | - |
| SEQ ID NO 26857 | TAGGTTCTCTATTCTCTTCCAT | TTC | chr12 | 21594908 | 21594929 | 21594913 | 21594908 | - |
| SEQ ID NO 26858 | GGTTCTCTATTCTCTTCCATTG | CTA | chr12 | 21594906 | 21594927 | 21594911 | 21594906 | - |
| SEQ ID NO 26859 | TCTATTCTCTTCCATTGGTCTA | TTC | chr12 | 21594901 | 21594922 | 21594906 | 21594901 | - |
| SEQ ID NO 26860 | TATTCTCTTCCATTGGTCTAAG | CTC | chr12 | 21594899 | 21594920 | 21594904 | 21594899 | - |
| SEQ ID NO 26861 | TTCTCTTCCATTGGTCTAAGTG | CTA | chr12 | 21594897 | 21594918 | 21594902 | 21594897 | - |
| SEQ ID NO 26862 | TCTTCCATTGGTCTAAGTGTCT | TTC | chr12 | 21594894 | 21594915 | 21594899 | 21594894 | - |
| SEQ ID NO 26863 | TTCCATTGGTCTAAGTGTCTGT | CTC | chr12 | 21594892 | 21594913 | 21594897 | 21594892 | - |

Figure 48 (Cont'd)

| SEQ ID NO 26864 | CCATTGGTCTAAGTGTCTGTTC | CTT | chr12 | 21594890 | 21594911 | 21594895 | 21594890 | - |
|---|---|---|---|---|---|---|---|---|
| SEQ ID NO 26865 | CATTGGTCTAAGTGTCTGTTCT | TTC | chr12 | 21594889 | 21594910 | 21594894 | 21594889 | - |
| SEQ ID NO 26866 | GTCTAAGTGTCTGTTCTAATGT | TTG | chr12 | 21594884 | 21594905 | 21594889 | 21594884 | - |
| SEQ ID NO 26867 | AGTGTCTGTTCTAATGTCAGTA | CTA | chr12 | 21594879 | 21594900 | 21594884 | 21594879 | - |
| SEQ ID NO 26868 | TTCTAATGTCAGTATCATGCTG | CTG | chr12 | 21594871 | 21594892 | 21594876 | 21594871 | - |
| SEQ ID NO 26869 | TAATGTCAGTATCATGCTGTTT | TTC | chr12 | 21594868 | 21594889 | 21594873 | 21594868 | - |
| SEQ ID NO 26870 | ATGTCAGTATCATGCTGTTTAG | CTA | chr12 | 21594866 | 21594887 | 21594871 | 21594866 | - |
| SEQ ID NO 26871 | TTTAGGTTCCTATACTTTTGTA | CTG | chr12 | 21594849 | 21594870 | 21594854 | 21594849 | - |
| SEQ ID NO 26872 | AGGTTCCTATACTTTTGTAATA | TTT | chr12 | 21594846 | 21594867 | 21594851 | 21594846 | - |
| SEQ ID NO 26873 | GGTTCCTATACTTTTGTAATAT | TTA | chr12 | 21594845 | 21594866 | 21594850 | 21594845 | - |
| SEQ ID NO 26874 | CTATACTTTTGTAATATACTTT | TTC | chr12 | 21594840 | 21594861 | 21594845 | 21594840 | - |
| SEQ ID NO 26875 | TACTTTTGTAATATACTTTGAA | CTA | chr12 | 21594837 | 21594858 | 21594842 | 21594837 | - |
| SEQ ID NO 26876 | TTGTAATATACTTTGAAATCAG | CTT | chr12 | 21594832 | 21594853 | 21594837 | 21594832 | - |
| SEQ ID NO 26877 | TGTAATATACTTTGAAATCAGG | TTT | chr12 | 21594831 | 21594852 | 21594836 | 21594831 | - |
| SEQ ID NO 26878 | GTAATATACTTTGAAATCAGGT | TTT | chr12 | 21594830 | 21594851 | 21594835 | 21594830 | - |
| SEQ ID NO 26879 | TAATATACTTTGAAATCAGGTA | TTG | chr12 | 21594829 | 21594850 | 21594834 | 21594829 | - |
| SEQ ID NO 26880 | TGAAATCAGGTAGTATGATACC | CTT | chr12 | 21594819 | 21594840 | 21594824 | 21594819 | - |
| SEQ ID NO 26881 | GAAATCAGGTAGTATGATACCT | TTT | chr12 | 21594818 | 21594839 | 21594823 | 21594818 | - |
| SEQ ID NO 26882 | AAATCAGGTAGTATGATACCTC | TTG | chr12 | 21594817 | 21594838 | 21594822 | 21594817 | - |
| SEQ ID NO 26883 | TAGCATTGTTCTTTTTTCACAG | CTC | chr12 | 21594795 | 21594816 | 21594800 | 21594795 | - |
| SEQ ID NO 26884 | GCATTGTTCTTTTTTCACAGGA | CTA | chr12 | 21594793 | 21594814 | 21594798 | 21594793 | - |
| SEQ ID NO 26885 | TTCTTTTTTCACAGGATGACTT | TTG | chr12 | 21594787 | 21594808 | 21594792 | 21594787 | - |
| SEQ ID NO 26886 | TTTTTTCACAGGATGACTTTGG | TTC | chr12 | 21594784 | 21594805 | 21594789 | 21594784 | - |
| SEQ ID NO 26887 | TTTTCACAGGATGACTTTGGCT | CTT | chr12 | 21594782 | 21594803 | 21594787 | 21594782 | - |
| SEQ ID NO 26888 | TTTCACAGGATGACTTTGGCTA | TTT | chr12 | 21594781 | 21594802 | 21594786 | 21594781 | - |
| SEQ ID NO 26889 | TTCACAGGATGACTTTGGCTAC | TTT | chr12 | 21594780 | 21594801 | 21594785 | 21594780 | - |
| SEQ ID NO 26890 | TCACAGGATGACTTTGGCTACT | TTT | chr12 | 21594779 | 21594800 | 21594784 | 21594779 | - |
| SEQ ID NO 26891 | CACAGGATGACTTTGGCTACTG | TTT | chr12 | 21594778 | 21594799 | 21594783 | 21594778 | - |
| SEQ ID NO 26892 | ACAGGATGACTTTGGCTACTGG | TTC | chr12 | 21594777 | 21594798 | 21594782 | 21594777 | - |
| SEQ ID NO 26893 | TGGCTACTGGAGCTATTTTTTA | CTT | chr12 | 21594765 | 21594786 | 21594770 | 21594765 | - |
| SEQ ID NO 26894 | GGCTACTGGAGCTATTTTTTAA | TTT | chr12 | 21594764 | 21594785 | 21594769 | 21594764 | - |
| SEQ ID NO 26895 | GCTACTGGAGCTATTTTTTAAT | TTG | chr12 | 21594763 | 21594784 | 21594768 | 21594763 | - |
| SEQ ID NO 26896 | CTGGAGCTATTTTTTAATTTCA | CTA | chr12 | 21594759 | 21594780 | 21594764 | 21594759 | - |
| SEQ ID NO 26897 | GAGCTATTTTTTAATTTCATAC | CTG | chr12 | 21594756 | 21594777 | 21594761 | 21594756 | - |
| SEQ ID NO 26898 | TTTTTTAATTTCATACAAATTT | CTA | chr12 | 21594750 | 21594771 | 21594755 | 21594750 | - |
| SEQ ID NO 26899 | TTTAATTTCATACAAATTTTAG | TTT | chr12 | 21594747 | 21594768 | 21594752 | 21594747 | - |
| SEQ ID NO 26900 | TTAATTTCATACAAATTTTAGA | TTT | chr12 | 21594746 | 21594767 | 21594751 | 21594746 | - |
| SEQ ID NO 26901 | TAATTTCATACAAATTTTAGAT | TTT | chr12 | 21594745 | 21594766 | 21594750 | 21594745 | - |
| SEQ ID NO 26902 | AATTTCATACAAATTTTAGATT | TTT | chr12 | 21594744 | 21594765 | 21594749 | 21594744 | - |
| SEQ ID NO 26903 | ATTTCATACAAATTTTAGATTG | TTA | chr12 | 21594743 | 21594764 | 21594748 | 21594743 | - |
| SEQ ID NO 26904 | CATACAAATTTTAGATTGGTTT | TTT | chr12 | 21594739 | 21594760 | 21594744 | 21594739 | - |
| SEQ ID NO 26905 | ATACAAATTTTAGATTGGTTTT | TTC | chr12 | 21594738 | 21594759 | 21594743 | 21594738 | - |
| SEQ ID NO 26906 | TAGATTGGTTTTTCCATTTCTG | TTT | chr12 | 21594728 | 21594749 | 21594733 | 21594728 | - |
| SEQ ID NO 26907 | AGATTGGTTTTTCCATTTCTGT | TTT | chr12 | 21594727 | 21594748 | 21594732 | 21594727 | - |
| SEQ ID NO 26908 | GATTGGTTTTTCCATTTCTGTG | TTA | chr12 | 21594726 | 21594747 | 21594731 | 21594726 | - |
| SEQ ID NO 26909 | GTTTTTCCATTTCTGTGAAAAA | TTG | chr12 | 21594721 | 21594742 | 21594726 | 21594721 | - |
| SEQ ID NO 26910 | TTCCATTTCTGTGAAAAATGAC | TTT | chr12 | 21594717 | 21594738 | 21594722 | 21594717 | - |
| SEQ ID NO 26911 | TCCATTTCTGTGAAAAATGACA | TTT | chr12 | 21594716 | 21594737 | 21594721 | 21594716 | - |
| SEQ ID NO 26912 | CCATTTCTGTGAAAAATGACAT | TTT | chr12 | 21594715 | 21594736 | 21594720 | 21594715 | - |
| SEQ ID NO 26913 | CATTTCTGTGAAAAATGACATT | TTC | chr12 | 21594714 | 21594735 | 21594719 | 21594714 | - |
| SEQ ID NO 26914 | CTGTGAAAAATGACATTGCTAT | TTT | chr12 | 21594709 | 21594730 | 21594714 | 21594709 | - |
| SEQ ID NO 26915 | TGTGAAAAATGACATTGCTATT | TTC | chr12 | 21594708 | 21594729 | 21594713 | 21594708 | - |
| SEQ ID NO 26916 | TGAAAAATGACATTGCTATTTT | CTG | chr12 | 21594706 | 21594727 | 21594711 | 21594706 | - |
| SEQ ID NO 26917 | CTATTTTGATAGCGGTCATATA | TTG | chr12 | 21594691 | 21594712 | 21594696 | 21594691 | - |
| SEQ ID NO 26918 | TTTTGATAGCGGTCATATAGAA | CTA | chr12 | 21594688 | 21594709 | 21594693 | 21594688 | - |
| SEQ ID NO 26919 | TGATAGCGGTCATATAGAATCT | TTT | chr12 | 21594685 | 21594706 | 21594690 | 21594685 | - |
| SEQ ID NO 26920 | GATAGCGGTCATATAGAATCTG | TTT | chr12 | 21594684 | 21594705 | 21594689 | 21594684 | - |
| SEQ ID NO 26921 | ATAGCGGTCATATAGAATCTGT | TTG | chr12 | 21594683 | 21594704 | 21594688 | 21594683 | - |

Figure 48 (Cont'd)

| | | | | | | | | |
|---|---|---|---|---|---|---|---|---|
| SEQ ID NO 26922 | TAGATTGCTTTGGGTAGTATGG | CTG | chr12 | 21594662 | 21594683 | 21594667 | 21594662 | - |
| SEQ ID NO 26923 | CTTTGGGTAGTATGGCCATTTT | TTG | chr12 | 21594655 | 21594676 | 21594660 | 21594655 | - |
| SEQ ID NO 26924 | TGGGTAGTATGGCCATTTTAAC | CTT | chr12 | 21594652 | 21594673 | 21594657 | 21594652 | - |
| SEQ ID NO 26925 | GGGTAGTATGGCCATTTTAACA | TTT | chr12 | 21594651 | 21594672 | 21594656 | 21594651 | - |
| SEQ ID NO 26926 | GGTAGTATGGCCATTTTAACAA | TTG | chr12 | 21594650 | 21594671 | 21594655 | 21594650 | - |
| SEQ ID NO 26927 | TAACAATATTAATTTTTCTGAT | TTT | chr12 | 21594634 | 21594655 | 21594639 | 21594634 | - |
| SEQ ID NO 26928 | AACAATATTAATTTTTCTGATC | TTT | chr12 | 21594633 | 21594654 | 21594638 | 21594633 | - |
| SEQ ID NO 26929 | ACAATATTAATTTTTCTGATCC | TTA | chr12 | 21594632 | 21594653 | 21594637 | 21594632 | - |
| SEQ ID NO 26930 | ATTTTTCTGATCCATGAACATA | TTA | chr12 | 21594623 | 21594644 | 21594628 | 21594623 | - |
| SEQ ID NO 26931 | TTCTGATCCATGAACATAGGAT | TTT | chr12 | 21594619 | 21594640 | 21594624 | 21594619 | - |
| SEQ ID NO 26932 | TCTGATCCATGAACATAGGATA | TTT | chr12 | 21594618 | 21594639 | 21594623 | 21594618 | - |
| SEQ ID NO 26933 | CTGATCCATGAACATAGGATAT | TTT | chr12 | 21594617 | 21594638 | 21594622 | 21594617 | - |
| SEQ ID NO 26934 | TGATCCATGAACATAGGATATC | TTC | chr12 | 21594616 | 21594637 | 21594621 | 21594616 | - |
| SEQ ID NO 26935 | ATCCATGAACATAGGATATCTC | CTG | chr12 | 21594614 | 21594635 | 21594619 | 21594614 | - |
| SEQ ID NO 26936 | TCCATTTGTTTCTGTCCTTTTC | CTC | chr12 | 21594592 | 21594613 | 21594597 | 21594592 | - |
| SEQ ID NO 26937 | CATTTGTTTCTGTCCTTTTCAA | CTC | chr12 | 21594590 | 21594611 | 21594595 | 21594590 | - |
| SEQ ID NO 26938 | GTTTCTGTCCTTTTCAATTCTT | TTT | chr12 | 21594585 | 21594606 | 21594590 | 21594585 | - |
| SEQ ID NO 26939 | TTTCTGTCCTTTTCAATTCTTT | TTG | chr12 | 21594584 | 21594605 | 21594589 | 21594584 | - |
| SEQ ID NO 26940 | CTGTCCTTTTCAATTCTTTTAT | TTT | chr12 | 21594581 | 21594602 | 21594586 | 21594581 | - |
| SEQ ID NO 26941 | TGTCCTTTTCAATTCTTTTATC | TTC | chr12 | 21594580 | 21594601 | 21594585 | 21594580 | - |
| SEQ ID NO 26942 | TCCTTTTCAATTCTTTTATCAG | CTG | chr12 | 21594578 | 21594599 | 21594583 | 21594578 | - |
| SEQ ID NO 26943 | TTCAATTCTTTTATCAGTGTTT | CTT | chr12 | 21594573 | 21594594 | 21594578 | 21594573 | - |
| SEQ ID NO 26944 | TCAATTCTTTTATCAGTGTTTT | TTT | chr12 | 21594572 | 21594593 | 21594577 | 21594572 | - |
| SEQ ID NO 26945 | CAATTCTTTTATCAGTGTTTTG | TTT | chr12 | 21594571 | 21594592 | 21594576 | 21594571 | - |
| SEQ ID NO 26946 | AATTCTTTTATCAGTGTTTTGT | TTC | chr12 | 21594570 | 21594591 | 21594575 | 21594570 | - |
| SEQ ID NO 26947 | TTTTATCAGTGTTTTGTAGTTT | TTC | chr12 | 21594565 | 21594586 | 21594570 | 21594565 | - |
| SEQ ID NO 26948 | TTATCAGTGTTTTGTAGTTTTC | CTT | chr12 | 21594563 | 21594584 | 21594568 | 21594563 | - |
| SEQ ID NO 26949 | TATCAGTGTTTTGTAGTTTTCC | TTT | chr12 | 21594562 | 21594583 | 21594567 | 21594562 | - |
| SEQ ID NO 26950 | ATCAGTGTTTTGTAGTTTTCCG | TTT | chr12 | 21594561 | 21594582 | 21594566 | 21594561 | - |
| SEQ ID NO 26951 | TCAGTGTTTTGTAGTTTTCCGA | TTA | chr12 | 21594560 | 21594581 | 21594565 | 21594560 | - |
| SEQ ID NO 26952 | TGTAGTTTTCCGAATAGAGGTT | TTT | chr12 | 21594551 | 21594572 | 21594556 | 21594551 | - |
| SEQ ID NO 26953 | GTAGTTTTCCGAATAGAGGTTT | TTT | chr12 | 21594550 | 21594571 | 21594555 | 21594550 | - |
| SEQ ID NO 26954 | TAGTTTTCCGAATAGAGGTTTT | TTG | chr12 | 21594549 | 21594570 | 21594554 | 21594549 | - |
| SEQ ID NO 26955 | TCCGAATAGAGGTTTTTCGGTT | TTT | chr12 | 21594543 | 21594564 | 21594548 | 21594543 | - |
| SEQ ID NO 26956 | CCGAATAGAGGTTTTTCGGTTC | TTT | chr12 | 21594542 | 21594563 | 21594547 | 21594542 | - |
| SEQ ID NO 26957 | CGAATAGAGGTTTTTCGGTTCC | TTC | chr12 | 21594541 | 21594562 | 21594546 | 21594541 | - |
| SEQ ID NO 26958 | TTCGGTTCCTTGGTTAAATTTA | TTT | chr12 | 21594528 | 21594549 | 21594533 | 21594528 | - |
| SEQ ID NO 26959 | TCGGTTCCTTGGTTAAATTTAT | TTT | chr12 | 21594527 | 21594548 | 21594532 | 21594527 | - |
| SEQ ID NO 26960 | CGGTTCCTTGGTTAAATTTATC | TTT | chr12 | 21594526 | 21594547 | 21594531 | 21594526 | - |
| SEQ ID NO 26961 | GGTTCCTTGGTTAAATTTATCC | TTC | chr12 | 21594525 | 21594546 | 21594530 | 21594525 | - |
| SEQ ID NO 26962 | CTTGGTTAAATTTATCCCTAAA | TTC | chr12 | 21594520 | 21594541 | 21594525 | 21594520 | - |
| SEQ ID NO 26963 | GGTTAAATTTATCCCTAAATAT | CTT | chr12 | 21594517 | 21594538 | 21594522 | 21594517 | - |
| SEQ ID NO 26964 | GTTAAATTTATCCCTAAATATT | TTG | chr12 | 21594516 | 21594537 | 21594521 | 21594516 | - |
| SEQ ID NO 26965 | AATTTATCCCTAAATATTTTAT | TTA | chr12 | 21594512 | 21594533 | 21594517 | 21594512 | - |
| SEQ ID NO 26966 | ATCCCTAAATATTTTATTTTTT | TTT | chr12 | 21594507 | 21594528 | 21594512 | 21594507 | - |
| SEQ ID NO 26967 | TCCCTAAATATTTTATTTTTTA | TTA | chr12 | 21594506 | 21594527 | 21594511 | 21594506 | - |
| SEQ ID NO 26968 | AATATTTTATTTTTTAGCTATT | CTA | chr12 | 21594500 | 21594521 | 21594505 | 21594500 | - |
| SEQ ID NO 26969 | TATTTTTAGCTATTGTAAATG | TTT | chr12 | 21594493 | 21594514 | 21594498 | 21594493 | - |
| SEQ ID NO 26970 | ATTTTTTAGCTATTGTAAATGG | TTT | chr12 | 21594492 | 21594513 | 21594497 | 21594492 | - |
| SEQ ID NO 26971 | TTTTTTAGCTATTGTAAATGGG | TTA | chr12 | 21594491 | 21594512 | 21594496 | 21594491 | - |
| SEQ ID NO 26972 | TTTAGCTATTGTAAATGGGATT | TTT | chr12 | 21594488 | 21594509 | 21594493 | 21594488 | - |
| SEQ ID NO 26973 | TTAGCTATTGTAAATGGGATTG | TTT | chr12 | 21594487 | 21594508 | 21594492 | 21594487 | - |
| SEQ ID NO 26974 | TAGCTATTGTAAATGGGATTGC | TTT | chr12 | 21594486 | 21594507 | 21594491 | 21594486 | - |
| SEQ ID NO 26975 | AGCTATTGTAAATGGGATTGCC | TTT | chr12 | 21594485 | 21594506 | 21594490 | 21594485 | - |
| SEQ ID NO 26976 | GCTATTGTAAATGGGATTGCCT | TTA | chr12 | 21594484 | 21594505 | 21594489 | 21594484 | - |
| SEQ ID NO 26977 | TTGTAAATGGGATTGCCTTCTT | CTA | chr12 | 21594480 | 21594501 | 21594485 | 21594480 | - |
| SEQ ID NO 26978 | TAAATGGGATTGCCTTCTTAAT | TTG | chr12 | 21594477 | 21594498 | 21594482 | 21594477 | - |
| SEQ ID NO 26979 | CCTTCTTAATTTCCTTCTCAGC | TTG | chr12 | 21594465 | 21594486 | 21594470 | 21594465 | - |

Figure 48 (Cont'd)

| | | | | | | | | |
|---|---|---|---|---|---|---|---|---|
| SEQ ID NO 26980 | CTTAATTTCCTTCTCAGCTAGT | CTT | chr12 | 21594461 | 21594482 | 21594466 | 21594461 | - |
| SEQ ID NO 26981 | TTAATTTCCTTCTCAGCTAGTT | TTC | chr12 | 21594460 | 21594481 | 21594465 | 21594460 | - |
| SEQ ID NO 26982 | AATTTCCTTCTCAGCTAGTTTA | CTT | chr12 | 21594458 | 21594479 | 21594463 | 21594458 | - |
| SEQ ID NO 26983 | ATTTCCTTCTCAGCTAGTTTAT | TTA | chr12 | 21594457 | 21594478 | 21594462 | 21594457 | - |
| SEQ ID NO 26984 | CCTTCTCAGCTAGTTTATTATT | TTT | chr12 | 21594453 | 21594474 | 21594458 | 21594453 | - |
| SEQ ID NO 26985 | CTTCTCAGCTAGTTTATTATTG | TTC | chr12 | 21594452 | 21594473 | 21594457 | 21594452 | - |
| SEQ ID NO 26986 | CTCAGCTAGTTTATTATTGGTG | CTT | chr12 | 21594449 | 21594470 | 21594454 | 21594449 | - |
| SEQ ID NO 26987 | TCAGCTAGTTTATTATTGGTGT | TTC | chr12 | 21594448 | 21594469 | 21594453 | 21594448 | - |
| SEQ ID NO 26988 | AGCTAGTTTATTATTGGTGTGT | CTC | chr12 | 21594446 | 21594467 | 21594451 | 21594446 | - |
| SEQ ID NO 26989 | GTTTATTATTGGTGTGTAGAAA | CTA | chr12 | 21594441 | 21594462 | 21594446 | 21594441 | - |
| SEQ ID NO 26990 | ATTATTGGTGTGTAGAAACATT | TTT | chr12 | 21594437 | 21594458 | 21594442 | 21594437 | - |
| SEQ ID NO 26991 | TTATTGGTGTGTAGAAACATTG | TTA | chr12 | 21594436 | 21594457 | 21594441 | 21594436 | - |
| SEQ ID NO 26992 | TTGGTGTGTAGAAACATTGCTT | TTA | chr12 | 21594433 | 21594454 | 21594438 | 21594433 | - |
| SEQ ID NO 26993 | GTGTGTAGAAACATTGCTTGTT | TTG | chr12 | 21594430 | 21594451 | 21594435 | 21594430 | - |
| SEQ ID NO 26994 | CTTGTTTCATATGCTGATTTTG | TTG | chr12 | 21594414 | 21594435 | 21594419 | 21594414 | - |
| SEQ ID NO 26995 | GTTTCATATGCTGATTTTGTCT | CTT | chr12 | 21594411 | 21594432 | 21594416 | 21594411 | - |
| SEQ ID NO 26996 | TTTCATATGCTGATTTTGTCTC | TTG | chr12 | 21594410 | 21594431 | 21594415 | 21594410 | - |
| SEQ ID NO 26997 | CATATGCTGATTTTGTCTCCTG | TTT | chr12 | 21594407 | 21594428 | 21594412 | 21594407 | - |
| SEQ ID NO 26998 | ATATGCTGATTTTGTCTCCTGT | TTC | chr12 | 21594406 | 21594427 | 21594411 | 21594406 | - |
| SEQ ID NO 26999 | ATTTTGTCTCCTGTAACTTTAC | CTG | chr12 | 21594398 | 21594419 | 21594403 | 21594398 | - |
| SEQ ID NO 27000 | TGTCTCCTGTAACTTTACTGAA | TTT | chr12 | 21594394 | 21594415 | 21594399 | 21594394 | - |
| SEQ ID NO 27001 | GTCTCCTGTAACTTTACTGAAT | TTT | chr12 | 21594393 | 21594414 | 21594398 | 21594393 | - |
| SEQ ID NO 27002 | TCTCCTGTAACTTTACTGAATT | TTG | chr12 | 21594392 | 21594413 | 21594397 | 21594392 | - |
| SEQ ID NO 27003 | CTGTAACTTTACTGAATTTATT | CTC | chr12 | 21594388 | 21594409 | 21594393 | 21594388 | - |
| SEQ ID NO 27004 | TAACTTTACTGAATTTATTTTT | CTG | chr12 | 21594385 | 21594406 | 21594390 | 21594385 | - |
| SEQ ID NO 27005 | TACTGAATTTATTTTTCAGCGC | CTT | chr12 | 21594379 | 21594400 | 21594384 | 21594379 | - |
| SEQ ID NO 27006 | ACTGAATTTATTTTTCAGCGCT | TTT | chr12 | 21594378 | 21594399 | 21594383 | 21594378 | - |
| SEQ ID NO 27007 | CTGAATTTATTTTTCAGCGCTA | TTA | chr12 | 21594377 | 21594398 | 21594382 | 21594377 | - |
| SEQ ID NO 27008 | AATTTATTTTTCAGCGCTAAGA | CTG | chr12 | 21594374 | 21594395 | 21594379 | 21594374 | - |
| SEQ ID NO 27009 | ATTTTCAGCGCTAAGAGTGCT | TTT | chr12 | 21594369 | 21594390 | 21594374 | 21594369 | - |
| SEQ ID NO 27010 | TTTTTCAGCGCTAAGAGTGCTT | TTA | chr12 | 21594368 | 21594389 | 21594373 | 21594368 | - |
| SEQ ID NO 27011 | TTCAGCGCTAAGAGTGCTTTGG | TTT | chr12 | 21594365 | 21594386 | 21594370 | 21594365 | - |
| SEQ ID NO 27012 | TCAGCGCTAAGAGTGCTTTGGT | TTT | chr12 | 21594364 | 21594385 | 21594369 | 21594364 | - |
| SEQ ID NO 27013 | CAGCGCTAAGAGTGCTTTGGTG | TTT | chr12 | 21594363 | 21594384 | 21594368 | 21594363 | - |
| SEQ ID NO 27014 | AGCGCTAAGAGTGCTTTGGTGG | TTC | chr12 | 21594362 | 21594383 | 21594367 | 21594362 | - |
| SEQ ID NO 27015 | AGAGTGCTTTGGTGGAGTCTTG | CTA | chr12 | 21594355 | 21594376 | 21594360 | 21594355 | - |
| SEQ ID NO 27016 | TGGTGGAGTCTTGGTTTTTCTA | CTT | chr12 | 21594346 | 21594367 | 21594351 | 21594346 | - |
| SEQ ID NO 27017 | GGTGGAGTCTTGGTTTTTCTAG | TTT | chr12 | 21594345 | 21594366 | 21594350 | 21594345 | - |
| SEQ ID NO 27018 | GTGGAGTCTTGGTTTTTCTAGG | TTG | chr12 | 21594344 | 21594365 | 21594349 | 21594344 | - |
| SEQ ID NO 27019 | GGTTTTTCTAGGTATAAAATCA | CTT | chr12 | 21594334 | 21594355 | 21594339 | 21594334 | - |
| SEQ ID NO 27020 | GTTTTTCTAGGTATAAAATCAT | TTG | chr12 | 21594333 | 21594354 | 21594338 | 21594333 | - |
| SEQ ID NO 27021 | TTCTAGGTATAAAATCATGTCA | TTT | chr12 | 21594329 | 21594350 | 21594334 | 21594329 | - |
| SEQ ID NO 27022 | TCTAGGTATAAAATCATGTCAT | TTT | chr12 | 21594328 | 21594349 | 21594333 | 21594328 | - |
| SEQ ID NO 27023 | CTAGGTATAAAATCATGTCATC | TTT | chr12 | 21594327 | 21594348 | 21594332 | 21594327 | - |
| SEQ ID NO 27024 | TAGGTATAAAATCATGTCATCT | TTC | chr12 | 21594326 | 21594347 | 21594331 | 21594326 | - |
| SEQ ID NO 27025 | GGTATAAAATCATGTCATCTGG | CTA | chr12 | 21594324 | 21594345 | 21594329 | 21594324 | - |
| SEQ ID NO 27026 | GAAAGATGGACAGTTTGACTTC | CTG | chr12 | 21594303 | 21594324 | 21594308 | 21594303 | - |
| SEQ ID NO 27027 | GACTTCATCTTTTCCTATTTGC | TTT | chr12 | 21594287 | 21594308 | 21594292 | 21594287 | - |
| SEQ ID NO 27028 | ACTTCATCTTTTCCTATTTGCA | TTG | chr12 | 21594286 | 21594307 | 21594291 | 21594286 | - |
| SEQ ID NO 27029 | CATCTTTTCCTATTTGCATGCC | CTT | chr12 | 21594282 | 21594303 | 21594287 | 21594282 | - |
| SEQ ID NO 27030 | ATCTTTTCCTATTTGCATGCCT | TTC | chr12 | 21594281 | 21594302 | 21594286 | 21594281 | - |
| SEQ ID NO 27031 | TTCCTATTTGCATGCCTTTTCT | CTT | chr12 | 21594276 | 21594297 | 21594281 | 21594276 | - |
| SEQ ID NO 27032 | TCCTATTTGCATGCCTTTTCTT | TTT | chr12 | 21594275 | 21594296 | 21594280 | 21594275 | - |
| SEQ ID NO 27033 | CCTATTTGCATGCCTTTTCTTT | TTT | chr12 | 21594274 | 21594295 | 21594279 | 21594274 | - |
| SEQ ID NO 27034 | CTATTTGCATGCCTTTTCTTTC | TTC | chr12 | 21594273 | 21594294 | 21594278 | 21594273 | - |
| SEQ ID NO 27035 | TTTGCATGCCTTTTCTTTCTTT | CTA | chr12 | 21594270 | 21594291 | 21594275 | 21594270 | - |
| SEQ ID NO 27036 | GCATGCCTTTTCTTTCTTTCTT | TTT | chr12 | 21594267 | 21594288 | 21594272 | 21594267 | - |
| SEQ ID NO 27037 | CATGCCTTTTCTTTCTTTCTTT | TTG | chr12 | 21594266 | 21594287 | 21594271 | 21594266 | - |

Figure 48 (Cont'd)

| SEQ ID NO 27038 | TTCTTTCTTTCTTTCTCTGACC | CTT | chr12 | 21594258 | 21594279 | 21594263 | 21594258 | - |
| SEQ ID NO 27039 | TCTTTCTTTCTTTCTCTGACCT | TTT | chr12 | 21594257 | 21594278 | 21594262 | 21594257 | - |
| SEQ ID NO 27040 | CTTTCTTTCTTTCTCTGACCTG | TTT | chr12 | 21594256 | 21594277 | 21594261 | 21594256 | - |
| SEQ ID NO 27041 | TTTCTTTCTTTCTCTGACCTGA | TTC | chr12 | 21594255 | 21594276 | 21594260 | 21594255 | - |
| SEQ ID NO 27042 | TCTTTCTTTCTCTGACCTGAAA | CTT | chr12 | 21594253 | 21594274 | 21594258 | 21594253 | - |
| SEQ ID NO 27043 | CTTTCTTTCTCTGACCTGAAAG | TTT | chr12 | 21594252 | 21594273 | 21594257 | 21594252 | - |
| SEQ ID NO 27044 | TTTCTTTCTCTGACCTGAAAGC | TTC | chr12 | 21594251 | 21594272 | 21594256 | 21594251 | - |
| SEQ ID NO 27045 | TCTTTCTCTGACCTGAAAGCTG | CTT | chr12 | 21594249 | 21594270 | 21594254 | 21594249 | - |
| SEQ ID NO 27046 | CTTTCTCTGACCTGAAAGCTGT | TTT | chr12 | 21594248 | 21594269 | 21594253 | 21594248 | - |
| SEQ ID NO 27047 | TTTCTCTGACCTGAAAGCTGTG | TTC | chr12 | 21594247 | 21594268 | 21594252 | 21594247 | - |
| SEQ ID NO 27048 | TCTCTGACCTGAAAGCTGTGGC | CTT | chr12 | 21594245 | 21594266 | 21594250 | 21594245 | - |
| SEQ ID NO 27049 | CTCTGACCTGAAAGCTGTGGCT | TTT | chr12 | 21594244 | 21594265 | 21594249 | 21594244 | - |
| SEQ ID NO 27050 | TCTGACCTGAAAGCTGTGGCTA | TTC | chr12 | 21594243 | 21594264 | 21594248 | 21594243 | - |
| SEQ ID NO 27051 | TGACCTGAAAGCTGTGGCTAGG | CTC | chr12 | 21594241 | 21594262 | 21594246 | 21594241 | - |
| SEQ ID NO 27052 | ACCTGAAAGCTGTGGCTAGGAC | CTG | chr12 | 21594239 | 21594260 | 21594244 | 21594239 | - |
| SEQ ID NO 27053 | AAAGCTGTGGCTAGGACTTCCA | CTG | chr12 | 21594234 | 21594255 | 21594239 | 21594234 | - |
| SEQ ID NO 27054 | TGGCTAGGACTTCCAGTATTAT | CTG | chr12 | 21594227 | 21594248 | 21594232 | 21594227 | - |
| SEQ ID NO 27055 | GGACTTCCAGTATTATATTGAA | CTA | chr12 | 21594221 | 21594242 | 21594226 | 21594221 | - |
| SEQ ID NO 27056 | CCAGTATTATATTGAATAGGAG | CTT | chr12 | 21594215 | 21594236 | 21594220 | 21594215 | - |
| SEQ ID NO 27057 | CAGTATTATATTGAATAGGAGT | TTC | chr12 | 21594214 | 21594235 | 21594219 | 21594214 | - |
| SEQ ID NO 27058 | TATTGAATAGGAGTGATGGAAG | TTA | chr12 | 21594206 | 21594227 | 21594211 | 21594206 | - |
| SEQ ID NO 27059 | AATAGGAGTGATGGAAGTGGGC | TTG | chr12 | 21594201 | 21594222 | 21594206 | 21594201 | - |
| SEQ ID NO 27060 | ATTTTGTTTCAGTTCTTAGAGG | CTT | chr12 | 21594173 | 21594194 | 21594178 | 21594173 | - |
| SEQ ID NO 27061 | TTTTGTTTCAGTTCTTAGAGGA | TTA | chr12 | 21594172 | 21594193 | 21594177 | 21594172 | - |
| SEQ ID NO 27062 | TGTTTCAGTTCTTAGAGGAAAG | TTT | chr12 | 21594169 | 21594190 | 21594174 | 21594169 | - |
| SEQ ID NO 27063 | GTTTCAGTTCTTAGAGGAAAGG | TTT | chr12 | 21594168 | 21594189 | 21594173 | 21594168 | - |
| SEQ ID NO 27064 | TTTCAGTTCTTAGAGGAAAGGC | TTG | chr12 | 21594167 | 21594188 | 21594172 | 21594167 | - |
| SEQ ID NO 27065 | CAGTTCTTAGAGGAAAGGCTTC | TTT | chr12 | 21594164 | 21594185 | 21594169 | 21594164 | - |
| SEQ ID NO 27066 | AGTTCTTAGAGGAAAGGCTTCC | TTC | chr12 | 21594163 | 21594184 | 21594168 | 21594163 | - |
| SEQ ID NO 27067 | TTAGAGGAAAGGCTTCCAGCTT | TTC | chr12 | 21594158 | 21594179 | 21594163 | 21594158 | - |
| SEQ ID NO 27068 | AGAGGAAAGGCTTCCAGCTTTT | CTT | chr12 | 21594156 | 21594177 | 21594161 | 21594156 | - |
| SEQ ID NO 27069 | GAGGAAAGGCTTCCAGCTTTTC | TTA | chr12 | 21594155 | 21594176 | 21594160 | 21594155 | - |
| SEQ ID NO 27070 | CCAGCTTTTCCCAATTCAGTAT | CTT | chr12 | 21594143 | 21594164 | 21594148 | 21594143 | - |
| SEQ ID NO 27071 | CAGCTTTTCCCAATTCAGTATG | TTC | chr12 | 21594142 | 21594163 | 21594147 | 21594142 | - |
| SEQ ID NO 27072 | TTCCCAATTCAGTATGATGTTA | CTT | chr12 | 21594136 | 21594157 | 21594141 | 21594136 | - |
| SEQ ID NO 27073 | TCCCAATTCAGTATGATGTTAG | TTT | chr12 | 21594135 | 21594156 | 21594140 | 21594135 | - |
| SEQ ID NO 27074 | CCCAATTCAGTATGATGTTAGC | TTT | chr12 | 21594134 | 21594155 | 21594139 | 21594134 | - |
| SEQ ID NO 27075 | CCAATTCAGTATGATGTTAGCT | TTC | chr12 | 21594133 | 21594154 | 21594138 | 21594133 | - |
| SEQ ID NO 27076 | AGTATGATGTTAGCTGTGGGTT | TTC | chr12 | 21594126 | 21594147 | 21594131 | 21594126 | - |
| SEQ ID NO 27077 | GCTGTGGGTTTGTCATATATGA | TTA | chr12 | 21594114 | 21594135 | 21594119 | 21594114 | - |
| SEQ ID NO 27078 | TGGGTTTGTCATATATGACTTT | CTG | chr12 | 21594110 | 21594131 | 21594115 | 21594110 | - |
| SEQ ID NO 27079 | GTCATATATGACTTTTATTATA | TTT | chr12 | 21594103 | 21594124 | 21594108 | 21594103 | - |
| SEQ ID NO 27080 | TCATATATGACTTTTATTATAT | TTG | chr12 | 21594102 | 21594123 | 21594107 | 21594102 | - |
| SEQ ID NO 27081 | TTATTATATTGAGATATGTTCC | CTT | chr12 | 21594089 | 21594110 | 21594094 | 21594089 | - |
| SEQ ID NO 27082 | TATTATATTGAGATATGTTCCT | TTT | chr12 | 21594088 | 21594109 | 21594093 | 21594088 | - |
| SEQ ID NO 27083 | ATTATATTGAGATATGTTCCTT | TTT | chr12 | 21594087 | 21594108 | 21594092 | 21594087 | - |
| SEQ ID NO 27084 | TTATATTGAGATATGTTCCTTC | TTA | chr12 | 21594086 | 21594107 | 21594091 | 21594086 | - |
| SEQ ID NO 27085 | TATTGAGATATGTTCCTTCTAT | TTA | chr12 | 21594083 | 21594104 | 21594088 | 21594083 | - |
| SEQ ID NO 27086 | AGATATGTTCCTTCTATGATTG | TTG | chr12 | 21594078 | 21594099 | 21594083 | 21594078 | - |
| SEQ ID NO 27087 | CTTCTATGATTGGCTGCAGATA | TTC | chr12 | 21594068 | 21594089 | 21594073 | 21594068 | - |
| SEQ ID NO 27088 | CTATGATTGGCTGCAGATAGTT | CTT | chr12 | 21594065 | 21594086 | 21594070 | 21594065 | - |
| SEQ ID NO 27089 | TATGATTGGCTGCAGATAGTTT | TTC | chr12 | 21594064 | 21594085 | 21594069 | 21594064 | - |
| SEQ ID NO 27090 | TGATTGGCTGCAGATAGTTTTT | CTA | chr12 | 21594062 | 21594083 | 21594067 | 21594062 | - |
| SEQ ID NO 27091 | GCTGCAGATAGTTTTTATCATG | TTG | chr12 | 21594056 | 21594077 | 21594061 | 21594056 | - |
| SEQ ID NO 27092 | CAGATAGTTTTTATCATGAAGG | CTG | chr12 | 21594052 | 21594073 | 21594057 | 21594052 | - |
| SEQ ID NO 27093 | TTATCATGAAGGAATGTTAAAT | TTT | chr12 | 21594042 | 21594063 | 21594047 | 21594042 | - |
| SEQ ID NO 27094 | TATCATGAAGGAATGTTAAATT | TTT | chr12 | 21594041 | 21594062 | 21594046 | 21594041 | - |
| SEQ ID NO 27095 | ATCATGAAGGAATGTTAAATTT | TTT | chr12 | 21594040 | 21594061 | 21594045 | 21594040 | - |

Figure 48 (Cont'd)

| | | | | | | | | |
|---|---|---|---|---|---|---|---|---|
| SEQ ID NO 27096 | TCATGAAGGAATGTTAAATTTT | TTA | chr12 | 21594039 | 21594060 | 21594044 | 21594039 | - |
| SEQ ID NO 27097 | AATTTTATCAAATACTTTTTCT | TTA | chr12 | 21594023 | 21594044 | 21594028 | 21594023 | - |
| SEQ ID NO 27098 | TATCAAATACTTTTTCTGTATC | TTT | chr12 | 21594018 | 21594039 | 21594023 | 21594018 | - |
| SEQ ID NO 27099 | ATCAAATACTTTTTCTGTATCT | TTT | chr12 | 21594017 | 21594038 | 21594022 | 21594017 | - |
| SEQ ID NO 27100 | TCAAATACTTTTTCTGTATCTA | TTA | chr12 | 21594016 | 21594037 | 21594021 | 21594016 | - |
| SEQ ID NO 27101 | TTTCTGTATCTATTGAGATGAT | CTT | chr12 | 21594006 | 21594027 | 21594011 | 21594006 | - |
| SEQ ID NO 27102 | TTCTGTATCTATTGAGATGATC | TTT | chr12 | 21594005 | 21594026 | 21594010 | 21594005 | - |
| SEQ ID NO 27103 | TCTGTATCTATTGAGATGATCA | TTT | chr12 | 21594004 | 21594025 | 21594009 | 21594004 | - |
| SEQ ID NO 27104 | CTGTATCTATTGAGATGATCAT | TTT | chr12 | 21594003 | 21594024 | 21594008 | 21594003 | - |
| SEQ ID NO 27105 | TGTATCTATTGAGATGATCATA | TTC | chr12 | 21594002 | 21594023 | 21594007 | 21594002 | - |
| SEQ ID NO 27106 | TATCTATTGAGATGATCATATG | CTG | chr12 | 21594000 | 21594021 | 21594005 | 21594000 | - |
| SEQ ID NO 27107 | TTGAGATGATCATATGGTTTTT | CTA | chr12 | 21593994 | 21594015 | 21593999 | 21593994 | - |
| SEQ ID NO 27108 | AGATGATCATATGGTTTTTGTT | TTG | chr12 | 21593991 | 21594012 | 21593996 | 21593991 | - |
| SEQ ID NO 27109 | TTGTTCTTTTTGTTGATGTGAT | TTT | chr12 | 21593974 | 21593995 | 21593979 | 21593974 | - |
| SEQ ID NO 27110 | TGTTCTTTTTGTTGATGTGATG | TTT | chr12 | 21593973 | 21593994 | 21593978 | 21593973 | - |
| SEQ ID NO 27111 | GTTCTTTTTGTTGATGTGATGT | TTT | chr12 | 21593972 | 21593993 | 21593977 | 21593972 | - |
| SEQ ID NO 27112 | TTCTTTTTGTTGATGTGATGTA | TTG | chr12 | 21593971 | 21593992 | 21593976 | 21593971 | - |
| SEQ ID NO 27113 | TTTTTGTTGATGTGATGTATCA | TTC | chr12 | 21593968 | 21593989 | 21593973 | 21593968 | - |
| SEQ ID NO 27114 | TTTGTTGATGTGATGTATCACA | CTT | chr12 | 21593966 | 21593987 | 21593971 | 21593966 | - |
| SEQ ID NO 27115 | TTGTTGATGTGATGTATCACAT | TTT | chr12 | 21593965 | 21593986 | 21593970 | 21593965 | - |
| SEQ ID NO 27116 | TGTTGATGTGATGTATCACATT | TTT | chr12 | 21593964 | 21593985 | 21593969 | 21593964 | - |
| SEQ ID NO 27117 | GTTGATGTGATGTATCACATTT | TTT | chr12 | 21593963 | 21593984 | 21593968 | 21593963 | - |
| SEQ ID NO 27118 | TTGATGTGATGTATCACATTTA | TTG | chr12 | 21593962 | 21593983 | 21593967 | 21593962 | - |
| SEQ ID NO 27119 | ATGTGATGTATCACATTTATTG | TTG | chr12 | 21593959 | 21593980 | 21593964 | 21593959 | - |
| SEQ ID NO 27120 | ATTGATTTGAACTGTTCTTGCA | TTT | chr12 | 21593941 | 21593962 | 21593946 | 21593941 | - |
| SEQ ID NO 27121 | TTGATTTGAACTGTTCTTGCAA | TTA | chr12 | 21593940 | 21593961 | 21593945 | 21593940 | - |
| SEQ ID NO 27122 | ATTTGAACTGTTCTTGCAACCC | TTG | chr12 | 21593937 | 21593958 | 21593942 | 21593937 | - |
| SEQ ID NO 27123 | GAACTGTTCTTGCAACCCTAGT | TTT | chr12 | 21593933 | 21593954 | 21593938 | 21593933 | - |
| SEQ ID NO 27124 | AACTGTTCTTGCAACCCTAGTA | TTG | chr12 | 21593932 | 21593953 | 21593937 | 21593932 | - |
| SEQ ID NO 27125 | TTCTTGCAACCCTAGTATAAAT | CTG | chr12 | 21593927 | 21593948 | 21593932 | 21593927 | - |
| SEQ ID NO 27126 | TTGCAACCCTAGTATAAATCCC | TTC | chr12 | 21593924 | 21593945 | 21593929 | 21593924 | - |
| SEQ ID NO 27127 | GCAACCCTAGTATAAATCCCAC | CTT | chr12 | 21593922 | 21593943 | 21593927 | 21593922 | - |
| SEQ ID NO 27128 | CAACCCTAGTATAAATCCCACT | TTG | chr12 | 21593921 | 21593942 | 21593926 | 21593921 | - |
| SEQ ID NO 27129 | GTATAAATCCCACTTGATCATG | CTA | chr12 | 21593913 | 21593934 | 21593918 | 21593913 | - |
| SEQ ID NO 27130 | GATCATGGTGTATTATCTTTTG | CTT | chr12 | 21593898 | 21593919 | 21593903 | 21593898 | - |
| SEQ ID NO 27131 | ATCATGGTGTATTATCTTTTGG | TTG | chr12 | 21593897 | 21593918 | 21593902 | 21593897 | - |
| SEQ ID NO 27132 | TCTTTTGGATGTACTGTTGGAT | TTA | chr12 | 21593883 | 21593904 | 21593888 | 21593883 | - |
| SEQ ID NO 27133 | TTGGATGTACTGTTGGATTCAG | CTT | chr12 | 21593879 | 21593900 | 21593884 | 21593879 | - |
| SEQ ID NO 27134 | TGGATGTACTGTTGGATTCAGT | TTT | chr12 | 21593878 | 21593899 | 21593883 | 21593878 | - |
| SEQ ID NO 27135 | GGATGTACTGTTGGATTCAGTT | TTT | chr12 | 21593877 | 21593898 | 21593882 | 21593877 | - |
| SEQ ID NO 27136 | GATGTACTGTTGGATTCAGTTT | TTG | chr12 | 21593876 | 21593897 | 21593881 | 21593876 | - |
| SEQ ID NO 27137 | TTGGATTCAGTTTGCTAGTATT | CTG | chr12 | 21593867 | 21593888 | 21593872 | 21593867 | - |
| SEQ ID NO 27138 | GATTCAGTTTGCTAGTATTTTG | TTG | chr12 | 21593864 | 21593885 | 21593869 | 21593864 | - |
| SEQ ID NO 27139 | AGTTTGCTAGTATTTTGTTGAG | TTC | chr12 | 21593859 | 21593880 | 21593864 | 21593859 | - |
| SEQ ID NO 27140 | GCTAGTATTTTGTTGAGGATTT | TTT | chr12 | 21593854 | 21593875 | 21593859 | 21593854 | - |
| SEQ ID NO 27141 | CTAGTATTTTGTTGAGGATTTT | TTG | chr12 | 21593853 | 21593874 | 21593858 | 21593853 | - |
| SEQ ID NO 27142 | GTATTTTGTTGAGGATTTTCAC | CTA | chr12 | 21593850 | 21593871 | 21593855 | 21593850 | - |
| SEQ ID NO 27143 | TGTTGAGGATTTTCACACCTAT | TTT | chr12 | 21593844 | 21593865 | 21593849 | 21593844 | - |
| SEQ ID NO 27144 | GTTGAGGATTTTCACACCTATG | TTT | chr12 | 21593843 | 21593864 | 21593848 | 21593843 | - |
| SEQ ID NO 27145 | TTGAGGATTTTCACACCTATGT | TTG | chr12 | 21593842 | 21593863 | 21593847 | 21593842 | - |
| SEQ ID NO 27146 | AGGATTTTCACACCTATGTTCC | TTG | chr12 | 21593839 | 21593860 | 21593844 | 21593839 | - |
| SEQ ID NO 27147 | TCACACCTATGTTCCATCAGGG | TTT | chr12 | 21593832 | 21593853 | 21593837 | 21593832 | - |
| SEQ ID NO 27148 | CACACCTATGTTCCATCAGGGA | TTT | chr12 | 21593831 | 21593852 | 21593836 | 21593831 | - |
| SEQ ID NO 27149 | ACACCTATGTTCCATCAGGGAT | TTC | chr12 | 21593830 | 21593851 | 21593835 | 21593830 | - |
| SEQ ID NO 27150 | TGTTCCATCAGGGATATTGACC | CTA | chr12 | 21593823 | 21593844 | 21593828 | 21593823 | - |
| SEQ ID NO 27151 | CATCAGGGATATTGACCTGCAG | TTC | chr12 | 21593818 | 21593839 | 21593823 | 21593818 | - |
| SEQ ID NO 27152 | ACCTGCAGTTTTATTTTACTT | TTG | chr12 | 21593804 | 21593825 | 21593809 | 21593804 | - |
| SEQ ID NO 27153 | CAGTTTTATTTTACTTGCATC | CTG | chr12 | 21593799 | 21593820 | 21593804 | 21593799 | - |

Figure 48 (Cont'd)

| SEQ ID NO 27154 | TATTTTTACTTGCATCCTTGTC | TTT | chr12 | 21593793 | 21593814 | 21593798 | 21593793 | - |
|---|---|---|---|---|---|---|---|---|
| SEQ ID NO 27155 | ATTTTTACTTGCATCCTTGTCT | TTT | chr12 | 21593792 | 21593813 | 21593797 | 21593792 | - |
| SEQ ID NO 27156 | TTTTTACTTGCATCCTTGTCTG | TTA | chr12 | 21593791 | 21593812 | 21593796 | 21593791 | - |
| SEQ ID NO 27157 | TTACTTGCATCCTTGTCTGGTT | TTT | chr12 | 21593788 | 21593809 | 21593793 | 21593788 | - |
| SEQ ID NO 27158 | TACTTGCATCCTTGTCTGGTTA | TTT | chr12 | 21593787 | 21593808 | 21593792 | 21593787 | - |
| SEQ ID NO 27159 | ACTTGCATCCTTGTCTGGTTAT | TTT | chr12 | 21593786 | 21593807 | 21593791 | 21593786 | - |
| SEQ ID NO 27160 | CTTGCATCCTTGTCTGGTTATG | TTA | chr12 | 21593785 | 21593806 | 21593790 | 21593785 | - |
| SEQ ID NO 27161 | GCATCCTTGTCTGGTTATGGAA | CTT | chr12 | 21593782 | 21593803 | 21593787 | 21593782 | - |
| SEQ ID NO 27162 | CATCCTTGTCTGGTTATGGAAT | TTG | chr12 | 21593781 | 21593802 | 21593786 | 21593781 | - |
| SEQ ID NO 27163 | GTCTGGTTATGGAATCAGGATA | CTT | chr12 | 21593774 | 21593795 | 21593779 | 21593774 | - |
| SEQ ID NO 27164 | TCTGGTTATGGAATCAGGATAA | TTG | chr12 | 21593773 | 21593794 | 21593778 | 21593773 | - |
| SEQ ID NO 27165 | GTTATGGAATCAGGATAATACT | CTG | chr12 | 21593769 | 21593790 | 21593774 | 21593769 | - |
| SEQ ID NO 27166 | TGGAATCAGGATAATACTGGCC | TTA | chr12 | 21593765 | 21593786 | 21593770 | 21593765 | - |
| SEQ ID NO 27167 | GCCTCAGAGAATGAGTTAGGGA | CTG | chr12 | 21593746 | 21593767 | 21593751 | 21593746 | - |
| SEQ ID NO 27168 | AGAGAATGAGTTAGGGAGAATT | CTC | chr12 | 21593741 | 21593762 | 21593746 | 21593741 | - |
| SEQ ID NO 27169 | GGGAGAATTCCTTCCTGTTTAA | TTA | chr12 | 21593728 | 21593749 | 21593733 | 21593728 | - |
| SEQ ID NO 27170 | CTTCCTGTTTAATTTTTAAAAG | TTC | chr12 | 21593718 | 21593739 | 21593723 | 21593718 | - |
| SEQ ID NO 27171 | CCTGTTTAATTTTTAAAAGAAT | CTT | chr12 | 21593715 | 21593736 | 21593720 | 21593715 | - |
| SEQ ID NO 27172 | CTGTTTAATTTTTAAAAGAATT | TTC | chr12 | 21593714 | 21593735 | 21593719 | 21593714 | - |
| SEQ ID NO 27173 | TTTAATTTTTAAAAGAATTTAA | CTG | chr12 | 21593711 | 21593732 | 21593716 | 21593711 | - |
| SEQ ID NO 27174 | AATTTTTAAAAGAATTTAAGGA | TTT | chr12 | 21593708 | 21593729 | 21593713 | 21593708 | - |
| SEQ ID NO 27175 | ATTTTTAAAAGAATTTAAGGAG | TTA | chr12 | 21593707 | 21593728 | 21593712 | 21593707 | - |
| SEQ ID NO 27176 | TTAAAAGAATTTAAGGAGACTT | TTT | chr12 | 21593703 | 21593724 | 21593708 | 21593703 | - |
| SEQ ID NO 27177 | TAAAAGAATTTAAGGAGACTTG | TTT | chr12 | 21593702 | 21593723 | 21593707 | 21593702 | - |
| SEQ ID NO 27178 | AAAAGAATTTAAGGAGACTTGT | TTT | chr12 | 21593701 | 21593722 | 21593706 | 21593701 | - |
| SEQ ID NO 27179 | AAAGAATTTAAGGAGACTTGTT | TTA | chr12 | 21593700 | 21593721 | 21593705 | 21593700 | - |
| SEQ ID NO 27180 | AAGGAGACTTGTTAGTTTTCTT | TTT | chr12 | 21593691 | 21593712 | 21593696 | 21593691 | - |
| SEQ ID NO 27181 | AGGAGACTTGTTAGTTTTCTTT | TTA | chr12 | 21593690 | 21593711 | 21593695 | 21593690 | - |
| SEQ ID NO 27182 | GTTAGTTTTCTTTGAAAGTTTG | CTT | chr12 | 21593681 | 21593702 | 21593686 | 21593681 | - |
| SEQ ID NO 27183 | TTAGTTTTCTTTGAAAGTTTGG | TTG | chr12 | 21593680 | 21593701 | 21593685 | 21593680 | - |
| SEQ ID NO 27184 | GTTTTCTTTGAAAGTTTGGTAA | TTA | chr12 | 21593677 | 21593698 | 21593682 | 21593677 | - |
| SEQ ID NO 27185 | TCTTTGAAAGTTTGGTAAAATT | TTT | chr12 | 21593673 | 21593694 | 21593678 | 21593673 | - |
| SEQ ID NO 27186 | CTTTGAAAGTTTGGTAAAATTT | TTT | chr12 | 21593672 | 21593693 | 21593677 | 21593672 | - |
| SEQ ID NO 27187 | TTTGAAAGTTTGGTAAAATTTG | TTC | chr12 | 21593671 | 21593692 | 21593676 | 21593671 | - |
| SEQ ID NO 27188 | TGAAAGTTTGGTAAAATTTGAC | CTT | chr12 | 21593669 | 21593690 | 21593674 | 21593669 | - |
| SEQ ID NO 27189 | GAAAGTTTGGTAAAATTTGACA | TTT | chr12 | 21593668 | 21593689 | 21593673 | 21593668 | - |
| SEQ ID NO 27190 | AAAGTTTGGTAAAATTTGACAG | TTG | chr12 | 21593667 | 21593688 | 21593672 | 21593667 | - |
| SEQ ID NO 27191 | GGTAAAATTTGACAGTAAAGCC | TTT | chr12 | 21593660 | 21593681 | 21593665 | 21593660 | - |
| SEQ ID NO 27192 | GTAAAATTTGACAGTAAAGCCA | TTG | chr12 | 21593659 | 21593680 | 21593664 | 21593659 | - |
| SEQ ID NO 27193 | GACAGTAAAGCCATCTGGTCTT | TTT | chr12 | 21593650 | 21593671 | 21593655 | 21593650 | - |
| SEQ ID NO 27194 | ACAGTAAAGCCATCTGGTCTTG | TTG | chr12 | 21593649 | 21593670 | 21593654 | 21593649 | - |
| SEQ ID NO 27195 | GTCTTGAAATTTTCTTTTTTGG | CTG | chr12 | 21593633 | 21593654 | 21593638 | 21593633 | - |
| SEQ ID NO 27196 | GAAATTTTCTTTTTTGGGAGAC | CTT | chr12 | 21593628 | 21593649 | 21593633 | 21593628 | - |
| SEQ ID NO 27197 | AAATTTTCTTTTTTGGGAGACT | TTG | chr12 | 21593627 | 21593648 | 21593632 | 21593627 | - |
| SEQ ID NO 27198 | TCTTTTTTGGGAGACTTTTTAC | TTT | chr12 | 21593621 | 21593642 | 21593626 | 21593621 | - |
| SEQ ID NO 27199 | CTTTTTTGGGAGACTTTTTACT | TTT | chr12 | 21593620 | 21593641 | 21593625 | 21593620 | - |
| SEQ ID NO 27200 | TTTTTTGGGAGACTTTTTACTA | TTC | chr12 | 21593619 | 21593640 | 21593624 | 21593619 | - |
| SEQ ID NO 27201 | TTTTGGGAGACTTTTTACTACT | CTT | chr12 | 21593617 | 21593638 | 21593622 | 21593617 | - |
| SEQ ID NO 27202 | TTTGGGAGACTTTTTACTACTG | TTT | chr12 | 21593616 | 21593637 | 21593621 | 21593616 | - |
| SEQ ID NO 27203 | TTGGGAGACTTTTTACTACTGA | TTT | chr12 | 21593615 | 21593636 | 21593620 | 21593615 | - |
| SEQ ID NO 27204 | TGGGAGACTTTTTACTACTGAT | TTT | chr12 | 21593614 | 21593635 | 21593619 | 21593614 | - |
| SEQ ID NO 27205 | GGGAGACTTTTTACTACTGATT | TTT | chr12 | 21593613 | 21593634 | 21593618 | 21593613 | - |
| SEQ ID NO 27206 | GGAGACTTTTTACTACTGATTC | TTG | chr12 | 21593612 | 21593633 | 21593617 | 21593612 | - |
| SEQ ID NO 27207 | TTTACTACTGATTCAATTTCAT | CTT | chr12 | 21593604 | 21593625 | 21593609 | 21593604 | - |
| SEQ ID NO 27208 | TTACTACTGATTCAATTTCATT | TTT | chr12 | 21593603 | 21593624 | 21593608 | 21593603 | - |
| SEQ ID NO 27209 | TACTACTGATTCAATTTCATTA | TTT | chr12 | 21593602 | 21593623 | 21593607 | 21593602 | - |
| SEQ ID NO 27210 | ACTACTGATTCAATTTCATTAT | TTT | chr12 | 21593601 | 21593622 | 21593606 | 21593601 | - |
| SEQ ID NO 27211 | CTACTGATTCAATTTCATTATT | TTA | chr12 | 21593600 | 21593621 | 21593605 | 21593600 | - |

Figure 48 (Cont'd)

| SEQ ID NO 27212 | CTGATTCAATTTCATTATTCAT | CTA | chr12 | 21593597 | 21593618 | 21593602 | 21593597 | - |
|---|---|---|---|---|---|---|---|---|
| SEQ ID NO 27213 | ATTCAATTTCATTATTCATTAC | CTG | chr12 | 21593594 | 21593615 | 21593599 | 21593594 | - |
| SEQ ID NO 27214 | AATTTCATTATTCATTACTGGT | TTC | chr12 | 21593590 | 21593611 | 21593595 | 21593590 | - |
| SEQ ID NO 27215 | CATTATTCATTACTGGTCTGTT | TTT | chr12 | 21593585 | 21593606 | 21593590 | 21593585 | - |
| SEQ ID NO 27216 | ATTATTCATTACTGGTCTGTTC | TTC | chr12 | 21593584 | 21593605 | 21593589 | 21593584 | - |
| SEQ ID NO 27217 | TTCATTACTGGTCTGTTCAGGT | TTA | chr12 | 21593580 | 21593601 | 21593585 | 21593580 | - |
| SEQ ID NO 27218 | ATTACTGGTCTGTTCAGGTTTT | TTC | chr12 | 21593577 | 21593598 | 21593582 | 21593577 | - |
| SEQ ID NO 27219 | CTGGTCTGTTCAGGTTTTCTAT | TTA | chr12 | 21593573 | 21593594 | 21593578 | 21593573 | - |
| SEQ ID NO 27220 | GTCTGTTCAGGTTTTCTATTCT | CTG | chr12 | 21593570 | 21593591 | 21593575 | 21593570 | - |
| SEQ ID NO 27221 | TTCAGGTTTTCTATTCTTTCTT | CTG | chr12 | 21593565 | 21593586 | 21593570 | 21593565 | - |
| SEQ ID NO 27222 | AGGTTTTCTATTCTTTCTTAAT | TTC | chr12 | 21593562 | 21593583 | 21593567 | 21593562 | - |
| SEQ ID NO 27223 | TCTATTCTTTCTTAATTCAATC | TTT | chr12 | 21593556 | 21593577 | 21593561 | 21593556 | - |
| SEQ ID NO 27224 | CTATTCTTTCTTAATTCAATCT | TTT | chr12 | 21593555 | 21593576 | 21593560 | 21593555 | - |
| SEQ ID NO 27225 | TATTCTTTCTTAATTCAATCTT | TTC | chr12 | 21593554 | 21593575 | 21593559 | 21593554 | - |
| SEQ ID NO 27226 | TTCTTTCTTAATTCAATCTTGG | CTA | chr12 | 21593552 | 21593573 | 21593557 | 21593552 | - |
| SEQ ID NO 27227 | TTTCTTAATTCAATCTTGGTAG | TTC | chr12 | 21593549 | 21593570 | 21593554 | 21593549 | - |
| SEQ ID NO 27228 | TCTTAATTCAATCTTGGTAGGT | CTT | chr12 | 21593547 | 21593568 | 21593552 | 21593547 | - |
| SEQ ID NO 27229 | CTTAATTCAATCTTGGTAGGTG | TTT | chr12 | 21593546 | 21593567 | 21593551 | 21593546 | - |
| SEQ ID NO 27230 | TTAATTCAATCTTGGTAGGTGG | TTC | chr12 | 21593545 | 21593566 | 21593550 | 21593545 | - |
| SEQ ID NO 27231 | AATTCAATCTTGGTAGGTGGTA | CTT | chr12 | 21593543 | 21593564 | 21593548 | 21593543 | - |
| SEQ ID NO 27232 | ATTCAATCTTGGTAGGTGGTAT | TTA | chr12 | 21593542 | 21593563 | 21593547 | 21593542 | - |
| SEQ ID NO 27233 | AATCTTGGTAGGTGGTATGTGT | TTC | chr12 | 21593538 | 21593559 | 21593543 | 21593538 | - |
| SEQ ID NO 27234 | GGTAGGTGGTATGTGTCCAGAA | CTT | chr12 | 21593532 | 21593553 | 21593537 | 21593532 | - |
| SEQ ID NO 27235 | GTAGGTGGTATGTGTCCAGAAA | TTG | chr12 | 21593531 | 21593552 | 21593536 | 21593531 | - |
| SEQ ID NO 27236 | ATTAATTTCCTCTAGATTTTTC | TTT | chr12 | 21593506 | 21593527 | 21593511 | 21593506 | - |
| SEQ ID NO 27237 | TTAATTTCCTCTAGATTTTTCA | TTA | chr12 | 21593505 | 21593526 | 21593510 | 21593505 | - |
| SEQ ID NO 27238 | ATTTCCTCTAGATTTTTCAGTT | TTA | chr12 | 21593502 | 21593523 | 21593507 | 21593502 | - |
| SEQ ID NO 27239 | CCTCTAGATTTTTCAGTTTTTT | TTT | chr12 | 21593498 | 21593519 | 21593503 | 21593498 | - |
| SEQ ID NO 27240 | CTCTAGATTTTTCAGTTTTTTA | TTC | chr12 | 21593497 | 21593518 | 21593502 | 21593497 | - |
| SEQ ID NO 27241 | TAGATTTTTCAGTTTTTTAGTG | CTC | chr12 | 21593494 | 21593515 | 21593499 | 21593494 | - |
| SEQ ID NO 27242 | GATTTTTCAGTTTTTTAGTGTA | CTA | chr12 | 21593492 | 21593513 | 21593497 | 21593492 | - |
| SEQ ID NO 27243 | TTCAGTTTTTTAGTGTATGGTT | TTT | chr12 | 21593487 | 21593508 | 21593492 | 21593487 | - |
| SEQ ID NO 27244 | TCAGTTTTTTAGTGTATGGTTG | TTT | chr12 | 21593486 | 21593507 | 21593491 | 21593486 | - |
| SEQ ID NO 27245 | CAGTTTTTTAGTGTATGGTTGT | TTT | chr12 | 21593485 | 21593506 | 21593490 | 21593485 | - |
| SEQ ID NO 27246 | AGTTTTTTAGTGTATGGTTGTT | TTC | chr12 | 21593484 | 21593505 | 21593489 | 21593484 | - |
| SEQ ID NO 27247 | TTTAGTGTATGGTTGTTCATAA | TTT | chr12 | 21593479 | 21593500 | 21593484 | 21593479 | - |
| SEQ ID NO 27248 | TTAGTGTATGGTTGTTCATAAT | TTT | chr12 | 21593478 | 21593499 | 21593483 | 21593478 | - |
| SEQ ID NO 27249 | TAGTGTATGGTTGTTCATAATA | TTT | chr12 | 21593477 | 21593498 | 21593482 | 21593477 | - |
| SEQ ID NO 27250 | AGTGTATGGTTGTTCATAATAG | TTT | chr12 | 21593476 | 21593497 | 21593481 | 21593476 | - |
| SEQ ID NO 27251 | GTGTATGGTTGTTCATAATAGT | TTA | chr12 | 21593475 | 21593496 | 21593480 | 21593475 | - |
| SEQ ID NO 27252 | TTCATAATAGTCTCTGATAATC | TTG | chr12 | 21593464 | 21593485 | 21593469 | 21593464 | - |
| SEQ ID NO 27253 | ATAATAGTCTCTGATAATCTTT | TTC | chr12 | 21593461 | 21593482 | 21593466 | 21593461 | - |
| SEQ ID NO 27254 | TGATAATCTTTTCTATTTCTGT | CTC | chr12 | 21593450 | 21593471 | 21593455 | 21593450 | - |
| SEQ ID NO 27255 | ATAATCTTTTCTATTTCTGTGG | CTG | chr12 | 21593448 | 21593469 | 21593453 | 21593448 | - |
| SEQ ID NO 27256 | TTCTATTTCTGTGGTATCGGTT | CTT | chr12 | 21593440 | 21593461 | 21593445 | 21593440 | - |
| SEQ ID NO 27257 | TCTATTTCTGTGGTATCGGTTG | TTT | chr12 | 21593439 | 21593460 | 21593444 | 21593439 | - |
| SEQ ID NO 27258 | CTATTTCTGTGGTATCGGTTGT | TTT | chr12 | 21593438 | 21593459 | 21593443 | 21593438 | - |
| SEQ ID NO 27259 | TATTTCTGTGGTATCGGTTGTA | TTC | chr12 | 21593437 | 21593458 | 21593442 | 21593437 | - |
| SEQ ID NO 27260 | TTTCTGTGGTATCGGTTGTAAT | CTA | chr12 | 21593435 | 21593456 | 21593440 | 21593435 | - |
| SEQ ID NO 27261 | CTGTGGTATCGGTTGTAATATA | TTT | chr12 | 21593432 | 21593453 | 21593437 | 21593432 | - |
| SEQ ID NO 27262 | TGTGGTATCGGTTGTAATATAT | TTC | chr12 | 21593431 | 21593452 | 21593436 | 21593431 | - |
| SEQ ID NO 27263 | TGGTATCGGTTGTAATATATTT | CTG | chr12 | 21593429 | 21593450 | 21593434 | 21593429 | - |
| SEQ ID NO 27264 | TAATATATTTTCTTTTTTATTT | TTG | chr12 | 21593417 | 21593438 | 21593422 | 21593417 | - |
| SEQ ID NO 27265 | TCTTTTTTATTTCTGATTTTCT | TTT | chr12 | 21593407 | 21593428 | 21593412 | 21593407 | - |
| SEQ ID NO 27266 | CTTTTTTATTTCTGATTTTCTT | TTT | chr12 | 21593406 | 21593427 | 21593411 | 21593406 | - |
| SEQ ID NO 27267 | TTTTTTATTTCTGATTTTCTTT | TTC | chr12 | 21593405 | 21593426 | 21593410 | 21593405 | - |
| SEQ ID NO 27268 | TTTTATTTCTGATTTTCTTTAT | CTT | chr12 | 21593403 | 21593424 | 21593408 | 21593403 | - |
| SEQ ID NO 27269 | TTTATTTCTGATTTTCTTTATT | TTT | chr12 | 21593402 | 21593423 | 21593407 | 21593402 | - |

Figure 48 (Cont'd)

| | | | | | | | | |
|---|---|---|---|---|---|---|---|---|
| SEQ ID NO 27270 | TTATTTCTGATTTTCTTTATTT | TTT | chr12 | 21593401 | 21593422 | 21593406 | 21593401 | - |
| SEQ ID NO 27271 | TATTTCTGATTTTCTTTATTTC | TTT | chr12 | 21593400 | 21593421 | 21593405 | 21593400 | - |
| SEQ ID NO 27272 | ATTTCTGATTTTCTTTATTTCA | TTT | chr12 | 21593399 | 21593420 | 21593404 | 21593399 | - |
| SEQ ID NO 27273 | TTTCTGATTTTCTTTATTTCAG | TTA | chr12 | 21593398 | 21593419 | 21593403 | 21593398 | - |
| SEQ ID NO 27274 | CTGATTTTCTTTATTTCAGTCT | TTT | chr12 | 21593395 | 21593416 | 21593400 | 21593395 | - |
| SEQ ID NO 27275 | TGATTTTCTTTATTTCAGTCTC | TTC | chr12 | 21593394 | 21593415 | 21593399 | 21593394 | - |
| SEQ ID NO 27276 | ATTTTCTTTATTTCAGTCTCTT | CTG | chr12 | 21593392 | 21593413 | 21593397 | 21593392 | - |
| SEQ ID NO 27277 | TCTTTATTTCAGTCTCTTCTCT | TTT | chr12 | 21593388 | 21593409 | 21593393 | 21593388 | - |
| SEQ ID NO 27278 | CTTTATTTCAGTCTCTTCTCTT | TTT | chr12 | 21593387 | 21593408 | 21593392 | 21593387 | - |
| SEQ ID NO 27279 | TTTATTTCAGTCTCTTCTCTTT | TTC | chr12 | 21593386 | 21593407 | 21593391 | 21593386 | - |
| SEQ ID NO 27280 | TATTTCAGTCTCTTCTCTTTTT | CTT | chr12 | 21593384 | 21593405 | 21593389 | 21593384 | - |
| SEQ ID NO 27281 | ATTTCAGTCTCTTCTCTTTTTC | TTT | chr12 | 21593383 | 21593404 | 21593388 | 21593383 | - |
| SEQ ID NO 27282 | TTTCAGTCTCTTCTCTTTTTCT | TTA | chr12 | 21593382 | 21593403 | 21593387 | 21593382 | - |
| SEQ ID NO 27283 | CAGTCTCTTCTCTTTTTCTTGG | TTT | chr12 | 21593379 | 21593400 | 21593384 | 21593379 | - |
| SEQ ID NO 27284 | AGTCTCTTCTCTTTTTCTTGGT | TTC | chr12 | 21593378 | 21593399 | 21593383 | 21593378 | - |
| SEQ ID NO 27285 | TTCTCTTTTTCTTGGTTAGTCT | CTC | chr12 | 21593372 | 21593393 | 21593377 | 21593372 | - |
| SEQ ID NO 27286 | CTCTTTTTCTTGGTTAGTCTAG | CTT | chr12 | 21593370 | 21593391 | 21593375 | 21593370 | - |
| SEQ ID NO 27287 | TCTTTTTCTTGGTTAGTCTAGC | TTC | chr12 | 21593369 | 21593390 | 21593374 | 21593369 | - |
| SEQ ID NO 27288 | TTTTTCTTGGTTAGTCTAGCTA | CTC | chr12 | 21593367 | 21593388 | 21593372 | 21593367 | - |
| SEQ ID NO 27289 | TTTCTTGGTTAGTCTAGCTAGA | CTT | chr12 | 21593365 | 21593386 | 21593370 | 21593365 | - |
| SEQ ID NO 27290 | TTCTTGGTTAGTCTAGCTAGAG | TTT | chr12 | 21593364 | 21593385 | 21593369 | 21593364 | - |
| SEQ ID NO 27291 | TCTTGGTTAGTCTAGCTAGAGC | TTT | chr12 | 21593363 | 21593384 | 21593368 | 21593363 | - |
| SEQ ID NO 27292 | CTTGGTTAGTCTAGCTAGAGCT | TTT | chr12 | 21593362 | 21593383 | 21593367 | 21593362 | - |
| SEQ ID NO 27293 | TTGGTTAGTCTAGCTAGAGCTA | TTC | chr12 | 21593361 | 21593382 | 21593366 | 21593361 | - |
| SEQ ID NO 27294 | GGTTAGTCTAGCTAGAGCTATA | CTT | chr12 | 21593359 | 21593380 | 21593364 | 21593359 | - |
| SEQ ID NO 27295 | GTTAGTCTAGCTAGAGCTATAT | TTG | chr12 | 21593358 | 21593379 | 21593363 | 21593358 | - |
| SEQ ID NO 27296 | GTCTAGCTAGAGCTATATCCAT | TTA | chr12 | 21593354 | 21593375 | 21593359 | 21593354 | - |
| SEQ ID NO 27297 | GCTAGAGCTATATCCATTTTAT | CTA | chr12 | 21593349 | 21593370 | 21593354 | 21593349 | - |
| SEQ ID NO 27298 | GAGCTATATCCATTTTATCTTT | CTA | chr12 | 21593345 | 21593366 | 21593350 | 21593345 | - |
| SEQ ID NO 27299 | TATCCATTTTATCTTTTTAAA | CTA | chr12 | 21593339 | 21593360 | 21593344 | 21593339 | - |
| SEQ ID NO 27300 | TATCTTTTTAAATAACAACTT | TTT | chr12 | 21593330 | 21593351 | 21593335 | 21593330 | - |
| SEQ ID NO 27301 | ATCTTTTTAAATAACAACTTT | TTT | chr12 | 21593329 | 21593350 | 21593334 | 21593329 | - |
| SEQ ID NO 27302 | TCTTTTTAAATAACAACTTTT | TTA | chr12 | 21593328 | 21593349 | 21593333 | 21593328 | - |
| SEQ ID NO 27303 | TTTTAAATAACAACTTTTCATT | CTT | chr12 | 21593324 | 21593345 | 21593329 | 21593324 | - |
| SEQ ID NO 27304 | TTTAAATAACAACTTTTCATTT | TTT | chr12 | 21593323 | 21593344 | 21593328 | 21593323 | - |
| SEQ ID NO 27305 | TTAAATAACAACTTTTCATTTT | TTT | chr12 | 21593322 | 21593343 | 21593327 | 21593322 | - |
| SEQ ID NO 27306 | TAAATAACAACTTTTCATTTTG | TTT | chr12 | 21593321 | 21593342 | 21593326 | 21593321 | - |
| SEQ ID NO 27307 | AAATAACAACTTTTCATTTTGC | TTT | chr12 | 21593320 | 21593341 | 21593325 | 21593320 | - |
| SEQ ID NO 27308 | AATAACAACTTTTCATTTTGCT | TTA | chr12 | 21593319 | 21593340 | 21593324 | 21593319 | - |
| SEQ ID NO 27309 | TTCATTTTGCTAATCCCTTGTT | CTT | chr12 | 21593308 | 21593329 | 21593313 | 21593308 | - |
| SEQ ID NO 27310 | TCATTTTGCTAATCCCTTGTTG | TTT | chr12 | 21593307 | 21593328 | 21593312 | 21593307 | - |
| SEQ ID NO 27311 | CATTTTGCTAATCCCTTGTTGT | TTT | chr12 | 21593306 | 21593327 | 21593311 | 21593306 | - |
| SEQ ID NO 27312 | ATTTTGCTAATCCCTTGTTGTT | TTC | chr12 | 21593305 | 21593326 | 21593310 | 21593305 | - |
| SEQ ID NO 27313 | TGCTAATCCCTTGTTGTTGTTT | TTT | chr12 | 21593301 | 21593322 | 21593306 | 21593301 | - |
| SEQ ID NO 27314 | GCTAATCCCTTGTTGTTGTTTT | TTT | chr12 | 21593300 | 21593321 | 21593305 | 21593300 | - |
| SEQ ID NO 27315 | CTAATCCCTTGTTGTTGTTTTT | TTG | chr12 | 21593299 | 21593320 | 21593304 | 21593299 | - |
| SEQ ID NO 27316 | ATCCCTTGTTGTTGTTTTTCTC | CTA | chr12 | 21593296 | 21593317 | 21593301 | 21593296 | - |
| SEQ ID NO 27317 | GTTGTTGTTTTTCTCTATTTCA | CTT | chr12 | 21593289 | 21593310 | 21593294 | 21593289 | - |
| SEQ ID NO 27318 | TTGTTGTTTTTCTCTATTTCAT | TTG | chr12 | 21593288 | 21593309 | 21593293 | 21593288 | - |
| SEQ ID NO 27319 | TTGTTTTTCTCTATTTCATTAA | TTG | chr12 | 21593285 | 21593306 | 21593290 | 21593285 | - |
| SEQ ID NO 27320 | TTTTTCTCTATTTCATTAAGTT | TTG | chr12 | 21593282 | 21593303 | 21593287 | 21593282 | - |
| SEQ ID NO 27321 | TTCTCTATTTCATTAAGTTCTT | TTT | chr12 | 21593279 | 21593300 | 21593284 | 21593279 | - |
| SEQ ID NO 27322 | TCTCTATTTCATTAAGTTCTTC | TTT | chr12 | 21593278 | 21593299 | 21593283 | 21593278 | - |
| SEQ ID NO 27323 | CTCTATTTCATTAAGTTCTTCT | TTT | chr12 | 21593277 | 21593298 | 21593282 | 21593277 | - |
| SEQ ID NO 27324 | TCTATTTCATTAAGTTCTTCTG | TTC | chr12 | 21593276 | 21593297 | 21593281 | 21593276 | - |
| SEQ ID NO 27325 | TATTTCATTAAGTTCTTCTGTT | CTC | chr12 | 21593274 | 21593295 | 21593279 | 21593274 | - |
| SEQ ID NO 27326 | TTTCATTAAGTTCTTCTGTTCT | CTA | chr12 | 21593272 | 21593293 | 21593277 | 21593272 | - |
| SEQ ID NO 27327 | CATTAAGTTCTTCTGTTCTTCA | TTT | chr12 | 21593269 | 21593290 | 21593274 | 21593269 | - |

Figure 48 (Cont'd)

| SEQ ID NO 27328 | ATTAAGTTCTTCTGTTCTTCAT | TTC | chr12 | 21593268 | 21593289 | 21593273 | 21593268 | - |
|---|---|---|---|---|---|---|---|---|
| SEQ ID NO 27329 | AGTTCTTCTGTTCTTCATTTTT | TTA | chr12 | 21593264 | 21593285 | 21593269 | 21593264 | - |
| SEQ ID NO 27330 | TTCTGTTCTTCATTTTTTCTTT | TTC | chr12 | 21593259 | 21593280 | 21593264 | 21593259 | - |
| SEQ ID NO 27331 | CTGTTCTTCATTTTTTCTTTCC | CTT | chr12 | 21593257 | 21593278 | 21593262 | 21593257 | - |
| SEQ ID NO 27332 | TGTTCTTCATTTTTTCTTTCCT | TTC | chr12 | 21593256 | 21593277 | 21593261 | 21593256 | - |
| SEQ ID NO 27333 | TTCTTCATTTTTTCTTTCCTTC | CTG | chr12 | 21593254 | 21593275 | 21593259 | 21593254 | - |
| SEQ ID NO 27334 | TTCATTTTTTCTTTCCTTCTGC | TTC | chr12 | 21593251 | 21593272 | 21593256 | 21593251 | - |
| SEQ ID NO 27335 | CATTTTTTCTTTCCTTCTGCTA | CTT | chr12 | 21593249 | 21593270 | 21593254 | 21593249 | - |
| SEQ ID NO 27336 | ATTTTTTCTTTCCTTCTGCTAG | TTC | chr12 | 21593248 | 21593269 | 21593253 | 21593248 | - |
| SEQ ID NO 27337 | TTTCTTTCCTTCTGCTAGTTTT | TTT | chr12 | 21593244 | 21593265 | 21593249 | 21593244 | - |
| SEQ ID NO 27338 | TTCTTTCCTTCTGCTAGTTTTG | TTT | chr12 | 21593243 | 21593264 | 21593248 | 21593243 | - |
| SEQ ID NO 27339 | TCTTTCCTTCTGCTAGTTTTGG | TTT | chr12 | 21593242 | 21593263 | 21593247 | 21593242 | - |
| SEQ ID NO 27340 | CTTTCCTTCTGCTAGTTTTGGG | TTT | chr12 | 21593241 | 21593262 | 21593246 | 21593241 | - |
| SEQ ID NO 27341 | TTTCCTTCTGCTAGTTTTGGGT | TTC | chr12 | 21593240 | 21593261 | 21593245 | 21593240 | - |
| SEQ ID NO 27342 | TCCTTCTGCTAGTTTTGGGTTT | CTT | chr12 | 21593238 | 21593259 | 21593243 | 21593238 | - |
| SEQ ID NO 27343 | CCTTCTGCTAGTTTTGGGTTTT | TTT | chr12 | 21593237 | 21593258 | 21593242 | 21593237 | - |
| SEQ ID NO 27344 | CTTCTGCTAGTTTTGGGTTTTG | TTC | chr12 | 21593236 | 21593257 | 21593241 | 21593236 | - |
| SEQ ID NO 27345 | CTGCTAGTTTTGGGTTTTGTTC | CTT | chr12 | 21593233 | 21593254 | 21593238 | 21593233 | - |
| SEQ ID NO 27346 | TGCTAGTTTTGGGTTTTGTTCT | TTC | chr12 | 21593232 | 21593253 | 21593237 | 21593232 | - |
| SEQ ID NO 27347 | CTAGTTTTGGGTTTTGTTCTTG | CTG | chr12 | 21593230 | 21593251 | 21593235 | 21593230 | - |
| SEQ ID NO 27348 | GTTTTGGGTTTTGTTCTTGCTT | CTA | chr12 | 21593227 | 21593248 | 21593232 | 21593227 | - |
| SEQ ID NO 27349 | TGGGTTTTGTTCTTGCTTTTCT | TTT | chr12 | 21593223 | 21593244 | 21593228 | 21593223 | - |
| SEQ ID NO 27350 | GGGTTTTGTTCTTGCTTTTCTA | TTT | chr12 | 21593222 | 21593243 | 21593227 | 21593222 | - |
| SEQ ID NO 27351 | GGTTTTGTTCTTGCTTTTCTAG | TTG | chr12 | 21593221 | 21593242 | 21593226 | 21593221 | - |
| SEQ ID NO 27352 | TGTTCTTGCTTTTCTAGCTTGT | TTT | chr12 | 21593216 | 21593237 | 21593221 | 21593216 | - |
| SEQ ID NO 27353 | GTTCTTGCTTTTCTAGCTTGTT | TTT | chr12 | 21593215 | 21593236 | 21593220 | 21593215 | - |
| SEQ ID NO 27354 | TTCTTGCTTTTCTAGCTTGTTG | TTG | chr12 | 21593214 | 21593235 | 21593219 | 21593214 | - |
| SEQ ID NO 27355 | TTGCTTTTCTAGCTTGTTGAGG | TTC | chr12 | 21593211 | 21593232 | 21593216 | 21593211 | - |
| SEQ ID NO 27356 | GCTTTTCTAGCTTGTTGAGGTA | CTT | chr12 | 21593209 | 21593230 | 21593214 | 21593209 | - |
| SEQ ID NO 27357 | CTTTTCTAGCTTGTTGAGGTAC | TTG | chr12 | 21593208 | 21593229 | 21593213 | 21593208 | - |
| SEQ ID NO 27358 | TTCTAGCTTGTTGAGGTACATG | CTT | chr12 | 21593205 | 21593226 | 21593210 | 21593205 | - |
| SEQ ID NO 27359 | TCTAGCTTGTTGAGGTACATGA | TTT | chr12 | 21593204 | 21593225 | 21593209 | 21593204 | - |
| SEQ ID NO 27360 | CTAGCTTGTTGAGGTACATGAT | TTT | chr12 | 21593203 | 21593224 | 21593208 | 21593203 | - |
| SEQ ID NO 27361 | TAGCTTGTTGAGGTACATGATT | TTC | chr12 | 21593202 | 21593223 | 21593207 | 21593202 | - |
| SEQ ID NO 27362 | GCTTGTTGAGGTACATGATTAG | CTA | chr12 | 21593200 | 21593221 | 21593205 | 21593200 | - |
| SEQ ID NO 27363 | GTTGAGGTACATGATTAGATTA | CTT | chr12 | 21593196 | 21593217 | 21593201 | 21593196 | - |
| SEQ ID NO 27364 | TTGAGGTACATGATTAGATTAT | TTG | chr12 | 21593195 | 21593216 | 21593200 | 21593195 | - |
| SEQ ID NO 27365 | AGGTACATGATTAGATTATATA | TTG | chr12 | 21593192 | 21593213 | 21593197 | 21593192 | - |
| SEQ ID NO 27366 | GATTATATATTTGAAATCTTTC | TTA | chr12 | 21593179 | 21593200 | 21593184 | 21593179 | - |
| SEQ ID NO 27367 | TATATTTGAAATCTTTCTATGT | TTA | chr12 | 21593174 | 21593195 | 21593179 | 21593174 | - |
| SEQ ID NO 27368 | GAAATCTTTCTATGTTTTTAAT | TTT | chr12 | 21593167 | 21593188 | 21593172 | 21593167 | - |
| SEQ ID NO 27369 | AAATCTTTCTATGTTTTTAATT | TTG | chr12 | 21593166 | 21593187 | 21593171 | 21593166 | - |
| SEQ ID NO 27370 | TCTATGTTTTTAATTTAAGTGT | CTT | chr12 | 21593159 | 21593180 | 21593164 | 21593159 | - |
| SEQ ID NO 27371 | CTATGTTTTTAATTTAAGTGTT | TTT | chr12 | 21593158 | 21593179 | 21593163 | 21593158 | - |
| SEQ ID NO 27372 | TATGTTTTTAATTTAAGTGTTT | TTC | chr12 | 21593157 | 21593178 | 21593162 | 21593157 | - |
| SEQ ID NO 27373 | TGTTTTTAATTTAAGTGTTTAT | CTA | chr12 | 21593155 | 21593176 | 21593160 | 21593155 | - |
| SEQ ID NO 27374 | TTAATTTAAGTGTTTATTGATA | TTT | chr12 | 21593150 | 21593171 | 21593155 | 21593150 | - |
| SEQ ID NO 27375 | TAATTTAAGTGTTTATTGATAA | TTT | chr12 | 21593149 | 21593170 | 21593154 | 21593149 | - |
| SEQ ID NO 27376 | AATTTAAGTGTTTATTGATAAG | TTT | chr12 | 21593148 | 21593169 | 21593153 | 21593148 | - |
| SEQ ID NO 27377 | ATTTAAGTGTTTATTGATAAGC | TTA | chr12 | 21593147 | 21593168 | 21593152 | 21593147 | - |
| SEQ ID NO 27378 | AAGTGTTTATTGATAAGCTTCT | TTT | chr12 | 21593143 | 21593164 | 21593148 | 21593143 | - |
| SEQ ID NO 27379 | AGTGTTTATTGATAAGCTTCTC | TTA | chr12 | 21593142 | 21593163 | 21593147 | 21593142 | - |
| SEQ ID NO 27380 | ATTGATAAGCTTCTCTCTTAGC | TTT | chr12 | 21593135 | 21593156 | 21593140 | 21593135 | - |
| SEQ ID NO 27381 | TTGATAAGCTTCTCTCTTAGCA | TTA | chr12 | 21593134 | 21593155 | 21593139 | 21593134 | - |
| SEQ ID NO 27382 | ATAAGCTTCTCTCTTAGCACTG | TTG | chr12 | 21593131 | 21593152 | 21593136 | 21593131 | - |
| SEQ ID NO 27383 | CTCTCTTAGCACTGCTTTTGCT | CTT | chr12 | 21593123 | 21593144 | 21593128 | 21593123 | - |
| SEQ ID NO 27384 | TCTCTTAGCACTGCTTTTGCTG | TTC | chr12 | 21593122 | 21593143 | 21593127 | 21593122 | - |
| SEQ ID NO 27385 | TCTTAGCACTGCTTTTGCTGTA | CTC | chr12 | 21593120 | 21593141 | 21593125 | 21593120 | - |

Figure 48 (Cont'd)

| SEQ ID NO 27386 | TTAGCACTGCTTTTGCTGTATC | CTC | chr12 | 21593118 | 21593139 | 21593123 | 21593118 | - |
|---|---|---|---|---|---|---|---|---|
| SEQ ID NO 27387 | AGCACTGCTTTTGCTGTATCC | CTT | chr12 | 21593116 | 21593137 | 21593121 | 21593116 | - |
| SEQ ID NO 27388 | GCACTGCTTTTGCTGTATCCCA | TTA | chr12 | 21593115 | 21593136 | 21593120 | 21593115 | - |
| SEQ ID NO 27389 | CTTTTGCTGTATCCCATGGCTT | CTG | chr12 | 21593109 | 21593130 | 21593114 | 21593109 | - |
| SEQ ID NO 27390 | TTGCTGTATCCCATGGCTTTTC | CTT | chr12 | 21593106 | 21593127 | 21593111 | 21593106 | - |
| SEQ ID NO 27391 | TGCTGTATCCCATGGCTTTTCC | TTT | chr12 | 21593105 | 21593126 | 21593110 | 21593105 | - |
| SEQ ID NO 27392 | GCTGTATCCCATGGCTTTTCCT | TTT | chr12 | 21593104 | 21593125 | 21593109 | 21593104 | - |
| SEQ ID NO 27393 | CTGTATCCCATGGCTTTTCCTA | TTG | chr12 | 21593103 | 21593124 | 21593108 | 21593103 | - |
| SEQ ID NO 27394 | TATCCCATGGCTTTTCCTATGT | CTG | chr12 | 21593100 | 21593121 | 21593105 | 21593100 | - |
| SEQ ID NO 27395 | TTCCTATGTTGTATTTCAATTT | CTT | chr12 | 21593087 | 21593108 | 21593092 | 21593087 | - |
| SEQ ID NO 27396 | TCCTATGTTGTATTTCAATTTT | TTT | chr12 | 21593086 | 21593107 | 21593091 | 21593086 | - |
| SEQ ID NO 27397 | CCTATGTTGTATTTCAATTTTC | TTT | chr12 | 21593085 | 21593106 | 21593090 | 21593085 | - |
| SEQ ID NO 27398 | CTATGTTGTATTTCAATTTTCA | TTC | chr12 | 21593084 | 21593105 | 21593089 | 21593084 | - |
| SEQ ID NO 27399 | TGTTGTATTTCAATTTTCATTT | CTA | chr12 | 21593081 | 21593102 | 21593086 | 21593081 | - |
| SEQ ID NO 27400 | TATTTCAATTTTCATTTGTTTC | TTG | chr12 | 21593076 | 21593097 | 21593081 | 21593076 | - |
| SEQ ID NO 27401 | CAATTTTCATTTGTTTCAAAAA | TTT | chr12 | 21593071 | 21593092 | 21593076 | 21593071 | - |
| SEQ ID NO 27402 | AATTTTCATTTGTTTCAAAAAA | TTC | chr12 | 21593070 | 21593091 | 21593075 | 21593070 | - |
| SEQ ID NO 27403 | TCATTTGTTTCAAAAAATTTTT | TTT | chr12 | 21593065 | 21593086 | 21593070 | 21593065 | - |
| SEQ ID NO 27404 | CATTTGTTTCAAAAAATTTTTG | TTT | chr12 | 21593064 | 21593085 | 21593069 | 21593064 | - |
| SEQ ID NO 27405 | ATTTGTTTCAAAAAATTTTTGA | TTC | chr12 | 21593063 | 21593084 | 21593068 | 21593063 | - |
| SEQ ID NO 27406 | GTTTCAAAAAATTTTTGATTTC | TTT | chr12 | 21593059 | 21593080 | 21593064 | 21593059 | - |
| SEQ ID NO 27407 | TTTCAAAAAATTTTTGATTTCC | TTG | chr12 | 21593058 | 21593079 | 21593063 | 21593058 | - |
| SEQ ID NO 27408 | CAAAAAATTTTTGATTTCCTTC | TTT | chr12 | 21593055 | 21593076 | 21593060 | 21593055 | - |
| SEQ ID NO 27409 | AAAAAATTTTTGATTTCCTTCT | TTC | chr12 | 21593054 | 21593075 | 21593059 | 21593054 | - |
| SEQ ID NO 27410 | TTGATTTCCTTCTTAATTTTCT | TTT | chr12 | 21593045 | 21593066 | 21593050 | 21593045 | - |
| SEQ ID NO 27411 | TGATTTCCTTCTTAATTTTCTT | TTT | chr12 | 21593044 | 21593065 | 21593049 | 21593044 | - |
| SEQ ID NO 27412 | GATTTCCTTCTTAATTTTCTTC | TTT | chr12 | 21593043 | 21593064 | 21593048 | 21593043 | - |
| SEQ ID NO 27413 | ATTTCCTTCTTAATTTTCTTCT | TTG | chr12 | 21593042 | 21593063 | 21593047 | 21593042 | - |
| SEQ ID NO 27414 | CCTTCTTAATTTTCTTCTTGAC | TTT | chr12 | 21593038 | 21593059 | 21593043 | 21593038 | - |
| SEQ ID NO 27415 | CTTCTTAATTTTCTTCTTGACA | TTC | chr12 | 21593037 | 21593058 | 21593042 | 21593037 | - |
| SEQ ID NO 27416 | CTTAATTTTCTTCTTGACATAA | CTT | chr12 | 21593034 | 21593055 | 21593039 | 21593034 | - |
| SEQ ID NO 27417 | TTAATTTTCTTCTTGACATAAC | TTC | chr12 | 21593033 | 21593054 | 21593038 | 21593033 | - |
| SEQ ID NO 27418 | AATTTTCTTCTTGACATAACGT | CTT | chr12 | 21593031 | 21593052 | 21593036 | 21593031 | - |
| SEQ ID NO 27419 | ATTTTCTTCTTGACATAACGTT | TTA | chr12 | 21593030 | 21593051 | 21593035 | 21593030 | - |
| SEQ ID NO 27420 | TCTTCTTGACATAACGTTCATT | TTT | chr12 | 21593026 | 21593047 | 21593031 | 21593026 | - |
| SEQ ID NO 27421 | CTTCTTGACATAACGTTCATTC | TTT | chr12 | 21593025 | 21593046 | 21593030 | 21593025 | - |
| SEQ ID NO 27422 | TTCTTGACATAACGTTCATTCA | TTC | chr12 | 21593024 | 21593045 | 21593029 | 21593024 | - |
| SEQ ID NO 27423 | CTTGACATAACGTTCATTCAGG | CTT | chr12 | 21593022 | 21593043 | 21593027 | 21593022 | - |
| SEQ ID NO 27424 | TTGACATAACGTTCATTCAGGA | TTC | chr12 | 21593021 | 21593042 | 21593026 | 21593021 | - |
| SEQ ID NO 27425 | GACATAACGTTCATTCAGGAGC | CTT | chr12 | 21593019 | 21593040 | 21593024 | 21593019 | - |
| SEQ ID NO 27426 | ACATAACGTTCATTCAGGAGCA | TTG | chr12 | 21593018 | 21593039 | 21593023 | 21593018 | - |
| SEQ ID NO 27427 | ATTCAGGAGCATGTTGTTTAAT | TTC | chr12 | 21593007 | 21593028 | 21593012 | 21593007 | - |
| SEQ ID NO 27428 | AGGAGCATGTTGTTTAATTTCC | TTC | chr12 | 21593003 | 21593024 | 21593008 | 21593003 | - |
| SEQ ID NO 27429 | TTTAATTTCCATGTATTTGTAT | TTG | chr12 | 21592991 | 21593012 | 21592996 | 21592991 | - |
| SEQ ID NO 27430 | AATTTCCATGTATTTGTATAGG | TTT | chr12 | 21592988 | 21593009 | 21592993 | 21592988 | - |
| SEQ ID NO 27431 | ATTTCCATGTATTTGTATAGGT | TTA | chr12 | 21592987 | 21593008 | 21592992 | 21592987 | - |
| SEQ ID NO 27432 | CCATGTATTTGTATAGGTTTTA | TTT | chr12 | 21592983 | 21593004 | 21592988 | 21592983 | - |
| SEQ ID NO 27433 | CATGTATTTGTATAGGTTTTAA | TTC | chr12 | 21592982 | 21593003 | 21592987 | 21592982 | - |
| SEQ ID NO 27434 | GTATAGGTTTTAAAGTTTTTCT | TTT | chr12 | 21592973 | 21592994 | 21592978 | 21592973 | - |
| SEQ ID NO 27435 | TATAGGTTTTAAAGTTTTTCTT | TTG | chr12 | 21592972 | 21592993 | 21592977 | 21592972 | - |
| SEQ ID NO 27436 | TAAAGTTTTCTTGTTATTGAT | TTT | chr12 | 21592963 | 21592984 | 21592968 | 21592963 | - |
| SEQ ID NO 27437 | AAAGTTTTCTTGTTATTGATT | TTT | chr12 | 21592962 | 21592983 | 21592967 | 21592962 | - |
| SEQ ID NO 27438 | AAGTTTTCTTGTTATTGATTT | TTA | chr12 | 21592961 | 21592982 | 21592966 | 21592961 | - |
| SEQ ID NO 27439 | TTCTTGTTATTGATTTCTAGTT | TTT | chr12 | 21592955 | 21592976 | 21592960 | 21592955 | - |
| SEQ ID NO 27440 | TCTTGTTATTGATTTCTAGTTT | TTT | chr12 | 21592954 | 21592975 | 21592959 | 21592954 | - |
| SEQ ID NO 27441 | CTTGTTATTGATTTCTAGTTTT | TTT | chr12 | 21592953 | 21592974 | 21592958 | 21592953 | - |
| SEQ ID NO 27442 | TTGTTATTGATTTCTAGTTTTA | TTC | chr12 | 21592952 | 21592973 | 21592957 | 21592952 | - |
| SEQ ID NO 27443 | GTTATTGATTTCTAGTTTTATT | CTT | chr12 | 21592950 | 21592971 | 21592955 | 21592950 | - |

Figure 48 (Cont'd)

| | | | | | | | | |
|---|---|---|---|---|---|---|---|---|
| SEQ ID NO 27444 | TTATTGATTTCTAGTTTTATTC | TTG | chr12 | 21592949 | 21592970 | 21592954 | 21592949 | - |
| SEQ ID NO 27445 | TTGATTTCTAGTTTTATTCCAT | TTA | chr12 | 21592946 | 21592967 | 21592951 | 21592946 | - |
| SEQ ID NO 27446 | ATTTCTAGTTTTATTCCATTGT | TTG | chr12 | 21592943 | 21592964 | 21592948 | 21592943 | - |
| SEQ ID NO 27447 | CTAGTTTTATTCCATTGTGGTC | TTT | chr12 | 21592939 | 21592960 | 21592944 | 21592939 | - |
| SEQ ID NO 27448 | TAGTTTTATTCCATTGTGGTCT | TTC | chr12 | 21592938 | 21592959 | 21592943 | 21592938 | - |
| SEQ ID NO 27449 | GTTTTATTCCATTGTGGTCTGA | CTA | chr12 | 21592936 | 21592957 | 21592941 | 21592936 | - |
| SEQ ID NO 27450 | TATTCCATTGTGGTCTGAGAAG | TTT | chr12 | 21592932 | 21592953 | 21592937 | 21592932 | - |
| SEQ ID NO 27451 | ATTCCATTGTGGTCTGAGAAGA | TTT | chr12 | 21592931 | 21592952 | 21592936 | 21592931 | - |
| SEQ ID NO 27452 | TTCCATTGTGGTCTGAGAAGAT | TTA | chr12 | 21592930 | 21592951 | 21592935 | 21592930 | - |
| SEQ ID NO 27453 | CATTGTGGTCTGAGAAGATGCT | TTC | chr12 | 21592927 | 21592948 | 21592932 | 21592927 | - |
| SEQ ID NO 27454 | TGGTCTGAGAAGATGCTTAATA | TTG | chr12 | 21592922 | 21592943 | 21592927 | 21592922 | - |
| SEQ ID NO 27455 | AGAAGATGCTTAATATGATTTC | CTG | chr12 | 21592915 | 21592936 | 21592920 | 21592915 | - |
| SEQ ID NO 27456 | AATATGATTTCAAATATTTCAA | CTT | chr12 | 21592904 | 21592925 | 21592909 | 21592904 | - |
| SEQ ID NO 27457 | ATATGATTTCAAATATTTCAAA | TTA | chr12 | 21592903 | 21592924 | 21592908 | 21592903 | - |
| SEQ ID NO 27458 | CAAATATTTCAAATTAGTTGAG | TTT | chr12 | 21592894 | 21592915 | 21592899 | 21592894 | - |
| SEQ ID NO 27459 | AAATATTTCAAATTAGTTGAGA | TTC | chr12 | 21592893 | 21592914 | 21592898 | 21592893 | - |
| SEQ ID NO 27460 | CAAATTAGTTGAGACTTCTTTT | TTT | chr12 | 21592885 | 21592906 | 21592890 | 21592885 | - |
| SEQ ID NO 27461 | AAATTAGTTGAGACTTCTTTTG | TTC | chr12 | 21592884 | 21592905 | 21592889 | 21592884 | - |
| SEQ ID NO 27462 | GTTGAGACTTCTTTTGTGTTCT | TTA | chr12 | 21592878 | 21592899 | 21592883 | 21592878 | - |
| SEQ ID NO 27463 | AGACTTCTTTTGTGTTCTAACA | TTG | chr12 | 21592874 | 21592895 | 21592879 | 21592874 | - |
| SEQ ID NO 27464 | CTTTTGTGTTCTAACATATGGT | CTT | chr12 | 21592868 | 21592889 | 21592873 | 21592868 | - |
| SEQ ID NO 27465 | TTTTGTGTTCTAACATATGGTG | TTC | chr12 | 21592867 | 21592888 | 21592872 | 21592867 | - |
| SEQ ID NO 27466 | TTGTGTTCTAACATATGGTGTA | CTT | chr12 | 21592865 | 21592886 | 21592870 | 21592865 | - |
| SEQ ID NO 27467 | TGTGTTCTAACATATGGTGTAT | TTT | chr12 | 21592864 | 21592885 | 21592869 | 21592864 | - |
| SEQ ID NO 27468 | GTGTTCTAACATATGGTGTATC | TTT | chr12 | 21592863 | 21592884 | 21592868 | 21592863 | - |
| SEQ ID NO 27469 | TGTTCTAACATATGGTGTATCC | TTG | chr12 | 21592862 | 21592883 | 21592867 | 21592862 | - |
| SEQ ID NO 27470 | TAACATATGGTGTATCCTGGGG | TTC | chr12 | 21592857 | 21592878 | 21592862 | 21592857 | - |
| SEQ ID NO 27471 | ACATATGGTGTATCCTGGGGAA | CTA | chr12 | 21592855 | 21592876 | 21592860 | 21592855 | - |
| SEQ ID NO 27472 | GGGAATGCGTCATGTGCTGATG | CTG | chr12 | 21592838 | 21592859 | 21592843 | 21592838 | - |
| SEQ ID NO 27473 | ATGAGATAAATATATTCTGTAG | CTG | chr12 | 21592819 | 21592840 | 21592824 | 21592819 | - |
| SEQ ID NO 27474 | TGTAGCTGTTGGATGAAATATT | TTC | chr12 | 21592802 | 21592823 | 21592807 | 21592802 | - |
| SEQ ID NO 27475 | TAGCTGTTGGATGAAATATTGT | CTG | chr12 | 21592800 | 21592821 | 21592805 | 21592800 | - |
| SEQ ID NO 27476 | TTGGATGAAATATTGTGTAAAT | CTG | chr12 | 21592794 | 21592815 | 21592799 | 21592794 | - |
| SEQ ID NO 27477 | GATGAAATATTGTGTAAATGTT | TTG | chr12 | 21592791 | 21592812 | 21592796 | 21592791 | - |
| SEQ ID NO 27478 | TGTAAATGTTAGATCCATTTGG | TTG | chr12 | 21592779 | 21592800 | 21592784 | 21592779 | - |
| SEQ ID NO 27479 | GATCCATTTGGTCTAAAGTCAA | TTA | chr12 | 21592768 | 21592789 | 21592773 | 21592768 | - |
| SEQ ID NO 27480 | GGTCTAAAGTCAAGTTTAAATC | TTT | chr12 | 21592759 | 21592780 | 21592764 | 21592759 | - |
| SEQ ID NO 27481 | GTCTAAAGTCAAGTTTAAATCC | TTG | chr12 | 21592758 | 21592779 | 21592763 | 21592758 | - |
| SEQ ID NO 27482 | AAGTCAAGTTTAAATCCAATGT | CTA | chr12 | 21592753 | 21592774 | 21592758 | 21592753 | - |
| SEQ ID NO 27483 | AAATCCAATGTTTCTTTGTTAA | TTT | chr12 | 21592742 | 21592763 | 21592747 | 21592742 | - |
| SEQ ID NO 27484 | AATCCAATGTTTCTTTGTTAAT | TTA | chr12 | 21592741 | 21592762 | 21592746 | 21592741 | - |
| SEQ ID NO 27485 | CTTTGTTAATTTTCTGTCTAGA | TTT | chr12 | 21592729 | 21592750 | 21592734 | 21592729 | - |
| SEQ ID NO 27486 | TTTGTTAATTTTCTGTCTAGAT | TTC | chr12 | 21592728 | 21592749 | 21592733 | 21592728 | - |
| SEQ ID NO 27487 | TGTTAATTTTCTGTCTAGATGA | CTT | chr12 | 21592726 | 21592747 | 21592731 | 21592726 | - |
| SEQ ID NO 27488 | GTTAATTTTCTGTCTAGATGAT | TTT | chr12 | 21592725 | 21592746 | 21592730 | 21592725 | - |
| SEQ ID NO 27489 | TTAATTTTCTGTCTAGATGATC | TTG | chr12 | 21592724 | 21592745 | 21592729 | 21592724 | - |
| SEQ ID NO 27490 | ATTTTCTGTCTAGATGATCTAT | TTA | chr12 | 21592721 | 21592742 | 21592726 | 21592721 | - |
| SEQ ID NO 27491 | TCTGTCTAGATGATCTATCTGA | TTT | chr12 | 21592717 | 21592738 | 21592722 | 21592717 | - |
| SEQ ID NO 27492 | CTGTCTAGATGATCTATCTGAT | TTT | chr12 | 21592716 | 21592737 | 21592721 | 21592716 | - |
| SEQ ID NO 27493 | TGTCTAGATGATCTATCTGATG | TTC | chr12 | 21592715 | 21592736 | 21592720 | 21592715 | - |
| SEQ ID NO 27494 | TCTAGATGATCTATCTGATGCT | CTG | chr12 | 21592713 | 21592734 | 21592718 | 21592713 | - |
| SEQ ID NO 27495 | GATGATCTATCTGATGCTGAGA | CTA | chr12 | 21592709 | 21592730 | 21592714 | 21592709 | - |
| SEQ ID NO 27496 | TCTGATGCTGAGATTAGAATGT | CTA | chr12 | 21592700 | 21592721 | 21592705 | 21592700 | - |
| SEQ ID NO 27497 | ATGCTGAGATTAGAATGTTGAA | CTG | chr12 | 21592696 | 21592717 | 21592701 | 21592696 | - |
| SEQ ID NO 27498 | AGATTAGAATGTTGAAATCCCC | CTG | chr12 | 21592690 | 21592711 | 21592695 | 21592690 | - |
| SEQ ID NO 27499 | GAATGTTGAAATCCCCAACTAT | TTA | chr12 | 21592684 | 21592705 | 21592689 | 21592684 | - |
| SEQ ID NO 27500 | AAATCCCCAACTATTATTGTAT | TTG | chr12 | 21592676 | 21592697 | 21592681 | 21592676 | - |
| SEQ ID NO 27501 | TTATTGTATTGGATTCTATTTC | CTA | chr12 | 21592663 | 21592684 | 21592668 | 21592663 | - |

Figure 48 (Cont'd)

| SEQ ID NO | Sequence | | | | | | |
|---|---|---|---|---|---|---|---|
| SEQ ID NO 27502 | TTGTATTGGATTCTATTTCACC | TTA | chr12 | 21592660 | 21592681 | 21592665 | 21592660 | - |
| SEQ ID NO 27503 | TATTGGATTCTATTTCACCCTT | TTG | chr12 | 21592657 | 21592678 | 21592662 | 21592657 | - |
| SEQ ID NO 27504 | GATTCTATTTCACCCTTTATAT | TTG | chr12 | 21592652 | 21592673 | 21592657 | 21592652 | - |
| SEQ ID NO 27505 | TATTTCACCCTTTATATCTAAT | TTC | chr12 | 21592647 | 21592668 | 21592652 | 21592647 | - |
| SEQ ID NO 27506 | TTTCACCCTTTATATCTAATAA | CTA | chr12 | 21592645 | 21592666 | 21592650 | 21592645 | - |
| SEQ ID NO 27507 | CACCCTTTATATCTAATAACAT | TTT | chr12 | 21592642 | 21592663 | 21592647 | 21592642 | - |
| SEQ ID NO 27508 | ACCCTTTATATCTAATAACATT | TTC | chr12 | 21592641 | 21592662 | 21592646 | 21592641 | - |
| SEQ ID NO 27509 | TATATCTAATAACATTTGCTTT | CTT | chr12 | 21592635 | 21592656 | 21592640 | 21592635 | - |
| SEQ ID NO 27510 | ATATCTAATAACATTTGCTTTA | TTT | chr12 | 21592634 | 21592655 | 21592639 | 21592634 | - |
| SEQ ID NO 27511 | TATCTAATAACATTTGCTTTAC | TTA | chr12 | 21592633 | 21592654 | 21592638 | 21592633 | - |
| SEQ ID NO 27512 | ATAACATTTGCTTTACATATCT | CTA | chr12 | 21592627 | 21592648 | 21592632 | 21592627 | - |
| SEQ ID NO 27513 | GCTTTACATATCTGGATGCTCT | TTT | chr12 | 21592618 | 21592639 | 21592623 | 21592618 | - |
| SEQ ID NO 27514 | CTTTACATATCTGGATGCTCTG | TTG | chr12 | 21592617 | 21592638 | 21592622 | 21592617 | - |
| SEQ ID NO 27515 | TACATATCTGGATGCTCTGGTG | CTT | chr12 | 21592614 | 21592635 | 21592619 | 21592614 | - |
| SEQ ID NO 27516 | ACATATCTGGATGCTCTGGTGT | TTT | chr12 | 21592613 | 21592634 | 21592618 | 21592613 | - |
| SEQ ID NO 27517 | CATATCTGGATGCTCTGGTGTT | TTA | chr12 | 21592612 | 21592633 | 21592617 | 21592612 | - |
| SEQ ID NO 27518 | GATGCTCTGGTGTTGAGTGTGA | CTG | chr12 | 21592604 | 21592625 | 21592609 | 21592604 | - |
| SEQ ID NO 27519 | TGGTGTTGAGTGTGAATGTTTA | CTC | chr12 | 21592597 | 21592618 | 21592602 | 21592597 | - |
| SEQ ID NO 27520 | GTGTTGAGTGTGAATGTTTAGA | CTG | chr12 | 21592595 | 21592616 | 21592600 | 21592595 | - |
| SEQ ID NO 27521 | AGTGTGAATGTTTAGAATTGTT | TTG | chr12 | 21592589 | 21592610 | 21592594 | 21592589 | - |
| SEQ ID NO 27522 | AGAATTGTTATATACTCTTGCT | TTT | chr12 | 21592576 | 21592597 | 21592581 | 21592576 | - |
| SEQ ID NO 27523 | GAATTGTTATATACTCTTGCTG | TTA | chr12 | 21592575 | 21592596 | 21592580 | 21592575 | - |
| SEQ ID NO 27524 | TTATATACTCTTGCTGAATTGT | TTG | chr12 | 21592569 | 21592590 | 21592574 | 21592569 | - |
| SEQ ID NO 27525 | TATACTCTTGCTGAATTGTTCC | TTA | chr12 | 21592566 | 21592587 | 21592571 | 21592566 | - |
| SEQ ID NO 27526 | TTGCTGAATTGTTCCTTTTATC | CTC | chr12 | 21592559 | 21592580 | 21592564 | 21592559 | - |
| SEQ ID NO 27527 | GCTGAATTGTTCCTTTTATCAT | CTT | chr12 | 21592557 | 21592578 | 21592562 | 21592557 | - |
| SEQ ID NO 27528 | CTGAATTGTTCCTTTTATCATT | TTG | chr12 | 21592556 | 21592577 | 21592561 | 21592556 | - |
| SEQ ID NO 27529 | AATTGTTCCTTTTATCATTATG | CTG | chr12 | 21592553 | 21592574 | 21592558 | 21592553 | - |
| SEQ ID NO 27530 | TTCCTTTTATCATTATGTAATG | TTG | chr12 | 21592548 | 21592569 | 21592553 | 21592548 | - |
| SEQ ID NO 27531 | CTTTTATCATTATGTAATGACT | TTC | chr12 | 21592545 | 21592566 | 21592550 | 21592545 | - |
| SEQ ID NO 27532 | TTATCATTATGTAATGACTTTT | CTT | chr12 | 21592542 | 21592563 | 21592547 | 21592542 | - |
| SEQ ID NO 27533 | TATCATTATGTAATGACTTTTG | TTT | chr12 | 21592541 | 21592562 | 21592546 | 21592541 | - |
| SEQ ID NO 27534 | ATCATTATGTAATGACTTTTGT | TTT | chr12 | 21592540 | 21592561 | 21592545 | 21592540 | - |
| SEQ ID NO 27535 | TCATTATGTAATGACTTTTGTC | TTA | chr12 | 21592539 | 21592560 | 21592544 | 21592539 | - |
| SEQ ID NO 27536 | TGTAATGACTTTTGTCTCTTAG | TTA | chr12 | 21592533 | 21592554 | 21592538 | 21592533 | - |
| SEQ ID NO 27537 | TTGTCTCTTAGTGTTTTTTATT | CTT | chr12 | 21592522 | 21592543 | 21592527 | 21592522 | - |
| SEQ ID NO 27538 | TGTCTCTTAGTGTTTTTTATTT | TTT | chr12 | 21592521 | 21592542 | 21592526 | 21592521 | - |
| SEQ ID NO 27539 | GTCTCTTAGTGTTTTTTATTTA | TTT | chr12 | 21592520 | 21592541 | 21592525 | 21592520 | - |
| SEQ ID NO 27540 | TCTCTTAGTGTTTTTTATTTAA | TTG | chr12 | 21592519 | 21592540 | 21592524 | 21592519 | - |
| SEQ ID NO 27541 | TTAGTGTTTTTTATTTAAAGTC | CTC | chr12 | 21592515 | 21592536 | 21592520 | 21592515 | - |
| SEQ ID NO 27542 | AGTGTTTTTTATTTAAAGTCAA | CTT | chr12 | 21592513 | 21592534 | 21592518 | 21592513 | - |
| SEQ ID NO 27543 | GTGTTTTTTATTTAAAGTCAAT | TTA | chr12 | 21592512 | 21592533 | 21592517 | 21592512 | - |
| SEQ ID NO 27544 | TTTATTTAAAGTCAATTTTATC | TTT | chr12 | 21592506 | 21592527 | 21592511 | 21592506 | - |
| SEQ ID NO 27545 | TTATTTAAAGTCAATTTTATCT | TTT | chr12 | 21592505 | 21592526 | 21592510 | 21592505 | - |
| SEQ ID NO 27546 | TATTTAAAGTCAATTTTATCTG | TTT | chr12 | 21592504 | 21592525 | 21592509 | 21592504 | - |
| SEQ ID NO 27547 | ATTTAAAGTCAATTTTATCTGT | TTT | chr12 | 21592503 | 21592524 | 21592508 | 21592503 | - |
| SEQ ID NO 27548 | TTTAAAGTCAATTTTATCTGTT | TTA | chr12 | 21592502 | 21592523 | 21592507 | 21592502 | - |
| SEQ ID NO 27549 | AAAGTCAATTTTATCTGTTATA | TTT | chr12 | 21592499 | 21592520 | 21592504 | 21592499 | - |
| SEQ ID NO 27550 | AAGTCAATTTTATCTGTTATAG | TTA | chr12 | 21592498 | 21592519 | 21592503 | 21592498 | - |
| SEQ ID NO 27551 | TATCTGTTATAGGTATAACTAC | TTT | chr12 | 21592488 | 21592509 | 21592493 | 21592488 | - |
| SEQ ID NO 27552 | ATCTGTTATAGGTATAACTACT | TTT | chr12 | 21592487 | 21592508 | 21592492 | 21592487 | - |
| SEQ ID NO 27553 | TCTGTTATAGGTATAACTACTT | TTA | chr12 | 21592486 | 21592507 | 21592491 | 21592486 | - |
| SEQ ID NO 27554 | TTATAGGTATAACTACTTTTGC | CTG | chr12 | 21592482 | 21592503 | 21592487 | 21592482 | - |
| SEQ ID NO 27555 | TAGGTATAACTACTTTTGCTCA | TTA | chr12 | 21592479 | 21592500 | 21592484 | 21592479 | - |
| SEQ ID NO 27556 | CTTTTGCTCATTTTTGGTTTCT | CTA | chr12 | 21592467 | 21592488 | 21592472 | 21592467 | - |
| SEQ ID NO 27557 | TTGCTCATTTTTGGTTTCTCTT | CTT | chr12 | 21592464 | 21592485 | 21592469 | 21592464 | - |
| SEQ ID NO 27558 | TGCTCATTTTTGGTTTCTCTTT | TTT | chr12 | 21592463 | 21592484 | 21592468 | 21592463 | - |
| SEQ ID NO 27559 | GCTCATTTTTGGTTTCTCTTTG | TTT | chr12 | 21592462 | 21592483 | 21592467 | 21592462 | - |

Figure 48 (Cont'd)

| | | | | | | | | |
|---|---|---|---|---|---|---|---|---|
| SEQ ID NO 27560 | CTCATTTTTGGTTTCTCTTTGT | TTG | chr12 | 21592461 | 21592482 | 21592466 | 21592461 | - |
| SEQ ID NO 27561 | ATTTTTGGTTTCTCTTTGTATG | CTC | chr12 | 21592458 | 21592479 | 21592463 | 21592458 | - |
| SEQ ID NO 27562 | TTGGTTTCTCTTTGTATGGAAG | TTT | chr12 | 21592454 | 21592475 | 21592459 | 21592454 | - |
| SEQ ID NO 27563 | TGGTTTCTCTTTGTATGGAAGA | TTT | chr12 | 21592453 | 21592474 | 21592458 | 21592453 | - |
| SEQ ID NO 27564 | GGTTTCTCTTTGTATGGAAGAT | TTT | chr12 | 21592452 | 21592473 | 21592457 | 21592452 | - |
| SEQ ID NO 27565 | GTTTCTCTTTGTATGGAAGATC | TTG | chr12 | 21592451 | 21592472 | 21592456 | 21592451 | - |
| SEQ ID NO 27566 | CTCTTTGTATGGAAGATCTTTC | TTT | chr12 | 21592447 | 21592468 | 21592452 | 21592447 | - |
| SEQ ID NO 27567 | TCTTTGTATGGAAGATCTTTCA | TTC | chr12 | 21592446 | 21592467 | 21592451 | 21592446 | - |
| SEQ ID NO 27568 | TTTGTATGGAAGATCTTTCATC | CTC | chr12 | 21592444 | 21592465 | 21592449 | 21592444 | - |
| SEQ ID NO 27569 | TGTATGGAAGATCTTTCATCTT | CTT | chr12 | 21592442 | 21592463 | 21592447 | 21592442 | - |
| SEQ ID NO 27570 | GTATGGAAGATCTTTCATCTTT | TTT | chr12 | 21592441 | 21592462 | 21592446 | 21592441 | - |
| SEQ ID NO 27571 | TATGGAAGATCTTTCATCTTTT | TTG | chr12 | 21592440 | 21592461 | 21592445 | 21592440 | - |
| SEQ ID NO 27572 | TCATCTTTTACTTTCAGTCTA | CTT | chr12 | 21592427 | 21592448 | 21592432 | 21592427 | - |
| SEQ ID NO 27573 | CATCTTTTACTTTCAGTCTAT | TTT | chr12 | 21592426 | 21592447 | 21592431 | 21592426 | - |
| SEQ ID NO 27574 | ATCTTTTACTTTCAGTCTATA | TTC | chr12 | 21592425 | 21592446 | 21592430 | 21592425 | - |
| SEQ ID NO 27575 | TTTACTTTCAGTCTATATTTAT | CTT | chr12 | 21592420 | 21592441 | 21592425 | 21592420 | - |
| SEQ ID NO 27576 | TTACTTTCAGTCTATATTTATC | TTT | chr12 | 21592419 | 21592440 | 21592424 | 21592419 | - |
| SEQ ID NO 27577 | TACTTTCAGTCTATATTTATCT | TTT | chr12 | 21592418 | 21592439 | 21592423 | 21592418 | - |
| SEQ ID NO 27578 | ACTTTCAGTCTATATTTATCTT | TTT | chr12 | 21592417 | 21592438 | 21592422 | 21592417 | - |
| SEQ ID NO 27579 | CTTTCAGTCTATATTTATCTTT | TTA | chr12 | 21592416 | 21592437 | 21592421 | 21592416 | - |
| SEQ ID NO 27580 | TCAGTCTATATTTATCTTTACA | CTT | chr12 | 21592413 | 21592434 | 21592418 | 21592413 | - |
| SEQ ID NO 27581 | CAGTCTATATTTATCTTTACAA | TTT | chr12 | 21592412 | 21592433 | 21592417 | 21592412 | - |
| SEQ ID NO 27582 | AGTCTATATTTATCTTTACAAG | TTC | chr12 | 21592411 | 21592432 | 21592416 | 21592411 | - |
| SEQ ID NO 27583 | TATTTATCTTTACAAGTGAGAT | CTA | chr12 | 21592405 | 21592426 | 21592410 | 21592405 | - |
| SEQ ID NO 27584 | ATCTTTACAAGTGAGATAAGTT | TTT | chr12 | 21592400 | 21592421 | 21592405 | 21592400 | - |
| SEQ ID NO 27585 | TCTTTACAAGTGAGATAAGTTT | TTA | chr12 | 21592399 | 21592420 | 21592404 | 21592399 | - |
| SEQ ID NO 27586 | TACAAGTGAGATAAGTTTCTTA | CTT | chr12 | 21592395 | 21592416 | 21592400 | 21592395 | - |
| SEQ ID NO 27587 | ACAAGTGAGATAAGTTTCTTAT | TTT | chr12 | 21592394 | 21592415 | 21592399 | 21592394 | - |
| SEQ ID NO 27588 | CAAGTGAGATAAGTTTCTTATA | TTA | chr12 | 21592393 | 21592414 | 21592398 | 21592393 | - |
| SEQ ID NO 27589 | CTTATAGGCAGCTTACAACTGG | TTT | chr12 | 21592377 | 21592398 | 21592382 | 21592377 | - |
| SEQ ID NO 27590 | TTATAGGCAGCTTACAACTGGG | TTC | chr12 | 21592376 | 21592397 | 21592381 | 21592376 | - |
| SEQ ID NO 27591 | ATAGGCAGCTTACAACTGGGTC | CTT | chr12 | 21592374 | 21592395 | 21592379 | 21592374 | - |
| SEQ ID NO 27592 | TAGGCAGCTTACAACTGGGTCA | TTA | chr12 | 21592373 | 21592394 | 21592378 | 21592373 | - |
| SEQ ID NO 27593 | ACAACTGGGTCATATTTTTGTT | CTT | chr12 | 21592363 | 21592384 | 21592368 | 21592363 | - |
| SEQ ID NO 27594 | CAACTGGGTCATATTTTTGTTT | TTA | chr12 | 21592362 | 21592383 | 21592367 | 21592362 | - |
| SEQ ID NO 27595 | GGTCATATTTTTGTTTTAAATC | CTG | chr12 | 21592356 | 21592377 | 21592361 | 21592356 | - |
| SEQ ID NO 27596 | TTGTTTTAAATCTATTTAGCCA | TTT | chr12 | 21592346 | 21592367 | 21592351 | 21592346 | - |
| SEQ ID NO 27597 | TGTTTTAAATCTATTTAGCCAG | TTT | chr12 | 21592345 | 21592366 | 21592350 | 21592345 | - |
| SEQ ID NO 27598 | GTTTTAAATCTATTTAGCCAGT | TTT | chr12 | 21592344 | 21592365 | 21592349 | 21592344 | - |
| SEQ ID NO 27599 | TTTTAAATCTATTTAGCCAGTC | TTG | chr12 | 21592343 | 21592364 | 21592348 | 21592343 | - |
| SEQ ID NO 27600 | TAAATCTATTTAGCCAGTCTAT | TTT | chr12 | 21592340 | 21592361 | 21592345 | 21592340 | - |
| SEQ ID NO 27601 | AAATCTATTTAGCCAGTCTATA | TTT | chr12 | 21592339 | 21592360 | 21592344 | 21592339 | - |
| SEQ ID NO 27602 | AATCTATTTAGCCAGTCTATAT | TTA | chr12 | 21592338 | 21592359 | 21592343 | 21592338 | - |
| SEQ ID NO 27603 | TTTAGCCAGTCTATATCTTTCA | CTA | chr12 | 21592332 | 21592353 | 21592337 | 21592332 | - |
| SEQ ID NO 27604 | AGCCAGTCTATATCTTTCAAGT | TTT | chr12 | 21592329 | 21592350 | 21592334 | 21592329 | - |
| SEQ ID NO 27605 | GCCAGTCTATATCTTTCAAGTA | TTA | chr12 | 21592328 | 21592349 | 21592333 | 21592328 | - |
| SEQ ID NO 27606 | TATCTTTCAAGTAACAATTTAA | CTA | chr12 | 21592319 | 21592340 | 21592324 | 21592319 | - |
| SEQ ID NO 27607 | TCAAGTAACAATTTAATCCATT | CTT | chr12 | 21592313 | 21592334 | 21592318 | 21592313 | - |
| SEQ ID NO 27608 | CAAGTAACAATTTAATCCATTT | TTT | chr12 | 21592312 | 21592333 | 21592317 | 21592312 | - |
| SEQ ID NO 27609 | AAGTAACAATTTAATCCATTTA | TTC | chr12 | 21592311 | 21592332 | 21592316 | 21592311 | - |
| SEQ ID NO 27610 | AATCCATTTACATGCAAGGCTA | TTT | chr12 | 21592299 | 21592320 | 21592304 | 21592299 | - |
| SEQ ID NO 27611 | ATCCATTTACATGCAAGGCTAT | TTA | chr12 | 21592298 | 21592319 | 21592303 | 21592298 | - |
| SEQ ID NO 27612 | ACATGCAAGGCTATTATTGACA | TTT | chr12 | 21592290 | 21592311 | 21592295 | 21592290 | - |
| SEQ ID NO 27613 | CATGCAAGGCTATTATTGACAT | TTA | chr12 | 21592289 | 21592310 | 21592294 | 21592289 | - |
| SEQ ID NO 27614 | TTATTGACATGTGAGAGCTTAT | CTA | chr12 | 21592277 | 21592298 | 21592282 | 21592277 | - |
| SEQ ID NO 27615 | TTGACATGTGAGAGCTTATTCC | TTA | chr12 | 21592274 | 21592295 | 21592279 | 21592274 | - |
| SEQ ID NO 27616 | ACATGTGAGAGCTTATTCCTGC | TTG | chr12 | 21592271 | 21592292 | 21592276 | 21592271 | - |
| SEQ ID NO 27617 | ATTCCTGCCATTTTGTTAATTG | CTT | chr12 | 21592257 | 21592278 | 21592262 | 21592257 | - |

Figure 48 (Cont'd)

| | | | | | | | | |
|---|---|---|---|---|---|---|---|---|
| SEQ ID NO 27618 | TTCCTGCCATTTTGTTAATTGA | TTA | chr12 | 21592256 | 21592277 | 21592261 | 21592256 | - |
| SEQ ID NO 27619 | CTGCCATTTTGTTAATTGATTC | TTC | chr12 | 21592253 | 21592274 | 21592258 | 21592253 | - |
| SEQ ID NO 27620 | CCATTTTGTTAATTGATTCCTG | CTG | chr12 | 21592250 | 21592271 | 21592255 | 21592250 | - |
| SEQ ID NO 27621 | TGTTAATTGATTCCTGGTTGTT | TTT | chr12 | 21592244 | 21592265 | 21592249 | 21592244 | - |
| SEQ ID NO 27622 | GTTAATTGATTCCTGGTTGTTT | TTT | chr12 | 21592243 | 21592264 | 21592248 | 21592243 | - |
| SEQ ID NO 27623 | TTAATTGATTCCTGGTTGTTTT | TTG | chr12 | 21592242 | 21592263 | 21592247 | 21592242 | - |
| SEQ ID NO 27624 | ATTGATTCCTGGTTGTTTTGTT | TTA | chr12 | 21592239 | 21592260 | 21592244 | 21592239 | - |
| SEQ ID NO 27625 | ATTCCTGGTTGTTTTGTTTTTT | TTG | chr12 | 21592235 | 21592256 | 21592240 | 21592235 | - |
| SEQ ID NO 27626 | CTGGTTGTTTTGTTTTTTTTTT | TTC | chr12 | 21592231 | 21592252 | 21592236 | 21592231 | - |
| SEQ ID NO 27627 | GTTGTTTTGTTTTTTTTTTAGT | CTG | chr12 | 21592228 | 21592249 | 21592233 | 21592228 | - |
| SEQ ID NO 27628 | TTTTGTTTTTTTTTAGTTTGT | TTG | chr12 | 21592224 | 21592245 | 21592229 | 21592224 | - |
| SEQ ID NO 27629 | TGTTTTTTTTAGTTTGTTTG | TTT | chr12 | 21592221 | 21592242 | 21592226 | 21592221 | - |
| SEQ ID NO 27630 | GTTTTTTTTTAGTTTGTTTGT | TTT | chr12 | 21592220 | 21592241 | 21592225 | 21592220 | - |
| SEQ ID NO 27631 | TTTTTTTTTAGTTTGTTTGTT | TTG | chr12 | 21592219 | 21592240 | 21592224 | 21592219 | - |
| SEQ ID NO 27632 | TTTTTTTAGTTTGTTTGTTTTG | TTT | chr12 | 21592216 | 21592237 | 21592221 | 21592216 | - |
| SEQ ID NO 27633 | TTTTTTAGTTTGTTTGTTTTGT | TTT | chr12 | 21592215 | 21592236 | 21592220 | 21592215 | - |
| SEQ ID NO 27634 | TTTTTAGTTTGTTTGTTTTGTG | TTT | chr12 | 21592214 | 21592235 | 21592219 | 21592214 | - |
| SEQ ID NO 27635 | TTTTAGTTTGTTTGTTTTGTGT | TTT | chr12 | 21592213 | 21592234 | 21592218 | 21592213 | - |
| SEQ ID NO 27636 | TTTAGTTTGTTTGTTTTGTGTT | TTT | chr12 | 21592212 | 21592233 | 21592217 | 21592212 | - |
| SEQ ID NO 27637 | TTAGTTTGTTTGTTTTGTGTTT | TTT | chr12 | 21592211 | 21592232 | 21592216 | 21592211 | - |
| SEQ ID NO 27638 | TAGTTTGTTTGTTTTGTGTTTT | TTT | chr12 | 21592210 | 21592231 | 21592215 | 21592210 | - |
| SEQ ID NO 27639 | AGTTTGTTTGTTTTGTGTTTTT | TTT | chr12 | 21592209 | 21592230 | 21592214 | 21592209 | - |
| SEQ ID NO 27640 | GTTTGTTTGTTTTGTGTTTTTT | TTA | chr12 | 21592208 | 21592229 | 21592213 | 21592208 | - |
| SEQ ID NO 27641 | GTTTGTTTTGTGTTTTTTTCTT | TTT | chr12 | 21592204 | 21592225 | 21592209 | 21592204 | - |
| SEQ ID NO 27642 | TTTGTTTTGTGTTTTTTTCTTC | TTG | chr12 | 21592203 | 21592224 | 21592208 | 21592203 | - |
| SEQ ID NO 27643 | GTTTTGTGTTTTTTTCTTCCTT | TTT | chr12 | 21592200 | 21592221 | 21592205 | 21592200 | - |
| SEQ ID NO 27644 | TTTTGTGTTTTTTTCTTCCTTC | TTG | chr12 | 21592199 | 21592220 | 21592204 | 21592199 | - |
| SEQ ID NO 27645 | TGTGTTTTTTTCTTCCTTCCTT | TTT | chr12 | 21592196 | 21592217 | 21592201 | 21592196 | - |
| SEQ ID NO 27646 | GTGTTTTTTTCTTCCTTCCTTC | TTT | chr12 | 21592195 | 21592216 | 21592200 | 21592195 | - |
| SEQ ID NO 27647 | TGTTTTTTTCTTCCTTCCTTCC | TTG | chr12 | 21592194 | 21592215 | 21592199 | 21592194 | - |
| SEQ ID NO 27648 | TTTTCTTCCTTCCTTCCTTTTC | TTT | chr12 | 21592189 | 21592210 | 21592194 | 21592189 | - |
| SEQ ID NO 27649 | TTTCTTCCTTCCTTCCTTTTCT | TTT | chr12 | 21592188 | 21592209 | 21592193 | 21592188 | - |
| SEQ ID NO 27650 | TTCTTCCTTCCTTCCTTTTCTT | TTT | chr12 | 21592187 | 21592208 | 21592192 | 21592187 | - |
| SEQ ID NO 27651 | TCTTCCTTCCTTCCTTTTCTTT | TTT | chr12 | 21592186 | 21592207 | 21592191 | 21592186 | - |
| SEQ ID NO 27652 | CTTCCTTCCTTCCTTTTCTTTC | TTT | chr12 | 21592185 | 21592206 | 21592190 | 21592185 | - |
| SEQ ID NO 27653 | TTCCTTCCTTCCTTTTCTTTCT | TTC | chr12 | 21592184 | 21592205 | 21592189 | 21592184 | - |
| SEQ ID NO 27654 | CCTTCCTTCCTTTTCTTTCTTT | CTT | chr12 | 21592182 | 21592203 | 21592187 | 21592182 | - |
| SEQ ID NO 27655 | CTTCCTTCCTTTTCTTTCTTTC | TTC | chr12 | 21592181 | 21592202 | 21592186 | 21592181 | - |
| SEQ ID NO 27656 | CCTTCCTTTTCTTTCTTTCATT | CTT | chr12 | 21592178 | 21592199 | 21592183 | 21592178 | - |
| SEQ ID NO 27657 | CTTCCTTTTCTTTCTTTCATTC | TTC | chr12 | 21592177 | 21592198 | 21592182 | 21592177 | - |
| SEQ ID NO 27658 | CCTTTTCTTTCTTTCATTCTCT | CTT | chr12 | 21592174 | 21592195 | 21592179 | 21592174 | - |
| SEQ ID NO 27659 | CTTTTCTTTCTTTCATTCTCTC | TTC | chr12 | 21592173 | 21592194 | 21592178 | 21592173 | - |
| SEQ ID NO 27660 | TTCTTTCTTTCATTCTCTCTCT | CTT | chr12 | 21592170 | 21592191 | 21592175 | 21592170 | - |
| SEQ ID NO 27661 | TCTTTCTTTCATTCTCTCTCTC | TTT | chr12 | 21592169 | 21592190 | 21592174 | 21592169 | - |
| SEQ ID NO 27662 | CTTTCTTTCATTCTCTCTCTCT | TTT | chr12 | 21592168 | 21592189 | 21592173 | 21592168 | - |
| SEQ ID NO 27663 | TTTCTTTCATTCTCTCTCTCTC | TTC | chr12 | 21592167 | 21592188 | 21592172 | 21592167 | - |
| SEQ ID NO 27664 | TCTTTCATTCTCTCTCTCTCTC | CTT | chr12 | 21592165 | 21592186 | 21592170 | 21592165 | - |
| SEQ ID NO 27665 | CTTTCATTCTCTCTCTCTCTCT | TTT | chr12 | 21592164 | 21592185 | 21592169 | 21592164 | - |
| SEQ ID NO 27666 | TTTCATTCTCTCTCTCTCTCTC | TTC | chr12 | 21592163 | 21592184 | 21592168 | 21592163 | - |
| SEQ ID NO 27667 | TCATTCTCTCTCTCTCTCTCTT | CTT | chr12 | 21592161 | 21592182 | 21592166 | 21592161 | - |
| SEQ ID NO 27668 | CATTCTCTCTCTCTCTCTCTTT | TTT | chr12 | 21592160 | 21592181 | 21592165 | 21592160 | - |
| SEQ ID NO 27669 | ATTCTCTCTCTCTCTCTCTTTC | TTC | chr12 | 21592159 | 21592180 | 21592164 | 21592159 | - |
| SEQ ID NO 27670 | TCTCTCTCTCTCTCTTTCTTTC | TTC | chr12 | 21592155 | 21592176 | 21592160 | 21592155 | - |
| SEQ ID NO 27671 | TCTCTCTCTCTCTTTCTTTCTT | CTC | chr12 | 21592153 | 21592174 | 21592158 | 21592153 | - |
| SEQ ID NO 27672 | TCTCTCTCTCTTTCTTTCTTTC | CTC | chr12 | 21592151 | 21592172 | 21592156 | 21592151 | - |
| SEQ ID NO 27673 | TCTCTCTCTTTCTTTCTTTCTT | CTC | chr12 | 21592149 | 21592170 | 21592154 | 21592149 | - |
| SEQ ID NO 27674 | TCTCTCTTTCTTTCTTTCTTTC | CTC | chr12 | 21592147 | 21592168 | 21592152 | 21592147 | - |
| SEQ ID NO 27675 | TCTCTTTCTTTCTTTCTTTCTT | CTC | chr12 | 21592145 | 21592166 | 21592150 | 21592145 | - |

Figure 48 (Cont'd)

| | | | | | | | | |
|---|---|---|---|---|---|---|---|---|
| SEQ ID NO 27676 | TCTTTCTTTCTTTCTTTCTTTC | CTC | chr12 | 21592143 | 21592164 | 21592148 | 21592143 | - |
| SEQ ID NO 27677 | TTTCTTTCTTTCTTTCTTTCTT | CTC | chr12 | 21592141 | 21592162 | 21592146 | 21592141 | - |
| SEQ ID NO 27678 | TCTTTCTTTCTTTCTTTCTTAT | CTT | chr12 | 21592139 | 21592160 | 21592144 | 21592139 | - |
| SEQ ID NO 27679 | CTTTCTTTCTTTCTTTCTTATT | TTT | chr12 | 21592138 | 21592159 | 21592143 | 21592138 | - |
| SEQ ID NO 27680 | TTTCTTTCTTTCTTTCTTATTA | TTC | chr12 | 21592137 | 21592158 | 21592142 | 21592137 | - |
| SEQ ID NO 27681 | TCTTTCTTTCTTTCTTATTATT | CTT | chr12 | 21592135 | 21592156 | 21592140 | 21592135 | - |
| SEQ ID NO 27682 | CTTTCTTTCTTTCTTATTATTT | TTT | chr12 | 21592134 | 21592155 | 21592139 | 21592134 | - |
| SEQ ID NO 27683 | TTTCTTTCTTTCTTATTATTTA | TTC | chr12 | 21592133 | 21592154 | 21592138 | 21592133 | - |
| SEQ ID NO 27684 | TCTTTCTTTCTTATTATTTATG | CTT | chr12 | 21592131 | 21592152 | 21592136 | 21592131 | - |
| SEQ ID NO 27685 | CTTTCTTTCTTATTATTTATGA | TTT | chr12 | 21592130 | 21592151 | 21592135 | 21592130 | - |
| SEQ ID NO 27686 | TTTCTTTCTTATTATTTATGAT | TTC | chr12 | 21592129 | 21592150 | 21592134 | 21592129 | - |
| SEQ ID NO 27687 | TCTTTCTTATTATTTATGATTG | CTT | chr12 | 21592127 | 21592148 | 21592132 | 21592127 | - |
| SEQ ID NO 27688 | CTTTCTTATTATTTATGATTGT | TTT | chr12 | 21592126 | 21592147 | 21592131 | 21592126 | - |
| SEQ ID NO 27689 | TTTCTTATTATTTATGATTGTG | TTC | chr12 | 21592125 | 21592146 | 21592130 | 21592125 | - |
| SEQ ID NO 27690 | TCTTATTATTTATGATTGTGGT | CTT | chr12 | 21592123 | 21592144 | 21592128 | 21592123 | - |
| SEQ ID NO 27691 | CTTATTATTTATGATTGTGGTT | TTT | chr12 | 21592122 | 21592143 | 21592127 | 21592122 | - |
| SEQ ID NO 27692 | TTATTATTTATGATTGTGGTTT | TTC | chr12 | 21592121 | 21592142 | 21592126 | 21592121 | - |
| SEQ ID NO 27693 | ATTATTTATGATTGTGGTTTGG | CTT | chr12 | 21592119 | 21592140 | 21592124 | 21592119 | - |
| SEQ ID NO 27694 | TTATTTATGATTGTGGTTTGGT | TTA | chr12 | 21592118 | 21592139 | 21592123 | 21592118 | - |
| SEQ ID NO 27695 | TTTATGATTGTGGTTTGGTGAT | TTA | chr12 | 21592115 | 21592136 | 21592120 | 21592115 | - |
| SEQ ID NO 27696 | ATGATTGTGGTTTGGTGATTTT | TTT | chr12 | 21592112 | 21592133 | 21592117 | 21592112 | - |
| SEQ ID NO 27697 | TGATTGTGGTTTGGTGATTTTC | TTA | chr12 | 21592111 | 21592132 | 21592116 | 21592111 | - |
| SEQ ID NO 27698 | TGGTTTGGTGATTTTCTGTAGT | TTG | chr12 | 21592105 | 21592126 | 21592110 | 21592105 | - |
| SEQ ID NO 27699 | GGTGATTTTCTGTAGTGGTAAC | TTT | chr12 | 21592099 | 21592120 | 21592104 | 21592099 | - |
| SEQ ID NO 27700 | GTGATTTTCTGTAGTGGTAACG | TTG | chr12 | 21592098 | 21592119 | 21592103 | 21592098 | - |
| SEQ ID NO 27701 | TCTGTAGTGGTAACGTTTGAGT | TTT | chr12 | 21592091 | 21592112 | 21592096 | 21592091 | - |
| SEQ ID NO 27702 | CTGTAGTGGTAACGTTTGAGTT | TTT | chr12 | 21592090 | 21592111 | 21592095 | 21592090 | - |
| SEQ ID NO 27703 | TGTAGTGGTAACGTTTGAGTTC | TTC | chr12 | 21592089 | 21592110 | 21592094 | 21592089 | - |
| SEQ ID NO 27704 | TAGTGGTAACGTTTGAGTTCTT | CTG | chr12 | 21592087 | 21592108 | 21592092 | 21592087 | - |
| SEQ ID NO 27705 | GAGTTCTTTCTCTTCTTTATTT | TTT | chr12 | 21592073 | 21592094 | 21592078 | 21592073 | - |
| SEQ ID NO 27706 | AGTTCTTTCTCTTCTTTATTTG | TTG | chr12 | 21592072 | 21592093 | 21592077 | 21592072 | - |
| SEQ ID NO 27707 | TTTCTCTTCTTTATTTGTGTTT | TTC | chr12 | 21592067 | 21592088 | 21592072 | 21592067 | - |
| SEQ ID NO 27708 | TCTCTTCTTTATTTGTGTTTTG | CTT | chr12 | 21592065 | 21592086 | 21592070 | 21592065 | - |
| SEQ ID NO 27709 | CTCTTCTTTATTTGTGTTTTGC | TTT | chr12 | 21592064 | 21592085 | 21592069 | 21592064 | - |
| SEQ ID NO 27710 | TCTTCTTTATTTGTGTTTTGCT | TTC | chr12 | 21592063 | 21592084 | 21592068 | 21592063 | - |
| SEQ ID NO 27711 | TTCTTTATTTGTGTTTTGCTCT | CTC | chr12 | 21592061 | 21592082 | 21592066 | 21592061 | - |
| SEQ ID NO 27712 | CTTTATTTGTGTTTTGCTCTAC | CTT | chr12 | 21592059 | 21592080 | 21592064 | 21592059 | - |
| SEQ ID NO 27713 | TTTATTTGTGTTTTGCTCTACC | TTC | chr12 | 21592058 | 21592079 | 21592063 | 21592058 | - |
| SEQ ID NO 27714 | TATTTGTGTTTTGCTCTACCAG | CTT | chr12 | 21592056 | 21592077 | 21592061 | 21592056 | - |
| SEQ ID NO 27715 | ATTTGTGTTTTGCTCTACCAGT | TTT | chr12 | 21592055 | 21592076 | 21592060 | 21592055 | - |
| SEQ ID NO 27716 | TTTGTGTTTTGCTCTACCAGTT | TTA | chr12 | 21592054 | 21592075 | 21592059 | 21592054 | - |
| SEQ ID NO 27717 | GTGTTTTGCTCTACCAGTTAGT | TTT | chr12 | 21592051 | 21592072 | 21592056 | 21592051 | - |
| SEQ ID NO 27718 | TGTTTTGCTCTACCAGTTAGTT | TTG | chr12 | 21592050 | 21592071 | 21592055 | 21592050 | - |
| SEQ ID NO 27719 | TGCTCTACCAGTTAGTTGTATA | TTT | chr12 | 21592045 | 21592066 | 21592050 | 21592045 | - |
| SEQ ID NO 27720 | GCTCTACCAGTTAGTTGTATAC | TTT | chr12 | 21592044 | 21592065 | 21592049 | 21592044 | - |
| SEQ ID NO 27721 | CTCTACCAGTTAGTTGTATACC | TTG | chr12 | 21592043 | 21592064 | 21592048 | 21592043 | - |
| SEQ ID NO 27722 | TACCAGTTAGTTGTATACCTTT | CTC | chr12 | 21592040 | 21592061 | 21592045 | 21592040 | - |
| SEQ ID NO 27723 | CCAGTTAGTTGTATACCTTTGT | CTA | chr12 | 21592038 | 21592059 | 21592043 | 21592038 | - |
| SEQ ID NO 27724 | GTTGTATACCTTTGTGTGTCTT | TTA | chr12 | 21592031 | 21592052 | 21592036 | 21592031 | - |
| SEQ ID NO 27725 | TATACCTTTGTGTGTCTTCATA | TTG | chr12 | 21592027 | 21592048 | 21592032 | 21592027 | - |
| SEQ ID NO 27726 | TGTGTGTCTTCATAATGGCAGT | CTT | chr12 | 21592019 | 21592040 | 21592024 | 21592019 | - |
| SEQ ID NO 27727 | GTGTGTCTTCATAATGGCAGTG | TTT | chr12 | 21592018 | 21592039 | 21592023 | 21592018 | - |
| SEQ ID NO 27728 | TGTGTCTTCATAATGGCAGTGT | TTG | chr12 | 21592017 | 21592038 | 21592022 | 21592017 | - |
| SEQ ID NO 27729 | CATAATGGCAGTGTCCTGTCAC | CTT | chr12 | 21592009 | 21592030 | 21592014 | 21592009 | - |
| SEQ ID NO 27730 | ATAATGGCAGTGTCCTGTCACT | TTC | chr12 | 21592008 | 21592029 | 21592013 | 21592008 | - |
| SEQ ID NO 27731 | TCACTTTCATGTGTAGGACTCC | CTG | chr12 | 21591991 | 21592012 | 21591996 | 21591991 | - |
| SEQ ID NO 27732 | TCATGTGTAGGACTCCCTTAAA | CTT | chr12 | 21591985 | 21592006 | 21591990 | 21591985 | - |
| SEQ ID NO 27733 | CATGTGTAGGACTCCCTTAAAT | TTT | chr12 | 21591984 | 21592005 | 21591989 | 21591984 | - |

Figure 48 (Cont'd)

| | | | | | | | | |
|---|---|---|---|---|---|---|---|---|
| SEQ ID NO 27734 | ATGTGTAGGACTCCCTTAAATA | TTC | chr12 | 21591983 | 21592004 | 21591988 | 21591983 | - |
| SEQ ID NO 27735 | CCTTAAATATTTCTTGTAAAGC | CTC | chr12 | 21591970 | 21591991 | 21591975 | 21591970 | - |
| SEQ ID NO 27736 | AAATATTTCTTGTAAAGCCAGT | CTT | chr12 | 21591966 | 21591987 | 21591971 | 21591966 | - |
| SEQ ID NO 27737 | AATATTTCTTGTAAAGCCAGTC | TTA | chr12 | 21591965 | 21591986 | 21591970 | 21591965 | - |
| SEQ ID NO 27738 | CTTGTAAAGCCAGTCTAGTGAT | TTT | chr12 | 21591958 | 21591979 | 21591963 | 21591958 | - |
| SEQ ID NO 27739 | TTGTAAAGCCAGTCTAGTGATA | TTC | chr12 | 21591957 | 21591978 | 21591962 | 21591957 | - |
| SEQ ID NO 27740 | GTAAAGCCAGTCTAGTGATAGT | CTT | chr12 | 21591955 | 21591976 | 21591960 | 21591955 | - |
| SEQ ID NO 27741 | TAAAGCCAGTCTAGTGATAGTG | TTG | chr12 | 21591954 | 21591975 | 21591959 | 21591954 | - |
| SEQ ID NO 27742 | GTGATAGTGAATTCCTTCAAAT | CTA | chr12 | 21591941 | 21591962 | 21591946 | 21591941 | - |
| SEQ ID NO 27743 | CTTCAAATTTTCTTGCCCAGA | TTC | chr12 | 21591927 | 21591948 | 21591932 | 21591927 | - |
| SEQ ID NO 27744 | CAAATTTTCTTGCCCAGAAAA | CTT | chr12 | 21591924 | 21591945 | 21591929 | 21591924 | - |
| SEQ ID NO 27745 | AAATTTTCTTGCCCAGAAAAG | TTC | chr12 | 21591923 | 21591944 | 21591928 | 21591923 | - |
| SEQ ID NO 27746 | TTCTTGCCCAGAAAAGATTTTA | TTT | chr12 | 21591917 | 21591938 | 21591922 | 21591917 | - |
| SEQ ID NO 27747 | TCTTGCCCAGAAAAGATTTTAT | TTT | chr12 | 21591916 | 21591937 | 21591921 | 21591916 | - |
| SEQ ID NO 27748 | CTTGCCCAGAAAAGATTTTATT | TTT | chr12 | 21591915 | 21591936 | 21591920 | 21591915 | - |
| SEQ ID NO 27749 | TTGCCCAGAAAAGATTTTATTT | TTC | chr12 | 21591914 | 21591935 | 21591919 | 21591914 | - |
| SEQ ID NO 27750 | GCCCAGAAAAGATTTTATTTAT | CTT | chr12 | 21591912 | 21591933 | 21591917 | 21591912 | - |
| SEQ ID NO 27751 | CCCAGAAAAGATTTTATTTATC | TTG | chr12 | 21591911 | 21591932 | 21591916 | 21591911 | - |
| SEQ ID NO 27752 | TATTTATCCTTCATTTTTGAAG | TTT | chr12 | 21591897 | 21591918 | 21591902 | 21591897 | - |
| SEQ ID NO 27753 | ATTTATCCTTCATTTTTGAAGA | TTT | chr12 | 21591896 | 21591917 | 21591901 | 21591896 | - |
| SEQ ID NO 27754 | TTTATCCTTCATTTTTGAAGAA | TTA | chr12 | 21591895 | 21591916 | 21591900 | 21591895 | - |
| SEQ ID NO 27755 | ATCCTTCATTTTTGAAGAACAA | TTT | chr12 | 21591892 | 21591913 | 21591897 | 21591892 | - |
| SEQ ID NO 27756 | TCCTTCATTTTTGAAGAACAAT | TTA | chr12 | 21591891 | 21591912 | 21591896 | 21591891 | - |
| SEQ ID NO 27757 | CATTTTTGAAGAACAATGTTGC | CTT | chr12 | 21591886 | 21591907 | 21591891 | 21591886 | - |
| SEQ ID NO 27758 | ATTTTTGAAGAACAATGTTGCT | TTC | chr12 | 21591885 | 21591906 | 21591890 | 21591885 | - |
| SEQ ID NO 27759 | TTGAAGAACAATGTTGCTGGGT | TTT | chr12 | 21591881 | 21591902 | 21591886 | 21591881 | - |
| SEQ ID NO 27760 | TGAAGAACAATGTTGCTGGGTA | TTT | chr12 | 21591880 | 21591901 | 21591885 | 21591880 | - |
| SEQ ID NO 27761 | GAAGAACAATGTTGCTGGGTAT | TTT | chr12 | 21591879 | 21591900 | 21591884 | 21591879 | - |
| SEQ ID NO 27762 | AAGAACAATGTTGCTGGGTATA | TTG | chr12 | 21591878 | 21591899 | 21591883 | 21591878 | - |
| SEQ ID NO 27763 | CTGGGTATAACATCCTTGGTGT | TTG | chr12 | 21591865 | 21591886 | 21591870 | 21591865 | - |
| SEQ ID NO 27764 | GGTATAACATCCTTGGTGTCAT | CTG | chr12 | 21591862 | 21591883 | 21591867 | 21591862 | - |
| SEQ ID NO 27765 | GGTGTCATTTTTTTCTTTCACT | CTT | chr12 | 21591848 | 21591869 | 21591853 | 21591848 | - |
| SEQ ID NO 27766 | GTGTCATTTTTTTCTTTCACTA | TTG | chr12 | 21591847 | 21591868 | 21591852 | 21591847 | - |
| SEQ ID NO 27767 | TTTTCTTTCACTATTTTGAATA | TTT | chr12 | 21591838 | 21591859 | 21591843 | 21591838 | - |
| SEQ ID NO 27768 | TTTCTTTCACTATTTTGAATAT | TTT | chr12 | 21591837 | 21591858 | 21591842 | 21591837 | - |
| SEQ ID NO 27769 | TTCTTTCACTATTTTGAATATA | TTT | chr12 | 21591836 | 21591857 | 21591841 | 21591836 | - |
| SEQ ID NO 27770 | TCTTTCACTATTTTGAATATAT | TTT | chr12 | 21591835 | 21591856 | 21591840 | 21591835 | - |
| SEQ ID NO 27771 | CTTTCACTATTTTGAATATATC | TTT | chr12 | 21591834 | 21591855 | 21591839 | 21591834 | - |
| SEQ ID NO 27772 | TTTCACTATTTTGAATATATCA | TTC | chr12 | 21591833 | 21591854 | 21591838 | 21591833 | - |
| SEQ ID NO 27773 | TCACTATTTTGAATATATCATC | CTT | chr12 | 21591831 | 21591852 | 21591836 | 21591831 | - |
| SEQ ID NO 27774 | CACTATTTTGAATATATCATCC | TTT | chr12 | 21591830 | 21591851 | 21591835 | 21591830 | - |
| SEQ ID NO 27775 | ACTATTTTGAATATATCATCCC | TTC | chr12 | 21591829 | 21591850 | 21591834 | 21591829 | - |
| SEQ ID NO 27776 | TTTTGAATATATCATCCCATCT | CTA | chr12 | 21591825 | 21591846 | 21591830 | 21591825 | - |
| SEQ ID NO 27777 | TGAATATATCATCCCATCTTCT | TTT | chr12 | 21591822 | 21591843 | 21591827 | 21591822 | - |
| SEQ ID NO 27778 | GAATATATCATCCCATCTTCTC | TTT | chr12 | 21591821 | 21591842 | 21591826 | 21591821 | - |
| SEQ ID NO 27779 | AATATATCATCCCATCTTCTCC | TTG | chr12 | 21591820 | 21591841 | 21591825 | 21591820 | - |
| SEQ ID NO 27780 | CTCCTGGCCTGTGAGGTTTCTG | CTT | chr12 | 21591802 | 21591823 | 21591807 | 21591802 | - |
| SEQ ID NO 27781 | TCCTGGCCTGTGAGGTTTCTGC | TTC | chr12 | 21591801 | 21591822 | 21591806 | 21591801 | - |
| SEQ ID NO 27782 | CTGGCCTGTGAGGTTTCTGCTG | CTC | chr12 | 21591799 | 21591820 | 21591804 | 21591799 | - |
| SEQ ID NO 27783 | GCCTGTGAGGTTTCTGCTGAGA | CTG | chr12 | 21591796 | 21591817 | 21591801 | 21591796 | - |
| SEQ ID NO 27784 | TGAGGTTTCTGCTGAGAAATCT | CTG | chr12 | 21591791 | 21591812 | 21591796 | 21591791 | - |
| SEQ ID NO 27785 | CTGCTGAGAAATCTGCTGTTAA | TTT | chr12 | 21591783 | 21591804 | 21591788 | 21591783 | - |
| SEQ ID NO 27786 | TGCTGAGAAATCTGCTGTTAAT | TTC | chr12 | 21591782 | 21591803 | 21591787 | 21591782 | - |
| SEQ ID NO 27787 | CTGAGAAATCTGCTGTTAATCT | CTG | chr12 | 21591780 | 21591801 | 21591785 | 21591780 | - |
| SEQ ID NO 27788 | AGAAATCTGCTGTTAATCTGTT | CTG | chr12 | 21591777 | 21591798 | 21591782 | 21591777 | - |
| SEQ ID NO 27789 | CTGTTAATCTGTTAATCTTGTG | CTG | chr12 | 21591768 | 21591789 | 21591773 | 21591768 | - |
| SEQ ID NO 27790 | TTAATCTGTTAATCTTGTGGAA | CTG | chr12 | 21591765 | 21591786 | 21591770 | 21591765 | - |
| SEQ ID NO 27791 | ATCTGTTAATCTTGTGGAAGTT | TTA | chr12 | 21591762 | 21591783 | 21591767 | 21591762 | - |

Figure 48 (Cont'd)

| SEQ ID NO 27792 | TTAATCTTGTGGAAGTTCCCTT | CTG | chr12 | 21591757 | 21591778 | 21591762 | 21591757 | - |
|---|---|---|---|---|---|---|---|---|
| SEQ ID NO 27793 | ATCTTGTGGAAGTTCCCTTATA | TTA | chr12 | 21591754 | 21591775 | 21591759 | 21591754 | - |
| SEQ ID NO 27794 | GTGGAAGTTCCCTTATAAGTGA | CTT | chr12 | 21591749 | 21591770 | 21591754 | 21591749 | - |
| SEQ ID NO 27795 | TGGAAGTTCCCTTATAAGTGAC | TTG | chr12 | 21591748 | 21591769 | 21591753 | 21591748 | - |
| SEQ ID NO 27796 | CCTTATAAGTGACTAGACATTT | TTC | chr12 | 21591739 | 21591760 | 21591744 | 21591739 | - |
| SEQ ID NO 27797 | ATAAGTGACTAGACATTTTGCT | CTT | chr12 | 21591735 | 21591756 | 21591740 | 21591735 | - |
| SEQ ID NO 27798 | TAAGTGACTAGACATTTTGCTT | TTA | chr12 | 21591734 | 21591755 | 21591739 | 21591734 | - |
| SEQ ID NO 27799 | GACATTTTGCTTGCTGTTTTAG | CTA | chr12 | 21591724 | 21591745 | 21591729 | 21591724 | - |
| SEQ ID NO 27800 | TGCTTGCTGTTTTAGAGTTCTT | TTT | chr12 | 21591717 | 21591738 | 21591722 | 21591717 | - |
| SEQ ID NO 27801 | GCTTGCTGTTTTAGAGTTCTTA | TTT | chr12 | 21591716 | 21591737 | 21591721 | 21591716 | - |
| SEQ ID NO 27802 | CTTGCTGTTTTAGAGTTCTTAC | TTG | chr12 | 21591715 | 21591736 | 21591720 | 21591715 | - |
| SEQ ID NO 27803 | GCTGTTTTAGAGTTCTTACTCT | CTT | chr12 | 21591712 | 21591733 | 21591717 | 21591712 | - |
| SEQ ID NO 27804 | CTGTTTTAGAGTTCTTACTCTT | TTG | chr12 | 21591711 | 21591732 | 21591716 | 21591711 | - |
| SEQ ID NO 27805 | TTTTAGAGTTCTTACTCTTTGG | CTG | chr12 | 21591708 | 21591729 | 21591713 | 21591708 | - |
| SEQ ID NO 27806 | TAGAGTTCTTACTCTTTGGCTT | TTT | chr12 | 21591705 | 21591726 | 21591710 | 21591705 | - |
| SEQ ID NO 27807 | AGAGTTCTTACTCTTTGGCTTT | TTT | chr12 | 21591704 | 21591725 | 21591709 | 21591704 | - |
| SEQ ID NO 27808 | GAGTTCTTACTCTTTGGCTTTT | TTA | chr12 | 21591703 | 21591724 | 21591708 | 21591703 | - |
| SEQ ID NO 27809 | TTACTCTTTGGCTTTTGACAGT | TTC | chr12 | 21591697 | 21591718 | 21591702 | 21591697 | - |
| SEQ ID NO 27810 | ACTCTTTGGCTTTTGACAGTTT | CTT | chr12 | 21591695 | 21591716 | 21591700 | 21591695 | - |
| SEQ ID NO 27811 | CTCTTTGGCTTTTGACAGTTTG | TTA | chr12 | 21591694 | 21591715 | 21591699 | 21591694 | - |
| SEQ ID NO 27812 | TTTGGCTTTTGACAGTTTGACT | CTC | chr12 | 21591691 | 21591712 | 21591696 | 21591691 | - |
| SEQ ID NO 27813 | TGGCTTTTGACAGTTTGACTAT | CTT | chr12 | 21591689 | 21591710 | 21591694 | 21591689 | - |
| SEQ ID NO 27814 | GGCTTTTGACAGTTTGACTATA | TTT | chr12 | 21591688 | 21591709 | 21591693 | 21591688 | - |
| SEQ ID NO 27815 | GCTTTTGACAGTTTGACTATAA | TTG | chr12 | 21591687 | 21591708 | 21591692 | 21591687 | - |
| SEQ ID NO 27816 | TTGACAGTTTGACTATAATGTG | CTT | chr12 | 21591683 | 21591704 | 21591688 | 21591683 | - |
| SEQ ID NO 27817 | TGACAGTTTGACTATAATGTGC | TTT | chr12 | 21591682 | 21591703 | 21591687 | 21591682 | - |
| SEQ ID NO 27818 | GACAGTTTGACTATAATGTGCT | TTT | chr12 | 21591681 | 21591702 | 21591686 | 21591681 | - |
| SEQ ID NO 27819 | ACAGTTTGACTATAATGTGCTG | TTG | chr12 | 21591680 | 21591701 | 21591685 | 21591680 | - |
| SEQ ID NO 27820 | GACTATAATGTGCTGTGGAGAA | TTT | chr12 | 21591673 | 21591694 | 21591678 | 21591673 | - |
| SEQ ID NO 27821 | ACTATAATGTGCTGTGGAGAAG | TTG | chr12 | 21591672 | 21591693 | 21591677 | 21591672 | - |
| SEQ ID NO 27822 | TAATGTGCTGTGGAGAAGAGCT | CTA | chr12 | 21591668 | 21591689 | 21591673 | 21591668 | - |
| SEQ ID NO 27823 | TGGAGAAGAGCTTTTTGCATTA | CTG | chr12 | 21591658 | 21591679 | 21591663 | 21591658 | - |
| SEQ ID NO 27824 | TTTGCATTATATTATTTGGGAA | CTT | chr12 | 21591645 | 21591666 | 21591650 | 21591645 | - |
| SEQ ID NO 27825 | TTGCATTATATTATTTGGGAAT | TTT | chr12 | 21591644 | 21591665 | 21591649 | 21591644 | - |
| SEQ ID NO 27826 | TGCATTATATTATTTGGGAATT | TTT | chr12 | 21591643 | 21591664 | 21591648 | 21591643 | - |
| SEQ ID NO 27827 | GCATTATATTATTTGGGAATTT | TTT | chr12 | 21591642 | 21591663 | 21591647 | 21591642 | - |
| SEQ ID NO 27828 | CATTATATTATTTGGGAATTTC | TTG | chr12 | 21591641 | 21591662 | 21591646 | 21591641 | - |
| SEQ ID NO 27829 | TATTATTTGGGAATTTCTGATT | TTA | chr12 | 21591636 | 21591657 | 21591641 | 21591636 | - |
| SEQ ID NO 27830 | TTTGGGAATTTCTGATTTTCAT | TTA | chr12 | 21591631 | 21591652 | 21591636 | 21591631 | - |
| SEQ ID NO 27831 | GGGAATTTCTGATTTTCATTTG | TTT | chr12 | 21591628 | 21591649 | 21591633 | 21591628 | - |
| SEQ ID NO 27832 | GGAATTTCTGATTTTCATTTGT | TTG | chr12 | 21591627 | 21591648 | 21591632 | 21591627 | - |
| SEQ ID NO 27833 | CTGATTTTCATTTGTCTGGATG | TTT | chr12 | 21591620 | 21591641 | 21591625 | 21591620 | - |
| SEQ ID NO 27834 | TGATTTTCATTTGTCTGGATGT | TTC | chr12 | 21591619 | 21591640 | 21591624 | 21591619 | - |
| SEQ ID NO 27835 | ATTTTCATTTGTCTGGATGTCT | CTG | chr12 | 21591617 | 21591638 | 21591622 | 21591617 | - |
| SEQ ID NO 27836 | TCATTTGTCTGGATGTCTACAT | TTT | chr12 | 21591613 | 21591634 | 21591618 | 21591613 | - |
| SEQ ID NO 27837 | CATTTGTCTGGATGTCTACATT | TTT | chr12 | 21591612 | 21591633 | 21591617 | 21591612 | - |
| SEQ ID NO 27838 | ATTTGTCTGGATGTCTACATTT | TTC | chr12 | 21591611 | 21591632 | 21591616 | 21591611 | - |
| SEQ ID NO 27839 | GTCTGGATGTCTACATTTCTTG | TTT | chr12 | 21591607 | 21591628 | 21591612 | 21591607 | - |
| SEQ ID NO 27840 | TCTGGATGTCTACATTTCTTGC | TTG | chr12 | 21591606 | 21591627 | 21591611 | 21591606 | - |
| SEQ ID NO 27841 | GATGTCTACATTTCTTGCTAGA | CTG | chr12 | 21591602 | 21591623 | 21591607 | 21591602 | - |
| SEQ ID NO 27842 | CATTTCTTGCTAGACTTGACAA | CTA | chr12 | 21591594 | 21591615 | 21591599 | 21591594 | - |
| SEQ ID NO 27843 | CTTGCTAGACTTGACAAGTTTT | TTT | chr12 | 21591589 | 21591610 | 21591594 | 21591589 | - |
| SEQ ID NO 27844 | TTGCTAGACTTGACAAGTTTTC | TTC | chr12 | 21591588 | 21591609 | 21591593 | 21591588 | - |
| SEQ ID NO 27845 | GCTAGACTTGACAAGTTTTCAG | CTT | chr12 | 21591586 | 21591607 | 21591591 | 21591586 | - |
| SEQ ID NO 27846 | CTAGACTTGACAAGTTTTCAGC | TTG | chr12 | 21591585 | 21591606 | 21591590 | 21591585 | - |
| SEQ ID NO 27847 | GACTTGACAAGTTTTCAGCTAT | CTA | chr12 | 21591582 | 21591603 | 21591587 | 21591582 | - |
| SEQ ID NO 27848 | GACAAGTTTTCAGCTATTGTGT | CTT | chr12 | 21591577 | 21591598 | 21591582 | 21591577 | - |
| SEQ ID NO 27849 | ACAAGTTTTCAGCTATTGTGTT | TTG | chr12 | 21591576 | 21591597 | 21591581 | 21591576 | - |

Figure 48 (Cont'd)

| SEQ ID NO 27850 | TCAGCTATTGTGTTGTTACGTA | TTT | chr12 | 21591568 | 21591589 | 21591573 | 21591568 | - |
|---|---|---|---|---|---|---|---|---|
| SEQ ID NO 27851 | CAGCTATTGTGTTGTTACGTAG | TTT | chr12 | 21591567 | 21591588 | 21591572 | 21591567 | - |
| SEQ ID NO 27852 | AGCTATTGTGTTGTTACGTAGG | TTC | chr12 | 21591566 | 21591587 | 21591571 | 21591566 | - |
| SEQ ID NO 27853 | TTGTGTTGTTACGTAGGTTTCC | CTA | chr12 | 21591561 | 21591582 | 21591566 | 21591561 | - |
| SEQ ID NO 27854 | TGTTGTTACGTAGGTTTCCTAC | TTG | chr12 | 21591558 | 21591579 | 21591563 | 21591558 | - |
| SEQ ID NO 27855 | TTACGTAGGTTTCCTACACCTT | TTG | chr12 | 21591553 | 21591574 | 21591558 | 21591553 | - |
| SEQ ID NO 27856 | CGTAGGTTTCCTACACCTTTCA | TTA | chr12 | 21591550 | 21591571 | 21591555 | 21591550 | - |
| SEQ ID NO 27857 | CCTACACCTTTCATGTTCTCTT | TTT | chr12 | 21591541 | 21591562 | 21591546 | 21591541 | - |
| SEQ ID NO 27858 | CTACACCTTTCATGTTCTCTTT | TTC | chr12 | 21591540 | 21591561 | 21591545 | 21591540 | - |
| SEQ ID NO 27859 | CACCTTTCATGTTCTCTTTACC | CTA | chr12 | 21591537 | 21591558 | 21591542 | 21591537 | - |
| SEQ ID NO 27860 | TCATGTTCTCTTTACCTTCTGG | CTT | chr12 | 21591531 | 21591552 | 21591536 | 21591531 | - |
| SEQ ID NO 27861 | CATGTTCTCTTTACCTTCTGGG | TTT | chr12 | 21591530 | 21591551 | 21591535 | 21591530 | - |
| SEQ ID NO 27862 | ATGTTCTCTTTACCTTCTGGGA | TTC | chr12 | 21591529 | 21591550 | 21591534 | 21591529 | - |
| SEQ ID NO 27863 | TCTTTACCTTCTGGGAAACTGC | TTC | chr12 | 21591523 | 21591544 | 21591528 | 21591523 | - |
| SEQ ID NO 27864 | TTTACCTTCTGGGAAACTGCAA | CTC | chr12 | 21591521 | 21591542 | 21591526 | 21591521 | - |
| SEQ ID NO 27865 | TACCTTCTGGGAAACTGCAAAT | CTT | chr12 | 21591519 | 21591540 | 21591524 | 21591519 | - |
| SEQ ID NO 27866 | ACCTTCTGGGAAACTGCAAATT | TTT | chr12 | 21591518 | 21591539 | 21591523 | 21591518 | - |
| SEQ ID NO 27867 | CCTTCTGGGAAACTGCAAATTT | TTA | chr12 | 21591517 | 21591538 | 21591522 | 21591517 | - |
| SEQ ID NO 27868 | CTGGGAAACTGCAAATTTGAAT | CTT | chr12 | 21591513 | 21591534 | 21591518 | 21591513 | - |
| SEQ ID NO 27869 | TGGGAAACTGCAAATTTGAATA | TTC | chr12 | 21591512 | 21591533 | 21591517 | 21591512 | - |
| SEQ ID NO 27870 | GGAAACTGCAAATTTGAATATT | CTG | chr12 | 21591510 | 21591531 | 21591515 | 21591510 | - |
| SEQ ID NO 27871 | CAAATTTGAATATTTGTTCACT | CTG | chr12 | 21591502 | 21591523 | 21591507 | 21591502 | - |
| SEQ ID NO 27872 | GAATATTTGTTCACTTTATAGT | TTT | chr12 | 21591495 | 21591516 | 21591500 | 21591495 | - |
| SEQ ID NO 27873 | AATATTTGTTCACTTTATAGTG | TTG | chr12 | 21591494 | 21591515 | 21591499 | 21591494 | - |
| SEQ ID NO 27874 | GTTCACTTTATAGTGCCTCATA | TTT | chr12 | 21591487 | 21591508 | 21591492 | 21591487 | - |
| SEQ ID NO 27875 | TTCACTTTATAGTGCCTCATAT | TTG | chr12 | 21591486 | 21591507 | 21591491 | 21591486 | - |
| SEQ ID NO 27876 | ACTTTATAGTGCCTCATATGTC | TTC | chr12 | 21591483 | 21591504 | 21591488 | 21591483 | - |
| SEQ ID NO 27877 | TATAGTGCCTCATATGTCACAT | CTT | chr12 | 21591479 | 21591500 | 21591484 | 21591479 | - |
| SEQ ID NO 27878 | ATAGTGCCTCATATGTCACATA | TTT | chr12 | 21591478 | 21591499 | 21591483 | 21591478 | - |
| SEQ ID NO 27879 | TAGTGCCTCATATGTCACATAC | TTA | chr12 | 21591477 | 21591498 | 21591482 | 21591477 | - |
| SEQ ID NO 27880 | ATATGTCACATACACTTTGTTC | CTC | chr12 | 21591468 | 21591489 | 21591473 | 21591468 | - |
| SEQ ID NO 27881 | TGTTCATTCTTTTTTTTTCCTT | CTT | chr12 | 21591451 | 21591472 | 21591456 | 21591451 | - |
| SEQ ID NO 27882 | GTTCATTCTTTTTTTTCCTTT | TTT | chr12 | 21591450 | 21591471 | 21591455 | 21591450 | - |
| SEQ ID NO 27883 | TTCATTCTTTTTTTTCCTTTC | TTG | chr12 | 21591449 | 21591470 | 21591454 | 21591449 | - |
| SEQ ID NO 27884 | ATTCTTTTTTTTCCTTTCTAT | TTC | chr12 | 21591446 | 21591467 | 21591451 | 21591446 | - |
| SEQ ID NO 27885 | TTTTTTTTCCTTTCTATCATT | TTC | chr12 | 21591442 | 21591463 | 21591447 | 21591442 | - |
| SEQ ID NO 27886 | TTTTTTTCCTTTCTATCATTTG | CTT | chr12 | 21591440 | 21591461 | 21591445 | 21591440 | - |
| SEQ ID NO 27887 | TTTTTTCCTTTCTATCATTTGA | TTT | chr12 | 21591439 | 21591460 | 21591444 | 21591439 | - |
| SEQ ID NO 27888 | TTTTTCCTTTCTATCATTTGAC | TTT | chr12 | 21591438 | 21591459 | 21591443 | 21591438 | - |
| SEQ ID NO 27889 | TTTTCCTTTCTATCATTTGACC | TTT | chr12 | 21591437 | 21591458 | 21591442 | 21591437 | - |
| SEQ ID NO 27890 | TTTCCTTTCTATCATTTGACCA | TTT | chr12 | 21591436 | 21591457 | 21591441 | 21591436 | - |
| SEQ ID NO 27891 | TTCCTTTCTATCATTTGACCAG | TTT | chr12 | 21591435 | 21591456 | 21591440 | 21591435 | - |
| SEQ ID NO 27892 | TCCTTTCTATCATTTGACCAGC | TTT | chr12 | 21591434 | 21591455 | 21591439 | 21591434 | - |
| SEQ ID NO 27893 | CCTTTCTATCATTTGACCAGCT | TTT | chr12 | 21591433 | 21591454 | 21591438 | 21591433 | - |
| SEQ ID NO 27894 | CTTTCTATCATTTGACCAGCTA | TTC | chr12 | 21591432 | 21591453 | 21591437 | 21591432 | - |
| SEQ ID NO 27895 | TCTATCATTTGACCAGCTAATT | CTT | chr12 | 21591429 | 21591450 | 21591434 | 21591429 | - |
| SEQ ID NO 27896 | CTATCATTTGACCAGCTAATTT | TTT | chr12 | 21591428 | 21591449 | 21591433 | 21591428 | - |
| SEQ ID NO 27897 | TATCATTTGACCAGCTAATTTT | TTC | chr12 | 21591427 | 21591448 | 21591432 | 21591427 | - |
| SEQ ID NO 27898 | TCATTTGACCAGCTAATTTTAA | CTA | chr12 | 21591425 | 21591446 | 21591430 | 21591425 | - |
| SEQ ID NO 27899 | GACCAGCTAATTTTAAAAGACC | TTT | chr12 | 21591419 | 21591440 | 21591424 | 21591419 | - |
| SEQ ID NO 27900 | ACCAGCTAATTTTAAAAGACCT | TTG | chr12 | 21591418 | 21591439 | 21591423 | 21591418 | - |
| SEQ ID NO 27901 | ATTTTAAAAGACCTGTCTTCAA | CTA | chr12 | 21591410 | 21591431 | 21591415 | 21591410 | - |
| SEQ ID NO 27902 | TAAAAGACCTGTCTTCAAGTTC | TTT | chr12 | 21591406 | 21591427 | 21591411 | 21591406 | - |
| SEQ ID NO 27903 | AAAAGACCTGTCTTCAAGTTCT | TTT | chr12 | 21591405 | 21591426 | 21591410 | 21591405 | - |
| SEQ ID NO 27904 | AAAGACCTGTCTTCAAGTTCTG | TTA | chr12 | 21591404 | 21591425 | 21591409 | 21591404 | - |
| SEQ ID NO 27905 | TCTTCAAGTTCTGAAATTTTTC | CTG | chr12 | 21591395 | 21591416 | 21591400 | 21591395 | - |
| SEQ ID NO 27906 | CAAGTTCTGAAATTTTCTTCT | CTT | chr12 | 21591391 | 21591412 | 21591396 | 21591391 | - |
| SEQ ID NO 27907 | AAGTTCTGAAATTTTCTTCTG | TTC | chr12 | 21591390 | 21591411 | 21591395 | 21591390 | - |

Figure 48 (Cont'd)

| SEQ ID NO | Sequence | | | | | | | |
|---|---|---|---|---|---|---|---|---|
| SEQ ID NO 27908 | TGAAATTTTTCTTCTGCTTGAT | TTC | chr12 | 21591384 | 21591405 | 21591389 | 21591384 | - |
| SEQ ID NO 27909 | AAATTTTTCTTCTGCTTGATCT | CTG | chr12 | 21591382 | 21591403 | 21591387 | 21591382 | - |
| SEQ ID NO 27910 | TTCTTCTGCTTGATCTGATCTA | TTT | chr12 | 21591376 | 21591397 | 21591381 | 21591376 | - |
| SEQ ID NO 27911 | TCTTCTGCTTGATCTGATCTAT | TTT | chr12 | 21591375 | 21591396 | 21591380 | 21591375 | - |
| SEQ ID NO 27912 | CTTCTGCTTGATCTGATCTATT | TTT | chr12 | 21591374 | 21591395 | 21591379 | 21591374 | - |
| SEQ ID NO 27913 | TTCTGCTTGATCTGATCTATTG | TTC | chr12 | 21591373 | 21591394 | 21591378 | 21591373 | - |
| SEQ ID NO 27914 | CTGCTTGATCTGATCTATTGTT | CTT | chr12 | 21591371 | 21591392 | 21591376 | 21591371 | - |
| SEQ ID NO 27915 | TGCTTGATCTGATCTATTGTTG | TTC | chr12 | 21591370 | 21591391 | 21591375 | 21591370 | - |
| SEQ ID NO 27916 | CTTGATCTGATCTATTGTTGAA | CTG | chr12 | 21591368 | 21591389 | 21591373 | 21591368 | - |
| SEQ ID NO 27917 | GATCTGATCTATTGTTGAAGTT | CTT | chr12 | 21591365 | 21591386 | 21591370 | 21591365 | - |
| SEQ ID NO 27918 | ATCTGATCTATTGTTGAAGTTT | TTG | chr12 | 21591364 | 21591385 | 21591369 | 21591364 | - |
| SEQ ID NO 27919 | ATCTATTGTTGAAGTTTTTGAA | CTG | chr12 | 21591359 | 21591380 | 21591364 | 21591359 | - |
| SEQ ID NO 27920 | TTGTTGAAGTTTTTGAATGTAT | CTA | chr12 | 21591354 | 21591375 | 21591359 | 21591354 | - |
| SEQ ID NO 27921 | TTGAAGTTTTTGAATGTATTTT | TTG | chr12 | 21591351 | 21591372 | 21591356 | 21591351 | - |
| SEQ ID NO 27922 | AAGTTTTTGAATGTATTTTGTA | TTG | chr12 | 21591348 | 21591369 | 21591353 | 21591348 | - |
| SEQ ID NO 27923 | TTGAATGTATTTTGTATTTCTT | TTT | chr12 | 21591342 | 21591363 | 21591347 | 21591342 | - |
| SEQ ID NO 27924 | TGAATGTATTTTGTATTTCTTT | TTT | chr12 | 21591341 | 21591362 | 21591346 | 21591341 | - |
| SEQ ID NO 27925 | GAATGTATTTTGTATTTCTTTC | TTT | chr12 | 21591340 | 21591361 | 21591345 | 21591340 | - |
| SEQ ID NO 27926 | AATGTATTTTGTATTTCTTTCA | TTG | chr12 | 21591339 | 21591360 | 21591344 | 21591339 | - |
| SEQ ID NO 27927 | TGTATTTCTTTCAATAAACTCT | TTT | chr12 | 21591330 | 21591351 | 21591335 | 21591330 | - |
| SEQ ID NO 27928 | GTATTTCTTTCAATAAACTCTT | TTT | chr12 | 21591329 | 21591350 | 21591334 | 21591329 | - |
| SEQ ID NO 27929 | TATTTCTTTCAATAAACTCTTC | TTG | chr12 | 21591328 | 21591349 | 21591333 | 21591328 | - |
| SEQ ID NO 27930 | CTTTCAATAAACTCTTCAGTTA | TTT | chr12 | 21591323 | 21591344 | 21591328 | 21591323 | - |
| SEQ ID NO 27931 | TTTCAATAAACTCTTCAGTTAC | TTC | chr12 | 21591322 | 21591343 | 21591327 | 21591322 | - |
| SEQ ID NO 27932 | TCAATAAACTCTTCAGTTACAG | CTT | chr12 | 21591320 | 21591341 | 21591325 | 21591320 | - |
| SEQ ID NO 27933 | CAATAAACTCTTCAGTTACAGA | TTT | chr12 | 21591319 | 21591340 | 21591324 | 21591319 | - |
| SEQ ID NO 27934 | AATAAACTCTTCAGTTACAGAA | TTC | chr12 | 21591318 | 21591339 | 21591323 | 21591318 | - |
| SEQ ID NO 27935 | TTCAGTTACAGAATTTCTGTTT | CTC | chr12 | 21591309 | 21591330 | 21591314 | 21591309 | - |
| SEQ ID NO 27936 | CAGTTACAGAATTTCTGTTTGG | CTT | chr12 | 21591307 | 21591328 | 21591312 | 21591307 | - |
| SEQ ID NO 27937 | AGTTACAGAATTTCTGTTTGGT | TTC | chr12 | 21591306 | 21591327 | 21591311 | 21591306 | - |
| SEQ ID NO 27938 | CAGAATTTCTGTTTGGTTCATT | TTA | chr12 | 21591301 | 21591322 | 21591306 | 21591301 | - |
| SEQ ID NO 27939 | CTGTTTGGTTCATTCTTGTTGT | TTT | chr12 | 21591293 | 21591314 | 21591298 | 21591293 | - |
| SEQ ID NO 27940 | TGTTTGGTTCATTCTTGTTGTA | TTC | chr12 | 21591292 | 21591313 | 21591297 | 21591292 | - |
| SEQ ID NO 27941 | TTTGGTTCATTCTTGTTGTATC | CTG | chr12 | 21591290 | 21591311 | 21591295 | 21591290 | - |
| SEQ ID NO 27942 | GGTTCATTCTTGTTGTATCTAT | TTT | chr12 | 21591287 | 21591308 | 21591292 | 21591287 | - |
| SEQ ID NO 27943 | GTTCATTCTTGTTGTATCTATC | TTG | chr12 | 21591286 | 21591307 | 21591291 | 21591286 | - |
| SEQ ID NO 27944 | ATTCTTGTTGTATCTATCTCTT | TTC | chr12 | 21591282 | 21591303 | 21591287 | 21591282 | - |
| SEQ ID NO 27945 | TTGTTGTATCTATCTCTTGGGT | TTC | chr12 | 21591278 | 21591299 | 21591283 | 21591278 | - |
| SEQ ID NO 27946 | GTTGTATCTATCTCTTGGGTAA | CTT | chr12 | 21591276 | 21591297 | 21591281 | 21591276 | - |
| SEQ ID NO 27947 | TTGTATCTATCTCTTGGGTAAA | TTG | chr12 | 21591275 | 21591296 | 21591280 | 21591275 | - |
| SEQ ID NO 27948 | TATCTATCTCTTGGGTAAATTT | TTG | chr12 | 21591272 | 21591293 | 21591277 | 21591272 | - |
| SEQ ID NO 27949 | TCTCTTGGGTAAATTTCTCATT | CTA | chr12 | 21591266 | 21591287 | 21591271 | 21591266 | - |
| SEQ ID NO 27950 | TTGGGTAAATTTCTCATTCATA | CTC | chr12 | 21591262 | 21591283 | 21591267 | 21591262 | - |
| SEQ ID NO 27951 | GGGTAAATTTCTCATTCATATC | CTT | chr12 | 21591260 | 21591281 | 21591265 | 21591260 | - |
| SEQ ID NO 27952 | GGTAAATTTCTCATTCATATCC | TTG | chr12 | 21591259 | 21591280 | 21591264 | 21591259 | - |
| SEQ ID NO 27953 | CTCATTCATATCCTGAATTGTT | TTT | chr12 | 21591250 | 21591271 | 21591255 | 21591250 | - |
| SEQ ID NO 27954 | TCATTCATATCCTGAATTGTTT | TTC | chr12 | 21591249 | 21591270 | 21591254 | 21591249 | - |
| SEQ ID NO 27955 | ATTCATATCCTGAATTGTTTTT | CTC | chr12 | 21591247 | 21591268 | 21591252 | 21591247 | - |
| SEQ ID NO 27956 | ATATCCTGAATTGTTTTCTGA | TTC | chr12 | 21591243 | 21591264 | 21591248 | 21591243 | - |
| SEQ ID NO 27957 | AATTGTTTTTCTGATTTCTTTT | CTG | chr12 | 21591235 | 21591256 | 21591240 | 21591235 | - |
| SEQ ID NO 27958 | TTTTTCTGATTTCTTTTATTG | TTG | chr12 | 21591230 | 21591251 | 21591235 | 21591230 | - |
| SEQ ID NO 27959 | TTCTGATTTCTTTTATTGTTT | TTT | chr12 | 21591227 | 21591248 | 21591232 | 21591227 | - |
| SEQ ID NO 27960 | TCTGATTTCTTTTATTGTTTA | TTT | chr12 | 21591226 | 21591247 | 21591231 | 21591226 | - |
| SEQ ID NO 27961 | CTGATTTCTTTTATTGTTTAT | TTT | chr12 | 21591225 | 21591246 | 21591230 | 21591225 | - |
| SEQ ID NO 27962 | TGATTTCTTTTATTGTTTATC | TTC | chr12 | 21591224 | 21591245 | 21591229 | 21591224 | - |
| SEQ ID NO 27963 | ATTTCTTTTATTGTTTATCTG | CTG | chr12 | 21591222 | 21591243 | 21591227 | 21591222 | - |
| SEQ ID NO 27964 | CTTTTATTGTTTATCTGAGTT | TTT | chr12 | 21591218 | 21591239 | 21591223 | 21591218 | - |
| SEQ ID NO 27965 | TTTTATTGTTTATCTGAGTTC | TTC | chr12 | 21591217 | 21591238 | 21591222 | 21591217 | - |

Figure 48 (Cont'd)

| | | | | | | | | |
|---|---|---|---|---|---|---|---|---|
| SEQ ID NO 27966 | TTTATTGTTTATCTGAGTTCTC | CTT | chr12 | 21591215 | 21591236 | 21591220 | 21591215 | - |
| SEQ ID NO 27967 | TTATTGTTTATCTGAGTTCTCT | TTT | chr12 | 21591214 | 21591235 | 21591219 | 21591214 | - |
| SEQ ID NO 27968 | TATTGTTTATCTGAGTTCTCTT | TTT | chr12 | 21591213 | 21591234 | 21591218 | 21591213 | - |
| SEQ ID NO 27969 | ATTGTTTATCTGAGTTCTCTTG | TTT | chr12 | 21591212 | 21591233 | 21591217 | 21591212 | - |
| SEQ ID NO 27970 | TTGTTTATCTGAGTTCTCTTGT | TTA | chr12 | 21591211 | 21591232 | 21591216 | 21591211 | - |
| SEQ ID NO 27971 | TTTATCTGAGTTCTCTTGTGTC | TTG | chr12 | 21591208 | 21591229 | 21591213 | 21591208 | - |
| SEQ ID NO 27972 | ATCTGAGTTCTCTTGTGTCTCA | TTT | chr12 | 21591205 | 21591226 | 21591210 | 21591205 | - |
| SEQ ID NO 27973 | TCTGAGTTCTCTTGTGTCTCAC | TTA | chr12 | 21591204 | 21591225 | 21591209 | 21591204 | - |
| SEQ ID NO 27974 | AGTTCTCTTGTGTCTCACTGAG | CTG | chr12 | 21591200 | 21591221 | 21591205 | 21591200 | - |
| SEQ ID NO 27975 | TCTTGTGTCTCACTGAGCTTCC | TTC | chr12 | 21591195 | 21591216 | 21591200 | 21591195 | - |
| SEQ ID NO 27976 | TTGTGTCTCACTGAGCTTCCTT | CTC | chr12 | 21591193 | 21591214 | 21591198 | 21591193 | - |
| SEQ ID NO 27977 | GTGTCTCACTGAGCTTCCTTAA | CTT | chr12 | 21591191 | 21591212 | 21591196 | 21591191 | - |
| SEQ ID NO 27978 | TGTCTCACTGAGCTTCCTTAAT | TTG | chr12 | 21591190 | 21591211 | 21591195 | 21591190 | - |
| SEQ ID NO 27979 | ACTGAGCTTCCTTAATATCAAC | CTC | chr12 | 21591184 | 21591205 | 21591189 | 21591184 | - |
| SEQ ID NO 27980 | AGCTTCCTTAATATCAACATTT | CTG | chr12 | 21591180 | 21591201 | 21591185 | 21591180 | - |
| SEQ ID NO 27981 | CCTTAATATCAACATTTTGGAT | CTT | chr12 | 21591175 | 21591196 | 21591180 | 21591175 | - |
| SEQ ID NO 27982 | CTTAATATCAACATTTTGGATT | TTC | chr12 | 21591174 | 21591195 | 21591179 | 21591174 | - |
| SEQ ID NO 27983 | AATATCAACATTTTGGATTCTT | CTT | chr12 | 21591171 | 21591192 | 21591176 | 21591171 | - |
| SEQ ID NO 27984 | ATATCAACATTTTGGATTCTTT | TTA | chr12 | 21591170 | 21591191 | 21591175 | 21591170 | - |
| SEQ ID NO 27985 | TGGATTCTTTTTTCCAGAATTT | TTT | chr12 | 21591158 | 21591179 | 21591163 | 21591158 | - |
| SEQ ID NO 27986 | GGATTCTTTTTTCCAGAATTTT | TTT | chr12 | 21591157 | 21591178 | 21591162 | 21591157 | - |
| SEQ ID NO 27987 | GATTCTTTTTTCCAGAATTTTA | TTG | chr12 | 21591156 | 21591177 | 21591161 | 21591156 | - |
| SEQ ID NO 27988 | TTTTTTCCAGAATTTTATAAAT | TTC | chr12 | 21591151 | 21591172 | 21591156 | 21591151 | - |
| SEQ ID NO 27989 | TTTTCCAGAATTTTATAAATGT | CTT | chr12 | 21591149 | 21591170 | 21591154 | 21591149 | - |
| SEQ ID NO 27990 | TTTCCAGAATTTTATAAATGTC | TTT | chr12 | 21591148 | 21591169 | 21591153 | 21591148 | - |
| SEQ ID NO 27991 | TTCCAGAATTTTATAAATGTCT | TTT | chr12 | 21591147 | 21591168 | 21591152 | 21591147 | - |
| SEQ ID NO 27992 | TCCAGAATTTTATAAATGTCTT | TTT | chr12 | 21591146 | 21591167 | 21591151 | 21591146 | - |
| SEQ ID NO 27993 | CCAGAATTTTATAAATGTCTTT | TTT | chr12 | 21591145 | 21591166 | 21591150 | 21591145 | - |
| SEQ ID NO 27994 | CAGAATTTTATAAATGTCTTTT | TTC | chr12 | 21591144 | 21591165 | 21591149 | 21591144 | - |
| SEQ ID NO 27995 | TATAAATGTCTTTTTTTTCCAC | TTT | chr12 | 21591136 | 21591157 | 21591141 | 21591136 | - |
| SEQ ID NO 27996 | ATAAATGTCTTTTTTTTCCACT | TTT | chr12 | 21591135 | 21591156 | 21591140 | 21591135 | - |
| SEQ ID NO 27997 | TAAATGTCTTTTTTTTCCACTG | TTA | chr12 | 21591134 | 21591155 | 21591139 | 21591134 | - |
| SEQ ID NO 27998 | TTTTTTCCACTGGCTTATGTTG | CTT | chr12 | 21591124 | 21591145 | 21591129 | 21591124 | - |
| SEQ ID NO 27999 | TTTTTCCACTGGCTTATGTTGC | TTT | chr12 | 21591123 | 21591144 | 21591128 | 21591123 | - |
| SEQ ID NO 28000 | TTTTCCACTGGCTTATGTTGCT | TTT | chr12 | 21591122 | 21591143 | 21591127 | 21591122 | - |
| SEQ ID NO 28001 | TTTCCACTGGCTTATGTTGCTG | TTT | chr12 | 21591121 | 21591142 | 21591126 | 21591121 | - |
| SEQ ID NO 28002 | TTCCACTGGCTTATGTTGCTGA | TTT | chr12 | 21591120 | 21591141 | 21591125 | 21591120 | - |
| SEQ ID NO 28003 | TCCACTGGCTTATGTTGCTGAA | TTT | chr12 | 21591119 | 21591140 | 21591124 | 21591119 | - |
| SEQ ID NO 28004 | CCACTGGCTTATGTTGCTGAAG | TTT | chr12 | 21591118 | 21591139 | 21591123 | 21591118 | - |
| SEQ ID NO 28005 | CACTGGCTTATGTTGCTGAAGA | TTC | chr12 | 21591117 | 21591138 | 21591122 | 21591117 | - |
| SEQ ID NO 28006 | GCTTATGTTGCTGAAGAATTAT | CTG | chr12 | 21591112 | 21591133 | 21591117 | 21591112 | - |
| SEQ ID NO 28007 | ATGTTGCTGAAGAATTATTAAA | CTT | chr12 | 21591108 | 21591129 | 21591113 | 21591108 | - |
| SEQ ID NO 28008 | TGTTGCTGAAGAATTATTAAAT | TTA | chr12 | 21591107 | 21591128 | 21591112 | 21591107 | - |
| SEQ ID NO 28009 | CTGAAGAATTATTAAATTCCTT | TTG | chr12 | 21591102 | 21591123 | 21591107 | 21591102 | - |
| SEQ ID NO 28010 | AAGAATTATTAAATTCCTTTGG | CTG | chr12 | 21591099 | 21591120 | 21591104 | 21591099 | - |
| SEQ ID NO 28011 | TTAAATTCCTTTGGAAGTGTCA | TTA | chr12 | 21591091 | 21591112 | 21591096 | 21591091 | - |
| SEQ ID NO 28012 | AATTCCTTTGGAAGTGTCATAT | TTA | chr12 | 21591088 | 21591109 | 21591093 | 21591088 | - |
| SEQ ID NO 28013 | CTTTGGAAGTGTCATATTTCTT | TTC | chr12 | 21591083 | 21591104 | 21591088 | 21591083 | - |
| SEQ ID NO 28014 | TGGAAGTGTCATATTTCTTCAC | CTT | chr12 | 21591080 | 21591101 | 21591085 | 21591080 | - |
| SEQ ID NO 28015 | GGAAGTGTCATATTTCTTCACC | TTT | chr12 | 21591079 | 21591100 | 21591084 | 21591079 | - |
| SEQ ID NO 28016 | GAAGTGTCATATTTCTTCACCT | TTG | chr12 | 21591078 | 21591099 | 21591083 | 21591078 | - |
| SEQ ID NO 28017 | CTTCACCTTTTATGTTTATTT | TTT | chr12 | 21591064 | 21591085 | 21591069 | 21591064 | - |
| SEQ ID NO 28018 | TTCACCTTTTATGTTTATTTT | TTC | chr12 | 21591063 | 21591084 | 21591068 | 21591063 | - |
| SEQ ID NO 28019 | CACCTTTTATGTTTATTTTGT | CTT | chr12 | 21591061 | 21591082 | 21591066 | 21591061 | - |
| SEQ ID NO 28020 | ACCTTTTATGTTTATTTTGTT | TTC | chr12 | 21591060 | 21591081 | 21591065 | 21591060 | - |
| SEQ ID NO 28021 | TTTATGTTTATTTTGTTCTTGC | CTT | chr12 | 21591055 | 21591076 | 21591060 | 21591055 | - |
| SEQ ID NO 28022 | TTATGTTTATTTTGTTCTTGCA | TTT | chr12 | 21591054 | 21591075 | 21591059 | 21591054 | - |
| SEQ ID NO 28023 | TATGTTTATTTTGTTCTTGCAT | TTT | chr12 | 21591053 | 21591074 | 21591058 | 21591053 | - |

Figure 48 (Cont'd)

| | | | | | | | | |
|---|---|---|---|---|---|---|---|---|
| SEQ ID NO 28024 | ATGTTTATTTTGTTCTTGCATT | TTT | chr12 | 21591052 | 21591073 | 21591057 | 21591052 | - |
| SEQ ID NO 28025 | TGTTTATTTTGTTCTTGCATTG | TTA | chr12 | 21591051 | 21591072 | 21591056 | 21591051 | - |
| SEQ ID NO 28026 | ATTTTGTTCTTGCATTGATATC | TTT | chr12 | 21591046 | 21591067 | 21591051 | 21591046 | - |
| SEQ ID NO 28027 | TTTTGTTCTTGCATTGATATCT | TTA | chr12 | 21591045 | 21591066 | 21591050 | 21591045 | - |
| SEQ ID NO 28028 | TGTTCTTGCATTGATATCTCTG | TTT | chr12 | 21591042 | 21591063 | 21591047 | 21591042 | - |
| SEQ ID NO 28029 | GTTCTTGCATTGATATCTCTGC | TTT | chr12 | 21591041 | 21591062 | 21591046 | 21591041 | - |
| SEQ ID NO 28030 | TTCTTGCATTGATATCTCTGCA | TTG | chr12 | 21591040 | 21591061 | 21591045 | 21591040 | - |
| SEQ ID NO 28031 | TTGCATTGATATCTCTGCATCT | TTC | chr12 | 21591037 | 21591058 | 21591042 | 21591037 | - |
| SEQ ID NO 28032 | GCATTGATATCTCTGCATCTGG | CTT | chr12 | 21591035 | 21591056 | 21591040 | 21591035 | - |
| SEQ ID NO 28033 | CATTGATATCTCTGCATCTGGT | TTG | chr12 | 21591034 | 21591055 | 21591039 | 21591034 | - |
| SEQ ID NO 28034 | ATATCTCTGCATCTGGTGTAAT | TTG | chr12 | 21591029 | 21591050 | 21591034 | 21591029 | - |
| SEQ ID NO 28035 | TGCATCTGGTGTAATGATTGCT | CTC | chr12 | 21591022 | 21591043 | 21591027 | 21591022 | - |
| SEQ ID NO 28036 | CATCTGGTGTAATGATTGCTGC | CTG | chr12 | 21591020 | 21591041 | 21591025 | 21591020 | - |
| SEQ ID NO 28037 | GTGTAATGATTGCTGCTTCCAG | CTG | chr12 | 21591014 | 21591035 | 21591019 | 21591014 | - |
| SEQ ID NO 28038 | CTGCTTCCAGTTTTGTAAATTT | TTG | chr12 | 21591002 | 21591023 | 21591007 | 21591002 | - |
| SEQ ID NO 28039 | CTTCCAGTTTTGTAAATTTGTT | CTG | chr12 | 21590999 | 21591020 | 21591004 | 21590999 | - |
| SEQ ID NO 28040 | CCAGTTTTGTAAATTTGTTTTT | CTT | chr12 | 21590996 | 21591017 | 21591001 | 21590996 | - |
| SEQ ID NO 28041 | CAGTTTTGTAAATTTGTTTTTG | TTC | chr12 | 21590995 | 21591016 | 21591000 | 21590995 | - |
| SEQ ID NO 28042 | TGTAAATTTGTTTTTGTAGGGG | TTT | chr12 | 21590989 | 21591010 | 21590994 | 21590989 | - |
| SEQ ID NO 28043 | GTAAATTTGTTTTTGTAGGGGA | TTT | chr12 | 21590988 | 21591009 | 21590993 | 21590988 | - |
| SEQ ID NO 28044 | TAAATTTGTTTTTGTAGGGGAA | TTG | chr12 | 21590987 | 21591008 | 21590992 | 21590987 | - |
| SEQ ID NO 28045 | GTTTTTGTAGGGGAAGACTTTT | TTT | chr12 | 21590980 | 21591001 | 21590985 | 21590980 | - |
| SEQ ID NO 28046 | TTTTTGTAGGGGAAGACTTTTT | TTG | chr12 | 21590979 | 21591000 | 21590984 | 21590979 | - |
| SEQ ID NO 28047 | TTGTAGGGGAAGACTTTTTTCT | TTT | chr12 | 21590976 | 21590997 | 21590981 | 21590976 | - |
| SEQ ID NO 28048 | TGTAGGGGAAGACTTTTTTCTG | TTT | chr12 | 21590975 | 21590996 | 21590980 | 21590975 | - |
| SEQ ID NO 28049 | GTAGGGGAAGACTTTTTTCTGA | TTT | chr12 | 21590974 | 21590995 | 21590979 | 21590974 | - |
| SEQ ID NO 28050 | TAGGGGAAGACTTTTTTCTGAA | TTG | chr12 | 21590973 | 21590994 | 21590978 | 21590973 | - |
| SEQ ID NO 28051 | TTTTCTGAAGATGTATCTTGGT | CTT | chr12 | 21590960 | 21590981 | 21590965 | 21590960 | - |
| SEQ ID NO 28052 | TTTCTGAAGATGTATCTTGGTG | TTT | chr12 | 21590959 | 21590980 | 21590964 | 21590959 | - |
| SEQ ID NO 28053 | TTCTGAAGATGTATCTTGGTGT | TTT | chr12 | 21590958 | 21590979 | 21590963 | 21590958 | - |
| SEQ ID NO 28054 | TCTGAAGATGTATCTTGGTGTT | TTT | chr12 | 21590957 | 21590978 | 21590962 | 21590957 | - |
| SEQ ID NO 28055 | CTGAAGATGTATCTTGGTGTTG | TTT | chr12 | 21590956 | 21590977 | 21590961 | 21590956 | - |
| SEQ ID NO 28056 | TGAAGATGTATCTTGGTGTTGA | TTC | chr12 | 21590955 | 21590976 | 21590960 | 21590955 | - |
| SEQ ID NO 28057 | AAGATGTATCTTGGTGTTGATT | CTG | chr12 | 21590953 | 21590974 | 21590958 | 21590953 | - |
| SEQ ID NO 28058 | GGTGTTGATTGAGTAGGGCACT | CTT | chr12 | 21590941 | 21590962 | 21590946 | 21590941 | - |
| SEQ ID NO 28059 | GTGTTGATTGAGTAGGGCACTT | TTG | chr12 | 21590940 | 21590961 | 21590945 | 21590940 | - |
| SEQ ID NO 28060 | ATTGAGTAGGGCACTTTGATTT | TTG | chr12 | 21590934 | 21590955 | 21590939 | 21590934 | - |
| SEQ ID NO 28061 | AGTAGGGCACTTTGATTTTGAT | TTG | chr12 | 21590930 | 21590951 | 21590935 | 21590930 | - |
| SEQ ID NO 28062 | TGATTTTGATTTCTAGGTGCAT | CTT | chr12 | 21590918 | 21590939 | 21590923 | 21590918 | - |
| SEQ ID NO 28063 | GATTTTGATTTCTAGGTGCATA | TTT | chr12 | 21590917 | 21590938 | 21590922 | 21590917 | - |
| SEQ ID NO 28064 | ATTTTGATTTCTAGGTGCATAC | TTG | chr12 | 21590916 | 21590937 | 21590921 | 21590916 | - |
| SEQ ID NO 28065 | TGATTTCTAGGTGCATACAGCA | TTT | chr12 | 21590912 | 21590933 | 21590917 | 21590912 | - |
| SEQ ID NO 28066 | GATTTCTAGGTGCATACAGCAG | TTT | chr12 | 21590911 | 21590932 | 21590916 | 21590911 | - |
| SEQ ID NO 28067 | ATTTCTAGGTGCATACAGCAGC | TTG | chr12 | 21590910 | 21590931 | 21590915 | 21590910 | - |
| SEQ ID NO 28068 | CTAGGTGCATACAGCAGCATAG | TTT | chr12 | 21590906 | 21590927 | 21590911 | 21590906 | - |
| SEQ ID NO 28069 | TAGGTGCATACAGCAGCATAGT | TTC | chr12 | 21590905 | 21590926 | 21590910 | 21590905 | - |
| SEQ ID NO 28070 | GGTGCATACAGCAGCATAGTCT | CTA | chr12 | 21590903 | 21590924 | 21590908 | 21590903 | - |
| SEQ ID NO 28071 | CATATTATTTTTTTCAGCTGC | CTT | chr12 | 21590880 | 21590901 | 21590885 | 21590880 | - |
| SEQ ID NO 28072 | ATATTATTTTTTTCAGCTGCC | TTC | chr12 | 21590879 | 21590900 | 21590884 | 21590879 | - |
| SEQ ID NO 28073 | TTTTTTTCAGCTGCCAACAGT | TTA | chr12 | 21590873 | 21590894 | 21590878 | 21590873 | - |
| SEQ ID NO 28074 | TTTTTCAGCTGCCAACAGTATC | TTT | chr12 | 21590870 | 21590891 | 21590875 | 21590870 | - |
| SEQ ID NO 28075 | TTTTCAGCTGCCAACAGTATCA | TTT | chr12 | 21590869 | 21590890 | 21590874 | 21590869 | - |
| SEQ ID NO 28076 | TTTCAGCTGCCAACAGTATCAT | TTT | chr12 | 21590868 | 21590889 | 21590873 | 21590868 | - |
| SEQ ID NO 28077 | TTCAGCTGCCAACAGTATCATC | TTT | chr12 | 21590867 | 21590888 | 21590872 | 21590867 | - |
| SEQ ID NO 28078 | TCAGCTGCCAACAGTATCATCA | TTT | chr12 | 21590866 | 21590887 | 21590871 | 21590866 | - |
| SEQ ID NO 28079 | CAGCTGCCAACAGTATCATCAG | TTT | chr12 | 21590865 | 21590886 | 21590870 | 21590865 | - |
| SEQ ID NO 28080 | AGCTGCCAACAGTATCATCAGT | TTC | chr12 | 21590864 | 21590885 | 21590869 | 21590864 | - |
| SEQ ID NO 28081 | CCAACAGTATCATCAGTGTCTG | CTG | chr12 | 21590859 | 21590880 | 21590864 | 21590859 | - |

Figure 48 (Cont'd)

| | | | | | | | | |
|---|---|---|---|---|---|---|---|---|
| SEQ ID NO 28082 | TGATTTTTTCAGTGGCTTAGGG | CTG | chr12 | 21590837 | 21590858 | 21590842 | 21590837 | - |
| SEQ ID NO 28083 | TTTCAGTGGCTTAGGGTGCATT | TTT | chr12 | 21590831 | 21590852 | 21590836 | 21590831 | - |
| SEQ ID NO 28084 | TTCAGTGGCTTAGGGTGCATTT | TTT | chr12 | 21590830 | 21590851 | 21590835 | 21590830 | - |
| SEQ ID NO 28085 | TCAGTGGCTTAGGGTGCATTTG | TTT | chr12 | 21590829 | 21590850 | 21590834 | 21590829 | - |
| SEQ ID NO 28086 | CAGTGGCTTAGGGTGCATTTGT | TTT | chr12 | 21590828 | 21590849 | 21590833 | 21590828 | - |
| SEQ ID NO 28087 | AGTGGCTTAGGGTGCATTTGTT | TTC | chr12 | 21590827 | 21590848 | 21590832 | 21590827 | - |
| SEQ ID NO 28088 | AGGGTGCATTTGTTAGTGAAGG | CTT | chr12 | 21590819 | 21590840 | 21590824 | 21590819 | - |
| SEQ ID NO 28089 | GGGTGCATTTGTTAGTGAAGGT | TTA | chr12 | 21590818 | 21590839 | 21590823 | 21590818 | - |
| SEQ ID NO 28090 | GTTAGTGAAGGTGGTGATGAGG | TTT | chr12 | 21590808 | 21590829 | 21590813 | 21590808 | - |
| SEQ ID NO 28091 | TTAGTGAAGGTGGTGATGAGGT | TTG | chr12 | 21590807 | 21590828 | 21590812 | 21590807 | - |
| SEQ ID NO 28092 | GTGAAGGTGGTGATGAGGTTGT | TTA | chr12 | 21590804 | 21590825 | 21590809 | 21590804 | - |
| SEQ ID NO 28093 | TGCTGGAGACAAGAATATCAAG | TTG | chr12 | 21590783 | 21590804 | 21590788 | 21590783 | - |
| SEQ ID NO 28094 | GAGACAAGAATATCAAGTGGGC | CTG | chr12 | 21590778 | 21590799 | 21590783 | 21590778 | - |
| SEQ ID NO 28095 | GGCCCAGTGGTGGTGGTGGGC | CTT | chr12 | 21590748 | 21590769 | 21590753 | 21590748 | - |
| SEQ ID NO 28096 | GCCCCAGTGGTGGTGGTGGGCC | TTG | chr12 | 21590747 | 21590768 | 21590752 | 21590747 | - |
| SEQ ID NO 28097 | GCATTCCTGTCCTTGGGCCCCA | CTA | chr12 | 21590723 | 21590744 | 21590728 | 21590723 | - |
| SEQ ID NO 28098 | CTGTCCTTGGGCCCCATGGCTG | TTC | chr12 | 21590717 | 21590738 | 21590722 | 21590717 | - |
| SEQ ID NO 28099 | TCCTTGGGCCCCATGGCTGTGT | CTG | chr12 | 21590714 | 21590735 | 21590719 | 21590714 | - |
| SEQ ID NO 28100 | GGGCCCCATGGCTGTGTACATT | CTT | chr12 | 21590709 | 21590730 | 21590714 | 21590709 | - |
| SEQ ID NO 28101 | GGCCCCATGGCTGTGTACATTG | TTG | chr12 | 21590708 | 21590729 | 21590713 | 21590708 | - |
| SEQ ID NO 28102 | TGTACATTGGCACTGATGGTAA | CTG | chr12 | 21590695 | 21590716 | 21590700 | 21590695 | - |
| SEQ ID NO 28103 | GCACTGATGGTAATGAGTCTAG | TTG | chr12 | 21590686 | 21590707 | 21590691 | 21590686 | - |
| SEQ ID NO 28104 | ATGGTAATGAGTCTAGTTGGGT | CTG | chr12 | 21590680 | 21590701 | 21590685 | 21590680 | - |
| SEQ ID NO 28105 | GTTGGGTTGATTCTTTGGCCTT | CTA | chr12 | 21590665 | 21590686 | 21590670 | 21590665 | - |
| SEQ ID NO 28106 | GGTTGATTCTTTGGCCTTCAGG | TTG | chr12 | 21590661 | 21590682 | 21590666 | 21590661 | - |
| SEQ ID NO 28107 | ATTCTTTGGCCTTCAGGCAGTT | TTG | chr12 | 21590656 | 21590677 | 21590661 | 21590656 | - |
| SEQ ID NO 28108 | TTTGGCCTTCAGGCAGTTTGCT | TTC | chr12 | 21590652 | 21590673 | 21590657 | 21590652 | - |
| SEQ ID NO 28109 | TGGCCTTCAGGCAGTTTGCTTG | CTT | chr12 | 21590650 | 21590671 | 21590655 | 21590650 | - |
| SEQ ID NO 28110 | GGCCTTCAGGCAGTTTGCTTGG | TTT | chr12 | 21590649 | 21590670 | 21590654 | 21590649 | - |
| SEQ ID NO 28111 | GCCTTCAGGCAGTTTGCTTGGG | TTG | chr12 | 21590648 | 21590669 | 21590653 | 21590648 | - |
| SEQ ID NO 28112 | CAGGCAGTTTGCTTGGGTGTCA | CTT | chr12 | 21590643 | 21590664 | 21590648 | 21590643 | - |
| SEQ ID NO 28113 | AGGCAGTTTGCTTGGGTGTCAG | TTC | chr12 | 21590642 | 21590663 | 21590647 | 21590642 | - |
| SEQ ID NO 28114 | GCTTGGGTGTCAGTAGTGGCCA | TTT | chr12 | 21590633 | 21590654 | 21590638 | 21590633 | - |
| SEQ ID NO 28115 | CTTGGGTGTCAGTAGTGGCCAT | TTG | chr12 | 21590632 | 21590653 | 21590637 | 21590632 | - |
| SEQ ID NO 28116 | GGGTGTCAGTAGTGGCCATAGT | CTT | chr12 | 21590629 | 21590650 | 21590634 | 21590629 | - |
| SEQ ID NO 28117 | GGTGTCAGTAGTGGCCATAGTA | TTG | chr12 | 21590628 | 21590649 | 21590633 | 21590628 | - |
| SEQ ID NO 28118 | GGCTGGTGTGTGGGTCCTCAGG | CTG | chr12 | 21590601 | 21590622 | 21590606 | 21590601 | - |
| SEQ ID NO 28119 | GTGTGTGGGTCCTCAGGCTTCT | CTG | chr12 | 21590596 | 21590617 | 21590601 | 21590596 | - |
| SEQ ID NO 28120 | AGGCTTCTGGACAGTGGGTGTG | CTC | chr12 | 21590582 | 21590603 | 21590587 | 21590582 | - |
| SEQ ID NO 28121 | CTGGACAGTGGGTGTGGTGTGG | CTT | chr12 | 21590576 | 21590597 | 21590581 | 21590576 | - |
| SEQ ID NO 28122 | TGGACAGTGGGTGTGGTGTGGG | TTC | chr12 | 21590575 | 21590596 | 21590580 | 21590575 | - |
| SEQ ID NO 28123 | GACAGTGGGTGTGGTGTGGGTG | CTG | chr12 | 21590573 | 21590594 | 21590578 | 21590573 | - |
| SEQ ID NO 28124 | TAGCAACTGCAGGACAACCCTC | CTG | chr12 | 21590544 | 21590565 | 21590549 | 21590544 | - |
| SEQ ID NO 28125 | CAGGACAACCCTCTGGCTCCCA | CTG | chr12 | 21590535 | 21590556 | 21590540 | 21590535 | - |
| SEQ ID NO 28126 | TGGCTCCCAAGCAGTCTGCACT | CTC | chr12 | 21590522 | 21590543 | 21590527 | 21590522 | - |
| SEQ ID NO 28127 | GCTCCCAAGCAGTCTGCACTGG | CTG | chr12 | 21590520 | 21590541 | 21590525 | 21590520 | - |
| SEQ ID NO 28128 | CCAAGCAGTCTGCACTGGTGTT | CTC | chr12 | 21590516 | 21590537 | 21590521 | 21590516 | - |
| SEQ ID NO 28129 | CACTGGTGTTGGTGGTGGCTGC | CTG | chr12 | 21590504 | 21590525 | 21590509 | 21590504 | - |
| SEQ ID NO 28130 | GTGTTGGTGGTGGCTGCAAGGG | CTG | chr12 | 21590499 | 21590520 | 21590504 | 21590499 | - |
| SEQ ID NO 28131 | GTGGTGGCTGCAAGGGCTGAAT | TTG | chr12 | 21590493 | 21590514 | 21590498 | 21590493 | - |
| SEQ ID NO 28132 | CAAGGGCTGAATGAGCCAGTCT | CTG | chr12 | 21590483 | 21590504 | 21590488 | 21590483 | - |
| SEQ ID NO 28133 | AATGAGCCAGTCTTCAGACCCA | CTG | chr12 | 21590474 | 21590495 | 21590479 | 21590474 | - |
| SEQ ID NO 28134 | CAGACCCACAGGTGGCACATGC | CTT | chr12 | 21590460 | 21590481 | 21590465 | 21590460 | - |
| SEQ ID NO 28135 | AGACCCACAGGTGGCACATGCA | TTC | chr12 | 21590459 | 21590480 | 21590464 | 21590459 | - |
| SEQ ID NO 28136 | TGATGGCAGTGGCAGATTGGGT | TTG | chr12 | 21590423 | 21590444 | 21590428 | 21590423 | - |
| SEQ ID NO 28137 | GGTAGGCCCATCATCAGGCTTC | TTG | chr12 | 21590404 | 21590425 | 21590409 | 21590404 | - |
| SEQ ID NO 28138 | CTGGGAGGGTTGCTTAGGTACC | CTT | chr12 | 21590383 | 21590404 | 21590388 | 21590383 | - |
| SEQ ID NO 28139 | TGGGAGGGTTGCTTAGGTACCA | TTC | chr12 | 21590382 | 21590403 | 21590387 | 21590382 | - |

Figure 48 (Cont'd)

| | | | | | | | | |
|---|---|---|---|---|---|---|---|---|
| SEQ ID NO 28140 | GGAGGGTTGCTTAGGTACCAGT | CTG | chr12 | 21590380 | 21590401 | 21590385 | 21590380 | - |
| SEQ ID NO 28141 | CTTAGGTACCAGTCATGGTGGA | TTG | chr12 | 21590371 | 21590392 | 21590376 | 21590371 | - |
| SEQ ID NO 28142 | AGGTACCAGTCATGGTGGATGG | CTT | chr12 | 21590368 | 21590389 | 21590373 | 21590368 | - |
| SEQ ID NO 28143 | GGTACCAGTCATGGTGGATGGC | TTA | chr12 | 21590367 | 21590388 | 21590372 | 21590367 | - |
| SEQ ID NO 28144 | TCTCTGGGTTCCCAGACAACTT | CTG | chr12 | 21590336 | 21590357 | 21590341 | 21590336 | - |
| SEQ ID NO 28145 | TGGGTTCCCAGACAACTTGCTT | CTC | chr12 | 21590332 | 21590353 | 21590337 | 21590332 | - |
| SEQ ID NO 28146 | GGTTCCCAGACAACTTGCTTAG | CTG | chr12 | 21590330 | 21590351 | 21590335 | 21590330 | - |
| SEQ ID NO 28147 | CCAGACAACTTGCTTAGGCATT | TTC | chr12 | 21590325 | 21590346 | 21590330 | 21590325 | - |
| SEQ ID NO 28148 | GCTTAGGCATTGAGGAAGGCAA | CTT | chr12 | 21590314 | 21590335 | 21590319 | 21590314 | - |
| SEQ ID NO 28149 | CTTAGGCATTGAGGAAGGCAAA | TTG | chr12 | 21590313 | 21590334 | 21590318 | 21590313 | - |
| SEQ ID NO 28150 | AGGCATTGAGGAAGGCAAAGCC | CTT | chr12 | 21590310 | 21590331 | 21590315 | 21590310 | - |
| SEQ ID NO 28151 | GGCATTGAGGAAGGCAAAGCCA | TTA | chr12 | 21590309 | 21590330 | 21590314 | 21590309 | - |
| SEQ ID NO 28152 | AGGAAGGCAAAGCCAGGCTGGG | TTG | chr12 | 21590302 | 21590323 | 21590307 | 21590302 | - |
| SEQ ID NO 28153 | GGTGTTCCTGACCTCAGGCCAC | CTG | chr12 | 21590282 | 21590303 | 21590287 | 21590282 | - |
| SEQ ID NO 28154 | CTGACCTCAGGCCACTCAGTGG | TTC | chr12 | 21590275 | 21590296 | 21590280 | 21590275 | - |
| SEQ ID NO 28155 | ACCTCAGGCCACTCAGTGGTGT | CTG | chr12 | 21590272 | 21590293 | 21590277 | 21590272 | - |
| SEQ ID NO 28156 | AGGCCACTCAGTGGTGTGTGTG | CTC | chr12 | 21590267 | 21590288 | 21590272 | 21590267 | - |
| SEQ ID NO 28157 | AGTGGTGTGTGTGGACACCGGC | CTC | chr12 | 21590258 | 21590279 | 21590263 | 21590258 | - |
| SEQ ID NO 28158 | TCATAGGCTGGAGTGGAGTGAT | CTA | chr12 | 21590234 | 21590255 | 21590239 | 21590234 | - |
| SEQ ID NO 28159 | GAGTGGAGTGATCCTCAGGCCC | CTG | chr12 | 21590224 | 21590245 | 21590229 | 21590224 | - |
| SEQ ID NO 28160 | AGGCCCCAGCAGAATGCCTGA | CTC | chr12 | 21590208 | 21590229 | 21590213 | 21590208 | - |
| SEQ ID NO 28161 | AGTGAATTAGCAGCTACTGCAT | CTG | chr12 | 21590187 | 21590208 | 21590192 | 21590187 | - |
| SEQ ID NO 28162 | GCAGCTACTGCATTGTTGCCCT | TTA | chr12 | 21590178 | 21590199 | 21590183 | 21590178 | - |
| SEQ ID NO 28163 | CTGCATTGTTGCCCTGCTCTTG | CTA | chr12 | 21590171 | 21590192 | 21590176 | 21590171 | - |
| SEQ ID NO 28164 | CATTGTTGCCCTGCTCTTGAAG | CTG | chr12 | 21590168 | 21590189 | 21590173 | 21590168 | - |
| SEQ ID NO 28165 | TTGCCCTGCTCTTGAAGGGGTG | TTG | chr12 | 21590163 | 21590184 | 21590168 | 21590163 | - |
| SEQ ID NO 28166 | CCCTGCTCTTGAAGGGGTGCGG | TTG | chr12 | 21590160 | 21590181 | 21590165 | 21590160 | - |
| SEQ ID NO 28167 | CTCTTGAAGGGGTGCGGGGTGT | CTG | chr12 | 21590155 | 21590176 | 21590160 | 21590155 | - |
| SEQ ID NO 28168 | TTGAAGGGGTGCGGGGTGTGTT | CTC | chr12 | 21590152 | 21590173 | 21590157 | 21590152 | - |
| SEQ ID NO 28169 | GAAGGGGTGCGGGGTGTGTTGC | CTT | chr12 | 21590150 | 21590171 | 21590155 | 21590150 | - |
| SEQ ID NO 28170 | AAGGGGTGCGGGGTGTGTTGCT | TTG | chr12 | 21590149 | 21590170 | 21590154 | 21590149 | - |
| SEQ ID NO 28171 | CTTTCAGTGGCAGCAGCTATAA | TTG | chr12 | 21590129 | 21590150 | 21590134 | 21590129 | - |
| SEQ ID NO 28172 | TCAGTGGCAGCAGCTATAAATG | CTT | chr12 | 21590126 | 21590147 | 21590131 | 21590126 | - |
| SEQ ID NO 28173 | CAGTGGCAGCAGCTATAAATGG | TTT | chr12 | 21590125 | 21590146 | 21590130 | 21590125 | - |
| SEQ ID NO 28174 | AGTGGCAGCAGCTATAAATGGG | TTC | chr12 | 21590124 | 21590145 | 21590129 | 21590124 | - |
| SEQ ID NO 28175 | TAAATGGGTTGCTGGTGGGCAT | CTA | chr12 | 21590110 | 21590131 | 21590115 | 21590110 | - |
| SEQ ID NO 28176 | CTGGTGGGCATGTGTTTCAGCC | TTG | chr12 | 21590099 | 21590120 | 21590104 | 21590099 | - |
| SEQ ID NO 28177 | GTGGGCATGTGTTTCAGCCCCA | CTG | chr12 | 21590096 | 21590117 | 21590101 | 21590096 | - |
| SEQ ID NO 28178 | CAGCCCCAGATGGTGGCTGCAA | TTT | chr12 | 21590082 | 21590103 | 21590087 | 21590082 | - |
| SEQ ID NO 28179 | AGCCCCAGATGGTGGCTGCAAG | TTC | chr12 | 21590081 | 21590102 | 21590086 | 21590081 | - |
| SEQ ID NO 28180 | CAAGTGGGGTAGCATTTTCTTA | CTG | chr12 | 21590063 | 21590084 | 21590068 | 21590063 | - |
| SEQ ID NO 28181 | TCTTAGGGAGCTTATAAATGTG | TTT | chr12 | 21590046 | 21590067 | 21590051 | 21590046 | - |
| SEQ ID NO 28182 | CTTAGGGAGCTTATAAATGTGT | TTT | chr12 | 21590045 | 21590066 | 21590050 | 21590045 | - |
| SEQ ID NO 28183 | TTAGGGAGCTTATAAATGTGTA | TTC | chr12 | 21590044 | 21590065 | 21590049 | 21590044 | - |
| SEQ ID NO 28184 | AGGGAGCTTATAAATGTGTAGC | CTT | chr12 | 21590042 | 21590063 | 21590047 | 21590042 | - |
| SEQ ID NO 28185 | GGGAGCTTATAAATGTGTAGCA | TTA | chr12 | 21590041 | 21590062 | 21590046 | 21590041 | - |
| SEQ ID NO 28186 | ATAAATGTGTAGCAGCCCTGCT | CTT | chr12 | 21590033 | 21590054 | 21590038 | 21590033 | - |
| SEQ ID NO 28187 | TAAATGTGTAGCAGCCCTGCTA | TTA | chr12 | 21590032 | 21590053 | 21590037 | 21590032 | - |
| SEQ ID NO 28188 | CTACTGGGGGTGGGGGAGTCCA | CTG | chr12 | 21590013 | 21590034 | 21590018 | 21590013 | - |
| SEQ ID NO 28189 | CTGGGGGTGGGGGAGTCCACTT | CTA | chr12 | 21590010 | 21590031 | 21590015 | 21590010 | - |
| SEQ ID NO 28190 | GGGGTGGGGGAGTCCACTTCTA | CTG | chr12 | 21590007 | 21590028 | 21590012 | 21590007 | - |
| SEQ ID NO 28191 | CTAATGACACACTTTATCCCTG | CTT | chr12 | 21589988 | 21590009 | 21589993 | 21589988 | - |
| SEQ ID NO 28192 | TAATGACACACTTTATCCCTGG | TTC | chr12 | 21589987 | 21590008 | 21589992 | 21589987 | - |
| SEQ ID NO 28193 | ATGACACACTTTATCCCTGGTG | CTA | chr12 | 21589985 | 21590006 | 21589990 | 21589985 | - |
| SEQ ID NO 28194 | TATCCCTGGTGACAGCAGCCAG | CTT | chr12 | 21589974 | 21589995 | 21589979 | 21589974 | - |
| SEQ ID NO 28195 | ATCCCTGGTGACAGCAGCCAGC | TTT | chr12 | 21589973 | 21589994 | 21589978 | 21589973 | - |
| SEQ ID NO 28196 | TCCCTGGTGACAGCAGCCAGCA | TTA | chr12 | 21589972 | 21589993 | 21589977 | 21589972 | - |
| SEQ ID NO 28197 | GTGACAGCAGCCAGCAGTAGCA | CTG | chr12 | 21589966 | 21589987 | 21589971 | 21589966 | - |

Figure 48 (Cont'd)

| SEQ ID NO 28198 | AGCTGTGGGTGGGGGATGTCAG | CTC | chr12 | 21589941 | 21589962 | 21589946 | 21589941 | - |
|---|---|---|---|---|---|---|---|---|
| SEQ ID NO 28199 | TGGGTGGGGATGTCAGCAGAG | CTG | chr12 | 21589936 | 21589957 | 21589941 | 21589936 | - |
| SEQ ID NO 28200 | CAGGGATGTAGAGATGCAGATG | CTT | chr12 | 21589911 | 21589932 | 21589916 | 21589911 | - |
| SEQ ID NO 28201 | AGGGATGTAGAGATGCAGATGA | TTC | chr12 | 21589910 | 21589931 | 21589915 | 21589910 | - |
| SEQ ID NO 28202 | GGGTCTGAGGAACGATGTCATC | TTG | chr12 | 21589883 | 21589904 | 21589888 | 21589883 | - |
| SEQ ID NO 28203 | AGGAACGATGTCATCTGGTGGG | CTG | chr12 | 21589876 | 21589897 | 21589881 | 21589876 | - |
| SEQ ID NO 28204 | GTGGGTGTTGGGCTCTCAAAAT | CTG | chr12 | 21589859 | 21589880 | 21589864 | 21589859 | - |
| SEQ ID NO 28205 | GGCTCTCAAAATGGCACCTTGC | TTG | chr12 | 21589849 | 21589870 | 21589854 | 21589849 | - |
| SEQ ID NO 28206 | TCAAAATGGCACCTTGCTGCTC | CTC | chr12 | 21589844 | 21589865 | 21589849 | 21589844 | - |
| SEQ ID NO 28207 | AAAATGGCACCTTGCTGCTCAG | CTC | chr12 | 21589842 | 21589863 | 21589847 | 21589842 | - |
| SEQ ID NO 28208 | GCTGCTCAGTAATGGGGATGGC | CTT | chr12 | 21589829 | 21589850 | 21589834 | 21589829 | - |
| SEQ ID NO 28209 | CTGCTCAGTAATGGGGATGGCA | TTG | chr12 | 21589828 | 21589849 | 21589833 | 21589828 | - |
| SEQ ID NO 28210 | CTCAGTAATGGGGATGGCAGGG | CTG | chr12 | 21589825 | 21589846 | 21589830 | 21589825 | - |
| SEQ ID NO 28211 | AGTAATGGGGATGGCAGGGGTG | CTC | chr12 | 21589822 | 21589843 | 21589827 | 21589822 | - |
| SEQ ID NO 28212 | CTTCTCTGGAGCAATGCCTTTG | CTC | chr12 | 21589783 | 21589804 | 21589788 | 21589783 | - |
| SEQ ID NO 28213 | CTCTGGAGCAATGCCTTTGTGC | CTT | chr12 | 21589780 | 21589801 | 21589785 | 21589780 | - |
| SEQ ID NO 28214 | TCTGGAGCAATGCCTTTGTGCG | TTC | chr12 | 21589779 | 21589800 | 21589784 | 21589779 | - |
| SEQ ID NO 28215 | TGGAGCAATGCCTTTGTGCGAT | CTC | chr12 | 21589777 | 21589798 | 21589782 | 21589777 | - |
| SEQ ID NO 28216 | GAGCAATGCCTTTGTGCGATTG | CTG | chr12 | 21589775 | 21589796 | 21589780 | 21589775 | - |
| SEQ ID NO 28217 | TGTGCGATTGCTGGGCAGTTCC | CTT | chr12 | 21589763 | 21589784 | 21589768 | 21589763 | - |
| SEQ ID NO 28218 | GTGCGATTGCTGGGCAGTTCCT | TTT | chr12 | 21589762 | 21589783 | 21589767 | 21589762 | - |
| SEQ ID NO 28219 | TGCGATTGCTGGGCAGTTCCTT | TTG | chr12 | 21589761 | 21589782 | 21589766 | 21589761 | - |
| SEQ ID NO 28220 | CTGGGCAGTTCCTTATGATAGT | TTG | chr12 | 21589753 | 21589774 | 21589758 | 21589753 | - |
| SEQ ID NO 28221 | GGCAGTTCCTTATGATAGTCTC | CTG | chr12 | 21589750 | 21589771 | 21589755 | 21589750 | - |
| SEQ ID NO 28222 | CTTATGATAGTCTCAAGGCCTG | TTC | chr12 | 21589742 | 21589763 | 21589747 | 21589742 | - |
| SEQ ID NO 28223 | ATGATAGTCTCAAGGCCTGCAT | CTT | chr12 | 21589739 | 21589760 | 21589744 | 21589739 | - |
| SEQ ID NO 28224 | TGATAGTCTCAAGGCCTGCATG | TTA | chr12 | 21589738 | 21589759 | 21589743 | 21589738 | - |
| SEQ ID NO 28225 | AAGGCCTGCATGGTCAAGGGAC | CTC | chr12 | 21589728 | 21589749 | 21589733 | 21589728 | - |
| SEQ ID NO 28226 | CATGGTCAAGGGACTCTCCTGT | CTG | chr12 | 21589720 | 21589741 | 21589725 | 21589720 | - |
| SEQ ID NO 28227 | TCCTGTGGCTAGGATTCCTGGA | CTC | chr12 | 21589704 | 21589725 | 21589709 | 21589704 | - |
| SEQ ID NO 28228 | CTGTGGCTAGGATTCCTGGAGT | CTC | chr12 | 21589702 | 21589723 | 21589707 | 21589702 | - |
| SEQ ID NO 28229 | TGGCTAGGATTCCTGGAGTCCA | CTG | chr12 | 21589699 | 21589720 | 21589704 | 21589699 | - |
| SEQ ID NO 28230 | GGATTCCTGGAGTCCATAATGC | CTA | chr12 | 21589693 | 21589714 | 21589698 | 21589693 | - |
| SEQ ID NO 28231 | CTGGAGTCCATAATGCAGATGT | TTC | chr12 | 21589687 | 21589708 | 21589692 | 21589687 | - |
| SEQ ID NO 28232 | GAGTCCATAATGCAGATGTGGA | CTG | chr12 | 21589684 | 21589705 | 21589689 | 21589684 | - |
| SEQ ID NO 28233 | GGAGTCAGTCACTTAACTTTCG | CTG | chr12 | 21589656 | 21589677 | 21589661 | 21589656 | - |
| SEQ ID NO 28234 | AACTTTCGATGCACTGGGGAGC | CTT | chr12 | 21589642 | 21589663 | 21589647 | 21589642 | - |
| SEQ ID NO 28235 | ACTTTCGATGCACTGGGGAGCC | TTA | chr12 | 21589641 | 21589662 | 21589646 | 21589641 | - |
| SEQ ID NO 28236 | TCGATGCACTGGGGAGCCTCTC | CTT | chr12 | 21589637 | 21589658 | 21589642 | 21589637 | - |
| SEQ ID NO 28237 | CGATGCACTGGGGAGCCTCTCT | TTT | chr12 | 21589636 | 21589657 | 21589641 | 21589636 | - |
| SEQ ID NO 28238 | GATGCACTGGGGAGCCTCTCTG | TTC | chr12 | 21589635 | 21589656 | 21589640 | 21589635 | - |
| SEQ ID NO 28239 | GGGAGCCTCTCTGGCCTCACAG | CTG | chr12 | 21589626 | 21589647 | 21589631 | 21589626 | - |
| SEQ ID NO 28240 | TCTGGCCTCACAGAGGATCCCT | CTC | chr12 | 21589617 | 21589638 | 21589622 | 21589617 | - |
| SEQ ID NO 28241 | TGGCCTCACAGAGGATCCCTAC | CTC | chr12 | 21589615 | 21589636 | 21589620 | 21589615 | - |
| SEQ ID NO 28242 | GCCTCACAGAGGATCCCTACTG | CTG | chr12 | 21589613 | 21589634 | 21589618 | 21589613 | - |
| SEQ ID NO 28243 | ACAGAGGATCCCTACTGGGTAG | CTC | chr12 | 21589608 | 21589629 | 21589613 | 21589608 | - |
| SEQ ID NO 28244 | CTGGGTAGGCTTCCTTGCTTCC | CTA | chr12 | 21589594 | 21589615 | 21589599 | 21589594 | - |
| SEQ ID NO 28245 | GGTAGGCTTCCTTGCTTCCCTC | CTG | chr12 | 21589591 | 21589612 | 21589596 | 21589591 | - |
| SEQ ID NO 28246 | CCTTGCTTCCCTCCCCTTCATT | CTT | chr12 | 21589582 | 21589603 | 21589587 | 21589582 | - |
| SEQ ID NO 28247 | CTTGCTTCCCTCCCCTTCATTG | TTC | chr12 | 21589581 | 21589602 | 21589586 | 21589581 | - |
| SEQ ID NO 28248 | GCTTCCCTCCCCTTCATTGCCT | CTT | chr12 | 21589578 | 21589599 | 21589583 | 21589578 | - |
| SEQ ID NO 28249 | CTTCCCTCCCCTTCATTGCCTT | TTG | chr12 | 21589577 | 21589598 | 21589582 | 21589577 | - |
| SEQ ID NO 28250 | CCCTCCCCTTCATTGCCTTAGA | CTT | chr12 | 21589574 | 21589595 | 21589579 | 21589574 | - |
| SEQ ID NO 28251 | CCTCCCCTTCATTGCCTTAGAT | TTC | chr12 | 21589573 | 21589594 | 21589578 | 21589573 | - |
| SEQ ID NO 28252 | CCCTTCATTGCCTTAGATGCTT | CTC | chr12 | 21589569 | 21589590 | 21589574 | 21589569 | - |
| SEQ ID NO 28253 | CATTGCCTTAGATGCTTCCTGT | CTT | chr12 | 21589564 | 21589585 | 21589569 | 21589564 | - |
| SEQ ID NO 28254 | ATTGCCTTAGATGCTTCCTGTC | TTC | chr12 | 21589563 | 21589584 | 21589568 | 21589563 | - |
| SEQ ID NO 28255 | CCTTAGATGCTTCCTGTCACTT | TTG | chr12 | 21589559 | 21589580 | 21589564 | 21589559 | - |

Figure 48 (Cont'd)

| | | | | | | | | |
|---|---|---|---|---|---|---|---|---|
| SEQ ID NO 28256 | AGATGCTTCCTGTCACTTCTCT | CTT | chr12 | 21589555 | 21589576 | 21589560 | 21589555 | - |
| SEQ ID NO 28257 | GATGCTTCCTGTCACTTCTCTG | TTA | chr12 | 21589554 | 21589575 | 21589559 | 21589554 | - |
| SEQ ID NO 28258 | CCTGTCACTTCTCTGTTGAATT | CTT | chr12 | 21589547 | 21589568 | 21589552 | 21589547 | - |
| SEQ ID NO 28259 | CTGTCACTTCTCTGTTGAATTC | TTC | chr12 | 21589546 | 21589567 | 21589551 | 21589546 | - |
| SEQ ID NO 28260 | TCACTTCTCTGTTGAATTCCAG | CTG | chr12 | 21589543 | 21589564 | 21589548 | 21589543 | - |
| SEQ ID NO 28261 | CTCTGTTGAATTCCAGAATTCT | CTT | chr12 | 21589537 | 21589558 | 21589542 | 21589537 | - |
| SEQ ID NO 28262 | TCTGTTGAATTCCAGAATTCTC | TTC | chr12 | 21589536 | 21589557 | 21589541 | 21589536 | - |
| SEQ ID NO 28263 | TGTTGAATTCCAGAATTCTCTC | CTC | chr12 | 21589534 | 21589555 | 21589539 | 21589534 | - |
| SEQ ID NO 28264 | TTGAATTCCAGAATTCTCTCTT | CTG | chr12 | 21589532 | 21589553 | 21589537 | 21589532 | - |
| SEQ ID NO 28265 | AATTCCAGAATTCTCTCTTATG | TTG | chr12 | 21589529 | 21589550 | 21589534 | 21589529 | - |
| SEQ ID NO 28266 | CAGAATTCTCTCTTATGTGGGA | TTC | chr12 | 21589524 | 21589545 | 21589529 | 21589524 | - |
| SEQ ID NO 28267 | TCTCTTATGTGGGATTTTCTAC | TTC | chr12 | 21589516 | 21589537 | 21589521 | 21589516 | - |
| SEQ ID NO 28268 | TCTTATGTGGGATTTTCTACTT | CTC | chr12 | 21589514 | 21589535 | 21589519 | 21589514 | - |
| SEQ ID NO 28269 | TTATGTGGGATTTTCTACTTAC | CTC | chr12 | 21589512 | 21589533 | 21589517 | 21589512 | - |
| SEQ ID NO 28270 | ATGTGGGATTTTCTACTTACTA | CTT | chr12 | 21589510 | 21589531 | 21589515 | 21589510 | - |
| SEQ ID NO 28271 | TGTGGGATTTTCTACTTACTAT | TTA | chr12 | 21589509 | 21589530 | 21589514 | 21589509 | - |
| SEQ ID NO 28272 | TCTACTTACTATTTTGGTTCTT | TTT | chr12 | 21589499 | 21589520 | 21589504 | 21589499 | - |
| SEQ ID NO 28273 | CTACTTACTATTTTGGTTCTTT | TTT | chr12 | 21589498 | 21589519 | 21589503 | 21589498 | - |
| SEQ ID NO 28274 | TACTTACTATTTTGGTTCTTTG | TTC | chr12 | 21589497 | 21589518 | 21589502 | 21589497 | - |
| SEQ ID NO 28275 | CTTACTATTTTGGTTCTTTGTG | CTA | chr12 | 21589495 | 21589516 | 21589500 | 21589495 | - |
| SEQ ID NO 28276 | ACTATTTTGGTTCTTTGTGGAG | CTT | chr12 | 21589492 | 21589513 | 21589497 | 21589492 | - |
| SEQ ID NO 28277 | CTATTTTGGTTCTTTGTGGAGG | TTA | chr12 | 21589491 | 21589512 | 21589496 | 21589491 | - |
| SEQ ID NO 28278 | TTTTGGTTCTTTGTGGAGGAGG | CTA | chr12 | 21589488 | 21589509 | 21589493 | 21589488 | - |
| SEQ ID NO 28279 | TGGTTCTTTGTGGAGGAGGTGA | TTT | chr12 | 21589485 | 21589506 | 21589490 | 21589485 | - |
| SEQ ID NO 28280 | GGTTCTTTGTGGAGGAGGTGAG | TTT | chr12 | 21589484 | 21589505 | 21589489 | 21589484 | - |
| SEQ ID NO 28281 | GTTCTTTGTGGAGGAGGTGAGT | TTG | chr12 | 21589483 | 21589504 | 21589488 | 21589483 | - |
| SEQ ID NO 28282 | TTTGTGGAGGAGGTGAGTGTCA | TTC | chr12 | 21589479 | 21589500 | 21589484 | 21589479 | - |
| SEQ ID NO 28283 | TGTGGAGGAGGTGAGTGTCAGC | CTT | chr12 | 21589477 | 21589498 | 21589482 | 21589477 | - |
| SEQ ID NO 28284 | GTGGAGGAGGTGAGTGTCAGCT | TTT | chr12 | 21589476 | 21589497 | 21589481 | 21589476 | - |
| SEQ ID NO 28285 | TGGAGGAGGTGAGTGTCAGCTG | TTG | chr12 | 21589475 | 21589496 | 21589480 | 21589475 | - |
| SEQ ID NO 28286 | CCCTTAGTCAGTAATCTTCAAG | CTG | chr12 | 21589453 | 21589474 | 21589458 | 21589453 | - |
| SEQ ID NO 28287 | AGTCAGTAATCTTCAAGCCCCT | CTT | chr12 | 21589448 | 21589469 | 21589453 | 21589448 | - |
| SEQ ID NO 28288 | GTCAGTAATCTTCAAGCCCCTT | TTA | chr12 | 21589447 | 21589468 | 21589452 | 21589447 | - |
| SEQ ID NO 28289 | CAAGCCCCTTCCCTTGAAATTT | CTT | chr12 | 21589435 | 21589456 | 21589440 | 21589435 | - |
| SEQ ID NO 28290 | AAGCCCCTTCCCTTGAAATTTT | TTC | chr12 | 21589434 | 21589455 | 21589439 | 21589434 | - |
| SEQ ID NO 28291 | CCCTTGAAATTTTTTAAGCTTT | CTT | chr12 | 21589425 | 21589446 | 21589430 | 21589425 | - |
| SEQ ID NO 28292 | CCTTGAAATTTTTTAAGCTTTA | TTC | chr12 | 21589424 | 21589445 | 21589429 | 21589424 | - |
| SEQ ID NO 28293 | GAAATTTTTTAAGCTTTATGTT | CTT | chr12 | 21589420 | 21589441 | 21589425 | 21589420 | - |
| SEQ ID NO 28294 | AAATTTTTTAAGCTTTATGTTT | TTG | chr12 | 21589419 | 21589440 | 21589424 | 21589419 | - |
| SEQ ID NO 28295 | TTTAAGCTTTATGTTTTTATTT | TTT | chr12 | 21589413 | 21589434 | 21589418 | 21589413 | - |
| SEQ ID NO 28296 | TTAAGCTTTATGTTTTTATTTC | TTT | chr12 | 21589412 | 21589433 | 21589417 | 21589412 | - |
| SEQ ID NO 28297 | TAAGCTTTATGTTTTTATTTCT | TTT | chr12 | 21589411 | 21589432 | 21589416 | 21589411 | - |
| SEQ ID NO 28298 | AAGCTTTATGTTTTTATTTCTA | TTT | chr12 | 21589410 | 21589431 | 21589415 | 21589410 | - |
| SEQ ID NO 28299 | AGCTTTATGTTTTTATTTCTAA | TTA | chr12 | 21589409 | 21589430 | 21589414 | 21589409 | - |
| SEQ ID NO 28300 | TATGTTTTTATTTCTAATAGAC | CTT | chr12 | 21589404 | 21589425 | 21589409 | 21589404 | - |
| SEQ ID NO 28301 | ATGTTTTTATTTCTAATAGACT | TTT | chr12 | 21589403 | 21589424 | 21589408 | 21589403 | - |
| SEQ ID NO 28302 | TGTTTTTATTTCTAATAGACTG | TTA | chr12 | 21589402 | 21589423 | 21589407 | 21589402 | - |
| SEQ ID NO 28303 | TTATTTCTAATAGACTGAAAGA | TTT | chr12 | 21589397 | 21589418 | 21589402 | 21589397 | - |
| SEQ ID NO 28304 | TATTTCTAATAGACTGAAAGAG | TTT | chr12 | 21589396 | 21589417 | 21589401 | 21589396 | - |
| SEQ ID NO 28305 | ATTTCTAATAGACTGAAAGAGC | TTT | chr12 | 21589395 | 21589416 | 21589400 | 21589395 | - |
| SEQ ID NO 28306 | TTTCTAATAGACTGAAAGAGCA | TTA | chr12 | 21589394 | 21589415 | 21589399 | 21589394 | - |
| SEQ ID NO 28307 | CTAATAGACTGAAAGAGCATAA | TTT | chr12 | 21589391 | 21589412 | 21589396 | 21589391 | - |
| SEQ ID NO 28308 | TAATAGACTGAAAGAGCATAAT | TTC | chr12 | 21589390 | 21589411 | 21589395 | 21589390 | - |
| SEQ ID NO 28309 | ATAGACTGAAAGAGCATAATCA | CTA | chr12 | 21589388 | 21589409 | 21589393 | 21589388 | - |
| SEQ ID NO 28310 | AAAGAGCATAATCATATTTTAA | CTG | chr12 | 21589380 | 21589401 | 21589385 | 21589380 | - |
| SEQ ID NO 28311 | TAAACACTCTAAGGCTATATGG | TTT | chr12 | 21589361 | 21589382 | 21589366 | 21589361 | - |
| SEQ ID NO 28312 | AAACACTCTAAGGCTATATGGG | TTT | chr12 | 21589360 | 21589381 | 21589365 | 21589360 | - |
| SEQ ID NO 28313 | AACACTCTAAGGCTATATGGGG | TTA | chr12 | 21589359 | 21589380 | 21589364 | 21589359 | - |

Figure 48 (Cont'd)

| SEQ ID NO | Sequence | Code | Chr | Pos1 | Pos2 | Pos3 | Pos4 | - |
|---|---|---|---|---|---|---|---|---|
| SEQ ID NO 28314 | TAAGGCTATATGGGGGACTATC | CTC | chr12 | 21589352 | 21589373 | 21589357 | 21589352 | - |
| SEQ ID NO 28315 | AGGCTATATGGGGGACTATCTG | CTA | chr12 | 21589350 | 21589371 | 21589355 | 21589350 | - |
| SEQ ID NO 28316 | TATGGGGGACTATCTGAAGGCC | CTA | chr12 | 21589344 | 21589365 | 21589349 | 21589344 | - |
| SEQ ID NO 28317 | TCTGAAGGCCTCAGATGAGTAA | CTA | chr12 | 21589332 | 21589353 | 21589337 | 21589332 | - |
| SEQ ID NO 28318 | AAGGCCTCAGATGAGTAAAAGA | CTG | chr12 | 21589328 | 21589349 | 21589333 | 21589328 | - |
| SEQ ID NO 28319 | AGATGAGTAAAAGAAGTAGCGA | CTC | chr12 | 21589320 | 21589341 | 21589325 | 21589320 | - |
| SEQ ID NO 28320 | GTTAACTATGTTTTCTTTTCA | TTA | chr12 | 21589294 | 21589315 | 21589299 | 21589294 | - |
| SEQ ID NO 28321 | ACTATGTTTTCTTTTCATTTC | TTA | chr12 | 21589290 | 21589311 | 21589295 | 21589290 | - |
| SEQ ID NO 28322 | TGTTTTTCTTTTCATTTCATTT | CTA | chr12 | 21589286 | 21589307 | 21589291 | 21589286 | - |
| SEQ ID NO 28323 | TTCTTTTCATTTCATTTCCCAA | TTT | chr12 | 21589281 | 21589302 | 21589286 | 21589281 | - |
| SEQ ID NO 28324 | TCTTTTCATTTCATTTCCCAAA | TTT | chr12 | 21589280 | 21589301 | 21589285 | 21589280 | - |
| SEQ ID NO 28325 | CTTTTCATTTCATTTCCCAAAT | TTT | chr12 | 21589279 | 21589300 | 21589284 | 21589279 | - |
| SEQ ID NO 28326 | TTTTCATTTCATTTCCCAAATC | TTC | chr12 | 21589278 | 21589299 | 21589283 | 21589278 | - |
| SEQ ID NO 28327 | TTCATTTCATTTCCCAAATCAA | CTT | chr12 | 21589276 | 21589297 | 21589281 | 21589276 | - |
| SEQ ID NO 28328 | TCATTTCATTTCCCAAATCAAA | TTT | chr12 | 21589275 | 21589296 | 21589280 | 21589275 | - |
| SEQ ID NO 28329 | CATTTCATTTCCCAAATCAAAT | TTT | chr12 | 21589274 | 21589295 | 21589279 | 21589274 | - |
| SEQ ID NO 28330 | ATTTCATTTCCCAAATCAAATC | TTC | chr12 | 21589273 | 21589294 | 21589278 | 21589273 | - |
| SEQ ID NO 28331 | CATTTCCCAAATCAAATCATTT | TTT | chr12 | 21589269 | 21589290 | 21589274 | 21589269 | - |
| SEQ ID NO 28332 | ATTTCCCAAATCAAATCATTTG | TTC | chr12 | 21589268 | 21589289 | 21589273 | 21589268 | - |
| SEQ ID NO 28333 | CCCAAATCAAATCATTTGTTTC | TTT | chr12 | 21589264 | 21589285 | 21589269 | 21589264 | - |
| SEQ ID NO 28334 | CCAAATCAAATCATTTGTTTCT | TTC | chr12 | 21589263 | 21589284 | 21589268 | 21589263 | - |
| SEQ ID NO 28335 | GTTTCTTCAAATAAAGAATCTC | TTT | chr12 | 21589247 | 21589268 | 21589252 | 21589247 | - |
| SEQ ID NO 28336 | TTTCTTCAAATAAAGAATCTCT | TTG | chr12 | 21589246 | 21589267 | 21589251 | 21589246 | - |
| SEQ ID NO 28337 | CTTCAAATAAAGAATCTCTATT | TTT | chr12 | 21589243 | 21589264 | 21589248 | 21589243 | - |
| SEQ ID NO 28338 | TTCAAATAAAGAATCTCTATTT | TTC | chr12 | 21589242 | 21589263 | 21589247 | 21589242 | - |
| SEQ ID NO 28339 | CAAATAAAGAATCTCTATTTCC | CTT | chr12 | 21589240 | 21589261 | 21589245 | 21589240 | - |
| SEQ ID NO 28340 | AAATAAAGAATCTCTATTTCCC | TTC | chr12 | 21589239 | 21589260 | 21589244 | 21589239 | - |
| SEQ ID NO 28341 | TATTTCCCCCTTATGTTCTTCA | CTC | chr12 | 21589225 | 21589246 | 21589230 | 21589225 | - |
| SEQ ID NO 28342 | TTTCCCCCTTATGTTCTTCAGC | CTA | chr12 | 21589223 | 21589244 | 21589228 | 21589223 | - |
| SEQ ID NO 28343 | CCCCCTTATGTTCTTCAGCAAA | TTT | chr12 | 21589220 | 21589241 | 21589225 | 21589220 | - |
| SEQ ID NO 28344 | CCCCTTATGTTCTTCAGCAAAT | TTC | chr12 | 21589219 | 21589240 | 21589224 | 21589219 | - |
| SEQ ID NO 28345 | ATGTTCTTCAGCAAATAAAAAT | CTT | chr12 | 21589213 | 21589234 | 21589218 | 21589213 | - |
| SEQ ID NO 28346 | TGTTCTTCAGCAAATAAAAATG | TTA | chr12 | 21589212 | 21589233 | 21589217 | 21589212 | - |
| SEQ ID NO 28347 | TTCAGCAAATAAAAATGTTTGC | TTC | chr12 | 21589207 | 21589228 | 21589212 | 21589207 | - |
| SEQ ID NO 28348 | CAGCAAATAAAAATGTTTGCAT | CTT | chr12 | 21589205 | 21589226 | 21589210 | 21589205 | - |
| SEQ ID NO 28349 | AGCAAATAAAAATGTTTGCATC | TTC | chr12 | 21589204 | 21589225 | 21589209 | 21589204 | - |
| SEQ ID NO 28350 | GCATCTACCAAAGTGTATATGA | TTT | chr12 | 21589187 | 21589208 | 21589192 | 21589187 | - |
| SEQ ID NO 28351 | CATCTACCAAAGTGTATATGAA | TTG | chr12 | 21589186 | 21589207 | 21589191 | 21589186 | - |
| SEQ ID NO 28352 | CCAAAGTGTATATGAATTTGAA | CTA | chr12 | 21589180 | 21589201 | 21589185 | 21589180 | - |
| SEQ ID NO 28353 | GAAATACGTAATCTAACAAACA | TTT | chr12 | 21589161 | 21589182 | 21589166 | 21589161 | - |
| SEQ ID NO 28354 | AAATACGTAATCTAACAAACAA | TTG | chr12 | 21589160 | 21589181 | 21589165 | 21589160 | - |
| SEQ ID NO 28355 | ACAAACAAGGATGTTTTAAGAT | CTA | chr12 | 21589146 | 21589167 | 21589151 | 21589146 | - |
| SEQ ID NO 28356 | TAAGATCTCTGAGTAAGATGCA | TTT | chr12 | 21589130 | 21589151 | 21589135 | 21589130 | - |
| SEQ ID NO 28357 | AAGATCTCTGAGTAAGATGCAT | TTT | chr12 | 21589129 | 21589150 | 21589134 | 21589129 | - |
| SEQ ID NO 28358 | AGATCTCTGAGTAAGATGCATA | TTA | chr12 | 21589128 | 21589149 | 21589133 | 21589128 | - |
| SEQ ID NO 28359 | TGAGTAAGATGCATAGTTGCAA | CTC | chr12 | 21589121 | 21589142 | 21589126 | 21589121 | - |
| SEQ ID NO 28360 | AGTAAGATGCATAGTTGCAAAT | CTG | chr12 | 21589119 | 21589140 | 21589124 | 21589119 | - |
| SEQ ID NO 28361 | CAAATAAAGGAGTTTTCAAGG | TTG | chr12 | 21589102 | 21589123 | 21589107 | 21589102 | - |
| SEQ ID NO 28362 | TCAAGGATAAAAATGTAAATA | TTT | chr12 | 21589086 | 21589107 | 21589091 | 21589086 | - |
| SEQ ID NO 28363 | CAAGGATAAAAATGTAAATAA | TTT | chr12 | 21589085 | 21589106 | 21589090 | 21589085 | - |
| SEQ ID NO 28364 | AAGGATAAAAATGTAAATAAA | TTC | chr12 | 21589084 | 21589105 | 21589089 | 21589084 | - |
| SEQ ID NO 28365 | ATAAATGTGTACCATCAGAAAC | CTA | chr12 | 21589055 | 21589076 | 21589060 | 21589055 | - |
| SEQ ID NO 28366 | ATGGTATATTCTCCTGGAAAAG | CTT | chr12 | 21589031 | 21589052 | 21589036 | 21589031 | - |
| SEQ ID NO 28367 | TGGTATATTCTCCTGGAAAAGA | TTA | chr12 | 21589030 | 21589051 | 21589035 | 21589030 | - |
| SEQ ID NO 28368 | TCCTGGAAAAGATGAAGATGAA | TTC | chr12 | 21589020 | 21589041 | 21589025 | 21589020 | - |
| SEQ ID NO 28369 | CTGGAAAAGATGAAGATGAAGA | CTC | chr12 | 21589018 | 21589039 | 21589023 | 21589018 | - |
| SEQ ID NO 28370 | GAAAAGATGAAGATGAAGAAAA | CTG | chr12 | 21589015 | 21589036 | 21589020 | 21589015 | - |
| SEQ ID NO 28371 | CAGAAGAGGAGAAATTCTTTGG | CTA | chr12 | 21588985 | 21589006 | 21588990 | 21588985 | - |

Figure 48 (Cont'd)

| | | | | | | | | |
|---|---|---|---|---|---|---|---|---|
| SEQ ID NO 28372 | TTTGGAAATTTTGCATTTTTGT | TTC | chr12 | 21588968 | 21588989 | 21588973 | 21588968 | - |
| SEQ ID NO 28373 | TGGAAATTTTGCATTTTTGTGG | CTT | chr12 | 21588966 | 21588987 | 21588971 | 21588966 | - |
| SEQ ID NO 28374 | GGAAATTTTGCATTTTTGTGGA | TTT | chr12 | 21588965 | 21588986 | 21588970 | 21588965 | - |
| SEQ ID NO 28375 | GAAATTTTGCATTTTTGTGGAT | TTG | chr12 | 21588964 | 21588985 | 21588969 | 21588964 | - |
| SEQ ID NO 28376 | TGCATTTTTGTGGATAGTGGTT | TTT | chr12 | 21588957 | 21588978 | 21588962 | 21588957 | - |
| SEQ ID NO 28377 | GCATTTTTGTGGATAGTGGTTT | TTT | chr12 | 21588956 | 21588977 | 21588961 | 21588956 | - |
| SEQ ID NO 28378 | CATTTTTGTGGATAGTGGTTTT | TTG | chr12 | 21588955 | 21588976 | 21588960 | 21588955 | - |
| SEQ ID NO 28379 | TTGTGGATAGTGGTTTTGAAGA | TTT | chr12 | 21588950 | 21588971 | 21588955 | 21588950 | - |
| SEQ ID NO 28380 | TGTGGATAGTGGTTTTGAAGAA | TTT | chr12 | 21588949 | 21588970 | 21588954 | 21588949 | - |
| SEQ ID NO 28381 | GTGGATAGTGGTTTTGAAGAAA | TTT | chr12 | 21588948 | 21588969 | 21588953 | 21588948 | - |
| SEQ ID NO 28382 | TGGATAGTGGTTTTGAAGAAAG | TTG | chr12 | 21588947 | 21588968 | 21588952 | 21588947 | - |
| SEQ ID NO 28383 | TGAAGAAAGCTTAGATATATTT | TTT | chr12 | 21588934 | 21588955 | 21588939 | 21588934 | - |
| SEQ ID NO 28384 | GAAGAAAGCTTAGATATATTTA | TTT | chr12 | 21588933 | 21588954 | 21588938 | 21588933 | - |
| SEQ ID NO 28385 | AAGAAAGCTTAGATATATTTAA | TTG | chr12 | 21588932 | 21588953 | 21588937 | 21588932 | - |
| SEQ ID NO 28386 | AGATATATTTAAATATGTTGCT | CTT | chr12 | 21588922 | 21588943 | 21588927 | 21588922 | - |
| SEQ ID NO 28387 | GATATATTTAAATATGTTGCTA | TTA | chr12 | 21588921 | 21588942 | 21588926 | 21588921 | - |
| SEQ ID NO 28388 | AAATATGTTGCTAAGATGTGAC | TTT | chr12 | 21588912 | 21588933 | 21588917 | 21588912 | - |
| SEQ ID NO 28389 | AATATGTTGCTAAGATGTGACT | TTA | chr12 | 21588911 | 21588932 | 21588916 | 21588911 | - |
| SEQ ID NO 28390 | CTAAGATGTGACTCCCACACTT | TTG | chr12 | 21588902 | 21588923 | 21588907 | 21588902 | - |
| SEQ ID NO 28391 | AGATGTGACTCCCACACTTTAA | CTA | chr12 | 21588899 | 21588920 | 21588904 | 21588899 | - |
| SEQ ID NO 28392 | CCACACTTTAAAGAAAAGTTCT | CTC | chr12 | 21588888 | 21588909 | 21588893 | 21588888 | - |
| SEQ ID NO 28393 | TAAAGAAAAGTTCTTCATTTTA | CTT | chr12 | 21588880 | 21588901 | 21588885 | 21588880 | - |
| SEQ ID NO 28394 | AAAGAAAAGTTCTTCATTTTAG | TTT | chr12 | 21588879 | 21588900 | 21588884 | 21588879 | - |
| SEQ ID NO 28395 | AAGAAAAGTTCTTCATTTTAGT | TTA | chr12 | 21588878 | 21588899 | 21588883 | 21588878 | - |
| SEQ ID NO 28396 | TTCATTTTAGTTGCCCTTGCAA | TTC | chr12 | 21588867 | 21588888 | 21588872 | 21588867 | - |
| SEQ ID NO 28397 | CATTTTAGTTGCCCTTGCAAAT | CTT | chr12 | 21588865 | 21588886 | 21588870 | 21588865 | - |
| SEQ ID NO 28398 | ATTTTAGTTGCCCTTGCAAATT | TTC | chr12 | 21588864 | 21588885 | 21588869 | 21588864 | - |
| SEQ ID NO 28399 | TAGTTGCCCTTGCAAATTGGCT | TTT | chr12 | 21588860 | 21588881 | 21588865 | 21588860 | - |
| SEQ ID NO 28400 | AGTTGCCCTTGCAAATTGGCTA | TTT | chr12 | 21588859 | 21588880 | 21588864 | 21588859 | - |
| SEQ ID NO 28401 | GTTGCCCTTGCAAATTGGCTAA | TTA | chr12 | 21588858 | 21588879 | 21588863 | 21588858 | - |
| SEQ ID NO 28402 | CCCTTGCAAATTGGCTAAGTTT | TTG | chr12 | 21588854 | 21588875 | 21588859 | 21588854 | - |
| SEQ ID NO 28403 | GCAAATTGGCTAAGTTTATTTT | CTT | chr12 | 21588849 | 21588870 | 21588854 | 21588849 | - |
| SEQ ID NO 28404 | CAAATTGGCTAAGTTTATTTTT | TTG | chr12 | 21588848 | 21588869 | 21588853 | 21588848 | - |
| SEQ ID NO 28405 | GCTAAGTTTATTTTTCCTCAAC | TTG | chr12 | 21588841 | 21588862 | 21588846 | 21588841 | - |
| SEQ ID NO 28406 | AGTTTATTTTTCCTCAACAAAT | CTA | chr12 | 21588837 | 21588858 | 21588842 | 21588837 | - |
| SEQ ID NO 28407 | ATTTTTCCTCAACAAATAATTT | TTT | chr12 | 21588832 | 21588853 | 21588837 | 21588832 | - |
| SEQ ID NO 28408 | TTTTTCCTCAACAAATAATTTT | TTA | chr12 | 21588831 | 21588852 | 21588836 | 21588831 | - |
| SEQ ID NO 28409 | TTCCTCAACAAATAATTTTGAT | TTT | chr12 | 21588828 | 21588849 | 21588833 | 21588828 | - |
| SEQ ID NO 28410 | TCCTCAACAAATAATTTTGATG | TTT | chr12 | 21588827 | 21588848 | 21588832 | 21588827 | - |
| SEQ ID NO 28411 | CCTCAACAAATAATTTTGATGG | TTT | chr12 | 21588826 | 21588847 | 21588831 | 21588826 | - |
| SEQ ID NO 28412 | CTCAACAAATAATTTTGATGGT | TTC | chr12 | 21588825 | 21588846 | 21588830 | 21588825 | - |
| SEQ ID NO 28413 | AACAAATAATTTTGATGGTTTC | CTC | chr12 | 21588822 | 21588843 | 21588827 | 21588822 | - |
| SEQ ID NO 28414 | TGATGGTTTCTAAAATTGTCCA | TTT | chr12 | 21588810 | 21588831 | 21588815 | 21588810 | - |
| SEQ ID NO 28415 | GATGGTTTCTAAAATTGTCCAG | TTT | chr12 | 21588809 | 21588830 | 21588814 | 21588809 | - |
| SEQ ID NO 28416 | ATGGTTTCTAAAATTGTCCAGA | TTG | chr12 | 21588808 | 21588829 | 21588813 | 21588808 | - |
| SEQ ID NO 28417 | CTAAAATTGTCCAGAATTTGAG | TTT | chr12 | 21588801 | 21588822 | 21588806 | 21588801 | - |
| SEQ ID NO 28418 | TAAAATTGTCCAGAATTTGAGG | TTC | chr12 | 21588800 | 21588821 | 21588805 | 21588800 | - |
| SEQ ID NO 28419 | AAATTGTCCAGAATTTGAGGAA | CTA | chr12 | 21588798 | 21588819 | 21588803 | 21588798 | - |
| SEQ ID NO 28420 | TCCAGAATTTGAGGAAATACTT | TTG | chr12 | 21588792 | 21588813 | 21588797 | 21588792 | - |
| SEQ ID NO 28421 | GAGGAAATACTTAGATGTAGTA | TTT | chr12 | 21588782 | 21588803 | 21588787 | 21588782 | - |
| SEQ ID NO 28422 | AGGAAATACTTAGATGTAGTAG | TTG | chr12 | 21588781 | 21588802 | 21588786 | 21588781 | - |
| SEQ ID NO 28423 | AGATGTAGTAGATGACATCAAT | CTT | chr12 | 21588770 | 21588791 | 21588775 | 21588770 | - |
| SEQ ID NO 28424 | GATGTAGTAGATGACATCAATT | TTA | chr12 | 21588769 | 21588790 | 21588774 | 21588769 | - |
| SEQ ID NO 28425 | ATGTTAACTTAGATTTATTGTT | TTT | chr12 | 21588746 | 21588767 | 21588751 | 21588746 | - |
| SEQ ID NO 28426 | TGTTAACTTAGATTTATTGTTG | TTA | chr12 | 21588745 | 21588766 | 21588750 | 21588745 | - |
| SEQ ID NO 28427 | ACTTAGATTTATTGTTGGATGG | TTA | chr12 | 21588740 | 21588761 | 21588745 | 21588740 | - |
| SEQ ID NO 28428 | AGATTTATTGTTGGATGGTTAA | CTT | chr12 | 21588736 | 21588757 | 21588741 | 21588736 | - |
| SEQ ID NO 28429 | GATTTATTGTTGGATGGTTAAG | TTA | chr12 | 21588735 | 21588756 | 21588740 | 21588735 | - |

Figure 48 (Cont'd)

| SEQ ID NO 28430 | ATTGTTGGATGGTTAAGTTAAT | TTT | chr12 | 21588730 | 21588751 | 21588735 | 21588730 | - |
|---|---|---|---|---|---|---|---|---|
| SEQ ID NO 28431 | TTGTTGGATGGTTAAGTTAATC | TTA | chr12 | 21588729 | 21588750 | 21588734 | 21588729 | - |
| SEQ ID NO 28432 | TTGGATGGTTAAGTTAATCATG | TTG | chr12 | 21588726 | 21588747 | 21588731 | 21588726 | - |
| SEQ ID NO 28433 | GATGGTTAAGTTAATCATGTCT | TTG | chr12 | 21588723 | 21588744 | 21588728 | 21588723 | - |
| SEQ ID NO 28434 | AGTTAATCATGTCTGTTCTTGT | TTA | chr12 | 21588715 | 21588736 | 21588720 | 21588715 | - |
| SEQ ID NO 28435 | ATCATGTCTGTTCTTGTCCAGT | TTA | chr12 | 21588710 | 21588731 | 21588715 | 21588710 | - |
| SEQ ID NO 28436 | TTCTTGTCCAGTCTAGAAGTTT | CTG | chr12 | 21588700 | 21588721 | 21588705 | 21588700 | - |
| SEQ ID NO 28437 | TTGTCCAGTCTAGAAGTTTCTG | TTC | chr12 | 21588697 | 21588718 | 21588702 | 21588697 | - |
| SEQ ID NO 28438 | GTCCAGTCTAGAAGTTTCTGCT | CTT | chr12 | 21588695 | 21588716 | 21588700 | 21588695 | - |
| SEQ ID NO 28439 | TCCAGTCTAGAAGTTTCTGCTT | TTG | chr12 | 21588694 | 21588715 | 21588699 | 21588694 | - |
| SEQ ID NO 28440 | GAAGTTTCTGCTTCCTCCTCAT | CTA | chr12 | 21588685 | 21588706 | 21588690 | 21588685 | - |
| SEQ ID NO 28441 | CTGCTTCCTCCTCATGTGTTCT | TTT | chr12 | 21588678 | 21588699 | 21588683 | 21588678 | - |
| SEQ ID NO 28442 | TGCTTCCTCCTCATGTGTTCTA | TTC | chr12 | 21588677 | 21588698 | 21588682 | 21588677 | - |
| SEQ ID NO 28443 | CTTCCTCCTCATGTGTTCTATT | CTG | chr12 | 21588675 | 21588696 | 21588680 | 21588675 | - |
| SEQ ID NO 28444 | CCTCCTCATGTGTTCTATTCTG | CTT | chr12 | 21588672 | 21588693 | 21588677 | 21588672 | - |
| SEQ ID NO 28445 | CTCCTCATGTGTTCTATTCTGT | TTC | chr12 | 21588671 | 21588692 | 21588676 | 21588671 | - |
| SEQ ID NO 28446 | CTCATGTGTTCTATTCTGTCCT | CTC | chr12 | 21588668 | 21588689 | 21588673 | 21588668 | - |
| SEQ ID NO 28447 | ATGTGTTCTATTCTGTCCTCAT | CTC | chr12 | 21588665 | 21588686 | 21588670 | 21588665 | - |
| SEQ ID NO 28448 | TATTCTGTCCTCATCACATAAC | TTC | chr12 | 21588657 | 21588678 | 21588662 | 21588657 | - |
| SEQ ID NO 28449 | TTCTGTCCTCATCACATAACAT | CTA | chr12 | 21588655 | 21588676 | 21588660 | 21588655 | - |
| SEQ ID NO 28450 | TGTCCTCATCACATAACATCTG | TTC | chr12 | 21588652 | 21588673 | 21588657 | 21588652 | - |
| SEQ ID NO 28451 | TCCTCATCACATAACATCTGAA | CTG | chr12 | 21588650 | 21588671 | 21588655 | 21588650 | - |
| SEQ ID NO 28452 | ATCACATAACATCTGAACTGTG | CTC | chr12 | 21588645 | 21588666 | 21588650 | 21588645 | - |
| SEQ ID NO 28453 | AACTGTGATTTGACAGTGTCCT | CTG | chr12 | 21588630 | 21588651 | 21588635 | 21588630 | - |
| SEQ ID NO 28454 | TGATTTGACAGTGTCCTTATTA | CTG | chr12 | 21588625 | 21588646 | 21588630 | 21588625 | - |
| SEQ ID NO 28455 | GACAGTGTCCTTATTATCAGAC | TTT | chr12 | 21588619 | 21588640 | 21588624 | 21588619 | - |
| SEQ ID NO 28456 | ACAGTGTCCTTATTATCAGACT | TTG | chr12 | 21588618 | 21588639 | 21588623 | 21588618 | - |
| SEQ ID NO 28457 | ATTATCAGACTCTGCTCAATGA | CTT | chr12 | 21588607 | 21588628 | 21588612 | 21588607 | - |
| SEQ ID NO 28458 | TTATCAGACTCTGCTCAATGAC | TTA | chr12 | 21588606 | 21588627 | 21588611 | 21588606 | - |
| SEQ ID NO 28459 | TCAGACTCTGCTCAATGACAGT | TTA | chr12 | 21588603 | 21588624 | 21588608 | 21588603 | - |
| SEQ ID NO 28460 | TGCTCAATGACAGTTTAAACTT | CTC | chr12 | 21588595 | 21588616 | 21588600 | 21588595 | - |
| SEQ ID NO 28461 | CTCAATGACAGTTTAAACTTCT | CTG | chr12 | 21588593 | 21588614 | 21588598 | 21588593 | - |
| SEQ ID NO 28462 | AATGACAGTTTAAACTTCTTTT | CTC | chr12 | 21588590 | 21588611 | 21588595 | 21588590 | - |
| SEQ ID NO 28463 | AAACTTCTTTTTGATACAGTAA | TTT | chr12 | 21588579 | 21588600 | 21588584 | 21588579 | - |
| SEQ ID NO 28464 | AACTTCTTTTTGATACAGTAAA | TTA | chr12 | 21588578 | 21588599 | 21588583 | 21588578 | - |
| SEQ ID NO 28465 | CTTTTTGATACAGTAAAAAACT | CTT | chr12 | 21588573 | 21588594 | 21588578 | 21588573 | - |
| SEQ ID NO 28466 | TTTTTGATACAGTAAAAAACTT | TTC | chr12 | 21588572 | 21588593 | 21588577 | 21588572 | - |
| SEQ ID NO 28467 | TTTGATACAGTAAAAAACTTTT | CTT | chr12 | 21588570 | 21588591 | 21588575 | 21588570 | - |
| SEQ ID NO 28468 | TTGATACAGTAAAAAACTTTTC | TTT | chr12 | 21588569 | 21588590 | 21588574 | 21588569 | - |
| SEQ ID NO 28469 | TGATACAGTAAAAAACTTTTCC | TTT | chr12 | 21588568 | 21588589 | 21588573 | 21588568 | - |
| SEQ ID NO 28470 | GATACAGTAAAAAACTTTTCCT | TTT | chr12 | 21588567 | 21588588 | 21588572 | 21588567 | - |
| SEQ ID NO 28471 | ATACAGTAAAAAACTTTTCCTT | TTG | chr12 | 21588566 | 21588587 | 21588571 | 21588566 | - |
| SEQ ID NO 28472 | TTCCTTAAAGATGAAATTCTTA | CTT | chr12 | 21588550 | 21588571 | 21588555 | 21588550 | - |
| SEQ ID NO 28473 | TCCTTAAAGATGAAATTCTTAA | TTT | chr12 | 21588549 | 21588570 | 21588554 | 21588549 | - |
| SEQ ID NO 28474 | CCTTAAAGATGAAATTCTTAAG | TTT | chr12 | 21588548 | 21588569 | 21588553 | 21588548 | - |
| SEQ ID NO 28475 | CTTAAAGATGAAATTCTTAAGG | TTC | chr12 | 21588547 | 21588568 | 21588552 | 21588547 | - |
| SEQ ID NO 28476 | AAAGATGAAATTCTTAAGGACA | CTT | chr12 | 21588544 | 21588565 | 21588549 | 21588544 | - |
| SEQ ID NO 28477 | AAGATGAAATTCTTAAGGACAA | TTA | chr12 | 21588543 | 21588564 | 21588548 | 21588543 | - |
| SEQ ID NO 28478 | TTAAGGACAATTAGCTTGTGTA | TTC | chr12 | 21588531 | 21588552 | 21588536 | 21588531 | - |
| SEQ ID NO 28479 | AAGGACAATTAGCTTGTGTAGA | CTT | chr12 | 21588529 | 21588550 | 21588534 | 21588529 | - |
| SEQ ID NO 28480 | AGGACAATTAGCTTGTGTAGAC | TTA | chr12 | 21588528 | 21588549 | 21588533 | 21588528 | - |
| SEQ ID NO 28481 | GCTTGTGTAGACTCATATGAAA | TTA | chr12 | 21588518 | 21588539 | 21588523 | 21588518 | - |
| SEQ ID NO 28482 | GTGTAGACTCATATGAAAATTG | CTT | chr12 | 21588514 | 21588535 | 21588519 | 21588514 | - |
| SEQ ID NO 28483 | TGTAGACTCATATGAAAATTGC | TTG | chr12 | 21588513 | 21588534 | 21588518 | 21588513 | - |
| SEQ ID NO 28484 | ATATGAAAATTGCTTGCATTTT | CTC | chr12 | 21588504 | 21588525 | 21588509 | 21588504 | - |
| SEQ ID NO 28485 | CTTGCATTTTGGAGTTACATTA | TTG | chr12 | 21588492 | 21588513 | 21588497 | 21588492 | - |
| SEQ ID NO 28486 | GCATTTTGGAGTTACATTAGCT | CTT | chr12 | 21588489 | 21588510 | 21588494 | 21588489 | - |
| SEQ ID NO 28487 | CATTTTGGAGTTACATTAGCTC | TTG | chr12 | 21588488 | 21588509 | 21588493 | 21588488 | - |

Figure 48 (Cont'd)

| | | | | | | | | |
|---|---|---|---|---|---|---|---|---|
| SEQ ID NO 28488 | TGGAGTTACATTAGCTCTTCT | TTT | chr12 | 21588483 | 21588504 | 21588488 | 21588483 | - |
| SEQ ID NO 28489 | GGAGTTACATTAGCTCTTCTCC | TTT | chr12 | 21588482 | 21588503 | 21588487 | 21588482 | - |
| SEQ ID NO 28490 | GAGTTACATTAGCTCTTCTCCT | TTG | chr12 | 21588481 | 21588502 | 21588486 | 21588481 | - |
| SEQ ID NO 28491 | CATTAGCTCTTCTCCTTTATAA | TTA | chr12 | 21588475 | 21588496 | 21588480 | 21588475 | - |
| SEQ ID NO 28492 | GCTCTTCTCCTTTATAAATTAA | TTA | chr12 | 21588470 | 21588491 | 21588475 | 21588470 | - |
| SEQ ID NO 28493 | TTCTCCTTTATAAATTAATGAA | CTC | chr12 | 21588466 | 21588487 | 21588471 | 21588466 | - |
| SEQ ID NO 28494 | CTCCTTTATAAATTAATGAATC | CTT | chr12 | 21588464 | 21588485 | 21588469 | 21588464 | - |
| SEQ ID NO 28495 | TCCTTTATAAATTAATGAATCC | TTC | chr12 | 21588463 | 21588484 | 21588468 | 21588463 | - |
| SEQ ID NO 28496 | CTTTATAAATTAATGAATCCTA | CTC | chr12 | 21588461 | 21588482 | 21588466 | 21588461 | - |
| SEQ ID NO 28497 | TATAAATTAATGAATCCTATTG | CTT | chr12 | 21588458 | 21588479 | 21588463 | 21588458 | - |
| SEQ ID NO 28498 | ATAAATTAATGAATCCTATTGG | TTT | chr12 | 21588457 | 21588478 | 21588462 | 21588457 | - |
| SEQ ID NO 28499 | TAAATTAATGAATCCTATTGGT | TTA | chr12 | 21588456 | 21588477 | 21588461 | 21588456 | - |
| SEQ ID NO 28500 | ATGAATCCTATTGGTACCATAT | TTA | chr12 | 21588449 | 21588470 | 21588454 | 21588449 | - |
| SEQ ID NO 28501 | TTGGTACCATATAATAGCATCA | CTA | chr12 | 21588439 | 21588460 | 21588444 | 21588439 | - |
| SEQ ID NO 28502 | GTACCATATAATAGCATCAACA | TTG | chr12 | 21588436 | 21588457 | 21588441 | 21588436 | - |
| SEQ ID NO 28503 | GCCTTTTGTGTCTCGCCTTTCA | TTT | chr12 | 21588411 | 21588432 | 21588416 | 21588411 | - |
| SEQ ID NO 28504 | CCTTTTGTGTCTCGCCTTTCAA | TTG | chr12 | 21588410 | 21588431 | 21588415 | 21588410 | - |
| SEQ ID NO 28505 | TTGTGTCTCGCCTTTCAAAGGG | CTT | chr12 | 21588406 | 21588427 | 21588411 | 21588406 | - |
| SEQ ID NO 28506 | TGTGTCTCGCCTTTCAAAGGGC | TTT | chr12 | 21588405 | 21588426 | 21588410 | 21588405 | - |
| SEQ ID NO 28507 | GTGTCTCGCCTTTCAAAGGGCA | TTT | chr12 | 21588404 | 21588425 | 21588409 | 21588404 | - |
| SEQ ID NO 28508 | TGTCTCGCCTTTCAAAGGGCAA | TTG | chr12 | 21588403 | 21588424 | 21588408 | 21588403 | - |
| SEQ ID NO 28509 | GCCTTTCAAAGGGCAATTTTCC | CTC | chr12 | 21588397 | 21588418 | 21588402 | 21588397 | - |
| SEQ ID NO 28510 | TCAAAGGGCAATTTTCCAAAAA | CTT | chr12 | 21588392 | 21588413 | 21588397 | 21588392 | - |
| SEQ ID NO 28511 | CAAAGGGCAATTTTCCAAAAAG | TTT | chr12 | 21588391 | 21588412 | 21588396 | 21588391 | - |
| SEQ ID NO 28512 | AAAGGGCAATTTTCCAAAAAGT | TTC | chr12 | 21588390 | 21588411 | 21588395 | 21588390 | - |
| SEQ ID NO 28513 | TCCAAAAAGTATATTTTGCATG | TTT | chr12 | 21588378 | 21588399 | 21588383 | 21588378 | - |
| SEQ ID NO 28514 | CCAAAAAGTATATTTTGCATGG | TTT | chr12 | 21588377 | 21588398 | 21588382 | 21588377 | - |
| SEQ ID NO 28515 | CAAAAAGTATATTTTGCATGGC | TTC | chr12 | 21588376 | 21588397 | 21588381 | 21588376 | - |
| SEQ ID NO 28516 | TGCATGGCTCAGGCTAAAAGTA | TTT | chr12 | 21588362 | 21588383 | 21588367 | 21588362 | - |
| SEQ ID NO 28517 | GCATGGCTCAGGCTAAAAGTAA | TTT | chr12 | 21588361 | 21588382 | 21588366 | 21588361 | - |
| SEQ ID NO 28518 | CATGGCTCAGGCTAAAAGTAAT | TTG | chr12 | 21588360 | 21588381 | 21588365 | 21588360 | - |
| SEQ ID NO 28519 | AGGCTAAAAGTAATGTCTCCAG | CTC | chr12 | 21588352 | 21588373 | 21588357 | 21588352 | - |
| SEQ ID NO 28520 | AAAGTAATGTCTCCAGATGAAG | CTA | chr12 | 21588346 | 21588367 | 21588351 | 21588346 | - |
| SEQ ID NO 28521 | CAGATGAAGTTCTACTTTGTGA | CTC | chr12 | 21588333 | 21588354 | 21588338 | 21588333 | - |
| SEQ ID NO 28522 | TACTTTGTGACCATTGATTGTG | TTC | chr12 | 21588321 | 21588342 | 21588326 | 21588321 | - |
| SEQ ID NO 28523 | CTTTGTGACCATTGATTGTGAC | CTA | chr12 | 21588319 | 21588340 | 21588324 | 21588319 | - |
| SEQ ID NO 28524 | TGTGACCATTGATTGTGACTAT | CTT | chr12 | 21588316 | 21588337 | 21588321 | 21588316 | - |
| SEQ ID NO 28525 | GTGACCATTGATTGTGACTATT | TTT | chr12 | 21588315 | 21588336 | 21588320 | 21588315 | - |
| SEQ ID NO 28526 | TGACCATTGATTGTGACTATTG | TTG | chr12 | 21588314 | 21588335 | 21588319 | 21588314 | - |
| SEQ ID NO 28527 | ATTGTGACTATTGATAAGATTT | TTG | chr12 | 21588305 | 21588326 | 21588310 | 21588305 | - |
| SEQ ID NO 28528 | TGACTATTGATAAGATTTACTA | TTG | chr12 | 21588301 | 21588322 | 21588306 | 21588301 | - |
| SEQ ID NO 28529 | TTGATAAGATTTACTATGTAAA | CTA | chr12 | 21588295 | 21588316 | 21588300 | 21588295 | - |
| SEQ ID NO 28530 | ATAAGATTTACTATGTAAAGTA | TTG | chr12 | 21588292 | 21588313 | 21588297 | 21588292 | - |
| SEQ ID NO 28531 | ACTATGTAAAGTATAAGTTACT | TTT | chr12 | 21588283 | 21588304 | 21588288 | 21588283 | - |
| SEQ ID NO 28532 | CTATGTAAAGTATAAGTTACTG | TTA | chr12 | 21588282 | 21588303 | 21588287 | 21588282 | - |
| SEQ ID NO 28533 | TGTAAAGTATAAGTTACTGGAA | CTA | chr12 | 21588279 | 21588300 | 21588284 | 21588279 | - |
| SEQ ID NO 28534 | CTGGAATAATACATTTAAGAAA | TTA | chr12 | 21588263 | 21588284 | 21588268 | 21588263 | - |
| SEQ ID NO 28535 | GAATAATACATTTAAGAAATAT | CTG | chr12 | 21588260 | 21588281 | 21588265 | 21588260 | - |
| SEQ ID NO 28536 | AAGAAATATAGTAGCTATTAAA | TTT | chr12 | 21588247 | 21588268 | 21588252 | 21588247 | - |
| SEQ ID NO 28537 | AGAAATATAGTAGCTATTAAAA | TTA | chr12 | 21588246 | 21588267 | 21588251 | 21588246 | - |
| SEQ ID NO 28538 | TTAAAACCTGTAGTCTGATGAA | CTA | chr12 | 21588230 | 21588251 | 21588235 | 21588230 | - |
| SEQ ID NO 28539 | AAACCTGTAGTCTGATGAAATG | TTA | chr12 | 21588227 | 21588248 | 21588232 | 21588227 | - |
| SEQ ID NO 28540 | TAGTCTGATGAAATGGAATATG | CTG | chr12 | 21588220 | 21588241 | 21588225 | 21588220 | - |
| SEQ ID NO 28541 | ATGAAATGGAATATGTTTTGAA | CTG | chr12 | 21588213 | 21588234 | 21588218 | 21588213 | - |
| SEQ ID NO 28542 | TGAAAGACAGCAGTGAAAAATG | TTT | chr12 | 21588195 | 21588216 | 21588200 | 21588195 | - |
| SEQ ID NO 28543 | GAAAGACAGCAGTGAAAAATGA | TTT | chr12 | 21588194 | 21588215 | 21588199 | 21588194 | - |
| SEQ ID NO 28544 | AAAGACAGCAGTGAAAAATGAG | TTG | chr12 | 21588193 | 21588214 | 21588198 | 21588193 | - |
| SEQ ID NO 28545 | CTTTTTGCAATTGAGTTGAAGA | TTG | chr12 | 21588146 | 21588167 | 21588151 | 21588146 | - |

Figure 48 (Cont'd)

| SEQ ID NO 28546 | TTTGCAATTGAGTTGAAGATTG | CTT | chr12 | 21588143 | 21588164 | 21588148 | 21588143 | - |
|---|---|---|---|---|---|---|---|---|
| SEQ ID NO 28547 | TTGCAATTGAGTTGAAGATTGA | TTT | chr12 | 21588142 | 21588163 | 21588147 | 21588142 | - |
| SEQ ID NO 28548 | TGCAATTGAGTTGAAGATTGAT | TTT | chr12 | 21588141 | 21588162 | 21588146 | 21588141 | - |
| SEQ ID NO 28549 | GCAATTGAGTTGAAGATTGATG | TTT | chr12 | 21588140 | 21588161 | 21588145 | 21588140 | - |
| SEQ ID NO 28550 | CAATTGAGTTGAAGATTGATGC | TTG | chr12 | 21588139 | 21588160 | 21588144 | 21588139 | - |
| SEQ ID NO 28551 | AGTTGAAGATTGATGCCAGGAT | TTG | chr12 | 21588133 | 21588154 | 21588138 | 21588133 | - |
| SEQ ID NO 28552 | AAGATTGATGCCAGGATCTTAT | TTG | chr12 | 21588128 | 21588149 | 21588133 | 21588128 | - |
| SEQ ID NO 28553 | ATGCCAGGATCTTATTACCTCC | TTG | chr12 | 21588121 | 21588142 | 21588126 | 21588121 | - |
| SEQ ID NO 28554 | ATTACCTCCAGGATTTCACAAA | CTT | chr12 | 21588108 | 21588129 | 21588113 | 21588108 | - |
| SEQ ID NO 28555 | TTACCTCCAGGATTTCACAAAG | TTA | chr12 | 21588107 | 21588128 | 21588112 | 21588107 | - |
| SEQ ID NO 28556 | CCTCCAGGATTTCACAAAGGAT | TTA | chr12 | 21588104 | 21588125 | 21588109 | 21588104 | - |
| SEQ ID NO 28557 | CAGGATTTCACAAAGGATTTCT | CTC | chr12 | 21588100 | 21588121 | 21588105 | 21588100 | - |
| SEQ ID NO 28558 | CACAAAGGATTTCTTGAGTCAT | TTT | chr12 | 21588092 | 21588113 | 21588097 | 21588092 | - |
| SEQ ID NO 28559 | ACAAAGGATTTCTTGAGTCATC | TTC | chr12 | 21588091 | 21588112 | 21588096 | 21588091 | - |
| SEQ ID NO 28560 | CTTGAGTCATCCCCTTGCTCTA | TTT | chr12 | 21588080 | 21588101 | 21588085 | 21588080 | - |
| SEQ ID NO 28561 | TTGAGTCATCCCCTTGCTCTAG | TTC | chr12 | 21588079 | 21588100 | 21588084 | 21588079 | - |
| SEQ ID NO 28562 | GAGTCATCCCCTTGCTCTAGCT | CTT | chr12 | 21588077 | 21588098 | 21588082 | 21588077 | - |
| SEQ ID NO 28563 | AGTCATCCCCTTGCTCTAGCTC | TTG | chr12 | 21588076 | 21588097 | 21588081 | 21588076 | - |
| SEQ ID NO 28564 | GCTCTAGCTCATGAACAAAGTA | CTT | chr12 | 21588064 | 21588085 | 21588069 | 21588064 | - |
| SEQ ID NO 28565 | CTCTAGCTCATGAACAAAGTAT | TTG | chr12 | 21588063 | 21588084 | 21588068 | 21588063 | - |
| SEQ ID NO 28566 | TAGCTCATGAACAAAGTATTGC | CTC | chr12 | 21588060 | 21588081 | 21588065 | 21588060 | - |
| SEQ ID NO 28567 | GCTCATGAACAAAGTATTGCTC | CTA | chr12 | 21588058 | 21588079 | 21588063 | 21588058 | - |
| SEQ ID NO 28568 | ATGAACAAAGTATTGCTCAAGT | CTC | chr12 | 21588054 | 21588075 | 21588059 | 21588054 | - |
| SEQ ID NO 28569 | CTCAAGTAATCGACAGATTATT | TTG | chr12 | 21588039 | 21588060 | 21588044 | 21588039 | - |
| SEQ ID NO 28570 | AAGTAATCGACAGATTATTTGT | CTC | chr12 | 21588036 | 21588057 | 21588041 | 21588036 | - |
| SEQ ID NO 28571 | TTTGTGTATTCTCACATGTGAT | TTA | chr12 | 21588019 | 21588040 | 21588024 | 21588019 | - |
| SEQ ID NO 28572 | GTGTATTCTCACATGTGATTAT | TTT | chr12 | 21588016 | 21588037 | 21588021 | 21588016 | - |
| SEQ ID NO 28573 | TGTATTCTCACATGTGATTATT | TTG | chr12 | 21588015 | 21588036 | 21588020 | 21588015 | - |
| SEQ ID NO 28574 | TCACATGTGATTATTATTTAGT | TTC | chr12 | 21588008 | 21588029 | 21588013 | 21588008 | - |
| SEQ ID NO 28575 | ACATGTGATTATTATTTAGTGC | CTC | chr12 | 21588006 | 21588027 | 21588011 | 21588006 | - |
| SEQ ID NO 28576 | TTATTTAGTGCTGTCACGGGAA | TTA | chr12 | 21587995 | 21588016 | 21588000 | 21587995 | - |
| SEQ ID NO 28577 | TTTAGTGCTGTCACGGGAAATA | TTA | chr12 | 21587992 | 21588013 | 21587997 | 21587992 | - |
| SEQ ID NO 28578 | AGTGCTGTCACGGGAAATATCC | TTT | chr12 | 21587989 | 21588010 | 21587994 | 21587989 | - |
| SEQ ID NO 28579 | GTGCTGTCACGGGAAATATCCT | TTA | chr12 | 21587988 | 21588009 | 21587993 | 21587988 | - |
| SEQ ID NO 28580 | TCACGGGAAATATCCTGCCTAA | CTG | chr12 | 21587982 | 21588003 | 21587987 | 21587982 | - |
| SEQ ID NO 28581 | CCTAAGTTTACTGGAGGTCTTC | CTG | chr12 | 21587965 | 21587986 | 21587970 | 21587965 | - |
| SEQ ID NO 28582 | AGTTTACTGGAGGTCTTCCTCC | CTA | chr12 | 21587961 | 21587982 | 21587966 | 21587961 | - |
| SEQ ID NO 28583 | ACTGGAGGTCTTCCTCCCCTTA | TTT | chr12 | 21587956 | 21587977 | 21587961 | 21587956 | - |
| SEQ ID NO 28584 | CTGGAGGTCTTCCTCCCCTTAC | TTA | chr12 | 21587955 | 21587976 | 21587960 | 21587955 | - |
| SEQ ID NO 28585 | GAGGTCTTCCTCCCCTTACCCC | CTG | chr12 | 21587952 | 21587973 | 21587957 | 21587952 | - |
| SEQ ID NO 28586 | CCTCCCCTTACCCCTCCCTATG | CTT | chr12 | 21587944 | 21587965 | 21587949 | 21587944 | - |
| SEQ ID NO 28587 | CTCCCCTTACCCCTCCCTATGT | TTC | chr12 | 21587943 | 21587964 | 21587948 | 21587943 | - |
| SEQ ID NO 28588 | CCCTTACCCCTCCCTATGTCCT | CTC | chr12 | 21587940 | 21587961 | 21587945 | 21587940 | - |
| SEQ ID NO 28589 | ACCCCTCCCTATGTCCTCCTAC | CTT | chr12 | 21587935 | 21587956 | 21587940 | 21587935 | - |
| SEQ ID NO 28590 | CCCCTCCCTATGTCCTCCTACC | TTA | chr12 | 21587934 | 21587955 | 21587939 | 21587934 | - |
| SEQ ID NO 28591 | CCTATGTCCTCCTACCTGGTTA | CTC | chr12 | 21587928 | 21587949 | 21587933 | 21587928 | - |
| SEQ ID NO 28592 | TGTCCTCCTACCTGGTTATCCT | CTA | chr12 | 21587924 | 21587945 | 21587929 | 21587924 | - |
| SEQ ID NO 28593 | CTACCTGGTTATCCTTTTCAAT | CTC | chr12 | 21587917 | 21587938 | 21587922 | 21587917 | - |
| SEQ ID NO 28594 | CCTGGTTATCCTTTTCAATCCT | CTA | chr12 | 21587914 | 21587935 | 21587919 | 21587914 | - |
| SEQ ID NO 28595 | GTTATCCTTTTCAATCCTATTA | CTG | chr12 | 21587910 | 21587931 | 21587915 | 21587910 | - |
| SEQ ID NO 28596 | TCCTTTTCAATCCTATTACTCT | TTA | chr12 | 21587906 | 21587927 | 21587911 | 21587906 | - |
| SEQ ID NO 28597 | TTCAATCCTATTACTCTTTCCT | CTT | chr12 | 21587901 | 21587922 | 21587906 | 21587901 | - |
| SEQ ID NO 28598 | TCAATCCTATTACTCTTTCCTT | TTT | chr12 | 21587900 | 21587921 | 21587905 | 21587900 | - |
| SEQ ID NO 28599 | CAATCCTATTACTCTTTCCTTG | TTT | chr12 | 21587899 | 21587920 | 21587904 | 21587899 | - |
| SEQ ID NO 28600 | AATCCTATTACTCTTTCCTTGC | TTC | chr12 | 21587898 | 21587919 | 21587903 | 21587898 | - |
| SEQ ID NO 28601 | TTACTCTTTCCTTGCACACTCT | CTA | chr12 | 21587891 | 21587912 | 21587896 | 21587891 | - |
| SEQ ID NO 28602 | CTCTTTCCTTGCACACTCTACT | TTA | chr12 | 21587888 | 21587909 | 21587893 | 21587888 | - |
| SEQ ID NO 28603 | TTTCCTTGCACACTCTACTCCA | CTC | chr12 | 21587885 | 21587906 | 21587890 | 21587885 | - |

Figure 48 (Cont'd)

| SEQ ID NO 28604 | TCCTTGCACACTCTACTCCAGC | CTT | chr12 | 21587883 | 21587904 | 21587888 | 21587883 | - |
|---|---|---|---|---|---|---|---|---|
| SEQ ID NO 28605 | CCTTGCACACTCTACTCCAGCT | TTT | chr12 | 21587882 | 21587903 | 21587887 | 21587882 | - |
| SEQ ID NO 28606 | CTTGCACACTCTACTCCAGCTT | TTC | chr12 | 21587881 | 21587902 | 21587886 | 21587881 | - |
| SEQ ID NO 28607 | GCACACTCTACTCCAGCTTAGG | CTT | chr12 | 21587878 | 21587899 | 21587883 | 21587878 | - |
| SEQ ID NO 28608 | CACACTCTACTCCAGCTTAGGG | TTG | chr12 | 21587877 | 21587898 | 21587882 | 21587877 | - |
| SEQ ID NO 28609 | TACTCCAGCTTAGGGCCTGGGC | CTC | chr12 | 21587870 | 21587891 | 21587875 | 21587870 | - |
| SEQ ID NO 28610 | CTCCAGCTTAGGGCCTGGGCTC | CTA | chr12 | 21587868 | 21587889 | 21587873 | 21587868 | - |
| SEQ ID NO 28611 | CAGCTTAGGGCCTGGGCTCTGA | CTC | chr12 | 21587865 | 21587886 | 21587870 | 21587865 | - |
| SEQ ID NO 28612 | AGGGCCTGGGCTCTGACCATTA | CTT | chr12 | 21587859 | 21587880 | 21587864 | 21587859 | - |
| SEQ ID NO 28613 | GGGCCTGGGCTCTGACCATTAC | TTA | chr12 | 21587858 | 21587879 | 21587863 | 21587858 | - |
| SEQ ID NO 28614 | GGCTCTGACCATTACCTCTGCC | CTG | chr12 | 21587851 | 21587872 | 21587856 | 21587851 | - |
| SEQ ID NO 28615 | TGACCATTACCTCTGCCTAAAA | CTC | chr12 | 21587846 | 21587867 | 21587851 | 21587846 | - |
| SEQ ID NO 28616 | ACCATTACCTCTGCCTAAAAAT | CTG | chr12 | 21587844 | 21587865 | 21587849 | 21587844 | - |
| SEQ ID NO 28617 | CCTCTGCCTAAAAATTCCTCCT | TTA | chr12 | 21587837 | 21587858 | 21587842 | 21587837 | - |
| SEQ ID NO 28618 | TGCCTAAAAATTCCTCCTCATG | CTC | chr12 | 21587833 | 21587854 | 21587838 | 21587833 | - |
| SEQ ID NO 28619 | CCTAAAAATTCCTCCTCATGAC | CTG | chr12 | 21587831 | 21587852 | 21587836 | 21587831 | - |
| SEQ ID NO 28620 | AAAATTCCTCCTCATGACATCC | CTA | chr12 | 21587827 | 21587848 | 21587832 | 21587827 | - |
| SEQ ID NO 28621 | CTCCTCATGACATCCATTTGCC | TTC | chr12 | 21587820 | 21587841 | 21587825 | 21587820 | - |
| SEQ ID NO 28622 | CTCATGACATCCATTTGCCCAA | CTC | chr12 | 21587817 | 21587838 | 21587822 | 21587817 | - |
| SEQ ID NO 28623 | ATGACATCCATTTGCCCAATTT | CTC | chr12 | 21587814 | 21587835 | 21587819 | 21587814 | - |
| SEQ ID NO 28624 | GCCCAATTTCTTCACCCTTTTA | TTT | chr12 | 21587801 | 21587822 | 21587806 | 21587801 | - |
| SEQ ID NO 28625 | CCCAATTTCTTCACCCTTTTAA | TTG | chr12 | 21587800 | 21587821 | 21587805 | 21587800 | - |
| SEQ ID NO 28626 | CTTCACCCTTTTAATTACCCCA | TTT | chr12 | 21587792 | 21587813 | 21587797 | 21587792 | - |
| SEQ ID NO 28627 | TTCACCCTTTTAATTACCCCAT | TTC | chr12 | 21587791 | 21587812 | 21587796 | 21587791 | - |
| SEQ ID NO 28628 | CACCCTTTTAATTACCCCATTA | CTT | chr12 | 21587789 | 21587810 | 21587794 | 21587789 | - |
| SEQ ID NO 28629 | ACCCTTTTAATTACCCCATTAA | TTC | chr12 | 21587788 | 21587809 | 21587793 | 21587788 | - |
| SEQ ID NO 28630 | TTAATTACCCCATTAAGTGATA | CTT | chr12 | 21587782 | 21587803 | 21587787 | 21587782 | - |
| SEQ ID NO 28631 | TAATTACCCCATTAAGTGATAT | TTT | chr12 | 21587781 | 21587802 | 21587786 | 21587781 | - |
| SEQ ID NO 28632 | AATTACCCCATTAAGTGATATT | TTT | chr12 | 21587780 | 21587801 | 21587785 | 21587780 | - |
| SEQ ID NO 28633 | ATTACCCCATTAAGTGATATTT | TTA | chr12 | 21587779 | 21587800 | 21587784 | 21587779 | - |
| SEQ ID NO 28634 | CCCCATTAAGTGATATTTTGCT | TTA | chr12 | 21587775 | 21587796 | 21587780 | 21587775 | - |
| SEQ ID NO 28635 | AGTGATATTTTGCTTGCTCAAT | TTA | chr12 | 21587767 | 21587788 | 21587772 | 21587767 | - |
| SEQ ID NO 28636 | TGCTTGCTCAATTTTTGCCTTT | TTT | chr12 | 21587757 | 21587778 | 21587762 | 21587757 | - |
| SEQ ID NO 28637 | GCTTGCTCAATTTTTGCCTTTT | TTT | chr12 | 21587756 | 21587777 | 21587761 | 21587756 | - |
| SEQ ID NO 28638 | CTTGCTCAATTTTTGCCTTTTC | TTG | chr12 | 21587755 | 21587776 | 21587760 | 21587755 | - |
| SEQ ID NO 28639 | GCTCAATTTTTGCCTTTTCAAT | CTT | chr12 | 21587752 | 21587773 | 21587757 | 21587752 | - |
| SEQ ID NO 28640 | CTCAATTTTTGCCTTTTCAATC | TTG | chr12 | 21587751 | 21587772 | 21587756 | 21587751 | - |
| SEQ ID NO 28641 | AATTTTTGCCTTTTCAATCAGA | CTC | chr12 | 21587748 | 21587769 | 21587753 | 21587748 | - |
| SEQ ID NO 28642 | TTGCCTTTTCAATCAGATCTAA | TTT | chr12 | 21587743 | 21587764 | 21587748 | 21587743 | - |
| SEQ ID NO 28643 | TGCCTTTTCAATCAGATCTAAT | TTT | chr12 | 21587742 | 21587763 | 21587747 | 21587742 | - |
| SEQ ID NO 28644 | GCCTTTTCAATCAGATCTAATT | TTT | chr12 | 21587741 | 21587762 | 21587746 | 21587741 | - |
| SEQ ID NO 28645 | CCTTTTCAATCAGATCTAATTT | TTG | chr12 | 21587740 | 21587761 | 21587745 | 21587740 | - |
| SEQ ID NO 28646 | TTCAATCAGATCTAATTTATTT | CTT | chr12 | 21587736 | 21587757 | 21587741 | 21587736 | - |
| SEQ ID NO 28647 | TCAATCAGATCTAATTTATTTT | TTT | chr12 | 21587735 | 21587756 | 21587740 | 21587735 | - |
| SEQ ID NO 28648 | CAATCAGATCTAATTTATTTTA | TTT | chr12 | 21587734 | 21587755 | 21587739 | 21587734 | - |
| SEQ ID NO 28649 | AATCAGATCTAATTTATTTTAT | TTC | chr12 | 21587733 | 21587754 | 21587738 | 21587733 | - |
| SEQ ID NO 28650 | ATTTATTTTATATTTTAAAAT | CTA | chr12 | 21587722 | 21587743 | 21587727 | 21587722 | - |
| SEQ ID NO 28651 | ATTTTATATTTTAAAATTTAT | TTT | chr12 | 21587718 | 21587739 | 21587723 | 21587718 | - |
| SEQ ID NO 28652 | TTTTATATTTTAAAATTTATT | TTA | chr12 | 21587717 | 21587738 | 21587722 | 21587717 | - |
| SEQ ID NO 28653 | TATATTTTAAAATTTATTTAT | TTT | chr12 | 21587714 | 21587735 | 21587719 | 21587714 | - |
| SEQ ID NO 28654 | ATATTTTAAAATTTATTTATA | TTT | chr12 | 21587713 | 21587734 | 21587718 | 21587713 | - |
| SEQ ID NO 28655 | TATTTTAAAATTTATTTATAT | TTA | chr12 | 21587712 | 21587733 | 21587717 | 21587712 | - |
| SEQ ID NO 28656 | TTAAAATTATTTATATATATT | TTT | chr12 | 21587707 | 21587728 | 21587712 | 21587707 | - |
| SEQ ID NO 28657 | TAAAATTTATTTATATATATTT | TTT | chr12 | 21587706 | 21587727 | 21587711 | 21587706 | - |
| SEQ ID NO 28658 | AAAATTTATTTATATATATTTA | TTT | chr12 | 21587705 | 21587726 | 21587710 | 21587705 | - |
| SEQ ID NO 28659 | AAATTTATTTATATATATTTAG | TTA | chr12 | 21587704 | 21587725 | 21587709 | 21587704 | - |
| SEQ ID NO 28660 | ATTTATATATATTTAGAAGGTA | TTT | chr12 | 21587698 | 21587719 | 21587703 | 21587698 | - |
| SEQ ID NO 28661 | TTTATATATATTTAGAAGGTAT | TTA | chr12 | 21587697 | 21587718 | 21587702 | 21587697 | - |

Figure 48 (Cont'd)

| SEQ ID NO | Sequence | | | | | | |
|---|---|---|---|---|---|---|---|
| SEQ ID NO 28662 | ATATATATTTAGAAGGTATGTA | TTT | chr12 | 21587694 | 21587715 | 21587699 | 21587694 | - |
| SEQ ID NO 28663 | TATATATTTAGAAGGTATGTAC | TTA | chr12 | 21587693 | 21587714 | 21587698 | 21587693 | - |
| SEQ ID NO 28664 | AGAAGGTATGTACTAGTTCGTT | TTT | chr12 | 21587684 | 21587705 | 21587689 | 21587684 | - |
| SEQ ID NO 28665 | GAAGGTATGTACTAGTTCGTTA | TTA | chr12 | 21587683 | 21587704 | 21587688 | 21587683 | - |
| SEQ ID NO 28666 | GTTCGTTATCATGCTGCTTATA | CTA | chr12 | 21587669 | 21587690 | 21587674 | 21587669 | - |
| SEQ ID NO 28667 | GTTATCATGCTGCTTATAAAGA | TTC | chr12 | 21587665 | 21587686 | 21587670 | 21587665 | - |
| SEQ ID NO 28668 | TCATGCTGCTTATAAAGACATA | TTA | chr12 | 21587661 | 21587682 | 21587666 | 21587661 | - |
| SEQ ID NO 28669 | CTTATAAAGACATACCTGAGAC | CTG | chr12 | 21587653 | 21587674 | 21587658 | 21587653 | - |
| SEQ ID NO 28670 | ATAAAGACATACCTGAGACTGG | CTT | chr12 | 21587650 | 21587671 | 21587655 | 21587650 | - |
| SEQ ID NO 28671 | TAAAGACATACCTGAGACTGGG | TTA | chr12 | 21587649 | 21587670 | 21587654 | 21587649 | - |
| SEQ ID NO 28672 | AGACTGGGTAATTTATAAGGAA | CTG | chr12 | 21587635 | 21587656 | 21587640 | 21587635 | - |
| SEQ ID NO 28673 | GGTAATTTATAAGGAAAAACG | CTG | chr12 | 21587629 | 21587650 | 21587634 | 21587629 | - |
| SEQ ID NO 28674 | ATAAGGAAAAAACGTTTAATTG | TTT | chr12 | 21587621 | 21587642 | 21587626 | 21587621 | - |
| SEQ ID NO 28675 | TAAGGAAAAAACGTTTAATTGT | TTA | chr12 | 21587620 | 21587641 | 21587625 | 21587620 | - |
| SEQ ID NO 28676 | AATTGTCTCACAGTTCCACAGG | TTT | chr12 | 21587604 | 21587625 | 21587609 | 21587604 | - |
| SEQ ID NO 28677 | ATTGTCTCACAGTTCCACAGGG | TTA | chr12 | 21587603 | 21587624 | 21587608 | 21587603 | - |
| SEQ ID NO 28678 | TCTCACAGTTCCACAGGGCTGG | TTG | chr12 | 21587599 | 21587620 | 21587604 | 21587599 | - |
| SEQ ID NO 28679 | ACAGTTCCACAGGGCTGGGGAG | CTC | chr12 | 21587595 | 21587616 | 21587600 | 21587595 | - |
| SEQ ID NO 28680 | CACAGGGCTGGGGAGGCCTCGG | TTC | chr12 | 21587588 | 21587609 | 21587593 | 21587588 | - |
| SEQ ID NO 28681 | GGGAGGCCTCGGGAAACTTACA | CTG | chr12 | 21587578 | 21587599 | 21587583 | 21587578 | - |
| SEQ ID NO 28682 | GGGAAACTTACAATCATGGCAG | CTC | chr12 | 21587568 | 21587589 | 21587573 | 21587568 | - |
| SEQ ID NO 28683 | ACAATCATGGCAGAAGAAGAAA | CTT | chr12 | 21587559 | 21587580 | 21587564 | 21587559 | - |
| SEQ ID NO 28684 | CAATCATGGCAGAAGAAGAAAC | TTA | chr12 | 21587558 | 21587579 | 21587563 | 21587558 | - |
| SEQ ID NO 28685 | CTTCACATGGCAGCAGCAAGTA | CTT | chr12 | 21587524 | 21587545 | 21587529 | 21587524 | - |
| SEQ ID NO 28686 | TTCACATGGCAGCAGCAAGTAG | TTC | chr12 | 21587523 | 21587544 | 21587528 | 21587523 | - |
| SEQ ID NO 28687 | CACATGGCAGCAGCAAGTAGAA | CTT | chr12 | 21587521 | 21587542 | 21587526 | 21587521 | - |
| SEQ ID NO 28688 | ACATGGCAGCAGCAAGTAGAAG | TTC | chr12 | 21587520 | 21587541 | 21587525 | 21587520 | - |
| SEQ ID NO 28689 | ATAAACCATCAGATCTTGTAA | CTT | chr12 | 21587470 | 21587491 | 21587475 | 21587470 | - |
| SEQ ID NO 28690 | TAAAACCATCAGATCTTGTAAG | TTA | chr12 | 21587469 | 21587490 | 21587474 | 21587469 | - |
| SEQ ID NO 28691 | GTAAGAACTCACTATCACGAGA | CTT | chr12 | 21587452 | 21587473 | 21587457 | 21587452 | - |
| SEQ ID NO 28692 | TAAGAACTCACTATCACGAGAA | TTG | chr12 | 21587451 | 21587472 | 21587456 | 21587451 | - |
| SEQ ID NO 28693 | ACTATCACGAGAAGAGCATGAG | CTC | chr12 | 21587442 | 21587463 | 21587447 | 21587442 | - |
| SEQ ID NO 28694 | TCACGAGAAGAGCATGAGAGTA | CTA | chr12 | 21587438 | 21587459 | 21587443 | 21587438 | - |
| SEQ ID NO 28695 | CTCTATGATTCAATTACCTCCC | CTC | chr12 | 21587411 | 21587432 | 21587416 | 21587411 | - |
| SEQ ID NO 28696 | TATGATTCAATTACCTCCCTCC | CTC | chr12 | 21587408 | 21587429 | 21587413 | 21587408 | - |
| SEQ ID NO 28697 | TGATTCAATTACCTCCCTCCAA | CTA | chr12 | 21587406 | 21587427 | 21587411 | 21587406 | - |
| SEQ ID NO 28698 | AATTACCTCCCTCCAAATCCCT | TTC | chr12 | 21587400 | 21587421 | 21587405 | 21587400 | - |
| SEQ ID NO 28699 | CCTCCCTCCAAATCCCTCCCAC | TTA | chr12 | 21587395 | 21587416 | 21587400 | 21587395 | - |
| SEQ ID NO 28700 | CCTCCAAATCCCTCCCACAACA | CTC | chr12 | 21587391 | 21587412 | 21587396 | 21587391 | - |
| SEQ ID NO 28701 | CAAATCCCTCCCACAACACGTG | CTC | chr12 | 21587387 | 21587408 | 21587392 | 21587387 | - |
| SEQ ID NO 28702 | CCACAACACGTGAGGATTATGG | CTC | chr12 | 21587377 | 21587398 | 21587382 | 21587377 | - |
| SEQ ID NO 28703 | TGGGAACTACAATTCAAGATGA | TTA | chr12 | 21587358 | 21587379 | 21587363 | 21587358 | - |
| SEQ ID NO 28704 | CAATTCAAGATGAGATTTGGGT | CTA | chr12 | 21587349 | 21587370 | 21587354 | 21587349 | - |
| SEQ ID NO 28705 | AAGATGAGATTTGGGTGGGGAC | TTC | chr12 | 21587343 | 21587364 | 21587348 | 21587343 | - |
| SEQ ID NO 28706 | GGGTGGGGACACAGTCAAGCTG | TTT | chr12 | 21587331 | 21587352 | 21587336 | 21587331 | - |
| SEQ ID NO 28707 | GGTGGGGACACAGTCAAGCTGT | TTG | chr12 | 21587330 | 21587351 | 21587335 | 21587330 | - |
| SEQ ID NO 28708 | TATCAGGGTACAAGCTCGGGTT | CTG | chr12 | 21587309 | 21587330 | 21587314 | 21587309 | - |
| SEQ ID NO 28709 | GGGTTCCTTACATATGTATGTT | CTC | chr12 | 21587292 | 21587313 | 21587297 | 21587292 | - |
| SEQ ID NO 28710 | CTTACATATGTATGTTGCATAG | TTC | chr12 | 21587286 | 21587307 | 21587291 | 21587286 | - |
| SEQ ID NO 28711 | ACATATGTATGTTGCATAGTGG | CTT | chr12 | 21587283 | 21587304 | 21587288 | 21587283 | - |
| SEQ ID NO 28712 | CATATGTATGTTGCATAGTGGT | TTA | chr12 | 21587282 | 21587303 | 21587287 | 21587282 | - |
| SEQ ID NO 28713 | CATAGTGGTGAAGTCTGAGCTT | TTG | chr12 | 21587269 | 21587290 | 21587274 | 21587269 | - |
| SEQ ID NO 28714 | AGCTTTTAGTGGACCATCACCT | CTG | chr12 | 21587252 | 21587273 | 21587257 | 21587252 | - |
| SEQ ID NO 28715 | TTAGTGGACCATCACCTGAAAA | CTT | chr12 | 21587247 | 21587268 | 21587252 | 21587247 | - |
| SEQ ID NO 28716 | TAGTGGACCATCACCTGAAAAG | TTT | chr12 | 21587246 | 21587267 | 21587251 | 21587246 | - |
| SEQ ID NO 28717 | AGTGGACCATCACCTGAAAAGT | TTT | chr12 | 21587245 | 21587266 | 21587250 | 21587245 | - |
| SEQ ID NO 28718 | GTGGACCATCACCTGAAAAGTG | TTA | chr12 | 21587244 | 21587265 | 21587249 | 21587244 | - |
| SEQ ID NO 28719 | AAAAGTGAATGTTGTATCCAAT | CTG | chr12 | 21587229 | 21587250 | 21587234 | 21587229 | - |

Figure 48 (Cont'd)

| | | | | | | | | |
|---|---|---|---|---|---|---|---|---|
| SEQ ID NO 28720 | TATCCAATCCGTAGTTTTTCAG | TTG | chr12 | 21587215 | 21587236 | 21587220 | 21587215 | - |
| SEQ ID NO 28721 | TTCAGTCCTCACCATACTCCTA | TTT | chr12 | 21587198 | 21587219 | 21587203 | 21587198 | - |
| SEQ ID NO 28722 | TCAGTCCTCACCATACTCCTAT | TTT | chr12 | 21587197 | 21587218 | 21587202 | 21587197 | - |
| SEQ ID NO 28723 | CAGTCCTCACCATACTCCTATC | TTT | chr12 | 21587196 | 21587217 | 21587201 | 21587196 | - |
| SEQ ID NO 28724 | AGTCCTCACCATACTCCTATCC | TTC | chr12 | 21587195 | 21587216 | 21587200 | 21587195 | - |
| SEQ ID NO 28725 | ACCATACTCCTATCCTCCCACC | CTC | chr12 | 21587188 | 21587209 | 21587193 | 21587188 | - |
| SEQ ID NO 28726 | CTATCCTCCCACCTTTCTCTAG | CTC | chr12 | 21587179 | 21587200 | 21587184 | 21587179 | - |
| SEQ ID NO 28727 | TCCTCCCACCTTTCTCTAGTCT | CTA | chr12 | 21587176 | 21587197 | 21587181 | 21587176 | - |
| SEQ ID NO 28728 | CCACCTTTCTCTAGTCTCAAGT | CTC | chr12 | 21587171 | 21587192 | 21587176 | 21587171 | - |
| SEQ ID NO 28729 | TCTCTAGTCTCAAGTGTCTATT | CTT | chr12 | 21587164 | 21587185 | 21587169 | 21587164 | - |
| SEQ ID NO 28730 | CTCTAGTCTCAAGTGTCTATTA | TTT | chr12 | 21587163 | 21587184 | 21587168 | 21587163 | - |
| SEQ ID NO 28731 | TCTAGTCTCAAGTGTCTATTAT | TTC | chr12 | 21587162 | 21587183 | 21587167 | 21587162 | - |
| SEQ ID NO 28732 | TAGTCTCAAGTGTCTATTATTT | CTC | chr12 | 21587160 | 21587181 | 21587165 | 21587160 | - |
| SEQ ID NO 28733 | GTCTCAAGTGTCTATTATTTCA | CTA | chr12 | 21587158 | 21587179 | 21587163 | 21587158 | - |
| SEQ ID NO 28734 | AAGTGTCTATTATTTCATTCTA | CTC | chr12 | 21587153 | 21587174 | 21587158 | 21587153 | - |
| SEQ ID NO 28735 | TTATTTCATTCTATATGTCTAT | CTA | chr12 | 21587144 | 21587165 | 21587149 | 21587144 | - |
| SEQ ID NO 28736 | TTTCATTCTATATGTCTATGCT | TTA | chr12 | 21587141 | 21587162 | 21587146 | 21587141 | - |
| SEQ ID NO 28737 | CATTCTATATGTCTATGCTTAC | TTT | chr12 | 21587138 | 21587159 | 21587143 | 21587138 | - |
| SEQ ID NO 28738 | ATTCTATATGTCTATGCTTACT | TTC | chr12 | 21587137 | 21587158 | 21587142 | 21587137 | - |
| SEQ ID NO 28739 | TATATGTCTATGCTTACTCATC | TTC | chr12 | 21587133 | 21587154 | 21587138 | 21587133 | - |
| SEQ ID NO 28740 | TATGTCTATGCTTACTCATCGT | CTA | chr12 | 21587131 | 21587152 | 21587136 | 21587131 | - |
| SEQ ID NO 28741 | TGCTTACTCATCGTTTAGCTCC | CTA | chr12 | 21587123 | 21587144 | 21587128 | 21587123 | - |
| SEQ ID NO 28742 | ACTCATCGTTTAGCTCCCACTT | CTT | chr12 | 21587118 | 21587139 | 21587123 | 21587118 | - |
| SEQ ID NO 28743 | CTCATCGTTTAGCTCCCACTTG | TTA | chr12 | 21587117 | 21587138 | 21587122 | 21587117 | - |
| SEQ ID NO 28744 | ATCGTTTAGCTCCCACTTGGCT | CTC | chr12 | 21587114 | 21587135 | 21587119 | 21587114 | - |
| SEQ ID NO 28745 | AGCTCCCACTTGGCTCTCACTA | TTT | chr12 | 21587107 | 21587128 | 21587112 | 21587107 | - |
| SEQ ID NO 28746 | GCTCCCACTTGGCTCTCACTAA | TTA | chr12 | 21587106 | 21587127 | 21587111 | 21587106 | - |
| SEQ ID NO 28747 | CCACTTGGCTCTCACTAAATGA | CTC | chr12 | 21587102 | 21587123 | 21587107 | 21587102 | - |
| SEQ ID NO 28748 | GGCTCTCACTAAATGAGAACAT | CTT | chr12 | 21587096 | 21587117 | 21587101 | 21587096 | - |
| SEQ ID NO 28749 | GCTCTCACTAAATGAGAACATA | TTG | chr12 | 21587095 | 21587116 | 21587100 | 21587095 | - |
| SEQ ID NO 28750 | TCACTAAATGAGAACATACTGT | CTC | chr12 | 21587091 | 21587112 | 21587096 | 21587091 | - |
| SEQ ID NO 28751 | ACTAAATGAGAACATACTGTGT | CTC | chr12 | 21587089 | 21587110 | 21587094 | 21587089 | - |
| SEQ ID NO 28752 | AATGAGAACATACTGTGTTTGA | CTA | chr12 | 21587085 | 21587106 | 21587090 | 21587085 | - |
| SEQ ID NO 28753 | TGTTTGACTTCTGTTTCTGAG | CTG | chr12 | 21587070 | 21587091 | 21587075 | 21587070 | - |
| SEQ ID NO 28754 | GACTTCTGTTTCTGAGTTATT | TTT | chr12 | 21587065 | 21587086 | 21587070 | 21587065 | - |
| SEQ ID NO 28755 | ACTTTCTGTTTCTGAGTTATTT | TTG | chr12 | 21587064 | 21587085 | 21587069 | 21587064 | - |
| SEQ ID NO 28756 | TCTGTTTCTGAGTTATTTCACT | CTT | chr12 | 21587060 | 21587081 | 21587065 | 21587060 | - |
| SEQ ID NO 28757 | CTGTTTCTGAGTTATTTCACTG | TTT | chr12 | 21587059 | 21587080 | 21587064 | 21587059 | - |
| SEQ ID NO 28758 | TGTTTCTGAGTTATTTCACTGA | TTC | chr12 | 21587058 | 21587079 | 21587063 | 21587058 | - |
| SEQ ID NO 28759 | TTTCTGAGTTATTTCACTGAGG | CTG | chr12 | 21587056 | 21587077 | 21587061 | 21587056 | - |
| SEQ ID NO 28760 | CTGAGTTATTTCACTGAGGATA | TTT | chr12 | 21587053 | 21587074 | 21587058 | 21587053 | - |
| SEQ ID NO 28761 | TGAGTTATTTCACTGAGGATAA | TTC | chr12 | 21587052 | 21587073 | 21587057 | 21587052 | - |
| SEQ ID NO 28762 | AGTTATTTCACTGAGGATAATG | CTG | chr12 | 21587050 | 21587071 | 21587055 | 21587050 | - |
| SEQ ID NO 28763 | TTTCACTGAGGATAATGTCCTC | TTA | chr12 | 21587045 | 21587066 | 21587050 | 21587045 | - |
| SEQ ID NO 28764 | CACTGAGGATAATGTCCTCCAG | TTT | chr12 | 21587042 | 21587063 | 21587047 | 21587042 | - |
| SEQ ID NO 28765 | ACTGAGGATAATGTCCTCCAGT | TTC | chr12 | 21587041 | 21587062 | 21587046 | 21587041 | - |
| SEQ ID NO 28766 | AGGATAATGTCCTCCAGTTCTA | CTG | chr12 | 21587037 | 21587058 | 21587042 | 21587037 | - |
| SEQ ID NO 28767 | CAGTTCTAACCATGTTTCTAGA | CTC | chr12 | 21587023 | 21587044 | 21587028 | 21587023 | - |
| SEQ ID NO 28768 | TAACCATGTTTCTAGAGAAGAC | TTC | chr12 | 21587017 | 21587038 | 21587022 | 21587017 | - |
| SEQ ID NO 28769 | ACCATGTTTCTAGAGAAGACAT | CTA | chr12 | 21587015 | 21587036 | 21587020 | 21587015 | - |
| SEQ ID NO 28770 | CTAGAGAAGACATGATTTCATT | TTT | chr12 | 21587006 | 21587027 | 21587011 | 21587006 | - |
| SEQ ID NO 28771 | TAGAGAAGACATGATTTCATTC | TTC | chr12 | 21587005 | 21587026 | 21587010 | 21587005 | - |
| SEQ ID NO 28772 | GAGAAGACATGATTTCATTCTT | CTA | chr12 | 21587003 | 21587024 | 21587008 | 21587003 | - |
| SEQ ID NO 28773 | CATTCTTTTTTATGGCTGAGTA | TTT | chr12 | 21586988 | 21587009 | 21586993 | 21586988 | - |
| SEQ ID NO 28774 | ATTCTTTTTTATGGCTGAGTAA | TTC | chr12 | 21586987 | 21587008 | 21586992 | 21586987 | - |
| SEQ ID NO 28775 | TTTTTTATGGCTGAGTAATATA | TTC | chr12 | 21586983 | 21587004 | 21586988 | 21586983 | - |
| SEQ ID NO 28776 | TTTTATGGCTGAGTAATATATA | CTT | chr12 | 21586981 | 21587002 | 21586986 | 21586981 | - |
| SEQ ID NO 28777 | TTTATGGCTGAGTAATATATAT | TTT | chr12 | 21586980 | 21587001 | 21586985 | 21586980 | - |

Figure 48 (Cont'd)

| | | | | | | | | |
|---|---|---|---|---|---|---|---|---|
| SEQ ID NO 28778 | TTATGGCTGAGTAATATATATG | TTT | chr12 | 21586979 | 21587000 | 21586984 | 21586979 | - |
| SEQ ID NO 28779 | TATGGCTGAGTAATATATATGT | TTT | chr12 | 21586978 | 21586999 | 21586983 | 21586978 | - |
| SEQ ID NO 28780 | ATGGCTGAGTAATATATATGTA | TTT | chr12 | 21586977 | 21586998 | 21586982 | 21586977 | - |
| SEQ ID NO 28781 | TGGCTGAGTAATATATATGTAT | TTA | chr12 | 21586976 | 21586997 | 21586981 | 21586976 | - |
| SEQ ID NO 28782 | AGTAATATATGTATATAAAT | CTG | chr12 | 21586970 | 21586991 | 21586975 | 21586970 | - |
| SEQ ID NO 28783 | TCTTTATCCAATCGTCCATTGG | TTT | chr12 | 21586931 | 21586952 | 21586936 | 21586931 | - |
| SEQ ID NO 28784 | CTTTATCCAATCGTCCATTGGT | TTT | chr12 | 21586930 | 21586951 | 21586935 | 21586930 | - |
| SEQ ID NO 28785 | TTTATCCAATCGTCCATTGGTA | TTC | chr12 | 21586929 | 21586950 | 21586934 | 21586929 | - |
| SEQ ID NO 28786 | TATCCAATCGTCCATTGGTAGA | CTT | chr12 | 21586927 | 21586948 | 21586932 | 21586927 | - |
| SEQ ID NO 28787 | ATCCAATCGTCCATTGGTAGAC | TTT | chr12 | 21586926 | 21586947 | 21586931 | 21586926 | - |
| SEQ ID NO 28788 | TCCAATCGTCCATTGGTAGACA | TTA | chr12 | 21586925 | 21586946 | 21586930 | 21586925 | - |
| SEQ ID NO 28789 | GTAGACATTTAGGTTGATTCCA | TTG | chr12 | 21586910 | 21586931 | 21586915 | 21586910 | - |
| SEQ ID NO 28790 | AGGTTGATTCCATATCTTTGCT | TTT | chr12 | 21586900 | 21586921 | 21586905 | 21586900 | - |
| SEQ ID NO 28791 | GGTTGATTCCATATCTTTGCTA | TTA | chr12 | 21586899 | 21586920 | 21586904 | 21586899 | - |
| SEQ ID NO 28792 | ATTCCATATCTTTGCTATTGGG | TTG | chr12 | 21586894 | 21586915 | 21586899 | 21586894 | - |
| SEQ ID NO 28793 | CATATCTTTGCTATTGGGAACA | TTC | chr12 | 21586890 | 21586911 | 21586895 | 21586890 | - |
| SEQ ID NO 28794 | TGCTATTGGGAACAGTGCTACT | CTT | chr12 | 21586882 | 21586903 | 21586887 | 21586882 | - |
| SEQ ID NO 28795 | GCTATTGGGAACAGTGCTACTT | TTT | chr12 | 21586881 | 21586902 | 21586886 | 21586881 | - |
| SEQ ID NO 28796 | CTATTGGGAACAGTGCTACTTT | TTG | chr12 | 21586880 | 21586901 | 21586885 | 21586880 | - |
| SEQ ID NO 28797 | TTGGGAACAGTGCTACTTTGAA | CTA | chr12 | 21586877 | 21586898 | 21586882 | 21586877 | - |
| SEQ ID NO 28798 | GGAACAGTGCTACTTTGAACAT | TTG | chr12 | 21586874 | 21586895 | 21586879 | 21586874 | - |
| SEQ ID NO 28799 | CTTTGAACATACTAATGCAGAT | CTA | chr12 | 21586862 | 21586883 | 21586867 | 21586862 | - |
| SEQ ID NO 28800 | TGAACATACTAATGCAGATATC | CTT | chr12 | 21586859 | 21586880 | 21586864 | 21586859 | - |
| SEQ ID NO 28801 | GAACATACTAATGCAGATATCT | TTT | chr12 | 21586858 | 21586879 | 21586863 | 21586858 | - |
| SEQ ID NO 28802 | AACATACTAATGCAGATATCTT | TTG | chr12 | 21586857 | 21586878 | 21586862 | 21586857 | - |
| SEQ ID NO 28803 | ATGCAGATATCTTTTTTAATAT | CTA | chr12 | 21586848 | 21586869 | 21586853 | 21586848 | - |
| SEQ ID NO 28804 | TTTTAATATGATCTCTTTCACT | CTT | chr12 | 21586835 | 21586856 | 21586840 | 21586835 | - |
| SEQ ID NO 28805 | TTTAATATGATCTCTTTCACTT | TTT | chr12 | 21586834 | 21586855 | 21586839 | 21586834 | - |
| SEQ ID NO 28806 | TTAATATGATCTCTTTCACTTT | TTT | chr12 | 21586833 | 21586854 | 21586838 | 21586833 | - |
| SEQ ID NO 28807 | TAATATGATCTCTTTCACTTTG | TTT | chr12 | 21586832 | 21586853 | 21586837 | 21586832 | - |
| SEQ ID NO 28808 | AATATGATCTCTTTCACTTTGG | TTT | chr12 | 21586831 | 21586852 | 21586836 | 21586831 | - |
| SEQ ID NO 28809 | ATATGATCTCTTTCACTTTGGG | TTA | chr12 | 21586830 | 21586851 | 21586835 | 21586830 | - |
| SEQ ID NO 28810 | TTTCACTTTGGGTCCATACCCA | CTC | chr12 | 21586820 | 21586841 | 21586825 | 21586820 | - |
| SEQ ID NO 28811 | TCACTTTGGGTCCATACCCAGT | CTT | chr12 | 21586818 | 21586839 | 21586823 | 21586818 | - |
| SEQ ID NO 28812 | CACTTTGGGTCCATACCCAGTA | TTT | chr12 | 21586817 | 21586838 | 21586822 | 21586817 | - |
| SEQ ID NO 28813 | ACTTTGGGTCCATACCCAGTAG | TTC | chr12 | 21586816 | 21586837 | 21586821 | 21586816 | - |
| SEQ ID NO 28814 | TGGGTCCATACCCAGTAGTGGG | CTT | chr12 | 21586812 | 21586833 | 21586817 | 21586812 | - |
| SEQ ID NO 28815 | GGGTCCATACCCAGTAGTGGGA | TTT | chr12 | 21586811 | 21586832 | 21586816 | 21586811 | - |
| SEQ ID NO 28816 | GGTCCATACCCAGTAGTGGGAT | TTG | chr12 | 21586810 | 21586831 | 21586815 | 21586810 | - |
| SEQ ID NO 28817 | CAGGATTGAATGGTAGTTCTGT | TTG | chr12 | 21586786 | 21586807 | 21586791 | 21586786 | - |
| SEQ ID NO 28818 | AATGGTAGTTCTGTTTCTAGTT | TTG | chr12 | 21586778 | 21586799 | 21586783 | 21586778 | - |
| SEQ ID NO 28819 | TGTTTCTAGTTCTTTAAGAAAT | TTC | chr12 | 21586767 | 21586788 | 21586772 | 21586767 | - |
| SEQ ID NO 28820 | TTTCTAGTTCTTTAAGAAATCT | CTG | chr12 | 21586765 | 21586786 | 21586770 | 21586765 | - |
| SEQ ID NO 28821 | CTAGTTCTTTAAGAAATCTTCA | TTT | chr12 | 21586762 | 21586783 | 21586767 | 21586762 | - |
| SEQ ID NO 28822 | TAGTTCTTTAAGAAATCTTCAT | TTC | chr12 | 21586761 | 21586782 | 21586766 | 21586761 | - |
| SEQ ID NO 28823 | GTTCTTTAAGAAATCTTCATGC | CTA | chr12 | 21586759 | 21586780 | 21586764 | 21586759 | - |
| SEQ ID NO 28824 | TTTAAGAAATCTTCATGCTGTC | TTC | chr12 | 21586755 | 21586776 | 21586760 | 21586755 | - |
| SEQ ID NO 28825 | TAAGAAATCTTCATGCTGTCTT | CTT | chr12 | 21586753 | 21586774 | 21586758 | 21586753 | - |
| SEQ ID NO 28826 | AAGAAATCTTCATGCTGTCTTC | TTT | chr12 | 21586752 | 21586773 | 21586757 | 21586752 | - |
| SEQ ID NO 28827 | AGAAATCTTCATGCTGTCTTCC | TTA | chr12 | 21586751 | 21586772 | 21586756 | 21586751 | - |
| SEQ ID NO 28828 | CATGCTGTCTTCCATAAAGTTT | CTT | chr12 | 21586742 | 21586763 | 21586747 | 21586742 | - |
| SEQ ID NO 28829 | ATGCTGTCTTCCATAAAGTTTG | TTC | chr12 | 21586741 | 21586762 | 21586746 | 21586741 | - |
| SEQ ID NO 28830 | TCTTCCATAAAGTTTGTACTAA | CTG | chr12 | 21586735 | 21586756 | 21586740 | 21586735 | - |
| SEQ ID NO 28831 | CCATAAAGTTTGTACTAATTTA | CTT | chr12 | 21586731 | 21586752 | 21586736 | 21586731 | - |
| SEQ ID NO 28832 | CATAAAGTTTGTACTAATTTAC | TTC | chr12 | 21586730 | 21586751 | 21586735 | 21586730 | - |
| SEQ ID NO 28833 | GTACTAATTTACATTCTTACCA | TTT | chr12 | 21586720 | 21586741 | 21586725 | 21586720 | - |
| SEQ ID NO 28834 | TACTAATTTACATTCTTACCAA | TTG | chr12 | 21586719 | 21586740 | 21586724 | 21586719 | - |
| SEQ ID NO 28835 | ATTTACATTCTTACCAACAGTG | CTA | chr12 | 21586714 | 21586735 | 21586719 | 21586714 | - |

Figure 48 (Cont'd)

| SEQ ID NO 28836 | ACATTCTTACCAACAGTGTATA | TTT | chr12 | 21586710 | 21586731 | 21586715 | 21586710 | - |
|---|---|---|---|---|---|---|---|---|
| SEQ ID NO 28837 | CATTCTTACCAACAGTGTATAA | TTA | chr12 | 21586709 | 21586730 | 21586714 | 21586709 | - |
| SEQ ID NO 28838 | TTACCAACAGTGTATAAGCATT | TTC | chr12 | 21586704 | 21586725 | 21586709 | 21586704 | - |
| SEQ ID NO 28839 | ACCAACAGTGTATAAGCATTTT | CTT | chr12 | 21586702 | 21586723 | 21586707 | 21586702 | - |
| SEQ ID NO 28840 | CCAACAGTGTATAAGCATTTTC | TTA | chr12 | 21586701 | 21586722 | 21586706 | 21586701 | - |
| SEQ ID NO 28841 | TCTTGTCTCCACATCCTCACCA | TTT | chr12 | 21586681 | 21586702 | 21586686 | 21586681 | - |
| SEQ ID NO 28842 | CTTGTCTCCACATCCTCACCAA | TTT | chr12 | 21586680 | 21586701 | 21586685 | 21586680 | - |
| SEQ ID NO 28843 | TTGTCTCCACATCCTCACCAAC | TTC | chr12 | 21586679 | 21586700 | 21586684 | 21586679 | - |
| SEQ ID NO 28844 | GTCTCCACATCCTCACCAACAT | CTT | chr12 | 21586677 | 21586698 | 21586682 | 21586677 | - |
| SEQ ID NO 28845 | TCTCCACATCCTCACCAACATC | TTG | chr12 | 21586676 | 21586697 | 21586681 | 21586676 | - |
| SEQ ID NO 28846 | CACATCCTCACCAACATCTGCT | CTC | chr12 | 21586672 | 21586693 | 21586677 | 21586672 | - |
| SEQ ID NO 28847 | ACCAACATCTGCTGTTTTTGAA | CTC | chr12 | 21586663 | 21586684 | 21586668 | 21586663 | - |
| SEQ ID NO 28848 | CTGTTTTTGAACTTTATAATGA | CTG | chr12 | 21586652 | 21586673 | 21586657 | 21586652 | - |
| SEQ ID NO 28849 | TTTTTGAACTTTATAATGATAG | CTG | chr12 | 21586649 | 21586670 | 21586654 | 21586649 | - |
| SEQ ID NO 28850 | TTGAACTTTATAATGATAGCCA | TTT | chr12 | 21586646 | 21586667 | 21586651 | 21586646 | - |
| SEQ ID NO 28851 | TGAACTTTATAATGATAGCCAT | TTT | chr12 | 21586645 | 21586666 | 21586650 | 21586645 | - |
| SEQ ID NO 28852 | GAACTTTATAATGATAGCCATT | TTT | chr12 | 21586644 | 21586665 | 21586649 | 21586644 | - |
| SEQ ID NO 28853 | AACTTTATAATGATAGCCATTC | TTG | chr12 | 21586643 | 21586664 | 21586648 | 21586643 | - |
| SEQ ID NO 28854 | TATAATGATAGCCATTCTGACT | CTT | chr12 | 21586638 | 21586659 | 21586643 | 21586638 | - |
| SEQ ID NO 28855 | ATAATGATAGCCATTCTGACTG | TTT | chr12 | 21586637 | 21586658 | 21586642 | 21586637 | - |
| SEQ ID NO 28856 | TAATGATAGCCATTCTGACTGG | TTA | chr12 | 21586636 | 21586657 | 21586641 | 21586636 | - |
| SEQ ID NO 28857 | TGACTGGCATAAGGAGGTATCA | TTC | chr12 | 21586621 | 21586642 | 21586626 | 21586621 | - |
| SEQ ID NO 28858 | ACTGGCATAAGGAGGTATCATA | CTG | chr12 | 21586619 | 21586640 | 21586624 | 21586619 | - |
| SEQ ID NO 28859 | GCATAAGGAGGTATCATATGGT | CTG | chr12 | 21586615 | 21586636 | 21586620 | 21586615 | - |
| SEQ ID NO 28860 | TAATTGCATTCTCTGATTATT | TTT | chr12 | 21586588 | 21586609 | 21586593 | 21586588 | - |
| SEQ ID NO 28861 | AATTTGCATTCTCTGATTATTA | TTT | chr12 | 21586587 | 21586608 | 21586592 | 21586587 | - |
| SEQ ID NO 28862 | ATTTGCATTCTCTGATTATTAG | TTA | chr12 | 21586586 | 21586607 | 21586591 | 21586586 | - |
| SEQ ID NO 28863 | GCATTCTCTGATTATTAGTGAT | TTT | chr12 | 21586582 | 21586603 | 21586587 | 21586582 | - |
| SEQ ID NO 28864 | CATTCTCTGATTATTAGTGATG | TTG | chr12 | 21586581 | 21586602 | 21586586 | 21586581 | - |
| SEQ ID NO 28865 | TCTGATTATTAGTGATGTTGAA | TTC | chr12 | 21586576 | 21586597 | 21586581 | 21586576 | - |
| SEQ ID NO 28866 | TGATTATTAGTGATGTTGAACT | CTC | chr12 | 21586574 | 21586595 | 21586579 | 21586574 | - |
| SEQ ID NO 28867 | ATTATTAGTGATGTTGAACTTT | CTG | chr12 | 21586572 | 21586593 | 21586577 | 21586572 | - |
| SEQ ID NO 28868 | TTAGTGATGTTGAACTTTTTTT | TTA | chr12 | 21586568 | 21586589 | 21586573 | 21586568 | - |
| SEQ ID NO 28869 | GTGATGTTGAACTTTTTTTTGA | TTA | chr12 | 21586565 | 21586586 | 21586570 | 21586565 | - |
| SEQ ID NO 28870 | AACTTTTTTTTGACGTTTATTG | TTG | chr12 | 21586556 | 21586577 | 21586561 | 21586556 | - |
| SEQ ID NO 28871 | TTTTTTGACGTTTATTGGCCAC | CTT | chr12 | 21586551 | 21586572 | 21586556 | 21586551 | - |
| SEQ ID NO 28872 | TTTTTGACGTTTATTGGCCACT | TTT | chr12 | 21586550 | 21586571 | 21586555 | 21586550 | - |
| SEQ ID NO 28873 | TTTTGACGTTTATTGGCCACTT | TTT | chr12 | 21586549 | 21586570 | 21586554 | 21586549 | - |
| SEQ ID NO 28874 | TTTGACGTTTATTGGCCACTTG | TTT | chr12 | 21586548 | 21586569 | 21586553 | 21586548 | - |
| SEQ ID NO 28875 | TTGACGTTTATTGGCCACTTGT | TTT | chr12 | 21586547 | 21586568 | 21586552 | 21586547 | - |
| SEQ ID NO 28876 | TGACGTTTATTGGCCACTTGTA | TTT | chr12 | 21586546 | 21586567 | 21586551 | 21586546 | - |
| SEQ ID NO 28877 | GACGTTTATTGGCCACTTGTAT | TTT | chr12 | 21586545 | 21586566 | 21586550 | 21586545 | - |
| SEQ ID NO 28878 | ACGTTTATTGGCCACTTGTATG | TTG | chr12 | 21586544 | 21586565 | 21586549 | 21586544 | - |
| SEQ ID NO 28879 | ATTGGCCACTTGTATGTCTTCT | TTT | chr12 | 21586538 | 21586559 | 21586543 | 21586538 | - |
| SEQ ID NO 28880 | TTGGCCACTTGTATGTCTTCTT | TTA | chr12 | 21586537 | 21586558 | 21586542 | 21586537 | - |
| SEQ ID NO 28881 | GCCACTTGTATGTCTTCTTTTG | TTG | chr12 | 21586534 | 21586555 | 21586539 | 21586534 | - |
| SEQ ID NO 28882 | GTATGTCTTCTTTTGGAAAATG | CTT | chr12 | 21586527 | 21586548 | 21586532 | 21586527 | - |
| SEQ ID NO 28883 | TATGTCTTCTTTTGGAAAATGT | TTG | chr12 | 21586526 | 21586547 | 21586531 | 21586526 | - |
| SEQ ID NO 28884 | CTTTTGGAAAATGTCTGCTCAG | CTT | chr12 | 21586518 | 21586539 | 21586523 | 21586518 | - |
| SEQ ID NO 28885 | TTTTGGAAAATGTCTGCTCAGG | TTC | chr12 | 21586517 | 21586538 | 21586522 | 21586517 | - |
| SEQ ID NO 28886 | TTGGAAAATGTCTGCTCAGGAC | CTT | chr12 | 21586515 | 21586536 | 21586520 | 21586515 | - |
| SEQ ID NO 28887 | TGGAAAATGTCTGCTCAGGACC | TTT | chr12 | 21586514 | 21586535 | 21586519 | 21586514 | - |
| SEQ ID NO 28888 | GGAAAATGTCTGCTCAGGACCT | TTT | chr12 | 21586513 | 21586534 | 21586518 | 21586513 | - |
| SEQ ID NO 28889 | GAAAATGTCTGCTCAGGACCTG | TTG | chr12 | 21586512 | 21586533 | 21586517 | 21586512 | - |
| SEQ ID NO 28890 | CTCAGGACCTGAGCTCACTGTA | CTG | chr12 | 21586501 | 21586522 | 21586506 | 21586501 | - |
| SEQ ID NO 28891 | AGGACCTGAGCTCACTGTATTT | CTC | chr12 | 21586498 | 21586519 | 21586503 | 21586498 | - |
| SEQ ID NO 28892 | AGCTCACTGTATTTGTCAGGGT | CTG | chr12 | 21586490 | 21586511 | 21586495 | 21586490 | - |
| SEQ ID NO 28893 | ACTGTATTTGTCAGGGTTCCCT | CTC | chr12 | 21586485 | 21586506 | 21586490 | 21586485 | - |

Figure 48 (Cont'd)

| | | | | | | | | |
|---|---|---|---|---|---|---|---|---|
| SEQ ID NO 28894 | TATTTGTCAGGGTTCCCTAGAG | CTG | chr12 | 21586481 | 21586502 | 21586486 | 21586481 | - |
| SEQ ID NO 28895 | GTCAGGGTTCCCTAGAGAGACA | TTT | chr12 | 21586476 | 21586497 | 21586481 | 21586476 | - |
| SEQ ID NO 28896 | TCAGGGTTCCCTAGAGAGACAG | TTG | chr12 | 21586475 | 21586496 | 21586480 | 21586475 | - |
| SEQ ID NO 28897 | CCTAGAGAGACAGAACTAATAG | TTC | chr12 | 21586466 | 21586487 | 21586471 | 21586466 | - |
| SEQ ID NO 28898 | GAGAGACAGAACTAATAGGAGA | CTA | chr12 | 21586462 | 21586483 | 21586467 | 21586462 | - |
| SEQ ID NO 28899 | ATAGGAGATAGATAGATAGATA | CTA | chr12 | 21586448 | 21586469 | 21586453 | 21586448 | - |
| SEQ ID NO 28900 | AGATATAAAAGGGAGTTTATTA | TTT | chr12 | 21586391 | 21586412 | 21586396 | 21586391 | - |
| SEQ ID NO 28901 | GATATAAAAGGGAGTTTATTAA | TTA | chr12 | 21586390 | 21586411 | 21586395 | 21586390 | - |
| SEQ ID NO 28902 | ATTAAGTAGTGTTAACTTACAC | TTT | chr12 | 21586373 | 21586394 | 21586378 | 21586373 | - |
| SEQ ID NO 28903 | TTAAGTAGTGTTAACTTACACA | TTA | chr12 | 21586372 | 21586393 | 21586377 | 21586372 | - |
| SEQ ID NO 28904 | AGTAGTGTTAACTTACACAATC | TTA | chr12 | 21586369 | 21586390 | 21586374 | 21586369 | - |
| SEQ ID NO 28905 | ACTTACACAATCACAAGGTCCC | TTA | chr12 | 21586359 | 21586380 | 21586364 | 21586359 | - |
| SEQ ID NO 28906 | ACACAATCACAAGGTCCCACAA | CTT | chr12 | 21586355 | 21586376 | 21586360 | 21586355 | - |
| SEQ ID NO 28907 | CACAATCACAAGGTCCCACAAT | TTA | chr12 | 21586354 | 21586375 | 21586359 | 21586354 | - |
| SEQ ID NO 28908 | CAAGCAGAGGAGCAAGGAAGCC | CTG | chr12 | 21586322 | 21586343 | 21586327 | 21586322 | - |
| SEQ ID NO 28909 | AAGGACTTGGAGTCCAATGTTT | CTG | chr12 | 21586281 | 21586302 | 21586286 | 21586281 | - |
| SEQ ID NO 28910 | GGAGTCCAATGTTTGAGGGCAG | CTT | chr12 | 21586273 | 21586294 | 21586278 | 21586273 | - |
| SEQ ID NO 28911 | GAGTCCAATGTTTGAGGGCAGG | TTG | chr12 | 21586272 | 21586293 | 21586277 | 21586272 | - |
| SEQ ID NO 28912 | GAGGGCAGGAAGCATCCAGCAT | TTT | chr12 | 21586259 | 21586280 | 21586264 | 21586259 | - |
| SEQ ID NO 28913 | AGGGCAGGAAGCATCCAGCATG | TTG | chr12 | 21586258 | 21586279 | 21586263 | 21586258 | - |
| SEQ ID NO 28914 | GGAGGCTAAGCCAGTCCAGGAT | CTT | chr12 | 21586218 | 21586239 | 21586223 | 21586218 | - |
| SEQ ID NO 28915 | GAGGCTAAGCCAGTCCAGGATT | TTG | chr12 | 21586217 | 21586238 | 21586222 | 21586217 | - |
| SEQ ID NO 28916 | AGCCAGTCCAGGATTTTCACAT | CTA | chr12 | 21586210 | 21586231 | 21586215 | 21586210 | - |
| SEQ ID NO 28917 | TCACATGTTTTTTTTCTGCCTG | TTT | chr12 | 21586194 | 21586215 | 21586199 | 21586194 | - |
| SEQ ID NO 28918 | CACATGTTTTTTTTCTGCCTGC | TTT | chr12 | 21586193 | 21586214 | 21586198 | 21586193 | - |
| SEQ ID NO 28919 | ACATGTTTTTTTTCTGCCTGCT | TTC | chr12 | 21586192 | 21586213 | 21586197 | 21586192 | - |
| SEQ ID NO 28920 | TTTTTCTGCCTGCTTTATATCC | TTT | chr12 | 21586184 | 21586205 | 21586189 | 21586184 | - |
| SEQ ID NO 28921 | TTTTCTGCCTGCTTTATATCCT | TTT | chr12 | 21586183 | 21586204 | 21586188 | 21586183 | - |
| SEQ ID NO 28922 | TTTCTGCCTGCTTTATATCCTG | TTT | chr12 | 21586182 | 21586203 | 21586187 | 21586182 | - |
| SEQ ID NO 28923 | TTCTGCCTGCTTTATATCCTGG | TTT | chr12 | 21586181 | 21586202 | 21586186 | 21586181 | - |
| SEQ ID NO 28924 | TCTGCCTGCTTTATATCCTGGC | TTT | chr12 | 21586180 | 21586201 | 21586185 | 21586180 | - |
| SEQ ID NO 28925 | CTGCCTGCTTTATATCCTGGCC | TTT | chr12 | 21586179 | 21586200 | 21586184 | 21586179 | - |
| SEQ ID NO 28926 | TGCCTGCTTTATATCCTGGCCA | TTC | chr12 | 21586178 | 21586199 | 21586183 | 21586178 | - |
| SEQ ID NO 28927 | CCTGCTTTATATCCTGGCCACA | CTG | chr12 | 21586176 | 21586197 | 21586181 | 21586176 | - |
| SEQ ID NO 28928 | CTTTATATCCTGGCCACACTGG | CTG | chr12 | 21586172 | 21586193 | 21586177 | 21586172 | - |
| SEQ ID NO 28929 | TATATCCTGGCCACACTGGCAA | CTT | chr12 | 21586169 | 21586190 | 21586174 | 21586169 | - |
| SEQ ID NO 28930 | ATATCCTGGCCACACTGGCAAC | TTT | chr12 | 21586168 | 21586189 | 21586173 | 21586168 | - |
| SEQ ID NO 28931 | TATCCTGGCCACACTGGCAACT | TTA | chr12 | 21586167 | 21586188 | 21586172 | 21586167 | - |
| SEQ ID NO 28932 | GCCACACTGGCAACTGATTAGA | CTG | chr12 | 21586160 | 21586181 | 21586165 | 21586160 | - |
| SEQ ID NO 28933 | GCAACTGATTAGATGGTGCCCA | CTG | chr12 | 21586151 | 21586172 | 21586156 | 21586151 | - |
| SEQ ID NO 28934 | ATTAGATGGTGCCCACCCAGAT | CTG | chr12 | 21586144 | 21586165 | 21586149 | 21586144 | - |
| SEQ ID NO 28935 | GATGGTGCCCACCCAGATTAAG | TTA | chr12 | 21586140 | 21586161 | 21586145 | 21586140 | - |
| SEQ ID NO 28936 | AGGGTGGGTCTGCCTTTCCCAG | TTA | chr12 | 21586120 | 21586141 | 21586125 | 21586120 | - |
| SEQ ID NO 28937 | CCTTTCCCAGCCCACTGACTAA | CTG | chr12 | 21586108 | 21586129 | 21586113 | 21586108 | - |
| SEQ ID NO 28938 | TCCCAGCCCACTGACTAAAATG | CTT | chr12 | 21586104 | 21586125 | 21586109 | 21586104 | - |
| SEQ ID NO 28939 | CCCAGCCCACTGACTAAAATGT | TTT | chr12 | 21586103 | 21586124 | 21586108 | 21586103 | - |
| SEQ ID NO 28940 | CCAGCCCACTGACTAAAATGTT | TTC | chr12 | 21586102 | 21586123 | 21586107 | 21586102 | - |
| SEQ ID NO 28941 | ACTAAAATGTTAATCTCCTTTG | CTG | chr12 | 21586091 | 21586112 | 21586096 | 21586091 | - |
| SEQ ID NO 28942 | AAATGTTAATCTCCTTTGGCAA | CTA | chr12 | 21586087 | 21586108 | 21586092 | 21586087 | - |
| SEQ ID NO 28943 | ATCTCCTTTGGCAATACCCTCA | TTA | chr12 | 21586079 | 21586100 | 21586084 | 21586079 | - |
| SEQ ID NO 28944 | CTTTGGCAATACCCTCACAGAC | CTC | chr12 | 21586074 | 21586095 | 21586079 | 21586074 | - |
| SEQ ID NO 28945 | TGGCAATACCCTCACAGACACA | CTT | chr12 | 21586071 | 21586092 | 21586076 | 21586071 | - |
| SEQ ID NO 28946 | GGCAATACCCTCACAGACACAC | TTT | chr12 | 21586070 | 21586091 | 21586075 | 21586070 | - |
| SEQ ID NO 28947 | GCAATACCCTCACAGACACACT | TTG | chr12 | 21586069 | 21586090 | 21586074 | 21586069 | - |
| SEQ ID NO 28948 | ACAGACACACTCAGGATCAATA | CTC | chr12 | 21586058 | 21586079 | 21586063 | 21586058 | - |
| SEQ ID NO 28949 | AGGATCAATACTTTGCACACTT | CTC | chr12 | 21586046 | 21586067 | 21586051 | 21586046 | - |
| SEQ ID NO 28950 | TGCACACTTCAATCCAATCAAG | CTT | chr12 | 21586033 | 21586054 | 21586038 | 21586033 | - |
| SEQ ID NO 28951 | GCACACTTCAATCCAATCAAGT | TTT | chr12 | 21586032 | 21586053 | 21586037 | 21586032 | - |

Figure 48 (Cont'd)

| SEQ ID NO | Sequence | | | | | | |
|---|---|---|---|---|---|---|---|
| SEQ ID NO 28952 | CACACTTCAATCCAATCAAGTT | TTG | chr12 | 21586031 | 21586052 | 21586036 | 21586031 | - |
| SEQ ID NO 28953 | CAATCCAATCAAGTTGACACTC | CTT | chr12 | 21586024 | 21586045 | 21586029 | 21586024 | - |
| SEQ ID NO 28954 | AATCCAATCAAGTTGACACTCA | TTC | chr12 | 21586023 | 21586044 | 21586028 | 21586023 | - |
| SEQ ID NO 28955 | ACACTCAGTATTAACCATCACA | TTG | chr12 | 21586008 | 21586029 | 21586013 | 21586008 | - |
| SEQ ID NO 28956 | AGTATTAACCATCACAAGTCCA | CTC | chr12 | 21586002 | 21586023 | 21586007 | 21586002 | - |
| SEQ ID NO 28957 | ACCATCACAAGTCCATCGCTTG | TTA | chr12 | 21585995 | 21586016 | 21586000 | 21585995 | - |
| SEQ ID NO 28958 | GTCAACTTGAGCCTATACACAT | CTT | chr12 | 21585974 | 21585995 | 21585979 | 21585974 | - |
| SEQ ID NO 28959 | TCAACTTGAGCCTATACACATC | TTG | chr12 | 21585973 | 21585994 | 21585978 | 21585973 | - |
| SEQ ID NO 28960 | GAGCCTATACACATCCCCTGAG | CTT | chr12 | 21585966 | 21585987 | 21585971 | 21585966 | - |
| SEQ ID NO 28961 | AGCCTATACACATCCCCTGAGG | TTG | chr12 | 21585965 | 21585986 | 21585970 | 21585965 | - |
| SEQ ID NO 28962 | TACACATCCCCTGAGGTCATAC | CTA | chr12 | 21585959 | 21585980 | 21585964 | 21585959 | - |
| SEQ ID NO 28963 | AGGTCATACATTATCTTCAAAT | CTG | chr12 | 21585946 | 21585967 | 21585951 | 21585946 | - |
| SEQ ID NO 28964 | TCTTCAAATAAAGACAACAATA | TTA | chr12 | 21585933 | 21585954 | 21585938 | 21585933 | - |
| SEQ ID NO 28965 | CAAATAAAGACAACAATAAGTC | CTT | chr12 | 21585929 | 21585950 | 21585934 | 21585929 | - |
| SEQ ID NO 28966 | AAATAAAGACAACAATAAGTCA | TTC | chr12 | 21585928 | 21585949 | 21585933 | 21585928 | - |
| SEQ ID NO 28967 | TGCCTAACATACTAAAACTATC | TTA | chr12 | 21585900 | 21585921 | 21585905 | 21585900 | - |
| SEQ ID NO 28968 | ACATACTAAAACTATCCTTCGT | CTA | chr12 | 21585894 | 21585915 | 21585899 | 21585894 | - |
| SEQ ID NO 28969 | AAACTATCCTTCGTGCAATTGA | CTA | chr12 | 21585886 | 21585907 | 21585891 | 21585886 | - |
| SEQ ID NO 28970 | TCCTTCGTGCAATTGAAAATGC | CTA | chr12 | 21585880 | 21585901 | 21585885 | 21585880 | - |
| SEQ ID NO 28971 | CGTGCAATTGAAAATGCACCAA | CTT | chr12 | 21585875 | 21585896 | 21585880 | 21585875 | - |
| SEQ ID NO 28972 | GTGCAATTGAAAATGCACCAAT | TTC | chr12 | 21585874 | 21585895 | 21585879 | 21585874 | - |
| SEQ ID NO 28973 | AAAATGCACCAATCCCCATTGC | TTG | chr12 | 21585865 | 21585886 | 21585870 | 21585865 | - |
| SEQ ID NO 28974 | CAAATGCTATTACATAAACTTA | TTG | chr12 | 21585844 | 21585865 | 21585849 | 21585844 | - |
| SEQ ID NO 28975 | TTACATAAACTTAACAATACTT | CTA | chr12 | 21585835 | 21585856 | 21585840 | 21585835 | - |
| SEQ ID NO 28976 | CATAAACTTAACAATACTTAAA | TTA | chr12 | 21585832 | 21585853 | 21585837 | 21585832 | - |
| SEQ ID NO 28977 | AACAATACTTAAATGCTGATAT | CTT | chr12 | 21585823 | 21585844 | 21585828 | 21585823 | - |
| SEQ ID NO 28978 | ACAATACTTAAATGCTGATATG | TTA | chr12 | 21585822 | 21585843 | 21585827 | 21585822 | - |
| SEQ ID NO 28979 | AAATGCTGATATGAAGTCAATA | CTT | chr12 | 21585813 | 21585834 | 21585818 | 21585813 | - |
| SEQ ID NO 28980 | AATGCTGATATGAAGTCAATAA | TTA | chr12 | 21585812 | 21585833 | 21585817 | 21585812 | - |
| SEQ ID NO 28981 | ATATGAAGTCAATAAATCTTAT | CTG | chr12 | 21585805 | 21585826 | 21585810 | 21585805 | - |
| SEQ ID NO 28982 | ATGTCACATGATAAAGGAAAAA | CTT | chr12 | 21585785 | 21585806 | 21585790 | 21585785 | - |
| SEQ ID NO 28983 | TGTCACATGATAAAGGAAAAAG | TTA | chr12 | 21585784 | 21585805 | 21585789 | 21585784 | - |
| SEQ ID NO 28984 | TCTTAGTACAAGTGTATACAGA | TTT | chr12 | 21585742 | 21585763 | 21585747 | 21585742 | - |
| SEQ ID NO 28985 | CTTAGTACAAGTGTATACAGAC | TTT | chr12 | 21585741 | 21585762 | 21585746 | 21585741 | - |
| SEQ ID NO 28986 | TTAGTACAAGTGTATACAGACA | TTC | chr12 | 21585740 | 21585761 | 21585745 | 21585740 | - |
| SEQ ID NO 28987 | AGTACAAGTGTATACAGACACG | CTT | chr12 | 21585738 | 21585759 | 21585743 | 21585738 | - |
| SEQ ID NO 28988 | GTACAAGTGTATACAGACACGA | TTA | chr12 | 21585737 | 21585758 | 21585742 | 21585737 | - |
| SEQ ID NO 28989 | TTAACAAAAGAAGGAGGAAATA | TTT | chr12 | 21585707 | 21585728 | 21585712 | 21585707 | - |
| SEQ ID NO 28990 | TAACAAAAGAAGGAGGAAATAC | TTT | chr12 | 21585706 | 21585727 | 21585711 | 21585706 | - |
| SEQ ID NO 28991 | AACAAAAGAAGGAGGAAATACT | TTT | chr12 | 21585705 | 21585726 | 21585710 | 21585705 | - |
| SEQ ID NO 28992 | ACAAAAGAAGGAGGAAATACTC | TTA | chr12 | 21585704 | 21585725 | 21585709 | 21585704 | - |
| SEQ ID NO 28993 | ATGACAATTACAGTCCTTGTAT | CTC | chr12 | 21585682 | 21585703 | 21585687 | 21585682 | - |
| SEQ ID NO 28994 | CAGTCCTTGTATCTGCAATTGG | TTA | chr12 | 21585672 | 21585693 | 21585677 | 21585672 | - |
| SEQ ID NO 28995 | GTATCTGCAATTGGTCACGTGA | CTT | chr12 | 21585664 | 21585685 | 21585669 | 21585664 | - |
| SEQ ID NO 28996 | TATCTGCAATTGGTCACGTGAT | TTG | chr12 | 21585663 | 21585684 | 21585668 | 21585663 | - |
| SEQ ID NO 28997 | CAATTGGTCACGTGATCGTAGC | CTG | chr12 | 21585657 | 21585678 | 21585662 | 21585657 | - |
| SEQ ID NO 28998 | GTCACGTGATCGTAGCTGGTAT | TTG | chr12 | 21585651 | 21585672 | 21585656 | 21585651 | - |
| SEQ ID NO 28999 | GTATTGATGACTACCTTCTTCT | CTG | chr12 | 21585633 | 21585654 | 21585638 | 21585633 | - |
| SEQ ID NO 29000 | ATGACTACCTTCTTCTGCTACA | TTG | chr12 | 21585627 | 21585648 | 21585632 | 21585627 | - |
| SEQ ID NO 29001 | CCTTCTTCTGCTACATATTCTG | CTA | chr12 | 21585620 | 21585641 | 21585625 | 21585620 | - |
| SEQ ID NO 29002 | CTTCTGCTACATATTCTGTATT | CTT | chr12 | 21585616 | 21585637 | 21585621 | 21585616 | - |
| SEQ ID NO 29003 | TTCTGCTACATATTCTGTATTC | TTC | chr12 | 21585615 | 21585636 | 21585620 | 21585615 | - |
| SEQ ID NO 29004 | CTGCTACATATTCTGTATTCCC | CTT | chr12 | 21585613 | 21585634 | 21585618 | 21585613 | - |
| SEQ ID NO 29005 | TGCTACATATTCTGTATTCCCT | TTC | chr12 | 21585612 | 21585633 | 21585617 | 21585612 | - |
| SEQ ID NO 29006 | CTACATATTCTGTATTCCCTTT | CTG | chr12 | 21585610 | 21585631 | 21585615 | 21585610 | - |
| SEQ ID NO 29007 | CATATTCTGTATTCCCTTTGCC | CTA | chr12 | 21585607 | 21585628 | 21585612 | 21585607 | - |
| SEQ ID NO 29008 | TGTATTCCCTTTGCCCTCAGCA | TTC | chr12 | 21585600 | 21585621 | 21585605 | 21585600 | - |
| SEQ ID NO 29009 | TATTCCCTTTGCCCTCAGCAAG | CTG | chr12 | 21585598 | 21585619 | 21585603 | 21585598 | - |

Figure 48 (Cont'd)

| | | | | | | | | |
|---|---|---|---|---|---|---|---|---|
| SEQ ID NO 29010 | CCTTTGCCCTCAGCAAGCACCT | TTC | chr12 | 21585593 | 21585614 | 21585598 | 21585593 | - |
| SEQ ID NO 29011 | TGCCCTCAGCAAGCACCTCAGC | CTT | chr12 | 21585589 | 21585610 | 21585594 | 21585589 | - |
| SEQ ID NO 29012 | GCCCTCAGCAAGCACCTCAGCA | TTT | chr12 | 21585588 | 21585609 | 21585593 | 21585588 | - |
| SEQ ID NO 29013 | CCCTCAGCAAGCACCTCAGCAG | TTG | chr12 | 21585587 | 21585608 | 21585592 | 21585587 | - |
| SEQ ID NO 29014 | AGCAAGCACCTCAGCAGGTCTT | CTC | chr12 | 21585582 | 21585603 | 21585587 | 21585582 | - |
| SEQ ID NO 29015 | AGCAGGTCTTGTCTTTTTTTTT | CTC | chr12 | 21585570 | 21585591 | 21585575 | 21585570 | - |
| SEQ ID NO 29016 | GTCTTTTTTTTTTTTTTTTTTC | CTT | chr12 | 21585560 | 21585581 | 21585565 | 21585560 | - |
| SEQ ID NO 29017 | TCTTTTTTTTTTTTTTTTTTCC | TTG | chr12 | 21585559 | 21585580 | 21585564 | 21585559 | - |
| SEQ ID NO 29018 | TTTTTTTTTTTTTTTTCCTGGT | CTT | chr12 | 21585555 | 21585576 | 21585560 | 21585555 | - |
| SEQ ID NO 29019 | TTTTTTTTTTTTTTTCCTGGTG | TTT | chr12 | 21585554 | 21585575 | 21585559 | 21585554 | - |
| SEQ ID NO 29020 | TTTTTTTTTTTTTTCCTGGTGG | TTT | chr12 | 21585553 | 21585574 | 21585558 | 21585553 | - |
| SEQ ID NO 29021 | TTTTTTTTTTTTTCCTGGTGGA | TTT | chr12 | 21585552 | 21585573 | 21585557 | 21585552 | - |
| SEQ ID NO 29022 | TTTTTTTTTTTTCCTGGTGGAG | TTT | chr12 | 21585551 | 21585572 | 21585556 | 21585551 | - |
| SEQ ID NO 29023 | TTTTTTTTTTTCCTGGTGGAGT | TTT | chr12 | 21585550 | 21585571 | 21585555 | 21585550 | - |
| SEQ ID NO 29024 | TTTTTTTTTTCCTGGTGGAGTG | TTT | chr12 | 21585549 | 21585570 | 21585554 | 21585549 | - |
| SEQ ID NO 29025 | TTTTTTTTTCCTGGTGGAGTGA | TTT | chr12 | 21585548 | 21585569 | 21585553 | 21585548 | - |
| SEQ ID NO 29026 | TTTTTTTTCCTGGTGGAGTGAC | TTT | chr12 | 21585547 | 21585568 | 21585552 | 21585547 | - |
| SEQ ID NO 29027 | TTTTTTTCCTGGTGGAGTGACC | TTT | chr12 | 21585546 | 21585567 | 21585551 | 21585546 | - |
| SEQ ID NO 29028 | TTTTTTCCTGGTGGAGTGACCC | TTT | chr12 | 21585545 | 21585566 | 21585550 | 21585545 | - |
| SEQ ID NO 29029 | TTTTTCCTGGTGGAGTGACCCA | TTT | chr12 | 21585544 | 21585565 | 21585549 | 21585544 | - |
| SEQ ID NO 29030 | TTTTCCTGGTGGAGTGACCCAA | TTT | chr12 | 21585543 | 21585564 | 21585548 | 21585543 | - |
| SEQ ID NO 29031 | TTTCCTGGTGGAGTGACCCAAA | TTT | chr12 | 21585542 | 21585563 | 21585547 | 21585542 | - |
| SEQ ID NO 29032 | TTCCTGGTGGAGTGACCCAAAC | TTT | chr12 | 21585541 | 21585562 | 21585546 | 21585541 | - |
| SEQ ID NO 29033 | TCCTGGTGGAGTGACCCAAACC | TTT | chr12 | 21585540 | 21585561 | 21585545 | 21585540 | - |
| SEQ ID NO 29034 | CCTGGTGGAGTGACCCAAACCT | TTT | chr12 | 21585539 | 21585560 | 21585544 | 21585539 | - |
| SEQ ID NO 29035 | CTGGTGGAGTGACCCAAACCTT | TTC | chr12 | 21585538 | 21585559 | 21585543 | 21585538 | - |
| SEQ ID NO 29036 | GTGGAGTGACCCAAACCTTTAT | CTG | chr12 | 21585535 | 21585556 | 21585540 | 21585535 | - |
| SEQ ID NO 29037 | TATTTGTAGTCCTGCCTGGAAT | CTT | chr12 | 21585516 | 21585537 | 21585521 | 21585516 | - |
| SEQ ID NO 29038 | ATTTGTAGTCCTGCCTGGAATG | TTT | chr12 | 21585515 | 21585536 | 21585520 | 21585515 | - |
| SEQ ID NO 29039 | TTTGTAGTCCTGCCTGGAATGG | TTA | chr12 | 21585514 | 21585535 | 21585519 | 21585514 | - |
| SEQ ID NO 29040 | GTAGTCCTGCCTGGAATGGCCT | TTT | chr12 | 21585511 | 21585532 | 21585516 | 21585511 | - |
| SEQ ID NO 29041 | TAGTCCTGCCTGGAATGGCCTG | TTG | chr12 | 21585510 | 21585531 | 21585515 | 21585510 | - |
| SEQ ID NO 29042 | CCTGGAATGGCCTGTAGTAGTT | CTG | chr12 | 21585502 | 21585523 | 21585507 | 21585502 | - |
| SEQ ID NO 29043 | GAATGGCCTGTAGTAGTTTCCC | CTG | chr12 | 21585498 | 21585519 | 21585503 | 21585498 | - |
| SEQ ID NO 29044 | TAGTAGTTTCCCACTGACCTTA | CTG | chr12 | 21585488 | 21585509 | 21585493 | 21585488 | - |
| SEQ ID NO 29045 | CCCACTGACCTTAATTCCAGGA | TTT | chr12 | 21585479 | 21585500 | 21585484 | 21585479 | - |
| SEQ ID NO 29046 | CCACTGACCTTAATTCCAGGAC | TTC | chr12 | 21585478 | 21585499 | 21585483 | 21585478 | - |
| SEQ ID NO 29047 | ACCTTAATTCCAGGACATGGTA | CTG | chr12 | 21585472 | 21585493 | 21585477 | 21585472 | - |
| SEQ ID NO 29048 | AATTCCAGGACATGGTAAAACT | CTT | chr12 | 21585467 | 21585488 | 21585472 | 21585467 | - |
| SEQ ID NO 29049 | ATTCCAGGACATGGTAAAACTA | TTA | chr12 | 21585466 | 21585487 | 21585471 | 21585466 | - |
| SEQ ID NO 29050 | CAGGACATGGTAAAACTAAGAG | TTC | chr12 | 21585462 | 21585483 | 21585467 | 21585462 | - |
| SEQ ID NO 29051 | AGAGACACCCTAATGGATCTCC | CTA | chr12 | 21585444 | 21585465 | 21585449 | 21585444 | - |
| SEQ ID NO 29052 | ATGGATCTCCTATATTCCATGC | CTA | chr12 | 21585432 | 21585453 | 21585437 | 21585432 | - |
| SEQ ID NO 29053 | CTATATTCCATGCATACGCTTC | CTC | chr12 | 21585423 | 21585444 | 21585428 | 21585423 | - |
| SEQ ID NO 29054 | TATTCCATGCATACGCTTCCTT | CTA | chr12 | 21585420 | 21585441 | 21585425 | 21585420 | - |
| SEQ ID NO 29055 | CATGCATACGCTTCCTTACCTC | TTC | chr12 | 21585415 | 21585436 | 21585420 | 21585415 | - |
| SEQ ID NO 29056 | CCTTACCTCCATTGTGGAGTTG | CTT | chr12 | 21585402 | 21585423 | 21585407 | 21585402 | - |
| SEQ ID NO 29057 | CTTACCTCCATTGTGGAGTTGT | TTC | chr12 | 21585401 | 21585422 | 21585406 | 21585401 | - |
| SEQ ID NO 29058 | ACCTCCATTGTGGAGTTGTAGA | CTT | chr12 | 21585398 | 21585419 | 21585403 | 21585398 | - |
| SEQ ID NO 29059 | CCTCCATTGTGGAGTTGTAGAC | TTA | chr12 | 21585397 | 21585418 | 21585402 | 21585397 | - |
| SEQ ID NO 29060 | CATTGTGGAGTTGTAGACTGAT | CTC | chr12 | 21585393 | 21585414 | 21585398 | 21585393 | - |
| SEQ ID NO 29061 | TGGAGTTGTAGACTGATTTCAT | TTG | chr12 | 21585388 | 21585409 | 21585393 | 21585388 | - |
| SEQ ID NO 29062 | TAGACTGATTTCATCTTGATAG | TTG | chr12 | 21585380 | 21585401 | 21585385 | 21585380 | - |
| SEQ ID NO 29063 | ATTTCATCTTGATAGTCTGGGT | CTG | chr12 | 21585373 | 21585394 | 21585378 | 21585373 | - |
| SEQ ID NO 29064 | CATCTTGATAGTCTGGGTTAAT | TTT | chr12 | 21585369 | 21585390 | 21585374 | 21585369 | - |
| SEQ ID NO 29065 | ATCTTGATAGTCTGGGTTAATC | TTC | chr12 | 21585368 | 21585389 | 21585373 | 21585368 | - |
| SEQ ID NO 29066 | GATAGTCTGGGTTAATCACCGC | CTT | chr12 | 21585363 | 21585384 | 21585368 | 21585363 | - |
| SEQ ID NO 29067 | ATAGTCTGGGTTAATCACCGCA | TTG | chr12 | 21585362 | 21585383 | 21585367 | 21585362 | - |

Figure 48 (Cont'd)

| SEQ ID NO 29068 | GGTTAATCACCGCAGCCAACAC | CTG | chr12 | 21585354 | 21585375 | 21585359 | 21585354 | - |
|---|---|---|---|---|---|---|---|---|
| SEQ ID NO 29069 | ATCACCGCAGCCAACACTGTAA | TTA | chr12 | 21585349 | 21585370 | 21585354 | 21585349 | - |
| SEQ ID NO 29070 | TAACTCTCTTCTTAGCCTGTTG | CTG | chr12 | 21585330 | 21585351 | 21585335 | 21585330 | - |
| SEQ ID NO 29071 | TCTTCTTAGCCTGTTGACTTAA | CTC | chr12 | 21585324 | 21585345 | 21585329 | 21585324 | - |
| SEQ ID NO 29072 | TTCTTAGCCTGTTGACTTAAAG | CTC | chr12 | 21585322 | 21585343 | 21585327 | 21585322 | - |
| SEQ ID NO 29073 | CTTAGCCTGTTGACTTAAAGGT | CTT | chr12 | 21585320 | 21585341 | 21585325 | 21585320 | - |
| SEQ ID NO 29074 | TTAGCCTGTTGACTTAAAGGTG | TTC | chr12 | 21585319 | 21585340 | 21585324 | 21585319 | - |
| SEQ ID NO 29075 | AGCCTGTTGACTTAAAGGTGGG | CTT | chr12 | 21585317 | 21585338 | 21585322 | 21585317 | - |
| SEQ ID NO 29076 | GCCTGTTGACTTAAAGGTGGGA | TTA | chr12 | 21585316 | 21585337 | 21585321 | 21585316 | - |
| SEQ ID NO 29077 | TTGACTTAAAGGTGGGAGGAGC | CTG | chr12 | 21585311 | 21585332 | 21585316 | 21585311 | - |
| SEQ ID NO 29078 | ACTTAAAGGTGGGAGGAGCCCA | TTG | chr12 | 21585308 | 21585329 | 21585313 | 21585308 | - |
| SEQ ID NO 29079 | AAAGGTGGGAGGAGCCCAAAGT | CTT | chr12 | 21585304 | 21585325 | 21585309 | 21585304 | - |
| SEQ ID NO 29080 | AAGGTGGGAGGAGCCCAAAGTG | TTA | chr12 | 21585303 | 21585324 | 21585308 | 21585303 | - |
| SEQ ID NO 29081 | AATTTGCAGTTTAATGGAATCA | CTT | chr12 | 21585265 | 21585286 | 21585270 | 21585265 | - |
| SEQ ID NO 29082 | ATTTGCAGTTTAATGGAATCAT | TTA | chr12 | 21585264 | 21585285 | 21585269 | 21585264 | - |
| SEQ ID NO 29083 | GCAGTTTAATGGAATCATTATT | TTT | chr12 | 21585260 | 21585281 | 21585265 | 21585260 | - |
| SEQ ID NO 29084 | CAGTTTAATGGAATCATTATTG | TTG | chr12 | 21585259 | 21585280 | 21585264 | 21585259 | - |
| SEQ ID NO 29085 | AATGGAATCATTATTGTGTCAC | TTT | chr12 | 21585253 | 21585274 | 21585258 | 21585253 | - |
| SEQ ID NO 29086 | ATGGAATCATTATTGTGTCACC | TTA | chr12 | 21585252 | 21585273 | 21585257 | 21585252 | - |
| SEQ ID NO 29087 | TTGTGTCACCTGGCGGCAGTGT | TTA | chr12 | 21585240 | 21585261 | 21585245 | 21585240 | - |
| SEQ ID NO 29088 | TGTCACCTGGCGGCAGTGTTCC | TTG | chr12 | 21585237 | 21585258 | 21585242 | 21585237 | - |
| SEQ ID NO 29089 | GCGGCAGTGTTCCTCCCTCTGG | CTG | chr12 | 21585228 | 21585249 | 21585233 | 21585228 | - |
| SEQ ID NO 29090 | CTCCCTCTGGAACTAAGACCTC | TTC | chr12 | 21585216 | 21585237 | 21585221 | 21585216 | - |
| SEQ ID NO 29091 | CCTCTGGAACTAAGACCTCTAA | CTC | chr12 | 21585213 | 21585234 | 21585218 | 21585213 | - |
| SEQ ID NO 29092 | TGGAACTAAGACCTCTAAGCCA | CTC | chr12 | 21585209 | 21585230 | 21585214 | 21585209 | - |
| SEQ ID NO 29093 | GAACTAAGACCTCTAAGCCAGC | CTG | chr12 | 21585207 | 21585228 | 21585212 | 21585207 | - |
| SEQ ID NO 29094 | AGACCTCTAAGCCAGCAGAACA | CTA | chr12 | 21585201 | 21585222 | 21585206 | 21585201 | - |
| SEQ ID NO 29095 | TAAGCCAGCAGAACATAATGCC | CTC | chr12 | 21585194 | 21585215 | 21585199 | 21585194 | - |
| SEQ ID NO 29096 | AGCCAGCAGAACATAATGCCAT | CTA | chr12 | 21585192 | 21585213 | 21585197 | 21585192 | - |
| SEQ ID NO 29097 | TGCTAGTGGAACACTAGGGGTG | TTT | chr12 | 21585149 | 21585170 | 21585154 | 21585149 | - |
| SEQ ID NO 29098 | GCTAGTGGAACACTAGGGGTGA | TTT | chr12 | 21585148 | 21585169 | 21585153 | 21585148 | - |
| SEQ ID NO 29099 | CTAGTGGAACACTAGGGGTGAT | TTG | chr12 | 21585147 | 21585168 | 21585152 | 21585147 | - |
| SEQ ID NO 29100 | GTGGAACACTAGGGGTGATGGT | CTA | chr12 | 21585144 | 21585165 | 21585149 | 21585144 | - |
| SEQ ID NO 29101 | GGGGTGATGGTGAGTGGTGCCA | CTA | chr12 | 21585133 | 21585154 | 21585138 | 21585133 | - |
| SEQ ID NO 29102 | CCACTTCCACTTCCACCCTTTG | CTT | chr12 | 21585108 | 21585129 | 21585113 | 21585108 | - |
| SEQ ID NO 29103 | CACTTCCACTTCCACCCTTTGA | TTC | chr12 | 21585107 | 21585128 | 21585112 | 21585107 | - |
| SEQ ID NO 29104 | CCACTTCCACCCTTTGATTCCT | CTT | chr12 | 21585102 | 21585123 | 21585107 | 21585102 | - |
| SEQ ID NO 29105 | CACTTCCACCCTTTGATTCCTG | TTC | chr12 | 21585101 | 21585122 | 21585106 | 21585101 | - |
| SEQ ID NO 29106 | CCACCCTTTGATTCCTGGACCC | CTT | chr12 | 21585096 | 21585117 | 21585101 | 21585096 | - |
| SEQ ID NO 29107 | CACCCTTTGATTCCTGGACCCG | TTC | chr12 | 21585095 | 21585116 | 21585100 | 21585095 | - |
| SEQ ID NO 29108 | TGATTCCTGGACCCGTGAATCC | CTT | chr12 | 21585088 | 21585109 | 21585093 | 21585088 | - |
| SEQ ID NO 29109 | GATTCCTGGACCCGTGAATCCT | TTT | chr12 | 21585087 | 21585108 | 21585092 | 21585087 | - |
| SEQ ID NO 29110 | ATTCCTGGACCCGTGAATCCTG | TTG | chr12 | 21585086 | 21585107 | 21585091 | 21585086 | - |
| SEQ ID NO 29111 | CTGGACCCGTGAATCCTGTCTA | TTC | chr12 | 21585082 | 21585103 | 21585087 | 21585082 | - |
| SEQ ID NO 29112 | GACCCGTGAATCCTGTCTATGG | CTG | chr12 | 21585079 | 21585100 | 21585084 | 21585079 | - |
| SEQ ID NO 29113 | TCTATGGGAGAAACAGTACCAT | CTG | chr12 | 21585064 | 21585085 | 21585069 | 21585064 | - |
| SEQ ID NO 29114 | TGGGAGAAACAGTACCATATAT | CTA | chr12 | 21585060 | 21585081 | 21585065 | 21585060 | - |
| SEQ ID NO 29115 | GACACTGATTCAGAGCATACAC | TTG | chr12 | 21585036 | 21585057 | 21585041 | 21585036 | - |
| SEQ ID NO 29116 | ATTCAGAGCATACACAGCCTTC | CTG | chr12 | 21585029 | 21585050 | 21585034 | 21585029 | - |
| SEQ ID NO 29117 | AGAGCATACACAGCCTTCTGGA | TTC | chr12 | 21585025 | 21585046 | 21585030 | 21585025 | - |
| SEQ ID NO 29118 | CTGGGAGAACTTTGCCCCAGGCC | CTT | chr12 | 21585008 | 21585029 | 21585013 | 21585008 | - |
| SEQ ID NO 29119 | TGGAGAACTTTGCCCCAGGCCT | TTC | chr12 | 21585007 | 21585028 | 21585012 | 21585007 | - |
| SEQ ID NO 29120 | GAGAACTTTGCCCCAGGCCTGC | CTG | chr12 | 21585005 | 21585026 | 21585010 | 21585005 | - |
| SEQ ID NO 29121 | TGCCCCAGGCCTGCAAAGTATT | CTT | chr12 | 21584997 | 21585018 | 21585002 | 21584997 | - |
| SEQ ID NO 29122 | GCCCCAGGCCTGCAAAGTATTG | TTT | chr12 | 21584996 | 21585017 | 21585001 | 21584996 | - |
| SEQ ID NO 29123 | CCCCAGGCCTGCAAAGTATTGT | TTG | chr12 | 21584995 | 21585016 | 21585000 | 21584995 | - |
| SEQ ID NO 29124 | CAAAGTATTGTCACCTAGTTGG | CTG | chr12 | 21584984 | 21585005 | 21584989 | 21584984 | - |
| SEQ ID NO 29125 | TCACCTAGTTGGCATTGTAATC | TTG | chr12 | 21584974 | 21584995 | 21584979 | 21584974 | - |

Figure 48 (Cont'd)

| | | | | | | | | |
|---|---|---|---|---|---|---|---|---|
| SEQ ID NO 29126 | GTTGGCATTGTAATCGTGACTT | CTA | chr12 | 21584967 | 21584988 | 21584972 | 21584967 | - |
| SEQ ID NO 29127 | GCATTGTAATCGTGACTTCAAA | TTG | chr12 | 21584963 | 21584984 | 21584968 | 21584963 | - |
| SEQ ID NO 29128 | TAATCGTGACTTCAAAAGGCCA | TTG | chr12 | 21584957 | 21584978 | 21584962 | 21584957 | - |
| SEQ ID NO 29129 | CAAAAGGCCATTCAAAAGCTGC | CTT | chr12 | 21584945 | 21584966 | 21584950 | 21584945 | - |
| SEQ ID NO 29130 | AAAAGGCCATTCAAAAGCTGCT | TTC | chr12 | 21584944 | 21584965 | 21584949 | 21584944 | - |
| SEQ ID NO 29131 | AAAAGCTGCTTCAGGATGATAG | TTC | chr12 | 21584932 | 21584953 | 21584937 | 21584932 | - |
| SEQ ID NO 29132 | CTTCAGGATGATAGGGATCATG | CTG | chr12 | 21584924 | 21584945 | 21584929 | 21584924 | - |
| SEQ ID NO 29133 | CAGGATGATAGGGATCATGGTA | CTT | chr12 | 21584921 | 21584942 | 21584926 | 21584921 | - |
| SEQ ID NO 29134 | AGGATGATAGGGATCATGGTAA | TTC | chr12 | 21584920 | 21584941 | 21584925 | 21584920 | - |
| SEQ ID NO 29135 | CATGAGCATGAGCCCACTGTCA | TTC | chr12 | 21584885 | 21584906 | 21584890 | 21584885 | - |
| SEQ ID NO 29136 | TCACACTTCTTTAGCCATAAAG | CTG | chr12 | 21584866 | 21584887 | 21584871 | 21584866 | - |
| SEQ ID NO 29137 | CTTTAGCCATAAAGTGAGTGGC | CTT | chr12 | 21584858 | 21584879 | 21584863 | 21584858 | - |
| SEQ ID NO 29138 | TTTAGCCATAAAGTGAGTGGCT | TTC | chr12 | 21584857 | 21584878 | 21584862 | 21584857 | - |
| SEQ ID NO 29139 | TAGCCATAAAGTGAGTGGCTTG | CTT | chr12 | 21584855 | 21584876 | 21584860 | 21584855 | - |
| SEQ ID NO 29140 | AGCCATAAAGTGAGTGGCTTGG | TTT | chr12 | 21584854 | 21584875 | 21584859 | 21584854 | - |
| SEQ ID NO 29141 | GCCATAAAGTGAGTGGCTTGGT | TTA | chr12 | 21584853 | 21584874 | 21584858 | 21584853 | - |
| SEQ ID NO 29142 | GGTCAGAAGCAATGCTGTGTGG | CTT | chr12 | 21584834 | 21584855 | 21584839 | 21584834 | - |
| SEQ ID NO 29143 | GTCAGAAGCAATGCTGTGTGGA | TTG | chr12 | 21584833 | 21584854 | 21584838 | 21584833 | - |
| SEQ ID NO 29144 | TGTGGAATACCATGACAGTGGA | CTG | chr12 | 21584817 | 21584838 | 21584822 | 21584817 | - |
| SEQ ID NO 29145 | TGTGATTCCATGGATGGTAGTC | TTC | chr12 | 21584785 | 21584806 | 21584790 | 21584785 | - |
| SEQ ID NO 29146 | TGATTCCATGGATGGTAGTCTT | CTG | chr12 | 21584783 | 21584804 | 21584788 | 21584783 | - |
| SEQ ID NO 29147 | CATGGATGGTAGTCTTGGCATA | TTC | chr12 | 21584777 | 21584798 | 21584782 | 21584777 | - |
| SEQ ID NO 29148 | GGCATAAGCATTGAGTTCAGGA | CTT | chr12 | 21584761 | 21584782 | 21584766 | 21584761 | - |
| SEQ ID NO 29149 | GCATAAGCATTGAGTTCAGGAT | TTG | chr12 | 21584760 | 21584781 | 21584765 | 21584760 | - |
| SEQ ID NO 29150 | AGTTCAGGATTGGGAAACCCAT | TTG | chr12 | 21584748 | 21584769 | 21584753 | 21584748 | - |
| SEQ ID NO 29151 | AGGATTGGGAAACCCATATCCA | TTC | chr12 | 21584743 | 21584764 | 21584748 | 21584743 | - |
| SEQ ID NO 29152 | GGAAACCCATATCCAGAGTAAG | TTG | chr12 | 21584736 | 21584757 | 21584741 | 21584736 | - |
| SEQ ID NO 29153 | TTCCAGTGAGGACAAGCCTCTG | CTA | chr12 | 21584708 | 21584729 | 21584713 | 21584708 | - |
| SEQ ID NO 29154 | CAGTGAGGACAAGCCTCTGCCC | TTC | chr12 | 21584705 | 21584726 | 21584710 | 21584705 | - |
| SEQ ID NO 29155 | TGCCCTTTCCATGATGGAAGAG | CTC | chr12 | 21584688 | 21584709 | 21584693 | 21584688 | - |
| SEQ ID NO 29156 | CCCTTTCCATGATGGAAGAGGT | CTG | chr12 | 21584686 | 21584707 | 21584691 | 21584686 | - |
| SEQ ID NO 29157 | TCCATGATGGAAGAGGTCCAAT | CTT | chr12 | 21584681 | 21584702 | 21584686 | 21584681 | - |
| SEQ ID NO 29158 | CCATGATGGAAGAGGTCCAATA | TTT | chr12 | 21584680 | 21584701 | 21584685 | 21584680 | - |
| SEQ ID NO 29159 | CATGATGGAAGAGGTCCAATAT | TTC | chr12 | 21584679 | 21584700 | 21584684 | 21584679 | - |
| SEQ ID NO 29160 | CCACCAGGTAGCTGGCTGATCA | CTG | chr12 | 21584647 | 21584668 | 21584652 | 21584647 | - |
| SEQ ID NO 29161 | GCTGATCACCCCGAGGAATGGT | CTG | chr12 | 21584633 | 21584654 | 21584638 | 21584633 | - |
| SEQ ID NO 29162 | ATCACCCCGAGGAATGGTGCCA | CTG | chr12 | 21584629 | 21584650 | 21584634 | 21584629 | - |
| SEQ ID NO 29163 | AGTGTTGGTCTCTGATGCTGGC | CTT | chr12 | 21584595 | 21584616 | 21584600 | 21584595 | - |
| SEQ ID NO 29164 | GTGTTGGTCTCTGATGCTGGCA | TTA | chr12 | 21584594 | 21584615 | 21584599 | 21584594 | - |
| SEQ ID NO 29165 | GTCTCTGATGCTGGCAAGCAGT | TTG | chr12 | 21584588 | 21584609 | 21584593 | 21584588 | - |
| SEQ ID NO 29166 | TGATGCTGGCAAGCAGTGGCTG | CTC | chr12 | 21584583 | 21584604 | 21584588 | 21584583 | - |
| SEQ ID NO 29167 | ATGCTGGCAAGCAGTGGCTGTG | CTG | chr12 | 21584581 | 21584602 | 21584586 | 21584581 | - |
| SEQ ID NO 29168 | GCAAGCAGTGGCTGTGGCCAGG | CTG | chr12 | 21584575 | 21584596 | 21584580 | 21584575 | - |
| SEQ ID NO 29169 | TGGCCAGGTCAGCTTTGGTGAG | CTG | chr12 | 21584561 | 21584582 | 21584566 | 21584561 | - |
| SEQ ID NO 29170 | TGGTGAGTGGAAGTCCATGTTG | CTT | chr12 | 21584546 | 21584567 | 21584551 | 21584546 | - |
| SEQ ID NO 29171 | GGTGAGTGGAAGTCCATGTTGC | TTT | chr12 | 21584545 | 21584566 | 21584550 | 21584545 | - |
| SEQ ID NO 29172 | GTGAGTGGAAGTCCATGTTGCT | TTG | chr12 | 21584544 | 21584565 | 21584549 | 21584544 | - |
| SEQ ID NO 29173 | CTGAGCCAAGCATAACTTCCA | TTG | chr12 | 21584524 | 21584545 | 21584529 | 21584524 | - |
| SEQ ID NO 29174 | AGCCCAAGCATAACTTCCATCC | CTG | chr12 | 21584521 | 21584542 | 21584526 | 21584521 | - |
| SEQ ID NO 29175 | CCATCCCTGCAACTGTGGCCAC | CTT | chr12 | 21584505 | 21584526 | 21584510 | 21584505 | - |
| SEQ ID NO 29176 | CATCCCTGCAACTGTGGCCACT | TTC | chr12 | 21584504 | 21584525 | 21584509 | 21584504 | - |
| SEQ ID NO 29177 | CAACTGTGGCCACTTTGTTCAT | CTG | chr12 | 21584496 | 21584517 | 21584501 | 21584496 | - |
| SEQ ID NO 29178 | TGGCCACTTTGTTCATGGGTCC | CTG | chr12 | 21584490 | 21584511 | 21584495 | 21584490 | - |
| SEQ ID NO 29179 | TGTTCATGGGTCCATTGGACGA | CTT | chr12 | 21584481 | 21584502 | 21584486 | 21584481 | - |
| SEQ ID NO 29180 | GTTCATGGGTCCATTGGACGAT | TTT | chr12 | 21584480 | 21584501 | 21584485 | 21584480 | - |
| SEQ ID NO 29181 | TTCATGGGTCCATTGGACGATG | TTG | chr12 | 21584479 | 21584500 | 21584484 | 21584479 | - |
| SEQ ID NO 29182 | ATGGGTCCATTGGACGATGACA | TTC | chr12 | 21584476 | 21584497 | 21584481 | 21584476 | - |
| SEQ ID NO 29183 | GACGATGACATGAGTGGCCTGG | TTG | chr12 | 21584464 | 21584485 | 21584469 | 21584464 | - |

Figure 48 (Cont'd)

| SEQ ID NO 29184 | GGAAAAGGCTGAGTGGTGTCCA | CTG | chr12 | 21584443 | 21584464 | 21584448 | 21584443 | - |
|---|---|---|---|---|---|---|---|---|
| SEQ ID NO 29185 | AGTGGTGTCCACAGAATTGATC | CTG | chr12 | 21584432 | 21584453 | 21584437 | 21584432 | - |
| SEQ ID NO 29186 | ATCATCCTATCCACTTGATTAT | TTG | chr12 | 21584413 | 21584434 | 21584418 | 21584413 | - |
| SEQ ID NO 29187 | TCCACTTGATTATTAAAATCCT | CTA | chr12 | 21584404 | 21584425 | 21584409 | 21584404 | - |
| SEQ ID NO 29188 | GATTATTAAAATCCTCTTCTGC | CTT | chr12 | 21584397 | 21584418 | 21584402 | 21584397 | - |
| SEQ ID NO 29189 | ATTATTAAAATCCTCTTCTGCT | TTG | chr12 | 21584396 | 21584417 | 21584401 | 21584396 | - |
| SEQ ID NO 29190 | TTAAAATCCTCTTCTGCTGAGG | TTA | chr12 | 21584392 | 21584413 | 21584397 | 21584392 | - |
| SEQ ID NO 29191 | AAATCCTCTTCTGCTGAGGTCA | TTA | chr12 | 21584389 | 21584410 | 21584394 | 21584389 | - |
| SEQ ID NO 29192 | TTCTGCTGAGGTCACCCATTGG | CTC | chr12 | 21584381 | 21584402 | 21584386 | 21584381 | - |
| SEQ ID NO 29193 | CTGCTGAGGTCACCCATTGGTG | CTT | chr12 | 21584379 | 21584400 | 21584384 | 21584379 | - |
| SEQ ID NO 29194 | TGCTGAGGTCACCCATTGGTGA | TTC | chr12 | 21584378 | 21584399 | 21584383 | 21584378 | - |
| SEQ ID NO 29195 | CTGAGGTCACCCATTGGTGAGC | CTG | chr12 | 21584376 | 21584397 | 21584381 | 21584376 | - |
| SEQ ID NO 29196 | AGGTCACCCATTGGTGAGCACT | CTG | chr12 | 21584373 | 21584394 | 21584378 | 21584373 | - |
| SEQ ID NO 29197 | GTGAGCACTCACATGGGATGAA | TTG | chr12 | 21584360 | 21584381 | 21584365 | 21584360 | - |
| SEQ ID NO 29198 | ACATGGGATGAAAATATCTTTG | CTC | chr12 | 21584350 | 21584371 | 21584355 | 21584350 | - |
| SEQ ID NO 29199 | TGTAGTTTTTGACTAATCATAG | CTT | chr12 | 21584330 | 21584351 | 21584335 | 21584330 | - |
| SEQ ID NO 29200 | GTAGTTTTTGACTAATCATAGA | TTT | chr12 | 21584329 | 21584350 | 21584334 | 21584329 | - |
| SEQ ID NO 29201 | TAGTTTTTGACTAATCATAGAG | TTG | chr12 | 21584328 | 21584349 | 21584333 | 21584328 | - |
| SEQ ID NO 29202 | TTGACTAATCATAGAGGTCCAT | TTT | chr12 | 21584322 | 21584343 | 21584327 | 21584322 | - |
| SEQ ID NO 29203 | TGACTAATCATAGAGGTCCATC | TTT | chr12 | 21584321 | 21584342 | 21584326 | 21584321 | - |
| SEQ ID NO 29204 | GACTAATCATAGAGGTCCATCC | TTT | chr12 | 21584320 | 21584341 | 21584325 | 21584320 | - |
| SEQ ID NO 29205 | ACTAATCATAGAGGTCCATCCA | TTG | chr12 | 21584319 | 21584340 | 21584324 | 21584319 | - |
| SEQ ID NO 29206 | ATCATAGAGGTCCATCCACATA | CTA | chr12 | 21584315 | 21584336 | 21584320 | 21584315 | - |
| SEQ ID NO 29207 | TTCCCCAAATTTCTTTGTCATC | CTC | chr12 | 21584289 | 21584310 | 21584294 | 21584289 | - |
| SEQ ID NO 29208 | CCCCAAATTTCTTTGTCATCAA | CTT | chr12 | 21584287 | 21584308 | 21584292 | 21584287 | - |
| SEQ ID NO 29209 | CCCAAATTTCTTTGTCATCAAT | TTC | chr12 | 21584286 | 21584307 | 21584291 | 21584286 | - |
| SEQ ID NO 29210 | CTTTGTCATCAATTTTCCAGTC | TTT | chr12 | 21584277 | 21584298 | 21584282 | 21584277 | - |
| SEQ ID NO 29211 | TTTGTCATCAATTTTCCAGTCA | TTC | chr12 | 21584276 | 21584297 | 21584281 | 21584276 | - |
| SEQ ID NO 29212 | TGTCATCAATTTTCCAGTCATG | CTT | chr12 | 21584274 | 21584295 | 21584279 | 21584274 | - |
| SEQ ID NO 29213 | GTCATCAATTTTCCAGTCATGC | TTT | chr12 | 21584273 | 21584294 | 21584278 | 21584273 | - |
| SEQ ID NO 29214 | TCATCAATTTTCCAGTCATGCT | TTG | chr12 | 21584272 | 21584293 | 21584277 | 21584272 | - |
| SEQ ID NO 29215 | TCCAGTCATGCTTTTTCCAAGT | TTT | chr12 | 21584262 | 21584283 | 21584267 | 21584262 | - |
| SEQ ID NO 29216 | CCAGTCATGCTTTTTCCAAGTC | TTT | chr12 | 21584261 | 21584282 | 21584266 | 21584261 | - |
| SEQ ID NO 29217 | CAGTCATGCTTTTTCCAAGTCC | TTC | chr12 | 21584260 | 21584281 | 21584265 | 21584260 | - |
| SEQ ID NO 29218 | TTTCCAAGTCCCTGACCATCTA | CTT | chr12 | 21584249 | 21584270 | 21584254 | 21584249 | - |
| SEQ ID NO 29219 | TTCCAAGTCCCTGACCATCTAG | TTT | chr12 | 21584248 | 21584269 | 21584253 | 21584248 | - |
| SEQ ID NO 29220 | TCCAAGTCCCTGACCATCTAGC | TTT | chr12 | 21584247 | 21584268 | 21584252 | 21584247 | - |
| SEQ ID NO 29221 | CCAAGTCCCTGACCATCTAGCC | TTT | chr12 | 21584246 | 21584267 | 21584251 | 21584246 | - |
| SEQ ID NO 29222 | CAAGTCCCTGACCATCTAGCCA | TTC | chr12 | 21584245 | 21584266 | 21584250 | 21584245 | - |
| SEQ ID NO 29223 | ACCATCTAGCCAAACCTTTGGC | CTG | chr12 | 21584235 | 21584256 | 21584240 | 21584235 | - |
| SEQ ID NO 29224 | GCCAAACCTTTGGCTACAGCCC | CTA | chr12 | 21584227 | 21584248 | 21584232 | 21584227 | - |
| SEQ ID NO 29225 | TGGCTACAGCCCATGAATAAGT | CTT | chr12 | 21584217 | 21584238 | 21584222 | 21584217 | - |
| SEQ ID NO 29226 | GGCTACAGCCCATGAATAAGTA | TTT | chr12 | 21584216 | 21584237 | 21584221 | 21584216 | - |
| SEQ ID NO 29227 | GCTACAGCCCATGAATAAGTAT | TTG | chr12 | 21584215 | 21584236 | 21584220 | 21584215 | - |
| SEQ ID NO 29228 | CAGCCCATGAATAAGTATATAA | CTA | chr12 | 21584211 | 21584232 | 21584216 | 21584211 | - |
| SEQ ID NO 29229 | GCCATTTCTCCTTCTGTGCAAA | CTG | chr12 | 21584178 | 21584199 | 21584183 | 21584178 | - |
| SEQ ID NO 29230 | CTCCTTCTGTGCAAAGTGCACA | TTT | chr12 | 21584171 | 21584192 | 21584176 | 21584171 | - |
| SEQ ID NO 29231 | TCCTTCTGTGCAAAGTGCACAA | TTC | chr12 | 21584170 | 21584191 | 21584175 | 21584170 | - |
| SEQ ID NO 29232 | CTTCTGTGCAAAGTGCACAACC | CTC | chr12 | 21584168 | 21584189 | 21584173 | 21584168 | - |
| SEQ ID NO 29233 | CTGTGCAAAGTGCACAACCAGG | CTT | chr12 | 21584165 | 21584186 | 21584170 | 21584165 | - |
| SEQ ID NO 29234 | TGTGCAAAGTGCACAACCAGGC | TTC | chr12 | 21584164 | 21584185 | 21584169 | 21584164 | - |
| SEQ ID NO 29235 | TGCAAAGTGCACAACCAGGCAC | CTG | chr12 | 21584162 | 21584183 | 21584167 | 21584162 | - |
| SEQ ID NO 29236 | CTCAAAGTTCTGCCAACTAGGA | CTG | chr12 | 21584136 | 21584157 | 21584141 | 21584136 | - |
| SEQ ID NO 29237 | AAAGTTCTGCCAACTAGGAAGA | CTC | chr12 | 21584133 | 21584154 | 21584138 | 21584133 | - |
| SEQ ID NO 29238 | TGCCAACTAGGAAGATTTCCCT | TTC | chr12 | 21584126 | 21584147 | 21584131 | 21584126 | - |
| SEQ ID NO 29239 | CCAACTAGGAAGATTTCCCTTC | CTG | chr12 | 21584124 | 21584145 | 21584129 | 21584124 | - |
| SEQ ID NO 29240 | GGAAGATTTCCCTTCACCGTTG | CTA | chr12 | 21584117 | 21584138 | 21584122 | 21584117 | - |
| SEQ ID NO 29241 | CCCTTCACCGTTGTCCTTCAGG | TTT | chr12 | 21584108 | 21584129 | 21584113 | 21584108 | - |

Figure 48 (Cont'd)

| | | | | | | | | |
|---|---|---|---|---|---|---|---|---|
| SEQ ID NO 29242 | CCTTCACCGTTGTCCTTCAGGG | TTC | chr12 | 21584107 | 21584128 | 21584112 | 21584107 | - |
| SEQ ID NO 29243 | CACCGTTGTCCTTCAGGGATGT | CTT | chr12 | 21584103 | 21584124 | 21584108 | 21584103 | - |
| SEQ ID NO 29244 | ACCGTTGTCCTTCAGGGATGTC | TTC | chr12 | 21584102 | 21584123 | 21584107 | 21584102 | - |
| SEQ ID NO 29245 | TCCTTCAGGGATGTCCTAGAAA | TTG | chr12 | 21584095 | 21584116 | 21584100 | 21584095 | - |
| SEQ ID NO 29246 | CAGGGATGTCCTAGAAAGGGGC | CTT | chr12 | 21584090 | 21584111 | 21584095 | 21584090 | - |
| SEQ ID NO 29247 | AGGGATGTCCTAGAAAGGGGCT | TTC | chr12 | 21584089 | 21584110 | 21584094 | 21584089 | - |
| SEQ ID NO 29248 | GAAAGGGGCTGTAGTGCTGCGG | CTA | chr12 | 21584077 | 21584098 | 21584082 | 21584077 | - |
| SEQ ID NO 29249 | TAGTGCTGCGGCTGTCCACTTT | CTG | chr12 | 21584066 | 21584087 | 21584071 | 21584066 | - |
| SEQ ID NO 29250 | CGGCTGTCCACTTTTGGGTGGT | CTG | chr12 | 21584058 | 21584079 | 21584063 | 21584058 | - |
| SEQ ID NO 29251 | TCCACTTTTGGGTGGTGCCTGC | CTG | chr12 | 21584052 | 21584073 | 21584057 | 21584052 | - |
| SEQ ID NO 29252 | TTGGGTGGTGCCTGCATATCGT | CTT | chr12 | 21584045 | 21584066 | 21584050 | 21584045 | - |
| SEQ ID NO 29253 | TGGGTGGTGCCTGCATATCGTG | TTT | chr12 | 21584044 | 21584065 | 21584049 | 21584044 | - |
| SEQ ID NO 29254 | GGGTGGTGCCTGCATATCGTGC | TTT | chr12 | 21584043 | 21584064 | 21584048 | 21584043 | - |
| SEQ ID NO 29255 | GGTGGTGCCTGCATATCGTGCA | TTG | chr12 | 21584042 | 21584063 | 21584047 | 21584042 | - |
| SEQ ID NO 29256 | CATATCGTGCAGAACTATCTGT | CTG | chr12 | 21584031 | 21584052 | 21584036 | 21584031 | - |
| SEQ ID NO 29257 | TCTGTGAACCAGGACCTAGTCT | CTA | chr12 | 21584014 | 21584035 | 21584019 | 21584014 | - |
| SEQ ID NO 29258 | TGAACCAGGACCTAGTCTTCTC | CTG | chr12 | 21584010 | 21584031 | 21584015 | 21584010 | - |
| SEQ ID NO 29259 | GTCTTCTCTTCCTCTGTCAGCT | CTA | chr12 | 21583996 | 21584017 | 21584001 | 21583996 | - |
| SEQ ID NO 29260 | CTCTTCCTCTGTCAGCTGATCA | CTT | chr12 | 21583991 | 21584012 | 21583996 | 21583991 | - |
| SEQ ID NO 29261 | TCTTCCTCTGTCAGCTGATCAT | TTC | chr12 | 21583990 | 21584011 | 21583995 | 21583990 | - |
| SEQ ID NO 29262 | TTCCTCTGTCAGCTGATCATAG | CTC | chr12 | 21583988 | 21584009 | 21583993 | 21583988 | - |
| SEQ ID NO 29263 | CCTCTGTCAGCTGATCATAGGG | CTT | chr12 | 21583986 | 21584007 | 21583991 | 21583986 | - |
| SEQ ID NO 29264 | CTCTGTCAGCTGATCATAGGGA | TTC | chr12 | 21583985 | 21584006 | 21583990 | 21583985 | - |
| SEQ ID NO 29265 | TGTCAGCTGATCATAGGGAACT | CTC | chr12 | 21583982 | 21584003 | 21583987 | 21583982 | - |
| SEQ ID NO 29266 | TCAGCTGATCATAGGGAACTCC | CTG | chr12 | 21583980 | 21584001 | 21583985 | 21583980 | - |
| SEQ ID NO 29267 | ATCATAGGGAACTCCCCATGAG | CTG | chr12 | 21583973 | 21583994 | 21583978 | 21583973 | - |
| SEQ ID NO 29268 | CCCATGAGACCATCGGTGCAGT | CTC | chr12 | 21583959 | 21583980 | 21583964 | 21583959 | - |
| SEQ ID NO 29269 | AGGGAGAGAAAGCAGTGTGTCA | CTC | chr12 | 21583934 | 21583955 | 21583939 | 21583934 | - |
| SEQ ID NO 29270 | GAGCCCCTTTCTCATGTAACTT | TTT | chr12 | 21583890 | 21583911 | 21583895 | 21583890 | - |
| SEQ ID NO 29271 | AGCCCCTTTCTCATGTAACTTA | TTG | chr12 | 21583889 | 21583910 | 21583894 | 21583889 | - |
| SEQ ID NO 29272 | TCTCATGTAACTTACTAGTGCC | CTT | chr12 | 21583881 | 21583902 | 21583886 | 21583881 | - |
| SEQ ID NO 29273 | CTCATGTAACTTACTAGTGCCT | TTT | chr12 | 21583880 | 21583901 | 21583885 | 21583880 | - |
| SEQ ID NO 29274 | TCATGTAACTTACTAGTGCCTT | TTC | chr12 | 21583879 | 21583900 | 21583884 | 21583879 | - |
| SEQ ID NO 29275 | ATGTAACTTACTAGTGCCTTCA | CTC | chr12 | 21583877 | 21583898 | 21583882 | 21583877 | - |
| SEQ ID NO 29276 | ACTAGTGCCTTCAGGATCTGCT | CTT | chr12 | 21583868 | 21583889 | 21583873 | 21583868 | - |
| SEQ ID NO 29277 | CTAGTGCCTTCAGGATCTGCTC | TTA | chr12 | 21583867 | 21583888 | 21583872 | 21583867 | - |
| SEQ ID NO 29278 | GTGCCTTCAGGATCTGCTCAAG | CTA | chr12 | 21583864 | 21583885 | 21583869 | 21583864 | - |
| SEQ ID NO 29279 | CAGGATCTGCTCAAGCCCAATC | CTT | chr12 | 21583857 | 21583878 | 21583862 | 21583857 | - |
| SEQ ID NO 29280 | AGGATCTGCTCAAGCCCAATCG | TTC | chr12 | 21583856 | 21583877 | 21583861 | 21583856 | - |
| SEQ ID NO 29281 | CTCAAGCCCAATCGCATATATA | CTG | chr12 | 21583848 | 21583869 | 21583853 | 21583848 | - |
| SEQ ID NO 29282 | AAGCCCAATCGCATATATACCA | CTC | chr12 | 21583845 | 21583866 | 21583850 | 21583845 | - |
| SEQ ID NO 29283 | CCATTTGCTGATGCAATGCTGC | CTT | chr12 | 21583820 | 21583841 | 21583825 | 21583820 | - |
| SEQ ID NO 29284 | CATTTGCTGATGCAATGCTGCT | TTC | chr12 | 21583819 | 21583840 | 21583824 | 21583819 | - |
| SEQ ID NO 29285 | GCTGATGCAATGCTGCTGTGCA | TTT | chr12 | 21583814 | 21583835 | 21583819 | 21583814 | - |
| SEQ ID NO 29286 | CTGATGCAATGCTGCTGTGCAC | TTG | chr12 | 21583813 | 21583834 | 21583818 | 21583813 | - |
| SEQ ID NO 29287 | ATGCAATGCTGCTGTGCACAGC | CTG | chr12 | 21583810 | 21583831 | 21583815 | 21583810 | - |
| SEQ ID NO 29288 | CTGTGCACAGCCCACTTTATGG | CTG | chr12 | 21583799 | 21583820 | 21583804 | 21583799 | - |
| SEQ ID NO 29289 | TGCACAGCCCACTTTATGGCTA | CTG | chr12 | 21583796 | 21583817 | 21583801 | 21583796 | - |
| SEQ ID NO 29290 | TATGGCTAGATGGATCAGAAAG | CTT | chr12 | 21583782 | 21583803 | 21583787 | 21583782 | - |
| SEQ ID NO 29291 | ATGGCTAGATGGATCAGAAAGC | TTT | chr12 | 21583781 | 21583802 | 21583786 | 21583781 | - |
| SEQ ID NO 29292 | TGGCTAGATGGATCAGAAAGCA | TTA | chr12 | 21583780 | 21583801 | 21583785 | 21583780 | - |
| SEQ ID NO 29293 | GATGGATCAGAAAGCACCCAGT | CTA | chr12 | 21583774 | 21583795 | 21583779 | 21583774 | - |
| SEQ ID NO 29294 | ATGATAGGCAGTTCAGGTCACA | TTC | chr12 | 21583750 | 21583771 | 21583755 | 21583750 | - |
| SEQ ID NO 29295 | AGGTCACATGGTGACTTGATGA | TTC | chr12 | 21583736 | 21583757 | 21583741 | 21583736 | - |
| SEQ ID NO 29296 | GATGACTCATAGTCAAATATTT | CTT | chr12 | 21583719 | 21583740 | 21583724 | 21583719 | - |
| SEQ ID NO 29297 | ATGACTCATAGTCAAATATTTC | TTG | chr12 | 21583718 | 21583739 | 21583723 | 21583718 | - |
| SEQ ID NO 29298 | ATAGTCAAATATTTCGTTTCCA | CTC | chr12 | 21583711 | 21583732 | 21583716 | 21583711 | - |
| SEQ ID NO 29299 | CGTTTCCACCAAAGCCCAGTAA | TTT | chr12 | 21583697 | 21583718 | 21583702 | 21583697 | - |

Figure 48 (Cont'd)

| SEQ ID NO 29300 | GTTTCCACCAAAGCCCAGTAAC | TTC | chr12 | 21583696 | 21583717 | 21583701 | 21583696 | - |
|---|---|---|---|---|---|---|---|---|
| SEQ ID NO 29301 | CCACCAAAGCCCAGTAACAGGC | TTT | chr12 | 21583692 | 21583713 | 21583697 | 21583692 | - |
| SEQ ID NO 29302 | CACCAAAGCCCAGTAACAGGCC | TTC | chr12 | 21583691 | 21583712 | 21583696 | 21583691 | - |
| SEQ ID NO 29303 | TCTCCCTAAAAGAGAGTAGTTA | CTT | chr12 | 21583661 | 21583682 | 21583666 | 21583661 | - |
| SEQ ID NO 29304 | CTCCCTAAAAGAGAGTAGTTAT | TTT | chr12 | 21583660 | 21583681 | 21583665 | 21583660 | - |
| SEQ ID NO 29305 | TCCCTAAAAGAGAGTAGTTATC | TTC | chr12 | 21583659 | 21583680 | 21583664 | 21583659 | - |
| SEQ ID NO 29306 | CCTAAAAGAGAGTAGTTATCTG | CTC | chr12 | 21583657 | 21583678 | 21583662 | 21583657 | - |
| SEQ ID NO 29307 | AAAGAGAGTAGTTATCTGCAGA | CTA | chr12 | 21583653 | 21583674 | 21583658 | 21583653 | - |
| SEQ ID NO 29308 | TCTGCAGAAGATGGCAGGGCCT | TTA | chr12 | 21583639 | 21583660 | 21583644 | 21583639 | - |
| SEQ ID NO 29309 | CAGAAGATGGCAGGGCCTTGCT | CTG | chr12 | 21583635 | 21583656 | 21583640 | 21583635 | - |
| SEQ ID NO 29310 | GCTCCAAAATCCTAGAGGCCTC | CTT | chr12 | 21583616 | 21583637 | 21583621 | 21583616 | - |
| SEQ ID NO 29311 | CTCCAAAATCCTAGAGGCCTCC | TTG | chr12 | 21583615 | 21583636 | 21583620 | 21583615 | - |
| SEQ ID NO 29312 | CAAAATCCTAGAGGCCTCCGCT | CTC | chr12 | 21583612 | 21583633 | 21583617 | 21583612 | - |
| SEQ ID NO 29313 | GAGGCCTCCGCTGTGATTCAGC | CTA | chr12 | 21583602 | 21583623 | 21583607 | 21583602 | - |
| SEQ ID NO 29314 | CGCTGTGATTCAGCCTGCCAAA | CTC | chr12 | 21583594 | 21583615 | 21583599 | 21583594 | - |
| SEQ ID NO 29315 | TGATTCAGCCTGCCAAATGCTC | CTG | chr12 | 21583589 | 21583610 | 21583594 | 21583589 | - |
| SEQ ID NO 29316 | AGCCTGCCAAATGCTCCAAACA | TTC | chr12 | 21583583 | 21583604 | 21583588 | 21583583 | - |
| SEQ ID NO 29317 | CCAAATGCTCCAAACAGCATCC | CTG | chr12 | 21583577 | 21583598 | 21583582 | 21583577 | - |
| SEQ ID NO 29318 | CAAACAGCATCCTATCTGGCA | CTC | chr12 | 21583567 | 21583588 | 21583572 | 21583567 | - |
| SEQ ID NO 29319 | TCTGGCACTGACACCTCAAGCA | CTA | chr12 | 21583552 | 21583573 | 21583557 | 21583552 | - |
| SEQ ID NO 29320 | GCACTGACACCTCAAGCATCAT | CTG | chr12 | 21583548 | 21583569 | 21583553 | 21583548 | - |
| SEQ ID NO 29321 | ACACCTCAAGCATCATTGGATC | CTG | chr12 | 21583542 | 21583563 | 21583547 | 21583542 | - |
| SEQ ID NO 29322 | AAGCATCATTGGATCTGCTAGG | CTC | chr12 | 21583535 | 21583556 | 21583540 | 21583535 | - |
| SEQ ID NO 29323 | GATCTGCTAGGTCATATGGCCC | TTG | chr12 | 21583524 | 21583545 | 21583529 | 21583524 | - |
| SEQ ID NO 29324 | CTAGGTCATATGGCCCAAGTGG | CTG | chr12 | 21583518 | 21583539 | 21583523 | 21583518 | - |
| SEQ ID NO 29325 | GGTCATATGGCCCAAGTGGCAT | CTA | chr12 | 21583515 | 21583536 | 21583520 | 21583515 | - |
| SEQ ID NO 29326 | GCACAGCAGCCTGGACCTGTGG | CTT | chr12 | 21583485 | 21583506 | 21583490 | 21583485 | - |
| SEQ ID NO 29327 | CACAGCAGCCTGGACCTGTGGC | TTG | chr12 | 21583484 | 21583505 | 21583489 | 21583484 | - |
| SEQ ID NO 29328 | GACCTGTGGCAGAGCCTTCTGT | CTG | chr12 | 21583472 | 21583493 | 21583477 | 21583472 | - |
| SEQ ID NO 29329 | TGGCAGAGCCTTCTGTTCTGGA | CTG | chr12 | 21583466 | 21583487 | 21583471 | 21583466 | - |
| SEQ ID NO 29330 | CTGTTCTGGACTCCACTCAAAA | CTT | chr12 | 21583454 | 21583475 | 21583459 | 21583454 | - |
| SEQ ID NO 29331 | TGTTCTGGACTCCACTCAAAAC | TTC | chr12 | 21583453 | 21583474 | 21583458 | 21583453 | - |
| SEQ ID NO 29332 | TTCTGGACTCCACTCAAAACTG | CTG | chr12 | 21583451 | 21583472 | 21583456 | 21583451 | - |
| SEQ ID NO 29333 | TGGACTCCACTCAAAACTGGCA | TTC | chr12 | 21583448 | 21583469 | 21583453 | 21583448 | - |
| SEQ ID NO 29334 | GACTCCACTCAAAACTGGCAGC | CTG | chr12 | 21583446 | 21583467 | 21583451 | 21583446 | - |
| SEQ ID NO 29335 | CACTCAAAACTGGCAGCCTTTT | CTC | chr12 | 21583441 | 21583462 | 21583446 | 21583441 | - |
| SEQ ID NO 29336 | AAAACTGGCAGCCTTTTGGATC | CTC | chr12 | 21583436 | 21583457 | 21583441 | 21583436 | - |
| SEQ ID NO 29337 | GCAGCCTTTTGGATCACTCGAT | CTG | chr12 | 21583429 | 21583450 | 21583434 | 21583429 | - |
| SEQ ID NO 29338 | TTGGATCACTCGATAAATGGGC | CTT | chr12 | 21583421 | 21583442 | 21583426 | 21583421 | - |
| SEQ ID NO 29339 | TGGATCACTCGATAAATGGGCC | TTT | chr12 | 21583420 | 21583441 | 21583425 | 21583420 | - |
| SEQ ID NO 29340 | GGATCACTCGATAAATGGGCCA | TTT | chr12 | 21583419 | 21583440 | 21583424 | 21583419 | - |
| SEQ ID NO 29341 | GATCACTCGATAAATGGGCCAG | TTG | chr12 | 21583418 | 21583439 | 21583423 | 21583418 | - |
| SEQ ID NO 29342 | GATAAATGGGCCAGAGTAACAC | CTC | chr12 | 21583410 | 21583431 | 21583415 | 21583410 | - |
| SEQ ID NO 29343 | CCTCCAAAATCCAAATAGGCCC | TTG | chr12 | 21583367 | 21583388 | 21583372 | 21583367 | - |
| SEQ ID NO 29344 | CAAAATCCAAATAGGCCCACTA | CTC | chr12 | 21583363 | 21583384 | 21583368 | 21583363 | - |
| SEQ ID NO 29345 | GGCGTTGTGCCTATTTCTTGGT | CTA | chr12 | 21583341 | 21583362 | 21583346 | 21583341 | - |
| SEQ ID NO 29346 | TGCCTATTTCTTGGTTGTAAGA | TTG | chr12 | 21583334 | 21583355 | 21583339 | 21583334 | - |
| SEQ ID NO 29347 | TTTCTTGGTTGTAAGAGTGGCC | CTA | chr12 | 21583328 | 21583349 | 21583333 | 21583328 | - |
| SEQ ID NO 29348 | CTTGGTTGTAAGAGTGGCCAAA | TTT | chr12 | 21583325 | 21583346 | 21583330 | 21583325 | - |
| SEQ ID NO 29349 | TTGGTTGTAAGAGTGGCCAAAT | TTC | chr12 | 21583324 | 21583345 | 21583329 | 21583324 | - |
| SEQ ID NO 29350 | GGTTGTAAGAGTGGCCAAATGC | CTT | chr12 | 21583322 | 21583343 | 21583327 | 21583322 | - |
| SEQ ID NO 29351 | GTTGTAAGAGTGGCCAAATGCA | TTG | chr12 | 21583321 | 21583342 | 21583326 | 21583321 | - |
| SEQ ID NO 29352 | TAAGAGTGGCCAAATGCAGCAA | TTG | chr12 | 21583317 | 21583338 | 21583322 | 21583317 | - |
| SEQ ID NO 29353 | TCCTTCACTTTAGAAGGAATAT | TTA | chr12 | 21583291 | 21583312 | 21583296 | 21583291 | - |
| SEQ ID NO 29354 | CACTTTAGAAGGAATATCTCAA | CTT | chr12 | 21583286 | 21583307 | 21583291 | 21583286 | - |
| SEQ ID NO 29355 | ACTTTAGAAGGAATATCTCAAA | TTC | chr12 | 21583285 | 21583306 | 21583290 | 21583285 | - |
| SEQ ID NO 29356 | TAGAAGGAATATCTCAAAGAGC | CTT | chr12 | 21583281 | 21583302 | 21583286 | 21583281 | - |
| SEQ ID NO 29357 | AGAAGGAATATCTCAAAGAGCC | TTT | chr12 | 21583280 | 21583301 | 21583285 | 21583280 | - |

Figure 48 (Cont'd)

| | | | | | | | | |
|---|---|---|---|---|---|---|---|---|
| SEQ ID NO 29358 | GAAGGAATATCTCAAAGAGCCC | TTA | chr12 | 21583279 | 21583300 | 21583284 | 21583279 | - |
| SEQ ID NO 29359 | AAAGAGCCCCAAACCATTGGAC | CTC | chr12 | 21583266 | 21583287 | 21583271 | 21583266 | - |
| SEQ ID NO 29360 | GACCCCTATAAATTTTACTGAG | TTG | chr12 | 21583247 | 21583268 | 21583252 | 21583247 | - |
| SEQ ID NO 29361 | TAAATTTTACTGAGGTAGAAGG | CTA | chr12 | 21583239 | 21583260 | 21583244 | 21583239 | - |
| SEQ ID NO 29362 | TACTGAGGTAGAAGGTCCCTGA | TTT | chr12 | 21583232 | 21583253 | 21583237 | 21583232 | - |
| SEQ ID NO 29363 | ACTGAGGTAGAAGGTCCCTGAA | TTT | chr12 | 21583231 | 21583252 | 21583236 | 21583231 | - |
| SEQ ID NO 29364 | CTGAGGTAGAAGGTCCCTGAAT | TTA | chr12 | 21583230 | 21583251 | 21583235 | 21583230 | - |
| SEQ ID NO 29365 | AGGTAGAAGGTCCCTGAATTTA | CTG | chr12 | 21583227 | 21583248 | 21583232 | 21583227 | - |
| SEQ ID NO 29366 | AATTTAATCAGATTTATTTCCC | CTG | chr12 | 21583211 | 21583232 | 21583216 | 21583211 | - |
| SEQ ID NO 29367 | AATCAGATTTATTTCCCATCCT | TTT | chr12 | 21583206 | 21583227 | 21583211 | 21583206 | - |
| SEQ ID NO 29368 | ATCAGATTTATTTCCCATCCTC | TTA | chr12 | 21583205 | 21583226 | 21583210 | 21583205 | - |
| SEQ ID NO 29369 | ATTTCCCATCCTCTGTCCCACA | TTT | chr12 | 21583196 | 21583217 | 21583201 | 21583196 | - |
| SEQ ID NO 29370 | TTTCCCATCCTCTGTCCCACAA | TTA | chr12 | 21583195 | 21583216 | 21583200 | 21583195 | - |
| SEQ ID NO 29371 | CCCATCCTCTGTCCCACAAATG | TTT | chr12 | 21583192 | 21583213 | 21583197 | 21583192 | - |
| SEQ ID NO 29372 | CCATCCTCTGTCCCACAAATGT | TTC | chr12 | 21583191 | 21583212 | 21583196 | 21583191 | - |
| SEQ ID NO 29373 | TGTCCCACAAATGTCTCATCAA | CTC | chr12 | 21583183 | 21583204 | 21583188 | 21583183 | - |
| SEQ ID NO 29374 | TCCCACAAATGTCTCATCAATA | CTG | chr12 | 21583181 | 21583202 | 21583186 | 21583181 | - |
| SEQ ID NO 29375 | ATCAATAAATCCAGTGTGTTTG | CTC | chr12 | 21583166 | 21583187 | 21583171 | 21583166 | - |
| SEQ ID NO 29376 | GCTACTTCTTGCTCACTAGTTC | TTT | chr12 | 21583145 | 21583166 | 21583150 | 21583145 | - |
| SEQ ID NO 29377 | CTACTTCTTGCTCACTAGTTCC | TTG | chr12 | 21583144 | 21583165 | 21583149 | 21583144 | - |
| SEQ ID NO 29378 | CTTCTTGCTCACTAGTTCCAGT | CTA | chr12 | 21583141 | 21583162 | 21583146 | 21583141 | - |
| SEQ ID NO 29379 | CTTGCTCACTAGTTCCAGTCAG | CTT | chr12 | 21583138 | 21583159 | 21583143 | 21583138 | - |
| SEQ ID NO 29380 | TTGCTCACTAGTTCCAGTCAGC | TTC | chr12 | 21583137 | 21583158 | 21583142 | 21583137 | - |
| SEQ ID NO 29381 | GCTCACTAGTTCCAGTCAGCAT | CTT | chr12 | 21583135 | 21583156 | 21583140 | 21583135 | - |
| SEQ ID NO 29382 | CTCACTAGTTCCAGTCAGCATG | TTG | chr12 | 21583134 | 21583155 | 21583139 | 21583134 | - |
| SEQ ID NO 29383 | ACTAGTTCCAGTCAGCATGTCA | CTC | chr12 | 21583131 | 21583152 | 21583136 | 21583131 | - |
| SEQ ID NO 29384 | GTTCCAGTCAGCATGTCATCAA | CTA | chr12 | 21583127 | 21583148 | 21583132 | 21583127 | - |
| SEQ ID NO 29385 | CAGTCAGCATGTCATCAATGTA | TTC | chr12 | 21583123 | 21583144 | 21583128 | 21583123 | - |
| SEQ ID NO 29386 | TGATATCTTGTGGAAGTGAAAG | CTG | chr12 | 21583090 | 21583111 | 21583095 | 21583090 | - |
| SEQ ID NO 29387 | GTGGAAGTGAAAGGTGAGCAAG | CTT | chr12 | 21583081 | 21583102 | 21583086 | 21583081 | - |
| SEQ ID NO 29388 | TGGAAGTGAAAGGTGAGCAAGT | TTG | chr12 | 21583080 | 21583101 | 21583085 | 21583080 | - |
| SEQ ID NO 29389 | TCTCCAAATAAGATTATGGCAC | TTC | chr12 | 21583056 | 21583077 | 21583061 | 21583056 | - |
| SEQ ID NO 29390 | TCCAAATAAGATTATGGCACAA | CTC | chr12 | 21583054 | 21583075 | 21583059 | 21583054 | - |
| SEQ ID NO 29391 | CAAATAAGATTATGGCACAAAG | CTC | chr12 | 21583052 | 21583073 | 21583057 | 21583052 | - |
| SEQ ID NO 29392 | TGGCACAAAGCTGGAGAGTTGA | TTA | chr12 | 21583040 | 21583061 | 21583045 | 21583040 | - |
| SEQ ID NO 29393 | GAGAGTTGATATACTCCTGAGT | CTG | chr12 | 21583027 | 21583048 | 21583032 | 21583027 | - |
| SEQ ID NO 29394 | ATATACTCCTGAGTTCATCATT | TTG | chr12 | 21583019 | 21583040 | 21583024 | 21583019 | - |
| SEQ ID NO 29395 | CTGAGTTCATCATTTTCTTTCA | CTC | chr12 | 21583011 | 21583032 | 21583016 | 21583011 | - |
| SEQ ID NO 29396 | AGTTCATCATTTTCTTTCATCA | CTG | chr12 | 21583008 | 21583029 | 21583013 | 21583008 | - |
| SEQ ID NO 29397 | ATCATTTTCTTTCATCACTTTG | TTC | chr12 | 21583003 | 21583024 | 21583008 | 21583003 | - |
| SEQ ID NO 29398 | TCTTTCATCACTTTGTCCAGCG | TTT | chr12 | 21582996 | 21583017 | 21583001 | 21582996 | - |
| SEQ ID NO 29399 | CTTTCATCACTTTGTCCAGCGA | TTT | chr12 | 21582995 | 21583016 | 21583000 | 21582995 | - |
| SEQ ID NO 29400 | TTTCATCACTTTGTCCAGCGAA | TTC | chr12 | 21582994 | 21583015 | 21582999 | 21582994 | - |
| SEQ ID NO 29401 | TCATCACTTTGTCCAGCGAACT | CTT | chr12 | 21582992 | 21583013 | 21582997 | 21582992 | - |
| SEQ ID NO 29402 | CATCACTTTGTCCAGCGAACTT | TTT | chr12 | 21582991 | 21583012 | 21582996 | 21582991 | - |
| SEQ ID NO 29403 | ATCACTTTGTCCAGCGAACTTA | TTC | chr12 | 21582990 | 21583011 | 21582995 | 21582990 | - |
| SEQ ID NO 29404 | TGTCCAGCGAACTTACAAGCAA | CTT | chr12 | 21582983 | 21583004 | 21582988 | 21582983 | - |
| SEQ ID NO 29405 | GTCCAGCGAACTTACAAGCAAC | TTT | chr12 | 21582982 | 21583003 | 21582987 | 21582982 | - |
| SEQ ID NO 29406 | TCCAGCGAACTTACAAGCAACC | TTG | chr12 | 21582981 | 21583002 | 21582986 | 21582981 | - |
| SEQ ID NO 29407 | ACAAGCAACCAACCAACTTCAC | CTT | chr12 | 21582969 | 21582990 | 21582974 | 21582969 | - |
| SEQ ID NO 29408 | CAAGCAACCAACCAACTTCACT | TTA | chr12 | 21582968 | 21582989 | 21582973 | 21582968 | - |
| SEQ ID NO 29409 | CACTATGTTCCTTGATTCTCCA | CTT | chr12 | 21582950 | 21582971 | 21582955 | 21582950 | - |
| SEQ ID NO 29410 | ACTATGTTCCTTGATTCTCCAC | TTC | chr12 | 21582949 | 21582970 | 21582954 | 21582949 | - |
| SEQ ID NO 29411 | TGTTCCTTGATTCTCCACATAT | CTA | chr12 | 21582945 | 21582966 | 21582950 | 21582945 | - |
| SEQ ID NO 29412 | CTTGATTCTCCACATATAGTCA | TTC | chr12 | 21582940 | 21582961 | 21582945 | 21582940 | - |
| SEQ ID NO 29413 | GATTCTCCACATATAGTCAAAA | CTT | chr12 | 21582937 | 21582958 | 21582942 | 21582937 | - |
| SEQ ID NO 29414 | ATTCTCCACATATAGTCAAAAG | TTG | chr12 | 21582936 | 21582957 | 21582941 | 21582936 | - |
| SEQ ID NO 29415 | TCCACATATAGTCAAAAGTATT | TTC | chr12 | 21582932 | 21582953 | 21582937 | 21582932 | - |

Figure 48 (Cont'd)

| SEQ ID NO 29416 | CACATATAGTCAAAAGTATTAT | CTC | chr12 | 21582930 | 21582951 | 21582935 | 21582930 | - |
|---|---|---|---|---|---|---|---|---|
| SEQ ID NO 29417 | TGTATACAGTAGCTAAATTCCT | TTA | chr12 | 21582909 | 21582930 | 21582914 | 21582909 | - |
| SEQ ID NO 29418 | AATTCCTTGCCTCTCACAAGCG | CTA | chr12 | 21582894 | 21582915 | 21582899 | 21582894 | - |
| SEQ ID NO 29419 | CTTGCCTCTCACAAGCGTTGAA | TTC | chr12 | 21582889 | 21582910 | 21582894 | 21582889 | - |
| SEQ ID NO 29420 | GCCTCTCACAAGCGTTGAATCA | CTT | chr12 | 21582886 | 21582907 | 21582891 | 21582886 | - |
| SEQ ID NO 29421 | CCTCTCACAAGCGTTGAATCAA | TTG | chr12 | 21582885 | 21582906 | 21582890 | 21582885 | - |
| SEQ ID NO 29422 | TCACAAGCGTTGAATCAAGAGT | CTC | chr12 | 21582881 | 21582902 | 21582886 | 21582881 | - |
| SEQ ID NO 29423 | ACAAGCGTTGAATCAAGAGTGT | CTC | chr12 | 21582879 | 21582900 | 21582884 | 21582879 | - |
| SEQ ID NO 29424 | AATCAAGAGTGTCAAATGCATT | TTG | chr12 | 21582869 | 21582890 | 21582874 | 21582869 | - |
| SEQ ID NO 29425 | ATTTTGCATAACTCTCTAAACA | TTT | chr12 | 21582846 | 21582867 | 21582851 | 21582846 | - |
| SEQ ID NO 29426 | TTTTGCATAACTCTCTAAACAA | TTA | chr12 | 21582845 | 21582866 | 21582850 | 21582845 | - |
| SEQ ID NO 29427 | TGCATAACTCTCTAAACAATTG | TTT | chr12 | 21582842 | 21582863 | 21582847 | 21582842 | - |
| SEQ ID NO 29428 | GCATAACTCTCTAAACAATTGA | TTT | chr12 | 21582841 | 21582862 | 21582846 | 21582841 | - |
| SEQ ID NO 29429 | CATAACTCTCTAAACAATTGAT | TTG | chr12 | 21582840 | 21582861 | 21582845 | 21582840 | - |
| SEQ ID NO 29430 | TCTAAACAATTGATGCCAAGGA | CTC | chr12 | 21582832 | 21582853 | 21582837 | 21582832 | - |
| SEQ ID NO 29431 | TAAACAATTGATGCCAAGGATT | CTC | chr12 | 21582830 | 21582851 | 21582835 | 21582830 | - |
| SEQ ID NO 29432 | AACAATTGATGCCAAGGATTAT | CTA | chr12 | 21582828 | 21582849 | 21582833 | 21582828 | - |
| SEQ ID NO 29433 | ATGCCAAGGATTATCAGTGTTC | TTG | chr12 | 21582820 | 21582841 | 21582825 | 21582820 | - |
| SEQ ID NO 29434 | TCAGTGTTCTCCATACCATTAG | TTA | chr12 | 21582807 | 21582828 | 21582812 | 21582807 | - |
| SEQ ID NO 29435 | TCCATACCATTAGAAGAAGAGT | TTC | chr12 | 21582798 | 21582819 | 21582803 | 21582798 | - |
| SEQ ID NO 29436 | CATACCATTAGAAGAAGAGTCC | CTC | chr12 | 21582796 | 21582817 | 21582801 | 21582796 | - |
| SEQ ID NO 29437 | GAAGAAGAGTCCTTAGCATATT | TTA | chr12 | 21582786 | 21582807 | 21582791 | 21582786 | - |
| SEQ ID NO 29438 | AGCATATTTGGGTCTAATCATA | CTT | chr12 | 21582772 | 21582793 | 21582777 | 21582772 | - |
| SEQ ID NO 29439 | GCATATTTGGGTCTAATCATAT | TTA | chr12 | 21582771 | 21582792 | 21582776 | 21582771 | - |
| SEQ ID NO 29440 | GGGTCTAATCATATTAAGCAGC | TTT | chr12 | 21582763 | 21582784 | 21582768 | 21582763 | - |
| SEQ ID NO 29441 | GGTCTAATCATATTAAGCAGCC | TTG | chr12 | 21582762 | 21582783 | 21582767 | 21582762 | - |
| SEQ ID NO 29442 | ATCATATTAAGCAGCCAACTCC | CTA | chr12 | 21582756 | 21582777 | 21582761 | 21582756 | - |
| SEQ ID NO 29443 | AGCAGCCAACTCCAGAAACCCC | TTA | chr12 | 21582747 | 21582768 | 21582752 | 21582747 | - |
| SEQ ID NO 29444 | CAGAAACCCCAAAACCAATGAA | CTC | chr12 | 21582735 | 21582756 | 21582740 | 21582735 | - |
| SEQ ID NO 29445 | CATCCTTAATATTCTGTTCCTC | CTC | chr12 | 21582706 | 21582727 | 21582711 | 21582706 | - |
| SEQ ID NO 29446 | AATATTCTGTTCCTCTAGAACC | CTT | chr12 | 21582699 | 21582720 | 21582704 | 21582699 | - |
| SEQ ID NO 29447 | ATATTCTGTTCCTCTAGAACCA | TTA | chr12 | 21582698 | 21582719 | 21582703 | 21582698 | - |
| SEQ ID NO 29448 | TGTTCCTCTAGAACCACTCCTG | TTC | chr12 | 21582692 | 21582713 | 21582697 | 21582692 | - |
| SEQ ID NO 29449 | TTCCTCTAGAACCACTCCTGGT | CTG | chr12 | 21582690 | 21582711 | 21582695 | 21582690 | - |
| SEQ ID NO 29450 | CTCTAGAACCACTCCTGGTACC | TTC | chr12 | 21582687 | 21582708 | 21582692 | 21582687 | - |
| SEQ ID NO 29451 | TAGAACCACTCCTGGTACCAAA | CTC | chr12 | 21582684 | 21582705 | 21582689 | 21582684 | - |
| SEQ ID NO 29452 | GAACCACTCCTGGTACCAAAAT | CTA | chr12 | 21582682 | 21582703 | 21582687 | 21582682 | - |
| SEQ ID NO 29453 | CTGGTACCAAAATCTGTATTAG | CTC | chr12 | 21582673 | 21582694 | 21582678 | 21582673 | - |
| SEQ ID NO 29454 | GTACCAAAATCTGTATTAGGGT | CTG | chr12 | 21582670 | 21582691 | 21582675 | 21582670 | - |
| SEQ ID NO 29455 | TATTAGGGTTCTACAGAGAAAC | CTG | chr12 | 21582657 | 21582678 | 21582662 | 21582657 | - |
| SEQ ID NO 29456 | GGGTTCTACAGAGAAACAGAAT | TTA | chr12 | 21582652 | 21582673 | 21582657 | 21582652 | - |
| SEQ ID NO 29457 | TACAGAGAAACAGAATTAATAG | TTC | chr12 | 21582646 | 21582667 | 21582651 | 21582646 | - |
| SEQ ID NO 29458 | CAGAGAAACAGAATTAATAGGA | CTA | chr12 | 21582644 | 21582665 | 21582649 | 21582644 | - |
| SEQ ID NO 29459 | ATAGGAGATATATATCTATATC | TTA | chr12 | 21582628 | 21582649 | 21582633 | 21582628 | - |
| SEQ ID NO 29460 | TATCTATATCTATATCTATATC | CTA | chr12 | 21582610 | 21582631 | 21582615 | 21582610 | - |
| SEQ ID NO 29461 | TATCTATATCTATATCTATATC | CTA | chr12 | 21582604 | 21582625 | 21582609 | 21582604 | - |
| SEQ ID NO 29462 | TATCTATATCTATATCTATATC | CTA | chr12 | 21582598 | 21582619 | 21582603 | 21582598 | - |
| SEQ ID NO 29463 | TATCTATATCTATATCTATCTC | CTA | chr12 | 21582592 | 21582613 | 21582597 | 21582592 | - |
| SEQ ID NO 29464 | TATCTATATCTATCTCTATATC | CTA | chr12 | 21582586 | 21582607 | 21582591 | 21582586 | - |
| SEQ ID NO 29465 | TATCTATCTCTATATCTATCTC | CTA | chr12 | 21582580 | 21582601 | 21582585 | 21582580 | - |
| SEQ ID NO 29466 | TCTCTATATCTATCTCTATATC | CTA | chr12 | 21582574 | 21582595 | 21582579 | 21582574 | - |
| SEQ ID NO 29467 | TATATCTATCTCTATATCTATA | CTC | chr12 | 21582570 | 21582591 | 21582575 | 21582570 | - |
| SEQ ID NO 29468 | TATCTATCTCTATATCTATATC | CTA | chr12 | 21582568 | 21582589 | 21582573 | 21582568 | - |
| SEQ ID NO 29469 | TCTCTATATCTATATCTATATG | CTA | chr12 | 21582562 | 21582583 | 21582567 | 21582562 | - |
| SEQ ID NO 29470 | TATATCTATATCTATATGAGAG | CTC | chr12 | 21582558 | 21582579 | 21582563 | 21582558 | - |
| SEQ ID NO 29471 | TATCTATATCTATATGAGAGTT | CTA | chr12 | 21582556 | 21582577 | 21582561 | 21582556 | - |
| SEQ ID NO 29472 | TATCTATATGAGAGTTTATTAT | CTA | chr12 | 21582550 | 21582571 | 21582555 | 21582550 | - |
| SEQ ID NO 29473 | TATGAGAGTTTATTATGTAGTA | CTA | chr12 | 21582544 | 21582565 | 21582549 | 21582544 | - |

Figure 48 (Cont'd)

| | | | | | | | | |
|---|---|---|---|---|---|---|---|---|
| SEQ ID NO 29474 | ATTATGTAGTATTGACTCACAT | TTT | chr12 | 21582533 | 21582554 | 21582538 | 21582533 | - |
| SEQ ID NO 29475 | TTATGTAGTATTGACTCACATG | TTA | chr12 | 21582532 | 21582553 | 21582537 | 21582532 | - |
| SEQ ID NO 29476 | TGTAGTATTGACTCACATGTTC | TTA | chr12 | 21582529 | 21582550 | 21582534 | 21582529 | - |
| SEQ ID NO 29477 | ACTCACATGTTCACAAGGTCCC | TTG | chr12 | 21582519 | 21582540 | 21582524 | 21582519 | - |
| SEQ ID NO 29478 | ACATGTTCACAAGGTCCCAAAA | CTC | chr12 | 21582515 | 21582536 | 21582520 | 21582515 | - |
| SEQ ID NO 29479 | ACAAGGTCCCAAAACAGGCCAT | TTC | chr12 | 21582507 | 21582528 | 21582512 | 21582507 | - |
| SEQ ID NO 29480 | CCAGCTGAGGAACAAGGAAGCT | CTG | chr12 | 21582482 | 21582503 | 21582487 | 21582482 | - |
| SEQ ID NO 29481 | AGGAACAAGGAAGCTAGTCGGA | CTG | chr12 | 21582475 | 21582496 | 21582480 | 21582475 | - |
| SEQ ID NO 29482 | GTCGGAGTCCCAAAGCTGAAGA | CTA | chr12 | 21582459 | 21582480 | 21582464 | 21582459 | - |
| SEQ ID NO 29483 | AAGAACCTGGAGTTCAATGTTC | CTG | chr12 | 21582441 | 21582462 | 21582446 | 21582441 | - |
| SEQ ID NO 29484 | GAGTTCAATGTTCCAGGGCAGG | CTG | chr12 | 21582432 | 21582453 | 21582437 | 21582432 | - |
| SEQ ID NO 29485 | AATGTTCCAGGGCAGGAAGAAT | TTC | chr12 | 21582426 | 21582447 | 21582431 | 21582426 | - |
| SEQ ID NO 29486 | CAGGGCAGGAAGAATCCAGCAT | TTC | chr12 | 21582419 | 21582440 | 21582424 | 21582419 | - |
| SEQ ID NO 29487 | GGATGCCAAGCCAATCTAGCCT | CTG | chr12 | 21582378 | 21582399 | 21582383 | 21582378 | - |
| SEQ ID NO 29488 | GCCTTTTCACATTTTTCTGCCT | CTA | chr12 | 21582360 | 21582381 | 21582365 | 21582360 | - |
| SEQ ID NO 29489 | TTCACATTTTTCTGCCTGCTTT | CTT | chr12 | 21582355 | 21582376 | 21582360 | 21582355 | - |
| SEQ ID NO 29490 | TCACATTTTTCTGCCTGCTTTA | TTT | chr12 | 21582354 | 21582375 | 21582359 | 21582354 | - |
| SEQ ID NO 29491 | CACATTTTTCTGCCTGCTTTAT | TTT | chr12 | 21582353 | 21582374 | 21582358 | 21582353 | - |
| SEQ ID NO 29492 | ACATTTTTCTGCCTGCTTTATA | TTC | chr12 | 21582352 | 21582373 | 21582357 | 21582352 | - |
| SEQ ID NO 29493 | TTCTGCCTGCTTTATATCCTGG | TTT | chr12 | 21582346 | 21582367 | 21582351 | 21582346 | - |
| SEQ ID NO 29494 | TCTGCCTGCTTTATATCCTGGC | TTT | chr12 | 21582345 | 21582366 | 21582350 | 21582345 | - |
| SEQ ID NO 29495 | CTGCCTGCTTTATATCCTGGCT | TTT | chr12 | 21582344 | 21582365 | 21582349 | 21582344 | - |
| SEQ ID NO 29496 | TGCCTGCTTTATATCCTGGCTG | TTC | chr12 | 21582343 | 21582364 | 21582348 | 21582343 | - |
| SEQ ID NO 29497 | CCTGCTTTATATCCTGGCTGTG | CTG | chr12 | 21582341 | 21582362 | 21582346 | 21582341 | - |
| SEQ ID NO 29498 | CTTTATATCCTGGCTGTGCTGG | CTG | chr12 | 21582337 | 21582358 | 21582342 | 21582337 | - |
| SEQ ID NO 29499 | TATATCCTGGCTGTGCTGGCAA | CTT | chr12 | 21582334 | 21582355 | 21582339 | 21582334 | - |
| SEQ ID NO 29500 | ATATCCTGGCTGTGCTGGCAAC | TTT | chr12 | 21582333 | 21582354 | 21582338 | 21582333 | - |
| SEQ ID NO 29501 | TATCCTGGCTGTGCTGGCAACT | TTA | chr12 | 21582332 | 21582353 | 21582337 | 21582332 | - |
| SEQ ID NO 29502 | GCTGTGCTGGCAACTGATTAGA | CTG | chr12 | 21582325 | 21582346 | 21582330 | 21582325 | - |
| SEQ ID NO 29503 | TGCTGGCAACTGATTAGATGGT | CTG | chr12 | 21582321 | 21582342 | 21582326 | 21582321 | - |
| SEQ ID NO 29504 | GCAACTGATTAGATGGTGCCCA | CTG | chr12 | 21582316 | 21582337 | 21582321 | 21582316 | - |
| SEQ ID NO 29505 | ATTAGATGGTGCCCACCCAGAT | CTG | chr12 | 21582309 | 21582330 | 21582314 | 21582309 | - |
| SEQ ID NO 29506 | GATGGTGCCCACCCAGATTAAG | TTA | chr12 | 21582305 | 21582326 | 21582310 | 21582305 | - |
| SEQ ID NO 29507 | AGGGTGGGTCTGCCTTCCCCAG | TTA | chr12 | 21582285 | 21582306 | 21582290 | 21582285 | - |
| SEQ ID NO 29508 | CCTTCCCCAGCCCACTGACTGA | CTG | chr12 | 21582273 | 21582294 | 21582278 | 21582273 | - |
| SEQ ID NO 29509 | CCCCAGCCCACTGACTGAAATA | CTT | chr12 | 21582269 | 21582290 | 21582274 | 21582269 | - |
| SEQ ID NO 29510 | CCCAGCCCACTGACTGAAATAT | TTC | chr12 | 21582268 | 21582289 | 21582273 | 21582268 | - |
| SEQ ID NO 29511 | ACTGAAATATTAATCTCCTTTG | CTG | chr12 | 21582256 | 21582277 | 21582261 | 21582256 | - |
| SEQ ID NO 29512 | AAATATTAATCTCCTTTGGTAA | CTG | chr12 | 21582252 | 21582273 | 21582257 | 21582252 | - |
| SEQ ID NO 29513 | ATCTCCTTTGGTAACACCCTCA | TTA | chr12 | 21582244 | 21582265 | 21582249 | 21582244 | - |
| SEQ ID NO 29514 | CTTTGGTAACACCCTCACAGAC | CTC | chr12 | 21582239 | 21582260 | 21582244 | 21582239 | - |
| SEQ ID NO 29515 | TGGTAACACCCTCACAGACACA | CTT | chr12 | 21582236 | 21582257 | 21582241 | 21582236 | - |
| SEQ ID NO 29516 | GGTAACACCCTCACAGACACAC | TTT | chr12 | 21582235 | 21582256 | 21582240 | 21582235 | - |
| SEQ ID NO 29517 | GTAACACCCTCACAGACACACC | TTG | chr12 | 21582234 | 21582255 | 21582239 | 21582234 | - |
| SEQ ID NO 29518 | ACAGACACACCCAAGATCATTA | CTC | chr12 | 21582223 | 21582244 | 21582228 | 21582223 | - |
| SEQ ID NO 29519 | CTTTGCATCCTTCAGTCCAATC | TTA | chr12 | 21582201 | 21582222 | 21582206 | 21582201 | - |
| SEQ ID NO 29520 | TGCATCCTTCAGTCCAATCAAG | CTT | chr12 | 21582198 | 21582219 | 21582203 | 21582198 | - |
| SEQ ID NO 29521 | GCATCCTTCAGTCCAATCAAGT | TTT | chr12 | 21582197 | 21582218 | 21582202 | 21582197 | - |
| SEQ ID NO 29522 | CATCCTTCAGTCCAATCAAGTT | TTG | chr12 | 21582196 | 21582217 | 21582201 | 21582196 | - |
| SEQ ID NO 29523 | CAGTCCAATCAAGTTGACACTC | CTT | chr12 | 21582189 | 21582210 | 21582194 | 21582189 | - |
| SEQ ID NO 29524 | AGTCCAATCAAGTTGACACTCA | TTC | chr12 | 21582188 | 21582209 | 21582193 | 21582188 | - |
| SEQ ID NO 29525 | ACACTCAGTATTAACCATCACA | TTG | chr12 | 21582173 | 21582194 | 21582178 | 21582173 | - |
| SEQ ID NO 29526 | AGTATTAACCATCACAGTCACT | CTC | chr12 | 21582167 | 21582188 | 21582172 | 21582167 | - |
| SEQ ID NO 29527 | ACCATCACAGTCACTTTCTAAT | TTA | chr12 | 21582160 | 21582181 | 21582165 | 21582160 | - |
| SEQ ID NO 29528 | TCTAATGAGGTTGGTTTTTTTG | CTT | chr12 | 21582144 | 21582165 | 21582149 | 21582144 | - |
| SEQ ID NO 29529 | CTAATGAGGTTGGTTTTTTTGT | TTT | chr12 | 21582143 | 21582164 | 21582148 | 21582143 | - |
| SEQ ID NO 29530 | TAATGAGGTTGGTTTTTTTGTT | TTC | chr12 | 21582142 | 21582163 | 21582147 | 21582142 | - |
| SEQ ID NO 29531 | ATGAGGTTGGTTTTTTTGTTGT | CTA | chr12 | 21582140 | 21582161 | 21582145 | 21582140 | - |

Figure 48 (Cont'd)

| SEQ ID NO 29532 | GTTTTTTTGTTGTTGAGTTCCT | TTG | chr12 | 21582131 | 21582152 | 21582136 | 21582131 | - |
|---|---|---|---|---|---|---|---|---|
| SEQ ID NO 29533 | TTTTGTTGTTGAGTTCCTTGTA | TTT | chr12 | 21582127 | 21582148 | 21582132 | 21582127 | - |
| SEQ ID NO 29534 | TTTGTTGTTGAGTTCCTTGTAG | TTT | chr12 | 21582126 | 21582147 | 21582131 | 21582126 | - |
| SEQ ID NO 29535 | TTGTTGTTGAGTTCCTTGTAGA | TTT | chr12 | 21582125 | 21582146 | 21582130 | 21582125 | - |
| SEQ ID NO 29536 | TGTTGTTGAGTTCCTTGTAGAT | TTT | chr12 | 21582124 | 21582145 | 21582129 | 21582124 | - |
| SEQ ID NO 29537 | GTTGTTGAGTTCCTTGTAGATT | TTT | chr12 | 21582123 | 21582144 | 21582128 | 21582123 | - |
| SEQ ID NO 29538 | TTGTTGAGTTCCTTGTAGATTC | TTG | chr12 | 21582122 | 21582143 | 21582127 | 21582122 | - |
| SEQ ID NO 29539 | TTGAGTTCCTTGTAGATTCTGT | TTG | chr12 | 21582119 | 21582140 | 21582124 | 21582119 | - |
| SEQ ID NO 29540 | AGTTCCTTGTAGATTCTGTATA | TTG | chr12 | 21582116 | 21582137 | 21582121 | 21582116 | - |
| SEQ ID NO 29541 | CTTGTAGATTCTGTATATTAGC | TTC | chr12 | 21582111 | 21582132 | 21582116 | 21582111 | - |
| SEQ ID NO 29542 | GTAGATTCTGTATATTAGCCTT | CTT | chr12 | 21582108 | 21582129 | 21582113 | 21582108 | - |
| SEQ ID NO 29543 | TAGATTCTGTATATTAGCCTTT | TTG | chr12 | 21582107 | 21582128 | 21582112 | 21582107 | - |
| SEQ ID NO 29544 | TGTATATTAGCCTTTTGTTGCA | TTC | chr12 | 21582100 | 21582121 | 21582105 | 21582100 | - |
| SEQ ID NO 29545 | TATATTAGCCTTTTGTTGCATT | CTG | chr12 | 21582098 | 21582119 | 21582103 | 21582098 | - |
| SEQ ID NO 29546 | GCCTTTTGTTGCATTCATAGTT | TTA | chr12 | 21582091 | 21582112 | 21582096 | 21582091 | - |
| SEQ ID NO 29547 | TTGTTGCATTCATAGTTTGCAA | CTT | chr12 | 21582086 | 21582107 | 21582091 | 21582086 | - |
| SEQ ID NO 29548 | TGTTGCATTCATAGTTTGCAAT | TTT | chr12 | 21582085 | 21582106 | 21582090 | 21582085 | - |
| SEQ ID NO 29549 | GTTGCATTCATAGTTTGCAATT | TTT | chr12 | 21582084 | 21582105 | 21582089 | 21582084 | - |
| SEQ ID NO 29550 | TTGCATTCATAGTTTGCAATTT | TTG | chr12 | 21582083 | 21582104 | 21582088 | 21582083 | - |
| SEQ ID NO 29551 | CATTCATAGTTTGCAATTTTTT | TTG | chr12 | 21582080 | 21582101 | 21582085 | 21582080 | - |
| SEQ ID NO 29552 | ATAGTTTGCAATTTTTTTTTCT | TTC | chr12 | 21582075 | 21582096 | 21582080 | 21582075 | - |
| SEQ ID NO 29553 | GCAATTTTTTTTCTCATTCTG | TTT | chr12 | 21582068 | 21582089 | 21582073 | 21582068 | - |
| SEQ ID NO 29554 | CAATTTTTTTTCTCATTCTGT | TTG | chr12 | 21582067 | 21582088 | 21582072 | 21582067 | - |
| SEQ ID NO 29555 | TTTTTTCTCATTCTGTAGGTTA | TTT | chr12 | 21582061 | 21582082 | 21582066 | 21582061 | - |
| SEQ ID NO 29556 | TTTTTCTCATTCTGTAGGTTAT | TTT | chr12 | 21582060 | 21582081 | 21582065 | 21582060 | - |
| SEQ ID NO 29557 | TTTTCTCATTCTGTAGGTTATC | TTT | chr12 | 21582059 | 21582080 | 21582064 | 21582059 | - |
| SEQ ID NO 29558 | TTTCTCATTCTGTAGGTTATCC | TTT | chr12 | 21582058 | 21582079 | 21582063 | 21582058 | - |
| SEQ ID NO 29559 | TTCTCATTCTGTAGGTTATCCG | TTT | chr12 | 21582057 | 21582078 | 21582062 | 21582057 | - |
| SEQ ID NO 29560 | TCTCATTCTGTAGGTTATCCGT | TTT | chr12 | 21582056 | 21582077 | 21582061 | 21582056 | - |
| SEQ ID NO 29561 | CTCATTCTGTAGGTTATCCGTT | TTT | chr12 | 21582055 | 21582076 | 21582060 | 21582055 | - |
| SEQ ID NO 29562 | TCATTCTGTAGGTTATCCGTTT | TTC | chr12 | 21582054 | 21582075 | 21582059 | 21582054 | - |
| SEQ ID NO 29563 | ATTCTGTAGGTTATCCGTTTAC | CTC | chr12 | 21582052 | 21582073 | 21582057 | 21582052 | - |
| SEQ ID NO 29564 | TGTAGGTTATCCGTTTACTCTG | TTC | chr12 | 21582048 | 21582069 | 21582053 | 21582048 | - |
| SEQ ID NO 29565 | TAGGTTATCCGTTTACTCTGTT | CTG | chr12 | 21582046 | 21582067 | 21582051 | 21582046 | - |
| SEQ ID NO 29566 | TCCGTTTACTCTGTTGATTCGG | TTA | chr12 | 21582039 | 21582060 | 21582044 | 21582039 | - |
| SEQ ID NO 29567 | ACTCTGTTGATTCGGTCTTTTG | TTT | chr12 | 21582032 | 21582053 | 21582037 | 21582032 | - |
| SEQ ID NO 29568 | CTCTGTTGATTCGGTCTTTTGC | TTA | chr12 | 21582031 | 21582052 | 21582036 | 21582031 | - |
| SEQ ID NO 29569 | TGTTGATTCGGTCTTTTGCGGT | CTC | chr12 | 21582028 | 21582049 | 21582033 | 21582028 | - |
| SEQ ID NO 29570 | TTGATTCGGTCTTTTGCGGTGC | CTG | chr12 | 21582026 | 21582047 | 21582031 | 21582026 | - |
| SEQ ID NO 29571 | ATTCGGTCTTTTGCGGTGCAGA | TTG | chr12 | 21582023 | 21582044 | 21582028 | 21582023 | - |
| SEQ ID NO 29572 | GGTCTTTTGCGGTGCAGAAGCA | TTC | chr12 | 21582019 | 21582040 | 21582024 | 21582019 | - |
| SEQ ID NO 29573 | TTGCGGTGCAGAAGCATTTTAG | CTT | chr12 | 21582013 | 21582034 | 21582018 | 21582013 | - |
| SEQ ID NO 29574 | TGCGGTGCAGAAGCATTTTAGT | TTT | chr12 | 21582012 | 21582033 | 21582017 | 21582012 | - |
| SEQ ID NO 29575 | GCGGTGCAGAAGCATTTTAGTT | TTT | chr12 | 21582011 | 21582032 | 21582016 | 21582011 | - |
| SEQ ID NO 29576 | CGGTGCAGAAGCATTTTAGTTT | TTG | chr12 | 21582010 | 21582031 | 21582015 | 21582010 | - |
| SEQ ID NO 29577 | TAGTTTAATTAAGTCCCATTTG | TTT | chr12 | 21581994 | 21582015 | 21581999 | 21581994 | - |
| SEQ ID NO 29578 | AGTTTAATTAAGTCCCATTTGT | TTT | chr12 | 21581993 | 21582014 | 21581998 | 21581993 | - |
| SEQ ID NO 29579 | GTTTAATTAAGTCCCATTTGTC | TTA | chr12 | 21581992 | 21582013 | 21581997 | 21581992 | - |
| SEQ ID NO 29580 | AATTAAGTCCCATTTGTCTGTT | TTT | chr12 | 21581988 | 21582009 | 21581993 | 21581988 | - |
| SEQ ID NO 29581 | ATTAAGTCCCATTTGTCTGTTT | TTA | chr12 | 21581987 | 21582008 | 21581992 | 21581987 | - |
| SEQ ID NO 29582 | AGTCCCATTTGTCTGTTTTTGT | TTA | chr12 | 21581983 | 21582004 | 21581988 | 21581983 | - |
| SEQ ID NO 29583 | GTCTGTTTTTGTTTTTGTTGTG | TTT | chr12 | 21581973 | 21581994 | 21581978 | 21581973 | - |
| SEQ ID NO 29584 | TCTGTTTTTGTTTTTGTTGTGT | TTG | chr12 | 21581972 | 21581993 | 21581977 | 21581972 | - |
| SEQ ID NO 29585 | TTTTTGTTTTTGTTGTGTTTAG | CTG | chr12 | 21581968 | 21581989 | 21581973 | 21581968 | - |
| SEQ ID NO 29586 | TTGTTTTTGTTGTGTTTAGTTT | TTT | chr12 | 21581965 | 21581986 | 21581970 | 21581965 | - |
| SEQ ID NO 29587 | TGTTTTTGTTGTGTTTAGTTTT | TTT | chr12 | 21581964 | 21581985 | 21581969 | 21581964 | - |
| SEQ ID NO 29588 | GTTTTTGTTGTGTTTAGTTTTG | TTT | chr12 | 21581963 | 21581984 | 21581968 | 21581963 | - |
| SEQ ID NO 29589 | TTTTTGTTGTGTTTAGTTTTGA | TTG | chr12 | 21581962 | 21581983 | 21581967 | 21581962 | - |

Figure 48 (Cont'd)

| SEQ ID NO 29590 | TTGTTGTGTTTAGTTTTGAGGA | TTT | chr12 | 21581959 | 21581980 | 21581964 | 21581959 | - |
|---|---|---|---|---|---|---|---|---|
| SEQ ID NO 29591 | TGTTGTGTTTAGTTTTGAGGAC | TTT | chr12 | 21581958 | 21581979 | 21581963 | 21581958 | - |
| SEQ ID NO 29592 | GTTGTGTTTAGTTTTGAGGACT | TTT | chr12 | 21581957 | 21581978 | 21581962 | 21581957 | - |
| SEQ ID NO 29593 | TTGTGTTTAGTTTTGAGGACTT | TTG | chr12 | 21581956 | 21581977 | 21581961 | 21581956 | - |
| SEQ ID NO 29594 | TGTTTAGTTTTGAGGACTTGGT | TTG | chr12 | 21581953 | 21581974 | 21581958 | 21581953 | - |
| SEQ ID NO 29595 | AGTTTTGAGGACTTGGTCATAA | TTT | chr12 | 21581948 | 21581969 | 21581953 | 21581948 | - |
| SEQ ID NO 29596 | GTTTTGAGGACTTGGTCATAAA | TTA | chr12 | 21581947 | 21581968 | 21581952 | 21581947 | - |
| SEQ ID NO 29597 | TGAGGACTTGGTCATAAATTCT | TTT | chr12 | 21581943 | 21581964 | 21581948 | 21581943 | - |
| SEQ ID NO 29598 | GAGGACTTGGTCATAAATTCTT | TTT | chr12 | 21581942 | 21581963 | 21581947 | 21581942 | - |
| SEQ ID NO 29599 | AGGACTTGGTCATAAATTCTTT | TTG | chr12 | 21581941 | 21581962 | 21581946 | 21581941 | - |
| SEQ ID NO 29600 | GGTCATAAATTCTTTGCCTAGG | CTT | chr12 | 21581934 | 21581955 | 21581939 | 21581934 | - |
| SEQ ID NO 29601 | GTCATAAATTCTTTGCCTAGGC | TTG | chr12 | 21581933 | 21581954 | 21581938 | 21581933 | - |
| SEQ ID NO 29602 | TTTGCCTAGGCCACATCTAATT | TTC | chr12 | 21581922 | 21581943 | 21581927 | 21581922 | - |
| SEQ ID NO 29603 | TGCCTAGGCCACATCTAATTTT | CTT | chr12 | 21581920 | 21581941 | 21581925 | 21581920 | - |
| SEQ ID NO 29604 | GCCTAGGCCACATCTAATTTTT | TTT | chr12 | 21581919 | 21581940 | 21581924 | 21581919 | - |
| SEQ ID NO 29605 | CCTAGGCCACATCTAATTTTTA | TTG | chr12 | 21581918 | 21581939 | 21581923 | 21581918 | - |
| SEQ ID NO 29606 | GGCCACATCTAATTTTTAATCC | CTA | chr12 | 21581914 | 21581935 | 21581919 | 21581914 | - |
| SEQ ID NO 29607 | ATTTTTAATCCTCTTTTAGAGC | CTA | chr12 | 21581903 | 21581924 | 21581908 | 21581903 | - |
| SEQ ID NO 29608 | TTAATCCTCTTTTAGAGCCTGT | TTT | chr12 | 21581899 | 21581920 | 21581904 | 21581899 | - |
| SEQ ID NO 29609 | TAATCCTCTTTTAGAGCCTGTC | TTT | chr12 | 21581898 | 21581919 | 21581903 | 21581898 | - |
| SEQ ID NO 29610 | AATCCTCTTTTAGAGCCTGTCT | TTT | chr12 | 21581897 | 21581918 | 21581902 | 21581897 | - |
| SEQ ID NO 29611 | ATCCTCTTTTAGAGCCTGTCTT | TTA | chr12 | 21581896 | 21581917 | 21581901 | 21581896 | - |
| SEQ ID NO 29612 | TTTTAGAGCCTGTCTTTCCCTC | CTC | chr12 | 21581890 | 21581911 | 21581895 | 21581890 | - |
| SEQ ID NO 29613 | TTAGAGCCTGTCTTTCCCTCCA | CTT | chr12 | 21581888 | 21581909 | 21581893 | 21581888 | - |
| SEQ ID NO 29614 | TAGAGCCTGTCTTTCCCTCCAA | TTT | chr12 | 21581887 | 21581908 | 21581892 | 21581887 | - |
| SEQ ID NO 29615 | AGAGCCTGTCTTTCCCTCCAAA | TTT | chr12 | 21581886 | 21581907 | 21581891 | 21581886 | - |
| SEQ ID NO 29616 | GAGCCTGTCTTTCCCTCCAAAC | TTA | chr12 | 21581885 | 21581906 | 21581890 | 21581885 | - |
| SEQ ID NO 29617 | TCTTTCCCTCCAAACTAAATAT | CTG | chr12 | 21581878 | 21581899 | 21581883 | 21581878 | - |
| SEQ ID NO 29618 | TCCCTCCAAACTAAATATTATT | CTT | chr12 | 21581874 | 21581895 | 21581879 | 21581874 | - |
| SEQ ID NO 29619 | CCCTCCAAACTAAATATTATTT | TTT | chr12 | 21581873 | 21581894 | 21581878 | 21581873 | - |
| SEQ ID NO 29620 | CCTCCAAACTAAATATTATTTT | TTC | chr12 | 21581872 | 21581893 | 21581877 | 21581872 | - |
| SEQ ID NO 29621 | CAAACTAAATATTATTTTACCC | CTC | chr12 | 21581868 | 21581889 | 21581873 | 21581868 | - |
| SEQ ID NO 29622 | AATATTATTTTACCCCCATTTG | CTA | chr12 | 21581861 | 21581882 | 21581866 | 21581861 | - |
| SEQ ID NO 29623 | TTTTACCCCCATTTGACACATG | TTA | chr12 | 21581854 | 21581875 | 21581859 | 21581854 | - |
| SEQ ID NO 29624 | TACCCCCATTTGACACATGAGC | TTT | chr12 | 21581851 | 21581872 | 21581856 | 21581851 | - |
| SEQ ID NO 29625 | ACCCCCATTTGACACATGAGCT | TTT | chr12 | 21581850 | 21581871 | 21581855 | 21581850 | - |
| SEQ ID NO 29626 | CCCCCATTTGACACATGAGCTA | TTA | chr12 | 21581849 | 21581870 | 21581854 | 21581849 | - |
| SEQ ID NO 29627 | GACACATGAGCTAATTGAGCCT | TTT | chr12 | 21581840 | 21581861 | 21581845 | 21581840 | - |
| SEQ ID NO 29628 | ACACATGAGCTAATTGAGCCTT | TTG | chr12 | 21581839 | 21581860 | 21581844 | 21581839 | - |
| SEQ ID NO 29629 | ATTGAGCCTTCTGTCTGTTAAG | CTA | chr12 | 21581827 | 21581848 | 21581832 | 21581827 | - |
| SEQ ID NO 29630 | AGCCTTCTGTCTGTTAAGTAAG | TTG | chr12 | 21581823 | 21581844 | 21581828 | 21581823 | - |
| SEQ ID NO 29631 | CTGTCTGTTAAGTAAGTTGACT | CTT | chr12 | 21581817 | 21581838 | 21581822 | 21581817 | - |
| SEQ ID NO 29632 | TGTCTGTTAAGTAAGTTGACTA | TTC | chr12 | 21581816 | 21581837 | 21581821 | 21581816 | - |
| SEQ ID NO 29633 | TCTGTTAAGTAAGTTGACTAGT | CTG | chr12 | 21581814 | 21581835 | 21581819 | 21581814 | - |
| SEQ ID NO 29634 | TTAAGTAAGTTGACTAGTTCAG | CTG | chr12 | 21581810 | 21581831 | 21581815 | 21581810 | - |
| SEQ ID NO 29635 | AGTAAGTTGACTAGTTCAGTGT | TTA | chr12 | 21581807 | 21581828 | 21581812 | 21581807 | - |
| SEQ ID NO 29636 | ACTAGTTCAGTGTAAGTTGTTT | TTG | chr12 | 21581798 | 21581819 | 21581803 | 21581798 | - |
| SEQ ID NO 29637 | GTTCAGTGTAAGTTGTTTCTAA | CTA | chr12 | 21581794 | 21581815 | 21581799 | 21581794 | - |
| SEQ ID NO 29638 | AGTGTAAGTTGTTTCTAATTTT | TTC | chr12 | 21581790 | 21581811 | 21581795 | 21581790 | - |
| SEQ ID NO 29639 | TTTCTAATTTTTTGCCATCATA | TTG | chr12 | 21581779 | 21581800 | 21581784 | 21581779 | - |
| SEQ ID NO 29640 | CTAATTTTTTGCCATCATAATG | TTT | chr12 | 21581776 | 21581797 | 21581781 | 21581776 | - |
| SEQ ID NO 29641 | TAATTTTTTGCCATCATAATGC | TTC | chr12 | 21581775 | 21581796 | 21581780 | 21581775 | - |
| SEQ ID NO 29642 | ATTTTTTGCCATCATAATGCTT | CTA | chr12 | 21581773 | 21581794 | 21581778 | 21581773 | - |
| SEQ ID NO 29643 | TTTGCCATCATAATGCTTTAGT | TTT | chr12 | 21581769 | 21581790 | 21581774 | 21581769 | - |
| SEQ ID NO 29644 | TTGCCATCATAATGCTTTAGTA | TTT | chr12 | 21581768 | 21581789 | 21581773 | 21581768 | - |
| SEQ ID NO 29645 | TGCCATCATAATGCTTTAGTAA | TTT | chr12 | 21581767 | 21581788 | 21581772 | 21581767 | - |
| SEQ ID NO 29646 | GCCATCATAATGCTTTAGTAAA | TTT | chr12 | 21581766 | 21581787 | 21581771 | 21581766 | - |
| SEQ ID NO 29647 | CCATCATAATGCTTTAGTAAAC | TTG | chr12 | 21581765 | 21581786 | 21581770 | 21581765 | - |

Figure 48 (Cont'd)

| | | | | | | | | |
|---|---|---|---|---|---|---|---|---|
| SEQ ID NO 29648 | TAGTAAACATCCTTTTCATACT | CTT | chr12 | 21581751 | 21581772 | 21581756 | 21581751 | - |
| SEQ ID NO 29649 | AGTAAACATCCTTTTCATACTC | TTT | chr12 | 21581750 | 21581771 | 21581755 | 21581750 | - |
| SEQ ID NO 29650 | GTAAACATCCTTTTCATACTCT | TTA | chr12 | 21581749 | 21581770 | 21581754 | 21581749 | - |
| SEQ ID NO 29651 | TTCATACTCTCCTTAATTTTCC | CTT | chr12 | 21581737 | 21581758 | 21581742 | 21581737 | - |
| SEQ ID NO 29652 | TCATACTCTCCTTAATTTTCCC | TTT | chr12 | 21581736 | 21581757 | 21581741 | 21581736 | - |
| SEQ ID NO 29653 | CATACTCTCCTTAATTTTCCCC | TTT | chr12 | 21581735 | 21581756 | 21581740 | 21581735 | - |
| SEQ ID NO 29654 | ATACTCTCCTTAATTTTCCCCC | TTC | chr12 | 21581734 | 21581755 | 21581739 | 21581734 | - |
| SEQ ID NO 29655 | TCCTTAATTTTCCCCCAGGATG | CTC | chr12 | 21581728 | 21581749 | 21581733 | 21581728 | - |
| SEQ ID NO 29656 | CTTAATTTTCCCCCAGGATGGT | CTC | chr12 | 21581726 | 21581747 | 21581731 | 21581726 | - |
| SEQ ID NO 29657 | AATTTTCCCCCAGGATGGTTTT | CTT | chr12 | 21581723 | 21581744 | 21581728 | 21581723 | - |
| SEQ ID NO 29658 | ATTTTCCCCCAGGATGGTTTTC | TTA | chr12 | 21581722 | 21581743 | 21581727 | 21581722 | - |
| SEQ ID NO 29659 | TCCCCCAGGATGGTTTTCTAGA | TTT | chr12 | 21581718 | 21581739 | 21581723 | 21581718 | - |
| SEQ ID NO 29660 | CCCCCAGGATGGTTTTCTAGAT | TTT | chr12 | 21581717 | 21581738 | 21581722 | 21581717 | - |
| SEQ ID NO 29661 | CCCCAGGATGGTTTTCTAGATG | TTC | chr12 | 21581716 | 21581737 | 21581721 | 21581716 | - |
| SEQ ID NO 29662 | TCTAGATGTGGACTTGCTGGAT | TTT | chr12 | 21581702 | 21581723 | 21581707 | 21581702 | - |
| SEQ ID NO 29663 | CTAGATGTGGACTTGCTGGATC | TTT | chr12 | 21581701 | 21581722 | 21581706 | 21581701 | - |
| SEQ ID NO 29664 | TAGATGTGGACTTGCTGGATCC | TTC | chr12 | 21581700 | 21581721 | 21581705 | 21581700 | - |
| SEQ ID NO 29665 | GATGTGGACTTGCTGGATCCAA | CTA | chr12 | 21581698 | 21581719 | 21581703 | 21581698 | - |
| SEQ ID NO 29666 | GCTGGATCCAAAGTGTGCATAT | CTT | chr12 | 21581687 | 21581708 | 21581692 | 21581687 | - |
| SEQ ID NO 29667 | CTGGATCCAAAGTGTGCATATT | TTG | chr12 | 21581686 | 21581707 | 21581691 | 21581686 | - |
| SEQ ID NO 29668 | GATCCAAAGTGTGCATATTTTC | CTG | chr12 | 21581683 | 21581704 | 21581688 | 21581683 | - |
| SEQ ID NO 29669 | TCCAAATGTATCCATATATTGT | TTT | chr12 | 21581663 | 21581684 | 21581668 | 21581663 | - |
| SEQ ID NO 29670 | CCAAATGTATCCATATATTGTG | TTT | chr12 | 21581662 | 21581683 | 21581667 | 21581662 | - |
| SEQ ID NO 29671 | CAAATGTATCCATATATTGTGG | TTC | chr12 | 21581661 | 21581682 | 21581666 | 21581661 | - |
| SEQ ID NO 29672 | TGGCTTTGTGTTTTAATAGAGG | TTG | chr12 | 21581642 | 21581663 | 21581647 | 21581642 | - |
| SEQ ID NO 29673 | TGTGTTTTAATAGAGGTAGCAG | CTT | chr12 | 21581636 | 21581657 | 21581641 | 21581636 | - |
| SEQ ID NO 29674 | GTGTTTTAATAGAGGTAGCAGC | TTT | chr12 | 21581635 | 21581656 | 21581640 | 21581635 | - |
| SEQ ID NO 29675 | TGTTTTAATAGAGGTAGCAGCA | TTG | chr12 | 21581634 | 21581655 | 21581639 | 21581634 | - |
| SEQ ID NO 29676 | TAATAGAGGTAGCAGCAATATT | TTT | chr12 | 21581629 | 21581650 | 21581634 | 21581629 | - |
| SEQ ID NO 29677 | AATAGAGGTAGCAGCAATATTA | TTT | chr12 | 21581628 | 21581649 | 21581633 | 21581628 | - |
| SEQ ID NO 29678 | ATAGAGGTAGCAGCAATATTAG | TTA | chr12 | 21581627 | 21581648 | 21581632 | 21581627 | - |
| SEQ ID NO 29679 | GAGGAGAGAATTAAGGAACGAT | TTA | chr12 | 21581606 | 21581627 | 21581611 | 21581606 | - |
| SEQ ID NO 29680 | AGGAACGATTCTAGTGTAGCAG | TTA | chr12 | 21581593 | 21581614 | 21581598 | 21581593 | - |
| SEQ ID NO 29681 | TAGTGTAGCAGGACAAGCTGCA | TTC | chr12 | 21581582 | 21581603 | 21581587 | 21581582 | - |
| SEQ ID NO 29682 | GTGTAGCAGGACAAGCTGCATA | CTA | chr12 | 21581580 | 21581601 | 21581585 | 21581580 | - |
| SEQ ID NO 29683 | CATACAAAACCCCTCAGACACC | CTG | chr12 | 21581562 | 21581583 | 21581567 | 21581562 | - |
| SEQ ID NO 29684 | AGACACCGAGTTAAAGAAGGAA | CTC | chr12 | 21581547 | 21581568 | 21581552 | 21581547 | - |
| SEQ ID NO 29685 | AAGAAGGAAGGGCTTTATTCGG | TTA | chr12 | 21581534 | 21581555 | 21581539 | 21581534 | - |
| SEQ ID NO 29686 | TATTCGGCTGGGAGCTTGGGCA | CTT | chr12 | 21581519 | 21581540 | 21581524 | 21581519 | - |
| SEQ ID NO 29687 | ATTCGGCTGGGAGCTTGGGCAA | TTT | chr12 | 21581518 | 21581539 | 21581523 | 21581518 | - |
| SEQ ID NO 29688 | TTCGGCTGGGAGCTTGGGCAAG | TTA | chr12 | 21581517 | 21581538 | 21581522 | 21581517 | - |
| SEQ ID NO 29689 | GGCTGGGAGCTTGGGCAAGACT | TTC | chr12 | 21581514 | 21581535 | 21581519 | 21581514 | - |
| SEQ ID NO 29690 | GGAGCTTGGGCAAGACTCACAT | CTG | chr12 | 21581509 | 21581530 | 21581514 | 21581509 | - |
| SEQ ID NO 29691 | GGGCAAGACTCACATCTCCAAC | CTT | chr12 | 21581502 | 21581523 | 21581507 | 21581502 | - |
| SEQ ID NO 29692 | GGCAAGACTCACATCTCCAACA | TTG | chr12 | 21581501 | 21581522 | 21581506 | 21581501 | - |
| SEQ ID NO 29693 | ACATCTCCAACAACCAAGCTCT | CTC | chr12 | 21581491 | 21581512 | 21581496 | 21581491 | - |
| SEQ ID NO 29694 | CAACAACCAAGCTCTCAGAGTG | CTC | chr12 | 21581484 | 21581505 | 21581489 | 21581484 | - |
| SEQ ID NO 29695 | TCAGAGTGAGCAATTCCTGTCC | CTC | chr12 | 21581470 | 21581491 | 21581475 | 21581470 | - |
| SEQ ID NO 29696 | AGAGTGAGCAATTCCTGTCCCT | CTC | chr12 | 21581468 | 21581489 | 21581473 | 21581468 | - |
| SEQ ID NO 29697 | CTGTCCCTTTTAAGGGCTTACA | TTC | chr12 | 21581454 | 21581475 | 21581459 | 21581454 | - |
| SEQ ID NO 29698 | TCCCTTTTAAGGGCTTACAACT | CTG | chr12 | 21581451 | 21581472 | 21581456 | 21581451 | - |
| SEQ ID NO 29699 | TTAAGGGCTTACAACTCTAAGG | CTT | chr12 | 21581445 | 21581466 | 21581450 | 21581445 | - |
| SEQ ID NO 29700 | TAAGGGCTTACAACTCTAAGGG | TTT | chr12 | 21581444 | 21581465 | 21581449 | 21581444 | - |
| SEQ ID NO 29701 | AAGGGCTTACAACTCTAAGGGG | TTT | chr12 | 21581443 | 21581464 | 21581448 | 21581443 | - |
| SEQ ID NO 29702 | AGGGCTTACAACTCTAAGGGGG | TTA | chr12 | 21581442 | 21581463 | 21581447 | 21581442 | - |
| SEQ ID NO 29703 | ACAACTCTAAGGGGGTACATGA | CTT | chr12 | 21581435 | 21581456 | 21581440 | 21581435 | - |
| SEQ ID NO 29704 | CAACTCTAAGGGGGTACATGAC | TTA | chr12 | 21581434 | 21581455 | 21581439 | 21581434 | - |
| SEQ ID NO 29705 | TAAGGGGGTACATGACTGGGGG | CTC | chr12 | 21581428 | 21581449 | 21581433 | 21581428 | - |

Figure 48 (Cont'd)

| | | | | | | | | |
|---|---|---|---|---|---|---|---|---|
| SEQ ID NO 29706 | AGGGGGTACATGACTGGGGGCT | CTA | chr12 | 21581426 | 21581447 | 21581431 | 21581426 | - |
| SEQ ID NO 29707 | GGGGCTGCATGCACTGGTCATC | CTG | chr12 | 21581410 | 21581431 | 21581415 | 21581410 | - |
| SEQ ID NO 29708 | CATGCACTGGTCATCAGAATGG | CTG | chr12 | 21581403 | 21581424 | 21581408 | 21581403 | - |
| SEQ ID NO 29709 | GTCATCAGAATGGAACAGAACA | CTG | chr12 | 21581394 | 21581415 | 21581399 | 21581394 | - |
| SEQ ID NO 29710 | TCACACTGCTTTTCCATACAGT | TTT | chr12 | 21581360 | 21581381 | 21581365 | 21581360 | - |
| SEQ ID NO 29711 | CACACTGCTTTTCCATACAGTG | TTT | chr12 | 21581359 | 21581380 | 21581364 | 21581359 | - |
| SEQ ID NO 29712 | ACACTGCTTTTCCATACAGTGT | TTC | chr12 | 21581358 | 21581379 | 21581363 | 21581358 | - |
| SEQ ID NO 29713 | CTTTTCCATACAGTGTCTGGAA | CTG | chr12 | 21581352 | 21581373 | 21581357 | 21581352 | - |
| SEQ ID NO 29714 | TTCCATACAGTGTCTGGAATCT | CTT | chr12 | 21581349 | 21581370 | 21581354 | 21581349 | - |
| SEQ ID NO 29715 | TCCATACAGTGTCTGGAATCTA | TTT | chr12 | 21581348 | 21581369 | 21581353 | 21581348 | - |
| SEQ ID NO 29716 | CCATACAGTGTCTGGAATCTAT | TTT | chr12 | 21581347 | 21581368 | 21581352 | 21581347 | - |
| SEQ ID NO 29717 | CATACAGTGTCTGGAATCTATA | TTC | chr12 | 21581346 | 21581367 | 21581351 | 21581346 | - |
| SEQ ID NO 29718 | GAATCTATAGATAACATAACTG | CTG | chr12 | 21581333 | 21581354 | 21581338 | 21581333 | - |
| SEQ ID NO 29719 | TAGATAACATAACTGGCCAGGT | CTA | chr12 | 21581326 | 21581347 | 21581331 | 21581326 | - |
| SEQ ID NO 29720 | GCCAGGTCAGGGGTCTATCTTT | CTG | chr12 | 21581311 | 21581332 | 21581316 | 21581311 | - |
| SEQ ID NO 29721 | TCTTTAACCAGGCCCAGGATGT | CTA | chr12 | 21581294 | 21581315 | 21581299 | 21581294 | - |
| SEQ ID NO 29722 | TAACCAGGCCCAGGATGTGGTC | CTT | chr12 | 21581290 | 21581311 | 21581295 | 21581290 | - |
| SEQ ID NO 29723 | AACCAGGCCCAGGATGTGGTCT | TTT | chr12 | 21581289 | 21581310 | 21581294 | 21581289 | - |
| SEQ ID NO 29724 | ACCAGGCCCAGGATGTGGTCTC | TTA | chr12 | 21581288 | 21581309 | 21581293 | 21581288 | - |
| SEQ ID NO 29725 | AGGCTGTTTGCCTGTGGATTTC | CTC | chr12 | 21581266 | 21581287 | 21581271 | 21581266 | - |
| SEQ ID NO 29726 | TTTGCCTGTGGATTTCATTTCT | CTG | chr12 | 21581260 | 21581281 | 21581265 | 21581260 | - |
| SEQ ID NO 29727 | GCCTGTGGATTTCATTTCTGCC | TTT | chr12 | 21581257 | 21581278 | 21581262 | 21581257 | - |
| SEQ ID NO 29728 | CCTGTGGATTTCATTTCTGCCT | TTG | chr12 | 21581256 | 21581277 | 21581261 | 21581256 | - |
| SEQ ID NO 29729 | TGGATTTCATTTCTGCCTTTTA | CTG | chr12 | 21581252 | 21581273 | 21581257 | 21581252 | - |
| SEQ ID NO 29730 | CATTTCTGCCTTTTAGTTTTTA | TTT | chr12 | 21581245 | 21581266 | 21581250 | 21581245 | - |
| SEQ ID NO 29731 | ATTTCTGCCTTTTAGTTTTTAC | TTC | chr12 | 21581244 | 21581265 | 21581249 | 21581244 | - |
| SEQ ID NO 29732 | CTGCCTTTTAGTTTTTACTTCT | TTT | chr12 | 21581240 | 21581261 | 21581245 | 21581240 | - |
| SEQ ID NO 29733 | TGCCTTTTAGTTTTTACTTCTT | TTC | chr12 | 21581239 | 21581260 | 21581244 | 21581239 | - |
| SEQ ID NO 29734 | CCTTTTAGTTTTTACTTCTTCT | CTG | chr12 | 21581237 | 21581258 | 21581242 | 21581237 | - |
| SEQ ID NO 29735 | TTAGTTTTTACTTCTTCTTTCT | CTT | chr12 | 21581233 | 21581254 | 21581238 | 21581233 | - |
| SEQ ID NO 29736 | TAGTTTTTACTTCTTCTTTCTT | TTT | chr12 | 21581232 | 21581253 | 21581237 | 21581232 | - |
| SEQ ID NO 29737 | AGTTTTTACTTCTTCTTTCTTT | TTT | chr12 | 21581231 | 21581252 | 21581236 | 21581231 | - |
| SEQ ID NO 29738 | GTTTTTACTTCTTCTTTCTTTG | TTA | chr12 | 21581230 | 21581251 | 21581235 | 21581230 | - |
| SEQ ID NO 29739 | TTACTTCTTCTTTCTTTGGAGG | TTT | chr12 | 21581226 | 21581247 | 21581231 | 21581226 | - |
| SEQ ID NO 29740 | TACTTCTTCTTTCTTTGGAGGC | TTT | chr12 | 21581225 | 21581246 | 21581230 | 21581225 | - |
| SEQ ID NO 29741 | ACTTCTTCTTTCTTTGGAGGCA | TTT | chr12 | 21581224 | 21581245 | 21581229 | 21581224 | - |
| SEQ ID NO 29742 | CTTCTTCTTTCTTTGGAGGCAG | TTA | chr12 | 21581223 | 21581244 | 21581228 | 21581223 | - |
| SEQ ID NO 29743 | CTTCTTTCTTTGGAGGCAGAAA | CTT | chr12 | 21581220 | 21581241 | 21581225 | 21581220 | - |
| SEQ ID NO 29744 | TTCTTTCTTTGGAGGCAGAAAT | TTC | chr12 | 21581219 | 21581240 | 21581224 | 21581219 | - |
| SEQ ID NO 29745 | CTTTCTTTGGAGGCAGAAATTG | CTT | chr12 | 21581217 | 21581238 | 21581222 | 21581217 | - |
| SEQ ID NO 29746 | TTTCTTTGGAGGCAGAAATTGG | TTC | chr12 | 21581216 | 21581237 | 21581221 | 21581216 | - |
| SEQ ID NO 29747 | TCTTTGGAGGCAGAAATTGGGC | CTT | chr12 | 21581214 | 21581235 | 21581219 | 21581214 | - |
| SEQ ID NO 29748 | CTTTGGAGGCAGAAATTGGGCA | TTT | chr12 | 21581213 | 21581234 | 21581218 | 21581213 | - |
| SEQ ID NO 29749 | TTTGGAGGCAGAAATTGGGCAT | TTC | chr12 | 21581212 | 21581233 | 21581217 | 21581212 | - |
| SEQ ID NO 29750 | TGGAGGCAGAAATTGGGCATAA | CTT | chr12 | 21581210 | 21581231 | 21581215 | 21581210 | - |
| SEQ ID NO 29751 | GGAGGCAGAAATTGGGCATAAA | TTT | chr12 | 21581209 | 21581230 | 21581214 | 21581209 | - |
| SEQ ID NO 29752 | GAGGCAGAAATTGGGCATAAAA | TTG | chr12 | 21581208 | 21581229 | 21581213 | 21581208 | - |
| SEQ ID NO 29753 | GGCATAAAACAATATGAAGGGT | TTG | chr12 | 21581195 | 21581216 | 21581200 | 21581195 | - |
| SEQ ID NO 29754 | CTCCCTTACTAGGAAGAGAGAA | CTC | chr12 | 21581167 | 21581188 | 21581172 | 21581167 | - |
| SEQ ID NO 29755 | CCTTACTAGGAAGAGAGAAATA | CTC | chr12 | 21581164 | 21581185 | 21581169 | 21581164 | - |
| SEQ ID NO 29756 | ACTAGGAAGAGAGAAATACCAT | CTT | chr12 | 21581160 | 21581181 | 21581165 | 21581160 | - |
| SEQ ID NO 29757 | CTAGGAAGAGAGAAATACCATG | TTA | chr12 | 21581159 | 21581180 | 21581164 | 21581159 | - |
| SEQ ID NO 29758 | GGAAGAGAGAAATACCATGTGA | CTA | chr12 | 21581156 | 21581177 | 21581161 | 21581156 | - |
| SEQ ID NO 29759 | GTGTTATTGGATTTGACATCGG | TTT | chr12 | 21581117 | 21581138 | 21581122 | 21581117 | - |
| SEQ ID NO 29760 | TGTTATTGGATTTGACATCGGG | TTG | chr12 | 21581116 | 21581137 | 21581121 | 21581116 | - |
| SEQ ID NO 29761 | TTGGATTTGACATCGGGGTTGG | TTA | chr12 | 21581111 | 21581132 | 21581116 | 21581111 | - |
| SEQ ID NO 29762 | GATTTGACATCGGGGTTGGACC | TTG | chr12 | 21581108 | 21581129 | 21581113 | 21581108 | - |
| SEQ ID NO 29763 | GACATCGGGGTTGGACCAAGCA | TTT | chr12 | 21581103 | 21581124 | 21581108 | 21581103 | - |

Figure 48 (Cont'd)

| SEQ ID NO 29764 | ACATCGGGGTTGGACCAAGCAT | TTG | chr12 | 21581102 | 21581123 | 21581107 | 21581102 | - |
| SEQ ID NO 29765 | GACCAAGCATCTTCTATGAACA | TTG | chr12 | 21581090 | 21581111 | 21581095 | 21581090 | - |
| SEQ ID NO 29766 | CTATGAACATCTATAAGCACGT | CTT | chr12 | 21581077 | 21581098 | 21581082 | 21581077 | - |
| SEQ ID NO 29767 | TATGAACATCTATAAGCACGTT | TTC | chr12 | 21581076 | 21581097 | 21581081 | 21581076 | - |
| SEQ ID NO 29768 | TGAACATCTATAAGCACGTTCT | CTA | chr12 | 21581074 | 21581095 | 21581079 | 21581074 | - |
| SEQ ID NO 29769 | TAAGCACGTTCTCCTTATCAAA | CTA | chr12 | 21581064 | 21581085 | 21581069 | 21581064 | - |
| SEQ ID NO 29770 | TCCTTATCAAAAGGTACTTTGC | TTC | chr12 | 21581053 | 21581074 | 21581058 | 21581053 | - |
| SEQ ID NO 29771 | CTTATCAAAAGGTACTTTGCTT | CTC | chr12 | 21581051 | 21581072 | 21581056 | 21581051 | - |
| SEQ ID NO 29772 | ATCAAAAGGTACTTTGCTTGGT | CTT | chr12 | 21581048 | 21581069 | 21581053 | 21581048 | - |
| SEQ ID NO 29773 | TCAAAAGGTACTTTGCTTGGTG | TTA | chr12 | 21581047 | 21581068 | 21581052 | 21581047 | - |
| SEQ ID NO 29774 | TGCTTGGTGCTTTAAAAGATAA | CTT | chr12 | 21581034 | 21581055 | 21581039 | 21581034 | - |
| SEQ ID NO 29775 | GCTTGGTGCTTTAAAAGATAAA | TTT | chr12 | 21581033 | 21581054 | 21581038 | 21581033 | - |
| SEQ ID NO 29776 | CTTGGTGCTTTAAAAGATAAAT | TTG | chr12 | 21581032 | 21581053 | 21581037 | 21581032 | - |
| SEQ ID NO 29777 | GGTGCTTTAAAAGATAAATGAC | CTT | chr12 | 21581029 | 21581050 | 21581034 | 21581029 | - |
| SEQ ID NO 29778 | GTGCTTTAAAAGATAAATGACT | TTG | chr12 | 21581028 | 21581049 | 21581033 | 21581028 | - |
| SEQ ID NO 29779 | TAAAAGATAAATGACTATGTAG | CTT | chr12 | 21581022 | 21581043 | 21581027 | 21581022 | - |
| SEQ ID NO 29780 | AAAAGATAAATGACTATGTAGC | TTT | chr12 | 21581021 | 21581042 | 21581026 | 21581021 | - |
| SEQ ID NO 29781 | AAAGATAAATGACTATGTAGCT | TTA | chr12 | 21581020 | 21581041 | 21581025 | 21581020 | - |
| SEQ ID NO 29782 | TGTAGCTTAGGAGATTTCTTCA | CTA | chr12 | 21581005 | 21581026 | 21581010 | 21581005 | - |
| SEQ ID NO 29783 | AGGAGATTTCTTCATAATTGAA | CTT | chr12 | 21580997 | 21581018 | 21581002 | 21580997 | - |
| SEQ ID NO 29784 | GGAGATTTCTTCATAATTGAAA | TTA | chr12 | 21580996 | 21581017 | 21581001 | 21580996 | - |
| SEQ ID NO 29785 | CTTCATAATTGAAAACCACAGC | TTT | chr12 | 21580988 | 21581009 | 21580993 | 21580988 | - |
| SEQ ID NO 29786 | TTCATAATTGAAAACCACAGCA | TTC | chr12 | 21580987 | 21581008 | 21580992 | 21580987 | - |
| SEQ ID NO 29787 | CATAATTGAAAACCACAGCAGC | CTT | chr12 | 21580985 | 21581006 | 21580990 | 21580985 | - |
| SEQ ID NO 29788 | ATAATTGAAAACCACAGCAGCT | TTC | chr12 | 21580984 | 21581005 | 21580989 | 21580984 | - |
| SEQ ID NO 29789 | AAAACCACAGCAGCTGTTATTT | TTG | chr12 | 21580977 | 21580998 | 21580982 | 21580977 | - |
| SEQ ID NO 29790 | TTATTTGAACATACCTGAGCCC | CTG | chr12 | 21580961 | 21580982 | 21580966 | 21580961 | - |
| SEQ ID NO 29791 | TTTGAACATACCTGAGCCCCTT | TTA | chr12 | 21580958 | 21580979 | 21580963 | 21580958 | - |
| SEQ ID NO 29792 | GAACATACCTGAGCCCCTTCTG | TTT | chr12 | 21580955 | 21580976 | 21580960 | 21580955 | - |
| SEQ ID NO 29793 | AACATACCTGAGCCCCTTCTGG | TTG | chr12 | 21580954 | 21580975 | 21580959 | 21580954 | - |
| SEQ ID NO 29794 | AGCCCCTTCTGGACCACTGTAG | CTG | chr12 | 21580944 | 21580965 | 21580949 | 21580944 | - |
| SEQ ID NO 29795 | CTGGACCACTGTAGGAGAAGGA | CTT | chr12 | 21580936 | 21580957 | 21580941 | 21580936 | - |
| SEQ ID NO 29796 | TGGACCACTGTAGGAGAAGGAG | TTC | chr12 | 21580935 | 21580956 | 21580940 | 21580935 | - |
| SEQ ID NO 29797 | GACCACTGTAGGAGAAGGAGGA | CTG | chr12 | 21580933 | 21580954 | 21580938 | 21580933 | - |
| SEQ ID NO 29798 | TAGGAGAAGGAGGAAGAGAGGT | CTG | chr12 | 21580925 | 21580946 | 21580930 | 21580925 | - |
| SEQ ID NO 29799 | CTGCTGCTGAGGGCATGTATGA | TTT | chr12 | 21580892 | 21580913 | 21580897 | 21580892 | - |
| SEQ ID NO 29800 | TGCTGCTGAGGGCATGTATGAT | TTC | chr12 | 21580891 | 21580912 | 21580896 | 21580891 | - |
| SEQ ID NO 29801 | CTGCTGAGGGCATGTATGATGA | CTG | chr12 | 21580889 | 21580910 | 21580894 | 21580889 | - |
| SEQ ID NO 29802 | CTGAGGGCATGTATGATGACAA | CTG | chr12 | 21580886 | 21580907 | 21580891 | 21580886 | - |
| SEQ ID NO 29803 | AGGGCATGTATGATGACAATGG | CTG | chr12 | 21580883 | 21580904 | 21580888 | 21580883 | - |
| SEQ ID NO 29804 | GTCCTAACTTTGACACTACAAA | TTT | chr12 | 21580855 | 21580876 | 21580860 | 21580855 | - |
| SEQ ID NO 29805 | TCCTAACTTTGACACTACAAAG | TTG | chr12 | 21580854 | 21580875 | 21580859 | 21580854 | - |
| SEQ ID NO 29806 | ACTTTGACACTACAAAGTGACT | CTA | chr12 | 21580849 | 21580870 | 21580854 | 21580849 | - |
| SEQ ID NO 29807 | TGACACTACAAAGTGACTGGAG | CTT | chr12 | 21580845 | 21580866 | 21580850 | 21580845 | - |
| SEQ ID NO 29808 | GACACTACAAAGTGACTGGAGC | TTT | chr12 | 21580844 | 21580865 | 21580849 | 21580844 | - |
| SEQ ID NO 29809 | ACACTACAAAGTGACTGGAGCT | TTG | chr12 | 21580843 | 21580864 | 21580848 | 21580843 | - |
| SEQ ID NO 29810 | CAAAGTGACTGGAGCTTTAGGC | CTA | chr12 | 21580837 | 21580858 | 21580842 | 21580837 | - |
| SEQ ID NO 29811 | GAGCTTTAGGCAAGTAGTTACT | CTG | chr12 | 21580826 | 21580847 | 21580831 | 21580826 | - |
| SEQ ID NO 29812 | TAGGCAAGTAGTTACTCCAATT | CTT | chr12 | 21580820 | 21580841 | 21580825 | 21580820 | - |
| SEQ ID NO 29813 | AGGCAAGTAGTTACTCCAATTG | TTT | chr12 | 21580819 | 21580840 | 21580824 | 21580819 | - |
| SEQ ID NO 29814 | GGCAAGTAGTTACTCCAATTGT | TTA | chr12 | 21580818 | 21580839 | 21580823 | 21580818 | - |
| SEQ ID NO 29815 | CTCCAATTGTCTTTTCAGACTC | TTA | chr12 | 21580806 | 21580827 | 21580811 | 21580806 | - |
| SEQ ID NO 29816 | CAATTGTCTTTTCAGACTCTTT | CTC | chr12 | 21580803 | 21580824 | 21580808 | 21580803 | - |
| SEQ ID NO 29817 | TCTTTTCAGACTCTTTCTTTTT | TTG | chr12 | 21580797 | 21580818 | 21580802 | 21580797 | - |
| SEQ ID NO 29818 | TTCAGACTCTTTCTTTTTGAGG | CTT | chr12 | 21580793 | 21580814 | 21580798 | 21580793 | - |
| SEQ ID NO 29819 | TCAGACTCTTTCTTTTTGAGGT | TTT | chr12 | 21580792 | 21580813 | 21580797 | 21580792 | - |
| SEQ ID NO 29820 | CAGACTCTTTCTTTTTGAGGTA | TTT | chr12 | 21580791 | 21580812 | 21580796 | 21580791 | - |
| SEQ ID NO 29821 | AGACTCTTTCTTTTTGAGGTAT | TTC | chr12 | 21580790 | 21580811 | 21580795 | 21580790 | - |

Figure 48 (Cont'd)

| SEQ ID NO | Sequence | | | | | | |
|---|---|---|---|---|---|---|---|
| SEQ ID NO 29822 | TTTCTTTTTGAGGTATTTGACC | CTC | chr12 | 21580784 | 21580805 | 21580789 | 21580784 | - |
| SEQ ID NO 29823 | TCTTTTTGAGGTATTTGACCTC | CTT | chr12 | 21580782 | 21580803 | 21580787 | 21580782 | - |
| SEQ ID NO 29824 | CTTTTTGAGGTATTTGACCTCT | TTT | chr12 | 21580781 | 21580802 | 21580786 | 21580781 | - |
| SEQ ID NO 29825 | TTTTTGAGGTATTTGACCTCTT | TTC | chr12 | 21580780 | 21580801 | 21580785 | 21580780 | - |
| SEQ ID NO 29826 | TTTGAGGTATTTGACCTCTTTG | CTT | chr12 | 21580778 | 21580799 | 21580783 | 21580778 | - |
| SEQ ID NO 29827 | TTGAGGTATTTGACCTCTTTGC | TTT | chr12 | 21580777 | 21580798 | 21580782 | 21580777 | - |
| SEQ ID NO 29828 | TGAGGTATTTGACCTCTTTGCG | TTT | chr12 | 21580776 | 21580797 | 21580781 | 21580776 | - |
| SEQ ID NO 29829 | GAGGTATTTGACCTCTTTGCGG | TTT | chr12 | 21580775 | 21580796 | 21580780 | 21580775 | - |
| SEQ ID NO 29830 | AGGTATTTGACCTCTTTGCGGC | TTG | chr12 | 21580774 | 21580795 | 21580779 | 21580774 | - |
| SEQ ID NO 29831 | GACCTCTTTGCGGCATCAGCCT | TTT | chr12 | 21580766 | 21580787 | 21580771 | 21580766 | - |
| SEQ ID NO 29832 | ACCTCTTTGCGGCATCAGCCTG | TTG | chr12 | 21580765 | 21580786 | 21580770 | 21580765 | - |
| SEQ ID NO 29833 | TTTGCGGCATCAGCCTGCTGCT | CTC | chr12 | 21580760 | 21580781 | 21580765 | 21580760 | - |
| SEQ ID NO 29834 | TGCGGCATCAGCCTGCTGCTAT | CTT | chr12 | 21580758 | 21580779 | 21580763 | 21580758 | - |
| SEQ ID NO 29835 | GCGGCATCAGCCTGCTGCTATT | TTT | chr12 | 21580757 | 21580778 | 21580762 | 21580757 | - |
| SEQ ID NO 29836 | CGGCATCAGCCTGCTGCTATTT | TTG | chr12 | 21580756 | 21580777 | 21580761 | 21580756 | - |
| SEQ ID NO 29837 | CTGCTATTTCACATGCACCTAG | CTG | chr12 | 21580743 | 21580764 | 21580748 | 21580743 | - |
| SEQ ID NO 29838 | CTATTTCACATGCACCTAGAAG | CTG | chr12 | 21580740 | 21580761 | 21580745 | 21580740 | - |
| SEQ ID NO 29839 | TTTCACATGCACCTAGAAGGGA | CTA | chr12 | 21580737 | 21580758 | 21580742 | 21580737 | - |
| SEQ ID NO 29840 | CACATGCACCTAGAAGGGACTT | TTT | chr12 | 21580734 | 21580755 | 21580739 | 21580734 | - |
| SEQ ID NO 29841 | ACATGCACCTAGAAGGGACTTT | TTC | chr12 | 21580733 | 21580754 | 21580738 | 21580733 | - |
| SEQ ID NO 29842 | GAAGGGACTTTAAAACATGCAC | CTA | chr12 | 21580722 | 21580743 | 21580727 | 21580722 | - |
| SEQ ID NO 29843 | TAAAACATGCACAGAATTGAAC | CTT | chr12 | 21580712 | 21580733 | 21580717 | 21580712 | - |
| SEQ ID NO 29844 | AAAACATGCACAGAATTGAACA | TTT | chr12 | 21580711 | 21580732 | 21580716 | 21580711 | - |
| SEQ ID NO 29845 | AAACATGCACAGAATTGAACAA | TTA | chr12 | 21580710 | 21580731 | 21580715 | 21580710 | - |
| SEQ ID NO 29846 | AACAAAGCAGTAACCATTCGTT | TTG | chr12 | 21580693 | 21580714 | 21580698 | 21580693 | - |
| SEQ ID NO 29847 | GTTGGTGTCCCTTAACAATATG | TTC | chr12 | 21580674 | 21580695 | 21580679 | 21580674 | - |
| SEQ ID NO 29848 | GTGTCCCTTAACAATATGTCAA | TTG | chr12 | 21580670 | 21580691 | 21580675 | 21580670 | - |
| SEQ ID NO 29849 | AACAATATGTCAAATACTATTA | CTT | chr12 | 21580661 | 21580682 | 21580666 | 21580661 | - |
| SEQ ID NO 29850 | ACAATATGTCAAATACTATTAT | TTA | chr12 | 21580660 | 21580681 | 21580665 | 21580660 | - |
| SEQ ID NO 29851 | TTATTTTGAAAGGTAAATAAA | CTA | chr12 | 21580642 | 21580663 | 21580647 | 21580642 | - |
| SEQ ID NO 29852 | TTTTTGAAAGGTAAATAAATCC | TTA | chr12 | 21580639 | 21580660 | 21580644 | 21580639 | - |
| SEQ ID NO 29853 | TTGAAAGGTAAATAAATCCTTG | TTT | chr12 | 21580636 | 21580657 | 21580641 | 21580636 | - |
| SEQ ID NO 29854 | TGAAAGGTAAATAAATCCTTGG | TTT | chr12 | 21580635 | 21580656 | 21580640 | 21580635 | - |
| SEQ ID NO 29855 | GAAAGGTAAATAAATCCTTGGG | TTT | chr12 | 21580634 | 21580655 | 21580639 | 21580634 | - |
| SEQ ID NO 29856 | AAAGGTAAATAAATCCTTGGGC | TTG | chr12 | 21580633 | 21580654 | 21580638 | 21580633 | - |
| SEQ ID NO 29857 | GGGCTTAGTGGATCCTAAATGC | CTT | chr12 | 21580615 | 21580636 | 21580620 | 21580615 | - |
| SEQ ID NO 29858 | GGCTTAGTGGATCCTAAATGCT | TTG | chr12 | 21580614 | 21580635 | 21580619 | 21580614 | - |
| SEQ ID NO 29859 | AGTGGATCCTAAATGCTAATTT | CTT | chr12 | 21580609 | 21580630 | 21580614 | 21580609 | - |
| SEQ ID NO 29860 | GTGGATCCTAAATGCTAATTTA | TTA | chr12 | 21580608 | 21580629 | 21580613 | 21580608 | - |
| SEQ ID NO 29861 | AATGCTAATTTAAAAATCTGAA | CTA | chr12 | 21580598 | 21580619 | 21580603 | 21580598 | - |
| SEQ ID NO 29862 | ATTTAAAAATCTGAACTCATTT | CTA | chr12 | 21580591 | 21580612 | 21580596 | 21580591 | - |
| SEQ ID NO 29863 | AAAAATCTGAACTCATTTCCAT | TTT | chr12 | 21580587 | 21580608 | 21580592 | 21580587 | - |
| SEQ ID NO 29864 | AAAATCTGAACTCATTTCCATC | TTA | chr12 | 21580586 | 21580607 | 21580591 | 21580586 | - |
| SEQ ID NO 29865 | AACTCATTTCCATCCCTTATTA | CTG | chr12 | 21580578 | 21580599 | 21580583 | 21580578 | - |
| SEQ ID NO 29866 | ATTTCCATCCCTTATTACTTTA | CTC | chr12 | 21580573 | 21580594 | 21580578 | 21580573 | - |
| SEQ ID NO 29867 | CCATCCCTTATTACTTTAAACA | TTT | chr12 | 21580569 | 21580590 | 21580574 | 21580569 | - |
| SEQ ID NO 29868 | CATCCCTTATTACTTTAAACAA | TTC | chr12 | 21580568 | 21580589 | 21580573 | 21580568 | - |
| SEQ ID NO 29869 | ATTACTTTAAACAAATTGCTAA | CTT | chr12 | 21580560 | 21580581 | 21580565 | 21580560 | - |
| SEQ ID NO 29870 | TTACTTTAAACAAATTGCTAAC | TTA | chr12 | 21580559 | 21580580 | 21580564 | 21580559 | - |
| SEQ ID NO 29871 | CTTTAAACAAATTGCTAACCTG | TTA | chr12 | 21580556 | 21580577 | 21580561 | 21580556 | - |
| SEQ ID NO 29872 | TAAACAAATTGCTAACCTGAAT | CTT | chr12 | 21580553 | 21580574 | 21580558 | 21580553 | - |
| SEQ ID NO 29873 | AAACAAATTGCTAACCTGAATG | TTT | chr12 | 21580552 | 21580573 | 21580557 | 21580552 | - |
| SEQ ID NO 29874 | AACAAATTGCTAACCTGAATGA | TTA | chr12 | 21580551 | 21580572 | 21580556 | 21580551 | - |
| SEQ ID NO 29875 | CTAACCTGAATGATAATAGAAA | TTG | chr12 | 21580542 | 21580563 | 21580547 | 21580542 | - |
| SEQ ID NO 29876 | ACCTGAATGATAATAGAAACTT | CTA | chr12 | 21580539 | 21580560 | 21580544 | 21580539 | - |
| SEQ ID NO 29877 | AATGATAATAGAAACTTTTTTC | CTG | chr12 | 21580534 | 21580555 | 21580539 | 21580534 | - |
| SEQ ID NO 29878 | TTTTCCTTTTAACAGTTGGAGG | CTT | chr12 | 21580517 | 21580538 | 21580522 | 21580517 | - |
| SEQ ID NO 29879 | TTTCCTTTTAACAGTTGGAGGC | TTT | chr12 | 21580516 | 21580537 | 21580521 | 21580516 | - |

Figure 48 (Cont'd)

| | | | | | | | | |
|---|---|---|---|---|---|---|---|---|
| SEQ ID NO 29880 | TTCCTTTTAACAGTTGGAGGCA | TTT | chr12 | 21580515 | 21580536 | 21580520 | 21580515 | - |
| SEQ ID NO 29881 | TCCTTTTAACAGTTGGAGGCAT | TTT | chr12 | 21580514 | 21580535 | 21580519 | 21580514 | - |
| SEQ ID NO 29882 | CCTTTTAACAGTTGGAGGCATC | TTT | chr12 | 21580513 | 21580534 | 21580518 | 21580513 | - |
| SEQ ID NO 29883 | CTTTTAACAGTTGGAGGCATCT | TTC | chr12 | 21580512 | 21580533 | 21580517 | 21580512 | - |
| SEQ ID NO 29884 | TTAACAGTTGGAGGCATCTATA | CTT | chr12 | 21580509 | 21580530 | 21580514 | 21580509 | - |
| SEQ ID NO 29885 | TAACAGTTGGAGGCATCTATAC | TTT | chr12 | 21580508 | 21580529 | 21580513 | 21580508 | - |
| SEQ ID NO 29886 | AACAGTTGGAGGCATCTATACT | TTT | chr12 | 21580507 | 21580528 | 21580512 | 21580507 | - |
| SEQ ID NO 29887 | ACAGTTGGAGGCATCTATACTG | TTA | chr12 | 21580506 | 21580527 | 21580511 | 21580506 | - |
| SEQ ID NO 29888 | GAGGCATCTATACTGTGATTCA | TTG | chr12 | 21580499 | 21580520 | 21580504 | 21580499 | - |
| SEQ ID NO 29889 | TACTGTGATTCAGACAAAGGCC | CTA | chr12 | 21580489 | 21580510 | 21580494 | 21580489 | - |
| SEQ ID NO 29890 | TGATTCAGACAAAGGCCAAAAC | CTG | chr12 | 21580484 | 21580505 | 21580489 | 21580484 | - |
| SEQ ID NO 29891 | AGACAAAGGCCAAAACAACAGC | TTC | chr12 | 21580478 | 21580499 | 21580483 | 21580478 | - |
| SEQ ID NO 29892 | TTTTCTGATAGGTCCATATTTT | CTA | chr12 | 21580435 | 21580456 | 21580440 | 21580435 | - |
| SEQ ID NO 29893 | TCTGATAGGTCCATATTTTGAG | TTT | chr12 | 21580432 | 21580453 | 21580437 | 21580432 | - |
| SEQ ID NO 29894 | CTGATAGGTCCATATTTTGAGC | TTT | chr12 | 21580431 | 21580452 | 21580436 | 21580431 | - |
| SEQ ID NO 29895 | TGATAGGTCCATATTTTGAGCA | TTC | chr12 | 21580430 | 21580451 | 21580435 | 21580430 | - |
| SEQ ID NO 29896 | ATAGGTCCATATTTTGAGCATA | CTG | chr12 | 21580428 | 21580449 | 21580433 | 21580428 | - |
| SEQ ID NO 29897 | TGAGCATAATATGAAGACTCAG | TTT | chr12 | 21580414 | 21580435 | 21580419 | 21580414 | - |
| SEQ ID NO 29898 | GAGCATAATATGAAGACTCAGG | TTT | chr12 | 21580413 | 21580434 | 21580418 | 21580413 | - |
| SEQ ID NO 29899 | AGCATAATATGAAGACTCAGGT | TTG | chr12 | 21580412 | 21580433 | 21580417 | 21580412 | - |
| SEQ ID NO 29900 | AGGTGGAACAGTGTGAACCTGT | CTC | chr12 | 21580394 | 21580415 | 21580399 | 21580394 | - |
| SEQ ID NO 29901 | TAAATGATGCTGTCAGAAGAGC | CTG | chr12 | 21580373 | 21580394 | 21580378 | 21580373 | - |
| SEQ ID NO 29902 | TCAGAAGAGCAGTGGACGCAAT | CTG | chr12 | 21580361 | 21580382 | 21580366 | 21580361 | - |

Figure 49

| # | Sequence | PAM | Chr | Start | End | Cuts 5' of | Str |
|---|---|---|---|---|---|---|---|
| SEQ ID NO 29903 | TGTCCTTCTGGCAGGGAACC | TGG | chr3 | 120675793 | 120675812 | 120675809 | + |
| SEQ ID NO 29904 | GTCCTTCTGGCAGGGAACCT | GGG | chr3 | 120675794 | 120675813 | 120675810 | + |
| SEQ ID NO 29905 | CTTCTGGCAGGGAACCTGGG | CAG | chr3 | 120675797 | 120675816 | 120675813 | + |
| SEQ ID NO 29906 | TGGCAGGGAACCTGGGCAGC | GAG | chr3 | 120675801 | 120675820 | 120675817 | + |
| SEQ ID NO 29907 | GGCAGGGAACCTGGGCAGCG | AGG | chr3 | 120675802 | 120675821 | 120675818 | + |
| SEQ ID NO 29908 | TGGGCAGCGAGGATCCTCTG | AAG | chr3 | 120675813 | 120675832 | 120675829 | + |
| SEQ ID NO 29909 | AGAACACTCATTCCCAAATC | CAG | chr3 | 120675834 | 120675853 | 120675850 | + |
| SEQ ID NO 29910 | CCAAATCCAGAAATGTACTG | TAG | chr3 | 120675847 | 120675866 | 120675863 | + |
| SEQ ID NO 29911 | CAAATCCAGAAATGTACTGT | AGG | chr3 | 120675848 | 120675867 | 120675864 | + |
| SEQ ID NO 29912 | GAAATGTACTGTAGGTGACA | AAG | chr3 | 120675856 | 120675875 | 120675872 | + |
| SEQ ID NO 29913 | AAAGACACAAATGCCACCAT | TAG | chr3 | 120675875 | 120675894 | 120675891 | + |
| SEQ ID NO 29914 | GACACAAATGCCACCATTAG | CAG | chr3 | 120675878 | 120675897 | 120675894 | + |
| SEQ ID NO 29915 | ACACAAATGCCACCATTAGC | AGG | chr3 | 120675879 | 120675898 | 120675895 | + |
| SEQ ID NO 29916 | GCCACCATTAGCAGGATTTA | AAG | chr3 | 120675887 | 120675906 | 120675903 | + |
| SEQ ID NO 29917 | CACCATTAGCAGGATTTAAA | GAG | chr3 | 120675889 | 120675908 | 120675905 | + |
| SEQ ID NO 29918 | GCAGGATTTAAAGAGCATTT | CAG | chr3 | 120675897 | 120675916 | 120675913 | + |
| SEQ ID NO 29919 | TAAAGAGCATTTCAGAAAAT | TGG | chr3 | 120675905 | 120675924 | 120675921 | + |
| SEQ ID NO 29920 | AGAGCATTTCAGAAAATTGG | CAG | chr3 | 120675908 | 120675927 | 120675924 | + |
| SEQ ID NO 29921 | CAGAAAATTGGCAGTTTACT | AAG | chr3 | 120675917 | 120675936 | 120675933 | + |
| SEQ ID NO 29922 | AGAAAATTGGCAGTTTACTA | AGG | chr3 | 120675918 | 120675937 | 120675934 | + |
| SEQ ID NO 29923 | AATTGGCAGTTTACTAAGGT | AAG | chr3 | 120675922 | 120675941 | 120675938 | + |
| SEQ ID NO 29924 | CTAAGGTAAGAATTTCTATA | TGG | chr3 | 120675935 | 120675954 | 120675951 | + |
| SEQ ID NO 29925 | GTCTTGACATATGAATCATT | TAG | chr3 | 120676002 | 120676021 | 120676018 | + |
| SEQ ID NO 29926 | TCTTGACATATGAATCATTT | AGG | chr3 | 120676003 | 120676022 | 120676019 | + |
| SEQ ID NO 29927 | CTTGACATATGAATCATTTA | GGG | chr3 | 120676004 | 120676023 | 120676020 | + |
| SEQ ID NO 29928 | GACATATGAATCATTTAGGG | AAG | chr3 | 120676007 | 120676026 | 120676023 | + |
| SEQ ID NO 29929 | ATCATTTAGGGAAGACAATA | TGG | chr3 | 120676016 | 120676035 | 120676032 | + |
| SEQ ID NO 29930 | TATGGTTTCTGTGAATTTTA | AAG | chr3 | 120676034 | 120676053 | 120676050 | + |
| SEQ ID NO 29931 | TTTAAAGACTTCTAATTAAT | CAG | chr3 | 120676050 | 120676069 | 120676066 | + |
| SEQ ID NO 29932 | AAAGACTTCTAATTAATCAG | AAG | chr3 | 120676053 | 120676072 | 120676069 | + |
| SEQ ID NO 29933 | AGACTTCTAATTAATCAGAA | GAG | chr3 | 120676055 | 120676074 | 120676071 | + |
| SEQ ID NO 29934 | CTAATTAATCAGAAGAGTGC | TGG | chr3 | 120676061 | 120676080 | 120676077 | + |
| SEQ ID NO 29935 | GAAGAGTGCTGGATATTGCA | TAG | chr3 | 120676072 | 120676091 | 120676088 | + |
| SEQ ID NO 29936 | TGCATAGACTTCTCCACCCT | TAG | chr3 | 120676088 | 120676107 | 120676104 | + |
| SEQ ID NO 29937 | TCTCCACCCTTAGCTGTACT | TAG | chr3 | 120676098 | 120676117 | 120676114 | + |
| SEQ ID NO 29938 | AGCTGTACTTAGCTGATTTG | TGG | chr3 | 120676109 | 120676128 | 120676125 | + |
| SEQ ID NO 29939 | GCTGTACTTAGCTGATTTGT | GGG | chr3 | 120676110 | 120676129 | 120676126 | + |
| SEQ ID NO 29940 | ACTGTAACCTCCCTGAACTT | GAG | chr3 | 120676138 | 120676157 | 120676154 | + |
| SEQ ID NO 29941 | TCCATTTCCCTTTCAAACTC | TGG | chr3 | 120676163 | 120676182 | 120676179 | + |
| SEQ ID NO 29942 | CCATTTCCCTTTCAAACTCT | GGG | chr3 | 120676164 | 120676183 | 120676180 | + |
| SEQ ID NO 29943 | TTTCAAACTCTGGGAAAAAA | AAG | chr3 | 120676173 | 120676192 | 120676189 | + |
| SEQ ID NO 29944 | ACTCTGGGAAAAAAAGAAA | AAG | chr3 | 120676179 | 120676198 | 120676195 | + |
| SEQ ID NO 29945 | AAAAGAAAAGCATCTATG | AAG | chr3 | 120676190 | 120676209 | 120676206 | + |
| SEQ ID NO 29946 | AAAGAAAAGCATCTATGAA | GAG | chr3 | 120676192 | 120676211 | 120676208 | + |
| SEQ ID NO 29947 | AAGAAAAGCATCTATGAAG | AGG | chr3 | 120676193 | 120676212 | 120676209 | + |
| SEQ ID NO 29948 | AGCATCTATGAAGAGGTGTG | TGG | chr3 | 120676200 | 120676219 | 120676216 | + |

Figure 49 (Cont'd)

| | | | | | | | |
|---|---|---|---|---|---|---|---|
| SEQ ID NO 29949 | GCATCTATGAAGAGGTGTGT | GGG | chr3 | 120676201 | 120676220 | 120676217 | + |
| SEQ ID NO 29950 | GTGTGTGGGTCCAACCCTGA | CAG | chr3 | 120676215 | 120676234 | 120676231 | + |
| SEQ ID NO 29951 | CAGCAAAACCCTCTCCAAAC | TAG | chr3 | 120676235 | 120676254 | 120676251 | + |
| SEQ ID NO 29952 | TCTCCAAACTAGCCTTGCTG | TAG | chr3 | 120676246 | 120676265 | 120676262 | + |
| SEQ ID NO 29953 | CTCCAAACTAGCCTTGCTGT | AGG | chr3 | 120676247 | 120676266 | 120676263 | + |
| SEQ ID NO 29954 | CAAACTAGCCTTGCTGTAGG | CAG | chr3 | 120676250 | 120676269 | 120676266 | + |
| SEQ ID NO 29955 | ACTAGCCTTGCTGTAGGCAG | AAG | chr3 | 120676253 | 120676272 | 120676269 | + |
| SEQ ID NO 29956 | TCTGCTATCTGCCTCATCTA | TGG | chr3 | 120676278 | 120676297 | 120676294 | + |
| SEQ ID NO 29957 | TGTGCGAATGCATGAAAATA | AAG | chr3 | 120676315 | 120676334 | 120676331 | + |
| SEQ ID NO 29958 | ATGCATGAAAATAAAGTTTA | AAG | chr3 | 120676322 | 120676341 | 120676338 | + |
| SEQ ID NO 29959 | GAAAATAAAGTTTAAAGATA | TGG | chr3 | 120676328 | 120676347 | 120676344 | + |
| SEQ ID NO 29960 | AAAATAAAGTTTAAAGATAT | GGG | chr3 | 120676329 | 120676348 | 120676345 | + |
| SEQ ID NO 29961 | ATAAAGTTTAAAGATATGGG | TGG | chr3 | 120676332 | 120676351 | 120676348 | + |
| SEQ ID NO 29962 | TTAAAGATATGGGTGGCCTT | CAG | chr3 | 120676339 | 120676358 | 120676355 | + |
| SEQ ID NO 29963 | TAAAGATATGGGTGGCCTTC | AGG | chr3 | 120676340 | 120676359 | 120676356 | + |
| SEQ ID NO 29964 | AAGATATGGGTGGCCTTCAG | GAG | chr3 | 120676342 | 120676361 | 120676358 | + |
| SEQ ID NO 29965 | GTGGCCTTCAGGAGACACGC | CAG | chr3 | 120676351 | 120676370 | 120676367 | + |
| SEQ ID NO 29966 | CTTCAGGAGACACGCCAGCC | CAG | chr3 | 120676356 | 120676375 | 120676372 | + |
| SEQ ID NO 29967 | ATCTTTTCACAATGACACAA | TGG | chr3 | 120676380 | 120676399 | 120676396 | + |
| SEQ ID NO 29968 | CCATCTCTTCACTTTACACC | CAG | chr3 | 120676418 | 120676437 | 120676434 | + |
| SEQ ID NO 29969 | ATCTCTTCACTTTACACCCA | GAG | chr3 | 120676420 | 120676439 | 120676436 | + |
| SEQ ID NO 29970 | TCTCTTCACTTTACACCCAG | AGG | chr3 | 120676421 | 120676440 | 120676437 | + |
| SEQ ID NO 29971 | TTACACCCAGAGGAAAAAAA | AAG | chr3 | 120676431 | 120676450 | 120676447 | + |
| SEQ ID NO 29972 | CCAGAGGAAAAAAAAGTTA | AAG | chr3 | 120676437 | 120676456 | 120676453 | + |
| SEQ ID NO 29973 | CAGAGGAAAAAAAAGTTAA | AGG | chr3 | 120676438 | 120676457 | 120676454 | + |
| SEQ ID NO 29974 | AGAGGAAAAAAAAGTTAAA | GGG | chr3 | 120676439 | 120676458 | 120676455 | + |
| SEQ ID NO 29975 | AAGTTAAAGGGTTTCTCAAC | CAG | chr3 | 120676451 | 120676470 | 120676467 | + |
| SEQ ID NO 29976 | AGTTAAAGGGTTTCTCAACC | AGG | chr3 | 120676452 | 120676471 | 120676468 | + |
| SEQ ID NO 29977 | AAAGGGTTTCTCAACCAGGT | AAG | chr3 | 120676456 | 120676475 | 120676472 | + |
| SEQ ID NO 29978 | TTTCTCAACCAGGTAAGTCA | TGG | chr3 | 120676462 | 120676481 | 120676478 | + |
| SEQ ID NO 29979 | TCTCAACCAGGTAAGTCATG | GAG | chr3 | 120676464 | 120676483 | 120676480 | + |
| SEQ ID NO 29980 | TCAACCAGGTAAGTCATGGA | GAG | chr3 | 120676466 | 120676485 | 120676482 | + |
| SEQ ID NO 29981 | GCAACACTCAACACACTTGT | GAG | chr3 | 120676507 | 120676526 | 120676523 | + |
| SEQ ID NO 29982 | GTGAGTTCTTGTGCACTGTC | TGG | chr3 | 120676525 | 120676544 | 120676541 | + |
| SEQ ID NO 29983 | GCACTGTCTGGCTTTTTTGC | TAG | chr3 | 120676537 | 120676556 | 120676553 | + |
| SEQ ID NO 29984 | TGGCTTTTTTGCTAGCCTAT | AAG | chr3 | 120676545 | 120676564 | 120676561 | + |
| SEQ ID NO 29985 | GCTAGCCTATAAGCTGCATG | AAG | chr3 | 120676555 | 120676574 | 120676571 | + |
| SEQ ID NO 29986 | CTAGCCTATAAGCTGCATGA | AGG | chr3 | 120676556 | 120676575 | 120676572 | + |
| SEQ ID NO 29987 | CTATAAGCTGCATGAAGGCT | GAG | chr3 | 120676561 | 120676580 | 120676577 | + |
| SEQ ID NO 29988 | CTGCATGAAGGCTGAGACTA | TGG | chr3 | 120676568 | 120676587 | 120676584 | + |
| SEQ ID NO 29989 | CATGAAGGCTGAGACTATGG | CAG | chr3 | 120676571 | 120676590 | 120676587 | + |
| SEQ ID NO 29990 | GGCTGAGACTATGGCAGTCT | TGG | chr3 | 120676577 | 120676596 | 120676593 | + |
| SEQ ID NO 29991 | ACTATGGCAGTCTTGGCTCA | TAG | chr3 | 120676584 | 120676603 | 120676600 | + |
| SEQ ID NO 29992 | ATGGCAGTCTTGGCTCATAG | AAG | chr3 | 120676587 | 120676606 | 120676603 | + |
| SEQ ID NO 29993 | TGGCAGTCTTGGCTCATAGA | AGG | chr3 | 120676588 | 120676607 | 120676604 | + |
| SEQ ID NO 29994 | CTTGGCTCATAGAAGGTAAT | CAG | chr3 | 120676595 | 120676614 | 120676611 | + |
| SEQ ID NO 29995 | GGCTCATAGAAGGTAATCAG | TGG | chr3 | 120676598 | 120676617 | 120676614 | + |

Figure 49 (Cont'd)

| | | | | | | | |
|---|---|---|---|---|---|---|---|
| SEQ ID NO 29996 | TTGATTGAATTTTTCCCTTA | AAG | chr3 | 120676632 | 120676651 | 120676648 | + |
| SEQ ID NO 29997 | CTTAAAGCCAATTCTAATGT | AAG | chr3 | 120676648 | 120676667 | 120676664 | + |
| SEQ ID NO 29998 | TGTATGTGTGCTGCTGTAAA | TAG | chr3 | 120676671 | 120676690 | 120676687 | + |
| SEQ ID NO 29999 | GTATGTGTGCTGCTGTAAAT | AGG | chr3 | 120676672 | 120676691 | 120676688 | + |
| SEQ ID NO 30000 | TATGTGTGCTGCTGTAAATA | GGG | chr3 | 120676673 | 120676692 | 120676689 | + |
| SEQ ID NO 30001 | TGTGCTGCTGTAAATAGGGT | TAG | chr3 | 120676677 | 120676696 | 120676693 | + |
| SEQ ID NO 30002 | ACTTAAATACCAATTGATTT | TAG | chr3 | 120676716 | 120676735 | 120676732 | + |
| SEQ ID NO 30003 | AATACCAATTGATTTTAGCC | CAG | chr3 | 120676721 | 120676740 | 120676737 | + |
| SEQ ID NO 30004 | ATACCAATTGATTTTAGCCC | AGG | chr3 | 120676722 | 120676741 | 120676738 | + |
| SEQ ID NO 30005 | AGCCCAGGATAATGAAAATG | CAG | chr3 | 120676737 | 120676756 | 120676753 | + |
| SEQ ID NO 30006 | AATGAAAATGCAGTCTTGCT | CAG | chr3 | 120676747 | 120676766 | 120676763 | + |
| SEQ ID NO 30007 | AAAATGCAGTCTTGCTCAGC | AAG | chr3 | 120676751 | 120676770 | 120676767 | + |
| SEQ ID NO 30008 | GAAATGTAACCATCTGAACA | CAG | chr3 | 120676775 | 120676794 | 120676791 | + |
| SEQ ID NO 30009 | CCATCTGAACACAGCTCCTT | AAG | chr3 | 120676784 | 120676803 | 120676800 | + |
| SEQ ID NO 30010 | ATCTGAACACAGCTCCTTAA | GAG | chr3 | 120676786 | 120676805 | 120676802 | + |
| SEQ ID NO 30011 | CACAGCTCCTTAAGAGATAT | AAG | chr3 | 120676793 | 120676812 | 120676809 | + |
| SEQ ID NO 30012 | AGCTCCTTAAGAGATATAAG | AAG | chr3 | 120676796 | 120676815 | 120676812 | + |
| SEQ ID NO 30013 | GCTCCTTAAGAGATATAAGA | AGG | chr3 | 120676797 | 120676816 | 120676813 | + |
| SEQ ID NO 30014 | CTCCTTAAGAGATATAAGAA | GGG | chr3 | 120676798 | 120676817 | 120676814 | + |
| SEQ ID NO 30015 | CTTAAGAGATATAAGAAGGG | TGG | chr3 | 120676801 | 120676820 | 120676817 | + |
| SEQ ID NO 30016 | AAGAGATATAAGAAGGGTGG | AAG | chr3 | 120676804 | 120676823 | 120676820 | + |
| SEQ ID NO 30017 | AGATATAAGAAGGGTGGAAG | TGG | chr3 | 120676807 | 120676826 | 120676823 | + |
| SEQ ID NO 30018 | GATATAAGAAGGGTGGAAGT | GGG | chr3 | 120676808 | 120676827 | 120676824 | + |
| SEQ ID NO 30019 | AAGAAGGGTGGAAGTGGGTG | AAG | chr3 | 120676813 | 120676832 | 120676829 | + |
| SEQ ID NO 30020 | AGAAGGGTGGAAGTGGGTGA | AGG | chr3 | 120676814 | 120676833 | 120676830 | + |
| SEQ ID NO 30021 | GAAGGGTGGAAGTGGGTGAA | GGG | chr3 | 120676815 | 120676834 | 120676831 | + |
| SEQ ID NO 30022 | GGGTGGAAGTGGGTGAAGGG | TAG | chr3 | 120676818 | 120676837 | 120676834 | + |
| SEQ ID NO 30023 | GGTGGAAGTGGGTGAAGGGT | AGG | chr3 | 120676819 | 120676838 | 120676835 | + |
| SEQ ID NO 30024 | TGGGTGAAGGGTAGGCCCTC | CAG | chr3 | 120676827 | 120676846 | 120676843 | + |
| SEQ ID NO 30025 | GGTGAAGGGTAGGCCCTCCA | GAG | chr3 | 120676829 | 120676848 | 120676845 | + |
| SEQ ID NO 30026 | GGTAGGCCCTCCAGAGTTCT | CAG | chr3 | 120676836 | 120676855 | 120676852 | + |
| SEQ ID NO 30027 | TCCAGAGTTCTCAGTTGTTG | CGG | chr3 | 120676845 | 120676864 | 120676861 | + |
| SEQ ID NO 30028 | CCAGAGTTCTCAGTTGTTGC | GGG | chr3 | 120676846 | 120676865 | 120676862 | + |
| SEQ ID NO 30029 | GAGTTCTCAGTTGTTGCGGG | AAG | chr3 | 120676849 | 120676868 | 120676865 | + |
| SEQ ID NO 30030 | CTCAGTTGTTGCGGGAAGTC | TGG | chr3 | 120676854 | 120676873 | 120676870 | + |
| SEQ ID NO 30031 | TCAGTTGTTGCGGGAAGTCT | GGG | chr3 | 120676855 | 120676874 | 120676871 | + |
| SEQ ID NO 30032 | GGGAAGTCTGGGACTCCAAA | CGG | chr3 | 120676866 | 120676885 | 120676882 | + |
| SEQ ID NO 30033 | GAAGTCTGGGACTCCAAACG | GAG | chr3 | 120676868 | 120676887 | 120676884 | + |
| SEQ ID NO 30034 | AAGTCTGGGACTCCAAACGG | AGG | chr3 | 120676869 | 120676888 | 120676885 | + |
| SEQ ID NO 30035 | AGTCTGGGACTCCAAACGGA | GGG | chr3 | 120676870 | 120676889 | 120676886 | + |
| SEQ ID NO 30036 | GGGACTCCAAACGGAGGGAT | CAG | chr3 | 120676875 | 120676894 | 120676891 | + |
| SEQ ID NO 30037 | CCAAACGGAGGGATCAGCTG | AAG | chr3 | 120676881 | 120676900 | 120676897 | + |
| SEQ ID NO 30038 | GGAGGGATCAGCTGAAGCCA | TGG | chr3 | 120676887 | 120676906 | 120676903 | + |
| SEQ ID NO 30039 | GGGATCAGCTGAAGCCATGG | CAG | chr3 | 120676890 | 120676909 | 120676906 | + |
| SEQ ID NO 30040 | ATCAGCTGAAGCCATGGCAG | AAG | chr3 | 120676893 | 120676912 | 120676909 | + |
| SEQ ID NO 30041 | GAAGCCATGGCAGAAGTTCG | TGG | chr3 | 120676900 | 120676919 | 120676916 | + |
| SEQ ID NO 30042 | GCAGAAGTTCGTGGATTGTG | AAG | chr3 | 120676909 | 120676928 | 120676925 | + |

Figure 49 (Cont'd)

| SEQ ID NO 30043 | CGTGGATTGTGAAGATTTCA | TGG | chr3 | 120676918 | 120676937 | 120676934 | + |
| SEQ ID NO 30044 | AAGATTTCATGGACATTTAT | TAG | chr3 | 120676929 | 120676948 | 120676945 | + |
| SEQ ID NO 30045 | ATCTCTAAACATAAATTGTA | AAG | chr3 | 120677000 | 120677019 | 120677016 | + |
| SEQ ID NO 30046 | CATAAATTGTAAAGATTTCA | TGG | chr3 | 120677009 | 120677028 | 120677025 | + |
| SEQ ID NO 30047 | ATGGACACTTATCACTTCCC | CAG | chr3 | 120677028 | 120677047 | 120677044 | + |
| SEQ ID NO 30048 | CTTTAATCTCTTAATCCTGT | CAG | chr3 | 120677082 | 120677101 | 120677098 | + |
| SEQ ID NO 30049 | ATCTCTTAATCCTGTCAGCT | GAG | chr3 | 120677087 | 120677106 | 120677103 | + |
| SEQ ID NO 30050 | TCTCTTAATCCTGTCAGCTG | AGG | chr3 | 120677088 | 120677107 | 120677104 | + |
| SEQ ID NO 30051 | TCTTAATCCTGTCAGCTGAG | GAG | chr3 | 120677090 | 120677109 | 120677106 | + |
| SEQ ID NO 30052 | CTTAATCCTGTCAGCTGAGG | AGG | chr3 | 120677091 | 120677110 | 120677107 | + |
| SEQ ID NO 30053 | GAGGAGGATGTATATTGCCT | CAG | chr3 | 120677107 | 120677126 | 120677123 | + |
| SEQ ID NO 30054 | AGGAGGATGTATATTGCCTC | AGG | chr3 | 120677108 | 120677127 | 120677124 | + |
| SEQ ID NO 30055 | CATTAACTGCACAAATTGTA | CAG | chr3 | 120677146 | 120677165 | 120677162 | + |
| SEQ ID NO 30056 | ATTGTACAGCATGTGTGTTT | GAG | chr3 | 120677160 | 120677179 | 120677176 | + |
| SEQ ID NO 30057 | TGTTTGAGCAACATGAAATG | TGG | chr3 | 120677175 | 120677194 | 120677191 | + |
| SEQ ID NO 30058 | AAATGTGGACACCTTGAAAA | AAG | chr3 | 120677190 | 120677209 | 120677206 | + |
| SEQ ID NO 30059 | TGGACACCTTGAAAAAGAA | CAG | chr3 | 120677195 | 120677214 | 120677211 | + |
| SEQ ID NO 30060 | GGACACCTTGAAAAAGAAC | AGG | chr3 | 120677196 | 120677215 | 120677212 | + |
| SEQ ID NO 30061 | TTGAAAAAGAACAGGATAA | CAG | chr3 | 120677203 | 120677222 | 120677219 | + |
| SEQ ID NO 30062 | ACAGGATAACAGCAATTGTT | CAG | chr3 | 120677214 | 120677233 | 120677230 | + |
| SEQ ID NO 30063 | CAGGATAACAGCAATTGTTC | AGG | chr3 | 120677215 | 120677234 | 120677231 | + |
| SEQ ID NO 30064 | AGGATAACAGCAATTGTTCA | GGG | chr3 | 120677216 | 120677235 | 120677232 | + |
| SEQ ID NO 30065 | ACAGCAATTGTTCAGGGAAT | AAG | chr3 | 120677222 | 120677241 | 120677238 | + |
| SEQ ID NO 30066 | AGCAATTGTTCAGGGAATAA | GAG | chr3 | 120677224 | 120677243 | 120677240 | + |
| SEQ ID NO 30067 | CAATTGTTCAGGGAATAAGA | GAG | chr3 | 120677226 | 120677245 | 120677242 | + |
| SEQ ID NO 30068 | TAACCTTAAACTCTGACTGC | TGG | chr3 | 120677250 | 120677269 | 120677266 | + |
| SEQ ID NO 30069 | CTTAAACTCTGACTGCTGGT | GAG | chr3 | 120677254 | 120677273 | 120677270 | + |
| SEQ ID NO 30070 | AACTCTGACTGCTGGTGAGC | CAG | chr3 | 120677258 | 120677277 | 120677274 | + |
| SEQ ID NO 30071 | ACTCTGACTGCTGGTGAGCC | AGG | chr3 | 120677259 | 120677278 | 120677275 | + |
| SEQ ID NO 30072 | CTGACTGCTGGTGAGCCAGG | CAG | chr3 | 120677262 | 120677281 | 120677278 | + |
| SEQ ID NO 30073 | TGCTGGTGAGCCAGGCAGAA | CAG | chr3 | 120677267 | 120677286 | 120677283 | + |
| SEQ ID NO 30074 | CTGGTGAGCCAGGCAGAACA | GAG | chr3 | 120677269 | 120677288 | 120677285 | + |
| SEQ ID NO 30075 | CCATATTTCTCTTCTTTCAA | AAG | chr3 | 120677292 | 120677311 | 120677308 | + |
| SEQ ID NO 30076 | TCTCTTCTTTCAAAAGCAAA | TGG | chr3 | 120677299 | 120677318 | 120677315 | + |
| SEQ ID NO 30077 | CTCTTCTTTCAAAAGCAAAT | GGG | chr3 | 120677300 | 120677319 | 120677316 | + |
| SEQ ID NO 30078 | CTTCTTTCAAAAGCAAATGG | GAG | chr3 | 120677302 | 120677321 | 120677318 | + |
| SEQ ID NO 30079 | TATCGCTGAATTCTTTTTCT | CAG | chr3 | 120677328 | 120677347 | 120677344 | + |
| SEQ ID NO 30080 | CTGAATTCTTTTTCTCAGCA | TGG | chr3 | 120677333 | 120677352 | 120677349 | + |
| SEQ ID NO 30081 | TCTCAGCATGGAACATCCCT | GAG | chr3 | 120677345 | 120677364 | 120677361 | + |
| SEQ ID NO 30082 | AGCATGGAACATCCCTGAGA | AAG | chr3 | 120677349 | 120677368 | 120677365 | + |
| SEQ ID NO 30083 | CATGGAACATCCCTGAGAAA | GAG | chr3 | 120677351 | 120677370 | 120677367 | + |
| SEQ ID NO 30084 | ATCCCTGAGAAAGAGAATAC | GAG | chr3 | 120677359 | 120677378 | 120677375 | + |
| SEQ ID NO 30085 | CTGAGAAAGAGAATACGAGC | CAG | chr3 | 120677363 | 120677382 | 120677379 | + |
| SEQ ID NO 30086 | TGAGAAAGAGAATACGAGCC | AGG | chr3 | 120677364 | 120677383 | 120677380 | + |
| SEQ ID NO 30087 | AGAAAGAGAATACGAGCCAG | GAG | chr3 | 120677366 | 120677385 | 120677382 | + |
| SEQ ID NO 30088 | GAAAGAGAATACGAGCCAGG | AGG | chr3 | 120677367 | 120677386 | 120677383 | + |
| SEQ ID NO 30089 | AGAATACGAGCCAGGAGGTA | TAG | chr3 | 120677372 | 120677391 | 120677388 | + |

Figure 49 (Cont'd)

| SEQ ID NO | Sequence | | | | | |
|---|---|---|---|---|---|---|
| SEQ ID NO 30090 | GAATACGAGCCAGGAGGTAT | AGG | chr3 | 120677373 | 120677392 | 120677389 + |
| SEQ ID NO 30091 | AGGAGGTATAGGCTTATAAA | CAG | chr3 | 120677384 | 120677403 | 120677400 + |
| SEQ ID NO 30092 | GCTTATAAACAGCCCCCCTC | CAG | chr3 | 120677395 | 120677414 | 120677411 + |
| SEQ ID NO 30093 | CTTATAAACAGCCCCCCTCC | AGG | chr3 | 120677396 | 120677415 | 120677412 + |
| SEQ ID NO 30094 | CCAGGTGCGCCTGTCTCTTA | TGG | chr3 | 120677414 | 120677433 | 120677430 + |
| SEQ ID NO 30095 | TGCGCCTGTCTCTTATGGTC | GAG | chr3 | 120677419 | 120677438 | 120677435 + |
| SEQ ID NO 30096 | GTCTCTTATGGTCGAGACTG | CAG | chr3 | 120677426 | 120677445 | 120677442 + |
| SEQ ID NO 30097 | TCTCTTATGGTCGAGACTGC | AGG | chr3 | 120677427 | 120677446 | 120677443 + |
| SEQ ID NO 30098 | CTCTTATGGTCGAGACTGCA | GGG | chr3 | 120677428 | 120677447 | 120677444 + |
| SEQ ID NO 30099 | TCTTATGGTCGAGACTGCAG | GGG | chr3 | 120677429 | 120677448 | 120677445 + |
| SEQ ID NO 30100 | TCGAGACTGCAGGGGTGAAA | TAG | chr3 | 120677437 | 120677456 | 120677453 + |
| SEQ ID NO 30101 | TGCAGGGGTGAAATAGACCC | CAG | chr3 | 120677444 | 120677463 | 120677460 + |
| SEQ ID NO 30102 | AAATAGACCCCAGTCTCCCA | CAG | chr3 | 120677454 | 120677473 | 120677470 + |
| SEQ ID NO 30103 | CCAGTCTCCCACAGCGCTCC | CAG | chr3 | 120677463 | 120677482 | 120677479 + |
| SEQ ID NO 30104 | CAGTCTCCCACAGCGCTCCC | AGG | chr3 | 120677464 | 120677483 | 120677480 + |
| SEQ ID NO 30105 | CACAGCGCTCCCAGGCTTAT | TAG | chr3 | 120677472 | 120677491 | 120677488 + |
| SEQ ID NO 30106 | ACAGCGCTCCCAGGCTTATT | AGG | chr3 | 120677473 | 120677492 | 120677489 + |
| SEQ ID NO 30107 | GCGCTCCCAGGCTTATTAGG | AAG | chr3 | 120677476 | 120677495 | 120677492 + |
| SEQ ID NO 30108 | GCTCCCAGGCTTATTAGGAA | GAG | chr3 | 120677478 | 120677497 | 120677494 + |
| SEQ ID NO 30109 | CTCCCAGGCTTATTAGGAAG | AGG | chr3 | 120677479 | 120677498 | 120677495 + |
| SEQ ID NO 30110 | AATTCCCGCCTAATAAATTT | TGG | chr3 | 120677503 | 120677522 | 120677519 + |
| SEQ ID NO 30111 | CCCGCCTAATAAATTTTGGT | CAG | chr3 | 120677507 | 120677526 | 120677523 + |
| SEQ ID NO 30112 | CTAATAAATTTTGGTCAGAC | CAG | chr3 | 120677512 | 120677531 | 120677528 + |
| SEQ ID NO 30113 | TAAAAACCCTGTCTCCTGAT | AAG | chr3 | 120677542 | 120677561 | 120677558 + |
| SEQ ID NO 30114 | TAAGATGTTATCAATGACAA | TGG | chr3 | 120677561 | 120677580 | 120677577 + |
| SEQ ID NO 30115 | AATGGTGCCCGAAACTTCAT | TAG | chr3 | 120677579 | 120677598 | 120677595 + |
| SEQ ID NO 30116 | TAGCAATTTTAATTTCGCCT | CGG | chr3 | 120677599 | 120677618 | 120677615 + |
| SEQ ID NO 30117 | TTAATTTCGCCTCGGTCCTG | TGG | chr3 | 120677607 | 120677626 | 120677623 + |
| SEQ ID NO 30118 | TGATATTCTATTACCTTGTA | AAG | chr3 | 120677663 | 120677682 | 120677679 + |
| SEQ ID NO 30119 | AATCCCTAATACAAACTTGC | TGG | chr3 | 120677737 | 120677756 | 120677753 + |
| SEQ ID NO 30120 | TACAAACTTGCTGGTTTTTG | TGG | chr3 | 120677746 | 120677765 | 120677762 + |
| SEQ ID NO 30121 | TTGCTGGTTTTTGTGGCTTG | TGG | chr3 | 120677753 | 120677772 | 120677769 + |
| SEQ ID NO 30122 | TGCTGGTTTTTGTGGCTTGT | GGG | chr3 | 120677754 | 120677773 | 120677770 + |
| SEQ ID NO 30123 | GCTGGTTTTTGTGGCTTGTG | GGG | chr3 | 120677755 | 120677774 | 120677771 + |
| SEQ ID NO 30124 | TTGTGGCTTGTGGGGCATCA | CGG | chr3 | 120677763 | 120677782 | 120677779 + |
| SEQ ID NO 30125 | CCGAAATGTGATGCCTCCCC | CGG | chr3 | 120677792 | 120677811 | 120677808 + |
| SEQ ID NO 30126 | TGATGCCTCCCCGGATGCC | CGG | chr3 | 120677800 | 120677819 | 120677816 + |
| SEQ ID NO 30127 | ACTCTGTCCCTTTATTTCTA | AAG | chr3 | 120677845 | 120677864 | 120677861 + |
| SEQ ID NO 30128 | TGTCCCTTTATTTCTAAAGT | TGG | chr3 | 120677849 | 120677868 | 120677865 + |
| SEQ ID NO 30129 | TTCTAAAGTTGGCCGACGCT | TAG | chr3 | 120677860 | 120677879 | 120677876 + |
| SEQ ID NO 30130 | TCTAAAGTTGGCCGACGCTT | AGG | chr3 | 120677861 | 120677880 | 120677877 + |
| SEQ ID NO 30131 | CTAAAGTTGGCCGACGCTTA | GGG | chr3 | 120677862 | 120677881 | 120677878 + |
| SEQ ID NO 30132 | TGGCCGACGCTTAGGGAAAA | TAG | chr3 | 120677869 | 120677888 | 120677885 + |
| SEQ ID NO 30133 | GACGCTTAGGGAAAATAGAA | AAG | chr3 | 120677874 | 120677893 | 120677890 + |
| SEQ ID NO 30134 | AAAAGAACCTACGTGAATAT | TGG | chr3 | 120677892 | 120677911 | 120677908 + |
| SEQ ID NO 30135 | AAAGAACCTACGTGAATATT | GGG | chr3 | 120677893 | 120677912 | 120677909 + |
| SEQ ID NO 30136 | AAGAACCTACGTGAATATTG | GGG | chr3 | 120677894 | 120677913 | 120677910 + |

Figure 49 (Cont'd)

| | | | | | | | |
|---|---|---|---|---|---|---|---|
| SEQ ID NO 30137 | AACCTACGTGAATATTGGGG | CAG | chr3 | 120677897 | 120677916 | 120677913 | + |
| SEQ ID NO 30138 | ACCTACGTGAATATTGGGGC | AGG | chr3 | 120677898 | 120677917 | 120677914 | + |
| SEQ ID NO 30139 | GGGGCAGGTTCCCTGATACT | CAG | chr3 | 120677913 | 120677932 | 120677929 | + |
| SEQ ID NO 30140 | GCAGGTTCCCTGATACTCAG | TGG | chr3 | 120677916 | 120677935 | 120677932 | + |
| SEQ ID NO 30141 | TTCCCTGATACTCAGTGGCG | TGG | chr3 | 120677921 | 120677940 | 120677937 | + |
| SEQ ID NO 30142 | CCCTGATACTCAGTGGCGTG | GAG | chr3 | 120677923 | 120677942 | 120677939 | + |
| SEQ ID NO 30143 | CAGTGGCGTGGAGATGTAAC | AAG | chr3 | 120677933 | 120677952 | 120677949 | + |
| SEQ ID NO 30144 | GCGTGGAGATGTAACAAGCC | TGG | chr3 | 120677938 | 120677957 | 120677954 | + |
| SEQ ID NO 30145 | TGTAACAAGCCTGGATGTGT | GAG | chr3 | 120677947 | 120677966 | 120677963 | + |
| SEQ ID NO 30146 | CTGGATGTGTGAGTGATGAT | CAG | chr3 | 120677957 | 120677976 | 120677973 | + |
| SEQ ID NO 30147 | TGGATGTGTGAGTGATGATC | AGG | chr3 | 120677958 | 120677977 | 120677974 | + |
| SEQ ID NO 30148 | AGTGATGATCAGGCCAACAA | CAG | chr3 | 120677968 | 120677987 | 120677984 | + |
| SEQ ID NO 30149 | GGCCAACAACAGTCTGTATT | TGG | chr3 | 120677979 | 120677998 | 120677995 | + |
| SEQ ID NO 30150 | CAACAACAGTCTGTATTTGG | AAG | chr3 | 120677982 | 120678001 | 120677998 | + |
| SEQ ID NO 30151 | TCTGTATTTGGAAGAAATAT | CAG | chr3 | 120677991 | 120678010 | 120678007 | + |
| SEQ ID NO 30152 | CAGATGTGAATGTTATGACC | TAG | chr3 | 120678011 | 120678030 | 120678027 | + |
| SEQ ID NO 30153 | AGATGTGAATGTTATGACCT | AGG | chr3 | 120678012 | 120678031 | 120678028 | + |
| SEQ ID NO 30154 | TGTGAATGTTATGACCTAGG | AAG | chr3 | 120678015 | 120678034 | 120678031 | + |
| SEQ ID NO 30155 | TGTTATGACCTAGGAAGCAA | TGG | chr3 | 120678021 | 120678040 | 120678037 | + |
| SEQ ID NO 30156 | TATGACCTAGGAAGCAATGG | AAG | chr3 | 120678024 | 120678043 | 120678040 | + |
| SEQ ID NO 30157 | AAAATTATTCTTTTTGCCTT | CAG | chr3 | 120678050 | 120678069 | 120678066 | + |
| SEQ ID NO 30158 | TTGTCAACACAAAAAATACT | AAG | chr3 | 120678099 | 120678118 | 120678115 | + |
| SEQ ID NO 30159 | GTTGTATACTGATTTGTTAA | AAG | chr3 | 120678121 | 120678140 | 120678137 | + |
| SEQ ID NO 30160 | GTATACTGATTTGTTAAAAG | CAG | chr3 | 120678124 | 120678143 | 120678140 | + |
| SEQ ID NO 30161 | TACTGATTTGTTAAAAGCAG | CAG | chr3 | 120678127 | 120678146 | 120678143 | + |
| SEQ ID NO 30162 | TTGTTAAAAGCAGCAGCATG | CAG | chr3 | 120678134 | 120678153 | 120678150 | + |
| SEQ ID NO 30163 | TAAAAGCAGCAGCATGCAGT | TAG | chr3 | 120678138 | 120678157 | 120678154 | + |
| SEQ ID NO 30164 | AAAAGCAGCAGCATGCAGTT | AGG | chr3 | 120678139 | 120678158 | 120678155 | + |
| SEQ ID NO 30165 | TGCAGTTAGGATGATATCTT | TGG | chr3 | 120678152 | 120678171 | 120678168 | + |
| SEQ ID NO 30166 | GCAGTTAGGATGATATCTTT | GGG | chr3 | 120678153 | 120678172 | 120678169 | + |
| SEQ ID NO 30167 | CAGTTAGGATGATATCTTTG | GGG | chr3 | 120678154 | 120678173 | 120678170 | + |
| SEQ ID NO 30168 | GGATGATATCTTTGGGGAAA | TGG | chr3 | 120678160 | 120678179 | 120678176 | + |
| SEQ ID NO 30169 | TGATATCTTTGGGGAAATGG | CAG | chr3 | 120678163 | 120678182 | 120678179 | + |
| SEQ ID NO 30170 | ATATCTTTGGGGAAATGGCA | GAG | chr3 | 120678165 | 120678184 | 120678181 | + |
| SEQ ID NO 30171 | AACCCATGCTCACCATCAA | CGG | chr3 | 120678240 | 120678259 | 120678256 | + |
| SEQ ID NO 30172 | ACCCCATGCTCACCATCAAC | GGG | chr3 | 120678241 | 120678260 | 120678257 | + |
| SEQ ID NO 30173 | CCATCAACGGGATTGAATTT | GAG | chr3 | 120678253 | 120678272 | 120678269 | + |
| SEQ ID NO 30174 | GGGATTGAATTTGAGCTGCT | GAG | chr3 | 120678261 | 120678280 | 120678277 | + |
| SEQ ID NO 30175 | GAATTTGAGCTGCTGAGAAT | TGG | chr3 | 120678267 | 120678286 | 120678283 | + |
| SEQ ID NO 30176 | TTATCTTCAATTCTGTGAAA | TGG | chr3 | 120678303 | 120678322 | 120678319 | + |
| SEQ ID NO 30177 | AATTCTGTGAAATGGAATTT | TAG | chr3 | 120678311 | 120678330 | 120678327 | + |
| SEQ ID NO 30178 | TGTGAAATGGAATTTTAGAC | CAG | chr3 | 120678316 | 120678335 | 120678332 | + |
| SEQ ID NO 30179 | TTTAGACCAGCCTGTGACTG | AAG | chr3 | 120678329 | 120678348 | 120678345 | + |
| SEQ ID NO 30180 | CAGCCTGTGACTGAAGCCAC | TGG | chr3 | 120678336 | 120678355 | 120678352 | + |
| SEQ ID NO 30181 | AGCCTGTGACTGAAGCCACT | GGG | chr3 | 120678337 | 120678356 | 120678353 | + |
| SEQ ID NO 30182 | ACTGAAGCCACTGGGCATTA | CAG | chr3 | 120678345 | 120678364 | 120678361 | + |
| SEQ ID NO 30183 | GCCGCATTGTTTCTCTCTGC | AAG | chr3 | 120678388 | 120678407 | 120678404 | + |

Figure 49 (Cont'd)

| SEQ ID NO 30184 | CGCATTGTTTCTCTCTGCAA | GAG | chr3 | 120678390 | 120678409 | 120678406 | + |
| SEQ ID NO 30185 | CATTGTTTCTCTCTGCAAGA | GAG | chr3 | 120678392 | 120678411 | 120678408 | + |
| SEQ ID NO 30186 | ATTGTTTCTCTCTGCAAGAG | AGG | chr3 | 120678393 | 120678412 | 120678409 | + |
| SEQ ID NO 30187 | GTTTCTCTCTGCAAGAGAGG | AAG | chr3 | 120678396 | 120678415 | 120678412 | + |
| SEQ ID NO 30188 | TTTCTCTCTGCAAGAGAGGA | AGG | chr3 | 120678397 | 120678416 | 120678413 | + |
| SEQ ID NO 30189 | CTCTCTGCAAGAGAGGAAGG | AAG | chr3 | 120678400 | 120678419 | 120678416 | + |
| SEQ ID NO 30190 | TCTCTGCAAGAGAGGAAGGA | AGG | chr3 | 120678401 | 120678420 | 120678417 | + |
| SEQ ID NO 30191 | TGCAAGAGAGGAAGGAAGGC | TGG | chr3 | 120678405 | 120678424 | 120678421 | + |
| SEQ ID NO 30192 | CAAGAGAGGAAGGAAGGCTG | GAG | chr3 | 120678407 | 120678426 | 120678423 | + |
| SEQ ID NO 30193 | GAGGAAGGAAGGCTGGAGTA | CAG | chr3 | 120678412 | 120678431 | 120678428 | + |
| SEQ ID NO 30194 | AGGAAGGCTGGAGTACAGCT | GAG | chr3 | 120678417 | 120678436 | 120678433 | + |
| SEQ ID NO 30195 | TGGAGTACAGCTGAGCTTTC | TGG | chr3 | 120678425 | 120678444 | 120678441 | + |
| SEQ ID NO 30196 | AGTACAGCTGAGCTTTCTGG | CAG | chr3 | 120678428 | 120678447 | 120678444 | + |
| SEQ ID NO 30197 | GTACAGCTGAGCTTTCTGGC | AGG | chr3 | 120678429 | 120678448 | 120678445 | + |
| SEQ ID NO 30198 | CTGAGCTTTCTGGCAGGCAC | TGG | chr3 | 120678435 | 120678454 | 120678451 | + |
| SEQ ID NO 30199 | AGCTTTCTGGCAGGCACTGG | TGG | chr3 | 120678438 | 120678457 | 120678454 | + |
| SEQ ID NO 30200 | CTTTCTGGCAGGCACTGGTG | GAG | chr3 | 120678440 | 120678459 | 120678456 | + |
| SEQ ID NO 30201 | CCTTCCCCATTCTTTGTAAC | TGG | chr3 | 120678474 | 120678493 | 120678490 | + |
| SEQ ID NO 30202 | TCCCCATTCTTTGTAACTGG | TGG | chr3 | 120678477 | 120678496 | 120678493 | + |
| SEQ ID NO 30203 | TTCTTTGTAACTGGTGGCCT | TAG | chr3 | 120678483 | 120678502 | 120678499 | + |
| SEQ ID NO 30204 | TTTGTAACTGGTGGCCTTAG | AAG | chr3 | 120678486 | 120678505 | 120678502 | + |
| SEQ ID NO 30205 | TGTAACTGGTGGCCTTAGAA | GAG | chr3 | 120678488 | 120678507 | 120678504 | + |
| SEQ ID NO 30206 | GTAACTGGTGGCCTTAGAAG | AGG | chr3 | 120678489 | 120678508 | 120678505 | + |
| SEQ ID NO 30207 | TAACTGGTGGCCTTAGAAGA | GGG | chr3 | 120678490 | 120678509 | 120678506 | + |
| SEQ ID NO 30208 | GGTGGCCTTAGAAGAGGGTT | CAG | chr3 | 120678495 | 120678514 | 120678511 | + |
| SEQ ID NO 30209 | GTGGCCTTAGAAGAGGGTTC | AGG | chr3 | 120678496 | 120678515 | 120678512 | + |
| SEQ ID NO 30210 | TGGCCTTAGAAGAGGGTTCA | GGG | chr3 | 120678497 | 120678516 | 120678513 | + |
| SEQ ID NO 30211 | AGGGTTCAGGGTTATGTGTT | TGG | chr3 | 120678509 | 120678528 | 120678525 | + |
| SEQ ID NO 30212 | GGGTTATGTGTTTGGAACAC | GAG | chr3 | 120678517 | 120678536 | 120678533 | + |
| SEQ ID NO 30213 | TATGTGTTTGGAACACGAGT | TAG | chr3 | 120678521 | 120678540 | 120678537 | + |
| SEQ ID NO 30214 | GGAACACGAGTTAGTATAAA | TGG | chr3 | 120678530 | 120678549 | 120678546 | + |
| SEQ ID NO 30215 | AGTTAGTATAAATGGTTCTG | AAG | chr3 | 120678538 | 120678557 | 120678554 | + |
| SEQ ID NO 30216 | TGGTTCTGAAGCACTTGATT | CAG | chr3 | 120678550 | 120678569 | 120678566 | + |
| SEQ ID NO 30217 | TCAGACTGTGCTTTAAAAAA | TAG | chr3 | 120678569 | 120678588 | 120678585 | + |
| SEQ ID NO 30218 | CAGACTGTGCTTTAAAAAAT | AGG | chr3 | 120678570 | 120678589 | 120678586 | + |
| SEQ ID NO 30219 | CTGTGCTTTAAAAAATAGGA | AAG | chr3 | 120678574 | 120678593 | 120678590 | + |
| SEQ ID NO 30220 | GCTTTAAAAAATAGGAAAGA | AAG | chr3 | 120678578 | 120678597 | 120678594 | + |
| SEQ ID NO 30221 | TTAAAAAATAGGAAAGAAAG | TAG | chr3 | 120678581 | 120678600 | 120678597 | + |
| SEQ ID NO 30222 | AAAATAGGAAAGAAAGTAGA | AAG | chr3 | 120678585 | 120678604 | 120678601 | + |
| SEQ ID NO 30223 | AGGAAAGAAAGTAGAAAGAA | CAG | chr3 | 120678590 | 120678609 | 120678606 | + |
| SEQ ID NO 30224 | AAAGTAGAAAGAACAGCTGA | TGG | chr3 | 120678597 | 120678616 | 120678613 | + |
| SEQ ID NO 30225 | AGAAAGAACAGCTGATGGTT | TGG | chr3 | 120678602 | 120678621 | 120678618 | + |
| SEQ ID NO 30226 | AAGAACAGCTGATGGTTTGG | AAG | chr3 | 120678605 | 120678624 | 120678621 | + |
| SEQ ID NO 30227 | AGAACAGCTGATGGTTTGGA | AGG | chr3 | 120678606 | 120678625 | 120678622 | + |
| SEQ ID NO 30228 | GAACAGCTGATGGTTTGGAA | GGG | chr3 | 120678607 | 120678626 | 120678623 | + |
| SEQ ID NO 30229 | ACAGCTGATGGTTTGGAAGG | GAG | chr3 | 120678609 | 120678628 | 120678625 | + |
| SEQ ID NO 30230 | TGGTTTGGAAGGGAGCCACC | AAG | chr3 | 120678617 | 120678636 | 120678633 | + |

Figure 49 (Cont'd)

| SEQ ID NO 30231 | GAAGGGAGCCACCAAGCACC | AAG | chr3 | 120678624 | 120678643 | 120678640 | + |
| SEQ ID NO 30232 | AGGGAGCCACCAAGCACCAA | GAG | chr3 | 120678626 | 120678645 | 120678642 | + |
| SEQ ID NO 30233 | GGGAGCCACCAAGCACCAAG | AGG | chr3 | 120678627 | 120678646 | 120678643 | + |
| SEQ ID NO 30234 | CACCAAGCACCAAGAGGTGT | GAG | chr3 | 120678633 | 120678652 | 120678649 | + |
| SEQ ID NO 30235 | CTGAATCCGTTTCTCAATCT | TAG | chr3 | 120678658 | 120678677 | 120678674 | + |
| SEQ ID NO 30236 | CCGTTTCTCAATCTTAGCTG | CAG | chr3 | 120678664 | 120678683 | 120678680 | + |
| SEQ ID NO 30237 | CGTTTCTCAATCTTAGCTGC | AGG | chr3 | 120678665 | 120678684 | 120678681 | + |
| SEQ ID NO 30238 | GTTTCTCAATCTTAGCTGCA | GGG | chr3 | 120678666 | 120678685 | 120678682 | + |
| SEQ ID NO 30239 | CAATCTTAGCTGCAGGGCAT | TGG | chr3 | 120678672 | 120678691 | 120678688 | + |
| SEQ ID NO 30240 | TAGCTGCAGGGCATTGGCTA | AAG | chr3 | 120678678 | 120678697 | 120678694 | + |
| SEQ ID NO 30241 | GCTGCAGGGCATTGGCTAAA | GAG | chr3 | 120678680 | 120678699 | 120678696 | + |
| SEQ ID NO 30242 | CTGCAGGGCATTGGCTAAAG | AGG | chr3 | 120678681 | 120678700 | 120678697 | + |
| SEQ ID NO 30243 | CAGGGCATTGGCTAAAGAGG | AAG | chr3 | 120678684 | 120678703 | 120678700 | + |
| SEQ ID NO 30244 | AGGGCATTGGCTAAAGAGGA | AGG | chr3 | 120678685 | 120678704 | 120678701 | + |
| SEQ ID NO 30245 | AGAGGAAGGTGAAAACTGCT | GAG | chr3 | 120678699 | 120678718 | 120678715 | + |
| SEQ ID NO 30246 | TGAGTCACTATCAAATCAAT | TGG | chr3 | 120678718 | 120678737 | 120678734 | + |
| SEQ ID NO 30247 | ATTGGTTTTTCTAATCCCCT | GAG | chr3 | 120678736 | 120678755 | 120678752 | + |
| SEQ ID NO 30248 | TGGTTTTTCTAATCCCCTGA | GAG | chr3 | 120678738 | 120678757 | 120678754 | + |
| SEQ ID NO 30249 | TTCTAATCCCCTGAGAGAAA | AAG | chr3 | 120678744 | 120678763 | 120678760 | + |
| SEQ ID NO 30250 | ATCCCCTGAGAGAAAAGTA | CAG | chr3 | 120678749 | 120678768 | 120678765 | + |
| SEQ ID NO 30251 | CCCCTGAGAGAAAAGTACA | GAG | chr3 | 120678751 | 120678770 | 120678767 | + |
| SEQ ID NO 30252 | AAAAGTACAGAGTTTATTG | CAG | chr3 | 120678761 | 120678780 | 120678777 | + |
| SEQ ID NO 30253 | TTAAAATGCCATGCCCCTCA | CGG | chr3 | 120678786 | 120678805 | 120678802 | + |
| SEQ ID NO 30254 | TGCCATGCCCCTCACGGCCA | AAG | chr3 | 120678792 | 120678811 | 120678808 | + |
| SEQ ID NO 30255 | GCCATGCCCCTCACGGCCAA | AGG | chr3 | 120678793 | 120678812 | 120678809 | + |
| SEQ ID NO 30256 | CGGCCAAAGGCATCTGAATT | AAG | chr3 | 120678806 | 120678825 | 120678822 | + |
| SEQ ID NO 30257 | GGCCAAAGGCATCTGAATTA | AGG | chr3 | 120678807 | 120678826 | 120678823 | + |
| SEQ ID NO 30258 | CAAAGGCATCTGAATTAAGG | AAG | chr3 | 120678810 | 120678829 | 120678826 | + |
| SEQ ID NO 30259 | AGGCATCTGAATTAAGGAAG | CAG | chr3 | 120678813 | 120678832 | 120678829 | + |
| SEQ ID NO 30260 | AATTAAGGAAGCAGTATTCA | CAG | chr3 | 120678822 | 120678841 | 120678838 | + |
| SEQ ID NO 30261 | GTATTCACAGCTGCTTTCTC | CAG | chr3 | 120678835 | 120678854 | 120678851 | + |
| SEQ ID NO 30262 | AGCTGCTTTCTCCAGACATT | GAG | chr3 | 120678843 | 120678862 | 120678859 | + |
| SEQ ID NO 30263 | TTTCTCCAGACATTGAGCTC | AAG | chr3 | 120678849 | 120678868 | 120678865 | + |
| SEQ ID NO 30264 | TTCTCCAGACATTGAGCTCA | AGG | chr3 | 120678850 | 120678869 | 120678866 | + |
| SEQ ID NO 30265 | CCAGACATTGAGCTCAAGGA | CAG | chr3 | 120678854 | 120678873 | 120678870 | + |
| SEQ ID NO 30266 | AATCTGAACTCTGCTTTTAT | CAG | chr3 | 120678877 | 120678896 | 120678893 | + |
| SEQ ID NO 30267 | TTTATCAGCTGCGAAAATCC | AAG | chr3 | 120678892 | 120678911 | 120678908 | + |
| SEQ ID NO 30268 | AAAATCCAAGCATTCATTTC | CAG | chr3 | 120678905 | 120678924 | 120678921 | + |
| SEQ ID NO 30269 | TCCAAGCATTCATTTCCAGC | TGG | chr3 | 120678909 | 120678928 | 120678925 | + |
| SEQ ID NO 30270 | GCATTCATTTCCAGCTGGTT | CAG | chr3 | 120678914 | 120678933 | 120678930 | + |
| SEQ ID NO 30271 | CTGGTTCAGTGCCTATGTAA | AAG | chr3 | 120678928 | 120678947 | 120678944 | + |
| SEQ ID NO 30272 | AGTATACTGTGTACAAAAAT | AAG | chr3 | 120678949 | 120678968 | 120678965 | + |
| SEQ ID NO 30273 | TGTACAAAAATAAGATTAAA | AAG | chr3 | 120678958 | 120678977 | 120678974 | + |
| SEQ ID NO 30274 | AAGATTAAAAAGCTAACATT | AAG | chr3 | 120678969 | 120678988 | 120678985 | + |
| SEQ ID NO 30275 | TTAAAAGCTAACATTAAGC | AAG | chr3 | 120678973 | 120678992 | 120678989 | + |
| SEQ ID NO 30276 | GTGTGTTTGTATGTTTTCTA | CAG | chr3 | 120678995 | 120679014 | 120679011 | + |
| SEQ ID NO 30277 | TTTGTATGTTTTCTACAGTT | CGG | chr3 | 120679000 | 120679019 | 120679016 | + |

Figure 49 (Cont'd)

| | | | | | | | |
|---|---|---|---|---|---|---|---|
| SEQ ID NO 30278 | TTCTGAATAATTTGATCCGA | CAG | chr3 | 120679025 | 120679044 | 120679041 | + |
| SEQ ID NO 30279 | ATATGATTTCATTTCTTTTC | GAG | chr3 | 120679052 | 120679071 | 120679068 | + |
| SEQ ID NO 30280 | ATGATTTCATTTCTTTTCGA | GAG | chr3 | 120679054 | 120679073 | 120679070 | + |
| SEQ ID NO 30281 | TATGCATACTTTCTAAATGC | AAG | chr3 | 120679082 | 120679101 | 120679098 | + |
| SEQ ID NO 30282 | AAATGCAAGAATAAATTCCT | GAG | chr3 | 120679096 | 120679115 | 120679112 | + |
| SEQ ID NO 30283 | TCCTGAGCTCCATGTGACTT | CAG | chr3 | 120679112 | 120679131 | 120679128 | + |
| SEQ ID NO 30284 | CCATGTGACTTCAGTACCAT | CAG | chr3 | 120679121 | 120679140 | 120679137 | + |
| SEQ ID NO 30285 | CTTCAGTACCATCAGCTCTT | TGG | chr3 | 120679129 | 120679148 | 120679145 | + |
| SEQ ID NO 30286 | CAGTACCATCAGCTCTTTGG | CAG | chr3 | 120679132 | 120679151 | 120679148 | + |
| SEQ ID NO 30287 | TCAGCTCTTTGGCAGCTTAT | GAG | chr3 | 120679140 | 120679159 | 120679156 | + |
| SEQ ID NO 30288 | TTTGGCAGCTTATGAGTATA | CAG | chr3 | 120679147 | 120679166 | 120679163 | + |
| SEQ ID NO 30289 | ACAGCTTTTAATTCTCACC | TGG | chr3 | 120679166 | 120679185 | 120679182 | + |
| SEQ ID NO 30290 | TTTAATTCTCACCTGGTCCC | CAG | chr3 | 120679173 | 120679192 | 120679189 | + |
| SEQ ID NO 30291 | TTAATTCTCACCTGGTCCCC | AGG | chr3 | 120679174 | 120679193 | 120679190 | + |
| SEQ ID NO 30292 | CTCACCTGGTCCCCAGGATA | TGG | chr3 | 120679180 | 120679199 | 120679196 | + |
| SEQ ID NO 30293 | CCAGGATATGGTTTACTTGT | CAG | chr3 | 120679192 | 120679211 | 120679208 | + |
| SEQ ID NO 30294 | AGGATATGGTTTACTTGTCA | GAG | chr3 | 120679194 | 120679213 | 120679210 | + |
| SEQ ID NO 30295 | ATATGGTTTACTTGTCAGAG | TAG | chr3 | 120679197 | 120679216 | 120679213 | + |
| SEQ ID NO 30296 | ACTTGTCAGAGTAGTTTTAT | GAG | chr3 | 120679206 | 120679225 | 120679222 | + |
| SEQ ID NO 30297 | CTTGTCAGAGTAGTTTTATG | AGG | chr3 | 120679207 | 120679226 | 120679223 | + |
| SEQ ID NO 30298 | CTTTCTCCTGACTCTGATTC | TAG | chr3 | 120679232 | 120679251 | 120679248 | + |
| SEQ ID NO 30299 | TTTCTCCTGACTCTGATTCT | AGG | chr3 | 120679233 | 120679252 | 120679249 | + |
| SEQ ID NO 30300 | GATTCTAGGTAACACCTGAT | GAG | chr3 | 120679247 | 120679266 | 120679263 | + |
| SEQ ID NO 30301 | GTAACACCTGATGAGATGAA | CAG | chr3 | 120679255 | 120679274 | 120679271 | + |
| SEQ ID NO 30302 | CACCTGATGAGATGAACAGA | TGG | chr3 | 120679259 | 120679278 | 120679275 | + |
| SEQ ID NO 30303 | TGCACCTCACTTCCTCTTAC | TGG | chr3 | 120679282 | 120679301 | 120679298 | + |
| SEQ ID NO 30304 | GCACCTCACTTCCTCTTACT | GGG | chr3 | 120679283 | 120679302 | 120679299 | + |
| SEQ ID NO 30305 | ACTTCCTCTTACTGGGCATG | AAG | chr3 | 120679290 | 120679309 | 120679306 | + |
| SEQ ID NO 30306 | CTTCCTCTTACTGGGCATGA | AGG | chr3 | 120679291 | 120679310 | 120679307 | + |
| SEQ ID NO 30307 | CTCTTACTGGGCATGAAGGA | AAG | chr3 | 120679295 | 120679314 | 120679311 | + |
| SEQ ID NO 30308 | CTTACTGGGCATGAAGGAAA | GAG | chr3 | 120679297 | 120679316 | 120679313 | + |
| SEQ ID NO 30309 | TACTGGGCATGAAGGAAAGA | GAG | chr3 | 120679299 | 120679318 | 120679315 | + |
| SEQ ID NO 30310 | CTGGGCATGAAGGAAAGAGA | GAG | chr3 | 120679301 | 120679320 | 120679317 | + |
| SEQ ID NO 30311 | GGCATGAAGGAAAGAGAGAG | AAG | chr3 | 120679304 | 120679323 | 120679320 | + |
| SEQ ID NO 30312 | TGAAGGAAAGAGAGAGAAGT | CAG | chr3 | 120679308 | 120679327 | 120679324 | + |
| SEQ ID NO 30313 | GAAGGAAAGAGAGAGAAGTC | AGG | chr3 | 120679309 | 120679328 | 120679325 | + |
| SEQ ID NO 30314 | AAGGAAAGAGAGAGAAGTCA | GGG | chr3 | 120679310 | 120679329 | 120679326 | + |
| SEQ ID NO 30315 | GAAAGAGAGAGAAGTCAGGG | TAG | chr3 | 120679313 | 120679332 | 120679329 | + |
| SEQ ID NO 30316 | AAGAGAGAGAAGTCAGGGTA | GAG | chr3 | 120679315 | 120679334 | 120679331 | + |
| SEQ ID NO 30317 | TGCTACATTTTTTTTTCTG | TGG | chr3 | 120679348 | 120679367 | 120679364 | + |
| SEQ ID NO 30318 | ATTTTTTTTTCTGTGGAAA | AAG | chr3 | 120679354 | 120679373 | 120679370 | + |
| SEQ ID NO 30319 | TTTTTTTTCTGTGGAAAAA | GAG | chr3 | 120679356 | 120679375 | 120679372 | + |
| SEQ ID NO 30320 | ATATTTCTAATTAACCTTGA | TGG | chr3 | 120679383 | 120679402 | 120679399 | + |
| SEQ ID NO 30321 | TATTTCTAATTAACCTTGAT | GGG | chr3 | 120679384 | 120679403 | 120679400 | + |
| SEQ ID NO 30322 | AATTAACCTTGATGGGAACA | TAG | chr3 | 120679391 | 120679410 | 120679407 | + |
| SEQ ID NO 30323 | CTTGATGGGAACATAGAACA | TAG | chr3 | 120679398 | 120679417 | 120679414 | + |
| SEQ ID NO 30324 | AACATAGAACATAGATTGTA | AAG | chr3 | 120679407 | 120679426 | 120679423 | + |

Figure 49 (Cont'd)

| | | | | | | | |
|---|---|---|---|---|---|---|---|
| SEQ ID NO 30325 | ACATAGAACATAGATTGTAA | AGG | chr3 | 120679408 | 120679427 | 120679424 | + |
| SEQ ID NO 30326 | CATAGAACATAGATTGTAAA | GGG | chr3 | 120679409 | 120679428 | 120679425 | + |
| SEQ ID NO 30327 | AGGGAACTTGCACATTATCG | CAG | chr3 | 120679428 | 120679447 | 120679444 | + |
| SEQ ID NO 30328 | GAACTTGCACATTATCGCAG | TAG | chr3 | 120679431 | 120679450 | 120679447 | + |
| SEQ ID NO 30329 | AACTTGCACATTATCGCAGT | AGG | chr3 | 120679432 | 120679451 | 120679448 | + |
| SEQ ID NO 30330 | TATCGCAGTAGGCTGAATAA | TGG | chr3 | 120679443 | 120679462 | 120679459 | + |
| SEQ ID NO 30331 | GTAGGCTGAATAATGGCTAA | TGG | chr3 | 120679450 | 120679469 | 120679466 | + |
| SEQ ID NO 30332 | TGGCTAATGGCTCACTCTGA | AAG | chr3 | 120679463 | 120679482 | 120679479 | + |
| SEQ ID NO 30333 | CTCACTCTGAAAGATATGTA | TGG | chr3 | 120679473 | 120679492 | 120679489 | + |
| SEQ ID NO 30334 | GCTTAACCCCTGAAACCTGT | GAG | chr3 | 120679495 | 120679514 | 120679511 | + |
| SEQ ID NO 30335 | CCTGTGAGTATTATCTTTTC | TAG | chr3 | 120679510 | 120679529 | 120679526 | + |
| SEQ ID NO 30336 | TATTATCTTTTCTAGCCAAA | CAG | chr3 | 120679518 | 120679537 | 120679534 | + |
| SEQ ID NO 30337 | AGACTTTGCATATATAATT | AAG | chr3 | 120679539 | 120679558 | 120679555 | + |
| SEQ ID NO 30338 | GACTTTTGCATATATAATTA | AGG | chr3 | 120679540 | 120679559 | 120679556 | + |
| SEQ ID NO 30339 | GCATATATAATTAAGGATCT | TGG | chr3 | 120679547 | 120679566 | 120679563 | + |
| SEQ ID NO 30340 | CATATATAATTAAGGATCTT | GGG | chr3 | 120679548 | 120679567 | 120679564 | + |
| SEQ ID NO 30341 | TATAATTAAGGATCTTGGGA | TGG | chr3 | 120679552 | 120679571 | 120679568 | + |
| SEQ ID NO 30342 | ATAATTAAGGATCTTGGGAT | GGG | chr3 | 120679553 | 120679572 | 120679569 | + |
| SEQ ID NO 30343 | TAATTAAGGATCTTGGGATG | GGG | chr3 | 120679554 | 120679573 | 120679570 | + |
| SEQ ID NO 30344 | ATTAAGGATCTTGGGATGGG | GAG | chr3 | 120679556 | 120679575 | 120679572 | + |
| SEQ ID NO 30345 | GGGGAGATATCCTAATTATT | TGG | chr3 | 120679573 | 120679592 | 120679589 | + |
| SEQ ID NO 30346 | GGGAGATATCCTAATTATTT | GGG | chr3 | 120679574 | 120679593 | 120679590 | + |
| SEQ ID NO 30347 | TGTATCCTAAATGTAATCAC | AAG | chr3 | 120679597 | 120679616 | 120679613 | + |
| SEQ ID NO 30348 | GTAATCACAAGTGTCATTAT | AAG | chr3 | 120679609 | 120679628 | 120679625 | + |
| SEQ ID NO 30349 | AATCACAAGTGTCATTATAA | GAG | chr3 | 120679611 | 120679630 | 120679627 | + |
| SEQ ID NO 30350 | ATCACAAGTGTCATTATAAG | AGG | chr3 | 120679612 | 120679631 | 120679628 | + |
| SEQ ID NO 30351 | TCACAAGTGTCATTATAAGA | GGG | chr3 | 120679613 | 120679632 | 120679629 | + |
| SEQ ID NO 30352 | ACAAGTGTCATTATAAGAGG | GAG | chr3 | 120679615 | 120679634 | 120679631 | + |
| SEQ ID NO 30353 | CAAGTGTCATTATAAGAGGG | AGG | chr3 | 120679616 | 120679635 | 120679632 | + |
| SEQ ID NO 30354 | GTCATTATAAGAGGGAGGCA | AAG | chr3 | 120679621 | 120679640 | 120679637 | + |
| SEQ ID NO 30355 | TCATTATAAGAGGGAGGCAA | AGG | chr3 | 120679622 | 120679641 | 120679638 | + |
| SEQ ID NO 30356 | CATTATAAGAGGGAGGCAAA | GGG | chr3 | 120679623 | 120679642 | 120679639 | + |
| SEQ ID NO 30357 | TTATAAGAGGGAGGCAAAGG | GAG | chr3 | 120679625 | 120679644 | 120679641 | + |
| SEQ ID NO 30358 | CAAAGGGAGATTTGACTTAT | AAG | chr3 | 120679639 | 120679658 | 120679655 | + |
| SEQ ID NO 30359 | AAGGGAGATTTGACTTATAA | GAG | chr3 | 120679641 | 120679660 | 120679657 | + |
| SEQ ID NO 30360 | AGGGAGATTTGACTTATAAG | AGG | chr3 | 120679642 | 120679661 | 120679658 | + |
| SEQ ID NO 30361 | GGAGATTTGACTTATAAGAG | GAG | chr3 | 120679644 | 120679663 | 120679660 | + |
| SEQ ID NO 30362 | AAAATGTGACGTGATTACAA | AAG | chr3 | 120679667 | 120679686 | 120679683 | + |
| SEQ ID NO 30363 | ATGTGACGTGATTACAAAAG | CAG | chr3 | 120679670 | 120679689 | 120679686 | + |
| SEQ ID NO 30364 | GTGACGTGATTACAAAAGCA | GAG | chr3 | 120679672 | 120679691 | 120679688 | + |
| SEQ ID NO 30365 | AGCAGAGATACATTTTTTTG | AAG | chr3 | 120679688 | 120679707 | 120679704 | + |
| SEQ ID NO 30366 | GATACATTTTTTGAAGATC | GAG | chr3 | 120679694 | 120679713 | 120679710 | + |
| SEQ ID NO 30367 | ATACATTTTTTGAAGATCG | AGG | chr3 | 120679695 | 120679714 | 120679711 | + |
| SEQ ID NO 30368 | CATTTTTTGAAGATCGAGG | AAG | chr3 | 120679698 | 120679717 | 120679714 | + |
| SEQ ID NO 30369 | TTTTTTTGAAGATCGAGGAA | GAG | chr3 | 120679700 | 120679719 | 120679716 | + |
| SEQ ID NO 30370 | TTTTTTGAAGATCGAGGAAG | AGG | chr3 | 120679701 | 120679720 | 120679717 | + |
| SEQ ID NO 30371 | CGAGGAAGAGGCTACAAACC | AAG | chr3 | 120679713 | 120679732 | 120679729 | + |

Figure 49 (Cont'd)

| SEQ ID NO 30372 | GAGGAAGAGGCTACAAACCA | AGG | chr3 | 120679714 | 120679733 | 120679730 | + |
| SEQ ID NO 30373 | AGGCTACAAACCAAGGAATG | TGG | chr3 | 120679721 | 120679740 | 120679737 | + |
| SEQ ID NO 30374 | GGCTACAAACCAAGGAATGT | GGG | chr3 | 120679722 | 120679741 | 120679738 | + |
| SEQ ID NO 30375 | TACAAACCAAGGAATGTGGG | TAG | chr3 | 120679725 | 120679744 | 120679741 | + |
| SEQ ID NO 30376 | CAAGGAATGTGGGTAGCCTC | TAG | chr3 | 120679732 | 120679751 | 120679748 | + |
| SEQ ID NO 30377 | GGAATGTGGGTAGCCTCTAG | AAG | chr3 | 120679735 | 120679754 | 120679751 | + |
| SEQ ID NO 30378 | AATGTGGGTAGCCTCTAGAA | GAG | chr3 | 120679737 | 120679756 | 120679753 | + |
| SEQ ID NO 30379 | ATGTGGGTAGCCTCTAGAAG | AGG | chr3 | 120679738 | 120679757 | 120679754 | + |
| SEQ ID NO 30380 | GTAGCCTCTAGAAGAGGAAA | CAG | chr3 | 120679744 | 120679763 | 120679760 | + |
| SEQ ID NO 30381 | AGAAGAGGAAACAGAATCCA | TGG | chr3 | 120679753 | 120679772 | 120679769 | + |
| SEQ ID NO 30382 | AGGAAACAGAATCCATGGAA | AAG | chr3 | 120679758 | 120679777 | 120679774 | + |
| SEQ ID NO 30383 | GGAAACAGAATCCATGGAAA | AGG | chr3 | 120679759 | 120679778 | 120679775 | + |
| SEQ ID NO 30384 | AACAGAATCCATGGAAAGG | CAG | chr3 | 120679762 | 120679781 | 120679778 | + |
| SEQ ID NO 30385 | ACAGAATCCATGGAAAGGC | AGG | chr3 | 120679763 | 120679782 | 120679779 | + |
| SEQ ID NO 30386 | CAGGAAAACACAATCTCTCA | TAG | chr3 | 120679782 | 120679801 | 120679798 | + |
| SEQ ID NO 30387 | GGAAAACACAATCTCTCATA | GAG | chr3 | 120679784 | 120679803 | 120679800 | + |
| SEQ ID NO 30388 | ACAATCTCTCATAGAGTCTC | CAG | chr3 | 120679791 | 120679810 | 120679807 | + |
| SEQ ID NO 30389 | ATCTCTCATAGAGTCTCCAG | AAG | chr3 | 120679794 | 120679813 | 120679810 | + |
| SEQ ID NO 30390 | CATAGAGTCTCCAGAAGAAA | CAG | chr3 | 120679800 | 120679819 | 120679816 | + |
| SEQ ID NO 30391 | CCACACTGACACCTCGACTT | TAG | chr3 | 120679823 | 120679842 | 120679839 | + |
| SEQ ID NO 30392 | CTGACACCTCGACTTTAGCC | CAG | chr3 | 120679828 | 120679847 | 120679844 | + |
| SEQ ID NO 30393 | TAGCCCAGTGAAACCGATTT | CAG | chr3 | 120679843 | 120679862 | 120679859 | + |
| SEQ ID NO 30394 | CTTCTGACCTCCACAACTTC | AAG | chr3 | 120679867 | 120679886 | 120679883 | + |
| SEQ ID NO 30395 | TAATACATTTGTGTTGTTTT | AAG | chr3 | 120679891 | 120679910 | 120679907 | + |
| SEQ ID NO 30396 | GTTTTAAGCCAATAAATTTG | TGG | chr3 | 120679906 | 120679925 | 120679922 | + |
| SEQ ID NO 30397 | AAATTTGTGGTAATTTTTTA | CAG | chr3 | 120679919 | 120679938 | 120679935 | + |
| SEQ ID NO 30398 | TTTGTGGTAATTTTTTACAG | CAG | chr3 | 120679922 | 120679941 | 120679938 | + |
| SEQ ID NO 30399 | TGGTAATTTTTTACAGCAGC | AAG | chr3 | 120679926 | 120679945 | 120679942 | + |
| SEQ ID NO 30400 | GTAATTTTTTACAGCAGCAA | GAG | chr3 | 120679928 | 120679947 | 120679944 | + |
| SEQ ID NO 30401 | TAATTTTTTACAGCAGCAAG | AGG | chr3 | 120679929 | 120679948 | 120679945 | + |
| SEQ ID NO 30402 | TTACAGCAGCAAGAGGAAAT | CAG | chr3 | 120679936 | 120679955 | 120679952 | + |
| SEQ ID NO 30403 | GCAAGAGGAAATCAGTTACG | TAG | chr3 | 120679944 | 120679963 | 120679960 | + |
| SEQ ID NO 30404 | AGGAAATCAGTTACGTAGAA | TAG | chr3 | 120679949 | 120679968 | 120679965 | + |
| SEQ ID NO 30405 | AAATCAGTTACGTAGAATAG | TAG | chr3 | 120679952 | 120679971 | 120679968 | + |
| SEQ ID NO 30406 | AATCAGTTACGTAGAATAGT | AGG | chr3 | 120679953 | 120679972 | 120679969 | + |
| SEQ ID NO 30407 | AGAATAGTAGGTCCTGTCTC | TGG | chr3 | 120679965 | 120679984 | 120679981 | + |
| SEQ ID NO 30408 | TCCTGTCTCTGGCTAATCAT | TAG | chr3 | 120679976 | 120679995 | 120679992 | + |
| SEQ ID NO 30409 | GCTAATCATTAGAATCACTC | CAG | chr3 | 120679987 | 120680006 | 120680003 | + |
| SEQ ID NO 30410 | AATCATTAGAATCACTCCAG | AAG | chr3 | 120679990 | 120680009 | 120680006 | + |
| SEQ ID NO 30411 | CTCCAGAAGCTTGTTACATA | CAG | chr3 | 120680004 | 120680023 | 120680020 | + |
| SEQ ID NO 30412 | AAGCTTGTTACATACAGACC | CAG | chr3 | 120680010 | 120680029 | 120680026 | + |
| SEQ ID NO 30413 | GCTTGTTACATACAGACCCA | GAG | chr3 | 120680012 | 120680031 | 120680028 | + |
| SEQ ID NO 30414 | GTTACATACAGACCCAGAGC | CAG | chr3 | 120680016 | 120680035 | 120680032 | + |
| SEQ ID NO 30415 | AGACCCAGAGCCAGTGAATC | AAG | chr3 | 120680025 | 120680044 | 120680041 | + |
| SEQ ID NO 30416 | GACCCAGAGCCAGTGAATCA | AGG | chr3 | 120680026 | 120680045 | 120680042 | + |
| SEQ ID NO 30417 | GAGCCAGTGAATCAAGGATT | TGG | chr3 | 120680032 | 120680051 | 120680048 | + |
| SEQ ID NO 30418 | CCAGTGAATCAAGGATTTGG | TGG | chr3 | 120680035 | 120680054 | 120680051 | + |

Figure 49 (Cont'd)

| | | | | | | | |
|---|---|---|---|---|---|---|---|
| SEQ ID NO 30419 | GTGAATCAAGGATTTGGTGG | TGG | chr3 | 120680038 | 120680057 | 120680054 | + |
| SEQ ID NO 30420 | TGAATCAAGGATTTGGTGGT | GGG | chr3 | 120680039 | 120680058 | 120680055 | + |
| SEQ ID NO 30421 | GAATCAAGGATTTGGTGGTG | GGG | chr3 | 120680040 | 120680059 | 120680056 | + |
| SEQ ID NO 30422 | AAGGATTTGGTGGTGGGGCC | CAG | chr3 | 120680045 | 120680064 | 120680061 | + |
| SEQ ID NO 30423 | GGATTTGGTGGTGGGGCCCA | GAG | chr3 | 120680047 | 120680066 | 120680063 | + |
| SEQ ID NO 30424 | GGGCCCAGAGCCTGAATATT | AAG | chr3 | 120680060 | 120680079 | 120680076 | + |
| SEQ ID NO 30425 | CCAGAGCCTGAATATTAAGC | AAG | chr3 | 120680064 | 120680083 | 120680080 | + |
| SEQ ID NO 30426 | ATTAAGCAAGTTCTTCGTTT | TAG | chr3 | 120680077 | 120680096 | 120680093 | + |
| SEQ ID NO 30427 | AAGTTCTTCGTTTTAGAAAT | GAG | chr3 | 120680084 | 120680103 | 120680100 | + |
| SEQ ID NO 30428 | AGTTCTTCGTTTTAGAAATG | AGG | chr3 | 120680085 | 120680104 | 120680101 | + |
| SEQ ID NO 30429 | GTTTTAGAAATGAGGAAACC | AAG | chr3 | 120680093 | 120680112 | 120680109 | + |
| SEQ ID NO 30430 | TTTTAGAAATGAGGAAACCA | AGG | chr3 | 120680094 | 120680113 | 120680110 | + |
| SEQ ID NO 30431 | AGAAATGAGGAAACCAAGGT | TGG | chr3 | 120680098 | 120680117 | 120680114 | + |
| SEQ ID NO 30432 | GAAATGAGGAAACCAAGGTT | GGG | chr3 | 120680099 | 120680118 | 120680115 | + |
| SEQ ID NO 30433 | AATGAGGAAACCAAGGTTGG | GAG | chr3 | 120680101 | 120680120 | 120680117 | + |
| SEQ ID NO 30434 | GAGGAAACCAAGGTTGGGAG | AAG | chr3 | 120680104 | 120680123 | 120680120 | + |
| SEQ ID NO 30435 | AACCAAGGTTGGGAGAAGCT | AAG | chr3 | 120680109 | 120680128 | 120680125 | + |
| SEQ ID NO 30436 | AAGCAACTTACTCAAATACA | TAG | chr3 | 120680129 | 120680148 | 120680145 | + |
| SEQ ID NO 30437 | AGCAACTTACTCAAATACAT | AGG | chr3 | 120680130 | 120680149 | 120680146 | + |
| SEQ ID NO 30438 | GCAACTTACTCAAATACATA | GGG | chr3 | 120680131 | 120680150 | 120680147 | + |
| SEQ ID NO 30439 | TCTTTTGAATTTTCTTACCC | CAG | chr3 | 120680186 | 120680205 | 120680202 | + |
| SEQ ID NO 30440 | TGTAAATGTGATTTCATTTA | CGG | chr3 | 120680220 | 120680239 | 120680236 | + |
| SEQ ID NO 30441 | TTGACATATTCATTAAAATG | AAG | chr3 | 120680250 | 120680269 | 120680266 | + |
| SEQ ID NO 30442 | TCATTAAAATGAAGAAATAA | AAG | chr3 | 120680259 | 120680278 | 120680275 | + |
| SEQ ID NO 30443 | AAAATGAAGAAATAAAAGAT | GAG | chr3 | 120680264 | 120680283 | 120680280 | + |
| SEQ ID NO 30444 | AAGAAATAAAAGATGAGAAA | CAG | chr3 | 120680270 | 120680289 | 120680286 | + |
| SEQ ID NO 30445 | ATTATATAATGTTTATTGAT | TAG | chr3 | 120680301 | 120680320 | 120680317 | + |
| SEQ ID NO 30446 | AGAATGAATATGATGCAATC | TGG | chr3 | 120680322 | 120680341 | 120680338 | + |
| SEQ ID NO 30447 | GCAATCTGGTTTTCTGTGTT | CAG | chr3 | 120680336 | 120680355 | 120680352 | + |
| SEQ ID NO 30448 | GTGTTCAGATTCCTGACCTC | TGG | chr3 | 120680351 | 120680370 | 120680367 | + |
| SEQ ID NO 30449 | GTTCAGATTCCTGACCTCTG | GAG | chr3 | 120680353 | 120680372 | 120680369 | + |
| SEQ ID NO 30450 | GGAGTTAACCTTTCTTTGTA | AAG | chr3 | 120680372 | 120680391 | 120680388 | + |
| SEQ ID NO 30451 | TAACCTTTCTTTGTAAAGAT | TAG | chr3 | 120680377 | 120680396 | 120680393 | + |
| SEQ ID NO 30452 | CTTTCTTTGTAAAGATTAGA | CAG | chr3 | 120680381 | 120680400 | 120680397 | + |
| SEQ ID NO 30453 | TCTTTGTAAAGATTAGACAG | CAG | chr3 | 120680384 | 120680403 | 120680400 | + |
| SEQ ID NO 30454 | CTTTGTAAAGATTAGACAGC | AGG | chr3 | 120680385 | 120680404 | 120680401 | + |
| SEQ ID NO 30455 | TGTAAAGATTAGACAGCAGG | CAG | chr3 | 120680388 | 120680407 | 120680404 | + |
| SEQ ID NO 30456 | GTAAAGATTAGACAGCAGGC | AGG | chr3 | 120680389 | 120680408 | 120680405 | + |
| SEQ ID NO 30457 | TAAAGATTAGACAGCAGGCA | GGG | chr3 | 120680390 | 120680409 | 120680406 | + |
| SEQ ID NO 30458 | AGATTAGACAGCAGGCAGGG | AAG | chr3 | 120680393 | 120680412 | 120680409 | + |
| SEQ ID NO 30459 | GGAAGAATGCCTTTGAAACT | GAG | chr3 | 120680411 | 120680430 | 120680427 | + |
| SEQ ID NO 30460 | AAGAATGCCTTTGAAACTGA | GAG | chr3 | 120680413 | 120680432 | 120680429 | + |
| SEQ ID NO 30461 | TGCCTTTGAAACTGAGAGCA | AAG | chr3 | 120680418 | 120680437 | 120680434 | + |
| SEQ ID NO 30462 | TTGAAACTGAGAGCAAAGAC | TGG | chr3 | 120680423 | 120680442 | 120680439 | + |
| SEQ ID NO 30463 | TGCAATTTACATTGATGTCC | TGG | chr3 | 120680448 | 120680467 | 120680464 | + |
| SEQ ID NO 30464 | GTCCTGGTGCTGTGCATAAT | AAG | chr3 | 120680464 | 120680483 | 120680480 | + |
| SEQ ID NO 30465 | AATAAGTTGCTTAAACATGA | CAG | chr3 | 120680481 | 120680500 | 120680497 | + |

Figure 49 (Cont'd)

| SEQ ID NO 30466 | AAGTTGCTTAAACATGACAG | CAG | chr3 | 120680484 | 120680503 | 120680500 | + |
| SEQ ID NO 30467 | AGTTGCTTAAACATGACAGC | AGG | chr3 | 120680485 | 120680504 | 120680501 | + |
| SEQ ID NO 30468 | GCTTAAACATGACAGCAGGA | TAG | chr3 | 120680489 | 120680508 | 120680505 | + |
| SEQ ID NO 30469 | CTTAAACATGACAGCAGGAT | AGG | chr3 | 120680490 | 120680509 | 120680506 | + |
| SEQ ID NO 30470 | ACATAAAATTTATTTATAAA | TGG | chr3 | 120680518 | 120680537 | 120680534 | + |
| SEQ ID NO 30471 | AAATTTATTTATAAATGGTA | AAG | chr3 | 120680523 | 120680542 | 120680539 | + |
| SEQ ID NO 30472 | ACCTCTGCTGAACTTCCTCA | TAG | chr3 | 120680555 | 120680574 | 120680571 | + |
| SEQ ID NO 30473 | CTTCCTCATAGAATGTTCAT | CAG | chr3 | 120680567 | 120680586 | 120680583 | + |
| SEQ ID NO 30474 | AGAATGTTCATCAGAAAACA | AAG | chr3 | 120680576 | 120680595 | 120680592 | + |
| SEQ ID NO 30475 | TTCTATCTACTCTTTCTTCC | AAG | chr3 | 120680600 | 120680619 | 120680616 | + |
| SEQ ID NO 30476 | ACCACTGACATCATGACCCT | CAG | chr3 | 120680635 | 120680654 | 120680651 | + |
| SEQ ID NO 30477 | GACCCTCAGTTCTATTCCCC | TAG | chr3 | 120680649 | 120680668 | 120680665 | + |
| SEQ ID NO 30478 | CTGCCCACTCCCCTGAAATC | CAG | chr3 | 120680674 | 120680693 | 120680690 | + |
| SEQ ID NO 30479 | CCATAAATCCAACCACCGCC | TGG | chr3 | 120680699 | 120680718 | 120680715 | + |
| SEQ ID NO 30480 | CATAAATCCAACCACCGCCT | GGG | chr3 | 120680700 | 120680719 | 120680716 | + |
| SEQ ID NO 30481 | CAACCACCGCCTGGGTATCT | CAG | chr3 | 120680708 | 120680727 | 120680724 | + |
| SEQ ID NO 30482 | ACCGCCTGGGTATCTCAGTT | TGG | chr3 | 120680713 | 120680732 | 120680729 | + |
| SEQ ID NO 30483 | TCCCTCCATCAACTCAAATT | TGG | chr3 | 120680739 | 120680758 | 120680755 | + |
| SEQ ID NO 30484 | CAACTCAAATTTGGCTGACA | CAG | chr3 | 120680748 | 120680767 | 120680764 | + |
| SEQ ID NO 30485 | AAATTTGGCTGACACAGTTT | TGG | chr3 | 120680754 | 120680773 | 120680770 | + |
| SEQ ID NO 30486 | GCTGACACAGTTTTGGATTC | TAG | chr3 | 120680761 | 120680780 | 120680777 | + |
| SEQ ID NO 30487 | TGACACAGTTTTGGATTCTA | GAG | chr3 | 120680763 | 120680782 | 120680779 | + |
| SEQ ID NO 30488 | GTTTTGGATTCTAGAGCATG | CAG | chr3 | 120680770 | 120680789 | 120680786 | + |
| SEQ ID NO 30489 | TTTTGGATTCTAGAGCATGC | AGG | chr3 | 120680771 | 120680790 | 120680787 | + |
| SEQ ID NO 30490 | TTTGCACTCACTCTTCCCTC | CAG | chr3 | 120680814 | 120680833 | 120680830 | + |
| SEQ ID NO 30491 | CCCGTCCTTCCTCACTTTGC | CAG | chr3 | 120680839 | 120680858 | 120680855 | + |
| SEQ ID NO 30492 | CCAGTTCCAACTTCTCTCTG | AAG | chr3 | 120680858 | 120680877 | 120680874 | + |
| SEQ ID NO 30493 | CCAACTTCTCTCTGAAGACT | CAG | chr3 | 120680864 | 120680883 | 120680880 | + |
| SEQ ID NO 30494 | TTCTCTCTGAAGACTCAGTT | TAG | chr3 | 120680869 | 120680888 | 120680885 | + |
| SEQ ID NO 30495 | TCTCTCTGAAGACTCAGTTT | AGG | chr3 | 120680870 | 120680889 | 120680886 | + |
| SEQ ID NO 30496 | CTGAAGACTCAGTTTAGGTA | CAG | chr3 | 120680875 | 120680894 | 120680891 | + |
| SEQ ID NO 30497 | TGAAGACTCAGTTTAGGTAC | AGG | chr3 | 120680876 | 120680895 | 120680892 | + |
| SEQ ID NO 30498 | AGTTTAGGTACAGGCTCCTT | TAG | chr3 | 120680885 | 120680904 | 120680901 | + |
| SEQ ID NO 30499 | GTTTAGGTACAGGCTCCTTT | AGG | chr3 | 120680886 | 120680905 | 120680902 | + |
| SEQ ID NO 30500 | AATTTTTTTTGACTCTACC | TAG | chr3 | 120680910 | 120680929 | 120680926 | + |
| SEQ ID NO 30501 | TTTTTTGACTCTACCTAGCC | CAG | chr3 | 120680915 | 120680934 | 120680931 | + |
| SEQ ID NO 30502 | GACTCTACCTAGCCCAGACT | CAG | chr3 | 120680921 | 120680940 | 120680937 | + |
| SEQ ID NO 30503 | TCATCTACGATATTAATCTG | CAG | chr3 | 120680945 | 120680964 | 120680961 | + |
| SEQ ID NO 30504 | TAATCTGCAGTGTCATGCAC | TAG | chr3 | 120680958 | 120680977 | 120680974 | + |
| SEQ ID NO 30505 | ACAAAATATTTGCTGAATGA | AAG | chr3 | 120680982 | 120681001 | 120680998 | + |
| SEQ ID NO 30506 | TATTTGCTGAATGAAAGAAT | GAG | chr3 | 120680988 | 120681007 | 120681004 | + |
| SEQ ID NO 30507 | TTTGCTGAATGAAAGAATGA | GAG | chr3 | 120680990 | 120681009 | 120681006 | + |
| SEQ ID NO 30508 | AAAGAATGAGAGTTAACTTT | TAG | chr3 | 120681001 | 120681020 | 120681017 | + |
| SEQ ID NO 30509 | AATGAGAGTTAACTTTTAGT | CAG | chr3 | 120681005 | 120681024 | 120681021 | + |
| SEQ ID NO 30510 | ATGAGAGTTAACTTTTAGTC | AGG | chr3 | 120681006 | 120681025 | 120681022 | + |
| SEQ ID NO 30511 | TTAACTTTTAGTCAGGCATA | AAG | chr3 | 120681013 | 120681032 | 120681029 | + |
| SEQ ID NO 30512 | GGCATAAAGATAAAAAACCA | AAG | chr3 | 120681027 | 120681046 | 120681043 | + |

Figure 49 (Cont'd)

| SEQ ID NO 30513 | AAAACCAAAGTCTTTTACTC | CGG | chr3 | 120681040 | 120681059 | 120681056 | + |
| SEQ ID NO 30514 | CAAAGTCTTTTACTCCGGTG | TGG | chr3 | 120681045 | 120681064 | 120681061 | + |
| SEQ ID NO 30515 | AAGTCTTTTACTCCGGTGTG | GAG | chr3 | 120681047 | 120681066 | 120681063 | + |
| SEQ ID NO 30516 | ACTCCGGTGTGGAGTGTTTT | CAG | chr3 | 120681056 | 120681075 | 120681072 | + |
| SEQ ID NO 30517 | CTCCGGTGTGGAGTGTTTTC | AGG | chr3 | 120681057 | 120681076 | 120681073 | + |
| SEQ ID NO 30518 | TTTTCAGGATTCCTACCAAT | TAG | chr3 | 120681072 | 120681091 | 120681088 | + |
| SEQ ID NO 30519 | TTTCAGGATTCCTACCAATT | AGG | chr3 | 120681073 | 120681092 | 120681089 | + |
| SEQ ID NO 30520 | CAGGATTCCTACCAATTAGG | AAG | chr3 | 120681076 | 120681095 | 120681092 | + |
| SEQ ID NO 30521 | AGGATTCCTACCAATTAGGA | AGG | chr3 | 120681077 | 120681096 | 120681093 | + |
| SEQ ID NO 30522 | GGTGTTTGATTCTTCAAACT | CAG | chr3 | 120681098 | 120681117 | 120681114 | + |
| SEQ ID NO 30523 | AAACACCTCCCCTTAACTGA | TGG | chr3 | 120681121 | 120681140 | 120681137 | + |
| SEQ ID NO 30524 | ACTGATGGATTCTTCAAACT | CAG | chr3 | 120681136 | 120681155 | 120681152 | + |
| SEQ ID NO 30525 | GGATTCTTCAAACTCAGCAT | CAG | chr3 | 120681142 | 120681161 | 120681158 | + |
| SEQ ID NO 30526 | TCTTCAAACTCAGCATCAGT | TAG | chr3 | 120681146 | 120681165 | 120681162 | + |
| SEQ ID NO 30527 | TTCAAACTCAGCATCAGTTA | GAG | chr3 | 120681148 | 120681167 | 120681164 | + |
| SEQ ID NO 30528 | TCAAACTCAGCATCAGTTAG | AGG | chr3 | 120681149 | 120681168 | 120681165 | + |
| SEQ ID NO 30529 | CAAACTCAGCATCAGTTAGA | GGG | chr3 | 120681150 | 120681169 | 120681166 | + |
| SEQ ID NO 30530 | CAGCATCAGTTAGAGGGCAT | TAG | chr3 | 120681156 | 120681175 | 120681172 | + |
| SEQ ID NO 30531 | AGCATCAGTTAGAGGGCATT | AGG | chr3 | 120681157 | 120681176 | 120681173 | + |
| SEQ ID NO 30532 | GCATCAGTTAGAGGGCATTA | GGG | chr3 | 120681158 | 120681177 | 120681174 | + |
| SEQ ID NO 30533 | CACTTCTCAAACCCTGCATT | CAG | chr3 | 120681181 | 120681200 | 120681197 | + |
| SEQ ID NO 30534 | ACTTCTCAAACCCTGCATTC | AGG | chr3 | 120681182 | 120681201 | 120681198 | + |
| SEQ ID NO 30535 | CTTCTCAAACCCTGCATTCA | GGG | chr3 | 120681183 | 120681202 | 120681199 | + |
| SEQ ID NO 30536 | CTCAAACCCTGCATTCAGGG | AAG | chr3 | 120681186 | 120681205 | 120681202 | + |
| SEQ ID NO 30537 | TTCAGGGAAGATGTCTGTTG | TGG | chr3 | 120681199 | 120681218 | 120681215 | + |
| SEQ ID NO 30538 | TCAGGGAAGATGTCTGTTGT | GGG | chr3 | 120681200 | 120681219 | 120681216 | + |
| SEQ ID NO 30539 | CAGGGAAGATGTCTGTTGTG | GGG | chr3 | 120681201 | 120681220 | 120681217 | + |
| SEQ ID NO 30540 | GGAAGATGTCTGTTGTGGGG | TGG | chr3 | 120681204 | 120681223 | 120681220 | + |
| SEQ ID NO 30541 | ATGTCTGTTGTGGGGTGGTC | TGG | chr3 | 120681209 | 120681228 | 120681225 | + |
| SEQ ID NO 30542 | GTGGGGTGGTCTGGCCTACT | TGG | chr3 | 120681218 | 120681237 | 120681234 | + |
| SEQ ID NO 30543 | TGGTCTGGCCTACTTGGCCT | GAG | chr3 | 120681224 | 120681243 | 120681240 | + |
| SEQ ID NO 30544 | TGGCCTACTTGGCCTGAGCC | AAG | chr3 | 120681229 | 120681248 | 120681245 | + |
| SEQ ID NO 30545 | GGCCTACTTGGCCTGAGCCA | AGG | chr3 | 120681230 | 120681249 | 120681246 | + |
| SEQ ID NO 30546 | CTTGGCCTGAGCCAAGGTTC | TGG | chr3 | 120681236 | 120681255 | 120681252 | + |
| SEQ ID NO 30547 | TTGGCCTGAGCCAAGGTTCT | GGG | chr3 | 120681237 | 120681256 | 120681253 | + |
| SEQ ID NO 30548 | GCCTGAGCCAAGGTTCTGGG | CAG | chr3 | 120681240 | 120681259 | 120681256 | + |
| SEQ ID NO 30549 | AGGTTCTGGGCAGTTCTGTT | CAG | chr3 | 120681250 | 120681269 | 120681266 | + |
| SEQ ID NO 30550 | CAGTTACACATGCATGCGTT | GAG | chr3 | 120681270 | 120681289 | 120681286 | + |
| SEQ ID NO 30551 | CATGCGTTGAGCATTGATTC | AAG | chr3 | 120681282 | 120681301 | 120681298 | + |
| SEQ ID NO 30552 | GTTGAGCATTGATTCAAGCC | TGG | chr3 | 120681287 | 120681306 | 120681303 | + |
| SEQ ID NO 30553 | GCATTGATTCAAGCCTGGCC | TGG | chr3 | 120681292 | 120681311 | 120681308 | + |
| SEQ ID NO 30554 | CATTGATTCAAGCCTGGCCT | GGG | chr3 | 120681293 | 120681312 | 120681309 | + |
| SEQ ID NO 30555 | TTCAAGCCTGGCCTGGGCAC | TAG | chr3 | 120681299 | 120681318 | 120681315 | + |
| SEQ ID NO 30556 | TCAAGCCTGGCCTGGGCACT | AGG | chr3 | 120681300 | 120681319 | 120681316 | + |
| SEQ ID NO 30557 | CCTGGCCTGGGCACTAGGCA | TGG | chr3 | 120681305 | 120681324 | 120681321 | + |
| SEQ ID NO 30558 | CTGGGCACTAGGCATGGTTT | TAG | chr3 | 120681311 | 120681330 | 120681327 | + |
| SEQ ID NO 30559 | CTAGGCATGGTTTTAGATAT | TAG | chr3 | 120681318 | 120681337 | 120681334 | + |

Figure 49 (Cont'd)

| | | | | | | | |
|---|---|---|---|---|---|---|---|
| SEQ ID NO 30560 | TAGGCATGGTTTTAGATATT | AGG | chr3 | 120681319 | 120681338 | 120681335 | + |
| SEQ ID NO 30561 | AGGCATGGTTTTAGATATTA | GGG | chr3 | 120681320 | 120681339 | 120681336 | + |
| SEQ ID NO 30562 | TATTCTGTTTTCCTTGCCTT | AAG | chr3 | 120681346 | 120681365 | 120681362 | + |
| SEQ ID NO 30563 | TTTTCCTTGCCTTAAGATAC | CAG | chr3 | 120681353 | 120681372 | 120681369 | + |
| SEQ ID NO 30564 | CTTGCCTTAAGATACCAGTC | TAG | chr3 | 120681358 | 120681377 | 120681374 | + |
| SEQ ID NO 30565 | GCCTTAAGATACCAGTCTAG | TAG | chr3 | 120681361 | 120681380 | 120681377 | + |
| SEQ ID NO 30566 | CCTTAAGATACCAGTCTAGT | AGG | chr3 | 120681362 | 120681381 | 120681378 | + |
| SEQ ID NO 30567 | TTAAGATACCAGTCTAGTAG | GAG | chr3 | 120681364 | 120681383 | 120681380 | + |
| SEQ ID NO 30568 | CCAGTCTAGTAGGAGCCACT | AAG | chr3 | 120681372 | 120681391 | 120681388 | + |
| SEQ ID NO 30569 | CAGTCTAGTAGGAGCCACTA | AGG | chr3 | 120681373 | 120681392 | 120681389 | + |
| SEQ ID NO 30570 | AGCCACTAAGGCCCCTTTTT | GAG | chr3 | 120681385 | 120681404 | 120681401 | + |
| SEQ ID NO 30571 | CTAAGGCCCCTTTTTGAGCC | TGG | chr3 | 120681390 | 120681409 | 120681406 | + |
| SEQ ID NO 30572 | AACATACCCTGCTTCTAATC | AAG | chr3 | 120681425 | 120681444 | 120681441 | + |
| SEQ ID NO 30573 | CTTCTAATCAAGTCATCTAT | TGG | chr3 | 120681436 | 120681455 | 120681452 | + |
| SEQ ID NO 30574 | CTAATCAAGTCATCTATTGG | CAG | chr3 | 120681439 | 120681458 | 120681455 | + |
| SEQ ID NO 30575 | TCATCTATTGGCAGTGACCT | TGG | chr3 | 120681448 | 120681467 | 120681464 | + |
| SEQ ID NO 30576 | CATCTATTGGCAGTGACCTT | GGG | chr3 | 120681449 | 120681468 | 120681465 | + |
| SEQ ID NO 30577 | CAGTGACCTTGGGCAAATCA | TAG | chr3 | 120681459 | 120681478 | 120681475 | + |
| SEQ ID NO 30578 | GGGCAAATCATAGTCTCTCC | AAG | chr3 | 120681469 | 120681488 | 120681485 | + |
| SEQ ID NO 30579 | ATTACTTTCTAATTGAAAC | AAG | chr3 | 120681493 | 120681512 | 120681509 | + |
| SEQ ID NO 30580 | AAGAACCTCTCTATACCC | CAG | chr3 | 120681513 | 120681532 | 120681529 | + |
| SEQ ID NO 30581 | CTATACCCCAGATTTATTTT | GAG | chr3 | 120681525 | 120681544 | 120681541 | + |
| SEQ ID NO 30582 | TATACCCCAGATTTATTTTG | AGG | chr3 | 120681526 | 120681545 | 120681542 | + |
| SEQ ID NO 30583 | AGATTTATTTTGAGGATTAT | GAG | chr3 | 120681534 | 120681553 | 120681550 | + |
| SEQ ID NO 30584 | GAGGATTATGAGTTAATTCA | TAG | chr3 | 120681545 | 120681564 | 120681561 | + |
| SEQ ID NO 30585 | TAATTCATAGCTAAAATGCT | TAG | chr3 | 120681558 | 120681577 | 120681574 | + |
| SEQ ID NO 30586 | CTAAAATGCTTAGCACCTAA | CAG | chr3 | 120681568 | 120681587 | 120681584 | + |
| SEQ ID NO 30587 | TTCAATTGCGTATTACTAAA | AAG | chr3 | 120681611 | 120681630 | 120681627 | + |
| SEQ ID NO 30588 | AATTGCGTATTACTAAAAG | AAG | chr3 | 120681614 | 120681633 | 120681630 | + |
| SEQ ID NO 30589 | ATTGCGTATTACTAAAAGA | AGG | chr3 | 120681615 | 120681634 | 120681631 | + |
| SEQ ID NO 30590 | AAAAGAAGGAATGATTTCC | TAG | chr3 | 120681628 | 120681647 | 120681644 | + |
| SEQ ID NO 30591 | AAAGAAGGAATGATTTCCTA | GAG | chr3 | 120681630 | 120681649 | 120681646 | + |
| SEQ ID NO 30592 | AAGAAGGAATGATTTCCTAG | AGG | chr3 | 120681631 | 120681650 | 120681647 | + |
| SEQ ID NO 30593 | GAAGGAATGATTTCCTAGAG | GAG | chr3 | 120681633 | 120681652 | 120681649 | + |
| SEQ ID NO 30594 | AAGGAATGATTTCCTAGAGG | AGG | chr3 | 120681634 | 120681653 | 120681650 | + |
| SEQ ID NO 30595 | CCTAGAGGAGGTGCTTCTTC | TGG | chr3 | 120681646 | 120681665 | 120681662 | + |
| SEQ ID NO 30596 | AGGAGGTGCTTCTTCTGGCC | AAG | chr3 | 120681651 | 120681670 | 120681667 | + |
| SEQ ID NO 30597 | GGAGGTGCTTCTTCTGGCCA | AGG | chr3 | 120681652 | 120681671 | 120681668 | + |
| SEQ ID NO 30598 | GAGGTGCTTCTTCTGGCCAA | GGG | chr3 | 120681653 | 120681672 | 120681669 | + |
| SEQ ID NO 30599 | CTTCTGGCCAAGGGCTGATT | CAG | chr3 | 120681662 | 120681681 | 120681678 | + |
| SEQ ID NO 30600 | TCTGGCCAAGGGCTGATTCA | GAG | chr3 | 120681664 | 120681683 | 120681680 | + |
| SEQ ID NO 30601 | CAGAGCCTTAATTAACTAAA | TAG | chr3 | 120681682 | 120681701 | 120681698 | + |
| SEQ ID NO 30602 | CTTAATTAACTAAATAGATC | AAG | chr3 | 120681688 | 120681707 | 120681704 | + |
| SEQ ID NO 30603 | ATAGATCAAGCATATCTAAC | TGG | chr3 | 120681701 | 120681720 | 120681717 | + |
| SEQ ID NO 30604 | AAGCATATCTAACTGGTCAC | CGG | chr3 | 120681708 | 120681727 | 120681724 | + |
| SEQ ID NO 30605 | CATATCTAACTGGTCACCGG | AAG | chr3 | 120681711 | 120681730 | 120681727 | + |
| SEQ ID NO 30606 | ATCTAACTGGTCACCGGAAG | TGG | chr3 | 120681714 | 120681733 | 120681730 | + |

Figure 49 (Cont'd)

| | | | | | | | |
|---|---|---|---|---|---|---|---|
| SEQ ID NO 30607 | GGTCACCGGAAGTGGTCCAT | GAG | chr3 | 120681722 | 120681741 | 120681738 | + |
| SEQ ID NO 30608 | GTCACCGGAAGTGGTCCATG | AGG | chr3 | 120681723 | 120681742 | 120681739 | + |
| SEQ ID NO 30609 | GGAAGTGGTCCATGAGGCTG | CAG | chr3 | 120681729 | 120681748 | 120681745 | + |
| SEQ ID NO 30610 | GGTCCATGAGGCTGCAGCAA | TGG | chr3 | 120681735 | 120681754 | 120681751 | + |
| SEQ ID NO 30611 | GTCCATGAGGCTGCAGCAAT | GGG | chr3 | 120681736 | 120681755 | 120681752 | + |
| SEQ ID NO 30612 | CATGAGGCTGCAGCAATGGG | AAG | chr3 | 120681739 | 120681758 | 120681755 | + |
| SEQ ID NO 30613 | ATGAGGCTGCAGCAATGGGA | AGG | chr3 | 120681740 | 120681759 | 120681756 | + |
| SEQ ID NO 30614 | CTGCAGCAATGGGAAGGTGT | CAG | chr3 | 120681746 | 120681765 | 120681762 | + |
| SEQ ID NO 30615 | GCAGCAATGGGAAGGTGTCA | GAG | chr3 | 120681748 | 120681767 | 120681764 | + |
| SEQ ID NO 30616 | GCAATGGGAAGGTGTCAGAG | CAG | chr3 | 120681751 | 120681770 | 120681767 | + |
| SEQ ID NO 30617 | CAATGGGAAGGTGTCAGAGC | AGG | chr3 | 120681752 | 120681771 | 120681768 | + |
| SEQ ID NO 30618 | AATGGGAAGGTGTCAGAGCA | GGG | chr3 | 120681753 | 120681772 | 120681769 | + |
| SEQ ID NO 30619 | ATGGGAAGGTGTCAGAGCAG | GGG | chr3 | 120681754 | 120681773 | 120681770 | + |
| SEQ ID NO 30620 | GAAGGTGTCAGAGCAGGGGT | TGG | chr3 | 120681758 | 120681777 | 120681774 | + |
| SEQ ID NO 30621 | AAGGTGTCAGAGCAGGGGTT | GGG | chr3 | 120681759 | 120681778 | 120681775 | + |
| SEQ ID NO 30622 | TCAGAGCAGGGGTTGGGAAA | AAG | chr3 | 120681765 | 120681784 | 120681781 | + |
| SEQ ID NO 30623 | CAGGGGTTGGGAAAAGACA | TAG | chr3 | 120681771 | 120681790 | 120681787 | + |
| SEQ ID NO 30624 | GGGGTTGGGAAAAGACATA | GAG | chr3 | 120681773 | 120681792 | 120681789 | + |
| SEQ ID NO 30625 | GGTTGGGAAAAGACATAGA | GAG | chr3 | 120681775 | 120681794 | 120681791 | + |
| SEQ ID NO 30626 | GAGAGAAACGTGCATGTCCG | TAG | chr3 | 120681793 | 120681812 | 120681809 | + |
| SEQ ID NO 30627 | AGAAACGTGCATGTCCGTAG | TGG | chr3 | 120681796 | 120681815 | 120681812 | + |
| SEQ ID NO 30628 | AAACGTGCATGTCCGTAGTG | GAG | chr3 | 120681798 | 120681817 | 120681814 | + |
| SEQ ID NO 30629 | AACGTGCATGTCCGTAGTGG | AGG | chr3 | 120681799 | 120681818 | 120681815 | + |
| SEQ ID NO 30630 | ACGTGCATGTCCGTAGTGGA | GGG | chr3 | 120681800 | 120681819 | 120681816 | + |
| SEQ ID NO 30631 | CGTGCATGTCCGTAGTGGAG | GGG | chr3 | 120681801 | 120681820 | 120681817 | + |
| SEQ ID NO 30632 | TGCATGTCCGTAGTGGAGGG | GAG | chr3 | 120681803 | 120681822 | 120681819 | + |
| SEQ ID NO 30633 | CCGTAGTGGAGGGGAGCTCT | TAG | chr3 | 120681810 | 120681829 | 120681826 | + |
| SEQ ID NO 30634 | CGTAGTGGAGGGGAGCTCTT | AGG | chr3 | 120681811 | 120681830 | 120681827 | + |
| SEQ ID NO 30635 | GGGAGCTCTTAGGATGTCTA | CAG | chr3 | 120681821 | 120681840 | 120681837 | + |
| SEQ ID NO 30636 | TAGGATGTCTACAGATTTCC | AAG | chr3 | 120681830 | 120681849 | 120681846 | + |
| SEQ ID NO 30637 | GACAATAATTGAAATGAACA | AAG | chr3 | 120681852 | 120681871 | 120681868 | + |
| SEQ ID NO 30638 | ACAATAATTGAAATGAACAA | AGG | chr3 | 120681853 | 120681872 | 120681869 | + |
| SEQ ID NO 30639 | TAATTGAAATGAACAAAGGC | AAG | chr3 | 120681857 | 120681876 | 120681873 | + |
| SEQ ID NO 30640 | AATTGAAATGAACAAAGGCA | AGG | chr3 | 120681858 | 120681877 | 120681874 | + |
| SEQ ID NO 30641 | ATTGAAATGAACAAAGGCAA | GGG | chr3 | 120681859 | 120681878 | 120681875 | + |
| SEQ ID NO 30642 | AAAGGCAAGGGATGACCAAT | AAG | chr3 | 120681871 | 120681890 | 120681887 | + |
| SEQ ID NO 30643 | AGGCAAGGGATGACCAATAA | GAG | chr3 | 120681873 | 120681892 | 120681889 | + |
| SEQ ID NO 30644 | ATCACCTTTCCCTTGTTCTT | CAG | chr3 | 120681913 | 120681932 | 120681929 | + |
| SEQ ID NO 30645 | TTTCCCTTGTTCTTCAGCTC | CAG | chr3 | 120681919 | 120681938 | 120681935 | + |
| SEQ ID NO 30646 | TTCAGCTCCAGCTGTGCCCA | CAG | chr3 | 120681931 | 120681950 | 120681947 | + |
| SEQ ID NO 30647 | AGCTGTGCCCACAGACACCA | CAG | chr3 | 120681940 | 120681959 | 120681956 | + |
| SEQ ID NO 30648 | GCTGTGCCCACAGACACCAC | AGG | chr3 | 120681941 | 120681960 | 120681957 | + |
| SEQ ID NO 30649 | CTGTGCCCACAGACACCACA | GGG | chr3 | 120681942 | 120681961 | 120681958 | + |
| SEQ ID NO 30650 | TGCCCACAGACACCACAGGG | AAG | chr3 | 120681945 | 120681964 | 120681961 | + |
| SEQ ID NO 30651 | CACAGGGAAGCCTCTGAACA | CAG | chr3 | 120681958 | 120681977 | 120681974 | + |
| SEQ ID NO 30652 | ACAGGGAAGCCTCTGAACAC | AGG | chr3 | 120681959 | 120681978 | 120681975 | + |
| SEQ ID NO 30653 | CAGGGAAGCCTCTGAACACA | GGG | chr3 | 120681960 | 120681979 | 120681976 | + |

Figure 49 (Cont'd)

| | | | | | | | |
|---|---|---|---|---|---|---|---|
| SEQ ID NO 30654 | AGGGAAGCCTCTGAACACAG | GGG | chr3 | 120681961 | 120681980 | 120681977 | + |
| SEQ ID NO 30655 | CTGAACACAGGGGTTTGAAC | CAG | chr3 | 120681971 | 120681990 | 120681987 | + |
| SEQ ID NO 30656 | TGAACACAGGGGTTTGAACC | AGG | chr3 | 120681972 | 120681991 | 120681988 | + |
| SEQ ID NO 30657 | GAACACAGGGGTTTGAACCA | GGG | chr3 | 120681973 | 120681992 | 120681989 | + |
| SEQ ID NO 30658 | GTTTGAACCAGGGCCTCTCT | AAG | chr3 | 120681983 | 120682002 | 120681999 | + |
| SEQ ID NO 30659 | TTTCCAACTCTGATACCCTG | AAG | chr3 | 120682009 | 120682028 | 120682025 | + |
| SEQ ID NO 30660 | CTCTGATACCCTGAAGTTCT | CAG | chr3 | 120682016 | 120682035 | 120682032 | + |
| SEQ ID NO 30661 | TCAGAAACTTCCATAAATTT | TGG | chr3 | 120682035 | 120682054 | 120682051 | + |
| SEQ ID NO 30662 | ACTTCCATAAATTTTGGCTG | AAG | chr3 | 120682041 | 120682060 | 120682057 | + |
| SEQ ID NO 30663 | TCCATAAATTTTGGCTGAAG | AAG | chr3 | 120682044 | 120682063 | 120682060 | + |
| SEQ ID NO 30664 | AATTTTGGCTGAAGAAGCCA | TAG | chr3 | 120682050 | 120682069 | 120682066 | + |
| SEQ ID NO 30665 | AGAAGCCATAGCAAACTTGT | CAG | chr3 | 120682062 | 120682081 | 120682078 | + |
| SEQ ID NO 30666 | GCCATAGCAAACTTGTCAGA | TGG | chr3 | 120682066 | 120682085 | 120682082 | + |
| SEQ ID NO 30667 | ATGGTTTCTTACCTTTAACT | CAG | chr3 | 120682085 | 120682104 | 120682101 | + |
| SEQ ID NO 30668 | TTTTCTCTCCTCTATGTG | TGG | chr3 | 120682111 | 120682130 | 120682127 | + |
| SEQ ID NO 30669 | TCCTCTATGTGTGGTGACTT | CAG | chr3 | 120682120 | 120682139 | 120682136 | + |
| SEQ ID NO 30670 | CCTCTATGTGTGGTGACTTC | AGG | chr3 | 120682121 | 120682140 | 120682137 | + |
| SEQ ID NO 30671 | TGTGGTGACTTCAGGAAACC | CAG | chr3 | 120682129 | 120682148 | 120682145 | + |
| SEQ ID NO 30672 | GTGGTGACTTCAGGAAACCC | AGG | chr3 | 120682130 | 120682149 | 120682146 | + |
| SEQ ID NO 30673 | GACTTCAGGAAACCCAGGCC | CAG | chr3 | 120682135 | 120682154 | 120682151 | + |
| SEQ ID NO 30674 | CTTCAGGAAACCCAGGCCCA | GAG | chr3 | 120682137 | 120682156 | 120682153 | + |
| SEQ ID NO 30675 | TTCAGGAAACCCAGGCCCAG | AGG | chr3 | 120682138 | 120682157 | 120682154 | + |
| SEQ ID NO 30676 | ACCCAGGCCCAGAGGATATA | AAG | chr3 | 120682146 | 120682165 | 120682162 | + |
| SEQ ID NO 30677 | TTCTCCTTCAAACCACTCTT | TGG | chr3 | 120682182 | 120682201 | 120682198 | + |
| SEQ ID NO 30678 | AAACCACTCTTTGGATATTC | CGG | chr3 | 120682191 | 120682210 | 120682207 | + |
| SEQ ID NO 30679 | ACTGCTTCACTGCGCTTCAC | TGG | chr3 | 120682219 | 120682238 | 120682235 | + |
| SEQ ID NO 30680 | CTTCACTGCGCTTCACTGGT | CAG | chr3 | 120682223 | 120682242 | 120682239 | + |
| SEQ ID NO 30681 | GGTCAGTGCGTCACTCAAAC | TAG | chr3 | 120682240 | 120682259 | 120682256 | + |
| SEQ ID NO 30682 | GCGTCACTCAAACTAGCTGA | AAG | chr3 | 120682247 | 120682266 | 120682263 | + |
| SEQ ID NO 30683 | AGAATTGTCTAACTCATACA | CAG | chr3 | 120682268 | 120682287 | 120682284 | + |
| SEQ ID NO 30684 | GAATTGTCTAACTCATACAC | AGG | chr3 | 120682269 | 120682288 | 120682285 | + |
| SEQ ID NO 30685 | AATTGTCTAACTCATACACA | GGG | chr3 | 120682270 | 120682289 | 120682286 | + |
| SEQ ID NO 30686 | CTAACTCATACACAGGGACA | AAG | chr3 | 120682276 | 120682295 | 120682292 | + |
| SEQ ID NO 30687 | TCATACACAGGGACAAAGTC | CAG | chr3 | 120682281 | 120682300 | 120682297 | + |
| SEQ ID NO 30688 | ACACAGGGACAAAGTCCAGC | AAG | chr3 | 120682285 | 120682304 | 120682301 | + |
| SEQ ID NO 30689 | GTCCAGCAAGCTTATTTAAC | CGG | chr3 | 120682298 | 120682317 | 120682314 | + |
| SEQ ID NO 30690 | ACCGGTTACACAATTGCCTT | TGG | chr3 | 120682316 | 120682335 | 120682332 | + |
| SEQ ID NO 30691 | ACAATTGCCTTTGGTTTTTA | CAG | chr3 | 120682325 | 120682344 | 120682341 | + |
| SEQ ID NO 30692 | GGTTTTTACAGTTTGTTCCT | AAG | chr3 | 120682337 | 120682356 | 120682353 | + |
| SEQ ID NO 30693 | AGTTTGTTCCTAAGTGTTTC | CAG | chr3 | 120682346 | 120682365 | 120682362 | + |
| SEQ ID NO 30694 | TTTGTTCCTAAGTGTTTCCA | GAG | chr3 | 120682348 | 120682367 | 120682364 | + |
| SEQ ID NO 30695 | TTGTTCCTAAGTGTTTCCAG | AGG | chr3 | 120682349 | 120682368 | 120682365 | + |
| SEQ ID NO 30696 | CCTAAGTGTTTCCAGAGGCT | TGG | chr3 | 120682354 | 120682373 | 120682370 | + |
| SEQ ID NO 30697 | GGCTTGGTTCCTCTTCACCT | GAG | chr3 | 120682370 | 120682389 | 120682386 | + |
| SEQ ID NO 30698 | GCTTGGTTCCTCTTCACCTG | AGG | chr3 | 120682371 | 120682390 | 120682387 | + |
| SEQ ID NO 30699 | TGGTTCCTCTTCACCTGAGG | TAG | chr3 | 120682374 | 120682393 | 120682390 | + |
| SEQ ID NO 30700 | GTTCCTCTTCACCTGAGGTA | GAG | chr3 | 120682376 | 120682395 | 120682392 | + |

Figure 49 (Cont'd)

| | | | | | | | |
|---|---|---|---|---|---|---|---|
| SEQ ID NO 30701 | GATTGACCAATTATTTATTC | CAG | chr3 | 120682398 | 120682417 | 120682414 | + |
| SEQ ID NO 30702 | CAATTATTTATTCCAGTTAA | AAG | chr3 | 120682405 | 120682424 | 120682421 | + |
| SEQ ID NO 30703 | TTATTTATTCCAGTTAAAAG | TAG | chr3 | 120682408 | 120682427 | 120682424 | + |
| SEQ ID NO 30704 | TATTTATTCCAGTTAAAAGT | AGG | chr3 | 120682409 | 120682428 | 120682425 | + |
| SEQ ID NO 30705 | TAAAAGTAGGCTTATTTCAA | AAG | chr3 | 120682422 | 120682441 | 120682438 | + |
| SEQ ID NO 30706 | AAAAGTAGGCTTATTTCAAA | AGG | chr3 | 120682423 | 120682442 | 120682439 | + |
| SEQ ID NO 30707 | AGTAGGCTTATTTCAAAAGG | CAG | chr3 | 120682426 | 120682445 | 120682442 | + |
| SEQ ID NO 30708 | TAGGCTTATTTCAAAAGGCA | GAG | chr3 | 120682428 | 120682447 | 120682444 | + |
| SEQ ID NO 30709 | TTCAAAAGGCAGAGAATTTG | AAG | chr3 | 120682437 | 120682456 | 120682453 | + |
| SEQ ID NO 30710 | GGCAGAGAATTTGAAGCTAT | CGG | chr3 | 120682444 | 120682463 | 120682460 | + |
| SEQ ID NO 30711 | GCAGAGAATTTGAAGCTATC | GGG | chr3 | 120682445 | 120682464 | 120682461 | + |
| SEQ ID NO 30712 | CAGAGAATTTGAAGCTATCG | GGG | chr3 | 120682446 | 120682465 | 120682462 | + |
| SEQ ID NO 30713 | GAATTTGAAGCTATCGGGGA | AAG | chr3 | 120682450 | 120682469 | 120682466 | + |
| SEQ ID NO 30714 | AATTTGAAGCTATCGGGGAA | AGG | chr3 | 120682451 | 120682470 | 120682467 | + |
| SEQ ID NO 30715 | GCTATCGGGGAAAGGAACTG | TGG | chr3 | 120682459 | 120682478 | 120682475 | + |
| SEQ ID NO 30716 | ATCGGGGAAAGGAACTGTGG | CAG | chr3 | 120682462 | 120682481 | 120682478 | + |
| SEQ ID NO 30717 | GGGAAAGGAACTGTGGCAGA | TAG | chr3 | 120682466 | 120682485 | 120682482 | + |
| SEQ ID NO 30718 | CAGATAGTGCCTGCTGTGTG | TGG | chr3 | 120682482 | 120682501 | 120682498 | + |
| SEQ ID NO 30719 | ATAGTGCCTGCTGTGTGTGG | TGG | chr3 | 120682485 | 120682504 | 120682501 | + |
| SEQ ID NO 30720 | AGTGCCTGCTGTGTGGTG | GAG | chr3 | 120682487 | 120682506 | 120682503 | + |
| SEQ ID NO 30721 | GTGCCTGCTGTGTGGTGG | AGG | chr3 | 120682488 | 120682507 | 120682504 | + |
| SEQ ID NO 30722 | GTGGTGGAGGATTCTCTGCT | CAG | chr3 | 120682501 | 120682520 | 120682517 | + |
| SEQ ID NO 30723 | TTCTCTGCTCAGTCCTGACT | CAG | chr3 | 120682512 | 120682531 | 120682528 | + |
| SEQ ID NO 30724 | TCTCTGCTCAGTCCTGACTC | AGG | chr3 | 120682513 | 120682532 | 120682529 | + |
| SEQ ID NO 30725 | TGCTCAGTCCTGACTCAGGC | TAG | chr3 | 120682517 | 120682536 | 120682533 | + |
| SEQ ID NO 30726 | GCTCAGTCCTGACTCAGGCT | AGG | chr3 | 120682518 | 120682537 | 120682534 | + |
| SEQ ID NO 30727 | CAGTCCTGACTCAGGCTAGG | AAG | chr3 | 120682521 | 120682540 | 120682537 | + |
| SEQ ID NO 30728 | AGTCCTGACTCAGGCTAGGA | AGG | chr3 | 120682522 | 120682541 | 120682538 | + |
| SEQ ID NO 30729 | TGACTCAGGCTAGGAAGGAA | CAG | chr3 | 120682527 | 120682546 | 120682543 | + |
| SEQ ID NO 30730 | GACTCAGGCTAGGAAGGAAC | AGG | chr3 | 120682528 | 120682547 | 120682544 | + |
| SEQ ID NO 30731 | ACTCAGGCTAGGAAGGAACA | GGG | chr3 | 120682529 | 120682548 | 120682545 | + |
| SEQ ID NO 30732 | CAGGCTAGGAAGGAACAGGG | CAG | chr3 | 120682532 | 120682551 | 120682548 | + |
| SEQ ID NO 30733 | GGAAGGAACAGGGCAGTGCT | GAG | chr3 | 120682539 | 120682558 | 120682555 | + |
| SEQ ID NO 30734 | CAGGGCAGTGCTGAGTCTCC | TGG | chr3 | 120682547 | 120682566 | 120682563 | + |
| SEQ ID NO 30735 | GGGCAGTGCTGAGTCTCCTG | GAG | chr3 | 120682549 | 120682568 | 120682565 | + |
| SEQ ID NO 30736 | AGCACTGCCCTGTTCCTTCC | TAG | chr3 | 120682539 | 120682558 | 120682542 | - |
| SEQ ID NO 30737 | GCCCTGTTCCTTCCTAGCCT | GAG | chr3 | 120682533 | 120682552 | 120682536 | - |
| SEQ ID NO 30738 | TGTTCCTTCCTAGCCTGAGT | CAG | chr3 | 120682529 | 120682548 | 120682532 | - |
| SEQ ID NO 30739 | GTTCCTTCCTAGCCTGAGTC | AGG | chr3 | 120682528 | 120682547 | 120682531 | - |
| SEQ ID NO 30740 | TCCTAGCCTGAGTCAGGACT | GAG | chr3 | 120682522 | 120682541 | 120682525 | - |
| SEQ ID NO 30741 | TAGCCTGAGTCAGGACTGAG | CAG | chr3 | 120682519 | 120682538 | 120682522 | - |
| SEQ ID NO 30742 | GCCTGAGTCAGGACTGAGCA | GAG | chr3 | 120682517 | 120682536 | 120682520 | - |
| SEQ ID NO 30743 | AGAGAATCCTCCACCACACA | CAG | chr3 | 120682498 | 120682517 | 120682501 | - |
| SEQ ID NO 30744 | GAATCCTCCACCACACACAG | CAG | chr3 | 120682495 | 120682514 | 120682498 | - |
| SEQ ID NO 30745 | AATCCTCCACCACACACAGC | AGG | chr3 | 120682494 | 120682513 | 120682497 | - |
| SEQ ID NO 30746 | ACAGCAGGCACTATCTGCCA | CAG | chr3 | 120682479 | 120682498 | 120682482 | - |
| SEQ ID NO 30747 | GCCACAGTTCCTTTCCCCGA | TAG | chr3 | 120682463 | 120682482 | 120682466 | - |

Figure 49 (Cont'd)

| SEQ ID NO | Sequence | Codon | Chr | Start | End | Pos | Strand |
|---|---|---|---|---|---|---|---|
| SEQ ID NO 30748 | AATTCTCTGCCTTTTGAAAT | AAG | chr3 | 120682435 | 120682454 | 120682438 | - |
| SEQ ID NO 30749 | GAAATAAGCCTACTTTTAAC | TGG | chr3 | 120682420 | 120682439 | 120682423 | - |
| SEQ ID NO 30750 | TTTTAACTGGAATAAATAAT | TGG | chr3 | 120682407 | 120682426 | 120682410 | - |
| SEQ ID NO 30751 | TAATTGGTCAATCTCTACCT | CAG | chr3 | 120682391 | 120682410 | 120682394 | - |
| SEQ ID NO 30752 | AATTGGTCAATCTCTACCTC | AGG | chr3 | 120682390 | 120682409 | 120682393 | - |
| SEQ ID NO 30753 | GTCAATCTCTACCTCAGGTG | AAG | chr3 | 120682385 | 120682404 | 120682388 | - |
| SEQ ID NO 30754 | CAATCTCTACCTCAGGTGAA | GAG | chr3 | 120682383 | 120682402 | 120682386 | - |
| SEQ ID NO 30755 | AATCTCTACCTCAGGTGAAG | AGG | chr3 | 120682382 | 120682401 | 120682385 | - |
| SEQ ID NO 30756 | ACCTCAGGTGAAGAGGAACC | AAG | chr3 | 120682375 | 120682394 | 120682378 | - |
| SEQ ID NO 30757 | GTGAAGAGGAACCAAGCCTC | TGG | chr3 | 120682368 | 120682387 | 120682371 | - |
| SEQ ID NO 30758 | ACCAAGCCTCTGGAAACACT | TAG | chr3 | 120682358 | 120682377 | 120682361 | - |
| SEQ ID NO 30759 | CCAAGCCTCTGGAAACACTT | AGG | chr3 | 120682357 | 120682376 | 120682360 | - |
| SEQ ID NO 30760 | GGAACAAACTGTAAAAACCA | AAG | chr3 | 120682336 | 120682355 | 120682339 | - |
| SEQ ID NO 30761 | GAACAAACTGTAAAAACCAA | AGG | chr3 | 120682335 | 120682354 | 120682338 | - |
| SEQ ID NO 30762 | ACCAAAGGCAATTGTGTAAC | CGG | chr3 | 120682320 | 120682339 | 120682323 | - |
| SEQ ID NO 30763 | AATTGTGTAACCGGTTAAAT | AAG | chr3 | 120682311 | 120682330 | 120682314 | - |
| SEQ ID NO 30764 | AACCGGTTAAATAAGCTTGC | TGG | chr3 | 120682303 | 120682322 | 120682306 | - |
| SEQ ID NO 30765 | TGGACTTTGTCCCTGTGTAT | GAG | chr3 | 120682283 | 120682302 | 120682286 | - |
| SEQ ID NO 30766 | CTTTGTCCCTGTGTATGAGT | TAG | chr3 | 120682279 | 120682298 | 120682282 | - |
| SEQ ID NO 30767 | TATGAGTTAGACAATTCTTT | CAG | chr3 | 120682266 | 120682285 | 120682269 | - |
| SEQ ID NO 30768 | AGTTAGACAATTCTTTCAGC | TAG | chr3 | 120682262 | 120682281 | 120682265 | - |
| SEQ ID NO 30769 | ACAATTCTTTCAGCTAGTTT | GAG | chr3 | 120682256 | 120682275 | 120682259 | - |
| SEQ ID NO 30770 | AGTTTGAGTGACGCACTGAC | CAG | chr3 | 120682241 | 120682260 | 120682244 | - |
| SEQ ID NO 30771 | GAGTGACGCACTGACCAGTG | AAG | chr3 | 120682236 | 120682255 | 120682239 | - |
| SEQ ID NO 30772 | ACGCACTGACCAGTGAAGCG | CAG | chr3 | 120682231 | 120682250 | 120682234 | - |
| SEQ ID NO 30773 | CTGACCAGTGAAGCGCAGTG | AAG | chr3 | 120682226 | 120682245 | 120682229 | - |
| SEQ ID NO 30774 | ACCAGTGAAGCGCAGTGAAG | CAG | chr3 | 120682223 | 120682242 | 120682226 | - |
| SEQ ID NO 30775 | AGTGAAGCGCAGTGAAGCAG | TGG | chr3 | 120682220 | 120682239 | 120682223 | - |
| SEQ ID NO 30776 | GTGAAGCGCAGTGAAGCAGT | GGG | chr3 | 120682219 | 120682238 | 120682222 | - |
| SEQ ID NO 30777 | CGCAGTGAAGCAGTGGGAAC | CGG | chr3 | 120682213 | 120682232 | 120682216 | - |
| SEQ ID NO 30778 | AGTGGGAACCGGAATATCCA | AAG | chr3 | 120682202 | 120682221 | 120682205 | - |
| SEQ ID NO 30779 | TGGGAACCGGAATATCCAAA | GAG | chr3 | 120682200 | 120682219 | 120682203 | - |
| SEQ ID NO 30780 | GAACCGGAATATCCAAAGAG | TGG | chr3 | 120682197 | 120682216 | 120682200 | - |
| SEQ ID NO 30781 | AATATCCAAAGAGTGGTTTG | AAG | chr3 | 120682190 | 120682209 | 120682193 | - |
| SEQ ID NO 30782 | ATATCCAAAGAGTGGTTTGA | AGG | chr3 | 120682189 | 120682208 | 120682192 | - |
| SEQ ID NO 30783 | ATCCAAAGAGTGGTTTGAAG | GAG | chr3 | 120682187 | 120682206 | 120682190 | - |
| SEQ ID NO 30784 | AAAGAGTGGTTTGAAGGAGA | AAG | chr3 | 120682183 | 120682202 | 120682186 | - |
| SEQ ID NO 30785 | GAGTGGTTTGAAGGAGAAAG | AAG | chr3 | 120682180 | 120682199 | 120682183 | - |
| SEQ ID NO 30786 | TGAAGGAGAAAGAAGCATTG | TGG | chr3 | 120682172 | 120682191 | 120682175 | - |
| SEQ ID NO 30787 | CATTGTGGCTTTATATCCTC | TGG | chr3 | 120682157 | 120682176 | 120682160 | - |
| SEQ ID NO 30788 | ATTGTGGCTTTATATCCTCT | GGG | chr3 | 120682156 | 120682175 | 120682159 | - |
| SEQ ID NO 30789 | GGCTTTATATCCTCTGGGCC | TGG | chr3 | 120682151 | 120682170 | 120682154 | - |
| SEQ ID NO 30790 | GCTTTATATCCTCTGGGCCT | GGG | chr3 | 120682150 | 120682169 | 120682153 | - |
| SEQ ID NO 30791 | CTCTGGGCCTGGGTTTCCTG | AAG | chr3 | 120682140 | 120682159 | 120682143 | - |
| SEQ ID NO 30792 | TTTCCTGAAGTCACCACACA | TAG | chr3 | 120682127 | 120682146 | 120682130 | - |
| SEQ ID NO 30793 | TCCTGAAGTCACCACACATA | GAG | chr3 | 120682125 | 120682144 | 120682128 | - |
| SEQ ID NO 30794 | CCTGAAGTCACCACACATAG | AGG | chr3 | 120682124 | 120682143 | 120682127 | - |

Figure 49 (Cont'd)

| | | | | | | | |
|---|---|---|---|---|---|---|---|
| SEQ ID NO 30795 | TGAAGTCACCACACATAGAG | GAG | chr3 | 120682122 | 120682141 | 120682125 | - |
| SEQ ID NO 30796 | AAGTCACCACACATAGAGGA | GAG | chr3 | 120682120 | 120682139 | 120682123 | - |
| SEQ ID NO 30797 | GTCACCACACATAGAGGAGA | GAG | chr3 | 120682118 | 120682137 | 120682121 | - |
| SEQ ID NO 30798 | CACATAGAGGAGAGAGAAAA | TGG | chr3 | 120682111 | 120682130 | 120682114 | - |
| SEQ ID NO 30799 | AGAGGAGAGAGAAAATGGCT | GAG | chr3 | 120682106 | 120682125 | 120682109 | - |
| SEQ ID NO 30800 | GAGAGAAAATGGCTGAGTTA | AAG | chr3 | 120682100 | 120682119 | 120682103 | - |
| SEQ ID NO 30801 | AGAGAAAATGGCTGAGTTAA | AGG | chr3 | 120682099 | 120682118 | 120682102 | - |
| SEQ ID NO 30802 | AAAATGGCTGAGTTAAAGGT | AAG | chr3 | 120682095 | 120682114 | 120682098 | - |
| SEQ ID NO 30803 | AAGGTAAGAAACCATCTGAC | AAG | chr3 | 120682080 | 120682099 | 120682083 | - |
| SEQ ID NO 30804 | ACCATCTGACAAGTTTGCTA | TGG | chr3 | 120682070 | 120682089 | 120682073 | - |
| SEQ ID NO 30805 | CAAGTTTGCTATGGCTTCTT | CAG | chr3 | 120682061 | 120682080 | 120682064 | - |
| SEQ ID NO 30806 | GCTTCTTCAGCCAAAATTTA | TGG | chr3 | 120682048 | 120682067 | 120682051 | - |
| SEQ ID NO 30807 | TCTTCAGCCAAAATTTATGG | AAG | chr3 | 120682045 | 120682064 | 120682048 | - |
| SEQ ID NO 30808 | CAAAATTTATGGAAGTTTCT | GAG | chr3 | 120682037 | 120682056 | 120682040 | - |
| SEQ ID NO 30809 | ATGGAAGTTTCTGAGAACTT | CAG | chr3 | 120682029 | 120682048 | 120682032 | - |
| SEQ ID NO 30810 | TGGAAGTTTCTGAGAACTTC | AGG | chr3 | 120682028 | 120682047 | 120682031 | - |
| SEQ ID NO 30811 | GGAAGTTTCTGAGAACTTCA | GGG | chr3 | 120682027 | 120682046 | 120682030 | - |
| SEQ ID NO 30812 | TTCTGAGAACTTCAGGGTAT | CAG | chr3 | 120682021 | 120682040 | 120682024 | - |
| SEQ ID NO 30813 | CTGAGAACTTCAGGGTATCA | GAG | chr3 | 120682019 | 120682038 | 120682022 | - |
| SEQ ID NO 30814 | GAACTTCAGGGTATCAGAGT | TGG | chr3 | 120682015 | 120682034 | 120682018 | - |
| SEQ ID NO 30815 | TCAGGGTATCAGAGTTGGAA | AAG | chr3 | 120682010 | 120682029 | 120682013 | - |
| SEQ ID NO 30816 | TATCAGAGTTGGAAAAGACT | TAG | chr3 | 120682004 | 120682023 | 120682007 | - |
| SEQ ID NO 30817 | TCAGAGTTGGAAAAGACTTA | GAG | chr3 | 120682002 | 120682021 | 120682005 | - |
| SEQ ID NO 30818 | AGAGTTGGAAAAGACTTAGA | GAG | chr3 | 120682000 | 120682019 | 120682003 | - |
| SEQ ID NO 30819 | GAGTTGGAAAAGACTTAGAG | AGG | chr3 | 120681999 | 120682018 | 120682002 | - |
| SEQ ID NO 30820 | GAAAAGACTTAGAGAGGCCC | TGG | chr3 | 120681993 | 120682012 | 120681996 | - |
| SEQ ID NO 30821 | CTGGTTCAAACCCTGTGTT | CAG | chr3 | 120681974 | 120681993 | 120681977 | - |
| SEQ ID NO 30822 | GGTTCAAACCCTGTGTTCA | GAG | chr3 | 120681972 | 120681991 | 120681975 | - |
| SEQ ID NO 30823 | GTTCAAACCCTGTGTTCAG | AGG | chr3 | 120681971 | 120681990 | 120681974 | - |
| SEQ ID NO 30824 | TGTGTTCAGAGGCTTCCCTG | TGG | chr3 | 120681960 | 120681979 | 120681963 | - |
| SEQ ID NO 30825 | AGGCTTCCCTGTGGTGTCTG | TGG | chr3 | 120681951 | 120681970 | 120681954 | - |
| SEQ ID NO 30826 | GGCTTCCCTGTGGTGTCTGT | GGG | chr3 | 120681950 | 120681969 | 120681953 | - |
| SEQ ID NO 30827 | CCCTGTGGTGTCTGTGGGCA | CAG | chr3 | 120681945 | 120681964 | 120681948 | - |
| SEQ ID NO 30828 | GTGGTGTCTGTGGGCACAGC | TGG | chr3 | 120681941 | 120681960 | 120681944 | - |
| SEQ ID NO 30829 | GGTGTCTGTGGGCACAGCTG | GAG | chr3 | 120681939 | 120681958 | 120681942 | - |
| SEQ ID NO 30830 | TGTGGGCACAGCTGGAGCTG | AAG | chr3 | 120681933 | 120681952 | 120681936 | - |
| SEQ ID NO 30831 | CACAGCTGGAGCTGAAGAAC | AAG | chr3 | 120681927 | 120681946 | 120681930 | - |
| SEQ ID NO 30832 | ACAGCTGGAGCTGAAGAACA | AGG | chr3 | 120681926 | 120681945 | 120681929 | - |
| SEQ ID NO 30833 | CAGCTGGAGCTGAAGAACAA | GGG | chr3 | 120681925 | 120681944 | 120681928 | - |
| SEQ ID NO 30834 | TGGAGCTGAAGAACAAGGGA | AAG | chr3 | 120681921 | 120681940 | 120681924 | - |
| SEQ ID NO 30835 | GGAGCTGAAGAACAAGGGAA | AGG | chr3 | 120681920 | 120681939 | 120681923 | - |
| SEQ ID NO 30836 | AGAACAAGGGAAGGTGATA | AAG | chr3 | 120681912 | 120681931 | 120681915 | - |
| SEQ ID NO 30837 | GAACAAGGGAAGGTGATAA | AGG | chr3 | 120681911 | 120681930 | 120681914 | - |
| SEQ ID NO 30838 | AAGGGAAAGGTGATAAAGGA | AAG | chr3 | 120681907 | 120681926 | 120681910 | - |
| SEQ ID NO 30839 | GGTGATAAAGGAAAGAAATG | AAG | chr3 | 120681899 | 120681918 | 120681902 | - |
| SEQ ID NO 30840 | GAAAGAAATGAAGCTCTTAT | TGG | chr3 | 120681889 | 120681908 | 120681892 | - |
| SEQ ID NO 30841 | GTTCATTTCAATTATTGTCT | TGG | chr3 | 120681851 | 120681870 | 120681854 | - |

Figure 49 (Cont'd)

| SEQ ID | Sequence | Codon | Chr | Start | End | Pos | Strand |
|---|---|---|---|---|---|---|---|
| SEQ ID NO 30842 | ATTATTGTCTTGGAAATCTG | TAG | chr3 | 120681841 | 120681860 | 120681844 | - |
| SEQ ID NO 30843 | TGGAAATCTGTAGACATCCT | AAG | chr3 | 120681831 | 120681850 | 120681834 | - |
| SEQ ID NO 30844 | GAAATCTGTAGACATCCTAA | GAG | chr3 | 120681829 | 120681848 | 120681832 | - |
| SEQ ID NO 30845 | CTAAGAGCTCCCCTCCACTA | CGG | chr3 | 120681813 | 120681832 | 120681816 | - |
| SEQ ID NO 30846 | CTGACACCTTCCCATTGCTG | CAG | chr3 | 120681749 | 120681768 | 120681752 | - |
| SEQ ID NO 30847 | TTCCCATTGCTGCAGCCTCA | TGG | chr3 | 120681741 | 120681760 | 120681744 | - |
| SEQ ID NO 30848 | GCAGCCTCATGGACCACTTC | CGG | chr3 | 120681730 | 120681749 | 120681733 | - |
| SEQ ID NO 30849 | CATGGACCACTTCCGGTGAC | CAG | chr3 | 120681723 | 120681742 | 120681726 | - |
| SEQ ID NO 30850 | GACCACTTCCGGTGACCAGT | TAG | chr3 | 120681719 | 120681738 | 120681722 | - |
| SEQ ID NO 30851 | TTAGATATGCTTGATCTATT | TAG | chr3 | 120681700 | 120681719 | 120681703 | - |
| SEQ ID NO 30852 | CTTGATCTATTTAGTTAATT | AAG | chr3 | 120681691 | 120681710 | 120681694 | - |
| SEQ ID NO 30853 | TTGATCTATTTAGTTAATTA | AGG | chr3 | 120681690 | 120681709 | 120681693 | - |
| SEQ ID NO 30854 | AGTTAATTAAGGCTCTGAAT | CAG | chr3 | 120681679 | 120681698 | 120681682 | - |
| SEQ ID NO 30855 | TAAGGCTCTGAATCAGCCCT | TGG | chr3 | 120681672 | 120681691 | 120681675 | - |
| SEQ ID NO 30856 | GCTCTGAATCAGCCCTTGGC | CAG | chr3 | 120681668 | 120681687 | 120681671 | - |
| SEQ ID NO 30857 | CTGAATCAGCCCTTGGCCAG | AAG | chr3 | 120681665 | 120681684 | 120681668 | - |
| SEQ ID NO 30858 | AATCAGCCCTTGGCCAGAAG | AAG | chr3 | 120681662 | 120681681 | 120681665 | - |
| SEQ ID NO 30859 | GCCAGAAGAAGCACCTCCTC | TAG | chr3 | 120681650 | 120681669 | 120681653 | - |
| SEQ ID NO 30860 | CCAGAAGAAGCACCTCCTCT | AGG | chr3 | 120681649 | 120681668 | 120681652 | - |
| SEQ ID NO 30861 | AGGAAATCATTCCTTCTTTT | TAG | chr3 | 120681629 | 120681648 | 120681632 | - |
| SEQ ID NO 30862 | TTTAGTAATACGCAATTGAA | AAG | chr3 | 120681611 | 120681630 | 120681614 | - |
| SEQ ID NO 30863 | ACGCAATTGAAAAGTATGTG | TGG | chr3 | 120681602 | 120681621 | 120681605 | - |
| SEQ ID NO 30864 | CGCAATTGAAAAGTATGTGT | GGG | chr3 | 120681601 | 120681620 | 120681604 | - |
| SEQ ID NO 30865 | ATGTGTGGGTTATGTGCTGT | TAG | chr3 | 120681587 | 120681606 | 120681590 | - |
| SEQ ID NO 30866 | TGTGTGGGTTATGTGCTGTT | AGG | chr3 | 120681586 | 120681605 | 120681589 | - |
| SEQ ID NO 30867 | GTTATGTGCTGTTAGGTGCT | AAG | chr3 | 120681579 | 120681598 | 120681582 | - |
| SEQ ID NO 30868 | CTGTTAGGTGCTAAGCATTT | TAG | chr3 | 120681571 | 120681590 | 120681574 | - |
| SEQ ID NO 30869 | CATAATCCTCAAAATAAATC | TGG | chr3 | 120681535 | 120681554 | 120681538 | - |
| SEQ ID NO 30870 | ATAATCCTCAAAATAAATCT | GGG | chr3 | 120681534 | 120681553 | 120681537 | - |
| SEQ ID NO 30871 | TAATCCTCAAAATAAATCTG | GGG | chr3 | 120681533 | 120681552 | 120681536 | - |
| SEQ ID NO 30872 | CTCAAAATAAATCTGGGGTA | TAG | chr3 | 120681528 | 120681547 | 120681531 | - |
| SEQ ID NO 30873 | CAAAATAAATCTGGGGTATA | GAG | chr3 | 120681526 | 120681545 | 120681529 | - |
| SEQ ID NO 30874 | AAATAAATCTGGGGTATAGA | GAG | chr3 | 120681524 | 120681543 | 120681527 | - |
| SEQ ID NO 30875 | ATAAATCTGGGGTATAGAGA | GAG | chr3 | 120681522 | 120681541 | 120681525 | - |
| SEQ ID NO 30876 | TAAATCTGGGGTATAGAGAG | AGG | chr3 | 120681521 | 120681540 | 120681524 | - |
| SEQ ID NO 30877 | AGAGAGGTTCTTGTTTCAAT | TAG | chr3 | 120681505 | 120681524 | 120681508 | - |
| SEQ ID NO 30878 | GGTTCTTGTTTCAATTAGAA | AAG | chr3 | 120681500 | 120681519 | 120681503 | - |
| SEQ ID NO 30879 | TCAATTAGAAAAGTAATGCT | TGG | chr3 | 120681490 | 120681509 | 120681493 | - |
| SEQ ID NO 30880 | AATTAGAAAAGTAATGCTTG | GAG | chr3 | 120681488 | 120681507 | 120681491 | - |
| SEQ ID NO 30881 | TTAGAAAAGTAATGCTTGGA | GAG | chr3 | 120681486 | 120681505 | 120681489 | - |
| SEQ ID NO 30882 | GGAGAGACTATGATTTGCCC | AAG | chr3 | 120681469 | 120681488 | 120681472 | - |
| SEQ ID NO 30883 | GAGAGACTATGATTTGCCCA | AGG | chr3 | 120681468 | 120681487 | 120681471 | - |
| SEQ ID NO 30884 | TTGCCCAAGGTCACTGCCAA | TAG | chr3 | 120681455 | 120681474 | 120681458 | - |
| SEQ ID NO 30885 | CTGCCAATAGATGACTTGAT | TAG | chr3 | 120681442 | 120681461 | 120681445 | - |
| SEQ ID NO 30886 | CCAATAGATGACTTGATTAG | AAG | chr3 | 120681439 | 120681458 | 120681442 | - |
| SEQ ID NO 30887 | ATAGATGACTTGATTAGAAG | CAG | chr3 | 120681436 | 120681455 | 120681439 | - |
| SEQ ID NO 30888 | TAGATGACTTGATTAGAAGC | AGG | chr3 | 120681435 | 120681454 | 120681438 | - |

Figure 49 (Cont'd)

| SEQ ID NO | Sequence | PAM | Chr | Start | End | Cut | Strand |
|---|---|---|---|---|---|---|---|
| SEQ ID NO 30889 | AGATGACTTGATTAGAAGCA | GGG | chr3 | 120681434 | 120681453 | 120681437 | - |
| SEQ ID NO 30890 | GCAGGGTATGTTTGAATGCG | AAG | chr3 | 120681417 | 120681436 | 120681420 | - |
| SEQ ID NO 30891 | GTATGTTTGAATGCGAAGTC | CAG | chr3 | 120681412 | 120681431 | 120681415 | - |
| SEQ ID NO 30892 | TATGTTTGAATGCGAAGTCC | AGG | chr3 | 120681411 | 120681430 | 120681414 | - |
| SEQ ID NO 30893 | ATGCGAAGTCCAGGCTCAAA | AAG | chr3 | 120681402 | 120681421 | 120681405 | - |
| SEQ ID NO 30894 | TGCGAAGTCCAGGCTCAAAA | AGG | chr3 | 120681401 | 120681420 | 120681404 | - |
| SEQ ID NO 30895 | GCGAAGTCCAGGCTCAAAAA | GGG | chr3 | 120681400 | 120681419 | 120681403 | - |
| SEQ ID NO 30896 | CGAAGTCCAGGCTCAAAAAG | GGG | chr3 | 120681399 | 120681418 | 120681402 | - |
| SEQ ID NO 30897 | CCAGGCTCAAAAAGGGGCCT | TAG | chr3 | 120681393 | 120681412 | 120681396 | - |
| SEQ ID NO 30898 | GGCTCAAAAAGGGGCCTTAG | TGG | chr3 | 120681390 | 120681409 | 120681393 | - |
| SEQ ID NO 30899 | GGGGCCTTAGTGGCTCCTAC | TAG | chr3 | 120681380 | 120681399 | 120681383 | - |
| SEQ ID NO 30900 | CTTAGTGGCTCCTACTAGAC | TGG | chr3 | 120681375 | 120681394 | 120681378 | - |
| SEQ ID NO 30901 | TCCTACTAGACTGGTATCTT | AAG | chr3 | 120681366 | 120681385 | 120681369 | - |
| SEQ ID NO 30902 | CCTACTAGACTGGTATCTTA | AGG | chr3 | 120681365 | 120681384 | 120681368 | - |
| SEQ ID NO 30903 | CTAGACTGGTATCTTAAGGC | AAG | chr3 | 120681361 | 120681380 | 120681364 | - |
| SEQ ID NO 30904 | TAGACTGGTATCTTAAGGCA | AGG | chr3 | 120681360 | 120681379 | 120681363 | - |
| SEQ ID NO 30905 | GTATCTTAAGGCAAGGAAAA | CAG | chr3 | 120681353 | 120681372 | 120681356 | - |
| SEQ ID NO 30906 | CTAATATCTAAAACCATGCC | TAG | chr3 | 120681321 | 120681340 | 120681324 | - |
| SEQ ID NO 30907 | CTAAAACCATGCCTAGTGCC | CAG | chr3 | 120681314 | 120681333 | 120681317 | - |
| SEQ ID NO 30908 | TAAAACCATGCCTAGTGCCC | AGG | chr3 | 120681313 | 120681332 | 120681316 | - |
| SEQ ID NO 30909 | ACCATGCCTAGTGCCCAGGC | CAG | chr3 | 120681309 | 120681328 | 120681312 | - |
| SEQ ID NO 30910 | CCATGCCTAGTGCCCAGGCC | AGG | chr3 | 120681308 | 120681327 | 120681311 | - |
| SEQ ID NO 30911 | CGCATGCATGTGTAACTGAA | CAG | chr3 | 120681268 | 120681287 | 120681271 | - |
| SEQ ID NO 30912 | TGTAACTGAACAGAACTGCC | CAG | chr3 | 120681258 | 120681277 | 120681261 | - |
| SEQ ID NO 30913 | AACAGAACTGCCCAGAACCT | TGG | chr3 | 120681250 | 120681269 | 120681253 | - |
| SEQ ID NO 30914 | AACTGCCCAGAACCTTGGCT | CAG | chr3 | 120681245 | 120681264 | 120681248 | - |
| SEQ ID NO 30915 | ACTGCCCAGAACCTTGGCTC | AGG | chr3 | 120681244 | 120681263 | 120681247 | - |
| SEQ ID NO 30916 | CCAGAACCTTGGCTCAGGCC | AAG | chr3 | 120681239 | 120681258 | 120681242 | - |
| SEQ ID NO 30917 | GAACCTTGGCTCAGGCCAAG | TAG | chr3 | 120681236 | 120681255 | 120681239 | - |
| SEQ ID NO 30918 | AACCTTGGCTCAGGCCAAGT | AGG | chr3 | 120681235 | 120681254 | 120681238 | - |
| SEQ ID NO 30919 | TTGGCTCAGGCCAAGTAGGC | CAG | chr3 | 120681231 | 120681250 | 120681234 | - |
| SEQ ID NO 30920 | TAGGCCAGACCACCCCACAA | CAG | chr3 | 120681216 | 120681235 | 120681219 | - |
| SEQ ID NO 30921 | ACAGACATCTTCCCTGAATG | CAG | chr3 | 120681197 | 120681216 | 120681200 | - |
| SEQ ID NO 30922 | CAGACATCTTCCCTGAATGC | AGG | chr3 | 120681196 | 120681215 | 120681199 | - |
| SEQ ID NO 30923 | AGACATCTTCCCTGAATGCA | GGG | chr3 | 120681195 | 120681214 | 120681198 | - |
| SEQ ID NO 30924 | CTTCCCTGAATGCAGGGTTT | GAG | chr3 | 120681189 | 120681208 | 120681192 | - |
| SEQ ID NO 30925 | CCCTGAATGCAGGGTTTGAG | AAG | chr3 | 120681186 | 120681205 | 120681189 | - |
| SEQ ID NO 30926 | AATGCCCTCAACTGATGCT | GAG | chr3 | 120681157 | 120681176 | 120681160 | - |
| SEQ ID NO 30927 | TCTAACTGATGCTGAGTTTG | AAG | chr3 | 120681150 | 120681169 | 120681153 | - |
| SEQ ID NO 30928 | GCTGAGTTTGAAGAATCCAT | CAG | chr3 | 120681140 | 120681159 | 120681143 | - |
| SEQ ID NO 30929 | GTTTGAAGAATCCATCAGTT | AAG | chr3 | 120681135 | 120681154 | 120681138 | - |
| SEQ ID NO 30930 | TTTGAAGAATCCATCAGTTA | AGG | chr3 | 120681134 | 120681153 | 120681137 | - |
| SEQ ID NO 30931 | TTGAAGAATCCATCAGTTAA | GGG | chr3 | 120681133 | 120681152 | 120681136 | - |
| SEQ ID NO 30932 | TGAAGAATCCATCAGTTAAG | GGG | chr3 | 120681132 | 120681151 | 120681135 | - |
| SEQ ID NO 30933 | AAGAATCCATCAGTTAAGGG | GAG | chr3 | 120681130 | 120681149 | 120681133 | - |
| SEQ ID NO 30934 | AGAATCCATCAGTTAAGGGG | AGG | chr3 | 120681129 | 120681148 | 120681132 | - |
| SEQ ID NO 30935 | AGTTAAGGGGAGGTGTTTCT | GAG | chr3 | 120681119 | 120681138 | 120681122 | - |

Figure 49 (Cont'd)

| | | | | | | | |
|---|---|---|---|---|---|---|---|
| SEQ ID NO 30936 | GGGAGGTGTTTCTGAGTTTG | AAG | chr3 | 120681112 | 120681131 | 120681115 | - |
| SEQ ID NO 30937 | GAATCAAACACCTTCCTAAT | TGG | chr3 | 120681090 | 120681109 | 120681093 | - |
| SEQ ID NO 30938 | TCAAACACCTTCCTAATTGG | TAG | chr3 | 120681087 | 120681106 | 120681090 | - |
| SEQ ID NO 30939 | CAAACACCTTCCTAATTGGT | AGG | chr3 | 120681086 | 120681105 | 120681089 | - |
| SEQ ID NO 30940 | ATCCTGAAAACACTCCACAC | CGG | chr3 | 120681062 | 120681081 | 120681065 | - |
| SEQ ID NO 30941 | CCTGAAAACACTCCACACCG | GAG | chr3 | 120681060 | 120681079 | 120681063 | - |
| SEQ ID NO 30942 | AACACTCCACACCGGAGTAA | AAG | chr3 | 120681054 | 120681073 | 120681057 | - |
| SEQ ID NO 30943 | CACACCGGAGTAAAAGACTT | TGG | chr3 | 120681047 | 120681066 | 120681050 | - |
| SEQ ID NO 30944 | TTATCTTTATGCCTGACTAA | AAG | chr3 | 120681020 | 120681039 | 120681023 | - |
| SEQ ID NO 30945 | TTAACTCTCATTCTTTCATT | CAG | chr3 | 120680997 | 120681016 | 120681000 | - |
| SEQ ID NO 30946 | ATTCAGCAAATATTTTGTGC | TAG | chr3 | 120680980 | 120680999 | 120680983 | - |
| SEQ ID NO 30947 | TGTGCTAGTGCATGACACTG | CAG | chr3 | 120680965 | 120680984 | 120680968 | - |
| SEQ ID NO 30948 | GACACTGCAGATTAATATCG | TAG | chr3 | 120680952 | 120680971 | 120680955 | - |
| SEQ ID NO 30949 | ATTAATATCGTAGATGAACT | GAG | chr3 | 120680942 | 120680961 | 120680945 | - |
| SEQ ID NO 30950 | TATCGTAGATGAACTGAGTC | TGG | chr3 | 120680937 | 120680956 | 120680940 | - |
| SEQ ID NO 30951 | ATCGTAGATGAACTGAGTCT | GGG | chr3 | 120680936 | 120680955 | 120680939 | - |
| SEQ ID NO 30952 | TAGATGAACTGAGTCTGGGC | TAG | chr3 | 120680932 | 120680951 | 120680935 | - |
| SEQ ID NO 30953 | AGATGAACTGAGTCTGGGCT | AGG | chr3 | 120680931 | 120680950 | 120680934 | - |
| SEQ ID NO 30954 | TGAACTGAGTCTGGGCTAGG | TAG | chr3 | 120680928 | 120680947 | 120680931 | - |
| SEQ ID NO 30955 | AACTGAGTCTGGGCTAGGTA | GAG | chr3 | 120680926 | 120680945 | 120680929 | - |
| SEQ ID NO 30956 | AGTCAAAAAAAAATTTCCTA | AAG | chr3 | 120680905 | 120680924 | 120680908 | - |
| SEQ ID NO 30957 | GTCAAAAAAAAATTTCCTAA | AGG | chr3 | 120680904 | 120680923 | 120680907 | - |
| SEQ ID NO 30958 | CAAAAAAAAATTTCCTAAAG | GAG | chr3 | 120680902 | 120680921 | 120680905 | - |
| SEQ ID NO 30959 | AAGGAGCCTGTACCTAAACT | GAG | chr3 | 120680885 | 120680904 | 120680888 | - |
| SEQ ID NO 30960 | CTGTACCTAAACTGAGTCTT | CAG | chr3 | 120680878 | 120680897 | 120680881 | - |
| SEQ ID NO 30961 | GTACCTAAACTGAGTCTTCA | GAG | chr3 | 120680876 | 120680895 | 120680879 | - |
| SEQ ID NO 30962 | ACCTAAACTGAGTCTTCAGA | GAG | chr3 | 120680874 | 120680893 | 120680877 | - |
| SEQ ID NO 30963 | TAAACTGAGTCTTCAGAGAG | AAG | chr3 | 120680871 | 120680890 | 120680874 | - |
| SEQ ID NO 30964 | CTGAGTCTTCAGAGAGAAGT | TGG | chr3 | 120680867 | 120680886 | 120680870 | - |
| SEQ ID NO 30965 | CTTCAGAGAGAAGTTGGAAC | TGG | chr3 | 120680861 | 120680880 | 120680864 | - |
| SEQ ID NO 30966 | GAGAGAAGTTGGAACTGGCA | AAG | chr3 | 120680856 | 120680875 | 120680859 | - |
| SEQ ID NO 30967 | GAAGTTGGAACTGGCAAAGT | GAG | chr3 | 120680852 | 120680871 | 120680855 | - |
| SEQ ID NO 30968 | AAGTTGGAACTGGCAAAGTG | AGG | chr3 | 120680851 | 120680870 | 120680854 | - |
| SEQ ID NO 30969 | TTGGAACTGGCAAAGTGAGG | AAG | chr3 | 120680848 | 120680867 | 120680851 | - |
| SEQ ID NO 30970 | TGGAACTGGCAAAGTGAGGA | AGG | chr3 | 120680847 | 120680866 | 120680850 | - |
| SEQ ID NO 30971 | ACTGGCAAAGTGAGGAAGGA | CGG | chr3 | 120680843 | 120680862 | 120680846 | - |
| SEQ ID NO 30972 | CTGGCAAAGTGAGGAAGGAC | GGG | chr3 | 120680842 | 120680861 | 120680845 | - |
| SEQ ID NO 30973 | TGGCAAAGTGAGGAAGGACG | GGG | chr3 | 120680841 | 120680860 | 120680844 | - |
| SEQ ID NO 30974 | AAGTGAGGAAGGACGGGGTC | TGG | chr3 | 120680836 | 120680855 | 120680839 | - |
| SEQ ID NO 30975 | GTGAGGAAGGACGGGGTCTG | GAG | chr3 | 120680834 | 120680853 | 120680837 | - |
| SEQ ID NO 30976 | TGAGGAAGGACGGGGTCTGG | AGG | chr3 | 120680833 | 120680852 | 120680836 | - |
| SEQ ID NO 30977 | GAGGAAGGACGGGGTCTGGA | GGG | chr3 | 120680832 | 120680851 | 120680835 | - |
| SEQ ID NO 30978 | GAAGGACGGGGTCTGGAGGG | AAG | chr3 | 120680829 | 120680848 | 120680832 | - |
| SEQ ID NO 30979 | AGGACGGGGTCTGGAGGGAA | GAG | chr3 | 120680827 | 120680846 | 120680830 | - |
| SEQ ID NO 30980 | CGGGGTCTGGAGGGAAGAGT | GAG | chr3 | 120680823 | 120680842 | 120680826 | - |
| SEQ ID NO 30981 | TGGAGGGAAGAGTGAGTGCA | AAG | chr3 | 120680816 | 120680835 | 120680819 | - |
| SEQ ID NO 30982 | GGAGGGAAGAGTGAGTGCAA | AGG | chr3 | 120680815 | 120680834 | 120680818 | - |

Figure 49 (Cont'd)

| SEQ ID NO | Sequence | Codon | Chr | Start | End | Pos | Strand |
|---|---|---|---|---|---|---|---|
| SEQ ID NO 30983 | GAAGAGTGAGTGCAAAGGCA | CAG | chr3 | 120680810 | 120680829 | 120680813 | - |
| SEQ ID NO 30984 | GTGCAAAGGCACAGCACATA | CAG | chr3 | 120680801 | 120680820 | 120680804 | - |
| SEQ ID NO 30985 | TACAGAATGCCTGCATGCTC | TAG | chr3 | 120680783 | 120680802 | 120680786 | - |
| SEQ ID NO 30986 | TCTAGAATCCAAAACTGTGT | CAG | chr3 | 120680765 | 120680784 | 120680768 | - |
| SEQ ID NO 30987 | AAACTGTGTCAGCCAAATTT | GAG | chr3 | 120680754 | 120680773 | 120680757 | - |
| SEQ ID NO 30988 | GTCAGCCAAATTTGAGTTGA | TGG | chr3 | 120680747 | 120680766 | 120680750 | - |
| SEQ ID NO 30989 | CAGCCAAATTTGAGTTGATG | GAG | chr3 | 120680745 | 120680764 | 120680748 | - |
| SEQ ID NO 30990 | AGCCAAATTTGAGTTGATGG | AGG | chr3 | 120680744 | 120680763 | 120680747 | - |
| SEQ ID NO 30991 | GCCAAATTTGAGTTGATGGA | GGG | chr3 | 120680743 | 120680762 | 120680746 | - |
| SEQ ID NO 30992 | AATTTGAGTTGATGGAGGGA | CAG | chr3 | 120680739 | 120680758 | 120680742 | - |
| SEQ ID NO 30993 | GATGGAGGGACAGCCAAACT | GAG | chr3 | 120680729 | 120680748 | 120680732 | - |
| SEQ ID NO 30994 | GACAGCCAAACTGAGATACC | CAG | chr3 | 120680721 | 120680740 | 120680724 | - |
| SEQ ID NO 30995 | ACAGCCAAACTGAGATACCC | AGG | chr3 | 120680720 | 120680739 | 120680723 | - |
| SEQ ID NO 30996 | GCCAAACTGAGATACCCAGG | CGG | chr3 | 120680717 | 120680736 | 120680720 | - |
| SEQ ID NO 30997 | AAACTGAGATACCCAGGCGG | TGG | chr3 | 120680714 | 120680733 | 120680717 | - |
| SEQ ID NO 30998 | TGAGATACCCAGGCGGTGGT | TGG | chr3 | 120680710 | 120680729 | 120680713 | - |
| SEQ ID NO 30999 | CCAGGCGGTGGTTGGATTTA | TGG | chr3 | 120680702 | 120680721 | 120680705 | - |
| SEQ ID NO 31000 | GGTGGTTGGATTTATGGATC | TGG | chr3 | 120680696 | 120680715 | 120680699 | - |
| SEQ ID NO 31001 | GGATTTATGGATCTGGATTT | CAG | chr3 | 120680689 | 120680708 | 120680692 | - |
| SEQ ID NO 31002 | GATTTATGGATCTGGATTTC | AGG | chr3 | 120680688 | 120680707 | 120680691 | - |
| SEQ ID NO 31003 | ATTTATGGATCTGGATTTCA | GGG | chr3 | 120680687 | 120680706 | 120680690 | - |
| SEQ ID NO 31004 | TTTATGGATCTGGATTTCAG | GGG | chr3 | 120680686 | 120680705 | 120680689 | - |
| SEQ ID NO 31005 | TATGGATCTGGATTTCAGGG | GAG | chr3 | 120680684 | 120680703 | 120680687 | - |
| SEQ ID NO 31006 | GGATCTGGATTTCAGGGGAG | TGG | chr3 | 120680681 | 120680700 | 120680684 | - |
| SEQ ID NO 31007 | GATCTGGATTTCAGGGGAGT | GGG | chr3 | 120680680 | 120680699 | 120680683 | - |
| SEQ ID NO 31008 | CTGGATTTCAGGGGAGTGGG | CAG | chr3 | 120680677 | 120680696 | 120680680 | - |
| SEQ ID NO 31009 | TGGATTTCAGGGGAGTGGGC | AGG | chr3 | 120680676 | 120680695 | 120680679 | - |
| SEQ ID NO 31010 | GGATTTCAGGGGAGTGGGCA | GGG | chr3 | 120680675 | 120680694 | 120680678 | - |
| SEQ ID NO 31011 | TTCAGGGGAGTGGGCAGGGC | TAG | chr3 | 120680671 | 120680690 | 120680674 | - |
| SEQ ID NO 31012 | TCAGGGGAGTGGGCAGGGCT | AGG | chr3 | 120680670 | 120680689 | 120680673 | - |
| SEQ ID NO 31013 | CAGGGGAGTGGGCAGGGCTA | GGG | chr3 | 120680669 | 120680688 | 120680672 | - |
| SEQ ID NO 31014 | AGGGGAGTGGGCAGGGCTAG | GGG | chr3 | 120680668 | 120680687 | 120680671 | - |
| SEQ ID NO 31015 | AGTGGGCAGGGCTAGGGGAA | TAG | chr3 | 120680663 | 120680682 | 120680666 | - |
| SEQ ID NO 31016 | AGGGCTAGGGGAATAGAACT | GAG | chr3 | 120680656 | 120680675 | 120680659 | - |
| SEQ ID NO 31017 | GGGCTAGGGGAATAGAACTG | AGG | chr3 | 120680655 | 120680674 | 120680658 | - |
| SEQ ID NO 31018 | GGCTAGGGGAATAGAACTGA | GGG | chr3 | 120680654 | 120680673 | 120680657 | - |
| SEQ ID NO 31019 | AGAACTGAGGGTCATGATGT | CAG | chr3 | 120680642 | 120680661 | 120680645 | - |
| SEQ ID NO 31020 | ACTGAGGGTCATGATGTCAG | TGG | chr3 | 120680639 | 120680658 | 120680642 | - |
| SEQ ID NO 31021 | GAGGGTCATGATGTCAGTGG | TAG | chr3 | 120680636 | 120680655 | 120680639 | - |
| SEQ ID NO 31022 | AGGGTCATGATGTCAGTGGT | AGG | chr3 | 120680635 | 120680654 | 120680638 | - |
| SEQ ID NO 31023 | GGTCATGATGTCAGTGGTAG | GAG | chr3 | 120680633 | 120680652 | 120680636 | - |
| SEQ ID NO 31024 | GATGTCAGTGGTAGGAGTTG | AAG | chr3 | 120680627 | 120680646 | 120680630 | - |
| SEQ ID NO 31025 | AGTGGTAGGAGTTGAAGTCT | TGG | chr3 | 120680621 | 120680640 | 120680624 | - |
| SEQ ID NO 31026 | GGTAGGAGTTGAAGTCTTGG | AAG | chr3 | 120680618 | 120680637 | 120680621 | - |
| SEQ ID NO 31027 | GGAGTTGAAGTCTTGGAAGA | AAG | chr3 | 120680614 | 120680633 | 120680617 | - |
| SEQ ID NO 31028 | AGTTGAAGTCTTGGAAGAAA | GAG | chr3 | 120680612 | 120680631 | 120680615 | - |
| SEQ ID NO 31029 | TGAAGTCTTGGAAGAAAGAG | TAG | chr3 | 120680609 | 120680628 | 120680612 | - |

Figure 49 (Cont'd)

| | | | | | | |
|---|---|---|---|---|---|---|
| SEQ ID NO 31030 | GTCTTGGAAGAAAGAGTAGA | TAG | chr3 | 120680605 | 120680624 | 120680608 - |
| SEQ ID NO 31031 | TTTTCTGATGAACATTCTAT | GAG | chr3 | 120680574 | 120680593 | 120680577 - |
| SEQ ID NO 31032 | TTTCTGATGAACATTCTATG | AGG | chr3 | 120680573 | 120680592 | 120680576 - |
| SEQ ID NO 31033 | CTGATGAACATTCTATGAGG | AAG | chr3 | 120680570 | 120680589 | 120680573 - |
| SEQ ID NO 31034 | GAACATTCTATGAGGAAGTT | CAG | chr3 | 120680565 | 120680584 | 120680568 - |
| SEQ ID NO 31035 | CATTCTATGAGGAAGTTCAG | CAG | chr3 | 120680562 | 120680581 | 120680565 - |
| SEQ ID NO 31036 | TTCTATGAGGAAGTTCAGCA | GAG | chr3 | 120680560 | 120680579 | 120680563 - |
| SEQ ID NO 31037 | TCTATGAGGAAGTTCAGCAG | AGG | chr3 | 120680559 | 120680578 | 120680562 - |
| SEQ ID NO 31038 | TGAGGAAGTTCAGCAGAGGT | TGG | chr3 | 120680555 | 120680574 | 120680558 - |
| SEQ ID NO 31039 | CCTATCCTGCTGTCATGTTT | AAG | chr3 | 120680493 | 120680512 | 120680496 - |
| SEQ ID NO 31040 | TTTAAGCAACTTATTATGCA | CAG | chr3 | 120680476 | 120680495 | 120680479 - |
| SEQ ID NO 31041 | CAACTTATTATGCACAGCAC | CAG | chr3 | 120680470 | 120680489 | 120680473 - |
| SEQ ID NO 31042 | AACTTATTATGCACAGCACC | AGG | chr3 | 120680469 | 120680488 | 120680472 - |
| SEQ ID NO 31043 | CATCAATGTAAATTGCATGC | CAG | chr3 | 120680445 | 120680464 | 120680448 - |
| SEQ ID NO 31044 | TGCATGCCAGTCTTTGCTCT | CAG | chr3 | 120680432 | 120680451 | 120680435 - |
| SEQ ID NO 31045 | AGTCTTTGCTCTCAGTTTCA | AAG | chr3 | 120680424 | 120680443 | 120680427 - |
| SEQ ID NO 31046 | GTCTTTGCTCTCAGTTTCAA | AGG | chr3 | 120680423 | 120680442 | 120680426 - |
| SEQ ID NO 31047 | CCTGCTGTCAATCTTTACA | AAG | chr3 | 120680388 | 120680407 | 120680391 - |
| SEQ ID NO 31048 | CTGTCAATCTTTACAAAGA | AAG | chr3 | 120680384 | 120680403 | 120680387 - |
| SEQ ID NO 31049 | TGTCTAATCTTTACAAAGAA | AGG | chr3 | 120680383 | 120680402 | 120680386 - |
| SEQ ID NO 31050 | TTACAAAGAAAGGTTAACTC | CAG | chr3 | 120680373 | 120680392 | 120680376 - |
| SEQ ID NO 31051 | ACAAAGAAAGGTTAACTCCA | GAG | chr3 | 120680371 | 120680390 | 120680374 - |
| SEQ ID NO 31052 | CAAAGAAAGGTTAACTCCAG | AGG | chr3 | 120680370 | 120680389 | 120680373 - |
| SEQ ID NO 31053 | GAAAGGTTAACTCCAGAGGT | CAG | chr3 | 120680366 | 120680385 | 120680369 - |
| SEQ ID NO 31054 | AAAGGTTAACTCCAGAGGTC | AGG | chr3 | 120680365 | 120680384 | 120680368 - |
| SEQ ID NO 31055 | AGAGGTCAGGAATCTGAACA | CAG | chr3 | 120680352 | 120680371 | 120680355 - |
| SEQ ID NO 31056 | GGAATCTGAACACAGAAAAC | CAG | chr3 | 120680344 | 120680363 | 120680347 - |
| SEQ ID NO 31057 | TTAATGAATATGTCAACACA | AAG | chr3 | 120680246 | 120680265 | 120680249 - |
| SEQ ID NO 31058 | ATGAAATCACATTTACACAA | AAG | chr3 | 120680217 | 120680236 | 120680220 - |
| SEQ ID NO 31059 | CATTTACACAAAGTACAAC | TGG | chr3 | 120680208 | 120680227 | 120680211 - |
| SEQ ID NO 31060 | ATTTACACAAAGTACAACT | GGG | chr3 | 120680207 | 120680226 | 120680210 - |
| SEQ ID NO 31061 | TTTACACAAAGTACAACTG | GGG | chr3 | 120680206 | 120680225 | 120680209 - |
| SEQ ID NO 31062 | CACAAAGTACAACTGGGGT | AAG | chr3 | 120680202 | 120680221 | 120680205 - |
| SEQ ID NO 31063 | ACTGGGGTAAGAAAATTCAA | AAG | chr3 | 120680190 | 120680209 | 120680193 - |
| SEQ ID NO 31064 | GTAAGAAAATTCAAAGATA | AAG | chr3 | 120680184 | 120680203 | 120680187 - |
| SEQ ID NO 31065 | ATGAAATACCCTATGTATTT | GAG | chr3 | 120680142 | 120680161 | 120680145 - |
| SEQ ID NO 31066 | AATACCCTATGTATTTGAGT | AAG | chr3 | 120680138 | 120680157 | 120680141 - |
| SEQ ID NO 31067 | ATGTATTTGAGTAAGTTGCT | TAG | chr3 | 120680130 | 120680149 | 120680133 - |
| SEQ ID NO 31068 | TGCTTAGCTTCTCCCAACCT | TGG | chr3 | 120680114 | 120680133 | 120680117 - |
| SEQ ID NO 31069 | GTTTCCTCATTTCTAAAACG | AAG | chr3 | 120680092 | 120680111 | 120680095 - |
| SEQ ID NO 31070 | CGAAGAACTTGCTTAATATT | CAG | chr3 | 120680074 | 120680093 | 120680077 - |
| SEQ ID NO 31071 | GAAGAACTTGCTTAATATTC | AGG | chr3 | 120680073 | 120680092 | 120680076 - |
| SEQ ID NO 31072 | CTTGCTTAATATTCAGGCTC | TGG | chr3 | 120680067 | 120680086 | 120680070 - |
| SEQ ID NO 31073 | TTGCTTAATATTCAGGCTCT | GGG | chr3 | 120680066 | 120680085 | 120680069 - |
| SEQ ID NO 31074 | CCACCAAATCCTTGATTCAC | TGG | chr3 | 120680038 | 120680057 | 120680041 - |
| SEQ ID NO 31075 | AATCCTTGATTCACTGGCTC | TGG | chr3 | 120680032 | 120680051 | 120680035 - |
| SEQ ID NO 31076 | ATCCTTGATTCACTGGCTCT | GGG | chr3 | 120680031 | 120680050 | 120680034 - |

Figure 49 (Cont'd)

| SEQ ID NO | Sequence | PAM | Chr | Start | End | Pos | Strand |
|---|---|---|---|---|---|---|---|
| SEQ ID NO 31077 | GCTCTGGGTCTGTATGTAAC | AAG | chr3 | 120680016 | 120680035 | 120680019 | - |
| SEQ ID NO 31078 | GTCTGTATGTAACAAGCTTC | TGG | chr3 | 120680009 | 120680028 | 120680012 | - |
| SEQ ID NO 31079 | CTGTATGTAACAAGCTTCTG | GAG | chr3 | 120680007 | 120680026 | 120680010 | - |
| SEQ ID NO 31080 | TCTGGAGTGATTCTAATGAT | TAG | chr3 | 120679991 | 120680010 | 120679994 | - |
| SEQ ID NO 31081 | GAGTGATTCTAATGATTAGC | CAG | chr3 | 120679987 | 120680006 | 120679990 | - |
| SEQ ID NO 31082 | GTGATTCTAATGATTAGCCA | GAG | chr3 | 120679985 | 120680004 | 120679988 | - |
| SEQ ID NO 31083 | TTCTAATGATTAGCCAGAGA | CAG | chr3 | 120679981 | 120680000 | 120679984 | - |
| SEQ ID NO 31084 | TCTAATGATTAGCCAGAGAC | AGG | chr3 | 120679980 | 120679999 | 120679983 | - |
| SEQ ID NO 31085 | AAAAATTACCACAAATTTAT | TGG | chr3 | 120679917 | 120679936 | 120679920 | - |
| SEQ ID NO 31086 | AACACAAATGTATTATCTTG | AAG | chr3 | 120679886 | 120679905 | 120679889 | - |
| SEQ ID NO 31087 | AATGTATTATCTTGAAGTTG | TGG | chr3 | 120679880 | 120679899 | 120679883 | - |
| SEQ ID NO 31088 | TGTATTATCTTGAAGTTGTG | GAG | chr3 | 120679878 | 120679897 | 120679881 | - |
| SEQ ID NO 31089 | GTATTATCTTGAAGTTGTGG | AGG | chr3 | 120679877 | 120679896 | 120679880 | - |
| SEQ ID NO 31090 | TATCTTGAAGTTGTGGAGGT | CAG | chr3 | 120679873 | 120679892 | 120679876 | - |
| SEQ ID NO 31091 | CTTGAAGTTGTGGAGGTCAG | AAG | chr3 | 120679870 | 120679889 | 120679873 | - |
| SEQ ID NO 31092 | GGAGGTCAGAAGTCTGAAAT | CGG | chr3 | 120679859 | 120679878 | 120679862 | - |
| SEQ ID NO 31093 | AAGTCTGAAATCGGTTTCAC | TGG | chr3 | 120679850 | 120679869 | 120679853 | - |
| SEQ ID NO 31094 | AGTCTGAAATCGGTTTCACT | GGG | chr3 | 120679849 | 120679868 | 120679852 | - |
| SEQ ID NO 31095 | AAATCGGTTTCACTGGGCTA | AAG | chr3 | 120679843 | 120679862 | 120679846 | - |
| SEQ ID NO 31096 | GGTTTCACTGGGCTAAAGTC | GAG | chr3 | 120679838 | 120679857 | 120679841 | - |
| SEQ ID NO 31097 | GTTTCACTGGGCTAAAGTCG | AGG | chr3 | 120679837 | 120679856 | 120679840 | - |
| SEQ ID NO 31098 | CTGGGCTAAAGTCGAGGTGT | CAG | chr3 | 120679831 | 120679850 | 120679834 | - |
| SEQ ID NO 31099 | CTAAAGTCGAGGTGTCAGTG | TGG | chr3 | 120679826 | 120679845 | 120679829 | - |
| SEQ ID NO 31100 | GTCAGTGTGGCTGTTTCTTC | TGG | chr3 | 120679813 | 120679832 | 120679816 | - |
| SEQ ID NO 31101 | CAGTGTGGCTGTTTCTTCTG | GAG | chr3 | 120679811 | 120679830 | 120679814 | - |
| SEQ ID NO 31102 | GTTTCTTCTGGAGACTCTAT | GAG | chr3 | 120679801 | 120679820 | 120679804 | - |
| SEQ ID NO 31103 | TTCTTCTGGAGACTCTATGA | GAG | chr3 | 120679799 | 120679818 | 120679802 | - |
| SEQ ID NO 31104 | GTGTTTTCCTGCCTTTTCCA | TGG | chr3 | 120679773 | 120679792 | 120679776 | - |
| SEQ ID NO 31105 | ATGGATTCTGTTTCCTCTTC | TAG | chr3 | 120679754 | 120679773 | 120679757 | - |
| SEQ ID NO 31106 | GGATTCTGTTTCCTCTTCTA | GAG | chr3 | 120679752 | 120679771 | 120679755 | - |
| SEQ ID NO 31107 | GATTCTGTTTCCTCTTCTAG | AGG | chr3 | 120679751 | 120679770 | 120679754 | - |
| SEQ ID NO 31108 | TAGAGGCTACCCACATTCCT | TGG | chr3 | 120679734 | 120679753 | 120679737 | - |
| SEQ ID NO 31109 | TACCCACATTCCTTGGTTTG | TAG | chr3 | 120679727 | 120679746 | 120679730 | - |
| SEQ ID NO 31110 | GTCACATTTCTCCTCTTAT | AAG | chr3 | 120679657 | 120679676 | 120679660 | - |
| SEQ ID NO 31111 | ATGACACTTGTGATTACATT | TAG | chr3 | 120679606 | 120679625 | 120679609 | - |
| SEQ ID NO 31112 | TGACACTTGTGATTACATTT | AGG | chr3 | 120679605 | 120679624 | 120679608 | - |
| SEQ ID NO 31113 | TTAGGATACACCCAAATAAT | TAG | chr3 | 120679587 | 120679606 | 120679590 | - |
| SEQ ID NO 31114 | TAGGATACACCCAAATAATT | AGG | chr3 | 120679586 | 120679605 | 120679589 | - |
| SEQ ID NO 31115 | TTAGGATATCTCCCCATCCC | AAG | chr3 | 120679568 | 120679587 | 120679571 | - |
| SEQ ID NO 31116 | ATCCTTAATTATATATGCAA | AAG | chr3 | 120679545 | 120679564 | 120679548 | - |
| SEQ ID NO 31117 | TATATATGCAAAGTCTGTT | TGG | chr3 | 120679536 | 120679555 | 120679539 | - |
| SEQ ID NO 31118 | TATGCAAAGTCTGTTTGGC | TAG | chr3 | 120679532 | 120679551 | 120679535 | - |
| SEQ ID NO 31119 | AAAAGTCTGTTTGGCTAGAA | AAG | chr3 | 120679527 | 120679546 | 120679530 | - |
| SEQ ID NO 31120 | GCTAGAAAAGATAATACTCA | CAG | chr3 | 120679514 | 120679533 | 120679517 | - |
| SEQ ID NO 31121 | CTAGAAAAGATAATACTCAC | AGG | chr3 | 120679513 | 120679532 | 120679516 | - |
| SEQ ID NO 31122 | AAGATAATACTCACAGGTTT | CAG | chr3 | 120679507 | 120679526 | 120679510 | - |
| SEQ ID NO 31123 | AGATAATACTCACAGGTTTC | AGG | chr3 | 120679506 | 120679525 | 120679509 | - |

Figure 49 (Cont'd)

| | | | | | | | |
|---|---|---|---|---|---|---|---|
| SEQ ID NO 31124 | GATAATACTCACAGGTTTCA | GGG | chr3 | 120679505 | 120679524 | 120679508 | - |
| SEQ ID NO 31125 | ATAATACTCACAGGTTTCAG | GGG | chr3 | 120679504 | 120679523 | 120679507 | - |
| SEQ ID NO 31126 | ACTCACAGGTTTCAGGGGTT | AAG | chr3 | 120679499 | 120679518 | 120679502 | - |
| SEQ ID NO 31127 | GTTAAGCCATACATATCTTT | CAG | chr3 | 120679482 | 120679501 | 120679485 | - |
| SEQ ID NO 31128 | TAAGCCATACATATCTTTCA | GAG | chr3 | 120679480 | 120679499 | 120679483 | - |
| SEQ ID NO 31129 | CCATACATATCTTTCAGAGT | GAG | chr3 | 120679476 | 120679495 | 120679479 | - |
| SEQ ID NO 31130 | TATCTTTCAGAGTGAGCCAT | TAG | chr3 | 120679469 | 120679488 | 120679472 | - |
| SEQ ID NO 31131 | GTGAGCCATTAGCCATTATT | CAG | chr3 | 120679458 | 120679477 | 120679461 | - |
| SEQ ID NO 31132 | AGCCTACTGCGATAATGTGC | AAG | chr3 | 120679437 | 120679456 | 120679440 | - |
| SEQ ID NO 31133 | CTATGTTCTATGTTCCCATC | AAG | chr3 | 120679401 | 120679420 | 120679404 | - |
| SEQ ID NO 31134 | TATGTTCTATGTTCCCATCA | AGG | chr3 | 120679400 | 120679419 | 120679403 | - |
| SEQ ID NO 31135 | ATGTTCCCATCAAGGTTAAT | TAG | chr3 | 120679392 | 120679411 | 120679395 | - |
| SEQ ID NO 31136 | TCAAGGTTAATTAGAAATAT | TAG | chr3 | 120679383 | 120679402 | 120679386 | - |
| SEQ ID NO 31137 | AATATTAGACTCTTTTTCCA | CAG | chr3 | 120679368 | 120679387 | 120679371 | - |
| SEQ ID NO 31138 | TTCCACAGAAAAAAAAAATG | TAG | chr3 | 120679353 | 120679372 | 120679356 | - |
| SEQ ID NO 31139 | CACAGAAAAAAAAAATGTAG | CAG | chr3 | 120679350 | 120679369 | 120679353 | - |
| SEQ ID NO 31140 | AGAAAAAAAAAATGTAGCAG | TAG | chr3 | 120679347 | 120679366 | 120679350 | - |
| SEQ ID NO 31141 | CTCTCTCTTTCCTTCATGCC | CAG | chr3 | 120679304 | 120679323 | 120679307 | - |
| SEQ ID NO 31142 | CTCTTTCCTTCATGCCCAGT | AAG | chr3 | 120679300 | 120679319 | 120679303 | - |
| SEQ ID NO 31143 | CTTTCCTTCATGCCCAGTAA | GAG | chr3 | 120679298 | 120679317 | 120679301 | - |
| SEQ ID NO 31144 | TTTCCTTCATGCCCAGTAAG | AGG | chr3 | 120679297 | 120679316 | 120679300 | - |
| SEQ ID NO 31145 | CCTTCATGCCCAGTAAGAGG | AAG | chr3 | 120679294 | 120679313 | 120679297 | - |
| SEQ ID NO 31146 | CATGCCCAGTAAGAGGAAGT | GAG | chr3 | 120679290 | 120679309 | 120679293 | - |
| SEQ ID NO 31147 | ATGCCCAGTAAGAGGAAGTG | AGG | chr3 | 120679289 | 120679308 | 120679292 | - |
| SEQ ID NO 31148 | GCACCATCTGTTCATCTCAT | CAG | chr3 | 120679265 | 120679284 | 120679268 | - |
| SEQ ID NO 31149 | CACCATCTGTTCATCTCATC | AGG | chr3 | 120679264 | 120679283 | 120679267 | - |
| SEQ ID NO 31150 | TCATCTCATCAGGTGTTACC | TAG | chr3 | 120679254 | 120679273 | 120679257 | - |
| SEQ ID NO 31151 | CATCAGGTGTTACCTAGAAT | CAG | chr3 | 120679248 | 120679267 | 120679251 | - |
| SEQ ID NO 31152 | TCAGGTGTTACCTAGAATCA | GAG | chr3 | 120679246 | 120679265 | 120679249 | - |
| SEQ ID NO 31153 | GTGTTACCTAGAATCAGAGT | CAG | chr3 | 120679242 | 120679261 | 120679245 | - |
| SEQ ID NO 31154 | TGTTACCTAGAATCAGAGTC | AGG | chr3 | 120679241 | 120679260 | 120679244 | - |
| SEQ ID NO 31155 | TTACCTAGAATCAGAGTCAG | GAG | chr3 | 120679239 | 120679258 | 120679242 | - |
| SEQ ID NO 31156 | CTAGAATCAGAGTCAGGAGA | AAG | chr3 | 120679235 | 120679254 | 120679238 | - |
| SEQ ID NO 31157 | CCTCATAAAACTACTCTGAC | AAG | chr3 | 120679210 | 120679229 | 120679213 | - |
| SEQ ID NO 31158 | CTGACAAGTAAACCATATCC | TGG | chr3 | 120679195 | 120679214 | 120679198 | - |
| SEQ ID NO 31159 | TGACAAGTAAACCATATCCT | GGG | chr3 | 120679194 | 120679213 | 120679197 | - |
| SEQ ID NO 31160 | GACAAGTAAACCATATCCTG | GGG | chr3 | 120679193 | 120679212 | 120679196 | - |
| SEQ ID NO 31161 | GTAAACCATATCCTGGGGAC | CAG | chr3 | 120679188 | 120679207 | 120679191 | - |
| SEQ ID NO 31162 | TAAACCATATCCTGGGGACC | AGG | chr3 | 120679187 | 120679206 | 120679190 | - |
| SEQ ID NO 31163 | CCATATCCTGGGGACCAGGT | GAG | chr3 | 120679183 | 120679202 | 120679186 | - |
| SEQ ID NO 31164 | GGGACCAGGTGAGAATTAAA | AAG | chr3 | 120679173 | 120679192 | 120679176 | - |
| SEQ ID NO 31165 | TTAAAAGCTGTATACTCAT | AAG | chr3 | 120679158 | 120679177 | 120679161 | - |
| SEQ ID NO 31166 | TGTATACTCATAAGCTGCCA | AAG | chr3 | 120679149 | 120679168 | 120679152 | - |
| SEQ ID NO 31167 | TATACTCATAAGCTGCCAAA | GAG | chr3 | 120679147 | 120679166 | 120679150 | - |
| SEQ ID NO 31168 | ATAAGCTGCCAAAGAGCTGA | TGG | chr3 | 120679140 | 120679159 | 120679143 | - |
| SEQ ID NO 31169 | CCAAAGAGCTGATGGTACTG | AAG | chr3 | 120679132 | 120679151 | 120679135 | - |
| SEQ ID NO 31170 | CTGATGGTACTGAAGTCACA | TGG | chr3 | 120679124 | 120679143 | 120679127 | - |

Figure 49 (Cont'd)

| SEQ ID | Sequence | Codon | Chr | Start | End | Pos | Strand |
|---|---|---|---|---|---|---|---|
| SEQ ID NO 31171 | GATGGTACTGAAGTCACATG | GAG | chr3 | 120679122 | 120679141 | 120679125 | - |
| SEQ ID NO 31172 | TACTGAAGTCACATGGAGCT | CAG | chr3 | 120679117 | 120679136 | 120679120 | - |
| SEQ ID NO 31173 | ACTGAAGTCACATGGAGCTC | AGG | chr3 | 120679116 | 120679135 | 120679119 | - |
| SEQ ID NO 31174 | CAGGAATTTATTCTTGCATT | TAG | chr3 | 120679097 | 120679116 | 120679100 | - |
| SEQ ID NO 31175 | AATTTATTCTTGCATTTAGA | AAG | chr3 | 120679093 | 120679112 | 120679096 | - |
| SEQ ID NO 31176 | ATGCATATAATTCTCTCGAA | AAG | chr3 | 120679069 | 120679088 | 120679072 | - |
| SEQ ID NO 31177 | ATGAAATCATATTTTTCTGT | CGG | chr3 | 120679044 | 120679063 | 120679047 | - |
| SEQ ID NO 31178 | TTCTGTCGGATCAAATTATT | CAG | chr3 | 120679030 | 120679049 | 120679033 | - |
| SEQ ID NO 31179 | TTATTCAGAAATCCGAACTG | TAG | chr3 | 120679015 | 120679034 | 120679018 | - |
| SEQ ID NO 31180 | CAAACACACTTGCTTAATGT | TAG | chr3 | 120678984 | 120679003 | 120678987 | - |
| SEQ ID NO 31181 | TTTAATCTTATTTTTGTACA | CAG | chr3 | 120678958 | 120678977 | 120678961 | - |
| SEQ ID NO 31182 | GTACACAGTATACTTTTACA | TAG | chr3 | 120678943 | 120678962 | 120678946 | - |
| SEQ ID NO 31183 | TACACAGTATACTTTTACAT | AGG | chr3 | 120678942 | 120678961 | 120678945 | - |
| SEQ ID NO 31184 | CTTTTACATAGGCACTGAAC | CAG | chr3 | 120678931 | 120678950 | 120678934 | - |
| SEQ ID NO 31185 | TACATAGGCACTGAACCAGC | TGG | chr3 | 120678927 | 120678946 | 120678930 | - |
| SEQ ID NO 31186 | ACCAGCTGGAAATGAATGCT | TGG | chr3 | 120678913 | 120678932 | 120678916 | - |
| SEQ ID NO 31187 | AATGAATGCTTGGATTTTCG | CAG | chr3 | 120678903 | 120678922 | 120678906 | - |
| SEQ ID NO 31188 | TGGATTTTCGCAGCTGATAA | AAG | chr3 | 120678893 | 120678912 | 120678896 | - |
| SEQ ID NO 31189 | ATTTTCGCAGCTGATAAAAG | CAG | chr3 | 120678890 | 120678909 | 120678893 | - |
| SEQ ID NO 31190 | TTTCGCAGCTGATAAAAGCA | GAG | chr3 | 120678888 | 120678907 | 120678891 | - |
| SEQ ID NO 31191 | CAGCTGATAAAAGCAGAGTT | CAG | chr3 | 120678883 | 120678902 | 120678886 | - |
| SEQ ID NO 31192 | AGAGTTCAGATTCTGTCCTT | GAG | chr3 | 120678869 | 120678888 | 120678872 | - |
| SEQ ID NO 31193 | CTGTCCTTGAGCTCAATGTC | TGG | chr3 | 120678857 | 120678876 | 120678860 | - |
| SEQ ID NO 31194 | GTCCTTGAGCTCAATGTCTG | GAG | chr3 | 120678855 | 120678874 | 120678858 | - |
| SEQ ID NO 31195 | TTGAGCTCAATGTCTGGAGA | AAG | chr3 | 120678851 | 120678870 | 120678854 | - |
| SEQ ID NO 31196 | AGCTCAATGTCTGGAGAAAG | CAG | chr3 | 120678848 | 120678867 | 120678851 | - |
| SEQ ID NO 31197 | TGAATACTGCTTCCTTAATT | CAG | chr3 | 120678822 | 120678841 | 120678825 | - |
| SEQ ID NO 31198 | TTCCTTAATTCAGATGCCTT | TGG | chr3 | 120678812 | 120678831 | 120678815 | - |
| SEQ ID NO 31199 | ATTCAGATGCCTTTGGCCGT | GAG | chr3 | 120678805 | 120678824 | 120678808 | - |
| SEQ ID NO 31200 | TTCAGATGCCTTTGGCCGTG | AGG | chr3 | 120678804 | 120678823 | 120678807 | - |
| SEQ ID NO 31201 | TCAGATGCCTTTGGCCGTGA | GGG | chr3 | 120678803 | 120678822 | 120678806 | - |
| SEQ ID NO 31202 | CAGATGCCTTTGGCCGTGAG | GGG | chr3 | 120678802 | 120678821 | 120678805 | - |
| SEQ ID NO 31203 | GCCTTTGGCCGTGAGGGGCA | TGG | chr3 | 120678797 | 120678816 | 120678800 | - |
| SEQ ID NO 31204 | GTGAGGGGCATGGCATTTTA | AAG | chr3 | 120678787 | 120678806 | 120678790 | - |
| SEQ ID NO 31205 | AAACTCTGTACTTTTTCTCT | CAG | chr3 | 120678757 | 120678776 | 120678760 | - |
| SEQ ID NO 31206 | AACTCTGTACTTTTTCTCTC | AGG | chr3 | 120678756 | 120678775 | 120678759 | - |
| SEQ ID NO 31207 | ACTCTGTACTTTTTCTCTCA | GGG | chr3 | 120678755 | 120678774 | 120678758 | - |
| SEQ ID NO 31208 | CTCTGTACTTTTTCTCTCAG | GGG | chr3 | 120678754 | 120678773 | 120678757 | - |
| SEQ ID NO 31209 | TACTTTTTCTCTCAGGGGAT | TAG | chr3 | 120678749 | 120678768 | 120678752 | - |
| SEQ ID NO 31210 | AGAAAACCAATTGATTTGA | TAG | chr3 | 120678728 | 120678747 | 120678731 | - |
| SEQ ID NO 31211 | CAATTGATTTGATAGTGACT | CAG | chr3 | 120678720 | 120678739 | 120678723 | - |
| SEQ ID NO 31212 | TTGATTTGATAGTGACTCAG | CAG | chr3 | 120678717 | 120678736 | 120678720 | - |
| SEQ ID NO 31213 | GCAGTTTTCACCTTCCTCTT | TAG | chr3 | 120678698 | 120678717 | 120678701 | - |
| SEQ ID NO 31214 | CCTCTTTAGCCAATGCCCTG | CAG | chr3 | 120678684 | 120678703 | 120678687 | - |
| SEQ ID NO 31215 | TTAGCCAATGCCCTGCAGCT | AAG | chr3 | 120678679 | 120678698 | 120678682 | - |
| SEQ ID NO 31216 | AATGCCCTGCAGCTAAGATT | GAG | chr3 | 120678673 | 120678692 | 120678676 | - |
| SEQ ID NO 31217 | CTGCAGCTAAGATTGAGAAA | CGG | chr3 | 120678667 | 120678686 | 120678670 | - |

Figure 49 (Cont'd)

| | | | | | | | |
|---|---|---|---|---|---|---|---|
| SEQ ID NO 31218 | CTAAGATTGAGAAACGGATT | CAG | chr3 | 120678661 | 120678680 | 120678664 | - |
| SEQ ID NO 31219 | GATTCAGAACTCACACCTCT | TGG | chr3 | 120678645 | 120678664 | 120678648 | - |
| SEQ ID NO 31220 | AACTCACACCTCTTGGTGCT | TGG | chr3 | 120678638 | 120678657 | 120678641 | - |
| SEQ ID NO 31221 | TCACACCTCTTGGTGCTTGG | TGG | chr3 | 120678635 | 120678654 | 120678638 | - |
| SEQ ID NO 31222 | GTGGCTCCCTTCCAAACCAT | CAG | chr3 | 120678616 | 120678635 | 120678619 | - |
| SEQ ID NO 31223 | ACTTTCTTTCCTATTTTTTA | AAG | chr3 | 120678582 | 120678601 | 120678585 | - |
| SEQ ID NO 31224 | CTTTCCTATTTTTTAAAGCA | CAG | chr3 | 120678577 | 120678596 | 120678580 | - |
| SEQ ID NO 31225 | TTTAAAGCACAGTCTGAATC | AAG | chr3 | 120678566 | 120678585 | 120678569 | - |
| SEQ ID NO 31226 | ACAGTCTGAATCAAGTGCTT | CAG | chr3 | 120678558 | 120678577 | 120678561 | - |
| SEQ ID NO 31227 | ATAACCCTGAACCCTCTTCT | AAG | chr3 | 120678504 | 120678523 | 120678507 | - |
| SEQ ID NO 31228 | TAACCCTGAACCCTCTTCTA | AGG | chr3 | 120678503 | 120678522 | 120678506 | - |
| SEQ ID NO 31229 | GAACCCTCTTCTAAGGCCAC | CAG | chr3 | 120678496 | 120678515 | 120678499 | - |
| SEQ ID NO 31230 | TTCTAAGGCCACCAGTTACA | AAG | chr3 | 120678488 | 120678507 | 120678491 | - |
| SEQ ID NO 31231 | AGGCCACCAGTTACAAAGAA | TGG | chr3 | 120678483 | 120678502 | 120678486 | - |
| SEQ ID NO 31232 | GGCCACCAGTTACAAAGAAT | GGG | chr3 | 120678482 | 120678501 | 120678485 | - |
| SEQ ID NO 31233 | GCCACCAGTTACAAAGAATG | GGG | chr3 | 120678481 | 120678500 | 120678484 | - |
| SEQ ID NO 31234 | ACCAGTTACAAAGAATGGGG | AAG | chr3 | 120678478 | 120678497 | 120678481 | - |
| SEQ ID NO 31235 | CCAGTTACAAAGAATGGGGA | AGG | chr3 | 120678477 | 120678496 | 120678480 | - |
| SEQ ID NO 31236 | AAAGAATGGGGAAGGTTAAT | GAG | chr3 | 120678469 | 120678488 | 120678472 | - |
| SEQ ID NO 31237 | AGGTTAATGAGTAACTCCAC | CAG | chr3 | 120678457 | 120678476 | 120678460 | - |
| SEQ ID NO 31238 | GTAACTCCACCAGTGCCTGC | CAG | chr3 | 120678447 | 120678466 | 120678450 | - |
| SEQ ID NO 31239 | CTCCACCAGTGCCTGCCAGA | AAG | chr3 | 120678443 | 120678462 | 120678446 | - |
| SEQ ID NO 31240 | CCAGTGCCTGCCAGAAAGCT | CAG | chr3 | 120678438 | 120678457 | 120678441 | - |
| SEQ ID NO 31241 | CAGAAAGCTCAGCTGTACTC | CAG | chr3 | 120678427 | 120678446 | 120678430 | - |
| SEQ ID NO 31242 | CAGCCTTCCTTCCTCTCTTG | CAG | chr3 | 120678407 | 120678426 | 120678410 | - |
| SEQ ID NO 31243 | GCCTTCCTTCCTCTCTTGCA | GAG | chr3 | 120678405 | 120678424 | 120678408 | - |
| SEQ ID NO 31244 | CTTCCTTCCTCTCTTGCAGA | GAG | chr3 | 120678403 | 120678422 | 120678406 | - |
| SEQ ID NO 31245 | TCTTGCAGAGAGAAACAATG | CGG | chr3 | 120678392 | 120678411 | 120678395 | - |
| SEQ ID NO 31246 | TGCAGAGAGAAACAATGCGG | CAG | chr3 | 120678389 | 120678408 | 120678392 | - |
| SEQ ID NO 31247 | AACAATGCGGCAGTTGAACA | AAG | chr3 | 120678379 | 120678398 | 120678382 | - |
| SEQ ID NO 31248 | TGCGGCAGTTGAACAAAGCG | AAG | chr3 | 120678374 | 120678393 | 120678377 | - |
| SEQ ID NO 31249 | GCGGCAGTTGAACAAAGCGA | AGG | chr3 | 120678373 | 120678392 | 120678376 | - |
| SEQ ID NO 31250 | AGCGAAGGCACTGTAATGCC | CAG | chr3 | 120678358 | 120678377 | 120678361 | - |
| SEQ ID NO 31251 | GAAGGCACTGTAATGCCCAG | TGG | chr3 | 120678355 | 120678374 | 120678358 | - |
| SEQ ID NO 31252 | ACTGTAATGCCCAGTGGCTT | CAG | chr3 | 120678349 | 120678368 | 120678352 | - |
| SEQ ID NO 31253 | ATGCCCAGTGGCTTCAGTCA | CAG | chr3 | 120678343 | 120678362 | 120678346 | - |
| SEQ ID NO 31254 | TGCCCAGTGGCTTCAGTCAC | AGG | chr3 | 120678342 | 120678361 | 120678345 | - |
| SEQ ID NO 31255 | CAGTGGCTTCAGTCACAGGC | TGG | chr3 | 120678338 | 120678357 | 120678341 | - |
| SEQ ID NO 31256 | TGGTCTAAAATTCCATTTCA | CAG | chr3 | 120678318 | 120678337 | 120678321 | - |
| SEQ ID NO 31257 | AATTCCATTTCACAGAATTG | AAG | chr3 | 120678310 | 120678329 | 120678313 | - |
| SEQ ID NO 31258 | TCACAGAATTGAAGATAATT | TGG | chr3 | 120678301 | 120678320 | 120678304 | - |
| SEQ ID NO 31259 | CACAGAATTGAAGATAATTT | GGG | chr3 | 120678300 | 120678319 | 120678303 | - |
| SEQ ID NO 31260 | ACAGAATTGAAGATAATTTG | GGG | chr3 | 120678299 | 120678318 | 120678302 | - |
| SEQ ID NO 31261 | TTGGGGTTATTACCAATTCT | CAG | chr3 | 120678282 | 120678301 | 120678285 | - |
| SEQ ID NO 31262 | GGGTTATTACCAATTCTCAG | CAG | chr3 | 120678279 | 120678298 | 120678282 | - |
| SEQ ID NO 31263 | CTCAAATTCAATCCCGTTGA | TGG | chr3 | 120678256 | 120678275 | 120678259 | - |
| SEQ ID NO 31264 | AATTCAATCCCGTTGATGGT | GAG | chr3 | 120678252 | 120678271 | 120678255 | - |

Figure 49 (Cont'd)

| | | | | | | | |
|---|---|---|---|---|---|---|---|
| SEQ ID NO 31265 | AATCCCGTTGATGGTGAGCA | TGG | chr3 | 120678247 | 120678266 | 120678250 | - |
| SEQ ID NO 31266 | ATCCCGTTGATGGTGAGCAT | GGG | chr3 | 120678246 | 120678265 | 120678249 | - |
| SEQ ID NO 31267 | TCCCGTTGATGGTGAGCATG | GGG | chr3 | 120678245 | 120678264 | 120678248 | - |
| SEQ ID NO 31268 | GTGAGCATGGGGTTCATTTT | GAG | chr3 | 120678234 | 120678253 | 120678237 | - |
| SEQ ID NO 31269 | GAGCATGGGGTTCATTTTGA | GAG | chr3 | 120678232 | 120678251 | 120678235 | - |
| SEQ ID NO 31270 | CATGGGGTTCATTTTGAGAG | TAG | chr3 | 120678229 | 120678248 | 120678232 | - |
| SEQ ID NO 31271 | TCATTTTGAGAGTAGAAAAT | TGG | chr3 | 120678221 | 120678240 | 120678224 | - |
| SEQ ID NO 31272 | TGAGAGTAGAAAATTGGATG | CAG | chr3 | 120678215 | 120678234 | 120678218 | - |
| SEQ ID NO 31273 | GAGTAGAAAATTGGATGCAG | TGG | chr3 | 120678212 | 120678231 | 120678215 | - |
| SEQ ID NO 31274 | GTAGAAAATTGGATGCAGTG | GAG | chr3 | 120678210 | 120678229 | 120678213 | - |
| SEQ ID NO 31275 | AATTGGATGCAGTGGAGAAT | CAG | chr3 | 120678204 | 120678223 | 120678207 | - |
| SEQ ID NO 31276 | GCAGTGGAGAATCAGAATGT | TGG | chr3 | 120678196 | 120678215 | 120678199 | - |
| SEQ ID NO 31277 | TGGAGAATCAGAATGTTGGA | TGG | chr3 | 120678192 | 120678211 | 120678195 | - |
| SEQ ID NO 31278 | TGGTCTCTGCCATTTCCCCA | AAG | chr3 | 120678172 | 120678191 | 120678175 | - |
| SEQ ID NO 31279 | TGCTGCTGCTTTTAACAAAT | CAG | chr3 | 120678132 | 120678151 | 120678135 | - |
| SEQ ID NO 31280 | TAACAAATCAGTATACAACT | TAG | chr3 | 120678120 | 120678139 | 120678123 | - |
| SEQ ID NO 31281 | TTTCAAATATACAAAATATT | GAG | chr3 | 120678077 | 120678096 | 120678080 | - |
| SEQ ID NO 31282 | TATACAAAATATTGAGTCTG | AAG | chr3 | 120678070 | 120678089 | 120678073 | - |
| SEQ ID NO 31283 | ATACAAAATATTGAGTCTGA | AGG | chr3 | 120678069 | 120678088 | 120678072 | - |
| SEQ ID NO 31284 | ATATTGAGTCTGAAGGCAAA | AAG | chr3 | 120678062 | 120678081 | 120678065 | - |
| SEQ ID NO 31285 | TTTTCACTTCCATTGCTTCC | TAG | chr3 | 120678033 | 120678052 | 120678036 | - |
| SEQ ID NO 31286 | TTTCACTTCCATTGCTTCCT | AGG | chr3 | 120678032 | 120678051 | 120678035 | - |
| SEQ ID NO 31287 | TCTGATATTTCTTCCAAATA | CAG | chr3 | 120677995 | 120678014 | 120677998 | - |
| SEQ ID NO 31288 | TTCCAAATACAGACTGTTGT | TGG | chr3 | 120677984 | 120678003 | 120677987 | - |
| SEQ ID NO 31289 | CTGATCATCACTCACACATC | CAG | chr3 | 120677960 | 120677979 | 120677963 | - |
| SEQ ID NO 31290 | TGATCATCACTCACACATCC | AGG | chr3 | 120677959 | 120677978 | 120677962 | - |
| SEQ ID NO 31291 | TGTTACATCTCCACGCCACT | GAG | chr3 | 120677934 | 120677953 | 120677937 | - |
| SEQ ID NO 31292 | ATCTCCACGCCACTGAGTAT | CAG | chr3 | 120677928 | 120677947 | 120677931 | - |
| SEQ ID NO 31293 | TCTCCACGCCACTGAGTATC | AGG | chr3 | 120677927 | 120677946 | 120677930 | - |
| SEQ ID NO 31294 | CTCCACGCCACTGAGTATCA | GGG | chr3 | 120677926 | 120677945 | 120677929 | - |
| SEQ ID NO 31295 | AACCTGCCCAATATTCACG | TAG | chr3 | 120677903 | 120677922 | 120677906 | - |
| SEQ ID NO 31296 | ACCTGCCCCAATATTCACGT | AGG | chr3 | 120677902 | 120677921 | 120677905 | - |
| SEQ ID NO 31297 | GGTTCTTTTCTATTTTCCCT | AAG | chr3 | 120677881 | 120677900 | 120677884 | - |
| SEQ ID NO 31298 | TTTCTATTTTCCCTAAGCGT | CGG | chr3 | 120677875 | 120677894 | 120677878 | - |
| SEQ ID NO 31299 | CCCTAAGCGTCGGCCAACTT | TAG | chr3 | 120677865 | 120677884 | 120677868 | - |
| SEQ ID NO 31300 | GTCGGCCAACTTTAGAAATA | AAG | chr3 | 120677857 | 120677876 | 120677860 | - |
| SEQ ID NO 31301 | TCGGCCAACTTTAGAAATAA | AGG | chr3 | 120677856 | 120677875 | 120677859 | - |
| SEQ ID NO 31302 | CGGCCAACTTTAGAAATAAA | GGG | chr3 | 120677855 | 120677874 | 120677858 | - |
| SEQ ID NO 31303 | CAACTTTAGAAATAAAGGGA | CAG | chr3 | 120677851 | 120677870 | 120677854 | - |
| SEQ ID NO 31304 | ACTTTAGAAATAAAGGGACA | GAG | chr3 | 120677849 | 120677868 | 120677852 | - |
| SEQ ID NO 31305 | AATAAAGGGACAGAGTACAA | AAG | chr3 | 120677841 | 120677860 | 120677844 | - |
| SEQ ID NO 31306 | TAAAGGGACAGAGTACAAAA | GAG | chr3 | 120677839 | 120677858 | 120677842 | - |
| SEQ ID NO 31307 | AAGGGACAGAGTACAAAAGA | GAG | chr3 | 120677837 | 120677856 | 120677840 | - |
| SEQ ID NO 31308 | TACAAAAGAGAGAAATTTTA | AAG | chr3 | 120677826 | 120677845 | 120677829 | - |
| SEQ ID NO 31309 | AAAGAGAGAAATTTTAAAGC | CGG | chr3 | 120677822 | 120677841 | 120677825 | - |
| SEQ ID NO 31310 | AAGAGAGAAATTTTAAAGCC | GGG | chr3 | 120677821 | 120677840 | 120677824 | - |
| SEQ ID NO 31311 | AAATTTTAAAGCCGGGCATC | CGG | chr3 | 120677814 | 120677833 | 120677817 | - |

Figure 49 (Cont'd)

| | | | | | | | |
|---|---|---|---|---|---|---|---|
| SEQ ID NO 31312 | AATTTTAAAGCCGGGCATCC | GGG | chr3 | 120677813 | 120677832 | 120677816 | - |
| SEQ ID NO 31313 | ATTTTAAAGCCGGGCATCCG | GGG | chr3 | 120677812 | 120677831 | 120677815 | - |
| SEQ ID NO 31314 | TTTTAAAGCCGGGCATCCGG | GGG | chr3 | 120677811 | 120677830 | 120677814 | - |
| SEQ ID NO 31315 | TTAAAGCCGGGCATCCGGGG | GAG | chr3 | 120677809 | 120677828 | 120677812 | - |
| SEQ ID NO 31316 | TAAAGCCGGGCATCCGGGGG | AGG | chr3 | 120677808 | 120677827 | 120677811 | - |
| SEQ ID NO 31317 | CCGGGGGAGGCATCACATTT | CGG | chr3 | 120677795 | 120677814 | 120677798 | - |
| SEQ ID NO 31318 | GGGGAGGCATCACATTTCGG | TAG | chr3 | 120677792 | 120677811 | 120677795 | - |
| SEQ ID NO 31319 | GGGAGGCATCACATTTCGGT | AGG | chr3 | 120677791 | 120677810 | 120677794 | - |
| SEQ ID NO 31320 | TAGGTTCCGTGATGCCCCAC | AAG | chr3 | 120677772 | 120677791 | 120677775 | - |
| SEQ ID NO 31321 | GCCCCACAAGCCACAAAAAC | CAG | chr3 | 120677759 | 120677778 | 120677762 | - |
| SEQ ID NO 31322 | CACAAGCCACAAAAACCAGC | AAG | chr3 | 120677755 | 120677774 | 120677758 | - |
| SEQ ID NO 31323 | AAAAACCAGCAAGTTTGTAT | TAG | chr3 | 120677745 | 120677764 | 120677748 | - |
| SEQ ID NO 31324 | AAAACCAGCAAGTTTGTATT | AGG | chr3 | 120677744 | 120677763 | 120677747 | - |
| SEQ ID NO 31325 | AAACCAGCAAGTTTGTATTA | GGG | chr3 | 120677743 | 120677762 | 120677746 | - |
| SEQ ID NO 31326 | TTGTATTAGGGATTTTCAAA | TGG | chr3 | 120677731 | 120677750 | 120677734 | - |
| SEQ ID NO 31327 | TGTATTAGGGATTTTCAAAT | GGG | chr3 | 120677730 | 120677749 | 120677733 | - |
| SEQ ID NO 31328 | GTATTAGGGATTTTCAAATG | GGG | chr3 | 120677729 | 120677748 | 120677732 | - |
| SEQ ID NO 31329 | ATTAGGGATTTTCAAATGGG | GAG | chr3 | 120677727 | 120677746 | 120677730 | - |
| SEQ ID NO 31330 | TTAGGGATTTTCAAATGGGG | AGG | chr3 | 120677726 | 120677745 | 120677729 | - |
| SEQ ID NO 31331 | GGGATTTTCAAATGGGGAGG | CAG | chr3 | 120677723 | 120677742 | 120677726 | - |
| SEQ ID NO 31332 | ATGGGGAGGCAGTGTGCAAA | TAG | chr3 | 120677712 | 120677731 | 120677715 | - |
| SEQ ID NO 31333 | TGGGGAGGCAGTGTGCAAAT | AGG | chr3 | 120677711 | 120677730 | 120677714 | - |
| SEQ ID NO 31334 | AGGCAGTGTGCAAATAGGTG | TGG | chr3 | 120677706 | 120677725 | 120677709 | - |
| SEQ ID NO 31335 | GGCAGTGTGCAAATAGGTGT | GGG | chr3 | 120677705 | 120677724 | 120677708 | - |
| SEQ ID NO 31336 | GTGCAAATAGGTGTGGGTCA | CAG | chr3 | 120677699 | 120677718 | 120677702 | - |
| SEQ ID NO 31337 | AGGTGTGGGTCACAGACATC | AAG | chr3 | 120677691 | 120677710 | 120677694 | - |
| SEQ ID NO 31338 | ACAGACATCAAGTACTTTAC | AAG | chr3 | 120677680 | 120677699 | 120677683 | - |
| SEQ ID NO 31339 | CAGACATCAAGTACTTTACA | AGG | chr3 | 120677679 | 120677698 | 120677682 | - |
| SEQ ID NO 31340 | TCAAGTACTTTACAAGGTAA | TAG | chr3 | 120677673 | 120677692 | 120677676 | - |
| SEQ ID NO 31341 | ACAAGGTAATAGAATATCAC | AAG | chr3 | 120677662 | 120677681 | 120677665 | - |
| SEQ ID NO 31342 | CAAGGTAATAGAATATCACA | AGG | chr3 | 120677661 | 120677680 | 120677664 | - |
| SEQ ID NO 31343 | GTAATAGAATATCACAAGGC | AAG | chr3 | 120677657 | 120677676 | 120677660 | - |
| SEQ ID NO 31344 | ATAGAATATCACAAGGCAAG | TGG | chr3 | 120677654 | 120677673 | 120677657 | - |
| SEQ ID NO 31345 | AGAATATCACAAGGCAAGTG | GAG | chr3 | 120677652 | 120677671 | 120677655 | - |
| SEQ ID NO 31346 | GAATATCACAAGGCAAGTGG | AGG | chr3 | 120677651 | 120677670 | 120677654 | - |
| SEQ ID NO 31347 | TATCACAAGGCAAGTGGAGG | CAG | chr3 | 120677648 | 120677667 | 120677651 | - |
| SEQ ID NO 31348 | ATCACAAGGCAAGTGGAGGC | AGG | chr3 | 120677647 | 120677666 | 120677650 | - |
| SEQ ID NO 31349 | TCACAAGGCAAGTGGAGGCA | GGG | chr3 | 120677646 | 120677665 | 120677649 | - |
| SEQ ID NO 31350 | AAGGCAAGTGGAGGCAGGGT | GAG | chr3 | 120677642 | 120677661 | 120677645 | - |
| SEQ ID NO 31351 | GTGGAGGCAGGGTGAGATCA | CAG | chr3 | 120677635 | 120677654 | 120677638 | - |
| SEQ ID NO 31352 | TGGAGGCAGGGTGAGATCAC | AGG | chr3 | 120677634 | 120677653 | 120677637 | - |
| SEQ ID NO 31353 | AGGGTGAGATCACAGGACCA | CAG | chr3 | 120677627 | 120677646 | 120677630 | - |
| SEQ ID NO 31354 | GGGTGAGATCACAGGACCAC | AGG | chr3 | 120677626 | 120677645 | 120677629 | - |
| SEQ ID NO 31355 | GATCACAGGACCACAGGACC | GAG | chr3 | 120677620 | 120677639 | 120677623 | - |
| SEQ ID NO 31356 | ATCACAGGACCACAGGACCG | AGG | chr3 | 120677619 | 120677638 | 120677622 | - |
| SEQ ID NO 31357 | CGAAATTAAAATTGCTAATG | AAG | chr3 | 120677596 | 120677615 | 120677599 | - |
| SEQ ID NO 31358 | TAAAATTGCTAATGAAGTTT | CGG | chr3 | 120677590 | 120677609 | 120677593 | - |

Figure 49 (Cont'd)

| | | | | | | | |
|---|---|---|---|---|---|---|---|
| SEQ ID NO 31359 | AAAATTGCTAATGAAGTTTC | GGG | chr3 | 120677589 | 120677608 | 120677592 | - |
| SEQ ID NO 31360 | TGTCATTGATAACATCTTAT | CAG | chr3 | 120677560 | 120677579 | 120677563 | - |
| SEQ ID NO 31361 | GTCATTGATAACATCTTATC | AGG | chr3 | 120677559 | 120677578 | 120677562 | - |
| SEQ ID NO 31362 | CATTGATAACATCTTATCAG | GAG | chr3 | 120677557 | 120677576 | 120677560 | - |
| SEQ ID NO 31363 | GATAACATCTTATCAGGAGA | CAG | chr3 | 120677553 | 120677572 | 120677556 | - |
| SEQ ID NO 31364 | ATAACATCTTATCAGGAGAC | AGG | chr3 | 120677552 | 120677571 | 120677555 | - |
| SEQ ID NO 31365 | TAACATCTTATCAGGAGACA | GGG | chr3 | 120677551 | 120677570 | 120677554 | - |
| SEQ ID NO 31366 | TTATCAGGAGACAGGGTTTT | TAG | chr3 | 120677544 | 120677563 | 120677547 | - |
| SEQ ID NO 31367 | TATCAGGAGACAGGGTTTTT | AGG | chr3 | 120677543 | 120677562 | 120677546 | - |
| SEQ ID NO 31368 | ACAGGGTTTTTAGGATCAAC | TGG | chr3 | 120677534 | 120677553 | 120677537 | - |
| SEQ ID NO 31369 | CTGGTCTGACCAAAATTTAT | TAG | chr3 | 120677515 | 120677534 | 120677518 | - |
| SEQ ID NO 31370 | TGGTCTGACCAAAATTTATT | AGG | chr3 | 120677514 | 120677533 | 120677517 | - |
| SEQ ID NO 31371 | TCTGACCAAAATTTATTAGG | CGG | chr3 | 120677511 | 120677530 | 120677514 | - |
| SEQ ID NO 31372 | CTGACCAAAATTTATTAGGC | GGG | chr3 | 120677510 | 120677529 | 120677513 | - |
| SEQ ID NO 31373 | GGGAATTTCCTCTTCCTAAT | AAG | chr3 | 120677490 | 120677509 | 120677493 | - |
| SEQ ID NO 31374 | TTTCCTCTTCCTAATAAGCC | TGG | chr3 | 120677485 | 120677504 | 120677488 | - |
| SEQ ID NO 31375 | TTCCTCTTCCTAATAAGCCT | GGG | chr3 | 120677484 | 120677503 | 120677487 | - |
| SEQ ID NO 31376 | CCTCTTCCTAATAAGCCTGG | GAG | chr3 | 120677482 | 120677501 | 120677485 | - |
| SEQ ID NO 31377 | TAATAAGCCTGGGAGCGCTG | TGG | chr3 | 120677474 | 120677493 | 120677477 | - |
| SEQ ID NO 31378 | AATAAGCCTGGGAGCGCTGT | GGG | chr3 | 120677473 | 120677492 | 120677476 | - |
| SEQ ID NO 31379 | TAAGCCTGGGAGCGCTGTGG | GAG | chr3 | 120677471 | 120677490 | 120677474 | - |
| SEQ ID NO 31380 | CTGGGAGCGCTGTGGGAGAC | TGG | chr3 | 120677466 | 120677485 | 120677469 | - |
| SEQ ID NO 31381 | TGGGAGCGCTGTGGGAGACT | GGG | chr3 | 120677465 | 120677484 | 120677468 | - |
| SEQ ID NO 31382 | GGGAGCGCTGTGGGAGACTG | GGG | chr3 | 120677464 | 120677483 | 120677467 | - |
| SEQ ID NO 31383 | TGGGGTCTATTTCACCCCTG | CAG | chr3 | 120677446 | 120677465 | 120677449 | - |
| SEQ ID NO 31384 | ACCCCTGCAGTCTCGACCAT | AAG | chr3 | 120677433 | 120677452 | 120677436 | - |
| SEQ ID NO 31385 | CCCTGCAGTCTCGACCATAA | GAG | chr3 | 120677431 | 120677450 | 120677434 | - |
| SEQ ID NO 31386 | GCAGTCTCGACCATAAGAGA | CAG | chr3 | 120677427 | 120677446 | 120677430 | - |
| SEQ ID NO 31387 | CAGTCTCGACCATAAGAGAC | AGG | chr3 | 120677426 | 120677445 | 120677429 | - |
| SEQ ID NO 31388 | CCATAAGAGACAGGCGCACC | TGG | chr3 | 120677417 | 120677436 | 120677420 | - |
| SEQ ID NO 31389 | ATAAGAGACAGGCGCACCTG | GAG | chr3 | 120677415 | 120677434 | 120677418 | - |
| SEQ ID NO 31390 | TAAGAGACAGGCGCACCTGG | AGG | chr3 | 120677414 | 120677433 | 120677417 | - |
| SEQ ID NO 31391 | AAGAGACAGGCGCACCTGGA | GGG | chr3 | 120677413 | 120677432 | 120677416 | - |
| SEQ ID NO 31392 | AGAGACAGGCGCACCTGGAG | GGG | chr3 | 120677412 | 120677431 | 120677415 | - |
| SEQ ID NO 31393 | GAGACAGGCGCACCTGGAGG | GGG | chr3 | 120677411 | 120677430 | 120677414 | - |
| SEQ ID NO 31394 | AGACAGGCGCACCTGGAGGG | GGG | chr3 | 120677410 | 120677429 | 120677413 | - |
| SEQ ID NO 31395 | CCTGGAGGGGGCTGTTTAT | AAG | chr3 | 120677399 | 120677418 | 120677402 | - |
| SEQ ID NO 31396 | GTTTATAAGCCTATACCTCC | TGG | chr3 | 120677385 | 120677404 | 120677388 | - |
| SEQ ID NO 31397 | CTGGCTCGTATTCTCTTTCT | CAG | chr3 | 120677366 | 120677385 | 120677369 | - |
| SEQ ID NO 31398 | TGGCTCGTATTCTCTTTCTC | AGG | chr3 | 120677365 | 120677384 | 120677368 | - |
| SEQ ID NO 31399 | GGCTCGTATTCTCTTTCTCA | GGG | chr3 | 120677364 | 120677383 | 120677367 | - |
| SEQ ID NO 31400 | TCTCAGGGATGTTCCATGCT | GAG | chr3 | 120677349 | 120677368 | 120677352 | - |
| SEQ ID NO 31401 | GGATGTTCCATGCTGAGAAA | AAG | chr3 | 120677343 | 120677362 | 120677346 | - |
| SEQ ID NO 31402 | CCATGCTGAGAAAAAGAATT | CAG | chr3 | 120677336 | 120677355 | 120677339 | - |
| SEQ ID NO 31403 | TTTCTCCCATTTGCTTTTGA | AAG | chr3 | 120677308 | 120677327 | 120677311 | - |
| SEQ ID NO 31404 | CTCCCATTTGCTTTTGAAAG | AAG | chr3 | 120677305 | 120677324 | 120677308 | - |
| SEQ ID NO 31405 | CCCATTTGCTTTTGAAAGAA | GAG | chr3 | 120677303 | 120677322 | 120677306 | - |

Figure 49 (Cont'd)

| SEQ ID NO 31406 | CTTTTGAAAGAAGAGAAATA | TGG | chr3 | 120677295 | 120677314 | 120677298 | - |
| SEQ ID NO 31407 | AAATATGGCTCTGTTCTGCC | TGG | chr3 | 120677280 | 120677299 | 120677283 | - |
| SEQ ID NO 31408 | CTCTGTTCTGCCTGGCTCAC | CAG | chr3 | 120677272 | 120677291 | 120677275 | - |
| SEQ ID NO 31409 | TGTTCTGCCTGGCTCACCAG | CAG | chr3 | 120677269 | 120677288 | 120677272 | - |
| SEQ ID NO 31410 | CTGCCTGGCTCACCAGCAGT | CAG | chr3 | 120677265 | 120677284 | 120677268 | - |
| SEQ ID NO 31411 | GCCTGGCTCACCAGCAGTCA | GAG | chr3 | 120677263 | 120677282 | 120677266 | - |
| SEQ ID NO 31412 | CTCACCAGCAGTCAGAGTTT | AAG | chr3 | 120677257 | 120677276 | 120677260 | - |
| SEQ ID NO 31413 | TCACCAGCAGTCAGAGTTTA | AGG | chr3 | 120677256 | 120677275 | 120677259 | - |
| SEQ ID NO 31414 | TGTTATCCTGTTCTTTTTTC | AAG | chr3 | 120677205 | 120677224 | 120677208 | - |
| SEQ ID NO 31415 | GTTATCCTGTTCTTTTTTCA | AGG | chr3 | 120677204 | 120677223 | 120677207 | - |
| SEQ ID NO 31416 | CACATGCTGTACAATTTGTG | CAG | chr3 | 120677155 | 120677174 | 120677158 | - |
| SEQ ID NO 31417 | TGCAGTTAATGCAATTATTA | CAG | chr3 | 120677137 | 120677156 | 120677140 | - |
| SEQ ID NO 31418 | GCAGTTAATGCAATTATTAC | AGG | chr3 | 120677136 | 120677155 | 120677139 | - |
| SEQ ID NO 31419 | CAGTTAATGCAATTATTACA | GGG | chr3 | 120677135 | 120677154 | 120677138 | - |
| SEQ ID NO 31420 | TGCAATTATTACAGGGTCCT | GAG | chr3 | 120677128 | 120677147 | 120677131 | - |
| SEQ ID NO 31421 | GCAATTATTACAGGGTCCTG | AGG | chr3 | 120677127 | 120677146 | 120677130 | - |
| SEQ ID NO 31422 | GAGGCAATATACATCCTCCT | CAG | chr3 | 120677108 | 120677127 | 120677111 | - |
| SEQ ID NO 31423 | TATACATCCTCCTCAGCTGA | CAG | chr3 | 120677101 | 120677120 | 120677104 | - |
| SEQ ID NO 31424 | ATACATCCTCCTCAGCTGAC | AGG | chr3 | 120677100 | 120677119 | 120677103 | - |
| SEQ ID NO 31425 | CCTCCTCAGCTGACAGGATT | AAG | chr3 | 120677094 | 120677113 | 120677097 | - |
| SEQ ID NO 31426 | TCCTCAGCTGACAGGATTAA | GAG | chr3 | 120677092 | 120677111 | 120677095 | - |
| SEQ ID NO 31427 | CTGACAGGATTAAGAGATTA | AAG | chr3 | 120677085 | 120677104 | 120677088 | - |
| SEQ ID NO 31428 | AGGATTAAGAGATTAAAGTA | AAG | chr3 | 120677080 | 120677099 | 120677083 | - |
| SEQ ID NO 31429 | TTAAGAGATTAAAGTAAAGA | CAG | chr3 | 120677076 | 120677095 | 120677079 | - |
| SEQ ID NO 31430 | TAAGAGATTAAAGTAAAGAC | AGG | chr3 | 120677075 | 120677094 | 120677078 | - |
| SEQ ID NO 31431 | TAAAGACAGGCATAAATCAC | AAG | chr3 | 120677062 | 120677081 | 120677065 | - |
| SEQ ID NO 31432 | AAAGACAGGCATAAATCACA | AGG | chr3 | 120677061 | 120677080 | 120677064 | - |
| SEQ ID NO 31433 | TAAATCACAAGGATATTGAC | TGG | chr3 | 120677050 | 120677069 | 120677053 | - |
| SEQ ID NO 31434 | AAATCACAAGGATATTGACT | GGG | chr3 | 120677049 | 120677068 | 120677052 | - |
| SEQ ID NO 31435 | AATCACAAGGATATTGACTG | GGG | chr3 | 120677048 | 120677067 | 120677051 | - |
| SEQ ID NO 31436 | CACAAGGATATTGACTGGGG | AAG | chr3 | 120677045 | 120677064 | 120677048 | - |
| SEQ ID NO 31437 | ATATTGACTGGGGAAGTGAT | AAG | chr3 | 120677038 | 120677057 | 120677041 | - |
| SEQ ID NO 31438 | AAATCTTTACAATTTATGTT | TAG | chr3 | 120677007 | 120677026 | 120677010 | - |
| SEQ ID NO 31439 | ATCTTTACAATTTATGTTTA | GAG | chr3 | 120677005 | 120677024 | 120677008 | - |
| SEQ ID NO 31440 | CAATTTATGTTTAGAGATTG | CAG | chr3 | 120676998 | 120677017 | 120677001 | - |
| SEQ ID NO 31441 | TATGTTTAGAGATTGCAGTA | AAG | chr3 | 120676993 | 120677012 | 120676996 | - |
| SEQ ID NO 31442 | TTTAGAGATTGCAGTAAAGA | CAG | chr3 | 120676989 | 120677008 | 120676992 | - |
| SEQ ID NO 31443 | TTAGAGATTGCAGTAAAGAC | AGG | chr3 | 120676988 | 120677007 | 120676991 | - |
| SEQ ID NO 31444 | ATTGCAGTAAAGACAGGCAT | AAG | chr3 | 120676982 | 120677001 | 120676985 | - |
| SEQ ID NO 31445 | ACAGGCATAAGAAATTACAA | AAG | chr3 | 120676970 | 120676989 | 120676973 | - |
| SEQ ID NO 31446 | AAATTACAAAAGTATTAATT | TGG | chr3 | 120676959 | 120676978 | 120676962 | - |
| SEQ ID NO 31447 | AATTACAAAAGTATTAATTT | GGG | chr3 | 120676958 | 120676977 | 120676961 | - |
| SEQ ID NO 31448 | ATTACAAAAGTATTAATTTG | GGG | chr3 | 120676957 | 120676976 | 120676960 | - |
| SEQ ID NO 31449 | CAATCCACGAACTTCTGCCA | TGG | chr3 | 120676907 | 120676926 | 120676910 | - |
| SEQ ID NO 31450 | ACGAACTTCTGCCATGGCTT | CAG | chr3 | 120676901 | 120676920 | 120676904 | - |
| SEQ ID NO 31451 | CTTCAGCTGATCCCTCCGTT | TGG | chr3 | 120676884 | 120676903 | 120676887 | - |
| SEQ ID NO 31452 | TCAGCTGATCCCTCCGTTTG | GAG | chr3 | 120676882 | 120676901 | 120676885 | - |

Figure 49 (Cont'd)

| | | | | | | | |
|---|---|---|---|---|---|---|---|
| SEQ ID NO 31453 | GATCCCTCCGTTTGGAGTCC | CAG | chr3 | 120676876 | 120676895 | 120676879 | - |
| SEQ ID NO 31454 | CCAGACTTCCCGCAACAACT | GAG | chr3 | 120676857 | 120676876 | 120676860 | - |
| SEQ ID NO 31455 | CCCGCAACAACTGAGAACTC | TGG | chr3 | 120676849 | 120676868 | 120676852 | - |
| SEQ ID NO 31456 | CGCAACAACTGAGAACTCTG | GAG | chr3 | 120676847 | 120676866 | 120676850 | - |
| SEQ ID NO 31457 | GCAACAACTGAGAACTCTGG | AGG | chr3 | 120676846 | 120676865 | 120676849 | - |
| SEQ ID NO 31458 | CAACAACTGAGAACTCTGGA | GGG | chr3 | 120676845 | 120676864 | 120676848 | - |
| SEQ ID NO 31459 | CCACCCTTCTTATATCTCTT | AAG | chr3 | 120676804 | 120676823 | 120676807 | - |
| SEQ ID NO 31460 | CACCCTTCTTATATCTCTTA | AGG | chr3 | 120676803 | 120676822 | 120676806 | - |
| SEQ ID NO 31461 | CCCTTCTTATATCTCTTAAG | GAG | chr3 | 120676801 | 120676820 | 120676804 | - |
| SEQ ID NO 31462 | ATCTCTTAAGGAGCTGTGTT | CAG | chr3 | 120676791 | 120676810 | 120676794 | - |
| SEQ ID NO 31463 | CTTAAGGAGCTGTGTTCAGA | TGG | chr3 | 120676787 | 120676806 | 120676790 | - |
| SEQ ID NO 31464 | ATGGTTACATTTCGCTTGCT | GAG | chr3 | 120676768 | 120676787 | 120676771 | - |
| SEQ ID NO 31465 | TTACATTTCGCTTGCTGAGC | AAG | chr3 | 120676764 | 120676783 | 120676767 | - |
| SEQ ID NO 31466 | AGACTGCATTTTCATTATCC | TGG | chr3 | 120676743 | 120676762 | 120676746 | - |
| SEQ ID NO 31467 | GACTGCATTTTCATTATCCT | GGG | chr3 | 120676742 | 120676761 | 120676745 | - |
| SEQ ID NO 31468 | TATCCTGGGCTAAAATCAAT | TGG | chr3 | 120676728 | 120676747 | 120676731 | - |
| SEQ ID NO 31469 | GCTAAAATCAATTGGTATTT | AAG | chr3 | 120676720 | 120676739 | 120676723 | - |
| SEQ ID NO 31470 | AAATCAATTGGTATTTAAGT | TAG | chr3 | 120676716 | 120676735 | 120676719 | - |
| SEQ ID NO 31471 | ATCAATTGGTATTTAAGTTA | GAG | chr3 | 120676714 | 120676733 | 120676717 | - |
| SEQ ID NO 31472 | GGTATTTAAGTTAGAGCAAA | AAG | chr3 | 120676707 | 120676726 | 120676710 | - |
| SEQ ID NO 31473 | GTATTTAAGTTAGAGCAAAA | AGG | chr3 | 120676706 | 120676725 | 120676709 | - |
| SEQ ID NO 31474 | TATTTAAGTTAGAGCAAAAA | GGG | chr3 | 120676705 | 120676724 | 120676708 | - |
| SEQ ID NO 31475 | AAGGGTTCTAACCCTATTTA | CAG | chr3 | 120676687 | 120676706 | 120676690 | - |
| SEQ ID NO 31476 | GGTTCTAACCCTATTTACAG | CAG | chr3 | 120676684 | 120676703 | 120676687 | - |
| SEQ ID NO 31477 | CAGCACACATACACTTACAT | TAG | chr3 | 120676664 | 120676683 | 120676667 | - |
| SEQ ID NO 31478 | ACATACACTTACATTAGAAT | TGG | chr3 | 120676658 | 120676677 | 120676661 | - |
| SEQ ID NO 31479 | CTTACATTAGAATTGGCTTT | AAG | chr3 | 120676651 | 120676670 | 120676654 | - |
| SEQ ID NO 31480 | TTACATTAGAATTGGCTTTA | AGG | chr3 | 120676650 | 120676669 | 120676653 | - |
| SEQ ID NO 31481 | TACATTAGAATTGGCTTTAA | GGG | chr3 | 120676649 | 120676668 | 120676652 | - |
| SEQ ID NO 31482 | TTCCACTGATTACCTTCTAT | GAG | chr3 | 120676603 | 120676622 | 120676606 | - |
| SEQ ID NO 31483 | CTGATTACCTTCTATGAGCC | AAG | chr3 | 120676598 | 120676617 | 120676601 | - |
| SEQ ID NO 31484 | TCTATGAGCCAAGACTGCCA | TAG | chr3 | 120676588 | 120676607 | 120676591 | - |
| SEQ ID NO 31485 | AGCCAAGACTGCCATAGTCT | CAG | chr3 | 120676582 | 120676601 | 120676585 | - |
| SEQ ID NO 31486 | CCATAGTCTCAGCCTTCATG | CAG | chr3 | 120676571 | 120676590 | 120676574 | - |
| SEQ ID NO 31487 | CTCAGCCTTCATGCAGCTTA | TAG | chr3 | 120676564 | 120676583 | 120676567 | - |
| SEQ ID NO 31488 | TCAGCCTTCATGCAGCTTAT | AGG | chr3 | 120676563 | 120676582 | 120676566 | - |
| SEQ ID NO 31489 | CCTTCATGCAGCTTATAGGC | TAG | chr3 | 120676559 | 120676578 | 120676562 | - |
| SEQ ID NO 31490 | CAGCTTATAGGCTAGCAAAA | AAG | chr3 | 120676551 | 120676570 | 120676554 | - |
| SEQ ID NO 31491 | TTATAGGCTAGCAAAAAGC | CAG | chr3 | 120676547 | 120676566 | 120676550 | - |
| SEQ ID NO 31492 | AGGCTAGCAAAAAGCCAGA | CAG | chr3 | 120676543 | 120676562 | 120676546 | - |
| SEQ ID NO 31493 | AAAAAGCCAGACAGTGCAC | AAG | chr3 | 120676535 | 120676554 | 120676538 | - |
| SEQ ID NO 31494 | GACAGTGCACAAGAACTCAC | AAG | chr3 | 120676525 | 120676544 | 120676528 | - |
| SEQ ID NO 31495 | CAAGAACTCACAAGTGTGTT | GAG | chr3 | 120676516 | 120676535 | 120676519 | - |
| SEQ ID NO 31496 | ACAAGTGTGTTGAGTGTTGC | AAG | chr3 | 120676507 | 120676526 | 120676510 | - |
| SEQ ID NO 31497 | AAGTGTGTTGAGTGTTGCAA | GAG | chr3 | 120676505 | 120676524 | 120676508 | - |
| SEQ ID NO 31498 | GTGTTGAGTGTTGCAAGAGT | AAG | chr3 | 120676501 | 120676520 | 120676504 | - |
| SEQ ID NO 31499 | AGTGTTGCAAGAGTAAGTTT | CAG | chr3 | 120676495 | 120676514 | 120676498 | - |

Figure 49 (Cont'd)

| SEQ ID NO 31500 | GTGTTGCAAGAGTAAGTTTC | AGG | chr3 | 120676494 | 120676513 | 120676497 | - |
| SEQ ID NO 31501 | TGTTGCAAGAGTAAGTTTCA | GGG | chr3 | 120676493 | 120676512 | 120676496 | - |
| SEQ ID NO 31502 | GTTGCAAGAGTAAGTTTCAG | GGG | chr3 | 120676492 | 120676511 | 120676495 | - |
| SEQ ID NO 31503 | GGGGCTCTCCATGACTTACC | TGG | chr3 | 120676473 | 120676492 | 120676476 | - |
| SEQ ID NO 31504 | TCTCCATGACTTACCTGGTT | GAG | chr3 | 120676468 | 120676487 | 120676471 | - |
| SEQ ID NO 31505 | CTTTAACTTTTTTTTTCCTC | TGG | chr3 | 120676440 | 120676459 | 120676443 | - |
| SEQ ID NO 31506 | TTTAACTTTTTTTTCCTCT | GGG | chr3 | 120676439 | 120676458 | 120676442 | - |
| SEQ ID NO 31507 | TTTTTTTTCCTCTGGGTGTA | AAG | chr3 | 120676432 | 120676451 | 120676435 | - |
| SEQ ID NO 31508 | TTTCCTCTGGGTGTAAAGTG | AAG | chr3 | 120676427 | 120676446 | 120676430 | - |
| SEQ ID NO 31509 | TCCTCTGGGTGTAAAGTGAA | GAG | chr3 | 120676425 | 120676444 | 120676428 | - |
| SEQ ID NO 31510 | CTGGGTGTAAAGTGAAGAGA | TGG | chr3 | 120676421 | 120676440 | 120676424 | - |
| SEQ ID NO 31511 | TAAAGTGAAGAGATGGCAAT | CAG | chr3 | 120676414 | 120676433 | 120676417 | - |
| SEQ ID NO 31512 | AAGTGAAGAGATGGCAATCA | GAG | chr3 | 120676412 | 120676431 | 120676415 | - |
| SEQ ID NO 31513 | TGAAGAGATGGCAATCAGAG | TAG | chr3 | 120676409 | 120676428 | 120676412 | - |
| SEQ ID NO 31514 | GAAGAGATGGCAATCAGAGT | AGG | chr3 | 120676408 | 120676427 | 120676411 | - |
| SEQ ID NO 31515 | TTCCATTGTGTCATTGTGAA | AAG | chr3 | 120676385 | 120676404 | 120676388 | - |
| SEQ ID NO 31516 | GTGTCATTGTGAAAAGATGC | TGG | chr3 | 120676378 | 120676397 | 120676381 | - |
| SEQ ID NO 31517 | TGTCATTGTGAAAAGATGCT | GGG | chr3 | 120676377 | 120676396 | 120676380 | - |
| SEQ ID NO 31518 | ATTGTGAAAAGATGCTGGGC | TGG | chr3 | 120676373 | 120676392 | 120676376 | - |
| SEQ ID NO 31519 | CTGGGCTGGCGTGTCTCCTG | AAG | chr3 | 120676359 | 120676378 | 120676362 | - |
| SEQ ID NO 31520 | TGGGCTGGCGTGTCTCCTGA | AGG | chr3 | 120676358 | 120676377 | 120676361 | - |
| SEQ ID NO 31521 | TTCATGCATTCGCACAAATA | TAG | chr3 | 120676311 | 120676330 | 120676314 | - |
| SEQ ID NO 31522 | ACAAATATAGATGTGTTCCA | TAG | chr3 | 120676298 | 120676317 | 120676301 | - |
| SEQ ID NO 31523 | TATAGATGTGTTCCATAGAT | GAG | chr3 | 120676293 | 120676312 | 120676296 | - |
| SEQ ID NO 31524 | ATAGATGTGTTCCATAGATG | AGG | chr3 | 120676292 | 120676311 | 120676295 | - |
| SEQ ID NO 31525 | GATGTGTTCCATAGATGAGG | CAG | chr3 | 120676289 | 120676308 | 120676292 | - |
| SEQ ID NO 31526 | TGTTCCATAGATGAGGCAGA | TAG | chr3 | 120676285 | 120676304 | 120676288 | - |
| SEQ ID NO 31527 | TCCATAGATGAGGCAGATAG | CAG | chr3 | 120676282 | 120676301 | 120676285 | - |
| SEQ ID NO 31528 | CATAGATGAGGCAGATAGCA | GAG | chr3 | 120676280 | 120676299 | 120676283 | - |
| SEQ ID NO 31529 | ATAGATGAGGCAGATAGCAG | AGG | chr3 | 120676279 | 120676298 | 120676282 | - |
| SEQ ID NO 31530 | ATAGCAGAGGCTTCTGCCTA | CAG | chr3 | 120676266 | 120676285 | 120676269 | - |
| SEQ ID NO 31531 | CAGAGGCTTCTGCCTACAGC | AAG | chr3 | 120676262 | 120676281 | 120676265 | - |
| SEQ ID NO 31532 | AGAGGCTTCTGCCTACAGCA | AGG | chr3 | 120676261 | 120676280 | 120676264 | - |
| SEQ ID NO 31533 | GCTTCTGCCTACAGCAAGGC | TAG | chr3 | 120676257 | 120676276 | 120676260 | - |
| SEQ ID NO 31534 | TGCCTACAGCAAGGCTAGTT | TGG | chr3 | 120676252 | 120676271 | 120676255 | - |
| SEQ ID NO 31535 | CCTACAGCAAGGCTAGTTTG | GAG | chr3 | 120676250 | 120676269 | 120676253 | - |
| SEQ ID NO 31536 | TACAGCAAGGCTAGTTTGGA | GAG | chr3 | 120676248 | 120676267 | 120676251 | - |
| SEQ ID NO 31537 | ACAGCAAGGCTAGTTTGGAG | AGG | chr3 | 120676247 | 120676266 | 120676250 | - |
| SEQ ID NO 31538 | CAGCAAGGCTAGTTTGGAGA | GGG | chr3 | 120676246 | 120676265 | 120676249 | - |
| SEQ ID NO 31539 | TTTGGAGAGGGTTTTGCTGT | CAG | chr3 | 120676234 | 120676253 | 120676237 | - |
| SEQ ID NO 31540 | TTGGAGAGGGTTTTGCTGTC | AGG | chr3 | 120676233 | 120676252 | 120676236 | - |
| SEQ ID NO 31541 | TGGAGAGGGTTTTGCTGTCA | GGG | chr3 | 120676232 | 120676251 | 120676235 | - |
| SEQ ID NO 31542 | GAGGGTTTTGCTGTCAGGGT | TGG | chr3 | 120676228 | 120676247 | 120676231 | - |
| SEQ ID NO 31543 | TGGACCCACACACCTCTTCA | TAG | chr3 | 120676208 | 120676227 | 120676211 | - |
| SEQ ID NO 31544 | ATGCTTTTCTTTTTTTTCC | CAG | chr3 | 120676185 | 120676204 | 120676188 | - |
| SEQ ID NO 31545 | GCTTTTCTTTTTTTTCCCA | GAG | chr3 | 120676183 | 120676202 | 120676186 | - |
| SEQ ID NO 31546 | TTTTTTTTCCCAGAGTTTGA | AAG | chr3 | 120676175 | 120676194 | 120676178 | - |

Figure 49 (Cont'd)

| | | | | | | | |
|---|---|---|---|---|---|---|---|
| SEQ ID NO 31547 | TTTTTTTCCCAGAGTTTGAA | AGG | chr3 | 120676174 | 120676193 | 120676177 | - |
| SEQ ID NO 31548 | TTTTTTCCCAGAGTTTGAAA | GGG | chr3 | 120676173 | 120676192 | 120676176 | - |
| SEQ ID NO 31549 | CCCAGAGTTTGAAAGGGAAA | TGG | chr3 | 120676167 | 120676186 | 120676170 | - |
| SEQ ID NO 31550 | CAGAGTTTGAAAGGGAAATG | GAG | chr3 | 120676165 | 120676184 | 120676168 | - |
| SEQ ID NO 31551 | TGAAAGGGAAATGGAGTCTC | AAG | chr3 | 120676158 | 120676177 | 120676161 | - |
| SEQ ID NO 31552 | GGGAAATGGAGTCTCAAGTT | CAG | chr3 | 120676153 | 120676172 | 120676156 | - |
| SEQ ID NO 31553 | GGAAATGGAGTCTCAAGTTC | AGG | chr3 | 120676152 | 120676171 | 120676155 | - |
| SEQ ID NO 31554 | GAAATGGAGTCTCAAGTTCA | GGG | chr3 | 120676151 | 120676170 | 120676154 | - |
| SEQ ID NO 31555 | AATGGAGTCTCAAGTTCAGG | GAG | chr3 | 120676149 | 120676168 | 120676152 | - |
| SEQ ID NO 31556 | ATGGAGTCTCAAGTTCAGGG | AGG | chr3 | 120676148 | 120676167 | 120676151 | - |
| SEQ ID NO 31557 | TCTCAAGTTCAGGGAGGTTA | CAG | chr3 | 120676142 | 120676161 | 120676145 | - |
| SEQ ID NO 31558 | AGTTCAGGGAGGTTACAGTG | TAG | chr3 | 120676137 | 120676156 | 120676140 | - |
| SEQ ID NO 31559 | TACAGTGTAGACCCACAAAT | CAG | chr3 | 120676124 | 120676143 | 120676127 | - |
| SEQ ID NO 31560 | TGTAGACCCACAAATCAGCT | AAG | chr3 | 120676119 | 120676138 | 120676122 | - |
| SEQ ID NO 31561 | ACCCACAAATCAGCTAAGTA | CAG | chr3 | 120676114 | 120676133 | 120676117 | - |
| SEQ ID NO 31562 | CAAATCAGCTAAGTACAGCT | AAG | chr3 | 120676109 | 120676128 | 120676112 | - |
| SEQ ID NO 31563 | AAATCAGCTAAGTACAGCTA | AGG | chr3 | 120676108 | 120676127 | 120676111 | - |
| SEQ ID NO 31564 | AATCAGCTAAGTACAGCTAA | GGG | chr3 | 120676107 | 120676126 | 120676110 | - |
| SEQ ID NO 31565 | CAGCTAAGTACAGCTAAGGG | TGG | chr3 | 120676104 | 120676123 | 120676107 | - |
| SEQ ID NO 31566 | GCTAAGTACAGCTAAGGGTG | GAG | chr3 | 120676102 | 120676121 | 120676105 | - |
| SEQ ID NO 31567 | AAGTACAGCTAAGGGTGGAG | AAG | chr3 | 120676099 | 120676118 | 120676102 | - |
| SEQ ID NO 31568 | GGAGAAGTCTATGCAATATC | CAG | chr3 | 120676083 | 120676102 | 120676086 | - |
| SEQ ID NO 31569 | CCAGCACTCTTCTGATTAAT | TAG | chr3 | 120676064 | 120676083 | 120676067 | - |
| SEQ ID NO 31570 | GCACTCTTCTGATTAATTAG | AAG | chr3 | 120676061 | 120676080 | 120676064 | - |
| SEQ ID NO 31571 | TTAGAAGTCTTTAAAATTCA | CAG | chr3 | 120676045 | 120676064 | 120676048 | - |
| SEQ ID NO 31572 | CCCTAAATGATTCATATGTC | AAG | chr3 | 120676007 | 120676026 | 120676010 | - |
| SEQ ID NO 31573 | ATGATTCATATGTCAAGACA | CAG | chr3 | 120676001 | 120676020 | 120676004 | - |
| SEQ ID NO 31574 | TCATATGTCAAGACACAGTA | AAG | chr3 | 120675996 | 120676015 | 120675999 | - |
| SEQ ID NO 31575 | CACAGTAAAGATATTATATG | TGG | chr3 | 120675983 | 120676002 | 120675986 | - |
| SEQ ID NO 31576 | TGGAACATCATACACAAACA | TAG | chr3 | 120675963 | 120675982 | 120675966 | - |
| SEQ ID NO 31577 | GGAACATCATACACAAACAT | AGG | chr3 | 120675962 | 120675981 | 120675965 | - |
| SEQ ID NO 31578 | TACACAAACATAGGTCCATA | TAG | chr3 | 120675953 | 120675972 | 120675956 | - |
| SEQ ID NO 31579 | CCATATAGAAATTCTTACCT | TAG | chr3 | 120675938 | 120675957 | 120675941 | - |
| SEQ ID NO 31580 | TGCTCTTTAAATCCTGCTAA | TGG | chr3 | 120675894 | 120675913 | 120675897 | - |
| SEQ ID NO 31581 | TCTTTAAATCCTGCTAATGG | TGG | chr3 | 120675891 | 120675910 | 120675894 | - |
| SEQ ID NO 31582 | ATTTGTGTCTTTGTCACCTA | CAG | chr3 | 120675867 | 120675886 | 120675870 | - |
| SEQ ID NO 31583 | TGTCACCTACAGTACATTTC | TGG | chr3 | 120675856 | 120675875 | 120675859 | - |
| SEQ ID NO 31584 | CTACAGTACATTTCTGGATT | TGG | chr3 | 120675850 | 120675869 | 120675853 | - |
| SEQ ID NO 31585 | TACAGTACATTTCTGGATTT | GGG | chr3 | 120675849 | 120675868 | 120675852 | - |
| SEQ ID NO 31586 | ACATTTCTGGATTTGGGAAT | GAG | chr3 | 120675843 | 120675862 | 120675846 | - |
| SEQ ID NO 31587 | ATTTGGGAATGAGTGTTCTT | CAG | chr3 | 120675833 | 120675852 | 120675836 | - |
| SEQ ID NO 31588 | TTGGGAATGAGTGTTCTTCA | GAG | chr3 | 120675831 | 120675850 | 120675834 | - |
| SEQ ID NO 31589 | TGGGAATGAGTGTTCTTCAG | AGG | chr3 | 120675830 | 120675849 | 120675833 | - |
| SEQ ID NO 31590 | TTCAGAGGATCCTCGCTGCC | CAG | chr3 | 120675815 | 120675834 | 120675818 | - |
| SEQ ID NO 31591 | TCAGAGGATCCTCGCTGCCC | AGG | chr3 | 120675814 | 120675833 | 120675817 | - |
| SEQ ID NO 31592 | TCGCTGCCCAGGTTCCTGC | CAG | chr3 | 120675803 | 120675822 | 120675806 | - |
| SEQ ID NO 31593 | CTGCCCAGGTTCCCTGCCAG | AAG | chr3 | 120675800 | 120675819 | 120675803 | - |

Figure 49 (Cont'd)

| | | | | | | | |
|---|---|---|---|---|---|---|---|
| SEQ ID NO 31594 | TGCCCAGGTTCCCTGCCAGA | AGG | chr3 | 120675799 | 120675818 | 120675802 | - |
| SEQ ID NO 31595 | CAGGTTCCCTGCCAGAAGGA | CAG | chr3 | 120675795 | 120675814 | 120675798 | - |

Figure 50

| # | Sequence | PAM | Chr | Start | End | Cuts 5' of | Str |
|---|---|---|---|---|---|---|---|
| SEQ ID NO 31596 | TGGCAGGGAACCTGGGCAGC | GAGGAT | chr3 | 120675801 | 120675820 | 120675817 | + |
| SEQ ID NO 31597 | GACACAAATGCCACCATTAG | CAGGAT | chr3 | 120675878 | 120675897 | 120675894 | + |
| SEQ ID NO 31598 | AATTGGCAGTTTACTAAGGT | AAGAAT | chr3 | 120675922 | 120675941 | 120675938 | + |
| SEQ ID NO 31599 | TCTTTACTGTGTCTTGACAT | ATGAAT | chr3 | 120675992 | 120676011 | 120676008 | + |
| SEQ ID NO 31600 | GGGAAGACAATATGGTTTCT | GTGAAT | chr3 | 120676024 | 120676043 | 120676040 | + |
| SEQ ID NO 31601 | AAAGACTTCTAATTAATCAG | AAGAGT | chr3 | 120676053 | 120676072 | 120676069 | + |
| SEQ ID NO 31602 | TCTAATTAATCAGAAGAGTG | CTGGAT | chr3 | 120676060 | 120676079 | 120676076 | + |
| SEQ ID NO 31603 | TAGCTGTACTTAGCTGATTT | GTGGGT | chr3 | 120676108 | 120676127 | 120676124 | + |
| SEQ ID NO 31604 | AAGCATCTATGAAGAGGTGT | GTGGGT | chr3 | 120676199 | 120676218 | 120676215 | + |
| SEQ ID NO 31605 | TGGAACACATCTATATTTGT | GCGAAT | chr3 | 120676298 | 120676317 | 120676314 | + |
| SEQ ID NO 31606 | TGAAAATAAAGTTTAAAGAT | ATGGGT | chr3 | 120676327 | 120676346 | 120676343 | + |
| SEQ ID NO 31607 | CCAGAGGAAAAAAAAGTTA | AAGGGT | chr3 | 120676437 | 120676456 | 120676453 | + |
| SEQ ID NO 31608 | TTGCAACACTCAACACACTT | GTGAGT | chr3 | 120676505 | 120676524 | 120676521 | + |
| SEQ ID NO 31609 | AGTGGAAATTTGTCGATTGA | TTGAAT | chr3 | 120676616 | 120676635 | 120676632 | + |
| SEQ ID NO 31610 | TGTATGTGTGCTGCTGTAAA | TAGGGT | chr3 | 120676671 | 120676690 | 120676687 | + |
| SEQ ID NO 31611 | AATACCAATTGATTTTAGCC | CAGGAT | chr3 | 120676721 | 120676740 | 120676737 | + |
| SEQ ID NO 31612 | AGCTCCTTAAGAGATATAAG | AAGGGT | chr3 | 120676796 | 120676815 | 120676812 | + |
| SEQ ID NO 31613 | GAGATATAAGAAGGGTGGAA | GTGGGT | chr3 | 120676806 | 120676825 | 120676822 | + |
| SEQ ID NO 31614 | AAGAAGGGTGGAAGTGGGTG | AAGGGT | chr3 | 120676813 | 120676832 | 120676829 | + |
| SEQ ID NO 31615 | TGGGTGAAGGGTAGGCCCTC | CAGAGT | chr3 | 120676827 | 120676846 | 120676843 | + |
| SEQ ID NO 31616 | AAGTCTGGGACTCCAAACGG | AGGGAT | chr3 | 120676869 | 120676888 | 120676885 | + |
| SEQ ID NO 31617 | TGAAGCCATGGCAGAAGTTC | GTGGAT | chr3 | 120676899 | 120676918 | 120676915 | + |
| SEQ ID NO 31618 | TCTTAATCCTGTCAGCTGAG | GAGGAT | chr3 | 120677090 | 120677109 | 120677106 | + |
| SEQ ID NO 31619 | TGGACACCTTGAAAAAGAA | CAGGAT | chr3 | 120677195 | 120677214 | 120677211 | + |
| SEQ ID NO 31620 | AGGATAACAGCAATTGTTCA | GGGAAT | chr3 | 120677216 | 120677235 | 120677232 | + |
| SEQ ID NO 31621 | AGCAAATGGGAGAAATATCG | CTGAAT | chr3 | 120677313 | 120677332 | 120677329 | + |
| SEQ ID NO 31622 | CATGGAACATCCCTGAGAAA | GAGAAT | chr3 | 120677351 | 120677370 | 120677367 | + |
| SEQ ID NO 31623 | TCTCTTATGGTCGAGACTGC | AGGGGT | chr3 | 120677427 | 120677446 | 120677443 | + |
| SEQ ID NO 31624 | ACCGAAATGTGATGCCTCCC | CCGGAT | chr3 | 120677791 | 120677810 | 120677807 | + |
| SEQ ID NO 31625 | GAAAATAGAAAAGAACCTAC | GTGAAT | chr3 | 120677884 | 120677903 | 120677900 | + |
| SEQ ID NO 31626 | GGCGTGGAGATGTAACAAGC | CTGGAT | chr3 | 120677937 | 120677956 | 120677953 | + |
| SEQ ID NO 31627 | GATGTAACAAGCCTGGATGT | GTGAGT | chr3 | 120677945 | 120677964 | 120677961 | + |
| SEQ ID NO 31628 | ATTTGGAAGAAATATCAGAT | GTGAAT | chr3 | 120677996 | 120678015 | 120678012 | + |
| SEQ ID NO 31629 | TAAAAGCAGCAGCATGCAGT | TAGGAT | chr3 | 120678138 | 120678157 | 120678154 | + |
| SEQ ID NO 31630 | AACCCCATGCTCACCATCAA | CGGGAT | chr3 | 120678240 | 120678259 | 120678256 | + |
| SEQ ID NO 31631 | CATGCTCACCATCAACGGGA | TTGAAT | chr3 | 120678245 | 120678264 | 120678261 | + |
| SEQ ID NO 31632 | GGGATTGAATTTGAGCTGCT | GAGAAT | chr3 | 120678261 | 120678280 | 120678277 | + |
| SEQ ID NO 31633 | TTATCTTCAATTCTGTGAAA | TGGAAT | chr3 | 120678303 | 120678322 | 120678319 | + |
| SEQ ID NO 31634 | TGCAAGAGAGGAAGGAAGGC | TGGAGT | chr3 | 120678405 | 120678424 | 120678421 | + |
| SEQ ID NO 31635 | AGCTTTCTGGCAGGCACTGG | TGGAGT | chr3 | 120678438 | 120678457 | 120678454 | + |
| SEQ ID NO 31636 | TGTAACTGGTGGCCTTAGAA | GAGGGT | chr3 | 120678488 | 120678507 | 120678504 | + |
| SEQ ID NO 31637 | GGTGGCCTTAGAAGAGGGTT | CAGGGT | chr3 | 120678495 | 120678514 | 120678511 | + |
| SEQ ID NO 31638 | CAGGGTTATGTGTTTGGAAC | ACGAGT | chr3 | 120678515 | 120678534 | 120678531 | + |
| SEQ ID NO 31639 | GCCACCAAGCACCAAGAGGT | GTGAGT | chr3 | 120678631 | 120678650 | 120678647 | + |
| SEQ ID NO 31640 | AGCACCAAGAGGTGTGAGTT | CTGAAT | chr3 | 120678638 | 120678657 | 120678654 | + |
| SEQ ID NO 31641 | AAAGAGGAAGGTGAAAACTG | CTGAGT | chr3 | 120678697 | 120678716 | 120678713 | + |
| SEQ ID NO 31642 | ATCCCCTGAGAGAAAAAGTA | CAGAGT | chr3 | 120678749 | 120678768 | 120678765 | + |
| SEQ ID NO 31643 | CCCCTCACGGCCAAAGGCAT | CTGAAT | chr3 | 120678799 | 120678818 | 120678815 | + |

Figure 50 (Cont'd)

| | | | | | | | |
|---|---|---|---|---|---|---|---|
| SEQ ID NO 31644 | CCAGACATTGAGCTCAAGGA | CAGAAT | chr3 | 120678854 | 120678873 | 120678870 | + |
| SEQ ID NO 31645 | GTTTGTATGTTTTCTACAGT | TCGGAT | chr3 | 120678999 | 120679018 | 120679015 | + |
| SEQ ID NO 31646 | GTTTTCTACAGTTCGGATTT | CTGAAT | chr3 | 120679007 | 120679026 | 120679023 | + |
| SEQ ID NO 31647 | ATGATTTCATTTCTTTTCGA | GAGAAT | chr3 | 120679054 | 120679073 | 120679070 | + |
| SEQ ID NO 31648 | TATGCATACTTTCTAAATGC | AAGAAT | chr3 | 120679082 | 120679101 | 120679098 | + |
| SEQ ID NO 31649 | CATCAGCTCTTTGGCAGCTT | ATGAGT | chr3 | 120679138 | 120679157 | 120679154 | + |
| SEQ ID NO 31650 | TTTAATTCTCACCTGGTCCC | CAGGAT | chr3 | 120679173 | 120679192 | 120679189 | + |
| SEQ ID NO 31651 | CCAGGATATGGTTTACTTGT | CAGAGT | chr3 | 120679192 | 120679211 | 120679208 | + |
| SEQ ID NO 31652 | TGAAGGAAAGAGAGAGAAGT | CAGGGT | chr3 | 120679308 | 120679327 | 120679324 | + |
| SEQ ID NO 31653 | ATTTTTTTTTTCTGTGGAAA | AAGAGT | chr3 | 120679354 | 120679373 | 120679370 | + |
| SEQ ID NO 31654 | TTGCACATTATCGCAGTAGG | CTGAAT | chr3 | 120679435 | 120679454 | 120679451 | + |
| SEQ ID NO 31655 | TGGCTTAACCCCTGAAACCT | GTGAGT | chr3 | 120679493 | 120679512 | 120679509 | + |
| SEQ ID NO 31656 | AGACTTTTGCATATATAATT | AAGGAT | chr3 | 120679539 | 120679558 | 120679555 | + |
| SEQ ID NO 31657 | GCATATATAATTAAGGATCT | TGGGAT | chr3 | 120679547 | 120679566 | 120679563 | + |
| SEQ ID NO 31658 | TGGGGAGATATCCTAATTAT | TTGGGT | chr3 | 120679572 | 120679591 | 120679588 | + |
| SEQ ID NO 31659 | GAGGAAGAGGCTACAAACCA | AGGAAT | chr3 | 120679714 | 120679733 | 120679730 | + |
| SEQ ID NO 31660 | GAGGCTACAAACCAAGGAAT | GTGGGT | chr3 | 120679720 | 120679739 | 120679736 | + |
| SEQ ID NO 31661 | GTAGCCTCTAGAAGAGGAAA | CAGAAT | chr3 | 120679744 | 120679763 | 120679760 | + |
| SEQ ID NO 31662 | CAGGAAAACACAATCTCTCA | TAGAGT | chr3 | 120679782 | 120679801 | 120679798 | + |
| SEQ ID NO 31663 | GCAAGAGGAAATCAGTTACG | TAGAAT | chr3 | 120679944 | 120679963 | 120679960 | + |
| SEQ ID NO 31664 | TCCTGTCTCTGGCTAATCAT | TAGAAT | chr3 | 120679976 | 120679995 | 120679992 | + |
| SEQ ID NO 31665 | TACATACAGACCCAGAGCCA | GTGAAT | chr3 | 120680018 | 120680037 | 120680034 | + |
| SEQ ID NO 31666 | AGACCCAGAGCCAGTGAATC | AAGGAT | chr3 | 120680025 | 120680044 | 120680041 | + |
| SEQ ID NO 31667 | TTGGTGGTGGGGCCCAGAGC | CTGAAT | chr3 | 120680051 | 120680070 | 120680067 | + |
| SEQ ID NO 31668 | AAGCAACTTACTCAAATACA | TAGGGT | chr3 | 120680129 | 120680148 | 120680145 | + |
| SEQ ID NO 31669 | TAATTTTATTACTTTATCTT | TTGAAT | chr3 | 120680170 | 120680189 | 120680186 | + |
| SEQ ID NO 31670 | ATTATATAATGTTTATTGAT | TAGAAT | chr3 | 120680301 | 120680320 | 120680317 | + |
| SEQ ID NO 31671 | TATAATGTTTATTGATTAGA | ATGAAT | chr3 | 120680305 | 120680324 | 120680321 | + |
| SEQ ID NO 31672 | GTGTTCAGATTCCTGACCTC | TGGAGT | chr3 | 120680351 | 120680370 | 120680367 | + |
| SEQ ID NO 31673 | AGATTAGACAGCAGGCAGGG | AAGAAT | chr3 | 120680393 | 120680412 | 120680409 | + |
| SEQ ID NO 31674 | AAGTTGCTTAAACATGACAG | CAGGAT | chr3 | 120680484 | 120680503 | 120680500 | + |
| SEQ ID NO 31675 | GCTTAAACATGACAGCAGGA | TAGGAT | chr3 | 120680489 | 120680508 | 120680505 | + |
| SEQ ID NO 31676 | ACCTCTGCTGAACTTCCTCA | TAGAAT | chr3 | 120680555 | 120680574 | 120680571 | + |
| SEQ ID NO 31677 | TCCATAAATCCAACCACCGC | CTGGGT | chr3 | 120680698 | 120680717 | 120680714 | + |
| SEQ ID NO 31678 | CAAATTTGGCTGACACAGTT | TTGGAT | chr3 | 120680753 | 120680772 | 120680769 | + |
| SEQ ID NO 31679 | GCACTAGCACAAAATATTTG | CTGAAT | chr3 | 120680974 | 120680993 | 120680990 | + |
| SEQ ID NO 31680 | ACAAAATATTTGCTGAATGA | AAGAAT | chr3 | 120680982 | 120681001 | 120680998 | + |
| SEQ ID NO 31681 | TATTTGCTGAATGAAAGAAT | GAGAGT | chr3 | 120680988 | 120681007 | 120681004 | + |
| SEQ ID NO 31682 | CAAAGTCTTTTACTCCGGTG | TGGAGT | chr3 | 120681045 | 120681064 | 120681061 | + |
| SEQ ID NO 31683 | ACTCCGGTGTGGAGTGTTTT | CAGGAT | chr3 | 120681056 | 120681075 | 120681072 | + |
| SEQ ID NO 31684 | GAAACACCTCCCCTTAACTG | ATGGAT | chr3 | 120681120 | 120681139 | 120681136 | + |
| SEQ ID NO 31685 | TTCAGGGAAGATGTCTGTTG | TGGGGT | chr3 | 120681199 | 120681218 | 120681215 | + |
| SEQ ID NO 31686 | CTATACCCCAGATTTATTTT | GAGGAT | chr3 | 120681525 | 120681544 | 120681541 | + |
| SEQ ID NO 31687 | CCAGATTTATTTTGAGGATT | ATGAGT | chr3 | 120681532 | 120681551 | 120681548 | + |
| SEQ ID NO 31688 | ATTGCGTATTACTAAAAGA | AGGAAT | chr3 | 120681615 | 120681634 | 120681631 | + |
| SEQ ID NO 31689 | CAATGGGAAGGTGTCAGAGC | AGGGGT | chr3 | 120681752 | 120681771 | 120681768 | + |
| SEQ ID NO 31690 | CCGTAGTGGAGGGAGCTCT | TAGGAT | chr3 | 120681810 | 120681829 | 120681826 | + |
| SEQ ID NO 31691 | AATTGAAATGAACAAAGGCA | AGGGAT | chr3 | 120681858 | 120681877 | 120681874 | + |
| SEQ ID NO 31692 | ACAGGGAAGCCTCTGAACAC | AGGGGT | chr3 | 120681959 | 120681978 | 120681975 | + |

Figure 50 (Cont'd)

| | | | | | | | |
|---|---|---|---|---|---|---|---|
| SEQ ID NO 31693 | CTTCAGGAAACCCAGGCCCA | GAGGAT | chr3 | 120682137 | 120682156 | 120682153 | + |
| SEQ ID NO 31694 | TTTCTCCTTCAAACCACTCT | TTGGAT | chr3 | 120682181 | 120682200 | 120682197 | + |
| SEQ ID NO 31695 | GCGTCACTCAAACTAGCTGA | AAGAAT | chr3 | 120682247 | 120682266 | 120682263 | + |
| SEQ ID NO 31696 | TAGGCTTATTTCAAAAGGCA | GAGAAT | chr3 | 120682428 | 120682447 | 120682444 | + |
| SEQ ID NO 31697 | AGTGCCTGCTGTGTGGTG | GAGGAT | chr3 | 120682487 | 120682506 | 120682503 | + |
| SEQ ID NO 31698 | TAGGAAGGAACAGGGCAGTG | CTGAGT | chr3 | 120682537 | 120682556 | 120682553 | + |
| SEQ ID NO 31699 | CTGCCCTGTTCCTTCCTAGC | CTGAGT | chr3 | 120682535 | 120682554 | 120682538 | - |
| SEQ ID NO 31700 | GCCTGAGTCAGGACTGAGCA | GAGAAT | chr3 | 120682517 | 120682536 | 120682520 | - |
| SEQ ID NO 31701 | GAAATAAGCCTACTTTTAAC | TGGAAT | chr3 | 120682420 | 120682439 | 120682423 | - |
| SEQ ID NO 31702 | GCTGGACTTTGTCCCTGTGT | ATGAGT | chr3 | 120682285 | 120682304 | 120682288 | - |
| SEQ ID NO 31703 | AGACAATTCTTTCAGCTAGT | TTGAGT | chr3 | 120682258 | 120682277 | 120682261 | - |
| SEQ ID NO 31704 | CGCAGTGAAGCAGTGGGAAC | CGGAAT | chr3 | 120682213 | 120682232 | 120682216 | - |
| SEQ ID NO 31705 | AGTGGGAACCGGAATATCCA | AAGAGT | chr3 | 120682202 | 120682221 | 120682205 | - |
| SEQ ID NO 31706 | TGGCTTTATATCCTCTGGGC | CTGGGT | chr3 | 120682152 | 120682171 | 120682155 | - |
| SEQ ID NO 31707 | ATAGAGGAGAGAGAAAATGG | CTGAGT | chr3 | 120682108 | 120682127 | 120682111 | - |
| SEQ ID NO 31708 | ATGGAAGTTTCTGAGAACTT | CAGGGT | chr3 | 120682029 | 120682048 | 120682032 | - |
| SEQ ID NO 31709 | TTCTGAGAACTTCAGGGTAT | CAGAGT | chr3 | 120682021 | 120682040 | 120682024 | - |
| SEQ ID NO 31710 | CTATTTAGTTAATTAAGGCT | CTGAAT | chr3 | 120681685 | 120681704 | 120681688 | - |
| SEQ ID NO 31711 | TACGCAATTGAAAAGTATGT | GTGGGT | chr3 | 120681603 | 120681622 | 120681606 | - |
| SEQ ID NO 31712 | AGGTGCTAAGCATTTTAGCT | ATGAAT | chr3 | 120681566 | 120681585 | 120681569 | - |
| SEQ ID NO 31713 | CATAATCCTCAAAATAAATC | TGGGGT | chr3 | 120681535 | 120681554 | 120681538 | - |
| SEQ ID NO 31714 | ATAGATGACTTGATTAGAAG | CAGGGT | chr3 | 120681436 | 120681455 | 120681439 | - |
| SEQ ID NO 31715 | TGATTAGAAGCAGGGTATGT | TTGAAT | chr3 | 120681426 | 120681445 | 120681429 | - |
| SEQ ID NO 31716 | GTATCTTAAGGCAAGGAAAA | CAGAAT | chr3 | 120681353 | 120681372 | 120681356 | - |
| SEQ ID NO 31717 | GCCTAGTGCCCAGGCCAGGC | TTGAAT | chr3 | 120681304 | 120681323 | 120681307 | - |
| SEQ ID NO 31718 | CCCCACAACAGACATCTTCC | CTGAAT | chr3 | 120681204 | 120681223 | 120681207 | - |
| SEQ ID NO 31719 | ACAGACATCTTCCCTGAATG | CAGGGT | chr3 | 120681197 | 120681216 | 120681200 | - |
| SEQ ID NO 31720 | CTAATGCCCTCTAACTGATG | CTGAGT | chr3 | 120681159 | 120681178 | 120681162 | - |
| SEQ ID NO 31721 | TCTAACTGATGCTGAGTTTG | AAGAAT | chr3 | 120681150 | 120681169 | 120681153 | - |
| SEQ ID NO 31722 | TCAGTTAAGGGGAGGTGTTT | CTGAGT | chr3 | 120681121 | 120681140 | 120681124 | - |
| SEQ ID NO 31723 | GGGAGGTGTTTCTGAGTTTG | AAGAAT | chr3 | 120681112 | 120681131 | 120681115 | - |
| SEQ ID NO 31724 | CAAACACCTTCCTAATTGGT | AGGAAT | chr3 | 120681086 | 120681105 | 120681089 | - |
| SEQ ID NO 31725 | ATCCTGAAAACACTCCACAC | CGGAGT | chr3 | 120681062 | 120681081 | 120681065 | - |
| SEQ ID NO 31726 | AGATTAATATCGTAGATGAA | CTGAGT | chr3 | 120680944 | 120680963 | 120680947 | - |
| SEQ ID NO 31727 | TGAACTGAGTCTGGGCTAGG | TAGAGT | chr3 | 120680928 | 120680947 | 120680931 | - |
| SEQ ID NO 31728 | TAAAGGAGCCTGTACCTAAA | CTGAGT | chr3 | 120680887 | 120680906 | 120680890 | - |
| SEQ ID NO 31729 | ACTGGCAAAGTGAGGAAGGA | CGGGGT | chr3 | 120680843 | 120680862 | 120680846 | - |
| SEQ ID NO 31730 | GAAGGACGGGGTCTGGAGGG | AAGAGT | chr3 | 120680829 | 120680848 | 120680832 | - |
| SEQ ID NO 31731 | GACGGGGTCTGGAGGGAAGA | GTGAGT | chr3 | 120680825 | 120680844 | 120680828 | - |
| SEQ ID NO 31732 | GTGCAAAGGCACAGCACATA | CAGAAT | chr3 | 120680801 | 120680820 | 120680804 | - |
| SEQ ID NO 31733 | TACAGAATGCCTGCATGCTC | TAGAAT | chr3 | 120680783 | 120680802 | 120680786 | - |
| SEQ ID NO 31734 | CAAAACTGTGTCAGCCAAAT | TTGAGT | chr3 | 120680756 | 120680775 | 120680759 | - |
| SEQ ID NO 31735 | CTGAGATACCCAGGCGGTGG | TTGGAT | chr3 | 120680711 | 120680730 | 120680714 | - |
| SEQ ID NO 31736 | CCCAGGCGGTGGTTGGATTT | ATGGAT | chr3 | 120680703 | 120680722 | 120680706 | - |
| SEQ ID NO 31737 | CGGTGGTTGGATTTATGGAT | CTGGAT | chr3 | 120680697 | 120680716 | 120680700 | - |
| SEQ ID NO 31738 | TTTATGGATCTGGATTTCAG | GGGAGT | chr3 | 120680686 | 120680705 | 120680689 | - |
| SEQ ID NO 31739 | AGGGGAGTGGGCAGGGCTAG | GGGAAT | chr3 | 120680668 | 120680687 | 120680671 | - |
| SEQ ID NO 31740 | AGGGCTAGGGGAATAGAACT | GAGGGT | chr3 | 120680656 | 120680675 | 120680659 | - |
| SEQ ID NO 31741 | AGGGTCATGATGTCAGTGGT | AGGAGT | chr3 | 120680635 | 120680654 | 120680638 | - |

Figure 50 (Cont'd)

| | | | | | | | |
|---|---|---|---|---|---|---|---|
| SEQ ID NO 31742 | GGAGTTGAAGTCTTGGAAGA | AAGAGT | chr3 | 120680614 | 120680633 | 120680617 | - |
| SEQ ID NO 31743 | AAAGGTTAACTCCAGAGGTC | AGGAAT | chr3 | 120680365 | 120680384 | 120680368 | - |
| SEQ ID NO 31744 | TCTTTTATTTCTTCATTTTA | ATGAAT | chr3 | 120680263 | 120680282 | 120680266 | - |
| SEQ ID NO 31745 | CATTTACACAAAAGTACAAC | TGGGGT | chr3 | 120680208 | 120680227 | 120680211 | - |
| SEQ ID NO 31746 | AAATGAAATACCCTATGTAT | TTGAGT | chr3 | 120680144 | 120680163 | 120680147 | - |
| SEQ ID NO 31747 | AAATCCTTGATTCACTGGCT | CTGGGT | chr3 | 120680033 | 120680052 | 120680036 | - |
| SEQ ID NO 31748 | GTCTGTATGTAACAAGCTTC | TGGAGT | chr3 | 120680009 | 120680028 | 120680012 | - |
| SEQ ID NO 31749 | TGTGTTTTCCTGCCTTTTCC | ATGGAT | chr3 | 120679774 | 120679793 | 120679777 | - |
| SEQ ID NO 31750 | ATGACACTTGTGATTACATT | TAGGAT | chr3 | 120679606 | 120679625 | 120679609 | - |
| SEQ ID NO 31751 | TTAGGATACACCCAAATAAT | TAGGAT | chr3 | 120679587 | 120679606 | 120679590 | - |
| SEQ ID NO 31752 | AGATAATACTCACAGGTTTC | AGGGGT | chr3 | 120679506 | 120679525 | 120679509 | - |
| SEQ ID NO 31753 | GTTAAGCCATACATATCTTT | CAGAGT | chr3 | 120679482 | 120679501 | 120679485 | - |
| SEQ ID NO 31754 | TCATCTCATCAGGTGTTACC | TAGAAT | chr3 | 120679254 | 120679273 | 120679257 | - |
| SEQ ID NO 31755 | CATCAGGTGTTACCTAGAAT | CAGAGT | chr3 | 120679248 | 120679267 | 120679251 | - |
| SEQ ID NO 31756 | CCATATCCTGGGGACCAGGT | GAGAAT | chr3 | 120679183 | 120679202 | 120679186 | - |
| SEQ ID NO 31757 | ACTGAAGTCACATGGAGCTC | AGGAAT | chr3 | 120679116 | 120679135 | 120679119 | - |
| SEQ ID NO 31758 | AATGAAATCATATTTTTCTG | TCGGAT | chr3 | 120679045 | 120679064 | 120679048 | - |
| SEQ ID NO 31759 | AGGCACTGAACCAGCTGGAA | ATGAAT | chr3 | 120678922 | 120678941 | 120678925 | - |
| SEQ ID NO 31760 | AACCAGCTGGAAATGAATGC | TTGGAT | chr3 | 120678914 | 120678933 | 120678917 | - |
| SEQ ID NO 31761 | ATTTTCGCAGCTGATAAAAG | CAGAGT | chr3 | 120678890 | 120678909 | 120678893 | - |
| SEQ ID NO 31762 | AATGTCTGGAGAAAGCAGCT | GTGAAT | chr3 | 120678843 | 120678862 | 120678846 | - |
| SEQ ID NO 31763 | ACTCTGTACTTTTTCTCTCA | GGGGAT | chr3 | 120678755 | 120678774 | 120678758 | - |
| SEQ ID NO 31764 | CCTGCAGCTAAGATTGAGAA | ACGGAT | chr3 | 120678668 | 120678687 | 120678671 | - |
| SEQ ID NO 31765 | CCTATTTTTTAAAGCACAGT | CTGAAT | chr3 | 120678573 | 120678592 | 120678576 | - |
| SEQ ID NO 31766 | TTCTAAGGCCACCAGTTACA | AAGAAT | chr3 | 120678488 | 120678507 | 120678491 | - |
| SEQ ID NO 31767 | ACAAAGAATGGGGAAGGTTA | ATGAGT | chr3 | 120678471 | 120678490 | 120678474 | - |
| SEQ ID NO 31768 | TGGTCTAAAATTCCATTTCA | CAGAAT | chr3 | 120678318 | 120678337 | 120678321 | - |
| SEQ ID NO 31769 | TCACAGAATTGAAGATAATT | TGGGGT | chr3 | 120678301 | 120678320 | 120678304 | - |
| SEQ ID NO 31770 | AATCCCGTTGATGGTGAGCA | TGGGGT | chr3 | 120678247 | 120678266 | 120678250 | - |
| SEQ ID NO 31771 | GTGAGCATGGGGTTCATTTT | GAGAGT | chr3 | 120678234 | 120678253 | 120678237 | - |
| SEQ ID NO 31772 | TTCATTTTGAGAGTAGAAAA | TTGGAT | chr3 | 120678222 | 120678241 | 120678225 | - |
| SEQ ID NO 31773 | GTAGAAAATTGGATGCAGTG | GAGAAT | chr3 | 120678210 | 120678229 | 120678213 | - |
| SEQ ID NO 31774 | AATTGGATGCAGTGGAGAAT | CAGAAT | chr3 | 120678204 | 120678223 | 120678207 | - |
| SEQ ID NO 31775 | TGCAGTGGAGAATCAGAATG | TTGGAT | chr3 | 120678197 | 120678216 | 120678200 | - |
| SEQ ID NO 31776 | ATTTTCAAATATACAAAATA | TTGAGT | chr3 | 120678079 | 120678098 | 120678082 | - |
| SEQ ID NO 31777 | ATATTGAGTCTGAAGGCAAA | AAGAAT | chr3 | 120678062 | 120678081 | 120678065 | - |
| SEQ ID NO 31778 | CTTGTTACATCTCCACGCCA | CTGAGT | chr3 | 120677936 | 120677955 | 120677939 | - |
| SEQ ID NO 31779 | CAACTTTAGAAATAAAGGGA | CAGAGT | chr3 | 120677851 | 120677870 | 120677854 | - |
| SEQ ID NO 31780 | AAAACCAGCAAGTTTGTATT | AGGGAT | chr3 | 120677744 | 120677763 | 120677747 | - |
| SEQ ID NO 31781 | GAGGCAGTGTGCAAATAGGT | GTGGGT | chr3 | 120677707 | 120677726 | 120677710 | - |
| SEQ ID NO 31782 | TCAAGTACTTTACAAGGTAA | TAGAAT | chr3 | 120677673 | 120677692 | 120677676 | - |
| SEQ ID NO 31783 | TATCACAAGGCAAGTGGAGG | CAGGGT | chr3 | 120677648 | 120677667 | 120677651 | - |
| SEQ ID NO 31784 | GATAACATCTTATCAGGAGA | CAGGGT | chr3 | 120677553 | 120677572 | 120677556 | - |
| SEQ ID NO 31785 | TTATCAGGAGACAGGGTTTT | TAGGAT | chr3 | 120677544 | 120677563 | 120677547 | - |
| SEQ ID NO 31786 | CTGACCAAAATTTATTAGGC | GGGAAT | chr3 | 120677510 | 120677529 | 120677513 | - |
| SEQ ID NO 31787 | CTGGGAGCGCTGTGGGAGAC | TGGGGT | chr3 | 120677466 | 120677485 | 120677469 | - |
| SEQ ID NO 31788 | TGGCTCGTATTCTCTTTCTC | AGGGAT | chr3 | 120677365 | 120677384 | 120677368 | - |
| SEQ ID NO 31789 | GGATGTTCCATGCTGAGAAA | AAGAAT | chr3 | 120677343 | 120677362 | 120677346 | - |
| SEQ ID NO 31790 | CTGCCTGGCTCACCAGCAGT | CAGAGT | chr3 | 120677265 | 120677284 | 120677268 | - |

Figure 50 (Cont'd)

| | | | | | | | |
|---|---|---|---|---|---|---|---|
| SEQ ID NO 31791 | TGCAGTTAATGCAATTATTA | CAGGGT | chr3 | 120677137 | 120677156 | 120677140 | - |
| SEQ ID NO 31792 | TATACATCCTCCTCAGCTGA | CAGGAT | chr3 | 120677101 | 120677120 | 120677104 | - |
| SEQ ID NO 31793 | TAAAGACAGGCATAAATCAC | AAGGAT | chr3 | 120677062 | 120677081 | 120677065 | - |
| SEQ ID NO 31794 | CTTCAGCTGATCCCTCCGTT | TGGAGT | chr3 | 120676884 | 120676903 | 120676887 | - |
| SEQ ID NO 31795 | GGTATTTAAGTTAGAGCAAA | AAGGGT | chr3 | 120676707 | 120676726 | 120676710 | - |
| SEQ ID NO 31796 | CAGCACACATACACTTACAT | TAGAAT | chr3 | 120676664 | 120676683 | 120676667 | - |
| SEQ ID NO 31797 | CACAAGAACTCACAAGTGTG | TTGAGT | chr3 | 120676518 | 120676537 | 120676521 | - |
| SEQ ID NO 31798 | ACAAGTGTGTTGAGTGTTGC | AAGAGT | chr3 | 120676507 | 120676526 | 120676510 | - |
| SEQ ID NO 31799 | CCTTTAACTTTTTTTTTCCT | CTGGGT | chr3 | 120676441 | 120676460 | 120676444 | - |
| SEQ ID NO 31800 | TAAAGTGAAGAGATGGCAAT | CAGAGT | chr3 | 120676414 | 120676433 | 120676417 | - |
| SEQ ID NO 31801 | TACAGCAAGGCTAGTTTGGA | GAGGGT | chr3 | 120676248 | 120676267 | 120676251 | - |
| SEQ ID NO 31802 | TTTGGAGAGGGTTTTGCTGT | CAGGGT | chr3 | 120676234 | 120676253 | 120676237 | - |
| SEQ ID NO 31803 | ATGCTTTTTCTTTTTTTTCC | CAGAGT | chr3 | 120676185 | 120676204 | 120676188 | - |
| SEQ ID NO 31804 | CCCAGAGTTTGAAAGGGAAA | TGGAGT | chr3 | 120676167 | 120676186 | 120676170 | - |
| SEQ ID NO 31805 | CAAATCAGCTAAGTACAGCT | AAGGGT | chr3 | 120676109 | 120676128 | 120676112 | - |
| SEQ ID NO 31806 | TTGTCACCTACAGTACATTT | CTGGAT | chr3 | 120675857 | 120675876 | 120675860 | - |
| SEQ ID NO 31807 | TACAGTACATTTCTGGATTT | GGGAAT | chr3 | 120675849 | 120675868 | 120675852 | - |
| SEQ ID NO 31808 | GTACATTTCTGGATTTGGGA | ATGAGT | chr3 | 120675845 | 120675864 | 120675848 | - |
| SEQ ID NO 31809 | TTGGGAATGAGTGTTCTTCA | GAGGAT | chr3 | 120675831 | 120675850 | 120675834 | - |

Figure 51

| # | Sequence | PAM | Chr | Start | End | Cuts 5' of | Str |
|---|---|---|---|---|---|---|---|
| SEQ ID NO 31810 | AAGAACACTCATTCCCAAAT | CCAGAAA | chr3 | 120675833 | 120675852 | 120675849 | + |
| SEQ ID NO 31811 | AGCAGGATTTAAAGAGCATT | TCAGAAA | chr3 | 120675896 | 120675915 | 120675912 | + |
| SEQ ID NO 31812 | AAATTGGCAGTTTACTAAGG | TAAGAAT | chr3 | 120675921 | 120675940 | 120675937 | + |
| SEQ ID NO 31813 | CTTTCAAACTCTGGGAAAAA | AAAGAAA | chr3 | 120676172 | 120676191 | 120676188 | + |
| SEQ ID NO 31814 | TCTTCTTTCAAAAGCAAATG | GGAGAAA | chr3 | 120677301 | 120677320 | 120677317 | + |
| SEQ ID NO 31815 | TTCTCAGCATGGAACATCCC | TGAGAAA | chr3 | 120677344 | 120677363 | 120677360 | + |
| SEQ ID NO 31816 | GCATGGAACATCCCTGAGAA | AGAGAAT | chr3 | 120677350 | 120677369 | 120677366 | + |
| SEQ ID NO 31817 | TTGGCCGACGCTTAGGGAAA | ATAGAAA | chr3 | 120677868 | 120677887 | 120677884 | + |
| SEQ ID NO 31818 | CCAACAACAGTCTGTATTTG | GAAGAAA | chr3 | 120677981 | 120678000 | 120677997 | + |
| SEQ ID NO 31819 | CGGGATTGAATTTGAGCTGC | TGAGAAT | chr3 | 120678260 | 120678279 | 120678276 | + |
| SEQ ID NO 31820 | ACTGTGCTTTAAAAAATAGG | AAAGAAA | chr3 | 120678573 | 120678592 | 120678589 | + |
| SEQ ID NO 31821 | TTTAAAAAATAGGAAAGAAA | GTAGAAA | chr3 | 120678580 | 120678599 | 120678596 | + |
| SEQ ID NO 31822 | TTGGTTTTCTAATCCCCTG | AGAGAAA | chr3 | 120678737 | 120678756 | 120678753 | + |
| SEQ ID NO 31823 | TCCAGACATTGAGCTCAAGG | ACAGAAT | chr3 | 120678853 | 120678872 | 120678869 | + |
| SEQ ID NO 31824 | TTTCTGAATAATTTGATCCG | ACAGAAA | chr3 | 120679024 | 120679043 | 120679040 | + |
| SEQ ID NO 31825 | TATGATTTCATTTCTTTTCG | AGAGAAT | chr3 | 120679053 | 120679072 | 120679069 | + |
| SEQ ID NO 31826 | ATATGCATACTTTCTAAATG | CAAGAAT | chr3 | 120679081 | 120679100 | 120679097 | + |
| SEQ ID NO 31827 | GGGAGATTTGACTTATAAGA | GGAGAAA | chr3 | 120679643 | 120679662 | 120679659 | + |
| SEQ ID NO 31828 | GGTAGCCTCTAGAAGAGGAA | ACAGAAT | chr3 | 120679743 | 120679762 | 120679759 | + |
| SEQ ID NO 31829 | AATCTCTCATAGAGTCTCCA | GAAGAAA | chr3 | 120679793 | 120679812 | 120679809 | + |
| SEQ ID NO 31830 | AGCAAGAGGAAATCAGTTAC | GTAGAAT | chr3 | 120679943 | 120679962 | 120679959 | + |
| SEQ ID NO 31831 | GTCCTGTCTCTGGCTAATCA | TTAGAAT | chr3 | 120679975 | 120679994 | 120679991 | + |
| SEQ ID NO 31832 | TATTAAGCAAGTTCTTCGTT | TTAGAAA | chr3 | 120680076 | 120680095 | 120680092 | + |
| SEQ ID NO 31833 | GTTGACATATTCATTAAAAT | GAAGAAA | chr3 | 120680249 | 120680268 | 120680265 | + |
| SEQ ID NO 31834 | TAAAATGAAGAAATAAAAGA | TGAGAAA | chr3 | 120680263 | 120680282 | 120680279 | + |
| SEQ ID NO 31835 | AATTATATAATGTTATTGA | TTAGAAT | chr3 | 120680300 | 120680319 | 120680316 | + |
| SEQ ID NO 31836 | AAGATTAGACAGCAGGCAGG | GAAGAAT | chr3 | 120680392 | 120680411 | 120680408 | + |
| SEQ ID NO 31837 | AACCTCTGCTGAACTTCCTC | ATAGAAT | chr3 | 120680554 | 120680573 | 120680570 | + |
| SEQ ID NO 31838 | ACTTCCTCATAGAATGTTCA | TCAGAAA | chr3 | 120680566 | 120680585 | 120680582 | + |
| SEQ ID NO 31839 | CACAAAATATTTGCTGAATG | AAAGAAT | chr3 | 120680981 | 120681000 | 120680997 | + |
| SEQ ID NO 31840 | AGGTGTTTGATTCTTCAAAC | TCAGAAA | chr3 | 120681097 | 120681116 | 120681113 | + |
| SEQ ID NO 31841 | GGGTTGGGAAAAGACATAG | AGAGAAA | chr3 | 120681774 | 120681793 | 120681790 | + |
| SEQ ID NO 31842 | ACTCTGATACCCTGAAGTTC | TCAGAAA | chr3 | 120682015 | 120682034 | 120682031 | + |
| SEQ ID NO 31843 | TGCGTCACTCAAACTAGCT | AAAGAAT | chr3 | 120682246 | 120682265 | 120682262 | + |
| SEQ ID NO 31844 | GTAGGCTTATTTCAAAAGGC | AGAGAAT | chr3 | 120682427 | 120682446 | 120682443 | + |
| SEQ ID NO 31845 | AGCCTGAGTCAGGACTGAGC | AGAGAAT | chr3 | 120682518 | 120682537 | 120682521 | - |
| SEQ ID NO 31846 | TATCCAAAGAGTGGTTTGAA | GGAGAAA | chr3 | 120682188 | 120682207 | 120682191 | - |
| SEQ ID NO 31847 | AGTCACCACACATAGAGGAG | AGAGAAA | chr3 | 120682119 | 120682138 | 120682122 | - |
| SEQ ID NO 31848 | GAAAATGGCTGAGTTAAAGG | TAAGAAA | chr3 | 120682096 | 120682115 | 120682099 | - |
| SEQ ID NO 31849 | CAAGGGAAAGGTGATAAAGG | AAAGAAA | chr3 | 120681908 | 120681927 | 120681911 | - |
| SEQ ID NO 31850 | GAGAGAGGTTCTTGTTTCAA | TTAGAAA | chr3 | 120681506 | 120681525 | 120681509 | - |
| SEQ ID NO 31851 | GGTATCTTAAGGCAAGGAAA | ACAGAAT | chr3 | 120681354 | 120681373 | 120681357 | - |
| SEQ ID NO 31852 | CTCTAACTGATGCTGAGTTT | GAAGAAT | chr3 | 120681151 | 120681170 | 120681154 | - |
| SEQ ID NO 31853 | GGGGAGGTGTTTCTGAGTTT | GAAGAAT | chr3 | 120681113 | 120681132 | 120681116 | - |
| SEQ ID NO 31854 | AGTGCAAAGGCACAGCACAT | ACAGAAT | chr3 | 120680802 | 120680821 | 120680805 | - |
| SEQ ID NO 31855 | ATACAGAATGCCTGCATGCT | CTAGAAT | chr3 | 120680784 | 120680803 | 120680787 | - |
| SEQ ID NO 31856 | TGGTAGGAGTTGAAGTCTTG | GAAGAAA | chr3 | 120680619 | 120680638 | 120680622 | - |
| SEQ ID NO 31857 | AGTCTTGGAAGAAAGAGTAG | ATAGAAA | chr3 | 120680606 | 120680625 | 120680609 | - |

Figure 51 (Cont'd)

| | | | | | | | |
|---|---|---|---|---|---|---|---|
| SEQ ID NO 31858 | GCCTGCTGTCTAATCTTTAC | AAAGAAA | chr3 | 120680389 | 120680408 | 120680392 | - |
| SEQ ID NO 31859 | CAGAGGTCAGGAATCTGAAC | ACAGAAA | chr3 | 120680353 | 120680372 | 120680356 | - |
| SEQ ID NO 31860 | ACACAAAAGTACAACTGGGG | TAAGAAA | chr3 | 120680203 | 120680222 | 120680206 | - |
| SEQ ID NO 31861 | ATATGCAAAAGTCTGTTTGG | CTAGAAA | chr3 | 120679533 | 120679552 | 120679536 | - |
| SEQ ID NO 31862 | TATGTTCCCATCAAGGTTAA | TTAGAAA | chr3 | 120679393 | 120679412 | 120679396 | - |
| SEQ ID NO 31863 | AAATATTAGACTCTTTTTCC | ACAGAAA | chr3 | 120679369 | 120679388 | 120679372 | - |
| SEQ ID NO 31864 | TTCATCTCATCAGGTGTTAC | CTAGAAT | chr3 | 120679255 | 120679274 | 120679258 | - |
| SEQ ID NO 31865 | GTTACCTAGAATCAGAGTCA | GGAGAAA | chr3 | 120679240 | 120679259 | 120679243 | - |
| SEQ ID NO 31866 | ACCATATCCTGGGGACCAGG | TGAGAAT | chr3 | 120679184 | 120679203 | 120679187 | - |
| SEQ ID NO 31867 | TCAGGAATTTATTCTTGCAT | TTAGAAA | chr3 | 120679098 | 120679117 | 120679101 | - |
| SEQ ID NO 31868 | TATGCATATAATTCTCTCGA | AAAGAAA | chr3 | 120679070 | 120679089 | 120679073 | - |
| SEQ ID NO 31869 | TTTCTGTCGGATCAAATTAT | TCAGAAA | chr3 | 120679031 | 120679050 | 120679034 | - |
| SEQ ID NO 31870 | ATTATTCAGAAATCCGAACT | GTAGAAA | chr3 | 120679016 | 120679035 | 120679019 | - |
| SEQ ID NO 31871 | TGTCCTTGAGCTCAATGTCT | GGAGAAA | chr3 | 120678856 | 120678875 | 120678859 | - |
| SEQ ID NO 31872 | GTACTTTTTCTCTCAGGGGA | TTAGAAA | chr3 | 120678750 | 120678769 | 120678753 | - |
| SEQ ID NO 31873 | CAATGCCCTGCAGCTAAGAT | TGAGAAA | chr3 | 120678674 | 120678693 | 120678677 | - |
| SEQ ID NO 31874 | CTTCTAAGGCCACCAGTTAC | AAAGAAT | chr3 | 120678489 | 120678508 | 120678492 | - |
| SEQ ID NO 31875 | AGTAACTCCACCAGTGCCTG | CCAGAAA | chr3 | 120678448 | 120678467 | 120678451 | - |
| SEQ ID NO 31876 | CCTTCCTTCCTCTCTTGCAG | AGAGAAA | chr3 | 120678404 | 120678423 | 120678407 | - |
| SEQ ID NO 31877 | CTGGTCTAAAATTCCATTTC | ACAGAAT | chr3 | 120678319 | 120678338 | 120678322 | - |
| SEQ ID NO 31878 | GCATGGGGTTCATTTTGAGA | GTAGAAA | chr3 | 120678230 | 120678249 | 120678233 | - |
| SEQ ID NO 31879 | AGTAGAAAATTGGATGCAGT | GGAGAAT | chr3 | 120678211 | 120678230 | 120678214 | - |
| SEQ ID NO 31880 | AAATTGGATGCAGTGGAGAA | TCAGAAT | chr3 | 120678205 | 120678224 | 120678208 | - |
| SEQ ID NO 31881 | AATATTGAGTCTGAAGGCAA | AAAGAAT | chr3 | 120678063 | 120678082 | 120678066 | - |
| SEQ ID NO 31882 | TCCCTAAGCGTCGGCCAACT | TTAGAAA | chr3 | 120677866 | 120677885 | 120677869 | - |
| SEQ ID NO 31883 | AAAGGGACAGAGTACAAAAG | AGAGAAA | chr3 | 120677838 | 120677857 | 120677841 | - |
| SEQ ID NO 31884 | ATCAAGTACTTTACAAGGTA | ATAGAAT | chr3 | 120677674 | 120677693 | 120677677 | - |
| SEQ ID NO 31885 | TTCTCAGGGATGTTCCATGC | TGAGAAA | chr3 | 120677350 | 120677369 | 120677353 | - |
| SEQ ID NO 31886 | GGGATGTTCCATGCTGAGAA | AAAGAAT | chr3 | 120677344 | 120677363 | 120677347 | - |
| SEQ ID NO 31887 | TCCCATTTGCTTTTGAAAGA | AGAGAAA | chr3 | 120677304 | 120677323 | 120677307 | - |
| SEQ ID NO 31888 | GATTGCAGTAAAGACAGGCA | TAAGAAA | chr3 | 120676983 | 120677002 | 120676986 | - |
| SEQ ID NO 31889 | GCAGCACACATACACTTACA | TTAGAAT | chr3 | 120676665 | 120676684 | 120676668 | - |
| SEQ ID NO 31890 | CTCTCCATGACTTACCTGGT | TGAGAAA | chr3 | 120676469 | 120676488 | 120676472 | - |
| SEQ ID NO 31891 | ATTAGAAGTCTTTAAAATTC | ACAGAAA | chr3 | 120676046 | 120676065 | 120676049 | - |
| SEQ ID NO 31892 | ATACACAAACATAGGTCCAT | ATAGAAA | chr3 | 120675954 | 120675973 | 120675957 | - |

Figure 52

| # | Sequence | PAM | Chr | Start | End | Cuts 5' of | Str |
|---|---|---|---|---|---|---|---|
| SEQ ID NO 31893 | TGTGGGTCCAACCCTGACAG | CAAAAC | chr3 | 120676218 | 120676237 | 120676234 | + |
| SEQ ID NO 31894 | TGGTCAGACCAGTTGATCCT | AAAAAC | chr3 | 120677523 | 120677542 | 120677539 | + |
| SEQ ID NO 31895 | CATTGGCTAAAGAGGAAGGT | GAAAAC | chr3 | 120678689 | 120678708 | 120678705 | + |
| SEQ ID NO 31896 | AGAATCCATGGAAAAGGCAG | GAAAAC | chr3 | 120679765 | 120679784 | 120679781 | + |
| SEQ ID NO 31897 | TCCTCATAGAATGTTCATCA | GAAAAC | chr3 | 120680569 | 120680588 | 120680585 | + |
| SEQ ID NO 31898 | TTTAGTCAGGCATAAAGATA | AAAAAC | chr3 | 120681019 | 120681038 | 120681035 | + |
| SEQ ID NO 31899 | AACACTTAGGAACAAACTGT | AAAAAC | chr3 | 120682344 | 120682363 | 120682347 | - |
| SEQ ID NO 31900 | GACTGGTATCTTAAGGCAAG | GAAAAC | chr3 | 120681358 | 120681377 | 120681361 | - |
| SEQ ID NO 31901 | CAGAATATGTCCCTAATATC | TAAAAC | chr3 | 120681333 | 120681352 | 120681336 | - |
| SEQ ID NO 31902 | TCCTAATTGGTAGGAATCCT | GAAAAC | chr3 | 120681077 | 120681096 | 120681080 | - |
| SEQ ID NO 31903 | TGCCTGCATGCTCTAGAATC | CAAAAC | chr3 | 120680776 | 120680795 | 120680779 | - |
| SEQ ID NO 31904 | AGGTCAGGAATCTGAACACA | GAAAAC | chr3 | 120680350 | 120680369 | 120680353 | - |
| SEQ ID NO 31905 | AATAAACATTATATAATTTT | TAAAAC | chr3 | 120680298 | 120680317 | 120680301 | - |
| SEQ ID NO 31906 | AACCTTGGTTTCCTCATTTC | TAAAAC | chr3 | 120680099 | 120680118 | 120680102 | - |
| SEQ ID NO 31907 | TTACCACAAATTTATTGGCT | TAAAAC | chr3 | 120679912 | 120679931 | 120679915 | - |
| SEQ ID NO 31908 | AGTCAGGAGAAAGCACCTCA | TAAAAC | chr3 | 120679225 | 120679244 | 120679228 | - |
| SEQ ID NO 31909 | ATTCAGAAATCCGAACTGTA | GAAAAC | chr3 | 120679013 | 120679032 | 120679016 | - |
| SEQ ID NO 31910 | TTTTTCTCTCAGGGGATTAG | AAAAAC | chr3 | 120678746 | 120678765 | 120678749 | - |
| SEQ ID NO 31911 | CGTGATGCCCCACAAGCCAC | AAAAAC | chr3 | 120677765 | 120677784 | 120677768 | - |

Figure 53

| # | Sequence | PAM | Chr | Start | End | Cuts 5' of | Str |
|---|---|---|---|---|---|---|---|
| SEQ ID NO 31912 | AGACACAAATGCCACCATTA | GCAGGATT | chr3 | 120675877 | 120675896 | 120675893 | + |
| SEQ ID NO 31913 | AAAGAGCATTTCAGAAAATT | GGCAGTTT | chr3 | 120675906 | 120675925 | 120675922 | + |
| SEQ ID NO 31914 | GTAAGAATTTCTATATGGAC | CTATGTTT | chr3 | 120675940 | 120675959 | 120675956 | + |
| SEQ ID NO 31915 | GAATCATTTAGGGAAGACAA | TATGGTTT | chr3 | 120676014 | 120676033 | 120676030 | + |
| SEQ ID NO 31916 | CTCCACCCTTAGCTGTACTT | AGCTGATT | chr3 | 120676099 | 120676118 | 120676115 | + |
| SEQ ID NO 31917 | TTTGTGCGAATGCATGAAAA | TAAAGTTT | chr3 | 120676313 | 120676332 | 120676329 | + |
| SEQ ID NO 31918 | CAATGACACAATGGAACCTA | CTCTGATT | chr3 | 120676389 | 120676408 | 120676405 | + |
| SEQ ID NO 31919 | CCAGAGGAAAAAAAAAGTTA | AAGGGTTT | chr3 | 120676437 | 120676456 | 120676453 | + |
| SEQ ID NO 31920 | TTGTGAGTTCTTGTGCACTG | TCTGGCTT | chr3 | 120676523 | 120676542 | 120676539 | + |
| SEQ ID NO 31921 | GAAGGTAATCAGTGGAAATT | TGTCGATT | chr3 | 120676606 | 120676625 | 120676622 | + |
| SEQ ID NO 31922 | GTAATCAGTGGAAATTTGTC | GATTGATT | chr3 | 120676610 | 120676629 | 120676626 | + |
| SEQ ID NO 31923 | TTTGCTCTAACTTAAATACC | AATTGATT | chr3 | 120676707 | 120676726 | 120676723 | + |
| SEQ ID NO 31924 | CTGAAGCCATGGCAGAAGTT | CGTGGATT | chr3 | 120676898 | 120676917 | 120676914 | + |
| SEQ ID NO 31925 | TGGCAGAAGTTCGTGGATTG | TGAAGATT | chr3 | 120676907 | 120676926 | 120676923 | + |
| SEQ ID NO 31926 | CAATCTCTAAACATAAATTG | TAAAGATT | chr3 | 120676998 | 120677017 | 120677014 | + |
| SEQ ID NO 31927 | CACTTCCCCAGTCAATATCC | TTGTGATT | chr3 | 120677040 | 120677059 | 120677056 | + |
| SEQ ID NO 31928 | CTGCACAAATTGTACAGCAT | GTGTGTTT | chr3 | 120677152 | 120677171 | 120677168 | + |
| SEQ ID NO 31929 | GAGAATACGAGCCAGGAGGT | ATAGGCTT | chr3 | 120677371 | 120677390 | 120677387 | + |
| SEQ ID NO 31930 | CCCAGTCTCCCACAGCGCTC | CCAGGCTT | chr3 | 120677462 | 120677481 | 120677478 | + |
| SEQ ID NO 31931 | AAAATCCCTAATACAAACTT | GCTGGTTT | chr3 | 120677735 | 120677754 | 120677751 | + |
| SEQ ID NO 31932 | AATACAAACTTGCTGGTTTT | TGTGGCTT | chr3 | 120677744 | 120677763 | 120677760 | + |
| SEQ ID NO 31933 | TGTGATGCCTCCCCCGGATG | CCCGGCTT | chr3 | 120677798 | 120677817 | 120677814 | + |
| SEQ ID NO 31934 | CCTTTATTTCTAAAGTTGGC | CGACGCTT | chr3 | 120677853 | 120677872 | 120677869 | + |
| SEQ ID NO 31935 | ACAAAAAATACTAAGTTGTA | TACTGATT | chr3 | 120678107 | 120678126 | 120678123 | + |
| SEQ ID NO 31936 | ATGGCAGAGACCATCCAACA | TTCTGATT | chr3 | 120678179 | 120678198 | 120678195 | + |
| SEQ ID NO 31937 | GAACCCCATGCTCACCATCA | ACGGGATT | chr3 | 120678239 | 120678258 | 120678255 | + |
| SEQ ID NO 31938 | GCCACTGGGCATTACAGTGC | CTTCGCTT | chr3 | 120678351 | 120678370 | 120678367 | + |
| SEQ ID NO 31939 | TTCGCTTTGTTCAACTGCCG | CATTGTTT | chr3 | 120678372 | 120678391 | 120678388 | + |
| SEQ ID NO 31940 | GAAGGAAGGCTGGAGTACAG | CTGAGCTT | chr3 | 120678415 | 120678434 | 120678431 | + |
| SEQ ID NO 31941 | TTAGAAGAGGGTTCAGGGTT | ATGTGTTT | chr3 | 120678502 | 120678521 | 120678518 | + |
| SEQ ID NO 31942 | AGTATAAATGGTTCTGAAGC | ACTTGATT | chr3 | 120678542 | 120678561 | 120678558 | + |
| SEQ ID NO 31943 | TCTGAAGCACTTGATTCAGA | CTGTGCTT | chr3 | 120678554 | 120678573 | 120678570 | + |
| SEQ ID NO 31944 | AGAAAGTAGAAAGAACAGCT | GATGGTTT | chr3 | 120678595 | 120678614 | 120678611 | + |
| SEQ ID NO 31945 | CCAAGAGGTGTGAGTTCTGA | ATCCGTTT | chr3 | 120678642 | 120678661 | 120678658 | + |
| SEQ ID NO 31946 | GCTGAGTCACTATCAAATCA | ATTGGTTT | chr3 | 120678716 | 120678735 | 120678732 | + |
| SEQ ID NO 31947 | ATCCCCTGAGAGAAAAAGTA | CAGAGTTT | chr3 | 120678749 | 120678768 | 120678765 | + |
| SEQ ID NO 31948 | AGAAAAAGTACAGAGTTTAT | TGCAGCTT | chr3 | 120678759 | 120678778 | 120678775 | + |
| SEQ ID NO 31949 | ATTAAGGAAGCAGTATTCAC | AGCTGCTT | chr3 | 120678823 | 120678842 | 120678839 | + |
| SEQ ID NO 31950 | GCTCAAGGACAGAATCTGAA | CTCTGCTT | chr3 | 120678865 | 120678884 | 120678881 | + |
| SEQ ID NO 31951 | AAAGTATACTGTGTACAAAA | ATAAGATT | chr3 | 120678947 | 120678966 | 120678963 | + |
| SEQ ID NO 31952 | AAAAAGCTAACATTAAGCAA | GTGTGTTT | chr3 | 120678975 | 120678994 | 120678991 | + |
| SEQ ID NO 31953 | AACATTAAGCAAGTGTGTTT | GTATGTTT | chr3 | 120678983 | 120679002 | 120678999 | + |
| SEQ ID NO 31954 | TGTTTGTATGTTTTCTACAG | TTCGGATT | chr3 | 120678998 | 120679017 | 120679014 | + |
| SEQ ID NO 31955 | TAATTTGATCCGACAGAAAA | ATATGATT | chr3 | 120679032 | 120679051 | 120679048 | + |
| SEQ ID NO 31956 | TTCAGTACCATCAGCTCTTT | GGCAGCTT | chr3 | 120679130 | 120679149 | 120679146 | + |
| SEQ ID NO 31957 | TCTTTGGCAGCTTATGAGTA | TACAGCTT | chr3 | 120679145 | 120679164 | 120679161 | + |
| SEQ ID NO 31958 | TTCTCACCTGGTCCCCAGGA | TATGGTTT | chr3 | 120679178 | 120679197 | 120679194 | + |
| SEQ ID NO 31959 | GGATATGGTTTACTTGTCAG | AGTAGTTT | chr3 | 120679195 | 120679214 | 120679211 | + |

Figure 53 (Cont'd)

| SEQ ID NO 31960 | CTTGTCAGAGTAGTTTTATG | AGGTGCTT chr3 | 120679207 | 120679226 | 120679223 | + |
| SEQ ID NO 31961 | TATGAGGTGCTTTCTCCTGA | CTCTGATT chr3 | 120679223 | 120679242 | 120679239 | + |
| SEQ ID NO 31962 | ACCTTGATGGGAACATAGAA | CATAGATT chr3 | 120679396 | 120679415 | 120679412 | + |
| SEQ ID NO 31963 | GGCTCACTCTGAAAGATATG | TATGGCTT chr3 | 120679471 | 120679490 | 120679487 | + |
| SEQ ID NO 31964 | CATTATAAGAGGGAGGCAAA | GGGAGATT chr3 | 120679623 | 120679642 | 120679639 | + |
| SEQ ID NO 31965 | TTATAAGAGGAGAAAATGTG | ACGTGATT chr3 | 120679655 | 120679674 | 120679671 | + |
| SEQ ID NO 31966 | CCTCGACTTTAGCCCAGTGA | AACCGATT chr3 | 120679834 | 120679853 | 120679850 | + |
| SEQ ID NO 31967 | ACTTCAAGATAATACATTTG | TGTTGTTT chr3 | 120679882 | 120679901 | 120679898 | + |
| SEQ ID NO 31968 | CTAATCATTAGAATCACTCC | AGAAGCTT chr3 | 120679988 | 120680007 | 120680004 | + |
| SEQ ID NO 31969 | CAGACCCAGAGCCAGTGAAT | CAAGGATT chr3 | 120680024 | 120680043 | 120680040 | + |
| SEQ ID NO 31970 | GCCTGAATATTAAGCAAGTT | CTTCGTTT chr3 | 120680069 | 120680088 | 120680085 | + |
| SEQ ID NO 31971 | CCAGTTGTACTTTTGTGTAA | ATGTGATT chr3 | 120680205 | 120680224 | 120680221 | + |
| SEQ ID NO 31972 | TGTGTAAATGTGATTTCATT | TACGGCTT chr3 | 120680218 | 120680237 | 120680234 | + |
| SEQ ID NO 31973 | TGAAGAAATAAAAGATGAGA | AACAGTTT chr3 | 120680268 | 120680287 | 120680284 | + |
| SEQ ID NO 31974 | AAACAGTTTTAAAAATTATA | TAATGTTT chr3 | 120680287 | 120680306 | 120680303 | + |
| SEQ ID NO 31975 | TTTAAAAATTATATAATGTT | TATTGATT chr3 | 120680294 | 120680313 | 120680310 | + |
| SEQ ID NO 31976 | TTAGAATGAATATGATGCAA | TCTGGTTT chr3 | 120680320 | 120680339 | 120680336 | + |
| SEQ ID NO 31977 | ATGCAATCTGGTTTTCTGTG | TTCAGATT chr3 | 120680334 | 120680353 | 120680350 | + |
| SEQ ID NO 31978 | CTGGAGTTAACCTTTCTTTG | TAAAGATT chr3 | 120680370 | 120680389 | 120680386 | + |
| SEQ ID NO 31979 | TCCTGGTGCTGTGCATAATA | AGTTGCTT chr3 | 120680465 | 120680484 | 120680481 | + |
| SEQ ID NO 31980 | TGCTTAAACATGACAGCAGG | ATAGGATT chr3 | 120680488 | 120680507 | 120680504 | + |
| SEQ ID NO 31981 | AATTTATTTATAAATGGTAA | AGATGTTT chr3 | 120680524 | 120680543 | 120680540 | + |
| SEQ ID NO 31982 | ATAGAATGTTCATCAGAAAA | CAAAGTTT chr3 | 120680574 | 120680593 | 120680590 | + |
| SEQ ID NO 31983 | TCCAACCACCGCCTGGGTAT | CTCAGTTT chr3 | 120680706 | 120680725 | 120680722 | + |
| SEQ ID NO 31984 | ATCAACTCAAATTTGGCTGA | CACAGTTT chr3 | 120680746 | 120680765 | 120680762 | + |
| SEQ ID NO 31985 | TCAAATTTGGCTGACACAGT | TTTGGATT chr3 | 120680752 | 120680771 | 120680768 | + |
| SEQ ID NO 31986 | TTCCAACTTCTCTCTGAAGA | CTCAGTTT chr3 | 120680862 | 120680881 | 120680878 | + |
| SEQ ID NO 31987 | AAGTCTTTTACTCCGGTGTG | GAGTGTTT chr3 | 120681047 | 120681066 | 120681063 | + |
| SEQ ID NO 31988 | TACTCCGGTGTGGAGTGTTT | TCAGGATT chr3 | 120681055 | 120681074 | 120681071 | + |
| SEQ ID NO 31989 | AGGATTCCTACCAATTAGGA | AGGTGTTT chr3 | 120681077 | 120681096 | 120681093 | + |
| SEQ ID NO 31990 | TTCCTACCAATTAGGAAGGT | GTTTGATT chr3 | 120681081 | 120681100 | 120681097 | + |
| SEQ ID NO 31991 | AGAAACACCTCCCCTTAACT | GATGGATT chr3 | 120681119 | 120681138 | 120681135 | + |
| SEQ ID NO 31992 | TTACACATGCATGCGTTGAG | CATTGATT chr3 | 120681273 | 120681292 | 120681289 | + |
| SEQ ID NO 31993 | AGCCTGGCCTGGGCACTAGG | CATGGTTT chr3 | 120681303 | 120681322 | 120681319 | + |
| SEQ ID NO 31994 | TTTTAGATATTAGGGACATA | TTCTGTTT chr3 | 120681328 | 120681347 | 120681344 | + |
| SEQ ID NO 31995 | GGACTTCGCATTCAAACATA | CCCTGCTT chr3 | 120681411 | 120681430 | 120681427 | + |
| SEQ ID NO 31996 | ACAAGAACCTCTCTCTATAC | CCCAGATT chr3 | 120681511 | 120681530 | 120681527 | + |
| SEQ ID NO 31997 | TCTATACCCCAGATTTATTT | TGAGGATT chr3 | 120681524 | 120681543 | 120681540 | + |
| SEQ ID NO 31998 | TATGAGTTAATTCATAGCTA | AAATGCTT chr3 | 120681551 | 120681570 | 120681567 | + |
| SEQ ID NO 31999 | TGCGTATTACTAAAAAGAAG | GAATGATT chr3 | 120681617 | 120681636 | 120681633 | + |
| SEQ ID NO 32000 | AAGGAATGATTTCCTAGAGG | AGGTGCTT chr3 | 120681634 | 120681653 | 120681650 | + |
| SEQ ID NO 32001 | AGGTGCTTCTTCTGGCCAAG | GGCTGATT chr3 | 120681654 | 120681673 | 120681670 | + |
| SEQ ID NO 32002 | AGGGGAGCTCTTAGGATGTC | TACAGATT chr3 | 120681819 | 120681838 | 120681835 | + |
| SEQ ID NO 32003 | AAAGGCAAGGGATGACCAAT | AAGAGCTT chr3 | 120681871 | 120681890 | 120681887 | + |
| SEQ ID NO 32004 | ACAGGGAAGCCTCTGAACAC | AGGGGTTT chr3 | 120681959 | 120681978 | 120681975 | + |
| SEQ ID NO 32005 | AAGCCATAGCAAACTTGTCA | GATGGTTT chr3 | 120682064 | 120682083 | 120682080 | + |
| SEQ ID NO 32006 | GCCCAGAGGATATAAAGCCA | CAATGCTT chr3 | 120682152 | 120682171 | 120682168 | + |
| SEQ ID NO 32007 | TCTTTGGATATTCCGGTTCC | CACTGCTT chr3 | 120682198 | 120682217 | 120682214 | + |
| SEQ ID NO 32008 | TTCCGGTTCCCACTGCTTCA | CTGCGCTT chr3 | 120682208 | 120682227 | 120682224 | + |

Figure 53 (Cont'd)

| SEQ ID NO 32009 | ATACACAGGGACAAAGTCCA | GCAAGCTT | chr3 | 120682283 | 120682302 | 120682299 | + |
| SEQ ID NO 32010 | TAACCGGTTACACAATTGCC | TTTGGTTT | chr3 | 120682314 | 120682333 | 120682330 | + |
| SEQ ID NO 32011 | ACACAATTGCCTTTGGTTTT | TACAGTTT | chr3 | 120682323 | 120682342 | 120682339 | + |
| SEQ ID NO 32012 | GGTTTTTACAGTTTGTTCCT | AAGTGTTT | chr3 | 120682337 | 120682356 | 120682353 | + |
| SEQ ID NO 32013 | GTTTGTTCCTAAGTGTTTCC | AGAGGCTT | chr3 | 120682347 | 120682366 | 120682363 | + |
| SEQ ID NO 32014 | TGGTTCCTCTTCACCTGAGG | TAGAGATT | chr3 | 120682374 | 120682393 | 120682390 | + |
| SEQ ID NO 32015 | ATTATTTATTCCAGTTAAAA | GTAGGCTT | chr3 | 120682407 | 120682426 | 120682423 | + |
| SEQ ID NO 32016 | TAGTGCCTGCTGTGTGTGGT | GGAGGATT | chr3 | 120682486 | 120682505 | 120682502 | + |
| SEQ ID NO 32017 | CTGCCACAGTTCCTTTCCCC | GATAGCTT | chr3 | 120682465 | 120682484 | 120682468 | - |
| SEQ ID NO 32018 | GCAATTGTGTAACCGGTTAA | ATAAGCTT | chr3 | 120682313 | 120682332 | 120682316 | - |
| SEQ ID NO 32019 | TGAGTTAGACAATTCTTTCA | GCTAGTTT | chr3 | 120682264 | 120682283 | 120682267 | - |
| SEQ ID NO 32020 | GGGAACCGGAATATCCAAAG | AGTGGTTT | chr3 | 120682199 | 120682218 | 120682202 | - |
| SEQ ID NO 32021 | TTTGAAGGAGAAAGAAGCAT | TGTGGCTT | chr3 | 120682174 | 120682193 | 120682177 | - |
| SEQ ID NO 32022 | TGGCTTTATATCCTCTGGGC | CTGGGTTT | chr3 | 120682152 | 120682171 | 120682155 | - |
| SEQ ID NO 32023 | TAAAGGTAAGAAACCATCTG | ACAAGTTT | chr3 | 120682082 | 120682101 | 120682085 | - |
| SEQ ID NO 32024 | AAACCATCTGACAAGTTTGC | TATGGCTT | chr3 | 120682072 | 120682091 | 120682075 | - |
| SEQ ID NO 32025 | CTTCTTCAGCCAAAATTTAT | GGAAGTTT | chr3 | 120682047 | 120682066 | 120682050 | - |
| SEQ ID NO 32026 | TGGTTCAAACCCTGTGTTC | AGAGGCTT | chr3 | 120681973 | 120681992 | 120681976 | - |
| SEQ ID NO 32027 | CTCCCCTCCACTACGGACAT | GCACGTTT | chr3 | 120681806 | 120681825 | 120681809 | - |
| SEQ ID NO 32028 | CACTTCCGGTGACCAGTTAG | ATATGCTT | chr3 | 120681716 | 120681735 | 120681719 | - |
| SEQ ID NO 32029 | TCTGGGGTATAGAGAGAGGT | TCTTGTTT | chr3 | 120681517 | 120681536 | 120681520 | - |
| SEQ ID NO 32030 | TCTTGTTTCAATTAGAAAAG | TAATGCTT | chr3 | 120681497 | 120681516 | 120681500 | - |
| SEQ ID NO 32031 | AAAAGTAATGCTTGGAGAGA | CTATGATT | chr3 | 120681482 | 120681501 | 120681485 | - |
| SEQ ID NO 32032 | AAGGTCACTGCCAATAGATG | ACTTGATT | chr3 | 120681449 | 120681468 | 120681452 | - |
| SEQ ID NO 32033 | ATGACTTGATTAGAAGCAGG | GTATGTTT | chr3 | 120681432 | 120681451 | 120681435 | - |
| SEQ ID NO 32034 | AACCATGCCTAGTGCCCAGG | CCAGGCTT | chr3 | 120681310 | 120681329 | 120681313 | - |
| SEQ ID NO 32035 | ACAGACATCTTCCCTGAATG | CAGGGTTT | chr3 | 120681197 | 120681216 | 120681200 | - |
| SEQ ID NO 32036 | CTAATGCCCTCTAACTGATG | CTGAGTTT | chr3 | 120681159 | 120681178 | 120681162 | - |
| SEQ ID NO 32037 | AGAATCCATCAGTTAAGGGG | AGGTGTTT | chr3 | 120681129 | 120681148 | 120681132 | - |
| SEQ ID NO 32038 | TCAGTTAAGGGGAGGTGTTT | CTGAGTTT | chr3 | 120681121 | 120681140 | 120681124 | - |
| SEQ ID NO 32039 | TCCACACCGGAGTAAAAGAC | TTTGGTTT | chr3 | 120681049 | 120681068 | 120681052 | - |
| SEQ ID NO 32040 | TTTGTGCTAGTGCATGACAC | TGCAGATT | chr3 | 120680967 | 120680986 | 120680970 | - |
| SEQ ID NO 32041 | ACTGAGATACCCAGGCGGTG | GTTGGATT | chr3 | 120680712 | 120680731 | 120680715 | - |
| SEQ ID NO 32042 | GCGGTGGTTGGATTTATGGA | TCTGGATT | chr3 | 120680698 | 120680717 | 120680701 | - |
| SEQ ID NO 32043 | GAAGAAAGAGTAGATAGAAA | CTTTGTTT | chr3 | 120680599 | 120680618 | 120680602 | - |
| SEQ ID NO 32044 | TGTAAAATCCTATCCTGCTG | TCATGTTT | chr3 | 120680501 | 120680520 | 120680504 | - |
| SEQ ID NO 32045 | ATTGCATGCCAGTCTTTGCT | CTCAGTTT | chr3 | 120680434 | 120680453 | 120680437 | - |
| SEQ ID NO 32046 | CAGGAATCTGAACACAGAAA | ACCAGATT | chr3 | 120680346 | 120680365 | 120680349 | - |
| SEQ ID NO 32047 | AAACATTATATAATTTTTAA | AACTGTTT | chr3 | 120680295 | 120680314 | 120680298 | - |
| SEQ ID NO 32048 | ATACCCTATGTATTTGAGTA | AGTTGCTT | chr3 | 120680137 | 120680156 | 120680140 | - |
| SEQ ID NO 32049 | CTATGTATTTGAGTAAGTTG | CTTAGCTT | chr3 | 120680132 | 120680151 | 120680135 | - |
| SEQ ID NO 32050 | GTTGCTTAGCTTCTCCCAAC | CTTGGTTT | chr3 | 120680116 | 120680135 | 120680119 | - |
| SEQ ID NO 32051 | CCTCATTTCTAAAACGAAGA | ACTTGCTT | chr3 | 120680088 | 120680107 | 120680091 | - |
| SEQ ID NO 32052 | TCTGGGCCCACCACCAAAT | CCTTGATT | chr3 | 120680049 | 120680068 | 120680052 | - |
| SEQ ID NO 32053 | TGGCTCTGGGTCTGTATGTA | ACAAGCTT | chr3 | 120680018 | 120680037 | 120680021 | - |
| SEQ ID NO 32054 | CTGTATGTAACAAGCTTCTG | GAGTGATT | chr3 | 120680007 | 120680026 | 120680010 | - |
| SEQ ID NO 32055 | ACAAGCTTCTGGAGTGATTC | TAATGATT | chr3 | 120679998 | 120680017 | 120680001 | - |
| SEQ ID NO 32056 | CAGGACCTACTATTCTACGT | AACTGATT | chr3 | 120679961 | 120679980 | 120679964 | - |
| SEQ ID NO 32057 | TAAAAAATTACCACAAATTT | ATTGGCTT | chr3 | 120679919 | 120679938 | 120679922 | - |

Figure 53 (Cont'd)

| SEQ ID NO | Sequence | | Chr | Start | End | Pos | Strand |
|---|---|---|---|---|---|---|---|
| SEQ ID NO 32058 | GTGGAGGTCAGAAGTCTGAA | ATCGGTTT | chr3 | 120679861 | 120679880 | 120679864 | - |
| SEQ ID NO 32059 | TAAAGTCGAGGTGTCAGTGT | GGCTGTTT | chr3 | 120679825 | 120679844 | 120679828 | - |
| SEQ ID NO 32060 | GTTTCTTCTGGAGACTCTAT | GAGAGATT | chr3 | 120679801 | 120679820 | 120679804 | - |
| SEQ ID NO 32061 | TCTGGAGACTCTATGAGAGA | TTGTGTTT | chr3 | 120679795 | 120679814 | 120679798 | - |
| SEQ ID NO 32062 | TTGTGTTTTCCTGCCTTTTC | CATGGATT | chr3 | 120679775 | 120679794 | 120679778 | - |
| SEQ ID NO 32063 | TTTCCTGCCTTTTCCATGGA | TTCTGTTT | chr3 | 120679769 | 120679788 | 120679772 | - |
| SEQ ID NO 32064 | TCTAGAGGCTACCCACATTC | CTTGGTTT | chr3 | 120679736 | 120679755 | 120679739 | - |
| SEQ ID NO 32065 | CGATCTTCAAAAAAATGTAT | CTCTGCTT | chr3 | 120679695 | 120679714 | 120679698 | - |
| SEQ ID NO 32066 | CCTCCCTCTTATAATGACAC | TTGTGATT | chr3 | 120679619 | 120679638 | 120679622 | - |
| SEQ ID NO 32067 | CCTTAATTATATATGCAAAA | GTCTGTTT | chr3 | 120679543 | 120679562 | 120679546 | - |
| SEQ ID NO 32068 | GGCTAGAAAAGATAATACTC | ACAGGTTT | chr3 | 120679515 | 120679534 | 120679518 | - |
| SEQ ID NO 32069 | ACAGAAAAAAAAAATGTAGC | AGTAGTTT | chr3 | 120679349 | 120679368 | 120679352 | - |
| SEQ ID NO 32070 | TGTAGAAAACATACAAACAC | ACTTGCTT | chr3 | 120678997 | 120679016 | 120679000 | - |
| SEQ ID NO 32071 | TACAAACACACTTGCTTAAT | GTTAGCTT | chr3 | 120678986 | 120679005 | 120678989 | - |
| SEQ ID NO 32072 | GCACTGAACCAGCTGGAAAT | GAATGCTT | chr3 | 120678920 | 120678939 | 120678923 | - |
| SEQ ID NO 32073 | GAACCAGCTGGAAATGAATG | CTTGGATT | chr3 | 120678915 | 120678934 | 120678918 | - |
| SEQ ID NO 32074 | CGCAGCTGATAAAAGCAGAG | TTCAGATT | chr3 | 120678885 | 120678904 | 120678888 | - |
| SEQ ID NO 32075 | CTGGAGAAAGCAGCTGTGAA | TACTGCTT | chr3 | 120678838 | 120678857 | 120678841 | - |
| SEQ ID NO 32076 | AACTCTGTACTTTTTCTCTC | AGGGGATT | chr3 | 120678756 | 120678775 | 120678759 | - |
| SEQ ID NO 32077 | CTCAGGGGATTAGAAAAACC | AATTGATT | chr3 | 120678739 | 120678758 | 120678742 | - |
| SEQ ID NO 32078 | AATTGATTTGATAGTGACTC | AGCAGTTT | chr3 | 120678719 | 120678738 | 120678722 | - |
| SEQ ID NO 32079 | CTTTAGCCAATGCCCTGCAG | CTAAGATT | chr3 | 120678681 | 120678700 | 120678684 | - |
| SEQ ID NO 32080 | CCCTGCAGCTAAGATTGAGA | AACGGATT | chr3 | 120678669 | 120678688 | 120678672 | - |
| SEQ ID NO 32081 | GATTCAGAACTCACACCTCT | TGGTGCTT | chr3 | 120678645 | 120678664 | 120678648 | - |
| SEQ ID NO 32082 | TTTAAAGCACAGTCTGAATC | AAGTGCTT | chr3 | 120678566 | 120678585 | 120678569 | - |
| SEQ ID NO 32083 | GCGAAGGCACTGTAATGCCC | AGTGGCTT | chr3 | 120678357 | 120678376 | 120678360 | - |
| SEQ ID NO 32084 | ATATCATCCTAACTGCATGC | TGCTGCTT | chr3 | 120678149 | 120678168 | 120678152 | - |
| SEQ ID NO 32085 | AAAGAATAATTTTTCACTTC | CATTGCTT | chr3 | 120678043 | 120678062 | 120678046 | - |
| SEQ ID NO 32086 | CCTGATCATCACTCACACAT | CCAGGCTT | chr3 | 120677961 | 120677980 | 120677964 | - |
| SEQ ID NO 32087 | CCCACAAGCCACAAAAACCA | GCAAGTTT | chr3 | 120677757 | 120677776 | 120677760 | - |
| SEQ ID NO 32088 | AAAAACCAGCAAGTTTGTAT | TAGGGATT | chr3 | 120677745 | 120677764 | 120677748 | - |
| SEQ ID NO 32089 | GGCGAAATTAAAATTGCTAA | TGAAGTTT | chr3 | 120677598 | 120677617 | 120677601 | - |
| SEQ ID NO 32090 | GATAACATCTTATCAGGAGA | CAGGGTTT | chr3 | 120677553 | 120677572 | 120677556 | - |
| SEQ ID NO 32091 | GACAGGCGCACCTGGAGGGG | GGCTGTTT | chr3 | 120677409 | 120677428 | 120677412 | - |
| SEQ ID NO 32092 | AATTCAGCGATATTTCTCCC | ATTTGCTT | chr3 | 120677320 | 120677339 | 120677323 | - |
| SEQ ID NO 32093 | CTGCCTGGCTCACCAGCAGT | CAGAGTTT | chr3 | 120677265 | 120677284 | 120677268 | - |
| SEQ ID NO 32094 | ATATACATCCTCCTCAGCTG | ACAGGATT | chr3 | 120677102 | 120677121 | 120677105 | - |
| SEQ ID NO 32095 | CCTCCTCAGCTGACAGGATT | AAGAGATT | chr3 | 120677094 | 120677113 | 120677097 | - |
| SEQ ID NO 32096 | GTCCATGAAATCTTTACAAT | TTATGTTT | chr3 | 120677014 | 120677033 | 120677017 | - |
| SEQ ID NO 32097 | AAATCTTTACAATTTATGTT | TAGAGATT | chr3 | 120677007 | 120677026 | 120677010 | - |
| SEQ ID NO 32098 | CACAATCCACGAACTTCTGC | CATGGCTT | chr3 | 120676909 | 120676928 | 120676912 | - |
| SEQ ID NO 32099 | GCCATGGCTTCAGCTGATCC | CTCCGTTT | chr3 | 120676891 | 120676910 | 120676894 | - |
| SEQ ID NO 32100 | GCTGTGTTCAGATGGTTACA | TTTCGCTT | chr3 | 120676779 | 120676798 | 120676782 | - |
| SEQ ID NO 32101 | ACACATACACTTACATTAGA | ATTGGCTT | chr3 | 120676660 | 120676679 | 120676663 | - |
| SEQ ID NO 32102 | TCAATCAATCGACAAATTTC | CACTGATT | chr3 | 120676620 | 120676639 | 120676623 | - |
| SEQ ID NO 32103 | TGCCATAGTCTCAGCCTTCA | TGCAGCTT | chr3 | 120676573 | 120676592 | 120676576 | - |
| SEQ ID NO 32104 | GTGTGTTGAGTGTTGCAAGA | GTAAGTTT | chr3 | 120676503 | 120676522 | 120676506 | - |
| SEQ ID NO 32105 | CCATAGATGAGGCAGATAGC | AGAGGCTT | chr3 | 120676281 | 120676300 | 120676284 | - |
| SEQ ID NO 32106 | AGGCTTCTGCCTACAGCAAG | GCTAGTTT | chr3 | 120676259 | 120676278 | 120676262 | - |

Figure 53 (Cont'd)

| | | | | | | |
|---|---|---|---|---|---|---|
| SEQ ID NO 32107 | TACAGCAAGGCTAGTTTGGA | GAGGGTTT | chr3 | 120676248 | 120676267 | 120676251 - |
| SEQ ID NO 32108 | GGACCCACACACCTCTTCAT | AGATGCTT | chr3 | 120676207 | 120676226 | 120676210 - |
| SEQ ID NO 32109 | ATGCTTTTTCTTTTTTTTCC | CAGAGTTT | chr3 | 120676185 | 120676204 | 120676188 - |
| SEQ ID NO 32110 | CTATGCAATATCCAGCACTC | TTCTGATT | chr3 | 120676075 | 120676094 | 120676078 - |
| SEQ ID NO 32111 | GAAACCATATTGTCTTCCCT | AAATGATT | chr3 | 120676023 | 120676042 | 120676026 - |
| SEQ ID NO 32112 | TTTGTCACCTACAGTACATT | TCTGGATT | chr3 | 120675858 | 120675877 | 120675861 - |

Figure 54

| # | Sequence | PAM | Chr | Start | End | Cut site 1 (5' of) | Cut site 2 (5' of) | Str |
|---|---|---|---|---|---|---|---|---|
| SEQ ID NO 32113 | TCCTTCTGGCAGGGAACCTGGG | CTG | chr3 | 120675795 | 120675816 | 120675812 | 120675817 | + |
| SEQ ID NO 32114 | CTGGCAGGGAACCTGGGCAGCG | CTT | chr3 | 120675800 | 120675821 | 120675817 | 120675822 | + |
| SEQ ID NO 32115 | TGGCAGGGAACCTGGGCAGCGA | TTC | chr3 | 120675801 | 120675822 | 120675818 | 120675823 | + |
| SEQ ID NO 32116 | GCAGGGAACCTGGGCAGCGAGG | CTG | chr3 | 120675803 | 120675824 | 120675820 | 120675825 | + |
| SEQ ID NO 32117 | GGCAGCGAGGATCCTCTGAAGA | CTG | chr3 | 120675815 | 120675836 | 120675832 | 120675837 | + |
| SEQ ID NO 32118 | TGAAGAACACTCATTCCCAAAT | CTC | chr3 | 120675831 | 120675852 | 120675848 | 120675853 | + |
| SEQ ID NO 32119 | AAGAACACTCATTCCCAAATCC | CTG | chr3 | 120675833 | 120675854 | 120675850 | 120675855 | + |
| SEQ ID NO 32120 | ATTCCCAAATCCAGAAATGTAC | CTC | chr3 | 120675843 | 120675864 | 120675860 | 120675865 | + |
| SEQ ID NO 32121 | CCAAATCCAGAAATGTACTGTA | TTC | chr3 | 120675847 | 120675868 | 120675864 | 120675869 | + |
| SEQ ID NO 32122 | TAGGTGACAAAGACACAAATGC | CTG | chr3 | 120675867 | 120675888 | 120675884 | 120675889 | + |
| SEQ ID NO 32123 | GCAGGATTTAAAGAGCATTTCA | TTA | chr3 | 120675897 | 120675918 | 120675914 | 120675919 | + |
| SEQ ID NO 32124 | AAAGAGCATTTCAGAAAATTGG | TTT | chr3 | 120675906 | 120675927 | 120675923 | 120675928 | + |
| SEQ ID NO 32125 | AAGAGCATTTCAGAAAATTGGC | TTA | chr3 | 120675907 | 120675928 | 120675924 | 120675929 | + |
| SEQ ID NO 32126 | CAGAAAATTGGCAGTTTACTAA | TTT | chr3 | 120675917 | 120675938 | 120675934 | 120675939 | + |
| SEQ ID NO 32127 | AGAAAATTGGCAGTTTACTAAG | TTC | chr3 | 120675918 | 120675939 | 120675935 | 120675940 | + |
| SEQ ID NO 32128 | GCAGTTTACTAAGGTAAGAATT | TTG | chr3 | 120675927 | 120675948 | 120675944 | 120675949 | + |
| SEQ ID NO 32129 | ACTAAGGTAAGAATTTCTATAT | TTT | chr3 | 120675934 | 120675955 | 120675951 | 120675956 | + |
| SEQ ID NO 32130 | CTAAGGTAAGAATTTCTATATG | TTA | chr3 | 120675935 | 120675956 | 120675952 | 120675957 | + |
| SEQ ID NO 32131 | AGGTAAGAATTTCTATATGGAC | CTA | chr3 | 120675938 | 120675959 | 120675955 | 120675960 | + |
| SEQ ID NO 32132 | CTATATGGACCTATGTTTGTGT | TTT | chr3 | 120675950 | 120675971 | 120675967 | 120675972 | + |
| SEQ ID NO 32133 | TATATGGACCTATGTTTGTGTA | TTC | chr3 | 120675951 | 120675972 | 120675968 | 120675973 | + |
| SEQ ID NO 32134 | TATGGACCTATGTTTGTGTATG | CTA | chr3 | 120675953 | 120675974 | 120675970 | 120675975 | + |
| SEQ ID NO 32135 | TGTTTGTGTATGATGTTCCACA | CTA | chr3 | 120675963 | 120675984 | 120675980 | 120675985 | + |
| SEQ ID NO 32136 | GTGTATGATGTTCCACATATAA | TTT | chr3 | 120675968 | 120675989 | 120675985 | 120675990 | + |
| SEQ ID NO 32137 | TGTATGATGTTCCACATATAAT | TTG | chr3 | 120675969 | 120675990 | 120675986 | 120675991 | + |
| SEQ ID NO 32138 | CACATATAATATCTTTACTGTG | TTC | chr3 | 120675981 | 120676002 | 120675998 | 120676003 | + |
| SEQ ID NO 32139 | TACTGTGTCTTGACATATGAAT | CTT | chr3 | 120675996 | 120676017 | 120676013 | 120676018 | + |
| SEQ ID NO 32140 | ACTGTGTCTTGACATATGAATC | TTT | chr3 | 120675997 | 120676018 | 120676014 | 120676019 | + |
| SEQ ID NO 32141 | CTGTGTCTTGACATATGAATCA | TTA | chr3 | 120675998 | 120676019 | 120676015 | 120676020 | + |
| SEQ ID NO 32142 | TGTCTTGACATATGAATCATTT | CTG | chr3 | 120676001 | 120676022 | 120676018 | 120676023 | + |
| SEQ ID NO 32143 | GACATATGAATCATTTAGGGAA | CTT | chr3 | 120676007 | 120676028 | 120676024 | 120676029 | + |
| SEQ ID NO 32144 | ACATATGAATCATTTAGGGAAG | TTG | chr3 | 120676008 | 120676029 | 120676025 | 120676030 | + |
| SEQ ID NO 32145 | AGGGAAGACAATATGGTTTCTG | TTT | chr3 | 120676023 | 120676044 | 120676040 | 120676045 | + |
| SEQ ID NO 32146 | GGGAAGACAATATGGTTTCTGT | TTA | chr3 | 120676024 | 120676045 | 120676041 | 120676046 | + |
| SEQ ID NO 32147 | CTGTGAATTTTAAAGACTTCTA | TTT | chr3 | 120676042 | 120676063 | 120676059 | 120676064 | + |
| SEQ ID NO 32148 | TGTGAATTTTAAAGACTTCTAA | TTC | chr3 | 120676043 | 120676064 | 120676060 | 120676065 | + |
| SEQ ID NO 32149 | TGAATTTTAAAGACTTCTAATT | CTG | chr3 | 120676045 | 120676066 | 120676062 | 120676067 | + |
| SEQ ID NO 32150 | TAAAGACTTCTAATTAATCAGA | TTT | chr3 | 120676052 | 120676073 | 120676069 | 120676074 | + |
| SEQ ID NO 32151 | AAAGACTTCTAATTAATCAGAA | TTT | chr3 | 120676053 | 120676074 | 120676070 | 120676075 | + |
| SEQ ID NO 32152 | AAGACTTCTAATTAATCAGAAG | TTA | chr3 | 120676054 | 120676075 | 120676071 | 120676076 | + |
| SEQ ID NO 32153 | CTAATTAATCAGAAGAGTGCTG | CTT | chr3 | 120676061 | 120676082 | 120676078 | 120676083 | + |
| SEQ ID NO 32154 | TAATTAATCAGAAGAGTGCTGG | TTC | chr3 | 120676062 | 120676083 | 120676079 | 120676084 | + |
| SEQ ID NO 32155 | ATTAATCAGAAGAGTGCTGGAT | CTA | chr3 | 120676064 | 120676085 | 120676081 | 120676086 | + |
| SEQ ID NO 32156 | ATCAGAAGAGTGCTGGATATTG | TTA | chr3 | 120676068 | 120676089 | 120676085 | 120676090 | + |
| SEQ ID NO 32157 | GATATTGCATAGACTTCTCCAC | CTG | chr3 | 120676083 | 120676104 | 120676100 | 120676105 | + |
| SEQ ID NO 32158 | CATAGACTTCTCCACCCTTAGC | TTG | chr3 | 120676090 | 120676111 | 120676107 | 120676112 | + |
| SEQ ID NO 32159 | CTCCACCCTTAGCTGTACTTAG | CTT | chr3 | 120676099 | 120676120 | 120676116 | 120676121 | + |
| SEQ ID NO 32160 | TCCACCCTTAGCTGTACTTAGC | TTC | chr3 | 120676100 | 120676121 | 120676117 | 120676122 | + |
| SEQ ID NO 32161 | CACCCTTAGCTGTACTTAGCTG | CTC | chr3 | 120676102 | 120676123 | 120676119 | 120676124 | + |
| SEQ ID NO 32162 | AGCTGTACTTAGCTGATTTGTG | CTT | chr3 | 120676109 | 120676130 | 120676126 | 120676131 | + |
| SEQ ID NO 32163 | GCTGTACTTAGCTGATTTGTGG | TTA | chr3 | 120676110 | 120676131 | 120676127 | 120676132 | + |
| SEQ ID NO 32164 | TACTTAGCTGATTTGTGGGTCT | CTG | chr3 | 120676114 | 120676135 | 120676131 | 120676136 | + |
| SEQ ID NO 32165 | AGCTGATTTGTGGGTCTACACT | CTT | chr3 | 120676119 | 120676140 | 120676136 | 120676141 | + |
| SEQ ID NO 32166 | GCTGATTTGTGGGTCTACACTG | TTA | chr3 | 120676120 | 120676141 | 120676137 | 120676142 | + |
| SEQ ID NO 32167 | ATTTGTGGGTCTACACTGTAAC | CTG | chr3 | 120676124 | 120676145 | 120676141 | 120676146 | + |
| SEQ ID NO 32168 | GTGGGTCTACACTGTAACCTCC | TTT | chr3 | 120676128 | 120676149 | 120676145 | 120676150 | + |
| SEQ ID NO 32169 | TGGGTCTACACTGTAACCTCCC | TTG | chr3 | 120676129 | 120676150 | 120676146 | 120676151 | + |
| SEQ ID NO 32170 | CACTGTAACCTCCCTGAACTTG | CTA | chr3 | 120676137 | 120676158 | 120676154 | 120676159 | + |

Figure 54 (Cont'd)

| | | | | | | | | |
|---|---|---|---|---|---|---|---|---|
| SEQ ID NO 32171 | TAACCTCCCTGAACTTGAGACT | CTG | chr3 | 120676142 | 120676163 | 120676159 | 120676164 | + |
| SEQ ID NO 32172 | CCTGAACTTGAGACTCCATTTC | CTC | chr3 | 120676149 | 120676170 | 120676166 | 120676171 | + |
| SEQ ID NO 32173 | AACTTGAGACTCCATTTCCCTT | CTG | chr3 | 120676153 | 120676174 | 120676170 | 120676175 | + |
| SEQ ID NO 32174 | GAGACTCCATTTCCCTTTCAAA | CTT | chr3 | 120676158 | 120676179 | 120676175 | 120676180 | + |
| SEQ ID NO 32175 | AGACTCCATTTCCCTTTCAAAC | TTG | chr3 | 120676159 | 120676180 | 120676176 | 120676181 | + |
| SEQ ID NO 32176 | CATTTCCCTTTCAAACTCTGGG | CTC | chr3 | 120676165 | 120676186 | 120676182 | 120676187 | + |
| SEQ ID NO 32177 | CCCTTTCAAACTCTGGGAAAAA | TTT | chr3 | 120676170 | 120676191 | 120676187 | 120676192 | + |
| SEQ ID NO 32178 | CCTTTCAAACTCTGGGAAAAAA | TTC | chr3 | 120676171 | 120676192 | 120676188 | 120676193 | + |
| SEQ ID NO 32179 | TCAAACTCTGGGAAAAAAAGA | CTT | chr3 | 120676175 | 120676196 | 120676192 | 120676197 | + |
| SEQ ID NO 32180 | CAAACTCTGGGAAAAAAAGAA | TTT | chr3 | 120676176 | 120676197 | 120676193 | 120676198 | + |
| SEQ ID NO 32181 | AAACTCTGGGAAAAAAAGAAA | TTC | chr3 | 120676177 | 120676198 | 120676194 | 120676199 | + |
| SEQ ID NO 32182 | TGGGAAAAAAAGAAAAAGCAT | CTC | chr3 | 120676183 | 120676204 | 120676200 | 120676205 | + |
| SEQ ID NO 32183 | GGAAAAAAAGAAAAAGCATCT | CTG | chr3 | 120676185 | 120676206 | 120676202 | 120676207 | + |
| SEQ ID NO 32184 | TGAAGAGGTGTGTGGGTCCAAC | CTA | chr3 | 120676208 | 120676229 | 120676225 | 120676230 | + |
| SEQ ID NO 32185 | ACAGCAAAACCCTCTCCAAACT | CTG | chr3 | 120676234 | 120676255 | 120676251 | 120676256 | + |
| SEQ ID NO 32186 | TCCAAACTAGCCTTGCTGTAGG | CTC | chr3 | 120676248 | 120676269 | 120676265 | 120676270 | + |
| SEQ ID NO 32187 | CAAACTAGCCTTGCTGTAGGCA | CTC | chr3 | 120676250 | 120676271 | 120676267 | 120676272 | + |
| SEQ ID NO 32188 | GCCTTGCTGTAGGCAGAAGCCT | CTA | chr3 | 120676257 | 120676278 | 120676274 | 120676279 | + |
| SEQ ID NO 32189 | GCTGTAGGCAGAAGCCTCTGCT | CTT | chr3 | 120676262 | 120676283 | 120676279 | 120676284 | + |
| SEQ ID NO 32190 | CTGTAGGCAGAAGCCTCTGCTA | TTG | chr3 | 120676263 | 120676284 | 120676280 | 120676285 | + |
| SEQ ID NO 32191 | TAGGCAGAAGCCTCTGCTATCT | CTG | chr3 | 120676266 | 120676287 | 120676283 | 120676288 | + |
| SEQ ID NO 32192 | TGCTATCTGCCTCATCTATGGA | CTC | chr3 | 120676280 | 120676301 | 120676297 | 120676302 | + |
| SEQ ID NO 32193 | CTATCTGCCTCATCTATGGAAC | CTG | chr3 | 120676282 | 120676303 | 120676299 | 120676304 | + |
| SEQ ID NO 32194 | TCTGCCTCATCTATGGAACACA | CTA | chr3 | 120676285 | 120676306 | 120676302 | 120676307 | + |
| SEQ ID NO 32195 | CCTCATCTATGGAACACATCTA | CTG | chr3 | 120676289 | 120676310 | 120676306 | 120676311 | + |
| SEQ ID NO 32196 | ATCTATGGAACACATCTATATT | CTC | chr3 | 120676293 | 120676314 | 120676310 | 120676315 | + |
| SEQ ID NO 32197 | TGGAACACATCTATATTTGTGC | CTA | chr3 | 120676298 | 120676319 | 120676315 | 120676320 | + |
| SEQ ID NO 32198 | TATTTGTGCGAATGCATGAAAA | CTA | chr3 | 120676311 | 120676332 | 120676328 | 120676333 | + |
| SEQ ID NO 32199 | GTGCGAATGCATGAAAATAAAG | TTT | chr3 | 120676316 | 120676337 | 120676333 | 120676338 | + |
| SEQ ID NO 32200 | TGCGAATGCATGAAAATAAAGT | TTG | chr3 | 120676317 | 120676338 | 120676334 | 120676339 | + |
| SEQ ID NO 32201 | AAAGTATGGGTGGCCTTCAGG | TTT | chr3 | 120676341 | 120676362 | 120676358 | 120676363 | + |
| SEQ ID NO 32202 | AAGATATGGGTGGCCTTCAGGA | TTA | chr3 | 120676342 | 120676363 | 120676359 | 120676364 | + |
| SEQ ID NO 32203 | CAGGAGACACGCCAGCCCAGCA | CTT | chr3 | 120676359 | 120676380 | 120676376 | 120676381 | + |
| SEQ ID NO 32204 | AGGAGACACGCCAGCCCAGCAT | TTC | chr3 | 120676360 | 120676381 | 120676377 | 120676382 | + |
| SEQ ID NO 32205 | TTCACAATGACACAATGGAACC | CTT | chr3 | 120676385 | 120676406 | 120676402 | 120676407 | + |
| SEQ ID NO 32206 | TCACAATGACACAATGGAACCT | TTT | chr3 | 120676386 | 120676407 | 120676403 | 120676408 | + |
| SEQ ID NO 32207 | CACAATGACACAATGGAACCTA | TTT | chr3 | 120676387 | 120676408 | 120676404 | 120676409 | + |
| SEQ ID NO 32208 | ACAATGACACAATGGAACCTAC | TTC | chr3 | 120676388 | 120676409 | 120676405 | 120676410 | + |
| SEQ ID NO 32209 | CTCTGATTGCCATCTCTTCACT | CTA | chr3 | 120676409 | 120676430 | 120676426 | 120676431 | + |
| SEQ ID NO 32210 | TGATTGCCATCTCTTCACTTTA | CTC | chr3 | 120676412 | 120676433 | 120676429 | 120676434 | + |
| SEQ ID NO 32211 | ATTGCCATCTCTTCACTTTACA | CTG | chr3 | 120676414 | 120676435 | 120676431 | 120676436 | + |
| SEQ ID NO 32212 | CCATCTCTTCACTTTACACCCA | TTG | chr3 | 120676418 | 120676439 | 120676435 | 120676440 | + |
| SEQ ID NO 32213 | TTCACTTTACACCCAGAGGAAA | CTC | chr3 | 120676425 | 120676446 | 120676442 | 120676447 | + |
| SEQ ID NO 32214 | CACTTTACACCCAGAGGAAAAA | CTT | chr3 | 120676427 | 120676448 | 120676444 | 120676449 | + |
| SEQ ID NO 32215 | ACTTTACACCCAGAGGAAAAAA | TTC | chr3 | 120676428 | 120676449 | 120676445 | 120676450 | + |
| SEQ ID NO 32216 | TACACCCAGAGGAAAAAAAAG | CTT | chr3 | 120676432 | 120676453 | 120676449 | 120676454 | + |
| SEQ ID NO 32217 | ACACCCAGAGGAAAAAAAAGT | TTT | chr3 | 120676433 | 120676454 | 120676450 | 120676455 | + |
| SEQ ID NO 32218 | CACCCAGAGGAAAAAAAAGTT | TTA | chr3 | 120676434 | 120676455 | 120676451 | 120676456 | + |
| SEQ ID NO 32219 | AAGGGTTTCTCAACCAGGTAAG | TTA | chr3 | 120676457 | 120676478 | 120676474 | 120676479 | + |
| SEQ ID NO 32220 | CTCAACCAGGTAAGTCATGGAG | TTT | chr3 | 120676465 | 120676486 | 120676482 | 120676487 | + |
| SEQ ID NO 32221 | TCAACCAGGTAAGTCATGGAGA | TTC | chr3 | 120676466 | 120676487 | 120676483 | 120676488 | + |
| SEQ ID NO 32222 | AACCAGGTAAGTCATGGAGAGC | CTC | chr3 | 120676468 | 120676489 | 120676485 | 120676490 | + |
| SEQ ID NO 32223 | AAACTTACTCTTGCAACACTCA | CTG | chr3 | 120676495 | 120676516 | 120676512 | 120676517 | + |
| SEQ ID NO 32224 | ACTCTTGCAACACTCAACACAC | CTT | chr3 | 120676501 | 120676522 | 120676518 | 120676523 | + |
| SEQ ID NO 32225 | CTCTTGCAACACTCAACACACT | TTA | chr3 | 120676502 | 120676523 | 120676519 | 120676524 | + |
| SEQ ID NO 32226 | TTGCAACACTCAACACACTTGT | CTC | chr3 | 120676505 | 120676526 | 120676522 | 120676527 | + |
| SEQ ID NO 32227 | GCAACACTCAACACACTTGTGA | CTT | chr3 | 120676507 | 120676528 | 120676524 | 120676529 | + |
| SEQ ID NO 32228 | CAACACTCAACACACTTGTGAG | TTG | chr3 | 120676508 | 120676529 | 120676525 | 120676530 | + |
| SEQ ID NO 32229 | AACACACTTGTGAGTTCTTGTG | CTC | chr3 | 120676516 | 120676537 | 120676533 | 120676538 | + |

Figure 54 (Cont'd)

| | | | | | | | | |
|---|---|---|---|---|---|---|---|---|
| SEQ ID NO 32230 | GTGAGTTCTTGTGCACTGTCTG | CTT | chr3 | 120676525 | 120676546 | 120676542 | 120676547 | + |
| SEQ ID NO 32231 | TGAGTTCTTGTGCACTGTCTGG | TTG | chr3 | 120676526 | 120676547 | 120676543 | 120676548 | + |
| SEQ ID NO 32232 | TTGTGCACTGTCTGGCTTTTTT | TTC | chr3 | 120676533 | 120676554 | 120676550 | 120676555 | + |
| SEQ ID NO 32233 | GTGCACTGTCTGGCTTTTTTGC | CTT | chr3 | 120676535 | 120676556 | 120676552 | 120676557 | + |
| SEQ ID NO 32234 | TGCACTGTCTGGCTTTTTTGCT | TTG | chr3 | 120676536 | 120676557 | 120676553 | 120676558 | + |
| SEQ ID NO 32235 | TCTGGCTTTTTTGCTAGCCTAT | CTG | chr3 | 120676543 | 120676564 | 120676560 | 120676565 | + |
| SEQ ID NO 32236 | GCTTTTTTGCTAGCCTATAAGC | CTG | chr3 | 120676547 | 120676568 | 120676564 | 120676569 | + |
| SEQ ID NO 32237 | TTTTGCTAGCCTATAAGCTGCA | CTT | chr3 | 120676551 | 120676572 | 120676568 | 120676573 | + |
| SEQ ID NO 32238 | TTTGCTAGCCTATAAGCTGCAT | TTT | chr3 | 120676552 | 120676573 | 120676569 | 120676574 | + |
| SEQ ID NO 32239 | TTGCTAGCCTATAAGCTGCATG | TTT | chr3 | 120676553 | 120676574 | 120676570 | 120676575 | + |
| SEQ ID NO 32240 | TGCTAGCCTATAAGCTGCATGA | TTT | chr3 | 120676554 | 120676575 | 120676571 | 120676576 | + |
| SEQ ID NO 32241 | GCTAGCCTATAAGCTGCATGAA | TTT | chr3 | 120676555 | 120676576 | 120676572 | 120676577 | + |
| SEQ ID NO 32242 | CTAGCCTATAAGCTGCATGAAG | TTG | chr3 | 120676556 | 120676577 | 120676573 | 120676578 | + |
| SEQ ID NO 32243 | GCCTATAAGCTGCATGAAGGCT | CTA | chr3 | 120676559 | 120676580 | 120676576 | 120676581 | + |
| SEQ ID NO 32244 | TAAGCTGCATGAAGGCTGAGAC | CTA | chr3 | 120676564 | 120676585 | 120676581 | 120676586 | + |
| SEQ ID NO 32245 | CATGAAGGCTGAGACTATGGCA | CTG | chr3 | 120676571 | 120676592 | 120676588 | 120676593 | + |
| SEQ ID NO 32246 | AGACTATGGCAGTCTTGGCTCA | CTG | chr3 | 120676582 | 120676603 | 120676599 | 120676604 | + |
| SEQ ID NO 32247 | TGGCAGTCTTGGCTCATAGAAG | CTA | chr3 | 120676588 | 120676609 | 120676605 | 120676610 | + |
| SEQ ID NO 32248 | GGCTCATAGAAGGTAATCAGTG | CTT | chr3 | 120676598 | 120676619 | 120676615 | 120676620 | + |
| SEQ ID NO 32249 | GCTCATAGAAGGTAATCAGTGG | TTG | chr3 | 120676599 | 120676620 | 120676616 | 120676621 | + |
| SEQ ID NO 32250 | ATAGAAGGTAATCAGTGGAAAT | CTC | chr3 | 120676603 | 120676624 | 120676620 | 120676625 | + |
| SEQ ID NO 32251 | GTCGATTGATTGAATTTTTCCC | TTT | chr3 | 120676627 | 120676648 | 120676644 | 120676649 | + |
| SEQ ID NO 32252 | TCGATTGATTGAATTTTTCCCT | TTG | chr3 | 120676628 | 120676649 | 120676645 | 120676650 | + |
| SEQ ID NO 32253 | ATTGAATTTTTCCCTTAAAGCC | TTG | chr3 | 120676635 | 120676656 | 120676652 | 120676657 | + |
| SEQ ID NO 32254 | AATTTTTCCCTTAAAGCCAATT | TTG | chr3 | 120676639 | 120676660 | 120676656 | 120676661 | + |
| SEQ ID NO 32255 | TTCCCTTAAAGCCAATTCTAAT | TTT | chr3 | 120676644 | 120676665 | 120676661 | 120676666 | + |
| SEQ ID NO 32256 | TCCCTTAAAGCCAATTCTAATG | TTT | chr3 | 120676645 | 120676666 | 120676662 | 120676667 | + |
| SEQ ID NO 32257 | CCCTTAAAGCCAATTCTAATGT | TTT | chr3 | 120676646 | 120676667 | 120676663 | 120676668 | + |
| SEQ ID NO 32258 | CCTTAAAGCCAATTCTAATGTA | TTC | chr3 | 120676647 | 120676668 | 120676664 | 120676669 | + |
| SEQ ID NO 32259 | AAAGCCAATTCTAATGTAAGTG | CTT | chr3 | 120676651 | 120676672 | 120676668 | 120676673 | + |
| SEQ ID NO 32260 | AAGCCAATTCTAATGTAAGTGT | TTA | chr3 | 120676652 | 120676673 | 120676669 | 120676674 | + |
| SEQ ID NO 32261 | TAATGTAAGTGTATGTGTGCTG | TTC | chr3 | 120676662 | 120676683 | 120676679 | 120676684 | + |
| SEQ ID NO 32262 | ATGTAAGTGTATGTGTGCTGCT | CTA | chr3 | 120676664 | 120676685 | 120676681 | 120676686 | + |
| SEQ ID NO 32263 | CTGTAAATAGGGTTAGAACCCT | CTG | chr3 | 120676684 | 120676705 | 120676701 | 120676706 | + |
| SEQ ID NO 32264 | TAAATAGGGTTAGAACCCTTTT | CTG | chr3 | 120676687 | 120676708 | 120676704 | 120676709 | + |
| SEQ ID NO 32265 | GAACCCTTTTGCTCTAACTTA | TTA | chr3 | 120676699 | 120676720 | 120676716 | 120676721 | + |
| SEQ ID NO 32266 | TTTGCTCTAACTTAAATACCAA | CTT | chr3 | 120676707 | 120676728 | 120676724 | 120676729 | + |
| SEQ ID NO 32267 | TTGCTCTAACTTAAATACCAAT | TTT | chr3 | 120676708 | 120676729 | 120676725 | 120676730 | + |
| SEQ ID NO 32268 | TGCTCTAACTTAAATACCAATT | TTT | chr3 | 120676709 | 120676730 | 120676726 | 120676731 | + |
| SEQ ID NO 32269 | GCTCTAACTTAAATACCAATTG | TTT | chr3 | 120676710 | 120676731 | 120676727 | 120676732 | + |
| SEQ ID NO 32270 | CTCTAACTTAAATACCAATTGA | TTG | chr3 | 120676711 | 120676732 | 120676728 | 120676733 | + |
| SEQ ID NO 32271 | TAACTTAAATACCAATTGATTT | CTC | chr3 | 120676714 | 120676735 | 120676731 | 120676736 | + |
| SEQ ID NO 32272 | ACTTAAATACCAATTGATTTTA | CTA | chr3 | 120676716 | 120676737 | 120676733 | 120676738 | + |
| SEQ ID NO 32273 | AAATACCAATTGATTTTAGCCC | CTT | chr3 | 120676720 | 120676741 | 120676737 | 120676742 | + |
| SEQ ID NO 32274 | AATACCAATTGATTTTAGCCCA | TTA | chr3 | 120676721 | 120676742 | 120676738 | 120676743 | + |
| SEQ ID NO 32275 | ATTTTAGCCCAGGATAATGAAA | TTG | chr3 | 120676732 | 120676753 | 120676749 | 120676754 | + |
| SEQ ID NO 32276 | TAGCCCAGGATAATGAAAATGC | TTT | chr3 | 120676736 | 120676757 | 120676753 | 120676758 | + |
| SEQ ID NO 32277 | AGCCCAGGATAATGAAAATGCA | TTT | chr3 | 120676737 | 120676758 | 120676754 | 120676759 | + |
| SEQ ID NO 32278 | GCCCAGGATAATGAAAATGCAG | TTA | chr3 | 120676738 | 120676759 | 120676755 | 120676760 | + |
| SEQ ID NO 32279 | GCTCAGCAAGCGAAATGTAACC | CTT | chr3 | 120676764 | 120676785 | 120676781 | 120676786 | + |
| SEQ ID NO 32280 | CTCAGCAAGCGAAATGTAACCA | TTG | chr3 | 120676765 | 120676786 | 120676782 | 120676787 | + |
| SEQ ID NO 32281 | AGCAAGCGAAATGTAACCATCT | CTC | chr3 | 120676768 | 120676789 | 120676785 | 120676790 | + |
| SEQ ID NO 32282 | AACACAGCTCCTTAAGAGATAT | CTG | chr3 | 120676791 | 120676812 | 120676808 | 120676813 | + |
| SEQ ID NO 32283 | CTTAAGAGATATAAGAAGGGTG | CTC | chr3 | 120676801 | 120676822 | 120676818 | 120676823 | + |
| SEQ ID NO 32284 | AAGAGATATAAGAAGGGTGGAA | CTT | chr3 | 120676804 | 120676825 | 120676821 | 120676826 | + |
| SEQ ID NO 32285 | AGAGATATAAGAAGGGTGGAAG | TTA | chr3 | 120676805 | 120676826 | 120676822 | 120676827 | + |
| SEQ ID NO 32286 | CAGAGTTCTCAGTTGTTGCGGG | CTC | chr3 | 120676847 | 120676868 | 120676864 | 120676869 | + |
| SEQ ID NO 32287 | TCAGTTGTTGCGGGAAGTCTGG | TTC | chr3 | 120676855 | 120676876 | 120676872 | 120676877 | + |
| SEQ ID NO 32288 | AGTTGTTGCGGGAAGTCTGGGA | CTC | chr3 | 120676857 | 120676878 | 120676874 | 120676879 | + |

Figure 54 (Cont'd)

| | | | | | | | | |
|---|---|---|---|---|---|---|---|---|
| SEQ ID NO 32289 | TTGCGGGAAGTCTGGGACTCCA | TTG | chr3 | 120676862 | 120676883 | 120676879 | 120676884 | + |
| SEQ ID NO 32290 | CGGGAAGTCTGGGACTCCAAAC | TTG | chr3 | 120676865 | 120676886 | 120676882 | 120676887 | + |
| SEQ ID NO 32291 | GGACTCCAAACGGAGGGATCAG | CTG | chr3 | 120676876 | 120676897 | 120676893 | 120676898 | + |
| SEQ ID NO 32292 | CAAACGGAGGGATCAGCTGAAG | CTC | chr3 | 120676882 | 120676903 | 120676899 | 120676904 | + |
| SEQ ID NO 32293 | AAGCCATGGCAGAAGTTCGTGG | CTG | chr3 | 120676901 | 120676922 | 120676918 | 120676923 | + |
| SEQ ID NO 32294 | GTGGATTGTGAAGATTTCATGG | TTC | chr3 | 120676919 | 120676940 | 120676936 | 120676941 | + |
| SEQ ID NO 32295 | TGAAGATTTCATGGACATTTAT | TTG | chr3 | 120676927 | 120676948 | 120676944 | 120676949 | + |
| SEQ ID NO 32296 | CATGGACATTTATTAGTTCCCC | TTT | chr3 | 120676936 | 120676957 | 120676953 | 120676958 | + |
| SEQ ID NO 32297 | ATGGACATTTATTAGTTCCCCA | TTC | chr3 | 120676937 | 120676958 | 120676954 | 120676959 | + |
| SEQ ID NO 32298 | ATTAGTTCCCCAAATTAATACT | TTT | chr3 | 120676947 | 120676968 | 120676964 | 120676969 | + |
| SEQ ID NO 32299 | TTAGTTCCCCAAATTAATACTT | TTA | chr3 | 120676948 | 120676969 | 120676965 | 120676970 | + |
| SEQ ID NO 32300 | GTTCCCCAAATTAATACTTTTG | TTA | chr3 | 120676951 | 120676972 | 120676968 | 120676973 | + |
| SEQ ID NO 32301 | CCCAAATTAATACTTTTGTAAT | TTC | chr3 | 120676955 | 120676976 | 120676972 | 120676977 | + |
| SEQ ID NO 32302 | ATACTTTTGTAATTTCTTATGC | TTA | chr3 | 120676964 | 120676985 | 120676981 | 120676986 | + |
| SEQ ID NO 32303 | TTGTAATTTCTTATGCCTGTCT | CTT | chr3 | 120676970 | 120676991 | 120676987 | 120676992 | + |
| SEQ ID NO 32304 | TGTAATTTCTTATGCCTGTCTT | TTT | chr3 | 120676971 | 120676992 | 120676988 | 120676993 | + |
| SEQ ID NO 32305 | GTAATTTCTTATGCCTGTCTTT | TTT | chr3 | 120676972 | 120676993 | 120676989 | 120676994 | + |
| SEQ ID NO 32306 | TAATTTCTTATGCCTGTCTTTA | TTG | chr3 | 120676973 | 120676994 | 120676990 | 120676995 | + |
| SEQ ID NO 32307 | CTTATGCCTGTCTTTACTGCAA | TTT | chr3 | 120676979 | 120677000 | 120676996 | 120677001 | + |
| SEQ ID NO 32308 | TTATGCCTGTCTTTACTGCAAT | TTC | chr3 | 120676980 | 120677001 | 120676997 | 120677002 | + |
| SEQ ID NO 32309 | ATGCCTGTCTTTACTGCAATCT | CTT | chr3 | 120676982 | 120677003 | 120676999 | 120677004 | + |
| SEQ ID NO 32310 | TGCCTGTCTTTACTGCAATCTC | TTA | chr3 | 120676983 | 120677004 | 120677000 | 120677005 | + |
| SEQ ID NO 32311 | TCTTTACTGCAATCTCTAAACA | CTG | chr3 | 120676989 | 120677010 | 120677006 | 120677011 | + |
| SEQ ID NO 32312 | TACTGCAATCTCTAAACATAAA | CTT | chr3 | 120676993 | 120677014 | 120677010 | 120677015 | + |
| SEQ ID NO 32313 | ACTGCAATCTCTAAACATAAAT | TTT | chr3 | 120676994 | 120677015 | 120677011 | 120677016 | + |
| SEQ ID NO 32314 | CTGCAATCTCTAAACATAAATT | TTA | chr3 | 120676995 | 120677016 | 120677012 | 120677017 | + |
| SEQ ID NO 32315 | CAATCTCTAAACATAAATTGTA | CTG | chr3 | 120676998 | 120677019 | 120677015 | 120677020 | + |
| SEQ ID NO 32316 | TAAACATAAATTGTAAAGATTT | CTC | chr3 | 120677005 | 120677026 | 120677022 | 120677027 | + |
| SEQ ID NO 32317 | AACATAAATTGTAAAGATTTCA | CTA | chr3 | 120677007 | 120677028 | 120677024 | 120677029 | + |
| SEQ ID NO 32318 | TAAAGATTTCATGGACACTTAT | TTG | chr3 | 120677018 | 120677039 | 120677035 | 120677040 | + |
| SEQ ID NO 32319 | CATGGACACTTATCACTTCCCC | TTT | chr3 | 120677027 | 120677048 | 120677044 | 120677049 | + |
| SEQ ID NO 32320 | ATGGACACTTATCACTTCCCCA | TTC | chr3 | 120677028 | 120677049 | 120677045 | 120677050 | + |
| SEQ ID NO 32321 | ATCACTTCCCCAGTCAATATCC | CTT | chr3 | 120677038 | 120677059 | 120677055 | 120677060 | + |
| SEQ ID NO 32322 | TCACTTCCCCAGTCAATATCCT | TTA | chr3 | 120677039 | 120677060 | 120677056 | 120677061 | + |
| SEQ ID NO 32323 | CCCCAGTCAATATCCTTGTGAT | CTT | chr3 | 120677045 | 120677066 | 120677062 | 120677067 | + |
| SEQ ID NO 32324 | CCCAGTCAATATCCTTGTGATT | TTC | chr3 | 120677046 | 120677067 | 120677063 | 120677068 | + |
| SEQ ID NO 32325 | GTGATTTATGCCTGTCTTTACT | CTT | chr3 | 120677062 | 120677083 | 120677079 | 120677084 | + |
| SEQ ID NO 32326 | TGATTTATGCCTGTCTTTACTT | TTG | chr3 | 120677063 | 120677084 | 120677080 | 120677085 | + |
| SEQ ID NO 32327 | ATGCCTGTCTTTACTTTAATCT | TTT | chr3 | 120677069 | 120677090 | 120677086 | 120677091 | + |
| SEQ ID NO 32328 | TGCCTGTCTTTACTTTAATCTC | TTA | chr3 | 120677070 | 120677091 | 120677087 | 120677092 | + |
| SEQ ID NO 32329 | TCTTTACTTTAATCTCTTAATC | CTG | chr3 | 120677076 | 120677097 | 120677093 | 120677098 | + |
| SEQ ID NO 32330 | TACTTTAATCTCTTAATCCTGT | CTT | chr3 | 120677080 | 120677101 | 120677097 | 120677102 | + |
| SEQ ID NO 32331 | ACTTTAATCTCTTAATCCTGTC | TTT | chr3 | 120677081 | 120677102 | 120677098 | 120677103 | + |
| SEQ ID NO 32332 | CTTTAATCTCTTAATCCTGTCA | TTA | chr3 | 120677082 | 120677103 | 120677099 | 120677104 | + |
| SEQ ID NO 32333 | TAATCTCTTAATCCTGTCAGCT | CTT | chr3 | 120677085 | 120677106 | 120677102 | 120677107 | + |
| SEQ ID NO 32334 | AATCTCTTAATCCTGTCAGCTG | TTT | chr3 | 120677086 | 120677107 | 120677103 | 120677108 | + |
| SEQ ID NO 32335 | ATCTCTTAATCCTGTCAGCTGA | TTA | chr3 | 120677087 | 120677108 | 120677104 | 120677109 | + |
| SEQ ID NO 32336 | TTAATCCTGTCAGCTGAGGAGG | CTC | chr3 | 120677092 | 120677113 | 120677109 | 120677114 | + |
| SEQ ID NO 32337 | AATCCTGTCAGCTGAGGAGGAT | CTT | chr3 | 120677094 | 120677115 | 120677111 | 120677116 | + |
| SEQ ID NO 32338 | ATCCTGTCAGCTGAGGAGGATG | TTA | chr3 | 120677095 | 120677116 | 120677112 | 120677117 | + |
| SEQ ID NO 32339 | TCAGCTGAGGAGGATGTATATT | CTG | chr3 | 120677101 | 120677122 | 120677118 | 120677123 | + |
| SEQ ID NO 32340 | AGGAGGATGTATATTGCCTCAG | CTG | chr3 | 120677108 | 120677129 | 120677125 | 120677130 | + |
| SEQ ID NO 32341 | CCTCAGGACCCTGTAATAATTG | TTG | chr3 | 120677124 | 120677145 | 120677141 | 120677146 | + |
| SEQ ID NO 32342 | AGGACCCTGTAATAATTGCATT | CTC | chr3 | 120677128 | 120677149 | 120677145 | 120677150 | + |
| SEQ ID NO 32343 | TAATAATTGCATTAACTGCACA | CTG | chr3 | 120677137 | 120677158 | 120677154 | 120677159 | + |
| SEQ ID NO 32344 | CATTAACTGCACAAATTGTACA | TTG | chr3 | 120677146 | 120677167 | 120677163 | 120677168 | + |
| SEQ ID NO 32345 | ACTGCACAAATTGTACAGCATG | TTA | chr3 | 120677151 | 120677172 | 120677168 | 120677173 | + |
| SEQ ID NO 32346 | CACAAATTGTACAGCATGTGTG | CTG | chr3 | 120677155 | 120677176 | 120677172 | 120677177 | + |
| SEQ ID NO 32347 | TACAGCATGTGTGTTTGAGCAA | TTG | chr3 | 120677164 | 120677185 | 120677181 | 120677186 | + |

Figure 54 (Cont'd)

| SEQ ID NO 32348 | GAGCAACATGAAATGTGGACAC | TTT | chr3 | 120677180 | 120677201 | 120677197 | 120677202 | + |
|---|---|---|---|---|---|---|---|---|
| SEQ ID NO 32349 | AGCAACATGAAATGTGGACACC | TTG | chr3 | 120677181 | 120677202 | 120677198 | 120677203 | + |
| SEQ ID NO 32350 | GAAAAAGAACAGGATAACAGC | CTT | chr3 | 120677205 | 120677226 | 120677222 | 120677227 | + |
| SEQ ID NO 32351 | AAAAAAGAACAGGATAACAGCA | TTG | chr3 | 120677206 | 120677227 | 120677223 | 120677228 | + |
| SEQ ID NO 32352 | TTCAGGGAATAAGAGAGATAAC | TTG | chr3 | 120677232 | 120677253 | 120677249 | 120677254 | + |
| SEQ ID NO 32353 | AGGGAATAAGAGAGATAACCTT | TTC | chr3 | 120677235 | 120677256 | 120677252 | 120677257 | + |
| SEQ ID NO 32354 | AAACTCTGACTGCTGGTGAGCC | CTT | chr3 | 120677257 | 120677278 | 120677274 | 120677279 | + |
| SEQ ID NO 32355 | AACTCTGACTGCTGGTGAGCCA | TTA | chr3 | 120677258 | 120677279 | 120677275 | 120677280 | + |
| SEQ ID NO 32356 | TGACTGCTGGTGAGCCAGGCAG | CTC | chr3 | 120677263 | 120677284 | 120677280 | 120677285 | + |
| SEQ ID NO 32357 | ACTGCTGGTGAGCCAGGCAGAA | CTG | chr3 | 120677265 | 120677286 | 120677282 | 120677287 | + |
| SEQ ID NO 32358 | CTGGTGAGCCAGGCAGAACAGA | CTG | chr3 | 120677269 | 120677290 | 120677286 | 120677291 | + |
| SEQ ID NO 32359 | GTGAGCCAGGCAGAACAGAGCC | CTG | chr3 | 120677272 | 120677293 | 120677289 | 120677294 | + |
| SEQ ID NO 32360 | CTCTTCTTTCAAAAGCAAATGG | TTT | chr3 | 120677300 | 120677321 | 120677317 | 120677322 | + |
| SEQ ID NO 32361 | TCTTCTTTCAAAAGCAAATGGG | TTC | chr3 | 120677301 | 120677322 | 120677318 | 120677323 | + |
| SEQ ID NO 32362 | TTCTTTCAAAAGCAAATGGGAG | CTC | chr3 | 120677303 | 120677324 | 120677320 | 120677325 | + |
| SEQ ID NO 32363 | CTTTCAAAAGCAAATGGGAGAA | CTT | chr3 | 120677305 | 120677326 | 120677322 | 120677327 | + |
| SEQ ID NO 32364 | TTTCAAAAGCAAATGGGAGAAA | TTC | chr3 | 120677306 | 120677327 | 120677323 | 120677328 | + |
| SEQ ID NO 32365 | TCAAAAGCAAATGGGAGAAATA | CTT | chr3 | 120677308 | 120677329 | 120677325 | 120677330 | + |
| SEQ ID NO 32366 | CAAAAGCAAATGGGAGAAATAT | TTT | chr3 | 120677309 | 120677330 | 120677326 | 120677331 | + |
| SEQ ID NO 32367 | AAAAGCAAATGGGAGAAATATC | TTC | chr3 | 120677310 | 120677331 | 120677327 | 120677332 | + |
| SEQ ID NO 32368 | AATTCTTTTTCTCAGCATGGAA | CTG | chr3 | 120677336 | 120677357 | 120677353 | 120677358 | + |
| SEQ ID NO 32369 | TTTTTCTCAGCATGGAACATCC | TTC | chr3 | 120677341 | 120677362 | 120677358 | 120677363 | + |
| SEQ ID NO 32370 | TTTCTCAGCATGGAACATCCCT | CTT | chr3 | 120677343 | 120677364 | 120677360 | 120677365 | + |
| SEQ ID NO 32371 | TTCTCAGCATGGAACATCCCTG | TTT | chr3 | 120677344 | 120677365 | 120677361 | 120677366 | + |
| SEQ ID NO 32372 | TCTCAGCATGGAACATCCCTGA | TTT | chr3 | 120677345 | 120677366 | 120677362 | 120677367 | + |
| SEQ ID NO 32373 | CTCAGCATGGAACATCCCTGAG | TTT | chr3 | 120677346 | 120677367 | 120677363 | 120677368 | + |
| SEQ ID NO 32374 | TCAGCATGGAACATCCCTGAGA | TTC | chr3 | 120677347 | 120677368 | 120677364 | 120677369 | + |
| SEQ ID NO 32375 | AGCATGGAACATCCCTGAGAAA | CTC | chr3 | 120677349 | 120677370 | 120677366 | 120677371 | + |
| SEQ ID NO 32376 | AGAAAGAGAATACGAGCCAGGA | CTG | chr3 | 120677366 | 120677387 | 120677383 | 120677388 | + |
| SEQ ID NO 32377 | ATAAACAGCCCCCCTCCAGGTG | CTT | chr3 | 120677399 | 120677420 | 120677416 | 120677421 | + |
| SEQ ID NO 32378 | TAAACAGCCCCCCTCCAGGTGC | TTA | chr3 | 120677400 | 120677421 | 120677417 | 120677422 | + |
| SEQ ID NO 32379 | CAGGTGCGCCTGTCTCTTATGG | CTC | chr3 | 120677415 | 120677436 | 120677432 | 120677437 | + |
| SEQ ID NO 32380 | TCTCTTATGGTCGAGACTGCAG | CTG | chr3 | 120677427 | 120677448 | 120677444 | 120677449 | + |
| SEQ ID NO 32381 | TTATGGTCGAGACTGCAGGGGT | CTC | chr3 | 120677431 | 120677452 | 120677448 | 120677453 | + |
| SEQ ID NO 32382 | ATGGTCGAGACTGCAGGGGTGA | CTT | chr3 | 120677433 | 120677454 | 120677450 | 120677455 | + |
| SEQ ID NO 32383 | TGGTCGAGACTGCAGGGGTGAA | TTA | chr3 | 120677434 | 120677455 | 120677451 | 120677456 | + |
| SEQ ID NO 32384 | CAGGGGTGAAATAGACCCCAGT | CTG | chr3 | 120677446 | 120677467 | 120677463 | 120677468 | + |
| SEQ ID NO 32385 | CCACAGCGCTCCCAGGCTTATT | CTC | chr3 | 120677471 | 120677492 | 120677488 | 120677493 | + |
| SEQ ID NO 32386 | CCAGGCTTATTAGGAAGAGGAA | CTC | chr3 | 120677482 | 120677503 | 120677499 | 120677504 | + |
| SEQ ID NO 32387 | ATTAGGAAGAGGAAATTCCCGC | CTT | chr3 | 120677490 | 120677511 | 120677507 | 120677512 | + |
| SEQ ID NO 32388 | TTAGGAAGAGGAAATTCCCGCC | TTA | chr3 | 120677491 | 120677512 | 120677508 | 120677513 | + |
| SEQ ID NO 32389 | GGAAGAGGAAATTCCCGCCTAA | TTA | chr3 | 120677494 | 120677515 | 120677511 | 120677516 | + |
| SEQ ID NO 32390 | CCGCCTAATAAATTTTGGTCAG | TTC | chr3 | 120677508 | 120677529 | 120677525 | 120677530 | + |
| SEQ ID NO 32391 | ATAAATTTTGGTCAGACCAGTT | CTA | chr3 | 120677515 | 120677536 | 120677532 | 120677537 | + |
| SEQ ID NO 32392 | TGGTCAGACCAGTTGATCCTAA | TTT | chr3 | 120677523 | 120677544 | 120677540 | 120677545 | + |
| SEQ ID NO 32393 | GGTCAGACCAGTTGATCCTAAA | TTT | chr3 | 120677524 | 120677545 | 120677541 | 120677546 | + |
| SEQ ID NO 32394 | GTCAGACCAGTTGATCCTAAAA | TTG | chr3 | 120677525 | 120677546 | 120677542 | 120677547 | + |
| SEQ ID NO 32395 | ATCCTAAAACCCTGTCTCCTG | TTG | chr3 | 120677538 | 120677559 | 120677555 | 120677560 | + |
| SEQ ID NO 32396 | AAAACCCTGTCTCCTGATAAGA | CTA | chr3 | 120677544 | 120677565 | 120677561 | 120677566 | + |
| SEQ ID NO 32397 | TCTCCTGATAAGATGTTATCAA | CTG | chr3 | 120677553 | 120677574 | 120677570 | 120677575 | + |
| SEQ ID NO 32398 | CTGATAAGATGTTATCAATGAC | CTC | chr3 | 120677557 | 120677578 | 120677574 | 120677579 | + |
| SEQ ID NO 32399 | ATAAGATGTTATCAATGACAAT | CTG | chr3 | 120677560 | 120677581 | 120677577 | 120677582 | + |
| SEQ ID NO 32400 | TCAATGACAATGGTGCCCGAAA | TTA | chr3 | 120677571 | 120677592 | 120677588 | 120677593 | + |
| SEQ ID NO 32401 | CATTAGCAATTTTAATTTCGCC | CTT | chr3 | 120677596 | 120677617 | 120677613 | 120677618 | + |
| SEQ ID NO 32402 | ATTAGCAATTTTAATTTCGCCT | TTC | chr3 | 120677597 | 120677618 | 120677614 | 120677619 | + |
| SEQ ID NO 32403 | GCAATTTTAATTTCGCCTCGGT | TTA | chr3 | 120677601 | 120677622 | 120677618 | 120677623 | + |
| SEQ ID NO 32404 | TAATTTCGCCTCGGTCCTGTGG | TTT | chr3 | 120677608 | 120677629 | 120677625 | 120677630 | + |
| SEQ ID NO 32405 | AATTTCGCCTCGGTCCTGTGGT | TTT | chr3 | 120677609 | 120677630 | 120677626 | 120677631 | + |
| SEQ ID NO 32406 | ATTTCGCCTCGGTCCTGTGGTC | TTA | chr3 | 120677610 | 120677631 | 120677627 | 120677632 | + |

Figure 54 (Cont'd)

| SEQ ID NO 32407 | CGCCTCGGTCCTGTGGTCCTGT | TTT | chr3 | 120677614 | 120677635 | 120677631 | 120677636 | + |
| SEQ ID NO 32408 | GCCTCGGTCCTGTGGTCCTGTG | TTC | chr3 | 120677615 | 120677636 | 120677632 | 120677637 | + |
| SEQ ID NO 32409 | GGTCCTGTGGTCCTGTGATCTC | CTC | chr3 | 120677620 | 120677641 | 120677637 | 120677642 | + |
| SEQ ID NO 32410 | TGGTCCTGTGATCTCACCCTGC | CTG | chr3 | 120677627 | 120677648 | 120677644 | 120677649 | + |
| SEQ ID NO 32411 | TGATCTCACCCTGCCTCCACTT | CTG | chr3 | 120677635 | 120677656 | 120677652 | 120677657 | + |
| SEQ ID NO 32412 | ACCCTGCCTCCACTTGCCTTGT | CTC | chr3 | 120677642 | 120677663 | 120677659 | 120677664 | + |
| SEQ ID NO 32413 | CCTCCACTTGCCTTGTGATATT | CTG | chr3 | 120677648 | 120677669 | 120677665 | 120677670 | + |
| SEQ ID NO 32414 | CACTTGCCTTGTGATATTCTAT | CTC | chr3 | 120677652 | 120677673 | 120677669 | 120677674 | + |
| SEQ ID NO 32415 | GCCTTGTGATATTCTATTACCT | CTT | chr3 | 120677657 | 120677678 | 120677674 | 120677679 | + |
| SEQ ID NO 32416 | CCTTGTGATATTCTATTACCTT | TTG | chr3 | 120677658 | 120677679 | 120677675 | 120677680 | + |
| SEQ ID NO 32417 | GTGATATTCTATTACCTTGTAA | CTT | chr3 | 120677662 | 120677683 | 120677679 | 120677684 | + |
| SEQ ID NO 32418 | TGATATTCTATTACCTTGTAAA | TTG | chr3 | 120677663 | 120677684 | 120677680 | 120677685 | + |
| SEQ ID NO 32419 | TATTACCTTGTAAAGTACTTGA | TTC | chr3 | 120677671 | 120677692 | 120677688 | 120677693 | + |
| SEQ ID NO 32420 | TTACCTTGTAAAGTACTTGATG | CTA | chr3 | 120677673 | 120677694 | 120677690 | 120677695 | + |
| SEQ ID NO 32421 | CCTTGTAAAGTACTTGATGTCT | TTA | chr3 | 120677676 | 120677697 | 120677693 | 120677698 | + |
| SEQ ID NO 32422 | GTAAAGTACTTGATGTCTGTGA | CTT | chr3 | 120677680 | 120677701 | 120677697 | 120677702 | + |
| SEQ ID NO 32423 | TAAAGTACTTGATGTCTGTGAC | TTG | chr3 | 120677681 | 120677702 | 120677698 | 120677703 | + |
| SEQ ID NO 32424 | GATGTCTGTGACCCACACCTAT | CTT | chr3 | 120677691 | 120677712 | 120677708 | 120677713 | + |
| SEQ ID NO 32425 | ATGTCTGTGACCCACACCTATT | TTG | chr3 | 120677692 | 120677713 | 120677709 | 120677714 | + |
| SEQ ID NO 32426 | TGACCCACACCTATTTGCACAC | CTG | chr3 | 120677699 | 120677720 | 120677716 | 120677721 | + |
| SEQ ID NO 32427 | TTTGCACACTGCCTCCCCATTT | CTA | chr3 | 120677712 | 120677733 | 120677729 | 120677734 | + |
| SEQ ID NO 32428 | GCACACTGCCTCCCCATTTGAA | TTT | chr3 | 120677715 | 120677736 | 120677732 | 120677737 | + |
| SEQ ID NO 32429 | CACACTGCCTCCCCATTTGAAA | TTG | chr3 | 120677716 | 120677737 | 120677733 | 120677738 | + |
| SEQ ID NO 32430 | CCTCCCCATTTGAAAATCCCTA | CTG | chr3 | 120677723 | 120677744 | 120677740 | 120677745 | + |
| SEQ ID NO 32431 | CCCATTTGAAAATCCCTAATAC | CTC | chr3 | 120677727 | 120677748 | 120677744 | 120677749 | + |
| SEQ ID NO 32432 | GAAAATCCCTAATACAAACTTG | TTT | chr3 | 120677734 | 120677755 | 120677751 | 120677756 | + |
| SEQ ID NO 32433 | AAAATCCCTAATACAAACTTGC | TTG | chr3 | 120677735 | 120677756 | 120677752 | 120677757 | + |
| SEQ ID NO 32434 | ATACAAACTTGCTGGTTTTTGT | CTA | chr3 | 120677745 | 120677766 | 120677762 | 120677767 | + |
| SEQ ID NO 32435 | GCTGGTTTTTGTGGCTTGTGGG | CTT | chr3 | 120677755 | 120677776 | 120677772 | 120677777 | + |
| SEQ ID NO 32436 | CTGGTTTTTGTGGCTTGTGGGG | TTG | chr3 | 120677756 | 120677777 | 120677773 | 120677778 | + |
| SEQ ID NO 32437 | GTTTTTGTGGCTTGTGGGGCAT | CTG | chr3 | 120677759 | 120677780 | 120677776 | 120677781 | + |
| SEQ ID NO 32438 | TTGTGGCTTGTGGGGCATCACG | TTT | chr3 | 120677763 | 120677784 | 120677780 | 120677785 | + |
| SEQ ID NO 32439 | TGTGGCTTGTGGGGCATCACGG | TTT | chr3 | 120677764 | 120677785 | 120677781 | 120677786 | + |
| SEQ ID NO 32440 | GTGGCTTGTGGGGCATCACGGA | TTT | chr3 | 120677765 | 120677786 | 120677782 | 120677787 | + |
| SEQ ID NO 32441 | TGGCTTGTGGGGCATCACGGAA | TTG | chr3 | 120677766 | 120677787 | 120677783 | 120677788 | + |
| SEQ ID NO 32442 | GTGGGGCATCACGGAACCTACC | CTT | chr3 | 120677772 | 120677793 | 120677789 | 120677794 | + |
| SEQ ID NO 32443 | TGGGGCATCACGGAACCTACCG | TTG | chr3 | 120677773 | 120677794 | 120677790 | 120677795 | + |
| SEQ ID NO 32444 | CCGAAATGTGATGCCTCCCCCG | CTA | chr3 | 120677792 | 120677813 | 120677809 | 120677814 | + |
| SEQ ID NO 32445 | CCCCGGATGCCCGGCTTTAAAA | CTC | chr3 | 120677809 | 120677830 | 120677826 | 120677831 | + |
| SEQ ID NO 32446 | TAAAATTTCTCTCTTTTGTACT | CTT | chr3 | 120677826 | 120677847 | 120677843 | 120677848 | + |
| SEQ ID NO 32447 | AAAATTTCTCTCTTTTGTACTC | TTT | chr3 | 120677827 | 120677848 | 120677844 | 120677849 | + |
| SEQ ID NO 32448 | AAATTTCTCTCTTTTGTACTCT | TTA | chr3 | 120677828 | 120677849 | 120677845 | 120677850 | + |
| SEQ ID NO 32449 | CTCTCTTTTGTACTCTGTCCCT | TTT | chr3 | 120677834 | 120677855 | 120677851 | 120677856 | + |
| SEQ ID NO 32450 | TCTCTTTTGTACTCTGTCCCTT | TTC | chr3 | 120677835 | 120677856 | 120677852 | 120677857 | + |
| SEQ ID NO 32451 | TCTTTTGTACTCTGTCCCTTTA | CTC | chr3 | 120677837 | 120677858 | 120677854 | 120677859 | + |
| SEQ ID NO 32452 | TTTTGTACTCTGTCCCTTTATT | CTC | chr3 | 120677839 | 120677860 | 120677856 | 120677861 | + |
| SEQ ID NO 32453 | TTGTACTCTGTCCCTTTATTTC | CTT | chr3 | 120677841 | 120677862 | 120677858 | 120677863 | + |
| SEQ ID NO 32454 | TGTACTCTGTCCCTTTATTTCT | TTT | chr3 | 120677842 | 120677863 | 120677859 | 120677864 | + |
| SEQ ID NO 32455 | GTACTCTGTCCCTTTATTTCTA | TTT | chr3 | 120677843 | 120677864 | 120677860 | 120677865 | + |
| SEQ ID NO 32456 | TACTCTGTCCCTTTATTTCTAA | TTG | chr3 | 120677844 | 120677865 | 120677861 | 120677866 | + |
| SEQ ID NO 32457 | TGTCCCTTTATTTCTAAAGTTG | CTC | chr3 | 120677849 | 120677870 | 120677866 | 120677871 | + |
| SEQ ID NO 32458 | TCCCTTTATTTCTAAAGTTGGC | CTG | chr3 | 120677851 | 120677872 | 120677868 | 120677873 | + |
| SEQ ID NO 32459 | TATTTCTAAAGTTGGCCGACGC | CTT | chr3 | 120677857 | 120677878 | 120677874 | 120677879 | + |
| SEQ ID NO 32460 | ATTTCTAAAGTTGGCCGACGCT | TTT | chr3 | 120677858 | 120677879 | 120677875 | 120677880 | + |
| SEQ ID NO 32461 | TTTCTAAAGTTGGCCGACGCTT | TTA | chr3 | 120677859 | 120677880 | 120677876 | 120677881 | + |
| SEQ ID NO 32462 | CTAAAGTTGGCCGACGCTTAGG | TTT | chr3 | 120677862 | 120677883 | 120677879 | 120677884 | + |
| SEQ ID NO 32463 | TAAAGTTGGCCGACGCTTAGGG | TTC | chr3 | 120677863 | 120677884 | 120677880 | 120677885 | + |
| SEQ ID NO 32464 | AAGTTGGCCGACGCTTAGGGAA | CTA | chr3 | 120677865 | 120677886 | 120677882 | 120677887 | + |
| SEQ ID NO 32465 | GCCGACGCTTAGGGAAAATAGA | TTG | chr3 | 120677871 | 120677892 | 120677888 | 120677893 | + |

Figure 54 (Cont'd)

| | | | | | | | | |
|---|---|---|---|---|---|---|---|---|
| SEQ ID NO 32466 | AGGGAAAATAGAAAAGAACCTA | CTT | chr3 | 120677881 | 120677902 | 120677898 | 120677903 | + |
| SEQ ID NO 32467 | GGGAAAATAGAAAAGAACCTAC | TTA | chr3 | 120677882 | 120677903 | 120677899 | 120677904 | + |
| SEQ ID NO 32468 | CGTGAATATTGGGGCAGGTTCC | CTA | chr3 | 120677903 | 120677924 | 120677920 | 120677925 | + |
| SEQ ID NO 32469 | GGGCAGGTTCCTGATACTCAG | TTG | chr3 | 120677914 | 120677935 | 120677931 | 120677936 | + |
| SEQ ID NO 32470 | CCTGATACTCAGTGGCGTGGAG | TTC | chr3 | 120677924 | 120677945 | 120677941 | 120677946 | + |
| SEQ ID NO 32471 | ATACTCAGTGGCGTGGAGATGT | CTG | chr3 | 120677928 | 120677949 | 120677945 | 120677950 | + |
| SEQ ID NO 32472 | AGTGGCGTGGAGATGTAACAAG | CTC | chr3 | 120677934 | 120677955 | 120677951 | 120677956 | + |
| SEQ ID NO 32473 | GATGTGTGAGTGATGATCAGGC | CTG | chr3 | 120677960 | 120677981 | 120677977 | 120677982 | + |
| SEQ ID NO 32474 | TATTTGGAAGAAATATCAGATG | CTG | chr3 | 120677995 | 120678016 | 120678012 | 120678017 | + |
| SEQ ID NO 32475 | GGAAGAAATATCAGATGTGAAT | TTT | chr3 | 120678000 | 120678021 | 120678017 | 120678022 | + |
| SEQ ID NO 32476 | GAAGAAATATCAGATGTGAATG | TTG | chr3 | 120678001 | 120678022 | 120678018 | 120678023 | + |
| SEQ ID NO 32477 | TGACCTAGGAAGCAATGGAAGT | TTA | chr3 | 120678026 | 120678047 | 120678043 | 120678048 | + |
| SEQ ID NO 32478 | GGAAGCAATGGAAGTGAAAAAT | CTA | chr3 | 120678033 | 120678054 | 120678050 | 120678055 | + |
| SEQ ID NO 32479 | TTCTTTTTGCCTTCAGACTCAA | TTA | chr3 | 120678057 | 120678078 | 120678074 | 120678079 | + |
| SEQ ID NO 32480 | TTTTTGCCTTCAGACTCAATAT | TTC | chr3 | 120678060 | 120678081 | 120678077 | 120678082 | + |
| SEQ ID NO 32481 | TTTGCCTTCAGACTCAATATTT | CTT | chr3 | 120678062 | 120678083 | 120678079 | 120678084 | + |
| SEQ ID NO 32482 | TTGCCTTCAGACTCAATATTTT | TTT | chr3 | 120678063 | 120678084 | 120678080 | 120678085 | + |
| SEQ ID NO 32483 | TGCCTTCAGACTCAATATTTTG | TTT | chr3 | 120678064 | 120678085 | 120678081 | 120678086 | + |
| SEQ ID NO 32484 | GCCTTCAGACTCAATATTTTGT | TTT | chr3 | 120678065 | 120678086 | 120678082 | 120678087 | + |
| SEQ ID NO 32485 | CCTTCAGACTCAATATTTTGTA | TTG | chr3 | 120678066 | 120678087 | 120678083 | 120678088 | + |
| SEQ ID NO 32486 | CAGACTCAATATTTTGTATATT | CTT | chr3 | 120678070 | 120678091 | 120678087 | 120678092 | + |
| SEQ ID NO 32487 | AGACTCAATATTTTGTATATTT | TTC | chr3 | 120678071 | 120678092 | 120678088 | 120678093 | + |
| SEQ ID NO 32488 | AATATTTTGTATATTTGAAAAT | CTC | chr3 | 120678077 | 120678098 | 120678094 | 120678099 | + |
| SEQ ID NO 32489 | TGTATATTTGAAAATTTGTCAA | TTT | chr3 | 120678084 | 120678105 | 120678101 | 120678106 | + |
| SEQ ID NO 32490 | GTATATTTGAAAATTTGTCAAC | TTT | chr3 | 120678085 | 120678106 | 120678102 | 120678107 | + |
| SEQ ID NO 32491 | TATATTTGAAAATTTGTCAACA | TTG | chr3 | 120678086 | 120678107 | 120678103 | 120678108 | + |
| SEQ ID NO 32492 | GAAAATTTGTCAACACAAAAAA | TTT | chr3 | 120678093 | 120678114 | 120678110 | 120678115 | + |
| SEQ ID NO 32493 | AAAATTTGTCAACACAAAAAAT | TTG | chr3 | 120678094 | 120678115 | 120678111 | 120678116 | + |
| SEQ ID NO 32494 | GTCAACACAAAAAATACTAAGT | TTT | chr3 | 120678101 | 120678122 | 120678118 | 120678123 | + |
| SEQ ID NO 32495 | TCAACACAAAAAATACTAAGTT | TTG | chr3 | 120678102 | 120678123 | 120678119 | 120678124 | + |
| SEQ ID NO 32496 | AGTTGTATACTGATTTGTTAAA | CTA | chr3 | 120678120 | 120678141 | 120678137 | 120678142 | + |
| SEQ ID NO 32497 | TATACTGATTTGTTAAAAGCAG | TTG | chr3 | 120678125 | 120678146 | 120678142 | 120678147 | + |
| SEQ ID NO 32498 | ATTTGTTAAAAGCAGCAGCATG | CTG | chr3 | 120678132 | 120678153 | 120678149 | 120678154 | + |
| SEQ ID NO 32499 | GTTAAAAGCAGCAGCATGCAGT | TTT | chr3 | 120678136 | 120678157 | 120678153 | 120678158 | + |
| SEQ ID NO 32500 | TTAAAAGCAGCAGCATGCAGTT | TTG | chr3 | 120678137 | 120678158 | 120678154 | 120678159 | + |
| SEQ ID NO 32501 | AAAGCAGCAGCATGCAGTTAGG | TTA | chr3 | 120678140 | 120678161 | 120678157 | 120678162 | + |
| SEQ ID NO 32502 | GGATGATATCTTTGGGGAAATG | TTA | chr3 | 120678160 | 120678181 | 120678177 | 120678182 | + |
| SEQ ID NO 32503 | TGGGGAAATGGCAGAGACCATC | CTT | chr3 | 120678172 | 120678193 | 120678189 | 120678194 | + |
| SEQ ID NO 32504 | GGGGAAATGGCAGAGACCATCC | TTT | chr3 | 120678173 | 120678194 | 120678190 | 120678195 | + |
| SEQ ID NO 32505 | GGGAAATGGCAGAGACCATCCA | TTG | chr3 | 120678174 | 120678195 | 120678191 | 120678196 | + |
| SEQ ID NO 32506 | TGATTCTCCACTGCATCCAATT | TTC | chr3 | 120678202 | 120678223 | 120678219 | 120678224 | + |
| SEQ ID NO 32507 | ATTCTCCACTGCATCCAATTTT | CTG | chr3 | 120678204 | 120678225 | 120678221 | 120678226 | + |
| SEQ ID NO 32508 | TCCACTGCATCCAATTTTCTAC | TTC | chr3 | 120678208 | 120678229 | 120678225 | 120678230 | + |
| SEQ ID NO 32509 | CACTGCATCCAATTTTCTACTC | CTC | chr3 | 120678210 | 120678231 | 120678227 | 120678232 | + |
| SEQ ID NO 32510 | CATCCAATTTTCTACTCTCAAA | CTG | chr3 | 120678215 | 120678236 | 120678232 | 120678237 | + |
| SEQ ID NO 32511 | TCTACTCTCAAAATGAACCCCA | TTT | chr3 | 120678225 | 120678246 | 120678242 | 120678247 | + |
| SEQ ID NO 32512 | CTACTCTCAAAATGAACCCCAT | TTT | chr3 | 120678226 | 120678247 | 120678243 | 120678248 | + |
| SEQ ID NO 32513 | TACTCTCAAAATGAACCCCATG | TTC | chr3 | 120678227 | 120678248 | 120678244 | 120678249 | + |
| SEQ ID NO 32514 | CTCTCAAAATGAACCCCATGCT | CTA | chr3 | 120678229 | 120678250 | 120678246 | 120678251 | + |
| SEQ ID NO 32515 | TCAAAATGAACCCCATGCTCAC | CTC | chr3 | 120678232 | 120678253 | 120678249 | 120678254 | + |
| SEQ ID NO 32516 | AAAATGAACCCCATGCTCACCA | CTC | chr3 | 120678234 | 120678255 | 120678251 | 120678256 | + |
| SEQ ID NO 32517 | ACCATCAACGGGATTGAATTTG | CTC | chr3 | 120678252 | 120678273 | 120678269 | 120678274 | + |
| SEQ ID NO 32518 | AATTTGAGCTGCTGAGAATTGG | TTG | chr3 | 120678268 | 120678289 | 120678285 | 120678290 | + |
| SEQ ID NO 32519 | GAGCTGCTGAGAATTGGTAATA | TTT | chr3 | 120678273 | 120678294 | 120678290 | 120678295 | + |
| SEQ ID NO 32520 | AGCTGCTGAGAATTGGTAATAA | TTG | chr3 | 120678274 | 120678295 | 120678291 | 120678296 | + |
| SEQ ID NO 32521 | CTGAGAATTGGTAATAACCCCA | CTG | chr3 | 120678279 | 120678300 | 120678296 | 120678301 | + |
| SEQ ID NO 32522 | AGAATTGGTAATAACCCCAAAT | CTG | chr3 | 120678282 | 120678303 | 120678299 | 120678304 | + |
| SEQ ID NO 32523 | GTAATAACCCCAAATTATCTTC | TTG | chr3 | 120678289 | 120678310 | 120678306 | 120678311 | + |
| SEQ ID NO 32524 | TCTTCAATTCTGTGAAATGGAA | TTA | chr3 | 120678306 | 120678327 | 120678323 | 120678328 | + |

Figure 54 (Cont'd)

| SEQ ID NO 32525 | CAATTCTGTGAAATGGAATTTT | CTT | chr3 | 120678310 | 120678331 | 120678327 | 120678332 | + |
| SEQ ID NO 32526 | AATTCTGTGAAATGGAATTTTA | TTC | chr3 | 120678311 | 120678332 | 120678328 | 120678333 | + |
| SEQ ID NO 32527 | TGTGAAATGGAATTTTAGACCA | TTC | chr3 | 120678316 | 120678337 | 120678333 | 120678338 | + |
| SEQ ID NO 32528 | TGAAATGGAATTTTAGACCAGC | CTG | chr3 | 120678318 | 120678339 | 120678335 | 120678340 | + |
| SEQ ID NO 32529 | TAGACCAGCCTGTGACTGAAGC | TTT | chr3 | 120678331 | 120678352 | 120678348 | 120678353 | + |
| SEQ ID NO 32530 | AGACCAGCCTGTGACTGAAGCC | TTT | chr3 | 120678332 | 120678353 | 120678349 | 120678354 | + |
| SEQ ID NO 32531 | GACCAGCCTGTGACTGAAGCCA | TTA | chr3 | 120678333 | 120678354 | 120678350 | 120678355 | + |
| SEQ ID NO 32532 | TGACTGAAGCCACTGGGCATTA | CTG | chr3 | 120678343 | 120678364 | 120678360 | 120678365 | + |
| SEQ ID NO 32533 | AAGCCACTGGGCATTACAGTGC | CTG | chr3 | 120678349 | 120678370 | 120678366 | 120678371 | + |
| SEQ ID NO 32534 | GGCATTACAGTGCCTTCGCTTT | CTG | chr3 | 120678358 | 120678379 | 120678375 | 120678380 | + |
| SEQ ID NO 32535 | CAGTGCCTTCGCTTTGTTCAAC | TTA | chr3 | 120678365 | 120678386 | 120678382 | 120678387 | + |
| SEQ ID NO 32536 | CGCTTTGTTCAACTGCCGCATT | CTT | chr3 | 120678374 | 120678395 | 120678391 | 120678396 | + |
| SEQ ID NO 32537 | GCTTTGTTCAACTGCCGCATTG | TTC | chr3 | 120678375 | 120678396 | 120678392 | 120678397 | + |
| SEQ ID NO 32538 | TGTTCAACTGCCGCATTGTTTC | CTT | chr3 | 120678379 | 120678400 | 120678396 | 120678401 | + |
| SEQ ID NO 32539 | GTTCAACTGCCGCATTGTTTCT | TTT | chr3 | 120678380 | 120678401 | 120678397 | 120678402 | + |
| SEQ ID NO 32540 | TTCAACTGCCGCATTGTTTCTC | TTG | chr3 | 120678381 | 120678402 | 120678398 | 120678403 | + |
| SEQ ID NO 32541 | AACTGCCGCATTGTTTCTCTCT | TTC | chr3 | 120678384 | 120678405 | 120678401 | 120678406 | + |
| SEQ ID NO 32542 | CCGCATTGTTTCTCTCTGCAAG | CTG | chr3 | 120678389 | 120678410 | 120678406 | 120678411 | + |
| SEQ ID NO 32543 | TTTCTCTCTGCAAGAGAGGAAG | TTG | chr3 | 120678397 | 120678418 | 120678414 | 120678419 | + |
| SEQ ID NO 32544 | CTCTCTGCAAGAGAGGAAGGAA | TTT | chr3 | 120678400 | 120678421 | 120678417 | 120678422 | + |
| SEQ ID NO 32545 | TCTCTGCAAGAGAGGAAGGAAG | TTC | chr3 | 120678401 | 120678422 | 120678418 | 120678423 | + |
| SEQ ID NO 32546 | TCTGCAAGAGAGGAAGGAAGGC | CTC | chr3 | 120678403 | 120678424 | 120678420 | 120678425 | + |
| SEQ ID NO 32547 | TGCAAGAGAGGAAGGAAGGCTG | CTC | chr3 | 120678405 | 120678426 | 120678422 | 120678427 | + |
| SEQ ID NO 32548 | CAAGAGAGGAAGGAAGGCTGGA | CTG | chr3 | 120678407 | 120678428 | 120678424 | 120678429 | + |
| SEQ ID NO 32549 | GAGTACAGCTGAGCTTTCTGGC | CTG | chr3 | 120678427 | 120678448 | 120678444 | 120678449 | + |
| SEQ ID NO 32550 | AGCTTTCTGGCAGGCACTGGTG | CTG | chr3 | 120678438 | 120678459 | 120678455 | 120678460 | + |
| SEQ ID NO 32551 | TCTGGCAGGCACTGGTGGAGTT | CTT | chr3 | 120678443 | 120678464 | 120678460 | 120678465 | + |
| SEQ ID NO 32552 | CTGGCAGGCACTGGTGGAGTTA | TTT | chr3 | 120678444 | 120678465 | 120678461 | 120678466 | + |
| SEQ ID NO 32553 | TGGCAGGCACTGGTGGAGTTAC | TTC | chr3 | 120678445 | 120678466 | 120678462 | 120678467 | + |
| SEQ ID NO 32554 | GCAGGCACTGGTGGAGTTACTC | CTG | chr3 | 120678447 | 120678468 | 120678464 | 120678469 | + |
| SEQ ID NO 32555 | GTGGAGTTACTCATTAACCTTC | CTG | chr3 | 120678457 | 120678478 | 120678474 | 120678479 | + |
| SEQ ID NO 32556 | CTCATTAACCTTCCCCATTCTT | TTA | chr3 | 120678466 | 120678487 | 120678483 | 120678488 | + |
| SEQ ID NO 32557 | ATTAACCTTCCCCATTCTTTGT | CTC | chr3 | 120678469 | 120678490 | 120678486 | 120678491 | + |
| SEQ ID NO 32558 | ACCTTCCCCATTCTTTGTAACT | TTA | chr3 | 120678473 | 120678494 | 120678490 | 120678495 | + |
| SEQ ID NO 32559 | CCCCATTCTTTGTAACTGGTGG | CTT | chr3 | 120678478 | 120678499 | 120678495 | 120678500 | + |
| SEQ ID NO 32560 | CCCATTCTTTGTAACTGGTGGC | TTC | chr3 | 120678479 | 120678500 | 120678496 | 120678501 | + |
| SEQ ID NO 32561 | TTTGTAACTGGTGGCCTTAGAA | TTC | chr3 | 120678486 | 120678507 | 120678503 | 120678508 | + |
| SEQ ID NO 32562 | TGTAACTGGTGGCCTTAGAAGA | CTT | chr3 | 120678488 | 120678509 | 120678505 | 120678510 | + |
| SEQ ID NO 32563 | GTAACTGGTGGCCTTAGAAGAG | TTT | chr3 | 120678489 | 120678510 | 120678506 | 120678511 | + |
| SEQ ID NO 32564 | TAACTGGTGGCCTTAGAAGAGG | TTG | chr3 | 120678490 | 120678511 | 120678507 | 120678512 | + |
| SEQ ID NO 32565 | GTGGCCTTAGAAGAGGGTTCAG | CTG | chr3 | 120678496 | 120678517 | 120678513 | 120678518 | + |
| SEQ ID NO 32566 | AGAAGAGGGTTCAGGGTTATGT | CTT | chr3 | 120678504 | 120678525 | 120678521 | 120678526 | + |
| SEQ ID NO 32567 | GAAGAGGGTTCAGGGTTATGTG | TTA | chr3 | 120678505 | 120678526 | 120678522 | 120678527 | + |
| SEQ ID NO 32568 | AGGGTTATGTGTTTGGAACACG | TTC | chr3 | 120678516 | 120678537 | 120678533 | 120678538 | + |
| SEQ ID NO 32569 | TGTGTTTGGAACACGAGTTAGT | TTA | chr3 | 120678523 | 120678544 | 120678540 | 120678545 | + |
| SEQ ID NO 32570 | GGAACACGAGTTAGTATAAATG | TTT | chr3 | 120678530 | 120678551 | 120678547 | 120678552 | + |
| SEQ ID NO 32571 | GAACACGAGTTAGTATAAATGG | TTG | chr3 | 120678531 | 120678552 | 120678548 | 120678553 | + |
| SEQ ID NO 32572 | GTATAAATGGTTCTGAAGCACT | TTA | chr3 | 120678543 | 120678564 | 120678560 | 120678565 | + |
| SEQ ID NO 32573 | TGAAGCACTTGATTCAGACTGT | TTC | chr3 | 120678556 | 120678577 | 120678573 | 120678578 | + |
| SEQ ID NO 32574 | AAGCACTTGATTCAGACTGTGC | CTG | chr3 | 120678558 | 120678579 | 120678575 | 120678580 | + |
| SEQ ID NO 32575 | GATTCAGACTGTGCTTTAAAAA | CTT | chr3 | 120678566 | 120678587 | 120678583 | 120678588 | + |
| SEQ ID NO 32576 | ATTCAGACTGTGCTTTAAAAAA | TTG | chr3 | 120678567 | 120678588 | 120678584 | 120678589 | + |
| SEQ ID NO 32577 | AGACTGTGCTTTAAAAAATAGG | TTC | chr3 | 120678571 | 120678592 | 120678588 | 120678593 | + |
| SEQ ID NO 32578 | TGCTTTAAAAAATAGGAAAGAA | CTG | chr3 | 120678577 | 120678598 | 120678594 | 120678599 | + |
| SEQ ID NO 32579 | TAAAAAATAGGAAAGAAAGTAG | CTT | chr3 | 120678582 | 120678603 | 120678599 | 120678604 | + |
| SEQ ID NO 32580 | AAAAAATAGGAAAGAAAGTAGA | TTT | chr3 | 120678583 | 120678604 | 120678600 | 120678605 | + |
| SEQ ID NO 32581 | AAAAATAGGAAAGAAAGTAGAA | TTA | chr3 | 120678584 | 120678605 | 120678601 | 120678606 | + |
| SEQ ID NO 32582 | ATGGTTTGGAAGGGAGCCACCA | CTG | chr3 | 120678616 | 120678637 | 120678633 | 120678638 | + |
| SEQ ID NO 32583 | GGAAGGGAGCCACCAAGCACCA | TTT | chr3 | 120678623 | 120678644 | 120678640 | 120678645 | + |

Figure 54 (Cont'd)

| | | | | | | | | |
|---|---|---|---|---|---|---|---|---|
| SEQ ID NO 32584 | GAAGGGAGCCACCAAGCACCAA | TTG | chr3 | 120678624 | 120678645 | 120678641 | 120678646 | + |
| SEQ ID NO 32585 | TGAATCCGTTTCTCAATCTTAG | TTC | chr3 | 120678659 | 120678680 | 120678676 | 120678681 | + |
| SEQ ID NO 32586 | AATCCGTTTCTCAATCTTAGCT | CTG | chr3 | 120678661 | 120678682 | 120678678 | 120678683 | + |
| SEQ ID NO 32587 | CTCAATCTTAGCTGCAGGGCAT | TTT | chr3 | 120678670 | 120678691 | 120678687 | 120678692 | + |
| SEQ ID NO 32588 | TCAATCTTAGCTGCAGGGCATT | TTC | chr3 | 120678671 | 120678692 | 120678688 | 120678693 | + |
| SEQ ID NO 32589 | AATCTTAGCTGCAGGGCATTGG | CTC | chr3 | 120678673 | 120678694 | 120678690 | 120678695 | + |
| SEQ ID NO 32590 | AGCTGCAGGGCATTGGCTAAAG | CTT | chr3 | 120678679 | 120678700 | 120678696 | 120678701 | + |
| SEQ ID NO 32591 | GCTGCAGGGCATTGGCTAAAGA | TTA | chr3 | 120678680 | 120678701 | 120678697 | 120678702 | + |
| SEQ ID NO 32592 | CAGGGCATTGGCTAAAGAGGAA | CTG | chr3 | 120678684 | 120678705 | 120678701 | 120678706 | + |
| SEQ ID NO 32593 | GCTAAAGAGGAAGGTGAAAACT | TTG | chr3 | 120678694 | 120678715 | 120678711 | 120678716 | + |
| SEQ ID NO 32594 | AAGAGGAAGGTGAAAACTGCTG | CTA | chr3 | 120678698 | 120678719 | 120678715 | 120678720 | + |
| SEQ ID NO 32595 | CTGAGTCACTATCAAATCAATT | CTG | chr3 | 120678717 | 120678738 | 120678734 | 120678739 | + |
| SEQ ID NO 32596 | AGTCACTATCAAATCAATTGGT | CTG | chr3 | 120678720 | 120678741 | 120678737 | 120678742 | + |
| SEQ ID NO 32597 | TCAAATCAATTGGTTTTTCTAA | CTA | chr3 | 120678728 | 120678749 | 120678745 | 120678750 | + |
| SEQ ID NO 32598 | GTTTTTCTAATCCCTGAGAGA | TTG | chr3 | 120678740 | 120678761 | 120678757 | 120678762 | + |
| SEQ ID NO 32599 | TTCTAATCCCTGAGAGAAAAA | TTT | chr3 | 120678744 | 120678765 | 120678761 | 120678766 | + |
| SEQ ID NO 32600 | TCTAATCCCTGAGAGAAAAAG | TTT | chr3 | 120678745 | 120678766 | 120678762 | 120678767 | + |
| SEQ ID NO 32601 | CTAATCCCTGAGAGAAAAAGT | TTT | chr3 | 120678746 | 120678767 | 120678763 | 120678768 | + |
| SEQ ID NO 32602 | TAATCCCTGAGAGAAAAAGTA | TTC | chr3 | 120678747 | 120678768 | 120678764 | 120678769 | + |
| SEQ ID NO 32603 | ATCCCTGAGAGAAAAAGTACA | CTA | chr3 | 120678749 | 120678770 | 120678766 | 120678771 | + |
| SEQ ID NO 32604 | AGAGAAAAAGTACAGAGTTTAT | CTG | chr3 | 120678757 | 120678778 | 120678774 | 120678779 | + |
| SEQ ID NO 32605 | ATTGCAGCTTTAAAATGCCATG | TTT | chr3 | 120678777 | 120678798 | 120678794 | 120678799 | + |
| SEQ ID NO 32606 | TTGCAGCTTTAAAATGCCATGC | TTA | chr3 | 120678778 | 120678799 | 120678795 | 120678800 | + |
| SEQ ID NO 32607 | CAGCTTTAAAATGCCATGCCCC | TTG | chr3 | 120678781 | 120678802 | 120678798 | 120678803 | + |
| SEQ ID NO 32608 | TAAAATGCCATGCCCCTCACGG | CTT | chr3 | 120678787 | 120678808 | 120678804 | 120678809 | + |
| SEQ ID NO 32609 | AAAATGCCATGCCCCTCACGGC | TTT | chr3 | 120678788 | 120678809 | 120678805 | 120678810 | + |
| SEQ ID NO 32610 | AAATGCCATGCCCCTCACGGCC | TTA | chr3 | 120678789 | 120678810 | 120678806 | 120678811 | + |
| SEQ ID NO 32611 | ACGGCAAAGGCATCTGAATTA | CTC | chr3 | 120678805 | 120678826 | 120678822 | 120678827 | + |
| SEQ ID NO 32612 | AATTAAGGAAGCAGTATTCACA | CTG | chr3 | 120678822 | 120678843 | 120678839 | 120678844 | + |
| SEQ ID NO 32613 | AGGAAGCAGTATTCACAGCTGC | TTA | chr3 | 120678827 | 120678848 | 120678844 | 120678849 | + |
| SEQ ID NO 32614 | ACAGCTGCTTTCTCCAGACATT | TTC | chr3 | 120678841 | 120678862 | 120678858 | 120678863 | + |
| SEQ ID NO 32615 | CTTTCTCCAGACATTGAGCTCA | CTG | chr3 | 120678848 | 120678869 | 120678865 | 120678870 | + |
| SEQ ID NO 32616 | TCTCCAGACATTGAGCTCAAGG | CTT | chr3 | 120678851 | 120678872 | 120678868 | 120678873 | + |
| SEQ ID NO 32617 | CTCCAGACATTGAGCTCAAGGA | TTT | chr3 | 120678852 | 120678873 | 120678869 | 120678874 | + |
| SEQ ID NO 32618 | TCCAGACATTGAGCTCAAGGAC | TTC | chr3 | 120678853 | 120678874 | 120678870 | 120678875 | + |
| SEQ ID NO 32619 | CAGACATTGAGCTCAAGGACAG | CTC | chr3 | 120678855 | 120678876 | 120678872 | 120678877 | + |
| SEQ ID NO 32620 | AGCTCAAGGACAGAATCTGAAC | TTG | chr3 | 120678864 | 120678885 | 120678881 | 120678886 | + |
| SEQ ID NO 32621 | AAGGACAGAATCTGAACTCTGC | CTC | chr3 | 120678869 | 120678890 | 120678886 | 120678891 | + |
| SEQ ID NO 32622 | AACTCTGCTTTTATCAGCTGCG | CTG | chr3 | 120678883 | 120678904 | 120678900 | 120678905 | + |
| SEQ ID NO 32623 | TGCTTTTATCAGCTGCGAAAAT | CTC | chr3 | 120678888 | 120678909 | 120678905 | 120678910 | + |
| SEQ ID NO 32624 | CTTTTATCAGCTGCGAAAATCC | CTG | chr3 | 120678890 | 120678911 | 120678907 | 120678912 | + |
| SEQ ID NO 32625 | TTATCAGCTGCGAAAATCCAAG | CTT | chr3 | 120678893 | 120678914 | 120678910 | 120678915 | + |
| SEQ ID NO 32626 | TATCAGCTGCGAAAATCCAAGC | TTT | chr3 | 120678894 | 120678915 | 120678911 | 120678916 | + |
| SEQ ID NO 32627 | ATCAGCTGCGAAAATCCAAGCA | TTT | chr3 | 120678895 | 120678916 | 120678912 | 120678917 | + |
| SEQ ID NO 32628 | TCAGCTGCGAAAATCCAAGCAT | TTA | chr3 | 120678896 | 120678917 | 120678913 | 120678918 | + |
| SEQ ID NO 32629 | CGAAAATCCAAGCATTCATTTC | CTG | chr3 | 120678903 | 120678924 | 120678920 | 120678925 | + |
| SEQ ID NO 32630 | ATTTCCAGCTGGTTCAGTGCCT | TTC | chr3 | 120678920 | 120678941 | 120678937 | 120678942 | + |
| SEQ ID NO 32631 | CCAGCTGGTTCAGTGCCTATGT | TTT | chr3 | 120678924 | 120678945 | 120678941 | 120678946 | + |
| SEQ ID NO 32632 | CAGCTGGTTCAGTGCCTATGTA | TTC | chr3 | 120678925 | 120678946 | 120678942 | 120678947 | + |
| SEQ ID NO 32633 | GTTCAGTGCCTATGTAAAAGTA | CTG | chr3 | 120678931 | 120678952 | 120678948 | 120678953 | + |
| SEQ ID NO 32634 | AGTGCCTATGTAAAAGTATACT | TTC | chr3 | 120678935 | 120678956 | 120678952 | 120678957 | + |
| SEQ ID NO 32635 | TGTAAAAGTATACTGTGTACAA | CTA | chr3 | 120678943 | 120678964 | 120678960 | 120678965 | + |
| SEQ ID NO 32636 | TGTACAAAATAAGATTAAAAA | CTG | chr3 | 120678958 | 120678979 | 120678975 | 120678980 | + |
| SEQ ID NO 32637 | AAAAGCTAACATTAAGCAAGTG | TTA | chr3 | 120678976 | 120678997 | 120678993 | 120678998 | + |
| SEQ ID NO 32638 | ACATTAAGCAAGTGTGTTTGTA | CTA | chr3 | 120678984 | 120679005 | 120679001 | 120679006 | + |
| SEQ ID NO 32639 | AGCAAGTGTGTTTGTATGTTTT | TTA | chr3 | 120678990 | 120679011 | 120679007 | 120679012 | + |
| SEQ ID NO 32640 | GTATGTTTTCTACAGTTCGGAT | TTT | chr3 | 120679003 | 120679024 | 120679020 | 120679025 | + |
| SEQ ID NO 32641 | TATGTTTTCTACAGTTCGGATT | TTG | chr3 | 120679004 | 120679025 | 120679021 | 120679026 | + |
| SEQ ID NO 32642 | TCTACAGTTCGGATTTCTGAAT | TTT | chr3 | 120679011 | 120679032 | 120679028 | 120679033 | + |

Figure 54 (Cont'd)

| | | | | | | | | |
|---|---|---|---|---|---|---|---|---|
| SEQ ID NO 32643 | CTACAGTTCGGATTTCTGAATA | TTT | chr3 | 120679012 | 120679033 | 120679029 | 120679034 | + |
| SEQ ID NO 32644 | TACAGTTCGGATTTCTGAATAA | TTC | chr3 | 120679013 | 120679034 | 120679030 | 120679035 | + |
| SEQ ID NO 32645 | CAGTTCGGATTTCTGAATAATT | CTA | chr3 | 120679015 | 120679036 | 120679032 | 120679037 | + |
| SEQ ID NO 32646 | GGATTTCTGAATAATTTGATCC | TTC | chr3 | 120679021 | 120679042 | 120679038 | 120679043 | + |
| SEQ ID NO 32647 | CTGAATAATTTGATCCGACAGA | TTT | chr3 | 120679027 | 120679048 | 120679044 | 120679049 | + |
| SEQ ID NO 32648 | TGAATAATTTGATCCGACAGAA | TTC | chr3 | 120679028 | 120679049 | 120679045 | 120679050 | + |
| SEQ ID NO 32649 | AATAATTTGATCCGACAGAAAA | CTG | chr3 | 120679030 | 120679051 | 120679047 | 120679052 | + |
| SEQ ID NO 32650 | GATCCGACAGAAAAATATGATT | TTT | chr3 | 120679038 | 120679059 | 120679055 | 120679060 | + |
| SEQ ID NO 32651 | ATCCGACAGAAAAATATGATTT | TTG | chr3 | 120679039 | 120679060 | 120679056 | 120679061 | + |
| SEQ ID NO 32652 | CATTTCTTTTCGAGAGAATTAT | TTT | chr3 | 120679061 | 120679082 | 120679078 | 120679083 | + |
| SEQ ID NO 32653 | ATTTCTTTTCGAGAGAATTATA | TTC | chr3 | 120679062 | 120679083 | 120679079 | 120679084 | + |
| SEQ ID NO 32654 | CTTTTCGAGAGAATTATATGCA | TTT | chr3 | 120679066 | 120679087 | 120679083 | 120679088 | + |
| SEQ ID NO 32655 | TTTTCGAGAGAATTATATGCAT | TTC | chr3 | 120679067 | 120679088 | 120679084 | 120679089 | + |
| SEQ ID NO 32656 | TTCGAGAGAATTATATGCATAC | CTT | chr3 | 120679069 | 120679090 | 120679086 | 120679091 | + |
| SEQ ID NO 32657 | TCGAGAGAATTATATGCATACT | TTT | chr3 | 120679070 | 120679091 | 120679087 | 120679092 | + |
| SEQ ID NO 32658 | CGAGAGAATTATATGCATACTT | TTT | chr3 | 120679071 | 120679092 | 120679088 | 120679093 | + |
| SEQ ID NO 32659 | GAGAGAATTATATGCATACTTT | TTC | chr3 | 120679072 | 120679093 | 120679089 | 120679094 | + |
| SEQ ID NO 32660 | TATGCATACTTTCTAAATGCAA | TTA | chr3 | 120679082 | 120679103 | 120679099 | 120679104 | + |
| SEQ ID NO 32661 | TCTAAATGCAAGAATAAATTCC | CTT | chr3 | 120679093 | 120679114 | 120679110 | 120679115 | + |
| SEQ ID NO 32662 | CTAAATGCAAGAATAAATTCCT | TTT | chr3 | 120679094 | 120679115 | 120679111 | 120679116 | + |
| SEQ ID NO 32663 | TAAATGCAAGAATAAATTCCTG | TTC | chr3 | 120679095 | 120679116 | 120679112 | 120679117 | + |
| SEQ ID NO 32664 | AATGCAAGAATAAATTCCTGAG | CTA | chr3 | 120679097 | 120679118 | 120679114 | 120679119 | + |
| SEQ ID NO 32665 | CTGAGCTCCATGTGACTTCAGT | TTC | chr3 | 120679114 | 120679135 | 120679131 | 120679136 | + |
| SEQ ID NO 32666 | AGCTCCATGTGACTTCAGTACC | CTG | chr3 | 120679117 | 120679138 | 120679134 | 120679139 | + |
| SEQ ID NO 32667 | CATGTGACTTCAGTACCATCAG | CTC | chr3 | 120679122 | 120679143 | 120679139 | 120679144 | + |
| SEQ ID NO 32668 | CAGTACCATCAGCTCTTTGGCA | CTT | chr3 | 120679132 | 120679153 | 120679149 | 120679154 | + |
| SEQ ID NO 32669 | AGTACCATCAGCTCTTTGGCAG | TTC | chr3 | 120679133 | 120679154 | 120679150 | 120679155 | + |
| SEQ ID NO 32670 | TTTGGCAGCTTATGAGTATACA | CTC | chr3 | 120679147 | 120679168 | 120679164 | 120679169 | + |
| SEQ ID NO 32671 | TGGCAGCTTATGAGTATACAGC | CTT | chr3 | 120679149 | 120679170 | 120679166 | 120679171 | + |
| SEQ ID NO 32672 | GGCAGCTTATGAGTATACAGCT | TTT | chr3 | 120679150 | 120679171 | 120679167 | 120679172 | + |
| SEQ ID NO 32673 | GCAGCTTATGAGTATACAGCTT | TTG | chr3 | 120679151 | 120679172 | 120679168 | 120679173 | + |
| SEQ ID NO 32674 | ATGAGTATACAGCTTTTAATT | CTT | chr3 | 120679158 | 120679179 | 120679175 | 120679180 | + |
| SEQ ID NO 32675 | TGAGTATACAGCTTTTAATTC | TTA | chr3 | 120679159 | 120679180 | 120679176 | 120679181 | + |
| SEQ ID NO 32676 | TTTAATTCTCACCTGGTCCCCA | CTT | chr3 | 120679173 | 120679194 | 120679190 | 120679195 | + |
| SEQ ID NO 32677 | TTAATTCTCACCTGGTCCCCAG | TTT | chr3 | 120679174 | 120679195 | 120679191 | 120679196 | + |
| SEQ ID NO 32678 | TAATTCTCACCTGGTCCCCAGG | TTT | chr3 | 120679175 | 120679196 | 120679192 | 120679197 | + |
| SEQ ID NO 32679 | AATTCTCACCTGGTCCCCAGGA | TTT | chr3 | 120679176 | 120679197 | 120679193 | 120679198 | + |
| SEQ ID NO 32680 | ATTCTCACCTGGTCCCCAGGAT | TTA | chr3 | 120679177 | 120679198 | 120679194 | 120679199 | + |
| SEQ ID NO 32681 | TCACCTGGTCCCCAGGATATGG | TTC | chr3 | 120679181 | 120679202 | 120679198 | 120679203 | + |
| SEQ ID NO 32682 | ACCTGGTCCCCAGGATATGGTT | CTC | chr3 | 120679183 | 120679204 | 120679200 | 120679205 | + |
| SEQ ID NO 32683 | GTCCCCAGGATATGGTTTACTT | CTG | chr3 | 120679188 | 120679209 | 120679205 | 120679210 | + |
| SEQ ID NO 32684 | ACTTGTCAGAGTAGTTTTATGA | TTT | chr3 | 120679206 | 120679227 | 120679223 | 120679228 | + |
| SEQ ID NO 32685 | CTTGTCAGAGTAGTTTTATGAG | TTA | chr3 | 120679207 | 120679228 | 120679224 | 120679229 | + |
| SEQ ID NO 32686 | GTCAGAGTAGTTTTATGAGGTG | CTT | chr3 | 120679210 | 120679231 | 120679227 | 120679232 | + |
| SEQ ID NO 32687 | TCAGAGTAGTTTTATGAGGTGC | TTG | chr3 | 120679211 | 120679232 | 120679228 | 120679233 | + |
| SEQ ID NO 32688 | TATGAGGTGCTTTCTCCTGACT | TTT | chr3 | 120679223 | 120679244 | 120679240 | 120679245 | + |
| SEQ ID NO 32689 | ATGAGGTGCTTTCTCCTGACTC | TTT | chr3 | 120679224 | 120679245 | 120679241 | 120679246 | + |
| SEQ ID NO 32690 | TGAGGTGCTTTCTCCTGACTCT | TTA | chr3 | 120679225 | 120679246 | 120679242 | 120679247 | + |
| SEQ ID NO 32691 | TCTCCTGACTCTGATTCTAGGT | CTT | chr3 | 120679235 | 120679256 | 120679252 | 120679257 | + |
| SEQ ID NO 32692 | CTCCTGACTCTGATTCTAGGTA | TTT | chr3 | 120679236 | 120679257 | 120679253 | 120679258 | + |
| SEQ ID NO 32693 | TCCTGACTCTGATTCTAGGTAA | TTC | chr3 | 120679237 | 120679258 | 120679254 | 120679259 | + |
| SEQ ID NO 32694 | CTGACTCTGATTCTAGGTAACA | CTC | chr3 | 120679239 | 120679260 | 120679256 | 120679261 | + |
| SEQ ID NO 32695 | ACTCTGATTCTAGGTAACACCT | CTG | chr3 | 120679242 | 120679263 | 120679259 | 120679264 | + |
| SEQ ID NO 32696 | TGATTCTAGGTAACACCTGATG | CTC | chr3 | 120679246 | 120679267 | 120679263 | 120679268 | + |
| SEQ ID NO 32697 | ATTCTAGGTAACACCTGATGAG | CTG | chr3 | 120679248 | 120679269 | 120679265 | 120679270 | + |
| SEQ ID NO 32698 | TAGGTAACACCTGATGAGATGA | TTC | chr3 | 120679252 | 120679273 | 120679269 | 120679274 | + |
| SEQ ID NO 32699 | GGTAACACCTGATGAGATGAAC | CTA | chr3 | 120679254 | 120679275 | 120679271 | 120679276 | + |
| SEQ ID NO 32700 | ATGAGATGAACAGATGGTGCAC | CTG | chr3 | 120679265 | 120679286 | 120679282 | 120679287 | + |
| SEQ ID NO 32701 | ACTTCCTCTTACTGGGCATGAA | CTC | chr3 | 120679290 | 120679311 | 120679307 | 120679312 | + |

Figure 54 (Cont'd)

| | | | | | | | | |
|---|---|---|---|---|---|---|---|---|
| SEQ ID NO 32702 | CCTCTTACTGGGCATGAAGGAA | CTT | chr3 | 120679294 | 120679315 | 120679311 | 120679316 | + |
| SEQ ID NO 32703 | CTCTTACTGGGCATGAAGGAAA | TTC | chr3 | 120679295 | 120679316 | 120679312 | 120679317 | + |
| SEQ ID NO 32704 | TTACTGGGCATGAAGGAAAGAG | CTC | chr3 | 120679298 | 120679319 | 120679315 | 120679320 | + |
| SEQ ID NO 32705 | ACTGGGCATGAAGGAAAGAGAG | CTT | chr3 | 120679300 | 120679321 | 120679317 | 120679322 | + |
| SEQ ID NO 32706 | CTGGGCATGAAGGAAAGAGAGA | TTA | chr3 | 120679301 | 120679322 | 120679318 | 120679323 | + |
| SEQ ID NO 32707 | GGCATGAAGGAAAGAGAGAGAA | CTG | chr3 | 120679304 | 120679325 | 120679321 | 120679326 | + |
| SEQ ID NO 32708 | CTGCTACATTTTTTTTTCTGT | CTA | chr3 | 120679347 | 120679368 | 120679364 | 120679369 | + |
| SEQ ID NO 32709 | CTACATTTTTTTTTCTGTGGA | CTG | chr3 | 120679350 | 120679371 | 120679367 | 120679372 | + |
| SEQ ID NO 32710 | CATTTTTTTTTCTGTGGAAAA | CTA | chr3 | 120679353 | 120679374 | 120679370 | 120679375 | + |
| SEQ ID NO 32711 | TTTTTTTCTGTGGAAAAAGAGT | TTT | chr3 | 120679358 | 120679379 | 120679375 | 120679380 | + |
| SEQ ID NO 32712 | TTTTTTCTGTGGAAAAAGAGTC | TTT | chr3 | 120679359 | 120679380 | 120679376 | 120679381 | + |
| SEQ ID NO 32713 | TTTTTCTGTGGAAAAAGAGTCT | TTT | chr3 | 120679360 | 120679381 | 120679377 | 120679382 | + |
| SEQ ID NO 32714 | TTTTCTGTGGAAAAAGAGTCTA | TTT | chr3 | 120679361 | 120679382 | 120679378 | 120679383 | + |
| SEQ ID NO 32715 | TTTCTGTGGAAAAAGAGTCTAA | TTT | chr3 | 120679362 | 120679383 | 120679379 | 120679384 | + |
| SEQ ID NO 32716 | TTCTGTGGAAAAAGAGTCTAAT | TTT | chr3 | 120679363 | 120679384 | 120679380 | 120679385 | + |
| SEQ ID NO 32717 | TCTGTGGAAAAAGAGTCTAATA | TTT | chr3 | 120679364 | 120679385 | 120679381 | 120679386 | + |
| SEQ ID NO 32718 | CTGTGGAAAAAGAGTCTAATAT | TTT | chr3 | 120679365 | 120679386 | 120679382 | 120679387 | + |
| SEQ ID NO 32719 | TGTGGAAAAAGAGTCTAATATT | TTC | chr3 | 120679366 | 120679387 | 120679383 | 120679388 | + |
| SEQ ID NO 32720 | TGGAAAAAGAGTCTAATATTTC | CTG | chr3 | 120679368 | 120679389 | 120679385 | 120679390 | + |
| SEQ ID NO 32721 | ATATTTCTAATTAACCTTGATG | CTA | chr3 | 120679383 | 120679404 | 120679400 | 120679405 | + |
| SEQ ID NO 32722 | CTAATTAACCTTGATGGGAACA | TTT | chr3 | 120679389 | 120679410 | 120679406 | 120679411 | + |
| SEQ ID NO 32723 | TAATTAACCTTGATGGGAACAT | TTC | chr3 | 120679390 | 120679411 | 120679407 | 120679412 | + |
| SEQ ID NO 32724 | ATTAACCTTGATGGGAACATAG | CTA | chr3 | 120679392 | 120679413 | 120679409 | 120679414 | + |
| SEQ ID NO 32725 | ACCTTGATGGGAACATAGAACA | TTA | chr3 | 120679396 | 120679417 | 120679413 | 120679418 | + |
| SEQ ID NO 32726 | GATGGGAACATAGAACATAGAT | CTT | chr3 | 120679401 | 120679422 | 120679418 | 120679423 | + |
| SEQ ID NO 32727 | ATGGGAACATAGAACATAGATT | TTG | chr3 | 120679402 | 120679423 | 120679419 | 120679424 | + |
| SEQ ID NO 32728 | TAAAGGGAACTTGCACATTATC | TTG | chr3 | 120679425 | 120679446 | 120679442 | 120679447 | + |
| SEQ ID NO 32729 | GCACATTATCGCAGTAGGCTGA | CTT | chr3 | 120679437 | 120679458 | 120679454 | 120679459 | + |
| SEQ ID NO 32730 | CACATTATCGCAGTAGGCTGAA | TTG | chr3 | 120679438 | 120679459 | 120679455 | 120679460 | + |
| SEQ ID NO 32731 | TCGCAGTAGGCTGAATAATGGC | TTA | chr3 | 120679445 | 120679466 | 120679462 | 120679467 | + |
| SEQ ID NO 32732 | AATAATGGCTAATGGCTCACTC | CTG | chr3 | 120679458 | 120679479 | 120679475 | 120679480 | + |
| SEQ ID NO 32733 | ATGGCTCACTCTGAAAGATATG | CTA | chr3 | 120679469 | 120679490 | 120679486 | 120679491 | + |
| SEQ ID NO 32734 | ACTCTGAAAGATATGTATGGCT | CTC | chr3 | 120679476 | 120679497 | 120679493 | 120679498 | + |
| SEQ ID NO 32735 | TGAAAGATATGTATGGCTTAAC | CTC | chr3 | 120679480 | 120679501 | 120679497 | 120679502 | + |
| SEQ ID NO 32736 | AAAGATATGTATGGCTTAACCC | CTG | chr3 | 120679482 | 120679503 | 120679499 | 120679504 | + |
| SEQ ID NO 32737 | AACCCCTGAAACCTGTGAGTAT | CTT | chr3 | 120679499 | 120679520 | 120679516 | 120679521 | + |
| SEQ ID NO 32738 | ACCCCTGAAACCTGTGAGTATT | TTA | chr3 | 120679500 | 120679521 | 120679517 | 120679522 | + |
| SEQ ID NO 32739 | AAACCTGTGAGTATTATCTTTT | CTG | chr3 | 120679507 | 120679528 | 120679524 | 120679529 | + |
| SEQ ID NO 32740 | TGAGTATTATCTTTTCTAGCCA | CTG | chr3 | 120679514 | 120679535 | 120679531 | 120679536 | + |
| SEQ ID NO 32741 | TCTTTTCTAGCCAAACAGACTT | TTA | chr3 | 120679523 | 120679544 | 120679540 | 120679545 | + |
| SEQ ID NO 32742 | TTCTAGCCAAACAGACTTTTGC | CTT | chr3 | 120679527 | 120679548 | 120679544 | 120679549 | + |
| SEQ ID NO 32743 | TCTAGCCAAACAGACTTTTGCA | TTT | chr3 | 120679528 | 120679549 | 120679545 | 120679550 | + |
| SEQ ID NO 32744 | CTAGCCAAACAGACTTTTGCAT | TTT | chr3 | 120679529 | 120679550 | 120679546 | 120679551 | + |
| SEQ ID NO 32745 | TAGCCAAACAGACTTTTGCATA | TTC | chr3 | 120679530 | 120679551 | 120679547 | 120679552 | + |
| SEQ ID NO 32746 | GCCAAACAGACTTTTGCATATA | CTA | chr3 | 120679532 | 120679553 | 120679549 | 120679554 | + |
| SEQ ID NO 32747 | TTGCATATATAATTAAGGATCT | CTT | chr3 | 120679545 | 120679566 | 120679562 | 120679567 | + |
| SEQ ID NO 32748 | TGCATATATAATTAAGGATCTT | TTT | chr3 | 120679546 | 120679567 | 120679563 | 120679568 | + |
| SEQ ID NO 32749 | GCATATATAATTAAGGATCTTG | TTT | chr3 | 120679547 | 120679568 | 120679564 | 120679569 | + |
| SEQ ID NO 32750 | CATATATAATTAAGGATCTTGG | TTG | chr3 | 120679548 | 120679569 | 120679565 | 120679570 | + |
| SEQ ID NO 32751 | AGGATCTTGGGATGGGAGATA | TTA | chr3 | 120679560 | 120679581 | 120679577 | 120679582 | + |
| SEQ ID NO 32752 | GGGATGGGAGATATCCTAATT | CTT | chr3 | 120679568 | 120679589 | 120679585 | 120679590 | + |
| SEQ ID NO 32753 | GGATGGGAGATATCCTAATTA | TTG | chr3 | 120679569 | 120679590 | 120679586 | 120679591 | + |
| SEQ ID NO 32754 | ATTATTTGGGTGTATCCTAAAT | CTA | chr3 | 120679587 | 120679608 | 120679604 | 120679609 | + |
| SEQ ID NO 32755 | TTTGGGTGTATCCTAAATGTAA | TTA | chr3 | 120679591 | 120679612 | 120679608 | 120679613 | + |
| SEQ ID NO 32756 | GGGTGTATCCTAAATGTAATCA | TTT | chr3 | 120679594 | 120679615 | 120679611 | 120679616 | + |
| SEQ ID NO 32757 | GGTGTATCCTAAATGTAATCAC | TTG | chr3 | 120679595 | 120679616 | 120679612 | 120679617 | + |
| SEQ ID NO 32758 | AATGTAATCACAAGTGTCATTA | CTA | chr3 | 120679606 | 120679627 | 120679623 | 120679628 | + |
| SEQ ID NO 32759 | TAAGAGGGAGGCAAAGGGAGAT | TTA | chr3 | 120679628 | 120679649 | 120679645 | 120679650 | + |
| SEQ ID NO 32760 | GACTTATAAGAGGAGAAAATGT | TTT | chr3 | 120679652 | 120679673 | 120679669 | 120679674 | + |

Figure 54 (Cont'd)

| | | | | | | | | |
|---|---|---|---|---|---|---|---|---|
| SEQ ID NO 32761 | ACTTATAAGAGGAGAAAATGTG | TTG | chr3 | 120679653 | 120679674 | 120679670 | 120679675 | + |
| SEQ ID NO 32762 | ATAAGAGGAGAAAATGTGACGT | CTT | chr3 | 120679657 | 120679678 | 120679674 | 120679679 | + |
| SEQ ID NO 32763 | TAAGAGGAGAAAATGTGACGTG | TTA | chr3 | 120679658 | 120679679 | 120679675 | 120679680 | + |
| SEQ ID NO 32764 | CAAAAGCAGAGATACATTTTTT | TTA | chr3 | 120679684 | 120679705 | 120679701 | 120679706 | + |
| SEQ ID NO 32765 | TTTTGAAGATCGAGGAAGAGGC | TTT | chr3 | 120679703 | 120679724 | 120679720 | 120679725 | + |
| SEQ ID NO 32766 | TTTGAAGATCGAGGAAGAGGCT | TTT | chr3 | 120679704 | 120679725 | 120679721 | 120679726 | + |
| SEQ ID NO 32767 | TTGAAGATCGAGGAAGAGGCTA | TTT | chr3 | 120679705 | 120679726 | 120679722 | 120679727 | + |
| SEQ ID NO 32768 | TGAAGATCGAGGAAGAGGCTAC | TTT | chr3 | 120679706 | 120679727 | 120679723 | 120679728 | + |
| SEQ ID NO 32769 | GAAGATCGAGGAAGAGGCTACA | TTT | chr3 | 120679707 | 120679728 | 120679724 | 120679729 | + |
| SEQ ID NO 32770 | AAGATCGAGGAAGAGGCTACAA | TTG | chr3 | 120679708 | 120679729 | 120679725 | 120679730 | + |
| SEQ ID NO 32771 | CAAACCAAGGAATGTGGGTAGC | CTA | chr3 | 120679727 | 120679748 | 120679744 | 120679749 | + |
| SEQ ID NO 32772 | TAGAAGAGGAAACAGAATCCAT | CTC | chr3 | 120679752 | 120679773 | 120679769 | 120679774 | + |
| SEQ ID NO 32773 | GAAGAGGAAACAGAATCCATGG | CTA | chr3 | 120679754 | 120679775 | 120679771 | 120679776 | + |
| SEQ ID NO 32774 | TCATAGAGTCTCCAGAAGAAAC | CTC | chr3 | 120679799 | 120679820 | 120679816 | 120679821 | + |
| SEQ ID NO 32775 | ATAGAGTCTCCAGAAGAAACAG | CTC | chr3 | 120679801 | 120679822 | 120679818 | 120679823 | + |
| SEQ ID NO 32776 | CAGAAGAAACAGCCACACTGAC | CTC | chr3 | 120679811 | 120679832 | 120679828 | 120679833 | + |
| SEQ ID NO 32777 | ACACCTCGACTTTAGCCCAGTG | CTG | chr3 | 120679831 | 120679852 | 120679848 | 120679853 | + |
| SEQ ID NO 32778 | GACTTTAGCCCAGTGAAACCGA | CTC | chr3 | 120679838 | 120679859 | 120679855 | 120679860 | + |
| SEQ ID NO 32779 | TAGCCCAGTGAAACCGATTTCA | CTT | chr3 | 120679843 | 120679864 | 120679860 | 120679865 | + |
| SEQ ID NO 32780 | AGCCCAGTGAAACCGATTTCAG | TTT | chr3 | 120679844 | 120679865 | 120679861 | 120679866 | + |
| SEQ ID NO 32781 | GCCCAGTGAAACCGATTTCAGA | TTA | chr3 | 120679845 | 120679866 | 120679862 | 120679867 | + |
| SEQ ID NO 32782 | CAGACTTCTGACCTCCACAACT | TTT | chr3 | 120679863 | 120679884 | 120679880 | 120679885 | + |
| SEQ ID NO 32783 | AGACTTCTGACCTCCACAACTT | TTC | chr3 | 120679864 | 120679885 | 120679881 | 120679886 | + |
| SEQ ID NO 32784 | CTGACCTCCACAACTTCAAGAT | CTT | chr3 | 120679870 | 120679891 | 120679887 | 120679892 | + |
| SEQ ID NO 32785 | TGACCTCCACAACTTCAAGATA | TTC | chr3 | 120679871 | 120679892 | 120679888 | 120679893 | + |
| SEQ ID NO 32786 | ACCTCCACAACTTCAAGATAAT | CTG | chr3 | 120679873 | 120679894 | 120679890 | 120679895 | + |
| SEQ ID NO 32787 | CACAACTTCAAGATAATACATT | CTC | chr3 | 120679878 | 120679899 | 120679895 | 120679900 | + |
| SEQ ID NO 32788 | CAAGATAATACATTTGTGTTGT | CTT | chr3 | 120679886 | 120679907 | 120679903 | 120679908 | + |
| SEQ ID NO 32789 | AAGATAATACATTTGTGTTGTT | TTC | chr3 | 120679887 | 120679908 | 120679904 | 120679909 | + |
| SEQ ID NO 32790 | GTGTTGTTTTAAGCCAATAAAT | TTT | chr3 | 120679901 | 120679922 | 120679918 | 120679923 | + |
| SEQ ID NO 32791 | TGTTGTTTTAAGCCAATAAATT | TTG | chr3 | 120679902 | 120679923 | 120679919 | 120679924 | + |
| SEQ ID NO 32792 | TTTTAAGCCAATAAATTTGTGG | TTG | chr3 | 120679907 | 120679928 | 120679924 | 120679929 | + |
| SEQ ID NO 32793 | TAAGCCAATAAATTTGTGGTAA | TTT | chr3 | 120679910 | 120679931 | 120679927 | 120679932 | + |
| SEQ ID NO 32794 | AAGCCAATAAATTTGTGGTAAT | TTT | chr3 | 120679911 | 120679932 | 120679928 | 120679933 | + |
| SEQ ID NO 32795 | AGCCAATAAATTTGTGGTAATT | TTA | chr3 | 120679912 | 120679933 | 120679929 | 120679934 | + |
| SEQ ID NO 32796 | GTGGTAATTTTTTACAGCAGCA | TTT | chr3 | 120679925 | 120679946 | 120679942 | 120679947 | + |
| SEQ ID NO 32797 | TGGTAATTTTTTACAGCAGCAA | TTG | chr3 | 120679926 | 120679947 | 120679943 | 120679948 | + |
| SEQ ID NO 32798 | TTTACAGCAGCAAGAGGAAATC | TTT | chr3 | 120679935 | 120679956 | 120679952 | 120679957 | + |
| SEQ ID NO 32799 | TTACAGCAGCAAGAGGAAATCA | TTT | chr3 | 120679936 | 120679957 | 120679953 | 120679958 | + |
| SEQ ID NO 32800 | TACAGCAGCAAGAGGAAATCAG | TTT | chr3 | 120679937 | 120679958 | 120679954 | 120679959 | + |
| SEQ ID NO 32801 | ACAGCAGCAAGAGGAAATCAGT | TTT | chr3 | 120679938 | 120679959 | 120679955 | 120679960 | + |
| SEQ ID NO 32802 | CAGCAGCAAGAGGAAATCAGTT | TTA | chr3 | 120679939 | 120679960 | 120679956 | 120679961 | + |
| SEQ ID NO 32803 | CGTAGAATAGTAGGTCCTGTCT | TTA | chr3 | 120679962 | 120679983 | 120679979 | 120679984 | + |
| SEQ ID NO 32804 | TCTCTGGCTAATCATTAGAATC | CTG | chr3 | 120679981 | 120680002 | 120679998 | 120680003 | + |
| SEQ ID NO 32805 | TGGCTAATCATTAGAATCACTC | CTC | chr3 | 120679985 | 120680006 | 120680002 | 120680007 | + |
| SEQ ID NO 32806 | GCTAATCATTAGAATCACTCCA | CTG | chr3 | 120679987 | 120680008 | 120680004 | 120680009 | + |
| SEQ ID NO 32807 | ATCATTAGAATCACTCCAGAAG | CTA | chr3 | 120679991 | 120680012 | 120680008 | 120680013 | + |
| SEQ ID NO 32808 | GAATCACTCCAGAAGCTTGTTA | TTA | chr3 | 120679998 | 120680019 | 120680015 | 120680020 | + |
| SEQ ID NO 32809 | CAGAAGCTTGTTACATACAGAC | CTC | chr3 | 120680007 | 120680028 | 120680024 | 120680029 | + |
| SEQ ID NO 32810 | GTTACATACAGACCCAGAGCCA | CTT | chr3 | 120680016 | 120680037 | 120680033 | 120680038 | + |
| SEQ ID NO 32811 | TTACATACAGACCCAGAGCCAG | TTG | chr3 | 120680017 | 120680038 | 120680034 | 120680039 | + |
| SEQ ID NO 32812 | CATACAGACCCAGAGCCAGTGA | TTA | chr3 | 120680020 | 120680041 | 120680037 | 120680042 | + |
| SEQ ID NO 32813 | GGTGGTGGGCCCAGAGCCTGA | TTT | chr3 | 120680053 | 120680074 | 120680070 | 120680075 | + |
| SEQ ID NO 32814 | GTGGTGGGCCCAGAGCCTGAA | TTG | chr3 | 120680054 | 120680075 | 120680071 | 120680076 | + |
| SEQ ID NO 32815 | AATATTAAGCAAGTTCTTCGTT | CTG | chr3 | 120680074 | 120680095 | 120680091 | 120680096 | + |
| SEQ ID NO 32816 | AGCAAGTTCTTCGTTTTAGAAA | TTA | chr3 | 120680081 | 120680102 | 120680098 | 120680103 | + |
| SEQ ID NO 32817 | TTCGTTTTAGAAATGAGGAAAC | TTC | chr3 | 120680090 | 120680111 | 120680107 | 120680112 | + |
| SEQ ID NO 32818 | CGTTTTAGAAATGAGGAAACCA | CTT | chr3 | 120680092 | 120680113 | 120680109 | 120680114 | + |
| SEQ ID NO 32819 | GTTTTAGAAATGAGGAAACCAA | TTC | chr3 | 120680093 | 120680114 | 120680110 | 120680115 | + |

Figure 54 (Cont'd)

| | | | | | | | | |
|---|---|---|---|---|---|---|---|---|
| SEQ ID NO 32820 | TAGAAATGAGGAAACCAAGGTT | TTT | chr3 | 120680097 | 120680118 | 120680114 | 120680119 | + |
| SEQ ID NO 32821 | AGAAATGAGGAAACCAAGGTTG | TTT | chr3 | 120680098 | 120680119 | 120680115 | 120680120 | + |
| SEQ ID NO 32822 | GAAATGAGGAAACCAAGGTTGG | TTA | chr3 | 120680099 | 120680120 | 120680116 | 120680121 | + |
| SEQ ID NO 32823 | GGAGAAGCTAAGCAACTTACTC | TTG | chr3 | 120680120 | 120680141 | 120680137 | 120680142 | + |
| SEQ ID NO 32824 | AGCAACTTACTCAAATACATAG | CTA | chr3 | 120680130 | 120680151 | 120680147 | 120680152 | + |
| SEQ ID NO 32825 | ACTCAAATACATAGGGTATTTC | CTT | chr3 | 120680138 | 120680159 | 120680155 | 120680160 | + |
| SEQ ID NO 32826 | CTCAAATACATAGGGTATTTCA | TTA | chr3 | 120680139 | 120680160 | 120680156 | 120680161 | + |
| SEQ ID NO 32827 | AAATACATAGGGTATTTCATTT | CTC | chr3 | 120680142 | 120680163 | 120680159 | 120680164 | + |
| SEQ ID NO 32828 | CATTTTAAATTTAATTTTATTA | TTT | chr3 | 120680159 | 120680180 | 120680176 | 120680181 | + |
| SEQ ID NO 32829 | ATTTTAAATTTAATTTTATTAC | TTC | chr3 | 120680160 | 120680181 | 120680177 | 120680182 | + |
| SEQ ID NO 32830 | TAAATTTAATTTTATTACTTTA | TTT | chr3 | 120680164 | 120680185 | 120680181 | 120680186 | + |
| SEQ ID NO 32831 | AAATTTAATTTTATTACTTTAT | TTT | chr3 | 120680165 | 120680186 | 120680182 | 120680187 | + |
| SEQ ID NO 32832 | AATTTAATTTTATTACTTTATC | TTA | chr3 | 120680166 | 120680187 | 120680183 | 120680188 | + |
| SEQ ID NO 32833 | AATTTTATTACTTTATCTTTTG | TTT | chr3 | 120680171 | 120680192 | 120680188 | 120680193 | + |
| SEQ ID NO 32834 | ATTTTATTACTTTATCTTTTGA | TTA | chr3 | 120680172 | 120680193 | 120680189 | 120680194 | + |
| SEQ ID NO 32835 | TATTACTTTATCTTTTGAATTT | TTT | chr3 | 120680176 | 120680197 | 120680193 | 120680198 | + |
| SEQ ID NO 32836 | ATTACTTTATCTTTTGAATTTT | TTT | chr3 | 120680177 | 120680198 | 120680194 | 120680199 | + |
| SEQ ID NO 32837 | TTACTTTATCTTTTGAATTTTC | TTA | chr3 | 120680178 | 120680199 | 120680195 | 120680200 | + |
| SEQ ID NO 32838 | CTTTATCTTTTGAATTTTCTTA | TTA | chr3 | 120680181 | 120680202 | 120680198 | 120680203 | + |
| SEQ ID NO 32839 | TATCTTTTGAATTTTCTTACCC | CTT | chr3 | 120680184 | 120680205 | 120680201 | 120680206 | + |
| SEQ ID NO 32840 | ATCTTTTGAATTTTCTTACCCC | TTT | chr3 | 120680185 | 120680206 | 120680202 | 120680207 | + |
| SEQ ID NO 32841 | TCTTTTGAATTTTCTTACCCCA | TTA | chr3 | 120680186 | 120680207 | 120680203 | 120680208 | + |
| SEQ ID NO 32842 | TTGAATTTTCTTACCCCAGTTG | CTT | chr3 | 120680190 | 120680211 | 120680207 | 120680212 | + |
| SEQ ID NO 32843 | TGAATTTTCTTACCCCAGTTGT | TTT | chr3 | 120680191 | 120680212 | 120680208 | 120680213 | + |
| SEQ ID NO 32844 | GAATTTTCTTACCCCAGTTGTA | TTT | chr3 | 120680192 | 120680213 | 120680209 | 120680214 | + |
| SEQ ID NO 32845 | AATTTTCTTACCCCAGTTGTAC | TTG | chr3 | 120680193 | 120680214 | 120680210 | 120680215 | + |
| SEQ ID NO 32846 | TCTTACCCCAGTTGTACTTTTG | TTT | chr3 | 120680198 | 120680219 | 120680215 | 120680220 | + |
| SEQ ID NO 32847 | CTTACCCCAGTTGTACTTTTGT | TTT | chr3 | 120680199 | 120680220 | 120680216 | 120680221 | + |
| SEQ ID NO 32848 | TTACCCCAGTTGTACTTTTGTG | TTC | chr3 | 120680200 | 120680221 | 120680217 | 120680222 | + |
| SEQ ID NO 32849 | ACCCCAGTTGTACTTTTGTGTA | CTT | chr3 | 120680202 | 120680223 | 120680219 | 120680224 | + |
| SEQ ID NO 32850 | CCCCAGTTGTACTTTTGTGTAA | TTA | chr3 | 120680203 | 120680224 | 120680220 | 120680225 | + |
| SEQ ID NO 32851 | TACTTTTGTGTAAATGTGATTT | TTG | chr3 | 120680212 | 120680233 | 120680229 | 120680234 | + |
| SEQ ID NO 32852 | TTGTGTAAATGTGATTTCATTT | CTT | chr3 | 120680217 | 120680238 | 120680234 | 120680239 | + |
| SEQ ID NO 32853 | TGTGTAAATGTGATTTCATTTA | TTT | chr3 | 120680218 | 120680239 | 120680235 | 120680240 | + |
| SEQ ID NO 32854 | GTGTAAATGTGATTTCATTTAC | TTT | chr3 | 120680219 | 120680240 | 120680236 | 120680241 | + |
| SEQ ID NO 32855 | TGTAAATGTGATTTCATTTACG | TTG | chr3 | 120680220 | 120680241 | 120680237 | 120680242 | + |
| SEQ ID NO 32856 | CATTTACGGCTTTGTGTTGACA | TTT | chr3 | 120680234 | 120680255 | 120680251 | 120680256 | + |
| SEQ ID NO 32857 | ATTTACGGCTTTGTGTTGACAT | TTC | chr3 | 120680235 | 120680256 | 120680252 | 120680257 | + |
| SEQ ID NO 32858 | ACGGCTTTGTGTTGACATATTC | TTT | chr3 | 120680239 | 120680260 | 120680256 | 120680261 | + |
| SEQ ID NO 32859 | CGGCTTTGTGTTGACATATTCA | TTA | chr3 | 120680240 | 120680261 | 120680257 | 120680262 | + |
| SEQ ID NO 32860 | TGTGTTGACATATTCATTAAAA | CTT | chr3 | 120680246 | 120680267 | 120680263 | 120680268 | + |
| SEQ ID NO 32861 | GTGTTGACATATTCATTAAAAT | TTT | chr3 | 120680247 | 120680268 | 120680264 | 120680269 | + |
| SEQ ID NO 32862 | TGTTGACATATTCATTAAAATG | TTG | chr3 | 120680248 | 120680269 | 120680265 | 120680270 | + |
| SEQ ID NO 32863 | ACATATTCATTAAAATGAAGAA | TTG | chr3 | 120680253 | 120680274 | 120680270 | 120680275 | + |
| SEQ ID NO 32864 | ATTAAAATGAAGAAATAAAAGA | TTC | chr3 | 120680261 | 120680282 | 120680278 | 120680283 | + |
| SEQ ID NO 32865 | AAATGAAGAAATAAAAGATGAG | TTA | chr3 | 120680265 | 120680286 | 120680282 | 120680287 | + |
| SEQ ID NO 32866 | TAAAATTATATAATGTTTATT | TTT | chr3 | 120680296 | 120680317 | 120680313 | 120680318 | + |
| SEQ ID NO 32867 | AAAAATTATATAATGTTTATTG | TTT | chr3 | 120680297 | 120680318 | 120680314 | 120680319 | + |
| SEQ ID NO 32868 | AAAATTATATAATGTTTATTGA | TTA | chr3 | 120680298 | 120680319 | 120680315 | 120680320 | + |
| SEQ ID NO 32869 | TATAATGTTTATTGATTAGAAT | TTA | chr3 | 120680305 | 120680326 | 120680322 | 120680327 | + |
| SEQ ID NO 32870 | ATTGATTAGAATGAATATGATG | TTT | chr3 | 120680315 | 120680336 | 120680332 | 120680337 | + |
| SEQ ID NO 32871 | TTGATTAGAATGAATATGATGC | TTA | chr3 | 120680316 | 120680337 | 120680333 | 120680338 | + |
| SEQ ID NO 32872 | ATTAGAATGAATATGATGCAAT | TTG | chr3 | 120680319 | 120680340 | 120680336 | 120680341 | + |
| SEQ ID NO 32873 | GAATGAATATGATGCAATCTGG | TTA | chr3 | 120680323 | 120680344 | 120680340 | 120680345 | + |
| SEQ ID NO 32874 | GTTTTCTGTGTTCAGATTCCTG | CTG | chr3 | 120680344 | 120680365 | 120680361 | 120680366 | + |
| SEQ ID NO 32875 | TCTGTGTTCAGATTCCTGACCT | TTT | chr3 | 120680348 | 120680369 | 120680365 | 120680370 | + |
| SEQ ID NO 32876 | CTGTGTTCAGATTCCTGACCTC | TTT | chr3 | 120680349 | 120680370 | 120680366 | 120680371 | + |
| SEQ ID NO 32877 | TGTGTTCAGATTCCTGACCTCT | TTC | chr3 | 120680350 | 120680371 | 120680367 | 120680372 | + |
| SEQ ID NO 32878 | TGTTCAGATTCCTGACCTCTGG | CTG | chr3 | 120680352 | 120680373 | 120680369 | 120680374 | + |

Figure 54 (Cont'd)

| | | | | | | | | |
|---|---|---|---|---|---|---|---|---|
| SEQ ID NO 32879 | AGATTCCTGACCTCTGGAGTTA | TTC | chr3 | 120680357 | 120680378 | 120680374 | 120680379 | + |
| SEQ ID NO 32880 | CTGACCTCTGGAGTTAACCTTT | TTC | chr3 | 120680363 | 120680384 | 120680380 | 120680385 | + |
| SEQ ID NO 32881 | ACCTCTGGAGTTAACCTTTCTT | CTG | chr3 | 120680366 | 120680387 | 120680383 | 120680388 | + |
| SEQ ID NO 32882 | TGGAGTTAACCTTTCTTTGTAA | CTC | chr3 | 120680371 | 120680392 | 120680388 | 120680393 | + |
| SEQ ID NO 32883 | GAGTTAACCTTTCTTTGTAAAG | CTG | chr3 | 120680373 | 120680394 | 120680390 | 120680395 | + |
| SEQ ID NO 32884 | ACCTTTCTTTGTAAAGATTAGA | TTA | chr3 | 120680379 | 120680400 | 120680396 | 120680401 | + |
| SEQ ID NO 32885 | TCTTTGTAAAGATTAGACAGCA | CTT | chr3 | 120680384 | 120680405 | 120680401 | 120680406 | + |
| SEQ ID NO 32886 | CTTTGTAAAGATTAGACAGCAG | TTT | chr3 | 120680385 | 120680406 | 120680402 | 120680407 | + |
| SEQ ID NO 32887 | TTTGTAAAGATTAGACAGCAGG | TTC | chr3 | 120680386 | 120680407 | 120680403 | 120680408 | + |
| SEQ ID NO 32888 | TGTAAAGATTAGACAGCAGGCA | CTT | chr3 | 120680388 | 120680409 | 120680405 | 120680410 | + |
| SEQ ID NO 32889 | GTAAAGATTAGACAGCAGGCAG | TTT | chr3 | 120680389 | 120680410 | 120680406 | 120680411 | + |
| SEQ ID NO 32890 | TAAAGATTAGACAGCAGGCAGG | TTG | chr3 | 120680390 | 120680411 | 120680407 | 120680412 | + |
| SEQ ID NO 32891 | GACAGCAGGCAGGGAAGAATGC | TTA | chr3 | 120680399 | 120680420 | 120680416 | 120680421 | + |
| SEQ ID NO 32892 | TGAAACTGAGAGCAAAGACTGG | CTT | chr3 | 120680424 | 120680445 | 120680441 | 120680446 | + |
| SEQ ID NO 32893 | GAAACTGAGAGCAAAGACTGGC | TTT | chr3 | 120680425 | 120680446 | 120680442 | 120680447 | + |
| SEQ ID NO 32894 | AAACTGAGAGCAAAGACTGGCA | TTG | chr3 | 120680426 | 120680447 | 120680443 | 120680448 | + |
| SEQ ID NO 32895 | AGAGCAAAGACTGGCATGCAAT | CTG | chr3 | 120680432 | 120680453 | 120680449 | 120680454 | + |
| SEQ ID NO 32896 | GCATGCAATTTACATTGATGTC | CTG | chr3 | 120680445 | 120680466 | 120680462 | 120680467 | + |
| SEQ ID NO 32897 | ACATTGATGTCCTGGTGCTGTG | TTT | chr3 | 120680456 | 120680477 | 120680473 | 120680478 | + |
| SEQ ID NO 32898 | CATTGATGTCCTGGTGCTGTGC | TTA | chr3 | 120680457 | 120680478 | 120680474 | 120680479 | + |
| SEQ ID NO 32899 | ATGTCCTGGTGCTGTGCATAAT | TTG | chr3 | 120680462 | 120680483 | 120680479 | 120680484 | + |
| SEQ ID NO 32900 | GTGCTGTGCATAATAAGTTGCT | CTG | chr3 | 120680470 | 120680491 | 120680487 | 120680492 | + |
| SEQ ID NO 32901 | TGCATAATAAGTTGCTTAAACA | CTG | chr3 | 120680476 | 120680497 | 120680493 | 120680498 | + |
| SEQ ID NO 32902 | CTTAAACATGACAGCAGGATAG | TTG | chr3 | 120680490 | 120680511 | 120680507 | 120680512 | + |
| SEQ ID NO 32903 | AAACATGACAGCAGGATAGGAT | CTT | chr3 | 120680493 | 120680514 | 120680510 | 120680515 | + |
| SEQ ID NO 32904 | AACATGACAGCAGGATAGGATT | TTA | chr3 | 120680494 | 120680515 | 120680511 | 120680516 | + |
| SEQ ID NO 32905 | TACATAAAATTTATTTATAAAT | TTT | chr3 | 120680517 | 120680538 | 120680534 | 120680539 | + |
| SEQ ID NO 32906 | ACATAAAATTTATTTATAAATG | TTT | chr3 | 120680518 | 120680539 | 120680535 | 120680540 | + |
| SEQ ID NO 32907 | CATAAAATTTATTTATAAATGG | TTA | chr3 | 120680519 | 120680540 | 120680536 | 120680541 | + |
| SEQ ID NO 32908 | ATTTATAAATGGTAAAGATGTT | TTT | chr3 | 120680529 | 120680550 | 120680546 | 120680551 | + |
| SEQ ID NO 32909 | TTTATAAATGGTAAAGATGTTT | TTA | chr3 | 120680530 | 120680551 | 120680547 | 120680552 | + |
| SEQ ID NO 32910 | ATAAATGGTAAAGATGTTTCCA | TTT | chr3 | 120680533 | 120680554 | 120680550 | 120680555 | + |
| SEQ ID NO 32911 | TAAATGGTAAAGATGTTTCCAA | TTA | chr3 | 120680534 | 120680555 | 120680551 | 120680556 | + |
| SEQ ID NO 32912 | CCAACCTCTGCTGAACTTCCTC | TTT | chr3 | 120680552 | 120680573 | 120680569 | 120680574 | + |
| SEQ ID NO 32913 | CAACCTCTGCTGAACTTCCTCA | TTC | chr3 | 120680553 | 120680574 | 120680570 | 120680575 | + |
| SEQ ID NO 32914 | TGCTGAACTTCCTCATAGAATG | CTC | chr3 | 120680560 | 120680581 | 120680577 | 120680582 | + |
| SEQ ID NO 32915 | CTGAACTTCCTCATAGAATGTT | CTG | chr3 | 120680562 | 120680583 | 120680579 | 120680584 | + |
| SEQ ID NO 32916 | AACTTCCTCATAGAATGTTCAT | CTG | chr3 | 120680565 | 120680586 | 120680582 | 120680587 | + |
| SEQ ID NO 32917 | CCTCATAGAATGTTCATCAGAA | CTT | chr3 | 120680570 | 120680591 | 120680587 | 120680592 | + |
| SEQ ID NO 32918 | CTCATAGAATGTTCATCAGAAA | TTC | chr3 | 120680571 | 120680592 | 120680588 | 120680593 | + |
| SEQ ID NO 32919 | ATAGAATGTTCATCAGAAAACA | CTC | chr3 | 120680574 | 120680595 | 120680591 | 120680596 | + |
| SEQ ID NO 32920 | ATCAGAAAACAAAGTTTCTATC | TTC | chr3 | 120680585 | 120680606 | 120680602 | 120680607 | + |
| SEQ ID NO 32921 | CTATCTACTCTTTCTTCCAAGA | TTT | chr3 | 120680602 | 120680623 | 120680619 | 120680624 | + |
| SEQ ID NO 32922 | TATCTACTCTTTCTTCCAAGAC | TTC | chr3 | 120680603 | 120680624 | 120680620 | 120680625 | + |
| SEQ ID NO 32923 | TCTACTCTTTCTTCCAAGACTT | CTA | chr3 | 120680605 | 120680626 | 120680622 | 120680627 | + |
| SEQ ID NO 32924 | CTCTTTCTTCCAAGACTTCAAC | CTA | chr3 | 120680609 | 120680630 | 120680626 | 120680631 | + |
| SEQ ID NO 32925 | TTTCTTCCAAGACTTCAACTCC | CTC | chr3 | 120680612 | 120680633 | 120680629 | 120680634 | + |
| SEQ ID NO 32926 | TCTTCCAAGACTTCAACTCCTA | CTT | chr3 | 120680614 | 120680635 | 120680631 | 120680636 | + |
| SEQ ID NO 32927 | CTTCCAAGACTTCAACTCCTAC | TTT | chr3 | 120680615 | 120680636 | 120680632 | 120680637 | + |
| SEQ ID NO 32928 | TTCCAAGACTTCAACTCCTACC | TTC | chr3 | 120680616 | 120680637 | 120680633 | 120680638 | + |
| SEQ ID NO 32929 | CCAAGACTTCAACTCCTACCAC | CTT | chr3 | 120680618 | 120680639 | 120680635 | 120680640 | + |
| SEQ ID NO 32930 | CAAGACTTCAACTCCTACCACT | TTC | chr3 | 120680619 | 120680640 | 120680636 | 120680641 | + |
| SEQ ID NO 32931 | CAACTCCTACCACTGACATCAT | CTT | chr3 | 120680627 | 120680648 | 120680644 | 120680649 | + |
| SEQ ID NO 32932 | AACTCCTACCACTGACATCATG | TTC | chr3 | 120680628 | 120680649 | 120680645 | 120680650 | + |
| SEQ ID NO 32933 | CTACCACTGACATCATGACCCT | CTC | chr3 | 120680633 | 120680654 | 120680650 | 120680655 | + |
| SEQ ID NO 32934 | CCACTGACATCATGACCCTCAG | CTA | chr3 | 120680636 | 120680657 | 120680653 | 120680658 | + |
| SEQ ID NO 32935 | ACATCATGACCCTCAGTTCTAT | CTG | chr3 | 120680642 | 120680663 | 120680659 | 120680664 | + |
| SEQ ID NO 32936 | AGTTCTATTCCCCTAGCCCTGC | CTC | chr3 | 120680656 | 120680677 | 120680673 | 120680678 | + |
| SEQ ID NO 32937 | TATTCCCCTAGCCCTGCCCACT | TTC | chr3 | 120680661 | 120680682 | 120680678 | 120680683 | + |

Figure 54 (Cont'd)

| | | | | | | | | |
|---|---|---|---|---|---|---|---|---|
| SEQ ID NO 32938 | TTCCCCTAGCCCTGCCCACTCC | CTA | chr3 | 120680663 | 120680684 | 120680680 | 120680685 | + |
| SEQ ID NO 32939 | CCCTAGCCCTGCCCACTCCCT | TTC | chr3 | 120680666 | 120680687 | 120680683 | 120680688 | + |
| SEQ ID NO 32940 | GCCCTGCCCACTCCCCTGAAAT | CTA | chr3 | 120680671 | 120680692 | 120680688 | 120680693 | + |
| SEQ ID NO 32941 | CCCACTCCCCTGAAATCCAGAT | CTG | chr3 | 120680677 | 120680698 | 120680694 | 120680699 | + |
| SEQ ID NO 32942 | CCCTGAAATCCAGATCCATAAA | CTC | chr3 | 120680684 | 120680705 | 120680701 | 120680706 | + |
| SEQ ID NO 32943 | AAATCCAGATCCATAAATCCAA | CTG | chr3 | 120680689 | 120680710 | 120680706 | 120680711 | + |
| SEQ ID NO 32944 | GGTATCTCAGTTTGGCTGTCCC | CTG | chr3 | 120680721 | 120680742 | 120680738 | 120680743 | + |
| SEQ ID NO 32945 | AGTTTGGCTGTCCCTCCATCAA | CTC | chr3 | 120680729 | 120680750 | 120680746 | 120680751 | + |
| SEQ ID NO 32946 | GGCTGTCCCTCCATCAACTCAA | TTT | chr3 | 120680734 | 120680755 | 120680751 | 120680756 | + |
| SEQ ID NO 32947 | GCTGTCCCTCCATCAACTCAAA | TTG | chr3 | 120680735 | 120680756 | 120680752 | 120680757 | + |
| SEQ ID NO 32948 | TCCCTCCATCAACTCAAATTTG | CTG | chr3 | 120680739 | 120680760 | 120680756 | 120680761 | + |
| SEQ ID NO 32949 | CATCAACTCAAATTTGGCTGAC | CTC | chr3 | 120680745 | 120680766 | 120680762 | 120680767 | + |
| SEQ ID NO 32950 | AAATTTGGCTGACACAGTTTTG | CTC | chr3 | 120680754 | 120680775 | 120680771 | 120680776 | + |
| SEQ ID NO 32951 | GGCTGACACAGTTTTGGATTCT | TTT | chr3 | 120680760 | 120680781 | 120680777 | 120680782 | + |
| SEQ ID NO 32952 | GCTGACACAGTTTTGGATTCTA | TTG | chr3 | 120680761 | 120680782 | 120680778 | 120680783 | + |
| SEQ ID NO 32953 | ACACAGTTTTGGATTCTAGAGC | CTG | chr3 | 120680765 | 120680786 | 120680782 | 120680787 | + |
| SEQ ID NO 32954 | TGGATTCTAGAGCATGCAGGCA | TTT | chr3 | 120680774 | 120680795 | 120680791 | 120680796 | + |
| SEQ ID NO 32955 | GGATTCTAGAGCATGCAGGCAT | TTT | chr3 | 120680775 | 120680796 | 120680792 | 120680797 | + |
| SEQ ID NO 32956 | GATTCTAGAGCATGCAGGCATT | TTG | chr3 | 120680776 | 120680797 | 120680793 | 120680798 | + |
| SEQ ID NO 32957 | TAGAGCATGCAGGCATTCTGTA | TTC | chr3 | 120680781 | 120680802 | 120680798 | 120680803 | + |
| SEQ ID NO 32958 | GAGCATGCAGGCATTCTGTATG | CTA | chr3 | 120680783 | 120680804 | 120680800 | 120680805 | + |
| SEQ ID NO 32959 | TGTATGTGCTGTGCCTTTGCAC | TTC | chr3 | 120680799 | 120680820 | 120680816 | 120680821 | + |
| SEQ ID NO 32960 | TATGTGCTGTGCCTTTGCACTC | CTG | chr3 | 120680801 | 120680822 | 120680818 | 120680823 | + |
| SEQ ID NO 32961 | TGCCTTTGCACTCACTCTTCCC | CTG | chr3 | 120680810 | 120680831 | 120680827 | 120680832 | + |
| SEQ ID NO 32962 | TGCACTCACTCTTCCCTCCAGA | CTT | chr3 | 120680816 | 120680837 | 120680833 | 120680838 | + |
| SEQ ID NO 32963 | GCACTCACTCTTCCCTCCAGAC | TTT | chr3 | 120680817 | 120680838 | 120680834 | 120680839 | + |
| SEQ ID NO 32964 | CACTCACTCTTCCCTCCAGACC | TTG | chr3 | 120680818 | 120680839 | 120680835 | 120680840 | + |
| SEQ ID NO 32965 | ACTCTTCCCTCCAGACCCGTC | CTC | chr3 | 120680823 | 120680844 | 120680840 | 120680845 | + |
| SEQ ID NO 32966 | TTCCCTCCAGACCCGTCCTTC | CTC | chr3 | 120680827 | 120680848 | 120680844 | 120680849 | + |
| SEQ ID NO 32967 | CCCTCCAGACCCGTCCTTCCT | CTT | chr3 | 120680829 | 120680850 | 120680846 | 120680851 | + |
| SEQ ID NO 32968 | CCTCCAGACCCGTCCTTCCTC | TTC | chr3 | 120680830 | 120680851 | 120680847 | 120680852 | + |
| SEQ ID NO 32969 | CAGACCCGTCCTTCCTCACTT | CTC | chr3 | 120680834 | 120680855 | 120680851 | 120680856 | + |
| SEQ ID NO 32970 | CCTCACTTGCCAGTTCCAACT | CTT | chr3 | 120680848 | 120680869 | 120680865 | 120680870 | + |
| SEQ ID NO 32971 | CTCACTTGCCAGTTCCAACTT | TTC | chr3 | 120680849 | 120680870 | 120680866 | 120680871 | + |
| SEQ ID NO 32972 | ACTTTGCCAGTTCCAACTTCTC | CTC | chr3 | 120680852 | 120680873 | 120680869 | 120680874 | + |
| SEQ ID NO 32973 | TGCCAGTTCCAACTTCTCTCTG | CTT | chr3 | 120680856 | 120680877 | 120680873 | 120680878 | + |
| SEQ ID NO 32974 | GCCAGTTCCAACTTCTCTCTGA | TTT | chr3 | 120680857 | 120680878 | 120680874 | 120680879 | + |
| SEQ ID NO 32975 | CCAGTTCCAACTTCTCTCTGAA | TTG | chr3 | 120680858 | 120680879 | 120680875 | 120680880 | + |
| SEQ ID NO 32976 | CAACTTCTCTCTGAAGACTCAG | TTC | chr3 | 120680865 | 120680886 | 120680882 | 120680887 | + |
| SEQ ID NO 32977 | CTCTCTGAAGACTCAGTTTAGG | CTT | chr3 | 120680871 | 120680892 | 120680888 | 120680893 | + |
| SEQ ID NO 32978 | TCTCTGAAGACTCAGTTTAGGT | TTC | chr3 | 120680872 | 120680893 | 120680889 | 120680894 | + |
| SEQ ID NO 32979 | TCTGAAGACTCAGTTTAGGTAC | CTC | chr3 | 120680874 | 120680895 | 120680891 | 120680896 | + |
| SEQ ID NO 32980 | TGAAGACTCAGTTTAGGTACAG | CTC | chr3 | 120680876 | 120680897 | 120680893 | 120680898 | + |
| SEQ ID NO 32981 | AAGACTCAGTTTAGGTACAGGC | CTG | chr3 | 120680878 | 120680899 | 120680895 | 120680900 | + |
| SEQ ID NO 32982 | AGTTTAGGTACAGGCTCCTTTA | CTC | chr3 | 120680885 | 120680906 | 120680902 | 120680907 | + |
| SEQ ID NO 32983 | AGGTACAGGCTCCTTTAGGAAA | TTT | chr3 | 120680890 | 120680911 | 120680907 | 120680912 | + |
| SEQ ID NO 32984 | GGTACAGGCTCCTTTAGGAAAT | TTA | chr3 | 120680891 | 120680912 | 120680908 | 120680913 | + |
| SEQ ID NO 32985 | CTTTAGGAAATTTTTTTTGAC | CTC | chr3 | 120680902 | 120680923 | 120680919 | 120680924 | + |
| SEQ ID NO 32986 | TAGGAAATTTTTTTTGACTCT | CTT | chr3 | 120680905 | 120680926 | 120680922 | 120680927 | + |
| SEQ ID NO 32987 | AGGAAATTTTTTTTGACTCTA | TTT | chr3 | 120680906 | 120680927 | 120680923 | 120680928 | + |
| SEQ ID NO 32988 | GGAAATTTTTTTTGACTCTAC | TTA | chr3 | 120680907 | 120680928 | 120680924 | 120680929 | + |
| SEQ ID NO 32989 | TTTTTGACTCTACCTAGCCCA | TTT | chr3 | 120680915 | 120680936 | 120680932 | 120680937 | + |
| SEQ ID NO 32990 | TTTTTGACTCTACCTAGCCCAG | TTT | chr3 | 120680916 | 120680937 | 120680933 | 120680938 | + |
| SEQ ID NO 32991 | TTTTGACTCTACCTAGCCCAGA | TTT | chr3 | 120680917 | 120680938 | 120680934 | 120680939 | + |
| SEQ ID NO 32992 | TTTGACTCTACCTAGCCCAGAC | TTT | chr3 | 120680918 | 120680939 | 120680935 | 120680940 | + |
| SEQ ID NO 32993 | TTGACTCTACCTAGCCCAGACT | TTT | chr3 | 120680919 | 120680940 | 120680936 | 120680941 | + |
| SEQ ID NO 32994 | TGACTCTACCTAGCCCAGACTC | TTT | chr3 | 120680920 | 120680941 | 120680937 | 120680942 | + |
| SEQ ID NO 32995 | GACTCTACCTAGCCCAGACTCA | TTT | chr3 | 120680921 | 120680942 | 120680938 | 120680943 | + |
| SEQ ID NO 32996 | ACTCTACCTAGCCCAGACTCAG | TTG | chr3 | 120680922 | 120680943 | 120680939 | 120680944 | + |

Figure 54 (Cont'd)

| | | | | | | | | |
|---|---|---|---|---|---|---|---|---|
| SEQ ID NO 32997 | TACCTAGCCCAGACTCAGTTCA | CTC | chr3 | 120680926 | 120680947 | 120680943 | 120680948 | + |
| SEQ ID NO 32998 | CCTAGCCCAGACTCAGTTCATC | CTA | chr3 | 120680928 | 120680949 | 120680945 | 120680950 | + |
| SEQ ID NO 32999 | GCCCAGACTCAGTTCATCTACG | CTA | chr3 | 120680932 | 120680953 | 120680949 | 120680954 | + |
| SEQ ID NO 33000 | AGTTCATCTACGATATTAATCT | CTC | chr3 | 120680942 | 120680963 | 120680959 | 120680964 | + |
| SEQ ID NO 33001 | ATCTACGATATTAATCTGCAGT | TTC | chr3 | 120680947 | 120680968 | 120680964 | 120680969 | + |
| SEQ ID NO 33002 | CGATATTAATCTGCAGTGTCAT | CTA | chr3 | 120680952 | 120680973 | 120680969 | 120680974 | + |
| SEQ ID NO 33003 | ATCTGCAGTGTCATGCACTAGC | TTA | chr3 | 120680960 | 120680981 | 120680977 | 120680982 | + |
| SEQ ID NO 33004 | CAGTGTCATGCACTAGCACAAA | CTG | chr3 | 120680965 | 120680986 | 120680982 | 120680987 | + |
| SEQ ID NO 33005 | GCACAAAATATTTGCTGAATGA | CTA | chr3 | 120680980 | 120681001 | 120680997 | 120681002 | + |
| SEQ ID NO 33006 | GCTGAATGAAAGAATGAGAGTT | TTT | chr3 | 120680993 | 120681014 | 120681010 | 120681015 | + |
| SEQ ID NO 33007 | CTGAATGAAAGAATGAGAGTTA | TTG | chr3 | 120680994 | 120681015 | 120681011 | 120681016 | + |
| SEQ ID NO 33008 | AATGAAAGAATGAGAGTTAACT | CTG | chr3 | 120680997 | 120681018 | 120681014 | 120681019 | + |
| SEQ ID NO 33009 | ACTTTTAGTCAGGCATAAAGAT | TTA | chr3 | 120681016 | 120681037 | 120681033 | 120681038 | + |
| SEQ ID NO 33010 | TTAGTCAGGCATAAAGATAAAA | CTT | chr3 | 120681020 | 120681041 | 120681037 | 120681042 | + |
| SEQ ID NO 33011 | TAGTCAGGCATAAAGATAAAAA | TTT | chr3 | 120681021 | 120681042 | 120681038 | 120681043 | + |
| SEQ ID NO 33012 | AGTCAGGCATAAAGATAAAAAA | TTT | chr3 | 120681022 | 120681043 | 120681039 | 120681044 | + |
| SEQ ID NO 33013 | GTCAGGCATAAAGATAAAAAAC | TTA | chr3 | 120681023 | 120681044 | 120681040 | 120681045 | + |
| SEQ ID NO 33014 | TTACTCCGGTGTGGAGTGTTTT | CTT | chr3 | 120681054 | 120681075 | 120681071 | 120681076 | + |
| SEQ ID NO 33015 | TACTCCGGTGTGGAGTGTTTTC | TTT | chr3 | 120681055 | 120681076 | 120681072 | 120681077 | + |
| SEQ ID NO 33016 | ACTCCGGTGTGGAGTGTTTTCA | TTT | chr3 | 120681056 | 120681077 | 120681073 | 120681078 | + |
| SEQ ID NO 33017 | CTCCGGTGTGGAGTGTTTTCAG | TTA | chr3 | 120681057 | 120681078 | 120681074 | 120681079 | + |
| SEQ ID NO 33018 | CGGTGTGGAGTGTTTTCAGGAT | CTC | chr3 | 120681060 | 120681081 | 120681077 | 120681082 | + |
| SEQ ID NO 33019 | TCAGGATTCCTACCAATTAGGA | TTT | chr3 | 120681075 | 120681096 | 120681092 | 120681097 | + |
| SEQ ID NO 33020 | CAGGATTCCTACCAATTAGGAA | TTT | chr3 | 120681076 | 120681097 | 120681093 | 120681098 | + |
| SEQ ID NO 33021 | AGGATTCCTACCAATTAGGAAG | TTC | chr3 | 120681077 | 120681098 | 120681094 | 120681099 | + |
| SEQ ID NO 33022 | CTACCAATTAGGAAGGTGTTTG | TTC | chr3 | 120681084 | 120681105 | 120681101 | 120681106 | + |
| SEQ ID NO 33023 | CCAATTAGGAAGGTGTTTGATT | CTA | chr3 | 120681087 | 120681108 | 120681104 | 120681109 | + |
| SEQ ID NO 33024 | GGAAGGTGTTTGATTCTTCAAA | TTA | chr3 | 120681094 | 120681115 | 120681111 | 120681116 | + |
| SEQ ID NO 33025 | GATTCTTCAAACTCAGAAACAC | TTT | chr3 | 120681105 | 120681126 | 120681122 | 120681127 | + |
| SEQ ID NO 33026 | ATTCTTCAAACTCAGAAACACC | TTG | chr3 | 120681106 | 120681127 | 120681123 | 120681128 | + |
| SEQ ID NO 33027 | TTCAAACTCAGAAACACCTCCC | TTC | chr3 | 120681110 | 120681131 | 120681127 | 120681132 | + |
| SEQ ID NO 33028 | CAAACTCAGAAACACCTCCCCT | CTT | chr3 | 120681112 | 120681133 | 120681129 | 120681134 | + |
| SEQ ID NO 33029 | AAACTCAGAAACACCTCCCCTT | TTC | chr3 | 120681113 | 120681134 | 120681130 | 120681135 | + |
| SEQ ID NO 33030 | AGAAACACCTCCCCTTAACTGA | CTC | chr3 | 120681119 | 120681140 | 120681136 | 120681141 | + |
| SEQ ID NO 33031 | CCCTTAACTGATGGATTCTTCA | CTC | chr3 | 120681130 | 120681151 | 120681147 | 120681152 | + |
| SEQ ID NO 33032 | AACTGATGGATTCTTCAAACTC | CTT | chr3 | 120681135 | 120681156 | 120681152 | 120681157 | + |
| SEQ ID NO 33033 | ACTGATGGATTCTTCAAACTCA | TTA | chr3 | 120681136 | 120681157 | 120681153 | 120681158 | + |
| SEQ ID NO 33034 | ATGGATTCTTCAAACTCAGCAT | CTG | chr3 | 120681140 | 120681161 | 120681157 | 120681162 | + |
| SEQ ID NO 33035 | TTCAAACTCAGCATCAGTTAGA | TTC | chr3 | 120681148 | 120681169 | 120681165 | 120681170 | + |
| SEQ ID NO 33036 | CAAACTCAGCATCAGTTAGAGG | CTT | chr3 | 120681150 | 120681171 | 120681167 | 120681172 | + |
| SEQ ID NO 33037 | AAACTCAGCATCAGTTAGAGGG | TTC | chr3 | 120681151 | 120681172 | 120681168 | 120681173 | + |
| SEQ ID NO 33038 | AGCATCAGTTAGAGGGCATTAG | CTC | chr3 | 120681157 | 120681178 | 120681174 | 120681179 | + |
| SEQ ID NO 33039 | GAGGGCATTAGGGCACTTCTCA | TTA | chr3 | 120681168 | 120681189 | 120681185 | 120681190 | + |
| SEQ ID NO 33040 | GGGCACTTCTCAAACCCTGCAT | TTA | chr3 | 120681178 | 120681199 | 120681195 | 120681200 | + |
| SEQ ID NO 33041 | CTCAAACCCTGCATTCAGGGAA | CTT | chr3 | 120681186 | 120681207 | 120681203 | 120681208 | + |
| SEQ ID NO 33042 | TCAAACCCTGCATTCAGGGAAG | TTC | chr3 | 120681187 | 120681208 | 120681204 | 120681209 | + |
| SEQ ID NO 33043 | AAACCCTGCATTCAGGGAAGAT | CTC | chr3 | 120681189 | 120681210 | 120681206 | 120681211 | + |
| SEQ ID NO 33044 | CATTCAGGGAAGATGTCTGTTG | CTG | chr3 | 120681197 | 120681218 | 120681214 | 120681219 | + |
| SEQ ID NO 33045 | AGGGAAGATGTCTGTTGTGGGG | TTC | chr3 | 120681202 | 120681223 | 120681219 | 120681224 | + |
| SEQ ID NO 33046 | TTGTGGGGTGGTCTGGCCTACT | CTG | chr3 | 120681216 | 120681237 | 120681233 | 120681238 | + |
| SEQ ID NO 33047 | TGGGGTGGTCTGGCCTACTTGG | TTG | chr3 | 120681219 | 120681240 | 120681236 | 120681241 | + |
| SEQ ID NO 33048 | GCCTACTTGGCCTGAGCCAAGG | CTG | chr3 | 120681231 | 120681252 | 120681248 | 120681253 | + |
| SEQ ID NO 33049 | CTTGGCCTGAGCCAAGGTTCTG | CTA | chr3 | 120681236 | 120681257 | 120681253 | 120681258 | + |
| SEQ ID NO 33050 | GGCCTGAGCCAAGGTTCTGGGC | CTT | chr3 | 120681239 | 120681260 | 120681256 | 120681261 | + |
| SEQ ID NO 33051 | GCCTGAGCCAAGGTTCTGGGCA | TTG | chr3 | 120681240 | 120681261 | 120681257 | 120681262 | + |
| SEQ ID NO 33052 | AGCCAAGGTTCTGGGCAGTTCT | CTG | chr3 | 120681245 | 120681266 | 120681262 | 120681267 | + |
| SEQ ID NO 33053 | TGGGCAGTTCTGTTCAGTTACA | TTC | chr3 | 120681256 | 120681277 | 120681273 | 120681278 | + |
| SEQ ID NO 33054 | GGCAGTTCTGTTCAGTTACACA | CTG | chr3 | 120681258 | 120681279 | 120681275 | 120681280 | + |
| SEQ ID NO 33055 | TGTTCAGTTACACATGCATGCG | TTC | chr3 | 120681266 | 120681287 | 120681283 | 120681288 | + |

Figure 54 (Cont'd)

| | | | | | | | | |
|---|---|---|---|---|---|---|---|---|
| SEQ ID NO 33056 | TTCAGTTACACATGCATGCGTT | CTG | chr3 | 120681268 | 120681289 | 120681285 | 120681290 | + |
| SEQ ID NO 33057 | AGTTACACATGCATGCGTTGAG | TTC | chr3 | 120681271 | 120681292 | 120681288 | 120681293 | + |
| SEQ ID NO 33058 | CACATGCATGCGTTGAGCATTG | TTA | chr3 | 120681276 | 120681297 | 120681293 | 120681298 | + |
| SEQ ID NO 33059 | AGCATTGATTCAAGCCTGGCCT | TTG | chr3 | 120681291 | 120681312 | 120681308 | 120681313 | + |
| SEQ ID NO 33060 | ATTCAAGCCTGGCCTGGGCACT | TTG | chr3 | 120681298 | 120681319 | 120681315 | 120681320 | + |
| SEQ ID NO 33061 | AAGCCTGGCCTGGGCACTAGGC | TTC | chr3 | 120681302 | 120681323 | 120681319 | 120681324 | + |
| SEQ ID NO 33062 | GCCTGGGCACTAGGCATGGTTT | CTG | chr3 | 120681309 | 120681330 | 120681326 | 120681331 | + |
| SEQ ID NO 33063 | GGCACTAGGCATGGTTTTAGAT | CTG | chr3 | 120681314 | 120681335 | 120681331 | 120681336 | + |
| SEQ ID NO 33064 | GGCATGGTTTTAGATATTAGGG | CTA | chr3 | 120681321 | 120681342 | 120681338 | 120681343 | + |
| SEQ ID NO 33065 | TAGATATTAGGGACATATTCTG | TTT | chr3 | 120681331 | 120681352 | 120681348 | 120681353 | + |
| SEQ ID NO 33066 | AGATATTAGGGACATATTCTGT | TTT | chr3 | 120681332 | 120681353 | 120681349 | 120681354 | + |
| SEQ ID NO 33067 | GATATTAGGGACATATTCTGTT | TTA | chr3 | 120681333 | 120681354 | 120681350 | 120681355 | + |
| SEQ ID NO 33068 | GGGACATATTCTGTTTTCCTTG | TTA | chr3 | 120681340 | 120681361 | 120681357 | 120681362 | + |
| SEQ ID NO 33069 | TGTTTTCCTTGCCTTAAGATAC | TTC | chr3 | 120681351 | 120681372 | 120681368 | 120681373 | + |
| SEQ ID NO 33070 | TTTTCCTTGCCTTAAGATACCA | CTG | chr3 | 120681353 | 120681374 | 120681370 | 120681375 | + |
| SEQ ID NO 33071 | TCCTTGCCTTAAGATACCAGTC | TTT | chr3 | 120681356 | 120681377 | 120681373 | 120681378 | + |
| SEQ ID NO 33072 | CCTTGCCTTAAGATACCAGTCT | TTT | chr3 | 120681357 | 120681378 | 120681374 | 120681379 | + |
| SEQ ID NO 33073 | CTTGCCTTAAGATACCAGTCTA | TTC | chr3 | 120681358 | 120681379 | 120681375 | 120681380 | + |
| SEQ ID NO 33074 | GCCTTAAGATACCAGTCTAGTA | CTT | chr3 | 120681361 | 120681382 | 120681378 | 120681383 | + |
| SEQ ID NO 33075 | CCTTAAGATACCAGTCTAGTAG | TTG | chr3 | 120681362 | 120681383 | 120681379 | 120681384 | + |
| SEQ ID NO 33076 | AAGATACCAGTCTAGTAGGAGC | CTT | chr3 | 120681366 | 120681387 | 120681383 | 120681388 | + |
| SEQ ID NO 33077 | AGATACCAGTCTAGTAGGAGCC | TTA | chr3 | 120681367 | 120681388 | 120681384 | 120681389 | + |
| SEQ ID NO 33078 | GTAGGAGCCACTAAGGCCCCTT | CTA | chr3 | 120681380 | 120681401 | 120681397 | 120681402 | + |
| SEQ ID NO 33079 | AGGCCCCTTTTTGAGCCTGGAC | CTA | chr3 | 120681393 | 120681414 | 120681410 | 120681415 | + |
| SEQ ID NO 33080 | TTTGAGCCTGGACTTCGCATTC | CTT | chr3 | 120681402 | 120681423 | 120681419 | 120681424 | + |
| SEQ ID NO 33081 | TTGAGCCTGGACTTCGCATTCA | TTT | chr3 | 120681403 | 120681424 | 120681420 | 120681425 | + |
| SEQ ID NO 33082 | TGAGCCTGGACTTCGCATTCAA | TTT | chr3 | 120681404 | 120681425 | 120681421 | 120681426 | + |
| SEQ ID NO 33083 | GAGCCTGGACTTCGCATTCAAA | TTT | chr3 | 120681405 | 120681426 | 120681422 | 120681427 | + |
| SEQ ID NO 33084 | AGCCTGGACTTCGCATTCAAAC | TTG | chr3 | 120681406 | 120681427 | 120681423 | 120681428 | + |
| SEQ ID NO 33085 | GACTTCGCATTCAAACATACCC | CTG | chr3 | 120681412 | 120681433 | 120681429 | 120681434 | + |
| SEQ ID NO 33086 | CGCATTCAAACATACCCTGCTT | CTT | chr3 | 120681417 | 120681438 | 120681434 | 120681439 | + |
| SEQ ID NO 33087 | GCATTCAAACATACCCTGCTTC | TTC | chr3 | 120681418 | 120681439 | 120681435 | 120681440 | + |
| SEQ ID NO 33088 | AAACATACCCTGCTTCTAATCA | TTC | chr3 | 120681424 | 120681445 | 120681441 | 120681446 | + |
| SEQ ID NO 33089 | CTTCTAATCAAGTCATCTATTG | CTG | chr3 | 120681436 | 120681457 | 120681453 | 120681458 | + |
| SEQ ID NO 33090 | CTAATCAAGTCATCTATTGGCA | CTT | chr3 | 120681439 | 120681460 | 120681456 | 120681461 | + |
| SEQ ID NO 33091 | TAATCAAGTCATCTATTGGCAG | TTC | chr3 | 120681440 | 120681461 | 120681457 | 120681462 | + |
| SEQ ID NO 33092 | ATCAAGTCATCTATTGGCAGTG | CTA | chr3 | 120681442 | 120681463 | 120681459 | 120681464 | + |
| SEQ ID NO 33093 | TTGGCAGTGACCTTGGGCAAAT | CTA | chr3 | 120681455 | 120681476 | 120681472 | 120681477 | + |
| SEQ ID NO 33094 | GCAGTGACCTTGGGCAAATCAT | TTG | chr3 | 120681458 | 120681479 | 120681475 | 120681480 | + |
| SEQ ID NO 33095 | GGGCAAATCATAGTCTCTCCAA | CTT | chr3 | 120681469 | 120681490 | 120681486 | 120681491 | + |
| SEQ ID NO 33096 | GGCAAATCATAGTCTCTCCAAG | TTG | chr3 | 120681470 | 120681491 | 120681487 | 120681492 | + |
| SEQ ID NO 33097 | TCCAAGCATTACTTTTCTAATT | CTC | chr3 | 120681486 | 120681507 | 120681503 | 120681508 | + |
| SEQ ID NO 33098 | CAAGCATTACTTTTCTAATTGA | CTC | chr3 | 120681488 | 120681509 | 120681505 | 120681510 | + |
| SEQ ID NO 33099 | CTTTTCTAATTGAAACAAGAAC | TTA | chr3 | 120681497 | 120681518 | 120681514 | 120681519 | + |
| SEQ ID NO 33100 | TTCTAATTGAAACAAGAACCTC | CTT | chr3 | 120681500 | 120681521 | 120681517 | 120681522 | + |
| SEQ ID NO 33101 | TCTAATTGAAACAAGAACCTCT | TTT | chr3 | 120681501 | 120681522 | 120681518 | 120681523 | + |
| SEQ ID NO 33102 | CTAATTGAAACAAGAACCTCTC | TTT | chr3 | 120681502 | 120681523 | 120681519 | 120681524 | + |
| SEQ ID NO 33103 | TAATTGAAACAAGAACCTCTCT | TTC | chr3 | 120681503 | 120681524 | 120681520 | 120681525 | + |
| SEQ ID NO 33104 | ATTGAAACAAGAACCTCTCTCT | CTA | chr3 | 120681505 | 120681526 | 120681522 | 120681527 | + |
| SEQ ID NO 33105 | AAACAAGAACCTCTCTCTATAC | TTG | chr3 | 120681509 | 120681530 | 120681526 | 120681531 | + |
| SEQ ID NO 33106 | TCTCTATACCCCAGATTTATTT | CTC | chr3 | 120681522 | 120681543 | 120681539 | 120681544 | + |
| SEQ ID NO 33107 | TCTATACCCCAGATTTATTTTG | CTC | chr3 | 120681524 | 120681545 | 120681541 | 120681546 | + |
| SEQ ID NO 33108 | TATACCCCAGATTTATTTTGAG | CTC | chr3 | 120681526 | 120681547 | 120681543 | 120681548 | + |
| SEQ ID NO 33109 | TACCCCAGATTTATTTTGAGGA | CTA | chr3 | 120681528 | 120681549 | 120681545 | 120681550 | + |
| SEQ ID NO 33110 | ATTTTGAGGATTATGAGTTAAT | TTT | chr3 | 120681540 | 120681561 | 120681557 | 120681562 | + |
| SEQ ID NO 33111 | TTTTGAGGATTATGAGTTAATT | TTA | chr3 | 120681541 | 120681562 | 120681558 | 120681563 | + |
| SEQ ID NO 33112 | TGAGGATTATGAGTTAATTCAT | TTT | chr3 | 120681544 | 120681565 | 120681561 | 120681566 | + |
| SEQ ID NO 33113 | GAGGATTATGAGTTAATTCATA | TTT | chr3 | 120681545 | 120681566 | 120681562 | 120681567 | + |
| SEQ ID NO 33114 | AGGATTATGAGTTAATTCATAG | TTG | chr3 | 120681546 | 120681567 | 120681563 | 120681568 | + |

Figure 54 (Cont'd)

| | | | | | | | | |
|---|---|---|---|---|---|---|---|---|
| SEQ ID NO 33115 | TGAGTTAATTCATAGCTAAAAT | TTA | chr3 | 120681553 | 120681574 | 120681570 | 120681575 | + |
| SEQ ID NO 33116 | ATTCATAGCTAAAATGCTTAGC | TTA | chr3 | 120681560 | 120681581 | 120681577 | 120681582 | + |
| SEQ ID NO 33117 | ATAGCTAAAATGCTTAGCACCT | TTC | chr3 | 120681564 | 120681585 | 120681581 | 120681586 | + |
| SEQ ID NO 33118 | AAATGCTTAGCACCTAACAGCA | CTA | chr3 | 120681571 | 120681592 | 120681588 | 120681593 | + |
| SEQ ID NO 33119 | AGCACCTAACAGCACATAACCC | CTT | chr3 | 120681579 | 120681600 | 120681596 | 120681601 | + |
| SEQ ID NO 33120 | GCACCTAACAGCACATAACCCA | TTA | chr3 | 120681580 | 120681601 | 120681597 | 120681602 | + |
| SEQ ID NO 33121 | ACAGCACATAACCCACACATAC | CTA | chr3 | 120681587 | 120681608 | 120681604 | 120681609 | + |
| SEQ ID NO 33122 | TTCAATTGCGTATTACTAAAAA | CTT | chr3 | 120681611 | 120681632 | 120681628 | 120681633 | + |
| SEQ ID NO 33123 | TCAATTGCGTATTACTAAAAAG | TTT | chr3 | 120681612 | 120681633 | 120681629 | 120681634 | + |
| SEQ ID NO 33124 | CAATTGCGTATTACTAAAAAGA | TTT | chr3 | 120681613 | 120681634 | 120681630 | 120681635 | + |
| SEQ ID NO 33125 | AATTGCGTATTACTAAAAAGAA | TTC | chr3 | 120681614 | 120681635 | 120681631 | 120681636 | + |
| SEQ ID NO 33126 | CGTATTACTAAAAAGAAGGAAT | TTG | chr3 | 120681619 | 120681640 | 120681636 | 120681641 | + |
| SEQ ID NO 33127 | CTAAAAAGAAGGAATGATTTCC | TTA | chr3 | 120681626 | 120681647 | 120681643 | 120681648 | + |
| SEQ ID NO 33128 | AAAAGAAGGAATGATTTCCTAG | CTA | chr3 | 120681629 | 120681650 | 120681646 | 120681651 | + |
| SEQ ID NO 33129 | CCTAGAGGAGGTGCTTCTTCTG | TTT | chr3 | 120681646 | 120681667 | 120681663 | 120681668 | + |
| SEQ ID NO 33130 | CTAGAGGAGGTGCTTCTTCTGG | TTC | chr3 | 120681647 | 120681668 | 120681664 | 120681669 | + |
| SEQ ID NO 33131 | GAGGAGGTGCTTCTTCTGGCCA | CTA | chr3 | 120681650 | 120681671 | 120681667 | 120681672 | + |
| SEQ ID NO 33132 | CTTCTGGCCAAGGGCTGATTCA | CTT | chr3 | 120681662 | 120681683 | 120681679 | 120681684 | + |
| SEQ ID NO 33133 | TTCTGGCCAAGGGCTGATTCAG | TTC | chr3 | 120681663 | 120681684 | 120681680 | 120681685 | + |
| SEQ ID NO 33134 | CTGGCCAAGGGCTGATTCAGAG | CTT | chr3 | 120681665 | 120681686 | 120681682 | 120681687 | + |
| SEQ ID NO 33135 | TGGCCAAGGGCTGATTCAGAGC | TTC | chr3 | 120681666 | 120681687 | 120681683 | 120681688 | + |
| SEQ ID NO 33136 | GCCAAGGGCTGATTCAGAGCCT | CTG | chr3 | 120681668 | 120681689 | 120681685 | 120681690 | + |
| SEQ ID NO 33137 | ATTCAGAGCCTTAATTAACTAA | CTG | chr3 | 120681679 | 120681700 | 120681696 | 120681701 | + |
| SEQ ID NO 33138 | AGAGCCTTAATTAACTAAATAG | TTC | chr3 | 120681683 | 120681704 | 120681700 | 120681705 | + |
| SEQ ID NO 33139 | AATTAACTAAATAGATCAAGCA | CTT | chr3 | 120681691 | 120681712 | 120681708 | 120681713 | + |
| SEQ ID NO 33140 | ATTAACTAAATAGATCAAGCAT | TTA | chr3 | 120681692 | 120681713 | 120681709 | 120681714 | + |
| SEQ ID NO 33141 | ACTAAATAGATCAAGCATATCT | TTA | chr3 | 120681696 | 120681717 | 120681713 | 120681718 | + |
| SEQ ID NO 33142 | AATAGATCAAGCATATCTAACT | CTA | chr3 | 120681700 | 120681721 | 120681717 | 120681722 | + |
| SEQ ID NO 33143 | ACTGGTCACCGGAAGTGGTCCA | CTA | chr3 | 120681719 | 120681740 | 120681736 | 120681741 | + |
| SEQ ID NO 33144 | GTCACCGGAAGTGGTCCATGAG | CTG | chr3 | 120681723 | 120681744 | 120681740 | 120681745 | + |
| SEQ ID NO 33145 | CAGCAATGGGAAGGTGTCAGAG | CTG | chr3 | 120681749 | 120681770 | 120681766 | 120681771 | + |
| SEQ ID NO 33146 | GGAAAAGACATAGAGAGAAAC | TTG | chr3 | 120681780 | 120681801 | 120681797 | 120681802 | + |
| SEQ ID NO 33147 | TTAGGATGTCTACAGATTTCCA | CTC | chr3 | 120681829 | 120681850 | 120681846 | 120681851 | + |
| SEQ ID NO 33148 | AGGATGTCTACAGATTTCCAAG | CTT | chr3 | 120681831 | 120681852 | 120681848 | 120681853 | + |
| SEQ ID NO 33149 | GGATGTCTACAGATTTCCAAGA | TTA | chr3 | 120681832 | 120681853 | 120681849 | 120681854 | + |
| SEQ ID NO 33150 | CAGATTTCCAAGACAATAATTG | CTA | chr3 | 120681841 | 120681862 | 120681858 | 120681863 | + |
| SEQ ID NO 33151 | CCAAGACAATAATTGAAATGAA | TTT | chr3 | 120681848 | 120681869 | 120681865 | 120681870 | + |
| SEQ ID NO 33152 | CAAGACAATAATTGAAATGAAC | TTC | chr3 | 120681849 | 120681870 | 120681866 | 120681871 | + |
| SEQ ID NO 33153 | AAATGAACAAAGGCAAGGGATG | TTG | chr3 | 120681863 | 120681884 | 120681880 | 120681885 | + |
| SEQ ID NO 33154 | CATTTCTTTCCTTTATCACCTT | CTT | chr3 | 120681899 | 120681920 | 120681916 | 120681921 | + |
| SEQ ID NO 33155 | ATTTCTTTCCTTTATCACCTTT | TTC | chr3 | 120681900 | 120681921 | 120681917 | 120681922 | + |
| SEQ ID NO 33156 | CTTTCCTTTATCACCTTTCCCT | TTT | chr3 | 120681904 | 120681925 | 120681921 | 120681926 | + |
| SEQ ID NO 33157 | TTTCCTTTATCACCTTTCCCTT | TTC | chr3 | 120681905 | 120681926 | 120681922 | 120681927 | + |
| SEQ ID NO 33158 | TCCTTTATCACCTTTCCCTTGT | CTT | chr3 | 120681907 | 120681928 | 120681924 | 120681929 | + |
| SEQ ID NO 33159 | CCTTTATCACCTTTCCCTTGTT | TTT | chr3 | 120681908 | 120681929 | 120681925 | 120681930 | + |
| SEQ ID NO 33160 | CTTTATCACCTTTCCCTTGTTC | TTC | chr3 | 120681909 | 120681930 | 120681926 | 120681931 | + |
| SEQ ID NO 33161 | TATCACCTTTCCCTTGTTCTTC | CTT | chr3 | 120681912 | 120681933 | 120681929 | 120681934 | + |
| SEQ ID NO 33162 | ATCACCTTTCCCTTGTTCTTCA | TTT | chr3 | 120681913 | 120681934 | 120681930 | 120681935 | + |
| SEQ ID NO 33163 | TCACCTTTCCCTTGTTCTTCAG | TTA | chr3 | 120681914 | 120681935 | 120681931 | 120681936 | + |
| SEQ ID NO 33164 | TCCCTTGTTCTTCAGCTCCAGC | CTT | chr3 | 120681921 | 120681942 | 120681938 | 120681943 | + |
| SEQ ID NO 33165 | CCCTTGTTCTTCAGCTCCAGCT | TTT | chr3 | 120681922 | 120681943 | 120681939 | 120681944 | + |
| SEQ ID NO 33166 | CCTTGTTCTTCAGCTCCAGCTG | TTC | chr3 | 120681923 | 120681944 | 120681940 | 120681945 | + |
| SEQ ID NO 33167 | GTTCTTCAGCTCCAGCTGTGCC | CTT | chr3 | 120681927 | 120681948 | 120681944 | 120681949 | + |
| SEQ ID NO 33168 | TTCTTCAGCTCCAGCTGTGCCC | TTG | chr3 | 120681928 | 120681949 | 120681945 | 120681950 | + |
| SEQ ID NO 33169 | TTCAGCTCCAGCTGTGCCCACA | TTC | chr3 | 120681931 | 120681952 | 120681948 | 120681953 | + |
| SEQ ID NO 33170 | CAGCTCCAGCTGTGCCCACAGA | CTT | chr3 | 120681933 | 120681954 | 120681950 | 120681955 | + |
| SEQ ID NO 33171 | AGCTCCAGCTGTGCCCACAGAC | TTC | chr3 | 120681934 | 120681955 | 120681951 | 120681956 | + |
| SEQ ID NO 33172 | CAGCTGTGCCCACAGACACCAC | CTC | chr3 | 120681939 | 120681960 | 120681956 | 120681961 | + |
| SEQ ID NO 33173 | TGCCCACAGACACCACAGGGAA | CTG | chr3 | 120681945 | 120681966 | 120681962 | 120681967 | + |

Figure 54 (Cont'd)

| | | | | | | | | |
|---|---|---|---|---|---|---|---|---|
| SEQ ID NO 33174 | TGAACACAGGGGTTTGAACCAG | CTC | chr3 | 120681972 | 120681993 | 120681989 | 120681994 | + |
| SEQ ID NO 33175 | AACACAGGGGTTTGAACCAGGG | CTG | chr3 | 120681974 | 120681995 | 120681991 | 120681996 | + |
| SEQ ID NO 33176 | GAACCAGGGCCTCTCTAAGTCT | TTT | chr3 | 120681987 | 120682008 | 120682004 | 120682009 | + |
| SEQ ID NO 33177 | AACCAGGGCCTCTCTAAGTCTT | TTG | chr3 | 120681988 | 120682009 | 120682005 | 120682010 | + |
| SEQ ID NO 33178 | TCTAAGTCTTTTCCAACTCTGA | CTC | chr3 | 120682000 | 120682021 | 120682017 | 120682022 | + |
| SEQ ID NO 33179 | TAAGTCTTTTCCAACTCTGATA | CTC | chr3 | 120682002 | 120682023 | 120682019 | 120682024 | + |
| SEQ ID NO 33180 | AGTCTTTTCCAACTCTGATACC | CTA | chr3 | 120682004 | 120682025 | 120682021 | 120682026 | + |
| SEQ ID NO 33181 | TTCCAACTCTGATACCCTGAAG | CTT | chr3 | 120682010 | 120682031 | 120682027 | 120682032 | + |
| SEQ ID NO 33182 | TCCAACTCTGATACCCTGAAGT | TTT | chr3 | 120682011 | 120682032 | 120682028 | 120682033 | + |
| SEQ ID NO 33183 | CCAACTCTGATACCCTGAAGTT | TTT | chr3 | 120682012 | 120682033 | 120682029 | 120682034 | + |
| SEQ ID NO 33184 | CAACTCTGATACCCTGAAGTTC | TTC | chr3 | 120682013 | 120682034 | 120682030 | 120682035 | + |
| SEQ ID NO 33185 | TGATACCCTGAAGTTCTCAGAA | CTC | chr3 | 120682019 | 120682040 | 120682036 | 120682041 | + |
| SEQ ID NO 33186 | ATACCCTGAAGTTCTCAGAAAC | CTG | chr3 | 120682021 | 120682042 | 120682038 | 120682043 | + |
| SEQ ID NO 33187 | AAGTTCTCAGAAACTTCCATAA | CTG | chr3 | 120682029 | 120682050 | 120682046 | 120682051 | + |
| SEQ ID NO 33188 | TCAGAAACTTCCATAAATTTTG | TTC | chr3 | 120682035 | 120682056 | 120682052 | 120682057 | + |
| SEQ ID NO 33189 | AGAAACTTCCATAAATTTTGGC | CTC | chr3 | 120682037 | 120682058 | 120682054 | 120682059 | + |
| SEQ ID NO 33190 | CCATAAATTTTGGCTGAAGAAG | CTT | chr3 | 120682045 | 120682066 | 120682062 | 120682067 | + |
| SEQ ID NO 33191 | CATAAATTTTGGCTGAAGAAGC | TTC | chr3 | 120682046 | 120682067 | 120682063 | 120682068 | + |
| SEQ ID NO 33192 | TGGCTGAAGAAGCCATAGCAAA | TTT | chr3 | 120682055 | 120682076 | 120682072 | 120682077 | + |
| SEQ ID NO 33193 | GGCTGAAGAAGCCATAGCAAAC | TTT | chr3 | 120682056 | 120682077 | 120682073 | 120682078 | + |
| SEQ ID NO 33194 | GCTGAAGAAGCCATAGCAAACT | TTG | chr3 | 120682057 | 120682078 | 120682074 | 120682079 | + |
| SEQ ID NO 33195 | AAGAAGCCATAGCAAACTTGTC | CTG | chr3 | 120682061 | 120682082 | 120682078 | 120682083 | + |
| SEQ ID NO 33196 | GTCAGATGGTTTCTTACCTTTA | CTT | chr3 | 120682080 | 120682101 | 120682097 | 120682102 | + |
| SEQ ID NO 33197 | TCAGATGGTTTCTTACCTTTAA | TTG | chr3 | 120682081 | 120682102 | 120682098 | 120682103 | + |
| SEQ ID NO 33198 | CTTACCTTTAACTCAGCCATTT | TTT | chr3 | 120682092 | 120682113 | 120682109 | 120682114 | + |
| SEQ ID NO 33199 | TTACCTTTAACTCAGCCATTTT | TTC | chr3 | 120682093 | 120682114 | 120682110 | 120682115 | + |
| SEQ ID NO 33200 | ACCTTTAACTCAGCCATTTTCT | CTT | chr3 | 120682095 | 120682116 | 120682112 | 120682117 | + |
| SEQ ID NO 33201 | CCTTTAACTCAGCCATTTTCTC | TTA | chr3 | 120682096 | 120682117 | 120682113 | 120682118 | + |
| SEQ ID NO 33202 | TAACTCAGCCATTTTCTCTCTC | CTT | chr3 | 120682100 | 120682121 | 120682117 | 120682122 | + |
| SEQ ID NO 33203 | AACTCAGCCATTTTCTCTCTCC | TTT | chr3 | 120682101 | 120682122 | 120682118 | 120682123 | + |
| SEQ ID NO 33204 | ACTCAGCCATTTTCTCTCTCCT | TTA | chr3 | 120682102 | 120682123 | 120682119 | 120682124 | + |
| SEQ ID NO 33205 | AGCCATTTTCTCTCTCCTCTAT | CTC | chr3 | 120682106 | 120682127 | 120682123 | 120682128 | + |
| SEQ ID NO 33206 | TCTCTCCTCTATGTGTGGTG | TTT | chr3 | 120682114 | 120682135 | 120682131 | 120682136 | + |
| SEQ ID NO 33207 | CTCTCCTCTATGTGTGGTGA | TTT | chr3 | 120682115 | 120682136 | 120682132 | 120682137 | + |
| SEQ ID NO 33208 | TCTCCTCTATGTGTGGTGAC | TTC | chr3 | 120682116 | 120682137 | 120682133 | 120682138 | + |
| SEQ ID NO 33209 | TCTCCTCTATGTGTGGTGACTT | CTC | chr3 | 120682118 | 120682139 | 120682135 | 120682140 | + |
| SEQ ID NO 33210 | TCCTCTATGTGTGGTGACTTCA | CTC | chr3 | 120682120 | 120682141 | 120682137 | 120682142 | + |
| SEQ ID NO 33211 | CTCTATGTGTGGTGACTTCAGG | CTC | chr3 | 120682122 | 120682143 | 120682139 | 120682144 | + |
| SEQ ID NO 33212 | TATGTGTGGTGACTTCAGGAAA | CTC | chr3 | 120682125 | 120682146 | 120682142 | 120682147 | + |
| SEQ ID NO 33213 | TGTGTGGTGACTTCAGGAAACC | CTA | chr3 | 120682127 | 120682148 | 120682144 | 120682149 | + |
| SEQ ID NO 33214 | CAGGAAACCCAGGCCCAGAGGA | CTT | chr3 | 120682140 | 120682161 | 120682157 | 120682162 | + |
| SEQ ID NO 33215 | AGGAAACCCAGGCCCAGAGGAT | TTC | chr3 | 120682141 | 120682162 | 120682158 | 120682163 | + |
| SEQ ID NO 33216 | CTTTCTCCTTCAAACCACTCTT | CTT | chr3 | 120682180 | 120682201 | 120682197 | 120682202 | + |
| SEQ ID NO 33217 | TTTCTCCTTCAAACCACTCTTT | TTC | chr3 | 120682181 | 120682202 | 120682198 | 120682203 | + |
| SEQ ID NO 33218 | TCTCCTTCAAACCACTCTTTGG | CTT | chr3 | 120682183 | 120682204 | 120682200 | 120682205 | + |
| SEQ ID NO 33219 | CTCCTTCAAACCACTCTTTGGA | TTT | chr3 | 120682184 | 120682205 | 120682201 | 120682206 | + |
| SEQ ID NO 33220 | TCCTTCAAACCACTCTTTGGAT | TTC | chr3 | 120682185 | 120682206 | 120682202 | 120682207 | + |
| SEQ ID NO 33221 | CTTCAAACCACTCTTTGGATAT | CTC | chr3 | 120682187 | 120682208 | 120682204 | 120682209 | + |
| SEQ ID NO 33222 | CAAACCACTCTTTGGATATTCC | CTT | chr3 | 120682190 | 120682211 | 120682207 | 120682212 | + |
| SEQ ID NO 33223 | AAACCACTCTTTGGATATTCCG | TTC | chr3 | 120682191 | 120682212 | 120682208 | 120682213 | + |
| SEQ ID NO 33224 | TTTGGATATTCCGGTTCCCACT | CTC | chr3 | 120682200 | 120682221 | 120682217 | 120682222 | + |
| SEQ ID NO 33225 | TGGATATTCCGGTTCCCACTGC | CTT | chr3 | 120682202 | 120682223 | 120682219 | 120682224 | + |
| SEQ ID NO 33226 | GGATATTCCGGTTCCCACTGCT | TTT | chr3 | 120682203 | 120682224 | 120682220 | 120682225 | + |
| SEQ ID NO 33227 | GATATTCCGGTTCCCACTGCTT | TTG | chr3 | 120682204 | 120682225 | 120682221 | 120682226 | + |
| SEQ ID NO 33228 | CGGTTCCCACTGCTTCACTGCG | TTC | chr3 | 120682211 | 120682232 | 120682228 | 120682233 | + |
| SEQ ID NO 33229 | CCACTGCTTCACTGCGCTTCAC | TTC | chr3 | 120682217 | 120682238 | 120682234 | 120682239 | + |
| SEQ ID NO 33230 | CTTCACTGCGCTTCACTGGTCA | CTG | chr3 | 120682223 | 120682244 | 120682240 | 120682245 | + |
| SEQ ID NO 33231 | CACTGCGCTTCACTGGTCAGTG | CTT | chr3 | 120682226 | 120682247 | 120682243 | 120682248 | + |
| SEQ ID NO 33232 | ACTGCGCTTCACTGGTCAGTGC | TTC | chr3 | 120682227 | 120682248 | 120682244 | 120682249 | + |

Figure 54 (Cont'd)

| | | | | | | | | |
|---|---|---|---|---|---|---|---|---|
| SEQ ID NO 33233 | CGCTTCACTGGTCAGTGCGTCA | CTG | chr3 | 120682231 | 120682252 | 120682248 | 120682253 | + |
| SEQ ID NO 33234 | CACTGGTCAGTGCGTCACTCAA | CTT | chr3 | 120682236 | 120682257 | 120682253 | 120682258 | + |
| SEQ ID NO 33235 | ACTGGTCAGTGCGTCACTCAAA | TTC | chr3 | 120682237 | 120682258 | 120682254 | 120682259 | + |
| SEQ ID NO 33236 | GTCAGTGCGTCACTCAAACTAG | CTG | chr3 | 120682241 | 120682262 | 120682258 | 120682263 | + |
| SEQ ID NO 33237 | AAACTAGCTGAAAGAATTGTCT | CTC | chr3 | 120682256 | 120682277 | 120682273 | 120682278 | + |
| SEQ ID NO 33238 | GCTGAAAGAATTGTCTAACTCA | CTA | chr3 | 120682262 | 120682283 | 120682279 | 120682284 | + |
| SEQ ID NO 33239 | AAAGAATTGTCTAACTCATACA | CTG | chr3 | 120682266 | 120682287 | 120682283 | 120682288 | + |
| SEQ ID NO 33240 | TCTAACTCATACACAGGGACAA | TTG | chr3 | 120682275 | 120682296 | 120682292 | 120682297 | + |
| SEQ ID NO 33241 | ACTCATACACAGGGACAAAGTC | CTA | chr3 | 120682279 | 120682300 | 120682296 | 120682301 | + |
| SEQ ID NO 33242 | ATACACAGGGACAAAGTCCAGC | CTC | chr3 | 120682283 | 120682304 | 120682300 | 120682305 | + |
| SEQ ID NO 33243 | ATTTAACCGGTTACACAATTGC | CTT | chr3 | 120682311 | 120682332 | 120682328 | 120682333 | + |
| SEQ ID NO 33244 | TTTAACCGGTTACACAATTGCC | TTA | chr3 | 120682312 | 120682333 | 120682329 | 120682334 | + |
| SEQ ID NO 33245 | AACCGGTTACACAATTGCCTTT | TTT | chr3 | 120682315 | 120682336 | 120682332 | 120682337 | + |
| SEQ ID NO 33246 | ACCGGTTACACAATTGCCTTTG | TTA | chr3 | 120682316 | 120682337 | 120682333 | 120682338 | + |
| SEQ ID NO 33247 | CACAATTGCCTTTGGTTTTTAC | TTA | chr3 | 120682324 | 120682345 | 120682341 | 120682346 | + |
| SEQ ID NO 33248 | CCTTTGGTTTTTACAGTTTGTT | TTG | chr3 | 120682332 | 120682353 | 120682349 | 120682354 | + |
| SEQ ID NO 33249 | TGGTTTTTACAGTTTGTTCCTA | CTT | chr3 | 120682336 | 120682357 | 120682353 | 120682358 | + |
| SEQ ID NO 33250 | GGTTTTTACAGTTTGTTCCTAA | TTT | chr3 | 120682337 | 120682358 | 120682354 | 120682359 | + |
| SEQ ID NO 33251 | GTTTTTACAGTTTGTTCCTAAG | TTG | chr3 | 120682338 | 120682359 | 120682355 | 120682360 | + |
| SEQ ID NO 33252 | TTACAGTTTGTTCCTAAGTGTT | TTT | chr3 | 120682342 | 120682363 | 120682359 | 120682364 | + |
| SEQ ID NO 33253 | TACAGTTTGTTCCTAAGTGTTT | TTT | chr3 | 120682343 | 120682364 | 120682360 | 120682365 | + |
| SEQ ID NO 33254 | ACAGTTTGTTCCTAAGTGTTTC | TTT | chr3 | 120682344 | 120682365 | 120682361 | 120682366 | + |
| SEQ ID NO 33255 | CAGTTTGTTCCTAAGTGTTTCC | TTA | chr3 | 120682345 | 120682366 | 120682362 | 120682367 | + |
| SEQ ID NO 33256 | GTTCCTAAGTGTTTCCAGAGGC | TTT | chr3 | 120682351 | 120682372 | 120682368 | 120682373 | + |
| SEQ ID NO 33257 | TTCCTAAGTGTTTCCAGAGGCT | TTG | chr3 | 120682352 | 120682373 | 120682369 | 120682374 | + |
| SEQ ID NO 33258 | CTAAGTGTTTCCAGAGGCTTGG | TTC | chr3 | 120682355 | 120682376 | 120682372 | 120682377 | + |
| SEQ ID NO 33259 | AGTGTTTCCAGAGGCTTGGTTC | CTA | chr3 | 120682358 | 120682379 | 120682375 | 120682380 | + |
| SEQ ID NO 33260 | CCAGAGGCTTGGTTCCTCTTCA | TTT | chr3 | 120682365 | 120682386 | 120682382 | 120682387 | + |
| SEQ ID NO 33261 | CAGAGGCTTGGTTCCTCTTCAC | TTC | chr3 | 120682366 | 120682387 | 120682383 | 120682388 | + |
| SEQ ID NO 33262 | GGTTCCTCTTCACCTGAGGTAG | CTT | chr3 | 120682375 | 120682396 | 120682392 | 120682397 | + |
| SEQ ID NO 33263 | GTTCCTCTTCACCTGAGGTAGA | TTG | chr3 | 120682376 | 120682397 | 120682393 | 120682398 | + |
| SEQ ID NO 33264 | CTCTTCACCTGAGGTAGAGATT | TTC | chr3 | 120682380 | 120682401 | 120682397 | 120682402 | + |
| SEQ ID NO 33265 | TTCACCTGAGGTAGAGATTGAC | CTC | chr3 | 120682383 | 120682404 | 120682400 | 120682405 | + |
| SEQ ID NO 33266 | CACCTGAGGTAGAGATTGACCA | CTT | chr3 | 120682385 | 120682406 | 120682402 | 120682407 | + |
| SEQ ID NO 33267 | ACCTGAGGTAGAGATTGACCAA | TTC | chr3 | 120682386 | 120682407 | 120682403 | 120682408 | + |
| SEQ ID NO 33268 | AGGTAGAGATTGACCAATTATT | CTG | chr3 | 120682391 | 120682412 | 120682408 | 120682413 | + |
| SEQ ID NO 33269 | ACCAATTATTTATTCCAGTTAA | TTG | chr3 | 120682403 | 120682424 | 120682420 | 120682425 | + |
| SEQ ID NO 33270 | TTTATTCCAGTTAAAAGTAGGC | TTA | chr3 | 120682411 | 120682432 | 120682428 | 120682433 | + |
| SEQ ID NO 33271 | ATTCCAGTTAAAAGTAGGCTTA | TTT | chr3 | 120682414 | 120682435 | 120682431 | 120682436 | + |
| SEQ ID NO 33272 | TTCCAGTTAAAAGTAGGCTTAT | TTA | chr3 | 120682415 | 120682436 | 120682432 | 120682437 | + |
| SEQ ID NO 33273 | CAGTTAAAAGTAGGCTTATTTC | TTC | chr3 | 120682418 | 120682439 | 120682435 | 120682440 | + |
| SEQ ID NO 33274 | AAAGTAGGCTTATTTCAAAAGG | TTA | chr3 | 120682424 | 120682445 | 120682441 | 120682446 | + |
| SEQ ID NO 33275 | ATTTCAAAAGGCAGAGAATTTG | CTT | chr3 | 120682435 | 120682456 | 120682452 | 120682457 | + |
| SEQ ID NO 33276 | TTTCAAAAGGCAGAGAATTTGA | TTA | chr3 | 120682436 | 120682457 | 120682453 | 120682458 | + |
| SEQ ID NO 33277 | CAAAAGGCAGAGAATTTGAAGC | TTT | chr3 | 120682439 | 120682460 | 120682456 | 120682461 | + |
| SEQ ID NO 33278 | AAAAGGCAGAGAATTTGAAGCT | TTC | chr3 | 120682440 | 120682461 | 120682457 | 120682462 | + |
| SEQ ID NO 33279 | GAAGCTATCGGGGAAAGGAACT | TTT | chr3 | 120682456 | 120682477 | 120682473 | 120682478 | + |
| SEQ ID NO 33280 | AAGCTATCGGGGAAAGGAACTG | TTG | chr3 | 120682457 | 120682478 | 120682474 | 120682479 | + |
| SEQ ID NO 33281 | TCGGGGAAAGGAACTGTGGCAG | CTA | chr3 | 120682463 | 120682484 | 120682480 | 120682485 | + |
| SEQ ID NO 33282 | TGGCAGATAGTGCCTGCTGTGT | CTG | chr3 | 120682479 | 120682500 | 120682496 | 120682501 | + |
| SEQ ID NO 33283 | CTGTGTGTGGTGGAGGATTCTC | CTG | chr3 | 120682495 | 120682516 | 120682512 | 120682517 | + |
| SEQ ID NO 33284 | TGTGTGGTGGAGGATTCTCTGC | CTG | chr3 | 120682498 | 120682519 | 120682515 | 120682520 | + |
| SEQ ID NO 33285 | TCTGCTCAGTCCTGACTCAGGC | TTC | chr3 | 120682515 | 120682536 | 120682532 | 120682537 | + |
| SEQ ID NO 33286 | TGCTCAGTCCTGACTCAGGCTA | CTC | chr3 | 120682517 | 120682538 | 120682534 | 120682539 | + |
| SEQ ID NO 33287 | CTCAGTCCTGACTCAGGCTAGG | CTG | chr3 | 120682519 | 120682540 | 120682536 | 120682541 | + |
| SEQ ID NO 33288 | AGTCCTGACTCAGGCTAGGAAG | CTC | chr3 | 120682522 | 120682543 | 120682539 | 120682544 | + |
| SEQ ID NO 33289 | ACTCAGGCTAGGAAGGAACAGG | CTG | chr3 | 120682529 | 120682550 | 120682546 | 120682551 | + |
| SEQ ID NO 33290 | AGGCTAGGAAGGAACAGGGCAG | CTC | chr3 | 120682533 | 120682554 | 120682550 | 120682555 | + |
| SEQ ID NO 33291 | GGAAGGAACAGGGCAGTGCTGA | CTA | chr3 | 120682539 | 120682560 | 120682556 | 120682561 | + |

Figure 54 (Cont'd)

| SEQ ID NO 33292 | CAGGAGACTCAGCACTGCCCTG | CTC | chr3 | 120682547 | 120682568 | 120682552 | 120682547 | - |
|---|---|---|---|---|---|---|---|---|
| SEQ ID NO 33293 | AGCACTGCCCTGTTCCTTCCTA | CTC | chr3 | 120682537 | 120682558 | 120682542 | 120682537 | - |
| SEQ ID NO 33294 | CCCTGTTCCTTCCTAGCCTGAG | CTG | chr3 | 120682530 | 120682551 | 120682535 | 120682530 | - |
| SEQ ID NO 33295 | TTCCTTCCTAGCCTGAGTCAGG | CTG | chr3 | 120682525 | 120682546 | 120682530 | 120682525 | - |
| SEQ ID NO 33296 | CTTCCTAGCCTGAGTCAGGACT | TTC | chr3 | 120682522 | 120682543 | 120682527 | 120682522 | - |
| SEQ ID NO 33297 | CCTAGCCTGAGTCAGGACTGAG | CTT | chr3 | 120682519 | 120682540 | 120682524 | 120682519 | - |
| SEQ ID NO 33298 | CTAGCCTGAGTCAGGACTGAGC | TTC | chr3 | 120682518 | 120682539 | 120682523 | 120682518 | - |
| SEQ ID NO 33299 | GCCTGAGTCAGGACTGAGCAGA | CTA | chr3 | 120682515 | 120682536 | 120682520 | 120682515 | - |
| SEQ ID NO 33300 | AGTCAGGACTGAGCAGAGAATC | CTG | chr3 | 120682510 | 120682531 | 120682515 | 120682510 | - |
| SEQ ID NO 33301 | AGCAGAGAATCCTCCACCACAC | CTG | chr3 | 120682499 | 120682520 | 120682504 | 120682499 | - |
| SEQ ID NO 33302 | CACCACACACAGCAGGCACTAT | CTC | chr3 | 120682485 | 120682506 | 120682490 | 120682485 | - |
| SEQ ID NO 33303 | TCTGCCACAGTTCCTTTCCCCG | CTA | chr3 | 120682464 | 120682485 | 120682469 | 120682464 | - |
| SEQ ID NO 33304 | CCACAGTTCCTTTCCCCGATAG | CTG | chr3 | 120682460 | 120682481 | 120682465 | 120682460 | - |
| SEQ ID NO 33305 | CTTTCCCCGATAGCTTCAAATT | TTC | chr3 | 120682451 | 120682472 | 120682456 | 120682451 | - |
| SEQ ID NO 33306 | TCCCCGATAGCTTCAAATTCTC | CTT | chr3 | 120682448 | 120682469 | 120682453 | 120682448 | - |
| SEQ ID NO 33307 | CCCCGATAGCTTCAAATTCTCT | TTT | chr3 | 120682447 | 120682468 | 120682452 | 120682447 | - |
| SEQ ID NO 33308 | CCCGATAGCTTCAAATTCTCTG | TTC | chr3 | 120682446 | 120682467 | 120682451 | 120682446 | - |
| SEQ ID NO 33309 | CAAATTCTCTGCCTTTTGAAAT | CTT | chr3 | 120682435 | 120682456 | 120682440 | 120682435 | - |
| SEQ ID NO 33310 | AAATTCTCTGCCTTTTGAAATA | TTC | chr3 | 120682434 | 120682455 | 120682439 | 120682434 | - |
| SEQ ID NO 33311 | TCTGCCTTTTGAAATAAGCCTA | TTC | chr3 | 120682428 | 120682449 | 120682433 | 120682428 | - |
| SEQ ID NO 33312 | TGCCTTTTGAAATAAGCCTACT | CTC | chr3 | 120682426 | 120682447 | 120682431 | 120682426 | - |
| SEQ ID NO 33313 | CCTTTTGAAATAAGCCTACTTT | CTG | chr3 | 120682424 | 120682445 | 120682429 | 120682424 | - |
| SEQ ID NO 33314 | TTGAAATAAGCCTACTTTTAAC | CTT | chr3 | 120682420 | 120682441 | 120682425 | 120682420 | - |
| SEQ ID NO 33315 | TGAAATAAGCCTACTTTTAACT | TTT | chr3 | 120682419 | 120682440 | 120682424 | 120682419 | - |
| SEQ ID NO 33316 | GAAATAAGCCTACTTTTAACTG | TTT | chr3 | 120682418 | 120682439 | 120682423 | 120682418 | - |
| SEQ ID NO 33317 | AAATAAGCCTACTTTTAACTGG | TTG | chr3 | 120682417 | 120682438 | 120682422 | 120682417 | - |
| SEQ ID NO 33318 | CTTTTAACTGGAATAAATAATT | CTA | chr3 | 120682406 | 120682427 | 120682411 | 120682406 | - |
| SEQ ID NO 33319 | TTAACTGGAATAAATAATTGGT | CTT | chr3 | 120682403 | 120682424 | 120682408 | 120682403 | - |
| SEQ ID NO 33320 | TAACTGGAATAAATAATTGGTC | TTT | chr3 | 120682402 | 120682423 | 120682407 | 120682402 | - |
| SEQ ID NO 33321 | AACTGGAATAAATAATTGGTCA | TTT | chr3 | 120682401 | 120682422 | 120682406 | 120682401 | - |
| SEQ ID NO 33322 | ACTGGAATAAATAATTGGTCAA | TTA | chr3 | 120682400 | 120682421 | 120682405 | 120682400 | - |
| SEQ ID NO 33323 | GAATAAATAATTGGTCAATCTC | CTG | chr3 | 120682396 | 120682417 | 120682401 | 120682396 | - |
| SEQ ID NO 33324 | GTCAATCTCTACCTCAGGTGAA | TTG | chr3 | 120682383 | 120682404 | 120682388 | 120682383 | - |
| SEQ ID NO 33325 | TACCTCAGGTGAAGAGGAACCA | CTC | chr3 | 120682374 | 120682395 | 120682379 | 120682374 | - |
| SEQ ID NO 33326 | CCTCAGGTGAAGAGGAACCAAG | CTA | chr3 | 120682372 | 120682393 | 120682377 | 120682372 | - |
| SEQ ID NO 33327 | AGGTGAAGAGGAACCAAGCCTC | CTC | chr3 | 120682368 | 120682389 | 120682373 | 120682368 | - |
| SEQ ID NO 33328 | TGGAAACACTTAGGAACAAACT | CTC | chr3 | 120682346 | 120682367 | 120682351 | 120682346 | - |
| SEQ ID NO 33329 | GAAACACTTAGGAACAAACTGT | CTG | chr3 | 120682344 | 120682365 | 120682349 | 120682344 | - |
| SEQ ID NO 33330 | AGGAACAAACTGTAAAAACCAA | CTT | chr3 | 120682335 | 120682356 | 120682340 | 120682335 | - |
| SEQ ID NO 33331 | GGAACAAACTGTAAAAACCAAA | TTA | chr3 | 120682334 | 120682355 | 120682339 | 120682334 | - |
| SEQ ID NO 33332 | TAAAAACCAAGGCAATTGTGT | CTG | chr3 | 120682323 | 120682344 | 120682328 | 120682323 | - |
| SEQ ID NO 33333 | TGTAACCGGTTAAATAAGCTTG | TTG | chr3 | 120682304 | 120682325 | 120682309 | 120682304 | - |
| SEQ ID NO 33334 | AATAAGCTTGCTGGACTTTGTC | TTA | chr3 | 120682292 | 120682313 | 120682297 | 120682292 | - |
| SEQ ID NO 33335 | GCTGGACTTTGTCCCTGTGTAT | CTT | chr3 | 120682283 | 120682304 | 120682288 | 120682283 | - |
| SEQ ID NO 33336 | CTGGACTTTGTCCCTGTGTATG | TTG | chr3 | 120682282 | 120682303 | 120682287 | 120682282 | - |
| SEQ ID NO 33337 | GACTTTGTCCCTGTGTATGAGT | CTG | chr3 | 120682279 | 120682300 | 120682284 | 120682279 | - |
| SEQ ID NO 33338 | TGTCCCTGTGTATGAGTTAGAC | CTT | chr3 | 120682274 | 120682295 | 120682279 | 120682274 | - |
| SEQ ID NO 33339 | GTCCCTGTGTATGAGTTAGACA | TTT | chr3 | 120682273 | 120682294 | 120682278 | 120682273 | - |
| SEQ ID NO 33340 | TCCCTGTGTATGAGTTAGACAA | TTG | chr3 | 120682272 | 120682293 | 120682277 | 120682272 | - |
| SEQ ID NO 33341 | TGTATGAGTTAGACAATTCTTT | CTG | chr3 | 120682266 | 120682287 | 120682271 | 120682266 | - |
| SEQ ID NO 33342 | GACAATTCTTTCAGCTAGTTTG | TTA | chr3 | 120682255 | 120682276 | 120682260 | 120682255 | - |
| SEQ ID NO 33343 | TTTCAGCTAGTTTGAGTGACGC | TTC | chr3 | 120682247 | 120682268 | 120682252 | 120682247 | - |
| SEQ ID NO 33344 | TCAGCTAGTTTGAGTGACGCAC | CTT | chr3 | 120682245 | 120682266 | 120682250 | 120682245 | - |
| SEQ ID NO 33345 | CAGCTAGTTTGAGTGACGCACT | TTT | chr3 | 120682244 | 120682265 | 120682249 | 120682244 | - |
| SEQ ID NO 33346 | AGCTAGTTTGAGTGACGCACTG | TTC | chr3 | 120682243 | 120682264 | 120682248 | 120682243 | - |
| SEQ ID NO 33347 | GTTTGAGTGACGCACTGACCAG | CTA | chr3 | 120682238 | 120682259 | 120682243 | 120682238 | - |
| SEQ ID NO 33348 | GAGTGACGCACTGACCAGTGAA | TTT | chr3 | 120682234 | 120682255 | 120682239 | 120682234 | - |
| SEQ ID NO 33349 | AGTGACGCACTGACCAGTGAAG | TTG | chr3 | 120682233 | 120682254 | 120682238 | 120682233 | - |
| SEQ ID NO 33350 | ACCAGTGAAGCGCAGTGAAGCA | CTG | chr3 | 120682221 | 120682242 | 120682226 | 120682221 | - |

Figure 54 (Cont'd)

| | | | | | | | | |
|---|---|---|---|---|---|---|---|---|
| SEQ ID NO 33351 | GAAGGAGAAAGAAGCATTGTGG | TTT | chr3 | 120682169 | 120682190 | 120682174 | 120682169 | - |
| SEQ ID NO 33352 | AAGGAGAAAGAAGCATTGTGGC | TTG | chr3 | 120682168 | 120682189 | 120682173 | 120682168 | - |
| SEQ ID NO 33353 | TGGCTTTATATCCTCTGGGCCT | TTG | chr3 | 120682150 | 120682171 | 120682155 | 120682150 | - |
| SEQ ID NO 33354 | TATATCCTCTGGGCCTGGGTTT | CTT | chr3 | 120682144 | 120682165 | 120682149 | 120682144 | - |
| SEQ ID NO 33355 | ATATCCTCTGGGCCTGGGTTTC | TTT | chr3 | 120682143 | 120682164 | 120682148 | 120682143 | - |
| SEQ ID NO 33356 | TATCCTCTGGGCCTGGGTTTCC | TTA | chr3 | 120682142 | 120682163 | 120682147 | 120682142 | - |
| SEQ ID NO 33357 | TGGGCCTGGGTTTCCTGAAGTC | CTC | chr3 | 120682135 | 120682156 | 120682140 | 120682135 | - |
| SEQ ID NO 33358 | GGCCTGGGTTTCCTGAAGTCAC | CTG | chr3 | 120682133 | 120682154 | 120682138 | 120682133 | - |
| SEQ ID NO 33359 | GGTTTCCTGAAGTCACCACACA | CTG | chr3 | 120682127 | 120682148 | 120682132 | 120682127 | - |
| SEQ ID NO 33360 | CCTGAAGTCACCACACATAGAG | TTT | chr3 | 120682122 | 120682143 | 120682127 | 120682122 | - |
| SEQ ID NO 33361 | CTGAAGTCACCACACATAGAGG | TTC | chr3 | 120682121 | 120682142 | 120682126 | 120682121 | - |
| SEQ ID NO 33362 | AAGTCACCACACATAGAGGAGA | CTG | chr3 | 120682118 | 120682139 | 120682123 | 120682118 | - |
| SEQ ID NO 33363 | AGTTAAAGGTAAGAAACCATCT | CTG | chr3 | 120682083 | 120682104 | 120682088 | 120682083 | - |
| SEQ ID NO 33364 | AAGGTAAGAAACCATCTGACAA | TTA | chr3 | 120682078 | 120682099 | 120682083 | 120682078 | - |
| SEQ ID NO 33365 | ACAAGTTTGCTATGGCTTCTTC | CTG | chr3 | 120682060 | 120682081 | 120682065 | 120682060 | - |
| SEQ ID NO 33366 | GCTATGGCTTCTTCAGCCAAAA | TTT | chr3 | 120682052 | 120682073 | 120682057 | 120682052 | - |
| SEQ ID NO 33367 | CTATGGCTTCTTCAGCCAAAAT | TTG | chr3 | 120682051 | 120682072 | 120682056 | 120682051 | - |
| SEQ ID NO 33368 | TGGCTTCTTCAGCCAAAATTTA | CTA | chr3 | 120682048 | 120682069 | 120682053 | 120682048 | - |
| SEQ ID NO 33369 | CTTCAGCCAAAATTTATGGAAG | CTT | chr3 | 120682042 | 120682063 | 120682047 | 120682042 | - |
| SEQ ID NO 33370 | TTCAGCCAAAATTTATGGAAGT | TTC | chr3 | 120682041 | 120682062 | 120682046 | 120682041 | - |
| SEQ ID NO 33371 | CAGCCAAAATTTATGGAAGTTT | CTT | chr3 | 120682039 | 120682060 | 120682044 | 120682039 | - |
| SEQ ID NO 33372 | AGCCAAAATTTATGGAAGTTTC | TTC | chr3 | 120682038 | 120682059 | 120682043 | 120682038 | - |
| SEQ ID NO 33373 | ATGGAAGTTTCTGAGAACTTCA | TTT | chr3 | 120682027 | 120682048 | 120682032 | 120682027 | - |
| SEQ ID NO 33374 | TGGAAGTTTCTGAGAACTTCAG | TTA | chr3 | 120682026 | 120682047 | 120682031 | 120682026 | - |
| SEQ ID NO 33375 | CTGAGAACTTCAGGGTATCAGA | TTT | chr3 | 120682017 | 120682038 | 120682022 | 120682017 | - |
| SEQ ID NO 33376 | TGAGAACTTCAGGGTATCAGAG | TTC | chr3 | 120682016 | 120682037 | 120682021 | 120682016 | - |
| SEQ ID NO 33377 | AGAACTTCAGGGTATCAGAGTT | CTG | chr3 | 120682014 | 120682035 | 120682019 | 120682014 | - |
| SEQ ID NO 33378 | CAGGGTATCAGAGTTGGAAAAG | CTT | chr3 | 120682007 | 120682028 | 120682012 | 120682007 | - |
| SEQ ID NO 33379 | AGGGTATCAGAGTTGGAAAAGA | TTC | chr3 | 120682006 | 120682027 | 120682011 | 120682006 | - |
| SEQ ID NO 33380 | GAAAAGACTTAGAGAGGCCCTG | TTG | chr3 | 120681991 | 120682012 | 120681996 | 120681991 | - |
| SEQ ID NO 33381 | AGAGAGGCCCTGGTTCAAACCC | CTT | chr3 | 120681981 | 120682002 | 120681986 | 120681981 | - |
| SEQ ID NO 33382 | GAGAGGCCCTGGTTCAAACCCC | TTA | chr3 | 120681980 | 120682001 | 120681985 | 120681980 | - |
| SEQ ID NO 33383 | GTTCAAACCCCTGTGTTCAGAG | CTG | chr3 | 120681969 | 120681990 | 120681974 | 120681969 | - |
| SEQ ID NO 33384 | AAACCCCTGTGTTCAGAGGCTT | TTC | chr3 | 120681965 | 120681986 | 120681970 | 120681965 | - |
| SEQ ID NO 33385 | TGTTCAGAGGCTTCCCTGTGGT | CTG | chr3 | 120681956 | 120681977 | 120681961 | 120681956 | - |
| SEQ ID NO 33386 | AGAGGCTTCCCTGTGGTGTCTG | TTC | chr3 | 120681951 | 120681972 | 120681956 | 120681951 | - |
| SEQ ID NO 33387 | CCCTGTGGTGTCTGTGGGCACA | CTT | chr3 | 120681943 | 120681964 | 120681948 | 120681943 | - |
| SEQ ID NO 33388 | CCTGTGGTGTCTGTGGGCACAG | TTC | chr3 | 120681942 | 120681963 | 120681947 | 120681942 | - |
| SEQ ID NO 33389 | TGGTGTCTGTGGGCACAGCTGG | CTG | chr3 | 120681938 | 120681959 | 120681943 | 120681938 | - |
| SEQ ID NO 33390 | TGGGCACAGCTGGAGCTGAAGA | CTG | chr3 | 120681929 | 120681950 | 120681934 | 120681929 | - |
| SEQ ID NO 33391 | GAGCTGAAGAACAAGGGAAAGG | CTG | chr3 | 120681917 | 120681938 | 120681922 | 120681917 | - |
| SEQ ID NO 33392 | AAGAACAAGGGAAAGGTGATAA | CTG | chr3 | 120681911 | 120681932 | 120681916 | 120681911 | - |
| SEQ ID NO 33393 | TTATTGGTCATCCCTTGCCTTT | CTC | chr3 | 120681871 | 120681892 | 120681876 | 120681871 | - |
| SEQ ID NO 33394 | ATTGGTCATCCCTTGCCTTTGT | CTT | chr3 | 120681869 | 120681890 | 120681874 | 120681869 | - |
| SEQ ID NO 33395 | TTGGTCATCCCTTGCCTTTGTT | TTA | chr3 | 120681868 | 120681889 | 120681873 | 120681868 | - |
| SEQ ID NO 33396 | GTCATCCCTTGCCTTTGTTCAT | TTG | chr3 | 120681865 | 120681886 | 120681870 | 120681865 | - |
| SEQ ID NO 33397 | GCCTTTGTTCATTTCAATTATT | CTT | chr3 | 120681855 | 120681876 | 120681860 | 120681855 | - |
| SEQ ID NO 33398 | CCTTTGTTCATTTCAATTATTG | TTG | chr3 | 120681854 | 120681875 | 120681859 | 120681854 | - |
| SEQ ID NO 33399 | TGTTCATTTCAATTATTGTCTT | CTT | chr3 | 120681850 | 120681871 | 120681855 | 120681850 | - |
| SEQ ID NO 33400 | GTTCATTTCAATTATTGTCTTG | TTT | chr3 | 120681849 | 120681870 | 120681854 | 120681849 | - |
| SEQ ID NO 33401 | TTCATTTCAATTATTGTCTTGG | TTG | chr3 | 120681848 | 120681869 | 120681853 | 120681848 | - |
| SEQ ID NO 33402 | ATTTCAATTATTGTCTTGGAAA | TTC | chr3 | 120681845 | 120681866 | 120681850 | 120681845 | - |
| SEQ ID NO 33403 | CAATTATTGTCTTGGAAATCTG | TTT | chr3 | 120681841 | 120681862 | 120681846 | 120681841 | - |
| SEQ ID NO 33404 | AATTATTGTCTTGGAAATCTGT | TTC | chr3 | 120681840 | 120681861 | 120681845 | 120681840 | - |
| SEQ ID NO 33405 | TTGTCTTGGAAATCTGTAGACA | TTA | chr3 | 120681835 | 120681856 | 120681840 | 120681835 | - |
| SEQ ID NO 33406 | TCTTGGAAATCTGTAGACATCC | TTG | chr3 | 120681832 | 120681853 | 120681837 | 120681832 | - |
| SEQ ID NO 33407 | GGAAATCTGTAGACATCCTAAG | CTT | chr3 | 120681828 | 120681849 | 120681833 | 120681828 | - |
| SEQ ID NO 33408 | GAAATCTGTAGACATCCTAAGA | TTG | chr3 | 120681827 | 120681848 | 120681832 | 120681827 | - |
| SEQ ID NO 33409 | TAGACATCCTAAGAGCTCCCCT | CTG | chr3 | 120681819 | 120681840 | 120681824 | 120681819 | - |

Figure 54 (Cont'd)

| SEQ ID | Sequence | Codon | Chr | Pos1 | Pos2 | Pos3 | Pos4 | |
|---|---|---|---|---|---|---|---|---|
| SEQ ID NO 33410 | AGAGCTCCCCTCCACTACGGAC | CTA | chr3 | 120681808 | 120681829 | 120681813 | 120681808 | - |
| SEQ ID NO 33411 | CCCTCCACTACGGACATGCACG | CTC | chr3 | 120681801 | 120681822 | 120681806 | 120681801 | - |
| SEQ ID NO 33412 | CACTACGGACATGCACGTTTCT | CTC | chr3 | 120681796 | 120681817 | 120681801 | 120681796 | - |
| SEQ ID NO 33413 | CGGACATGCACGTTTCTCTCTA | CTA | chr3 | 120681791 | 120681812 | 120681796 | 120681791 | - |
| SEQ ID NO 33414 | CTCTCTATGTCTTTTTCCCAAC | TTT | chr3 | 120681776 | 120681797 | 120681781 | 120681776 | - |
| SEQ ID NO 33415 | TCTCTATGTCTTTTTCCCAACC | TTC | chr3 | 120681775 | 120681796 | 120681780 | 120681775 | - |
| SEQ ID NO 33416 | TCTATGTCTTTTTCCCAACCCC | CTC | chr3 | 120681773 | 120681794 | 120681778 | 120681773 | - |
| SEQ ID NO 33417 | TATGTCTTTTTCCCAACCCCTG | CTC | chr3 | 120681771 | 120681792 | 120681776 | 120681771 | - |
| SEQ ID NO 33418 | TGTCTTTTTCCCAACCCCTGCT | CTA | chr3 | 120681769 | 120681790 | 120681774 | 120681769 | - |
| SEQ ID NO 33419 | TTTCCCAACCCTGCTCTGACA | CTT | chr3 | 120681763 | 120681784 | 120681768 | 120681763 | - |
| SEQ ID NO 33420 | TTCCCAACCCTGCTCTGACAC | TTT | chr3 | 120681762 | 120681783 | 120681767 | 120681762 | - |
| SEQ ID NO 33421 | TCCCAACCCTGCTCTGACACC | TTT | chr3 | 120681761 | 120681782 | 120681766 | 120681761 | - |
| SEQ ID NO 33422 | CCCAACCCTGCTCTGACACCT | TTT | chr3 | 120681760 | 120681781 | 120681765 | 120681760 | - |
| SEQ ID NO 33423 | CCAACCCTGCTCTGACACCTT | TTC | chr3 | 120681759 | 120681780 | 120681764 | 120681759 | - |
| SEQ ID NO 33424 | CTCTGACACCTTCCCATTGCTG | CTG | chr3 | 120681749 | 120681770 | 120681754 | 120681749 | - |
| SEQ ID NO 33425 | TGACACCTTCCCATTGCTGCAG | CTC | chr3 | 120681746 | 120681767 | 120681751 | 120681746 | - |
| SEQ ID NO 33426 | ACACCTTCCCATTGCTGCAGCC | CTG | chr3 | 120681744 | 120681765 | 120681749 | 120681744 | - |
| SEQ ID NO 33427 | CCCATTGCTGCAGCCTCATGGA | CTT | chr3 | 120681737 | 120681758 | 120681742 | 120681737 | - |
| SEQ ID NO 33428 | CCATTGCTGCAGCCTCATGGAC | TTC | chr3 | 120681736 | 120681757 | 120681741 | 120681736 | - |
| SEQ ID NO 33429 | CTGCAGCCTCATGGACCACTTC | TTG | chr3 | 120681730 | 120681751 | 120681735 | 120681730 | - |
| SEQ ID NO 33430 | CAGCCTCATGGACCACTTCCGG | CTG | chr3 | 120681727 | 120681748 | 120681732 | 120681727 | - |
| SEQ ID NO 33431 | ATGGACCACTTCCGGTGACCAG | CTC | chr3 | 120681720 | 120681741 | 120681725 | 120681720 | - |
| SEQ ID NO 33432 | CCGGTGACCAGTTAGATATGCT | CTT | chr3 | 120681709 | 120681730 | 120681714 | 120681709 | - |
| SEQ ID NO 33433 | CGGTGACCAGTTAGATATGCTT | TTC | chr3 | 120681708 | 120681729 | 120681713 | 120681708 | - |
| SEQ ID NO 33434 | GATATGCTTGATCTATTTAGTT | TTA | chr3 | 120681695 | 120681716 | 120681700 | 120681695 | - |
| SEQ ID NO 33435 | GATCTATTTAGTTAATTAAGGC | CTT | chr3 | 120681686 | 120681707 | 120681691 | 120681686 | - |
| SEQ ID NO 33436 | ATCTATTTAGTTAATTAAGGCT | TTG | chr3 | 120681685 | 120681706 | 120681690 | 120681685 | - |
| SEQ ID NO 33437 | TTTAGTTAATTAAGGCTCTGAA | CTA | chr3 | 120681680 | 120681701 | 120681685 | 120681680 | - |
| SEQ ID NO 33438 | AGTTAATTAAGGCTCTGAATCA | TTT | chr3 | 120681677 | 120681698 | 120681682 | 120681677 | - |
| SEQ ID NO 33439 | GTTAATTAAGGCTCTGAATCAG | TTA | chr3 | 120681676 | 120681697 | 120681681 | 120681676 | - |
| SEQ ID NO 33440 | ATTAAGGCTCTGAATCAGCCCT | TTA | chr3 | 120681672 | 120681693 | 120681677 | 120681672 | - |
| SEQ ID NO 33441 | AGGCTCTGAATCAGCCCTTGGC | TTA | chr3 | 120681668 | 120681689 | 120681673 | 120681668 | - |
| SEQ ID NO 33442 | TGAATCAGCCCTTGGCCAGAAG | CTC | chr3 | 120681662 | 120681683 | 120681667 | 120681662 | - |
| SEQ ID NO 33443 | AATCAGCCCTTGGCCAGAAGAA | CTG | chr3 | 120681660 | 120681681 | 120681665 | 120681660 | - |
| SEQ ID NO 33444 | GGCCAGAAGAAGCACCTCCTCT | CTT | chr3 | 120681649 | 120681670 | 120681654 | 120681649 | - |
| SEQ ID NO 33445 | GCCAGAAGAAGCACCTCCTCTA | TTG | chr3 | 120681648 | 120681669 | 120681653 | 120681648 | - |
| SEQ ID NO 33446 | CTCTAGGAAATCATTCCTTCTT | CTC | chr3 | 120681631 | 120681652 | 120681636 | 120681631 | - |
| SEQ ID NO 33447 | TAGGAAATCATTCCTTCTTTTT | CTC | chr3 | 120681628 | 120681649 | 120681633 | 120681628 | - |
| SEQ ID NO 33448 | GGAAATCATTCCTTCTTTTTAG | CTA | chr3 | 120681626 | 120681647 | 120681631 | 120681626 | - |
| SEQ ID NO 33449 | CTTCTTTTTAGTAATACGCAAT | TTC | chr3 | 120681615 | 120681636 | 120681620 | 120681615 | - |
| SEQ ID NO 33450 | CTTTTTAGTAATACGCAATTGA | CTT | chr3 | 120681612 | 120681633 | 120681617 | 120681612 | - |
| SEQ ID NO 33451 | TTTTTAGTAATACGCAATTGAA | TTC | chr3 | 120681611 | 120681632 | 120681616 | 120681611 | - |
| SEQ ID NO 33452 | TTTAGTAATACGCAATTGAAAA | CTT | chr3 | 120681609 | 120681630 | 120681614 | 120681609 | - |
| SEQ ID NO 33453 | TTAGTAATACGCAATTGAAAAG | TTT | chr3 | 120681608 | 120681629 | 120681613 | 120681608 | - |
| SEQ ID NO 33454 | TAGTAATACGCAATTGAAAAGT | TTT | chr3 | 120681607 | 120681628 | 120681612 | 120681607 | - |
| SEQ ID NO 33455 | AGTAATACGCAATTGAAAAGTA | TTT | chr3 | 120681606 | 120681627 | 120681611 | 120681606 | - |
| SEQ ID NO 33456 | GTAATACGCAATTGAAAAGTAT | TTA | chr3 | 120681605 | 120681626 | 120681610 | 120681605 | - |
| SEQ ID NO 33457 | AAAAGTATGTGTGGGTTATGTG | TTG | chr3 | 120681591 | 120681612 | 120681596 | 120681591 | - |
| SEQ ID NO 33458 | TGTGTGTTAGGTGCTAAGCAT | TTA | chr3 | 120681573 | 120681594 | 120681578 | 120681573 | - |
| SEQ ID NO 33459 | TTAGGTGCTAAGCATTTTAGCT | CTG | chr3 | 120681566 | 120681587 | 120681571 | 120681566 | - |
| SEQ ID NO 33460 | GGTGCTAAGCATTTTAGCTATG | TTA | chr3 | 120681563 | 120681584 | 120681568 | 120681563 | - |
| SEQ ID NO 33461 | AGCATTTTAGCTATGAATTAAC | CTA | chr3 | 120681556 | 120681577 | 120681561 | 120681556 | - |
| SEQ ID NO 33462 | TAGCTATGAATTAACTCATAAT | TTT | chr3 | 120681549 | 120681570 | 120681554 | 120681549 | - |
| SEQ ID NO 33463 | AGCTATGAATTAACTCATAATC | TTT | chr3 | 120681548 | 120681569 | 120681553 | 120681548 | - |
| SEQ ID NO 33464 | GCTATGAATTAACTCATAATCC | TTA | chr3 | 120681547 | 120681568 | 120681552 | 120681547 | - |
| SEQ ID NO 33465 | TGAATTAACTCATAATCCTCAA | CTA | chr3 | 120681543 | 120681564 | 120681548 | 120681543 | - |
| SEQ ID NO 33466 | ACTCATAATCCTCAAAATAAAT | TTA | chr3 | 120681536 | 120681557 | 120681541 | 120681536 | - |
| SEQ ID NO 33467 | ATAATCCTCAAAATAAATCTGG | CTC | chr3 | 120681532 | 120681553 | 120681537 | 120681532 | - |
| SEQ ID NO 33468 | AAAATAAATCTGGGGTATAGAG | CTC | chr3 | 120681523 | 120681544 | 120681528 | 120681523 | - |

Figure 54 (Cont'd)

| SEQ ID NO 33469 | GGGTATAGAGAGAGGTTCTTGT | CTG | chr3 | 120681511 | 120681532 | 120681516 | 120681511 | - |
|---|---|---|---|---|---|---|---|---|
| SEQ ID NO 33470 | TTGTTTCAATTAGAAAAGTAAT | TTC | chr3 | 120681493 | 120681514 | 120681498 | 120681493 | - |
| SEQ ID NO 33471 | GTTTCAATTAGAAAAGTAATGC | CTT | chr3 | 120681491 | 120681512 | 120681496 | 120681491 | - |
| SEQ ID NO 33472 | TTTCAATTAGAAAAGTAATGCT | TTG | chr3 | 120681490 | 120681511 | 120681495 | 120681490 | - |
| SEQ ID NO 33473 | CAATTAGAAAAGTAATGCTTGG | TTT | chr3 | 120681487 | 120681508 | 120681492 | 120681487 | - |
| SEQ ID NO 33474 | AATTAGAAAAGTAATGCTTGGA | TTC | chr3 | 120681486 | 120681507 | 120681491 | 120681486 | - |
| SEQ ID NO 33475 | GAAAAGTAATGCTTGGAGAGAC | TTA | chr3 | 120681481 | 120681502 | 120681486 | 120681481 | - |
| SEQ ID NO 33476 | GGAGAGACTATGATTTGCCCAA | CTT | chr3 | 120681467 | 120681488 | 120681472 | 120681467 | - |
| SEQ ID NO 33477 | GAGAGACTATGATTTGCCCAAG | TTG | chr3 | 120681466 | 120681487 | 120681471 | 120681466 | - |
| SEQ ID NO 33478 | TGATTTGCCCAAGGTCACTGCC | CTA | chr3 | 120681457 | 120681478 | 120681462 | 120681457 | - |
| SEQ ID NO 33479 | GCCCAAGGTCACTGCCAATAGA | TTT | chr3 | 120681451 | 120681472 | 120681456 | 120681451 | - |
| SEQ ID NO 33480 | CCCAAGGTCACTGCCAATAGAT | TTG | chr3 | 120681450 | 120681471 | 120681455 | 120681450 | - |
| SEQ ID NO 33481 | CCAATAGATGACTTGATTAGAA | CTG | chr3 | 120681437 | 120681458 | 120681442 | 120681437 | - |
| SEQ ID NO 33482 | GATTAGAAGCAGGGTATGTTTG | CTT | chr3 | 120681423 | 120681444 | 120681428 | 120681423 | - |
| SEQ ID NO 33483 | ATTAGAAGCAGGGTATGTTTGA | TTG | chr3 | 120681422 | 120681443 | 120681427 | 120681422 | - |
| SEQ ID NO 33484 | GAAGCAGGGTATGTTTGAATGC | TTA | chr3 | 120681418 | 120681439 | 120681423 | 120681418 | - |
| SEQ ID NO 33485 | GAATGCGAAGTCCAGGCTCAAA | TTT | chr3 | 120681402 | 120681423 | 120681407 | 120681402 | - |
| SEQ ID NO 33486 | AATGCGAAGTCCAGGCTCAAAA | TTG | chr3 | 120681401 | 120681422 | 120681406 | 120681401 | - |
| SEQ ID NO 33487 | AAAAAGGGGCCTTAGTGGCTCC | CTC | chr3 | 120681383 | 120681404 | 120681388 | 120681383 | - |
| SEQ ID NO 33488 | AGTGGCTCCTACTAGACTGGTA | CTT | chr3 | 120681370 | 120681391 | 120681375 | 120681370 | - |
| SEQ ID NO 33489 | GTGGCTCCTACTAGACTGGTAT | TTA | chr3 | 120681369 | 120681390 | 120681374 | 120681369 | - |
| SEQ ID NO 33490 | CTACTAGACTGGTATCTTAAGG | CTC | chr3 | 120681362 | 120681383 | 120681367 | 120681362 | - |
| SEQ ID NO 33491 | CTAGACTGGTATCTTAAGGCAA | CTA | chr3 | 120681359 | 120681380 | 120681364 | 120681359 | - |
| SEQ ID NO 33492 | GACTGGTATCTTAAGGCAAGGA | CTA | chr3 | 120681356 | 120681377 | 120681361 | 120681356 | - |
| SEQ ID NO 33493 | GTATCTTAAGGCAAGGAAAACA | CTG | chr3 | 120681351 | 120681372 | 120681356 | 120681351 | - |
| SEQ ID NO 33494 | AAGGCAAGGAAAACAGAATATG | CTT | chr3 | 120681344 | 120681365 | 120681349 | 120681344 | - |
| SEQ ID NO 33495 | AGGCAAGGAAAACAGAATATGT | TTA | chr3 | 120681343 | 120681364 | 120681348 | 120681343 | - |
| SEQ ID NO 33496 | ATATCTAAAACCATGCCTAGTG | CTA | chr3 | 120681316 | 120681337 | 120681321 | 120681316 | - |
| SEQ ID NO 33497 | AAACCATGCCTAGTGCCCAGGC | CTA | chr3 | 120681309 | 120681330 | 120681314 | 120681309 | - |
| SEQ ID NO 33498 | GTGCCCAGGCCAGGCTTGAATC | CTA | chr3 | 120681297 | 120681318 | 120681302 | 120681297 | - |
| SEQ ID NO 33499 | GAATCAATGCTCAACGCATGCA | CTT | chr3 | 120681280 | 120681301 | 120681285 | 120681280 | - |
| SEQ ID NO 33500 | AATCAATGCTCAACGCATGCAT | TTG | chr3 | 120681279 | 120681300 | 120681284 | 120681279 | - |
| SEQ ID NO 33501 | AACGCATGCATGTGTAACTGAA | CTC | chr3 | 120681268 | 120681289 | 120681273 | 120681268 | - |
| SEQ ID NO 33502 | AACAGAACTGCCCAGAACCTTG | CTG | chr3 | 120681248 | 120681269 | 120681253 | 120681248 | - |
| SEQ ID NO 33503 | CCCAGAACCTTGGCTCAGGCCA | CTG | chr3 | 120681238 | 120681259 | 120681243 | 120681238 | - |
| SEQ ID NO 33504 | GGCTCAGGCCAAGTAGGCCAGA | CTT | chr3 | 120681227 | 120681248 | 120681232 | 120681227 | - |
| SEQ ID NO 33505 | GCTCAGGCCAAGTAGGCCAGAC | TTG | chr3 | 120681226 | 120681247 | 120681231 | 120681226 | - |
| SEQ ID NO 33506 | AGGCCAAGTAGGCCAGACCACC | CTC | chr3 | 120681222 | 120681243 | 120681227 | 120681222 | - |
| SEQ ID NO 33507 | CCCTGAATGCAGGGTTTGAGAA | CTT | chr3 | 120681184 | 120681205 | 120681189 | 120681184 | - |
| SEQ ID NO 33508 | CCTGAATGCAGGGTTTGAGAAG | TTC | chr3 | 120681183 | 120681204 | 120681188 | 120681183 | - |
| SEQ ID NO 33509 | AATGCAGGGTTTGAGAAGTGCC | CTG | chr3 | 120681179 | 120681200 | 120681184 | 120681179 | - |
| SEQ ID NO 33510 | GAGAAGTGCCCTAATGCCCTCT | TTT | chr3 | 120681167 | 120681188 | 120681172 | 120681167 | - |
| SEQ ID NO 33511 | AGAAGTGCCCTAATGCCCTCTA | TTG | chr3 | 120681166 | 120681187 | 120681171 | 120681166 | - |
| SEQ ID NO 33512 | ATGCCCTCTAACTGATGCTGAG | CTA | chr3 | 120681154 | 120681175 | 120681159 | 120681154 | - |
| SEQ ID NO 33513 | TAACTGATGCTGAGTTTGAAGA | CTC | chr3 | 120681146 | 120681167 | 120681151 | 120681146 | - |
| SEQ ID NO 33514 | ACTGATGCTGAGTTTGAAGAAT | CTA | chr3 | 120681144 | 120681165 | 120681149 | 120681144 | - |
| SEQ ID NO 33515 | ATGCTGAGTTTGAAGAATCCAT | CTG | chr3 | 120681140 | 120681161 | 120681145 | 120681140 | - |
| SEQ ID NO 33516 | AGTTGAAGAATCCATCAGTTA | CTG | chr3 | 120681134 | 120681155 | 120681139 | 120681134 | - |
| SEQ ID NO 33517 | GAAGAATCCATCAGTTAAGGGG | TTT | chr3 | 120681129 | 120681150 | 120681134 | 120681129 | - |
| SEQ ID NO 33518 | AAGAATCCATCAGTTAAGGGGA | TTG | chr3 | 120681128 | 120681149 | 120681133 | 120681128 | - |
| SEQ ID NO 33519 | AGGGGAGGTGTTTCTGAGTTTG | TTA | chr3 | 120681112 | 120681133 | 120681117 | 120681112 | - |
| SEQ ID NO 33520 | CTGAGTTTGAAGAATCAAACAC | TTT | chr3 | 120681099 | 120681120 | 120681104 | 120681099 | - |
| SEQ ID NO 33521 | TGAGTTTGAAGAATCAAACACC | TTC | chr3 | 120681098 | 120681119 | 120681103 | 120681098 | - |
| SEQ ID NO 33522 | AGTTTGAAGAATCAAACACCTT | CTG | chr3 | 120681096 | 120681117 | 120681101 | 120681096 | - |
| SEQ ID NO 33523 | GAAGAATCAAACACCTTCCTAA | TTT | chr3 | 120681091 | 120681112 | 120681096 | 120681091 | - |
| SEQ ID NO 33524 | AAGAATCAAACACCTTCCTAAT | TTG | chr3 | 120681090 | 120681111 | 120681095 | 120681090 | - |
| SEQ ID NO 33525 | CCTAATTGGTAGGAATCCTGAA | CTT | chr3 | 120681074 | 120681095 | 120681079 | 120681074 | - |
| SEQ ID NO 33526 | CTAATTGGTAGGAATCCTGAAA | TTC | chr3 | 120681073 | 120681094 | 120681078 | 120681073 | - |
| SEQ ID NO 33527 | ATTGGTAGGAATCCTGAAAACA | CTA | chr3 | 120681070 | 120681091 | 120681075 | 120681070 | - |

Figure 54 (Cont'd)

| | | | | | | | | |
|---|---|---|---|---|---|---|---|---|
| SEQ ID NO 33528 | GTAGGAATCCTGAAAACACTCC | TTG | chr3 | 120681066 | 120681087 | 120681071 | 120681066 | - |
| SEQ ID NO 33529 | AAAACACTCCACACCGGAGTAA | CTG | chr3 | 120681054 | 120681075 | 120681059 | 120681054 | - |
| SEQ ID NO 33530 | CACACCGGAGTAAAAGACTTTG | CTC | chr3 | 120681045 | 120681066 | 120681050 | 120681045 | - |
| SEQ ID NO 33531 | TGGTTTTTTATCTTTATGCCTG | CTT | chr3 | 120681025 | 120681046 | 120681030 | 120681025 | - |
| SEQ ID NO 33532 | GGTTTTTTATCTTTATGCCTGA | TTT | chr3 | 120681024 | 120681045 | 120681029 | 120681024 | - |
| SEQ ID NO 33533 | GTTTTTTATCTTTATGCCTGAC | TTG | chr3 | 120681023 | 120681044 | 120681028 | 120681023 | - |
| SEQ ID NO 33534 | TTTATCTTTATGCCTGACTAAA | TTT | chr3 | 120681019 | 120681040 | 120681024 | 120681019 | - |
| SEQ ID NO 33535 | TTATCTTTATGCCTGACTAAAA | TTT | chr3 | 120681018 | 120681039 | 120681023 | 120681018 | - |
| SEQ ID NO 33536 | TATCTTTATGCCTGACTAAAAG | TTT | chr3 | 120681017 | 120681038 | 120681022 | 120681017 | - |
| SEQ ID NO 33537 | ATCTTTATGCCTGACTAAAAGT | TTT | chr3 | 120681016 | 120681037 | 120681021 | 120681016 | - |
| SEQ ID NO 33538 | TCTTTATGCCTGACTAAAAGTT | TTA | chr3 | 120681015 | 120681036 | 120681020 | 120681015 | - |
| SEQ ID NO 33539 | TATGCCTGACTAAAAGTTAACT | CTT | chr3 | 120681011 | 120681032 | 120681016 | 120681011 | - |
| SEQ ID NO 33540 | ATGCCTGACTAAAAGTTAACTC | TTT | chr3 | 120681010 | 120681031 | 120681015 | 120681010 | - |
| SEQ ID NO 33541 | TGCCTGACTAAAAGTTAACTCT | TTA | chr3 | 120681009 | 120681030 | 120681014 | 120681009 | - |
| SEQ ID NO 33542 | ACTAAAAGTTAACTCTCATTCT | CTG | chr3 | 120681003 | 120681024 | 120681008 | 120681003 | - |
| SEQ ID NO 33543 | AAAGTTAACTCTCATTCTTTCA | CTA | chr3 | 120680999 | 120681020 | 120681004 | 120680999 | - |
| SEQ ID NO 33544 | ACTCTCATTCTTTCATTCAGCA | TTA | chr3 | 120680992 | 120681013 | 120680997 | 120680992 | - |
| SEQ ID NO 33545 | TCATTCTTTCATTCAGCAAATA | CTC | chr3 | 120680988 | 120681009 | 120680993 | 120680988 | - |
| SEQ ID NO 33546 | ATTCTTTCATTCAGCAAATATT | CTC | chr3 | 120680986 | 120681007 | 120680991 | 120680986 | - |
| SEQ ID NO 33547 | TTTCATTCAGCAAATATTTTGT | TTC | chr3 | 120680982 | 120681003 | 120680987 | 120680982 | - |
| SEQ ID NO 33548 | TCATTCAGCAAATATTTTGTGC | CTT | chr3 | 120680980 | 120681001 | 120680985 | 120680980 | - |
| SEQ ID NO 33549 | CATTCAGCAAATATTTTGTGCT | TTT | chr3 | 120680979 | 120681000 | 120680984 | 120680979 | - |
| SEQ ID NO 33550 | ATTCAGCAAATATTTTGTGCTA | TTC | chr3 | 120680978 | 120680999 | 120680983 | 120680978 | - |
| SEQ ID NO 33551 | AGCAAATATTTTGTGCTAGTGC | TTC | chr3 | 120680974 | 120680995 | 120680979 | 120680974 | - |
| SEQ ID NO 33552 | TGTGCTAGTGCATGACACTGCA | TTT | chr3 | 120680963 | 120680984 | 120680968 | 120680963 | - |
| SEQ ID NO 33553 | GTGCTAGTGCATGACACTGCAG | TTT | chr3 | 120680962 | 120680983 | 120680967 | 120680962 | - |
| SEQ ID NO 33554 | TGCTAGTGCATGACACTGCAGA | TTG | chr3 | 120680961 | 120680982 | 120680966 | 120680961 | - |
| SEQ ID NO 33555 | GTGCATGACACTGCAGATTAAT | CTA | chr3 | 120680956 | 120680977 | 120680961 | 120680956 | - |
| SEQ ID NO 33556 | CAGATTAATATCGTAGATGAAC | CTG | chr3 | 120680943 | 120680964 | 120680948 | 120680943 | - |
| SEQ ID NO 33557 | ATATCGTAGATGAACTGAGTCT | TTA | chr3 | 120680936 | 120680957 | 120680941 | 120680936 | - |
| SEQ ID NO 33558 | AGTCTGGGCTAGGTAGAGTCAA | CTG | chr3 | 120680919 | 120680940 | 120680924 | 120680919 | - |
| SEQ ID NO 33559 | GGCTAGGTAGAGTCAAAAAAAA | CTG | chr3 | 120680913 | 120680934 | 120680918 | 120680913 | - |
| SEQ ID NO 33560 | GGTAGAGTCAAAAAAAAATTTC | CTA | chr3 | 120680908 | 120680929 | 120680913 | 120680908 | - |
| SEQ ID NO 33561 | CCTAAAGGAGCCTGTACCTAAA | TTT | chr3 | 120680887 | 120680908 | 120680892 | 120680887 | - |
| SEQ ID NO 33562 | CTAAAGGAGCCTGTACCTAAAC | TTC | chr3 | 120680886 | 120680907 | 120680891 | 120680886 | - |
| SEQ ID NO 33563 | AAGGAGCCTGTACCTAAACTGA | CTA | chr3 | 120680883 | 120680904 | 120680888 | 120680883 | - |
| SEQ ID NO 33564 | TACCTAAACTGAGTCTTCAGAG | CTG | chr3 | 120680873 | 120680894 | 120680878 | 120680873 | - |
| SEQ ID NO 33565 | AACTGAGTCTTCAGAGAGAAGT | CTA | chr3 | 120680867 | 120680888 | 120680872 | 120680867 | - |
| SEQ ID NO 33566 | AGTCTTCAGAGAGAAGTTGGAA | CTG | chr3 | 120680862 | 120680883 | 120680867 | 120680862 | - |
| SEQ ID NO 33567 | CAGAGAGAAGTTGGAACTGGCA | CTT | chr3 | 120680856 | 120680877 | 120680861 | 120680856 | - |
| SEQ ID NO 33568 | AGAGAGAAGTTGGAACTGGCAA | TTC | chr3 | 120680855 | 120680876 | 120680860 | 120680855 | - |
| SEQ ID NO 33569 | GAACTGGCAAAGTGAGGAAGGA | TTG | chr3 | 120680843 | 120680864 | 120680848 | 120680843 | - |
| SEQ ID NO 33570 | GCAAAGTGAGGAAGGACGGGGT | CTG | chr3 | 120680837 | 120680858 | 120680842 | 120680837 | - |
| SEQ ID NO 33571 | GAGGGAAGAGTGAGTGCAAAGG | CTG | chr3 | 120680812 | 120680833 | 120680817 | 120680812 | - |
| SEQ ID NO 33572 | CATGCTCTAGAATCCAAAACTG | CTG | chr3 | 120680768 | 120680789 | 120680773 | 120680768 | - |
| SEQ ID NO 33573 | TAGAATCCAAAACTGTGTCAGC | CTC | chr3 | 120680761 | 120680782 | 120680766 | 120680761 | - |
| SEQ ID NO 33574 | GAATCCAAAACTGTGTCAGCCA | CTA | chr3 | 120680759 | 120680780 | 120680764 | 120680759 | - |
| SEQ ID NO 33575 | TGTCAGCCAAATTTGAGTTGAT | CTG | chr3 | 120680746 | 120680767 | 120680751 | 120680746 | - |
| SEQ ID NO 33576 | GAGTTGATGGAGGGACAGCCAA | TTT | chr3 | 120680732 | 120680753 | 120680737 | 120680732 | - |
| SEQ ID NO 33577 | AGTTGATGGAGGGACAGCCAAA | TTG | chr3 | 120680731 | 120680752 | 120680736 | 120680731 | - |
| SEQ ID NO 33578 | ATGGAGGGACAGCCAAACTGAG | TTG | chr3 | 120680726 | 120680747 | 120680731 | 120680726 | - |
| SEQ ID NO 33579 | AGATACCCAGGCGGTGGTTGGA | CTG | chr3 | 120680706 | 120680727 | 120680711 | 120680706 | - |
| SEQ ID NO 33580 | GATTTATGGATCTGGATTTCAG | TTG | chr3 | 120680686 | 120680707 | 120680691 | 120680686 | - |
| SEQ ID NO 33581 | ATGGATCTGGATTTCAGGGGAG | TTT | chr3 | 120680681 | 120680702 | 120680686 | 120680681 | - |
| SEQ ID NO 33582 | TGGATCTGGATTTCAGGGGAGT | TTA | chr3 | 120680680 | 120680701 | 120680685 | 120680680 | - |
| SEQ ID NO 33583 | GATTTCAGGGGAGTGGGCAGGG | CTG | chr3 | 120680672 | 120680693 | 120680677 | 120680672 | - |
| SEQ ID NO 33584 | CAGGGGAGTGGGCAGGGCTAGG | TTT | chr3 | 120680667 | 120680688 | 120680672 | 120680667 | - |
| SEQ ID NO 33585 | AGGGGAGTGGGCAGGGCTAGGG | TTC | chr3 | 120680666 | 120680687 | 120680671 | 120680666 | - |
| SEQ ID NO 33586 | GGGGAATAGAACTGAGGGTCAT | CTA | chr3 | 120680647 | 120680668 | 120680652 | 120680647 | - |

Figure 54 (Cont'd)

| | | | | | | | |
|---|---|---|---|---|---|---|---|
| SEQ ID NO 33587 | AGGGTCATGATGTCAGTGGTAG | CTG | chr3 | 120680633 | 120680654 | 120680638 | 120680633 | - |
| SEQ ID NO 33588 | AAGTCTTGGAAGAAAGAGTAGA | TTG | chr3 | 120680605 | 120680626 | 120680610 | 120680605 | - |
| SEQ ID NO 33589 | GGAAGAAAGAGTAGATAGAAAC | CTT | chr3 | 120680598 | 120680619 | 120680603 | 120680598 | - |
| SEQ ID NO 33590 | GAAGAAAGAGTAGATAGAAACT | TTG | chr3 | 120680597 | 120680618 | 120680602 | 120680597 | - |
| SEQ ID NO 33591 | TGTTTTCTGATGAACATTCTAT | CTT | chr3 | 120680574 | 120680595 | 120680579 | 120680574 | - |
| SEQ ID NO 33592 | GTTTTCTGATGAACATTCTATG | TTT | chr3 | 120680573 | 120680594 | 120680578 | 120680573 | - |
| SEQ ID NO 33593 | TTTTCTGATGAACATTCTATGA | TTG | chr3 | 120680572 | 120680593 | 120680577 | 120680572 | - |
| SEQ ID NO 33594 | TCTGATGAACATTCTATGAGGA | TTT | chr3 | 120680569 | 120680590 | 120680574 | 120680569 | - |
| SEQ ID NO 33595 | CTGATGAACATTCTATGAGGAA | TTT | chr3 | 120680568 | 120680589 | 120680573 | 120680568 | - |
| SEQ ID NO 33596 | TGATGAACATTCTATGAGGAAG | TTC | chr3 | 120680567 | 120680588 | 120680572 | 120680567 | - |
| SEQ ID NO 33597 | ATGAACATTCTATGAGGAAGTT | CTG | chr3 | 120680565 | 120680586 | 120680570 | 120680565 | - |
| SEQ ID NO 33598 | TATGAGGAAGTTCAGCAGAGGT | TTC | chr3 | 120680555 | 120680576 | 120680560 | 120680555 | - |
| SEQ ID NO 33599 | TGAGGAAGTTCAGCAGAGGTTG | CTA | chr3 | 120680553 | 120680574 | 120680558 | 120680553 | - |
| SEQ ID NO 33600 | AGCAGAGGTTGGAAACATCTTT | TTC | chr3 | 120680542 | 120680563 | 120680547 | 120680542 | - |
| SEQ ID NO 33601 | GAAACATCTTTACCATTTATAA | TTG | chr3 | 120680531 | 120680552 | 120680536 | 120680531 | - |
| SEQ ID NO 33602 | TACCATTTATAAATAAATTTTA | CTT | chr3 | 120680521 | 120680542 | 120680526 | 120680521 | - |
| SEQ ID NO 33603 | ACCATTTATAAATAAATTTTAT | TTT | chr3 | 120680520 | 120680541 | 120680525 | 120680520 | - |
| SEQ ID NO 33604 | CCATTTATAAATAAATTTTATG | TTA | chr3 | 120680519 | 120680540 | 120680524 | 120680519 | - |
| SEQ ID NO 33605 | ATAAATAAATTTTATGTAAAAT | TTT | chr3 | 120680513 | 120680534 | 120680518 | 120680513 | - |
| SEQ ID NO 33606 | TAAATAAATTTTATGTAAAATC | TTA | chr3 | 120680512 | 120680533 | 120680517 | 120680512 | - |
| SEQ ID NO 33607 | TATGTAAAATCCTATCCTGCTG | TTT | chr3 | 120680501 | 120680522 | 120680506 | 120680501 | - |
| SEQ ID NO 33608 | ATGTAAAATCCTATCCTGCTGT | TTT | chr3 | 120680500 | 120680521 | 120680505 | 120680500 | - |
| SEQ ID NO 33609 | TGTAAAATCCTATCCTGCTGTC | TTA | chr3 | 120680499 | 120680520 | 120680504 | 120680499 | - |
| SEQ ID NO 33610 | TCCTGCTGTCATGTTAAGCAA | CTA | chr3 | 120680487 | 120680508 | 120680492 | 120680487 | - |
| SEQ ID NO 33611 | CTGTCATGTTAAGCAACTTAT | CTG | chr3 | 120680482 | 120680503 | 120680487 | 120680482 | - |
| SEQ ID NO 33612 | TCATGTTAAGCAACTTATTAT | CTG | chr3 | 120680479 | 120680500 | 120680484 | 120680479 | - |
| SEQ ID NO 33613 | AAGCAACTTATTATGCACAGCA | TTT | chr3 | 120680471 | 120680492 | 120680476 | 120680471 | - |
| SEQ ID NO 33614 | AGCAACTTATTATGCACAGCAC | TTA | chr3 | 120680470 | 120680491 | 120680475 | 120680470 | - |
| SEQ ID NO 33615 | ATTATGCACAGCACCAGGACAT | CTT | chr3 | 120680462 | 120680483 | 120680467 | 120680462 | - |
| SEQ ID NO 33616 | TTATGCACAGCACCAGGACATC | TTA | chr3 | 120680461 | 120680482 | 120680466 | 120680461 | - |
| SEQ ID NO 33617 | TGCACAGCACCAGGACATCAAT | TTA | chr3 | 120680458 | 120680479 | 120680463 | 120680458 | - |
| SEQ ID NO 33618 | CATGCCAGTCTTTGCTCTCAGT | TTG | chr3 | 120680428 | 120680449 | 120680433 | 120680428 | - |
| SEQ ID NO 33619 | TGCTCTCAGTTTCAAAGGCATT | CTT | chr3 | 120680416 | 120680437 | 120680421 | 120680416 | - |
| SEQ ID NO 33620 | GCTCTCAGTTTCAAAGGCATTC | TTT | chr3 | 120680415 | 120680436 | 120680420 | 120680415 | - |
| SEQ ID NO 33621 | CTCTCAGTTTCAAAGGCATTCT | TTG | chr3 | 120680414 | 120680435 | 120680419 | 120680414 | - |
| SEQ ID NO 33622 | TCAGTTTCAAAGGCATTCTTCC | CTC | chr3 | 120680411 | 120680432 | 120680416 | 120680411 | - |
| SEQ ID NO 33623 | AGTTTCAAAGGCATTCTTCCCT | CTC | chr3 | 120680409 | 120680430 | 120680414 | 120680409 | - |
| SEQ ID NO 33624 | CAAAGGCATTCTTCCCTGCCTG | TTT | chr3 | 120680404 | 120680425 | 120680409 | 120680404 | - |
| SEQ ID NO 33625 | AAAGGCATTCTTCCCTGCCTGC | TTC | chr3 | 120680403 | 120680424 | 120680408 | 120680403 | - |
| SEQ ID NO 33626 | TTCCCTGCCTGCTGTCTAATCT | TTC | chr3 | 120680393 | 120680414 | 120680398 | 120680393 | - |
| SEQ ID NO 33627 | CCCTGCCTGCTGTCTAATCTTT | CTT | chr3 | 120680391 | 120680412 | 120680396 | 120680391 | - |
| SEQ ID NO 33628 | CCTGCCTGCTGTCTAATCTTTA | TTC | chr3 | 120680390 | 120680411 | 120680395 | 120680390 | - |
| SEQ ID NO 33629 | CCTGCTGTCTAATCTTTACAAA | CTG | chr3 | 120680386 | 120680407 | 120680391 | 120680386 | - |
| SEQ ID NO 33630 | CTGTCTAATCTTTACAAAGAAA | CTG | chr3 | 120680382 | 120680403 | 120680387 | 120680382 | - |
| SEQ ID NO 33631 | TCTAATCTTTACAAAGAAAGGT | CTG | chr3 | 120680379 | 120680400 | 120680384 | 120680379 | - |
| SEQ ID NO 33632 | ATCTTTACAAAGAAAGGTTAAC | CTA | chr3 | 120680375 | 120680396 | 120680380 | 120680375 | - |
| SEQ ID NO 33633 | TACAAAGAAAGGTTAACTCCAG | CTT | chr3 | 120680370 | 120680391 | 120680375 | 120680370 | - |
| SEQ ID NO 33634 | ACAAAGAAAGGTTAACTCCAGA | TTT | chr3 | 120680369 | 120680390 | 120680374 | 120680369 | - |
| SEQ ID NO 33635 | CAAAGAAAGGTTAACTCCAGAG | TTA | chr3 | 120680368 | 120680389 | 120680373 | 120680368 | - |
| SEQ ID NO 33636 | ACTCCAGAGTCAGGAATCTGA | TTA | chr3 | 120680355 | 120680376 | 120680360 | 120680355 | - |
| SEQ ID NO 33637 | CAGAGGTCAGGAATCTGAACAC | CTC | chr3 | 120680351 | 120680372 | 120680356 | 120680351 | - |
| SEQ ID NO 33638 | AACACAGAAAACCAGATTGCAT | CTG | chr3 | 120680334 | 120680355 | 120680339 | 120680334 | - |
| SEQ ID NO 33639 | CATCATATTCATTCTAATCAAT | TTG | chr3 | 120680315 | 120680336 | 120680320 | 120680315 | - |
| SEQ ID NO 33640 | ATTCTAATCAATAAACATTATA | TTC | chr3 | 120680305 | 120680326 | 120680310 | 120680305 | - |
| SEQ ID NO 33641 | TAATCAATAAACATTATATAAT | TTC | chr3 | 120680301 | 120680322 | 120680306 | 120680301 | - |
| SEQ ID NO 33642 | ATCAATAAACATTATATAATTT | CTA | chr3 | 120680299 | 120680320 | 120680304 | 120680299 | - |
| SEQ ID NO 33643 | TATAATTTTTAAAACTGTTTCT | TTA | chr3 | 120680285 | 120680306 | 120680290 | 120680285 | - |
| SEQ ID NO 33644 | TTAAAACTGTTTCTCATCTTTT | TTT | chr3 | 120680277 | 120680298 | 120680282 | 120680277 | - |
| SEQ ID NO 33645 | TAAAACTGTTTCTCATCTTTTA | TTT | chr3 | 120680276 | 120680297 | 120680281 | 120680276 | - |

Figure 54 (Cont'd)

| SEQ ID NO | Sequence | | | | | | |
|---|---|---|---|---|---|---|---|
| SEQ ID NO 33646 | AAAACTGTTTCTCATCTTTTAT | TTT | chr3 | 120680275 | 120680296 | 120680280 | 120680275 | - |
| SEQ ID NO 33647 | AAACTGTTTCTCATCTTTTATT | TTA | chr3 | 120680274 | 120680295 | 120680279 | 120680274 | - |
| SEQ ID NO 33648 | TTTCTCATCTTTTATTTCTTCA | CTG | chr3 | 120680268 | 120680289 | 120680273 | 120680268 | - |
| SEQ ID NO 33649 | CTCATCTTTTATTTCTTCATTT | TTT | chr3 | 120680265 | 120680286 | 120680270 | 120680265 | - |
| SEQ ID NO 33650 | TCATCTTTTATTTCTTCATTTT | TTC | chr3 | 120680264 | 120680285 | 120680269 | 120680264 | - |
| SEQ ID NO 33651 | ATCTTTTATTTCTTCATTTTAA | CTC | chr3 | 120680262 | 120680283 | 120680267 | 120680262 | - |
| SEQ ID NO 33652 | TTATTTCTTCATTTTAATGAAT | CTT | chr3 | 120680257 | 120680278 | 120680262 | 120680257 | - |
| SEQ ID NO 33653 | TATTTCTTCATTTTAATGAATA | TTT | chr3 | 120680256 | 120680277 | 120680261 | 120680256 | - |
| SEQ ID NO 33654 | ATTTCTTCATTTTAATGAATAT | TTT | chr3 | 120680255 | 120680276 | 120680260 | 120680255 | - |
| SEQ ID NO 33655 | TTTCTTCATTTTAATGAATATG | TTA | chr3 | 120680254 | 120680275 | 120680259 | 120680254 | - |
| SEQ ID NO 33656 | CTTCATTTTAATGAATATGTCA | TTT | chr3 | 120680251 | 120680272 | 120680256 | 120680251 | - |
| SEQ ID NO 33657 | TTCATTTTAATGAATATGTCAA | TTC | chr3 | 120680250 | 120680271 | 120680255 | 120680250 | - |
| SEQ ID NO 33658 | CATTTTAATGAATATGTCAACA | CTT | chr3 | 120680248 | 120680269 | 120680253 | 120680248 | - |
| SEQ ID NO 33659 | ATTTTAATGAATATGTCAACAC | TTC | chr3 | 120680247 | 120680268 | 120680252 | 120680247 | - |
| SEQ ID NO 33660 | TAATGAATATGTCAACACAAAG | TTT | chr3 | 120680243 | 120680264 | 120680248 | 120680243 | - |
| SEQ ID NO 33661 | AATGAATATGTCAACACAAAGC | TTT | chr3 | 120680242 | 120680263 | 120680247 | 120680242 | - |
| SEQ ID NO 33662 | ATGAATATGTCAACACAAAGCC | TTA | chr3 | 120680241 | 120680262 | 120680246 | 120680241 | - |
| SEQ ID NO 33663 | ACACAAAGTACAACTGGGGTA | TTT | chr3 | 120680201 | 120680222 | 120680206 | 120680201 | - |
| SEQ ID NO 33664 | CACAAAGTACAACTGGGGTAA | TTA | chr3 | 120680200 | 120680221 | 120680205 | 120680200 | - |
| SEQ ID NO 33665 | GGGTAAGAAAATTCAAAAGATA | CTG | chr3 | 120680184 | 120680205 | 120680189 | 120680184 | - |
| SEQ ID NO 33666 | AAAAGATAAAGTAATAAAATTA | TTC | chr3 | 120680170 | 120680191 | 120680175 | 120680170 | - |
| SEQ ID NO 33667 | AATTTAAAATGAAATACCCTAT | TTA | chr3 | 120680148 | 120680169 | 120680153 | 120680148 | - |
| SEQ ID NO 33668 | AAAATGAAATACCCTATGTATT | TTT | chr3 | 120680143 | 120680164 | 120680148 | 120680143 | - |
| SEQ ID NO 33669 | AAATGAAATACCCTATGTATTT | TTA | chr3 | 120680142 | 120680163 | 120680147 | 120680142 | - |
| SEQ ID NO 33670 | TGTATTTGAGTAAGTTGCTTAG | CTA | chr3 | 120680127 | 120680148 | 120680132 | 120680127 | - |
| SEQ ID NO 33671 | GAGTAAGTTGCTTAGCTTCTCC | TTT | chr3 | 120680120 | 120680141 | 120680125 | 120680120 | - |
| SEQ ID NO 33672 | AGTAAGTTGCTTAGCTTCTCCC | TTG | chr3 | 120680119 | 120680140 | 120680124 | 120680119 | - |
| SEQ ID NO 33673 | CTTAGCTTCTCCCAACCTTGGT | TTG | chr3 | 120680110 | 120680131 | 120680115 | 120680110 | - |
| SEQ ID NO 33674 | AGCTTCTCCCAACCTTGGTTTC | CTT | chr3 | 120680107 | 120680128 | 120680112 | 120680107 | - |
| SEQ ID NO 33675 | GCTTCTCCCAACCTTGGTTTCC | TTA | chr3 | 120680106 | 120680127 | 120680111 | 120680106 | - |
| SEQ ID NO 33676 | CTCCCAACCTTGGTTTCCTCAT | CTT | chr3 | 120680102 | 120680123 | 120680107 | 120680102 | - |
| SEQ ID NO 33677 | TCCCAACCTTGGTTTCCTCATT | TTC | chr3 | 120680101 | 120680122 | 120680106 | 120680101 | - |
| SEQ ID NO 33678 | CCAACCTTGGTTTCCTCATTTC | CTC | chr3 | 120680099 | 120680120 | 120680104 | 120680099 | - |
| SEQ ID NO 33679 | GGTTTCCTCATTTCTAAAACGA | CTT | chr3 | 120680091 | 120680112 | 120680096 | 120680091 | - |
| SEQ ID NO 33680 | GTTTCCTCATTTCTAAAACGAA | TTG | chr3 | 120680090 | 120680111 | 120680095 | 120680090 | - |
| SEQ ID NO 33681 | CCTCATTTCTAAAACGAAGAAC | TTT | chr3 | 120680086 | 120680107 | 120680091 | 120680086 | - |
| SEQ ID NO 33682 | CTCATTTCTAAAACGAAGAACT | TTC | chr3 | 120680085 | 120680106 | 120680090 | 120680085 | - |
| SEQ ID NO 33683 | ATTTCTAAAACGAAGAACTTGC | CTC | chr3 | 120680082 | 120680103 | 120680087 | 120680082 | - |
| SEQ ID NO 33684 | CTAAAACGAAGAACTTGCTTAA | TTT | chr3 | 120680078 | 120680099 | 120680083 | 120680078 | - |
| SEQ ID NO 33685 | TAAAACGAAGAACTTGCTTAAT | TTC | chr3 | 120680077 | 120680098 | 120680082 | 120680077 | - |
| SEQ ID NO 33686 | AAACGAAGAACTTGCTTAATAT | CTA | chr3 | 120680075 | 120680096 | 120680080 | 120680075 | - |
| SEQ ID NO 33687 | GCTTAATATTCAGGCTCTGGGC | CTT | chr3 | 120680062 | 120680083 | 120680067 | 120680062 | - |
| SEQ ID NO 33688 | CTTAATATTCAGGCTCTGGGCC | TTG | chr3 | 120680061 | 120680082 | 120680066 | 120680061 | - |
| SEQ ID NO 33689 | AATATTCAGGCTCTGGGCCCCA | CTT | chr3 | 120680058 | 120680079 | 120680063 | 120680058 | - |
| SEQ ID NO 33690 | ATATTCAGGCTCTGGGCCCCAC | TTA | chr3 | 120680057 | 120680078 | 120680062 | 120680057 | - |
| SEQ ID NO 33691 | AGGCTCTGGGCCCCACCACCA | TTC | chr3 | 120680051 | 120680072 | 120680056 | 120680051 | - |
| SEQ ID NO 33692 | TGGGCCCCACCACCAAATCCTT | CTC | chr3 | 120680045 | 120680066 | 120680050 | 120680045 | - |
| SEQ ID NO 33693 | GGCCCCACCACCAAATCCTTGA | CTG | chr3 | 120680043 | 120680064 | 120680048 | 120680043 | - |
| SEQ ID NO 33694 | GATTCACTGGCTCTGGGTCTGT | CTT | chr3 | 120680023 | 120680044 | 120680028 | 120680023 | - |
| SEQ ID NO 33695 | ATTCACTGGCTCTGGGTCTGTA | TTG | chr3 | 120680022 | 120680043 | 120680027 | 120680022 | - |
| SEQ ID NO 33696 | ACTGGCTCTGGGTCTGTATGTA | TTC | chr3 | 120680018 | 120680039 | 120680023 | 120680018 | - |
| SEQ ID NO 33697 | GCTCTGGGTCTGTATGTAACAA | CTG | chr3 | 120680014 | 120680035 | 120680019 | 120680014 | - |
| SEQ ID NO 33698 | TGGGTCTGTATGTAACAAGCTT | CTC | chr3 | 120680010 | 120680031 | 120680015 | 120680010 | - |
| SEQ ID NO 33699 | GGTCTGTATGTAACAAGCTTCT | CTG | chr3 | 120680008 | 120680029 | 120680013 | 120680008 | - |
| SEQ ID NO 33700 | TATGTAACAAGCTTCTGGAGTG | CTG | chr3 | 120680002 | 120680023 | 120680007 | 120680002 | - |
| SEQ ID NO 33701 | CTGGAGTGATTCTAATGATTAG | CTT | chr3 | 120679988 | 120680009 | 120679993 | 120679988 | - |
| SEQ ID NO 33702 | TGGAGTGATTCTAATGATTAGC | TTC | chr3 | 120679987 | 120680008 | 120679992 | 120679987 | - |
| SEQ ID NO 33703 | GAGTGATTCTAATGATTAGCCA | CTG | chr3 | 120679985 | 120680006 | 120679990 | 120679985 | - |
| SEQ ID NO 33704 | TAATGATTAGCCAGAGACAGGA | TTC | chr3 | 120679976 | 120679997 | 120679981 | 120679976 | - |

Figure 54 (Cont'd)

| | | | | | | | | |
|---|---|---|---|---|---|---|---|---|
| SEQ ID NO 33705 | ATGATTAGCCAGAGACAGGACC | CTA | chr3 | 120679974 | 120679995 | 120679979 | 120679974 | - |
| SEQ ID NO 33706 | GCCAGAGACAGGACCTACTATT | TTA | chr3 | 120679967 | 120679988 | 120679972 | 120679967 | - |
| SEQ ID NO 33707 | CTATTCTACGTAACTGATTTCC | CTA | chr3 | 120679950 | 120679971 | 120679955 | 120679950 | - |
| SEQ ID NO 33708 | TTCTACGTAACTGATTTCCTCT | CTA | chr3 | 120679947 | 120679968 | 120679952 | 120679947 | - |
| SEQ ID NO 33709 | TACGTAACTGATTTCCTCTTGC | TTC | chr3 | 120679944 | 120679965 | 120679949 | 120679944 | - |
| SEQ ID NO 33710 | CGTAACTGATTTCCTCTTGCTG | CTA | chr3 | 120679942 | 120679963 | 120679947 | 120679942 | - |
| SEQ ID NO 33711 | ATTTCCTCTTGCTGCTGTAAAA | CTG | chr3 | 120679934 | 120679955 | 120679939 | 120679934 | - |
| SEQ ID NO 33712 | CCTCTTGCTGCTGTAAAAAATT | TTT | chr3 | 120679930 | 120679951 | 120679935 | 120679930 | - |
| SEQ ID NO 33713 | CTCTTGCTGCTGTAAAAAATTA | TTC | chr3 | 120679929 | 120679950 | 120679934 | 120679929 | - |
| SEQ ID NO 33714 | TTGCTGCTGTAAAAAATTACCA | CTC | chr3 | 120679926 | 120679947 | 120679931 | 120679926 | - |
| SEQ ID NO 33715 | GCTGCTGTAAAAAATTACCACA | CTT | chr3 | 120679924 | 120679945 | 120679929 | 120679924 | - |
| SEQ ID NO 33716 | CTGCTGTAAAAAATTACCACAA | TTG | chr3 | 120679923 | 120679944 | 120679928 | 120679923 | - |
| SEQ ID NO 33717 | CTGTAAAAAATTACCACAAATT | CTG | chr3 | 120679920 | 120679941 | 120679925 | 120679920 | - |
| SEQ ID NO 33718 | TAAAAAATTACCACAAATTTAT | CTG | chr3 | 120679917 | 120679938 | 120679922 | 120679917 | - |
| SEQ ID NO 33719 | CCACAAATTTATTGGCTTAAAA | TTA | chr3 | 120679907 | 120679928 | 120679912 | 120679907 | - |
| SEQ ID NO 33720 | ATTGGCTTAAAACAACACAAAT | TTT | chr3 | 120679897 | 120679918 | 120679902 | 120679897 | - |
| SEQ ID NO 33721 | TTGGCTTAAAACAACACAAATG | TTA | chr3 | 120679896 | 120679917 | 120679901 | 120679896 | - |
| SEQ ID NO 33722 | GCTTAAAACAACACAAATGTAT | TTG | chr3 | 120679893 | 120679914 | 120679898 | 120679893 | - |
| SEQ ID NO 33723 | AAAACAACACAAATGTATTATC | CTT | chr3 | 120679889 | 120679910 | 120679894 | 120679889 | - |
| SEQ ID NO 33724 | AAACAACACAAATGTATTATCT | TTA | chr3 | 120679888 | 120679909 | 120679893 | 120679888 | - |
| SEQ ID NO 33725 | TCTTGAAGTTGTGGAGGTCAGA | TTA | chr3 | 120679869 | 120679890 | 120679874 | 120679869 | - |
| SEQ ID NO 33726 | GAAGTTGTGGAGGTCAGAAGTC | CTT | chr3 | 120679865 | 120679886 | 120679870 | 120679865 | - |
| SEQ ID NO 33727 | AAGTTGTGGAGGTCAGAAGTCT | TTG | chr3 | 120679864 | 120679885 | 120679869 | 120679864 | - |
| SEQ ID NO 33728 | TGGAGGTCAGAAGTCTGAAATC | TTG | chr3 | 120679858 | 120679879 | 120679863 | 120679858 | - |
| SEQ ID NO 33729 | AAATCGGTTTCACTGGGCTAAA | CTG | chr3 | 120679841 | 120679862 | 120679846 | 120679841 | - |
| SEQ ID NO 33730 | CACTGGGCTAAAGTCGAGGTGT | TTT | chr3 | 120679831 | 120679852 | 120679836 | 120679831 | - |
| SEQ ID NO 33731 | ACTGGGCTAAAGTCGAGGTGTC | TTC | chr3 | 120679830 | 120679851 | 120679835 | 120679830 | - |
| SEQ ID NO 33732 | GGCTAAAGTCGAGGTGTCAGTG | CTG | chr3 | 120679826 | 120679847 | 120679831 | 120679826 | - |
| SEQ ID NO 33733 | AAGTCGAGGTGTCAGTGTGGCT | CTA | chr3 | 120679821 | 120679842 | 120679826 | 120679821 | - |
| SEQ ID NO 33734 | TTTCTTCTGGAGACTCTATGAG | CTG | chr3 | 120679798 | 120679819 | 120679803 | 120679798 | - |
| SEQ ID NO 33735 | CTTCTGGAGACTCTATGAGAGA | TTT | chr3 | 120679795 | 120679816 | 120679800 | 120679795 | - |
| SEQ ID NO 33736 | TTCTGGAGACTCTATGAGAGAT | TTC | chr3 | 120679794 | 120679815 | 120679799 | 120679794 | - |
| SEQ ID NO 33737 | CTGGAGACTCTATGAGAGATTG | CTT | chr3 | 120679792 | 120679813 | 120679797 | 120679792 | - |
| SEQ ID NO 33738 | TGGAGACTCTATGAGAGATTGT | TTC | chr3 | 120679791 | 120679812 | 120679796 | 120679791 | - |
| SEQ ID NO 33739 | GAGACTCTATGAGAGATTGTGT | CTG | chr3 | 120679789 | 120679810 | 120679794 | 120679789 | - |
| SEQ ID NO 33740 | TATGAGAGATTGTGTTTTCCTG | CTC | chr3 | 120679782 | 120679803 | 120679787 | 120679782 | - |
| SEQ ID NO 33741 | TGAGAGATTGTGTTTTCCTGCC | CTA | chr3 | 120679780 | 120679801 | 120679785 | 120679780 | - |
| SEQ ID NO 33742 | TGTTTTCCTGCCTTTTCCATGG | TTG | chr3 | 120679770 | 120679791 | 120679775 | 120679770 | - |
| SEQ ID NO 33743 | TCCTGCCTTTTCCATGGATTCT | TTT | chr3 | 120679765 | 120679786 | 120679770 | 120679765 | - |
| SEQ ID NO 33744 | CCTGCCTTTTCCATGGATTCTG | TTT | chr3 | 120679764 | 120679785 | 120679769 | 120679764 | - |
| SEQ ID NO 33745 | CTGCCTTTTCCATGGATTCTGT | TTC | chr3 | 120679763 | 120679784 | 120679768 | 120679763 | - |
| SEQ ID NO 33746 | CCTTTTCCATGGATTCTGTTTC | CTG | chr3 | 120679760 | 120679781 | 120679765 | 120679760 | - |
| SEQ ID NO 33747 | TTCCATGGATTCTGTTTCCTCT | CTT | chr3 | 120679756 | 120679777 | 120679761 | 120679756 | - |
| SEQ ID NO 33748 | TCCATGGATTCTGTTTCCTCTT | TTT | chr3 | 120679755 | 120679776 | 120679760 | 120679755 | - |
| SEQ ID NO 33749 | CCATGGATTCTGTTTCCTCTTC | TTT | chr3 | 120679754 | 120679775 | 120679759 | 120679754 | - |
| SEQ ID NO 33750 | CATGGATTCTGTTTCCTCTTCT | TTC | chr3 | 120679753 | 120679774 | 120679758 | 120679753 | - |
| SEQ ID NO 33751 | TGTTTCCTCTTCTAGAGGCTAC | TTC | chr3 | 120679744 | 120679765 | 120679749 | 120679744 | - |
| SEQ ID NO 33752 | TTTCCTCTTCTAGAGGCTACCC | CTG | chr3 | 120679742 | 120679763 | 120679747 | 120679742 | - |
| SEQ ID NO 33753 | CCTCTTCTAGAGGCTACCCACA | TTT | chr3 | 120679739 | 120679760 | 120679744 | 120679739 | - |
| SEQ ID NO 33754 | CTCTTCTAGAGGCTACCCACAT | TTC | chr3 | 120679738 | 120679759 | 120679743 | 120679738 | - |
| SEQ ID NO 33755 | TTCTAGAGGCTACCCACATTCC | CTC | chr3 | 120679735 | 120679756 | 120679740 | 120679735 | - |
| SEQ ID NO 33756 | CTAGAGGCTACCCACATTCCTT | CTT | chr3 | 120679733 | 120679754 | 120679738 | 120679733 | - |
| SEQ ID NO 33757 | TAGAGGCTACCCACATTCCTTG | TTC | chr3 | 120679732 | 120679753 | 120679737 | 120679732 | - |
| SEQ ID NO 33758 | GAGGCTACCCACATTCCTTGGT | CTA | chr3 | 120679730 | 120679751 | 120679735 | 120679730 | - |
| SEQ ID NO 33759 | CCCACATTCCTTGGTTTGTAGC | CTA | chr3 | 120679723 | 120679744 | 120679728 | 120679723 | - |
| SEQ ID NO 33760 | CTTGGTTTGTAGCCTCTTCCTC | TTC | chr3 | 120679714 | 120679735 | 120679719 | 120679714 | - |
| SEQ ID NO 33761 | GGTTTGTAGCCTCTTCCTCGAT | CTT | chr3 | 120679711 | 120679732 | 120679716 | 120679711 | - |
| SEQ ID NO 33762 | GTTTGTAGCCTCTTCCTCGATC | TTG | chr3 | 120679710 | 120679731 | 120679715 | 120679710 | - |
| SEQ ID NO 33763 | GTAGCCTCTTCCTCGATCTTCA | TTT | chr3 | 120679706 | 120679727 | 120679711 | 120679706 | - |

Figure 54 (Cont'd)

| SEQ ID NO 33764 | TAGCCTCTTCCTCGATCTTCAA | TTG | chr3 | 120679705 | 120679726 | 120679710 | 120679705 | - |
|---|---|---|---|---|---|---|---|---|
| SEQ ID NO 33765 | TTCCTCGATCTTCAAAAAAATG | CTC | chr3 | 120679698 | 120679719 | 120679703 | 120679698 | - |
| SEQ ID NO 33766 | CCTCGATCTTCAAAAAAATGTA | CTT | chr3 | 120679696 | 120679717 | 120679701 | 120679696 | - |
| SEQ ID NO 33767 | CTCGATCTTCAAAAAAATGTAT | TTC | chr3 | 120679695 | 120679716 | 120679700 | 120679695 | - |
| SEQ ID NO 33768 | GATCTTCAAAAAAATGTATCTC | CTC | chr3 | 120679692 | 120679713 | 120679697 | 120679692 | - |
| SEQ ID NO 33769 | CAAAAAAATGTATCTCTGCTTT | CTT | chr3 | 120679686 | 120679707 | 120679691 | 120679686 | - |
| SEQ ID NO 33770 | AAAAAAATGTATCTCTGCTTTT | TTC | chr3 | 120679685 | 120679706 | 120679690 | 120679685 | - |
| SEQ ID NO 33771 | TGCTTTTGTAATCACGTCACAT | CTC | chr3 | 120679670 | 120679691 | 120679675 | 120679670 | - |
| SEQ ID NO 33772 | CTTTTGTAATCACGTCACATTT | CTG | chr3 | 120679668 | 120679689 | 120679673 | 120679668 | - |
| SEQ ID NO 33773 | TTGTAATCACGTCACATTTTCT | CTT | chr3 | 120679665 | 120679686 | 120679670 | 120679665 | - |
| SEQ ID NO 33774 | TGTAATCACGTCACATTTTCTC | TTT | chr3 | 120679664 | 120679685 | 120679669 | 120679664 | - |
| SEQ ID NO 33775 | GTAATCACGTCACATTTTCTCC | TTT | chr3 | 120679663 | 120679684 | 120679668 | 120679663 | - |
| SEQ ID NO 33776 | TAATCACGTCACATTTTCTCCT | TTG | chr3 | 120679662 | 120679683 | 120679667 | 120679662 | - |
| SEQ ID NO 33777 | TCTCCTCTTATAAGTCAAATCT | TTT | chr3 | 120679646 | 120679667 | 120679651 | 120679646 | - |
| SEQ ID NO 33778 | CTCCTCTTATAAGTCAAATCTC | TTT | chr3 | 120679645 | 120679666 | 120679650 | 120679645 | - |
| SEQ ID NO 33779 | TCCTCTTATAAGTCAAATCTCC | TTC | chr3 | 120679644 | 120679665 | 120679649 | 120679644 | - |
| SEQ ID NO 33780 | CTCTTATAAGTCAAATCTCCCT | CTC | chr3 | 120679642 | 120679663 | 120679647 | 120679642 | - |
| SEQ ID NO 33781 | TTATAAGTCAAATCTCCCTTTG | CTC | chr3 | 120679639 | 120679660 | 120679644 | 120679639 | - |
| SEQ ID NO 33782 | ATAAGTCAAATCTCCCTTTGCC | CTT | chr3 | 120679637 | 120679658 | 120679642 | 120679637 | - |
| SEQ ID NO 33783 | TAAGTCAAATCTCCCTTTGCCT | TTA | chr3 | 120679636 | 120679657 | 120679641 | 120679636 | - |
| SEQ ID NO 33784 | CCTTTGCCTCCCTCTTATAATG | CTC | chr3 | 120679623 | 120679644 | 120679628 | 120679623 | - |
| SEQ ID NO 33785 | TGCCTCCCTCTTATAATGACAC | CTT | chr3 | 120679619 | 120679640 | 120679624 | 120679619 | - |
| SEQ ID NO 33786 | GCCTCCCTCTTATAATGACACT | TTT | chr3 | 120679618 | 120679639 | 120679623 | 120679618 | - |
| SEQ ID NO 33787 | CCTCCCTCTTATAATGACACTT | TTG | chr3 | 120679617 | 120679638 | 120679622 | 120679617 | - |
| SEQ ID NO 33788 | CCTCTTATAATGACACTTGTGA | CTC | chr3 | 120679613 | 120679634 | 120679618 | 120679613 | - |
| SEQ ID NO 33789 | TTATAATGACACTTGTGATTAC | CTC | chr3 | 120679609 | 120679630 | 120679614 | 120679609 | - |
| SEQ ID NO 33790 | ATAATGACACTTGTGATTACAT | CTT | chr3 | 120679607 | 120679628 | 120679612 | 120679607 | - |
| SEQ ID NO 33791 | TAATGACACTTGTGATTACATT | TTA | chr3 | 120679606 | 120679627 | 120679611 | 120679606 | - |
| SEQ ID NO 33792 | GTGATTACATTTAGGATACACC | CTT | chr3 | 120679595 | 120679616 | 120679600 | 120679595 | - |
| SEQ ID NO 33793 | TGATTACATTTAGGATACACCC | TTG | chr3 | 120679594 | 120679615 | 120679599 | 120679594 | - |
| SEQ ID NO 33794 | CATTTAGGATACACCCAAATAA | TTA | chr3 | 120679588 | 120679609 | 120679593 | 120679588 | - |
| SEQ ID NO 33795 | AGGATACACCCAAATAATTAGG | TTT | chr3 | 120679583 | 120679604 | 120679588 | 120679583 | - |
| SEQ ID NO 33796 | GGATACACCCAAATAATTAGGA | TTA | chr3 | 120679582 | 120679603 | 120679587 | 120679582 | - |
| SEQ ID NO 33797 | GGATATCTCCCCATCCCAAGAT | TTA | chr3 | 120679563 | 120679584 | 120679568 | 120679563 | - |
| SEQ ID NO 33798 | CCCATCCCAAGATCCTTAATTA | CTC | chr3 | 120679554 | 120679575 | 120679559 | 120679554 | - |
| SEQ ID NO 33799 | AATTATATATGCAAAGTCTGT | CTT | chr3 | 120679537 | 120679558 | 120679542 | 120679537 | - |
| SEQ ID NO 33800 | ATTATATATGCAAAGTCTGTT | TTA | chr3 | 120679536 | 120679557 | 120679541 | 120679536 | - |
| SEQ ID NO 33801 | TATATGCAAAGTCTGTTTGGC | TTA | chr3 | 120679532 | 120679553 | 120679537 | 120679532 | - |
| SEQ ID NO 33802 | TTTGGCTAGAAAAGATAATACT | CTG | chr3 | 120679516 | 120679537 | 120679521 | 120679516 | - |
| SEQ ID NO 33803 | GGCTAGAAAAGATAATACTCAC | TTT | chr3 | 120679513 | 120679534 | 120679518 | 120679513 | - |
| SEQ ID NO 33804 | GCTAGAAAAGATAATACTCACA | TTG | chr3 | 120679512 | 120679533 | 120679517 | 120679512 | - |
| SEQ ID NO 33805 | GAAAAGATAATACTCACAGGTT | CTA | chr3 | 120679508 | 120679529 | 120679513 | 120679508 | - |
| SEQ ID NO 33806 | ACAGGTTTCAGGGGTTAAGCCA | CTC | chr3 | 120679493 | 120679514 | 120679498 | 120679493 | - |
| SEQ ID NO 33807 | CAGGGGTTAAGCCATACATATC | TTT | chr3 | 120679485 | 120679506 | 120679490 | 120679485 | - |
| SEQ ID NO 33808 | AGGGGTTAAGCCATACATATCT | TTC | chr3 | 120679484 | 120679505 | 120679489 | 120679484 | - |
| SEQ ID NO 33809 | AGCCATACATATCTTTCAGAGT | TTA | chr3 | 120679476 | 120679497 | 120679481 | 120679476 | - |
| SEQ ID NO 33810 | TCAGAGTGAGCCATTAGCCATT | CTT | chr3 | 120679461 | 120679482 | 120679466 | 120679461 | - |
| SEQ ID NO 33811 | CAGAGTGAGCCATTAGCCATTA | TTT | chr3 | 120679460 | 120679481 | 120679465 | 120679460 | - |
| SEQ ID NO 33812 | AGAGTGAGCCATTAGCCATTAT | TTC | chr3 | 120679459 | 120679480 | 120679464 | 120679459 | - |
| SEQ ID NO 33813 | GCCATTATTCAGCCTACTGCGA | TTA | chr3 | 120679445 | 120679466 | 120679450 | 120679445 | - |
| SEQ ID NO 33814 | TTCAGCCTACTGCGATAATGTG | TTA | chr3 | 120679438 | 120679459 | 120679443 | 120679438 | - |
| SEQ ID NO 33815 | AGCCTACTGCGATAATGTGCAA | TTC | chr3 | 120679435 | 120679456 | 120679440 | 120679435 | - |
| SEQ ID NO 33816 | CTGCGATAATGTGCAAGTTCCC | CTA | chr3 | 120679429 | 120679450 | 120679434 | 120679429 | - |
| SEQ ID NO 33817 | CGATAATGTGCAAGTTCCCTTT | CTG | chr3 | 120679426 | 120679447 | 120679431 | 120679426 | - |
| SEQ ID NO 33818 | CCTTTACAATCTATGTTCTATG | TTC | chr3 | 120679409 | 120679430 | 120679414 | 120679409 | - |
| SEQ ID NO 33819 | TACAATCTATGTTCTATGTTCC | CTT | chr3 | 120679405 | 120679426 | 120679410 | 120679405 | - |
| SEQ ID NO 33820 | ACAATCTATGTTCTATGTTCCC | TTT | chr3 | 120679404 | 120679425 | 120679409 | 120679404 | - |
| SEQ ID NO 33821 | CAATCTATGTTCTATGTTCCCA | TTA | chr3 | 120679403 | 120679424 | 120679408 | 120679403 | - |
| SEQ ID NO 33822 | TGTTCTATGTTCCCATCAAGGT | CTA | chr3 | 120679396 | 120679417 | 120679401 | 120679396 | - |

Figure 54 (Cont'd)

| SEQ ID NO 33823 | TATGTTCCCATCAAGGTTAATT | TTC | chr3 | 120679391 | 120679412 | 120679396 | 120679391 | - |
|---|---|---|---|---|---|---|---|---|
| SEQ ID NO 33824 | TGTTCCCATCAAGGTTAATTAG | CTA | chr3 | 120679389 | 120679410 | 120679394 | 120679389 | - |
| SEQ ID NO 33825 | CCATCAAGGTTAATTAGAAATA | TTC | chr3 | 120679384 | 120679405 | 120679389 | 120679384 | - |
| SEQ ID NO 33826 | ATTAGAAATATTAGACTCTTTT | TTA | chr3 | 120679372 | 120679393 | 120679377 | 120679372 | - |
| SEQ ID NO 33827 | GAAATATTAGACTCTTTTTCCA | TTA | chr3 | 120679368 | 120679389 | 120679373 | 120679368 | - |
| SEQ ID NO 33828 | GACTCTTTTTCCACAGAAAAAA | TTA | chr3 | 120679359 | 120679380 | 120679364 | 120679359 | - |
| SEQ ID NO 33829 | TTTTTCCACAGAAAAAAAAAAT | CTC | chr3 | 120679354 | 120679375 | 120679359 | 120679354 | - |
| SEQ ID NO 33830 | TTTCCACAGAAAAAAAAATGT | CTT | chr3 | 120679352 | 120679373 | 120679357 | 120679352 | - |
| SEQ ID NO 33831 | TTCCACAGAAAAAAAAATGTA | TTT | chr3 | 120679351 | 120679372 | 120679356 | 120679351 | - |
| SEQ ID NO 33832 | TCCACAGAAAAAAAAATGTAG | TTT | chr3 | 120679350 | 120679371 | 120679355 | 120679350 | - |
| SEQ ID NO 33833 | CCACAGAAAAAAAAATGTAGC | TTT | chr3 | 120679349 | 120679370 | 120679354 | 120679349 | - |
| SEQ ID NO 33834 | CACAGAAAAAAAAATGTAGCA | TTC | chr3 | 120679348 | 120679369 | 120679353 | 120679348 | - |
| SEQ ID NO 33835 | CATCTCTACCCTGACTTCTCTC | TTT | chr3 | 120679319 | 120679340 | 120679324 | 120679319 | - |
| SEQ ID NO 33836 | ATCTCTACCCTGACTTCTCTCT | TTC | chr3 | 120679318 | 120679339 | 120679323 | 120679318 | - |
| SEQ ID NO 33837 | TACCCTGACTTCTCTCTCTTTC | CTC | chr3 | 120679313 | 120679334 | 120679318 | 120679313 | - |
| SEQ ID NO 33838 | CCCTGACTTCTCTCTCTTTCCT | CTA | chr3 | 120679311 | 120679332 | 120679316 | 120679311 | - |
| SEQ ID NO 33839 | ACTTCTCTCTCTTTCCTTCATG | CTG | chr3 | 120679306 | 120679327 | 120679311 | 120679306 | - |
| SEQ ID NO 33840 | CTCTCTCTTTCCTTCATGCCCA | CTT | chr3 | 120679302 | 120679323 | 120679307 | 120679302 | - |
| SEQ ID NO 33841 | TCTCTCTTTCCTTCATGCCCAG | TTC | chr3 | 120679301 | 120679322 | 120679306 | 120679301 | - |
| SEQ ID NO 33842 | TCTCTTTCCTTCATGCCCAGTA | CTC | chr3 | 120679299 | 120679320 | 120679304 | 120679299 | - |
| SEQ ID NO 33843 | TCTTTCCTTCATGCCCAGTAAG | CTC | chr3 | 120679297 | 120679318 | 120679302 | 120679297 | - |
| SEQ ID NO 33844 | TTTCCTTCATGCCCAGTAAGAG | CTC | chr3 | 120679295 | 120679316 | 120679300 | 120679295 | - |
| SEQ ID NO 33845 | TCCTTCATGCCCAGTAAGAGGA | CTT | chr3 | 120679293 | 120679314 | 120679298 | 120679293 | - |
| SEQ ID NO 33846 | CCTTCATGCCCAGTAAGAGGAA | TTT | chr3 | 120679292 | 120679313 | 120679297 | 120679292 | - |
| SEQ ID NO 33847 | CTTCATGCCCAGTAAGAGGAAG | TTC | chr3 | 120679291 | 120679312 | 120679296 | 120679291 | - |
| SEQ ID NO 33848 | CATGCCCAGTAAGAGGAAGTGA | CTT | chr3 | 120679288 | 120679309 | 120679293 | 120679288 | - |
| SEQ ID NO 33849 | ATGCCCAGTAAGAGGAAGTGAG | TTC | chr3 | 120679287 | 120679308 | 120679292 | 120679287 | - |
| SEQ ID NO 33850 | TTCATCTCATCAGGTGTTACCT | CTG | chr3 | 120679253 | 120679274 | 120679258 | 120679253 | - |
| SEQ ID NO 33851 | ATCTCATCAGGTGTTACCTAGA | TTC | chr3 | 120679250 | 120679271 | 120679255 | 120679250 | - |
| SEQ ID NO 33852 | ATCAGGTGTTACCTAGAATCAG | CTC | chr3 | 120679245 | 120679266 | 120679250 | 120679245 | - |
| SEQ ID NO 33853 | CCTAGAATCAGAGTCAGGAGAA | TTA | chr3 | 120679234 | 120679255 | 120679239 | 120679234 | - |
| SEQ ID NO 33854 | GAATCAGAGTCAGGAGAAAGCA | CTA | chr3 | 120679230 | 120679251 | 120679235 | 120679230 | - |
| SEQ ID NO 33855 | ATAAAACTACTCTGACAAGTAA | CTC | chr3 | 120679204 | 120679225 | 120679209 | 120679204 | - |
| SEQ ID NO 33856 | CTCTGACAAGTAAACCATATCC | CTA | chr3 | 120679195 | 120679216 | 120679200 | 120679195 | - |
| SEQ ID NO 33857 | TGACAAGTAAACCATATCCTGG | CTC | chr3 | 120679192 | 120679213 | 120679197 | 120679192 | - |
| SEQ ID NO 33858 | ACAAGTAAACCATATCCTGGGG | CTG | chr3 | 120679190 | 120679211 | 120679195 | 120679190 | - |
| SEQ ID NO 33859 | GGGACCAGGTGAGAATTAAAAA | CTG | chr3 | 120679171 | 120679192 | 120679176 | 120679171 | - |
| SEQ ID NO 33860 | AAAAGCTGTATACTCATAAGCT | TTA | chr3 | 120679153 | 120679174 | 120679158 | 120679153 | - |
| SEQ ID NO 33861 | TATACTCATAAGCTGCCAAAGA | CTG | chr3 | 120679145 | 120679166 | 120679150 | 120679145 | - |
| SEQ ID NO 33862 | ATAAGCTGCCAAAGAGCTGATG | CTC | chr3 | 120679138 | 120679159 | 120679143 | 120679138 | - |
| SEQ ID NO 33863 | CCAAAGAGCTGATGGTACTGAA | CTG | chr3 | 120679130 | 120679151 | 120679135 | 120679130 | - |
| SEQ ID NO 33864 | ATGGTACTGAAGTCACATGGAG | CTG | chr3 | 120679119 | 120679140 | 120679124 | 120679119 | - |
| SEQ ID NO 33865 | AAGTCACATGGAGCTCAGGAAT | CTG | chr3 | 120679110 | 120679131 | 120679115 | 120679110 | - |
| SEQ ID NO 33866 | AGGAATTTATTCTTGCATTTAG | CTC | chr3 | 120679094 | 120679115 | 120679099 | 120679094 | - |
| SEQ ID NO 33867 | ATTCTTGCATTTAGAAAGTATG | TTT | chr3 | 120679086 | 120679107 | 120679091 | 120679086 | - |
| SEQ ID NO 33868 | TTCTTGCATTTAGAAAGTATGC | TTA | chr3 | 120679085 | 120679106 | 120679090 | 120679085 | - |
| SEQ ID NO 33869 | TTGCATTTAGAAAGTATGCATA | TTC | chr3 | 120679082 | 120679103 | 120679087 | 120679082 | - |
| SEQ ID NO 33870 | GCATTTAGAAAGTATGCATATA | CTT | chr3 | 120679080 | 120679101 | 120679085 | 120679080 | - |
| SEQ ID NO 33871 | CATTTAGAAAGTATGCATATAA | TTG | chr3 | 120679079 | 120679100 | 120679084 | 120679079 | - |
| SEQ ID NO 33872 | AGAAAGTATGCATATAATTCTC | TTT | chr3 | 120679074 | 120679095 | 120679079 | 120679074 | - |
| SEQ ID NO 33873 | GAAAGTATGCATATAATTCTCT | TTA | chr3 | 120679073 | 120679094 | 120679078 | 120679073 | - |
| SEQ ID NO 33874 | TCTCGAAAAGAAATGAAATCAT | TTC | chr3 | 120679054 | 120679075 | 120679059 | 120679054 | - |
| SEQ ID NO 33875 | TCGAAAAGAAATGAAATCATAT | CTC | chr3 | 120679052 | 120679073 | 120679057 | 120679052 | - |
| SEQ ID NO 33876 | GAAAAGAAATGAAATCATATTT | CTC | chr3 | 120679050 | 120679071 | 120679055 | 120679050 | - |
| SEQ ID NO 33877 | TTCTGTCGGATCAAATTATTCA | TTT | chr3 | 120679028 | 120679049 | 120679033 | 120679028 | - |
| SEQ ID NO 33878 | TCTGTCGGATCAAATTATTCAG | TTT | chr3 | 120679027 | 120679048 | 120679032 | 120679027 | - |
| SEQ ID NO 33879 | CTGTCGGATCAAATTATTCAGA | TTT | chr3 | 120679026 | 120679047 | 120679031 | 120679026 | - |
| SEQ ID NO 33880 | TGTCGGATCAAATTATTCAGAA | TTC | chr3 | 120679025 | 120679046 | 120679030 | 120679025 | - |
| SEQ ID NO 33881 | TCGGATCAAATTATTCAGAAAT | CTG | chr3 | 120679023 | 120679044 | 120679028 | 120679023 | - |

Figure 54 (Cont'd)

| | | | | | | | | |
|---|---|---|---|---|---|---|---|---|
| SEQ ID NO 33882 | TTCAGAAATCCGAACTGTAGAA | TTA | chr3 | 120679010 | 120679031 | 120679015 | 120679010 | - |
| SEQ ID NO 33883 | AGAAATCCGAACTGTAGAAAAC | TTC | chr3 | 120679007 | 120679028 | 120679012 | 120679007 | - |
| SEQ ID NO 33884 | TAGAAAACATACAAACACACTT | CTG | chr3 | 120678993 | 120679014 | 120678998 | 120678993 | - |
| SEQ ID NO 33885 | GCTTAATGTTAGCTTTTTAATC | CTT | chr3 | 120678971 | 120678992 | 120678976 | 120678971 | - |
| SEQ ID NO 33886 | CTTAATGTTAGCTTTTTAATCT | TTG | chr3 | 120678970 | 120678991 | 120678975 | 120678970 | - |
| SEQ ID NO 33887 | AATGTTAGCTTTTTAATCTTAT | CTT | chr3 | 120678967 | 120678988 | 120678972 | 120678967 | - |
| SEQ ID NO 33888 | ATGTTAGCTTTTTAATCTTATT | TTA | chr3 | 120678966 | 120678987 | 120678971 | 120678966 | - |
| SEQ ID NO 33889 | GCTTTTTAATCTTATTTTTGTA | TTA | chr3 | 120678960 | 120678981 | 120678965 | 120678960 | - |
| SEQ ID NO 33890 | TTTAATCTTATTTTTGTACACA | CTT | chr3 | 120678956 | 120678977 | 120678961 | 120678956 | - |
| SEQ ID NO 33891 | TTAATCTTATTTTTGTACACAG | TTT | chr3 | 120678955 | 120678976 | 120678960 | 120678955 | - |
| SEQ ID NO 33892 | TAATCTTATTTTTGTACACAGT | TTT | chr3 | 120678954 | 120678975 | 120678959 | 120678954 | - |
| SEQ ID NO 33893 | AATCTTATTTTTGTACACAGTA | TTT | chr3 | 120678953 | 120678974 | 120678958 | 120678953 | - |
| SEQ ID NO 33894 | ATCTTATTTTTGTACACAGTAT | TTA | chr3 | 120678952 | 120678973 | 120678957 | 120678952 | - |
| SEQ ID NO 33895 | ATTTTTGTACACAGTATACTTT | CTT | chr3 | 120678947 | 120678968 | 120678952 | 120678947 | - |
| SEQ ID NO 33896 | TTTTTGTACACAGTATACTTTT | TTA | chr3 | 120678946 | 120678967 | 120678951 | 120678946 | - |
| SEQ ID NO 33897 | TTGTACACAGTATACTTTTACA | TTT | chr3 | 120678943 | 120678964 | 120678948 | 120678943 | - |
| SEQ ID NO 33898 | TGTACACAGTATACTTTTACAT | TTT | chr3 | 120678942 | 120678963 | 120678947 | 120678942 | - |
| SEQ ID NO 33899 | GTACACAGTATACTTTTACATA | TTT | chr3 | 120678941 | 120678962 | 120678946 | 120678941 | - |
| SEQ ID NO 33900 | TACACAGTATACTTTTACATAG | TTG | chr3 | 120678940 | 120678961 | 120678945 | 120678940 | - |
| SEQ ID NO 33901 | TTACATAGGCACTGAACCAGCT | CTT | chr3 | 120678926 | 120678947 | 120678931 | 120678926 | - |
| SEQ ID NO 33902 | TACATAGGCACTGAACCAGCTG | TTT | chr3 | 120678925 | 120678946 | 120678930 | 120678925 | - |
| SEQ ID NO 33903 | ACATAGGCACTGAACCAGCTGG | TTT | chr3 | 120678924 | 120678945 | 120678929 | 120678924 | - |
| SEQ ID NO 33904 | CATAGGCACTGAACCAGCTGGA | TTA | chr3 | 120678923 | 120678944 | 120678928 | 120678923 | - |
| SEQ ID NO 33905 | AACCAGCTGGAAATGAATGCTT | CTG | chr3 | 120678912 | 120678933 | 120678917 | 120678912 | - |
| SEQ ID NO 33906 | GAAATGAATGCTTGGATTTTCG | CTG | chr3 | 120678903 | 120678924 | 120678908 | 120678903 | - |
| SEQ ID NO 33907 | GGATTTTCGCAGCTGATAAAAG | CTT | chr3 | 120678890 | 120678911 | 120678895 | 120678890 | - |
| SEQ ID NO 33908 | GATTTTCGCAGCTGATAAAAGC | TTG | chr3 | 120678889 | 120678910 | 120678894 | 120678889 | - |
| SEQ ID NO 33909 | TCGCAGCTGATAAAAGCAGAGT | TTT | chr3 | 120678884 | 120678905 | 120678889 | 120678884 | - |
| SEQ ID NO 33910 | CGCAGCTGATAAAAGCAGAGTT | TTT | chr3 | 120678883 | 120678904 | 120678888 | 120678883 | - |
| SEQ ID NO 33911 | GCAGCTGATAAAAGCAGAGTTC | TTC | chr3 | 120678882 | 120678903 | 120678887 | 120678882 | - |
| SEQ ID NO 33912 | ATAAAAGCAGAGTTCAGATTCT | CTG | chr3 | 120678875 | 120678896 | 120678880 | 120678875 | - |
| SEQ ID NO 33913 | AGATTCTGTCCTTGAGCTCAAT | TTC | chr3 | 120678860 | 120678881 | 120678865 | 120678860 | - |
| SEQ ID NO 33914 | TGTCCTTGAGCTCAATGTCTGG | TTC | chr3 | 120678854 | 120678875 | 120678859 | 120678854 | - |
| SEQ ID NO 33915 | TCCTTGAGCTCAATGTCTGGAG | CTG | chr3 | 120678852 | 120678873 | 120678857 | 120678852 | - |
| SEQ ID NO 33916 | GAGCTCAATGTCTGGAGAAAGC | CTT | chr3 | 120678847 | 120678868 | 120678852 | 120678847 | - |
| SEQ ID NO 33917 | AGCTCAATGTCTGGAGAAAGCA | TTG | chr3 | 120678846 | 120678867 | 120678851 | 120678846 | - |
| SEQ ID NO 33918 | AATGTCTGGAGAAAGCAGCTGT | CTC | chr3 | 120678841 | 120678862 | 120678846 | 120678841 | - |
| SEQ ID NO 33919 | GAGAAAGCAGCTGTGAATACTG | CTG | chr3 | 120678833 | 120678854 | 120678838 | 120678833 | - |
| SEQ ID NO 33920 | TGAATACTGCTTCCTTAATTCA | CTG | chr3 | 120678820 | 120678841 | 120678825 | 120678820 | - |
| SEQ ID NO 33921 | CTTCCTTAATTCAGATGCCTTT | CTG | chr3 | 120678811 | 120678832 | 120678816 | 120678811 | - |
| SEQ ID NO 33922 | CCTTAATTCAGATGCCTTTGGC | CTT | chr3 | 120678808 | 120678829 | 120678813 | 120678808 | - |
| SEQ ID NO 33923 | CTTAATTCAGATGCCTTTGGCC | TTC | chr3 | 120678807 | 120678828 | 120678812 | 120678807 | - |
| SEQ ID NO 33924 | AATTCAGATGCCTTTGGCCGTG | CTT | chr3 | 120678804 | 120678825 | 120678809 | 120678804 | - |
| SEQ ID NO 33925 | ATTCAGATGCCTTTGGCCGTGA | TTA | chr3 | 120678803 | 120678824 | 120678808 | 120678803 | - |
| SEQ ID NO 33926 | AGATGCCTTTGGCCGTGAGGGG | TTC | chr3 | 120678799 | 120678820 | 120678804 | 120678799 | - |
| SEQ ID NO 33927 | TGGCCGTGAGGGGCATGGCATT | CTT | chr3 | 120678790 | 120678811 | 120678795 | 120678790 | - |
| SEQ ID NO 33928 | GGCCGTGAGGGGCATGGCATTT | TTT | chr3 | 120678789 | 120678810 | 120678794 | 120678789 | - |
| SEQ ID NO 33929 | GCCGTGAGGGGCATGGCATTTT | TTG | chr3 | 120678788 | 120678809 | 120678793 | 120678788 | - |
| SEQ ID NO 33930 | TAAAGCTGCAATAAACTCTGTA | TTT | chr3 | 120678767 | 120678788 | 120678772 | 120678767 | - |
| SEQ ID NO 33931 | AAAGCTGCAATAAACTCTGTAC | TTT | chr3 | 120678766 | 120678787 | 120678771 | 120678766 | - |
| SEQ ID NO 33932 | AAGCTGCAATAAACTCTGTACT | TTA | chr3 | 120678765 | 120678786 | 120678770 | 120678765 | - |
| SEQ ID NO 33933 | CAATAAACTCTGTACTTTTTCT | CTG | chr3 | 120678759 | 120678780 | 120678764 | 120678759 | - |
| SEQ ID NO 33934 | TGTACTTTTTCTCTCAGGGGAT | CTC | chr3 | 120678749 | 120678770 | 120678754 | 120678749 | - |
| SEQ ID NO 33935 | TACTTTTTCTCTCAGGGGATTA | CTG | chr3 | 120678747 | 120678768 | 120678752 | 120678747 | - |
| SEQ ID NO 33936 | TTTCTCTCAGGGGATTAGAAAA | CTT | chr3 | 120678742 | 120678763 | 120678747 | 120678742 | - |
| SEQ ID NO 33937 | TTCTCTCAGGGGATTAGAAAAA | TTT | chr3 | 120678741 | 120678762 | 120678746 | 120678741 | - |
| SEQ ID NO 33938 | TCTCTCAGGGGATTAGAAAAAC | TTT | chr3 | 120678740 | 120678761 | 120678745 | 120678740 | - |
| SEQ ID NO 33939 | CTCTCAGGGGATTAGAAAAACC | TTT | chr3 | 120678739 | 120678760 | 120678744 | 120678739 | - |
| SEQ ID NO 33940 | TCTCAGGGGATTAGAAAAACCA | TTC | chr3 | 120678738 | 120678759 | 120678743 | 120678738 | - |

Figure 54 (Cont'd)

| SEQ ID NO | Sequence | Codon | Chr | Pos1 | Pos2 | Pos3 | Pos4 | |
|---|---|---|---|---|---|---|---|---|
| SEQ ID NO 33941 | TCAGGGGATTAGAAAAACCAAT | CTC | chr3 | 120678736 | 120678757 | 120678741 | 120678736 | - |
| SEQ ID NO 33942 | AGGGGATTAGAAAAACCAATTG | CTC | chr3 | 120678734 | 120678755 | 120678739 | 120678734 | - |
| SEQ ID NO 33943 | GAAAAACCAATTGATTTGATAG | TTA | chr3 | 120678725 | 120678746 | 120678730 | 120678725 | - |
| SEQ ID NO 33944 | ATTTGATAGTGACTCAGCAGTT | TTG | chr3 | 120678712 | 120678733 | 120678717 | 120678712 | - |
| SEQ ID NO 33945 | GATAGTGACTCAGCAGTTTTCA | TTT | chr3 | 120678708 | 120678729 | 120678713 | 120678708 | - |
| SEQ ID NO 33946 | ATAGTGACTCAGCAGTTTTCAC | TTG | chr3 | 120678707 | 120678728 | 120678712 | 120678707 | - |
| SEQ ID NO 33947 | AGCAGTTTTCACCTTCCTCTTT | CTC | chr3 | 120678697 | 120678718 | 120678702 | 120678697 | - |
| SEQ ID NO 33948 | TCACCTTCCTCTTTAGCCAATG | TTT | chr3 | 120678689 | 120678710 | 120678694 | 120678689 | - |
| SEQ ID NO 33949 | CACCTTCCTCTTTAGCCAATGC | TTT | chr3 | 120678688 | 120678709 | 120678693 | 120678688 | - |
| SEQ ID NO 33950 | ACCTTCCTCTTTAGCCAATGCC | TTC | chr3 | 120678687 | 120678708 | 120678692 | 120678687 | - |
| SEQ ID NO 33951 | CCTCTTTAGCCAATGCCCTGCA | CTT | chr3 | 120678682 | 120678703 | 120678687 | 120678682 | - |
| SEQ ID NO 33952 | CTCTTTAGCCAATGCCCTGCAG | TTC | chr3 | 120678681 | 120678702 | 120678686 | 120678681 | - |
| SEQ ID NO 33953 | TTTAGCCAATGCCCTGCAGCTA | CTC | chr3 | 120678678 | 120678699 | 120678683 | 120678678 | - |
| SEQ ID NO 33954 | TAGCCAATGCCCTGCAGCTAAG | CTT | chr3 | 120678676 | 120678697 | 120678681 | 120678676 | - |
| SEQ ID NO 33955 | AGCCAATGCCCTGCAGCTAAGA | TTT | chr3 | 120678675 | 120678696 | 120678680 | 120678675 | - |
| SEQ ID NO 33956 | GCCAATGCCCTGCAGCTAAGAT | TTA | chr3 | 120678674 | 120678695 | 120678679 | 120678674 | - |
| SEQ ID NO 33957 | CAGCTAAGATTGAGAAACGGAT | CTG | chr3 | 120678662 | 120678683 | 120678667 | 120678662 | - |
| SEQ ID NO 33958 | AGATTGAGAAACGGATTCAGAA | CTA | chr3 | 120678656 | 120678677 | 120678661 | 120678656 | - |
| SEQ ID NO 33959 | AGAAACGGATTCAGAACTCACA | TTG | chr3 | 120678650 | 120678671 | 120678655 | 120678650 | - |
| SEQ ID NO 33960 | AGAACTCACACCTCTTGGTGCT | TTC | chr3 | 120678638 | 120678659 | 120678643 | 120678638 | - |
| SEQ ID NO 33961 | ACACCTCTTGGTGCTTGGTGGC | CTC | chr3 | 120678631 | 120678652 | 120678636 | 120678631 | - |
| SEQ ID NO 33962 | TTGGTGCTTGGTGGCTCCCTTC | CTC | chr3 | 120678624 | 120678645 | 120678629 | 120678624 | - |
| SEQ ID NO 33963 | GGTGCTTGGTGGCTCCCTTCCA | CTT | chr3 | 120678622 | 120678643 | 120678627 | 120678622 | - |
| SEQ ID NO 33964 | GTGCTTGGTGGCTCCCTTCCAA | TTG | chr3 | 120678621 | 120678642 | 120678626 | 120678621 | - |
| SEQ ID NO 33965 | GGTGGCTCCCTTCCAAACCATC | CTT | chr3 | 120678615 | 120678636 | 120678620 | 120678615 | - |
| SEQ ID NO 33966 | GTGGCTCCCTTCCAAACCATCA | TTG | chr3 | 120678614 | 120678635 | 120678619 | 120678614 | - |
| SEQ ID NO 33967 | CCTTCCAAACCATCAGCTGTTC | CTC | chr3 | 120678607 | 120678628 | 120678612 | 120678607 | - |
| SEQ ID NO 33968 | CCAAACCATCAGCTGTTCTTTC | CTT | chr3 | 120678603 | 120678624 | 120678608 | 120678603 | - |
| SEQ ID NO 33969 | CAAACCATCAGCTGTTCTTTCT | TTC | chr3 | 120678602 | 120678623 | 120678607 | 120678602 | - |
| SEQ ID NO 33970 | TTCTTTCTACTTTCTTTCCTAT | CTG | chr3 | 120678588 | 120678609 | 120678593 | 120678588 | - |
| SEQ ID NO 33971 | TTTCTACTTTCTTTCCTATTTT | TTC | chr3 | 120678585 | 120678606 | 120678590 | 120678585 | - |
| SEQ ID NO 33972 | TCTACTTTCTTTCCTATTTTTT | CTT | chr3 | 120678583 | 120678604 | 120678588 | 120678583 | - |
| SEQ ID NO 33973 | CTACTTTCTTTCCTATTTTTTA | TTT | chr3 | 120678582 | 120678603 | 120678587 | 120678582 | - |
| SEQ ID NO 33974 | TACTTTCTTTCCTATTTTTTAA | TTC | chr3 | 120678581 | 120678602 | 120678586 | 120678581 | - |
| SEQ ID NO 33975 | CTTTCTTTCCTATTTTTTAAAG | CTA | chr3 | 120678579 | 120678600 | 120678584 | 120678579 | - |
| SEQ ID NO 33976 | TCTTTCCTATTTTTTAAAGCAC | CTT | chr3 | 120678576 | 120678597 | 120678581 | 120678576 | - |
| SEQ ID NO 33977 | CTTTCCTATTTTTTAAAGCACA | TTT | chr3 | 120678575 | 120678596 | 120678580 | 120678575 | - |
| SEQ ID NO 33978 | TTTCCTATTTTTTAAAGCACAG | TTC | chr3 | 120678574 | 120678595 | 120678579 | 120678574 | - |
| SEQ ID NO 33979 | TCCTATTTTTTAAAGCACAGTC | CTT | chr3 | 120678572 | 120678593 | 120678577 | 120678572 | - |
| SEQ ID NO 33980 | CCTATTTTTTAAAGCACAGTCT | TTT | chr3 | 120678571 | 120678592 | 120678576 | 120678571 | - |
| SEQ ID NO 33981 | CTATTTTTTAAAGCACAGTCTG | TTC | chr3 | 120678570 | 120678591 | 120678575 | 120678570 | - |
| SEQ ID NO 33982 | TTTTTTAAAGCACAGTCTGAAT | CTA | chr3 | 120678567 | 120678588 | 120678572 | 120678567 | - |
| SEQ ID NO 33983 | TTTAAAGCACAGTCTGAATCAA | TTT | chr3 | 120678564 | 120678585 | 120678569 | 120678564 | - |
| SEQ ID NO 33984 | TTAAAGCACAGTCTGAATCAAG | TTT | chr3 | 120678563 | 120678584 | 120678568 | 120678563 | - |
| SEQ ID NO 33985 | TAAAGCACAGTCTGAATCAAGT | TTT | chr3 | 120678562 | 120678583 | 120678567 | 120678562 | - |
| SEQ ID NO 33986 | AAAGCACAGTCTGAATCAAGTG | TTT | chr3 | 120678561 | 120678582 | 120678566 | 120678561 | - |
| SEQ ID NO 33987 | AAGCACAGTCTGAATCAAGTGC | TTA | chr3 | 120678560 | 120678581 | 120678565 | 120678560 | - |
| SEQ ID NO 33988 | AATCAAGTGCTTCAGAACCATT | CTG | chr3 | 120678548 | 120678569 | 120678553 | 120678548 | - |
| SEQ ID NO 33989 | CAGAACCATTTATACTAACTCT | CTT | chr3 | 120678536 | 120678557 | 120678541 | 120678536 | - |
| SEQ ID NO 33990 | AGAACCATTTATACTAACTCGT | TTC | chr3 | 120678535 | 120678556 | 120678540 | 120678535 | - |
| SEQ ID NO 33991 | ATACTAACTCGTGTTCCAAACA | TTT | chr3 | 120678525 | 120678546 | 120678530 | 120678525 | - |
| SEQ ID NO 33992 | TACTAACTCGTGTTCCAAACAC | TTA | chr3 | 120678524 | 120678545 | 120678529 | 120678524 | - |
| SEQ ID NO 33993 | ACTCGTGTTCCAAACACATAAC | CTA | chr3 | 120678519 | 120678540 | 120678524 | 120678519 | - |
| SEQ ID NO 33994 | GTGTTCCAAACACATAACCCTG | CTC | chr3 | 120678515 | 120678536 | 120678520 | 120678515 | - |
| SEQ ID NO 33995 | CAAACACATAACCCTGAACCCT | TTC | chr3 | 120678509 | 120678530 | 120678514 | 120678509 | - |
| SEQ ID NO 33996 | AACCCTCTTCTAAGGCCACCAG | CTG | chr3 | 120678493 | 120678514 | 120678498 | 120678493 | - |
| SEQ ID NO 33997 | TTCTAAGGCCACCAGTTACAAA | CTC | chr3 | 120678486 | 120678507 | 120678491 | 120678486 | - |
| SEQ ID NO 33998 | CTAAGGCCACCAGTTACAAAGA | CTT | chr3 | 120678484 | 120678505 | 120678489 | 120678484 | - |
| SEQ ID NO 33999 | TAAGGCCACCAGTTACAAAGAA | TTC | chr3 | 120678483 | 120678504 | 120678488 | 120678483 | - |

Figure 54 (Cont'd)

| | | | | | | | |
|---|---|---|---|---|---|---|---|
| SEQ ID NO 34000 | AGGCCACCAGTTACAAAGAATG | CTA | chr3 | 120678481 | 120678502 | 120678486 | 120678481 | - |
| SEQ ID NO 34001 | CAAAGAATGGGGAAGGTTAATG | TTA | chr3 | 120678468 | 120678489 | 120678473 | 120678468 | - |
| SEQ ID NO 34002 | ATGAGTAACTCCACCAGTGCCT | TTA | chr3 | 120678449 | 120678470 | 120678454 | 120678449 | - |
| SEQ ID NO 34003 | CACCAGTGCCTGCCAGAAAGCT | CTC | chr3 | 120678438 | 120678459 | 120678443 | 120678438 | - |
| SEQ ID NO 34004 | CCAGAAAGCTCAGCTGTACTCC | CTG | chr3 | 120678426 | 120678447 | 120678431 | 120678426 | - |
| SEQ ID NO 34005 | AGCTGTACTCCAGCCTTCCTTC | CTC | chr3 | 120678415 | 120678436 | 120678420 | 120678415 | - |
| SEQ ID NO 34006 | TACTCCAGCCTTCCTTCCTCTC | CTG | chr3 | 120678410 | 120678431 | 120678415 | 120678410 | - |
| SEQ ID NO 34007 | CAGCCTTCCTTCCTCTCTTGCA | CTC | chr3 | 120678405 | 120678426 | 120678410 | 120678405 | - |
| SEQ ID NO 34008 | CCTTCCTCTCTTGCAGAGAGAA | CTT | chr3 | 120678398 | 120678419 | 120678403 | 120678398 | - |
| SEQ ID NO 34009 | CTTCCTCTCTTGCAGAGAGAAA | TTC | chr3 | 120678397 | 120678418 | 120678402 | 120678397 | - |
| SEQ ID NO 34010 | CCTCTCTTGCAGAGAGAAACAA | CTT | chr3 | 120678394 | 120678415 | 120678399 | 120678394 | - |
| SEQ ID NO 34011 | CTCTCTTGCAGAGAGAAACAAT | TTC | chr3 | 120678393 | 120678414 | 120678398 | 120678393 | - |
| SEQ ID NO 34012 | TCTTGCAGAGAGAAACAATGCG | CTC | chr3 | 120678390 | 120678411 | 120678395 | 120678390 | - |
| SEQ ID NO 34013 | TTGCAGAGAGAAACAATGCGGC | CTC | chr3 | 120678388 | 120678409 | 120678393 | 120678388 | - |
| SEQ ID NO 34014 | GCAGAGAGAAACAATGCGGCAG | CTT | chr3 | 120678386 | 120678407 | 120678391 | 120678386 | - |
| SEQ ID NO 34015 | CAGAGAGAAACAATGCGGCAGT | TTG | chr3 | 120678385 | 120678406 | 120678390 | 120678385 | - |
| SEQ ID NO 34016 | AACAAAGCGAAGGCACTGTAAT | TTG | chr3 | 120678361 | 120678382 | 120678366 | 120678361 | - |
| SEQ ID NO 34017 | TAATGCCCAGTGGCTTCAGTCA | CTG | chr3 | 120678343 | 120678364 | 120678348 | 120678343 | - |
| SEQ ID NO 34018 | CAGTCACAGGCTGGTCTAAAAT | CTT | chr3 | 120678327 | 120678348 | 120678332 | 120678327 | - |
| SEQ ID NO 34019 | AGTCACAGGCTGGTCTAAAATT | TTC | chr3 | 120678326 | 120678347 | 120678331 | 120678326 | - |
| SEQ ID NO 34020 | GTCTAAAATTCCATTTCACAGA | CTG | chr3 | 120678314 | 120678335 | 120678319 | 120678314 | - |
| SEQ ID NO 34021 | AAATTCCATTTCACAGAATTGA | CTA | chr3 | 120678309 | 120678330 | 120678314 | 120678309 | - |
| SEQ ID NO 34022 | CATTTCACAGAATTGAAGATAA | TTC | chr3 | 120678303 | 120678324 | 120678308 | 120678303 | - |
| SEQ ID NO 34023 | CACAGAATTGAAGATAATTTGG | TTT | chr3 | 120678298 | 120678319 | 120678303 | 120678298 | - |
| SEQ ID NO 34024 | ACAGAATTGAAGATAATTTGGG | TTC | chr3 | 120678297 | 120678318 | 120678302 | 120678297 | - |
| SEQ ID NO 34025 | AAGATAATTTGGGGTTATTACC | TTG | chr3 | 120678288 | 120678309 | 120678293 | 120678288 | - |
| SEQ ID NO 34026 | GGGGTTATTACCAATTCTCAGC | TTT | chr3 | 120678278 | 120678299 | 120678283 | 120678278 | - |
| SEQ ID NO 34027 | GGGTTATTACCAATTCTCAGCA | TTG | chr3 | 120678277 | 120678298 | 120678282 | 120678277 | - |
| SEQ ID NO 34028 | TTACCAATTCTCAGCAGCTCAA | TTA | chr3 | 120678271 | 120678292 | 120678276 | 120678271 | - |
| SEQ ID NO 34029 | CCAATTCTCAGCAGCTCAAATT | TTA | chr3 | 120678268 | 120678289 | 120678273 | 120678268 | - |
| SEQ ID NO 34030 | TCAGCAGCTCAAATTCAATCCC | TTC | chr3 | 120678261 | 120678282 | 120678266 | 120678261 | - |
| SEQ ID NO 34031 | AGCAGCTCAAATTCAATCCCGT | CTC | chr3 | 120678259 | 120678280 | 120678264 | 120678259 | - |
| SEQ ID NO 34032 | AAATTCAATCCCGTTGATGGTG | CTC | chr3 | 120678251 | 120678272 | 120678256 | 120678251 | - |
| SEQ ID NO 34033 | AATCCCGTTGATGGTGAGCATG | TTC | chr3 | 120678245 | 120678266 | 120678250 | 120678245 | - |
| SEQ ID NO 34034 | ATGGTGAGCATGGGGGTTCATTT | TTG | chr3 | 120678235 | 120678256 | 120678240 | 120678235 | - |
| SEQ ID NO 34035 | ATTTTGAGAGTAGAAAATTGGA | TTC | chr3 | 120678217 | 120678238 | 120678222 | 120678217 | - |
| SEQ ID NO 34036 | TGAGAGTAGAAAATTGGATGCA | TTT | chr3 | 120678213 | 120678234 | 120678218 | 120678213 | - |
| SEQ ID NO 34037 | GAGAGTAGAAAATTGGATGCAG | TTT | chr3 | 120678212 | 120678233 | 120678217 | 120678212 | - |
| SEQ ID NO 34038 | AGAGTAGAAAATTGGATGCAGT | TTG | chr3 | 120678211 | 120678232 | 120678216 | 120678211 | - |
| SEQ ID NO 34039 | GATGCAGTGGAGAATCAGAATG | TTG | chr3 | 120678197 | 120678218 | 120678202 | 120678197 | - |
| SEQ ID NO 34040 | GATGGTCTCTGCCATTTCCCCA | TTG | chr3 | 120678172 | 120678193 | 120678177 | 120678172 | - |
| SEQ ID NO 34041 | TGCCATTTCCCCAAAGATATCA | CTC | chr3 | 120678163 | 120678184 | 120678168 | 120678163 | - |
| SEQ ID NO 34042 | CCATTTCCCCAAAGATATCATC | CTG | chr3 | 120678161 | 120678182 | 120678166 | 120678161 | - |
| SEQ ID NO 34043 | CCCCAAAGATATCATCCTAACT | TTT | chr3 | 120678155 | 120678176 | 120678160 | 120678155 | - |
| SEQ ID NO 34044 | CCCAAAGATATCATCCTAACTG | TTC | chr3 | 120678154 | 120678175 | 120678159 | 120678154 | - |
| SEQ ID NO 34045 | ACTGCATGCTGCTGCTTTTAAC | CTA | chr3 | 120678136 | 120678157 | 120678141 | 120678136 | - |
| SEQ ID NO 34046 | CATGCTGCTGCTTTTAACAAAT | CTG | chr3 | 120678132 | 120678153 | 120678137 | 120678132 | - |
| SEQ ID NO 34047 | CTGCTTTTAACAAATCAGTATA | CTG | chr3 | 120678125 | 120678146 | 120678130 | 120678125 | - |
| SEQ ID NO 34048 | CTTTTAACAAATCAGTATACAA | CTG | chr3 | 120678122 | 120678143 | 120678127 | 120678122 | - |
| SEQ ID NO 34049 | TTAACAAATCAGTATACAACTT | CTT | chr3 | 120678119 | 120678140 | 120678124 | 120678119 | - |
| SEQ ID NO 34050 | TAACAAATCAGTATACAACTTA | TTT | chr3 | 120678118 | 120678139 | 120678123 | 120678118 | - |
| SEQ ID NO 34051 | AACAAATCAGTATACAACTTAG | TTT | chr3 | 120678117 | 120678138 | 120678122 | 120678117 | - |
| SEQ ID NO 34052 | ACAAATCAGTATACAACTTAGT | TTA | chr3 | 120678116 | 120678137 | 120678121 | 120678116 | - |
| SEQ ID NO 34053 | AGTATTTTTTGTGTTGACAAAT | CTT | chr3 | 120678097 | 120678118 | 120678102 | 120678097 | - |
| SEQ ID NO 34054 | GTATTTTTTGTGTTGACAAATT | TTA | chr3 | 120678096 | 120678117 | 120678101 | 120678096 | - |
| SEQ ID NO 34055 | TTTGTGTTGACAAATTTTCAAA | TTT | chr3 | 120678090 | 120678111 | 120678095 | 120678090 | - |
| SEQ ID NO 34056 | TTGTGTTGACAAATTTTCAAAT | TTT | chr3 | 120678089 | 120678110 | 120678094 | 120678089 | - |
| SEQ ID NO 34057 | TGTGTTGACAAATTTTCAAATA | TTT | chr3 | 120678088 | 120678109 | 120678093 | 120678088 | - |
| SEQ ID NO 34058 | GTGTTGACAAATTTTCAAATAT | TTT | chr3 | 120678087 | 120678108 | 120678092 | 120678087 | - |

Figure 54 (Cont'd)

| SEQ ID NO | Sequence | | | | | | |
|---|---|---|---|---|---|---|---|
| SEQ ID NO 34059 | TGTTGACAAATTTTCAAATATA | TTG | chr3 | 120678086 | 120678107 | 120678091 | 120678086 | - |
| SEQ ID NO 34060 | ACAAATTTTCAAATATACAAAA | TTG | chr3 | 120678081 | 120678102 | 120678086 | 120678081 | - |
| SEQ ID NO 34061 | TCAAATATACAAAATATTGAGT | TTT | chr3 | 120678073 | 120678094 | 120678078 | 120678073 | - |
| SEQ ID NO 34062 | CAAATATACAAAATATTGAGTC | TTT | chr3 | 120678072 | 120678093 | 120678077 | 120678072 | - |
| SEQ ID NO 34063 | AAATATACAAAATATTGAGTCT | TTC | chr3 | 120678071 | 120678092 | 120678076 | 120678071 | - |
| SEQ ID NO 34064 | AGTCTGAAGGCAAAAAGAATAA | TTG | chr3 | 120678054 | 120678075 | 120678059 | 120678054 | - |
| SEQ ID NO 34065 | AAGGCAAAAAGAATAATTTTTC | CTG | chr3 | 120678048 | 120678069 | 120678053 | 120678048 | - |
| SEQ ID NO 34066 | TTCACTTCCATTGCTTCCTAGG | TTT | chr3 | 120678029 | 120678050 | 120678034 | 120678029 | - |
| SEQ ID NO 34067 | TCACTTCCATTGCTTCCTAGGT | TTT | chr3 | 120678028 | 120678049 | 120678033 | 120678028 | - |
| SEQ ID NO 34068 | CACTTCCATTGCTTCCTAGGTC | TTT | chr3 | 120678027 | 120678048 | 120678032 | 120678027 | - |
| SEQ ID NO 34069 | ACTTCCATTGCTTCCTAGGTCA | TTC | chr3 | 120678026 | 120678047 | 120678031 | 120678026 | - |
| SEQ ID NO 34070 | CCATTGCTTCCTAGGTCATAAC | CTT | chr3 | 120678022 | 120678043 | 120678027 | 120678022 | - |
| SEQ ID NO 34071 | CATTGCTTCCTAGGTCATAACA | TTC | chr3 | 120678021 | 120678042 | 120678026 | 120678021 | - |
| SEQ ID NO 34072 | CTTCCTAGGTCATAACATTCAC | TTG | chr3 | 120678016 | 120678037 | 120678021 | 120678016 | - |
| SEQ ID NO 34073 | CCTAGGTCATAACATTCACATC | CTT | chr3 | 120678013 | 120678034 | 120678018 | 120678013 | - |
| SEQ ID NO 34074 | CTAGGTCATAACATTCACATCT | TTC | chr3 | 120678012 | 120678033 | 120678017 | 120678012 | - |
| SEQ ID NO 34075 | GGTCATAACATTCACATCTGAT | CTA | chr3 | 120678009 | 120678030 | 120678014 | 120678009 | - |
| SEQ ID NO 34076 | ACATCTGATATTTCTTCCAAAT | TTC | chr3 | 120677996 | 120678017 | 120678001 | 120677996 | - |
| SEQ ID NO 34077 | ATATTTCTTCCAAATACAGACT | CTG | chr3 | 120677989 | 120678010 | 120677994 | 120677989 | - |
| SEQ ID NO 34078 | CTTCCAAATACAGACTGTTGTT | TTT | chr3 | 120677983 | 120678004 | 120677988 | 120677983 | - |
| SEQ ID NO 34079 | TTCCAAATACAGACTGTTGTTG | TTC | chr3 | 120677982 | 120678003 | 120677987 | 120677982 | - |
| SEQ ID NO 34080 | CCAAATACAGACTGTTGTTGGC | CTT | chr3 | 120677980 | 120678001 | 120677985 | 120677980 | - |
| SEQ ID NO 34081 | CAAATACAGACTGTTGTTGGCC | TTC | chr3 | 120677979 | 120678000 | 120677984 | 120677979 | - |
| SEQ ID NO 34082 | TTGTTGGCCTGATCATCACTCA | CTG | chr3 | 120677966 | 120677987 | 120677971 | 120677966 | - |
| SEQ ID NO 34083 | TTGGCCTGATCATCACTCACAC | TTG | chr3 | 120677963 | 120677984 | 120677968 | 120677963 | - |
| SEQ ID NO 34084 | GCCTGATCATCACTCACACATC | TTG | chr3 | 120677960 | 120677981 | 120677965 | 120677960 | - |
| SEQ ID NO 34085 | ATCATCACTCACACATCCAGGC | CTG | chr3 | 120677955 | 120677976 | 120677960 | 120677955 | - |
| SEQ ID NO 34086 | ACACATCCAGGCTTGTTACATC | CTC | chr3 | 120677945 | 120677966 | 120677950 | 120677945 | - |
| SEQ ID NO 34087 | GTTACATCTCCACGCCACTGAG | CTT | chr3 | 120677931 | 120677952 | 120677936 | 120677931 | - |
| SEQ ID NO 34088 | TTACATCTCCACGCCACTGAGT | TTG | chr3 | 120677930 | 120677951 | 120677935 | 120677930 | - |
| SEQ ID NO 34089 | CATCTCCACGCCACTGAGTATC | TTA | chr3 | 120677927 | 120677948 | 120677932 | 120677927 | - |
| SEQ ID NO 34090 | CACGCCACTGAGTATCAGGGAA | CTC | chr3 | 120677921 | 120677942 | 120677926 | 120677921 | - |
| SEQ ID NO 34091 | AGTATCAGGGAACCTGCCCCAA | CTG | chr3 | 120677911 | 120677932 | 120677916 | 120677911 | - |
| SEQ ID NO 34092 | CCCCAATATTCACGTAGGTTCT | CTG | chr3 | 120677895 | 120677916 | 120677900 | 120677895 | - |
| SEQ ID NO 34093 | ACGTAGGTTCTTTTCTATTTTC | TTC | chr3 | 120677884 | 120677905 | 120677889 | 120677884 | - |
| SEQ ID NO 34094 | TTTTCTATTTTCCCTAAGCGTC | TTC | chr3 | 120677874 | 120677895 | 120677879 | 120677874 | - |
| SEQ ID NO 34095 | TTCTATTTTCCCTAAGCGTCGG | CTT | chr3 | 120677872 | 120677893 | 120677877 | 120677872 | - |
| SEQ ID NO 34096 | TCTATTTTCCCTAAGCGTCGGC | TTT | chr3 | 120677871 | 120677892 | 120677876 | 120677871 | - |
| SEQ ID NO 34097 | CTATTTTCCCTAAGCGTCGGCC | TTT | chr3 | 120677870 | 120677891 | 120677875 | 120677870 | - |
| SEQ ID NO 34098 | TATTTTCCCTAAGCGTCGGCCA | TTC | chr3 | 120677869 | 120677890 | 120677874 | 120677869 | - |
| SEQ ID NO 34099 | TTTTCCCTAAGCGTCGGCCAAC | CTA | chr3 | 120677867 | 120677888 | 120677872 | 120677867 | - |
| SEQ ID NO 34100 | TCCCTAAGCGTCGGCCAACTTT | TTT | chr3 | 120677864 | 120677885 | 120677869 | 120677864 | - |
| SEQ ID NO 34101 | CCCTAAGCGTCGGCCAACTTTA | TTT | chr3 | 120677863 | 120677884 | 120677868 | 120677863 | - |
| SEQ ID NO 34102 | CCTAAGCGTCGGCCAACTTTAG | TTC | chr3 | 120677862 | 120677883 | 120677867 | 120677862 | - |
| SEQ ID NO 34103 | AGCGTCGGCCAACTTTAGAAAT | CTA | chr3 | 120677858 | 120677879 | 120677863 | 120677858 | - |
| SEQ ID NO 34104 | TAGAAATAAAGGGACAGAGTAC | CTT | chr3 | 120677843 | 120677864 | 120677848 | 120677843 | - |
| SEQ ID NO 34105 | AGAAATAAAGGGACAGAGTACA | TTT | chr3 | 120677842 | 120677863 | 120677847 | 120677842 | - |
| SEQ ID NO 34106 | GAAATAAAGGGACAGAGTACAA | TTA | chr3 | 120677841 | 120677862 | 120677846 | 120677841 | - |
| SEQ ID NO 34107 | TAAAGCCGGGCATCCGGGGGAG | TTT | chr3 | 120677806 | 120677827 | 120677811 | 120677806 | - |
| SEQ ID NO 34108 | AAAGCCGGGCATCCGGGGGAGG | TTT | chr3 | 120677805 | 120677826 | 120677810 | 120677805 | - |
| SEQ ID NO 34109 | AAGCCGGGCATCCGGGGGAGGC | TTA | chr3 | 120677804 | 120677825 | 120677809 | 120677804 | - |
| SEQ ID NO 34110 | CGGTAGGTTCCGTGATGCCCCA | TTT | chr3 | 120677773 | 120677794 | 120677778 | 120677773 | - |
| SEQ ID NO 34111 | GGTAGGTTCCGTGATGCCCCAC | TTC | chr3 | 120677772 | 120677793 | 120677777 | 120677772 | - |
| SEQ ID NO 34112 | CGTGATGCCCCACAAGCCACAA | TTC | chr3 | 120677763 | 120677784 | 120677768 | 120677763 | - |
| SEQ ID NO 34113 | GTATTAGGGATTTTCAAATGGG | TTT | chr3 | 120677727 | 120677748 | 120677732 | 120677727 | - |
| SEQ ID NO 34114 | TATTAGGGATTTTCAAATGGGG | TTG | chr3 | 120677726 | 120677747 | 120677731 | 120677726 | - |
| SEQ ID NO 34115 | GGGATTTTCAAATGGGGAGGCA | TTA | chr3 | 120677721 | 120677742 | 120677726 | 120677721 | - |
| SEQ ID NO 34116 | TCAAATGGGGAGGCAGTGTGCA | TTT | chr3 | 120677714 | 120677735 | 120677719 | 120677714 | - |
| SEQ ID NO 34117 | CAAATGGGGAGGCAGTGTGCAA | TTT | chr3 | 120677713 | 120677734 | 120677718 | 120677713 | - |

Figure 54 (Cont'd)

| | | | | | | | | |
|---|---|---|---|---|---|---|---|---|
| SEQ ID NO 34118 | AAATGGGGAGGCAGTGTGCAAA | TTC | chr3 | 120677712 | 120677733 | 120677717 | 120677712 | - |
| SEQ ID NO 34119 | TACAAGGTAATAGAATATCACA | CTT | chr3 | 120677661 | 120677682 | 120677666 | 120677661 | - |
| SEQ ID NO 34120 | ACAAGGTAATAGAATATCACAA | TTT | chr3 | 120677660 | 120677681 | 120677665 | 120677660 | - |
| SEQ ID NO 34121 | CAAGGTAATAGAATATCACAAG | TTA | chr3 | 120677659 | 120677680 | 120677664 | 120677659 | - |
| SEQ ID NO 34122 | AAATTGCTAATGAAGTTTCGGG | TTA | chr3 | 120677586 | 120677607 | 120677591 | 120677586 | - |
| SEQ ID NO 34123 | CTAATGAAGTTTCGGGCACCAT | TTG | chr3 | 120677580 | 120677601 | 120677585 | 120677580 | - |
| SEQ ID NO 34124 | ATGAAGTTTCGGGCACCATTGT | CTA | chr3 | 120677577 | 120677598 | 120677582 | 120677577 | - |
| SEQ ID NO 34125 | CGGGCACCATTGTCATTGATAA | TTT | chr3 | 120677568 | 120677589 | 120677573 | 120677568 | - |
| SEQ ID NO 34126 | GGGCACCATTGTCATTGATAAC | TTC | chr3 | 120677567 | 120677588 | 120677572 | 120677567 | - |
| SEQ ID NO 34127 | TCATTGATAACATCTTATCAGG | TTG | chr3 | 120677556 | 120677577 | 120677561 | 120677556 | - |
| SEQ ID NO 34128 | ATAACATCTTATCAGGAGACAG | TTG | chr3 | 120677550 | 120677571 | 120677555 | 120677550 | - |
| SEQ ID NO 34129 | ATCAGGAGACAGGGTTTTTAGG | CTT | chr3 | 120677540 | 120677561 | 120677545 | 120677540 | - |
| SEQ ID NO 34130 | TCAGGAGACAGGGTTTTTAGGA | TTA | chr3 | 120677539 | 120677560 | 120677544 | 120677539 | - |
| SEQ ID NO 34131 | TTAGGATCAACTGGTCTGACCA | TTT | chr3 | 120677523 | 120677544 | 120677528 | 120677523 | - |
| SEQ ID NO 34132 | TAGGATCAACTGGTCTGACCAA | TTT | chr3 | 120677522 | 120677543 | 120677527 | 120677522 | - |
| SEQ ID NO 34133 | AGGATCAACTGGTCTGACCAAA | TTT | chr3 | 120677521 | 120677542 | 120677526 | 120677521 | - |
| SEQ ID NO 34134 | GGATCAACTGGTCTGACCAAAA | TTA | chr3 | 120677520 | 120677541 | 120677525 | 120677520 | - |
| SEQ ID NO 34135 | GTCTGACCAAAATTTATTAGGC | CTG | chr3 | 120677510 | 120677531 | 120677515 | 120677510 | - |
| SEQ ID NO 34136 | ACCAAAATTTATTAGGCGGGAA | CTG | chr3 | 120677505 | 120677526 | 120677510 | 120677505 | - |
| SEQ ID NO 34137 | ATTAGGCGGGAATTTCCTCTTC | TTT | chr3 | 120677495 | 120677516 | 120677500 | 120677495 | - |
| SEQ ID NO 34138 | TTAGGCGGGAATTTCCTCTTCC | TTA | chr3 | 120677494 | 120677515 | 120677499 | 120677494 | - |
| SEQ ID NO 34139 | GGCGGGAATTTCCTCTTCCTAA | TTA | chr3 | 120677491 | 120677512 | 120677496 | 120677491 | - |
| SEQ ID NO 34140 | CCTCTTCCTAATAAGCCTGGGA | TTT | chr3 | 120677480 | 120677501 | 120677485 | 120677480 | - |
| SEQ ID NO 34141 | CTCTTCCTAATAAGCCTGGGAG | TTC | chr3 | 120677479 | 120677500 | 120677484 | 120677479 | - |
| SEQ ID NO 34142 | TTCCTAATAAGCCTGGGAGCGC | CTC | chr3 | 120677476 | 120677497 | 120677481 | 120677476 | - |
| SEQ ID NO 34143 | CCTAATAAGCCTGGGAGCGCTG | CTT | chr3 | 120677474 | 120677495 | 120677479 | 120677474 | - |
| SEQ ID NO 34144 | CTAATAAGCCTGGGAGCGCTGT | TTC | chr3 | 120677473 | 120677494 | 120677478 | 120677473 | - |
| SEQ ID NO 34145 | ATAAGCCTGGGAGCGCTGTGGG | CTA | chr3 | 120677470 | 120677491 | 120677475 | 120677470 | - |
| SEQ ID NO 34146 | GGAGCGCTGTGGGAGACTGGGG | CTG | chr3 | 120677461 | 120677482 | 120677466 | 120677461 | - |
| SEQ ID NO 34147 | TGGGAGACTGGGGTCTATTTCA | CTG | chr3 | 120677452 | 120677473 | 120677457 | 120677452 | - |
| SEQ ID NO 34148 | GGGTCTATTTCACCCCTGCAGT | CTG | chr3 | 120677442 | 120677463 | 120677447 | 120677442 | - |
| SEQ ID NO 34149 | TTTCACCCCTGCAGTCTCGACC | CTA | chr3 | 120677435 | 120677456 | 120677440 | 120677435 | - |
| SEQ ID NO 34150 | CACCCCTGCAGTCTCGACCATA | TTT | chr3 | 120677432 | 120677453 | 120677437 | 120677432 | - |
| SEQ ID NO 34151 | ACCCCTGCAGTCTCGACCATAA | TTC | chr3 | 120677431 | 120677452 | 120677436 | 120677431 | - |
| SEQ ID NO 34152 | CAGTCTCGACCATAAGAGACAG | CTG | chr3 | 120677424 | 120677445 | 120677429 | 120677424 | - |
| SEQ ID NO 34153 | GACCATAAGAGACAGGCGCACC | CTC | chr3 | 120677417 | 120677438 | 120677422 | 120677417 | - |
| SEQ ID NO 34154 | GAGGGGGGCTGTTTATAAGCCT | CTG | chr3 | 120677393 | 120677414 | 120677398 | 120677393 | - |
| SEQ ID NO 34155 | TTTATAAGCCTATACCTCCTGG | CTG | chr3 | 120677382 | 120677403 | 120677387 | 120677382 | - |
| SEQ ID NO 34156 | ATAAGCCTATACCTCCTGGCTC | TTT | chr3 | 120677379 | 120677400 | 120677384 | 120677379 | - |
| SEQ ID NO 34157 | TAAGCCTATACCTCCTGGCTCG | TTA | chr3 | 120677378 | 120677399 | 120677383 | 120677378 | - |
| SEQ ID NO 34158 | TACCTCCTGGCTCGTATTCTCT | CTA | chr3 | 120677370 | 120677391 | 120677375 | 120677370 | - |
| SEQ ID NO 34159 | CTGGCTCGTATTCTCTTTCTCA | CTC | chr3 | 120677364 | 120677385 | 120677369 | 120677364 | - |
| SEQ ID NO 34160 | GCTCGTATTCTCTTTCTCAGGG | CTG | chr3 | 120677361 | 120677382 | 120677366 | 120677361 | - |
| SEQ ID NO 34161 | GTATTCTCTTTCTCAGGGATGT | CTC | chr3 | 120677357 | 120677378 | 120677362 | 120677357 | - |
| SEQ ID NO 34162 | TCTTTCTCAGGGATGTTCCATG | TTC | chr3 | 120677351 | 120677372 | 120677356 | 120677351 | - |
| SEQ ID NO 34163 | TTTCTCAGGGATGTTCCATGCT | CTC | chr3 | 120677349 | 120677370 | 120677354 | 120677349 | - |
| SEQ ID NO 34164 | TCTCAGGGATGTTCCATGCTGA | CTT | chr3 | 120677347 | 120677368 | 120677352 | 120677347 | - |
| SEQ ID NO 34165 | CTCAGGGATGTTCCATGCTGAG | TTT | chr3 | 120677346 | 120677367 | 120677351 | 120677346 | - |
| SEQ ID NO 34166 | TCAGGGATGTTCCATGCTGAGA | TTC | chr3 | 120677345 | 120677366 | 120677350 | 120677345 | - |
| SEQ ID NO 34167 | AGGGATGTTCCATGCTGAGAAA | CTC | chr3 | 120677343 | 120677364 | 120677348 | 120677343 | - |
| SEQ ID NO 34168 | CATGCTGAGAAAAGAATTCAG | TTC | chr3 | 120677333 | 120677354 | 120677338 | 120677333 | - |
| SEQ ID NO 34169 | AGAAAAGAATTCAGCGATATT | CTG | chr3 | 120677326 | 120677347 | 120677331 | 120677326 | - |
| SEQ ID NO 34170 | AGCGATATTTCTCCCATTTGCT | TTC | chr3 | 120677313 | 120677334 | 120677318 | 120677313 | - |
| SEQ ID NO 34171 | CTCCCATTTGCTTTTGAAAGAA | TTT | chr3 | 120677303 | 120677324 | 120677308 | 120677303 | - |
| SEQ ID NO 34172 | TCCCATTTGCTTTTGAAAGAAG | TTC | chr3 | 120677302 | 120677323 | 120677307 | 120677302 | - |
| SEQ ID NO 34173 | CCATTTGCTTTTGAAAGAAGAG | CTC | chr3 | 120677300 | 120677321 | 120677305 | 120677300 | - |
| SEQ ID NO 34174 | GCTTTTGAAAGAAGAGAAATAT | TTT | chr3 | 120677294 | 120677315 | 120677299 | 120677294 | - |
| SEQ ID NO 34175 | CTTTTGAAAGAAGAGAAATATG | TTG | chr3 | 120677293 | 120677314 | 120677298 | 120677293 | - |
| SEQ ID NO 34176 | TTGAAAGAAGAGAAATATGGCT | CTT | chr3 | 120677290 | 120677311 | 120677295 | 120677290 | - |

Figure 54 (Cont'd)

| | | | | | | | |
|---|---|---|---|---|---|---|---|
| SEQ ID NO 34177 | TGAAAGAAGAGAAATATGGCTC | TTT | chr3 | 120677289 | 120677310 | 120677294 | 120677289 | - |
| SEQ ID NO 34178 | GAAAGAAGAGAAATATGGCTCT | TTT | chr3 | 120677288 | 120677309 | 120677293 | 120677288 | - |
| SEQ ID NO 34179 | AAAGAAGAGAAATATGGCTCTG | TTG | chr3 | 120677287 | 120677308 | 120677292 | 120677287 | - |
| SEQ ID NO 34180 | TGTTCTGCCTGGCTCACCAGCA | CTC | chr3 | 120677267 | 120677288 | 120677272 | 120677267 | - |
| SEQ ID NO 34181 | TTCTGCCTGGCTCACCAGCAGT | CTG | chr3 | 120677265 | 120677286 | 120677270 | 120677265 | - |
| SEQ ID NO 34182 | TGCCTGGCTCACCAGCAGTCAG | TTC | chr3 | 120677262 | 120677283 | 120677267 | 120677262 | - |
| SEQ ID NO 34183 | CCTGGCTCACCAGCAGTCAGAG | CTG | chr3 | 120677260 | 120677281 | 120677265 | 120677260 | - |
| SEQ ID NO 34184 | GCTCACCAGCAGTCAGAGTTTA | CTG | chr3 | 120677256 | 120677277 | 120677261 | 120677256 | - |
| SEQ ID NO 34185 | ACCAGCAGTCAGAGTTTAAGGT | CTC | chr3 | 120677252 | 120677273 | 120677257 | 120677252 | - |
| SEQ ID NO 34186 | AAGGTTATCTCTCTTATTCCCT | TTT | chr3 | 120677235 | 120677256 | 120677240 | 120677235 | - |
| SEQ ID NO 34187 | AGGTTATCTCTCTTATTCCCTG | TTA | chr3 | 120677234 | 120677255 | 120677239 | 120677234 | - |
| SEQ ID NO 34188 | TCTCTCTTATTCCCTGAACAAT | TTA | chr3 | 120677228 | 120677249 | 120677233 | 120677228 | - |
| SEQ ID NO 34189 | TCTTATTCCCTGAACAATTGCT | CTC | chr3 | 120677224 | 120677245 | 120677229 | 120677224 | - |
| SEQ ID NO 34190 | TTATTCCCTGAACAATTGCTGT | CTC | chr3 | 120677222 | 120677243 | 120677227 | 120677222 | - |
| SEQ ID NO 34191 | ATTCCCTGAACAATTGCTGTTA | CTT | chr3 | 120677220 | 120677241 | 120677225 | 120677220 | - |
| SEQ ID NO 34192 | TTCCCTGAACAATTGCTGTTAT | TTA | chr3 | 120677219 | 120677240 | 120677224 | 120677219 | - |
| SEQ ID NO 34193 | CCTGAACAATTGCTGTTATCCT | TTC | chr3 | 120677216 | 120677237 | 120677221 | 120677216 | - |
| SEQ ID NO 34194 | AACAATTGCTGTTATCCTGTTC | CTG | chr3 | 120677212 | 120677233 | 120677217 | 120677212 | - |
| SEQ ID NO 34195 | CTGTTATCCTGTTCTTTTTTCA | TTG | chr3 | 120677204 | 120677225 | 120677209 | 120677204 | - |
| SEQ ID NO 34196 | TTATCCTGTTCTTTTTTCAAGG | CTG | chr3 | 120677201 | 120677222 | 120677206 | 120677201 | - |
| SEQ ID NO 34197 | TCCTGTTCTTTTTTCAAGGTGT | TTA | chr3 | 120677198 | 120677219 | 120677203 | 120677198 | - |
| SEQ ID NO 34198 | TTCTTTTTTCAAGGTGTCCACA | CTG | chr3 | 120677193 | 120677214 | 120677198 | 120677193 | - |
| SEQ ID NO 34199 | TTTTTTCAAGGTGTCCACATTT | TTC | chr3 | 120677190 | 120677211 | 120677195 | 120677190 | - |
| SEQ ID NO 34200 | TTTTCAAGGTGTCCACATTTCA | CTT | chr3 | 120677188 | 120677209 | 120677193 | 120677188 | - |
| SEQ ID NO 34201 | TTTCAAGGTGTCCACATTTCAT | TTT | chr3 | 120677187 | 120677208 | 120677192 | 120677187 | - |
| SEQ ID NO 34202 | TTCAAGGTGTCCACATTTCATG | TTT | chr3 | 120677186 | 120677207 | 120677191 | 120677186 | - |
| SEQ ID NO 34203 | TCAAGGTGTCCACATTTCATGT | TTT | chr3 | 120677185 | 120677206 | 120677190 | 120677185 | - |
| SEQ ID NO 34204 | CAAGGTGTCCACATTTCATGTT | TTT | chr3 | 120677184 | 120677205 | 120677189 | 120677184 | - |
| SEQ ID NO 34205 | AAGGTGTCCACATTTCATGTTG | TTC | chr3 | 120677183 | 120677204 | 120677188 | 120677183 | - |
| SEQ ID NO 34206 | CATGTTGCTCAAACACACATGC | TTT | chr3 | 120677168 | 120677189 | 120677173 | 120677168 | - |
| SEQ ID NO 34207 | ATGTTGCTCAAACACACATGCT | TTC | chr3 | 120677167 | 120677188 | 120677172 | 120677167 | - |
| SEQ ID NO 34208 | CTCAAACACACATGCTGTACAA | TTG | chr3 | 120677161 | 120677182 | 120677166 | 120677161 | - |
| SEQ ID NO 34209 | AAACACACATGCTGTACAATTT | CTC | chr3 | 120677158 | 120677179 | 120677163 | 120677158 | - |
| SEQ ID NO 34210 | TACAATTTGTGCAGTTAATGCA | CTG | chr3 | 120677144 | 120677165 | 120677149 | 120677144 | - |
| SEQ ID NO 34211 | GTGCAGTTAATGCAATTATTAC | TTT | chr3 | 120677136 | 120677157 | 120677141 | 120677136 | - |
| SEQ ID NO 34212 | TGCAGTTAATGCAATTATTACA | TTG | chr3 | 120677135 | 120677156 | 120677140 | 120677135 | - |
| SEQ ID NO 34213 | ATGCAATTATTACAGGGTCCTG | TTA | chr3 | 120677127 | 120677148 | 120677132 | 120677127 | - |
| SEQ ID NO 34214 | TTACAGGGTCCTGAGGCAATAT | TTA | chr3 | 120677118 | 120677139 | 120677123 | 120677118 | - |
| SEQ ID NO 34215 | CAGGGTCCTGAGGCAATATACA | TTA | chr3 | 120677115 | 120677136 | 120677120 | 120677115 | - |
| SEQ ID NO 34216 | AGGCAATATACATCCTCCTCAG | CTG | chr3 | 120677105 | 120677126 | 120677110 | 120677105 | - |
| SEQ ID NO 34217 | CTCAGCTGACAGGATTAAGAGA | CTC | chr3 | 120677088 | 120677109 | 120677093 | 120677088 | -- |
| SEQ ID NO 34218 | AGCTGACAGGATTAAGAGATTA | CTC | chr3 | 120677085 | 120677106 | 120677090 | 120677085 | - |
| SEQ ID NO 34219 | ACAGGATTAAGAGATTAAAGTA | CTG | chr3 | 120677080 | 120677101 | 120677085 | 120677080 | - |
| SEQ ID NO 34220 | AGAGATTAAAGTAAAGACAGGC | TTA | chr3 | 120677071 | 120677092 | 120677076 | 120677071 | - |
| SEQ ID NO 34221 | AAGTAAAGACAGGCATAAATCA | TTA | chr3 | 120677063 | 120677084 | 120677068 | 120677063 | - |
| SEQ ID NO 34222 | ACTGGGAAGTGATAAGTGTCC | TTG | chr3 | 120677030 | 120677051 | 120677035 | 120677030 | - |
| SEQ ID NO 34223 | GGGAAGTGATAAGTGTCCATGA | CTG | chr3 | 120677026 | 120677047 | 120677031 | 120677026 | - |
| SEQ ID NO 34224 | TACAATTTATGTTTAGAGATTG | CTT | chr3 | 120676998 | 120677019 | 120677003 | 120676998 | - |
| SEQ ID NO 34225 | ACAATTTATGTTTAGAGATTGC | TTT | chr3 | 120676997 | 120677018 | 120677002 | 120676997 | - |
| SEQ ID NO 34226 | CAATTTATGTTTAGAGATTGCA | TTA | chr3 | 120676996 | 120677017 | 120677001 | 120676996 | - |
| SEQ ID NO 34227 | ATGTTTAGAGATTGCAGTAAAG | TTT | chr3 | 120676990 | 120677011 | 120676995 | 120676990 | - |
| SEQ ID NO 34228 | TGTTTAGAGATTGCAGTAAAGA | TTA | chr3 | 120676989 | 120677010 | 120676994 | 120676989 | - |
| SEQ ID NO 34229 | AGAGATTGCAGTAAAGACAGGC | TTT | chr3 | 120676984 | 120677005 | 120676989 | 120676984 | - |
| SEQ ID NO 34230 | GAGATTGCAGTAAAGACAGGCA | TTA | chr3 | 120676983 | 120677004 | 120676988 | 120676983 | - |
| SEQ ID NO 34231 | CAGTAAAGACAGGCATAAGAAA | TTG | chr3 | 120676976 | 120676997 | 120676981 | 120676976 | - |
| SEQ ID NO 34232 | CAAAAGTATTAATTTGGGGAAC | TTA | chr3 | 120676951 | 120676972 | 120676956 | 120676951 | - |
| SEQ ID NO 34233 | ATTTGGGGAACTAATAAATGTC | TTA | chr3 | 120676940 | 120676961 | 120676945 | 120676940 | - |
| SEQ ID NO 34234 | GGGGAACTAATAAATGTCCATG | TTT | chr3 | 120676936 | 120676957 | 120676941 | 120676936 | - |
| SEQ ID NO 34235 | GGGAACTAATAAATGTCCATGA | TTG | chr3 | 120676935 | 120676956 | 120676940 | 120676935 | - |

Figure 54 (Cont'd)

| | | | | | | | | |
|---|---|---|---|---|---|---|---|---|
| SEQ ID NO 34236 | ATAAATGTCCATGAAATCTTCA | CTA | chr3 | 120676927 | 120676948 | 120676932 | 120676927 | - |
| SEQ ID NO 34237 | CACAATCCACGAACTTCTGCCA | CTT | chr3 | 120676907 | 120676928 | 120676912 | 120676907 | - |
| SEQ ID NO 34238 | ACAATCCACGAACTTCTGCCAT | TTC | chr3 | 120676906 | 120676927 | 120676911 | 120676906 | - |
| SEQ ID NO 34239 | CTGCCATGGCTTCAGCTGATCC | CTT | chr3 | 120676891 | 120676912 | 120676896 | 120676891 | - |
| SEQ ID NO 34240 | TGCCATGGCTTCAGCTGATCCC | TTC | chr3 | 120676890 | 120676911 | 120676895 | 120676890 | - |
| SEQ ID NO 34241 | CCATGGCTTCAGCTGATCCCTC | CTG | chr3 | 120676888 | 120676909 | 120676893 | 120676888 | - |
| SEQ ID NO 34242 | CAGCTGATCCCTCCGTTTGGAG | CTT | chr3 | 120676879 | 120676900 | 120676884 | 120676879 | - |
| SEQ ID NO 34243 | AGCTGATCCCTCCGTTTGGAGT | TTC | chr3 | 120676878 | 120676899 | 120676883 | 120676878 | - |
| SEQ ID NO 34244 | ATCCCTCCGTTTGGAGTCCCAG | CTG | chr3 | 120676873 | 120676894 | 120676878 | 120676873 | - |
| SEQ ID NO 34245 | CGTTTGGAGTCCCAGACTTCCC | CTC | chr3 | 120676866 | 120676887 | 120676871 | 120676866 | - |
| SEQ ID NO 34246 | GGAGTCCCAGACTTCCCGCAAC | TTT | chr3 | 120676861 | 120676882 | 120676866 | 120676861 | - |
| SEQ ID NO 34247 | GAGTCCCAGACTTCCCGCAACA | TTG | chr3 | 120676860 | 120676881 | 120676865 | 120676860 | - |
| SEQ ID NO 34248 | CCCGCAACAACTGAGAACTCTG | CTT | chr3 | 120676847 | 120676868 | 120676852 | 120676847 | - |
| SEQ ID NO 34249 | CCGCAACAACTGAGAACTCTGG | TTC | chr3 | 120676846 | 120676867 | 120676851 | 120676846 | - |
| SEQ ID NO 34250 | AGAACTCTGGAGGGCCTACCCT | CTG | chr3 | 120676834 | 120676855 | 120676839 | 120676834 | - |
| SEQ ID NO 34251 | TGGAGGGCCTACCCTTCACCCA | CTC | chr3 | 120676827 | 120676848 | 120676832 | 120676827 | - |
| SEQ ID NO 34252 | GAGGGCCTACCCTTCACCCACT | CTG | chr3 | 120676825 | 120676846 | 120676830 | 120676825 | - |
| SEQ ID NO 34253 | CCCTTCACCCACTTCCACCCTT | CTA | chr3 | 120676816 | 120676837 | 120676821 | 120676816 | - |
| SEQ ID NO 34254 | CACCCACTTCCACCCTTCTTAT | CTT | chr3 | 120676811 | 120676832 | 120676816 | 120676811 | - |
| SEQ ID NO 34255 | ACCCACTTCCACCCTTCTTATA | TTC | chr3 | 120676810 | 120676831 | 120676815 | 120676810 | - |
| SEQ ID NO 34256 | CCACCCTTCTTATATCTCTTAA | CTT | chr3 | 120676802 | 120676823 | 120676807 | 120676802 | - |
| SEQ ID NO 34257 | CACCCTTCTTATATCTCTTAAG | TTC | chr3 | 120676801 | 120676822 | 120676806 | 120676801 | - |
| SEQ ID NO 34258 | CTTATATCTCTTAAGGAGCTGT | CTT | chr3 | 120676794 | 120676815 | 120676799 | 120676794 | - |
| SEQ ID NO 34259 | TTATATCTCTTAAGGAGCTGTG | TTC | chr3 | 120676793 | 120676814 | 120676798 | 120676793 | - |
| SEQ ID NO 34260 | ATATCTCTTAAGGAGCTGTGTT | CTT | chr3 | 120676791 | 120676812 | 120676796 | 120676791 | - |
| SEQ ID NO 34261 | TATCTCTTAAGGAGCTGTGTTC | TTA | chr3 | 120676790 | 120676811 | 120676795 | 120676790 | - |
| SEQ ID NO 34262 | TTAAGGAGCTGTGTTCAGATGG | CTC | chr3 | 120676784 | 120676805 | 120676789 | 120676784 | - |
| SEQ ID NO 34263 | AAGGAGCTGTGTTCAGATGGTT | CTT | chr3 | 120676782 | 120676803 | 120676787 | 120676782 | - |
| SEQ ID NO 34264 | AGGAGCTGTGTTCAGATGGTTA | TTA | chr3 | 120676781 | 120676802 | 120676786 | 120676781 | - |
| SEQ ID NO 34265 | TGTTCAGATGGTTACATTTCGC | CTG | chr3 | 120676773 | 120676794 | 120676778 | 120676773 | - |
| SEQ ID NO 34266 | AGATGGTTACATTTCGCTTGCT | TTC | chr3 | 120676768 | 120676789 | 120676773 | 120676768 | - |
| SEQ ID NO 34267 | CATTTCGCTTGCTGAGCAAGAC | TTA | chr3 | 120676759 | 120676780 | 120676764 | 120676759 | - |
| SEQ ID NO 34268 | CGCTTGCTGAGCAAGACTGCAT | TTT | chr3 | 120676754 | 120676775 | 120676759 | 120676754 | - |
| SEQ ID NO 34269 | GCTTGCTGAGCAAGACTGCATT | TTC | chr3 | 120676753 | 120676774 | 120676758 | 120676753 | - |
| SEQ ID NO 34270 | GCTGAGCAAGACTGCATTTTCA | CTT | chr3 | 120676749 | 120676770 | 120676754 | 120676749 | - |
| SEQ ID NO 34271 | CTGAGCAAGACTGCATTTTCAT | TTG | chr3 | 120676748 | 120676769 | 120676753 | 120676748 | - |
| SEQ ID NO 34272 | AGCAAGACTGCATTTTCATTAT | CTG | chr3 | 120676745 | 120676766 | 120676750 | 120676745 | - |
| SEQ ID NO 34273 | CATTTTCATTATCCTGGGCTAA | CTG | chr3 | 120676735 | 120676756 | 120676740 | 120676735 | - |
| SEQ ID NO 34274 | TCATTATCCTGGGCTAAAATCA | TTT | chr3 | 120676730 | 120676751 | 120676735 | 120676730 | - |
| SEQ ID NO 34275 | CATTATCCTGGGCTAAAATCAA | TTT | chr3 | 120676729 | 120676750 | 120676734 | 120676729 | - |
| SEQ ID NO 34276 | ATTATCCTGGGCTAAAATCAAT | TTC | chr3 | 120676728 | 120676749 | 120676733 | 120676728 | - |
| SEQ ID NO 34277 | TCCTGGGCTAAAATCAATTGGT | TTA | chr3 | 120676724 | 120676745 | 120676729 | 120676724 | - |
| SEQ ID NO 34278 | GGCTAAAATCAATTGGTATTTA | CTG | chr3 | 120676719 | 120676740 | 120676724 | 120676719 | - |
| SEQ ID NO 34279 | AAATCAATTGGTATTTAAGTTA | CTA | chr3 | 120676714 | 120676735 | 120676719 | 120676714 | - |
| SEQ ID NO 34280 | GTATTTAAGTTAGAGCAAAAAG | TTG | chr3 | 120676704 | 120676725 | 120676709 | 120676704 | - |
| SEQ ID NO 34281 | AAGTTAGAGCAAAAAGGGTTCT | TTT | chr3 | 120676698 | 120676719 | 120676703 | 120676698 | - |
| SEQ ID NO 34282 | AGTTAGAGCAAAAAGGGTTCTA | TTA | chr3 | 120676697 | 120676718 | 120676702 | 120676697 | - |
| SEQ ID NO 34283 | GAGCAAAAAGGGTTCTAACCCT | TTA | chr3 | 120676692 | 120676713 | 120676697 | 120676692 | - |
| SEQ ID NO 34284 | TAACCCTATTTACAGCAGCACA | TTC | chr3 | 120676677 | 120676698 | 120676682 | 120676677 | - |
| SEQ ID NO 34285 | ACCCTATTTACAGCAGCACACA | CTA | chr3 | 120676675 | 120676696 | 120676680 | 120676675 | - |
| SEQ ID NO 34286 | TTTACAGCAGCACACATACACT | CTA | chr3 | 120676669 | 120676690 | 120676674 | 120676669 | - |
| SEQ ID NO 34287 | ACAGCAGCACACATACACTTAC | TTT | chr3 | 120676666 | 120676687 | 120676671 | 120676666 | - |
| SEQ ID NO 34288 | CAGCAGCACACATACACTTACA | TTA | chr3 | 120676665 | 120676686 | 120676670 | 120676665 | - |
| SEQ ID NO 34289 | ACATTAGAATTGGCTTTAAGGG | CTT | chr3 | 120676646 | 120676667 | 120676651 | 120676646 | - |
| SEQ ID NO 34290 | CATTAGAATTGGCTTTAAGGGA | TTA | chr3 | 120676645 | 120676666 | 120676650 | 120676645 | - |
| SEQ ID NO 34291 | GAATTGGCTTTAAGGGAAAAAT | TTA | chr3 | 120676640 | 120676661 | 120676645 | 120676640 | - |
| SEQ ID NO 34292 | GCTTTAAGGGAAAAATTCAATC | TTG | chr3 | 120676634 | 120676655 | 120676639 | 120676634 | - |
| SEQ ID NO 34293 | TAAGGGAAAAATTCAATCAATC | CTT | chr3 | 120676630 | 120676651 | 120676635 | 120676630 | - |
| SEQ ID NO 34294 | AAGGGAAAAATTCAATCAATCG | TTT | chr3 | 120676629 | 120676650 | 120676634 | 120676629 | - |

Figure 54 (Cont'd)

| | | | | | | | | |
|---|---|---|---|---|---|---|---|---|
| SEQ ID NO 34295 | AGGGAAAAATTCAATCAATCGA | TTA | chr3 | 120676628 | 120676649 | 120676633 | 120676628 | - |
| SEQ ID NO 34296 | AATCAATCGACAAATTTCCACT | TTC | chr3 | 120676616 | 120676637 | 120676621 | 120676616 | - |
| SEQ ID NO 34297 | CCACTGATTACCTTCTATGAGC | TTT | chr3 | 120676599 | 120676620 | 120676604 | 120676599 | - |
| SEQ ID NO 34298 | CACTGATTACCTTCTATGAGCC | TTC | chr3 | 120676598 | 120676619 | 120676603 | 120676598 | - |
| SEQ ID NO 34299 | ATTACCTTCTATGAGCCAAGAC | CTG | chr3 | 120676593 | 120676614 | 120676598 | 120676593 | - |
| SEQ ID NO 34300 | CCTTCTATGAGCCAAGACTGCC | TTA | chr3 | 120676589 | 120676610 | 120676594 | 120676589 | - |
| SEQ ID NO 34301 | CTATGAGCCAAGACTGCCATAG | CTT | chr3 | 120676585 | 120676606 | 120676590 | 120676585 | - |
| SEQ ID NO 34302 | TATGAGCCAAGACTGCCATAGT | TTC | chr3 | 120676584 | 120676605 | 120676589 | 120676584 | - |
| SEQ ID NO 34303 | TGAGCCAAGACTGCCATAGTCT | CTA | chr3 | 120676582 | 120676603 | 120676587 | 120676582 | - |
| SEQ ID NO 34304 | CCATAGTCTCAGCCTTCATGCA | CTG | chr3 | 120676569 | 120676590 | 120676574 | 120676569 | - |
| SEQ ID NO 34305 | AGCCTTCATGCAGCTTATAGGC | CTC | chr3 | 120676559 | 120676580 | 120676564 | 120676559 | - |
| SEQ ID NO 34306 | CATGCAGCTTATAGGCTAGCAA | CTT | chr3 | 120676553 | 120676574 | 120676558 | 120676553 | - |
| SEQ ID NO 34307 | ATGCAGCTTATAGGCTAGCAAA | TTC | chr3 | 120676552 | 120676573 | 120676557 | 120676552 | - |
| SEQ ID NO 34308 | ATAGGCTAGCAAAAAGCCAGA | CTT | chr3 | 120676543 | 120676564 | 120676548 | 120676543 | - |
| SEQ ID NO 34309 | TAGGCTAGCAAAAAGCCAGAC | TTA | chr3 | 120676542 | 120676563 | 120676547 | 120676542 | - |
| SEQ ID NO 34310 | GCAAAAAGCCAGACAGTGCAC | CTA | chr3 | 120676535 | 120676556 | 120676540 | 120676535 | - |
| SEQ ID NO 34311 | ACAAGTGTGTTGAGTGTTGCAA | CTC | chr3 | 120676505 | 120676526 | 120676510 | 120676505 | - |
| SEQ ID NO 34312 | AGTGTTGCAAGAGTAAGTTTCA | TTG | chr3 | 120676493 | 120676514 | 120676498 | 120676493 | - |
| SEQ ID NO 34313 | CAAGAGTAAGTTTCAGGGGCTC | TTG | chr3 | 120676486 | 120676507 | 120676491 | 120676486 | - |
| SEQ ID NO 34314 | CAGGGGCTCTCCATGACTTACC | TTT | chr3 | 120676473 | 120676494 | 120676478 | 120676473 | - |
| SEQ ID NO 34315 | AGGGGCTCTCCATGACTTACCT | TTC | chr3 | 120676472 | 120676493 | 120676477 | 120676472 | - |
| SEQ ID NO 34316 | TCCATGACTTACCTGGTTGAGA | CTC | chr3 | 120676464 | 120676485 | 120676469 | 120676464 | - |
| SEQ ID NO 34317 | CATGACTTACCTGGTTGAGAAA | CTC | chr3 | 120676462 | 120676483 | 120676467 | 120676462 | - |
| SEQ ID NO 34318 | ACCTGGTTGAGAAACCCTTTAA | CTT | chr3 | 120676454 | 120676475 | 120676459 | 120676454 | - |
| SEQ ID NO 34319 | CCTGGTTGAGAAACCCTTTAAC | TTA | chr3 | 120676453 | 120676474 | 120676458 | 120676453 | - |
| SEQ ID NO 34320 | GTTGAGAAACCCTTTAACTTTT | CTG | chr3 | 120676449 | 120676470 | 120676454 | 120676449 | - |
| SEQ ID NO 34321 | AGAAACCCTTTAACTTTTTTTT | TTG | chr3 | 120676445 | 120676466 | 120676450 | 120676445 | - |
| SEQ ID NO 34322 | TAACTTTTTTTTCCTCTGGGT | CTT | chr3 | 120676435 | 120676456 | 120676440 | 120676435 | - |
| SEQ ID NO 34323 | AACTTTTTTTTCCTCTGGGTG | TTT | chr3 | 120676434 | 120676455 | 120676439 | 120676434 | - |
| SEQ ID NO 34324 | ACTTTTTTTTCCTCTGGGTGT | TTA | chr3 | 120676433 | 120676454 | 120676438 | 120676433 | - |
| SEQ ID NO 34325 | TTTTTTTCCTCTGGGTGTAAAG | CTT | chr3 | 120676429 | 120676450 | 120676434 | 120676429 | - |
| SEQ ID NO 34326 | TTTTTTCCTCTGGGTGTAAAGT | TTT | chr3 | 120676428 | 120676449 | 120676433 | 120676428 | - |
| SEQ ID NO 34327 | TTTTTCCTCTGGGTGTAAAGTG | TTT | chr3 | 120676427 | 120676448 | 120676432 | 120676427 | - |
| SEQ ID NO 34328 | TTTTCCTCTGGGTGTAAAGTGA | TTT | chr3 | 120676426 | 120676447 | 120676431 | 120676426 | - |
| SEQ ID NO 34329 | TTTCCTCTGGGTGTAAAGTGAA | TTT | chr3 | 120676425 | 120676446 | 120676430 | 120676425 | - |
| SEQ ID NO 34330 | TTCCTCTGGGTGTAAAGTGAAG | TTT | chr3 | 120676424 | 120676445 | 120676429 | 120676424 | - |
| SEQ ID NO 34331 | TCCTCTGGGTGTAAAGTGAAGA | TTT | chr3 | 120676423 | 120676444 | 120676428 | 120676423 | - |
| SEQ ID NO 34332 | CCTCTGGGTGTAAAGTGAAGAG | TTT | chr3 | 120676422 | 120676443 | 120676427 | 120676422 | - |
| SEQ ID NO 34333 | CTCTGGGTGTAAAGTGAAGAGA | TTC | chr3 | 120676421 | 120676442 | 120676426 | 120676421 | - |
| SEQ ID NO 34334 | TGGGTGTAAAGTGAAGAGATGG | CTC | chr3 | 120676418 | 120676439 | 120676423 | 120676418 | - |
| SEQ ID NO 34335 | GGTGTAAAGTGAAGAGATGGCA | CTG | chr3 | 120676416 | 120676437 | 120676421 | 120676416 | - |
| SEQ ID NO 34336 | CATTGTGTCATTGTGAAAAGAT | TTC | chr3 | 120676380 | 120676401 | 120676385 | 120676380 | - |
| SEQ ID NO 34337 | TGTCATTGTGAAAAGATGCTGG | TTG | chr3 | 120676375 | 120676396 | 120676380 | 120676375 | - |
| SEQ ID NO 34338 | TGAAAAGATGCTGGGCTGGCGT | TTG | chr3 | 120676367 | 120676388 | 120676372 | 120676367 | - |
| SEQ ID NO 34339 | GGCTGGCGTGTCTCCTGAAGGC | CTG | chr3 | 120676354 | 120676375 | 120676359 | 120676354 | - |
| SEQ ID NO 34340 | GCGTGTCTCCTGAAGGCCACCC | CTG | chr3 | 120676349 | 120676370 | 120676354 | 120676349 | - |
| SEQ ID NO 34341 | CTGAAGGCCACCCATATCTTTA | CTC | chr3 | 120676340 | 120676361 | 120676345 | 120676340 | - |
| SEQ ID NO 34342 | AAGGCCACCCATATCTTTAAAC | CTG | chr3 | 120676337 | 120676358 | 120676342 | 120676337 | - |
| SEQ ID NO 34343 | TAAACTTTATTTTCATGCATTC | CTT | chr3 | 120676320 | 120676341 | 120676325 | 120676320 | - |
| SEQ ID NO 34344 | AAACTTTATTTTCATGCATTCG | TTT | chr3 | 120676319 | 120676340 | 120676324 | 120676319 | - |
| SEQ ID NO 34345 | AACTTTATTTTCATGCATTCGC | TTA | chr3 | 120676318 | 120676339 | 120676323 | 120676318 | - |
| SEQ ID NO 34346 | TATTTTCATGCATTCGCACAAA | CTT | chr3 | 120676313 | 120676334 | 120676318 | 120676313 | - |
| SEQ ID NO 34347 | ATTTTCATGCATTCGCACAAAT | TTT | chr3 | 120676312 | 120676333 | 120676317 | 120676312 | - |
| SEQ ID NO 34348 | TTTTCATGCATTCGCACAAATA | TTA | chr3 | 120676311 | 120676332 | 120676316 | 120676311 | - |
| SEQ ID NO 34349 | TCATGCATTCGCACAAATATAG | TTT | chr3 | 120676308 | 120676329 | 120676313 | 120676308 | - |
| SEQ ID NO 34350 | CATGCATTCGCACAAATATAGA | TTT | chr3 | 120676307 | 120676328 | 120676312 | 120676307 | - |
| SEQ ID NO 34351 | ATGCATTCGCACAAATATAGAT | TTC | chr3 | 120676306 | 120676327 | 120676311 | 120676306 | - |
| SEQ ID NO 34352 | GCACAAATATAGATGTGTTCCA | TTC | chr3 | 120676298 | 120676319 | 120676303 | 120676298 | - |
| SEQ ID NO 34353 | CATAGATGAGGCAGATAGCAGA | TTC | chr3 | 120676278 | 120676299 | 120676283 | 120676278 | - |

Figure 54 (Cont'd)

| SEQ ID NO | Sequence | | | Start | End | Pos1 | Pos2 | |
|---|---|---|---|---|---|---|---|---|
| SEQ ID NO 34354 | CTGCCTACAGCAAGGCTAGTTT | CTT | chr3 | 120676251 | 120676272 | 120676256 | 120676251 | - |
| SEQ ID NO 34355 | TGCCTACAGCAAGGCTAGTTTG | TTC | chr3 | 120676250 | 120676271 | 120676255 | 120676250 | - |
| SEQ ID NO 34356 | CCTACAGCAAGGCTAGTTTGGA | CTG | chr3 | 120676248 | 120676269 | 120676253 | 120676248 | - |
| SEQ ID NO 34357 | CAGCAAGGCTAGTTTGGAGAGG | CTA | chr3 | 120676244 | 120676265 | 120676249 | 120676244 | - |
| SEQ ID NO 34358 | GTTTGGAGAGGGTTTTGCTGTC | CTA | chr3 | 120676233 | 120676254 | 120676238 | 120676233 | - |
| SEQ ID NO 34359 | GGAGAGGGTTTTGCTGTCAGGG | TTT | chr3 | 120676229 | 120676250 | 120676234 | 120676229 | - |
| SEQ ID NO 34360 | GAGAGGGTTTTGCTGTCAGGGT | TTG | chr3 | 120676228 | 120676249 | 120676233 | 120676228 | - |
| SEQ ID NO 34361 | TGCTGTCAGGGTTGGACCCACA | TTT | chr3 | 120676218 | 120676239 | 120676223 | 120676218 | - |
| SEQ ID NO 34362 | GCTGTCAGGGTTGGACCCACAC | TTT | chr3 | 120676217 | 120676238 | 120676222 | 120676217 | - |
| SEQ ID NO 34363 | CTGTCAGGGTTGGACCCACACA | TTG | chr3 | 120676216 | 120676237 | 120676221 | 120676216 | - |
| SEQ ID NO 34364 | TCAGGGTTGGACCCACACACCT | CTG | chr3 | 120676213 | 120676234 | 120676218 | 120676213 | - |
| SEQ ID NO 34365 | GACCCACACACCTCTTCATAGA | TTG | chr3 | 120676204 | 120676225 | 120676209 | 120676204 | - |
| SEQ ID NO 34366 | TTCATAGATGCTTTTTCTTTTT | CTC | chr3 | 120676190 | 120676211 | 120676195 | 120676190 | - |
| SEQ ID NO 34367 | CATAGATGCTTTTTCTTTTTTT | CTT | chr3 | 120676188 | 120676209 | 120676193 | 120676188 | - |
| SEQ ID NO 34368 | ATAGATGCTTTTTCTTTTTTTT | TTC | chr3 | 120676187 | 120676208 | 120676192 | 120676187 | - |
| SEQ ID NO 34369 | TTTCTTTTTTTTCCCAGAGTTT | CTT | chr3 | 120676177 | 120676198 | 120676182 | 120676177 | - |
| SEQ ID NO 34370 | TTCTTTTTTTTCCCAGAGTTTG | TTT | chr3 | 120676176 | 120676197 | 120676181 | 120676176 | - |
| SEQ ID NO 34371 | TCTTTTTTTTCCCAGAGTTTGA | TTT | chr3 | 120676175 | 120676196 | 120676180 | 120676175 | - |
| SEQ ID NO 34372 | CTTTTTTTTCCCAGAGTTTGAA | TTT | chr3 | 120676174 | 120676195 | 120676179 | 120676174 | - |
| SEQ ID NO 34373 | TTTTTTTTCCCAGAGTTTGAAA | TTC | chr3 | 120676173 | 120676194 | 120676178 | 120676173 | - |
| SEQ ID NO 34374 | TTTTTTCCCAGAGTTTGAAAGG | CTT | chr3 | 120676171 | 120676192 | 120676176 | 120676171 | - |
| SEQ ID NO 34375 | TTTTTCCCAGAGTTTGAAAGGG | TTT | chr3 | 120676170 | 120676191 | 120676175 | 120676170 | - |
| SEQ ID NO 34376 | TTTTCCCAGAGTTTGAAAGGGA | TTT | chr3 | 120676169 | 120676190 | 120676174 | 120676169 | - |
| SEQ ID NO 34377 | TTTCCCAGAGTTTGAAAGGGAA | TTT | chr3 | 120676168 | 120676189 | 120676173 | 120676168 | - |
| SEQ ID NO 34378 | TTCCCAGAGTTTGAAAGGGAAA | TTT | chr3 | 120676167 | 120676188 | 120676172 | 120676167 | - |
| SEQ ID NO 34379 | TCCCAGAGTTTGAAAGGGAAAT | TTT | chr3 | 120676166 | 120676187 | 120676171 | 120676166 | - |
| SEQ ID NO 34380 | CCCAGAGTTTGAAAGGGAAATG | TTT | chr3 | 120676165 | 120676186 | 120676170 | 120676165 | - |
| SEQ ID NO 34381 | CCAGAGTTTGAAAGGGAAATGG | TTC | chr3 | 120676164 | 120676185 | 120676169 | 120676164 | - |
| SEQ ID NO 34382 | GAAAGGGAAATGGAGTCTCAAG | TTT | chr3 | 120676155 | 120676176 | 120676160 | 120676155 | - |
| SEQ ID NO 34383 | AAAGGGAAATGGAGTCTCAAGT | TTG | chr3 | 120676154 | 120676175 | 120676159 | 120676154 | - |
| SEQ ID NO 34384 | AAGTTCAGGGAGGTTACAGTGT | CTC | chr3 | 120676136 | 120676157 | 120676141 | 120676136 | - |
| SEQ ID NO 34385 | AGGGAGGTTACAGTGTAGACCC | TTC | chr3 | 120676130 | 120676151 | 120676135 | 120676130 | - |
| SEQ ID NO 34386 | CAGTGTAGACCCACAAATCAGC | TTA | chr3 | 120676120 | 120676141 | 120676125 | 120676120 | - |
| SEQ ID NO 34387 | AGTACAGCTAAGGGTGGAGAAG | CTA | chr3 | 120676096 | 120676117 | 120676101 | 120676096 | - |
| SEQ ID NO 34388 | AGGGTGGAGAAGTCTATGCAAT | CTA | chr3 | 120676086 | 120676107 | 120676091 | 120676086 | - |
| SEQ ID NO 34389 | TGCAATATCCAGCACTCTTCTG | CTA | chr3 | 120676070 | 120676091 | 120676075 | 120676070 | - |
| SEQ ID NO 34390 | TTCTGATTAATTAGAAGTCTTT | CTC | chr3 | 120676053 | 120676074 | 120676058 | 120676053 | - |
| SEQ ID NO 34391 | CTGATTAATTAGAAGTCTTTAA | CTT | chr3 | 120676051 | 120676072 | 120676056 | 120676051 | - |
| SEQ ID NO 34392 | TGATTAATTAGAAGTCTTTAAA | TTC | chr3 | 120676050 | 120676071 | 120676055 | 120676050 | - |
| SEQ ID NO 34393 | ATTAATTAGAAGTCTTTAAAAT | CTG | chr3 | 120676048 | 120676069 | 120676053 | 120676048 | - |
| SEQ ID NO 34394 | ATTAGAAGTCTTTAAAATTCAC | TTA | chr3 | 120676044 | 120676065 | 120676049 | 120676044 | - |
| SEQ ID NO 34395 | GAAGTCTTTAAAATTCACAGAA | TTA | chr3 | 120676040 | 120676061 | 120676045 | 120676040 | - |
| SEQ ID NO 34396 | TAAAATTCACAGAAACCATATT | CTT | chr3 | 120676032 | 120676053 | 120676037 | 120676032 | - |
| SEQ ID NO 34397 | AAAATTCACAGAAACCATATTG | TTT | chr3 | 120676031 | 120676052 | 120676036 | 120676031 | - |
| SEQ ID NO 34398 | AAATTCACAGAAACCATATTGT | TTA | chr3 | 120676030 | 120676051 | 120676035 | 120676030 | - |
| SEQ ID NO 34399 | ACAGAAACCATATTGTCTTCCC | TTC | chr3 | 120676024 | 120676045 | 120676029 | 120676024 | - |
| SEQ ID NO 34400 | TCTTCCCTAAATGATTCATATG | TTG | chr3 | 120676009 | 120676030 | 120676014 | 120676009 | - |
| SEQ ID NO 34401 | CCCTAAATGATTCATATGTCAA | CTT | chr3 | 120676005 | 120676026 | 120676010 | 120676005 | - |
| SEQ ID NO 34402 | CCTAAATGATTCATATGTCAAG | TTC | chr3 | 120676004 | 120676025 | 120676009 | 120676004 | - |
| SEQ ID NO 34403 | AATGATTCATATGTCAAGACAC | CTA | chr3 | 120676000 | 120676021 | 120676005 | 120676000 | - |
| SEQ ID NO 34404 | ATATGTCAAGACACAGTAAAGA | TTC | chr3 | 120675992 | 120676013 | 120675997 | 120675992 | - |
| SEQ ID NO 34405 | TATGTGGAACATCATACACAAA | TTA | chr3 | 120675965 | 120675986 | 120675970 | 120675965 | - |
| SEQ ID NO 34406 | TTACCTTAGTAAACTGCCAATT | TTC | chr3 | 120675922 | 120675943 | 120675927 | 120675922 | - |
| SEQ ID NO 34407 | ACCTTAGTAAACTGCCAATTTT | CTT | chr3 | 120675920 | 120675941 | 120675925 | 120675920 | - |
| SEQ ID NO 34408 | CCTTAGTAAACTGCCAATTTTC | TTA | chr3 | 120675919 | 120675940 | 120675924 | 120675919 | - |
| SEQ ID NO 34409 | AGTAAACTGCCAATTTTCTGAA | CTT | chr3 | 120675915 | 120675936 | 120675920 | 120675915 | - |
| SEQ ID NO 34410 | GTAAACTGCCAATTTTCTGAAA | TTA | chr3 | 120675914 | 120675935 | 120675919 | 120675914 | - |
| SEQ ID NO 34411 | CCAATTTTCTGAAATGCTCTTT | CTG | chr3 | 120675906 | 120675927 | 120675911 | 120675906 | - |
| SEQ ID NO 34412 | TCTGAAATGCTCTTTAAATCCT | TTT | chr3 | 120675899 | 120675920 | 120675904 | 120675899 | - |

Figure 54 (Cont'd)

| | | | | | | | | |
|---|---|---|---|---|---|---|---|---|
| SEQ ID NO 34413 | CTGAAATGCTCTTTAAATCCTG | TTT | chr3 | 120675898 | 120675919 | 120675903 | 120675898 | - |
| SEQ ID NO 34414 | TGAAATGCTCTTTAAATCCTGC | TTC | chr3 | 120675897 | 120675918 | 120675902 | 120675897 | - |
| SEQ ID NO 34415 | AAATGCTCTTTAAATCCTGCTA | CTG | chr3 | 120675895 | 120675916 | 120675900 | 120675895 | - |
| SEQ ID NO 34416 | TTTAAATCCTGCTAATGGTGGC | CTC | chr3 | 120675887 | 120675908 | 120675892 | 120675887 | - |
| SEQ ID NO 34417 | TAAATCCTGCTAATGGTGGCAT | CTT | chr3 | 120675885 | 120675906 | 120675890 | 120675885 | - |
| SEQ ID NO 34418 | AAATCCTGCTAATGGTGGCATT | TTT | chr3 | 120675884 | 120675905 | 120675889 | 120675884 | - |
| SEQ ID NO 34419 | AATCCTGCTAATGGTGGCATTT | TTA | chr3 | 120675883 | 120675904 | 120675888 | 120675883 | - |
| SEQ ID NO 34420 | CTAATGGTGGCATTTGTGTCTT | CTG | chr3 | 120675876 | 120675897 | 120675881 | 120675876 | - |
| SEQ ID NO 34421 | ATGGTGGCATTTGTGTCTTTGT | CTA | chr3 | 120675873 | 120675894 | 120675878 | 120675873 | - |
| SEQ ID NO 34422 | GTGTCTTTGTCACCTACAGTAC | TTT | chr3 | 120675861 | 120675882 | 120675866 | 120675861 | - |
| SEQ ID NO 34423 | TGTCTTTGTCACCTACAGTACA | TTG | chr3 | 120675860 | 120675881 | 120675865 | 120675860 | - |
| SEQ ID NO 34424 | TGTCACCTACAGTACATTTCTG | CTT | chr3 | 120675854 | 120675875 | 120675859 | 120675854 | - |
| SEQ ID NO 34425 | GTCACCTACAGTACATTTCTGG | TTT | chr3 | 120675853 | 120675874 | 120675858 | 120675853 | - |
| SEQ ID NO 34426 | TCACCTACAGTACATTTCTGGA | TTG | chr3 | 120675852 | 120675873 | 120675857 | 120675852 | - |
| SEQ ID NO 34427 | CAGTACATTTCTGGATTTGGGA | CTA | chr3 | 120675845 | 120675866 | 120675850 | 120675845 | - |
| SEQ ID NO 34428 | CTGGATTTGGGAATGAGTGTTC | TTT | chr3 | 120675835 | 120675856 | 120675840 | 120675835 | - |
| SEQ ID NO 34429 | TGGATTTGGGAATGAGTGTTCT | TTC | chr3 | 120675834 | 120675855 | 120675839 | 120675834 | - |
| SEQ ID NO 34430 | GATTTGGGAATGAGTGTTCTTC | CTG | chr3 | 120675832 | 120675853 | 120675837 | 120675832 | - |
| SEQ ID NO 34431 | GGGAATGAGTGTTCTTCAGAGG | TTT | chr3 | 120675827 | 120675848 | 120675832 | 120675827 | - |
| SEQ ID NO 34432 | GGAATGAGTGTTCTTCAGAGGA | TTG | chr3 | 120675826 | 120675847 | 120675831 | 120675826 | - |
| SEQ ID NO 34433 | TTCAGAGGATCCTCGCTGCCCA | TTC | chr3 | 120675813 | 120675834 | 120675818 | 120675813 | - |
| SEQ ID NO 34434 | CAGAGGATCCTCGCTGCCCAGG | CTT | chr3 | 120675811 | 120675832 | 120675816 | 120675811 | - |
| SEQ ID NO 34435 | AGAGGATCCTCGCTGCCCAGGT | TTC | chr3 | 120675810 | 120675831 | 120675815 | 120675810 | - |
| SEQ ID NO 34436 | GCTGCCCAGGTTCCTGCCAGA | CTC | chr3 | 120675799 | 120675820 | 120675804 | 120675799 | - |
| SEQ ID NO 34437 | CCCAGGTTCCTGCCAGAAGGA | CTG | chr3 | 120675795 | 120675816 | 120675800 | 120675795 | - |

Figure 55

| # | Sequence | PAM | chr6 | Start | End | Cuts 5' of | Str |
|---|---|---|---|---|---|---|---|
| SEQ ID NO 34438 | CTCCTTTTGCCACACCCTCA | CAG | chr6 | 160654423 | 160654442 | 160654439 | + |
| SEQ ID NO 34439 | ACACCCTCACAGACATAACC | GAG | chr6 | 160654434 | 160654453 | 160654450 | + |
| SEQ ID NO 34440 | TTGCATCTTTCAATCCAATC | AAG | chr6 | 160654466 | 160654485 | 160654482 | + |
| SEQ ID NO 34441 | TTTCAATCCAATCAAGTTGA | CAG | chr6 | 160654473 | 160654492 | 160654489 | + |
| SEQ ID NO 34442 | TTGACAGTATTAACCATCAC | AAG | chr6 | 160654489 | 160654508 | 160654505 | + |
| SEQ ID NO 34443 | TCATACATAATCTTCAAATA | AAG | chr6 | 160654554 | 160654573 | 160654570 | + |
| SEQ ID NO 34444 | CTTCAAATAAAGACAATAAT | AAG | chr6 | 160654565 | 160654584 | 160654581 | + |
| SEQ ID NO 34445 | TTCAAATAAAGACAATAATA | AGG | chr6 | 160654566 | 160654585 | 160654582 | + |
| SEQ ID NO 34446 | TACAACTATCCTCATACAAC | CAG | chr6 | 160654610 | 160654629 | 160654626 | + |
| SEQ ID NO 34447 | CGCACCAATCCCCAAACCAA | AAG | chr6 | 160654636 | 160654655 | 160654652 | + |
| SEQ ID NO 34448 | CAAACCAAAAGTTATTACAT | AAG | chr6 | 160654648 | 160654667 | 160654664 | + |
| SEQ ID NO 34449 | AAACCAAAAGTTATTACATA | AGG | chr6 | 160654649 | 160654668 | 160654665 | + |
| SEQ ID NO 34450 | AATGCTTAAATGCTGATGTG | AAG | chr6 | 160654708 | 160654727 | 160654724 | + |
| SEQ ID NO 34451 | GATGTGAAGTCCATAAATCT | AAG | chr6 | 160654722 | 160654741 | 160654738 | + |
| SEQ ID NO 34452 | ATGTGAAGTCCATAAATCTA | AGG | chr6 | 160654723 | 160654742 | 160654739 | + |
| SEQ ID NO 34453 | AAATCTAAGGTCACATGATA | AAG | chr6 | 160654736 | 160654755 | 160654752 | + |
| SEQ ID NO 34454 | AATCTAAGGTCACATGATAA | AGG | chr6 | 160654737 | 160654756 | 160654753 | + |
| SEQ ID NO 34455 | CACATGATAAAGGAAAAATA | AAG | chr6 | 160654747 | 160654766 | 160654763 | + |
| SEQ ID NO 34456 | ACATGATAAAGGAAAAATAA | AGG | chr6 | 160654748 | 160654767 | 160654764 | + |
| SEQ ID NO 34457 | AAAATAAGGAAATAAAATA | AAG | chr6 | 160654761 | 160654780 | 160654777 | + |
| SEQ ID NO 34458 | ATAAAATAAGATATTTTCT | TAG | chr6 | 160654773 | 160654792 | 160654789 | + |
| SEQ ID NO 34459 | TAAAGATATTTTCTTAGCAC | AAG | chr6 | 160654779 | 160654798 | 160654795 | + |
| SEQ ID NO 34460 | CACAAGTGTACACATGCATT | TAG | chr6 | 160654796 | 160654815 | 160654812 | + |
| SEQ ID NO 34461 | AGTGTACACATGCATTTAGA | AAG | chr6 | 160654800 | 160654819 | 160654816 | + |
| SEQ ID NO 34462 | GTACACATGCATTTAGAAAG | TGG | chr6 | 160654803 | 160654822 | 160654819 | + |
| SEQ ID NO 34463 | ATGCATTTAGAAAGTGGATA | TAG | chr6 | 160654809 | 160654828 | 160654825 | + |
| SEQ ID NO 34464 | AGAAAGTGGATATAGTGCTG | CAG | chr6 | 160654817 | 160654836 | 160654833 | + |
| SEQ ID NO 34465 | GTGCTGCAGCTGTCCACTTT | CGG | chr6 | 160654831 | 160654850 | 160654847 | + |
| SEQ ID NO 34466 | TGCTGCAGCTGTCCACTTTC | GGG | chr6 | 160654832 | 160654851 | 160654848 | + |
| SEQ ID NO 34467 | TGCAGCTGTCCACTTTCGGG | TGG | chr6 | 160654835 | 160654854 | 160654851 | + |
| SEQ ID NO 34468 | GGTGGTGCCTGCATATCGTG | CAG | chr6 | 160654853 | 160654872 | 160654869 | + |
| SEQ ID NO 34469 | GTGCAGAACCATCTATGAAC | CAG | chr6 | 160654870 | 160654889 | 160654886 | + |
| SEQ ID NO 34470 | ACCATCTATGAACCAGTCCT | TAG | chr6 | 160654877 | 160654896 | 160654893 | + |
| SEQ ID NO 34471 | CTTCCTCTGTCAACTGATCA | TAG | chr6 | 160654906 | 160654925 | 160654922 | + |
| SEQ ID NO 34472 | TTCCTCTGTCAACTGATCAT | AGG | chr6 | 160654907 | 160654926 | 160654923 | + |
| SEQ ID NO 34473 | TCCTCTGTCAACTGATCATA | GGG | chr6 | 160654908 | 160654927 | 160654924 | + |
| SEQ ID NO 34474 | GATCATAGGGAACTCCCCAT | GAG | chr6 | 160654921 | 160654940 | 160654937 | + |
| SEQ ID NO 34475 | ATCATAGGGAACTCCCCATG | AGG | chr6 | 160654922 | 160654941 | 160654938 | + |
| SEQ ID NO 34476 | GGAACTCCCCATGAGGCCAT | TGG | chr6 | 160654929 | 160654948 | 160654945 | + |
| SEQ ID NO 34477 | TCCCCATGAGGCCATTGGTG | CAG | chr6 | 160654934 | 160654953 | 160654950 | + |
| SEQ ID NO 34478 | CCCCATGAGGCCATTGGTGC | AGG | chr6 | 160654935 | 160654954 | 160654951 | + |
| SEQ ID NO 34479 | ATGAGGCCATTGGTGCAGGC | TGG | chr6 | 160654939 | 160654958 | 160654955 | + |
| SEQ ID NO 34480 | TGAGGCCATTGGTGCAGGCT | GGG | chr6 | 160654940 | 160654959 | 160654956 | + |
| SEQ ID NO 34481 | GAGGCCATTGGTGCAGGCTG | GGG | chr6 | 160654941 | 160654960 | 160654957 | + |
| SEQ ID NO 34482 | AGGCCATTGGTGCAGGCTGG | GGG | chr6 | 160654942 | 160654961 | 160654958 | + |
| SEQ ID NO 34483 | GCCATTGGTGCAGGCTGGGG | GAG | chr6 | 160654944 | 160654963 | 160654960 | + |

Figure 55 (Cont'd)

| SEQ ID NO 34484 | CCATTGGTGCAGGCTGGGGG | AGG | chr6 | 160654945 | 160654964 | 160654961 | + |
| SEQ ID NO 34485 | CATTGGTGCAGGCTGGGGGA | GGG | chr6 | 160654946 | 160654965 | 160654962 | + |
| SEQ ID NO 34486 | TGGTGCAGGCTGGGGGAGGG | AAG | chr6 | 160654949 | 160654968 | 160654965 | + |
| SEQ ID NO 34487 | GGTGCAGGCTGGGGGAGGGA | AGG | chr6 | 160654950 | 160654969 | 160654966 | + |
| SEQ ID NO 34488 | GCAGGCTGGGGGAGGGAAGG | CAG | chr6 | 160654953 | 160654972 | 160654969 | + |
| SEQ ID NO 34489 | CAGGCTGGGGGAGGGAAGGC | AGG | chr6 | 160654954 | 160654973 | 160654970 | + |
| SEQ ID NO 34490 | AGGCTGGGGGAGGGAAGGCA | GGG | chr6 | 160654955 | 160654974 | 160654971 | + |
| SEQ ID NO 34491 | CTGGGGGAGGGAAGGCAGGG | TGG | chr6 | 160654958 | 160654977 | 160654974 | + |
| SEQ ID NO 34492 | GAGGGAAGGCAGGGTGGCAT | GAG | chr6 | 160654964 | 160654983 | 160654980 | + |
| SEQ ID NO 34493 | GGAAGGCAGGGTGGCATGAG | TGG | chr6 | 160654967 | 160654986 | 160654983 | + |
| SEQ ID NO 34494 | AAGGCAGGGTGGCATGAGTG | GAG | chr6 | 160654969 | 160654988 | 160654985 | + |
| SEQ ID NO 34495 | GGTGGCATGAGTGGAGAACA | TGG | chr6 | 160654976 | 160654995 | 160654992 | + |
| SEQ ID NO 34496 | GTGGCATGAGTGGAGAACAT | GGG | chr6 | 160654977 | 160654996 | 160654993 | + |
| SEQ ID NO 34497 | AGTGGAGAACATGGGCATTT | GAG | chr6 | 160654985 | 160655004 | 160655001 | + |
| SEQ ID NO 34498 | ATGTAACTTACTTGTGCCTT | CAG | chr6 | 160655018 | 160655037 | 160655034 | + |
| SEQ ID NO 34499 | TGTAACTTACTTGTGCCTTC | AGG | chr6 | 160655019 | 160655038 | 160655035 | + |
| SEQ ID NO 34500 | TGTGCCTTCAGGACCTGCTC | AAG | chr6 | 160655030 | 160655049 | 160655046 | + |
| SEQ ID NO 34501 | CGCTGTGCTGACCCACTTCA | TGG | chr6 | 160655094 | 160655113 | 160655110 | + |
| SEQ ID NO 34502 | GTGCTGACCCACTTCATGGC | TAG | chr6 | 160655098 | 160655117 | 160655114 | + |
| SEQ ID NO 34503 | TGACCCACTTCATGGCTAGA | TGG | chr6 | 160655102 | 160655121 | 160655118 | + |
| SEQ ID NO 34504 | GACCCACTTCATGGCTAGAT | GGG | chr6 | 160655103 | 160655122 | 160655119 | + |
| SEQ ID NO 34505 | CACTTCATGGCTAGATGGGT | CAG | chr6 | 160655107 | 160655126 | 160655123 | + |
| SEQ ID NO 34506 | TCATGGCTAGATGGGTCAGA | AAG | chr6 | 160655111 | 160655130 | 160655127 | + |
| SEQ ID NO 34507 | TAGATGGGTCAGAAAGCAAC | CAG | chr6 | 160655118 | 160655137 | 160655134 | + |
| SEQ ID NO 34508 | AGAAAGCAACCAGTTCATGA | TAG | chr6 | 160655128 | 160655147 | 160655144 | + |
| SEQ ID NO 34509 | GAAAGCAACCAGTTCATGAT | AGG | chr6 | 160655129 | 160655148 | 160655145 | + |
| SEQ ID NO 34510 | AGCAACCAGTTCATGATAGG | CAG | chr6 | 160655132 | 160655151 | 160655148 | + |
| SEQ ID NO 34511 | GCAACCAGTTCATGATAGGC | AGG | chr6 | 160655133 | 160655152 | 160655149 | + |
| SEQ ID NO 34512 | CAGTTCATGATAGGCAGGTT | CAG | chr6 | 160655138 | 160655157 | 160655154 | + |
| SEQ ID NO 34513 | AGTTCATGATAGGCAGGTTC | AGG | chr6 | 160655139 | 160655158 | 160655155 | + |
| SEQ ID NO 34514 | TCATGATAGGCAGGTTCAGG | TAG | chr6 | 160655142 | 160655161 | 160655158 | + |
| SEQ ID NO 34515 | ATAGGCAGGTTCAGGTAGCA | TGG | chr6 | 160655147 | 160655166 | 160655163 | + |
| SEQ ID NO 34516 | CATGGTGACTTTATGACCCA | CAG | chr6 | 160655165 | 160655184 | 160655181 | + |
| SEQ ID NO 34517 | ATGACCCACAGTCAAACGTT | CAG | chr6 | 160655177 | 160655196 | 160655193 | + |
| SEQ ID NO 34518 | CAAACGTTCAGTTACCACCA | AAG | chr6 | 160655189 | 160655208 | 160655205 | + |
| SEQ ID NO 34519 | TTACCACCAAAGCCCAATAA | CAG | chr6 | 160655200 | 160655219 | 160655216 | + |
| SEQ ID NO 34520 | AAAGCCCAATAACAGACCAA | TAG | chr6 | 160655208 | 160655227 | 160655224 | + |
| SEQ ID NO 34521 | GACCAATAGCTGTCTCTCAA | AAG | chr6 | 160655222 | 160655241 | 160655238 | + |
| SEQ ID NO 34522 | ACCAATAGCTGTCTCTCAAA | AGG | chr6 | 160655223 | 160655242 | 160655239 | + |
| SEQ ID NO 34523 | CAATAGCTGTCTCTCAAAAG | GAG | chr6 | 160655225 | 160655244 | 160655241 | + |
| SEQ ID NO 34524 | ATAGCTGTCTCTCAAAAGGA | GAG | chr6 | 160655227 | 160655246 | 160655243 | + |
| SEQ ID NO 34525 | GCTGTCTCTCAAAAGGAGAG | TAG | chr6 | 160655230 | 160655249 | 160655246 | + |
| SEQ ID NO 34526 | AAAAGGAGAGTAGTTATCTG | CAG | chr6 | 160655240 | 160655259 | 160655256 | + |
| SEQ ID NO 34527 | AGGAGAGTAGTTATCTGCAG | AAG | chr6 | 160655243 | 160655262 | 160655259 | + |
| SEQ ID NO 34528 | AGAGTAGTTATCTGCAGAAG | TGG | chr6 | 160655246 | 160655265 | 160655262 | + |
| SEQ ID NO 34529 | GTAGTTATCTGCAGAAGTGG | CAG | chr6 | 160655249 | 160655268 | 160655265 | + |
| SEQ ID NO 34530 | TAGTTATCTGCAGAAGTGGC | AGG | chr6 | 160655250 | 160655269 | 160655266 | + |

Figure 55 (Cont'd)

| | | | | | | | |
|---|---|---|---|---|---|---|---|
| SEQ ID NO 34531 | AGTTATCTGCAGAAGTGGCA | GGG | chr6 | 160655251 | 160655270 | 160655267 | + |
| SEQ ID NO 34532 | AGGGCCTTGCTCCAAAATCC | TAG | chr6 | 160655270 | 160655289 | 160655286 | + |
| SEQ ID NO 34533 | GGCCTTGCTCCAAAATCCTA | GAG | chr6 | 160655272 | 160655291 | 160655288 | + |
| SEQ ID NO 34534 | GCCTTGCTCCAAAATCCTAG | AGG | chr6 | 160655273 | 160655292 | 160655289 | + |
| SEQ ID NO 34535 | TCTCCACTGTGATTCACCTA | TGG | chr6 | 160655296 | 160655315 | 160655312 | + |
| SEQ ID NO 34536 | CTCCACTGTGATTCACCTAT | GGG | chr6 | 160655297 | 160655316 | 160655313 | + |
| SEQ ID NO 34537 | TCCACTGTGATTCACCTATG | GGG | chr6 | 160655298 | 160655317 | 160655314 | + |
| SEQ ID NO 34538 | CCACTGTGATTCACCTATGG | GGG | chr6 | 160655299 | 160655318 | 160655315 | + |
| SEQ ID NO 34539 | TCACCTATGGGGGCCTGCCA | AAG | chr6 | 160655309 | 160655328 | 160655325 | + |
| SEQ ID NO 34540 | CACCTATGGGGGCCTGCCAA | AGG | chr6 | 160655310 | 160655329 | 160655326 | + |
| SEQ ID NO 34541 | GGCCTGCCAAAGGCTCCAAA | CAG | chr6 | 160655320 | 160655339 | 160655336 | + |
| SEQ ID NO 34542 | CTATCTGCCACTGACACCTC | AAG | chr6 | 160655348 | 160655367 | 160655364 | + |
| SEQ ID NO 34543 | ACTGACACCTCAAGCACCAT | TGG | chr6 | 160655357 | 160655376 | 160655373 | + |
| SEQ ID NO 34544 | CTCAAGCACCATTGGATCTG | CGG | chr6 | 160655365 | 160655384 | 160655381 | + |
| SEQ ID NO 34545 | TCAAGCACCATTGGATCTGC | GGG | chr6 | 160655366 | 160655385 | 160655382 | + |
| SEQ ID NO 34546 | CAAGCACCATTGGATCTGCG | GGG | chr6 | 160655367 | 160655386 | 160655383 | + |
| SEQ ID NO 34547 | ATTGGATCTGCGGGGTCATG | TGG | chr6 | 160655375 | 160655394 | 160655391 | + |
| SEQ ID NO 34548 | GCGGGGTCATGTGGCCCAAA | TGG | chr6 | 160655384 | 160655403 | 160655400 | + |
| SEQ ID NO 34549 | GGGTCATGTGGCCCAAATGG | CAG | chr6 | 160655387 | 160655406 | 160655403 | + |
| SEQ ID NO 34550 | GTCATGTGGCCCAAATGGCA | GAG | chr6 | 160655389 | 160655408 | 160655405 | + |
| SEQ ID NO 34551 | ATGTGGCCCAAATGGCAGAG | CAG | chr6 | 160655392 | 160655411 | 160655408 | + |
| SEQ ID NO 34552 | AAATGGCAGAGCAGCTTTCA | CAG | chr6 | 160655401 | 160655420 | 160655417 | + |
| SEQ ID NO 34553 | TGGCAGAGCAGCTTTCACAG | CAG | chr6 | 160655404 | 160655423 | 160655420 | + |
| SEQ ID NO 34554 | GAGCAGCTTTCACAGCAGCC | TGG | chr6 | 160655409 | 160655428 | 160655425 | + |
| SEQ ID NO 34555 | ACAGCAGCCTGGACCTGTTT | CAG | chr6 | 160655420 | 160655439 | 160655436 | + |
| SEQ ID NO 34556 | AGCAGCCTGGACCTGTTTCA | GAG | chr6 | 160655422 | 160655441 | 160655438 | + |
| SEQ ID NO 34557 | TTCAGAGCCTTCTTTTGTTC | TAG | chr6 | 160655438 | 160655457 | 160655454 | + |
| SEQ ID NO 34558 | TTCTAGACTGCACTTAAATC | TGG | chr6 | 160655455 | 160655474 | 160655471 | + |
| SEQ ID NO 34559 | TAGACTGCACTTAAATCTGG | CAG | chr6 | 160655458 | 160655477 | 160655474 | + |
| SEQ ID NO 34560 | ACTTAAATCTGGCAGCCTTT | CAG | chr6 | 160655466 | 160655485 | 160655482 | + |
| SEQ ID NO 34561 | CTTAAATCTGGCAGCCTTTC | AGG | chr6 | 160655467 | 160655486 | 160655483 | + |
| SEQ ID NO 34562 | CTTTCAGGTCACTCGATAAA | TGG | chr6 | 160655482 | 160655501 | 160655498 | + |
| SEQ ID NO 34563 | TTTCAGGTCACTCGATAAAT | GGG | chr6 | 160655483 | 160655502 | 160655499 | + |
| SEQ ID NO 34564 | AGGTCACTCGATAAATGGGC | CAG | chr6 | 160655487 | 160655506 | 160655503 | + |
| SEQ ID NO 34565 | GTCACTCGATAAATGGGCCA | GAG | chr6 | 160655489 | 160655508 | 160655505 | + |
| SEQ ID NO 34566 | CCAGAGTAACACACCCAAAC | GAG | chr6 | 160655506 | 160655525 | 160655522 | + |
| SEQ ID NO 34567 | CAGAGTAACACACCCAAACG | AGG | chr6 | 160655507 | 160655526 | 160655523 | + |
| SEQ ID NO 34568 | TGTTGCCTCCAAAATCCAAA | TAG | chr6 | 160655534 | 160655553 | 160655550 | + |
| SEQ ID NO 34569 | GTTGCCTCCAAAATCCAAAT | AGG | chr6 | 160655535 | 160655554 | 160655551 | + |
| SEQ ID NO 34570 | CAAAATCCAAATAGGCCCAC | CAG | chr6 | 160655543 | 160655562 | 160655559 | + |
| SEQ ID NO 34571 | AAAATCCAAATAGGCCCACC | AGG | chr6 | 160655544 | 160655563 | 160655560 | + |
| SEQ ID NO 34572 | CAGGCATTGTGCCTCTTTCT | TGG | chr6 | 160655563 | 160655582 | 160655579 | + |
| SEQ ID NO 34573 | TGTGCCTCTTTCTTGGTTGT | AAG | chr6 | 160655570 | 160655589 | 160655586 | + |
| SEQ ID NO 34574 | TGCCTCTTTCTTGGTTGTAA | GAG | chr6 | 160655572 | 160655591 | 160655588 | + |
| SEQ ID NO 34575 | GCCTCTTTCTTGGTTGTAAG | AGG | chr6 | 160655573 | 160655592 | 160655589 | + |
| SEQ ID NO 34576 | CCTCTTTCTTGGTTGTAAGA | GGG | chr6 | 160655574 | 160655593 | 160655590 | + |
| SEQ ID NO 34577 | CTCTTTCTTGGTTGTAAGAG | GGG | chr6 | 160655575 | 160655594 | 160655591 | + |

Figure 55 (Cont'd)

| | | | | | | | |
|---|---|---|---|---|---|---|---|
| SEQ ID NO 34578 | GTTGTAAGAGGGGCCAAACG | CAG | chr6 | 160655585 | 160655604 | 160655601 | + |
| SEQ ID NO 34579 | TAAGAGGGGCCAAACGCAGC | AAG | chr6 | 160655589 | 160655608 | 160655605 | + |
| SEQ ID NO 34580 | CAGCAAGTTATGCTTCACCT | TAG | chr6 | 160655605 | 160655624 | 160655621 | + |
| SEQ ID NO 34581 | CAAGTTATGCTTCACCTTAG | AAG | chr6 | 160655608 | 160655627 | 160655624 | + |
| SEQ ID NO 34582 | AAGTTATGCTTCACCTTAGA | AGG | chr6 | 160655609 | 160655628 | 160655625 | + |
| SEQ ID NO 34583 | CCTTAGAAGGAATATCTCCA | TAG | chr6 | 160655622 | 160655641 | 160655638 | + |
| SEQ ID NO 34584 | CTTAGAAGGAATATCTCCAT | AGG | chr6 | 160655623 | 160655642 | 160655639 | + |
| SEQ ID NO 34585 | CTCCATAGGTCTCATGCCAC | TGG | chr6 | 160655637 | 160655656 | 160655653 | + |
| SEQ ID NO 34586 | GTCTCATGCCACTGGAACCC | TAG | chr6 | 160655645 | 160655664 | 160655661 | + |
| SEQ ID NO 34587 | GGAACCCTAGAAATTTTACC | GAG | chr6 | 160655658 | 160655677 | 160655674 | + |
| SEQ ID NO 34588 | GAACCCTAGAAATTTTACCG | AGG | chr6 | 160655659 | 160655678 | 160655675 | + |
| SEQ ID NO 34589 | CCCTAGAAATTTTACCGAGG | TAG | chr6 | 160655662 | 160655681 | 160655678 | + |
| SEQ ID NO 34590 | AGAAATTTTACCGAGGTAGA | AAG | chr6 | 160655666 | 160655685 | 160655682 | + |
| SEQ ID NO 34591 | GGTAGAAAGTCCCTAAATTT | TAG | chr6 | 160655680 | 160655699 | 160655696 | + |
| SEQ ID NO 34592 | GAAAGTCCCTAAATTTTAGC | TGG | chr6 | 160655684 | 160655703 | 160655700 | + |
| SEQ ID NO 34593 | TGGATTTATTTCCCATCCTC | TGG | chr6 | 160655704 | 160655723 | 160655720 | + |
| SEQ ID NO 34594 | CATACAAATGTCTCACCAAT | AAG | chr6 | 160655727 | 160655746 | 160655743 | + |
| SEQ ID NO 34595 | AAATGTCTCACCAATAAGTT | CAG | chr6 | 160655732 | 160655751 | 160655748 | + |
| SEQ ID NO 34596 | TCATAATGTCATGAATGTAA | TGG | chr6 | 160655790 | 160655809 | 160655806 | + |
| SEQ ID NO 34597 | ATGTCATGAATGTAATGGAC | CAG | chr6 | 160655795 | 160655814 | 160655811 | + |
| SEQ ID NO 34598 | TGGACCAGTGTTATATCTCG | TGG | chr6 | 160655810 | 160655829 | 160655826 | + |
| SEQ ID NO 34599 | ACCAGTGTTATATCTCGTGG | AAG | chr6 | 160655813 | 160655832 | 160655829 | + |
| SEQ ID NO 34600 | TTATATCTCGTGGAAGTGAA | AAG | chr6 | 160655820 | 160655839 | 160655836 | + |
| SEQ ID NO 34601 | ATCTCGTGGAAGTGAAAAGC | GAG | chr6 | 160655824 | 160655843 | 160655840 | + |
| SEQ ID NO 34602 | CGTGGAAGTGAAAAGCGAGC | AAG | chr6 | 160655828 | 160655847 | 160655844 | + |
| SEQ ID NO 34603 | GTGGAAGTGAAAAGCGAGCA | AGG | chr6 | 160655829 | 160655848 | 160655845 | + |
| SEQ ID NO 34604 | CGAGCAAGGTCTCTCCAAAT | AAG | chr6 | 160655843 | 160655862 | 160655859 | + |
| SEQ ID NO 34605 | CCAAATAAGATTATGACACA | AAG | chr6 | 160655857 | 160655876 | 160655873 | + |
| SEQ ID NO 34606 | ATAAGATTATGACACAAAGC | TGG | chr6 | 160655861 | 160655880 | 160655877 | + |
| SEQ ID NO 34607 | AAGATTATGACACAAAGCTG | GAG | chr6 | 160655863 | 160655882 | 160655879 | + |
| SEQ ID NO 34608 | GATTATGACACAAAGCTGGA | GAG | chr6 | 160655865 | 160655884 | 160655881 | + |
| SEQ ID NO 34609 | TGGAGAGTTGATACACCCCT | GAG | chr6 | 160655881 | 160655900 | 160655897 | + |
| SEQ ID NO 34610 | GGAGAGTTGATACACCCCTG | AGG | chr6 | 160655882 | 160655901 | 160655898 | + |
| SEQ ID NO 34611 | GAGTTGATACACCCCTGAGG | TAG | chr6 | 160655885 | 160655904 | 160655901 | + |
| SEQ ID NO 34612 | AGTTGATACACCCCTGAGGT | AGG | chr6 | 160655886 | 160655905 | 160655902 | + |
| SEQ ID NO 34613 | GTTGATACACCCCTGAGGTA | GGG | chr6 | 160655887 | 160655906 | 160655903 | + |
| SEQ ID NO 34614 | GATACACCCCTGAGGTAGGG | TGG | chr6 | 160655890 | 160655909 | 160655906 | + |
| SEQ ID NO 34615 | ACCCCTGAGGTAGGGTGGTA | AAG | chr6 | 160655895 | 160655914 | 160655911 | + |
| SEQ ID NO 34616 | CCCCTGAGGTAGGGTGGTAA | AGG | chr6 | 160655896 | 160655915 | 160655912 | + |
| SEQ ID NO 34617 | GGGTGGTAAAGGTATAATGC | TGG | chr6 | 160655907 | 160655926 | 160655923 | + |
| SEQ ID NO 34618 | AGGTATAATGCTGGCCTTGT | CAG | chr6 | 160655916 | 160655935 | 160655932 | + |
| SEQ ID NO 34619 | AATGCTGGCCTTGTCAGCTG | AAG | chr6 | 160655922 | 160655941 | 160655938 | + |
| SEQ ID NO 34620 | ATGCTGGCCTTGTCAGCTGA | AGG | chr6 | 160655923 | 160655942 | 160655939 | + |
| SEQ ID NO 34621 | AGCTGAAGGCAAATTGCTTC | TGG | chr6 | 160655937 | 160655956 | 160655953 | + |
| SEQ ID NO 34622 | TGAAGGCAAATTGCTTCTGG | TGG | chr6 | 160655940 | 160655959 | 160655956 | + |
| SEQ ID NO 34623 | GAAGGCAAATTGCTTCTGGT | GGG | chr6 | 160655941 | 160655960 | 160655957 | + |
| SEQ ID NO 34624 | ATTGCTTCTGGTGGGTCTTA | TGG | chr6 | 160655949 | 160655968 | 160655965 | + |

Figure 55 (Cont'd)

| | | | | | | | |
|---|---|---|---|---|---|---|---|
| SEQ ID NO 34625 | CTTCTGGTGGGTCTTATGGA | CAG | chr6 | 160655953 | 160655972 | 160655969 | + |
| SEQ ID NO 34626 | TTCTGGTGGGTCTTATGGAC | AGG | chr6 | 160655954 | 160655973 | 160655970 | + |
| SEQ ID NO 34627 | GTGGGTCTTATGGACAGGAA | TGG | chr6 | 160655959 | 160655978 | 160655975 | + |
| SEQ ID NO 34628 | GGGTCTTATGGACAGGAATG | GAG | chr6 | 160655961 | 160655980 | 160655977 | + |
| SEQ ID NO 34629 | TATGGACAGGAATGGAGAAA | AAG | chr6 | 160655967 | 160655986 | 160655983 | + |
| SEQ ID NO 34630 | TGGAGAAAAAGCCACTTGCC | AAG | chr6 | 160655979 | 160655998 | 160655995 | + |
| SEQ ID NO 34631 | AAAGCCACTTGCCAAGCCAA | TGG | chr6 | 160655986 | 160656005 | 160656002 | + |
| SEQ ID NO 34632 | CCAAGCCAATGGCTGCATAC | CAG | chr6 | 160655997 | 160656016 | 160656013 | + |
| SEQ ID NO 34633 | CAAGCCAATGGCTGCATACC | AGG | chr6 | 160655998 | 160656017 | 160656014 | + |
| SEQ ID NO 34634 | AATGGCTGCATACCAGGCAC | CAG | chr6 | 160656004 | 160656023 | 160656020 | + |
| SEQ ID NO 34635 | ATGGCTGCATACCAGGCACC | AGG | chr6 | 160656005 | 160656024 | 160656021 | + |
| SEQ ID NO 34636 | GGCTGCATACCAGGCACCAG | GAG | chr6 | 160656007 | 160656026 | 160656023 | + |
| SEQ ID NO 34637 | GGAGATGTGTTAATTTGCTC | AAG | chr6 | 160656026 | 160656045 | 160656042 | + |
| SEQ ID NO 34638 | TCAAGCAACAAAACCACAAC | TGG | chr6 | 160656044 | 160656063 | 160656060 | + |
| SEQ ID NO 34639 | AGCAACAAAACCACAACTGG | TAG | chr6 | 160656047 | 160656066 | 160656063 | + |
| SEQ ID NO 34640 | CAACAAAACCACAACTGGTA | GAG | chr6 | 160656049 | 160656068 | 160656065 | + |
| SEQ ID NO 34641 | CAAAACCACAACTGGTAGAG | CAG | chr6 | 160656052 | 160656071 | 160656068 | + |
| SEQ ID NO 34642 | ACTGGTAGAGCAGCTGCAAT | TGG | chr6 | 160656062 | 160656081 | 160656078 | + |
| SEQ ID NO 34643 | TGGTAGAGCAGCTGCAATTG | GAG | chr6 | 160656064 | 160656083 | 160656080 | + |
| SEQ ID NO 34644 | CTGCAATTGGAGTCACCACT | TGG | chr6 | 160656075 | 160656094 | 160656091 | + |
| SEQ ID NO 34645 | ATTGGAGTCACCACTTGGTT | AAG | chr6 | 160656080 | 160656099 | 160656096 | + |
| SEQ ID NO 34646 | ATAATCCACCATCATTTTCC | AAG | chr6 | 160656109 | 160656128 | 160656125 | + |
| SEQ ID NO 34647 | AGATCCATCTGTCCTCTGCA | CAG | chr6 | 160656130 | 160656149 | 160656146 | + |
| SEQ ID NO 34648 | GATCCATCTGTCCTCTGCAC | AGG | chr6 | 160656131 | 160656150 | 160656147 | + |
| SEQ ID NO 34649 | TGTCCTCTGCACAGGTCAAA | TGG | chr6 | 160656139 | 160656158 | 160656155 | + |
| SEQ ID NO 34650 | GTCCTCTGCACAGGTCAAAT | GGG | chr6 | 160656140 | 160656159 | 160656156 | + |
| SEQ ID NO 34651 | CCTCTGCACAGGTCAAATGG | GAG | chr6 | 160656142 | 160656161 | 160656158 | + |
| SEQ ID NO 34652 | TCTGCACAGGTCAAATGGGA | GAG | chr6 | 160656144 | 160656163 | 160656160 | + |
| SEQ ID NO 34653 | GGTCAAATGGGAGAGTTGAA | CAG | chr6 | 160656152 | 160656171 | 160656168 | + |
| SEQ ID NO 34654 | GTCAAATGGGAGAGTTGAAC | AGG | chr6 | 160656153 | 160656172 | 160656169 | + |
| SEQ ID NO 34655 | TCAAATGGGAGAGTTGAACA | GGG | chr6 | 160656154 | 160656173 | 160656170 | + |
| SEQ ID NO 34656 | GGGAGAGTTGAACAGGGATG | TGG | chr6 | 160656160 | 160656179 | 160656176 | + |
| SEQ ID NO 34657 | AGAGTTGAACAGGGATGTGG | TGG | chr6 | 160656163 | 160656182 | 160656179 | + |
| SEQ ID NO 34658 | GAGTTGAACAGGGATGTGGT | GGG | chr6 | 160656164 | 160656183 | 160656180 | + |
| SEQ ID NO 34659 | TCACCACCCCTGCGTCTTTC | AAG | chr6 | 160656189 | 160656208 | 160656205 | + |
| SEQ ID NO 34660 | TGCGTCTTTCAAGTCCTTGA | TGG | chr6 | 160656199 | 160656218 | 160656215 | + |
| SEQ ID NO 34661 | GATGGTGACACTAATCACTT | CAG | chr6 | 160656217 | 160656236 | 160656233 | + |
| SEQ ID NO 34662 | ACTAATCACTTCAGTCCCTC | CAG | chr6 | 160656226 | 160656245 | 160656242 | + |
| SEQ ID NO 34663 | CTAATCACTTCAGTCCCTCC | AGG | chr6 | 160656227 | 160656246 | 160656243 | + |
| SEQ ID NO 34664 | TAATCACTTCAGTCCCTCCA | GGG | chr6 | 160656228 | 160656247 | 160656244 | + |
| SEQ ID NO 34665 | CACTTCAGTCCCTCCAGGGA | TGG | chr6 | 160656232 | 160656251 | 160656248 | + |
| SEQ ID NO 34666 | ACTTCAGTCCCTCCAGGGAT | GGG | chr6 | 160656233 | 160656252 | 160656249 | + |
| SEQ ID NO 34667 | TTTTGATTTTTTATTTTTC | TAG | chr6 | 160656263 | 160656282 | 160656279 | + |
| SEQ ID NO 34668 | TTTGATTTTTTATTTTTCT | AGG | chr6 | 160656264 | 160656283 | 160656280 | + |
| SEQ ID NO 34669 | GATTTTTTATTTTTCTAGG | TAG | chr6 | 160656267 | 160656286 | 160656283 | + |
| SEQ ID NO 34670 | TTTTTTATTTTTCTAGGTA | GAG | chr6 | 160656269 | 160656288 | 160656285 | + |
| SEQ ID NO 34671 | TTTATTTTTCTAGGTAGAGA | CAG | chr6 | 160656273 | 160656292 | 160656289 | + |

Figure 55 (Cont'd)

| | | | | | | | |
|---|---|---|---|---|---|---|---|
| SEQ ID NO 34672 | CTAGGTAGAGACAGCTCTAA | TGG | chr6 | 160656282 | 160656301 | 160656298 | + |
| SEQ ID NO 34673 | CAGCTCTAATGGCTTCTGTT | TGG | chr6 | 160656293 | 160656312 | 160656309 | + |
| SEQ ID NO 34674 | TTTGGCCTTTCCCACCATAA | TAG | chr6 | 160656311 | 160656330 | 160656327 | + |
| SEQ ID NO 34675 | CATAATAGCCCTCATCCTAC | CAG | chr6 | 160656326 | 160656345 | 160656342 | + |
| SEQ ID NO 34676 | ATAGCCCTCATCCTACCAGT | CAG | chr6 | 160656330 | 160656349 | 160656346 | + |
| SEQ ID NO 34677 | TAGCCCTCATCCTACCAGTC | AGG | chr6 | 160656331 | 160656350 | 160656347 | + |
| SEQ ID NO 34678 | AGCCCTCATCCTACCAGTCA | GGG | chr6 | 160656332 | 160656351 | 160656348 | + |
| SEQ ID NO 34679 | CCCTCATCCTACCAGTCAGG | GAG | chr6 | 160656334 | 160656353 | 160656350 | + |
| SEQ ID NO 34680 | TACCAGTCAGGGAGCCAATG | TGG | chr6 | 160656343 | 160656362 | 160656359 | + |
| SEQ ID NO 34681 | AGCCAATGTGGCATTTCTGC | CAG | chr6 | 160656355 | 160656374 | 160656371 | + |
| SEQ ID NO 34682 | TGGCATTTCTGCCAGCTAAT | AAG | chr6 | 160656363 | 160656382 | 160656379 | + |
| SEQ ID NO 34683 | TCTATACAAATTATGCATTT | TGG | chr6 | 160656390 | 160656409 | 160656406 | + |
| SEQ ID NO 34684 | CAAATTATGCATTTTGGCAC | TGG | chr6 | 160656396 | 160656415 | 160656412 | + |
| SEQ ID NO 34685 | AAATTATGCATTTTGGCACT | GGG | chr6 | 160656397 | 160656416 | 160656413 | + |
| SEQ ID NO 34686 | TTTGGCACTGGGAAAATGAC | CAG | chr6 | 160656408 | 160656427 | 160656424 | + |
| SEQ ID NO 34687 | TGGCACTGGGAAAATGACCA | GAG | chr6 | 160656410 | 160656429 | 160656426 | + |
| SEQ ID NO 34688 | GGCACTGGGAAAATGACCAG | AGG | chr6 | 160656411 | 160656430 | 160656427 | + |
| SEQ ID NO 34689 | TGGGAAAATGACCAGAGGAT | AAG | chr6 | 160656416 | 160656435 | 160656432 | + |
| SEQ ID NO 34690 | AAATGACCAGAGGATAAGTC | CAG | chr6 | 160656421 | 160656440 | 160656437 | + |
| SEQ ID NO 34691 | AATGACCAGAGGATAAGTCC | AGG | chr6 | 160656422 | 160656441 | 160656438 | + |
| SEQ ID NO 34692 | ATGACCAGAGGATAAGTCCA | GGG | chr6 | 160656423 | 160656442 | 160656439 | + |
| SEQ ID NO 34693 | GGATAAGTCCAGGGACCCAC | TGG | chr6 | 160656432 | 160656451 | 160656448 | + |
| SEQ ID NO 34694 | GGACCCACTGGAACCACTGT | AAG | chr6 | 160656444 | 160656463 | 160656460 | + |
| SEQ ID NO 34695 | CCACTGGAACCACTGTAAGT | CAG | chr6 | 160656448 | 160656467 | 160656464 | + |
| SEQ ID NO 34696 | AACCACTGTAAGTCAGAAAT | GAG | chr6 | 160656455 | 160656474 | 160656471 | + |
| SEQ ID NO 34697 | ATTAATTACCTAACCTCCAT | AAG | chr6 | 160656488 | 160656507 | 160656504 | + |
| SEQ ID NO 34698 | CCATAAGCCCCTACTTTAAC | TGG | chr6 | 160656504 | 160656523 | 160656520 | + |
| SEQ ID NO 34699 | CATAAGCCCCTACTTTAACT | GGG | chr6 | 160656505 | 160656524 | 160656521 | + |
| SEQ ID NO 34700 | ATAAGCCCCTACTTTAACTG | GGG | chr6 | 160656506 | 160656525 | 160656522 | + |
| SEQ ID NO 34701 | GGGGAACCACAATAACGTTT | TGG | chr6 | 160656525 | 160656544 | 160656541 | + |
| SEQ ID NO 34702 | GGGAACCACAATAACGTTTT | GGG | chr6 | 160656526 | 160656545 | 160656542 | + |
| SEQ ID NO 34703 | CAATAACGTTTTGGGTACCC | TGG | chr6 | 160656534 | 160656553 | 160656550 | + |
| SEQ ID NO 34704 | GGGTACCCTGGAATCAACGT | CAG | chr6 | 160656546 | 160656565 | 160656562 | + |
| SEQ ID NO 34705 | CCCTGGAATCAACGTCAGCT | CAG | chr6 | 160656551 | 160656570 | 160656567 | + |
| SEQ ID NO 34706 | CTGGAATCAACGTCAGCTCA | GAG | chr6 | 160656553 | 160656572 | 160656569 | + |
| SEQ ID NO 34707 | AATCAACGTCAGCTCAGAGC | CAG | chr6 | 160656557 | 160656576 | 160656573 | + |
| SEQ ID NO 34708 | GTCAGCTCAGAGCCAGTGTC | CAG | chr6 | 160656564 | 160656583 | 160656580 | + |
| SEQ ID NO 34709 | TCTCATTACTTCCCTTTCTC | CAG | chr6 | 160656601 | 160656620 | 160656617 | + |
| SEQ ID NO 34710 | TTCCCTTTCTCCAGTACACA | CAG | chr6 | 160656610 | 160656629 | 160656626 | + |
| SEQ ID NO 34711 | TCCAGTACACACAGTTACCC | TGG | chr6 | 160656619 | 160656638 | 160656635 | + |
| SEQ ID NO 34712 | ACACACAGTTACCCTGGTAA | AAG | chr6 | 160656625 | 160656644 | 160656641 | + |
| SEQ ID NO 34713 | CACACAGTTACCCTGGTAAA | AGG | chr6 | 160656626 | 160656645 | 160656642 | + |
| SEQ ID NO 34714 | CAGTTACCCTGGTAAAAGGC | CAG | chr6 | 160656630 | 160656649 | 160656646 | + |
| SEQ ID NO 34715 | GTTACCCTGGTAAAAGGCCA | GAG | chr6 | 160656632 | 160656651 | 160656648 | + |
| SEQ ID NO 34716 | TTACCCTGGTAAAAGGCCAG | AGG | chr6 | 160656633 | 160656652 | 160656649 | + |
| SEQ ID NO 34717 | TAAAAGGCCAGAGGTCTCCT | TAG | chr6 | 160656642 | 160656661 | 160656658 | + |
| SEQ ID NO 34718 | AAAAGGCCAGAGGTCTCCTT | AGG | chr6 | 160656643 | 160656662 | 160656659 | + |

Figure 55 (Cont'd)

| | | | | | | | |
|---|---|---|---|---|---|---|---|
| SEQ ID NO 34719 | AAAGGCCAGAGGTCTCCTTA | GGG | chr6 | 160656644 | 160656663 | 160656660 | + |
| SEQ ID NO 34720 | GGCCAGAGGTCTCCTTAGGG | AAG | chr6 | 160656647 | 160656666 | 160656663 | + |
| SEQ ID NO 34721 | GCCAGAGGTCTCCTTAGGGA | AGG | chr6 | 160656648 | 160656667 | 160656664 | + |
| SEQ ID NO 34722 | GAGGTCTCCTTAGGGAAGGA | TGG | chr6 | 160656652 | 160656671 | 160656668 | + |
| SEQ ID NO 34723 | AGGTCTCCTTAGGGAAGGAT | GGG | chr6 | 160656653 | 160656672 | 160656669 | + |
| SEQ ID NO 34724 | GTCTCCTTAGGGAAGGATGG | GAG | chr6 | 160656655 | 160656674 | 160656671 | + |
| SEQ ID NO 34725 | CCTTAGGGAAGGATGGGAGA | AAG | chr6 | 160656659 | 160656678 | 160656675 | + |
| SEQ ID NO 34726 | TTAGGGAAGGATGGGAGAAA | GAG | chr6 | 160656661 | 160656680 | 160656677 | + |
| SEQ ID NO 34727 | AAGGATGGGAGAAAGAGTAA | CAG | chr6 | 160656667 | 160656686 | 160656683 | + |
| SEQ ID NO 34728 | GGGAGAAAGAGTAACAGCAT | AAG | chr6 | 160656673 | 160656692 | 160656689 | + |
| SEQ ID NO 34729 | AGAGTAACAGCATAAGTTGT | CAG | chr6 | 160656680 | 160656699 | 160656696 | + |
| SEQ ID NO 34730 | GTAACAGCATAAGTTGTCAG | TAG | chr6 | 160656683 | 160656702 | 160656699 | + |
| SEQ ID NO 34731 | AGCATAAGTTGTCAGTAGCC | TAG | chr6 | 160656688 | 160656707 | 160656704 | + |
| SEQ ID NO 34732 | ATAAGTTGTCAGTAGCCTAG | TGG | chr6 | 160656691 | 160656710 | 160656707 | + |
| SEQ ID NO 34733 | GCCTAGTGGTGTCCTTCCTC | AAG | chr6 | 160656705 | 160656724 | 160656721 | + |
| SEQ ID NO 34734 | CCTAGTGGTGTCCTTCCTCA | AGG | chr6 | 160656706 | 160656725 | 160656722 | + |
| SEQ ID NO 34735 | CTAGTGGTGTCCTTCCTCAA | GGG | chr6 | 160656707 | 160656726 | 160656723 | + |
| SEQ ID NO 34736 | TAGTGGTGTCCTTCCTCAAG | GGG | chr6 | 160656708 | 160656727 | 160656724 | + |
| SEQ ID NO 34737 | TGTCCTTCCTCAAGGGGATC | CAG | chr6 | 160656714 | 160656733 | 160656730 | + |
| SEQ ID NO 34738 | GATCCAGCCTCCCCTTCATT | CAG | chr6 | 160656730 | 160656749 | 160656746 | + |
| SEQ ID NO 34739 | CCAGCCTCCCCTTCATTCAG | TGG | chr6 | 160656733 | 160656752 | 160656749 | + |
| SEQ ID NO 34740 | CAGCCTCCCCTTCATTCAGT | GGG | chr6 | 160656734 | 160656753 | 160656750 | + |
| SEQ ID NO 34741 | CCCCTTCATTCAGTGGGTTC | TGG | chr6 | 160656740 | 160656759 | 160656756 | + |
| SEQ ID NO 34742 | AGTGGGTTCTGGAACTGTAA | CAG | chr6 | 160656751 | 160656770 | 160656767 | + |
| SEQ ID NO 34743 | GTGGGTTCTGGAACTGTAAC | AGG | chr6 | 160656752 | 160656771 | 160656768 | + |
| SEQ ID NO 34744 | TCTGGAACTGTAACAGGTTC | GAG | chr6 | 160656758 | 160656777 | 160656774 | + |
| SEQ ID NO 34745 | AACTGTAACAGGTTCGAGTC | TGG | chr6 | 160656763 | 160656782 | 160656779 | + |
| SEQ ID NO 34746 | TTCGAGTCTGGAAATTGATT | GAG | chr6 | 160656775 | 160656794 | 160656791 | + |
| SEQ ID NO 34747 | TCGAGTCTGGAAATTGATTG | AGG | chr6 | 160656776 | 160656795 | 160656792 | + |
| SEQ ID NO 34748 | CGAGTCTGGAAATTGATTGA | GGG | chr6 | 160656777 | 160656796 | 160656793 | + |
| SEQ ID NO 34749 | GATTCTCTGTTTTTATAATT | CAG | chr6 | 160656805 | 160656824 | 160656821 | + |
| SEQ ID NO 34750 | TCTGTTTTTATAATTCAGAT | TAG | chr6 | 160656810 | 160656829 | 160656826 | + |
| SEQ ID NO 34751 | TTATAATTCAGATTAGTCTT | TAG | chr6 | 160656817 | 160656836 | 160656833 | + |
| SEQ ID NO 34752 | AGTCTTTAGTCCATTCTACC | TGG | chr6 | 160656831 | 160656850 | 160656847 | + |
| SEQ ID NO 34753 | CTTTAGTCCATTCTACCTGG | CAG | chr6 | 160656834 | 160656853 | 160656850 | + |
| SEQ ID NO 34754 | GTTTTTTGTTTATATAAATC | AAG | chr6 | 160656856 | 160656875 | 160656872 | + |
| SEQ ID NO 34755 | TTTTGTTTATATAAATCAAG | TAG | chr6 | 160656859 | 160656878 | 160656875 | + |
| SEQ ID NO 34756 | TTTGTTTATATAAATCAAGT | AGG | chr6 | 160656860 | 160656879 | 160656876 | + |
| SEQ ID NO 34757 | ATATAAATCAAGTAGGAATA | CAG | chr6 | 160656867 | 160656886 | 160656883 | + |
| SEQ ID NO 34758 | TAAATCAAGTAGGAATACAG | TAG | chr6 | 160656870 | 160656889 | 160656886 | + |
| SEQ ID NO 34759 | AAATCAAGTAGGAATACAGT | AGG | chr6 | 160656871 | 160656890 | 160656887 | + |
| SEQ ID NO 34760 | TTTCCCATCAATTTCACTTC | TAG | chr6 | 160656894 | 160656913 | 160656910 | + |
| SEQ ID NO 34761 | TTCCCATCAATTTCACTTCT | AGG | chr6 | 160656895 | 160656914 | 160656911 | + |
| SEQ ID NO 34762 | CTAGGAACACCATGATTAAT | TAG | chr6 | 160656913 | 160656932 | 160656929 | + |
| SEQ ID NO 34763 | CATGATTAATTAGCCAATGC | CAG | chr6 | 160656923 | 160656942 | 160656939 | + |
| SEQ ID NO 34764 | TGATTAATTAGCCAATGCCA | GAG | chr6 | 160656925 | 160656944 | 160656941 | + |
| SEQ ID NO 34765 | CCAATGCCAGAGCTCTACAT | GAG | chr6 | 160656936 | 160656955 | 160656952 | + |

Figure 55 (Cont'd)

| SEQ ID NO 34766 | TGCCAGAGCTCTACATGAGT | CAG | chr6 | 160656940 | 160656959 | 160656956 | + |
| SEQ ID NO 34767 | CATGAGTCAGACTATTCTGA | TGG | chr6 | 160656953 | 160656972 | 160656969 | + |
| SEQ ID NO 34768 | TTTGCCTCTGCTGTCTATTA | TGG | chr6 | 160656980 | 160656999 | 160656996 | + |
| SEQ ID NO 34769 | GCCTCTGCTGTCTATTATGG | TAG | chr6 | 160656983 | 160657002 | 160656999 | + |
| SEQ ID NO 34770 | TATGCCCACCTTGCCTTTGA | TGG | chr6 | 160657007 | 160657026 | 160657023 | + |
| SEQ ID NO 34771 | CCACCTTGCCTTTGATGGTT | CAG | chr6 | 160657012 | 160657031 | 160657028 | + |
| SEQ ID NO 34772 | GATGGTTCAGTGCCAACACT | TGG | chr6 | 160657025 | 160657044 | 160657041 | + |
| SEQ ID NO 34773 | ACACTTGGCCCCTGCCACCT | CAG | chr6 | 160657040 | 160657059 | 160657056 | + |
| SEQ ID NO 34774 | CACTTGGCCCCTGCCACCTC | AGG | chr6 | 160657041 | 160657060 | 160657057 | + |
| SEQ ID NO 34775 | CCCATTGTATTTAAATTTTG | TAG | chr6 | 160657075 | 160657094 | 160657091 | + |
| SEQ ID NO 34776 | TGTATTTAAATTTTGTAGTT | GAG | chr6 | 160657080 | 160657099 | 160657096 | + |
| SEQ ID NO 34777 | ATTTTGTAGTTGAGTGACTG | TGG | chr6 | 160657089 | 160657108 | 160657105 | + |
| SEQ ID NO 34778 | GTGACTGTGGTTCCTACTGT | TAG | chr6 | 160657102 | 160657121 | 160657118 | + |
| SEQ ID NO 34779 | CTACTGTTAGATCTGACATA | CAG | chr6 | 160657115 | 160657134 | 160657131 | + |
| SEQ ID NO 34780 | ACTGTTAGATCTGACATACA | GAG | chr6 | 160657117 | 160657136 | 160657133 | + |
| SEQ ID NO 34781 | GTTAGATCTGACATACAGAG | AAG | chr6 | 160657120 | 160657139 | 160657136 | + |
| SEQ ID NO 34782 | TAGATCTGACATACAGAGAA | GAG | chr6 | 160657122 | 160657141 | 160657138 | + |
| SEQ ID NO 34783 | CATACAGAGAAGAGCAATTA | CGG | chr6 | 160657131 | 160657150 | 160657147 | + |
| SEQ ID NO 34784 | ATACAGAGAAGAGCAATTAC | GGG | chr6 | 160657132 | 160657151 | 160657148 | + |
| SEQ ID NO 34785 | TTACGGGCTCTTCAAAAATA | CAG | chr6 | 160657148 | 160657167 | 160657164 | + |
| SEQ ID NO 34786 | TACGGGCTCTTCAAAAATAC | AGG | chr6 | 160657149 | 160657168 | 160657165 | + |
| SEQ ID NO 34787 | TCTCACAAATCTATTTCACA | AAG | chr6 | 160657178 | 160657197 | 160657194 | + |
| SEQ ID NO 34788 | AAATCTATTTCACAAAGCTT | CGG | chr6 | 160657184 | 160657203 | 160657200 | + |
| SEQ ID NO 34789 | TATTTCACAAAGCTTCGGCC | AAG | chr6 | 160657189 | 160657208 | 160657205 | + |
| SEQ ID NO 34790 | ATTTCACAAAGCTTCGGCCA | AGG | chr6 | 160657190 | 160657209 | 160657206 | + |
| SEQ ID NO 34791 | TTTCACAAAGCTTCGGCCAA | GGG | chr6 | 160657191 | 160657210 | 160657207 | + |
| SEQ ID NO 34792 | TCGGCCAAGGGTGTATCTTC | TGG | chr6 | 160657203 | 160657222 | 160657219 | + |
| SEQ ID NO 34793 | GTGTATCTTCTGGACCCTCC | CAG | chr6 | 160657213 | 160657232 | 160657229 | + |
| SEQ ID NO 34794 | ATCTTCTGGACCCTCCCAGC | TGG | chr6 | 160657217 | 160657236 | 160657233 | + |
| SEQ ID NO 34795 | TCTTCTGGACCCTCCCAGCT | GGG | chr6 | 160657218 | 160657237 | 160657234 | + |
| SEQ ID NO 34796 | TGGACCCTCCCAGCTGGGAT | GAG | chr6 | 160657223 | 160657242 | 160657239 | + |
| SEQ ID NO 34797 | ACCCTCCCAGCTGGGATGAG | TAG | chr6 | 160657226 | 160657245 | 160657242 | + |
| SEQ ID NO 34798 | CCCTCCCAGCTGGGATGAGT | AGG | chr6 | 160657227 | 160657246 | 160657243 | + |
| SEQ ID NO 34799 | AGCTGGGATGAGTAGGTCTA | AAG | chr6 | 160657234 | 160657253 | 160657250 | + |
| SEQ ID NO 34800 | TCCACCATCCTAATCTCCCT | AAG | chr6 | 160657269 | 160657288 | 160657285 | + |
| SEQ ID NO 34801 | TCCTAATCTCCCTAAGCCTT | TGG | chr6 | 160657276 | 160657295 | 160657292 | + |
| SEQ ID NO 34802 | CACTTCCTCTACATTAAACC | AAG | chr6 | 160657301 | 160657320 | 160657317 | + |
| SEQ ID NO 34803 | ACTTCCTCTACATTAAACCA | AGG | chr6 | 160657302 | 160657321 | 160657318 | + |
| SEQ ID NO 34804 | ACATTAAACCAAGGCATTTC | CAG | chr6 | 160657311 | 160657330 | 160657327 | + |
| SEQ ID NO 34805 | CATTTCCAGCTCACTAACAT | TGG | chr6 | 160657325 | 160657344 | 160657341 | + |
| SEQ ID NO 34806 | CCATCTTTTAATCCATATTT | CAG | chr6 | 160657349 | 160657368 | 160657365 | + |
| SEQ ID NO 34807 | AATCCATATTTCAGCTAACC | AAG | chr6 | 160657358 | 160657377 | 160657374 | + |
| SEQ ID NO 34808 | AACTTTTTTTTTTTTTTTTT | TGG | chr6 | 160657396 | 160657415 | 160657412 | + |
| SEQ ID NO 34809 | TTTTTTTTTTTTTTGGAAA | TGG | chr6 | 160657402 | 160657421 | 160657418 | + |
| SEQ ID NO 34810 | TTTTTTTTTTTTGGAAATG | GAG | chr6 | 160657404 | 160657423 | 160657420 | + |
| SEQ ID NO 34811 | ATGGAGTCTTGCTCTGTTAC | CAG | chr6 | 160657421 | 160657440 | 160657437 | + |
| SEQ ID NO 34812 | TGGAGTCTTGCTCTGTTACC | AGG | chr6 | 160657422 | 160657441 | 160657438 | + |

Figure 55 (Cont'd)

| | | | | | | | |
|---|---|---|---|---|---|---|---|
| SEQ ID NO 34813 | GTCTTGCTCTGTTACCAGGC | TGG | chr6 | 160657426 | 160657445 | 160657442 | + |
| SEQ ID NO 34814 | TCTGTTACCAGGCTGGAATG | CAG | chr6 | 160657433 | 160657452 | 160657449 | + |
| SEQ ID NO 34815 | GTTACCAGGCTGGAATGCAG | TGG | chr6 | 160657436 | 160657455 | 160657452 | + |
| SEQ ID NO 34816 | TTACCAGGCTGGAATGCAGT | GGG | chr6 | 160657437 | 160657456 | 160657453 | + |
| SEQ ID NO 34817 | TACCAGGCTGGAATGCAGTG | GGG | chr6 | 160657438 | 160657457 | 160657454 | + |
| SEQ ID NO 34818 | GGAATGCAGTGGGGCGATCT | TGG | chr6 | 160657447 | 160657466 | 160657463 | + |
| SEQ ID NO 34819 | TCACTGCAATCTCTGCCTCA | CAG | chr6 | 160657471 | 160657490 | 160657487 | + |
| SEQ ID NO 34820 | CACTGCAATCTCTGCCTCAC | AGG | chr6 | 160657472 | 160657491 | 160657488 | + |
| SEQ ID NO 34821 | AATCTCTGCCTCACAGGTTC | AAG | chr6 | 160657478 | 160657497 | 160657494 | + |
| SEQ ID NO 34822 | CTCTGCCTCACAGGTTCAAG | CAG | chr6 | 160657481 | 160657500 | 160657497 | + |
| SEQ ID NO 34823 | TTCAAGCAGTTCTCTTGCCT | CAG | chr6 | 160657495 | 160657514 | 160657511 | + |
| SEQ ID NO 34824 | TTCTCTTGCCTCAGCCTCCC | AAG | chr6 | 160657504 | 160657523 | 160657520 | + |
| SEQ ID NO 34825 | TCTTGCCTCAGCCTCCCAAG | TAG | chr6 | 160657507 | 160657526 | 160657523 | + |
| SEQ ID NO 34826 | CCTCAGCCTCCCAAGTAGAT | GAG | chr6 | 160657512 | 160657531 | 160657528 | + |
| SEQ ID NO 34827 | CTCCCAAGTAGATGAGATTA | CAG | chr6 | 160657519 | 160657538 | 160657535 | + |
| SEQ ID NO 34828 | CAGTTACGCATCACCATGCC | CAG | chr6 | 160657539 | 160657558 | 160657555 | + |
| SEQ ID NO 34829 | CCAGCTAATTTTTGTATTTT | TAG | chr6 | 160657558 | 160657577 | 160657574 | + |
| SEQ ID NO 34830 | GCTAATTTTTGTATTTTTAG | CAG | chr6 | 160657561 | 160657580 | 160657577 | + |
| SEQ ID NO 34831 | TAATTTTTGTATTTTTAGCA | GAG | chr6 | 160657563 | 160657582 | 160657579 | + |
| SEQ ID NO 34832 | TTTTGTATTTTTAGCAGAGA | TGG | chr6 | 160657567 | 160657586 | 160657583 | + |
| SEQ ID NO 34833 | TTTGTATTTTTAGCAGAGAT | GGG | chr6 | 160657568 | 160657587 | 160657584 | + |
| SEQ ID NO 34834 | TTGTATTTTTAGCAGAGATG | GGG | chr6 | 160657569 | 160657588 | 160657585 | + |
| SEQ ID NO 34835 | GAGATGGGGTTTCACCATTT | TAG | chr6 | 160657583 | 160657602 | 160657599 | + |
| SEQ ID NO 34836 | TGGGGTTTCACCATTTTAGC | CAG | chr6 | 160657587 | 160657606 | 160657603 | + |
| SEQ ID NO 34837 | TCTGCCCGCCCCGCCTCCC | AAG | chr6 | 160657637 | 160657656 | 160657653 | + |
| SEQ ID NO 34838 | CTGCCCGCCCCGCCTCCCA | AGG | chr6 | 160657638 | 160657657 | 160657654 | + |
| SEQ ID NO 34839 | GCCCCGCCTCCCAAGGTGC | TGG | chr6 | 160657644 | 160657663 | 160657660 | + |
| SEQ ID NO 34840 | CCCCGCCTCCCAAGGTGCT | GGG | chr6 | 160657645 | 160657664 | 160657661 | + |
| SEQ ID NO 34841 | CTCCCAAGGTGCTGGGATTA | CAG | chr6 | 160657652 | 160657671 | 160657668 | + |
| SEQ ID NO 34842 | TCCCAAGGTGCTGGGATTAC | AGG | chr6 | 160657653 | 160657672 | 160657669 | + |
| SEQ ID NO 34843 | GGTGCTGGGATTACAGGCGT | GAG | chr6 | 160657659 | 160657678 | 160657675 | + |
| SEQ ID NO 34844 | CAGGCGTGAGCCACTGCTCC | CGG | chr6 | 160657672 | 160657691 | 160657688 | + |
| SEQ ID NO 34845 | GCCACTGCTCCCGGCCCTAT | CAG | chr6 | 160657681 | 160657700 | 160657697 | + |
| SEQ ID NO 34846 | GCCCTATCAGAACCTTTTCT | AAG | chr6 | 160657694 | 160657713 | 160657710 | + |
| SEQ ID NO 34847 | AGAACCTTTTCTAAGTCCCC | GAG | chr6 | 160657702 | 160657721 | 160657718 | + |
| SEQ ID NO 34848 | CCGAGCTGCAACATTAAATG | CAG | chr6 | 160657720 | 160657739 | 160657736 | + |
| SEQ ID NO 34849 | TTAAATGCAGAATCCCTACT | TAG | chr6 | 160657733 | 160657752 | 160657749 | + |
| SEQ ID NO 34850 | AATGCAGAATCCCTACTTAG | TAG | chr6 | 160657736 | 160657755 | 160657752 | + |
| SEQ ID NO 34851 | ATGCAGAATCCCTACTTAGT | AGG | chr6 | 160657737 | 160657756 | 160657753 | + |
| SEQ ID NO 34852 | TGCAGAATCCCTACTTAGTA | GGG | chr6 | 160657738 | 160657757 | 160657754 | + |
| SEQ ID NO 34853 | TAGGGCCAAACCAATAAATT | CAG | chr6 | 160657756 | 160657775 | 160657772 | + |
| SEQ ID NO 34854 | CCATTCCCATGCCTGTTCTC | CAG | chr6 | 160657828 | 160657847 | 160657844 | + |
| SEQ ID NO 34855 | AGATTTCTGCCAATATAAAT | TAG | chr6 | 160657849 | 160657868 | 160657865 | + |
| SEQ ID NO 34856 | TTCTGCCAATATAAATTAGA | AAG | chr6 | 160657853 | 160657872 | 160657869 | + |
| SEQ ID NO 34857 | CAATATAAATTAGAAAGCTT | AAG | chr6 | 160657859 | 160657878 | 160657875 | + |
| SEQ ID NO 34858 | TATAAATTAGAAAGCTTAAG | CAG | chr6 | 160657862 | 160657881 | 160657878 | + |
| SEQ ID NO 34859 | GAAAGCTTAAGCAGTTCTTT | TAG | chr6 | 160657871 | 160657890 | 160657887 | + |

Figure 55 (Cont'd)

| SEQ ID NO 34860 | AAGCTTAAGCAGTTCTTTTA | GAG | chr6 | 160657873 | 160657892 | 160657889 | + |
| SEQ ID NO 34861 | GAGTATAATGCACCTCCTCA | TGG | chr6 | 160657893 | 160657912 | 160657909 | + |
| SEQ ID NO 34862 | AGTATAATGCACCTCCTCAT | GGG | chr6 | 160657894 | 160657913 | 160657910 | + |
| SEQ ID NO 34863 | CACACTCTGAACCTCACCTC | TGG | chr6 | 160657918 | 160657937 | 160657934 | + |
| SEQ ID NO 34864 | ACACTCTGAACCTCACCTCT | GGG | chr6 | 160657919 | 160657938 | 160657935 | + |
| SEQ ID NO 34865 | CACTCTGAACCTCACCTCTG | GGG | chr6 | 160657920 | 160657939 | 160657936 | + |
| SEQ ID NO 34866 | ACCTCACCTCTGGGGCCCGC | AAG | chr6 | 160657928 | 160657947 | 160657944 | + |
| SEQ ID NO 34867 | CCTCACCTCTGGGGCCCGCA | AGG | chr6 | 160657929 | 160657948 | 160657945 | + |
| SEQ ID NO 34868 | TCTGGGGCCCGCAAGGAATT | TAG | chr6 | 160657936 | 160657955 | 160657952 | + |
| SEQ ID NO 34869 | GGCCCGCAAGGAATTTAGCC | TAG | chr6 | 160657941 | 160657960 | 160657957 | + |
| SEQ ID NO 34870 | CAAGGAATTTAGCCTAGTTA | TAG | chr6 | 160657947 | 160657966 | 160657963 | + |
| SEQ ID NO 34871 | AAGGAATTTAGCCTAGTTAT | AGG | chr6 | 160657948 | 160657967 | 160657964 | + |
| SEQ ID NO 34872 | ATTTAGCCTAGTTATAGGTC | TAG | chr6 | 160657953 | 160657972 | 160657969 | + |
| SEQ ID NO 34873 | TAGCCTAGTTATAGGTCTAG | AAG | chr6 | 160657956 | 160657975 | 160657972 | + |
| SEQ ID NO 34874 | GTTATAGGTCTAGAAGCATT | CAG | chr6 | 160657963 | 160657982 | 160657979 | + |
| SEQ ID NO 34875 | TTATAGGTCTAGAAGCATTC | AGG | chr6 | 160657964 | 160657983 | 160657980 | + |
| SEQ ID NO 34876 | TATAGGTCTAGAAGCATTCA | GGG | chr6 | 160657965 | 160657984 | 160657981 | + |
| SEQ ID NO 34877 | ATAGGTCTAGAAGCATTCAG | GGG | chr6 | 160657966 | 160657985 | 160657982 | + |
| SEQ ID NO 34878 | CTAGAAGCATTCAGGGGCAT | TAG | chr6 | 160657972 | 160657991 | 160657988 | + |
| SEQ ID NO 34879 | TAGAAGCATTCAGGGGCATT | AGG | chr6 | 160657973 | 160657992 | 160657989 | + |
| SEQ ID NO 34880 | AGAAGCATTCAGGGGCATTA | GGG | chr6 | 160657974 | 160657993 | 160657990 | + |
| SEQ ID NO 34881 | GAAGCATTCAGGGGCATTAG | GGG | chr6 | 160657975 | 160657994 | 160657991 | + |
| SEQ ID NO 34882 | GGGCATTAGGGGTGCCTCTT | GAG | chr6 | 160657986 | 160658005 | 160658002 | + |
| SEQ ID NO 34883 | GGCATTAGGGGTGCCTCTTG | AGG | chr6 | 160657987 | 160658006 | 160658003 | + |
| SEQ ID NO 34884 | CATTAGGGGTGCCTCTTGAG | GAG | chr6 | 160657989 | 160658008 | 160658005 | + |
| SEQ ID NO 34885 | AGAATCAACATTATCTTGCC | TGG | chr6 | 160658010 | 160658029 | 160658026 | + |
| SEQ ID NO 34886 | ATCAACATTATCTTGCCTGG | CAG | chr6 | 160658013 | 160658032 | 160658029 | + |
| SEQ ID NO 34887 | ATCTTGCCTGGCAGCTGCCT | CAG | chr6 | 160658022 | 160658041 | 160658038 | + |
| SEQ ID NO 34888 | TCTTGCCTGGCAGCTGCCTC | AGG | chr6 | 160658023 | 160658042 | 160658039 | + |
| SEQ ID NO 34889 | CTTGCCTGGCAGCTGCCTCA | GGG | chr6 | 160658024 | 160658043 | 160658040 | + |
| SEQ ID NO 34890 | GCCTGGCAGCTGCCTCAGGG | AAG | chr6 | 160658027 | 160658046 | 160658043 | + |
| SEQ ID NO 34891 | CCTGGCAGCTGCCTCAGGGA | AGG | chr6 | 160658028 | 160658047 | 160658044 | + |
| SEQ ID NO 34892 | AAGGCCATCACTGTTGCCTC | AAG | chr6 | 160658047 | 160658066 | 160658063 | + |
| SEQ ID NO 34893 | GCCATCACTGTTGCCTCAAG | CAG | chr6 | 160658050 | 160658069 | 160658066 | + |
| SEQ ID NO 34894 | CACTGTTGCCTCAAGCAGTG | CAG | chr6 | 160658055 | 160658074 | 160658071 | + |
| SEQ ID NO 34895 | ACTGTTGCCTCAAGCAGTGC | AGG | chr6 | 160658056 | 160658075 | 160658072 | + |
| SEQ ID NO 34896 | CTGTTGCCTCAAGCAGTGCA | GGG | chr6 | 160658057 | 160658076 | 160658073 | + |
| SEQ ID NO 34897 | CAGTGCAGGGTTTACATCCT | CAG | chr6 | 160658070 | 160658089 | 160658086 | + |
| SEQ ID NO 34898 | AGGGTTTACATCCTCAGACA | AAG | chr6 | 160658076 | 160658095 | 160658092 | + |
| SEQ ID NO 34899 | GGGTTTACATCCTCAGACAA | AGG | chr6 | 160658077 | 160658096 | 160658093 | + |
| SEQ ID NO 34900 | TTTACATCCTCAGACAAAGG | TGG | chr6 | 160658080 | 160658099 | 160658096 | + |
| SEQ ID NO 34901 | CATCCTCAGACAAAGGTGGA | AAG | chr6 | 160658084 | 160658103 | 160658100 | + |
| SEQ ID NO 34902 | ATCCTCAGACAAAGGTGGAA | AGG | chr6 | 160658085 | 160658104 | 160658101 | + |
| SEQ ID NO 34903 | GACAAAGGTGGAAAGGCTAA | TGG | chr6 | 160658092 | 160658111 | 160658108 | + |
| SEQ ID NO 34904 | AAAGGTGGAAAGGCTAATGG | CAG | chr6 | 160658095 | 160658114 | 160658111 | + |
| SEQ ID NO 34905 | TGGAAAGGCTAATGGCAGCA | CGG | chr6 | 160658100 | 160658119 | 160658116 | + |
| SEQ ID NO 34906 | GGAAAGGCTAATGGCAGCAC | GGG | chr6 | 160658101 | 160658120 | 160658117 | + |

Figure 55 (Cont'd)

| SEQ ID NO 34907 | AGGCTAATGGCAGCACGGGT | CAG | chr6 | 160658105 | 160658124 | 160658121 | + |
| SEQ ID NO 34908 | GGCTAATGGCAGCACGGGTC | AGG | chr6 | 160658106 | 160658125 | 160658122 | + |
| SEQ ID NO 34909 | GCTAATGGCAGCACGGGTCA | GGG | chr6 | 160658107 | 160658126 | 160658123 | + |
| SEQ ID NO 34910 | TAATGGCAGCACGGGTCAGG | GAG | chr6 | 160658109 | 160658128 | 160658125 | + |
| SEQ ID NO 34911 | AATGGCAGCACGGGTCAGGG | AGG | chr6 | 160658110 | 160658129 | 160658126 | + |
| SEQ ID NO 34912 | ATGGCAGCACGGGTCAGGGA | GGG | chr6 | 160658111 | 160658130 | 160658127 | + |
| SEQ ID NO 34913 | TGGCAGCACGGGTCAGGGAG | GGG | chr6 | 160658112 | 160658131 | 160658128 | + |
| SEQ ID NO 34914 | GGAGGGGATGTTACCACTAC | TGG | chr6 | 160658128 | 160658147 | 160658144 | + |
| SEQ ID NO 34915 | GAGGGGATGTTACCACTACT | GGG | chr6 | 160658129 | 160658148 | 160658145 | + |
| SEQ ID NO 34916 | AGGGGATGTTACCACTACTG | GGG | chr6 | 160658130 | 160658149 | 160658146 | + |
| SEQ ID NO 34917 | GATGTTACCACTACTGGGGA | TGG | chr6 | 160658134 | 160658153 | 160658150 | + |
| SEQ ID NO 34918 | ATGTTACCACTACTGGGGAT | GGG | chr6 | 160658135 | 160658154 | 160658151 | + |
| SEQ ID NO 34919 | TGTTACCACTACTGGGGATG | GGG | chr6 | 160658136 | 160658155 | 160658152 | + |
| SEQ ID NO 34920 | GATGGGGAAACTGTTTCTTC | TGG | chr6 | 160658152 | 160658171 | 160658168 | + |
| SEQ ID NO 34921 | AACTGTTTCTTCTGGCAAAA | AAG | chr6 | 160658160 | 160658179 | 160658176 | + |
| SEQ ID NO 34922 | TTCTGGCAAAAAGTTTCAT | CAG | chr6 | 160658169 | 160658188 | 160658185 | + |
| SEQ ID NO 34923 | CTGGCAAAAAGTTTCATCA | GAG | chr6 | 160658171 | 160658190 | 160658187 | + |
| SEQ ID NO 34924 | TTCATCAGAGTTCACAAACT | CAG | chr6 | 160658184 | 160658203 | 160658200 | + |
| SEQ ID NO 34925 | GTTCACAAACTCAGTGTCCT | CAG | chr6 | 160658193 | 160658212 | 160658209 | + |
| SEQ ID NO 34926 | CTCAGTGTCCTCAGCTTCAT | CAG | chr6 | 160658202 | 160658221 | 160658218 | + |
| SEQ ID NO 34927 | TCAGTGTCCTCAGCTTCATC | AGG | chr6 | 160658203 | 160658222 | 160658219 | + |
| SEQ ID NO 34928 | CAGTGTCCTCAGCTTCATCA | GGG | chr6 | 160658204 | 160658223 | 160658220 | + |
| SEQ ID NO 34929 | CTCCCACACATCCCCACTCC | AAG | chr6 | 160658229 | 160658248 | 160658245 | + |
| SEQ ID NO 34930 | CACATCCCCACTCCAAGTTC | CAG | chr6 | 160658235 | 160658254 | 160658251 | + |
| SEQ ID NO 34931 | ACATCCCCACTCCAAGTTCC | AGG | chr6 | 160658236 | 160658255 | 160658252 | + |
| SEQ ID NO 34932 | CATCCCCACTCCAAGTTCCA | GGG | chr6 | 160658237 | 160658256 | 160658253 | + |
| SEQ ID NO 34933 | TCCAGGGTCCCATTTTTTTC | CAG | chr6 | 160658253 | 160658272 | 160658269 | + |
| SEQ ID NO 34934 | AGTCAATGCCCTCACTTTAA | CAG | chr6 | 160658274 | 160658293 | 160658290 | + |
| SEQ ID NO 34935 | TCACTTTAACAGTAAACACC | TGG | chr6 | 160658285 | 160658304 | 160658301 | + |
| SEQ ID NO 34936 | TTTAACAGTAAACACCTGGC | AAG | chr6 | 160658289 | 160658308 | 160658305 | + |
| SEQ ID NO 34937 | TTAACAGTAAACACCTGGCA | AGG | chr6 | 160658290 | 160658309 | 160658306 | + |
| SEQ ID NO 34938 | TGTGCATGCACCTCTTGTTG | CAG | chr6 | 160658314 | 160658333 | 160658330 | + |
| SEQ ID NO 34939 | ATGCACCTCTTGTTGCAGAT | CAG | chr6 | 160658319 | 160658338 | 160658335 | + |
| SEQ ID NO 34940 | ATCAGCTACTCGCATGATAA | CAG | chr6 | 160658337 | 160658356 | 160658353 | + |
| SEQ ID NO 34941 | CAATTTCAACTCTTTCTCTA | CAG | chr6 | 160658378 | 160658397 | 160658394 | + |
| SEQ ID NO 34942 | AATTTCAACTCTTTCTCTAC | AGG | chr6 | 160658379 | 160658398 | 160658395 | + |
| SEQ ID NO 34943 | TTTCAACTCTTTCTCTACAG | GAG | chr6 | 160658381 | 160658400 | 160658397 | + |
| SEQ ID NO 34944 | CAGGAGTTAAAACTCTCATT | CAG | chr6 | 160658398 | 160658417 | 160658414 | + |
| SEQ ID NO 34945 | AGGAGTTAAAACTCTCATTC | AGG | chr6 | 160658399 | 160658418 | 160658415 | + |
| SEQ ID NO 34946 | GGAGTTAAAACTCTCATTCA | GGG | chr6 | 160658400 | 160658419 | 160658416 | + |
| SEQ ID NO 34947 | ACTCTCATTCAGGGCAATCT | TAG | chr6 | 160658409 | 160658428 | 160658425 | + |
| SEQ ID NO 34948 | CTCATTCAGGGCAATCTTAG | CAG | chr6 | 160658412 | 160658431 | 160658428 | + |
| SEQ ID NO 34949 | GGGCAATCTTAGCAGATTTG | TGG | chr6 | 160658420 | 160658439 | 160658436 | + |
| SEQ ID NO 34950 | ATCTTAGCAGATTTGTGGCT | CAG | chr6 | 160658425 | 160658444 | 160658441 | + |
| SEQ ID NO 34951 | TGGCTCAGTATCTGCTTCTG | AAG | chr6 | 160658440 | 160658459 | 160658456 | + |
| SEQ ID NO 34952 | GGCTCAGTATCTGCTTCTGA | AGG | chr6 | 160658441 | 160658460 | 160658457 | + |
| SEQ ID NO 34953 | TCAGTATCTGCTTCTGAAGG | TGG | chr6 | 160658444 | 160658463 | 160658460 | + |

Figure 55 (Cont'd)

| | | | | | | | |
|---|---|---|---|---|---|---|---|
| SEQ ID NO 34954 | CAGTATCTGCTTCTGAAGGT | GGG | chr6 | 160658445 | 160658464 | 160658461 | + |
| SEQ ID NO 34955 | GTATCTGCTTCTGAAGGTGG | GAG | chr6 | 160658447 | 160658466 | 160658463 | + |
| SEQ ID NO 34956 | CTGCTTCTGAAGGTGGGAGA | CAG | chr6 | 160658451 | 160658470 | 160658467 | + |
| SEQ ID NO 34957 | AGGTGGGAGACAGATCCCCT | GAG | chr6 | 160658461 | 160658480 | 160658477 | + |
| SEQ ID NO 34958 | TTTTCTTTCATCTCTTTCTC | CAG | chr6 | 160658491 | 160658510 | 160658507 | + |
| SEQ ID NO 34959 | TTCTTTCATCTCTTTCTCCA | GAG | chr6 | 160658493 | 160658512 | 160658509 | + |
| SEQ ID NO 34960 | ATCTCTTTCTCCAGAGAACT | TAG | chr6 | 160658500 | 160658519 | 160658516 | + |
| SEQ ID NO 34961 | TCTCTTTCTCCAGAGAACTT | AGG | chr6 | 160658501 | 160658520 | 160658517 | + |
| SEQ ID NO 34962 | TCTTTCTCCAGAGAACTTAG | GAG | chr6 | 160658503 | 160658522 | 160658519 | + |
| SEQ ID NO 34963 | ACCAACTTCATTATGTTCCT | TGG | chr6 | 160658532 | 160658551 | 160658548 | + |
| SEQ ID NO 34964 | GTTCCTTGGTTCTCCACATA | TAG | chr6 | 160658546 | 160658565 | 160658562 | + |
| SEQ ID NO 34965 | TGGTTCTCCACATATAGTCA | AAG | chr6 | 160658552 | 160658571 | 160658568 | + |
| SEQ ID NO 34966 | GGTTCTCCACATATAGTCAA | AGG | chr6 | 160658553 | 160658572 | 160658569 | + |
| SEQ ID NO 34967 | ATAGTCAAAGGTATTATGTA | TAG | chr6 | 160658565 | 160658584 | 160658581 | + |
| SEQ ID NO 34968 | AGTCAAAGGTATTATGTATA | GAG | chr6 | 160658567 | 160658586 | 160658583 | + |
| SEQ ID NO 34969 | CTAAACTCCTTGCCTCTCAT | AAG | chr6 | 160658593 | 160658612 | 160658609 | + |
| SEQ ID NO 34970 | GCCTCTCATAAGTGATGAAT | CAG | chr6 | 160658604 | 160658623 | 160658620 | + |
| SEQ ID NO 34971 | TCTCATAAGTGATGAATCAG | TAG | chr6 | 160658607 | 160658626 | 160658623 | + |
| SEQ ID NO 34972 | GCATAACTCTCTAAACAATT | CAG | chr6 | 160658649 | 160658668 | 160658665 | + |
| SEQ ID NO 34973 | CATAACTCTCTAAACAATTC | AGG | chr6 | 160658650 | 160658669 | 160658666 | + |
| SEQ ID NO 34974 | CTCTCTAAACAATTCAGGCC | AAG | chr6 | 160658655 | 160658674 | 160658671 | + |
| SEQ ID NO 34975 | CAATTCAGGCCAAGTACTAT | CAG | chr6 | 160658664 | 160658683 | 160658680 | + |
| SEQ ID NO 34976 | ATCAGTGTTCTCCATACTAT | TAG | chr6 | 160658682 | 160658701 | 160658698 | + |
| SEQ ID NO 34977 | AGTGTTCTCCATACTATTAG | AAG | chr6 | 160658685 | 160658704 | 160658701 | + |
| SEQ ID NO 34978 | GTTCTCCATACTATTAGAAG | TAG | chr6 | 160658688 | 160658707 | 160658704 | + |
| SEQ ID NO 34979 | TCTCCATACTATTAGAAGTA | GAG | chr6 | 160658690 | 160658709 | 160658706 | + |
| SEQ ID NO 34980 | ACTATTAGAAGTAGAGTCCT | TAG | chr6 | 160658697 | 160658716 | 160658713 | + |
| SEQ ID NO 34981 | GTAGAGTCCTTAGCATTTTT | TGG | chr6 | 160658707 | 160658726 | 160658723 | + |
| SEQ ID NO 34982 | TTTGGTCTAATCATATTAAT | CAG | chr6 | 160658725 | 160658744 | 160658741 | + |
| SEQ ID NO 34983 | TCATATTAATCAGCCAACAC | CAG | chr6 | 160658735 | 160658754 | 160658751 | + |
| SEQ ID NO 34984 | TATTAATCAGCCAACACCAG | AAG | chr6 | 160658738 | 160658757 | 160658754 | + |
| SEQ ID NO 34985 | AGAAGTCCCAAAACCAATGA | AAG | chr6 | 160658756 | 160658775 | 160658772 | + |
| SEQ ID NO 34986 | TCCTTAATATTCTGTTCCTC | AAG | chr6 | 160658786 | 160658805 | 160658802 | + |
| SEQ ID NO 34987 | TGTTCCTCAAGAACCACTTC | TGG | chr6 | 160658798 | 160658817 | 160658814 | + |
| SEQ ID NO 34988 | TCTGGTATGAAAATCTGTAT | TAG | chr6 | 160658816 | 160658835 | 160658832 | + |
| SEQ ID NO 34989 | GTATGAAAATCTGTATTAGT | CGG | chr6 | 160658820 | 160658839 | 160658836 | + |
| SEQ ID NO 34990 | TATGAAAATCTGTATTAGTC | GGG | chr6 | 160658821 | 160658840 | 160658837 | + |
| SEQ ID NO 34991 | ATGAAAATCTGTATTAGTCG | GGG | chr6 | 160658822 | 160658841 | 160658838 | + |
| SEQ ID NO 34992 | CTGTATTAGTCGGGGTTCTC | TAG | chr6 | 160658830 | 160658849 | 160658846 | + |
| SEQ ID NO 34993 | GTATTAGTCGGGGTTCTCTA | GAG | chr6 | 160658832 | 160658851 | 160658848 | + |
| SEQ ID NO 34994 | TATTAGTCGGGGTTCTCTAG | AGG | chr6 | 160658833 | 160658852 | 160658849 | + |
| SEQ ID NO 34995 | ATTAGTCGGGGTTCTCTAGA | GGG | chr6 | 160658834 | 160658853 | 160658850 | + |
| SEQ ID NO 34996 | GTCGGGGTTCTCTAGAGGGA | CAG | chr6 | 160658838 | 160658857 | 160658854 | + |
| SEQ ID NO 34997 | CTCTAGAGGGACAGAACTAA | TAG | chr6 | 160658847 | 160658866 | 160658863 | + |
| SEQ ID NO 34998 | TCTAGAGGGACAGAACTAAT | AGG | chr6 | 160658848 | 160658867 | 160658864 | + |
| SEQ ID NO 34999 | TAGAGGGACAGAACTAATAG | GAG | chr6 | 160658850 | 160658869 | 160658866 | + |
| SEQ ID NO 35000 | GATTATATATATATATATAT | GAG | chr6 | 160658872 | 160658891 | 160658888 | + |

Figure 55 (Cont'd)

| SEQ ID | Sequence | Codon | Chr | Start | End | Pos | Strand |
|---|---|---|---|---|---|---|---|
| SEQ ID NO 35001 | TTATATATATATATATGA | GAG | chr6 | 160658874 | 160658893 | 160658890 | + |
| SEQ ID NO 35002 | ATATATATATATATGAGA | GAG | chr6 | 160658876 | 160658895 | 160658892 | + |
| SEQ ID NO 35003 | ATATATATATATGAGAGA | GAG | chr6 | 160658878 | 160658897 | 160658894 | + |
| SEQ ID NO 35004 | ATATATATATGAGAGAGA | GAG | chr6 | 160658880 | 160658899 | 160658896 | + |
| SEQ ID NO 35005 | ATATATATGAGAGAGAGA | GAG | chr6 | 160658882 | 160658901 | 160658898 | + |
| SEQ ID NO 35006 | ATATATGAGAGAGAGAGA | GAG | chr6 | 160658884 | 160658903 | 160658900 | + |
| SEQ ID NO 35007 | ATATGAGAGAGAGAGAGA | GAG | chr6 | 160658886 | 160658905 | 160658902 | + |
| SEQ ID NO 35008 | ATATGAGAGAGAGAGAGA | GAG | chr6 | 160658888 | 160658907 | 160658904 | + |
| SEQ ID NO 35009 | TATGTATATATGTGTATATA | TAG | chr6 | 160658913 | 160658932 | 160658929 | + |
| SEQ ID NO 35010 | TATATATGTGTATATATAGT | GAG | chr6 | 160658917 | 160658936 | 160658933 | + |
| SEQ ID NO 35011 | AGTATACCTATATCTATCTA | TAG | chr6 | 160658938 | 160658957 | 160658954 | + |
| SEQ ID NO 35012 | CCTATATCTATCTATAGATA | TAG | chr6 | 160658944 | 160658963 | 160658960 | + |
| SEQ ID NO 35013 | GATATAGATATACTCACACA | AAG | chr6 | 160658960 | 160658979 | 160658976 | + |
| SEQ ID NO 35014 | ATATAGATATACTCACACAA | AGG | chr6 | 160658961 | 160658980 | 160658977 | + |
| SEQ ID NO 35015 | TATAGATATACTCACACAAA | GGG | chr6 | 160658962 | 160658981 | 160658978 | + |
| SEQ ID NO 35016 | ATAGATATACTCACACAAAG | GGG | chr6 | 160658963 | 160658982 | 160658979 | + |
| SEQ ID NO 35017 | AGATATACTCACACAAAGGG | GAG | chr6 | 160658965 | 160658984 | 160658981 | + |
| SEQ ID NO 35018 | CACACAAAGGGGAGCTTATT | AAG | chr6 | 160658974 | 160658993 | 160658990 | + |
| SEQ ID NO 35019 | ACAAAGGGGAGCTTATTAAG | TGG | chr6 | 160658977 | 160658996 | 160658993 | + |
| SEQ ID NO 35020 | ATTAAGTGGTATTAACTCAC | AAG | chr6 | 160658991 | 160659010 | 160659007 | + |
| SEQ ID NO 35021 | GTATTAACTCACAAGATTAC | AAG | chr6 | 160658999 | 160659018 | 160659015 | + |
| SEQ ID NO 35022 | TATTAACTCACAAGATTACA | AGG | chr6 | 160659000 | 160659019 | 160659016 | + |
| SEQ ID NO 35023 | AAGATTACAAGGTCCCATAA | TAG | chr6 | 160659011 | 160659030 | 160659027 | + |
| SEQ ID NO 35024 | AGATTACAAGGTCCCATAAT | AGG | chr6 | 160659012 | 160659031 | 160659028 | + |
| SEQ ID NO 35025 | TAATAGGCCACCTGCAATCT | GAG | chr6 | 160659028 | 160659047 | 160659044 | + |
| SEQ ID NO 35026 | AATAGGCCACCTGCAATCTG | AGG | chr6 | 160659029 | 160659048 | 160659045 | + |
| SEQ ID NO 35027 | TAGGCCACCTGCAATCTGAG | GAG | chr6 | 160659031 | 160659050 | 160659047 | + |
| SEQ ID NO 35028 | CCACCTGCAATCTGAGGAGC | AAG | chr6 | 160659035 | 160659054 | 160659051 | + |
| SEQ ID NO 35029 | CACCTGCAATCTGAGGAGCA | AGG | chr6 | 160659036 | 160659055 | 160659052 | + |
| SEQ ID NO 35030 | CTGCAATCTGAGGAGCAAGG | AAG | chr6 | 160659039 | 160659058 | 160659055 | + |
| SEQ ID NO 35031 | AATCTGAGGAGCAAGGAAGA | CAG | chr6 | 160659043 | 160659062 | 160659059 | + |
| SEQ ID NO 35032 | AGGAGCAAGGAAGACAGTCC | AAG | chr6 | 160659049 | 160659068 | 160659065 | + |
| SEQ ID NO 35033 | GGAAGACAGTCCAAGTCCCA | CAG | chr6 | 160659057 | 160659076 | 160659073 | + |
| SEQ ID NO 35034 | CAGTCCAAGTCCCACAGCTG | AAG | chr6 | 160659063 | 160659082 | 160659079 | + |
| SEQ ID NO 35035 | AGTCCCACAGCTGAAGAACT | TGG | chr6 | 160659070 | 160659089 | 160659086 | + |
| SEQ ID NO 35036 | TCCCACAGCTGAAGAACTTG | GAG | chr6 | 160659072 | 160659091 | 160659088 | + |
| SEQ ID NO 35037 | GAACTTGGAGTCCGATGTTC | AAG | chr6 | 160659085 | 160659104 | 160659101 | + |
| SEQ ID NO 35038 | ACTTGGAGTCCGATGTTCAA | GAG | chr6 | 160659087 | 160659106 | 160659103 | + |
| SEQ ID NO 35039 | TGGAGTCCGATGTTCAAGAG | CAG | chr6 | 160659090 | 160659109 | 160659106 | + |
| SEQ ID NO 35040 | GGAGTCCGATGTTCAAGAGC | AGG | chr6 | 160659091 | 160659110 | 160659107 | + |
| SEQ ID NO 35041 | GTCCGATGTTCAAGAGCAGG | AAG | chr6 | 160659094 | 160659113 | 160659110 | + |
| SEQ ID NO 35042 | TCCGATGTTCAAGAGCAGGA | AGG | chr6 | 160659095 | 160659114 | 160659111 | + |
| SEQ ID NO 35043 | GTTCAAGAGCAGGAAGGATC | CAG | chr6 | 160659101 | 160659120 | 160659117 | + |
| SEQ ID NO 35044 | AGAGCAGGAAGGATCCAGCA | CAG | chr6 | 160659106 | 160659125 | 160659122 | + |
| SEQ ID NO 35045 | GAGCAGGAAGGATCCAGCAC | AGG | chr6 | 160659107 | 160659126 | 160659123 | + |
| SEQ ID NO 35046 | GCAGGAAGGATCCAGCACAG | GAG | chr6 | 160659109 | 160659128 | 160659125 | + |
| SEQ ID NO 35047 | GAAGGATCCAGCACAGGAGA | AAG | chr6 | 160659113 | 160659132 | 160659129 | + |

Figure 55 (Cont'd)

| SEQ ID NO | Sequence | PAM | Chr | Start | End | Cut | Strand |
|---|---|---|---|---|---|---|---|
| SEQ ID NO 35048 | TCCAGCACAGGAGAAAGATG | TAG | chr6 | 160659119 | 160659138 | 160659135 | + |
| SEQ ID NO 35049 | CCAGCACAGGAGAAAGATGT | AGG | chr6 | 160659120 | 160659139 | 160659136 | + |
| SEQ ID NO 35050 | CACAGGAGAAAGATGTAGGC | TGG | chr6 | 160659124 | 160659143 | 160659140 | + |
| SEQ ID NO 35051 | ACAGGAGAAAGATGTAGGCT | GGG | chr6 | 160659125 | 160659144 | 160659141 | + |
| SEQ ID NO 35052 | AGGAGAAAGATGTAGGCTGG | GAG | chr6 | 160659127 | 160659146 | 160659143 | + |
| SEQ ID NO 35053 | GGAGAAAGATGTAGGCTGGG | AGG | chr6 | 160659128 | 160659147 | 160659144 | + |
| SEQ ID NO 35054 | AAGATGTAGGCTGGGAGGCT | AAG | chr6 | 160659133 | 160659152 | 160659149 | + |
| SEQ ID NO 35055 | TGTAGGCTGGGAGGCTAAGC | CAG | chr6 | 160659137 | 160659156 | 160659153 | + |
| SEQ ID NO 35056 | GCTGGGAGGCTAAGCCAGTC | TAG | chr6 | 160659142 | 160659161 | 160659158 | + |
| SEQ ID NO 35057 | GCCTTTTACATTTTTCTGC | CAG | chr6 | 160659164 | 160659183 | 160659180 | + |
| SEQ ID NO 35058 | TTTCTGCCAGCTTTATATTC | TGG | chr6 | 160659177 | 160659196 | 160659193 | + |
| SEQ ID NO 35059 | AGCTTTATATTCTGGCTCTA | CAG | chr6 | 160659185 | 160659204 | 160659201 | + |
| SEQ ID NO 35060 | TATATTCTGGCTCTACAGCT | TGG | chr6 | 160659190 | 160659209 | 160659206 | + |
| SEQ ID NO 35061 | ATATTCTGGCTCTACAGCTT | GGG | chr6 | 160659191 | 160659210 | 160659207 | + |
| SEQ ID NO 35062 | TATTCTGGCTCTACAGCTTG | GGG | chr6 | 160659192 | 160659211 | 160659208 | + |
| SEQ ID NO 35063 | ATTCTGGCTCTACAGCTTGG | GGG | chr6 | 160659193 | 160659212 | 160659209 | + |
| SEQ ID NO 35064 | CTGGCTCTACAGCTTGGGGG | CAG | chr6 | 160659196 | 160659215 | 160659212 | + |
| SEQ ID NO 35065 | GCTCTACAGCTTGGGGGCAG | CAG | chr6 | 160659199 | 160659218 | 160659215 | + |
| SEQ ID NO 35066 | CTCTACAGCTTGGGGGCAGC | AGG | chr6 | 160659200 | 160659219 | 160659216 | + |
| SEQ ID NO 35067 | TCTACAGCTTGGGGGCAGCA | GGG | chr6 | 160659201 | 160659220 | 160659217 | + |
| SEQ ID NO 35068 | CTACAGCTTGGGGGCAGCAG | GGG | chr6 | 160659202 | 160659221 | 160659218 | + |
| SEQ ID NO 35069 | CAGCTTGGGGGCAGCAGGGG | CAG | chr6 | 160659205 | 160659224 | 160659221 | + |
| SEQ ID NO 35070 | AGCTTGGGGGCAGCAGGGGC | AGG | chr6 | 160659206 | 160659225 | 160659222 | + |
| SEQ ID NO 35071 | GCTTGGGGGCAGCAGGGGCA | GGG | chr6 | 160659207 | 160659226 | 160659223 | + |
| SEQ ID NO 35072 | CTTGGGGGCAGCAGGGGCAG | GGG | chr6 | 160659208 | 160659227 | 160659224 | + |
| SEQ ID NO 35073 | GGCAGCAGGGGCAGGGGCCT | CAG | chr6 | 160659214 | 160659233 | 160659230 | + |
| SEQ ID NO 35074 | GCAGCAGGGGCAGGGGCCTC | AGG | chr6 | 160659215 | 160659234 | 160659231 | + |
| SEQ ID NO 35075 | CAGCAGGGGCAGGGGCCTCA | GGG | chr6 | 160659216 | 160659235 | 160659232 | + |
| SEQ ID NO 35076 | CAGGGGCCTCAGGGTGCTTG | CAG | chr6 | 160659225 | 160659244 | 160659241 | + |
| SEQ ID NO 35077 | AGGGGCCTCAGGGTGCTTGC | AGG | chr6 | 160659226 | 160659245 | 160659242 | + |
| SEQ ID NO 35078 | GGGGCCTCAGGGTGCTTGCA | GGG | chr6 | 160659227 | 160659246 | 160659243 | + |
| SEQ ID NO 35079 | TGCTTGCAGGGATGACACAC | TGG | chr6 | 160659239 | 160659258 | 160659255 | + |
| SEQ ID NO 35080 | ACACACTGGCCTCTTTTCCA | TAG | chr6 | 160659253 | 160659272 | 160659269 | + |
| SEQ ID NO 35081 | CACACTGGCCTCTTTTCCAT | AGG | chr6 | 160659254 | 160659273 | 160659270 | + |
| SEQ ID NO 35082 | ACACTGGCCTCTTTTCCATA | GGG | chr6 | 160659255 | 160659274 | 160659271 | + |
| SEQ ID NO 35083 | CTGGCCTCTTTTCCATAGGG | TGG | chr6 | 160659258 | 160659277 | 160659274 | + |
| SEQ ID NO 35084 | CCTCTTTTCCATAGGGTGGC | TGG | chr6 | 160659262 | 160659281 | 160659278 | + |
| SEQ ID NO 35085 | CTCTTTTCCATAGGGTGGCT | GGG | chr6 | 160659263 | 160659282 | 160659279 | + |
| SEQ ID NO 35086 | TCTTTTCCATAGGGTGGCTG | GGG | chr6 | 160659264 | 160659283 | 160659280 | + |
| SEQ ID NO 35087 | ATAGGGTGGCTGGGCACAC | TGG | chr6 | 160659272 | 160659291 | 160659288 | + |
| SEQ ID NO 35088 | TAGGGTGGCTGGGGCACACT | GGG | chr6 | 160659273 | 160659292 | 160659289 | + |
| SEQ ID NO 35089 | AGGGTGGCTGGGGCACACTG | GGG | chr6 | 160659274 | 160659293 | 160659290 | + |
| SEQ ID NO 35090 | GCTGGGGCACACTGGGGTGT | GAG | chr6 | 160659280 | 160659299 | 160659296 | + |
| SEQ ID NO 35091 | GGCACACTGGGGTGTGAGTA | AAG | chr6 | 160659285 | 160659304 | 160659301 | + |
| SEQ ID NO 35092 | TGGGGTGTGAGTAAAGCACT | CAG | chr6 | 160659292 | 160659311 | 160659308 | + |
| SEQ ID NO 35093 | GGGGTGTGAGTAAAGCACTC | AGG | chr6 | 160659293 | 160659312 | 160659309 | + |
| SEQ ID NO 35094 | CAGGATCTTTTTTCCTTCCC | TAG | chr6 | 160659312 | 160659331 | 160659328 | + |

Figure 55 (Cont'd)

| | | | | | | | |
|---|---|---|---|---|---|---|---|
| SEQ ID NO 35095 | CTTTTTTCCTTCCCTAGTCC | AAG | chr6 | 160659318 | 160659337 | 160659334 | + |
| SEQ ID NO 35096 | TTCCTTCCCTAGTCCAAGTA | CAG | chr6 | 160659323 | 160659342 | 160659339 | + |
| SEQ ID NO 35097 | TTCCCTAGTCCAAGTACAGC | AAG | chr6 | 160659327 | 160659346 | 160659343 | + |
| SEQ ID NO 35098 | TCCCTAGTCCAAGTACAGCA | AGG | chr6 | 160659328 | 160659347 | 160659344 | + |
| SEQ ID NO 35099 | CCCTAGTCCAAGTACAGCAA | GGG | chr6 | 160659329 | 160659348 | 160659345 | + |
| SEQ ID NO 35100 | TAGTCCAAGTACAGCAAGGG | CAG | chr6 | 160659332 | 160659351 | 160659348 | + |
| SEQ ID NO 35101 | CAGCAAGGGCAGTATGACTG | CAG | chr6 | 160659343 | 160659362 | 160659359 | + |
| SEQ ID NO 35102 | GGGCAGTATGACTGCAGTGT | TAG | chr6 | 160659349 | 160659368 | 160659365 | + |
| SEQ ID NO 35103 | CAGTATGACTGCAGTGTTAG | TGG | chr6 | 160659352 | 160659371 | 160659368 | + |
| SEQ ID NO 35104 | TATGACTGCAGTGTTAGTGG | CAG | chr6 | 160659355 | 160659374 | 160659371 | + |
| SEQ ID NO 35105 | GACTGCAGTGTTAGTGGCAG | AAG | chr6 | 160659358 | 160659377 | 160659374 | + |
| SEQ ID NO 35106 | ACTGCAGTGTTAGTGGCAGA | AGG | chr6 | 160659359 | 160659378 | 160659375 | + |
| SEQ ID NO 35107 | GTTAGTGGCAGAAGGACTTT | CAG | chr6 | 160659367 | 160659386 | 160659383 | + |
| SEQ ID NO 35108 | GAAGGACTTTCAGTCACCTC | TGG | chr6 | 160659377 | 160659396 | 160659393 | + |
| SEQ ID NO 35109 | AAGGACTTTCAGTCACCTCT | GGG | chr6 | 160659378 | 160659397 | 160659394 | + |
| SEQ ID NO 35110 | GGACTTTCAGTCACCTCTGG | GAG | chr6 | 160659380 | 160659399 | 160659396 | + |
| SEQ ID NO 35111 | AGCTTCACCCCACAAAAACA | CAG | chr6 | 160659401 | 160659420 | 160659417 | + |
| SEQ ID NO 35112 | CTTCACCCCACAAAAACACA | GAG | chr6 | 160659403 | 160659422 | 160659419 | + |
| SEQ ID NO 35113 | CCCCACAAAAACACAGAGTG | CAG | chr6 | 160659408 | 160659427 | 160659424 | + |
| SEQ ID NO 35114 | ACAAAAACACAGAGTGCAGC | CAG | chr6 | 160659412 | 160659431 | 160659428 | + |
| SEQ ID NO 35115 | AAAACACAGAGTGCAGCCAG | TGG | chr6 | 160659415 | 160659434 | 160659431 | + |
| SEQ ID NO 35116 | GCCAGTGGAAATGTTCAACT | GAG | chr6 | 160659430 | 160659449 | 160659446 | + |
| SEQ ID NO 35117 | GGAAATGTTCAACTGAGTTC | GAG | chr6 | 160659436 | 160659455 | 160659452 | + |
| SEQ ID NO 35118 | GAAATGTTCAACTGAGTTCG | AGG | chr6 | 160659437 | 160659456 | 160659453 | + |
| SEQ ID NO 35119 | AGTTCGAGGTGCCTGCACTG | TGG | chr6 | 160659451 | 160659470 | 160659467 | + |
| SEQ ID NO 35120 | GTTCGAGGTGCCTGCACTGT | GGG | chr6 | 160659452 | 160659471 | 160659468 | + |
| SEQ ID NO 35121 | GGTGCCTGCACTGTGGGCCC | AAG | chr6 | 160659458 | 160659477 | 160659474 | + |
| SEQ ID NO 35122 | CCTGCACTGTGGGCCCAAGC | CAG | chr6 | 160659462 | 160659481 | 160659478 | + |
| SEQ ID NO 35123 | CTGCACTGTGGGCCCAAGCC | AGG | chr6 | 160659463 | 160659482 | 160659479 | + |
| SEQ ID NO 35124 | GCACTGTGGGCCCAAGCCAG | GAG | chr6 | 160659465 | 160659484 | 160659481 | + |
| SEQ ID NO 35125 | CCCAAGCCAGGAGCCTTGCC | TGG | chr6 | 160659475 | 160659494 | 160659491 | + |
| SEQ ID NO 35126 | GCCAGGAGCCTTGCCTGGTG | AAG | chr6 | 160659480 | 160659499 | 160659496 | + |
| SEQ ID NO 35127 | CAGGAGCCTTGCCTGGTGAA | GAG | chr6 | 160659482 | 160659501 | 160659498 | + |
| SEQ ID NO 35128 | GAGCCTTGCCTGGTGAAGAG | TAG | chr6 | 160659485 | 160659504 | 160659501 | + |
| SEQ ID NO 35129 | CCTTGCCTGGTGAAGAGTAG | CAG | chr6 | 160659488 | 160659507 | 160659504 | + |
| SEQ ID NO 35130 | CTTGCCTGGTGAAGAGTAGC | AGG | chr6 | 160659489 | 160659508 | 160659505 | + |
| SEQ ID NO 35131 | TGGTGAAGAGTAGCAGGTGA | AAG | chr6 | 160659495 | 160659514 | 160659511 | + |
| SEQ ID NO 35132 | AGTAGCAGGTGAAAGCTCAC | AAG | chr6 | 160659503 | 160659522 | 160659519 | + |
| SEQ ID NO 35133 | GCAGGTGAAAGCTCACAAGA | AAG | chr6 | 160659507 | 160659526 | 160659523 | + |
| SEQ ID NO 35134 | AGGTGAAAGCTCACAAGAAA | GAG | chr6 | 160659509 | 160659528 | 160659525 | + |
| SEQ ID NO 35135 | AGCTCACAAGAAAGAGAAAC | TGG | chr6 | 160659516 | 160659535 | 160659532 | + |
| SEQ ID NO 35136 | ATTCTTTCCCTGCTGTGTGC | TGG | chr6 | 160659540 | 160659559 | 160659556 | + |
| SEQ ID NO 35137 | TCTTTCCCTGCTGTGTGCTG | GAG | chr6 | 160659542 | 160659561 | 160659558 | + |
| SEQ ID NO 35138 | CTTTCCCTGCTGTGTGCTGG | AGG | chr6 | 160659543 | 160659562 | 160659559 | + |
| SEQ ID NO 35139 | CTGCTGTGTGCTGGAGGTGT | CAG | chr6 | 160659549 | 160659568 | 160659565 | + |
| SEQ ID NO 35140 | TGCTGTGTGCTGGAGGTGTC | AGG | chr6 | 160659550 | 160659569 | 160659566 | + |
| SEQ ID NO 35141 | GCTGTGTGCTGGAGGTGTCA | GGG | chr6 | 160659551 | 160659570 | 160659567 | + |

Figure 55 (Cont'd)

| SEQ ID NO 35142 | GTGTGCTGGAGGTGTCAGGG | AAG | chr6 | 160659554 | 160659573 | 160659570 | + |
| SEQ ID NO 35143 | TGCTGGAGGTGTCAGGGAAG | TGG | chr6 | 160659557 | 160659576 | 160659573 | + |
| SEQ ID NO 35144 | GGAGGTGTCAGGGAAGTGGC | CAG | chr6 | 160659561 | 160659580 | 160659577 | + |
| SEQ ID NO 35145 | GAGGTGTCAGGGAAGTGGCC | AGG | chr6 | 160659562 | 160659581 | 160659578 | + |
| SEQ ID NO 35146 | GGCCAGGTCCCTTCTTTCTC | AAG | chr6 | 160659578 | 160659597 | 160659594 | + |
| SEQ ID NO 35147 | GTCCCTTCTTTCTCAAGCCC | AAG | chr6 | 160659584 | 160659603 | 160659600 | + |
| SEQ ID NO 35148 | TCCCTTCTTTCTCAAGCCCA | AGG | chr6 | 160659585 | 160659604 | 160659601 | + |
| SEQ ID NO 35149 | CCCTTCTTTCTCAAGCCCAA | GGG | chr6 | 160659586 | 160659605 | 160659602 | + |
| SEQ ID NO 35150 | CTCAAGCCCAAGGGCATTAA | CGG | chr6 | 160659595 | 160659614 | 160659611 | + |
| SEQ ID NO 35151 | AAGCCCAAGGGCATTAACGG | TGG | chr6 | 160659598 | 160659617 | 160659614 | + |
| SEQ ID NO 35152 | CATTAACGGTGGTACTGCTG | CAG | chr6 | 160659609 | 160659628 | 160659625 | + |
| SEQ ID NO 35153 | TGGTACTGCTGCAGCTGAAA | TGG | chr6 | 160659618 | 160659637 | 160659634 | + |
| SEQ ID NO 35154 | TACTGCTGCAGCTGAAATGG | CAG | chr6 | 160659621 | 160659640 | 160659637 | + |
| SEQ ID NO 35155 | CTGCTGCAGCTGAAATGGCA | GAG | chr6 | 160659623 | 160659642 | 160659639 | + |
| SEQ ID NO 35156 | TGCTGCAGCTGAAATGGCAG | AGG | chr6 | 160659624 | 160659643 | 160659640 | + |
| SEQ ID NO 35157 | GCTGCAGCTGAAATGGCAGA | GGG | chr6 | 160659625 | 160659644 | 160659641 | + |
| SEQ ID NO 35158 | CTGCAGCTGAAATGGCAGAG | GGG | chr6 | 160659626 | 160659645 | 160659642 | + |
| SEQ ID NO 35159 | CTGAAATGGCAGAGGGGCTG | TGG | chr6 | 160659632 | 160659651 | 160659648 | + |
| SEQ ID NO 35160 | TGAAATGGCAGAGGGGCTGT | GGG | chr6 | 160659633 | 160659652 | 160659649 | + |
| SEQ ID NO 35161 | AGGGGCTGTGGGTTGTCTCT | TGG | chr6 | 160659644 | 160659663 | 160659660 | + |
| SEQ ID NO 35162 | TGTCTCTTGGATTTCCTCCC | CAG | chr6 | 160659657 | 160659676 | 160659673 | + |
| SEQ ID NO 35163 | TCTCTTGGATTTCCTCCCCA | GAG | chr6 | 160659659 | 160659678 | 160659675 | + |
| SEQ ID NO 35164 | CTTGGATTTCCTCCCCAGAG | AAG | chr6 | 160659662 | 160659681 | 160659678 | + |
| SEQ ID NO 35165 | ATTTCCTCCCCAGAGAAGCA | CAG | chr6 | 160659667 | 160659686 | 160659683 | + |
| SEQ ID NO 35166 | TTCCTCCCCAGAGAAGCACA | GAG | chr6 | 160659669 | 160659688 | 160659685 | + |
| SEQ ID NO 35167 | CCAACACTGACTAAAATGTT | CAG | chr6 | 160659692 | 160659711 | 160659708 | + |
| SEQ ID NO 35168 | CAACACTGACTAAAATGTTC | AGG | chr6 | 160659693 | 160659712 | 160659709 | + |
| SEQ ID NO 35169 | CACTGACTAAAATGTTCAGG | CAG | chr6 | 160659696 | 160659715 | 160659712 | + |
| SEQ ID NO 35170 | ACTGACTAAAATGTTCAGGC | AGG | chr6 | 160659697 | 160659716 | 160659713 | + |
| SEQ ID NO 35171 | CTGACTAAAATGTTCAGGCA | GGG | chr6 | 160659698 | 160659717 | 160659714 | + |
| SEQ ID NO 35172 | CTAAAATGTTCAGGCAGGGC | CAG | chr6 | 160659702 | 160659721 | 160659718 | + |
| SEQ ID NO 35173 | TAAAATGTTCAGGCAGGGCC | AGG | chr6 | 160659703 | 160659722 | 160659719 | + |
| SEQ ID NO 35174 | AAAATGTTCAGGCAGGGCCA | GGG | chr6 | 160659704 | 160659723 | 160659720 | + |
| SEQ ID NO 35175 | ATGTTCAGGCAGGGCCAGGG | TGG | chr6 | 160659707 | 160659726 | 160659723 | + |
| SEQ ID NO 35176 | CAGGGTGGCTGTGCTCTGCC | CAG | chr6 | 160659722 | 160659741 | 160659738 | + |
| SEQ ID NO 35177 | GTGGCTGTGCTCTGCCCAGT | GAG | chr6 | 160659726 | 160659745 | 160659742 | + |
| SEQ ID NO 35178 | TGGCTGTGCTCTGCCCAGTG | AGG | chr6 | 160659727 | 160659746 | 160659743 | + |
| SEQ ID NO 35179 | GTGCTCTGCCCAGTGAGGAA | TAG | chr6 | 160659732 | 160659751 | 160659748 | + |
| SEQ ID NO 35180 | CTCTGCCCAGTGAGGAATAG | TAG | chr6 | 160659735 | 160659754 | 160659751 | + |
| SEQ ID NO 35181 | TCTGCCCAGTGAGGAATAGT | AGG | chr6 | 160659736 | 160659755 | 160659752 | + |
| SEQ ID NO 35182 | CTGCCCAGTGAGGAATAGTA | GGG | chr6 | 160659737 | 160659756 | 160659753 | + |
| SEQ ID NO 35183 | TGCCCAGTGAGGAATAGTAG | GGG | chr6 | 160659738 | 160659757 | 160659754 | + |
| SEQ ID NO 35184 | CCAGTGAGGAATAGTAGGGG | CAG | chr6 | 160659741 | 160659760 | 160659757 | + |
| SEQ ID NO 35185 | CAGTGAGGAATAGTAGGGGC | AGG | chr6 | 160659742 | 160659761 | 160659758 | + |
| SEQ ID NO 35186 | AGTGAGGAATAGTAGGGGCA | GGG | chr6 | 160659743 | 160659762 | 160659759 | + |
| SEQ ID NO 35187 | GGAATAGTAGGGGCAGGGAC | CAG | chr6 | 160659748 | 160659767 | 160659764 | + |
| SEQ ID NO 35188 | AGTAGGGGCAGGGACCAGTG | CAG | chr6 | 160659753 | 160659772 | 160659769 | + |

Figure 55 (Cont'd)

| SEQ ID NO 35189 | GCAGGGACCAGTGCAGAAAA | CAG | chr6 | 160659760 | 160659779 | 160659776 | + |
| SEQ ID NO 35190 | GACCAGTGCAGAAAACAGTG | TGG | chr6 | 160659765 | 160659784 | 160659781 | + |
| SEQ ID NO 35191 | CAGTGTGGCCACTTTTCCAT | AAG | chr6 | 160659780 | 160659799 | 160659796 | + |
| SEQ ID NO 35192 | AGTGTGGCCACTTTTCCATA | AGG | chr6 | 160659781 | 160659800 | 160659797 | + |
| SEQ ID NO 35193 | GTGGCCACTTTTCCATAAGG | CAG | chr6 | 160659784 | 160659803 | 160659800 | + |
| SEQ ID NO 35194 | ATAAGGCAGCTACACTGTGC | TGG | chr6 | 160659798 | 160659817 | 160659814 | + |
| SEQ ID NO 35195 | AAGGCAGCTACACTGTGCTG | GAG | chr6 | 160659800 | 160659819 | 160659816 | + |
| SEQ ID NO 35196 | AGGCAGCTACACTGTGCTGG | AGG | chr6 | 160659801 | 160659820 | 160659817 | + |
| SEQ ID NO 35197 | ACACTGTGCTGGAGGTCCGT | GAG | chr6 | 160659809 | 160659828 | 160659825 | + |
| SEQ ID NO 35198 | ACTGTGCTGGAGGTCCGTGA | GAG | chr6 | 160659811 | 160659830 | 160659827 | + |
| SEQ ID NO 35199 | GGAGGTCCGTGAGAGTCCTG | AAG | chr6 | 160659819 | 160659838 | 160659835 | + |
| SEQ ID NO 35200 | GAAGCTCCTCGCTCCCTCCT | GAG | chr6 | 160659838 | 160659857 | 160659854 | + |
| SEQ ID NO 35201 | TGAGCCCATACTTTAATCTC | AAG | chr6 | 160659857 | 160659876 | 160659873 | + |
| SEQ ID NO 35202 | AGCCCATACTTTAATCTCAA | GAG | chr6 | 160659859 | 160659878 | 160659875 | + |
| SEQ ID NO 35203 | TACTTTAATCTCAAGAGTTT | GAG | chr6 | 160659865 | 160659884 | 160659881 | + |
| SEQ ID NO 35204 | TCTCAAGAGTTTGAGATAAA | CAG | chr6 | 160659873 | 160659892 | 160659889 | + |
| SEQ ID NO 35205 | CAAGAGTTTGAGATAAACAG | TGG | chr6 | 160659876 | 160659895 | 160659892 | + |
| SEQ ID NO 35206 | AGTTTGAGATAAACAGTGGT | AAG | chr6 | 160659880 | 160659899 | 160659896 | + |
| SEQ ID NO 35207 | GTTTGAGATAAACAGTGGTA | AGG | chr6 | 160659881 | 160659900 | 160659897 | + |
| SEQ ID NO 35208 | TGAGATAAACAGTGGTAAGG | AAG | chr6 | 160659884 | 160659903 | 160659900 | + |
| SEQ ID NO 35209 | ATAAACAGTGGTAAGGAAGA | AAG | chr6 | 160659888 | 160659907 | 160659904 | + |
| SEQ ID NO 35210 | TGGTAAGGAAGAAAGTACAA | CGG | chr6 | 160659896 | 160659915 | 160659912 | + |
| SEQ ID NO 35211 | GGTAAGGAAGAAAGTACAAC | GGG | chr6 | 160659897 | 160659916 | 160659913 | + |
| SEQ ID NO 35212 | GGAAGAAAGTACAACGGGTA | CGG | chr6 | 160659902 | 160659921 | 160659918 | + |
| SEQ ID NO 35213 | CGGGTACGGCTAATGAAACC | CAG | chr6 | 160659916 | 160659935 | 160659932 | + |
| SEQ ID NO 35214 | GGGTACGGCTAATGAAACCC | AGG | chr6 | 160659917 | 160659936 | 160659933 | + |
| SEQ ID NO 35215 | TACGGCTAATGAAACCCAGG | AAG | chr6 | 160659920 | 160659939 | 160659936 | + |
| SEQ ID NO 35216 | CTAATGAAACCCAGGAAGAT | AAG | chr6 | 160659925 | 160659944 | 160659941 | + |
| SEQ ID NO 35217 | CAGGAAGATAAGTCAATGCG | TAG | chr6 | 160659936 | 160659955 | 160659952 | + |
| SEQ ID NO 35218 | GAAGATAAGTCAATGCGTAG | AAG | chr6 | 160659939 | 160659958 | 160659955 | + |
| SEQ ID NO 35219 | GTAGAAGTAATTCCAACCTA | AAG | chr6 | 160659955 | 160659974 | 160659971 | + |
| SEQ ID NO 35220 | CTTTTTAAAAATCATATTTA | TAG | chr6 | 160659983 | 160660002 | 160659999 | + |
| SEQ ID NO 35221 | TTTTAAAAATCATATTTATA | GAG | chr6 | 160659985 | 160660004 | 160660001 | + |
| SEQ ID NO 35222 | TTTAAAAATCATATTTATAG | AGG | chr6 | 160659986 | 160660005 | 160660002 | + |
| SEQ ID NO 35223 | ATCATATTTATAGAGGTTTG | CAG | chr6 | 160659993 | 160660012 | 160660009 | + |
| SEQ ID NO 35224 | AGAGGTTTGCAGTGATACTA | AAG | chr6 | 160660004 | 160660023 | 160660020 | + |
| SEQ ID NO 35225 | CAATATTGCAAATCATTATT | AAG | chr6 | 160660028 | 160660047 | 160660044 | + |
| SEQ ID NO 35226 | CAAATCATTATTAAGAATAC | AAG | chr6 | 160660036 | 160660055 | 160660052 | + |
| SEQ ID NO 35227 | ATCATTATTAAGAATACAAG | AAG | chr6 | 160660039 | 160660058 | 160660055 | + |
| SEQ ID NO 35228 | TTTCTTTAACACCTGTGATA | CAG | chr6 | 160660076 | 160660095 | 160660092 | + |
| SEQ ID NO 35229 | TTCTTTAACACCTGTGATAC | AGG | chr6 | 160660077 | 160660096 | 160660093 | + |
| SEQ ID NO 35230 | TTGATATGAATTCTACGTAA | TGG | chr6 | 160660103 | 160660122 | 160660119 | + |
| SEQ ID NO 35231 | TTGCTTCTTGCCACCACCCA | AAG | chr6 | 160660131 | 160660150 | 160660147 | + |
| SEQ ID NO 35232 | CTTCTTGCCACCACCCAAAG | AAG | chr6 | 160660134 | 160660153 | 160660150 | + |
| SEQ ID NO 35233 | TTCTTGCCACCACCCAAAGA | AGG | chr6 | 160660135 | 160660154 | 160660151 | + |
| SEQ ID NO 35234 | ACCACCCAAAGAAGGTTGTA | TAG | chr6 | 160660143 | 160660162 | 160660159 | + |
| SEQ ID NO 35235 | AAAGAAGGTTGTATAGCACT | CAG | chr6 | 160660150 | 160660169 | 160660166 | + |

Figure 55 (Cont'd)

| SEQ ID NO 35236 | AACTGCAACCGTGTATCTCT | TAG | chr6 | 160660182 | 160660201 | 160660198 | + |
| SEQ ID NO 35237 | ACTGCAACCGTGTATCTCTT | AGG | chr6 | 160660183 | 160660202 | 160660199 | + |
| SEQ ID NO 35238 | TTGCCCTCTTCCCTCCCTAT | CAG | chr6 | 160660216 | 160660235 | 160660232 | + |
| SEQ ID NO 35239 | CCTCCCTATCAGCATGTATC | TAG | chr6 | 160660227 | 160660246 | 160660243 | + |
| SEQ ID NO 35240 | CCCTATCAGCATGTATCTAG | CAG | chr6 | 160660230 | 160660249 | 160660246 | + |
| SEQ ID NO 35241 | GTATCTAGCAGCATTCTGAA | AAG | chr6 | 160660242 | 160660261 | 160660258 | + |
| SEQ ID NO 35242 | ATTCTGAAAAGTTAACTGCA | CAG | chr6 | 160660254 | 160660273 | 160660270 | + |
| SEQ ID NO 35243 | TGAAAAGTTAACTGCACAGT | GAG | chr6 | 160660258 | 160660277 | 160660274 | + |
| SEQ ID NO 35244 | ACTGCACAGTGAGCGACTGC | TGG | chr6 | 160660268 | 160660287 | 160660284 | + |
| SEQ ID NO 35245 | CTGCACAGTGAGCGACTGCT | GGG | chr6 | 160660269 | 160660288 | 160660285 | + |
| SEQ ID NO 35246 | GAGCGACTGCTGGGCATCTT | AAG | chr6 | 160660278 | 160660297 | 160660294 | + |
| SEQ ID NO 35247 | AGCGACTGCTGGGCATCTTA | AGG | chr6 | 160660279 | 160660298 | 160660295 | + |
| SEQ ID NO 35248 | GCGACTGCTGGGCATCTTAA | GGG | chr6 | 160660280 | 160660299 | 160660296 | + |
| SEQ ID NO 35249 | CGACTGCTGGGCATCTTAAG | GGG | chr6 | 160660281 | 160660300 | 160660297 | + |
| SEQ ID NO 35250 | AAGGGGCATTCTTTTCTACC | TAG | chr6 | 160660298 | 160660317 | 160660314 | + |
| SEQ ID NO 35251 | AGGGGCATTCTTTTCTACCT | AGG | chr6 | 160660299 | 160660318 | 160660315 | + |
| SEQ ID NO 35252 | CCCCCTCCTCCACTCATGTC | TAG | chr6 | 160660326 | 160660345 | 160660342 | + |
| SEQ ID NO 35253 | CTCCACTCATGTCTAGCATG | CAG | chr6 | 160660333 | 160660352 | 160660349 | + |
| SEQ ID NO 35254 | TCCACTCATGTCTAGCATGC | AGG | chr6 | 160660334 | 160660353 | 160660350 | + |
| SEQ ID NO 35255 | CATGTCTAGCATGCAGGACT | TGG | chr6 | 160660340 | 160660359 | 160660356 | + |
| SEQ ID NO 35256 | ATGTCTAGCATGCAGGACTT | GGG | chr6 | 160660341 | 160660360 | 160660357 | + |
| SEQ ID NO 35257 | TGCAGGACTTGGGTAATCTC | TGG | chr6 | 160660351 | 160660370 | 160660367 | + |
| SEQ ID NO 35258 | GCAGGACTTGGGTAATCTCT | GGG | chr6 | 160660352 | 160660371 | 160660368 | + |
| SEQ ID NO 35259 | CAGGACTTGGGTAATCTCTG | GGG | chr6 | 160660353 | 160660372 | 160660369 | + |
| SEQ ID NO 35260 | TTGGGTAATCTCTGGGGTTT | CAG | chr6 | 160660359 | 160660378 | 160660375 | + |
| SEQ ID NO 35261 | CTCTGGGGTTTCAGATTCTC | CAG | chr6 | 160660368 | 160660387 | 160660384 | + |
| SEQ ID NO 35262 | TCTCCAGACCTCCATTCTCT | CAG | chr6 | 160660384 | 160660403 | 160660400 | + |
| SEQ ID NO 35263 | CTCCAGACCTCCATTCTCTC | AGG | chr6 | 160660385 | 160660404 | 160660401 | + |
| SEQ ID NO 35264 | TCCAGACCTCCATTCTCTCA | GGG | chr6 | 160660386 | 160660405 | 160660402 | + |
| SEQ ID NO 35265 | CCAGACCTCCATTCTCTCAG | GGG | chr6 | 160660387 | 160660406 | 160660403 | + |
| SEQ ID NO 35266 | TTCCACCTCCTGCTCATATC | TAG | chr6 | 160660411 | 160660430 | 160660427 | + |
| SEQ ID NO 35267 | CTCATATCTAGCTATCTGCC | TAG | chr6 | 160660423 | 160660442 | 160660439 | + |
| SEQ ID NO 35268 | CTAACCATAAAATCTTAAAT | AAG | chr6 | 160660447 | 160660466 | 160660463 | + |
| SEQ ID NO 35269 | CATGTCATGATAAAAAAAAT | AAG | chr6 | 160660496 | 160660515 | 160660512 | + |
| SEQ ID NO 35270 | TAAAAAAAATAAGACACCAT | CAG | chr6 | 160660506 | 160660525 | 160660522 | + |
| SEQ ID NO 35271 | AAAAAATAAGACACCATCAG | TGG | chr6 | 160660509 | 160660528 | 160660525 | + |
| SEQ ID NO 35272 | TCAGTGGCAACTGTGTTGCC | AAG | chr6 | 160660525 | 160660544 | 160660541 | + |
| SEQ ID NO 35273 | TTGATCTGCTAATCCCTGTG | TAG | chr6 | 160660555 | 160660574 | 160660571 | + |
| SEQ ID NO 35274 | CCCTGTGTAGAAATGAACCT | TGG | chr6 | 160660568 | 160660587 | 160660584 | + |
| SEQ ID NO 35275 | CTGTGTAGAAATGAACCTTG | GAG | chr6 | 160660570 | 160660589 | 160660586 | + |
| SEQ ID NO 35276 | TGTGTAGAAATGAACCTTGG | AGG | chr6 | 160660571 | 160660590 | 160660587 | + |
| SEQ ID NO 35277 | ATTTCTTACAATATGTGCAT | TGG | chr6 | 160660604 | 160660623 | 160660620 | + |
| SEQ ID NO 35278 | TTGTAACACTGTCACTTTGA | CAG | chr6 | 160660627 | 160660646 | 160660643 | + |
| SEQ ID NO 35279 | CTGTCACTTTGACAGTTGAT | AAG | chr6 | 160660635 | 160660654 | 160660651 | + |
| SEQ ID NO 35280 | GTTGATAAGCATCTTCTGAA | TGG | chr6 | 160660649 | 160660668 | 160660665 | + |
| SEQ ID NO 35281 | CTTCTGAATGGTCCCTCCTT | TAG | chr6 | 160660661 | 160660680 | 160660677 | + |
| SEQ ID NO 35282 | TCCTTTAGTTACAAAAATGT | TGG | chr6 | 160660676 | 160660695 | 160660692 | + |

Figure 55 (Cont'd)

| | | | | | | | |
|---|---|---|---|---|---|---|---|
| SEQ ID NO 35283 | GTTACAAAAATGTTGGTGCA | TGG | chr6 | 160660683 | 160660702 | 160660699 | + |
| SEQ ID NO 35284 | TGTTGGTGCATGGATGATGT | TGG | chr6 | 160660693 | 160660712 | 160660709 | + |
| SEQ ID NO 35285 | GTTGGTGCATGGATGATGTT | GGG | chr6 | 160660694 | 160660713 | 160660710 | + |
| SEQ ID NO 35286 | TGATGTTGGGAATAAATAAA | AAG | chr6 | 160660707 | 160660726 | 160660723 | + |
| SEQ ID NO 35287 | ACTAAATTATGTTCTCATCT | TGG | chr6 | 160660733 | 160660752 | 160660749 | + |
| SEQ ID NO 35288 | CTAAATTATGTTCTCATCTT | GGG | chr6 | 160660734 | 160660753 | 160660750 | + |
| SEQ ID NO 35289 | TCTCATCTTGGGCAAAAATT | AAG | chr6 | 160660745 | 160660764 | 160660761 | + |
| SEQ ID NO 35290 | AAAATTAAGCAAAAAAAAAA | TGG | chr6 | 160660759 | 160660778 | 160660775 | + |
| SEQ ID NO 35291 | AATTAAGCAAAAAAAAATG | GAG | chr6 | 160660761 | 160660780 | 160660777 | + |
| SEQ ID NO 35292 | ATTAAGCAAAAAAAAATGG | AGG | chr6 | 160660762 | 160660781 | 160660778 | + |
| SEQ ID NO 35293 | AAAAAAAATGGAGGATATG | AAG | chr6 | 160660770 | 160660789 | 160660786 | + |
| SEQ ID NO 35294 | GGATATGAAGCTCCTCCACA | AAG | chr6 | 160660783 | 160660802 | 160660799 | + |
| SEQ ID NO 35295 | TATGAAGCTCCTCCACAAAG | AAG | chr6 | 160660786 | 160660805 | 160660802 | + |
| SEQ ID NO 35296 | ATGAAGCTCCTCCACAAAGA | AGG | chr6 | 160660787 | 160660806 | 160660803 | + |
| SEQ ID NO 35297 | AAAGAAGGCCATTTTTGTAC | TAG | chr6 | 160660802 | 160660821 | 160660818 | + |
| SEQ ID NO 35298 | AAGAAGGCCATTTTTGTACT | AGG | chr6 | 160660803 | 160660822 | 160660819 | + |
| SEQ ID NO 35299 | TTTTTGTACTAGGCTTACTA | CAG | chr6 | 160660813 | 160660832 | 160660829 | + |
| SEQ ID NO 35300 | CTACAGTGACACACCACTAT | TAG | chr6 | 160660830 | 160660849 | 160660846 | + |
| SEQ ID NO 35301 | AGTGACACACCACTATTAGT | TGG | chr6 | 160660834 | 160660853 | 160660850 | + |
| SEQ ID NO 35302 | GTGACACACCACTATTAGTT | GGG | chr6 | 160660835 | 160660854 | 160660851 | + |
| SEQ ID NO 35303 | TGACACACCACTATTAGTTG | GGG | chr6 | 160660836 | 160660855 | 160660852 | + |
| SEQ ID NO 35304 | ACACCACTATTAGTTGGG | GAG | chr6 | 160660838 | 160660857 | 160660854 | + |
| SEQ ID NO 35305 | ACTATTAGTTGGGGAGAATT | CAG | chr6 | 160660845 | 160660864 | 160660861 | + |
| SEQ ID NO 35306 | GGGGAGAATTCAGTTTTTCC | AAG | chr6 | 160660855 | 160660874 | 160660871 | + |
| SEQ ID NO 35307 | GGGAGAATTCAGTTTTTCCA | AGG | chr6 | 160660856 | 160660875 | 160660872 | + |
| SEQ ID NO 35308 | CAGTTTTTCCAAGGTGTTGA | TAG | chr6 | 160660865 | 160660884 | 160660881 | + |
| SEQ ID NO 35309 | AGTTTTTCCAAGGTGTTGAT | AGG | chr6 | 160660866 | 160660885 | 160660882 | + |
| SEQ ID NO 35310 | CCAAGGTGTTGATAGGCATC | CAG | chr6 | 160660873 | 160660892 | 160660889 | + |
| SEQ ID NO 35311 | GTTGATAGGCATCCAGATTT | CAG | chr6 | 160660880 | 160660899 | 160660896 | + |
| SEQ ID NO 35312 | TGATAGGCATCCAGATTTCA | GAG | chr6 | 160660882 | 160660901 | 160660898 | + |
| SEQ ID NO 35313 | GATAGGCATCCAGATTTCAG | AGG | chr6 | 160660883 | 160660902 | 160660899 | + |
| SEQ ID NO 35314 | TTTCAGAGGAAATTGTAAAA | AAG | chr6 | 160660897 | 160660916 | 160660913 | + |
| SEQ ID NO 35315 | CAGAGGAAATTGTAAAAAAG | CAG | chr6 | 160660900 | 160660919 | 160660916 | + |
| SEQ ID NO 35316 | AATTGTAAAAAAGCAGAACC | TGG | chr6 | 160660907 | 160660926 | 160660923 | + |
| SEQ ID NO 35317 | ATTGTAAAAAAGCAGAACCT | GGG | chr6 | 160660908 | 160660927 | 160660924 | + |
| SEQ ID NO 35318 | ACTGCCCACGATTTTCTTT | GAG | chr6 | 160660937 | 160660956 | 160660953 | + |
| SEQ ID NO 35319 | TTTTCTTTGAGATCAAATCT | GAG | chr6 | 160660949 | 160660968 | 160660965 | + |
| SEQ ID NO 35320 | TTTCTTTGAGATCAAATCTG | AGG | chr6 | 160660950 | 160660969 | 160660966 | + |
| SEQ ID NO 35321 | GAGGCAACAAATCTGTTCAA | AAG | chr6 | 160660969 | 160660988 | 160660985 | + |
| SEQ ID NO 35322 | TTCAAAGCTGCTTTCTGCC | TGG | chr6 | 160660984 | 160661003 | 160661000 | + |
| SEQ ID NO 35323 | AGCTGCTTTCTGCCTGGTTG | TGG | chr6 | 160660990 | 160661009 | 160661006 | + |
| SEQ ID NO 35324 | CTTTCTGCCTGGTTGTGGCA | AAG | chr6 | 160660995 | 160661014 | 160661011 | + |
| SEQ ID NO 35325 | TTTCTGCCTGGTTGTGGCAA | AGG | chr6 | 160660996 | 160661015 | 160661012 | + |
| SEQ ID NO 35326 | TTCTGCCTGGTTGTGGCAAA | GGG | chr6 | 160660997 | 160661016 | 160661013 | + |
| SEQ ID NO 35327 | TGCCTGGTTGTGGCAAAGGG | TGG | chr6 | 160661000 | 160661019 | 160661016 | + |
| SEQ ID NO 35328 | GGTTGTGGCAAAGGGTGGCC | AAG | chr6 | 160661005 | 160661024 | 160661021 | + |
| SEQ ID NO 35329 | TGTGGCAAAGGGTGGCCAAG | TGG | chr6 | 160661008 | 160661027 | 160661024 | + |

Figure 55 (Cont'd)

| SEQ ID NO 35330 | GTGGCAAAGGGTGGCCAAGT | GGG | chr6 | 160661009 | 160661028 | 160661025 | + |
| SEQ ID NO 35331 | TGGCAAAGGGTGGCCAAGTG | GGG | chr6 | 160661010 | 160661029 | 160661026 | + |
| SEQ ID NO 35332 | AAGGGTGGCCAAGTGGGGCT | CAG | chr6 | 160661015 | 160661034 | 160661031 | + |
| SEQ ID NO 35333 | CTCAGCTGTGTTCCCATTGC | AAG | chr6 | 160661033 | 160661052 | 160661049 | + |
| SEQ ID NO 35334 | TCAGCTGTGTTCCCATTGCA | AGG | chr6 | 160661034 | 160661053 | 160661050 | + |
| SEQ ID NO 35335 | GTTCCCATTGCAAGGCTACT | GAG | chr6 | 160661042 | 160661061 | 160661058 | + |
| SEQ ID NO 35336 | TACTGAGCATCCCCTGTCCT | GAG | chr6 | 160661058 | 160661077 | 160661074 | + |
| SEQ ID NO 35337 | ACTGAGCATCCCCTGTCCTG | AGG | chr6 | 160661059 | 160661078 | 160661075 | + |
| SEQ ID NO 35338 | TCCCCTGTCCTGAGGCTCCT | TAG | chr6 | 160661067 | 160661086 | 160661083 | + |
| SEQ ID NO 35339 | CCCCTGTCCTGAGGCTCCTT | AGG | chr6 | 160661068 | 160661087 | 160661084 | + |
| SEQ ID NO 35340 | CTGAGGCTCCTTAGGACACC | TGG | chr6 | 160661076 | 160661095 | 160661092 | + |
| SEQ ID NO 35341 | GCTCCTTAGGACACCTGGCT | GAG | chr6 | 160661081 | 160661100 | 160661097 | + |
| SEQ ID NO 35342 | TAGGACACCTGGCTGAGCTT | CAG | chr6 | 160661087 | 160661106 | 160661103 | + |
| SEQ ID NO 35343 | GACACCTGGCTGAGCTTCAG | CAG | chr6 | 160661090 | 160661109 | 160661106 | + |
| SEQ ID NO 35344 | AGCTTCAGCAGCCCTCTTCC | AAG | chr6 | 160661102 | 160661121 | 160661118 | + |
| SEQ ID NO 35345 | CAGCAGCCCTCTTCCAAGCC | TGG | chr6 | 160661107 | 160661126 | 160661123 | + |
| SEQ ID NO 35346 | GCAGCCCTCTTCCAAGCCTG | GAG | chr6 | 160661109 | 160661128 | 160661125 | + |
| SEQ ID NO 35347 | TCTTCCAAGCCTGGAGATGC | CAG | chr6 | 160661116 | 160661135 | 160661132 | + |
| SEQ ID NO 35348 | GGAGATGCCAGCTCCATCTC | TGG | chr6 | 160661128 | 160661147 | 160661144 | + |
| SEQ ID NO 35349 | TCCATCTCTGGCACAAAATG | TAG | chr6 | 160661140 | 160661159 | 160661156 | + |
| SEQ ID NO 35350 | ACAAAATGTAGTGATTTTCA | CAG | chr6 | 160661152 | 160661171 | 160661168 | + |
| SEQ ID NO 35351 | CAAAATGTAGTGATTTTCAC | AGG | chr6 | 160661153 | 160661172 | 160661169 | + |
| SEQ ID NO 35352 | AAAATGTAGTGATTTTCACA | GGG | chr6 | 160661154 | 160661173 | 160661170 | + |
| SEQ ID NO 35353 | TGTAGTGATTTTCACAGGGT | GAG | chr6 | 160661158 | 160661177 | 160661174 | + |
| SEQ ID NO 35354 | TAGTGATTTTCACAGGGTGA | GAG | chr6 | 160661160 | 160661179 | 160661176 | + |
| SEQ ID NO 35355 | AGTGATTTTCACAGGGTGAG | AGG | chr6 | 160661161 | 160661180 | 160661177 | + |
| SEQ ID NO 35356 | TTCACAGGGTGAGAGGCCAA | AAG | chr6 | 160661168 | 160661187 | 160661184 | + |
| SEQ ID NO 35357 | CACAGGGTGAGAGGCCAAAA | GAG | chr6 | 160661170 | 160661189 | 160661186 | + |
| SEQ ID NO 35358 | ACAGGGTGAGAGGCCAAAAG | AGG | chr6 | 160661171 | 160661190 | 160661187 | + |
| SEQ ID NO 35359 | CAAAAGAGGCTAATAAAATG | AAG | chr6 | 160661185 | 160661204 | 160661201 | + |
| SEQ ID NO 35360 | AGAGGCTAATAAAATGAAGA | TAG | chr6 | 160661189 | 160661208 | 160661205 | + |
| SEQ ID NO 35361 | CTAATAAAATGAAGATAGCC | AAG | chr6 | 160661194 | 160661213 | 160661210 | + |
| SEQ ID NO 35362 | TGAAGATAGCCAAGCTTCCA | TGG | chr6 | 160661203 | 160661222 | 160661219 | + |
| SEQ ID NO 35363 | AGCCAAGCTTCCATGGAATT | AAG | chr6 | 160661210 | 160661229 | 160661226 | + |
| SEQ ID NO 35364 | GCTTCCATGGAATTAAGCAA | CAG | chr6 | 160661216 | 160661235 | 160661232 | + |
| SEQ ID NO 35365 | CTTCCATGGAATTAAGCAAC | AGG | chr6 | 160661217 | 160661236 | 160661233 | + |
| SEQ ID NO 35366 | AGGACAACCTTGACCACTTT | GAG | chr6 | 160661237 | 160661256 | 160661253 | + |
| SEQ ID NO 35367 | GGACAACCTTGACCACTTTG | AGG | chr6 | 160661238 | 160661257 | 160661254 | + |
| SEQ ID NO 35368 | GACAACCTTGACCACTTTGA | GGG | chr6 | 160661239 | 160661258 | 160661255 | + |
| SEQ ID NO 35369 | ACAACCTTGACCACTTTGAG | GGG | chr6 | 160661240 | 160661259 | 160661256 | + |
| SEQ ID NO 35370 | CTTGACCACTTTGAGGGGTG | TGG | chr6 | 160661245 | 160661264 | 160661261 | + |
| SEQ ID NO 35371 | GACCACTTTGAGGGGTGTGG | TGG | chr6 | 160661248 | 160661267 | 160661264 | + |
| SEQ ID NO 35372 | ACCACTTTGAGGGGTGTGGT | GGG | chr6 | 160661249 | 160661268 | 160661265 | + |
| SEQ ID NO 35373 | CCACTTTGAGGGGTGTGGTG | GGG | chr6 | 160661250 | 160661269 | 160661266 | + |
| SEQ ID NO 35374 | CACTTTGAGGGGTGTGGTGG | GGG | chr6 | 160661251 | 160661270 | 160661267 | + |
| SEQ ID NO 35375 | GGTGTGGTGGGGCCACATG | CAG | chr6 | 160661261 | 160661280 | 160661277 | + |
| SEQ ID NO 35376 | TGGTGGGGCCACATGCAGA | TGG | chr6 | 160661265 | 160661284 | 160661281 | + |

Figure 55 (Cont'd)

| SEQ ID NO 35377 | GTGGGGGCCACATGCAGATG | GAG | chr6 | 160661267 | 160661286 | 160661283 | + |
| SEQ ID NO 35378 | GGGGCCACATGCAGATGGAG | TGG | chr6 | 160661270 | 160661289 | 160661286 | + |
| SEQ ID NO 35379 | GGGCCACATGCAGATGGAGT | GGG | chr6 | 160661271 | 160661290 | 160661287 | + |
| SEQ ID NO 35380 | CATGCAGATGGAGTGGGTTA | AAG | chr6 | 160661277 | 160661296 | 160661293 | + |
| SEQ ID NO 35381 | TGCAGATGGAGTGGGTTAAA | GAG | chr6 | 160661279 | 160661298 | 160661295 | + |
| SEQ ID NO 35382 | GGAGTGGGTTAAAGAGTGAC | TAG | chr6 | 160661286 | 160661305 | 160661302 | + |
| SEQ ID NO 35383 | GTGGGTTAAAGAGTGACTAG | AAG | chr6 | 160661289 | 160661308 | 160661305 | + |
| SEQ ID NO 35384 | GGGTTAAAGAGTGACTAGAA | GAG | chr6 | 160661291 | 160661310 | 160661307 | + |
| SEQ ID NO 35385 | TTAAAGAGTGACTAGAAGAG | CAG | chr6 | 160661294 | 160661313 | 160661310 | + |
| SEQ ID NO 35386 | AAGAGTGACTAGAAGAGCAG | TGG | chr6 | 160661297 | 160661316 | 160661313 | + |
| SEQ ID NO 35387 | AGAGTGACTAGAAGAGCAGT | GGG | chr6 | 160661298 | 160661317 | 160661314 | + |
| SEQ ID NO 35388 | GAGTGACTAGAAGAGCAGTG | GGG | chr6 | 160661299 | 160661318 | 160661315 | + |
| SEQ ID NO 35389 | AGTGACTAGAAGAGCAGTGG | GGG | chr6 | 160661300 | 160661319 | 160661316 | + |
| SEQ ID NO 35390 | GACTAGAAGAGCAGTGGGGG | TGG | chr6 | 160661303 | 160661322 | 160661319 | + |
| SEQ ID NO 35391 | TAGAAGAGCAGTGGGGGTGG | CAG | chr6 | 160661306 | 160661325 | 160661322 | + |
| SEQ ID NO 35392 | AAGAGCAGTGGGGGTGGCAG | CAG | chr6 | 160661309 | 160661328 | 160661325 | + |
| SEQ ID NO 35393 | AGAGCAGTGGGGGTGGCAGC | AGG | chr6 | 160661310 | 160661329 | 160661326 | + |
| SEQ ID NO 35394 | AGCAGTGGGGGTGGCAGCAG | GAG | chr6 | 160661312 | 160661331 | 160661328 | + |
| SEQ ID NO 35395 | CAGTGGGGGTGGCAGCAGGA | GAG | chr6 | 160661314 | 160661333 | 160661330 | + |
| SEQ ID NO 35396 | TGGGGGTGGCAGCAGGAGAG | AAG | chr6 | 160661317 | 160661336 | 160661333 | + |
| SEQ ID NO 35397 | GTGGCAGCAGGAGAGAAGCC | TGG | chr6 | 160661322 | 160661341 | 160661338 | + |
| SEQ ID NO 35398 | GGAGAGAAGCCTGGCTCTGA | AAG | chr6 | 160661331 | 160661350 | 160661347 | + |
| SEQ ID NO 35399 | GAGAAGCCTGGCTCTGAAAG | CAG | chr6 | 160661334 | 160661353 | 160661350 | + |
| SEQ ID NO 35400 | AGCCTGGCTCTGAAAGCAGC | GAG | chr6 | 160661338 | 160661357 | 160661354 | + |
| SEQ ID NO 35401 | TCTGAAAGCAGCGAGACTTC | TAG | chr6 | 160661346 | 160661365 | 160661362 | + |
| SEQ ID NO 35402 | CTGAAAGCAGCGAGACTTCT | AGG | chr6 | 160661347 | 160661366 | 160661363 | + |
| SEQ ID NO 35403 | TGAAAGCAGCGAGACTTCTA | GGG | chr6 | 160661348 | 160661367 | 160661364 | + |
| SEQ ID NO 35404 | AGCGAGACTTCTAGGGAATA | CAG | chr6 | 160661355 | 160661374 | 160661371 | + |
| SEQ ID NO 35405 | GCGAGACTTCTAGGGAATAC | AGG | chr6 | 160661356 | 160661375 | 160661372 | + |
| SEQ ID NO 35406 | CGAGACTTCTAGGGAATACA | GGG | chr6 | 160661357 | 160661376 | 160661373 | + |
| SEQ ID NO 35407 | ACTTCTAGGGAATACAGGGT | CAG | chr6 | 160661361 | 160661380 | 160661377 | + |
| SEQ ID NO 35408 | CTTCTAGGGAATACAGGGTC | AGG | chr6 | 160661362 | 160661381 | 160661378 | + |
| SEQ ID NO 35409 | TTCTAGGGAATACAGGGTCA | GGG | chr6 | 160661363 | 160661382 | 160661379 | + |
| SEQ ID NO 35410 | TCTAGGGAATACAGGGTCAG | GGG | chr6 | 160661364 | 160661383 | 160661380 | + |
| SEQ ID NO 35411 | TAGGGAATACAGGGTCAGGG | GAG | chr6 | 160661366 | 160661385 | 160661382 | + |
| SEQ ID NO 35412 | AGGGAATACAGGGTCAGGGG | AGG | chr6 | 160661367 | 160661386 | 160661383 | + |
| SEQ ID NO 35413 | AGGGTCAGGGGAGGTTCTGA | AAG | chr6 | 160661376 | 160661395 | 160661392 | + |
| SEQ ID NO 35414 | TTCTGAAAGATGACACACTG | CAG | chr6 | 160661390 | 160661409 | 160661406 | + |
| SEQ ID NO 35415 | CTGAAAGATGACACACTGCA | GAG | chr6 | 160661392 | 160661411 | 160661408 | + |
| SEQ ID NO 35416 | TGTGTTTGTATGCCGATGAC | AAG | chr6 | 160661419 | 160661438 | 160661435 | + |
| SEQ ID NO 35417 | GTATGCCGATGACAAGTATC | CAG | chr6 | 160661426 | 160661445 | 160661442 | + |
| SEQ ID NO 35418 | TGCCGATGACAAGTATCCAG | TAG | chr6 | 160661429 | 160661448 | 160661445 | + |
| SEQ ID NO 35419 | GATGACAAGTATCCAGTAGA | AAG | chr6 | 160661433 | 160661452 | 160661449 | + |
| SEQ ID NO 35420 | ATGACAAGTATCCAGTAGAA | AGG | chr6 | 160661434 | 160661453 | 160661450 | + |
| SEQ ID NO 35421 | ACAAGTATCCAGTAGAAAGG | CAG | chr6 | 160661437 | 160661456 | 160661453 | + |
| SEQ ID NO 35422 | CCAGTAGAAAGGCAGATGAA | CAG | chr6 | 160661445 | 160661464 | 160661461 | + |
| SEQ ID NO 35423 | GATGAACAGATTCTCATTCT | CAG | chr6 | 160661459 | 160661478 | 160661475 | + |

Figure 55 (Cont'd)

| SEQ ID NO 35424 | AACAGATTCTCATTCTCAGA | AAG | chr6 | 160661463 | 160661482 | 160661479 | + |
| SEQ ID NO 35425 | ACAGATTCTCATTCTCAGAA | AGG | chr6 | 160661464 | 160661483 | 160661480 | + |
| SEQ ID NO 35426 | AAGGCCTGTCCTGACCTCCT | GAG | chr6 | 160661483 | 160661502 | 160661499 | + |
| SEQ ID NO 35427 | GGCCTGTCCTGACCTCCTGA | GAG | chr6 | 160661485 | 160661504 | 160661501 | + |
| SEQ ID NO 35428 | CCTGACCTCCTGAGAGTACA | CAG | chr6 | 160661492 | 160661511 | 160661508 | + |
| SEQ ID NO 35429 | CCTGAGAGTACACAGACCAT | GAG | chr6 | 160661500 | 160661519 | 160661516 | + |
| SEQ ID NO 35430 | CTGAGAGTACACAGACCATG | AGG | chr6 | 160661501 | 160661520 | 160661517 | + |
| SEQ ID NO 35431 | TGAGAGTACACAGACCATGA | GGG | chr6 | 160661502 | 160661521 | 160661518 | + |
| SEQ ID NO 35432 | GAGTACACAGACCATGAGGG | CAG | chr6 | 160661505 | 160661524 | 160661521 | + |
| SEQ ID NO 35433 | AGTACACAGACCATGAGGGC | AGG | chr6 | 160661506 | 160661525 | 160661522 | + |
| SEQ ID NO 35434 | GTACACAGACCATGAGGGCA | GGG | chr6 | 160661507 | 160661526 | 160661523 | + |
| SEQ ID NO 35435 | ACAGACCATGAGGGCAGGGC | AAG | chr6 | 160661511 | 160661530 | 160661527 | + |
| SEQ ID NO 35436 | CAGACCATGAGGGCAGGGCA | AGG | chr6 | 160661512 | 160661531 | 160661528 | + |
| SEQ ID NO 35437 | GACCATGAGGGCAGGGCAAG | GAG | chr6 | 160661514 | 160661533 | 160661530 | + |
| SEQ ID NO 35438 | ACCATGAGGGCAGGGCAAGG | AGG | chr6 | 160661515 | 160661534 | 160661531 | + |
| SEQ ID NO 35439 | CATGAGGGCAGGGCAAGGAG | GAG | chr6 | 160661517 | 160661536 | 160661533 | + |
| SEQ ID NO 35440 | ATGAGGGCAGGGCAAGGAGG | AGG | chr6 | 160661518 | 160661537 | 160661534 | + |
| SEQ ID NO 35441 | CACGCTCACTGTTTCATGCA | AAG | chr6 | 160661544 | 160661563 | 160661560 | + |
| SEQ ID NO 35442 | ACTGTTTCATGCAAAGTCCT | TGG | chr6 | 160661551 | 160661570 | 160661567 | + |
| SEQ ID NO 35443 | TCATGCAAAGTCCTTGGCCA | CAG | chr6 | 160661557 | 160661576 | 160661573 | + |
| SEQ ID NO 35444 | CAATTTAATATGCTCTATGC | TGG | chr6 | 160661617 | 160661636 | 160661633 | + |
| SEQ ID NO 35445 | TATGCTCTATGCTGGAAAAC | TGG | chr6 | 160661625 | 160661644 | 160661641 | + |
| SEQ ID NO 35446 | TGGAAAACTGGATTATTGAA | CAG | chr6 | 160661637 | 160661656 | 160661653 | + |
| SEQ ID NO 35447 | GGAAAACTGGATTATTGAAC | AGG | chr6 | 160661638 | 160661657 | 160661654 | + |
| SEQ ID NO 35448 | CTGGATTATTGAACAGGCAT | TGG | chr6 | 160661644 | 160661663 | 160661660 | + |
| SEQ ID NO 35449 | TCTGAACCTAATCCACTAAA | AAG | chr6 | 160661676 | 160661695 | 160661692 | + |
| SEQ ID NO 35450 | ATCCACTAAAAGCACTTGA | TAG | chr6 | 160661686 | 160661705 | 160661702 | + |
| SEQ ID NO 35451 | AGATATATCAAAATATCATT | GAG | chr6 | 160661707 | 160661726 | 160661723 | + |
| SEQ ID NO 35452 | ATCAAAATATCATTGAGAAA | TAG | chr6 | 160661713 | 160661732 | 160661729 | + |
| SEQ ID NO 35453 | TCATTGAGAAATAGATATTT | TAG | chr6 | 160661722 | 160661741 | 160661738 | + |
| SEQ ID NO 35454 | CATTGAGAAATAGATATTTT | AGG | chr6 | 160661723 | 160661742 | 160661739 | + |
| SEQ ID NO 35455 | CTCATTTGAACTCTCTTTTC | CAG | chr6 | 160661777 | 160661796 | 160661793 | + |
| SEQ ID NO 35456 | TCATTTGAACTCTCTTTTCC | AGG | chr6 | 160661778 | 160661797 | 160661794 | + |
| SEQ ID NO 35457 | TTTGAACTCTCTTTTCCAGG | AAG | chr6 | 160661781 | 160661800 | 160661797 | + |
| SEQ ID NO 35458 | TGAACTCTCTTTTCCAGGAA | GAG | chr6 | 160661783 | 160661802 | 160661799 | + |
| SEQ ID NO 35459 | TTTCCAGGAAGAGTTGTGCT | TGG | chr6 | 160661793 | 160661812 | 160661809 | + |
| SEQ ID NO 35460 | TTCCAGGAAGAGTTGTGCTT | GGG | chr6 | 160661794 | 160661813 | 160661810 | + |
| SEQ ID NO 35461 | TTGTGCTTGGGTAAATTCTA | TAG | chr6 | 160661806 | 160661825 | 160661822 | + |
| SEQ ID NO 35462 | TGGGTAAATTCTATAGCTCA | CAG | chr6 | 160661813 | 160661832 | 160661829 | + |
| SEQ ID NO 35463 | AAAACACACAATAAATTAAT | AAG | chr6 | 160661845 | 160661864 | 160661861 | + |
| SEQ ID NO 35464 | AAACACACAATAAATTAATA | AGG | chr6 | 160661846 | 160661865 | 160661862 | + |
| SEQ ID NO 35465 | AATTAATAAGGTGCTTCCTA | CAG | chr6 | 160661858 | 160661877 | 160661874 | + |
| SEQ ID NO 35466 | AATAAGGTGCTTCCTACAGT | GAG | chr6 | 160661862 | 160661881 | 160661878 | + |
| SEQ ID NO 35467 | GGTGCTTCCTACAGTGAGTT | CAG | chr6 | 160661867 | 160661886 | 160661883 | + |
| SEQ ID NO 35468 | GAGTTCAGTTAAACATTTTG | AAG | chr6 | 160661882 | 160661901 | 160661898 | + |
| SEQ ID NO 35469 | GTTCAGTTAAACATTTTGAA | GAG | chr6 | 160661884 | 160661903 | 160661900 | + |
| SEQ ID NO 35470 | TGAAGAGTGTTTTGAAATG | TAG | chr6 | 160661900 | 160661919 | 160661916 | + |

Figure 55 (Cont'd)

| SEQ ID NO 35471 | AGAGTGTTTTTGAAATGTAG | CAG | chr6 | 160661903 | 160661922 | 160661919 | + |
| SEQ ID NO 35472 | AGTGTTTTTGAAATGTAGCA | GAG | chr6 | 160661905 | 160661924 | 160661921 | + |
| SEQ ID NO 35473 | GTTTTTGAAATGTAGCAGAG | CAG | chr6 | 160661908 | 160661927 | 160661924 | + |
| SEQ ID NO 35474 | TTTTTGAAATGTAGCAGAGC | AGG | chr6 | 160661909 | 160661928 | 160661925 | + |
| SEQ ID NO 35475 | GGCTACAATTGATATTCAAA | AAG | chr6 | 160661930 | 160661949 | 160661946 | + |
| SEQ ID NO 35476 | CTACAATTGATATTCAAAAA | GAG | chr6 | 160661932 | 160661951 | 160661948 | + |
| SEQ ID NO 35477 | TACAATTGATATTCAAAAAG | AGG | chr6 | 160661933 | 160661952 | 160661949 | + |
| SEQ ID NO 35478 | ATTTATTTCCCCCTTTAACT | AAG | chr6 | 160661964 | 160661983 | 160661980 | + |
| SEQ ID NO 35479 | TGTCATTTTATTATGCTTCA | TAG | chr6 | 160662000 | 160662019 | 160662016 | + |
| SEQ ID NO 35480 | TCATTTTATTATGCTTCATA | GAG | chr6 | 160662002 | 160662021 | 160662018 | + |
| SEQ ID NO 35481 | CTTCATAGAGCATCACTGCT | GAG | chr6 | 160662015 | 160662034 | 160662031 | + |
| SEQ ID NO 35482 | CACTGCTGAGATCCCCTCCC | CAG | chr6 | 160662028 | 160662047 | 160662044 | + |
| SEQ ID NO 35483 | CCCTCCCCAGCTCATGTTGC | TAG | chr6 | 160662041 | 160662060 | 160662057 | + |
| SEQ ID NO 35484 | CCTCCCCAGCTCATGTTGCT | AGG | chr6 | 160662042 | 160662061 | 160662058 | + |
| SEQ ID NO 35485 | TGCTAGGAAATATCCCAAAA | CAG | chr6 | 160662058 | 160662077 | 160662074 | + |
| SEQ ID NO 35486 | TTGTTTCTCTGATTCACCTC | CAG | chr6 | 160662126 | 160662145 | 160662142 | + |
| SEQ ID NO 35487 | TGTTTCTCTGATTCACCTCC | AGG | chr6 | 160662127 | 160662146 | 160662143 | + |
| SEQ ID NO 35488 | GTTTCTCTGATTCACCTCCA | GGG | chr6 | 160662128 | 160662147 | 160662144 | + |
| SEQ ID NO 35489 | ATTCACCTCCAGGGCTCATA | TGG | chr6 | 160662137 | 160662156 | 160662153 | + |
| SEQ ID NO 35490 | CTCCAGGGCTCATATGGCAA | TGG | chr6 | 160662143 | 160662162 | 160662159 | + |
| SEQ ID NO 35491 | TCCAGGGCTCATATGGCAAT | GGG | chr6 | 160662144 | 160662163 | 160662160 | + |
| SEQ ID NO 35492 | CCAGGGCTCATATGGCAATG | GGG | chr6 | 160662145 | 160662164 | 160662161 | + |
| SEQ ID NO 35493 | ATATGGCAATGGGGATTTAA | TAG | chr6 | 160662154 | 160662173 | 160662170 | + |
| SEQ ID NO 35494 | TATGGCAATGGGGATTTAAT | AGG | chr6 | 160662155 | 160662174 | 160662171 | + |
| SEQ ID NO 35495 | ATGGCAATGGGGATTTAATA | GGG | chr6 | 160662156 | 160662175 | 160662172 | + |
| SEQ ID NO 35496 | ATTTAATAGGGTTTATTTGT | TGG | chr6 | 160662168 | 160662187 | 160662184 | + |
| SEQ ID NO 35497 | ATAGGGTTTATTTGTTGGTG | AAG | chr6 | 160662173 | 160662192 | 160662189 | + |
| SEQ ID NO 35498 | ACATTAAACAAATCTTTTAA | TAG | chr6 | 160662198 | 160662217 | 160662214 | + |
| SEQ ID NO 35499 | CATTAAACAAATCTTTTAAT | AGG | chr6 | 160662199 | 160662218 | 160662215 | + |
| SEQ ID NO 35500 | GGAAAAATACTTTTATATTA | TAG | chr6 | 160662220 | 160662239 | 160662236 | + |
| SEQ ID NO 35501 | GAAAAATACTTTTATATTAT | AGG | chr6 | 160662221 | 160662240 | 160662237 | + |
| SEQ ID NO 35502 | TTTATATTATAGGCAAAATG | TAG | chr6 | 160662231 | 160662250 | 160662247 | + |
| SEQ ID NO 35503 | GTAGATGTATATTGCTACTG | AAG | chr6 | 160662250 | 160662269 | 160662266 | + |
| SEQ ID NO 35504 | AAGTAAATGTATTTTATTAA | TGG | chr6 | 160662270 | 160662289 | 160662286 | + |
| SEQ ID NO 35505 | ATGTATTTTATTAATGGTGT | GAG | chr6 | 160662276 | 160662295 | 160662292 | + |
| SEQ ID NO 35506 | TGAGAATTTCTTCCTCACTG | TGG | chr6 | 160662295 | 160662314 | 160662311 | + |
| SEQ ID NO 35507 | ATGCATATTTGCATGTGTAA | AAG | chr6 | 160662331 | 160662350 | 160662347 | + |
| SEQ ID NO 35508 | ATTTGCATGTGTAAAAGACT | TAG | chr6 | 160662337 | 160662356 | 160662353 | + |
| SEQ ID NO 35509 | AAGACTTAGCAATTTGTGAA | TAG | chr6 | 160662351 | 160662370 | 160662367 | + |
| SEQ ID NO 35510 | ACTTAGCAATTTGTGAATAG | AAG | chr6 | 160662354 | 160662373 | 160662370 | + |
| SEQ ID NO 35511 | ATGTTTCTCCGCTTCTCACT | GAG | chr6 | 160662377 | 160662396 | 160662393 | + |
| SEQ ID NO 35512 | TCTCCGCTTCTCACTGAGCA | TGG | chr6 | 160662382 | 160662401 | 160662398 | + |
| SEQ ID NO 35513 | CTCACTGAGCATGGCTGTAA | AAG | chr6 | 160662391 | 160662410 | 160662407 | + |
| SEQ ID NO 35514 | AAGAACTTTTCCTCTCCC | CGG | chr6 | 160662411 | 160662430 | 160662427 | + |
| SEQ ID NO 35515 | AGAAACTTTTCCTCTCCCC | GGG | chr6 | 160662412 | 160662431 | 160662428 | + |
| SEQ ID NO 35516 | TTTCCTCTCCCCGGGCATTC | CAG | chr6 | 160662420 | 160662439 | 160662436 | + |
| SEQ ID NO 35517 | CCGGGCATTCCAGCACACAT | TGG | chr6 | 160662430 | 160662449 | 160662446 | + |

Figure 55 (Cont'd)

| SEQ ID NO 35518 | GCATTCCAGCACACATTGGA | AAG | chr6 | 160662434 | 160662453 | 160662450 | + |
| SEQ ID NO 35519 | TTGGAAAGATAACACGTCCA | CAG | chr6 | 160662449 | 160662468 | 160662465 | + |
| SEQ ID NO 35520 | AAAGATAACACGTCCACAGA | AAG | chr6 | 160662453 | 160662472 | 160662469 | + |
| SEQ ID NO 35521 | TAACACGTCCACAGAAAGCC | TGG | chr6 | 160662458 | 160662477 | 160662474 | + |
| SEQ ID NO 35522 | CAGAAAGCCTGGCTTTCCAA | AAG | chr6 | 160662469 | 160662488 | 160662485 | + |
| SEQ ID NO 35523 | GAAAGCCTGGCTTTCCAAAA | GAG | chr6 | 160662471 | 160662490 | 160662487 | + |
| SEQ ID NO 35524 | GGCTTTCCAAAAGAGCTTAT | CAG | chr6 | 160662479 | 160662498 | 160662495 | + |
| SEQ ID NO 35525 | CTTTCCAAAAGAGCTTATCA | GAG | chr6 | 160662481 | 160662500 | 160662497 | + |
| SEQ ID NO 35526 | TTATCAGAGAATGTGCCCCC | CAG | chr6 | 160662495 | 160662514 | 160662511 | + |
| SEQ ID NO 35527 | TATCAGAGAATGTGCCCCCC | AGG | chr6 | 160662496 | 160662515 | 160662512 | + |
| SEQ ID NO 35528 | TAAAACATATGTTAATCCTG | TGG | chr6 | 160662524 | 160662543 | 160662540 | + |
| SEQ ID NO 35529 | AACATATGTTAATCCTGTGG | CAG | chr6 | 160662527 | 160662546 | 160662543 | + |
| SEQ ID NO 35530 | CATATGTTAATCCTGTGGCA | GAG | chr6 | 160662529 | 160662548 | 160662545 | + |
| SEQ ID NO 35531 | ATGTTAATCCTGTGGCAGAG | AAG | chr6 | 160662532 | 160662551 | 160662548 | + |
| SEQ ID NO 35532 | TGTGGCAGAGAAGTTTGTTC | TAG | chr6 | 160662542 | 160662561 | 160662558 | + |
| SEQ ID NO 35533 | GAGAAGTTTGTTCTAGCCTT | TGG | chr6 | 160662549 | 160662568 | 160662565 | + |
| SEQ ID NO 35534 | AGAAGTTTGTTCTAGCCTTT | GGG | chr6 | 160662550 | 160662569 | 160662566 | + |
| SEQ ID NO 35535 | TTTGTTCTAGCCTTTGGGTG | TAG | chr6 | 160662555 | 160662574 | 160662571 | + |
| SEQ ID NO 35536 | TTGGGTGTAGCCTGCTGAAT | AAG | chr6 | 160662568 | 160662587 | 160662584 | + |
| SEQ ID NO 35537 | TAGCCTGCTGAATAAGTTCA | CAG | chr6 | 160662575 | 160662594 | 160662591 | + |
| SEQ ID NO 35538 | GTTCACAGTGATCTACATCC | TAG | chr6 | 160662590 | 160662609 | 160662606 | + |
| SEQ ID NO 35539 | GATCTACATCCTAGTTTCCA | TGG | chr6 | 160662599 | 160662618 | 160662615 | + |
| SEQ ID NO 35540 | ATCTACATCCTAGTTTCCAT | GGG | chr6 | 160662600 | 160662619 | 160662616 | + |
| SEQ ID NO 35541 | CTAGTTTCCATGGGCTGAAA | TAG | chr6 | 160662609 | 160662628 | 160662625 | + |
| SEQ ID NO 35542 | CCCTGCACTCCCTACACACA | CAG | chr6 | 160662644 | 160662663 | 160662660 | + |
| SEQ ID NO 35543 | ACTCCCTACACACACAGACA | TAG | chr6 | 160662650 | 160662669 | 160662666 | + |
| SEQ ID NO 35544 | TTCTTTGATATTTTCTTGAA | TGG | chr6 | 160662724 | 160662743 | 160662740 | + |
| SEQ ID NO 35545 | TTCAAATGTGTTTGACTTTA | AAG | chr6 | 160662758 | 160662777 | 160662774 | + |
| SEQ ID NO 35546 | TCAACTTGTAAAATTTTATC | TGG | chr6 | 160662781 | 160662800 | 160662797 | + |
| SEQ ID NO 35547 | AAATTTTATCTGGTAATTTA | TAG | chr6 | 160662791 | 160662810 | 160662807 | + |
| SEQ ID NO 35548 | TAATTTATAGATTAAATTGC | AAG | chr6 | 160662804 | 160662823 | 160662820 | + |
| SEQ ID NO 35549 | AGCATCTACCTCCCTTTCAT | CAG | chr6 | 160662825 | 160662844 | 160662841 | + |
| SEQ ID NO 35550 | CTTTCATCAGACTCTCCCTG | CAG | chr6 | 160662838 | 160662857 | 160662854 | + |
| SEQ ID NO 35551 | TTTCATCAGACTCTCCCTGC | AGG | chr6 | 160662839 | 160662858 | 160662855 | + |
| SEQ ID NO 35552 | TTCATCAGACTCTCCCTGCA | GGG | chr6 | 160662840 | 160662859 | 160662856 | + |
| SEQ ID NO 35553 | TCAGACTCTCCCTGCAGGGC | AAG | chr6 | 160662844 | 160662863 | 160662860 | + |
| SEQ ID NO 35554 | TCTAACTATGTATGTGCTTC | AAG | chr6 | 160662871 | 160662890 | 160662887 | + |
| SEQ ID NO 35555 | ACTATGTATGTGCTTCAAGA | TGG | chr6 | 160662875 | 160662894 | 160662891 | + |
| SEQ ID NO 35556 | TGCTTCAAGATGGAACTCCT | GAG | chr6 | 160662885 | 160662904 | 160662901 | + |
| SEQ ID NO 35557 | AGATGGAACTCCTGAGTTCA | CAG | chr6 | 160662892 | 160662911 | 160662908 | + |
| SEQ ID NO 35558 | GATGGAACTCCTGAGTTCAC | AGG | chr6 | 160662893 | 160662912 | 160662909 | + |
| SEQ ID NO 35559 | CACAGGTGATTTATAAACCA | AAG | chr6 | 160662910 | 160662929 | 160662926 | + |
| SEQ ID NO 35560 | ACTACAAAACTCTCACCCTC | CAG | chr6 | 160662940 | 160662959 | 160662956 | + |
| SEQ ID NO 35561 | TACAAAACTCTCACCCTCCA | GAG | chr6 | 160662942 | 160662961 | 160662958 | + |
| SEQ ID NO 35562 | ACCCTCCAGAGATTTGCCTC | AAG | chr6 | 160662954 | 160662973 | 160662970 | + |
| SEQ ID NO 35563 | CCCTCCAGAGATTTGCCTCA | AGG | chr6 | 160662955 | 160662974 | 160662971 | + |
| SEQ ID NO 35564 | CCTCCAGAGATTTGCCTCAA | GGG | chr6 | 160662956 | 160662975 | 160662972 | + |

Figure 55 (Cont'd)

| SEQ ID NO | Sequence | PAM | Chr | Start | End | Pos | Strand |
|---|---|---|---|---|---|---|---|
| SEQ ID NO 35565 | GGGACAACACCCTGCTCACA | AAG | chr6 | 160662976 | 160662995 | 160662992 | + |
| SEQ ID NO 35566 | GGACAACACCCTGCTCACAA | AGG | chr6 | 160662977 | 160662996 | 160662993 | + |
| SEQ ID NO 35567 | CACCCTGCTCACAAAGGCAC | CAG | chr6 | 160662983 | 160663002 | 160662999 | + |
| SEQ ID NO 35568 | CCTGCTCACAAAGGCACCAG | CAG | chr6 | 160662986 | 160663005 | 160663002 | + |
| SEQ ID NO 35569 | CTGCTCACAAAGGCACCAGC | AGG | chr6 | 160662987 | 160663006 | 160663003 | + |
| SEQ ID NO 35570 | CAGGCAACTGCTCAACTACC | TGG | chr6 | 160663006 | 160663025 | 160663022 | + |
| SEQ ID NO 35571 | GCAACTGCTCAACTACCTGG | TGG | chr6 | 160663009 | 160663028 | 160663025 | + |
| SEQ ID NO 35572 | TGCTCAACTACCTGGTGGAT | AAG | chr6 | 160663014 | 160663033 | 160663030 | + |
| SEQ ID NO 35573 | GCTCAACTACCTGGTGGATA | AGG | chr6 | 160663015 | 160663034 | 160663031 | + |
| SEQ ID NO 35574 | ACCTGGTGGATAAGGTGCCC | AAG | chr6 | 160663023 | 160663042 | 160663039 | + |
| SEQ ID NO 35575 | GGTGGATAAGGTGCCCAAGC | TAG | chr6 | 160663027 | 160663046 | 160663043 | + |
| SEQ ID NO 35576 | ATAAGGTGCCCAAGCTAGCA | TGG | chr6 | 160663032 | 160663051 | 160663048 | + |
| SEQ ID NO 35577 | CCTCCTCTGTTGCCTTTTAA | AAG | chr6 | 160663074 | 160663093 | 160663090 | + |
| SEQ ID NO 35578 | AGTGCCACTTTCTGCTCCTA | AAG | chr6 | 160663095 | 160663114 | 160663111 | + |
| SEQ ID NO 35579 | CACTTTCTGCTCCTAAAGTG | AAG | chr6 | 160663100 | 160663119 | 160663116 | + |
| SEQ ID NO 35580 | TTTCTGCTCCTAAAGTGAAG | TAG | chr6 | 160663103 | 160663122 | 160663119 | + |
| SEQ ID NO 35581 | GCTCCTAAAGTGAAGTAGTA | CGG | chr6 | 160663108 | 160663127 | 160663124 | + |
| SEQ ID NO 35582 | CCTAAAGTGAAGTAGTACGG | CAG | chr6 | 160663111 | 160663130 | 160663127 | + |
| SEQ ID NO 35583 | CTAAAGTGAAGTAGTACGGC | AGG | chr6 | 160663112 | 160663131 | 160663128 | + |
| SEQ ID NO 35584 | ACTGCTGCATTTCTTCCCCT | AAG | chr6 | 160663135 | 160663154 | 160663151 | + |
| SEQ ID NO 35585 | CTGCATTTCTTCCCCTAAGC | TAG | chr6 | 160663139 | 160663158 | 160663155 | + |
| SEQ ID NO 35586 | TTCTTCCCCTAAGCTAGCTT | TGG | chr6 | 160663145 | 160663164 | 160663161 | + |
| SEQ ID NO 35587 | TTCCCCTAAGCTAGCTTTGG | AAG | chr6 | 160663148 | 160663167 | 160663164 | + |
| SEQ ID NO 35588 | GCAAATCACTTTCTTTATAC | CAG | chr6 | 160663170 | 160663189 | 160663186 | + |
| SEQ ID NO 35589 | CAGACTTCTCTCTTCTTAAT | TGG | chr6 | 160663190 | 160663209 | 160663206 | + |
| SEQ ID NO 35590 | TCTTCTTAATTGGATTCTGC | AAG | chr6 | 160663200 | 160663219 | 160663216 | + |
| SEQ ID NO 35591 | TCTTAATTGGATTCTGCAAG | TGG | chr6 | 160663203 | 160663222 | 160663219 | + |
| SEQ ID NO 35592 | CAAACAATTAACCTGCTCTT | CAG | chr6 | 160663226 | 160663245 | 160663242 | + |
| SEQ ID NO 35593 | AACCTGCTCTTCAGTTACAT | TGG | chr6 | 160663235 | 160663254 | 160663251 | + |
| SEQ ID NO 35594 | CAGTTACATTGGAATGTGTT | TAG | chr6 | 160663246 | 160663265 | 160663262 | + |
| SEQ ID NO 35595 | AGATTTATTTTTTCAAATGT | TGG | chr6 | 160663267 | 160663286 | 160663283 | + |
| SEQ ID NO 35596 | TTTTTTCAAATGTTGGAACA | AAG | chr6 | 160663274 | 160663293 | 160663290 | + |
| SEQ ID NO 35597 | ATGTTGGAACAAAGATGAAA | AAG | chr6 | 160663283 | 160663302 | 160663299 | + |
| SEQ ID NO 35598 | TGGAACAAAGATGAAAAAGT | GAG | chr6 | 160663287 | 160663306 | 160663303 | + |
| SEQ ID NO 35599 | AACAAAGATGAAAAAGTGAG | AAG | chr6 | 160663290 | 160663309 | 160663306 | + |
| SEQ ID NO 35600 | CAAAGATGAAAAAGTGAGAA | GAG | chr6 | 160663292 | 160663311 | 160663308 | + |
| SEQ ID NO 35601 | TGAAAAAGTGAGAAGAGCCC | TAG | chr6 | 160663298 | 160663317 | 160663314 | + |
| SEQ ID NO 35602 | AAGAGCCCTAGATTTTTCT | TGG | chr6 | 160663310 | 160663329 | 160663326 | + |
| SEQ ID NO 35603 | TAGATTTTTCTTGGAAATC | TGG | chr6 | 160663318 | 160663337 | 160663334 | + |
| SEQ ID NO 35604 | TTGGAAATCTGGCTTAAATC | CAG | chr6 | 160663329 | 160663348 | 160663345 | + |
| SEQ ID NO 35605 | TGGAAATCTGGCTTAAATCC | AGG | chr6 | 160663330 | 160663349 | 160663346 | + |
| SEQ ID NO 35606 | GTTTCTTTATTTCCTTGATT | TGG | chr6 | 160663352 | 160663371 | 160663368 | + |
| SEQ ID NO 35607 | TTTCTTTATTTCCTTGATTT | GGG | chr6 | 160663353 | 160663372 | 160663369 | + |
| SEQ ID NO 35608 | ATTTCCTTGATTTGGGAATT | TGG | chr6 | 160663360 | 160663379 | 160663376 | + |
| SEQ ID NO 35609 | TGATTTGGGAATTTGGTCAC | GAG | chr6 | 160663367 | 160663386 | 160663383 | + |
| SEQ ID NO 35610 | ACAAATAACATGATTTTCCT | AAG | chr6 | 160663390 | 160663409 | 160663406 | + |
| SEQ ID NO 35611 | TAACATGATTTTCCTAAGTC | TAG | chr6 | 160663395 | 160663414 | 160663411 | + |

Figure 55 (Cont'd)

| | | | | | | | |
|---|---|---|---|---|---|---|---|
| SEQ ID NO 35612 | AGATTTCTTTGTTTATAAAA | TGG | chr6 | 160663416 | 160663435 | 160663432 | + |
| SEQ ID NO 35613 | GATTTCTTTGTTTATAAAAT | GGG | chr6 | 160663417 | 160663436 | 160663433 | + |
| SEQ ID NO 35614 | ATTTCTTTGTTTATAAAATG | GGG | chr6 | 160663418 | 160663437 | 160663434 | + |
| SEQ ID NO 35615 | TGCTACCCTACCTATACCAT | GAG | chr6 | 160663448 | 160663467 | 160663464 | + |
| SEQ ID NO 35616 | ACCTATACCATGAGCTAAAT | AAG | chr6 | 160663457 | 160663476 | 160663473 | + |
| SEQ ID NO 35617 | ATACCATGAGCTAAATAAGC | TAG | chr6 | 160663461 | 160663480 | 160663477 | + |
| SEQ ID NO 35618 | TAAATAAGCTAGTATTTGTA | AAG | chr6 | 160663472 | 160663491 | 160663488 | + |
| SEQ ID NO 35619 | AAATAAGCTAGTATTTGTAA | AGG | chr6 | 160663473 | 160663492 | 160663489 | + |
| SEQ ID NO 35620 | CTTACATTCACAATCACACA | CGG | chr6 | 160663503 | 160663522 | 160663519 | + |
| SEQ ID NO 35621 | TGTATGTATGTATAAAAATG | TGG | chr6 | 160663536 | 160663555 | 160663552 | + |
| SEQ ID NO 35622 | GTATGTATGTATAAAAATGT | GGG | chr6 | 160663537 | 160663556 | 160663553 | + |
| SEQ ID NO 35623 | TATGTATGTATAAAAATGTG | GGG | chr6 | 160663538 | 160663557 | 160663554 | + |
| SEQ ID NO 35624 | ACCCACTCAACAAATACCCT | GAG | chr6 | 160663566 | 160663585 | 160663582 | + |
| SEQ ID NO 35625 | CATTATATGCGTATATCATC | TGG | chr6 | 160663601 | 160663620 | 160663617 | + |
| SEQ ID NO 35626 | TGCGTATATCATCTGGCAAA | TGG | chr6 | 160663608 | 160663627 | 160663624 | + |
| SEQ ID NO 35627 | ATGGATGTGTATAATTTCTC | CAG | chr6 | 160663627 | 160663646 | 160663643 | + |
| SEQ ID NO 35628 | TGGATGTGTATAATTTCTCC | AGG | chr6 | 160663628 | 160663647 | 160663644 | + |
| SEQ ID NO 35629 | GGATGTGTATAATTTCTCCA | GGG | chr6 | 160663629 | 160663648 | 160663645 | + |
| SEQ ID NO 35630 | TGTATAATTTCTCCAGGGAT | AAG | chr6 | 160663634 | 160663653 | 160663650 | + |
| SEQ ID NO 35631 | ATAATTTCTCCAGGGATAAG | AAG | chr6 | 160663637 | 160663656 | 160663653 | + |
| SEQ ID NO 35632 | AAGAAGCAAATGTATACCGA | TGG | chr6 | 160663654 | 160663673 | 160663670 | + |
| SEQ ID NO 35633 | AGCAAATGTATACCGATGGA | AAG | chr6 | 160663658 | 160663677 | 160663674 | + |
| SEQ ID NO 35634 | TACCGATGGAAAGCCTTACT | CAG | chr6 | 160663668 | 160663687 | 160663684 | + |
| SEQ ID NO 35635 | ACCGATGGAAAGCCTTACTC | AGG | chr6 | 160663669 | 160663688 | 160663685 | + |
| SEQ ID NO 35636 | GCCTTACTCAGGCCATAACA | AAG | chr6 | 160663680 | 160663699 | 160663696 | + |
| SEQ ID NO 35637 | CTTACTCAGGCCATAACAAA | GAG | chr6 | 160663682 | 160663701 | 160663698 | + |
| SEQ ID NO 35638 | TACTCAGGCCATAACAAAGA | GAG | chr6 | 160663684 | 160663703 | 160663700 | + |
| SEQ ID NO 35639 | ATAACAAAGAGAGAAATGCT | GAG | chr6 | 160663694 | 160663713 | 160663710 | + |
| SEQ ID NO 35640 | GCTGAGTCCCACTCCATGAA | CAG | chr6 | 160663711 | 160663730 | 160663727 | + |
| SEQ ID NO 35641 | CTGAGTCCCACTCCATGAAC | AGG | chr6 | 160663712 | 160663731 | 160663728 | + |
| SEQ ID NO 35642 | TCCCACTCCATGAACAGGTC | AAG | chr6 | 160663717 | 160663736 | 160663733 | + |
| SEQ ID NO 35643 | CCCACTCCATGAACAGGTCA | AGG | chr6 | 160663718 | 160663737 | 160663734 | + |
| SEQ ID NO 35644 | CAAGGAACCAAACATATTCA | AAG | chr6 | 160663736 | 160663755 | 160663752 | + |
| SEQ ID NO 35645 | AGGAACCAAACATATTCAAA | GAG | chr6 | 160663738 | 160663757 | 160663754 | + |
| SEQ ID NO 35646 | ATTTCATTGTTTCAACTTGC | TAG | chr6 | 160663763 | 160663782 | 160663779 | + |
| SEQ ID NO 35647 | CATTGTTTCAACTTGCTAGT | GAG | chr6 | 160663767 | 160663786 | 160663783 | + |
| SEQ ID NO 35648 | ATTGTTTCAACTTGCTAGTG | AGG | chr6 | 160663768 | 160663787 | 160663784 | + |
| SEQ ID NO 35649 | TTGTTTCAACTTGCTAGTGA | GGG | chr6 | 160663769 | 160663788 | 160663785 | + |
| SEQ ID NO 35650 | TGTTTCAACTTGCTAGTGAG | GGG | chr6 | 160663770 | 160663789 | 160663786 | + |
| SEQ ID NO 35651 | TTTCAACTTGCTAGTGAGGG | GAG | chr6 | 160663772 | 160663791 | 160663788 | + |
| SEQ ID NO 35652 | ACTTGCTAGTGAGGGGAGCA | TGG | chr6 | 160663777 | 160663796 | 160663793 | + |
| SEQ ID NO 35653 | AGGGGAGCATGGCACCTGAA | CAG | chr6 | 160663788 | 160663807 | 160663804 | + |
| SEQ ID NO 35654 | GGGAGCATGGCACCTGAACA | GAG | chr6 | 160663790 | 160663809 | 160663806 | + |
| SEQ ID NO 35655 | TGATATAAATTAATGAAACT | GAG | chr6 | 160663814 | 160663833 | 160663830 | + |
| SEQ ID NO 35656 | AATTAATGAAACTGAGAACC | AAG | chr6 | 160663821 | 160663840 | 160663837 | + |
| SEQ ID NO 35657 | ATGAAACTGAGAACCAAGCG | AAG | chr6 | 160663826 | 160663845 | 160663842 | + |
| SEQ ID NO 35658 | GAAACTGAGAACCAAGCGAA | GAG | chr6 | 160663828 | 160663847 | 160663844 | + |

Figure 55 (Cont'd)

| | | | | | | | |
|---|---|---|---|---|---|---|---|
| SEQ ID NO 35659 | TGAGAACCAAGCGAAGAGCT | TAG | chr6 | 160663833 | 160663852 | 160663849 | + |
| SEQ ID NO 35660 | GAGCTTAGCCATCCTTTGCA | TAG | chr6 | 160663848 | 160663867 | 160663864 | + |
| SEQ ID NO 35661 | TTAGCCATCCTTTGCATAGT | TAG | chr6 | 160663852 | 160663871 | 160663868 | + |
| SEQ ID NO 35662 | CTTTGCATAGTTAGCTACAA | TGG | chr6 | 160663861 | 160663880 | 160663877 | + |
| SEQ ID NO 35663 | TACAATGGCTATTTATTTTT | CAG | chr6 | 160663876 | 160663895 | 160663892 | + |
| SEQ ID NO 35664 | ATGGCTATTTATTTTTCAGC | CAG | chr6 | 160663880 | 160663899 | 160663896 | + |
| SEQ ID NO 35665 | TATTTATTTTTCAGCCAGAC | TGG | chr6 | 160663885 | 160663904 | 160663901 | + |
| SEQ ID NO 35666 | CAGCCAGACTGGCCATCATG | TAG | chr6 | 160663896 | 160663915 | 160663912 | + |
| SEQ ID NO 35667 | AGCCAGACTGGCCATCATGT | AGG | chr6 | 160663897 | 160663916 | 160663913 | + |
| SEQ ID NO 35668 | ATCATGTAGGCACACTCTTT | TAG | chr6 | 160663910 | 160663929 | 160663926 | + |
| SEQ ID NO 35669 | GTAGGCACACTCTTTTAGAT | TAG | chr6 | 160663915 | 160663934 | 160663931 | + |
| SEQ ID NO 35670 | TTTTTCTGCCCATTCATTC | CAG | chr6 | 160663953 | 160663972 | 160663969 | + |
| SEQ ID NO 35671 | CATTCATTCCAGCACCGTGA | CAG | chr6 | 160663964 | 160663983 | 160663980 | + |
| SEQ ID NO 35672 | CAGCACCGTGACAGTCTTCA | CGG | chr6 | 160663973 | 160663992 | 160663989 | + |
| SEQ ID NO 35673 | AGCACCGTGACAGTCTTCAC | GGG | chr6 | 160663974 | 160663993 | 160663990 | + |
| SEQ ID NO 35674 | GCACCGTGACAGTCTTCACG | GGG | chr6 | 160663975 | 160663994 | 160663991 | + |
| SEQ ID NO 35675 | GAAATTAAACTTATTTTTTT | AAG | chr6 | 160663997 | 160664016 | 160664013 | + |
| SEQ ID NO 35676 | AGAATTTTTCAATCATATAC | AAG | chr6 | 160664018 | 160664037 | 160664034 | + |
| SEQ ID NO 35677 | TCATATACAAGATTTTGAAC | TGG | chr6 | 160664030 | 160664049 | 160664046 | + |
| SEQ ID NO 35678 | CATATACAAGATTTTGAACT | GGG | chr6 | 160664031 | 160664050 | 160664047 | + |
| SEQ ID NO 35679 | AATTAAATGAATTGCACATA | AAG | chr6 | 160664070 | 160664089 | 160664086 | + |
| SEQ ID NO 35680 | ATGAATTGCACATAAAGCCA | TGG | chr6 | 160664076 | 160664095 | 160664092 | + |
| SEQ ID NO 35681 | TATGTATTTTACTACATTG | TGG | chr6 | 160664101 | 160664120 | 160664117 | + |
| SEQ ID NO 35682 | ATGTATTTTACTACATTGT | GGG | chr6 | 160664102 | 160664121 | 160664118 | + |
| SEQ ID NO 35683 | GTATTTTACTACATTGTGG | GAG | chr6 | 160664104 | 160664123 | 160664120 | + |
| SEQ ID NO 35684 | AACTATGTCTTACCTGATTT | CAG | chr6 | 160664153 | 160664172 | 160664169 | + |
| SEQ ID NO 35685 | TTACCTGATTTCAGAAATAA | AAG | chr6 | 160664162 | 160664181 | 160664178 | + |
| SEQ ID NO 35686 | CCTGATTTCAGAAATAAAAG | AAG | chr6 | 160664165 | 160664184 | 160664181 | + |
| SEQ ID NO 35687 | GATTTCAGAAATAAAAGAAG | TAG | chr6 | 160664168 | 160664187 | 160664184 | + |
| SEQ ID NO 35688 | TTCAGAAATAAAAGAAGTAG | AAG | chr6 | 160664171 | 160664190 | 160664187 | + |
| SEQ ID NO 35689 | CACTTCCTTATGTTCCATTT | TGG | chr6 | 160664197 | 160664216 | 160664213 | + |
| SEQ ID NO 35690 | ACTTCCTTATGTTCCATTTT | GGG | chr6 | 160664198 | 160664217 | 160664214 | + |
| SEQ ID NO 35691 | CTTATGTTCCATTTTGGGAC | TGG | chr6 | 160664203 | 160664222 | 160664219 | + |
| SEQ ID NO 35692 | TGTTCCATTTTGGGACTGGC | CAG | chr6 | 160664207 | 160664226 | 160664223 | + |
| SEQ ID NO 35693 | TCCATTTTGGGACTGGCCAG | CAG | chr6 | 160664210 | 160664229 | 160664226 | + |
| SEQ ID NO 35694 | TGGGACTGGCCAGCAGTGCC | CAG | chr6 | 160664217 | 160664236 | 160664233 | + |
| SEQ ID NO 35695 | ACTGGCCAGCAGTGCCCAGA | AAG | chr6 | 160664221 | 160664240 | 160664237 | + |
| SEQ ID NO 35696 | CAGAAAGTGTGTCCCAATCC | CAG | chr6 | 160664237 | 160664256 | 160664253 | + |
| SEQ ID NO 35697 | AGAAAGTGTGTCCCAATCCC | AGG | chr6 | 160664238 | 160664257 | 160664254 | + |
| SEQ ID NO 35698 | AGGACATTGTTGACTTACAT | GAG | chr6 | 160664258 | 160664277 | 160664274 | + |
| SEQ ID NO 35699 | GACATTGTTGACTTACATGA | GAG | chr6 | 160664260 | 160664279 | 160664276 | + |
| SEQ ID NO 35700 | GAGTAAACGCACCCACAAAC | CAG | chr6 | 160664280 | 160664299 | 160664296 | + |
| SEQ ID NO 35701 | AAACGCACCCACAAACCAGA | TAG | chr6 | 160664284 | 160664303 | 160664300 | + |
| SEQ ID NO 35702 | ACAAACCAGATAGTCAAATT | AAG | chr6 | 160664294 | 160664313 | 160664310 | + |
| SEQ ID NO 35703 | AATTAAGTTAATGATTCTCT | CAG | chr6 | 160664310 | 160664329 | 160664326 | + |
| SEQ ID NO 35704 | TTAAGTTAATGATTCTCTCA | GAG | chr6 | 160664312 | 160664331 | 160664328 | + |
| SEQ ID NO 35705 | CTCTCAGAGACCCATGCCAC | TGG | chr6 | 160664326 | 160664345 | 160664342 | + |

Figure 55 (Cont'd)

| SEQ ID NO 35706 | AGAGACCCATGCCACTGGCT | CAG | chr6 | 160664331 | 160664350 | 160664347 | + |
| SEQ ID NO 35707 | GACCCATGCCACTGGCTCAG | CAG | chr6 | 160664334 | 160664353 | 160664350 | + |
| SEQ ID NO 35708 | ACCCATGCCACTGGCTCAGC | AGG | chr6 | 160664335 | 160664354 | 160664351 | + |
| SEQ ID NO 35709 | CCCATGCCACTGGCTCAGCA | GGG | chr6 | 160664336 | 160664355 | 160664352 | + |
| SEQ ID NO 35710 | TTCAAACATTACCTTGAATA | TAG | chr6 | 160664359 | 160664378 | 160664375 | + |
| SEQ ID NO 35711 | CAAACATTACCTTGAATATA | GAG | chr6 | 160664361 | 160664380 | 160664377 | + |
| SEQ ID NO 35712 | TAGAGTCTTATAAAATATTT | GAG | chr6 | 160664379 | 160664398 | 160664395 | + |
| SEQ ID NO 35713 | GAGTCTTATAAAATATTTGA | GAG | chr6 | 160664381 | 160664400 | 160664397 | + |
| SEQ ID NO 35714 | ATTTGAGAGTGCAATGTCAA | TAG | chr6 | 160664395 | 160664414 | 160664411 | + |
| SEQ ID NO 35715 | AGTGCAATGTCAATAGATGC | TGG | chr6 | 160664402 | 160664421 | 160664418 | + |
| SEQ ID NO 35716 | GTGCAATGTCAATAGATGCT | GGG | chr6 | 160664403 | 160664422 | 160664419 | + |
| SEQ ID NO 35717 | CAATGTCAATAGATGCTGGG | AAG | chr6 | 160664406 | 160664425 | 160664422 | + |
| SEQ ID NO 35718 | TGTCAATAGATGCTGGGAAG | TGG | chr6 | 160664409 | 160664428 | 160664425 | + |
| SEQ ID NO 35719 | TAGATGCTGGGAAGTGGTGA | AAG | chr6 | 160664415 | 160664434 | 160664431 | + |
| SEQ ID NO 35720 | GTGAAAGCCATTTCCCCCCT | CAG | chr6 | 160664431 | 160664450 | 160664447 | + |
| SEQ ID NO 35721 | CTTACTCCTTCCCTCACCCC | TAG | chr6 | 160664479 | 160664498 | 160664495 | + |
| SEQ ID NO 35722 | AGACCTTCATCTTTCCTGAT | TAG | chr6 | 160664500 | 160664519 | 160664516 | + |
| SEQ ID NO 35723 | TTCTTTCATTCTCTTTCTTT | TGG | chr6 | 160664540 | 160664559 | 160664556 | + |
| SEQ ID NO 35724 | TGGATAAAATAAAATCATAA | AAG | chr6 | 160664560 | 160664579 | 160664576 | + |
| SEQ ID NO 35725 | ATAAAATAAAATCATAAAAG | TAG | chr6 | 160664563 | 160664582 | 160664579 | + |
| SEQ ID NO 35726 | TAAAAGTAGCTCATATTTGC | TGG | chr6 | 160664577 | 160664596 | 160664593 | + |
| SEQ ID NO 35727 | TTGCTGGTAACTTCCATGAC | CAG | chr6 | 160664593 | 160664612 | 160664609 | + |
| SEQ ID NO 35728 | CCATGACCAGACCCTCTGCC | AAG | chr6 | 160664606 | 160664625 | 160664622 | + |
| SEQ ID NO 35729 | TGCCAAGTGCTGCACATCCA | TAG | chr6 | 160664622 | 160664641 | 160664638 | + |
| SEQ ID NO 35730 | GCACATCCATAGCCTCCCTC | AAG | chr6 | 160664633 | 160664652 | 160664649 | + |
| SEQ ID NO 35731 | GCCTCCCTCAAGCTTTCCAA | CAG | chr6 | 160664644 | 160664663 | 160664660 | + |
| SEQ ID NO 35732 | CCTCCCTCAAGCTTTCCAAC | AGG | chr6 | 160664645 | 160664664 | 160664661 | + |
| SEQ ID NO 35733 | CCCTCAAGCTTTCCAACAGG | CAG | chr6 | 160664648 | 160664667 | 160664664 | + |
| SEQ ID NO 35734 | TCCAACAGGCAGTGCTGTAC | GAG | chr6 | 160664659 | 160664678 | 160664675 | + |
| SEQ ID NO 35735 | CCAACAGGCAGTGCTGTACG | AGG | chr6 | 160664660 | 160664679 | 160664676 | + |
| SEQ ID NO 35736 | AACAGGCAGTGCTGTACGAG | GAG | chr6 | 160664662 | 160664681 | 160664678 | + |
| SEQ ID NO 35737 | ACAGGCAGTGCTGTACGAGG | AGG | chr6 | 160664663 | 160664682 | 160664679 | + |
| SEQ ID NO 35738 | CAGGCAGTGCTGTACGAGGA | GGG | chr6 | 160664664 | 160664683 | 160664680 | + |
| SEQ ID NO 35739 | AGGCAGTGCTGTACGAGGAG | GGG | chr6 | 160664665 | 160664684 | 160664681 | + |
| SEQ ID NO 35740 | GGCAGTGCTGTACGAGGAGG | GGG | chr6 | 160664666 | 160664685 | 160664682 | + |
| SEQ ID NO 35741 | TGCTGTACGAGGAGGGGGCT | GAG | chr6 | 160664671 | 160664690 | 160664687 | + |
| SEQ ID NO 35742 | GCTGTACGAGGAGGGGCTG | AGG | chr6 | 160664672 | 160664691 | 160664688 | + |
| SEQ ID NO 35743 | GAGGGGGCTGAGGCCTTCCC | GAG | chr6 | 160664682 | 160664701 | 160664698 | + |
| SEQ ID NO 35744 | AGGGGGCTGAGGCCTTCCCG | AGG | chr6 | 160664683 | 160664702 | 160664699 | + |
| SEQ ID NO 35745 | CCCGAGGTTGTGTCGCTACC | CAG | chr6 | 160664699 | 160664718 | 160664715 | + |
| SEQ ID NO 35746 | CCGAGGTTGTGTCGCTACCC | AGG | chr6 | 160664700 | 160664719 | 160664716 | + |
| SEQ ID NO 35747 | CGAGGTTGTGTCGCTACCCA | GGG | chr6 | 160664701 | 160664720 | 160664717 | + |
| SEQ ID NO 35748 | GAGGTTGTGTCGCTACCCAG | GGG | chr6 | 160664702 | 160664721 | 160664718 | + |
| SEQ ID NO 35749 | TGTGTCGCTACCCAGGGGTG | CAG | chr6 | 160664707 | 160664726 | 160664723 | + |
| SEQ ID NO 35750 | CTACCCAGGGGTGCAGCTGA | TAG | chr6 | 160664714 | 160664733 | 160664730 | + |
| SEQ ID NO 35751 | GCTGATAGACACAACCCTTT | CAG | chr6 | 160664729 | 160664748 | 160664745 | + |
| SEQ ID NO 35752 | CTGATAGACACAACCCTTTC | AGG | chr6 | 160664730 | 160664749 | 160664746 | + |

Figure 55 (Cont'd)

| | | | | | | | |
|---|---|---|---|---|---|---|---|
| SEQ ID NO 35753 | GACACAACCCTTTCAGGTCT | TAG | chr6 | 160664736 | 160664755 | 160664752 | + |
| SEQ ID NO 35754 | CCTTTCAGGTCTTAGTTTAC | GAG | chr6 | 160664744 | 160664763 | 160664760 | + |
| SEQ ID NO 35755 | TCAGGTCTTAGTTTACGAGC | AAG | chr6 | 160664748 | 160664767 | 160664764 | + |
| SEQ ID NO 35756 | GTCTTAGTTTACGAGCAAGC | TAG | chr6 | 160664752 | 160664771 | 160664768 | + |
| SEQ ID NO 35757 | TCTTAGTTTACGAGCAAGCT | AGG | chr6 | 160664753 | 160664772 | 160664769 | + |
| SEQ ID NO 35758 | CTGTGCCGAAATGACAACAT | AAG | chr6 | 160664810 | 160664829 | 160664826 | + |
| SEQ ID NO 35759 | CTTCAAAATTTATTTATTCC | TAG | chr6 | 160664850 | 160664869 | 160664866 | + |
| SEQ ID NO 35760 | GTAATTATAAATTATGTTAT | AAG | chr6 | 160664891 | 160664910 | 160664907 | + |
| SEQ ID NO 35761 | TTATAAGATATCAATCCTTC | CAG | chr6 | 160664907 | 160664926 | 160664923 | + |
| SEQ ID NO 35762 | TATAAGATATCAATCCTTCC | AGG | chr6 | 160664908 | 160664927 | 160664924 | + |
| SEQ ID NO 35763 | TAAGATATCAATCCTTCCAG | GAG | chr6 | 160664910 | 160664929 | 160664926 | + |
| SEQ ID NO 35764 | AAGATATCAATCCTTCCAGG | AGG | chr6 | 160664911 | 160664930 | 160664927 | + |
| SEQ ID NO 35765 | AGATATCAATCCTTCCAGGA | GGG | chr6 | 160664912 | 160664931 | 160664928 | + |
| SEQ ID NO 35766 | GATATCAATCCTTCCAGGAG | GGG | chr6 | 160664913 | 160664932 | 160664929 | + |
| SEQ ID NO 35767 | ATATCAATCCTTCCAGGAGG | GGG | chr6 | 160664914 | 160664933 | 160664930 | + |
| SEQ ID NO 35768 | TCAATCCTTCCAGGAGGGGG | TGG | chr6 | 160664917 | 160664936 | 160664933 | + |
| SEQ ID NO 35769 | ATCCTTCCAGGAGGGGTGG | TGG | chr6 | 160664920 | 160664939 | 160664936 | + |
| SEQ ID NO 35770 | GTGGCTCATGCCTATAATCC | CAG | chr6 | 160664939 | 160664958 | 160664955 | + |
| SEQ ID NO 35771 | TGCCTATAATCCCAGCATTT | TGG | chr6 | 160664947 | 160664966 | 160664963 | + |
| SEQ ID NO 35772 | GCCTATAATCCCAGCATTTT | GGG | chr6 | 160664948 | 160664967 | 160664964 | + |
| SEQ ID NO 35773 | CTATAATCCCAGCATTTTGG | GAG | chr6 | 160664950 | 160664969 | 160664966 | + |
| SEQ ID NO 35774 | TATAATCCCAGCATTTTGGG | AGG | chr6 | 160664951 | 160664970 | 160664967 | + |
| SEQ ID NO 35775 | CCCAGCATTTTGGGAGGCCA | CGG | chr6 | 160664957 | 160664976 | 160664973 | + |
| SEQ ID NO 35776 | AGCATTTTGGGAGGCCACGG | CAG | chr6 | 160664960 | 160664979 | 160664976 | + |
| SEQ ID NO 35777 | TTTTGGGAGGCCACGGCAGA | TGG | chr6 | 160664964 | 160664983 | 160664980 | + |
| SEQ ID NO 35778 | CCACGGCAGATGGATCACCT | GAG | chr6 | 160664974 | 160664993 | 160664990 | + |
| SEQ ID NO 35779 | CACGGCAGATGGATCACCTG | AGG | chr6 | 160664975 | 160664994 | 160664991 | + |
| SEQ ID NO 35780 | GCAGATGGATCACCTGAGGC | CAG | chr6 | 160664979 | 160664998 | 160664995 | + |
| SEQ ID NO 35781 | CAGATGGATCACCTGAGGCC | AGG | chr6 | 160664980 | 160664999 | 160664996 | + |
| SEQ ID NO 35782 | GATGGATCACCTGAGGCCAG | GAG | chr6 | 160664982 | 160665001 | 160664998 | + |
| SEQ ID NO 35783 | TCACCTGAGGCCAGGAGTTT | GAG | chr6 | 160664988 | 160665007 | 160665004 | + |
| SEQ ID NO 35784 | TGAGGCCAGGAGTTTGAGAC | AAG | chr6 | 160664993 | 160665012 | 160665009 | + |
| SEQ ID NO 35785 | CCAGGAGTTTGAGACAAGCC | TGG | chr6 | 160664998 | 160665017 | 160665014 | + |
| SEQ ID NO 35786 | CAGGAGTTTGAGACAAGCCT | GGG | chr6 | 160664999 | 160665018 | 160665015 | + |
| SEQ ID NO 35787 | TCTACAAAAAATACAAAAAT | TAG | chr6 | 160665042 | 160665061 | 160665058 | + |
| SEQ ID NO 35788 | CAAAAAATACAAAAATTAGC | TGG | chr6 | 160665046 | 160665065 | 160665062 | + |
| SEQ ID NO 35789 | AAAAAATACAAAAATTAGCT | GGG | chr6 | 160665047 | 160665066 | 160665063 | + |
| SEQ ID NO 35790 | ATACAAAAATTAGCTGGGTG | TGG | chr6 | 160665052 | 160665071 | 160665068 | + |
| SEQ ID NO 35791 | ACAAAAATTAGCTGGGTGTG | GAG | chr6 | 160665054 | 160665073 | 160665070 | + |
| SEQ ID NO 35792 | CAAAAATTAGCTGGGTGTGG | AGG | chr6 | 160665055 | 160665074 | 160665071 | + |
| SEQ ID NO 35793 | CTGGGTGTGGAGGCACATGC | CAG | chr6 | 160665065 | 160665084 | 160665081 | + |
| SEQ ID NO 35794 | GAGGCACATGCCAGTCATCC | CAG | chr6 | 160665074 | 160665093 | 160665090 | + |
| SEQ ID NO 35795 | TGCCAGTCATCCCAGCTACT | AAG | chr6 | 160665082 | 160665101 | 160665098 | + |
| SEQ ID NO 35796 | CAGTCATCCCAGCTACTAAG | TAG | chr6 | 160665085 | 160665104 | 160665101 | + |
| SEQ ID NO 35797 | AGTCATCCCAGCTACTAAGT | AGG | chr6 | 160665086 | 160665105 | 160665102 | + |
| SEQ ID NO 35798 | TCCCAGCTACTAAGTAGGCT | GAG | chr6 | 160665091 | 160665110 | 160665107 | + |
| SEQ ID NO 35799 | CCCAGCTACTAAGTAGGCTG | AGG | chr6 | 160665092 | 160665111 | 160665108 | + |

Figure 55 (Cont'd)

| SEQ ID NO 35800 | TACTAAGTAGGCTGAGGCAC | TAG | chr6 | 160665098 | 160665117 | 160665114 | + |
| SEQ ID NO 35801 | GCACTAGAATTGCTTGAACA | CAG | chr6 | 160665114 | 160665133 | 160665130 | + |
| SEQ ID NO 35802 | CACTAGAATTGCTTGAACAC | AGG | chr6 | 160665115 | 160665134 | 160665131 | + |
| SEQ ID NO 35803 | CTAGAATTGCTTGAACACAG | GAG | chr6 | 160665117 | 160665136 | 160665133 | + |
| SEQ ID NO 35804 | AATTGCTTGAACACAGGAGA | TGG | chr6 | 160665121 | 160665140 | 160665137 | + |
| SEQ ID NO 35805 | TTGCTTGAACACAGGAGATG | GAG | chr6 | 160665123 | 160665142 | 160665139 | + |
| SEQ ID NO 35806 | TGCTTGAACACAGGAGATGG | AGG | chr6 | 160665124 | 160665143 | 160665140 | + |
| SEQ ID NO 35807 | AACACAGGAGATGGAGGTTG | CAG | chr6 | 160665130 | 160665149 | 160665146 | + |
| SEQ ID NO 35808 | CAGGAGATGGAGGTTGCAGT | GAG | chr6 | 160665134 | 160665153 | 160665150 | + |
| SEQ ID NO 35809 | GATGGAGGTTGCAGTGAGCC | AAG | chr6 | 160665139 | 160665158 | 160665155 | + |
| SEQ ID NO 35810 | AAGAATGTGCCACTGCACTC | CAG | chr6 | 160665159 | 160665178 | 160665175 | + |
| SEQ ID NO 35811 | TGTGCCACTGCACTCCAGCC | TGG | chr6 | 160665164 | 160665183 | 160665180 | + |
| SEQ ID NO 35812 | GTGCCACTGCACTCCAGCCT | GGG | chr6 | 160665165 | 160665184 | 160665181 | + |
| SEQ ID NO 35813 | CTGCACTCCAGCCTGGGTGA | CAG | chr6 | 160665171 | 160665190 | 160665187 | + |
| SEQ ID NO 35814 | GCACTCCAGCCTGGGTGACA | GAG | chr6 | 160665173 | 160665192 | 160665189 | + |
| SEQ ID NO 35815 | TCCAGCCTGGGTGACAGAGC | AAG | chr6 | 160665177 | 160665196 | 160665193 | + |
| SEQ ID NO 35816 | GTGACAGAGCAAGAATGTCT | CAG | chr6 | 160665187 | 160665206 | 160665203 | + |
| SEQ ID NO 35817 | TGACAGAGCAAGAATGTCTC | AGG | chr6 | 160665188 | 160665207 | 160665204 | + |
| SEQ ID NO 35818 | AGAGCAAGAATGTCTCAGGA | AAG | chr6 | 160665192 | 160665211 | 160665208 | + |
| SEQ ID NO 35819 | AATATCAATCCTTCCTATTC | TAG | chr6 | 160665250 | 160665269 | 160665266 | + |
| SEQ ID NO 35820 | ATCAATCCTTCCTATTCTAG | TAG | chr6 | 160665253 | 160665272 | 160665269 | + |
| SEQ ID NO 35821 | CCTTCCTATTCTAGTAGTTG | TGG | chr6 | 160665259 | 160665278 | 160665275 | + |
| SEQ ID NO 35822 | ATATTTTAAAAATAAAACA | TAG | chr6 | 160665299 | 160665318 | 160665315 | + |
| SEQ ID NO 35823 | TATTTTTAAAAATAAAACAT | AGG | chr6 | 160665300 | 160665319 | 160665316 | + |
| SEQ ID NO 35824 | ATTTTTAAAAATAAAACATA | GGG | chr6 | 160665301 | 160665320 | 160665317 | + |
| SEQ ID NO 35825 | TAAAAATAAAACATAGGGTC | GAG | chr6 | 160665306 | 160665325 | 160665322 | + |
| SEQ ID NO 35826 | ATAAAACATAGGGTCGAGTG | CGG | chr6 | 160665311 | 160665330 | 160665327 | + |
| SEQ ID NO 35827 | AAACATAGGGTCGAGTGCGG | TGG | chr6 | 160665314 | 160665333 | 160665330 | + |
| SEQ ID NO 35828 | GTGGCTCAACTCTGTAATCC | CAG | chr6 | 160665333 | 160665352 | 160665349 | + |
| SEQ ID NO 35829 | ACTCTGTAATCCCAGCACTT | TGG | chr6 | 160665341 | 160665360 | 160665357 | + |
| SEQ ID NO 35830 | CTCTGTAATCCCAGCACTTT | GGG | chr6 | 160665342 | 160665361 | 160665358 | + |
| SEQ ID NO 35831 | CTGTAATCCCAGCACTTTGG | GAG | chr6 | 160665344 | 160665363 | 160665360 | + |
| SEQ ID NO 35832 | TGTAATCCCAGCACTTTGGG | AGG | chr6 | 160665345 | 160665364 | 160665361 | + |
| SEQ ID NO 35833 | TCCCAGCACTTTGGGAGGCC | AAG | chr6 | 160665350 | 160665369 | 160665366 | + |
| SEQ ID NO 35834 | AGCACTTTGGGAGGCCAAGA | CAG | chr6 | 160665354 | 160665373 | 160665370 | + |
| SEQ ID NO 35835 | GCACTTTGGGAGGCCAAGAC | AGG | chr6 | 160665355 | 160665374 | 160665371 | + |
| SEQ ID NO 35836 | CTTTGGGAGGCCAAGACAGG | TGG | chr6 | 160665358 | 160665377 | 160665374 | + |
| SEQ ID NO 35837 | GGCCAAGACAGGTGGATCAC | AAG | chr6 | 160665366 | 160665385 | 160665382 | + |
| SEQ ID NO 35838 | GCCAAGACAGGTGGATCACA | AGG | chr6 | 160665367 | 160665386 | 160665383 | + |
| SEQ ID NO 35839 | AGACAGGTGGATCACAAGGT | CAG | chr6 | 160665371 | 160665390 | 160665387 | + |
| SEQ ID NO 35840 | GACAGGTGGATCACAAGGTC | AGG | chr6 | 160665372 | 160665391 | 160665388 | + |
| SEQ ID NO 35841 | CAGGTGGATCACAAGGTCAG | GAG | chr6 | 160665374 | 160665393 | 160665390 | + |
| SEQ ID NO 35842 | GATCACAAGGTCAGGAGTTT | GAG | chr6 | 160665380 | 160665399 | 160665396 | + |
| SEQ ID NO 35843 | CAAGGTCAGGAGTTTGAGAC | CAG | chr6 | 160665385 | 160665404 | 160665401 | + |
| SEQ ID NO 35844 | GTCAGGAGTTTGAGACCAGC | CAG | chr6 | 160665389 | 160665408 | 160665405 | + |
| SEQ ID NO 35845 | TCAGGAGTTTGAGACCAGCC | AGG | chr6 | 160665390 | 160665409 | 160665406 | + |
| SEQ ID NO 35846 | TGAGACCAGCCAGGCCAATG | TGG | chr6 | 160665399 | 160665418 | 160665415 | + |

Figure 55 (Cont'd)

| SEQ ID NO | Sequence | Codon | Chr | Start | End | Pos | Strand |
|---|---|---|---|---|---|---|---|
| SEQ ID NO 35847 | TCTACTAAAAATACAAAAAT | TAG | chr6 | 160665434 | 160665453 | 160665450 | + |
| SEQ ID NO 35848 | CTAAAAATACAAAAATTAGC | CAG | chr6 | 160665438 | 160665457 | 160665454 | + |
| SEQ ID NO 35849 | TAAAAATACAAAAATTAGCC | AGG | chr6 | 160665439 | 160665458 | 160665455 | + |
| SEQ ID NO 35850 | ATACAAAATTAGCCAGGCG | TGG | chr6 | 160665444 | 160665463 | 160665460 | + |
| SEQ ID NO 35851 | CAAAAATTAGCCAGGCGTGG | TGG | chr6 | 160665447 | 160665466 | 160665463 | + |
| SEQ ID NO 35852 | AAATTAGCCAGGCGTGGTGG | TGG | chr6 | 160665450 | 160665469 | 160665466 | + |
| SEQ ID NO 35853 | AATTAGCCAGGCGTGGTGGT | GGG | chr6 | 160665451 | 160665470 | 160665467 | + |
| SEQ ID NO 35854 | GTGGTGGGCACCTGTAATCC | CAG | chr6 | 160665466 | 160665485 | 160665482 | + |
| SEQ ID NO 35855 | GCACCTGTAATCCCAGCTAC | TAG | chr6 | 160665473 | 160665492 | 160665489 | + |
| SEQ ID NO 35856 | CACCTGTAATCCCAGCTACT | AGG | chr6 | 160665474 | 160665493 | 160665490 | + |
| SEQ ID NO 35857 | ACCTGTAATCCCAGCTACTA | GGG | chr6 | 160665475 | 160665494 | 160665491 | + |
| SEQ ID NO 35858 | CTGTAATCCCAGCTACTAGG | GAG | chr6 | 160665477 | 160665496 | 160665493 | + |
| SEQ ID NO 35859 | TGTAATCCCAGCTACTAGGG | AGG | chr6 | 160665478 | 160665497 | 160665494 | + |
| SEQ ID NO 35860 | ATCCCAGCTACTAGGGAGGC | TGG | chr6 | 160665482 | 160665501 | 160665498 | + |
| SEQ ID NO 35861 | CCCAGCTACTAGGGAGGCTG | GAG | chr6 | 160665484 | 160665503 | 160665500 | + |
| SEQ ID NO 35862 | CTGGAGTATTCACTTGAACC | CAG | chr6 | 160665501 | 160665520 | 160665517 | + |
| SEQ ID NO 35863 | TGGAGTATTCACTTGAACCC | AGG | chr6 | 160665502 | 160665521 | 160665518 | + |
| SEQ ID NO 35864 | GAGTATTCACTTGAACCCAG | GAG | chr6 | 160665504 | 160665523 | 160665520 | + |
| SEQ ID NO 35865 | AGTATTCACTTGAACCCAGG | AGG | chr6 | 160665505 | 160665524 | 160665521 | + |
| SEQ ID NO 35866 | ATTCACTTGAACCCAGGAGG | TGG | chr6 | 160665508 | 160665527 | 160665524 | + |
| SEQ ID NO 35867 | CACTTGAACCCAGGAGGTGG | AAG | chr6 | 160665511 | 160665530 | 160665527 | + |
| SEQ ID NO 35868 | AACCCAGGAGGTGGAAGTTG | CAG | chr6 | 160665517 | 160665536 | 160665533 | + |
| SEQ ID NO 35869 | CAGGAGGTGGAAGTTGCAGT | GAG | chr6 | 160665521 | 160665540 | 160665537 | + |
| SEQ ID NO 35870 | GCAGTGAGCCAAAATCACGT | CAG | chr6 | 160665536 | 160665555 | 160665552 | + |
| SEQ ID NO 35871 | TCACGTCAGTGCACTTCAAC | CGG | chr6 | 160665550 | 160665569 | 160665566 | + |
| SEQ ID NO 35872 | CACGTCAGTGCACTTCAACC | GGG | chr6 | 160665551 | 160665570 | 160665567 | + |
| SEQ ID NO 35873 | ACGTCAGTGCACTTCAACCG | GGG | chr6 | 160665552 | 160665571 | 160665568 | + |
| SEQ ID NO 35874 | CAGTGCACTTCAACCGGGGT | GAG | chr6 | 160665556 | 160665575 | 160665572 | + |
| SEQ ID NO 35875 | GTGCACTTCAACCGGGGTGA | GAG | chr6 | 160665558 | 160665577 | 160665574 | + |
| SEQ ID NO 35876 | AATAAAATAAAATAAAATAA | AAG | chr6 | 160665610 | 160665629 | 160665626 | + |
| SEQ ID NO 35877 | AATAAAATAAAATAAAAGCA | TAG | chr6 | 160665615 | 160665634 | 160665631 | + |
| SEQ ID NO 35878 | TCTTTCCGCAAATGAATTCA | TGG | chr6 | 160665644 | 160665663 | 160665660 | + |
| SEQ ID NO 35879 | CTTACATTTTCGTTCTCATG | AAG | chr6 | 160665673 | 160665692 | 160665689 | + |
| SEQ ID NO 35880 | ATTTTCGTTCTCATGAAGTA | AAG | chr6 | 160665678 | 160665697 | 160665694 | + |
| SEQ ID NO 35881 | TCGTTCTCATGAAGTAAAGC | AAG | chr6 | 160665682 | 160665701 | 160665698 | + |
| SEQ ID NO 35882 | GTTCTCATGAAGTAAAGCAA | GAG | chr6 | 160665684 | 160665703 | 160665700 | + |
| SEQ ID NO 35883 | CTCATGAAGTAAAGCAAGAG | TGG | chr6 | 160665687 | 160665706 | 160665703 | + |
| SEQ ID NO 35884 | ATGAAGTAAAGCAAGAGTGG | TAG | chr6 | 160665690 | 160665709 | 160665706 | + |
| SEQ ID NO 35885 | AAAGCAAGAGTGGTAGAATT | AAG | chr6 | 160665697 | 160665716 | 160665713 | + |
| SEQ ID NO 35886 | GCAAGAGTGGTAGAATTAAG | TGG | chr6 | 160665700 | 160665719 | 160665716 | + |
| SEQ ID NO 35887 | GAGTGGTAGAATTAAGTGGA | AAG | chr6 | 160665704 | 160665723 | 160665720 | + |
| SEQ ID NO 35888 | GTGGTAGAATTAAGTGGAAA | GAG | chr6 | 160665706 | 160665725 | 160665722 | + |
| SEQ ID NO 35889 | AAGTGGAAAGAGTCTATCTC | TAG | chr6 | 160665717 | 160665736 | 160665733 | + |
| SEQ ID NO 35890 | GAAAGAGTCTATCTCTAGTG | TAG | chr6 | 160665722 | 160665741 | 160665738 | + |
| SEQ ID NO 35891 | TATCTCTAGTGTAGTCACGT | CAG | chr6 | 160665731 | 160665750 | 160665747 | + |
| SEQ ID NO 35892 | CTCTAGTGTAGTCACGTCAG | TGG | chr6 | 160665734 | 160665753 | 160665750 | + |
| SEQ ID NO 35893 | GTCACGTCAGTGGTTGTGTC | AAG | chr6 | 160665744 | 160665763 | 160665760 | + |

Figure 55 (Cont'd)

| | | | | | | | |
|---|---|---|---|---|---|---|---|
| SEQ ID NO 35894 | CGTCAGTGGTTGTGTCAAGA | TGG | chr6 | 160665748 | 160665767 | 160665764 | + |
| SEQ ID NO 35895 | AGTGGTTGTGTCAAGATGGT | TAG | chr6 | 160665752 | 160665771 | 160665768 | + |
| SEQ ID NO 35896 | GTGGTTGTGTCAAGATGGTT | AGG | chr6 | 160665753 | 160665772 | 160665769 | + |
| SEQ ID NO 35897 | GGTTGTGTCAAGATGGTTAG | GAG | chr6 | 160665755 | 160665774 | 160665771 | + |
| SEQ ID NO 35898 | GTTGTGTCAAGATGGTTAGG | AGG | chr6 | 160665756 | 160665775 | 160665772 | + |
| SEQ ID NO 35899 | GAGGCTCCTCCCGTTTAAAA | CAG | chr6 | 160665775 | 160665794 | 160665791 | + |
| SEQ ID NO 35900 | TCCCGTTTAAAACAGTATCC | AAG | chr6 | 160665783 | 160665802 | 160665799 | + |
| SEQ ID NO 35901 | TTAAAACAGTATCCAAGCCC | CAG | chr6 | 160665789 | 160665808 | 160665805 | + |
| SEQ ID NO 35902 | AGCCCAGTTGTAAATCAAT | TGG | chr6 | 160665804 | 160665823 | 160665820 | + |
| SEQ ID NO 35903 | GCCCCAGTTGTAAATCAATT | GGG | chr6 | 160665805 | 160665824 | 160665821 | + |
| SEQ ID NO 35904 | CCCCAGTTGTAAATCAATTG | GGG | chr6 | 160665806 | 160665825 | 160665822 | + |
| SEQ ID NO 35905 | CCAGTTGTAAATCAATTGGG | GAG | chr6 | 160665808 | 160665827 | 160665824 | + |
| SEQ ID NO 35906 | GACACGCCAACTCTGATCAT | CAG | chr6 | 160665830 | 160665849 | 160665846 | + |
| SEQ ID NO 35907 | TCTGATCATCAGCAATATCT | GAG | chr6 | 160665841 | 160665860 | 160665857 | + |
| SEQ ID NO 35908 | CATCAGCAATATCTGAGCTC | CAG | chr6 | 160665847 | 160665866 | 160665863 | + |
| SEQ ID NO 35909 | CAATATCTGAGCTCCAGTCT | CAG | chr6 | 160665853 | 160665872 | 160665869 | + |
| SEQ ID NO 35910 | CCAGTCTCAGATATTGTGTG | CAG | chr6 | 160665866 | 160665885 | 160665882 | + |
| SEQ ID NO 35911 | TCTCAGATATTGTGTGCAGT | TAG | chr6 | 160665870 | 160665889 | 160665886 | + |
| SEQ ID NO 35912 | CCCTCTACCTCCTTCCCTAC | CAG | chr6 | 160665906 | 160665925 | 160665922 | + |
| SEQ ID NO 35913 | TACCAGAAAAATCACCACTT | TAG | chr6 | 160665923 | 160665942 | 160665939 | + |
| SEQ ID NO 35914 | AAAATCACCACTTTAGTCCC | TGG | chr6 | 160665930 | 160665949 | 160665946 | + |
| SEQ ID NO 35915 | CCACTTTAGTCCCTGGCCAC | CGG | chr6 | 160665937 | 160665956 | 160665953 | + |
| SEQ ID NO 35916 | CACTTTAGTCCCTGGCCACC | GGG | chr6 | 160665938 | 160665957 | 160665954 | + |
| SEQ ID NO 35917 | CCCTGGCCACCGGGACACCC | CAG | chr6 | 160665947 | 160665966 | 160665963 | + |
| SEQ ID NO 35918 | CCTGGCCACCGGGACACCCC | AGG | chr6 | 160665948 | 160665967 | 160665964 | + |
| SEQ ID NO 35919 | TGGCCACCGGGACACCCCAG | GAG | chr6 | 160665950 | 160665969 | 160665966 | + |
| SEQ ID NO 35920 | GGCCACCGGGACACCCCAGG | AGG | chr6 | 160665951 | 160665970 | 160665967 | + |
| SEQ ID NO 35921 | GCCACCGGGACACCCCAGGA | GGG | chr6 | 160665952 | 160665971 | 160665968 | + |
| SEQ ID NO 35922 | CCGGGACACCCCAGGAGGGT | GAG | chr6 | 160665956 | 160665975 | 160665972 | + |
| SEQ ID NO 35923 | GGACACCCCAGGAGGGTGAG | TGG | chr6 | 160665959 | 160665978 | 160665975 | + |
| SEQ ID NO 35924 | CCCAGGAGGGTGAGTGGTCT | GAG | chr6 | 160665965 | 160665984 | 160665981 | + |
| SEQ ID NO 35925 | CCAGGAGGGTGAGTGGTCTG | AGG | chr6 | 160665966 | 160665985 | 160665982 | + |
| SEQ ID NO 35926 | GGAGGGTGAGTGGTCTGAGG | TAG | chr6 | 160665969 | 160665988 | 160665985 | + |
| SEQ ID NO 35927 | TGAGTGGTCTGAGGTAGTTA | TGG | chr6 | 160665975 | 160665994 | 160665991 | + |
| SEQ ID NO 35928 | TGAGGTAGTTATGGCACTTA | TGG | chr6 | 160665984 | 160666003 | 160666000 | + |
| SEQ ID NO 35929 | TGGCTCCCTGCTGCTGATC | TGG | chr6 | 160666004 | 160666023 | 160666020 | + |
| SEQ ID NO 35930 | TTGCTGCTGATCTGGAACTC | AAG | chr6 | 160666012 | 160666031 | 160666028 | + |
| SEQ ID NO 35931 | TGATCTGGAACTCAAGCCCC | AAG | chr6 | 160666019 | 160666038 | 160666035 | + |
| SEQ ID NO 35932 | TCTGGAACTCAAGCCCCAAG | AAG | chr6 | 160666022 | 160666041 | 160666038 | + |
| SEQ ID NO 35933 | CAAGCCCCAAGAAGTCCCT | TGG | chr6 | 160666031 | 160666050 | 160666047 | + |
| SEQ ID NO 35934 | GGATGATCTGAATATACATT | TGG | chr6 | 160666052 | 160666071 | 160666068 | + |
| SEQ ID NO 35935 | GATGATCTGAATATACATTT | GGG | chr6 | 160666053 | 160666072 | 160666069 | + |
| SEQ ID NO 35936 | ATCTGAATATACATTTGGGA | CAG | chr6 | 160666057 | 160666076 | 160666073 | + |
| SEQ ID NO 35937 | ATATACATTTGGGACAGATC | TAG | chr6 | 160666063 | 160666082 | 160666079 | + |
| SEQ ID NO 35938 | TATACATTTGGGACAGATCT | AGG | chr6 | 160666064 | 160666083 | 160666080 | + |
| SEQ ID NO 35939 | ATACATTTGGGACAGATCTA | GGG | chr6 | 160666065 | 160666084 | 160666081 | + |
| SEQ ID NO 35940 | ACATTTGGGACAGATCTAGG | GAG | chr6 | 160666067 | 160666086 | 160666083 | + |

Figure 55 (Cont'd)

| SEQ ID | Sequence | Codon | Chr | Start | End | Pos | Strand |
|---|---|---|---|---|---|---|---|
| SEQ ID NO 35941 | GACAGATCTAGGGAGTTTCT | GAG | chr6 | 160666075 | 160666094 | 160666091 | + |
| SEQ ID NO 35942 | GGGAGTTTCTGAGCAACACT | TAG | chr6 | 160666085 | 160666104 | 160666101 | + |
| SEQ ID NO 35943 | TTTCTGAGCAACACTTAGAC | TGG | chr6 | 160666090 | 160666109 | 160666106 | + |
| SEQ ID NO 35944 | TTCTGAGCAACACTTAGACT | GGG | chr6 | 160666091 | 160666110 | 160666107 | + |
| SEQ ID NO 35945 | TCTGAGCAACACTTAGACTG | GGG | chr6 | 160666092 | 160666111 | 160666108 | + |
| SEQ ID NO 35946 | CCTACTTGAATTCGCTACTT | TGG | chr6 | 160666132 | 160666151 | 160666148 | + |
| SEQ ID NO 35947 | CTACTTGAATTCGCTACTTT | GGG | chr6 | 160666133 | 160666152 | 160666149 | + |
| SEQ ID NO 35948 | AATTCGCTACTTTGGGACTC | AAG | chr6 | 160666140 | 160666159 | 160666156 | + |
| SEQ ID NO 35949 | CTACTTTGGGACTCAAGTCT | AAG | chr6 | 160666146 | 160666165 | 160666162 | + |
| SEQ ID NO 35950 | TACTTTGGGACTCAAGTCTA | AGG | chr6 | 160666147 | 160666166 | 160666163 | + |
| SEQ ID NO 35951 | ACTTTGGGACTCAAGTCTAA | GGG | chr6 | 160666148 | 160666167 | 160666164 | + |
| SEQ ID NO 35952 | GGACTCAAGTCTAAGGGACT | GAG | chr6 | 160666154 | 160666173 | 160666170 | + |
| SEQ ID NO 35953 | AAGTCTAAGGGACTGAGACT | GAG | chr6 | 160666160 | 160666179 | 160666176 | + |
| SEQ ID NO 35954 | CTAAGGGACTGAGACTGAGA | CAG | chr6 | 160666164 | 160666183 | 160666180 | + |
| SEQ ID NO 35955 | TAAGGGACTGAGACTGAGAC | AGG | chr6 | 160666165 | 160666184 | 160666181 | + |
| SEQ ID NO 35956 | AGGGACTGAGACTGAGACAG | GAG | chr6 | 160666167 | 160666186 | 160666183 | + |
| SEQ ID NO 35957 | GGACTGAGACTGAGACAGGA | GAG | chr6 | 160666169 | 160666188 | 160666185 | + |
| SEQ ID NO 35958 | AGACTGAGACAGGAGAGCAC | AAG | chr6 | 160666175 | 160666194 | 160666191 | + |
| SEQ ID NO 35959 | GGAGAGCACAAGACTAACTT | TGG | chr6 | 160666186 | 160666205 | 160666202 | + |
| SEQ ID NO 35960 | CTTGCAACTGTCAATGCCTC | CAG | chr6 | 160666228 | 160666247 | 160666244 | + |
| SEQ ID NO 35961 | AATGCCTCCAGCCAAATGCC | CAG | chr6 | 160666240 | 160666259 | 160666256 | + |
| SEQ ID NO 35962 | CTCCAGCCAAATGCCCAGCA | CAG | chr6 | 160666245 | 160666264 | 160666261 | + |
| SEQ ID NO 35963 | CCAGCCAAATGCCCAGCACA | GAG | chr6 | 160666247 | 160666266 | 160666263 | + |
| SEQ ID NO 35964 | CAAATGCCCAGCACAGAGCT | CAG | chr6 | 160666252 | 160666271 | 160666268 | + |
| SEQ ID NO 35965 | ATGCCCAGCACAGAGCTCAG | TGG | chr6 | 160666255 | 160666274 | 160666271 | + |
| SEQ ID NO 35966 | GTGGATTTGACTCTTCCATT | CAG | chr6 | 160666274 | 160666293 | 160666290 | + |
| SEQ ID NO 35967 | CTCTTCCATTCAGAAACTCA | TAG | chr6 | 160666284 | 160666303 | 160666300 | + |
| SEQ ID NO 35968 | GCACACTTCATTCTCAATCA | CAG | chr6 | 160666312 | 160666331 | 160666328 | + |
| SEQ ID NO 35969 | CACACTTCATTCTCAATCAC | AGG | chr6 | 160666313 | 160666332 | 160666329 | + |
| SEQ ID NO 35970 | ACACTTCATTCTCAATCACA | GGG | chr6 | 160666314 | 160666333 | 160666330 | + |
| SEQ ID NO 35971 | ACTTCATTCTCAATCACAGG | GAG | chr6 | 160666316 | 160666335 | 160666332 | + |
| SEQ ID NO 35972 | CATTCTCAATCACAGGGAGC | TGG | chr6 | 160666320 | 160666339 | 160666336 | + |
| SEQ ID NO 35973 | ATTCTCAATCACAGGGAGCT | GGG | chr6 | 160666321 | 160666340 | 160666337 | + |
| SEQ ID NO 35974 | ACAGGGAGCTGGGCTTCCTT | GAG | chr6 | 160666331 | 160666350 | 160666347 | + |
| SEQ ID NO 35975 | GGAGCTGGGCTTCCTTGAGA | AAG | chr6 | 160666335 | 160666354 | 160666351 | + |
| SEQ ID NO 35976 | CTGGGCTTCCTTGAGAAAGC | CAG | chr6 | 160666339 | 160666358 | 160666355 | + |
| SEQ ID NO 35977 | CCTTGAGAAAGCCAGCCCCA | AAG | chr6 | 160666347 | 160666366 | 160666363 | + |
| SEQ ID NO 35978 | CTTGAGAAAGCCAGCCCCAA | AGG | chr6 | 160666348 | 160666367 | 160666364 | + |
| SEQ ID NO 35979 | CAAAGGTACCTGTGTTTAAA | AAG | chr6 | 160666365 | 160666384 | 160666381 | + |
| SEQ ID NO 35980 | ACCTGTGTTTAAAAGATGA | AAG | chr6 | 160666372 | 160666391 | 160666388 | + |
| SEQ ID NO 35981 | GTTTAAAAGATGAAAGAAA | TGG | chr6 | 160666378 | 160666397 | 160666394 | + |
| SEQ ID NO 35982 | TACGTCCACAACATGTTCAC | AAG | chr6 | 160666405 | 160666424 | 160666421 | + |
| SEQ ID NO 35983 | ACGTCCACAACATGTTCACA | AGG | chr6 | 160666406 | 160666425 | 160666422 | + |
| SEQ ID NO 35984 | ACATGTTCACAAGGAAACTC | CAG | chr6 | 160666415 | 160666434 | 160666431 | + |
| SEQ ID NO 35985 | TGTTCACAAGGAAACTCCAG | AAG | chr6 | 160666418 | 160666437 | 160666434 | + |
| SEQ ID NO 35986 | ACAAGGAAACTCCAGAAGAA | CAG | chr6 | 160666423 | 160666442 | 160666439 | + |
| SEQ ID NO 35987 | AAGGAAACTCCAGAAGAACA | GAG | chr6 | 160666425 | 160666444 | 160666441 | + |

Figure 55 (Cont'd)

| | | | | | | | |
|---|---|---|---|---|---|---|---|
| SEQ ID NO 35988 | GAAACTCCAGAAGAACAGAG | CAG | chr6 | 160666428 | 160666447 | 160666444 | + |
| SEQ ID NO 35989 | ACTCCAGAAGAACAGAGCAG | TGG | chr6 | 160666431 | 160666450 | 160666447 | + |
| SEQ ID NO 35990 | GAAGAACAGAGCAGTGGTGA | TGG | chr6 | 160666437 | 160666456 | 160666453 | + |
| SEQ ID NO 35991 | TGGACCTCCTGTCTGTCCGT | GAG | chr6 | 160666457 | 160666476 | 160666473 | + |
| SEQ ID NO 35992 | GGACCTCCTGTCTGTCCGTG | AGG | chr6 | 160666458 | 160666477 | 160666474 | + |
| SEQ ID NO 35993 | CCTGTCTGTCCGTGAGGCTG | TAG | chr6 | 160666464 | 160666483 | 160666480 | + |
| SEQ ID NO 35994 | TCCGTGAGGCTGTAGAACAC | AAG | chr6 | 160666472 | 160666491 | 160666488 | + |
| SEQ ID NO 35995 | CCGTGAGGCTGTAGAACACA | AGG | chr6 | 160666473 | 160666492 | 160666489 | + |
| SEQ ID NO 35996 | TGAGGCTGTAGAACACAAGG | CAG | chr6 | 160666476 | 160666495 | 160666492 | + |
| SEQ ID NO 35997 | AAGGCAGCTCCCAATGCTGC | CAG | chr6 | 160666492 | 160666511 | 160666508 | + |
| SEQ ID NO 35998 | CTGCCAGACTCTCTGAACCC | TGG | chr6 | 160666508 | 160666527 | 160666524 | + |
| SEQ ID NO 35999 | GCCAGACTCTCTGAACCCTG | GAG | chr6 | 160666510 | 160666529 | 160666526 | + |
| SEQ ID NO 36000 | CAGACTCTCTGAACCCTGGA | GAG | chr6 | 160666512 | 160666531 | 160666528 | + |
| SEQ ID NO 36001 | GGAGAGTGTAAACGTCATAT | AAG | chr6 | 160666529 | 160666548 | 160666545 | + |
| SEQ ID NO 36002 | AGAGTGTAAACGTCATATAA | GAG | chr6 | 160666531 | 160666550 | 160666547 | + |
| SEQ ID NO 36003 | GAGTCTATGTTCCAAAAACC | TGG | chr6 | 160666551 | 160666570 | 160666567 | + |
| SEQ ID NO 36004 | AAACCTGGATTTAACAATCT | GAG | chr6 | 160666566 | 160666585 | 160666582 | + |
| SEQ ID NO 36005 | TAACAATCTGAGCTTTGTCA | TGG | chr6 | 160666577 | 160666596 | 160666593 | + |
| SEQ ID NO 36006 | AGCTTTGTCATGGTGCTTTG | CGG | chr6 | 160666587 | 160666606 | 160666603 | + |
| SEQ ID NO 36007 | TTGTCATGGTGCTTTGCGGT | TGG | chr6 | 160666591 | 160666610 | 160666607 | + |
| SEQ ID NO 36008 | TCTTTGCTTTTAAAACCATA | AAG | chr6 | 160666634 | 160666653 | 160666650 | + |
| SEQ ID NO 36009 | TAAAGAATAATGTTTAAATG | TAG | chr6 | 160666652 | 160666671 | 160666668 | + |
| SEQ ID NO 36010 | AAGAATAATGTTTAAATGTA | GAG | chr6 | 160666654 | 160666673 | 160666670 | + |
| SEQ ID NO 36011 | AATGTTTAAATGTAGAGTCT | GAG | chr6 | 160666660 | 160666679 | 160666676 | + |
| SEQ ID NO 36012 | TGCTATTGTTTTTATATTTT | CAG | chr6 | 160666692 | 160666711 | 160666708 | + |
| SEQ ID NO 36013 | TTCACTCAACATTACATAAT | GAG | chr6 | 160666775 | 160666794 | 160666791 | + |
| SEQ ID NO 36014 | ATTACATAATGAGTTTTGTA | TAG | chr6 | 160666785 | 160666804 | 160666801 | + |
| SEQ ID NO 36015 | TCTTCATAACTAATATTTTA | AAG | chr6 | 160666816 | 160666835 | 160666832 | + |
| SEQ ID NO 36016 | CTTCATAACTAATATTTTAA | AGG | chr6 | 160666817 | 160666836 | 160666833 | + |
| SEQ ID NO 36017 | TCATAACTAATATTTTAAAG | GAG | chr6 | 160666819 | 160666838 | 160666835 | + |
| SEQ ID NO 36018 | ATAACTAATATTTTAAAGGA | GAG | chr6 | 160666821 | 160666840 | 160666837 | + |
| SEQ ID NO 36019 | AAGGAGAGCTACTGATTAAT | GAG | chr6 | 160666836 | 160666855 | 160666852 | + |
| SEQ ID NO 36020 | AGCTACTGATTAATGAGCAT | GAG | chr6 | 160666842 | 160666861 | 160666858 | + |
| SEQ ID NO 36021 | GCTACTGATTAATGAGCATG | AGG | chr6 | 160666843 | 160666862 | 160666859 | + |
| SEQ ID NO 36022 | AATGAGCATGAGGTTTCCTT | TGG | chr6 | 160666853 | 160666872 | 160666869 | + |
| SEQ ID NO 36023 | ATGAGCATGAGGTTTCCTTT | GGG | chr6 | 160666854 | 160666873 | 160666870 | + |
| SEQ ID NO 36024 | TGAGCATGAGGTTTCCTTTG | GGG | chr6 | 160666855 | 160666874 | 160666871 | + |
| SEQ ID NO 36025 | ATGAGGTTTCCTTTGGGGAT | GAG | chr6 | 160666860 | 160666879 | 160666876 | + |
| SEQ ID NO 36026 | TGAGGTTTCCTTTGGGGATG | AGG | chr6 | 160666861 | 160666880 | 160666877 | + |
| SEQ ID NO 36027 | TGGGGATGAGGAAAATATTC | TGG | chr6 | 160666873 | 160666892 | 160666889 | + |
| SEQ ID NO 36028 | ATATTCTGGAAATATGATGA | TGG | chr6 | 160666887 | 160666906 | 160666903 | + |
| SEQ ID NO 36029 | TGAATGTACTAAATGCCACT | TGG | chr6 | 160666923 | 160666942 | 160666939 | + |
| SEQ ID NO 36030 | ATGTACTAAATGCCACTTGG | TGG | chr6 | 160666926 | 160666945 | 160666942 | + |
| SEQ ID NO 36031 | TTGGTGGTACCCTGCAAAAA | TGG | chr6 | 160666942 | 160666961 | 160666958 | + |
| SEQ ID NO 36032 | CCCTGCAAAAATGGTTAAAA | TAG | chr6 | 160666951 | 160666970 | 160666967 | + |
| SEQ ID NO 36033 | TACATTTTATTGCAATAAAA | AAG | chr6 | 160666990 | 160667009 | 160667006 | + |
| SEQ ID NO 36034 | TTTATTGCAATAAAAAAGAA | TAG | chr6 | 160666995 | 160667014 | 160667011 | + |

Figure 55 (Cont'd)

| SEQ ID NO 36035 | AAGAATAGTCATCATTTACT | AAG | chr6 | 160667010 | 160667029 | 160667026 | + |
| SEQ ID NO 36036 | TTACTAAGCATTATCCTTTC | CAG | chr6 | 160667025 | 160667044 | 160667041 | + |
| SEQ ID NO 36037 | TACTAAGCATTATCCTTTCC | AGG | chr6 | 160667026 | 160667045 | 160667042 | + |
| SEQ ID NO 36038 | GCATTATCCTTTCCAGGCAC | AAG | chr6 | 160667032 | 160667051 | 160667048 | + |
| SEQ ID NO 36039 | CCAGGCACAAGCTTATAATG | TGG | chr6 | 160667044 | 160667063 | 160667060 | + |
| SEQ ID NO 36040 | ATCTCACTTCATCCTCACAA | CAG | chr6 | 160667070 | 160667089 | 160667086 | + |
| SEQ ID NO 36041 | CTCACAACAGTCCTATGAAA | CAG | chr6 | 160667083 | 160667102 | 160667099 | + |
| SEQ ID NO 36042 | TCACAACAGTCCTATGAAAC | AGG | chr6 | 160667084 | 160667103 | 160667100 | + |
| SEQ ID NO 36043 | CAACAGTCCTATGAAACAGG | CAG | chr6 | 160667087 | 160667106 | 160667103 | + |
| SEQ ID NO 36044 | GTTCCATCACTCCTGCTCTA | CAG | chr6 | 160667109 | 160667128 | 160667125 | + |
| SEQ ID NO 36045 | ATCACTCCTGCTCTACAGTT | AAG | chr6 | 160667114 | 160667133 | 160667130 | + |
| SEQ ID NO 36046 | TCACTCCTGCTCTACAGTTA | AGG | chr6 | 160667115 | 160667134 | 160667131 | + |
| SEQ ID NO 36047 | GCTCTACAGTTAAGGAAACT | GAG | chr6 | 160667123 | 160667142 | 160667139 | + |
| SEQ ID NO 36048 | CTCTACAGTTAAGGAAACTG | AGG | chr6 | 160667124 | 160667143 | 160667140 | + |
| SEQ ID NO 36049 | AGTTAAGGAAACTGAGGTGT | AAG | chr6 | 160667130 | 160667149 | 160667146 | + |
| SEQ ID NO 36050 | GTTAAGGAAACTGAGGTGTA | AGG | chr6 | 160667131 | 160667150 | 160667147 | + |
| SEQ ID NO 36051 | TAAGGAAACTGAGGTGTAAG | GAG | chr6 | 160667133 | 160667152 | 160667149 | + |
| SEQ ID NO 36052 | AAGGAAACTGAGGTGTAAGG | AGG | chr6 | 160667134 | 160667153 | 160667150 | + |
| SEQ ID NO 36053 | TGAGGTGTAAGGAGGTTGTC | TAG | chr6 | 160667142 | 160667161 | 160667158 | + |
| SEQ ID NO 36054 | GAGGTTGTCTAGTTCAACCT | GAG | chr6 | 160667153 | 160667172 | 160667169 | + |
| SEQ ID NO 36055 | TGTCTAGTTCAACCTGAGCC | TGG | chr6 | 160667158 | 160667177 | 160667174 | + |
| SEQ ID NO 36056 | GTCTAGTTCAACCTGAGCCT | GGG | chr6 | 160667159 | 160667178 | 160667175 | + |
| SEQ ID NO 36057 | TCAACCTGAGCCTGGGTCTG | CGG | chr6 | 160667166 | 160667185 | 160667182 | + |
| SEQ ID NO 36058 | AACCTGAGCCTGGGTCTGCG | GAG | chr6 | 160667168 | 160667187 | 160667184 | + |
| SEQ ID NO 36059 | TGCTTCCTCCCCGTGCGCGT | TGG | chr6 | 160667203 | 160667222 | 160667219 | + |
| SEQ ID NO 36060 | CCTCCACATCTTTGTTCATA | AAG | chr6 | 160667245 | 160667264 | 160667261 | + |
| SEQ ID NO 36061 | CTTATTCCTTAATATTTTCT | GAG | chr6 | 160667274 | 160667293 | 160667290 | + |
| SEQ ID NO 36062 | CCTTAATATTTTCTGAGCCT | AAG | chr6 | 160667280 | 160667299 | 160667296 | + |
| SEQ ID NO 36063 | CTAAGTTCCCATAAATTATA | TAG | chr6 | 160667298 | 160667317 | 160667314 | + |
| SEQ ID NO 36064 | AACACTGCCAATTTATTTTC | TAG | chr6 | 160667341 | 160667360 | 160667357 | + |
| SEQ ID NO 36065 | ACTGCCAATTTATTTTCTAG | AAG | chr6 | 160667344 | 160667363 | 160667360 | + |
| SEQ ID NO 36066 | CTGCCAATTTATTTTCTAGA | AGG | chr6 | 160667345 | 160667364 | 160667361 | + |
| SEQ ID NO 36067 | TATTTTCTAGAAGGTTATGA | CAG | chr6 | 160667354 | 160667373 | 160667370 | + |
| SEQ ID NO 36068 | ATGACAGTGTAAAATGTCAC | TAG | chr6 | 160667370 | 160667389 | 160667386 | + |
| SEQ ID NO 36069 | TCACTTCACCACACTTGTAT | GAG | chr6 | 160667400 | 160667419 | 160667416 | + |
| SEQ ID NO 36070 | AGTGTTCAATTTTTAAATAT | TAG | chr6 | 160667421 | 160667440 | 160667437 | + |
| SEQ ID NO 36071 | TTAAATATTAGCTAATCTAA | CAG | chr6 | 160667433 | 160667452 | 160667449 | + |
| SEQ ID NO 36072 | TAAATATTAGCTAATCTAAC | AGG | chr6 | 160667434 | 160667453 | 160667450 | + |
| SEQ ID NO 36073 | TTTATACTTCTTTGACAATT | TGG | chr6 | 160667484 | 160667503 | 160667500 | + |
| SEQ ID NO 36074 | TTATACTTCTTTGACAATTT | GGG | chr6 | 160667485 | 160667504 | 160667501 | + |
| SEQ ID NO 36075 | ATACTTCTTTGACAATTTGG | GAG | chr6 | 160667487 | 160667506 | 160667503 | + |
| SEQ ID NO 36076 | ACTTCTTTGACAATTTGGGA | GAG | chr6 | 160667489 | 160667508 | 160667505 | + |
| SEQ ID NO 36077 | TTTGACAATTTGGGAGAGTG | AAG | chr6 | 160667494 | 160667513 | 160667510 | + |
| SEQ ID NO 36078 | TGGGAGAGTGAAGATTCTCC | TGG | chr6 | 160667504 | 160667523 | 160667520 | + |
| SEQ ID NO 36079 | TTTTCTTTGCCAAATTCAAA | TAG | chr6 | 160667559 | 160667578 | 160667575 | + |
| SEQ ID NO 36080 | TTTGCCAAATTCAAATAGAA | CGG | chr6 | 160667564 | 160667583 | 160667580 | + |
| SEQ ID NO 36081 | TAGAACGGTTGCAAAATTGC | CAG | chr6 | 160667579 | 160667598 | 160667595 | + |

Figure 55 (Cont'd)

| SEQ ID NO 36082 | GAACGGTTGCAAAATTGCCA | GAG | chr6 | 160667581 | 160667600 | 160667597 | + |
| SEQ ID NO 36083 | AACGGTTGCAAAATTGCCAG | AGG | chr6 | 160667582 | 160667601 | 160667598 | + |
| SEQ ID NO 36084 | CAGAGGAAATGCTGTTTTTC | CAG | chr6 | 160667599 | 160667618 | 160667615 | + |
| SEQ ID NO 36085 | GGAAATGCTGTTTTTCCAGA | TGG | chr6 | 160667603 | 160667622 | 160667619 | + |
| SEQ ID NO 36086 | TTTTTCCAGATGGACACACC | CAG | chr6 | 160667613 | 160667632 | 160667629 | + |
| SEQ ID NO 36087 | TTTTCCAGATGGACACACCC | AGG | chr6 | 160667614 | 160667633 | 160667630 | + |
| SEQ ID NO 36088 | TTTCCAGATGGACACACCCA | GGG | chr6 | 160667615 | 160667634 | 160667631 | + |
| SEQ ID NO 36089 | GGACACACCCAGGGATGTTT | CAG | chr6 | 160667624 | 160667643 | 160667640 | + |
| SEQ ID NO 36090 | CAGTGTTCTCACAAATAATC | CAG | chr6 | 160667644 | 160667663 | 160667660 | + |
| SEQ ID NO 36091 | ATCCAGTTTTCTAATTTTGC | AAG | chr6 | 160667661 | 160667680 | 160667677 | + |
| SEQ ID NO 36092 | GTTTTCTAATTTTGCAAGCC | CAG | chr6 | 160667666 | 160667685 | 160667682 | + |
| SEQ ID NO 36093 | TTTGCAAGCCCAGCTTTCAT | TAG | chr6 | 160667676 | 160667695 | 160667692 | + |
| SEQ ID NO 36094 | TGCAAAAATCCTTGCTTTGC | GAG | chr6 | 160667704 | 160667723 | 160667720 | + |
| SEQ ID NO 36095 | AAATCCTTGCTTTGCGAGCA | TGG | chr6 | 160667709 | 160667728 | 160667725 | + |
| SEQ ID NO 36096 | CTTGCTTTGCGAGCATGGCA | CAG | chr6 | 160667714 | 160667733 | 160667730 | + |
| SEQ ID NO 36097 | TTGCTTTGCGAGCATGGCAC | AGG | chr6 | 160667715 | 160667734 | 160667731 | + |
| SEQ ID NO 36098 | TTTGCGAGCATGGCACAGGC | AAG | chr6 | 160667719 | 160667738 | 160667735 | + |
| SEQ ID NO 36099 | TGCGAGCATGGCACAGGCAA | GAG | chr6 | 160667721 | 160667740 | 160667737 | + |
| SEQ ID NO 36100 | GCATGGCACAGGCAAGAGAT | GAG | chr6 | 160667726 | 160667745 | 160667742 | + |
| SEQ ID NO 36101 | CATGGCACAGGCAAGAGATG | AGG | chr6 | 160667727 | 160667746 | 160667743 | + |
| SEQ ID NO 36102 | GCACTCTCTTTCTTCCCC | CAG | chr6 | 160667749 | 160667768 | 160667765 | + |
| SEQ ID NO 36103 | ACTCTCTTTCTTCCCCCA | GAG | chr6 | 160667751 | 160667770 | 160667767 | + |
| SEQ ID NO 36104 | CCAGAGCCTTTGACTGCACT | TAG | chr6 | 160667768 | 160667787 | 160667784 | + |
| SEQ ID NO 36105 | TGCACTTAGATCATTGACTT | TGG | chr6 | 160667782 | 160667801 | 160667798 | + |
| SEQ ID NO 36106 | TTAGATCATTGACTTTGGTT | CAG | chr6 | 160667787 | 160667806 | 160667803 | + |
| SEQ ID NO 36107 | TTCAGAAACCTGACTGCATC | TGG | chr6 | 160667805 | 160667824 | 160667821 | + |
| SEQ ID NO 36108 | CAGAAACCTGACTGCATCTG | GAG | chr6 | 160667807 | 160667826 | 160667823 | + |
| SEQ ID NO 36109 | ACTGCATCTGGAGTTGACAT | GAG | chr6 | 160667817 | 160667836 | 160667833 | + |
| SEQ ID NO 36110 | GCATCTGGAGTTGACATGAG | CAG | chr6 | 160667820 | 160667839 | 160667836 | + |
| SEQ ID NO 36111 | TGGAGTTGACATGAGCAGCA | TGG | chr6 | 160667825 | 160667844 | 160667841 | + |
| SEQ ID NO 36112 | AGTTGACATGAGCAGCATGG | AAG | chr6 | 160667828 | 160667847 | 160667844 | + |
| SEQ ID NO 36113 | AGCATGGAAGATGTTTGTCC | CAG | chr6 | 160667841 | 160667860 | 160667857 | + |
| SEQ ID NO 36114 | TTTGTCCCAGCACCTCACTC | CAG | chr6 | 160667854 | 160667873 | 160667870 | + |
| SEQ ID NO 36115 | TGTCCCAGCACCTCACTCCA | GAG | chr6 | 160667856 | 160667875 | 160667872 | + |
| SEQ ID NO 36116 | GTCCCAGCACCTCACTCCAG | AGG | chr6 | 160667857 | 160667876 | 160667873 | + |
| SEQ ID NO 36117 | CAGCACCTCACTCCAGAGGC | CAG | chr6 | 160667861 | 160667880 | 160667877 | + |
| SEQ ID NO 36118 | CCTCACTCCAGAGGCCAGCT | CAG | chr6 | 160667866 | 160667885 | 160667882 | + |
| SEQ ID NO 36119 | GAGGCCAGCTCAGCTCAATC | TGG | chr6 | 160667876 | 160667895 | 160667892 | + |
| SEQ ID NO 36120 | AGGCCAGCTCAGCTCAATCT | GGG | chr6 | 160667877 | 160667896 | 160667893 | + |
| SEQ ID NO 36121 | CCAGCTCAGCTCAATCTGGG | CAG | chr6 | 160667880 | 160667899 | 160667896 | + |
| SEQ ID NO 36122 | AGCTCAGCTCAATCTGGGCA | GAG | chr6 | 160667882 | 160667901 | 160667898 | + |
| SEQ ID NO 36123 | ATCTGGGCAGAGCTGCATGA | TGG | chr6 | 160667893 | 160667912 | 160667909 | + |
| SEQ ID NO 36124 | TGGGCAGAGCTGCATGATGG | AAG | chr6 | 160667896 | 160667915 | 160667912 | + |
| SEQ ID NO 36125 | GATGGAAGTTTCTGACTACC | AAG | chr6 | 160667911 | 160667930 | 160667927 | + |
| SEQ ID NO 36126 | AGTTTCTGACTACCAAGCAT | CGG | chr6 | 160667917 | 160667936 | 160667933 | + |
| SEQ ID NO 36127 | GTTTCTGACTACCAAGCATC | GGG | chr6 | 160667918 | 160667937 | 160667934 | + |
| SEQ ID NO 36128 | TCTGACTACCAAGCATCGGG | CAG | chr6 | 160667921 | 160667940 | 160667937 | + |

Figure 55 (Cont'd)

| SEQ ID NO 36129 | TGACTACCAAGCATCGGGCA | GAG | chr6 | 160667923 | 160667942 | 160667939 | + |
| SEQ ID NO 36130 | GACTACCAAGCATCGGGCAG | AGG | chr6 | 160667924 | 160667943 | 160667940 | + |
| SEQ ID NO 36131 | ACTACCAAGCATCGGGCAGA | GGG | chr6 | 160667925 | 160667944 | 160667941 | + |
| SEQ ID NO 36132 | CGGGCAGAGGGTGCATCACC | TGG | chr6 | 160667937 | 160667956 | 160667953 | + |
| SEQ ID NO 36133 | GGTGCATCACCTGGACTACA | TAG | chr6 | 160667946 | 160667965 | 160667962 | + |
| SEQ ID NO 36134 | CCTGGACTACATAGTTGTGT | GAG | chr6 | 160667955 | 160667974 | 160667971 | + |
| SEQ ID NO 36135 | CTGGACTACATAGTTGTGTG | AGG | chr6 | 160667956 | 160667975 | 160667972 | + |
| SEQ ID NO 36136 | TGGACTACATAGTTGTGTGA | GGG | chr6 | 160667957 | 160667976 | 160667973 | + |
| SEQ ID NO 36137 | GACTACATAGTTGTGTGAGG | GAG | chr6 | 160667959 | 160667978 | 160667975 | + |
| SEQ ID NO 36138 | TGTGAGGGAGCACCGTTCTC | TAG | chr6 | 160667972 | 160667991 | 160667988 | + |
| SEQ ID NO 36139 | TTCTCTAGAATCTGCTATTT | GAG | chr6 | 160667987 | 160668006 | 160668003 | + |
| SEQ ID NO 36140 | CTAGAATCTGCTATTTGAGC | AAG | chr6 | 160667991 | 160668010 | 160668007 | + |
| SEQ ID NO 36141 | TAGAATCTGCTATTTGAGCA | AGG | chr6 | 160667992 | 160668011 | 160668008 | + |
| SEQ ID NO 36142 | CAAGGCAAACATCCTGATAA | TGG | chr6 | 160668010 | 160668029 | 160668026 | + |
| SEQ ID NO 36143 | TAATGGTGAAAACCTACCGC | AAG | chr6 | 160668027 | 160668046 | 160668043 | + |
| SEQ ID NO 36144 | GAAAACCTACCGCAAGTTGC | CAG | chr6 | 160668034 | 160668053 | 160668050 | + |
| SEQ ID NO 36145 | AAAACCTACCGCAAGTTGCC | AGG | chr6 | 160668035 | 160668054 | 160668051 | + |
| SEQ ID NO 36146 | CCTACCGCAAGTTGCCAGGA | AAG | chr6 | 160668039 | 160668058 | 160668055 | + |
| SEQ ID NO 36147 | AGTTGCCAGGAAAGTTGATG | TGG | chr6 | 160668048 | 160668067 | 160668064 | + |
| SEQ ID NO 36148 | GGAAAGTTGATGTGGTCTGC | GAG | chr6 | 160668056 | 160668075 | 160668072 | + |
| SEQ ID NO 36149 | AAGTTGATGTGGTCTGCGAG | TAG | chr6 | 160668059 | 160668078 | 160668075 | + |
| SEQ ID NO 36150 | AGTTGATGTGGTCTGCGAGT | AGG | chr6 | 160668060 | 160668079 | 160668076 | + |
| SEQ ID NO 36151 | TGCGAGTAGGTGCTGCCATC | CAG | chr6 | 160668073 | 160668092 | 160668089 | + |
| SEQ ID NO 36152 | GAGTAGGTGCTGCCATCCAG | TGG | chr6 | 160668076 | 160668095 | 160668092 | + |
| SEQ ID NO 36153 | CTGCCATCCAGTGGCCGACA | TAG | chr6 | 160668085 | 160668104 | 160668101 | + |
| SEQ ID NO 36154 | GCCATCCAGTGGCCGACATA | GAG | chr6 | 160668087 | 160668106 | 160668103 | + |
| SEQ ID NO 36155 | GACATAGAGATGTCATCTCT | GAG | chr6 | 160668101 | 160668120 | 160668117 | + |
| SEQ ID NO 36156 | ACATAGAGATGTCATCTCTG | AGG | chr6 | 160668102 | 160668121 | 160668118 | + |
| SEQ ID NO 36157 | CATAGAGATGTCATCTCTGA | GGG | chr6 | 160668103 | 160668122 | 160668119 | + |
| SEQ ID NO 36158 | AGAGATGTCATCTCTGAGGG | CAG | chr6 | 160668106 | 160668125 | 160668122 | + |
| SEQ ID NO 36159 | GAGATGTCATCTCTGAGGGC | AGG | chr6 | 160668107 | 160668126 | 160668123 | + |
| SEQ ID NO 36160 | ATGTCATCTCTGAGGGCAGG | TAG | chr6 | 160668110 | 160668129 | 160668126 | + |
| SEQ ID NO 36161 | TGTCATCTCTGAGGGCAGGT | AGG | chr6 | 160668111 | 160668130 | 160668127 | + |
| SEQ ID NO 36162 | CTCTGAGGGCAGGTAGGCCA | CAG | chr6 | 160668117 | 160668136 | 160668133 | + |
| SEQ ID NO 36163 | TCTGAGGGCAGGTAGGCCAC | AGG | chr6 | 160668118 | 160668137 | 160668134 | + |
| SEQ ID NO 36164 | GCAGGTAGGCCACAGGTGAC | AAG | chr6 | 160668125 | 160668144 | 160668141 | + |
| SEQ ID NO 36165 | AGGTAGGCCACAGGTGACAA | GAG | chr6 | 160668127 | 160668146 | 160668143 | + |
| SEQ ID NO 36166 | GGTAGGCCACAGGTGACAAG | AGG | chr6 | 160668128 | 160668147 | 160668144 | + |
| SEQ ID NO 36167 | CACAGGTGACAAGAGGATTG | AAG | chr6 | 160668135 | 160668154 | 160668151 | + |
| SEQ ID NO 36168 | AGGATTGAAGCCCTCCCTGA | TGG | chr6 | 160668148 | 160668167 | 160668164 | + |
| SEQ ID NO 36169 | GGATTGAAGCCCTCCCTGAT | GGG | chr6 | 160668149 | 160668168 | 160668165 | + |
| SEQ ID NO 36170 | GATTGAAGCCCTCCCTGATG | GGG | chr6 | 160668150 | 160668169 | 160668166 | + |
| SEQ ID NO 36171 | AGCCCTCCCTGATGGGCCT | TGG | chr6 | 160668156 | 160668175 | 160668172 | + |
| SEQ ID NO 36172 | GCCCTCCCTGATGGGCCTT | GGG | chr6 | 160668157 | 160668176 | 160668173 | + |
| SEQ ID NO 36173 | CCCTCCCTGATGGGCCTTG | GGG | chr6 | 160668158 | 160668177 | 160668174 | + |
| SEQ ID NO 36174 | CTCCCTGATGGGCCTTGGG | GAG | chr6 | 160668160 | 160668179 | 160668176 | + |
| SEQ ID NO 36175 | CCCTGATGGGCCTTGGGGA | GAG | chr6 | 160668162 | 160668181 | 160668178 | + |

Figure 55 (Cont'd)

| SEQ ID NO | Sequence | | | | | | |
|---|---|---|---|---|---|---|---|
| SEQ ID NO 36176 | CCTGATGGGGCCTTGGGGAG | AGG | chr6 | 160668163 | 160668182 | 160668179 | + |
| SEQ ID NO 36177 | CTGATGGGGCCTTGGGGAGA | GGG | chr6 | 160668164 | 160668183 | 160668180 | + |
| SEQ ID NO 36178 | ATGGGGCCTTGGGGAGAGGG | CAG | chr6 | 160668167 | 160668186 | 160668183 | + |
| SEQ ID NO 36179 | GGGCCTTGGGGAGAGGGCAG | CAG | chr6 | 160668170 | 160668189 | 160668186 | + |
| SEQ ID NO 36180 | GGCCTTGGGGAGAGGGCAGC | AGG | chr6 | 160668171 | 160668190 | 160668187 | + |
| SEQ ID NO 36181 | GCCTTGGGGAGAGGGCAGCA | GGG | chr6 | 160668172 | 160668191 | 160668188 | + |
| SEQ ID NO 36182 | TGGGGAGAGGGCAGCAGGGT | AAG | chr6 | 160668176 | 160668195 | 160668192 | + |
| SEQ ID NO 36183 | AGAGGGCAGCAGGGTAAGTC | CAG | chr6 | 160668181 | 160668200 | 160668197 | + |
| SEQ ID NO 36184 | GGGCAGCAGGGTAAGTCCAG | CGG | chr6 | 160668184 | 160668203 | 160668200 | + |
| SEQ ID NO 36185 | CAGCAGGGTAAGTCCAGCGG | CAG | chr6 | 160668187 | 160668206 | 160668203 | + |
| SEQ ID NO 36186 | AGCAGGGTAAGTCCAGCGGC | AGG | chr6 | 160668188 | 160668207 | 160668204 | + |
| SEQ ID NO 36187 | GGTAAGTCCAGCGGCAGGAT | CAG | chr6 | 160668193 | 160668212 | 160668209 | + |
| SEQ ID NO 36188 | CAGGATCAGTCCATTGATTG | TGG | chr6 | 160668207 | 160668226 | 160668223 | + |
| SEQ ID NO 36189 | ATTGTGGATGACGACTGACC | TGG | chr6 | 160668223 | 160668242 | 160668239 | + |
| SEQ ID NO 36190 | ACTGACCTGGAAAATCCCCT | TGG | chr6 | 160668236 | 160668255 | 160668252 | + |
| SEQ ID NO 36191 | CCAAACTCTGCATTTGATCC | AAG | chr6 | 160668270 | 160668289 | 160668286 | + |
| SEQ ID NO 36192 | ACTCTGCATTTGATCCAAGT | CAG | chr6 | 160668274 | 160668293 | 160668290 | + |
| SEQ ID NO 36193 | CTCTGCATTTGATCCAAGTC | AGG | chr6 | 160668275 | 160668294 | 160668291 | + |
| SEQ ID NO 36194 | TCTGCATTTGATCCAAGTCA | GGG | chr6 | 160668276 | 160668295 | 160668292 | + |
| SEQ ID NO 36195 | GATCCAAGTCAGGGAACACC | TGG | chr6 | 160668285 | 160668304 | 160668301 | + |
| SEQ ID NO 36196 | AGGGAACACCTGGAAACATG | AAG | chr6 | 160668295 | 160668314 | 160668311 | + |
| SEQ ID NO 36197 | GGGAACACCTGGAAACATGA | AGG | chr6 | 160668296 | 160668315 | 160668312 | + |
| SEQ ID NO 36198 | GGAACACCTGGAAACATGAA | GGG | chr6 | 160668297 | 160668316 | 160668313 | + |
| SEQ ID NO 36199 | GAACACCTGGAAACATGAAG | GGG | chr6 | 160668298 | 160668317 | 160668314 | + |
| SEQ ID NO 36200 | ACACCTGGAAACATGAAGGG | GAG | chr6 | 160668300 | 160668319 | 160668316 | + |
| SEQ ID NO 36201 | ACCTGGAAACATGAAGGGGA | GAG | chr6 | 160668302 | 160668321 | 160668318 | + |
| SEQ ID NO 36202 | TGGAAACATGAAGGGGAGAG | CAG | chr6 | 160668305 | 160668324 | 160668321 | + |
| SEQ ID NO 36203 | GGAAACATGAAGGGGAGAGC | AGG | chr6 | 160668306 | 160668325 | 160668322 | + |
| SEQ ID NO 36204 | GAAAACTTTGACCTCCCTCT | CAG | chr6 | 160668328 | 160668347 | 160668344 | + |
| SEQ ID NO 36205 | AAACTTTGACCTCCCTCTCA | GAG | chr6 | 160668330 | 160668349 | 160668346 | + |
| SEQ ID NO 36206 | AACTTTGACCTCCCTCTCAG | AGG | chr6 | 160668331 | 160668350 | 160668347 | + |
| SEQ ID NO 36207 | TGACCTCCCTCTCAGAGGCT | GAG | chr6 | 160668336 | 160668355 | 160668352 | + |
| SEQ ID NO 36208 | CTGATGTCATTATTGACATG | TAG | chr6 | 160668372 | 160668391 | 160668388 | + |
| SEQ ID NO 36209 | ACATGTAGAAAATTGATGAA | CAG | chr6 | 160668387 | 160668406 | 160668403 | + |
| SEQ ID NO 36210 | CATGTAGAAAATTGATGAAC | AGG | chr6 | 160668388 | 160668407 | 160668404 | + |
| SEQ ID NO 36211 | GAAAATTGATGAACAGGCCT | GAG | chr6 | 160668394 | 160668413 | 160668410 | + |
| SEQ ID NO 36212 | CAGGCCTGAGTTATGTTTTG | TGG | chr6 | 160668407 | 160668426 | 160668423 | + |
| SEQ ID NO 36213 | TTATGTTTTGTGGCACCTCA | TGG | chr6 | 160668417 | 160668436 | 160668433 | + |
| SEQ ID NO 36214 | TTTTGTGGCACCTCATGGTC | TAG | chr6 | 160668422 | 160668441 | 160668438 | + |
| SEQ ID NO 36215 | GTGGCACCTCATGGTCTAGT | TAG | chr6 | 160668426 | 160668445 | 160668442 | + |
| SEQ ID NO 36216 | CATGGTCTAGTTAGTGTTCT | GAG | chr6 | 160668435 | 160668454 | 160668451 | + |
| SEQ ID NO 36217 | TGTTCTGAGAATCATTTTCT | CAG | chr6 | 160668449 | 160668468 | 160668465 | + |
| SEQ ID NO 36218 | TCTGAGAATCATTTTCTCAG | TGG | chr6 | 160668452 | 160668471 | 160668468 | + |
| SEQ ID NO 36219 | TCATTTTCTCAGTGGACCTG | CAG | chr6 | 160668460 | 160668479 | 160668476 | + |
| SEQ ID NO 36220 | CATTTTCTCAGTGGACCTGC | AGG | chr6 | 160668461 | 160668480 | 160668477 | + |
| SEQ ID NO 36221 | TTCTCAGTGGACCTGCAGGT | GAG | chr6 | 160668465 | 160668484 | 160668481 | + |
| SEQ ID NO 36222 | AGTGGACCTGCAGGTGAGAC | CAG | chr6 | 160668470 | 160668489 | 160668486 | + |

Figure 55 (Cont'd)

| SEQ ID NO 36223 | GTGGACCTGCAGGTGAGACC | AGG | chr6 | 160668471 | 160668490 | 160668487 | + |
| SEQ ID NO 36224 | ACCTGCAGGTGAGACCAGGC | GAG | chr6 | 160668475 | 160668494 | 160668491 | + |
| SEQ ID NO 36225 | CCTGCAGGTGAGACCAGGCG | AGG | chr6 | 160668476 | 160668495 | 160668492 | + |
| SEQ ID NO 36226 | GCAGGTGAGACCAGGCGAGG | CAG | chr6 | 160668479 | 160668498 | 160668495 | + |
| SEQ ID NO 36227 | GGTGAGACCAGGCGAGGCAG | AAG | chr6 | 160668482 | 160668501 | 160668498 | + |
| SEQ ID NO 36228 | GACCAGGCGAGGCAGAAGCC | TAG | chr6 | 160668487 | 160668506 | 160668503 | + |
| SEQ ID NO 36229 | CAGGCGAGGCAGAAGCCTAG | TGG | chr6 | 160668490 | 160668509 | 160668506 | + |
| SEQ ID NO 36230 | AGGCGAGGCAGAAGCCTAGT | GGG | chr6 | 160668491 | 160668510 | 160668507 | + |
| SEQ ID NO 36231 | GGCGAGGCAGAAGCCTAGTG | GGG | chr6 | 160668492 | 160668511 | 160668508 | + |
| SEQ ID NO 36232 | GCGAGGCAGAAGCCTAGTGG | GGG | chr6 | 160668493 | 160668512 | 160668509 | + |
| SEQ ID NO 36233 | GGCAGAAGCCTAGTGGGGA | TGG | chr6 | 160668497 | 160668516 | 160668513 | + |
| SEQ ID NO 36234 | AGAAGCCTAGTGGGGGATGG | TGG | chr6 | 160668500 | 160668519 | 160668516 | + |
| SEQ ID NO 36235 | GCCTAGTGGGGATGGTGGT | TAG | chr6 | 160668504 | 160668523 | 160668520 | + |
| SEQ ID NO 36236 | GGATGGTGGTTAGAAATGTG | TGG | chr6 | 160668514 | 160668533 | 160668530 | + |
| SEQ ID NO 36237 | GGTGGTTAGAAATGTGTGGA | TGG | chr6 | 160668518 | 160668537 | 160668534 | + |
| SEQ ID NO 36238 | TAGAAATGTGTGGATGGTTG | TGG | chr6 | 160668524 | 160668543 | 160668540 | + |
| SEQ ID NO 36239 | AGAAATGTGTGGATGGTTGT | GGG | chr6 | 160668525 | 160668544 | 160668541 | + |
| SEQ ID NO 36240 | GAAATGTGTGGATGGTTGTG | GGG | chr6 | 160668526 | 160668545 | 160668542 | + |
| SEQ ID NO 36241 | ATGTGTGGATGGTTGTGGGG | CAG | chr6 | 160668529 | 160668548 | 160668545 | + |
| SEQ ID NO 36242 | TGTGGATGGTTGTGGGGCAG | AAG | chr6 | 160668532 | 160668551 | 160668548 | + |
| SEQ ID NO 36243 | TGGTTGTGGGGCAGAAGAAA | CAG | chr6 | 160668538 | 160668557 | 160668554 | + |
| SEQ ID NO 36244 | TGTGGGGCAGAAGAAACAGC | AAG | chr6 | 160668542 | 160668561 | 160668558 | + |
| SEQ ID NO 36245 | GGGGCAGAAGAAACAGCAAG | TAG | chr6 | 160668545 | 160668564 | 160668561 | + |
| SEQ ID NO 36246 | GGGCAGAAGAAACAGCAAGT | AGG | chr6 | 160668546 | 160668565 | 160668562 | + |
| SEQ ID NO 36247 | AAGAAACAGCAAGTAGGCTC | TGG | chr6 | 160668552 | 160668571 | 160668568 | + |
| SEQ ID NO 36248 | AGAAACAGCAAGTAGGCTCT | GGG | chr6 | 160668553 | 160668572 | 160668569 | + |
| SEQ ID NO 36249 | ACAGCAAGTAGGCTCTGGGC | CAG | chr6 | 160668557 | 160668576 | 160668573 | + |
| SEQ ID NO 36250 | GCTCTGGGCCAGCTACAAAC | TGG | chr6 | 160668568 | 160668587 | 160668584 | + |
| SEQ ID NO 36251 | ATGATGTCTACTGATGATGA | TAG | chr6 | 160668595 | 160668614 | 160668611 | + |
| SEQ ID NO 36252 | TCTACTGATGATGATAGTGA | TGG | chr6 | 160668601 | 160668620 | 160668617 | + |
| SEQ ID NO 36253 | ACTGATGATGATAGTGATGG | TGG | chr6 | 160668604 | 160668623 | 160668620 | + |
| SEQ ID NO 36254 | GATGATGATAGTGATGGTGG | TGG | chr6 | 160668607 | 160668626 | 160668623 | + |
| SEQ ID NO 36255 | GATGATAGTGATGGTGGTGG | TGG | chr6 | 160668610 | 160668629 | 160668626 | + |
| SEQ ID NO 36256 | GATAGTGATGGTGGTGGTGG | TGG | chr6 | 160668613 | 160668632 | 160668629 | + |
| SEQ ID NO 36257 | GATGGTGGTGGTGGTGGTGA | TGG | chr6 | 160668619 | 160668638 | 160668635 | + |
| SEQ ID NO 36258 | GGTGGTGGTGGTGGTGATGG | TGG | chr6 | 160668622 | 160668641 | 160668638 | + |
| SEQ ID NO 36259 | GGTGGTGGTGGTGATGGTGG | TGG | chr6 | 160668625 | 160668644 | 160668641 | + |
| SEQ ID NO 36260 | GGTGGTGGTGATGGTGGTGG | TGG | chr6 | 160668628 | 160668647 | 160668644 | + |
| SEQ ID NO 36261 | GGTGGTGGTAATAATTGTGA | TGG | chr6 | 160668643 | 160668662 | 160668659 | + |
| SEQ ID NO 36262 | GGTGGTAATAATTGTGATGG | TGG | chr6 | 160668646 | 160668665 | 160668662 | + |
| SEQ ID NO 36263 | GGTAATAATTGTGATGGTGG | TGG | chr6 | 160668649 | 160668668 | 160668665 | + |
| SEQ ID NO 36264 | TGGTGGTGGAATGATGATGA | TGG | chr6 | 160668663 | 160668682 | 160668679 | + |
| SEQ ID NO 36265 | TGGTGGAATGATGATGATGG | TGG | chr6 | 160668666 | 160668685 | 160668682 | + |
| SEQ ID NO 36266 | TGGAATGATGATGATGGTGG | TGG | chr6 | 160668669 | 160668688 | 160668685 | + |
| SEQ ID NO 36267 | AATGATGATGATGGTGGTGG | TGG | chr6 | 160668672 | 160668691 | 160668688 | + |
| SEQ ID NO 36268 | ATGATGATGATGGTGGTGGT | GGG | chr6 | 160668673 | 160668692 | 160668689 | + |
| SEQ ID NO 36269 | ATGATGATGGTGGTGGTGGG | TAG | chr6 | 160668676 | 160668695 | 160668692 | + |

Figure 55 (Cont'd)

| | | | | | | | |
|---|---|---|---|---|---|---|---|
| SEQ ID NO 36270 | GTGGTGGTGGGTAGTAATGA | TGG | chr6 | 160668685 | 160668704 | 160668701 | + |
| SEQ ID NO 36271 | GTGGGTAGTAATGATGGTGT | TGG | chr6 | 160668691 | 160668710 | 160668707 | + |
| SEQ ID NO 36272 | AGTAATGATGGTGTTGGTGA | TGG | chr6 | 160668697 | 160668716 | 160668713 | + |
| SEQ ID NO 36273 | AATGATGGTGTTGGTGATGG | TGG | chr6 | 160668700 | 160668719 | 160668716 | + |
| SEQ ID NO 36274 | GATGGTGTTGGTGATGGTGG | TAG | chr6 | 160668703 | 160668722 | 160668719 | + |
| SEQ ID NO 36275 | GGTGTTGGTGATGGTGGTAG | TGG | chr6 | 160668706 | 160668725 | 160668722 | + |
| SEQ ID NO 36276 | GGTGATGGTGGTAGTGGTCG | TGG | chr6 | 160668712 | 160668731 | 160668728 | + |
| SEQ ID NO 36277 | GGTGGTAGTGGTCGTGGTGA | TGG | chr6 | 160668718 | 160668737 | 160668734 | + |
| SEQ ID NO 36278 | AGTGGTCGTGGTGATGGTGA | TAG | chr6 | 160668724 | 160668743 | 160668740 | + |
| SEQ ID NO 36279 | CGTGGTGATGGTGATAGTGA | TAG | chr6 | 160668730 | 160668749 | 160668746 | + |
| SEQ ID NO 36280 | GATGGTGATAGTGATAGTGA | TGG | chr6 | 160668736 | 160668755 | 160668752 | + |
| SEQ ID NO 36281 | GGTGATAGTGATAGTGATGG | TGG | chr6 | 160668739 | 160668758 | 160668755 | + |
| SEQ ID NO 36282 | GATAGTGATAGTGATGGTGG | TGG | chr6 | 160668742 | 160668761 | 160668758 | + |
| SEQ ID NO 36283 | GGTGGTAATGATAATGCTAA | TGG | chr6 | 160668760 | 160668779 | 160668776 | + |
| SEQ ID NO 36284 | GGTAATGATAATGCTAATGG | TGG | chr6 | 160668763 | 160668782 | 160668779 | + |
| SEQ ID NO 36285 | AATGATAATGCTAATGGTGG | TGG | chr6 | 160668766 | 160668785 | 160668782 | + |
| SEQ ID NO 36286 | GATAATGATTATCATGATGA | TAG | chr6 | 160668793 | 160668812 | 160668809 | + |
| SEQ ID NO 36287 | AATGATTATCATGATGATAG | CGG | chr6 | 160668796 | 160668815 | 160668812 | + |
| SEQ ID NO 36288 | GATTATCATGATGATAGCGG | TGG | chr6 | 160668799 | 160668818 | 160668815 | + |
| SEQ ID NO 36289 | CATGATGATAGCGGTGGTGA | TGG | chr6 | 160668805 | 160668824 | 160668821 | + |
| SEQ ID NO 36290 | GATAGCGGTGGTGATGGTGA | TGG | chr6 | 160668811 | 160668830 | 160668827 | + |
| SEQ ID NO 36291 | GATGGTGATGGTGATGATAA | TGG | chr6 | 160668823 | 160668842 | 160668839 | + |
| SEQ ID NO 36292 | GATGGTGATGATAATGGTGA | TGG | chr6 | 160668829 | 160668848 | 160668845 | + |
| SEQ ID NO 36293 | GGTGATGATAATGGTGATGG | TGG | chr6 | 160668832 | 160668851 | 160668848 | + |
| SEQ ID NO 36294 | GATGATAATGGTGATGGTGG | TAG | chr6 | 160668835 | 160668854 | 160668851 | + |
| SEQ ID NO 36295 | TGGTGGTAGAATGATGATGA | TGG | chr6 | 160668849 | 160668868 | 160668865 | + |
| SEQ ID NO 36296 | TAGAATGATGATGATGGTGA | TGG | chr6 | 160668855 | 160668874 | 160668871 | + |
| SEQ ID NO 36297 | AATGATGATGATGGTGATGG | TGG | chr6 | 160668858 | 160668877 | 160668874 | + |
| SEQ ID NO 36298 | GATGATGATGGTGATGGTGG | TGG | chr6 | 160668861 | 160668880 | 160668877 | + |
| SEQ ID NO 36299 | GATGATGGTGATGGTGGTGG | TGG | chr6 | 160668864 | 160668883 | 160668880 | + |
| SEQ ID NO 36300 | GATGGTGATGGTGGTGGTGG | TGG | chr6 | 160668867 | 160668886 | 160668883 | + |
| SEQ ID NO 36301 | GGTGATGGTGGTGGTGGTGG | TAG | chr6 | 160668870 | 160668889 | 160668886 | + |
| SEQ ID NO 36302 | GGTGGTGGTAGTAATGATGA | TGG | chr6 | 160668882 | 160668901 | 160668898 | + |
| SEQ ID NO 36303 | GGTGGTAGTAATGATGATGG | TGG | chr6 | 160668885 | 160668904 | 160668901 | + |
| SEQ ID NO 36304 | GGTAGTAATGATGATGGTGG | TGG | chr6 | 160668888 | 160668907 | 160668904 | + |
| SEQ ID NO 36305 | ATGGTGGTGGTGATGATGTT | GAG | chr6 | 160668901 | 160668920 | 160668917 | + |
| SEQ ID NO 36306 | TGGTGGTGGTGATGATGTTG | AGG | chr6 | 160668902 | 160668921 | 160668918 | + |
| SEQ ID NO 36307 | GGTGGTGGTGATGATGTTGA | GGG | chr6 | 160668903 | 160668922 | 160668919 | + |
| SEQ ID NO 36308 | GATGTTGAGGGTGATGATAA | TAG | chr6 | 160668915 | 160668934 | 160668931 | + |
| SEQ ID NO 36309 | GAGGGTGATGATAATAGTGA | CAG | chr6 | 160668921 | 160668940 | 160668937 | + |
| SEQ ID NO 36310 | GGTGATGATAATAGTGACAG | TGG | chr6 | 160668924 | 160668943 | 160668940 | + |
| SEQ ID NO 36311 | GATGATAATAGTGACAGTGG | TGG | chr6 | 160668927 | 160668946 | 160668943 | + |
| SEQ ID NO 36312 | GATAATAGTGACAGTGGTGG | TGG | chr6 | 160668930 | 160668949 | 160668946 | + |
| SEQ ID NO 36313 | AGTGGTGGTGGTAATGATAA | TGG | chr6 | 160668942 | 160668961 | 160668958 | + |
| SEQ ID NO 36314 | GGTGGTAATGATAATGGTGA | TGG | chr6 | 160668948 | 160668967 | 160668964 | + |
| SEQ ID NO 36315 | GGTAATGATAATGGTGATGG | TGG | chr6 | 160668951 | 160668970 | 160668967 | + |
| SEQ ID NO 36316 | TAATGGTGATGGTGGAATGA | TGG | chr6 | 160668959 | 160668978 | 160668975 | + |

Figure 55 (Cont'd)

| SEQ ID NO 36317 | TGATGGTGGAATGATGGTGA | TGG | chr6 | 160668965 | 160668984 | 160668981 | + |
| SEQ ID NO 36318 | TGGTGGAATGATGGTGATGG | TGG | chr6 | 160668968 | 160668987 | 160668984 | + |
| SEQ ID NO 36319 | TGGAATGATGGTGATGGTGG | TGG | chr6 | 160668971 | 160668990 | 160668987 | + |
| SEQ ID NO 36320 | TGATGGTGGTGGAATGATGA | TGG | chr6 | 160668982 | 160669001 | 160668998 | + |
| SEQ ID NO 36321 | TGGTGGTGGAATGATGATGG | TGG | chr6 | 160668985 | 160669004 | 160669001 | + |
| SEQ ID NO 36322 | GGAATGATGATGGTGGTGCT | GAG | chr6 | 160668992 | 160669011 | 160669008 | + |
| SEQ ID NO 36323 | ATGATGATGGTGGTGCTGAG | TAG | chr6 | 160668995 | 160669014 | 160669011 | + |
| SEQ ID NO 36324 | GTGGTGCTGAGTAGTAATGA | TGG | chr6 | 160669004 | 160669023 | 160669020 | + |
| SEQ ID NO 36325 | CTGAGTAGTAATGATGGTGA | TGG | chr6 | 160669010 | 160669029 | 160669026 | + |
| SEQ ID NO 36326 | AGTAGTAATGATGGTGATGG | TGG | chr6 | 160669013 | 160669032 | 160669029 | + |
| SEQ ID NO 36327 | AGTAATGATGGTGATGGTGG | TGG | chr6 | 160669016 | 160669035 | 160669032 | + |
| SEQ ID NO 36328 | AATGATGGTGATGGTGGTGG | TGG | chr6 | 160669019 | 160669038 | 160669035 | + |
| SEQ ID NO 36329 | GGTGATGGTGGTGGTGGCTG | TGG | chr6 | 160669025 | 160669044 | 160669041 | + |
| SEQ ID NO 36330 | GGTGGTGGCTGTGGTGATGA | TGG | chr6 | 160669034 | 160669053 | 160669050 | + |
| SEQ ID NO 36331 | GGTGGCTGTGGTGATGATGG | TGG | chr6 | 160669037 | 160669056 | 160669053 | + |
| SEQ ID NO 36332 | GGCTGTGGTGATGATGGTGG | TGG | chr6 | 160669040 | 160669059 | 160669056 | + |
| SEQ ID NO 36333 | TGTGGTGATGATGGTGGTGG | TAG | chr6 | 160669043 | 160669062 | 160669059 | + |
| SEQ ID NO 36334 | GGTGATGATGGTGGTGGTAG | TGG | chr6 | 160669046 | 160669065 | 160669062 | + |
| SEQ ID NO 36335 | GATGATGGTGGTGGTAGTGG | TAG | chr6 | 160669049 | 160669068 | 160669065 | + |
| SEQ ID NO 36336 | GGTAGTGGTAGTAACGATGA | TGG | chr6 | 160669061 | 160669080 | 160669077 | + |
| SEQ ID NO 36337 | AGTGGTAGTAACGATGATGG | TGG | chr6 | 160669064 | 160669083 | 160669080 | + |
| SEQ ID NO 36338 | GGTAGTAACGATGATGGTGG | TGG | chr6 | 160669067 | 160669086 | 160669083 | + |
| SEQ ID NO 36339 | GATGATGGTGGTGGTGATGA | TAG | chr6 | 160669076 | 160669095 | 160669092 | + |
| SEQ ID NO 36340 | GGTGGTGATGATAGTGATGA | TGG | chr6 | 160669085 | 160669104 | 160669101 | + |
| SEQ ID NO 36341 | GTGATGATGGTGATGATGTT | GAG | chr6 | 160669098 | 160669117 | 160669114 | + |
| SEQ ID NO 36342 | TGATGATGGTGATGATGTTG | AGG | chr6 | 160669099 | 160669118 | 160669115 | + |
| SEQ ID NO 36343 | GATGATGGTGATGATGTTGA | GGG | chr6 | 160669100 | 160669119 | 160669116 | + |
| SEQ ID NO 36344 | GATGTTGAGGGTGATGATAA | TAG | chr6 | 160669112 | 160669131 | 160669128 | + |
| SEQ ID NO 36345 | GAGGGTGATGATAATAGTGA | TAG | chr6 | 160669118 | 160669137 | 160669134 | + |
| SEQ ID NO 36346 | GGTGATGATAATAGTGATAG | CGG | chr6 | 160669121 | 160669140 | 160669137 | + |
| SEQ ID NO 36347 | GATGATAATAGTGATAGCGG | TGG | chr6 | 160669124 | 160669143 | 160669140 | + |
| SEQ ID NO 36348 | TACCACCACCATCATCACCA | CAG | chr6 | 160669045 | 160669064 | 160669048 | - |
| SEQ ID NO 36349 | CCATCACCATCATTACTACT | CAG | chr6 | 160669013 | 160669032 | 160669016 | - |
| SEQ ID NO 36350 | ATTATCATTACCACCACCAT | TAG | chr6 | 160668779 | 160668798 | 160668782 | - |
| SEQ ID NO 36351 | ACCACCATCACTATCATCAT | CAG | chr6 | 160668608 | 160668627 | 160668611 | - |
| SEQ ID NO 36352 | ACCATCACTATCATCATCAG | TAG | chr6 | 160668605 | 160668624 | 160668608 | - |
| SEQ ID NO 36353 | ATCAGTAGACATCATATAAC | CAG | chr6 | 160668590 | 160668609 | 160668593 | - |
| SEQ ID NO 36354 | GACATCATATAACCAGTTTG | TAG | chr6 | 160668583 | 160668602 | 160668586 | - |
| SEQ ID NO 36355 | TCATATAACCAGTTTGTAGC | TGG | chr6 | 160668579 | 160668598 | 160668582 | - |
| SEQ ID NO 36356 | TAACCAGTTTGTAGCTGGCC | CAG | chr6 | 160668574 | 160668593 | 160668577 | - |
| SEQ ID NO 36357 | ACCAGTTTGTAGCTGGCCCA | GAG | chr6 | 160668572 | 160668591 | 160668575 | - |
| SEQ ID NO 36358 | TTCTAACCACCATCCCCCAC | TAG | chr6 | 160668509 | 160668528 | 160668512 | - |
| SEQ ID NO 36359 | TCTAACCACCATCCCCCACT | AGG | chr6 | 160668508 | 160668527 | 160668511 | - |
| SEQ ID NO 36360 | CACTAGGCTTCTGCCTCGCC | TGG | chr6 | 160668492 | 160668511 | 160668495 | - |
| SEQ ID NO 36361 | GCCTCGCCTGGTCTCACCTG | CAG | chr6 | 160668480 | 160668499 | 160668483 | - |
| SEQ ID NO 36362 | CCTCGCCTGGTCTCACCTGC | AGG | chr6 | 160668479 | 160668498 | 160668482 | - |
| SEQ ID NO 36363 | GTCTCACCTGCAGGTCCACT | GAG | chr6 | 160668470 | 160668489 | 160668473 | - |

Figure 55 (Cont'd)

| SEQ ID | Sequence | Codon | Chr | Start | End | Pos | Strand |
|---|---|---|---|---|---|---|---|
| SEQ ID NO 36364 | TCCACTGAGAAAATGATTCT | CAG | chr6 | 160668456 | 160668475 | 160668459 | - |
| SEQ ID NO 36365 | ATGATTCTCAGAACACTAAC | TAG | chr6 | 160668444 | 160668463 | 160668447 | - |
| SEQ ID NO 36366 | CAGAACACTAACTAGACCAT | GAG | chr6 | 160668436 | 160668455 | 160668439 | - |
| SEQ ID NO 36367 | AGAACACTAACTAGACCATG | AGG | chr6 | 160668435 | 160668454 | 160668438 | - |
| SEQ ID NO 36368 | AGGTGCCACAAAACATAACT | CAG | chr6 | 160668415 | 160668434 | 160668418 | - |
| SEQ ID NO 36369 | GGTGCCACAAAACATAACTC | AGG | chr6 | 160668414 | 160668433 | 160668417 | - |
| SEQ ID NO 36370 | CTACATGTCAATAATGACAT | CAG | chr6 | 160668375 | 160668394 | 160668378 | - |
| SEQ ID NO 36371 | TACATGTCAATAATGACATC | AGG | chr6 | 160668374 | 160668393 | 160668377 | - |
| SEQ ID NO 36372 | AATAATGACATCAGGTCAAT | TGG | chr6 | 160668366 | 160668385 | 160668369 | - |
| SEQ ID NO 36373 | ATCAGGTCAATTGGCGTTCT | CAG | chr6 | 160668357 | 160668376 | 160668360 | - |
| SEQ ID NO 36374 | AATTGGCGTTCTCAGCCTCT | GAG | chr6 | 160668349 | 160668368 | 160668352 | - |
| SEQ ID NO 36375 | TTGGCGTTCTCAGCCTCTGA | GAG | chr6 | 160668347 | 160668366 | 160668350 | - |
| SEQ ID NO 36376 | TGGCGTTCTCAGCCTCTGAG | AGG | chr6 | 160668346 | 160668365 | 160668349 | - |
| SEQ ID NO 36377 | GGCGTTCTCAGCCTCTGAGA | GGG | chr6 | 160668345 | 160668364 | 160668348 | - |
| SEQ ID NO 36378 | CGTTCTCAGCCTCTGAGAGG | GAG | chr6 | 160668343 | 160668362 | 160668346 | - |
| SEQ ID NO 36379 | GTTCTCAGCCTCTGAGAGGG | AGG | chr6 | 160668342 | 160668361 | 160668345 | - |
| SEQ ID NO 36380 | AGCCTCTGAGAGGGAGGTCA | AAG | chr6 | 160668336 | 160668355 | 160668339 | - |
| SEQ ID NO 36381 | TGCTCTCCCCTTCATGTTTC | CAG | chr6 | 160668307 | 160668326 | 160668310 | - |
| SEQ ID NO 36382 | GCTCTCCCCTTCATGTTTCC | AGG | chr6 | 160668306 | 160668325 | 160668309 | - |
| SEQ ID NO 36383 | TTTCCAGGTGTTCCCTGACT | TGG | chr6 | 160668291 | 160668310 | 160668294 | - |
| SEQ ID NO 36384 | TCCCTGACTTGGATCAAATG | CAG | chr6 | 160668280 | 160668299 | 160668283 | - |
| SEQ ID NO 36385 | CCTGACTTGGATCAAATGCA | GAG | chr6 | 160668278 | 160668297 | 160668281 | - |
| SEQ ID NO 36386 | CTTGGATCAAATGCAGAGTT | TGG | chr6 | 160668273 | 160668292 | 160668276 | - |
| SEQ ID NO 36387 | TGGATCAAATGCAGAGTTTG | GAG | chr6 | 160668271 | 160668290 | 160668274 | - |
| SEQ ID NO 36388 | GGATCAAATGCAGAGTTTGG | AGG | chr6 | 160668270 | 160668289 | 160668273 | - |
| SEQ ID NO 36389 | ATGCAGAGTTTGGAGGTGTT | GAG | chr6 | 160668263 | 160668282 | 160668266 | - |
| SEQ ID NO 36390 | TGCAGAGTTTGGAGGTGTTG | AGG | chr6 | 160668262 | 160668281 | 160668265 | - |
| SEQ ID NO 36391 | AGTTTGGAGGTGTTGAGGCC | AAG | chr6 | 160668257 | 160668276 | 160668260 | - |
| SEQ ID NO 36392 | GTTTGGAGGTGTTGAGGCCA | AGG | chr6 | 160668256 | 160668275 | 160668259 | - |
| SEQ ID NO 36393 | TTTGGAGGTGTTGAGGCCAA | GGG | chr6 | 160668255 | 160668274 | 160668258 | - |
| SEQ ID NO 36394 | TTGGAGGTGTTGAGGCCAAG | GGG | chr6 | 160668254 | 160668273 | 160668257 | - |
| SEQ ID NO 36395 | TTGAGGCCAAGGGGATTTTC | CAG | chr6 | 160668245 | 160668264 | 160668248 | - |
| SEQ ID NO 36396 | TGAGGCCAAGGGGATTTTCC | AGG | chr6 | 160668244 | 160668263 | 160668247 | - |
| SEQ ID NO 36397 | GCCAAGGGGATTTTCCAGGT | CAG | chr6 | 160668240 | 160668259 | 160668243 | - |
| SEQ ID NO 36398 | CAGTCGTCATCCACAATCAA | TGG | chr6 | 160668220 | 160668239 | 160668223 | - |
| SEQ ID NO 36399 | CAATGGACTGATCCTGCCGC | TGG | chr6 | 160668203 | 160668222 | 160668206 | - |
| SEQ ID NO 36400 | TACCCTGCTGCCCTCTCCCC | AAG | chr6 | 160668177 | 160668196 | 160668180 | - |
| SEQ ID NO 36401 | ACCCTGCTGCCCTCTCCCCA | AGG | chr6 | 160668176 | 160668195 | 160668179 | - |
| SEQ ID NO 36402 | CCCTCTCCCCAAGGCCCCAT | CAG | chr6 | 160668167 | 160668186 | 160668170 | - |
| SEQ ID NO 36403 | CCTCTCCCCAAGGCCCCATC | AGG | chr6 | 160668166 | 160668185 | 160668169 | - |
| SEQ ID NO 36404 | CTCTCCCCAAGGCCCCATCA | GGG | chr6 | 160668165 | 160668184 | 160668168 | - |
| SEQ ID NO 36405 | CTCCCCAAGGCCCCATCAGG | GAG | chr6 | 160668163 | 160668182 | 160668166 | - |
| SEQ ID NO 36406 | TCCCCAAGGCCCCATCAGGG | AGG | chr6 | 160668162 | 160668181 | 160668165 | - |
| SEQ ID NO 36407 | CCCCAAGGCCCCATCAGGGA | GGG | chr6 | 160668161 | 160668180 | 160668164 | - |
| SEQ ID NO 36408 | TTCAATCCTCTTGTCACCTG | TGG | chr6 | 160668137 | 160668156 | 160668140 | - |
| SEQ ID NO 36409 | ACCTGTGGCCTACCTGCCCT | CAG | chr6 | 160668122 | 160668141 | 160668125 | - |
| SEQ ID NO 36410 | CTGTGGCCTACCTGCCCTCA | GAG | chr6 | 160668120 | 160668139 | 160668123 | - |

Figure 55 (Cont'd)

| | | | | | | | |
|---|---|---|---|---|---|---|---|
| SEQ ID NO 36411 | CAGAGATGACATCTCTATGT | CGG | chr6 | 160668102 | 160668121 | 160668105 | - |
| SEQ ID NO 36412 | GACATCTCTATGTCGGCCAC | TGG | chr6 | 160668095 | 160668114 | 160668098 | - |
| SEQ ID NO 36413 | TCTCTATGTCGGCCACTGGA | TGG | chr6 | 160668091 | 160668110 | 160668094 | - |
| SEQ ID NO 36414 | CTATGTCGGCCACTGGATGG | CAG | chr6 | 160668088 | 160668107 | 160668091 | - |
| SEQ ID NO 36415 | TGGATGGCAGCACCTACTCG | CAG | chr6 | 160668075 | 160668094 | 160668078 | - |
| SEQ ID NO 36416 | GCAGACCACATCAACTTTCC | TGG | chr6 | 160668056 | 160668075 | 160668059 | - |
| SEQ ID NO 36417 | TCAACTTTCCTGGCAACTTG | CGG | chr6 | 160668046 | 160668065 | 160668049 | - |
| SEQ ID NO 36418 | ACTTTCCTGGCAACTTGCGG | TAG | chr6 | 160668043 | 160668062 | 160668046 | - |
| SEQ ID NO 36419 | CTTTCCTGGCAACTTGCGGT | AGG | chr6 | 160668042 | 160668061 | 160668045 | - |
| SEQ ID NO 36420 | CGGTAGGTTTTCACCATTAT | CAG | chr6 | 160668026 | 160668045 | 160668029 | - |
| SEQ ID NO 36421 | GGTAGGTTTTCACCATTATC | AGG | chr6 | 160668025 | 160668044 | 160668028 | - |
| SEQ ID NO 36422 | GGATGTTTGCCTTGCTCAAA | TAG | chr6 | 160668004 | 160668023 | 160668007 | - |
| SEQ ID NO 36423 | TGTTTGCCTTGCTCAAATAG | CAG | chr6 | 160668001 | 160668020 | 160668004 | - |
| SEQ ID NO 36424 | CTTGCTCAAATAGCAGATTC | TAG | chr6 | 160667994 | 160668013 | 160667997 | - |
| SEQ ID NO 36425 | TGCTCAAATAGCAGATTCTA | GAG | chr6 | 160667992 | 160668011 | 160667995 | - |
| SEQ ID NO 36426 | AAATAGCAGATTCTAGAGAA | CGG | chr6 | 160667987 | 160668006 | 160667990 | - |
| SEQ ID NO 36427 | TGCTCCCTCACACAACTATG | TAG | chr6 | 160667964 | 160667983 | 160667967 | - |
| SEQ ID NO 36428 | CCTCACACAACTATGTAGTC | CAG | chr6 | 160667959 | 160667978 | 160667962 | - |
| SEQ ID NO 36429 | CTCACACAACTATGTAGTCC | AGG | chr6 | 160667958 | 160667977 | 160667961 | - |
| SEQ ID NO 36430 | TGCACCCTCTGCCCGATGCT | TGG | chr6 | 160667932 | 160667951 | 160667935 | - |
| SEQ ID NO 36431 | ACCCTCTGCCCGATGCTTGG | TAG | chr6 | 160667929 | 160667948 | 160667932 | - |
| SEQ ID NO 36432 | TCTGCCCGATGCTTGGTAGT | CAG | chr6 | 160667925 | 160667944 | 160667928 | - |
| SEQ ID NO 36433 | AGTCAGAAACTTCCATCATG | CAG | chr6 | 160667908 | 160667927 | 160667911 | - |
| SEQ ID NO 36434 | TTCCATCATGCAGCTCTGCC | CAG | chr6 | 160667898 | 160667917 | 160667901 | - |
| SEQ ID NO 36435 | CATGCAGCTCTGCCCAGATT | GAG | chr6 | 160667892 | 160667911 | 160667895 | - |
| SEQ ID NO 36436 | AGCTCTGCCCAGATTGAGCT | GAG | chr6 | 160667887 | 160667906 | 160667890 | - |
| SEQ ID NO 36437 | CTGCCCAGATTGAGCTGAGC | TGG | chr6 | 160667883 | 160667902 | 160667886 | - |
| SEQ ID NO 36438 | GATTGAGCTGAGCTGGCCTC | TGG | chr6 | 160667876 | 160667895 | 160667879 | - |
| SEQ ID NO 36439 | TTGAGCTGAGCTGGCCTCTG | GAG | chr6 | 160667874 | 160667893 | 160667877 | - |
| SEQ ID NO 36440 | GCTGAGCTGGCCTCTGGAGT | GAG | chr6 | 160667870 | 160667889 | 160667873 | - |
| SEQ ID NO 36441 | CTGAGCTGGCCTCTGGAGTG | AGG | chr6 | 160667869 | 160667888 | 160667872 | - |
| SEQ ID NO 36442 | TGGCCTCTGGAGTGAGGTGC | TGG | chr6 | 160667863 | 160667882 | 160667866 | - |
| SEQ ID NO 36443 | GGCCTCTGGAGTGAGGTGCT | GGG | chr6 | 160667862 | 160667881 | 160667865 | - |
| SEQ ID NO 36444 | CATGCTGCTCATGTCAACTC | CAG | chr6 | 160667827 | 160667846 | 160667830 | - |
| SEQ ID NO 36445 | GCTCATGTCAACTCCAGATG | CAG | chr6 | 160667821 | 160667840 | 160667824 | - |
| SEQ ID NO 36446 | ATGTCAACTCCAGATGCAGT | CAG | chr6 | 160667817 | 160667836 | 160667820 | - |
| SEQ ID NO 36447 | TGTCAACTCCAGATGCAGTC | AGG | chr6 | 160667816 | 160667835 | 160667819 | - |
| SEQ ID NO 36448 | GCAGTCAGGTTTCTGAACCA | AAG | chr6 | 160667802 | 160667821 | 160667805 | - |
| SEQ ID NO 36449 | TGAACCAAAGTCAATGATCT | AAG | chr6 | 160667789 | 160667808 | 160667792 | - |
| SEQ ID NO 36450 | CAAAGTCAATGATCTAAGTG | CAG | chr6 | 160667784 | 160667803 | 160667787 | - |
| SEQ ID NO 36451 | CAATGATCTAAGTGCAGTCA | AAG | chr6 | 160667778 | 160667797 | 160667781 | - |
| SEQ ID NO 36452 | AATGATCTAAGTGCAGTCAA | AGG | chr6 | 160667777 | 160667796 | 160667780 | - |
| SEQ ID NO 36453 | CTAAGTGCAGTCAAAGGCTC | TGG | chr6 | 160667771 | 160667790 | 160667774 | - |
| SEQ ID NO 36454 | TAAGTGCAGTCAAAGGCTCT | GGG | chr6 | 160667770 | 160667789 | 160667773 | - |
| SEQ ID NO 36455 | AAGTGCAGTCAAAGGCTCTG | GGG | chr6 | 160667769 | 160667788 | 160667772 | - |
| SEQ ID NO 36456 | AGTGCAGTCAAAGGCTCTGG | GGG | chr6 | 160667768 | 160667787 | 160667771 | - |
| SEQ ID NO 36457 | GCAGTCAAAGGCTCTGGGGG | AAG | chr6 | 160667765 | 160667784 | 160667768 | - |

Figure 55 (Cont'd)

| | | | | | | | |
|---|---|---|---|---|---|---|---|
| SEQ ID NO 36458 | TCAAAGGCTCTGGGGGAAGA | AAG | chr6 | 160667761 | 160667780 | 160667764 | - |
| SEQ ID NO 36459 | AAAGGCTCTGGGGGAAGAAA | GAG | chr6 | 160667759 | 160667778 | 160667762 | - |
| SEQ ID NO 36460 | AGGCTCTGGGGGAAGAAAGA | GAG | chr6 | 160667757 | 160667776 | 160667760 | - |
| SEQ ID NO 36461 | GCTCTGGGGGAAGAAAGAGA | GAG | chr6 | 160667755 | 160667774 | 160667758 | - |
| SEQ ID NO 36462 | TTGCCTGTGCCATGCTCGCA | AAG | chr6 | 160667721 | 160667740 | 160667724 | - |
| SEQ ID NO 36463 | CTGTGCCATGCTCGCAAAGC | AAG | chr6 | 160667717 | 160667736 | 160667720 | - |
| SEQ ID NO 36464 | TGTGCCATGCTCGCAAAGCA | AGG | chr6 | 160667716 | 160667735 | 160667719 | - |
| SEQ ID NO 36465 | TTTTTGCAAAATTCTAATGA | AAG | chr6 | 160667692 | 160667711 | 160667695 | - |
| SEQ ID NO 36466 | TGCAAAATTCTAATGAAAGC | TGG | chr6 | 160667688 | 160667707 | 160667691 | - |
| SEQ ID NO 36467 | GCAAAATTCTAATGAAAGCT | GGG | chr6 | 160667687 | 160667706 | 160667690 | - |
| SEQ ID NO 36468 | GAAAGCTGGGCTTGCAAAAT | TAG | chr6 | 160667674 | 160667693 | 160667677 | - |
| SEQ ID NO 36469 | GGCTTGCAAAATTAGAAAAC | TGG | chr6 | 160667666 | 160667685 | 160667669 | - |
| SEQ ID NO 36470 | TAGAAAACTGGATTATTTGT | GAG | chr6 | 160667654 | 160667673 | 160667657 | - |
| SEQ ID NO 36471 | TGAGAACACTGAAACATCCC | TGG | chr6 | 160667635 | 160667654 | 160667638 | - |
| SEQ ID NO 36472 | GAGAACACTGAAACATCCCT | GGG | chr6 | 160667634 | 160667653 | 160667637 | - |
| SEQ ID NO 36473 | CATCCCTGGGTGTGTCCATC | TGG | chr6 | 160667621 | 160667640 | 160667624 | - |
| SEQ ID NO 36474 | GGTGTGTCCATCTGGAAAAA | CAG | chr6 | 160667613 | 160667632 | 160667616 | - |
| SEQ ID NO 36475 | TGGAAAAACAGCATTTCCTC | TGG | chr6 | 160667601 | 160667620 | 160667604 | - |
| SEQ ID NO 36476 | GCAACCGTTCTATTTGAATT | TGG | chr6 | 160667571 | 160667590 | 160667574 | - |
| SEQ ID NO 36477 | CGTTCTATTTGAATTTGGCA | AAG | chr6 | 160667566 | 160667585 | 160667569 | - |
| SEQ ID NO 36478 | TGAATTTGGCAAAGAAAATA | AAG | chr6 | 160667557 | 160667576 | 160667560 | - |
| SEQ ID NO 36479 | ATTTGGCAAAGAAAATAAAG | CAG | chr6 | 160667554 | 160667573 | 160667557 | - |
| SEQ ID NO 36480 | AATAAAGCAGTTTTTCACAA | AAG | chr6 | 160667541 | 160667560 | 160667544 | - |
| SEQ ID NO 36481 | CACAAAGAATAAACACAAC | CAG | chr6 | 160667526 | 160667545 | 160667529 | - |
| SEQ ID NO 36482 | ACAAAGAATAAACACAACC | AGG | chr6 | 160667525 | 160667544 | 160667528 | - |
| SEQ ID NO 36483 | AAAAGAATAAACACAACCAG | GAG | chr6 | 160667523 | 160667542 | 160667526 | - |
| SEQ ID NO 36484 | TTCACTCCCAAATTGTCA | AAG | chr6 | 160667496 | 160667515 | 160667499 | - |
| SEQ ID NO 36485 | ACTCTCCCAAATTGTCAAAG | AAG | chr6 | 160667493 | 160667512 | 160667496 | - |
| SEQ ID NO 36486 | ATTGTCAAAGAAGTATAAAT | TAG | chr6 | 160667483 | 160667502 | 160667486 | - |
| SEQ ID NO 36487 | GTATAAATTAGAAAATGAAT | CAG | chr6 | 160667471 | 160667490 | 160667474 | - |
| SEQ ID NO 36488 | TATAAATTAGAAAATGAATC | AGG | chr6 | 160667470 | 160667489 | 160667473 | - |
| SEQ ID NO 36489 | TCAGGACAATTTCAACCTGT | TAG | chr6 | 160667452 | 160667471 | 160667455 | - |
| SEQ ID NO 36490 | ACAATTTCAACCTGTTAGAT | TAG | chr6 | 160667447 | 160667466 | 160667450 | - |
| SEQ ID NO 36491 | TAAAAATTGAACACTCATAC | AAG | chr6 | 160667416 | 160667435 | 160667419 | - |
| SEQ ID NO 36492 | ATTGAACACTCATACAAGTG | TGG | chr6 | 160667411 | 160667430 | 160667414 | - |
| SEQ ID NO 36493 | ACACTCATACAAGTGTGGTG | AAG | chr6 | 160667406 | 160667425 | 160667409 | - |
| SEQ ID NO 36494 | GTGGTGAAGTGATTGTTTTC | TAG | chr6 | 160667392 | 160667411 | 160667395 | - |
| SEQ ID NO 36495 | TTTACACTGTCATAACCTTC | TAG | chr6 | 160667363 | 160667382 | 160667366 | - |
| SEQ ID NO 36496 | TAACCTTCTAGAAAATAAAT | TGG | chr6 | 160667351 | 160667370 | 160667354 | - |
| SEQ ID NO 36497 | CCTTCTAGAAAATAAATTGG | CAG | chr6 | 160667348 | 160667367 | 160667351 | - |
| SEQ ID NO 36498 | AAATAAATTGGCAGTGTTAT | TGG | chr6 | 160667339 | 160667358 | 160667342 | - |
| SEQ ID NO 36499 | AATAAATTGGCAGTGTTATT | GGG | chr6 | 160667338 | 160667357 | 160667341 | - |
| SEQ ID NO 36500 | TAAATTGGCAGTGTTATTGG | GAG | chr6 | 160667336 | 160667355 | 160667339 | - |
| SEQ ID NO 36501 | TTGGCAGTGTTATTGGGAGA | CAG | chr6 | 160667332 | 160667351 | 160667335 | - |
| SEQ ID NO 36502 | AAATATGTCTATATAATTTA | TGG | chr6 | 160667309 | 160667328 | 160667312 | - |
| SEQ ID NO 36503 | AATATGTCTATATAATTTAT | GGG | chr6 | 160667308 | 160667327 | 160667311 | - |
| SEQ ID NO 36504 | CTATATAATTTATGGGAACT | TAG | chr6 | 160667301 | 160667320 | 160667304 | - |

Figure 55 (Cont'd)

| | | | | | | | |
|---|---|---|---|---|---|---|---|
| SEQ ID NO 36505 | TATATAATTTATGGGAACTT | AGG | chr6 | 160667300 | 160667319 | 160667303 | - |
| SEQ ID NO 36506 | AATTTATGGGAACTTAGGCT | CAG | chr6 | 160667295 | 160667314 | 160667298 | - |
| SEQ ID NO 36507 | ACTTAGGCTCAGAAAATATT | AAG | chr6 | 160667284 | 160667303 | 160667287 | - |
| SEQ ID NO 36508 | CTTAGGCTCAGAAAATATTA | AGG | chr6 | 160667283 | 160667302 | 160667286 | - |
| SEQ ID NO 36509 | CTCAGAAAATATTAAGGAAT | AAG | chr6 | 160667277 | 160667296 | 160667280 | - |
| SEQ ID NO 36510 | AAGAATGAACTTTATGAACA | AAG | chr6 | 160667257 | 160667276 | 160667260 | - |
| SEQ ID NO 36511 | GAACTTTATGAACAAAGATG | TGG | chr6 | 160667251 | 160667270 | 160667254 | - |
| SEQ ID NO 36512 | ACTTTATGAACAAAGATGTG | GAG | chr6 | 160667249 | 160667268 | 160667252 | - |
| SEQ ID NO 36513 | CTTTATGAACAAAGATGTGG | AGG | chr6 | 160667248 | 160667267 | 160667251 | - |
| SEQ ID NO 36514 | TTTATGAACAAAGATGTGGA | GGG | chr6 | 160667247 | 160667266 | 160667250 | - |
| SEQ ID NO 36515 | TGAACAAAGATGTGGAGGGT | TGG | chr6 | 160667243 | 160667262 | 160667246 | - |
| SEQ ID NO 36516 | ACAAAGATGTGGAGGGTTGG | AAG | chr6 | 160667240 | 160667259 | 160667243 | - |
| SEQ ID NO 36517 | AGATGTGGAGGGTTGGAAGC | AAG | chr6 | 160667236 | 160667255 | 160667239 | - |
| SEQ ID NO 36518 | ATGTGGAGGGTTGGAAGCAA | GAG | chr6 | 160667234 | 160667253 | 160667237 | - |
| SEQ ID NO 36519 | TGTGGAGGGTTGGAAGCAAG | AGG | chr6 | 160667233 | 160667252 | 160667236 | - |
| SEQ ID NO 36520 | GTGGAGGGTTGGAAGCAAGA | GGG | chr6 | 160667232 | 160667251 | 160667235 | - |
| SEQ ID NO 36521 | TGGAGGGTTGGAAGCAAGAG | GGG | chr6 | 160667231 | 160667250 | 160667234 | - |
| SEQ ID NO 36522 | GGAGGGTTGGAAGCAAGAGG | GGG | chr6 | 160667230 | 160667249 | 160667233 | - |
| SEQ ID NO 36523 | GAGGGTTGGAAGCAAGAGGG | GGG | chr6 | 160667229 | 160667248 | 160667232 | - |
| SEQ ID NO 36524 | AAGAGGGGGGCCAACGCGCA | CGG | chr6 | 160667216 | 160667235 | 160667219 | - |
| SEQ ID NO 36525 | AGAGGGGGGCCAACGCGCAC | GGG | chr6 | 160667215 | 160667234 | 160667218 | - |
| SEQ ID NO 36526 | GAGGGGGGCCAACGCGCACG | GGG | chr6 | 160667214 | 160667233 | 160667217 | - |
| SEQ ID NO 36527 | GGGGGGCCAACGCGCACGGG | GAG | chr6 | 160667212 | 160667231 | 160667215 | - |
| SEQ ID NO 36528 | GGGGGCCAACGCGCACGGGG | AGG | chr6 | 160667211 | 160667230 | 160667214 | - |
| SEQ ID NO 36529 | GGCCAACGCGCACGGGGAGG | AAG | chr6 | 160667208 | 160667227 | 160667211 | - |
| SEQ ID NO 36530 | GCGCACGGGGAGGAAGCATT | TGG | chr6 | 160667201 | 160667220 | 160667204 | - |
| SEQ ID NO 36531 | CGCACGGGGAGGAAGCATTT | GGG | chr6 | 160667200 | 160667219 | 160667203 | - |
| SEQ ID NO 36532 | ACGGGGAGGAAGCATTTGGG | CAG | chr6 | 160667197 | 160667216 | 160667200 | - |
| SEQ ID NO 36533 | GCATTTGGGCAGTGACTCCG | CAG | chr6 | 160667186 | 160667205 | 160667189 | - |
| SEQ ID NO 36534 | GGGCAGTGACTCCGCAGACC | CAG | chr6 | 160667180 | 160667199 | 160667183 | - |
| SEQ ID NO 36535 | GGCAGTGACTCCGCAGACCC | AGG | chr6 | 160667179 | 160667198 | 160667182 | - |
| SEQ ID NO 36536 | TGACTCCGCAGACCCAGGCT | CAG | chr6 | 160667174 | 160667193 | 160667177 | - |
| SEQ ID NO 36537 | GACTCCGCAGACCCAGGCTC | AGG | chr6 | 160667173 | 160667192 | 160667176 | - |
| SEQ ID NO 36538 | GACCCAGGCTCAGGTTGAAC | TAG | chr6 | 160667164 | 160667183 | 160667167 | - |
| SEQ ID NO 36539 | TAGACAACCTCCTTACACCT | CAG | chr6 | 160667144 | 160667163 | 160667147 | - |
| SEQ ID NO 36540 | CACCTCAGTTTCCTTAACTG | TAG | chr6 | 160667129 | 160667148 | 160667132 | - |
| SEQ ID NO 36541 | CCTCAGTTTCCTTAACTGTA | GAG | chr6 | 160667127 | 160667146 | 160667130 | - |
| SEQ ID NO 36542 | CAGTTTCCTTAACTGTAGAG | CAG | chr6 | 160667124 | 160667143 | 160667127 | - |
| SEQ ID NO 36543 | AGTTTCCTTAACTGTAGAGC | AGG | chr6 | 160667123 | 160667142 | 160667126 | - |
| SEQ ID NO 36544 | TTTCCTTAACTGTAGAGCAG | GAG | chr6 | 160667121 | 160667140 | 160667124 | - |
| SEQ ID NO 36545 | TAACTGTAGAGCAGGAGTGA | TGG | chr6 | 160667115 | 160667134 | 160667118 | - |
| SEQ ID NO 36546 | TGATGGAACTGCCTGTTTCA | TAG | chr6 | 160667098 | 160667117 | 160667101 | - |
| SEQ ID NO 36547 | GATGGAACTGCCTGTTTCAT | AGG | chr6 | 160667097 | 160667116 | 160667100 | - |
| SEQ ID NO 36548 | CTGTTTCATAGGACTGTTGT | GAG | chr6 | 160667086 | 160667105 | 160667089 | - |
| SEQ ID NO 36549 | TGTTTCATAGGACTGTTGTG | AGG | chr6 | 160667085 | 160667104 | 160667088 | - |
| SEQ ID NO 36550 | ATAGGACTGTTGTGAGGATG | AAG | chr6 | 160667079 | 160667098 | 160667082 | - |
| SEQ ID NO 36551 | GACTGTTGTGAGGATGAAGT | GAG | chr6 | 160667075 | 160667094 | 160667078 | - |

Figure 55 (Cont'd)

| SEQ ID | Sequence | Codon | Chr | Start | End | Pos | Strand |
|---|---|---|---|---|---|---|---|
| SEQ ID NO 36552 | AGTGAGATACACCACATTAT | AAG | chr6 | 160667058 | 160667077 | 160667061 | - |
| SEQ ID NO 36553 | CCACATTATAAGCTTGTGCC | TGG | chr6 | 160667047 | 160667066 | 160667050 | - |
| SEQ ID NO 36554 | ATTATAAGCTTGTGCCTGGA | AAG | chr6 | 160667043 | 160667062 | 160667046 | - |
| SEQ ID NO 36555 | TTATAAGCTTGTGCCTGGAA | AGG | chr6 | 160667042 | 160667061 | 160667045 | - |
| SEQ ID NO 36556 | TGCCTGGAAAGGATAATGCT | TAG | chr6 | 160667031 | 160667050 | 160667034 | - |
| SEQ ID NO 36557 | TTATTGCAATAAAATGTACA | CAG | chr6 | 160666988 | 160667007 | 160666991 | - |
| SEQ ID NO 36558 | CAATAAAATGTACACAGCGT | AAG | chr6 | 160666982 | 160667001 | 160666985 | - |
| SEQ ID NO 36559 | ATAAAATGTACACAGCGTAA | GAG | chr6 | 160666980 | 160666999 | 160666983 | - |
| SEQ ID NO 36560 | TACTATTTTAACCATTTTTG | CAG | chr6 | 160666956 | 160666975 | 160666959 | - |
| SEQ ID NO 36561 | ACTATTTTAACCATTTTTGC | AGG | chr6 | 160666955 | 160666974 | 160666958 | - |
| SEQ ID NO 36562 | CTATTTTAACCATTTTTGCA | GGG | chr6 | 160666954 | 160666973 | 160666957 | - |
| SEQ ID NO 36563 | CATTTTTGCAGGGTACCACC | AAG | chr6 | 160666944 | 160666963 | 160666947 | - |
| SEQ ID NO 36564 | TTTTGCAGGGTACCACCAAG | TGG | chr6 | 160666941 | 160666960 | 160666944 | - |
| SEQ ID NO 36565 | GGGTACCACCAAGTGGCATT | TAG | chr6 | 160666934 | 160666953 | 160666937 | - |
| SEQ ID NO 36566 | AGTGGCATTTAGTACATTCA | CAG | chr6 | 160666923 | 160666942 | 160666926 | - |
| SEQ ID NO 36567 | GGCATTTAGTACATTCACAG | TGG | chr6 | 160666920 | 160666939 | 160666923 | - |
| SEQ ID NO 36568 | TGCAACCATCATCATATTTC | CAG | chr6 | 160666895 | 160666914 | 160666898 | - |
| SEQ ID NO 36569 | GAATATTTTCCTCATCCCCA | AAG | chr6 | 160666873 | 160666892 | 160666876 | - |
| SEQ ID NO 36570 | AATATTTTCCTCATCCCCAA | AGG | chr6 | 160666872 | 160666891 | 160666875 | - |
| SEQ ID NO 36571 | GAAACCTCATGCTCATTAAT | CAG | chr6 | 160666850 | 160666869 | 160666853 | - |
| SEQ ID NO 36572 | ACCTCATGCTCATTAATCAG | TAG | chr6 | 160666847 | 160666866 | 160666850 | - |
| SEQ ID NO 36573 | GTAGCTCTCCTTTAAAATAT | TAG | chr6 | 160666828 | 160666847 | 160666831 | - |
| SEQ ID NO 36574 | CCTTTAAAATATTAGTTATG | AAG | chr6 | 160666820 | 160666839 | 160666823 | - |
| SEQ ID NO 36575 | AATATTAGTTATGAAGATCA | TAG | chr6 | 160666813 | 160666832 | 160666816 | - |
| SEQ ID NO 36576 | AAAACTCATTATGTAATGTT | GAG | chr6 | 160666782 | 160666801 | 160666785 | - |
| SEQ ID NO 36577 | GTAATGTTGAGTGAAAAAAT | CAG | chr6 | 160666770 | 160666789 | 160666773 | - |
| SEQ ID NO 36578 | TAATGTTGAGTGAAAAAATC | AGG | chr6 | 160666769 | 160666788 | 160666772 | - |
| SEQ ID NO 36579 | AATGTTGAGTGAAAAATCA | GGG | chr6 | 160666768 | 160666787 | 160666771 | - |
| SEQ ID NO 36580 | ATTTTGTGATATGATGTAAT | TAG | chr6 | 160666739 | 160666758 | 160666742 | - |
| SEQ ID NO 36581 | TGATATGATGTAATTAGTGA | AAG | chr6 | 160666733 | 160666752 | 160666736 | - |
| SEQ ID NO 36582 | TATGATGTAATTAGTGAAAG | AAG | chr6 | 160666730 | 160666749 | 160666733 | - |
| SEQ ID NO 36583 | TAGTGAAAGAAGCATACAAA | AAG | chr6 | 160666719 | 160666738 | 160666722 | - |
| SEQ ID NO 36584 | GTCTGAAAATATAAAAACAA | TAG | chr6 | 160666697 | 160666716 | 160666700 | - |
| SEQ ID NO 36585 | ACAATAGCAATTGCATTTCT | CAG | chr6 | 160666681 | 160666700 | 160666684 | - |
| SEQ ID NO 36586 | CATTTAAACATTATTCTTTA | TGG | chr6 | 160666652 | 160666671 | 160666655 | - |
| SEQ ID NO 36587 | ATTATTCTTTATGGTTTTAA | AAG | chr6 | 160666643 | 160666662 | 160666646 | - |
| SEQ ID NO 36588 | TCTTTATGGTTTTAAAAGCA | AAG | chr6 | 160666638 | 160666657 | 160666641 | - |
| SEQ ID NO 36589 | TGGTTTTAAAAGCAAAGAAA | AAG | chr6 | 160666632 | 160666651 | 160666635 | - |
| SEQ ID NO 36590 | GGTTTTAAAAGCAAAGAAAA | AGG | chr6 | 160666631 | 160666650 | 160666634 | - |
| SEQ ID NO 36591 | TAAAAGCAAAGAAAAGGTA | AAG | chr6 | 160666626 | 160666645 | 160666629 | - |
| SEQ ID NO 36592 | AGAAACAACAACCAACCGCA | AAG | chr6 | 160666605 | 160666624 | 160666608 | - |
| SEQ ID NO 36593 | AACCGCAAAGCACCATGACA | AAG | chr6 | 160666592 | 160666611 | 160666595 | - |
| SEQ ID NO 36594 | CAAAGCACCATGACAAAGCT | CAG | chr6 | 160666587 | 160666606 | 160666590 | - |
| SEQ ID NO 36595 | AAAGCTCAGATTGTTAAATC | CAG | chr6 | 160666573 | 160666592 | 160666576 | - |
| SEQ ID NO 36596 | AAGCTCAGATTGTTAAATCC | AGG | chr6 | 160666572 | 160666591 | 160666575 | - |
| SEQ ID NO 36597 | GATTGTTAAATCCAGGTTTT | TGG | chr6 | 160666565 | 160666584 | 160666568 | - |
| SEQ ID NO 36598 | AAATCCAGGTTTTTGGAACA | TAG | chr6 | 160666558 | 160666577 | 160666561 | - |

Figure 55 (Cont'd)

| SEQ ID | Sequence | PAM | Chr | Start | End | Pos | Strand |
|---|---|---|---|---|---|---|---|
| SEQ ID NO 36599 | TATATGACGTTTACACTCTC | CAG | chr6 | 160666530 | 160666549 | 160666533 | - |
| SEQ ID NO 36600 | ATATGACGTTTACACTCTCC | AGG | chr6 | 160666529 | 160666548 | 160666532 | - |
| SEQ ID NO 36601 | TATGACGTTTACACTCTCCA | GGG | chr6 | 160666528 | 160666547 | 160666531 | - |
| SEQ ID NO 36602 | CGTTTACACTCTCCAGGGTT | CAG | chr6 | 160666523 | 160666542 | 160666526 | - |
| SEQ ID NO 36603 | TTTACACTCTCCAGGGTTCA | GAG | chr6 | 160666521 | 160666540 | 160666524 | - |
| SEQ ID NO 36604 | TACACTCTCCAGGGTTCAGA | GAG | chr6 | 160666519 | 160666538 | 160666522 | - |
| SEQ ID NO 36605 | TCTCCAGGGTTCAGAGAGTC | TGG | chr6 | 160666514 | 160666533 | 160666517 | - |
| SEQ ID NO 36606 | CCAGGGTTCAGAGAGTCTGG | CAG | chr6 | 160666511 | 160666530 | 160666514 | - |
| SEQ ID NO 36607 | TTCAGAGAGTCTGGCAGCAT | TGG | chr6 | 160666505 | 160666524 | 160666508 | - |
| SEQ ID NO 36608 | TCAGAGAGTCTGGCAGCATT | GGG | chr6 | 160666504 | 160666523 | 160666507 | - |
| SEQ ID NO 36609 | AGAGAGTCTGGCAGCATTGG | GAG | chr6 | 160666502 | 160666521 | 160666505 | - |
| SEQ ID NO 36610 | GGGAGCTGCCTTGTGTTCTA | CAG | chr6 | 160666484 | 160666503 | 160666487 | - |
| SEQ ID NO 36611 | CCTTGTGTTCTACAGCCTCA | CGG | chr6 | 160666476 | 160666495 | 160666479 | - |
| SEQ ID NO 36612 | GTGTTCTACAGCCTCACGGA | CAG | chr6 | 160666472 | 160666491 | 160666475 | - |
| SEQ ID NO 36613 | TCTACAGCCTCACGGACAGA | CAG | chr6 | 160666468 | 160666487 | 160666471 | - |
| SEQ ID NO 36614 | CTACAGCCTCACGGACAGAC | AGG | chr6 | 160666467 | 160666486 | 160666470 | - |
| SEQ ID NO 36615 | ACAGCCTCACGGACAGACAG | GAG | chr6 | 160666465 | 160666484 | 160666468 | - |
| SEQ ID NO 36616 | CAGCCTCACGGACAGACAGG | AGG | chr6 | 160666464 | 160666483 | 160666467 | - |
| SEQ ID NO 36617 | TCACCACTGCTCTGTTCTTC | TGG | chr6 | 160666437 | 160666456 | 160666440 | - |
| SEQ ID NO 36618 | ACCACTGCTCTGTTCTTCTG | GAG | chr6 | 160666435 | 160666454 | 160666438 | - |
| SEQ ID NO 36619 | GTTTCCTTGTGAACATGTTG | TGG | chr6 | 160666413 | 160666432 | 160666416 | - |
| SEQ ID NO 36620 | TTGTGAACATGTTGTGGACG | TAG | chr6 | 160666407 | 160666426 | 160666410 | - |
| SEQ ID NO 36621 | TTCTTTCATCTTTTTAAACA | CAG | chr6 | 160666377 | 160666396 | 160666380 | - |
| SEQ ID NO 36622 | TCTTTCATCTTTTTAAACAC | AGG | chr6 | 160666376 | 160666395 | 160666379 | - |
| SEQ ID NO 36623 | TTTTTAAACACAGGTACCTT | TGG | chr6 | 160666367 | 160666386 | 160666370 | - |
| SEQ ID NO 36624 | TTTTAAACACAGGTACCTTT | GGG | chr6 | 160666366 | 160666385 | 160666369 | - |
| SEQ ID NO 36625 | TTTAAACACAGGTACCTTTG | GGG | chr6 | 160666365 | 160666384 | 160666368 | - |
| SEQ ID NO 36626 | AACACAGGTACCTTTGGGGC | TGG | chr6 | 160666361 | 160666380 | 160666364 | - |
| SEQ ID NO 36627 | CCTTTGGGGCTGGCTTTCTC | AAG | chr6 | 160666351 | 160666370 | 160666354 | - |
| SEQ ID NO 36628 | CTTTGGGGCTGGCTTTCTCA | AGG | chr6 | 160666350 | 160666369 | 160666353 | - |
| SEQ ID NO 36629 | TGGGGCTGGCTTTCTCAAGG | AAG | chr6 | 160666347 | 160666366 | 160666350 | - |
| SEQ ID NO 36630 | CTGGCTTTCTCAAGGAAGCC | CAG | chr6 | 160666342 | 160666361 | 160666345 | - |
| SEQ ID NO 36631 | AAGCCCAGCTCCCTGTGATT | GAG | chr6 | 160666327 | 160666346 | 160666330 | - |
| SEQ ID NO 36632 | GCTCCCTGTGATTGAGAATG | AAG | chr6 | 160666320 | 160666339 | 160666323 | - |
| SEQ ID NO 36633 | ATGAAGTGTGCAATCGCTAT | GAG | chr6 | 160666303 | 160666322 | 160666306 | - |
| SEQ ID NO 36634 | AATCGCTATGAGTTTCTGAA | TGG | chr6 | 160666292 | 160666311 | 160666295 | - |
| SEQ ID NO 36635 | CGCTATGAGTTTCTGAATGG | AAG | chr6 | 160666289 | 160666308 | 160666292 | - |
| SEQ ID NO 36636 | CTATGAGTTTCTGAATGGAA | GAG | chr6 | 160666287 | 160666306 | 160666290 | - |
| SEQ ID NO 36637 | ATGAAGAGTCAAATCCACT | GAG | chr6 | 160666273 | 160666292 | 160666276 | - |
| SEQ ID NO 36638 | AAATCCACTGAGCTCTGTGC | TGG | chr6 | 160666262 | 160666281 | 160666265 | - |
| SEQ ID NO 36639 | AATCCACTGAGCTCTGTGCT | GGG | chr6 | 160666261 | 160666280 | 160666264 | - |
| SEQ ID NO 36640 | TGAGCTCTGTGCTGGGCATT | TGG | chr6 | 160666254 | 160666273 | 160666257 | - |
| SEQ ID NO 36641 | CTCTGTGCTGGGCATTTGGC | TGG | chr6 | 160666250 | 160666269 | 160666253 | - |
| SEQ ID NO 36642 | CTGTGCTGGGCATTTGGCTG | GAG | chr6 | 160666248 | 160666267 | 160666251 | - |
| SEQ ID NO 36643 | TGTGCTGGGCATTTGGCTGG | AGG | chr6 | 160666247 | 160666266 | 160666250 | - |
| SEQ ID NO 36644 | CATTTGGCTGGAGGCATTGA | CAG | chr6 | 160666238 | 160666257 | 160666241 | - |
| SEQ ID NO 36645 | CTGGAGGCATTGACAGTTGC | AAG | chr6 | 160666231 | 160666250 | 160666234 | - |

Figure 55 (Cont'd)

| SEQ ID | Sequence | Codon | Chr | Start | End | Pos | Strand |
|---|---|---|---|---|---|---|---|
| SEQ ID NO 36646 | TGGAGGCATTGACAGTTGCA | AGG | chr6 | 160666230 | 160666249 | 160666233 | - |
| SEQ ID NO 36647 | GGCATTGACAGTTGCAAGGT | AAG | chr6 | 160666226 | 160666245 | 160666229 | - |
| SEQ ID NO 36648 | TGACAGTTGCAAGGTAAGAA | AAG | chr6 | 160666221 | 160666240 | 160666224 | - |
| SEQ ID NO 36649 | TTGCAAGGTAAGAAAAGATC | AAG | chr6 | 160666215 | 160666234 | 160666218 | - |
| SEQ ID NO 36650 | GCAAGGTAAGAAAAGATCAA | GAG | chr6 | 160666213 | 160666232 | 160666216 | - |
| SEQ ID NO 36651 | AAGAAAAGATCAAGAGACCA | AAG | chr6 | 160666206 | 160666225 | 160666209 | - |
| SEQ ID NO 36652 | AAAGATCAAGAGACCAAAGT | TAG | chr6 | 160666202 | 160666221 | 160666205 | - |
| SEQ ID NO 36653 | AGTCTTGTGCTCTCCTGTCT | CAG | chr6 | 160666181 | 160666200 | 160666184 | - |
| SEQ ID NO 36654 | GTGCTCTCCTGTCTCAGTCT | CAG | chr6 | 160666175 | 160666194 | 160666178 | - |
| SEQ ID NO 36655 | CTGTCTCAGTCTCAGTCCCT | TAG | chr6 | 160666167 | 160666186 | 160666170 | - |
| SEQ ID NO 36656 | AGTCTCAGTCCCTTAGACTT | GAG | chr6 | 160666160 | 160666179 | 160666163 | - |
| SEQ ID NO 36657 | TCCCTTAGACTTGAGTCCCA | AAG | chr6 | 160666152 | 160666171 | 160666155 | - |
| SEQ ID NO 36658 | CTTAGACTTGAGTCCCAAAG | TAG | chr6 | 160666149 | 160666168 | 160666152 | - |
| SEQ ID NO 36659 | AGTCCCAAAGTAGCGAATTC | AAG | chr6 | 160666139 | 160666158 | 160666142 | - |
| SEQ ID NO 36660 | CCCAAAGTAGCGAATTCAAG | TAG | chr6 | 160666136 | 160666155 | 160666139 | - |
| SEQ ID NO 36661 | CCAAAGTAGCGAATTCAAGT | AGG | chr6 | 160666135 | 160666154 | 160666138 | - |
| SEQ ID NO 36662 | TTCAAGTAGGATTTAATCAA | TGG | chr6 | 160666122 | 160666141 | 160666125 | - |
| SEQ ID NO 36663 | AAGTAGGATTTAATCAATGG | AAG | chr6 | 160666119 | 160666138 | 160666122 | - |
| SEQ ID NO 36664 | ATTTAATCAATGGAAGACCC | CAG | chr6 | 160666112 | 160666131 | 160666115 | - |
| SEQ ID NO 36665 | TCAATGGAAGACCCCAGTCT | AAG | chr6 | 160666106 | 160666125 | 160666109 | - |
| SEQ ID NO 36666 | ACCCCAGTCTAAGTGTTGCT | CAG | chr6 | 160666096 | 160666115 | 160666099 | - |
| SEQ ID NO 36667 | AGTGTTGCTCAGAAACTCCC | TAG | chr6 | 160666085 | 160666104 | 160666088 | - |
| SEQ ID NO 36668 | ATCTGTCCCAAATGTATATT | CAG | chr6 | 160666062 | 160666081 | 160666065 | - |
| SEQ ID NO 36669 | AATGTATATTCAGATCATCC | AAG | chr6 | 160666052 | 160666071 | 160666055 | - |
| SEQ ID NO 36670 | ATGTATATTCAGATCATCCA | AGG | chr6 | 160666051 | 160666070 | 160666054 | - |
| SEQ ID NO 36671 | TGTATATTCAGATCATCCAA | GGG | chr6 | 160666050 | 160666069 | 160666053 | - |
| SEQ ID NO 36672 | GTATATTCAGATCATCCAAG | GGG | chr6 | 160666049 | 160666068 | 160666052 | - |
| SEQ ID NO 36673 | GATCATCCAAGGGGACTTCT | TGG | chr6 | 160666040 | 160666059 | 160666043 | - |
| SEQ ID NO 36674 | ATCATCCAAGGGGACTTCTT | GGG | chr6 | 160666039 | 160666058 | 160666042 | - |
| SEQ ID NO 36675 | TCATCCAAGGGGACTTCTTG | GGG | chr6 | 160666038 | 160666057 | 160666041 | - |
| SEQ ID NO 36676 | AAGGGGACTTCTTGGGGCTT | GAG | chr6 | 160666032 | 160666051 | 160666035 | - |
| SEQ ID NO 36677 | ACTTCTTGGGGCTTGAGTTC | CAG | chr6 | 160666026 | 160666045 | 160666029 | - |
| SEQ ID NO 36678 | TTGGGGCTTGAGTTCCAGAT | CAG | chr6 | 160666021 | 160666040 | 160666024 | - |
| SEQ ID NO 36679 | GGGCTTGAGTTCCAGATCAG | CAG | chr6 | 160666018 | 160666037 | 160666021 | - |
| SEQ ID NO 36680 | TTGAGTTCCAGATCAGCAGC | AAG | chr6 | 160666014 | 160666033 | 160666017 | - |
| SEQ ID NO 36681 | TGAGTTCCAGATCAGCAGCA | AGG | chr6 | 160666013 | 160666032 | 160666016 | - |
| SEQ ID NO 36682 | GAGTTCCAGATCAGCAGCAA | GGG | chr6 | 160666012 | 160666031 | 160666015 | - |
| SEQ ID NO 36683 | GTTCCAGATCAGCAGCAAGG | GAG | chr6 | 160666010 | 160666029 | 160666013 | - |
| SEQ ID NO 36684 | ATCAGCAGCAAGGGAGCCAT | AAG | chr6 | 160666003 | 160666022 | 160666006 | - |
| SEQ ID NO 36685 | CATAAGTGCCATAACTACCT | CAG | chr6 | 160665986 | 160666005 | 160665989 | - |
| SEQ ID NO 36686 | CCTCAGACCACTCACCCTCC | TGG | chr6 | 160665969 | 160665988 | 160665972 | - |
| SEQ ID NO 36687 | CTCAGACCACTCACCCTCCT | GGG | chr6 | 160665968 | 160665987 | 160665971 | - |
| SEQ ID NO 36688 | TCAGACCACTCACCCTCCTG | GGG | chr6 | 160665967 | 160665986 | 160665970 | - |
| SEQ ID NO 36689 | CTCACCCTCCTGGGGTGTCC | CGG | chr6 | 160665959 | 160665978 | 160665962 | - |
| SEQ ID NO 36690 | ACCCTCCTGGGGTGTCCCGG | TGG | chr6 | 160665956 | 160665975 | 160665959 | - |
| SEQ ID NO 36691 | TCCTGGGGTGTCCCGGTGGC | CAG | chr6 | 160665952 | 160665971 | 160665955 | - |
| SEQ ID NO 36692 | CCTGGGGTGTCCCGGTGGCC | AGG | chr6 | 160665951 | 160665970 | 160665954 | - |

Figure 55 (Cont'd)

| SEQ ID | Sequence | Codon | Chr | Start | End | Pos | Strand |
|---|---|---|---|---|---|---|---|
| SEQ ID NO 36693 | CTGGGGTGTCCCGGTGGCCA | GGG | chr6 | 160665950 | 160665969 | 160665953 | - |
| SEQ ID NO 36694 | GTCCCGGTGGCCAGGGACTA | AAG | chr6 | 160665943 | 160665962 | 160665946 | - |
| SEQ ID NO 36695 | CCGGTGGCCAGGGACTAAAG | TGG | chr6 | 160665940 | 160665959 | 160665943 | - |
| SEQ ID NO 36696 | GACTAAAGTGGTGATTTTTC | TGG | chr6 | 160665928 | 160665947 | 160665931 | - |
| SEQ ID NO 36697 | TAAAGTGGTGATTTTTCTGG | TAG | chr6 | 160665925 | 160665944 | 160665928 | - |
| SEQ ID NO 36698 | AAAGTGGTGATTTTTCTGGT | AGG | chr6 | 160665924 | 160665943 | 160665927 | - |
| SEQ ID NO 36699 | AAGTGGTGATTTTTCTGGTA | GGG | chr6 | 160665923 | 160665942 | 160665926 | - |
| SEQ ID NO 36700 | TGGTGATTTTTCTGGTAGGG | AAG | chr6 | 160665920 | 160665939 | 160665923 | - |
| SEQ ID NO 36701 | GGTGATTTTTCTGGTAGGGA | AGG | chr6 | 160665919 | 160665938 | 160665922 | - |
| SEQ ID NO 36702 | TGATTTTTCTGGTAGGGAAG | GAG | chr6 | 160665917 | 160665936 | 160665920 | - |
| SEQ ID NO 36703 | GATTTTTCTGGTAGGGAAGG | AGG | chr6 | 160665916 | 160665935 | 160665919 | - |
| SEQ ID NO 36704 | TTTTCTGGTAGGGAAGGAGG | TAG | chr6 | 160665913 | 160665932 | 160665916 | - |
| SEQ ID NO 36705 | TTCTGGTAGGGAAGGAGGTA | GAG | chr6 | 160665911 | 160665930 | 160665914 | - |
| SEQ ID NO 36706 | TCTGGTAGGGAAGGAGGTAG | AGG | chr6 | 160665910 | 160665929 | 160665913 | - |
| SEQ ID NO 36707 | CTGGTAGGGAAGGAGGTAGA | GGG | chr6 | 160665909 | 160665928 | 160665912 | - |
| SEQ ID NO 36708 | AGGGAAGGAGGTAGAGGGTA | CAG | chr6 | 160665904 | 160665923 | 160665907 | - |
| SEQ ID NO 36709 | GGGAAGGAGGTAGAGGGTAC | AGG | chr6 | 160665903 | 160665922 | 160665906 | - |
| SEQ ID NO 36710 | AGGAGGTAGAGGGTACAGGA | CAG | chr6 | 160665899 | 160665918 | 160665902 | - |
| SEQ ID NO 36711 | GAGGTAGAGGGTACAGGACA | GAG | chr6 | 160665897 | 160665916 | 160665900 | - |
| SEQ ID NO 36712 | ACTAACTGCACACAATATCT | GAG | chr6 | 160665874 | 160665893 | 160665877 | - |
| SEQ ID NO 36713 | CTGCACACAATATCTGAGAC | TGG | chr6 | 160665869 | 160665888 | 160665872 | - |
| SEQ ID NO 36714 | GCACACAATATCTGAGACTG | GAG | chr6 | 160665867 | 160665886 | 160665870 | - |
| SEQ ID NO 36715 | CAATATCTGAGACTGGAGCT | CAG | chr6 | 160665862 | 160665881 | 160665865 | - |
| SEQ ID NO 36716 | GCTCAGATATTGCTGATGAT | CAG | chr6 | 160665845 | 160665864 | 160665848 | - |
| SEQ ID NO 36717 | TCAGATATTGCTGATGATCA | GAG | chr6 | 160665843 | 160665862 | 160665846 | - |
| SEQ ID NO 36718 | ATATTGCTGATGATCAGAGT | TGG | chr6 | 160665839 | 160665858 | 160665842 | - |
| SEQ ID NO 36719 | CTCCCCAATTGATTTACAAC | TGG | chr6 | 160665811 | 160665830 | 160665814 | - |
| SEQ ID NO 36720 | TCCCCAATTGATTTACAACT | GGG | chr6 | 160665810 | 160665829 | 160665813 | - |
| SEQ ID NO 36721 | CCCCAATTGATTTACAACTG | GGG | chr6 | 160665809 | 160665828 | 160665812 | - |
| SEQ ID NO 36722 | ATTGATTTACAACTGGGGCT | TGG | chr6 | 160665804 | 160665823 | 160665807 | - |
| SEQ ID NO 36723 | GGCTTGGATACTGTTTTAAA | CGG | chr6 | 160665788 | 160665807 | 160665791 | - |
| SEQ ID NO 36724 | GCTTGGATACTGTTTTAAAC | GGG | chr6 | 160665787 | 160665806 | 160665790 | - |
| SEQ ID NO 36725 | TTGGATACTGTTTTAAACGG | GAG | chr6 | 160665785 | 160665804 | 160665788 | - |
| SEQ ID NO 36726 | TGGATACTGTTTTAAACGGG | AGG | chr6 | 160665784 | 160665803 | 160665787 | - |
| SEQ ID NO 36727 | GATACTGTTTTAAACGGGAG | GAG | chr6 | 160665782 | 160665801 | 160665785 | - |
| SEQ ID NO 36728 | AACCACTGACGTGACTACAC | TAG | chr6 | 160665739 | 160665758 | 160665742 | - |
| SEQ ID NO 36729 | CCACTGACGTGACTACACTA | GAG | chr6 | 160665737 | 160665756 | 160665740 | - |
| SEQ ID NO 36730 | TGACGTGACTACACTAGAGA | TAG | chr6 | 160665733 | 160665752 | 160665736 | - |
| SEQ ID NO 36731 | CCACTCTTGCTTTACTTCAT | GAG | chr6 | 160665690 | 160665709 | 160665693 | - |
| SEQ ID NO 36732 | CTTCATGAGAACGAAAATGT | AAG | chr6 | 160665676 | 160665695 | 160665679 | - |
| SEQ ID NO 36733 | TTGCACCATGAATTCATTTG | CGG | chr6 | 160665652 | 160665671 | 160665655 | - |
| SEQ ID NO 36734 | ACCATGAATTCATTTGCGGA | AAG | chr6 | 160665648 | 160665667 | 160665651 | - |
| SEQ ID NO 36735 | TTATTTTATTTTATTTTATT | GAG | chr6 | 160665585 | 160665604 | 160665588 | - |
| SEQ ID NO 36736 | TTTTATTGAGACTCTCACCC | CGG | chr6 | 160665572 | 160665591 | 160665575 | - |
| SEQ ID NO 36737 | TGAGACTCTCACCCCGGTTG | AAG | chr6 | 160665566 | 160665585 | 160665569 | - |
| SEQ ID NO 36738 | GAAGTGCACTGACGTGATTT | TGG | chr6 | 160665547 | 160665566 | 160665550 | - |
| SEQ ID NO 36739 | TCACTGCAACTTCCACCTCC | TGG | chr6 | 160665523 | 160665542 | 160665526 | - |

Figure 55 (Cont'd)

| | | | | | | | |
|---|---|---|---|---|---|---|---|
| SEQ ID NO 36740 | CACTGCAACTTCCACCTCCT | GGG | chr6 | 160665522 | 160665541 | 160665525 | - |
| SEQ ID NO 36741 | AACTTCCACCTCCTGGGTTC | AAG | chr6 | 160665516 | 160665535 | 160665519 | - |
| SEQ ID NO 36742 | CTGGGTTCAAGTGAATACTC | CAG | chr6 | 160665504 | 160665523 | 160665507 | - |
| SEQ ID NO 36743 | AGTGAATACTCCAGCCTCCC | TAG | chr6 | 160665495 | 160665514 | 160665498 | - |
| SEQ ID NO 36744 | GAATACTCCAGCCTCCCTAG | TAG | chr6 | 160665492 | 160665511 | 160665495 | - |
| SEQ ID NO 36745 | ACTCCAGCCTCCCTAGTAGC | TGG | chr6 | 160665488 | 160665507 | 160665491 | - |
| SEQ ID NO 36746 | CTCCAGCCTCCCTAGTAGCT | GGG | chr6 | 160665487 | 160665506 | 160665490 | - |
| SEQ ID NO 36747 | CTCCCTAGTAGCTGGGATTA | CAG | chr6 | 160665480 | 160665499 | 160665483 | - |
| SEQ ID NO 36748 | TCCCTAGTAGCTGGGATTAC | AGG | chr6 | 160665479 | 160665498 | 160665482 | - |
| SEQ ID NO 36749 | CAGGTGCCCACCACCACGCC | TGG | chr6 | 160665460 | 160665479 | 160665463 | - |
| SEQ ID NO 36750 | CTGGCTAATTTTTGTATTTT | TAG | chr6 | 160665441 | 160665460 | 160665444 | - |
| SEQ ID NO 36751 | GCTAATTTTTGTATTTTTAG | TAG | chr6 | 160665438 | 160665457 | 160665441 | - |
| SEQ ID NO 36752 | TAATTTTTGTATTTTTAGTA | GAG | chr6 | 160665436 | 160665455 | 160665439 | - |
| SEQ ID NO 36753 | TTTTGTATTTTTAGTAGAGA | TGG | chr6 | 160665432 | 160665451 | 160665435 | - |
| SEQ ID NO 36754 | TTTGTATTTTTAGTAGAGAT | GGG | chr6 | 160665431 | 160665450 | 160665434 | - |
| SEQ ID NO 36755 | TTGTATTTTTAGTAGAGATG | GGG | chr6 | 160665430 | 160665449 | 160665433 | - |
| SEQ ID NO 36756 | GAGATGGGGTTTCACCACAT | TGG | chr6 | 160665416 | 160665435 | 160665419 | - |
| SEQ ID NO 36757 | GGGGTTTCACCACATTGGCC | TGG | chr6 | 160665411 | 160665430 | 160665414 | - |
| SEQ ID NO 36758 | TTTCACCACATTGGCCTGGC | TGG | chr6 | 160665407 | 160665426 | 160665410 | - |
| SEQ ID NO 36759 | ACCTTGTGATCCACCTGTCT | TGG | chr6 | 160665371 | 160665390 | 160665374 | - |
| SEQ ID NO 36760 | CCACCTGTCTTGGCCTCCCA | AAG | chr6 | 160665361 | 160665380 | 160665364 | - |
| SEQ ID NO 36761 | GTCTTGGCCTCCCAAAGTGC | TGG | chr6 | 160665355 | 160665374 | 160665358 | - |
| SEQ ID NO 36762 | TCTTGGCCTCCCAAAGTGCT | GGG | chr6 | 160665354 | 160665373 | 160665357 | - |
| SEQ ID NO 36763 | CTCCCAAAGTGCTGGGATTA | CAG | chr6 | 160665347 | 160665366 | 160665350 | - |
| SEQ ID NO 36764 | CCCAAAGTGCTGGGATTACA | GAG | chr6 | 160665345 | 160665364 | 160665348 | - |
| SEQ ID NO 36765 | AGTGCTGGGATTACAGAGTT | GAG | chr6 | 160665340 | 160665359 | 160665343 | - |
| SEQ ID NO 36766 | AAATATTTATTTATTTATTT | AAG | chr6 | 160665285 | 160665304 | 160665288 | - |
| SEQ ID NO 36767 | TTTATTTAAGCCACAACTAC | TAG | chr6 | 160665272 | 160665291 | 160665275 | - |
| SEQ ID NO 36768 | TTAAGCCACAACTACTAGAA | TAG | chr6 | 160665267 | 160665286 | 160665270 | - |
| SEQ ID NO 36769 | TAAGCCACAACTACTAGAAT | AGG | chr6 | 160665266 | 160665285 | 160665269 | - |
| SEQ ID NO 36770 | GCCACAACTACTAGAATAGG | AAG | chr6 | 160665263 | 160665282 | 160665266 | - |
| SEQ ID NO 36771 | CCACAACTACTAGAATAGGA | AGG | chr6 | 160665262 | 160665281 | 160665265 | - |
| SEQ ID NO 36772 | GATATTTTATTAATTTTATT | TGG | chr6 | 160665236 | 160665255 | 160665239 | - |
| SEQ ID NO 36773 | ATTATTTTTTTTCTTTCCT | GAG | chr6 | 160665208 | 160665227 | 160665211 | - |
| SEQ ID NO 36774 | GACATTCTTGCTCTGTCACC | CAG | chr6 | 160665186 | 160665205 | 160665189 | - |
| SEQ ID NO 36775 | ACATTCTTGCTCTGTCACCC | AGG | chr6 | 160665185 | 160665204 | 160665188 | - |
| SEQ ID NO 36776 | TCTTGCTCTGTCACCCAGGC | TGG | chr6 | 160665181 | 160665200 | 160665184 | - |
| SEQ ID NO 36777 | TTGCTCTGTCACCCAGGCTG | GAG | chr6 | 160665179 | 160665198 | 160665182 | - |
| SEQ ID NO 36778 | CTGTCACCCAGGCTGGAGTG | CAG | chr6 | 160665174 | 160665193 | 160665177 | - |
| SEQ ID NO 36779 | TCACCCAGGCTGGAGTGCAG | TGG | chr6 | 160665171 | 160665190 | 160665174 | - |
| SEQ ID NO 36780 | GGAGTGCAGTGGCACATTCT | TGG | chr6 | 160665160 | 160665179 | 160665163 | - |
| SEQ ID NO 36781 | AACCTCCATCTCCTGTGTTC | AAG | chr6 | 160665129 | 160665148 | 160665132 | - |
| SEQ ID NO 36782 | CTCCTGTGTTCAAGCAATTC | TAG | chr6 | 160665120 | 160665139 | 160665123 | - |
| SEQ ID NO 36783 | TTCAAGCAATTCTAGTGCCT | CAG | chr6 | 160665112 | 160665131 | 160665115 | - |
| SEQ ID NO 36784 | TTCTAGTGCCTCAGCCTACT | TAG | chr6 | 160665103 | 160665122 | 160665106 | - |
| SEQ ID NO 36785 | TAGTGCCTCAGCCTACTTAG | TAG | chr6 | 160665100 | 160665119 | 160665103 | - |
| SEQ ID NO 36786 | GCCTCAGCCTACTTAGTAGC | TGG | chr6 | 160665096 | 160665115 | 160665099 | - |

Figure 55 (Cont'd)

| SEQ ID NO | Sequence | PAM | Chr | Start | End | Cut | Strand |
|---|---|---|---|---|---|---|---|
| SEQ ID NO 36787 | CCTCAGCCTACTTAGTAGCT | GGG | chr6 | 160665095 | 160665114 | 160665098 | - |
| SEQ ID NO 36788 | TACTTAGTAGCTGGGATGAC | TGG | chr6 | 160665087 | 160665106 | 160665090 | - |
| SEQ ID NO 36789 | CTGGCATGTGCCTCCACACC | CAG | chr6 | 160665068 | 160665087 | 160665071 | - |
| SEQ ID NO 36790 | GCTAATTTTTGTATTTTTTG | TAG | chr6 | 160665046 | 160665065 | 160665049 | - |
| SEQ ID NO 36791 | TAATTTTTGTATTTTTTGTA | GAG | chr6 | 160665044 | 160665063 | 160665047 | - |
| SEQ ID NO 36792 | TTTTGTATTTTTGTAGAGA | CAG | chr6 | 160665040 | 160665059 | 160665043 | - |
| SEQ ID NO 36793 | TTTGTATTTTTGTAGAGAC | AGG | chr6 | 160665039 | 160665058 | 160665042 | - |
| SEQ ID NO 36794 | TTGTATTTTTGTAGAGACA | GGG | chr6 | 160665038 | 160665057 | 160665041 | - |
| SEQ ID NO 36795 | TTTTTGTAGAGACAGGGTTT | TGG | chr6 | 160665032 | 160665051 | 160665035 | - |
| SEQ ID NO 36796 | CAGGGTTTTGGCATGTTGCC | CAG | chr6 | 160665020 | 160665039 | 160665023 | - |
| SEQ ID NO 36797 | AGGGTTTTGGCATGTTGCCC | AGG | chr6 | 160665019 | 160665038 | 160665022 | - |
| SEQ ID NO 36798 | CCAGGCTTGTCTCAAACTCC | TGG | chr6 | 160665001 | 160665020 | 160665004 | - |
| SEQ ID NO 36799 | TTGTCTCAAACTCCTGGCCT | CAG | chr6 | 160664995 | 160665014 | 160664998 | - |
| SEQ ID NO 36800 | TGTCTCAAACTCCTGGCCTC | AGG | chr6 | 160664994 | 160665013 | 160664997 | - |
| SEQ ID NO 36801 | CTCAGGTGATCCATCTGCCG | TGG | chr6 | 160664977 | 160664996 | 160664980 | - |
| SEQ ID NO 36802 | GCCGTGGCCTCCCAAAATGC | TGG | chr6 | 160664961 | 160664980 | 160664964 | - |
| SEQ ID NO 36803 | CCGTGGCCTCCCAAAATGCT | GGG | chr6 | 160664960 | 160664979 | 160664963 | - |
| SEQ ID NO 36804 | CTCCCAAAATGCTGGGATTA | TAG | chr6 | 160664953 | 160664972 | 160664956 | - |
| SEQ ID NO 36805 | TCCCAAAATGCTGGGATTAT | AGG | chr6 | 160664952 | 160664971 | 160664955 | - |
| SEQ ID NO 36806 | AATGCTGGGATTATAGGCAT | GAG | chr6 | 160664946 | 160664965 | 160664949 | - |
| SEQ ID NO 36807 | CATGAGCCACCACCCCTCC | TGG | chr6 | 160664929 | 160664948 | 160664932 | - |
| SEQ ID NO 36808 | GAGCCACCACCCCTCCTGG | AAG | chr6 | 160664926 | 160664945 | 160664929 | - |
| SEQ ID NO 36809 | AGCCACCACCCCTCCTGGA | AGG | chr6 | 160664925 | 160664944 | 160664928 | - |
| SEQ ID NO 36810 | TATAACATAATTTATAATTA | CAG | chr6 | 160664892 | 160664911 | 160664895 | - |
| SEQ ID NO 36811 | TATAATTACAGAAAACATGT | GAG | chr6 | 160664880 | 160664899 | 160664883 | - |
| SEQ ID NO 36812 | CAGAAAACATGTGAGTTCAC | TAG | chr6 | 160664872 | 160664891 | 160664875 | - |
| SEQ ID NO 36813 | AGAAAACATGTGAGTTCACT | AGG | chr6 | 160664871 | 160664890 | 160664874 | - |
| SEQ ID NO 36814 | CTAGGAATAAATAAATTTTG | AAG | chr6 | 160664853 | 160664872 | 160664856 | - |
| SEQ ID NO 36815 | ATAAATTTTGAAGATAATAA | AAG | chr6 | 160664843 | 160664862 | 160664846 | - |
| SEQ ID NO 36816 | TTTCACTTATGTTGTCATTT | CGG | chr6 | 160664818 | 160664837 | 160664821 | - |
| SEQ ID NO 36817 | CTTATGTTGTCATTTCGGCA | CAG | chr6 | 160664813 | 160664832 | 160664816 | - |
| SEQ ID NO 36818 | GTTGTCATTTCGGCACAGTT | TGG | chr6 | 160664808 | 160664827 | 160664811 | - |
| SEQ ID NO 36819 | CATTTCGGCACAGTTTGGTA | TAG | chr6 | 160664803 | 160664822 | 160664806 | - |
| SEQ ID NO 36820 | ATTTCGGCACAGTTTGGTAT | AGG | chr6 | 160664802 | 160664821 | 160664805 | - |
| SEQ ID NO 36821 | GCACAGTTTGGTATAGGATG | TGG | chr6 | 160664796 | 160664815 | 160664799 | - |
| SEQ ID NO 36822 | ACAGTTTGGTATAGGATGTG | GAG | chr6 | 160664794 | 160664813 | 160664797 | - |
| SEQ ID NO 36823 | GAGATGTTAACATTTATACC | TAG | chr6 | 160664774 | 160664793 | 160664777 | - |
| SEQ ID NO 36824 | ACCTAGCTTGCTCGTAAACT | AAG | chr6 | 160664757 | 160664776 | 160664760 | - |
| SEQ ID NO 36825 | GCTCGTAAACTAAGACCTGA | AAG | chr6 | 160664748 | 160664767 | 160664751 | - |
| SEQ ID NO 36826 | CTCGTAAACTAAGACCTGAA | AGG | chr6 | 160664747 | 160664766 | 160664750 | - |
| SEQ ID NO 36827 | TCGTAAACTAAGACCTGAAA | GGG | chr6 | 160664746 | 160664765 | 160664749 | - |
| SEQ ID NO 36828 | CCTGAAAGGGTTGTGTCTAT | CAG | chr6 | 160664733 | 160664752 | 160664736 | - |
| SEQ ID NO 36829 | GTGTCTATCAGCTGCACCCC | TGG | chr6 | 160664721 | 160664740 | 160664724 | - |
| SEQ ID NO 36830 | TGTCTATCAGCTGCACCCCT | GGG | chr6 | 160664720 | 160664739 | 160664723 | - |
| SEQ ID NO 36831 | CTATCAGCTGCACCCCTGGG | TAG | chr6 | 160664717 | 160664736 | 160664720 | - |
| SEQ ID NO 36832 | CCTGGGTAGCGACACAACCT | CGG | chr6 | 160664703 | 160664722 | 160664706 | - |
| SEQ ID NO 36833 | CTGGGTAGCGACACAACCTC | GGG | chr6 | 160664702 | 160664721 | 160664705 | - |

Figure 55 (Cont'd)

| SEQ ID | Sequence | Codon | Chr | Start | End | Pos | Strand |
|---|---|---|---|---|---|---|---|
| SEQ ID NO 36834 | GGTAGCGACACAACCTCGGG | AAG | chr6 | 160664699 | 160664718 | 160664702 | - |
| SEQ ID NO 36835 | GTAGCGACACAACCTCGGGA | AGG | chr6 | 160664698 | 160664717 | 160664701 | - |
| SEQ ID NO 36836 | ACACAACCTCGGGAAGGCCT | CAG | chr6 | 160664692 | 160664711 | 160664695 | - |
| SEQ ID NO 36837 | GCCTCAGCCCCTCCTCGTA | CAG | chr6 | 160664676 | 160664695 | 160664679 | - |
| SEQ ID NO 36838 | CCTCGTACAGCACTGCCTGT | TGG | chr6 | 160664663 | 160664682 | 160664666 | - |
| SEQ ID NO 36839 | GTACAGCACTGCCTGTTGGA | AAG | chr6 | 160664659 | 160664678 | 160664662 | - |
| SEQ ID NO 36840 | CACTGCCTGTTGGAAAGCTT | GAG | chr6 | 160664653 | 160664672 | 160664656 | - |
| SEQ ID NO 36841 | ACTGCCTGTTGGAAAGCTTG | AGG | chr6 | 160664652 | 160664671 | 160664655 | - |
| SEQ ID NO 36842 | CTGCCTGTTGGAAAGCTTGA | GGG | chr6 | 160664651 | 160664670 | 160664654 | - |
| SEQ ID NO 36843 | GCCTGTTGGAAAGCTTGAGG | GAG | chr6 | 160664649 | 160664668 | 160664652 | - |
| SEQ ID NO 36844 | CCTGTTGGAAAGCTTGAGGG | AGG | chr6 | 160664648 | 160664667 | 160664651 | - |
| SEQ ID NO 36845 | GGAAAGCTTGAGGGAGGCTA | TGG | chr6 | 160664642 | 160664661 | 160664645 | - |
| SEQ ID NO 36846 | TGAGGGAGGCTATGGATGTG | CAG | chr6 | 160664634 | 160664653 | 160664637 | - |
| SEQ ID NO 36847 | GGCTATGGATGTGCAGCACT | TGG | chr6 | 160664627 | 160664646 | 160664630 | - |
| SEQ ID NO 36848 | TATGGATGTGCAGCACTTGG | CAG | chr6 | 160664624 | 160664643 | 160664627 | - |
| SEQ ID NO 36849 | TGGATGTGCAGCACTTGGCA | GAG | chr6 | 160664622 | 160664641 | 160664625 | - |
| SEQ ID NO 36850 | GGATGTGCAGCACTTGGCAG | AGG | chr6 | 160664621 | 160664640 | 160664624 | - |
| SEQ ID NO 36851 | GATGTGCAGCACTTGGCAGA | GGG | chr6 | 160664620 | 160664639 | 160664623 | - |
| SEQ ID NO 36852 | GCAGCACTTGGCAGAGGGTC | TGG | chr6 | 160664615 | 160664634 | 160664618 | - |
| SEQ ID NO 36853 | CTTGGCAGAGGGTCTGGTCA | TGG | chr6 | 160664609 | 160664628 | 160664612 | - |
| SEQ ID NO 36854 | GGCAGAGGGTCTGGTCATGG | AAG | chr6 | 160664606 | 160664625 | 160664609 | - |
| SEQ ID NO 36855 | GGTCTGGTCATGGAAGTTAC | CAG | chr6 | 160664599 | 160664618 | 160664602 | - |
| SEQ ID NO 36856 | TGGAAGTTACCAGCAAATAT | GAG | chr6 | 160664589 | 160664608 | 160664592 | - |
| SEQ ID NO 36857 | TATGATTTTATTTTATCCAA | AAG | chr6 | 160664559 | 160664578 | 160664562 | - |
| SEQ ID NO 36858 | ATTTTATTTTATCCAAAAGA | AAG | chr6 | 160664555 | 160664574 | 160664558 | - |
| SEQ ID NO 36859 | TTTATTTTATCCAAAAGAAA | GAG | chr6 | 160664553 | 160664572 | 160664556 | - |
| SEQ ID NO 36860 | ATCCAAAAGAAAGAGAATGA | AAG | chr6 | 160664545 | 160664564 | 160664548 | - |
| SEQ ID NO 36861 | CAAAAGAAAGAGAATGAAAG | AAG | chr6 | 160664542 | 160664561 | 160664545 | - |
| SEQ ID NO 36862 | AAAGAAAGAGAATGAAAGAA | GAG | chr6 | 160664540 | 160664559 | 160664543 | - |
| SEQ ID NO 36863 | AAGAAAGAGAATGAAAGAAG | AGG | chr6 | 160664539 | 160664558 | 160664542 | - |
| SEQ ID NO 36864 | AGAAAGAGAATGAAAGAAGA | GGG | chr6 | 160664538 | 160664557 | 160664541 | - |
| SEQ ID NO 36865 | GAAAGAGAATGAAAGAAGAG | GGG | chr6 | 160664537 | 160664556 | 160664540 | - |
| SEQ ID NO 36866 | AAGAGAATGAAAGAAGAGGG | GAG | chr6 | 160664535 | 160664554 | 160664538 | - |
| SEQ ID NO 36867 | AGAGAATGAAAGAAGAGGGG | AGG | chr6 | 160664534 | 160664553 | 160664537 | - |
| SEQ ID NO 36868 | GAAAGAAGAGGGGAGGAAAC | AAG | chr6 | 160664527 | 160664546 | 160664530 | - |
| SEQ ID NO 36869 | GGGGAGGAAACAAGACTAAT | CAG | chr6 | 160664518 | 160664537 | 160664521 | - |
| SEQ ID NO 36870 | GGGAGGAAACAAGACTAATC | AGG | chr6 | 160664517 | 160664536 | 160664520 | - |
| SEQ ID NO 36871 | GGAAACAAGACTAATCAGGA | AAG | chr6 | 160664513 | 160664532 | 160664516 | - |
| SEQ ID NO 36872 | AAGACTAATCAGGAAAGATG | AAG | chr6 | 160664507 | 160664526 | 160664510 | - |
| SEQ ID NO 36873 | AGACTAATCAGGAAAGATGA | AGG | chr6 | 160664506 | 160664525 | 160664509 | - |
| SEQ ID NO 36874 | AATCAGGAAAGATGAAGGTC | TAG | chr6 | 160664501 | 160664520 | 160664504 | - |
| SEQ ID NO 36875 | ATCAGGAAAGATGAAGGTCT | AGG | chr6 | 160664500 | 160664519 | 160664503 | - |
| SEQ ID NO 36876 | TCAGGAAAGATGAAGGTCTA | GGG | chr6 | 160664499 | 160664518 | 160664502 | - |
| SEQ ID NO 36877 | CAGGAAAGATGAAGGTCTAG | GGG | chr6 | 160664498 | 160664517 | 160664501 | - |
| SEQ ID NO 36878 | AAAGATGAAGGTCTAGGGGT | GAG | chr6 | 160664494 | 160664513 | 160664497 | - |
| SEQ ID NO 36879 | AAGATGAAGGTCTAGGGGTG | AGG | chr6 | 160664493 | 160664512 | 160664496 | - |
| SEQ ID NO 36880 | AGATGAAGGTCTAGGGGTGA | GGG | chr6 | 160664492 | 160664511 | 160664495 | - |

Figure 55 (Cont'd)

| SEQ ID NO 36881 | TGAAGGTCTAGGGGTGAGGG | AAG | chr6 | 160664489 | 160664508 | 160664492 | - |
| SEQ ID NO 36882 | GAAGGTCTAGGGGTGAGGGA | AGG | chr6 | 160664488 | 160664507 | 160664491 | - |
| SEQ ID NO 36883 | AGGTCTAGGGGTGAGGGAAG | GAG | chr6 | 160664486 | 160664505 | 160664489 | - |
| SEQ ID NO 36884 | CTAGGGGTGAGGGAAGGAGT | AAG | chr6 | 160664482 | 160664501 | 160664485 | - |
| SEQ ID NO 36885 | TAGGGGTGAGGGAAGGAGTA | AGG | chr6 | 160664481 | 160664500 | 160664484 | - |
| SEQ ID NO 36886 | GGGGTGAGGGAAGGAGTAAG | GAG | chr6 | 160664479 | 160664498 | 160664482 | - |
| SEQ ID NO 36887 | GGAAGGAGTAAGGAGACATA | AAG | chr6 | 160664471 | 160664490 | 160664474 | - |
| SEQ ID NO 36888 | GAAGGAGTAAGGAGACATAA | AGG | chr6 | 160664470 | 160664489 | 160664473 | - |
| SEQ ID NO 36889 | AAGGAGACATAAAGGCAATG | TGG | chr6 | 160664462 | 160664481 | 160664465 | - |
| SEQ ID NO 36890 | GGAGACATAAAGGCAATGTG | GAG | chr6 | 160664460 | 160664479 | 160664463 | - |
| SEQ ID NO 36891 | GACATAAAGGCAATGTGGAG | CAG | chr6 | 160664457 | 160664476 | 160664460 | - |
| SEQ ID NO 36892 | AAAGGCAATGTGGAGCAGCT | GAG | chr6 | 160664452 | 160664471 | 160664455 | - |
| SEQ ID NO 36893 | AAGGCAATGTGGAGCAGCTG | AGG | chr6 | 160664451 | 160664470 | 160664454 | - |
| SEQ ID NO 36894 | AGGCAATGTGGAGCAGCTGA | GGG | chr6 | 160664450 | 160664469 | 160664453 | - |
| SEQ ID NO 36895 | GGCAATGTGGAGCAGCTGAG | GGG | chr6 | 160664449 | 160664468 | 160664452 | - |
| SEQ ID NO 36896 | GCAATGTGGAGCAGCTGAGG | GGG | chr6 | 160664448 | 160664467 | 160664451 | - |
| SEQ ID NO 36897 | CAATGTGGAGCAGCTGAGGG | GGG | chr6 | 160664447 | 160664466 | 160664450 | - |
| SEQ ID NO 36898 | GGAGCAGCTGAGGGGGGAAA | TGG | chr6 | 160664441 | 160664460 | 160664444 | - |
| SEQ ID NO 36899 | AAATGGCTTTCACCACTTCC | CAG | chr6 | 160664424 | 160664443 | 160664427 | - |
| SEQ ID NO 36900 | TGCACTCTCAAATATTTTAT | AAG | chr6 | 160664388 | 160664407 | 160664391 | - |
| SEQ ID NO 36901 | TTTTATAAGACTCTATATTC | AAG | chr6 | 160664374 | 160664393 | 160664377 | - |
| SEQ ID NO 36902 | TTTATAAGACTCTATATTCA | AGG | chr6 | 160664373 | 160664392 | 160664376 | - |
| SEQ ID NO 36903 | GGTAATGTTTGAACCCTGCT | GAG | chr6 | 160664352 | 160664371 | 160664355 | - |
| SEQ ID NO 36904 | ATGTTTGAACCCTGCTGAGC | CAG | chr6 | 160664348 | 160664367 | 160664351 | - |
| SEQ ID NO 36905 | TTTGAACCCTGCTGAGCCAG | TGG | chr6 | 160664345 | 160664364 | 160664348 | - |
| SEQ ID NO 36906 | ACCCTGCTGAGCCAGTGGCA | TGG | chr6 | 160664340 | 160664359 | 160664343 | - |
| SEQ ID NO 36907 | CCCTGCTGAGCCAGTGGCAT | GGG | chr6 | 160664339 | 160664358 | 160664342 | - |
| SEQ ID NO 36908 | AGCCAGTGGCATGGGTCTCT | GAG | chr6 | 160664331 | 160664350 | 160664334 | - |
| SEQ ID NO 36909 | CCAGTGGCATGGGTCTCTGA | GAG | chr6 | 160664329 | 160664348 | 160664332 | - |
| SEQ ID NO 36910 | ATTAACTTAATTTGACTATC | TGG | chr6 | 160664302 | 160664321 | 160664305 | - |
| SEQ ID NO 36911 | TAATTTGACTATCTGGTTTG | TGG | chr6 | 160664295 | 160664314 | 160664298 | - |
| SEQ ID NO 36912 | AATTTGACTATCTGGTTTGT | GGG | chr6 | 160664294 | 160664313 | 160664297 | - |
| SEQ ID NO 36913 | GGGTGCGTTTACTCTCATGT | AAG | chr6 | 160664274 | 160664293 | 160664277 | - |
| SEQ ID NO 36914 | CATGTAAGTCAACAATGTCC | TGG | chr6 | 160664259 | 160664278 | 160664262 | - |
| SEQ ID NO 36915 | ATGTAAGTCAACAATGTCCT | GGG | chr6 | 160664258 | 160664277 | 160664261 | - |
| SEQ ID NO 36916 | AGTCAACAATGTCCTGGGAT | TGG | chr6 | 160664253 | 160664272 | 160664256 | - |
| SEQ ID NO 36917 | GTCAACAATGTCCTGGGATT | GGG | chr6 | 160664252 | 160664271 | 160664255 | - |
| SEQ ID NO 36918 | TGGGATTGGGACACACTTTC | TGG | chr6 | 160664239 | 160664258 | 160664242 | - |
| SEQ ID NO 36919 | GGGATTGGGACACACTTTCT | GGG | chr6 | 160664238 | 160664257 | 160664241 | - |
| SEQ ID NO 36920 | ACACACTTTCTGGGCACTGC | TGG | chr6 | 160664229 | 160664248 | 160664232 | - |
| SEQ ID NO 36921 | ACTTTCTGGGCACTGCTGGC | CAG | chr6 | 160664225 | 160664244 | 160664228 | - |
| SEQ ID NO 36922 | ACTGCTGGCCAGTCCCAAAA | TGG | chr6 | 160664214 | 160664233 | 160664217 | - |
| SEQ ID NO 36923 | CCAGTCCCAAAATGGAACAT | AAG | chr6 | 160664206 | 160664225 | 160664209 | - |
| SEQ ID NO 36924 | CAGTCCCAAAATGGAACATA | AGG | chr6 | 160664205 | 160664224 | 160664208 | - |
| SEQ ID NO 36925 | TCCCAAAATGGAACATAAGG | AAG | chr6 | 160664202 | 160664221 | 160664205 | - |
| SEQ ID NO 36926 | CAAAATGGAACATAAGGAAG | TGG | chr6 | 160664199 | 160664218 | 160664202 | - |
| SEQ ID NO 36927 | ACTTCTTTTATTTCTGAAAT | CAG | chr6 | 160664169 | 160664188 | 160664172 | - |

Figure 55 (Cont'd)

| SEQ ID NO 36928 | CTTCTTTTATTTCTGAAATC | AGG | chr6 | 160664168 | 160664187 | 160664171 | - |
| SEQ ID NO 36929 | TTTTATTTCTGAAATCAGGT | AAG | chr6 | 160664164 | 160664183 | 160664167 | - |
| SEQ ID NO 36930 | TTCTGAAATCAGGTAAGACA | TAG | chr6 | 160664158 | 160664177 | 160664161 | - |
| SEQ ID NO 36931 | ACATAGTTTTTTAAATTAT | AAG | chr6 | 160664141 | 160664160 | 160664144 | - |
| SEQ ID NO 36932 | TTATTTTTCTCCCACAATG | TAG | chr6 | 160664116 | 160664135 | 160664119 | - |
| SEQ ID NO 36933 | TAGTAAAAATACATATGCCA | TGG | chr6 | 160664096 | 160664115 | 160664099 | - |
| SEQ ID NO 36934 | TTTTTGATTCATGAAATTCC | CAG | chr6 | 160664052 | 160664071 | 160664055 | - |
| SEQ ID NO 36935 | TGAAAAATTCTTAAAAAAAT | AAG | chr6 | 160664009 | 160664028 | 160664012 | - |
| SEQ ID NO 36936 | ATAAGTTTAATTTCCCCGTG | AAG | chr6 | 160663991 | 160664010 | 160663994 | - |
| SEQ ID NO 36937 | TTTCCCCGTGAAGACTGTCA | CGG | chr6 | 160663981 | 160664000 | 160663984 | - |
| SEQ ID NO 36938 | CGTGAAGACTGTCACGGTGC | TGG | chr6 | 160663975 | 160663994 | 160663978 | - |
| SEQ ID NO 36939 | TGTCACGGTGCTGGAATGAA | TGG | chr6 | 160663966 | 160663985 | 160663969 | - |
| SEQ ID NO 36940 | GTCACGGTGCTGGAATGAAT | GGG | chr6 | 160663965 | 160663984 | 160663968 | - |
| SEQ ID NO 36941 | ACGGTGCTGGAATGAATGGG | CAG | chr6 | 160663962 | 160663981 | 160663965 | - |
| SEQ ID NO 36942 | TGAATGGGCAGAAAAAATAA | TGG | chr6 | 160663950 | 160663969 | 160663953 | - |
| SEQ ID NO 36943 | GGTTGATTTTTCTAATCTAA | AAG | chr6 | 160663929 | 160663948 | 160663932 | - |
| SEQ ID NO 36944 | TTGATTTTTCTAATCTAAAA | GAG | chr6 | 160663927 | 160663946 | 160663930 | - |
| SEQ ID NO 36945 | AAAAGAGTGTGCCTACATGA | TGG | chr6 | 160663911 | 160663930 | 160663914 | - |
| SEQ ID NO 36946 | GAGTGTGCCTACATGATGGC | CAG | chr6 | 160663907 | 160663926 | 160663910 | - |
| SEQ ID NO 36947 | TGCCTACATGATGGCCAGTC | TGG | chr6 | 160663902 | 160663921 | 160663905 | - |
| SEQ ID NO 36948 | CAGTCTGGCTGAAAAATAAA | TAG | chr6 | 160663887 | 160663906 | 160663890 | - |
| SEQ ID NO 36949 | TGAAAAATAAATAGCCATTG | TAG | chr6 | 160663878 | 160663897 | 160663881 | - |
| SEQ ID NO 36950 | CCATTGTAGCTAACTATGCA | AAG | chr6 | 160663864 | 160663883 | 160663867 | - |
| SEQ ID NO 36951 | CATTGTAGCTAACTATGCAA | AGG | chr6 | 160663863 | 160663882 | 160663866 | - |
| SEQ ID NO 36952 | GTAGCTAACTATGCAAAGGA | TGG | chr6 | 160663859 | 160663878 | 160663862 | - |
| SEQ ID NO 36953 | TAACTATGCAAAGGATGGCT | AAG | chr6 | 160663854 | 160663873 | 160663857 | - |
| SEQ ID NO 36954 | GGATGGCTAAGCTCTTCGCT | TGG | chr6 | 160663842 | 160663861 | 160663845 | - |
| SEQ ID NO 36955 | TAAGCTCTTCGCTTGGTTCT | CAG | chr6 | 160663835 | 160663854 | 160663838 | - |
| SEQ ID NO 36956 | TAATTTATATCATCTCTGTT | CAG | chr6 | 160663806 | 160663825 | 160663809 | - |
| SEQ ID NO 36957 | AATTTATATCATCTCTGTTC | AGG | chr6 | 160663805 | 160663824 | 160663808 | - |
| SEQ ID NO 36958 | AGGTGCCATGCTCCCCTCAC | TAG | chr6 | 160663785 | 160663804 | 160663788 | - |
| SEQ ID NO 36959 | GCCATGCTCCCCTCACTAGC | AAG | chr6 | 160663781 | 160663800 | 160663784 | - |
| SEQ ID NO 36960 | AATAACTCTTTGAATATGTT | TGG | chr6 | 160663746 | 160663765 | 160663749 | - |
| SEQ ID NO 36961 | TTGGTTCCTTGACCTGTTCA | TGG | chr6 | 160663727 | 160663746 | 160663730 | - |
| SEQ ID NO 36962 | GGTTCCTTGACCTGTTCATG | GAG | chr6 | 160663725 | 160663744 | 160663728 | - |
| SEQ ID NO 36963 | TCCTTGACCTGTTCATGGAG | TGG | chr6 | 160663722 | 160663741 | 160663725 | - |
| SEQ ID NO 36964 | CCTTGACCTGTTCATGGAGT | GGG | chr6 | 160663721 | 160663740 | 160663724 | - |
| SEQ ID NO 36965 | CCTGTTCATGGAGTGGGACT | CAG | chr6 | 160663715 | 160663734 | 160663718 | - |
| SEQ ID NO 36966 | CAGCATTTCTCTCTTTGTTA | TGG | chr6 | 160663695 | 160663714 | 160663698 | - |
| SEQ ID NO 36967 | TTCTCTCTTTGTTATGGCCT | GAG | chr6 | 160663689 | 160663708 | 160663692 | - |
| SEQ ID NO 36968 | CTCTTTGTTATGGCCTGAGT | AAG | chr6 | 160663685 | 160663704 | 160663688 | - |
| SEQ ID NO 36969 | TCTTTGTTATGGCCTGAGTA | AGG | chr6 | 160663684 | 160663703 | 160663687 | - |
| SEQ ID NO 36970 | GCCTGAGTAAGGCTTTCCAT | CGG | chr6 | 160663673 | 160663692 | 160663676 | - |
| SEQ ID NO 36971 | ATACATTTGCTTCTTATCCC | TGG | chr6 | 160663649 | 160663668 | 160663652 | - |
| SEQ ID NO 36972 | ACATTTGCTTCTTATCCCTG | GAG | chr6 | 160663647 | 160663666 | 160663650 | - |
| SEQ ID NO 36973 | AATTATACACATCCATTTGC | CAG | chr6 | 160663623 | 160663642 | 160663626 | - |
| SEQ ID NO 36974 | ATAATGATTCAACAAATACT | CAG | chr6 | 160663587 | 160663606 | 160663590 | - |

Figure 55 (Cont'd)

| SEQ ID NO | Sequence | Codon | Chr | Start | End | Pos | Strand |
|---|---|---|---|---|---|---|---|
| SEQ ID NO 36975 | TAATGATTCAACAAATACTC | AGG | chr6 | 160663586 | 160663605 | 160663589 | - |
| SEQ ID NO 36976 | AATGATTCAACAAATACTCA | GGG | chr6 | 160663585 | 160663604 | 160663588 | - |
| SEQ ID NO 36977 | AAATACTCAGGGTATTTGTT | GAG | chr6 | 160663574 | 160663593 | 160663577 | - |
| SEQ ID NO 36978 | TACTCAGGGTATTTGTTGAG | TGG | chr6 | 160663571 | 160663590 | 160663574 | - |
| SEQ ID NO 36979 | ACTCAGGGTATTTGTTGAGT | GGG | chr6 | 160663570 | 160663589 | 160663573 | - |
| SEQ ID NO 36980 | AGGGTATTTGTTGAGTGGGT | TAG | chr6 | 160663566 | 160663585 | 160663569 | - |
| SEQ ID NO 36981 | GGGTATTTGTTGAGTGGGTT | AGG | chr6 | 160663565 | 160663584 | 160663568 | - |
| SEQ ID NO 36982 | CCGTGTGTGATTGTGAATGT | AAG | chr6 | 160663506 | 160663525 | 160663509 | - |
| SEQ ID NO 36983 | TGTGTGTCCTTTACAAATAC | TAG | chr6 | 160663483 | 160663502 | 160663486 | - |
| SEQ ID NO 36984 | TTTACAAATACTAGCTTATT | TAG | chr6 | 160663474 | 160663493 | 160663477 | - |
| SEQ ID NO 36985 | ATACTAGCTTATTTAGCTCA | TGG | chr6 | 160663467 | 160663486 | 160663470 | - |
| SEQ ID NO 36986 | AGCTTATTTAGCTCATGGTA | TAG | chr6 | 160663462 | 160663481 | 160663465 | - |
| SEQ ID NO 36987 | GCTTATTTAGCTCATGGTAT | AGG | chr6 | 160663461 | 160663480 | 160663464 | - |
| SEQ ID NO 36988 | TATTTAGCTCATGGTATAGG | TAG | chr6 | 160663458 | 160663477 | 160663461 | - |
| SEQ ID NO 36989 | ATTTAGCTCATGGTATAGGT | AGG | chr6 | 160663457 | 160663476 | 160663460 | - |
| SEQ ID NO 36990 | TTTAGCTCATGGTATAGGTA | GGG | chr6 | 160663456 | 160663475 | 160663459 | - |
| SEQ ID NO 36991 | AGCTCATGGTATAGGTAGGG | TAG | chr6 | 160663453 | 160663472 | 160663456 | - |
| SEQ ID NO 36992 | ATGGTATAGGTAGGGTAGCA | TAG | chr6 | 160663448 | 160663467 | 160663451 | - |
| SEQ ID NO 36993 | TCATCCCCATTTTATAAACA | AAG | chr6 | 160663425 | 160663444 | 160663428 | - |
| SEQ ID NO 36994 | ATTTTATAAACAAAGAAATC | TAG | chr6 | 160663417 | 160663436 | 160663420 | - |
| SEQ ID NO 36995 | TAAACAAAGAAATCTAGACT | TAG | chr6 | 160663411 | 160663430 | 160663414 | - |
| SEQ ID NO 36996 | AAACAAAGAAATCTAGACTT | AGG | chr6 | 160663410 | 160663429 | 160663413 | - |
| SEQ ID NO 36997 | CGTGACCAAATTCCCAAATC | AAG | chr6 | 160663368 | 160663387 | 160663371 | - |
| SEQ ID NO 36998 | GTGACCAAATTCCCAAATCA | AGG | chr6 | 160663367 | 160663386 | 160663370 | - |
| SEQ ID NO 36999 | ATTCCCAAATCAAGGAAATA | AAG | chr6 | 160663359 | 160663378 | 160663362 | - |
| SEQ ID NO 37000 | ATCAAGGAAATAAAGAAACC | TGG | chr6 | 160663351 | 160663370 | 160663354 | - |
| SEQ ID NO 37001 | AAATAAAGAAACCTGGATTT | AAG | chr6 | 160663344 | 160663363 | 160663347 | - |
| SEQ ID NO 37002 | AAAGAAACCTGGATTTAAGC | CAG | chr6 | 160663340 | 160663359 | 160663343 | - |
| SEQ ID NO 37003 | TGGATTTAAGCCAGATTTCC | AAG | chr6 | 160663331 | 160663350 | 160663334 | - |
| SEQ ID NO 37004 | CAGATTTCCAAGAAAAAATC | TAG | chr6 | 160663320 | 160663339 | 160663323 | - |
| SEQ ID NO 37005 | AGATTTCCAAGAAAAAATCT | AGG | chr6 | 160663319 | 160663338 | 160663322 | - |
| SEQ ID NO 37006 | GATTTCCAAGAAAAAATCTA | GGG | chr6 | 160663318 | 160663337 | 160663321 | - |
| SEQ ID NO 37007 | AACACATTCCAATGTAACTG | AAG | chr6 | 160663246 | 160663265 | 160663249 | - |
| SEQ ID NO 37008 | CACATTCCAATGTAACTGAA | GAG | chr6 | 160663244 | 160663263 | 160663247 | - |
| SEQ ID NO 37009 | ATTCCAATGTAACTGAAGAG | CAG | chr6 | 160663241 | 160663260 | 160663244 | - |
| SEQ ID NO 37010 | TTCCAATGTAACTGAAGAGC | AGG | chr6 | 160663240 | 160663259 | 160663243 | - |
| SEQ ID NO 37011 | GGTTAATTGTTTGCCACTTG | CAG | chr6 | 160663219 | 160663238 | 160663222 | - |
| SEQ ID NO 37012 | GCCACTTGCAGAATCCAATT | AAG | chr6 | 160663207 | 160663226 | 160663210 | - |
| SEQ ID NO 37013 | ACTTGCAGAATCCAATTAAG | AAG | chr6 | 160663204 | 160663223 | 160663207 | - |
| SEQ ID NO 37014 | TTGCAGAATCCAATTAAGAA | GAG | chr6 | 160663202 | 160663221 | 160663205 | - |
| SEQ ID NO 37015 | GCAGAATCCAATTAAGAAGA | GAG | chr6 | 160663200 | 160663219 | 160663203 | - |
| SEQ ID NO 37016 | GAATCCAATTAAGAAGAGAG | AAG | chr6 | 160663197 | 160663216 | 160663200 | - |
| SEQ ID NO 37017 | CAATTAAGAAGAGAGAAGTC | TGG | chr6 | 160663192 | 160663211 | 160663195 | - |
| SEQ ID NO 37018 | GAAGAGAGAAGTCTGGTATA | AAG | chr6 | 160663185 | 160663204 | 160663188 | - |
| SEQ ID NO 37019 | AGAGAAGTCTGGTATAAAGA | AAG | chr6 | 160663181 | 160663200 | 160663184 | - |
| SEQ ID NO 37020 | AAGAAAGTGATTTGCTTCCA | AAG | chr6 | 160663165 | 160663184 | 160663168 | - |
| SEQ ID NO 37021 | AAGTGATTTGCTTCCAAAGC | TAG | chr6 | 160663161 | 160663180 | 160663164 | - |

Figure 55 (Cont'd)

| SEQ ID NO 37022 | ATTTGCTTCCAAAGCTAGCT | TAG | chr6 | 160663156 | 160663175 | 160663159 | - |
| SEQ ID NO 37023 | TTTGCTTCCAAAGCTAGCTT | AGG | chr6 | 160663155 | 160663174 | 160663158 | - |
| SEQ ID NO 37024 | TTGCTTCCAAAGCTAGCTTA | GGG | chr6 | 160663154 | 160663173 | 160663157 | - |
| SEQ ID NO 37025 | TGCTTCCAAAGCTAGCTTAG | GGG | chr6 | 160663153 | 160663172 | 160663156 | - |
| SEQ ID NO 37026 | TTCCAAAGCTAGCTTAGGGG | AAG | chr6 | 160663150 | 160663169 | 160663153 | - |
| SEQ ID NO 37027 | CTAGCTTAGGGGAAGAAATG | CAG | chr6 | 160663142 | 160663161 | 160663145 | - |
| SEQ ID NO 37028 | GCTTAGGGGAAGAAATGCAG | CAG | chr6 | 160663139 | 160663158 | 160663142 | - |
| SEQ ID NO 37029 | CCTGCCGTACTACTTCACTT | TAG | chr6 | 160663115 | 160663134 | 160663118 | - |
| SEQ ID NO 37030 | CTGCCGTACTACTTCACTTT | AGG | chr6 | 160663114 | 160663133 | 160663117 | - |
| SEQ ID NO 37031 | GCCGTACTACTTCACTTTAG | GAG | chr6 | 160663112 | 160663131 | 160663115 | - |
| SEQ ID NO 37032 | GTACTACTTCACTTTAGGAG | CAG | chr6 | 160663109 | 160663128 | 160663112 | - |
| SEQ ID NO 37033 | TACTTCACTTTAGGAGCAGA | AAG | chr6 | 160663105 | 160663124 | 160663108 | - |
| SEQ ID NO 37034 | TTCACTTTAGGAGCAGAAAG | TGG | chr6 | 160663102 | 160663121 | 160663105 | - |
| SEQ ID NO 37035 | GCAGAAAGTGGCACTTTTAA | AAG | chr6 | 160663090 | 160663109 | 160663093 | - |
| SEQ ID NO 37036 | CAGAAAGTGGCACTTTTAAA | AGG | chr6 | 160663089 | 160663108 | 160663092 | - |
| SEQ ID NO 37037 | GTGGCACTTTTAAAAGGCAA | CAG | chr6 | 160663083 | 160663102 | 160663086 | - |
| SEQ ID NO 37038 | GGCACTTTTAAAAGGCAACA | GAG | chr6 | 160663081 | 160663100 | 160663084 | - |
| SEQ ID NO 37039 | GCACTTTTAAAAGGCAACAG | AGG | chr6 | 160663080 | 160663099 | 160663083 | - |
| SEQ ID NO 37040 | ACTTTTAAAAGGCAACAGAG | GAG | chr6 | 160663078 | 160663097 | 160663081 | - |
| SEQ ID NO 37041 | CTTTTAAAAGGCAACAGAGG | AGG | chr6 | 160663077 | 160663096 | 160663080 | - |
| SEQ ID NO 37042 | TAAAAGGCAACAGAGGAGGC | GAG | chr6 | 160663073 | 160663092 | 160663076 | - |
| SEQ ID NO 37043 | AGGCAACAGAGGAGGCGAGC | AAG | chr6 | 160663069 | 160663088 | 160663072 | - |
| SEQ ID NO 37044 | GGCAACAGAGGAGGCGAGCA | AGG | chr6 | 160663068 | 160663087 | 160663071 | - |
| SEQ ID NO 37045 | AGAGGAGGCGAGCAAGGATT | CAG | chr6 | 160663062 | 160663081 | 160663065 | - |
| SEQ ID NO 37046 | GAGGAGGCGAGCAAGGATTC | AGG | chr6 | 160663061 | 160663080 | 160663064 | - |
| SEQ ID NO 37047 | AGGAGGCGAGCAAGGATTCA | GGG | chr6 | 160663060 | 160663079 | 160663063 | - |
| SEQ ID NO 37048 | GGAGGCGAGCAAGGATTCAG | GGG | chr6 | 160663059 | 160663078 | 160663062 | - |
| SEQ ID NO 37049 | AAGGATTCAGGGGTCCATGC | TAG | chr6 | 160663049 | 160663068 | 160663052 | - |
| SEQ ID NO 37050 | TTCAGGGGTCCATGCTAGCT | TGG | chr6 | 160663044 | 160663063 | 160663047 | - |
| SEQ ID NO 37051 | TCAGGGGTCCATGCTAGCTT | GGG | chr6 | 160663043 | 160663062 | 160663046 | - |
| SEQ ID NO 37052 | AGCTTGGGCACCTTATCCAC | CAG | chr6 | 160663028 | 160663047 | 160663031 | - |
| SEQ ID NO 37053 | GCTTGGGCACCTTATCCACC | AGG | chr6 | 160663027 | 160663046 | 160663030 | - |
| SEQ ID NO 37054 | TGGGCACCTTATCCACCAGG | TAG | chr6 | 160663024 | 160663043 | 160663027 | - |
| SEQ ID NO 37055 | ACCTTATCCACCAGGTAGTT | GAG | chr6 | 160663019 | 160663038 | 160663022 | - |
| SEQ ID NO 37056 | TTATCCACCAGGTAGTTGAG | CAG | chr6 | 160663016 | 160663035 | 160663019 | - |
| SEQ ID NO 37057 | GTAGTTGAGCAGTTGCCTGC | TGG | chr6 | 160663005 | 160663024 | 160663008 | - |
| SEQ ID NO 37058 | TTGCCTGCTGGTGCCTTTGT | GAG | chr6 | 160662993 | 160663012 | 160662996 | - |
| SEQ ID NO 37059 | CCTGCTGGTGCCTTTGTGAG | CAG | chr6 | 160662990 | 160663009 | 160662993 | - |
| SEQ ID NO 37060 | CTGCTGGTGCCTTTGTGAGC | AGG | chr6 | 160662989 | 160663008 | 160662992 | - |
| SEQ ID NO 37061 | TGCTGGTGCCTTTGTGAGCA | GGG | chr6 | 160662988 | 160663007 | 160662991 | - |
| SEQ ID NO 37062 | TGAGCAGGGTGTTGTCCCTT | GAG | chr6 | 160662974 | 160662993 | 160662977 | - |
| SEQ ID NO 37063 | GAGCAGGGTGTTGTCCCTTG | AGG | chr6 | 160662973 | 160662992 | 160662976 | - |
| SEQ ID NO 37064 | TGTCCCTTGAGGCAAATCTC | TGG | chr6 | 160662962 | 160662981 | 160662965 | - |
| SEQ ID NO 37065 | TCCCTTGAGGCAAATCTCTG | GAG | chr6 | 160662960 | 160662979 | 160662963 | - |
| SEQ ID NO 37066 | CCCTTGAGGCAAATCTCTGG | AGG | chr6 | 160662959 | 160662978 | 160662962 | - |
| SEQ ID NO 37067 | CCTTGAGGCAAATCTCTGGA | GGG | chr6 | 160662958 | 160662977 | 160662961 | - |
| SEQ ID NO 37068 | GAGGCAAATCTCTGGAGGGT | GAG | chr6 | 160662954 | 160662973 | 160662957 | - |

Figure 55 (Cont'd)

| SEQ ID NO 37069 | GGCAAATCTCTGGAGGGTGA | GAG | chr6 | 160662952 | 160662971 | 160662955 | - |
| SEQ ID NO 37070 | TCTGGAGGGTGAGAGTTTTG | TAG | chr6 | 160662944 | 160662963 | 160662947 | - |
| SEQ ID NO 37071 | GGAGGGTGAGAGTTTTGTAG | TGG | chr6 | 160662941 | 160662960 | 160662944 | - |
| SEQ ID NO 37072 | GAGGGTGAGAGTTTTGTAGT | GGG | chr6 | 160662940 | 160662959 | 160662943 | - |
| SEQ ID NO 37073 | GTTTTGTAGTGGGCATGCTT | TGG | chr6 | 160662930 | 160662949 | 160662933 | - |
| SEQ ID NO 37074 | TTATAAATCACCTGTGAACT | CAG | chr6 | 160662906 | 160662925 | 160662909 | - |
| SEQ ID NO 37075 | TATAAATCACCTGTGAACTC | AGG | chr6 | 160662905 | 160662924 | 160662908 | - |
| SEQ ID NO 37076 | TAAATCACCTGTGAACTCAG | GAG | chr6 | 160662903 | 160662922 | 160662906 | - |
| SEQ ID NO 37077 | AACTCAGGAGTTCCATCTTG | AAG | chr6 | 160662890 | 160662909 | 160662893 | - |
| SEQ ID NO 37078 | TCCATCTTGAAGCACATACA | TAG | chr6 | 160662879 | 160662898 | 160662882 | - |
| SEQ ID NO 37079 | TCTTGAAGCACATACATAGT | TAG | chr6 | 160662875 | 160662894 | 160662878 | - |
| SEQ ID NO 37080 | AGTTAGATGAACTTGCCCTG | CAG | chr6 | 160662858 | 160662877 | 160662861 | - |
| SEQ ID NO 37081 | GTTAGATGAACTTGCCCTGC | AGG | chr6 | 160662857 | 160662876 | 160662860 | - |
| SEQ ID NO 37082 | TTAGATGAACTTGCCCTGCA | GGG | chr6 | 160662856 | 160662875 | 160662859 | - |
| SEQ ID NO 37083 | AGATGAACTTGCCCTGCAGG | GAG | chr6 | 160662854 | 160662873 | 160662857 | - |
| SEQ ID NO 37084 | ATGAACTTGCCCTGCAGGGA | GAG | chr6 | 160662852 | 160662871 | 160662855 | - |
| SEQ ID NO 37085 | CTGCAGGGAGAGTCTGATGA | AAG | chr6 | 160662841 | 160662860 | 160662844 | - |
| SEQ ID NO 37086 | TGCAGGGAGAGTCTGATGAA | AGG | chr6 | 160662840 | 160662859 | 160662843 | - |
| SEQ ID NO 37087 | GCAGGGAGAGTCTGATGAAA | GGG | chr6 | 160662839 | 160662858 | 160662842 | - |
| SEQ ID NO 37088 | AGGGAGAGTCTGATGAAAGG | GAG | chr6 | 160662837 | 160662856 | 160662840 | - |
| SEQ ID NO 37089 | GGGAGAGTCTGATGAAAGGG | AGG | chr6 | 160662836 | 160662855 | 160662839 | - |
| SEQ ID NO 37090 | AGAGTCTGATGAAAGGGAGG | TAG | chr6 | 160662833 | 160662852 | 160662836 | - |
| SEQ ID NO 37091 | CAATTTAATCTATAAATTAC | CAG | chr6 | 160662803 | 160662822 | 160662806 | - |
| SEQ ID NO 37092 | ATTACCAGATAAAATTTTAC | AAG | chr6 | 160662788 | 160662807 | 160662791 | - |
| SEQ ID NO 37093 | AATTTTACAAGTTGACTTTA | AAG | chr6 | 160662776 | 160662795 | 160662779 | - |
| SEQ ID NO 37094 | AAGTCAAACACATTTGAATT | TAG | chr6 | 160662756 | 160662775 | 160662759 | - |
| SEQ ID NO 37095 | TCAAACACATTTGAATTTAG | TGG | chr6 | 160662753 | 160662772 | 160662756 | - |
| SEQ ID NO 37096 | AACACATTTGAATTTAGTGG | AAG | chr6 | 160662750 | 160662769 | 160662753 | - |
| SEQ ID NO 37097 | GAATTTAGTGGAAGCCATTC | AAG | chr6 | 160662741 | 160662760 | 160662744 | - |
| SEQ ID NO 37098 | AGCCATTCAAGAAAATATCA | AAG | chr6 | 160662729 | 160662748 | 160662732 | - |
| SEQ ID NO 37099 | AGAAAATATCAAAGAAAATA | CAG | chr6 | 160662720 | 160662739 | 160662723 | - |
| SEQ ID NO 37100 | AAAATATCAAAGAAAATACA | GAG | chr6 | 160662718 | 160662737 | 160662721 | - |
| SEQ ID NO 37101 | ATATCAAAGAAAATACAGAG | CAG | chr6 | 160662715 | 160662734 | 160662718 | - |
| SEQ ID NO 37102 | TATCAAAGAAAATACAGAGC | AGG | chr6 | 160662714 | 160662733 | 160662717 | - |
| SEQ ID NO 37103 | TCAAAGAAAATACAGAGCAG | GAG | chr6 | 160662712 | 160662731 | 160662715 | - |
| SEQ ID NO 37104 | AAGAAAATACAGAGCAGGAG | AAG | chr6 | 160662709 | 160662728 | 160662712 | - |
| SEQ ID NO 37105 | ATACAGAGCAGGAGAAGATT | AAG | chr6 | 160662703 | 160662722 | 160662706 | - |
| SEQ ID NO 37106 | GAGCAGGAGAAGATTAAGCA | AAG | chr6 | 160662698 | 160662717 | 160662701 | - |
| SEQ ID NO 37107 | GCAGGAGAAGATTAAGCAAA | GAG | chr6 | 160662696 | 160662715 | 160662699 | - |
| SEQ ID NO 37108 | AGATTAAGCAAAGAGTTTTT | TGG | chr6 | 160662688 | 160662707 | 160662691 | - |
| SEQ ID NO 37109 | GATTAAGCAAAGAGTTTTTT | GGG | chr6 | 160662687 | 160662706 | 160662690 | - |
| SEQ ID NO 37110 | ATTAAGCAAAGAGTTTTTTG | GGG | chr6 | 160662686 | 160662705 | 160662689 | - |
| SEQ ID NO 37111 | AAAGAGTTTTTGGGGAAAT | TGG | chr6 | 160662679 | 160662698 | 160662682 | - |
| SEQ ID NO 37112 | GGTGTCTATGTCTGTGTGTG | TAG | chr6 | 160662658 | 160662677 | 160662661 | - |
| SEQ ID NO 37113 | GTGTCTATGTCTGTGTGTGT | AGG | chr6 | 160662657 | 160662676 | 160662660 | - |
| SEQ ID NO 37114 | TGTCTATGTCTGTGTGTGTA | GGG | chr6 | 160662656 | 160662675 | 160662659 | - |
| SEQ ID NO 37115 | TCTATGTCTGTGTGTGTAGG | GAG | chr6 | 160662654 | 160662673 | 160662657 | - |

Figure 55 (Cont'd)

| SEQ ID | Sequence | Codon | Chr | Start | End | Pos | Strand |
|---|---|---|---|---|---|---|---|
| SEQ ID NO 37116 | GTCTGTGTGTGTAGGGAGTG | CAG | chr6 | 160662649 | 160662668 | 160662652 | - |
| SEQ ID NO 37117 | TCTGTGTGTGTAGGGAGTGC | AGG | chr6 | 160662648 | 160662667 | 160662651 | - |
| SEQ ID NO 37118 | CTGTGTGTGTAGGGAGTGCA | GGG | chr6 | 160662647 | 160662666 | 160662650 | - |
| SEQ ID NO 37119 | TGTGTGTGTAGGGAGTGCAG | GGG | chr6 | 160662646 | 160662665 | 160662649 | - |
| SEQ ID NO 37120 | GGGATATGAATATTCTATTT | CAG | chr6 | 160662626 | 160662645 | 160662629 | - |
| SEQ ID NO 37121 | GAATATTCTATTTCAGCCCA | TGG | chr6 | 160662619 | 160662638 | 160662622 | - |
| SEQ ID NO 37122 | CTATTTCAGCCCATGGAAAC | TAG | chr6 | 160662612 | 160662631 | 160662615 | - |
| SEQ ID NO 37123 | TATTTCAGCCCATGGAAACT | AGG | chr6 | 160662611 | 160662630 | 160662614 | - |
| SEQ ID NO 37124 | AGCCCATGGAAACTAGGATG | TAG | chr6 | 160662605 | 160662624 | 160662608 | - |
| SEQ ID NO 37125 | TAGATCACTGTGAACTTATT | CAG | chr6 | 160662585 | 160662604 | 160662588 | - |
| SEQ ID NO 37126 | ATCACTGTGAACTTATTCAG | CAG | chr6 | 160662582 | 160662601 | 160662585 | - |
| SEQ ID NO 37127 | TCACTGTGAACTTATTCAGC | AGG | chr6 | 160662581 | 160662600 | 160662584 | - |
| SEQ ID NO 37128 | TATTCAGCAGGCTACACCCA | AAG | chr6 | 160662569 | 160662588 | 160662572 | - |
| SEQ ID NO 37129 | ATTCAGCAGGCTACACCCAA | AGG | chr6 | 160662568 | 160662587 | 160662571 | - |
| SEQ ID NO 37130 | AGCAGGCTACACCCAAAGGC | TAG | chr6 | 160662564 | 160662583 | 160662567 | - |
| SEQ ID NO 37131 | TAGAACAAACTTCTCTGCCA | CAG | chr6 | 160662544 | 160662563 | 160662547 | - |
| SEQ ID NO 37132 | AGAACAAACTTCTCTGCCAC | AGG | chr6 | 160662543 | 160662562 | 160662546 | - |
| SEQ ID NO 37133 | AACATATGTTTTAATCGACC | TGG | chr6 | 160662517 | 160662536 | 160662520 | - |
| SEQ ID NO 37134 | ACATATGTTTTAATCGACCT | GGG | chr6 | 160662516 | 160662535 | 160662519 | - |
| SEQ ID NO 37135 | CATATGTTTTAATCGACCTG | GGG | chr6 | 160662515 | 160662534 | 160662518 | - |
| SEQ ID NO 37136 | ATATGTTTTAATCGACCTGG | GGG | chr6 | 160662514 | 160662533 | 160662517 | - |
| SEQ ID NO 37137 | TATGTTTTAATCGACCTGGG | GGG | chr6 | 160662513 | 160662532 | 160662516 | - |
| SEQ ID NO 37138 | TGGGGGGCACATTCTCTGAT | AAG | chr6 | 160662497 | 160662516 | 160662500 | - |
| SEQ ID NO 37139 | CATTCTCTGATAAGCTCTTT | TGG | chr6 | 160662488 | 160662507 | 160662491 | - |
| SEQ ID NO 37140 | CTCTGATAAGCTCTTTTGGA | AAG | chr6 | 160662484 | 160662503 | 160662487 | - |
| SEQ ID NO 37141 | GATAAGCTCTTTTGGAAAGC | CAG | chr6 | 160662480 | 160662499 | 160662483 | - |
| SEQ ID NO 37142 | ATAAGCTCTTTTGGAAAGCC | AGG | chr6 | 160662479 | 160662498 | 160662482 | - |
| SEQ ID NO 37143 | TTGGAAAGCCAGGCTTTCTG | TGG | chr6 | 160662469 | 160662488 | 160662472 | - |
| SEQ ID NO 37144 | GTTATCTTTCCAATGTGTGC | TGG | chr6 | 160662442 | 160662461 | 160662445 | - |
| SEQ ID NO 37145 | CCAATGTGTGCTGGAATGCC | CGG | chr6 | 160662433 | 160662452 | 160662436 | - |
| SEQ ID NO 37146 | CAATGTGTGCTGGAATGCCC | GGG | chr6 | 160662432 | 160662451 | 160662435 | - |
| SEQ ID NO 37147 | AATGTGTGCTGGAATGCCCG | GGG | chr6 | 160662431 | 160662450 | 160662434 | - |
| SEQ ID NO 37148 | TGTGTGCTGGAATGCCCGGG | GAG | chr6 | 160662429 | 160662448 | 160662432 | - |
| SEQ ID NO 37149 | TGTGCTGGAATGCCCGGGGA | GAG | chr6 | 160662427 | 160662446 | 160662430 | - |
| SEQ ID NO 37150 | GTGCTGGAATGCCCGGGGAG | AGG | chr6 | 160662426 | 160662445 | 160662429 | - |
| SEQ ID NO 37151 | GAATGCCCGGGGAGAGGAAA | AAG | chr6 | 160662420 | 160662439 | 160662423 | - |
| SEQ ID NO 37152 | AGAGGAAAAGTTTCTTTTA | CAG | chr6 | 160662408 | 160662427 | 160662411 | - |
| SEQ ID NO 37153 | GTTTCTTTTACAGCCATGCT | CAG | chr6 | 160662398 | 160662417 | 160662401 | - |
| SEQ ID NO 37154 | CTTTTACAGCCATGCTCAGT | GAG | chr6 | 160662394 | 160662413 | 160662397 | - |
| SEQ ID NO 37155 | TTACAGCCATGCTCAGTGAG | AAG | chr6 | 160662391 | 160662410 | 160662394 | - |
| SEQ ID NO 37156 | CAGCCATGCTCAGTGAGAAG | CGG | chr6 | 160662388 | 160662407 | 160662391 | - |
| SEQ ID NO 37157 | GCCATGCTCAGTGAGAAGCG | GAG | chr6 | 160662386 | 160662405 | 160662389 | - |
| SEQ ID NO 37158 | TCTTCTATTCACAAATTGCT | AAG | chr6 | 160662358 | 160662377 | 160662361 | - |
| SEQ ID NO 37159 | GCATACACATTCACACACCA | CAG | chr6 | 160662315 | 160662334 | 160662318 | - |
| SEQ ID NO 37160 | ACACATTCACACACCACAGT | GAG | chr6 | 160662311 | 160662330 | 160662314 | - |
| SEQ ID NO 37161 | CACATTCACACACCACAGTG | AGG | chr6 | 160662310 | 160662329 | 160662313 | - |
| SEQ ID NO 37162 | ATTCACACACCACAGTGAGG | AAG | chr6 | 160662307 | 160662326 | 160662310 | - |

Figure 55 (Cont'd)

| SEQ ID NO 37163 | TTAATAAAATACATTTACTT | CAG | chr6 | 160662270 | 160662289 | 160662273 | - |
| SEQ ID NO 37164 | ATAAAATACATTTACTTCAG | TAG | chr6 | 160662267 | 160662286 | 160662270 | - |
| SEQ ID NO 37165 | ACATTTTGCCTATAATATAA | AAG | chr6 | 160662232 | 160662251 | 160662235 | - |
| SEQ ID NO 37166 | AAAAGTATTTTTCCTATTAA | AAG | chr6 | 160662214 | 160662233 | 160662217 | - |
| SEQ ID NO 37167 | TTAAATCCCCATTGCCATAT | GAG | chr6 | 160662154 | 160662173 | 160662157 | - |
| SEQ ID NO 37168 | CCCCATTGCCATATGAGCCC | TGG | chr6 | 160662148 | 160662167 | 160662151 | - |
| SEQ ID NO 37169 | CCATTGCCATATGAGCCCTG | GAG | chr6 | 160662146 | 160662165 | 160662149 | - |
| SEQ ID NO 37170 | CATTGCCATATGAGCCCTGG | AGG | chr6 | 160662145 | 160662164 | 160662148 | - |
| SEQ ID NO 37171 | TATGAGCCCTGGAGGTGAAT | CAG | chr6 | 160662137 | 160662156 | 160662140 | - |
| SEQ ID NO 37172 | TGAGCCCTGGAGGTGAATCA | GAG | chr6 | 160662135 | 160662154 | 160662138 | - |
| SEQ ID NO 37173 | GAGGTGAATCAGAGAAACAA | AAG | chr6 | 160662126 | 160662145 | 160662129 | - |
| SEQ ID NO 37174 | AGGTGAATCAGAGAAACAAA | AGG | chr6 | 160662125 | 160662144 | 160662128 | - |
| SEQ ID NO 37175 | TCAGAGAAACAAAAGGATTG | TGG | chr6 | 160662118 | 160662137 | 160662121 | - |
| SEQ ID NO 37176 | AAGGATTGTGGAAAAATCAT | CAG | chr6 | 160662106 | 160662125 | 160662109 | - |
| SEQ ID NO 37177 | AGGATTGTGGAAAAATCATC | AGG | chr6 | 160662105 | 160662124 | 160662108 | - |
| SEQ ID NO 37178 | AAAAATCATCAGGTTAAAAA | AAG | chr6 | 160662095 | 160662114 | 160662098 | - |
| SEQ ID NO 37179 | AAGAAAAATTGATTCTGTTT | TGG | chr6 | 160662075 | 160662094 | 160662078 | - |
| SEQ ID NO 37180 | AGAAAAATTGATTCTGTTTT | GGG | chr6 | 160662074 | 160662093 | 160662077 | - |
| SEQ ID NO 37181 | TTCTGTTTTGGGATATTTCC | TAG | chr6 | 160662063 | 160662082 | 160662066 | - |
| SEQ ID NO 37182 | GGGATATTTCCTAGCAACAT | GAG | chr6 | 160662054 | 160662073 | 160662057 | - |
| SEQ ID NO 37183 | TATTTCCTAGCAACATGAGC | TGG | chr6 | 160662050 | 160662069 | 160662053 | - |
| SEQ ID NO 37184 | ATTTCCTAGCAACATGAGCT | GGG | chr6 | 160662049 | 160662068 | 160662052 | - |
| SEQ ID NO 37185 | TTTCCTAGCAACATGAGCTG | GGG | chr6 | 160662048 | 160662067 | 160662051 | - |
| SEQ ID NO 37186 | TCCTAGCAACATGAGCTGGG | GAG | chr6 | 160662046 | 160662065 | 160662049 | - |
| SEQ ID NO 37187 | CCTAGCAACATGAGCTGGGG | AGG | chr6 | 160662045 | 160662064 | 160662048 | - |
| SEQ ID NO 37188 | CTAGCAACATGAGCTGGGGA | GGG | chr6 | 160662044 | 160662063 | 160662047 | - |
| SEQ ID NO 37189 | TAGCAACATGAGCTGGGGAG | GGG | chr6 | 160662043 | 160662062 | 160662046 | - |
| SEQ ID NO 37190 | ATGAGCTGGGGAGGGGATCT | CAG | chr6 | 160662036 | 160662055 | 160662039 | - |
| SEQ ID NO 37191 | AGCTGGGGAGGGGATCTCAG | CAG | chr6 | 160662033 | 160662052 | 160662036 | - |
| SEQ ID NO 37192 | CTCAGCAGTGATGCTCTATG | AAG | chr6 | 160662018 | 160662037 | 160662021 | - |
| SEQ ID NO 37193 | TGAAGCATAATAAAATGACA | CAG | chr6 | 160662000 | 160662019 | 160662003 | - |
| SEQ ID NO 37194 | ATAATAAAATGACACAGTTA | CAG | chr6 | 160661994 | 160662013 | 160661997 | - |
| SEQ ID NO 37195 | TAATAAAATGACACAGTTAC | AGG | chr6 | 160661993 | 160662012 | 160661996 | - |
| SEQ ID NO 37196 | TGACACAGTTACAGGTAACT | TAG | chr6 | 160661985 | 160662004 | 160661988 | - |
| SEQ ID NO 37197 | AGTTACAGGTAACTTAGTTA | AAG | chr6 | 160661979 | 160661998 | 160661982 | - |
| SEQ ID NO 37198 | GTTACAGGTAACTTAGTTAA | AGG | chr6 | 160661978 | 160661997 | 160661981 | - |
| SEQ ID NO 37199 | TTACAGGTAACTTAGTTAAA | GGG | chr6 | 160661977 | 160661996 | 160661980 | - |
| SEQ ID NO 37200 | TACAGGTAACTTAGTTAAAG | GGG | chr6 | 160661976 | 160661995 | 160661979 | - |
| SEQ ID NO 37201 | ACAGGTAACTTAGTTAAAGG | GGG | chr6 | 160661975 | 160661994 | 160661978 | - |
| SEQ ID NO 37202 | TAGTTAAAGGGGGAAATAAA | TGG | chr6 | 160661965 | 160661984 | 160661968 | - |
| SEQ ID NO 37203 | TTAAAGGGGGAAATAAATGG | AAG | chr6 | 160661962 | 160661981 | 160661965 | - |
| SEQ ID NO 37204 | CTCTTTTTGAATATCAATTG | TAG | chr6 | 160661935 | 160661954 | 160661938 | - |
| SEQ ID NO 37205 | ATGTTTAACTGAACTCACTG | TAG | chr6 | 160661878 | 160661897 | 160661881 | - |
| SEQ ID NO 37206 | TGTTTAACTGAACTCACTGT | AGG | chr6 | 160661877 | 160661896 | 160661880 | - |
| SEQ ID NO 37207 | TTAACTGAACTCACTGTAGG | AAG | chr6 | 160661874 | 160661893 | 160661877 | - |
| SEQ ID NO 37208 | TTAATTTATTGTGTGTTTTG | AAG | chr6 | 160661844 | 160661863 | 160661847 | - |
| SEQ ID NO 37209 | GTGTTTTGAAGTCACACTGT | GAG | chr6 | 160661832 | 160661851 | 160661835 | - |

Figure 55 (Cont'd)

| SEQ ID NO 37210 | TGAAGTCACACTGTGAGCTA | TAG | chr6 | 160661826 | 160661845 | 160661829 | - |
| SEQ ID NO 37211 | GTGAGCTATAGAATTTACCC | AAG | chr6 | 160661814 | 160661833 | 160661817 | - |
| SEQ ID NO 37212 | TACCCAAGCACAACTCTTCC | TGG | chr6 | 160661799 | 160661818 | 160661802 | - |
| SEQ ID NO 37213 | AAGCACAACTCTTCCTGGAA | AAG | chr6 | 160661794 | 160661813 | 160661797 | - |
| SEQ ID NO 37214 | GCACAACTCTTCCTGGAAAA | GAG | chr6 | 160661792 | 160661811 | 160661795 | - |
| SEQ ID NO 37215 | ACAACTCTTCCTGGAAAAGA | GAG | chr6 | 160661790 | 160661809 | 160661793 | - |
| SEQ ID NO 37216 | CTGGAAAAGAGAGTTCAAAT | GAG | chr6 | 160661780 | 160661799 | 160661783 | - |
| SEQ ID NO 37217 | AAGAGAGTTCAAATGAGAAA | CAG | chr6 | 160661774 | 160661793 | 160661777 | - |
| SEQ ID NO 37218 | AGTTCAAATGAGAAACAGTG | CGG | chr6 | 160661769 | 160661788 | 160661772 | - |
| SEQ ID NO 37219 | GTTCAAATGAGAAACAGTGC | GGG | chr6 | 160661768 | 160661787 | 160661771 | - |
| SEQ ID NO 37220 | TTCAAATGAGAAACAGTGCG | GGG | chr6 | 160661767 | 160661786 | 160661770 | - |
| SEQ ID NO 37221 | ATGAGAAACAGTGCGGGGTG | AAG | chr6 | 160661762 | 160661781 | 160661765 | - |
| SEQ ID NO 37222 | AACAGTGCGGGGTGAAGACA | TGG | chr6 | 160661756 | 160661775 | 160661759 | - |
| SEQ ID NO 37223 | GCGGGGTGAAGACATGGATA | TGG | chr6 | 160661750 | 160661769 | 160661753 | - |
| SEQ ID NO 37224 | CGGGGTGAAGACATGGATAT | GGG | chr6 | 160661749 | 160661768 | 160661752 | - |
| SEQ ID NO 37225 | GATATTTTGATATATCTATC | AAG | chr6 | 160661704 | 160661723 | 160661707 | - |
| SEQ ID NO 37226 | TATATCTATCAAGTGCTTTT | TAG | chr6 | 160661694 | 160661713 | 160661697 | - |
| SEQ ID NO 37227 | ATCTATCAAGTGCTTTTTAG | TGG | chr6 | 160661691 | 160661710 | 160661694 | - |
| SEQ ID NO 37228 | TCAAGTGCTTTTTAGTGGAT | TAG | chr6 | 160661686 | 160661705 | 160661689 | - |
| SEQ ID NO 37229 | CAAGTGCTTTTTAGTGGATT | AGG | chr6 | 160661685 | 160661704 | 160661688 | - |
| SEQ ID NO 37230 | GCTTTTTAGTGGATTAGGTT | CAG | chr6 | 160661680 | 160661699 | 160661683 | - |
| SEQ ID NO 37231 | GGATTAGGTTCAGAATGCAT | CAG | chr6 | 160661670 | 160661689 | 160661673 | - |
| SEQ ID NO 37232 | CCAATGCCTGTTCAATAATC | CAG | chr6 | 160661647 | 160661666 | 160661650 | - |
| SEQ ID NO 37233 | TGTTCAATAATCCAGTTTTC | CAG | chr6 | 160661639 | 160661658 | 160661642 | - |
| SEQ ID NO 37234 | AATAATCCAGTTTTCCAGCA | TAG | chr6 | 160661634 | 160661653 | 160661637 | - |
| SEQ ID NO 37235 | TAATCCAGTTTTCCAGCATA | GAG | chr6 | 160661632 | 160661651 | 160661635 | - |
| SEQ ID NO 37236 | AGCATAGAGCATATTAAATT | GAG | chr6 | 160661618 | 160661637 | 160661621 | - |
| SEQ ID NO 37237 | GCATAGAGCATATTAAATTG | AGG | chr6 | 160661617 | 160661636 | 160661620 | - |
| SEQ ID NO 37238 | TAGAGCATATTAAATTGAGG | AAG | chr6 | 160661614 | 160661633 | 160661617 | - |
| SEQ ID NO 37239 | AGAGCATATTAAATTGAGGA | AGG | chr6 | 160661613 | 160661632 | 160661616 | - |
| SEQ ID NO 37240 | TATTAAATTGAGGAAGGACA | AAG | chr6 | 160661607 | 160661626 | 160661610 | - |
| SEQ ID NO 37241 | ATTGAGGAAGGACAAAGTCA | CAG | chr6 | 160661601 | 160661620 | 160661604 | - |
| SEQ ID NO 37242 | TGAGGAAGGACAAAGTCACA | GAG | chr6 | 160661599 | 160661618 | 160661602 | - |
| SEQ ID NO 37243 | GAGGAAGGACAAAGTCACAG | AGG | chr6 | 160661598 | 160661617 | 160661601 | - |
| SEQ ID NO 37244 | GAAGGACAAAGTCACAGAGG | TGG | chr6 | 160661595 | 160661614 | 160661598 | - |
| SEQ ID NO 37245 | AAGGACAAAGTCACAGAGGT | GGG | chr6 | 160661594 | 160661613 | 160661597 | - |
| SEQ ID NO 37246 | AGGACAAAGTCACAGAGGTG | GGG | chr6 | 160661593 | 160661612 | 160661596 | - |
| SEQ ID NO 37247 | GACAAAGTCACAGAGGTGGG | GAG | chr6 | 160661591 | 160661610 | 160661594 | - |
| SEQ ID NO 37248 | AAAGTCACAGAGGTGGGGAG | CAG | chr6 | 160661588 | 160661607 | 160661591 | - |
| SEQ ID NO 37249 | AAGTCACAGAGGTGGGGAGC | AGG | chr6 | 160661587 | 160661606 | 160661590 | - |
| SEQ ID NO 37250 | TCACAGAGGTGGGGAGCAGG | TGG | chr6 | 160661584 | 160661603 | 160661587 | - |
| SEQ ID NO 37251 | GGTGGGGAGCAGGTGGACTG | TGG | chr6 | 160661577 | 160661596 | 160661580 | - |
| SEQ ID NO 37252 | GGAGCAGGTGGACTGTGGCC | AAG | chr6 | 160661572 | 160661591 | 160661575 | - |
| SEQ ID NO 37253 | GAGCAGGTGGACTGTGGCCA | AGG | chr6 | 160661571 | 160661590 | 160661574 | - |
| SEQ ID NO 37254 | GCCAAGGACTTTGCATGAAA | CAG | chr6 | 160661555 | 160661574 | 160661558 | - |
| SEQ ID NO 37255 | AGGACTTTGCATGAAACAGT | GAG | chr6 | 160661551 | 160661570 | 160661554 | - |
| SEQ ID NO 37256 | TCCTCCTTGCCCTGCCCTCA | TGG | chr6 | 160661519 | 160661538 | 160661522 | - |

Figure 55 (Cont'd)

| | | | | | | | |
|---|---|---|---|---|---|---|---|
| SEQ ID NO 37257 | CCTCATGGTCTGTGTACTCT | CAG | chr6 | 160661504 | 160661523 | 160661507 | - |
| SEQ ID NO 37258 | CTCATGGTCTGTGTACTCTC | AGG | chr6 | 160661503 | 160661522 | 160661506 | - |
| SEQ ID NO 37259 | CATGGTCTGTGTACTCTCAG | GAG | chr6 | 160661501 | 160661520 | 160661504 | - |
| SEQ ID NO 37260 | ATGGTCTGTGTACTCTCAGG | AGG | chr6 | 160661500 | 160661519 | 160661503 | - |
| SEQ ID NO 37261 | TCTGTGTACTCTCAGGAGGT | CAG | chr6 | 160661496 | 160661515 | 160661499 | - |
| SEQ ID NO 37262 | CTGTGTACTCTCAGGAGGTC | AGG | chr6 | 160661495 | 160661514 | 160661498 | - |
| SEQ ID NO 37263 | GTACTCTCAGGAGGTCAGGA | CAG | chr6 | 160661491 | 160661510 | 160661494 | - |
| SEQ ID NO 37264 | TACTCTCAGGAGGTCAGGAC | AGG | chr6 | 160661490 | 160661509 | 160661493 | - |
| SEQ ID NO 37265 | AGGTCAGGACAGGCCTTTCT | GAG | chr6 | 160661480 | 160661499 | 160661483 | - |
| SEQ ID NO 37266 | GGACAGGCCTTTCTGAGAAT | GAG | chr6 | 160661474 | 160661493 | 160661477 | - |
| SEQ ID NO 37267 | CTGTTCATCTGCCTTTCTAC | TGG | chr6 | 160661448 | 160661467 | 160661451 | - |
| SEQ ID NO 37268 | TTCTACTGGATACTTGTCAT | CGG | chr6 | 160661434 | 160661453 | 160661437 | - |
| SEQ ID NO 37269 | ATACAAACACATGTTCTCTG | CAG | chr6 | 160661410 | 160661429 | 160661413 | - |
| SEQ ID NO 37270 | CTCTGCAGTGTGTCATCTTT | CAG | chr6 | 160661395 | 160661414 | 160661398 | - |
| SEQ ID NO 37271 | TCCCCTGACCCTGTATTCCC | TAG | chr6 | 160661368 | 160661387 | 160661371 | - |
| SEQ ID NO 37272 | CCTGACCCTGTATTCCCTAG | AAG | chr6 | 160661365 | 160661384 | 160661368 | - |
| SEQ ID NO 37273 | CCTAGAAGTCTCGCTGCTTT | CAG | chr6 | 160661350 | 160661369 | 160661353 | - |
| SEQ ID NO 37274 | TAGAAGTCTCGCTGCTTTCA | GAG | chr6 | 160661348 | 160661367 | 160661351 | - |
| SEQ ID NO 37275 | AGTCTCGCTGCTTTCAGAGC | CAG | chr6 | 160661344 | 160661363 | 160661347 | - |
| SEQ ID NO 37276 | GTCTCGCTGCTTTCAGAGCC | AGG | chr6 | 160661343 | 160661362 | 160661346 | - |
| SEQ ID NO 37277 | TGCCACCCCACTGCTCTTC | TAG | chr6 | 160661308 | 160661327 | 160661311 | - |
| SEQ ID NO 37278 | TAACCCACTCCATCTGCATG | TGG | chr6 | 160661277 | 160661296 | 160661280 | - |
| SEQ ID NO 37279 | GGCCCCACCACACCCCTCA | AAG | chr6 | 160661256 | 160661275 | 160661259 | - |
| SEQ ID NO 37280 | CCCCACCACACCCCTCAAAG | TGG | chr6 | 160661253 | 160661272 | 160661256 | - |
| SEQ ID NO 37281 | CCACACCCCTCAAAGTGGTC | AAG | chr6 | 160661248 | 160661267 | 160661251 | - |
| SEQ ID NO 37282 | CACACCCCTCAAAGTGGTCA | AGG | chr6 | 160661247 | 160661266 | 160661250 | - |
| SEQ ID NO 37283 | TGTCCTGTTGCTTAATTCCA | TGG | chr6 | 160661223 | 160661242 | 160661226 | - |
| SEQ ID NO 37284 | CCTGTTGCTTAATTCCATGG | AAG | chr6 | 160661220 | 160661239 | 160661223 | - |
| SEQ ID NO 37285 | TGCTTAATTCCATGGAAGCT | TGG | chr6 | 160661215 | 160661234 | 160661218 | - |
| SEQ ID NO 37286 | CTTGGCTATCTTCATTTTAT | TAG | chr6 | 160661197 | 160661216 | 160661200 | - |
| SEQ ID NO 37287 | TTCATTTTATTAGCCTCTTT | TGG | chr6 | 160661187 | 160661206 | 160661190 | - |
| SEQ ID NO 37288 | AAAATCACTACATTTTGTGC | CAG | chr6 | 160661150 | 160661169 | 160661153 | - |
| SEQ ID NO 37289 | AATCACTACATTTTGTGCCA | GAG | chr6 | 160661148 | 160661167 | 160661151 | - |
| SEQ ID NO 37290 | ACTACATTTTGTGCCAGAGA | TGG | chr6 | 160661144 | 160661163 | 160661147 | - |
| SEQ ID NO 37291 | TACATTTTGTGCCAGAGATG | GAG | chr6 | 160661142 | 160661161 | 160661145 | - |
| SEQ ID NO 37292 | TTTTGTGCCAGAGATGGAGC | TGG | chr6 | 160661138 | 160661157 | 160661141 | - |
| SEQ ID NO 37293 | AGAGATGGAGCTGGCATCTC | CAG | chr6 | 160661129 | 160661148 | 160661132 | - |
| SEQ ID NO 37294 | GAGATGGAGCTGGCATCTCC | AGG | chr6 | 160661128 | 160661147 | 160661131 | - |
| SEQ ID NO 37295 | GGAGCTGGCATCTCCAGGCT | TGG | chr6 | 160661123 | 160661142 | 160661126 | - |
| SEQ ID NO 37296 | GCTGGCATCTCCAGGCTTGG | AAG | chr6 | 160661120 | 160661139 | 160661123 | - |
| SEQ ID NO 37297 | TGGCATCTCCAGGCTTGGAA | GAG | chr6 | 160661118 | 160661137 | 160661121 | - |
| SEQ ID NO 37298 | GGCATCTCCAGGCTTGGAAG | AGG | chr6 | 160661117 | 160661136 | 160661120 | - |
| SEQ ID NO 37299 | GCATCTCCAGGCTTGGAAGA | GGG | chr6 | 160661116 | 160661135 | 160661119 | - |
| SEQ ID NO 37300 | GGCTTGGAAGAGGGCTGCTG | AAG | chr6 | 160661107 | 160661126 | 160661110 | - |
| SEQ ID NO 37301 | GGAAGAGGGCTGCTGAAGCT | CAG | chr6 | 160661102 | 160661121 | 160661105 | - |
| SEQ ID NO 37302 | GAGGGCTGCTGAAGCTCAGC | CAG | chr6 | 160661098 | 160661117 | 160661101 | - |
| SEQ ID NO 37303 | AGGGCTGCTGAAGCTCAGCC | AGG | chr6 | 160661097 | 160661116 | 160661100 | - |

Figure 55 (Cont'd)

| SEQ ID | Sequence | Codon | Chr | Start | End | Pos | Strand |
|---|---|---|---|---|---|---|---|
| SEQ ID NO 37304 | GAAGCTCAGCCAGGTGTCCT | AAG | chr6 | 160661088 | 160661107 | 160661091 | - |
| SEQ ID NO 37305 | AAGCTCAGCCAGGTGTCCTA | AGG | chr6 | 160661087 | 160661106 | 160661090 | - |
| SEQ ID NO 37306 | GCTCAGCCAGGTGTCCTAAG | GAG | chr6 | 160661085 | 160661104 | 160661088 | - |
| SEQ ID NO 37307 | CCAGGTGTCCTAAGGAGCCT | CAG | chr6 | 160661079 | 160661098 | 160661082 | - |
| SEQ ID NO 37308 | CAGGTGTCCTAAGGAGCCTC | AGG | chr6 | 160661078 | 160661097 | 160661081 | - |
| SEQ ID NO 37309 | TGTCCTAAGGAGCCTCAGGA | CAG | chr6 | 160661074 | 160661093 | 160661077 | - |
| SEQ ID NO 37310 | GTCCTAAGGAGCCTCAGGAC | AGG | chr6 | 160661073 | 160661092 | 160661076 | - |
| SEQ ID NO 37311 | TCCTAAGGAGCCTCAGGACA | GGG | chr6 | 160661072 | 160661091 | 160661075 | - |
| SEQ ID NO 37312 | CCTAAGGAGCCTCAGGACAG | GGG | chr6 | 160661071 | 160661090 | 160661074 | - |
| SEQ ID NO 37313 | GCCTCAGGACAGGGGATGCT | CAG | chr6 | 160661063 | 160661082 | 160661066 | - |
| SEQ ID NO 37314 | TCAGGACAGGGGATGCTCAG | TAG | chr6 | 160661060 | 160661079 | 160661063 | - |
| SEQ ID NO 37315 | GATGCTCAGTAGCCTTGCAA | TGG | chr6 | 160661049 | 160661068 | 160661052 | - |
| SEQ ID NO 37316 | ATGCTCAGTAGCCTTGCAAT | GGG | chr6 | 160661048 | 160661067 | 160661051 | - |
| SEQ ID NO 37317 | GTAGCCTTGCAATGGGAACA | CAG | chr6 | 160661041 | 160661060 | 160661044 | - |
| SEQ ID NO 37318 | CTTGCAATGGGAACACAGCT | GAG | chr6 | 160661036 | 160661055 | 160661039 | - |
| SEQ ID NO 37319 | GAACACAGCTGAGCCCCACT | TGG | chr6 | 160661026 | 160661045 | 160661029 | - |
| SEQ ID NO 37320 | TGGCCACCCTTTGCCACAAC | CAG | chr6 | 160661006 | 160661025 | 160661009 | - |
| SEQ ID NO 37321 | GGCCACCCTTTGCCACAACC | AGG | chr6 | 160661005 | 160661024 | 160661008 | - |
| SEQ ID NO 37322 | CACCCTTTGCCACAACCAGG | CAG | chr6 | 160661002 | 160661021 | 160661005 | - |
| SEQ ID NO 37323 | CTTTGCCACAACCAGGCAGA | AAG | chr6 | 160660998 | 160661017 | 160661001 | - |
| SEQ ID NO 37324 | TGCCACAACCAGGCAGAAAG | CAG | chr6 | 160660995 | 160661014 | 160660998 | - |
| SEQ ID NO 37325 | GGCAGAAAGCAGCTTTTGAA | CAG | chr6 | 160660984 | 160661003 | 160660987 | - |
| SEQ ID NO 37326 | TTTGAACAGATTTGTTGCCT | CAG | chr6 | 160660970 | 160660989 | 160660973 | - |
| SEQ ID NO 37327 | TTGCCTCAGATTTGATCTCA | AAG | chr6 | 160660956 | 160660975 | 160660959 | - |
| SEQ ID NO 37328 | TTGATCTCAAAGAAAAATCG | TGG | chr6 | 160660945 | 160660964 | 160660948 | - |
| SEQ ID NO 37329 | TGATCTCAAAGAAAAATCGT | GGG | chr6 | 160660944 | 160660963 | 160660947 | - |
| SEQ ID NO 37330 | TCTCAAAGAAAAATCGTGGG | CAG | chr6 | 160660941 | 160660960 | 160660944 | - |
| SEQ ID NO 37331 | AGAAAAATCGTGGGCAGTAT | TGG | chr6 | 160660935 | 160660954 | 160660938 | - |
| SEQ ID NO 37332 | ATCGTGGGCAGTATTGGTCC | CAG | chr6 | 160660929 | 160660948 | 160660932 | - |
| SEQ ID NO 37333 | TCGTGGGCAGTATTGGTCCC | AGG | chr6 | 160660928 | 160660947 | 160660931 | - |
| SEQ ID NO 37334 | TTACAATTTCCTCTGAAATC | TGG | chr6 | 160660895 | 160660914 | 160660898 | - |
| SEQ ID NO 37335 | CTGGATGCCTATCAACACCT | TGG | chr6 | 160660876 | 160660895 | 160660879 | - |
| SEQ ID NO 37336 | ACTGAATTCTCCCCAACTAA | TAG | chr6 | 160660849 | 160660868 | 160660852 | - |
| SEQ ID NO 37337 | GAATTCTCCCCAACTAATAG | TGG | chr6 | 160660846 | 160660865 | 160660849 | - |
| SEQ ID NO 37338 | CTAATAGTGGTGTGTCACTG | TAG | chr6 | 160660833 | 160660852 | 160660836 | - |
| SEQ ID NO 37339 | TAGTGGTGTGTCACTGTAGT | AAG | chr6 | 160660829 | 160660848 | 160660832 | - |
| SEQ ID NO 37340 | GTGTGTCACTGTAGTAAGCC | TAG | chr6 | 160660824 | 160660843 | 160660827 | - |
| SEQ ID NO 37341 | TAGTAAGCCTAGTACAAAAA | TGG | chr6 | 160660813 | 160660832 | 160660816 | - |
| SEQ ID NO 37342 | TACAAAATGGCCTTCTTTG | TGG | chr6 | 160660801 | 160660820 | 160660804 | - |
| SEQ ID NO 37343 | CAAAAATGGCCTTCTTTGTG | GAG | chr6 | 160660799 | 160660818 | 160660802 | - |
| SEQ ID NO 37344 | AAAAATGGCCTTCTTTGTGG | AGG | chr6 | 160660798 | 160660817 | 160660801 | - |
| SEQ ID NO 37345 | AAATGGCCTTCTTTGTGGAG | GAG | chr6 | 160660796 | 160660815 | 160660799 | - |
| SEQ ID NO 37346 | TTTTGCTTAATTTTTGCCC | AAG | chr6 | 160660754 | 160660773 | 160660757 | - |
| SEQ ID NO 37347 | GCTTAATTTTTGCCCAAGAT | GAG | chr6 | 160660749 | 160660768 | 160660752 | - |
| SEQ ID NO 37348 | CCCAAGATGAGAACATAATT | TAG | chr6 | 160660737 | 160660756 | 160660740 | - |
| SEQ ID NO 37349 | CACCAACATTTTTGTAACTA | AAG | chr6 | 160660681 | 160660700 | 160660684 | - |
| SEQ ID NO 37350 | ACCAACATTTTTGTAACTAA | AGG | chr6 | 160660680 | 160660699 | 160660683 | - |

Figure 55 (Cont'd)

| | | | | | | | |
|---|---|---|---|---|---|---|---|
| SEQ ID NO 37351 | CAACATTTTTGTAACTAAAG | GAG | chr6 | 160660678 | 160660697 | 160660681 | - |
| SEQ ID NO 37352 | AACATTTTTGTAACTAAAGG | AGG | chr6 | 160660677 | 160660696 | 160660680 | - |
| SEQ ID NO 37353 | ACATTTTTGTAACTAAAGGA | GGG | chr6 | 160660676 | 160660695 | 160660679 | - |
| SEQ ID NO 37354 | TAACTAAAGGAGGGACCATT | CAG | chr6 | 160660667 | 160660686 | 160660670 | - |
| SEQ ID NO 37355 | CTAAAGGAGGGACCATTCAG | AAG | chr6 | 160660664 | 160660683 | 160660667 | - |
| SEQ ID NO 37356 | AAGATGCTTATCAACTGTCA | AAG | chr6 | 160660644 | 160660663 | 160660647 | - |
| SEQ ID NO 37357 | CTTATCAACTGTCAAAGTGA | CAG | chr6 | 160660638 | 160660657 | 160660641 | - |
| SEQ ID NO 37358 | ACAACCAATGCACATATTGT | AAG | chr6 | 160660611 | 160660630 | 160660614 | - |
| SEQ ID NO 37359 | TATTGTAAGAAATCAAACAA | TGG | chr6 | 160660597 | 160660616 | 160660600 | - |
| SEQ ID NO 37360 | GAAATCAAACAATGGCCTCC | AAG | chr6 | 160660589 | 160660608 | 160660592 | - |
| SEQ ID NO 37361 | AAATCAAACAATGGCCTCCA | AGG | chr6 | 160660588 | 160660607 | 160660591 | - |
| SEQ ID NO 37362 | CTCCAAGGTTCATTTCTACA | CAG | chr6 | 160660573 | 160660592 | 160660576 | - |
| SEQ ID NO 37363 | TCCAAGGTTCATTTCTACAC | AGG | chr6 | 160660572 | 160660591 | 160660575 | - |
| SEQ ID NO 37364 | CCAAGGTTCATTTCTACACA | GGG | chr6 | 160660571 | 160660590 | 160660574 | - |
| SEQ ID NO 37365 | GTTCATTTCTACACAGGGAT | TAG | chr6 | 160660566 | 160660585 | 160660569 | - |
| SEQ ID NO 37366 | CATTTCTACACAGGGATTAG | CAG | chr6 | 160660563 | 160660582 | 160660566 | - |
| SEQ ID NO 37367 | TAGCAGATCAACATCAATCT | TGG | chr6 | 160660546 | 160660565 | 160660549 | - |
| SEQ ID NO 37368 | CAACATCAATCTTGGCAACA | CAG | chr6 | 160660538 | 160660557 | 160660541 | - |
| SEQ ID NO 37369 | GGCAACACAGTTGCCACTGA | TGG | chr6 | 160660525 | 160660544 | 160660528 | - |
| SEQ ID NO 37370 | TTATTTTTTTATCATGACA | TGG | chr6 | 160660498 | 160660517 | 160660501 | - |
| SEQ ID NO 37371 | TTTATCATGACATGGCAATC | AAG | chr6 | 160660490 | 160660509 | 160660493 | - |
| SEQ ID NO 37372 | TATCATGACATGGCAATCAA | GAG | chr6 | 160660488 | 160660507 | 160660491 | - |
| SEQ ID NO 37373 | AACATGATTTATTCTTATTT | AAG | chr6 | 160660463 | 160660482 | 160660466 | - |
| SEQ ID NO 37374 | TATTCTTATTTAAGATTTTA | TGG | chr6 | 160660454 | 160660473 | 160660457 | - |
| SEQ ID NO 37375 | CTTATTTAAGATTTTATGGT | TAG | chr6 | 160660450 | 160660469 | 160660453 | - |
| SEQ ID NO 37376 | TTAAGATTTTATGGTTAGAC | TAG | chr6 | 160660445 | 160660464 | 160660448 | - |
| SEQ ID NO 37377 | TAAGATTTTATGGTTAGACT | AGG | chr6 | 160660444 | 160660463 | 160660447 | - |
| SEQ ID NO 37378 | GATTTTATGGTTAGACTAGG | CAG | chr6 | 160660441 | 160660460 | 160660444 | - |
| SEQ ID NO 37379 | TTATGGTTAGACTAGGCAGA | TAG | chr6 | 160660437 | 160660456 | 160660440 | - |
| SEQ ID NO 37380 | GGTTAGACTAGGCAGATAGC | TAG | chr6 | 160660433 | 160660452 | 160660436 | - |
| SEQ ID NO 37381 | CTAGGCAGATAGCTAGATAT | GAG | chr6 | 160660426 | 160660445 | 160660429 | - |
| SEQ ID NO 37382 | GGCAGATAGCTAGATATGAG | CAG | chr6 | 160660423 | 160660442 | 160660426 | - |
| SEQ ID NO 37383 | GCAGATAGCTAGATATGAGC | AGG | chr6 | 160660422 | 160660441 | 160660425 | - |
| SEQ ID NO 37384 | AGATAGCTAGATATGAGCAG | GAG | chr6 | 160660420 | 160660439 | 160660423 | - |
| SEQ ID NO 37385 | GATAGCTAGATATGAGCAGG | AGG | chr6 | 160660419 | 160660438 | 160660422 | - |
| SEQ ID NO 37386 | AGCTAGATATGAGCAGGAGG | TGG | chr6 | 160660416 | 160660435 | 160660419 | - |
| SEQ ID NO 37387 | TAGATATGAGCAGGAGGTGG | AAG | chr6 | 160660413 | 160660432 | 160660416 | - |
| SEQ ID NO 37388 | AGCAGGAGGTGGAAGCCCCT | GAG | chr6 | 160660405 | 160660424 | 160660408 | - |
| SEQ ID NO 37389 | CAGGAGGTGGAAGCCCCTGA | GAG | chr6 | 160660403 | 160660422 | 160660406 | - |
| SEQ ID NO 37390 | GGTGGAAGCCCCTGAGAGAA | TGG | chr6 | 160660398 | 160660417 | 160660401 | - |
| SEQ ID NO 37391 | TGGAAGCCCCTGAGAGAATG | GAG | chr6 | 160660396 | 160660415 | 160660399 | - |
| SEQ ID NO 37392 | GGAAGCCCCTGAGAGAATGG | AGG | chr6 | 160660395 | 160660414 | 160660398 | - |
| SEQ ID NO 37393 | CCCCTGAGAGAATGGAGGTC | TGG | chr6 | 160660390 | 160660409 | 160660393 | - |
| SEQ ID NO 37394 | CCTGAGAGAATGGAGGTCTG | GAG | chr6 | 160660388 | 160660407 | 160660391 | - |
| SEQ ID NO 37395 | GTCTGGAGAATCTGAAACCC | CAG | chr6 | 160660373 | 160660392 | 160660376 | - |
| SEQ ID NO 37396 | CTGGAGAATCTGAAACCCCA | GAG | chr6 | 160660371 | 160660390 | 160660374 | - |
| SEQ ID NO 37397 | TGAAACCCCAGAGATTACCC | AAG | chr6 | 160660361 | 160660380 | 160660364 | - |

Figure 55 (Cont'd)

| | | | | | | | |
|---|---|---|---|---|---|---|---|
| SEQ ID NO 37398 | ATTACCCAAGTCCTGCATGC | TAG | chr6 | 160660348 | 160660367 | 160660351 | - |
| SEQ ID NO 37399 | AAGTCCTGCATGCTAGACAT | GAG | chr6 | 160660341 | 160660360 | 160660344 | - |
| SEQ ID NO 37400 | TCCTGCATGCTAGACATGAG | TGG | chr6 | 160660338 | 160660357 | 160660341 | - |
| SEQ ID NO 37401 | CTGCATGCTAGACATGAGTG | GAG | chr6 | 160660336 | 160660355 | 160660339 | - |
| SEQ ID NO 37402 | TGCATGCTAGACATGAGTGG | AGG | chr6 | 160660335 | 160660354 | 160660338 | - |
| SEQ ID NO 37403 | CATGCTAGACATGAGTGGAG | GAG | chr6 | 160660333 | 160660352 | 160660336 | - |
| SEQ ID NO 37404 | ATGCTAGACATGAGTGGAGG | AGG | chr6 | 160660332 | 160660351 | 160660335 | - |
| SEQ ID NO 37405 | TGCTAGACATGAGTGGAGGA | GGG | chr6 | 160660331 | 160660350 | 160660334 | - |
| SEQ ID NO 37406 | GCTAGACATGAGTGGAGGAG | GGG | chr6 | 160660330 | 160660349 | 160660333 | - |
| SEQ ID NO 37407 | CTAGACATGAGTGGAGGAGG | GGG | chr6 | 160660329 | 160660348 | 160660332 | - |
| SEQ ID NO 37408 | AGTGGAGGAGGGGAATACC | TAG | chr6 | 160660320 | 160660339 | 160660323 | - |
| SEQ ID NO 37409 | GTGGAGGAGGGGAATACCT | AGG | chr6 | 160660319 | 160660338 | 160660322 | - |
| SEQ ID NO 37410 | GAGGAGGGGAATACCTAGG | TAG | chr6 | 160660316 | 160660335 | 160660319 | - |
| SEQ ID NO 37411 | GGGGGAATACCTAGGTAGAA | AAG | chr6 | 160660311 | 160660330 | 160660314 | - |
| SEQ ID NO 37412 | GGTAGAAAAGAATGCCCCTT | AAG | chr6 | 160660298 | 160660317 | 160660301 | - |
| SEQ ID NO 37413 | AGAATGCCCCTTAAGATGCC | CAG | chr6 | 160660290 | 160660309 | 160660293 | - |
| SEQ ID NO 37414 | ATGCCCCTTAAGATGCCCAG | CAG | chr6 | 160660287 | 160660306 | 160660290 | - |
| SEQ ID NO 37415 | CCCAGCAGTCGCTCACTGTG | CAG | chr6 | 160660272 | 160660291 | 160660275 | - |
| SEQ ID NO 37416 | TCACTGTGCAGTTAACTTTT | CAG | chr6 | 160660260 | 160660279 | 160660263 | - |
| SEQ ID NO 37417 | TTAACTTTTCAGAATGCTGC | TAG | chr6 | 160660249 | 160660268 | 160660252 | - |
| SEQ ID NO 37418 | TGCTGCTAGATACATGCTGA | TAG | chr6 | 160660235 | 160660254 | 160660238 | - |
| SEQ ID NO 37419 | GCTGCTAGATACATGCTGAT | AGG | chr6 | 160660234 | 160660253 | 160660237 | - |
| SEQ ID NO 37420 | CTGCTAGATACATGCTGATA | GGG | chr6 | 160660233 | 160660252 | 160660236 | - |
| SEQ ID NO 37421 | GCTAGATACATGCTGATAGG | GAG | chr6 | 160660231 | 160660250 | 160660234 | - |
| SEQ ID NO 37422 | CTAGATACATGCTGATAGGG | AGG | chr6 | 160660230 | 160660249 | 160660233 | - |
| SEQ ID NO 37423 | TAGATACATGCTGATAGGGA | GGG | chr6 | 160660229 | 160660248 | 160660232 | - |
| SEQ ID NO 37424 | ATACATGCTGATAGGGAGGG | AAG | chr6 | 160660226 | 160660245 | 160660229 | - |
| SEQ ID NO 37425 | ACATGCTGATAGGGAGGGAA | GAG | chr6 | 160660224 | 160660243 | 160660227 | - |
| SEQ ID NO 37426 | CATGCTGATAGGGAGGGAAG | AGG | chr6 | 160660223 | 160660242 | 160660226 | - |
| SEQ ID NO 37427 | ATGCTGATAGGGAGGGAAGA | GGG | chr6 | 160660222 | 160660241 | 160660225 | - |
| SEQ ID NO 37428 | GATAGGGAGGGAAGAGGGCA | AAG | chr6 | 160660217 | 160660236 | 160660220 | - |
| SEQ ID NO 37429 | ATAGGGAGGGAAGAGGGCAA | AGG | chr6 | 160660216 | 160660235 | 160660219 | - |
| SEQ ID NO 37430 | AGGGAGGGAAGAGGGCAAAG | GAG | chr6 | 160660214 | 160660233 | 160660217 | - |
| SEQ ID NO 37431 | AGGGCAAAGGAGAAATTCCT | AAG | chr6 | 160660203 | 160660222 | 160660206 | - |
| SEQ ID NO 37432 | GGCAAAGGAGAAATTCCTAA | GAG | chr6 | 160660201 | 160660220 | 160660204 | - |
| SEQ ID NO 37433 | AGAAATTCCTAAGAGATACA | CGG | chr6 | 160660193 | 160660212 | 160660196 | - |
| SEQ ID NO 37434 | TCCTAAGAGATACACGGTTG | CAG | chr6 | 160660187 | 160660206 | 160660190 | - |
| SEQ ID NO 37435 | AAGAGATACACGGTTGCAGT | TAG | chr6 | 160660183 | 160660202 | 160660186 | - |
| SEQ ID NO 37436 | GTTGCAGTTAGTATACATCT | GAG | chr6 | 160660171 | 160660190 | 160660174 | - |
| SEQ ID NO 37437 | GAGTGCTATACAACCTTCTT | TGG | chr6 | 160660151 | 160660170 | 160660154 | - |
| SEQ ID NO 37438 | AGTGCTATACAACCTTCTTT | GGG | chr6 | 160660150 | 160660169 | 160660153 | - |
| SEQ ID NO 37439 | GCTATACAACCTTCTTTGGG | TGG | chr6 | 160660147 | 160660166 | 160660150 | - |
| SEQ ID NO 37440 | ATACAACCTTCTTTGGGTGG | TGG | chr6 | 160660144 | 160660163 | 160660147 | - |
| SEQ ID NO 37441 | AACCTTCTTTGGGTGGTGGC | AAG | chr6 | 160660140 | 160660159 | 160660143 | - |
| SEQ ID NO 37442 | CTTCTTTGGGTGGTGGCAAG | AAG | chr6 | 160660137 | 160660156 | 160660140 | - |
| SEQ ID NO 37443 | GGTGGTGGCAAGAAGCAATG | CAG | chr6 | 160660129 | 160660148 | 160660132 | - |
| SEQ ID NO 37444 | GAAGCAATGCAGCCATTACG | TAG | chr6 | 160660118 | 160660137 | 160660121 | - |

Figure 55 (Cont'd)

| | | | | | | | |
|---|---|---|---|---|---|---|---|
| SEQ ID NO 37445 | CATATCAAACACCTGTATCA | CAG | chr6 | 160660091 | 160660110 | 160660094 | - |
| SEQ ID NO 37446 | ATATCAAACACCTGTATCAC | AGG | chr6 | 160660090 | 160660109 | 160660093 | - |
| SEQ ID NO 37447 | CACCTGTATCACAGGTGTTA | AAG | chr6 | 160660082 | 160660101 | 160660085 | - |
| SEQ ID NO 37448 | ATCACAGGTGTTAAAGAAAC | AAG | chr6 | 160660075 | 160660094 | 160660078 | - |
| SEQ ID NO 37449 | ATGATTTGCAATATTGTCTT | TAG | chr6 | 160660024 | 160660043 | 160660027 | - |
| SEQ ID NO 37450 | CTATAAATATGATTTTTAAA | AAG | chr6 | 160659986 | 160660005 | 160659989 | - |
| SEQ ID NO 37451 | ATTTTTAAAAAGTATTTCTT | TAG | chr6 | 160659975 | 160659994 | 160659978 | - |
| SEQ ID NO 37452 | TTTTTAAAAAGTATTTCTTT | AGG | chr6 | 160659974 | 160659993 | 160659977 | - |
| SEQ ID NO 37453 | TAAAAAGTATTTCTTTAGGT | TGG | chr6 | 160659970 | 160659989 | 160659973 | - |
| SEQ ID NO 37454 | TACGCATTGACTTATCTTCC | TGG | chr6 | 160659938 | 160659957 | 160659941 | - |
| SEQ ID NO 37455 | ACGCATTGACTTATCTTCCT | GGG | chr6 | 160659937 | 160659956 | 160659940 | - |
| SEQ ID NO 37456 | CTTATCTTCCTGGGTTTCAT | TAG | chr6 | 160659928 | 160659947 | 160659931 | - |
| SEQ ID NO 37457 | ACTGTTTATCTCAAACTCTT | GAG | chr6 | 160659877 | 160659896 | 160659880 | - |
| SEQ ID NO 37458 | ATCTCAAACTCTTGAGATTA | AAG | chr6 | 160659870 | 160659889 | 160659873 | - |
| SEQ ID NO 37459 | AAACTCTTGAGATTAAAGTA | TGG | chr6 | 160659865 | 160659884 | 160659868 | - |
| SEQ ID NO 37460 | AACTCTTGAGATTAAAGTAT | GGG | chr6 | 160659864 | 160659883 | 160659867 | - |
| SEQ ID NO 37461 | TTGAGATTAAAGTATGGGCT | CAG | chr6 | 160659859 | 160659878 | 160659862 | - |
| SEQ ID NO 37462 | TGAGATTAAAGTATGGGCTC | AGG | chr6 | 160659858 | 160659877 | 160659861 | - |
| SEQ ID NO 37463 | AGATTAAAGTATGGGCTCAG | GAG | chr6 | 160659856 | 160659875 | 160659859 | - |
| SEQ ID NO 37464 | GATTAAAGTATGGGCTCAGG | AGG | chr6 | 160659855 | 160659874 | 160659858 | - |
| SEQ ID NO 37465 | ATTAAAGTATGGGCTCAGGA | GGG | chr6 | 160659854 | 160659873 | 160659857 | - |
| SEQ ID NO 37466 | TAAAGTATGGGCTCAGGAGG | GAG | chr6 | 160659852 | 160659871 | 160659855 | - |
| SEQ ID NO 37467 | GTATGGGCTCAGGAGGGAGC | GAG | chr6 | 160659848 | 160659867 | 160659851 | - |
| SEQ ID NO 37468 | TATGGGCTCAGGAGGGAGCG | AGG | chr6 | 160659847 | 160659866 | 160659850 | - |
| SEQ ID NO 37469 | TGGGCTCAGGAGGGAGCGAG | GAG | chr6 | 160659845 | 160659864 | 160659848 | - |
| SEQ ID NO 37470 | CAGGAGGGAGCGAGGAGCTT | CAG | chr6 | 160659839 | 160659858 | 160659842 | - |
| SEQ ID NO 37471 | AGGAGGGAGCGAGGAGCTTC | AGG | chr6 | 160659838 | 160659857 | 160659841 | - |
| SEQ ID NO 37472 | GAGGAGCTTCAGGACTCTCA | CGG | chr6 | 160659828 | 160659847 | 160659831 | - |
| SEQ ID NO 37473 | TCAGGACTCTCACGGACCTC | CAG | chr6 | 160659820 | 160659839 | 160659823 | - |
| SEQ ID NO 37474 | ACTCTCACGGACCTCCAGCA | CAG | chr6 | 160659815 | 160659834 | 160659818 | - |
| SEQ ID NO 37475 | CACGGACCTCCAGCACAGTG | TAG | chr6 | 160659810 | 160659829 | 160659813 | - |
| SEQ ID NO 37476 | AGCACAGTGTAGCTGCCTTA | TGG | chr6 | 160659799 | 160659818 | 160659802 | - |
| SEQ ID NO 37477 | AGTGTAGCTGCCTTATGGAA | AAG | chr6 | 160659794 | 160659813 | 160659797 | - |
| SEQ ID NO 37478 | GTAGCTGCCTTATGGAAAAG | TGG | chr6 | 160659791 | 160659810 | 160659794 | - |
| SEQ ID NO 37479 | GGCCACACTGTTTTCTGCAC | TGG | chr6 | 160659770 | 160659789 | 160659773 | - |
| SEQ ID NO 37480 | CTGCCCCTACTATTCCTCAC | TGG | chr6 | 160659744 | 160659763 | 160659747 | - |
| SEQ ID NO 37481 | TGCCCCTACTATTCCTCACT | GGG | chr6 | 160659743 | 160659762 | 160659746 | - |
| SEQ ID NO 37482 | CCCTACTATTCCTCACTGGG | CAG | chr6 | 160659740 | 160659759 | 160659743 | - |
| SEQ ID NO 37483 | CTACTATTCCTCACTGGGCA | GAG | chr6 | 160659738 | 160659757 | 160659741 | - |
| SEQ ID NO 37484 | ATTCCTCACTGGGCAGAGCA | CAG | chr6 | 160659733 | 160659752 | 160659736 | - |
| SEQ ID NO 37485 | TGGGCAGAGCACAGCCACCC | TGG | chr6 | 160659724 | 160659743 | 160659727 | - |
| SEQ ID NO 37486 | CTGGCCCTGCCTGAACATTT | TAG | chr6 | 160659705 | 160659724 | 160659708 | - |
| SEQ ID NO 37487 | CCCTGCCTGAACATTTTAGT | CAG | chr6 | 160659701 | 160659720 | 160659704 | - |
| SEQ ID NO 37488 | CTGAACATTTTAGTCAGTGT | TGG | chr6 | 160659695 | 160659714 | 160659698 | - |
| SEQ ID NO 37489 | GTGTTGGCTCTGTGCTTCTC | TGG | chr6 | 160659679 | 160659698 | 160659682 | - |
| SEQ ID NO 37490 | TGTTGGCTCTGTGCTTCTCT | GGG | chr6 | 160659678 | 160659697 | 160659681 | - |
| SEQ ID NO 37491 | GTTGGCTCTGTGCTTCTCTG | GGG | chr6 | 160659677 | 160659696 | 160659680 | - |

Figure 55 (Cont'd)

| | | | | | | | |
|---|---|---|---|---|---|---|---|
| SEQ ID NO 37492 | TGGCTCTGTGCTTCTCTGGG | GAG | chr6 | 160659675 | 160659694 | 160659678 | - |
| SEQ ID NO 37493 | GGCTCTGTGCTTCTCTGGGG | AGG | chr6 | 160659674 | 160659693 | 160659677 | - |
| SEQ ID NO 37494 | CTTCTCTGGGGAGGAAATCC | AAG | chr6 | 160659665 | 160659684 | 160659668 | - |
| SEQ ID NO 37495 | TCTCTGGGGAGGAAATCCAA | GAG | chr6 | 160659663 | 160659682 | 160659666 | - |
| SEQ ID NO 37496 | GAAATCCAAGAGACAACCCA | CAG | chr6 | 160659652 | 160659671 | 160659655 | - |
| SEQ ID NO 37497 | CCACAGCCCTCTGCCATTT | CAG | chr6 | 160659635 | 160659654 | 160659638 | - |
| SEQ ID NO 37498 | CCCCTCTGCCATTTCAGCTG | CAG | chr6 | 160659629 | 160659648 | 160659632 | - |
| SEQ ID NO 37499 | CTCTGCCATTTCAGCTGCAG | CAG | chr6 | 160659626 | 160659645 | 160659629 | - |
| SEQ ID NO 37500 | AGTACCACCGTTAATGCCCT | TGG | chr6 | 160659605 | 160659624 | 160659608 | - |
| SEQ ID NO 37501 | GTACCACCGTTAATGCCCTT | GGG | chr6 | 160659604 | 160659623 | 160659607 | - |
| SEQ ID NO 37502 | CCGTTAATGCCCTTGGGCTT | GAG | chr6 | 160659598 | 160659617 | 160659601 | - |
| SEQ ID NO 37503 | TAATGCCCTTGGGCTTGAGA | AAG | chr6 | 160659594 | 160659613 | 160659597 | - |
| SEQ ID NO 37504 | TGCCCTTGGGCTTGAGAAAG | AAG | chr6 | 160659591 | 160659610 | 160659594 | - |
| SEQ ID NO 37505 | GCCCTTGGGCTTGAGAAAGA | AGG | chr6 | 160659590 | 160659609 | 160659593 | - |
| SEQ ID NO 37506 | CCCTTGGGCTTGAGAAAGAA | GGG | chr6 | 160659589 | 160659608 | 160659592 | - |
| SEQ ID NO 37507 | GGCTTGAGAAAGAAGGGACC | TGG | chr6 | 160659583 | 160659602 | 160659586 | - |
| SEQ ID NO 37508 | GGCCACTTCCTGACACCTC | CAG | chr6 | 160659562 | 160659581 | 160659565 | - |
| SEQ ID NO 37509 | TCCCTGACACCTCCAGCACA | CAG | chr6 | 160659555 | 160659574 | 160659558 | - |
| SEQ ID NO 37510 | CTGACACCTCCAGCACACAG | CAG | chr6 | 160659552 | 160659571 | 160659555 | - |
| SEQ ID NO 37511 | TGACACCTCCAGCACACAGC | AGG | chr6 | 160659551 | 160659570 | 160659554 | - |
| SEQ ID NO 37512 | GACACCTCCAGCACACAGCA | GGG | chr6 | 160659550 | 160659569 | 160659553 | - |
| SEQ ID NO 37513 | CCTCCAGCACACAGCAGGGA | AAG | chr6 | 160659546 | 160659565 | 160659549 | - |
| SEQ ID NO 37514 | ACACAGCAGGGAAAGAATTC | CAG | chr6 | 160659538 | 160659557 | 160659541 | - |
| SEQ ID NO 37515 | TTCCAGTTTCTCTTTCTTGT | GAG | chr6 | 160659521 | 160659540 | 160659524 | - |
| SEQ ID NO 37516 | TTTCACCTGCTACTCTTCAC | CAG | chr6 | 160659497 | 160659516 | 160659500 | - |
| SEQ ID NO 37517 | TTCACCTGCTACTCTTCACC | AGG | chr6 | 160659496 | 160659515 | 160659499 | - |
| SEQ ID NO 37518 | CCTGCTACTCTTCACCAGGC | AAG | chr6 | 160659492 | 160659511 | 160659495 | - |
| SEQ ID NO 37519 | CTGCTACTCTTCACCAGGCA | AGG | chr6 | 160659491 | 160659510 | 160659494 | - |
| SEQ ID NO 37520 | TCTTCACCAGGCAAGGCTCC | TGG | chr6 | 160659484 | 160659503 | 160659487 | - |
| SEQ ID NO 37521 | ACCAGGCAAGGCTCCTGGCT | TGG | chr6 | 160659479 | 160659498 | 160659482 | - |
| SEQ ID NO 37522 | CCAGGCAAGGCTCCTGGCTT | GGG | chr6 | 160659478 | 160659497 | 160659481 | - |
| SEQ ID NO 37523 | AGGCTCCTGGCTTGGGCCCA | CAG | chr6 | 160659471 | 160659490 | 160659474 | - |
| SEQ ID NO 37524 | CCTGGCTTGGGCCCACAGTG | CAG | chr6 | 160659466 | 160659485 | 160659469 | - |
| SEQ ID NO 37525 | CTGGCTTGGGCCCACAGTGC | AGG | chr6 | 160659465 | 160659484 | 160659468 | - |
| SEQ ID NO 37526 | CAGTGCAGGCACCTCGAACT | CAG | chr6 | 160659451 | 160659470 | 160659454 | - |
| SEQ ID NO 37527 | ACTCAGTTGAACATTTCCAC | TGG | chr6 | 160659434 | 160659453 | 160659437 | - |
| SEQ ID NO 37528 | GGCTGCACTCTGTGTTTTTG | TGG | chr6 | 160659413 | 160659432 | 160659416 | - |
| SEQ ID NO 37529 | GCTGCACTCTGTGTTTTTGT | GGG | chr6 | 160659412 | 160659431 | 160659415 | - |
| SEQ ID NO 37530 | CTGCACTCTGTGTTTTTGTG | GGG | chr6 | 160659411 | 160659430 | 160659414 | - |
| SEQ ID NO 37531 | CTCTGTGTTTTTGTGGGGTG | AAG | chr6 | 160659406 | 160659425 | 160659409 | - |
| SEQ ID NO 37532 | TTTTTGTGGGGTGAAGCTCC | CAG | chr6 | 160659399 | 160659418 | 160659402 | - |
| SEQ ID NO 37533 | TTTGTGGGGTGAAGCTCCCA | GAG | chr6 | 160659397 | 160659416 | 160659400 | - |
| SEQ ID NO 37534 | TTGTGGGGTGAAGCTCCCAG | AGG | chr6 | 160659396 | 160659415 | 160659399 | - |
| SEQ ID NO 37535 | AAGCTCCCAGAGGTGACTGA | AAG | chr6 | 160659386 | 160659405 | 160659389 | - |
| SEQ ID NO 37536 | TCCTTCTGCCACTAACACTG | CAG | chr6 | 160659363 | 160659382 | 160659366 | - |
| SEQ ID NO 37537 | CATACTGCCCTTGCTGTACT | TGG | chr6 | 160659339 | 160659358 | 160659342 | - |
| SEQ ID NO 37538 | TGCCCTTGCTGTACTTGGAC | TAG | chr6 | 160659334 | 160659353 | 160659337 | - |

Figure 55 (Cont'd)

| SEQ ID | Sequence | Codon | Chr | Start | End | Pos | Strand |
|---|---|---|---|---|---|---|---|
| SEQ ID NO 37539 | GCCCTTGCTGTACTTGGACT | AGG | chr6 | 160659333 | 160659352 | 160659336 | - |
| SEQ ID NO 37540 | CCCTTGCTGTACTTGGACTA | GGG | chr6 | 160659332 | 160659351 | 160659335 | - |
| SEQ ID NO 37541 | TTGCTGTACTTGGACTAGGG | AAG | chr6 | 160659329 | 160659348 | 160659332 | - |
| SEQ ID NO 37542 | TGCTGTACTTGGACTAGGGA | AGG | chr6 | 160659328 | 160659347 | 160659331 | - |
| SEQ ID NO 37543 | CTTGGACTAGGGAAGGAAAA | AAG | chr6 | 160659321 | 160659340 | 160659324 | - |
| SEQ ID NO 37544 | AGGGAAGGAAAAAAGATCCT | GAG | chr6 | 160659313 | 160659332 | 160659316 | - |
| SEQ ID NO 37545 | TGAGTGCTTTACTCACACCC | CAG | chr6 | 160659294 | 160659313 | 160659297 | - |
| SEQ ID NO 37546 | ACTCACACCCCAGTGTGCCC | CAG | chr6 | 160659284 | 160659303 | 160659287 | - |
| SEQ ID NO 37547 | AGTGTGCCCCAGCCACCCTA | TGG | chr6 | 160659273 | 160659292 | 160659276 | - |
| SEQ ID NO 37548 | GCCCCAGCCACCCTATGGAA | AAG | chr6 | 160659268 | 160659287 | 160659271 | - |
| SEQ ID NO 37549 | CCCAGCCACCCTATGGAAAA | GAG | chr6 | 160659266 | 160659285 | 160659269 | - |
| SEQ ID NO 37550 | CCAGCCACCCTATGGAAAAG | AGG | chr6 | 160659265 | 160659284 | 160659268 | - |
| SEQ ID NO 37551 | CCACCCTATGGAAAAGAGGC | CAG | chr6 | 160659261 | 160659280 | 160659264 | - |
| SEQ ID NO 37552 | GGCCAGTGTGTCATCCCTGC | AAG | chr6 | 160659244 | 160659263 | 160659247 | - |
| SEQ ID NO 37553 | GTCATCCCTGCAAGCACCCT | GAG | chr6 | 160659235 | 160659254 | 160659238 | - |
| SEQ ID NO 37554 | TCATCCCTGCAAGCACCCTG | AGG | chr6 | 160659234 | 160659253 | 160659237 | - |
| SEQ ID NO 37555 | CCCCTGCCCCTGCTGCCCCC | AAG | chr6 | 160659211 | 160659230 | 160659214 | - |
| SEQ ID NO 37556 | CCCCTGCTGCCCCAAGCTG | TAG | chr6 | 160659205 | 160659224 | 160659208 | - |
| SEQ ID NO 37557 | CCTGCTGCCCCAAGCTGTA | GAG | chr6 | 160659203 | 160659222 | 160659206 | - |
| SEQ ID NO 37558 | CTGCCCCAAGCTGTAGAGC | CAG | chr6 | 160659199 | 160659218 | 160659202 | - |
| SEQ ID NO 37559 | AGCTGTAGAGCCAGAATATA | AAG | chr6 | 160659190 | 160659209 | 160659193 | - |
| SEQ ID NO 37560 | GTAGAGCCAGAATATAAAGC | TGG | chr6 | 160659186 | 160659205 | 160659189 | - |
| SEQ ID NO 37561 | GAGCCAGAATATAAAGCTGG | CAG | chr6 | 160659183 | 160659202 | 160659186 | - |
| SEQ ID NO 37562 | AGCTGGCAGAAAAATGTAAA | AAG | chr6 | 160659169 | 160659188 | 160659172 | - |
| SEQ ID NO 37563 | GCTGGCAGAAAAATGTAAAA | AGG | chr6 | 160659168 | 160659187 | 160659171 | - |
| SEQ ID NO 37564 | GCAGAAAAATGTAAAAGGC | TAG | chr6 | 160659164 | 160659183 | 160659167 | - |
| SEQ ID NO 37565 | AAAATGTAAAAGGCTAGAC | TGG | chr6 | 160659159 | 160659178 | 160659162 | - |
| SEQ ID NO 37566 | GTAAAAGGCTAGACTGGCT | TAG | chr6 | 160659154 | 160659173 | 160659157 | - |
| SEQ ID NO 37567 | GCTAGACTGGCTTAGCCTCC | CAG | chr6 | 160659146 | 160659165 | 160659149 | - |
| SEQ ID NO 37568 | CCTACATCTTTCTCCTGTGC | TGG | chr6 | 160659123 | 160659142 | 160659126 | - |
| SEQ ID NO 37569 | TCCTTCCTGCTCTTGAACAT | CGG | chr6 | 160659099 | 160659118 | 160659102 | - |
| SEQ ID NO 37570 | GCTCTTGAACATCGGACTCC | AAG | chr6 | 160659091 | 160659110 | 160659094 | - |
| SEQ ID NO 37571 | ACATCGGACTCCAAGTTCTT | CAG | chr6 | 160659083 | 160659102 | 160659086 | - |
| SEQ ID NO 37572 | GACTCCAAGTTCTTCAGCTG | TGG | chr6 | 160659077 | 160659096 | 160659080 | - |
| SEQ ID NO 37573 | ACTCCAAGTTCTTCAGCTGT | GGG | chr6 | 160659076 | 160659095 | 160659079 | - |
| SEQ ID NO 37574 | AGTTCTTCAGCTGTGGGACT | TGG | chr6 | 160659070 | 160659089 | 160659073 | - |
| SEQ ID NO 37575 | GGACTGTCTTCCTTGCTCCT | CAG | chr6 | 160659049 | 160659068 | 160659052 | - |
| SEQ ID NO 37576 | CTTCCTTGCTCCTCAGATTG | CAG | chr6 | 160659042 | 160659061 | 160659045 | - |
| SEQ ID NO 37577 | TTCCTTGCTCCTCAGATTGC | AGG | chr6 | 160659041 | 160659060 | 160659044 | - |
| SEQ ID NO 37578 | CTTGCTCCTCAGATTGCAGG | TGG | chr6 | 160659038 | 160659057 | 160659041 | - |
| SEQ ID NO 37579 | AGATTGCAGGTGGCCTATTA | TGG | chr6 | 160659028 | 160659047 | 160659031 | - |
| SEQ ID NO 37580 | GATTGCAGGTGGCCTATTAT | GGG | chr6 | 160659027 | 160659046 | 160659030 | - |
| SEQ ID NO 37581 | ATGGGACTTGTAATCTTGT | GAG | chr6 | 160659009 | 160659028 | 160659012 | - |
| SEQ ID NO 37582 | GTGAGTTAATACCACTTAAT | AAG | chr6 | 160658991 | 160659010 | 160658994 | - |
| SEQ ID NO 37583 | TAATAAGCTCCCCTTTGTGT | GAG | chr6 | 160658975 | 160658994 | 160658978 | - |
| SEQ ID NO 37584 | TGTGAGTATATCTATATCTA | TAG | chr6 | 160658958 | 160658977 | 160658961 | - |
| SEQ ID NO 37585 | AGTATATCTATATCTATAGA | TAG | chr6 | 160658954 | 160658973 | 160658957 | - |

Figure 55 (Cont'd)

| SEQ ID | Sequence | Codon | Chr | Pos1 | Pos2 | Pos3 | Strand |
|---|---|---|---|---|---|---|---|
| SEQ ID NO 37586 | TCTATATCTATAGATAGATA | TAG | chr6 | 160658948 | 160658967 | 160658951 | - |
| SEQ ID NO 37587 | CTATATCTATAGATAGATAT | AGG | chr6 | 160658947 | 160658966 | 160658950 | - |
| SEQ ID NO 37588 | ATATATATATAATCTCCTAT | TAG | chr6 | 160658866 | 160658885 | 160658869 | - |
| SEQ ID NO 37589 | TCCTATTAGTTCTGTCCCTC | TAG | chr6 | 160658852 | 160658871 | 160658855 | - |
| SEQ ID NO 37590 | CTATTAGTTCTGTCCCTCTA | GAG | chr6 | 160658850 | 160658869 | 160658853 | - |
| SEQ ID NO 37591 | CTAGAGAACCCCGACTAATA | CAG | chr6 | 160658833 | 160658852 | 160658836 | - |
| SEQ ID NO 37592 | ACTAATACAGATTTTCATAC | CAG | chr6 | 160658820 | 160658839 | 160658823 | - |
| SEQ ID NO 37593 | AATACAGATTTTCATACCAG | AAG | chr6 | 160658817 | 160658836 | 160658820 | - |
| SEQ ID NO 37594 | ACAGATTTTCATACCAGAAG | TGG | chr6 | 160658814 | 160658833 | 160658817 | - |
| SEQ ID NO 37595 | TCATACCAGAAGTGGTTCTT | GAG | chr6 | 160658806 | 160658825 | 160658809 | - |
| SEQ ID NO 37596 | CATACCAGAAGTGGTTCTTG | AGG | chr6 | 160658805 | 160658824 | 160658808 | - |
| SEQ ID NO 37597 | CAGAAGTGGTTCTTGAGGAA | CAG | chr6 | 160658800 | 160658819 | 160658803 | - |
| SEQ ID NO 37598 | TTCTTGAGGAACAGAATATT | AAG | chr6 | 160658791 | 160658810 | 160658794 | - |
| SEQ ID NO 37599 | TCTTGAGGAACAGAATATTA | AGG | chr6 | 160658790 | 160658809 | 160658793 | - |
| SEQ ID NO 37600 | GAGGAACAGAATATTAAGGA | TGG | chr6 | 160658786 | 160658805 | 160658789 | - |
| SEQ ID NO 37601 | TAAGGATGGAATTCTTTCAT | TGG | chr6 | 160658772 | 160658791 | 160658775 | - |
| SEQ ID NO 37602 | TGGAATTCTTTCATTGGTTT | TGG | chr6 | 160658766 | 160658785 | 160658769 | - |
| SEQ ID NO 37603 | GGAATTCTTTCATTGGTTTT | GGG | chr6 | 160658765 | 160658784 | 160658768 | - |
| SEQ ID NO 37604 | TTCATTGGTTTTGGGACTTC | TGG | chr6 | 160658757 | 160658776 | 160658760 | - |
| SEQ ID NO 37605 | GGTTTTGGGACTTCTGGTGT | TGG | chr6 | 160658751 | 160658770 | 160658754 | - |
| SEQ ID NO 37606 | TGTTGGCTGATTAATATGAT | TAG | chr6 | 160658734 | 160658753 | 160658737 | - |
| SEQ ID NO 37607 | TGATTAGACCAAAAAATGCT | AAG | chr6 | 160658718 | 160658737 | 160658721 | - |
| SEQ ID NO 37608 | GATTAGACCAAAAAATGCTA | AGG | chr6 | 160658717 | 160658736 | 160658720 | - |
| SEQ ID NO 37609 | GCTAAGGACTCTACTTCTAA | TAG | chr6 | 160658701 | 160658720 | 160658704 | - |
| SEQ ID NO 37610 | GGACTCTACTTCTAATAGTA | TGG | chr6 | 160658696 | 160658715 | 160658699 | - |
| SEQ ID NO 37611 | ACTCTACTTCTAATAGTATG | GAG | chr6 | 160658694 | 160658713 | 160658697 | - |
| SEQ ID NO 37612 | AATAGTATGGAGAACACTGA | TAG | chr6 | 160658683 | 160658702 | 160658686 | - |
| SEQ ID NO 37613 | TGGAGAACACTGATAGTACT | TGG | chr6 | 160658676 | 160658695 | 160658679 | - |
| SEQ ID NO 37614 | AGTACTTGGCCTGAATTGTT | TAG | chr6 | 160658662 | 160658681 | 160658665 | - |
| SEQ ID NO 37615 | TACTTGGCCTGAATTGTTTA | GAG | chr6 | 160658660 | 160658679 | 160658663 | - |
| SEQ ID NO 37616 | CTTGGCCTGAATTGTTTAGA | GAG | chr6 | 160658658 | 160658677 | 160658661 | - |
| SEQ ID NO 37617 | ACTACTGATTCATCACTTAT | GAG | chr6 | 160658611 | 160658630 | 160658614 | - |
| SEQ ID NO 37618 | TACTGATTCATCACTTATGA | GAG | chr6 | 160658609 | 160658628 | 160658612 | - |
| SEQ ID NO 37619 | ACTGATTCATCACTTATGAG | AGG | chr6 | 160658608 | 160658627 | 160658611 | - |
| SEQ ID NO 37620 | ATTCATCACTTATGAGAGGC | AAG | chr6 | 160658604 | 160658623 | 160658607 | - |
| SEQ ID NO 37621 | TTCATCACTTATGAGAGGCA | AGG | chr6 | 160658603 | 160658622 | 160658606 | - |
| SEQ ID NO 37622 | CATCACTTATGAGAGGCAAG | GAG | chr6 | 160658601 | 160658620 | 160658604 | - |
| SEQ ID NO 37623 | CTTATGAGAGGCAAGGAGTT | TAG | chr6 | 160658596 | 160658615 | 160658599 | - |
| SEQ ID NO 37624 | ATAATACCTTTGACTATATG | TGG | chr6 | 160658562 | 160658581 | 160658565 | - |
| SEQ ID NO 37625 | AATACCTTTGACTATATGTG | GAG | chr6 | 160658560 | 160658579 | 160658563 | - |
| SEQ ID NO 37626 | TTGACTATATGTGGAGAACC | AAG | chr6 | 160658553 | 160658572 | 160658556 | - |
| SEQ ID NO 37627 | TGACTATATGTGGAGAACCA | AGG | chr6 | 160658552 | 160658571 | 160658555 | - |
| SEQ ID NO 37628 | GAGAACCAAGGAACATAATG | AAG | chr6 | 160658540 | 160658559 | 160658543 | - |
| SEQ ID NO 37629 | ACCAAGGAACATAATGAAGT | TGG | chr6 | 160658536 | 160658555 | 160658539 | - |
| SEQ ID NO 37630 | GAAGTTGGTTGATTGCTCCT | AAG | chr6 | 160658521 | 160658540 | 160658524 | - |
| SEQ ID NO 37631 | TTGATTGCTCCTAAGTTCTC | TGG | chr6 | 160658513 | 160658532 | 160658516 | - |
| SEQ ID NO 37632 | GATTGCTCCTAAGTTCTCTG | GAG | chr6 | 160658511 | 160658530 | 160658514 | - |

Figure 55 (Cont'd)

| SEQ ID NO | Sequence | Codon | Chr | Start | End | Pos | Strand |
|---|---|---|---|---|---|---|---|
| SEQ ID NO 37633 | GCTCCTAAGTTCTCTGGAGA | AAG | chr6 | 160658507 | 160658526 | 160658510 | - |
| SEQ ID NO 37634 | TCCTAAGTTCTCTGGAGAAA | GAG | chr6 | 160658505 | 160658524 | 160658508 | - |
| SEQ ID NO 37635 | TTCTCTGGAGAAAGAGATGA | AAG | chr6 | 160658498 | 160658517 | 160658501 | - |
| SEQ ID NO 37636 | ATGAAAGAAAATGATGATCT | CAG | chr6 | 160658482 | 160658501 | 160658485 | - |
| SEQ ID NO 37637 | TGAAAGAAAATGATGATCTC | AGG | chr6 | 160658481 | 160658500 | 160658484 | - |
| SEQ ID NO 37638 | GAAAGAAAATGATGATCTCA | GGG | chr6 | 160658480 | 160658499 | 160658483 | - |
| SEQ ID NO 37639 | AAAGAAAATGATGATCTCAG | GGG | chr6 | 160658479 | 160658498 | 160658482 | - |
| SEQ ID NO 37640 | GGGGATCTGTCTCCCACCTT | CAG | chr6 | 160658460 | 160658479 | 160658463 | - |
| SEQ ID NO 37641 | GATCTGTCTCCCACCTTCAG | AAG | chr6 | 160658457 | 160658476 | 160658460 | - |
| SEQ ID NO 37642 | CTGTCTCCCACCTTCAGAAG | CAG | chr6 | 160658454 | 160658473 | 160658457 | - |
| SEQ ID NO 37643 | CACCTTCAGAAGCAGATACT | GAG | chr6 | 160658446 | 160658465 | 160658449 | - |
| SEQ ID NO 37644 | TACTGAGCCACAAATCTGCT | AAG | chr6 | 160658430 | 160658449 | 160658433 | - |
| SEQ ID NO 37645 | CTGCTAAGATTGCCCTGAAT | GAG | chr6 | 160658415 | 160658434 | 160658418 | - |
| SEQ ID NO 37646 | GCTAAGATTGCCCTGAATGA | GAG | chr6 | 160658413 | 160658432 | 160658416 | - |
| SEQ ID NO 37647 | AATGAGAGTTTTAACTCCTG | TAG | chr6 | 160658398 | 160658417 | 160658401 | - |
| SEQ ID NO 37648 | TGAGAGTTTTAACTCCTGTA | GAG | chr6 | 160658396 | 160658415 | 160658399 | - |
| SEQ ID NO 37649 | AGTTTTAACTCCTGTAGAGA | AAG | chr6 | 160658392 | 160658411 | 160658395 | - |
| SEQ ID NO 37650 | TTTTAACTCCTGTAGAGAAA | GAG | chr6 | 160658390 | 160658409 | 160658393 | - |
| SEQ ID NO 37651 | GAGTTGAAATTGTGAAAAAA | CAG | chr6 | 160658370 | 160658389 | 160658373 | - |
| SEQ ID NO 37652 | GTTGAAATTGTGAAAAAACA | GAG | chr6 | 160658368 | 160658387 | 160658371 | - |
| SEQ ID NO 37653 | AATTGTGAAAAAACAGAGAC | AAG | chr6 | 160658363 | 160658382 | 160658366 | - |
| SEQ ID NO 37654 | GAGACAAGCTGTTATCATGC | GAG | chr6 | 160658348 | 160658367 | 160658351 | - |
| SEQ ID NO 37655 | ACAAGCTGTTATCATGCGAG | TAG | chr6 | 160658345 | 160658364 | 160658348 | - |
| SEQ ID NO 37656 | GCGAGTAGCTGATCTGCAAC | AAG | chr6 | 160658330 | 160658349 | 160658333 | - |
| SEQ ID NO 37657 | GAGTAGCTGATCTGCAACAA | GAG | chr6 | 160658328 | 160658347 | 160658331 | - |
| SEQ ID NO 37658 | AGTAGCTGATCTGCAACAAG | AGG | chr6 | 160658327 | 160658346 | 160658330 | - |
| SEQ ID NO 37659 | TGCAACAAGAGGTGCATGCA | CAG | chr6 | 160658316 | 160658335 | 160658319 | - |
| SEQ ID NO 37660 | AGGTGCATGCACAGCCTTGC | CAG | chr6 | 160658307 | 160658326 | 160658310 | - |
| SEQ ID NO 37661 | GGTGCATGCACAGCCTTGCC | AGG | chr6 | 160658306 | 160658325 | 160658309 | - |
| SEQ ID NO 37662 | TTGCCAGGTGTTTACTGTTA | AAG | chr6 | 160658291 | 160658310 | 160658294 | - |
| SEQ ID NO 37663 | CAGGTGTTTACTGTTAAAGT | GAG | chr6 | 160658287 | 160658306 | 160658290 | - |
| SEQ ID NO 37664 | AGGTGTTTACTGTTAAAGTG | AGG | chr6 | 160658286 | 160658305 | 160658289 | - |
| SEQ ID NO 37665 | GGTGTTTACTGTTAAAGTGA | GGG | chr6 | 160658285 | 160658304 | 160658288 | - |
| SEQ ID NO 37666 | GTTAAAGTGAGGGCATTGAC | TGG | chr6 | 160658275 | 160658294 | 160658278 | - |
| SEQ ID NO 37667 | GGGCATTGACTGGAAAAAAA | TGG | chr6 | 160658265 | 160658284 | 160658268 | - |
| SEQ ID NO 37668 | GGCATTGACTGGAAAAAAAT | GGG | chr6 | 160658264 | 160658283 | 160658267 | - |
| SEQ ID NO 37669 | ACTGGAAAAAAATGGGACCC | TGG | chr6 | 160658257 | 160658276 | 160658260 | - |
| SEQ ID NO 37670 | AAAAATGGGACCCTGGAACT | TGG | chr6 | 160658250 | 160658269 | 160658253 | - |
| SEQ ID NO 37671 | AAATGGGACCCTGGAACTTG | GAG | chr6 | 160658248 | 160658267 | 160658251 | - |
| SEQ ID NO 37672 | TGGGACCCTGGAACTTGGAG | TGG | chr6 | 160658245 | 160658264 | 160658248 | - |
| SEQ ID NO 37673 | GGGACCCTGGAACTTGGAGT | GGG | chr6 | 160658244 | 160658263 | 160658247 | - |
| SEQ ID NO 37674 | GGACCCTGGAACTTGGAGTG | GGG | chr6 | 160658243 | 160658262 | 160658246 | - |
| SEQ ID NO 37675 | GAACTTGGAGTGGGGATGTG | TGG | chr6 | 160658235 | 160658254 | 160658238 | - |
| SEQ ID NO 37676 | AACTTGGAGTGGGGATGTGT | GGG | chr6 | 160658234 | 160658253 | 160658237 | - |
| SEQ ID NO 37677 | CTTGGAGTGGGGATGTGTGG | GAG | chr6 | 160658232 | 160658251 | 160658235 | - |
| SEQ ID NO 37678 | TGTGTGGGAGAACCCTGATG | AAG | chr6 | 160658219 | 160658238 | 160658222 | - |
| SEQ ID NO 37679 | GGGAGAACCCTGATGAAGCT | GAG | chr6 | 160658214 | 160658233 | 160658217 | - |

Figure 55 (Cont'd)

| SEQ ID | Sequence | Codon | Chr | Start | End | Pos | Strand |
|---|---|---|---|---|---|---|---|
| SEQ ID NO 37680 | GGAGAACCCTGATGAAGCTG | AGG | chr6 | 160658213 | 160658232 | 160658216 | - |
| SEQ ID NO 37681 | CTGATGAAGCTGAGGACACT | GAG | chr6 | 160658205 | 160658224 | 160658208 | - |
| SEQ ID NO 37682 | CTCTGATGAAACTTTTTTGC | CAG | chr6 | 160658174 | 160658193 | 160658177 | - |
| SEQ ID NO 37683 | TGATGAAACTTTTTTGCCAG | AAG | chr6 | 160658171 | 160658190 | 160658174 | - |
| SEQ ID NO 37684 | AACTTTTTTGCCAGAAGAAA | CAG | chr6 | 160658165 | 160658184 | 160658168 | - |
| SEQ ID NO 37685 | AGAAACAGTTTCCCCATCCC | CAG | chr6 | 160658150 | 160658169 | 160658153 | - |
| SEQ ID NO 37686 | AACAGTTTCCCCATCCCAG | TAG | chr6 | 160658147 | 160658166 | 160658150 | - |
| SEQ ID NO 37687 | AGTTTCCCCATCCCAGTAG | TGG | chr6 | 160658144 | 160658163 | 160658147 | - |
| SEQ ID NO 37688 | TCCCTGACCCGTGCTGCCAT | TAG | chr6 | 160658111 | 160658130 | 160658114 | - |
| SEQ ID NO 37689 | TAGCCTTTCCACCTTTGTCT | GAG | chr6 | 160658091 | 160658110 | 160658094 | - |
| SEQ ID NO 37690 | AGCCTTTCCACCTTTGTCTG | AGG | chr6 | 160658090 | 160658109 | 160658093 | - |
| SEQ ID NO 37691 | ATGTAAACCCTGCACTGCTT | GAG | chr6 | 160658067 | 160658086 | 160658070 | - |
| SEQ ID NO 37692 | TGTAAACCCTGCACTGCTTG | AGG | chr6 | 160658066 | 160658085 | 160658069 | - |
| SEQ ID NO 37693 | CCCTGCACTGCTTGAGGCAA | CAG | chr6 | 160658060 | 160658079 | 160658063 | - |
| SEQ ID NO 37694 | ACTGCTTGAGGCAACAGTGA | TGG | chr6 | 160658054 | 160658073 | 160658057 | - |
| SEQ ID NO 37695 | CAACAGTGATGGCCTTCCCT | GAG | chr6 | 160658043 | 160658062 | 160658046 | - |
| SEQ ID NO 37696 | AACAGTGATGGCCTTCCCTG | AGG | chr6 | 160658042 | 160658061 | 160658045 | - |
| SEQ ID NO 37697 | AGTGATGGCCTTCCCTGAGG | CAG | chr6 | 160658039 | 160658058 | 160658042 | - |
| SEQ ID NO 37698 | GCCTTCCCTGAGGCAGCTGC | CAG | chr6 | 160658032 | 160658051 | 160658035 | - |
| SEQ ID NO 37699 | CCTTCCCTGAGGCAGCTGCC | AGG | chr6 | 160658031 | 160658050 | 160658034 | - |
| SEQ ID NO 37700 | CCCTGAGGCAGCTGCCAGGC | AAG | chr6 | 160658027 | 160658046 | 160658030 | - |
| SEQ ID NO 37701 | AGATAATGTTGATTCTCCTC | AAG | chr6 | 160658006 | 160658025 | 160658009 | - |
| SEQ ID NO 37702 | ATAATGTTGATTCTCCTCAA | GAG | chr6 | 160658004 | 160658023 | 160658007 | - |
| SEQ ID NO 37703 | TAATGTTGATTCTCCTCAAG | AGG | chr6 | 160658003 | 160658022 | 160658006 | - |
| SEQ ID NO 37704 | CTAATGCCCCTGAATGCTTC | TAG | chr6 | 160657975 | 160657994 | 160657978 | - |
| SEQ ID NO 37705 | AATGCTTCTAGACCTATAAC | TAG | chr6 | 160657963 | 160657982 | 160657966 | - |
| SEQ ID NO 37706 | ATGCTTCTAGACCTATAACT | AGG | chr6 | 160657962 | 160657981 | 160657965 | - |
| SEQ ID NO 37707 | TAACTAGGCTAAATTCCTTG | CGG | chr6 | 160657947 | 160657966 | 160657950 | - |
| SEQ ID NO 37708 | AACTAGGCTAAATTCCTTGC | GGG | chr6 | 160657946 | 160657965 | 160657949 | - |
| SEQ ID NO 37709 | GCTAAATTCCTTGCGGGCCC | CAG | chr6 | 160657940 | 160657959 | 160657943 | - |
| SEQ ID NO 37710 | TAAATTCCTTGCGGGCCCCA | GAG | chr6 | 160657938 | 160657957 | 160657941 | - |
| SEQ ID NO 37711 | AAATTCCTTGCGGGCCCCAG | AGG | chr6 | 160657937 | 160657956 | 160657940 | - |
| SEQ ID NO 37712 | TCCTTGCGGGCCCCAGAGGT | GAG | chr6 | 160657933 | 160657952 | 160657936 | - |
| SEQ ID NO 37713 | CCTTGCGGGCCCCAGAGGTG | AGG | chr6 | 160657932 | 160657951 | 160657935 | - |
| SEQ ID NO 37714 | CGGGCCCCAGAGGTGAGGTT | CAG | chr6 | 160657927 | 160657946 | 160657930 | - |
| SEQ ID NO 37715 | GGCCCCAGAGGTGAGGTTCA | GAG | chr6 | 160657925 | 160657944 | 160657928 | - |
| SEQ ID NO 37716 | AGGTTCAGAGTGTGACCCAT | GAG | chr6 | 160657912 | 160657931 | 160657915 | - |
| SEQ ID NO 37717 | GGTTCAGAGTGTGACCCATG | AGG | chr6 | 160657911 | 160657930 | 160657914 | - |
| SEQ ID NO 37718 | TTCAGAGTGTGACCCATGAG | GAG | chr6 | 160657909 | 160657928 | 160657912 | - |
| SEQ ID NO 37719 | TCAGAGTGTGACCCATGAGG | AGG | chr6 | 160657908 | 160657927 | 160657911 | - |
| SEQ ID NO 37720 | GGAGGTGCATTATACTCTAA | AAG | chr6 | 160657890 | 160657909 | 160657893 | - |
| SEQ ID NO 37721 | ATACTCTAAAAGAACTGCTT | AAG | chr6 | 160657879 | 160657898 | 160657882 | - |
| SEQ ID NO 37722 | TTAAGCTTTCTAATTTATAT | TGG | chr6 | 160657861 | 160657880 | 160657864 | - |
| SEQ ID NO 37723 | AGCTTTCTAATTTATATTGG | CAG | chr6 | 160657858 | 160657877 | 160657861 | - |
| SEQ ID NO 37724 | AATTTATATTGGCAGAAATC | TGG | chr6 | 160657850 | 160657869 | 160657853 | - |
| SEQ ID NO 37725 | TTTATATTGGCAGAAATCTG | GAG | chr6 | 160657848 | 160657867 | 160657851 | - |
| SEQ ID NO 37726 | ATTGGCAGAAATCTGGAGAA | CAG | chr6 | 160657843 | 160657862 | 160657846 | - |

Figure 55 (Cont'd)

| | | | | | | | |
|---|---|---|---|---|---|---|---|
| SEQ ID NO 37727 | TTGGCAGAAATCTGGAGAAC | AGG | chr6 | 160657842 | 160657861 | 160657845 | - |
| SEQ ID NO 37728 | AGAAATCTGGAGAACAGGCA | TGG | chr6 | 160657837 | 160657856 | 160657840 | - |
| SEQ ID NO 37729 | GAAATCTGGAGAACAGGCAT | GGG | chr6 | 160657836 | 160657855 | 160657839 | - |
| SEQ ID NO 37730 | CTGGAGAACAGGCATGGGAA | TGG | chr6 | 160657831 | 160657850 | 160657834 | - |
| SEQ ID NO 37731 | CAGGCATGGGAATGGATATT | AAG | chr6 | 160657823 | 160657842 | 160657826 | - |
| SEQ ID NO 37732 | AGGCATGGGAATGGATATTA | AGG | chr6 | 160657822 | 160657841 | 160657825 | - |
| SEQ ID NO 37733 | GGCATGGGAATGGATATTAA | GGG | chr6 | 160657821 | 160657840 | 160657824 | - |
| SEQ ID NO 37734 | TGGGAATGGATATTAAGGGT | AAG | chr6 | 160657817 | 160657836 | 160657820 | - |
| SEQ ID NO 37735 | GGGAATGGATATTAAGGGTA | AGG | chr6 | 160657816 | 160657835 | 160657819 | - |
| SEQ ID NO 37736 | GGAATGGATATTAAGGGTAA | GGG | chr6 | 160657815 | 160657834 | 160657818 | - |
| SEQ ID NO 37737 | ATATTAAGGGTAAGGGATAA | TGG | chr6 | 160657808 | 160657827 | 160657811 | - |
| SEQ ID NO 37738 | TTAAGGGTAAGGGATAATGG | TGG | chr6 | 160657805 | 160657824 | 160657808 | - |
| SEQ ID NO 37739 | AGGGTAAGGGATAATGGTGG | AAG | chr6 | 160657802 | 160657821 | 160657805 | - |
| SEQ ID NO 37740 | GGGTAAGGGATAATGGTGGA | AGG | chr6 | 160657801 | 160657820 | 160657804 | - |
| SEQ ID NO 37741 | GGTAAGGGATAATGGTGGAA | GGG | chr6 | 160657800 | 160657819 | 160657803 | - |
| SEQ ID NO 37742 | GGATAATGGTGGAAGGGACA | TAG | chr6 | 160657794 | 160657813 | 160657797 | - |
| SEQ ID NO 37743 | ATAATGGTGGAAGGGACATA | GAG | chr6 | 160657792 | 160657811 | 160657795 | - |
| SEQ ID NO 37744 | TGGTGGAAGGGACATAGAGT | TGG | chr6 | 160657788 | 160657807 | 160657791 | - |
| SEQ ID NO 37745 | AAGGGACATAGAGTTGGATC | AAG | chr6 | 160657782 | 160657801 | 160657785 | - |
| SEQ ID NO 37746 | TTGGATCAAGCTGAATTTAT | TGG | chr6 | 160657769 | 160657788 | 160657772 | - |
| SEQ ID NO 37747 | TCAAGCTGAATTTATTGGTT | TGG | chr6 | 160657764 | 160657783 | 160657767 | - |
| SEQ ID NO 37748 | TTTATTGGTTTGGCCCTACT | AAG | chr6 | 160657754 | 160657773 | 160657757 | - |
| SEQ ID NO 37749 | ATTGGTTTGGCCCTACTAAG | TAG | chr6 | 160657751 | 160657770 | 160657754 | - |
| SEQ ID NO 37750 | TTGGTTTGGCCCTACTAAGT | AGG | chr6 | 160657750 | 160657769 | 160657753 | - |
| SEQ ID NO 37751 | TGGTTTGGCCCTACTAAGTA | GGG | chr6 | 160657749 | 160657768 | 160657752 | - |
| SEQ ID NO 37752 | GGATTCTGCATTTAATGTTG | CAG | chr6 | 160657728 | 160657747 | 160657731 | - |
| SEQ ID NO 37753 | CTGCATTTAATGTTGCAGCT | CGG | chr6 | 160657723 | 160657742 | 160657726 | - |
| SEQ ID NO 37754 | TGCATTTAATGTTGCAGCTC | GGG | chr6 | 160657722 | 160657741 | 160657725 | - |
| SEQ ID NO 37755 | GCATTTAATGTTGCAGCTCG | GGG | chr6 | 160657721 | 160657740 | 160657724 | - |
| SEQ ID NO 37756 | AATGTTGCAGCTCGGGGACT | TAG | chr6 | 160657715 | 160657734 | 160657718 | - |
| SEQ ID NO 37757 | TGCAGCTCGGGGACTTAGAA | AAG | chr6 | 160657710 | 160657729 | 160657713 | - |
| SEQ ID NO 37758 | GCAGCTCGGGGACTTAGAAA | AGG | chr6 | 160657709 | 160657728 | 160657712 | - |
| SEQ ID NO 37759 | GGACTTAGAAAAGGTTCTGA | TAG | chr6 | 160657700 | 160657719 | 160657703 | - |
| SEQ ID NO 37760 | GACTTAGAAAAGGTTCTGAT | AGG | chr6 | 160657699 | 160657718 | 160657702 | - |
| SEQ ID NO 37761 | ACTTAGAAAAGGTTCTGATA | GGG | chr6 | 160657698 | 160657717 | 160657701 | - |
| SEQ ID NO 37762 | AGAAAAGGTTCTGATAGGGC | CGG | chr6 | 160657694 | 160657713 | 160657697 | - |
| SEQ ID NO 37763 | GAAAAGGTTCTGATAGGGCC | GGG | chr6 | 160657693 | 160657712 | 160657696 | - |
| SEQ ID NO 37764 | AAAGGTTCTGATAGGGCCGG | GAG | chr6 | 160657691 | 160657710 | 160657694 | - |
| SEQ ID NO 37765 | GGTTCTGATAGGGCCGGGAG | CAG | chr6 | 160657688 | 160657707 | 160657691 | - |
| SEQ ID NO 37766 | TCTGATAGGGCCGGGAGCAG | TGG | chr6 | 160657685 | 160657704 | 160657688 | - |
| SEQ ID NO 37767 | GTGGCTCACGCCTGTAATCC | CAG | chr6 | 160657666 | 160657685 | 160657669 | - |
| SEQ ID NO 37768 | CGCCTGTAATCCCAGCACCT | TGG | chr6 | 160657658 | 160657677 | 160657661 | - |
| SEQ ID NO 37769 | GCCTGTAATCCCAGCACCTT | GGG | chr6 | 160657657 | 160657676 | 160657660 | - |
| SEQ ID NO 37770 | CTGTAATCCCAGCACCTTGG | GAG | chr6 | 160657655 | 160657674 | 160657658 | - |
| SEQ ID NO 37771 | TGTAATCCCAGCACCTTGGG | AGG | chr6 | 160657654 | 160657673 | 160657657 | - |
| SEQ ID NO 37772 | AATCCCAGCACCTTGGGAGG | CGG | chr6 | 160657651 | 160657670 | 160657654 | - |
| SEQ ID NO 37773 | ATCCCAGCACCTTGGGAGGC | GGG | chr6 | 160657650 | 160657669 | 160657653 | - |

Figure 55 (Cont'd)

| SEQ ID NO 37774 | TCCCAGCACCTTGGGAGGCG | GGG | chr6 | 160657649 | 160657668 | 160657652 | - |
| SEQ ID NO 37775 | CCCAGCACCTTGGGAGGCGG | GGG | chr6 | 160657648 | 160657667 | 160657651 | - |
| SEQ ID NO 37776 | AGCACCTTGGGAGGCGGGGG | CGG | chr6 | 160657645 | 160657664 | 160657648 | - |
| SEQ ID NO 37777 | GCACCTTGGGAGGCGGGGGC | GGG | chr6 | 160657644 | 160657663 | 160657647 | - |
| SEQ ID NO 37778 | CCTTGGGAGGCGGGGGCGGG | CAG | chr6 | 160657641 | 160657660 | 160657644 | - |
| SEQ ID NO 37779 | GGCGGGGGCGGGCAGATCAC | GAG | chr6 | 160657633 | 160657652 | 160657636 | - |
| SEQ ID NO 37780 | GGGCGGGCAGATCACGAGAT | CAG | chr6 | 160657628 | 160657647 | 160657631 | - |
| SEQ ID NO 37781 | GGCGGGCAGATCACGAGATC | AGG | chr6 | 160657627 | 160657646 | 160657630 | - |
| SEQ ID NO 37782 | CGGGCAGATCACGAGATCAG | GAG | chr6 | 160657625 | 160657644 | 160657628 | - |
| SEQ ID NO 37783 | GATCACGAGATCAGGAGATT | GAG | chr6 | 160657619 | 160657638 | 160657622 | - |
| SEQ ID NO 37784 | TCAGGAGATTGAGACAATTC | TGG | chr6 | 160657609 | 160657628 | 160657612 | - |
| SEQ ID NO 37785 | TGAGACAATTCTGGCTAAAA | TGG | chr6 | 160657600 | 160657619 | 160657603 | - |
| SEQ ID NO 37786 | TCTGCTAAAATACAAAAAT | TAG | chr6 | 160657565 | 160657584 | 160657568 | - |
| SEQ ID NO 37787 | CTAAAAATACAAAAATTAGC | TGG | chr6 | 160657561 | 160657580 | 160657564 | - |
| SEQ ID NO 37788 | TAAAAATACAAAAATTAGCT | GGG | chr6 | 160657560 | 160657579 | 160657563 | - |
| SEQ ID NO 37789 | ATACAAAAATTAGCTGGGCA | TGG | chr6 | 160657555 | 160657574 | 160657558 | - |
| SEQ ID NO 37790 | TAACTGTAATCTCATCTACT | TGG | chr6 | 160657525 | 160657544 | 160657528 | - |
| SEQ ID NO 37791 | AACTGTAATCTCATCTACTT | GGG | chr6 | 160657524 | 160657543 | 160657527 | - |
| SEQ ID NO 37792 | CTGTAATCTCATCTACTTGG | GAG | chr6 | 160657522 | 160657541 | 160657525 | - |
| SEQ ID NO 37793 | TGTAATCTCATCTACTTGGG | AGG | chr6 | 160657521 | 160657540 | 160657524 | - |
| SEQ ID NO 37794 | TCTCATCTACTTGGGAGGCT | GAG | chr6 | 160657516 | 160657535 | 160657519 | - |
| SEQ ID NO 37795 | CTCATCTACTTGGGAGGCTG | AGG | chr6 | 160657515 | 160657534 | 160657518 | - |
| SEQ ID NO 37796 | TCTACTTGGGAGGCTGAGGC | AAG | chr6 | 160657511 | 160657530 | 160657514 | - |
| SEQ ID NO 37797 | TACTTGGGAGGCTGAGGCAA | GAG | chr6 | 160657509 | 160657528 | 160657512 | - |
| SEQ ID NO 37798 | AGAGAACTGCTTGAACCTGT | GAG | chr6 | 160657490 | 160657509 | 160657493 | - |
| SEQ ID NO 37799 | GAGAACTGCTTGAACCTGTG | AGG | chr6 | 160657489 | 160657508 | 160657492 | - |
| SEQ ID NO 37800 | AACTGCTTGAACCTGTGAGG | CAG | chr6 | 160657486 | 160657505 | 160657489 | - |
| SEQ ID NO 37801 | CTGCTTGAACCTGTGAGGCA | GAG | chr6 | 160657484 | 160657503 | 160657487 | - |
| SEQ ID NO 37802 | AACCTGTGAGGCAGAGATTG | CAG | chr6 | 160657477 | 160657496 | 160657480 | - |
| SEQ ID NO 37803 | TGTGAGGCAGAGATTGCAGT | GAG | chr6 | 160657473 | 160657492 | 160657476 | - |
| SEQ ID NO 37804 | GGCAGAGATTGCAGTGAGCC | AAG | chr6 | 160657468 | 160657487 | 160657471 | - |
| SEQ ID NO 37805 | AAGATCGCCCCACTGCATTC | CAG | chr6 | 160657448 | 160657467 | 160657451 | - |
| SEQ ID NO 37806 | CGCCCCACTGCATTCCAGCC | TGG | chr6 | 160657443 | 160657462 | 160657446 | - |
| SEQ ID NO 37807 | ACTGCATTCCAGCCTGGTAA | CAG | chr6 | 160657437 | 160657456 | 160657440 | - |
| SEQ ID NO 37808 | TGCATTCCAGCCTGGTAACA | GAG | chr6 | 160657435 | 160657454 | 160657438 | - |
| SEQ ID NO 37809 | TTCCAGCCTGGTAACAGAGC | AAG | chr6 | 160657431 | 160657450 | 160657434 | - |
| SEQ ID NO 37810 | TTCCAAAAAAAAAAAAAAAA | AAG | chr6 | 160657401 | 160657420 | 160657404 | - |
| SEQ ID NO 37811 | AAAAAAAAAAAAAGTTATAA | TAG | chr6 | 160657392 | 160657411 | 160657395 | - |
| SEQ ID NO 37812 | GTTATAATAGTTTATTTGCT | TGG | chr6 | 160657379 | 160657398 | 160657382 | - |
| SEQ ID NO 37813 | TAATAGTTTATTTGCTTGGT | TAG | chr6 | 160657375 | 160657394 | 160657378 | - |
| SEQ ID NO 37814 | TTGCTTGGTTAGCTGAAATA | TGG | chr6 | 160657364 | 160657383 | 160657367 | - |
| SEQ ID NO 37815 | TTAGCTGAAATATGGATTAA | AAG | chr6 | 160657356 | 160657375 | 160657359 | - |
| SEQ ID NO 37816 | CTGAAATATGGATTAAAAGA | TGG | chr6 | 160657352 | 160657371 | 160657355 | - |
| SEQ ID NO 37817 | ATTAAAAGATGGTCCAATGT | TAG | chr6 | 160657341 | 160657360 | 160657344 | - |
| SEQ ID NO 37818 | AAAGATGGTCCAATGTTAGT | GAG | chr6 | 160657337 | 160657356 | 160657340 | - |
| SEQ ID NO 37819 | ATGGTCCAATGTTAGTGAGC | TGG | chr6 | 160657333 | 160657352 | 160657336 | - |
| SEQ ID NO 37820 | TTAGTGAGCTGGAAATGCCT | TGG | chr6 | 160657322 | 160657341 | 160657325 | - |

Figure 55 (Cont'd)

| SEQ ID NO | Sequence | Codon | Chr | Start | End | Pos | Strand |
|---|---|---|---|---|---|---|---|
| SEQ ID NO 37821 | GGAAATGCCTTGGTTTAATG | TAG | chr6 | 160657312 | 160657331 | 160657315 | - |
| SEQ ID NO 37822 | AAATGCCTTGGTTTAATGTA | GAG | chr6 | 160657310 | 160657329 | 160657313 | - |
| SEQ ID NO 37823 | AATGCCTTGGTTTAATGTAG | AGG | chr6 | 160657309 | 160657328 | 160657312 | - |
| SEQ ID NO 37824 | GCCTTGGTTTAATGTAGAGG | AAG | chr6 | 160657306 | 160657325 | 160657309 | - |
| SEQ ID NO 37825 | AATGTAGAGGAAGTGATCCA | AAG | chr6 | 160657296 | 160657315 | 160657299 | - |
| SEQ ID NO 37826 | ATGTAGAGGAAGTGATCCAA | AGG | chr6 | 160657295 | 160657314 | 160657298 | - |
| SEQ ID NO 37827 | GAGGAAGTGATCCAAAGGCT | TAG | chr6 | 160657290 | 160657309 | 160657293 | - |
| SEQ ID NO 37828 | AGGAAGTGATCCAAAGGCTT | AGG | chr6 | 160657289 | 160657308 | 160657292 | - |
| SEQ ID NO 37829 | GGAAGTGATCCAAAGGCTTA | GGG | chr6 | 160657288 | 160657307 | 160657291 | - |
| SEQ ID NO 37830 | AAGTGATCCAAAGGCTTAGG | GAG | chr6 | 160657286 | 160657305 | 160657289 | - |
| SEQ ID NO 37831 | ATCCAAAGGCTTAGGGAGAT | TAG | chr6 | 160657281 | 160657300 | 160657284 | - |
| SEQ ID NO 37832 | TCCAAAGGCTTAGGGAGATT | AGG | chr6 | 160657280 | 160657299 | 160657283 | - |
| SEQ ID NO 37833 | AAGGCTTAGGGAGATTAGGA | TGG | chr6 | 160657276 | 160657295 | 160657279 | - |
| SEQ ID NO 37834 | GCTTAGGGAGATTAGGATGG | TGG | chr6 | 160657273 | 160657292 | 160657276 | - |
| SEQ ID NO 37835 | TTAGGGAGATTAGGATGGTG | GAG | chr6 | 160657271 | 160657290 | 160657274 | - |
| SEQ ID NO 37836 | GGGAGATTAGGATGGTGGAG | TGG | chr6 | 160657268 | 160657287 | 160657271 | - |
| SEQ ID NO 37837 | ATTAGGATGGTGGAGTGGAT | TAG | chr6 | 160657263 | 160657282 | 160657266 | - |
| SEQ ID NO 37838 | GTGGAGTGGATTAGTCACTT | TAG | chr6 | 160657254 | 160657273 | 160657257 | - |
| SEQ ID NO 37839 | CACTTTAGACCTACTCATCC | CAG | chr6 | 160657239 | 160657258 | 160657242 | - |
| SEQ ID NO 37840 | TTAGACCTACTCATCCCAGC | TGG | chr6 | 160657235 | 160657254 | 160657238 | - |
| SEQ ID NO 37841 | TAGACCTACTCATCCCAGCT | GGG | chr6 | 160657234 | 160657253 | 160657237 | - |
| SEQ ID NO 37842 | GACCTACTCATCCCAGCTGG | GAG | chr6 | 160657232 | 160657251 | 160657235 | - |
| SEQ ID NO 37843 | ACCTACTCATCCCAGCTGGG | AGG | chr6 | 160657231 | 160657250 | 160657234 | - |
| SEQ ID NO 37844 | CCTACTCATCCCAGCTGGGA | GGG | chr6 | 160657230 | 160657249 | 160657233 | - |
| SEQ ID NO 37845 | TCATCCCAGCTGGGAGGGTC | CAG | chr6 | 160657225 | 160657244 | 160657228 | - |
| SEQ ID NO 37846 | TCCCAGCTGGGAGGGTCCAG | AAG | chr6 | 160657222 | 160657241 | 160657225 | - |
| SEQ ID NO 37847 | GGGTCCAGAAGATACACCCT | TGG | chr6 | 160657210 | 160657229 | 160657213 | - |
| SEQ ID NO 37848 | AGAAGATACACCCTTGGCCG | AAG | chr6 | 160657204 | 160657223 | 160657207 | - |
| SEQ ID NO 37849 | TTGGCCGAAGCTTTGTGAAA | TAG | chr6 | 160657191 | 160657210 | 160657194 | - |
| SEQ ID NO 37850 | GCTTTGTGAAATAGATTTGT | GAG | chr6 | 160657182 | 160657201 | 160657185 | - |
| SEQ ID NO 37851 | TTTGTGAAATAGATTTGTGA | GAG | chr6 | 160657180 | 160657199 | 160657183 | - |
| SEQ ID NO 37852 | GTGAAATAGATTTGTGAGAG | CAG | chr6 | 160657177 | 160657196 | 160657180 | - |
| SEQ ID NO 37853 | GAGCAGCACCTGTATTTTTG | AAG | chr6 | 160657160 | 160657179 | 160657163 | - |
| SEQ ID NO 37854 | GCAGCACCTGTATTTTTGAA | GAG | chr6 | 160657158 | 160657177 | 160657161 | - |
| SEQ ID NO 37855 | AATTGCTCTTCTCTGTATGT | CAG | chr6 | 160657130 | 160657149 | 160657133 | - |
| SEQ ID NO 37856 | TCTCTGTATGTCAGATCTAA | CAG | chr6 | 160657121 | 160657140 | 160657124 | - |
| SEQ ID NO 37857 | CTGTATGTCAGATCTAACAG | TAG | chr6 | 160657118 | 160657137 | 160657121 | - |
| SEQ ID NO 37858 | TGTATGTCAGATCTAACAGT | AGG | chr6 | 160657117 | 160657136 | 160657120 | - |
| SEQ ID NO 37859 | AGATCTAACAGTAGGAACCA | CAG | chr6 | 160657109 | 160657128 | 160657112 | - |
| SEQ ID NO 37860 | ACTACAAAATTTAAATACAA | TGG | chr6 | 160657079 | 160657098 | 160657082 | - |
| SEQ ID NO 37861 | CTACAAAATTTAAATACAAT | GGG | chr6 | 160657078 | 160657097 | 160657081 | - |
| SEQ ID NO 37862 | TTAAATACAATGGGAATAAT | TGG | chr6 | 160657069 | 160657088 | 160657072 | - |
| SEQ ID NO 37863 | AATGGGAATAATTGGATCCT | GAG | chr6 | 160657061 | 160657080 | 160657064 | - |
| SEQ ID NO 37864 | ATGGGAATAATTGGATCCTG | AGG | chr6 | 160657060 | 160657079 | 160657063 | - |
| SEQ ID NO 37865 | GGAATAATTGGATCCTGAGG | TGG | chr6 | 160657057 | 160657076 | 160657060 | - |
| SEQ ID NO 37866 | ATAATTGGATCCTGAGGTGG | CAG | chr6 | 160657054 | 160657073 | 160657057 | - |
| SEQ ID NO 37867 | TAATTGGATCCTGAGGTGGC | AGG | chr6 | 160657053 | 160657072 | 160657056 | - |

Figure 55 (Cont'd)

| | | | | | | | |
|---|---|---|---|---|---|---|---|
| SEQ ID NO 37868 | AATTGGATCCTGAGGTGGCA | GGG | chr6 | 160657052 | 160657071 | 160657055 | - |
| SEQ ID NO 37869 | ATTGGATCCTGAGGTGGCAG | GGG | chr6 | 160657051 | 160657070 | 160657054 | - |
| SEQ ID NO 37870 | ATCCTGAGGTGGCAGGGGCC | AAG | chr6 | 160657046 | 160657065 | 160657049 | - |
| SEQ ID NO 37871 | AGGTGGCAGGGGCCAAGTGT | TGG | chr6 | 160657040 | 160657059 | 160657043 | - |
| SEQ ID NO 37872 | GTGTTGGCACTGAACCATCA | AAG | chr6 | 160657024 | 160657043 | 160657027 | - |
| SEQ ID NO 37873 | TGTTGGCACTGAACCATCAA | AGG | chr6 | 160657023 | 160657042 | 160657026 | - |
| SEQ ID NO 37874 | GGCACTGAACCATCAAAGGC | AAG | chr6 | 160657019 | 160657038 | 160657022 | - |
| SEQ ID NO 37875 | GCACTGAACCATCAAAGGCA | AGG | chr6 | 160657018 | 160657037 | 160657021 | - |
| SEQ ID NO 37876 | CTGAACCATCAAAGGCAAGG | TGG | chr6 | 160657015 | 160657034 | 160657018 | - |
| SEQ ID NO 37877 | TGAACCATCAAAGGCAAGGT | GGG | chr6 | 160657014 | 160657033 | 160657017 | - |
| SEQ ID NO 37878 | GGTGGGCATAACTACCATAA | TAG | chr6 | 160656997 | 160657016 | 160657000 | - |
| SEQ ID NO 37879 | GGCATAACTACCATAATAGA | CAG | chr6 | 160656993 | 160657012 | 160656996 | - |
| SEQ ID NO 37880 | ATAACTACCATAATAGACAG | CAG | chr6 | 160656990 | 160657009 | 160656993 | - |
| SEQ ID NO 37881 | AACTACCATAATAGACAGCA | GAG | chr6 | 160656988 | 160657007 | 160656991 | - |
| SEQ ID NO 37882 | ACTACCATAATAGACAGCAG | AGG | chr6 | 160656987 | 160657006 | 160656990 | - |
| SEQ ID NO 37883 | CATAATAGACAGCAGAGGCA | AAG | chr6 | 160656982 | 160657001 | 160656985 | - |
| SEQ ID NO 37884 | AATAGACAGCAGAGGCAAAG | CAG | chr6 | 160656979 | 160656998 | 160656982 | - |
| SEQ ID NO 37885 | AGCAGAGGCAAAGCAGCCAT | CAG | chr6 | 160656972 | 160656991 | 160656975 | - |
| SEQ ID NO 37886 | AGGCAAAGCAGCCATCAGAA | TAG | chr6 | 160656967 | 160656986 | 160656970 | - |
| SEQ ID NO 37887 | TCAGAATAGTCTGACTCATG | TAG | chr6 | 160656953 | 160656972 | 160656956 | - |
| SEQ ID NO 37888 | AGAATAGTCTGACTCATGTA | GAG | chr6 | 160656951 | 160656970 | 160656954 | - |
| SEQ ID NO 37889 | GTCTGACTCATGTAGAGCTC | TGG | chr6 | 160656945 | 160656964 | 160656948 | - |
| SEQ ID NO 37890 | CTCATGTAGAGCTCTGGCAT | TGG | chr6 | 160656939 | 160656958 | 160656942 | - |
| SEQ ID NO 37891 | TGGCATTGGCTAATTAATCA | TGG | chr6 | 160656925 | 160656944 | 160656928 | - |
| SEQ ID NO 37892 | CTAATTAATCATGGTGTTCC | TAG | chr6 | 160656916 | 160656935 | 160656919 | - |
| SEQ ID NO 37893 | ATTAATCATGGTGTTCCTAG | AAG | chr6 | 160656913 | 160656932 | 160656916 | - |
| SEQ ID NO 37894 | GTTCCTAGAAGTGAAATTGA | TGG | chr6 | 160656901 | 160656920 | 160656904 | - |
| SEQ ID NO 37895 | TTCCTAGAAGTGAAATTGAT | GGG | chr6 | 160656900 | 160656919 | 160656903 | - |
| SEQ ID NO 37896 | TTATATAAACAAAAACTGC | CAG | chr6 | 160656853 | 160656872 | 160656856 | - |
| SEQ ID NO 37897 | TATATAAACAAAAACTGCC | AGG | chr6 | 160656852 | 160656871 | 160656855 | - |
| SEQ ID NO 37898 | ATAAACAAAAACTGCCAGG | TAG | chr6 | 160656849 | 160656868 | 160656852 | - |
| SEQ ID NO 37899 | CAAAAAACTGCCAGGTAGAA | TGG | chr6 | 160656844 | 160656863 | 160656847 | - |
| SEQ ID NO 37900 | CTGCCAGGTAGAATGGACTA | AAG | chr6 | 160656837 | 160656856 | 160656840 | - |
| SEQ ID NO 37901 | ACTAATCTGAATTATAAAAA | CAG | chr6 | 160656814 | 160656833 | 160656817 | - |
| SEQ ID NO 37902 | TAATCTGAATTATAAAACA | GAG | chr6 | 160656812 | 160656831 | 160656815 | - |
| SEQ ID NO 37903 | ATTATAAAACAGAGAATCA | TGG | chr6 | 160656804 | 160656823 | 160656807 | - |
| SEQ ID NO 37904 | TTATAAAACAGAGAATCAT | GGG | chr6 | 160656803 | 160656822 | 160656806 | - |
| SEQ ID NO 37905 | ATGGGCCCTCAATCAATTTC | CAG | chr6 | 160656785 | 160656804 | 160656788 | - |
| SEQ ID NO 37906 | TTCAGACTCGAACCTGTTA | CAG | chr6 | 160656768 | 160656787 | 160656771 | - |
| SEQ ID NO 37907 | ACTCGAACCTGTTACAGTTC | CAG | chr6 | 160656762 | 160656781 | 160656765 | - |
| SEQ ID NO 37908 | GTTCCAGAACCCACTGAATG | AAG | chr6 | 160656746 | 160656765 | 160656749 | - |
| SEQ ID NO 37909 | TTCCAGAACCCACTGAATGA | AGG | chr6 | 160656745 | 160656764 | 160656748 | - |
| SEQ ID NO 37910 | TCCAGAACCCACTGAATGAA | GGG | chr6 | 160656744 | 160656763 | 160656747 | - |
| SEQ ID NO 37911 | CCAGAACCCACTGAATGAAG | GGG | chr6 | 160656743 | 160656762 | 160656746 | - |
| SEQ ID NO 37912 | AGAACCCACTGAATGAAGGG | GAG | chr6 | 160656741 | 160656760 | 160656744 | - |
| SEQ ID NO 37913 | GAACCCACTGAATGAAGGGG | AGG | chr6 | 160656740 | 160656759 | 160656743 | - |
| SEQ ID NO 37914 | CCACTGAATGAAGGGGAGGC | TGG | chr6 | 160656736 | 160656755 | 160656739 | - |

Figure 55 (Cont'd)

| | | | | | | | |
|---|---|---|---|---|---|---|---|
| SEQ ID NO 37915 | AGGGGAGGCTGGATCCCCTT | GAG | chr6 | 160656725 | 160656744 | 160656728 | - |
| SEQ ID NO 37916 | GGGGAGGCTGGATCCCCTTG | AGG | chr6 | 160656724 | 160656743 | 160656727 | - |
| SEQ ID NO 37917 | GAGGCTGGATCCCCTTGAGG | AAG | chr6 | 160656721 | 160656740 | 160656724 | - |
| SEQ ID NO 37918 | AGGCTGGATCCCCTTGAGGA | AGG | chr6 | 160656720 | 160656739 | 160656723 | - |
| SEQ ID NO 37919 | CCCTTGAGGAAGGACACCAC | TAG | chr6 | 160656710 | 160656729 | 160656713 | - |
| SEQ ID NO 37920 | CCTTGAGGAAGGACACCACT | AGG | chr6 | 160656709 | 160656728 | 160656712 | - |
| SEQ ID NO 37921 | TCTTTCTCCCATCCTTCCCT | AAG | chr6 | 160656663 | 160656682 | 160656666 | - |
| SEQ ID NO 37922 | CTTTCTCCCATCCTTCCCTA | AGG | chr6 | 160656662 | 160656681 | 160656665 | - |
| SEQ ID NO 37923 | TTCTCCCATCCTTCCCTAAG | GAG | chr6 | 160656660 | 160656679 | 160656663 | - |
| SEQ ID NO 37924 | TCCTTCCCTAAGGAGACCTC | TGG | chr6 | 160656652 | 160656671 | 160656655 | - |
| SEQ ID NO 37925 | GGAGACCTCTGGCCTTTTAC | CAG | chr6 | 160656641 | 160656660 | 160656644 | - |
| SEQ ID NO 37926 | GAGACCTCTGGCCTTTTACC | AGG | chr6 | 160656640 | 160656659 | 160656643 | - |
| SEQ ID NO 37927 | AGACCTCTGGCCTTTTACCA | GGG | chr6 | 160656639 | 160656658 | 160656642 | - |
| SEQ ID NO 37928 | ACCAGGGTAACTGTGTGTAC | TGG | chr6 | 160656623 | 160656642 | 160656626 | - |
| SEQ ID NO 37929 | CAGGGTAACTGTGTGTACTG | GAG | chr6 | 160656621 | 160656640 | 160656624 | - |
| SEQ ID NO 37930 | GTAACTGTGTGTACTGGAGA | AAG | chr6 | 160656617 | 160656636 | 160656620 | - |
| SEQ ID NO 37931 | TAACTGTGTGTACTGGAGAA | AGG | chr6 | 160656616 | 160656635 | 160656619 | - |
| SEQ ID NO 37932 | AACTGTGTGTACTGGAGAAA | GGG | chr6 | 160656615 | 160656634 | 160656618 | - |
| SEQ ID NO 37933 | TGTGTGTACTGGAGAAAGGG | AAG | chr6 | 160656612 | 160656631 | 160656615 | - |
| SEQ ID NO 37934 | ACTGGAGAAAGGGAAGTAAT | GAG | chr6 | 160656605 | 160656624 | 160656608 | - |
| SEQ ID NO 37935 | AGGGAAGTAATGAGACATTT | CAG | chr6 | 160656596 | 160656615 | 160656599 | - |
| SEQ ID NO 37936 | AAGTAATGAGACATTTCAGA | AAG | chr6 | 160656592 | 160656611 | 160656595 | - |
| SEQ ID NO 37937 | TGAGACATTTCAGAAAGTAC | TGG | chr6 | 160656586 | 160656605 | 160656589 | - |
| SEQ ID NO 37938 | TTTCAGAAAGTACTGGACAC | TGG | chr6 | 160656579 | 160656598 | 160656582 | - |
| SEQ ID NO 37939 | AAGTACTGGACACTGGCTCT | GAG | chr6 | 160656572 | 160656591 | 160656575 | - |
| SEQ ID NO 37940 | CTCTGAGCTGACGTTGATTC | CAG | chr6 | 160656556 | 160656575 | 160656559 | - |
| SEQ ID NO 37941 | TCTGAGCTGACGTTGATTCC | AGG | chr6 | 160656555 | 160656574 | 160656558 | - |
| SEQ ID NO 37942 | CTGAGCTGACGTTGATTCCA | GGG | chr6 | 160656554 | 160656573 | 160656557 | - |
| SEQ ID NO 37943 | GGGTACCCAAAACGTTATTG | TGG | chr6 | 160656534 | 160656553 | 160656537 | - |
| SEQ ID NO 37944 | AAAACGTTATTGTGGTTCCC | CAG | chr6 | 160656526 | 160656545 | 160656529 | - |
| SEQ ID NO 37945 | TTATTGTGGTTCCCCAGTTA | AAG | chr6 | 160656520 | 160656539 | 160656523 | - |
| SEQ ID NO 37946 | TTGTGGTTCCCCAGTTAAAG | TAG | chr6 | 160656517 | 160656536 | 160656520 | - |
| SEQ ID NO 37947 | TGTGGTTCCCCAGTTAAAGT | AGG | chr6 | 160656516 | 160656535 | 160656519 | - |
| SEQ ID NO 37948 | GTGGTTCCCCAGTTAAAGTA | GGG | chr6 | 160656515 | 160656534 | 160656518 | - |
| SEQ ID NO 37949 | TGGTTCCCCAGTTAAAGTAG | GGG | chr6 | 160656514 | 160656533 | 160656517 | - |
| SEQ ID NO 37950 | CCAGTTAAAGTAGGGGCTTA | TGG | chr6 | 160656507 | 160656526 | 160656510 | - |
| SEQ ID NO 37951 | AGTTAAAGTAGGGGCTTATG | GAG | chr6 | 160656505 | 160656524 | 160656508 | - |
| SEQ ID NO 37952 | GTTAAAGTAGGGGCTTATGG | AGG | chr6 | 160656504 | 160656523 | 160656507 | - |
| SEQ ID NO 37953 | AAGTAGGGGCTTATGGAGGT | TAG | chr6 | 160656500 | 160656519 | 160656503 | - |
| SEQ ID NO 37954 | AGTAGGGGCTTATGGAGGTT | AGG | chr6 | 160656499 | 160656518 | 160656502 | - |
| SEQ ID NO 37955 | TATGGAGGTTAGGTAATTAA | TGG | chr6 | 160656489 | 160656508 | 160656492 | - |
| SEQ ID NO 37956 | TGGAGGTTAGGTAATTAATG | GAG | chr6 | 160656487 | 160656506 | 160656490 | - |
| SEQ ID NO 37957 | TTAGGTAATTAATGGAGTTT | TAG | chr6 | 160656481 | 160656500 | 160656484 | - |
| SEQ ID NO 37958 | TTTAGCTCATTTCTGACTTA | CAG | chr6 | 160656463 | 160656482 | 160656466 | - |
| SEQ ID NO 37959 | AGCTCATTTCTGACTTACAG | TGG | chr6 | 160656460 | 160656479 | 160656463 | - |
| SEQ ID NO 37960 | TTTCTGACTTACAGTGGTTC | CAG | chr6 | 160656454 | 160656473 | 160656457 | - |
| SEQ ID NO 37961 | CTGACTTACAGTGGTTCCAG | TGG | chr6 | 160656451 | 160656470 | 160656454 | - |

Figure 55 (Cont'd)

| SEQ ID NO 37962 | TGACTTACAGTGGTTCCAGT | GGG | chr6 | 160656450 | 160656469 | 160656453 | - |
| SEQ ID NO 37963 | CAGTGGTTCCAGTGGGTCCC | TGG | chr6 | 160656443 | 160656462 | 160656446 | - |
| SEQ ID NO 37964 | GGGTCCCTGGACTTATCCTC | TGG | chr6 | 160656430 | 160656449 | 160656433 | - |
| SEQ ID NO 37965 | TTATCCTCTGGTCATTTTCC | CAG | chr6 | 160656418 | 160656437 | 160656421 | - |
| SEQ ID NO 37966 | GCCAAAATGCATAATTTGTA | TAG | chr6 | 160656394 | 160656413 | 160656397 | - |
| SEQ ID NO 37967 | ATTTGTATAGACATACTTAT | TAG | chr6 | 160656381 | 160656400 | 160656384 | - |
| SEQ ID NO 37968 | GTATAGACATACTTATTAGC | TGG | chr6 | 160656377 | 160656396 | 160656380 | - |
| SEQ ID NO 37969 | TAGACATACTTATTAGCTGG | CAG | chr6 | 160656374 | 160656393 | 160656377 | - |
| SEQ ID NO 37970 | AGCTGGCAGAAATGCCACAT | TGG | chr6 | 160656360 | 160656379 | 160656363 | - |
| SEQ ID NO 37971 | TGCCACATTGGCTCCCTGAC | TGG | chr6 | 160656348 | 160656367 | 160656351 | - |
| SEQ ID NO 37972 | CACATTGGCTCCCTGACTGG | TAG | chr6 | 160656345 | 160656364 | 160656348 | - |
| SEQ ID NO 37973 | ACATTGGCTCCCTGACTGGT | AGG | chr6 | 160656344 | 160656363 | 160656347 | - |
| SEQ ID NO 37974 | GGCTCCCTGACTGGTAGGAT | GAG | chr6 | 160656339 | 160656358 | 160656342 | - |
| SEQ ID NO 37975 | GCTCCCTGACTGGTAGGATG | AGG | chr6 | 160656338 | 160656357 | 160656341 | - |
| SEQ ID NO 37976 | CTCCCTGACTGGTAGGATGA | GGG | chr6 | 160656337 | 160656356 | 160656340 | - |
| SEQ ID NO 37977 | TGGTAGGATGAGGGCTATTA | TGG | chr6 | 160656328 | 160656347 | 160656331 | - |
| SEQ ID NO 37978 | TAGGATGAGGGCTATTATGG | TGG | chr6 | 160656325 | 160656344 | 160656328 | - |
| SEQ ID NO 37979 | AGGATGAGGGCTATTATGGT | GGG | chr6 | 160656324 | 160656343 | 160656327 | - |
| SEQ ID NO 37980 | TGAGGGCTATTATGGTGGGA | AAG | chr6 | 160656320 | 160656339 | 160656323 | - |
| SEQ ID NO 37981 | GAGGGCTATTATGGTGGGAA | AGG | chr6 | 160656319 | 160656338 | 160656322 | - |
| SEQ ID NO 37982 | TTATGGTGGGAAAGGCCAAA | CAG | chr6 | 160656311 | 160656330 | 160656314 | - |
| SEQ ID NO 37983 | TGGTGGGAAAGGCCAAACAG | AAG | chr6 | 160656308 | 160656327 | 160656311 | - |
| SEQ ID NO 37984 | AAAGGCCAAACAGAAGCCAT | TAG | chr6 | 160656301 | 160656320 | 160656304 | - |
| SEQ ID NO 37985 | AGGCCAAACAGAAGCCATTA | GAG | chr6 | 160656299 | 160656318 | 160656302 | - |
| SEQ ID NO 37986 | CCATTAGAGCTGTCTCTACC | TAG | chr6 | 160656285 | 160656304 | 160656288 | - |
| SEQ ID NO 37987 | CAAAAACAATATCCCATCCC | TGG | chr6 | 160656248 | 160656267 | 160656251 | - |
| SEQ ID NO 37988 | AAAACAATATCCCATCCCTG | GAG | chr6 | 160656246 | 160656265 | 160656249 | - |
| SEQ ID NO 37989 | AAACAATATCCCATCCCTGG | AGG | chr6 | 160656245 | 160656264 | 160656248 | - |
| SEQ ID NO 37990 | AACAATATCCCATCCCTGGA | GGG | chr6 | 160656244 | 160656263 | 160656247 | - |
| SEQ ID NO 37991 | TCCCATCCCTGGAGGGACTG | AAG | chr6 | 160656237 | 160656256 | 160656240 | - |
| SEQ ID NO 37992 | CCTGGAGGGACTGAAGTGAT | TAG | chr6 | 160656230 | 160656249 | 160656233 | - |
| SEQ ID NO 37993 | AAGTGATTAGTGTCACCATC | AAG | chr6 | 160656217 | 160656236 | 160656220 | - |
| SEQ ID NO 37994 | AGTGATTAGTGTCACCATCA | AGG | chr6 | 160656216 | 160656235 | 160656219 | - |
| SEQ ID NO 37995 | TGTCACCATCAAGGACTTGA | AAG | chr6 | 160656207 | 160656226 | 160656210 | - |
| SEQ ID NO 37996 | CATCAAGGACTTGAAAGACG | CAG | chr6 | 160656201 | 160656220 | 160656204 | - |
| SEQ ID NO 37997 | ATCAAGGACTTGAAAGACGC | AGG | chr6 | 160656200 | 160656219 | 160656203 | - |
| SEQ ID NO 37998 | TCAAGGACTTGAAAGACGCA | GGG | chr6 | 160656199 | 160656218 | 160656202 | - |
| SEQ ID NO 37999 | CAAGGACTTGAAAGACGCAG | GGG | chr6 | 160656198 | 160656217 | 160656201 | - |
| SEQ ID NO 38000 | GGACTTGAAAGACGCAGGGG | TGG | chr6 | 160656195 | 160656214 | 160656198 | - |
| SEQ ID NO 38001 | ACTCTCCCATTTGACCTGTG | CAG | chr6 | 160656148 | 160656167 | 160656151 | - |
| SEQ ID NO 38002 | TCTCCCATTTGACCTGTGCA | GAG | chr6 | 160656146 | 160656165 | 160656149 | - |
| SEQ ID NO 38003 | CTCCCATTTGACCTGTGCAG | AGG | chr6 | 160656145 | 160656164 | 160656148 | - |
| SEQ ID NO 38004 | CATTTGACCTGTGCAGAGGA | CAG | chr6 | 160656141 | 160656160 | 160656144 | - |
| SEQ ID NO 38005 | TGACCTGTGCAGAGGACAGA | TGG | chr6 | 160656137 | 160656156 | 160656140 | - |
| SEQ ID NO 38006 | TGCAGAGGACAGATGGATCT | TGG | chr6 | 160656130 | 160656149 | 160656133 | - |
| SEQ ID NO 38007 | AGATGGATCTTGGAAAATGA | TGG | chr6 | 160656120 | 160656139 | 160656123 | - |
| SEQ ID NO 38008 | TGGATCTTGGAAAATGATGG | TGG | chr6 | 160656117 | 160656136 | 160656120 | - |

Figure 55 (Cont'd)

| | | | | | | | |
|---|---|---|---|---|---|---|---|
| SEQ ID NO 38009 | AAATGATGGTGGATTATTTT | AAG | chr6 | 160656106 | 160656125 | 160656109 | - |
| SEQ ID NO 38010 | GGATTATTTTAAGCTTAACC | AAG | chr6 | 160656096 | 160656115 | 160656099 | - |
| SEQ ID NO 38011 | TTATTTTAAGCTTAACCAAG | TGG | chr6 | 160656093 | 160656112 | 160656096 | - |
| SEQ ID NO 38012 | CCAAGTGGTGACTCCAATTG | CAG | chr6 | 160656078 | 160656097 | 160656081 | - |
| SEQ ID NO 38013 | TCCAATTGCAGCTGCTCTAC | CAG | chr6 | 160656066 | 160656085 | 160656069 | - |
| SEQ ID NO 38014 | TGCAGCTGCTCTACCAGTTG | TGG | chr6 | 160656060 | 160656079 | 160656063 | - |
| SEQ ID NO 38015 | CAGTTGTGGTTTTGTTGCTT | GAG | chr6 | 160656046 | 160656065 | 160656049 | - |
| SEQ ID NO 38016 | GAGCAAATTAACACATCTCC | TGG | chr6 | 160656026 | 160656045 | 160656029 | - |
| SEQ ID NO 38017 | TTAACACATCTCCTGGTGCC | TGG | chr6 | 160656019 | 160656038 | 160656022 | - |
| SEQ ID NO 38018 | ATCTCCTGGTGCCTGGTATG | CAG | chr6 | 160656012 | 160656031 | 160656015 | - |
| SEQ ID NO 38019 | GGTGCCTGGTATGCAGCCAT | TGG | chr6 | 160656005 | 160656024 | 160656008 | - |
| SEQ ID NO 38020 | CTGGTATGCAGCCATTGGCT | TGG | chr6 | 160656000 | 160656019 | 160656003 | - |
| SEQ ID NO 38021 | TATGCAGCCATTGGCTTGGC | AAG | chr6 | 160655996 | 160656015 | 160655999 | - |
| SEQ ID NO 38022 | GCAGCCATTGGCTTGGCAAG | TGG | chr6 | 160655993 | 160656012 | 160655996 | - |
| SEQ ID NO 38023 | TTTTCTCCATTCCTGTCCAT | AAG | chr6 | 160655968 | 160655987 | 160655971 | - |
| SEQ ID NO 38024 | TTCCTGTCCATAAGACCCAC | CAG | chr6 | 160655959 | 160655978 | 160655962 | - |
| SEQ ID NO 38025 | CTGTCCATAAGACCCACCAG | AAG | chr6 | 160655956 | 160655975 | 160655959 | - |
| SEQ ID NO 38026 | CACCAGAAGCAATTTGCCTT | CAG | chr6 | 160655942 | 160655961 | 160655945 | - |
| SEQ ID NO 38027 | GCAATTTGCCTTCAGCTGAC | AAG | chr6 | 160655934 | 160655953 | 160655937 | - |
| SEQ ID NO 38028 | CAATTTGCCTTCAGCTGACA | AGG | chr6 | 160655933 | 160655952 | 160655936 | - |
| SEQ ID NO 38029 | TTGCCTTCAGCTGACAAGGC | CAG | chr6 | 160655929 | 160655948 | 160655932 | - |
| SEQ ID NO 38030 | ATACCTTACCACCCTACCT | CAG | chr6 | 160655902 | 160655921 | 160655905 | - |
| SEQ ID NO 38031 | TACCTTTACCACCCTACCTC | AGG | chr6 | 160655901 | 160655920 | 160655904 | - |
| SEQ ID NO 38032 | ACCTTTACCACCCTACCTCA | GGG | chr6 | 160655900 | 160655919 | 160655903 | - |
| SEQ ID NO 38033 | CCTTTACCACCCTACCTCAG | GGG | chr6 | 160655899 | 160655918 | 160655902 | - |
| SEQ ID NO 38034 | TCAGGGGTGTATCAACTCTC | CAG | chr6 | 160655883 | 160655902 | 160655886 | - |
| SEQ ID NO 38035 | CTTTGTGTCATAATCTTATT | TGG | chr6 | 160655860 | 160655879 | 160655863 | - |
| SEQ ID NO 38036 | TTGTGTCATAATCTTATTTG | GAG | chr6 | 160655858 | 160655877 | 160655861 | - |
| SEQ ID NO 38037 | GTGTCATAATCTTATTTGGA | GAG | chr6 | 160655856 | 160655875 | 160655859 | - |
| SEQ ID NO 38038 | TGCTCGCTTTTCACTTCCAC | GAG | chr6 | 160655829 | 160655848 | 160655832 | - |
| SEQ ID NO 38039 | ACTTCCACGAGATATAACAC | TGG | chr6 | 160655817 | 160655836 | 160655820 | - |
| SEQ ID NO 38040 | ATTCATGACATTATGATGAT | TGG | chr6 | 160655786 | 160655805 | 160655789 | - |
| SEQ ID NO 38041 | GACATTATGATGATTGGATA | CAG | chr6 | 160655780 | 160655799 | 160655783 | - |
| SEQ ID NO 38042 | TTATGATGATTGGATACAGT | GAG | chr6 | 160655776 | 160655795 | 160655779 | - |
| SEQ ID NO 38043 | GATGATTGGATACAGTGAGC | AAG | chr6 | 160655772 | 160655791 | 160655775 | - |
| SEQ ID NO 38044 | GATTGGATACAGTGAGCAAG | AAG | chr6 | 160655769 | 160655788 | 160655772 | - |
| SEQ ID NO 38045 | TGGATACAGTGAGCAAGAAG | TAG | chr6 | 160655766 | 160655785 | 160655769 | - |
| SEQ ID NO 38046 | AGCAAACACACTGAACTTAT | TGG | chr6 | 160655745 | 160655764 | 160655748 | - |
| SEQ ID NO 38047 | AACACACTGAACTTATTGGT | GAG | chr6 | 160655741 | 160655760 | 160655744 | - |
| SEQ ID NO 38048 | TTGGTGAGACATTTGTATGC | CAG | chr6 | 160655726 | 160655745 | 160655729 | - |
| SEQ ID NO 38049 | GGTGAGACATTTGTATGCCA | GAG | chr6 | 160655724 | 160655743 | 160655727 | - |
| SEQ ID NO 38050 | GTGAGACATTTGTATGCCAG | AGG | chr6 | 160655723 | 160655742 | 160655726 | - |
| SEQ ID NO 38051 | GACATTTGTATGCCAGAGGA | TGG | chr6 | 160655719 | 160655738 | 160655722 | - |
| SEQ ID NO 38052 | ACATTTGTATGCCAGAGGAT | GGG | chr6 | 160655718 | 160655737 | 160655721 | - |
| SEQ ID NO 38053 | CAGAGGATGGGAAATAAATC | CAG | chr6 | 160655706 | 160655725 | 160655709 | - |
| SEQ ID NO 38054 | AAATAAATCCAGCTAAAATT | TAG | chr6 | 160655695 | 160655714 | 160655698 | - |
| SEQ ID NO 38055 | AATAAATCCAGCTAAAATTT | AGG | chr6 | 160655694 | 160655713 | 160655697 | - |

Figure 55 (Cont'd)

| SEQ ID | Sequence | PAM | Chr | Start | End | Pos | Strand |
|---|---|---|---|---|---|---|---|
| SEQ ID NO 38056 | ATAAATCCAGCTAAAATTTA | GGG | chr6 | 160655693 | 160655712 | 160655696 | - |
| SEQ ID NO 38057 | AATTTAGGGACTTTCTACCT | CGG | chr6 | 160655679 | 160655698 | 160655682 | - |
| SEQ ID NO 38058 | TTCTACCTCGGTAAAATTTC | TAG | chr6 | 160655667 | 160655686 | 160655670 | - |
| SEQ ID NO 38059 | TCTACCTCGGTAAAATTTCT | AGG | chr6 | 160655666 | 160655685 | 160655669 | - |
| SEQ ID NO 38060 | CTACCTCGGTAAAATTTCTA | GGG | chr6 | 160655665 | 160655684 | 160655668 | - |
| SEQ ID NO 38061 | CGGTAAAATTTCTAGGGTTC | CAG | chr6 | 160655659 | 160655678 | 160655662 | - |
| SEQ ID NO 38062 | TAAAATTTCTAGGGTTCCAG | TGG | chr6 | 160655656 | 160655675 | 160655659 | - |
| SEQ ID NO 38063 | TTCTAGGGTTCCAGTGGCAT | GAG | chr6 | 160655650 | 160655669 | 160655653 | - |
| SEQ ID NO 38064 | TTCCAGTGGCATGAGACCTA | TGG | chr6 | 160655642 | 160655661 | 160655645 | - |
| SEQ ID NO 38065 | CCAGTGGCATGAGACCTATG | GAG | chr6 | 160655640 | 160655659 | 160655643 | - |
| SEQ ID NO 38066 | CCTATGGAGATATTCCTTCT | AAG | chr6 | 160655626 | 160655645 | 160655629 | - |
| SEQ ID NO 38067 | CTATGGAGATATTCCTTCTA | AGG | chr6 | 160655625 | 160655644 | 160655628 | - |
| SEQ ID NO 38068 | GAGATATTCCTTCTAAGGTG | AAG | chr6 | 160655620 | 160655639 | 160655623 | - |
| SEQ ID NO 38069 | GAAGCATAACTTGCTGCGTT | TGG | chr6 | 160655601 | 160655620 | 160655604 | - |
| SEQ ID NO 38070 | GTTTGGCCCCTCTTACAACC | AAG | chr6 | 160655584 | 160655603 | 160655587 | - |
| SEQ ID NO 38071 | GGCCCCTCTTACAACCAAGA | AAG | chr6 | 160655580 | 160655599 | 160655583 | - |
| SEQ ID NO 38072 | CCCCTCTTACAACCAAGAAA | GAG | chr6 | 160655578 | 160655597 | 160655581 | - |
| SEQ ID NO 38073 | CCCTCTTACAACCAAGAAAG | AGG | chr6 | 160655577 | 160655596 | 160655580 | - |
| SEQ ID NO 38074 | CAAGAAAGAGGCACAATGCC | TGG | chr6 | 160655565 | 160655584 | 160655568 | - |
| SEQ ID NO 38075 | GAAAGAGGCACAATGCCTGG | TGG | chr6 | 160655562 | 160655581 | 160655565 | - |
| SEQ ID NO 38076 | AAAGAGGCACAATGCCTGGT | GGG | chr6 | 160655561 | 160655580 | 160655564 | - |
| SEQ ID NO 38077 | CAATGCCTGGTGGGCCTATT | TGG | chr6 | 160655552 | 160655571 | 160655555 | - |
| SEQ ID NO 38078 | TGGTGGGCCTATTTGGATTT | TGG | chr6 | 160655545 | 160655564 | 160655548 | - |
| SEQ ID NO 38079 | GTGGGCCTATTTGGATTTTG | GAG | chr6 | 160655543 | 160655562 | 160655546 | - |
| SEQ ID NO 38080 | TGGGCCTATTTGGATTTTGG | AGG | chr6 | 160655542 | 160655561 | 160655545 | - |
| SEQ ID NO 38081 | GAGGCAACACATTCCTCGTT | TGG | chr6 | 160655523 | 160655542 | 160655526 | - |
| SEQ ID NO 38082 | AGGCAACACATTCCTCGTTT | GGG | chr6 | 160655522 | 160655541 | 160655525 | - |
| SEQ ID NO 38083 | CTCGTTTGGGTGTGTTACTC | TGG | chr6 | 160655509 | 160655528 | 160655512 | - |
| SEQ ID NO 38084 | GTTACTCTGGCCCATTTATC | GAG | chr6 | 160655496 | 160655515 | 160655499 | - |
| SEQ ID NO 38085 | CCATTTATCGAGTGACCTGA | AAG | chr6 | 160655485 | 160655504 | 160655488 | - |
| SEQ ID NO 38086 | CATTTATCGAGTGACCTGAA | AGG | chr6 | 160655484 | 160655503 | 160655487 | - |
| SEQ ID NO 38087 | CGAGTGACCTGAAAGGCTGC | CAG | chr6 | 160655477 | 160655496 | 160655480 | - |
| SEQ ID NO 38088 | CCTGAAAGGCTGCCAGATTT | AAG | chr6 | 160655470 | 160655489 | 160655473 | - |
| SEQ ID NO 38089 | AAGGCTGCCAGATTTAAGTG | CAG | chr6 | 160655465 | 160655484 | 160655468 | - |
| SEQ ID NO 38090 | TGCCAGATTTAAGTGCAGTC | TAG | chr6 | 160655460 | 160655479 | 160655463 | - |
| SEQ ID NO 38091 | TTAAGTGCAGTCTAGAACAA | AAG | chr6 | 160655452 | 160655471 | 160655455 | - |
| SEQ ID NO 38092 | AGTGCAGTCTAGAACAAAAG | AAG | chr6 | 160655449 | 160655468 | 160655452 | - |
| SEQ ID NO 38093 | GTGCAGTCTAGAACAAAAGA | AGG | chr6 | 160655448 | 160655467 | 160655451 | - |
| SEQ ID NO 38094 | AACAAAAGAAGGCTCTGAAA | CAG | chr6 | 160655437 | 160655456 | 160655440 | - |
| SEQ ID NO 38095 | ACAAAAGAAGGCTCTGAAAC | AGG | chr6 | 160655436 | 160655455 | 160655439 | - |
| SEQ ID NO 38096 | AGAAGGCTCTGAAACAGGTC | CAG | chr6 | 160655431 | 160655450 | 160655434 | - |
| SEQ ID NO 38097 | GAAGGCTCTGAAACAGGTCC | AGG | chr6 | 160655430 | 160655449 | 160655433 | - |
| SEQ ID NO 38098 | ACAGGTCCAGGCTGCTGTGA | AAG | chr6 | 160655418 | 160655437 | 160655421 | - |
| SEQ ID NO 38099 | GTGAAAGCTGCTCTGCCATT | TGG | chr6 | 160655402 | 160655421 | 160655405 | - |
| SEQ ID NO 38100 | TGAAAGCTGCTCTGCCATTT | GGG | chr6 | 160655401 | 160655420 | 160655404 | - |
| SEQ ID NO 38101 | ATTTGGGCCACATGACCCCG | CAG | chr6 | 160655385 | 160655404 | 160655388 | - |
| SEQ ID NO 38102 | ACATGACCCCGCAGATCCAA | TGG | chr6 | 160655376 | 160655395 | 160655379 | - |

Figure 55 (Cont'd)

| | | | | | | | |
|---|---|---|---|---|---|---|---|
| SEQ ID NO 38103 | CCGCAGATCCAATGGTGCTT | GAG | chr6 | 160655368 | 160655387 | 160655371 | - |
| SEQ ID NO 38104 | CGCAGATCCAATGGTGCTTG | AGG | chr6 | 160655367 | 160655386 | 160655370 | - |
| SEQ ID NO 38105 | TCCAATGGTGCTTGAGGTGT | CAG | chr6 | 160655361 | 160655380 | 160655364 | - |
| SEQ ID NO 38106 | AATGGTGCTTGAGGTGTCAG | TGG | chr6 | 160655358 | 160655377 | 160655361 | - |
| SEQ ID NO 38107 | GGTGCTTGAGGTGTCAGTGG | CAG | chr6 | 160655355 | 160655374 | 160655358 | - |
| SEQ ID NO 38108 | CTTGAGGTGTCAGTGGCAGA | TAG | chr6 | 160655351 | 160655370 | 160655354 | - |
| SEQ ID NO 38109 | TTGAGGTGTCAGTGGCAGAT | AGG | chr6 | 160655350 | 160655369 | 160655353 | - |
| SEQ ID NO 38110 | TGAGGTGTCAGTGGCAGATA | GGG | chr6 | 160655349 | 160655368 | 160655352 | - |
| SEQ ID NO 38111 | TGGCAGATAGGGATGCTGTT | TGG | chr6 | 160655338 | 160655357 | 160655341 | - |
| SEQ ID NO 38112 | GCAGATAGGGATGCTGTTTG | GAG | chr6 | 160655336 | 160655355 | 160655339 | - |
| SEQ ID NO 38113 | GGGATGCTGTTTGGAGCCTT | TGG | chr6 | 160655329 | 160655348 | 160655332 | - |
| SEQ ID NO 38114 | ATGCTGTTTGGAGCCTTTGG | CAG | chr6 | 160655326 | 160655345 | 160655329 | - |
| SEQ ID NO 38115 | TGCTGTTTGGAGCCTTTGGC | AGG | chr6 | 160655325 | 160655344 | 160655328 | - |
| SEQ ID NO 38116 | GAGCCTTTGGCAGGCCCCCA | TAG | chr6 | 160655316 | 160655335 | 160655319 | - |
| SEQ ID NO 38117 | AGCCTTTGGCAGGCCCCCAT | AGG | chr6 | 160655315 | 160655334 | 160655318 | - |
| SEQ ID NO 38118 | AGGCCCCCATAGGTGAATCA | CAG | chr6 | 160655305 | 160655324 | 160655308 | - |
| SEQ ID NO 38119 | CCCCCATAGGTGAATCACAG | TGG | chr6 | 160655302 | 160655321 | 160655305 | - |
| SEQ ID NO 38120 | CCCATAGGTGAATCACAGTG | GAG | chr6 | 160655300 | 160655319 | 160655303 | - |
| SEQ ID NO 38121 | TGAATCACAGTGGAGACCTC | TAG | chr6 | 160655292 | 160655311 | 160655295 | - |
| SEQ ID NO 38122 | GAATCACAGTGGAGACCTCT | AGG | chr6 | 160655291 | 160655310 | 160655294 | - |
| SEQ ID NO 38123 | AGTGGAGACCTCTAGGATTT | TGG | chr6 | 160655284 | 160655303 | 160655287 | - |
| SEQ ID NO 38124 | TGGAGACCTCTAGGATTTTG | GAG | chr6 | 160655282 | 160655301 | 160655285 | - |
| SEQ ID NO 38125 | GACCTCTAGGATTTTGGAGC | AAG | chr6 | 160655278 | 160655297 | 160655281 | - |
| SEQ ID NO 38126 | ACCTCTAGGATTTTGGAGCA | AGG | chr6 | 160655277 | 160655296 | 160655280 | - |
| SEQ ID NO 38127 | GCAAGGCCCTGCCACTTCTG | CAG | chr6 | 160655260 | 160655279 | 160655263 | - |
| SEQ ID NO 38128 | CAGATAACTACTCTCCTTTT | GAG | chr6 | 160655240 | 160655259 | 160655243 | - |
| SEQ ID NO 38129 | GATAACTACTCTCCTTTTGA | GAG | chr6 | 160655238 | 160655257 | 160655241 | - |
| SEQ ID NO 38130 | ACTACTCTCCTTTTGAGAGA | CAG | chr6 | 160655234 | 160655253 | 160655237 | - |
| SEQ ID NO 38131 | TCCTTTTGAGAGACAGCTAT | TGG | chr6 | 160655227 | 160655246 | 160655230 | - |
| SEQ ID NO 38132 | GACAGCTATTGGTCTGTTAT | TGG | chr6 | 160655216 | 160655235 | 160655219 | - |
| SEQ ID NO 38133 | ACAGCTATTGGTCTGTTATT | GGG | chr6 | 160655215 | 160655234 | 160655218 | - |
| SEQ ID NO 38134 | ATTGGTCTGTTATTGGGCTT | TGG | chr6 | 160655209 | 160655228 | 160655212 | - |
| SEQ ID NO 38135 | GGTCTGTTATTGGGCTTTGG | TGG | chr6 | 160655206 | 160655225 | 160655209 | - |
| SEQ ID NO 38136 | GGTAACTGAACGTTTGACTG | TGG | chr6 | 160655185 | 160655204 | 160655188 | - |
| SEQ ID NO 38137 | GTAACTGAACGTTTGACTGT | GGG | chr6 | 160655184 | 160655203 | 160655187 | - |
| SEQ ID NO 38138 | ACGTTTGACTGTGGGTCATA | AAG | chr6 | 160655176 | 160655195 | 160655179 | - |
| SEQ ID NO 38139 | TGAACCTGCCTATCATGAAC | TGG | chr6 | 160655140 | 160655159 | 160655143 | - |
| SEQ ID NO 38140 | TGGTTGCTTTCTGACCCATC | TAG | chr6 | 160655120 | 160655139 | 160655123 | - |
| SEQ ID NO 38141 | TTCTGACCCATCTAGCCATG | AAG | chr6 | 160655112 | 160655131 | 160655115 | - |
| SEQ ID NO 38142 | TGACCCATCTAGCCATGAAG | TGG | chr6 | 160655109 | 160655128 | 160655112 | - |
| SEQ ID NO 38143 | GACCCATCTAGCCATGAAGT | GGG | chr6 | 160655108 | 160655127 | 160655111 | - |
| SEQ ID NO 38144 | CATCTAGCCATGAAGTGGGT | CAG | chr6 | 160655104 | 160655123 | 160655107 | - |
| SEQ ID NO 38145 | AGCCATGAAGTGGGTCAGCA | CAG | chr6 | 160655099 | 160655118 | 160655102 | - |
| SEQ ID NO 38146 | CATGAAGTGGGTCAGCACAG | CGG | chr6 | 160655096 | 160655115 | 160655099 | - |
| SEQ ID NO 38147 | GGCATTTCATCATCAAATTG | AAG | chr6 | 160655075 | 160655094 | 160655078 | - |
| SEQ ID NO 38148 | ATTTCATCATCAAATTGAAG | TGG | chr6 | 160655072 | 160655091 | 160655075 | - |
| SEQ ID NO 38149 | TGAAGTGGTGTGTATGTGAT | CGG | chr6 | 160655057 | 160655076 | 160655060 | - |

Figure 55 (Cont'd)

| SEQ ID | Sequence | Codon | Chr | Start | End | Pos | Strand |
|---|---|---|---|---|---|---|---|
| SEQ ID NO 38150 | GAAGTGGTGTGTATGTGATC | GGG | chr6 | 160655056 | 160655075 | 160655059 | - |
| SEQ ID NO 38151 | GTGTGTATGTGATCGGGCTT | GAG | chr6 | 160655050 | 160655069 | 160655053 | - |
| SEQ ID NO 38152 | TGTATGTGATCGGGCTTGAG | CAG | chr6 | 160655047 | 160655066 | 160655050 | - |
| SEQ ID NO 38153 | GTATGTGATCGGGCTTGAGC | AGG | chr6 | 160655046 | 160655065 | 160655049 | - |
| SEQ ID NO 38154 | TCGGGCTTGAGCAGGTCCTG | AAG | chr6 | 160655038 | 160655057 | 160655041 | - |
| SEQ ID NO 38155 | CGGGCTTGAGCAGGTCCTGA | AGG | chr6 | 160655037 | 160655056 | 160655040 | - |
| SEQ ID NO 38156 | TGAGCAGGTCCTGAAGGCAC | AAG | chr6 | 160655031 | 160655050 | 160655034 | - |
| SEQ ID NO 38157 | CAGGTCCTGAAGGCACAAGT | AAG | chr6 | 160655027 | 160655046 | 160655030 | - |
| SEQ ID NO 38158 | AAGGCACAAGTAAGTTACAT | AAG | chr6 | 160655018 | 160655037 | 160655021 | - |
| SEQ ID NO 38159 | AGGCACAAGTAAGTTACATA | AGG | chr6 | 160655017 | 160655036 | 160655020 | - |
| SEQ ID NO 38160 | CACAAGTAAGTTACATAAGG | AAG | chr6 | 160655014 | 160655033 | 160655017 | - |
| SEQ ID NO 38161 | AAGTAAGTTACATAAGGAAG | TGG | chr6 | 160655011 | 160655030 | 160655014 | - |
| SEQ ID NO 38162 | CCACCCTGCCTTCCCTCCCC | CAG | chr6 | 160654961 | 160654980 | 160654964 | - |
| SEQ ID NO 38163 | CCTCCCCAGCCTGCACCAA | TGG | chr6 | 160654948 | 160654967 | 160654951 | - |
| SEQ ID NO 38164 | AGCCTGCACCAATGGCCTCA | TGG | chr6 | 160654940 | 160654959 | 160654943 | - |
| SEQ ID NO 38165 | GCCTGCACCAATGGCCTCAT | GGG | chr6 | 160654939 | 160654958 | 160654942 | - |
| SEQ ID NO 38166 | CCTGCACCAATGGCCTCATG | GGG | chr6 | 160654938 | 160654957 | 160654941 | - |
| SEQ ID NO 38167 | TGCACCAATGGCCTCATGGG | GAG | chr6 | 160654936 | 160654955 | 160654939 | - |
| SEQ ID NO 38168 | CATGGGGAGTTCCCTATGAT | CAG | chr6 | 160654922 | 160654941 | 160654925 | - |
| SEQ ID NO 38169 | AGTTCCCTATGATCAGTTGA | CAG | chr6 | 160654915 | 160654934 | 160654918 | - |
| SEQ ID NO 38170 | TTCCCTATGATCAGTTGACA | GAG | chr6 | 160654913 | 160654932 | 160654916 | - |
| SEQ ID NO 38171 | TCCCTATGATCAGTTGACAG | AGG | chr6 | 160654912 | 160654931 | 160654915 | - |
| SEQ ID NO 38172 | CTATGATCAGTTGACAGAGG | AAG | chr6 | 160654909 | 160654928 | 160654912 | - |
| SEQ ID NO 38173 | TATGATCAGTTGACAGAGGA | AGG | chr6 | 160654908 | 160654927 | 160654911 | - |
| SEQ ID NO 38174 | ATGATCAGTTGACAGAGGAA | GGG | chr6 | 160654907 | 160654926 | 160654910 | - |
| SEQ ID NO 38175 | ATCAGTTGACAGAGGAAGGG | AAG | chr6 | 160654904 | 160654923 | 160654907 | - |
| SEQ ID NO 38176 | TGACAGAGGAAGGGAAGACT | AAG | chr6 | 160654898 | 160654917 | 160654901 | - |
| SEQ ID NO 38177 | GACAGAGGAAGGGAAGACTA | AGG | chr6 | 160654897 | 160654916 | 160654900 | - |
| SEQ ID NO 38178 | AGGAAGGGAAGACTAAGGAC | TGG | chr6 | 160654892 | 160654911 | 160654895 | - |
| SEQ ID NO 38179 | GAAGACTAAGGACTGGTTCA | TAG | chr6 | 160654885 | 160654904 | 160654888 | - |
| SEQ ID NO 38180 | ACTAAGGACTGGTTCATAGA | TGG | chr6 | 160654881 | 160654900 | 160654884 | - |
| SEQ ID NO 38181 | AGATGGTTCTGCACGATATG | CAG | chr6 | 160654864 | 160654883 | 160654867 | - |
| SEQ ID NO 38182 | GATGGTTCTGCACGATATGC | AGG | chr6 | 160654863 | 160654882 | 160654866 | - |
| SEQ ID NO 38183 | GATATGCAGGCACCACCCGA | AAG | chr6 | 160654850 | 160654869 | 160654853 | - |
| SEQ ID NO 38184 | ATGCAGGCACCACCCGAAAG | TGG | chr6 | 160654847 | 160654866 | 160654850 | - |
| SEQ ID NO 38185 | AGGCACCACCCGAAAGTGGA | CAG | chr6 | 160654843 | 160654862 | 160654846 | - |
| SEQ ID NO 38186 | CACCCGAAAGTGGACAGCTG | CAG | chr6 | 160654837 | 160654856 | 160654840 | - |
| SEQ ID NO 38187 | TGCATGTGTACACTTGTGCT | AAG | chr6 | 160654794 | 160654813 | 160654797 | - |
| SEQ ID NO 38188 | TTTCCTTTATCATGTGACCT | TAG | chr6 | 160654743 | 160654762 | 160654746 | - |
| SEQ ID NO 38189 | ATCATGTGACCTTAGATTTA | TGG | chr6 | 160654735 | 160654754 | 160654738 | - |
| SEQ ID NO 38190 | TAGATTTATGGACTTCACAT | CAG | chr6 | 160654723 | 160654742 | 160654726 | - |
| SEQ ID NO 38191 | TGGACTTCACATCAGCATTT | AAG | chr6 | 160654715 | 160654734 | 160654718 | - |
| SEQ ID NO 38192 | ACATCAGCATTTAAGCATTT | AAG | chr6 | 160654707 | 160654726 | 160654710 | - |
| SEQ ID NO 38193 | CATTTAAGTGTTGTTCATAT | CAG | chr6 | 160654692 | 160654711 | 160654695 | - |
| SEQ ID NO 38194 | TAACCTTATGTAATAACTTT | TGG | chr6 | 160654655 | 160654674 | 160654658 | - |
| SEQ ID NO 38195 | TTATGTAATAACTTTTGGTT | TGG | chr6 | 160654650 | 160654669 | 160654653 | - |
| SEQ ID NO 38196 | TATGTAATAACTTTTGGTTT | GGG | chr6 | 160654649 | 160654668 | 160654652 | - |

Figure 55 (Cont'd)

| | | | | | | | |
|---|---|---|---|---|---|---|---|
| SEQ ID NO 38197 | ATGTAATAACTTTTGGTTTG | GGG | chr6 | 160654648 | 160654667 | 160654651 | - |
| SEQ ID NO 38198 | ATAACTTTTGGTTTGGGGAT | TGG | chr6 | 160654643 | 160654662 | 160654646 | - |
| SEQ ID NO 38199 | TTTGGGGATTGGTGCGTTTC | TGG | chr6 | 160654632 | 160654651 | 160654635 | - |
| SEQ ID NO 38200 | TGGTGCGTTTCTGGTTGTAT | GAG | chr6 | 160654623 | 160654642 | 160654626 | - |
| SEQ ID NO 38201 | GGTGCGTTTCTGGTTGTATG | AGG | chr6 | 160654622 | 160654641 | 160654625 | - |
| SEQ ID NO 38202 | CGTTTCTGGTTGTATGAGGA | TAG | chr6 | 160654618 | 160654637 | 160654621 | - |
| SEQ ID NO 38203 | TGAGGATAGTTGTATTATAT | TAG | chr6 | 160654604 | 160654623 | 160654607 | - |
| SEQ ID NO 38204 | GAGGATAGTTGTATTATATT | AGG | chr6 | 160654603 | 160654622 | 160654606 | - |
| SEQ ID NO 38205 | CTTATTATTGTCTTTATTTG | AAG | chr6 | 160654568 | 160654587 | 160654571 | - |
| SEQ ID NO 38206 | TTGAAGATTATGTATGATTT | CAG | chr6 | 160654551 | 160654570 | 160654554 | - |
| SEQ ID NO 38207 | TGAAGATTATGTATGATTTC | AGG | chr6 | 160654550 | 160654569 | 160654553 | - |
| SEQ ID NO 38208 | ATGATTTCAGGATGTGTGTA | TGG | chr6 | 160654538 | 160654557 | 160654541 | - |
| SEQ ID NO 38209 | TGATTTCAGGATGTGTGTAT | GGG | chr6 | 160654537 | 160654556 | 160654540 | - |
| SEQ ID NO 38210 | CAGGATGTGTGTATGGTTC | AAG | chr6 | 160654531 | 160654550 | 160654534 | - |
| SEQ ID NO 38211 | GTGTATGGGTTCAAGTTGAC | AAG | chr6 | 160654523 | 160654542 | 160654526 | - |
| SEQ ID NO 38212 | TGTATGGGTTCAAGTTGACA | AGG | chr6 | 160654522 | 160654541 | 160654525 | - |
| SEQ ID NO 38213 | TATGGGTTCAAGTTGACAAG | GAG | chr6 | 160654520 | 160654539 | 160654523 | - |
| SEQ ID NO 38214 | GGTTCAAGTTGACAAGGAGT | TGG | chr6 | 160654516 | 160654535 | 160654519 | - |
| SEQ ID NO 38215 | ACAAGGAGTTGGACTTGTGA | TGG | chr6 | 160654505 | 160654524 | 160654508 | - |
| SEQ ID NO 38216 | GTTAATACTGTCAACTTGAT | TGG | chr6 | 160654483 | 160654502 | 160654486 | - |
| SEQ ID NO 38217 | TGTCAACTTGATTGGATTGA | AAG | chr6 | 160654475 | 160654494 | 160654478 | - |
| SEQ ID NO 38218 | TGATTGGATTGAAAGATGCA | AAG | chr6 | 160654467 | 160654486 | 160654470 | - |
| SEQ ID NO 38219 | AAGATGCAAAGTATTAATCT | CGG | chr6 | 160654455 | 160654474 | 160654458 | - |
| SEQ ID NO 38220 | TTAATCTCGGTTATGTCTGT | GAG | chr6 | 160654442 | 160654461 | 160654445 | - |
| SEQ ID NO 38221 | TAATCTCGGTTATGTCTGTG | AGG | chr6 | 160654441 | 160654460 | 160654444 | - |
| SEQ ID NO 38222 | AATCTCGGTTATGTCTGTGA | GGG | chr6 | 160654440 | 160654459 | 160654443 | - |
| SEQ ID NO 38223 | CGGTTATGTCTGTGAGGGTG | TGG | chr6 | 160654435 | 160654454 | 160654438 | - |
| SEQ ID NO 38224 | TGTCTGTGAGGGTGTGGCAA | AAG | chr6 | 160654429 | 160654448 | 160654432 | - |
| SEQ ID NO 38225 | GTCTGTGAGGGTGTGGCAAA | AGG | chr6 | 160654428 | 160654447 | 160654431 | - |
| SEQ ID NO 38226 | CTGTGAGGGTGTGGCAAAAG | GAG | chr6 | 160654426 | 160654445 | 160654429 | - |
| SEQ ID NO 38227 | GCAAAAGGAGATTAACATTT | GAG | chr6 | 160654413 | 160654432 | 160654416 | - |
| SEQ ID NO 38228 | AAGGAGATTAACATTTGAGT | CAG | chr6 | 160654409 | 160654428 | 160654412 | - |
| SEQ ID NO 38229 | GAGATTAACATTTGAGTCAG | TGG | chr6 | 160654406 | 160654425 | 160654409 | - |
| SEQ ID NO 38230 | AGATTAACATTTGAGTCAGT | GGG | chr6 | 160654405 | 160654424 | 160654408 | - |
| SEQ ID NO 38231 | TAACATTTGAGTCAGTGGGC | TGG | chr6 | 160654401 | 160654420 | 160654404 | - |
| SEQ ID NO 38232 | AACATTTGAGTCAGTGGGCT | GGG | chr6 | 160654400 | 160654419 | 160654403 | - |

Figure 56

| # | Sequence | PAM | chr6 | Start | End | Cuts 5' of | Str |
|---|---|---|---|---|---|---|---|
| SEQ ID NO 38233 | TGTACACATGCATTTAGAAA | GTGGAT | chr6 | 160654802 | 160654821 | 160654818 | + |
| SEQ ID NO 38234 | AGTGCTGCAGCTGTCCACTT | TCGGGT | chr6 | 160654830 | 160654849 | 160654846 | + |
| SEQ ID NO 38235 | GCAGGCTGGGGGAGGGAAGG | CAGGGT | chr6 | 160654953 | 160654972 | 160654969 | + |
| SEQ ID NO 38236 | GGGAGGGAAGGCAGGGTGGC | ATGAGT | chr6 | 160654962 | 160654981 | 160654978 | + |
| SEQ ID NO 38237 | CTGACCCACTTCATGGCTAG | ATGGGT | chr6 | 160655101 | 160655120 | 160655117 | + |
| SEQ ID NO 38238 | CAATAGCTGTCTCTCAAAAG | GAGAGT | chr6 | 160655225 | 160655244 | 160655241 | + |
| SEQ ID NO 38239 | CACTGACACCTCAAGCACCA | TTGGAT | chr6 | 160655356 | 160655375 | 160655372 | + |
| SEQ ID NO 38240 | CTCAAGCACCATTGGATCTG | CGGGGT | chr6 | 160655365 | 160655384 | 160655381 | + |
| SEQ ID NO 38241 | AGGTCACTCGATAAATGGGC | CAGAGT | chr6 | 160655487 | 160655506 | 160655503 | + |
| SEQ ID NO 38242 | CAGAGTAACACACCCAAACG | AGGAAT | chr6 | 160655507 | 160655526 | 160655523 | + |
| SEQ ID NO 38243 | AAGTTATGCTTCACCTTAGA | AGGAAT | chr6 | 160655609 | 160655628 | 160655625 | + |
| SEQ ID NO 38244 | AGAAAGTCCCTAAATTTTAG | CTGGAT | chr6 | 160655683 | 160655702 | 160655699 | + |
| SEQ ID NO 38245 | TATCCAATCATCATAATGTC | ATGAAT | chr6 | 160655780 | 160655799 | 160655796 | + |
| SEQ ID NO 38246 | AAGATTATGACACAAAGCTG | GAGAGT | chr6 | 160655863 | 160655882 | 160655879 | + |
| SEQ ID NO 38247 | GAGTTGATACACCCCTGAGG | TAGGGT | chr6 | 160655885 | 160655904 | 160655901 | + |
| SEQ ID NO 38248 | CTGAAGGCAAATTGCTTCTG | GTGGGT | chr6 | 160655939 | 160655958 | 160655955 | + |
| SEQ ID NO 38249 | TTCTGGTGGGTCTTATGGAC | AGGAAT | chr6 | 160655954 | 160655973 | 160655970 | + |
| SEQ ID NO 38250 | ACTGGTAGAGCAGCTGCAAT | TGGAGT | chr6 | 160656062 | 160656081 | 160656078 | + |
| SEQ ID NO 38251 | CCTCTGCACAGGTCAAATGG | GAGAGT | chr6 | 160656142 | 160656161 | 160656158 | + |
| SEQ ID NO 38252 | GTCAAATGGGAGAGTTGAAC | AGGGAT | chr6 | 160656153 | 160656172 | 160656169 | + |
| SEQ ID NO 38253 | GAGTTGAACAGGGATGTGGT | GGGAAT | chr6 | 160656164 | 160656183 | 160656180 | + |
| SEQ ID NO 38254 | CTAATCACTTCAGTCCCTCC | AGGGAT | chr6 | 160656227 | 160656246 | 160656243 | + |
| SEQ ID NO 38255 | CACTTCAGTCCCTCCAGGGA | TGGGAT | chr6 | 160656232 | 160656251 | 160656248 | + |
| SEQ ID NO 38256 | TGGCACTGGGAAAATGACCA | GAGGAT | chr6 | 160656410 | 160656429 | 160656426 | + |
| SEQ ID NO 38257 | TGGGGAACCACAATAACGTT | TTGGGT | chr6 | 160656524 | 160656543 | 160656540 | + |
| SEQ ID NO 38258 | CAATAACGTTTTGGGTACCC | TGGAAT | chr6 | 160656534 | 160656553 | 160656550 | + |
| SEQ ID NO 38259 | GGCCAGAGGTCTCCTTAGGG | AAGGAT | chr6 | 160656647 | 160656666 | 160656663 | + |
| SEQ ID NO 38260 | CCTTAGGGAAGGATGGGAGA | AAGAGT | chr6 | 160656659 | 160656678 | 160656675 | + |
| SEQ ID NO 38261 | CTAGTGGTGTCCTTCCTCAA | GGGGAT | chr6 | 160656707 | 160656726 | 160656723 | + |
| SEQ ID NO 38262 | TCCAGCCTCCCCTTCATTCA | GTGGGT | chr6 | 160656732 | 160656751 | 160656748 | + |
| SEQ ID NO 38263 | GTTCTGGAACTGTAACAGGT | TCGAGT | chr6 | 160656756 | 160656775 | 160656772 | + |
| SEQ ID NO 38264 | TTTGTTTATATAAATCAAGT | AGGAAT | chr6 | 160656860 | 160656879 | 160656876 | + |
| SEQ ID NO 38265 | AGCCAATGCCAGAGCTCTAC | ATGAGT | chr6 | 160656934 | 160656953 | 160656950 | + |
| SEQ ID NO 38266 | ACACTTGGCCCCTGCCACCT | CAGGAT | chr6 | 160657040 | 160657059 | 160657056 | + |
| SEQ ID NO 38267 | ATTGTATTTAAATTTTGTAG | TTGAGT | chr6 | 160657078 | 160657097 | 160657094 | + |
| SEQ ID NO 38268 | TATTTCACAAAGCTTCGGCC | AAGGGT | chr6 | 160657189 | 160657208 | 160657205 | + |
| SEQ ID NO 38269 | ATCTTCTGGACCCTCCCAGC | TGGGAT | chr6 | 160657217 | 160657236 | 160657233 | + |
| SEQ ID NO 38270 | TCTGGACCCTCCCAGCTGGG | ATGAGT | chr6 | 160657221 | 160657240 | 160657237 | + |
| SEQ ID NO 38271 | ATCCTAATCTCCCTAAGCCT | TTGGAT | chr6 | 160657275 | 160657294 | 160657291 | + |
| SEQ ID NO 38272 | TTTTTTTTTTTTTTGGAAA | TGGAGT | chr6 | 160657402 | 160657421 | 160657418 | + |
| SEQ ID NO 38273 | GTCTTGCTCTGTTACCAGGC | TGGAAT | chr6 | 160657426 | 160657445 | 160657442 | + |
| SEQ ID NO 38274 | TTTTGTATTTTAGCAGAGA | TGGGGT | chr6 | 160657567 | 160657586 | 160657583 | + |
| SEQ ID NO 38275 | TGGGGTTTCACCATTTTAGC | CAGAAT | chr6 | 160657587 | 160657606 | 160657603 | + |
| SEQ ID NO 38276 | GCCCCGCCTCCCAAGGTGC | TGGGAT | chr6 | 160657644 | 160657663 | 160657660 | + |
| SEQ ID NO 38277 | CCGAGCTGCAACATTAAATG | CAGAAT | chr6 | 160657720 | 160657739 | 160657736 | + |
| SEQ ID NO 38278 | GAAAGCTTAAGCAGTTCTTT | TAGAGT | chr6 | 160657871 | 160657890 | 160657887 | + |
| SEQ ID NO 38279 | AGAGTATAATGCACCTCCTC | ATGGGT | chr6 | 160657892 | 160657911 | 160657908 | + |
| SEQ ID NO 38280 | CCTCACCTCTGGGGCCCGCA | AGGAAT | chr6 | 160657929 | 160657948 | 160657945 | + |

Figure 56 (Cont'd)

| SEQ ID NO 38281 | TAGAAGCATTCAGGGGCATT | AGGGGT | chr6 | 160657973 | 160657992 | 160657989 | + |
| SEQ ID NO 38282 | CATTAGGGGTGCCTCTTGAG | GAGAAT | chr6 | 160657989 | 160658008 | 160658005 | + |
| SEQ ID NO 38283 | CACTGTTGCCTCAAGCAGTG | CAGGGT | chr6 | 160658055 | 160658074 | 160658071 | + |
| SEQ ID NO 38284 | GTGGAAAGGCTAATGGCAGC | ACGGGT | chr6 | 160658099 | 160658118 | 160658115 | + |
| SEQ ID NO 38285 | ATGGCAGCACGGGTCAGGGA | GGGGAT | chr6 | 160658111 | 160658130 | 160658127 | + |
| SEQ ID NO 38286 | GAGGGGATGTTACCACTACT | GGGGAT | chr6 | 160658129 | 160658148 | 160658145 | + |
| SEQ ID NO 38287 | TTCTGGCAAAAAGTTTCAT | CAGAGT | chr6 | 160658169 | 160658188 | 160658185 | + |
| SEQ ID NO 38288 | CTCAGTGTCCTCAGCTTCAT | CAGGGT | chr6 | 160658202 | 160658221 | 160658218 | + |
| SEQ ID NO 38289 | CACATCCCCACTCCAAGTTC | CAGGGT | chr6 | 160658235 | 160658254 | 160658251 | + |
| SEQ ID NO 38290 | AATTTCAACTCTTTCTCTAC | AGGAGT | chr6 | 160658379 | 160658398 | 160658395 | + |
| SEQ ID NO 38291 | ATAGTCAAAGGTATTATGTA | TAGAGT | chr6 | 160658565 | 160658584 | 160658581 | + |
| SEQ ID NO 38292 | CTCCTTGCCTCTCATAAGTG | ATGAAT | chr6 | 160658598 | 160658617 | 160658614 | + |
| SEQ ID NO 38293 | GTTCTCCATACTATTAGAAG | TAGAGT | chr6 | 160658688 | 160658707 | 160658704 | + |
| SEQ ID NO 38294 | AGAAGTCCCAAAACCAATGA | AAGAAT | chr6 | 160658756 | 160658775 | 160658772 | + |
| SEQ ID NO 38295 | GTATGAAAATCTGTATTAGT | CGGGGT | chr6 | 160658820 | 160658839 | 160658836 | + |
| SEQ ID NO 38296 | ATATATGAGAGAGAGAGAGA | GAGAGT | chr6 | 160658886 | 160658905 | 160658902 | + |
| SEQ ID NO 38297 | TGTATATATGTGTATATATA | GTGAGT | chr6 | 160658915 | 160658934 | 160658931 | + |
| SEQ ID NO 38298 | AGTCCCACAGCTGAAGAACT | TGGAGT | chr6 | 160659070 | 160659089 | 160659086 | + |
| SEQ ID NO 38299 | GTCCGATGTTCAAGAGCAGG | AAGGAT | chr6 | 160659094 | 160659113 | 160659110 | + |
| SEQ ID NO 38300 | GGCAGCAGGGGCAGGGGCCT | CAGGGT | chr6 | 160659214 | 160659233 | 160659230 | + |
| SEQ ID NO 38301 | AGGGGCCTCAGGGTGCTTGC | AGGGAT | chr6 | 160659226 | 160659245 | 160659242 | + |
| SEQ ID NO 38302 | ACACACTGGCCTCTTTTCCA | TAGGGT | chr6 | 160659253 | 160659272 | 160659269 | + |
| SEQ ID NO 38303 | ATAGGGTGGCTGGGGCACAC | TGGGGT | chr6 | 160659272 | 160659291 | 160659288 | + |
| SEQ ID NO 38304 | TGGCTGGGGCACACTGGGGT | GTGAGT | chr6 | 160659278 | 160659297 | 160659294 | + |
| SEQ ID NO 38305 | TGGGGTGTGAGTAAAGCACT | CAGGAT | chr6 | 160659292 | 160659311 | 160659308 | + |
| SEQ ID NO 38306 | AGCTTCACCCCACAAAAACA | CAGAGT | chr6 | 160659401 | 160659420 | 160659417 | + |
| SEQ ID NO 38307 | CAGCCAGTGGAAATGTTCAA | CTGAGT | chr6 | 160659428 | 160659447 | 160659444 | + |
| SEQ ID NO 38308 | GCCAGGAGCCTTGCCTGGTG | AAGAGT | chr6 | 160659480 | 160659499 | 160659496 | + |
| SEQ ID NO 38309 | AGCTCACAAGAAAGAGAAAC | TGGAAT | chr6 | 160659516 | 160659535 | 160659532 | + |
| SEQ ID NO 38310 | GCTGAAATGGCAGAGGGGCT | GTGGGT | chr6 | 160659631 | 160659650 | 160659647 | + |
| SEQ ID NO 38311 | GAGGGGCTGTGGGTTGTCTC | TTGGAT | chr6 | 160659643 | 160659662 | 160659659 | + |
| SEQ ID NO 38312 | CTAAAATGTTCAGGCAGGGC | CAGGGT | chr6 | 160659702 | 160659721 | 160659718 | + |
| SEQ ID NO 38313 | TGGCTGTGCTCTGCCCAGTG | AGGAAT | chr6 | 160659727 | 160659746 | 160659743 | + |
| SEQ ID NO 38314 | ACACTGTGCTGGAGGTCCGT | GAGAGT | chr6 | 160659809 | 160659828 | 160659825 | + |
| SEQ ID NO 38315 | TGAGCCCATACTTTAATCTC | AAGAGT | chr6 | 160659857 | 160659876 | 160659873 | + |
| SEQ ID NO 38316 | GTGGTAAGGAAGAAAGTACA | ACGGGT | chr6 | 160659895 | 160659914 | 160659911 | + |
| SEQ ID NO 38317 | CAATATTGCAAATCATTATT | AAGAAT | chr6 | 160660028 | 160660047 | 160660044 | + |
| SEQ ID NO 38318 | CTGTGATACAGGTGTTTGAT | ATGAAT | chr6 | 160660088 | 160660107 | 160660104 | + |
| SEQ ID NO 38319 | ACTGCAACGTGTATCTCTT | AGGAAT | chr6 | 160660183 | 160660202 | 160660199 | + |
| SEQ ID NO 38320 | TCATGTCTAGCATGCAGGAC | TTGGGT | chr6 | 160660339 | 160660358 | 160660355 | + |
| SEQ ID NO 38321 | TGCAGGACTTGGGTAATCTC | TGGGGT | chr6 | 160660351 | 160660370 | 160660367 | + |
| SEQ ID NO 38322 | CTAACCATAAAATCTTAAAT | AAGAAT | chr6 | 160660447 | 160660466 | 160660463 | + |
| SEQ ID NO 38323 | TGACAGTTGATAAGCATCTT | CTGAAT | chr6 | 160660644 | 160660663 | 160660660 | + |
| SEQ ID NO 38324 | AGTTACAAAAATGTTGGTGC | ATGGAT | chr6 | 160660682 | 160660701 | 160660698 | + |
| SEQ ID NO 38325 | GTTGGTGCATGGATGATGTT | GGGAAT | chr6 | 160660694 | 160660713 | 160660710 | + |
| SEQ ID NO 38326 | AATTAAGCAAAAAAAAAATG | GAGGAT | chr6 | 160660761 | 160660780 | 160660777 | + |
| SEQ ID NO 38327 | ACACCACTATTAGTTGGG | GAGAAT | chr6 | 160660838 | 160660857 | 160660854 | + |
| SEQ ID NO 38328 | CTTTCTGCCTGGTTGTGGCA | AAGGGT | chr6 | 160660995 | 160661014 | 160661011 | + |
| SEQ ID NO 38329 | ACAAAATGTAGTGATTTTCA | CAGGGT | chr6 | 160661152 | 160661171 | 160661168 | + |

Figure 56 (Cont'd)

| SEQ ID NO 38330 | TGAAGATAGCCAAGCTTCCA | TGGAAT | chr6 | 160661203 | 160661222 | 160661219 | + |
| SEQ ID NO 38331 | GGACAACCTTGACCACTTTG | AGGGGT | chr6 | 160661238 | 160661257 | 160661254 | + |
| SEQ ID NO 38332 | TGGTGGGGGCCACATGCAGA | TGGAGT | chr6 | 160661265 | 160661284 | 160661281 | + |
| SEQ ID NO 38333 | GGGGGCCACATGCAGATGGA | GTGGGT | chr6 | 160661269 | 160661288 | 160661285 | + |
| SEQ ID NO 38334 | CATGCAGATGGAGTGGGTTA | AAGAGT | chr6 | 160661277 | 160661296 | 160661293 | + |
| SEQ ID NO 38335 | AGAGTGACTAGAAGAGCAGT | GGGGGT | chr6 | 160661298 | 160661317 | 160661314 | + |
| SEQ ID NO 38336 | TGAAAGCAGCGAGACTTCTA | GGGAAT | chr6 | 160661348 | 160661367 | 160661364 | + |
| SEQ ID NO 38337 | AGCGAGACTTCTAGGGAATA | CAGGGT | chr6 | 160661355 | 160661374 | 160661371 | + |
| SEQ ID NO 38338 | AAGGCCTGTCCTGACCTCCT | GAGAGT | chr6 | 160661483 | 160661502 | 160661499 | + |
| SEQ ID NO 38339 | CATGAGGGCAGGGCAAGGAG | GAGGAT | chr6 | 160661517 | 160661536 | 160661533 | + |
| SEQ ID NO 38340 | ATATGCTCTATGCTGGAAAA | CTGGAT | chr6 | 160661624 | 160661643 | 160661640 | + |
| SEQ ID NO 38341 | TTTGAACTCTCTTTTCCAGG | AAGAGT | chr6 | 160661781 | 160661800 | 160661797 | + |
| SEQ ID NO 38342 | TTTTCCAGGAAGAGTTGTGC | TTGGGT | chr6 | 160661792 | 160661811 | 160661808 | + |
| SEQ ID NO 38343 | TTAATAAGGTGCTTCCTACA | GTGAGT | chr6 | 160661860 | 160661879 | 160661876 | + |
| SEQ ID NO 38344 | GAGTTCAGTTAAACATTTTG | AAGAGT | chr6 | 160661882 | 160661901 | 160661898 | + |
| SEQ ID NO 38345 | TGCTAGGAAATATCCCAAAA | CAGAAT | chr6 | 160662058 | 160662077 | 160662074 | + |
| SEQ ID NO 38346 | TCCAGGGCTCATATGGCAAT | GGGGAT | chr6 | 160662144 | 160662163 | 160662160 | + |
| SEQ ID NO 38347 | ATATGGCAATGGGGATTTAA | TAGGGT | chr6 | 160662154 | 160662173 | 160662170 | + |
| SEQ ID NO 38348 | ATGTATTTTATTAATGGTGT | GAGAAT | chr6 | 160662276 | 160662295 | 160662292 | + |
| SEQ ID NO 38349 | TTTCTTCCTCACTGTGGTGT | GTGAAT | chr6 | 160662301 | 160662320 | 160662317 | + |
| SEQ ID NO 38350 | TGTAAAAGACTTAGCAATTT | GTGAAT | chr6 | 160662346 | 160662365 | 160662362 | + |
| SEQ ID NO 38351 | CTTTCCAAAAGAGCTTATCA | GAGAAT | chr6 | 160662481 | 160662500 | 160662497 | + |
| SEQ ID NO 38352 | AGAGAAGTTTGTTCTAGCCT | TTGGGT | chr6 | 160662548 | 160662567 | 160662564 | + |
| SEQ ID NO 38353 | TAGCCTTTGGGTGTAGCCTG | CTGAAT | chr6 | 160662562 | 160662581 | 160662578 | + |
| SEQ ID NO 38354 | CTAGTTTCCATGGGCTGAAA | TAGAAT | chr6 | 160662609 | 160662628 | 160662625 | + |
| SEQ ID NO 38355 | GTATTTTCTTTGATATTTTC | TTGAAT | chr6 | 160662719 | 160662738 | 160662735 | + |
| SEQ ID NO 38356 | TGTGCTTCAAGATGGAACTC | CTGAGT | chr6 | 160662883 | 160662902 | 160662899 | + |
| SEQ ID NO 38357 | GGCAACTGCTCAACTACCTG | GTGGAT | chr6 | 160663008 | 160663027 | 160663024 | + |
| SEQ ID NO 38358 | GCCCAAGCTAGCATGGACCC | CTGAAT | chr6 | 160663039 | 160663058 | 160663055 | + |
| SEQ ID NO 38359 | CCAGACTTCTCTCTTCTTAA | TTGGAT | chr6 | 160663189 | 160663208 | 160663205 | + |
| SEQ ID NO 38360 | AACCTGCTCTTCAGTTACAT | TGGAAT | chr6 | 160663235 | 160663254 | 160663251 | + |
| SEQ ID NO 38361 | TTTCTTTATTTCCTTGATTT | GGGAAT | chr6 | 160663353 | 160663372 | 160663369 | + |
| SEQ ID NO 38362 | GATTTCTTTGTTTATAAAAT | GGGGAT | chr6 | 160663417 | 160663436 | 160663433 | + |
| SEQ ID NO 38363 | TAACCCACTCAACAAATACC | CTGAGT | chr6 | 160663564 | 160663583 | 160663580 | + |
| SEQ ID NO 38364 | ACAAATACCCTGAGTATTTG | TTGAAT | chr6 | 160663575 | 160663594 | 160663591 | + |
| SEQ ID NO 38365 | ATGCGTATATCATCTGGCAA | ATGGAT | chr6 | 160663607 | 160663626 | 160663623 | + |
| SEQ ID NO 38366 | TGGATGTGTATAATTTCTCC | AGGGAT | chr6 | 160663628 | 160663647 | 160663644 | + |
| SEQ ID NO 38367 | CCATAACAAAGAGAGAAATG | CTGAGT | chr6 | 160663692 | 160663711 | 160663708 | + |
| SEQ ID NO 38368 | CAAGGAACCAAACATATTCA | AAGAGT | chr6 | 160663736 | 160663755 | 160663752 | + |
| SEQ ID NO 38369 | GAAATTAAACTTATTTTTTT | AAGAAT | chr6 | 160663997 | 160664016 | 160664013 | + |
| SEQ ID NO 38370 | CATATACAAGATTTTGAACT | GGGAAT | chr6 | 160664031 | 160664050 | 160664047 | + |
| SEQ ID NO 38371 | GATTTTGAACTGGGAATTTC | ATGAAT | chr6 | 160664040 | 160664059 | 160664056 | + |
| SEQ ID NO 38372 | TTTCATGAATCAAAATTAA | ATGAAT | chr6 | 160664056 | 160664075 | 160664072 | + |
| SEQ ID NO 38373 | AGGACATTGTTGACTTACAT | GAGAGT | chr6 | 160664258 | 160664277 | 160664274 | + |
| SEQ ID NO 38374 | GACCCATGCCACTGGCTCAG | CAGGGT | chr6 | 160664334 | 160664353 | 160664350 | + |
| SEQ ID NO 38375 | AGCAGGGTTCAAACATTACC | TTGAAT | chr6 | 160664352 | 160664371 | 160664368 | + |
| SEQ ID NO 38376 | TTCAAACATTACCTTGAATA | TAGAGT | chr6 | 160664359 | 160664378 | 160664375 | + |
| SEQ ID NO 38377 | TAGAGTCTTATAAAATATTT | GAGAGT | chr6 | 160664379 | 160664398 | 160664395 | + |
| SEQ ID NO 38378 | CTTCTTTCATTCTCTTTCTT | TTGGAT | chr6 | 160664539 | 160664558 | 160664555 | + |

Figure 56 (Cont'd)

| SEQ ID NO 38379 | CCGAGGTTGTGTCGCTACCC | AGGGGT | chr6 | 160664700 | 160664719 | 160664716 | + |
| SEQ ID NO 38380 | AGATATCAATCCTTCCAGGA | GGGGGT | chr6 | 160664912 | 160664931 | 160664928 | + |
| SEQ ID NO 38381 | ATTTTGGGAGGCCACGGCAG | ATGGAT | chr6 | 160664963 | 160664982 | 160664979 | + |
| SEQ ID NO 38382 | CAGATGGATCACCTGAGGCC | AGGAGT | chr6 | 160664980 | 160664999 | 160664996 | + |
| SEQ ID NO 38383 | ACAAAAAATACAAAAATTAG | CTGGGT | chr6 | 160665045 | 160665064 | 160665061 | + |
| SEQ ID NO 38384 | TACTAAGTAGGCTGAGGCAC | TAGAAT | chr6 | 160665098 | 160665117 | 160665114 | + |
| SEQ ID NO 38385 | GATGGAGGTTGCAGTGAGCC | AAGAAT | chr6 | 160665139 | 160665158 | 160665155 | + |
| SEQ ID NO 38386 | ATGTGCCACTGCACTCCAGC | CTGGGT | chr6 | 160665163 | 160665182 | 160665179 | + |
| SEQ ID NO 38387 | TCCAGCCTGGGTGACAGAGC | AAGAAT | chr6 | 160665177 | 160665196 | 160665193 | + |
| SEQ ID NO 38388 | ATATTTTTAAAAATAAAACA | TAGGGT | chr6 | 160665299 | 160665318 | 160665315 | + |
| SEQ ID NO 38389 | TTTAAAAATAAAACATAGGG | TCGAGT | chr6 | 160665304 | 160665323 | 160665320 | + |
| SEQ ID NO 38390 | ACTTTGGGAGGCCAAGACAG | GTGGAT | chr6 | 160665357 | 160665376 | 160665373 | + |
| SEQ ID NO 38391 | GACAGGTGGATCACAAGGTC | AGGAGT | chr6 | 160665372 | 160665391 | 160665388 | + |
| SEQ ID NO 38392 | ATCCCAGCTACTAGGGAGGC | TGGAGT | chr6 | 160665482 | 160665501 | 160665498 | + |
| SEQ ID NO 38393 | TCACGTCAGTGCACTTCAAC | CGGGGT | chr6 | 160665550 | 160665569 | 160665566 | + |
| SEQ ID NO 38394 | CAGTGCACTTCAACCGGGGT | GAGAGT | chr6 | 160665556 | 160665575 | 160665572 | + |
| SEQ ID NO 38395 | TAGTATCAATCTTTCCGCAA | ATGAAT | chr6 | 160665635 | 160665654 | 160665651 | + |
| SEQ ID NO 38396 | TCGTTCTCATGAAGTAAAGC | AAGAGT | chr6 | 160665682 | 160665701 | 160665698 | + |
| SEQ ID NO 38397 | ATGAAGTAAAGCAAGAGTGG | TAGAAT | chr6 | 160665690 | 160665709 | 160665706 | + |
| SEQ ID NO 38398 | GAGTGGTAGAATTAAGTGGA | AAGAGT | chr6 | 160665704 | 160665723 | 160665720 | + |
| SEQ ID NO 38399 | TGGCCACCGGGACACCCAG | GAGGGT | chr6 | 160665950 | 160665969 | 160665966 | + |
| SEQ ID NO 38400 | CACCGGGACACCCAGGAGG | GTGAGT | chr6 | 160665954 | 160665973 | 160665970 | + |
| SEQ ID NO 38401 | TCAAGCCCAAGAAGTCCCC | TTGGAT | chr6 | 160666030 | 160666049 | 160666046 | + |
| SEQ ID NO 38402 | AAGAAGTCCCCTTGGATGAT | CTGAAT | chr6 | 160666039 | 160666058 | 160666055 | + |
| SEQ ID NO 38403 | ATACATTTGGGACAGATCTA | GGGAGT | chr6 | 160666065 | 160666084 | 160666081 | + |
| SEQ ID NO 38404 | TTTCTGAGCAACACTTAGAC | TGGGGT | chr6 | 160666090 | 160666109 | 160666106 | + |
| SEQ ID NO 38405 | TTCCATTGATTAAATCCTAC | TTGAAT | chr6 | 160666117 | 160666136 | 160666133 | + |
| SEQ ID NO 38406 | AATGCCCAGCACAGAGCTCA | GTGGAT | chr6 | 160666254 | 160666273 | 160666270 | + |
| SEQ ID NO 38407 | GCCAGACTCTCTGAACCCTG | GAGAGT | chr6 | 160666510 | 160666529 | 160666526 | + |
| SEQ ID NO 38408 | GGAGAGTGTAAACGTCATAT | AAGAGT | chr6 | 160666529 | 160666548 | 160666545 | + |
| SEQ ID NO 38409 | AGAGTCTATGTTCCAAAAAC | CTGGAT | chr6 | 160666550 | 160666569 | 160666566 | + |
| SEQ ID NO 38410 | TCTTTGCTTTTAAAACCATA | AAGAAT | chr6 | 160666634 | 160666653 | 160666650 | + |
| SEQ ID NO 38411 | TAAAGAATAATGTTTAAATG | TAGAGT | chr6 | 160666652 | 160666671 | 160666668 | + |
| SEQ ID NO 38412 | TTTTCACTCAACATTACATA | ATGAGT | chr6 | 160666773 | 160666792 | 160666789 | + |
| SEQ ID NO 38413 | ATGAGCATGAGGTTTCCTTT | GGGGAT | chr6 | 160666854 | 160666873 | 160666870 | + |
| SEQ ID NO 38414 | GATGATGGTTGCACACCACT | GTGAAT | chr6 | 160666902 | 160666921 | 160666918 | + |
| SEQ ID NO 38415 | TACATTTTATTGCAATAAAA | AAGAAT | chr6 | 160666990 | 160667009 | 160667006 | + |
| SEQ ID NO 38416 | TTGTCTAGTTCAACCTGAGC | CTGGGT | chr6 | 160667157 | 160667176 | 160667173 | + |
| SEQ ID NO 38417 | TCAACCTGAGCCTGGGTCTG | CGGAGT | chr6 | 160667166 | 160667185 | 160667182 | + |
| SEQ ID NO 38418 | AATCACTTCACCACACTTGT | ATGAGT | chr6 | 160667398 | 160667417 | 160667414 | + |
| SEQ ID NO 38419 | ATACTTCTTTGACAATTTGG | GAGAGT | chr6 | 160667487 | 160667506 | 160667503 | + |
| SEQ ID NO 38420 | TTTTCCAGATGGACACACCC | AGGGAT | chr6 | 160667614 | 160667633 | 160667630 | + |
| SEQ ID NO 38421 | TTTGCAAGCCCAGCTTTCAT | TAGAAT | chr6 | 160667676 | 160667695 | 160667692 | + |
| SEQ ID NO 38422 | TTCAGAAACCTGACTGCATC | TGGAGT | chr6 | 160667805 | 160667824 | 160667821 | + |
| SEQ ID NO 38423 | TGACTACCAAGCATCGGGCA | GAGGGT | chr6 | 160667923 | 160667942 | 160667939 | + |
| SEQ ID NO 38424 | TGTGAGGGAGCACCGTTCTC | TAGAAT | chr6 | 160667972 | 160667991 | 160667988 | + |
| SEQ ID NO 38425 | CAGGAAAGTTGATGTGGTCT | GCGAGT | chr6 | 160668054 | 160668073 | 160668070 | + |
| SEQ ID NO 38426 | AGGTAGGCCACAGGTGACAA | GAGGAT | chr6 | 160668127 | 160668146 | 160668143 | + |
| SEQ ID NO 38427 | GGGCCTTGGGGAGAGGGCAG | CAGGGT | chr6 | 160668170 | 160668189 | 160668186 | + |

Figure 56 (Cont'd)

| | | | | | | | |
|---|---|---|---|---|---|---|---|
| SEQ ID NO 38428 | CAGCAGGGTAAGTCCAGCGG | CAGGAT | chr6 | 160668187 | 160668206 | 160668203 | + |
| SEQ ID NO 38429 | GCAGGATCAGTCCATTGATT | GTGGAT | chr6 | 160668206 | 160668225 | 160668222 | + |
| SEQ ID NO 38430 | TAGAAAATTGATGAACAGGC | CTGAGT | chr6 | 160668392 | 160668411 | 160668408 | + |
| SEQ ID NO 38431 | CATGGTCTAGTTAGTGTTCT | GAGAAT | chr6 | 160668435 | 160668454 | 160668451 | + |
| SEQ ID NO 38432 | GGCGAGGCAGAAGCCTAGTG | GGGGAT | chr6 | 160668492 | 160668511 | 160668508 | + |
| SEQ ID NO 38433 | GGGATGGTGGTTAGAAATGT | GTGGAT | chr6 | 160668513 | 160668532 | 160668529 | + |
| SEQ ID NO 38434 | GGTAATAATTGTGATGGTGG | TGGAAT | chr6 | 160668649 | 160668668 | 160668665 | + |
| SEQ ID NO 38435 | GAATGATGATGATGGTGGTG | GTGGGT | chr6 | 160668671 | 160668690 | 160668687 | + |
| SEQ ID NO 38436 | GATGATAATGGTGATGGTGG | TAGAAT | chr6 | 160668835 | 160668854 | 160668851 | + |
| SEQ ID NO 38437 | ATGGTGGTGGTGATGATGTT | GAGGGT | chr6 | 160668901 | 160668920 | 160668917 | + |
| SEQ ID NO 38438 | GGTAATGATAATGGTGATGG | TGGAAT | chr6 | 160668951 | 160668970 | 160668967 | + |
| SEQ ID NO 38439 | TGGAATGATGGTGATGGTGG | TGGAAT | chr6 | 160668971 | 160668990 | 160668987 | + |
| SEQ ID NO 38440 | GTGGAATGATGATGGTGGTG | CTGAGT | chr6 | 160668990 | 160669009 | 160669006 | + |
| SEQ ID NO 38441 | GTGATGATGGTGATGATGTT | GAGGGT | chr6 | 160669098 | 160669117 | 160669114 | + |
| SEQ ID NO 38442 | GTTTCCAGGTGTTCCCTGAC | TTGGAT | chr6 | 160668292 | 160668311 | 160668295 | - |
| SEQ ID NO 38443 | TCCCTGACTTGGATCAAATG | CAGAGT | chr6 | 160668280 | 160668299 | 160668283 | - |
| SEQ ID NO 38444 | TTTGGAGGTGTTGAGGCCAA | GGGGAT | chr6 | 160668255 | 160668274 | 160668258 | - |
| SEQ ID NO 38445 | TGACATCTCTATGTCGGCCA | CTGGAT | chr6 | 160668096 | 160668115 | 160668099 | - |
| SEQ ID NO 38446 | CGGTAGGTTTTCACCATTAT | CAGGAT | chr6 | 160668026 | 160668045 | 160668029 | - |
| SEQ ID NO 38447 | GATTGAGCTGAGCTGGCCTC | TGGAGT | chr6 | 160667876 | 160667895 | 160667879 | - |
| SEQ ID NO 38448 | AGGCTCTGGGGGAAGAAAGA | GAGAGT | chr6 | 160667757 | 160667776 | 160667760 | - |
| SEQ ID NO 38449 | CTGTGCCATGCTCGCAAAGC | AAGGAT | chr6 | 160667717 | 160667736 | 160667720 | - |
| SEQ ID NO 38450 | GGGCTTGCAAAATTAGAAAA | CTGGAT | chr6 | 160667667 | 160667686 | 160667670 | - |
| SEQ ID NO 38451 | GTGAGAACACTGAAACATCC | CTGGGT | chr6 | 160667636 | 160667655 | 160667639 | - |
| SEQ ID NO 38452 | CAATTTTGCAACCGTTCTAT | TTGAAT | chr6 | 160667578 | 160667597 | 160667581 | - |
| SEQ ID NO 38453 | AATAAAGCAGTTTTTCACAA | AAGAAT | chr6 | 160667541 | 160667560 | 160667544 | - |
| SEQ ID NO 38454 | AAAAGAATAAACACAACCAG | GAGAAT | chr6 | 160667523 | 160667542 | 160667526 | - |
| SEQ ID NO 38455 | AAAGAAGTATAAATTAGAAA | ATGAAT | chr6 | 160667477 | 160667496 | 160667480 | - |
| SEQ ID NO 38456 | CTTAGGCTCAGAAAATATTA | AGGAAT | chr6 | 160667283 | 160667302 | 160667286 | - |
| SEQ ID NO 38457 | CTCAGAAAATATTAAGGAAT | AAGAAT | chr6 | 160667277 | 160667296 | 160667280 | - |
| SEQ ID NO 38458 | ACTTTATGAACAAAGATGTG | GAGGGT | chr6 | 160667249 | 160667268 | 160667252 | - |
| SEQ ID NO 38459 | AGTTTCCTTAACTGTAGAGC | AGGAGT | chr6 | 160667123 | 160667142 | 160667126 | - |
| SEQ ID NO 38460 | CTGTTTCATAGGACTGTTGT | GAGGAT | chr6 | 160667086 | 160667105 | 160667089 | - |
| SEQ ID NO 38461 | ATTATAAGCTTGTGCCTGGA | AAGGAT | chr6 | 160667043 | 160667062 | 160667046 | - |
| SEQ ID NO 38462 | CAATAAAATGTACACAGCGT | AAGAGT | chr6 | 160666982 | 160667001 | 160666985 | - |
| SEQ ID NO 38463 | TACTATTTTAACCATTTTTG | CAGGGT | chr6 | 160666956 | 160666975 | 160666959 | - |
| SEQ ID NO 38464 | TGCAACCATCATCATATTTC | CAGAAT | chr6 | 160666895 | 160666914 | 160666898 | - |
| SEQ ID NO 38465 | ACAAAACTCATTATGTAATG | TTGAGT | chr6 | 160666784 | 160666803 | 160666787 | - |
| SEQ ID NO 38466 | GTAATGTTGAGTGAAAAAAT | CAGGGT | chr6 | 160666770 | 160666789 | 160666773 | - |
| SEQ ID NO 38467 | TATATGACGTTTACACTCTC | CAGGGT | chr6 | 160666530 | 160666549 | 160666533 | - |
| SEQ ID NO 38468 | TTTACACTCTCCAGGGTTCA | GAGAGT | chr6 | 160666521 | 160666540 | 160666524 | - |
| SEQ ID NO 38469 | TCACCACTGCTCTGTTCTTC | TGGAGT | chr6 | 160666437 | 160666456 | 160666440 | - |
| SEQ ID NO 38470 | AAGCCCAGCTCCCTGTGATT | GAGAAT | chr6 | 160666327 | 160666346 | 160666330 | - |
| SEQ ID NO 38471 | GAATGAAGTGTGCAATCGCT | ATGAGT | chr6 | 160666305 | 160666324 | 160666308 | - |
| SEQ ID NO 38472 | TGTGCAATCGCTATGAGTTT | CTGAAT | chr6 | 160666297 | 160666316 | 160666300 | - |
| SEQ ID NO 38473 | CGCTATGAGTTTCTGAATGG | AAGAGT | chr6 | 160666289 | 160666308 | 160666292 | - |
| SEQ ID NO 38474 | TCAGTCTCAGTCCCTTAGAC | TTGAGT | chr6 | 160666162 | 160666181 | 160666165 | - |
| SEQ ID NO 38475 | TAGACTTGAGTCCCAAAGTA | GCGAAT | chr6 | 160666147 | 160666166 | 160666150 | - |
| SEQ ID NO 38476 | CCCAAAGTAGCGAATTCAAG | TAGGAT | chr6 | 160666136 | 160666155 | 160666139 | - |

Figure 56 (Cont'd)

| | | | | | | | |
|---|---|---|---|---|---|---|---|
| SEQ ID NO 38477 | CCAAGGGGACTTCTTGGGGC | TTGAGT | chr6 | 160666034 | 160666053 | 160666037 | - |
| SEQ ID NO 38478 | CCTCAGACCACTCACCCTCC | TGGGGT | chr6 | 160665969 | 160665988 | 160665972 | - |
| SEQ ID NO 38479 | TTCTGGTAGGGAAGGAGGTA | GAGGGT | chr6 | 160665911 | 160665930 | 160665914 | - |
| SEQ ID NO 38480 | GCTCAGATATTGCTGATGAT | CAGAGT | chr6 | 160665845 | 160665864 | 160665848 | - |
| SEQ ID NO 38481 | AATTGATTTACAACTGGGGC | TTGGAT | chr6 | 160665805 | 160665824 | 160665808 | - |
| SEQ ID NO 38482 | CGAAAATGTAAGATTGCACC | ATGAAT | chr6 | 160665665 | 160665684 | 160665668 | - |
| SEQ ID NO 38483 | CTCACTGCAACTTCCACCTC | CTGGGT | chr6 | 160665524 | 160665543 | 160665527 | - |
| SEQ ID NO 38484 | CTTCCACCTCCTGGGTTCAA | GTGAAT | chr6 | 160665514 | 160665533 | 160665517 | - |
| SEQ ID NO 38485 | ACTCCAGCCTCCCTAGTAGC | TGGGAT | chr6 | 160665488 | 160665507 | 160665491 | - |
| SEQ ID NO 38486 | TTTTGTATTTTTAGTAGAGA | TGGGGT | chr6 | 160665432 | 160665451 | 160665435 | - |
| SEQ ID NO 38487 | GTCTTGGCCTCCCAAAGTGC | TGGGAT | chr6 | 160665355 | 160665374 | 160665358 | - |
| SEQ ID NO 38488 | CTCCCAAAGTGCTGGGATTA | CAGAGT | chr6 | 160665347 | 160665366 | 160665350 | - |
| SEQ ID NO 38489 | TTTATTTAAGCCACAACTAC | TAGAAT | chr6 | 160665272 | 160665291 | 160665275 | - |
| SEQ ID NO 38490 | GCCACAACTACTAGAATAGG | AAGGAT | chr6 | 160665263 | 160665282 | 160665266 | - |
| SEQ ID NO 38491 | TCTTGCTCTGTCACCCAGGC | TGGAGT | chr6 | 160665181 | 160665200 | 160665184 | - |
| SEQ ID NO 38492 | GCCTCAGCCTACTTAGTAGC | TGGGAT | chr6 | 160665096 | 160665115 | 160665099 | - |
| SEQ ID NO 38493 | TTTTGTATTTTTTGTAGAGA | CAGGGT | chr6 | 160665040 | 160665059 | 160665043 | - |
| SEQ ID NO 38494 | GCCGTGGCCTCCCAAAATGC | TGGGAT | chr6 | 160664961 | 160664980 | 160664964 | - |
| SEQ ID NO 38495 | GAGCCACCACCCCTCCTGG | AAGGAT | chr6 | 160664926 | 160664945 | 160664929 | - |
| SEQ ID NO 38496 | TTTATAATTACAGAAAACAT | GTGAGT | chr6 | 160664882 | 160664901 | 160664885 | - |
| SEQ ID NO 38497 | AGAAAACATGTGAGTTCACT | AGGAAT | chr6 | 160664871 | 160664890 | 160664874 | - |
| SEQ ID NO 38498 | CATTTCGGCACAGTTTGGTA | TAGGAT | chr6 | 160664803 | 160664822 | 160664806 | - |
| SEQ ID NO 38499 | GCTCGTAAACTAAGACCTGA | AAGGGT | chr6 | 160664748 | 160664767 | 160664751 | - |
| SEQ ID NO 38500 | TGTGTCTATCAGCTGCACCC | CTGGGT | chr6 | 160664722 | 160664741 | 160664725 | - |
| SEQ ID NO 38501 | TGGAAAGCTTGAGGGAGGCT | ATGGAT | chr6 | 160664643 | 160664662 | 160664646 | - |
| SEQ ID NO 38502 | TGGATGTGCAGCACTTGGCA | GAGGGT | chr6 | 160664622 | 160664641 | 160664625 | - |
| SEQ ID NO 38503 | TTTATTTTATCCAAAAGAAA | GAGAAT | chr6 | 160664553 | 160664572 | 160664556 | - |
| SEQ ID NO 38504 | ATCAGGAAAGATGAAGGTCT | AGGGGT | chr6 | 160664500 | 160664519 | 160664503 | - |
| SEQ ID NO 38505 | GAAGGTCTAGGGGTGAGGGA | AGGAGT | chr6 | 160664488 | 160664507 | 160664491 | - |
| SEQ ID NO 38506 | AACCCTGCTGAGCCAGTGGC | ATGGGT | chr6 | 160664341 | 160664360 | 160664344 | - |
| SEQ ID NO 38507 | CCAGTGGCATGGGTCTCTGA | GAGAAT | chr6 | 160664329 | 160664348 | 160664332 | - |
| SEQ ID NO 38508 | TTAATTTGACTATCTGGTTT | GTGGGT | chr6 | 160664296 | 160664315 | 160664299 | - |
| SEQ ID NO 38509 | CATGTAAGTCAACAATGTCC | TGGGAT | chr6 | 160664259 | 160664278 | 160664262 | - |
| SEQ ID NO 38510 | ACATAGTTTTTTTAAATTAT | AAGAAT | chr6 | 160664141 | 160664160 | 160664144 | - |
| SEQ ID NO 38511 | CGTGAAGACTGTCACGGTGC | TGGAAT | chr6 | 160663975 | 160663994 | 160663978 | - |
| SEQ ID NO 38512 | AAGACTGTCACGGTGCTGGA | ATGAAT | chr6 | 160663971 | 160663990 | 160663974 | - |
| SEQ ID NO 38513 | GGTTGATTTTTCTAATCTAA | AAGAGT | chr6 | 160663929 | 160663948 | 160663932 | - |
| SEQ ID NO 38514 | CCATTGTAGCTAACTATGCA | AAGGAT | chr6 | 160663864 | 160663883 | 160663867 | - |
| SEQ ID NO 38515 | TGAAACAATGAAATAACTCT | TTGAAT | chr6 | 160663757 | 160663776 | 160663760 | - |
| SEQ ID NO 38516 | TTGGTTCCTTGACCTGTTCA | TGGAGT | chr6 | 160663727 | 160663746 | 160663730 | - |
| SEQ ID NO 38517 | ATTTCTCTCTTTGTTATGGC | CTGAGT | chr6 | 160663691 | 160663710 | 160663694 | - |
| SEQ ID NO 38518 | ATAATGATTCAACAAATACT | CAGGGT | chr6 | 160663587 | 160663606 | 160663590 | - |
| SEQ ID NO 38519 | ACAAATACTCAGGGTATTTG | TTGAGT | chr6 | 160663576 | 160663595 | 160663579 | - |
| SEQ ID NO 38520 | ATACTCAGGGTATTTGTTGA | GTGGGT | chr6 | 160663572 | 160663591 | 160663575 | - |
| SEQ ID NO 38521 | CATACACACCGTGTGTGATT | GTGAAT | chr6 | 160663514 | 160663533 | 160663517 | - |
| SEQ ID NO 38522 | TATTTAGCTCATGGTATAGG | TAGGGT | chr6 | 160663458 | 160663477 | 160663461 | - |
| SEQ ID NO 38523 | AATCAAGGAAATAAAGAAAC | CTGGAT | chr6 | 160663352 | 160663371 | 160663355 | - |
| SEQ ID NO 38524 | GGTTAATTGTTTGCCACTTG | CAGAAT | chr6 | 160663219 | 160663238 | 160663222 | - |
| SEQ ID NO 38525 | AGGCAACAGAGGAGGCGAGC | AAGGAT | chr6 | 160663069 | 160663088 | 160663072 | - |

Figure 56 (Cont'd)

| | | | | | | | |
|---|---|---|---|---|---|---|---|
| SEQ ID NO 38526 | GAGGAGGCGAGCAAGGATTC | AGGGGT | chr6 | 160663061 | 160663080 | 160663064 | - |
| SEQ ID NO 38527 | CCTGCTGGTGCCTTTGTGAG | CAGGGT | chr6 | 160662990 | 160663009 | 160662993 | - |
| SEQ ID NO 38528 | TCCCTTGAGGCAAATCTCTG | GAGGGT | chr6 | 160662960 | 160662979 | 160662963 | - |
| SEQ ID NO 38529 | GAGGCAAATCTCTGGAGGGT | GAGAGT | chr6 | 160662954 | 160662973 | 160662957 | - |
| SEQ ID NO 38530 | TATAAATCACCTGTGAACTC | AGGAGT | chr6 | 160662905 | 160662924 | 160662908 | - |
| SEQ ID NO 38531 | AGATGAACTTGCCCTGCAGG | GAGAGT | chr6 | 160662854 | 160662873 | 160662857 | - |
| SEQ ID NO 38532 | GACTTTAAAGTCAAACACAT | TTGAAT | chr6 | 160662763 | 160662782 | 160662766 | - |
| SEQ ID NO 38533 | GAGCAGGAGAAGATTAAGCA | AAGAGT | chr6 | 160662698 | 160662717 | 160662701 | - |
| SEQ ID NO 38534 | TGTCTATGTCTGTGTGTGTA | GGGAGT | chr6 | 160662656 | 160662675 | 160662659 | - |
| SEQ ID NO 38535 | CTGTGTGTGTAGGGAGTGCA | GGGGAT | chr6 | 160662647 | 160662666 | 160662650 | - |
| SEQ ID NO 38536 | GTGTAGGGAGTGCAGGGGAT | ATGAAT | chr6 | 160662641 | 160662660 | 160662644 | - |
| SEQ ID NO 38537 | CTATTTCAGCCCATGGAAAC | TAGGAT | chr6 | 160662612 | 160662631 | 160662615 | - |
| SEQ ID NO 38538 | TAGAACAAACTTCTCTGCCA | CAGGAT | chr6 | 160662544 | 160662563 | 160662547 | - |
| SEQ ID NO 38539 | GTTATCTTTCCAATGTGTGC | TGGAAT | chr6 | 160662442 | 160662461 | 160662445 | - |
| SEQ ID NO 38540 | TTGCCATATGAGCCCTGGAG | GTGAAT | chr6 | 160662143 | 160662162 | 160662146 | - |
| SEQ ID NO 38541 | GAGGTGAATCAGAGAAACAA | AAGGAT | chr6 | 160662126 | 160662145 | 160662129 | - |
| SEQ ID NO 38542 | AAGAAAAATTGATTCTGTTT | TGGGAT | chr6 | 160662075 | 160662094 | 160662078 | - |
| SEQ ID NO 38543 | CTAGCAACATGAGCTGGGGA | GGGGAT | chr6 | 160662044 | 160662063 | 160662047 | - |
| SEQ ID NO 38544 | TAAATGGAAGTTTCCTCTTT | TTGAAT | chr6 | 160661949 | 160661968 | 160661952 | - |
| SEQ ID NO 38545 | TGAAGTCACACTGTGAGCTA | TAGAAT | chr6 | 160661826 | 160661845 | 160661829 | - |
| SEQ ID NO 38546 | GCACAACTCTTCCTGGAAAA | GAGAGT | chr6 | 160661792 | 160661811 | 160661795 | - |
| SEQ ID NO 38547 | AGTTCAAATGAGAAACAGTG | CGGGGT | chr6 | 160661769 | 160661788 | 160661772 | - |
| SEQ ID NO 38548 | AAACAGTGCGGGGTGAAGAC | ATGGAT | chr6 | 160661757 | 160661776 | 160661760 | - |
| SEQ ID NO 38549 | TATCTATCAAGTGCTTTTTA | GTGGAT | chr6 | 160661692 | 160661711 | 160661695 | - |
| SEQ ID NO 38550 | GCTTTTTAGTGGATTAGGTT | CAGAAT | chr6 | 160661680 | 160661699 | 160661683 | - |
| SEQ ID NO 38551 | AGGTCAGGACAGGCCTTTCT | GAGAAT | chr6 | 160661480 | 160661499 | 160661483 | - |
| SEQ ID NO 38552 | GGACAGGCCTTTCTGAGAAT | GAGAAT | chr6 | 160661474 | 160661493 | 160661477 | - |
| SEQ ID NO 38553 | TCTGTTCATCTGCCTTTCTA | CTGGAT | chr6 | 160661449 | 160661468 | 160661452 | - |
| SEQ ID NO 38554 | TCCTAAGGAGCCTCAGGACA | GGGGAT | chr6 | 160661072 | 160661091 | 160661075 | - |
| SEQ ID NO 38555 | TTTACAATTTCCTCTGAAAT | CTGGAT | chr6 | 160660896 | 160660915 | 160660899 | - |
| SEQ ID NO 38556 | CTATCAACACCTTGGAAAAA | CTGAAT | chr6 | 160660868 | 160660887 | 160660871 | - |
| SEQ ID NO 38557 | TCCAAGGTTCATTTCTACAC | AGGGAT | chr6 | 160660572 | 160660591 | 160660575 | - |
| SEQ ID NO 38558 | CAGGAGGTGGAAGCCCCTGA | GAGAAT | chr6 | 160660403 | 160660422 | 160660406 | - |
| SEQ ID NO 38559 | CCTGAGAGAATGGAGGTCTG | GAGAAT | chr6 | 160660388 | 160660407 | 160660391 | - |
| SEQ ID NO 38560 | CCAAGTCCTGCATGCTAGAC | ATGAGT | chr6 | 160660343 | 160660362 | 160660346 | - |
| SEQ ID NO 38561 | CTAGACATGAGTGGAGGAGG | GGGAAT | chr6 | 160660329 | 160660348 | 160660332 | - |
| SEQ ID NO 38562 | GGGGGAATACCTAGGTAGAA | AAGAAT | chr6 | 160660311 | 160660330 | 160660314 | - |
| SEQ ID NO 38563 | TCACTGTGCAGTTAACTTTT | CAGAAT | chr6 | 160660260 | 160660279 | 160660263 | - |
| SEQ ID NO 38564 | CGGTTGCAGTTAGTATACAT | CTGAGT | chr6 | 160660173 | 160660192 | 160660176 | - |
| SEQ ID NO 38565 | TGAGTGCTATACAACCTTCT | TTGGGT | chr6 | 160660152 | 160660171 | 160660155 | - |
| SEQ ID NO 38566 | GAAGCAATGCAGCCATTACG | TAGAAT | chr6 | 160660118 | 160660137 | 160660121 | - |
| SEQ ID NO 38567 | TAAAAGTATTTCTTTAGGT | TGGAAT | chr6 | 160659970 | 160659989 | 160659973 | - |
| SEQ ID NO 38568 | CTACGCATTGACTTATCTTC | CTGGGT | chr6 | 160659939 | 160659958 | 160659942 | - |
| SEQ ID NO 38569 | CCTCCAGCACACAGCAGGGA | AAGAAT | chr6 | 160659546 | 160659565 | 160659549 | - |
| SEQ ID NO 38570 | GGCTGCACTCTGTGTTTTTG | TGGGGT | chr6 | 160659413 | 160659432 | 160659416 | - |
| SEQ ID NO 38571 | CTAGGGAAGGAAAAAAGATC | CTGAGT | chr6 | 160659315 | 160659334 | 160659318 | - |
| SEQ ID NO 38572 | CTGCCCCAAGCTGTAGAGC | CAGAAT | chr6 | 160659199 | 160659218 | 160659202 | - |
| SEQ ID NO 38573 | GCCTACATCTTTCTCCTGTG | CTGGAT | chr6 | 160659124 | 160659143 | 160659127 | - |
| SEQ ID NO 38574 | TTATGGGACCTTGTAATCTT | GTGAGT | chr6 | 160659011 | 160659030 | 160659014 | - |

Figure 56 (Cont'd)

| | | | | | | | |
|---|---|---|---|---|---|---|---|
| SEQ ID NO 38575 | CTTAATAAGCTCCCCTTTGT | GTGAGT | chr6 | 160658977 | 160658996 | 160658980 | - |
| SEQ ID NO 38576 | CAGAAGTGGTTCTTGAGGAA | CAGAAT | chr6 | 160658800 | 160658819 | 160658803 | - |
| SEQ ID NO 38577 | TTCTTGAGGAACAGAATATT | AAGGAT | chr6 | 160658791 | 160658810 | 160658794 | - |
| SEQ ID NO 38578 | GAGGAACAGAATATTAAGGA | TGGAAT | chr6 | 160658786 | 160658805 | 160658789 | - |
| SEQ ID NO 38579 | GAACACTGATAGTACTTGGC | CTGAAT | chr6 | 160658672 | 160658691 | 160658675 | - |
| SEQ ID NO 38580 | TACTTGGCCTGAATTGTTTA | GAGAGT | chr6 | 160658660 | 160658679 | 160658663 | - |
| SEQ ID NO 38581 | TTCATCACTTATGAGAGGCA | AGGAGT | chr6 | 160658603 | 160658622 | 160658606 | - |
| SEQ ID NO 38582 | GAAAGAAAATGATGATCTCA | GGGGAT | chr6 | 160658480 | 160658499 | 160658483 | - |
| SEQ ID NO 38583 | ACAAATCTGCTAAGATTGCC | CTGAAT | chr6 | 160658421 | 160658440 | 160658424 | - |
| SEQ ID NO 38584 | CTGCTAAGATTGCCCTGAAT | GAGAGT | chr6 | 160658415 | 160658434 | 160658418 | - |
| SEQ ID NO 38585 | AGTTTTAACTCCTGTAGAGA | AAGAGT | chr6 | 160658392 | 160658411 | 160658395 | - |
| SEQ ID NO 38586 | CAGAGACAAGCTGTTATCAT | GCGAGT | chr6 | 160658350 | 160658369 | 160658353 | - |
| SEQ ID NO 38587 | AAAAATGGGACCCTGGAACT | TGGAGT | chr6 | 160658250 | 160658269 | 160658253 | - |
| SEQ ID NO 38588 | GGGACCCTGGAACTTGGAGT | GGGGAT | chr6 | 160658244 | 160658263 | 160658247 | - |
| SEQ ID NO 38589 | CCCTGATGAAGCTGAGGACA | CTGAGT | chr6 | 160658207 | 160658226 | 160658210 | - |
| SEQ ID NO 38590 | TAGCCTTTCCACCTTTGTCT | GAGGAT | chr6 | 160658091 | 160658110 | 160658094 | - |
| SEQ ID NO 38591 | AAGAGGCACCCTAATGCCC | CTGAAT | chr6 | 160657986 | 160658005 | 160657989 | - |
| SEQ ID NO 38592 | CGGGCCCCAGAGGTGAGGTT | CAGAGT | chr6 | 160657927 | 160657946 | 160657930 | - |
| SEQ ID NO 38593 | GAAATCTGGAGAACAGGCAT | GGGAAT | chr6 | 160657836 | 160657855 | 160657839 | - |
| SEQ ID NO 38594 | TCTGGAGAACAGGCATGGGA | ATGGAT | chr6 | 160657832 | 160657851 | 160657835 | - |
| SEQ ID NO 38595 | CAGGCATGGGAATGGATATT | AAGGGT | chr6 | 160657823 | 160657842 | 160657826 | - |
| SEQ ID NO 38596 | GGGAATGGATATTAAGGGTA | AGGGAT | chr6 | 160657816 | 160657835 | 160657819 | - |
| SEQ ID NO 38597 | GGATAATGGTGGAAGGGACA | TAGAGT | chr6 | 160657794 | 160657813 | 160657797 | - |
| SEQ ID NO 38598 | ATGGTGGAAGGGACATAGAG | TTGGAT | chr6 | 160657789 | 160657808 | 160657792 | - |
| SEQ ID NO 38599 | GGACATAGAGTTGGATCAAG | CTGAAT | chr6 | 160657779 | 160657798 | 160657782 | - |
| SEQ ID NO 38600 | TTGGTTTGGCCCTACTAAGT | AGGGAT | chr6 | 160657750 | 160657769 | 160657753 | - |
| SEQ ID NO 38601 | TTTGCTTGGTTAGCTGAAAT | ATGGAT | chr6 | 160657365 | 160657384 | 160657368 | - |
| SEQ ID NO 38602 | ATCCAAAGGCTTAGGGAGAT | TAGGAT | chr6 | 160657281 | 160657300 | 160657284 | - |
| SEQ ID NO 38603 | GCTTAGGGAGATTAGGATGG | TGGAGT | chr6 | 160657273 | 160657292 | 160657276 | - |
| SEQ ID NO 38604 | AGGGAGATTAGGATGGTGGA | GTGGAT | chr6 | 160657269 | 160657288 | 160657272 | - |
| SEQ ID NO 38605 | GACCTACTCATCCCAGCTGG | GAGGGT | chr6 | 160657232 | 160657251 | 160657235 | - |
| SEQ ID NO 38606 | CTACAAAATTTAAATACAAT | GGGAAT | chr6 | 160657078 | 160657097 | 160657081 | - |
| SEQ ID NO 38607 | TTTAAATACAATGGGAATAA | TTGGAT | chr6 | 160657070 | 160657089 | 160657073 | - |
| SEQ ID NO 38608 | AGCAGAGGCAAAGCAGCCAT | CAGAAT | chr6 | 160656972 | 160656991 | 160656975 | - |
| SEQ ID NO 38609 | ATAAACAAAAACTGCCAGG | TAGAAT | chr6 | 160656849 | 160656868 | 160656852 | - |
| SEQ ID NO 38610 | AGAATGGACTAAAGACTAAT | CTGAAT | chr6 | 160656828 | 160656847 | 160656831 | - |
| SEQ ID NO 38611 | TAATCTGAATTATAAAAACA | GAGAAT | chr6 | 160656812 | 160656831 | 160656815 | - |
| SEQ ID NO 38612 | TGTTACAGTTCCAGAACCCA | CTGAAT | chr6 | 160656753 | 160656772 | 160656756 | - |
| SEQ ID NO 38613 | CCCACTGAATGAAGGGGAGG | CTGGAT | chr6 | 160656737 | 160656756 | 160656740 | - |
| SEQ ID NO 38614 | GGAGACCTCTGGCCTTTTAC | CAGGGT | chr6 | 160656641 | 160656660 | 160656644 | - |
| SEQ ID NO 38615 | CTCTGAGCTGACGTTGATTC | CAGGGT | chr6 | 160656556 | 160656575 | 160656559 | - |
| SEQ ID NO 38616 | TATGGAGGTTAGGTAATTAA | TGGAGT | chr6 | 160656489 | 160656508 | 160656492 | - |
| SEQ ID NO 38617 | TCTGACTTACAGTGGTTCCA | GTGGGT | chr6 | 160656452 | 160656471 | 160656455 | - |
| SEQ ID NO 38618 | CACATTGGCTCCCTGACTGG | TAGGAT | chr6 | 160656345 | 160656364 | 160656348 | - |
| SEQ ID NO 38619 | ATCAAGGACTTGAAAGACGC | AGGGGT | chr6 | 160656200 | 160656219 | 160656203 | - |
| SEQ ID NO 38620 | TTGACCTGTGCAGAGGACAG | ATGGAT | chr6 | 160656138 | 160656157 | 160656141 | - |
| SEQ ID NO 38621 | ATGGATCTTGGAAAATGATG | GTGGAT | chr6 | 160656118 | 160656137 | 160656121 | - |
| SEQ ID NO 38622 | TACCTTTACCACCCTACCTC | AGGGGT | chr6 | 160655901 | 160655920 | 160655904 | - |
| SEQ ID NO 38623 | CATTCATGACATTATGATGA | TTGGAT | chr6 | 160655787 | 160655806 | 160655790 | - |

Figure 56 (Cont'd)

| | | | | | | | |
|---|---|---|---|---|---|---|---|
| SEQ ID NO 38624 | GGTGAGACATTTGTATGCCA | GAGGAT | chr6 | 160655724 | 160655743 | 160655727 | - |
| SEQ ID NO 38625 | TTCTACCTCGGTAAAATTTC | TAGGGT | chr6 | 160655667 | 160655686 | 160655670 | - |
| SEQ ID NO 38626 | ACAATGCCTGGTGGGCCTAT | TTGGAT | chr6 | 160655553 | 160655572 | 160655556 | - |
| SEQ ID NO 38627 | GGAGGCAACACATTCCTCGT | TTGGGT | chr6 | 160655524 | 160655543 | 160655527 | - |
| SEQ ID NO 38628 | GTGTTACTCTGGCCCATTTA | TCGAGT | chr6 | 160655498 | 160655517 | 160655501 | - |
| SEQ ID NO 38629 | TTGAGGTGTCAGTGGCAGAT | AGGGAT | chr6 | 160655350 | 160655369 | 160655353 | - |
| SEQ ID NO 38630 | CCTTTGGCAGGCCCCCATAG | GTGAAT | chr6 | 160655313 | 160655332 | 160655316 | - |
| SEQ ID NO 38631 | TGAATCACAGTGGAGACCTC | TAGGAT | chr6 | 160655292 | 160655311 | 160655295 | - |
| SEQ ID NO 38632 | TGGTAACTGAACGTTTGACT | GTGGGT | chr6 | 160655186 | 160655205 | 160655189 | - |
| SEQ ID NO 38633 | CTGACCCATCTAGCCATGAA | GTGGGT | chr6 | 160655110 | 160655129 | 160655113 | - |
| SEQ ID NO 38634 | CCTGCACCAATGGCCTCATG | GGGAGT | chr6 | 160654938 | 160654957 | 160654941 | - |
| SEQ ID NO 38635 | TATGTAATAACTTTTGGTTT | GGGGAT | chr6 | 160654649 | 160654668 | 160654652 | - |
| SEQ ID NO 38636 | TGGTGCGTTTCTGGTTGTAT | GAGGAT | chr6 | 160654623 | 160654642 | 160654626 | - |
| SEQ ID NO 38637 | TTGAAGATTATGTATGATTT | CAGGAT | chr6 | 160654551 | 160654570 | 160654554 | - |
| SEQ ID NO 38638 | TATGATTTCAGGATGTGTGT | ATGGGT | chr6 | 160654539 | 160654558 | 160654542 | - |
| SEQ ID NO 38639 | TGTATGGGTTCAAGTTGACA | AGGAGT | chr6 | 160654522 | 160654541 | 160654525 | - |
| SEQ ID NO 38640 | GGTTAATACTGTCAACTTGA | TTGGAT | chr6 | 160654484 | 160654503 | 160654487 | - |
| SEQ ID NO 38641 | TTAATCTCGGTTATGTCTGT | GAGGGT | chr6 | 160654442 | 160654461 | 160654445 | - |
| SEQ ID NO 38642 | TGGCAAAAGGAGATTAACAT | TTGAGT | chr6 | 160654415 | 160654434 | 160654418 | - |

Figure 57

| # | Sequence | PAM | chr6 | Start | End | Cuts 5' of | Str |
|---|---|---|---|---|---|---|---|
| SEQ ID NO 38643 | ATACAACTATCCTCATACAA | CCAGAAA | chr6 | 160654609 | 160654628 | 160654625 | + |
| SEQ ID NO 38644 | GCACAAGTGTACACATGCAT | TTAGAAA | chr6 | 160654795 | 160654814 | 160654811 | + |
| SEQ ID NO 38645 | CCACTTCATGGCTAGATGGG | TCAGAAA | chr6 | 160655106 | 160655125 | 160655122 | + |
| SEQ ID NO 38646 | GGTCTCATGCCACTGGAACC | CTAGAAA | chr6 | 160655644 | 160655663 | 160655660 | + |
| SEQ ID NO 38647 | ACCCTAGAAATTTTACCGAG | GTAGAAA | chr6 | 160655661 | 160655680 | 160655677 | + |
| SEQ ID NO 38648 | TGGGTCTTATGGACAGGAAT | GGAGAAA | chr6 | 160655960 | 160655979 | 160655976 | + |
| SEQ ID NO 38649 | CCCACTGGAACCACTGTAAG | TCAGAAA | chr6 | 160656447 | 160656466 | 160656463 | + |
| SEQ ID NO 38650 | GGTCTCCTTAGGGAAGGATG | GGAGAAA | chr6 | 160656654 | 160656673 | 160656670 | + |
| SEQ ID NO 38651 | ATGGGGTTTCACCATTTTAG | CCAGAAT | chr6 | 160657586 | 160657605 | 160657602 | + |
| SEQ ID NO 38652 | CCCGAGCTGCAACATTAAAT | GCAGAAT | chr6 | 160657719 | 160657738 | 160657735 | + |
| SEQ ID NO 38653 | CAGATTTCTGCCAATATAAA | TTAGAAA | chr6 | 160657848 | 160657867 | 160657864 | + |
| SEQ ID NO 38654 | GCATTAGGGGTGCCTCTTGA | GGAGAAT | chr6 | 160657988 | 160658007 | 160658004 | + |
| SEQ ID NO 38655 | CAGAAGTCCCAAAACCAATG | AAAGAAT | chr6 | 160658755 | 160658774 | 160658771 | + |
| SEQ ID NO 38656 | AGCAGGAAGGATCCAGCACA | GGAGAAA | chr6 | 160659108 | 160659127 | 160659124 | + |
| SEQ ID NO 38657 | GAGTAGCAGGTGAAAGCTCA | CAAGAAA | chr6 | 160659502 | 160659521 | 160659518 | + |
| SEQ ID NO 38658 | CAGGTGAAAGCTCACAAGAA | AGAGAAA | chr6 | 160659508 | 160659527 | 160659524 | + |
| SEQ ID NO 38659 | TAGTAGGGGCAGGGACCAGT | GCAGAAA | chr6 | 160659752 | 160659771 | 160659768 | + |
| SEQ ID NO 38660 | TTGAGATAAACAGTGGTAAG | GAAGAAA | chr6 | 160659883 | 160659902 | 160659899 | + |
| SEQ ID NO 38661 | CGTAGAAGTAATTCCAACCT | AAAGAAA | chr6 | 160659954 | 160659973 | 160659970 | + |
| SEQ ID NO 38662 | ACAATATTGCAAATCATTAT | TAAGAAT | chr6 | 160660027 | 160660046 | 160660043 | + |
| SEQ ID NO 38663 | TCTAACCATAAAATCTTAAA | TAAGAAT | chr6 | 160660446 | 160660465 | 160660462 | + |
| SEQ ID NO 38664 | GTTGATCTGCTAATCCCTGT | GTAGAAA | chr6 | 160660554 | 160660573 | 160660570 | + |
| SEQ ID NO 38665 | GACACACCACTATTAGTTGG | GGAGAAT | chr6 | 160660837 | 160660856 | 160660853 | + |
| SEQ ID NO 38666 | ATGCCGATGACAAGTATCCA | GTAGAAA | chr6 | 160661428 | 160661447 | 160661444 | + |
| SEQ ID NO 38667 | AGATGAACAGATTCTCATTC | TCAGAAA | chr6 | 160661458 | 160661477 | 160661474 | + |
| SEQ ID NO 38668 | TAGATATATCAAAATATCAT | TGAGAAA | chr6 | 160661706 | 160661725 | 160661722 | + |
| SEQ ID NO 38669 | TTGCTAGGAAATATCCCAAA | ACAGAAT | chr6 | 160662057 | 160662076 | 160662073 | + |
| SEQ ID NO 38670 | AATAGGGTTTATTTGTTGGT | GAAGAAA | chr6 | 160662172 | 160662191 | 160662188 | + |
| SEQ ID NO 38671 | AATGTATTTTATTAATGGTG | TGAGAAT | chr6 | 160662275 | 160662294 | 160662291 | + |
| SEQ ID NO 38672 | TCTCACTGAGCATGGCTGTA | AAAGAAA | chr6 | 160662390 | 160662409 | 160662406 | + |
| SEQ ID NO 38673 | ATTGGAAAGATAACACGTCC | ACAGAAA | chr6 | 160662448 | 160662467 | 160662464 | + |
| SEQ ID NO 38674 | GCTTTCCAAAAGAGCTTATC | AGAGAAT | chr6 | 160662480 | 160662499 | 160662496 | + |
| SEQ ID NO 38675 | CCTAGTTCCATGGGCTGAA | ATAGAAT | chr6 | 160662608 | 160662627 | 160662624 | + |
| SEQ ID NO 38676 | TTACTCAGGCCATAACAAAG | AGAGAAA | chr6 | 160663683 | 160663702 | 160663699 | + |
| SEQ ID NO 38677 | TGTAGGCACACTCTTTTAGA | TTAGAAA | chr6 | 160663914 | 160663933 | 160663930 | + |
| SEQ ID NO 38678 | GGAAATTAAACTTATTTTTT | TAAGAAT | chr6 | 160663996 | 160664015 | 160664012 | + |
| SEQ ID NO 38679 | TGTATTTTACTACATTGTG | GGAGAAA | chr6 | 160664103 | 160664122 | 160664119 | + |
| SEQ ID NO 38680 | AAACTATGTCTTACCTGATT | TCAGAAA | chr6 | 160664152 | 160664171 | 160664168 | + |
| SEQ ID NO 38681 | TTGGGACTGGCCAGCAGTGC | CCAGAAA | chr6 | 160664216 | 160664235 | 160664232 | + |
| SEQ ID NO 38682 | CTACTAAGTAGGCTGAGGCA | CTAGAAT | chr6 | 160665097 | 160665116 | 160665113 | + |
| SEQ ID NO 38683 | AGATGGAGGTTGCAGTGAGC | CAAGAAT | chr6 | 160665138 | 160665157 | 160665154 | + |
| SEQ ID NO 38684 | CTCCAGCCTGGGTGACAGAG | CAAGAAT | chr6 | 160665176 | 160665195 | 160665192 | + |
| SEQ ID NO 38685 | CAGAGCAAGAATGTCTCAGG | AAAGAAA | chr6 | 160665191 | 160665210 | 160665207 | + |
| SEQ ID NO 38686 | CATGAAGTAAAGCAAGAGTG | GTAGAAT | chr6 | 160665689 | 160665708 | 160665705 | + |
| SEQ ID NO 38687 | ACCCTCTACCTCCTTCCCTA | CCAGAAA | chr6 | 160665905 | 160665924 | 160665921 | + |
| SEQ ID NO 38688 | AGTGGATTTGACTCTTCCAT | TCAGAAA | chr6 | 160666273 | 160666292 | 160666289 | + |
| SEQ ID NO 38689 | CACAGGGAGCTGGGCTTCCT | TGAGAAA | chr6 | 160666330 | 160666349 | 160666346 | + |
| SEQ ID NO 38690 | TACCTGTGTTTAAAAGATG | AAAGAAA | chr6 | 160666371 | 160666390 | 160666387 | + |

Figure 57 (Cont'd)

| | | | | | | | |
|---|---|---|---|---|---|---|---|
| SEQ ID NO 38691 | TTCTTTGCTTTTAAAACCAT | AAAGAAT | chr6 | 160666633 | 160666652 | 160666649 | + |
| SEQ ID NO 38692 | TAATGTTTAAATGTAGAGTC | TGAGAAA | chr6 | 160666659 | 160666678 | 160666675 | + |
| SEQ ID NO 38693 | GTACATTTTATTGCAATAAA | AAAGAAT | chr6 | 160666989 | 160667008 | 160667005 | + |
| SEQ ID NO 38694 | TATGACAGTGTAAAATGTCA | CTAGAAA | chr6 | 160667369 | 160667388 | 160667385 | + |
| SEQ ID NO 38695 | TTTTGCAAGCCCAGCTTTCA | TTAGAAT | chr6 | 160667675 | 160667694 | 160667691 | + |
| SEQ ID NO 38696 | CTTAGATCATTGACTTTGGT | TCAGAAA | chr6 | 160667786 | 160667805 | 160667802 | + |
| SEQ ID NO 38697 | GTGTGAGGGAGCACCGTTCT | CTAGAAT | chr6 | 160667971 | 160667990 | 160667987 | + |
| SEQ ID NO 38698 | CCTGATGTCATTATTGACAT | GTAGAAA | chr6 | 160668371 | 160668390 | 160668387 | + |
| SEQ ID NO 38699 | TCATGGTCTAGTTAGTGTTC | TGAGAAT | chr6 | 160668434 | 160668453 | 160668450 | + |
| SEQ ID NO 38700 | AGCCTAGTGGGGATGGTGG | TTAGAAA | chr6 | 160668503 | 160668522 | 160668519 | + |
| SEQ ID NO 38701 | GTGTGGATGGTTGTGGGCA | GAAGAAA | chr6 | 160668531 | 160668550 | 160668547 | + |
| SEQ ID NO 38702 | TGATGATAATGGTGATGGTG | GTAGAAT | chr6 | 160668834 | 160668853 | 160668850 | + |
| SEQ ID NO 38703 | GGTCTCACCTGCAGGTCCAC | TGAGAAA | chr6 | 160668471 | 160668490 | 160668474 | - |
| SEQ ID NO 38704 | CTCTGCCCGATGCTTGGTAG | TCAGAAA | chr6 | 160667926 | 160667945 | 160667929 | - |
| SEQ ID NO 38705 | TGCAGTCAAAGGCTCTGGGG | GAAGAAA | chr6 | 160667766 | 160667785 | 160667769 | - |
| SEQ ID NO 38706 | TGAAAGCTGGGCTTGCAAAA | TTAGAAA | chr6 | 160667675 | 160667694 | 160667678 | - |
| SEQ ID NO 38707 | CCGTTCTATTTGAATTTGGC | AAAGAAA | chr6 | 160667567 | 160667586 | 160667570 | - |
| SEQ ID NO 38708 | AAATAAAGCAGTTTTTCACA | AAAGAAT | chr6 | 160667542 | 160667561 | 160667545 | - |
| SEQ ID NO 38709 | CAAAAGAATAAACACAACCA | GGAGAAT | chr6 | 160667524 | 160667543 | 160667527 | - |
| SEQ ID NO 38710 | AATTGTCAAAGAAGTATAAA | TTAGAAA | chr6 | 160667484 | 160667503 | 160667487 | - |
| SEQ ID NO 38711 | TTTTACACTGTCATAACCTT | CTAGAAA | chr6 | 160667364 | 160667383 | 160667367 | - |
| SEQ ID NO 38712 | ATTGGCAGTGTTATTGGGAG | ACAGAAA | chr6 | 160667333 | 160667352 | 160667336 | - |
| SEQ ID NO 38713 | TAATTTATGGGAACTTAGGC | TCAGAAA | chr6 | 160667296 | 160667315 | 160667299 | - |
| SEQ ID NO 38714 | GCTCAGAAAATATTAAGGAA | TAAGAAT | chr6 | 160667278 | 160667297 | 160667281 | - |
| SEQ ID NO 38715 | GTGCAACCATCATCATATTT | CCAGAAT | chr6 | 160666896 | 160666915 | 160666899 | - |
| SEQ ID NO 38716 | TTCTTTATGGTTTTAAAAGC | AAAGAAA | chr6 | 160666639 | 160666658 | 160666642 | - |
| SEQ ID NO 38717 | TTAAAAGCAAAGAAAAAGGT | AAAGAAA | chr6 | 160666627 | 160666646 | 160666630 | - |
| SEQ ID NO 38718 | GAAGCCCAGCTCCCTGTGAT | TGAGAAT | chr6 | 160666328 | 160666347 | 160666331 | - |
| SEQ ID NO 38719 | AGGCATTGACAGTTGCAAGG | TAAGAAA | chr6 | 160666227 | 160666246 | 160666230 | - |
| SEQ ID NO 38720 | GACCCCAGTCTAAGTGTTGC | TCAGAAA | chr6 | 160666097 | 160666116 | 160666100 | - |
| SEQ ID NO 38721 | ATTTATTTAAGCCACAACTA | CTAGAAT | chr6 | 160665273 | 160665292 | 160665276 | - |
| SEQ ID NO 38722 | TTATAACATAATTTATAATT | ACAGAAA | chr6 | 160664893 | 160664912 | 160664896 | - |
| SEQ ID NO 38723 | TTATGATTTTATTTTATCCA | AAAGAAA | chr6 | 160664560 | 160664579 | 160664563 | - |
| SEQ ID NO 38724 | TTTTATTTTATCCAAAAGAA | AGAGAAT | chr6 | 160664554 | 160664573 | 160664557 | - |
| SEQ ID NO 38725 | GCCAGTGGCATGGGTCTCTG | AGAGAAT | chr6 | 160664330 | 160664349 | 160664333 | - |
| SEQ ID NO 38726 | GACATAGTTTTTTTAAATTA | TAAGAAT | chr6 | 160664142 | 160664161 | 160664145 | - |
| SEQ ID NO 38727 | CACGGTGCTGGAATGAATGG | GCAGAAA | chr6 | 160663963 | 160663982 | 160663966 | - |
| SEQ ID NO 38728 | TACATTTGCTTCTTATCCCT | GGAGAAA | chr6 | 160663648 | 160663667 | 160663651 | - |
| SEQ ID NO 38729 | GTCATCCCCATTTTATAAAC | AAAGAAA | chr6 | 160663426 | 160663445 | 160663429 | - |
| SEQ ID NO 38730 | AATTCCAAATCAAGGAAAT | AAAGAAA | chr6 | 160663360 | 160663379 | 160663363 | - |
| SEQ ID NO 38731 | CTGGATTTAAGCCAGATTTC | CAAGAAA | chr6 | 160663332 | 160663351 | 160663335 | - |
| SEQ ID NO 38732 | AGGTTAATTGTTTGCCACTT | GCAGAAT | chr6 | 160663220 | 160663239 | 160663223 | - |
| SEQ ID NO 38733 | AGAAGAGAGAAGTCTGGTAT | AAAGAAA | chr6 | 160663186 | 160663205 | 160663189 | - |
| SEQ ID NO 38734 | CTTCCAAAGCTAGCTTAGGG | GAAGAAA | chr6 | 160663151 | 160663170 | 160663154 | - |
| SEQ ID NO 38735 | CGTACTACTTCACTTTAGGA | GCAGAAA | chr6 | 160663110 | 160663129 | 160663113 | - |
| SEQ ID NO 38736 | TGAATTTAGTGGAAGCCATT | CAAGAAA | chr6 | 160662742 | 160662761 | 160662745 | - |
| SEQ ID NO 38737 | AAGCCATTCAAGAAAATATC | AAAGAAA | chr6 | 160662730 | 160662749 | 160662733 | - |
| SEQ ID NO 38738 | AGCCATGCTCAGTGAGAAGC | GGAGAAA | chr6 | 160662387 | 160662406 | 160662390 | - |
| SEQ ID NO 38739 | CATTCACACACCACAGTGAG | GAAGAAA | chr6 | 160662308 | 160662327 | 160662311 | - |

Figure 57 (Cont'd)

| SEQ ID NO 38740 | ATGAGCCCTGGAGGTGAATC | AGAGAAA | chr6 | 160662136 | 160662155 | 160662139 | - |
| SEQ ID NO 38741 | GAAAAATCATCAGGTTAAAA | AAAGAAA | chr6 | 160662096 | 160662115 | 160662099 | - |
| SEQ ID NO 38742 | TTGAAGTCACACTGTGAGCT | ATAGAAT | chr6 | 160661827 | 160661846 | 160661830 | - |
| SEQ ID NO 38743 | CCTGGAAAAGAGAGTTCAAA | TGAGAAA | chr6 | 160661781 | 160661800 | 160661784 | - |
| SEQ ID NO 38744 | TGCTTTTTAGTGGATTAGGT | TCAGAAT | chr6 | 160661681 | 160661700 | 160661684 | - |
| SEQ ID NO 38745 | GAGGTCAGGACAGGCCTTTC | TGAGAAT | chr6 | 160661481 | 160661500 | 160661484 | - |
| SEQ ID NO 38746 | AGGACAGGCCTTTCTGAGAA | TGAGAAT | chr6 | 160661475 | 160661494 | 160661478 | - |
| SEQ ID NO 38747 | CCACCCTTTGCCACAACCAG | GCAGAAA | chr6 | 160661003 | 160661022 | 160661006 | - |
| SEQ ID NO 38748 | GTTGCCTCAGATTTGATCTC | AAAGAAA | chr6 | 160660957 | 160660976 | 160660960 | - |
| SEQ ID NO 38749 | TACAACCAATGCACATATTG | TAAGAAA | chr6 | 160660612 | 160660631 | 160660615 | - |
| SEQ ID NO 38750 | GCAGGAGGTGGAAGCCCCTG | AGAGAAT | chr6 | 160660404 | 160660423 | 160660407 | - |
| SEQ ID NO 38751 | CCCTGAGAGAATGGAGGTCT | GGAGAAT | chr6 | 160660389 | 160660408 | 160660392 | - |
| SEQ ID NO 38752 | GGAGGAGGGGGAATACCTAG | GTAGAAA | chr6 | 160660317 | 160660336 | 160660320 | - |
| SEQ ID NO 38753 | AGGGGGAATACCTAGGTAGA | AAAGAAT | chr6 | 160660312 | 160660331 | 160660315 | - |
| SEQ ID NO 38754 | CTCACTGTGCAGTTAACTTT | TCAGAAT | chr6 | 160660261 | 160660280 | 160660264 | - |
| SEQ ID NO 38755 | TAGGGAGGGAAGAGGGCAAA | GGAGAAA | chr6 | 160660215 | 160660234 | 160660218 | - |
| SEQ ID NO 38756 | AGAAGCAATGCAGCCATTAC | GTAGAAT | chr6 | 160660119 | 160660138 | 160660122 | - |
| SEQ ID NO 38757 | ACACCTGTATCACAGGTGTT | AAAGAAA | chr6 | 160660083 | 160660102 | 160660086 | - |
| SEQ ID NO 38758 | TATCACAGGTGTTAAAGAAA | CAAGAAA | chr6 | 160660076 | 160660095 | 160660079 | - |
| SEQ ID NO 38759 | ACCGTTAATGCCCTTGGGCT | TGAGAAA | chr6 | 160659599 | 160659618 | 160659602 | - |
| SEQ ID NO 38760 | ACCTCCAGCACACAGCAGGG | AAAGAAT | chr6 | 160659547 | 160659566 | 160659550 | - |
| SEQ ID NO 38761 | GCTGCCCCAAGCTGTAGAG | CCAGAAT | chr6 | 160659200 | 160659219 | 160659203 | - |
| SEQ ID NO 38762 | AGAGCCAGAATATAAAGCTG | GCAGAAA | chr6 | 160659184 | 160659203 | 160659187 | - |
| SEQ ID NO 38763 | CCAGAAGTGGTTCTTGAGGA | ACAGAAT | chr6 | 160658801 | 160658820 | 160658804 | - |
| SEQ ID NO 38764 | TGATTGCTCCTAAGTTCTCT | GGAGAAA | chr6 | 160658512 | 160658531 | 160658515 | - |
| SEQ ID NO 38765 | GTTCTCTGGAGAAAGAGATG | AAAGAAA | chr6 | 160658499 | 160658518 | 160658502 | - |
| SEQ ID NO 38766 | ATGAGAGTTTTAACTCCTGT | AGAGAAA | chr6 | 160658397 | 160658416 | 160658400 | - |
| SEQ ID NO 38767 | CTGATGAAACTTTTTTGCCA | GAAGAAA | chr6 | 160658172 | 160658191 | 160658175 | - |
| SEQ ID NO 38768 | AAGCTTTCTAATTTATATTG | GCAGAAA | chr6 | 160657859 | 160657878 | 160657862 | - |
| SEQ ID NO 38769 | TAATGTTGCAGCTCGGGGAC | TTAGAAA | chr6 | 160657716 | 160657735 | 160657719 | - |
| SEQ ID NO 38770 | CAGCAGAGGCAAAGCAGCCA | TCAGAAT | chr6 | 160656973 | 160656992 | 160656976 | - |
| SEQ ID NO 38771 | TATAAACAAAAAACTGCCAG | GTAGAAT | chr6 | 160656850 | 160656869 | 160656853 | - |
| SEQ ID NO 38772 | CTAATCTGAATTATAAAAAC | AGAGAAT | chr6 | 160656813 | 160656832 | 160656816 | - |
| SEQ ID NO 38773 | CCAGGGTAACTGTGTGTACT | GGAGAAA | chr6 | 160656622 | 160656641 | 160656625 | - |
| SEQ ID NO 38774 | AAGGGAAGTAATGAGACATT | TCAGAAA | chr6 | 160656597 | 160656616 | 160656600 | - |
| SEQ ID NO 38775 | ATAGACATACTTATTAGCTG | GCAGAAA | chr6 | 160656375 | 160656394 | 160656378 | - |
| SEQ ID NO 38776 | GCCATTAGAGCTGTCTCTAC | CTAGAAA | chr6 | 160656286 | 160656305 | 160656289 | - |
| SEQ ID NO 38777 | CGTTTGGCCCCTCTTACAAC | CAAGAAA | chr6 | 160655585 | 160655604 | 160655588 | - |
| SEQ ID NO 38778 | ATGCATGTGTACACTTGTGC | TAAGAAA | chr6 | 160654795 | 160654814 | 160654798 | - |

Figure 58

| # | Sequence | PAM | chr6 | Start | End | Cuts 5' of | Str |
|---|---|---|---|---|---|---|---|
| SEQ ID NO 38779 | GTGTTAATTTGCTCAAGCAA | CAAAAC | chr6 | 160656032 | 160656051 | 160656048 | + |
| SEQ ID NO 38780 | ACTGTAAGTCAGAAATGAGC | TAAAAC | chr6 | 160656459 | 160656478 | 160656475 | + |
| SEQ ID NO 38781 | AACTCTTTCTCTACAGGAGT | TAAAAC | chr6 | 160658385 | 160658404 | 160658401 | + |
| SEQ ID NO 38782 | TCAGCCAACACCAGAAGTCC | CAAAAC | chr6 | 160658744 | 160658763 | 160658760 | + |
| SEQ ID NO 38783 | CTCTGGGAGCTTCACCCCAC | AAAAAC | chr6 | 160659394 | 160659413 | 160659410 | + |
| SEQ ID NO 38784 | TAGGGGCAGGGACCAGTGCA | GAAAAC | chr6 | 160659755 | 160659774 | 160659771 | + |
| SEQ ID NO 38785 | ATTTAATATGCTCTATGCTG | GAAAAC | chr6 | 160661619 | 160661638 | 160661635 | + |
| SEQ ID NO 38786 | TATAGCTCACAGTGTGACTT | CAAAAC | chr6 | 160661824 | 160661843 | 160661840 | + |
| SEQ ID NO 38787 | CATGTTGCTAGGAAATATCC | CAAAAC | chr6 | 160662053 | 160662072 | 160662069 | + |
| SEQ ID NO 38788 | AATGTGCCCCCAGGTCGAT | TAAAAC | chr6 | 160662504 | 160662523 | 160662520 | + |
| SEQ ID NO 38789 | CATAGACACCAATTTCCCCA | AAAAAC | chr6 | 160662668 | 160662687 | 160662684 | + |
| SEQ ID NO 38790 | AAACCAAAGCATGCCCACTA | CAAAAC | chr6 | 160662924 | 160662943 | 160662940 | + |
| SEQ ID NO 38791 | AAATAATTCTTATAATTTAA | AAAAAC | chr6 | 160664130 | 160664149 | 160664146 | + |
| SEQ ID NO 38792 | GACAAGCCTGGGCAACATGC | CAAAAC | chr6 | 160665010 | 160665029 | 160665026 | + |
| SEQ ID NO 38793 | TAAATAAATATTTTTAAAAA | TAAAAC | chr6 | 160665292 | 160665311 | 160665308 | + |
| SEQ ID NO 38794 | GTTAGGAGGCTCCTCCCGTT | TAAAAC | chr6 | 160665770 | 160665789 | 160665786 | + |
| SEQ ID NO 38795 | CATATAAGAGTCTATGTTCC | AAAAAC | chr6 | 160666544 | 160666563 | 160666560 | + |
| SEQ ID NO 38796 | TTTACCTTTTTCTTTGCTTT | TAAAAC | chr6 | 160666624 | 160666643 | 160666640 | + |
| SEQ ID NO 38797 | GACAGTGTAAAATGTCACTA | GAAAAC | chr6 | 160667372 | 160667391 | 160667388 | + |
| SEQ ID NO 38798 | GTTGTGTTTATTCTTTTGTG | AAAAAC | chr6 | 160667526 | 160667545 | 160667542 | + |
| SEQ ID NO 38799 | GCAAACATCCTGATAATGGT | GAAAAC | chr6 | 160668014 | 160668033 | 160668030 | + |
| SEQ ID NO 38800 | AAACATGAAGGGGAGAGCAG | GAAAAC | chr6 | 160668308 | 160668327 | 160668324 | + |
| SEQ ID NO 38801 | AACTAGACCATGAGGTGCCA | CAAAAC | chr6 | 160668427 | 160668446 | 160668430 | - |
| SEQ ID NO 38802 | AAGCTGGGCTTGCAAAATTA | GAAAAC | chr6 | 160667672 | 160667691 | 160667675 | - |
| SEQ ID NO 38803 | CCCTGGGTGTGTCCATCTGG | AAAAAC | chr6 | 160667618 | 160667637 | 160667621 | - |
| SEQ ID NO 38804 | ATGAAGATCATAGCACTATA | CAAAAC | chr6 | 160666803 | 160666822 | 160666806 | - |
| SEQ ID NO 38805 | TACAAAAGTCTGAAAATAT | AAAAAC | chr6 | 160666705 | 160666724 | 160666708 | - |
| SEQ ID NO 38806 | TAACATAATTTATAATTACA | GAAAAC | chr6 | 160664890 | 160664909 | 160664893 | - |
| SEQ ID NO 38807 | AGCCTGCTCTGCTACATTTC | AAAAAC | chr6 | 160661914 | 160661933 | 160661917 | - |
| SEQ ID NO 38808 | GATGCCTATCAACACCTTGG | AAAAAC | chr6 | 160660873 | 160660892 | 160660876 | - |
| SEQ ID NO 38809 | AGAAAGAGTTGAAATTGTGA | AAAAAC | chr6 | 160658375 | 160658394 | 160658378 | - |
| SEQ ID NO 38810 | CTACTTGATTTATATAAACA | AAAAAC | chr6 | 160656862 | 160656881 | 160656865 | - |
| SEQ ID NO 38811 | TAAAGACTAATCTGAATTAT | AAAAAC | chr6 | 160656819 | 160656838 | 160656822 | - |
| SEQ ID NO 38812 | GACGTTGATTCCAGGGTACC | CAAAAC | chr6 | 160656547 | 160656566 | 160656550 | - |
| SEQ ID NO 38813 | CCTAGAAAATAAAAAATC | AAAAAC | chr6 | 160656267 | 160656286 | 160656270 | - |

Figure 59

| # | Sequence | PAM | chr6 | Start | End | Cuts 5' of | Str |
|---|---|---|---|---|---|---|---|
| SEQ ID NO 38814 | CCACACCCTCACAGACATAA | CCGAGATT | chr6 | 160654432 | 160654451 | 160654448 | + |
| SEQ ID NO 38815 | TGCTGATATGAACAACACTT | AAATGCTT | chr6 | 160654687 | 160654706 | 160654703 | + |
| SEQ ID NO 38816 | CAAAATCCTAGAGGTCTCCA | CTGTGATT | chr6 | 160655282 | 160655301 | 160655298 | + |
| SEQ ID NO 38817 | TCATGTGGCCCAAATGGCAG | AGCAGCTT | chr6 | 160655390 | 160655409 | 160655406 | + |
| SEQ ID NO 38818 | CAGCTTTCACAGCAGCCTGG | ACCTGTTT | chr6 | 160655412 | 160655431 | 160655428 | + |
| SEQ ID NO 38819 | GAGGGGCCAAACGCAGCAAG | TTATGCTT | chr6 | 160655592 | 160655611 | 160655608 | + |
| SEQ ID NO 38820 | TAGAAAGTCCCTAAATTTTA | GCTGGATT | chr6 | 160655682 | 160655701 | 160655698 | + |
| SEQ ID NO 38821 | ATGTCTCACCAATAAGTTCA | GTGTGTTT | chr6 | 160655734 | 160655753 | 160655750 | + |
| SEQ ID NO 38822 | AGCGAGCAAGGTCTCTCCAA | ATAAGATT | chr6 | 160655841 | 160655860 | 160655857 | + |
| SEQ ID NO 38823 | GGCCTTGTCAGCTGAAGGCA | AATTGCTT | chr6 | 160655928 | 160655947 | 160655944 | + |
| SEQ ID NO 38824 | CAATTGGAGTCACCACTTGG | TTAAGCTT | chr6 | 160656078 | 160656097 | 160656094 | + |
| SEQ ID NO 38825 | CAGTCCCTCCAGGGATGGGA | TATTGTTT | chr6 | 160656237 | 160656256 | 160656253 | + |
| SEQ ID NO 38826 | CTCCAGGGATGGGATATTGT | TTTTGATT | chr6 | 160656243 | 160656262 | 160656259 | + |
| SEQ ID NO 38827 | TTCTAGGTAGAGACAGCTCT | AATGGCTT | chr6 | 160656280 | 160656299 | 160656296 | + |
| SEQ ID NO 38828 | GTAGAGACAGCTCTAATGGC | TTCTGTTT | chr6 | 160656286 | 160656305 | 160656302 | + |
| SEQ ID NO 38829 | CTTTAACTGGGGAACCACAA | TAACGTTT | chr6 | 160656517 | 160656536 | 160656533 | + |
| SEQ ID NO 38830 | GTAACAGGTTCGAGTCTGGA | AATTGATT | chr6 | 160656767 | 160656786 | 160656783 | + |
| SEQ ID NO 38831 | TCTGGAAATTGATTGAGGGC | CCATGATT | chr6 | 160656781 | 160656800 | 160656797 | + |
| SEQ ID NO 38832 | TTGATTGAGGGCCCATGATT | CTCTGTTT | chr6 | 160656789 | 160656808 | 160656805 | + |
| SEQ ID NO 38833 | ATGATTCTGTTTTTATAA | TTCAGATT | chr6 | 160656803 | 160656822 | 160656819 | + |
| SEQ ID NO 38834 | GTCTTTAGTCCATTCTACCT | GGCAGTTT | chr6 | 160656832 | 160656851 | 160656848 | + |
| SEQ ID NO 38835 | GTCCATTCTACCTGGCAGTT | TTTTGTTT | chr6 | 160656839 | 160656858 | 160656855 | + |
| SEQ ID NO 38836 | ATAAATCAAGTAGGAATACA | GTAGGTTT | chr6 | 160656869 | 160656888 | 160656885 | + |
| SEQ ID NO 38837 | CAATTTCACTTCTAGGAACA | CCATGATT | chr6 | 160656902 | 160656921 | 160656918 | + |
| SEQ ID NO 38838 | ATGAGTCAGACTATTCTGAT | GGCTGCTT | chr6 | 160656954 | 160656973 | 160656970 | + |
| SEQ ID NO 38839 | GCTCTCACAAATCTATTTCA | CAAAGCTT | chr6 | 160657176 | 160657195 | 160657192 | + |
| SEQ ID NO 38840 | TGCCTCAGCCTCCCAAGTAG | ATGAGATT | chr6 | 160657510 | 160657529 | 160657526 | + |
| SEQ ID NO 38841 | TTTTGTATTTTTAGCAGAGA | TGGGGTTT | chr6 | 160657567 | 160657586 | 160657583 | + |
| SEQ ID NO 38842 | CGCCCCGCCTCCCAAGGTG | CTGGGATT | chr6 | 160657643 | 160657662 | 160657659 | + |
| SEQ ID NO 38843 | AGTAGGGCCAAACCAATAAA | TTCAGCTT | chr6 | 160657754 | 160657773 | 160657770 | + |
| SEQ ID NO 38844 | ATCCATTCCCATGCCTGTTC | TCCAGATT | chr6 | 160657826 | 160657845 | 160657842 | + |
| SEQ ID NO 38845 | ATTTCTGCCAATATAAATTA | GAAAGCTT | chr6 | 160657851 | 160657870 | 160657867 | + |
| SEQ ID NO 38846 | CACTGTTGCCTCAAGCAGTG | CAGGGTTT | chr6 | 160658055 | 160658074 | 160658071 | + |
| SEQ ID NO 38847 | ACCACTACTGGGGATGGGGA | AACTGTTT | chr6 | 160658140 | 160658159 | 160658156 | + |
| SEQ ID NO 38848 | GAAACTGTTTCTTCTGGCAA | AAAAGTTT | chr6 | 160658158 | 160658177 | 160658174 | + |
| SEQ ID NO 38849 | GAGTTCACAAACTCAGTGTC | CTCAGCTT | chr6 | 160658191 | 160658210 | 160658207 | + |
| SEQ ID NO 38850 | AGATCAGCTACTCGCATGAT | AACAGCTT | chr6 | 160658335 | 160658354 | 160658351 | + |
| SEQ ID NO 38851 | CTCGCATGATAACAGCTTGT | CTCTGTTT | chr6 | 160658345 | 160658364 | 160658361 | + |
| SEQ ID NO 38852 | CTCTCATTCAGGGCAATCTT | AGCAGATT | chr6 | 160658410 | 160658429 | 160658426 | + |
| SEQ ID NO 38853 | TAGCAGATTTGTGGCTCAGT | ATCTGCTT | chr6 | 160658429 | 160658448 | 160658445 | + |
| SEQ ID NO 38854 | TCTAGAGGGACAGAACTAAT | AGGAGATT | chr6 | 160658848 | 160658867 | 160658864 | + |
| SEQ ID NO 38855 | ATAGATATACTCACACAAAG | GGGAGCTT | chr6 | 160658963 | 160658982 | 160658979 | + |
| SEQ ID NO 38856 | TTATTAAGTGGTATTAACTC | ACAAGATT | chr6 | 160658989 | 160659008 | 160659005 | + |
| SEQ ID NO 38857 | TAGCCTTTTACATTTTCT | GCCAGCTT | chr6 | 160659162 | 160659181 | 160659178 | + |
| SEQ ID NO 38858 | CCAGCTTTATATTCTGGCTC | TACAGCTT | chr6 | 160659183 | 160659202 | 160659199 | + |
| SEQ ID NO 38859 | CAGCAGGGGCAGGGGCCTCA | GGGTGCTT | chr6 | 160659216 | 160659235 | 160659232 | + |
| SEQ ID NO 38860 | AAGGACTTTCAGTCACCTCT | GGGAGCTT | chr6 | 160659378 | 160659397 | 160659394 | + |
| SEQ ID NO 38861 | AGAGGGGCTGTGGGTTGTCT | CTTGGATT | chr6 | 160659642 | 160659661 | 160659658 | + |

Figure 59 (Cont'd)

| | | | | | | | |
|---|---|---|---|---|---|---|---|
| SEQ ID NO 38862 | TGAGCCCATACTTTAATCTC | AAGAGTTT | chr6 | 160659857 | 160659876 | 160659873 | + |
| SEQ ID NO 38863 | TTTTTAAAAATCATATTTAT | AGAGGTTT | chr6 | 160659984 | 160660003 | 160660000 | + |
| SEQ ID NO 38864 | TATTAAGAATACAAGAAGTA | CAATGTTT | chr6 | 160660044 | 160660063 | 160660060 | + |
| SEQ ID NO 38865 | AATACAAGAAGTACAATGTT | TCTTGTTT | chr6 | 160660051 | 160660070 | 160660067 | + |
| SEQ ID NO 38866 | TTCTTTAACACCTGTGATAC | AGGTGTTT | chr6 | 160660077 | 160660096 | 160660093 | + |
| SEQ ID NO 38867 | TGAATTCTACGTAATGGCTG | CATTGCTT | chr6 | 160660109 | 160660128 | 160660125 | + |
| SEQ ID NO 38868 | TGCAGGACTTGGGTAATCTC | TGGGGTTT | chr6 | 160660351 | 160660370 | 160660367 | + |
| SEQ ID NO 38869 | ACTTGGGTAATCTCTGGGGT | TTCAGATT | chr6 | 160660357 | 160660376 | 160660373 | + |
| SEQ ID NO 38870 | CTCCAGACCTCCATTCTCTC | AGGGGCTT | chr6 | 160660385 | 160660404 | 160660401 | + |
| SEQ ID NO 38871 | AAATCTTAAATAAGAATAAA | TCATGTTT | chr6 | 160660456 | 160660475 | 160660472 | + |
| SEQ ID NO 38872 | TAAGAATAAATCATGTTTGC | TCTTGATT | chr6 | 160660466 | 160660485 | 160660482 | + |
| SEQ ID NO 38873 | CATCAGTGGCAACTGTGTTG | CCAAGATT | chr6 | 160660523 | 160660542 | 160660539 | + |
| SEQ ID NO 38874 | TAGAAATGAACCTTGGAGGC | CATTGTTT | chr6 | 160660575 | 160660594 | 160660591 | + |
| SEQ ID NO 38875 | AATGAACCTTGGAGGCCATT | GTTTGATT | chr6 | 160660579 | 160660598 | 160660595 | + |
| SEQ ID NO 38876 | CAAAGAAGGCCATTTTTGTA | CTAGGCTT | chr6 | 160660801 | 160660820 | 160660817 | + |
| SEQ ID NO 38877 | CCACTATTAGTTGGGGAGAA | TTCAGTTT | chr6 | 160660843 | 160660862 | 160660859 | + |
| SEQ ID NO 38878 | TTCCAAGGTGTTGATAGGCA | TCCAGATT | chr6 | 160660871 | 160660890 | 160660887 | + |
| SEQ ID NO 38879 | GAACCTGGGACCAATACTGC | CCACGATT | chr6 | 160660922 | 160660941 | 160660938 | + |
| SEQ ID NO 38880 | AGGCAACAAATCTGTTCAAA | AGCTGCTT | chr6 | 160660970 | 160660989 | 160660986 | + |
| SEQ ID NO 38881 | AGGCTCCTTAGGACACCTGG | CTGAGCTT | chr6 | 160661079 | 160661098 | 160661095 | + |
| SEQ ID NO 38882 | TCCATCTCTGGCACAAAATG | TAGTGATT | chr6 | 160661140 | 160661159 | 160661156 | + |
| SEQ ID NO 38883 | GGCTAATAAAATGAAGATAG | CCAAGCTT | chr6 | 160661192 | 160661211 | 160661208 | + |
| SEQ ID NO 38884 | GATGACACTGCAGAGAAC | ATGTGTTT | chr6 | 160661398 | 160661417 | 160661414 | + |
| SEQ ID NO 38885 | ATCCAGTAGAAAGGCAGATG | AACAGATT | chr6 | 160661443 | 160661462 | 160661459 | + |
| SEQ ID NO 38886 | CAAGGAGGAGGATGCACGCT | CACTGTTT | chr6 | 160661530 | 160661549 | 160661546 | + |
| SEQ ID NO 38887 | AATATGCTCTATGCTGGAAA | ACTGGATT | chr6 | 160661623 | 160661642 | 160661639 | + |
| SEQ ID NO 38888 | ATATCCATGTCTTCACCCCG | CACTGTTT | chr6 | 160661749 | 160661768 | 160661765 | + |
| SEQ ID NO 38889 | ACTCTCTTTTCCAGGAAGAG | TTGTGCTT | chr6 | 160661786 | 160661805 | 160661802 | + |
| SEQ ID NO 38890 | AAACACACAATAAATTAATA | AGGTGCTT | chr6 | 160661846 | 160661865 | 160661862 | + |
| SEQ ID NO 38891 | GTTCAGTTAAACATTTTGAA | GAGTGTTT | chr6 | 160661884 | 160661903 | 160661900 | + |
| SEQ ID NO 38892 | CCTGTAACTGTGTCATTTTA | TTATGCTT | chr6 | 160661990 | 160662009 | 160662006 | + |
| SEQ ID NO 38893 | CAATTTTTCTTTTTTTAACC | TGATGATT | chr6 | 160662084 | 160662103 | 160662100 | + |
| SEQ ID NO 38894 | TGATGATTTTCCACAATCC | TTTTGTTT | chr6 | 160662104 | 160662123 | 160662120 | + |
| SEQ ID NO 38895 | TTTCCACAATCCTTTTGTTT | CTCTGATT | chr6 | 160662112 | 160662131 | 160662128 | + |
| SEQ ID NO 38896 | CTCCAGGGCTCATATGGCAA | TGGGGATT | chr6 | 160662143 | 160662162 | 160662159 | + |
| SEQ ID NO 38897 | ATATGGCAATGGGGATTTAA | TAGGGTTT | chr6 | 160662154 | 160662173 | 160662170 | + |
| SEQ ID NO 38898 | CTTAGCAATTTGTGAATAGA | AGATGTTT | chr6 | 160662355 | 160662374 | 160662371 | + |
| SEQ ID NO 38899 | TTTGTGAATAGAAGATGTTT | CTCCGCTT | chr6 | 160662363 | 160662382 | 160662379 | + |
| SEQ ID NO 38900 | GATAACACGTCCACAGAAAG | CCTGGCTT | chr6 | 160662456 | 160662475 | 160662472 | + |
| SEQ ID NO 38901 | CAGAAAGCCTGGCTTTCCAA | AAGAGCTT | chr6 | 160662469 | 160662488 | 160662485 | + |
| SEQ ID NO 38902 | ATCAGAGAATGTGCCCCCA | GGTCGATT | chr6 | 160662497 | 160662516 | 160662513 | + |
| SEQ ID NO 38903 | ATATGTTAATCCTGTGGCAG | AGAAGTTT | chr6 | 160662530 | 160662549 | 160662546 | + |
| SEQ ID NO 38904 | AAGTTCACAGTGATCTACAT | CCTAGTTT | chr6 | 160662588 | 160662607 | 160662604 | + |
| SEQ ID NO 38905 | ACCAATTTCCCCAAAAAACT | CTTTGCTT | chr6 | 160662675 | 160662694 | 160662691 | + |
| SEQ ID NO 38906 | TTTTCTTTGATATTTTCTTG | AATGGCTT | chr6 | 160662722 | 160662741 | 160662738 | + |
| SEQ ID NO 38907 | ATGGCTTCCACTAAATTCAA | ATGTGTTT | chr6 | 160662743 | 160662762 | 160662759 | + |
| SEQ ID NO 38908 | TAAAATTTTATCTGGTAATT | TATAGATT | chr6 | 160662789 | 160662808 | 160662805 | + |
| SEQ ID NO 38909 | GCAAGTTCATCTAACTATGT | ATGTGCTT | chr6 | 160662862 | 160662881 | 160662878 | + |
| SEQ ID NO 38910 | GATGGAACTCCTGAGTTCAC | AGGTGATT | chr6 | 160662893 | 160662912 | 160662909 | + |

Figure 59 (Cont'd)

| SEQ ID NO 38911 | ACTACAAAACTCTCACCCTC | CAGAGATT | chr6 | 160662940 | 160662959 | 160662956 | + |
| SEQ ID NO 38912 | TGCTGCATTTCTTCCCCTAA | GCTAGCTT | chr6 | 160663137 | 160663156 | 160663153 | + |
| SEQ ID NO 38913 | ACCAGACTTCTCTCTTCTTA | ATTGGATT | chr6 | 160663188 | 160663207 | 160663204 | + |
| SEQ ID NO 38914 | TGCTCTTCAGTTACATTGGA | ATGTGTTT | chr6 | 160663239 | 160663258 | 160663255 | + |
| SEQ ID NO 38915 | TTCAGTTACATTGGAATGTG | TTTAGATT | chr6 | 160663244 | 160663263 | 160663260 | + |
| SEQ ID NO 38916 | GATGAAAAAGTGAGAAGAGC | CCTAGATT | chr6 | 160663296 | 160663315 | 160663312 | + |
| SEQ ID NO 38917 | CCTAGATTTTTTCTTGGAAA | TCTGGCTT | chr6 | 160663316 | 160663335 | 160663332 | + |
| SEQ ID NO 38918 | CTTGGAAATCTGGCTTAAAT | CCAGGTTT | chr6 | 160663328 | 160663347 | 160663344 | + |
| SEQ ID NO 38919 | AAATCCAGGTTTCTTTATTT | CCTTGATT | chr6 | 160663344 | 160663363 | 160663360 | + |
| SEQ ID NO 38920 | ATTTGGTCACGAGACAAATA | ACATGATT | chr6 | 160663377 | 160663396 | 160663393 | + |
| SEQ ID NO 38921 | AATAACATGATTTTCCTAAG | TCTAGATT | chr6 | 160663393 | 160663412 | 160663409 | + |
| SEQ ID NO 38922 | ATTTTCCTAAGTCTAGATTT | CTTTGTTT | chr6 | 160663402 | 160663421 | 160663418 | + |
| SEQ ID NO 38923 | ACATATTCAAAGAGTTATTT | CATTGTTT | chr6 | 160663747 | 160663766 | 160663763 | + |
| SEQ ID NO 38924 | ATGAAACTGAGAACCAAGCG | AAGAGCTT | chr6 | 160663826 | 160663845 | 160663842 | + |
| SEQ ID NO 38925 | CCATCATGTAGGCACACTCT | TTTAGATT | chr6 | 160663908 | 160663927 | 160663924 | + |
| SEQ ID NO 38926 | TAAGAATTTTTCAATCATAT | ACAAGATT | chr6 | 160664016 | 160664035 | 160664032 | + |
| SEQ ID NO 38927 | ATTTAAAAAAACTATGTCTT | ACCTGATT | chr6 | 160664144 | 160664163 | 160664160 | + |
| SEQ ID NO 38928 | ACCAGATAGTCAAATTAAGT | TAATGATT | chr6 | 160664298 | 160664317 | 160664314 | + |
| SEQ ID NO 38929 | CACCCCTAGACCTTCATCTT | TCCTGATT | chr6 | 160664493 | 160664512 | 160664509 | + |
| SEQ ID NO 38930 | CCTTCATCTTTCCTGATTAG | TCTTGTTT | chr6 | 160664503 | 160664522 | 160664519 | + |
| SEQ ID NO 38931 | CTGCACATCCATAGCCTCCC | TCAAGCTT | chr6 | 160664631 | 160664650 | 160664647 | + |
| SEQ ID NO 38932 | TAGACACAACCCTTTCAGGT | CTTAGTTT | chr6 | 160664734 | 160664753 | 160664750 | + |
| SEQ ID NO 38933 | TATTTATTCCTAGTGAACTC | ACATGTTT | chr6 | 160664860 | 160664879 | 160664876 | + |
| SEQ ID NO 38934 | CAGATGGATCACCTGAGGCC | AGGAGTTT | chr6 | 160664980 | 160664999 | 160664996 | + |
| SEQ ID NO 38935 | TAAGTAGGCTGAGGCACTAG | AATTGCTT | chr6 | 160665101 | 160665120 | 160665117 | + |
| SEQ ID NO 38936 | ATCCTTCCTATTCTAGTAGT | TGTGGCTT | chr6 | 160665257 | 160665276 | 160665273 | + |
| SEQ ID NO 38937 | GACAGGTGGATCACAAGGTC | AGGAGTTT | chr6 | 160665372 | 160665391 | 160665388 | + |
| SEQ ID NO 38938 | CAAGATGGTTAGGAGGCTCC | TCCCGTTT | chr6 | 160665763 | 160665782 | 160665779 | + |
| SEQ ID NO 38939 | ATACATTTGGGACAGATCTA | GGGAGTTT | chr6 | 160666065 | 160666084 | 160666081 | + |
| SEQ ID NO 38940 | ACACTTAGACTGGGGTCTTC | CATTGATT | chr6 | 160666100 | 160666119 | 160666116 | + |
| SEQ ID NO 38941 | AAATGCCCAGCACAGAGCTC | AGTGGATT | chr6 | 160666253 | 160666272 | 160666269 | + |
| SEQ ID NO 38942 | CTCTTCCATTCAGAAACTCA | TAGCGATT | chr6 | 160666284 | 160666303 | 160666300 | + |
| SEQ ID NO 38943 | TCATTCTCAATCACAGGGAG | CTGGGCTT | chr6 | 160666319 | 160666338 | 160666335 | + |
| SEQ ID NO 38944 | AAAGCCAGCCCCAAAGGTAC | CTGTGTTT | chr6 | 160666354 | 160666373 | 160666370 | + |
| SEQ ID NO 38945 | AAGAGTCTATGTTCCAAAAA | CCTGGATT | chr6 | 160666549 | 160666568 | 160666565 | + |
| SEQ ID NO 38946 | AAAAACCTGGATTTAACAAT | CTGAGCTT | chr6 | 160666564 | 160666583 | 160666580 | + |
| SEQ ID NO 38947 | TAACAATCTGAGCTTTGTCA | TGGTGCTT | chr6 | 160666577 | 160666596 | 160666593 | + |
| SEQ ID NO 38948 | CATGGTGCTTTGCGGTTGGT | TGTTGTTT | chr6 | 160666595 | 160666614 | 160666611 | + |
| SEQ ID NO 38949 | TGTTGTTTCTTTACCTTTTT | CTTTGCTT | chr6 | 160666615 | 160666634 | 160666631 | + |
| SEQ ID NO 38950 | GCTTTTAAAACCATAAAGAA | TAATGTTT | chr6 | 160666639 | 160666658 | 160666655 | + |
| SEQ ID NO 38951 | AGTCTGAGAAATGCAATTGC | TATTGTTT | chr6 | 160666675 | 160666694 | 160666691 | + |
| SEQ ID NO 38952 | TTTATATTTTCAGACTTTTT | GTATGCTT | chr6 | 160666702 | 160666721 | 160666718 | + |
| SEQ ID NO 38953 | TCATATCACAAAATTTCACA | CCCTGATT | chr6 | 160666745 | 160666764 | 160666761 | + |
| SEQ ID NO 38954 | TTTTCACTCAACATTACATA | ATGAGTTT | chr6 | 160666773 | 160666792 | 160666789 | + |
| SEQ ID NO 38955 | CTAATATTTTAAAGGAGAGC | TACTGATT | chr6 | 160666825 | 160666844 | 160666841 | + |
| SEQ ID NO 38956 | GAGCTACTGATTAATGAGCA | TGAGGTTT | chr6 | 160666841 | 160666860 | 160666857 | + |
| SEQ ID NO 38957 | AAGCATTATCCTTTCCAGGC | ACAAGCTT | chr6 | 160667030 | 160667049 | 160667046 | + |
| SEQ ID NO 38958 | GGTCTGCGGAGTCACTGCCC | AAATGCTT | chr6 | 160667180 | 160667199 | 160667196 | + |
| SEQ ID NO 38959 | CCCGTGCGCGTTGGCCCCCC | TCTTGCTT | chr6 | 160667212 | 160667231 | 160667228 | + |

Figure 59 (Cont'd)

| | | | | | | | |
|---|---|---|---|---|---|---|---|
| SEQ ID NO 38960 | AATCTAACAGGTTGAAATTG | TCCTGATT | chr6 | 160667446 | 160667465 | 160667462 | + |
| SEQ ID NO 38961 | TCTTTGACAATTTGGGAGAG | TGAAGATT | chr6 | 160667492 | 160667511 | 160667508 | + |
| SEQ ID NO 38962 | GAGAGTGAAGATTCTCCTGG | TTGTGTTT | chr6 | 160667507 | 160667526 | 160667523 | + |
| SEQ ID NO 38963 | GTGTTTATTCTTTTGTGAAA | AACTGCTT | chr6 | 160667529 | 160667548 | 160667545 | + |
| SEQ ID NO 38964 | TGCAAAATTGCCAGAGGAAA | TGCTGTTT | chr6 | 160667588 | 160667607 | 160667604 | + |
| SEQ ID NO 38965 | TTCCAGATGGACACACCCAG | GGATGTTT | chr6 | 160667616 | 160667635 | 160667632 | + |
| SEQ ID NO 38966 | TTCAGTGTTCTCACAAATAA | TCCAGTTT | chr6 | 160667642 | 160667661 | 160667658 | + |
| SEQ ID NO 38967 | CAGTTTTCTAATTTTGCAAG | CCCAGCTT | chr6 | 160667664 | 160667683 | 160667680 | + |
| SEQ ID NO 38968 | CATTAGAATTTTGCAAAAAT | CCTTGCTT | chr6 | 160667693 | 160667712 | 160667709 | + |
| SEQ ID NO 38969 | GTTGACATGAGCAGCATGGA | AGATGTTT | chr6 | 160667829 | 160667848 | 160667845 | + |
| SEQ ID NO 38970 | TCTGGGCAGAGCTGCATGAT | GGAAGTTT | chr6 | 160667894 | 160667913 | 160667910 | + |
| SEQ ID NO 38971 | CAGGTAGGCCACAGGTGACA | AGAGGATT | chr6 | 160668126 | 160668145 | 160668142 | + |
| SEQ ID NO 38972 | GTCCAGCGGCAGGATCAGTC | CATTGATT | chr6 | 160668198 | 160668217 | 160668214 | + |
| SEQ ID NO 38973 | AATTGATGAACAGGCCTGAG | TTATGTTT | chr6 | 160668397 | 160668416 | 160668413 | + |
| SEQ ID NO 38974 | GCTAATGGTGGTGGTAATGA | TAATGATT | chr6 | 160668775 | 160668794 | 160668791 | + |
| SEQ ID NO 38975 | TCATCAGTAGACATCATATA | ACCAGTTT | chr6 | 160668592 | 160668611 | 160668595 | - |
| SEQ ID NO 38976 | TAGCTGGCCCAGAGCCTACT | TGCTGTTT | chr6 | 160668563 | 160668582 | 160668566 | - |
| SEQ ID NO 38977 | TTTCTAACCACCATCCCCCA | CTAGGCTT | chr6 | 160668510 | 160668529 | 160668513 | - |
| SEQ ID NO 38978 | CACCTGCAGGTCCACTGAGA | AAATGATT | chr6 | 160668466 | 160668485 | 160668469 | - |
| SEQ ID NO 38979 | TCAGCCTCTGAGAGGGAGGT | CAAAGTTT | chr6 | 160668338 | 160668357 | 160668341 | - |
| SEQ ID NO 38980 | AAGTTTTCCTGCTCTCCCCT | TCATGTTT | chr6 | 160668316 | 160668335 | 160668319 | - |
| SEQ ID NO 38981 | TCCCTGACTTGGATCAAATG | CAGAGTTT | chr6 | 160668280 | 160668299 | 160668283 | - |
| SEQ ID NO 38982 | GTTTGGAGGTGTTGAGGCCA | AGGGGATT | chr6 | 160668256 | 160668275 | 160668259 | - |
| SEQ ID NO 38983 | CTCCCCAAGGCCCCATCAGG | GAGGGCTT | chr6 | 160668163 | 160668182 | 160668166 | - |
| SEQ ID NO 38984 | AACTTTCCTGGCAACTTGCG | GTAGGTTT | chr6 | 160668044 | 160668063 | 160668047 | - |
| SEQ ID NO 38985 | GTAGGTTTTCACCATTATCA | GGATGTTT | chr6 | 160668024 | 160668043 | 160668027 | - |
| SEQ ID NO 38986 | GATGTTGCCTTGCTCAAAT | AGCAGATT | chr6 | 160668003 | 160668022 | 160668006 | - |
| SEQ ID NO 38987 | CAGGTGATGCACCCTCTGCC | CGATGCTT | chr6 | 160667939 | 160667958 | 160667942 | - |
| SEQ ID NO 38988 | ACTTCCATCATGCAGCTCTG | CCCAGATT | chr6 | 160667900 | 160667919 | 160667903 | - |
| SEQ ID NO 38989 | CATGTCAACTCCAGATGCAG | TCAGGTTT | chr6 | 160667818 | 160667837 | 160667821 | - |
| SEQ ID NO 38990 | CCTGTGCCATGCTCGCAAAG | CAAGGATT | chr6 | 160667718 | 160667737 | 160667721 | - |
| SEQ ID NO 38991 | TTGCAAAATTCTAATGAAAG | CTGGGCTT | chr6 | 160667689 | 160667708 | 160667692 | - |
| SEQ ID NO 38992 | TGGGCTTGCAAAATTAGAAA | ACTGGATT | chr6 | 160667668 | 160667687 | 160667671 | - |
| SEQ ID NO 38993 | GAATTTGGCAAAGAAAATAA | AGCAGTTT | chr6 | 160667556 | 160667575 | 160667559 | - |
| SEQ ID NO 38994 | AATCAGGACAATTTCAACCT | GTTAGATT | chr6 | 160667454 | 160667473 | 160667457 | - |
| SEQ ID NO 38995 | ACACTCATACAAGTGTGGTG | AAGTGATT | chr6 | 160667406 | 160667425 | 160667409 | - |
| SEQ ID NO 38996 | TCATACAAGTGTGGTGAAGT | GATTGTTT | chr6 | 160667402 | 160667421 | 160667405 | - |
| SEQ ID NO 38997 | ACTAGACAACCTCCTTACAC | CTCAGTTT | chr6 | 160667146 | 160667165 | 160667149 | - |
| SEQ ID NO 38998 | AGAGCAGGAGTGATGGAACT | GCCTGTTT | chr6 | 160667108 | 160667127 | 160667111 | - |
| SEQ ID NO 38999 | GAAGTGAGATACACCACATT | ATAAGCTT | chr6 | 160667060 | 160667079 | 160667063 | - |
| SEQ ID NO 39000 | AAGCTTGTGCCTGGAAAGGA | TAATGCTT | chr6 | 160667038 | 160667057 | 160667041 | - |
| SEQ ID NO 39001 | TACATTTAAACATTATTCTT | TATGGTTT | chr6 | 160666654 | 160666673 | 160666657 | - |
| SEQ ID NO 39002 | CGCAAAGCACCATGACAAAG | CTCAGATT | chr6 | 160666589 | 160666608 | 160666592 | - |
| SEQ ID NO 39003 | CAAAGCTCAGATTGTTAAAT | CCAGGTTT | chr6 | 160666574 | 160666593 | 160666577 | - |
| SEQ ID NO 39004 | TTGGAACATAGACTCTTATA | TGACGTTT | chr6 | 160666546 | 160666565 | 160666549 | - |
| SEQ ID NO 39005 | TCACCACTGCTCTGTTCTTC | TGGAGTTT | chr6 | 160666437 | 160666456 | 160666440 | - |
| SEQ ID NO 39006 | TAAACACAGGTACCTTTGGG | GCTGGCTT | chr6 | 160666363 | 160666382 | 160666366 | - |
| SEQ ID NO 39007 | TCTCAAGGAAGCCCAGCTCC | CTGTGATT | chr6 | 160666335 | 160666354 | 160666338 | - |
| SEQ ID NO 39008 | GAATGAAGTGTGCAATCGCT | ATGAGTTT | chr6 | 160666305 | 160666324 | 160666308 | - |

Figure 59 (Cont'd)

| SEQ ID NO 39009 | TCCCAAAGTAGCGAATTCAA | GTAGGATT | chr6 | 160666137 | 160666156 | 160666140 | - |
| SEQ ID NO 39010 | GATCATCCAAGGGGACTTCT | TGGGGCTT | chr6 | 160666040 | 160666059 | 160666043 | - |
| SEQ ID NO 39011 | CCGGTGGCCAGGGACTAAAG | TGGTGATT | chr6 | 160665940 | 160665959 | 160665943 | - |
| SEQ ID NO 39012 | CAGAGTTGGCGTGTCTCCCC | AATTGATT | chr6 | 160665825 | 160665844 | 160665828 | - |
| SEQ ID NO 39013 | CTCCCCAATTGATTTACAAC | TGGGGCTT | chr6 | 160665811 | 160665830 | 160665814 | - |
| SEQ ID NO 39014 | ATTTACAACTGGGGCTTGGA | TACTGTTT | chr6 | 160665800 | 160665819 | 160665803 | - |
| SEQ ID NO 39015 | TTTCCACTTAATTCTACCAC | TCTTGCTT | chr6 | 160665706 | 160665725 | 160665709 | - |
| SEQ ID NO 39016 | TACTTCATGAGAACGAAAAT | GTAAGATT | chr6 | 160665678 | 160665697 | 160665681 | - |
| SEQ ID NO 39017 | GCACCATGAATTCATTTGCG | GAAAGATT | chr6 | 160665650 | 160665669 | 160665653 | - |
| SEQ ID NO 39018 | CATTTGCGGAAAGATTGATA | CTATGCTT | chr6 | 160665638 | 160665657 | 160665641 | - |
| SEQ ID NO 39019 | ACCCCGGTTGAAGTGCACTG | ACGTGATT | chr6 | 160665556 | 160665575 | 160665559 | - |
| SEQ ID NO 39020 | TACTCCAGCCTCCCTAGTAG | CTGGGATT | chr6 | 160665489 | 160665508 | 160665492 | - |
| SEQ ID NO 39021 | TTTTGTATTTTTAGTAGAGA | TGGGGTTT | chr6 | 160665432 | 160665451 | 160665435 | - |
| SEQ ID NO 39022 | TGTCTTGGCCTCCCAAAGTG | CTGGGATT | chr6 | 160665356 | 160665375 | 160665359 | - |
| SEQ ID NO 39023 | TTGAGCCACCGCACTCGACC | CTATGTTT | chr6 | 160665322 | 160665341 | 160665325 | - |
| SEQ ID NO 39024 | AGCCACAACTACTAGAATAG | GAAGGATT | chr6 | 160665264 | 160665283 | 160665267 | - |
| SEQ ID NO 39025 | TTTTGTATTTTTTGTAGAGA | CAGGGTTT | chr6 | 160665040 | 160665059 | 160665043 | - |
| SEQ ID NO 39026 | ACAGGGTTTTGGCATGTTGC | CCAGGCTT | chr6 | 160665021 | 160665040 | 160665024 | - |
| SEQ ID NO 39027 | TGCCGTGGCCTCCCAAAATG | CTGGGATT | chr6 | 160664962 | 160664981 | 160664965 | - |
| SEQ ID NO 39028 | TGAGCCACCACCCCCTCCTG | GAAGGATT | chr6 | 160664927 | 160664946 | 160664930 | - |
| SEQ ID NO 39029 | AAATAAATTTTGAAGATAAT | AAAAGATT | chr6 | 160664845 | 160664864 | 160664848 | - |
| SEQ ID NO 39030 | CACTTATGTTGTCATTTCGG | CACAGTTT | chr6 | 160664815 | 160664834 | 160664818 | - |
| SEQ ID NO 39031 | TGGAGATGTTAACATTTATA | CCTAGCTT | chr6 | 160664776 | 160664795 | 160664779 | - |
| SEQ ID NO 39032 | TCGTACAGCACTGCCTGTTG | GAAAGCTT | chr6 | 160664661 | 160664680 | 160664664 | - |
| SEQ ID NO 39033 | CCAGCAAATATGAGCTACTT | TTATGATT | chr6 | 160664580 | 160664599 | 160664583 | - |
| SEQ ID NO 39034 | GTGGAGCAGCTGAGGGGGGA | AATGGCTT | chr6 | 160664443 | 160664462 | 160664446 | - |
| SEQ ID NO 39035 | ATAAGACTCTATATTCAAGG | TAATGTTT | chr6 | 160664370 | 160664389 | 160664373 | - |
| SEQ ID NO 39036 | TCATTAACTTAATTTGACTA | TCTGGTTT | chr6 | 160664304 | 160664323 | 160664307 | - |
| SEQ ID NO 39037 | TTTGACTATCTGGTTTGTGG | GTGCGTTT | chr6 | 160664292 | 160664311 | 160664295 | - |
| SEQ ID NO 39038 | TCATGTAAGTCAACAATGTC | CTGGGATT | chr6 | 160664260 | 160664279 | 160664263 | - |
| SEQ ID NO 39039 | ATTTCTGAAATCAGGTAAGA | CATAGTTT | chr6 | 160664160 | 160664179 | 160664163 | - |
| SEQ ID NO 39040 | TGTAGTAAAAATACATATGC | CATGGCTT | chr6 | 160664098 | 160664117 | 160664101 | - |
| SEQ ID NO 39041 | TTATGTGCAATTCATTTAAT | TTTTGATT | chr6 | 160664071 | 160664090 | 160664074 | - |
| SEQ ID NO 39042 | TTCCCAGTTCAAAATCTTGT | ATATGATT | chr6 | 160664036 | 160664055 | 160664039 | - |
| SEQ ID NO 39043 | ATTGAAAAATTCTTAAAAAA | ATAAGTTT | chr6 | 160664011 | 160664030 | 160664014 | - |
| SEQ ID NO 39044 | GAATGGGCAGAAAAAATAAT | GGTTGATT | chr6 | 160663949 | 160663968 | 160663952 | - |
| SEQ ID NO 39045 | ATGCAAAGGATGGCTAAGCT | CTTCGCTT | chr6 | 160663849 | 160663868 | 160663852 | - |
| SEQ ID NO 39046 | GCTAAGCTCTTCGCTTGGTT | CTCAGTTT | chr6 | 160663837 | 160663856 | 160663840 | - |
| SEQ ID NO 39047 | ACAATGAAATAACTCTTTGA | ATATGTTT | chr6 | 160663753 | 160663772 | 160663756 | - |
| SEQ ID NO 39048 | TCTCTTTGTTATGGCCTGAG | TAAGGCTT | chr6 | 160663686 | 160663705 | 160663689 | - |
| SEQ ID NO 39049 | AAGGCTTTCCATCGGTATAC | ATTTGCTT | chr6 | 160663665 | 160663684 | 160663668 | - |
| SEQ ID NO 39050 | TGCCAGATGATATACGCATA | TAATGATT | chr6 | 160663606 | 160663625 | 160663609 | - |
| SEQ ID NO 39051 | CATACACACATACACACCGT | GTGTGATT | chr6 | 160663522 | 160663541 | 160663525 | - |
| SEQ ID NO 39052 | AGTGTGTGTCCTTTACAAAT | ACTAGCTT | chr6 | 160663485 | 160663504 | 160663488 | - |
| SEQ ID NO 39053 | AAATCAAGGAAATAAAGAAA | CCTGGATT | chr6 | 160663353 | 160663372 | 160663356 | - |
| SEQ ID NO 39054 | ATAAAGAAACCTGGATTTAA | GCCAGATT | chr6 | 160663342 | 160663361 | 160663345 | - |
| SEQ ID NO 39055 | ATGTAACTGAAGAGCAGGTT | AATTGTTT | chr6 | 160663235 | 160663254 | 160663238 | - |
| SEQ ID NO 39056 | AGAGAAGTCTGGTATAAAGA | AAGTGATT | chr6 | 160663181 | 160663200 | 160663184 | - |
| SEQ ID NO 39057 | AGTCTGGTATAAAGAAAGTG | ATTTGCTT | chr6 | 160663176 | 160663195 | 160663179 | - |

Figure 59 (Cont'd)

| SEQ ID NO 39058 | GAAAGTGATTTGCTTCCAAA | GCTAGCTT | chr6 | 160663163 | 160663182 | 160663166 | - |
| SEQ ID NO 39059 | AAGGCAACAGAGGAGGCGAG | CAAGGATT | chr6 | 160663070 | 160663089 | 160663073 | - |
| SEQ ID NO 39060 | GCAAGGATTCAGGGGTCCAT | GCTAGCTT | chr6 | 160663051 | 160663070 | 160663054 | - |
| SEQ ID NO 39061 | GAGGCAAATCTCTGGAGGGT | GAGAGTTT | chr6 | 160662954 | 160662973 | 160662957 | - |
| SEQ ID NO 39062 | GGGTGAGAGTTTTGTAGTGG | GCATGCTT | chr6 | 160662938 | 160662957 | 160662941 | - |
| SEQ ID NO 39063 | GAGTTTTGTAGTGGGCATGC | TTTGGTTT | chr6 | 160662932 | 160662951 | 160662935 | - |
| SEQ ID NO 39064 | GAGTCTGATGAAAGGGAGGT | AGATGCTT | chr6 | 160662832 | 160662851 | 160662835 | - |
| SEQ ID NO 39065 | CAAAGAAAATACAGAGCAGG | AGAAGATT | chr6 | 160662711 | 160662730 | 160662714 | - |
| SEQ ID NO 39066 | GAGCAGGAGAAGATTAAGCA | AAGAGTTT | chr6 | 160662698 | 160662717 | 160662701 | - |
| SEQ ID NO 39067 | CTAGAACAAACTTCTCTGCC | ACAGGATT | chr6 | 160662545 | 160662564 | 160662548 | - |
| SEQ ID NO 39068 | TTCTCTGCCACAGGATTAAC | ATATGTTT | chr6 | 160662534 | 160662553 | 160662537 | - |
| SEQ ID NO 39069 | TGATAAGCTCTTTTGGAAAG | CCAGGCTT | chr6 | 160662481 | 160662500 | 160662484 | - |
| SEQ ID NO 39070 | TGGAATGCCCGGGGAGAGGA | AAAAGTTT | chr6 | 160662422 | 160662441 | 160662425 | - |
| SEQ ID NO 39071 | ATAAAAGTATTTTTCCTATT | AAAAGATT | chr6 | 160662216 | 160662235 | 160662219 | - |
| SEQ ID NO 39072 | AGTATTTTTCCTATTAAAAG | ATTTGTTT | chr6 | 160662211 | 160662230 | 160662214 | - |
| SEQ ID NO 39073 | TTCCTATTAAAAGATTTGTT | TAATGTTT | chr6 | 160662204 | 160662223 | 160662207 | - |
| SEQ ID NO 39074 | GGAGGTGAATCAGAGAAACA | AAAGGATT | chr6 | 160662127 | 160662146 | 160662130 | - |
| SEQ ID NO 39075 | CATCAGGTTAAAAAAAGAAA | AATTGATT | chr6 | 160662089 | 160662108 | 160662092 | - |
| SEQ ID NO 39076 | GTTAAAAAAAGAAAAATTGA | TTCTGTTT | chr6 | 160662083 | 160662102 | 160662086 | - |
| SEQ ID NO 39077 | AGTTAAAGGGGGAAATAAAT | GGAAGTTT | chr6 | 160661964 | 160661983 | 160661967 | - |
| SEQ ID NO 39078 | CATTTCAAAAACACTCTTCA | AAATGTTT | chr6 | 160661900 | 160661919 | 160661903 | - |
| SEQ ID NO 39079 | AAGCACCTTATTAATTTATT | GTGTGTTT | chr6 | 160661854 | 160661873 | 160661857 | - |
| SEQ ID NO 39080 | GATATTTTGATATATCTATC | AAGTGCTT | chr6 | 160661704 | 160661723 | 160661707 | - |
| SEQ ID NO 39081 | ATATCTATCAAGTGCTTTTT | AGTGGATT | chr6 | 160661693 | 160661712 | 160661696 | - |
| SEQ ID NO 39082 | AGCCAATGCCTGTTCAATAA | TCCAGTTT | chr6 | 160661649 | 160661668 | 160661652 | - |
| SEQ ID NO 39083 | CCTGTATTCCCTAGAAGTCT | CGCTGCTT | chr6 | 160661359 | 160661378 | 160661362 | - |
| SEQ ID NO 39084 | AAGTCTCGCTGCTTTCAGAG | CCAGGCTT | chr6 | 160661345 | 160661364 | 160661348 | - |
| SEQ ID NO 39085 | CAAAGTGGTCAAGGTTGTCC | TGTTGCTT | chr6 | 160661238 | 160661257 | 160661241 | - |
| SEQ ID NO 39086 | GTCCTGTTGCTTAATTCCAT | GGAAGCTT | chr6 | 160661222 | 160661241 | 160661225 | - |
| SEQ ID NO 39087 | CAGAGATGGAGCTGGCATCT | CCAGGCTT | chr6 | 160661130 | 160661149 | 160661133 | - |
| SEQ ID NO 39088 | TTTGCCACAACCAGGCAGAA | AGCAGCTT | chr6 | 160660997 | 160661016 | 160661000 | - |
| SEQ ID NO 39089 | CAGGCAGAAAGCAGCTTTTG | AACAGATT | chr6 | 160660986 | 160661005 | 160660989 | - |
| SEQ ID NO 39090 | CTTTTGAACAGATTTGTTGC | CTCAGATT | chr6 | 160660972 | 160660991 | 160660975 | - |
| SEQ ID NO 39091 | TGGGCAGTATTGGTCCCAGG | TTCTGCTT | chr6 | 160660925 | 160660944 | 160660928 | - |
| SEQ ID NO 39092 | AAAAATGGCCTTCTTTGTGG | AGGAGCTT | chr6 | 160660798 | 160660817 | 160660801 | - |
| SEQ ID NO 39093 | CTTCATATCCTCCATTTTTT | TTTTGCTT | chr6 | 160660773 | 160660792 | 160660776 | - |
| SEQ ID NO 39094 | TAAAGGAGGGACCATTCAGA | AGATGCTT | chr6 | 160660663 | 160660682 | 160660666 | - |
| SEQ ID NO 39095 | CTCCAAGGTTCATTTCTACA | CAGGGATT | chr6 | 160660573 | 160660592 | 160660576 | - |
| SEQ ID NO 39096 | GACATGGCAATCAAGAGCAA | ACATGATT | chr6 | 160660482 | 160660501 | 160660485 | - |
| SEQ ID NO 39097 | CAAACATGATTTATTCTTAT | TTAAGATT | chr6 | 160660465 | 160660484 | 160660468 | - |
| SEQ ID NO 39098 | GTCTGGAGAATCTGAAACCC | CAGAGATT | chr6 | 160660373 | 160660392 | 160660376 | - |
| SEQ ID NO 39099 | TGTACTTCTTGTATTCTTAA | TAATGATT | chr6 | 160660046 | 160660065 | 160660049 | - |
| SEQ ID NO 39100 | ATCACTGCAAACCTCTATAA | ATATGATT | chr6 | 160660000 | 160660019 | 160660003 | - |
| SEQ ID NO 39101 | CTACGCATTGACTTATCTTC | CTGGGTTT | chr6 | 160659939 | 160659958 | 160659942 | - |
| SEQ ID NO 39102 | CGTTGTACTTCTTCCTTAC | CACTGTTT | chr6 | 160659898 | 160659917 | 160659901 | - |
| SEQ ID NO 39103 | CCACTGTTTATCTCAAACTC | TTGAGATT | chr6 | 160659879 | 160659898 | 160659882 | - |
| SEQ ID NO 39104 | TATGGGCTCAGGAGGGAGCG | AGGAGCTT | chr6 | 160659847 | 160659866 | 160659850 | - |
| SEQ ID NO 39105 | GCCTTATGGAAAAGTGGCCA | CACTGTTT | chr6 | 160659785 | 160659804 | 160659788 | - |
| SEQ ID NO 39106 | CATTTTAGTCAGTGTTGGCT | CTGTGCTT | chr6 | 160659690 | 160659709 | 160659693 | - |

Figure 59 (Cont'd)

| SEQ ID NO 39107 | CAGTACCACCGTTAATGCCC | TTGGGCTT | chr6 | 160659606 | 160659625 | 160659609 | - |
| SEQ ID NO 39108 | GCACACAGCAGGGAAAGAAT | TCCAGTTT | chr6 | 160659540 | 160659559 | 160659543 | - |
| SEQ ID NO 39109 | AATTCCAGTTTCTCTTTCTT | GTGAGCTT | chr6 | 160659523 | 160659542 | 160659526 | - |
| SEQ ID NO 39110 | ACTCTTCACCAGGCAAGGCT | CCTGGCTT | chr6 | 160659486 | 160659505 | 160659489 | - |
| SEQ ID NO 39111 | ACATTTCCACTGGCTGCACT | CTGTGTTT | chr6 | 160659424 | 160659443 | 160659427 | - |
| SEQ ID NO 39112 | AGGGAAGGAAAAAAGATCCT | GAGTGCTT | chr6 | 160659313 | 160659332 | 160659316 | - |
| SEQ ID NO 39113 | GAAAAATGTAAAAAGGCTAG | ACTGGCTT | chr6 | 160659161 | 160659180 | 160659164 | - |
| SEQ ID NO 39114 | TTGGACTGTCTTCCTTGCTC | CTCAGATT | chr6 | 160659051 | 160659070 | 160659054 | - |
| SEQ ID NO 39115 | CTCTAGAGAACCCCGACTAA | TACAGATT | chr6 | 160658835 | 160658854 | 160658838 | - |
| SEQ ID NO 39116 | ATTAAGGATGGAATTCTTTC | ATTGGTTT | chr6 | 160658774 | 160658793 | 160658777 | - |
| SEQ ID NO 39117 | GTTTTGGGACTTCTGGTGTT | GGCTGATT | chr6 | 160658750 | 160658769 | 160658753 | - |
| SEQ ID NO 39118 | CTTCTGGTGTTGGCTGATTA | ATATGATT | chr6 | 160658741 | 160658760 | 160658744 | - |
| SEQ ID NO 39119 | CACTGATAGTACTTGGCCTG | AATTGTTT | chr6 | 160658669 | 160658688 | 160658672 | - |
| SEQ ID NO 39120 | AAAATAAATGCATTTGACAC | TACTGATT | chr6 | 160658629 | 160658648 | 160658632 | - |
| SEQ ID NO 39121 | TTCATCACTTATGAGAGGCA | AGGAGTTT | chr6 | 160658603 | 160658622 | 160658606 | - |
| SEQ ID NO 39122 | CCAAGGAACATAATGAAGTT | GGTTGATT | chr6 | 160658535 | 160658554 | 160658538 | - |
| SEQ ID NO 39123 | GATACTGAGCCACAAATCTG | CTAAGATT | chr6 | 160658432 | 160658451 | 160658435 | - |
| SEQ ID NO 39124 | CTGCTAAGATTGCCCTGAAT | GAGAGTTT | chr6 | 160658415 | 160658434 | 160658418 | - |
| SEQ ID NO 39125 | GGTGCATGCACAGCCTTGCC | AGGTGTTT | chr6 | 160658306 | 160658325 | 160658309 | - |
| SEQ ID NO 39126 | CCCTGATGAAGCTGAGGACA | CTGAGTTT | chr6 | 160658207 | 160658226 | 160658210 | - |
| SEQ ID NO 39127 | GAAACTTTTTGCCAGAAGA | AACAGTTT | chr6 | 160658167 | 160658186 | 160658170 | - |
| SEQ ID NO 39128 | GTCTGAGGATGTAAACCCTG | CACTGCTT | chr6 | 160658075 | 160658094 | 160658078 | - |
| SEQ ID NO 39129 | GCAGCTGCCAGGCAAGATAA | TGTTGATT | chr6 | 160658020 | 160658039 | 160658023 | - |
| SEQ ID NO 39130 | GAGGCACCCTAATGCCCT | GAATGCTT | chr6 | 160657984 | 160658003 | 160657987 | - |
| SEQ ID NO 39131 | GGTGCATTATACTCTAAAAG | AACTGCTT | chr6 | 160657887 | 160657906 | 160657890 | - |
| SEQ ID NO 39132 | TTATACTCTAAAAGAACTGC | TTAAGCTT | chr6 | 160657881 | 160657900 | 160657884 | - |
| SEQ ID NO 39133 | AGTTGGATCAAGCTGAATTT | ATTGGTTT | chr6 | 160657771 | 160657790 | 160657774 | - |
| SEQ ID NO 39134 | ATTGGTTTGGCCCTACTAAG | TAGGGATT | chr6 | 160657751 | 160657770 | 160657754 | - |
| SEQ ID NO 39135 | GGCGGGCAGATCACGAGATC | AGGAGATT | chr6 | 160657627 | 160657646 | 160657630 | - |
| SEQ ID NO 39136 | TTGGGAGGCTGAGGCAAGAG | AACTGCTT | chr6 | 160657506 | 160657525 | 160657509 | - |
| SEQ ID NO 39137 | AACTGCTTGAACCTGTGAGG | CAGAGATT | chr6 | 160657486 | 160657505 | 160657489 | - |
| SEQ ID NO 39138 | AAAAAAAAAAAAAAGTTAT | AATAGTTT | chr6 | 160657394 | 160657413 | 160657397 | - |
| SEQ ID NO 39139 | AAAAAAGTTATAATAGTTT | ATTTGCTT | chr6 | 160657386 | 160657405 | 160657389 | - |
| SEQ ID NO 39140 | ATTTGCTTGGTTAGCTGAAA | TATGGATT | chr6 | 160657366 | 160657385 | 160657369 | - |
| SEQ ID NO 39141 | TGTTAGTGAGCTGGAAATGC | CTTGGTTT | chr6 | 160657324 | 160657343 | 160657327 | - |
| SEQ ID NO 39142 | TAATGTAGAGGAAGTGATCC | AAAGGCTT | chr6 | 160657297 | 160657316 | 160657300 | - |
| SEQ ID NO 39143 | GGAAGTGATCCAAAGGCTTA | GGGAGATT | chr6 | 160657288 | 160657307 | 160657291 | - |
| SEQ ID NO 39144 | TAGGGAGATTAGGATGGTGG | AGTGGATT | chr6 | 160657270 | 160657289 | 160657273 | - |
| SEQ ID NO 39145 | CCAGAAGATACACCCTTGGC | CGAAGCTT | chr6 | 160657206 | 160657225 | 160657209 | - |
| SEQ ID NO 39146 | CCTTGGCCGAAGCTTTGTGA | AATAGATT | chr6 | 160657193 | 160657212 | 160657196 | - |
| SEQ ID NO 39147 | GGGAAACCTACTGTATTCCT | ACTTGATT | chr6 | 160656880 | 160656899 | 160656883 | - |
| SEQ ID NO 39148 | GGACACTGGCTCTGAGCTGA | CGTTGATT | chr6 | 160656565 | 160656584 | 160656568 | - |
| SEQ ID NO 39149 | TGTGGTTCCCCAGTTAAAGT | AGGGGCTT | chr6 | 160656516 | 160656535 | 160656519 | - |
| SEQ ID NO 39150 | TATGGAGGTTAGGTAATTAA | TGGAGTTT | chr6 | 160656489 | 160656508 | 160656492 | - |
| SEQ ID NO 39151 | TCCCATCCCTGGAGGGACTG | AAGTGATT | chr6 | 160656237 | 160656256 | 160656240 | - |
| SEQ ID NO 39152 | GGACTTGAAAGACGCAGGGG | TGGTGATT | chr6 | 160656195 | 160656214 | 160656198 | - |
| SEQ ID NO 39153 | GATGGATCTTGGAAAATGAT | GGTGGATT | chr6 | 160656119 | 160656138 | 160656122 | - |
| SEQ ID NO 39154 | GAAAATGATGGTGGATTATT | TTAAGCTT | chr6 | 160656108 | 160656127 | 160656111 | - |
| SEQ ID NO 39155 | ATTGCAGCTGCTCTACCAGT | TGTGGTTT | chr6 | 160656062 | 160656081 | 160656065 | - |

Figure 59 (Cont'd)

| | | | | | | | |
|---|---|---|---|---|---|---|---|
| SEQ ID NO 39156 | TGCTCTACCAGTTGTGGTTT | TGTTGCTT | chr6 | 160656054 | 160656073 | 160656057 | - |
| SEQ ID NO 39157 | CTGGTGCCTGGTATGCAGCC | ATTGGCTT | chr6 | 160656007 | 160656026 | 160656010 | - |
| SEQ ID NO 39158 | ATGCAGCCATTGGCTTGGCA | AGTGGCTT | chr6 | 160655995 | 160656014 | 160655998 | - |
| SEQ ID NO 39159 | CCTCAGGGGTGTATCAACTC | TCCAGCTT | chr6 | 160655885 | 160655904 | 160655888 | - |
| SEQ ID NO 39160 | ATCTTATTTGGAGAGACCTT | GCTCGCTT | chr6 | 160655848 | 160655867 | 160655851 | - |
| SEQ ID NO 39161 | CCATTACATTCATGACATTA | TGATGATT | chr6 | 160655793 | 160655812 | 160655796 | - |
| SEQ ID NO 39162 | CTAAGGTGAAGCATAACTTG | CTGCGTTT | chr6 | 160655608 | 160655627 | 160655611 | - |
| SEQ ID NO 39163 | CACAATGCCTGGTGGGCCTA | TTTGGATT | chr6 | 160655554 | 160655573 | 160655557 | - |
| SEQ ID NO 39164 | GATTTTGGAGGCAACACATT | CCTCGTTT | chr6 | 160655530 | 160655549 | 160655533 | - |
| SEQ ID NO 39165 | ATCGAGTGACCTGAAAGGCT | GCCAGATT | chr6 | 160655479 | 160655498 | 160655482 | - |
| SEQ ID NO 39166 | ACATGACCCCGCAGATCCAA | TGGTGCTT | chr6 | 160655376 | 160655395 | 160655379 | - |
| SEQ ID NO 39167 | GTGTCAGTGGCAGATAGGGA | TGCTGTTT | chr6 | 160655345 | 160655364 | 160655348 | - |
| SEQ ID NO 39168 | GTGAATCACAGTGGAGACCT | CTAGGATT | chr6 | 160655293 | 160655312 | 160655296 | - |
| SEQ ID NO 39169 | AGACAGCTATTGGTCTGTTA | TTGGGCTT | chr6 | 160655217 | 160655236 | 160655220 | - |
| SEQ ID NO 39170 | ATTGGGCTTTGGTGGTAACT | GAACGTTT | chr6 | 160655198 | 160655217 | 160655201 | - |
| SEQ ID NO 39171 | GAACCTGCCTATCATGAACT | GGTTGCTT | chr6 | 160655139 | 160655158 | 160655142 | - |
| SEQ ID NO 39172 | TTGAAGTGGTGTGTATGTGA | TCGGGCTT | chr6 | 160655058 | 160655077 | 160655061 | - |
| SEQ ID NO 39173 | TTTTTCCTTTATCATGTGAC | CTTAGATT | chr6 | 160654745 | 160654764 | 160654748 | - |
| SEQ ID NO 39174 | GTTAACCTTATGTAATAACT | TTTGGTTT | chr6 | 160654657 | 160654676 | 160654660 | - |
| SEQ ID NO 39175 | TTATGTAATAACTTTTGGTT | TGGGGATT | chr6 | 160654650 | 160654669 | 160654653 | - |
| SEQ ID NO 39176 | AACTTTTGGTTTGGGGATTG | GTGCGTTT | chr6 | 160654641 | 160654660 | 160654644 | - |
| SEQ ID NO 39177 | ACCTTATTATTGTCTTTATT | TGAAGATT | chr6 | 160654570 | 160654589 | 160654573 | - |
| SEQ ID NO 39178 | TGTCTTTATTTGAAGATTAT | GTATGATT | chr6 | 160654560 | 160654579 | 160654563 | - |
| SEQ ID NO 39179 | TGTGATGGTTAATACTGTCA | ACTTGATT | chr6 | 160654490 | 160654509 | 160654493 | - |
| SEQ ID NO 39180 | TGGTTAATACTGTCAACTTG | ATTGGATT | chr6 | 160654485 | 160654504 | 160654488 | - |
| SEQ ID NO 39181 | GTCTGTGAGGGTGTGGCAAA | AGGAGATT | chr6 | 160654428 | 160654447 | 160654431 | - |

Figure 60

| # | Sequence | PAM | Chr | Start | End | Cut site 1 (5' of) | Cut site 2 (5' of) | Str |
|---|---|---|---|---|---|---|---|---|
| SEQ ID NO 39182 | CCAGCCCACTGACTCAAATGTT | TTC | chr6 | 160654398 | 160654419 | 160654415 | 160654420 | + |
| SEQ ID NO 39183 | ACTCAAATGTTAATCTCCTTTT | CTG | chr6 | 160654409 | 160654430 | 160654426 | 160654431 | + |
| SEQ ID NO 39184 | AAATGTTAATCTCCTTTTGCCA | CTC | chr6 | 160654413 | 160654434 | 160654430 | 160654435 | + |
| SEQ ID NO 39185 | ATCTCCTTTTGCCACACCCTCA | TTA | chr6 | 160654421 | 160654442 | 160654438 | 160654443 | + |
| SEQ ID NO 39186 | CTTTTGCCACACCCTCACAGAC | CTC | chr6 | 160654426 | 160654447 | 160654443 | 160654448 | + |
| SEQ ID NO 39187 | TTGCCACACCCTCACAGACATA | CTT | chr6 | 160654429 | 160654450 | 160654446 | 160654451 | + |
| SEQ ID NO 39188 | TGCCACACCCTCACAGACATAA | TTT | chr6 | 160654430 | 160654451 | 160654447 | 160654452 | + |
| SEQ ID NO 39189 | GCCACACCCTCACAGACATAAC | TTT | chr6 | 160654431 | 160654452 | 160654448 | 160654453 | + |
| SEQ ID NO 39190 | CCACACCCTCACAGACATAACC | TTG | chr6 | 160654432 | 160654453 | 160654449 | 160654454 | + |
| SEQ ID NO 39191 | ACAGACATAACCGAGATTAATA | CTC | chr6 | 160654442 | 160654463 | 160654459 | 160654464 | + |
| SEQ ID NO 39192 | ATACTTTGCATCTTTCAATCCA | TTA | chr6 | 160654461 | 160654482 | 160654478 | 160654483 | + |
| SEQ ID NO 39193 | TGCATCTTTCAATCCAATCAAG | CTT | chr6 | 160654467 | 160654488 | 160654484 | 160654489 | + |
| SEQ ID NO 39194 | GCATCTTTCAATCCAATCAAGT | TTT | chr6 | 160654468 | 160654489 | 160654485 | 160654490 | + |
| SEQ ID NO 39195 | CATCTTTCAATCCAATCAAGTT | TTG | chr6 | 160654469 | 160654490 | 160654486 | 160654491 | + |
| SEQ ID NO 39196 | TCAATCCAATCAAGTTGACAGT | CTT | chr6 | 160654475 | 160654496 | 160654492 | 160654497 | + |
| SEQ ID NO 39197 | CAATCCAATCAAGTTGACAGTA | TTT | chr6 | 160654476 | 160654497 | 160654493 | 160654498 | + |
| SEQ ID NO 39198 | AATCCAATCAAGTTGACAGTAT | TTC | chr6 | 160654477 | 160654498 | 160654494 | 160654499 | + |
| SEQ ID NO 39199 | ACAGTATTAACCATCACAAGTC | TTG | chr6 | 160654492 | 160654513 | 160654509 | 160654514 | + |
| SEQ ID NO 39200 | ACCATCACAAGTCCAACTCCTT | TTA | chr6 | 160654501 | 160654522 | 160654518 | 160654523 | + |
| SEQ ID NO 39201 | CTTGTCAACTTGAACCCATACA | CTC | chr6 | 160654520 | 160654541 | 160654537 | 160654542 | + |
| SEQ ID NO 39202 | GTCAACTTGAACCCATACACAC | CTT | chr6 | 160654523 | 160654544 | 160654540 | 160654545 | + |
| SEQ ID NO 39203 | TCAACTTGAACCCATACACACA | TTG | chr6 | 160654524 | 160654545 | 160654541 | 160654546 | + |
| SEQ ID NO 39204 | GAACCCATACACACATCCTGAA | CTT | chr6 | 160654531 | 160654552 | 160654548 | 160654553 | + |
| SEQ ID NO 39205 | AACCCATACACACATCCTGAAA | TTG | chr6 | 160654532 | 160654553 | 160654549 | 160654554 | + |
| SEQ ID NO 39206 | AAATCATACATAATCTTCAAAT | CTG | chr6 | 160654551 | 160654572 | 160654568 | 160654573 | + |
| SEQ ID NO 39207 | CAAATAAGACAATAATAAGGT | CTT | chr6 | 160654568 | 160654589 | 160654585 | 160654590 | + |
| SEQ ID NO 39208 | AAATAAGACAATAATAAGGTC | TTC | chr6 | 160654569 | 160654590 | 160654586 | 160654591 | + |
| SEQ ID NO 39209 | TGCCTAATATAATACAACTATC | TTA | chr6 | 160654598 | 160654619 | 160654615 | 160654620 | + |
| SEQ ID NO 39210 | ATATAATACAACTATCCTCATA | CTA | chr6 | 160654604 | 160654625 | 160654621 | 160654626 | + |
| SEQ ID NO 39211 | TCCTCATACAACCAGAAACGCA | CTA | chr6 | 160654618 | 160654639 | 160654635 | 160654640 | + |
| SEQ ID NO 39212 | ATACAACCAGAAACGCACCAAT | CTC | chr6 | 160654623 | 160654644 | 160654640 | 160654645 | + |
| SEQ ID NO 39213 | TTACATAAGGTTAACAATATTT | TTA | chr6 | 160654662 | 160654683 | 160654679 | 160654684 | + |
| SEQ ID NO 39214 | CATAAGGTTAACAATATTTAAA | TTA | chr6 | 160654665 | 160654686 | 160654682 | 160654687 | + |
| SEQ ID NO 39215 | ACAATATTTAAATGCTGATATG | TTA | chr6 | 160654675 | 160654696 | 160654692 | 160654697 | + |
| SEQ ID NO 39216 | AAATGCTGATATGAACAACACT | TTT | chr6 | 160654684 | 160654705 | 160654701 | 160654706 | + |
| SEQ ID NO 39217 | AATGCTGATATGAACAACACTT | TTA | chr6 | 160654685 | 160654706 | 160654702 | 160654707 | + |
| SEQ ID NO 39218 | ATATGAACAACACTTAAATGCT | CTG | chr6 | 160654692 | 160654713 | 160654709 | 160654714 | + |
| SEQ ID NO 39219 | AAATGCTTAAATGCTGATGTGA | CTT | chr6 | 160654707 | 160654728 | 160654724 | 160654729 | + |
| SEQ ID NO 39220 | AATGCTTAAATGCTGATGTGAA | TTA | chr6 | 160654708 | 160654729 | 160654725 | 160654730 | + |
| SEQ ID NO 39221 | AAATGCTGATGTGAAGTCCATA | CTT | chr6 | 160654715 | 160654736 | 160654732 | 160654737 | + |
| SEQ ID NO 39222 | AATGCTGATGTGAAGTCCATAA | TTA | chr6 | 160654716 | 160654737 | 160654733 | 160654738 | + |
| SEQ ID NO 39223 | ATGTGAAGTCCATAAATCTAAG | CTG | chr6 | 160654723 | 160654744 | 160654740 | 160654745 | + |
| SEQ ID NO 39224 | AGGTCACATGATAAAGGAAAAA | CTA | chr6 | 160654743 | 160654764 | 160654760 | 160654765 | + |
| SEQ ID NO 39225 | TCTTAGCACAAGTGTACACATG | TTT | chr6 | 160654790 | 160654811 | 160654807 | 160654812 | + |
| SEQ ID NO 39226 | CTTAGCACAAGTGTACACATGC | TTT | chr6 | 160654791 | 160654812 | 160654808 | 160654813 | + |
| SEQ ID NO 39227 | TTAGCACAAGTGTACACATGCA | TTC | chr6 | 160654792 | 160654813 | 160654809 | 160654814 | + |
| SEQ ID NO 39228 | AGCACAAGTGTACACATGCATT | CTT | chr6 | 160654794 | 160654815 | 160654811 | 160654816 | + |
| SEQ ID NO 39229 | GCACAAGTGTACACATGCATTT | TTA | chr6 | 160654795 | 160654816 | 160654812 | 160654817 | + |
| SEQ ID NO 39230 | AGAAAGTGGATATAGTGCTGCA | TTT | chr6 | 160654817 | 160654838 | 160654834 | 160654839 | + |
| SEQ ID NO 39231 | GAAAGTGGATATAGTGCTGCAG | TTA | chr6 | 160654818 | 160654839 | 160654835 | 160654840 | + |
| SEQ ID NO 39232 | CAGCTGTCCACTTTCGGGTGGT | CTG | chr6 | 160654837 | 160654858 | 160654854 | 160654859 | + |
| SEQ ID NO 39233 | TCCACTTTCGGGTGGTGCCTGC | CTG | chr6 | 160654843 | 160654864 | 160654860 | 160654865 | + |
| SEQ ID NO 39234 | TCGGGTGGTGCCTGCATATCGT | CTT | chr6 | 160654850 | 160654871 | 160654867 | 160654872 | + |
| SEQ ID NO 39235 | CGGGTGGTGCCTGCATATCGTG | TTT | chr6 | 160654851 | 160654872 | 160654868 | 160654873 | + |
| SEQ ID NO 39236 | GGGTGGTGCCTGCATATCGTGC | TTC | chr6 | 160654852 | 160654873 | 160654869 | 160654874 | + |
| SEQ ID NO 39237 | CATATCGTGCAGAACCATCTAT | CTG | chr6 | 160654864 | 160654885 | 160654881 | 160654886 | + |
| SEQ ID NO 39238 | TGAACCAGTCCTTAGTCTTCCC | CTA | chr6 | 160654885 | 160654906 | 160654902 | 160654907 | + |

Figure 60 (Cont'd)

| | | | | | | | | |
|---|---|---|---|---|---|---|---|---|
| SEQ ID NO 39239 | AGTCTTCCCTTCCTCTGTCAAC | CTT | chr6 | 160654898 | 160654919 | 160654915 | 160654920 | + |
| SEQ ID NO 39240 | GTCTTCCCTTCCTCTGTCAACT | TTA | chr6 | 160654899 | 160654920 | 160654916 | 160654921 | + |
| SEQ ID NO 39241 | CCCTTCCTCTGTCAACTGATCA | CTT | chr6 | 160654904 | 160654925 | 160654921 | 160654926 | + |
| SEQ ID NO 39242 | CCTTCCTCTGTCAACTGATCAT | TTC | chr6 | 160654905 | 160654926 | 160654922 | 160654927 | + |
| SEQ ID NO 39243 | CCTCTGTCAACTGATCATAGGG | CTT | chr6 | 160654909 | 160654930 | 160654926 | 160654931 | + |
| SEQ ID NO 39244 | CTCTGTCAACTGATCATAGGGA | TTC | chr6 | 160654910 | 160654931 | 160654927 | 160654932 | + |
| SEQ ID NO 39245 | TGTCAACTGATCATAGGGAACT | CTC | chr6 | 160654913 | 160654934 | 160654930 | 160654935 | + |
| SEQ ID NO 39246 | TCAACTGATCATAGGGAACTCC | CTG | chr6 | 160654915 | 160654936 | 160654932 | 160654937 | + |
| SEQ ID NO 39247 | ATCATAGGGAACTCCCCATGAG | CTG | chr6 | 160654922 | 160654943 | 160654939 | 160654944 | + |
| SEQ ID NO 39248 | CCCATGAGGCCATTGGTGCAGG | CTC | chr6 | 160654936 | 160654957 | 160654953 | 160654958 | + |
| SEQ ID NO 39249 | GTGCAGGCTGGGGGAGGGAAGG | TTG | chr6 | 160654951 | 160654972 | 160654968 | 160654973 | + |
| SEQ ID NO 39250 | GGGGAGGGAAGGCAGGGTGGCA | CTG | chr6 | 160654961 | 160654982 | 160654978 | 160654983 | + |
| SEQ ID NO 39251 | GAGCCACTTCCTTATGTAACTT | TTT | chr6 | 160655005 | 160655026 | 160655022 | 160655027 | + |
| SEQ ID NO 39252 | AGCCACTTCCTTATGTAACTTA | TTG | chr6 | 160655006 | 160655027 | 160655023 | 160655028 | + |
| SEQ ID NO 39253 | CCTTATGTAACTTACTTGTGCC | CTT | chr6 | 160655014 | 160655035 | 160655031 | 160655036 | + |
| SEQ ID NO 39254 | CTTATGTAACTTACTTGTGCCT | TTC | chr6 | 160655015 | 160655036 | 160655032 | 160655037 | + |
| SEQ ID NO 39255 | ATGTAACTTACTTGTGCCTTCA | CTT | chr6 | 160655018 | 160655039 | 160655035 | 160655040 | + |
| SEQ ID NO 39256 | TGTAACTTACTTGTGCCTTCAG | TTA | chr6 | 160655019 | 160655040 | 160655036 | 160655041 | + |
| SEQ ID NO 39257 | ACTTGTGCCTTCAGGACCTGCT | CTT | chr6 | 160655027 | 160655048 | 160655044 | 160655049 | + |
| SEQ ID NO 39258 | CTTGTGCCTTCAGGACCTGCTC | TTA | chr6 | 160655028 | 160655049 | 160655045 | 160655050 | + |
| SEQ ID NO 39259 | GTGCCTTCAGGACCTGCTCAAG | CTT | chr6 | 160655031 | 160655052 | 160655048 | 160655053 | + |
| SEQ ID NO 39260 | TGCCTTCAGGACCTGCTCAAGC | TTG | chr6 | 160655032 | 160655053 | 160655049 | 160655054 | + |
| SEQ ID NO 39261 | CAGGACCTGCTCAAGCCCGATC | CTT | chr6 | 160655038 | 160655059 | 160655055 | 160655060 | + |
| SEQ ID NO 39262 | AGGACCTGCTCAAGCCCGATCA | TTC | chr6 | 160655039 | 160655060 | 160655056 | 160655061 | + |
| SEQ ID NO 39263 | CTCAAGCCCGATCACATACACA | CTG | chr6 | 160655047 | 160655068 | 160655064 | 160655069 | + |
| SEQ ID NO 39264 | AAGCCCGATCACATACACACCA | CTC | chr6 | 160655050 | 160655071 | 160655067 | 160655072 | + |
| SEQ ID NO 39265 | CAATTTGATGATGAAATGCCGC | CTT | chr6 | 160655075 | 160655096 | 160655092 | 160655097 | + |
| SEQ ID NO 39266 | AATTTGATGATGAAATGCCGCT | TTC | chr6 | 160655076 | 160655097 | 160655093 | 160655098 | + |
| SEQ ID NO 39267 | GATGATGAAATGCCGCTGTGCT | TTT | chr6 | 160655081 | 160655102 | 160655098 | 160655103 | + |
| SEQ ID NO 39268 | ATGATGAAATGCCGCTGTGCTG | TTG | chr6 | 160655082 | 160655103 | 160655099 | 160655104 | + |
| SEQ ID NO 39269 | TGCTGACCCACTTCATGGCTAG | CTG | chr6 | 160655099 | 160655120 | 160655116 | 160655121 | + |
| SEQ ID NO 39270 | ACCCACTTCATGGCTAGATGGG | CTG | chr6 | 160655104 | 160655125 | 160655121 | 160655126 | + |
| SEQ ID NO 39271 | CATGGCTAGATGGGTCAGAAAG | CTT | chr6 | 160655112 | 160655133 | 160655129 | 160655134 | + |
| SEQ ID NO 39272 | ATGGCTAGATGGGTCAGAAAGC | TTC | chr6 | 160655113 | 160655134 | 160655130 | 160655135 | + |
| SEQ ID NO 39273 | GATGGGTCAGAAAGCAACCAGT | CTA | chr6 | 160655120 | 160655141 | 160655137 | 160655142 | + |
| SEQ ID NO 39274 | ATGATAGGCAGGTTCAGGTAGC | TTC | chr6 | 160655144 | 160655165 | 160655161 | 160655166 | + |
| SEQ ID NO 39275 | AGGTAGCATGGTGACTTTATGA | TTC | chr6 | 160655159 | 160655180 | 160655176 | 160655181 | + |
| SEQ ID NO 39276 | TATGACCCACAGTCAAACGTTC | CTT | chr6 | 160655176 | 160655197 | 160655193 | 160655198 | + |
| SEQ ID NO 39277 | ATGACCCACAGTCAAACGTTCA | TTT | chr6 | 160655177 | 160655198 | 160655194 | 160655199 | + |
| SEQ ID NO 39278 | TGACCCACAGTCAAACGTTCAG | TTA | chr6 | 160655178 | 160655199 | 160655195 | 160655200 | + |
| SEQ ID NO 39279 | AGTTACCACCAAAGCCCAATAA | TTC | chr6 | 160655198 | 160655219 | 160655215 | 160655220 | + |
| SEQ ID NO 39280 | CCACCAAAGCCCAATAACAGAC | TTA | chr6 | 160655203 | 160655224 | 160655220 | 160655225 | + |
| SEQ ID NO 39281 | TCTCTCAAAAGGAGAGTAGTTA | CTG | chr6 | 160655234 | 160655255 | 160655251 | 160655256 | + |
| SEQ ID NO 39282 | TCAAAAGGAGAGTAGTTATCTG | CTC | chr6 | 160655238 | 160655259 | 160655255 | 160655260 | + |
| SEQ ID NO 39283 | AAAAGGAGAGTAGTTATCTGCA | CTC | chr6 | 160655240 | 160655261 | 160655257 | 160655262 | + |
| SEQ ID NO 39284 | TCTGCAGAAGTGGCAGGGCCTT | TTA | chr6 | 160655256 | 160655277 | 160655273 | 160655278 | + |
| SEQ ID NO 39285 | CAGAAGTGGCAGGGCCTTGCTC | CTG | chr6 | 160655260 | 160655281 | 160655277 | 160655282 | + |
| SEQ ID NO 39286 | GCTCCAAAATCCTAGAGGTCTC | CTT | chr6 | 160655278 | 160655299 | 160655295 | 160655300 | + |
| SEQ ID NO 39287 | CTCCAAAATCCTAGAGGTCTCC | TTG | chr6 | 160655279 | 160655300 | 160655296 | 160655301 | + |
| SEQ ID NO 39288 | CAAAATCCTAGAGGTCTCCACT | CTC | chr6 | 160655282 | 160655303 | 160655299 | 160655304 | + |
| SEQ ID NO 39289 | GAGGTCTCCACTGTGATTCACC | CTA | chr6 | 160655292 | 160655313 | 160655309 | 160655314 | + |
| SEQ ID NO 39290 | CACTGTGATTCACCTATGGGGG | CTC | chr6 | 160655300 | 160655321 | 160655317 | 160655322 | + |
| SEQ ID NO 39291 | TGATTCACCTATGGGGCCTGC | CTG | chr6 | 160655305 | 160655326 | 160655322 | 160655327 | + |
| SEQ ID NO 39292 | ACCTATGGGGCCTGCCAAAGG | TTC | chr6 | 160655311 | 160655332 | 160655328 | 160655333 | + |
| SEQ ID NO 39293 | TGGGGCCTGCCAAAGGCTCCA | CTA | chr6 | 160655316 | 160655337 | 160655333 | 160655338 | + |
| SEQ ID NO 39294 | CCAAAGGCTCCAAACAGCATCC | CTG | chr6 | 160655326 | 160655347 | 160655343 | 160655348 | + |
| SEQ ID NO 39295 | CAAACAGCATCCCTATCTGCCA | CTC | chr6 | 160655336 | 160655357 | 160655353 | 160655358 | + |
| SEQ ID NO 39296 | TCTGCCACTGACACCTCAAGCA | CTA | chr6 | 160655351 | 160655372 | 160655368 | 160655373 | + |

Figure 60 (Cont'd)

| | | | | | | | | |
|---|---|---|---|---|---|---|---|---|
| SEQ ID NO 39297 | CCACTGACACCTCAAGCACCAT | CTG | chr6 | 160655355 | 160655376 | 160655372 | 160655377 | + |
| SEQ ID NO 39298 | ACACCTCAAGCACCATTGGATC | CTG | chr6 | 160655361 | 160655382 | 160655378 | 160655383 | + |
| SEQ ID NO 39299 | AAGCACCATTGGATCTGCGGGG | CTC | chr6 | 160655368 | 160655389 | 160655385 | 160655390 | + |
| SEQ ID NO 39300 | GATCTGCGGGGTCATGTGGCCC | TTG | chr6 | 160655379 | 160655400 | 160655396 | 160655401 | + |
| SEQ ID NO 39301 | CGGGGTCATGTGGCCCAAATGG | CTG | chr6 | 160655385 | 160655406 | 160655402 | 160655407 | + |
| SEQ ID NO 39302 | TCACAGCAGCCTGGACCTGTTT | CTT | chr6 | 160655418 | 160655439 | 160655435 | 160655440 | + |
| SEQ ID NO 39303 | CACAGCAGCCTGGACCTGTTTC | TTT | chr6 | 160655419 | 160655440 | 160655436 | 160655441 | + |
| SEQ ID NO 39304 | ACAGCAGCCTGGACCTGTTTCA | TTC | chr6 | 160655420 | 160655441 | 160655437 | 160655442 | + |
| SEQ ID NO 39305 | GACCTGTTTCAGAGCCTTCTTT | CTG | chr6 | 160655431 | 160655452 | 160655448 | 160655453 | + |
| SEQ ID NO 39306 | TTTCAGAGCCTTCTTTTGTTCT | CTG | chr6 | 160655437 | 160655458 | 160655454 | 160655459 | + |
| SEQ ID NO 39307 | CAGAGCCTTCTTTTGTTCTAGA | TTT | chr6 | 160655440 | 160655461 | 160655457 | 160655462 | + |
| SEQ ID NO 39308 | AGAGCCTTCTTTTGTTCTAGAC | TTC | chr6 | 160655441 | 160655462 | 160655458 | 160655463 | + |
| SEQ ID NO 39309 | CTTTTGTTCTAGACTGCACTTA | CTT | chr6 | 160655449 | 160655470 | 160655466 | 160655471 | + |
| SEQ ID NO 39310 | TTTTGTTCTAGACTGCACTTAA | TTC | chr6 | 160655450 | 160655471 | 160655467 | 160655472 | + |
| SEQ ID NO 39311 | TTGTTCTAGACTGCACTTAAAT | CTT | chr6 | 160655452 | 160655473 | 160655469 | 160655474 | + |
| SEQ ID NO 39312 | TGTTCTAGACTGCACTTAAATC | TTT | chr6 | 160655453 | 160655474 | 160655470 | 160655475 | + |
| SEQ ID NO 39313 | GTTCTAGACTGCACTTAAATCT | TTT | chr6 | 160655454 | 160655475 | 160655471 | 160655476 | + |
| SEQ ID NO 39314 | TTCTAGACTGCACTTAAATCTG | TTG | chr6 | 160655455 | 160655476 | 160655472 | 160655477 | + |
| SEQ ID NO 39315 | TAGACTGCACTTAAATCTGGCA | TTC | chr6 | 160655458 | 160655479 | 160655475 | 160655480 | + |
| SEQ ID NO 39316 | GACTGCACTTAAATCTGGCAGC | CTA | chr6 | 160655460 | 160655481 | 160655477 | 160655482 | + |
| SEQ ID NO 39317 | CACTTAAATCTGGCAGCCTTTC | CTG | chr6 | 160655465 | 160655486 | 160655482 | 160655487 | + |
| SEQ ID NO 39318 | AAATCTGGCAGCCTTTCAGGTC | CTT | chr6 | 160655470 | 160655491 | 160655487 | 160655492 | + |
| SEQ ID NO 39319 | AATCTGGCAGCCTTTCAGGTCA | TTA | chr6 | 160655471 | 160655492 | 160655488 | 160655493 | + |
| SEQ ID NO 39320 | GCAGCCTTTCAGGTCACTCGAT | CTG | chr6 | 160655477 | 160655498 | 160655494 | 160655499 | + |
| SEQ ID NO 39321 | TCAGGTCACTCGATAAATGGGC | CTT | chr6 | 160655485 | 160655506 | 160655502 | 160655507 | + |
| SEQ ID NO 39322 | CAGGTCACTCGATAAATGGGCC | TTT | chr6 | 160655486 | 160655507 | 160655503 | 160655508 | + |
| SEQ ID NO 39323 | AGGTCACTCGATAAATGGGCCA | TTC | chr6 | 160655487 | 160655508 | 160655504 | 160655509 | + |
| SEQ ID NO 39324 | GATAAATGGGCCAGAGTAACAC | CTC | chr6 | 160655496 | 160655517 | 160655513 | 160655518 | + |
| SEQ ID NO 39325 | CCTCCAAAATCCAAATAGGCCC | TTG | chr6 | 160655539 | 160655560 | 160655556 | 160655561 | + |
| SEQ ID NO 39326 | CAAAATCCAAATAGGCCCACCA | CTC | chr6 | 160655543 | 160655564 | 160655560 | 160655565 | + |
| SEQ ID NO 39327 | TGCCTCTTTCTTGGTTGTAAGA | TTG | chr6 | 160655572 | 160655593 | 160655589 | 160655594 | + |
| SEQ ID NO 39328 | TTTCTTGGTTGTAAGAGGGGCC | CTC | chr6 | 160655578 | 160655599 | 160655595 | 160655600 | + |
| SEQ ID NO 39329 | TCTTGGTTGTAAGAGGGGCCAA | CTT | chr6 | 160655580 | 160655601 | 160655597 | 160655602 | + |
| SEQ ID NO 39330 | CTTGGTTGTAAGAGGGGCCAAA | TTT | chr6 | 160655581 | 160655602 | 160655598 | 160655603 | + |
| SEQ ID NO 39331 | TTGGTTGTAAGAGGGGCCAAAC | TTC | chr6 | 160655582 | 160655603 | 160655599 | 160655604 | + |
| SEQ ID NO 39332 | GGTTGTAAGAGGGGCCAAACGC | CTT | chr6 | 160655584 | 160655605 | 160655601 | 160655606 | + |
| SEQ ID NO 39333 | GTTGTAAGAGGGGCCAAACGCA | TTG | chr6 | 160655585 | 160655606 | 160655602 | 160655607 | + |
| SEQ ID NO 39334 | TAAGAGGGGCCAAACGCAGCAA | TTG | chr6 | 160655589 | 160655610 | 160655606 | 160655611 | + |
| SEQ ID NO 39335 | TGCTTCACCTTAGAAGGAATAT | TTA | chr6 | 160655615 | 160655636 | 160655632 | 160655637 | + |
| SEQ ID NO 39336 | CACCTTAGAAGGAATATCTCCA | CTT | chr6 | 160655620 | 160655641 | 160655637 | 160655642 | + |
| SEQ ID NO 39337 | ACCTTAGAAGGAATATCTCCAT | TTC | chr6 | 160655621 | 160655642 | 160655638 | 160655643 | + |
| SEQ ID NO 39338 | AGAAGGAATATCTCCATAGGTC | CTT | chr6 | 160655626 | 160655647 | 160655643 | 160655648 | + |
| SEQ ID NO 39339 | GAAGGAATATCTCCATAGGTCT | TTA | chr6 | 160655627 | 160655648 | 160655644 | 160655649 | + |
| SEQ ID NO 39340 | CATAGGTCTCATGCCACTGGAA | CTC | chr6 | 160655640 | 160655661 | 160655657 | 160655662 | + |
| SEQ ID NO 39341 | ATGCCACTGGAACCCTAGAAAT | CTC | chr6 | 160655650 | 160655671 | 160655667 | 160655672 | + |
| SEQ ID NO 39342 | GAACCCTAGAAATTTTACCGAG | CTG | chr6 | 160655659 | 160655680 | 160655676 | 160655681 | + |
| SEQ ID NO 39343 | GAAATTTTACCGAGGTAGAAAG | CTA | chr6 | 160655667 | 160655688 | 160655684 | 160655689 | + |
| SEQ ID NO 39344 | TACCGAGGTAGAAAGTCCCTAA | TTT | chr6 | 160655674 | 160655695 | 160655691 | 160655696 | + |
| SEQ ID NO 39345 | ACCGAGGTAGAAAGTCCCTAAA | TTT | chr6 | 160655675 | 160655696 | 160655692 | 160655697 | + |
| SEQ ID NO 39346 | CCGAGGTAGAAAGTCCCTAAAT | TTA | chr6 | 160655676 | 160655697 | 160655693 | 160655698 | + |
| SEQ ID NO 39347 | AATTTAGCTGGATTTATTTCC | CTA | chr6 | 160655695 | 160655716 | 160655712 | 160655717 | + |
| SEQ ID NO 39348 | TAGCTGGATTTATTTCCCATCC | TTT | chr6 | 160655700 | 160655721 | 160655717 | 160655722 | + |
| SEQ ID NO 39349 | AGCTGGATTTATTTCCCATCCT | TTT | chr6 | 160655701 | 160655722 | 160655718 | 160655723 | + |
| SEQ ID NO 39350 | GCTGGATTTATTTCCCATCCTC | TTA | chr6 | 160655702 | 160655723 | 160655719 | 160655724 | + |
| SEQ ID NO 39351 | GATTTATTTCCCATCCTCTGGC | CTG | chr6 | 160655706 | 160655727 | 160655723 | 160655728 | + |
| SEQ ID NO 39352 | ATTTCCCATCCTCTGGCATACA | TTT | chr6 | 160655711 | 160655732 | 160655728 | 160655733 | + |
| SEQ ID NO 39353 | TTTCCCATCCTCTGGCATACAA | TTA | chr6 | 160655712 | 160655733 | 160655729 | 160655734 | + |
| SEQ ID NO 39354 | CCCATCCTCTGGCATACAAATG | TTT | chr6 | 160655715 | 160655736 | 160655732 | 160655737 | + |

Figure 60 (Cont'd)

| SEQ ID NO 39355 | CCATCCTCTGGCATACAAATGT | TTC | chr6 | 160655716 | 160655737 | 160655733 | 160655738 | + |
|---|---|---|---|---|---|---|---|---|
| SEQ ID NO 39356 | TGGCATACAAATGTCTCACCAA | CTC | chr6 | 160655724 | 160655745 | 160655741 | 160655746 | + |
| SEQ ID NO 39357 | GCATACAAATGTCTCACCAATA | CTG | chr6 | 160655726 | 160655747 | 160655743 | 160655748 | + |
| SEQ ID NO 39358 | ACCAATAAGTTCAGTGTGTTTG | CTC | chr6 | 160655741 | 160655762 | 160655758 | 160655763 | + |
| SEQ ID NO 39359 | AGTGTGTTTGCTACTTCTTGCT | TTC | chr6 | 160655753 | 160655774 | 160655770 | 160655775 | + |
| SEQ ID NO 39360 | GCTACTTCTTGCTCACTGTATC | TTT | chr6 | 160655762 | 160655783 | 160655779 | 160655784 | + |
| SEQ ID NO 39361 | CTACTTCTTGCTCACTGTATCC | TTG | chr6 | 160655763 | 160655784 | 160655780 | 160655785 | + |
| SEQ ID NO 39362 | CTTCTTGCTCACTGTATCCAAT | CTA | chr6 | 160655766 | 160655787 | 160655783 | 160655788 | + |
| SEQ ID NO 39363 | CTTGCTCACTGTATCCAATCAT | CTT | chr6 | 160655769 | 160655790 | 160655786 | 160655791 | + |
| SEQ ID NO 39364 | TTGCTCACTGTATCCAATCATC | TTC | chr6 | 160655770 | 160655791 | 160655787 | 160655792 | + |
| SEQ ID NO 39365 | GCTCACTGTATCCAATCATCAT | CTT | chr6 | 160655772 | 160655793 | 160655789 | 160655794 | + |
| SEQ ID NO 39366 | CTCACTGTATCCAATCATCATA | TTG | chr6 | 160655773 | 160655794 | 160655790 | 160655795 | + |
| SEQ ID NO 39367 | ACTGTATCCAATCATCATAATG | CTC | chr6 | 160655776 | 160655797 | 160655793 | 160655798 | + |
| SEQ ID NO 39368 | TATCCAATCATCATAATGTCAT | CTG | chr6 | 160655780 | 160655801 | 160655797 | 160655802 | + |
| SEQ ID NO 39369 | TATCTCGTGGAAGTGAAAAGCG | TTA | chr6 | 160655823 | 160655844 | 160655840 | 160655845 | + |
| SEQ ID NO 39370 | GTGGAAGTGAAAAGCGAGCAAG | CTC | chr6 | 160655829 | 160655850 | 160655846 | 160655851 | + |
| SEQ ID NO 39371 | TCCAAATAAGATTATGACACAA | CTC | chr6 | 160655856 | 160655877 | 160655873 | 160655878 | + |
| SEQ ID NO 39372 | CAAATAAGATTATGACACAAAG | CTC | chr6 | 160655858 | 160655879 | 160655875 | 160655880 | + |
| SEQ ID NO 39373 | TGACACAAAGCTGGAGAGTTGA | TTA | chr6 | 160655870 | 160655891 | 160655887 | 160655892 | + |
| SEQ ID NO 39374 | GAGAGTTGATACACCCCTGAGG | CTG | chr6 | 160655883 | 160655904 | 160655900 | 160655905 | + |
| SEQ ID NO 39375 | ATACACCCCTGAGGTAGGGTGG | TTG | chr6 | 160655891 | 160655912 | 160655908 | 160655913 | + |
| SEQ ID NO 39376 | AGGTAGGGTGGTAAAGGTATAA | CTG | chr6 | 160655902 | 160655923 | 160655919 | 160655924 | + |
| SEQ ID NO 39377 | GCCTTGTCAGCTGAAGGCAAAT | CTG | chr6 | 160655929 | 160655950 | 160655946 | 160655951 | + |
| SEQ ID NO 39378 | GTCAGCTGAAGGCAAATTGCTT | CTT | chr6 | 160655934 | 160655955 | 160655951 | 160655956 | + |
| SEQ ID NO 39379 | TCAGCTGAAGGCAAATTGCTTC | TTG | chr6 | 160655935 | 160655956 | 160655952 | 160655957 | + |
| SEQ ID NO 39380 | AAGGCAAATTGCTTCTGGTGGG | CTG | chr6 | 160655942 | 160655963 | 160655959 | 160655964 | + |
| SEQ ID NO 39381 | CTTCTGGTGGGTCTTATGGACA | TTG | chr6 | 160655953 | 160655974 | 160655970 | 160655975 | + |
| SEQ ID NO 39382 | CTGGTGGGTCTTATGGACAGGA | CTT | chr6 | 160655956 | 160655977 | 160655973 | 160655978 | + |
| SEQ ID NO 39383 | TGGTGGGTCTTATGGACAGGAA | TTC | chr6 | 160655957 | 160655978 | 160655974 | 160655979 | + |
| SEQ ID NO 39384 | GTGGGTCTTATGGACAGGAATG | CTG | chr6 | 160655959 | 160655980 | 160655976 | 160655981 | + |
| SEQ ID NO 39385 | ATGGACAGGAATGGAGAAAAAG | CTT | chr6 | 160655968 | 160655989 | 160655985 | 160655990 | + |
| SEQ ID NO 39386 | TGGACAGGAATGGAGAAAAAGC | TTA | chr6 | 160655969 | 160655990 | 160655986 | 160655991 | + |
| SEQ ID NO 39387 | GCCAAGCCAATGGCTGCATACC | CTT | chr6 | 160655996 | 160656017 | 160656013 | 160656018 | + |
| SEQ ID NO 39388 | CCAAGCCAATGGCTGCATACCA | TTG | chr6 | 160655997 | 160656018 | 160656014 | 160656019 | + |
| SEQ ID NO 39389 | CATACCAGGCACCAGGAGATGT | CTG | chr6 | 160656012 | 160656033 | 160656029 | 160656034 | + |
| SEQ ID NO 39390 | ATTTGCTCAAGCAACAAAACCA | TTA | chr6 | 160656038 | 160656059 | 160656055 | 160656060 | + |
| SEQ ID NO 39391 | GCTCAAGCAACAAAACCACAAC | TTT | chr6 | 160656042 | 160656063 | 160656059 | 160656064 | + |
| SEQ ID NO 39392 | CTCAAGCAACAAAACCACAACT | TTG | chr6 | 160656043 | 160656064 | 160656060 | 160656065 | + |
| SEQ ID NO 39393 | AAGCAACAAAACCACAACTGGT | CTC | chr6 | 160656046 | 160656067 | 160656063 | 160656068 | + |
| SEQ ID NO 39394 | GTAGAGCAGCTGCAATTGGAGT | CTG | chr6 | 160656066 | 160656087 | 160656083 | 160656088 | + |
| SEQ ID NO 39395 | CAATTGGAGTCACCACTTGGTT | CTG | chr6 | 160656078 | 160656099 | 160656095 | 160656100 | + |
| SEQ ID NO 39396 | GAGTCACCACTTGGTTAAGCTT | TTG | chr6 | 160656084 | 160656105 | 160656101 | 160656106 | + |
| SEQ ID NO 39397 | GGTTAAGCTTAAAATAATCCAC | CTT | chr6 | 160656096 | 160656117 | 160656113 | 160656118 | + |
| SEQ ID NO 39398 | GTTAAGCTTAAAATAATCCACC | TTG | chr6 | 160656097 | 160656118 | 160656114 | 160656119 | + |
| SEQ ID NO 39399 | AGCTTAAAATAATCCACCATCA | TTA | chr6 | 160656101 | 160656122 | 160656118 | 160656123 | + |
| SEQ ID NO 39400 | AAAATAATCCACCATCATTTTC | CTT | chr6 | 160656106 | 160656127 | 160656123 | 160656128 | + |
| SEQ ID NO 39401 | AAATAATCCACCATCATTTTCC | TTA | chr6 | 160656107 | 160656128 | 160656124 | 160656129 | + |
| SEQ ID NO 39402 | TCCAAGATCCATCTGTCCTCTG | TTT | chr6 | 160656126 | 160656147 | 160656143 | 160656148 | + |
| SEQ ID NO 39403 | CCAAGATCCATCTGTCCTCTGC | TTT | chr6 | 160656127 | 160656148 | 160656144 | 160656149 | + |
| SEQ ID NO 39404 | CAAGATCCATCTGTCCTCTGCA | TTC | chr6 | 160656128 | 160656149 | 160656145 | 160656150 | + |
| SEQ ID NO 39405 | TCCTCTGCACAGGTCAAATGGG | CTG | chr6 | 160656141 | 160656162 | 160656158 | 160656163 | + |
| SEQ ID NO 39406 | TGCACAGGTCAAATGGGAGAGT | CTC | chr6 | 160656146 | 160656167 | 160656163 | 160656168 | + |
| SEQ ID NO 39407 | CACAGGTCAAATGGGAGAGTTG | CTG | chr6 | 160656148 | 160656169 | 160656165 | 160656170 | + |
| SEQ ID NO 39408 | AACAGGGATGTGGTGGGAATCA | TTG | chr6 | 160656170 | 160656191 | 160656187 | 160656192 | + |
| SEQ ID NO 39409 | CGTCTTTCAAGTCCTTGATGGT | CTG | chr6 | 160656201 | 160656222 | 160656218 | 160656223 | + |
| SEQ ID NO 39410 | TCAAGTCCTTGATGGTGACACT | CTT | chr6 | 160656207 | 160656228 | 160656224 | 160656229 | + |
| SEQ ID NO 39411 | CAAGTCCTTGATGGTGACACTA | TTT | chr6 | 160656208 | 160656229 | 160656225 | 160656230 | + |
| SEQ ID NO 39412 | AAGTCCTTGATGGTGACACTAA | TTC | chr6 | 160656209 | 160656230 | 160656226 | 160656231 | + |

Figure 60 (Cont'd)

| | | | | | | | | |
|---|---|---|---|---|---|---|---|---|
| SEQ ID NO 39413 | GATGGTGACACTAATCACTTCA | CTT | chr6 | 160656217 | 160656238 | 160656234 | 160656239 | + |
| SEQ ID NO 39414 | ATGGTGACACTAATCACTTCAG | TTG | chr6 | 160656218 | 160656239 | 160656235 | 160656240 | + |
| SEQ ID NO 39415 | ATCACTTCAGTCCCTCCAGGGA | CTA | chr6 | 160656230 | 160656251 | 160656247 | 160656252 | + |
| SEQ ID NO 39416 | CAGTCCCTCCAGGGATGGGATA | CTT | chr6 | 160656237 | 160656258 | 160656254 | 160656259 | + |
| SEQ ID NO 39417 | AGTCCCTCCAGGGATGGGATAT | TTC | chr6 | 160656238 | 160656259 | 160656255 | 160656260 | + |
| SEQ ID NO 39418 | CAGGGATGGGATATTGTTTTTG | CTC | chr6 | 160656246 | 160656267 | 160656263 | 160656268 | + |
| SEQ ID NO 39419 | TTTTTGATTTTTTATTTTTCT | TTG | chr6 | 160656262 | 160656283 | 160656279 | 160656284 | + |
| SEQ ID NO 39420 | TTGATTTTTTATTTTTCTAGG | TTT | chr6 | 160656265 | 160656286 | 160656282 | 160656287 | + |
| SEQ ID NO 39421 | TGATTTTTTATTTTTCTAGGT | TTT | chr6 | 160656266 | 160656287 | 160656283 | 160656288 | + |
| SEQ ID NO 39422 | GATTTTTTATTTTTCTAGGTA | TTT | chr6 | 160656267 | 160656288 | 160656284 | 160656289 | + |
| SEQ ID NO 39423 | ATTTTTTATTTTTCTAGGTAG | TTG | chr6 | 160656268 | 160656289 | 160656285 | 160656290 | + |
| SEQ ID NO 39424 | TTTTATTTTTCTAGGTAGAGAC | TTT | chr6 | 160656272 | 160656293 | 160656289 | 160656294 | + |
| SEQ ID NO 39425 | TTTATTTTTCTAGGTAGAGACA | TTT | chr6 | 160656273 | 160656294 | 160656290 | 160656295 | + |
| SEQ ID NO 39426 | TTATTTTTCTAGGTAGAGACAG | TTT | chr6 | 160656274 | 160656295 | 160656291 | 160656296 | + |
| SEQ ID NO 39427 | TATTTTTCTAGGTAGAGACAGC | TTT | chr6 | 160656275 | 160656296 | 160656292 | 160656297 | + |
| SEQ ID NO 39428 | ATTTTTCTAGGTAGAGACAGCT | TTT | chr6 | 160656276 | 160656297 | 160656293 | 160656298 | + |
| SEQ ID NO 39429 | TTTTTCTAGGTAGAGACAGCTC | TTA | chr6 | 160656277 | 160656298 | 160656294 | 160656299 | + |
| SEQ ID NO 39430 | TTCTAGGTAGAGACAGCTCTAA | TTT | chr6 | 160656280 | 160656301 | 160656297 | 160656302 | + |
| SEQ ID NO 39431 | TCTAGGTAGAGACAGCTCTAAT | TTT | chr6 | 160656281 | 160656302 | 160656298 | 160656303 | + |
| SEQ ID NO 39432 | CTAGGTAGAGACAGCTCTAATG | TTT | chr6 | 160656282 | 160656303 | 160656299 | 160656304 | + |
| SEQ ID NO 39433 | TAGGTAGAGACAGCTCTAATGG | TTC | chr6 | 160656283 | 160656304 | 160656300 | 160656305 | + |
| SEQ ID NO 39434 | GGTAGAGACAGCTCTAATGGCT | CTA | chr6 | 160656285 | 160656306 | 160656302 | 160656307 | + |
| SEQ ID NO 39435 | TAATGGCTTCTGTTTGGCCTTT | CTC | chr6 | 160656299 | 160656320 | 160656316 | 160656321 | + |
| SEQ ID NO 39436 | ATGGCTTCTGTTTGGCCTTTCC | CTA | chr6 | 160656301 | 160656322 | 160656318 | 160656323 | + |
| SEQ ID NO 39437 | CTGTTTGGCCTTTCCCACCATA | CTT | chr6 | 160656308 | 160656329 | 160656325 | 160656330 | + |
| SEQ ID NO 39438 | TGTTTGGCCTTTCCCACCATAA | TTC | chr6 | 160656309 | 160656330 | 160656326 | 160656331 | + |
| SEQ ID NO 39439 | TTTGGCCTTTCCCACCATAATA | CTG | chr6 | 160656311 | 160656332 | 160656328 | 160656333 | + |
| SEQ ID NO 39440 | GGCCTTTCCCACCATAATAGCC | TTT | chr6 | 160656314 | 160656335 | 160656331 | 160656336 | + |
| SEQ ID NO 39441 | GCCTTTCCCACCATAATAGCCC | TTG | chr6 | 160656315 | 160656336 | 160656332 | 160656337 | + |
| SEQ ID NO 39442 | TCCCACCATAATAGCCCTCATC | CTT | chr6 | 160656320 | 160656341 | 160656337 | 160656342 | + |
| SEQ ID NO 39443 | CCCACCATAATAGCCCTCATCC | TTT | chr6 | 160656321 | 160656342 | 160656338 | 160656343 | + |
| SEQ ID NO 39444 | CCACCATAATAGCCCTCATCCT | TTC | chr6 | 160656322 | 160656343 | 160656339 | 160656344 | + |
| SEQ ID NO 39445 | ATCCTACCAGTCAGGGAGCCAA | CTC | chr6 | 160656339 | 160656360 | 160656356 | 160656361 | + |
| SEQ ID NO 39446 | CCAGTCAGGGAGCCAATGTGGC | CTA | chr6 | 160656345 | 160656366 | 160656362 | 160656367 | + |
| SEQ ID NO 39447 | CTGCCAGCTAATAAGTATGTCT | TTT | chr6 | 160656371 | 160656392 | 160656388 | 160656393 | + |
| SEQ ID NO 39448 | TGCCAGCTAATAAGTATGTCTA | TTC | chr6 | 160656372 | 160656393 | 160656389 | 160656394 | + |
| SEQ ID NO 39449 | CCAGCTAATAAGTATGTCTATA | CTG | chr6 | 160656374 | 160656395 | 160656391 | 160656396 | + |
| SEQ ID NO 39450 | ATAAGTATGTCTATACAAATTA | CTA | chr6 | 160656381 | 160656402 | 160656398 | 160656403 | + |
| SEQ ID NO 39451 | TACAAATTATGCATTTTGGCAC | CTA | chr6 | 160656394 | 160656415 | 160656411 | 160656416 | + |
| SEQ ID NO 39452 | TGCATTTTGGCACTGGGAAAAT | TTA | chr6 | 160656403 | 160656424 | 160656420 | 160656425 | + |
| SEQ ID NO 39453 | TGGCACTGGGAAAATGACCAGA | TTT | chr6 | 160656410 | 160656431 | 160656427 | 160656432 | + |
| SEQ ID NO 39454 | GGCACTGGGAAAATGACCAGAG | TTT | chr6 | 160656411 | 160656432 | 160656428 | 160656433 | + |
| SEQ ID NO 39455 | GCACTGGGAAAATGACCAGAGG | TTG | chr6 | 160656412 | 160656433 | 160656429 | 160656434 | + |
| SEQ ID NO 39456 | GGAAAATGACCAGAGGATAAGT | CTG | chr6 | 160656418 | 160656439 | 160656435 | 160656440 | + |
| SEQ ID NO 39457 | GAACCACTGTAAGTCAGAAATG | CTG | chr6 | 160656454 | 160656475 | 160656471 | 160656476 | + |
| SEQ ID NO 39458 | TAAGTCAGAAATGAGCTAAAAC | CTG | chr6 | 160656463 | 160656484 | 160656480 | 160656485 | + |
| SEQ ID NO 39459 | AAACTCCATTAATTACCTAACC | CTA | chr6 | 160656481 | 160656502 | 160656498 | 160656503 | + |
| SEQ ID NO 39460 | CATTAATTACCTAACCTCCATA | CTC | chr6 | 160656487 | 160656508 | 160656504 | 160656509 | + |
| SEQ ID NO 39461 | ATTACCTAACCTCCATAAGCCC | TTA | chr6 | 160656492 | 160656513 | 160656509 | 160656514 | + |
| SEQ ID NO 39462 | CCTAACCTCCATAAGCCCTAC | TTA | chr6 | 160656496 | 160656517 | 160656513 | 160656518 | + |
| SEQ ID NO 39463 | ACCTCCATAAGCCCCTACTTTA | CTA | chr6 | 160656500 | 160656521 | 160656517 | 160656522 | + |
| SEQ ID NO 39464 | CATAAGCCCCTACTTTAACTGG | CTC | chr6 | 160656505 | 160656526 | 160656522 | 160656527 | + |
| SEQ ID NO 39465 | CTTTAACTGGGGAACCACAATA | CTA | chr6 | 160656517 | 160656538 | 160656534 | 160656539 | + |
| SEQ ID NO 39466 | TAACTGGGGAACCACAATAACG | CTT | chr6 | 160656520 | 160656541 | 160656537 | 160656542 | + |
| SEQ ID NO 39467 | AACTGGGGAACCACAATAACGT | TTT | chr6 | 160656521 | 160656542 | 160656538 | 160656543 | + |
| SEQ ID NO 39468 | ACTGGGGAACCACAATAACGTT | TTA | chr6 | 160656522 | 160656543 | 160656539 | 160656544 | + |
| SEQ ID NO 39469 | GGGAACCACAATAACGTTTTGG | CTG | chr6 | 160656526 | 160656547 | 160656543 | 160656548 | + |
| SEQ ID NO 39470 | TGGGTACCCTGGAATCAACGTC | TTT | chr6 | 160656545 | 160656566 | 160656562 | 160656567 | + |

Figure 60 (Cont'd)

| SEQ ID NO 39471 | GGGTACCCTGGAATCAACGTCA | TTT | chr6 | 160656546 | 160656567 | 160656563 | 160656568 | + |
| SEQ ID NO 39472 | GGTACCCTGGAATCAACGTCAG | TTG | chr6 | 160656547 | 160656568 | 160656564 | 160656569 | + |
| SEQ ID NO 39473 | GAATCAACGTCAGCTCAGAGCC | CTG | chr6 | 160656556 | 160656577 | 160656573 | 160656578 | + |
| SEQ ID NO 39474 | AGAGCCAGTGTCCAGTACTTTC | CTC | chr6 | 160656572 | 160656593 | 160656589 | 160656594 | + |
| SEQ ID NO 39475 | TCTGAAATGTCTCATTACTTCC | CTT | chr6 | 160656592 | 160656613 | 160656609 | 160656614 | + |
| SEQ ID NO 39476 | CTGAAATGTCTCATTACTTCCC | TTT | chr6 | 160656593 | 160656614 | 160656610 | 160656615 | + |
| SEQ ID NO 39477 | TGAAATGTCTCATTACTTCCCT | TTC | chr6 | 160656594 | 160656615 | 160656611 | 160656616 | + |
| SEQ ID NO 39478 | AAATGTCTCATTACTTCCCTTT | CTG | chr6 | 160656596 | 160656617 | 160656613 | 160656618 | + |
| SEQ ID NO 39479 | ATTACTTCCCTTTCTCCAGTAC | CTC | chr6 | 160656605 | 160656626 | 160656622 | 160656627 | + |
| SEQ ID NO 39480 | CTTCCCTTTCTCCAGTACACAC | TTA | chr6 | 160656609 | 160656630 | 160656626 | 160656631 | + |
| SEQ ID NO 39481 | CCCTTTCTCCAGTACACACAGT | CTT | chr6 | 160656612 | 160656633 | 160656629 | 160656634 | + |
| SEQ ID NO 39482 | CCTTTCTCCAGTACACACAGTT | TTC | chr6 | 160656613 | 160656634 | 160656630 | 160656635 | + |
| SEQ ID NO 39483 | TCTCCAGTACACACAGTTACCC | CTT | chr6 | 160656617 | 160656638 | 160656634 | 160656639 | + |
| SEQ ID NO 39484 | CTCCAGTACACACAGTTACCCT | TTT | chr6 | 160656618 | 160656639 | 160656635 | 160656640 | + |
| SEQ ID NO 39485 | TCCAGTACACACAGTTACCCTG | TTC | chr6 | 160656619 | 160656640 | 160656636 | 160656641 | + |
| SEQ ID NO 39486 | CAGTACACACAGTTACCCTGGT | CTC | chr6 | 160656621 | 160656642 | 160656638 | 160656643 | + |
| SEQ ID NO 39487 | CCCTGGTAAAAGGCCAGAGGTC | TTA | chr6 | 160656636 | 160656657 | 160656653 | 160656658 | + |
| SEQ ID NO 39488 | GTAAAAGGCCAGAGGTCTCCTT | CTG | chr6 | 160656641 | 160656662 | 160656658 | 160656663 | + |
| SEQ ID NO 39489 | CTTAGGGAAGGATGGGAGAAAG | CTC | chr6 | 160656660 | 160656681 | 160656677 | 160656682 | + |
| SEQ ID NO 39490 | AGGGAAGGATGGGAGAAAGAGT | CTT | chr6 | 160656663 | 160656684 | 160656680 | 160656685 | + |
| SEQ ID NO 39491 | GGGAAGGATGGGAGAAAGAGTA | TTA | chr6 | 160656664 | 160656685 | 160656681 | 160656686 | + |
| SEQ ID NO 39492 | TCAGTAGCCAGTGGTGTCCTT | TTG | chr6 | 160656699 | 160656720 | 160656716 | 160656721 | + |
| SEQ ID NO 39493 | GTGGTGTCCTTCCTCAAGGGGA | CTA | chr6 | 160656710 | 160656731 | 160656727 | 160656732 | + |
| SEQ ID NO 39494 | CCTCAAGGGGATCCAGCCTCCC | CTT | chr6 | 160656721 | 160656742 | 160656738 | 160656743 | + |
| SEQ ID NO 39495 | CTCAAGGGGATCCAGCCTCCCC | TTC | chr6 | 160656722 | 160656743 | 160656739 | 160656744 | + |
| SEQ ID NO 39496 | AAGGGGATCCAGCCTCCCCTTC | CTC | chr6 | 160656725 | 160656746 | 160656742 | 160656747 | + |
| SEQ ID NO 39497 | CCCTTCATTCAGTGGGTTCTGG | CTC | chr6 | 160656741 | 160656762 | 160656758 | 160656763 | + |
| SEQ ID NO 39498 | CATTCAGTGGGTTCTGGAACTG | CTT | chr6 | 160656746 | 160656767 | 160656763 | 160656768 | + |
| SEQ ID NO 39499 | ATTCAGTGGGTTCTGGAACTGT | TTC | chr6 | 160656747 | 160656768 | 160656764 | 160656769 | + |
| SEQ ID NO 39500 | AGTGGGTTCTGGAACTGTAACA | TTC | chr6 | 160656751 | 160656772 | 160656768 | 160656773 | + |
| SEQ ID NO 39501 | TGGAACTGTAACAGGTTCGAGT | TTC | chr6 | 160656760 | 160656781 | 160656777 | 160656782 | + |
| SEQ ID NO 39502 | GAACTGTAACAGGTTCGAGTCT | CTG | chr6 | 160656762 | 160656783 | 160656779 | 160656784 | + |
| SEQ ID NO 39503 | TAACAGGTTCGAGTCTGGAAAT | CTG | chr6 | 160656768 | 160656789 | 160656785 | 160656790 | + |
| SEQ ID NO 39504 | GAGTCTGGAAATTGATTGAGGG | TTC | chr6 | 160656778 | 160656799 | 160656795 | 160656800 | + |
| SEQ ID NO 39505 | GAAATTGATTGAGGGCCCATGA | CTG | chr6 | 160656785 | 160656806 | 160656802 | 160656807 | + |
| SEQ ID NO 39506 | ATTGAGGGCCCATGATTCTCTG | TTG | chr6 | 160656792 | 160656813 | 160656809 | 160656814 | + |
| SEQ ID NO 39507 | AGGGCCCATGATTCTCTGTTTT | TTG | chr6 | 160656796 | 160656817 | 160656813 | 160656818 | + |
| SEQ ID NO 39508 | TCTGTTTTTATAATTCAGATTA | TTC | chr6 | 160656810 | 160656831 | 160656827 | 160656832 | + |
| SEQ ID NO 39509 | TGTTTTTATAATTCAGATTAGT | CTC | chr6 | 160656812 | 160656833 | 160656829 | 160656834 | + |
| SEQ ID NO 39510 | TTTTTATAATTCAGATTAGTCT | CTG | chr6 | 160656814 | 160656835 | 160656831 | 160656836 | + |
| SEQ ID NO 39511 | TTATAATTCAGATTAGTCTTTA | TTT | chr6 | 160656817 | 160656838 | 160656834 | 160656839 | + |
| SEQ ID NO 39512 | TATAATTCAGATTAGTCTTTAG | TTT | chr6 | 160656818 | 160656839 | 160656835 | 160656840 | + |
| SEQ ID NO 39513 | ATAATTCAGATTAGTCTTTAGT | TTT | chr6 | 160656819 | 160656840 | 160656836 | 160656841 | + |
| SEQ ID NO 39514 | TAATTCAGATTAGTCTTTAGTC | TTA | chr6 | 160656820 | 160656841 | 160656837 | 160656842 | + |
| SEQ ID NO 39515 | AGATTAGTCTTTAGTCCATTCT | TTC | chr6 | 160656826 | 160656847 | 160656843 | 160656848 | + |
| SEQ ID NO 39516 | GTCTTTAGTCCATTCTACCTGG | TTA | chr6 | 160656832 | 160656853 | 160656849 | 160656854 | + |
| SEQ ID NO 39517 | TAGTCCATTCTACCTGGCAGTT | CTT | chr6 | 160656837 | 160656858 | 160656854 | 160656859 | + |
| SEQ ID NO 39518 | AGTCCATTCTACCTGGCAGTTT | TTT | chr6 | 160656838 | 160656859 | 160656855 | 160656860 | + |
| SEQ ID NO 39519 | GTCCATTCTACCTGGCAGTTTT | TTA | chr6 | 160656839 | 160656860 | 160656856 | 160656861 | + |
| SEQ ID NO 39520 | TACCTGGCAGTTTTTGTTTAT | TTC | chr6 | 160656847 | 160656868 | 160656864 | 160656869 | + |
| SEQ ID NO 39521 | CCTGGCAGTTTTTGTTTATAT | CTA | chr6 | 160656849 | 160656870 | 160656866 | 160656871 | + |
| SEQ ID NO 39522 | GCAGTTTTTGTTTATATAAAT | CTG | chr6 | 160656853 | 160656874 | 160656870 | 160656875 | + |
| SEQ ID NO 39523 | TTTGTTTATATAAATCAAGTAG | TTT | chr6 | 160656860 | 160656881 | 160656877 | 160656882 | + |
| SEQ ID NO 39524 | TTGTTTATATAAATCAAGTAGG | TTT | chr6 | 160656861 | 160656882 | 160656878 | 160656883 | + |
| SEQ ID NO 39525 | TGTTTATATAAATCAAGTAGGA | TTT | chr6 | 160656862 | 160656883 | 160656879 | 160656884 | + |
| SEQ ID NO 39526 | GTTTATATAAATCAAGTAGGAA | TTT | chr6 | 160656863 | 160656884 | 160656880 | 160656885 | + |
| SEQ ID NO 39527 | TTTATATAAATCAAGTAGGAAT | TTG | chr6 | 160656864 | 160656885 | 160656881 | 160656886 | + |
| SEQ ID NO 39528 | ATATAAATCAAGTAGGAATACA | TTT | chr6 | 160656867 | 160656888 | 160656884 | 160656889 | + |

Figure 60 (Cont'd)

| | | | | | | | | |
|---|---|---|---|---|---|---|---|---|
| SEQ ID NO 39529 | TATAAATCAAGTAGGAATACAG | TTA | chr6 | 160656868 | 160656889 | 160656885 | 160656890 | + |
| SEQ ID NO 39530 | CCCATCAATTTCACTTCTAGGA | TTT | chr6 | 160656897 | 160656918 | 160656914 | 160656919 | + |
| SEQ ID NO 39531 | CCATCAATTTCACTTCTAGGAA | TTC | chr6 | 160656898 | 160656919 | 160656915 | 160656920 | + |
| SEQ ID NO 39532 | CACTTCTAGGAACACCATGATT | TTT | chr6 | 160656908 | 160656929 | 160656925 | 160656930 | + |
| SEQ ID NO 39533 | ACTTCTAGGAACACCATGATTA | TTC | chr6 | 160656909 | 160656930 | 160656926 | 160656931 | + |
| SEQ ID NO 39534 | CTAGGAACACCATGATTAATTA | CTT | chr6 | 160656913 | 160656934 | 160656930 | 160656935 | + |
| SEQ ID NO 39535 | TAGGAACACCATGATTAATTAG | TTC | chr6 | 160656914 | 160656935 | 160656931 | 160656936 | + |
| SEQ ID NO 39536 | GGAACACCATGATTAATTAGCC | CTA | chr6 | 160656916 | 160656937 | 160656933 | 160656938 | + |
| SEQ ID NO 39537 | ATTAGCCAATGCCAGAGCTCTA | TTA | chr6 | 160656931 | 160656952 | 160656948 | 160656953 | + |
| SEQ ID NO 39538 | GCCAATGCCAGAGCTCTACATG | TTA | chr6 | 160656935 | 160656956 | 160656952 | 160656957 | + |
| SEQ ID NO 39539 | TACATGAGTCAGACTATTCTGA | CTC | chr6 | 160656951 | 160656972 | 160656968 | 160656973 | + |
| SEQ ID NO 39540 | CATGAGTCAGACTATTCTGATG | CTA | chr6 | 160656953 | 160656974 | 160656970 | 160656975 | + |
| SEQ ID NO 39541 | TTCTGATGGCTGCTTTGCCTCT | CTA | chr6 | 160656967 | 160656988 | 160656984 | 160656989 | + |
| SEQ ID NO 39542 | TGATGGCTGCTTTGCCTCTGCT | TTC | chr6 | 160656970 | 160656991 | 160656987 | 160656992 | + |
| SEQ ID NO 39543 | ATGGCTGCTTTGCCTCTGCTGT | CTG | chr6 | 160656972 | 160656993 | 160656989 | 160656994 | + |
| SEQ ID NO 39544 | CTTTGCCTCTGCTGTCTATTAT | CTG | chr6 | 160656979 | 160657000 | 160656996 | 160657001 | + |
| SEQ ID NO 39545 | TGCCTCTGCTGTCTATTATGGT | CTT | chr6 | 160656982 | 160657003 | 160656999 | 160657004 | + |
| SEQ ID NO 39546 | GCCTCTGCTGTCTATTATGGTA | TTT | chr6 | 160656983 | 160657004 | 160657000 | 160657005 | + |
| SEQ ID NO 39547 | CCTCTGCTGTCTATTATGGTAG | TTG | chr6 | 160656984 | 160657005 | 160657001 | 160657006 | + |
| SEQ ID NO 39548 | TGCTGTCTATTATGGTAGTTAT | CTC | chr6 | 160656988 | 160657009 | 160657005 | 160657010 | + |
| SEQ ID NO 39549 | CTGTCTATTATGGTAGTTATGC | CTG | chr6 | 160656990 | 160657011 | 160657007 | 160657012 | + |
| SEQ ID NO 39550 | TCTATTATGGTAGTTATGCCCA | CTG | chr6 | 160656993 | 160657014 | 160657010 | 160657015 | + |
| SEQ ID NO 39551 | TTATGGTAGTTATGCCCACCTT | CTA | chr6 | 160656997 | 160657018 | 160657014 | 160657019 | + |
| SEQ ID NO 39552 | TGGTAGTTATGCCCACCTTGCC | TTA | chr6 | 160657000 | 160657021 | 160657017 | 160657022 | + |
| SEQ ID NO 39553 | TGCCCACCTTGCCTTTGATGGT | TTA | chr6 | 160657009 | 160657030 | 160657026 | 160657031 | + |
| SEQ ID NO 39554 | GCCTTTGATGGTTCAGTGCCAA | CTT | chr6 | 160657019 | 160657040 | 160657036 | 160657041 | + |
| SEQ ID NO 39555 | CCTTTGATGGTTCAGTGCCAAC | TTG | chr6 | 160657020 | 160657041 | 160657037 | 160657042 | + |
| SEQ ID NO 39556 | TGATGGTTCAGTGCCAACACTT | CTT | chr6 | 160657024 | 160657045 | 160657041 | 160657046 | + |
| SEQ ID NO 39557 | GATGGTTCAGTGCCAACACTTG | TTT | chr6 | 160657025 | 160657046 | 160657042 | 160657047 | + |
| SEQ ID NO 39558 | ATGGTTCAGTGCCAACACTTGG | TTG | chr6 | 160657026 | 160657047 | 160657043 | 160657048 | + |
| SEQ ID NO 39559 | AGTGCCAACACTTGGCCCCTGC | TTC | chr6 | 160657033 | 160657054 | 160657050 | 160657055 | + |
| SEQ ID NO 39560 | GGCCCTGCCACCTCAGGATCC | CTT | chr6 | 160657046 | 160657067 | 160657063 | 160657068 | + |
| SEQ ID NO 39561 | GCCCCTGCCACCTCAGGATCCA | TTG | chr6 | 160657047 | 160657068 | 160657064 | 160657069 | + |
| SEQ ID NO 39562 | CCACCTCAGGATCCAATTATTC | CTG | chr6 | 160657054 | 160657075 | 160657071 | 160657076 | + |
| SEQ ID NO 39563 | AGGATCCAATTATTCCCATTGT | CTC | chr6 | 160657061 | 160657082 | 160657078 | 160657083 | + |
| SEQ ID NO 39564 | TTCCCATTGTATTTAAATTTTG | TTA | chr6 | 160657073 | 160657094 | 160657090 | 160657095 | + |
| SEQ ID NO 39565 | CCATTGTATTTAAATTTTGTAG | TTC | chr6 | 160657076 | 160657097 | 160657093 | 160657098 | + |
| SEQ ID NO 39566 | TATTTAAATTTTGTAGTTGAGT | TTG | chr6 | 160657082 | 160657103 | 160657099 | 160657104 | + |
| SEQ ID NO 39567 | AAATTTTGTAGTTGAGTGACTG | TTT | chr6 | 160657087 | 160657108 | 160657104 | 160657109 | + |
| SEQ ID NO 39568 | AATTTTGTAGTTGAGTGACTGT | TTA | chr6 | 160657088 | 160657109 | 160657105 | 160657110 | + |
| SEQ ID NO 39569 | TGTAGTTGAGTGACTGTGGTTC | TTT | chr6 | 160657093 | 160657114 | 160657110 | 160657115 | + |
| SEQ ID NO 39570 | GTAGTTGAGTGACTGTGGTTCC | TTT | chr6 | 160657094 | 160657115 | 160657111 | 160657116 | + |
| SEQ ID NO 39571 | TAGTTGAGTGACTGTGGTTCCT | TTG | chr6 | 160657095 | 160657116 | 160657112 | 160657117 | + |
| SEQ ID NO 39572 | AGTGACTGTGGTTCCTACTGTT | TTG | chr6 | 160657101 | 160657122 | 160657118 | 160657123 | + |
| SEQ ID NO 39573 | TGGTTCCTACTGTTAGATCTGA | CTG | chr6 | 160657109 | 160657130 | 160657126 | 160657131 | + |
| SEQ ID NO 39574 | CTACTGTTAGATCTGACATACA | TTC | chr6 | 160657115 | 160657136 | 160657132 | 160657137 | + |
| SEQ ID NO 39575 | CTGTTAGATCTGACATACAGAG | CTA | chr6 | 160657118 | 160657139 | 160657135 | 160657140 | + |
| SEQ ID NO 39576 | TTAGATCTGACATACAGAGAAG | CTG | chr6 | 160657121 | 160657142 | 160657138 | 160657143 | + |
| SEQ ID NO 39577 | GATCTGACATACAGAGAAGAGC | TTA | chr6 | 160657124 | 160657145 | 160657141 | 160657146 | + |
| SEQ ID NO 39578 | ACATACAGAGAAGAGCAATTAC | CTG | chr6 | 160657130 | 160657151 | 160657147 | 160657152 | + |
| SEQ ID NO 39579 | CGGGCTCTTCAAAAATACAGGT | TTA | chr6 | 160657151 | 160657172 | 160657168 | 160657173 | + |
| SEQ ID NO 39580 | TTCAAAAATACAGGTGCTGCTC | CTC | chr6 | 160657158 | 160657179 | 160657175 | 160657180 | + |
| SEQ ID NO 39581 | CAAAAATACAGGTGCTGCTCTC | CTT | chr6 | 160657160 | 160657181 | 160657177 | 160657182 | + |
| SEQ ID NO 39582 | AAAAATACAGGTGCTGCTCTCA | TTC | chr6 | 160657161 | 160657182 | 160657178 | 160657183 | + |
| SEQ ID NO 39583 | CTCTCACAAATCTATTTCACAA | CTG | chr6 | 160657177 | 160657198 | 160657194 | 160657199 | + |
| SEQ ID NO 39584 | TCACAAATCTATTTCACAAAGC | CTC | chr6 | 160657180 | 160657201 | 160657197 | 160657202 | + |
| SEQ ID NO 39585 | ACAAATCTATTTCACAAAGCTT | CTC | chr6 | 160657182 | 160657203 | 160657199 | 160657204 | + |
| SEQ ID NO 39586 | TTTCACAAAGCTTCGGCCAAGG | CTA | chr6 | 160657191 | 160657212 | 160657208 | 160657213 | + |

Figure 60 (Cont'd)

| SEQ ID NO 39587 | CACAAAGCTTCGGCCAAGGGTG | TTT | chr6 | 160657194 | 160657215 | 160657211 | 160657216 | + |
| SEQ ID NO 39588 | ACAAAGCTTCGGCCAAGGGTGT | TTC | chr6 | 160657195 | 160657216 | 160657212 | 160657217 | + |
| SEQ ID NO 39589 | CGGCCAAGGGTGTATCTTCTGG | CTT | chr6 | 160657204 | 160657225 | 160657221 | 160657226 | + |
| SEQ ID NO 39590 | GGCCAAGGGTGTATCTTCTGGA | TTC | chr6 | 160657205 | 160657226 | 160657222 | 160657227 | + |
| SEQ ID NO 39591 | CTGGACCCTCCCAGCTGGGATG | CTT | chr6 | 160657222 | 160657243 | 160657239 | 160657244 | + |
| SEQ ID NO 39592 | TGGACCCTCCCAGCTGGGATGA | TTC | chr6 | 160657223 | 160657244 | 160657240 | 160657245 | + |
| SEQ ID NO 39593 | GACCCTCCCAGCTGGGATGAGT | CTG | chr6 | 160657225 | 160657246 | 160657242 | 160657247 | + |
| SEQ ID NO 39594 | CCAGCTGGGATGAGTAGGTCTA | CTC | chr6 | 160657232 | 160657253 | 160657249 | 160657254 | + |
| SEQ ID NO 39595 | GGATGAGTAGGTCTAAAGTGAC | CTG | chr6 | 160657239 | 160657260 | 160657256 | 160657261 | + |
| SEQ ID NO 39596 | AAGTGACTAATCCACTCCACCA | CTA | chr6 | 160657254 | 160657275 | 160657271 | 160657276 | + |
| SEQ ID NO 39597 | ATCCACTCCACCATCCTAATCT | CTA | chr6 | 160657263 | 160657284 | 160657280 | 160657285 | + |
| SEQ ID NO 39598 | CACCATCCTAATCTCCCTAAGC | CTC | chr6 | 160657271 | 160657292 | 160657288 | 160657293 | + |
| SEQ ID NO 39599 | ATCTCCCTAAGCCTTTGGATCA | CTA | chr6 | 160657281 | 160657302 | 160657298 | 160657303 | + |
| SEQ ID NO 39600 | CCTAAGCCTTTGGATCACTTCC | CTC | chr6 | 160657286 | 160657307 | 160657303 | 160657308 | + |
| SEQ ID NO 39601 | AGCCTTTGGATCACTTCCTCTA | CTA | chr6 | 160657290 | 160657311 | 160657307 | 160657312 | + |
| SEQ ID NO 39602 | TGGATCACTTCCTCTACATTAA | CTT | chr6 | 160657296 | 160657317 | 160657313 | 160657318 | + |
| SEQ ID NO 39603 | GGATCACTTCCTCTACATTAAA | TTT | chr6 | 160657297 | 160657318 | 160657314 | 160657319 | + |
| SEQ ID NO 39604 | GATCACTTCCTCTACATTAAAC | TTG | chr6 | 160657298 | 160657319 | 160657315 | 160657320 | + |
| SEQ ID NO 39605 | CCTCTACATTAAACCAAGGCAT | CTT | chr6 | 160657306 | 160657327 | 160657323 | 160657328 | + |
| SEQ ID NO 39606 | CTCTACATTAAACCAAGGCATT | TTC | chr6 | 160657307 | 160657328 | 160657324 | 160657329 | + |
| SEQ ID NO 39607 | TACATTAAACCAAGGCATTTCC | CTC | chr6 | 160657310 | 160657331 | 160657327 | 160657332 | + |
| SEQ ID NO 39608 | CATTAAACCAAGGCATTTCCAG | CTA | chr6 | 160657312 | 160657333 | 160657329 | 160657334 | + |
| SEQ ID NO 39609 | AACCAAGGCATTTCCAGCTCAC | TTA | chr6 | 160657317 | 160657338 | 160657334 | 160657339 | + |
| SEQ ID NO 39610 | CCAGCTCACTAACATTGGACCA | TTT | chr6 | 160657330 | 160657351 | 160657347 | 160657352 | + |
| SEQ ID NO 39611 | CAGCTCACTAACATTGGACCAT | TTC | chr6 | 160657331 | 160657352 | 160657348 | 160657353 | + |
| SEQ ID NO 39612 | ACTAACATTGGACCATCTTTTA | CTC | chr6 | 160657337 | 160657358 | 160657354 | 160657359 | + |
| SEQ ID NO 39613 | ACATTGGACCATCTTTTAATCC | CTA | chr6 | 160657341 | 160657362 | 160657358 | 160657363 | + |
| SEQ ID NO 39614 | GACCATCTTTTAATCCATATTT | TTG | chr6 | 160657347 | 160657368 | 160657364 | 160657369 | + |
| SEQ ID NO 39615 | TTAATCCATATTTCAGCTAACC | CTT | chr6 | 160657356 | 160657377 | 160657373 | 160657378 | + |
| SEQ ID NO 39616 | TAATCCATATTTCAGCTAACCA | TTT | chr6 | 160657357 | 160657378 | 160657374 | 160657379 | + |
| SEQ ID NO 39617 | AATCCATATTTCAGCTAACCAA | TTT | chr6 | 160657358 | 160657379 | 160657375 | 160657380 | + |
| SEQ ID NO 39618 | ATCCATATTTCAGCTAACCAAG | TTA | chr6 | 160657359 | 160657380 | 160657376 | 160657381 | + |
| SEQ ID NO 39619 | CAGCTAACCAAGCAAATAAACT | TTT | chr6 | 160657369 | 160657390 | 160657386 | 160657391 | + |
| SEQ ID NO 39620 | AGCTAACCAAGCAAATAAACTA | TTC | chr6 | 160657370 | 160657391 | 160657387 | 160657392 | + |
| SEQ ID NO 39621 | ACCAAGCAAATAAACTATTATA | CTA | chr6 | 160657375 | 160657396 | 160657392 | 160657397 | + |
| SEQ ID NO 39622 | TTATAACTTTTTTTTTTTTTTT | CTA | chr6 | 160657392 | 160657413 | 160657409 | 160657414 | + |
| SEQ ID NO 39623 | TAACTTTTTTTTTTTTTTTTTT | TTA | chr6 | 160657395 | 160657416 | 160657412 | 160657417 | + |
| SEQ ID NO 39624 | TTTTTTTTTTTTTTTGGAAAT | CTT | chr6 | 160657401 | 160657422 | 160657418 | 160657423 | + |
| SEQ ID NO 39625 | TTTTTTTTTTTTTTGGAAATG | TTT | chr6 | 160657402 | 160657423 | 160657419 | 160657424 | + |
| SEQ ID NO 39626 | TTTTTTTTTTTTTGGAAATGG | TTT | chr6 | 160657403 | 160657424 | 160657420 | 160657425 | + |
| SEQ ID NO 39627 | TTTTTTTTTTTTGGAAATGGA | TTT | chr6 | 160657404 | 160657425 | 160657421 | 160657426 | + |
| SEQ ID NO 39628 | TTTTTTTTTTTGGAAATGGAG | TTT | chr6 | 160657405 | 160657426 | 160657422 | 160657427 | + |
| SEQ ID NO 39629 | TTTTTTTTTTGGAAATGGAGT | TTT | chr6 | 160657406 | 160657427 | 160657423 | 160657428 | + |
| SEQ ID NO 39630 | TTTTTTTTTGGAAATGGAGTC | TTT | chr6 | 160657407 | 160657428 | 160657424 | 160657429 | + |
| SEQ ID NO 39631 | TTTTTTTTGGAAATGGAGTCT | TTT | chr6 | 160657408 | 160657429 | 160657425 | 160657430 | + |
| SEQ ID NO 39632 | TTTTTTTGGAAATGGAGTCTT | TTT | chr6 | 160657409 | 160657430 | 160657426 | 160657431 | + |
| SEQ ID NO 39633 | TTTTTTGGAAATGGAGTCTTG | TTT | chr6 | 160657410 | 160657431 | 160657427 | 160657432 | + |
| SEQ ID NO 39634 | TTTTTGGAAATGGAGTCTTGC | TTT | chr6 | 160657411 | 160657432 | 160657428 | 160657433 | + |
| SEQ ID NO 39635 | TTTTGGAAATGGAGTCTTGCT | TTT | chr6 | 160657412 | 160657433 | 160657429 | 160657434 | + |
| SEQ ID NO 39636 | TTTGGAAATGGAGTCTTGCTC | TTT | chr6 | 160657413 | 160657434 | 160657430 | 160657435 | + |
| SEQ ID NO 39637 | TTGGAAATGGAGTCTTGCTCT | TTT | chr6 | 160657414 | 160657435 | 160657431 | 160657436 | + |
| SEQ ID NO 39638 | TGGAAATGGAGTCTTGCTCTG | TTT | chr6 | 160657415 | 160657436 | 160657432 | 160657437 | + |
| SEQ ID NO 39639 | GGAAATGGAGTCTTGCTCTGT | TTT | chr6 | 160657416 | 160657437 | 160657433 | 160657438 | + |
| SEQ ID NO 39640 | GAAATGGAGTCTTGCTCTGTT | TTT | chr6 | 160657417 | 160657438 | 160657434 | 160657439 | + |
| SEQ ID NO 39641 | GAAATGGAGTCTTGCTCTGTTA | TTG | chr6 | 160657418 | 160657439 | 160657435 | 160657440 | + |
| SEQ ID NO 39642 | GCTCTGTTACCAGGCTGGAATG | CTT | chr6 | 160657431 | 160657452 | 160657448 | 160657453 | + |
| SEQ ID NO 39643 | CTCTGTTACCAGGCTGGAATGC | TTG | chr6 | 160657432 | 160657453 | 160657449 | 160657454 | + |
| SEQ ID NO 39644 | TGTTACCAGGCTGGAATGCAGT | CTC | chr6 | 160657435 | 160657456 | 160657452 | 160657457 | + |

Figure 60 (Cont'd)

| | | | | | | | | |
|---|---|---|---|---|---|---|---|---|
| SEQ ID NO 39645 | TTACCAGGCTGGAATGCAGTGG | CTG | chr6 | 160657437 | 160657458 | 160657454 | 160657459 | + |
| SEQ ID NO 39646 | CCAGGCTGGAATGCAGTGGGGC | TTA | chr6 | 160657440 | 160657461 | 160657457 | 160657462 | + |
| SEQ ID NO 39647 | GAATGCAGTGGGGCGATCTTGG | CTG | chr6 | 160657448 | 160657469 | 160657465 | 160657470 | + |
| SEQ ID NO 39648 | GGCTCACTGCAATCTCTGCCTC | CTT | chr6 | 160657468 | 160657489 | 160657485 | 160657490 | + |
| SEQ ID NO 39649 | GCTCACTGCAATCTCTGCCTCA | TTG | chr6 | 160657469 | 160657490 | 160657486 | 160657491 | + |
| SEQ ID NO 39650 | ACTGCAATCTCTGCCTCACAGG | CTC | chr6 | 160657473 | 160657494 | 160657490 | 160657495 | + |
| SEQ ID NO 39651 | CAATCTCTGCCTCACAGGTTCA | CTG | chr6 | 160657477 | 160657498 | 160657494 | 160657499 | + |
| SEQ ID NO 39652 | TGCCTCACAGGTTCAAGCAGTT | CTC | chr6 | 160657484 | 160657505 | 160657501 | 160657506 | + |
| SEQ ID NO 39653 | CCTCACAGGTTCAAGCAGTTCT | CTG | chr6 | 160657486 | 160657507 | 160657503 | 160657508 | + |
| SEQ ID NO 39654 | ACAGGTTCAAGCAGTTCTCTTG | CTC | chr6 | 160657490 | 160657511 | 160657507 | 160657512 | + |
| SEQ ID NO 39655 | AAGCAGTTCTCTTGCCTCAGCC | TTC | chr6 | 160657498 | 160657519 | 160657515 | 160657520 | + |
| SEQ ID NO 39656 | TCTTGCCTCAGCCTCCCAAGTA | TTC | chr6 | 160657507 | 160657528 | 160657524 | 160657529 | + |
| SEQ ID NO 39657 | TTGCCTCAGCCTCCCAAGTAGA | CTC | chr6 | 160657509 | 160657530 | 160657526 | 160657531 | + |
| SEQ ID NO 39658 | GCCTCAGCCTCCCAAGTAGATG | CTT | chr6 | 160657511 | 160657532 | 160657528 | 160657533 | + |
| SEQ ID NO 39659 | CCTCAGCCTCCCAAGTAGATGA | TTG | chr6 | 160657512 | 160657533 | 160657529 | 160657534 | + |
| SEQ ID NO 39660 | AGCCTCCCAAGTAGATGAGATT | CTC | chr6 | 160657516 | 160657537 | 160657533 | 160657538 | + |
| SEQ ID NO 39661 | CCAAGTAGATGAGATTACAGTT | CTC | chr6 | 160657522 | 160657543 | 160657539 | 160657544 | + |
| SEQ ID NO 39662 | CAGTTACGCATCACCATGCCCA | TTA | chr6 | 160657539 | 160657560 | 160657556 | 160657561 | + |
| SEQ ID NO 39663 | CGCATCACCATGCCCAGCTAAT | TTA | chr6 | 160657545 | 160657566 | 160657562 | 160657567 | + |
| SEQ ID NO 39664 | ATTTTTGTATTTTTAGCAGAGA | CTA | chr6 | 160657565 | 160657586 | 160657582 | 160657587 | + |
| SEQ ID NO 39665 | TTGTATTTTTAGCAGAGATGGG | TTT | chr6 | 160657569 | 160657590 | 160657586 | 160657591 | + |
| SEQ ID NO 39666 | TGTATTTTTAGCAGAGATGGGG | TTT | chr6 | 160657570 | 160657591 | 160657587 | 160657592 | + |
| SEQ ID NO 39667 | GTATTTTTAGCAGAGATGGGGT | TTT | chr6 | 160657571 | 160657592 | 160657588 | 160657593 | + |
| SEQ ID NO 39668 | TATTTTTAGCAGAGATGGGGTT | TTG | chr6 | 160657572 | 160657593 | 160657589 | 160657594 | + |
| SEQ ID NO 39669 | TTAGCAGAGATGGGGTTTCACC | TTT | chr6 | 160657577 | 160657598 | 160657594 | 160657599 | + |
| SEQ ID NO 39670 | TAGCAGAGATGGGGTTTCACCA | TTT | chr6 | 160657578 | 160657599 | 160657595 | 160657600 | + |
| SEQ ID NO 39671 | AGCAGAGATGGGGTTTCACCAT | TTT | chr6 | 160657579 | 160657600 | 160657596 | 160657601 | + |
| SEQ ID NO 39672 | GCAGAGATGGGGTTTCACCATT | TTA | chr6 | 160657580 | 160657601 | 160657597 | 160657602 | + |
| SEQ ID NO 39673 | CACCATTTTAGCCAGAATTGTC | TTT | chr6 | 160657595 | 160657616 | 160657612 | 160657617 | + |
| SEQ ID NO 39674 | ACCATTTTAGCCAGAATTGTCT | TTC | chr6 | 160657596 | 160657617 | 160657613 | 160657618 | + |
| SEQ ID NO 39675 | TAGCCAGAATTGTCTCAATCTC | TTT | chr6 | 160657603 | 160657624 | 160657620 | 160657625 | + |
| SEQ ID NO 39676 | AGCCAGAATTGTCTCAATCTCC | TTT | chr6 | 160657604 | 160657625 | 160657621 | 160657626 | + |
| SEQ ID NO 39677 | GCCAGAATTGTCTCAATCTCCT | TTA | chr6 | 160657605 | 160657626 | 160657622 | 160657627 | + |
| SEQ ID NO 39678 | TCTCAATCTCCTGATCTCGTGA | TTG | chr6 | 160657615 | 160657636 | 160657632 | 160657637 | + |
| SEQ ID NO 39679 | AATCTCCTGATCTCGTGATCTG | CTC | chr6 | 160657619 | 160657640 | 160657636 | 160657641 | + |
| SEQ ID NO 39680 | CTGATCTCGTGATCTGCCCGCC | CTC | chr6 | 160657625 | 160657646 | 160657642 | 160657647 | + |
| SEQ ID NO 39681 | ATCTCGTGATCTGCCCGCCCCC | CTG | chr6 | 160657628 | 160657649 | 160657645 | 160657650 | + |
| SEQ ID NO 39682 | GTGATCTGCCCGCCCCCGCCTC | CTC | chr6 | 160657633 | 160657654 | 160657650 | 160657655 | + |
| SEQ ID NO 39683 | CCCGCCCCGCCTCCCAAGGTG | CTG | chr6 | 160657641 | 160657662 | 160657658 | 160657663 | + |
| SEQ ID NO 39684 | CCAAGGTGCTGGGATTACAGGC | CTC | chr6 | 160657655 | 160657676 | 160657672 | 160657677 | + |
| SEQ ID NO 39685 | GGATTACAGGCGTGAGCCACTG | CTG | chr6 | 160657666 | 160657687 | 160657683 | 160657688 | + |
| SEQ ID NO 39686 | CAGGCGTGAGCCACTGCTCCCG | TTA | chr6 | 160657672 | 160657693 | 160657689 | 160657694 | + |
| SEQ ID NO 39687 | CTCCCGGCCCTATCAGAACCTT | CTG | chr6 | 160657688 | 160657709 | 160657705 | 160657710 | + |
| SEQ ID NO 39688 | CCGGCCCTATCAGAACCTTTTC | CTC | chr6 | 160657691 | 160657712 | 160657708 | 160657713 | + |
| SEQ ID NO 39689 | TCAGAACCTTTTCTAAGTCCCC | CTA | chr6 | 160657700 | 160657721 | 160657717 | 160657722 | + |
| SEQ ID NO 39690 | TTCTAAGTCCCCGAGCTGCAAC | CTT | chr6 | 160657710 | 160657731 | 160657727 | 160657732 | + |
| SEQ ID NO 39691 | TCTAAGTCCCCGAGCTGCAACA | TTT | chr6 | 160657711 | 160657732 | 160657728 | 160657733 | + |
| SEQ ID NO 39692 | CTAAGTCCCCGAGCTGCAACAT | TTT | chr6 | 160657712 | 160657733 | 160657729 | 160657734 | + |
| SEQ ID NO 39693 | TAAGTCCCCGAGCTGCAACATT | TTC | chr6 | 160657713 | 160657734 | 160657730 | 160657735 | + |
| SEQ ID NO 39694 | AGTCCCCGAGCTGCAACATTAA | CTA | chr6 | 160657715 | 160657736 | 160657732 | 160657737 | + |
| SEQ ID NO 39695 | CAACATTAAATGCAGAATCCCT | CTG | chr6 | 160657728 | 160657749 | 160657745 | 160657750 | + |
| SEQ ID NO 39696 | AATGCAGAATCCCTACTTAGTA | TTA | chr6 | 160657736 | 160657757 | 160657753 | 160657758 | + |
| SEQ ID NO 39697 | CTTAGTAGGGCCAAACCAATAA | CTA | chr6 | 160657751 | 160657772 | 160657768 | 160657773 | + |
| SEQ ID NO 39698 | AGTAGGGCCAAACCAATAAATT | CTT | chr6 | 160657754 | 160657775 | 160657771 | 160657776 | + |
| SEQ ID NO 39699 | GTAGGGCCAAACCAATAAATTC | TTA | chr6 | 160657755 | 160657776 | 160657772 | 160657777 | + |
| SEQ ID NO 39700 | AGCTTGATCCAACTCTATGTCC | TTC | chr6 | 160657777 | 160657798 | 160657794 | 160657799 | + |
| SEQ ID NO 39701 | GATCCAACTCTATGTCCCTTCC | CTT | chr6 | 160657782 | 160657803 | 160657799 | 160657804 | + |
| SEQ ID NO 39702 | ATCCAACTCTATGTCCCTTCCA | TTG | chr6 | 160657783 | 160657804 | 160657800 | 160657805 | + |

Figure 60 (Cont'd)

| SEQ ID NO 39703 | TATGTCCCTTCCACCATTATCC | CTC | chr6 | 160657792 | 160657813 | 160657809 | 160657814 | + |
| SEQ ID NO 39704 | TGTCCCTTCCACCATTATCCCT | CTA | chr6 | 160657794 | 160657815 | 160657811 | 160657816 | + |
| SEQ ID NO 39705 | CCACCATTATCCCTTACCCTTA | CTT | chr6 | 160657802 | 160657823 | 160657819 | 160657824 | + |
| SEQ ID NO 39706 | CACCATTATCCCTTACCCTTAA | TTC | chr6 | 160657803 | 160657824 | 160657820 | 160657825 | + |
| SEQ ID NO 39707 | TCCCTTACCCTTAATATCCATT | TTA | chr6 | 160657811 | 160657832 | 160657828 | 160657833 | + |
| SEQ ID NO 39708 | ACCCTTAATATCCATTCCCATG | CTT | chr6 | 160657817 | 160657838 | 160657834 | 160657839 | + |
| SEQ ID NO 39709 | CCCTTAATATCCATTCCCATGC | TTA | chr6 | 160657818 | 160657839 | 160657835 | 160657840 | + |
| SEQ ID NO 39710 | AATATCCATTCCCATGCCTGTT | CTT | chr6 | 160657823 | 160657844 | 160657840 | 160657845 | + |
| SEQ ID NO 39711 | ATATCCATTCCCATGCCTGTTC | TTA | chr6 | 160657824 | 160657845 | 160657841 | 160657846 | + |
| SEQ ID NO 39712 | CCATGCCTGTTCTCCAGATTTC | TTC | chr6 | 160657834 | 160657855 | 160657851 | 160657856 | + |
| SEQ ID NO 39713 | TTCTCCAGATTTCTGCCAATAT | CTG | chr6 | 160657843 | 160657864 | 160657860 | 160657865 | + |
| SEQ ID NO 39714 | TCCAGATTTCTGCCAATATAAA | TTC | chr6 | 160657846 | 160657867 | 160657863 | 160657868 | + |
| SEQ ID NO 39715 | CAGATTTCTGCCAATATAAATT | CTC | chr6 | 160657848 | 160657869 | 160657865 | 160657870 | + |
| SEQ ID NO 39716 | CTGCCAATATAAATTAGAAAGC | TTT | chr6 | 160657855 | 160657876 | 160657872 | 160657877 | + |
| SEQ ID NO 39717 | TGCCAATATAAATTAGAAAGCT | TTC | chr6 | 160657856 | 160657877 | 160657873 | 160657878 | + |
| SEQ ID NO 39718 | CCAATATAAATTAGAAAGCTTA | CTG | chr6 | 160657858 | 160657879 | 160657875 | 160657880 | + |
| SEQ ID NO 39719 | GAAAGCTTAAGCAGTTCTTTTA | TTA | chr6 | 160657871 | 160657892 | 160657888 | 160657893 | + |
| SEQ ID NO 39720 | AAGCAGTTCTTTTAGAGTATAA | CTT | chr6 | 160657879 | 160657900 | 160657896 | 160657901 | + |
| SEQ ID NO 39721 | AGCAGTTCTTTTAGAGTATAAT | TTA | chr6 | 160657880 | 160657901 | 160657897 | 160657902 | + |
| SEQ ID NO 39722 | TTTTAGAGTATAATGCACCTCC | TTC | chr6 | 160657888 | 160657909 | 160657905 | 160657910 | + |
| SEQ ID NO 39723 | TTAGAGTATAATGCACCTCCTC | CTT | chr6 | 160657890 | 160657911 | 160657907 | 160657912 | + |
| SEQ ID NO 39724 | TAGAGTATAATGCACCTCCTCA | TTT | chr6 | 160657891 | 160657912 | 160657908 | 160657913 | + |
| SEQ ID NO 39725 | AGAGTATAATGCACCTCCTCAT | TTT | chr6 | 160657892 | 160657913 | 160657909 | 160657914 | + |
| SEQ ID NO 39726 | GAGTATAATGCACCTCCTCATG | TTA | chr6 | 160657893 | 160657914 | 160657910 | 160657915 | + |
| SEQ ID NO 39727 | CTCATGGGTCACACTCTGAACC | CTC | chr6 | 160657909 | 160657930 | 160657926 | 160657931 | + |
| SEQ ID NO 39728 | ATGGGTCACACTCTGAACCTCA | CTC | chr6 | 160657912 | 160657933 | 160657929 | 160657934 | + |
| SEQ ID NO 39729 | TGAACCTCACCTCTGGGGCCCG | CTC | chr6 | 160657925 | 160657946 | 160657942 | 160657947 | + |
| SEQ ID NO 39730 | AACCTCACCTCTGGGGCCCGCA | CTG | chr6 | 160657927 | 160657948 | 160657944 | 160657949 | + |
| SEQ ID NO 39731 | ACCTCTGGGGCCCGCAAGGAAT | CTC | chr6 | 160657933 | 160657954 | 160657950 | 160657955 | + |
| SEQ ID NO 39732 | TGGGGCCCGCAAGGAATTTAGC | CTC | chr6 | 160657938 | 160657959 | 160657955 | 160657960 | + |
| SEQ ID NO 39733 | GGGCCCGCAAGGAATTTAGCCT | CTG | chr6 | 160657940 | 160657961 | 160657957 | 160657962 | + |
| SEQ ID NO 39734 | AGCCTAGTTATAGGTCTAGAAG | TTT | chr6 | 160657957 | 160657978 | 160657974 | 160657979 | + |
| SEQ ID NO 39735 | GCCTAGTTATAGGTCTAGAAGC | TTA | chr6 | 160657958 | 160657979 | 160657975 | 160657980 | + |
| SEQ ID NO 39736 | GTTATAGGTCTAGAAGCATTCA | CTA | chr6 | 160657963 | 160657984 | 160657980 | 160657985 | + |
| SEQ ID NO 39737 | TAGGTCTAGAAGCATTCAGGGG | TTA | chr6 | 160657967 | 160657988 | 160657984 | 160657989 | + |
| SEQ ID NO 39738 | GAAGCATTCAGGGGCATTAGGG | CTA | chr6 | 160657975 | 160657996 | 160657992 | 160657997 | + |
| SEQ ID NO 39739 | AGGGGCATTAGGGGTGCCTCTT | TTC | chr6 | 160657984 | 160658005 | 160658001 | 160658006 | + |
| SEQ ID NO 39740 | GGGGTGCCTCTTGAGGAGAATC | TTA | chr6 | 160657994 | 160658015 | 160658011 | 160658016 | + |
| SEQ ID NO 39741 | TTGAGGAGAATCAACATTATCT | CTC | chr6 | 160658004 | 160658025 | 160658021 | 160658026 | + |
| SEQ ID NO 39742 | GAGGAGAATCAACATTATCTTG | CTT | chr6 | 160658006 | 160658027 | 160658023 | 160658028 | + |
| SEQ ID NO 39743 | AGGAGAATCAACATTATCTTGC | TTG | chr6 | 160658007 | 160658028 | 160658024 | 160658029 | + |
| SEQ ID NO 39744 | TCTTGCCTGGCAGCTGCCTCAG | TTA | chr6 | 160658023 | 160658044 | 160658040 | 160658045 | + |
| SEQ ID NO 39745 | GCCTGGCAGCTGCCTCAGGGAA | CTT | chr6 | 160658027 | 160658048 | 160658044 | 160658049 | + |
| SEQ ID NO 39746 | CCTGGCAGCTGCCTCAGGGAAG | TTG | chr6 | 160658028 | 160658049 | 160658045 | 160658050 | + |
| SEQ ID NO 39747 | GCAGCTGCCTCAGGGAAGGCCA | CTG | chr6 | 160658032 | 160658053 | 160658049 | 160658054 | + |
| SEQ ID NO 39748 | CCTCAGGGAAGGCCATCACTGT | CTG | chr6 | 160658039 | 160658060 | 160658056 | 160658061 | + |
| SEQ ID NO 39749 | AGGGAAGGCCATCACTGTTGCC | CTC | chr6 | 160658043 | 160658064 | 160658060 | 160658065 | + |
| SEQ ID NO 39750 | TTGCCTCAAGCAGTGCAGGGTT | CTG | chr6 | 160658060 | 160658081 | 160658077 | 160658082 | + |
| SEQ ID NO 39751 | CCTCAAGCAGTGCAGGGTTTAC | TTG | chr6 | 160658063 | 160658084 | 160658080 | 160658085 | + |
| SEQ ID NO 39752 | AAGCAGTGCAGGGTTTACATCC | CTC | chr6 | 160658067 | 160658088 | 160658084 | 160658089 | + |
| SEQ ID NO 39753 | ACATCCTCAGACAAAGGTGGAA | TTT | chr6 | 160658083 | 160658104 | 160658100 | 160658105 | + |
| SEQ ID NO 39754 | CATCCTCAGACAAAGGTGGAAA | TTA | chr6 | 160658084 | 160658105 | 160658101 | 160658106 | + |
| SEQ ID NO 39755 | AGACAAAGGTGGAAAGGCTAAT | CTC | chr6 | 160658091 | 160658112 | 160658108 | 160658113 | + |
| SEQ ID NO 39756 | ATGGCAGCACGGGTCAGGGAGG | CTA | chr6 | 160658111 | 160658132 | 160658128 | 160658133 | + |
| SEQ ID NO 39757 | CCACTACTGGGGATGGGAAAC | TTA | chr6 | 160658141 | 160658162 | 160658158 | 160658163 | + |
| SEQ ID NO 39758 | CTGGGGATGGGAAACTGTTTC | CTA | chr6 | 160658147 | 160658168 | 160658164 | 160658169 | + |
| SEQ ID NO 39759 | GGGATGGGAAACTGTTTCTTG | CTG | chr6 | 160658150 | 160658171 | 160658167 | 160658172 | + |
| SEQ ID NO 39760 | TTTCTTCTGGCAAAAAGTTTC | CTG | chr6 | 160658165 | 160658186 | 160658182 | 160658187 | + |

Figure 60 (Cont'd)

| | | | | | | | | |
|---|---|---|---|---|---|---|---|---|
| SEQ ID NO 39761 | CTTCTGGCAAAAAAGTTTCATC | TTT | chr6 | 160658168 | 160658189 | 160658185 | 160658190 | + |
| SEQ ID NO 39762 | TTCTGGCAAAAAAGTTTCATCA | TTC | chr6 | 160658169 | 160658190 | 160658186 | 160658191 | + |
| SEQ ID NO 39763 | CTGGCAAAAAAGTTTCATCAGA | CTT | chr6 | 160658171 | 160658192 | 160658188 | 160658193 | + |
| SEQ ID NO 39764 | TGGCAAAAAAGTTTCATCAGAG | TTC | chr6 | 160658172 | 160658193 | 160658189 | 160658194 | + |
| SEQ ID NO 39765 | GCAAAAAAGTTTCATCAGAGTT | CTG | chr6 | 160658174 | 160658195 | 160658191 | 160658196 | + |
| SEQ ID NO 39766 | CATCAGAGTTCACAAACTCAGT | TTT | chr6 | 160658186 | 160658207 | 160658203 | 160658208 | + |
| SEQ ID NO 39767 | ATCAGAGTTCACAAACTCAGTG | TTC | chr6 | 160658187 | 160658208 | 160658204 | 160658209 | + |
| SEQ ID NO 39768 | ACAAACTCAGTGTCCTCAGCTT | TTC | chr6 | 160658197 | 160658218 | 160658214 | 160658219 | + |
| SEQ ID NO 39769 | AGTGTCCTCAGCTTCATCAGGG | CTC | chr6 | 160658205 | 160658226 | 160658222 | 160658227 | + |
| SEQ ID NO 39770 | AGCTTCATCAGGGTTCTCCCAC | CTC | chr6 | 160658214 | 160658235 | 160658231 | 160658236 | + |
| SEQ ID NO 39771 | CATCAGGGTTCTCCCACACATC | CTT | chr6 | 160658219 | 160658240 | 160658236 | 160658241 | + |
| SEQ ID NO 39772 | ATCAGGGTTCTCCCACACATCC | TTC | chr6 | 160658220 | 160658241 | 160658237 | 160658242 | + |
| SEQ ID NO 39773 | TCCCACACATCCCCACTCCAAG | TTC | chr6 | 160658230 | 160658251 | 160658247 | 160658252 | + |
| SEQ ID NO 39774 | CCACACATCCCCACTCCAAGTT | CTC | chr6 | 160658232 | 160658253 | 160658249 | 160658254 | + |
| SEQ ID NO 39775 | CAAGTTCCAGGGTCCCATTTTT | CTC | chr6 | 160658248 | 160658269 | 160658265 | 160658270 | + |
| SEQ ID NO 39776 | CAGGGTCCCATTTTTTTCCAGT | TTC | chr6 | 160658255 | 160658276 | 160658272 | 160658277 | + |
| SEQ ID NO 39777 | TTTTCAGTCAATGCCCTCACT | TTT | chr6 | 160658268 | 160658289 | 160658285 | 160658290 | + |
| SEQ ID NO 39778 | TTTCCAGTCAATGCCCTCACTT | TTT | chr6 | 160658269 | 160658290 | 160658286 | 160658291 | + |
| SEQ ID NO 39779 | TTCCAGTCAATGCCCTCACTTT | TTT | chr6 | 160658270 | 160658291 | 160658287 | 160658292 | + |
| SEQ ID NO 39780 | TCCAGTCAATGCCCTCACTTTA | TTT | chr6 | 160658271 | 160658292 | 160658288 | 160658293 | + |
| SEQ ID NO 39781 | CCAGTCAATGCCCTCACTTTAA | TTT | chr6 | 160658272 | 160658293 | 160658289 | 160658294 | + |
| SEQ ID NO 39782 | CAGTCAATGCCCTCACTTTAAC | TTC | chr6 | 160658273 | 160658294 | 160658290 | 160658295 | + |
| SEQ ID NO 39783 | ACTTTAACAGTAAACACCTGGC | CTC | chr6 | 160658287 | 160658308 | 160658304 | 160658309 | + |
| SEQ ID NO 39784 | TAACAGTAAACACCTGGCAAGG | CTT | chr6 | 160658291 | 160658312 | 160658308 | 160658313 | + |
| SEQ ID NO 39785 | AACAGTAAACACCTGGCAAGGC | TTT | chr6 | 160658292 | 160658313 | 160658309 | 160658314 | + |
| SEQ ID NO 39786 | ACAGTAAACACCTGGCAAGGCT | TTA | chr6 | 160658293 | 160658314 | 160658310 | 160658315 | + |
| SEQ ID NO 39787 | GCAAGGCTGTGCATGCACCTCT | CTG | chr6 | 160658307 | 160658328 | 160658324 | 160658329 | + |
| SEQ ID NO 39788 | TGCATGCACCTCTTGTTGCAGA | CTG | chr6 | 160658316 | 160658337 | 160658333 | 160658338 | + |
| SEQ ID NO 39789 | TTGTTGCAGATCAGCTACTCGC | CTC | chr6 | 160658328 | 160658349 | 160658345 | 160658350 | + |
| SEQ ID NO 39790 | GTTGCAGATCAGCTACTCGCAT | CTT | chr6 | 160658330 | 160658351 | 160658347 | 160658352 | + |
| SEQ ID NO 39791 | TTGCAGATCAGCTACTCGCATG | TTG | chr6 | 160658331 | 160658352 | 160658348 | 160658353 | + |
| SEQ ID NO 39792 | CAGATCAGCTACTCGCATGATA | TTG | chr6 | 160658334 | 160658355 | 160658351 | 160658356 | + |
| SEQ ID NO 39793 | CTCGCATGATAACAGCTTGTCT | CTA | chr6 | 160658345 | 160658366 | 160658362 | 160658367 | + |
| SEQ ID NO 39794 | GCATGATAACAGCTTGTCTCTG | CTC | chr6 | 160658348 | 160658369 | 160658365 | 160658370 | + |
| SEQ ID NO 39795 | GTCTCTGTTTTTTCACAATTTC | CTT | chr6 | 160658363 | 160658384 | 160658380 | 160658385 | + |
| SEQ ID NO 39796 | TCTCTGTTTTTTCACAATTTCA | TTG | chr6 | 160658364 | 160658385 | 160658381 | 160658386 | + |
| SEQ ID NO 39797 | TGTTTTTTCACAATTTCAACTC | CTC | chr6 | 160658368 | 160658389 | 160658385 | 160658390 | + |
| SEQ ID NO 39798 | TTTTTTCACAATTTCAACTCTT | CTG | chr6 | 160658370 | 160658391 | 160658387 | 160658392 | + |
| SEQ ID NO 39799 | TTTCACAATTTCAACTCTTTCT | TTT | chr6 | 160658373 | 160658394 | 160658390 | 160658395 | + |
| SEQ ID NO 39800 | TTCACAATTTCAACTCTTTCTC | TTT | chr6 | 160658374 | 160658395 | 160658391 | 160658396 | + |
| SEQ ID NO 39801 | TCACAATTTCAACTCTTTCTCT | TTT | chr6 | 160658375 | 160658396 | 160658392 | 160658397 | + |
| SEQ ID NO 39802 | CACAATTTCAACTCTTTCTCTA | TTT | chr6 | 160658376 | 160658397 | 160658393 | 160658398 | + |
| SEQ ID NO 39803 | ACAATTTCAACTCTTTCTCTAC | TTC | chr6 | 160658377 | 160658398 | 160658394 | 160658399 | + |
| SEQ ID NO 39804 | CAACTCTTTCTCTACAGGAGTT | TTT | chr6 | 160658384 | 160658405 | 160658401 | 160658406 | + |
| SEQ ID NO 39805 | AACTCTTTCTCTACAGGAGTTA | TTC | chr6 | 160658385 | 160658406 | 160658402 | 160658407 | + |
| SEQ ID NO 39806 | TTTCTCTACAGGAGTTAAAACT | CTC | chr6 | 160658390 | 160658411 | 160658407 | 160658412 | + |
| SEQ ID NO 39807 | TCTCTACAGGAGTTAAAACTCT | CTT | chr6 | 160658392 | 160658413 | 160658409 | 160658414 | + |
| SEQ ID NO 39808 | CTCTACAGGAGTTAAAACTCTC | TTT | chr6 | 160658393 | 160658414 | 160658410 | 160658415 | + |
| SEQ ID NO 39809 | TCTACAGGAGTTAAAACTCTCA | TTC | chr6 | 160658394 | 160658415 | 160658411 | 160658416 | + |
| SEQ ID NO 39810 | TACAGGAGTTAAAACTCTCATT | CTC | chr6 | 160658396 | 160658417 | 160658413 | 160658418 | + |
| SEQ ID NO 39811 | CAGGAGTTAAAACTCTCATTCA | CTA | chr6 | 160658398 | 160658419 | 160658415 | 160658420 | + |
| SEQ ID NO 39812 | AAACTCTCATTCAGGGCAATCT | TTA | chr6 | 160658407 | 160658428 | 160658424 | 160658429 | + |
| SEQ ID NO 39813 | TCATTCAGGGCAATCTTAGCAG | CTC | chr6 | 160658413 | 160658434 | 160658430 | 160658435 | + |
| SEQ ID NO 39814 | ATTCAGGGCAATCTTAGCAGAT | CTC | chr6 | 160658415 | 160658436 | 160658432 | 160658437 | + |
| SEQ ID NO 39815 | AGGGCAATCTTAGCAGATTTGT | TTC | chr6 | 160658419 | 160658440 | 160658436 | 160658441 | + |
| SEQ ID NO 39816 | AGCAGATTTGTGGCTCAGTATC | CTT | chr6 | 160658430 | 160658451 | 160658447 | 160658452 | + |
| SEQ ID NO 39817 | GCAGATTTGTGGCTCAGTATCT | TTA | chr6 | 160658431 | 160658452 | 160658448 | 160658453 | + |
| SEQ ID NO 39818 | GTGGCTCAGTATCTGCTTCTGA | TTT | chr6 | 160658439 | 160658460 | 160658456 | 160658461 | + |

Figure 60 (Cont'd)

| | | | | | | | | |
|---|---|---|---|---|---|---|---|---|
| SEQ ID NO 39819 | TGGCTCAGTATCTGCTTCTGAA | TTG | chr6 | 160658440 | 160658461 | 160658457 | 160658462 | + |
| SEQ ID NO 39820 | AGTATCTGCTTCTGAAGGTGGG | CTC | chr6 | 160658446 | 160658467 | 160658463 | 160658468 | + |
| SEQ ID NO 39821 | CTTCTGAAGGTGGGAGACAGAT | CTG | chr6 | 160658454 | 160658475 | 160658471 | 160658476 | + |
| SEQ ID NO 39822 | CTGAAGGTGGGAGACAGATCCC | CTT | chr6 | 160658457 | 160658478 | 160658474 | 160658479 | + |
| SEQ ID NO 39823 | TGAAGGTGGGAGACAGATCCCC | TTC | chr6 | 160658458 | 160658479 | 160658475 | 160658480 | + |
| SEQ ID NO 39824 | AAGGTGGGAGACAGATCCCCTG | CTG | chr6 | 160658460 | 160658481 | 160658477 | 160658482 | + |
| SEQ ID NO 39825 | AGATCATCATTTTCTTTCATCT | CTG | chr6 | 160658482 | 160658503 | 160658499 | 160658504 | + |
| SEQ ID NO 39826 | TCTTTCATCTCTTTCTCCAGAG | TTT | chr6 | 160658494 | 160658515 | 160658511 | 160658516 | + |
| SEQ ID NO 39827 | CTTTCATCTCTTTCTCCAGAGA | TTT | chr6 | 160658495 | 160658516 | 160658512 | 160658517 | + |
| SEQ ID NO 39828 | TTTCATCTCTTTCTCCAGAGAA | TTC | chr6 | 160658496 | 160658517 | 160658513 | 160658518 | + |
| SEQ ID NO 39829 | TCATCTCTTTCTCCAGAGAACT | CTT | chr6 | 160658498 | 160658519 | 160658515 | 160658520 | + |
| SEQ ID NO 39830 | CATCTCTTTCTCCAGAGAACTT | TTT | chr6 | 160658499 | 160658520 | 160658516 | 160658521 | + |
| SEQ ID NO 39831 | ATCTCTTTCTCCAGAGAACTTA | TTC | chr6 | 160658500 | 160658521 | 160658517 | 160658522 | + |
| SEQ ID NO 39832 | TTTCTCCAGAGAACTTAGGAGC | CTC | chr6 | 160658505 | 160658526 | 160658522 | 160658527 | + |
| SEQ ID NO 39833 | TCTCCAGAGAACTTAGGAGCAA | CTT | chr6 | 160658507 | 160658528 | 160658524 | 160658529 | + |
| SEQ ID NO 39834 | CTCCAGAGAACTTAGGAGCAAT | TTT | chr6 | 160658508 | 160658529 | 160658525 | 160658530 | + |
| SEQ ID NO 39835 | TCCAGAGAACTTAGGAGCAATC | TTC | chr6 | 160658509 | 160658530 | 160658526 | 160658531 | + |
| SEQ ID NO 39836 | CAGAGAACTTAGGAGCAATCAA | CTC | chr6 | 160658511 | 160658532 | 160658528 | 160658533 | + |
| SEQ ID NO 39837 | AGGAGCAATCAACCAACTTCAT | CTT | chr6 | 160658521 | 160658542 | 160658538 | 160658543 | + |
| SEQ ID NO 39838 | GGAGCAATCAACCAACTTCATT | TTA | chr6 | 160658522 | 160658543 | 160658539 | 160658544 | + |
| SEQ ID NO 39839 | CATTATGTTCCTTGGTTCTCCA | CTT | chr6 | 160658540 | 160658561 | 160658557 | 160658562 | + |
| SEQ ID NO 39840 | ATTATGTTCCTTGGTTCTCCAC | TTC | chr6 | 160658541 | 160658562 | 160658558 | 160658563 | + |
| SEQ ID NO 39841 | TGTTCCTTGGTTCTCCACATAT | TTA | chr6 | 160658545 | 160658566 | 160658562 | 160658567 | + |
| SEQ ID NO 39842 | CTTGGTTCTCCACATATAGTCA | TTC | chr6 | 160658550 | 160658571 | 160658567 | 160658572 | + |
| SEQ ID NO 39843 | GGTTCTCCACATATAGTCAAAG | CTT | chr6 | 160658553 | 160658574 | 160658570 | 160658575 | + |
| SEQ ID NO 39844 | GTTCTCCACATATAGTCAAAGG | TTG | chr6 | 160658554 | 160658575 | 160658571 | 160658576 | + |
| SEQ ID NO 39845 | TCCACATATAGTCAAAGGTATT | TTC | chr6 | 160658558 | 160658579 | 160658575 | 160658580 | + |
| SEQ ID NO 39846 | CACATATAGTCAAAGGTATTAT | CTC | chr6 | 160658560 | 160658581 | 160658577 | 160658582 | + |
| SEQ ID NO 39847 | TGTATAGAGTCACTAAACTCCT | TTA | chr6 | 160658581 | 160658602 | 160658598 | 160658603 | + |
| SEQ ID NO 39848 | AACTCCTTGCCTCTCATAAGTG | CTA | chr6 | 160658596 | 160658617 | 160658613 | 160658618 | + |
| SEQ ID NO 39849 | CTTGCCTCTCATAAGTGATGAA | CTC | chr6 | 160658601 | 160658622 | 160658618 | 160658623 | + |
| SEQ ID NO 39850 | GCCTCTCATAAGTGATGAATCA | CTT | chr6 | 160658604 | 160658625 | 160658621 | 160658626 | + |
| SEQ ID NO 39851 | CCTCTCATAAGTGATGAATCAG | TTG | chr6 | 160658605 | 160658626 | 160658622 | 160658627 | + |
| SEQ ID NO 39852 | TCATAAGTGATGAATCAGTAGT | CTC | chr6 | 160658609 | 160658630 | 160658626 | 160658631 | + |
| SEQ ID NO 39853 | ATAAGTGATGAATCAGTAGTGT | CTC | chr6 | 160658611 | 160658632 | 160658628 | 160658633 | + |
| SEQ ID NO 39854 | ATTTTGCATAACTCTCTAAACA | TTT | chr6 | 160658644 | 160658665 | 160658661 | 160658666 | + |
| SEQ ID NO 39855 | TTTTGCATAACTCTCTAAACAA | TTA | chr6 | 160658645 | 160658666 | 160658662 | 160658667 | + |
| SEQ ID NO 39856 | TGCATAACTCTCTAAACAATTC | TTT | chr6 | 160658648 | 160658669 | 160658665 | 160658670 | + |
| SEQ ID NO 39857 | GCATAACTCTCTAAACAATTCA | TTT | chr6 | 160658649 | 160658670 | 160658666 | 160658671 | + |
| SEQ ID NO 39858 | CATAACTCTCTAAACAATTCAG | TTG | chr6 | 160658650 | 160658671 | 160658667 | 160658672 | + |
| SEQ ID NO 39859 | TCTAAACAATTCAGGCCAAGTA | CTC | chr6 | 160658658 | 160658679 | 160658675 | 160658680 | + |
| SEQ ID NO 39860 | TAAACAATTCAGGCCAAGTACT | CTC | chr6 | 160658660 | 160658681 | 160658677 | 160658682 | + |
| SEQ ID NO 39861 | AACAATTCAGGCCAAGTACTAT | CTA | chr6 | 160658662 | 160658683 | 160658679 | 160658684 | + |
| SEQ ID NO 39862 | AGGCCAAGTACTATCAGTGTTC | TTC | chr6 | 160658670 | 160658691 | 160658687 | 160658692 | + |
| SEQ ID NO 39863 | TCAGTGTTCTCCATACTATTAG | CTA | chr6 | 160658683 | 160658704 | 160658700 | 160658705 | + |
| SEQ ID NO 39864 | TCCATACTATTAGAAGTAGAGT | TTC | chr6 | 160658692 | 160658713 | 160658709 | 160658714 | + |
| SEQ ID NO 39865 | CATACTATTAGAAGTAGAGTCC | CTC | chr6 | 160658694 | 160658715 | 160658711 | 160658716 | + |
| SEQ ID NO 39866 | TTAGAAGTAGAGTCCTTAGCAT | CTA | chr6 | 160658701 | 160658722 | 160658718 | 160658723 | + |
| SEQ ID NO 39867 | GAAGTAGAGTCCTTAGCATTTT | TTA | chr6 | 160658704 | 160658725 | 160658721 | 160658726 | + |
| SEQ ID NO 39868 | AGCATTTTTGGTCTAATCATA | CTT | chr6 | 160658718 | 160658739 | 160658735 | 160658740 | + |
| SEQ ID NO 39869 | GCATTTTTGGTCTAATCATAT | TTA | chr6 | 160658719 | 160658740 | 160658736 | 160658741 | + |
| SEQ ID NO 39870 | TTTGGTCTAATCATATTAATCA | TTT | chr6 | 160658725 | 160658746 | 160658742 | 160658747 | + |
| SEQ ID NO 39871 | TTGGTCTAATCATATTAATCAG | TTT | chr6 | 160658726 | 160658747 | 160658743 | 160658748 | + |
| SEQ ID NO 39872 | TGGTCTAATCATATTAATCAGC | TTT | chr6 | 160658727 | 160658748 | 160658744 | 160658749 | + |
| SEQ ID NO 39873 | GGTCTAATCATATTAATCAGCC | TTT | chr6 | 160658728 | 160658749 | 160658745 | 160658750 | + |
| SEQ ID NO 39874 | GTCTAATCATATTAATCAGCCA | TTG | chr6 | 160658729 | 160658750 | 160658746 | 160658751 | + |
| SEQ ID NO 39875 | ATCATATTAATCAGCCAACACC | CTA | chr6 | 160658734 | 160658755 | 160658751 | 160658756 | + |
| SEQ ID NO 39876 | ATCAGCCAACACCAGAAGTCCC | TTA | chr6 | 160658743 | 160658764 | 160658760 | 160658765 | + |

Figure 60 (Cont'd)

| | | | | | | | | |
|---|---|---|---|---|---|---|---|---|
| SEQ ID NO 39877 | CATCCTTAATATTCTGTTCCTC | TTC | chr6 | 160658784 | 160658805 | 160658801 | 160658806 | + |
| SEQ ID NO 39878 | AATATTCTGTTCCTCAAGAACC | CTT | chr6 | 160658791 | 160658812 | 160658808 | 160658813 | + |
| SEQ ID NO 39879 | ATATTCTGTTCCTCAAGAACCA | TTA | chr6 | 160658792 | 160658813 | 160658809 | 160658814 | + |
| SEQ ID NO 39880 | TGTTCCTCAAGAACCACTTCTG | TTC | chr6 | 160658798 | 160658819 | 160658815 | 160658820 | + |
| SEQ ID NO 39881 | TTCCTCAAGAACCACTTCTGGT | CTG | chr6 | 160658800 | 160658821 | 160658817 | 160658822 | + |
| SEQ ID NO 39882 | CTCAAGAACCACTTCTGGTATG | TTC | chr6 | 160658803 | 160658824 | 160658820 | 160658825 | + |
| SEQ ID NO 39883 | AAGAACCACTTCTGGTATGAAA | CTC | chr6 | 160658806 | 160658827 | 160658823 | 160658828 | + |
| SEQ ID NO 39884 | CTGGTATGAAAATCTGTATTAG | CTT | chr6 | 160658817 | 160658838 | 160658834 | 160658839 | + |
| SEQ ID NO 39885 | TGGTATGAAAATCTGTATTAGT | TTC | chr6 | 160658818 | 160658839 | 160658835 | 160658840 | + |
| SEQ ID NO 39886 | GTATGAAAATCTGTATTAGTCG | CTG | chr6 | 160658820 | 160658841 | 160658837 | 160658842 | + |
| SEQ ID NO 39887 | TATTAGTCGGGGTTCTCTAGAG | CTG | chr6 | 160658833 | 160658854 | 160658850 | 160658855 | + |
| SEQ ID NO 39888 | GTCGGGGTTCTCTAGAGGGACA | TTA | chr6 | 160658838 | 160658859 | 160658855 | 160658860 | + |
| SEQ ID NO 39889 | TCTAGAGGGACAGAACTAATAG | TTC | chr6 | 160658848 | 160658869 | 160658865 | 160658870 | + |
| SEQ ID NO 39890 | TAGAGGGACAGAACTAATAGGA | CTC | chr6 | 160658850 | 160658871 | 160658867 | 160658872 | + |
| SEQ ID NO 39891 | GAGGGACAGAACTAATAGGAGA | CTA | chr6 | 160658852 | 160658873 | 160658869 | 160658874 | + |
| SEQ ID NO 39892 | ATAGGAGATTATATATATATAT | CTA | chr6 | 160658866 | 160658887 | 160658883 | 160658888 | + |
| SEQ ID NO 39893 | TATATATATATATGAGAGAG | TTA | chr6 | 160658877 | 160658898 | 160658894 | 160658899 | + |
| SEQ ID NO 39894 | TATCTATCTATAGATATAGATA | CTA | chr6 | 160658948 | 160658969 | 160658965 | 160658970 | + |
| SEQ ID NO 39895 | TCTATAGATATAGATATACTCA | CTA | chr6 | 160658954 | 160658975 | 160658971 | 160658976 | + |
| SEQ ID NO 39896 | TAGATATAGATATACTCACACA | CTA | chr6 | 160658958 | 160658979 | 160658975 | 160658980 | + |
| SEQ ID NO 39897 | ACACAAAGGGGAGCTTATTAAG | CTC | chr6 | 160658975 | 160658996 | 160658992 | 160658997 | + |
| SEQ ID NO 39898 | ATTAAGTGGTATTAACTCACAA | CTT | chr6 | 160658991 | 160659012 | 160659008 | 160659013 | + |
| SEQ ID NO 39899 | TTAAGTGGTATTAACTCACAAG | TTA | chr6 | 160658992 | 160659013 | 160659009 | 160659014 | + |
| SEQ ID NO 39900 | AGTGGTATTAACTCACAAGATT | TTA | chr6 | 160658995 | 160659016 | 160659012 | 160659017 | + |
| SEQ ID NO 39901 | ACTCACAAGATTACAAGGTCCC | TTA | chr6 | 160659005 | 160659026 | 160659022 | 160659027 | + |
| SEQ ID NO 39902 | ACAAGATTACAAGGTCCCATAA | CTC | chr6 | 160659009 | 160659030 | 160659026 | 160659031 | + |
| SEQ ID NO 39903 | CAAGGTCCCATAATAGGCCACC | TTA | chr6 | 160659018 | 160659039 | 160659035 | 160659040 | + |
| SEQ ID NO 39904 | CAATCTGAGGAGCAAGGAAGAC | CTG | chr6 | 160659042 | 160659063 | 160659059 | 160659064 | + |
| SEQ ID NO 39905 | AGGAGCAAGGAAGACAGTCCAA | CTG | chr6 | 160659049 | 160659070 | 160659066 | 160659071 | + |
| SEQ ID NO 39906 | AAGAACTTGGAGTCCGATGTTC | CTG | chr6 | 160659083 | 160659104 | 160659100 | 160659105 | + |
| SEQ ID NO 39907 | GGAGTCCGATGTTCAAGAGCAG | CTT | chr6 | 160659091 | 160659112 | 160659108 | 160659113 | + |
| SEQ ID NO 39908 | GAGTCCGATGTTCAAGAGCAGG | TTG | chr6 | 160659092 | 160659113 | 160659109 | 160659114 | + |
| SEQ ID NO 39909 | AAGAGCAGGAAGGATCCAGCAC | TTC | chr6 | 160659105 | 160659126 | 160659122 | 160659127 | + |
| SEQ ID NO 39910 | GGAGGCTAAGCCAGTCTAGCCT | CTG | chr6 | 160659146 | 160659167 | 160659163 | 160659168 | + |
| SEQ ID NO 39911 | AGCCAGTCTAGCCTTTTTACAT | CTA | chr6 | 160659154 | 160659175 | 160659171 | 160659176 | + |
| SEQ ID NO 39912 | GCCTTTTTACATTTTTCTGCCA | CTA | chr6 | 160659164 | 160659185 | 160659181 | 160659186 | + |
| SEQ ID NO 39913 | TTTACATTTTTCTGCCAGCTTT | CTT | chr6 | 160659169 | 160659190 | 160659186 | 160659191 | + |
| SEQ ID NO 39914 | TTACATTTTTCTGCCAGCTTTA | TTT | chr6 | 160659170 | 160659191 | 160659187 | 160659192 | + |
| SEQ ID NO 39915 | TACATTTTTCTGCCAGCTTTAT | TTT | chr6 | 160659171 | 160659192 | 160659188 | 160659193 | + |
| SEQ ID NO 39916 | ACATTTTTCTGCCAGCTTTATA | TTT | chr6 | 160659172 | 160659193 | 160659189 | 160659194 | + |
| SEQ ID NO 39917 | CATTTTTCTGCCAGCTTTATAT | TTA | chr6 | 160659173 | 160659194 | 160659190 | 160659195 | + |
| SEQ ID NO 39918 | TTCTGCCAGCTTTATATTCTGG | TTT | chr6 | 160659178 | 160659199 | 160659195 | 160659200 | + |
| SEQ ID NO 39919 | TCTGCCAGCTTTATATTCTGGC | TTT | chr6 | 160659179 | 160659200 | 160659196 | 160659201 | + |
| SEQ ID NO 39920 | CTGCCAGCTTTATATTCTGGCT | TTT | chr6 | 160659180 | 160659201 | 160659197 | 160659202 | + |
| SEQ ID NO 39921 | TGCCAGCTTTATATTCTGGCTC | TTC | chr6 | 160659181 | 160659202 | 160659198 | 160659203 | + |
| SEQ ID NO 39922 | CCAGCTTTATATTCTGGCTCTA | CTG | chr6 | 160659183 | 160659204 | 160659200 | 160659205 | + |
| SEQ ID NO 39923 | TATATTCTGGCTCTACAGCTTG | CTT | chr6 | 160659190 | 160659211 | 160659207 | 160659212 | + |
| SEQ ID NO 39924 | ATATTCTGGCTCTACAGCTTGG | TTT | chr6 | 160659191 | 160659212 | 160659208 | 160659213 | + |
| SEQ ID NO 39925 | TATTCTGGCTCTACAGCTTGGG | TTA | chr6 | 160659192 | 160659213 | 160659209 | 160659214 | + |
| SEQ ID NO 39926 | TGGCTCTACAGCTTGGGGGCAG | TTC | chr6 | 160659197 | 160659218 | 160659214 | 160659219 | + |
| SEQ ID NO 39927 | GCTCTACAGCTTGGGGGCAGCA | CTG | chr6 | 160659199 | 160659220 | 160659216 | 160659221 | + |
| SEQ ID NO 39928 | TACAGCTTGGGGGCAGCAGGGG | CTC | chr6 | 160659203 | 160659224 | 160659220 | 160659225 | + |
| SEQ ID NO 39929 | CAGCTTGGGGGCAGCAGGGGCA | CTA | chr6 | 160659205 | 160659226 | 160659222 | 160659227 | + |
| SEQ ID NO 39930 | GGGGGCAGCAGGGGCAGGGGCC | CTT | chr6 | 160659211 | 160659232 | 160659228 | 160659233 | + |
| SEQ ID NO 39931 | GGGGCAGCAGGGGCAGGGGCCT | TTG | chr6 | 160659212 | 160659233 | 160659229 | 160659234 | + |
| SEQ ID NO 39932 | AGGGTGCTTGCAGGGATGACAC | CTC | chr6 | 160659235 | 160659256 | 160659252 | 160659257 | + |
| SEQ ID NO 39933 | GCAGGGATGACACACTGGCCTC | CTT | chr6 | 160659244 | 160659265 | 160659261 | 160659266 | + |
| SEQ ID NO 39934 | CAGGGATGACACACTGGCCTCT | TTG | chr6 | 160659245 | 160659266 | 160659262 | 160659267 | + |

Figure 60 (Cont'd)

| | | | | | | | | |
|---|---|---|---|---|---|---|---|---|
| SEQ ID NO 39935 | GCCTCTTTTCCATAGGGTGGCT | CTG | chr6 | 160659261 | 160659282 | 160659278 | 160659283 | + |
| SEQ ID NO 39936 | TTTTCCATAGGGTGGCTGGGGC | CTC | chr6 | 160659266 | 160659287 | 160659283 | 160659288 | + |
| SEQ ID NO 39937 | TTCCATAGGGTGGCTGGGGCAC | CTT | chr6 | 160659268 | 160659289 | 160659285 | 160659290 | + |
| SEQ ID NO 39938 | TCCATAGGGTGGCTGGGGCACA | TTT | chr6 | 160659269 | 160659290 | 160659286 | 160659291 | + |
| SEQ ID NO 39939 | CCATAGGGTGGCTGGGGCACAC | TTT | chr6 | 160659270 | 160659291 | 160659287 | 160659292 | + |
| SEQ ID NO 39940 | CATAGGGTGGCTGGGGCACACT | TTC | chr6 | 160659271 | 160659292 | 160659288 | 160659293 | + |
| SEQ ID NO 39941 | GGGCACACTGGGTGTGAGTAA | CTG | chr6 | 160659284 | 160659305 | 160659301 | 160659306 | + |
| SEQ ID NO 39942 | GGGTGTGAGTAAAGCACTCAGG | CTG | chr6 | 160659294 | 160659315 | 160659311 | 160659316 | + |
| SEQ ID NO 39943 | AGGATCTTTTTCCTTCCCTAG | CTC | chr6 | 160659313 | 160659334 | 160659330 | 160659335 | + |
| SEQ ID NO 39944 | TTTTCCTTCCCTAGTCCAAGTA | CTT | chr6 | 160659321 | 160659342 | 160659338 | 160659343 | + |
| SEQ ID NO 39945 | TTTCCTTCCCTAGTCCAAGTAC | TTT | chr6 | 160659322 | 160659343 | 160659339 | 160659344 | + |
| SEQ ID NO 39946 | TTCCTTCCCTAGTCCAAGTACA | TTT | chr6 | 160659323 | 160659344 | 160659340 | 160659345 | + |
| SEQ ID NO 39947 | TCCTTCCCTAGTCCAAGTACAG | TTT | chr6 | 160659324 | 160659345 | 160659341 | 160659346 | + |
| SEQ ID NO 39948 | CCTTCCCTAGTCCAAGTACAGC | TTT | chr6 | 160659325 | 160659346 | 160659342 | 160659347 | + |
| SEQ ID NO 39949 | CTTCCCTAGTCCAAGTACAGCA | TTC | chr6 | 160659326 | 160659347 | 160659343 | 160659348 | + |
| SEQ ID NO 39950 | CCCTAGTCCAAGTACAGCAAGG | CTT | chr6 | 160659329 | 160659350 | 160659346 | 160659351 | + |
| SEQ ID NO 39951 | CCTAGTCCAAGTACAGCAAGGG | TTC | chr6 | 160659330 | 160659351 | 160659347 | 160659352 | + |
| SEQ ID NO 39952 | GTCCAAGTACAGCAAGGGCAGT | CTA | chr6 | 160659334 | 160659355 | 160659351 | 160659356 | + |
| SEQ ID NO 39953 | CAGTGTTAGTGGCAGAAGGACT | CTG | chr6 | 160659363 | 160659384 | 160659380 | 160659385 | + |
| SEQ ID NO 39954 | GTGGCAGAAGGACTTTCAGTCA | TTA | chr6 | 160659371 | 160659392 | 160659388 | 160659393 | + |
| SEQ ID NO 39955 | TCAGTCACCTCTGGGAGCTTCA | CTT | chr6 | 160659386 | 160659407 | 160659403 | 160659408 | + |
| SEQ ID NO 39956 | CAGTCACCTCTGGGAGCTTCAC | TTT | chr6 | 160659387 | 160659408 | 160659404 | 160659409 | + |
| SEQ ID NO 39957 | AGTCACCTCTGGGAGCTTCACC | TTC | chr6 | 160659388 | 160659409 | 160659405 | 160659410 | + |
| SEQ ID NO 39958 | TGGGAGCTTCACCCCACAAAAA | CTC | chr6 | 160659397 | 160659418 | 160659414 | 160659419 | + |
| SEQ ID NO 39959 | GGAGCTTCACCCCACAAAAACA | CTG | chr6 | 160659399 | 160659420 | 160659416 | 160659421 | + |
| SEQ ID NO 39960 | CACCCCACAAAAACACAGAGTG | CTT | chr6 | 160659406 | 160659427 | 160659423 | 160659428 | + |
| SEQ ID NO 39961 | ACCCCACAAAAACACAGAGTGC | TTC | chr6 | 160659407 | 160659428 | 160659424 | 160659429 | + |
| SEQ ID NO 39962 | AACTGAGTTCGAGGTGCCTGCA | TTC | chr6 | 160659446 | 160659467 | 160659463 | 160659468 | + |
| SEQ ID NO 39963 | AGTTCGAGGTGCCTGCACTGTG | CTG | chr6 | 160659451 | 160659472 | 160659468 | 160659473 | + |
| SEQ ID NO 39964 | GAGGTGCCTGCACTGTGGGCCC | TTC | chr6 | 160659456 | 160659477 | 160659473 | 160659478 | + |
| SEQ ID NO 39965 | CACTGTGGGCCCAAGCCAGGAG | CTG | chr6 | 160659466 | 160659487 | 160659483 | 160659488 | + |
| SEQ ID NO 39966 | TGGGCCCAAGCCAGGAGCCTTG | CTG | chr6 | 160659471 | 160659492 | 160659488 | 160659493 | + |
| SEQ ID NO 39967 | GCCTGGTGAAGAGTAGCAGGTG | CTT | chr6 | 160659492 | 160659513 | 160659509 | 160659514 | + |
| SEQ ID NO 39968 | CCTGGTGAAGAGTAGCAGGTGA | TTG | chr6 | 160659493 | 160659514 | 160659510 | 160659515 | + |
| SEQ ID NO 39969 | GTGAAGAGTAGCAGGTGAAAGC | CTG | chr6 | 160659497 | 160659518 | 160659514 | 160659519 | + |
| SEQ ID NO 39970 | ACAAGAAAGAGAAACTGGAATT | CTC | chr6 | 160659521 | 160659542 | 160659538 | 160659543 | + |
| SEQ ID NO 39971 | GAATTCTTTCCCTGCTGTGTGC | CTG | chr6 | 160659538 | 160659559 | 160659555 | 160659560 | + |
| SEQ ID NO 39972 | TTTCCCTGCTGTGTGCTGGAGG | TTC | chr6 | 160659544 | 160659565 | 160659561 | 160659566 | + |
| SEQ ID NO 39973 | TCCCTGCTGTGTGCTGGAGGTG | CTT | chr6 | 160659546 | 160659567 | 160659563 | 160659568 | + |
| SEQ ID NO 39974 | CCCTGCTGTGTGCTGGAGGTGT | TTT | chr6 | 160659547 | 160659568 | 160659564 | 160659569 | + |
| SEQ ID NO 39975 | CCTGCTGTGTGCTGGAGGTGTC | TTC | chr6 | 160659548 | 160659569 | 160659565 | 160659570 | + |
| SEQ ID NO 39976 | CTGTGTGCTGGAGGTGTCAGGG | CTG | chr6 | 160659552 | 160659573 | 160659569 | 160659574 | + |
| SEQ ID NO 39977 | TGTGCTGGAGGTGTCAGGGAAG | CTG | chr6 | 160659555 | 160659576 | 160659572 | 160659577 | + |
| SEQ ID NO 39978 | GAGGTGTCAGGGAAGTGGCCAG | CTG | chr6 | 160659562 | 160659583 | 160659579 | 160659584 | + |
| SEQ ID NO 39979 | CTTTCTCAAGCCCAAGGGCATT | CTT | chr6 | 160659591 | 160659612 | 160659608 | 160659613 | + |
| SEQ ID NO 39980 | TTTCTCAAGCCCAAGGGCATTA | TTC | chr6 | 160659592 | 160659613 | 160659609 | 160659614 | + |
| SEQ ID NO 39981 | TCTCAAGCCCAAGGGCATTAAC | CTT | chr6 | 160659594 | 160659615 | 160659611 | 160659616 | + |
| SEQ ID NO 39982 | CTCAAGCCCAAGGGCATTAACG | TTT | chr6 | 160659595 | 160659616 | 160659612 | 160659617 | + |
| SEQ ID NO 39983 | TCAAGCCCAAGGGCATTAACGG | TTC | chr6 | 160659596 | 160659617 | 160659613 | 160659618 | + |
| SEQ ID NO 39984 | AAGCCCAAGGGCATTAACGGTG | CTC | chr6 | 160659598 | 160659619 | 160659615 | 160659620 | + |
| SEQ ID NO 39985 | ACGGTGGTACTGCTGCAGCTGA | TTA | chr6 | 160659614 | 160659635 | 160659631 | 160659636 | + |
| SEQ ID NO 39986 | CTGCAGCTGAAATGGCAGAGGG | CTG | chr6 | 160659626 | 160659647 | 160659643 | 160659648 | + |
| SEQ ID NO 39987 | CAGCTGAAATGGCAGAGGGCT | CTG | chr6 | 160659629 | 160659650 | 160659646 | 160659651 | + |
| SEQ ID NO 39988 | AAATGGCAGAGGGCTGTGGGT | CTG | chr6 | 160659635 | 160659656 | 160659652 | 160659657 | + |
| SEQ ID NO 39989 | TGGGTTGTCTCTTGGATTTCCT | CTG | chr6 | 160659652 | 160659673 | 160659669 | 160659674 | + |
| SEQ ID NO 39990 | TCTCTTGGATTTCCTCCCCAGA | TTG | chr6 | 160659659 | 160659680 | 160659676 | 160659681 | + |
| SEQ ID NO 39991 | TTGGATTTCCTCCCCAGAGAAG | CTC | chr6 | 160659663 | 160659684 | 160659680 | 160659685 | + |
| SEQ ID NO 39992 | GGATTTCCTCCCCAGAGAAGCA | CTT | chr6 | 160659665 | 160659686 | 160659682 | 160659687 | + |

Figure 60 (Cont'd)

| SEQ ID NO 39993 | GATTTCCTCCCCAGAGAAGCAC | TTG | chr6 | 160659666 | 160659687 | 160659683 | 160659688 | + |
| SEQ ID NO 39994 | CCTCCCCAGAGAAGCACAGAGC | TTT | chr6 | 160659671 | 160659692 | 160659688 | 160659693 | + |
| SEQ ID NO 39995 | CTCCCCAGAGAAGCACAGAGCC | TTC | chr6 | 160659672 | 160659693 | 160659689 | 160659694 | + |
| SEQ ID NO 39996 | CCCAGAGAAGCACAGAGCCAAC | CTC | chr6 | 160659675 | 160659696 | 160659692 | 160659697 | + |
| SEQ ID NO 39997 | ACTAAAATGTTCAGGCAGGGCC | CTG | chr6 | 160659701 | 160659722 | 160659718 | 160659723 | + |
| SEQ ID NO 39998 | AAATGTTCAGGCAGGGCCAGGG | CTA | chr6 | 160659705 | 160659726 | 160659722 | 160659727 | + |
| SEQ ID NO 39999 | AGGCAGGGCCAGGGTGGCTGTG | TTC | chr6 | 160659713 | 160659734 | 160659730 | 160659735 | + |
| SEQ ID NO 40000 | TGCTCTGCCCAGTGAGGAATAG | CTG | chr6 | 160659733 | 160659754 | 160659750 | 160659755 | + |
| SEQ ID NO 40001 | TGCCCAGTGAGGAATAGTAGGG | CTC | chr6 | 160659738 | 160659759 | 160659755 | 160659760 | + |
| SEQ ID NO 40002 | CCCAGTGAGGAATAGTAGGGGC | CTG | chr6 | 160659740 | 160659761 | 160659757 | 160659762 | + |
| SEQ ID NO 40003 | TTCCATAAGGCAGCTACACTGT | CTT | chr6 | 160659794 | 160659815 | 160659811 | 160659816 | + |
| SEQ ID NO 40004 | TCCATAAGGCAGCTACACTGTG | TTT | chr6 | 160659795 | 160659816 | 160659812 | 160659817 | + |
| SEQ ID NO 40005 | CCATAAGGCAGCTACACTGTGC | TTT | chr6 | 160659796 | 160659817 | 160659813 | 160659818 | + |
| SEQ ID NO 40006 | CATAAGGCAGCTACACTGTGCT | TTC | chr6 | 160659797 | 160659818 | 160659814 | 160659819 | + |
| SEQ ID NO 40007 | CACTGTGCTGGAGGTCCGTGAG | CTA | chr6 | 160659810 | 160659831 | 160659827 | 160659832 | + |
| SEQ ID NO 40008 | TGCTGGAGGTCCGTGAGAGTCC | CTG | chr6 | 160659815 | 160659836 | 160659832 | 160659837 | + |
| SEQ ID NO 40009 | GAGGTCCGTGAGAGTCCTGAAG | CTG | chr6 | 160659820 | 160659841 | 160659837 | 160659842 | + |
| SEQ ID NO 40010 | AAGCTCCTCGCTCCCTCCTGAG | CTG | chr6 | 160659839 | 160659860 | 160659856 | 160659861 | + |
| SEQ ID NO 40011 | CTCGCTCCCTCCTGAGCCCATA | CTC | chr6 | 160659845 | 160659866 | 160659862 | 160659867 | + |
| SEQ ID NO 40012 | GCTCCCTCCTGAGCCCATACTT | CTC | chr6 | 160659848 | 160659869 | 160659865 | 160659870 | + |
| SEQ ID NO 40013 | CCTCCTGAGCCCATACTTTAAT | CTC | chr6 | 160659852 | 160659873 | 160659869 | 160659874 | + |
| SEQ ID NO 40014 | CTGAGCCCATACTTTAATCTCA | CTC | chr6 | 160659856 | 160659877 | 160659873 | 160659878 | + |
| SEQ ID NO 40015 | AGCCCATACTTTAATCTCAAGA | CTG | chr6 | 160659859 | 160659880 | 160659876 | 160659881 | + |
| SEQ ID NO 40016 | TAATCTCAAGAGTTTGAGATAA | CTT | chr6 | 160659870 | 160659891 | 160659887 | 160659892 | + |
| SEQ ID NO 40017 | AATCTCAAGAGTTTGAGATAAA | TTT | chr6 | 160659871 | 160659892 | 160659888 | 160659893 | + |
| SEQ ID NO 40018 | ATCTCAAGAGTTTGAGATAAAC | TTA | chr6 | 160659872 | 160659893 | 160659889 | 160659894 | + |
| SEQ ID NO 40019 | AAGAGTTTGAGATAAACAGTGG | CTC | chr6 | 160659877 | 160659898 | 160659894 | 160659899 | + |
| SEQ ID NO 40020 | GAGATAAACAGTGGTAAGGAAG | TTT | chr6 | 160659885 | 160659906 | 160659902 | 160659907 | + |
| SEQ ID NO 40021 | AGATAAACAGTGGTAAGGAAGA | TTG | chr6 | 160659886 | 160659907 | 160659903 | 160659908 | + |
| SEQ ID NO 40022 | ATGAAACCCAGGAAGATAAGTC | CTA | chr6 | 160659928 | 160659949 | 160659945 | 160659950 | + |
| SEQ ID NO 40023 | CAACCTAAAGAAATACTTTTTA | TTC | chr6 | 160659968 | 160659989 | 160659985 | 160659990 | + |
| SEQ ID NO 40024 | AAGAAATACTTTTTAAAAATCA | CTA | chr6 | 160659975 | 160659996 | 160659992 | 160659997 | + |
| SEQ ID NO 40025 | TTTAAAAATCATATTTATAGAG | CTT | chr6 | 160659986 | 160660007 | 160660003 | 160660008 | + |
| SEQ ID NO 40026 | TTAAAAATCATATTTATAGAGG | TTT | chr6 | 160659987 | 160660008 | 160660004 | 160660009 | + |
| SEQ ID NO 40027 | TAAAAATCATATTTATAGAGGT | TTT | chr6 | 160659988 | 160660009 | 160660005 | 160660010 | + |
| SEQ ID NO 40028 | AAAAATCATATTTATAGAGGTT | TTT | chr6 | 160659989 | 160660010 | 160660006 | 160660011 | + |
| SEQ ID NO 40029 | AAAATCATATTTATAGAGGTTT | TTA | chr6 | 160659990 | 160660011 | 160660007 | 160660012 | + |
| SEQ ID NO 40030 | ATAGAGGTTTGCAGTGATACTA | TTT | chr6 | 160660002 | 160660023 | 160660019 | 160660024 | + |
| SEQ ID NO 40031 | TAGAGGTTTGCAGTGATACTAA | TTA | chr6 | 160660003 | 160660024 | 160660020 | 160660025 | + |
| SEQ ID NO 40032 | GCAGTGATACTAAAGACAATAT | TTT | chr6 | 160660012 | 160660033 | 160660029 | 160660034 | + |
| SEQ ID NO 40033 | CAGTGATACTAAAGACAATATT | TTG | chr6 | 160660013 | 160660034 | 160660030 | 160660035 | + |
| SEQ ID NO 40034 | AAGACAATATTGCAAATCATTA | CTA | chr6 | 160660024 | 160660045 | 160660041 | 160660046 | + |
| SEQ ID NO 40035 | CAAATCATTATTAAGAATACAA | TTG | chr6 | 160660036 | 160660057 | 160660053 | 160660058 | + |
| SEQ ID NO 40036 | TTAAGAATACAAGAAGTACAAT | TTA | chr6 | 160660046 | 160660067 | 160660063 | 160660068 | + |
| SEQ ID NO 40037 | AGAATACAAGAAGTACAATGTT | TTA | chr6 | 160660049 | 160660070 | 160660066 | 160660071 | + |
| SEQ ID NO 40038 | CTTGTTTCTTTAACACCTGTGA | TTT | chr6 | 160660072 | 160660093 | 160660089 | 160660094 | + |
| SEQ ID NO 40039 | TTGTTTCTTTAACACCTGTGAT | TTC | chr6 | 160660073 | 160660094 | 160660090 | 160660095 | + |
| SEQ ID NO 40040 | GTTTCTTTAACACCTGTGATAC | CTT | chr6 | 160660075 | 160660096 | 160660092 | 160660097 | + |
| SEQ ID NO 40041 | TTTCTTTAACACCTGTGATACA | TTG | chr6 | 160660076 | 160660097 | 160660093 | 160660098 | + |
| SEQ ID NO 40042 | CTTTAACACCTGTGATACAGGT | TTT | chr6 | 160660079 | 160660100 | 160660096 | 160660101 | + |
| SEQ ID NO 40043 | TTTAACACCTGTGATACAGGTG | TTC | chr6 | 160660080 | 160660101 | 160660097 | 160660102 | + |
| SEQ ID NO 40044 | TAACACCTGTGATACAGGTGTT | CTT | chr6 | 160660082 | 160660103 | 160660099 | 160660104 | + |
| SEQ ID NO 40045 | AACACCTGTGATACAGGTGTTT | TTT | chr6 | 160660083 | 160660104 | 160660100 | 160660105 | + |
| SEQ ID NO 40046 | ACACCTGTGATACAGGTGTTTG | TTA | chr6 | 160660084 | 160660105 | 160660101 | 160660106 | + |
| SEQ ID NO 40047 | TGATACAGGTGTTTGATATGAA | CTG | chr6 | 160660091 | 160660112 | 160660108 | 160660113 | + |
| SEQ ID NO 40048 | GATATGAATTCTACGTAATGGC | TTT | chr6 | 160660105 | 160660126 | 160660122 | 160660127 | + |
| SEQ ID NO 40049 | ATATGAATTCTACGTAATGGCT | TTG | chr6 | 160660106 | 160660127 | 160660123 | 160660128 | + |
| SEQ ID NO 40050 | TACGTAATGGCTGCATTGCTTC | TTC | chr6 | 160660116 | 160660137 | 160660133 | 160660138 | + |

Figure 60 (Cont'd)

| SEQ ID NO 40051 | CGTAATGGCTGCATTGCTTCTT | CTA | chr6 | 160660118 | 160660139 | 160660135 | 160660140 | + |
|---|---|---|---|---|---|---|---|---|
| SEQ ID NO 40052 | CATTGCTTCTTGCCACCACCCA | CTG | chr6 | 160660129 | 160660150 | 160660146 | 160660151 | + |
| SEQ ID NO 40053 | CTTCTTGCCACCACCCAAAGAA | TTG | chr6 | 160660134 | 160660155 | 160660151 | 160660156 | + |
| SEQ ID NO 40054 | CTTGCCACCACCCAAAGAAGGT | CTT | chr6 | 160660137 | 160660158 | 160660154 | 160660159 | + |
| SEQ ID NO 40055 | TTGCCACCACCCAAAGAAGGTT | TTC | chr6 | 160660138 | 160660159 | 160660155 | 160660160 | + |
| SEQ ID NO 40056 | GCCACCACCCAAAGAAGGTTGT | CTT | chr6 | 160660140 | 160660161 | 160660157 | 160660162 | + |
| SEQ ID NO 40057 | CCACCACCCAAAGAAGGTTGTA | TTG | chr6 | 160660141 | 160660162 | 160660158 | 160660163 | + |
| SEQ ID NO 40058 | TATAGCACTCAGATGTATACTA | TTG | chr6 | 160660161 | 160660182 | 160660178 | 160660183 | + |
| SEQ ID NO 40059 | AGATGTATACTAACTGCAACCG | CTC | chr6 | 160660171 | 160660192 | 160660188 | 160660193 | + |
| SEQ ID NO 40060 | ACTGCAACCGTGTATCTCTTAG | CTA | chr6 | 160660183 | 160660204 | 160660200 | 160660205 | + |
| SEQ ID NO 40061 | CAACCGTGTATCTCTTAGGAAT | CTG | chr6 | 160660187 | 160660208 | 160660204 | 160660209 | + |
| SEQ ID NO 40062 | TTAGGAATTTCTCCTTTGCCCT | CTC | chr6 | 160660201 | 160660222 | 160660218 | 160660223 | + |
| SEQ ID NO 40063 | AGGAATTTCTCCTTTGCCCTCT | CTT | chr6 | 160660203 | 160660224 | 160660220 | 160660225 | + |
| SEQ ID NO 40064 | GGAATTTCTCCTTTGCCCTCTT | TTA | chr6 | 160660204 | 160660225 | 160660221 | 160660226 | + |
| SEQ ID NO 40065 | CTCCTTTGCCCTCTTCCCTCCC | TTT | chr6 | 160660211 | 160660232 | 160660228 | 160660233 | + |
| SEQ ID NO 40066 | TCCTTTGCCCTCTTCCCTCCCT | TTC | chr6 | 160660212 | 160660233 | 160660229 | 160660234 | + |
| SEQ ID NO 40067 | CTTTGCCCTCTTCCCTCCCTAT | CTC | chr6 | 160660214 | 160660235 | 160660231 | 160660236 | + |
| SEQ ID NO 40068 | TGCCCTCTTCCCTCCCTATCAG | CTT | chr6 | 160660217 | 160660238 | 160660234 | 160660239 | + |
| SEQ ID NO 40069 | GCCCTCTTCCCTCCCTATCAGC | TTT | chr6 | 160660218 | 160660239 | 160660235 | 160660240 | + |
| SEQ ID NO 40070 | CCCTCTTCCCTCCCTATCAGCA | TTG | chr6 | 160660219 | 160660240 | 160660236 | 160660241 | + |
| SEQ ID NO 40071 | TTCCCTCCCTATCAGCATGTAT | CTC | chr6 | 160660224 | 160660245 | 160660241 | 160660246 | + |
| SEQ ID NO 40072 | CCCTCCCTATCAGCATGTATCT | CTT | chr6 | 160660226 | 160660247 | 160660243 | 160660248 | + |
| SEQ ID NO 40073 | CCTCCCTATCAGCATGTATCTA | TTC | chr6 | 160660227 | 160660248 | 160660244 | 160660249 | + |
| SEQ ID NO 40074 | CCTATCAGCATGTATCTAGCAG | CTC | chr6 | 160660231 | 160660252 | 160660248 | 160660253 | + |
| SEQ ID NO 40075 | TCAGCATGTATCTAGCAGCATT | CTA | chr6 | 160660235 | 160660256 | 160660252 | 160660257 | + |
| SEQ ID NO 40076 | GCAGCATTCTGAAAAGTTAACT | CTA | chr6 | 160660249 | 160660270 | 160660266 | 160660271 | + |
| SEQ ID NO 40077 | TGAAAAGTTAACTGCACAGTGA | TTC | chr6 | 160660258 | 160660279 | 160660275 | 160660280 | + |
| SEQ ID NO 40078 | AAAAGTTAACTGCACAGTGAGC | CTG | chr6 | 160660260 | 160660281 | 160660277 | 160660282 | + |
| SEQ ID NO 40079 | ACTGCACAGTGAGCGACTGCTG | TTA | chr6 | 160660268 | 160660289 | 160660285 | 160660290 | + |
| SEQ ID NO 40080 | CACAGTGAGCGACTGCTGGGCA | CTG | chr6 | 160660272 | 160660293 | 160660289 | 160660294 | + |
| SEQ ID NO 40081 | CTGGGCATCTTAAGGGGCATTC | CTG | chr6 | 160660287 | 160660308 | 160660304 | 160660309 | + |
| SEQ ID NO 40082 | GGCATCTTAAGGGGCATTCTTT | CTG | chr6 | 160660290 | 160660311 | 160660307 | 160660312 | + |
| SEQ ID NO 40083 | AAGGGGCATTCTTTTCTACCTA | CTT | chr6 | 160660298 | 160660319 | 160660315 | 160660320 | + |
| SEQ ID NO 40084 | AGGGGCATTCTTTTCTACCTAG | TTA | chr6 | 160660299 | 160660320 | 160660316 | 160660321 | + |
| SEQ ID NO 40085 | TTTTCTACCTAGGTATTCCCCC | TTC | chr6 | 160660309 | 160660330 | 160660326 | 160660331 | + |
| SEQ ID NO 40086 | TTCTACCTAGGTATTCCCCCTC | CTT | chr6 | 160660311 | 160660332 | 160660328 | 160660333 | + |
| SEQ ID NO 40087 | TCTACCTAGGTATTCCCCCTCC | TTT | chr6 | 160660312 | 160660333 | 160660329 | 160660334 | + |
| SEQ ID NO 40088 | CTACCTAGGTATTCCCCCTCCT | TTT | chr6 | 160660313 | 160660334 | 160660330 | 160660335 | + |
| SEQ ID NO 40089 | TACCTAGGTATTCCCCCTCCTC | TTC | chr6 | 160660314 | 160660335 | 160660331 | 160660336 | + |
| SEQ ID NO 40090 | CCTAGGTATTCCCCCTCCTCCA | CTA | chr6 | 160660316 | 160660337 | 160660333 | 160660338 | + |
| SEQ ID NO 40091 | GGTATTCCCCCTCCTCCACTCA | CTA | chr6 | 160660320 | 160660341 | 160660337 | 160660342 | + |
| SEQ ID NO 40092 | CCCCTCCTCCACTCATGTCTAG | TTC | chr6 | 160660327 | 160660348 | 160660344 | 160660349 | + |
| SEQ ID NO 40093 | CTCCACTCATGTCTAGCATGCA | CTC | chr6 | 160660333 | 160660354 | 160660350 | 160660355 | + |
| SEQ ID NO 40094 | CACTCATGTCTAGCATGCAGGA | CTC | chr6 | 160660336 | 160660357 | 160660353 | 160660358 | + |
| SEQ ID NO 40095 | ATGTCTAGCATGCAGGACTTGG | CTC | chr6 | 160660341 | 160660362 | 160660358 | 160660363 | + |
| SEQ ID NO 40096 | GCATGCAGGACTTGGGTAATCT | CTA | chr6 | 160660348 | 160660369 | 160660365 | 160660370 | + |
| SEQ ID NO 40097 | GGGTAATCTCTGGGGTTTCAGA | CTT | chr6 | 160660361 | 160660382 | 160660378 | 160660383 | + |
| SEQ ID NO 40098 | GGTAATCTCTGGGGTTTCAGAT | TTG | chr6 | 160660362 | 160660383 | 160660379 | 160660384 | + |
| SEQ ID NO 40099 | TGGGGTTTCAGATTCTCCAGAC | CTC | chr6 | 160660371 | 160660392 | 160660388 | 160660393 | + |
| SEQ ID NO 40100 | GGGTTTCAGATTCTCCAGACCT | CTG | chr6 | 160660373 | 160660394 | 160660390 | 160660395 | + |
| SEQ ID NO 40101 | CAGATTCTCCAGACCTCCATTC | TTT | chr6 | 160660379 | 160660400 | 160660396 | 160660401 | + |
| SEQ ID NO 40102 | AGATTCTCCAGACCTCCATTCT | TTC | chr6 | 160660380 | 160660401 | 160660397 | 160660402 | + |
| SEQ ID NO 40103 | TCCAGACCTCCATTCTCTCAGG | TTC | chr6 | 160660386 | 160660407 | 160660403 | 160660408 | + |
| SEQ ID NO 40104 | CAGACCTCCATTCTCTCAGGGG | CTC | chr6 | 160660388 | 160660409 | 160660405 | 160660410 | + |
| SEQ ID NO 40105 | CATTCTCTCAGGGGCTTCCACC | CTC | chr6 | 160660396 | 160660417 | 160660413 | 160660418 | + |
| SEQ ID NO 40106 | TCTCAGGGGCTTCCACCTCCTG | TTC | chr6 | 160660401 | 160660422 | 160660418 | 160660423 | + |
| SEQ ID NO 40107 | TCAGGGGCTTCCACCTCCTGCT | CTC | chr6 | 160660403 | 160660424 | 160660420 | 160660425 | + |
| SEQ ID NO 40108 | AGGGGCTTCCACCTCCTGCTCA | CTC | chr6 | 160660405 | 160660426 | 160660422 | 160660427 | + |

Figure 60 (Cont'd)

| | | | | | | | | |
|---|---|---|---|---|---|---|---|---|
| SEQ ID NO 40109 | CCACCTCCTGCTCATATCTAGC | CTT | chr6 | 160660413 | 160660434 | 160660430 | 160660435 | + |
| SEQ ID NO 40110 | CACCTCCTGCTCATATCTAGCT | TTC | chr6 | 160660414 | 160660435 | 160660431 | 160660436 | + |
| SEQ ID NO 40111 | CTGCTCATATCTAGCTATCTGC | CTC | chr6 | 160660420 | 160660441 | 160660437 | 160660442 | + |
| SEQ ID NO 40112 | CTCATATCTAGCTATCTGCCTA | CTG | chr6 | 160660423 | 160660444 | 160660440 | 160660445 | + |
| SEQ ID NO 40113 | ATATCTAGCTATCTGCCTAGTC | CTC | chr6 | 160660426 | 160660447 | 160660443 | 160660448 | + |
| SEQ ID NO 40114 | GCTATCTGCCTAGTCTAACCAT | CTA | chr6 | 160660433 | 160660454 | 160660450 | 160660455 | + |
| SEQ ID NO 40115 | TCTGCCTAGTCTAACCATAAAA | CTA | chr6 | 160660437 | 160660458 | 160660454 | 160660459 | + |
| SEQ ID NO 40116 | CCTAGTCTAACCATAAAATCTT | CTG | chr6 | 160660441 | 160660462 | 160660458 | 160660463 | + |
| SEQ ID NO 40117 | GTCTAACCATAAAATCTTAAAT | CTA | chr6 | 160660445 | 160660466 | 160660462 | 160660467 | + |
| SEQ ID NO 40118 | ACCATAAAATCTTAAATAAGAA | CTA | chr6 | 160660450 | 160660471 | 160660467 | 160660472 | + |
| SEQ ID NO 40119 | AAATAAGAATAAATCATGTTTG | CTT | chr6 | 160660463 | 160660484 | 160660480 | 160660485 | + |
| SEQ ID NO 40120 | AATAAGAATAAATCATGTTTGC | TTA | chr6 | 160660464 | 160660485 | 160660481 | 160660486 | + |
| SEQ ID NO 40121 | GCTCTTGATTGCCATGTCATGA | TTT | chr6 | 160660484 | 160660505 | 160660501 | 160660506 | + |
| SEQ ID NO 40122 | CTCTTGATTGCCATGTCATGAT | TTG | chr6 | 160660485 | 160660506 | 160660502 | 160660507 | + |
| SEQ ID NO 40123 | TTGATTGCCATGTCATGATAAA | CTC | chr6 | 160660488 | 160660509 | 160660505 | 160660510 | + |
| SEQ ID NO 40124 | GATTGCCATGTCATGATAAAAA | CTT | chr6 | 160660490 | 160660511 | 160660507 | 160660512 | + |
| SEQ ID NO 40125 | ATTGCCATGTCATGATAAAAAA | TTG | chr6 | 160660491 | 160660512 | 160660508 | 160660513 | + |
| SEQ ID NO 40126 | CCATGTCATGATAAAAAAAATA | TTG | chr6 | 160660495 | 160660516 | 160660512 | 160660517 | + |
| SEQ ID NO 40127 | TGTTGCCAAGATTGATGTTGAT | CTG | chr6 | 160660538 | 160660559 | 160660555 | 160660560 | + |
| SEQ ID NO 40128 | CCAAGATTGATGTTGATCTGCT | TTG | chr6 | 160660543 | 160660564 | 160660560 | 160660565 | + |
| SEQ ID NO 40129 | ATGTTGATCTGCTAATCCCTGT | TTG | chr6 | 160660552 | 160660573 | 160660569 | 160660574 | + |
| SEQ ID NO 40130 | ATCTGCTAATCCCTGTGTAGAA | TTG | chr6 | 160660558 | 160660579 | 160660575 | 160660580 | + |
| SEQ ID NO 40131 | CTAATCCCTGTGTAGAAATGAA | CTG | chr6 | 160660563 | 160660584 | 160660580 | 160660585 | + |
| SEQ ID NO 40132 | ATCCCTGTGTAGAAATGAACCT | CTA | chr6 | 160660566 | 160660587 | 160660583 | 160660588 | + |
| SEQ ID NO 40133 | TGTAGAAATGAACCTTGGAGGC | CTG | chr6 | 160660573 | 160660594 | 160660590 | 160660595 | + |
| SEQ ID NO 40134 | GGAGGCCATTGTTTGATTTCTT | CTT | chr6 | 160660589 | 160660610 | 160660606 | 160660611 | + |
| SEQ ID NO 40135 | GAGGCCATTGTTTGATTTCTTA | TTG | chr6 | 160660590 | 160660611 | 160660607 | 160660612 | + |
| SEQ ID NO 40136 | TTTGATTTCTTACAATATGTGC | TTG | chr6 | 160660600 | 160660621 | 160660617 | 160660622 | + |
| SEQ ID NO 40137 | GATTTCTTACAATATGTGCATT | TTT | chr6 | 160660603 | 160660624 | 160660620 | 160660625 | + |
| SEQ ID NO 40138 | ATTTCTTACAATATGTGCATTG | TTG | chr6 | 160660604 | 160660625 | 160660621 | 160660626 | + |
| SEQ ID NO 40139 | CTTACAATATGTGCATTGGTTG | TTT | chr6 | 160660608 | 160660629 | 160660625 | 160660630 | + |
| SEQ ID NO 40140 | TTACAATATGTGCATTGGTTGT | TTC | chr6 | 160660609 | 160660630 | 160660626 | 160660631 | + |
| SEQ ID NO 40141 | ACAATATGTGCATTGGTTGTAA | CTT | chr6 | 160660611 | 160660632 | 160660628 | 160660633 | + |
| SEQ ID NO 40142 | CAATATGTGCATTGGTTGTAAC | TTA | chr6 | 160660612 | 160660633 | 160660629 | 160660634 | + |
| SEQ ID NO 40143 | GTTGTAACACTGTCACTTTGAC | TTG | chr6 | 160660626 | 160660647 | 160660643 | 160660648 | + |
| SEQ ID NO 40144 | TAACACTGTCACTTTGACAGTT | TTG | chr6 | 160660630 | 160660651 | 160660647 | 160660652 | + |
| SEQ ID NO 40145 | TCACTTTGACAGTTGATAAGCA | CTG | chr6 | 160660638 | 160660659 | 160660655 | 160660660 | + |
| SEQ ID NO 40146 | TGACAGTTGATAAGCATCTTCT | CTT | chr6 | 160660644 | 160660665 | 160660661 | 160660666 | + |
| SEQ ID NO 40147 | GACAGTTGATAAGCATCTTCTG | TTT | chr6 | 160660645 | 160660666 | 160660662 | 160660667 | + |
| SEQ ID NO 40148 | ACAGTTGATAAGCATCTTCTGA | TTG | chr6 | 160660646 | 160660667 | 160660663 | 160660668 | + |
| SEQ ID NO 40149 | ATAAGCATCTTCTGAATGGTCC | TTG | chr6 | 160660653 | 160660674 | 160660670 | 160660675 | + |
| SEQ ID NO 40150 | CTGAATGGTCCCTCCTTTAGTT | CTT | chr6 | 160660664 | 160660685 | 160660681 | 160660686 | + |
| SEQ ID NO 40151 | TGAATGGTCCCTCCTTTAGTTA | TTC | chr6 | 160660665 | 160660686 | 160660682 | 160660687 | + |
| SEQ ID NO 40152 | AATGGTCCCTCCTTTAGTTACA | CTG | chr6 | 160660667 | 160660688 | 160660684 | 160660689 | + |
| SEQ ID NO 40153 | CTTTAGTTACAAAAATGTTGGT | CTC | chr6 | 160660678 | 160660699 | 160660695 | 160660700 | + |
| SEQ ID NO 40154 | TAGTTACAAAAATGTTGGTGCA | CTT | chr6 | 160660681 | 160660702 | 160660698 | 160660703 | + |
| SEQ ID NO 40155 | AGTTACAAAAATGTTGGTGCAT | TTT | chr6 | 160660682 | 160660703 | 160660699 | 160660704 | + |
| SEQ ID NO 40156 | GTTACAAAAATGTTGGTGCATG | TTA | chr6 | 160660683 | 160660704 | 160660700 | 160660705 | + |
| SEQ ID NO 40157 | CAAAAATGTTGGTGCATGGATG | TTA | chr6 | 160660687 | 160660708 | 160660704 | 160660709 | + |
| SEQ ID NO 40158 | GTGCATGGATGATGTTGGGAAT | TTG | chr6 | 160660698 | 160660719 | 160660715 | 160660720 | + |
| SEQ ID NO 40159 | GGAATAAATAAAAGTGAACTA | TTG | chr6 | 160660715 | 160660736 | 160660732 | 160660737 | + |
| SEQ ID NO 40160 | AATTATGTTCTCATCTTGGGCA | CTA | chr6 | 160660737 | 160660758 | 160660754 | 160660759 | + |
| SEQ ID NO 40161 | TGTTCTCATCTTGGGCAAAAAT | TTA | chr6 | 160660742 | 160660763 | 160660759 | 160660764 | + |
| SEQ ID NO 40162 | TCATCTTGGGCAAAAATTAAGC | TTC | chr6 | 160660747 | 160660768 | 160660764 | 160660769 | + |
| SEQ ID NO 40163 | ATCTTGGGCAAAAATTAAGCAA | CTC | chr6 | 160660749 | 160660770 | 160660766 | 160660771 | + |
| SEQ ID NO 40164 | GGGCAAAAATTAAGCAAAAAAA | CTT | chr6 | 160660754 | 160660775 | 160660771 | 160660776 | + |
| SEQ ID NO 40165 | GGCAAAAATTAAGCAAAAAAAA | TTG | chr6 | 160660755 | 160660776 | 160660772 | 160660777 | + |
| SEQ ID NO 40166 | AGCAAAAAAAAAATGGAGGATA | TTA | chr6 | 160660766 | 160660787 | 160660783 | 160660788 | + |

Figure 60 (Cont'd)

| | | | | | | | | |
|---|---|---|---|---|---|---|---|---|
| SEQ ID NO 40167 | CTCCACAAAGAAGGCCATTTTT | CTC | chr6 | 160660796 | 160660817 | 160660813 | 160660818 | + |
| SEQ ID NO 40168 | CACAAAGAAGGCCATTTTTGTA | CTC | chr6 | 160660799 | 160660820 | 160660816 | 160660821 | + |
| SEQ ID NO 40169 | TTGTACTAGGCTTACTACAGTG | TTT | chr6 | 160660816 | 160660837 | 160660833 | 160660838 | + |
| SEQ ID NO 40170 | TGTACTAGGCTTACTACAGTGA | TTT | chr6 | 160660817 | 160660838 | 160660834 | 160660839 | + |
| SEQ ID NO 40171 | GTACTAGGCTTACTACAGTGAC | TTT | chr6 | 160660818 | 160660839 | 160660835 | 160660840 | + |
| SEQ ID NO 40172 | TACTAGGCTTACTACAGTGACA | TTG | chr6 | 160660819 | 160660840 | 160660836 | 160660841 | + |
| SEQ ID NO 40173 | GGCTTACTACAGTGACACACCA | CTA | chr6 | 160660824 | 160660845 | 160660841 | 160660846 | + |
| SEQ ID NO 40174 | ACTACAGTGACACACCACTATT | CTT | chr6 | 160660829 | 160660850 | 160660846 | 160660851 | + |
| SEQ ID NO 40175 | CTACAGTGACACACCACTATTA | TTA | chr6 | 160660830 | 160660851 | 160660847 | 160660852 | + |
| SEQ ID NO 40176 | CAGTGACACACCACTATTAGTT | CTA | chr6 | 160660833 | 160660854 | 160660850 | 160660855 | + |
| SEQ ID NO 40177 | TTAGTTGGGGAGAATTCAGTTT | CTA | chr6 | 160660849 | 160660870 | 160660866 | 160660871 | + |
| SEQ ID NO 40178 | GTTGGGGAGAATTCAGTTTTTC | TTA | chr6 | 160660852 | 160660873 | 160660869 | 160660874 | + |
| SEQ ID NO 40179 | GGGAGAATTCAGTTTTTCCAAG | TTG | chr6 | 160660856 | 160660877 | 160660873 | 160660878 | + |
| SEQ ID NO 40180 | AGTTTTTCCAAGGTGTTGATAG | TTC | chr6 | 160660866 | 160660887 | 160660883 | 160660888 | + |
| SEQ ID NO 40181 | TTCCAAGGTGTTGATAGGCATC | TTT | chr6 | 160660871 | 160660892 | 160660888 | 160660893 | + |
| SEQ ID NO 40182 | TCCAAGGTGTTGATAGGCATCC | TTT | chr6 | 160660872 | 160660893 | 160660889 | 160660894 | + |
| SEQ ID NO 40183 | CCAAGGTGTTGATAGGCATCCA | TTT | chr6 | 160660873 | 160660894 | 160660890 | 160660895 | + |
| SEQ ID NO 40184 | CAAGGTGTTGATAGGCATCCAG | TTC | chr6 | 160660874 | 160660895 | 160660891 | 160660896 | + |
| SEQ ID NO 40185 | ATAGGCATCCAGATTTCAGAGG | TTG | chr6 | 160660884 | 160660905 | 160660901 | 160660906 | + |
| SEQ ID NO 40186 | CAGAGGAAATTGTAAAAAAGCA | TTT | chr6 | 160660900 | 160660921 | 160660917 | 160660922 | + |
| SEQ ID NO 40187 | AGAGGAAATTGTAAAAAAGCAG | TTC | chr6 | 160660901 | 160660922 | 160660918 | 160660923 | + |
| SEQ ID NO 40188 | TAAAAAAGCAGAACCTGGGACC | TTG | chr6 | 160660912 | 160660933 | 160660929 | 160660934 | + |
| SEQ ID NO 40189 | GGACCAATACTGCCCACGATTT | CTG | chr6 | 160660929 | 160660950 | 160660946 | 160660951 | + |
| SEQ ID NO 40190 | CCCACGATTTTTCTTTGAGATC | CTG | chr6 | 160660941 | 160660962 | 160660958 | 160660963 | + |
| SEQ ID NO 40191 | TTCTTTGAGATCAAATCTGAGG | TTT | chr6 | 160660951 | 160660972 | 160660968 | 160660973 | + |
| SEQ ID NO 40192 | TCTTTGAGATCAAATCTGAGGC | TTT | chr6 | 160660952 | 160660973 | 160660969 | 160660974 | + |
| SEQ ID NO 40193 | CTTTGAGATCAAATCTGAGGCA | TTT | chr6 | 160660953 | 160660974 | 160660970 | 160660975 | + |
| SEQ ID NO 40194 | TTTGAGATCAAATCTGAGGCAA | TTC | chr6 | 160660954 | 160660975 | 160660971 | 160660976 | + |
| SEQ ID NO 40195 | TGAGATCAAATCTGAGGCAACA | CTT | chr6 | 160660956 | 160660977 | 160660973 | 160660978 | + |
| SEQ ID NO 40196 | GAGATCAAATCTGAGGCAACAA | TTT | chr6 | 160660957 | 160660978 | 160660974 | 160660979 | + |
| SEQ ID NO 40197 | AGATCAAATCTGAGGCAACAAA | TTG | chr6 | 160660958 | 160660979 | 160660975 | 160660980 | + |
| SEQ ID NO 40198 | AGGCAACAAATCTGTTCAAAAG | CTG | chr6 | 160660970 | 160660991 | 160660987 | 160660992 | + |
| SEQ ID NO 40199 | TTCAAAAGCTGCTTTCTGCCTG | CTG | chr6 | 160660984 | 160661005 | 160661001 | 160661006 | + |
| SEQ ID NO 40200 | AAAAGCTGCTTTCTGCCTGGTT | TTC | chr6 | 160660987 | 160661008 | 160661004 | 160661009 | + |
| SEQ ID NO 40201 | CTTTCTGCCTGGTTGTGGCAAA | CTG | chr6 | 160660995 | 160661016 | 160661012 | 160661017 | + |
| SEQ ID NO 40202 | TCTGCCTGGTTGTGGCAAAGGG | CTT | chr6 | 160660998 | 160661019 | 160661015 | 160661020 | + |
| SEQ ID NO 40203 | CTGCCTGGTTGTGGCAAAGGGT | TTT | chr6 | 160660999 | 160661020 | 160661016 | 160661021 | + |
| SEQ ID NO 40204 | TGCCTGGTTGTGGCAAAGGGTG | TTC | chr6 | 160661000 | 160661021 | 160661017 | 160661022 | + |
| SEQ ID NO 40205 | CCTGGTTGTGGCAAAGGGTGGC | CTG | chr6 | 160661002 | 160661023 | 160661019 | 160661024 | + |
| SEQ ID NO 40206 | GTTGTGGCAAAGGGTGGCCAAG | CTG | chr6 | 160661006 | 160661027 | 160661023 | 160661028 | + |
| SEQ ID NO 40207 | TGGCAAAGGGTGGCCAAGTGGG | TTG | chr6 | 160661010 | 160661031 | 160661027 | 160661032 | + |
| SEQ ID NO 40208 | AGCTGTGTTCCCATTGCAAGGC | CTC | chr6 | 160661036 | 160661057 | 160661053 | 160661058 | + |
| SEQ ID NO 40209 | TGTTCCCATTGCAAGGCTACTG | CTG | chr6 | 160661041 | 160661062 | 160661058 | 160661063 | + |
| SEQ ID NO 40210 | CCATTGCAAGGCTACTGAGCAT | TTC | chr6 | 160661046 | 160661067 | 160661063 | 160661068 | + |
| SEQ ID NO 40211 | CAAGGCTACTGAGCATCCCCTG | TTG | chr6 | 160661052 | 160661073 | 160661069 | 160661074 | + |
| SEQ ID NO 40212 | CTGAGCATCCCCTGTCCTGAGG | CTA | chr6 | 160661060 | 160661081 | 160661077 | 160661082 | + |
| SEQ ID NO 40213 | AGCATCCCCTGTCCTGAGGCTC | CTG | chr6 | 160661063 | 160661084 | 160661080 | 160661085 | + |
| SEQ ID NO 40214 | TCCTGAGGCTCCTTAGGACACC | CTG | chr6 | 160661074 | 160661095 | 160661091 | 160661096 | + |
| SEQ ID NO 40215 | AGGCTCCTTAGGACACCTGGCT | CTG | chr6 | 160661079 | 160661100 | 160661096 | 160661101 | + |
| SEQ ID NO 40216 | CTTAGGACACCTGGCTGAGCTT | CTC | chr6 | 160661085 | 160661106 | 160661102 | 160661107 | + |
| SEQ ID NO 40217 | AGGACACCTGGCTGAGCTTCAG | CTT | chr6 | 160661088 | 160661109 | 160661105 | 160661110 | + |
| SEQ ID NO 40218 | GGACACCTGGCTGAGCTTCAGC | TTA | chr6 | 160661089 | 160661110 | 160661106 | 160661111 | + |
| SEQ ID NO 40219 | GCTGAGCTTCAGCAGCCCTCTT | CTG | chr6 | 160661098 | 160661119 | 160661115 | 160661120 | + |
| SEQ ID NO 40220 | AGCTTCAGCAGCCCTCTTCCAA | CTG | chr6 | 160661102 | 160661123 | 160661119 | 160661124 | + |
| SEQ ID NO 40221 | CAGCAGCCCTCTTCCAAGCCTG | CTT | chr6 | 160661107 | 160661128 | 160661124 | 160661129 | + |
| SEQ ID NO 40222 | AGCAGCCCTCTTCCAAGCCTGG | TTC | chr6 | 160661108 | 160661129 | 160661125 | 160661130 | + |
| SEQ ID NO 40223 | TTCCAAGCCTGGAGATGCCAGC | CTC | chr6 | 160661118 | 160661139 | 160661135 | 160661140 | + |
| SEQ ID NO 40224 | CCAAGCCTGGAGATGCCAGCTC | CTT | chr6 | 160661120 | 160661141 | 160661137 | 160661142 | + |

Figure 60 (Cont'd)

| SEQ ID NO 40225 | CAAGCCTGGAGATGCCAGCTCC | TTC | chr6 | 160661121 | 160661142 | 160661138 | 160661143 | + |
|---|---|---|---|---|---|---|---|---|
| SEQ ID NO 40226 | GAGATGCCAGCTCCATCTCTGG | CTG | chr6 | 160661129 | 160661150 | 160661146 | 160661151 | + |
| SEQ ID NO 40227 | CATCTCTGGCACAAAATGTAGT | CTC | chr6 | 160661142 | 160661163 | 160661159 | 160661164 | + |
| SEQ ID NO 40228 | TGGCACAAAATGTAGTGATTTT | CTC | chr6 | 160661148 | 160661169 | 160661165 | 160661170 | + |
| SEQ ID NO 40229 | GCACAAAATGTAGTGATTTTCA | CTG | chr6 | 160661150 | 160661171 | 160661167 | 160661172 | + |
| SEQ ID NO 40230 | TCACAGGGTGAGAGGCCAAAAG | TTT | chr6 | 160661169 | 160661190 | 160661186 | 160661191 | + |
| SEQ ID NO 40231 | CACAGGGTGAGAGGCCAAAAGA | TTT | chr6 | 160661170 | 160661191 | 160661187 | 160661192 | + |
| SEQ ID NO 40232 | ACAGGGTGAGAGGCCAAAAGAG | TTC | chr6 | 160661171 | 160661192 | 160661188 | 160661193 | + |
| SEQ ID NO 40233 | ATAAAATGAAGATAGCCAAGCT | CTA | chr6 | 160661197 | 160661218 | 160661214 | 160661219 | + |
| SEQ ID NO 40234 | CCATGGAATTAAGCAACAGGAC | CTT | chr6 | 160661220 | 160661241 | 160661237 | 160661242 | + |
| SEQ ID NO 40235 | CATGGAATTAAGCAACAGGACA | TTC | chr6 | 160661221 | 160661242 | 160661238 | 160661243 | + |
| SEQ ID NO 40236 | AGCAACAGGACAACCTTGACCA | TTA | chr6 | 160661231 | 160661252 | 160661248 | 160661253 | + |
| SEQ ID NO 40237 | GACCACTTTGAGGGGTGTGGTG | CTT | chr6 | 160661248 | 160661269 | 160661265 | 160661270 | + |
| SEQ ID NO 40238 | ACCACTTTGAGGGGTGTGGTGG | TTG | chr6 | 160661249 | 160661270 | 160661266 | 160661271 | + |
| SEQ ID NO 40239 | TGAGGGGTGTGGTGGGGGCCAC | CTT | chr6 | 160661256 | 160661277 | 160661273 | 160661278 | + |
| SEQ ID NO 40240 | GAGGGGTGTGGTGGGGGCCACA | TTT | chr6 | 160661257 | 160661278 | 160661274 | 160661279 | + |
| SEQ ID NO 40241 | AGGGGTGTGGTGGGGGCCACAT | TTG | chr6 | 160661258 | 160661279 | 160661275 | 160661280 | + |
| SEQ ID NO 40242 | AAGAGTGACTAGAAGAGCAGTG | TTA | chr6 | 160661297 | 160661318 | 160661314 | 160661319 | + |
| SEQ ID NO 40243 | GAAGAGCAGTGGGGGTGGCAGC | CTA | chr6 | 160661308 | 160661329 | 160661325 | 160661330 | + |
| SEQ ID NO 40244 | GCTCTGAAAGCAGCGAGACTTC | CTG | chr6 | 160661344 | 160661365 | 160661361 | 160661366 | + |
| SEQ ID NO 40245 | TGAAAGCAGCGAGACTTCTAGG | CTC | chr6 | 160661348 | 160661369 | 160661365 | 160661370 | + |
| SEQ ID NO 40246 | AAAGCAGCGAGACTTCTAGGGA | CTG | chr6 | 160661350 | 160661371 | 160661367 | 160661372 | + |
| SEQ ID NO 40247 | CTAGGGAATACAGGGTCAGGGG | CTT | chr6 | 160661365 | 160661386 | 160661382 | 160661387 | + |
| SEQ ID NO 40248 | TAGGGAATACAGGGTCAGGGGA | TTC | chr6 | 160661366 | 160661387 | 160661383 | 160661388 | + |
| SEQ ID NO 40249 | GGGAATACAGGGTCAGGGGAGG | CTA | chr6 | 160661368 | 160661389 | 160661385 | 160661390 | + |
| SEQ ID NO 40250 | TGAAAGATGACACACTGCAGAG | TTC | chr6 | 160661393 | 160661414 | 160661410 | 160661415 | + |
| SEQ ID NO 40251 | AAAGATGACACACTGCAGAGAA | CTG | chr6 | 160661395 | 160661416 | 160661412 | 160661417 | + |
| SEQ ID NO 40252 | CAGAGAACATGTGTTTGTATGC | CTG | chr6 | 160661410 | 160661431 | 160661427 | 160661432 | + |
| SEQ ID NO 40253 | GTATGCCGATGACAAGTATCCA | TTT | chr6 | 160661426 | 160661447 | 160661443 | 160661448 | + |
| SEQ ID NO 40254 | TATGCCGATGACAAGTATCCAG | TTG | chr6 | 160661427 | 160661448 | 160661444 | 160661449 | + |
| SEQ ID NO 40255 | TCATTCTCAGAAAGGCCTGTCC | TTC | chr6 | 160661472 | 160661493 | 160661489 | 160661494 | + |
| SEQ ID NO 40256 | ATTCTCAGAAAGGCCTGTCCTG | CTC | chr6 | 160661474 | 160661495 | 160661491 | 160661496 | + |
| SEQ ID NO 40257 | TCAGAAAGGCCTGTCCTGACCT | TTC | chr6 | 160661478 | 160661499 | 160661495 | 160661500 | + |
| SEQ ID NO 40258 | AGAAAGGCCTGTCCTGACCTCC | CTC | chr6 | 160661480 | 160661501 | 160661497 | 160661502 | + |
| SEQ ID NO 40259 | TCCTGACCTCCTGAGAGTACAC | CTG | chr6 | 160661491 | 160661512 | 160661508 | 160661513 | + |
| SEQ ID NO 40260 | ACCTCCTGAGAGTACACAGACC | CTG | chr6 | 160661496 | 160661517 | 160661513 | 160661518 | + |
| SEQ ID NO 40261 | CTGAGAGTACACAGACCATGAG | CTC | chr6 | 160661501 | 160661522 | 160661518 | 160661523 | + |
| SEQ ID NO 40262 | AGAGTACACAGACCATGAGGGC | CTG | chr6 | 160661504 | 160661525 | 160661521 | 160661526 | + |
| SEQ ID NO 40263 | ACTGTTTCATGCAAAGTCCTTG | CTC | chr6 | 160661551 | 160661572 | 160661568 | 160661573 | + |
| SEQ ID NO 40264 | TTTCATGCAAAGTCCTTGGCCA | CTG | chr6 | 160661555 | 160661576 | 160661572 | 160661577 | + |
| SEQ ID NO 40265 | CATGCAAAGTCCTTGGCCACAG | TTT | chr6 | 160661558 | 160661579 | 160661575 | 160661580 | + |
| SEQ ID NO 40266 | ATGCAAAGTCCTTGGCCACAGT | TTC | chr6 | 160661559 | 160661580 | 160661576 | 160661581 | + |
| SEQ ID NO 40267 | GGCCACAGTCCACCTGCTCCCC | CTT | chr6 | 160661572 | 160661593 | 160661589 | 160661594 | + |
| SEQ ID NO 40268 | GCCACAGTCCACCTGCTCCCCA | TTG | chr6 | 160661573 | 160661594 | 160661590 | 160661595 | + |
| SEQ ID NO 40269 | CTCCCCACCTCTGTGACTTTGT | CTG | chr6 | 160661588 | 160661609 | 160661605 | 160661610 | + |
| SEQ ID NO 40270 | CCCACCTCTGTGACTTTGTCCT | CTC | chr6 | 160661591 | 160661612 | 160661608 | 160661613 | + |
| SEQ ID NO 40271 | TGTGACTTTGTCCTTCCTCAAT | CTC | chr6 | 160661599 | 160661620 | 160661616 | 160661621 | + |
| SEQ ID NO 40272 | TGACTTTGTCCTTCCTCAATTT | CTG | chr6 | 160661601 | 160661622 | 160661618 | 160661623 | + |
| SEQ ID NO 40273 | TGTCCTTCCTCAATTTAATATG | CTT | chr6 | 160661607 | 160661628 | 160661624 | 160661629 | + |
| SEQ ID NO 40274 | GTCCTTCCTCAATTTAATATGC | TTT | chr6 | 160661608 | 160661629 | 160661625 | 160661630 | + |
| SEQ ID NO 40275 | TCCTTCCTCAATTTAATATGCT | TTG | chr6 | 160661609 | 160661630 | 160661626 | 160661631 | + |
| SEQ ID NO 40276 | CCTCAATTTAATATGCTCTATG | CTT | chr6 | 160661614 | 160661635 | 160661631 | 160661636 | + |
| SEQ ID NO 40277 | CTCAATTTAATATGCTCTATGC | TTC | chr6 | 160661615 | 160661636 | 160661632 | 160661637 | + |
| SEQ ID NO 40278 | AATTTAATATGCTCTATGCTGG | CTC | chr6 | 160661618 | 160661639 | 160661635 | 160661640 | + |
| SEQ ID NO 40279 | AATATGCTCTATGCTGGAAAAC | TTT | chr6 | 160661623 | 160661644 | 160661640 | 160661645 | + |
| SEQ ID NO 40280 | ATATGCTCTATGCTGGAAAACT | TTA | chr6 | 160661624 | 160661645 | 160661641 | 160661646 | + |
| SEQ ID NO 40281 | TATGCTGGAAAACTGGATTATT | CTC | chr6 | 160661632 | 160661653 | 160661649 | 160661654 | + |
| SEQ ID NO 40282 | TGCTGGAAAACTGGATTATTGA | CTA | chr6 | 160661634 | 160661655 | 160661651 | 160661656 | + |

Figure 60 (Cont'd)

| | | | | | | | | |
|---|---|---|---|---|---|---|---|---|
| SEQ ID NO 40283 | GAAAACTGGATTATTGAACAGG | CTG | chr6 | 160661639 | 160661660 | 160661656 | 160661661 | + |
| SEQ ID NO 40284 | GATTATTGAACAGGCATTGGCT | CTG | chr6 | 160661647 | 160661668 | 160661664 | 160661669 | + |
| SEQ ID NO 40285 | TTGAACAGGCATTGGCTGATGC | TTA | chr6 | 160661652 | 160661673 | 160661669 | 160661674 | + |
| SEQ ID NO 40286 | AACAGGCATTGGCTGATGCATT | TTG | chr6 | 160661655 | 160661676 | 160661672 | 160661677 | + |
| SEQ ID NO 40287 | GCTGATGCATTCTGAACCTAAT | TTG | chr6 | 160661666 | 160661687 | 160661683 | 160661688 | + |
| SEQ ID NO 40288 | ATGCATTCTGAACCTAATCCAC | CTG | chr6 | 160661670 | 160661691 | 160661687 | 160661692 | + |
| SEQ ID NO 40289 | TGAACCTAATCCACTAAAAAGC | TTC | chr6 | 160661678 | 160661699 | 160661695 | 160661700 | + |
| SEQ ID NO 40290 | AACCTAATCCACTAAAAAGCAC | CTG | chr6 | 160661680 | 160661701 | 160661697 | 160661702 | + |
| SEQ ID NO 40291 | ATCCACTAAAAAGCACTTGATA | CTA | chr6 | 160661686 | 160661707 | 160661703 | 160661708 | + |
| SEQ ID NO 40292 | AAAAGCACTTGATAGATATATC | CTA | chr6 | 160661694 | 160661715 | 160661711 | 160661716 | + |
| SEQ ID NO 40293 | GATAGATATATCAAAATATCAT | CTT | chr6 | 160661704 | 160661725 | 160661721 | 160661726 | + |
| SEQ ID NO 40294 | ATAGATATATCAAAATATCATT | TTG | chr6 | 160661705 | 160661726 | 160661722 | 160661727 | + |
| SEQ ID NO 40295 | AGAAATAGATATTTTAGGCCCA | TTG | chr6 | 160661728 | 160661749 | 160661745 | 160661750 | + |
| SEQ ID NO 40296 | TAGGCCCATATCCATGTCTTCA | TTT | chr6 | 160661742 | 160661763 | 160661759 | 160661764 | + |
| SEQ ID NO 40297 | AGGCCCATATCCATGTCTTCAC | TTT | chr6 | 160661743 | 160661764 | 160661760 | 160661765 | + |
| SEQ ID NO 40298 | GGCCCATATCCATGTCTTCACC | TTA | chr6 | 160661744 | 160661765 | 160661761 | 160661766 | + |
| SEQ ID NO 40299 | CACCCCGCACTGTTTCTCATTT | CTT | chr6 | 160661762 | 160661783 | 160661779 | 160661784 | + |
| SEQ ID NO 40300 | ACCCCGCACTGTTTCTCATTTG | TTC | chr6 | 160661763 | 160661784 | 160661780 | 160661785 | + |
| SEQ ID NO 40301 | TTTCTCATTTGAACTCTCTTTT | CTG | chr6 | 160661774 | 160661795 | 160661791 | 160661796 | + |
| SEQ ID NO 40302 | CTCATTTGAACTCTCTTTTCCA | TTT | chr6 | 160661777 | 160661798 | 160661794 | 160661799 | + |
| SEQ ID NO 40303 | TCATTTGAACTCTCTTTTCCAG | TTC | chr6 | 160661778 | 160661799 | 160661795 | 160661800 | + |
| SEQ ID NO 40304 | ATTTGAACTCTCTTTTCCAGGA | CTC | chr6 | 160661780 | 160661801 | 160661797 | 160661802 | + |
| SEQ ID NO 40305 | GAACTCTCTTTTCCAGGAAGAG | TTT | chr6 | 160661784 | 160661805 | 160661801 | 160661806 | + |
| SEQ ID NO 40306 | AACTCTCTTTTCCAGGAAGAGT | TTG | chr6 | 160661785 | 160661806 | 160661802 | 160661807 | + |
| SEQ ID NO 40307 | TCTTTTCCAGGAAGAGTTGTGC | CTC | chr6 | 160661790 | 160661811 | 160661807 | 160661812 | + |
| SEQ ID NO 40308 | TTTTCCAGGAAGAGTTGTGCTT | CTC | chr6 | 160661792 | 160661813 | 160661809 | 160661814 | + |
| SEQ ID NO 40309 | TTCCAGGAAGAGTTGTGCTTGG | CTT | chr6 | 160661794 | 160661815 | 160661811 | 160661816 | + |
| SEQ ID NO 40310 | TCCAGGAAGAGTTGTGCTTGGG | TTT | chr6 | 160661795 | 160661816 | 160661812 | 160661817 | + |
| SEQ ID NO 40311 | CCAGGAAGAGTTGTGCTTGGGT | TTT | chr6 | 160661796 | 160661817 | 160661813 | 160661818 | + |
| SEQ ID NO 40312 | CAGGAAGAGTTGTGCTTGGGTA | TTC | chr6 | 160661797 | 160661818 | 160661814 | 160661819 | + |
| SEQ ID NO 40313 | TGCTTGGGTAAATTCTATAGCT | TTG | chr6 | 160661809 | 160661830 | 160661826 | 160661831 | + |
| SEQ ID NO 40314 | GGGTAAATTCTATAGCTCACAG | CTT | chr6 | 160661814 | 160661835 | 160661831 | 160661836 | + |
| SEQ ID NO 40315 | GGTAAATTCTATAGCTCACAGT | TTG | chr6 | 160661815 | 160661836 | 160661832 | 160661837 | + |
| SEQ ID NO 40316 | TATAGCTCACAGTGTGACTTCA | TTC | chr6 | 160661824 | 160661845 | 160661841 | 160661846 | + |
| SEQ ID NO 40317 | TAGCTCACAGTGTGACTTCAAA | CTA | chr6 | 160661826 | 160661847 | 160661843 | 160661848 | + |
| SEQ ID NO 40318 | ACAGTGTGACTTCAAAACACAC | CTC | chr6 | 160661832 | 160661853 | 160661849 | 160661854 | + |
| SEQ ID NO 40319 | CAAAACACACAATAAATTAATA | CTT | chr6 | 160661844 | 160661865 | 160661861 | 160661866 | + |
| SEQ ID NO 40320 | AAAACACACAATAAATTAATAA | TTC | chr6 | 160661845 | 160661866 | 160661862 | 160661867 | + |
| SEQ ID NO 40321 | ATAAGGTGCTTCCTACAGTGAG | TTA | chr6 | 160661863 | 160661884 | 160661880 | 160661885 | + |
| SEQ ID NO 40322 | CCTACAGTGAGTTCAGTTAAAC | CTT | chr6 | 160661874 | 160661895 | 160661891 | 160661896 | + |
| SEQ ID NO 40323 | CTACAGTGAGTTCAGTTAAACA | TTC | chr6 | 160661875 | 160661896 | 160661892 | 160661897 | + |
| SEQ ID NO 40324 | CAGTGAGTTCAGTTAAACATTT | CTA | chr6 | 160661878 | 160661899 | 160661895 | 160661900 | + |
| SEQ ID NO 40325 | AGTTAAACATTTTGAAGAGTGT | TTC | chr6 | 160661888 | 160661909 | 160661905 | 160661910 | + |
| SEQ ID NO 40326 | AACATTTTGAAGAGTGTTTTTG | TTA | chr6 | 160661893 | 160661914 | 160661910 | 160661915 | + |
| SEQ ID NO 40327 | TGAAGAGTGTTTTTGAAATGTA | TTT | chr6 | 160661900 | 160661921 | 160661917 | 160661922 | + |
| SEQ ID NO 40328 | GAAGAGTGTTTTTGAAATGTAG | TTT | chr6 | 160661901 | 160661922 | 160661918 | 160661923 | + |
| SEQ ID NO 40329 | AAGAGTGTTTTTGAAATGTAGC | TTG | chr6 | 160661902 | 160661923 | 160661919 | 160661924 | + |
| SEQ ID NO 40330 | TTGAAATGTAGCAGAGCAGGCT | TTT | chr6 | 160661912 | 160661933 | 160661929 | 160661934 | + |
| SEQ ID NO 40331 | TGAAATGTAGCAGAGCAGGCTA | TTT | chr6 | 160661913 | 160661934 | 160661930 | 160661935 | + |
| SEQ ID NO 40332 | GAAATGTAGCAGAGCAGGCTAC | TTT | chr6 | 160661914 | 160661935 | 160661931 | 160661936 | + |
| SEQ ID NO 40333 | AAATGTAGCAGAGCAGGCTACA | TTG | chr6 | 160661915 | 160661936 | 160661932 | 160661937 | + |
| SEQ ID NO 40334 | CAATTGATATCAAAAGAGGA | CTA | chr6 | 160661935 | 160661956 | 160661952 | 160661957 | + |
| SEQ ID NO 40335 | ATATTCAAAAGAGGAAACTTC | TTG | chr6 | 160661941 | 160661962 | 160661958 | 160661963 | + |
| SEQ ID NO 40336 | AAAAGAGGAAACTTCCATTTA | TTC | chr6 | 160661947 | 160661968 | 160661964 | 160661969 | + |
| SEQ ID NO 40337 | CCATTTATTTCCCCCTTTAACT | CTT | chr6 | 160661962 | 160661983 | 160661979 | 160661984 | + |
| SEQ ID NO 40338 | CATTTATTTCCCCCTTTAACTA | TTC | chr6 | 160661963 | 160661984 | 160661980 | 160661985 | + |
| SEQ ID NO 40339 | ATTTCCCCCTTTAACTAAGTTA | TTT | chr6 | 160661968 | 160661989 | 160661985 | 160661990 | + |
| SEQ ID NO 40340 | TTTCCCCCTTTAACTAAGTTAC | TTA | chr6 | 160661969 | 160661990 | 160661986 | 160661991 | + |

Figure 60 (Cont'd)

| | | | | | | | | |
|---|---|---|---|---|---|---|---|---|
| SEQ ID NO 40341 | CCCCCTTTAACTAAGTTACCTG | TTT | chr6 | 160661972 | 160661993 | 160661989 | 160661994 | + |
| SEQ ID NO 40342 | CCCCTTTAACTAAGTTACCTGT | TTC | chr6 | 160661973 | 160661994 | 160661990 | 160661995 | + |
| SEQ ID NO 40343 | TAACTAAGTTACCTGTAACTGT | CTT | chr6 | 160661979 | 160662000 | 160661996 | 160662001 | + |
| SEQ ID NO 40344 | AACTAAGTTACCTGTAACTGTG | TTT | chr6 | 160661980 | 160662001 | 160661997 | 160662002 | + |
| SEQ ID NO 40345 | ACTAAGTTACCTGTAACTGTGT | TTA | chr6 | 160661981 | 160662002 | 160661998 | 160662003 | + |
| SEQ ID NO 40346 | AGTTACCTGTAACTGTGTCATT | CTA | chr6 | 160661985 | 160662006 | 160662002 | 160662007 | + |
| SEQ ID NO 40347 | CCTGTAACTGTGTCATTTTATT | TTA | chr6 | 160661990 | 160662011 | 160662007 | 160662012 | + |
| SEQ ID NO 40348 | TAACTGTGTCATTTTATTATGC | CTG | chr6 | 160661994 | 160662015 | 160662011 | 160662016 | + |
| SEQ ID NO 40349 | TGTCATTTTATTATGCTTCATA | CTG | chr6 | 160662000 | 160662021 | 160662017 | 160662022 | + |
| SEQ ID NO 40350 | TATTATGCTTCATAGAGCATCA | TTT | chr6 | 160662008 | 160662029 | 160662025 | 160662030 | + |
| SEQ ID NO 40351 | ATTATGCTTCATAGAGCATCAC | TTT | chr6 | 160662009 | 160662030 | 160662026 | 160662031 | + |
| SEQ ID NO 40352 | TTATGCTTCATAGAGCATCACT | TTA | chr6 | 160662010 | 160662031 | 160662027 | 160662032 | + |
| SEQ ID NO 40353 | TGCTTCATAGAGCATCACTGCT | TTA | chr6 | 160662013 | 160662034 | 160662030 | 160662035 | + |
| SEQ ID NO 40354 | CATAGAGCATCACTGCTGAGAT | CTT | chr6 | 160662018 | 160662039 | 160662035 | 160662040 | + |
| SEQ ID NO 40355 | ATAGAGCATCACTGCTGAGATC | TTC | chr6 | 160662019 | 160662040 | 160662036 | 160662041 | + |
| SEQ ID NO 40356 | CTGAGATCCCTCCCCAGCTCA | CTG | chr6 | 160662033 | 160662054 | 160662050 | 160662055 | + |
| SEQ ID NO 40357 | AGATCCCTCCCCAGCTCATGT | CTG | chr6 | 160662036 | 160662057 | 160662053 | 160662058 | + |
| SEQ ID NO 40358 | CCCAGCTCATGTTGCTAGGAAA | CTC | chr6 | 160662046 | 160662067 | 160662063 | 160662068 | + |
| SEQ ID NO 40359 | ATGTTGCTAGGAAATATCCCAA | CTC | chr6 | 160662054 | 160662075 | 160662071 | 160662076 | + |
| SEQ ID NO 40360 | CTAGGAAATATCCCAAAACAGA | TTG | chr6 | 160662060 | 160662081 | 160662077 | 160662082 | + |
| SEQ ID NO 40361 | GGAAATATCCCAAAACAGAATC | CTA | chr6 | 160662063 | 160662084 | 160662080 | 160662085 | + |
| SEQ ID NO 40362 | TTCTTTTTTTAACCTGATGATT | TTT | chr6 | 160662090 | 160662111 | 160662107 | 160662112 | + |
| SEQ ID NO 40363 | TCTTTTTTTAACCTGATGATTT | TTT | chr6 | 160662091 | 160662112 | 160662108 | 160662113 | + |
| SEQ ID NO 40364 | CTTTTTTTAACCTGATGATTTT | TTT | chr6 | 160662092 | 160662113 | 160662109 | 160662114 | + |
| SEQ ID NO 40365 | TTTTTTTAACCTGATGATTTTT | TTC | chr6 | 160662093 | 160662114 | 160662110 | 160662115 | + |
| SEQ ID NO 40366 | TTTTTAACCTGATGATTTTTCC | CTT | chr6 | 160662095 | 160662116 | 160662112 | 160662117 | + |
| SEQ ID NO 40367 | TTTTAACCTGATGATTTTTCCA | TTT | chr6 | 160662096 | 160662117 | 160662113 | 160662118 | + |
| SEQ ID NO 40368 | TTTAACCTGATGATTTTTCCAC | TTT | chr6 | 160662097 | 160662118 | 160662114 | 160662119 | + |
| SEQ ID NO 40369 | TTAACCTGATGATTTTTCCACA | TTT | chr6 | 160662098 | 160662119 | 160662115 | 160662120 | + |
| SEQ ID NO 40370 | TAACCTGATGATTTTTCCACAA | TTT | chr6 | 160662099 | 160662120 | 160662116 | 160662121 | + |
| SEQ ID NO 40371 | AACCTGATGATTTTTCCACAAT | TTT | chr6 | 160662100 | 160662121 | 160662117 | 160662122 | + |
| SEQ ID NO 40372 | ACCTGATGATTTTTCCACAATC | TTA | chr6 | 160662101 | 160662122 | 160662118 | 160662123 | + |
| SEQ ID NO 40373 | ATGATTTTTCCACAATCCTTTT | CTG | chr6 | 160662106 | 160662127 | 160662123 | 160662128 | + |
| SEQ ID NO 40374 | TTCCACAATCCTTTTGTTTCTC | TTT | chr6 | 160662113 | 160662134 | 160662130 | 160662135 | + |
| SEQ ID NO 40375 | TCCACAATCCTTTTGTTTCTCT | TTT | chr6 | 160662114 | 160662135 | 160662131 | 160662136 | + |
| SEQ ID NO 40376 | CCACAATCCTTTTGTTTCTCTG | TTT | chr6 | 160662115 | 160662136 | 160662132 | 160662137 | + |
| SEQ ID NO 40377 | CACAATCCTTTTGTTTCTCTGA | TTC | chr6 | 160662116 | 160662137 | 160662133 | 160662138 | + |
| SEQ ID NO 40378 | TTGTTTCTCTGATTCACCTCCA | CTT | chr6 | 160662126 | 160662147 | 160662143 | 160662148 | + |
| SEQ ID NO 40379 | TGTTTCTCTGATTCACCTCCAG | TTT | chr6 | 160662127 | 160662148 | 160662144 | 160662149 | + |
| SEQ ID NO 40380 | GTTTCTCTGATTCACCTCCAGG | TTT | chr6 | 160662128 | 160662149 | 160662145 | 160662150 | + |
| SEQ ID NO 40381 | TTTCTCTGATTCACCTCCAGGG | TTG | chr6 | 160662129 | 160662150 | 160662146 | 160662151 | + |
| SEQ ID NO 40382 | CTCTGATTCACCTCCAGGGCTC | TTT | chr6 | 160662132 | 160662153 | 160662149 | 160662154 | + |
| SEQ ID NO 40383 | TCTGATTCACCTCCAGGGCTCA | TTC | chr6 | 160662133 | 160662154 | 160662150 | 160662155 | + |
| SEQ ID NO 40384 | TGATTCACCTCCAGGGCTCATA | CTC | chr6 | 160662135 | 160662156 | 160662152 | 160662157 | + |
| SEQ ID NO 40385 | ATTCACCTCCAGGGCTCATATG | CTG | chr6 | 160662137 | 160662158 | 160662154 | 160662159 | + |
| SEQ ID NO 40386 | ACCTCCAGGGCTCATATGGCAA | TTC | chr6 | 160662141 | 160662162 | 160662158 | 160662163 | + |
| SEQ ID NO 40387 | CAGGGCTCATATGGCAATGGGG | CTC | chr6 | 160662146 | 160662167 | 160662163 | 160662168 | + |
| SEQ ID NO 40388 | ATATGGCAATGGGGATTTAATA | CTC | chr6 | 160662154 | 160662175 | 160662171 | 160662176 | + |
| SEQ ID NO 40389 | AATAGGGTTTATTTGTTGGTGA | TTT | chr6 | 160662172 | 160662193 | 160662189 | 160662194 | + |
| SEQ ID NO 40390 | ATAGGGTTTATTTGTTGGTGAA | TTA | chr6 | 160662173 | 160662194 | 160662190 | 160662195 | + |
| SEQ ID NO 40391 | ATTTGTTGGTGAAGAAACATTA | TTT | chr6 | 160662182 | 160662203 | 160662199 | 160662204 | + |
| SEQ ID NO 40392 | TTTGTTGGTGAAGAAACATTAA | TTA | chr6 | 160662183 | 160662204 | 160662200 | 160662205 | + |
| SEQ ID NO 40393 | GTTGGTGAAGAAACATTAAACA | TTT | chr6 | 160662186 | 160662207 | 160662203 | 160662208 | + |
| SEQ ID NO 40394 | TTGGTGAAGAAACATTAAACAA | TTG | chr6 | 160662187 | 160662208 | 160662204 | 160662209 | + |
| SEQ ID NO 40395 | GTGAAGAAACATTAAACAAATC | TTG | chr6 | 160662190 | 160662211 | 160662207 | 160662212 | + |
| SEQ ID NO 40396 | AACAAATCTTTTAATAGGAAAA | TTA | chr6 | 160662204 | 160662225 | 160662221 | 160662226 | + |
| SEQ ID NO 40397 | TTAATAGGAAAAATACTTTTAT | CTT | chr6 | 160662214 | 160662235 | 160662231 | 160662236 | + |
| SEQ ID NO 40398 | TAATAGGAAAAATACTTTTATA | TTT | chr6 | 160662215 | 160662236 | 160662232 | 160662237 | + |

Figure 60 (Cont'd)

| SEQ ID NO 40399 | AATAGGAAAAATACTTTTATAT | TTT | chr6 | 160662216 | 160662237 | 160662233 | 160662238 | + |
|---|---|---|---|---|---|---|---|---|
| SEQ ID NO 40400 | ATAGGAAAAATACTTTTATATT | TTA | chr6 | 160662217 | 160662238 | 160662234 | 160662239 | + |
| SEQ ID NO 40401 | TTATATTATAGGCAAAATGTAG | CTT | chr6 | 160662232 | 160662253 | 160662249 | 160662254 | + |
| SEQ ID NO 40402 | TATATTATAGGCAAAATGTAGA | TTT | chr6 | 160662233 | 160662254 | 160662250 | 160662255 | + |
| SEQ ID NO 40403 | ATATTATAGGCAAAATGTAGAT | TTT | chr6 | 160662234 | 160662255 | 160662251 | 160662256 | + |
| SEQ ID NO 40404 | TATTATAGGCAAAATGTAGATG | TTA | chr6 | 160662235 | 160662256 | 160662252 | 160662257 | + |
| SEQ ID NO 40405 | TAGGCAAAATGTAGATGTATAT | TTA | chr6 | 160662240 | 160662261 | 160662257 | 160662262 | + |
| SEQ ID NO 40406 | CTACTGAAGTAAATGTATTTTA | TTG | chr6 | 160662264 | 160662285 | 160662281 | 160662286 | + |
| SEQ ID NO 40407 | CTGAAGTAAATGTATTTTATTA | CTA | chr6 | 160662267 | 160662288 | 160662284 | 160662289 | + |
| SEQ ID NO 40408 | AAGTAAATGTATTTTATTAATG | CTG | chr6 | 160662270 | 160662291 | 160662287 | 160662292 | + |
| SEQ ID NO 40409 | TATTAATGGTGTGAGAATTTCT | TTT | chr6 | 160662284 | 160662305 | 160662301 | 160662306 | + |
| SEQ ID NO 40410 | ATTAATGGTGTGAGAATTTCTT | TTT | chr6 | 160662285 | 160662306 | 160662302 | 160662307 | + |
| SEQ ID NO 40411 | TTAATGGTGTGAGAATTTCTTC | TTA | chr6 | 160662286 | 160662307 | 160662303 | 160662308 | + |
| SEQ ID NO 40412 | ATGGTGTGAGAATTTCTTCCTC | TTA | chr6 | 160662289 | 160662310 | 160662306 | 160662311 | + |
| SEQ ID NO 40413 | CTTCCTCACTGTGGTGTGTGAA | TTT | chr6 | 160662304 | 160662325 | 160662321 | 160662326 | + |
| SEQ ID NO 40414 | TTCCTCACTGTGGTGTGTGAAT | TTC | chr6 | 160662305 | 160662326 | 160662322 | 160662327 | + |
| SEQ ID NO 40415 | CCTCACTGTGGTGTGTGAATGT | CTT | chr6 | 160662307 | 160662328 | 160662324 | 160662329 | + |
| SEQ ID NO 40416 | CTCACTGTGGTGTGTGAATGTG | TTC | chr6 | 160662308 | 160662329 | 160662325 | 160662330 | + |
| SEQ ID NO 40417 | ACTGTGGTGTGTGAATGTGTAT | CTC | chr6 | 160662311 | 160662332 | 160662328 | 160662333 | + |
| SEQ ID NO 40418 | TGGTGTGTGAATGTGTATGCAT | CTG | chr6 | 160662315 | 160662336 | 160662332 | 160662337 | + |
| SEQ ID NO 40419 | GCATGTGTAAAAGACTTAGCAA | TTT | chr6 | 160662341 | 160662362 | 160662358 | 160662363 | + |
| SEQ ID NO 40420 | CATGTGTAAAAGACTTAGCAAT | TTG | chr6 | 160662342 | 160662363 | 160662359 | 160662364 | + |
| SEQ ID NO 40421 | AGCAATTTGTGAATAGAAGATG | CTT | chr6 | 160662358 | 160662379 | 160662375 | 160662380 | + |
| SEQ ID NO 40422 | GCAATTTGTGAATAGAAGATGT | TTA | chr6 | 160662359 | 160662380 | 160662376 | 160662381 | + |
| SEQ ID NO 40423 | GTGAATAGAAGATGTTTCTCCG | TTT | chr6 | 160662366 | 160662387 | 160662383 | 160662388 | + |
| SEQ ID NO 40424 | TGAATAGAAGATGTTTCTCCGC | TTG | chr6 | 160662367 | 160662388 | 160662384 | 160662389 | + |
| SEQ ID NO 40425 | CTCCGCTTCTCACTGAGCATGG | TTT | chr6 | 160662383 | 160662404 | 160662400 | 160662405 | + |
| SEQ ID NO 40426 | TCCGCTTCTCACTGAGCATGGC | TTC | chr6 | 160662384 | 160662405 | 160662401 | 160662406 | + |
| SEQ ID NO 40427 | CGCTTCTCACTGAGCATGGCTG | CTC | chr6 | 160662386 | 160662407 | 160662403 | 160662408 | + |
| SEQ ID NO 40428 | CTCACTGAGCATGGCTGTAAAA | CTT | chr6 | 160662391 | 160662412 | 160662408 | 160662413 | + |
| SEQ ID NO 40429 | TCACTGAGCATGGCTGTAAAAG | TTC | chr6 | 160662392 | 160662413 | 160662409 | 160662414 | + |
| SEQ ID NO 40430 | ACTGAGCATGGCTGTAAAAGAA | CTC | chr6 | 160662394 | 160662415 | 160662411 | 160662416 | + |
| SEQ ID NO 40431 | AGCATGGCTGTAAAAGAAACTT | CTG | chr6 | 160662398 | 160662419 | 160662415 | 160662420 | + |
| SEQ ID NO 40432 | TAAAAGAAACTTTTTCCTCTCC | CTG | chr6 | 160662408 | 160662429 | 160662425 | 160662430 | + |
| SEQ ID NO 40433 | TTTCCTCTCCCCGGGCATTCCA | CTT | chr6 | 160662420 | 160662441 | 160662437 | 160662442 | + |
| SEQ ID NO 40434 | TTCCTCTCCCCGGGCATTCCAG | TTT | chr6 | 160662421 | 160662442 | 160662438 | 160662443 | + |
| SEQ ID NO 40435 | TCCTCTCCCCGGGCATTCCAGC | TTT | chr6 | 160662422 | 160662443 | 160662439 | 160662444 | + |
| SEQ ID NO 40436 | CCTCTCCCCGGGCATTCCAGCA | TTT | chr6 | 160662423 | 160662444 | 160662440 | 160662445 | + |
| SEQ ID NO 40437 | CTCTCCCCGGGCATTCCAGCAC | TTC | chr6 | 160662424 | 160662445 | 160662441 | 160662446 | + |
| SEQ ID NO 40438 | TCCCCGGGCATTCCAGCACACA | CTC | chr6 | 160662427 | 160662448 | 160662444 | 160662449 | + |
| SEQ ID NO 40439 | CCCGGGCATTCCAGCACACATT | CTC | chr6 | 160662429 | 160662450 | 160662446 | 160662451 | + |
| SEQ ID NO 40440 | CAGCACACATTGGAAAGATAAC | TTC | chr6 | 160662440 | 160662461 | 160662457 | 160662462 | + |
| SEQ ID NO 40441 | GAAAGATAACACGTCCACAGAA | TTG | chr6 | 160662452 | 160662473 | 160662469 | 160662474 | + |
| SEQ ID NO 40442 | GCTTTCCAAAAGAGCTTATCAG | CTG | chr6 | 160662480 | 160662501 | 160662497 | 160662502 | + |
| SEQ ID NO 40443 | TCCAAAAGAGCTTATCAGAGAA | CTT | chr6 | 160662484 | 160662505 | 160662501 | 160662506 | + |
| SEQ ID NO 40444 | CCAAAAGAGCTTATCAGAGAAT | TTT | chr6 | 160662485 | 160662506 | 160662502 | 160662507 | + |
| SEQ ID NO 40445 | CAAAAGAGCTTATCAGAGAATG | TTC | chr6 | 160662486 | 160662507 | 160662503 | 160662508 | + |
| SEQ ID NO 40446 | ATCAGAGAATGTGCCCCCCAGG | CTT | chr6 | 160662497 | 160662518 | 160662514 | 160662519 | + |
| SEQ ID NO 40447 | TCAGAGAATGTGCCCCCCAGGT | TTA | chr6 | 160662498 | 160662519 | 160662515 | 160662520 | + |
| SEQ ID NO 40448 | AAACATATGTTAATCCTGTGGC | TTA | chr6 | 160662526 | 160662547 | 160662543 | 160662548 | + |
| SEQ ID NO 40449 | ATCCTGTGGCAGAGAAGTTTGT | TTA | chr6 | 160662538 | 160662559 | 160662555 | 160662560 | + |
| SEQ ID NO 40450 | TGGCAGAGAAGTTTGTTCTAGC | CTG | chr6 | 160662544 | 160662565 | 160662561 | 160662566 | + |
| SEQ ID NO 40451 | GTTCTAGCCTTTGGGTGTAGCC | TTT | chr6 | 160662558 | 160662579 | 160662575 | 160662580 | + |
| SEQ ID NO 40452 | TTCTAGCCTTTGGGTGTAGCCT | TTG | chr6 | 160662559 | 160662580 | 160662576 | 160662581 | + |
| SEQ ID NO 40453 | TAGCCTTTGGGTGTAGCCTGCT | TTC | chr6 | 160662562 | 160662583 | 160662579 | 160662584 | + |
| SEQ ID NO 40454 | GCCTTTGGGTGTAGCCTGCTGA | CTA | chr6 | 160662564 | 160662585 | 160662581 | 160662586 | + |
| SEQ ID NO 40455 | TGGGTGTAGCCTGCTGAATAAG | CTT | chr6 | 160662569 | 160662590 | 160662586 | 160662591 | + |
| SEQ ID NO 40456 | GGGTGTAGCCTGCTGAATAAGT | TTT | chr6 | 160662570 | 160662591 | 160662587 | 160662592 | + |

Figure 60 (Cont'd)

| | | | | | | | | |
|---|---|---|---|---|---|---|---|---|
| SEQ ID NO 40457 | GGTGTAGCCTGCTGAATAAGTT | TTG | chr6 | 160662571 | 160662592 | 160662588 | 160662593 | + |
| SEQ ID NO 40458 | CTGAATAAGTTCACAGTGATCT | CTG | chr6 | 160662582 | 160662603 | 160662599 | 160662604 | + |
| SEQ ID NO 40459 | AATAAGTTCACAGTGATCTACA | CTG | chr6 | 160662585 | 160662606 | 160662602 | 160662607 | + |
| SEQ ID NO 40460 | ACAGTGATCTACATCCTAGTTT | TTC | chr6 | 160662594 | 160662615 | 160662611 | 160662616 | + |
| SEQ ID NO 40461 | CATCCTAGTTTCCATGGGCTGA | CTA | chr6 | 160662605 | 160662626 | 160662622 | 160662627 | + |
| SEQ ID NO 40462 | GTTTCCATGGGCTGAAATAGAA | CTA | chr6 | 160662612 | 160662633 | 160662629 | 160662634 | + |
| SEQ ID NO 40463 | CCATGGGCTGAAATAGAATATT | TTT | chr6 | 160662616 | 160662637 | 160662633 | 160662638 | + |
| SEQ ID NO 40464 | CATGGGCTGAAATAGAATATTC | TTC | chr6 | 160662617 | 160662638 | 160662634 | 160662639 | + |
| SEQ ID NO 40465 | AAATAGAATATTCATATCCCCT | CTG | chr6 | 160662626 | 160662647 | 160662643 | 160662648 | + |
| SEQ ID NO 40466 | ATATCCCCTGCACTCCCTACAC | TTC | chr6 | 160662639 | 160662660 | 160662656 | 160662661 | + |
| SEQ ID NO 40467 | CACTCCCTACACACACAGACAT | CTG | chr6 | 160662649 | 160662670 | 160662666 | 160662671 | + |
| SEQ ID NO 40468 | CCTACACACACAGACATAGACA | CTC | chr6 | 160662654 | 160662675 | 160662671 | 160662676 | + |
| SEQ ID NO 40469 | CACACACAGACATAGACACCAA | CTA | chr6 | 160662658 | 160662679 | 160662675 | 160662680 | + |
| SEQ ID NO 40470 | CCCCAAAAAACTCTTTGCTTAA | TTT | chr6 | 160662683 | 160662704 | 160662700 | 160662705 | + |
| SEQ ID NO 40471 | CCCAAAAAACTCTTTGCTTAAT | TTC | chr6 | 160662684 | 160662705 | 160662701 | 160662706 | + |
| SEQ ID NO 40472 | TTTGCTTAATCTTCTCCTGCTC | CTC | chr6 | 160662696 | 160662717 | 160662713 | 160662718 | + |
| SEQ ID NO 40473 | TGCTTAATCTTCTCCTGCTCTG | CTT | chr6 | 160662698 | 160662719 | 160662715 | 160662720 | + |
| SEQ ID NO 40474 | GCTTAATCTTCTCCTGCTCTGT | TTT | chr6 | 160662699 | 160662720 | 160662716 | 160662721 | + |
| SEQ ID NO 40475 | CTTAATCTTCTCCTGCTCTGTA | TTG | chr6 | 160662700 | 160662721 | 160662717 | 160662722 | + |
| SEQ ID NO 40476 | AATCTTCTCCTGCTCTGTATTT | CTT | chr6 | 160662703 | 160662724 | 160662720 | 160662725 | + |
| SEQ ID NO 40477 | ATCTTCTCCTGCTCTGTATTTT | TTA | chr6 | 160662704 | 160662725 | 160662721 | 160662726 | + |
| SEQ ID NO 40478 | CTCCTGCTCTGTATTTTCTTTG | CTT | chr6 | 160662709 | 160662730 | 160662726 | 160662731 | + |
| SEQ ID NO 40479 | TCCTGCTCTGTATTTTCTTTGA | TTC | chr6 | 160662710 | 160662731 | 160662727 | 160662732 | + |
| SEQ ID NO 40480 | CTGCTCTGTATTTTCTTTGATA | CTC | chr6 | 160662712 | 160662733 | 160662729 | 160662734 | + |
| SEQ ID NO 40481 | CTCTGTATTTTCTTTGATATTT | CTG | chr6 | 160662715 | 160662736 | 160662732 | 160662737 | + |
| SEQ ID NO 40482 | TGTATTTTCTTTGATATTTTCT | CTC | chr6 | 160662718 | 160662739 | 160662735 | 160662740 | + |
| SEQ ID NO 40483 | TATTTTCTTTGATATTTTCTTG | CTG | chr6 | 160662720 | 160662741 | 160662737 | 160662742 | + |
| SEQ ID NO 40484 | TCTTTGATATTTTCTTGAATGG | TTT | chr6 | 160662725 | 160662746 | 160662742 | 160662747 | + |
| SEQ ID NO 40485 | CTTTGATATTTTCTTGAATGGC | TTT | chr6 | 160662726 | 160662747 | 160662743 | 160662748 | + |
| SEQ ID NO 40486 | TTTGATATTTTCTTGAATGGCT | TTC | chr6 | 160662727 | 160662748 | 160662744 | 160662749 | + |
| SEQ ID NO 40487 | TGATATTTTCTTGAATGGCTTC | CTT | chr6 | 160662729 | 160662750 | 160662746 | 160662751 | + |
| SEQ ID NO 40488 | GATATTTTCTTGAATGGCTTCC | TTT | chr6 | 160662730 | 160662751 | 160662747 | 160662752 | + |
| SEQ ID NO 40489 | ATATTTTCTTGAATGGCTTCCA | TTG | chr6 | 160662731 | 160662752 | 160662748 | 160662753 | + |
| SEQ ID NO 40490 | TCTTGAATGGCTTCCACTAAAT | TTT | chr6 | 160662737 | 160662758 | 160662754 | 160662759 | + |
| SEQ ID NO 40491 | CTTGAATGGCTTCCACTAAATT | TTT | chr6 | 160662738 | 160662759 | 160662755 | 160662760 | + |
| SEQ ID NO 40492 | TTGAATGGCTTCCACTAAATTC | TTC | chr6 | 160662739 | 160662760 | 160662756 | 160662761 | + |
| SEQ ID NO 40493 | GAATGGCTTCCACTAAATTCAA | CTT | chr6 | 160662741 | 160662762 | 160662758 | 160662763 | + |
| SEQ ID NO 40494 | AATGGCTTCCACTAAATTCAAA | TTG | chr6 | 160662742 | 160662763 | 160662759 | 160662764 | + |
| SEQ ID NO 40495 | CCACTAAATTCAAATGTGTTTG | CTT | chr6 | 160662750 | 160662771 | 160662767 | 160662772 | + |
| SEQ ID NO 40496 | CACTAAATTCAAATGTGTTTGA | TTC | chr6 | 160662751 | 160662772 | 160662768 | 160662773 | + |
| SEQ ID NO 40497 | AATTCAAATGTGTTTGACTTTA | CTA | chr6 | 160662756 | 160662777 | 160662773 | 160662778 | + |
| SEQ ID NO 40498 | AAATGTGTTTGACTTTAAAGTC | TTC | chr6 | 160662761 | 160662782 | 160662778 | 160662783 | + |
| SEQ ID NO 40499 | GACTTTAAAGTCAACTTGTAAA | TTT | chr6 | 160662771 | 160662792 | 160662788 | 160662793 | + |
| SEQ ID NO 40500 | ACTTTAAAGTCAACTTGTAAAA | TTG | chr6 | 160662772 | 160662793 | 160662789 | 160662794 | + |
| SEQ ID NO 40501 | TAAAGTCAACTTGTAAAATTTT | CTT | chr6 | 160662776 | 160662797 | 160662793 | 160662798 | + |
| SEQ ID NO 40502 | AAAGTCAACTTGTAAAATTTTA | TTT | chr6 | 160662777 | 160662798 | 160662794 | 160662799 | + |
| SEQ ID NO 40503 | AAGTCAACTTGTAAAATTTTAT | TTA | chr6 | 160662778 | 160662799 | 160662795 | 160662800 | + |
| SEQ ID NO 40504 | GTAAAATTTTATCTGGTAATTT | CTT | chr6 | 160662788 | 160662809 | 160662805 | 160662810 | + |
| SEQ ID NO 40505 | TAAAATTTTATCTGGTAATTTA | TTG | chr6 | 160662789 | 160662810 | 160662806 | 160662811 | + |
| SEQ ID NO 40506 | TATCTGGTAATTTATAGATTAA | TTT | chr6 | 160662797 | 160662818 | 160662814 | 160662819 | + |
| SEQ ID NO 40507 | ATCTGGTAATTTATAGATTAAA | TTT | chr6 | 160662798 | 160662819 | 160662815 | 160662820 | + |
| SEQ ID NO 40508 | TCTGGTAATTTATAGATTAAAT | TTA | chr6 | 160662799 | 160662820 | 160662816 | 160662821 | + |
| SEQ ID NO 40509 | GTAATTTATAGATTAAATTGCA | CTG | chr6 | 160662803 | 160662824 | 160662820 | 160662825 | + |
| SEQ ID NO 40510 | ATAGATTAAATTGCAAGCATCT | TTT | chr6 | 160662810 | 160662831 | 160662827 | 160662832 | + |
| SEQ ID NO 40511 | TAGATTAAATTGCAAGCATCTA | TTA | chr6 | 160662811 | 160662832 | 160662828 | 160662833 | + |
| SEQ ID NO 40512 | AATTGCAAGCATCTACCTCCCT | TTA | chr6 | 160662818 | 160662839 | 160662835 | 160662840 | + |
| SEQ ID NO 40513 | CAAGCATCTACCTCCCTTTCAT | TTG | chr6 | 160662823 | 160662844 | 160662840 | 160662845 | + |
| SEQ ID NO 40514 | CCTCCCTTTCATCAGACTCTCC | CTA | chr6 | 160662833 | 160662854 | 160662850 | 160662855 | + |

Figure 60 (Cont'd)

| SEQ ID NO 40515 | CCTTTCATCAGACTCTCCCTGC | CTC | chr6 | 160662837 | 160662858 | 160662854 | 160662859 | + |
| SEQ ID NO 40516 | TCATCAGACTCTCCCTGCAGGG | CTT | chr6 | 160662841 | 160662862 | 160662858 | 160662863 | + |
| SEQ ID NO 40517 | CATCAGACTCTCCCTGCAGGGC | TTT | chr6 | 160662842 | 160662863 | 160662859 | 160662864 | + |
| SEQ ID NO 40518 | ATCAGACTCTCCCTGCAGGGCA | TTC | chr6 | 160662843 | 160662864 | 160662860 | 160662865 | + |
| SEQ ID NO 40519 | TCCCTGCAGGGCAAGTTCATCT | CTC | chr6 | 160662852 | 160662873 | 160662869 | 160662874 | + |
| SEQ ID NO 40520 | CCTGCAGGGCAAGTTCATCTAA | CTC | chr6 | 160662854 | 160662875 | 160662871 | 160662876 | + |
| SEQ ID NO 40521 | CAGGGCAAGTTCATCTAACTAT | CTG | chr6 | 160662858 | 160662879 | 160662875 | 160662880 | + |
| SEQ ID NO 40522 | ATCTAACTATGTATGTGCTTCA | TTC | chr6 | 160662870 | 160662891 | 160662887 | 160662892 | + |
| SEQ ID NO 40523 | ACTATGTATGTGCTTCAAGATG | CTA | chr6 | 160662875 | 160662896 | 160662892 | 160662897 | + |
| SEQ ID NO 40524 | TGTATGTGCTTCAAGATGGAAC | CTA | chr6 | 160662879 | 160662900 | 160662896 | 160662901 | + |
| SEQ ID NO 40525 | CAAGATGGAACTCCTGAGTTCA | CTT | chr6 | 160662890 | 160662911 | 160662907 | 160662912 | + |
| SEQ ID NO 40526 | AAGATGGAACTCCTGAGTTCAC | TTC | chr6 | 160662891 | 160662912 | 160662908 | 160662913 | + |
| SEQ ID NO 40527 | CTGAGTTCACAGGTGATTTATA | CTC | chr6 | 160662903 | 160662924 | 160662920 | 160662925 | + |
| SEQ ID NO 40528 | AGTTCACAGGTGATTTATAAAC | CTG | chr6 | 160662906 | 160662927 | 160662923 | 160662928 | + |
| SEQ ID NO 40529 | ACAGGTGATTTATAAACCAAAG | TTC | chr6 | 160662911 | 160662932 | 160662928 | 160662933 | + |
| SEQ ID NO 40530 | ATAAACCAAAGCATGCCCACTA | TTT | chr6 | 160662922 | 160662943 | 160662939 | 160662944 | + |
| SEQ ID NO 40531 | TAAACCAAAGCATGCCCACTAC | TTA | chr6 | 160662923 | 160662944 | 160662940 | 160662945 | + |
| SEQ ID NO 40532 | CAAAACTCTCACCCTCCAGAGA | CTA | chr6 | 160662944 | 160662965 | 160662961 | 160662966 | + |
| SEQ ID NO 40533 | TCACCCTCCAGAGATTTGCCTC | CTC | chr6 | 160662952 | 160662973 | 160662969 | 160662974 | + |
| SEQ ID NO 40534 | ACCCTCCAGAGATTTGCCTCAA | CTC | chr6 | 160662954 | 160662975 | 160662971 | 160662976 | + |
| SEQ ID NO 40535 | CAGAGATTTGCCTCAAGGGACA | CTC | chr6 | 160662960 | 160662981 | 160662977 | 160662982 | + |
| SEQ ID NO 40536 | GCCTCAAGGGACAACACCCTGC | TTT | chr6 | 160662969 | 160662990 | 160662986 | 160662991 | + |
| SEQ ID NO 40537 | CCTCAAGGGACAACACCCTGCT | TTG | chr6 | 160662970 | 160662991 | 160662987 | 160662992 | + |
| SEQ ID NO 40538 | AAGGGACAACACCCTGCTCACA | CTC | chr6 | 160662974 | 160662995 | 160662991 | 160662996 | + |
| SEQ ID NO 40539 | CTCACAAAGGCACCAGCAGGCA | CTG | chr6 | 160662990 | 160663011 | 160663007 | 160663012 | + |
| SEQ ID NO 40540 | ACAAAGGCACCAGCAGGCAACT | CTC | chr6 | 160662993 | 160663014 | 160663010 | 160663015 | + |
| SEQ ID NO 40541 | CTCAACTACCTGGTGGATAAGG | CTG | chr6 | 160663016 | 160663037 | 160663033 | 160663038 | + |
| SEQ ID NO 40542 | AACTACCTGGTGGATAAGGTGC | CTC | chr6 | 160663019 | 160663040 | 160663036 | 160663041 | + |
| SEQ ID NO 40543 | CCTGGTGGATAAGGTGCCCAAG | CTA | chr6 | 160663024 | 160663045 | 160663041 | 160663046 | + |
| SEQ ID NO 40544 | GTGGATAAGGTGCCCAAGCTAG | CTG | chr6 | 160663028 | 160663049 | 160663045 | 160663050 | + |
| SEQ ID NO 40545 | GCATGGACCCCTGAATCCTTGC | CTA | chr6 | 160663049 | 160663070 | 160663066 | 160663071 | + |
| SEQ ID NO 40546 | AATCCTTGCTCGCCTCCTCTGT | CTG | chr6 | 160663062 | 160663083 | 160663079 | 160663084 | + |
| SEQ ID NO 40547 | GCTCGCCTCCTCTGTTGCCTTT | CTT | chr6 | 160663069 | 160663090 | 160663086 | 160663091 | + |
| SEQ ID NO 40548 | CTCGCCTCCTCTGTTGCCTTTT | TTG | chr6 | 160663070 | 160663091 | 160663087 | 160663092 | + |
| SEQ ID NO 40549 | GCCTCCTCTGTTGCCTTTTAAA | CTC | chr6 | 160663073 | 160663094 | 160663090 | 160663095 | + |
| SEQ ID NO 40550 | CTCTGTTGCCTTTTAAAAGTGC | CTC | chr6 | 160663078 | 160663099 | 160663095 | 160663100 | + |
| SEQ ID NO 40551 | TGTTGCCTTTTAAAAGTGCCAC | CTC | chr6 | 160663081 | 160663102 | 160663098 | 160663103 | + |
| SEQ ID NO 40552 | TTGCCTTTTAAAAGTGCCACTT | CTG | chr6 | 160663083 | 160663104 | 160663100 | 160663105 | + |
| SEQ ID NO 40553 | CCTTTTAAAAGTGCCACTTTCT | TTG | chr6 | 160663086 | 160663107 | 160663103 | 160663108 | + |
| SEQ ID NO 40554 | TTAAAAGTGCCACTTTCTGCTC | CTT | chr6 | 160663090 | 160663111 | 160663107 | 160663112 | + |
| SEQ ID NO 40555 | TAAAAGTGCCACTTTCTGCTCC | TTT | chr6 | 160663091 | 160663112 | 160663108 | 160663113 | + |
| SEQ ID NO 40556 | AAAAGTGCCACTTTCTGCTCCT | TTT | chr6 | 160663092 | 160663113 | 160663109 | 160663114 | + |
| SEQ ID NO 40557 | AAAGTGCCACTTTCTGCTCCTA | TTA | chr6 | 160663093 | 160663114 | 160663110 | 160663115 | + |
| SEQ ID NO 40558 | TCTGCTCCTAAAGTGAAGTAGT | CTT | chr6 | 160663105 | 160663126 | 160663122 | 160663127 | + |
| SEQ ID NO 40559 | CTGCTCCTAAAGTGAAGTAGTA | TTT | chr6 | 160663106 | 160663127 | 160663123 | 160663128 | + |
| SEQ ID NO 40560 | TGCTCCTAAAGTGAAGTAGTAC | TTC | chr6 | 160663107 | 160663128 | 160663124 | 160663129 | + |
| SEQ ID NO 40561 | CTCCTAAAGTGAAGTAGTACGG | CTG | chr6 | 160663109 | 160663130 | 160663126 | 160663131 | + |
| SEQ ID NO 40562 | CTAAAGTGAAGTAGTACGGCAG | CTC | chr6 | 160663112 | 160663133 | 160663129 | 160663134 | + |
| SEQ ID NO 40563 | AAGTGAAGTAGTACGGCAGGAC | CTA | chr6 | 160663115 | 160663136 | 160663132 | 160663137 | + |
| SEQ ID NO 40564 | CTGCATTTCTTCCCCTAAGCTA | CTG | chr6 | 160663139 | 160663160 | 160663156 | 160663161 | + |
| SEQ ID NO 40565 | CATTTCTTCCCCTAAGCTAGCT | CTG | chr6 | 160663142 | 160663163 | 160663159 | 160663164 | + |
| SEQ ID NO 40566 | CTTCCCCTAAGCTAGCTTTGGA | TTT | chr6 | 160663147 | 160663168 | 160663164 | 160663169 | + |
| SEQ ID NO 40567 | TTCCCCTAAGCTAGCTTTGGAA | TTC | chr6 | 160663148 | 160663169 | 160663165 | 160663170 | + |
| SEQ ID NO 40568 | CCCCTAAGCTAGCTTTGGAAGC | CTT | chr6 | 160663150 | 160663171 | 160663167 | 160663172 | + |
| SEQ ID NO 40569 | CCCTAAGCTAGCTTTGGAAGCA | TTC | chr6 | 160663151 | 160663172 | 160663168 | 160663173 | + |
| SEQ ID NO 40570 | AGCTAGCTTTGGAAGCAAATCA | CTA | chr6 | 160663156 | 160663177 | 160663173 | 160663178 | + |
| SEQ ID NO 40571 | GCTTTGGAAGCAAATCACTTTC | CTA | chr6 | 160663161 | 160663182 | 160663178 | 160663183 | + |
| SEQ ID NO 40572 | TGGAAGCAAATCACTTTCTTTA | CTT | chr6 | 160663165 | 160663186 | 160663182 | 160663187 | + |

Figure 60 (Cont'd)

| | | | | | | | | |
|---|---|---|---|---|---|---|---|---|
| SEQ ID NO 40573 | GGAAGCAAATCACTTTCTTTAT | TTT | chr6 | 160663166 | 160663187 | 160663183 | 160663188 | + |
| SEQ ID NO 40574 | GAAGCAAATCACTTTCTTTATA | TTG | chr6 | 160663167 | 160663188 | 160663184 | 160663189 | + |
| SEQ ID NO 40575 | TCTTTATACCAGACTTCTCTCT | CTT | chr6 | 160663181 | 160663202 | 160663198 | 160663203 | + |
| SEQ ID NO 40576 | CTTTATACCAGACTTCTCTCTT | TTT | chr6 | 160663182 | 160663203 | 160663199 | 160663204 | + |
| SEQ ID NO 40577 | TTTATACCAGACTTCTCTCTTC | TTC | chr6 | 160663183 | 160663204 | 160663200 | 160663205 | + |
| SEQ ID NO 40578 | TATACCAGACTTCTCTCTTCTT | CTT | chr6 | 160663185 | 160663206 | 160663202 | 160663207 | + |
| SEQ ID NO 40579 | ATACCAGACTTCTCTCTTCTTA | TTT | chr6 | 160663186 | 160663207 | 160663203 | 160663208 | + |
| SEQ ID NO 40580 | TACCAGACTTCTCTCTTCTTAA | TTA | chr6 | 160663187 | 160663208 | 160663204 | 160663209 | + |
| SEQ ID NO 40581 | CTCTCTTCTTAATTGGATTCTG | CTT | chr6 | 160663197 | 160663218 | 160663214 | 160663219 | + |
| SEQ ID NO 40582 | TCTCTTCTTAATTGGATTCTGC | TTC | chr6 | 160663198 | 160663219 | 160663215 | 160663220 | + |
| SEQ ID NO 40583 | TCTTCTTAATTGGATTCTGCAA | CTC | chr6 | 160663200 | 160663221 | 160663217 | 160663222 | + |
| SEQ ID NO 40584 | TTCTTAATTGGATTCTGCAAGT | CTC | chr6 | 160663202 | 160663223 | 160663219 | 160663224 | + |
| SEQ ID NO 40585 | CTTAATTGGATTCTGCAAGTGG | CTT | chr6 | 160663204 | 160663225 | 160663221 | 160663226 | + |
| SEQ ID NO 40586 | TTAATTGGATTCTGCAAGTGGC | TTC | chr6 | 160663205 | 160663226 | 160663222 | 160663227 | + |
| SEQ ID NO 40587 | AATTGGATTCTGCAAGTGGCAA | CTT | chr6 | 160663207 | 160663228 | 160663224 | 160663229 | + |
| SEQ ID NO 40588 | ATTGGATTCTGCAAGTGGCAAA | TTA | chr6 | 160663208 | 160663229 | 160663225 | 160663230 | + |
| SEQ ID NO 40589 | GATTCTGCAAGTGGCAAACAAT | TTG | chr6 | 160663212 | 160663233 | 160663229 | 160663234 | + |
| SEQ ID NO 40590 | TGCAAGTGGCAAACAATTAACC | TTC | chr6 | 160663217 | 160663238 | 160663234 | 160663239 | + |
| SEQ ID NO 40591 | CAAGTGGCAAACAATTAACCTG | CTG | chr6 | 160663219 | 160663240 | 160663236 | 160663241 | + |
| SEQ ID NO 40592 | ACCTGCTCTTCAGTTACATTGG | TTA | chr6 | 160663236 | 160663257 | 160663253 | 160663258 | + |
| SEQ ID NO 40593 | CTCTTCAGTTACATTGGAATGT | CTG | chr6 | 160663241 | 160663262 | 160663258 | 160663263 | + |
| SEQ ID NO 40594 | TTCAGTTACATTGGAATGTGTT | CTC | chr6 | 160663244 | 160663265 | 160663261 | 160663266 | + |
| SEQ ID NO 40595 | CAGTTACATTGGAATGTGTTTA | CTT | chr6 | 160663246 | 160663267 | 160663263 | 160663268 | + |
| SEQ ID NO 40596 | AGTTACATTGGAATGTGTTTAG | TTC | chr6 | 160663247 | 160663268 | 160663264 | 160663269 | + |
| SEQ ID NO 40597 | CATTGGAATGTGTTTAGATTTA | TTA | chr6 | 160663252 | 160663273 | 160663269 | 160663274 | + |
| SEQ ID NO 40598 | GAATGTGTTTAGATTTATTTTT | TTG | chr6 | 160663257 | 160663278 | 160663274 | 160663279 | + |
| SEQ ID NO 40599 | AGATTTATTTTTTCAAATGTTG | TTT | chr6 | 160663267 | 160663288 | 160663284 | 160663289 | + |
| SEQ ID NO 40600 | GATTTATTTTTCAAATGTTGG | TTA | chr6 | 160663268 | 160663289 | 160663285 | 160663290 | + |
| SEQ ID NO 40601 | ATTTTTTCAAATGTTGGAACAA | TTT | chr6 | 160663273 | 160663294 | 160663290 | 160663295 | + |
| SEQ ID NO 40602 | TTTTTTCAAATGTTGGAACAAA | TTA | chr6 | 160663274 | 160663295 | 160663291 | 160663296 | + |
| SEQ ID NO 40603 | TTTCAAATGTTGGAACAAAGAT | TTT | chr6 | 160663277 | 160663298 | 160663294 | 160663299 | + |
| SEQ ID NO 40604 | TTCAAATGTTGGAACAAAGATG | TTT | chr6 | 160663278 | 160663299 | 160663295 | 160663300 | + |
| SEQ ID NO 40605 | TCAAATGTTGGAACAAAGATGA | TTT | chr6 | 160663279 | 160663300 | 160663296 | 160663301 | + |
| SEQ ID NO 40606 | CAAATGTTGGAACAAAGATGAA | TTT | chr6 | 160663280 | 160663301 | 160663297 | 160663302 | + |
| SEQ ID NO 40607 | AAATGTTGGAACAAAGATGAAA | TTC | chr6 | 160663281 | 160663302 | 160663298 | 160663303 | + |
| SEQ ID NO 40608 | GAACAAAGATGAAAAGTGAGA | TTG | chr6 | 160663289 | 160663310 | 160663306 | 160663311 | + |
| SEQ ID NO 40609 | GATTTTTCTTGGAAATCTGGC | CTA | chr6 | 160663320 | 160663341 | 160663337 | 160663342 | + |
| SEQ ID NO 40610 | TTTCTTGGAAATCTGGCTTAAA | TTT | chr6 | 160663325 | 160663346 | 160663342 | 160663347 | + |
| SEQ ID NO 40611 | TTCTTGGAAATCTGGCTTAAAT | TTT | chr6 | 160663326 | 160663347 | 160663343 | 160663348 | + |
| SEQ ID NO 40612 | TCTTGGAAATCTGGCTTAAATC | TTT | chr6 | 160663327 | 160663348 | 160663344 | 160663349 | + |
| SEQ ID NO 40613 | CTTGGAAATCTGGCTTAAATCC | TTT | chr6 | 160663328 | 160663349 | 160663345 | 160663350 | + |
| SEQ ID NO 40614 | TTGGAAATCTGGCTTAAATCCA | TTC | chr6 | 160663329 | 160663350 | 160663346 | 160663351 | + |
| SEQ ID NO 40615 | GGAAATCTGGCTTAAATCCAGG | CTT | chr6 | 160663331 | 160663352 | 160663348 | 160663353 | + |
| SEQ ID NO 40616 | GAAATCTGGCTTAAATCCAGGT | TTG | chr6 | 160663332 | 160663353 | 160663349 | 160663354 | + |
| SEQ ID NO 40617 | GCTTAAATCCAGGTTTCTTTAT | CTG | chr6 | 160663340 | 160663361 | 160663357 | 160663362 | + |
| SEQ ID NO 40618 | AAATCCAGGTTTCTTTATTTCC | CTT | chr6 | 160663344 | 160663365 | 160663361 | 160663366 | + |
| SEQ ID NO 40619 | AATCCAGGTTTCTTTATTTCCT | TTA | chr6 | 160663345 | 160663366 | 160663362 | 160663367 | + |
| SEQ ID NO 40620 | CTTTATTTCCTTGATTGGGAA | TTT | chr6 | 160663356 | 160663377 | 160663373 | 160663378 | + |
| SEQ ID NO 40621 | TTTATTTCCTTGATTTGGGAAT | TTC | chr6 | 160663357 | 160663378 | 160663374 | 160663379 | + |
| SEQ ID NO 40622 | TATTTCCTTGATTTGGGAATTT | CTT | chr6 | 160663359 | 160663380 | 160663376 | 160663381 | + |
| SEQ ID NO 40623 | ATTTCCTTGATTTGGGAATTTG | TTT | chr6 | 160663360 | 160663381 | 160663377 | 160663382 | + |
| SEQ ID NO 40624 | TTTCCTTGATTTGGGAATTTGG | TTA | chr6 | 160663361 | 160663382 | 160663378 | 160663383 | + |
| SEQ ID NO 40625 | CCTTGATTTGGGAATTTGGTCA | TTT | chr6 | 160663364 | 160663385 | 160663381 | 160663386 | + |
| SEQ ID NO 40626 | CTTGATTTGGGAATTTGGTCAC | TTC | chr6 | 160663365 | 160663386 | 160663382 | 160663387 | + |
| SEQ ID NO 40627 | GATTTGGGAATTTGGTCACGAG | CTT | chr6 | 160663368 | 160663389 | 160663385 | 160663390 | + |
| SEQ ID NO 40628 | ATTTGGGAATTTGGTCACGAGA | TTG | chr6 | 160663369 | 160663390 | 160663386 | 160663391 | + |
| SEQ ID NO 40629 | GGGAATTTGGTCACGAGACAAA | TTT | chr6 | 160663373 | 160663394 | 160663390 | 160663395 | + |
| SEQ ID NO 40630 | GGAATTTGGTCACGAGACAAAT | TTG | chr6 | 160663374 | 160663395 | 160663391 | 160663396 | + |

Figure 60 (Cont'd)

| SEQ ID NO 40631 | GGTCACGAGACAAATAACATGA | TTT | chr6 | 160663381 | 160663402 | 160663398 | 160663403 | + |
| SEQ ID NO 40632 | GTCACGAGACAAATAACATGAT | TTG | chr6 | 160663382 | 160663403 | 160663399 | 160663404 | + |
| SEQ ID NO 40633 | TCCTAAGTCTAGATTTCTTTGT | TTT | chr6 | 160663406 | 160663427 | 160663423 | 160663428 | + |
| SEQ ID NO 40634 | CCTAAGTCTAGATTTCTTTGTT | TTT | chr6 | 160663407 | 160663428 | 160663424 | 160663429 | + |
| SEQ ID NO 40635 | CTAAGTCTAGATTTCTTTGTTT | TTC | chr6 | 160663408 | 160663429 | 160663425 | 160663430 | + |
| SEQ ID NO 40636 | AGTCTAGATTTCTTTGTTTATA | CTA | chr6 | 160663411 | 160663432 | 160663428 | 160663433 | + |
| SEQ ID NO 40637 | GATTTCTTTGTTTATAAAATGG | CTA | chr6 | 160663417 | 160663438 | 160663434 | 160663439 | + |
| SEQ ID NO 40638 | CTTTGTTTATAAAATGGGGATG | TTT | chr6 | 160663422 | 160663443 | 160663439 | 160663444 | + |
| SEQ ID NO 40639 | TTTGTTTATAAAATGGGGATGA | TTC | chr6 | 160663423 | 160663444 | 160663440 | 160663445 | + |
| SEQ ID NO 40640 | TGTTTATAAAATGGGGATGACT | CTT | chr6 | 160663425 | 160663446 | 160663442 | 160663447 | + |
| SEQ ID NO 40641 | GTTTATAAAATGGGGATGACTA | TTT | chr6 | 160663426 | 160663447 | 160663443 | 160663448 | + |
| SEQ ID NO 40642 | TTTATAAAATGGGGATGACTAT | TTG | chr6 | 160663427 | 160663448 | 160663444 | 160663449 | + |
| SEQ ID NO 40643 | ATAAAATGGGGATGACTATGCT | TTT | chr6 | 160663430 | 160663451 | 160663447 | 160663452 | + |
| SEQ ID NO 40644 | TAAAATGGGGATGACTATGCTA | TTA | chr6 | 160663431 | 160663452 | 160663448 | 160663453 | + |
| SEQ ID NO 40645 | TGCTACCCTACCTATACCATGA | CTA | chr6 | 160663448 | 160663469 | 160663465 | 160663470 | + |
| SEQ ID NO 40646 | CCCTACCTATACCATGAGCTAA | CTA | chr6 | 160663453 | 160663474 | 160663470 | 160663475 | + |
| SEQ ID NO 40647 | CCTATACCATGAGCTAAATAAG | CTA | chr6 | 160663458 | 160663479 | 160663475 | 160663480 | + |
| SEQ ID NO 40648 | TACCATGAGCTAAATAAGCTAG | CTA | chr6 | 160663462 | 160663483 | 160663479 | 160663484 | + |
| SEQ ID NO 40649 | AATAAGCTAGTATTTGTAAAGG | CTA | chr6 | 160663474 | 160663495 | 160663491 | 160663496 | + |
| SEQ ID NO 40650 | GTATTTGTAAAGGACACACACT | CTA | chr6 | 160663483 | 160663504 | 160663500 | 160663505 | + |
| SEQ ID NO 40651 | GTAAAGGACACACACTTACATT | TTT | chr6 | 160663489 | 160663510 | 160663506 | 160663511 | + |
| SEQ ID NO 40652 | TAAAGGACACACACTTACATTC | TTG | chr6 | 160663490 | 160663511 | 160663507 | 160663512 | + |
| SEQ ID NO 40653 | ACATTCACAATCACACACGGTG | CTT | chr6 | 160663506 | 160663527 | 160663523 | 160663528 | + |
| SEQ ID NO 40654 | CATTCACAATCACACACGGTGT | TTA | chr6 | 160663507 | 160663528 | 160663524 | 160663529 | + |
| SEQ ID NO 40655 | ACAATCACACACGGTGTGTATG | TTC | chr6 | 160663512 | 160663533 | 160663529 | 160663534 | + |
| SEQ ID NO 40656 | ACCCACTCAACAAATACCCTGA | CTA | chr6 | 160663566 | 160663587 | 160663583 | 160663588 | + |
| SEQ ID NO 40657 | AACAAATACCCTGAGTATTTGT | CTC | chr6 | 160663574 | 160663595 | 160663591 | 160663596 | + |
| SEQ ID NO 40658 | AGTATTTGTTGAATCATTATAT | CTG | chr6 | 160663587 | 160663608 | 160663604 | 160663609 | + |
| SEQ ID NO 40659 | GTTGAATCATTATATGCGTATA | TTT | chr6 | 160663594 | 160663615 | 160663611 | 160663616 | + |
| SEQ ID NO 40660 | TTGAATCATTATATGCGTATAT | TTG | chr6 | 160663595 | 160663616 | 160663612 | 160663617 | + |
| SEQ ID NO 40661 | AATCATTATATGCGTATATCAT | TTG | chr6 | 160663598 | 160663619 | 160663615 | 160663620 | + |
| SEQ ID NO 40662 | TATGCGTATATCATCTGGCAAA | TTA | chr6 | 160663606 | 160663627 | 160663623 | 160663628 | + |
| SEQ ID NO 40663 | GCAAATGGATGTGTATAATTTC | CTG | chr6 | 160663623 | 160663644 | 160663640 | 160663645 | + |
| SEQ ID NO 40664 | CTCCAGGGATAAGAAGCAAATG | TTT | chr6 | 160663644 | 160663665 | 160663661 | 160663666 | + |
| SEQ ID NO 40665 | TCCAGGGATAAGAAGCAAATGT | TTC | chr6 | 160663645 | 160663666 | 160663662 | 160663667 | + |
| SEQ ID NO 40666 | CAGGGATAAGAAGCAAATGTAT | CTC | chr6 | 160663647 | 160663668 | 160663664 | 160663669 | + |
| SEQ ID NO 40667 | ACTCAGGCCATAACAAAGAGAG | CTT | chr6 | 160663685 | 160663706 | 160663702 | 160663707 | + |
| SEQ ID NO 40668 | CTCAGGCCATAACAAAGAGAGA | TTA | chr6 | 160663686 | 160663707 | 160663703 | 160663708 | + |
| SEQ ID NO 40669 | AGGCCATAACAAAGAGAGAAAT | CTC | chr6 | 160663689 | 160663710 | 160663706 | 160663711 | + |
| SEQ ID NO 40670 | AGTCCCACTCCATGAACAGGTC | CTG | chr6 | 160663715 | 160663736 | 160663732 | 160663737 | + |
| SEQ ID NO 40671 | CATGAACAGGTCAAGGAACCAA | CTC | chr6 | 160663725 | 160663746 | 160663742 | 160663747 | + |
| SEQ ID NO 40672 | AAAGAGTTATTTCATTGTTTCA | TTC | chr6 | 160663755 | 160663776 | 160663772 | 160663777 | + |
| SEQ ID NO 40673 | TTTCATTGTTTCAACTTGCTAG | TTA | chr6 | 160663764 | 160663785 | 160663781 | 160663786 | + |
| SEQ ID NO 40674 | CATTGTTTCAACTTGCTAGTGA | TTT | chr6 | 160663767 | 160663788 | 160663784 | 160663789 | + |
| SEQ ID NO 40675 | ATTGTTTCAACTTGCTAGTGAG | TTC | chr6 | 160663768 | 160663789 | 160663785 | 160663790 | + |
| SEQ ID NO 40676 | TTTCAACTTGCTAGTGAGGGGA | TTG | chr6 | 160663772 | 160663793 | 160663789 | 160663794 | + |
| SEQ ID NO 40677 | CAACTTGCTAGTGAGGGGAGCA | TTT | chr6 | 160663775 | 160663796 | 160663792 | 160663797 | + |
| SEQ ID NO 40678 | AACTTGCTAGTGAGGGGAGCAT | TTC | chr6 | 160663776 | 160663797 | 160663793 | 160663798 | + |
| SEQ ID NO 40679 | GCTAGTGAGGGGAGCATGGCAC | CTT | chr6 | 160663781 | 160663802 | 160663798 | 160663803 | + |
| SEQ ID NO 40680 | CTAGTGAGGGGAGCATGGCACC | TTG | chr6 | 160663782 | 160663803 | 160663799 | 160663804 | + |
| SEQ ID NO 40681 | GTGAGGGGAGCATGGCACCTGA | CTA | chr6 | 160663785 | 160663806 | 160663802 | 160663807 | + |
| SEQ ID NO 40682 | AACAGAGATGATATAAATTAAT | CTG | chr6 | 160663806 | 160663827 | 160663823 | 160663828 | + |
| SEQ ID NO 40683 | ATGAAACTGAGAACCAAGCGAA | TTA | chr6 | 160663826 | 160663847 | 160663843 | 160663848 | + |
| SEQ ID NO 40684 | AGAACCAAGCGAAGAGCTTAGC | CTG | chr6 | 160663835 | 160663856 | 160663852 | 160663857 | + |
| SEQ ID NO 40685 | AGCCATCCTTTGCATAGTTAGC | CTT | chr6 | 160663854 | 160663875 | 160663871 | 160663876 | + |
| SEQ ID NO 40686 | GCCATCCTTTGCATAGTTAGCT | TTA | chr6 | 160663855 | 160663876 | 160663872 | 160663877 | + |
| SEQ ID NO 40687 | TGCATAGTTAGCTACAATGGCT | CTT | chr6 | 160663864 | 160663885 | 160663881 | 160663886 | + |
| SEQ ID NO 40688 | GCATAGTTAGCTACAATGGCTA | TTT | chr6 | 160663865 | 160663886 | 160663882 | 160663887 | + |

Figure 60 (Cont'd)

| | | | | | | | | |
|---|---|---|---|---|---|---|---|---|
| SEQ ID NO 40689 | CATAGTTAGCTACAATGGCTAT | TTG | chr6 | 160663866 | 160663887 | 160663883 | 160663888 | + |
| SEQ ID NO 40690 | GCTACAATGGCTATTTATTTTT | TTA | chr6 | 160663874 | 160663895 | 160663891 | 160663896 | + |
| SEQ ID NO 40691 | CAATGGCTATTTATTTTTCAGC | CTA | chr6 | 160663878 | 160663899 | 160663895 | 160663900 | + |
| SEQ ID NO 40692 | TTTATTTTTCAGCCAGACTGGC | CTA | chr6 | 160663887 | 160663908 | 160663904 | 160663909 | + |
| SEQ ID NO 40693 | ATTTTTCAGCCAGACTGGCCAT | TTT | chr6 | 160663890 | 160663911 | 160663907 | 160663912 | + |
| SEQ ID NO 40694 | TTTTTCAGCCAGACTGGCCATC | TTA | chr6 | 160663891 | 160663912 | 160663908 | 160663913 | + |
| SEQ ID NO 40695 | TTCAGCCAGACTGGCCATCATG | TTT | chr6 | 160663894 | 160663915 | 160663911 | 160663916 | + |
| SEQ ID NO 40696 | TCAGCCAGACTGGCCATCATGT | TTT | chr6 | 160663895 | 160663916 | 160663912 | 160663917 | + |
| SEQ ID NO 40697 | CAGCCAGACTGGCCATCATGTA | TTT | chr6 | 160663896 | 160663917 | 160663913 | 160663918 | + |
| SEQ ID NO 40698 | AGCCAGACTGGCCATCATGTAG | TTC | chr6 | 160663897 | 160663918 | 160663914 | 160663919 | + |
| SEQ ID NO 40699 | GCCATCATGTAGGCACACTCTT | CTG | chr6 | 160663907 | 160663928 | 160663924 | 160663929 | + |
| SEQ ID NO 40700 | TTTTAGATTAGAAAAATCAACC | CTC | chr6 | 160663927 | 160663948 | 160663944 | 160663949 | + |
| SEQ ID NO 40701 | TTAGATTAGAAAAATCAACCAT | CTT | chr6 | 160663929 | 160663950 | 160663946 | 160663951 | + |
| SEQ ID NO 40702 | TAGATTAGAAAAATCAACCATT | TTT | chr6 | 160663930 | 160663951 | 160663947 | 160663952 | + |
| SEQ ID NO 40703 | AGATTAGAAAAATCAACCATTA | TTT | chr6 | 160663931 | 160663952 | 160663948 | 160663953 | + |
| SEQ ID NO 40704 | GATTAGAAAAATCAACCATTAT | TTA | chr6 | 160663932 | 160663953 | 160663949 | 160663954 | + |
| SEQ ID NO 40705 | GAAAAATCAACCATTATTTTTT | TTA | chr6 | 160663937 | 160663958 | 160663954 | 160663959 | + |
| SEQ ID NO 40706 | TTTTTTCTGCCCATTCATTCCA | TTA | chr6 | 160663953 | 160663974 | 160663970 | 160663975 | + |
| SEQ ID NO 40707 | TTTCTGCCCATTCATTCCAGCA | TTT | chr6 | 160663956 | 160663977 | 160663973 | 160663978 | + |
| SEQ ID NO 40708 | TTCTGCCCATTCATTCCAGCAC | TTT | chr6 | 160663957 | 160663978 | 160663974 | 160663979 | + |
| SEQ ID NO 40709 | TCTGCCCATTCATTCCAGCACC | TTT | chr6 | 160663958 | 160663979 | 160663975 | 160663980 | + |
| SEQ ID NO 40710 | CTGCCCATTCATTCCAGCACCG | TTT | chr6 | 160663959 | 160663980 | 160663976 | 160663981 | + |
| SEQ ID NO 40711 | TGCCCATTCATTCCAGCACCGT | TTC | chr6 | 160663960 | 160663981 | 160663977 | 160663982 | + |
| SEQ ID NO 40712 | CCCATTCATTCCAGCACCGTGA | CTG | chr6 | 160663962 | 160663983 | 160663979 | 160663984 | + |
| SEQ ID NO 40713 | ATTCCAGCACCGTGACAGTCTT | TTC | chr6 | 160663969 | 160663990 | 160663986 | 160663991 | + |
| SEQ ID NO 40714 | CAGCACCGTGACAGTCTTCACG | TTC | chr6 | 160663973 | 160663994 | 160663990 | 160663995 | + |
| SEQ ID NO 40715 | CACGGGGAAATTAAACTTATTT | CTT | chr6 | 160663991 | 160664012 | 160664008 | 160664013 | + |
| SEQ ID NO 40716 | ACGGGGAAATTAAACTTATTTT | TTC | chr6 | 160663992 | 160664013 | 160664009 | 160664014 | + |
| SEQ ID NO 40717 | AACTTATTTTTTTAAGAATTTT | TTA | chr6 | 160664004 | 160664025 | 160664021 | 160664026 | + |
| SEQ ID NO 40718 | ATTTTTTTAAGAATTTTTCAAT | CTT | chr6 | 160664009 | 160664030 | 160664026 | 160664031 | + |
| SEQ ID NO 40719 | TTTTTTTAAGAATTTTTCAATC | TTA | chr6 | 160664010 | 160664031 | 160664027 | 160664032 | + |
| SEQ ID NO 40720 | TTTTAAGAATTTTTCAATCATA | TTT | chr6 | 160664013 | 160664034 | 160664030 | 160664035 | + |
| SEQ ID NO 40721 | TTTAAGAATTTTTCAATCATAT | TTT | chr6 | 160664014 | 160664035 | 160664031 | 160664036 | + |
| SEQ ID NO 40722 | TTAAGAATTTTTCAATCATATA | TTT | chr6 | 160664015 | 160664036 | 160664032 | 160664037 | + |
| SEQ ID NO 40723 | TAAGAATTTTTCAATCATATAC | TTT | chr6 | 160664016 | 160664037 | 160664033 | 160664038 | + |
| SEQ ID NO 40724 | AAGAATTTTTCAATCATATACA | TTT | chr6 | 160664017 | 160664038 | 160664034 | 160664039 | + |
| SEQ ID NO 40725 | AGAATTTTTCAATCATATACAA | TTA | chr6 | 160664018 | 160664039 | 160664035 | 160664040 | + |
| SEQ ID NO 40726 | TTCAATCATATACAAGATTTTG | TTT | chr6 | 160664025 | 160664046 | 160664042 | 160664047 | + |
| SEQ ID NO 40727 | TCAATCATATACAAGATTTTGA | TTT | chr6 | 160664026 | 160664047 | 160664043 | 160664048 | + |
| SEQ ID NO 40728 | CAATCATATACAAGATTTTGAA | TTT | chr6 | 160664027 | 160664048 | 160664044 | 160664049 | + |
| SEQ ID NO 40729 | AATCATATACAAGATTTTGAAC | TTC | chr6 | 160664028 | 160664049 | 160664045 | 160664050 | + |
| SEQ ID NO 40730 | TGAACTGGGAATTTCATGAATC | TTT | chr6 | 160664045 | 160664066 | 160664062 | 160664067 | + |
| SEQ ID NO 40731 | GAACTGGGAATTTCATGAATCA | TTT | chr6 | 160664046 | 160664067 | 160664063 | 160664068 | + |
| SEQ ID NO 40732 | AACTGGGAATTTCATGAATCAA | TTG | chr6 | 160664047 | 160664068 | 160664064 | 160664069 | + |
| SEQ ID NO 40733 | GGAATTTCATGAATCAAAAATT | CTG | chr6 | 160664052 | 160664073 | 160664069 | 160664074 | + |
| SEQ ID NO 40734 | CATGAATCAAAAATTAAATGAA | TTT | chr6 | 160664059 | 160664080 | 160664076 | 160664081 | + |
| SEQ ID NO 40735 | ATGAATCAAAAATTAAATGAAT | TTC | chr6 | 160664060 | 160664081 | 160664077 | 160664082 | + |
| SEQ ID NO 40736 | AATGAATTGCACATAAAGCCAT | TTA | chr6 | 160664075 | 160664096 | 160664092 | 160664097 | + |
| SEQ ID NO 40737 | CACATAAAGCCATGGCATATGT | TTG | chr6 | 160664084 | 160664105 | 160664101 | 160664106 | + |
| SEQ ID NO 40738 | TTACTACATTGTGGGAGAAAAA | TTT | chr6 | 160664110 | 160664131 | 160664127 | 160664132 | + |
| SEQ ID NO 40739 | TACTACATTGTGGGAGAAAAAA | TTT | chr6 | 160664111 | 160664132 | 160664128 | 160664133 | + |
| SEQ ID NO 40740 | ACTACATTGTGGGAGAAAAAAT | TTT | chr6 | 160664112 | 160664133 | 160664129 | 160664134 | + |
| SEQ ID NO 40741 | CTACATTGTGGGAGAAAAAATA | TTA | chr6 | 160664113 | 160664134 | 160664130 | 160664135 | + |
| SEQ ID NO 40742 | CATTGTGGGAGAAAAATAATT | CTA | chr6 | 160664116 | 160664137 | 160664133 | 160664138 | + |
| SEQ ID NO 40743 | TGGGAGAAAAATAATTCTTAT | TTG | chr6 | 160664121 | 160664142 | 160664138 | 160664143 | + |
| SEQ ID NO 40744 | TTATAATTTAAAAAAACTATGT | TTC | chr6 | 160664139 | 160664160 | 160664156 | 160664161 | + |
| SEQ ID NO 40745 | ATAATTTAAAAAAACTATGTCT | CTT | chr6 | 160664141 | 160664162 | 160664158 | 160664163 | + |
| SEQ ID NO 40746 | TAATTTAAAAAAACTATGTCTT | TTA | chr6 | 160664142 | 160664163 | 160664159 | 160664164 | + |

Figure 60 (Cont'd)

| SEQ ID NO 40747 | AAAAAAACTATGTCTTACCTGA | TTT | chr6 | 160664148 | 160664169 | 160664165 | 160664170 | + |
|---|---|---|---|---|---|---|---|---|
| SEQ ID NO 40748 | AAAAAACTATGTCTTACCTGAT | TTA | chr6 | 160664149 | 160664170 | 160664166 | 160664171 | + |
| SEQ ID NO 40749 | TGTCTTACCTGATTTCAGAAAT | CTA | chr6 | 160664158 | 160664179 | 160664175 | 160664180 | + |
| SEQ ID NO 40750 | ACCTGATTTCAGAAATAAAAGA | CTT | chr6 | 160664164 | 160664185 | 160664181 | 160664186 | + |
| SEQ ID NO 40751 | CCTGATTTCAGAAATAAAAGAA | TTA | chr6 | 160664165 | 160664186 | 160664182 | 160664187 | + |
| SEQ ID NO 40752 | ATTTCAGAAATAAAAGAAGTAG | CTG | chr6 | 160664169 | 160664190 | 160664186 | 160664191 | + |
| SEQ ID NO 40753 | CAGAAATAAAAGAAGTAGAAGA | TTT | chr6 | 160664173 | 160664194 | 160664190 | 160664195 | + |
| SEQ ID NO 40754 | AGAAATAAAAGAAGTAGAAGAA | TTC | chr6 | 160664174 | 160664195 | 160664191 | 160664196 | + |
| SEQ ID NO 40755 | CCTTATGTTCCATTTTGGGACT | CTT | chr6 | 160664202 | 160664223 | 160664219 | 160664224 | + |
| SEQ ID NO 40756 | CTTATGTTCCATTTTGGGACTG | TTC | chr6 | 160664203 | 160664224 | 160664220 | 160664225 | + |
| SEQ ID NO 40757 | ATGTTCCATTTTGGGACTGGCC | CTT | chr6 | 160664206 | 160664227 | 160664223 | 160664228 | + |
| SEQ ID NO 40758 | TGTTCCATTTTGGGACTGGCCA | TTA | chr6 | 160664207 | 160664228 | 160664224 | 160664229 | + |
| SEQ ID NO 40759 | CATTTTGGGACTGGCCAGCAGT | TTC | chr6 | 160664212 | 160664233 | 160664229 | 160664234 | + |
| SEQ ID NO 40760 | TGGGACTGGCCAGCAGTGCCCA | TTT | chr6 | 160664217 | 160664238 | 160664234 | 160664239 | + |
| SEQ ID NO 40761 | GGGACTGGCCAGCAGTGCCCAG | TTT | chr6 | 160664218 | 160664239 | 160664235 | 160664240 | + |
| SEQ ID NO 40762 | GGACTGGCCAGCAGTGCCCAGA | TTG | chr6 | 160664219 | 160664240 | 160664236 | 160664241 | + |
| SEQ ID NO 40763 | GCCAGCAGTGCCCAGAAAGTGT | CTG | chr6 | 160664225 | 160664246 | 160664242 | 160664247 | + |
| SEQ ID NO 40764 | TTGACTTACATGAGAGTAAACG | TTG | chr6 | 160664267 | 160664288 | 160664284 | 160664289 | + |
| SEQ ID NO 40765 | ACTTACATGAGAGTAAACGCAC | TTG | chr6 | 160664270 | 160664291 | 160664287 | 160664292 | + |
| SEQ ID NO 40766 | ACATGAGAGTAAACGCACCCAC | CTT | chr6 | 160664274 | 160664295 | 160664291 | 160664296 | + |
| SEQ ID NO 40767 | CATGAGAGTAAACGCACCCACA | TTA | chr6 | 160664275 | 160664296 | 160664292 | 160664297 | + |
| SEQ ID NO 40768 | AGTTAATGATTCTCTCAGAGAC | TTA | chr6 | 160664315 | 160664336 | 160664332 | 160664337 | + |
| SEQ ID NO 40769 | ATGATTCTCTCAGAGACCCATG | TTA | chr6 | 160664320 | 160664341 | 160664337 | 160664342 | + |
| SEQ ID NO 40770 | TCTCAGAGACCCATGCCACTGG | TTC | chr6 | 160664327 | 160664348 | 160664344 | 160664349 | + |
| SEQ ID NO 40771 | TCAGAGACCCATGCCACTGGCT | CTC | chr6 | 160664329 | 160664350 | 160664346 | 160664351 | + |
| SEQ ID NO 40772 | AGAGACCCATGCCACTGGCTCA | CTC | chr6 | 160664331 | 160664352 | 160664348 | 160664353 | + |
| SEQ ID NO 40773 | GCTCAGCAGGGTTCAAACATTA | CTG | chr6 | 160664348 | 160664369 | 160664365 | 160664370 | + |
| SEQ ID NO 40774 | AGCAGGGTTCAAACATTACCTT | CTC | chr6 | 160664352 | 160664373 | 160664369 | 160664374 | + |
| SEQ ID NO 40775 | AAACATTACCTTGAATATAGAG | TTC | chr6 | 160664362 | 160664383 | 160664379 | 160664384 | + |
| SEQ ID NO 40776 | CCTTGAATATAGAGTCTTATAA | TTA | chr6 | 160664370 | 160664391 | 160664387 | 160664392 | + |
| SEQ ID NO 40777 | GAATATAGAGTCTTATAAAATA | CTT | chr6 | 160664374 | 160664395 | 160664391 | 160664396 | + |
| SEQ ID NO 40778 | AATATAGAGTCTTATAAAATAT | TTG | chr6 | 160664375 | 160664396 | 160664392 | 160664397 | + |
| SEQ ID NO 40779 | ATAAAATATTTGAGAGTGCAAT | CTT | chr6 | 160664388 | 160664409 | 160664405 | 160664410 | + |
| SEQ ID NO 40780 | TAAAATATTTGAGAGTGCAATG | TTA | chr6 | 160664389 | 160664410 | 160664406 | 160664411 | + |
| SEQ ID NO 40781 | GAGAGTGCAATGTCAATAGATG | TTT | chr6 | 160664399 | 160664420 | 160664416 | 160664421 | + |
| SEQ ID NO 40782 | AGAGTGCAATGTCAATAGATGC | TTG | chr6 | 160664400 | 160664421 | 160664417 | 160664422 | + |
| SEQ ID NO 40783 | GGAAGTGGTGAAAGCCATTTCC | CTG | chr6 | 160664424 | 160664445 | 160664441 | 160664446 | + |
| SEQ ID NO 40784 | CCCCCCTCAGCTGCTCCACATT | TTT | chr6 | 160664444 | 160664465 | 160664461 | 160664466 | + |
| SEQ ID NO 40785 | CCCCCTCAGCTGCTCCACATTG | TTC | chr6 | 160664445 | 160664466 | 160664462 | 160664467 | + |
| SEQ ID NO 40786 | AGCTGCTCCACATTGCCTTTAT | CTC | chr6 | 160664452 | 160664473 | 160664469 | 160664474 | + |
| SEQ ID NO 40787 | CTCCACATTGCCTTTATGTCTC | CTG | chr6 | 160664457 | 160664478 | 160664474 | 160664479 | + |
| SEQ ID NO 40788 | CACATTGCCTTTATGTCTCCTT | CTC | chr6 | 160664460 | 160664481 | 160664477 | 160664482 | + |
| SEQ ID NO 40789 | CCTTTATGTCTCCTTACTCCTT | TTG | chr6 | 160664467 | 160664488 | 160664484 | 160664489 | + |
| SEQ ID NO 40790 | TATGTCTCCTTACTCCTTCCCT | CTT | chr6 | 160664471 | 160664492 | 160664488 | 160664493 | + |
| SEQ ID NO 40791 | ATGTCTCCTTACTCCTTCCCTC | TTT | chr6 | 160664472 | 160664493 | 160664489 | 160664494 | + |
| SEQ ID NO 40792 | TGTCTCCTTACTCCTTCCCTCA | TTA | chr6 | 160664473 | 160664494 | 160664490 | 160664495 | + |
| SEQ ID NO 40793 | CTTACTCCTTCCCTCACCCCTA | CTC | chr6 | 160664479 | 160664500 | 160664496 | 160664501 | + |
| SEQ ID NO 40794 | ACTCCTTCCCTCACCCCTAGAC | CTT | chr6 | 160664482 | 160664503 | 160664499 | 160664504 | + |
| SEQ ID NO 40795 | CTCCTTCCCTCACCCCTAGACC | TTA | chr6 | 160664483 | 160664504 | 160664500 | 160664505 | + |
| SEQ ID NO 40796 | CTTCCCTCACCCCTAGACCTTC | CTC | chr6 | 160664486 | 160664507 | 160664503 | 160664508 | + |
| SEQ ID NO 40797 | CCCTCACCCCTAGACCTTCATC | CTT | chr6 | 160664489 | 160664510 | 160664506 | 160664511 | + |
| SEQ ID NO 40798 | CCTCACCCCTAGACCTTCATCT | TTC | chr6 | 160664490 | 160664511 | 160664507 | 160664512 | + |
| SEQ ID NO 40799 | ACCCCTAGACCTTCATCTTTCC | CTC | chr6 | 160664494 | 160664515 | 160664511 | 160664516 | + |
| SEQ ID NO 40800 | GACCTTCATCTTTCCTGATTAG | CTA | chr6 | 160664501 | 160664522 | 160664518 | 160664523 | + |
| SEQ ID NO 40801 | CATCTTTCCTGATTAGTCTTGT | CTT | chr6 | 160664507 | 160664528 | 160664524 | 160664529 | + |
| SEQ ID NO 40802 | ATCTTTCCTGATTAGTCTTGTT | TTC | chr6 | 160664508 | 160664529 | 160664525 | 160664530 | + |
| SEQ ID NO 40803 | TCCTGATTAGTCTTGTTTCCTC | CTT | chr6 | 160664513 | 160664534 | 160664530 | 160664535 | + |
| SEQ ID NO 40804 | CCTGATTAGTCTTGTTTCCTCC | TTT | chr6 | 160664514 | 160664535 | 160664531 | 160664536 | + |

Figure 60 (Cont'd)

| SEQ ID NO 40805 | CTGATTAGTCTTGTTTCCTCCC | TTC | chr6 | 160664515 | 160664536 | 160664532 | 160664537 | + |
| SEQ ID NO 40806 | ATTAGTCTTGTTTCCTCCCCTC | CTG | chr6 | 160664518 | 160664539 | 160664535 | 160664540 | + |
| SEQ ID NO 40807 | GTCTTGTTTCCTCCCCTCTTCT | TTA | chr6 | 160664522 | 160664543 | 160664539 | 160664544 | + |
| SEQ ID NO 40808 | GTTTCCTCCCCTCTTCTTTCAT | CTT | chr6 | 160664527 | 160664548 | 160664544 | 160664549 | + |
| SEQ ID NO 40809 | TTTCCTCCCCTCTTCTTTCATT | TTG | chr6 | 160664528 | 160664549 | 160664545 | 160664550 | + |
| SEQ ID NO 40810 | CCTCCCCTCTTCTTTCATTCTC | TTT | chr6 | 160664531 | 160664552 | 160664548 | 160664553 | + |
| SEQ ID NO 40811 | CTCCCCTCTTCTTTCATTCTCT | TTC | chr6 | 160664532 | 160664553 | 160664549 | 160664554 | + |
| SEQ ID NO 40812 | CCCTCTTCTTTCATTCTCTTTC | CTC | chr6 | 160664535 | 160664556 | 160664552 | 160664557 | + |
| SEQ ID NO 40813 | TTCTTTCATTCTCTTTCTTTTG | CTC | chr6 | 160664540 | 160664561 | 160664557 | 160664562 | + |
| SEQ ID NO 40814 | CTTTCATTCTCTTTCTTTTGGA | CTT | chr6 | 160664542 | 160664563 | 160664559 | 160664564 | + |
| SEQ ID NO 40815 | TTTCATTCTCTTTCTTTTGGAT | TTC | chr6 | 160664543 | 160664564 | 160664560 | 160664565 | + |
| SEQ ID NO 40816 | TCATTCTCTTTCTTTTGGATAA | CTT | chr6 | 160664545 | 160664566 | 160664562 | 160664567 | + |
| SEQ ID NO 40817 | CATTCTCTTTCTTTTGGATAAA | TTT | chr6 | 160664546 | 160664567 | 160664563 | 160664568 | + |
| SEQ ID NO 40818 | ATTCTCTTTCTTTTGGATAAAA | TTC | chr6 | 160664547 | 160664568 | 160664564 | 160664569 | + |
| SEQ ID NO 40819 | TCTTTCTTTTGGATAAAATAAA | TTC | chr6 | 160664551 | 160664572 | 160664568 | 160664573 | + |
| SEQ ID NO 40820 | TTTCTTTTGGATAAAATAAAAT | CTC | chr6 | 160664553 | 160664574 | 160664570 | 160664575 | + |
| SEQ ID NO 40821 | TCTTTTGGATAAAATAAAATCA | CTT | chr6 | 160664555 | 160664576 | 160664572 | 160664577 | + |
| SEQ ID NO 40822 | CTTTTGGATAAAATAAAATCAT | TTT | chr6 | 160664556 | 160664577 | 160664573 | 160664578 | + |
| SEQ ID NO 40823 | TTTTGGATAAAATAAAATCATA | TTC | chr6 | 160664557 | 160664578 | 160664574 | 160664579 | + |
| SEQ ID NO 40824 | TTGGATAAAATAAAATCATAAA | CTT | chr6 | 160664559 | 160664580 | 160664576 | 160664581 | + |
| SEQ ID NO 40825 | TGGATAAAATAAAATCATAAAA | TTT | chr6 | 160664560 | 160664581 | 160664577 | 160664582 | + |
| SEQ ID NO 40826 | GGATAAAATAAAATCATAAAAG | TTT | chr6 | 160664561 | 160664582 | 160664578 | 160664583 | + |
| SEQ ID NO 40827 | GATAAAATAAAATCATAAAAGT | TTG | chr6 | 160664562 | 160664583 | 160664579 | 160664584 | + |
| SEQ ID NO 40828 | ATATTTGCTGGTAACTTCCATG | CTC | chr6 | 160664589 | 160664610 | 160664606 | 160664611 | + |
| SEQ ID NO 40829 | GCTGGTAACTTCCATGACCAGA | TTT | chr6 | 160664595 | 160664616 | 160664612 | 160664617 | + |
| SEQ ID NO 40830 | CTGGTAACTTCCATGACCAGAC | TTG | chr6 | 160664596 | 160664617 | 160664613 | 160664618 | + |
| SEQ ID NO 40831 | GTAACTTCCATGACCAGACCCT | CTG | chr6 | 160664599 | 160664620 | 160664616 | 160664621 | + |
| SEQ ID NO 40832 | CCATGACCAGACCCTCTGCCAA | CTT | chr6 | 160664606 | 160664627 | 160664623 | 160664628 | + |
| SEQ ID NO 40833 | CATGACCAGACCCTCTGCCAAG | TTC | chr6 | 160664607 | 160664628 | 160664624 | 160664629 | + |
| SEQ ID NO 40834 | TGCCAAGTGCTGCACATCCATA | CTC | chr6 | 160664622 | 160664643 | 160664639 | 160664644 | + |
| SEQ ID NO 40835 | CCAAGTGCTGCACATCCATAGC | CTG | chr6 | 160664624 | 160664645 | 160664641 | 160664646 | + |
| SEQ ID NO 40836 | CACATCCATAGCCTCCCTCAAG | CTG | chr6 | 160664634 | 160664655 | 160664651 | 160664656 | + |
| SEQ ID NO 40837 | CCTCAAGCTTCCAACAGGCAG | CTC | chr6 | 160664649 | 160664670 | 160664666 | 160664671 | + |
| SEQ ID NO 40838 | AAGCTTTCCAACAGGCAGTGCT | CTC | chr6 | 160664653 | 160664674 | 160664670 | 160664675 | + |
| SEQ ID NO 40839 | TCCAACAGGCAGTGCTGTACGA | CTT | chr6 | 160664659 | 160664680 | 160664676 | 160664681 | + |
| SEQ ID NO 40840 | CCAACAGGCAGTGCTGTACGAG | TTT | chr6 | 160664660 | 160664681 | 160664677 | 160664682 | + |
| SEQ ID NO 40841 | CAACAGGCAGTGCTGTACGAGG | TTC | chr6 | 160664661 | 160664682 | 160664678 | 160664683 | + |
| SEQ ID NO 40842 | TACGAGGAGGGGCTGAGGCCT | CTG | chr6 | 160664676 | 160664697 | 160664693 | 160664698 | + |
| SEQ ID NO 40843 | AGGCCTTCCCGAGGTTGTGTCG | CTG | chr6 | 160664692 | 160664713 | 160664709 | 160664714 | + |
| SEQ ID NO 40844 | CCCGAGGTTGTGTCGCTACCCA | CTT | chr6 | 160664699 | 160664720 | 160664716 | 160664721 | + |
| SEQ ID NO 40845 | CCGAGGTTGTGTCGCTACCCAG | TTC | chr6 | 160664700 | 160664721 | 160664717 | 160664722 | + |
| SEQ ID NO 40846 | TGTCGCTACCCAGGGGTGCAGC | TTG | chr6 | 160664709 | 160664730 | 160664726 | 160664731 | + |
| SEQ ID NO 40847 | CCCAGGGGTGCAGCTGATAGAC | CTA | chr6 | 160664717 | 160664738 | 160664734 | 160664739 | + |
| SEQ ID NO 40848 | ATAGACACAACCCTTTCAGGTC | CTG | chr6 | 160664733 | 160664754 | 160664750 | 160664755 | + |
| SEQ ID NO 40849 | TCAGGTCTTAGTTTACGAGCAA | CTT | chr6 | 160664748 | 160664769 | 160664765 | 160664770 | + |
| SEQ ID NO 40850 | CAGGTCTTAGTTTACGAGCAAG | TTT | chr6 | 160664749 | 160664770 | 160664766 | 160664771 | + |
| SEQ ID NO 40851 | AGGTCTTAGTTTACGAGCAAGC | TTC | chr6 | 160664750 | 160664771 | 160664767 | 160664772 | + |
| SEQ ID NO 40852 | AGTTTACGAGCAAGCTAGGTAT | CTT | chr6 | 160664757 | 160664778 | 160664774 | 160664779 | + |
| SEQ ID NO 40853 | GTTTACGAGCAAGCTAGGTATA | TTA | chr6 | 160664758 | 160664779 | 160664775 | 160664780 | + |
| SEQ ID NO 40854 | ACGAGCAAGCTAGGTATAAATG | TTT | chr6 | 160664762 | 160664783 | 160664779 | 160664784 | + |
| SEQ ID NO 40855 | CGAGCAAGCTAGGTATAAATGT | TTA | chr6 | 160664763 | 160664784 | 160664780 | 160664785 | + |
| SEQ ID NO 40856 | GGTATAAATGTTAACATCTCCA | CTA | chr6 | 160664774 | 160664795 | 160664791 | 160664796 | + |
| SEQ ID NO 40857 | ACATCTCCACATCCTATACCAA | TTA | chr6 | 160664787 | 160664808 | 160664804 | 160664809 | + |
| SEQ ID NO 40858 | CACATCCTATACCAAACTGTGC | CTC | chr6 | 160664794 | 160664815 | 160664811 | 160664816 | + |
| SEQ ID NO 40859 | TACCAAACTGTGCCGAAATGAC | CTA | chr6 | 160664803 | 160664824 | 160664820 | 160664825 | + |
| SEQ ID NO 40860 | TGCCGAAATGACAACATAAGTG | CTG | chr6 | 160664813 | 160664834 | 160664830 | 160664835 | + |
| SEQ ID NO 40861 | TTATTATCTTCAAAATTTATTT | CTT | chr6 | 160664843 | 160664864 | 160664860 | 160664865 | + |
| SEQ ID NO 40862 | TATTATCTTCAAAATTTATTTA | TTT | chr6 | 160664844 | 160664865 | 160664861 | 160664866 | + |

Figure 60 (Cont'd)

| | | | | | | | | |
|---|---|---|---|---|---|---|---|---|
| SEQ ID NO 40863 | ATTATCTTCAAAATTTATTTAT | TTT | chr6 | 160664845 | 160664866 | 160664862 | 160664867 | + |
| SEQ ID NO 40864 | TTATCTTCAAAATTTATTTATT | TTA | chr6 | 160664846 | 160664867 | 160664863 | 160664868 | + |
| SEQ ID NO 40865 | TCTTCAAAATTTATTTATTCCT | TTA | chr6 | 160664849 | 160664870 | 160664866 | 160664871 | + |
| SEQ ID NO 40866 | CAAAATTTATTTATTCCTAGTG | CTT | chr6 | 160664853 | 160664874 | 160664870 | 160664875 | + |
| SEQ ID NO 40867 | AAAATTTATTTATTCCTAGTGA | TTC | chr6 | 160664854 | 160664875 | 160664871 | 160664876 | + |
| SEQ ID NO 40868 | ATTTATTCCTAGTGAACTCACA | TTT | chr6 | 160664861 | 160664882 | 160664878 | 160664883 | + |
| SEQ ID NO 40869 | TTTATTCCTAGTGAACTCACAT | TTA | chr6 | 160664862 | 160664883 | 160664879 | 160664884 | + |
| SEQ ID NO 40870 | ATTCCTAGTGAACTCACATGTT | TTT | chr6 | 160664865 | 160664886 | 160664882 | 160664887 | + |
| SEQ ID NO 40871 | TTCCTAGTGAACTCACATGTTT | TTA | chr6 | 160664866 | 160664887 | 160664883 | 160664888 | + |
| SEQ ID NO 40872 | CTAGTGAACTCACATGTTTTCT | TTC | chr6 | 160664869 | 160664890 | 160664886 | 160664891 | + |
| SEQ ID NO 40873 | GTGAACTCACATGTTTTCTGTA | CTA | chr6 | 160664872 | 160664893 | 160664889 | 160664894 | + |
| SEQ ID NO 40874 | ACATGTTTTCTGTAATTATAAA | CTC | chr6 | 160664880 | 160664901 | 160664897 | 160664902 | + |
| SEQ ID NO 40875 | TCTGTAATTATAAATTATGTTA | TTT | chr6 | 160664888 | 160664909 | 160664905 | 160664910 | + |
| SEQ ID NO 40876 | CTGTAATTATAAATTATGTTAT | TTT | chr6 | 160664889 | 160664910 | 160664906 | 160664911 | + |
| SEQ ID NO 40877 | TGTAATTATAAATTATGTTATA | TTC | chr6 | 160664890 | 160664911 | 160664907 | 160664912 | + |
| SEQ ID NO 40878 | TAATTATAAATTATGTTATAAG | CTG | chr6 | 160664892 | 160664913 | 160664909 | 160664914 | + |
| SEQ ID NO 40879 | TAAATTATGTTATAAGATATCA | TTA | chr6 | 160664898 | 160664919 | 160664915 | 160664920 | + |
| SEQ ID NO 40880 | TGTTATAAGATATCAATCCTTC | TTA | chr6 | 160664905 | 160664926 | 160664922 | 160664927 | + |
| SEQ ID NO 40881 | TAAGATATCAATCCTTCCAGGA | TTA | chr6 | 160664910 | 160664931 | 160664927 | 160664932 | + |
| SEQ ID NO 40882 | CCAGGAGGGGTGGTGGCTCAT | CTT | chr6 | 160664926 | 160664947 | 160664943 | 160664948 | + |
| SEQ ID NO 40883 | CAGGAGGGGTGGTGGCTCATG | TTC | chr6 | 160664927 | 160664948 | 160664944 | 160664949 | + |
| SEQ ID NO 40884 | ATGCCTATAATCCCAGCATTTT | CTC | chr6 | 160664946 | 160664967 | 160664963 | 160664968 | + |
| SEQ ID NO 40885 | TAATCCCAGCATTTTGGGAGGC | CTA | chr6 | 160664953 | 160664974 | 160664970 | 160664975 | + |
| SEQ ID NO 40886 | TGGGAGGCCACGGCAGATGGAT | TTT | chr6 | 160664967 | 160664988 | 160664984 | 160664989 | + |
| SEQ ID NO 40887 | GGGAGGCCACGGCAGATGGATC | TTT | chr6 | 160664968 | 160664989 | 160664985 | 160664990 | + |
| SEQ ID NO 40888 | GGAGGCCACGGCAGATGGATCA | TTG | chr6 | 160664969 | 160664990 | 160664986 | 160664991 | + |
| SEQ ID NO 40889 | AGGCCAGGAGTTTGAGACAAGC | CTG | chr6 | 160664995 | 160665016 | 160665012 | 160665017 | + |
| SEQ ID NO 40890 | GAGACAAGCCTGGGCAACATGC | TTT | chr6 | 160665008 | 160665029 | 160665025 | 160665030 | + |
| SEQ ID NO 40891 | AGACAAGCCTGGGCAACATGCC | TTG | chr6 | 160665009 | 160665030 | 160665026 | 160665031 | + |
| SEQ ID NO 40892 | GGCAACATGCCAAAACCCTGTC | CTG | chr6 | 160665020 | 160665041 | 160665037 | 160665042 | + |
| SEQ ID NO 40893 | TCTCTACAAAAAATACAAAAAT | CTG | chr6 | 160665040 | 160665061 | 160665057 | 160665062 | + |
| SEQ ID NO 40894 | TACAAAAAATACAAAAATTAGC | CTC | chr6 | 160665044 | 160665065 | 160665061 | 160665066 | + |
| SEQ ID NO 40895 | CAAAAAATACAAAAATTAGCTG | CTA | chr6 | 160665046 | 160665067 | 160665063 | 160665068 | + |
| SEQ ID NO 40896 | GCTGGGTGTGGAGGCACATGCC | TTA | chr6 | 160665064 | 160665085 | 160665081 | 160665086 | + |
| SEQ ID NO 40897 | GGTGTGGAGGCACATGCCAGTC | CTG | chr6 | 160665068 | 160665089 | 160665085 | 160665090 | + |
| SEQ ID NO 40898 | CTAAGTAGGCTGAGGCACTAGA | CTA | chr6 | 160665100 | 160665121 | 160665117 | 160665122 | + |
| SEQ ID NO 40899 | AGTAGGCTGAGGCACTAGAATT | CTA | chr6 | 160665103 | 160665124 | 160665120 | 160665125 | + |
| SEQ ID NO 40900 | AGGCACTAGAATTGCTTGAACA | CTG | chr6 | 160665112 | 160665133 | 160665129 | 160665134 | + |
| SEQ ID NO 40901 | GAATTGCTTGAACACAGGAGAT | CTA | chr6 | 160665120 | 160665141 | 160665137 | 160665142 | + |
| SEQ ID NO 40902 | CTTGAACACAGGAGATGGAGGT | TTG | chr6 | 160665126 | 160665147 | 160665143 | 160665148 | + |
| SEQ ID NO 40903 | GAACACAGGAGATGGAGGTTGC | CTT | chr6 | 160665129 | 160665150 | 160665146 | 160665151 | + |
| SEQ ID NO 40904 | AACACAGGAGATGGAGGTTGCA | TTG | chr6 | 160665130 | 160665151 | 160665147 | 160665152 | + |
| SEQ ID NO 40905 | CAGTGAGCCAAGAATGTGCCAC | TTG | chr6 | 160665150 | 160665171 | 160665167 | 160665172 | + |
| SEQ ID NO 40906 | CACTCCAGCCTGGGTGACAGAG | CTG | chr6 | 160665174 | 160665195 | 160665191 | 160665196 | + |
| SEQ ID NO 40907 | CAGCCTGGGTGACAGAGCAAGA | CTC | chr6 | 160665179 | 160665200 | 160665196 | 160665201 | + |
| SEQ ID NO 40908 | GGTGACAGAGCAAGAATGTCTC | CTG | chr6 | 160665186 | 160665207 | 160665203 | 160665208 | + |
| SEQ ID NO 40909 | AGGAAAGAAAAAAAAATAATAA | CTC | chr6 | 160665208 | 160665229 | 160665225 | 160665230 | + |
| SEQ ID NO 40910 | ATAAAATATCAATCCTTCCTAT | TTA | chr6 | 160665246 | 160665267 | 160665263 | 160665268 | + |
| SEQ ID NO 40911 | CCTATTCTAGTAGTTGTGGCTT | CTT | chr6 | 160665263 | 160665284 | 160665280 | 160665285 | + |
| SEQ ID NO 40912 | CTATTCTAGTAGTTGTGGCTTA | TTC | chr6 | 160665264 | 160665285 | 160665281 | 160665286 | + |
| SEQ ID NO 40913 | TTCTAGTAGTTGTGGCTTAAAT | CTA | chr6 | 160665267 | 160665288 | 160665284 | 160665289 | + |
| SEQ ID NO 40914 | TAGTAGTTGTGGCTTAAATAAA | TTC | chr6 | 160665270 | 160665291 | 160665287 | 160665292 | + |
| SEQ ID NO 40915 | GTAGTTGTGGCTTAAATAAATA | CTA | chr6 | 160665272 | 160665293 | 160665289 | 160665294 | + |
| SEQ ID NO 40916 | TGGCTTAAATAAATAAATAAAT | TTG | chr6 | 160665279 | 160665300 | 160665296 | 160665301 | + |
| SEQ ID NO 40917 | AAATAAATAAATAAATATTTTT | CTT | chr6 | 160665285 | 160665306 | 160665302 | 160665307 | + |
| SEQ ID NO 40918 | AATAAATAAATAAATATTTTTA | TTA | chr6 | 160665286 | 160665307 | 160665303 | 160665308 | + |
| SEQ ID NO 40919 | TTAAAATAAAACATAGGGTCG | TTT | chr6 | 160665305 | 160665326 | 160665322 | 160665327 | + |
| SEQ ID NO 40920 | TAAAAATAAAACATAGGGTCGA | TTT | chr6 | 160665306 | 160665327 | 160665323 | 160665328 | + |

Figure 60 (Cont'd)

| SEQ ID NO 40921 | AAAAATAAAACATAGGGTCGAG | TTT | chr6 | 160665307 | 160665328 | 160665324 | 160665329 | + |
| SEQ ID NO 40922 | AAAATAAAACATAGGGTCGAGT | TTA | chr6 | 160665308 | 160665329 | 160665325 | 160665330 | + |
| SEQ ID NO 40923 | AACTCTGTAATCCCAGCACTTT | CTC | chr6 | 160665340 | 160665361 | 160665357 | 160665362 | + |
| SEQ ID NO 40924 | TGTAATCCCAGCACTTTGGGAG | CTC | chr6 | 160665345 | 160665366 | 160665362 | 160665367 | + |
| SEQ ID NO 40925 | TAATCCCAGCACTTTGGGAGGC | CTG | chr6 | 160665347 | 160665368 | 160665364 | 160665369 | + |
| SEQ ID NO 40926 | TGGGAGGCCAAGACAGGTGGAT | CTT | chr6 | 160665361 | 160665382 | 160665378 | 160665383 | + |
| SEQ ID NO 40927 | GGGAGGCCAAGACAGGTGGATC | TTT | chr6 | 160665362 | 160665383 | 160665379 | 160665384 | + |
| SEQ ID NO 40928 | GGAGGCCAAGACAGGTGGATCA | TTG | chr6 | 160665363 | 160665384 | 160665380 | 160665385 | + |
| SEQ ID NO 40929 | GAGACCAGCCAGGCCAATGTGG | TTT | chr6 | 160665400 | 160665421 | 160665417 | 160665422 | + |
| SEQ ID NO 40930 | AGACCAGCCAGGCCAATGTGGT | TTG | chr6 | 160665401 | 160665422 | 160665418 | 160665423 | + |
| SEQ ID NO 40931 | TACTAAAAATACAAAAATTAGC | CTC | chr6 | 160665436 | 160665457 | 160665453 | 160665458 | + |
| SEQ ID NO 40932 | CTAAAAATACAAAAATTAGCCA | CTA | chr6 | 160665438 | 160665459 | 160665455 | 160665460 | + |
| SEQ ID NO 40933 | AAAATACAAAAATTAGCCAGGC | CTA | chr6 | 160665441 | 160665462 | 160665458 | 160665463 | + |
| SEQ ID NO 40934 | GCCAGGCGTGGTGGTGGGCACC | TTA | chr6 | 160665456 | 160665477 | 160665473 | 160665478 | + |
| SEQ ID NO 40935 | TAATCCCAGCTACTAGGGAGGC | CTG | chr6 | 160665480 | 160665501 | 160665497 | 160665502 | + |
| SEQ ID NO 40936 | CTAGGGAGGCTGGAGTATTCAC | CTA | chr6 | 160665492 | 160665513 | 160665509 | 160665514 | + |
| SEQ ID NO 40937 | GGGAGGCTGGAGTATTCACTTG | CTA | chr6 | 160665495 | 160665516 | 160665512 | 160665517 | + |
| SEQ ID NO 40938 | GAGTATTCACTTGAACCCAGGA | CTG | chr6 | 160665504 | 160665525 | 160665521 | 160665526 | + |
| SEQ ID NO 40939 | ACTTGAACCCAGGAGGTGGAAG | TTC | chr6 | 160665512 | 160665533 | 160665529 | 160665534 | + |
| SEQ ID NO 40940 | GAACCCAGGAGGTGGAAGTTGC | CTT | chr6 | 160665516 | 160665537 | 160665533 | 160665538 | + |
| SEQ ID NO 40941 | AACCCAGGAGGTGGAAGTTGCA | TTG | chr6 | 160665517 | 160665538 | 160665534 | 160665539 | + |
| SEQ ID NO 40942 | CAGTGAGCCAAAATCACGTCAG | TTG | chr6 | 160665537 | 160665558 | 160665554 | 160665559 | + |
| SEQ ID NO 40943 | CAACCGGGGTGAGAGTCTCAAT | CTT | chr6 | 160665566 | 160665587 | 160665583 | 160665588 | + |
| SEQ ID NO 40944 | AACCGGGGTGAGAGTCTCAATA | TTC | chr6 | 160665567 | 160665588 | 160665584 | 160665589 | + |
| SEQ ID NO 40945 | AATAAAATAAAATAAAATAAAA | CTC | chr6 | 160665585 | 160665606 | 160665602 | 160665607 | + |
| SEQ ID NO 40946 | TCCGCAAATGAATTCATGGTGC | CTT | chr6 | 160665648 | 160665669 | 160665665 | 160665670 | + |
| SEQ ID NO 40947 | CCGCAAATGAATTCATGGTGCA | TTT | chr6 | 160665649 | 160665670 | 160665666 | 160665671 | + |
| SEQ ID NO 40948 | CGCAAATGAATTCATGGTGCAA | TTC | chr6 | 160665650 | 160665671 | 160665667 | 160665672 | + |
| SEQ ID NO 40949 | ATGGTGCAATCTTACATTTTCG | TTC | chr6 | 160665663 | 160665684 | 160665680 | 160665685 | + |
| SEQ ID NO 40950 | ACATTTTCGTTCTCATGAAGTA | CTT | chr6 | 160665676 | 160665697 | 160665693 | 160665698 | + |
| SEQ ID NO 40951 | CATTTTCGTTCTCATGAAGTAA | TTA | chr6 | 160665677 | 160665698 | 160665694 | 160665699 | + |
| SEQ ID NO 40952 | TCGTTCTCATGAAGTAAAGCAA | TTT | chr6 | 160665682 | 160665703 | 160665699 | 160665704 | + |
| SEQ ID NO 40953 | CGTTCTCATGAAGTAAAGCAAG | TTT | chr6 | 160665683 | 160665704 | 160665700 | 160665705 | + |
| SEQ ID NO 40954 | GTTCTCATGAAGTAAAGCAAGA | TTC | chr6 | 160665684 | 160665705 | 160665701 | 160665706 | + |
| SEQ ID NO 40955 | TCATGAAGTAAAGCAAGAGTGG | TTC | chr6 | 160665688 | 160665709 | 160665705 | 160665710 | + |
| SEQ ID NO 40956 | ATGAAGTAAAGCAAGAGTGGTA | CTC | chr6 | 160665690 | 160665711 | 160665707 | 160665712 | + |
| SEQ ID NO 40957 | AGTGGAAAGAGTCTATCTCTAG | TTA | chr6 | 160665718 | 160665739 | 160665735 | 160665740 | + |
| SEQ ID NO 40958 | TCTCTAGTGTAGTCACGTCAGT | CTA | chr6 | 160665733 | 160665754 | 160665750 | 160665755 | + |
| SEQ ID NO 40959 | TAGTGTAGTCACGTCAGTGGTT | CTC | chr6 | 160665737 | 160665758 | 160665754 | 160665759 | + |
| SEQ ID NO 40960 | GTGTAGTCACGTCAGTGGTTGT | CTA | chr6 | 160665739 | 160665760 | 160665756 | 160665761 | + |
| SEQ ID NO 40961 | TGTCAAGATGGTTAGGAGGCTC | TTG | chr6 | 160665760 | 160665781 | 160665777 | 160665782 | + |
| SEQ ID NO 40962 | GGAGGCTCCTCCCGTTTAAAAC | TTA | chr6 | 160665774 | 160665795 | 160665791 | 160665796 | + |
| SEQ ID NO 40963 | CTCCCGTTTAAAACAGTATCCA | CTC | chr6 | 160665782 | 160665803 | 160665799 | 160665804 | + |
| SEQ ID NO 40964 | CCGTTTAAAACAGTATCCAAGC | CTC | chr6 | 160665785 | 160665806 | 160665802 | 160665807 | + |
| SEQ ID NO 40965 | AAAACAGTATCCAAGCCCCAGT | TTT | chr6 | 160665791 | 160665812 | 160665808 | 160665813 | + |
| SEQ ID NO 40966 | AAACAGTATCCAAGCCCCAGTT | TTA | chr6 | 160665792 | 160665813 | 160665809 | 160665814 | + |
| SEQ ID NO 40967 | TAAATCAATTGGGGAGACACGC | TTG | chr6 | 160665815 | 160665836 | 160665832 | 160665837 | + |
| SEQ ID NO 40968 | GGGAGACACGCCAACTCTGATC | TTG | chr6 | 160665826 | 160665847 | 160665843 | 160665848 | + |
| SEQ ID NO 40969 | TGATCATCAGCAATATCTGAGC | CTC | chr6 | 160665843 | 160665864 | 160665860 | 160665865 | + |
| SEQ ID NO 40970 | ATCATCAGCAATATCTGAGCTC | CTG | chr6 | 160665845 | 160665866 | 160665862 | 160665867 | + |
| SEQ ID NO 40971 | AGCTCCAGTCTCAGATATTGTG | CTG | chr6 | 160665862 | 160665883 | 160665879 | 160665884 | + |
| SEQ ID NO 40972 | CAGTCTCAGATATTGTGTGCAG | CTC | chr6 | 160665867 | 160665888 | 160665884 | 160665889 | + |
| SEQ ID NO 40973 | AGATATTGTGTGCAGTTAGTCT | CTC | chr6 | 160665874 | 160665895 | 160665891 | 160665896 | + |
| SEQ ID NO 40974 | TGTGCAGTTAGTCTCTGTCCTG | TTG | chr6 | 160665882 | 160665903 | 160665899 | 160665904 | + |
| SEQ ID NO 40975 | GTCTCTGTCCTGTACCCTCTAC | TTA | chr6 | 160665892 | 160665913 | 160665909 | 160665914 | + |
| SEQ ID NO 40976 | TGTCCTGTACCCTCTACCTCCT | CTC | chr6 | 160665897 | 160665918 | 160665914 | 160665919 | + |
| SEQ ID NO 40977 | TCCTGTACCCTCTACCTCCTTC | CTG | chr6 | 160665899 | 160665920 | 160665916 | 160665921 | + |
| SEQ ID NO 40978 | TACCCTCTACCTCCTTCCCTAC | CTG | chr6 | 160665904 | 160665925 | 160665921 | 160665926 | + |

Figure 60 (Cont'd)

| | | | | | | | | |
|---|---|---|---|---|---|---|---|---|
| SEQ ID NO 40979 | TACCTCCTTCCCTACCAGAAAA | CTC | chr6 | 160665911 | 160665932 | 160665928 | 160665933 | + |
| SEQ ID NO 40980 | CCTCCTTCCCTACCAGAAAAAT | CTA | chr6 | 160665913 | 160665934 | 160665930 | 160665935 | + |
| SEQ ID NO 40981 | CTTCCCTACCAGAAAAATCACC | CTC | chr6 | 160665917 | 160665938 | 160665934 | 160665939 | + |
| SEQ ID NO 40982 | CCCTACCAGAAAAATCACCACT | CTT | chr6 | 160665920 | 160665941 | 160665937 | 160665942 | + |
| SEQ ID NO 40983 | CCTACCAGAAAAATCACCACTT | TTC | chr6 | 160665921 | 160665942 | 160665938 | 160665943 | + |
| SEQ ID NO 40984 | CCAGAAAAATCACCACTTTAGT | CTA | chr6 | 160665925 | 160665946 | 160665942 | 160665947 | + |
| SEQ ID NO 40985 | TAGTCCCTGGCCACCGGGACAC | CTT | chr6 | 160665943 | 160665964 | 160665960 | 160665965 | + |
| SEQ ID NO 40986 | AGTCCCTGGCCACCGGGACACC | TTT | chr6 | 160665944 | 160665965 | 160665961 | 160665966 | + |
| SEQ ID NO 40987 | GTCCCTGGCCACCGGGACACCC | TTA | chr6 | 160665945 | 160665966 | 160665962 | 160665967 | + |
| SEQ ID NO 40988 | GCCACCGGGACACCCCAGGAGG | CTG | chr6 | 160665952 | 160665973 | 160665969 | 160665974 | + |
| SEQ ID NO 40989 | AGGTAGTTATGGCACTTATGGC | CTG | chr6 | 160665986 | 160666007 | 160666003 | 160666008 | + |
| SEQ ID NO 40990 | TGGCACTTATGGCTCCCTTGCT | TTA | chr6 | 160665995 | 160666016 | 160666012 | 160666017 | + |
| SEQ ID NO 40991 | ATGGCTCCCTTGCTGCTGATCT | CTT | chr6 | 160666003 | 160666024 | 160666020 | 160666025 | + |
| SEQ ID NO 40992 | TGGCTCCCTTGCTGCTGATCTG | TTA | chr6 | 160666004 | 160666025 | 160666021 | 160666026 | + |
| SEQ ID NO 40993 | CCTTGCTGCTGATCTGGAACTC | CTC | chr6 | 160666010 | 160666031 | 160666027 | 160666032 | + |
| SEQ ID NO 40994 | GCTGCTGATCTGGAACTCAAGC | CTT | chr6 | 160666014 | 160666035 | 160666031 | 160666036 | + |
| SEQ ID NO 40995 | CTGCTGATCTGGAACTCAAGCC | TTG | chr6 | 160666015 | 160666036 | 160666032 | 160666037 | + |
| SEQ ID NO 40996 | CTGATCTGGAACTCAAGCCCCA | CTG | chr6 | 160666018 | 160666039 | 160666035 | 160666040 | + |
| SEQ ID NO 40997 | ATCTGGAACTCAAGCCCCAAGA | CTG | chr6 | 160666021 | 160666042 | 160666038 | 160666043 | + |
| SEQ ID NO 40998 | GAACTCAAGCCCCAAGAAGTCC | CTG | chr6 | 160666026 | 160666047 | 160666043 | 160666048 | + |
| SEQ ID NO 40999 | AAGCCCCAAGAAGTCCCCTTGG | CTC | chr6 | 160666032 | 160666053 | 160666049 | 160666054 | + |
| SEQ ID NO 41000 | GGATGATCTGAATATACATTTG | CTT | chr6 | 160666052 | 160666073 | 160666069 | 160666074 | + |
| SEQ ID NO 41001 | GATGATCTGAATATACATTTGG | TTG | chr6 | 160666053 | 160666074 | 160666070 | 160666075 | + |
| SEQ ID NO 41002 | AATATACATTTGGGACAGATCT | CTG | chr6 | 160666062 | 160666083 | 160666079 | 160666084 | + |
| SEQ ID NO 41003 | GGGACAGATCTAGGGAGTTTCT | TTT | chr6 | 160666073 | 160666094 | 160666090 | 160666095 | + |
| SEQ ID NO 41004 | GGACAGATCTAGGGAGTTTCTG | TTG | chr6 | 160666074 | 160666095 | 160666091 | 160666096 | + |
| SEQ ID NO 41005 | GGGAGTTTCTGAGCAACACTTA | CTA | chr6 | 160666085 | 160666106 | 160666102 | 160666107 | + |
| SEQ ID NO 41006 | CTGAGCAACACTTAGACTGGGG | TTT | chr6 | 160666093 | 160666114 | 160666110 | 160666115 | + |
| SEQ ID NO 41007 | TGAGCAACACTTAGACTGGGGT | TTC | chr6 | 160666094 | 160666115 | 160666111 | 160666116 | + |
| SEQ ID NO 41008 | AGCAACACTTAGACTGGGGTCT | CTG | chr6 | 160666096 | 160666117 | 160666113 | 160666118 | + |
| SEQ ID NO 41009 | AGACTGGGGTCTTCCATTGATT | CTT | chr6 | 160666106 | 160666127 | 160666123 | 160666128 | + |
| SEQ ID NO 41010 | GACTGGGGTCTTCCATTGATTA | TTA | chr6 | 160666107 | 160666128 | 160666124 | 160666129 | + |
| SEQ ID NO 41011 | GGGTCTTCCATTGATTAAATCC | CTG | chr6 | 160666112 | 160666133 | 160666129 | 160666134 | + |
| SEQ ID NO 41012 | CCATTGATTAAATCCTACTTGA | CTT | chr6 | 160666119 | 160666140 | 160666136 | 160666141 | + |
| SEQ ID NO 41013 | CATTGATTAAATCCTACTTGAA | TTC | chr6 | 160666120 | 160666141 | 160666137 | 160666142 | + |
| SEQ ID NO 41014 | ATTAAATCCTACTTGAATTCGC | TTG | chr6 | 160666125 | 160666146 | 160666142 | 160666147 | + |
| SEQ ID NO 41015 | AATCCTACTTGAATTCGCTACT | TTA | chr6 | 160666129 | 160666150 | 160666146 | 160666151 | + |
| SEQ ID NO 41016 | CTTGAATTCGCTACTTTGGGAC | CTA | chr6 | 160666136 | 160666157 | 160666153 | 160666158 | + |
| SEQ ID NO 41017 | GAATTCGCTACTTTGGGACTCA | CTT | chr6 | 160666139 | 160666160 | 160666156 | 160666161 | + |
| SEQ ID NO 41018 | AATTCGCTACTTTGGGACTCAA | TTG | chr6 | 160666140 | 160666161 | 160666157 | 160666162 | + |
| SEQ ID NO 41019 | GCTACTTTGGGACTCAAGTCTA | TTC | chr6 | 160666145 | 160666166 | 160666162 | 160666167 | + |
| SEQ ID NO 41020 | CTTTGGGACTCAAGTCTAAGGG | CTA | chr6 | 160666149 | 160666170 | 160666166 | 160666171 | + |
| SEQ ID NO 41021 | TGGGACTCAAGTCTAAGGGACT | CTT | chr6 | 160666152 | 160666173 | 160666169 | 160666174 | + |
| SEQ ID NO 41022 | GGGACTCAAGTCTAAGGGACTG | TTT | chr6 | 160666153 | 160666174 | 160666170 | 160666175 | + |
| SEQ ID NO 41023 | GGACTCAAGTCTAAGGGACTGA | TTG | chr6 | 160666154 | 160666175 | 160666171 | 160666176 | + |
| SEQ ID NO 41024 | AAGTCTAAGGGACTGAGACTGA | CTC | chr6 | 160666160 | 160666181 | 160666177 | 160666182 | + |
| SEQ ID NO 41025 | AGGGACTGAGACTGAGACAGGA | CTA | chr6 | 160666167 | 160666188 | 160666184 | 160666189 | + |
| SEQ ID NO 41026 | AGACTGAGACAGGAGAGCACAA | CTG | chr6 | 160666175 | 160666196 | 160666192 | 160666197 | + |
| SEQ ID NO 41027 | AGACAGGAGAGCACAAGACTAA | CTG | chr6 | 160666181 | 160666202 | 160666198 | 160666203 | + |
| SEQ ID NO 41028 | ACTTTGGTCTCTTGATCTTTTC | CTA | chr6 | 160666202 | 160666223 | 160666219 | 160666224 | + |
| SEQ ID NO 41029 | TGGTCTCTTGATCTTTTCTTAC | CTT | chr6 | 160666206 | 160666227 | 160666223 | 160666228 | + |
| SEQ ID NO 41030 | GGTCTCTTGATCTTTTCTTACC | TTT | chr6 | 160666207 | 160666228 | 160666224 | 160666229 | + |
| SEQ ID NO 41031 | GTCTCTTGATCTTTTCTTACCT | TTG | chr6 | 160666208 | 160666229 | 160666225 | 160666230 | + |
| SEQ ID NO 41032 | TTGATCTTTTCTTACCTTGCAA | CTC | chr6 | 160666213 | 160666234 | 160666230 | 160666235 | + |
| SEQ ID NO 41033 | GATCTTTTCTTACCTTGCAACT | CTT | chr6 | 160666215 | 160666236 | 160666232 | 160666237 | + |
| SEQ ID NO 41034 | ATCTTTTCTTACCTTGCAACTG | TTG | chr6 | 160666216 | 160666237 | 160666233 | 160666238 | + |
| SEQ ID NO 41035 | TTCTTACCTTGCAACTGTCAAT | CTT | chr6 | 160666221 | 160666242 | 160666238 | 160666243 | + |
| SEQ ID NO 41036 | TCTTACCTTGCAACTGTCAATG | TTT | chr6 | 160666222 | 160666243 | 160666239 | 160666244 | + |

Figure 60 (Cont'd)

| | | | | | | | | |
|---|---|---|---|---|---|---|---|---|
| SEQ ID NO 41037 | CTTACCTTGCAACTGTCAATGC | TTT | chr6 | 160666223 | 160666244 | 160666240 | 160666245 | + |
| SEQ ID NO 41038 | TTACCTTGCAACTGTCAATGCC | TTC | chr6 | 160666224 | 160666245 | 160666241 | 160666246 | + |
| SEQ ID NO 41039 | ACCTTGCAACTGTCAATGCCTC | CTT | chr6 | 160666226 | 160666247 | 160666243 | 160666248 | + |
| SEQ ID NO 41040 | CCTTGCAACTGTCAATGCCTCC | TTA | chr6 | 160666227 | 160666248 | 160666244 | 160666249 | + |
| SEQ ID NO 41041 | GCAACTGTCAATGCCTCCAGCC | CTT | chr6 | 160666231 | 160666252 | 160666248 | 160666253 | + |
| SEQ ID NO 41042 | CAACTGTCAATGCCTCCAGCCA | TTG | chr6 | 160666232 | 160666253 | 160666249 | 160666254 | + |
| SEQ ID NO 41043 | TCAATGCCTCCAGCCAAATGCC | CTG | chr6 | 160666238 | 160666259 | 160666255 | 160666260 | + |
| SEQ ID NO 41044 | CAGCCAAATGCCCAGCACAGAG | CTC | chr6 | 160666248 | 160666269 | 160666265 | 160666270 | + |
| SEQ ID NO 41045 | AGTGGATTTGACTCTTCCATTC | CTC | chr6 | 160666273 | 160666294 | 160666290 | 160666295 | + |
| SEQ ID NO 41046 | GACTCTTCCATTCAGAAACTCA | TTT | chr6 | 160666282 | 160666303 | 160666299 | 160666304 | + |
| SEQ ID NO 41047 | ACTCTTCCATTCAGAAACTCAT | TTG | chr6 | 160666283 | 160666304 | 160666300 | 160666305 | + |
| SEQ ID NO 41048 | TTCCATTCAGAAACTCATAGCG | CTC | chr6 | 160666287 | 160666308 | 160666304 | 160666309 | + |
| SEQ ID NO 41049 | CCATTCAGAAACTCATAGCGAT | CTT | chr6 | 160666289 | 160666310 | 160666306 | 160666311 | + |
| SEQ ID NO 41050 | CATTCAGAAACTCATAGCGATT | TTC | chr6 | 160666290 | 160666311 | 160666307 | 160666312 | + |
| SEQ ID NO 41051 | AGAAACTCATAGCGATTGCACA | TTC | chr6 | 160666295 | 160666316 | 160666312 | 160666317 | + |
| SEQ ID NO 41052 | ATAGCGATTGCACACTTCATTC | CTC | chr6 | 160666303 | 160666324 | 160666320 | 160666325 | + |
| SEQ ID NO 41053 | CACACTTCATTCTCAATCACAG | TTG | chr6 | 160666313 | 160666334 | 160666330 | 160666335 | + |
| SEQ ID NO 41054 | CATTCTCAATCACAGGGAGCTG | CTT | chr6 | 160666320 | 160666341 | 160666337 | 160666342 | + |
| SEQ ID NO 41055 | ATTCTCAATCACAGGGAGCTGG | TTC | chr6 | 160666321 | 160666342 | 160666338 | 160666343 | + |
| SEQ ID NO 41056 | TCAATCACAGGGAGCTGGGCTT | TTC | chr6 | 160666325 | 160666346 | 160666342 | 160666347 | + |
| SEQ ID NO 41057 | AATCACAGGGAGCTGGGCTTCC | CTC | chr6 | 160666327 | 160666348 | 160666344 | 160666349 | + |
| SEQ ID NO 41058 | GGCTTCCTTGAGAAAGCCAGCC | CTG | chr6 | 160666342 | 160666363 | 160666359 | 160666364 | + |
| SEQ ID NO 41059 | CCTTGAGAAAGCCAGCCCCAAA | CTT | chr6 | 160666347 | 160666368 | 160666364 | 160666369 | + |
| SEQ ID NO 41060 | CTTGAGAAAGCCAGCCCCAAAG | TTC | chr6 | 160666348 | 160666369 | 160666365 | 160666370 | + |
| SEQ ID NO 41061 | GAGAAAGCCAGCCCCAAAGGTA | CTT | chr6 | 160666351 | 160666372 | 160666368 | 160666373 | + |
| SEQ ID NO 41062 | AGAAAGCCAGCCCCAAAGGTAC | TTG | chr6 | 160666352 | 160666373 | 160666369 | 160666374 | + |
| SEQ ID NO 41063 | TGTTTAAAAGATGAAAGAAAT | CTG | chr6 | 160666377 | 160666398 | 160666394 | 160666399 | + |
| SEQ ID NO 41064 | AAAAGATGAAAGAAATGGTAA | TTT | chr6 | 160666382 | 160666403 | 160666399 | 160666404 | + |
| SEQ ID NO 41065 | AAAAGATGAAAGAAATGGTAAC | TTA | chr6 | 160666383 | 160666404 | 160666400 | 160666405 | + |
| SEQ ID NO 41066 | CGTCCACAACATGTTCACAAGG | CTA | chr6 | 160666407 | 160666428 | 160666424 | 160666429 | + |
| SEQ ID NO 41067 | ACAAGGAAACTCCAGAAGAACA | TTC | chr6 | 160666423 | 160666444 | 160666440 | 160666445 | + |
| SEQ ID NO 41068 | CAGAAGAACAGAGCAGTGGTGA | CTC | chr6 | 160666435 | 160666456 | 160666452 | 160666457 | + |
| SEQ ID NO 41069 | CTGTCTGTCCGTGAGGCTGTAG | CTC | chr6 | 160666465 | 160666486 | 160666482 | 160666487 | + |
| SEQ ID NO 41070 | TCTGTCCGTGAGGCTGTAGAAC | CTG | chr6 | 160666468 | 160666489 | 160666485 | 160666490 | + |
| SEQ ID NO 41071 | TCCGTGAGGCTGTAGAACACAA | CTG | chr6 | 160666472 | 160666493 | 160666489 | 160666494 | + |
| SEQ ID NO 41072 | TAGAACACAAGGCAGCTCCCAA | CTG | chr6 | 160666484 | 160666505 | 160666501 | 160666506 | + |
| SEQ ID NO 41073 | CCAATGCTGCCAGACTCTCTGA | CTC | chr6 | 160666502 | 160666523 | 160666519 | 160666524 | + |
| SEQ ID NO 41074 | CCAGACTCTCTGAACCCTGGAG | CTG | chr6 | 160666511 | 160666532 | 160666528 | 160666533 | + |
| SEQ ID NO 41075 | TCTGAACCCTGGAGAGTGTAAA | CTC | chr6 | 160666519 | 160666540 | 160666536 | 160666541 | + |
| SEQ ID NO 41076 | TGAACCCTGGAGAGTGTAAACG | CTC | chr6 | 160666521 | 160666542 | 160666538 | 160666543 | + |
| SEQ ID NO 41077 | AACCCTGGAGAGTGTAAACGTC | CTG | chr6 | 160666523 | 160666544 | 160666540 | 160666545 | + |
| SEQ ID NO 41078 | GAGAGTGTAAACGTCATATAAG | CTG | chr6 | 160666530 | 160666551 | 160666547 | 160666552 | + |
| SEQ ID NO 41079 | TGTTCCAAAAACCTGGATTTAA | CTA | chr6 | 160666558 | 160666579 | 160666575 | 160666580 | + |
| SEQ ID NO 41080 | CAAAAACCTGGATTTAACAATC | TTC | chr6 | 160666563 | 160666584 | 160666580 | 160666585 | + |
| SEQ ID NO 41081 | GATTTAACAATCTGAGCTTTGT | CTG | chr6 | 160666573 | 160666594 | 160666590 | 160666595 | + |
| SEQ ID NO 41082 | AACAATCTGAGCTTTGTCATGG | TTT | chr6 | 160666578 | 160666599 | 160666595 | 160666600 | + |
| SEQ ID NO 41083 | ACAATCTGAGCTTTGTCATGGT | TTA | chr6 | 160666579 | 160666600 | 160666596 | 160666601 | + |
| SEQ ID NO 41084 | AGCTTTGTCATGGTGCTTTGCG | CTG | chr6 | 160666587 | 160666608 | 160666604 | 160666609 | + |
| SEQ ID NO 41085 | TGTCATGGTGCTTTGCGGTTGG | CTT | chr6 | 160666592 | 160666613 | 160666609 | 160666614 | + |
| SEQ ID NO 41086 | GTCATGGTGCTTTGCGGTTGGT | TTT | chr6 | 160666593 | 160666614 | 160666610 | 160666615 | + |
| SEQ ID NO 41087 | TCATGGTGCTTTGCGGTTGGTT | TTG | chr6 | 160666594 | 160666615 | 160666611 | 160666616 | + |
| SEQ ID NO 41088 | TGCGGTTGGTTGTTGTTTCTTT | CTT | chr6 | 160666605 | 160666626 | 160666622 | 160666627 | + |
| SEQ ID NO 41089 | GCGGTTGGTTGTTGTTTCTTTA | TTT | chr6 | 160666606 | 160666627 | 160666623 | 160666628 | + |
| SEQ ID NO 41090 | CGGTTGGTTGTTGTTTCTTTAC | TTG | chr6 | 160666607 | 160666628 | 160666624 | 160666629 | + |
| SEQ ID NO 41091 | GTTGTTGTTTCTTTACCTTTTT | TTG | chr6 | 160666613 | 160666634 | 160666630 | 160666635 | + |
| SEQ ID NO 41092 | TTGTTTCTTTACCTTTTTCTTT | TTG | chr6 | 160666617 | 160666638 | 160666634 | 160666639 | + |
| SEQ ID NO 41093 | TTTCTTTACCTTTTTCTTTGCT | TTG | chr6 | 160666620 | 160666641 | 160666637 | 160666642 | + |
| SEQ ID NO 41094 | CTTTACCTTTTTCTTTGCTTTT | TTT | chr6 | 160666623 | 160666644 | 160666640 | 160666645 | + |

Figure 60 (Cont'd)

| | | | | | | | | |
|---|---|---|---|---|---|---|---|---|
| SEQ ID NO 41095 | TTTACCTTTTTCTTTGCTTTTA | TTC | chr6 | 160666624 | 160666645 | 160666641 | 160666646 | + |
| SEQ ID NO 41096 | TACCTTTTTCTTTGCTTTTAAA | CTT | chr6 | 160666626 | 160666647 | 160666643 | 160666648 | + |
| SEQ ID NO 41097 | ACCTTTTTCTTTGCTTTTAAAA | TTT | chr6 | 160666627 | 160666648 | 160666644 | 160666649 | + |
| SEQ ID NO 41098 | CCTTTTTCTTTGCTTTTAAAAC | TTA | chr6 | 160666628 | 160666649 | 160666645 | 160666650 | + |
| SEQ ID NO 41099 | TTTCTTTGCTTTTAAAACCATA | CTT | chr6 | 160666632 | 160666653 | 160666649 | 160666654 | + |
| SEQ ID NO 41100 | TTCTTTGCTTTTAAAACCATAA | TTT | chr6 | 160666633 | 160666654 | 160666650 | 160666655 | + |
| SEQ ID NO 41101 | TCTTTGCTTTTAAAACCATAAA | TTT | chr6 | 160666634 | 160666655 | 160666651 | 160666656 | + |
| SEQ ID NO 41102 | CTTTGCTTTTAAAACCATAAAG | TTT | chr6 | 160666635 | 160666656 | 160666652 | 160666657 | + |
| SEQ ID NO 41103 | TTTGCTTTTAAAACCATAAAGA | TTC | chr6 | 160666636 | 160666657 | 160666653 | 160666658 | + |
| SEQ ID NO 41104 | TGCTTTTAAAACCATAAAGAAT | CTT | chr6 | 160666638 | 160666659 | 160666655 | 160666660 | + |
| SEQ ID NO 41105 | GCTTTTAAAACCATAAAGAATA | TTT | chr6 | 160666639 | 160666660 | 160666656 | 160666661 | + |
| SEQ ID NO 41106 | CTTTTAAAACCATAAAGAATAA | TTG | chr6 | 160666640 | 160666661 | 160666657 | 160666662 | + |
| SEQ ID NO 41107 | TTAAAACCATAAAGAATAATGT | CTT | chr6 | 160666643 | 160666664 | 160666660 | 160666665 | + |
| SEQ ID NO 41108 | TAAAACCATAAAGAATAATGTT | TTT | chr6 | 160666644 | 160666665 | 160666661 | 160666666 | + |
| SEQ ID NO 41109 | AAAACCATAAAGAATAATGTTT | TTT | chr6 | 160666645 | 160666666 | 160666662 | 160666667 | + |
| SEQ ID NO 41110 | AAACCATAAAGAATAATGTTTA | TTA | chr6 | 160666646 | 160666667 | 160666663 | 160666668 | + |
| SEQ ID NO 41111 | AAATGTAGAGTCTGAGAAATGC | TTT | chr6 | 160666667 | 160666688 | 160666684 | 160666689 | + |
| SEQ ID NO 41112 | AATGTAGAGTCTGAGAAATGCA | TTA | chr6 | 160666668 | 160666689 | 160666685 | 160666690 | + |
| SEQ ID NO 41113 | AGAAATGCAATTGCTATTGTTT | CTG | chr6 | 160666681 | 160666702 | 160666698 | 160666703 | + |
| SEQ ID NO 41114 | CTATTGTTTTATATTTTCAGA | TTG | chr6 | 160666694 | 160666715 | 160666711 | 160666716 | + |
| SEQ ID NO 41115 | TTGTTTTATATTTTCAGACTT | CTA | chr6 | 160666697 | 160666718 | 160666714 | 160666719 | + |
| SEQ ID NO 41116 | TTTTTATATTTTCAGACTTTTT | TTG | chr6 | 160666700 | 160666721 | 160666717 | 160666722 | + |
| SEQ ID NO 41117 | TTATATTTTCAGACTTTTTGTA | TTT | chr6 | 160666703 | 160666724 | 160666720 | 160666725 | + |
| SEQ ID NO 41118 | TATATTTTCAGACTTTTTGTAT | TTT | chr6 | 160666704 | 160666725 | 160666721 | 160666726 | + |
| SEQ ID NO 41119 | ATATTTTCAGACTTTTTGTATG | TTT | chr6 | 160666705 | 160666726 | 160666722 | 160666727 | + |
| SEQ ID NO 41120 | TATTTTCAGACTTTTTGTATGC | TTA | chr6 | 160666706 | 160666727 | 160666723 | 160666728 | + |
| SEQ ID NO 41121 | TCAGACTTTTTGTATGCTTCTT | TTT | chr6 | 160666711 | 160666732 | 160666728 | 160666733 | + |
| SEQ ID NO 41122 | CAGACTTTTTGTATGCTTCTTT | TTT | chr6 | 160666712 | 160666733 | 160666729 | 160666734 | + |
| SEQ ID NO 41123 | AGACTTTTTGTATGCTTCTTTC | TTC | chr6 | 160666713 | 160666734 | 160666730 | 160666735 | + |
| SEQ ID NO 41124 | TTTGTATGCTTCTTTCACTAAT | CTT | chr6 | 160666719 | 160666740 | 160666736 | 160666741 | + |
| SEQ ID NO 41125 | TTGTATGCTTCTTTCACTAATT | TTT | chr6 | 160666720 | 160666741 | 160666737 | 160666742 | + |
| SEQ ID NO 41126 | TGTATGCTTCTTTCACTAATTA | TTT | chr6 | 160666721 | 160666742 | 160666738 | 160666743 | + |
| SEQ ID NO 41127 | GTATGCTTCTTTCACTAATTAC | TTT | chr6 | 160666722 | 160666743 | 160666739 | 160666744 | + |
| SEQ ID NO 41128 | TATGCTTCTTTCACTAATTACA | TTG | chr6 | 160666723 | 160666744 | 160666740 | 160666745 | + |
| SEQ ID NO 41129 | CTTTCACTAATTACATCATATC | CTT | chr6 | 160666730 | 160666751 | 160666747 | 160666752 | + |
| SEQ ID NO 41130 | TTTCACTAATTACATCATATCA | TTC | chr6 | 160666731 | 160666752 | 160666748 | 160666753 | + |
| SEQ ID NO 41131 | TCACTAATTACATCATATCACA | CTT | chr6 | 160666733 | 160666754 | 160666750 | 160666755 | + |
| SEQ ID NO 41132 | CACTAATTACATCATATCACAA | TTT | chr6 | 160666734 | 160666755 | 160666751 | 160666756 | + |
| SEQ ID NO 41133 | ACTAATTACATCATATCACAAA | TTC | chr6 | 160666735 | 160666756 | 160666752 | 160666757 | + |
| SEQ ID NO 41134 | ATTACATCATATCACAAAATTT | CTA | chr6 | 160666739 | 160666760 | 160666756 | 160666761 | + |
| SEQ ID NO 41135 | CATCATATCACAAAATTTCACA | TTA | chr6 | 160666743 | 160666764 | 160666760 | 160666765 | + |
| SEQ ID NO 41136 | CACACCCTGATTTTTTCACTCA | TTT | chr6 | 160666761 | 160666782 | 160666778 | 160666783 | + |
| SEQ ID NO 41137 | ACACCCTGATTTTTTCACTCAA | TTC | chr6 | 160666762 | 160666783 | 160666779 | 160666784 | + |
| SEQ ID NO 41138 | ATTTTTTCACTCAACATTACAT | CTG | chr6 | 160666770 | 160666791 | 160666787 | 160666792 | + |
| SEQ ID NO 41139 | TTTCACTCAACATTACATAATG | TTT | chr6 | 160666774 | 160666795 | 160666791 | 160666796 | + |
| SEQ ID NO 41140 | TTCACTCAACATTACATAATGA | TTT | chr6 | 160666775 | 160666796 | 160666792 | 160666797 | + |
| SEQ ID NO 41141 | TCACTCAACATTACATAATGAG | TTT | chr6 | 160666776 | 160666797 | 160666793 | 160666798 | + |
| SEQ ID NO 41142 | CACTCAACATTACATAATGAGT | TTT | chr6 | 160666777 | 160666798 | 160666794 | 160666799 | + |
| SEQ ID NO 41143 | ACTCAACATTACATAATGAGTT | TTC | chr6 | 160666778 | 160666799 | 160666795 | 160666800 | + |
| SEQ ID NO 41144 | AACATTACATAATGAGTTTTGT | CTC | chr6 | 160666782 | 160666803 | 160666799 | 160666804 | + |
| SEQ ID NO 41145 | CATAATGAGTTTTGTATAGTGC | TTA | chr6 | 160666789 | 160666810 | 160666806 | 160666811 | + |
| SEQ ID NO 41146 | TGTATAGTGCTATGATCTTCAT | TTT | chr6 | 160666801 | 160666822 | 160666818 | 160666823 | + |
| SEQ ID NO 41147 | GTATAGTGCTATGATCTTCATA | TTT | chr6 | 160666802 | 160666823 | 160666819 | 160666824 | + |
| SEQ ID NO 41148 | TATAGTGCTATGATCTTCATAA | TTG | chr6 | 160666803 | 160666824 | 160666820 | 160666825 | + |
| SEQ ID NO 41149 | TGATCTTCATAACTAATATTTT | CTA | chr6 | 160666813 | 160666834 | 160666830 | 160666835 | + |
| SEQ ID NO 41150 | CATAACTAATATTTTAAAGGAG | CTT | chr6 | 160666820 | 160666841 | 160666837 | 160666842 | + |
| SEQ ID NO 41151 | ATAACTAATATTTTAAAGGAGA | TTC | chr6 | 160666821 | 160666842 | 160666838 | 160666843 | + |
| SEQ ID NO 41152 | ATATTTTAAAGGAGAGCTACTG | CTA | chr6 | 160666828 | 160666849 | 160666845 | 160666850 | + |

Figure 60 (Cont'd)

| SEQ ID NO 41153 | TAAAGGAGAGCTACTGATTAAT | TTT | chr6 | 160666834 | 160666855 | 160666851 | 160666856 | + |
|---|---|---|---|---|---|---|---|---|
| SEQ ID NO 41154 | AAAGGAGAGCTACTGATTAATG | TTT | chr6 | 160666835 | 160666856 | 160666852 | 160666857 | + |
| SEQ ID NO 41155 | AAGGAGAGCTACTGATTAATGA | TTA | chr6 | 160666836 | 160666857 | 160666853 | 160666858 | + |
| SEQ ID NO 41156 | CTGATTAATGAGCATGAGGTTT | CTA | chr6 | 160666847 | 160666868 | 160666864 | 160666869 | + |
| SEQ ID NO 41157 | ATTAATGAGCATGAGGTTTCCT | CTG | chr6 | 160666850 | 160666871 | 160666867 | 160666872 | + |
| SEQ ID NO 41158 | ATGAGCATGAGGTTTCCTTTGG | TTA | chr6 | 160666854 | 160666875 | 160666871 | 160666876 | + |
| SEQ ID NO 41159 | CCTTTGGGGATGAGGAAAATAT | TTT | chr6 | 160666869 | 160666890 | 160666886 | 160666891 | + |
| SEQ ID NO 41160 | CTTTGGGGATGAGGAAAATATT | TTC | chr6 | 160666870 | 160666891 | 160666887 | 160666892 | + |
| SEQ ID NO 41161 | TGGGGATGAGGAAAATATTCTG | CTT | chr6 | 160666873 | 160666894 | 160666890 | 160666895 | + |
| SEQ ID NO 41162 | GGGGATGAGGAAAATATTCTGG | TTT | chr6 | 160666874 | 160666895 | 160666891 | 160666896 | + |
| SEQ ID NO 41163 | GGGATGAGGAAAATATTCTGGA | TTG | chr6 | 160666875 | 160666896 | 160666892 | 160666897 | + |
| SEQ ID NO 41164 | TGGAAATATGATGATGGTTGCA | TTC | chr6 | 160666893 | 160666914 | 160666910 | 160666915 | + |
| SEQ ID NO 41165 | GAAATATGATGATGGTTGCACA | CTG | chr6 | 160666895 | 160666916 | 160666912 | 160666917 | + |
| SEQ ID NO 41166 | CACACCACTGTGAATGTACTAA | TTG | chr6 | 160666913 | 160666934 | 160666930 | 160666935 | + |
| SEQ ID NO 41167 | TGAATGTACTAAATGCCACTTG | CTG | chr6 | 160666923 | 160666944 | 160666940 | 160666945 | + |
| SEQ ID NO 41168 | AATGCCACTTGGTGGTACCCTG | CTA | chr6 | 160666934 | 160666955 | 160666951 | 160666956 | + |
| SEQ ID NO 41169 | GGTGGTACCCTGCAAAAATGGT | CTT | chr6 | 160666944 | 160666965 | 160666961 | 160666966 | + |
| SEQ ID NO 41170 | GTGGTACCCTGCAAAAATGGTT | TTG | chr6 | 160666945 | 160666966 | 160666962 | 160666967 | + |
| SEQ ID NO 41171 | CAAAAATGGTTAAAATAGTAAC | CTG | chr6 | 160666956 | 160666977 | 160666973 | 160666978 | + |
| SEQ ID NO 41172 | AAATAGTAACTCTTACGCTGTG | TTA | chr6 | 160666968 | 160666989 | 160666985 | 160666990 | + |
| SEQ ID NO 41173 | TTACGCTGTGTACATTTTATTG | CTC | chr6 | 160666980 | 160667001 | 160666997 | 160667002 | + |
| SEQ ID NO 41174 | ACGCTGTGTACATTTTATTGCA | CTT | chr6 | 160666982 | 160667003 | 160666999 | 160667004 | + |
| SEQ ID NO 41175 | CGCTGTGTACATTTTATTGCAA | TTA | chr6 | 160666983 | 160667004 | 160667000 | 160667005 | + |
| SEQ ID NO 41176 | TGTACATTTTATTGCAATAAAA | CTG | chr6 | 160666988 | 160667009 | 160667005 | 160667010 | + |
| SEQ ID NO 41177 | TATTGCAATAAAAAAGAATAGT | TTT | chr6 | 160666997 | 160667018 | 160667014 | 160667019 | + |
| SEQ ID NO 41178 | ATTGCAATAAAAAAGAATAGTC | TTT | chr6 | 160666998 | 160667019 | 160667015 | 160667020 | + |
| SEQ ID NO 41179 | TTGCAATAAAAAAGAATAGTCA | TTA | chr6 | 160666999 | 160667020 | 160667016 | 160667021 | + |
| SEQ ID NO 41180 | CAATAAAAAAGAATAGTCATCA | TTG | chr6 | 160667002 | 160667023 | 160667019 | 160667024 | + |
| SEQ ID NO 41181 | ACTAAGCATTATCCTTTCCAGG | TTT | chr6 | 160667027 | 160667048 | 160667044 | 160667049 | + |
| SEQ ID NO 41182 | CTAAGCATTATCCTTTCCAGGC | TTA | chr6 | 160667028 | 160667049 | 160667045 | 160667050 | + |
| SEQ ID NO 41183 | AGCATTATCCTTTCCAGGCACA | CTA | chr6 | 160667031 | 160667052 | 160667048 | 160667053 | + |
| SEQ ID NO 41184 | TCCTTTCCAGGCACAAGCTTAT | TTA | chr6 | 160667038 | 160667059 | 160667055 | 160667060 | + |
| SEQ ID NO 41185 | TCCAGGCACAAGCTTATAATGT | CTT | chr6 | 160667043 | 160667064 | 160667060 | 160667065 | + |
| SEQ ID NO 41186 | CCAGGCACAAGCTTATAATGTG | TTT | chr6 | 160667044 | 160667065 | 160667061 | 160667066 | + |
| SEQ ID NO 41187 | CAGGCACAAGCTTATAATGTGG | TTC | chr6 | 160667045 | 160667066 | 160667062 | 160667067 | + |
| SEQ ID NO 41188 | ATAATGTGGTGTATCTCACTTC | CTT | chr6 | 160667058 | 160667079 | 160667075 | 160667080 | + |
| SEQ ID NO 41189 | TAATGTGGTGTATCTCACTTCA | TTA | chr6 | 160667059 | 160667080 | 160667076 | 160667081 | + |
| SEQ ID NO 41190 | ACTTCATCCTCACAACAGTCCT | CTC | chr6 | 160667075 | 160667096 | 160667092 | 160667097 | + |
| SEQ ID NO 41191 | CATCCTCACAACAGTCCTATGA | CTT | chr6 | 160667079 | 160667100 | 160667096 | 160667101 | + |
| SEQ ID NO 41192 | ATCCTCACAACAGTCCTATGAA | TTC | chr6 | 160667080 | 160667101 | 160667097 | 160667102 | + |
| SEQ ID NO 41193 | ACAACAGTCCTATGAAACAGGC | CTC | chr6 | 160667086 | 160667107 | 160667103 | 160667108 | + |
| SEQ ID NO 41194 | TGAAACAGGCAGTTCCATCACT | CTA | chr6 | 160667098 | 160667119 | 160667115 | 160667120 | + |
| SEQ ID NO 41195 | CATCACTCCTGCTCTACAGTTA | TTC | chr6 | 160667113 | 160667134 | 160667130 | 160667135 | + |
| SEQ ID NO 41196 | CTGCTCTACAGTTAAGGAAACT | CTC | chr6 | 160667121 | 160667142 | 160667138 | 160667143 | + |
| SEQ ID NO 41197 | CTCTACAGTTAAGGAAACTGAG | CTG | chr6 | 160667124 | 160667145 | 160667141 | 160667146 | + |
| SEQ ID NO 41198 | TACAGTTAAGGAAACTGAGGTG | CTC | chr6 | 160667127 | 160667148 | 160667144 | 160667149 | + |
| SEQ ID NO 41199 | CAGTTAAGGAAACTGAGGTGTA | CTA | chr6 | 160667129 | 160667150 | 160667146 | 160667151 | + |
| SEQ ID NO 41200 | AGGAAACTGAGGTGTAAGGAGG | TTA | chr6 | 160667135 | 160667156 | 160667152 | 160667157 | + |
| SEQ ID NO 41201 | AGGTGTAAGGAGGTTGTCTAGT | CTG | chr6 | 160667144 | 160667165 | 160667161 | 160667166 | + |
| SEQ ID NO 41202 | TCTAGTTCAACCTGAGCCTGGG | TTG | chr6 | 160667160 | 160667181 | 160667177 | 160667182 | + |
| SEQ ID NO 41203 | GTTCAACCTGAGCCTGGGTCTG | CTA | chr6 | 160667164 | 160667185 | 160667181 | 160667186 | + |
| SEQ ID NO 41204 | AACCTGAGCCTGGGTCTGCGGA | TTC | chr6 | 160667168 | 160667189 | 160667185 | 160667190 | + |
| SEQ ID NO 41205 | AGCCTGGGTCTGCGGAGTCACT | CTG | chr6 | 160667174 | 160667195 | 160667191 | 160667196 | + |
| SEQ ID NO 41206 | GGTCTGCGGAGTCACTGCCCAA | CTG | chr6 | 160667180 | 160667201 | 160667197 | 160667202 | + |
| SEQ ID NO 41207 | CGGAGTCACTGCCCAAATGCTT | CTG | chr6 | 160667186 | 160667207 | 160667203 | 160667208 | + |
| SEQ ID NO 41208 | CCCAAATGCTTCCTCCCCGTGC | CTG | chr6 | 160667197 | 160667218 | 160667214 | 160667219 | + |
| SEQ ID NO 41209 | CCTCCCCGTGCGCGTTGGCCCC | CTT | chr6 | 160667208 | 160667229 | 160667225 | 160667230 | + |
| SEQ ID NO 41210 | CTCCCCGTGCGCGTTGGCCCCC | TTC | chr6 | 160667209 | 160667230 | 160667226 | 160667231 | + |

Figure 60 (Cont'd)

| SEQ ID NO 41211 | CCCGTGCGCGTTGGCCCCCCTC | CTC | chr6 | 160667212 | 160667233 | 160667229 | 160667234 | + |
| SEQ ID NO 41212 | GCCCCCCTCTTGCTTCCAACCC | TTG | chr6 | 160667225 | 160667246 | 160667242 | 160667247 | + |
| SEQ ID NO 41213 | TTGCTTCCAACCCTCCACATCT | CTC | chr6 | 160667234 | 160667255 | 160667251 | 160667256 | + |
| SEQ ID NO 41214 | GCTTCCAACCCTCCACATCTTT | CTT | chr6 | 160667236 | 160667257 | 160667253 | 160667258 | + |
| SEQ ID NO 41215 | CTTCCAACCCTCCACATCTTTG | TTG | chr6 | 160667237 | 160667258 | 160667254 | 160667259 | + |
| SEQ ID NO 41216 | CCAACCCTCCACATCTTTGTTC | CTT | chr6 | 160667240 | 160667261 | 160667257 | 160667262 | + |
| SEQ ID NO 41217 | CAACCCTCCACATCTTTGTTCA | TTC | chr6 | 160667241 | 160667262 | 160667258 | 160667263 | + |
| SEQ ID NO 41218 | CACATCTTTGTTCATAAAGTTC | CTC | chr6 | 160667249 | 160667270 | 160667266 | 160667271 | + |
| SEQ ID NO 41219 | TGTTCATAAAGTTCATTCTTAT | CTT | chr6 | 160667257 | 160667278 | 160667274 | 160667279 | + |
| SEQ ID NO 41220 | GTTCATAAAGTTCATTCTTATT | TTT | chr6 | 160667258 | 160667279 | 160667275 | 160667280 | + |
| SEQ ID NO 41221 | TTCATAAAGTTCATTCTTATTC | TTG | chr6 | 160667259 | 160667280 | 160667276 | 160667281 | + |
| SEQ ID NO 41222 | ATAAAGTTCATTCTTATTCCTT | TTC | chr6 | 160667262 | 160667283 | 160667279 | 160667284 | + |
| SEQ ID NO 41223 | ATTCTTATTCCTTAATATTTTC | TTC | chr6 | 160667271 | 160667292 | 160667288 | 160667293 | + |
| SEQ ID NO 41224 | TTATTCCTTAATATTTTCTGAG | TTC | chr6 | 160667275 | 160667296 | 160667292 | 160667297 | + |
| SEQ ID NO 41225 | ATTCCTTAATATTTTCTGAGCC | CTT | chr6 | 160667277 | 160667298 | 160667294 | 160667299 | + |
| SEQ ID NO 41226 | TTCCTTAATATTTTCTGAGCCT | TTA | chr6 | 160667278 | 160667299 | 160667295 | 160667300 | + |
| SEQ ID NO 41227 | CTTAATATTTTCTGAGCCTAAG | TTC | chr6 | 160667281 | 160667302 | 160667298 | 160667303 | + |
| SEQ ID NO 41228 | AATATTTTCTGAGCCTAAGTTC | CTT | chr6 | 160667284 | 160667305 | 160667301 | 160667306 | + |
| SEQ ID NO 41229 | ATATTTTCTGAGCCTAAGTTCC | TTA | chr6 | 160667285 | 160667306 | 160667302 | 160667307 | + |
| SEQ ID NO 41230 | TCTGAGCCTAAGTTCCCATAAA | TTT | chr6 | 160667291 | 160667312 | 160667308 | 160667313 | + |
| SEQ ID NO 41231 | CTGAGCCTAAGTTCCCATAAAT | TTT | chr6 | 160667292 | 160667313 | 160667309 | 160667314 | + |
| SEQ ID NO 41232 | TGAGCCTAAGTTCCCATAAATT | TTC | chr6 | 160667293 | 160667314 | 160667310 | 160667315 | + |
| SEQ ID NO 41233 | AGCCTAAGTTCCCATAAATTAT | CTG | chr6 | 160667295 | 160667316 | 160667312 | 160667317 | + |
| SEQ ID NO 41234 | AGTTCCCATAAATTATATAGAC | CTA | chr6 | 160667301 | 160667322 | 160667318 | 160667323 | + |
| SEQ ID NO 41235 | CCATAAATTATATAGACATATT | TTC | chr6 | 160667306 | 160667327 | 160667323 | 160667328 | + |
| SEQ ID NO 41236 | TATAGACATATTTCTGTCTCCC | TTA | chr6 | 160667316 | 160667337 | 160667333 | 160667338 | + |
| SEQ ID NO 41237 | CTGTCTCCCAATAACACTGCCA | TTT | chr6 | 160667329 | 160667350 | 160667346 | 160667351 | + |
| SEQ ID NO 41238 | TGTCTCCCAATAACACTGCCAA | TTC | chr6 | 160667330 | 160667351 | 160667347 | 160667352 | + |
| SEQ ID NO 41239 | TCTCCCAATAACACTGCCAATT | CTG | chr6 | 160667332 | 160667353 | 160667349 | 160667354 | + |
| SEQ ID NO 41240 | CCAATAACACTGCCAATTTATT | CTC | chr6 | 160667336 | 160667357 | 160667353 | 160667358 | + |
| SEQ ID NO 41241 | CCAATTTATTTTCTAGAAGGTT | CTG | chr6 | 160667348 | 160667369 | 160667365 | 160667370 | + |
| SEQ ID NO 41242 | ATTTTCTAGAAGGTTATGACAG | TTT | chr6 | 160667355 | 160667376 | 160667372 | 160667377 | + |
| SEQ ID NO 41243 | TTTTCTAGAAGGTTATGACAGT | TTA | chr6 | 160667356 | 160667377 | 160667373 | 160667378 | + |
| SEQ ID NO 41244 | TCTAGAAGGTTATGACAGTGTA | TTT | chr6 | 160667359 | 160667380 | 160667376 | 160667381 | + |
| SEQ ID NO 41245 | CTAGAAGGTTATGACAGTGTAA | TTT | chr6 | 160667360 | 160667381 | 160667377 | 160667382 | + |
| SEQ ID NO 41246 | TAGAAGGTTATGACAGTGTAAA | TTC | chr6 | 160667361 | 160667382 | 160667378 | 160667383 | + |
| SEQ ID NO 41247 | GAAGGTTATGACAGTGTAAAAT | CTA | chr6 | 160667363 | 160667384 | 160667380 | 160667385 | + |
| SEQ ID NO 41248 | TGACAGTGTAAAATGTCACTAG | TTA | chr6 | 160667371 | 160667392 | 160667388 | 160667393 | + |
| SEQ ID NO 41249 | GAAAACAATCACTTCACCCACAC | CTA | chr6 | 160667392 | 160667413 | 160667409 | 160667414 | + |
| SEQ ID NO 41250 | CACCCACTTGTATGAGTGTTC | CTT | chr6 | 160667406 | 160667427 | 160667423 | 160667428 | + |
| SEQ ID NO 41251 | ACCACACTTGTATGAGTGTTCA | TTC | chr6 | 160667407 | 160667428 | 160667424 | 160667429 | + |
| SEQ ID NO 41252 | GTATGAGTGTTCAATTTTTAAA | CTT | chr6 | 160667416 | 160667437 | 160667433 | 160667438 | + |
| SEQ ID NO 41253 | TATGAGTGTTCAATTTTTAAAT | TTG | chr6 | 160667417 | 160667438 | 160667434 | 160667439 | + |
| SEQ ID NO 41254 | AATTTTTAAATATTAGCTAATC | TTC | chr6 | 160667428 | 160667449 | 160667445 | 160667450 | + |
| SEQ ID NO 41255 | TTAAATATTAGCTAATCTAACA | TTT | chr6 | 160667433 | 160667454 | 160667450 | 160667455 | + |
| SEQ ID NO 41256 | TAAATATTAGCTAATCTAACAG | TTT | chr6 | 160667434 | 160667455 | 160667451 | 160667456 | + |
| SEQ ID NO 41257 | AAATATTAGCTAATCTAACAGG | TTT | chr6 | 160667435 | 160667456 | 160667452 | 160667457 | + |
| SEQ ID NO 41258 | AATATTAGCTAATCTAACAGGT | TTA | chr6 | 160667436 | 160667457 | 160667453 | 160667458 | + |
| SEQ ID NO 41259 | GCTAATCTAACAGGTTGAAATT | TTA | chr6 | 160667443 | 160667464 | 160667460 | 160667465 | + |
| SEQ ID NO 41260 | ATCTAACAGGTTGAAATTGTCC | CTA | chr6 | 160667447 | 160667468 | 160667464 | 160667469 | + |
| SEQ ID NO 41261 | ACAGGTTGAAATTGTCCTGATT | CTA | chr6 | 160667452 | 160667473 | 160667469 | 160667474 | + |
| SEQ ID NO 41262 | AAATTGTCCTGATTCATTTTCT | TTG | chr6 | 160667460 | 160667481 | 160667477 | 160667482 | + |
| SEQ ID NO 41263 | TCCTGATTCATTTTCTAATTTA | TTG | chr6 | 160667466 | 160667487 | 160667483 | 160667488 | + |
| SEQ ID NO 41264 | ATTCATTTTCTAATTTATACTT | CTG | chr6 | 160667471 | 160667492 | 160667488 | 160667493 | + |
| SEQ ID NO 41265 | ATTTTCTAATTTATACTTCTTT | TTC | chr6 | 160667475 | 160667496 | 160667492 | 160667497 | + |
| SEQ ID NO 41266 | TCTAATTTATACTTCTTTGACA | TTT | chr6 | 160667479 | 160667500 | 160667496 | 160667501 | + |
| SEQ ID NO 41267 | CTAATTTATACTTCTTTGACAA | TTT | chr6 | 160667480 | 160667501 | 160667497 | 160667502 | + |
| SEQ ID NO 41268 | TAATTTATACTTCTTTGACAAT | TTC | chr6 | 160667481 | 160667502 | 160667498 | 160667503 | + |

Figure 60 (Cont'd)

| SEQ ID NO 41269 | ATTTATACTTCTTTGACAATTT | CTA | chr6 | 160667483 | 160667504 | 160667500 | 160667505 | + |
|---|---|---|---|---|---|---|---|---|
| SEQ ID NO 41270 | ATACTTCTTTGACAATTTGGGA | TTT | chr6 | 160667487 | 160667508 | 160667504 | 160667509 | + |
| SEQ ID NO 41271 | TACTTCTTTGACAATTTGGGAG | TTA | chr6 | 160667488 | 160667509 | 160667505 | 160667510 | + |
| SEQ ID NO 41272 | CTTTGACAATTTGGGAGAGTGA | CTT | chr6 | 160667493 | 160667514 | 160667510 | 160667515 | + |
| SEQ ID NO 41273 | TTTGACAATTTGGGAGAGTGAA | TTC | chr6 | 160667494 | 160667515 | 160667511 | 160667516 | + |
| SEQ ID NO 41274 | TGACAATTTGGGAGAGTGAAGA | CTT | chr6 | 160667496 | 160667517 | 160667513 | 160667518 | + |
| SEQ ID NO 41275 | GACAATTTGGGAGAGTGAAGAT | TTT | chr6 | 160667497 | 160667518 | 160667514 | 160667519 | + |
| SEQ ID NO 41276 | ACAATTTGGGAGAGTGAAGATT | TTG | chr6 | 160667498 | 160667519 | 160667515 | 160667520 | + |
| SEQ ID NO 41277 | GGGAGAGTGAAGATTCTCCTGG | TTT | chr6 | 160667505 | 160667526 | 160667522 | 160667527 | + |
| SEQ ID NO 41278 | GGAGAGTGAAGATTCTCCTGGT | TTG | chr6 | 160667506 | 160667527 | 160667523 | 160667528 | + |
| SEQ ID NO 41279 | TCCTGGTTGTGTTTATTCTTTT | TTC | chr6 | 160667521 | 160667542 | 160667538 | 160667543 | + |
| SEQ ID NO 41280 | CTGGTTGTGTTTATTCTTTTGT | CTC | chr6 | 160667523 | 160667544 | 160667540 | 160667545 | + |
| SEQ ID NO 41281 | GTTGTGTTTATTCTTTTGTGAA | CTG | chr6 | 160667526 | 160667547 | 160667543 | 160667548 | + |
| SEQ ID NO 41282 | TGTTTATTCTTTTGTGAAAAAC | TTG | chr6 | 160667530 | 160667551 | 160667547 | 160667552 | + |
| SEQ ID NO 41283 | ATTCTTTTGTGAAAAACTGCTT | TTT | chr6 | 160667535 | 160667556 | 160667552 | 160667557 | + |
| SEQ ID NO 41284 | TTCTTTTGTGAAAAACTGCTTT | TTA | chr6 | 160667536 | 160667557 | 160667553 | 160667558 | + |
| SEQ ID NO 41285 | TTTTGTGAAAAACTGCTTTATT | TTC | chr6 | 160667539 | 160667560 | 160667556 | 160667561 | + |
| SEQ ID NO 41286 | TTGTGAAAAACTGCTTTATTTT | CTT | chr6 | 160667541 | 160667562 | 160667558 | 160667563 | + |
| SEQ ID NO 41287 | TGTGAAAAACTGCTTTATTTTC | TTT | chr6 | 160667542 | 160667563 | 160667559 | 160667564 | + |
| SEQ ID NO 41288 | GTGAAAAACTGCTTTATTTTCT | TTT | chr6 | 160667543 | 160667564 | 160667560 | 160667565 | + |
| SEQ ID NO 41289 | TGAAAAACTGCTTTATTTTCTT | TTG | chr6 | 160667544 | 160667565 | 160667561 | 160667566 | + |
| SEQ ID NO 41290 | CTTTATTTTCTTTGCCAAATTC | CTG | chr6 | 160667554 | 160667575 | 160667571 | 160667576 | + |
| SEQ ID NO 41291 | TATTTTCTTTGCCAAATTCAAA | CTT | chr6 | 160667557 | 160667578 | 160667574 | 160667579 | + |
| SEQ ID NO 41292 | ATTTTCTTTGCCAAATTCAAAT | TTT | chr6 | 160667558 | 160667579 | 160667575 | 160667580 | + |
| SEQ ID NO 41293 | TTTTCTTTGCCAAATTCAAATA | TTA | chr6 | 160667559 | 160667580 | 160667576 | 160667581 | + |
| SEQ ID NO 41294 | TCTTTGCCAAATTCAAATAGAA | TTT | chr6 | 160667562 | 160667583 | 160667579 | 160667584 | + |
| SEQ ID NO 41295 | CTTTGCCAAATTCAAATAGAAC | TTT | chr6 | 160667563 | 160667584 | 160667580 | 160667585 | + |
| SEQ ID NO 41296 | TTTGCCAAATTCAAATAGAACG | TTC | chr6 | 160667564 | 160667585 | 160667581 | 160667586 | + |
| SEQ ID NO 41297 | TGCCAAATTCAAATAGAACGGT | CTT | chr6 | 160667566 | 160667587 | 160667583 | 160667588 | + |
| SEQ ID NO 41298 | GCCAAATTCAAATAGAACGGTT | TTT | chr6 | 160667567 | 160667588 | 160667584 | 160667589 | + |
| SEQ ID NO 41299 | CCAAATTCAAATAGAACGGTTG | TTG | chr6 | 160667568 | 160667589 | 160667585 | 160667590 | + |
| SEQ ID NO 41300 | AAATAGAACGGTTGCAAAATTG | TTC | chr6 | 160667576 | 160667597 | 160667593 | 160667598 | + |
| SEQ ID NO 41301 | CAAAATTGCCAGAGGAAATGCT | TTG | chr6 | 160667590 | 160667611 | 160667607 | 160667612 | + |
| SEQ ID NO 41302 | CCAGAGGAAATGCTGTTTTTCC | TTG | chr6 | 160667598 | 160667619 | 160667615 | 160667620 | + |
| SEQ ID NO 41303 | TTTTTCCAGATGGACACACCCA | CTG | chr6 | 160667613 | 160667634 | 160667630 | 160667635 | + |
| SEQ ID NO 41304 | TTCCAGATGGACACACCCAGGG | TTT | chr6 | 160667616 | 160667637 | 160667633 | 160667638 | + |
| SEQ ID NO 41305 | TCCAGATGGACACACCCAGGGA | TTT | chr6 | 160667617 | 160667638 | 160667634 | 160667639 | + |
| SEQ ID NO 41306 | CCAGATGGACACACCCAGGGAT | TTT | chr6 | 160667618 | 160667639 | 160667635 | 160667640 | + |
| SEQ ID NO 41307 | CAGATGGACACACCCAGGGATG | TTC | chr6 | 160667619 | 160667640 | 160667636 | 160667641 | + |
| SEQ ID NO 41308 | CAGTGTTCTCACAAATAATCCA | TTT | chr6 | 160667644 | 160667665 | 160667661 | 160667666 | + |
| SEQ ID NO 41309 | AGTGTTCTCACAAATAATCCAG | TTC | chr6 | 160667645 | 160667666 | 160667662 | 160667667 | + |
| SEQ ID NO 41310 | TCACAAATAATCCAGTTTTCTA | TTC | chr6 | 160667652 | 160667673 | 160667669 | 160667674 | + |
| SEQ ID NO 41311 | ACAAATAATCCAGTTTTCTAAT | CTC | chr6 | 160667654 | 160667675 | 160667671 | 160667676 | + |
| SEQ ID NO 41312 | TCTAATTTTGCAAGCCCAGCTT | TTT | chr6 | 160667670 | 160667691 | 160667687 | 160667692 | + |
| SEQ ID NO 41313 | CTAATTTTGCAAGCCCAGCTTT | TTT | chr6 | 160667671 | 160667692 | 160667688 | 160667693 | + |
| SEQ ID NO 41314 | TAATTTTGCAAGCCCAGCTTTC | TTC | chr6 | 160667672 | 160667693 | 160667689 | 160667694 | + |
| SEQ ID NO 41315 | ATTTTGCAAGCCCAGCTTTCAT | CTA | chr6 | 160667674 | 160667695 | 160667691 | 160667696 | + |
| SEQ ID NO 41316 | TGCAAGCCCAGCTTTCATTAGA | TTT | chr6 | 160667678 | 160667699 | 160667695 | 160667700 | + |
| SEQ ID NO 41317 | GCAAGCCCAGCTTTCATTAGAA | TTT | chr6 | 160667679 | 160667700 | 160667696 | 160667701 | + |
| SEQ ID NO 41318 | CAAGCCCAGCTTTCATTAGAAT | TTG | chr6 | 160667680 | 160667701 | 160667697 | 160667702 | + |
| SEQ ID NO 41319 | TCATTAGAATTTTGCAAAAATC | CTT | chr6 | 160667692 | 160667713 | 160667709 | 160667714 | + |
| SEQ ID NO 41320 | CATTAGAATTTTGCAAAAATCC | TTT | chr6 | 160667693 | 160667714 | 160667710 | 160667715 | + |
| SEQ ID NO 41321 | ATTAGAATTTTGCAAAAATCCT | TTC | chr6 | 160667694 | 160667715 | 160667711 | 160667716 | + |
| SEQ ID NO 41322 | GAATTTTGCAAAAATCCTTGCT | TTA | chr6 | 160667698 | 160667719 | 160667715 | 160667720 | + |
| SEQ ID NO 41323 | TGCAAAAATCCTTGCTTTGCGA | TTT | chr6 | 160667704 | 160667725 | 160667721 | 160667726 | + |
| SEQ ID NO 41324 | GCAAAAATCCTTGCTTTGCGAG | TTT | chr6 | 160667705 | 160667726 | 160667722 | 160667727 | + |
| SEQ ID NO 41325 | CAAAAATCCTTGCTTTGCGAGC | TTG | chr6 | 160667706 | 160667727 | 160667723 | 160667728 | + |
| SEQ ID NO 41326 | GCTTTGCGAGCATGGCACAGGC | CTT | chr6 | 160667717 | 160667738 | 160667734 | 160667739 | + |

Figure 60 (Cont'd)

| SEQ ID NO 41327 | CTTTGCGAGCATGGCACAGGCA | TTG | chr6 | 160667718 | 160667739 | 160667735 | 160667740 | + |
| --- | --- | --- | --- | --- | --- | --- | --- | --- |
| SEQ ID NO 41328 | TGCGAGCATGGCACAGGCAAGA | CTT | chr6 | 160667721 | 160667742 | 160667738 | 160667743 | + |
| SEQ ID NO 41329 | GCGAGCATGGCACAGGCAAGAG | TTT | chr6 | 160667722 | 160667743 | 160667739 | 160667744 | + |
| SEQ ID NO 41330 | CGAGCATGGCACAGGCAAGAGA | TTG | chr6 | 160667723 | 160667744 | 160667740 | 160667745 | + |
| SEQ ID NO 41331 | TCTCTTTCTTCCCCCAGAGCCT | CTC | chr6 | 160667755 | 160667776 | 160667772 | 160667777 | + |
| SEQ ID NO 41332 | TCTTTCTTCCCCCAGAGCCTTT | CTC | chr6 | 160667757 | 160667778 | 160667774 | 160667779 | + |
| SEQ ID NO 41333 | TTTCTTCCCCCAGAGCCTTTGA | CTC | chr6 | 160667759 | 160667780 | 160667776 | 160667781 | + |
| SEQ ID NO 41334 | TCTTCCCCCAGAGCCTTTGACT | CTT | chr6 | 160667761 | 160667782 | 160667778 | 160667783 | + |
| SEQ ID NO 41335 | CTTCCCCCAGAGCCTTTGACTG | TTT | chr6 | 160667762 | 160667783 | 160667779 | 160667784 | + |
| SEQ ID NO 41336 | TTCCCCCAGAGCCTTTGACTGC | TTC | chr6 | 160667763 | 160667784 | 160667780 | 160667785 | + |
| SEQ ID NO 41337 | CCCCCAGAGCCTTTGACTGCAC | CTT | chr6 | 160667765 | 160667786 | 160667782 | 160667787 | + |
| SEQ ID NO 41338 | CCCCAGAGCCTTTGACTGCACT | TTC | chr6 | 160667766 | 160667787 | 160667783 | 160667788 | + |
| SEQ ID NO 41339 | TGACTGCACTTAGATCATTGAC | CTT | chr6 | 160667778 | 160667799 | 160667795 | 160667800 | + |
| SEQ ID NO 41340 | GACTGCACTTAGATCATTGACT | TTT | chr6 | 160667779 | 160667800 | 160667796 | 160667801 | + |
| SEQ ID NO 41341 | ACTGCACTTAGATCATTGACTT | TTG | chr6 | 160667780 | 160667801 | 160667797 | 160667802 | + |
| SEQ ID NO 41342 | CACTTAGATCATTGACTTTGGT | CTG | chr6 | 160667784 | 160667805 | 160667801 | 160667806 | + |
| SEQ ID NO 41343 | AGATCATTGACTTTGGTTCAGA | CTT | chr6 | 160667789 | 160667810 | 160667806 | 160667811 | + |
| SEQ ID NO 41344 | GATCATTGACTTTGGTTCAGAA | TTA | chr6 | 160667790 | 160667811 | 160667807 | 160667812 | + |
| SEQ ID NO 41345 | ACTTTGGTTCAGAAACCTGACT | TTG | chr6 | 160667798 | 160667819 | 160667815 | 160667820 | + |
| SEQ ID NO 41346 | TGGTTCAGAAACCTGACTGCAT | CTT | chr6 | 160667802 | 160667823 | 160667819 | 160667824 | + |
| SEQ ID NO 41347 | GGTTCAGAAACCTGACTGCATC | TTT | chr6 | 160667803 | 160667824 | 160667820 | 160667825 | + |
| SEQ ID NO 41348 | GTTCAGAAACCTGACTGCATCT | TTG | chr6 | 160667804 | 160667825 | 160667821 | 160667826 | + |
| SEQ ID NO 41349 | AGAAACCTGACTGCATCTGGAG | TTC | chr6 | 160667808 | 160667829 | 160667825 | 160667830 | + |
| SEQ ID NO 41350 | ACTGCATCTGGAGTTGACATGA | CTG | chr6 | 160667817 | 160667838 | 160667834 | 160667839 | + |
| SEQ ID NO 41351 | CATCTGGAGTTGACATGAGCAG | CTG | chr6 | 160667821 | 160667842 | 160667838 | 160667843 | + |
| SEQ ID NO 41352 | GAGTTGACATGAGCAGCATGGA | CTG | chr6 | 160667827 | 160667848 | 160667844 | 160667849 | + |
| SEQ ID NO 41353 | ACATGAGCAGCATGGAAGATGT | TTG | chr6 | 160667833 | 160667854 | 160667850 | 160667855 | + |
| SEQ ID NO 41354 | GTCCAGCACCTCACTCCAGAG | TTT | chr6 | 160667857 | 160667878 | 160667874 | 160667879 | + |
| SEQ ID NO 41355 | TCCCAGCACCTCACTCCAGAGG | TTG | chr6 | 160667858 | 160667879 | 160667875 | 160667880 | + |
| SEQ ID NO 41356 | ACTCCAGAGGCCAGCTCAGCTC | CTC | chr6 | 160667870 | 160667891 | 160667887 | 160667892 | + |
| SEQ ID NO 41357 | CAGAGGCCAGCTCAGCTCAATC | CTC | chr6 | 160667874 | 160667895 | 160667891 | 160667896 | + |
| SEQ ID NO 41358 | AGCTCAATCTGGGCAGAGCTGC | CTC | chr6 | 160667887 | 160667908 | 160667904 | 160667909 | + |
| SEQ ID NO 41359 | AATCTGGGCAGAGCTGCATGAT | CTC | chr6 | 160667892 | 160667913 | 160667909 | 160667914 | + |
| SEQ ID NO 41360 | GGCAGAGCTGCATGATGGAAGT | CTG | chr6 | 160667898 | 160667919 | 160667915 | 160667920 | + |
| SEQ ID NO 41361 | CATGATGGAAGTTTCTGACTAC | CTG | chr6 | 160667908 | 160667929 | 160667925 | 160667930 | + |
| SEQ ID NO 41362 | CTGACTACCAAGCATCGGGCAG | TTT | chr6 | 160667922 | 160667943 | 160667939 | 160667944 | + |
| SEQ ID NO 41363 | TGACTACCAAGCATCGGGCAGA | TTC | chr6 | 160667923 | 160667944 | 160667940 | 160667945 | + |
| SEQ ID NO 41364 | ACTACCAAGCATCGGGCAGAGG | CTG | chr6 | 160667925 | 160667946 | 160667942 | 160667947 | + |
| SEQ ID NO 41365 | CCAAGCATCGGGCAGAGGGTGC | CTA | chr6 | 160667929 | 160667950 | 160667946 | 160667951 | + |
| SEQ ID NO 41366 | GACTACATAGTTGTGTGAGGGA | CTG | chr6 | 160667959 | 160667980 | 160667976 | 160667981 | + |
| SEQ ID NO 41367 | CATAGTTGTGTGAGGGAGCACC | CTA | chr6 | 160667964 | 160667985 | 160667981 | 160667986 | + |
| SEQ ID NO 41368 | TGTGAGGGAGCACCGTTCTCTA | TTG | chr6 | 160667972 | 160667993 | 160667989 | 160667994 | + |
| SEQ ID NO 41369 | TCTAGAATCTGCTATTTGAGCA | TTC | chr6 | 160667990 | 160668011 | 160668007 | 160668012 | + |
| SEQ ID NO 41370 | TAGAATCTGCTATTTGAGCAAG | CTC | chr6 | 160667992 | 160668013 | 160668009 | 160668014 | + |
| SEQ ID NO 41371 | GAATCTGCTATTTGAGCAAGGC | CTA | chr6 | 160667994 | 160668015 | 160668011 | 160668016 | + |
| SEQ ID NO 41372 | CTATTTGAGCAAGGCAAACATC | CTG | chr6 | 160668001 | 160668022 | 160668018 | 160668023 | + |
| SEQ ID NO 41373 | TTTGAGCAAGGCAAACATCCTG | CTA | chr6 | 160668004 | 160668025 | 160668021 | 160668026 | + |
| SEQ ID NO 41374 | GAGCAAGGCAAACATCCTGATA | TTT | chr6 | 160668007 | 160668028 | 160668024 | 160668029 | + |
| SEQ ID NO 41375 | AGCAAGGCAAACATCCTGATAA | TTG | chr6 | 160668008 | 160668029 | 160668025 | 160668030 | + |
| SEQ ID NO 41376 | ATAATGGTGAAACCTACCGCA | CTG | chr6 | 160668026 | 160668047 | 160668043 | 160668048 | + |
| SEQ ID NO 41377 | CCGCAAGTTGCCAGGAAAGTTG | CTA | chr6 | 160668043 | 160668064 | 160668060 | 160668065 | + |
| SEQ ID NO 41378 | CCAGGAAAGTTGATGTGGTCTG | TTG | chr6 | 160668053 | 160668074 | 160668070 | 160668075 | + |
| SEQ ID NO 41379 | ATGTGGTCTGCGAGTAGGTGCT | TTG | chr6 | 160668065 | 160668086 | 160668082 | 160668087 | + |
| SEQ ID NO 41380 | CGAGTAGGTGCTGCCATCCAGT | CTG | chr6 | 160668075 | 160668096 | 160668092 | 160668097 | + |
| SEQ ID NO 41381 | CCATCCAGTGGCCGACATAGAG | CTG | chr6 | 160668088 | 160668109 | 160668105 | 160668110 | + |
| SEQ ID NO 41382 | TGAGGGCAGGTAGGCCACAGGT | CTC | chr6 | 160668120 | 160668141 | 160668137 | 160668142 | + |
| SEQ ID NO 41383 | AGGGCAGGTAGGCCACAGGTGA | CTG | chr6 | 160668122 | 160668143 | 160668139 | 160668144 | + |
| SEQ ID NO 41384 | AAGCCCTCCCTGATGGGCCTT | TTG | chr6 | 160668155 | 160668176 | 160668172 | 160668177 | + |

Figure 60 (Cont'd)

| | | | | | | | | |
|---|---|---|---|---|---|---|---|---|
| SEQ ID NO 41385 | CCTGATGGGGCCTTGGGGAGAG | CTC | chr6 | 160668163 | 160668184 | 160668180 | 160668185 | + |
| SEQ ID NO 41386 | ATGGGGCCTTGGGGAGAGGGCA | CTG | chr6 | 160668167 | 160668188 | 160668184 | 160668189 | + |
| SEQ ID NO 41387 | GGGGAGAGGGCAGCAGGGTAAG | CTT | chr6 | 160668177 | 160668198 | 160668194 | 160668199 | + |
| SEQ ID NO 41388 | GGGAGAGGGCAGCAGGGTAAGT | TTG | chr6 | 160668178 | 160668199 | 160668195 | 160668200 | + |
| SEQ ID NO 41389 | ATTGTGGATGACGACTGACCTG | TTG | chr6 | 160668223 | 160668244 | 160668240 | 160668245 | + |
| SEQ ID NO 41390 | TGGATGACGACTGACCTGGAAA | TTG | chr6 | 160668227 | 160668248 | 160668244 | 160668249 | + |
| SEQ ID NO 41391 | ACCTGGAAAATCCCCTTGGCCT | CTG | chr6 | 160668240 | 160668261 | 160668257 | 160668262 | + |
| SEQ ID NO 41392 | GAAAATCCCCTTGGCCTCAACA | CTG | chr6 | 160668245 | 160668266 | 160668262 | 160668267 | + |
| SEQ ID NO 41393 | GGCCTCAACACCTCCAAACTCT | CTT | chr6 | 160668257 | 160668278 | 160668274 | 160668279 | + |
| SEQ ID NO 41394 | GCCTCAACACCTCCAAACTCTG | TTG | chr6 | 160668258 | 160668279 | 160668275 | 160668280 | + |
| SEQ ID NO 41395 | AACACCTCCAAACTCTGCATTT | CTC | chr6 | 160668263 | 160668284 | 160668280 | 160668285 | + |
| SEQ ID NO 41396 | CAAACTCTGCATTTGATCCAAG | CTC | chr6 | 160668271 | 160668292 | 160668288 | 160668293 | + |
| SEQ ID NO 41397 | TGCATTTGATCCAAGTCAGGGA | CTC | chr6 | 160668278 | 160668299 | 160668295 | 160668300 | + |
| SEQ ID NO 41398 | CATTTGATCCAAGTCAGGGAAC | CTG | chr6 | 160668280 | 160668301 | 160668297 | 160668302 | + |
| SEQ ID NO 41399 | GATCCAAGTCAGGGAACACCTG | TTT | chr6 | 160668285 | 160668306 | 160668302 | 160668307 | + |
| SEQ ID NO 41400 | ATCCAAGTCAGGGAACACCTGG | TTG | chr6 | 160668286 | 160668307 | 160668303 | 160668308 | + |
| SEQ ID NO 41401 | GAAACATGAAGGGGAGAGCAGG | CTG | chr6 | 160668307 | 160668328 | 160668324 | 160668329 | + |
| SEQ ID NO 41402 | TGACCTCCCTCTCAGAGGCTGA | CTT | chr6 | 160668336 | 160668357 | 160668353 | 160668358 | + |
| SEQ ID NO 41403 | GACCTCCCTCTCAGAGGCTGAG | TTT | chr6 | 160668337 | 160668358 | 160668354 | 160668359 | + |
| SEQ ID NO 41404 | ACCTCCCTCTCAGAGGCTGAGA | TTG | chr6 | 160668338 | 160668359 | 160668355 | 160668360 | + |
| SEQ ID NO 41405 | CCTCTCAGAGGCTGAGAACGCC | CTC | chr6 | 160668343 | 160668364 | 160668360 | 160668365 | + |
| SEQ ID NO 41406 | TCAGAGGCTGAGAACGCCAATT | CTC | chr6 | 160668347 | 160668368 | 160668364 | 160668369 | + |
| SEQ ID NO 41407 | AGAGGCTGAGAACGCCAATTGA | CTC | chr6 | 160668349 | 160668370 | 160668366 | 160668371 | + |
| SEQ ID NO 41408 | AGAACGCCAATTGACCTGATGT | CTG | chr6 | 160668357 | 160668378 | 160668374 | 160668379 | + |
| SEQ ID NO 41409 | ACCTGATGTCATTATTGACATG | TTG | chr6 | 160668370 | 160668391 | 160668387 | 160668392 | + |
| SEQ ID NO 41410 | ATGTCATTATTGACATGTAGAA | CTG | chr6 | 160668375 | 160668396 | 160668392 | 160668397 | + |
| SEQ ID NO 41411 | TTGACATGTAGAAAATTGATGA | TTA | chr6 | 160668384 | 160668405 | 160668401 | 160668406 | + |
| SEQ ID NO 41412 | ACATGTAGAAAATTGATGAACA | TTG | chr6 | 160668387 | 160668408 | 160668404 | 160668409 | + |
| SEQ ID NO 41413 | ATGAACAGGCCTGAGTTATGTT | TTG | chr6 | 160668402 | 160668423 | 160668419 | 160668424 | + |
| SEQ ID NO 41414 | AGTTATGTTTTGTGGCACCTCA | CTG | chr6 | 160668415 | 160668436 | 160668432 | 160668437 | + |
| SEQ ID NO 41415 | TGTTTTGTGGCACCTCATGGTC | TTA | chr6 | 160668420 | 160668441 | 160668437 | 160668442 | + |
| SEQ ID NO 41416 | TGTGGCACCTCATGGTCTAGTT | TTT | chr6 | 160668425 | 160668446 | 160668442 | 160668447 | + |
| SEQ ID NO 41417 | GTGGCACCTCATGGTCTAGTTA | TTT | chr6 | 160668426 | 160668447 | 160668443 | 160668448 | + |
| SEQ ID NO 41418 | TGGCACCTCATGGTCTAGTTAG | TTG | chr6 | 160668427 | 160668448 | 160668444 | 160668449 | + |
| SEQ ID NO 41419 | ATGGTCTAGTTAGTGTTCTGAG | CTC | chr6 | 160668436 | 160668457 | 160668453 | 160668458 | + |
| SEQ ID NO 41420 | GTTAGTGTTCTGAGAATCATTT | CTA | chr6 | 160668444 | 160668465 | 160668461 | 160668466 | + |
| SEQ ID NO 41421 | GTGTTCTGAGAATCATTTTCTC | TTA | chr6 | 160668448 | 160668469 | 160668465 | 160668470 | + |
| SEQ ID NO 41422 | TGAGAATCATTTTCTCAGTGGA | TTC | chr6 | 160668454 | 160668475 | 160668471 | 160668476 | + |
| SEQ ID NO 41423 | AGAATCATTTTCTCAGTGGACC | CTG | chr6 | 160668456 | 160668477 | 160668473 | 160668478 | + |
| SEQ ID NO 41424 | TCTCAGTGGACCTGCAGGTGAG | TTT | chr6 | 160668466 | 160668487 | 160668483 | 160668488 | + |
| SEQ ID NO 41425 | CTCAGTGGACCTGCAGGTGAGA | TTT | chr6 | 160668467 | 160668488 | 160668484 | 160668489 | + |
| SEQ ID NO 41426 | TCAGTGGACCTGCAGGTGAGAC | TTC | chr6 | 160668468 | 160668489 | 160668485 | 160668490 | + |
| SEQ ID NO 41427 | AGTGGACCTGCAGGTGAGACCA | CTC | chr6 | 160668470 | 160668491 | 160668487 | 160668492 | + |
| SEQ ID NO 41428 | CAGGTGAGACCAGGCGAGGCAG | CTG | chr6 | 160668480 | 160668501 | 160668497 | 160668502 | + |
| SEQ ID NO 41429 | GTGGGGATGGTGGTTAGAAAT | CTA | chr6 | 160668509 | 160668530 | 160668526 | 160668531 | + |
| SEQ ID NO 41430 | GAAATGTGTGGATGGTTGTGGG | TTA | chr6 | 160668526 | 160668547 | 160668543 | 160668548 | + |
| SEQ ID NO 41431 | TGGGGCAGAAGAAACAGCAAGT | TTG | chr6 | 160668544 | 160668565 | 160668561 | 160668566 | + |
| SEQ ID NO 41432 | TGGGCCAGCTACAAACTGGTTA | CTC | chr6 | 160668572 | 160668593 | 160668589 | 160668594 | + |
| SEQ ID NO 41433 | GGCCAGCTACAAACTGGTTATA | CTG | chr6 | 160668574 | 160668595 | 160668591 | 160668596 | + |
| SEQ ID NO 41434 | CAAACTGGTTATATGATGTCTA | CTA | chr6 | 160668583 | 160668604 | 160668600 | 160668605 | + |
| SEQ ID NO 41435 | GTTATATGATGTCTACTGATGA | CTG | chr6 | 160668590 | 160668611 | 160668607 | 160668612 | + |
| SEQ ID NO 41436 | TATGATGTCTACTGATGATGAT | TTA | chr6 | 160668594 | 160668615 | 160668611 | 160668616 | + |
| SEQ ID NO 41437 | CTGATGATGATAGTGATGGTGG | CTA | chr6 | 160668605 | 160668626 | 160668622 | 160668627 | + |
| SEQ ID NO 41438 | ATGATGATAGTGATGGTGGTGG | CTG | chr6 | 160668608 | 160668629 | 160668625 | 160668630 | + |
| SEQ ID NO 41439 | TGATGGTGGTGGAATGATGATG | TTG | chr6 | 160668660 | 160668681 | 160668677 | 160668682 | + |
| SEQ ID NO 41440 | GTGATGGTGGTAGTGGTCGTGG | TTG | chr6 | 160668713 | 160668734 | 160668730 | 160668735 | + |
| SEQ ID NO 41441 | ATGGTGGTGGTAATGATAATGA | CTA | chr6 | 160668779 | 160668800 | 160668796 | 160668801 | + |
| SEQ ID NO 41442 | TCATGATGATAGCGGTGGTGAT | TTA | chr6 | 160668804 | 160668825 | 160668821 | 160668826 | + |

Figure 60 (Cont'd)

| SEQ ID NO 41443 | AGGGTGATGATAATAGTGACAG | TTG | chr6 | 160668922 | 160668943 | 160668939 | 160668944 | + |
| SEQ ID NO 41444 | AGTAGTAATGATGGTGATGGTG | CTG | chr6 | 160669013 | 160669034 | 160669030 | 160669035 | + |
| SEQ ID NO 41445 | TGGTGATGATGGTGGTGGTAGT | CTG | chr6 | 160669045 | 160669066 | 160669062 | 160669067 | + |
| SEQ ID NO 41446 | AGGGTGATGATAATAGTGATAG | TTG | chr6 | 160669119 | 160669140 | 160669136 | 160669141 | + |
| SEQ ID NO 41447 | TCACTATTATCATCACCCTCAA | CTA | chr6 | 160669116 | 160669137 | 160669121 | 160669116 | - |
| SEQ ID NO 41448 | TTATCATCACCCTCAACATCAT | CTA | chr6 | 160669110 | 160669131 | 160669115 | 160669110 | - |
| SEQ ID NO 41449 | TCATCACCCTCAACATCATCAC | TTA | chr6 | 160669107 | 160669128 | 160669112 | 160669107 | - |
| SEQ ID NO 41450 | AACATCATCACCATCATCACTA | CTC | chr6 | 160669096 | 160669117 | 160669101 | 160669096 | - |
| SEQ ID NO 41451 | TCATCACCACCACCATCATCGT | CTA | chr6 | 160669074 | 160669095 | 160669079 | 160669074 | - |
| SEQ ID NO 41452 | CTACCACTACCACCACCATCAT | TTA | chr6 | 160669050 | 160669071 | 160669055 | 160669050 | - |
| SEQ ID NO 41453 | CCACTACCACCACCATCATCAC | CTA | chr6 | 160669047 | 160669068 | 160669052 | 160669047 | - |
| SEQ ID NO 41454 | CCACCACCATCATCACCACAGC | CTA | chr6 | 160669041 | 160669062 | 160669046 | 160669041 | - |
| SEQ ID NO 41455 | CTACTCAGCACCACCATCATCA | TTA | chr6 | 160668996 | 160669017 | 160669001 | 160668996 | - |
| SEQ ID NO 41456 | CTCAGCACCACCATCATCATTC | CTA | chr6 | 160668993 | 160669014 | 160668998 | 160668993 | - |
| SEQ ID NO 41457 | AGCACCACCATCATCATTCCAC | CTC | chr6 | 160668990 | 160669011 | 160668995 | 160668990 | - |
| SEQ ID NO 41458 | CACCACCATCACCATCATTCCA | TTC | chr6 | 160668971 | 160668992 | 160668976 | 160668971 | - |
| SEQ ID NO 41459 | CACCATCACCATTATCATTACC | TTC | chr6 | 160668951 | 160668972 | 160668956 | 160668951 | - |
| SEQ ID NO 41460 | TCATTACCACCACCACTGTCAC | TTA | chr6 | 160668937 | 160668958 | 160668942 | 160668937 | - |
| SEQ ID NO 41461 | CCACCACCACTGTCACTATTAT | TTA | chr6 | 160668931 | 160668952 | 160668936 | 160668931 | - |
| SEQ ID NO 41462 | TCACTATTATCATCACCCTCAA | CTG | chr6 | 160668919 | 160668940 | 160668924 | 160668919 | - |
| SEQ ID NO 41463 | TTATCATCACCCTCAACATCAT | CTA | chr6 | 160668913 | 160668934 | 160668918 | 160668913 | - |
| SEQ ID NO 41464 | TCATCACCCTCAACATCATCAC | TTA | chr6 | 160668910 | 160668931 | 160668915 | 160668910 | - |
| SEQ ID NO 41465 | AACATCATCACCACCACCATCA | CTC | chr6 | 160668899 | 160668920 | 160668904 | 160668899 | - |
| SEQ ID NO 41466 | CTACCACCACCACCACCATCAC | TTA | chr6 | 160668871 | 160668892 | 160668876 | 160668871 | - |
| SEQ ID NO 41467 | CCACCACCACCACCATCACCAT | CTA | chr6 | 160668868 | 160668889 | 160668873 | 160668868 | - |
| SEQ ID NO 41468 | TACCACCATCACCATTATCATC | TTC | chr6 | 160668835 | 160668856 | 160668840 | 160668835 | - |
| SEQ ID NO 41469 | CCACCATCACCATTATCATCAC | CTA | chr6 | 160668833 | 160668854 | 160668838 | 160668833 | - |
| SEQ ID NO 41470 | TCATCACCATCACCATCACCAC | TTA | chr6 | 160668818 | 160668839 | 160668823 | 160668818 | - |
| SEQ ID NO 41471 | TCATCATGATAATCATTATCAT | CTA | chr6 | 160668791 | 160668812 | 160668796 | 160668791 | - |
| SEQ ID NO 41472 | TCATTACCACCACCATTAGCAT | TTA | chr6 | 160668773 | 160668794 | 160668778 | 160668773 | - |
| SEQ ID NO 41473 | CCACCACCATTAGCATTATCAT | TTA | chr6 | 160668767 | 160668788 | 160668772 | 160668767 | - |
| SEQ ID NO 41474 | GCATTATCATTACCACCACCAT | TTA | chr6 | 160668755 | 160668776 | 160668760 | 160668755 | - |
| SEQ ID NO 41475 | TCATTACCACCACCATCACTAT | TTA | chr6 | 160668749 | 160668770 | 160668754 | 160668749 | - |
| SEQ ID NO 41476 | CCACCACCATCACTATCACTAT | TTA | chr6 | 160668743 | 160668764 | 160668748 | 160668743 | - |
| SEQ ID NO 41477 | TCACTATCACCATCACCACGAC | CTA | chr6 | 160668728 | 160668749 | 160668733 | 160668728 | - |
| SEQ ID NO 41478 | TCACCATCACCACGACCACTAC | CTA | chr6 | 160668722 | 160668743 | 160668727 | 160668722 | - |
| SEQ ID NO 41479 | CCACCATCACCAACACCATCAT | CTA | chr6 | 160668701 | 160668722 | 160668706 | 160668701 | - |
| SEQ ID NO 41480 | CTACCCACCACCACCATCATCA | TTA | chr6 | 160668677 | 160668698 | 160668682 | 160668677 | - |
| SEQ ID NO 41481 | CCCACCACCACCATCATCATCA | CTA | chr6 | 160668674 | 160668695 | 160668679 | 160668674 | - |
| SEQ ID NO 41482 | CACCACCATCACAATTATTACC | TTC | chr6 | 160668649 | 160668670 | 160668654 | 160668649 | - |
| SEQ ID NO 41483 | TTACCACCACCACCATCACCAC | TTA | chr6 | 160668632 | 160668653 | 160668637 | 160668632 | - |
| SEQ ID NO 41484 | CCACCACCACCATCACCACCAC | TTA | chr6 | 160668629 | 160668650 | 160668634 | 160668629 | - |
| SEQ ID NO 41485 | TCATCATCAGTAGACATCATAT | CTA | chr6 | 160668593 | 160668614 | 160668598 | 160668593 | - |
| SEQ ID NO 41486 | GTAGCTGGCCCAGAGCCTACTT | TTT | chr6 | 160668562 | 160668583 | 160668567 | 160668562 | - |
| SEQ ID NO 41487 | TAGCTGGCCCAGAGCCTACTTG | TTG | chr6 | 160668561 | 160668582 | 160668566 | 160668561 | - |
| SEQ ID NO 41488 | GCCCAGAGCCTACTTGCTGTTT | CTG | chr6 | 160668555 | 160668576 | 160668560 | 160668555 | - |
| SEQ ID NO 41489 | CTTGCTGTTTCTTCTGCCCCAC | CTA | chr6 | 160668543 | 160668564 | 160668548 | 160668543 | - |
| SEQ ID NO 41490 | GCTGTTTCTTCTGCCCCACAAC | CTT | chr6 | 160668540 | 160668561 | 160668545 | 160668540 | - |
| SEQ ID NO 41491 | CTGTTTCTTCTGCCCCACAACC | TTG | chr6 | 160668539 | 160668560 | 160668544 | 160668539 | - |
| SEQ ID NO 41492 | TTTCTTCTGCCCCACAACCATC | CTG | chr6 | 160668536 | 160668557 | 160668541 | 160668536 | - |
| SEQ ID NO 41493 | CTTCTGCCCCACAACCATCCAC | TTT | chr6 | 160668533 | 160668554 | 160668538 | 160668533 | - |
| SEQ ID NO 41494 | TTCTGCCCCACAACCATCCACA | TTC | chr6 | 160668532 | 160668553 | 160668537 | 160668532 | - |
| SEQ ID NO 41495 | CTGCCCCACAACCATCCACACA | CTT | chr6 | 160668530 | 160668551 | 160668535 | 160668530 | - |
| SEQ ID NO 41496 | TGCCCCACAACCATCCACACAT | TTC | chr6 | 160668529 | 160668550 | 160668534 | 160668529 | - |
| SEQ ID NO 41497 | CCCCACAACCATCCACACATTT | CTG | chr6 | 160668527 | 160668548 | 160668532 | 160668527 | - |
| SEQ ID NO 41498 | CTAACCACCATCCCCCACTAGG | TTT | chr6 | 160668505 | 160668526 | 160668510 | 160668505 | - |
| SEQ ID NO 41499 | TAACCACCATCCCCCACTAGGC | TTC | chr6 | 160668504 | 160668525 | 160668509 | 160668504 | - |
| SEQ ID NO 41500 | ACCACCATCCCCCACTAGGCTT | CTA | chr6 | 160668502 | 160668523 | 160668507 | 160668502 | - |

Figure 60 (Cont'd)

| | | | | | | | |
|---|---|---|---|---|---|---|---|
| SEQ ID NO 41501 | GGCTTCTGCCTCGCCTGGTCTCT | CTA | chr6 | 160668485 | 160668506 | 160668490 | 160668485 | - |
| SEQ ID NO 41502 | CTGCCTCGCCTGGTCTCACCTG | CTT | chr6 | 160668480 | 160668501 | 160668485 | 160668480 | - |
| SEQ ID NO 41503 | TGCCTCGCCTGGTCTCACCTGC | TTC | chr6 | 160668479 | 160668500 | 160668484 | 160668479 | - |
| SEQ ID NO 41504 | CCTCGCCTGGTCTCACCTGCAG | CTG | chr6 | 160668477 | 160668498 | 160668482 | 160668477 | - |
| SEQ ID NO 41505 | GCCTGGTCTCACCTGCAGGTCC | CTC | chr6 | 160668473 | 160668494 | 160668478 | 160668473 | - |
| SEQ ID NO 41506 | GTCTCACCTGCAGGTCCACTGA | CTG | chr6 | 160668468 | 160668489 | 160668473 | 160668468 | - |
| SEQ ID NO 41507 | ACCTGCAGGTCCACTGAGAAAA | CTC | chr6 | 160668463 | 160668484 | 160668468 | 160668463 | - |
| SEQ ID NO 41508 | CAGGTCCACTGAGAAAATGATT | CTG | chr6 | 160668458 | 160668479 | 160668463 | 160668458 | - |
| SEQ ID NO 41509 | AGAAAATGATTCTCAGAACACT | CTG | chr6 | 160668447 | 160668468 | 160668452 | 160668447 | - |
| SEQ ID NO 41510 | TCAGAACACTAACTAGACCATG | TTC | chr6 | 160668435 | 160668456 | 160668440 | 160668435 | - |
| SEQ ID NO 41511 | AGAACACTAACTAGACCATGAG | CTC | chr6 | 160668433 | 160668454 | 160668438 | 160668433 | - |
| SEQ ID NO 41512 | ACTAGACCATGAGGTGCCACAA | CTA | chr6 | 160668424 | 160668445 | 160668429 | 160668424 | - |
| SEQ ID NO 41513 | GACCATGAGGTGCCACAAAACA | CTA | chr6 | 160668420 | 160668441 | 160668425 | 160668420 | - |
| SEQ ID NO 41514 | AGGCCTGTTCATCAATTTTCTA | CTC | chr6 | 160668392 | 160668413 | 160668397 | 160668392 | - |
| SEQ ID NO 41515 | TTCATCAATTTTCTACATGTCA | CTG | chr6 | 160668385 | 160668406 | 160668390 | 160668385 | - |
| SEQ ID NO 41516 | ATCAATTTTCTACATGTCAATA | TTC | chr6 | 160668382 | 160668403 | 160668387 | 160668382 | - |
| SEQ ID NO 41517 | TCTACATGTCAATAATGACATC | TTT | chr6 | 160668374 | 160668395 | 160668379 | 160668374 | - |
| SEQ ID NO 41518 | CTACATGTCAATAATGACATCA | TTT | chr6 | 160668373 | 160668394 | 160668378 | 160668373 | - |
| SEQ ID NO 41519 | TACATGTCAATAATGACATCAG | TTC | chr6 | 160668372 | 160668393 | 160668377 | 160668372 | - |
| SEQ ID NO 41520 | CATGTCAATAATGACATCAGGT | CTA | chr6 | 160668370 | 160668391 | 160668375 | 160668370 | - |
| SEQ ID NO 41521 | GCGTTCTCAGCCTCTGAGAGGG | TTG | chr6 | 160668342 | 160668363 | 160668347 | 160668342 | - |
| SEQ ID NO 41522 | TCAGCCTCTGAGAGGGAGGTCA | TTC | chr6 | 160668336 | 160668357 | 160668341 | 160668336 | - |
| SEQ ID NO 41523 | AGCCTCTGAGAGGGAGGTCAAA | CTC | chr6 | 160668334 | 160668355 | 160668339 | 160668334 | - |
| SEQ ID NO 41524 | TGAGAGGGAGGTCAAAGTTTTC | CTC | chr6 | 160668328 | 160668349 | 160668333 | 160668328 | - |
| SEQ ID NO 41525 | AGAGGGAGGTCAAAGTTTTCCT | CTG | chr6 | 160668326 | 160668347 | 160668331 | 160668326 | - |
| SEQ ID NO 41526 | TCCTGCTCTCCCCTTCATGTTT | TTT | chr6 | 160668308 | 160668329 | 160668313 | 160668308 | - |
| SEQ ID NO 41527 | CCTGCTCTCCCCTTCATGTTTC | TTT | chr6 | 160668307 | 160668328 | 160668312 | 160668307 | - |
| SEQ ID NO 41528 | CTGCTCTCCCCTTCATGTTTCC | TTC | chr6 | 160668306 | 160668327 | 160668311 | 160668306 | - |
| SEQ ID NO 41529 | CTCTCCCCTTCATGTTTCCAGG | CTG | chr6 | 160668303 | 160668324 | 160668308 | 160668303 | - |
| SEQ ID NO 41530 | TCCCCTTCATGTTTCCAGGTGT | CTC | chr6 | 160668300 | 160668321 | 160668305 | 160668300 | - |
| SEQ ID NO 41531 | CCCCTTCATGTTTCCAGGTGTT | CTC | chr6 | 160668298 | 160668319 | 160668303 | 160668298 | - |
| SEQ ID NO 41532 | CATGTTTCCAGGTGTTCCCTGA | CTT | chr6 | 160668293 | 160668314 | 160668298 | 160668293 | - |
| SEQ ID NO 41533 | ATGTTTCCAGGTGTTCCCTGAC | TTC | chr6 | 160668292 | 160668313 | 160668297 | 160668292 | - |
| SEQ ID NO 41534 | CCAGGTGTTCCCTGACTTGGAT | TTT | chr6 | 160668286 | 160668307 | 160668291 | 160668286 | - |
| SEQ ID NO 41535 | CAGGTGTTCCCTGACTTGGATC | TTC | chr6 | 160668285 | 160668306 | 160668290 | 160668285 | - |
| SEQ ID NO 41536 | CCTGACTTGGATCAAATGCAGA | TTC | chr6 | 160668276 | 160668297 | 160668281 | 160668276 | - |
| SEQ ID NO 41537 | ACTTGGATCAAATGCAGAGTTT | CTG | chr6 | 160668272 | 160668293 | 160668277 | 160668272 | - |
| SEQ ID NO 41538 | GGATCAAATGCAGAGTTTGGAG | CTT | chr6 | 160668268 | 160668289 | 160668273 | 160668268 | - |
| SEQ ID NO 41539 | GATCAAATGCAGAGTTTGGAGG | TTG | chr6 | 160668267 | 160668288 | 160668272 | 160668267 | - |
| SEQ ID NO 41540 | GGAGGTGTTGAGGCCAAGGGGA | TTT | chr6 | 160668250 | 160668271 | 160668255 | 160668250 | - |
| SEQ ID NO 41541 | GAGGTGTTGAGGCCAAGGGGAT | TTG | chr6 | 160668249 | 160668270 | 160668254 | 160668249 | - |
| SEQ ID NO 41542 | AGGCCAAGGGGATTTTCCAGGT | TTG | chr6 | 160668240 | 160668261 | 160668245 | 160668240 | - |
| SEQ ID NO 41543 | TCCAGGTCAGTCGTCATCCACA | TTT | chr6 | 160668225 | 160668246 | 160668230 | 160668225 | - |
| SEQ ID NO 41544 | CCAGGTCAGTCGTCATCCACAA | TTT | chr6 | 160668224 | 160668245 | 160668229 | 160668224 | - |
| SEQ ID NO 41545 | CAGGTCAGTCGTCATCCACAAT | TTC | chr6 | 160668223 | 160668244 | 160668228 | 160668223 | - |
| SEQ ID NO 41546 | ATCCTGCCGCTGGACTTACCCT | CTG | chr6 | 160668191 | 160668212 | 160668196 | 160668191 | - |
| SEQ ID NO 41547 | CCGCTGGACTTACCCTGCTGCC | CTG | chr6 | 160668185 | 160668206 | 160668190 | 160668185 | - |
| SEQ ID NO 41548 | GACTTACCCTGCTGCCCTCTCC | CTG | chr6 | 160668179 | 160668200 | 160668184 | 160668179 | - |
| SEQ ID NO 41549 | ACCCTGCTGCCCTCTCCCCAAG | CTT | chr6 | 160668174 | 160668195 | 160668179 | 160668174 | - |
| SEQ ID NO 41550 | CCCTGCTGCCCTCTCCCCAAGG | TTA | chr6 | 160668173 | 160668194 | 160668178 | 160668173 | - |
| SEQ ID NO 41551 | CTGCCCTCTCCCCAAGGCCCCA | CTG | chr6 | 160668168 | 160668189 | 160668173 | 160668168 | - |
| SEQ ID NO 41552 | CCCTCTCCCCAAGGCCCCATCA | CTG | chr6 | 160668165 | 160668186 | 160668170 | 160668165 | - |
| SEQ ID NO 41553 | TCCCCAAGGCCCCATCAGGGAG | CTC | chr6 | 160668160 | 160668181 | 160668165 | 160668160 | - |
| SEQ ID NO 41554 | CCCAAGGCCCCATCAGGGAGGG | CTC | chr6 | 160668158 | 160668179 | 160668163 | 160668158 | - |
| SEQ ID NO 41555 | CAATCCTCTTGTCACCTGTGGC | CTT | chr6 | 160668133 | 160668154 | 160668138 | 160668133 | - |
| SEQ ID NO 41556 | AATCCTCTTGTCACCTGTGGCC | TTC | chr6 | 160668132 | 160668153 | 160668137 | 160668132 | - |
| SEQ ID NO 41557 | TTGTCACCTGTGGCCTACCTGC | CTC | chr6 | 160668125 | 160668146 | 160668130 | 160668125 | - |
| SEQ ID NO 41558 | GTCACCTGTGGCCTACCTGCCC | CTT | chr6 | 160668123 | 160668144 | 160668128 | 160668123 | - |

Figure 60 (Cont'd)

| | | | | | | | | |
|---|---|---|---|---|---|---|---|---|
| SEQ ID NO 41559 | TCACCTGTGGCCTACCTGCCCT | TTG | chr6 | 160668122 | 160668143 | 160668127 | 160668122 | - |
| SEQ ID NO 41560 | TGGCCTACCTGCCCTCAGAGAT | CTG | chr6 | 160668115 | 160668136 | 160668120 | 160668115 | - |
| SEQ ID NO 41561 | CCTGCCCTCAGAGATGACATCT | CTA | chr6 | 160668108 | 160668129 | 160668113 | 160668108 | - |
| SEQ ID NO 41562 | CCCTCAGAGATGACATCTCTAT | CTG | chr6 | 160668104 | 160668125 | 160668109 | 160668104 | - |
| SEQ ID NO 41563 | AGAGATGACATCTCTATGTCGG | CTC | chr6 | 160668099 | 160668120 | 160668104 | 160668099 | - |
| SEQ ID NO 41564 | TATGTCGGCCACTGGATGGCAG | CTC | chr6 | 160668085 | 160668106 | 160668090 | 160668085 | - |
| SEQ ID NO 41565 | TGTCGGCCACTGGATGGCAGCA | CTA | chr6 | 160668083 | 160668104 | 160668088 | 160668083 | - |
| SEQ ID NO 41566 | GATGGCAGCACCTACTCGCAGA | CTG | chr6 | 160668071 | 160668092 | 160668076 | 160668071 | - |
| SEQ ID NO 41567 | CTCGCAGACCACATCAACTTTC | CTA | chr6 | 160668057 | 160668078 | 160668062 | 160668057 | - |
| SEQ ID NO 41568 | GCAGACCACATCAACTTTCCTG | CTC | chr6 | 160668054 | 160668075 | 160668059 | 160668054 | - |
| SEQ ID NO 41569 | TCCTGGCAACTTGCGGTAGGTT | CTT | chr6 | 160668037 | 160668058 | 160668042 | 160668037 | - |
| SEQ ID NO 41570 | CCTGGCAACTTGCGGTAGGTTT | TTT | chr6 | 160668036 | 160668057 | 160668041 | 160668036 | - |
| SEQ ID NO 41571 | CTGGCAACTTGCGGTAGGTTTT | TTC | chr6 | 160668035 | 160668056 | 160668040 | 160668035 | - |
| SEQ ID NO 41572 | GCAACTTGCGGTAGGTTTTCAC | CTG | chr6 | 160668032 | 160668053 | 160668037 | 160668032 | - |
| SEQ ID NO 41573 | GCGGTAGGTTTTCACCATTATC | CTT | chr6 | 160668025 | 160668046 | 160668030 | 160668025 | - |
| SEQ ID NO 41574 | CGGTAGGTTTTCACCATTATCA | TTG | chr6 | 160668024 | 160668045 | 160668029 | 160668024 | - |
| SEQ ID NO 41575 | TCACCATTATCAGGATGTTTGC | TTT | chr6 | 160668014 | 160668035 | 160668019 | 160668014 | - |
| SEQ ID NO 41576 | CACCATTATCAGGATGTTTGCC | TTT | chr6 | 160668013 | 160668034 | 160668018 | 160668013 | - |
| SEQ ID NO 41577 | ACCATTATCAGGATGTTTGCCT | TTC | chr6 | 160668012 | 160668033 | 160668017 | 160668012 | - |
| SEQ ID NO 41578 | TCAGGATGTTTGCCTTGCTCAA | TTA | chr6 | 160668005 | 160668026 | 160668010 | 160668005 | - |
| SEQ ID NO 41579 | GCCTTGCTCAAATAGCAGATTC | TTT | chr6 | 160667994 | 160668015 | 160667999 | 160667994 | - |
| SEQ ID NO 41580 | CCTTGCTCAAATAGCAGATTCT | TTG | chr6 | 160667993 | 160668014 | 160667998 | 160667993 | - |
| SEQ ID NO 41581 | GCTCAAATAGCAGATTCTAGAG | CTT | chr6 | 160667989 | 160668010 | 160667994 | 160667989 | - |
| SEQ ID NO 41582 | CTCAAATAGCAGATTCTAGAGA | TTG | chr6 | 160667988 | 160668009 | 160667993 | 160667988 | - |
| SEQ ID NO 41583 | AAATAGCAGATTCTAGAGAACG | CTC | chr6 | 160667985 | 160668006 | 160667990 | 160667985 | - |
| SEQ ID NO 41584 | TAGAGAACGGTGCTCCCTCACA | TTC | chr6 | 160667972 | 160667993 | 160667977 | 160667972 | - |
| SEQ ID NO 41585 | GAGAACGGTGCTCCCTCACACA | CTA | chr6 | 160667970 | 160667991 | 160667975 | 160667970 | - |
| SEQ ID NO 41586 | CCTCACACAACTATGTAGTCCA | CTC | chr6 | 160667957 | 160667978 | 160667962 | 160667957 | - |
| SEQ ID NO 41587 | ACACAACTATGTAGTCCAGGTG | CTC | chr6 | 160667953 | 160667974 | 160667958 | 160667953 | - |
| SEQ ID NO 41588 | TGTAGTCCAGGTGATGCACCCT | CTA | chr6 | 160667944 | 160667965 | 160667949 | 160667944 | - |
| SEQ ID NO 41589 | TGCCCGATGCTTGGTAGTCAGA | CTC | chr6 | 160667921 | 160667942 | 160667926 | 160667921 | - |
| SEQ ID NO 41590 | CCCGATGCTTGGTAGTCAGAAA | CTG | chr6 | 160667919 | 160667940 | 160667924 | 160667919 | - |
| SEQ ID NO 41591 | GGTAGTCAGAAACTTCCATCAT | CTT | chr6 | 160667909 | 160667930 | 160667914 | 160667909 | - |
| SEQ ID NO 41592 | GTAGTCAGAAACTTCCATCATG | TTG | chr6 | 160667908 | 160667929 | 160667913 | 160667908 | - |
| SEQ ID NO 41593 | CCATCATGCAGCTCTGCCCAGA | CTT | chr6 | 160667894 | 160667915 | 160667899 | 160667894 | - |
| SEQ ID NO 41594 | CATCATGCAGCTCTGCCCAGAT | TTC | chr6 | 160667893 | 160667914 | 160667898 | 160667893 | - |
| SEQ ID NO 41595 | TGCCCAGATTGAGCTGAGCTGG | CTC | chr6 | 160667880 | 160667901 | 160667885 | 160667880 | - |
| SEQ ID NO 41596 | CCCAGATTGAGCTGAGCTGGCC | CTG | chr6 | 160667878 | 160667899 | 160667883 | 160667878 | - |
| SEQ ID NO 41597 | AGCTGAGCTGGCCTCTGGAGTG | TTG | chr6 | 160667869 | 160667890 | 160667874 | 160667869 | - |
| SEQ ID NO 41598 | AGCTGGCCTCTGGAGTGAGGTG | CTG | chr6 | 160667864 | 160667885 | 160667869 | 160667864 | - |
| SEQ ID NO 41599 | GCCTCTGGAGTGAGGTGCTGGG | CTG | chr6 | 160667859 | 160667880 | 160667864 | 160667859 | - |
| SEQ ID NO 41600 | TGGAGTGAGGTGCTGGGACAAA | CTC | chr6 | 160667854 | 160667875 | 160667859 | 160667854 | - |
| SEQ ID NO 41601 | GAGTGAGGTGCTGGGACAAACA | CTG | chr6 | 160667852 | 160667873 | 160667857 | 160667852 | - |
| SEQ ID NO 41602 | GGACAAACATCTTCCATGCTGC | CTG | chr6 | 160667839 | 160667860 | 160667844 | 160667839 | - |
| SEQ ID NO 41603 | CCATGCTGCTCATGTCAACTCC | CTT | chr6 | 160667826 | 160667847 | 160667831 | 160667826 | - |
| SEQ ID NO 41604 | CATGCTGCTCATGTCAACTCCA | TTC | chr6 | 160667825 | 160667846 | 160667830 | 160667825 | - |
| SEQ ID NO 41605 | CTCATGTCAACTCCAGATGCAG | CTG | chr6 | 160667818 | 160667839 | 160667823 | 160667818 | - |
| SEQ ID NO 41606 | ATGTCAACTCCAGATGCAGTCA | CTC | chr6 | 160667815 | 160667836 | 160667820 | 160667815 | - |
| SEQ ID NO 41607 | CAGATGCAGTCAGGTTTCTGAA | CTC | chr6 | 160667805 | 160667826 | 160667810 | 160667805 | - |
| SEQ ID NO 41608 | CTGAACCAAAGTCAATGATCTA | TTT | chr6 | 160667788 | 160667809 | 160667793 | 160667788 | - |
| SEQ ID NO 41609 | TGAACCAAAGTCAATGATCTAA | TTC | chr6 | 160667787 | 160667808 | 160667792 | 160667787 | - |
| SEQ ID NO 41610 | AACCAAAGTCAATGATCTAAGT | CTG | chr6 | 160667785 | 160667806 | 160667790 | 160667785 | - |
| SEQ ID NO 41611 | AGTGCAGTCAAAGGCTCTGGGG | CTA | chr6 | 160667766 | 160667787 | 160667771 | 160667766 | - |
| SEQ ID NO 41612 | TGGGGAAGAAAGAGAGAGTGC | CTC | chr6 | 160667749 | 160667770 | 160667754 | 160667749 | - |
| SEQ ID NO 41613 | GGGGAAGAAAGAGAGAGTGCCT | CTG | chr6 | 160667747 | 160667768 | 160667752 | 160667747 | - |
| SEQ ID NO 41614 | ATCTCTTGCCTGTGCCATGCTC | CTC | chr6 | 160667724 | 160667745 | 160667729 | 160667724 | - |
| SEQ ID NO 41615 | TTGCCTGTGCCATGCTCGCAAA | CTC | chr6 | 160667719 | 160667740 | 160667724 | 160667719 | - |
| SEQ ID NO 41616 | GCCTGTGCCATGCTCGCAAAGC | CTT | chr6 | 160667717 | 160667738 | 160667722 | 160667717 | - |

Figure 60 (Cont'd)

| | | | | | | | | |
|---|---|---|---|---|---|---|---|---|
| SEQ ID NO 41617 | CCTGTGCCATGCTCGCAAAGCA | TTG | chr6 | 160667716 | 160667737 | 160667721 | 160667716 | - |
| SEQ ID NO 41618 | TGCCATGCTCGCAAAGCAAGGA | CTG | chr6 | 160667712 | 160667733 | 160667717 | 160667712 | - |
| SEQ ID NO 41619 | GCAAAGCAAGGATTTTTGCAAA | CTC | chr6 | 160667702 | 160667723 | 160667707 | 160667702 | - |
| SEQ ID NO 41620 | TTGCAAAATTCTAATGAAAGCT | TTT | chr6 | 160667687 | 160667708 | 160667692 | 160667687 | - |
| SEQ ID NO 41621 | TGCAAAATTCTAATGAAAGCTG | TTT | chr6 | 160667686 | 160667707 | 160667691 | 160667686 | - |
| SEQ ID NO 41622 | GCAAAATTCTAATGAAAGCTGG | TTT | chr6 | 160667685 | 160667706 | 160667690 | 160667685 | - |
| SEQ ID NO 41623 | CAAAATTCTAATGAAAGCTGGG | TTG | chr6 | 160667684 | 160667705 | 160667689 | 160667684 | - |
| SEQ ID NO 41624 | TAATGAAAGCTGGGCTTGCAAA | TTC | chr6 | 160667676 | 160667697 | 160667681 | 160667676 | - |
| SEQ ID NO 41625 | ATGAAAGCTGGGCTTGCAAAAT | CTA | chr6 | 160667674 | 160667695 | 160667679 | 160667674 | - |
| SEQ ID NO 41626 | GGCTTGCAAAATTAGAAAACTG | CTG | chr6 | 160667664 | 160667685 | 160667669 | 160667664 | - |
| SEQ ID NO 41627 | GCAAAATTAGAAAACTGGATTA | CTT | chr6 | 160667659 | 160667680 | 160667664 | 160667659 | - |
| SEQ ID NO 41628 | CAAAATTAGAAAACTGGATTAT | TTG | chr6 | 160667658 | 160667679 | 160667663 | 160667658 | - |
| SEQ ID NO 41629 | GAAAACTGGATTATTTGTGAGA | TTA | chr6 | 160667650 | 160667671 | 160667655 | 160667650 | - |
| SEQ ID NO 41630 | GATTATTTGTGAGAACACTGAA | CTG | chr6 | 160667642 | 160667663 | 160667647 | 160667642 | - |
| SEQ ID NO 41631 | TTTGTGAGAACACTGAAACATC | TTA | chr6 | 160667637 | 160667658 | 160667642 | 160667637 | - |
| SEQ ID NO 41632 | GTGAGAACACTGAAACATCCCT | TTT | chr6 | 160667634 | 160667655 | 160667639 | 160667634 | - |
| SEQ ID NO 41633 | TGAGAACACTGAAACATCCCTG | TTG | chr6 | 160667633 | 160667654 | 160667638 | 160667633 | - |
| SEQ ID NO 41634 | AAACATCCCTGGGTGTGTCCAT | CTG | chr6 | 160667622 | 160667643 | 160667627 | 160667622 | - |
| SEQ ID NO 41635 | GGTGTGTCCATCTGGAAAAACA | CTG | chr6 | 160667611 | 160667632 | 160667616 | 160667611 | - |
| SEQ ID NO 41636 | GAAAAACAGCATTTCCTCTGGC | CTG | chr6 | 160667597 | 160667618 | 160667602 | 160667597 | - |
| SEQ ID NO 41637 | CCTCTGGCAATTTTGCAACCGT | TTT | chr6 | 160667583 | 160667604 | 160667588 | 160667583 | - |
| SEQ ID NO 41638 | CTCTGGCAATTTTGCAACCGTT | TTC | chr6 | 160667582 | 160667603 | 160667587 | 160667582 | - |
| SEQ ID NO 41639 | TGGCAATTTTGCAACCGTTCTA | CTC | chr6 | 160667579 | 160667600 | 160667584 | 160667579 | - |
| SEQ ID NO 41640 | GCAATTTTGCAACCGTTCTATT | CTG | chr6 | 160667577 | 160667598 | 160667582 | 160667577 | - |
| SEQ ID NO 41641 | TGCAACCGTTCTATTTGAATTT | TTT | chr6 | 160667570 | 160667591 | 160667575 | 160667570 | - |
| SEQ ID NO 41642 | GCAACCGTTCTATTTGAATTTG | TTT | chr6 | 160667569 | 160667590 | 160667574 | 160667569 | - |
| SEQ ID NO 41643 | CAACCGTTCTATTTGAATTTGG | TTG | chr6 | 160667568 | 160667589 | 160667573 | 160667568 | - |
| SEQ ID NO 41644 | TATTTGAATTTGGCAAAGAAAA | TTC | chr6 | 160667559 | 160667580 | 160667564 | 160667559 | - |
| SEQ ID NO 41645 | TTTGAATTTGGCAAAGAAAATA | CTA | chr6 | 160667557 | 160667578 | 160667562 | 160667557 | - |
| SEQ ID NO 41646 | GAATTTGGCAAAGAAAATAAAG | TTT | chr6 | 160667554 | 160667575 | 160667559 | 160667554 | - |
| SEQ ID NO 41647 | AATTTGGCAAAGAAAATAAAGC | TTG | chr6 | 160667553 | 160667574 | 160667558 | 160667553 | - |
| SEQ ID NO 41648 | GGCAAAGAAAATAAAGCAGTTT | TTT | chr6 | 160667548 | 160667569 | 160667553 | 160667548 | - |
| SEQ ID NO 41649 | GCAAAGAAAATAAAGCAGTTTT | TTG | chr6 | 160667547 | 160667568 | 160667552 | 160667547 | - |
| SEQ ID NO 41650 | TTCACAAAGAATAAACACAAC | TTT | chr6 | 160667526 | 160667547 | 160667531 | 160667526 | - |
| SEQ ID NO 41651 | TCACAAAGAATAAACACAACC | TTT | chr6 | 160667525 | 160667546 | 160667530 | 160667525 | - |
| SEQ ID NO 41652 | CACAAAGAATAAACACAACCA | TTT | chr6 | 160667524 | 160667545 | 160667529 | 160667524 | - |
| SEQ ID NO 41653 | ACAAAGAATAAACACAACCAG | TTC | chr6 | 160667523 | 160667544 | 160667528 | 160667523 | - |
| SEQ ID NO 41654 | CACTCTCCCAAATTGTCAAAGA | CTT | chr6 | 160667492 | 160667513 | 160667497 | 160667492 | - |
| SEQ ID NO 41655 | ACTCTCCCAAATTGTCAAAGAA | TTC | chr6 | 160667491 | 160667512 | 160667496 | 160667491 | - |
| SEQ ID NO 41656 | TCCCAAATTGTCAAAGAAGTAT | CTC | chr6 | 160667487 | 160667508 | 160667492 | 160667487 | - |
| SEQ ID NO 41657 | CCAAATTGTCAAAGAAGTATAA | CTC | chr6 | 160667485 | 160667506 | 160667490 | 160667485 | - |
| SEQ ID NO 41658 | TCAAAGAAGTATAAATTAGAAA | TTG | chr6 | 160667477 | 160667498 | 160667482 | 160667477 | - |
| SEQ ID NO 41659 | GAAATGAATCAGGACAATTTC | TTA | chr6 | 160667459 | 160667480 | 160667464 | 160667459 | - |
| SEQ ID NO 41660 | CAACCTGTTAGATTAGCTAATA | TTT | chr6 | 160667438 | 160667459 | 160667443 | 160667438 | - |
| SEQ ID NO 41661 | AACCTGTTAGATTAGCTAATAT | TTC | chr6 | 160667437 | 160667458 | 160667442 | 160667437 | - |
| SEQ ID NO 41662 | TTAGATTAGCTAATATTTAAAA | CTG | chr6 | 160667431 | 160667452 | 160667436 | 160667431 | - |
| SEQ ID NO 41663 | GATTAGCTAATATTTAAAAATT | TTA | chr6 | 160667428 | 160667449 | 160667433 | 160667428 | - |
| SEQ ID NO 41664 | GCTAATATTTAAAAATTGAACA | TTA | chr6 | 160667423 | 160667444 | 160667428 | 160667423 | - |
| SEQ ID NO 41665 | ATATTTAAAAATTGAACACTCA | CTA | chr6 | 160667419 | 160667440 | 160667424 | 160667419 | - |
| SEQ ID NO 41666 | AAAAATTGAACACTCATACAAG | TTT | chr6 | 160667413 | 160667434 | 160667418 | 160667413 | - |
| SEQ ID NO 41667 | AAAATTGAACACTCATACAAGT | TTA | chr6 | 160667412 | 160667433 | 160667417 | 160667412 | - |
| SEQ ID NO 41668 | AACACTCATACAAGTGTGGTGA | TTG | chr6 | 160667405 | 160667426 | 160667410 | 160667405 | - |
| SEQ ID NO 41669 | ATACAAGTGTGGTGAAGTGATT | CTC | chr6 | 160667398 | 160667419 | 160667403 | 160667398 | - |
| SEQ ID NO 41670 | TTTTCTAGTGACATTTTACACT | TTG | chr6 | 160667375 | 160667396 | 160667380 | 160667375 | - |
| SEQ ID NO 41671 | TCTAGTGACATTTTACACTGTC | TTT | chr6 | 160667372 | 160667393 | 160667377 | 160667372 | - |
| SEQ ID NO 41672 | CTAGTGACATTTTACACTGTCA | TTT | chr6 | 160667371 | 160667392 | 160667376 | 160667371 | - |
| SEQ ID NO 41673 | TAGTGACATTTTACACTGTCAT | TTC | chr6 | 160667370 | 160667391 | 160667375 | 160667370 | - |
| SEQ ID NO 41674 | GTGACATTTTACACTGTCATAA | CTA | chr6 | 160667368 | 160667389 | 160667373 | 160667368 | - |

Figure 60 (Cont'd)

| | | | | | | | | |
|---|---|---|---|---|---|---|---|---|
| SEQ ID NO 41675 | TACACTGTCATAACCTTCTAGA | TTT | chr6 | 160667359 | 160667380 | 160667364 | 160667359 | - |
| SEQ ID NO 41676 | ACACTGTCATAACCTTCTAGAA | TTT | chr6 | 160667358 | 160667379 | 160667363 | 160667358 | - |
| SEQ ID NO 41677 | CACTGTCATAACCTTCTAGAAA | TTA | chr6 | 160667357 | 160667378 | 160667362 | 160667357 | - |
| SEQ ID NO 41678 | TCATAACCTTCTAGAAAATAAA | CTG | chr6 | 160667352 | 160667373 | 160667357 | 160667352 | - |
| SEQ ID NO 41679 | CTAGAAAATAAATTGGCAGTGT | CTT | chr6 | 160667342 | 160667363 | 160667347 | 160667342 | - |
| SEQ ID NO 41680 | TAGAAAATAAATTGGCAGTGTT | TTC | chr6 | 160667341 | 160667362 | 160667346 | 160667341 | - |
| SEQ ID NO 41681 | GAAAATAAATTGGCAGTGTTAT | CTA | chr6 | 160667339 | 160667360 | 160667344 | 160667339 | - |
| SEQ ID NO 41682 | GCAGTGTTATTGGGAGACAGAA | TTG | chr6 | 160667327 | 160667348 | 160667332 | 160667327 | - |
| SEQ ID NO 41683 | TTGGGAGACAGAAATATGTCTA | TTA | chr6 | 160667318 | 160667339 | 160667323 | 160667318 | - |
| SEQ ID NO 41684 | GGAGACAGAAATATGTCTATAT | TTG | chr6 | 160667315 | 160667336 | 160667320 | 160667315 | - |
| SEQ ID NO 41685 | TATAATTTATGGGAACTTAGGC | CTA | chr6 | 160667296 | 160667317 | 160667301 | 160667296 | - |
| SEQ ID NO 41686 | ATGGGAACTTAGGCTCAGAAAA | TTT | chr6 | 160667288 | 160667309 | 160667293 | 160667288 | - |
| SEQ ID NO 41687 | TGGGAACTTAGGCTCAGAAAAT | TTA | chr6 | 160667287 | 160667308 | 160667292 | 160667287 | - |
| SEQ ID NO 41688 | AGGCTCAGAAAATATTAAGGAA | CTT | chr6 | 160667278 | 160667299 | 160667283 | 160667278 | - |
| SEQ ID NO 41689 | GGCTCAGAAAATATTAAGGAAT | TTA | chr6 | 160667277 | 160667298 | 160667282 | 160667277 | - |
| SEQ ID NO 41690 | AGAAAATATTAAGGAATAAGAA | CTC | chr6 | 160667272 | 160667293 | 160667277 | 160667272 | - |
| SEQ ID NO 41691 | AGGAATAAGAATGAACTTTATG | TTA | chr6 | 160667261 | 160667282 | 160667266 | 160667261 | - |
| SEQ ID NO 41692 | TATGAACAAAGATGTGGAGGGT | CTT | chr6 | 160667243 | 160667264 | 160667248 | 160667243 | - |
| SEQ ID NO 41693 | ATGAACAAAGATGTGGAGGGTT | TTT | chr6 | 160667242 | 160667263 | 160667247 | 160667242 | - |
| SEQ ID NO 41694 | TGAACAAAGATGTGGAGGGTTG | TTA | chr6 | 160667241 | 160667262 | 160667246 | 160667241 | - |
| SEQ ID NO 41695 | GAAGCAAGAGGGGGCCAACGC | TTG | chr6 | 160667219 | 160667240 | 160667224 | 160667219 | - |
| SEQ ID NO 41696 | GGGCAGTGACTCCGCAGACCCA | TTT | chr6 | 160667178 | 160667199 | 160667183 | 160667178 | - |
| SEQ ID NO 41697 | GGCAGTGACTCCGCAGACCCAG | TTG | chr6 | 160667177 | 160667198 | 160667182 | 160667177 | - |
| SEQ ID NO 41698 | CGCAGACCCAGGCTCAGGTTGA | CTC | chr6 | 160667166 | 160667187 | 160667171 | 160667166 | - |
| SEQ ID NO 41699 | AGGTTGAACTAGACAACCTCCT | CTC | chr6 | 160667151 | 160667172 | 160667156 | 160667151 | - |
| SEQ ID NO 41700 | AACTAGACAACCTCCTTACACC | TTG | chr6 | 160667145 | 160667166 | 160667150 | 160667145 | - |
| SEQ ID NO 41701 | GACAACCTCCTTACACCTCAGT | CTA | chr6 | 160667140 | 160667161 | 160667145 | 160667140 | - |
| SEQ ID NO 41702 | CTTACACCTCAGTTTCCTTAAC | CTC | chr6 | 160667131 | 160667152 | 160667136 | 160667131 | - |
| SEQ ID NO 41703 | ACACCTCAGTTTCCTTAACTGT | CTT | chr6 | 160667128 | 160667149 | 160667133 | 160667128 | - |
| SEQ ID NO 41704 | CACCTCAGTTTCCTTAACTGTA | TTA | chr6 | 160667127 | 160667148 | 160667132 | 160667127 | - |
| SEQ ID NO 41705 | AGTTTCCTTAACTGTAGAGCAG | CTC | chr6 | 160667121 | 160667142 | 160667126 | 160667121 | - |
| SEQ ID NO 41706 | CCTTAACTGTAGAGCAGGAGTG | TTT | chr6 | 160667116 | 160667137 | 160667121 | 160667116 | - |
| SEQ ID NO 41707 | CTTAACTGTAGAGCAGGAGTGA | TTC | chr6 | 160667115 | 160667136 | 160667120 | 160667115 | - |
| SEQ ID NO 41708 | AACTGTAGAGCAGGAGTGATGG | CTT | chr6 | 160667112 | 160667133 | 160667117 | 160667112 | - |
| SEQ ID NO 41709 | ACTGTAGAGCAGGAGTGATGGA | TTA | chr6 | 160667111 | 160667132 | 160667116 | 160667111 | - |
| SEQ ID NO 41710 | TAGAGCAGGAGTGATGGAACTG | CTG | chr6 | 160667107 | 160667128 | 160667112 | 160667107 | - |
| SEQ ID NO 41711 | CCTGTTTCATAGGACTGTTGTG | CTG | chr6 | 160667085 | 160667106 | 160667090 | 160667085 | - |
| SEQ ID NO 41712 | TTTCATAGGACTGTTGTGAGGA | CTG | chr6 | 160667081 | 160667102 | 160667086 | 160667081 | - |
| SEQ ID NO 41713 | CATAGGACTGTTGTGAGGATGA | TTT | chr6 | 160667078 | 160667099 | 160667083 | 160667078 | - |
| SEQ ID NO 41714 | ATAGGACTGTTGTGAGGATGAA | TTC | chr6 | 160667077 | 160667098 | 160667082 | 160667077 | - |
| SEQ ID NO 41715 | TTGTGAGGATGAAGTGAGATAC | CTG | chr6 | 160667068 | 160667089 | 160667073 | 160667068 | - |
| SEQ ID NO 41716 | TGAGGATGAAGTGAGATACACC | TTG | chr6 | 160667065 | 160667086 | 160667070 | 160667065 | - |
| SEQ ID NO 41717 | TAAGCTTGTGCCTGGAAAGGAT | TTA | chr6 | 160667037 | 160667058 | 160667042 | 160667037 | - |
| SEQ ID NO 41718 | GTGCCTGGAAAGGATAATGCTT | CTT | chr6 | 160667030 | 160667051 | 160667035 | 160667030 | - |
| SEQ ID NO 41719 | TGCCTGGAAAGGATAATGCTTA | TTG | chr6 | 160667029 | 160667050 | 160667034 | 160667029 | - |
| SEQ ID NO 41720 | GAAAGGATAATGCTTAGTAAAT | CTG | chr6 | 160667023 | 160667044 | 160667028 | 160667023 | - |
| SEQ ID NO 41721 | AGTAAATGATGACTATTCTTTT | CTT | chr6 | 160667008 | 160667029 | 160667013 | 160667008 | - |
| SEQ ID NO 41722 | GTAAATGATGACTATTCTTTTT | TTA | chr6 | 160667007 | 160667028 | 160667012 | 160667007 | - |
| SEQ ID NO 41723 | TTCTTTTTTATTGCAATAAAAT | CTA | chr6 | 160666993 | 160667014 | 160666998 | 160666993 | - |
| SEQ ID NO 41724 | TTTTTTATTGCAATAAAATGTA | TTC | chr6 | 160666990 | 160667011 | 160666995 | 160666990 | - |
| SEQ ID NO 41725 | TTTTATTGCAATAAAATGTACA | CTT | chr6 | 160666988 | 160667009 | 160666993 | 160666988 | - |
| SEQ ID NO 41726 | TTTATTGCAATAAAATGTACAC | TTT | chr6 | 160666987 | 160667008 | 160666992 | 160666987 | - |
| SEQ ID NO 41727 | TTATTGCAATAAAATGTACACA | TTT | chr6 | 160666986 | 160667007 | 160666991 | 160666986 | - |
| SEQ ID NO 41728 | TATTGCAATAAAATGTACACAG | TTT | chr6 | 160666985 | 160667006 | 160666990 | 160666985 | - |
| SEQ ID NO 41729 | ATTGCAATAAAATGTACACAGC | TTT | chr6 | 160666984 | 160667005 | 160666989 | 160666984 | - |
| SEQ ID NO 41730 | TTGCAATAAAATGTACACAGCG | TTA | chr6 | 160666983 | 160667004 | 160666988 | 160666983 | - |
| SEQ ID NO 41731 | CAATAAAATGTACACAGCGTAA | TTG | chr6 | 160666980 | 160667001 | 160666985 | 160666980 | - |
| SEQ ID NO 41732 | CTATTTTAACCATTTTTGCAGG | TTA | chr6 | 160666952 | 160666973 | 160666957 | 160666952 | - |

Figure 60 (Cont'd)

| | | | | | | | | |
|---|---|---|---|---|---|---|---|---|
| SEQ ID NO 41733 | TTTTAACCATTTTTGCAGGGTA | CTA | chr6 | 160666949 | 160666970 | 160666954 | 160666949 | - |
| SEQ ID NO 41734 | TAACCATTTTTGCAGGGTACCA | TTT | chr6 | 160666946 | 160666967 | 160666951 | 160666946 | - |
| SEQ ID NO 41735 | AACCATTTTTGCAGGGTACCAC | TTT | chr6 | 160666945 | 160666966 | 160666950 | 160666945 | - |
| SEQ ID NO 41736 | ACCATTTTTGCAGGGTACCACC | TTA | chr6 | 160666944 | 160666965 | 160666949 | 160666944 | - |
| SEQ ID NO 41737 | TTGCAGGGTACCACCAAGTGGC | TTT | chr6 | 160666937 | 160666958 | 160666942 | 160666937 | - |
| SEQ ID NO 41738 | TGCAGGGTACCACCAAGTGGCA | TTT | chr6 | 160666936 | 160666957 | 160666941 | 160666936 | - |
| SEQ ID NO 41739 | GCAGGGTACCACCAAGTGGCAT | TTT | chr6 | 160666935 | 160666956 | 160666940 | 160666935 | - |
| SEQ ID NO 41740 | CAGGGTACCACCAAGTGGCATT | TTG | chr6 | 160666934 | 160666955 | 160666939 | 160666934 | - |
| SEQ ID NO 41741 | AGTACATTCACAGTGGTGTGCA | TTT | chr6 | 160666911 | 160666932 | 160666916 | 160666911 | - |
| SEQ ID NO 41742 | GTACATTCACAGTGGTGTGCAA | TTA | chr6 | 160666910 | 160666931 | 160666915 | 160666910 | - |
| SEQ ID NO 41743 | ACAGTGGTGTGCAACCATCATC | TTC | chr6 | 160666902 | 160666923 | 160666907 | 160666902 | - |
| SEQ ID NO 41744 | CCAGAATATTTTCCTCATCCCC | TTT | chr6 | 160666874 | 160666895 | 160666879 | 160666874 | - |
| SEQ ID NO 41745 | CAGAATATTTTCCTCATCCCCA | TTC | chr6 | 160666873 | 160666894 | 160666878 | 160666873 | - |
| SEQ ID NO 41746 | TCCTCATCCCCAAAGGAAACCT | TTT | chr6 | 160666863 | 160666884 | 160666868 | 160666863 | - |
| SEQ ID NO 41747 | CCTCATCCCCAAAGGAAACCTC | TTT | chr6 | 160666862 | 160666883 | 160666867 | 160666862 | - |
| SEQ ID NO 41748 | CTCATCCCCAAAGGAAACCTCA | TTC | chr6 | 160666861 | 160666882 | 160666866 | 160666861 | - |
| SEQ ID NO 41749 | ATCCCCAAAGGAAACCTCATGC | CTC | chr6 | 160666858 | 160666879 | 160666863 | 160666858 | - |
| SEQ ID NO 41750 | ATGCTCATTAATCAGTAGCTCT | CTC | chr6 | 160666840 | 160666861 | 160666845 | 160666840 | - |
| SEQ ID NO 41751 | ATTAATCAGTAGCTCTCCTTTA | CTC | chr6 | 160666834 | 160666855 | 160666839 | 160666834 | - |
| SEQ ID NO 41752 | ATCAGTAGCTCTCCTTTAAAAT | TTA | chr6 | 160666830 | 160666851 | 160666835 | 160666830 | - |
| SEQ ID NO 41753 | TCCTTTAAAATATTAGTTATGA | CTC | chr6 | 160666819 | 160666840 | 160666824 | 160666819 | - |
| SEQ ID NO 41754 | CTTTAAAATATTAGTTATGAAG | CTC | chr6 | 160666817 | 160666838 | 160666822 | 160666817 | - |
| SEQ ID NO 41755 | TAAAATATTAGTTATGAAGATC | CTT | chr6 | 160666814 | 160666835 | 160666819 | 160666814 | - |
| SEQ ID NO 41756 | AAAATATTAGTTATGAAGATCA | TTT | chr6 | 160666813 | 160666834 | 160666818 | 160666813 | - |
| SEQ ID NO 41757 | AAATATTAGTTATGAAGATCAT | TTA | chr6 | 160666812 | 160666833 | 160666817 | 160666812 | - |
| SEQ ID NO 41758 | GTTATGAAGATCATAGCACTAT | TTA | chr6 | 160666804 | 160666825 | 160666809 | 160666804 | - |
| SEQ ID NO 41759 | TGAAGATCATAGCACTATACAA | TTA | chr6 | 160666800 | 160666821 | 160666805 | 160666800 | - |
| SEQ ID NO 41760 | TACAAAACTCATTATGTAATGT | CTA | chr6 | 160666783 | 160666804 | 160666788 | 160666783 | - |
| SEQ ID NO 41761 | ATTATGTAATGTTGAGTGAAAA | CTC | chr6 | 160666773 | 160666794 | 160666778 | 160666773 | - |
| SEQ ID NO 41762 | TGTAATGTTGAGTGAAAAAATC | TTA | chr6 | 160666769 | 160666790 | 160666774 | 160666769 | - |
| SEQ ID NO 41763 | AGTGAAAAAATCAGGGTGTGAA | TTG | chr6 | 160666759 | 160666780 | 160666764 | 160666759 | - |
| SEQ ID NO 41764 | TGTGATATGATGTAATTAGTGA | TTT | chr6 | 160666733 | 160666754 | 160666738 | 160666733 | - |
| SEQ ID NO 41765 | GTGATATGATGTAATTAGTGAA | TTT | chr6 | 160666732 | 160666753 | 160666737 | 160666732 | - |
| SEQ ID NO 41766 | TGATATGATGTAATTAGTGAAA | TTG | chr6 | 160666731 | 160666752 | 160666736 | 160666731 | - |
| SEQ ID NO 41767 | GTGAAAGAAGCATACAAAAAGT | TTA | chr6 | 160666715 | 160666736 | 160666720 | 160666715 | - |
| SEQ ID NO 41768 | AAAATATAAAAACAATAGCAAT | CTG | chr6 | 160666690 | 160666711 | 160666695 | 160666690 | - |
| SEQ ID NO 41769 | CATTTCTCAGACTCTACATTTA | TTG | chr6 | 160666666 | 160666687 | 160666671 | 160666666 | - |
| SEQ ID NO 41770 | CTCAGACTCTACATTTAAACAT | TTT | chr6 | 160666661 | 160666682 | 160666666 | 160666661 | - |
| SEQ ID NO 41771 | TCAGACTCTACATTTAAACATT | TTC | chr6 | 160666660 | 160666681 | 160666665 | 160666660 | - |
| SEQ ID NO 41772 | AGACTCTACATTTAAACATTAT | CTC | chr6 | 160666658 | 160666679 | 160666663 | 160666658 | - |
| SEQ ID NO 41773 | TACATTTAAACATTATTCTTTA | CTC | chr6 | 160666652 | 160666673 | 160666657 | 160666652 | - |
| SEQ ID NO 41774 | CATTTAAACATTATTCTTTATG | CTA | chr6 | 160666650 | 160666671 | 160666655 | 160666650 | - |
| SEQ ID NO 41775 | AAACATTATTCTTTATGGTTTT | TTT | chr6 | 160666645 | 160666666 | 160666650 | 160666645 | - |
| SEQ ID NO 41776 | AACATTATTCTTTATGGTTTTA | TTA | chr6 | 160666644 | 160666665 | 160666649 | 160666644 | - |
| SEQ ID NO 41777 | TTCTTTATGGTTTTAAAAGCAA | TTA | chr6 | 160666637 | 160666658 | 160666642 | 160666637 | - |
| SEQ ID NO 41778 | TTTATGGTTTTAAAAGCAAAGA | TTC | chr6 | 160666634 | 160666655 | 160666639 | 160666634 | - |
| SEQ ID NO 41779 | TATGGTTTTAAAAGCAAAGAAA | CTT | chr6 | 160666632 | 160666653 | 160666637 | 160666632 | - |
| SEQ ID NO 41780 | ATGGTTTTAAAAGCAAAGAAAA | TTT | chr6 | 160666631 | 160666652 | 160666636 | 160666631 | - |
| SEQ ID NO 41781 | TGGTTTTAAAAGCAAAGAAAAG | TTA | chr6 | 160666630 | 160666651 | 160666635 | 160666630 | - |
| SEQ ID NO 41782 | TAAAAGCAAAGAAAAGGTAAA | TTT | chr6 | 160666624 | 160666645 | 160666629 | 160666624 | - |
| SEQ ID NO 41783 | AAAAGCAAAGAAAAGGTAAAG | TTT | chr6 | 160666623 | 160666644 | 160666628 | 160666623 | - |
| SEQ ID NO 41784 | AAAGCAAAGAAAAGGTAAAGA | TTA | chr6 | 160666622 | 160666643 | 160666627 | 160666622 | - |
| SEQ ID NO 41785 | AGATTGTTAAATCCAGGTTTTT | CTC | chr6 | 160666564 | 160666585 | 160666569 | 160666564 | - |
| SEQ ID NO 41786 | TTAAATCCAGGTTTTTGGAACA | TTG | chr6 | 160666558 | 160666579 | 160666563 | 160666558 | - |
| SEQ ID NO 41787 | AATCCAGGTTTTTGGAACATAG | TTA | chr6 | 160666555 | 160666576 | 160666560 | 160666555 | - |
| SEQ ID NO 41788 | TTGGAACATAGACTCTTATATG | TTT | chr6 | 160666544 | 160666565 | 160666549 | 160666544 | - |
| SEQ ID NO 41789 | TGGAACATAGACTCTTATATGA | TTT | chr6 | 160666543 | 160666564 | 160666548 | 160666543 | - |
| SEQ ID NO 41790 | GGAACATAGACTCTTATATGAC | TTT | chr6 | 160666542 | 160666563 | 160666547 | 160666542 | - |

Figure 60 (Cont'd)

| | | | | | | | | |
|---|---|---|---|---|---|---|---|---|
| SEQ ID NO 41791 | GAACATAGACTCTTATATGACG | TTG | chr6 | 160666541 | 160666562 | 160666546 | 160666541 | - |
| SEQ ID NO 41792 | TTATATGACGTTTACACTCTCC | CTC | chr6 | 160666529 | 160666550 | 160666534 | 160666529 | - |
| SEQ ID NO 41793 | ATATGACGTTTACACTCTCCAG | CTT | chr6 | 160666527 | 160666548 | 160666532 | 160666527 | - |
| SEQ ID NO 41794 | TATGACGTTTACACTCTCCAGG | TTA | chr6 | 160666526 | 160666547 | 160666531 | 160666526 | - |
| SEQ ID NO 41795 | ACACTCTCCAGGGTTCAGAGAG | TTT | chr6 | 160666516 | 160666537 | 160666521 | 160666516 | - |
| SEQ ID NO 41796 | CACTCTCCAGGGTTCAGAGAGT | TTA | chr6 | 160666515 | 160666536 | 160666520 | 160666515 | - |
| SEQ ID NO 41797 | TCCAGGGTTCAGAGAGTCTGGC | CTC | chr6 | 160666510 | 160666531 | 160666515 | 160666510 | - |
| SEQ ID NO 41798 | CAGGGTTCAGAGAGTCTGGCAG | CTC | chr6 | 160666508 | 160666529 | 160666513 | 160666508 | - |
| SEQ ID NO 41799 | AGAGAGTCTGGCAGCATTGGGA | TTC | chr6 | 160666500 | 160666521 | 160666505 | 160666500 | - |
| SEQ ID NO 41800 | GCAGCATTGGGAGCTGCCTTGT | CTG | chr6 | 160666490 | 160666511 | 160666495 | 160666490 | - |
| SEQ ID NO 41801 | GGAGCTGCCTTGTGTTCTACAG | TTG | chr6 | 160666481 | 160666502 | 160666486 | 160666481 | - |
| SEQ ID NO 41802 | CCTTGTGTTCTACAGCCTCACG | CTG | chr6 | 160666474 | 160666495 | 160666479 | 160666474 | - |
| SEQ ID NO 41803 | GTGTTCTACAGCCTCACGGACA | CTT | chr6 | 160666470 | 160666491 | 160666475 | 160666470 | - |
| SEQ ID NO 41804 | TGTTCTACAGCCTCACGGACAG | TTG | chr6 | 160666469 | 160666490 | 160666474 | 160666469 | - |
| SEQ ID NO 41805 | TACAGCCTCACGGACAGACAGG | TTC | chr6 | 160666464 | 160666485 | 160666469 | 160666464 | - |
| SEQ ID NO 41806 | CAGCCTCACGGACAGACAGGAG | CTA | chr6 | 160666462 | 160666483 | 160666467 | 160666462 | - |
| SEQ ID NO 41807 | ACGGACAGACAGGAGGTCCATC | CTC | chr6 | 160666455 | 160666476 | 160666460 | 160666455 | - |
| SEQ ID NO 41808 | CTCTGTTCTTCTGGAGTTTCCT | CTG | chr6 | 160666426 | 160666447 | 160666431 | 160666426 | - |
| SEQ ID NO 41809 | TGTTCTTCTGGAGTTTCCTTGT | CTC | chr6 | 160666423 | 160666444 | 160666428 | 160666423 | - |
| SEQ ID NO 41810 | TTCTTCTGGAGTTTCCTTGTGA | CTG | chr6 | 160666421 | 160666442 | 160666426 | 160666421 | - |
| SEQ ID NO 41811 | TTCTGGAGTTTCCTTGTGAACA | TTC | chr6 | 160666418 | 160666439 | 160666423 | 160666418 | - |
| SEQ ID NO 41812 | CTGGAGTTTCCTTGTGAACATG | CTT | chr6 | 160666416 | 160666437 | 160666421 | 160666416 | - |
| SEQ ID NO 41813 | TGGAGTTTCCTTGTGAACATGT | TTC | chr6 | 160666415 | 160666436 | 160666420 | 160666415 | - |
| SEQ ID NO 41814 | GAGTTTCCTTGTGAACATGTTG | CTG | chr6 | 160666413 | 160666434 | 160666418 | 160666413 | - |
| SEQ ID NO 41815 | CCTTGTGAACATGTTGTGGACG | TTT | chr6 | 160666407 | 160666428 | 160666412 | 160666407 | - |
| SEQ ID NO 41816 | CTTGTGAACATGTTGTGGACGT | TTC | chr6 | 160666406 | 160666427 | 160666411 | 160666406 | - |
| SEQ ID NO 41817 | GTGAACATGTTGTGGACGTAGT | CTT | chr6 | 160666403 | 160666424 | 160666408 | 160666403 | - |
| SEQ ID NO 41818 | TGAACATGTTGTGGACGTAGTT | TTG | chr6 | 160666402 | 160666423 | 160666407 | 160666402 | - |
| SEQ ID NO 41819 | TGGACGTAGTTACCATTTCTTT | TTG | chr6 | 160666391 | 160666412 | 160666396 | 160666391 | - |
| SEQ ID NO 41820 | CCATTTCTTTCATCTTTTTAAA | TTA | chr6 | 160666379 | 160666400 | 160666384 | 160666379 | - |
| SEQ ID NO 41821 | CTTTCATCTTTTTAAACACAGG | TTT | chr6 | 160666373 | 160666394 | 160666378 | 160666373 | - |
| SEQ ID NO 41822 | TTTCATCTTTTTAAACACAGGT | TTC | chr6 | 160666372 | 160666393 | 160666377 | 160666372 | - |
| SEQ ID NO 41823 | TCATCTTTTTAAACACAGGTAC | CTT | chr6 | 160666370 | 160666391 | 160666375 | 160666370 | - |
| SEQ ID NO 41824 | CATCTTTTTAAACACAGGTACC | TTT | chr6 | 160666369 | 160666390 | 160666374 | 160666369 | - |
| SEQ ID NO 41825 | ATCTTTTTAAACACAGGTACCT | TTC | chr6 | 160666368 | 160666389 | 160666373 | 160666368 | - |
| SEQ ID NO 41826 | TTTAAACACAGGTACCTTTGGG | CTT | chr6 | 160666363 | 160666384 | 160666368 | 160666363 | - |
| SEQ ID NO 41827 | TTAAACACAGGTACCTTTGGGG | TTT | chr6 | 160666362 | 160666383 | 160666367 | 160666362 | - |
| SEQ ID NO 41828 | TAAACACAGGTACCTTTGGGGC | TTT | chr6 | 160666361 | 160666382 | 160666366 | 160666361 | - |
| SEQ ID NO 41829 | AAACACAGGTACCTTTGGGGCT | TTT | chr6 | 160666360 | 160666381 | 160666365 | 160666360 | - |
| SEQ ID NO 41830 | AACACAGGTACCTTTGGGGCTG | TTA | chr6 | 160666359 | 160666380 | 160666364 | 160666359 | - |
| SEQ ID NO 41831 | TGGGGCTGGCTTTCTCAAGGAA | CTT | chr6 | 160666345 | 160666366 | 160666350 | 160666345 | - |
| SEQ ID NO 41832 | GGGGCTGGCTTTCTCAAGGAAG | TTT | chr6 | 160666344 | 160666365 | 160666349 | 160666344 | - |
| SEQ ID NO 41833 | GGGCTGGCTTTCTCAAGGAAGC | TTG | chr6 | 160666343 | 160666364 | 160666348 | 160666343 | - |
| SEQ ID NO 41834 | GCTTTCTCAAGGAAGCCCAGCT | CTG | chr6 | 160666337 | 160666358 | 160666342 | 160666337 | - |
| SEQ ID NO 41835 | TCTCAAGGAAGCCCAGCTCCCT | CTT | chr6 | 160666333 | 160666354 | 160666338 | 160666333 | - |
| SEQ ID NO 41836 | CTCAAGGAAGCCCAGCTCCCTG | TTT | chr6 | 160666332 | 160666353 | 160666337 | 160666332 | - |
| SEQ ID NO 41837 | TCAAGGAAGCCCAGCTCCCTGT | TTC | chr6 | 160666331 | 160666352 | 160666336 | 160666331 | - |
| SEQ ID NO 41838 | AAGGAAGCCCAGCTCCCTGTGA | CTC | chr6 | 160666329 | 160666350 | 160666334 | 160666329 | - |
| SEQ ID NO 41839 | CCTGTGATTGAGAATGAAGTGT | CTC | chr6 | 160666314 | 160666335 | 160666319 | 160666314 | - |
| SEQ ID NO 41840 | TGATTGAGAATGAAGTGTGCAA | CTG | chr6 | 160666310 | 160666331 | 160666315 | 160666310 | - |
| SEQ ID NO 41841 | AGAATGAAGTGTGCAATCGCTA | TTG | chr6 | 160666304 | 160666325 | 160666309 | 160666304 | - |
| SEQ ID NO 41842 | TGAGTTTCTGAATGGAAGAGTC | CTA | chr6 | 160666282 | 160666303 | 160666287 | 160666282 | - |
| SEQ ID NO 41843 | CTGAATGGAAGAGTCAAATCCA | TTT | chr6 | 160666275 | 160666296 | 160666280 | 160666275 | - |
| SEQ ID NO 41844 | TGAATGGAAGAGTCAAATCCAC | TTC | chr6 | 160666274 | 160666295 | 160666279 | 160666274 | - |
| SEQ ID NO 41845 | AATGGAAGAGTCAAATCCACTG | CTG | chr6 | 160666272 | 160666293 | 160666277 | 160666272 | - |
| SEQ ID NO 41846 | AGCTCTGTGCTGGGCATTTGGC | CTG | chr6 | 160666250 | 160666271 | 160666255 | 160666250 | - |
| SEQ ID NO 41847 | TGTGCTGGGCATTTGGCTGGAG | CTC | chr6 | 160666245 | 160666266 | 160666250 | 160666245 | - |
| SEQ ID NO 41848 | TGCTGGGCATTTGGCTGGAGGC | CTG | chr6 | 160666243 | 160666264 | 160666248 | 160666243 | - |

Figure 60 (Cont'd)

| | | | | | | | | |
|---|---|---|---|---|---|---|---|---|
| SEQ ID NO 41849 | GGCATTTGGCTGGAGGCATTGA | CTG | chr6 | 160666238 | 160666259 | 160666243 | 160666238 | - |
| SEQ ID NO 41850 | GGCTGGAGGCATTGACAGTTGC | TTT | chr6 | 160666231 | 160666252 | 160666236 | 160666231 | - |
| SEQ ID NO 41851 | GCTGGAGGCATTGACAGTTGCA | TTG | chr6 | 160666230 | 160666251 | 160666235 | 160666230 | - |
| SEQ ID NO 41852 | GAGGCATTGACAGTTGCAAGGT | CTG | chr6 | 160666226 | 160666247 | 160666231 | 160666226 | - |
| SEQ ID NO 41853 | ACAGTTGCAAGGTAAGAAAAGA | TTG | chr6 | 160666217 | 160666238 | 160666222 | 160666217 | - |
| SEQ ID NO 41854 | CAAGGTAAGAAAAGATCAAGAG | TTG | chr6 | 160666210 | 160666231 | 160666215 | 160666210 | - |
| SEQ ID NO 41855 | GTCTTGTGCTCTCCTGTCTCAG | TTA | chr6 | 160666178 | 160666199 | 160666183 | 160666178 | - |
| SEQ ID NO 41856 | GTGCTCTCCTGTCTCAGTCTCA | CTT | chr6 | 160666173 | 160666194 | 160666178 | 160666173 | - |
| SEQ ID NO 41857 | TGCTCTCCTGTCTCAGTCTCAG | TTG | chr6 | 160666172 | 160666193 | 160666177 | 160666172 | - |
| SEQ ID NO 41858 | TCCTGTCTCAGTCTCAGTCCCT | CTC | chr6 | 160666167 | 160666188 | 160666172 | 160666167 | - |
| SEQ ID NO 41859 | CTGTCTCAGTCTCAGTCCCTTA | CTC | chr6 | 160666165 | 160666186 | 160666170 | 160666165 | - |
| SEQ ID NO 41860 | TCTCAGTCTCAGTCCCTTAGAC | CTG | chr6 | 160666162 | 160666183 | 160666167 | 160666162 | - |
| SEQ ID NO 41861 | AGTCTCAGTCCCTTAGACTTGA | CTC | chr6 | 160666158 | 160666179 | 160666163 | 160666158 | - |
| SEQ ID NO 41862 | AGTCCCTTAGACTTGAGTCCCA | CTC | chr6 | 160666152 | 160666173 | 160666157 | 160666152 | - |
| SEQ ID NO 41863 | AGACTTGAGTCCCAAAGTAGCG | CTT | chr6 | 160666144 | 160666165 | 160666149 | 160666144 | - |
| SEQ ID NO 41864 | GACTTGAGTCCCAAAGTAGCGA | TTA | chr6 | 160666143 | 160666164 | 160666148 | 160666143 | - |
| SEQ ID NO 41865 | GAGTCCCAAAGTAGCGAATTCA | CTT | chr6 | 160666138 | 160666159 | 160666143 | 160666138 | - |
| SEQ ID NO 41866 | AGTCCCAAAGTAGCGAATTCAA | TTG | chr6 | 160666137 | 160666158 | 160666142 | 160666137 | - |
| SEQ ID NO 41867 | AAGTAGGATTTAATCAATGGAA | TTC | chr6 | 160666117 | 160666138 | 160666122 | 160666117 | - |
| SEQ ID NO 41868 | AATCAATGGAAGACCCCAGTCT | TTT | chr6 | 160666106 | 160666127 | 160666111 | 160666106 | - |
| SEQ ID NO 41869 | ATCAATGGAAGACCCCAGTCTA | TTA | chr6 | 160666105 | 160666126 | 160666110 | 160666105 | - |
| SEQ ID NO 41870 | AGTGTTGCTCAGAAACTCCCTA | CTA | chr6 | 160666083 | 160666104 | 160666088 | 160666083 | - |
| SEQ ID NO 41871 | CTCAGAAACTCCCTAGATCTGT | TTG | chr6 | 160666076 | 160666097 | 160666081 | 160666076 | - |
| SEQ ID NO 41872 | AGAAACTCCCTAGATCTGTCCC | CTC | chr6 | 160666073 | 160666094 | 160666078 | 160666073 | - |
| SEQ ID NO 41873 | CCTAGATCTGTCCCAAATGTAT | CTC | chr6 | 160666065 | 160666086 | 160666070 | 160666065 | - |
| SEQ ID NO 41874 | GATCTGTCCCAAATGTATATTC | CTA | chr6 | 160666061 | 160666082 | 160666066 | 160666061 | - |
| SEQ ID NO 41875 | TCCCAAATGTATATTCAGATCA | CTG | chr6 | 160666055 | 160666076 | 160666060 | 160666055 | - |
| SEQ ID NO 41876 | AGATCATCCAAGGGGACTTCTT | TTC | chr6 | 160666039 | 160666060 | 160666044 | 160666039 | - |
| SEQ ID NO 41877 | CTTGGGGCTTGAGTTCCAGATC | CTT | chr6 | 160666020 | 160666041 | 160666025 | 160666020 | - |
| SEQ ID NO 41878 | TTGGGGCTTGAGTTCCAGATCA | TTC | chr6 | 160666019 | 160666040 | 160666024 | 160666019 | - |
| SEQ ID NO 41879 | GGGGCTTGAGTTCCAGATCAGC | CTT | chr6 | 160666017 | 160666038 | 160666022 | 160666017 | - |
| SEQ ID NO 41880 | GGGCTTGAGTTCCAGATCAGCA | TTG | chr6 | 160666016 | 160666037 | 160666021 | 160666016 | - |
| SEQ ID NO 41881 | GAGTTCCAGATCAGCAGCAAGG | CTT | chr6 | 160666010 | 160666031 | 160666015 | 160666010 | - |
| SEQ ID NO 41882 | AGTTCCAGATCAGCAGCAAGGG | TTG | chr6 | 160666009 | 160666030 | 160666014 | 160666009 | - |
| SEQ ID NO 41883 | CAGATCAGCAGCAAGGGAGCCA | TTC | chr6 | 160666004 | 160666025 | 160666009 | 160666004 | - |
| SEQ ID NO 41884 | CCTCAGACCACTCACCCTCCTG | CTA | chr6 | 160665967 | 160665988 | 160665972 | 160665967 | - |
| SEQ ID NO 41885 | AGACCACTCACCCTCCTGGGGT | CTC | chr6 | 160665963 | 160665984 | 160665968 | 160665963 | - |
| SEQ ID NO 41886 | ACCCTCCTGGGGTGTCCCGGTG | CTC | chr6 | 160665954 | 160665975 | 160665959 | 160665954 | - |
| SEQ ID NO 41887 | CTGGGGTGTCCCGGTGGCCAGG | CTC | chr6 | 160665948 | 160665969 | 160665953 | 160665948 | - |
| SEQ ID NO 41888 | GGGTGTCCCGGTGGCCAGGGAC | CTG | chr6 | 160665945 | 160665966 | 160665950 | 160665945 | - |
| SEQ ID NO 41889 | AAGTGGTGATTTTTCTGGTAGG | CTA | chr6 | 160665921 | 160665942 | 160665926 | 160665921 | - |
| SEQ ID NO 41890 | TTCTGGTAGGGAAGGAGGTAGA | TTT | chr6 | 160665909 | 160665930 | 160665914 | 160665909 | - |
| SEQ ID NO 41891 | TCTGGTAGGGAAGGAGGTAGAG | TTT | chr6 | 160665908 | 160665929 | 160665913 | 160665908 | - |
| SEQ ID NO 41892 | CTGGTAGGGAAGGAGGTAGAGG | TTT | chr6 | 160665907 | 160665928 | 160665912 | 160665907 | - |
| SEQ ID NO 41893 | TGGTAGGGAAGGAGGTAGAGGG | TTC | chr6 | 160665906 | 160665927 | 160665911 | 160665906 | - |
| SEQ ID NO 41894 | GTAGGGAAGGAGGTAGAGGGTA | CTG | chr6 | 160665904 | 160665925 | 160665909 | 160665904 | - |
| SEQ ID NO 41895 | ACTGCACACAATATCTGAGACT | CTA | chr6 | 160665868 | 160665889 | 160665873 | 160665868 | - |
| SEQ ID NO 41896 | CACACAATATCTGAGACTGGAG | CTG | chr6 | 160665864 | 160665885 | 160665869 | 160665864 | - |
| SEQ ID NO 41897 | AGACTGGAGCTCAGATATTGCT | CTG | chr6 | 160665851 | 160665872 | 160665856 | 160665851 | - |
| SEQ ID NO 41898 | GAGCTCAGATATTGCTGATGAT | CTG | chr6 | 160665845 | 160665866 | 160665850 | 160665845 | - |
| SEQ ID NO 41899 | AGATATTGCTGATGATCAGAGT | CTC | chr6 | 160665839 | 160665860 | 160665844 | 160665839 | - |
| SEQ ID NO 41900 | CTGATGATCAGAGTTGGCGTGT | TTG | chr6 | 160665831 | 160665852 | 160665836 | 160665831 | - |
| SEQ ID NO 41901 | ATGATCAGAGTTGGCGTGTCTC | CTG | chr6 | 160665828 | 160665849 | 160665833 | 160665828 | - |
| SEQ ID NO 41902 | GCGTGTCTCCCCAATTGATTTA | TTG | chr6 | 160665815 | 160665836 | 160665820 | 160665815 | - |
| SEQ ID NO 41903 | CCCAATTGATTTACAACTGGGG | CTC | chr6 | 160665806 | 160665827 | 160665811 | 160665806 | - |
| SEQ ID NO 41904 | ATTTACAACTGGGGCTTGGATA | TTG | chr6 | 160665798 | 160665819 | 160665803 | 160665798 | - |
| SEQ ID NO 41905 | ACAACTGGGGCTTGGATACTGT | TTT | chr6 | 160665794 | 160665815 | 160665799 | 160665794 | - |
| SEQ ID NO 41906 | CAACTGGGGCTTGGATACTGTT | TTA | chr6 | 160665793 | 160665814 | 160665798 | 160665793 | - |

Figure 60 (Cont'd)

| | | | | | | | | |
|---|---|---|---|---|---|---|---|---|
| SEQ ID NO 41907 | GGGCTTGGATACTGTTTTAAAC | CTG | chr6 | 160665787 | 160665808 | 160665792 | 160665787 | - |
| SEQ ID NO 41908 | GGATACTGTTTTAAACGGGAGG | CTT | chr6 | 160665781 | 160665802 | 160665786 | 160665781 | - |
| SEQ ID NO 41909 | GATACTGTTTTAAACGGGAGGA | TTG | chr6 | 160665780 | 160665801 | 160665785 | 160665780 | - |
| SEQ ID NO 41910 | TTTTAAACGGGAGGAGCCTCCT | CTG | chr6 | 160665773 | 160665794 | 160665778 | 160665773 | - |
| SEQ ID NO 41911 | TAAACGGGAGGAGCCTCCTAAC | TTT | chr6 | 160665770 | 160665791 | 160665775 | 160665770 | - |
| SEQ ID NO 41912 | AAACGGGAGGAGCCTCCTAACC | TTT | chr6 | 160665769 | 160665790 | 160665774 | 160665769 | - |
| SEQ ID NO 41913 | AACGGGAGGAGCCTCCTAACCA | TTA | chr6 | 160665768 | 160665789 | 160665773 | 160665768 | - |
| SEQ ID NO 41914 | CTAACCATCTTGACACAACCAC | CTC | chr6 | 160665753 | 160665774 | 160665758 | 160665753 | - |
| SEQ ID NO 41915 | ACCATCTTGACACAACCACTGA | CTA | chr6 | 160665750 | 160665771 | 160665755 | 160665750 | - |
| SEQ ID NO 41916 | GACACAACCACTGACGTGACTA | CTT | chr6 | 160665742 | 160665763 | 160665747 | 160665742 | - |
| SEQ ID NO 41917 | ACACAACCACTGACGTGACTAC | TTG | chr6 | 160665741 | 160665762 | 160665746 | 160665741 | - |
| SEQ ID NO 41918 | ACGTGACTACACTAGAGATAGA | CTG | chr6 | 160665729 | 160665750 | 160665734 | 160665729 | - |
| SEQ ID NO 41919 | CACTAGAGATAGACTCTTTCCA | CTA | chr6 | 160665720 | 160665741 | 160665725 | 160665720 | - |
| SEQ ID NO 41920 | GAGATAGACTCTTTCCACTTAA | CTA | chr6 | 160665715 | 160665736 | 160665720 | 160665715 | - |
| SEQ ID NO 41921 | TTTCCACTTAATTCTACCACTC | CTC | chr6 | 160665704 | 160665725 | 160665709 | 160665704 | - |
| SEQ ID NO 41922 | TCCACTTAATTCTACCACTCTT | CTT | chr6 | 160665702 | 160665723 | 160665707 | 160665702 | - |
| SEQ ID NO 41923 | CCACTTAATTCTACCACTCTTG | TTT | chr6 | 160665701 | 160665722 | 160665706 | 160665701 | - |
| SEQ ID NO 41924 | CACTTAATTCTACCACTCTTGC | TTC | chr6 | 160665700 | 160665721 | 160665705 | 160665700 | - |
| SEQ ID NO 41925 | AATTCTACCACTCTTGCTTTAC | CTT | chr6 | 160665695 | 160665716 | 160665700 | 160665695 | - |
| SEQ ID NO 41926 | ATTCTACCACTCTTGCTTTACT | TTA | chr6 | 160665694 | 160665715 | 160665699 | 160665694 | - |
| SEQ ID NO 41927 | TACCACTCTTGCTTTACTTCAT | TTC | chr6 | 160665690 | 160665711 | 160665695 | 160665690 | - |
| SEQ ID NO 41928 | CCACTCTTGCTTTACTTCATGA | CTA | chr6 | 160665688 | 160665709 | 160665693 | 160665688 | - |
| SEQ ID NO 41929 | TTGCTTTACTTCATGAGAACGA | CTC | chr6 | 160665682 | 160665703 | 160665687 | 160665682 | - |
| SEQ ID NO 41930 | GCTTTACTTCATGAGAACGAAA | CTT | chr6 | 160665680 | 160665701 | 160665685 | 160665680 | - |
| SEQ ID NO 41931 | CTTTACTTCATGAGAACGAAAA | TTG | chr6 | 160665679 | 160665700 | 160665684 | 160665679 | - |
| SEQ ID NO 41932 | TACTTCATGAGAACGAAAATGT | CTT | chr6 | 160665676 | 160665697 | 160665681 | 160665676 | - |
| SEQ ID NO 41933 | ACTTCATGAGAACGAAAATGTA | TTT | chr6 | 160665675 | 160665696 | 160665680 | 160665675 | - |
| SEQ ID NO 41934 | CTTCATGAGAACGAAAATGTAA | TTA | chr6 | 160665674 | 160665695 | 160665679 | 160665674 | - |
| SEQ ID NO 41935 | CATGAGAACGAAAATGTAAGAT | CTT | chr6 | 160665671 | 160665692 | 160665676 | 160665671 | - |
| SEQ ID NO 41936 | ATGAGAACGAAAATGTAAGATT | TTC | chr6 | 160665670 | 160665691 | 160665675 | 160665670 | - |
| SEQ ID NO 41937 | CACCATGAATTCATTTGCGGAA | TTG | chr6 | 160665647 | 160665668 | 160665652 | 160665647 | - |
| SEQ ID NO 41938 | ATTTGCGGAAAGATTGATACTA | TTC | chr6 | 160665635 | 160665656 | 160665640 | 160665635 | - |
| SEQ ID NO 41939 | GCGGAAAGATTGATACTATGCT | TTT | chr6 | 160665631 | 160665652 | 160665636 | 160665631 | - |
| SEQ ID NO 41940 | CGGAAAGATTGATACTATGCTT | TTG | chr6 | 160665630 | 160665651 | 160665635 | 160665630 | - |
| SEQ ID NO 41941 | ATACTATGCTTTTATTTTATTT | TTG | chr6 | 160665619 | 160665640 | 160665624 | 160665619 | - |
| SEQ ID NO 41942 | TGCTTTTATTTTATTTTATTTT | CTA | chr6 | 160665613 | 160665634 | 160665618 | 160665613 | - |
| SEQ ID NO 41943 | TTATTTTATTTTATTTTATTTT | CTT | chr6 | 160665608 | 160665629 | 160665613 | 160665608 | - |
| SEQ ID NO 41944 | TATTTTATTTTATTTTATTTTA | TTT | chr6 | 160665607 | 160665628 | 160665612 | 160665607 | - |
| SEQ ID NO 41945 | ATTTTATTTTATTTTATTTTAT | TTT | chr6 | 160665606 | 160665627 | 160665611 | 160665606 | - |
| SEQ ID NO 41946 | TTTTATTTTATTTTATTTTATT | TTA | chr6 | 160665605 | 160665626 | 160665610 | 160665605 | - |
| SEQ ID NO 41947 | TATTTTATTTTATTTTATTTTA | TTT | chr6 | 160665602 | 160665623 | 160665607 | 160665602 | - |
| SEQ ID NO 41948 | ATTTTATTTTATTTTATTTTAT | TTT | chr6 | 160665601 | 160665622 | 160665606 | 160665601 | - |
| SEQ ID NO 41949 | TTTTATTTTATTTTATTTTATT | TTA | chr6 | 160665600 | 160665621 | 160665605 | 160665600 | - |
| SEQ ID NO 41950 | TATTTTATTTTATTTTATTTTA | TTT | chr6 | 160665597 | 160665618 | 160665602 | 160665597 | - |
| SEQ ID NO 41951 | ATTTTATTTTATTTTATTTTAT | TTT | chr6 | 160665596 | 160665617 | 160665601 | 160665596 | - |
| SEQ ID NO 41952 | TTTTATTTTATTTTATTTTATT | TTA | chr6 | 160665595 | 160665616 | 160665600 | 160665595 | - |
| SEQ ID NO 41953 | TATTTTATTTTATTTTATTTTA | TTT | chr6 | 160665592 | 160665613 | 160665597 | 160665592 | - |
| SEQ ID NO 41954 | ATTTTATTTTATTTTATTTTAT | TTT | chr6 | 160665591 | 160665612 | 160665596 | 160665591 | - |
| SEQ ID NO 41955 | TTTTATTTTATTTTATTTTATT | TTA | chr6 | 160665590 | 160665611 | 160665595 | 160665590 | - |
| SEQ ID NO 41956 | TATTTTATTTTATTTTATTTTA | TTT | chr6 | 160665587 | 160665608 | 160665592 | 160665587 | - |
| SEQ ID NO 41957 | ATTTTATTTTATTTTATTTTAT | TTT | chr6 | 160665586 | 160665607 | 160665591 | 160665586 | - |
| SEQ ID NO 41958 | TTTTATTTTATTTTATTTTATT | TTA | chr6 | 160665585 | 160665606 | 160665590 | 160665585 | - |
| SEQ ID NO 41959 | TATTTTATTTTATTTTATTGAG | TTT | chr6 | 160665582 | 160665603 | 160665587 | 160665582 | - |
| SEQ ID NO 41960 | ATTTTATTTTATTTTATTGAGA | TTT | chr6 | 160665581 | 160665602 | 160665586 | 160665581 | - |
| SEQ ID NO 41961 | TTTTATTTTATTTTATTGAGAC | TTA | chr6 | 160665580 | 160665601 | 160665585 | 160665580 | - |
| SEQ ID NO 41962 | TATTTTATTTTATTGAGACTCT | TTT | chr6 | 160665577 | 160665598 | 160665582 | 160665577 | - |
| SEQ ID NO 41963 | ATTTTATTTTATTGAGACTCTC | TTT | chr6 | 160665576 | 160665597 | 160665581 | 160665576 | - |
| SEQ ID NO 41964 | TTTTATTTTATTGAGACTCTCA | TTA | chr6 | 160665575 | 160665596 | 160665580 | 160665575 | - |

Figure 60 (Cont'd)

| SEQ ID NO 41965 | TATTTTATTGAGACTCTCACCC | TTT | chr6 | 160665572 | 160665593 | 160665577 | 160665572 | - |
|---|---|---|---|---|---|---|---|---|
| SEQ ID NO 41966 | ATTTTATTGAGACTCTCACCCC | TTT | chr6 | 160665571 | 160665592 | 160665576 | 160665571 | - |
| SEQ ID NO 41967 | TTTTATTGAGACTCTCACCCCG | TTA | chr6 | 160665570 | 160665591 | 160665575 | 160665570 | - |
| SEQ ID NO 41968 | TATTGAGACTCTCACCCCGGTT | TTT | chr6 | 160665567 | 160665588 | 160665572 | 160665567 | - |
| SEQ ID NO 41969 | ATTGAGACTCTCACCCCGGTTG | TTT | chr6 | 160665566 | 160665587 | 160665571 | 160665566 | - |
| SEQ ID NO 41970 | TTGAGACTCTCACCCCGGTTGA | TTA | chr6 | 160665565 | 160665586 | 160665570 | 160665565 | - |
| SEQ ID NO 41971 | AGACTCTCACCCCGGTTGAAGT | TTG | chr6 | 160665562 | 160665583 | 160665567 | 160665562 | - |
| SEQ ID NO 41972 | TCACCCCGGTTGAAGTGCACTG | CTC | chr6 | 160665556 | 160665577 | 160665561 | 160665556 | - |
| SEQ ID NO 41973 | ACCCCGGTTGAAGTGCACTGAC | CTC | chr6 | 160665554 | 160665575 | 160665559 | 160665554 | - |
| SEQ ID NO 41974 | AAGTGCACTGACGTGATTTTGG | TTG | chr6 | 160665544 | 160665565 | 160665549 | 160665544 | - |
| SEQ ID NO 41975 | ACGTGATTTTGGCTCACTGCAA | CTG | chr6 | 160665534 | 160665555 | 160665539 | 160665534 | - |
| SEQ ID NO 41976 | TGGCTCACTGCAACTTCCACCT | TTT | chr6 | 160665525 | 160665546 | 160665530 | 160665525 | - |
| SEQ ID NO 41977 | GGCTCACTGCAACTTCCACCTC | TTT | chr6 | 160665524 | 160665545 | 160665529 | 160665524 | - |
| SEQ ID NO 41978 | GCTCACTGCAACTTCCACCTCC | TTG | chr6 | 160665523 | 160665544 | 160665528 | 160665523 | - |
| SEQ ID NO 41979 | ACTGCAACTTCCACCTCCTGGG | CTC | chr6 | 160665519 | 160665540 | 160665524 | 160665519 | - |
| SEQ ID NO 41980 | CAACTTCCACCTCCTGGGTTCA | CTG | chr6 | 160665515 | 160665536 | 160665520 | 160665515 | - |
| SEQ ID NO 41981 | CCACCTCCTGGGTTCAAGTGAA | CTT | chr6 | 160665509 | 160665530 | 160665514 | 160665509 | - |
| SEQ ID NO 41982 | CACCTCCTGGGTTCAAGTGAAT | TTC | chr6 | 160665508 | 160665529 | 160665513 | 160665508 | - |
| SEQ ID NO 41983 | CTGGGTTCAAGTGAATACTCCA | CTC | chr6 | 160665502 | 160665523 | 160665507 | 160665502 | - |
| SEQ ID NO 41984 | GGTTCAAGTGAATACTCCAGCC | CTG | chr6 | 160665499 | 160665520 | 160665504 | 160665499 | - |
| SEQ ID NO 41985 | AAGTGAATACTCCAGCCTCCCT | TTC | chr6 | 160665494 | 160665515 | 160665499 | 160665494 | - |
| SEQ ID NO 41986 | CAGCCTCCCTAGTAGCTGGGAT | CTC | chr6 | 160665482 | 160665503 | 160665487 | 160665482 | - |
| SEQ ID NO 41987 | CCTAGTAGCTGGGATTACAGGT | CTC | chr6 | 160665475 | 160665496 | 160665480 | 160665475 | - |
| SEQ ID NO 41988 | GTAGCTGGGATTACAGGTGCCC | CTA | chr6 | 160665471 | 160665492 | 160665476 | 160665471 | - |
| SEQ ID NO 41989 | GGATTACAGGTGCCCACCACCA | CTG | chr6 | 160665464 | 160665485 | 160665469 | 160665464 | - |
| SEQ ID NO 41990 | CAGGTGCCCACCACCACGCCTG | TTA | chr6 | 160665458 | 160665479 | 160665463 | 160665458 | - |
| SEQ ID NO 41991 | GCTAATTTTTGTATTTTTAGTA | CTG | chr6 | 160665436 | 160665457 | 160665441 | 160665436 | - |
| SEQ ID NO 41992 | ATTTTTGTATTTTTAGTAGAGA | CTA | chr6 | 160665432 | 160665453 | 160665437 | 160665432 | - |
| SEQ ID NO 41993 | TTGTATTTTTAGTAGAGATGGG | TTT | chr6 | 160665428 | 160665449 | 160665433 | 160665428 | - |
| SEQ ID NO 41994 | TGTATTTTTAGTAGAGATGGGG | TTT | chr6 | 160665427 | 160665448 | 160665432 | 160665427 | - |
| SEQ ID NO 41995 | GTATTTTTAGTAGAGATGGGGT | TTT | chr6 | 160665426 | 160665447 | 160665431 | 160665426 | - |
| SEQ ID NO 41996 | TATTTTTAGTAGAGATGGGGTT | TTG | chr6 | 160665425 | 160665446 | 160665430 | 160665425 | - |
| SEQ ID NO 41997 | TTAGTAGAGATGGGGTTTCACC | TTT | chr6 | 160665420 | 160665441 | 160665425 | 160665420 | - |
| SEQ ID NO 41998 | TAGTAGAGATGGGGTTTCACCA | TTT | chr6 | 160665419 | 160665440 | 160665424 | 160665419 | - |
| SEQ ID NO 41999 | AGTAGAGATGGGGTTTCACCAC | TTT | chr6 | 160665418 | 160665439 | 160665423 | 160665418 | - |
| SEQ ID NO 42000 | GTAGAGATGGGGTTTCACCACA | TTA | chr6 | 160665417 | 160665438 | 160665422 | 160665417 | - |
| SEQ ID NO 42001 | CACCACATTGGCCTGGCTGGTC | TTT | chr6 | 160665402 | 160665423 | 160665407 | 160665402 | - |
| SEQ ID NO 42002 | ACCACATTGGCCTGGCTGGTCT | TTC | chr6 | 160665401 | 160665422 | 160665406 | 160665401 | - |
| SEQ ID NO 42003 | GCCTGGCTGGTCTCAAACTCCT | TTG | chr6 | 160665392 | 160665413 | 160665397 | 160665392 | - |
| SEQ ID NO 42004 | GCTGGTCTCAAACTCCTGACCT | CTG | chr6 | 160665387 | 160665408 | 160665392 | 160665387 | - |
| SEQ ID NO 42005 | GTCTCAAACTCCTGACCTTGTG | CTG | chr6 | 160665383 | 160665404 | 160665388 | 160665383 | - |
| SEQ ID NO 42006 | AAACTCCTGACCTTGTGATCCA | CTC | chr6 | 160665378 | 160665399 | 160665383 | 160665378 | - |
| SEQ ID NO 42007 | CTGACCTTGTGATCCACCTGTC | CTC | chr6 | 160665372 | 160665393 | 160665377 | 160665372 | - |
| SEQ ID NO 42008 | ACCTTGTGATCCACCTGTCTTG | CTG | chr6 | 160665369 | 160665390 | 160665374 | 160665369 | - |
| SEQ ID NO 42009 | GTGATCCACCTGTCTTGGCCTC | CTT | chr6 | 160665364 | 160665385 | 160665369 | 160665364 | - |
| SEQ ID NO 42010 | TGATCCACCTGTCTTGGCCTCC | TTG | chr6 | 160665363 | 160665384 | 160665368 | 160665363 | - |
| SEQ ID NO 42011 | TCTTGGCCTCCCAAAGTGCTGG | CTG | chr6 | 160665352 | 160665373 | 160665357 | 160665352 | - |
| SEQ ID NO 42012 | GGCCTCCCAAAGTGCTGGGATT | CTT | chr6 | 160665348 | 160665369 | 160665353 | 160665348 | - |
| SEQ ID NO 42013 | GCCTCCCAAAGTGCTGGGATTA | TTG | chr6 | 160665347 | 160665368 | 160665352 | 160665347 | - |
| SEQ ID NO 42014 | CCAAAGTGCTGGGATTACAGAG | CTC | chr6 | 160665342 | 160665363 | 160665347 | 160665342 | - |
| SEQ ID NO 42015 | GGATTACAGAGTTGAGCCACCG | CTG | chr6 | 160665331 | 160665352 | 160665336 | 160665331 | - |
| SEQ ID NO 42016 | CAGAGTTGAGCCACCGCACTCG | TTA | chr6 | 160665325 | 160665346 | 160665330 | 160665325 | - |
| SEQ ID NO 42017 | AGCCACCGCACTCGACCCTATG | TTG | chr6 | 160665317 | 160665338 | 160665322 | 160665317 | - |
| SEQ ID NO 42018 | GACCCTATGTTTTATTTTTAAA | CTC | chr6 | 160665304 | 160665325 | 160665309 | 160665304 | - |
| SEQ ID NO 42019 | TGTTTTATTTTTAAAAATATTT | CTA | chr6 | 160665297 | 160665318 | 160665302 | 160665297 | - |
| SEQ ID NO 42020 | TATTTTTAAAAATATTTATTTA | TTT | chr6 | 160665292 | 160665313 | 160665297 | 160665292 | - |
| SEQ ID NO 42021 | ATTTTTAAAAATATTTATTTAT | TTT | chr6 | 160665291 | 160665312 | 160665296 | 160665291 | - |
| SEQ ID NO 42022 | TTTTTAAAAATATTTATTTATT | TTA | chr6 | 160665290 | 160665311 | 160665295 | 160665290 | - |

Figure 60 (Cont'd)

| SEQ ID NO 42023 | TTAAAAATATTTATTTATTTAT | TTT | chr6 | 160665287 | 160665308 | 160665292 | 160665287 | - |
|---|---|---|---|---|---|---|---|---|
| SEQ ID NO 42024 | TAAAAATATTTATTTATTTATT | TTT | chr6 | 160665286 | 160665307 | 160665291 | 160665286 | - |
| SEQ ID NO 42025 | AAAAATATTTATTTATTTATTT | TTT | chr6 | 160665285 | 160665306 | 160665290 | 160665285 | - |
| SEQ ID NO 42026 | AAAATATTTATTTATTTATTTA | TTA | chr6 | 160665284 | 160665305 | 160665289 | 160665284 | - |
| SEQ ID NO 42027 | ATTTATTTATTTAAGCCACAAC | TTT | chr6 | 160665275 | 160665296 | 160665280 | 160665275 | - |
| SEQ ID NO 42028 | TTTATTTATTTAAGCCACAACT | TTA | chr6 | 160665274 | 160665295 | 160665279 | 160665274 | - |
| SEQ ID NO 42029 | ATTTATTTAAGCCACAACTACT | TTT | chr6 | 160665271 | 160665292 | 160665276 | 160665271 | - |
| SEQ ID NO 42030 | TTTATTTAAGCCACAACTACTA | TTA | chr6 | 160665270 | 160665291 | 160665275 | 160665270 | - |
| SEQ ID NO 42031 | ATTTAAGCCACAACTACTAGAA | TTT | chr6 | 160665267 | 160665288 | 160665272 | 160665267 | - |
| SEQ ID NO 42032 | TTTAAGCCACAACTACTAGAAT | TTA | chr6 | 160665266 | 160665287 | 160665271 | 160665266 | - |
| SEQ ID NO 42033 | AAGCCACAACTACTAGAATAGG | TTT | chr6 | 160665263 | 160665284 | 160665268 | 160665263 | - |
| SEQ ID NO 42034 | AGCCACAACTACTAGAATAGGA | TTA | chr6 | 160665262 | 160665283 | 160665267 | 160665262 | - |
| SEQ ID NO 42035 | CTAGAATAGGAAGGATTGATAT | CTA | chr6 | 160665251 | 160665272 | 160665256 | 160665251 | - |
| SEQ ID NO 42036 | GAATAGGAAGGATTGATATTTT | CTA | chr6 | 160665248 | 160665269 | 160665253 | 160665248 | - |
| SEQ ID NO 42037 | ATATTTTATTAATTTTATTTGG | TTG | chr6 | 160665233 | 160665254 | 160665238 | 160665233 | - |
| SEQ ID NO 42038 | TATTAATTTTATTTGGTATTTA | TTT | chr6 | 160665227 | 160665248 | 160665232 | 160665227 | - |
| SEQ ID NO 42039 | ATTAATTTTATTTGGTATTTAT | TTT | chr6 | 160665226 | 160665247 | 160665231 | 160665226 | - |
| SEQ ID NO 42040 | TTAATTTTATTTGGTATTTATT | TTA | chr6 | 160665225 | 160665246 | 160665230 | 160665225 | - |
| SEQ ID NO 42041 | ATTTTATTTGGTATTTATTATT | TTA | chr6 | 160665222 | 160665243 | 160665227 | 160665222 | - |
| SEQ ID NO 42042 | TATTTGGTATTTATTATTTTTT | TTT | chr6 | 160665218 | 160665239 | 160665223 | 160665218 | - |
| SEQ ID NO 42043 | ATTTGGTATTTATTATTTTTTT | TTT | chr6 | 160665217 | 160665238 | 160665222 | 160665217 | - |
| SEQ ID NO 42044 | TTTGGTATTTATTATTTTTTTT | TTA | chr6 | 160665216 | 160665237 | 160665221 | 160665216 | - |
| SEQ ID NO 42045 | GGTATTTATTATTTTTTTTTCT | TTT | chr6 | 160665213 | 160665234 | 160665218 | 160665213 | - |
| SEQ ID NO 42046 | GTATTTATTATTTTTTTTCTT | TTG | chr6 | 160665212 | 160665233 | 160665217 | 160665212 | - |
| SEQ ID NO 42047 | ATTATTTTTTTTCTTCCTGA | TTT | chr6 | 160665206 | 160665227 | 160665211 | 160665206 | - |
| SEQ ID NO 42048 | TTATTTTTTTTTCTTCCTGAG | TTA | chr6 | 160665205 | 160665226 | 160665210 | 160665205 | - |
| SEQ ID NO 42049 | TTTTTTTTTCTTCCTGAGACA | TTA | chr6 | 160665202 | 160665223 | 160665207 | 160665202 | - |
| SEQ ID NO 42050 | TTTTTTCTTCCTGAGACATTC | TTT | chr6 | 160665199 | 160665220 | 160665204 | 160665199 | - |
| SEQ ID NO 42051 | TTTTTCTTCCTGAGACATTCT | TTT | chr6 | 160665198 | 160665219 | 160665203 | 160665198 | - |
| SEQ ID NO 42052 | TTTTCTTCCTGAGACATTCTT | TTT | chr6 | 160665197 | 160665218 | 160665202 | 160665197 | - |
| SEQ ID NO 42053 | TTTCTTCCTGAGACATTCTTG | TTT | chr6 | 160665196 | 160665217 | 160665201 | 160665196 | - |
| SEQ ID NO 42054 | TTCTTTCCTGAGACATTCTTGC | TTT | chr6 | 160665195 | 160665216 | 160665200 | 160665195 | - |
| SEQ ID NO 42055 | TCTTTCCTGAGACATTCTTGCT | TTT | chr6 | 160665194 | 160665215 | 160665199 | 160665194 | - |
| SEQ ID NO 42056 | CTTTCCTGAGACATTCTTGCTC | TTT | chr6 | 160665193 | 160665214 | 160665198 | 160665193 | - |
| SEQ ID NO 42057 | TTTCCTGAGACATTCTTGCTCT | TTC | chr6 | 160665192 | 160665213 | 160665197 | 160665192 | - |
| SEQ ID NO 42058 | TCCTGAGACATTCTTGCTCTGT | CTT | chr6 | 160665190 | 160665211 | 160665195 | 160665190 | - |
| SEQ ID NO 42059 | CCTGAGACATTCTTGCTCTGTC | TTT | chr6 | 160665189 | 160665210 | 160665194 | 160665189 | - |
| SEQ ID NO 42060 | CTGAGACATTCTTGCTCTGTCA | TTC | chr6 | 160665188 | 160665209 | 160665193 | 160665188 | - |
| SEQ ID NO 42061 | AGACATTCTTGCTCTGTCACCC | CTG | chr6 | 160665185 | 160665206 | 160665190 | 160665185 | - |
| SEQ ID NO 42062 | TTGCTCTGTCACCCAGGCTGGA | TTC | chr6 | 160665177 | 160665198 | 160665182 | 160665177 | - |
| SEQ ID NO 42063 | GCTCTGTCACCCAGGCTGGAGT | CTT | chr6 | 160665175 | 160665196 | 160665180 | 160665175 | - |
| SEQ ID NO 42064 | CTCTGTCACCCAGGCTGGAGTG | TTG | chr6 | 160665174 | 160665195 | 160665179 | 160665174 | - |
| SEQ ID NO 42065 | TGTCACCCAGGCTGGAGTGCAG | CTC | chr6 | 160665171 | 160665192 | 160665176 | 160665171 | - |
| SEQ ID NO 42066 | TCACCCAGGCTGGAGTGCAGTG | CTG | chr6 | 160665169 | 160665190 | 160665174 | 160665169 | - |
| SEQ ID NO 42067 | GAGTGCAGTGGCACATTCTTGG | CTG | chr6 | 160665157 | 160665178 | 160665162 | 160665157 | - |
| SEQ ID NO 42068 | TTGGCTCACTGCAACCTCCATC | TTC | chr6 | 160665139 | 160665160 | 160665144 | 160665139 | - |
| SEQ ID NO 42069 | GGCTCACTGCAACCTCCATCTC | CTT | chr6 | 160665137 | 160665158 | 160665142 | 160665137 | - |
| SEQ ID NO 42070 | GCTCACTGCAACCTCCATCTCC | TTG | chr6 | 160665136 | 160665157 | 160665141 | 160665136 | - |
| SEQ ID NO 42071 | ACTGCAACCTCCATCTCCTGTG | CTC | chr6 | 160665132 | 160665153 | 160665137 | 160665132 | - |
| SEQ ID NO 42072 | CAACCTCCATCTCCTGTGTTCA | CTG | chr6 | 160665128 | 160665149 | 160665133 | 160665128 | - |
| SEQ ID NO 42073 | CATCTCCTGTGTTCAAGCAATT | CTC | chr6 | 160665121 | 160665142 | 160665126 | 160665121 | - |
| SEQ ID NO 42074 | CTGTGTTCAAGCAATTCTAGTG | CTC | chr6 | 160665115 | 160665136 | 160665120 | 160665115 | - |
| SEQ ID NO 42075 | TGTTCAAGCAATTCTAGTGCCT | CTG | chr6 | 160665112 | 160665133 | 160665117 | 160665112 | - |
| SEQ ID NO 42076 | AAGCAATTCTAGTGCCTCAGCC | TTC | chr6 | 160665107 | 160665128 | 160665112 | 160665107 | - |
| SEQ ID NO 42077 | TAGTGCCTCAGCCTACTTAGTA | TTC | chr6 | 160665098 | 160665119 | 160665103 | 160665098 | - |
| SEQ ID NO 42078 | GTGCCTCAGCCTACTTAGTAGC | CTA | chr6 | 160665096 | 160665117 | 160665101 | 160665096 | - |
| SEQ ID NO 42079 | AGCCTACTTAGTAGCTGGGATG | CTC | chr6 | 160665089 | 160665110 | 160665094 | 160665089 | - |
| SEQ ID NO 42080 | CTTAGTAGCTGGGATGACTGGC | CTA | chr6 | 160665083 | 160665104 | 160665088 | 160665083 | - |

Figure 60 (Cont'd)

| | | | | | | | | |
|---|---|---|---|---|---|---|---|---|
| SEQ ID NO 42081 | AGTAGCTGGGATGACTGGCATG | CTT | chr6 | 160665080 | 160665101 | 160665085 | 160665080 | - |
| SEQ ID NO 42082 | GTAGCTGGGATGACTGGCATGT | TTA | chr6 | 160665079 | 160665100 | 160665084 | 160665079 | - |
| SEQ ID NO 42083 | GGATGACTGGCATGTGCCTCCA | CTG | chr6 | 160665072 | 160665093 | 160665077 | 160665072 | - |
| SEQ ID NO 42084 | GCATGTGCCTCCACACCCAGCT | CTG | chr6 | 160665063 | 160665084 | 160665068 | 160665063 | - |
| SEQ ID NO 42085 | CACACCCAGCTAATTTTTGTAT | CTC | chr6 | 160665052 | 160665073 | 160665057 | 160665052 | - |
| SEQ ID NO 42086 | ATTTTTGTATTTTTTGTAGAGA | CTA | chr6 | 160665040 | 160665061 | 160665045 | 160665040 | - |
| SEQ ID NO 42087 | TTGTATTTTTTGTAGAGACAGG | TTT | chr6 | 160665036 | 160665057 | 160665041 | 160665036 | - |
| SEQ ID NO 42088 | TGTATTTTTTGTAGAGACAGGG | TTT | chr6 | 160665035 | 160665056 | 160665040 | 160665035 | - |
| SEQ ID NO 42089 | GTATTTTTTGTAGAGACAGGGT | TTT | chr6 | 160665034 | 160665055 | 160665039 | 160665034 | - |
| SEQ ID NO 42090 | TATTTTTTGTAGAGACAGGGTT | TTG | chr6 | 160665033 | 160665054 | 160665038 | 160665033 | - |
| SEQ ID NO 42091 | TTTGTAGAGACAGGGTTTTGGC | TTT | chr6 | 160665028 | 160665049 | 160665033 | 160665028 | - |
| SEQ ID NO 42092 | TTGTAGAGACAGGGTTTTGGCA | TTT | chr6 | 160665027 | 160665048 | 160665032 | 160665027 | - |
| SEQ ID NO 42093 | TGTAGAGACAGGGTTTTGGCAT | TTT | chr6 | 160665026 | 160665047 | 160665031 | 160665026 | - |
| SEQ ID NO 42094 | GTAGAGACAGGGTTTTGGCATG | TTT | chr6 | 160665025 | 160665046 | 160665030 | 160665025 | - |
| SEQ ID NO 42095 | TAGAGACAGGGTTTTGGCATGT | TTG | chr6 | 160665024 | 160665045 | 160665029 | 160665024 | - |
| SEQ ID NO 42096 | TGGCATGTTGCCCAGGCTTGTC | TTT | chr6 | 160665010 | 160665031 | 160665015 | 160665010 | - |
| SEQ ID NO 42097 | GGCATGTTGCCCAGGCTTGTCT | TTT | chr6 | 160665009 | 160665030 | 160665014 | 160665009 | - |
| SEQ ID NO 42098 | GCATGTTGCCCAGGCTTGTCTC | TTG | chr6 | 160665008 | 160665029 | 160665013 | 160665008 | - |
| SEQ ID NO 42099 | CCCAGGCTTGTCTCAAACTCCT | TTG | chr6 | 160665000 | 160665021 | 160665005 | 160665000 | - |
| SEQ ID NO 42100 | GTCTCAAACTCCTGGCCTCAGG | CTT | chr6 | 160664991 | 160665012 | 160664996 | 160664991 | - |
| SEQ ID NO 42101 | TCTCAAACTCCTGGCCTCAGGT | TTG | chr6 | 160664990 | 160665011 | 160664995 | 160664990 | - |
| SEQ ID NO 42102 | AAACTCCTGGCCTCAGGTGATC | CTC | chr6 | 160664986 | 160665007 | 160664991 | 160664986 | - |
| SEQ ID NO 42103 | CTGGCCTCAGGTGATCCATCTG | CTC | chr6 | 160664980 | 160665001 | 160664985 | 160664980 | - |
| SEQ ID NO 42104 | GCCTCAGGTGATCCATCTGCCG | CTG | chr6 | 160664977 | 160664998 | 160664982 | 160664977 | - |
| SEQ ID NO 42105 | AGGTGATCCATCTGCCGTGGCC | CTC | chr6 | 160664972 | 160664993 | 160664977 | 160664972 | - |
| SEQ ID NO 42106 | CCGTGGCCTCCCAAAATGCTGG | CTG | chr6 | 160664958 | 160664979 | 160664963 | 160664958 | - |
| SEQ ID NO 42107 | CCAAAATGCTGGGATTATAGGC | CTC | chr6 | 160664948 | 160664969 | 160664953 | 160664948 | - |
| SEQ ID NO 42108 | GGATTATAGGCATGAGCCACCA | CTG | chr6 | 160664937 | 160664958 | 160664942 | 160664937 | - |
| SEQ ID NO 42109 | TAGGCATGAGCCACCACCCCCT | TTA | chr6 | 160664931 | 160664952 | 160664936 | 160664931 | - |
| SEQ ID NO 42110 | CTGGAAGGATTGATATCTTATA | CTC | chr6 | 160664908 | 160664929 | 160664913 | 160664908 | - |
| SEQ ID NO 42111 | GAAGGATTGATATCTTATAACA | CTG | chr6 | 160664905 | 160664926 | 160664910 | 160664905 | - |
| SEQ ID NO 42112 | ATATCTTATAACATAATTTATA | TTG | chr6 | 160664896 | 160664917 | 160664901 | 160664896 | - |
| SEQ ID NO 42113 | ATAACATAATTTATAATTACAG | CTT | chr6 | 160664889 | 160664910 | 160664894 | 160664889 | - |
| SEQ ID NO 42114 | TAACATAATTTATAATTACAGA | TTA | chr6 | 160664888 | 160664909 | 160664893 | 160664888 | - |
| SEQ ID NO 42115 | ATAATTACAGAAAACATGTGAG | TTT | chr6 | 160664877 | 160664898 | 160664882 | 160664877 | - |
| SEQ ID NO 42116 | TAATTACAGAAAACATGTGAGT | TTA | chr6 | 160664876 | 160664897 | 160664881 | 160664876 | - |
| SEQ ID NO 42117 | CAGAAAACATGTGAGTTCACTA | TTA | chr6 | 160664870 | 160664891 | 160664875 | 160664870 | - |
| SEQ ID NO 42118 | ACTAGGAATAAATAAATTTTGA | TTC | chr6 | 160664852 | 160664873 | 160664857 | 160664852 | - |
| SEQ ID NO 42119 | GGAATAAATAAATTTTGAAGAT | CTA | chr6 | 160664848 | 160664869 | 160664853 | 160664848 | - |
| SEQ ID NO 42120 | TGAAGATAATAAAGATTTTCA | TTT | chr6 | 160664833 | 160664854 | 160664838 | 160664833 | - |
| SEQ ID NO 42121 | GAAGATAATAAAGATTTTCAC | TTT | chr6 | 160664832 | 160664853 | 160664837 | 160664832 | - |
| SEQ ID NO 42122 | AAGATAATAAAGATTTTCACT | TTG | chr6 | 160664831 | 160664852 | 160664836 | 160664831 | - |
| SEQ ID NO 42123 | TCACTTATGTTGTCATTTCGGC | TTT | chr6 | 160664814 | 160664835 | 160664819 | 160664814 | - |
| SEQ ID NO 42124 | CACTTATGTTGTCATTTCGGCA | TTT | chr6 | 160664813 | 160664834 | 160664818 | 160664813 | - |
| SEQ ID NO 42125 | ACTTATGTTGTCATTTCGGCAC | TTC | chr6 | 160664812 | 160664833 | 160664817 | 160664812 | - |
| SEQ ID NO 42126 | ATGTTGTCATTTCGGCACAGTT | CTT | chr6 | 160664808 | 160664829 | 160664813 | 160664808 | - |
| SEQ ID NO 42127 | TGTTGTCATTTCGGCACAGTTT | TTA | chr6 | 160664807 | 160664828 | 160664812 | 160664807 | - |
| SEQ ID NO 42128 | TCATTTCGGCACAGTTTGGTAT | TTG | chr6 | 160664802 | 160664823 | 160664807 | 160664802 | - |
| SEQ ID NO 42129 | CGGCACAGTTTGGTATAGGATG | TTT | chr6 | 160664796 | 160664817 | 160664801 | 160664796 | - |
| SEQ ID NO 42130 | GGCACAGTTTGGTATAGGATGT | TTC | chr6 | 160664795 | 160664816 | 160664800 | 160664795 | - |
| SEQ ID NO 42131 | GGTATAGGATGTGGAGATGTTA | TTT | chr6 | 160664785 | 160664806 | 160664790 | 160664785 | - |
| SEQ ID NO 42132 | GTATAGGATGTGGAGATGTTAA | TTG | chr6 | 160664784 | 160664805 | 160664789 | 160664784 | - |
| SEQ ID NO 42133 | ACATTTATACCTAGCTTGCTCG | TTA | chr6 | 160664763 | 160664784 | 160664768 | 160664763 | - |
| SEQ ID NO 42134 | ATACCTAGCTTGCTCGTAAACT | TTT | chr6 | 160664757 | 160664778 | 160664762 | 160664757 | - |
| SEQ ID NO 42135 | TACCTAGCTTGCTCGTAAACTA | TTA | chr6 | 160664756 | 160664777 | 160664761 | 160664756 | - |
| SEQ ID NO 42136 | GCTTGCTCGTAAACTAAGACCT | CTA | chr6 | 160664750 | 160664771 | 160664755 | 160664750 | - |
| SEQ ID NO 42137 | GCTCGTAAACTAAGACCTGAAA | CTT | chr6 | 160664746 | 160664767 | 160664751 | 160664746 | - |
| SEQ ID NO 42138 | CTCGTAAACTAAGACCTGAAAG | TTG | chr6 | 160664745 | 160664766 | 160664750 | 160664745 | - |

Figure 60 (Cont'd)

| SEQ ID NO | Sequence | Codon | Chr | Pos1 | Pos2 | Pos3 | Pos4 | |
|---|---|---|---|---|---|---|---|---|
| SEQ ID NO 42139 | GTAAACTAAGACCTGAAAGGGT | CTC | chr6 | 160664742 | 160664763 | 160664747 | 160664742 | - |
| SEQ ID NO 42140 | AGACCTGAAAGGGTTGTGTCTA | CTA | chr6 | 160664734 | 160664755 | 160664739 | 160664734 | - |
| SEQ ID NO 42141 | AAAGGGTTGTGTCTATCAGCTG | CTG | chr6 | 160664727 | 160664748 | 160664732 | 160664727 | - |
| SEQ ID NO 42142 | TGTCTATCAGCTGCACCCCTGG | TTG | chr6 | 160664718 | 160664739 | 160664723 | 160664718 | - |
| SEQ ID NO 42143 | TCAGCTGCACCCCTGGGTAGCG | CTA | chr6 | 160664712 | 160664733 | 160664717 | 160664712 | - |
| SEQ ID NO 42144 | CACCCCTGGGTAGCGACACAAC | CTG | chr6 | 160664705 | 160664726 | 160664710 | 160664705 | - |
| SEQ ID NO 42145 | GGTAGCGACACAACCTCGGGAA | CTG | chr6 | 160664697 | 160664718 | 160664702 | 160664697 | - |
| SEQ ID NO 42146 | GGGAAGGCCTCAGCCCCCTCCT | CTC | chr6 | 160664680 | 160664701 | 160664685 | 160664680 | - |
| SEQ ID NO 42147 | AGCCCCTCCTCGTACAGCACT | CTC | chr6 | 160664669 | 160664690 | 160664674 | 160664669 | - |
| SEQ ID NO 42148 | CTCGTACAGCACTGCCTGTTGG | CTC | chr6 | 160664660 | 160664681 | 160664665 | 160664660 | - |
| SEQ ID NO 42149 | GTACAGCACTGCCTGTTGGAAA | CTC | chr6 | 160664657 | 160664678 | 160664662 | 160664657 | - |
| SEQ ID NO 42150 | CCTGTTGGAAAGCTTGAGGGAG | CTG | chr6 | 160664646 | 160664667 | 160664651 | 160664646 | - |
| SEQ ID NO 42151 | TTGGAAAGCTTGAGGGAGGCTA | CTG | chr6 | 160664642 | 160664663 | 160664647 | 160664642 | - |
| SEQ ID NO 42152 | GAAAGCTTGAGGGAGGCTATGG | TTG | chr6 | 160664639 | 160664660 | 160664644 | 160664639 | - |
| SEQ ID NO 42153 | GAGGGAGGCTATGGATGTGCAG | CTT | chr6 | 160664631 | 160664652 | 160664636 | 160664631 | - |
| SEQ ID NO 42154 | AGGGAGGCTATGGATGTGCAGC | TTG | chr6 | 160664630 | 160664651 | 160664635 | 160664630 | - |
| SEQ ID NO 42155 | TGGATGTGCAGCACTTGGCAGA | CTA | chr6 | 160664620 | 160664641 | 160664625 | 160664620 | - |
| SEQ ID NO 42156 | GGCAGAGGGTCTGGTCATGGAA | CTT | chr6 | 160664604 | 160664625 | 160664609 | 160664604 | - |
| SEQ ID NO 42157 | GCAGAGGGTCTGGTCATGGAAG | TTG | chr6 | 160664603 | 160664624 | 160664608 | 160664603 | - |
| SEQ ID NO 42158 | GTCATGGAAGTTACCAGCAAAT | CTG | chr6 | 160664591 | 160664612 | 160664596 | 160664591 | - |
| SEQ ID NO 42159 | CCAGCAAATATGAGCTACTTTT | TTA | chr6 | 160664578 | 160664599 | 160664583 | 160664578 | - |
| SEQ ID NO 42160 | CTTTTATGATTTTATTTTATCC | CTA | chr6 | 160664561 | 160664582 | 160664566 | 160664561 | - |
| SEQ ID NO 42161 | TTATGATTTTATTTTATCCAAA | CTT | chr6 | 160664558 | 160664579 | 160664563 | 160664558 | - |
| SEQ ID NO 42162 | TATGATTTTATTTTATCCAAAA | TTT | chr6 | 160664557 | 160664578 | 160664562 | 160664557 | - |
| SEQ ID NO 42163 | ATGATTTTATTTTATCCAAAAG | TTT | chr6 | 160664556 | 160664577 | 160664561 | 160664556 | - |
| SEQ ID NO 42164 | TGATTTTATTTTATCCAAAAGA | TTA | chr6 | 160664555 | 160664576 | 160664560 | 160664555 | - |
| SEQ ID NO 42165 | TATTTTATCCAAAAGAAAGAGA | TTT | chr6 | 160664549 | 160664570 | 160664554 | 160664549 | - |
| SEQ ID NO 42166 | ATTTTATCCAAAAGAAAGAGAA | TTT | chr6 | 160664548 | 160664569 | 160664553 | 160664548 | - |
| SEQ ID NO 42167 | TTTTATCCAAAAGAAAGAGAAT | TTA | chr6 | 160664547 | 160664568 | 160664552 | 160664547 | - |
| SEQ ID NO 42168 | TATCCAAAAGAAAGAGAATGAA | TTT | chr6 | 160664544 | 160664565 | 160664549 | 160664544 | - |
| SEQ ID NO 42169 | ATCCAAAAGAAAGAGAATGAAA | TTT | chr6 | 160664543 | 160664564 | 160664548 | 160664543 | - |
| SEQ ID NO 42170 | TCCAAAAGAAAGAGAATGAAAG | TTA | chr6 | 160664542 | 160664563 | 160664547 | 160664542 | - |
| SEQ ID NO 42171 | ATCAGGAAAGATGAAGGTCTAG | CTA | chr6 | 160664498 | 160664519 | 160664503 | 160664498 | - |
| SEQ ID NO 42172 | GGGGTGAGGGAAGGAGTAAGGA | CTA | chr6 | 160664477 | 160664498 | 160664482 | 160664477 | - |
| SEQ ID NO 42173 | AGGGGGGAAATGGCTTTCACCA | CTG | chr6 | 160664429 | 160664450 | 160664434 | 160664429 | - |
| SEQ ID NO 42174 | TCACCACTTCCCAGCATCTATT | CTT | chr6 | 160664413 | 160664434 | 160664418 | 160664413 | - |
| SEQ ID NO 42175 | CACCACTTCCCAGCATCTATTG | TTT | chr6 | 160664412 | 160664433 | 160664417 | 160664412 | - |
| SEQ ID NO 42176 | ACCACTTCCCAGCATCTATTGA | TTC | chr6 | 160664411 | 160664432 | 160664416 | 160664411 | - |
| SEQ ID NO 42177 | CCCAGCATCTATTGACATTGCA | CTT | chr6 | 160664404 | 160664425 | 160664409 | 160664404 | - |
| SEQ ID NO 42178 | CCAGCATCTATTGACATTGCAC | TTC | chr6 | 160664403 | 160664424 | 160664408 | 160664403 | - |
| SEQ ID NO 42179 | TTGACATTGCACTCTCAAATAT | CTA | chr6 | 160664393 | 160664414 | 160664398 | 160664393 | - |
| SEQ ID NO 42180 | ACATTGCACTCTCAAATATTTT | TTG | chr6 | 160664390 | 160664411 | 160664395 | 160664390 | - |
| SEQ ID NO 42181 | CACTCTCAAATATTTTATAAGA | TTG | chr6 | 160664384 | 160664405 | 160664389 | 160664384 | - |
| SEQ ID NO 42182 | TCAAATATTTTATAAGACTCTA | CTC | chr6 | 160664379 | 160664400 | 160664384 | 160664379 | - |
| SEQ ID NO 42183 | AAATATTTTATAAGACTCTATA | CTC | chr6 | 160664377 | 160664398 | 160664382 | 160664377 | - |
| SEQ ID NO 42184 | TATAAGACTCTATATTCAAGGT | TTT | chr6 | 160664369 | 160664390 | 160664374 | 160664369 | - |
| SEQ ID NO 42185 | ATAAGACTCTATATTCAAGGTA | TTT | chr6 | 160664368 | 160664389 | 160664373 | 160664368 | - |
| SEQ ID NO 42186 | TAAGACTCTATATTCAAGGTAA | TTA | chr6 | 160664367 | 160664388 | 160664372 | 160664367 | - |
| SEQ ID NO 42187 | TATATTCAAGGTAATGTTTGAA | CTC | chr6 | 160664359 | 160664380 | 160664364 | 160664359 | - |
| SEQ ID NO 42188 | TATTCAAGGTAATGTTTGAACC | CTA | chr6 | 160664357 | 160664378 | 160664362 | 160664357 | - |
| SEQ ID NO 42189 | AAGGTAATGTTTGAACCCTGCT | TTC | chr6 | 160664352 | 160664373 | 160664357 | 160664352 | - |
| SEQ ID NO 42190 | GAACCCTGCTGAGCCAGTGGCA | TTT | chr6 | 160664340 | 160664361 | 160664345 | 160664340 | - |
| SEQ ID NO 42191 | AACCCTGCTGAGCCAGTGGCAT | TTG | chr6 | 160664339 | 160664360 | 160664344 | 160664339 | - |
| SEQ ID NO 42192 | CTGAGCCAGTGGCATGGGTCTC | CTG | chr6 | 160664332 | 160664353 | 160664337 | 160664332 | - |
| SEQ ID NO 42193 | AGCCAGTGGCATGGGTCTCTGA | CTG | chr6 | 160664329 | 160664350 | 160664334 | 160664329 | - |
| SEQ ID NO 42194 | TGAGAGAATCATTAACTTAATT | CTC | chr6 | 160664310 | 160664331 | 160664315 | 160664310 | - |
| SEQ ID NO 42195 | AGAGAATCATTAACTTAATTTG | CTG | chr6 | 160664308 | 160664329 | 160664313 | 160664308 | - |
| SEQ ID NO 42196 | ACTTAATTTGACTATCTGGTTT | TTA | chr6 | 160664296 | 160664317 | 160664301 | 160664296 | - |

Figure 60 (Cont'd)

| | | | | | | | | |
|---|---|---|---|---|---|---|---|---|
| SEQ ID NO 42197 | AATTTGACTATCTGGTTTGTGG | CTT | chr6 | 160664292 | 160664313 | 160664297 | 160664292 | - |
| SEQ ID NO 42198 | ATTTGACTATCTGGTTTGTGGG | TTA | chr6 | 160664291 | 160664312 | 160664296 | 160664291 | - |
| SEQ ID NO 42199 | GACTATCTGGTTTGTGGGTGCG | TTT | chr6 | 160664287 | 160664308 | 160664292 | 160664287 | - |
| SEQ ID NO 42200 | ACTATCTGGTTTGTGGGTGCGT | TTG | chr6 | 160664286 | 160664307 | 160664291 | 160664286 | - |
| SEQ ID NO 42201 | TCTGGTTTGTGGGTGCGTTTAC | CTA | chr6 | 160664282 | 160664303 | 160664287 | 160664282 | - |
| SEQ ID NO 42202 | GTTTGTGGGTGCGTTTACTCTC | CTG | chr6 | 160664278 | 160664299 | 160664283 | 160664278 | - |
| SEQ ID NO 42203 | GTGGGTGCGTTTACTCTCATGT | TTT | chr6 | 160664274 | 160664295 | 160664279 | 160664274 | - |
| SEQ ID NO 42204 | TGGGTGCGTTTACTCTCATGTA | TTG | chr6 | 160664273 | 160664294 | 160664278 | 160664273 | - |
| SEQ ID NO 42205 | ACTCTCATGTAAGTCAACAATG | TTT | chr6 | 160664262 | 160664283 | 160664267 | 160664262 | - |
| SEQ ID NO 42206 | CTCTCATGTAAGTCAACAATGT | TTA | chr6 | 160664261 | 160664282 | 160664266 | 160664261 | - |
| SEQ ID NO 42207 | TCATGTAAGTCAACAATGTCCT | CTC | chr6 | 160664258 | 160664279 | 160664263 | 160664258 | - |
| SEQ ID NO 42208 | ATGTAAGTCAACAATGTCCTGG | CTC | chr6 | 160664256 | 160664277 | 160664261 | 160664256 | - |
| SEQ ID NO 42209 | GGATTGGGACACACTTTCTGGG | CTG | chr6 | 160664235 | 160664256 | 160664240 | 160664235 | - |
| SEQ ID NO 42210 | GGACACACTTTCTGGGCACTGC | TTG | chr6 | 160664229 | 160664250 | 160664234 | 160664229 | - |
| SEQ ID NO 42211 | TCTGGGCACTGCTGGCCAGTCC | CTT | chr6 | 160664219 | 160664240 | 160664224 | 160664219 | - |
| SEQ ID NO 42212 | CTGGGCACTGCTGGCCAGTCCC | TTT | chr6 | 160664218 | 160664239 | 160664223 | 160664218 | - |
| SEQ ID NO 42213 | TGGGCACTGCTGGCCAGTCCCA | TTC | chr6 | 160664217 | 160664238 | 160664222 | 160664217 | - |
| SEQ ID NO 42214 | GGCACTGCTGGCCAGTCCCAAA | CTG | chr6 | 160664215 | 160664236 | 160664220 | 160664215 | - |
| SEQ ID NO 42215 | CTGGCCAGTCCCAAAATGGAAC | CTG | chr6 | 160664208 | 160664229 | 160664213 | 160664208 | - |
| SEQ ID NO 42216 | GCCAGTCCCAAAATGGAACATA | CTG | chr6 | 160664205 | 160664226 | 160664210 | 160664205 | - |
| SEQ ID NO 42217 | TTCTACTTCTTTTATTTCTGAA | TTC | chr6 | 160664171 | 160664192 | 160664176 | 160664171 | - |
| SEQ ID NO 42218 | CTACTTCTTTTATTTCTGAAAT | CTT | chr6 | 160664169 | 160664190 | 160664174 | 160664169 | - |
| SEQ ID NO 42219 | TACTTCTTTTATTTCTGAAATC | TTC | chr6 | 160664168 | 160664189 | 160664173 | 160664168 | - |
| SEQ ID NO 42220 | CTTCTTTTATTTCTGAAATCAG | CTA | chr6 | 160664166 | 160664187 | 160664171 | 160664166 | - |
| SEQ ID NO 42221 | CTTTTATTTCTGAAATCAGGTA | CTT | chr6 | 160664163 | 160664184 | 160664168 | 160664163 | - |
| SEQ ID NO 42222 | TTTTATTTCTGAAATCAGGTAA | TTC | chr6 | 160664162 | 160664183 | 160664167 | 160664162 | - |
| SEQ ID NO 42223 | TTATTTCTGAAATCAGGTAAGA | CTT | chr6 | 160664160 | 160664181 | 160664165 | 160664160 | - |
| SEQ ID NO 42224 | TATTTCTGAAATCAGGTAAGAC | TTT | chr6 | 160664159 | 160664180 | 160664164 | 160664159 | - |
| SEQ ID NO 42225 | ATTTCTGAAATCAGGTAAGACA | TTT | chr6 | 160664158 | 160664179 | 160664163 | 160664158 | - |
| SEQ ID NO 42226 | TTTCTGAAATCAGGTAAGACAT | TTA | chr6 | 160664157 | 160664178 | 160664162 | 160664157 | - |
| SEQ ID NO 42227 | CTGAAATCAGGTAAGACATAGT | TTT | chr6 | 160664154 | 160664175 | 160664159 | 160664154 | - |
| SEQ ID NO 42228 | TGAAATCAGGTAAGACATAGTT | TTC | chr6 | 160664153 | 160664174 | 160664158 | 160664153 | - |
| SEQ ID NO 42229 | AAATCAGGTAAGACATAGTTTT | CTG | chr6 | 160664151 | 160664172 | 160664156 | 160664151 | - |
| SEQ ID NO 42230 | TTTTAAATTATAAGAATTATTT | TTT | chr6 | 160664130 | 160664151 | 160664135 | 160664130 | - |
| SEQ ID NO 42231 | TTTAAATTATAAGAATTATTTT | TTT | chr6 | 160664129 | 160664150 | 160664134 | 160664129 | - |
| SEQ ID NO 42232 | TTAAATTATAAGAATTATTTTT | TTT | chr6 | 160664128 | 160664149 | 160664133 | 160664128 | - |
| SEQ ID NO 42233 | TAAATTATAAGAATTATTTTTT | TTT | chr6 | 160664127 | 160664148 | 160664132 | 160664127 | - |
| SEQ ID NO 42234 | AAATTATAAGAATTATTTTTTC | TTT | chr6 | 160664126 | 160664147 | 160664131 | 160664126 | - |
| SEQ ID NO 42235 | AATTATAAGAATTATTTTTTCT | TTA | chr6 | 160664125 | 160664146 | 160664130 | 160664125 | - |
| SEQ ID NO 42236 | TAAGAATTATTTTTTCTCCCAC | TTA | chr6 | 160664120 | 160664141 | 160664125 | 160664120 | - |
| SEQ ID NO 42237 | TTTTTTCTCCCACAATGTAGTA | TTA | chr6 | 160664111 | 160664132 | 160664116 | 160664111 | - |
| SEQ ID NO 42238 | TTTCTCCCACAATGTAGTAAAA | TTT | chr6 | 160664108 | 160664129 | 160664113 | 160664108 | - |
| SEQ ID NO 42239 | TTCTCCCACAATGTAGTAAAAA | TTT | chr6 | 160664107 | 160664128 | 160664112 | 160664107 | - |
| SEQ ID NO 42240 | TCTCCCACAATGTAGTAAAAAT | TTT | chr6 | 160664106 | 160664127 | 160664111 | 160664106 | - |
| SEQ ID NO 42241 | CTCCCACAATGTAGTAAAAATA | TTT | chr6 | 160664105 | 160664126 | 160664110 | 160664105 | - |
| SEQ ID NO 42242 | TCCCACAATGTAGTAAAAATAC | TTC | chr6 | 160664104 | 160664125 | 160664109 | 160664104 | - |
| SEQ ID NO 42243 | CCACAATGTAGTAAAAATACAT | CTC | chr6 | 160664102 | 160664123 | 160664107 | 160664102 | - |
| SEQ ID NO 42244 | TATGTGCAATTCATTTAATTTT | CTT | chr6 | 160664068 | 160664089 | 160664073 | 160664068 | - |
| SEQ ID NO 42245 | ATGTGCAATTCATTTAATTTTT | TTT | chr6 | 160664067 | 160664088 | 160664072 | 160664067 | - |
| SEQ ID NO 42246 | TGTGCAATTCATTTAATTTTTG | TTA | chr6 | 160664066 | 160664087 | 160664071 | 160664066 | - |
| SEQ ID NO 42247 | ATTTAATTTTTGATTCATGAAA | TTC | chr6 | 160664056 | 160664077 | 160664061 | 160664056 | - |
| SEQ ID NO 42248 | AATTTTTGATTCATGAAATTCC | TTT | chr6 | 160664052 | 160664073 | 160664057 | 160664052 | - |
| SEQ ID NO 42249 | ATTTTTGATTCATGAAATTCCC | TTA | chr6 | 160664051 | 160664072 | 160664056 | 160664051 | - |
| SEQ ID NO 42250 | TTGATTCATGAAATTCCCAGTT | TTT | chr6 | 160664047 | 160664068 | 160664052 | 160664047 | - |
| SEQ ID NO 42251 | TGATTCATGAAATTCCCAGTTC | TTT | chr6 | 160664046 | 160664067 | 160664051 | 160664046 | - |
| SEQ ID NO 42252 | GATTCATGAAATTCCCAGTTCA | TTT | chr6 | 160664045 | 160664066 | 160664050 | 160664045 | - |
| SEQ ID NO 42253 | ATTCATGAAATTCCCAGTTCAA | TTG | chr6 | 160664044 | 160664065 | 160664049 | 160664044 | - |
| SEQ ID NO 42254 | ATGAAATTCCCAGTTCAAAATC | TTC | chr6 | 160664040 | 160664061 | 160664045 | 160664040 | - |

Figure 60 (Cont'd)

| SEQ ID NO 42255 | CCAGTTCAAAATCTTGTATATG | TTC | chr6 | 160664031 | 160664052 | 160664036 | 160664031 | - |
|---|---|---|---|---|---|---|---|---|
| SEQ ID NO 42256 | AAAATCTTGTATATGATTGAAA | TTC | chr6 | 160664024 | 160664045 | 160664029 | 160664024 | - |
| SEQ ID NO 42257 | GTATATGATTGAAAAATTCTTA | CTT | chr6 | 160664016 | 160664037 | 160664021 | 160664016 | - |
| SEQ ID NO 42258 | TATATGATTGAAAAATTCTTAA | TTG | chr6 | 160664015 | 160664036 | 160664020 | 160664015 | - |
| SEQ ID NO 42259 | AAAAATTCTTAAAAAAATAAGT | TTG | chr6 | 160664005 | 160664026 | 160664010 | 160664005 | - |
| SEQ ID NO 42260 | TTAAAAAAATAAGTTTAATTTC | TTC | chr6 | 160663997 | 160664018 | 160664002 | 160663997 | - |
| SEQ ID NO 42261 | AAAAAAATAAGTTTAATTTCCC | CTT | chr6 | 160663995 | 160664016 | 160664000 | 160663995 | - |
| SEQ ID NO 42262 | AAAAAATAAGTTTAATTTCCCC | TTA | chr6 | 160663994 | 160664015 | 160663999 | 160663994 | - |
| SEQ ID NO 42263 | AATTTCCCCGTGAAGACTGTCA | TTT | chr6 | 160663981 | 160664002 | 160663986 | 160663981 | - |
| SEQ ID NO 42264 | ATTTCCCCGTGAAGACTGTCAC | TTA | chr6 | 160663980 | 160664001 | 160663985 | 160663980 | - |
| SEQ ID NO 42265 | CCCCGTGAAGACTGTCACGGTG | TTT | chr6 | 160663976 | 160663997 | 160663981 | 160663976 | - |
| SEQ ID NO 42266 | CCCGTGAAGACTGTCACGGTGC | TTC | chr6 | 160663975 | 160663996 | 160663980 | 160663975 | - |
| SEQ ID NO 42267 | TCACGGTGCTGGAATGAATGGG | CTG | chr6 | 160663962 | 160663983 | 160663967 | 160663962 | - |
| SEQ ID NO 42268 | GAATGAATGGGCAGAAAAAATA | CTG | chr6 | 160663951 | 160663972 | 160663956 | 160663951 | - |
| SEQ ID NO 42269 | ATTTTTCTAATCTAAAAGAGTG | TTG | chr6 | 160663922 | 160663943 | 160663927 | 160663922 | - |
| SEQ ID NO 42270 | TTCTAATCTAAAAGAGTGTGCC | TTT | chr6 | 160663918 | 160663939 | 160663923 | 160663918 | - |
| SEQ ID NO 42271 | TCTAATCTAAAAGAGTGTGCCT | TTT | chr6 | 160663917 | 160663938 | 160663922 | 160663917 | - |
| SEQ ID NO 42272 | CTAATCTAAAAGAGTGTGCCTA | TTT | chr6 | 160663916 | 160663937 | 160663921 | 160663916 | - |
| SEQ ID NO 42273 | TAATCTAAAAGAGTGTGCCTAC | TTC | chr6 | 160663915 | 160663936 | 160663920 | 160663915 | - |
| SEQ ID NO 42274 | ATCTAAAAGAGTGTGCCTACAT | CTA | chr6 | 160663913 | 160663934 | 160663918 | 160663913 | - |
| SEQ ID NO 42275 | AAAGAGTGTGCCTACATGATGG | CTA | chr6 | 160663908 | 160663929 | 160663913 | 160663908 | - |
| SEQ ID NO 42276 | CATGATGGCCAGTCTGGCTGAA | CTA | chr6 | 160663894 | 160663915 | 160663899 | 160663894 | - |
| SEQ ID NO 42277 | GCTGAAAATAAATAGCCATTG | CTG | chr6 | 160663878 | 160663899 | 160663883 | 160663878 | - |
| SEQ ID NO 42278 | AAAAATAAATAGCCATTGTAGC | CTG | chr6 | 160663874 | 160663895 | 160663879 | 160663874 | - |
| SEQ ID NO 42279 | TAGCTAACTATGCAAAGGATGG | TTG | chr6 | 160663856 | 160663877 | 160663861 | 160663856 | - |
| SEQ ID NO 42280 | ACTATGCAAAGGATGGCTAAGC | CTA | chr6 | 160663850 | 160663871 | 160663855 | 160663850 | - |
| SEQ ID NO 42281 | TGCAAAGGATGGCTAAGCTCTT | CTA | chr6 | 160663846 | 160663867 | 160663851 | 160663846 | - |
| SEQ ID NO 42282 | AGCTCTTCGCTTGGTTCTCAGT | CTA | chr6 | 160663831 | 160663852 | 160663836 | 160663831 | - |
| SEQ ID NO 42283 | TTCGCTTGGTTCTCAGTTTCAT | CTC | chr6 | 160663826 | 160663847 | 160663831 | 160663826 | - |
| SEQ ID NO 42284 | CGCTTGGTTCTCAGTTTCATTA | CTT | chr6 | 160663824 | 160663845 | 160663829 | 160663824 | - |
| SEQ ID NO 42285 | GCTTGGTTCTCAGTTTCATTAA | TTC | chr6 | 160663823 | 160663844 | 160663828 | 160663823 | - |
| SEQ ID NO 42286 | GGTTCTCAGTTTCATTAATTTA | CTT | chr6 | 160663819 | 160663840 | 160663824 | 160663819 | - |
| SEQ ID NO 42287 | GTTCTCAGTTTCATTAATTTAT | TTG | chr6 | 160663818 | 160663839 | 160663823 | 160663818 | - |
| SEQ ID NO 42288 | TCAGTTTCATTAATTTATATCA | TTC | chr6 | 160663814 | 160663835 | 160663819 | 160663814 | - |
| SEQ ID NO 42289 | AGTTTCATTAATTTATATCATC | CTC | chr6 | 160663812 | 160663833 | 160663817 | 160663812 | - |
| SEQ ID NO 42290 | CATTAATTTATATCATCTCTGT | TTT | chr6 | 160663807 | 160663828 | 160663812 | 160663807 | - |
| SEQ ID NO 42291 | ATTAATTTATATCATCTCTGTT | TTC | chr6 | 160663806 | 160663827 | 160663811 | 160663806 | - |
| SEQ ID NO 42292 | ATTTATATCATCTCTGTTCAGG | TTA | chr6 | 160663802 | 160663823 | 160663807 | 160663802 | - |
| SEQ ID NO 42293 | ATATCATCTCTGTTCAGGTGCC | TTT | chr6 | 160663798 | 160663819 | 160663803 | 160663798 | - |
| SEQ ID NO 42294 | TATCATCTCTGTTCAGGTGCCA | TTA | chr6 | 160663797 | 160663818 | 160663802 | 160663797 | - |
| SEQ ID NO 42295 | TGTTCAGGTGCCATGCTCCCCT | CTC | chr6 | 160663788 | 160663809 | 160663793 | 160663788 | - |
| SEQ ID NO 42296 | TTCAGGTGCCATGCTCCCCTCA | CTG | chr6 | 160663786 | 160663807 | 160663791 | 160663786 | - |
| SEQ ID NO 42297 | AGGTGCCATGCTCCCCTCACTA | TTC | chr6 | 160663783 | 160663804 | 160663788 | 160663783 | - |
| SEQ ID NO 42298 | CCCTCACTAGCAAGTTGAAACA | CTC | chr6 | 160663770 | 160663791 | 160663775 | 160663770 | - |
| SEQ ID NO 42299 | ACTAGCAAGTTGAAACAATGAA | CTC | chr6 | 160663765 | 160663786 | 160663770 | 160663765 | - |
| SEQ ID NO 42300 | GCAAGTTGAAACAATGAAATAA | CTA | chr6 | 160663761 | 160663782 | 160663766 | 160663761 | - |
| SEQ ID NO 42301 | AAACAATGAAATAACTCTTTGA | TTG | chr6 | 160663753 | 160663774 | 160663758 | 160663753 | - |
| SEQ ID NO 42302 | TTTGAATATGTTTGGTTCCTTG | CTC | chr6 | 160663736 | 160663757 | 160663741 | 160663736 | - |
| SEQ ID NO 42303 | TGAATATGTTTGGTTCCTTGAC | CTT | chr6 | 160663734 | 160663755 | 160663739 | 160663734 | - |
| SEQ ID NO 42304 | GAATATGTTTGGTTCCTTGACC | TTT | chr6 | 160663733 | 160663754 | 160663738 | 160663733 | - |
| SEQ ID NO 42305 | AATATGTTTGGTTCCTTGACCT | TTG | chr6 | 160663732 | 160663753 | 160663737 | 160663732 | - |
| SEQ ID NO 42306 | GGTTCCTTGACCTGTTCATGGA | TTT | chr6 | 160663723 | 160663744 | 160663728 | 160663723 | - |
| SEQ ID NO 42307 | GTTCCTTGACCTGTTCATGGAG | TTG | chr6 | 160663722 | 160663743 | 160663727 | 160663722 | - |
| SEQ ID NO 42308 | CTTGACCTGTTCATGGAGTGGG | TTC | chr6 | 160663718 | 160663739 | 160663723 | 160663718 | - |
| SEQ ID NO 42309 | GACCTGTTCATGGAGTGGGACT | CTT | chr6 | 160663715 | 160663736 | 160663720 | 160663715 | - |
| SEQ ID NO 42310 | ACCTGTTCATGGAGTGGGACTC | TTG | chr6 | 160663714 | 160663735 | 160663719 | 160663714 | - |
| SEQ ID NO 42311 | TTCATGGAGTGGGACTCAGCAT | CTG | chr6 | 160663709 | 160663730 | 160663714 | 160663709 | - |
| SEQ ID NO 42312 | ATGGAGTGGGACTCAGCATTTC | TTC | chr6 | 160663706 | 160663727 | 160663711 | 160663706 | - |

Figure 60 (Cont'd)

| | | | | | | | |
|---|---|---|---|---|---|---|---|
| SEQ ID NO 42313 | AGCATTTCTCTCTTTGTTATGG | CTC | chr6 | 160663692 | 160663713 | 160663697 | 160663692 | - |
| SEQ ID NO 42314 | CTCTCTTTGTTATGGCCTGAGT | TTT | chr6 | 160663685 | 160663706 | 160663690 | 160663685 | - |
| SEQ ID NO 42315 | TCTCTTTGTTATGGCCTGAGTA | TTC | chr6 | 160663684 | 160663705 | 160663689 | 160663684 | - |
| SEQ ID NO 42316 | TCTTTGTTATGGCCTGAGTAAG | CTC | chr6 | 160663682 | 160663703 | 160663687 | 160663682 | - |
| SEQ ID NO 42317 | TTTGTTATGGCCTGAGTAAGGC | CTC | chr6 | 160663680 | 160663701 | 160663685 | 160663680 | - |
| SEQ ID NO 42318 | TGTTATGGCCTGAGTAAGGCTT | CTT | chr6 | 160663678 | 160663699 | 160663683 | 160663678 | - |
| SEQ ID NO 42319 | GTTATGGCCTGAGTAAGGCTTT | TTT | chr6 | 160663677 | 160663698 | 160663682 | 160663677 | - |
| SEQ ID NO 42320 | TTATGGCCTGAGTAAGGCTTTC | TTG | chr6 | 160663676 | 160663697 | 160663681 | 160663676 | - |
| SEQ ID NO 42321 | TGGCCTGAGTAAGGCTTTCCAT | TTA | chr6 | 160663673 | 160663694 | 160663678 | 160663673 | - |
| SEQ ID NO 42322 | AGTAAGGCTTTCCATCGGTATA | CTG | chr6 | 160663666 | 160663687 | 160663671 | 160663666 | - |
| SEQ ID NO 42323 | TCCATCGGTATACATTTGCTTC | CTT | chr6 | 160663656 | 160663677 | 160663661 | 160663656 | - |
| SEQ ID NO 42324 | CCATCGGTATACATTTGCTTCT | TTT | chr6 | 160663655 | 160663676 | 160663660 | 160663655 | - |
| SEQ ID NO 42325 | CATCGGTATACATTTGCTTCTT | TTC | chr6 | 160663654 | 160663675 | 160663659 | 160663654 | - |
| SEQ ID NO 42326 | GCTTCTTATCCTGGAGAAATT | TTT | chr6 | 160663639 | 160663660 | 160663644 | 160663639 | - |
| SEQ ID NO 42327 | CTTCTTATCCTGGAGAAATTA | TTG | chr6 | 160663638 | 160663659 | 160663643 | 160663638 | - |
| SEQ ID NO 42328 | CTTATCCTGGAGAAATTATAC | CTT | chr6 | 160663635 | 160663656 | 160663640 | 160663635 | - |
| SEQ ID NO 42329 | TTATCCTGGAGAAATTATACA | TTC | chr6 | 160663634 | 160663655 | 160663639 | 160663634 | - |
| SEQ ID NO 42330 | ATCCCTGGAGAAATTATACACA | CTT | chr6 | 160663632 | 160663653 | 160663637 | 160663632 | - |
| SEQ ID NO 42331 | TCCCTGGAGAAATTATACACAT | TTA | chr6 | 160663631 | 160663652 | 160663636 | 160663631 | - |
| SEQ ID NO 42332 | GAGAAATTATACACATCCATTT | CTG | chr6 | 160663625 | 160663646 | 160663630 | 160663625 | - |
| SEQ ID NO 42333 | TACACATCCATTTGCCAGATGA | TTA | chr6 | 160663616 | 160663637 | 160663621 | 160663616 | - |
| SEQ ID NO 42334 | GCCAGATGATATACGCATATAA | TTT | chr6 | 160663603 | 160663624 | 160663608 | 160663603 | - |
| SEQ ID NO 42335 | CCAGATGATATACGCATATAAT | TTG | chr6 | 160663602 | 160663623 | 160663607 | 160663602 | - |
| SEQ ID NO 42336 | AACAAATACTCAGGGTATTTGT | TTC | chr6 | 160663575 | 160663596 | 160663580 | 160663575 | - |
| SEQ ID NO 42337 | AGGGTATTTGTTGAGTGGGTTA | CTC | chr6 | 160663564 | 160663585 | 160663569 | 160663564 | - |
| SEQ ID NO 42338 | GTTGAGTGGGTTAGGTCCCCAC | TTT | chr6 | 160663555 | 160663576 | 160663560 | 160663555 | - |
| SEQ ID NO 42339 | TTGAGTGGGTTAGGTCCCCACA | TTG | chr6 | 160663554 | 160663575 | 160663559 | 160663554 | - |
| SEQ ID NO 42340 | AGTGGGTTAGGTCCCCACATTT | TTG | chr6 | 160663551 | 160663572 | 160663556 | 160663551 | - |
| SEQ ID NO 42341 | GGTCCCCACATTTTTATACATA | TTA | chr6 | 160663542 | 160663563 | 160663547 | 160663542 | - |
| SEQ ID NO 42342 | TTATACATACATACACACATAC | TTT | chr6 | 160663529 | 160663550 | 160663534 | 160663529 | - |
| SEQ ID NO 42343 | TATACATACATACACACATACA | TTT | chr6 | 160663528 | 160663549 | 160663533 | 160663528 | - |
| SEQ ID NO 42344 | ATACATACATACACACATACAC | TTT | chr6 | 160663527 | 160663548 | 160663532 | 160663527 | - |
| SEQ ID NO 42345 | TACATACATACACACATACACA | TTA | chr6 | 160663526 | 160663547 | 160663531 | 160663526 | - |
| SEQ ID NO 42346 | TGAATGTAAGTGTGTGTCCTTT | TTG | chr6 | 160663491 | 160663512 | 160663496 | 160663491 | - |
| SEQ ID NO 42347 | TACAAATACTAGCTTATTTAGC | CTT | chr6 | 160663470 | 160663491 | 160663475 | 160663470 | - |
| SEQ ID NO 42348 | ACAAATACTAGCTTATTTAGCT | TTT | chr6 | 160663469 | 160663490 | 160663474 | 160663469 | - |
| SEQ ID NO 42349 | CAAATACTAGCTTATTTAGCTC | TTA | chr6 | 160663468 | 160663489 | 160663473 | 160663468 | - |
| SEQ ID NO 42350 | GCTTATTTAGCTCATGGTATAG | CTA | chr6 | 160663459 | 160663480 | 160663464 | 160663459 | - |
| SEQ ID NO 42351 | ATTTAGCTCATGGTATAGGTAG | CTT | chr6 | 160663455 | 160663476 | 160663460 | 160663455 | - |
| SEQ ID NO 42352 | TTTAGCTCATGGTATAGGTAGG | TTA | chr6 | 160663454 | 160663475 | 160663459 | 160663454 | - |
| SEQ ID NO 42353 | AGCTCATGGTATAGGTAGGGTA | TTT | chr6 | 160663451 | 160663472 | 160663456 | 160663451 | - |
| SEQ ID NO 42354 | GCTCATGGTATAGGTAGGGTAG | TTA | chr6 | 160663450 | 160663471 | 160663455 | 160663450 | - |
| SEQ ID NO 42355 | ATGGTATAGGTAGGGTAGCATA | CTC | chr6 | 160663446 | 160663467 | 160663451 | 160663446 | - |
| SEQ ID NO 42356 | TATAAACAAAGAAATCTAGACT | TTT | chr6 | 160663411 | 160663432 | 160663416 | 160663411 | - |
| SEQ ID NO 42357 | ATAAACAAAGAAATCTAGACTT | TTT | chr6 | 160663410 | 160663431 | 160663415 | 160663410 | - |
| SEQ ID NO 42358 | TAAACAAAGAAATCTAGACTTA | TTA | chr6 | 160663409 | 160663430 | 160663414 | 160663409 | - |
| SEQ ID NO 42359 | GACTTAGGAAAATCATGTTATT | CTA | chr6 | 160663393 | 160663414 | 160663398 | 160663393 | - |
| SEQ ID NO 42360 | AGGAAAATCATGTTATTTGTCT | CTT | chr6 | 160663388 | 160663409 | 160663393 | 160663388 | - |
| SEQ ID NO 42361 | GGAAAATCATGTTATTTGTCTC | TTA | chr6 | 160663387 | 160663408 | 160663392 | 160663387 | - |
| SEQ ID NO 42362 | TTTGTCTCGTGACCAAATTCCC | TTA | chr6 | 160663373 | 160663394 | 160663378 | 160663373 | - |
| SEQ ID NO 42363 | GTCTCGTGACCAAATTCCCAAA | TTT | chr6 | 160663370 | 160663391 | 160663375 | 160663370 | - |
| SEQ ID NO 42364 | TCTCGTGACCAAATTCCCAAAT | TTG | chr6 | 160663369 | 160663390 | 160663374 | 160663369 | - |
| SEQ ID NO 42365 | GTGACCAAATTCCCAAATCAAG | CTC | chr6 | 160663365 | 160663386 | 160663370 | 160663365 | - |
| SEQ ID NO 42366 | CCAAATCAAGGAAATAAAGAAA | TTC | chr6 | 160663353 | 160663374 | 160663358 | 160663353 | - |
| SEQ ID NO 42367 | GATTTAAGCCAGATTCCAAGA | CTG | chr6 | 160663327 | 160663348 | 160663332 | 160663327 | - |
| SEQ ID NO 42368 | AAGCCAGATTCCAAGAAAAAA | TTT | chr6 | 160663322 | 160663343 | 160663327 | 160663322 | - |
| SEQ ID NO 42369 | AGCCAGATTCCAAGAAAAAAT | TTA | chr6 | 160663321 | 160663342 | 160663326 | 160663321 | - |
| SEQ ID NO 42370 | CCAAGAAAAAATCTAGGGCTCT | TTT | chr6 | 160663311 | 160663332 | 160663316 | 160663311 | - |

Figure 60 (Cont'd)

| | | | | | | | |
|---|---|---|---|---|---|---|---|
| SEQ ID NO 42371 | CAAGAAAAAATCTAGGGCTCTT | TTC | chr6 | 160663310 | 160663331 | 160663315 | 160663310 | - |
| SEQ ID NO 42372 | GGGCTCTTCTCACTTTTTCATC | CTA | chr6 | 160663296 | 160663317 | 160663301 | 160663296 | - |
| SEQ ID NO 42373 | TTCTCACTTTTTCATCTTTGTT | CTC | chr6 | 160663290 | 160663311 | 160663295 | 160663290 | - |
| SEQ ID NO 42374 | CTCACTTTTTCATCTTTGTTCC | CTT | chr6 | 160663288 | 160663309 | 160663293 | 160663288 | - |
| SEQ ID NO 42375 | TCACTTTTTCATCTTTGTTCCA | TTC | chr6 | 160663287 | 160663308 | 160663292 | 160663287 | - |
| SEQ ID NO 42376 | ACTTTTTCATCTTTGTTCCAAC | CTC | chr6 | 160663285 | 160663306 | 160663290 | 160663285 | - |
| SEQ ID NO 42377 | TTTCATCTTTGTTCCAACATTT | CTT | chr6 | 160663281 | 160663302 | 160663286 | 160663281 | - |
| SEQ ID NO 42378 | TTCATCTTTGTTCCAACATTTG | TTT | chr6 | 160663280 | 160663301 | 160663285 | 160663280 | - |
| SEQ ID NO 42379 | TCATCTTTGTTCCAACATTTGA | TTT | chr6 | 160663279 | 160663300 | 160663284 | 160663279 | - |
| SEQ ID NO 42380 | CATCTTTGTTCCAACATTTGAA | TTT | chr6 | 160663278 | 160663299 | 160663283 | 160663278 | - |
| SEQ ID NO 42381 | ATCTTTGTTCCAACATTTGAAA | TTC | chr6 | 160663277 | 160663298 | 160663282 | 160663277 | - |
| SEQ ID NO 42382 | TGTTCCAACATTTGAAAAAATA | CTT | chr6 | 160663272 | 160663293 | 160663277 | 160663272 | - |
| SEQ ID NO 42383 | GTTCCAACATTTGAAAAATAA | TTT | chr6 | 160663271 | 160663292 | 160663276 | 160663271 | - |
| SEQ ID NO 42384 | TTCCAACATTTGAAAAAATAAA | TTG | chr6 | 160663270 | 160663291 | 160663275 | 160663270 | - |
| SEQ ID NO 42385 | CAACATTTGAAAAAATAAATCT | TTC | chr6 | 160663267 | 160663288 | 160663272 | 160663267 | - |
| SEQ ID NO 42386 | GAAAAAATAAATCTAAACACAT | TTT | chr6 | 160663259 | 160663280 | 160663264 | 160663259 | - |
| SEQ ID NO 42387 | AAAAAATAAATCTAAACACATT | TTG | chr6 | 160663258 | 160663279 | 160663263 | 160663258 | - |
| SEQ ID NO 42388 | AACACATTCCAATGTAACTGAA | CTA | chr6 | 160663244 | 160663265 | 160663249 | 160663244 | - |
| SEQ ID NO 42389 | CAATGTAACTGAAGAGCAGGTT | TTC | chr6 | 160663235 | 160663256 | 160663240 | 160663235 | - |
| SEQ ID NO 42390 | AAGAGCAGGTTAATTGTTTGCC | CTG | chr6 | 160663224 | 160663245 | 160663229 | 160663224 | - |
| SEQ ID NO 42391 | ATTGTTTGCCACTTGCAGAATC | TTA | chr6 | 160663212 | 160663233 | 160663217 | 160663212 | - |
| SEQ ID NO 42392 | TTTGCCACTTGCAGAATCCAAT | TTG | chr6 | 160663208 | 160663229 | 160663213 | 160663208 | - |
| SEQ ID NO 42393 | GCCACTTGCAGAATCCAATTAA | TTT | chr6 | 160663205 | 160663226 | 160663210 | 160663205 | - |
| SEQ ID NO 42394 | CCACTTGCAGAATCCAATTAAG | TTG | chr6 | 160663204 | 160663225 | 160663209 | 160663204 | - |
| SEQ ID NO 42395 | GCAGAATCCAATTAAGAAGAGA | CTT | chr6 | 160663198 | 160663219 | 160663203 | 160663198 | - |
| SEQ ID NO 42396 | CAGAATCCAATTAAGAAGAGAG | TTG | chr6 | 160663197 | 160663218 | 160663202 | 160663197 | - |
| SEQ ID NO 42397 | AGAAGAGAGAAGTCTGGTATAA | TTA | chr6 | 160663184 | 160663205 | 160663189 | 160663184 | - |
| SEQ ID NO 42398 | GTATAAAGAAAGTGATTTGCTT | CTG | chr6 | 160663168 | 160663189 | 160663173 | 160663168 | - |
| SEQ ID NO 42399 | GCTTCCAAAGCTAGCTTAGGGG | TTT | chr6 | 160663150 | 160663171 | 160663155 | 160663150 | - |
| SEQ ID NO 42400 | CTTCCAAAGCTAGCTTAGGGGA | TTG | chr6 | 160663149 | 160663170 | 160663154 | 160663149 | - |
| SEQ ID NO 42401 | CCAAAGCTAGCTTAGGGGAAGA | CTT | chr6 | 160663146 | 160663167 | 160663151 | 160663146 | - |
| SEQ ID NO 42402 | CAAAGCTAGCTTAGGGGAAGAA | TTC | chr6 | 160663145 | 160663166 | 160663150 | 160663145 | - |
| SEQ ID NO 42403 | GCTTAGGGGAAGAAATGCAGCA | CTA | chr6 | 160663137 | 160663158 | 160663142 | 160663137 | - |
| SEQ ID NO 42404 | AGGGGAAGAAATGCAGCAGTCC | CTT | chr6 | 160663133 | 160663154 | 160663138 | 160663133 | - |
| SEQ ID NO 42405 | GGGGAAGAAATGCAGCAGTCCT | TTA | chr6 | 160663132 | 160663153 | 160663137 | 160663132 | - |
| SEQ ID NO 42406 | CCGTACTACTTCACTTTAGGAG | CTG | chr6 | 160663109 | 160663130 | 160663114 | 160663109 | - |
| SEQ ID NO 42407 | CTTCACTTTAGGAGCAGAAAGT | CTA | chr6 | 160663101 | 160663122 | 160663106 | 160663101 | - |
| SEQ ID NO 42408 | CACTTTAGGAGCAGAAAGTGGC | CTT | chr6 | 160663098 | 160663119 | 160663103 | 160663098 | - |
| SEQ ID NO 42409 | ACTTTAGGAGCAGAAAGTGGCA | TTC | chr6 | 160663097 | 160663118 | 160663102 | 160663097 | - |
| SEQ ID NO 42410 | TAGGAGCAGAAAGTGGCACTTT | CTT | chr6 | 160663093 | 160663114 | 160663098 | 160663093 | - |
| SEQ ID NO 42411 | AGGAGCAGAAAGTGGCACTTTT | TTT | chr6 | 160663092 | 160663113 | 160663097 | 160663092 | - |
| SEQ ID NO 42412 | GGAGCAGAAAGTGGCACTTTTA | TTA | chr6 | 160663091 | 160663112 | 160663096 | 160663091 | - |
| SEQ ID NO 42413 | TTAAAAGGCAACAGAGGAGGCG | CTT | chr6 | 160663072 | 160663093 | 160663077 | 160663072 | - |
| SEQ ID NO 42414 | TAAAAGGCAACAGAGGAGGCGA | TTT | chr6 | 160663071 | 160663092 | 160663076 | 160663071 | - |
| SEQ ID NO 42415 | AAAAGGCAACAGAGGAGGCGAG | TTT | chr6 | 160663070 | 160663091 | 160663075 | 160663070 | - |
| SEQ ID NO 42416 | AAAGGCAACAGAGGAGGCGAGC | TTA | chr6 | 160663069 | 160663090 | 160663074 | 160663069 | - |
| SEQ ID NO 42417 | AGGGGTCCATGCTAGCTTGGGC | TTC | chr6 | 160663039 | 160663060 | 160663044 | 160663039 | - |
| SEQ ID NO 42418 | GCTTGGGCACCTTATCCACCAG | CTA | chr6 | 160663025 | 160663046 | 160663030 | 160663025 | - |
| SEQ ID NO 42419 | GGGCACCTTATCCACCAGGTAG | CTT | chr6 | 160663021 | 160663042 | 160663026 | 160663021 | - |
| SEQ ID NO 42420 | GGCACCTTATCCACCAGGTAGT | TTG | chr6 | 160663020 | 160663041 | 160663025 | 160663020 | - |
| SEQ ID NO 42421 | ATCCACCAGGTAGTTGAGCAGT | CTT | chr6 | 160663012 | 160663033 | 160663017 | 160663012 | - |
| SEQ ID NO 42422 | TCCACCAGGTAGTTGAGCAGTT | TTA | chr6 | 160663011 | 160663032 | 160663016 | 160663011 | - |
| SEQ ID NO 42423 | AGCAGTTGCCTGCTGGTGCCTT | TTG | chr6 | 160662996 | 160663017 | 160663001 | 160662996 | - |
| SEQ ID NO 42424 | CCTGCTGGTGCCTTTGTGAGCA | TTG | chr6 | 160662988 | 160663009 | 160662993 | 160662988 | - |
| SEQ ID NO 42425 | CTGGTGCCTTTGTGAGCAGGGT | CTG | chr6 | 160662984 | 160663005 | 160662989 | 160662984 | - |
| SEQ ID NO 42426 | GTGCCTTTGTGAGCAGGGTGTT | CTG | chr6 | 160662981 | 160663002 | 160662986 | 160662981 | - |
| SEQ ID NO 42427 | TGTGAGCAGGGTGTTGTCCCTT | CTT | chr6 | 160662974 | 160662995 | 160662979 | 160662974 | - |
| SEQ ID NO 42428 | GTGAGCAGGGTGTTGTCCCTTG | TTT | chr6 | 160662973 | 160662994 | 160662978 | 160662973 | - |

Figure 60 (Cont'd)

| | | | | | | | | |
|---|---|---|---|---|---|---|---|---|
| SEQ ID NO 42429 | TGAGCAGGGTGTTGTCCCTTGA | TTG | chr6 | 160662972 | 160662993 | 160662977 | 160662972 | - |
| SEQ ID NO 42430 | TCCCTTGAGGCAAATCTCTGGA | TTG | chr6 | 160662958 | 160662979 | 160662963 | 160662958 | - |
| SEQ ID NO 42431 | GAGGCAAATCTCTGGAGGGTGA | CTT | chr6 | 160662952 | 160662973 | 160662957 | 160662952 | - |
| SEQ ID NO 42432 | AGGCAAATCTCTGGAGGGTGAG | TTG | chr6 | 160662951 | 160662972 | 160662956 | 160662951 | - |
| SEQ ID NO 42433 | TGGAGGGTGAGAGTTTTGTAGT | CTC | chr6 | 160662940 | 160662961 | 160662945 | 160662940 | - |
| SEQ ID NO 42434 | GAGGGTGAGAGTTTTGTAGTGG | CTG | chr6 | 160662938 | 160662959 | 160662943 | 160662938 | - |
| SEQ ID NO 42435 | TGTAGTGGGCATGCTTTGGTTT | TTT | chr6 | 160662924 | 160662945 | 160662929 | 160662924 | - |
| SEQ ID NO 42436 | GTAGTGGGCATGCTTTGGTTTA | TTT | chr6 | 160662923 | 160662944 | 160662928 | 160662923 | - |
| SEQ ID NO 42437 | TAGTGGGCATGCTTTGGTTTAT | TTG | chr6 | 160662922 | 160662943 | 160662927 | 160662922 | - |
| SEQ ID NO 42438 | TGGTTTATAAATCACCTGTGAA | CTT | chr6 | 160662908 | 160662929 | 160662913 | 160662908 | - |
| SEQ ID NO 42439 | GGTTTATAAATCACCTGTGAAC | TTT | chr6 | 160662907 | 160662928 | 160662912 | 160662907 | - |
| SEQ ID NO 42440 | GTTTATAAATCACCTGTGAACT | TTG | chr6 | 160662906 | 160662927 | 160662911 | 160662906 | - |
| SEQ ID NO 42441 | ATAAATCACCTGTGAACTCAGG | TTT | chr6 | 160662902 | 160662923 | 160662907 | 160662902 | - |
| SEQ ID NO 42442 | TAAATCACCTGTGAACTCAGGA | TTA | chr6 | 160662901 | 160662922 | 160662906 | 160662901 | - |
| SEQ ID NO 42443 | TGAACTCAGGAGTTCCATCTTG | CTG | chr6 | 160662890 | 160662911 | 160662895 | 160662890 | - |
| SEQ ID NO 42444 | AGGAGTTCCATCTTGAAGCACA | CTC | chr6 | 160662883 | 160662904 | 160662888 | 160662883 | - |
| SEQ ID NO 42445 | CATCTTGAAGCACATACATAGT | TTC | chr6 | 160662875 | 160662896 | 160662880 | 160662875 | - |
| SEQ ID NO 42446 | GAAGCACATACATAGTTAGATG | CTT | chr6 | 160662869 | 160662890 | 160662874 | 160662869 | - |
| SEQ ID NO 42447 | AAGCACATACATAGTTAGATGA | TTG | chr6 | 160662868 | 160662889 | 160662873 | 160662868 | - |
| SEQ ID NO 42448 | GATGAACTTGCCCTGCAGGGAG | TTA | chr6 | 160662851 | 160662872 | 160662856 | 160662851 | - |
| SEQ ID NO 42449 | GCCCTGCAGGGAGAGTCTGATG | CTT | chr6 | 160662842 | 160662863 | 160662847 | 160662842 | - |
| SEQ ID NO 42450 | CCCTGCAGGGAGAGTCTGATGA | TTG | chr6 | 160662841 | 160662862 | 160662846 | 160662841 | - |
| SEQ ID NO 42451 | CAGGGAGAGTCTGATGAAAGGG | CTG | chr6 | 160662836 | 160662857 | 160662841 | 160662836 | - |
| SEQ ID NO 42452 | ATGAAAGGGAGGTAGATGCTTG | CTG | chr6 | 160662823 | 160662844 | 160662828 | 160662823 | - |
| SEQ ID NO 42453 | GCAATTTAATCTATAAATTACC | CTT | chr6 | 160662802 | 160662823 | 160662807 | 160662802 | - |
| SEQ ID NO 42454 | CAATTTAATCTATAAATTACCA | TTG | chr6 | 160662801 | 160662822 | 160662806 | 160662801 | - |
| SEQ ID NO 42455 | AATCTATAAATTACCAGATAAA | TTT | chr6 | 160662795 | 160662816 | 160662800 | 160662795 | - |
| SEQ ID NO 42456 | ATCTATAAATTACCAGATAAAA | TTA | chr6 | 160662794 | 160662815 | 160662799 | 160662794 | - |
| SEQ ID NO 42457 | TAAATTACCAGATAAAATTTTA | CTA | chr6 | 160662789 | 160662810 | 160662794 | 160662789 | - |
| SEQ ID NO 42458 | CCAGATAAAATTTTACAAGTTG | TTA | chr6 | 160662782 | 160662803 | 160662787 | 160662782 | - |
| SEQ ID NO 42459 | TACAAGTTGACTTTAAAGTCAA | TTT | chr6 | 160662769 | 160662790 | 160662774 | 160662769 | - |
| SEQ ID NO 42460 | ACAAGTTGACTTTAAAGTCAAA | TTT | chr6 | 160662768 | 160662789 | 160662773 | 160662768 | - |
| SEQ ID NO 42461 | CAAGTTGACTTTAAAGTCAAAC | TTA | chr6 | 160662767 | 160662788 | 160662772 | 160662767 | - |
| SEQ ID NO 42462 | ACTTTAAAGTCAAACACATTTG | TTG | chr6 | 160662760 | 160662781 | 160662765 | 160662760 | - |
| SEQ ID NO 42463 | TAAAGTCAAACACATTTGAATT | CTT | chr6 | 160662756 | 160662777 | 160662761 | 160662756 | - |
| SEQ ID NO 42464 | AAAGTCAAACACATTTGAATTT | TTT | chr6 | 160662755 | 160662776 | 160662760 | 160662755 | - |
| SEQ ID NO 42465 | AAGTCAAACACATTTGAATTTA | TTA | chr6 | 160662754 | 160662775 | 160662759 | 160662754 | - |
| SEQ ID NO 42466 | GAATTTAGTGGAAGCCATTCAA | TTT | chr6 | 160662739 | 160662760 | 160662744 | 160662739 | - |
| SEQ ID NO 42467 | AATTTAGTGGAAGCCATTCAAG | TTG | chr6 | 160662738 | 160662759 | 160662743 | 160662738 | - |
| SEQ ID NO 42468 | AGTGGAAGCCATTCAAGAAAAT | TTT | chr6 | 160662733 | 160662754 | 160662738 | 160662733 | - |
| SEQ ID NO 42469 | GTGGAAGCCATTCAAGAAAATA | TTA | chr6 | 160662732 | 160662753 | 160662737 | 160662732 | - |
| SEQ ID NO 42470 | AAGAAAATATCAAAGAAAATAC | TTC | chr6 | 160662719 | 160662740 | 160662724 | 160662719 | - |
| SEQ ID NO 42471 | AGCAAAGAGTTTTTTGGGGAAA | TTA | chr6 | 160662680 | 160662701 | 160662685 | 160662680 | - |
| SEQ ID NO 42472 | TTTGGGGAAATTGGTGTCTATG | TTT | chr6 | 160662668 | 160662689 | 160662673 | 160662668 | - |
| SEQ ID NO 42473 | TTGGGGAAATTGGTGTCTATGT | TTT | chr6 | 160662667 | 160662688 | 160662672 | 160662667 | - |
| SEQ ID NO 42474 | TGGGGAAATTGGTGTCTATGTC | TTT | chr6 | 160662666 | 160662687 | 160662671 | 160662666 | - |
| SEQ ID NO 42475 | GGGGAAATTGGTGTCTATGTCT | TTT | chr6 | 160662665 | 160662686 | 160662670 | 160662665 | - |
| SEQ ID NO 42476 | GGGAAATTGGTGTCTATGTCTG | TTG | chr6 | 160662664 | 160662685 | 160662669 | 160662664 | - |
| SEQ ID NO 42477 | GTGTCTATGTCTGTGTGTGTAG | TTG | chr6 | 160662655 | 160662676 | 160662660 | 160662655 | - |
| SEQ ID NO 42478 | TGTCTGTGTGTGTAGGGAGTGC | CTA | chr6 | 160662648 | 160662669 | 160662653 | 160662648 | - |
| SEQ ID NO 42479 | TGTGTGTAGGGAGTGCAGGGGA | CTG | chr6 | 160662642 | 160662663 | 160662647 | 160662642 | - |
| SEQ ID NO 42480 | TATTTCAGCCCATGGAAACTAG | TTC | chr6 | 160662609 | 160662630 | 160662614 | 160662609 | - |
| SEQ ID NO 42481 | TTTCAGCCCATGGAAACTAGGA | CTA | chr6 | 160662607 | 160662628 | 160662612 | 160662607 | - |
| SEQ ID NO 42482 | CAGCCCATGGAAACTAGGATGT | TTT | chr6 | 160662604 | 160662625 | 160662609 | 160662604 | - |
| SEQ ID NO 42483 | AGCCCATGGAAACTAGGATGTA | TTC | chr6 | 160662603 | 160662624 | 160662608 | 160662603 | - |
| SEQ ID NO 42484 | GGATGTAGACACTGTGAACTT | CTA | chr6 | 160662588 | 160662609 | 160662593 | 160662588 | - |
| SEQ ID NO 42485 | TGAACTTATTCAGCAGGCTACA | CTG | chr6 | 160662573 | 160662594 | 160662578 | 160662573 | - |
| SEQ ID NO 42486 | ATTCAGCAGGCTACACCCAAAG | CTT | chr6 | 160662566 | 160662587 | 160662571 | 160662566 | - |

Figure 60 (Cont'd)

| | | | | | | | | |
|---|---|---|---|---|---|---|---|---|
| SEQ ID NO 42487 | TTCAGCAGGCTACACCCAAAGG | TTA | chr6 | 160662565 | 160662586 | 160662570 | 160662565 | - |
| SEQ ID NO 42488 | AGCAGGCTACACCCAAAGGCTA | TTC | chr6 | 160662562 | 160662583 | 160662567 | 160662562 | - |
| SEQ ID NO 42489 | CACCCAAAGGCTAGAACAAACT | CTA | chr6 | 160662553 | 160662574 | 160662558 | 160662553 | - |
| SEQ ID NO 42490 | GAACAAACTTCTCTGCCACAGG | CTA | chr6 | 160662540 | 160662561 | 160662545 | 160662540 | - |
| SEQ ID NO 42491 | CTCTGCCACAGGATTAACATAT | CTT | chr6 | 160662530 | 160662551 | 160662535 | 160662530 | - |
| SEQ ID NO 42492 | TCTGCCACAGGATTAACATATG | TTC | chr6 | 160662529 | 160662550 | 160662534 | 160662529 | - |
| SEQ ID NO 42493 | TGCCACAGGATTAACATATGTT | CTC | chr6 | 160662527 | 160662548 | 160662532 | 160662527 | - |
| SEQ ID NO 42494 | CCACAGGATTAACATATGTTTT | CTG | chr6 | 160662525 | 160662546 | 160662530 | 160662525 | - |
| SEQ ID NO 42495 | ACATATGTTTTAATCGACCTGG | TTA | chr6 | 160662514 | 160662535 | 160662519 | 160662514 | - |
| SEQ ID NO 42496 | TAATCGACCTGGGGGGCACATT | TTT | chr6 | 160662504 | 160662525 | 160662509 | 160662504 | - |
| SEQ ID NO 42497 | AATCGACCTGGGGGGCACATTC | TTT | chr6 | 160662503 | 160662524 | 160662508 | 160662503 | - |
| SEQ ID NO 42498 | ATCGACCTGGGGGGCACATTCT | TTA | chr6 | 160662502 | 160662523 | 160662507 | 160662502 | - |
| SEQ ID NO 42499 | GGGGGCACATTCTCTGATAAGC | CTG | chr6 | 160662493 | 160662514 | 160662498 | 160662493 | - |
| SEQ ID NO 42500 | TCTGATAAGCTCTTTTGGAAAG | TTC | chr6 | 160662481 | 160662502 | 160662486 | 160662481 | - |
| SEQ ID NO 42501 | TGATAAGCTCTTTTGGAAAGCC | CTC | chr6 | 160662479 | 160662500 | 160662484 | 160662479 | - |
| SEQ ID NO 42502 | ATAAGCTCTTTTGGAAAGCCAG | CTG | chr6 | 160662477 | 160662498 | 160662482 | 160662477 | - |
| SEQ ID NO 42503 | TTTTGGAAAGCCAGGCTTTCTG | CTC | chr6 | 160662469 | 160662490 | 160662474 | 160662469 | - |
| SEQ ID NO 42504 | TTGGAAAGCCAGGCTTTCTGTG | CTT | chr6 | 160662467 | 160662488 | 160662472 | 160662467 | - |
| SEQ ID NO 42505 | TGGAAAGCCAGGCTTTCTGTGG | TTT | chr6 | 160662466 | 160662487 | 160662471 | 160662466 | - |
| SEQ ID NO 42506 | GGAAAGCCAGGCTTTCTGTGGA | TTT | chr6 | 160662465 | 160662486 | 160662470 | 160662465 | - |
| SEQ ID NO 42507 | GAAAGCCAGGCTTTCTGTGGAC | TTG | chr6 | 160662464 | 160662485 | 160662469 | 160662464 | - |
| SEQ ID NO 42508 | TCTGTGGACGTGTTATCTTTCC | CTT | chr6 | 160662451 | 160662472 | 160662456 | 160662451 | - |
| SEQ ID NO 42509 | CTGTGGACGTGTTATCTTTCCA | TTT | chr6 | 160662450 | 160662471 | 160662455 | 160662450 | - |
| SEQ ID NO 42510 | TGTGGACGTGTTATCTTTCCAA | TTC | chr6 | 160662449 | 160662470 | 160662454 | 160662449 | - |
| SEQ ID NO 42511 | TGGACGTGTTATCTTTCCAATG | CTG | chr6 | 160662447 | 160662468 | 160662452 | 160662447 | - |
| SEQ ID NO 42512 | TCTTTCCAATGTGTGCTGGAAT | TTA | chr6 | 160662436 | 160662457 | 160662441 | 160662436 | - |
| SEQ ID NO 42513 | TCCAATGTGTGCTGGAATGCCC | CTT | chr6 | 160662432 | 160662453 | 160662437 | 160662432 | - |
| SEQ ID NO 42514 | CCAATGTGTGCTGGAATGCCCG | TTT | chr6 | 160662431 | 160662452 | 160662436 | 160662431 | - |
| SEQ ID NO 42515 | CAATGTGTGCTGGAATGCCCGG | TTC | chr6 | 160662430 | 160662451 | 160662435 | 160662430 | - |
| SEQ ID NO 42516 | GAATGCCCGGGGAGAGGAAAA | CTG | chr6 | 160662418 | 160662439 | 160662423 | 160662418 | - |
| SEQ ID NO 42517 | CTTTTACAGCCATGCTCAGTGA | TTT | chr6 | 160662392 | 160662413 | 160662397 | 160662392 | - |
| SEQ ID NO 42518 | TTTTACAGCCATGCTCAGTGAG | TTC | chr6 | 160662391 | 160662412 | 160662396 | 160662391 | - |
| SEQ ID NO 42519 | TTACAGCCATGCTCAGTGAGAA | CTT | chr6 | 160662389 | 160662410 | 160662394 | 160662389 | - |
| SEQ ID NO 42520 | TACAGCCATGCTCAGTGAGAAG | TTT | chr6 | 160662388 | 160662409 | 160662393 | 160662388 | - |
| SEQ ID NO 42521 | ACAGCCATGCTCAGTGAGAAGC | TTT | chr6 | 160662387 | 160662408 | 160662392 | 160662387 | - |
| SEQ ID NO 42522 | CAGCCATGCTCAGTGAGAAGCG | TTA | chr6 | 160662386 | 160662407 | 160662391 | 160662386 | - |
| SEQ ID NO 42523 | AGTGAGAAGCGGAGAAACATCT | CTC | chr6 | 160662375 | 160662396 | 160662380 | 160662375 | - |
| SEQ ID NO 42524 | CTATTCACAAATTGCTAAGTCT | CTT | chr6 | 160662352 | 160662373 | 160662357 | 160662352 | - |
| SEQ ID NO 42525 | TATTCACAAATTGCTAAGTCTT | TTC | chr6 | 160662351 | 160662372 | 160662356 | 160662351 | - |
| SEQ ID NO 42526 | TTCACAAATTGCTAAGTCTTTT | CTA | chr6 | 160662349 | 160662370 | 160662354 | 160662349 | - |
| SEQ ID NO 42527 | ACAAATTGCTAAGTCTTTTACA | TTC | chr6 | 160662346 | 160662367 | 160662351 | 160662346 | - |
| SEQ ID NO 42528 | CTAAGTCTTTTACACATGCAAA | TTG | chr6 | 160662338 | 160662359 | 160662343 | 160662338 | - |
| SEQ ID NO 42529 | AGTCTTTTACACATGCAAATAT | CTA | chr6 | 160662335 | 160662356 | 160662340 | 160662335 | - |
| SEQ ID NO 42530 | TTACACATGCAAATATGCATAC | CTT | chr6 | 160662329 | 160662350 | 160662334 | 160662329 | - |
| SEQ ID NO 42531 | TACACATGCAAATATGCATACA | TTT | chr6 | 160662328 | 160662349 | 160662333 | 160662328 | - |
| SEQ ID NO 42532 | ACACATGCAAATATGCATACAC | TTT | chr6 | 160662327 | 160662348 | 160662332 | 160662327 | - |
| SEQ ID NO 42533 | CACATGCAAATATGCATACACA | TTA | chr6 | 160662326 | 160662347 | 160662331 | 160662326 | - |
| SEQ ID NO 42534 | ACACACCACAGTGAGGAAGAAA | TTC | chr6 | 160662301 | 160662322 | 160662306 | 160662301 | - |
| SEQ ID NO 42535 | TCACACCATTAATAAAATACAT | TTC | chr6 | 160662276 | 160662297 | 160662281 | 160662276 | - |
| SEQ ID NO 42536 | ACACCATTAATAAAATACATTT | CTC | chr6 | 160662274 | 160662295 | 160662279 | 160662274 | - |
| SEQ ID NO 42537 | ATAAAATACATTTACTTCAGTA | TTA | chr6 | 160662265 | 160662286 | 160662270 | 160662265 | - |
| SEQ ID NO 42538 | ACTTCAGTAGCAATATACATCT | TTT | chr6 | 160662252 | 160662273 | 160662257 | 160662252 | - |
| SEQ ID NO 42539 | CTTCAGTAGCAATATACATCTA | TTA | chr6 | 160662251 | 160662272 | 160662256 | 160662251 | - |
| SEQ ID NO 42540 | CAGTAGCAATATACATCTACAT | CTT | chr6 | 160662248 | 160662269 | 160662253 | 160662248 | - |
| SEQ ID NO 42541 | AGTAGCAATATACATCTACATT | TTC | chr6 | 160662247 | 160662268 | 160662252 | 160662247 | - |
| SEQ ID NO 42542 | CATTTGCCTATAATATAAAAG | CTA | chr6 | 160662229 | 160662250 | 160662234 | 160662229 | - |
| SEQ ID NO 42543 | TGCCTATAATATAAAAGTATTT | TTT | chr6 | 160662224 | 160662245 | 160662229 | 160662224 | - |
| SEQ ID NO 42544 | GCCTATAATATAAAAGTATTTT | TTT | chr6 | 160662223 | 160662244 | 160662228 | 160662223 | - |

Figure 60 (Cont'd)

| SEQ ID NO 42545 | CCTATAATATAAAAGTATTTTT | TTG | chr6 | 160662222 | 160662243 | 160662227 | 160662222 | - |
|---|---|---|---|---|---|---|---|---|
| SEQ ID NO 42546 | TAATATAAAAGTATTTTTCCTA | CTA | chr6 | 160662218 | 160662239 | 160662223 | 160662218 | - |
| SEQ ID NO 42547 | TTCCTATTAAAAGATTTGTTTA | TTT | chr6 | 160662202 | 160662223 | 160662207 | 160662202 | - |
| SEQ ID NO 42548 | TCCTATTAAAAGATTTGTTTAA | TTT | chr6 | 160662201 | 160662222 | 160662206 | 160662201 | - |
| SEQ ID NO 42549 | CCTATTAAAAGATTTGTTTAAT | TTT | chr6 | 160662200 | 160662221 | 160662205 | 160662200 | - |
| SEQ ID NO 42550 | CTATTAAAAGATTTGTTTAATG | TTC | chr6 | 160662199 | 160662220 | 160662204 | 160662199 | - |
| SEQ ID NO 42551 | TTAAAAGATTTGTTTAATGTTT | CTA | chr6 | 160662196 | 160662217 | 160662201 | 160662196 | - |
| SEQ ID NO 42552 | AAAGATTTGTTTAATGTTTCTT | TTA | chr6 | 160662193 | 160662214 | 160662198 | 160662193 | - |
| SEQ ID NO 42553 | GTTTAATGTTTCTTCACCAACA | TTT | chr6 | 160662185 | 160662206 | 160662190 | 160662185 | - |
| SEQ ID NO 42554 | TTTAATGTTTCTTCACCAACAA | TTG | chr6 | 160662184 | 160662205 | 160662189 | 160662184 | - |
| SEQ ID NO 42555 | AATGTTTCTTCACCAACAAATA | TTT | chr6 | 160662181 | 160662202 | 160662186 | 160662181 | - |
| SEQ ID NO 42556 | ATGTTTCTTCACCAACAAATAA | TTA | chr6 | 160662180 | 160662201 | 160662185 | 160662180 | - |
| SEQ ID NO 42557 | CTTCACCAACAAATAAACCCTA | TTT | chr6 | 160662174 | 160662195 | 160662179 | 160662174 | - |
| SEQ ID NO 42558 | TTCACCAACAAATAAACCCTAT | TTC | chr6 | 160662173 | 160662194 | 160662178 | 160662173 | - |
| SEQ ID NO 42559 | CACCAACAAATAAACCCTATTA | CTT | chr6 | 160662171 | 160662192 | 160662176 | 160662171 | - |
| SEQ ID NO 42560 | ACCAACAAATAAACCCTATTAA | TTC | chr6 | 160662170 | 160662191 | 160662175 | 160662170 | - |
| SEQ ID NO 42561 | TTAAATCCCCATTGCCATATGA | CTA | chr6 | 160662152 | 160662173 | 160662157 | 160662152 | - |
| SEQ ID NO 42562 | AATCCCCATTGCCATATGAGCC | TTA | chr6 | 160662149 | 160662170 | 160662154 | 160662149 | - |
| SEQ ID NO 42563 | CCATATGAGCCCTGGAGGTGAA | TTG | chr6 | 160662138 | 160662159 | 160662143 | 160662138 | - |
| SEQ ID NO 42564 | GAGGTGAATCAGAGAAACAAAA | CTG | chr6 | 160662124 | 160662145 | 160662129 | 160662124 | - |
| SEQ ID NO 42565 | TGGAAAAATCATCAGGTTAAAA | TTG | chr6 | 160662096 | 160662117 | 160662101 | 160662096 | - |
| SEQ ID NO 42566 | AAAAAAGAAAAATTGATTCTGT | TTA | chr6 | 160662077 | 160662098 | 160662082 | 160662077 | - |
| SEQ ID NO 42567 | ATTCTGTTTTGGGATATTTCCT | TTG | chr6 | 160662062 | 160662083 | 160662067 | 160662062 | - |
| SEQ ID NO 42568 | TGTTTTGGGATATTTCCTAGCA | TTC | chr6 | 160662058 | 160662079 | 160662063 | 160662058 | - |
| SEQ ID NO 42569 | TTTTGGGATATTTCCTAGCAAC | CTG | chr6 | 160662056 | 160662077 | 160662061 | 160662056 | - |
| SEQ ID NO 42570 | TGGGATATTTCCTAGCAACATG | TTT | chr6 | 160662053 | 160662074 | 160662058 | 160662053 | - |
| SEQ ID NO 42571 | GGGATATTTCCTAGCAACATGA | TTT | chr6 | 160662052 | 160662073 | 160662057 | 160662052 | - |
| SEQ ID NO 42572 | GGATATTTCCTAGCAACATGAG | TTG | chr6 | 160662051 | 160662072 | 160662056 | 160662051 | - |
| SEQ ID NO 42573 | CCTAGCAACATGAGCTGGGGAG | TTT | chr6 | 160662043 | 160662064 | 160662048 | 160662043 | - |
| SEQ ID NO 42574 | CTAGCAACATGAGCTGGGGAGG | TTC | chr6 | 160662042 | 160662063 | 160662047 | 160662042 | - |
| SEQ ID NO 42575 | GCAACATGAGCTGGGGAGGGGA | CTA | chr6 | 160662039 | 160662060 | 160662044 | 160662039 | - |
| SEQ ID NO 42576 | GGGAGGGGATCTCAGCAGTGAT | CTG | chr6 | 160662026 | 160662047 | 160662031 | 160662026 | - |
| SEQ ID NO 42577 | AGCAGTGATGCTCTATGAAGCA | CTC | chr6 | 160662013 | 160662034 | 160662018 | 160662013 | - |
| SEQ ID NO 42578 | TATGAAGCATAATAAAATGACA | CTC | chr6 | 160662000 | 160662021 | 160662005 | 160662000 | - |
| SEQ ID NO 42579 | TGAAGCATAATAAAATGACACA | CTA | chr6 | 160661998 | 160662019 | 160662003 | 160661998 | - |
| SEQ ID NO 42580 | CAGGTAACTTAGTTAAAGGGGG | TTA | chr6 | 160661972 | 160661993 | 160661977 | 160661972 | - |
| SEQ ID NO 42581 | AGTTAAAGGGGGAAATAAATGG | CTT | chr6 | 160661962 | 160661983 | 160661967 | 160661962 | - |
| SEQ ID NO 42582 | GTTAAAGGGGGAAATAAATGGA | TTA | chr6 | 160661961 | 160661982 | 160661966 | 160661961 | - |
| SEQ ID NO 42583 | AAGGGGGAAATAAATGGAAGTT | TTA | chr6 | 160661957 | 160661978 | 160661962 | 160661957 | - |
| SEQ ID NO 42584 | CCTCTTTTTGAATATCAATTGT | TTT | chr6 | 160661934 | 160661955 | 160661939 | 160661934 | - |
| SEQ ID NO 42585 | CTCTTTTTGAATATCAATTGTA | TTC | chr6 | 160661933 | 160661954 | 160661938 | 160661933 | - |
| SEQ ID NO 42586 | TTTTTGAATATCAATTGTAGCC | CTC | chr6 | 160661930 | 160661951 | 160661935 | 160661930 | - |
| SEQ ID NO 42587 | TTTGAATATCAATTGTAGCCTG | CTT | chr6 | 160661928 | 160661949 | 160661933 | 160661928 | - |
| SEQ ID NO 42588 | TTGAATATCAATTGTAGCCTGC | TTT | chr6 | 160661927 | 160661948 | 160661932 | 160661927 | - |
| SEQ ID NO 42589 | TGAATATCAATTGTAGCCTGCT | TTT | chr6 | 160661926 | 160661947 | 160661931 | 160661926 | - |
| SEQ ID NO 42590 | GAATATCAATTGTAGCCTGCTC | TTT | chr6 | 160661925 | 160661946 | 160661930 | 160661925 | - |
| SEQ ID NO 42591 | AATATCAATTGTAGCCTGCTCT | TTG | chr6 | 160661924 | 160661945 | 160661929 | 160661924 | - |
| SEQ ID NO 42592 | TAGCCTGCTCTGCTACATTTCA | TTG | chr6 | 160661913 | 160661934 | 160661918 | 160661913 | - |
| SEQ ID NO 42593 | CTCTGCTACATTTCAAAACAC | CTG | chr6 | 160661906 | 160661927 | 160661911 | 160661906 | - |
| SEQ ID NO 42594 | TGCTACATTTCAAAACACTCT | CTC | chr6 | 160661903 | 160661924 | 160661908 | 160661903 | - |
| SEQ ID NO 42595 | CTACATTTCAAAACACTCTTC | CTG | chr6 | 160661901 | 160661922 | 160661906 | 160661901 | - |
| SEQ ID NO 42596 | CATTTCAAAACACTCTTCAAA | CTA | chr6 | 160661898 | 160661919 | 160661903 | 160661898 | - |
| SEQ ID NO 42597 | CAAAAACACTCTTCAAAATGTT | TTT | chr6 | 160661893 | 160661914 | 160661898 | 160661893 | - |
| SEQ ID NO 42598 | AAAAACACTCTTCAAAATGTTT | TTC | chr6 | 160661892 | 160661913 | 160661897 | 160661892 | - |
| SEQ ID NO 42599 | TTCAAAATGTTTAACTGAACTC | CTC | chr6 | 160661882 | 160661903 | 160661887 | 160661882 | - |
| SEQ ID NO 42600 | CAAAATGTTTAACTGAACTCAC | CTT | chr6 | 160661880 | 160661901 | 160661885 | 160661880 | - |
| SEQ ID NO 42601 | AAAATGTTTAACTGAACTCACT | TTC | chr6 | 160661879 | 160661900 | 160661884 | 160661879 | - |
| SEQ ID NO 42602 | AACTGAACTCACTGTAGGAAGC | TTT | chr6 | 160661870 | 160661891 | 160661875 | 160661870 | - |

Figure 60 (Cont'd)

| | | | | | | | | |
|---|---|---|---|---|---|---|---|---|
| SEQ ID NO 42603 | ACTGAACTCACTGTAGGAAGCA | TTA | chr6 | 160661869 | 160661890 | 160661874 | 160661869 | - |
| SEQ ID NO 42604 | AACTCACTGTAGGAAGCACCTT | CTG | chr6 | 160661865 | 160661886 | 160661870 | 160661865 | - |
| SEQ ID NO 42605 | ACTGTAGGAAGCACCTTATTAA | CTC | chr6 | 160661860 | 160661881 | 160661865 | 160661860 | - |
| SEQ ID NO 42606 | TAGGAAGCACCTTATTAATTTA | CTG | chr6 | 160661856 | 160661877 | 160661861 | 160661856 | - |
| SEQ ID NO 42607 | ATTAATTTATTGTGTGTTTTGA | CTT | chr6 | 160661843 | 160661864 | 160661848 | 160661843 | - |
| SEQ ID NO 42608 | TTAATTTATTGTGTGTTTTGAA | TTA | chr6 | 160661842 | 160661863 | 160661847 | 160661842 | - |
| SEQ ID NO 42609 | ATTTATTGTGTGTTTTGAAGTC | TTA | chr6 | 160661839 | 160661860 | 160661844 | 160661839 | - |
| SEQ ID NO 42610 | ATTGTGTGTTTTGAAGTCACAC | TTT | chr6 | 160661835 | 160661856 | 160661840 | 160661835 | - |
| SEQ ID NO 42611 | TTGTGTGTTTTGAAGTCACACT | TTA | chr6 | 160661834 | 160661855 | 160661839 | 160661834 | - |
| SEQ ID NO 42612 | TGTGTTTTGAAGTCACACTGTG | TTG | chr6 | 160661831 | 160661852 | 160661836 | 160661831 | - |
| SEQ ID NO 42613 | TGAAGTCACACTGTGAGCTATA | TTT | chr6 | 160661824 | 160661845 | 160661829 | 160661824 | - |
| SEQ ID NO 42614 | GAAGTCACACTGTGAGCTATAG | TTT | chr6 | 160661823 | 160661844 | 160661828 | 160661823 | - |
| SEQ ID NO 42615 | AAGTCACACTGTGAGCTATAGA | TTG | chr6 | 160661822 | 160661843 | 160661827 | 160661822 | - |
| SEQ ID NO 42616 | TGAGCTATAGAATTTACCCAAG | CTG | chr6 | 160661811 | 160661832 | 160661816 | 160661811 | - |
| SEQ ID NO 42617 | TAGAATTTACCCAAGCACAACT | CTA | chr6 | 160661804 | 160661825 | 160661809 | 160661804 | - |
| SEQ ID NO 42618 | ACCCAAGCACAACTCTTCCTGG | TTT | chr6 | 160661796 | 160661817 | 160661801 | 160661796 | - |
| SEQ ID NO 42619 | CCCAAGCACAACTCTTCCTGGA | TTA | chr6 | 160661795 | 160661816 | 160661800 | 160661795 | - |
| SEQ ID NO 42620 | TTCCTGGAAAAGAGAGTTCAAA | CTC | chr6 | 160661781 | 160661802 | 160661786 | 160661781 | - |
| SEQ ID NO 42621 | CCTGGAAAAGAGAGTTCAAATG | CTT | chr6 | 160661779 | 160661800 | 160661784 | 160661779 | - |
| SEQ ID NO 42622 | CTGGAAAAGAGAGTTCAAATGA | TTC | chr6 | 160661778 | 160661799 | 160661783 | 160661778 | - |
| SEQ ID NO 42623 | GAAAAGAGAGTTCAAATGAGAA | CTG | chr6 | 160661775 | 160661796 | 160661780 | 160661775 | - |
| SEQ ID NO 42624 | AAATGAGAAACAGTGCGGGGTG | TTC | chr6 | 160661762 | 160661783 | 160661767 | 160661762 | - |
| SEQ ID NO 42625 | AAATATCTATTTCTCAATGATA | CTA | chr6 | 160661720 | 160661741 | 160661725 | 160661720 | - |
| SEQ ID NO 42626 | TTTCTCAATGATATTTTGATAT | CTA | chr6 | 160661711 | 160661732 | 160661716 | 160661711 | - |
| SEQ ID NO 42627 | CTCAATGATATTTTGATATATC | TTT | chr6 | 160661708 | 160661729 | 160661713 | 160661708 | - |
| SEQ ID NO 42628 | TCAATGATATTTTGATATATCT | TTC | chr6 | 160661707 | 160661728 | 160661712 | 160661707 | - |
| SEQ ID NO 42629 | AATGATATTTTGATATATCTAT | CTC | chr6 | 160661705 | 160661726 | 160661710 | 160661705 | - |
| SEQ ID NO 42630 | TGATATATCTATCAAGTGCTTT | TTT | chr6 | 160661695 | 160661716 | 160661700 | 160661695 | - |
| SEQ ID NO 42631 | GATATATCTATCAAGTGCTTTT | TTT | chr6 | 160661694 | 160661715 | 160661699 | 160661694 | - |
| SEQ ID NO 42632 | ATATATCTATCAAGTGCTTTTT | TTG | chr6 | 160661693 | 160661714 | 160661698 | 160661693 | - |
| SEQ ID NO 42633 | TCAAGTGCTTTTTAGTGGATTA | CTA | chr6 | 160661684 | 160661705 | 160661689 | 160661684 | - |
| SEQ ID NO 42634 | TTTAGTGGATTAGGTTCAGAAT | CTT | chr6 | 160661674 | 160661695 | 160661679 | 160661674 | - |
| SEQ ID NO 42635 | TTAGTGGATTAGGTTCAGAATG | TTT | chr6 | 160661673 | 160661694 | 160661678 | 160661673 | - |
| SEQ ID NO 42636 | TAGTGGATTAGGTTCAGAATGC | TTT | chr6 | 160661672 | 160661693 | 160661677 | 160661672 | - |
| SEQ ID NO 42637 | AGTGGATTAGGTTCAGAATGCA | TTT | chr6 | 160661671 | 160661692 | 160661676 | 160661671 | - |
| SEQ ID NO 42638 | GTGGATTAGGTTCAGAATGCAT | TTA | chr6 | 160661670 | 160661691 | 160661675 | 160661670 | - |
| SEQ ID NO 42639 | GGTTCAGAATGCATCAGCCAAT | TTA | chr6 | 160661662 | 160661683 | 160661667 | 160661662 | - |
| SEQ ID NO 42640 | AGAATGCATCAGCCAATGCCTG | TTC | chr6 | 160661657 | 160661678 | 160661662 | 160661657 | - |
| SEQ ID NO 42641 | TTCAATAATCCAGTTTTCCAGC | CTG | chr6 | 160661635 | 160661656 | 160661640 | 160661635 | - |
| SEQ ID NO 42642 | AATAATCCAGTTTTCCAGCATA | TTC | chr6 | 160661632 | 160661653 | 160661637 | 160661632 | - |
| SEQ ID NO 42643 | TCCAGCATAGAGCATATTAAAT | TTT | chr6 | 160661619 | 160661640 | 160661624 | 160661619 | - |
| SEQ ID NO 42644 | CCAGCATAGAGCATATTAAATT | TTT | chr6 | 160661618 | 160661639 | 160661623 | 160661618 | - |
| SEQ ID NO 42645 | CAGCATAGAGCATATTAAATTG | TTC | chr6 | 160661617 | 160661638 | 160661622 | 160661617 | - |
| SEQ ID NO 42646 | AATTGAGGAAGGACAAAGTCAC | TTA | chr6 | 160661600 | 160661621 | 160661605 | 160661600 | - |
| SEQ ID NO 42647 | AGGAAGGACAAAGTCACAGAGG | TTG | chr6 | 160661595 | 160661616 | 160661600 | 160661595 | - |
| SEQ ID NO 42648 | TGGCCAAGGACTTTGCATGAAA | CTG | chr6 | 160661555 | 160661576 | 160661560 | 160661555 | - |
| SEQ ID NO 42649 | TGCATGAAACAGTGAGCGTGCA | CTT | chr6 | 160661542 | 160661563 | 160661547 | 160661542 | - |
| SEQ ID NO 42650 | GCATGAAACAGTGAGCGTGCAT | TTT | chr6 | 160661541 | 160661562 | 160661546 | 160661541 | - |
| SEQ ID NO 42651 | CATGAAACAGTGAGCGTGCATC | TTG | chr6 | 160661540 | 160661561 | 160661545 | 160661540 | - |
| SEQ ID NO 42652 | CTCCTTGCCCTGCCCTCATGGT | CTC | chr6 | 160661515 | 160661536 | 160661520 | 160661515 | - |
| SEQ ID NO 42653 | CTTGCCCTGCCCTCATGGTCTG | CTC | chr6 | 160661512 | 160661533 | 160661517 | 160661512 | - |
| SEQ ID NO 42654 | GCCCTGCCCTCATGGTCTGTGT | CTT | chr6 | 160661509 | 160661530 | 160661514 | 160661509 | - |
| SEQ ID NO 42655 | CCCTGCCCTCATGGTCTGTGTA | TTG | chr6 | 160661508 | 160661529 | 160661513 | 160661508 | - |
| SEQ ID NO 42656 | CCCTCATGGTCTGTGTACTCTC | CTG | chr6 | 160661503 | 160661524 | 160661508 | 160661503 | - |
| SEQ ID NO 42657 | ATGGTCTGTGTACTCTCAGGAG | CTC | chr6 | 160661498 | 160661519 | 160661503 | 160661498 | - |
| SEQ ID NO 42658 | TGTACTCTCAGGAGGTCAGGAC | CTG | chr6 | 160661490 | 160661511 | 160661495 | 160661490 | - |
| SEQ ID NO 42659 | TCAGGAGGTCAGGACAGGCCTT | CTC | chr6 | 160661483 | 160661504 | 160661488 | 160661483 | - |
| SEQ ID NO 42660 | AGGAGGTCAGGACAGGCCTTTC | CTC | chr6 | 160661481 | 160661502 | 160661486 | 160661481 | - |

Figure 60 (Cont'd)

| | | | | | | | | |
|---|---|---|---|---|---|---|---|---|
| SEQ ID NO 42661 | TCTGAGAATGAGAATCTGTTCA | CTT | chr6 | 160661461 | 160661482 | 160661466 | 160661461 | - |
| SEQ ID NO 42662 | CTGAGAATGAGAATCTGTTCAT | TTT | chr6 | 160661460 | 160661481 | 160661465 | 160661460 | - |
| SEQ ID NO 42663 | TGAGAATGAGAATCTGTTCATC | TTC | chr6 | 160661459 | 160661480 | 160661464 | 160661459 | - |
| SEQ ID NO 42664 | AGAATGAGAATCTGTTCATCTG | CTG | chr6 | 160661457 | 160661478 | 160661462 | 160661457 | - |
| SEQ ID NO 42665 | TTCATCTGCCTTTCTACTGGAT | CTG | chr6 | 160661443 | 160661464 | 160661448 | 160661443 | - |
| SEQ ID NO 42666 | ATCTGCCTTTCTACTGGATACT | TTC | chr6 | 160661440 | 160661461 | 160661445 | 160661440 | - |
| SEQ ID NO 42667 | CCTTTCTACTGGATACTTGTCA | CTG | chr6 | 160661435 | 160661456 | 160661440 | 160661435 | - |
| SEQ ID NO 42668 | TCTACTGGATACTTGTCATCGG | CTT | chr6 | 160661431 | 160661452 | 160661436 | 160661431 | - |
| SEQ ID NO 42669 | CTACTGGATACTTGTCATCGGC | TTT | chr6 | 160661430 | 160661451 | 160661435 | 160661430 | - |
| SEQ ID NO 42670 | TACTGGATACTTGTCATCGGCA | TTC | chr6 | 160661429 | 160661450 | 160661434 | 160661429 | - |
| SEQ ID NO 42671 | CTGGATACTTGTCATCGGCATA | CTA | chr6 | 160661427 | 160661448 | 160661432 | 160661427 | - |
| SEQ ID NO 42672 | GATACTTGTCATCGGCATACAA | CTG | chr6 | 160661424 | 160661445 | 160661429 | 160661424 | - |
| SEQ ID NO 42673 | GTCATCGGCATACAAACACATG | CTT | chr6 | 160661417 | 160661438 | 160661422 | 160661417 | - |
| SEQ ID NO 42674 | TCATCGGCATACAAACACATGT | TTG | chr6 | 160661416 | 160661437 | 160661421 | 160661416 | - |
| SEQ ID NO 42675 | TCTGCAGTGTGTCATCTTTCAG | TTC | chr6 | 160661392 | 160661413 | 160661397 | 160661392 | - |
| SEQ ID NO 42676 | TGCAGTGTGTCATCTTTCAGAA | CTC | chr6 | 160661390 | 160661411 | 160661395 | 160661390 | - |
| SEQ ID NO 42677 | CAGTGTGTCATCTTTCAGAACC | CTG | chr6 | 160661388 | 160661409 | 160661393 | 160661388 | - |
| SEQ ID NO 42678 | TCAGAACCTCCCCTGACCCTGT | CTT | chr6 | 160661374 | 160661395 | 160661379 | 160661374 | - |
| SEQ ID NO 42679 | CAGAACCTCCCCTGACCCTGTA | TTT | chr6 | 160661373 | 160661394 | 160661378 | 160661373 | - |
| SEQ ID NO 42680 | AGAACCTCCCCTGACCCTGTAT | TTC | chr6 | 160661372 | 160661393 | 160661377 | 160661372 | - |
| SEQ ID NO 42681 | CCCTGACCCTGTATTCCCTAGA | CTC | chr6 | 160661364 | 160661385 | 160661369 | 160661364 | - |
| SEQ ID NO 42682 | ACCCTGTATTCCCTAGAAGTCT | CTG | chr6 | 160661359 | 160661380 | 160661364 | 160661359 | - |
| SEQ ID NO 42683 | TATTCCCTAGAAGTCTCGCTGC | CTG | chr6 | 160661353 | 160661374 | 160661358 | 160661353 | - |
| SEQ ID NO 42684 | CCTAGAAGTCTCGCTGCTTTCA | TTC | chr6 | 160661348 | 160661369 | 160661353 | 160661348 | - |
| SEQ ID NO 42685 | GAAGTCTCGCTGCTTTCAGAGC | CTA | chr6 | 160661344 | 160661365 | 160661349 | 160661344 | - |
| SEQ ID NO 42686 | GCTGCTTTCAGAGCCAGGCTTC | CTC | chr6 | 160661336 | 160661357 | 160661341 | 160661336 | - |
| SEQ ID NO 42687 | CTTTCAGAGCCAGGCTTCTCTC | CTG | chr6 | 160661332 | 160661353 | 160661337 | 160661332 | - |
| SEQ ID NO 42688 | TCAGAGCCAGGCTTCTCTCCTG | CTT | chr6 | 160661329 | 160661350 | 160661334 | 160661329 | - |
| SEQ ID NO 42689 | CAGAGCCAGGCTTCTCTCCTGC | TTT | chr6 | 160661328 | 160661349 | 160661333 | 160661328 | - |
| SEQ ID NO 42690 | AGAGCCAGGCTTCTCTCCTGCT | TTC | chr6 | 160661327 | 160661348 | 160661332 | 160661327 | - |
| SEQ ID NO 42691 | CTCTCCTGCTGCCACCCCCACT | CTT | chr6 | 160661315 | 160661336 | 160661320 | 160661315 | - |
| SEQ ID NO 42692 | TCTCCTGCTGCCACCCCCACTG | TTC | chr6 | 160661314 | 160661335 | 160661319 | 160661314 | - |
| SEQ ID NO 42693 | TCCTGCTGCCACCCCCACTGCT | CTC | chr6 | 160661312 | 160661333 | 160661317 | 160661312 | - |
| SEQ ID NO 42694 | CTGCTGCCACCCCCACTGCTCT | CTC | chr6 | 160661310 | 160661331 | 160661315 | 160661310 | - |
| SEQ ID NO 42695 | CTGCCACCCCCACTGCTCTTCT | CTG | chr6 | 160661307 | 160661328 | 160661312 | 160661307 | - |
| SEQ ID NO 42696 | CCACCCCCACTGCTCTTCTAGT | CTG | chr6 | 160661304 | 160661325 | 160661309 | 160661304 | - |
| SEQ ID NO 42697 | CTCTTCTAGTCACTCTTTAACC | CTG | chr6 | 160661292 | 160661313 | 160661297 | 160661292 | - |
| SEQ ID NO 42698 | TTCTAGTCACTCTTTAACCCAC | CTC | chr6 | 160661289 | 160661310 | 160661294 | 160661289 | - |
| SEQ ID NO 42699 | CTAGTCACTCTTTAACCCACTC | CTT | chr6 | 160661287 | 160661308 | 160661292 | 160661287 | - |
| SEQ ID NO 42700 | TAGTCACTCTTTAACCCACTCC | TTC | chr6 | 160661286 | 160661307 | 160661291 | 160661286 | - |
| SEQ ID NO 42701 | GTCACTCTTTAACCCACTCCAT | CTA | chr6 | 160661284 | 160661305 | 160661289 | 160661284 | - |
| SEQ ID NO 42702 | TTTAACCCACTCCATCTGCATG | CTC | chr6 | 160661277 | 160661298 | 160661282 | 160661277 | - |
| SEQ ID NO 42703 | TAACCCACTCCATCTGCATGTG | CTT | chr6 | 160661275 | 160661296 | 160661280 | 160661275 | - |
| SEQ ID NO 42704 | AACCCACTCCATCTGCATGTGG | TTT | chr6 | 160661274 | 160661295 | 160661279 | 160661274 | - |
| SEQ ID NO 42705 | ACCCACTCCATCTGCATGTGGC | TTA | chr6 | 160661273 | 160661294 | 160661278 | 160661273 | - |
| SEQ ID NO 42706 | CATCTGCATGTGGCCCCCACCA | CTC | chr6 | 160661265 | 160661286 | 160661270 | 160661265 | - |
| SEQ ID NO 42707 | CATGTGGCCCCCACCACACCCC | CTG | chr6 | 160661259 | 160661280 | 160661264 | 160661259 | - |
| SEQ ID NO 42708 | AAAGTGGTCAAGGTTGTCCTGT | CTC | chr6 | 160661235 | 160661256 | 160661240 | 160661235 | - |
| SEQ ID NO 42709 | TCCTGTTGCTTAATTCCATGGA | TTG | chr6 | 160661219 | 160661240 | 160661224 | 160661219 | - |
| SEQ ID NO 42710 | TTGCTTAATTCCATGGAAGCTT | CTG | chr6 | 160661214 | 160661235 | 160661219 | 160661214 | - |
| SEQ ID NO 42711 | CTTAATTCCATGGAAGCTTGGC | TTG | chr6 | 160661211 | 160661232 | 160661216 | 160661211 | - |
| SEQ ID NO 42712 | AATTCCATGGAAGCTTGGCTAT | CTT | chr6 | 160661208 | 160661229 | 160661213 | 160661208 | - |
| SEQ ID NO 42713 | ATTCCATGGAAGCTTGGCTATC | TTA | chr6 | 160661207 | 160661228 | 160661212 | 160661207 | - |
| SEQ ID NO 42714 | CATGGAAGCTTGGCTATCTTCA | TTC | chr6 | 160661203 | 160661224 | 160661208 | 160661203 | - |
| SEQ ID NO 42715 | GGCTATCTTCATTTTATTAGCC | CTT | chr6 | 160661192 | 160661213 | 160661197 | 160661192 | - |
| SEQ ID NO 42716 | GCTATCTTCATTTTATTAGCCT | TTG | chr6 | 160661191 | 160661212 | 160661196 | 160661191 | - |
| SEQ ID NO 42717 | TCTTCATTTTATTAGCCTCTTT | CTA | chr6 | 160661187 | 160661208 | 160661192 | 160661187 | - |
| SEQ ID NO 42718 | CATTTTATTAGCCTCTTTTGGC | CTT | chr6 | 160661183 | 160661204 | 160661188 | 160661183 | - |

Figure 60 (Cont'd)

| | | | | | | | | |
|---|---|---|---|---|---|---|---|---|
| SEQ ID NO 42719 | ATTTTATTAGCCTCTTTTGGCC | TTC | chr6 | 160661182 | 160661203 | 160661187 | 160661182 | - |
| SEQ ID NO 42720 | TATTAGCCTCTTTTGGCCTCT | TTT | chr6 | 160661178 | 160661199 | 160661183 | 160661178 | - |
| SEQ ID NO 42721 | ATTAGCCTCTTTTGGCCTCTCA | TTT | chr6 | 160661177 | 160661198 | 160661182 | 160661177 | - |
| SEQ ID NO 42722 | TTAGCCTCTTTTGGCCTCTCAC | TTA | chr6 | 160661176 | 160661197 | 160661181 | 160661176 | - |
| SEQ ID NO 42723 | GCCTCTTTTGGCCTCTCACCCT | TTA | chr6 | 160661173 | 160661194 | 160661178 | 160661173 | - |
| SEQ ID NO 42724 | TTTTGGCCTCTCACCCTGTGAA | CTC | chr6 | 160661168 | 160661189 | 160661173 | 160661168 | - |
| SEQ ID NO 42725 | TTGGCCTCTCACCCTGTGAAAA | CTT | chr6 | 160661166 | 160661187 | 160661171 | 160661166 | - |
| SEQ ID NO 42726 | TGGCCTCTCACCCTGTGAAAAT | TTT | chr6 | 160661165 | 160661186 | 160661170 | 160661165 | - |
| SEQ ID NO 42727 | GGCCTCTCACCCTGTGAAAATC | TTT | chr6 | 160661164 | 160661185 | 160661169 | 160661164 | - |
| SEQ ID NO 42728 | GCCTCTCACCCTGTGAAAATCA | TTG | chr6 | 160661163 | 160661184 | 160661168 | 160661163 | - |
| SEQ ID NO 42729 | TCACCCTGTGAAAATCACTACA | CTC | chr6 | 160661158 | 160661179 | 160661163 | 160661158 | - |
| SEQ ID NO 42730 | ACCCTGTGAAAATCACTACATT | CTC | chr6 | 160661156 | 160661177 | 160661161 | 160661156 | - |
| SEQ ID NO 42731 | TGAAAATCACTACATTTTGTGC | CTG | chr6 | 160661150 | 160661171 | 160661155 | 160661150 | - |
| SEQ ID NO 42732 | CATTTTGTGCCAGAGATGGAGC | CTA | chr6 | 160661138 | 160661159 | 160661143 | 160661138 | - |
| SEQ ID NO 42733 | TGTGCCAGAGATGGAGCTGGCA | TTT | chr6 | 160661133 | 160661154 | 160661138 | 160661133 | - |
| SEQ ID NO 42734 | GTGCCAGAGATGGAGCTGGCAT | TTT | chr6 | 160661132 | 160661153 | 160661137 | 160661132 | - |
| SEQ ID NO 42735 | TGCCAGAGATGGAGCTGGCATC | TTG | chr6 | 160661131 | 160661152 | 160661136 | 160661131 | - |
| SEQ ID NO 42736 | GCATCTCAGGCTTGGAAGAGG | CTG | chr6 | 160661114 | 160661135 | 160661119 | 160661114 | - |
| SEQ ID NO 42737 | CAGGCTTGGAAGAGGGCTGCTG | CTC | chr6 | 160661107 | 160661128 | 160661112 | 160661107 | - |
| SEQ ID NO 42738 | GGAAGAGGGCTGCTGAAGCTCA | CTT | chr6 | 160661100 | 160661121 | 160661105 | 160661100 | - |
| SEQ ID NO 42739 | GAAGAGGGCTGCTGAAGCTCAG | TTG | chr6 | 160661099 | 160661120 | 160661104 | 160661099 | - |
| SEQ ID NO 42740 | CTGAAGCTCAGCCAGGTGTCCT | CTG | chr6 | 160661088 | 160661109 | 160661093 | 160661088 | - |
| SEQ ID NO 42741 | AAGCTCAGCCAGGTGTCCTAAG | CTG | chr6 | 160661085 | 160661106 | 160661090 | 160661085 | - |
| SEQ ID NO 42742 | AGCCAGGTGTCCTAAGGAGCCT | CTC | chr6 | 160661079 | 160661100 | 160661084 | 160661079 | - |
| SEQ ID NO 42743 | AGGAGCCTCAGGACAGGGGATG | CTA | chr6 | 160661065 | 160661086 | 160661070 | 160661065 | - |
| SEQ ID NO 42744 | AGGACAGGGGATGCTCAGTAGC | CTC | chr6 | 160661056 | 160661077 | 160661061 | 160661056 | - |
| SEQ ID NO 42745 | AGTAGCCTTGCAATGGGAACAC | CTC | chr6 | 160661040 | 160661061 | 160661045 | 160661040 | - |
| SEQ ID NO 42746 | GCAATGGGAACACAGCTGAGCC | CTT | chr6 | 160661031 | 160661052 | 160661036 | 160661031 | - |
| SEQ ID NO 42747 | CAATGGGAACACAGCTGAGCCC | TTG | chr6 | 160661030 | 160661051 | 160661035 | 160661030 | - |
| SEQ ID NO 42748 | AGCCCACTTGGCCACCCTTTG | CTG | chr6 | 160661013 | 160661034 | 160661018 | 160661013 | - |
| SEQ ID NO 42749 | GGCCACCCTTTGCCACAACCAG | CTT | chr6 | 160661003 | 160661024 | 160661008 | 160661003 | - |
| SEQ ID NO 42750 | GCCACCCTTTGCCACAACCAGG | TTG | chr6 | 160661002 | 160661023 | 160661007 | 160661002 | - |
| SEQ ID NO 42751 | TGCCACAACCAGGCAGAAAGCA | CTT | chr6 | 160660993 | 160661014 | 160660998 | 160660993 | - |
| SEQ ID NO 42752 | GCCACAACCAGGCAGAAAGCAG | TTT | chr6 | 160660992 | 160661013 | 160660997 | 160660992 | - |
| SEQ ID NO 42753 | CCACAACCAGGCAGAAAGCAGC | TTG | chr6 | 160660991 | 160661012 | 160660996 | 160660991 | - |
| SEQ ID NO 42754 | TTGAACAGATTTGTTGCCTCAG | CTT | chr6 | 160660967 | 160660988 | 160660972 | 160660967 | - |
| SEQ ID NO 42755 | TGAACAGATTTGTTGCCTCAGA | TTT | chr6 | 160660966 | 160660987 | 160660971 | 160660966 | - |
| SEQ ID NO 42756 | GAACAGATTTGTTGCCTCAGAT | TTT | chr6 | 160660965 | 160660986 | 160660970 | 160660965 | - |
| SEQ ID NO 42757 | AACAGATTTGTTGCCTCAGATT | TTG | chr6 | 160660964 | 160660985 | 160660969 | 160660964 | - |
| SEQ ID NO 42758 | GTTGCCTCAGATTTGATCTCAA | TTT | chr6 | 160660955 | 160660976 | 160660960 | 160660955 | - |
| SEQ ID NO 42759 | TTGCCTCAGATTTGATCTCAAA | TTG | chr6 | 160660954 | 160660975 | 160660959 | 160660954 | - |
| SEQ ID NO 42760 | CCTCAGATTTGATCTCAAAGAA | TTG | chr6 | 160660951 | 160660972 | 160660956 | 160660951 | - |
| SEQ ID NO 42761 | AGATTTGATCTCAAAGAAAAT | CTC | chr6 | 160660947 | 160660968 | 160660952 | 160660947 | - |
| SEQ ID NO 42762 | GATCTCAAAGAAAATCGTGGG | TTT | chr6 | 160660941 | 160660962 | 160660946 | 160660941 | - |
| SEQ ID NO 42763 | ATCTCAAAGAAAATCGTGGGC | TTG | chr6 | 160660940 | 160660961 | 160660945 | 160660940 | - |
| SEQ ID NO 42764 | AAAGAAAATCGTGGGCAGTAT | CTC | chr6 | 160660935 | 160660956 | 160660940 | 160660935 | - |
| SEQ ID NO 42765 | GTCCCAGGTTCTGCTTTTTTAC | TTG | chr6 | 160660911 | 160660932 | 160660916 | 160660911 | - |
| SEQ ID NO 42766 | TGCTTTTTTACAATTTCCTCTG | TTC | chr6 | 160660900 | 160660921 | 160660905 | 160660900 | - |
| SEQ ID NO 42767 | CTTTTTTACAATTTCCTCTGAA | CTG | chr6 | 160660898 | 160660919 | 160660903 | 160660898 | - |
| SEQ ID NO 42768 | TTTTACAATTTCCTCTGAAATC | CTT | chr6 | 160660895 | 160660916 | 160660900 | 160660895 | - |
| SEQ ID NO 42769 | TTTACAATTTCCTCTGAAATCT | TTT | chr6 | 160660894 | 160660915 | 160660899 | 160660894 | - |
| SEQ ID NO 42770 | TTACAATTTCCTCTGAAATCTG | TTT | chr6 | 160660893 | 160660914 | 160660898 | 160660893 | - |
| SEQ ID NO 42771 | TACAATTTCCTCTGAAATCTGG | TTT | chr6 | 160660892 | 160660913 | 160660897 | 160660892 | - |
| SEQ ID NO 42772 | ACAATTTCCTCTGAAATCTGGA | TTT | chr6 | 160660891 | 160660912 | 160660896 | 160660891 | - |
| SEQ ID NO 42773 | CAATTTCCTCTGAAATCTGGAT | TTA | chr6 | 160660890 | 160660911 | 160660895 | 160660890 | - |
| SEQ ID NO 42774 | CCTCTGAAATCTGGATGCCTAT | TTT | chr6 | 160660884 | 160660905 | 160660889 | 160660884 | - |
| SEQ ID NO 42775 | CTCTGAAATCTGGATGCCTATC | TTC | chr6 | 160660883 | 160660904 | 160660888 | 160660883 | - |
| SEQ ID NO 42776 | TGAAATCTGGATGCCTATCAAC | CTC | chr6 | 160660880 | 160660901 | 160660885 | 160660880 | - |

Figure 60 (Cont'd)

| | | | | | | | | |
|---|---|---|---|---|---|---|---|---|
| SEQ ID NO 42777 | AAATCTGGATGCCTATCAACAC | CTG | chr6 | 160660878 | 160660899 | 160660883 | 160660878 | - |
| SEQ ID NO 42778 | GATGCCTATCAACACCTTGGAA | CTG | chr6 | 160660871 | 160660892 | 160660876 | 160660871 | - |
| SEQ ID NO 42779 | TCAACACCTTGGAAAAACTGAA | CTA | chr6 | 160660863 | 160660884 | 160660868 | 160660863 | - |
| SEQ ID NO 42780 | GGAAAAACTGAATTCTCCCCAA | CTT | chr6 | 160660853 | 160660874 | 160660858 | 160660853 | - |
| SEQ ID NO 42781 | GAAAAACTGAATTCTCCCCAAC | TTG | chr6 | 160660852 | 160660873 | 160660857 | 160660852 | - |
| SEQ ID NO 42782 | AATTCTCCCCAACTAATAGTGG | CTG | chr6 | 160660843 | 160660864 | 160660848 | 160660843 | - |
| SEQ ID NO 42783 | TCCCCAACTAATAGTGGTGTGT | TTC | chr6 | 160660838 | 160660859 | 160660843 | 160660838 | - |
| SEQ ID NO 42784 | CCCAACTAATAGTGGTGTGTCA | CTC | chr6 | 160660836 | 160660857 | 160660841 | 160660836 | - |
| SEQ ID NO 42785 | ATAGTGGTGTGTCACTGTAGTA | CTA | chr6 | 160660828 | 160660849 | 160660833 | 160660828 | - |
| SEQ ID NO 42786 | TAGTAAGCCTAGTACAAAAATG | CTG | chr6 | 160660811 | 160660832 | 160660816 | 160660811 | - |
| SEQ ID NO 42787 | GTACAAAAATGGCCTTCTTTGT | CTA | chr6 | 160660800 | 160660821 | 160660805 | 160660800 | - |
| SEQ ID NO 42788 | CTTTGTGGAGGAGCTTCATATC | CTT | chr6 | 160660784 | 160660805 | 160660789 | 160660784 | - |
| SEQ ID NO 42789 | TTTGTGGAGGAGCTTCATATCC | TTC | chr6 | 160660783 | 160660804 | 160660788 | 160660783 | - |
| SEQ ID NO 42790 | TGTGGAGGAGCTTCATATCCTC | CTT | chr6 | 160660781 | 160660802 | 160660786 | 160660781 | - |
| SEQ ID NO 42791 | GTGGAGGAGCTTCATATCCTCC | TTT | chr6 | 160660780 | 160660801 | 160660785 | 160660780 | - |
| SEQ ID NO 42792 | TGGAGGAGCTTCATATCCTCCA | TTG | chr6 | 160660779 | 160660800 | 160660784 | 160660779 | - |
| SEQ ID NO 42793 | CATATCCTCCATTTTTTTTTTG | CTT | chr6 | 160660768 | 160660789 | 160660773 | 160660768 | - |
| SEQ ID NO 42794 | ATATCCTCCATTTTTTTTTTGC | TTC | chr6 | 160660767 | 160660788 | 160660772 | 160660767 | - |
| SEQ ID NO 42795 | CATTTTTTTTTGCTTAATTTTT | CTC | chr6 | 160660759 | 160660780 | 160660764 | 160660759 | - |
| SEQ ID NO 42796 | TTTTTTTGCTTAATTTTTGCCC | TTT | chr6 | 160660754 | 160660775 | 160660759 | 160660754 | - |
| SEQ ID NO 42797 | TTTTTTGCTTAATTTTTGCCCA | TTT | chr6 | 160660753 | 160660774 | 160660758 | 160660753 | - |
| SEQ ID NO 42798 | TTTTTGCTTAATTTTTGCCCAA | TTT | chr6 | 160660752 | 160660773 | 160660757 | 160660752 | - |
| SEQ ID NO 42799 | TTTTGCTTAATTTTTGCCCAAG | TTT | chr6 | 160660751 | 160660772 | 160660756 | 160660751 | - |
| SEQ ID NO 42800 | TTTGCTTAATTTTTGCCCAAGA | TTT | chr6 | 160660750 | 160660771 | 160660755 | 160660750 | - |
| SEQ ID NO 42801 | TTGCTTAATTTTTGCCCAAGAT | TTT | chr6 | 160660749 | 160660770 | 160660754 | 160660749 | - |
| SEQ ID NO 42802 | TGCTTAATTTTTGCCCAAGATG | TTT | chr6 | 160660748 | 160660769 | 160660753 | 160660748 | - |
| SEQ ID NO 42803 | GCTTAATTTTTGCCCAAGATGA | TTT | chr6 | 160660747 | 160660768 | 160660752 | 160660747 | - |
| SEQ ID NO 42804 | CTTAATTTTTGCCCAAGATGAG | TTG | chr6 | 160660746 | 160660767 | 160660751 | 160660746 | - |
| SEQ ID NO 42805 | AATTTTTGCCCAAGATGAGAAC | CTT | chr6 | 160660743 | 160660764 | 160660748 | 160660743 | - |
| SEQ ID NO 42806 | ATTTTTGCCCAAGATGAGAACA | TTA | chr6 | 160660742 | 160660763 | 160660747 | 160660742 | - |
| SEQ ID NO 42807 | TTGCCCAAGATGAGAACATAAT | TTT | chr6 | 160660738 | 160660759 | 160660743 | 160660738 | - |
| SEQ ID NO 42808 | TGCCCAAGATGAGAACATAATT | TTT | chr6 | 160660737 | 160660758 | 160660742 | 160660737 | - |
| SEQ ID NO 42809 | GCCCAAGATGAGAACATAATTT | TTT | chr6 | 160660736 | 160660757 | 160660741 | 160660736 | - |
| SEQ ID NO 42810 | CCCAAGATGAGAACATAATTTA | TTG | chr6 | 160660735 | 160660756 | 160660740 | 160660735 | - |
| SEQ ID NO 42811 | AGTTCACTTTTTATTTATTCCC | TTT | chr6 | 160660714 | 160660735 | 160660719 | 160660714 | - |
| SEQ ID NO 42812 | GTTCACTTTTTATTTATTCCCA | TTA | chr6 | 160660713 | 160660734 | 160660718 | 160660713 | - |
| SEQ ID NO 42813 | ACTTTTTATTTATTCCCAACAT | TTC | chr6 | 160660709 | 160660730 | 160660714 | 160660709 | - |
| SEQ ID NO 42814 | TTTATTTATTCCCAACATCATC | CTT | chr6 | 160660705 | 160660726 | 160660710 | 160660705 | - |
| SEQ ID NO 42815 | TTATTTATTCCCAACATCATCC | TTT | chr6 | 160660704 | 160660725 | 160660709 | 160660704 | - |
| SEQ ID NO 42816 | TATTTATTCCCAACATCATCCA | TTT | chr6 | 160660703 | 160660724 | 160660708 | 160660703 | - |
| SEQ ID NO 42817 | ATTTATTCCCAACATCATCCAT | TTT | chr6 | 160660702 | 160660723 | 160660707 | 160660702 | - |
| SEQ ID NO 42818 | TTTATTCCCAACATCATCCATG | TTA | chr6 | 160660701 | 160660722 | 160660706 | 160660701 | - |
| SEQ ID NO 42819 | ATTCCCAACATCATCCATGCAC | TTT | chr6 | 160660698 | 160660719 | 160660703 | 160660698 | - |
| SEQ ID NO 42820 | TTCCCAACATCATCCATGCACC | TTA | chr6 | 160660697 | 160660718 | 160660702 | 160660697 | - |
| SEQ ID NO 42821 | CCAACATCATCCATGCACCAAC | TTC | chr6 | 160660694 | 160660715 | 160660699 | 160660694 | - |
| SEQ ID NO 42822 | TTGTAACTAAAGGAGGGACCAT | TTT | chr6 | 160660668 | 160660689 | 160660673 | 160660668 | - |
| SEQ ID NO 42823 | TGTAACTAAAGGAGGGACCATT | TTT | chr6 | 160660667 | 160660688 | 160660672 | 160660667 | - |
| SEQ ID NO 42824 | GTAACTAAAGGAGGGACCATTC | TTT | chr6 | 160660666 | 160660687 | 160660671 | 160660666 | - |
| SEQ ID NO 42825 | TAACTAAAGGAGGGACCATTCA | TTG | chr6 | 160660665 | 160660686 | 160660670 | 160660665 | - |
| SEQ ID NO 42826 | AAGGAGGGACCATTCAGAAGAT | CTA | chr6 | 160660659 | 160660680 | 160660664 | 160660659 | - |
| SEQ ID NO 42827 | AGAAGATGCTTATCAACTGTCA | TTC | chr6 | 160660644 | 160660665 | 160660649 | 160660644 | - |
| SEQ ID NO 42828 | ATCAACTGTCAAAGTGACAGTG | CTT | chr6 | 160660633 | 160660654 | 160660638 | 160660633 | - |
| SEQ ID NO 42829 | TCAACTGTCAAAGTGACAGTGT | TTA | chr6 | 160660632 | 160660653 | 160660637 | 160660632 | - |
| SEQ ID NO 42830 | TCAAAGTGACAGTGTTACAACC | CTG | chr6 | 160660625 | 160660646 | 160660630 | 160660625 | - |
| SEQ ID NO 42831 | CAACCAATGCACATATTGTAAG | TTA | chr6 | 160660608 | 160660629 | 160660613 | 160660608 | - |
| SEQ ID NO 42832 | TAAGAAATCAAACAATGGCCTC | TTG | chr6 | 160660590 | 160660611 | 160660595 | 160660590 | - |
| SEQ ID NO 42833 | CAAGGTTCATTTCTACACAGGG | CTC | chr6 | 160660568 | 160660589 | 160660573 | 160660568 | - |
| SEQ ID NO 42834 | ATTTCTACACAGGGATTAGCAG | TTC | chr6 | 160660560 | 160660581 | 160660565 | 160660560 | - |

Figure 60 (Cont'd)

| | | | | | | | | |
|---|---|---|---|---|---|---|---|---|
| SEQ ID NO 42835 | CTACACAGGGATTAGCAGATCA | TTT | chr6 | 160660556 | 160660577 | 160660561 | 160660556 | - |
| SEQ ID NO 42836 | TACACAGGGATTAGCAGATCAA | TTC | chr6 | 160660555 | 160660576 | 160660560 | 160660555 | - |
| SEQ ID NO 42837 | CACAGGGATTAGCAGATCAACA | CTA | chr6 | 160660553 | 160660574 | 160660558 | 160660553 | - |
| SEQ ID NO 42838 | GCAGATCAACATCAATCTTGGC | TTA | chr6 | 160660542 | 160660563 | 160660547 | 160660542 | - |
| SEQ ID NO 42839 | GGCAACACAGTTGCCACTGATG | CTT | chr6 | 160660523 | 160660544 | 160660528 | 160660523 | - |
| SEQ ID NO 42840 | GCAACACAGTTGCCACTGATGG | TTG | chr6 | 160660522 | 160660543 | 160660527 | 160660522 | - |
| SEQ ID NO 42841 | CCACTGATGGTGTCTTATTTTT | TTG | chr6 | 160660510 | 160660531 | 160660515 | 160660510 | - |
| SEQ ID NO 42842 | ATGGTGTCTTATTTTTTTTATC | CTG | chr6 | 160660504 | 160660525 | 160660509 | 160660504 | - |
| SEQ ID NO 42843 | ATTTTTTTTATCATGACATGGC | CTT | chr6 | 160660494 | 160660515 | 160660499 | 160660494 | - |
| SEQ ID NO 42844 | TTTTTTTTATCATGACATGGCA | TTA | chr6 | 160660493 | 160660514 | 160660498 | 160660493 | - |
| SEQ ID NO 42845 | TTTTTATCATGACATGGCAATC | TTT | chr6 | 160660490 | 160660511 | 160660495 | 160660490 | - |
| SEQ ID NO 42846 | TTTTATCATGACATGGCAATCA | TTT | chr6 | 160660489 | 160660510 | 160660494 | 160660489 | - |
| SEQ ID NO 42847 | TTTATCATGACATGGCAATCAA | TTT | chr6 | 160660488 | 160660509 | 160660493 | 160660488 | - |
| SEQ ID NO 42848 | TTATCATGACATGGCAATCAAG | TTT | chr6 | 160660487 | 160660508 | 160660492 | 160660487 | - |
| SEQ ID NO 42849 | TATCATGACATGGCAATCAAGA | TTT | chr6 | 160660486 | 160660507 | 160660491 | 160660486 | - |
| SEQ ID NO 42850 | ATCATGACATGGCAATCAAGAG | TTT | chr6 | 160660485 | 160660506 | 160660490 | 160660485 | - |
| SEQ ID NO 42851 | TCATGACATGGCAATCAAGAGC | TTA | chr6 | 160660484 | 160660505 | 160660489 | 160660484 | - |
| SEQ ID NO 42852 | ATTCTTATTTAAGATTTTATGG | TTT | chr6 | 160660451 | 160660472 | 160660456 | 160660451 | - |
| SEQ ID NO 42853 | TTCTTATTTAAGATTTTATGGT | TTA | chr6 | 160660450 | 160660471 | 160660455 | 160660450 | - |
| SEQ ID NO 42854 | TTATTTAAGATTTTATGGTTAG | TTC | chr6 | 160660447 | 160660468 | 160660452 | 160660447 | - |
| SEQ ID NO 42855 | ATTTAAGATTTTATGGTTAGAC | CTT | chr6 | 160660445 | 160660466 | 160660450 | 160660445 | - |
| SEQ ID NO 42856 | TTTAAGATTTTATGGTTAGACT | TTA | chr6 | 160660444 | 160660465 | 160660449 | 160660444 | - |
| SEQ ID NO 42857 | AAGATTTTATGGTTAGACTAGG | TTT | chr6 | 160660441 | 160660462 | 160660446 | 160660441 | - |
| SEQ ID NO 42858 | AGATTTTATGGTTAGACTAGGC | TTA | chr6 | 160660440 | 160660461 | 160660445 | 160660440 | - |
| SEQ ID NO 42859 | TATGGTTAGACTAGGCAGATAG | TTT | chr6 | 160660434 | 160660455 | 160660439 | 160660434 | - |
| SEQ ID NO 42860 | ATGGTTAGACTAGGCAGATAGC | TTT | chr6 | 160660433 | 160660454 | 160660438 | 160660433 | - |
| SEQ ID NO 42861 | TGGTTAGACTAGGCAGATAGCT | TTA | chr6 | 160660432 | 160660453 | 160660437 | 160660432 | - |
| SEQ ID NO 42862 | GACTAGGCAGATAGCTAGATAT | TTA | chr6 | 160660426 | 160660447 | 160660431 | 160660426 | - |
| SEQ ID NO 42863 | GGCAGATAGCTAGATATGAGCA | CTA | chr6 | 160660421 | 160660442 | 160660426 | 160660421 | - |
| SEQ ID NO 42864 | GATATGAGCAGGAGGTGGAAGC | CTA | chr6 | 160660409 | 160660430 | 160660414 | 160660409 | - |
| SEQ ID NO 42865 | AGAGAATGGAGGTCTGGAGAAT | CTG | chr6 | 160660382 | 160660403 | 160660387 | 160660382 | - |
| SEQ ID NO 42866 | GAGAATCTGAAACCCCAGAGAT | CTG | chr6 | 160660366 | 160660387 | 160660371 | 160660366 | - |
| SEQ ID NO 42867 | AAACCCCAGAGATTACCCAAGT | CTG | chr6 | 160660357 | 160660378 | 160660362 | 160660357 | - |
| SEQ ID NO 42868 | CCCAAGTCCTGCATGCTAGACA | TTA | chr6 | 160660342 | 160660363 | 160660347 | 160660342 | - |
| SEQ ID NO 42869 | CATGCTAGACATGAGTGGAGGA | CTG | chr6 | 160660331 | 160660352 | 160660336 | 160660331 | - |
| SEQ ID NO 42870 | GACATGAGTGGAGGAGGGGGAA | CTA | chr6 | 160660324 | 160660345 | 160660329 | 160660324 | - |
| SEQ ID NO 42871 | GGTAGAAAAGAATGCCCCTTAA | CTA | chr6 | 160660296 | 160660317 | 160660301 | 160660296 | - |
| SEQ ID NO 42872 | AAGATGCCCAGCAGTCGCTCAC | CTT | chr6 | 160660276 | 160660297 | 160660281 | 160660276 | - |
| SEQ ID NO 42873 | AGATGCCCAGCAGTCGCTCACT | TTA | chr6 | 160660275 | 160660296 | 160660280 | 160660275 | - |
| SEQ ID NO 42874 | ACTGTGCAGTTAACTTTTCAGA | CTC | chr6 | 160660256 | 160660277 | 160660261 | 160660256 | - |
| SEQ ID NO 42875 | TGCAGTTAACTTTTCAGAATGC | CTG | chr6 | 160660252 | 160660273 | 160660257 | 160660252 | - |
| SEQ ID NO 42876 | ACTTTTCAGAATGCTGCTAGAT | TTA | chr6 | 160660244 | 160660265 | 160660249 | 160660244 | - |
| SEQ ID NO 42877 | TTCAGAATGCTGCTAGATACAT | CTT | chr6 | 160660240 | 160660261 | 160660245 | 160660240 | - |
| SEQ ID NO 42878 | TCAGAATGCTGCTAGATACATG | TTT | chr6 | 160660239 | 160660260 | 160660244 | 160660239 | - |
| SEQ ID NO 42879 | CAGAATGCTGCTAGATACATGC | TTT | chr6 | 160660238 | 160660259 | 160660243 | 160660238 | - |
| SEQ ID NO 42880 | AGAATGCTGCTAGATACATGCT | TTC | chr6 | 160660237 | 160660258 | 160660242 | 160660237 | - |
| SEQ ID NO 42881 | CTAGATACATGCTGATAGGGAG | CTG | chr6 | 160660228 | 160660249 | 160660233 | 160660228 | - |
| SEQ ID NO 42882 | GATACATGCTGATAGGGAGGGA | CTA | chr6 | 160660225 | 160660246 | 160660230 | 160660225 | - |
| SEQ ID NO 42883 | ATAGGGAGGGAAGAGGGCAAAG | CTG | chr6 | 160660214 | 160660235 | 160660219 | 160660214 | - |
| SEQ ID NO 42884 | CTAAGAGATACACGGTTGCAGT | TTC | chr6 | 160660183 | 160660204 | 160660188 | 160660183 | - |
| SEQ ID NO 42885 | AGAGATACACGGTTGCAGTTAG | CTA | chr6 | 160660180 | 160660201 | 160660185 | 160660180 | - |
| SEQ ID NO 42886 | CAGTTAGTATACATCTGAGTGC | TTG | chr6 | 160660165 | 160660186 | 160660170 | 160660165 | - |
| SEQ ID NO 42887 | GTATACATCTGAGTGCTATACA | TTA | chr6 | 160660159 | 160660180 | 160660164 | 160660159 | - |
| SEQ ID NO 42888 | AGTGCTATACAACCTTCTTTGG | CTG | chr6 | 160660148 | 160660169 | 160660153 | 160660148 | - |
| SEQ ID NO 42889 | TACAACCTTCTTTGGGTGGTGG | CTA | chr6 | 160660141 | 160660162 | 160660146 | 160660141 | - |
| SEQ ID NO 42890 | CTTTGGGTGGTGGCAAGAAGCA | CTT | chr6 | 160660132 | 160660153 | 160660137 | 160660132 | - |
| SEQ ID NO 42891 | TTTGGGTGGTGGCAAGAAGCAA | TTC | chr6 | 160660131 | 160660152 | 160660136 | 160660131 | - |
| SEQ ID NO 42892 | TGGGTGGTGGCAAGAAGCAATG | CTT | chr6 | 160660129 | 160660150 | 160660134 | 160660129 | - |

Figure 60 (Cont'd)

| | | | | | | | | |
|---|---|---|---|---|---|---|---|---|
| SEQ ID NO 42893 | GGGTGGTGGCAAGAAGCAATGC | TTT | chr6 | 160660128 | 160660149 | 160660133 | 160660128 | - |
| SEQ ID NO 42894 | GGTGGTGGCAAGAAGCAATGCA | TTG | chr6 | 160660127 | 160660148 | 160660132 | 160660127 | - |
| SEQ ID NO 42895 | CGTAGAATTCATATCAAACACC | TTA | chr6 | 160660098 | 160660119 | 160660103 | 160660098 | - |
| SEQ ID NO 42896 | ATATCAAACACCTGTATCACAG | TTC | chr6 | 160660088 | 160660109 | 160660093 | 160660088 | - |
| SEQ ID NO 42897 | TATCACAGGTGTTAAAGAAACA | CTG | chr6 | 160660074 | 160660095 | 160660079 | 160660074 | - |
| SEQ ID NO 42898 | AAGAAACAAGAAACATTGTACT | TTA | chr6 | 160660060 | 160660081 | 160660065 | 160660060 | - |
| SEQ ID NO 42899 | TACTTCTTGTATTCTTAATAAT | TTG | chr6 | 160660042 | 160660063 | 160660047 | 160660042 | - |
| SEQ ID NO 42900 | CTTGTATTCTTAATAATGATTT | CTT | chr6 | 160660037 | 160660058 | 160660042 | 160660037 | - |
| SEQ ID NO 42901 | TTGTATTCTTAATAATGATTTG | TTC | chr6 | 160660036 | 160660057 | 160660041 | 160660036 | - |
| SEQ ID NO 42902 | GTATTCTTAATAATGATTTGCA | CTT | chr6 | 160660034 | 160660055 | 160660039 | 160660034 | - |
| SEQ ID NO 42903 | TATTCTTAATAATGATTTGCAA | TTG | chr6 | 160660033 | 160660054 | 160660038 | 160660033 | - |
| SEQ ID NO 42904 | TTAATAATGATTTGCAATATTG | TTC | chr6 | 160660028 | 160660049 | 160660033 | 160660028 | - |
| SEQ ID NO 42905 | AATAATGATTTGCAATATTGTC | CTT | chr6 | 160660026 | 160660047 | 160660031 | 160660026 | - |
| SEQ ID NO 42906 | ATAATGATTTGCAATATTGTCT | TTA | chr6 | 160660025 | 160660046 | 160660030 | 160660025 | - |
| SEQ ID NO 42907 | GCAATATTGTCTTTAGTATCAC | TTT | chr6 | 160660015 | 160660036 | 160660020 | 160660015 | - |
| SEQ ID NO 42908 | CAATATTGTCTTTAGTATCACT | TTG | chr6 | 160660014 | 160660035 | 160660019 | 160660014 | - |
| SEQ ID NO 42909 | TCTTTAGTATCACTGCAAACCT | TTG | chr6 | 160660006 | 160660027 | 160660011 | 160660006 | - |
| SEQ ID NO 42910 | TAGTATCACTGCAAACCTCTAT | CTT | chr6 | 160660002 | 160660023 | 160660007 | 160660002 | - |
| SEQ ID NO 42911 | AGTATCACTGCAAACCTCTATA | TTT | chr6 | 160660001 | 160660022 | 160660006 | 160660001 | - |
| SEQ ID NO 42912 | GTATCACTGCAAACCTCTATAA | TTA | chr6 | 160660000 | 160660021 | 160660005 | 160660000 | - |
| SEQ ID NO 42913 | CAAACCTCTATAAATATGATTT | CTG | chr6 | 160659991 | 160660012 | 160659996 | 160659991 | - |
| SEQ ID NO 42914 | TATAAATATGATTTTTAAAAAG | CTC | chr6 | 160659983 | 160660004 | 160659988 | 160659983 | - |
| SEQ ID NO 42915 | TAAATATGATTTTTAAAAAGTA | CTA | chr6 | 160659981 | 160660002 | 160659986 | 160659981 | - |
| SEQ ID NO 42916 | TTAAAAGTATTTCTTTAGGTT | TTT | chr6 | 160659969 | 160659990 | 160659974 | 160659969 | - |
| SEQ ID NO 42917 | TAAAAGTATTTCTTTAGGTTG | TTT | chr6 | 160659968 | 160659989 | 160659973 | 160659968 | - |
| SEQ ID NO 42918 | AAAAGTATTTCTTTAGGTTGG | TTT | chr6 | 160659967 | 160659988 | 160659972 | 160659967 | - |
| SEQ ID NO 42919 | AAAAGTATTTCTTTAGGTTGGA | TTA | chr6 | 160659966 | 160659987 | 160659971 | 160659966 | - |
| SEQ ID NO 42920 | CTTTAGGTTGGAATTACTTCTA | TTT | chr6 | 160659956 | 160659977 | 160659961 | 160659956 | - |
| SEQ ID NO 42921 | TTTAGGTTGGAATTACTTCTAC | TTC | chr6 | 160659955 | 160659976 | 160659960 | 160659955 | - |
| SEQ ID NO 42922 | TAGGTTGGAATTACTTCTACGC | CTT | chr6 | 160659953 | 160659974 | 160659958 | 160659953 | - |
| SEQ ID NO 42923 | AGGTTGGAATTACTTCTACGCA | TTT | chr6 | 160659952 | 160659973 | 160659957 | 160659952 | - |
| SEQ ID NO 42924 | GGTTGGAATTACTTCTACGCAT | TTA | chr6 | 160659951 | 160659972 | 160659956 | 160659951 | - |
| SEQ ID NO 42925 | GAATTACTTCTACGCATTGACT | TTG | chr6 | 160659946 | 160659967 | 160659951 | 160659946 | - |
| SEQ ID NO 42926 | CTTCTACGCATTGACTTATCTT | TTA | chr6 | 160659940 | 160659961 | 160659945 | 160659940 | - |
| SEQ ID NO 42927 | CTACGCATTGACTTATCTTCCT | CTT | chr6 | 160659937 | 160659958 | 160659942 | 160659937 | - |
| SEQ ID NO 42928 | TACGCATTGACTTATCTTCCTG | TTC | chr6 | 160659936 | 160659957 | 160659941 | 160659936 | - |
| SEQ ID NO 42929 | CGCATTGACTTATCTTCCTGGG | CTA | chr6 | 160659934 | 160659955 | 160659939 | 160659934 | - |
| SEQ ID NO 42930 | ACTTATCTTCCTGGGTTTCATT | TTG | chr6 | 160659927 | 160659948 | 160659932 | 160659927 | - |
| SEQ ID NO 42931 | ATCTTCCTGGGTTTCATTAGCC | CTT | chr6 | 160659923 | 160659944 | 160659928 | 160659923 | - |
| SEQ ID NO 42932 | TCTTCCTGGGTTTCATTAGCCG | TTA | chr6 | 160659922 | 160659943 | 160659927 | 160659922 | - |
| SEQ ID NO 42933 | CCTGGGTTTCATTAGCCGTACC | CTT | chr6 | 160659918 | 160659939 | 160659923 | 160659918 | - |
| SEQ ID NO 42934 | CTGGGTTTCATTAGCCGTACCC | TTC | chr6 | 160659917 | 160659938 | 160659922 | 160659917 | - |
| SEQ ID NO 42935 | GGTTTCATTAGCCGTACCCGTT | CTG | chr6 | 160659914 | 160659935 | 160659919 | 160659914 | - |
| SEQ ID NO 42936 | CATTAGCCGTACCCGTTGTACT | TTT | chr6 | 160659909 | 160659930 | 160659914 | 160659909 | - |
| SEQ ID NO 42937 | ATTAGCCGTACCCGTTGTACTT | TTC | chr6 | 160659908 | 160659929 | 160659913 | 160659908 | - |
| SEQ ID NO 42938 | GCCGTACCCGTTGTACTTTCTT | TTA | chr6 | 160659904 | 160659925 | 160659909 | 160659904 | - |
| SEQ ID NO 42939 | TACTTTCTTCCTTACCACTGTT | TTG | chr6 | 160659891 | 160659912 | 160659896 | 160659891 | - |
| SEQ ID NO 42940 | TCTTCCTTACCACTGTTTATCT | CTT | chr6 | 160659886 | 160659907 | 160659891 | 160659886 | - |
| SEQ ID NO 42941 | CTTCCTTACCACTGTTTATCTC | TTT | chr6 | 160659885 | 160659906 | 160659890 | 160659885 | - |
| SEQ ID NO 42942 | TTCCTTACCACTGTTTATCTCA | TTC | chr6 | 160659884 | 160659905 | 160659889 | 160659884 | - |
| SEQ ID NO 42943 | CCTTACCACTGTTTATCTCAAA | CTT | chr6 | 160659882 | 160659903 | 160659887 | 160659882 | - |
| SEQ ID NO 42944 | CTTACCACTGTTTATCTCAAAC | TTC | chr6 | 160659881 | 160659902 | 160659886 | 160659881 | - |
| SEQ ID NO 42945 | ACCACTGTTTATCTCAAACTCT | CTT | chr6 | 160659878 | 160659899 | 160659883 | 160659878 | - |
| SEQ ID NO 42946 | CCACTGTTTATCTCAAACTCTT | TTA | chr6 | 160659877 | 160659898 | 160659882 | 160659877 | - |
| SEQ ID NO 42947 | TTTATCTCAAACTCTTGAGATT | CTG | chr6 | 160659871 | 160659892 | 160659876 | 160659871 | - |
| SEQ ID NO 42948 | ATCTCAAACTCTTGAGATTAAA | TTT | chr6 | 160659868 | 160659889 | 160659873 | 160659868 | - |
| SEQ ID NO 42949 | TCTCAAACTCTTGAGATTAAAG | TTA | chr6 | 160659867 | 160659888 | 160659872 | 160659867 | - |
| SEQ ID NO 42950 | AAACTCTTGAGATTAAAGTATG | CTC | chr6 | 160659863 | 160659884 | 160659868 | 160659863 | - |

Figure 60 (Cont'd)

| | | | | | | | | |
|---|---|---|---|---|---|---|---|---|
| SEQ ID NO 42951 | TTGAGATTAAAGTATGGGCTCA | CTC | chr6 | 160659857 | 160659878 | 160659862 | 160659857 | - |
| SEQ ID NO 42952 | GAGATTAAAGTATGGGCTCAGG | CTT | chr6 | 160659855 | 160659876 | 160659860 | 160659855 | - |
| SEQ ID NO 42953 | AGATTAAAGTATGGGCTCAGGA | TTG | chr6 | 160659854 | 160659875 | 160659859 | 160659854 | - |
| SEQ ID NO 42954 | AAGTATGGGCTCAGGAGGGAGC | TTA | chr6 | 160659848 | 160659869 | 160659853 | 160659848 | - |
| SEQ ID NO 42955 | AGGAGGGAGCGAGGAGCTTCAG | CTC | chr6 | 160659836 | 160659857 | 160659841 | 160659836 | - |
| SEQ ID NO 42956 | CAGGACTCTCACGGACCTCCAG | CTT | chr6 | 160659817 | 160659838 | 160659822 | 160659817 | - |
| SEQ ID NO 42957 | AGGACTCTCACGGACCTCCAGC | TTC | chr6 | 160659816 | 160659837 | 160659821 | 160659816 | - |
| SEQ ID NO 42958 | TCACGGACCTCCAGCACAGTGT | CTC | chr6 | 160659809 | 160659830 | 160659814 | 160659809 | - |
| SEQ ID NO 42959 | ACGGACCTCCAGCACAGTGTAG | CTC | chr6 | 160659807 | 160659828 | 160659812 | 160659807 | - |
| SEQ ID NO 42960 | CAGCACAGTGTAGCTGCCTTAT | CTC | chr6 | 160659798 | 160659819 | 160659803 | 160659798 | - |
| SEQ ID NO 42961 | CCTTATGGAAAAGTGGCCACAC | CTG | chr6 | 160659782 | 160659803 | 160659787 | 160659782 | - |
| SEQ ID NO 42962 | ATGGAAAAGTGGCCACACTGTT | CTT | chr6 | 160659778 | 160659799 | 160659783 | 160659778 | - |
| SEQ ID NO 42963 | TGGAAAAGTGGCCACACTGTTT | TTA | chr6 | 160659777 | 160659798 | 160659782 | 160659777 | - |
| SEQ ID NO 42964 | TTTTCTGCACTGGTCCCTGCCC | CTG | chr6 | 160659758 | 160659779 | 160659763 | 160659758 | - |
| SEQ ID NO 42965 | TCTGCACTGGTCCCTGCCCCTA | TTT | chr6 | 160659755 | 160659776 | 160659760 | 160659755 | - |
| SEQ ID NO 42966 | CTGCACTGGTCCCTGCCCCTAC | TTT | chr6 | 160659754 | 160659775 | 160659759 | 160659754 | - |
| SEQ ID NO 42967 | TGCACTGGTCCCTGCCCCTACT | TTC | chr6 | 160659753 | 160659774 | 160659758 | 160659753 | - |
| SEQ ID NO 42968 | CACTGGTCCCTGCCCCTACTAT | CTG | chr6 | 160659751 | 160659772 | 160659756 | 160659751 | - |
| SEQ ID NO 42969 | GTCCCTGCCCCTACTATTCCTC | CTG | chr6 | 160659746 | 160659767 | 160659751 | 160659746 | - |
| SEQ ID NO 42970 | CCCCTACTATTCCTCACTGGGC | CTG | chr6 | 160659739 | 160659760 | 160659744 | 160659739 | - |
| SEQ ID NO 42971 | CTATTCCTCACTGGGCAGAGCA | CTA | chr6 | 160659733 | 160659754 | 160659738 | 160659733 | - |
| SEQ ID NO 42972 | TTCCTCACTGGGCAGAGCACAG | CTA | chr6 | 160659730 | 160659751 | 160659735 | 160659730 | - |
| SEQ ID NO 42973 | CTCACTGGGCAGAGCACAGCCA | TTC | chr6 | 160659727 | 160659748 | 160659732 | 160659727 | - |
| SEQ ID NO 42974 | ACTGGGCAGAGCACAGCCACCC | CTC | chr6 | 160659724 | 160659745 | 160659729 | 160659724 | - |
| SEQ ID NO 42975 | GGCAGAGCACAGCCACCCTGGC | CTG | chr6 | 160659720 | 160659741 | 160659725 | 160659720 | - |
| SEQ ID NO 42976 | GCCCTGCCTGAACATTTTAGTC | CTG | chr6 | 160659700 | 160659721 | 160659705 | 160659700 | - |
| SEQ ID NO 42977 | CCTGAACATTTTAGTCAGTGTT | CTG | chr6 | 160659694 | 160659715 | 160659699 | 160659694 | - |
| SEQ ID NO 42978 | AACATTTTAGTCAGTGTTGGCT | CTG | chr6 | 160659690 | 160659711 | 160659695 | 160659690 | - |
| SEQ ID NO 42979 | TAGTCAGTGTTGGCTCTGTGCT | TTT | chr6 | 160659683 | 160659704 | 160659688 | 160659683 | - |
| SEQ ID NO 42980 | AGTCAGTGTTGGCTCTGTGCTT | TTT | chr6 | 160659682 | 160659703 | 160659687 | 160659682 | - |
| SEQ ID NO 42981 | GTCAGTGTTGGCTCTGTGCTTC | TTA | chr6 | 160659681 | 160659702 | 160659686 | 160659681 | - |
| SEQ ID NO 42982 | GCTCTGTGCTTCTCTGGGGAGG | TTG | chr6 | 160659671 | 160659692 | 160659676 | 160659671 | - |
| SEQ ID NO 42983 | TGTGCTTCTCTGGGGAGGAAAT | CTC | chr6 | 160659667 | 160659688 | 160659672 | 160659667 | - |
| SEQ ID NO 42984 | TGCTTCTCTGGGGAGGAAATCC | CTG | chr6 | 160659665 | 160659686 | 160659670 | 160659665 | - |
| SEQ ID NO 42985 | CTCTGGGGAGGAAATCCAAGAG | CTT | chr6 | 160659660 | 160659681 | 160659665 | 160659660 | - |
| SEQ ID NO 42986 | TCTGGGGAGGAAATCCAAGAGA | TTC | chr6 | 160659659 | 160659680 | 160659664 | 160659659 | - |
| SEQ ID NO 42987 | TGGGGAGGAAATCCAAGAGACA | CTC | chr6 | 160659657 | 160659678 | 160659662 | 160659657 | - |
| SEQ ID NO 42988 | GGGAGGAAATCCAAGAGACAAC | CTG | chr6 | 160659655 | 160659676 | 160659660 | 160659655 | - |
| SEQ ID NO 42989 | TGCCATTTCAGCTGCAGCAGTA | CTC | chr6 | 160659621 | 160659642 | 160659626 | 160659621 | - |
| SEQ ID NO 42990 | CCATTTCAGCTGCAGCAGTACC | CTG | chr6 | 160659619 | 160659640 | 160659624 | 160659619 | - |
| SEQ ID NO 42991 | CAGCTGCAGCAGTACCACCGTT | TTT | chr6 | 160659613 | 160659634 | 160659618 | 160659613 | - |
| SEQ ID NO 42992 | AGCTGCAGCAGTACCACCGTTA | TTC | chr6 | 160659612 | 160659633 | 160659617 | 160659612 | - |
| SEQ ID NO 42993 | CAGCAGTACCACCGTTAATGCC | CTG | chr6 | 160659607 | 160659628 | 160659612 | 160659607 | - |
| SEQ ID NO 42994 | ATGCCCTTGGGCTTGAGAAAGA | TTA | chr6 | 160659590 | 160659611 | 160659595 | 160659590 | - |
| SEQ ID NO 42995 | GGGCTTGAGAAAGAAGGGACCT | CTT | chr6 | 160659582 | 160659603 | 160659587 | 160659582 | - |
| SEQ ID NO 42996 | GGCTTGAGAAAGAAGGGACCTG | TTG | chr6 | 160659581 | 160659602 | 160659586 | 160659581 | - |
| SEQ ID NO 42997 | GAGAAAGAAGGGACCTGGCCAC | CTT | chr6 | 160659576 | 160659597 | 160659581 | 160659576 | - |
| SEQ ID NO 42998 | AGAAAGAAGGGACCTGGCCACT | TTG | chr6 | 160659575 | 160659596 | 160659580 | 160659575 | - |
| SEQ ID NO 42999 | GCCACTTCCTGACACCTCCAG | CTG | chr6 | 160659559 | 160659580 | 160659564 | 160659559 | - |
| SEQ ID NO 43000 | CCCTGACACCTCCAGCACACAG | CTT | chr6 | 160659552 | 160659573 | 160659557 | 160659552 | - |
| SEQ ID NO 43001 | CCTGACACCTCCAGCACACAGC | TTC | chr6 | 160659551 | 160659572 | 160659556 | 160659551 | - |
| SEQ ID NO 43002 | ACACCTCCAGCACACAGCAGGG | CTG | chr6 | 160659547 | 160659568 | 160659552 | 160659547 | - |
| SEQ ID NO 43003 | CAGCACACAGCAGGGAAAGAAT | CTC | chr6 | 160659540 | 160659561 | 160659545 | 160659540 | - |
| SEQ ID NO 43004 | CAGTTTCTCTTTCTTGTGAGCT | TTC | chr6 | 160659516 | 160659537 | 160659521 | 160659516 | - |
| SEQ ID NO 43005 | CTCTTTCTTGTGAGCTTTCACC | TTT | chr6 | 160659510 | 160659531 | 160659515 | 160659510 | - |
| SEQ ID NO 43006 | TCTTTCTTGTGAGCTTTCACCT | TTC | chr6 | 160659509 | 160659530 | 160659514 | 160659509 | - |
| SEQ ID NO 43007 | TTTCTTGTGAGCTTTCACCTGC | CTC | chr6 | 160659507 | 160659528 | 160659512 | 160659507 | - |
| SEQ ID NO 43008 | TCTTGTGAGCTTTCACCTGCTA | CTT | chr6 | 160659505 | 160659526 | 160659510 | 160659505 | - |

Figure 60 (Cont'd)

| | | | | | | | | |
|---|---|---|---|---|---|---|---|---|
| SEQ ID NO 43009 | CTTGTGAGCTTTCACCTGCTAC | TTT | chr6 | 160659504 | 160659525 | 160659509 | 160659504 | - |
| SEQ ID NO 43010 | TTGTGAGCTTTCACCTGCTACT | TTC | chr6 | 160659503 | 160659524 | 160659508 | 160659503 | - |
| SEQ ID NO 43011 | GTGAGCTTTCACCTGCTACTCT | CTT | chr6 | 160659501 | 160659522 | 160659506 | 160659501 | - |
| SEQ ID NO 43012 | TGAGCTTTCACCTGCTACTCTT | TTG | chr6 | 160659500 | 160659521 | 160659505 | 160659500 | - |
| SEQ ID NO 43013 | TCACCTGCTACTCTTCACCAGG | CTT | chr6 | 160659493 | 160659514 | 160659498 | 160659493 | - |
| SEQ ID NO 43014 | CACCTGCTACTCTTCACCAGGC | TTT | chr6 | 160659492 | 160659513 | 160659497 | 160659492 | - |
| SEQ ID NO 43015 | ACCTGCTACTCTTCACCAGGCA | TTC | chr6 | 160659491 | 160659512 | 160659496 | 160659491 | - |
| SEQ ID NO 43016 | CTACTCTTCACCAGGCAAGGCT | CTG | chr6 | 160659486 | 160659507 | 160659491 | 160659486 | - |
| SEQ ID NO 43017 | CTCTTCACCAGGCAAGGCTCCT | CTA | chr6 | 160659483 | 160659504 | 160659488 | 160659483 | - |
| SEQ ID NO 43018 | TTCACCAGGCAAGGCTCCTGGC | CTC | chr6 | 160659480 | 160659501 | 160659485 | 160659480 | - |
| SEQ ID NO 43019 | CACCAGGCAAGGCTCCTGGCTT | CTT | chr6 | 160659478 | 160659499 | 160659483 | 160659478 | - |
| SEQ ID NO 43020 | ACCAGGCAAGGCTCCTGGCTTG | TTC | chr6 | 160659477 | 160659498 | 160659482 | 160659477 | - |
| SEQ ID NO 43021 | CTGGCTTGGGCCCACAGTGCAG | CTC | chr6 | 160659463 | 160659484 | 160659468 | 160659463 | - |
| SEQ ID NO 43022 | GCTTGGGCCCACAGTGCAGGCA | CTG | chr6 | 160659460 | 160659481 | 160659465 | 160659460 | - |
| SEQ ID NO 43023 | GGGCCCACAGTGCAGGCACCTC | CTT | chr6 | 160659456 | 160659477 | 160659461 | 160659456 | - |
| SEQ ID NO 43024 | GGCCCACAGTGCAGGCACCTCG | TTG | chr6 | 160659455 | 160659476 | 160659460 | 160659455 | - |
| SEQ ID NO 43025 | GAACTCAGTTGAACATTTCCAC | CTC | chr6 | 160659434 | 160659455 | 160659439 | 160659434 | - |
| SEQ ID NO 43026 | AGTTGAACATTTCCACTGGCTG | CTC | chr6 | 160659428 | 160659449 | 160659433 | 160659428 | - |
| SEQ ID NO 43027 | AACATTTCCACTGGCTGCACTC | TTG | chr6 | 160659423 | 160659444 | 160659428 | 160659423 | - |
| SEQ ID NO 43028 | CCACTGGCTGCACTCTGTGTTT | TTT | chr6 | 160659416 | 160659437 | 160659421 | 160659416 | - |
| SEQ ID NO 43029 | CACTGGCTGCACTCTGTGTTTT | TTC | chr6 | 160659415 | 160659436 | 160659420 | 160659415 | - |
| SEQ ID NO 43030 | GCTGCACTCTGTGTTTTTGTGG | CTG | chr6 | 160659410 | 160659431 | 160659415 | 160659410 | - |
| SEQ ID NO 43031 | CACTCTGTGTTTTTGTGGGGTG | CTG | chr6 | 160659406 | 160659427 | 160659411 | 160659406 | - |
| SEQ ID NO 43032 | TGTGTTTTTGTGGGGTGAAGCT | CTC | chr6 | 160659401 | 160659422 | 160659406 | 160659401 | - |
| SEQ ID NO 43033 | TGTTTTTGTGGGGTGAAGCTCC | CTG | chr6 | 160659399 | 160659420 | 160659404 | 160659399 | - |
| SEQ ID NO 43034 | TTGTGGGGTGAAGCTCCCAGAG | TTT | chr6 | 160659394 | 160659415 | 160659399 | 160659394 | - |
| SEQ ID NO 43035 | TGTGGGGTGAAGCTCCCAGAGG | TTT | chr6 | 160659393 | 160659414 | 160659398 | 160659393 | - |
| SEQ ID NO 43036 | GTGGGGTGAAGCTCCCAGAGGT | TTT | chr6 | 160659392 | 160659413 | 160659397 | 160659392 | - |
| SEQ ID NO 43037 | TGGGGTGAAGCTCCCAGAGGTG | TTG | chr6 | 160659391 | 160659412 | 160659396 | 160659391 | - |
| SEQ ID NO 43038 | CCAGAGGTGACTGAAAGTCCTT | CTC | chr6 | 160659378 | 160659399 | 160659383 | 160659378 | - |
| SEQ ID NO 43039 | AAAGTCCTTCTGCCACTAACAC | CTG | chr6 | 160659365 | 160659386 | 160659370 | 160659365 | - |
| SEQ ID NO 43040 | CTGCCACTAACACTGCAGTCAT | CTT | chr6 | 160659356 | 160659377 | 160659361 | 160659356 | - |
| SEQ ID NO 43041 | TGCCACTAACACTGCAGTCATA | TTC | chr6 | 160659355 | 160659376 | 160659360 | 160659355 | - |
| SEQ ID NO 43042 | CCACTAACACTGCAGTCATACT | CTG | chr6 | 160659353 | 160659374 | 160659358 | 160659353 | - |
| SEQ ID NO 43043 | ACACTGCAGTCATACTGCCCTT | CTA | chr6 | 160659347 | 160659368 | 160659352 | 160659347 | - |
| SEQ ID NO 43044 | CAGTCATACTGCCCTTGCTGTA | CTG | chr6 | 160659341 | 160659362 | 160659346 | 160659341 | - |
| SEQ ID NO 43045 | CCCTTGCTGTACTTGGACTAGG | CTG | chr6 | 160659330 | 160659351 | 160659335 | 160659330 | - |
| SEQ ID NO 43046 | GCTGTACTTGGACTAGGGAAGG | CTT | chr6 | 160659325 | 160659346 | 160659330 | 160659325 | - |
| SEQ ID NO 43047 | CTGTACTTGGACTAGGGAAGGA | TTG | chr6 | 160659324 | 160659345 | 160659329 | 160659324 | - |
| SEQ ID NO 43048 | TACTTGGACTAGGGAAGGAAAA | CTG | chr6 | 160659321 | 160659342 | 160659326 | 160659321 | - |
| SEQ ID NO 43049 | GGACTAGGGAAGGAAAAAGAT | CTT | chr6 | 160659316 | 160659337 | 160659321 | 160659316 | - |
| SEQ ID NO 43050 | GACTAGGGAAGGAAAAAGATC | TTG | chr6 | 160659315 | 160659336 | 160659320 | 160659315 | - |
| SEQ ID NO 43051 | GGGAAGGAAAAAGATCCTGAG | CTA | chr6 | 160659310 | 160659331 | 160659315 | 160659310 | - |
| SEQ ID NO 43052 | AGTGCTTTACTCACACCCCAGT | CTG | chr6 | 160659290 | 160659311 | 160659295 | 160659290 | - |
| SEQ ID NO 43053 | TACTCACACCCCAGTGTGCCCC | CTT | chr6 | 160659283 | 160659304 | 160659288 | 160659283 | - |
| SEQ ID NO 43054 | ACTCACACCCCAGTGTGCCCCA | TTT | chr6 | 160659282 | 160659303 | 160659287 | 160659282 | - |
| SEQ ID NO 43055 | CTCACACCCCAGTGTGCCCCAG | TTA | chr6 | 160659281 | 160659302 | 160659286 | 160659281 | - |
| SEQ ID NO 43056 | ACACCCCAGTGTGCCCCAGCCA | CTC | chr6 | 160659278 | 160659299 | 160659283 | 160659278 | - |
| SEQ ID NO 43057 | TGGAAAAGAGGCCAGTGTGTCA | CTA | chr6 | 160659251 | 160659272 | 160659256 | 160659251 | - |
| SEQ ID NO 43058 | CAAGCACCCTGAGGCCCCTGCC | CTG | chr6 | 160659223 | 160659244 | 160659228 | 160659223 | - |
| SEQ ID NO 43059 | AGGCCCCTGCCCCTGCTGCCCC | CTG | chr6 | 160659212 | 160659233 | 160659217 | 160659212 | - |
| SEQ ID NO 43060 | CCCCTGCTGCCCCCAAGCTGTA | CTG | chr6 | 160659203 | 160659224 | 160659208 | 160659203 | - |
| SEQ ID NO 43061 | CTGCCCCAAGCTGTAGAGCCA | CTG | chr6 | 160659197 | 160659218 | 160659202 | 160659197 | - |
| SEQ ID NO 43062 | CCCCCAAGCTGTAGAGCCAGAA | CTG | chr6 | 160659194 | 160659215 | 160659199 | 160659194 | - |
| SEQ ID NO 43063 | TAGAGCCAGAATATAAAGCTGG | CTG | chr6 | 160659183 | 160659204 | 160659188 | 160659183 | - |
| SEQ ID NO 43064 | GCAGAAAAATGTAAAAGGCTA | CTG | chr6 | 160659162 | 160659183 | 160659167 | 160659162 | - |
| SEQ ID NO 43065 | GACTGGCTTAGCCTCCCAGCCT | CTA | chr6 | 160659140 | 160659161 | 160659145 | 160659140 | - |
| SEQ ID NO 43066 | GCTTAGCCTCCCAGCCTACATC | CTG | chr6 | 160659135 | 160659156 | 160659140 | 160659135 | - |

Figure 60 (Cont'd)

| SEQ ID | Sequence | Codon | Chr | Start | End | Pos3 | Pos4 | - |
|---|---|---|---|---|---|---|---|---|
| SEQ ID NO 43067 | AGCCTCCCAGCCTACATCTTTC | CTT | chr6 | 160659131 | 160659152 | 160659136 | 160659131 | - |
| SEQ ID NO 43068 | GCCTCCCAGCCTACATCTTTCT | TTA | chr6 | 160659130 | 160659151 | 160659135 | 160659130 | - |
| SEQ ID NO 43069 | CCAGCCTACATCTTTCTCCTGT | CTC | chr6 | 160659125 | 160659146 | 160659130 | 160659125 | - |
| SEQ ID NO 43070 | CATCTTTCTCCTGTGCTGGATC | CTA | chr6 | 160659117 | 160659138 | 160659122 | 160659117 | - |
| SEQ ID NO 43071 | TCTCCTGTGCTGGATCCTTCCT | CTT | chr6 | 160659111 | 160659132 | 160659116 | 160659111 | - |
| SEQ ID NO 43072 | CTCCTGTGCTGGATCCTTCCTG | TTT | chr6 | 160659110 | 160659131 | 160659115 | 160659110 | - |
| SEQ ID NO 43073 | TCCTGTGCTGGATCCTTCCTGC | TTC | chr6 | 160659109 | 160659130 | 160659114 | 160659109 | - |
| SEQ ID NO 43074 | CTGTGCTGGATCCTTCCTGCTC | CTC | chr6 | 160659107 | 160659128 | 160659112 | 160659107 | - |
| SEQ ID NO 43075 | TGCTGGATCCTTCCTGCTCTTG | CTG | chr6 | 160659104 | 160659125 | 160659109 | 160659104 | - |
| SEQ ID NO 43076 | GATCCTTCCTGCTCTTGAACAT | CTG | chr6 | 160659099 | 160659120 | 160659104 | 160659099 | - |
| SEQ ID NO 43077 | CCTGCTCTTGAACATCGGACTC | CTT | chr6 | 160659092 | 160659113 | 160659097 | 160659092 | - |
| SEQ ID NO 43078 | CTGCTCTTGAACATCGGACTCC | TTC | chr6 | 160659091 | 160659112 | 160659096 | 160659091 | - |
| SEQ ID NO 43079 | CTCTTGAACATCGGACTCCAAG | CTG | chr6 | 160659088 | 160659109 | 160659093 | 160659088 | - |
| SEQ ID NO 43080 | TTGAACATCGGACTCCAAGTTC | CTC | chr6 | 160659085 | 160659106 | 160659090 | 160659085 | - |
| SEQ ID NO 43081 | GAACATCGGACTCCAAGTTCTT | CTT | chr6 | 160659083 | 160659104 | 160659088 | 160659083 | - |
| SEQ ID NO 43082 | AACATCGGACTCCAAGTTCTTC | TTG | chr6 | 160659082 | 160659103 | 160659087 | 160659082 | - |
| SEQ ID NO 43083 | CAAGTTCTTCAGCTGTGGGACT | CTC | chr6 | 160659070 | 160659091 | 160659075 | 160659070 | - |
| SEQ ID NO 43084 | TTCAGCTGTGGGACTTGGACTG | TTC | chr6 | 160659063 | 160659084 | 160659068 | 160659063 | - |
| SEQ ID NO 43085 | CAGCTGTGGGACTTGGACTGTC | CTT | chr6 | 160659061 | 160659082 | 160659066 | 160659061 | - |
| SEQ ID NO 43086 | AGCTGTGGGACTTGGACTGTCT | TTC | chr6 | 160659060 | 160659081 | 160659065 | 160659060 | - |
| SEQ ID NO 43087 | TGGGACTTGGACTGTCTTCCTT | CTG | chr6 | 160659055 | 160659076 | 160659060 | 160659055 | - |
| SEQ ID NO 43088 | GGACTGTCTTCCTTGCTCCTCA | CTT | chr6 | 160659047 | 160659068 | 160659052 | 160659047 | - |
| SEQ ID NO 43089 | GACTGTCTTCCTTGCTCCTCAG | TTG | chr6 | 160659046 | 160659067 | 160659051 | 160659046 | - |
| SEQ ID NO 43090 | TCTTCCTTGCTCCTCAGATTGC | CTG | chr6 | 160659041 | 160659062 | 160659046 | 160659041 | - |
| SEQ ID NO 43091 | CCTTGCTCCTCAGATTGCAGGT | CTT | chr6 | 160659037 | 160659058 | 160659042 | 160659037 | - |
| SEQ ID NO 43092 | CTTGCTCCTCAGATTGCAGGTG | TTC | chr6 | 160659036 | 160659057 | 160659041 | 160659036 | - |
| SEQ ID NO 43093 | GCTCCTCAGATTGCAGGTGGCC | CTT | chr6 | 160659033 | 160659054 | 160659038 | 160659033 | - |
| SEQ ID NO 43094 | CTCCTCAGATTGCAGGTGGCCT | TTG | chr6 | 160659032 | 160659053 | 160659037 | 160659032 | - |
| SEQ ID NO 43095 | CTCAGATTGCAGGTGGCCTATT | CTC | chr6 | 160659029 | 160659050 | 160659034 | 160659029 | - |
| SEQ ID NO 43096 | AGATTGCAGGTGGCCTATTATG | CTC | chr6 | 160659026 | 160659047 | 160659031 | 160659026 | - |
| SEQ ID NO 43097 | CAGGTGGCCTATTATGGGACCT | TTG | chr6 | 160659020 | 160659041 | 160659025 | 160659020 | - |
| SEQ ID NO 43098 | TTATGGGACCTTGTAATCTTGT | CTA | chr6 | 160659009 | 160659030 | 160659014 | 160659009 | - |
| SEQ ID NO 43099 | TGGGACCTTGTAATCTTGTGAG | TTA | chr6 | 160659006 | 160659027 | 160659011 | 160659006 | - |
| SEQ ID NO 43100 | GTAATCTTGTGAGTTAATACCA | CTT | chr6 | 160658997 | 160659018 | 160659002 | 160658997 | - |
| SEQ ID NO 43101 | TAATCTTGTGAGTTAATACCAC | TTG | chr6 | 160658996 | 160659017 | 160659001 | 160658996 | - |
| SEQ ID NO 43102 | GTGAGTTAATACCACTTAATAA | CTT | chr6 | 160658989 | 160659010 | 160658994 | 160658989 | - |
| SEQ ID NO 43103 | TGAGTTAATACCACTTAATAAG | TTG | chr6 | 160658988 | 160659009 | 160658993 | 160658988 | - |
| SEQ ID NO 43104 | ATACCACTTAATAAGCTCCCCT | TTA | chr6 | 160658981 | 160659002 | 160658986 | 160658981 | - |
| SEQ ID NO 43105 | AATAAGCTCCCCTTTGTGTGAG | CTT | chr6 | 160658972 | 160658993 | 160658977 | 160658972 | - |
| SEQ ID NO 43106 | ATAAGCTCCCCTTTGTGTGAGT | TTA | chr6 | 160658971 | 160658992 | 160658976 | 160658971 | - |
| SEQ ID NO 43107 | CCCTTTGTGTGAGTATATCTAT | CTC | chr6 | 160658963 | 160658984 | 160658968 | 160658963 | - |
| SEQ ID NO 43108 | TGTGTGAGTATATCTATATCTA | CTT | chr6 | 160658958 | 160658979 | 160658963 | 160658958 | - |
| SEQ ID NO 43109 | GTGTGAGTATATCTATATCTAT | TTT | chr6 | 160658957 | 160658978 | 160658962 | 160658957 | - |
| SEQ ID NO 43110 | TGTGAGTATATCTATATCTATA | TTG | chr6 | 160658956 | 160658977 | 160658961 | 160658956 | - |
| SEQ ID NO 43111 | TATCTATAGATAGATATAGGTA | CTA | chr6 | 160658942 | 160658963 | 160658947 | 160658942 | - |
| SEQ ID NO 43112 | TAGATAGATATAGGTATACTCA | CTA | chr6 | 160658936 | 160658957 | 160658941 | 160658936 | - |
| SEQ ID NO 43113 | ACTATATATACACATATATACA | CTC | chr6 | 160658915 | 160658936 | 160658920 | 160658915 | - |
| SEQ ID NO 43114 | TATATACACATATATACATATA | CTA | chr6 | 160658911 | 160658932 | 160658916 | 160658911 | - |
| SEQ ID NO 43115 | TCTCTCTCTCTCTCATATAT | CTC | chr6 | 160658886 | 160658907 | 160658891 | 160658886 | - |
| SEQ ID NO 43116 | TCTCTCTCTCTCATATATAT | CTC | chr6 | 160658884 | 160658905 | 160658889 | 160658884 | - |
| SEQ ID NO 43117 | TCTCTCTCTCATATATATAT | CTC | chr6 | 160658882 | 160658903 | 160658887 | 160658882 | - |
| SEQ ID NO 43118 | TCTCTCTCATATATATATAT | CTC | chr6 | 160658880 | 160658901 | 160658885 | 160658880 | - |
| SEQ ID NO 43119 | TCTCTCTCATATATATATATAT | CTC | chr6 | 160658878 | 160658899 | 160658883 | 160658878 | - |
| SEQ ID NO 43120 | TCTCTCATATATATATATATAT | CTC | chr6 | 160658876 | 160658897 | 160658881 | 160658876 | - |
| SEQ ID NO 43121 | TCTCATATATATATATATATAA | CTC | chr6 | 160658874 | 160658895 | 160658879 | 160658874 | - |
| SEQ ID NO 43122 | TCATATATATATATATATAATC | CTC | chr6 | 160658872 | 160658893 | 160658877 | 160658872 | - |
| SEQ ID NO 43123 | ATATATATATATATATAATCTC | CTC | chr6 | 160658870 | 160658891 | 160658875 | 160658870 | - |
| SEQ ID NO 43124 | CTATTAGTTCTGTCCCTCTAGA | CTC | chr6 | 160658848 | 160658869 | 160658853 | 160658848 | - |

Figure 60 (Cont'd)

| | | | | | | | | |
|---|---|---|---|---|---|---|---|---|
| SEQ ID NO 43125 | TTAGTTCTGTCCCTCTAGAGAA | CTA | chr6 | 160658845 | 160658866 | 160658850 | 160658845 | - |
| SEQ ID NO 43126 | GTTCTGTCCCTCTAGAGAACCC | TTA | chr6 | 160658842 | 160658863 | 160658847 | 160658842 | - |
| SEQ ID NO 43127 | TGTCCCTCTAGAGAACCCCGAC | TTC | chr6 | 160658838 | 160658859 | 160658843 | 160658838 | - |
| SEQ ID NO 43128 | TCCCTCTAGAGAACCCCGACTA | CTG | chr6 | 160658836 | 160658857 | 160658841 | 160658836 | - |
| SEQ ID NO 43129 | TAGAGAACCCCGACTAATACAG | CTC | chr6 | 160658830 | 160658851 | 160658835 | 160658830 | - |
| SEQ ID NO 43130 | GAGAACCCCGACTAATACAGAT | CTA | chr6 | 160658828 | 160658849 | 160658833 | 160658828 | - |
| SEQ ID NO 43131 | ATACAGATTTTCATACCAGAAG | CTA | chr6 | 160658814 | 160658835 | 160658819 | 160658814 | - |
| SEQ ID NO 43132 | TCATACCAGAAGTGGTTCTTGA | TTT | chr6 | 160658804 | 160658825 | 160658809 | 160658804 | - |
| SEQ ID NO 43133 | CATACCAGAAGTGGTTCTTGAG | TTT | chr6 | 160658803 | 160658824 | 160658808 | 160658803 | - |
| SEQ ID NO 43134 | ATACCAGAAGTGGTTCTTGAGG | TTC | chr6 | 160658802 | 160658823 | 160658807 | 160658802 | - |
| SEQ ID NO 43135 | TTGAGGAACAGAATATTAAGGA | TTC | chr6 | 160658786 | 160658807 | 160658791 | 160658786 | - |
| SEQ ID NO 43136 | GAGGAACAGAATATTAAGGATG | CTT | chr6 | 160658784 | 160658805 | 160658789 | 160658784 | - |
| SEQ ID NO 43137 | AGGAACAGAATATTAAGGATGG | TTG | chr6 | 160658783 | 160658804 | 160658788 | 160658783 | - |
| SEQ ID NO 43138 | AGGATGGAATTCTTTCATTGGT | TTA | chr6 | 160658768 | 160658789 | 160658773 | 160658768 | - |
| SEQ ID NO 43139 | TTTCATTGGTTTTGGGACTTCT | TTC | chr6 | 160658756 | 160658777 | 160658761 | 160658756 | - |
| SEQ ID NO 43140 | TCATTGGTTTTGGGACTTCTGG | CTT | chr6 | 160658754 | 160658775 | 160658759 | 160658754 | - |
| SEQ ID NO 43141 | CATTGGTTTTGGGACTTCTGGT | TTT | chr6 | 160658753 | 160658774 | 160658758 | 160658753 | - |
| SEQ ID NO 43142 | ATTGGTTTTGGGACTTCTGGTG | TTC | chr6 | 160658752 | 160658773 | 160658757 | 160658752 | - |
| SEQ ID NO 43143 | GTTTTGGGACTTCTGGTGTTGG | TTG | chr6 | 160658748 | 160658769 | 160658753 | 160658748 | - |
| SEQ ID NO 43144 | TGGGACTTCTGGTGTTGGCTGA | TTT | chr6 | 160658744 | 160658765 | 160658749 | 160658744 | - |
| SEQ ID NO 43145 | GGGACTTCTGGTGTTGGCTGAT | TTT | chr6 | 160658743 | 160658764 | 160658748 | 160658743 | - |
| SEQ ID NO 43146 | GGACTTCTGGTGTTGGCTGATT | TTG | chr6 | 160658742 | 160658763 | 160658747 | 160658742 | - |
| SEQ ID NO 43147 | CTGGTGTTGGCTGATTAATATG | CTT | chr6 | 160658736 | 160658757 | 160658741 | 160658736 | - |
| SEQ ID NO 43148 | TGGTGTTGGCTGATTAATATGA | TTC | chr6 | 160658735 | 160658756 | 160658740 | 160658735 | - |
| SEQ ID NO 43149 | GTGTTGGCTGATTAATATGATT | CTG | chr6 | 160658733 | 160658754 | 160658738 | 160658733 | - |
| SEQ ID NO 43150 | GCTGATTAATATGATTAGACCA | TTG | chr6 | 160658727 | 160658748 | 160658732 | 160658727 | - |
| SEQ ID NO 43151 | ATTAATATGATTAGACCAAAAA | CTG | chr6 | 160658723 | 160658744 | 160658728 | 160658723 | - |
| SEQ ID NO 43152 | ATATGATTAGACCAAAAAATGC | TTA | chr6 | 160658719 | 160658740 | 160658724 | 160658719 | - |
| SEQ ID NO 43153 | GACCAAAAAATGCTAAGGACTC | TTA | chr6 | 160658710 | 160658731 | 160658715 | 160658710 | - |
| SEQ ID NO 43154 | AGGACTCTACTTCTAATAGTAT | CTA | chr6 | 160658695 | 160658716 | 160658700 | 160658695 | - |
| SEQ ID NO 43155 | TACTTCTAATAGTATGGAGAAC | CTC | chr6 | 160658688 | 160658709 | 160658693 | 160658688 | - |
| SEQ ID NO 43156 | CTTCTAATAGTATGGAGAACAC | CTA | chr6 | 160658686 | 160658707 | 160658691 | 160658686 | - |
| SEQ ID NO 43157 | CTAATAGTATGGAGAACACTGA | CTT | chr6 | 160658683 | 160658704 | 160658688 | 160658683 | - |
| SEQ ID NO 43158 | TAATAGTATGGAGAACACTGAT | TTC | chr6 | 160658682 | 160658703 | 160658687 | 160658682 | - |
| SEQ ID NO 43159 | ATAGTATGGAGAACACTGATAG | CTA | chr6 | 160658680 | 160658701 | 160658685 | 160658680 | - |
| SEQ ID NO 43160 | ATAGTACTTGGCCTGAATTGTT | CTG | chr6 | 160658662 | 160658683 | 160658667 | 160658662 | - |
| SEQ ID NO 43161 | GGCCTGAATTGTTTAGAGAGTT | CTT | chr6 | 160658653 | 160658674 | 160658658 | 160658653 | - |
| SEQ ID NO 43162 | GCCTGAATTGTTTAGAGAGTTA | TTG | chr6 | 160658652 | 160658673 | 160658657 | 160658652 | - |
| SEQ ID NO 43163 | AATTGTTTAGAGAGTTATGCAA | CTG | chr6 | 160658647 | 160658668 | 160658652 | 160658647 | - |
| SEQ ID NO 43164 | TTTAGAGAGTTATGCAAAATAA | TTG | chr6 | 160658642 | 160658663 | 160658647 | 160658642 | - |
| SEQ ID NO 43165 | AGAGAGTTATGCAAAATAAATG | TTT | chr6 | 160658639 | 160658660 | 160658644 | 160658639 | - |
| SEQ ID NO 43166 | GAGAGTTATGCAAAATAAATGC | TTA | chr6 | 160658638 | 160658659 | 160658643 | 160658638 | - |
| SEQ ID NO 43167 | TGCAAAATAAATGCATTTGACA | TTA | chr6 | 160658630 | 160658651 | 160658635 | 160658630 | - |
| SEQ ID NO 43168 | GACACTACTGATTCATCACTTA | TTT | chr6 | 160658612 | 160658633 | 160658617 | 160658612 | - |
| SEQ ID NO 43169 | ACACTACTGATTCATCACTTAT | TTG | chr6 | 160658611 | 160658632 | 160658616 | 160658611 | - |
| SEQ ID NO 43170 | CTGATTCATCACTTATGAGAGG | CTA | chr6 | 160658605 | 160658626 | 160658610 | 160658605 | - |
| SEQ ID NO 43171 | ATTCATCACTTATGAGAGGCAA | CTG | chr6 | 160658602 | 160658623 | 160658607 | 160658602 | - |
| SEQ ID NO 43172 | ATCACTTATGAGAGGCAAGGAG | TTC | chr6 | 160658598 | 160658619 | 160658603 | 160658598 | - |
| SEQ ID NO 43173 | ATGAGAGGCAAGGAGTTTAGTG | CTT | chr6 | 160658591 | 160658612 | 160658596 | 160658591 | - |
| SEQ ID NO 43174 | TGAGAGGCAAGGAGTTTAGTGA | TTA | chr6 | 160658590 | 160658611 | 160658595 | 160658590 | - |
| SEQ ID NO 43175 | AGTGACTCTATACATAATACCT | TTT | chr6 | 160658573 | 160658594 | 160658578 | 160658573 | - |
| SEQ ID NO 43176 | GTGACTCTATACATAATACCTT | TTA | chr6 | 160658572 | 160658593 | 160658577 | 160658572 | - |
| SEQ ID NO 43177 | TATACATAATACCTTGACTAT | CTC | chr6 | 160658565 | 160658586 | 160658570 | 160658565 | - |
| SEQ ID NO 43178 | TACATAATACCTTTGACTATAT | CTA | chr6 | 160658563 | 160658584 | 160658568 | 160658563 | - |
| SEQ ID NO 43179 | TGACTATATGTGGAGAACCAAG | CTT | chr6 | 160658550 | 160658571 | 160658555 | 160658550 | - |
| SEQ ID NO 43180 | GACTATATGTGGAGAACCAAGG | TTT | chr6 | 160658549 | 160658570 | 160658554 | 160658549 | - |
| SEQ ID NO 43181 | ACTATATGTGGAGAACCAAGGA | TTG | chr6 | 160658548 | 160658569 | 160658553 | 160658548 | - |
| SEQ ID NO 43182 | TATGTGGAGAACCAAGGAACAT | CTA | chr6 | 160658544 | 160658565 | 160658549 | 160658544 | - |

Figure 60 (Cont'd)

| SEQ ID NO | Sequence | Codon | Chr | Pos1 | Pos2 | Pos3 | Pos4 | |
|---|---|---|---|---|---|---|---|---|
| SEQ ID NO 43183 | GTTGATTGCTCCTAAGTTCTCT | TTG | chr6 | 160658512 | 160658533 | 160658517 | 160658512 | - |
| SEQ ID NO 43184 | ATTGCTCCTAAGTTCTCTGGAG | TTG | chr6 | 160658508 | 160658529 | 160658513 | 160658508 | - |
| SEQ ID NO 43185 | CTCCTAAGTTCTCTGGAGAAAG | TTG | chr6 | 160658504 | 160658525 | 160658509 | 160658504 | - |
| SEQ ID NO 43186 | CTAAGTTCTCTGGAGAAAGAGA | CTC | chr6 | 160658501 | 160658522 | 160658506 | 160658501 | - |
| SEQ ID NO 43187 | AGTTCTCTGGAGAAAGAGATGA | CTA | chr6 | 160658498 | 160658519 | 160658503 | 160658498 | - |
| SEQ ID NO 43188 | TCTGGAGAAAGAGATGAAAGAA | TTC | chr6 | 160658493 | 160658514 | 160658498 | 160658493 | - |
| SEQ ID NO 43189 | TGGAGAAAGAGATGAAAGAAAA | CTC | chr6 | 160658491 | 160658512 | 160658496 | 160658491 | - |
| SEQ ID NO 43190 | GAGAAAGAGATGAAAGAAAATG | CTG | chr6 | 160658489 | 160658510 | 160658494 | 160658489 | - |
| SEQ ID NO 43191 | AGGGGATCTGTCTCCCACCTTC | CTC | chr6 | 160658459 | 160658480 | 160658464 | 160658459 | - |
| SEQ ID NO 43192 | TCTCCCACCTTCAGAAGCAGAT | CTG | chr6 | 160658449 | 160658470 | 160658454 | 160658449 | - |
| SEQ ID NO 43193 | CCACCTTCAGAAGCAGATACTG | CTC | chr6 | 160658445 | 160658466 | 160658450 | 160658445 | - |
| SEQ ID NO 43194 | CAGAAGCAGATACTGAGCCACA | CTT | chr6 | 160658438 | 160658459 | 160658443 | 160658438 | - |
| SEQ ID NO 43195 | AGAAGCAGATACTGAGCCACAA | TTC | chr6 | 160658437 | 160658458 | 160658442 | 160658437 | - |
| SEQ ID NO 43196 | AGCCACAAATCTGCTAAGATTG | CTG | chr6 | 160658423 | 160658444 | 160658428 | 160658423 | - |
| SEQ ID NO 43197 | CTAAGATTGCCCTGAATGAGAG | CTG | chr6 | 160658410 | 160658431 | 160658415 | 160658410 | - |
| SEQ ID NO 43198 | AGATTGCCCTGAATGAGAGTTT | CTA | chr6 | 160658407 | 160658428 | 160658412 | 160658407 | - |
| SEQ ID NO 43199 | CCCTGAATGAGAGTTTTAACTC | TTG | chr6 | 160658401 | 160658422 | 160658406 | 160658401 | - |
| SEQ ID NO 43200 | AATGAGAGTTTTAACTCCTGTA | CTG | chr6 | 160658396 | 160658417 | 160658401 | 160658396 | - |
| SEQ ID NO 43201 | TAACTCCTGTAGAGAAAGAGTT | TTT | chr6 | 160658385 | 160658406 | 160658390 | 160658385 | - |
| SEQ ID NO 43202 | AACTCCTGTAGAGAAAGAGTTG | TTT | chr6 | 160658384 | 160658405 | 160658389 | 160658384 | - |
| SEQ ID NO 43203 | ACTCCTGTAGAGAAAGAGTTGA | TTA | chr6 | 160658383 | 160658404 | 160658388 | 160658383 | - |
| SEQ ID NO 43204 | CTGTAGAGAAAGAGTTGAAATT | CTC | chr6 | 160658379 | 160658400 | 160658384 | 160658379 | - |
| SEQ ID NO 43205 | TAGAGAAAGAGTTGAAATTGTG | CTG | chr6 | 160658376 | 160658397 | 160658381 | 160658376 | - |
| SEQ ID NO 43206 | AAATTGTGAAAAACAGAGACA | TTG | chr6 | 160658362 | 160658383 | 160658367 | 160658362 | - |
| SEQ ID NO 43207 | TGAAAAACAGAGACAAGCTGT | TTG | chr6 | 160658356 | 160658377 | 160658361 | 160658356 | - |
| SEQ ID NO 43208 | TTATCATGCGAGTAGCTGATCT | CTG | chr6 | 160658335 | 160658356 | 160658340 | 160658335 | - |
| SEQ ID NO 43209 | TCATGCGAGTAGCTGATCTGCA | TTA | chr6 | 160658332 | 160658353 | 160658337 | 160658332 | - |
| SEQ ID NO 43210 | ATCTGCAACAAGAGGTGCATGC | CTG | chr6 | 160658317 | 160658338 | 160658322 | 160658317 | - |
| SEQ ID NO 43211 | CAACAAGAGGTGCATGCACAGC | CTG | chr6 | 160658312 | 160658333 | 160658317 | 160658312 | - |
| SEQ ID NO 43212 | GCCAGGTGTTTACTGTTAAAGT | CTT | chr6 | 160658287 | 160658308 | 160658292 | 160658287 | - |
| SEQ ID NO 43213 | CCAGGTGTTTACTGTTAAAGTG | TTG | chr6 | 160658286 | 160658307 | 160658291 | 160658286 | - |
| SEQ ID NO 43214 | ACTGTTAAAGTGAGGGCATTGA | TTT | chr6 | 160658276 | 160658297 | 160658281 | 160658276 | - |
| SEQ ID NO 43215 | CTGTTAAAGTGAGGGCATTGAC | TTA | chr6 | 160658275 | 160658296 | 160658280 | 160658275 | - |
| SEQ ID NO 43216 | TTAAAGTGAGGGCATTGACTGG | CTG | chr6 | 160658272 | 160658293 | 160658277 | 160658272 | - |
| SEQ ID NO 43217 | AAGTGAGGGCATTGACTGGAAA | TTA | chr6 | 160658269 | 160658290 | 160658274 | 160658269 | - |
| SEQ ID NO 43218 | ACTGGAAAAAATGGGACCCTG | TTG | chr6 | 160658255 | 160658276 | 160658260 | 160658255 | - |
| SEQ ID NO 43219 | GAAAAAATGGGACCCTGGAAC | CTG | chr6 | 160658251 | 160658272 | 160658256 | 160658251 | - |
| SEQ ID NO 43220 | GAACTTGGAGTGGGGATGTGTG | CTG | chr6 | 160658233 | 160658254 | 160658238 | 160658233 | - |
| SEQ ID NO 43221 | GGAGTGGGGATGTGTGGGAGAA | CTT | chr6 | 160658227 | 160658248 | 160658232 | 160658227 | - |
| SEQ ID NO 43222 | GAGTGGGGATGTGTGGGAGAAC | TTG | chr6 | 160658226 | 160658247 | 160658231 | 160658226 | - |
| SEQ ID NO 43223 | ATGAAGCTGAGGACACTGAGTT | CTG | chr6 | 160658200 | 160658221 | 160658205 | 160658200 | - |
| SEQ ID NO 43224 | AGGACACTGAGTTTGTGAACTC | CTG | chr6 | 160658191 | 160658212 | 160658196 | 160658191 | - |
| SEQ ID NO 43225 | AGTTTGTGAACTCTGATGAAAC | CTG | chr6 | 160658182 | 160658203 | 160658187 | 160658182 | - |
| SEQ ID NO 43226 | GTGAACTCTGATGAAACTTTTT | TTT | chr6 | 160658177 | 160658198 | 160658182 | 160658177 | - |
| SEQ ID NO 43227 | TGAACTCTGATGAAACTTTTTT | TTG | chr6 | 160658176 | 160658197 | 160658181 | 160658176 | - |
| SEQ ID NO 43228 | TGATGAAACTTTTTTGCCAGAA | CTC | chr6 | 160658169 | 160658190 | 160658174 | 160658169 | - |
| SEQ ID NO 43229 | ATGAAACTTTTTTGCCAGAAGA | CTG | chr6 | 160658167 | 160658188 | 160658172 | 160658167 | - |
| SEQ ID NO 43230 | TTTTGCCAGAAGAAACAGTTTC | CTT | chr6 | 160658158 | 160658179 | 160658163 | 160658158 | - |
| SEQ ID NO 43231 | TTTGCCAGAAGAAACAGTTTCC | TTT | chr6 | 160658157 | 160658178 | 160658162 | 160658157 | - |
| SEQ ID NO 43232 | TTGCCAGAAGAAACAGTTTCCC | TTT | chr6 | 160658156 | 160658177 | 160658161 | 160658156 | - |
| SEQ ID NO 43233 | TGCCAGAAGAAACAGTTTCCCC | TTT | chr6 | 160658155 | 160658176 | 160658160 | 160658155 | - |
| SEQ ID NO 43234 | GCCAGAAGAAACAGTTTCCCCA | TTT | chr6 | 160658154 | 160658175 | 160658159 | 160658154 | - |
| SEQ ID NO 43235 | CCAGAAGAAACAGTTTCCCCAT | TTG | chr6 | 160658153 | 160658174 | 160658158 | 160658153 | - |
| SEQ ID NO 43236 | CCCCATCCCCAGTAGTGGTAAC | TTT | chr6 | 160658137 | 160658158 | 160658142 | 160658137 | - |
| SEQ ID NO 43237 | CCCATCCCCAGTAGTGGTAACA | TTC | chr6 | 160658136 | 160658157 | 160658141 | 160658136 | - |
| SEQ ID NO 43238 | CCTGACCCGTGCTGCCATTAGC | CTC | chr6 | 160658107 | 160658128 | 160658112 | 160658107 | - |
| SEQ ID NO 43239 | ACCCGTGCTGCCATTAGCCTTT | CTG | chr6 | 160658103 | 160658124 | 160658108 | 160658103 | - |
| SEQ ID NO 43240 | CCATTAGCCTTTCCACCTTTGT | CTG | chr6 | 160658093 | 160658114 | 160658098 | 160658093 | - |

Figure 60 (Cont'd)

| | | | | | | | | |
|---|---|---|---|---|---|---|---|---|
| SEQ ID NO 43241 | GCCTTTCCACCTTTGTCTGAGG | TTA | chr6 | 160658087 | 160658108 | 160658092 | 160658087 | - |
| SEQ ID NO 43242 | TCCACCTTTGTCTGAGGATGTA | CTT | chr6 | 160658082 | 160658103 | 160658087 | 160658082 | - |
| SEQ ID NO 43243 | CCACCTTTGTCTGAGGATGTAA | TTT | chr6 | 160658081 | 160658102 | 160658086 | 160658081 | - |
| SEQ ID NO 43244 | CACCTTTGTCTGAGGATGTAAA | TTC | chr6 | 160658080 | 160658101 | 160658085 | 160658080 | - |
| SEQ ID NO 43245 | TGTCTGAGGATGTAAACCCTGC | CTT | chr6 | 160658074 | 160658095 | 160658079 | 160658074 | - |
| SEQ ID NO 43246 | GTCTGAGGATGTAAACCCTGCA | TTT | chr6 | 160658073 | 160658094 | 160658078 | 160658073 | - |
| SEQ ID NO 43247 | TCTGAGGATGTAAACCCTGCAC | TTG | chr6 | 160658072 | 160658093 | 160658077 | 160658072 | - |
| SEQ ID NO 43248 | AGGATGTAAACCCTGCACTGCT | CTG | chr6 | 160658068 | 160658089 | 160658073 | 160658068 | - |
| SEQ ID NO 43249 | CACTGCTTGAGGCAACAGTGAT | CTG | chr6 | 160658053 | 160658074 | 160658058 | 160658053 | - |
| SEQ ID NO 43250 | CTTGAGGCAACAGTGATGGCCT | CTG | chr6 | 160658048 | 160658069 | 160658053 | 160658048 | - |
| SEQ ID NO 43251 | GAGGCAACAGTGATGGCCTTCC | CTT | chr6 | 160658045 | 160658066 | 160658050 | 160658045 | - |
| SEQ ID NO 43252 | AGGCAACAGTGATGGCCTTCCC | TTG | chr6 | 160658044 | 160658065 | 160658049 | 160658044 | - |
| SEQ ID NO 43253 | CCCTGAGGCAGCTGCCAGGCAA | CTT | chr6 | 160658025 | 160658046 | 160658030 | 160658025 | - |
| SEQ ID NO 43254 | CCTGAGGCAGCTGCCAGGCAAG | TTC | chr6 | 160658024 | 160658045 | 160658029 | 160658024 | - |
| SEQ ID NO 43255 | AGGCAGCTGCCAGGCAAGATAA | CTG | chr6 | 160658020 | 160658041 | 160658025 | 160658020 | - |
| SEQ ID NO 43256 | CCAGGCAAGATAATGTTGATTC | CTG | chr6 | 160658011 | 160658032 | 160658016 | 160658011 | - |
| SEQ ID NO 43257 | ATTCTCCTCAAGAGGCACCCCT | TTG | chr6 | 160657993 | 160658014 | 160657998 | 160657993 | - |
| SEQ ID NO 43258 | TCCTCAAGAGGCACCCCTAATG | TTC | chr6 | 160657989 | 160658010 | 160657994 | 160657989 | - |
| SEQ ID NO 43259 | CTCAAGAGGCACCCCTAATGCC | CTC | chr6 | 160657987 | 160658008 | 160657992 | 160657987 | - |
| SEQ ID NO 43260 | AAGAGGCACCCCTAATGCCCCT | CTC | chr6 | 160657984 | 160658005 | 160657989 | 160657984 | - |
| SEQ ID NO 43261 | ATGCCCTGAATGCTTCTAGAC | CTA | chr6 | 160657970 | 160657991 | 160657975 | 160657970 | - |
| SEQ ID NO 43262 | AATGCTTCTAGACCTATAACTA | CTG | chr6 | 160657961 | 160657982 | 160657966 | 160657961 | - |
| SEQ ID NO 43263 | CTAGACCTATAACTAGGCTAAA | CTT | chr6 | 160657954 | 160657975 | 160657959 | 160657954 | - |
| SEQ ID NO 43264 | TAGACCTATAACTAGGCTAAAT | TTC | chr6 | 160657953 | 160657974 | 160657958 | 160657953 | - |
| SEQ ID NO 43265 | GACCTATAACTAGGCTAAATTC | CTA | chr6 | 160657951 | 160657972 | 160657956 | 160657951 | - |
| SEQ ID NO 43266 | TAACTAGGCTAAATTCCTTGCG | CTA | chr6 | 160657945 | 160657966 | 160657950 | 160657945 | - |
| SEQ ID NO 43267 | GGCTAAATTCCTTGCGGGCCCC | CTA | chr6 | 160657939 | 160657960 | 160657944 | 160657939 | - |
| SEQ ID NO 43268 | AATTCCTTGCGGGCCCCAGAGG | CTA | chr6 | 160657934 | 160657955 | 160657939 | 160657934 | - |
| SEQ ID NO 43269 | CTTGCGGGCCCCAGAGGTGAGG | TTC | chr6 | 160657929 | 160657950 | 160657934 | 160657929 | - |
| SEQ ID NO 43270 | GCGGGCCCCAGAGGTGAGGTTC | CTT | chr6 | 160657926 | 160657947 | 160657931 | 160657926 | - |
| SEQ ID NO 43271 | CGGGCCCCAGAGGTGAGGTTCA | TTG | chr6 | 160657925 | 160657946 | 160657930 | 160657925 | - |
| SEQ ID NO 43272 | AGAGTGTGACCCATGAGGAGGT | TTC | chr6 | 160657904 | 160657925 | 160657909 | 160657904 | - |
| SEQ ID NO 43273 | TACTCTAAAAGAACTGCTTAAG | TTA | chr6 | 160657876 | 160657897 | 160657881 | 160657876 | - |
| SEQ ID NO 43274 | TAAAAGAACTGCTTAAGCTTTC | CTC | chr6 | 160657871 | 160657892 | 160657876 | 160657871 | - |
| SEQ ID NO 43275 | AAAGAACTGCTTAAGCTTTCTA | CTA | chr6 | 160657869 | 160657890 | 160657874 | 160657869 | - |
| SEQ ID NO 43276 | CTTAAGCTTTCTAATTTATATT | CTG | chr6 | 160657860 | 160657881 | 160657865 | 160657860 | - |
| SEQ ID NO 43277 | AAGCTTTCTAATTTATATTGGC | CTT | chr6 | 160657857 | 160657878 | 160657862 | 160657857 | - |
| SEQ ID NO 43278 | AGCTTTCTAATTTATATTGGCA | TTA | chr6 | 160657856 | 160657877 | 160657861 | 160657856 | - |
| SEQ ID NO 43279 | TCTAATTTATATTGGCAGAAAT | CTT | chr6 | 160657851 | 160657872 | 160657856 | 160657851 | - |
| SEQ ID NO 43280 | CTAATTTATATTGGCAGAAATC | TTT | chr6 | 160657850 | 160657871 | 160657855 | 160657850 | - |
| SEQ ID NO 43281 | TAATTTATATTGGCAGAAATCT | TTC | chr6 | 160657849 | 160657870 | 160657854 | 160657849 | - |
| SEQ ID NO 43282 | ATTTATATTGGCAGAAATCTGG | CTA | chr6 | 160657847 | 160657868 | 160657852 | 160657847 | - |
| SEQ ID NO 43283 | ATATTGGCAGAAATCTGGAGAA | TTT | chr6 | 160657843 | 160657864 | 160657848 | 160657843 | - |
| SEQ ID NO 43284 | TATTGGCAGAAATCTGGAGAAC | TTA | chr6 | 160657842 | 160657863 | 160657847 | 160657842 | - |
| SEQ ID NO 43285 | GCAGAAATCTGGAGAACAGGCA | TTG | chr6 | 160657837 | 160657858 | 160657842 | 160657837 | - |
| SEQ ID NO 43286 | GAGAACAGGCATGGGAATGGAT | CTG | chr6 | 160657826 | 160657847 | 160657831 | 160657826 | - |
| SEQ ID NO 43287 | AGGGTAAGGGATAATGGTGGAA | TTA | chr6 | 160657800 | 160657821 | 160657805 | 160657800 | - |
| SEQ ID NO 43288 | GATCAAGCTGAATTTATTGGTT | TTG | chr6 | 160657764 | 160657785 | 160657769 | 160657764 | - |
| SEQ ID NO 43289 | AATTTATTGGTTTGGCCCTACT | CTG | chr6 | 160657754 | 160657775 | 160657759 | 160657754 | - |
| SEQ ID NO 43290 | ATTGGTTTGGCCCTACTAAGTA | TTT | chr6 | 160657749 | 160657770 | 160657754 | 160657749 | - |
| SEQ ID NO 43291 | TTGGTTTGGCCCTACTAAGTAG | TTA | chr6 | 160657748 | 160657769 | 160657753 | 160657748 | - |
| SEQ ID NO 43292 | GTTTGGCCCTACTAAGTAGGGA | TTG | chr6 | 160657745 | 160657766 | 160657750 | 160657745 | - |
| SEQ ID NO 43293 | GGCCCTACTAAGTAGGGATTCT | TTT | chr6 | 160657741 | 160657762 | 160657746 | 160657741 | - |
| SEQ ID NO 43294 | GCCCTACTAAGTAGGGATTCTG | TTG | chr6 | 160657740 | 160657761 | 160657745 | 160657740 | - |
| SEQ ID NO 43295 | CTAAGTAGGGATTCTGCATTTA | CTA | chr6 | 160657734 | 160657755 | 160657739 | 160657734 | - |
| SEQ ID NO 43296 | AGTAGGGATTCTGCATTTAATG | CTA | chr6 | 160657731 | 160657752 | 160657736 | 160657731 | - |
| SEQ ID NO 43297 | TGCATTTAATGTTGCAGCTCGG | TTC | chr6 | 160657720 | 160657741 | 160657725 | 160657720 | - |
| SEQ ID NO 43298 | CATTTAATGTTGCAGCTCGGGG | CTG | chr6 | 160657718 | 160657739 | 160657723 | 160657718 | - |

Figure 60 (Cont'd)

| | | | | | | | | |
|---|---|---|---|---|---|---|---|---|
| SEQ ID NO 43299 | AATGTTGCAGCTCGGGGACTTA | TTT | chr6 | 160657713 | 160657734 | 160657718 | 160657713 | - |
| SEQ ID NO 43300 | ATGTTGCAGCTCGGGGACTTAG | TTA | chr6 | 160657712 | 160657733 | 160657717 | 160657712 | - |
| SEQ ID NO 43301 | CAGCTCGGGGACTTAGAAAAGG | TTG | chr6 | 160657706 | 160657727 | 160657711 | 160657706 | - |
| SEQ ID NO 43302 | GGGGACTTAGAAAAGGTTCTGA | CTC | chr6 | 160657700 | 160657721 | 160657705 | 160657700 | - |
| SEQ ID NO 43303 | AGAAAAGGTTCTGATAGGGCCG | CTT | chr6 | 160657692 | 160657713 | 160657697 | 160657692 | - |
| SEQ ID NO 43304 | GAAAAGGTTCTGATAGGGCCGG | TTA | chr6 | 160657691 | 160657712 | 160657696 | 160657691 | - |
| SEQ ID NO 43305 | TGATAGGGCCGGGAGCAGTGGC | TTC | chr6 | 160657681 | 160657702 | 160657686 | 160657681 | - |
| SEQ ID NO 43306 | ATAGGGCCGGGAGCAGTGGCTC | CTG | chr6 | 160657679 | 160657700 | 160657684 | 160657679 | - |
| SEQ ID NO 43307 | ACGCCTGTAATCCCAGCACCTT | CTC | chr6 | 160657657 | 160657678 | 160657662 | 160657657 | - |
| SEQ ID NO 43308 | TAATCCCAGCACCTTGGGAGGC | CTG | chr6 | 160657650 | 160657671 | 160657655 | 160657650 | - |
| SEQ ID NO 43309 | GGGAGGCGGGGCGGGCAGATC | CTT | chr6 | 160657635 | 160657656 | 160657640 | 160657635 | - |
| SEQ ID NO 43310 | GGAGGCGGGGCGGGCAGATCA | TTG | chr6 | 160657634 | 160657655 | 160657639 | 160657634 | - |
| SEQ ID NO 43311 | AGACAATTCTGGCTAAAATGGT | TTG | chr6 | 160657596 | 160657617 | 160657601 | 160657596 | - |
| SEQ ID NO 43312 | TGGCTAAAATGGTGAAACCCCA | TTC | chr6 | 160657587 | 160657608 | 160657592 | 160657587 | - |
| SEQ ID NO 43313 | GCTAAAATGGTGAAACCCCATC | CTG | chr6 | 160657585 | 160657606 | 160657590 | 160657585 | - |
| SEQ ID NO 43314 | AAATGGTGAAACCCCATCTCTG | CTA | chr6 | 160657581 | 160657602 | 160657586 | 160657581 | - |
| SEQ ID NO 43315 | TGCTAAAAATACAAAAATTAGC | CTC | chr6 | 160657561 | 160657582 | 160657566 | 160657561 | - |
| SEQ ID NO 43316 | CTAAAAATACAAAAATTAGCTG | CTG | chr6 | 160657559 | 160657580 | 160657564 | 160657559 | - |
| SEQ ID NO 43317 | AAAATACAAAAATTAGCTGGGC | CTA | chr6 | 160657556 | 160657577 | 160657561 | 160657556 | - |
| SEQ ID NO 43318 | GCTGGGCATGGTGATGCGTAAC | TTA | chr6 | 160657541 | 160657562 | 160657546 | 160657541 | - |
| SEQ ID NO 43319 | GGCATGGTGATGCGTAACTGTA | CTG | chr6 | 160657537 | 160657558 | 160657542 | 160657537 | - |
| SEQ ID NO 43320 | TAATCTCATCTACTTGGGAGGC | CTG | chr6 | 160657517 | 160657538 | 160657522 | 160657517 | - |
| SEQ ID NO 43321 | ATCTACTTGGGAGGCTGAGGCA | CTC | chr6 | 160657510 | 160657531 | 160657515 | 160657510 | - |
| SEQ ID NO 43322 | CTTGGGAGGCTGAGGCAAGAGA | CTA | chr6 | 160657505 | 160657526 | 160657510 | 160657505 | - |
| SEQ ID NO 43323 | GGGAGGCTGAGGCAAGAGAACT | CTT | chr6 | 160657502 | 160657523 | 160657507 | 160657502 | - |
| SEQ ID NO 43324 | GGAGGCTGAGGCAAGAGAACTG | TTG | chr6 | 160657501 | 160657522 | 160657506 | 160657501 | - |
| SEQ ID NO 43325 | AGGCAAGAGAACTGCTTGAACC | CTG | chr6 | 160657493 | 160657514 | 160657498 | 160657493 | - |
| SEQ ID NO 43326 | CTTGAACCTGTGAGGCAGAGAT | CTG | chr6 | 160657479 | 160657500 | 160657484 | 160657479 | - |
| SEQ ID NO 43327 | GAACCTGTGAGGCAGAGATTGC | CTT | chr6 | 160657476 | 160657497 | 160657481 | 160657476 | - |
| SEQ ID NO 43328 | AACCTGTGAGGCAGAGATTGCA | TTG | chr6 | 160657475 | 160657496 | 160657480 | 160657475 | - |
| SEQ ID NO 43329 | TGAGGCAGAGATTGCAGTGAGC | CTG | chr6 | 160657469 | 160657490 | 160657474 | 160657469 | - |
| SEQ ID NO 43330 | CAGTGAGCCAAGATCGCCCCAC | TTG | chr6 | 160657455 | 160657476 | 160657460 | 160657455 | - |
| SEQ ID NO 43331 | CATTCCAGCCTGGTAACAGAGC | CTG | chr6 | 160657431 | 160657452 | 160657436 | 160657431 | - |
| SEQ ID NO 43332 | CAGCCTGGTAACAGAGCAAGAC | TTC | chr6 | 160657426 | 160657447 | 160657431 | 160657426 | - |
| SEQ ID NO 43333 | GTAACAGAGCAAGACTCCATTT | CTG | chr6 | 160657419 | 160657440 | 160657424 | 160657419 | - |
| SEQ ID NO 43334 | CATTTCCAAAAAAAAAAAAAAA | CTC | chr6 | 160657402 | 160657423 | 160657407 | 160657402 | - |
| SEQ ID NO 43335 | CCAAAAAAAAAAAAAAAAAAGT | TTT | chr6 | 160657397 | 160657418 | 160657402 | 160657397 | - |
| SEQ ID NO 43336 | CAAAAAAAAAAAAAAAAAAGTT | TTC | chr6 | 160657396 | 160657417 | 160657401 | 160657396 | - |
| SEQ ID NO 43337 | TAATAGTTTATTTGCTTGGTTA | TTA | chr6 | 160657373 | 160657394 | 160657378 | 160657373 | - |
| SEQ ID NO 43338 | ATTTGCTTGGTTAGCTGAAATA | TTT | chr6 | 160657364 | 160657385 | 160657369 | 160657364 | - |
| SEQ ID NO 43339 | TTTGCTTGGTTAGCTGAAATAT | TTA | chr6 | 160657363 | 160657384 | 160657368 | 160657363 | - |
| SEQ ID NO 43340 | GCTTGGTTAGCTGAAATATGGA | TTT | chr6 | 160657360 | 160657381 | 160657365 | 160657360 | - |
| SEQ ID NO 43341 | CTTGGTTAGCTGAAATATGGAT | TTG | chr6 | 160657359 | 160657380 | 160657364 | 160657359 | - |
| SEQ ID NO 43342 | GGTTAGCTGAAATATGGATTAA | CTT | chr6 | 160657356 | 160657377 | 160657361 | 160657356 | - |
| SEQ ID NO 43343 | GTTAGCTGAAATATGGATTAAA | TTG | chr6 | 160657355 | 160657376 | 160657360 | 160657355 | - |
| SEQ ID NO 43344 | GCTGAAATATGGATTAAAAGAT | TTA | chr6 | 160657351 | 160657372 | 160657356 | 160657351 | - |
| SEQ ID NO 43345 | AAATATGGATTAAAAGATGGTC | CTG | chr6 | 160657347 | 160657368 | 160657352 | 160657347 | - |
| SEQ ID NO 43346 | AAAGATGGTCCAATGTTAGTGA | TTA | chr6 | 160657335 | 160657356 | 160657340 | 160657335 | - |
| SEQ ID NO 43347 | GTGAGCTGGAAATGCCTTGGTT | TTA | chr6 | 160657317 | 160657338 | 160657322 | 160657317 | - |
| SEQ ID NO 43348 | GAAATGCCTTGGTTTAATGTAG | CTG | chr6 | 160657309 | 160657330 | 160657314 | 160657309 | - |
| SEQ ID NO 43349 | GGTTTAATGTAGAGGAAGTGAT | CTT | chr6 | 160657299 | 160657320 | 160657304 | 160657299 | - |
| SEQ ID NO 43350 | GTTTAATGTAGAGGAAGTGATC | TTG | chr6 | 160657298 | 160657319 | 160657303 | 160657298 | - |
| SEQ ID NO 43351 | AATGTAGAGGAAGTGATCCAAA | TTT | chr6 | 160657294 | 160657315 | 160657299 | 160657294 | - |
| SEQ ID NO 43352 | ATGTAGAGGAAGTGATCCAAAG | TTA | chr6 | 160657293 | 160657314 | 160657298 | 160657293 | - |
| SEQ ID NO 43353 | AGGGAGATTAGGATGGTGGAGT | CTT | chr6 | 160657267 | 160657288 | 160657272 | 160657267 | - |
| SEQ ID NO 43354 | GGGAGATTAGGATGGTGGAGTG | TTA | chr6 | 160657266 | 160657287 | 160657271 | 160657266 | - |
| SEQ ID NO 43355 | GGATGGTGGAGTGGATTAGTCA | TTA | chr6 | 160657257 | 160657278 | 160657262 | 160657257 | - |
| SEQ ID NO 43356 | GTCACTTTAGACCTACTCATCC | TTA | chr6 | 160657239 | 160657260 | 160657244 | 160657239 | - |

Figure 60 (Cont'd)

| | | | | | | | | |
|---|---|---|---|---|---|---|---|---|
| SEQ ID NO 43357 | TAGACCTACTCATCCCAGCTGG | CTT | chr6 | 160657232 | 160657253 | 160657237 | 160657232 | - |
| SEQ ID NO 43358 | AGACCTACTCATCCCAGCTGGG | TTT | chr6 | 160657231 | 160657252 | 160657236 | 160657231 | - |
| SEQ ID NO 43359 | GACCTACTCATCCCAGCTGGGA | TTA | chr6 | 160657230 | 160657251 | 160657235 | 160657230 | - |
| SEQ ID NO 43360 | CTCATCCCAGCTGGGAGGGTCC | CTA | chr6 | 160657224 | 160657245 | 160657229 | 160657224 | - |
| SEQ ID NO 43361 | ATCCCAGCTGGGAGGGTCCAGA | CTC | chr6 | 160657221 | 160657242 | 160657226 | 160657221 | - |
| SEQ ID NO 43362 | GGAGGGTCCAGAAGATACACCC | CTG | chr6 | 160657211 | 160657232 | 160657216 | 160657211 | - |
| SEQ ID NO 43363 | GGCCGAAGCTTTGTGAAATAGA | CTT | chr6 | 160657187 | 160657208 | 160657192 | 160657187 | - |
| SEQ ID NO 43364 | GCCGAAGCTTTGTGAAATAGAT | TTG | chr6 | 160657186 | 160657207 | 160657191 | 160657186 | - |
| SEQ ID NO 43365 | TGTGAAATAGATTTGTGAGAGC | CTT | chr6 | 160657176 | 160657197 | 160657181 | 160657176 | - |
| SEQ ID NO 43366 | GTGAAATAGATTTGTGAGAGCA | TTT | chr6 | 160657175 | 160657196 | 160657180 | 160657175 | - |
| SEQ ID NO 43367 | TGAAATAGATTTGTGAGAGCAG | TTG | chr6 | 160657174 | 160657195 | 160657179 | 160657174 | - |
| SEQ ID NO 43368 | GTGAGAGCAGCACCTGTATTTT | TTT | chr6 | 160657162 | 160657183 | 160657167 | 160657162 | - |
| SEQ ID NO 43369 | TGAGAGCAGCACCTGTATTTTT | TTG | chr6 | 160657161 | 160657182 | 160657166 | 160657161 | - |
| SEQ ID NO 43370 | TATTTTTGAAGAGCCCGTAATT | CTG | chr6 | 160657146 | 160657167 | 160657151 | 160657146 | - |
| SEQ ID NO 43371 | TTGAAGAGCCCGTAATTGCTCT | TTT | chr6 | 160657141 | 160657162 | 160657146 | 160657141 | - |
| SEQ ID NO 43372 | TGAAGAGCCCGTAATTGCTCTT | TTT | chr6 | 160657140 | 160657161 | 160657145 | 160657140 | - |
| SEQ ID NO 43373 | GAAGAGCCCGTAATTGCTCTTC | TTT | chr6 | 160657139 | 160657160 | 160657144 | 160657139 | - |
| SEQ ID NO 43374 | AAGAGCCCGTAATTGCTCTTCT | TTG | chr6 | 160657138 | 160657159 | 160657143 | 160657138 | - |
| SEQ ID NO 43375 | CTCTTCTCTGTATGTCAGATCT | TTG | chr6 | 160657123 | 160657144 | 160657128 | 160657123 | - |
| SEQ ID NO 43376 | TTCTCTGTATGTCAGATCTAAC | CTC | chr6 | 160657120 | 160657141 | 160657125 | 160657120 | - |
| SEQ ID NO 43377 | CTCTGTATGTCAGATCTAACAG | CTT | chr6 | 160657118 | 160657139 | 160657123 | 160657118 | - |
| SEQ ID NO 43378 | TCTGTATGTCAGATCTAACAGT | TTC | chr6 | 160657117 | 160657138 | 160657122 | 160657117 | - |
| SEQ ID NO 43379 | TGTATGTCAGATCTAACAGTAG | CTC | chr6 | 160657115 | 160657136 | 160657120 | 160657115 | - |
| SEQ ID NO 43380 | TATGTCAGATCTAACAGTAGGA | CTG | chr6 | 160657113 | 160657134 | 160657118 | 160657113 | - |
| SEQ ID NO 43381 | ACAGTAGGAACCACAGTCACTC | CTA | chr6 | 160657100 | 160657121 | 160657105 | 160657100 | - |
| SEQ ID NO 43382 | AACTACAAAATTTAAATACAAT | CTC | chr6 | 160657078 | 160657099 | 160657083 | 160657078 | - |
| SEQ ID NO 43383 | CAAAATTTAAATACAATGGGAA | CTA | chr6 | 160657073 | 160657094 | 160657078 | 160657073 | - |
| SEQ ID NO 43384 | AAATACAATGGGAATAATTGGA | TTT | chr6 | 160657065 | 160657086 | 160657070 | 160657065 | - |
| SEQ ID NO 43385 | AATACAATGGGAATAATTGGAT | TTA | chr6 | 160657064 | 160657085 | 160657069 | 160657064 | - |
| SEQ ID NO 43386 | GATCCTGAGGTGGCAGGGGCCA | TTG | chr6 | 160657045 | 160657066 | 160657050 | 160657045 | - |
| SEQ ID NO 43387 | AGGTGGCAGGGGCCAAGTGTTG | CTG | chr6 | 160657038 | 160657059 | 160657043 | 160657038 | - |
| SEQ ID NO 43388 | GCACTGAACCATCAAAGGCAAG | TTG | chr6 | 160657016 | 160657037 | 160657021 | 160657016 | - |
| SEQ ID NO 43389 | AACCATCAAAGGCAAGGTGGGC | CTG | chr6 | 160657010 | 160657031 | 160657015 | 160657010 | - |
| SEQ ID NO 43390 | CCATAATAGACAGCAGAGGCAA | CTA | chr6 | 160656981 | 160657002 | 160656986 | 160656981 | - |
| SEQ ID NO 43391 | ACTCATGTAGAGCTCTGGCATT | CTG | chr6 | 160656938 | 160656959 | 160656943 | 160656938 | - |
| SEQ ID NO 43392 | ATGTAGAGCTCTGGCATTGGCT | CTC | chr6 | 160656934 | 160656955 | 160656939 | 160656934 | - |
| SEQ ID NO 43393 | TGGCATTGGCTAATTAATCATG | CTC | chr6 | 160656923 | 160656944 | 160656928 | 160656923 | - |
| SEQ ID NO 43394 | GCATTGGCTAATTAATCATGGT | CTG | chr6 | 160656921 | 160656942 | 160656926 | 160656921 | - |
| SEQ ID NO 43395 | GCTAATTAATCATGGTGTTCCT | TTG | chr6 | 160656915 | 160656936 | 160656920 | 160656915 | - |
| SEQ ID NO 43396 | ATTAATCATGGTGTTCCTAGAA | CTA | chr6 | 160656911 | 160656932 | 160656916 | 160656911 | - |
| SEQ ID NO 43397 | ATCATGGTGTTCCTAGAAGTGA | TTA | chr6 | 160656907 | 160656928 | 160656912 | 160656907 | - |
| SEQ ID NO 43398 | CTAGAAGTGAAATTGATGGGAA | TTC | chr6 | 160656895 | 160656916 | 160656900 | 160656895 | - |
| SEQ ID NO 43399 | GAAGTGAAATTGATGGGAAACC | CTA | chr6 | 160656892 | 160656913 | 160656897 | 160656892 | - |
| SEQ ID NO 43400 | ATGGGAAACCTACTGTATTCCT | TTG | chr6 | 160656880 | 160656901 | 160656885 | 160656880 | - |
| SEQ ID NO 43401 | CTGTATTCCTACTTGATTTATA | CTA | chr6 | 160656868 | 160656889 | 160656873 | 160656868 | - |
| SEQ ID NO 43402 | TATTCCTACTTGATTTATATAA | CTG | chr6 | 160656865 | 160656886 | 160656870 | 160656865 | - |
| SEQ ID NO 43403 | CTACTTGATTTATATAAACAAA | TTC | chr6 | 160656860 | 160656881 | 160656865 | 160656860 | - |
| SEQ ID NO 43404 | CTTGATTTATATAAACAAAAAA | CTA | chr6 | 160656857 | 160656878 | 160656862 | 160656857 | - |
| SEQ ID NO 43405 | GATTTATATAAACAAAAACTG | CTT | chr6 | 160656854 | 160656875 | 160656859 | 160656854 | - |
| SEQ ID NO 43406 | ATTTATATAAACAAAAACTGC | TTG | chr6 | 160656853 | 160656874 | 160656858 | 160656853 | - |
| SEQ ID NO 43407 | ATATAAACAAAAACTGCCAGG | TTT | chr6 | 160656849 | 160656870 | 160656854 | 160656849 | - |
| SEQ ID NO 43408 | TATAAACAAAAACTGCCAGGT | TTA | chr6 | 160656848 | 160656869 | 160656853 | 160656848 | - |
| SEQ ID NO 43409 | CCAGGTAGAATGGACTAAAGAC | CTG | chr6 | 160656832 | 160656853 | 160656837 | 160656832 | - |
| SEQ ID NO 43410 | AAGACTAATCTGAATTATAAAA | CTA | chr6 | 160656815 | 160656836 | 160656820 | 160656815 | - |
| SEQ ID NO 43411 | ATCTGAATTATAAAACAGAGA | CTA | chr6 | 160656808 | 160656829 | 160656813 | 160656808 | - |
| SEQ ID NO 43412 | AATTATAAAACAGAGAATCAT | CTG | chr6 | 160656803 | 160656824 | 160656808 | 160656803 | - |
| SEQ ID NO 43413 | TAAAAACAGAGAATCATGGCC | TTA | chr6 | 160656798 | 160656819 | 160656803 | 160656798 | - |
| SEQ ID NO 43414 | AATCAATTTCCAGACTCGAACC | CTC | chr6 | 160656773 | 160656794 | 160656778 | 160656773 | - |

Figure 60 (Cont'd)

| SEQ ID NO 43415 | CCAGACTCGAACCTGTTACAGT | TTT | chr6 | 160656764 | 160656785 | 160656769 | 160656764 | - |
|---|---|---|---|---|---|---|---|---|
| SEQ ID NO 43416 | CAGACTCGAACCTGTTACAGTT | TTC | chr6 | 160656763 | 160656784 | 160656768 | 160656763 | - |
| SEQ ID NO 43417 | GAACCTGTTACAGTTCCAGAAC | CTC | chr6 | 160656756 | 160656777 | 160656761 | 160656756 | - |
| SEQ ID NO 43418 | TTACAGTTCCAGAACCCACTGA | CTG | chr6 | 160656749 | 160656770 | 160656754 | 160656749 | - |
| SEQ ID NO 43419 | CAGTTCCAGAACCCACTGAATG | TTA | chr6 | 160656746 | 160656767 | 160656751 | 160656746 | - |
| SEQ ID NO 43420 | CAGAACCCACTGAATGAAGGGG | TTC | chr6 | 160656740 | 160656761 | 160656745 | 160656740 | - |
| SEQ ID NO 43421 | AATGAAGGGGAGGCTGGATCCC | CTG | chr6 | 160656728 | 160656749 | 160656733 | 160656728 | - |
| SEQ ID NO 43422 | GATCCCCTTGAGGAAGGACACC | CTG | chr6 | 160656712 | 160656733 | 160656717 | 160656712 | - |
| SEQ ID NO 43423 | GAGGAAGGACACCACTAGGCTA | CTT | chr6 | 160656703 | 160656724 | 160656708 | 160656703 | - |
| SEQ ID NO 43424 | AGGAAGGACACCACTAGGCTAC | TTG | chr6 | 160656702 | 160656723 | 160656707 | 160656702 | - |
| SEQ ID NO 43425 | GGCTACTGACAACTTATGCTGT | CTA | chr6 | 160656686 | 160656707 | 160656691 | 160656686 | - |
| SEQ ID NO 43426 | CTGACAACTTATGCTGTTACTC | CTA | chr6 | 160656681 | 160656702 | 160656686 | 160656681 | - |
| SEQ ID NO 43427 | ACAACTTATGCTGTTACTCTTT | CTG | chr6 | 160656678 | 160656699 | 160656683 | 160656678 | - |
| SEQ ID NO 43428 | ATGCTGTTACTCTTTCTCCCAT | CTT | chr6 | 160656671 | 160656692 | 160656676 | 160656671 | - |
| SEQ ID NO 43429 | TGCTGTTACTCTTTCTCCCATC | TTA | chr6 | 160656670 | 160656691 | 160656675 | 160656670 | - |
| SEQ ID NO 43430 | TTACTCTTTCTCCCATCCTTCC | CTG | chr6 | 160656665 | 160656686 | 160656670 | 160656665 | - |
| SEQ ID NO 43431 | CTCTTTCTCCCATCCTTCCCTA | TTA | chr6 | 160656662 | 160656683 | 160656667 | 160656662 | - |
| SEQ ID NO 43432 | TTTCTCCCATCCTTCCCTAAGG | CTC | chr6 | 160656659 | 160656680 | 160656664 | 160656659 | - |
| SEQ ID NO 43433 | TCTCCCATCCTTCCCTAAGGAG | CTT | chr6 | 160656657 | 160656678 | 160656662 | 160656657 | - |
| SEQ ID NO 43434 | CTCCCATCCTTCCCTAAGGAGA | TTT | chr6 | 160656656 | 160656677 | 160656661 | 160656656 | - |
| SEQ ID NO 43435 | TCCCATCCTTCCCTAAGGAGAC | TTC | chr6 | 160656655 | 160656676 | 160656660 | 160656655 | - |
| SEQ ID NO 43436 | CCATCCTTCCCTAAGGAGACCT | CTC | chr6 | 160656653 | 160656674 | 160656658 | 160656653 | - |
| SEQ ID NO 43437 | CCCTAAGGAGACCTCTGGCCTT | CTT | chr6 | 160656645 | 160656666 | 160656650 | 160656645 | - |
| SEQ ID NO 43438 | CCTAAGGAGACCTCTGGCCTTT | TTC | chr6 | 160656644 | 160656665 | 160656649 | 160656644 | - |
| SEQ ID NO 43439 | AGGAGACCTCTGGCCTTTTACC | CTA | chr6 | 160656640 | 160656661 | 160656645 | 160656640 | - |
| SEQ ID NO 43440 | TGGCCTTTTACCAGGGTAACTG | CTC | chr6 | 160656630 | 160656651 | 160656635 | 160656630 | - |
| SEQ ID NO 43441 | GCCTTTTACCAGGGTAACTGTG | CTG | chr6 | 160656628 | 160656649 | 160656633 | 160656628 | - |
| SEQ ID NO 43442 | TTACCAGGGTAACTGTGTAC | CTT | chr6 | 160656623 | 160656644 | 160656628 | 160656623 | - |
| SEQ ID NO 43443 | TACCAGGGTAACTGTGTGTACT | TTT | chr6 | 160656622 | 160656643 | 160656627 | 160656622 | - |
| SEQ ID NO 43444 | ACCAGGGTAACTGTGTGTACTG | TTT | chr6 | 160656621 | 160656642 | 160656626 | 160656621 | - |
| SEQ ID NO 43445 | CCAGGGTAACTGTGTGTACTGG | TTA | chr6 | 160656620 | 160656641 | 160656625 | 160656620 | - |
| SEQ ID NO 43446 | TGTGTACTGGAGAAAGGGAAGT | CTG | chr6 | 160656608 | 160656629 | 160656613 | 160656608 | - |
| SEQ ID NO 43447 | GAGAAAGGGAAGTAATGAGACA | CTG | chr6 | 160656599 | 160656620 | 160656604 | 160656599 | - |
| SEQ ID NO 43448 | CAGAAAGTACTGGACACTGGCT | TTT | chr6 | 160656574 | 160656595 | 160656579 | 160656574 | - |
| SEQ ID NO 43449 | AGAAAGTACTGGACACTGGCTC | TTC | chr6 | 160656573 | 160656594 | 160656578 | 160656573 | - |
| SEQ ID NO 43450 | GACACTGGCTCTGAGCTGACGT | CTG | chr6 | 160656562 | 160656583 | 160656567 | 160656562 | - |
| SEQ ID NO 43451 | GCTCTGAGCTGACGTTGATTCC | CTG | chr6 | 160656555 | 160656576 | 160656560 | 160656555 | - |
| SEQ ID NO 43452 | TGAGCTGACGTTGATTCCAGGG | CTC | chr6 | 160656551 | 160656572 | 160656556 | 160656551 | - |
| SEQ ID NO 43453 | AGCTGACGTTGATTCCAGGGTA | CTG | chr6 | 160656549 | 160656570 | 160656554 | 160656549 | - |
| SEQ ID NO 43454 | ACGTTGATTCCAGGGTACCCAA | CTG | chr6 | 160656544 | 160656565 | 160656549 | 160656544 | - |
| SEQ ID NO 43455 | ATTCCAGGGTACCCAAAACGTT | TTG | chr6 | 160656538 | 160656559 | 160656543 | 160656538 | - |
| SEQ ID NO 43456 | CAGGGTACCCAAAACGTTATTG | TTC | chr6 | 160656534 | 160656555 | 160656539 | 160656534 | - |
| SEQ ID NO 43457 | TTGTGGTTCCCCAGTTAAAGTA | TTA | chr6 | 160656515 | 160656536 | 160656520 | 160656515 | - |
| SEQ ID NO 43458 | TGGTTCCCCAGTTAAAGTAGGG | TTG | chr6 | 160656512 | 160656533 | 160656517 | 160656512 | - |
| SEQ ID NO 43459 | CCCAGTTAAAGTAGGGCTTAT | TTC | chr6 | 160656506 | 160656527 | 160656511 | 160656506 | - |
| SEQ ID NO 43460 | AAGTAGGGCTTATGGAGGTTA | TTA | chr6 | 160656498 | 160656519 | 160656503 | 160656498 | - |
| SEQ ID NO 43461 | ATGGAGGTTAGGTAATTAATGG | CTT | chr6 | 160656486 | 160656507 | 160656491 | 160656486 | - |
| SEQ ID NO 43462 | TGGAGGTTAGGTAATTAATGGA | TTA | chr6 | 160656485 | 160656506 | 160656490 | 160656485 | - |
| SEQ ID NO 43463 | GGTAATTAATGGAGTTTTAGCT | TTA | chr6 | 160656476 | 160656497 | 160656481 | 160656476 | - |
| SEQ ID NO 43464 | ATGGAGTTTTAGCTCATTTCTG | TTA | chr6 | 160656468 | 160656489 | 160656473 | 160656468 | - |
| SEQ ID NO 43465 | TAGCTCATTTCTGACTTACAGT | TTT | chr6 | 160656459 | 160656480 | 160656464 | 160656459 | - |
| SEQ ID NO 43466 | AGCTCATTTCTGACTTACAGTG | TTT | chr6 | 160656458 | 160656479 | 160656463 | 160656458 | - |
| SEQ ID NO 43467 | GCTCATTTCTGACTTACAGTGG | TTA | chr6 | 160656457 | 160656478 | 160656462 | 160656457 | - |
| SEQ ID NO 43468 | ATTTCTGACTTACAGTGGTTCC | CTC | chr6 | 160656453 | 160656474 | 160656458 | 160656453 | - |
| SEQ ID NO 43469 | CTGACTTACAGTGGTTCCAGTG | TTT | chr6 | 160656449 | 160656470 | 160656454 | 160656449 | - |
| SEQ ID NO 43470 | TGACTTACAGTGGTTCCAGTGG | TTC | chr6 | 160656448 | 160656469 | 160656453 | 160656448 | - |
| SEQ ID NO 43471 | ACTTACAGTGGTTCCAGTGGGT | CTG | chr6 | 160656446 | 160656467 | 160656451 | 160656446 | - |
| SEQ ID NO 43472 | ACAGTGGTTCCAGTGGGTCCCT | CTT | chr6 | 160656442 | 160656463 | 160656447 | 160656442 | - |

Figure 60 (Cont'd)

| | | | | | | | | |
|---|---|---|---|---|---|---|---|---|
| SEQ ID NO 43473 | CAGTGGTTCCAGTGGGTCCCTG | TTA | chr6 | 160656441 | 160656462 | 160656446 | 160656441 | - |
| SEQ ID NO 43474 | CAGTGGGTCCCTGGACTTATCC | TTC | chr6 | 160656432 | 160656453 | 160656437 | 160656432 | - |
| SEQ ID NO 43475 | GACTTATCCTCTGGTCATTTTC | CTG | chr6 | 160656419 | 160656440 | 160656424 | 160656419 | - |
| SEQ ID NO 43476 | ATCCTCTGGTCATTTTCCCAGT | CTT | chr6 | 160656414 | 160656435 | 160656419 | 160656414 | - |
| SEQ ID NO 43477 | TCCTCTGGTCATTTTCCCAGTG | TTA | chr6 | 160656413 | 160656434 | 160656418 | 160656413 | - |
| SEQ ID NO 43478 | TGGTCATTTTCCCAGTGCCAAA | CTC | chr6 | 160656408 | 160656429 | 160656413 | 160656408 | - |
| SEQ ID NO 43479 | GTCATTTTCCCAGTGCCAAAAT | CTG | chr6 | 160656406 | 160656427 | 160656411 | 160656406 | - |
| SEQ ID NO 43480 | TCCCAGTGCCAAAATGCATAAT | TTT | chr6 | 160656399 | 160656420 | 160656404 | 160656399 | - |
| SEQ ID NO 43481 | CCCAGTGCCAAAATGCATAATT | TTT | chr6 | 160656398 | 160656419 | 160656403 | 160656398 | - |
| SEQ ID NO 43482 | CCAGTGCCAAAATGCATAATTT | TTC | chr6 | 160656397 | 160656418 | 160656402 | 160656397 | - |
| SEQ ID NO 43483 | GTATAGACATACTTATTAGCTG | TTT | chr6 | 160656375 | 160656396 | 160656380 | 160656375 | - |
| SEQ ID NO 43484 | TATAGACATACTTATTAGCTGG | TTG | chr6 | 160656374 | 160656395 | 160656379 | 160656374 | - |
| SEQ ID NO 43485 | ATTAGCTGGCAGAAATGCCACA | CTT | chr6 | 160656361 | 160656382 | 160656366 | 160656361 | - |
| SEQ ID NO 43486 | TTAGCTGGCAGAAATGCCACAT | TTA | chr6 | 160656360 | 160656381 | 160656365 | 160656360 | - |
| SEQ ID NO 43487 | GCTGGCAGAAATGCCACATTGG | TTA | chr6 | 160656357 | 160656378 | 160656362 | 160656357 | - |
| SEQ ID NO 43488 | GCAGAAATGCCACATTGGCTCC | CTG | chr6 | 160656353 | 160656374 | 160656358 | 160656353 | - |
| SEQ ID NO 43489 | GCTCCCTGACTGGTAGGATGAG | TTG | chr6 | 160656336 | 160656357 | 160656341 | 160656336 | - |
| SEQ ID NO 43490 | CCTGACTGGTAGGATGAGGGCT | CTC | chr6 | 160656332 | 160656353 | 160656337 | 160656332 | - |
| SEQ ID NO 43491 | ACTGGTAGGATGAGGGCTATTA | CTG | chr6 | 160656328 | 160656349 | 160656333 | 160656328 | - |
| SEQ ID NO 43492 | GTAGGATGAGGGCTATTATGGT | CTG | chr6 | 160656324 | 160656345 | 160656329 | 160656324 | - |
| SEQ ID NO 43493 | TTATGGTGGGAAAGGCCAAACA | CTA | chr6 | 160656309 | 160656330 | 160656314 | 160656309 | - |
| SEQ ID NO 43494 | TGGTGGGAAAGGCCAAACAGAA | TTA | chr6 | 160656306 | 160656327 | 160656311 | 160656306 | - |
| SEQ ID NO 43495 | GAGCTGTCTCTACCTAGAAAAA | TTA | chr6 | 160656277 | 160656298 | 160656282 | 160656277 | - |
| SEQ ID NO 43496 | TCTCTACCTAGAAAAATAAAAA | CTG | chr6 | 160656271 | 160656292 | 160656276 | 160656271 | - |
| SEQ ID NO 43497 | TACCTAGAAAAATAAAAAAATC | CTC | chr6 | 160656267 | 160656288 | 160656272 | 160656267 | - |
| SEQ ID NO 43498 | CCTAGAAAAATAAAAAAATCAA | CTA | chr6 | 160656265 | 160656286 | 160656270 | 160656265 | - |
| SEQ ID NO 43499 | GAAAAATAAAAAAATCAAAAAC | CTA | chr6 | 160656261 | 160656282 | 160656266 | 160656261 | - |
| SEQ ID NO 43500 | GAGGGACTGAAGTGATTAGTGT | CTG | chr6 | 160656224 | 160656245 | 160656229 | 160656224 | - |
| SEQ ID NO 43501 | AAGTGATTAGTGTCACCATCAA | CTG | chr6 | 160656215 | 160656236 | 160656220 | 160656215 | - |
| SEQ ID NO 43502 | GTGTCACCATCAAGGACTTGAA | TTA | chr6 | 160656206 | 160656227 | 160656211 | 160656206 | - |
| SEQ ID NO 43503 | GAAAGACGCAGGGGTGGTGATT | CTT | chr6 | 160656187 | 160656208 | 160656192 | 160656187 | - |
| SEQ ID NO 43504 | AAAGACGCAGGGGTGGTGATTC | TTG | chr6 | 160656186 | 160656207 | 160656191 | 160656186 | - |
| SEQ ID NO 43505 | CCACCACATCCCTGTTCAACTC | TTC | chr6 | 160656164 | 160656185 | 160656169 | 160656164 | - |
| SEQ ID NO 43506 | TTCAACTCTCCCATTTGACCTG | CTG | chr6 | 160656150 | 160656171 | 160656155 | 160656150 | - |
| SEQ ID NO 43507 | AACTCTCCCATTTGACCTGTGC | TTC | chr6 | 160656147 | 160656168 | 160656152 | 160656147 | - |
| SEQ ID NO 43508 | TCCCATTTGACCTGTGCAGAGG | CTC | chr6 | 160656142 | 160656163 | 160656147 | 160656142 | - |
| SEQ ID NO 43509 | CCATTTGACCTGTGCAGAGGAC | CTC | chr6 | 160656140 | 160656161 | 160656145 | 160656140 | - |
| SEQ ID NO 43510 | GACCTGTGCAGAGGACAGATGG | TTT | chr6 | 160656134 | 160656155 | 160656139 | 160656134 | - |
| SEQ ID NO 43511 | ACCTGTGCAGAGGACAGATGGA | TTG | chr6 | 160656133 | 160656154 | 160656138 | 160656133 | - |
| SEQ ID NO 43512 | TGCAGAGGACAGATGGATCTTG | CTG | chr6 | 160656128 | 160656149 | 160656133 | 160656128 | - |
| SEQ ID NO 43513 | GGAAAATGATGGTGGATTATTT | CTT | chr6 | 160656107 | 160656128 | 160656112 | 160656107 | - |
| SEQ ID NO 43514 | GAAAATGATGGTGGATTATTTT | TTG | chr6 | 160656106 | 160656127 | 160656111 | 160656106 | - |
| SEQ ID NO 43515 | TTTTAAGCTTAACCAAGTGGTG | TTA | chr6 | 160656088 | 160656109 | 160656093 | 160656088 | - |
| SEQ ID NO 43516 | TAAGCTTAACCAAGTGGTGACT | TTT | chr6 | 160656085 | 160656106 | 160656090 | 160656085 | - |
| SEQ ID NO 43517 | AAGCTTAACCAAGTGGTGACTC | TTT | chr6 | 160656084 | 160656105 | 160656089 | 160656084 | - |
| SEQ ID NO 43518 | AGCTTAACCAAGTGGTGACTCC | TTA | chr6 | 160656083 | 160656104 | 160656088 | 160656083 | - |
| SEQ ID NO 43519 | AACCAAGTGGTGACTCCAATTG | CTT | chr6 | 160656078 | 160656099 | 160656083 | 160656078 | - |
| SEQ ID NO 43520 | ACCAAGTGGTGACTCCAATTGC | TTA | chr6 | 160656077 | 160656098 | 160656082 | 160656077 | - |
| SEQ ID NO 43521 | CAATTGCAGCTGCTCTACCAGT | CTC | chr6 | 160656062 | 160656083 | 160656067 | 160656062 | - |
| SEQ ID NO 43522 | CAGCTGCTCTACCAGTTGTGGT | TTG | chr6 | 160656056 | 160656077 | 160656061 | 160656056 | - |
| SEQ ID NO 43523 | CTCTACCAGTTGTGGTTTTGTT | CTG | chr6 | 160656050 | 160656071 | 160656055 | 160656050 | - |
| SEQ ID NO 43524 | TACCAGTTGTGGTTTTGTTGCT | CTC | chr6 | 160656047 | 160656068 | 160656052 | 160656047 | - |
| SEQ ID NO 43525 | CCAGTTGTGGTTTTGTTGCTTG | CTA | chr6 | 160656045 | 160656066 | 160656050 | 160656045 | - |
| SEQ ID NO 43526 | TGGTTTTGTTGCTTGAGCAAAT | TTG | chr6 | 160656038 | 160656059 | 160656043 | 160656038 | - |
| SEQ ID NO 43527 | TGTTGCTTGAGCAAATTAACAC | TTT | chr6 | 160656032 | 160656053 | 160656037 | 160656032 | - |
| SEQ ID NO 43528 | GTTGCTTGAGCAAATTAACACA | TTT | chr6 | 160656031 | 160656052 | 160656036 | 160656031 | - |
| SEQ ID NO 43529 | TTGCTTGAGCAAATTAACACAT | TTG | chr6 | 160656030 | 160656051 | 160656035 | 160656030 | - |
| SEQ ID NO 43530 | CTTGAGCAAATTAACACATCTC | TTG | chr6 | 160656027 | 160656048 | 160656032 | 160656027 | - |

Figure 60 (Cont'd)

| SEQ ID NO | Sequence | Codon | Chr | Start | End | Pos1 | Pos2 | - |
|---|---|---|---|---|---|---|---|---|
| SEQ ID NO 43531 | GAGCAAATTAACACATCTCCTG | CTT | chr6 | 160656024 | 160656045 | 160656029 | 160656024 | - |
| SEQ ID NO 43532 | AGCAAATTAACACATCTCCTGG | TTG | chr6 | 160656023 | 160656044 | 160656028 | 160656023 | - |
| SEQ ID NO 43533 | ACACATCTCCTGGTGCCTGGTA | TTA | chr6 | 160656014 | 160656035 | 160656019 | 160656014 | - |
| SEQ ID NO 43534 | CTGGTGCCTGGTATGCAGCCAT | CTC | chr6 | 160656005 | 160656026 | 160656010 | 160656005 | - |
| SEQ ID NO 43535 | GTGCCTGGTATGCAGCCATTGG | CTG | chr6 | 160656002 | 160656023 | 160656007 | 160656002 | - |
| SEQ ID NO 43536 | GTATGCAGCCATTGGCTTGGCA | CTG | chr6 | 160655995 | 160656016 | 160656000 | 160655995 | - |
| SEQ ID NO 43537 | GCTTGGCAAGTGGCTTTTTCTC | TTG | chr6 | 160655981 | 160656002 | 160655986 | 160655981 | - |
| SEQ ID NO 43538 | GGCAAGTGGCTTTTTCTCCATT | CTT | chr6 | 160655977 | 160655998 | 160655982 | 160655977 | - |
| SEQ ID NO 43539 | GCAAGTGGCTTTTTCTCCATTC | TTG | chr6 | 160655976 | 160655997 | 160655981 | 160655976 | - |
| SEQ ID NO 43540 | TTTCTCCATTCCTGTCCATAAG | CTT | chr6 | 160655965 | 160655986 | 160655970 | 160655965 | - |
| SEQ ID NO 43541 | TTCTCCATTCCTGTCCATAAGA | TTT | chr6 | 160655964 | 160655985 | 160655969 | 160655964 | - |
| SEQ ID NO 43542 | TCTCCATTCCTGTCCATAAGAC | TTT | chr6 | 160655963 | 160655984 | 160655968 | 160655963 | - |
| SEQ ID NO 43543 | CTCCATTCCTGTCCATAAGACC | TTT | chr6 | 160655962 | 160655983 | 160655967 | 160655962 | - |
| SEQ ID NO 43544 | TCCATTCCTGTCCATAAGACCC | TTC | chr6 | 160655961 | 160655982 | 160655966 | 160655961 | - |
| SEQ ID NO 43545 | CATTCCTGTCCATAAGACCCAC | CTC | chr6 | 160655959 | 160655980 | 160655964 | 160655959 | - |
| SEQ ID NO 43546 | CTGTCCATAAGACCCACCAGAA | TTC | chr6 | 160655954 | 160655975 | 160655959 | 160655954 | - |
| SEQ ID NO 43547 | TCCATAAGACCCACCAGAAGCA | CTG | chr6 | 160655951 | 160655972 | 160655956 | 160655951 | - |
| SEQ ID NO 43548 | GCCTTCAGCTGACAAGGCCAGC | TTT | chr6 | 160655925 | 160655946 | 160655930 | 160655925 | - |
| SEQ ID NO 43549 | CCTTCAGCTGACAAGGCCAGCA | TTG | chr6 | 160655924 | 160655945 | 160655929 | 160655924 | - |
| SEQ ID NO 43550 | CAGCTGACAAGGCCAGCATTAT | CTT | chr6 | 160655920 | 160655941 | 160655925 | 160655920 | - |
| SEQ ID NO 43551 | AGCTGACAAGGCCAGCATTATA | TTC | chr6 | 160655919 | 160655940 | 160655924 | 160655919 | - |
| SEQ ID NO 43552 | ACAAGGCCAGCATTATACCTTT | CTG | chr6 | 160655914 | 160655935 | 160655919 | 160655914 | - |
| SEQ ID NO 43553 | TACCTTTACCACCCTACCTCAG | TTA | chr6 | 160655899 | 160655920 | 160655904 | 160655899 | - |
| SEQ ID NO 43554 | TACCACCCTACCTCAGGGGTGT | CTT | chr6 | 160655893 | 160655914 | 160655898 | 160655893 | - |
| SEQ ID NO 43555 | ACCACCCTACCTCAGGGGTGTA | TTT | chr6 | 160655892 | 160655913 | 160655897 | 160655892 | - |
| SEQ ID NO 43556 | CCACCCTACCTCAGGGGTGTAT | TTA | chr6 | 160655891 | 160655912 | 160655896 | 160655891 | - |
| SEQ ID NO 43557 | CCTCAGGGGTGTATCAACTCTC | CTA | chr6 | 160655883 | 160655904 | 160655888 | 160655883 | - |
| SEQ ID NO 43558 | AGGGGTGTATCAACTCTCCAGC | CTC | chr6 | 160655879 | 160655900 | 160655884 | 160655879 | - |
| SEQ ID NO 43559 | TCCAGCTTTGTGTCATAATCTT | CTC | chr6 | 160655863 | 160655884 | 160655868 | 160655863 | - |
| SEQ ID NO 43560 | CAGCTTTGTGTCATAATCTTAT | CTC | chr6 | 160655861 | 160655882 | 160655866 | 160655861 | - |
| SEQ ID NO 43561 | TGTGTCATAATCTTATTTGGAG | CTT | chr6 | 160655855 | 160655876 | 160655860 | 160655855 | - |
| SEQ ID NO 43562 | GTGTCATAATCTTATTTGGAGA | TTT | chr6 | 160655854 | 160655875 | 160655859 | 160655854 | - |
| SEQ ID NO 43563 | TGTCATAATCTTATTTGGAGAG | TTG | chr6 | 160655853 | 160655874 | 160655858 | 160655853 | - |
| SEQ ID NO 43564 | ATTTGGAGAGACCTTGCTCGCT | CTT | chr6 | 160655841 | 160655862 | 160655846 | 160655841 | - |
| SEQ ID NO 43565 | TTTGGAGAGACCTTGCTCGCTT | TTA | chr6 | 160655840 | 160655861 | 160655845 | 160655840 | - |
| SEQ ID NO 43566 | GGAGAGACCTTGCTCGCTTTTC | TTT | chr6 | 160655837 | 160655858 | 160655842 | 160655837 | - |
| SEQ ID NO 43567 | GAGAGACCTTGCTCGCTTTTCA | TTG | chr6 | 160655836 | 160655857 | 160655841 | 160655836 | - |
| SEQ ID NO 43568 | GCTCGCTTTTCACTTCCACGAG | CTT | chr6 | 160655826 | 160655847 | 160655831 | 160655826 | - |
| SEQ ID NO 43569 | CTCGCTTTTCACTTCCACGAGA | TTG | chr6 | 160655825 | 160655846 | 160655830 | 160655825 | - |
| SEQ ID NO 43570 | GCTTTTCACTTCCACGAGATAT | CTC | chr6 | 160655822 | 160655843 | 160655827 | 160655822 | - |
| SEQ ID NO 43571 | TTCACTTCCACGAGATATAACA | CTT | chr6 | 160655818 | 160655839 | 160655823 | 160655818 | - |
| SEQ ID NO 43572 | TCACTTCCACGAGATATAACAC | TTT | chr6 | 160655817 | 160655838 | 160655822 | 160655817 | - |
| SEQ ID NO 43573 | CACTTCCACGAGATATAACACT | TTT | chr6 | 160655816 | 160655837 | 160655821 | 160655816 | - |
| SEQ ID NO 43574 | ACTTCCACGAGATATAACACTG | TTC | chr6 | 160655815 | 160655836 | 160655820 | 160655815 | - |
| SEQ ID NO 43575 | CCACGAGATATAACACTGGTCC | CTT | chr6 | 160655811 | 160655832 | 160655816 | 160655811 | - |
| SEQ ID NO 43576 | CACGAGATATAACACTGGTCCA | TTC | chr6 | 160655810 | 160655831 | 160655815 | 160655810 | - |
| SEQ ID NO 43577 | GTCCATTACATTCATGACATTA | CTG | chr6 | 160655793 | 160655814 | 160655798 | 160655793 | - |
| SEQ ID NO 43578 | CATTCATGACATTATGATGATT | TTA | chr6 | 160655785 | 160655806 | 160655790 | 160655785 | - |
| SEQ ID NO 43579 | ATGACATTATGATGATTGGATA | TTC | chr6 | 160655780 | 160655801 | 160655785 | 160655780 | - |
| SEQ ID NO 43580 | TGATGATTGGATACAGTGAGCA | TTA | chr6 | 160655771 | 160655792 | 160655776 | 160655771 | - |
| SEQ ID NO 43581 | GATACAGTGAGCAAGAAGTAGC | TTG | chr6 | 160655762 | 160655783 | 160655767 | 160655762 | - |
| SEQ ID NO 43582 | AACTTATTGGTGAGACATTTGT | CTG | chr6 | 160655730 | 160655751 | 160655735 | 160655730 | - |
| SEQ ID NO 43583 | ATTGGTGAGACATTTGTATGCC | CTT | chr6 | 160655725 | 160655746 | 160655730 | 160655725 | - |
| SEQ ID NO 43584 | TTGGTGAGACATTTGTATGCCA | TTA | chr6 | 160655724 | 160655745 | 160655729 | 160655724 | - |
| SEQ ID NO 43585 | GTGAGACATTTGTATGCCAGAG | TTG | chr6 | 160655721 | 160655742 | 160655726 | 160655721 | - |
| SEQ ID NO 43586 | GTATGCCAGAGGATGGGAAATA | TTT | chr6 | 160655710 | 160655731 | 160655715 | 160655710 | - |
| SEQ ID NO 43587 | TATGCCAGAGGATGGGAAATAA | TTG | chr6 | 160655709 | 160655730 | 160655714 | 160655709 | - |
| SEQ ID NO 43588 | AAATTTAGGGACTTTCTACCTC | CTA | chr6 | 160655678 | 160655699 | 160655683 | 160655678 | - |

Figure 60 (Cont'd)

| | | | | | | | | |
|---|---|---|---|---|---|---|---|---|
| SEQ ID NO 43589 | AGGGACTTTCTACCTCGGTAAAA | TTT | chr6 | 160655672 | 160655693 | 160655677 | 160655672 | - |
| SEQ ID NO 43590 | GGGACTTTCTACCTCGGTAAAAA | TTA | chr6 | 160655671 | 160655692 | 160655676 | 160655671 | - |
| SEQ ID NO 43591 | TCTACCTCGGTAAAATTTCTAG | CTT | chr6 | 160655664 | 160655685 | 160655669 | 160655664 | - |
| SEQ ID NO 43592 | CTACCTCGGTAAAATTTCTAGG | TTT | chr6 | 160655663 | 160655684 | 160655668 | 160655663 | - |
| SEQ ID NO 43593 | TACCTCGGTAAAATTTCTAGGG | TTC | chr6 | 160655662 | 160655683 | 160655667 | 160655662 | - |
| SEQ ID NO 43594 | CCTCGGTAAAATTTCTAGGGTT | CTA | chr6 | 160655660 | 160655681 | 160655665 | 160655660 | - |
| SEQ ID NO 43595 | GGTAAAATTTCTAGGGTTCCAG | CTC | chr6 | 160655656 | 160655677 | 160655661 | 160655656 | - |
| SEQ ID NO 43596 | CTAGGGTTCCAGTGGCATGAGA | TTT | chr6 | 160655646 | 160655667 | 160655651 | 160655646 | - |
| SEQ ID NO 43597 | TAGGGTTCCAGTGGCATGAGAC | TTC | chr6 | 160655645 | 160655666 | 160655650 | 160655645 | - |
| SEQ ID NO 43598 | GGGTTCCAGTGGCATGAGACCT | CTA | chr6 | 160655643 | 160655664 | 160655648 | 160655643 | - |
| SEQ ID NO 43599 | CAGTGGCATGAGACCTATGGAG | TTC | chr6 | 160655637 | 160655658 | 160655642 | 160655637 | - |
| SEQ ID NO 43600 | TGGAGATATTCCTTCTAAGGTG | CTA | chr6 | 160655620 | 160655641 | 160655625 | 160655620 | - |
| SEQ ID NO 43601 | CTTCTAAGGTGAAGCATAACTT | TTC | chr6 | 160655609 | 160655630 | 160655614 | 160655609 | - |
| SEQ ID NO 43602 | CTAAGGTGAAGCATAACTTGCT | CTT | chr6 | 160655606 | 160655627 | 160655611 | 160655606 | - |
| SEQ ID NO 43603 | TAAGGTGAAGCATAACTTGCTG | TTC | chr6 | 160655605 | 160655626 | 160655610 | 160655605 | - |
| SEQ ID NO 43604 | AGGTGAAGCATAACTTGCTGCG | CTA | chr6 | 160655603 | 160655624 | 160655608 | 160655603 | - |
| SEQ ID NO 43605 | GCTGCGTTTGGCCCCTCTTACA | CTT | chr6 | 160655587 | 160655608 | 160655592 | 160655587 | - |
| SEQ ID NO 43606 | CTGCGTTTGGCCCCTCTTACAA | TTG | chr6 | 160655586 | 160655607 | 160655591 | 160655586 | - |
| SEQ ID NO 43607 | CGTTTGGCCCCTCTTACAACCA | CTG | chr6 | 160655583 | 160655604 | 160655588 | 160655583 | - |
| SEQ ID NO 43608 | GGCCCCTCTTACAACCAAGAAA | TTT | chr6 | 160655578 | 160655599 | 160655583 | 160655578 | - |
| SEQ ID NO 43609 | GCCCCTCTTACAACCAAGAAAG | TTG | chr6 | 160655577 | 160655598 | 160655582 | 160655577 | - |
| SEQ ID NO 43610 | TTACAACCAAGAAAGAGGCACA | CTC | chr6 | 160655570 | 160655591 | 160655575 | 160655570 | - |
| SEQ ID NO 43611 | ACAACCAAGAAAGAGGCACAAT | CTT | chr6 | 160655568 | 160655589 | 160655573 | 160655568 | - |
| SEQ ID NO 43612 | CAACCAAGAAAGAGGCACAATG | TTA | chr6 | 160655567 | 160655588 | 160655572 | 160655567 | - |
| SEQ ID NO 43613 | GTGGGCCTATTTGGATTTTGGA | CTG | chr6 | 160655541 | 160655562 | 160655546 | 160655541 | - |
| SEQ ID NO 43614 | TTTGGATTTTGGAGGCAACACA | CTA | chr6 | 160655532 | 160655553 | 160655537 | 160655532 | - |
| SEQ ID NO 43615 | GGATTTTGGAGGCAACACATTC | TTT | chr6 | 160655529 | 160655550 | 160655534 | 160655529 | - |
| SEQ ID NO 43616 | GATTTTGGAGGCAACACATTCC | TTG | chr6 | 160655528 | 160655549 | 160655533 | 160655528 | - |
| SEQ ID NO 43617 | TGGAGGCAACACATTCCTCGTT | TTT | chr6 | 160655523 | 160655544 | 160655528 | 160655523 | - |
| SEQ ID NO 43618 | GGAGGCAACACATTCCTCGTTT | TTT | chr6 | 160655522 | 160655543 | 160655527 | 160655522 | - |
| SEQ ID NO 43619 | GAGGCAACACATTCCTCGTTTG | TTG | chr6 | 160655521 | 160655542 | 160655526 | 160655521 | - |
| SEQ ID NO 43620 | CTCGTTTGGGTGTGTTACTCTG | TTC | chr6 | 160655507 | 160655528 | 160655512 | 160655507 | - |
| SEQ ID NO 43621 | GTTTGGGTGTGTTACTCTGGCC | CTC | chr6 | 160655504 | 160655525 | 160655509 | 160655504 | - |
| SEQ ID NO 43622 | GGGTGTGTTACTCTGGCCCATT | TTT | chr6 | 160655500 | 160655521 | 160655505 | 160655500 | - |
| SEQ ID NO 43623 | GGTGTGTTACTCTGGCCCATTT | TTG | chr6 | 160655499 | 160655520 | 160655504 | 160655499 | - |
| SEQ ID NO 43624 | CTCTGGCCCATTTATCGAGTGA | TTA | chr6 | 160655490 | 160655511 | 160655495 | 160655490 | - |
| SEQ ID NO 43625 | TGGCCCATTTATCGAGTGACCT | CTC | chr6 | 160655487 | 160655508 | 160655492 | 160655487 | - |
| SEQ ID NO 43626 | GCCCATTTATCGAGTGACCTGA | CTG | chr6 | 160655485 | 160655506 | 160655490 | 160655485 | - |
| SEQ ID NO 43627 | ATCGAGTGACCTGAAAGGCTGC | TTT | chr6 | 160655477 | 160655498 | 160655482 | 160655477 | - |
| SEQ ID NO 43628 | TCGAGTGACCTGAAAGGCTGCC | TTA | chr6 | 160655476 | 160655497 | 160655481 | 160655476 | - |
| SEQ ID NO 43629 | AAAGGCTGCCAGATTTAAGTGC | CTG | chr6 | 160655464 | 160655485 | 160655469 | 160655464 | - |
| SEQ ID NO 43630 | CCAGATTTAAGTGCAGTCTAGA | CTG | chr6 | 160655456 | 160655477 | 160655461 | 160655456 | - |
| SEQ ID NO 43631 | AAGTGCAGTCTAGAACAAAGA | TTT | chr6 | 160655448 | 160655469 | 160655453 | 160655448 | - |
| SEQ ID NO 43632 | AGTGCAGTCTAGAACAAAGAA | TTA | chr6 | 160655447 | 160655468 | 160655452 | 160655447 | - |
| SEQ ID NO 43633 | GAACAAAGAAGGCTCTGAAAC | CTA | chr6 | 160655436 | 160655457 | 160655441 | 160655436 | - |
| SEQ ID NO 43634 | TGAAACAGGCCAGGCTGCTGT | CTC | chr6 | 160655420 | 160655441 | 160655425 | 160655420 | - |
| SEQ ID NO 43635 | AAACAGGCCAGGCTGCTGTGA | CTG | chr6 | 160655418 | 160655439 | 160655423 | 160655418 | - |
| SEQ ID NO 43636 | CTGTGAAAGCTGCTCTGCCATT | CTG | chr6 | 160655402 | 160655423 | 160655407 | 160655402 | - |
| SEQ ID NO 43637 | TGAAAGCTGCTCTGCCATTGG | CTG | chr6 | 160655399 | 160655420 | 160655404 | 160655399 | - |
| SEQ ID NO 43638 | CTCTGCCATTGGGCCACATGA | CTG | chr6 | 160655390 | 160655411 | 160655395 | 160655390 | - |
| SEQ ID NO 43639 | TGCCATTTGGGCCACATGACCC | CTC | chr6 | 160655387 | 160655408 | 160655392 | 160655387 | - |
| SEQ ID NO 43640 | CCATTTGGGCCACATGACCCCG | CTG | chr6 | 160655385 | 160655406 | 160655390 | 160655385 | - |
| SEQ ID NO 43641 | GGGCCACATGACCCCGCAGATC | TTT | chr6 | 160655379 | 160655400 | 160655384 | 160655379 | - |
| SEQ ID NO 43642 | GGCCACATGACCCCGCAGATCC | TTG | chr6 | 160655378 | 160655399 | 160655383 | 160655378 | - |
| SEQ ID NO 43643 | GAGGTGTCAGTGGCAGATAGGG | CTT | chr6 | 160655346 | 160655367 | 160655351 | 160655346 | - |
| SEQ ID NO 43644 | AGGTGTCAGTGGCAGATAGGGA | TTG | chr6 | 160655345 | 160655366 | 160655350 | 160655345 | - |
| SEQ ID NO 43645 | TTTGGAGCCTTTGGCAGGCCCC | CTG | chr6 | 160655318 | 160655339 | 160655323 | 160655318 | - |
| SEQ ID NO 43646 | GGAGCCTTTGGCAGGCCCCCAT | TTT | chr6 | 160655315 | 160655336 | 160655320 | 160655315 | - |

Figure 60 (Cont'd)

| | | | | | | | | |
|---|---|---|---|---|---|---|---|---|
| SEQ ID NO 43647 | GAGCCTTTGGCAGGCCCCCATA | TTG | chr6 | 160655314 | 160655335 | 160655319 | 160655314 | - |
| SEQ ID NO 43648 | TGGCAGGCCCCCATAGGTGAAT | CTT | chr6 | 160655307 | 160655328 | 160655312 | 160655307 | - |
| SEQ ID NO 43649 | GGCAGGCCCCCATAGGTGAATC | TTT | chr6 | 160655306 | 160655327 | 160655311 | 160655306 | - |
| SEQ ID NO 43650 | GCAGGCCCCCATAGGTGAATCA | TTG | chr6 | 160655305 | 160655326 | 160655310 | 160655305 | - |
| SEQ ID NO 43651 | TAGGATTTTGGAGCAAGGCCCT | CTC | chr6 | 160655270 | 160655291 | 160655275 | 160655270 | - |
| SEQ ID NO 43652 | GGATTTTGGAGCAAGGCCCTGC | CTA | chr6 | 160655268 | 160655289 | 160655273 | 160655268 | - |
| SEQ ID NO 43653 | TGGAGCAAGGCCCTGCCACTTC | TTT | chr6 | 160655262 | 160655283 | 160655267 | 160655262 | - |
| SEQ ID NO 43654 | GGAGCAAGGCCCTGCCACTTCT | TTT | chr6 | 160655261 | 160655282 | 160655266 | 160655261 | - |
| SEQ ID NO 43655 | GAGCAAGGCCCTGCCACTTCTG | TTG | chr6 | 160655260 | 160655281 | 160655265 | 160655260 | - |
| SEQ ID NO 43656 | CCACTTCTGCAGATAACTACTC | CTG | chr6 | 160655247 | 160655268 | 160655252 | 160655247 | - |
| SEQ ID NO 43657 | CTGCAGATAACTACTCTCCTTT | CTT | chr6 | 160655241 | 160655262 | 160655246 | 160655241 | - |
| SEQ ID NO 43658 | TGCAGATAACTACTCTCCTTTT | TTC | chr6 | 160655240 | 160655261 | 160655245 | 160655240 | - |
| SEQ ID NO 43659 | CAGATAACTACTCTCCTTTTGA | CTG | chr6 | 160655238 | 160655259 | 160655243 | 160655238 | - |
| SEQ ID NO 43660 | CTCTCCTTTTGAGAGACAGCTA | CTA | chr6 | 160655228 | 160655249 | 160655233 | 160655228 | - |
| SEQ ID NO 43661 | TCCTTTTGAGAGACAGCTATTG | CTC | chr6 | 160655225 | 160655246 | 160655230 | 160655225 | - |
| SEQ ID NO 43662 | CTTTTGAGAGACAGCTATTGGT | CTC | chr6 | 160655223 | 160655244 | 160655228 | 160655223 | - |
| SEQ ID NO 43663 | TTGAGAGACAGCTATTGGTCTG | CTT | chr6 | 160655220 | 160655241 | 160655225 | 160655220 | - |
| SEQ ID NO 43664 | TGAGAGACAGCTATTGGTCTGT | TTT | chr6 | 160655219 | 160655240 | 160655224 | 160655219 | - |
| SEQ ID NO 43665 | GAGAGACAGCTATTGGTCTGTT | TTT | chr6 | 160655218 | 160655239 | 160655223 | 160655218 | - |
| SEQ ID NO 43666 | AGAGACAGCTATTGGTCTGTTA | TTG | chr6 | 160655217 | 160655238 | 160655222 | 160655217 | - |
| SEQ ID NO 43667 | TTGGTCTGTTATTGGGCTTTGG | CTA | chr6 | 160655206 | 160655227 | 160655211 | 160655206 | - |
| SEQ ID NO 43668 | GTCTGTTATTGGGCTTTGGTGG | TTG | chr6 | 160655203 | 160655224 | 160655208 | 160655203 | - |
| SEQ ID NO 43669 | TTATTGGGCTTTGGTGGTAACT | CTG | chr6 | 160655198 | 160655219 | 160655203 | 160655198 | - |
| SEQ ID NO 43670 | TTGGGCTTTGGTGGTAACTGAA | TTA | chr6 | 160655195 | 160655216 | 160655200 | 160655195 | - |
| SEQ ID NO 43671 | GGCTTTGGTGGTAACTGAACGT | TTG | chr6 | 160655192 | 160655213 | 160655197 | 160655192 | - |
| SEQ ID NO 43672 | TGGTGGTAACTGAACGTTTGAC | CTT | chr6 | 160655187 | 160655208 | 160655192 | 160655187 | - |
| SEQ ID NO 43673 | GGTGGTAACTGAACGTTTGACT | TTT | chr6 | 160655186 | 160655207 | 160655191 | 160655186 | - |
| SEQ ID NO 43674 | GTGGTAACTGAACGTTTGACTG | TTG | chr6 | 160655185 | 160655206 | 160655190 | 160655185 | - |
| SEQ ID NO 43675 | AACGTTTGACTGTGGGTCATAA | CTG | chr6 | 160655175 | 160655196 | 160655180 | 160655175 | - |
| SEQ ID NO 43676 | GACTGTGGGTCATAAAGTCACC | TTT | chr6 | 160655168 | 160655189 | 160655173 | 160655168 | - |
| SEQ ID NO 43677 | ACTGTGGGTCATAAAGTCACCA | TTG | chr6 | 160655167 | 160655188 | 160655172 | 160655167 | - |
| SEQ ID NO 43678 | TGGGTCATAAAGTCACCATGCT | CTG | chr6 | 160655163 | 160655184 | 160655168 | 160655163 | - |
| SEQ ID NO 43679 | CCTGAACCTGCCTATCATGAAC | CTA | chr6 | 160655140 | 160655161 | 160655145 | 160655140 | - |
| SEQ ID NO 43680 | AACCTGCCTATCATGAACTGGT | CTG | chr6 | 160655136 | 160655157 | 160655141 | 160655136 | - |
| SEQ ID NO 43681 | CCTATCATGAACTGGTTGCTTT | CTG | chr6 | 160655130 | 160655151 | 160655135 | 160655130 | - |
| SEQ ID NO 43682 | TCATGAACTGGTTGCTTTCTGA | CTA | chr6 | 160655126 | 160655147 | 160655131 | 160655126 | - |
| SEQ ID NO 43683 | GTTGCTTTCTGACCCATCTAGC | CTG | chr6 | 160655116 | 160655137 | 160655121 | 160655116 | - |
| SEQ ID NO 43684 | CTTTCTGACCCATCTAGCCATG | TTG | chr6 | 160655112 | 160655133 | 160655117 | 160655112 | - |
| SEQ ID NO 43685 | TCTGACCCATCTAGCCATGAAG | CTT | chr6 | 160655109 | 160655130 | 160655114 | 160655109 | - |
| SEQ ID NO 43686 | CTGACCCATCTAGCCATGAAGT | TTT | chr6 | 160655108 | 160655129 | 160655113 | 160655108 | - |
| SEQ ID NO 43687 | TGACCCATCTAGCCATGAAGTG | TTC | chr6 | 160655107 | 160655128 | 160655112 | 160655107 | - |
| SEQ ID NO 43688 | ACCCATCTAGCCATGAAGTGGG | CTG | chr6 | 160655105 | 160655126 | 160655110 | 160655105 | - |
| SEQ ID NO 43689 | GCCATGAAGTGGGTCAGCACAG | CTA | chr6 | 160655096 | 160655117 | 160655101 | 160655096 | - |
| SEQ ID NO 43690 | CATCATCAAATTGAAGTGGTGT | TTT | chr6 | 160655066 | 160655087 | 160655071 | 160655066 | - |
| SEQ ID NO 43691 | ATCATCAAATTGAAGTGGTGTG | TTC | chr6 | 160655065 | 160655086 | 160655070 | 160655065 | - |
| SEQ ID NO 43692 | AAGTGGTGTGTATGTGATCGGG | TTG | chr6 | 160655053 | 160655074 | 160655058 | 160655053 | - |
| SEQ ID NO 43693 | GAGCAGGTCCTGAAGGCACAAG | CTT | chr6 | 160655028 | 160655049 | 160655033 | 160655028 | - |
| SEQ ID NO 43694 | AGCAGGTCCTGAAGGCACAAGT | TTG | chr6 | 160655027 | 160655048 | 160655032 | 160655027 | - |
| SEQ ID NO 43695 | AAGGCACAAGTAAGTTACATAA | CTG | chr6 | 160655016 | 160655037 | 160655021 | 160655016 | - |
| SEQ ID NO 43696 | CATAAGGAAGTGGCTCAAATGC | TTA | chr6 | 160654999 | 160655020 | 160655004 | 160654999 | - |
| SEQ ID NO 43697 | AAATGCCCATGTTCTCCACTCA | CTC | chr6 | 160654983 | 160655004 | 160654988 | 160654983 | - |
| SEQ ID NO 43698 | TCCACTCATGCCACCCTGCCTT | TTC | chr6 | 160654969 | 160654990 | 160654974 | 160654969 | - |
| SEQ ID NO 43699 | CACTCATGCCACCCTGCCTTCC | CTC | chr6 | 160654967 | 160654988 | 160654972 | 160654967 | - |
| SEQ ID NO 43700 | ATGCCACCCTGCCTTCCCTCCC | CTC | chr6 | 160654962 | 160654983 | 160654967 | 160654962 | - |
| SEQ ID NO 43701 | CCTTCCCTCCCCAGCCTGCAC | CTG | chr6 | 160654951 | 160654972 | 160654956 | 160654951 | - |
| SEQ ID NO 43702 | CCCTCCCCAGCCTGCACCAAT | CTT | chr6 | 160654947 | 160654968 | 160654952 | 160654947 | - |
| SEQ ID NO 43703 | CCTCCCCAGCCTGCACCAATG | TTC | chr6 | 160654946 | 160654967 | 160654951 | 160654946 | - |
| SEQ ID NO 43704 | CCCCAGCCTGCACCAATGGCCT | CTC | chr6 | 160654942 | 160654963 | 160654947 | 160654942 | - |

Figure 60 (Cont'd)

| | | | | | | | | |
|---|---|---|---|---|---|---|---|---|
| SEQ ID NO 43705 | CACCAATGGCCTCATGGGGAGT | CTG | chr6 | 160654932 | 160654953 | 160654937 | 160654932 | - |
| SEQ ID NO 43706 | ATGGGGAGTTCCCTATGATCAG | CTC | chr6 | 160654919 | 160654940 | 160654924 | 160654919 | - |
| SEQ ID NO 43707 | CCTATGATCAGTTGACAGAGGA | TTC | chr6 | 160654908 | 160654929 | 160654913 | 160654908 | - |
| SEQ ID NO 43708 | TGATCAGTTGACAGAGGAAGGG | CTA | chr6 | 160654904 | 160654925 | 160654909 | 160654904 | - |
| SEQ ID NO 43709 | ACAGAGGAAGGGAAGACTAAGG | TTG | chr6 | 160654894 | 160654915 | 160654899 | 160654894 | - |
| SEQ ID NO 43710 | AGGACTGGTTCATAGATGGTTC | CTA | chr6 | 160654875 | 160654896 | 160654880 | 160654875 | - |
| SEQ ID NO 43711 | GTTCATAGATGGTTCTGCACGA | CTG | chr6 | 160654868 | 160654889 | 160654873 | 160654868 | - |
| SEQ ID NO 43712 | ATAGATGGTTCTGCACGATATG | TTC | chr6 | 160654864 | 160654885 | 160654869 | 160654864 | - |
| SEQ ID NO 43713 | TGCACGATATGCAGGCACCACC | TTC | chr6 | 160654853 | 160654874 | 160654858 | 160654853 | - |
| SEQ ID NO 43714 | CACGATATGCAGGCACCACCCG | CTG | chr6 | 160654851 | 160654872 | 160654856 | 160654851 | - |
| SEQ ID NO 43715 | CAGCACTATATCCACTTTCTAA | CTG | chr6 | 160654815 | 160654836 | 160654820 | 160654815 | - |
| SEQ ID NO 43716 | TATCCACTTTCTAAATGCATGT | CTA | chr6 | 160654807 | 160654828 | 160654812 | 160654807 | - |
| SEQ ID NO 43717 | TCTAAATGCATGTGTACACTTG | CTT | chr6 | 160654798 | 160654819 | 160654803 | 160654798 | - |
| SEQ ID NO 43718 | CTAAATGCATGTGTACACTTGT | TTT | chr6 | 160654797 | 160654818 | 160654802 | 160654797 | - |
| SEQ ID NO 43719 | TAAATGCATGTGTACACTTGTG | TTC | chr6 | 160654796 | 160654817 | 160654801 | 160654796 | - |
| SEQ ID NO 43720 | AATGCATGTGTACACTTGTGCT | CTA | chr6 | 160654794 | 160654815 | 160654799 | 160654794 | - |
| SEQ ID NO 43721 | GTGCTAAGAAAATATCTTTATT | CTT | chr6 | 160654777 | 160654798 | 160654782 | 160654777 | - |
| SEQ ID NO 43722 | TGCTAAGAAAATATCTTTATTT | TTG | chr6 | 160654776 | 160654797 | 160654781 | 160654776 | - |
| SEQ ID NO 43723 | AGAAAATATCTTTATTTTATTT | CTA | chr6 | 160654771 | 160654792 | 160654776 | 160654771 | - |
| SEQ ID NO 43724 | TATTTTATTTCCTTTATTTTTC | CTT | chr6 | 160654759 | 160654780 | 160654764 | 160654759 | - |
| SEQ ID NO 43725 | ATTTTATTTCCTTTATTTTTCC | TTT | chr6 | 160654758 | 160654779 | 160654763 | 160654758 | - |
| SEQ ID NO 43726 | TTTTATTTCCTTTATTTTTCCT | TTA | chr6 | 160654757 | 160654778 | 160654762 | 160654757 | - |
| SEQ ID NO 43727 | TATTTCCTTTATTTTTCCTTTA | TTT | chr6 | 160654754 | 160654775 | 160654759 | 160654754 | - |
| SEQ ID NO 43728 | ATTTCCTTTATTTTTCCTTTAT | TTT | chr6 | 160654753 | 160654774 | 160654758 | 160654753 | - |
| SEQ ID NO 43729 | TTTCCTTTATTTTTCCTTTATC | TTA | chr6 | 160654752 | 160654773 | 160654757 | 160654752 | - |
| SEQ ID NO 43730 | CCTTTATTTTTCCTTTATCATG | TTT | chr6 | 160654749 | 160654770 | 160654754 | 160654749 | - |
| SEQ ID NO 43731 | CTTTATTTTTCCTTTATCATGT | TTC | chr6 | 160654748 | 160654769 | 160654753 | 160654748 | - |
| SEQ ID NO 43732 | TATTTTTCCTTTATCATGTGAC | CTT | chr6 | 160654745 | 160654766 | 160654750 | 160654745 | - |
| SEQ ID NO 43733 | ATTTTTCCTTTATCATGTGACC | TTT | chr6 | 160654744 | 160654765 | 160654749 | 160654744 | - |
| SEQ ID NO 43734 | TTTTTCCTTTATCATGTGACCT | TTA | chr6 | 160654743 | 160654764 | 160654748 | 160654743 | - |
| SEQ ID NO 43735 | TTCCTTTATCATGTGACCTTAG | TTT | chr6 | 160654740 | 160654761 | 160654745 | 160654740 | - |
| SEQ ID NO 43736 | TCCTTTATCATGTGACCTTAGA | TTT | chr6 | 160654739 | 160654760 | 160654744 | 160654739 | - |
| SEQ ID NO 43737 | CCTTTATCATGTGACCTTAGAT | TTT | chr6 | 160654738 | 160654759 | 160654743 | 160654738 | - |
| SEQ ID NO 43738 | CTTTATCATGTGACCTTAGATT | TTC | chr6 | 160654737 | 160654758 | 160654742 | 160654737 | - |
| SEQ ID NO 43739 | TATCATGTGACCTTAGATTTAT | CTT | chr6 | 160654734 | 160654755 | 160654739 | 160654734 | - |
| SEQ ID NO 43740 | ATCATGTGACCTTAGATTTATG | TTT | chr6 | 160654733 | 160654754 | 160654738 | 160654733 | - |
| SEQ ID NO 43741 | TCATGTGACCTTAGATTTATGG | TTA | chr6 | 160654732 | 160654753 | 160654737 | 160654732 | - |
| SEQ ID NO 43742 | AGATTTATGGACTTCACATCAG | CTT | chr6 | 160654720 | 160654741 | 160654725 | 160654720 | - |
| SEQ ID NO 43743 | GATTTATGGACTTCACATCAGC | TTA | chr6 | 160654719 | 160654740 | 160654724 | 160654719 | - |
| SEQ ID NO 43744 | ATGGACTTCACATCAGCATTTA | TTT | chr6 | 160654714 | 160654735 | 160654719 | 160654714 | - |
| SEQ ID NO 43745 | TGGACTTCACATCAGCATTTAA | TTA | chr6 | 160654713 | 160654734 | 160654718 | 160654713 | - |
| SEQ ID NO 43746 | CACATCAGCATTTAAGCATTTA | CTT | chr6 | 160654706 | 160654727 | 160654711 | 160654706 | - |
| SEQ ID NO 43747 | ACATCAGCATTTAAGCATTTAA | TTC | chr6 | 160654705 | 160654726 | 160654710 | 160654705 | - |
| SEQ ID NO 43748 | AAGCATTTAAGTGTTGTTCATA | TTT | chr6 | 160654693 | 160654714 | 160654698 | 160654693 | - |
| SEQ ID NO 43749 | AGCATTTAAGTGTTGTTCATAT | TTA | chr6 | 160654692 | 160654713 | 160654697 | 160654692 | - |
| SEQ ID NO 43750 | AAGTGTTGTTCATATCAGCATT | TTT | chr6 | 160654685 | 160654706 | 160654690 | 160654685 | - |
| SEQ ID NO 43751 | AGTGTTGTTCATATCAGCATTT | TTA | chr6 | 160654684 | 160654705 | 160654689 | 160654684 | - |
| SEQ ID NO 43752 | TTCATATCAGCATTTAAATATT | TTG | chr6 | 160654677 | 160654698 | 160654682 | 160654677 | - |
| SEQ ID NO 43753 | ATATCAGCATTTAAATATTGTT | TTC | chr6 | 160654674 | 160654695 | 160654679 | 160654674 | - |
| SEQ ID NO 43754 | AAATATTGTTAACCTTATGTAA | TTT | chr6 | 160654662 | 160654683 | 160654667 | 160654662 | - |
| SEQ ID NO 43755 | AATATTGTTAACCTTATGTAAT | TTA | chr6 | 160654661 | 160654682 | 160654666 | 160654661 | - |
| SEQ ID NO 43756 | TTAACCTTATGTAATAACTTTT | TTG | chr6 | 160654654 | 160654675 | 160654659 | 160654654 | - |
| SEQ ID NO 43757 | ACCTTATGTAATAACTTTTGGT | TTA | chr6 | 160654651 | 160654672 | 160654656 | 160654651 | - |
| SEQ ID NO 43758 | ATGTAATAACTTTTGGTTTGGG | CTT | chr6 | 160654646 | 160654667 | 160654651 | 160654646 | - |
| SEQ ID NO 43759 | TGTAATAACTTTTGGTTTGGGG | TTA | chr6 | 160654645 | 160654666 | 160654650 | 160654645 | - |
| SEQ ID NO 43760 | TTGGTTTGGGGATTGGTGCGTT | CTT | chr6 | 160654634 | 160654655 | 160654639 | 160654634 | - |
| SEQ ID NO 43761 | TGGTTTGGGGATTGGTGCGTTT | TTT | chr6 | 160654633 | 160654654 | 160654638 | 160654633 | - |
| SEQ ID NO 43762 | GGTTTGGGGATTGGTGCGTTTC | TTT | chr6 | 160654632 | 160654653 | 160654637 | 160654632 | - |

Figure 60 (Cont'd)

| SEQ ID NO 43763 | GTTTGGGGATTGGTGCGTTTCT | TTG | chr6 | 160654631 | 160654652 | 160654636 | 160654631 | - |
|---|---|---|---|---|---|---|---|---|
| SEQ ID NO 43764 | GGGGATTGGTGCGTTTCTGGTT | TTT | chr6 | 160654627 | 160654648 | 160654632 | 160654627 | - |
| SEQ ID NO 43765 | GGGATTGGTGCGTTTCTGGTTG | TTG | chr6 | 160654626 | 160654647 | 160654631 | 160654626 | - |
| SEQ ID NO 43766 | GTGCGTTTCTGGTTGTATGAGG | TTG | chr6 | 160654619 | 160654640 | 160654624 | 160654619 | - |
| SEQ ID NO 43767 | CTGGTTGTATGAGGATAGTTGT | TTT | chr6 | 160654611 | 160654632 | 160654616 | 160654611 | - |
| SEQ ID NO 43768 | TGGTTGTATGAGGATAGTTGTA | TTC | chr6 | 160654610 | 160654631 | 160654615 | 160654610 | - |
| SEQ ID NO 43769 | GTTGTATGAGGATAGTTGTATT | CTG | chr6 | 160654608 | 160654629 | 160654613 | 160654608 | - |
| SEQ ID NO 43770 | TATGAGGATAGTTGTATTATAT | TTG | chr6 | 160654604 | 160654625 | 160654609 | 160654604 | - |
| SEQ ID NO 43771 | TATTATATTAGGCATAATTATG | TTG | chr6 | 160654590 | 160654611 | 160654595 | 160654590 | - |
| SEQ ID NO 43772 | TATTAGGCATAATTATGACCTT | TTA | chr6 | 160654585 | 160654606 | 160654590 | 160654585 | - |
| SEQ ID NO 43773 | GGCATAATTATGACCTTATTAT | TTA | chr6 | 160654580 | 160654601 | 160654585 | 160654580 | - |
| SEQ ID NO 43774 | TGACCTTATTATTGTCTTTATT | TTA | chr6 | 160654570 | 160654591 | 160654575 | 160654570 | - |
| SEQ ID NO 43775 | ATTATTGTCTTTATTTGAAGAT | CTT | chr6 | 160654563 | 160654584 | 160654568 | 160654563 | - |
| SEQ ID NO 43776 | TTATTGTCTTTATTTGAAGATT | TTA | chr6 | 160654562 | 160654583 | 160654567 | 160654562 | - |
| SEQ ID NO 43777 | TTGTCTTTATTTGAAGATTATG | TTA | chr6 | 160654559 | 160654580 | 160654564 | 160654559 | - |
| SEQ ID NO 43778 | TCTTTATTTGAAGATTATGTAT | TTG | chr6 | 160654556 | 160654577 | 160654561 | 160654556 | - |
| SEQ ID NO 43779 | TATTTGAAGATTATGTATGATT | CTT | chr6 | 160654552 | 160654573 | 160654557 | 160654552 | - |
| SEQ ID NO 43780 | ATTTGAAGATTATGTATGATTT | TTT | chr6 | 160654551 | 160654572 | 160654556 | 160654551 | - |
| SEQ ID NO 43781 | TTTGAAGATTATGTATGATTTC | TTA | chr6 | 160654550 | 160654571 | 160654555 | 160654550 | - |
| SEQ ID NO 43782 | GAAGATTATGTATGATTTCAGG | TTT | chr6 | 160654547 | 160654568 | 160654552 | 160654547 | - |
| SEQ ID NO 43783 | AAGATTATGTATGATTTCAGGA | TTG | chr6 | 160654546 | 160654567 | 160654551 | 160654546 | - |
| SEQ ID NO 43784 | TGTATGATTTCAGGATGTGTGT | TTA | chr6 | 160654539 | 160654560 | 160654544 | 160654539 | - |
| SEQ ID NO 43785 | CAGGATGTGTGTATGGGTTCAA | TTT | chr6 | 160654529 | 160654550 | 160654534 | 160654529 | - |
| SEQ ID NO 43786 | AGGATGTGTGTATGGGTTCAAG | TTC | chr6 | 160654528 | 160654549 | 160654533 | 160654528 | - |
| SEQ ID NO 43787 | AAGTTGACAAGGAGTTGGACTT | TTC | chr6 | 160654509 | 160654530 | 160654514 | 160654509 | - |
| SEQ ID NO 43788 | ACAAGGAGTTGGACTTGTGATG | TTG | chr6 | 160654503 | 160654524 | 160654508 | 160654503 | - |
| SEQ ID NO 43789 | GACTTGTGATGGTTAATACTGT | TTG | chr6 | 160654492 | 160654513 | 160654497 | 160654492 | - |
| SEQ ID NO 43790 | GTGATGGTTAATACTGTCAACT | CTT | chr6 | 160654487 | 160654508 | 160654492 | 160654487 | - |
| SEQ ID NO 43791 | TGATGGTTAATACTGTCAACTT | TTG | chr6 | 160654486 | 160654507 | 160654491 | 160654486 | - |
| SEQ ID NO 43792 | ATACTGTCAACTTGATTGGATT | TTA | chr6 | 160654477 | 160654498 | 160654482 | 160654477 | - |
| SEQ ID NO 43793 | TCAACTTGATTGGATTGAAAGA | CTG | chr6 | 160654471 | 160654492 | 160654476 | 160654471 | - |
| SEQ ID NO 43794 | GATTGGATTGAAAGATGCAAAG | CTT | chr6 | 160654464 | 160654485 | 160654469 | 160654464 | - |
| SEQ ID NO 43795 | ATTGGATTGAAAGATGCAAAGT | TTG | chr6 | 160654463 | 160654484 | 160654468 | 160654463 | - |
| SEQ ID NO 43796 | GATTGAAAGATGCAAAGTATTA | TTG | chr6 | 160654459 | 160654480 | 160654464 | 160654459 | - |
| SEQ ID NO 43797 | AAAGATGCAAAGTATTAATCTC | TTG | chr6 | 160654454 | 160654475 | 160654459 | 160654454 | - |
| SEQ ID NO 43798 | ATCTCGGTTATGTCTGTGAGGG | TTA | chr6 | 160654437 | 160654458 | 160654442 | 160654437 | - |
| SEQ ID NO 43799 | GGTTATGTCTGTGAGGGTGTGG | CTC | chr6 | 160654432 | 160654453 | 160654437 | 160654432 | - |
| SEQ ID NO 43800 | TGTCTGTGAGGGTGTGGCAAAA | TTA | chr6 | 160654427 | 160654448 | 160654432 | 160654427 | - |
| SEQ ID NO 43801 | TGAGGGTGTGGCAAAAGGAGAT | CTG | chr6 | 160654421 | 160654442 | 160654426 | 160654421 | - |
| SEQ ID NO 43802 | ACATTTGAGTCAGTGGGCTGGG | TTA | chr6 | 160654397 | 160654418 | 160654402 | 160654397 | - |

Figure 61

| # | Sequence | PAM | Chr | Start | End | Cuts 5' of | Str |
|---|---|---|---|---|---|---|---|
| SEQ ID NO 43803 | TAACGACCCCGGTAGGTGAG | AGG | chr1 | 55038311 | 55038330 | 55038327 | + |
| SEQ ID NO 43804 | ACCCCGGTAGGTGAGAGGCC | AAG | chr1 | 55038316 | 55038335 | 55038332 | + |
| SEQ ID NO 43805 | CCCCGGTAGGTGAGAGGCCA | AGG | chr1 | 55038317 | 55038336 | 55038333 | + |
| SEQ ID NO 43806 | GGTGAGAGGCCAAGGTCCCA | AAG | chr1 | 55038325 | 55038344 | 55038341 | + |
| SEQ ID NO 43807 | GTGAGAGGCCAAGGTCCCAA | AGG | chr1 | 55038326 | 55038345 | 55038342 | + |
| SEQ ID NO 43808 | TGAGAGGCCAAGGTCCCAAA | GGG | chr1 | 55038327 | 55038346 | 55038343 | + |
| SEQ ID NO 43809 | GAGAGGCCAAGGTCCCAAAG | GGG | chr1 | 55038328 | 55038347 | 55038344 | + |
| SEQ ID NO 43810 | GAGGCCAAGGTCCCAAAGGG | GAG | chr1 | 55038330 | 55038349 | 55038346 | + |
| SEQ ID NO 43811 | GCCAAGGTCCCAAAGGGGAG | CAG | chr1 | 55038333 | 55038352 | 55038349 | + |
| SEQ ID NO 43812 | AAGGTCCCAAAGGGGAGCAG | CAG | chr1 | 55038336 | 55038355 | 55038352 | + |
| SEQ ID NO 43813 | AGGTCCCAAAGGGGAGCAGC | AGG | chr1 | 55038337 | 55038356 | 55038353 | + |
| SEQ ID NO 43814 | GGTCCCAAAGGGGAGCAGCA | GGG | chr1 | 55038338 | 55038357 | 55038354 | + |
| SEQ ID NO 43815 | CCAAAGGGGAGCAGCAGGGA | AAG | chr1 | 55038342 | 55038361 | 55038358 | + |
| SEQ ID NO 43816 | AGGGGAGCAGCAGGGAAAGT | TAG | chr1 | 55038346 | 55038365 | 55038362 | + |
| SEQ ID NO 43817 | GCTCCCATCTATTCTTGCTC | CAG | chr1 | 55038368 | 55038387 | 55038384 | + |
| SEQ ID NO 43818 | CTCCCATCTATTCTTGCTCC | AGG | chr1 | 55038369 | 55038388 | 55038385 | + |
| SEQ ID NO 43819 | TCCCATCTATTCTTGCTCCA | GGG | chr1 | 55038370 | 55038389 | 55038386 | + |
| SEQ ID NO 43820 | CCCATCTATTCTTGCTCCAG | GGG | chr1 | 55038371 | 55038390 | 55038387 | + |
| SEQ ID NO 43821 | CATCTATTCTTGCTCCAGGG | GAG | chr1 | 55038373 | 55038392 | 55038389 | + |
| SEQ ID NO 43822 | ATCTATTCTTGCTCCAGGGG | AGG | chr1 | 55038374 | 55038393 | 55038390 | + |
| SEQ ID NO 43823 | CTCCAGGGGAGGCCTTTGAT | GAG | chr1 | 55038385 | 55038404 | 55038401 | + |
| SEQ ID NO 43824 | TCCAGGGGAGGCCTTTGATG | AGG | chr1 | 55038386 | 55038405 | 55038402 | + |
| SEQ ID NO 43825 | AGGGGAGGCCTTTGATGAGG | AAG | chr1 | 55038389 | 55038408 | 55038405 | + |
| SEQ ID NO 43826 | TTTGATGAGGAAGCTGCCAA | AAG | chr1 | 55038399 | 55038418 | 55038415 | + |
| SEQ ID NO 43827 | TGCAAATACAATTCCAATTA | CAG | chr1 | 55038427 | 55038446 | 55038443 | + |
| SEQ ID NO 43828 | GCAAATACAATTCCAATTAC | AGG | chr1 | 55038428 | 55038447 | 55038444 | + |
| SEQ ID NO 43829 | ACAATTCCAATTACAGGCAA | CAG | chr1 | 55038434 | 55038453 | 55038450 | + |
| SEQ ID NO 43830 | CAATTCCAATTACAGGCAAC | AGG | chr1 | 55038435 | 55038454 | 55038451 | + |
| SEQ ID NO 43831 | TTCCAATTACAGGCAACAGG | AAG | chr1 | 55038438 | 55038457 | 55038454 | + |
| SEQ ID NO 43832 | TCCAATTACAGGCAACAGGA | AGG | chr1 | 55038439 | 55038458 | 55038455 | + |
| SEQ ID NO 43833 | CAATTACAGGCAACAGGAAG | GAG | chr1 | 55038441 | 55038460 | 55038457 | + |
| SEQ ID NO 43834 | ACCACCTCTGCCACCTCTGT | CAG | chr1 | 55038465 | 55038484 | 55038481 | + |
| SEQ ID NO 43835 | CACCTCTGTCAGCAAACCAT | GAG | chr1 | 55038476 | 55038495 | 55038492 | + |
| SEQ ID NO 43836 | GCTCCTACTCTGTGCTGCGA | TGG | chr1 | 55038498 | 55038517 | 55038514 | + |
| SEQ ID NO 43837 | CCTACTCTGTGCTGCGATGG | CGG | chr1 | 55038501 | 55038520 | 55038517 | + |
| SEQ ID NO 43838 | CTACTCTGTGCTGCGATGGC | GGG | chr1 | 55038502 | 55038521 | 55038518 | + |
| SEQ ID NO 43839 | TGCTGCGATGGCGGGCTCGA | TGG | chr1 | 55038510 | 55038529 | 55038526 | + |
| SEQ ID NO 43840 | GCTGCGATGGCGGGCTCGAT | GGG | chr1 | 55038511 | 55038530 | 55038527 | + |
| SEQ ID NO 43841 | CTGCGATGGCGGGCTCGATG | GGG | chr1 | 55038512 | 55038531 | 55038528 | + |
| SEQ ID NO 43842 | ATAACTCTGACCTTACCTCA | TGG | chr1 | 55038535 | 55038554 | 55038551 | + |
| SEQ ID NO 43843 | AACTCTGACCTTACCTCATG | GAG | chr1 | 55038537 | 55038556 | 55038553 | + |
| SEQ ID NO 43844 | TGGAGTCACTGTCAACCCAC | TGG | chr1 | 55038555 | 55038574 | 55038571 | + |
| SEQ ID NO 43845 | GTTGCACTGTCTTTGTGCAC | TGG | chr1 | 55038577 | 55038596 | 55038593 | + |
| SEQ ID NO 43846 | GTCTTTGTGCACTGGCTCTC | TGG | chr1 | 55038585 | 55038604 | 55038601 | + |
| SEQ ID NO 43847 | CTTTGTGCACTGGCTCTCTG | GAG | chr1 | 55038587 | 55038606 | 55038603 | + |
| SEQ ID NO 43848 | GTGCACTGGCTCTCTGGAGT | GAG | chr1 | 55038591 | 55038610 | 55038607 | + |

Figure 61 (Cont'd)

| | | | | | | | |
|---|---|---|---|---|---|---|---|
| SEQ ID NO 43849 | TGCACTGGCTCTCTGGAGTG | AGG | chr1 | 55038592 | 55038611 | 55038608 | + |
| SEQ ID NO 43850 | GAGTGAGGTCTTTGCAAACA | AAG | chr1 | 55038607 | 55038626 | 55038623 | + |
| SEQ ID NO 43851 | TGAGGTCTTTGCAAACAAAG | TGG | chr1 | 55038610 | 55038629 | 55038626 | + |
| SEQ ID NO 43852 | GTCTTTGCAAACAAAGTGGA | AAG | chr1 | 55038614 | 55038633 | 55038630 | + |
| SEQ ID NO 43853 | CTTTGCAAACAAAGTGGAAA | GAG | chr1 | 55038616 | 55038635 | 55038632 | + |
| SEQ ID NO 43854 | AGTGGAAAGAGCATCAACTT | TGG | chr1 | 55038628 | 55038647 | 55038644 | + |
| SEQ ID NO 43855 | AGAGCATCAACTTTGGACTC | CAG | chr1 | 55038635 | 55038654 | 55038651 | + |
| SEQ ID NO 43856 | CAACTTTGGACTCCAGCACC | TAG | chr1 | 55038642 | 55038661 | 55038658 | + |
| SEQ ID NO 43857 | TGGACTCCAGCACCTAGATT | CAG | chr1 | 55038648 | 55038667 | 55038664 | + |
| SEQ ID NO 43858 | GACTCCAGCACCTAGATTCA | GAG | chr1 | 55038650 | 55038669 | 55038666 | + |
| SEQ ID NO 43859 | TCCAGCACCTAGATTCAGAG | CAG | chr1 | 55038653 | 55038672 | 55038669 | + |
| SEQ ID NO 43860 | CCAGCACCTAGATTCAGAGC | AGG | chr1 | 55038654 | 55038673 | 55038670 | + |
| SEQ ID NO 43861 | TCAGAGCAGGCCATTTCACT | CGG | chr1 | 55038667 | 55038686 | 55038683 | + |
| SEQ ID NO 43862 | GGAATCTGCTGTGCATCTGC | AAG | chr1 | 55038688 | 55038707 | 55038704 | + |
| SEQ ID NO 43863 | GAATCTGCTGTGCATCTGCA | AGG | chr1 | 55038689 | 55038708 | 55038705 | + |
| SEQ ID NO 43864 | AATCTGCTGTGCATCTGCAA | GGG | chr1 | 55038690 | 55038709 | 55038706 | + |
| SEQ ID NO 43865 | TCTGCTGTGCATCTGCAAGG | GAG | chr1 | 55038692 | 55038711 | 55038708 | + |
| SEQ ID NO 43866 | CTGCTGTGCATCTGCAAGGG | AGG | chr1 | 55038693 | 55038712 | 55038709 | + |
| SEQ ID NO 43867 | AATTCGCCTTTGTTCTTCC | CAG | chr1 | 55038722 | 55038741 | 55038738 | + |
| SEQ ID NO 43868 | TTGTTTCTTCCCAGTATCGA | CAG | chr1 | 55038731 | 55038750 | 55038747 | + |
| SEQ ID NO 43869 | CCCAGTATCGACAGCCCTTC | CAG | chr1 | 55038740 | 55038759 | 55038756 | + |
| SEQ ID NO 43870 | GTATCGACAGCCCTTCCAGA | AAG | chr1 | 55038744 | 55038763 | 55038760 | + |
| SEQ ID NO 43871 | ATCGACAGCCCTTCCAGAAA | GAG | chr1 | 55038746 | 55038765 | 55038762 | + |
| SEQ ID NO 43872 | ACAGCCCTTCCAGAAAGAGC | AAG | chr1 | 55038750 | 55038769 | 55038766 | + |
| SEQ ID NO 43873 | TCATGCCACATGTACAATCT | GAG | chr1 | 55038780 | 55038799 | 55038796 | + |
| SEQ ID NO 43874 | CATGCCACATGTACAATCTG | AGG | chr1 | 55038781 | 55038800 | 55038797 | + |
| SEQ ID NO 43875 | CCACATGTACAATCTGAGGC | CAG | chr1 | 55038785 | 55038804 | 55038801 | + |
| SEQ ID NO 43876 | CACATGTACAATCTGAGGCC | AGG | chr1 | 55038786 | 55038805 | 55038802 | + |
| SEQ ID NO 43877 | CATGTACAATCTGAGGCCAG | GAG | chr1 | 55038788 | 55038807 | 55038804 | + |
| SEQ ID NO 43878 | CCCCTTTTCATCCTCCTGCC | TGG | chr1 | 55038819 | 55038838 | 55038835 | + |
| SEQ ID NO 43879 | TCCTCCTGCCTGGTACACAA | TAG | chr1 | 55038829 | 55038848 | 55038845 | + |
| SEQ ID NO 43880 | CCTCCTGCCTGGTACACAAT | AGG | chr1 | 55038830 | 55038849 | 55038846 | + |
| SEQ ID NO 43881 | GGTACACAATAGGTGTTTAC | TGG | chr1 | 55038840 | 55038859 | 55038856 | + |
| SEQ ID NO 43882 | GTGTTTACTGGATGCTTGTC | CAG | chr1 | 55038852 | 55038871 | 55038868 | + |
| SEQ ID NO 43883 | TCCAGTTGATTTCTTGAACA | TGG | chr1 | 55038870 | 55038889 | 55038886 | + |
| SEQ ID NO 43884 | TTCTTGAACATGGTGTGTAA | AAG | chr1 | 55038880 | 55038899 | 55038896 | + |
| SEQ ID NO 43885 | TCTTGAACATGGTGTGTAAA | AGG | chr1 | 55038881 | 55038900 | 55038897 | + |
| SEQ ID NO 43886 | TCTTTGCAAATTGAATCTTC | TGG | chr1 | 55038906 | 55038925 | 55038922 | + |
| SEQ ID NO 43887 | TGCAAATTGAATCTTCTGGA | AAG | chr1 | 55038910 | 55038929 | 55038926 | + |
| SEQ ID NO 43888 | ATTGAATCTTCTGGAAAGCT | GAG | chr1 | 55038915 | 55038934 | 55038931 | + |
| SEQ ID NO 43889 | AGCTGAGCTTGTGCCTACCA | TAG | chr1 | 55038931 | 55038950 | 55038947 | + |
| SEQ ID NO 43890 | ACTTAAAACCTGAATCTTTG | TAG | chr1 | 55038987 | 55039006 | 55039003 | + |
| SEQ ID NO 43891 | TAAATCCCTTGAAATGCATG | TAG | chr1 | 55039012 | 55039031 | 55039028 | + |
| SEQ ID NO 43892 | AAATCCCTTGAAATGCATGT | AGG | chr1 | 55039013 | 55039032 | 55039029 | + |
| SEQ ID NO 43893 | CCCTTGAAATGCATGTAGGC | TGG | chr1 | 55039017 | 55039036 | 55039033 | + |
| SEQ ID NO 43894 | GCATGTAGGCTGGACATCAA | AAG | chr1 | 55039027 | 55039046 | 55039043 | + |
| SEQ ID NO 43895 | GTAGGCTGGACATCAAAAGC | AAG | chr1 | 55039031 | 55039050 | 55039047 | + |

Figure 61 (Cont'd)

| | | | | | | | |
|---|---|---|---|---|---|---|---|
| SEQ ID NO 43896 | CAAAAGCAAGCAATCTCTTC | AAG | chr1 | 55039044 | 55039063 | 55039060 | + |
| SEQ ID NO 43897 | AAAAGCAAGCAATCTCTTCA | AGG | chr1 | 55039045 | 55039064 | 55039061 | + |
| SEQ ID NO 43898 | AAGCAAGCAATCTCTTCAAG | GAG | chr1 | 55039047 | 55039066 | 55039063 | + |
| SEQ ID NO 43899 | CAAGCAATCTCTTCAAGGAG | CAG | chr1 | 55039050 | 55039069 | 55039066 | + |
| SEQ ID NO 43900 | CAATCTCTTCAAGGAGCAGC | TAG | chr1 | 55039054 | 55039073 | 55039070 | + |
| SEQ ID NO 43901 | CTCTTCAAGGAGCAGCTAGT | TGG | chr1 | 55039058 | 55039077 | 55039074 | + |
| SEQ ID NO 43902 | TCAAGGAGCAGCTAGTTGGT | AAG | chr1 | 55039062 | 55039081 | 55039078 | + |
| SEQ ID NO 43903 | CAAGGAGCAGCTAGTTGGTA | AGG | chr1 | 55039063 | 55039082 | 55039079 | + |
| SEQ ID NO 43904 | GAGCAGCTAGTTGGTAAGGT | CAG | chr1 | 55039067 | 55039086 | 55039083 | + |
| SEQ ID NO 43905 | TAGTTGGTAAGGTCAGTGTG | CAG | chr1 | 55039074 | 55039093 | 55039090 | + |
| SEQ ID NO 43906 | AGTTGGTAAGGTCAGTGTGC | AGG | chr1 | 55039075 | 55039094 | 55039091 | + |
| SEQ ID NO 43907 | GTTGGTAAGGTCAGTGTGCA | GGG | chr1 | 55039076 | 55039095 | 55039092 | + |
| SEQ ID NO 43908 | GTCAGTGTGCAGGGTGCATA | AAG | chr1 | 55039085 | 55039104 | 55039101 | + |
| SEQ ID NO 43909 | TCAGTGTGCAGGGTGCATAA | AGG | chr1 | 55039086 | 55039105 | 55039102 | + |
| SEQ ID NO 43910 | CAGTGTGCAGGGTGCATAAA | GGG | chr1 | 55039087 | 55039106 | 55039103 | + |
| SEQ ID NO 43911 | TGTGCAGGGTGCATAAAGGG | CAG | chr1 | 55039090 | 55039109 | 55039106 | + |
| SEQ ID NO 43912 | TGCAGGGTGCATAAAGGGCA | GAG | chr1 | 55039092 | 55039111 | 55039108 | + |
| SEQ ID NO 43913 | GCAGGGTGCATAAAGGGCAG | AGG | chr1 | 55039093 | 55039112 | 55039109 | + |
| SEQ ID NO 43914 | GGTGCATAAAGGGCAGAGGC | CGG | chr1 | 55039097 | 55039116 | 55039113 | + |
| SEQ ID NO 43915 | TGCATAAAGGGCAGAGGCCG | GAG | chr1 | 55039099 | 55039118 | 55039115 | + |
| SEQ ID NO 43916 | GCATAAAGGGCAGAGGCCGG | AGG | chr1 | 55039100 | 55039119 | 55039116 | + |
| SEQ ID NO 43917 | CATAAAGGGCAGAGGCCGGA | GGG | chr1 | 55039101 | 55039120 | 55039117 | + |
| SEQ ID NO 43918 | ATAAAGGGCAGAGGCCGGAG | GGG | chr1 | 55039102 | 55039121 | 55039118 | + |
| SEQ ID NO 43919 | TAAAGGGCAGAGGCCGGAGG | GGG | chr1 | 55039103 | 55039122 | 55039119 | + |
| SEQ ID NO 43920 | GGCAGAGGCCGGAGGGGGTC | CAG | chr1 | 55039108 | 55039127 | 55039124 | + |
| SEQ ID NO 43921 | GCAGAGGCCGGAGGGGGTCC | AGG | chr1 | 55039109 | 55039128 | 55039125 | + |
| SEQ ID NO 43922 | GGCCGGAGGGGTCCAGGCT | AAG | chr1 | 55039114 | 55039133 | 55039130 | + |
| SEQ ID NO 43923 | GAGGGGGTCCAGGCTAAGTT | TAG | chr1 | 55039119 | 55039138 | 55039135 | + |
| SEQ ID NO 43924 | GGGGTCCAGGCTAAGTTTAG | AAG | chr1 | 55039122 | 55039141 | 55039138 | + |
| SEQ ID NO 43925 | GGGTCCAGGCTAAGTTTAGA | AGG | chr1 | 55039123 | 55039142 | 55039139 | + |
| SEQ ID NO 43926 | GGCTAAGTTTAGAAGGCTGC | CAG | chr1 | 55039130 | 55039149 | 55039146 | + |
| SEQ ID NO 43927 | GCTAAGTTTAGAAGGCTGCC | AGG | chr1 | 55039131 | 55039150 | 55039147 | + |
| SEQ ID NO 43928 | GTTTAGAAGGCTGCCAGGTT | AAG | chr1 | 55039136 | 55039155 | 55039152 | + |
| SEQ ID NO 43929 | TTTAGAAGGCTGCCAGGTTA | AGG | chr1 | 55039137 | 55039156 | 55039153 | + |
| SEQ ID NO 43930 | GAAGGCTGCCAGGTTAAGGC | CAG | chr1 | 55039141 | 55039160 | 55039157 | + |
| SEQ ID NO 43931 | GGCTGCCAGGTTAAGGCCAG | TGG | chr1 | 55039144 | 55039163 | 55039160 | + |
| SEQ ID NO 43932 | GCCAGGTTAAGGCCAGTGGA | AAG | chr1 | 55039148 | 55039167 | 55039164 | + |
| SEQ ID NO 43933 | TAAGGCCAGTGGAAAGAATT | CGG | chr1 | 55039155 | 55039174 | 55039171 | + |
| SEQ ID NO 43934 | GGCCAGTGGAAAGAATTCGG | TGG | chr1 | 55039158 | 55039177 | 55039174 | + |
| SEQ ID NO 43935 | GCCAGTGGAAAGAATTCGGT | GGG | chr1 | 55039159 | 55039178 | 55039175 | + |
| SEQ ID NO 43936 | AGTGGAAAGAATTCGGTGGG | CAG | chr1 | 55039162 | 55039181 | 55039178 | + |
| SEQ ID NO 43937 | GAAAGAATTCGGTGGGCAGC | GAG | chr1 | 55039166 | 55039185 | 55039182 | + |
| SEQ ID NO 43938 | AAAGAATTCGGTGGGCAGCG | AGG | chr1 | 55039167 | 55039186 | 55039183 | + |
| SEQ ID NO 43939 | AGAATTCGGTGGGCAGCGAG | GAG | chr1 | 55039169 | 55039188 | 55039185 | + |
| SEQ ID NO 43940 | GGTGGGCAGCGAGGAGTCCA | CAG | chr1 | 55039176 | 55039195 | 55039192 | + |
| SEQ ID NO 43941 | GGGCAGCGAGGAGTCCACAG | TAG | chr1 | 55039179 | 55039198 | 55039195 | + |
| SEQ ID NO 43942 | GGCAGCGAGGAGTCCACAGT | AGG | chr1 | 55039180 | 55039199 | 55039196 | + |

Figure 61 (Cont'd)

| | | | | | | | |
|---|---|---|---|---|---|---|---|
| SEQ ID NO 43943 | AGTCCACAGTAGGATTGATT | CAG | chr1 | 55039190 | 55039209 | 55039206 | + |
| SEQ ID NO 43944 | CCACAGTAGGATTGATTCAG | AAG | chr1 | 55039193 | 55039212 | 55039209 | + |
| SEQ ID NO 43945 | GATTGATTCAGAAGTCTCAC | TGG | chr1 | 55039202 | 55039221 | 55039218 | + |
| SEQ ID NO 43946 | GATTCAGAAGTCTCACTGGT | CAG | chr1 | 55039206 | 55039225 | 55039222 | + |
| SEQ ID NO 43947 | TCAGAAGTCTCACTGGTCAG | CAG | chr1 | 55039209 | 55039228 | 55039225 | + |
| SEQ ID NO 43948 | CAGAAGTCTCACTGGTCAGC | AGG | chr1 | 55039210 | 55039229 | 55039226 | + |
| SEQ ID NO 43949 | GAAGTCTCACTGGTCAGCAG | GAG | chr1 | 55039212 | 55039231 | 55039228 | + |
| SEQ ID NO 43950 | CTCACTGGTCAGCAGGAGAC | AAG | chr1 | 55039217 | 55039236 | 55039233 | + |
| SEQ ID NO 43951 | TCACTGGTCAGCAGGAGACA | AGG | chr1 | 55039218 | 55039237 | 55039234 | + |
| SEQ ID NO 43952 | CTGGTCAGCAGGAGACAAGG | TGG | chr1 | 55039221 | 55039240 | 55039237 | + |
| SEQ ID NO 43953 | AGCAGGAGACAAGGTGGACC | CAG | chr1 | 55039227 | 55039246 | 55039243 | + |
| SEQ ID NO 43954 | GCAGGAGACAAGGTGGACCC | AGG | chr1 | 55039228 | 55039247 | 55039244 | + |
| SEQ ID NO 43955 | TGGACCCAGGAAACACTGAA | AAG | chr1 | 55039241 | 55039260 | 55039257 | + |
| SEQ ID NO 43956 | GGACCCAGGAAACACTGAAA | AGG | chr1 | 55039242 | 55039261 | 55039258 | + |
| SEQ ID NO 43957 | CCCAGGAAACACTGAAAAGG | TGG | chr1 | 55039245 | 55039264 | 55039261 | + |
| SEQ ID NO 43958 | CCAGGAAACACTGAAAAGGT | GGG | chr1 | 55039246 | 55039265 | 55039262 | + |
| SEQ ID NO 43959 | AAACACTGAAAAGGTGGGCC | CGG | chr1 | 55039251 | 55039270 | 55039267 | + |
| SEQ ID NO 43960 | CACTGAAAAGGTGGGCCCGG | CAG | chr1 | 55039254 | 55039273 | 55039270 | + |
| SEQ ID NO 43961 | AAGGTGGGCCCGGCAGAACT | TGG | chr1 | 55039261 | 55039280 | 55039277 | + |
| SEQ ID NO 43962 | GGTGGGCCCGGCAGAACTTG | GAG | chr1 | 55039263 | 55039282 | 55039279 | + |
| SEQ ID NO 43963 | GCCCGGCAGAACTTGGAGTC | TGG | chr1 | 55039268 | 55039287 | 55039284 | + |
| SEQ ID NO 43964 | TTGGAGTCTGGCATCCCACG | CAG | chr1 | 55039280 | 55039299 | 55039296 | + |
| SEQ ID NO 43965 | TGGAGTCTGGCATCCCACGC | AGG | chr1 | 55039281 | 55039300 | 55039297 | + |
| SEQ ID NO 43966 | GGAGTCTGGCATCCCACGCA | GGG | chr1 | 55039282 | 55039301 | 55039298 | + |
| SEQ ID NO 43967 | TCTGGCATCCCACGCAGGGT | GAG | chr1 | 55039286 | 55039305 | 55039302 | + |
| SEQ ID NO 43968 | TGGCATCCCACGCAGGGTGA | GAG | chr1 | 55039288 | 55039307 | 55039304 | + |
| SEQ ID NO 43969 | GGCATCCCACGCAGGGTGAG | AGG | chr1 | 55039289 | 55039308 | 55039305 | + |
| SEQ ID NO 43970 | ATCCCACGCAGGGTGAGAGG | CGG | chr1 | 55039292 | 55039311 | 55039308 | + |
| SEQ ID NO 43971 | TCCCACGCAGGGTGAGAGGC | GGG | chr1 | 55039293 | 55039312 | 55039309 | + |
| SEQ ID NO 43972 | CCACGCAGGGTGAGAGGCGG | GAG | chr1 | 55039295 | 55039314 | 55039311 | + |
| SEQ ID NO 43973 | ACGCAGGGTGAGAGGCGGGA | GAG | chr1 | 55039297 | 55039316 | 55039313 | + |
| SEQ ID NO 43974 | CGCAGGGTGAGAGGCGGGAG | AGG | chr1 | 55039298 | 55039317 | 55039314 | + |
| SEQ ID NO 43975 | CAGGGTGAGAGGCGGGAGAG | GAG | chr1 | 55039300 | 55039319 | 55039316 | + |
| SEQ ID NO 43976 | AGGGTGAGAGGCGGGAGAGG | AGG | chr1 | 55039301 | 55039320 | 55039317 | + |
| SEQ ID NO 43977 | GGTGAGAGGCGGGAGAGGAG | GAG | chr1 | 55039303 | 55039322 | 55039319 | + |
| SEQ ID NO 43978 | GGCGGGAGAGGAGGAGCCCC | TAG | chr1 | 55039310 | 55039329 | 55039326 | + |
| SEQ ID NO 43979 | GCGGGAGAGGAGGAGCCCCT | AGG | chr1 | 55039311 | 55039330 | 55039327 | + |
| SEQ ID NO 43980 | CGGGAGAGGAGGAGCCCCTA | GGG | chr1 | 55039312 | 55039331 | 55039328 | + |
| SEQ ID NO 43981 | AGGAGGAGCCCCTAGGGCGC | CGG | chr1 | 55039318 | 55039337 | 55039334 | + |
| SEQ ID NO 43982 | TAGGGCGCCGGCCTGCCTTC | CAG | chr1 | 55039330 | 55039349 | 55039346 | + |
| SEQ ID NO 43983 | CGCCGGCCTGCCTTCCAGCC | CAG | chr1 | 55039335 | 55039354 | 55039351 | + |
| SEQ ID NO 43984 | GGCCTGCCTTCCAGCCCAGT | TAG | chr1 | 55039339 | 55039358 | 55039355 | + |
| SEQ ID NO 43985 | GCCTGCCTTCCAGCCCAGTT | AGG | chr1 | 55039340 | 55039359 | 55039356 | + |
| SEQ ID NO 43986 | CTTCCAGCCCAGTTAGGATT | TGG | chr1 | 55039346 | 55039365 | 55039362 | + |
| SEQ ID NO 43987 | TTCCAGCCCAGTTAGGATTT | GGG | chr1 | 55039347 | 55039366 | 55039363 | + |
| SEQ ID NO 43988 | CCAGCCCAGTTAGGATTTGG | GAG | chr1 | 55039349 | 55039368 | 55039365 | + |
| SEQ ID NO 43989 | GCGCGTAATCTGACGCTGTT | TGG | chr1 | 55039387 | 55039406 | 55039403 | + |

Figure 61 (Cont'd)

| SEQ ID NO 43990 | CGCGTAATCTGACGCTGTTT | GGG | chr1 | 55039388 | 55039407 | 55039404 | + |
| SEQ ID NO 43991 | GCGTAATCTGACGCTGTTTG | GGG | chr1 | 55039389 | 55039408 | 55039405 | + |
| SEQ ID NO 43992 | GTAATCTGACGCTGTTTGGG | GAG | chr1 | 55039391 | 55039410 | 55039407 | + |
| SEQ ID NO 43993 | TAATCTGACGCTGTTTGGGG | AGG | chr1 | 55039392 | 55039411 | 55039408 | + |
| SEQ ID NO 43994 | AATCTGACGCTGTTTGGGGA | GGG | chr1 | 55039393 | 55039412 | 55039409 | + |
| SEQ ID NO 43995 | TGACGCTGTTTGGGGAGGGC | GAG | chr1 | 55039397 | 55039416 | 55039413 | + |
| SEQ ID NO 43996 | GACGCTGTTTGGGGAGGGCG | AGG | chr1 | 55039398 | 55039417 | 55039414 | + |
| SEQ ID NO 43997 | GAGGCCGAAACCTGATCCTC | CAG | chr1 | 55039417 | 55039436 | 55039433 | + |
| SEQ ID NO 43998 | CGAAACCTGATCCTCCAGTC | CGG | chr1 | 55039422 | 55039441 | 55039438 | + |
| SEQ ID NO 43999 | GAAACCTGATCCTCCAGTCC | GGG | chr1 | 55039423 | 55039442 | 55039439 | + |
| SEQ ID NO 44000 | AAACCTGATCCTCCAGTCCG | GGG | chr1 | 55039424 | 55039443 | 55039440 | + |
| SEQ ID NO 44001 | AACCTGATCCTCCAGTCCGG | GGG | chr1 | 55039425 | 55039444 | 55039441 | + |
| SEQ ID NO 44002 | GGGTTCCGTTAATGTTTAAT | CAG | chr1 | 55039445 | 55039464 | 55039461 | + |
| SEQ ID NO 44003 | TCCGTTAATGTTTAATCAGA | TAG | chr1 | 55039449 | 55039468 | 55039465 | + |
| SEQ ID NO 44004 | CCGTTAATGTTTAATCAGAT | AGG | chr1 | 55039450 | 55039469 | 55039466 | + |
| SEQ ID NO 44005 | AATCAGATAGGATCGTCCGA | TGG | chr1 | 55039462 | 55039481 | 55039478 | + |
| SEQ ID NO 44006 | ATCAGATAGGATCGTCCGAT | GGG | chr1 | 55039463 | 55039482 | 55039479 | + |
| SEQ ID NO 44007 | TCAGATAGGATCGTCCGATG | GGG | chr1 | 55039464 | 55039483 | 55039480 | + |
| SEQ ID NO 44008 | AGGATCGTCCGATGGGCTC | TGG | chr1 | 55039470 | 55039489 | 55039486 | + |
| SEQ ID NO 44009 | ATCGTCCGATGGGCTCTGG | TGG | chr1 | 55039473 | 55039492 | 55039489 | + |
| SEQ ID NO 44010 | GTGGCGTGATCTGCGCGCCC | CAG | chr1 | 55039492 | 55039511 | 55039508 | + |
| SEQ ID NO 44011 | TGGCGTGATCTGCGCGCCCC | AGG | chr1 | 55039493 | 55039512 | 55039509 | + |
| SEQ ID NO 44012 | ATCTGCGCGCCCCAGGCGTC | AAG | chr1 | 55039500 | 55039519 | 55039516 | + |
| SEQ ID NO 44013 | GGCGTCAAGCACCCACACCC | TAG | chr1 | 55039514 | 55039533 | 55039530 | + |
| SEQ ID NO 44014 | GTCAAGCACCCACACCCTAG | AAG | chr1 | 55039517 | 55039536 | 55039533 | + |
| SEQ ID NO 44015 | TCAAGCACCCACACCCTAGA | AGG | chr1 | 55039518 | 55039537 | 55039534 | + |
| SEQ ID NO 44016 | CACACCCTAGAAGGTTTCCG | CAG | chr1 | 55039527 | 55039546 | 55039543 | + |
| SEQ ID NO 44017 | AAGGTTTCCGCAGCGACGTC | GAG | chr1 | 55039537 | 55039556 | 55039553 | + |
| SEQ ID NO 44018 | AGGTTTCCGCAGCGACGTCG | AGG | chr1 | 55039538 | 55039557 | 55039554 | + |
| SEQ ID NO 44019 | CAGCGACGTCGAGGCGCTCA | TGG | chr1 | 55039547 | 55039566 | 55039563 | + |
| SEQ ID NO 44020 | CGTCGAGGCGCTCATGGTTG | CAG | chr1 | 55039553 | 55039572 | 55039569 | + |
| SEQ ID NO 44021 | GTCGAGGCGCTCATGGTTGC | AGG | chr1 | 55039554 | 55039573 | 55039570 | + |
| SEQ ID NO 44022 | GAGGCGCTCATGGTTGCAGG | CGG | chr1 | 55039557 | 55039576 | 55039573 | + |
| SEQ ID NO 44023 | AGGCGCTCATGGTTGCAGGC | GGG | chr1 | 55039558 | 55039577 | 55039574 | + |
| SEQ ID NO 44024 | TGCAGGCGGGCGCCGCCGTT | CAG | chr1 | 55039571 | 55039590 | 55039587 | + |
| SEQ ID NO 44025 | GCGGGCGCCGCCGTTCAGTT | CAG | chr1 | 55039576 | 55039595 | 55039592 | + |
| SEQ ID NO 44026 | CGGGCGCCGCCGTTCAGTTC | AGG | chr1 | 55039577 | 55039596 | 55039593 | + |
| SEQ ID NO 44027 | GGGCGCCGCCGTTCAGTTCA | GGG | chr1 | 55039578 | 55039597 | 55039594 | + |
| SEQ ID NO 44028 | CGCCGTTCAGTTCAGGGTCT | GAG | chr1 | 55039584 | 55039603 | 55039600 | + |
| SEQ ID NO 44029 | TTCAGTTCAGGGTCTGAGCC | TGG | chr1 | 55039589 | 55039608 | 55039605 | + |
| SEQ ID NO 44030 | CAGTTCAGGGTCTGAGCCTG | GAG | chr1 | 55039591 | 55039610 | 55039607 | + |
| SEQ ID NO 44031 | AGTTCAGGGTCTGAGCCTGG | AGG | chr1 | 55039592 | 55039611 | 55039608 | + |
| SEQ ID NO 44032 | TTCAGGGTCTGAGCCTGGAG | GAG | chr1 | 55039594 | 55039613 | 55039610 | + |
| SEQ ID NO 44033 | GGGTCTGAGCCTGGAGGAGT | GAG | chr1 | 55039598 | 55039617 | 55039614 | + |
| SEQ ID NO 44034 | CTGAGCCTGGAGGAGTGAGC | CAG | chr1 | 55039602 | 55039621 | 55039618 | + |
| SEQ ID NO 44035 | TGAGCCTGGAGGAGTGAGCC | AGG | chr1 | 55039603 | 55039622 | 55039619 | + |
| SEQ ID NO 44036 | GCCTGGAGGAGTGAGCCAGG | CAG | chr1 | 55039606 | 55039625 | 55039622 | + |

Figure 61 (Cont'd)

| SEQ ID NO 44037 | GGAGGAGTGAGCCAGGCAGT | GAG | chr1 | 55039610 | 55039629 | 55039626 | + |
| SEQ ID NO 44038 | AGTGAGCCAGGCAGTGAGAC | TGG | chr1 | 55039615 | 55039634 | 55039631 | + |
| SEQ ID NO 44039 | GCCAGGCAGTGAGACTGGCT | CGG | chr1 | 55039620 | 55039639 | 55039636 | + |
| SEQ ID NO 44040 | CCAGGCAGTGAGACTGGCTC | GGG | chr1 | 55039621 | 55039640 | 55039637 | + |
| SEQ ID NO 44041 | GGCAGTGAGACTGGCTCGGG | CGG | chr1 | 55039624 | 55039643 | 55039640 | + |
| SEQ ID NO 44042 | GCAGTGAGACTGGCTCGGGC | GGG | chr1 | 55039625 | 55039644 | 55039641 | + |
| SEQ ID NO 44043 | TGAGACTGGCTCGGGCGGGC | CGG | chr1 | 55039629 | 55039648 | 55039645 | + |
| SEQ ID NO 44044 | GAGACTGGCTCGGGCGGGCC | GGG | chr1 | 55039630 | 55039649 | 55039646 | + |
| SEQ ID NO 44045 | CGGGCCGGGACGCGTCGTTG | CAG | chr1 | 55039644 | 55039663 | 55039660 | + |
| SEQ ID NO 44046 | GCCGGGACGCGTCGTTGCAG | CAG | chr1 | 55039647 | 55039666 | 55039663 | + |
| SEQ ID NO 44047 | GGGACGCGTCGTTGCAGCAG | CGG | chr1 | 55039650 | 55039669 | 55039666 | + |
| SEQ ID NO 44048 | GTCGTTGCAGCAGCGGCTCC | CAG | chr1 | 55039657 | 55039676 | 55039673 | + |
| SEQ ID NO 44049 | CAGCAGCGGCTCCCAGCTCC | CAG | chr1 | 55039664 | 55039683 | 55039680 | + |
| SEQ ID NO 44050 | AGCGGCTCCCAGCTCCCAGC | CAG | chr1 | 55039668 | 55039687 | 55039684 | + |
| SEQ ID NO 44051 | GCGGCTCCCAGCTCCCAGCC | AGG | chr1 | 55039669 | 55039688 | 55039685 | + |
| SEQ ID NO 44052 | CGCGCCCTGCTCCTGAACTT | CAG | chr1 | 55039710 | 55039729 | 55039726 | + |
| SEQ ID NO 44053 | CCTGAACTTCAGCTCCTGCA | CAG | chr1 | 55039721 | 55039740 | 55039737 | + |
| SEQ ID NO 44054 | TGCACAGTCCTCCCACCGC | AAG | chr1 | 55039737 | 55039756 | 55039753 | + |
| SEQ ID NO 44055 | GCACAGTCCTCCCCACCGCA | AGG | chr1 | 55039738 | 55039757 | 55039754 | + |
| SEQ ID NO 44056 | TCCTCCCCACCGCAAGGCTC | AAG | chr1 | 55039744 | 55039763 | 55039760 | + |
| SEQ ID NO 44057 | CCTCCCCACCGCAAGGCTCA | AGG | chr1 | 55039745 | 55039764 | 55039761 | + |
| SEQ ID NO 44058 | CGCAAGGCTCAAGGCGCCGC | CGG | chr1 | 55039754 | 55039773 | 55039770 | + |
| SEQ ID NO 44059 | GGCTCAAGGCGCCGCCGGCG | TGG | chr1 | 55039759 | 55039778 | 55039775 | + |
| SEQ ID NO 44060 | CCGCCGGCGTGGACCGCGCA | CGG | chr1 | 55039770 | 55039789 | 55039786 | + |
| SEQ ID NO 44061 | CGTGGACCGCGCACGGCCTC | TAG | chr1 | 55039777 | 55039796 | 55039793 | + |
| SEQ ID NO 44062 | GTGGACCGCGCACGGCCTCT | AGG | chr1 | 55039778 | 55039797 | 55039794 | + |
| SEQ ID NO 44063 | CGGCCTCTAGGTCTCCTCGC | CAG | chr1 | 55039790 | 55039809 | 55039806 | + |
| SEQ ID NO 44064 | GGCCTCTAGGTCTCCTCGCC | AGG | chr1 | 55039791 | 55039810 | 55039807 | + |
| SEQ ID NO 44065 | TCTAGGTCTCCTCGCCAGGA | CAG | chr1 | 55039795 | 55039814 | 55039811 | + |
| SEQ ID NO 44066 | CAGGACAGCAACCTCTCCCC | TGG | chr1 | 55039810 | 55039829 | 55039826 | + |
| SEQ ID NO 44067 | AACCTCTCCCCTGGCCCTCA | TGG | chr1 | 55039819 | 55039838 | 55039835 | + |
| SEQ ID NO 44068 | ACCTCTCCCCTGGCCCTCAT | GGG | chr1 | 55039820 | 55039839 | 55039836 | + |
| SEQ ID NO 44069 | CTGGCCCTCATGGGCACCGT | CAG | chr1 | 55039829 | 55039848 | 55039845 | + |
| SEQ ID NO 44070 | CTCATGGGCACCGTCAGCTC | CAG | chr1 | 55039835 | 55039854 | 55039851 | + |
| SEQ ID NO 44071 | TCATGGGCACCGTCAGCTCC | AGG | chr1 | 55039836 | 55039855 | 55039852 | + |
| SEQ ID NO 44072 | TGGGCACCGTCAGCTCCAGG | CGG | chr1 | 55039839 | 55039858 | 55039855 | + |
| SEQ ID NO 44073 | CCGTCAGCTCCAGGCGGTCC | TGG | chr1 | 55039845 | 55039864 | 55039861 | + |
| SEQ ID NO 44074 | TCAGCTCCAGGCGGTCCTGG | TGG | chr1 | 55039848 | 55039867 | 55039864 | + |
| SEQ ID NO 44075 | GCTGCTGCTGCTGCTGCTCC | TGG | chr1 | 55039885 | 55039904 | 55039901 | + |
| SEQ ID NO 44076 | CTGCTGCTGCTGCTGCTCCT | GGG | chr1 | 55039886 | 55039905 | 55039902 | + |
| SEQ ID NO 44077 | GCTGCTGCTCCTGGGTCCCG | CGG | chr1 | 55039894 | 55039913 | 55039910 | + |
| SEQ ID NO 44078 | CTGCTGCTCCTGGGTCCCGC | GGG | chr1 | 55039895 | 55039914 | 55039911 | + |
| SEQ ID NO 44079 | GTCCCGCGGGCGCCCGTGCG | CAG | chr1 | 55039908 | 55039927 | 55039924 | + |
| SEQ ID NO 44080 | TCCCGCGGGCGCCCGTGCGC | AGG | chr1 | 55039909 | 55039928 | 55039925 | + |
| SEQ ID NO 44081 | CCGCGGGCGCCCGTGCGCAG | GAG | chr1 | 55039911 | 55039930 | 55039927 | + |
| SEQ ID NO 44082 | CGCGGGCGCCCGTGCGCAGG | AGG | chr1 | 55039912 | 55039931 | 55039928 | + |
| SEQ ID NO 44083 | GCGCCCGTGCGCAGGAGGAC | GAG | chr1 | 55039917 | 55039936 | 55039933 | + |

Figure 61 (Cont'd)

| SEQ ID NO 44084 | CGCCCGTGCGCAGGAGGACG | AGG | chr1 | 55039918 | 55039937 | 55039934 | + |
| SEQ ID NO 44085 | CGTGCGCAGGAGGACGAGGA | CGG | chr1 | 55039922 | 55039941 | 55039938 | + |
| SEQ ID NO 44086 | AGGACGAGGACGGCGACTAC | GAG | chr1 | 55039932 | 55039951 | 55039948 | + |
| SEQ ID NO 44087 | GGACGAGGACGGCGACTACG | AGG | chr1 | 55039933 | 55039952 | 55039949 | + |
| SEQ ID NO 44088 | ACGAGGACGGCGACTACGAG | GAG | chr1 | 55039935 | 55039954 | 55039951 | + |
| SEQ ID NO 44089 | GGACGGCGACTACGAGGAGC | TGG | chr1 | 55039939 | 55039958 | 55039955 | + |
| SEQ ID NO 44090 | CGACTACGAGGAGCTGGTGC | TAG | chr1 | 55039945 | 55039964 | 55039961 | + |
| SEQ ID NO 44091 | TGGTGCTAGCCTTGCGTTCC | GAG | chr1 | 55039959 | 55039978 | 55039975 | + |
| SEQ ID NO 44092 | GGTGCTAGCCTTGCGTTCCG | AGG | chr1 | 55039960 | 55039979 | 55039976 | + |
| SEQ ID NO 44093 | TGCTAGCCTTGCGTTCCGAG | GAG | chr1 | 55039962 | 55039981 | 55039978 | + |
| SEQ ID NO 44094 | GCTAGCCTTGCGTTCCGAGG | AGG | chr1 | 55039963 | 55039982 | 55039979 | + |
| SEQ ID NO 44095 | GCCTTGCGTTCCGAGGAGGA | CGG | chr1 | 55039967 | 55039986 | 55039983 | + |
| SEQ ID NO 44096 | GCGTTCCGAGGAGGACGGCC | TGG | chr1 | 55039972 | 55039991 | 55039988 | + |
| SEQ ID NO 44097 | CGAGGAGGACGGCCTGGCCG | AAG | chr1 | 55039978 | 55039997 | 55039994 | + |
| SEQ ID NO 44098 | ACGGCCTGGCCGAAGCACCC | GAG | chr1 | 55039986 | 55040005 | 55040002 | + |
| SEQ ID NO 44099 | CTGGCCGAAGCACCCGAGCA | CGG | chr1 | 55039991 | 55040010 | 55040007 | + |
| SEQ ID NO 44100 | AGCACCCGAGCACGGAACCA | CAG | chr1 | 55039999 | 55040018 | 55040015 | + |
| SEQ ID NO 44101 | CCACCTTCCACCGCTGCGCC | AAG | chr1 | 55040022 | 55040041 | 55040038 | + |
| SEQ ID NO 44102 | CACCTTCCACCGCTGCGCCA | AGG | chr1 | 55040023 | 55040042 | 55040039 | + |
| SEQ ID NO 44103 | TCCACCGCTGCGCCAAGGTG | CGG | chr1 | 55040028 | 55040047 | 55040044 | + |
| SEQ ID NO 44104 | CCACCGCTGCGCCAAGGTGC | GGG | chr1 | 55040029 | 55040048 | 55040045 | + |
| SEQ ID NO 44105 | GCTGCGCCAAGGTGCGGGTG | TAG | chr1 | 55040034 | 55040053 | 55040050 | + |
| SEQ ID NO 44106 | CTGCGCCAAGGTGCGGGTGT | AGG | chr1 | 55040035 | 55040054 | 55040051 | + |
| SEQ ID NO 44107 | TGCGCCAAGGTGCGGGTGTA | GGG | chr1 | 55040036 | 55040055 | 55040052 | + |
| SEQ ID NO 44108 | CCAAGGTGCGGGTGTAGGGA | TGG | chr1 | 55040040 | 55040059 | 55040056 | + |
| SEQ ID NO 44109 | CAAGGTGCGGGTGTAGGGAT | GGG | chr1 | 55040041 | 55040060 | 55040057 | + |
| SEQ ID NO 44110 | AGGTGCGGGTGTAGGGATGG | GAG | chr1 | 55040043 | 55040062 | 55040059 | + |
| SEQ ID NO 44111 | GGTGCGGGTGTAGGGATGGG | AGG | chr1 | 55040044 | 55040063 | 55040060 | + |
| SEQ ID NO 44112 | CGGGTGTAGGGATGGGAGGC | CGG | chr1 | 55040048 | 55040067 | 55040064 | + |
| SEQ ID NO 44113 | GGGTGTAGGGATGGGAGGCC | GGG | chr1 | 55040049 | 55040068 | 55040065 | + |
| SEQ ID NO 44114 | GGTGTAGGGATGGGAGGCCG | GGG | chr1 | 55040050 | 55040069 | 55040066 | + |
| SEQ ID NO 44115 | GGGAGGCCGGGGCGAACCCG | CAG | chr1 | 55040061 | 55040080 | 55040077 | + |
| SEQ ID NO 44116 | GGCCGGGGCGAACCCGCAGC | CGG | chr1 | 55040065 | 55040084 | 55040081 | + |
| SEQ ID NO 44117 | GCCGGGGCGAACCCGCAGCC | GGG | chr1 | 55040066 | 55040085 | 55040082 | + |
| SEQ ID NO 44118 | GGGCGAACCCGCAGCCGGGA | CGG | chr1 | 55040070 | 55040089 | 55040086 | + |
| SEQ ID NO 44119 | AACCCGCAGCCGGGACGGTG | CGG | chr1 | 55040075 | 55040094 | 55040091 | + |
| SEQ ID NO 44120 | GGTGCGGTGCTGTTTCCTCT | CGG | chr1 | 55040091 | 55040110 | 55040107 | + |
| SEQ ID NO 44121 | GTGCGGTGCTGTTTCCTCTC | GGG | chr1 | 55040092 | 55040111 | 55040108 | + |
| SEQ ID NO 44122 | TGCTGTTTCCTCTCGGCCT | CAG | chr1 | 55040098 | 55040117 | 55040114 | + |
| SEQ ID NO 44123 | GCCTCAGTTTCCCCCATGT | AAG | chr1 | 55040114 | 55040133 | 55040130 | + |
| SEQ ID NO 44124 | CTCAGTTTCCCCCATGTAA | GAG | chr1 | 55040116 | 55040135 | 55040132 | + |
| SEQ ID NO 44125 | CAGTTTCCCCCATGTAAGA | GAG | chr1 | 55040118 | 55040137 | 55040134 | + |
| SEQ ID NO 44126 | AGTTTCCCCCATGTAAGAG | AGG | chr1 | 55040119 | 55040138 | 55040135 | + |
| SEQ ID NO 44127 | TTCCCCCATGTAAGAGAGG | AAG | chr1 | 55040122 | 55040141 | 55040138 | + |
| SEQ ID NO 44128 | CCCCCATGTAAGAGAGGAAG | TGG | chr1 | 55040125 | 55040144 | 55040141 | + |
| SEQ ID NO 44129 | CCCATGTAAGAGAGGAAGTG | GAG | chr1 | 55040127 | 55040146 | 55040143 | + |
| SEQ ID NO 44130 | GTAAGAGAGGAAGTGGAGTG | CAG | chr1 | 55040132 | 55040151 | 55040148 | + |

Figure 61 (Cont'd)

| SEQ ID NO 44131 | TAAGAGAGGAAGTGGAGTGC | AGG | chr1 | 55040133 | 55040152 | 55040149 | + |
| SEQ ID NO 44132 | GAAGTGGAGTGCAGGTCGCC | GAG | chr1 | 55040141 | 55040160 | 55040157 | + |
| SEQ ID NO 44133 | AAGTGGAGTGCAGGTCGCCG | AGG | chr1 | 55040142 | 55040161 | 55040158 | + |
| SEQ ID NO 44134 | AGTGGAGTGCAGGTCGCCGA | GGG | chr1 | 55040143 | 55040162 | 55040159 | + |
| SEQ ID NO 44135 | GTCGCCGAGGGCTCTTCGCT | TGG | chr1 | 55040155 | 55040174 | 55040171 | + |
| SEQ ID NO 44136 | CTCTTCGCTTGGCACGATCT | TGG | chr1 | 55040166 | 55040185 | 55040182 | + |
| SEQ ID NO 44137 | TCTTCGCTTGGCACGATCTT | GGG | chr1 | 55040167 | 55040186 | 55040183 | + |
| SEQ ID NO 44138 | CTTCGCTTGGCACGATCTTG | GGG | chr1 | 55040168 | 55040187 | 55040184 | + |
| SEQ ID NO 44139 | TGGCACGATCTTGGGGACTG | CAG | chr1 | 55040175 | 55040194 | 55040191 | + |
| SEQ ID NO 44140 | GGCACGATCTTGGGGACTGC | AGG | chr1 | 55040176 | 55040195 | 55040192 | + |
| SEQ ID NO 44141 | CGATCTTGGGGACTGCAGGC | AAG | chr1 | 55040180 | 55040199 | 55040196 | + |
| SEQ ID NO 44142 | GATCTTGGGGACTGCAGGCA | AGG | chr1 | 55040181 | 55040200 | 55040197 | + |
| SEQ ID NO 44143 | CTTGGGGACTGCAGGCAAGG | CGG | chr1 | 55040184 | 55040203 | 55040200 | + |
| SEQ ID NO 44144 | GGGGACTGCAGGCAAGGCGG | CGG | chr1 | 55040187 | 55040206 | 55040203 | + |
| SEQ ID NO 44145 | GGGACTGCAGGCAAGGCGGC | GGG | chr1 | 55040188 | 55040207 | 55040204 | + |
| SEQ ID NO 44146 | GGACTGCAGGCAAGGCGGCG | GGG | chr1 | 55040189 | 55040208 | 55040205 | + |
| SEQ ID NO 44147 | GACTGCAGGCAAGGCGGCGG | GGG | chr1 | 55040190 | 55040209 | 55040206 | + |
| SEQ ID NO 44148 | CTGCAGGCAAGGCGGCGGGG | GAG | chr1 | 55040192 | 55040211 | 55040208 | + |
| SEQ ID NO 44149 | TGCAGGCAAGGCGGCGGGGG | AGG | chr1 | 55040193 | 55040212 | 55040209 | + |
| SEQ ID NO 44150 | GGCAAGGCGGCGGGGGAGGA | CGG | chr1 | 55040197 | 55040216 | 55040213 | + |
| SEQ ID NO 44151 | GCAAGGCGGCGGGGGAGGAC | GGG | chr1 | 55040198 | 55040217 | 55040214 | + |
| SEQ ID NO 44152 | AGGCGGCGGGGGAGGACGGG | TAG | chr1 | 55040201 | 55040220 | 55040217 | + |
| SEQ ID NO 44153 | CGGCGGGGGAGGACGGGTAG | TGG | chr1 | 55040204 | 55040223 | 55040220 | + |
| SEQ ID NO 44154 | GGCGGGGGAGGACGGGTAGT | GGG | chr1 | 55040205 | 55040224 | 55040221 | + |
| SEQ ID NO 44155 | GCGGGGGAGGACGGGTAGTG | GGG | chr1 | 55040206 | 55040225 | 55040222 | + |
| SEQ ID NO 44156 | GGGGGAGGACGGGTAGTGGG | GAG | chr1 | 55040208 | 55040227 | 55040224 | + |
| SEQ ID NO 44157 | AGGACGGGTAGTGGGGAGCA | CGG | chr1 | 55040213 | 55040232 | 55040229 | + |
| SEQ ID NO 44158 | ACGGGTAGTGGGGAGCACGG | TGG | chr1 | 55040216 | 55040235 | 55040232 | + |
| SEQ ID NO 44159 | GGGTAGTGGGGAGCACGGTG | GAG | chr1 | 55040218 | 55040237 | 55040234 | + |
| SEQ ID NO 44160 | GTAGTGGGGAGCACGGTGGA | GAG | chr1 | 55040220 | 55040239 | 55040236 | + |
| SEQ ID NO 44161 | GTGGGGAGCACGGTGGAGAG | CGG | chr1 | 55040223 | 55040242 | 55040239 | + |
| SEQ ID NO 44162 | TGGGGAGCACGGTGGAGAGC | GGG | chr1 | 55040224 | 55040243 | 55040240 | + |
| SEQ ID NO 44163 | GGGGAGCACGGTGGAGAGCG | GGG | chr1 | 55040225 | 55040244 | 55040241 | + |
| SEQ ID NO 44164 | AGCACGGTGGAGAGCGGGGA | CGG | chr1 | 55040229 | 55040248 | 55040245 | + |
| SEQ ID NO 44165 | CGGTGGAGAGCGGGGACGGC | CGG | chr1 | 55040233 | 55040252 | 55040249 | + |
| SEQ ID NO 44166 | AGCGGGGACGGCCGGCTCTT | TGG | chr1 | 55040241 | 55040260 | 55040257 | + |
| SEQ ID NO 44167 | GCGGGGACGGCCGGCTCTTT | GGG | chr1 | 55040242 | 55040261 | 55040258 | + |
| SEQ ID NO 44168 | CGGGGACGGCCGGCTCTTTG | GGG | chr1 | 55040243 | 55040262 | 55040259 | + |
| SEQ ID NO 44169 | CCGGCTCTTTGGGGACTTGC | TGG | chr1 | 55040252 | 55040271 | 55040268 | + |
| SEQ ID NO 44170 | CGGCTCTTTGGGGACTTGCT | GGG | chr1 | 55040253 | 55040272 | 55040269 | + |
| SEQ ID NO 44171 | GGCTCTTTGGGGACTTGCTG | GGG | chr1 | 55040254 | 55040273 | 55040270 | + |
| SEQ ID NO 44172 | TGGGGACTTGCTGGGGCGTG | CGG | chr1 | 55040261 | 55040280 | 55040277 | + |
| SEQ ID NO 44173 | GGGCGTGCGGCTGCGCTATT | CAG | chr1 | 55040274 | 55040293 | 55040290 | + |
| SEQ ID NO 44174 | CGTGCGGCTGCGCTATTCAG | TGG | chr1 | 55040277 | 55040296 | 55040293 | + |
| SEQ ID NO 44175 | GTGCGGCTGCGCTATTCAGT | GGG | chr1 | 55040278 | 55040297 | 55040294 | + |
| SEQ ID NO 44176 | CGGCTGCGCTATTCAGTGGG | AAG | chr1 | 55040281 | 55040300 | 55040297 | + |
| SEQ ID NO 44177 | GGCTGCGCTATTCAGTGGGA | AGG | chr1 | 55040282 | 55040301 | 55040298 | + |

Figure 61 (Cont'd)

| | | | | | | | |
|---|---|---|---|---|---|---|---|
| SEQ ID NO 44178 | CTATTCAGTGGGAAGGTTCG | CGG | chr1 | 55040289 | 55040308 | 55040305 | + |
| SEQ ID NO 44179 | TATTCAGTGGGAAGGTTCGC | GGG | chr1 | 55040290 | 55040309 | 55040306 | + |
| SEQ ID NO 44180 | ATTCAGTGGGAAGGTTCGCG | GGG | chr1 | 55040291 | 55040310 | 55040307 | + |
| SEQ ID NO 44181 | AGTGGGAAGGTTCGCGGGGT | TGG | chr1 | 55040295 | 55040314 | 55040311 | + |
| SEQ ID NO 44182 | GTGGGAAGGTTCGCGGGGTT | GGG | chr1 | 55040296 | 55040315 | 55040312 | + |
| SEQ ID NO 44183 | GGGAAGGTTCGCGGGGTTGG | GAG | chr1 | 55040298 | 55040317 | 55040314 | + |
| SEQ ID NO 44184 | GTTCGCGGGGTTGGGAGACC | CGG | chr1 | 55040304 | 55040323 | 55040320 | + |
| SEQ ID NO 44185 | TCGCGGGGTTGGGAGACCCG | GAG | chr1 | 55040306 | 55040325 | 55040322 | + |
| SEQ ID NO 44186 | CGCGGGGTTGGGAGACCCGG | AGG | chr1 | 55040307 | 55040326 | 55040323 | + |
| SEQ ID NO 44187 | GGTTGGGAGACCCGGAGGCC | GAG | chr1 | 55040312 | 55040331 | 55040328 | + |
| SEQ ID NO 44188 | GTTGGGAGACCCGGAGGCCG | AGG | chr1 | 55040313 | 55040332 | 55040329 | + |
| SEQ ID NO 44189 | GGGAGACCCGGAGGCCGAGG | AAG | chr1 | 55040316 | 55040335 | 55040332 | + |
| SEQ ID NO 44190 | GGAGACCCGGAGGCCGAGGA | AGG | chr1 | 55040317 | 55040336 | 55040333 | + |
| SEQ ID NO 44191 | GAGACCCGGAGGCCGAGGAA | GGG | chr1 | 55040318 | 55040337 | 55040334 | + |
| SEQ ID NO 44192 | CCCGGAGGCCGAGGAAGGGC | GAG | chr1 | 55040322 | 55040341 | 55040338 | + |
| SEQ ID NO 44193 | GGAGGCCGAGGAAGGGCGAG | CAG | chr1 | 55040325 | 55040344 | 55040341 | + |
| SEQ ID NO 44194 | AGGCCGAGGAAGGGCGAGCA | GAG | chr1 | 55040327 | 55040346 | 55040343 | + |
| SEQ ID NO 44195 | AAGGGCGAGCAGAGCACTGC | CAG | chr1 | 55040336 | 55040355 | 55040352 | + |
| SEQ ID NO 44196 | AGGGCGAGCAGAGCACTGCC | AGG | chr1 | 55040337 | 55040356 | 55040353 | + |
| SEQ ID NO 44197 | CACTGCCAGGATATCCTGCC | CAG | chr1 | 55040350 | 55040369 | 55040366 | + |
| SEQ ID NO 44198 | GATATCCTGCCCAGATTTCC | CAG | chr1 | 55040359 | 55040378 | 55040375 | + |
| SEQ ID NO 44199 | TCCCAGTTTCTGCCTCGCCG | CGG | chr1 | 55040376 | 55040395 | 55040392 | + |
| SEQ ID NO 44200 | GTTTCTGCCTCGCCGCGGCA | CAG | chr1 | 55040381 | 55040400 | 55040397 | + |
| SEQ ID NO 44201 | TTTCTGCCTCGCCGCGGCAC | AGG | chr1 | 55040382 | 55040401 | 55040398 | + |
| SEQ ID NO 44202 | CTGCCTCGCCGCGGCACAGG | TGG | chr1 | 55040385 | 55040404 | 55040401 | + |
| SEQ ID NO 44203 | TGCCTCGCCGCGGCACAGGT | GGG | chr1 | 55040386 | 55040405 | 55040402 | + |
| SEQ ID NO 44204 | CGCCGCGGCACAGGTGGGTG | AAG | chr1 | 55040391 | 55040410 | 55040407 | + |
| SEQ ID NO 44205 | GCCGCGGCACAGGTGGGTGA | AGG | chr1 | 55040392 | 55040411 | 55040408 | + |
| SEQ ID NO 44206 | CGCGGCACAGGTGGGTGAAG | GAG | chr1 | 55040394 | 55040413 | 55040410 | + |
| SEQ ID NO 44207 | TGGGTGAAGGAGTGAATGCC | TGG | chr1 | 55040405 | 55040424 | 55040421 | + |
| SEQ ID NO 44208 | AGTGAATGCCTGGAACGTAC | TGG | chr1 | 55040415 | 55040434 | 55040431 | + |
| SEQ ID NO 44209 | GTGAATGCCTGGAACGTACT | GGG | chr1 | 55040416 | 55040435 | 55040432 | + |
| SEQ ID NO 44210 | GAACGTACTGGGAACTGCAC | CAG | chr1 | 55040427 | 55040446 | 55040443 | + |
| SEQ ID NO 44211 | AACGTACTGGGAACTGCACC | AGG | chr1 | 55040428 | 55040447 | 55040444 | + |
| SEQ ID NO 44212 | ACTGGGAACTGCACCAGGCA | CAG | chr1 | 55040433 | 55040452 | 55040449 | + |
| SEQ ID NO 44213 | TGGGAACTGCACCAGGCACA | GAG | chr1 | 55040435 | 55040454 | 55040451 | + |
| SEQ ID NO 44214 | AACTGCACCAGGCACAGAGA | AAG | chr1 | 55040439 | 55040458 | 55040455 | + |
| SEQ ID NO 44215 | TGCACCAGGCACAGAGAAAG | CGG | chr1 | 55040442 | 55040461 | 55040458 | + |
| SEQ ID NO 44216 | GCACCAGGCACAGAGAAAGC | GGG | chr1 | 55040443 | 55040462 | 55040459 | + |
| SEQ ID NO 44217 | AGAAAGCGGGCTTGCCATTA | TAG | chr1 | 55040456 | 55040475 | 55040472 | + |
| SEQ ID NO 44218 | AAGCGGGCTTGCCATTATAG | TGG | chr1 | 55040459 | 55040478 | 55040475 | + |
| SEQ ID NO 44219 | AGCGGGCTTGCCATTATAGT | GGG | chr1 | 55040460 | 55040479 | 55040476 | + |
| SEQ ID NO 44220 | CATTATAGTGGGTTCCGATT | TGG | chr1 | 55040471 | 55040490 | 55040487 | + |
| SEQ ID NO 44221 | TAGTGGGTTCCGATTTGGTT | TGG | chr1 | 55040476 | 55040495 | 55040492 | + |
| SEQ ID NO 44222 | CCGATTTGGTTTGGAAAACA | TGG | chr1 | 55040485 | 55040504 | 55040501 | + |
| SEQ ID NO 44223 | CGATTTGGTTTGGAAAACAT | GGG | chr1 | 55040486 | 55040505 | 55040502 | + |
| SEQ ID NO 44224 | TTTGGTTTGGAAAACATGGG | CAG | chr1 | 55040489 | 55040508 | 55040505 | + |

Figure 61 (Cont'd)

| | | | | | | | |
|---|---|---|---|---|---|---|---|
| SEQ ID NO 44225 | GGTTTGGAAAACATGGGCAG | CGG | chr1 | 55040492 | 55040511 | 55040508 | + |
| SEQ ID NO 44226 | TTTGGAAAACATGGGCAGCG | GAG | chr1 | 55040494 | 55040513 | 55040510 | + |
| SEQ ID NO 44227 | TTGGAAAACATGGGCAGCGG | AGG | chr1 | 55040495 | 55040514 | 55040511 | + |
| SEQ ID NO 44228 | TGGAAAACATGGGCAGCGGA | GGG | chr1 | 55040496 | 55040515 | 55040512 | + |
| SEQ ID NO 44229 | AAAACATGGGCAGCGGAGGG | TGG | chr1 | 55040499 | 55040518 | 55040515 | + |
| SEQ ID NO 44230 | AACATGGGCAGCGGAGGGTG | GAG | chr1 | 55040501 | 55040520 | 55040517 | + |
| SEQ ID NO 44231 | ACATGGGCAGCGGAGGGTGG | AGG | chr1 | 55040502 | 55040521 | 55040518 | + |
| SEQ ID NO 44232 | CATGGGCAGCGGAGGGTGGA | GGG | chr1 | 55040503 | 55040522 | 55040519 | + |
| SEQ ID NO 44233 | GCAGCGGAGGGTGGAGGGCC | TGG | chr1 | 55040508 | 55040527 | 55040524 | + |
| SEQ ID NO 44234 | AGCGGAGGGTGGAGGGCCTG | GAG | chr1 | 55040510 | 55040529 | 55040526 | + |
| SEQ ID NO 44235 | CGGAGGGTGGAGGGCCTGGA | GAG | chr1 | 55040512 | 55040531 | 55040528 | + |
| SEQ ID NO 44236 | AGGGTGGAGGGCCTGGAGAG | AAG | chr1 | 55040515 | 55040534 | 55040531 | + |
| SEQ ID NO 44237 | GGGTGGAGGGCCTGGAGAGA | AGG | chr1 | 55040516 | 55040535 | 55040532 | + |
| SEQ ID NO 44238 | CTGGAGAGAAGGCCCTACCC | GAG | chr1 | 55040527 | 55040546 | 55040543 | + |
| SEQ ID NO 44239 | AGAGAAGGCCCTACCCGAGA | CAG | chr1 | 55040531 | 55040550 | 55040547 | + |
| SEQ ID NO 44240 | GAGAAGGCCCTACCCGAGAC | AGG | chr1 | 55040532 | 55040551 | 55040548 | + |
| SEQ ID NO 44241 | AGAAGGCCCTACCCGAGACA | GGG | chr1 | 55040533 | 55040552 | 55040549 | + |
| SEQ ID NO 44242 | GAAGGCCCTACCCGAGACAG | GGG | chr1 | 55040534 | 55040553 | 55040550 | + |
| SEQ ID NO 44243 | GGCCCTACCCGAGACAGGGG | CGG | chr1 | 55040537 | 55040556 | 55040553 | + |
| SEQ ID NO 44244 | GCCCTACCCGAGACAGGGGC | GGG | chr1 | 55040538 | 55040557 | 55040554 | + |
| SEQ ID NO 44245 | CCCTACCCGAGACAGGGGCG | GGG | chr1 | 55040539 | 55040558 | 55040555 | + |
| SEQ ID NO 44246 | TACCCGAGACAGGGGCGGGG | TGG | chr1 | 55040542 | 55040561 | 55040558 | + |
| SEQ ID NO 44247 | ACCCGAGACAGGGGCGGGGT | GGG | chr1 | 55040543 | 55040562 | 55040559 | + |
| SEQ ID NO 44248 | CGAGACAGGGGCGGGGTGGG | AAG | chr1 | 55040546 | 55040565 | 55040562 | + |
| SEQ ID NO 44249 | GAGACAGGGGCGGGGTGGGA | AGG | chr1 | 55040547 | 55040566 | 55040563 | + |
| SEQ ID NO 44250 | CAGGGGCGGGGTGGGAAGGA | CGG | chr1 | 55040551 | 55040570 | 55040567 | + |
| SEQ ID NO 44251 | GGGCGGGGTGGGAAGGACGG | CAG | chr1 | 55040554 | 55040573 | 55040570 | + |
| SEQ ID NO 44252 | GTGGGAAGGACGGCAGATGC | TGG | chr1 | 55040561 | 55040580 | 55040577 | + |
| SEQ ID NO 44253 | TGGGAAGGACGGCAGATGCT | GGG | chr1 | 55040562 | 55040581 | 55040578 | + |
| SEQ ID NO 44254 | GGAAGGACGGCAGATGCTGG | GAG | chr1 | 55040564 | 55040583 | 55040580 | + |
| SEQ ID NO 44255 | ACGGCAGATGCTGGGAGCAC | GAG | chr1 | 55040570 | 55040589 | 55040586 | + |
| SEQ ID NO 44256 | CGGCAGATGCTGGGAGCACG | AGG | chr1 | 55040571 | 55040590 | 55040587 | + |
| SEQ ID NO 44257 | GAGGCAATTTCTTTATGACA | CAG | chr1 | 55040590 | 55040609 | 55040606 | + |
| SEQ ID NO 44258 | ATGACACAGAACTCATGCTC | TAG | chr1 | 55040604 | 55040623 | 55040620 | + |
| SEQ ID NO 44259 | CTCTAGTATTCCATCTGTTT | CAG | chr1 | 55040621 | 55040640 | 55040637 | + |
| SEQ ID NO 44260 | TATTCCATCTGTTTCAGCCG | AAG | chr1 | 55040627 | 55040646 | 55040643 | + |
| SEQ ID NO 44261 | CATCTGTTTCAGCCGAAGAA | AAG | chr1 | 55040632 | 55040651 | 55040648 | + |
| SEQ ID NO 44262 | TTTCAGCCGAAGAAAAGAAC | CAG | chr1 | 55040638 | 55040657 | 55040654 | + |
| SEQ ID NO 44263 | CCGAAGAAAAGAACCAGCTG | AAG | chr1 | 55040644 | 55040663 | 55040660 | + |
| SEQ ID NO 44264 | CGAAGAAAAGAACCAGCTGA | AGG | chr1 | 55040645 | 55040664 | 55040661 | + |
| SEQ ID NO 44265 | GAAGAAAAGAACCAGCTGAA | GGG | chr1 | 55040646 | 55040665 | 55040662 | + |
| SEQ ID NO 44266 | AAGAAAAGAACCAGCTGAAG | GGG | chr1 | 55040647 | 55040666 | 55040663 | + |
| SEQ ID NO 44267 | AAAAGAACCAGCTGAAGGGG | CAG | chr1 | 55040650 | 55040669 | 55040666 | + |
| SEQ ID NO 44268 | AAAGAACCAGCTGAAGGGGC | AGG | chr1 | 55040651 | 55040670 | 55040667 | + |
| SEQ ID NO 44269 | AAGAACCAGCTGAAGGGGCA | GGG | chr1 | 55040652 | 55040671 | 55040668 | + |
| SEQ ID NO 44270 | AGAACCAGCTGAAGGGGCAG | GGG | chr1 | 55040653 | 55040672 | 55040669 | + |
| SEQ ID NO 44271 | AACCAGCTGAAGGGGCAGGG | GAG | chr1 | 55040655 | 55040674 | 55040671 | + |

Figure 61 (Cont'd)

| | | | | | | | |
|---|---|---|---|---|---|---|---|
| SEQ ID NO 44272 | CAGCTGAAGGGGCAGGGGAG | AAG | chr1 | 55040658 | 55040677 | 55040674 | + |
| SEQ ID NO 44273 | AGCTGAAGGGGCAGGGGAGA | AGG | chr1 | 55040659 | 55040678 | 55040675 | + |
| SEQ ID NO 44274 | GCTGAAGGGGCAGGGGAGAA | GGG | chr1 | 55040660 | 55040679 | 55040676 | + |
| SEQ ID NO 44275 | CTGAAGGGGCAGGGGAGAAG | GGG | chr1 | 55040661 | 55040680 | 55040677 | + |
| SEQ ID NO 44276 | AAGGGGCAGGGGAGAAGGGG | CGG | chr1 | 55040664 | 55040683 | 55040680 | + |
| SEQ ID NO 44277 | GGGGCAGGGGAGAAGGGGCG | GAG | chr1 | 55040666 | 55040685 | 55040682 | + |
| SEQ ID NO 44278 | GGGCAGGGGAGAAGGGGCGG | AGG | chr1 | 55040667 | 55040686 | 55040683 | + |
| SEQ ID NO 44279 | GAAGGGGCGGAGGTATTCTC | GAG | chr1 | 55040677 | 55040696 | 55040693 | + |
| SEQ ID NO 44280 | AAGGGGCGGAGGTATTCTCG | AGG | chr1 | 55040678 | 55040697 | 55040694 | + |
| SEQ ID NO 44281 | GAGGTATTCTCGAGGCCCAT | TGG | chr1 | 55040686 | 55040705 | 55040702 | + |
| SEQ ID NO 44282 | CGAGGCCCATTGGCGTCCTT | TAG | chr1 | 55040696 | 55040715 | 55040712 | + |
| SEQ ID NO 44283 | GAGGCCCATTGGCGTCCTTT | AGG | chr1 | 55040697 | 55040716 | 55040713 | + |
| SEQ ID NO 44284 | CATTGGCGTCCTTTAGGACT | CAG | chr1 | 55040703 | 55040722 | 55040719 | + |
| SEQ ID NO 44285 | ATTGGCGTCCTTTAGGACTC | AGG | chr1 | 55040704 | 55040723 | 55040720 | + |
| SEQ ID NO 44286 | GGCGTCCTTTAGGACTCAGG | CAG | chr1 | 55040707 | 55040726 | 55040723 | + |
| SEQ ID NO 44287 | GCGTCCTTTAGGACTCAGGC | AGG | chr1 | 55040708 | 55040727 | 55040724 | + |
| SEQ ID NO 44288 | CGTCCTTTAGGACTCAGGCA | GGG | chr1 | 55040709 | 55040728 | 55040725 | + |
| SEQ ID NO 44289 | CCTTTAGGACTCAGGCAGGG | AAG | chr1 | 55040712 | 55040731 | 55040728 | + |
| SEQ ID NO 44290 | CTTTAGGACTCAGGCAGGGA | AGG | chr1 | 55040713 | 55040732 | 55040729 | + |
| SEQ ID NO 44291 | TTTAGGACTCAGGCAGGGAA | GGG | chr1 | 55040714 | 55040733 | 55040730 | + |
| SEQ ID NO 44292 | CTCAGGCAGGGAAGGGCCCT | TGG | chr1 | 55040721 | 55040740 | 55040737 | + |
| SEQ ID NO 44293 | GGGAAGGGCCCTTGGTGCTC | TGG | chr1 | 55040729 | 55040748 | 55040745 | + |
| SEQ ID NO 44294 | GAAGGGCCCTTGGTGCTCTG | GAG | chr1 | 55040731 | 55040750 | 55040747 | + |
| SEQ ID NO 44295 | GGCCCTTGGTGCTCTGGAGC | CGG | chr1 | 55040735 | 55040754 | 55040751 | + |
| SEQ ID NO 44296 | CCCTTGGTGCTCTGGAGCCG | GAG | chr1 | 55040737 | 55040756 | 55040753 | + |
| SEQ ID NO 44297 | CCTTGGTGCTCTGGAGCCGG | AGG | chr1 | 55040738 | 55040757 | 55040754 | + |
| SEQ ID NO 44298 | TGGTGCTCTGGAGCCGGAGG | TGG | chr1 | 55040741 | 55040760 | 55040757 | + |
| SEQ ID NO 44299 | GGAGCCGGAGGTGGTGCGCC | TGG | chr1 | 55040750 | 55040769 | 55040766 | + |
| SEQ ID NO 44300 | GGAGGTGGTGCGCCTGGTAC | TGG | chr1 | 55040756 | 55040775 | 55040772 | + |
| SEQ ID NO 44301 | GAGGTGGTGCGCCTGGTACT | GGG | chr1 | 55040757 | 55040776 | 55040773 | + |
| SEQ ID NO 44302 | TGCGCCTGGTACTGGGACCC | CGG | chr1 | 55040764 | 55040783 | 55040780 | + |
| SEQ ID NO 44303 | CGCCTGGTACTGGGACCCCG | GAG | chr1 | 55040766 | 55040785 | 55040782 | + |
| SEQ ID NO 44304 | GGTACTGGGACCCCGGAGCT | GAG | chr1 | 55040771 | 55040790 | 55040787 | + |
| SEQ ID NO 44305 | TGGGACCCCGGAGCTGAGCC | CGG | chr1 | 55040776 | 55040795 | 55040792 | + |
| SEQ ID NO 44306 | CGGAGCTGAGCCCGGCGCCT | CAG | chr1 | 55040784 | 55040803 | 55040800 | + |
| SEQ ID NO 44307 | GCCCGGCGCCTCAGCCCACC | TGG | chr1 | 55040793 | 55040812 | 55040809 | + |
| SEQ ID NO 44308 | GGCTGTCTGCCGACCGTGTG | CGG | chr1 | 55040814 | 55040833 | 55040830 | + |
| SEQ ID NO 44309 | GCTGTCTGCCGACCGTGTGC | GGG | chr1 | 55040815 | 55040834 | 55040831 | + |
| SEQ ID NO 44310 | CTGTCTGCCGACCGTGTGCG | GGG | chr1 | 55040816 | 55040835 | 55040832 | + |
| SEQ ID NO 44311 | CTGCCGACCGTGTGCGGGGC | GAG | chr1 | 55040820 | 55040839 | 55040836 | + |
| SEQ ID NO 44312 | AGTTTGCTCAACAACTCTGC | CAG | chr1 | 55040841 | 55040860 | 55040857 | + |
| SEQ ID NO 44313 | TCAACAACTCTGCCAGCTTC | TGG | chr1 | 55040848 | 55040867 | 55040864 | + |
| SEQ ID NO 44314 | CTCTGCCAGCTTCTGGCCCT | CAG | chr1 | 55040855 | 55040874 | 55040871 | + |
| SEQ ID NO 44315 | TCTGCCAGCTTCTGGCCCTC | AGG | chr1 | 55040856 | 55040875 | 55040872 | + |
| SEQ ID NO 44316 | AGCTTCTGGCCCTCAGGCTG | TGG | chr1 | 55040862 | 55040881 | 55040878 | + |
| SEQ ID NO 44317 | GCTTCTGGCCCTCAGGCTGT | GGG | chr1 | 55040863 | 55040882 | 55040879 | + |
| SEQ ID NO 44318 | TCTGGCCCTCAGGCTGTGGG | AAG | chr1 | 55040866 | 55040885 | 55040882 | + |

Figure 61 (Cont'd)

| | | | | | | | |
|---|---|---|---|---|---|---|---|
| SEQ ID NO 44319 | GGCTGTGGGAAGCTTCTTCC | CGG | chr1 | 55040877 | 55040896 | 55040893 | + |
| SEQ ID NO 44320 | GCTGTGGGAAGCTTCTTCCC | GGG | chr1 | 55040878 | 55040897 | 55040894 | + |
| SEQ ID NO 44321 | CTGTGGGAAGCTTCTTCCCG | GGG | chr1 | 55040879 | 55040898 | 55040895 | + |
| SEQ ID NO 44322 | GGGAAGCTTCTTCCCGGGGC | GAG | chr1 | 55040883 | 55040902 | 55040899 | + |
| SEQ ID NO 44323 | TCTTCCCGGGGCGAGACCAC | TAG | chr1 | 55040891 | 55040910 | 55040907 | + |
| SEQ ID NO 44324 | CGAGACCACTAGCTTTTCT | AAG | chr1 | 55040902 | 55040921 | 55040918 | + |
| SEQ ID NO 44325 | TAGCTTTTCTAAGTATTAC | CAG | chr1 | 55040911 | 55040930 | 55040927 | + |
| SEQ ID NO 44326 | TTTTCTAAGTATTACCAGCC | CAG | chr1 | 55040916 | 55040935 | 55040932 | + |
| SEQ ID NO 44327 | TTTCTAAGTATTACCAGCCC | AGG | chr1 | 55040917 | 55040936 | 55040933 | + |
| SEQ ID NO 44328 | AGTATTACCAGCCCAGGACT | TGG | chr1 | 55040923 | 55040942 | 55040939 | + |
| SEQ ID NO 44329 | TACCAGCCCAGGACTTGGCT | GAG | chr1 | 55040928 | 55040947 | 55040944 | + |
| SEQ ID NO 44330 | ACCAGCCCAGGACTTGGCTG | AGG | chr1 | 55040929 | 55040948 | 55040945 | + |
| SEQ ID NO 44331 | GGCTGAGGTTCTGTGTCCCC | CAG | chr1 | 55040944 | 55040963 | 55040960 | + |
| SEQ ID NO 44332 | AGGTTCTGTGTCCCCCAGCT | TGG | chr1 | 55040949 | 55040968 | 55040965 | + |
| SEQ ID NO 44333 | GTTCTGTGTCCCCAGCTTG | GAG | chr1 | 55040951 | 55040970 | 55040967 | + |
| SEQ ID NO 44334 | TGTGTCCCCAGCTTGGAGT | CAG | chr1 | 55040955 | 55040974 | 55040971 | + |
| SEQ ID NO 44335 | CCCCAGCTTGGAGTCAGATG | TGG | chr1 | 55040961 | 55040980 | 55040977 | + |
| SEQ ID NO 44336 | CCCAGCTTGGAGTCAGATGT | GGG | chr1 | 55040962 | 55040981 | 55040978 | + |
| SEQ ID NO 44337 | CCAGCTTGGAGTCAGATGTG | GGG | chr1 | 55040963 | 55040982 | 55040979 | + |
| SEQ ID NO 44338 | TCAGATGTGGGGTTGAATCT | TGG | chr1 | 55040974 | 55040993 | 55040990 | + |
| SEQ ID NO 44339 | GAATCTTGGCTTCCTCTCAC | TAG | chr1 | 55040988 | 55041007 | 55041004 | + |
| SEQ ID NO 44340 | TGGCTTCCTCTCACTAGCTG | TGG | chr1 | 55040994 | 55041013 | 55041010 | + |
| SEQ ID NO 44341 | CACTAGCTGTGGTGCTTGAC | AAG | chr1 | 55041005 | 55041024 | 55041021 | + |
| SEQ ID NO 44342 | TTGACAAGTCACTTATCCTT | GAG | chr1 | 55041020 | 55041039 | 55041036 | + |
| SEQ ID NO 44343 | CTCCATTGCCTAATCTTTAA | AAG | chr1 | 55041044 | 55041063 | 55041060 | + |
| SEQ ID NO 44344 | TCCATTGCCTAATCTTTAAA | AGG | chr1 | 55041045 | 55041064 | 55041061 | + |
| SEQ ID NO 44345 | CCATTGCCTAATCTTTAAAA | GGG | chr1 | 55041046 | 55041065 | 55041062 | + |
| SEQ ID NO 44346 | ATTGCCTAATCTTTAAAAGG | GAG | chr1 | 55041048 | 55041067 | 55041064 | + |
| SEQ ID NO 44347 | TTGCCTAATCTTTAAAAGGG | AGG | chr1 | 55041049 | 55041068 | 55041065 | + |
| SEQ ID NO 44348 | GGAGGTGACAATCGTCCCTA | CGG | chr1 | 55041067 | 55041086 | 55041083 | + |
| SEQ ID NO 44349 | TGACAATCGTCCCTACGGCT | CAG | chr1 | 55041072 | 55041091 | 55041088 | + |
| SEQ ID NO 44350 | CAATCGTCCCTACGGCTCAG | TGG | chr1 | 55041075 | 55041094 | 55041091 | + |
| SEQ ID NO 44351 | TCGTCCCTACGGCTCAGTGG | CAG | chr1 | 55041078 | 55041097 | 55041094 | + |
| SEQ ID NO 44352 | TCCCTACGGCTCAGTGGCAG | CAG | chr1 | 55041081 | 55041100 | 55041097 | + |
| SEQ ID NO 44353 | TACGGCTCAGTGGCAGCAGA | TGG | chr1 | 55041085 | 55041104 | 55041101 | + |
| SEQ ID NO 44354 | ACGGCTCAGTGGCAGCAGAT | GGG | chr1 | 55041086 | 55041105 | 55041102 | + |
| SEQ ID NO 44355 | CGGCTCAGTGGCAGCAGATG | GGG | chr1 | 55041087 | 55041106 | 55041103 | + |
| SEQ ID NO 44356 | GCTCAGTGGCAGCAGATGGG | GAG | chr1 | 55041089 | 55041108 | 55041105 | + |
| SEQ ID NO 44357 | TGGCAGCAGATGGGGAGATG | AAG | chr1 | 55041095 | 55041114 | 55041111 | + |
| SEQ ID NO 44358 | GGCAGCAGATGGGGAGATGA | AGG | chr1 | 55041096 | 55041115 | 55041112 | + |
| SEQ ID NO 44359 | GCAGCAGATGGGGAGATGAA | GGG | chr1 | 55041097 | 55041116 | 55041113 | + |
| SEQ ID NO 44360 | CAGATGGGGAGATGAAGGA | AAG | chr1 | 55041101 | 55041120 | 55041117 | + |
| SEQ ID NO 44361 | GGGAAAGTTCTGTTGACCAT | GAG | chr1 | 55041117 | 55041136 | 55041133 | + |
| SEQ ID NO 44362 | CATGAGTGAACTTACAATGC | AAG | chr1 | 55041134 | 55041153 | 55041150 | + |
| SEQ ID NO 44363 | TGAACTTACAATGCAAGCCC | CGG | chr1 | 55041140 | 55041159 | 55041156 | + |
| SEQ ID NO 44364 | GAACTTACAATGCAAGCCCC | GGG | chr1 | 55041141 | 55041160 | 55041157 | + |
| SEQ ID NO 44365 | AACTTACAATGCAAGCCCCG | GGG | chr1 | 55041142 | 55041161 | 55041158 | + |

Figure 61 (Cont'd)

| SEQ ID NO 44366 | ACTTACAATGCAAGCCCCGG | GGG | chr1 | 55041143 | 55041162 | 55041159 | + |
| SEQ ID NO 44367 | CTTACAATGCAAGCCCCGGG | GGG | chr1 | 55041144 | 55041163 | 55041160 | + |
| SEQ ID NO 44368 | AGCCCCGGGGGGATCACTTG | CAG | chr1 | 55041155 | 55041174 | 55041171 | + |
| SEQ ID NO 44369 | TGCAGTTTTGTCCCTGTCTG | CAG | chr1 | 55041173 | 55041192 | 55041189 | + |
| SEQ ID NO 44370 | CTGTCTGCAGTGTGACCTGT | TGG | chr1 | 55041186 | 55041205 | 55041202 | + |
| SEQ ID NO 44371 | ATTGTCTTTGCTCCAAACCA | CAG | chr1 | 55041213 | 55041232 | 55041229 | + |
| SEQ ID NO 44372 | TTGCTCCAAACCACAGCTCC | TGG | chr1 | 55041220 | 55041239 | 55041236 | + |
| SEQ ID NO 44373 | TGCTCCAAACCACAGCTCCT | GGG | chr1 | 55041221 | 55041240 | 55041237 | + |
| SEQ ID NO 44374 | GCTCCAAACCACAGCTCCTG | GGG | chr1 | 55041222 | 55041241 | 55041238 | + |
| SEQ ID NO 44375 | CCAAACCACAGCTCCTGGGG | CAG | chr1 | 55041225 | 55041244 | 55041241 | + |
| SEQ ID NO 44376 | AAACCACAGCTCCTGGGGCA | GAG | chr1 | 55041227 | 55041246 | 55041243 | + |
| SEQ ID NO 44377 | AACCACAGCTCCTGGGGCAG | AGG | chr1 | 55041228 | 55041247 | 55041244 | + |
| SEQ ID NO 44378 | ACCACAGCTCCTGGGGCAGA | GGG | chr1 | 55041229 | 55041248 | 55041245 | + |
| SEQ ID NO 44379 | CCACAGCTCCTGGGGCAGAG | GGG | chr1 | 55041230 | 55041249 | 55041246 | + |
| SEQ ID NO 44380 | GGGGAAAATTCTGCCACTCA | CAG | chr1 | 55041249 | 55041268 | 55041265 | + |
| SEQ ID NO 44381 | GCCTGCCCACGCTTCTGTCT | GAG | chr1 | 55041274 | 55041293 | 55041290 | + |
| SEQ ID NO 44382 | ACGCTTCTGTCTGAGTGTGC | TGG | chr1 | 55041282 | 55041301 | 55041298 | + |
| SEQ ID NO 44383 | CGCTTCTGTCTGAGTGTGCT | GGG | chr1 | 55041283 | 55041302 | 55041299 | + |
| SEQ ID NO 44384 | TTCTGTCTGAGTGTGCTGGG | TGG | chr1 | 55041286 | 55041305 | 55041302 | + |
| SEQ ID NO 44385 | TGTCTGAGTGTGCTGGGTGG | CAG | chr1 | 55041289 | 55041308 | 55041305 | + |
| SEQ ID NO 44386 | GTCTGAGTGTGCTGGGTGGC | AGG | chr1 | 55041290 | 55041309 | 55041306 | + |
| SEQ ID NO 44387 | GAGTGTGCTGGGTGGCAGGA | TGG | chr1 | 55041294 | 55041313 | 55041310 | + |
| SEQ ID NO 44388 | GTGCTGGGTGGCAGGATGGC | AAG | chr1 | 55041298 | 55041317 | 55041314 | + |
| SEQ ID NO 44389 | CAGGATGGCAAGTCCTTACT | CAG | chr1 | 55041309 | 55041328 | 55041325 | + |
| SEQ ID NO 44390 | TGGCAAGTCCTTACTCAGCT | CAG | chr1 | 55041314 | 55041333 | 55041330 | + |
| SEQ ID NO 44391 | AGTCCTTACTCAGCTCAGTA | TAG | chr1 | 55041319 | 55041338 | 55041335 | + |
| SEQ ID NO 44392 | AGCCCTCTTCCTTGTTCCCT | GAG | chr1 | 55041340 | 55041359 | 55041356 | + |
| SEQ ID NO 44393 | CCTGAGCCTTTGACTTTCTC | GAG | chr1 | 55041357 | 55041376 | 55041373 | + |
| SEQ ID NO 44394 | CTGAGCCTTTGACTTTCTCG | AGG | chr1 | 55041358 | 55041377 | 55041374 | + |
| SEQ ID NO 44395 | TGAGCCTTTGACTTTCTCGA | GGG | chr1 | 55041359 | 55041378 | 55041375 | + |
| SEQ ID NO 44396 | GACTTTCTCGAGGGATGTTG | TGG | chr1 | 55041368 | 55041387 | 55041384 | + |
| SEQ ID NO 44397 | ACTTTCTCGAGGGATGTTGT | GGG | chr1 | 55041369 | 55041388 | 55041385 | + |
| SEQ ID NO 44398 | CTTTCTCGAGGGATGTTGTG | GGG | chr1 | 55041370 | 55041389 | 55041386 | + |
| SEQ ID NO 44399 | CGAGGGATGTTGTGGGGTTG | TGG | chr1 | 55041376 | 55041395 | 55041392 | + |
| SEQ ID NO 44400 | GGATGTTGTGGGGTTGTGGC | CAG | chr1 | 55041380 | 55041399 | 55041396 | + |
| SEQ ID NO 44401 | GATGTTGTGGGGTTGTGGCC | AGG | chr1 | 55041381 | 55041400 | 55041397 | + |
| SEQ ID NO 44402 | TGTGGGGTTGTGGCCAGGAT | AAG | chr1 | 55041386 | 55041405 | 55041402 | + |
| SEQ ID NO 44403 | GGGTTGTGGCCAGGATAAGA | AAG | chr1 | 55041390 | 55041409 | 55041406 | + |
| SEQ ID NO 44404 | GGTTGTGGCCAGGATAAGAA | AGG | chr1 | 55041391 | 55041410 | 55041407 | + |
| SEQ ID NO 44405 | GTTGTGGCCAGGATAAGAAA | GGG | chr1 | 55041392 | 55041411 | 55041408 | + |
| SEQ ID NO 44406 | AGGATAAGAAAGGGCATTTC | AAG | chr1 | 55041401 | 55041420 | 55041417 | + |
| SEQ ID NO 44407 | CTGCTCCAAAACAACTGTTC | TGG | chr1 | 55041430 | 55041449 | 55041446 | + |
| SEQ ID NO 44408 | CAAAACAACTGTTCTGGAAA | TAG | chr1 | 55041436 | 55041455 | 55041452 | + |
| SEQ ID NO 44409 | ACAACTGTTCTGGAAATAGT | GAG | chr1 | 55041440 | 55041459 | 55041456 | + |
| SEQ ID NO 44410 | AATAGTGAGTACCCCATCCT | GAG | chr1 | 55041454 | 55041473 | 55041470 | + |
| SEQ ID NO 44411 | TAGTGAGTACCCCATCCTGA | GAG | chr1 | 55041456 | 55041475 | 55041472 | + |
| SEQ ID NO 44412 | AGTGAGTACCCCATCCTGAG | AGG | chr1 | 55041457 | 55041476 | 55041473 | + |

Figure 61 (Cont'd)

| | | | | | | | |
|---|---|---|---|---|---|---|---|
| SEQ ID NO 44413 | AGTACCCCATCCTGAGAGGT | GAG | chr1 | 55041461 | 55041480 | 55041477 | + |
| SEQ ID NO 44414 | CCCCATCCTGAGAGGTGAGT | AAG | chr1 | 55041465 | 55041484 | 55041481 | + |
| SEQ ID NO 44415 | CATCCTGAGAGGTGAGTAAG | CAG | chr1 | 55041468 | 55041487 | 55041484 | + |
| SEQ ID NO 44416 | TCCTGAGAGGTGAGTAAGCA | GAG | chr1 | 55041470 | 55041489 | 55041486 | + |
| SEQ ID NO 44417 | CCTGAGAGGTGAGTAAGCAG | AGG | chr1 | 55041471 | 55041490 | 55041487 | + |
| SEQ ID NO 44418 | GCTGTATGACCACCTGAACC | AAG | chr1 | 55041493 | 55041512 | 55041509 | + |
| SEQ ID NO 44419 | ACCACCTGAACCAAGCCCTT | GAG | chr1 | 55041501 | 55041520 | 55041517 | + |
| SEQ ID NO 44420 | CCACCTGAACCAAGCCCTTG | AGG | chr1 | 55041502 | 55041521 | 55041518 | + |
| SEQ ID NO 44421 | CCTTGAGGATGTTTCTTCTC | TGG | chr1 | 55041517 | 55041536 | 55041533 | + |
| SEQ ID NO 44422 | TGAGGATGTTTCTTCTCTGG | TGG | chr1 | 55041520 | 55041539 | 55041536 | + |
| SEQ ID NO 44423 | GGATGTTTCTTCTCTGGTGG | AAG | chr1 | 55041523 | 55041542 | 55041539 | + |
| SEQ ID NO 44424 | TTTCTTCTCTGGTGGAAGTT | TGG | chr1 | 55041528 | 55041547 | 55041544 | + |
| SEQ ID NO 44425 | TCTCTGGTGGAAGTTTGGAA | CAG | chr1 | 55041533 | 55041552 | 55041549 | + |
| SEQ ID NO 44426 | CTCTGGTGGAAGTTTGGAAC | AGG | chr1 | 55041534 | 55041553 | 55041550 | + |
| SEQ ID NO 44427 | CTGGTGGAAGTTTGGAACAG | GAG | chr1 | 55041536 | 55041555 | 55041552 | + |
| SEQ ID NO 44428 | TTTGGAACAGGAGCCTCCTC | AAG | chr1 | 55041546 | 55041565 | 55041562 | + |
| SEQ ID NO 44429 | TCATTTATTCATTCATTCAA | TGG | chr1 | 55041570 | 55041589 | 55041586 | + |
| SEQ ID NO 44430 | TTCATTCAATGGTTATTTTG | TGG | chr1 | 55041581 | 55041600 | 55041597 | + |
| SEQ ID NO 44431 | TCATTCAATGGTTATTTTGT | GGG | chr1 | 55041582 | 55041601 | 55041598 | + |
| SEQ ID NO 44432 | TATTTTGTGGGAATCGAATT | TAG | chr1 | 55041594 | 55041613 | 55041610 | + |
| SEQ ID NO 44433 | TTTAGAATGAAAATATTTTT | TGG | chr1 | 55041612 | 55041631 | 55041628 | + |
| SEQ ID NO 44434 | GAATGAAAATATTTTTTGGC | AAG | chr1 | 55041616 | 55041635 | 55041632 | + |
| SEQ ID NO 44435 | TGAAAATATTTTTTGGCAAG | CAG | chr1 | 55041619 | 55041638 | 55041635 | + |
| SEQ ID NO 44436 | GGCAAGCAGAAAATAATTTT | TAG | chr1 | 55041633 | 55041652 | 55041649 | + |
| SEQ ID NO 44437 | TTAGACCAATCCTTTTCTTT | TAG | chr1 | 55041652 | 55041671 | 55041668 | + |
| SEQ ID NO 44438 | AATCCTTTTCTTTTAGTCAT | GAG | chr1 | 55041659 | 55041678 | 55041675 | + |
| SEQ ID NO 44439 | TCTTTTAGTCATGAGAAACT | GAG | chr1 | 55041667 | 55041686 | 55041683 | + |
| SEQ ID NO 44440 | CTTTTAGTCATGAGAAACTG | AGG | chr1 | 55041668 | 55041687 | 55041684 | + |
| SEQ ID NO 44441 | AGTCATGAGAAACTGAGGCC | CAG | chr1 | 55041673 | 55041692 | 55041689 | + |
| SEQ ID NO 44442 | TCATGAGAAACTGAGGCCCA | GAG | chr1 | 55041675 | 55041694 | 55041691 | + |
| SEQ ID NO 44443 | ATGAGAAACTGAGGCCCAGA | GAG | chr1 | 55041677 | 55041696 | 55041693 | + |
| SEQ ID NO 44444 | GAGAAACTGAGGCCCAGAGA | GAG | chr1 | 55041679 | 55041698 | 55041695 | + |
| SEQ ID NO 44445 | AGAAACTGAGGCCCAGAGAG | AGG | chr1 | 55041680 | 55041699 | 55041696 | + |
| SEQ ID NO 44446 | AAACTGAGGCCCAGAGAGAG | GAG | chr1 | 55041682 | 55041701 | 55041698 | + |
| SEQ ID NO 44447 | AACTGAGGCCCAGAGAGAGG | AGG | chr1 | 55041683 | 55041702 | 55041699 | + |
| SEQ ID NO 44448 | CCAGAGAGGAGGTCACCC | CAG | chr1 | 55041692 | 55041711 | 55041708 | + |
| SEQ ID NO 44449 | CAGAGAGAGGAGGTCACCCC | AGG | chr1 | 55041693 | 55041712 | 55041709 | + |
| SEQ ID NO 44450 | GGAGGTCACCCCAGGTGCAT | TAG | chr1 | 55041701 | 55041720 | 55041717 | + |
| SEQ ID NO 44451 | CACCCCAGGTGCATTAGAAC | TGG | chr1 | 55041707 | 55041726 | 55041723 | + |
| SEQ ID NO 44452 | ACCCCAGGTGCATTAGAACT | GGG | chr1 | 55041708 | 55041727 | 55041724 | + |
| SEQ ID NO 44453 | GTGCATTAGAACTGGGTTTC | CAG | chr1 | 55041715 | 55041734 | 55041731 | + |
| SEQ ID NO 44454 | AGAACTGACACTCCACTGCA | CAG | chr1 | 55041736 | 55041755 | 55041752 | + |
| SEQ ID NO 44455 | AACTGACACTCCACTGCACA | GAG | chr1 | 55041738 | 55041757 | 55041754 | + |
| SEQ ID NO 44456 | CAATTCATTCAATTTTATT | TAG | chr1 | 55041769 | 55041788 | 55041785 | + |
| SEQ ID NO 44457 | TTCATTCAATTTTATTTAG | CGG | chr1 | 55041772 | 55041791 | 55041788 | + |
| SEQ ID NO 44458 | ATTCAATTTTATTTAGCGG | AAG | chr1 | 55041775 | 55041794 | 55041791 | + |
| SEQ ID NO 44459 | TTCAATTTTATTTAGCGGA | AGG | chr1 | 55041776 | 55041795 | 55041792 | + |

Figure 61 (Cont'd)

| | | | | | | | |
|---|---|---|---|---|---|---|---|
| SEQ ID NO 44460 | TATTTAGCGGAAGGCATTTT | CAG | chr1 | 55041785 | 55041804 | 55041801 | + |
| SEQ ID NO 44461 | TAGCGGAAGGCATTTTCAGA | TGG | chr1 | 55041789 | 55041808 | 55041805 | + |
| SEQ ID NO 44462 | AGCGGAAGGCATTTTCAGAT | GGG | chr1 | 55041790 | 55041809 | 55041806 | + |
| SEQ ID NO 44463 | CATTTTCAGATGGGTCTTTG | AAG | chr1 | 55041799 | 55041818 | 55041815 | + |
| SEQ ID NO 44464 | CAGATGGGTCTTTGAAGCAT | TAG | chr1 | 55041805 | 55041824 | 55041821 | + |
| SEQ ID NO 44465 | ATGGGTCTTTGAAGCATTAG | TAG | chr1 | 55041808 | 55041827 | 55041824 | + |
| SEQ ID NO 44466 | TGGGTCTTTGAAGCATTAGT | AGG | chr1 | 55041809 | 55041828 | 55041825 | + |
| SEQ ID NO 44467 | GGTCTTTGAAGCATTAGTAG | GAG | chr1 | 55041811 | 55041830 | 55041827 | + |
| SEQ ID NO 44468 | TTGAAGCATTAGTAGGAGTT | CAG | chr1 | 55041816 | 55041835 | 55041832 | + |
| SEQ ID NO 44469 | TAGTAGGAGTTCAGCGATGA | TGG | chr1 | 55041825 | 55041844 | 55041841 | + |
| SEQ ID NO 44470 | TTCAGCGATGATGGTGTCAT | GAG | chr1 | 55041834 | 55041853 | 55041850 | + |
| SEQ ID NO 44471 | GTGTCATGAGAATTTTATTC | TAG | chr1 | 55041847 | 55041866 | 55041863 | + |
| SEQ ID NO 44472 | TGTCATGAGAATTTTATTCT | AGG | chr1 | 55041848 | 55041867 | 55041864 | + |
| SEQ ID NO 44473 | TGAGAATTTTATTCTAGGAT | TAG | chr1 | 55041853 | 55041872 | 55041869 | + |
| SEQ ID NO 44474 | GAGAATTTTATTCTAGGATT | AGG | chr1 | 55041854 | 55041873 | 55041870 | + |
| SEQ ID NO 44475 | GAATTTTATTCTAGGATTAG | GAG | chr1 | 55041856 | 55041875 | 55041872 | + |
| SEQ ID NO 44476 | AATTTTATTCTAGGATTAGG | AGG | chr1 | 55041857 | 55041876 | 55041873 | + |
| SEQ ID NO 44477 | ATTAGGAGGTACCATGAACA | AAG | chr1 | 55041871 | 55041890 | 55041887 | + |
| SEQ ID NO 44478 | AGGTACCATGAACAAAGATA | CAG | chr1 | 55041877 | 55041896 | 55041893 | + |
| SEQ ID NO 44479 | GTACCATGAACAAAGATACA | GAG | chr1 | 55041879 | 55041898 | 55041895 | + |
| SEQ ID NO 44480 | CATGAACAAAGATACAGAGC | TGG | chr1 | 55041883 | 55041902 | 55041899 | + |
| SEQ ID NO 44481 | ATGAACAAAGATACAGAGCT | GGG | chr1 | 55041884 | 55041903 | 55041900 | + |
| SEQ ID NO 44482 | AGATACAGAGCTGGGAAAAC | CAG | chr1 | 55041892 | 55041911 | 55041908 | + |
| SEQ ID NO 44483 | ATACAGAGCTGGGAAAACCA | GAG | chr1 | 55041894 | 55041913 | 55041910 | + |
| SEQ ID NO 44484 | TACAGAGCTGGGAAAACCAG | AGG | chr1 | 55041895 | 55041914 | 55041911 | + |
| SEQ ID NO 44485 | AGAGCTGGGAAAACCAGAGG | TGG | chr1 | 55041898 | 55041917 | 55041914 | + |
| SEQ ID NO 44486 | GCTGGGAAAACCAGAGGTGG | AAG | chr1 | 55041901 | 55041920 | 55041917 | + |
| SEQ ID NO 44487 | GAAAACCAGAGGTGGAAGAT | AAG | chr1 | 55041906 | 55041925 | 55041922 | + |
| SEQ ID NO 44488 | AAAACCAGAGGTGGAAGATA | AGG | chr1 | 55041907 | 55041926 | 55041923 | + |
| SEQ ID NO 44489 | AACCAGAGGTGGAAGATAAG | GAG | chr1 | 55041909 | 55041928 | 55041925 | + |
| SEQ ID NO 44490 | AGATAAGGAGCACATGTCCA | CAG | chr1 | 55041922 | 55041941 | 55041938 | + |
| SEQ ID NO 44491 | GTTCTTTTTCTTTTTTTTTT | GAG | chr1 | 55041944 | 55041963 | 55041960 | + |
| SEQ ID NO 44492 | TTTTTCTTTTTTTTTTGAGA | TGG | chr1 | 55041948 | 55041967 | 55041964 | + |
| SEQ ID NO 44493 | TTTCTTTTTTTTTTGAGATG | GAG | chr1 | 55041950 | 55041969 | 55041966 | + |
| SEQ ID NO 44494 | GGAGTTTCGCTCTTGTTGCC | CAG | chr1 | 55041969 | 55041988 | 55041985 | + |
| SEQ ID NO 44495 | GAGTTTCGCTCTTGTTGCCC | AGG | chr1 | 55041970 | 55041989 | 55041986 | + |
| SEQ ID NO 44496 | TTCGCTCTTGTTGCCCAGGC | TGG | chr1 | 55041974 | 55041993 | 55041990 | + |
| SEQ ID NO 44497 | CGCTCTTGTTGCCCAGGCTG | GAG | chr1 | 55041976 | 55041995 | 55041992 | + |
| SEQ ID NO 44498 | TTGCCCAGGCTGGAGTGCAA | TGG | chr1 | 55041984 | 55042003 | 55042000 | + |
| SEQ ID NO 44499 | CAGGCTGGAGTGCAATGGTG | CAG | chr1 | 55041989 | 55042008 | 55042005 | + |
| SEQ ID NO 44500 | GGAGTGCAATGGTGCAGTCT | CAG | chr1 | 55041995 | 55042014 | 55042011 | + |
| SEQ ID NO 44501 | TCACTGCAACATCTGTCTCC | CGG | chr1 | 55042019 | 55042038 | 55042035 | + |
| SEQ ID NO 44502 | CACTGCAACATCTGTCTCCC | GGG | chr1 | 55042020 | 55042039 | 55042036 | + |
| SEQ ID NO 44503 | AACATCTGTCTCCCGGGTTC | AAG | chr1 | 55042026 | 55042045 | 55042042 | + |
| SEQ ID NO 44504 | ATCTGTCTCCCGGGTTCAAG | TGG | chr1 | 55042029 | 55042048 | 55042045 | + |
| SEQ ID NO 44505 | TTCAAGTGGTTCTCCTGCCT | CAG | chr1 | 55042043 | 55042062 | 55042059 | + |
| SEQ ID NO 44506 | TTCTCCTGCCTCAGCCTCCC | AAG | chr1 | 55042052 | 55042071 | 55042068 | + |

Figure 61 (Cont'd)

| SEQ ID NO 44507 | TCCTGCCTCAGCCTCCCAAG | AAG | chr1 | 55042055 | 55042074 | 55042071 | + |
| SEQ ID NO 44508 | GCCTCAGCCTCCCAAGAAGC | TGG | chr1 | 55042059 | 55042078 | 55042075 | + |
| SEQ ID NO 44509 | CCTCAGCCTCCCAAGAAGCT | GGG | chr1 | 55042060 | 55042079 | 55042076 | + |
| SEQ ID NO 44510 | CTCCCAAGAAGCTGGGATTA | CAG | chr1 | 55042067 | 55042086 | 55042083 | + |
| SEQ ID NO 44511 | TCCCAAGAAGCTGGGATTAC | AGG | chr1 | 55042068 | 55042087 | 55042084 | + |
| SEQ ID NO 44512 | CAGGTACCTGCCACCACGCC | CGG | chr1 | 55042087 | 55042106 | 55042103 | + |
| SEQ ID NO 44513 | CCGGCTAATTTTTGTATTTT | TAG | chr1 | 55042106 | 55042125 | 55042122 | + |
| SEQ ID NO 44514 | GCTAATTTTTGTATTTTTAG | TAG | chr1 | 55042109 | 55042128 | 55042125 | + |
| SEQ ID NO 44515 | TAATTTTTGTATTTTTAGTA | GAG | chr1 | 55042111 | 55042130 | 55042127 | + |
| SEQ ID NO 44516 | TTTTTGTATTTTTAGTAGAG | AAG | chr1 | 55042114 | 55042133 | 55042130 | + |
| SEQ ID NO 44517 | TTTTGTATTTTTAGTAGAGA | AGG | chr1 | 55042115 | 55042134 | 55042131 | + |
| SEQ ID NO 44518 | TTTGTATTTTTAGTAGAGAA | GGG | chr1 | 55042116 | 55042135 | 55042132 | + |
| SEQ ID NO 44519 | TTGTATTTTTAGTAGAGAAG | GGG | chr1 | 55042117 | 55042136 | 55042133 | + |
| SEQ ID NO 44520 | GAGAAGGGGTTTCACCACGT | TGG | chr1 | 55042131 | 55042150 | 55042147 | + |
| SEQ ID NO 44521 | AGGGGTTTCACCACGTTGGC | CAG | chr1 | 55042135 | 55042154 | 55042151 | + |
| SEQ ID NO 44522 | GGGGTTTCACCACGTTGGCC | AGG | chr1 | 55042136 | 55042155 | 55042152 | + |
| SEQ ID NO 44523 | TTTCACCACGTTGGCCAGGC | TAG | chr1 | 55042140 | 55042159 | 55042156 | + |
| SEQ ID NO 44524 | TCGCAAACTCCTGACCTCCT | CAG | chr1 | 55042163 | 55042182 | 55042179 | + |
| SEQ ID NO 44525 | CAAACTCCTGACCTCCTCAG | TGG | chr1 | 55042166 | 55042185 | 55042182 | + |
| SEQ ID NO 44526 | CTGACCTCCTCAGTGGATCC | GAG | chr1 | 55042173 | 55042192 | 55042189 | + |
| SEQ ID NO 44527 | TGACCTCCTCAGTGGATCCG | AGG | chr1 | 55042174 | 55042193 | 55042190 | + |
| SEQ ID NO 44528 | ACCTCCTCAGTGGATCCGAG | GAG | chr1 | 55042176 | 55042195 | 55042192 | + |
| SEQ ID NO 44529 | CCTCCTCAGTGGATCCGAGG | AGG | chr1 | 55042177 | 55042196 | 55042193 | + |
| SEQ ID NO 44530 | AGGAGGTGATCCTCCCGCCT | CAG | chr1 | 55042194 | 55042213 | 55042210 | + |
| SEQ ID NO 44531 | CCTCCCGCCTCAGCCTCCCA | AAG | chr1 | 55042204 | 55042223 | 55042220 | + |
| SEQ ID NO 44532 | CTCCCAAAGTGCTCGAATTA | CAG | chr1 | 55042218 | 55042237 | 55042234 | + |
| SEQ ID NO 44533 | TCCCAAAGTGCTCGAATTAC | AGG | chr1 | 55042219 | 55042238 | 55042235 | + |
| SEQ ID NO 44534 | AGTGCTCGAATTACAGGTGT | GAG | chr1 | 55042225 | 55042244 | 55042241 | + |
| SEQ ID NO 44535 | CAGGTGTGAGCCACCACGCC | TGG | chr1 | 55042238 | 55042257 | 55042254 | + |
| SEQ ID NO 44536 | GCCACCACGCCTGGCCTCCA | CAG | chr1 | 55042247 | 55042266 | 55042263 | + |
| SEQ ID NO 44537 | TAAAATGTTACGAAAACCAA | AAG | chr1 | 55042293 | 55042312 | 55042309 | + |
| SEQ ID NO 44538 | TTTTTTTGTGATTTATTTGA | TGG | chr1 | 55042317 | 55042336 | 55042333 | + |
| SEQ ID NO 44539 | TTTTGTGATTTATTTGATGG | TAG | chr1 | 55042320 | 55042339 | 55042336 | + |
| SEQ ID NO 44540 | CACCTGACGTGAACTGACAT | GAG | chr1 | 55042343 | 55042362 | 55042359 | + |
| SEQ ID NO 44541 | ACATGAGATTATTTTTAATT | TAG | chr1 | 55042359 | 55042378 | 55042375 | + |
| SEQ ID NO 44542 | TATTCATATATTTGCTGCA | TAG | chr1 | 55042397 | 55042416 | 55042413 | + |
| SEQ ID NO 44543 | ATATTTGCTGCATAGATTA | CAG | chr1 | 55042404 | 55042423 | 55042420 | + |
| SEQ ID NO 44544 | GCTGCATAGATTACAGTATG | CAG | chr1 | 55042411 | 55042430 | 55042427 | + |
| SEQ ID NO 44545 | TAGATTACAGTATGCAGCTC | CAG | chr1 | 55042417 | 55042436 | 55042433 | + |
| SEQ ID NO 44546 | ATGCAGCTCCAGATTCTTCC | AAG | chr1 | 55042428 | 55042447 | 55042444 | + |
| SEQ ID NO 44547 | CAGCTCCAGATTCTTCCAAG | CAG | chr1 | 55042431 | 55042450 | 55042447 | + |
| SEQ ID NO 44548 | TGCCTTTCTAAAATCCAAAC | AAG | chr1 | 55042472 | 55042491 | 55042488 | + |
| SEQ ID NO 44549 | CTAAAATCCAAACAAGTTCT | GAG | chr1 | 55042479 | 55042498 | 55042495 | + |
| SEQ ID NO 44550 | TAAAATCCAAACAAGTTCTG | AGG | chr1 | 55042480 | 55042499 | 55042496 | + |
| SEQ ID NO 44551 | TCTGAGGTTCAAAACCGTTT | TGG | chr1 | 55042496 | 55042515 | 55042512 | + |
| SEQ ID NO 44552 | TTCAAAACCGTTTTGGCCCT | AAG | chr1 | 55042503 | 55042522 | 55042519 | + |
| SEQ ID NO 44553 | TCAAAACCGTTTTGGCCCTA | AGG | chr1 | 55042504 | 55042523 | 55042520 | + |

Figure 61 (Cont'd)

| | | | | | | | |
|---|---|---|---|---|---|---|---|
| SEQ ID NO 44554 | CCGTTTTGGCCCTAAGGCTT | TGG | chr1 | 55042510 | 55042529 | 55042526 | + |
| SEQ ID NO 44555 | CGTTTTGGCCCTAAGGCTTT | GGG | chr1 | 55042511 | 55042530 | 55042527 | + |
| SEQ ID NO 44556 | TGGCCCTAAGGCTTTGGGTA | AAG | chr1 | 55042516 | 55042535 | 55042532 | + |
| SEQ ID NO 44557 | GGCCCTAAGGCTTTGGGTAA | AGG | chr1 | 55042517 | 55042536 | 55042533 | + |
| SEQ ID NO 44558 | GCCCTAAGGCTTTGGGTAAA | GGG | chr1 | 55042518 | 55042537 | 55042534 | + |
| SEQ ID NO 44559 | CCCTAAGGCTTTGGGTAAAG | GGG | chr1 | 55042519 | 55042538 | 55042535 | + |
| SEQ ID NO 44560 | CCTAAGGCTTTGGGTAAAGG | GGG | chr1 | 55042520 | 55042539 | 55042536 | + |
| SEQ ID NO 44561 | AAGGCTTTGGGTAAAGGGGG | TGG | chr1 | 55042523 | 55042542 | 55042539 | + |
| SEQ ID NO 44562 | GGACTCTGTTCTACTCTGAC | TGG | chr1 | 55042544 | 55042563 | 55042560 | + |
| SEQ ID NO 44563 | ACTCTGTTCTACTCTGACTG | GAG | chr1 | 55042546 | 55042565 | 55042562 | + |
| SEQ ID NO 44564 | TTCTACTCTGACTGGAGTCC | AAG | chr1 | 55042552 | 55042571 | 55042568 | + |
| SEQ ID NO 44565 | GAGTCCAAGATGCATATATA | CAG | chr1 | 55042566 | 55042585 | 55042582 | + |
| SEQ ID NO 44566 | GTCCAAGATGCATATATACA | GAG | chr1 | 55042568 | 55042587 | 55042584 | + |
| SEQ ID NO 44567 | GATGCATATATACAGAGATA | TGG | chr1 | 55042574 | 55042593 | 55042590 | + |
| SEQ ID NO 44568 | ATGCATATATACAGAGATAT | GGG | chr1 | 55042575 | 55042594 | 55042591 | + |
| SEQ ID NO 44569 | ATATACAGAGATATGGGTGA | TGG | chr1 | 55042581 | 55042600 | 55042597 | + |
| SEQ ID NO 44570 | TATACAGAGATATGGGTGAT | GGG | chr1 | 55042582 | 55042601 | 55042598 | + |
| SEQ ID NO 44571 | ATACAGAGATATGGGTGATG | GGG | chr1 | 55042583 | 55042602 | 55042599 | + |
| SEQ ID NO 44572 | GATATGGGTGATGGGCTGC | AAG | chr1 | 55042590 | 55042609 | 55042606 | + |
| SEQ ID NO 44573 | ATATGGGTGATGGGCTGCA | AGG | chr1 | 55042591 | 55042610 | 55042607 | + |
| SEQ ID NO 44574 | TGGGTGATGGGGCTGCAAGG | TAG | chr1 | 55042594 | 55042613 | 55042610 | + |
| SEQ ID NO 44575 | GGGTGATGGGGCTGCAAGGT | AGG | chr1 | 55042595 | 55042614 | 55042611 | + |
| SEQ ID NO 44576 | ATGGGGCTGCAAGGTAGGTT | GAG | chr1 | 55042600 | 55042619 | 55042616 | + |
| SEQ ID NO 44577 | TGGGGCTGCAAGGTAGGTTG | AGG | chr1 | 55042601 | 55042620 | 55042617 | + |
| SEQ ID NO 44578 | GGCTGCAAGGTAGGTTGAGG | TAG | chr1 | 55042604 | 55042623 | 55042620 | + |
| SEQ ID NO 44579 | GCTGCAAGGTAGGTTGAGGT | AGG | chr1 | 55042605 | 55042624 | 55042621 | + |
| SEQ ID NO 44580 | CTGCAAGGTAGGTTGAGGTA | GGG | chr1 | 55042606 | 55042625 | 55042622 | + |
| SEQ ID NO 44581 | TGCAAGGTAGGTTGAGGTAG | GGG | chr1 | 55042607 | 55042626 | 55042623 | + |
| SEQ ID NO 44582 | GGTAGGTTGAGGTAGGGGCC | AAG | chr1 | 55042612 | 55042631 | 55042628 | + |
| SEQ ID NO 44583 | GTAGGTTGAGGTAGGGGCCA | AGG | chr1 | 55042613 | 55042632 | 55042629 | + |
| SEQ ID NO 44584 | AGGTTGAGGTAGGGGCCAAG | GAG | chr1 | 55042615 | 55042634 | 55042631 | + |
| SEQ ID NO 44585 | GGTTGAGGTAGGGGCCAAGG | AGG | chr1 | 55042616 | 55042635 | 55042632 | + |
| SEQ ID NO 44586 | TTGAGGTAGGGGCCAAGGAG | GAG | chr1 | 55042618 | 55042637 | 55042634 | + |
| SEQ ID NO 44587 | GTAGGGGCCAAGGAGGAGCA | TGG | chr1 | 55042623 | 55042642 | 55042639 | + |
| SEQ ID NO 44588 | AGGGGCCAAGGAGGAGCATG | GAG | chr1 | 55042625 | 55042644 | 55042641 | + |
| SEQ ID NO 44589 | CCAAGGAGGAGCATGGAGTT | TGG | chr1 | 55042630 | 55042649 | 55042646 | + |
| SEQ ID NO 44590 | GGAGTTTGGACTTGATTCAT | GAG | chr1 | 55042644 | 55042663 | 55042660 | + |
| SEQ ID NO 44591 | GAGTTTGGACTTGATTCATG | AGG | chr1 | 55042645 | 55042664 | 55042661 | + |
| SEQ ID NO 44592 | GGACTTGATTCATGAGGCTG | TGG | chr1 | 55042651 | 55042670 | 55042667 | + |
| SEQ ID NO 44593 | GACTTGATTCATGAGGCTGT | GGG | chr1 | 55042652 | 55042671 | 55042668 | + |
| SEQ ID NO 44594 | ACTTGATTCATGAGGCTGTG | GGG | chr1 | 55042653 | 55042672 | 55042669 | + |
| SEQ ID NO 44595 | TTGATTCATGAGGCTGTGGG | GAG | chr1 | 55042655 | 55042674 | 55042671 | + |
| SEQ ID NO 44596 | TTCATGAGGCTGTGGGGAGC | CAG | chr1 | 55042659 | 55042678 | 55042675 | + |
| SEQ ID NO 44597 | GAGGCTGTGGGGAGCCAGTG | AAG | chr1 | 55042664 | 55042683 | 55042680 | + |
| SEQ ID NO 44598 | AGGCTGTGGGGAGCCAGTGA | AGG | chr1 | 55042665 | 55042684 | 55042681 | + |
| SEQ ID NO 44599 | GGGAGCCAGTGAAGGTTCTT | AAG | chr1 | 55042673 | 55042692 | 55042689 | + |
| SEQ ID NO 44600 | AGCCAGTGAAGGTTCTTAAG | CAG | chr1 | 55042676 | 55042695 | 55042692 | + |

Figure 61 (Cont'd)

| SEQ ID NO 44601 | GCCAGTGAAGGTTCTTAAGC | AGG | chr1 | 55042677 | 55042696 | 55042693 | + |
| SEQ ID NO 44602 | TTAAGCAGGTATGTCTGCCT | GAG | chr1 | 55042691 | 55042710 | 55042707 | + |
| SEQ ID NO 44603 | AAGCAGGTATGTCTGCCTGA | GAG | chr1 | 55042693 | 55042712 | 55042709 | + |
| SEQ ID NO 44604 | CAGGTATGTCTGCCTGAGAG | CAG | chr1 | 55042696 | 55042715 | 55042712 | + |
| SEQ ID NO 44605 | TATGTCTGCCTGAGAGCAGT | TGG | chr1 | 55042700 | 55042719 | 55042716 | + |
| SEQ ID NO 44606 | TGTCTGCCTGAGAGCAGTTG | GAG | chr1 | 55042702 | 55042721 | 55042718 | + |
| SEQ ID NO 44607 | CTGCCTGAGAGCAGTTGGAG | CAG | chr1 | 55042705 | 55042724 | 55042721 | + |
| SEQ ID NO 44608 | TGAGAGCAGTTGGAGCAGAC | AAG | chr1 | 55042710 | 55042729 | 55042726 | + |
| SEQ ID NO 44609 | AGAGCAGTTGGAGCAGACAA | GAG | chr1 | 55042712 | 55042731 | 55042728 | + |
| SEQ ID NO 44610 | AAAAACCAAACAAATCACCA | TAG | chr1 | 55042737 | 55042756 | 55042753 | + |
| SEQ ID NO 44611 | ACCAAACAAATCACCATAGA | TAG | chr1 | 55042741 | 55042760 | 55042757 | + |
| SEQ ID NO 44612 | AAACAAATCACCATAGATAG | TGG | chr1 | 55042744 | 55042763 | 55042760 | + |
| SEQ ID NO 44613 | TGTCCCCTCCAAATCTCATG | TGG | chr1 | 55042782 | 55042801 | 55042798 | + |
| SEQ ID NO 44614 | CCAAATCTCATGTGGAAATT | TGG | chr1 | 55042790 | 55042809 | 55042806 | + |
| SEQ ID NO 44615 | TCATGTGGAAATTTGGTCCT | CAG | chr1 | 55042797 | 55042816 | 55042813 | + |
| SEQ ID NO 44616 | GGAAATTTGGTCCTCAGTGT | TGG | chr1 | 55042803 | 55042822 | 55042819 | + |
| SEQ ID NO 44617 | AATTTGGTCCTCAGTGTTGG | AAG | chr1 | 55042806 | 55042825 | 55042822 | + |
| SEQ ID NO 44618 | TTGGTCCTCAGTGTTGGAAG | TGG | chr1 | 55042809 | 55042828 | 55042825 | + |
| SEQ ID NO 44619 | TGGTCCTCAGTGTTGGAAGT | GGG | chr1 | 55042810 | 55042829 | 55042826 | + |
| SEQ ID NO 44620 | GGTCCTCAGTGTTGGAAGTG | GGG | chr1 | 55042811 | 55042830 | 55042827 | + |
| SEQ ID NO 44621 | GTGTTGGAAGTGGGGCCTAA | TGG | chr1 | 55042819 | 55042838 | 55042835 | + |
| SEQ ID NO 44622 | TGTTGGAAGTGGGGCCTAAT | GGG | chr1 | 55042820 | 55042839 | 55042836 | + |
| SEQ ID NO 44623 | TTGGAAGTGGGGCCTAATGG | GAG | chr1 | 55042822 | 55042841 | 55042838 | + |
| SEQ ID NO 44624 | TGGAAGTGGGGCCTAATGGG | AGG | chr1 | 55042823 | 55042842 | 55042839 | + |
| SEQ ID NO 44625 | GGGGCCTAATGGGAGGTGTT | TGG | chr1 | 55042830 | 55042849 | 55042846 | + |
| SEQ ID NO 44626 | GGGCCTAATGGGAGGTGTTT | GGG | chr1 | 55042831 | 55042850 | 55042847 | + |
| SEQ ID NO 44627 | AATGGGAGGTGTTTGGGTCA | TGG | chr1 | 55042837 | 55042856 | 55042853 | + |
| SEQ ID NO 44628 | ATGGGAGGTGTTTGGGTCAT | GGG | chr1 | 55042838 | 55042857 | 55042854 | + |
| SEQ ID NO 44629 | TGGGAGGTGTTTGGGTCATG | GGG | chr1 | 55042839 | 55042858 | 55042855 | + |
| SEQ ID NO 44630 | GGGAGGTGTTTGGGTCATGG | GGG | chr1 | 55042840 | 55042859 | 55042856 | + |
| SEQ ID NO 44631 | GAGGTGTTTGGGTCATGGGG | GAG | chr1 | 55042842 | 55042861 | 55042858 | + |
| SEQ ID NO 44632 | AGGTGTTTGGGTCATGGGGG | AGG | chr1 | 55042843 | 55042862 | 55042859 | + |
| SEQ ID NO 44633 | TGGGGGAGGAACCCCTGTGA | AAG | chr1 | 55042857 | 55042876 | 55042873 | + |
| SEQ ID NO 44634 | GGGGGAGGAACCCCTGTGAA | AGG | chr1 | 55042858 | 55042877 | 55042874 | + |
| SEQ ID NO 44635 | AGGAACCCCTGTGAAGGCT | TGG | chr1 | 55042863 | 55042882 | 55042879 | + |
| SEQ ID NO 44636 | GGTGCCGTCCTTGTGATAAT | GAG | chr1 | 55042884 | 55042903 | 55042900 | + |
| SEQ ID NO 44637 | CCGTCCTTGTGATAATGAGT | AAG | chr1 | 55042888 | 55042907 | 55042904 | + |
| SEQ ID NO 44638 | TCCCGCTATGATTTCCCTTG | AAG | chr1 | 55042914 | 55042933 | 55042930 | + |
| SEQ ID NO 44639 | CCCGCTATGATTTCCCTTGA | AGG | chr1 | 55042915 | 55042934 | 55042931 | + |
| SEQ ID NO 44640 | CTTGAAGGCTGATTATTAAA | AAG | chr1 | 55042930 | 55042949 | 55042946 | + |
| SEQ ID NO 44641 | TGAAGGCTGATTATTAAAAA | GAG | chr1 | 55042932 | 55042951 | 55042948 | + |
| SEQ ID NO 44642 | GCTGATTATTAAAAGAGCT | TGG | chr1 | 55042937 | 55042956 | 55042953 | + |
| SEQ ID NO 44643 | GTGATTGATCTCTGCACATG | TAG | chr1 | 55042998 | 55043017 | 55043014 | + |
| SEQ ID NO 44644 | TGATTGATCTCTGCACATGT | AGG | chr1 | 55042999 | 55043018 | 55043015 | + |
| SEQ ID NO 44645 | TCCCCTTCACCTTCTGCCAT | CAG | chr1 | 55043023 | 55043042 | 55043039 | + |
| SEQ ID NO 44646 | TCACCTTCTGCCATCAGTGA | AAG | chr1 | 55043029 | 55043048 | 55043045 | + |
| SEQ ID NO 44647 | CCTTCTGCCATCAGTGAAAG | CAG | chr1 | 55043032 | 55043051 | 55043048 | + |

Figure 61 (Cont'd)

| | | | | | | | |
|---|---|---|---|---|---|---|---|
| SEQ ID NO 44648 | GCCATCAGTGAAAGCAGCTT | AAG | chr1 | 55043038 | 55043057 | 55043054 | + |
| SEQ ID NO 44649 | CCATCAGTGAAAGCAGCTTA | AGG | chr1 | 55043039 | 55043058 | 55043055 | + |
| SEQ ID NO 44650 | AAGCAGCTTAAGGCCCTCAC | CAG | chr1 | 55043049 | 55043068 | 55043065 | + |
| SEQ ID NO 44651 | CAGCTTAAGGCCCTCACCAG | AAG | chr1 | 55043052 | 55043071 | 55043068 | + |
| SEQ ID NO 44652 | CTTAAGGCCCTCACCAGAAG | CAG | chr1 | 55043055 | 55043074 | 55043071 | + |
| SEQ ID NO 44653 | CCCTCACCAGAAGCAGATGC | TGG | chr1 | 55043062 | 55043081 | 55043078 | + |
| SEQ ID NO 44654 | GATGCTGGTGCCATGCTTCC | TGG | chr1 | 55043077 | 55043096 | 55043093 | + |
| SEQ ID NO 44655 | TGCTGGTGCCATGCTTCCTG | GAG | chr1 | 55043079 | 55043098 | 55043095 | + |
| SEQ ID NO 44656 | CTGGTGCCATGCTTCCTGGA | GAG | chr1 | 55043081 | 55043100 | 55043097 | + |
| SEQ ID NO 44657 | CATGCTTCCTGGAGAGCTTG | CAG | chr1 | 55043088 | 55043107 | 55043104 | + |
| SEQ ID NO 44658 | TGGAGAGCTTGCAGAATCAT | GAG | chr1 | 55043097 | 55043116 | 55043113 | + |
| SEQ ID NO 44659 | CCTTGTAAATTACTCACCTT | CAG | chr1 | 55043137 | 55043156 | 55043153 | + |
| SEQ ID NO 44660 | CTTGTAAATTACTCACCTTC | AGG | chr1 | 55043138 | 55043157 | 55043154 | + |
| SEQ ID NO 44661 | CCTCAGGTATTCCTTTATA | TAG | chr1 | 55043153 | 55043172 | 55043169 | + |
| SEQ ID NO 44662 | TCCTTTATATAGCAACACAA | AAG | chr1 | 55043164 | 55043183 | 55043180 | + |
| SEQ ID NO 44663 | CCTTTATATAGCAACACAAA | AGG | chr1 | 55043165 | 55043184 | 55043181 | + |
| SEQ ID NO 44664 | TATAGCAACACAAAAGGACT | AAG | chr1 | 55043171 | 55043190 | 55043187 | + |
| SEQ ID NO 44665 | GCAACACAAAAGGACTAAGA | CAG | chr1 | 55043175 | 55043194 | 55043191 | + |
| SEQ ID NO 44666 | ACACAAAAGGACTAAGACAG | TGG | chr1 | 55043178 | 55043197 | 55043194 | + |
| SEQ ID NO 44667 | CTTGACTTTCTCTCTCTTT | AAG | chr1 | 55043202 | 55043221 | 55043218 | + |
| SEQ ID NO 44668 | GACTTTCTCTCTCTTTAAG | AAG | chr1 | 55043205 | 55043224 | 55043221 | + |
| SEQ ID NO 44669 | AAGTGTTGCCTTTGCTCACT | TAG | chr1 | 55043225 | 55043244 | 55043241 | + |
| SEQ ID NO 44670 | ATCCCTTCTGCCTGCATTTG | TAG | chr1 | 55043250 | 55043269 | 55043266 | + |
| SEQ ID NO 44671 | CCCTTCTGCCTGCATTTGTA | GAG | chr1 | 55043252 | 55043271 | 55043268 | + |
| SEQ ID NO 44672 | GCCTGCATTTGTAGAGCATC | TGG | chr1 | 55043259 | 55043278 | 55043275 | + |
| SEQ ID NO 44673 | GCATTTGTAGAGCATCTGGA | TGG | chr1 | 55043263 | 55043282 | 55043279 | + |
| SEQ ID NO 44674 | CATTTGTAGAGCATCTGGAT | GGG | chr1 | 55043264 | 55043283 | 55043280 | + |
| SEQ ID NO 44675 | TTTGTAGAGCATCTGGATGG | GAG | chr1 | 55043266 | 55043285 | 55043282 | + |
| SEQ ID NO 44676 | ACCGTCACTCTTGACTTTCC | CAG | chr1 | 55043298 | 55043317 | 55043314 | + |
| SEQ ID NO 44677 | GTCACTCTTGACTTTCCCAG | CAG | chr1 | 55043301 | 55043320 | 55043317 | + |
| SEQ ID NO 44678 | TCACTCTTGACTTTCCCAGC | AGG | chr1 | 55043302 | 55043321 | 55043318 | + |
| SEQ ID NO 44679 | TTCCCAGCAGGCCTATGTCA | TAG | chr1 | 55043314 | 55043333 | 55043330 | + |
| SEQ ID NO 44680 | TCCCAGCAGGCCTATGTCAT | AGG | chr1 | 55043315 | 55043334 | 55043331 | + |
| SEQ ID NO 44681 | GGCCTATGTCATAGGTACTG | TGG | chr1 | 55043323 | 55043342 | 55043339 | + |
| SEQ ID NO 44682 | GTACTGTGGTCTCTACAATA | CAG | chr1 | 55043337 | 55043356 | 55043353 | + |
| SEQ ID NO 44683 | CTGTGGTCTCTACAATACAG | CAG | chr1 | 55043340 | 55043359 | 55043356 | + |
| SEQ ID NO 44684 | GTGGTCTCTACAATACAGCA | GAG | chr1 | 55043342 | 55043361 | 55043358 | + |
| SEQ ID NO 44685 | TGGTCTCTACAATACAGCAG | AGG | chr1 | 55043343 | 55043362 | 55043359 | + |
| SEQ ID NO 44686 | ACAATACAGCAGAGGTATCT | GAG | chr1 | 55043351 | 55043370 | 55043367 | + |
| SEQ ID NO 44687 | CAATACAGCAGAGGTATCTG | AGG | chr1 | 55043352 | 55043371 | 55043368 | + |
| SEQ ID NO 44688 | GCAGAGGTATCTGAGGCTCC | GAG | chr1 | 55043359 | 55043378 | 55043375 | + |
| SEQ ID NO 44689 | AGAGGTATCTGAGGCTCCGA | GAG | chr1 | 55043361 | 55043380 | 55043377 | + |
| SEQ ID NO 44690 | GAGGTATCTGAGGCTCCGAG | AGG | chr1 | 55043362 | 55043381 | 55043378 | + |
| SEQ ID NO 44691 | ATCTGAGGCTCCGAGAGGTT | GAG | chr1 | 55043367 | 55043386 | 55043383 | + |
| SEQ ID NO 44692 | GAGGTTGAGTGACTTGCTCA | TGG | chr1 | 55043381 | 55043400 | 55043397 | + |
| SEQ ID NO 44693 | CTTGCTCATGGCTGCACAAC | CAG | chr1 | 55043393 | 55043412 | 55043409 | + |
| SEQ ID NO 44694 | GCTGCACAACCAGTAAATAT | TGG | chr1 | 55043403 | 55043422 | 55043419 | + |

Figure 61 (Cont'd)

| | | | | | | | |
|---|---|---|---|---|---|---|---|
| SEQ ID NO 44695 | TGCACAACCAGTAAATATTG | GAG | chr1 | 55043405 | 55043424 | 55043421 | + |
| SEQ ID NO 44696 | CAACCAGTAAATATTGGAGC | TGG | chr1 | 55043409 | 55043428 | 55043425 | + |
| SEQ ID NO 44697 | TAAATATTGGAGCTGGAATT | CAG | chr1 | 55043416 | 55043435 | 55043432 | + |
| SEQ ID NO 44698 | AAATATTGGAGCTGGAATTC | AGG | chr1 | 55043417 | 55043436 | 55043433 | + |
| SEQ ID NO 44699 | GGAGCTGGAATTCAGGTCCA | CGG | chr1 | 55043424 | 55043443 | 55043440 | + |
| SEQ ID NO 44700 | AATTCAGGTCCACGGTTTCC | TGG | chr1 | 55043432 | 55043451 | 55043448 | + |
| SEQ ID NO 44701 | TCCACGGTTTCCTGGCTCCA | AAG | chr1 | 55043440 | 55043459 | 55043456 | + |
| SEQ ID NO 44702 | TTCCCTCAATTTATTCTGAC | TGG | chr1 | 55043474 | 55043493 | 55043490 | + |
| SEQ ID NO 44703 | TCCCTCAATTTATTCTGACT | GGG | chr1 | 55043475 | 55043494 | 55043491 | + |
| SEQ ID NO 44704 | CCCTCAATTTATTCTGACTG | GGG | chr1 | 55043476 | 55043495 | 55043492 | + |
| SEQ ID NO 44705 | AATTTATTCTGACTGGGGCA | TGG | chr1 | 55043481 | 55043500 | 55043497 | + |
| SEQ ID NO 44706 | ATTTATTCTGACTGGGGCAT | GGG | chr1 | 55043482 | 55043501 | 55043498 | + |
| SEQ ID NO 44707 | TTTATTCTGACTGGGGCATG | GGG | chr1 | 55043483 | 55043502 | 55043499 | + |
| SEQ ID NO 44708 | TTATTCTGACTGGGGCATGG | GGG | chr1 | 55043484 | 55043503 | 55043500 | + |
| SEQ ID NO 44709 | ATTCTGACTGGGGCATGGGG | GAG | chr1 | 55043486 | 55043505 | 55043502 | + |
| SEQ ID NO 44710 | TTCTGACTGGGGCATGGGGG | AGG | chr1 | 55043487 | 55043506 | 55043503 | + |
| SEQ ID NO 44711 | TCTGACTGGGGCATGGGGGA | GGG | chr1 | 55043488 | 55043507 | 55043504 | + |
| SEQ ID NO 44712 | CTGACTGGGGCATGGGGGAG | GGG | chr1 | 55043489 | 55043508 | 55043505 | + |
| SEQ ID NO 44713 | TGACTGGGGCATGGGGGAGG | GGG | chr1 | 55043490 | 55043509 | 55043506 | + |
| SEQ ID NO 44714 | CTGGGGCATGGGGGAGGGGG | TGG | chr1 | 55043493 | 55043512 | 55043509 | + |
| SEQ ID NO 44715 | ATGGGGGAGGGGGTGGCCTT | TGG | chr1 | 55043500 | 55043519 | 55043516 | + |
| SEQ ID NO 44716 | TGGGGGAGGGGGTGGCCTTT | GGG | chr1 | 55043501 | 55043520 | 55043517 | + |
| SEQ ID NO 44717 | GGGAGGGGGTGGCCTTTGGG | CAG | chr1 | 55043504 | 55043523 | 55043520 | + |
| SEQ ID NO 44718 | GGAGGGGGTGGCCTTTGGGC | AGG | chr1 | 55043505 | 55043524 | 55043521 | + |
| SEQ ID NO 44719 | GAGGGGGTGGCCTTTGGGCA | GGG | chr1 | 55043506 | 55043525 | 55043522 | + |
| SEQ ID NO 44720 | TGGCCTTTGGGCAGGGCCAC | CAG | chr1 | 55043513 | 55043532 | 55043529 | + |
| SEQ ID NO 44721 | GGCCTTTGGGCAGGGCCACC | AGG | chr1 | 55043514 | 55043533 | 55043530 | + |
| SEQ ID NO 44722 | CCTTTGGGCAGGGCCACCAG | GAG | chr1 | 55043516 | 55043535 | 55043532 | + |
| SEQ ID NO 44723 | GCAGGGCCACCAGGAGCGAC | CAG | chr1 | 55043523 | 55043542 | 55043539 | + |
| SEQ ID NO 44724 | CAGGGCCACCAGGAGCGACC | AGG | chr1 | 55043524 | 55043543 | 55043540 | + |
| SEQ ID NO 44725 | ACCAGGAGCGACCAGGCCCG | TAG | chr1 | 55043531 | 55043550 | 55043547 | + |
| SEQ ID NO 44726 | CAGGAGCGACCAGGCCCGTA | GAG | chr1 | 55043533 | 55043552 | 55043549 | + |
| SEQ ID NO 44727 | GGAGCGACCAGGCCCGTAGA | GAG | chr1 | 55043535 | 55043554 | 55043551 | + |
| SEQ ID NO 44728 | CGACCAGGCCCGTAGAGAGC | TGG | chr1 | 55043539 | 55043558 | 55043555 | + |
| SEQ ID NO 44729 | GACCAGGCCCGTAGAGAGCT | GGG | chr1 | 55043540 | 55043559 | 55043556 | + |
| SEQ ID NO 44730 | GGCCCGTAGAGAGCTGGGTG | CAG | chr1 | 55043545 | 55043564 | 55043561 | + |
| SEQ ID NO 44731 | GCCCGTAGAGAGCTGGGTGC | AGG | chr1 | 55043546 | 55043565 | 55043562 | + |
| SEQ ID NO 44732 | TAGAGAGCTGGGTGCAGGTA | CAG | chr1 | 55043551 | 55043570 | 55043567 | + |
| SEQ ID NO 44733 | GAGAGCTGGGTGCAGGTACA | GAG | chr1 | 55043553 | 55043572 | 55043569 | + |
| SEQ ID NO 44734 | AGAGCTGGGTGCAGGTACAG | AGG | chr1 | 55043554 | 55043573 | 55043570 | + |
| SEQ ID NO 44735 | ACAGAGGAAAACCTGTTGTC | GAG | chr1 | 55043570 | 55043589 | 55043586 | + |
| SEQ ID NO 44736 | GGAAAACCTGTTGTCGAGTG | TGG | chr1 | 55043575 | 55043594 | 55043591 | + |
| SEQ ID NO 44737 | CTGTTGTCGAGTGTGGCCCG | TAG | chr1 | 55043582 | 55043601 | 55043598 | + |
| SEQ ID NO 44738 | AGTTCCATTTTTGCCTGAA | TGG | chr1 | 55043603 | 55043622 | 55043619 | + |
| SEQ ID NO 44739 | TGCCTGAATGGCACATTTGA | AAG | chr1 | 55043615 | 55043634 | 55043631 | + |
| SEQ ID NO 44740 | TATAACCATGTGAATAATAA | TAG | chr1 | 55043643 | 55043662 | 55043659 | + |
| SEQ ID NO 44741 | ACCATGTGAATAATAATAGT | TGG | chr1 | 55043647 | 55043666 | 55043663 | + |

Figure 61 (Cont'd)

| | | | | | | | |
|---|---|---|---|---|---|---|---|
| SEQ ID NO 44742 | TAATAATAGTTGGCCTATAT | GAG | chr1 | 55043657 | 55043676 | 55043673 | + |
| SEQ ID NO 44743 | GAGTTCTTTAATTTGCTTTT | TGG | chr1 | 55043677 | 55043696 | 55043693 | + |
| SEQ ID NO 44744 | TTTGCTTTTGGTCCGCATT | TGG | chr1 | 55043688 | 55043707 | 55043704 | + |
| SEQ ID NO 44745 | TCTCTTTTGTTGTAATTTGT | AAG | chr1 | 55043744 | 55043763 | 55043760 | + |
| SEQ ID NO 44746 | CTTTTGTTGTAATTTGTAAG | TAG | chr1 | 55043747 | 55043766 | 55043763 | + |
| SEQ ID NO 44747 | TTTTGTTGTAATTTGTAAGT | AGG | chr1 | 55043748 | 55043767 | 55043764 | + |
| SEQ ID NO 44748 | TTTGTTGTAATTTGTAAGTA | GGG | chr1 | 55043749 | 55043768 | 55043765 | + |
| SEQ ID NO 44749 | TTGTTGTAATTTGTAAGTAG | GGG | chr1 | 55043750 | 55043769 | 55043766 | + |
| SEQ ID NO 44750 | TGTAATTTGTAAGTAGGGGT | GAG | chr1 | 55043754 | 55043773 | 55043770 | + |
| SEQ ID NO 44751 | TTGTAAGTAGGGGTGAGATA | AAG | chr1 | 55043760 | 55043779 | 55043776 | + |
| SEQ ID NO 44752 | GGGGTGAGATAAAGTACACC | TAG | chr1 | 55043769 | 55043788 | 55043785 | + |
| SEQ ID NO 44753 | GGGTGAGATAAAGTACACCT | AGG | chr1 | 55043770 | 55043789 | 55043786 | + |
| SEQ ID NO 44754 | GGTGAGATAAAGTACACCTA | GGG | chr1 | 55043771 | 55043790 | 55043787 | + |
| SEQ ID NO 44755 | AAAGTACACCTAGGGTTTGC | TGG | chr1 | 55043779 | 55043798 | 55043795 | + |
| SEQ ID NO 44756 | AAGTACACCTAGGGTTTGCT | GGG | chr1 | 55043780 | 55043799 | 55043796 | + |
| SEQ ID NO 44757 | TCATCATGTTCCTCCTTGCA | TGG | chr1 | 55043814 | 55043833 | 55043830 | + |
| SEQ ID NO 44758 | CATCATGTTCCTCCTTGCAT | GGG | chr1 | 55043815 | 55043834 | 55043831 | + |
| SEQ ID NO 44759 | ATCATGTTCCTCCTTGCATG | GGG | chr1 | 55043816 | 55043835 | 55043832 | + |
| SEQ ID NO 44760 | TGTTCCTCCTTGCATGGGGC | CAG | chr1 | 55043820 | 55043839 | 55043836 | + |
| SEQ ID NO 44761 | GTTCCTCCTTGCATGGGGCC | AGG | chr1 | 55043821 | 55043840 | 55043837 | + |
| SEQ ID NO 44762 | TTGCATGGGGCCAGGATCCG | TGG | chr1 | 55043829 | 55043848 | 55043845 | + |
| SEQ ID NO 44763 | GCATGGGGCCAGGATCCGTG | GAG | chr1 | 55043831 | 55043850 | 55043847 | + |
| SEQ ID NO 44764 | CATGGGGCCAGGATCCGTGG | AGG | chr1 | 55043832 | 55043851 | 55043848 | + |
| SEQ ID NO 44765 | CAGGATCCGTGGAGGTTGCC | TGG | chr1 | 55043840 | 55043859 | 55043856 | + |
| SEQ ID NO 44766 | GAGGTTGCCTGGCACCTACG | TGG | chr1 | 55043851 | 55043870 | 55043867 | + |
| SEQ ID NO 44767 | GTTGCCTGGCACCTACGTGG | TGG | chr1 | 55043854 | 55043873 | 55043870 | + |
| SEQ ID NO 44768 | GCACCTACGTGGTGGTGCTG | AAG | chr1 | 55043862 | 55043881 | 55043878 | + |
| SEQ ID NO 44769 | CACCTACGTGGTGGTGCTGA | AGG | chr1 | 55043863 | 55043882 | 55043879 | + |
| SEQ ID NO 44770 | CCTACGTGGTGGTGCTGAAG | GAG | chr1 | 55043865 | 55043884 | 55043881 | + |
| SEQ ID NO 44771 | CTACGTGGTGGTGCTGAAGG | AGG | chr1 | 55043866 | 55043885 | 55043882 | + |
| SEQ ID NO 44772 | ACGTGGTGGTGCTGAAGGAG | GAG | chr1 | 55043868 | 55043887 | 55043884 | + |
| SEQ ID NO 44773 | AGGAGGAGACCCACCTCTCG | CAG | chr1 | 55043883 | 55043902 | 55043899 | + |
| SEQ ID NO 44774 | GGAGACCCACCTCTCGCAGT | CAG | chr1 | 55043887 | 55043906 | 55043903 | + |
| SEQ ID NO 44775 | AGACCCACCTCTCGCAGTCA | GAG | chr1 | 55043889 | 55043908 | 55043905 | + |
| SEQ ID NO 44776 | AGCGCACTGCCCGCCGCCTG | CAG | chr1 | 55043910 | 55043929 | 55043926 | + |
| SEQ ID NO 44777 | GCGCACTGCCCGCCGCCTGC | AGG | chr1 | 55043911 | 55043930 | 55043927 | + |
| SEQ ID NO 44778 | CTGCCCGCCGCCTGCAGGCC | CAG | chr1 | 55043916 | 55043935 | 55043932 | + |
| SEQ ID NO 44779 | TGCCCGCCGCCTGCAGGCCC | AGG | chr1 | 55043917 | 55043936 | 55043933 | + |
| SEQ ID NO 44780 | TGCAGGCCCAGGCTGCCCGC | CGG | chr1 | 55043928 | 55043947 | 55043944 | + |
| SEQ ID NO 44781 | GCAGGCCCAGGCTGCCCGCC | GGG | chr1 | 55043929 | 55043948 | 55043945 | + |
| SEQ ID NO 44782 | CAGGCCCAGGCTGCCCGCCG | GGG | chr1 | 55043930 | 55043949 | 55043946 | + |
| SEQ ID NO 44783 | CCCGCCGGGATACCTCACC | AAG | chr1 | 55043943 | 55043962 | 55043959 | + |
| SEQ ID NO 44784 | AAGATCCTGCATGTCTTCCA | TGG | chr1 | 55043963 | 55043982 | 55043979 | + |
| SEQ ID NO 44785 | GTCTTCCATGGCCTTCTTCC | TGG | chr1 | 55043975 | 55043994 | 55043991 | + |
| SEQ ID NO 44786 | TGGCCTTCTTCCTGGCTTCC | TGG | chr1 | 55043983 | 55044002 | 55043999 | + |
| SEQ ID NO 44787 | TTCTTCCTGGCTTCCTGGTG | AAG | chr1 | 55043988 | 55044007 | 55044004 | + |
| SEQ ID NO 44788 | CCTGGCTTCCTGGTGAAGAT | GAG | chr1 | 55043993 | 55044012 | 55044009 | + |

Figure 61 (Cont'd)

| | | | | | | | |
|---|---|---|---|---|---|---|---|
| SEQ ID NO 44789 | GGCTTCCTGGTGAAGATGAG | TGG | chr1 | 55043996 | 55044015 | 55044012 | + |
| SEQ ID NO 44790 | GAAGATGAGTGGCGACCTGC | TGG | chr1 | 55044007 | 55044026 | 55044023 | + |
| SEQ ID NO 44791 | AGATGAGTGGCGACCTGCTG | GAG | chr1 | 55044009 | 55044028 | 55044025 | + |
| SEQ ID NO 44792 | GAGTGGCGACCTGCTGGAGC | TGG | chr1 | 55044013 | 55044032 | 55044029 | + |
| SEQ ID NO 44793 | GGCGACCTGCTGGAGCTGGT | GAG | chr1 | 55044017 | 55044036 | 55044033 | + |
| SEQ ID NO 44794 | AGCTGGTGAGCCACCCTTTT | TGG | chr1 | 55044030 | 55044049 | 55044046 | + |
| SEQ ID NO 44795 | GCTGGTGAGCCACCCTTTTT | GGG | chr1 | 55044031 | 55044050 | 55044047 | + |
| SEQ ID NO 44796 | TGAGCCACCCTTTTTGGGAA | TGG | chr1 | 55044036 | 55044055 | 55044052 | + |
| SEQ ID NO 44797 | TTGGGAATGGCACTTCCTGA | TAG | chr1 | 55044049 | 55044068 | 55044065 | + |
| SEQ ID NO 44798 | TGGGAATGGCACTTCCTGAT | AGG | chr1 | 55044050 | 55044069 | 55044066 | + |
| SEQ ID NO 44799 | GGGAATGGCACTTCCTGATA | GGG | chr1 | 55044051 | 55044070 | 55044067 | + |
| SEQ ID NO 44800 | ATGGCACTTCCTGATAGGGC | TGG | chr1 | 55044055 | 55044074 | 55044071 | + |
| SEQ ID NO 44801 | TGGCACTTCCTGATAGGGCT | GGG | chr1 | 55044056 | 55044075 | 55044072 | + |
| SEQ ID NO 44802 | CTGGGCCACTGCATATACAC | TGG | chr1 | 55044074 | 55044093 | 55044090 | + |
| SEQ ID NO 44803 | TGGGCCACTGCATATACACT | GGG | chr1 | 55044075 | 55044094 | 55044091 | + |
| SEQ ID NO 44804 | GGGCCACTGCATATACACTG | GGG | chr1 | 55044076 | 55044095 | 55044092 | + |
| SEQ ID NO 44805 | TATACACTGGGGACTGTGCT | TAG | chr1 | 55044087 | 55044106 | 55044103 | + |
| SEQ ID NO 44806 | ACACTGGGGACTGTGCTTAG | TAG | chr1 | 55044090 | 55044109 | 55044106 | + |
| SEQ ID NO 44807 | CACTGGGGACTGTGCTTAGT | AGG | chr1 | 55044091 | 55044110 | 55044107 | + |
| SEQ ID NO 44808 | GTAGGCCCATTGCTGAAAAT | CAG | chr1 | 55044109 | 55044128 | 55044125 | + |
| SEQ ID NO 44809 | GGCCCATTGCTGAAAATCAG | AAG | chr1 | 55044112 | 55044131 | 55044128 | + |
| SEQ ID NO 44810 | GCCCATTGCTGAAAATCAGA | AGG | chr1 | 55044113 | 55044132 | 55044129 | + |
| SEQ ID NO 44811 | CCCATTGCTGAAAATCAGAA | GGG | chr1 | 55044114 | 55044133 | 55044130 | + |
| SEQ ID NO 44812 | CCATTGCTGAAAATCAGAAG | GGG | chr1 | 55044115 | 55044134 | 55044131 | + |
| SEQ ID NO 44813 | TGCTGAAAATCAGAAGGGGA | CAG | chr1 | 55044119 | 55044138 | 55044135 | + |
| SEQ ID NO 44814 | GAAAATCAGAAGGGGACAGC | AAG | chr1 | 55044123 | 55044142 | 55044139 | + |
| SEQ ID NO 44815 | GGGGACAGCAAGTATGTATT | GAG | chr1 | 55044134 | 55044153 | 55044150 | + |
| SEQ ID NO 44816 | AGTATGTATTGAGCACTTAT | CGG | chr1 | 55044144 | 55044163 | 55044160 | + |
| SEQ ID NO 44817 | GTATGTATTGAGCACTTATC | GGG | chr1 | 55044145 | 55044164 | 55044161 | + |
| SEQ ID NO 44818 | TTGAGCACTTATCGGGTACC | AAG | chr1 | 55044152 | 55044171 | 55044168 | + |
| SEQ ID NO 44819 | CACTTATCGGGTACCAAGCA | CAG | chr1 | 55044157 | 55044176 | 55044173 | + |
| SEQ ID NO 44820 | GTACCAAGCACAGTAACTAC | TGG | chr1 | 55044167 | 55044186 | 55044183 | + |
| SEQ ID NO 44821 | GTAACTACTGGCTTTCTGTA | TAG | chr1 | 55044179 | 55044198 | 55044195 | + |
| SEQ ID NO 44822 | TTCTGTATAGAATTCCCTTT | AAG | chr1 | 55044192 | 55044211 | 55044208 | + |
| SEQ ID NO 44823 | TATAGAATTCCCTTTAAGCC | TGG | chr1 | 55044197 | 55044216 | 55044213 | + |
| SEQ ID NO 44824 | CTTTAAGCCTGGCCATGCCC | CAG | chr1 | 55044208 | 55044227 | 55044224 | + |
| SEQ ID NO 44825 | TAAGCCTGGCCATGCCCCAG | TGG | chr1 | 55044211 | 55044230 | 55044227 | + |
| SEQ ID NO 44826 | GTACGTCTATCTTCATTTGA | AAG | chr1 | 55044233 | 55044252 | 55044249 | + |
| SEQ ID NO 44827 | TCTATCTTCATTTGAAAGAC | GAG | chr1 | 55044238 | 55044257 | 55044254 | + |
| SEQ ID NO 44828 | CTATCTTCATTTGAAAGACG | AGG | chr1 | 55044239 | 55044258 | 55044255 | + |
| SEQ ID NO 44829 | ATCTTCATTTGAAAGACGAG | GAG | chr1 | 55044241 | 55044260 | 55044257 | + |
| SEQ ID NO 44830 | TTTGAAAGACGAGGAGACTG | AAG | chr1 | 55044248 | 55044267 | 55044264 | + |
| SEQ ID NO 44831 | AAGACGAGGAGACTGAAGTT | CAG | chr1 | 55044253 | 55044272 | 55044269 | + |
| SEQ ID NO 44832 | GACGAGGAGACTGAAGTTCA | GAG | chr1 | 55044255 | 55044274 | 55044271 | + |
| SEQ ID NO 44833 | ACGAGGAGACTGAAGTTCAG | AGG | chr1 | 55044256 | 55044275 | 55044272 | + |
| SEQ ID NO 44834 | CGAGGAGACTGAAGTTCAGA | GGG | chr1 | 55044257 | 55044276 | 55044273 | + |
| SEQ ID NO 44835 | GAGGAGACTGAAGTTCAGAG | GGG | chr1 | 55044258 | 55044277 | 55044274 | + |

Figure 61 (Cont'd)

| | | | | | | | |
|---|---|---|---|---|---|---|---|
| SEQ ID NO 44836 | GAAGTTCAGAGGGGACCACA | CAG | chr1 | 55044267 | 55044286 | 55044283 | + |
| SEQ ID NO 44837 | TTCAGAGGGGACCACACAGA | CAG | chr1 | 55044271 | 55044290 | 55044287 | + |
| SEQ ID NO 44838 | GAGGGGACCACACAGACAGC | TAG | chr1 | 55044275 | 55044294 | 55044291 | + |
| SEQ ID NO 44839 | AGGGGACCACACAGACAGCT | AGG | chr1 | 55044276 | 55044295 | 55044292 | + |
| SEQ ID NO 44840 | GGGGACCACACAGACAGCTA | GGG | chr1 | 55044277 | 55044296 | 55044293 | + |
| SEQ ID NO 44841 | GGGACCACACAGACAGCTAG | GGG | chr1 | 55044278 | 55044297 | 55044294 | + |
| SEQ ID NO 44842 | ACCACACAGACAGCTAGGGG | TAG | chr1 | 55044281 | 55044300 | 55044297 | + |
| SEQ ID NO 44843 | CACACAGACAGCTAGGGGTA | GAG | chr1 | 55044283 | 55044302 | 55044299 | + |
| SEQ ID NO 44844 | AGACAGCTAGGGGTAGAGCC | TGG | chr1 | 55044288 | 55044307 | 55044304 | + |
| SEQ ID NO 44845 | AGAGCCTGGATCAAACCCAT | TGG | chr1 | 55044302 | 55044321 | 55044318 | + |
| SEQ ID NO 44846 | AAACCCATTGGTCTGCCTGC | CAG | chr1 | 55044314 | 55044333 | 55044330 | + |
| SEQ ID NO 44847 | GCCAATGCATCTGCTGCCTA | CGG | chr1 | 55044347 | 55044366 | 55044363 | + |
| SEQ ID NO 44848 | CTGCTGCCTACGGAAACCTG | TAG | chr1 | 55044357 | 55044376 | 55044373 | + |
| SEQ ID NO 44849 | TGCTGCCTACGGAAACCTGT | AGG | chr1 | 55044358 | 55044377 | 55044374 | + |
| SEQ ID NO 44850 | GCTGCCTACGGAAACCTGTA | GGG | chr1 | 55044359 | 55044378 | 55044375 | + |
| SEQ ID NO 44851 | CTACGGAAACCTGTAGGGAC | AAG | chr1 | 55044364 | 55044383 | 55044380 | + |
| SEQ ID NO 44852 | TACGGAAACCTGTAGGGACA | AGG | chr1 | 55044365 | 55044384 | 55044381 | + |
| SEQ ID NO 44853 | AACCTGTAGGGACAAGGCCC | TGG | chr1 | 55044371 | 55044390 | 55044387 | + |
| SEQ ID NO 44854 | ACCTGTAGGGACAAGGCCCT | GGG | chr1 | 55044372 | 55044391 | 55044388 | + |
| SEQ ID NO 44855 | GGACAAGGCCCTGGGATGTT | CAG | chr1 | 55044380 | 55044399 | 55044396 | + |
| SEQ ID NO 44856 | CAAGGCCCTGGGATGTTCAG | TGG | chr1 | 55044383 | 55044402 | 55044399 | + |
| SEQ ID NO 44857 | AGGCCCTGGGATGTTCAGTG | GAG | chr1 | 55044385 | 55044404 | 55044401 | + |
| SEQ ID NO 44858 | TGGGATGTTCAGTGGAGCCT | GAG | chr1 | 55044391 | 55044410 | 55044407 | + |
| SEQ ID NO 44859 | GCCTGAGTCATTTTATAAAA | AAG | chr1 | 55044407 | 55044426 | 55044423 | + |
| SEQ ID NO 44860 | TTTATAAAAAGCATGACTC | TAG | chr1 | 55044418 | 55044437 | 55044434 | + |
| SEQ ID NO 44861 | TTATAAAAAGCATGACTCT | AGG | chr1 | 55044419 | 55044438 | 55044435 | + |
| SEQ ID NO 44862 | TATAAAAAGCATGACTCTA | GGG | chr1 | 55044420 | 55044439 | 55044436 | + |
| SEQ ID NO 44863 | TAGGGTCCAAAATTCCTTTG | AAG | chr1 | 55044438 | 55044457 | 55044454 | + |
| SEQ ID NO 44864 | CCTTTGAAGCTGTTGCTATC | CAG | chr1 | 55044452 | 55044471 | 55044468 | + |
| SEQ ID NO 44865 | TTTGAAGCTGTTGCTATCCA | GAG | chr1 | 55044454 | 55044473 | 55044470 | + |
| SEQ ID NO 44866 | AGCTGTTGCTATCCAGAGTG | AAG | chr1 | 55044459 | 55044478 | 55044475 | + |
| SEQ ID NO 44867 | CCAGAGTGAAGTCCCTTCTT | TAG | chr1 | 55044471 | 55044490 | 55044487 | + |
| SEQ ID NO 44868 | CAGAGTGAAGTCCCTTCTTT | AGG | chr1 | 55044472 | 55044491 | 55044488 | + |
| SEQ ID NO 44869 | GTGAAGTCCCTTCTTTAGGA | CAG | chr1 | 55044476 | 55044495 | 55044492 | + |
| SEQ ID NO 44870 | TGAAGTCCCTTCTTTAGGAC | AGG | chr1 | 55044477 | 55044496 | 55044493 | + |
| SEQ ID NO 44871 | GAAGTCCCTTCTTTAGGACA | GGG | chr1 | 55044478 | 55044497 | 55044494 | + |
| SEQ ID NO 44872 | GTCCCTTCTTTAGGACAGGG | TGG | chr1 | 55044481 | 55044500 | 55044497 | + |
| SEQ ID NO 44873 | AGGGTGGCCCTCCTCCCTCC | TGG | chr1 | 55044497 | 55044516 | 55044513 | + |
| SEQ ID NO 44874 | CCTCCTGGATGTCACATCTT | CGG | chr1 | 55044512 | 55044531 | 55044528 | + |
| SEQ ID NO 44875 | CCTGGATGTCACATCTTCGG | TGG | chr1 | 55044515 | 55044534 | 55044531 | + |
| SEQ ID NO 44876 | TGGATGTCACATCTTCGGTG | GAG | chr1 | 55044517 | 55044536 | 55044533 | + |
| SEQ ID NO 44877 | GGATGTCACATCTTCGGTGG | AGG | chr1 | 55044518 | 55044537 | 55044534 | + |
| SEQ ID NO 44878 | GATGTCACATCTTCGGTGGA | GGG | chr1 | 55044519 | 55044538 | 55044535 | + |
| SEQ ID NO 44879 | ATGTCACATCTTCGGTGGAG | GGG | chr1 | 55044520 | 55044539 | 55044536 | + |
| SEQ ID NO 44880 | TCACATCTTCGGTGGAGGGG | CAG | chr1 | 55044523 | 55044542 | 55044539 | + |
| SEQ ID NO 44881 | ATCTTCGGTGGAGGGGCAGA | AAG | chr1 | 55044527 | 55044546 | 55044543 | + |
| SEQ ID NO 44882 | TCTTCGGTGGAGGGGCAGAA | AGG | chr1 | 55044528 | 55044547 | 55044544 | + |

Figure 61 (Cont'd)

| | | | | | | | |
|---|---|---|---|---|---|---|---|
| SEQ ID NO 44883 | CTTCGGTGGAGGGGCAGAAA | GGG | chr1 | 55044529 | 55044548 | 55044545 | + |
| SEQ ID NO 44884 | TTCGGTGGAGGGGCAGAAAG | GGG | chr1 | 55044530 | 55044549 | 55044546 | + |
| SEQ ID NO 44885 | TGGAGGGGCAGAAAGGGGAC | TGG | chr1 | 55044535 | 55044554 | 55044551 | + |
| SEQ ID NO 44886 | GGAGGGGCAGAAAGGGGACT | GGG | chr1 | 55044536 | 55044555 | 55044552 | + |
| SEQ ID NO 44887 | ACTGGGTATTCTCCTCACCC | TGG | chr1 | 55044553 | 55044572 | 55044569 | + |
| SEQ ID NO 44888 | TATTCTCCTCACCCTGGCCC | TAG | chr1 | 55044559 | 55044578 | 55044575 | + |
| SEQ ID NO 44889 | TGTGCTTCTGCACCACCTTC | TAG | chr1 | 55044612 | 55044631 | 55044628 | + |
| SEQ ID NO 44890 | ACAAATAAAAACGTTTTTTT | AAG | chr1 | 55044595 | 55044614 | 55044598 | - |
| SEQ ID NO 44891 | AAACGTTTTTTTAAGATTTG | AAG | chr1 | 55044587 | 55044606 | 55044590 | - |
| SEQ ID NO 44892 | TTTTTTAAGATTTGAAGCAC | TAG | chr1 | 55044581 | 55044600 | 55044584 | - |
| SEQ ID NO 44893 | TTTTTAAGATTTGAAGCACT | AGG | chr1 | 55044580 | 55044599 | 55044583 | - |
| SEQ ID NO 44894 | TTTTAAGATTTGAAGCACTA | GGG | chr1 | 55044579 | 55044598 | 55044582 | - |
| SEQ ID NO 44895 | AAGATTTGAAGCACTAGGGC | CAG | chr1 | 55044575 | 55044594 | 55044578 | - |
| SEQ ID NO 44896 | AGATTTGAAGCACTAGGGCC | AGG | chr1 | 55044574 | 55044593 | 55044577 | - |
| SEQ ID NO 44897 | GATTTGAAGCACTAGGGCCA | GGG | chr1 | 55044573 | 55044592 | 55044576 | - |
| SEQ ID NO 44898 | TGAAGCACTAGGGCCAGGGT | GAG | chr1 | 55044569 | 55044588 | 55044572 | - |
| SEQ ID NO 44899 | GAAGCACTAGGGCCAGGGTG | AGG | chr1 | 55044568 | 55044587 | 55044571 | - |
| SEQ ID NO 44900 | AGCACTAGGGCCAGGGTGAG | GAG | chr1 | 55044566 | 55044585 | 55044569 | - |
| SEQ ID NO 44901 | GCCAGGGTGAGGAGAATACC | CAG | chr1 | 55044557 | 55044576 | 55044560 | - |
| SEQ ID NO 44902 | CCCTTTCTGCCCCTCCACCG | AAG | chr1 | 55044532 | 55044551 | 55044535 | - |
| SEQ ID NO 44903 | TCCACCGAAGATGTGACATC | CAG | chr1 | 55044519 | 55044538 | 55044522 | - |
| SEQ ID NO 44904 | CCACCGAAGATGTGACATCC | AGG | chr1 | 55044518 | 55044537 | 55044521 | - |
| SEQ ID NO 44905 | ACCGAAGATGTGACATCCAG | GAG | chr1 | 55044516 | 55044535 | 55044519 | - |
| SEQ ID NO 44906 | CCGAAGATGTGACATCCAGG | AGG | chr1 | 55044515 | 55044534 | 55044518 | - |
| SEQ ID NO 44907 | CGAAGATGTGACATCCAGGA | GGG | chr1 | 55044514 | 55044533 | 55044517 | - |
| SEQ ID NO 44908 | AAGATGTGACATCCAGGAGG | GAG | chr1 | 55044512 | 55044531 | 55044515 | - |
| SEQ ID NO 44909 | AGATGTGACATCCAGGAGGG | AGG | chr1 | 55044511 | 55044530 | 55044514 | - |
| SEQ ID NO 44910 | ATGTGACATCCAGGAGGGAG | GAG | chr1 | 55044509 | 55044528 | 55044512 | - |
| SEQ ID NO 44911 | TGTGACATCCAGGAGGGAGG | AGG | chr1 | 55044508 | 55044527 | 55044511 | - |
| SEQ ID NO 44912 | GTGACATCCAGGAGGGAGGA | GGG | chr1 | 55044507 | 55044526 | 55044510 | - |
| SEQ ID NO 44913 | AGGAGGGCCACCCTGTCCTA | AAG | chr1 | 55044491 | 55044510 | 55044494 | - |
| SEQ ID NO 44914 | AGGGCCACCCTGTCCTAAAG | AAG | chr1 | 55044488 | 55044507 | 55044491 | - |
| SEQ ID NO 44915 | GGGCCACCCTGTCCTAAAGA | AGG | chr1 | 55044487 | 55044506 | 55044490 | - |
| SEQ ID NO 44916 | GGCCACCCTGTCCTAAAGAA | GGG | chr1 | 55044486 | 55044505 | 55044489 | - |
| SEQ ID NO 44917 | CTAAAGAAGGGACTTCACTC | TGG | chr1 | 55044474 | 55044493 | 55044477 | - |
| SEQ ID NO 44918 | AGAAGGGACTTCACTCTGGA | TAG | chr1 | 55044470 | 55044489 | 55044473 | - |
| SEQ ID NO 44919 | GACTTCACTCTGGATAGCAA | CAG | chr1 | 55044464 | 55044483 | 55044467 | - |
| SEQ ID NO 44920 | TCTGGATAGCAACAGCTTCA | AAG | chr1 | 55044456 | 55044475 | 55044459 | - |
| SEQ ID NO 44921 | CTGGATAGCAACAGCTTCAA | AGG | chr1 | 55044455 | 55044474 | 55044458 | - |
| SEQ ID NO 44922 | CAACAGCTTCAAAGGAATTT | TGG | chr1 | 55044447 | 55044466 | 55044450 | - |
| SEQ ID NO 44923 | TTCAAAGGAATTTTGGACCC | TAG | chr1 | 55044440 | 55044459 | 55044443 | - |
| SEQ ID NO 44924 | CAAAGGAATTTTGGACCCTA | GAG | chr1 | 55044438 | 55044457 | 55044441 | - |
| SEQ ID NO 44925 | TGCTTTTTTATAAAATGACT | CAG | chr1 | 55044412 | 55044431 | 55044415 | - |
| SEQ ID NO 44926 | GCTTTTTTATAAAATGACTC | AGG | chr1 | 55044411 | 55044430 | 55044414 | - |
| SEQ ID NO 44927 | TCAGGCTCCACTGAACATCC | CAG | chr1 | 55044393 | 55044412 | 55044396 | - |
| SEQ ID NO 44928 | CAGGCTCCACTGAACATCCC | AGG | chr1 | 55044392 | 55044411 | 55044395 | - |
| SEQ ID NO 44929 | AGGCTCCACTGAACATCCCA | GGG | chr1 | 55044391 | 55044410 | 55044394 | - |

Figure 61 (Cont'd)

| SEQ ID NO 44930 | ATCCCAGGGCCTTGTCCCTA | CAG | chr1 | 55044377 | 55044396 | 55044380 | - |
| SEQ ID NO 44931 | TCCCAGGGCCTTGTCCCTAC | AGG | chr1 | 55044376 | 55044395 | 55044379 | - |
| SEQ ID NO 44932 | CTTGTCCCTACAGGTTTCCG | TAG | chr1 | 55044367 | 55044386 | 55044370 | - |
| SEQ ID NO 44933 | TTGTCCCTACAGGTTTCCGT | AGG | chr1 | 55044366 | 55044385 | 55044369 | - |
| SEQ ID NO 44934 | TCCCTACAGGTTTCCGTAGG | CAG | chr1 | 55044363 | 55044382 | 55044366 | - |
| SEQ ID NO 44935 | CTACAGGTTTCCGTAGGCAG | CAG | chr1 | 55044360 | 55044379 | 55044363 | - |
| SEQ ID NO 44936 | TCCGTAGGCAGCAGATGCAT | TGG | chr1 | 55044351 | 55044370 | 55044354 | - |
| SEQ ID NO 44937 | GGCAGCAGATGCATTGGCAC | AAG | chr1 | 55044345 | 55044364 | 55044348 | - |
| SEQ ID NO 44938 | CAGATGCATTGGCACAAGAA | TGG | chr1 | 55044340 | 55044359 | 55044343 | - |
| SEQ ID NO 44939 | TGCATTGGCACAAGAATGGC | TGG | chr1 | 55044336 | 55044355 | 55044339 | - |
| SEQ ID NO 44940 | ATTGGCACAAGAATGGCTGG | CAG | chr1 | 55044333 | 55044352 | 55044336 | - |
| SEQ ID NO 44941 | TTGGCACAAGAATGGCTGGC | AGG | chr1 | 55044332 | 55044351 | 55044335 | - |
| SEQ ID NO 44942 | GCACAAGAATGGCTGGCAGG | CAG | chr1 | 55044329 | 55044348 | 55044332 | - |
| SEQ ID NO 44943 | ATGGCTGGCAGGCAGACCAA | TGG | chr1 | 55044321 | 55044340 | 55044324 | - |
| SEQ ID NO 44944 | TGGCTGGCAGGCAGACCAAT | GGG | chr1 | 55044320 | 55044339 | 55044323 | - |
| SEQ ID NO 44945 | GCAGACCAATGGGTTTGATC | CAG | chr1 | 55044310 | 55044329 | 55044313 | - |
| SEQ ID NO 44946 | CAGACCAATGGGTTTGATCC | AGG | chr1 | 55044309 | 55044328 | 55044312 | - |
| SEQ ID NO 44947 | TTTGATCCAGGCTCTACCCC | TAG | chr1 | 55044297 | 55044316 | 55044300 | - |
| SEQ ID NO 44948 | TCTACCCCAGCTGTCTGTG | TGG | chr1 | 55044285 | 55044304 | 55044288 | - |
| SEQ ID NO 44949 | GTGTGGTCCCTCTGAACTT | CAG | chr1 | 55044268 | 55044287 | 55044271 | - |
| SEQ ID NO 44950 | GTCCTCGTCTTTCAAATG | AAG | chr1 | 55044246 | 55044265 | 55044249 | - |
| SEQ ID NO 44951 | CCTCGTCTTTCAAATGAAGA | TAG | chr1 | 55044242 | 55044261 | 55044245 | - |
| SEQ ID NO 44952 | AATGAAGATAGACGTACCAC | TGG | chr1 | 55044230 | 55044249 | 55044233 | - |
| SEQ ID NO 44953 | ATGAAGATAGACGTACCACT | GGG | chr1 | 55044229 | 55044248 | 55044232 | - |
| SEQ ID NO 44954 | TGAAGATAGACGTACCACTG | GGG | chr1 | 55044228 | 55044247 | 55044231 | - |
| SEQ ID NO 44955 | ATAGACGTACCACTGGGGCA | TGG | chr1 | 55044223 | 55044242 | 55044226 | - |
| SEQ ID NO 44956 | ACGTACCACTGGGGCATGGC | CAG | chr1 | 55044219 | 55044238 | 55044222 | - |
| SEQ ID NO 44957 | CGTACCACTGGGGCATGGCC | AGG | chr1 | 55044218 | 55044237 | 55044221 | - |
| SEQ ID NO 44958 | CTGGGGCATGGCCAGGCTTA | AAG | chr1 | 55044211 | 55044230 | 55044214 | - |
| SEQ ID NO 44959 | TGGGGCATGGCCAGGCTTAA | AGG | chr1 | 55044210 | 55044229 | 55044213 | - |
| SEQ ID NO 44960 | GGGGCATGGCCAGGCTTAAA | GGG | chr1 | 55044209 | 55044228 | 55044212 | - |
| SEQ ID NO 44961 | GGCTTAAAGGGAATTCTATA | CAG | chr1 | 55044197 | 55044216 | 55044200 | - |
| SEQ ID NO 44962 | TAAAGGGAATTCTATACAGA | AAG | chr1 | 55044193 | 55044212 | 55044196 | - |
| SEQ ID NO 44963 | GGGAATTCTATACAGAAAGC | CAG | chr1 | 55044189 | 55044208 | 55044192 | - |
| SEQ ID NO 44964 | AATTCTATACAGAAAGCCAG | TAG | chr1 | 55044186 | 55044205 | 55044189 | - |
| SEQ ID NO 44965 | AAGCCAGTAGTTACTGTGCT | TGG | chr1 | 55044173 | 55044192 | 55044176 | - |
| SEQ ID NO 44966 | TACTGTGCTTGGTACCCGAT | AAG | chr1 | 55044162 | 55044181 | 55044165 | - |
| SEQ ID NO 44967 | TGCTGTCCCTTCTGATTTT | CAG | chr1 | 55044124 | 55044143 | 55044127 | - |
| SEQ ID NO 44968 | CCCCTTCTGATTTTCAGCAA | TGG | chr1 | 55044118 | 55044137 | 55044121 | - |
| SEQ ID NO 44969 | CCCTTCTGATTTTCAGCAAT | GGG | chr1 | 55044117 | 55044136 | 55044120 | - |
| SEQ ID NO 44970 | TTTTCAGCAATGGGCCTACT | AAG | chr1 | 55044108 | 55044127 | 55044111 | - |
| SEQ ID NO 44971 | AGCAATGGGCCTACTAAGCA | CAG | chr1 | 55044103 | 55044122 | 55044106 | - |
| SEQ ID NO 44972 | GGCCTACTAAGCACAGTCCC | CAG | chr1 | 55044096 | 55044115 | 55044099 | - |
| SEQ ID NO 44973 | CACAGTCCCCAGTGTATATG | CAG | chr1 | 55044085 | 55044104 | 55044088 | - |
| SEQ ID NO 44974 | AGTCCCCAGTGTATATGCAG | TGG | chr1 | 55044082 | 55044101 | 55044085 | - |
| SEQ ID NO 44975 | CCAGTGTATATGCAGTGGCC | CAG | chr1 | 55044077 | 55044096 | 55044080 | - |
| SEQ ID NO 44976 | ATGCAGTGGCCCAGCCCTAT | CAG | chr1 | 55044068 | 55044087 | 55044071 | - |

Figure 61 (Cont'd)

| SEQ ID NO 44977 | TGCAGTGGCCCAGCCCTATC | AGG | chr1 | 55044067 | 55044086 | 55044070 | - |
| SEQ ID NO 44978 | AGTGGCCCAGCCCTATCAGG | AAG | chr1 | 55044064 | 55044083 | 55044067 | - |
| SEQ ID NO 44979 | CAGGAAGTGCCATTCCCAAA | AAG | chr1 | 55044048 | 55044067 | 55044051 | - |
| SEQ ID NO 44980 | AGGAAGTGCCATTCCCAAAA | AGG | chr1 | 55044047 | 55044066 | 55044050 | - |
| SEQ ID NO 44981 | GGAAGTGCCATTCCCAAAAA | GGG | chr1 | 55044046 | 55044065 | 55044049 | - |
| SEQ ID NO 44982 | AGTGCCATTCCCAAAAAGGG | TGG | chr1 | 55044043 | 55044062 | 55044046 | - |
| SEQ ID NO 44983 | TCCCAAAAGGGTGGCTCAC | CAG | chr1 | 55044035 | 55044054 | 55044038 | - |
| SEQ ID NO 44984 | AAAGGGTGGCTCACCAGCTC | CAG | chr1 | 55044029 | 55044048 | 55044032 | - |
| SEQ ID NO 44985 | GGGTGGCTCACCAGCTCCAG | CAG | chr1 | 55044026 | 55044045 | 55044029 | - |
| SEQ ID NO 44986 | GGTGGCTCACCAGCTCCAGC | AGG | chr1 | 55044025 | 55044044 | 55044028 | - |
| SEQ ID NO 44987 | AGGTCGCCACTCATCTTCAC | CAG | chr1 | 55044005 | 55044024 | 55044008 | - |
| SEQ ID NO 44988 | GGTCGCCACTCATCTTCACC | AGG | chr1 | 55044004 | 55044023 | 55044007 | - |
| SEQ ID NO 44989 | CGCCACTCATCTTCACCAGG | AAG | chr1 | 55044001 | 55044020 | 55044004 | - |
| SEQ ID NO 44990 | ACTCATCTTCACCAGGAAGC | CAG | chr1 | 55043997 | 55044016 | 55044000 | - |
| SEQ ID NO 44991 | CTCATCTTCACCAGGAAGCC | AGG | chr1 | 55043996 | 55044015 | 55043999 | - |
| SEQ ID NO 44992 | ATCTTCACCAGGAAGCCAGG | AAG | chr1 | 55043993 | 55044012 | 55043996 | - |
| SEQ ID NO 44993 | TTCACCAGGAAGCCAGGAAG | AAG | chr1 | 55043990 | 55044009 | 55043993 | - |
| SEQ ID NO 44994 | TCACCAGGAAGCCAGGAAGA | AGG | chr1 | 55043989 | 55044008 | 55043992 | - |
| SEQ ID NO 44995 | GGAAGCCAGGAAGAAGGCCA | TGG | chr1 | 55043983 | 55044002 | 55043986 | - |
| SEQ ID NO 44996 | AGCCAGGAAGAAGGCCATGG | AAG | chr1 | 55043980 | 55043999 | 55043983 | - |
| SEQ ID NO 44997 | AGAAGGCCATGGAAGACATG | CAG | chr1 | 55043972 | 55043991 | 55043975 | - |
| SEQ ID NO 44998 | GAAGGCCATGGAAGACATGC | AGG | chr1 | 55043971 | 55043990 | 55043974 | - |
| SEQ ID NO 44999 | ATGGAAGACATGCAGGATCT | TGG | chr1 | 55043964 | 55043983 | 55043967 | - |
| SEQ ID NO 45000 | AAGACATGCAGGATCTTGGT | GAG | chr1 | 55043960 | 55043979 | 55043963 | - |
| SEQ ID NO 45001 | AGACATGCAGGATCTTGGTG | AGG | chr1 | 55043959 | 55043978 | 55043962 | - |
| SEQ ID NO 45002 | GGATCTTGGTGAGGTATCCC | CGG | chr1 | 55043950 | 55043969 | 55043953 | - |
| SEQ ID NO 45003 | TCTTGGTGAGGTATCCCCGG | CGG | chr1 | 55043947 | 55043966 | 55043950 | - |
| SEQ ID NO 45004 | CTTGGTGAGGTATCCCCGGC | GGG | chr1 | 55043946 | 55043965 | 55043949 | - |
| SEQ ID NO 45005 | GGTGAGGTATCCCCGGCGGG | CAG | chr1 | 55043943 | 55043962 | 55043946 | - |
| SEQ ID NO 45006 | GGTATCCCCGGCGGGCAGCC | TGG | chr1 | 55043938 | 55043957 | 55043941 | - |
| SEQ ID NO 45007 | GTATCCCCGGCGGGCAGCCT | GGG | chr1 | 55043937 | 55043956 | 55043940 | - |
| SEQ ID NO 45008 | CGGCGGGCAGCCTGGGCCTG | CAG | chr1 | 55043930 | 55043949 | 55043933 | - |
| SEQ ID NO 45009 | GGCGGGCAGCCTGGGCCTGC | AGG | chr1 | 55043929 | 55043948 | 55043932 | - |
| SEQ ID NO 45010 | GGGCAGCCTGGGCCTGCAGG | CGG | chr1 | 55043926 | 55043945 | 55043929 | - |
| SEQ ID NO 45011 | CAGCCTGGGCCTGCAGGCGG | CGG | chr1 | 55043923 | 55043942 | 55043926 | - |
| SEQ ID NO 45012 | AGCCTGGGCCTGCAGGCGGC | GGG | chr1 | 55043922 | 55043941 | 55043925 | - |
| SEQ ID NO 45013 | CTGGGCCTGCAGGCGGCGGG | CAG | chr1 | 55043919 | 55043938 | 55043922 | - |
| SEQ ID NO 45014 | GGGCAGTGCGCTCTGACTGC | GAG | chr1 | 55043902 | 55043921 | 55043905 | - |
| SEQ ID NO 45015 | GCAGTGCGCTCTGACTGCGA | GAG | chr1 | 55043900 | 55043919 | 55043903 | - |
| SEQ ID NO 45016 | CAGTGCGCTCTGACTGCGAG | AGG | chr1 | 55043899 | 55043918 | 55043902 | - |
| SEQ ID NO 45017 | TGCGCTCTGACTGCGAGAGG | TGG | chr1 | 55043896 | 55043915 | 55043899 | - |
| SEQ ID NO 45018 | GCGCTCTGACTGCGAGAGGT | GGG | chr1 | 55043895 | 55043914 | 55043898 | - |
| SEQ ID NO 45019 | GAGAGGTGGGTCTCCTCCTT | CAG | chr1 | 55043882 | 55043901 | 55043885 | - |
| SEQ ID NO 45020 | CCTCCTTCAGCACCACCACG | TAG | chr1 | 55043869 | 55043888 | 55043872 | - |
| SEQ ID NO 45021 | CTCCTTCAGCACCACCACGT | AGG | chr1 | 55043868 | 55043887 | 55043871 | - |
| SEQ ID NO 45022 | CAGCACCACCACGTAGGTGC | CAG | chr1 | 55043862 | 55043881 | 55043865 | - |
| SEQ ID NO 45023 | AGCACCACCACGTAGGTGCC | AGG | chr1 | 55043861 | 55043880 | 55043864 | - |

Figure 61 (Cont'd)

| SEQ ID NO 45024 | TAGGTGCCAGGCAACCTCCA | CGG | chr1 | 55043849 | 55043868 | 55043852 | - |
| SEQ ID NO 45025 | CAGGCAACCTCCACGGATCC | TGG | chr1 | 55043842 | 55043861 | 55043845 | - |
| SEQ ID NO 45026 | CACGGATCCTGGCCCCATGC | AAG | chr1 | 55043831 | 55043850 | 55043834 | - |
| SEQ ID NO 45027 | ACGGATCCTGGCCCCATGCA | AGG | chr1 | 55043830 | 55043849 | 55043833 | - |
| SEQ ID NO 45028 | GGATCCTGGCCCCATGCAAG | GAG | chr1 | 55043828 | 55043847 | 55043831 | - |
| SEQ ID NO 45029 | GATCCTGGCCCCATGCAAGG | AGG | chr1 | 55043827 | 55043846 | 55043830 | - |
| SEQ ID NO 45030 | CAAGGAGGAACATGATGACA | TGG | chr1 | 55043812 | 55043831 | 55043815 | - |
| SEQ ID NO 45031 | GGAGGAACATGATGACATGG | AAG | chr1 | 55043809 | 55043828 | 55043812 | - |
| SEQ ID NO 45032 | ATGATGACATGGAAGAAACC | CAG | chr1 | 55043801 | 55043820 | 55043804 | - |
| SEQ ID NO 45033 | GGAAGAAACCCAGCAAACCC | TAG | chr1 | 55043791 | 55043810 | 55043794 | - |
| SEQ ID NO 45034 | GAAGAAACCCAGCAAACCCT | AGG | chr1 | 55043790 | 55043809 | 55043793 | - |
| SEQ ID NO 45035 | CTACTTACAAATTACAACAA | AAG | chr1 | 55043750 | 55043769 | 55043753 | - |
| SEQ ID NO 45036 | ACTTACAAATTACAACAAAA | GAG | chr1 | 55043748 | 55043767 | 55043751 | - |
| SEQ ID NO 45037 | TTACAACAAAAGAGACACAA | CAG | chr1 | 55043739 | 55043758 | 55043742 | - |
| SEQ ID NO 45038 | ACAACAAAAGAGACACAACA | GAG | chr1 | 55043737 | 55043756 | 55043740 | - |
| SEQ ID NO 45039 | AAAAGAGACACAACAGAGTA | TAG | chr1 | 55043732 | 55043751 | 55043735 | - |
| SEQ ID NO 45040 | AGAGACACAACAGAGTATAG | TAG | chr1 | 55043729 | 55043748 | 55043732 | - |
| SEQ ID NO 45041 | ACAGAGTATAGTAGATGATA | AAG | chr1 | 55043720 | 55043739 | 55043723 | - |
| SEQ ID NO 45042 | GAGTATAGTAGATGATAAAG | AAG | chr1 | 55043717 | 55043736 | 55043720 | - |
| SEQ ID NO 45043 | GATAAAGAAGTTACCAAATG | CGG | chr1 | 55043704 | 55043723 | 55043707 | - |
| SEQ ID NO 45044 | GTTACCAAATGCGGACCAAA | AAG | chr1 | 55043695 | 55043714 | 55043698 | - |
| SEQ ID NO 45045 | GCGGACCAAAAAGCAAATTA | AAG | chr1 | 55043685 | 55043704 | 55043688 | - |
| SEQ ID NO 45046 | AGCAAATTAAAGAACTCATA | TAG | chr1 | 55043674 | 55043693 | 55043677 | - |
| SEQ ID NO 45047 | GCAAATTAAAGAACTCATAT | AGG | chr1 | 55043673 | 55043692 | 55043676 | - |
| SEQ ID NO 45048 | GCCAACTATTATTATTCACA | TGG | chr1 | 55043651 | 55043670 | 55043654 | - |
| SEQ ID NO 45049 | ACACTTTCAAATGTGCCATT | CAG | chr1 | 55043621 | 55043640 | 55043624 | - |
| SEQ ID NO 45050 | CACTTTCAAATGTGCCATTC | AGG | chr1 | 55043620 | 55043639 | 55043623 | - |
| SEQ ID NO 45051 | ATGTGCCATTCAGGCAAAAA | TGG | chr1 | 55043611 | 55043630 | 55043614 | - |
| SEQ ID NO 45052 | TGTGCCATTCAGGCAAAAAT | GGG | chr1 | 55043610 | 55043629 | 55043613 | - |
| SEQ ID NO 45053 | TCAGGCAAAAATGGGAACTA | CGG | chr1 | 55043602 | 55043621 | 55043605 | - |
| SEQ ID NO 45054 | CAGGCAAAAATGGGAACTAC | GGG | chr1 | 55043601 | 55043620 | 55043604 | - |
| SEQ ID NO 45055 | CTACGGGCCACACTCGACAA | CAG | chr1 | 55043585 | 55043604 | 55043588 | - |
| SEQ ID NO 45056 | TACGGGCCACACTCGACAAC | AGG | chr1 | 55043584 | 55043603 | 55043587 | - |
| SEQ ID NO 45057 | TTTTCCTCTGTACCTGCACC | CAG | chr1 | 55043561 | 55043580 | 55043564 | - |
| SEQ ID NO 45058 | TACCTGCACCCAGCTCTCTA | CGG | chr1 | 55043551 | 55043570 | 55043554 | - |
| SEQ ID NO 45059 | ACCTGCACCCAGCTCTCTAC | GGG | chr1 | 55043550 | 55043569 | 55043553 | - |
| SEQ ID NO 45060 | CACCCAGCTCTCTACGGGCC | TGG | chr1 | 55043545 | 55043564 | 55043548 | - |
| SEQ ID NO 45061 | TCTACGGGCCTGGTCGCTCC | TGG | chr1 | 55043535 | 55043554 | 55043538 | - |
| SEQ ID NO 45062 | ACGGGCCTGGTCGCTCCTGG | TGG | chr1 | 55043532 | 55043551 | 55043535 | - |
| SEQ ID NO 45063 | GCTCCTGGTGGCCCTGCCCA | AAG | chr1 | 55043520 | 55043539 | 55043523 | - |
| SEQ ID NO 45064 | CTCCTGGTGGCCCTGCCCAA | AGG | chr1 | 55043519 | 55043538 | 55043522 | - |
| SEQ ID NO 45065 | CCACCCCCTCCCCCATGCCC | CAG | chr1 | 55043496 | 55043515 | 55043499 | - |
| SEQ ID NO 45066 | CCCCTCCCCCATGCCCCAGT | CAG | chr1 | 55043492 | 55043511 | 55043495 | - |
| SEQ ID NO 45067 | TGCCCCAGTCAGAATAAATT | GAG | chr1 | 55043481 | 55043500 | 55043484 | - |
| SEQ ID NO 45068 | GCCCCAGTCAGAATAAATTG | AGG | chr1 | 55043480 | 55043499 | 55043483 | - |
| SEQ ID NO 45069 | CCCCAGTCAGAATAAATTGA | GGG | chr1 | 55043479 | 55043498 | 55043482 | - |
| SEQ ID NO 45070 | TAAATTGAGGGAAAAAATCA | TGG | chr1 | 55043467 | 55043486 | 55043470 | - |

Figure 61 (Cont'd)

| SEQ ID NO 45071 | AAATTGAGGGAAAAAATCAT | GGG | chr1 | 55043466 | 55043485 | 55043469 | - |
| SEQ ID NO 45072 | AGGGAAAAAATCATGGCTT | TGG | chr1 | 55043460 | 55043479 | 55043463 | - |
| SEQ ID NO 45073 | GGAAAAAATCATGGGCTTTG | GAG | chr1 | 55043458 | 55043477 | 55043461 | - |
| SEQ ID NO 45074 | AAAATCATGGGCTTTGGAGC | CAG | chr1 | 55043454 | 55043473 | 55043457 | - |
| SEQ ID NO 45075 | AAATCATGGGCTTTGGAGCC | AGG | chr1 | 55043453 | 55043472 | 55043456 | - |
| SEQ ID NO 45076 | GCTTTGGAGCCAGGAAACCG | TGG | chr1 | 55043444 | 55043463 | 55043447 | - |
| SEQ ID NO 45077 | GAAACCGTGGACCTGAATTC | CAG | chr1 | 55043431 | 55043450 | 55043434 | - |
| SEQ ID NO 45078 | ATTCCAGCTCCAATATTTAC | TGG | chr1 | 55043415 | 55043434 | 55043418 | - |
| SEQ ID NO 45079 | TCCAATATTTACTGGTTGTG | CAG | chr1 | 55043407 | 55043426 | 55043410 | - |
| SEQ ID NO 45080 | TTTACTGGTTGTGCAGCCAT | GAG | chr1 | 55043400 | 55043419 | 55043403 | - |
| SEQ ID NO 45081 | CTGGTTGTGCAGCCATGAGC | AAG | chr1 | 55043396 | 55043415 | 55043399 | - |
| SEQ ID NO 45082 | GAGCAAGTCACTCAACCTCT | CGG | chr1 | 55043380 | 55043399 | 55043383 | - |
| SEQ ID NO 45083 | GCAAGTCACTCAACCTCTCG | GAG | chr1 | 55043378 | 55043397 | 55043381 | - |
| SEQ ID NO 45084 | CACTCAACCTCTCGGAGCCT | CAG | chr1 | 55043372 | 55043391 | 55043375 | - |
| SEQ ID NO 45085 | CAGATACCTCTGCTGTATTG | TAG | chr1 | 55043352 | 55043371 | 55043355 | - |
| SEQ ID NO 45086 | GATACCTCTGCTGTATTGTA | GAG | chr1 | 55043350 | 55043369 | 55043353 | - |
| SEQ ID NO 45087 | CTGCTGTATTGTAGAGACCA | CAG | chr1 | 55043343 | 55043362 | 55043346 | - |
| SEQ ID NO 45088 | AGACCACAGTACCTATGACA | TAG | chr1 | 55043329 | 55043348 | 55043332 | - |
| SEQ ID NO 45089 | GACCACAGTACCTATGACAT | AGG | chr1 | 55043328 | 55043347 | 55043331 | - |
| SEQ ID NO 45090 | TACCTATGACATAGGCCTGC | TGG | chr1 | 55043320 | 55043339 | 55043323 | - |
| SEQ ID NO 45091 | ACCTATGACATAGGCCTGCT | GGG | chr1 | 55043319 | 55043338 | 55043322 | - |
| SEQ ID NO 45092 | ATGACATAGGCCTGCTGGGA | AAG | chr1 | 55043315 | 55043334 | 55043318 | - |
| SEQ ID NO 45093 | ATAGGCCTGCTGGGAAAGTC | AAG | chr1 | 55043310 | 55043329 | 55043313 | - |
| SEQ ID NO 45094 | AGGCCTGCTGGGAAAGTCAA | GAG | chr1 | 55043308 | 55043327 | 55043311 | - |
| SEQ ID NO 45095 | GCTGGGAAAGTCAAGAGTGA | CGG | chr1 | 55043302 | 55043321 | 55043305 | - |
| SEQ ID NO 45096 | GGTTATATAAATCTCCCATC | CAG | chr1 | 55043281 | 55043300 | 55043284 | - |
| SEQ ID NO 45097 | ATCCAGATGCTCTACAAATG | CAG | chr1 | 55043264 | 55043283 | 55043267 | - |
| SEQ ID NO 45098 | TCCAGATGCTCTACAAATGC | AGG | chr1 | 55043263 | 55043282 | 55043266 | - |
| SEQ ID NO 45099 | AGATGCTCTACAAATGCAGG | CAG | chr1 | 55043260 | 55043279 | 55043263 | - |
| SEQ ID NO 45100 | TGCTCTACAAATGCAGGCAG | AAG | chr1 | 55043257 | 55043276 | 55043260 | - |
| SEQ ID NO 45101 | GCTCTACAAATGCAGGCAGA | AGG | chr1 | 55043256 | 55043275 | 55043259 | - |
| SEQ ID NO 45102 | CTCTACAAATGCAGGCAGAA | GGG | chr1 | 55043255 | 55043274 | 55043258 | - |
| SEQ ID NO 45103 | TGCAGGCAGAAGGGATGACT | AAG | chr1 | 55043246 | 55043265 | 55043249 | - |
| SEQ ID NO 45104 | GGCAGAAGGGATGACTAAGT | GAG | chr1 | 55043242 | 55043261 | 55043245 | - |
| SEQ ID NO 45105 | AAGGGATGACTAAGTGAGCA | AAG | chr1 | 55043237 | 55043256 | 55043240 | - |
| SEQ ID NO 45106 | AGGGATGACTAAGTGAGCAA | AGG | chr1 | 55043236 | 55043255 | 55043239 | - |
| SEQ ID NO 45107 | AGCAAAGGCAACACTTCTTA | AAG | chr1 | 55043221 | 55043240 | 55043224 | - |
| SEQ ID NO 45108 | CAAAGGCAACACTTCTTAAA | GAG | chr1 | 55043219 | 55043238 | 55043222 | - |
| SEQ ID NO 45109 | AAGGCAACACTTCTTAAAGA | GAG | chr1 | 55043217 | 55043236 | 55043220 | - |
| SEQ ID NO 45110 | GGCAACACTTCTTAAAGAGA | GAG | chr1 | 55043215 | 55043234 | 55043218 | - |
| SEQ ID NO 45111 | CACTTCTTAAAGAGAGAGAA | AAG | chr1 | 55043210 | 55043229 | 55043213 | - |
| SEQ ID NO 45112 | CTTAAAGAGAGAGAAAAGTC | AAG | chr1 | 55043205 | 55043224 | 55043208 | - |
| SEQ ID NO 45113 | TTAAAGAGAGAGAAAAGTCA | AGG | chr1 | 55043204 | 55043223 | 55043207 | - |
| SEQ ID NO 45114 | AAAAGTCAAGGCCACTGTCT | TAG | chr1 | 55043192 | 55043211 | 55043195 | - |
| SEQ ID NO 45115 | TCCTTTTGTGTTGCTATATA | AAG | chr1 | 55043169 | 55043188 | 55043172 | - |
| SEQ ID NO 45116 | CCTTTTGTGTTGCTATATAA | AGG | chr1 | 55043168 | 55043187 | 55043171 | - |
| SEQ ID NO 45117 | GCTATATAAAGGAATACCTG | AAG | chr1 | 55043157 | 55043176 | 55043160 | - |

Figure 61 (Cont'd)

| SEQ ID NO 45118 | CTATATAAAGGAATACCTGA | AGG | chr1 | 55043156 | 55043175 | 55043159 | - |
| --- | --- | --- | --- | --- | --- | --- | --- |
| SEQ ID NO 45119 | ATAAAGGAATACCTGAAGGT | GAG | chr1 | 55043152 | 55043171 | 55043155 | - |
| SEQ ID NO 45120 | CCTGAAGGTGAGTAATTTAC | AAG | chr1 | 55043141 | 55043160 | 55043144 | - |
| SEQ ID NO 45121 | CTGAAGGTGAGTAATTTACA | AGG | chr1 | 55043140 | 55043159 | 55043143 | - |
| SEQ ID NO 45122 | GGTGAGTAATTTACAAGGAA | AAG | chr1 | 55043135 | 55043154 | 55043138 | - |
| SEQ ID NO 45123 | GTGAGTAATTTACAAGGAAA | AGG | chr1 | 55043134 | 55043153 | 55043137 | - |
| SEQ ID NO 45124 | TGAGTAATTTACAAGGAAAA | GGG | chr1 | 55043133 | 55043152 | 55043136 | - |
| SEQ ID NO 45125 | ACAAGGAAAAGGGATTTATT | CAG | chr1 | 55043123 | 55043142 | 55043126 | - |
| SEQ ID NO 45126 | TATTCAGCTCATGATTCTGC | AAG | chr1 | 55043107 | 55043126 | 55043110 | - |
| SEQ ID NO 45127 | TCATGATTCTGCAAGCTCTC | CAG | chr1 | 55043099 | 55043118 | 55043102 | - |
| SEQ ID NO 45128 | CATGATTCTGCAAGCTCTCC | AGG | chr1 | 55043098 | 55043117 | 55043101 | - |
| SEQ ID NO 45129 | GATTCTGCAAGCTCTCCAGG | AAG | chr1 | 55043095 | 55043114 | 55043098 | - |
| SEQ ID NO 45130 | TGCAAGCTCTCCAGGAAGCA | TGG | chr1 | 55043090 | 55043109 | 55043093 | - |
| SEQ ID NO 45131 | CTCTCCAGGAAGCATGGCAC | CAG | chr1 | 55043084 | 55043103 | 55043087 | - |
| SEQ ID NO 45132 | ATGGCACCAGCATCTGCTTC | TGG | chr1 | 55043071 | 55043090 | 55043074 | - |
| SEQ ID NO 45133 | CACCAGCATCTGCTTCTGGT | GAG | chr1 | 55043067 | 55043086 | 55043070 | - |
| SEQ ID NO 45134 | ACCAGCATCTGCTTCTGGTG | AGG | chr1 | 55043066 | 55043085 | 55043069 | - |
| SEQ ID NO 45135 | CCAGCATCTGCTTCTGGTGA | GGG | chr1 | 55043065 | 55043084 | 55043068 | - |
| SEQ ID NO 45136 | CTGCTTCTGGTGAGGGCCTT | AAG | chr1 | 55043058 | 55043077 | 55043061 | - |
| SEQ ID NO 45137 | CCTTAAGCTGCTTTCACTGA | TGG | chr1 | 55043042 | 55043061 | 55043045 | - |
| SEQ ID NO 45138 | TAAGCTGCTTTCACTGATGG | CAG | chr1 | 55043039 | 55043058 | 55043042 | - |
| SEQ ID NO 45139 | GCTGCTTTCACTGATGGCAG | AAG | chr1 | 55043036 | 55043055 | 55043039 | - |
| SEQ ID NO 45140 | CTGCTTTCACTGATGGCAGA | AGG | chr1 | 55043035 | 55043054 | 55043038 | - |
| SEQ ID NO 45141 | TTCACTGATGGCAGAAGGTG | AAG | chr1 | 55043030 | 55043049 | 55043033 | - |
| SEQ ID NO 45142 | TCACTGATGGCAGAAGGTGA | AGG | chr1 | 55043029 | 55043048 | 55043032 | - |
| SEQ ID NO 45143 | CACTGATGGCAGAAGGTGAA | GGG | chr1 | 55043028 | 55043047 | 55043031 | - |
| SEQ ID NO 45144 | ACTGATGGCAGAAGGTGAAG | GGG | chr1 | 55043027 | 55043046 | 55043030 | - |
| SEQ ID NO 45145 | TGATGGCAGAAGGTGAAGGG | GAG | chr1 | 55043025 | 55043044 | 55043028 | - |
| SEQ ID NO 45146 | TGAAGGGGAGCCTACATGTG | CAG | chr1 | 55043012 | 55043031 | 55043015 | - |
| SEQ ID NO 45147 | AAGGGGAGCCTACATGTGCA | GAG | chr1 | 55043010 | 55043029 | 55043013 | - |
| SEQ ID NO 45148 | ATGTGCAGAGATCAATCACA | TGG | chr1 | 55042997 | 55043016 | 55043000 | - |
| SEQ ID NO 45149 | GCAGAGATCAATCACATGGC | AAG | chr1 | 55042993 | 55043012 | 55042996 | - |
| SEQ ID NO 45150 | AGAGATCAATCACATGGCAA | GAG | chr1 | 55042991 | 55043010 | 55042994 | - |
| SEQ ID NO 45151 | GATCAATCACATGGCAAGAG | AAG | chr1 | 55042988 | 55043007 | 55042991 | - |
| SEQ ID NO 45152 | CAATCACATGGCAAGAGAAG | AAG | chr1 | 55042985 | 55043004 | 55042988 | - |
| SEQ ID NO 45153 | CACATGGCAAGAGAAGAAGC | AAG | chr1 | 55042981 | 55043000 | 55042984 | - |
| SEQ ID NO 45154 | CATGGCAAGAGAAGAAGCAA | GAG | chr1 | 55042979 | 55042998 | 55042982 | - |
| SEQ ID NO 45155 | TGGCAAGAGAAGAAGCAAGA | GAG | chr1 | 55042977 | 55042996 | 55042980 | - |
| SEQ ID NO 45156 | CAAGAGAAGAAGCAAGAGAG | AAG | chr1 | 55042974 | 55042993 | 55042977 | - |
| SEQ ID NO 45157 | AGAGAAGAAGCAAGAGAGAA | GAG | chr1 | 55042972 | 55042991 | 55042975 | - |
| SEQ ID NO 45158 | AGAAGAAGCAAGAGAGAAGA | GAG | chr1 | 55042970 | 55042989 | 55042973 | - |
| SEQ ID NO 45159 | GAAGAAGCAAGAGAGAAGAG | AGG | chr1 | 55042969 | 55042988 | 55042972 | - |
| SEQ ID NO 45160 | AAGAAGCAAGAGAGAAGAGA | GGG | chr1 | 55042968 | 55042987 | 55042971 | - |
| SEQ ID NO 45161 | GAAGCAAGAGAGAAGAGAGG | GAG | chr1 | 55042966 | 55042985 | 55042969 | - |
| SEQ ID NO 45162 | AAGCAAGAGAGAAGAGAGGG | AGG | chr1 | 55042965 | 55042984 | 55042968 | - |
| SEQ ID NO 45163 | AGAGAAGAGAGGGAGGTGCC | AAG | chr1 | 55042958 | 55042977 | 55042961 | - |
| SEQ ID NO 45164 | GCCAAGCTCTTTTTAATAAT | CAG | chr1 | 55042941 | 55042960 | 55042944 | - |

Figure 61 (Cont'd)

| SEQ ID NO 45165 | CTTTTTAATAATCAGCCTTC | AAG | chr1 | 55042933 | 55042952 | 55042936 | - |
| SEQ ID NO 45166 | TTTTTAATAATCAGCCTTCA | AGG | chr1 | 55042932 | 55042951 | 55042935 | - |
| SEQ ID NO 45167 | TTTTAATAATCAGCCTTCAA | GGG | chr1 | 55042931 | 55042950 | 55042934 | - |
| SEQ ID NO 45168 | TCAGCCTTCAAGGGAAATCA | TAG | chr1 | 55042922 | 55042941 | 55042925 | - |
| SEQ ID NO 45169 | GCCTTCAAGGGAAATCATAG | CGG | chr1 | 55042919 | 55042938 | 55042922 | - |
| SEQ ID NO 45170 | CCTTCAAGGGAAATCATAGC | GGG | chr1 | 55042918 | 55042937 | 55042921 | - |
| SEQ ID NO 45171 | TTCAAGGGAAATCATAGCGG | GAG | chr1 | 55042916 | 55042935 | 55042919 | - |
| SEQ ID NO 45172 | GAGAACTTACTCATTATCAC | AAG | chr1 | 55042896 | 55042915 | 55042899 | - |
| SEQ ID NO 45173 | AGAACTTACTCATTATCACA | AGG | chr1 | 55042895 | 55042914 | 55042898 | - |
| SEQ ID NO 45174 | CTTACTCATTATCACAAGGA | CGG | chr1 | 55042891 | 55042910 | 55042894 | - |
| SEQ ID NO 45175 | ATTATCACAAGGACGGCACC | AAG | chr1 | 55042884 | 55042903 | 55042887 | - |
| SEQ ID NO 45176 | GGACGGCACCAAGCCTTTCA | CAG | chr1 | 55042874 | 55042893 | 55042877 | - |
| SEQ ID NO 45177 | GACGGCACCAAGCCTTTCAC | AGG | chr1 | 55042873 | 55042892 | 55042876 | - |
| SEQ ID NO 45178 | ACGGCACCAAGCCTTTCACA | GGG | chr1 | 55042872 | 55042891 | 55042875 | - |
| SEQ ID NO 45179 | CGGCACCAAGCCTTTCACAG | GGG | chr1 | 55042871 | 55042890 | 55042874 | - |
| SEQ ID NO 45180 | ATGACCCAAACACCTCCCAT | TAG | chr1 | 55042838 | 55042857 | 55042841 | - |
| SEQ ID NO 45181 | TGACCCAAACACCTCCCATT | AGG | chr1 | 55042837 | 55042856 | 55042840 | - |
| SEQ ID NO 45182 | TAGGCCCCACTTCCAACACT | GAG | chr1 | 55042818 | 55042837 | 55042821 | - |
| SEQ ID NO 45183 | AGGCCCCACTTCCAACACTG | AGG | chr1 | 55042817 | 55042836 | 55042820 | - |
| SEQ ID NO 45184 | TGAGGACCAAATTTCCACAT | GAG | chr1 | 55042799 | 55042818 | 55042802 | - |
| SEQ ID NO 45185 | CCAAATTTCCACATGAGATT | TGG | chr1 | 55042793 | 55042812 | 55042796 | - |
| SEQ ID NO 45186 | AAATTTCCACATGAGATTTG | GAG | chr1 | 55042791 | 55042810 | 55042794 | - |
| SEQ ID NO 45187 | AATTTCCACATGAGATTTGG | AGG | chr1 | 55042790 | 55042809 | 55042793 | - |
| SEQ ID NO 45188 | ATTTCCACATGAGATTTGGA | GGG | chr1 | 55042789 | 55042808 | 55042792 | - |
| SEQ ID NO 45189 | TTTCCACATGAGATTTGGAG | GGG | chr1 | 55042788 | 55042807 | 55042791 | - |
| SEQ ID NO 45190 | TGGAGGGACAAACAAATTA | TAG | chr1 | 55042773 | 55042792 | 55042776 | - |
| SEQ ID NO 45191 | AGGGGACAAACAAATTATAG | CAG | chr1 | 55042770 | 55042789 | 55042773 | - |
| SEQ ID NO 45192 | ATTATAGCAGCCACTATCTA | TGG | chr1 | 55042757 | 55042776 | 55042760 | - |
| SEQ ID NO 45193 | ACTATCTATGGTGATTTGTT | TGG | chr1 | 55042745 | 55042764 | 55042748 | - |
| SEQ ID NO 45194 | ATGGTGATTTGTTTGGTTTT | TAG | chr1 | 55042738 | 55042757 | 55042741 | - |
| SEQ ID NO 45195 | TTGTCTGCTCCAACTGCTCT | CAG | chr1 | 55042712 | 55042731 | 55042715 | - |
| SEQ ID NO 45196 | TGTCTGCTCCAACTGCTCTC | AGG | chr1 | 55042711 | 55042730 | 55042714 | - |
| SEQ ID NO 45197 | CTGCTCCAACTGCTCTCAGG | CAG | chr1 | 55042708 | 55042727 | 55042711 | - |
| SEQ ID NO 45198 | TCAGGCAGACATACCTGCTT | AAG | chr1 | 55042693 | 55042712 | 55042696 | - |
| SEQ ID NO 45199 | ACCTGCTTAAGAACCTTCAC | TGG | chr1 | 55042681 | 55042700 | 55042684 | - |
| SEQ ID NO 45200 | GAACCTTCACTGGCTCCCCA | CAG | chr1 | 55042671 | 55042690 | 55042674 | - |
| SEQ ID NO 45201 | TCCCCACAGCCTCATGAATC | AAG | chr1 | 55042657 | 55042676 | 55042660 | - |
| SEQ ID NO 45202 | CCAAACTCCATGCTCCTCCT | TGG | chr1 | 55042633 | 55042652 | 55042636 | - |
| SEQ ID NO 45203 | CCCTACCTCAACCTACCTTG | CAG | chr1 | 55042609 | 55042628 | 55042612 | - |
| SEQ ID NO 45204 | ATCTCTGTATATATGCATCT | TGG | chr1 | 55042573 | 55042592 | 55042576 | - |
| SEQ ID NO 45205 | TATATATGCATCTTGGACTC | CAG | chr1 | 55042566 | 55042585 | 55042569 | - |
| SEQ ID NO 45206 | TATGCATCTTGGACTCCAGT | CAG | chr1 | 55042562 | 55042581 | 55042565 | - |
| SEQ ID NO 45207 | TGCATCTTGGACTCCAGTCA | GAG | chr1 | 55042560 | 55042579 | 55042563 | - |
| SEQ ID NO 45208 | ATCTTGGACTCCAGTCAGAG | TAG | chr1 | 55042557 | 55042576 | 55042560 | - |
| SEQ ID NO 45209 | GGACTCCAGTCAGAGTAGAA | CAG | chr1 | 55042552 | 55042571 | 55042555 | - |
| SEQ ID NO 45210 | ACTCCAGTCAGAGTAGAACA | GAG | chr1 | 55042550 | 55042569 | 55042553 | - |
| SEQ ID NO 45211 | GAGTCCACCCCCTTTACCCA | AAG | chr1 | 55042530 | 55042549 | 55042533 | - |

Figure 61 (Cont'd)

| SEQ ID NO 45212 | ACCCCCTTTACCCAAAGCCT | TAG | chr1 | 55042524 | 55042543 | 55042527 | - |
| SEQ ID NO 45213 | CCCCCTTTACCCAAAGCCTT | AGG | chr1 | 55042523 | 55042542 | 55042526 | - |
| SEQ ID NO 45214 | CCCCTTTACCCAAAGCCTTA | GGG | chr1 | 55042522 | 55042541 | 55042525 | - |
| SEQ ID NO 45215 | CCAAAGCCTTAGGGCCAAAA | CGG | chr1 | 55042513 | 55042532 | 55042516 | - |
| SEQ ID NO 45216 | GCCAAAACGGTTTTGAACCT | CAG | chr1 | 55042500 | 55042519 | 55042503 | - |
| SEQ ID NO 45217 | TTTGAACCTCAGAACTTGTT | TGG | chr1 | 55042489 | 55042508 | 55042492 | - |
| SEQ ID NO 45218 | CTCAGAACTTGTTTGGATTT | TAG | chr1 | 55042482 | 55042501 | 55042485 | - |
| SEQ ID NO 45219 | GAACTTGTTTGGATTTTAGA | AAG | chr1 | 55042478 | 55042497 | 55042481 | - |
| SEQ ID NO 45220 | AACTTGTTTGGATTTTAGAA | AGG | chr1 | 55042477 | 55042496 | 55042480 | - |
| SEQ ID NO 45221 | TTGTTTGGATTTTAGAAAGG | CAG | chr1 | 55042474 | 55042493 | 55042477 | - |
| SEQ ID NO 45222 | GGATTTTAGAAAGGCAGTAA | TGG | chr1 | 55042468 | 55042487 | 55042471 | - |
| SEQ ID NO 45223 | GATTTTAGAAAGGCAGTAAT | GGG | chr1 | 55042467 | 55042486 | 55042470 | - |
| SEQ ID NO 45224 | GAAAGGCAGTAATGGGCAAT | CAG | chr1 | 55042460 | 55042479 | 55042463 | - |
| SEQ ID NO 45225 | AAGGCAGTAATGGGCAATCA | GAG | chr1 | 55042458 | 55042477 | 55042461 | - |
| SEQ ID NO 45226 | ATGGGCAATCAGAGTCTGCT | TGG | chr1 | 55042449 | 55042468 | 55042452 | - |
| SEQ ID NO 45227 | GGCAATCAGAGTCTGCTTGG | AAG | chr1 | 55042446 | 55042465 | 55042449 | - |
| SEQ ID NO 45228 | AGAGTCTGCTTGGAAGAATC | TGG | chr1 | 55042439 | 55042458 | 55042442 | - |
| SEQ ID NO 45229 | AGTCTGCTTGGAAGAATCTG | GAG | chr1 | 55042437 | 55042456 | 55042440 | - |
| SEQ ID NO 45230 | GCTGCATACTGTAATCTATG | CAG | chr1 | 55042415 | 55042434 | 55042418 | - |
| SEQ ID NO 45231 | AATTAAAAATAATCTCATGT | CAG | chr1 | 55042359 | 55042378 | 55042362 | - |
| SEQ ID NO 45232 | AATCTCATGTCAGTTCACGT | CAG | chr1 | 55042349 | 55042368 | 55042352 | - |
| SEQ ID NO 45233 | ATCTCATGTCAGTTCACGTC | AGG | chr1 | 55042348 | 55042367 | 55042351 | - |
| SEQ ID NO 45234 | TAAATCACAAAAAAAACTTT | TGG | chr1 | 55042312 | 55042331 | 55042315 | - |
| SEQ ID NO 45235 | TTTCGTAACATTTTACATTT | CAG | chr1 | 55042288 | 55042307 | 55042291 | - |
| SEQ ID NO 45236 | GTAACATTTTACATTTCAGA | CGG | chr1 | 55042284 | 55042303 | 55042287 | - |
| SEQ ID NO 45237 | ACATTTTACATTTCAGACGG | TGG | chr1 | 55042281 | 55042300 | 55042284 | - |
| SEQ ID NO 45238 | TACATTTCAGACGGTGGATA | AAG | chr1 | 55042275 | 55042294 | 55042278 | - |
| SEQ ID NO 45239 | AGACGGTGGATAAAGAACTG | TGG | chr1 | 55042267 | 55042286 | 55042270 | - |
| SEQ ID NO 45240 | ACGGTGGATAAAGAACTGTG | GAG | chr1 | 55042265 | 55042284 | 55042268 | - |
| SEQ ID NO 45241 | CGGTGGATAAAGAACTGTGG | AGG | chr1 | 55042264 | 55042283 | 55042267 | - |
| SEQ ID NO 45242 | GGATAAAGAACTGTGGAGGC | CAG | chr1 | 55042260 | 55042279 | 55042263 | - |
| SEQ ID NO 45243 | GATAAAGAACTGTGGAGGCC | AGG | chr1 | 55042259 | 55042278 | 55042262 | - |
| SEQ ID NO 45244 | AGAACTGTGGAGGCCAGGCG | TGG | chr1 | 55042254 | 55042273 | 55042257 | - |
| SEQ ID NO 45245 | ACTGTGGAGGCCAGGCGTGG | TGG | chr1 | 55042251 | 55042270 | 55042254 | - |
| SEQ ID NO 45246 | GTGGCTCACACCTGTAATTC | GAG | chr1 | 55042232 | 55042251 | 55042235 | - |
| SEQ ID NO 45247 | CACCTGTAATTCGAGCACTT | TGG | chr1 | 55042224 | 55042243 | 55042227 | - |
| SEQ ID NO 45248 | ACCTGTAATTCGAGCACTTT | GGG | chr1 | 55042223 | 55042242 | 55042226 | - |
| SEQ ID NO 45249 | CTGTAATTCGAGCACTTTGG | GAG | chr1 | 55042221 | 55042240 | 55042224 | - |
| SEQ ID NO 45250 | TGTAATTCGAGCACTTTGGG | AGG | chr1 | 55042220 | 55042239 | 55042223 | - |
| SEQ ID NO 45251 | TTCGAGCACTTTGGGAGGCT | GAG | chr1 | 55042215 | 55042234 | 55042218 | - |
| SEQ ID NO 45252 | TCGAGCACTTTGGGAGGCTG | AGG | chr1 | 55042214 | 55042233 | 55042217 | - |
| SEQ ID NO 45253 | AGCACTTTGGGAGGCTGAGG | CGG | chr1 | 55042211 | 55042230 | 55042214 | - |
| SEQ ID NO 45254 | GCACTTTGGGAGGCTGAGGC | GGG | chr1 | 55042210 | 55042229 | 55042213 | - |
| SEQ ID NO 45255 | ACTTTGGGAGGCTGAGGCGG | GAG | chr1 | 55042208 | 55042227 | 55042211 | - |
| SEQ ID NO 45256 | CTTTGGGAGGCTGAGGCGGG | AGG | chr1 | 55042207 | 55042226 | 55042210 | - |
| SEQ ID NO 45257 | AGGCGGGAGGATCACCTCCT | CGG | chr1 | 55042194 | 55042213 | 55042197 | - |
| SEQ ID NO 45258 | ATCACCTCCTCGGATCCACT | GAG | chr1 | 55042184 | 55042203 | 55042187 | - |

Figure 61 (Cont'd)

| SEQ ID NO 45259 | TCACCTCCTCGGATCCACTG | AGG | chr1 | 55042183 | 55042202 | 55042186 | - |
| SEQ ID NO 45260 | ACCTCCTCGGATCCACTGAG | GAG | chr1 | 55042181 | 55042200 | 55042184 | - |
| SEQ ID NO 45261 | CCTCCTCGGATCCACTGAGG | AGG | chr1 | 55042180 | 55042199 | 55042183 | - |
| SEQ ID NO 45262 | CTCGGATCCACTGAGGAGGT | CAG | chr1 | 55042176 | 55042195 | 55042179 | - |
| SEQ ID NO 45263 | TCGGATCCACTGAGGAGGTC | AGG | chr1 | 55042175 | 55042194 | 55042178 | - |
| SEQ ID NO 45264 | GGATCCACTGAGGAGGTCAG | GAG | chr1 | 55042173 | 55042192 | 55042176 | - |
| SEQ ID NO 45265 | GGAGGTCAGGAGTTTGCGAC | TAG | chr1 | 55042162 | 55042181 | 55042165 | - |
| SEQ ID NO 45266 | TCAGGAGTTTGCGACTAGCC | TGG | chr1 | 55042157 | 55042176 | 55042160 | - |
| SEQ ID NO 45267 | TGCGACTAGCCTGGCCAACG | TGG | chr1 | 55042148 | 55042167 | 55042151 | - |
| SEQ ID NO 45268 | TCTACTAAAAATACAAAAAT | TAG | chr1 | 55042113 | 55042132 | 55042116 | - |
| SEQ ID NO 45269 | CTAAAAATACAAAAATTAGC | CGG | chr1 | 55042109 | 55042128 | 55042112 | - |
| SEQ ID NO 45270 | TAAAAATACAAAAATTAGCC | GGG | chr1 | 55042108 | 55042127 | 55042111 | - |
| SEQ ID NO 45271 | ATACAAAAATTAGCCGGGCG | TGG | chr1 | 55042103 | 55042122 | 55042106 | - |
| SEQ ID NO 45272 | CAAAAATTAGCCGGGCGTGG | TGG | chr1 | 55042100 | 55042119 | 55042103 | - |
| SEQ ID NO 45273 | AAATTAGCCGGGCGTGGTGG | CAG | chr1 | 55042097 | 55042116 | 55042100 | - |
| SEQ ID NO 45274 | AATTAGCCGGGCGTGGTGGC | AGG | chr1 | 55042096 | 55042115 | 55042099 | - |
| SEQ ID NO 45275 | GTGGCAGGTACCTGTAATCC | CAG | chr1 | 55042081 | 55042100 | 55042084 | - |
| SEQ ID NO 45276 | TACCTGTAATCCCAGCTTCT | TGG | chr1 | 55042073 | 55042092 | 55042076 | - |
| SEQ ID NO 45277 | ACCTGTAATCCCAGCTTCTT | GGG | chr1 | 55042072 | 55042091 | 55042075 | - |
| SEQ ID NO 45278 | CTGTAATCCCAGCTTCTTGG | GAG | chr1 | 55042070 | 55042089 | 55042073 | - |
| SEQ ID NO 45279 | TGTAATCCCAGCTTCTTGGG | AGG | chr1 | 55042069 | 55042088 | 55042072 | - |
| SEQ ID NO 45280 | TCCCAGCTTCTTGGGAGGCT | GAG | chr1 | 55042064 | 55042083 | 55042067 | - |
| SEQ ID NO 45281 | CCCAGCTTCTTGGGAGGCTG | AGG | chr1 | 55042063 | 55042082 | 55042066 | - |
| SEQ ID NO 45282 | AGCTTCTTGGGAGGCTGAGG | CAG | chr1 | 55042060 | 55042079 | 55042063 | - |
| SEQ ID NO 45283 | GCTTCTTGGGAGGCTGAGGC | AGG | chr1 | 55042059 | 55042078 | 55042062 | - |
| SEQ ID NO 45284 | TTCTTGGGAGGCTGAGGCAG | GAG | chr1 | 55042057 | 55042076 | 55042060 | - |
| SEQ ID NO 45285 | GCAGGAGAACCACTTGAACC | CGG | chr1 | 55042041 | 55042060 | 55042044 | - |
| SEQ ID NO 45286 | CAGGAGAACCACTTGAACCC | GGG | chr1 | 55042040 | 55042059 | 55042043 | - |
| SEQ ID NO 45287 | GGAGAACCACTTGAACCCGG | GAG | chr1 | 55042038 | 55042057 | 55042041 | - |
| SEQ ID NO 45288 | AACCACTTGAACCCGGGAGA | CAG | chr1 | 55042034 | 55042053 | 55042037 | - |
| SEQ ID NO 45289 | AACCCGGGAGACAGATGTTG | CAG | chr1 | 55042025 | 55042044 | 55042028 | - |
| SEQ ID NO 45290 | CGGGAGACAGATGTTGCAGT | GAG | chr1 | 55042021 | 55042040 | 55042024 | - |
| SEQ ID NO 45291 | GACAGATGTTGCAGTGAGCT | GAG | chr1 | 55042016 | 55042035 | 55042019 | - |
| SEQ ID NO 45292 | GAGACTGCACCATTGCACTC | CAG | chr1 | 55041996 | 55042015 | 55041999 | - |
| SEQ ID NO 45293 | TGCACCATTGCACTCCAGCC | TGG | chr1 | 55041991 | 55042010 | 55041994 | - |
| SEQ ID NO 45294 | GCACCATTGCACTCCAGCCT | GGG | chr1 | 55041990 | 55042009 | 55041993 | - |
| SEQ ID NO 45295 | TGCACTCCAGCCTGGGCAAC | AAG | chr1 | 55041983 | 55042002 | 55041986 | - |
| SEQ ID NO 45296 | CACTCCAGCCTGGGCAACAA | GAG | chr1 | 55041981 | 55042000 | 55041984 | - |
| SEQ ID NO 45297 | AAACTCCATCTCAAAAAAAA | AAG | chr1 | 55041956 | 55041975 | 55041959 | - |
| SEQ ID NO 45298 | CATCTCAAAAAAAAAAGAAA | AAG | chr1 | 55041950 | 55041969 | 55041953 | - |
| SEQ ID NO 45299 | AAAAAAAGAAAAAGAACTG | TGG | chr1 | 55041942 | 55041961 | 55041945 | - |
| SEQ ID NO 45300 | TGCTCCTTATCTTCCACCTC | TGG | chr1 | 55041914 | 55041933 | 55041917 | - |
| SEQ ID NO 45301 | TCTTCCACCTCTGGTTTTCC | CAG | chr1 | 55041905 | 55041924 | 55041908 | - |
| SEQ ID NO 45302 | CAGCTCTGTATCTTTGTTCA | TGG | chr1 | 55041885 | 55041904 | 55041888 | - |
| SEQ ID NO 45303 | TTCATGGTACCTCCTAATCC | TAG | chr1 | 55041869 | 55041888 | 55041872 | - |
| SEQ ID NO 45304 | GAACTCCTACTAATGCTTCA | AAG | chr1 | 55041817 | 55041836 | 55041820 | - |
| SEQ ID NO 45305 | TAAATAAAAATTGAATGAAT | TGG | chr1 | 55041771 | 55041790 | 55041774 | - |

Figure 61 (Cont'd)

| SEQ ID NO 45306 | AAATAAAAATTGAATGAATT | GGG | chr1 | 55041770 | 55041789 | 55041773 | - |
| SEQ ID NO 45307 | ATAAAAATTGAATGAATTGG | GAG | chr1 | 55041768 | 55041787 | 55041771 | - |
| SEQ ID NO 45308 | AAAAATTGAATGAATTGGGA | GAG | chr1 | 55041766 | 55041785 | 55041769 | - |
| SEQ ID NO 45309 | AATTGGGAGAGTACTCTGTG | CAG | chr1 | 55041754 | 55041773 | 55041757 | - |
| SEQ ID NO 45310 | TGGGAGAGTACTCTGTGCAG | TGG | chr1 | 55041751 | 55041770 | 55041754 | - |
| SEQ ID NO 45311 | GGAGAGTACTCTGTGCAGTG | GAG | chr1 | 55041749 | 55041768 | 55041752 | - |
| SEQ ID NO 45312 | TACTCTGTGCAGTGGAGTGT | CAG | chr1 | 55041743 | 55041762 | 55041746 | - |
| SEQ ID NO 45313 | GTGCAGTGGAGTGTCAGTTC | TGG | chr1 | 55041737 | 55041756 | 55041740 | - |
| SEQ ID NO 45314 | GAGTGTCAGTTCTGGAAACC | CAG | chr1 | 55041729 | 55041748 | 55041732 | - |
| SEQ ID NO 45315 | AAACCCAGTTCTAATGCACC | TGG | chr1 | 55041714 | 55041733 | 55041717 | - |
| SEQ ID NO 45316 | AACCCAGTTCTAATGCACCT | GGG | chr1 | 55041713 | 55041732 | 55041716 | - |
| SEQ ID NO 45317 | ACCCAGTTCTAATGCACCTG | GGG | chr1 | 55041712 | 55041731 | 55041715 | - |
| SEQ ID NO 45318 | CTGGGGTGACCTCCTCTCTC | TGG | chr1 | 55041695 | 55041714 | 55041698 | - |
| SEQ ID NO 45319 | TGGGGTGACCTCCTCTCTCT | GGG | chr1 | 55041694 | 55041713 | 55041697 | - |
| SEQ ID NO 45320 | GACCTCCTCTCTGGGCCT | CAG | chr1 | 55041688 | 55041707 | 55041691 | - |
| SEQ ID NO 45321 | CCTCAGTTTCTCATGACTAA | AAG | chr1 | 55041671 | 55041690 | 55041674 | - |
| SEQ ID NO 45322 | GTTTCTCATGACTAAAAGAA | AAG | chr1 | 55041666 | 55041685 | 55041669 | - |
| SEQ ID NO 45323 | TTTCTCATGACTAAAAGAAA | AGG | chr1 | 55041665 | 55041684 | 55041668 | - |
| SEQ ID NO 45324 | CATGACTAAAGAAAAGGAT | TGG | chr1 | 55041660 | 55041679 | 55041663 | - |
| SEQ ID NO 45325 | ATGAATGAATAAATGAACTT | GAG | chr1 | 55041566 | 55041585 | 55041569 | - |
| SEQ ID NO 45326 | TGAATGAATAAATGAACTTG | AGG | chr1 | 55041565 | 55041584 | 55041568 | - |
| SEQ ID NO 45327 | AATGAATAAATGAACTTGAG | GAG | chr1 | 55041563 | 55041582 | 55041566 | - |
| SEQ ID NO 45328 | ATGAATAAATGAACTTGAGG | AGG | chr1 | 55041562 | 55041581 | 55041565 | - |
| SEQ ID NO 45329 | CTCCTGTTCCAAACTTCCAC | CAG | chr1 | 55041539 | 55041558 | 55041542 | - |
| SEQ ID NO 45330 | CCTGTTCCAAACTTCCACCA | GAG | chr1 | 55041537 | 55041556 | 55041540 | - |
| SEQ ID NO 45331 | GTTCCAAACTTCCACCAGAG | AAG | chr1 | 55041534 | 55041553 | 55041537 | - |
| SEQ ID NO 45332 | ACCAGAGAAGAAACATCCTC | AAG | chr1 | 55041521 | 55041540 | 55041524 | - |
| SEQ ID NO 45333 | CCAGAGAAGAAACATCCTCA | AGG | chr1 | 55041520 | 55041539 | 55041523 | - |
| SEQ ID NO 45334 | CAGAGAAGAAACATCCTCAA | GGG | chr1 | 55041519 | 55041538 | 55041522 | - |
| SEQ ID NO 45335 | AAGAAACATCCTCAAGGGCT | TGG | chr1 | 55041514 | 55041533 | 55041517 | - |
| SEQ ID NO 45336 | ACATCCTCAAGGGCTTGGTT | CAG | chr1 | 55041509 | 55041528 | 55041512 | - |
| SEQ ID NO 45337 | CATCCTCAAGGGCTTGGTTC | AGG | chr1 | 55041508 | 55041527 | 55041511 | - |
| SEQ ID NO 45338 | CCTCAAGGGCTTGGTTCAGG | TGG | chr1 | 55041505 | 55041524 | 55041508 | - |
| SEQ ID NO 45339 | GCTTGGTTCAGGTGGTCATA | CAG | chr1 | 55041497 | 55041516 | 55041500 | - |
| SEQ ID NO 45340 | GCCTCTGCTTACTCACCTCT | CAG | chr1 | 55041475 | 55041494 | 55041478 | - |
| SEQ ID NO 45341 | CCTCTGCTTACTCACCTCTC | AGG | chr1 | 55041474 | 55041493 | 55041477 | - |
| SEQ ID NO 45342 | TGCTTACTCACCTCTCAGGA | TGG | chr1 | 55041470 | 55041489 | 55041473 | - |
| SEQ ID NO 45343 | GCTTACTCACCTCTCAGGAT | GGG | chr1 | 55041469 | 55041488 | 55041472 | - |
| SEQ ID NO 45344 | CTTACTCACCTCTCAGGATG | GGG | chr1 | 55041468 | 55041487 | 55041471 | - |
| SEQ ID NO 45345 | GATGGGTACTCACTATTTC | CAG | chr1 | 55041452 | 55041471 | 55041455 | - |
| SEQ ID NO 45346 | GGTACTCACTATTTCCAGAA | CAG | chr1 | 55041447 | 55041466 | 55041450 | - |
| SEQ ID NO 45347 | TATTTCCAGAACAGTTGTTT | TGG | chr1 | 55041438 | 55041457 | 55041441 | - |
| SEQ ID NO 45348 | TTTCCAGAACAGTTGTTTTG | GAG | chr1 | 55041436 | 55041455 | 55041439 | - |
| SEQ ID NO 45349 | CCAGAACAGTTGTTTTGGAG | CAG | chr1 | 55041433 | 55041452 | 55041436 | - |
| SEQ ID NO 45350 | GAACAGTTGTTTTGGAGCAG | TGG | chr1 | 55041430 | 55041449 | 55041433 | - |
| SEQ ID NO 45351 | TGAAATGCCCTTTCTTATCC | TGG | chr1 | 55041402 | 55041421 | 55041405 | - |
| SEQ ID NO 45352 | ACAACCCCACAACATCCCTC | GAG | chr1 | 55041377 | 55041396 | 55041380 | - |

Figure 61 (Cont'd)

| SEQ ID NO 45353 | CCCCACAACATCCCTCGAGA | AAG | chr1 | 55041373 | 55041392 | 55041376 | - |
| SEQ ID NO 45354 | AACATCCCTCGAGAAAGTCA | AAG | chr1 | 55041367 | 55041386 | 55041370 | - |
| SEQ ID NO 45355 | ACATCCCTCGAGAAAGTCAA | AGG | chr1 | 55041366 | 55041385 | 55041369 | - |
| SEQ ID NO 45356 | CCTCGAGAAAGTCAAAGGCT | CAG | chr1 | 55041361 | 55041380 | 55041364 | - |
| SEQ ID NO 45357 | CTCGAGAAAGTCAAAGGCTC | AGG | chr1 | 55041360 | 55041379 | 55041363 | - |
| SEQ ID NO 45358 | TCGAGAAAGTCAAAGGCTCA | GGG | chr1 | 55041359 | 55041378 | 55041362 | - |
| SEQ ID NO 45359 | AAGTCAAAGGCTCAGGGAAC | AAG | chr1 | 55041353 | 55041372 | 55041356 | - |
| SEQ ID NO 45360 | AGTCAAAGGCTCAGGGAACA | AGG | chr1 | 55041352 | 55041371 | 55041355 | - |
| SEQ ID NO 45361 | CAAAGGCTCAGGGAACAAGG | AAG | chr1 | 55041349 | 55041368 | 55041352 | - |
| SEQ ID NO 45362 | AAGGCTCAGGGAACAAGGAA | GAG | chr1 | 55041347 | 55041366 | 55041350 | - |
| SEQ ID NO 45363 | AGGCTCAGGGAACAAGGAAG | AGG | chr1 | 55041346 | 55041365 | 55041349 | - |
| SEQ ID NO 45364 | GGCTCAGGGAACAAGGAAGA | GGG | chr1 | 55041345 | 55041364 | 55041348 | - |
| SEQ ID NO 45365 | ACAAGGAAGAGGGCTATACT | GAG | chr1 | 55041335 | 55041354 | 55041338 | - |
| SEQ ID NO 45366 | GAAGAGGGCTATACTGAGCT | GAG | chr1 | 55041330 | 55041349 | 55041333 | - |
| SEQ ID NO 45367 | AGGGCTATACTGAGCTGAGT | AAG | chr1 | 55041326 | 55041345 | 55041329 | - |
| SEQ ID NO 45368 | GGGCTATACTGAGCTGAGTA | AGG | chr1 | 55041325 | 55041344 | 55041328 | - |
| SEQ ID NO 45369 | GGACTTGCCATCCTGCCACC | CAG | chr1 | 55041304 | 55041323 | 55041307 | - |
| SEQ ID NO 45370 | ATCCTGCCACCCAGCACACT | CAG | chr1 | 55041295 | 55041314 | 55041298 | - |
| SEQ ID NO 45371 | TGCCACCCAGCACACTCAGA | CAG | chr1 | 55041291 | 55041310 | 55041294 | - |
| SEQ ID NO 45372 | CACCCAGCACACTCAGACAG | AAG | chr1 | 55041288 | 55041307 | 55041291 | - |
| SEQ ID NO 45373 | AGCACACTCAGACAGAAGCG | TGG | chr1 | 55041283 | 55041302 | 55041286 | - |
| SEQ ID NO 45374 | GCACACTCAGACAGAAGCGT | GGG | chr1 | 55041282 | 55041301 | 55041285 | - |
| SEQ ID NO 45375 | CACTCAGACAGAAGCGTGGG | CAG | chr1 | 55041279 | 55041298 | 55041282 | - |
| SEQ ID NO 45376 | ACTCAGACAGAAGCGTGGGC | AGG | chr1 | 55041278 | 55041297 | 55041281 | - |
| SEQ ID NO 45377 | CAGACAGAAGCGTGGGCAGG | CAG | chr1 | 55041275 | 55041294 | 55041278 | - |
| SEQ ID NO 45378 | AAGCGTGGGCAGGCAGCTGT | GAG | chr1 | 55041268 | 55041287 | 55041271 | - |
| SEQ ID NO 45379 | CGTGGGCAGGCAGCTGTGAG | TGG | chr1 | 55041265 | 55041284 | 55041268 | - |
| SEQ ID NO 45380 | GGGCAGGCAGCTGTGAGTGG | CAG | chr1 | 55041262 | 55041281 | 55041265 | - |
| SEQ ID NO 45381 | CAGAATTTTCCCCTCTGCCC | CAG | chr1 | 55041242 | 55041261 | 55041245 | - |
| SEQ ID NO 45382 | AGAATTTTCCCCTCTGCCCC | AGG | chr1 | 55041241 | 55041260 | 55041244 | - |
| SEQ ID NO 45383 | AATTTTCCCCTCTGCCCCAG | GAG | chr1 | 55041239 | 55041258 | 55041242 | - |
| SEQ ID NO 45384 | CCCCTCTGCCCCAGGAGCTG | TGG | chr1 | 55041233 | 55041252 | 55041236 | - |
| SEQ ID NO 45385 | CTGCCCCAGGAGCTGTGGTT | TGG | chr1 | 55041228 | 55041247 | 55041231 | - |
| SEQ ID NO 45386 | GCCCCAGGAGCTGTGGTTTG | GAG | chr1 | 55041226 | 55041245 | 55041229 | - |
| SEQ ID NO 45387 | AGGAGCTGTGGTTTGGAGCA | AAG | chr1 | 55041221 | 55041240 | 55041224 | - |
| SEQ ID NO 45388 | AGCAAAGACAATGTCACCAA | CAG | chr1 | 55041205 | 55041224 | 55041208 | - |
| SEQ ID NO 45389 | GCAAAGACAATGTCACCAAC | AGG | chr1 | 55041204 | 55041223 | 55041207 | - |
| SEQ ID NO 45390 | GTCACCAACAGGTCACACTG | CAG | chr1 | 55041193 | 55041212 | 55041196 | - |
| SEQ ID NO 45391 | CCAACAGGTCACACTGCAGA | CAG | chr1 | 55041189 | 55041208 | 55041192 | - |
| SEQ ID NO 45392 | CAACAGGTCACACTGCAGAC | AGG | chr1 | 55041188 | 55041207 | 55041191 | - |
| SEQ ID NO 45393 | AACAGGTCACACTGCAGACA | GGG | chr1 | 55041187 | 55041206 | 55041190 | - |
| SEQ ID NO 45394 | GCAGACAGGGACAAAACTGC | AAG | chr1 | 55041174 | 55041193 | 55041177 | - |
| SEQ ID NO 45395 | AAAACTGCAAGTGATCCCCC | CGG | chr1 | 55041162 | 55041181 | 55041165 | - |
| SEQ ID NO 45396 | AAACTGCAAGTGATCCCCCC | GGG | chr1 | 55041161 | 55041180 | 55041164 | - |
| SEQ ID NO 45397 | AACTGCAAGTGATCCCCCCG | GGG | chr1 | 55041160 | 55041179 | 55041163 | - |
| SEQ ID NO 45398 | CCCCCCGGGGCTTGCATTGT | AAG | chr1 | 55041147 | 55041166 | 55041150 | - |
| SEQ ID NO 45399 | TTGCATTGTAAGTTCACTCA | TGG | chr1 | 55041136 | 55041155 | 55041139 | - |

Figure 61 (Cont'd)

| SEQ ID NO 45400 | GTAAGTTCACTCATGGTCAA | CAG | chr1 | 55041129 | 55041148 | 55041132 | - |
| SEQ ID NO 45401 | TCTCCCCATCTGCTGCCACT | GAG | chr1 | 55041093 | 55041112 | 55041096 | - |
| SEQ ID NO 45402 | CATCTGCTGCCACTGAGCCG | TAG | chr1 | 55041087 | 55041106 | 55041090 | - |
| SEQ ID NO 45403 | ATCTGCTGCCACTGAGCCGT | AGG | chr1 | 55041086 | 55041105 | 55041089 | - |
| SEQ ID NO 45404 | TCTGCTGCCACTGAGCCGTA | GGG | chr1 | 55041085 | 55041104 | 55041088 | - |
| SEQ ID NO 45405 | CGATTGTCACCTCCCTTTTA | AAG | chr1 | 55041061 | 55041080 | 55041064 | - |
| SEQ ID NO 45406 | GTCACCTCCCTTTTAAAGAT | TAG | chr1 | 55041056 | 55041075 | 55041059 | - |
| SEQ ID NO 45407 | TCACCTCCCTTTTAAAGATT | AGG | chr1 | 55041055 | 55041074 | 55041058 | - |
| SEQ ID NO 45408 | CCCTTTTAAAGATTAGGCAA | TGG | chr1 | 55041049 | 55041068 | 55041052 | - |
| SEQ ID NO 45409 | CTTTTAAAGATTAGGCAATG | GAG | chr1 | 55041047 | 55041066 | 55041050 | - |
| SEQ ID NO 45410 | TTTTAAAGATTAGGCAATGG | AGG | chr1 | 55041046 | 55041065 | 55041049 | - |
| SEQ ID NO 45411 | AGATTAGGCAATGGAGGCTC | AAG | chr1 | 55041040 | 55041059 | 55041043 | - |
| SEQ ID NO 45412 | GATTAGGCAATGGAGGCTCA | AGG | chr1 | 55041039 | 55041058 | 55041042 | - |
| SEQ ID NO 45413 | GGCAATGGAGGCTCAAGGAT | AAG | chr1 | 55041034 | 55041053 | 55041037 | - |
| SEQ ID NO 45414 | TCAAGGATAAGTGACTTGTC | AAG | chr1 | 55041022 | 55041041 | 55041025 | - |
| SEQ ID NO 45415 | AAGTGACTTGTCAAGCACCA | CAG | chr1 | 55041014 | 55041033 | 55041017 | - |
| SEQ ID NO 45416 | GACTTGTCAAGCACCACAGC | TAG | chr1 | 55041010 | 55041029 | 55041013 | - |
| SEQ ID NO 45417 | TGTCAAGCACCACAGCTAGT | GAG | chr1 | 55041006 | 55041025 | 55041009 | - |
| SEQ ID NO 45418 | TCAAGCACCACAGCTAGTGA | GAG | chr1 | 55041004 | 55041023 | 55041007 | - |
| SEQ ID NO 45419 | CAAGCACCACAGCTAGTGAG | AGG | chr1 | 55041003 | 55041022 | 55041006 | - |
| SEQ ID NO 45420 | GCACCACAGCTAGTGAGAGG | AAG | chr1 | 55041000 | 55041019 | 55041003 | - |
| SEQ ID NO 45421 | ACAGCTAGTGAGAGGAAGCC | AAG | chr1 | 55040995 | 55041014 | 55040998 | - |
| SEQ ID NO 45422 | TCAACCCCACATCTGACTCC | AAG | chr1 | 55040970 | 55040989 | 55040973 | - |
| SEQ ID NO 45423 | CCCCACATCTGACTCCAAGC | TGG | chr1 | 55040966 | 55040985 | 55040969 | - |
| SEQ ID NO 45424 | CCCACATCTGACTCCAAGCT | GGG | chr1 | 55040965 | 55040984 | 55040968 | - |
| SEQ ID NO 45425 | CCACATCTGACTCCAAGCTG | GGG | chr1 | 55040964 | 55040983 | 55040967 | - |
| SEQ ID NO 45426 | CACATCTGACTCCAAGCTGG | GGG | chr1 | 55040963 | 55040982 | 55040966 | - |
| SEQ ID NO 45427 | TGACTCCAAGCTGGGGGACA | CAG | chr1 | 55040957 | 55040976 | 55040960 | - |
| SEQ ID NO 45428 | AGCTGGGGGACACAGAACCT | CAG | chr1 | 55040949 | 55040968 | 55040952 | - |
| SEQ ID NO 45429 | GGGGACACAGAACCTCAGCC | AAG | chr1 | 55040944 | 55040963 | 55040947 | - |
| SEQ ID NO 45430 | ACAGAACCTCAGCCAAGTCC | TGG | chr1 | 55040938 | 55040957 | 55040941 | - |
| SEQ ID NO 45431 | CAGAACCTCAGCCAAGTCCT | GGG | chr1 | 55040937 | 55040956 | 55040940 | - |
| SEQ ID NO 45432 | ACCTCAGCCAAGTCCTGGGC | TGG | chr1 | 55040933 | 55040952 | 55040936 | - |
| SEQ ID NO 45433 | AGTCCTGGGCTGGTAATACT | TAG | chr1 | 55040923 | 55040942 | 55040926 | - |
| SEQ ID NO 45434 | GGGCTGGTAATACTTAGAAA | AAG | chr1 | 55040917 | 55040936 | 55040920 | - |
| SEQ ID NO 45435 | TGGTAATACTTAGAAAAAGC | TAG | chr1 | 55040913 | 55040932 | 55040916 | - |
| SEQ ID NO 45436 | TAATACTTAGAAAAAGCTAG | TGG | chr1 | 55040910 | 55040929 | 55040913 | - |
| SEQ ID NO 45437 | AAAAGCTAGTGGTCTCGCCC | CGG | chr1 | 55040899 | 55040918 | 55040902 | - |
| SEQ ID NO 45438 | AAAGCTAGTGGTCTCGCCCC | GGG | chr1 | 55040898 | 55040917 | 55040901 | - |
| SEQ ID NO 45439 | GCTAGTGGTCTCGCCCCGGG | AAG | chr1 | 55040895 | 55040914 | 55040898 | - |
| SEQ ID NO 45440 | AGTGGTCTCGCCCCGGGAAG | AAG | chr1 | 55040892 | 55040911 | 55040895 | - |
| SEQ ID NO 45441 | CCCCGGGAAGAAGCTTCCCA | CAG | chr1 | 55040882 | 55040901 | 55040885 | - |
| SEQ ID NO 45442 | GAAGAAGCTTCCCACAGCCT | GAG | chr1 | 55040876 | 55040895 | 55040879 | - |
| SEQ ID NO 45443 | AAGAAGCTTCCCACAGCCTG | AGG | chr1 | 55040875 | 55040894 | 55040878 | - |
| SEQ ID NO 45444 | AGAAGCTTCCCACAGCCTGA | GGG | chr1 | 55040874 | 55040893 | 55040877 | - |
| SEQ ID NO 45445 | GCTTCCCACAGCCTGAGGGC | CAG | chr1 | 55040870 | 55040889 | 55040873 | - |
| SEQ ID NO 45446 | TCCCACAGCCTGAGGGCCAG | AAG | chr1 | 55040867 | 55040886 | 55040870 | - |

Figure 61 (Cont'd)

| SEQ ID NO 45447 | ACAGCCTGAGGGCCAGAAGC | TGG | chr1 | 55040863 | 55040882 | 55040866 | - |
| SEQ ID NO 45448 | GCCTGAGGGCCAGAAGCTGG | CAG | chr1 | 55040860 | 55040879 | 55040863 | - |
| SEQ ID NO 45449 | CTGAGGGCCAGAAGCTGGCA | GAG | chr1 | 55040858 | 55040877 | 55040861 | - |
| SEQ ID NO 45450 | CAGAAGCTGGCAGAGTTGTT | GAG | chr1 | 55040850 | 55040869 | 55040853 | - |
| SEQ ID NO 45451 | GAGCAAACTCGCCCCGCACA | CGG | chr1 | 55040830 | 55040849 | 55040833 | - |
| SEQ ID NO 45452 | AAACTCGCCCCGCACACGGT | CGG | chr1 | 55040826 | 55040845 | 55040829 | - |
| SEQ ID NO 45453 | CTCGCCCCGCACACGGTCGG | CAG | chr1 | 55040823 | 55040842 | 55040826 | - |
| SEQ ID NO 45454 | CCCCGCACACGGTCGGCAGA | CAG | chr1 | 55040819 | 55040838 | 55040822 | - |
| SEQ ID NO 45455 | GCACACGGTCGGCAGACAGC | CAG | chr1 | 55040815 | 55040834 | 55040818 | - |
| SEQ ID NO 45456 | CACACGGTCGGCAGACAGCC | AGG | chr1 | 55040814 | 55040833 | 55040817 | - |
| SEQ ID NO 45457 | ACGGTCGGCAGACAGCCAGG | TGG | chr1 | 55040811 | 55040830 | 55040814 | - |
| SEQ ID NO 45458 | CGGTCGGCAGACAGCCAGGT | GGG | chr1 | 55040810 | 55040829 | 55040813 | - |
| SEQ ID NO 45459 | GGCAGACAGCCAGGTGGGCT | GAG | chr1 | 55040805 | 55040824 | 55040808 | - |
| SEQ ID NO 45460 | GCAGACAGCCAGGTGGGCTG | AGG | chr1 | 55040804 | 55040823 | 55040807 | - |
| SEQ ID NO 45461 | AGCCAGGTGGGCTGAGGCGC | CGG | chr1 | 55040798 | 55040817 | 55040801 | - |
| SEQ ID NO 45462 | GCCAGGTGGGCTGAGGCGCC | GGG | chr1 | 55040797 | 55040816 | 55040800 | - |
| SEQ ID NO 45463 | GTGGGCTGAGGCGCCGGGCT | CAG | chr1 | 55040792 | 55040811 | 55040795 | - |
| SEQ ID NO 45464 | TGAGGCGCCGGGCTCAGCTC | CGG | chr1 | 55040786 | 55040805 | 55040789 | - |
| SEQ ID NO 45465 | GAGGCGCCGGGCTCAGCTCC | GGG | chr1 | 55040785 | 55040804 | 55040788 | - |
| SEQ ID NO 45466 | AGGCGCCGGGCTCAGCTCCG | GGG | chr1 | 55040784 | 55040803 | 55040787 | - |
| SEQ ID NO 45467 | CGGGCTCAGCTCCGGGGTCC | CAG | chr1 | 55040778 | 55040797 | 55040781 | - |
| SEQ ID NO 45468 | CAGCTCCGGGGTCCCAGTAC | CAG | chr1 | 55040772 | 55040791 | 55040775 | - |
| SEQ ID NO 45469 | AGCTCCGGGGTCCCAGTACC | AGG | chr1 | 55040771 | 55040790 | 55040774 | - |
| SEQ ID NO 45470 | AGTACCAGGCGCACCACCTC | CGG | chr1 | 55040757 | 55040776 | 55040760 | - |
| SEQ ID NO 45471 | AGGCGCACCACCTCCGGCTC | CAG | chr1 | 55040751 | 55040770 | 55040754 | - |
| SEQ ID NO 45472 | GCGCACCACCTCCGGCTCCA | GAG | chr1 | 55040749 | 55040768 | 55040752 | - |
| SEQ ID NO 45473 | ACCTCCGGCTCCAGAGCACC | AAG | chr1 | 55040742 | 55040761 | 55040745 | - |
| SEQ ID NO 45474 | CCTCCGGCTCCAGAGCACCA | AGG | chr1 | 55040741 | 55040760 | 55040744 | - |
| SEQ ID NO 45475 | CTCCGGCTCCAGAGCACCAA | GGG | chr1 | 55040740 | 55040759 | 55040743 | - |
| SEQ ID NO 45476 | CCAAGGGCCCTTCCCTGCCT | GAG | chr1 | 55040724 | 55040743 | 55040727 | - |
| SEQ ID NO 45477 | CCTTCCCTGCCTGAGTCCTA | AAG | chr1 | 55040716 | 55040735 | 55040719 | - |
| SEQ ID NO 45478 | CTTCCCTGCCTGAGTCCTAA | AGG | chr1 | 55040715 | 55040734 | 55040718 | - |
| SEQ ID NO 45479 | TGAGTCCTAAAGGACGCCAA | TGG | chr1 | 55040705 | 55040724 | 55040708 | - |
| SEQ ID NO 45480 | GAGTCCTAAAGGACGCCAAT | GGG | chr1 | 55040704 | 55040723 | 55040707 | - |
| SEQ ID NO 45481 | AAAGGACGCCAATGGGCCTC | GAG | chr1 | 55040697 | 55040716 | 55040700 | - |
| SEQ ID NO 45482 | CCCCTTCTCCCTGCCCCTT | CAG | chr1 | 55040664 | 55040683 | 55040667 | - |
| SEQ ID NO 45483 | TTCTCCCTGCCCCTTCAGC | TGG | chr1 | 55040660 | 55040679 | 55040663 | - |
| SEQ ID NO 45484 | CTTCAGCTGGTTCTTTTCTT | CGG | chr1 | 55040647 | 55040666 | 55040650 | - |
| SEQ ID NO 45485 | GTTCTTTTCTTCGGCTGAAA | CAG | chr1 | 55040638 | 55040657 | 55040641 | - |
| SEQ ID NO 45486 | TTTTCTTCGGCTGAAACAGA | TGG | chr1 | 55040634 | 55040653 | 55040637 | - |
| SEQ ID NO 45487 | GGCTGAAACAGATGGAATAC | TAG | chr1 | 55040626 | 55040645 | 55040629 | - |
| SEQ ID NO 45488 | CTGAAACAGATGGAATACTA | GAG | chr1 | 55040624 | 55040643 | 55040627 | - |
| SEQ ID NO 45489 | CAGATGGAATACTAGAGCAT | GAG | chr1 | 55040618 | 55040637 | 55040621 | - |
| SEQ ID NO 45490 | AGCATGAGTTCTGTGTCATA | AAG | chr1 | 55040603 | 55040622 | 55040606 | - |
| SEQ ID NO 45491 | AAGAAATTGCCTCGTGCTCC | CAG | chr1 | 55040583 | 55040602 | 55040586 | - |
| SEQ ID NO 45492 | TTCCCACCCCGCCCCTGTCT | CGG | chr1 | 55040548 | 55040567 | 55040551 | - |
| SEQ ID NO 45493 | TCCCACCCCGCCCCTGTCTC | GGG | chr1 | 55040547 | 55040566 | 55040550 | - |

Figure 61 (Cont'd)

| SEQ ID NO 45494 | CACCCCGCCCCTGTCTCGGG | TAG | chr1 | 55040544 | 55040563 | 55040547 | - |
| SEQ ID NO 45495 | ACCCCGCCCCTGTCTCGGGT | AGG | chr1 | 55040543 | 55040562 | 55040546 | - |
| SEQ ID NO 45496 | CCCCGCCCCTGTCTCGGGTA | GGG | chr1 | 55040542 | 55040561 | 55040545 | - |
| SEQ ID NO 45497 | CTCGGGTAGGGCCTTCTCTC | CAG | chr1 | 55040530 | 55040549 | 55040533 | - |
| SEQ ID NO 45498 | TCGGGTAGGGCCTTCTCTCC | AGG | chr1 | 55040529 | 55040548 | 55040532 | - |
| SEQ ID NO 45499 | CCATGTTTTCCAAACCAAAT | CGG | chr1 | 55040488 | 55040507 | 55040491 | - |
| SEQ ID NO 45500 | CAAATCGGAACCCACTATAA | TGG | chr1 | 55040473 | 55040492 | 55040476 | - |
| SEQ ID NO 45501 | TCGGAACCCACTATAATGGC | AAG | chr1 | 55040469 | 55040488 | 55040472 | - |
| SEQ ID NO 45502 | AAGCCCGCTTTCTCTGTGCC | TGG | chr1 | 55040449 | 55040468 | 55040452 | - |
| SEQ ID NO 45503 | CGCTTTCTCTGTGCCTGGTG | CAG | chr1 | 55040444 | 55040463 | 55040447 | - |
| SEQ ID NO 45504 | TCTGTGCCTGGTGCAGTTCC | CAG | chr1 | 55040437 | 55040456 | 55040440 | - |
| SEQ ID NO 45505 | GTGCAGTTCCCAGTACGTTC | CAG | chr1 | 55040427 | 55040446 | 55040430 | - |
| SEQ ID NO 45506 | TGCAGTTCCCAGTACGTTCC | AGG | chr1 | 55040426 | 55040445 | 55040429 | - |
| SEQ ID NO 45507 | TCCTTCACCCACCTGTGCCG | CGG | chr1 | 55040396 | 55040415 | 55040399 | - |
| SEQ ID NO 45508 | TCACCCACCTGTGCCGCGGC | GAG | chr1 | 55040392 | 55040411 | 55040395 | - |
| SEQ ID NO 45509 | CACCCACCTGTGCCGCGGCG | AGG | chr1 | 55040391 | 55040410 | 55040394 | - |
| SEQ ID NO 45510 | CCACCTGTGCCGCGGCGAGG | CAG | chr1 | 55040388 | 55040407 | 55040391 | - |
| SEQ ID NO 45511 | TGCCGCGGCGAGGCAGAAAC | TGG | chr1 | 55040381 | 55040400 | 55040384 | - |
| SEQ ID NO 45512 | GCCGCGGCGAGGCAGAAACT | GGG | chr1 | 55040380 | 55040399 | 55040383 | - |
| SEQ ID NO 45513 | GAGGCAGAAACTGGGAAATC | TGG | chr1 | 55040372 | 55040391 | 55040375 | - |
| SEQ ID NO 45514 | AGGCAGAAACTGGGAAATCT | GGG | chr1 | 55040371 | 55040390 | 55040374 | - |
| SEQ ID NO 45515 | CAGAAACTGGGAAATCTGGG | CAG | chr1 | 55040368 | 55040387 | 55040371 | - |
| SEQ ID NO 45516 | AGAAACTGGGAAATCTGGGC | AGG | chr1 | 55040367 | 55040386 | 55040370 | - |
| SEQ ID NO 45517 | GAAATCTGGGCAGGATATCC | TGG | chr1 | 55040358 | 55040377 | 55040361 | - |
| SEQ ID NO 45518 | ATCTGGGCAGGATATCCTGG | CAG | chr1 | 55040355 | 55040374 | 55040358 | - |
| SEQ ID NO 45519 | GTGCTCTGCTCGCCCTTCCT | CGG | chr1 | 55040333 | 55040352 | 55040336 | - |
| SEQ ID NO 45520 | GCTCGCCCTTCCTCGGCCTC | CGG | chr1 | 55040326 | 55040345 | 55040329 | - |
| SEQ ID NO 45521 | CTCGCCCTTCCTCGGCCTCC | GGG | chr1 | 55040325 | 55040344 | 55040328 | - |
| SEQ ID NO 45522 | CCGCGAACCTTCCCACTGAA | TAG | chr1 | 55040292 | 55040311 | 55040295 | - |
| SEQ ID NO 45523 | AACCTTCCCACTGAATAGCG | CAG | chr1 | 55040287 | 55040306 | 55040290 | - |
| SEQ ID NO 45524 | AATAGCGCAGCCGCACGCCC | CAG | chr1 | 55040274 | 55040293 | 55040277 | - |
| SEQ ID NO 45525 | GCGCAGCCGCACGCCCCAGC | AAG | chr1 | 55040270 | 55040289 | 55040273 | - |
| SEQ ID NO 45526 | CACGCCCCAGCAAGTCCCCA | AAG | chr1 | 55040261 | 55040280 | 55040264 | - |
| SEQ ID NO 45527 | CGCCCCAGCAAGTCCCCAAA | GAG | chr1 | 55040259 | 55040278 | 55040262 | - |
| SEQ ID NO 45528 | CCAGCAAGTCCCCAAAGAGC | CGG | chr1 | 55040255 | 55040274 | 55040258 | - |
| SEQ ID NO 45529 | CTCCCCGCCGCCTTGCCTG | CAG | chr1 | 55040195 | 55040214 | 55040198 | - |
| SEQ ID NO 45530 | CCGCCTTGCCTGCAGTCCCC | AAG | chr1 | 55040187 | 55040206 | 55040190 | - |
| SEQ ID NO 45531 | GCAGTCCCCAAGATCGTGCC | AAG | chr1 | 55040176 | 55040195 | 55040179 | - |
| SEQ ID NO 45532 | CCCCAAGATCGTGCCAAGCG | AAG | chr1 | 55040171 | 55040190 | 55040174 | - |
| SEQ ID NO 45533 | CCAAGATCGTGCCAAGCGAA | GAG | chr1 | 55040169 | 55040188 | 55040172 | - |
| SEQ ID NO 45534 | CGTGCCAAGCGAAGAGCCCT | CGG | chr1 | 55040162 | 55040181 | 55040165 | - |
| SEQ ID NO 45535 | ACTCCACTTCCTCTCTTACA | TGG | chr1 | 55040131 | 55040150 | 55040134 | - |
| SEQ ID NO 45536 | CTCCACTTCCTCTCTTACAT | GGG | chr1 | 55040130 | 55040149 | 55040133 | - |
| SEQ ID NO 45537 | TCCACTTCCTCTCTTACATG | GGG | chr1 | 55040129 | 55040148 | 55040132 | - |
| SEQ ID NO 45538 | CCACTTCCTCTCTTACATGG | GGG | chr1 | 55040128 | 55040147 | 55040131 | - |
| SEQ ID NO 45539 | CACTTCCTCTCTTACATGGG | GGG | chr1 | 55040127 | 55040146 | 55040130 | - |
| SEQ ID NO 45540 | CTCTTACATGGGGGGAAACT | GAG | chr1 | 55040119 | 55040138 | 55040122 | - |

Figure 61 (Cont'd)

| SEQ ID NO 45541 | TCTTACATGGGGGGAAACTG | AGG | chr1 | 55040118 | 55040137 | 55040121 | - |
| SEQ ID NO 45542 | ATGGGGGGAAACTGAGGCCC | GAG | chr1 | 55040112 | 55040131 | 55040115 | - |
| SEQ ID NO 45543 | GGGGGGAAACTGAGGCCCGA | GAG | chr1 | 55040110 | 55040129 | 55040113 | - |
| SEQ ID NO 45544 | GGGGGAAACTGAGGCCCGAG | AGG | chr1 | 55040109 | 55040128 | 55040112 | - |
| SEQ ID NO 45545 | AACTGAGGCCCGAGAGGAAA | CAG | chr1 | 55040103 | 55040122 | 55040106 | - |
| SEQ ID NO 45546 | GAAACAGCACCGCACCGTCC | CGG | chr1 | 55040087 | 55040106 | 55040090 | - |
| SEQ ID NO 45547 | GCACCGCACCGTCCCGGCTG | CGG | chr1 | 55040081 | 55040100 | 55040084 | - |
| SEQ ID NO 45548 | CACCGCACCGTCCCGGCTGC | GGG | chr1 | 55040080 | 55040099 | 55040083 | - |
| SEQ ID NO 45549 | TCCCGGCTGCGGGTTCGCCC | CGG | chr1 | 55040070 | 55040089 | 55040073 | - |
| SEQ ID NO 45550 | CCATCCCTACACCCGCACCT | TGG | chr1 | 55040043 | 55040062 | 55040046 | - |
| SEQ ID NO 45551 | CCTACACCCGCACCTTGGCG | CAG | chr1 | 55040038 | 55040057 | 55040041 | - |
| SEQ ID NO 45552 | ACACCCGCACCTTGGCGCAG | CGG | chr1 | 55040035 | 55040054 | 55040038 | - |
| SEQ ID NO 45553 | CCCGCACCTTGGCGCAGCGG | TGG | chr1 | 55040032 | 55040051 | 55040035 | - |
| SEQ ID NO 45554 | GCACCTTGGCGCAGCGGTGG | AAG | chr1 | 55040029 | 55040048 | 55040032 | - |
| SEQ ID NO 45555 | CACCTTGGCGCAGCGGTGGA | AGG | chr1 | 55040028 | 55040047 | 55040031 | - |
| SEQ ID NO 45556 | CTTGGCGCAGCGGTGGAAGG | TGG | chr1 | 55040025 | 55040044 | 55040028 | - |
| SEQ ID NO 45557 | GCAGCGGTGGAAGGTGGCTG | TGG | chr1 | 55040019 | 55040038 | 55040022 | - |
| SEQ ID NO 45558 | GGTGGCTGTGGTTCCGTGCT | CGG | chr1 | 55040007 | 55040026 | 55040010 | - |
| SEQ ID NO 45559 | GTGGCTGTGGTTCCGTGCTC | GGG | chr1 | 55040006 | 55040025 | 55040009 | - |
| SEQ ID NO 45560 | GGTTCCGTGCTCGGGTGCTT | CGG | chr1 | 55039998 | 55040017 | 55040001 | - |
| SEQ ID NO 45561 | CCGTGCTCGGGTGCTTCGGC | CAG | chr1 | 55039994 | 55040013 | 55039997 | - |
| SEQ ID NO 45562 | CGTGCTCGGGTGCTTCGGCC | AGG | chr1 | 55039993 | 55040012 | 55039996 | - |
| SEQ ID NO 45563 | TTCGGCCAGGCCGTCCTCCT | CGG | chr1 | 55039980 | 55039999 | 55039983 | - |
| SEQ ID NO 45564 | GGCCGTCCTCCTCGGAACGC | AAG | chr1 | 55039972 | 55039991 | 55039975 | - |
| SEQ ID NO 45565 | GCCGTCCTCCTCGGAACGCA | AGG | chr1 | 55039971 | 55039990 | 55039974 | - |
| SEQ ID NO 45566 | TCCTCCTCGGAACGCAAGGC | TAG | chr1 | 55039967 | 55039986 | 55039970 | - |
| SEQ ID NO 45567 | TCGGAACGCAAGGCTAGCAC | CAG | chr1 | 55039961 | 55039980 | 55039964 | - |
| SEQ ID NO 45568 | AGGCTAGCACCAGCTCCTCG | TAG | chr1 | 55039951 | 55039970 | 55039954 | - |
| SEQ ID NO 45569 | CGTCCTCGTCCTCCTGCGCA | CGG | chr1 | 55039924 | 55039943 | 55039927 | - |
| SEQ ID NO 45570 | GTCCTCGTCCTCCTGCGCAC | GGG | chr1 | 55039923 | 55039942 | 55039926 | - |
| SEQ ID NO 45571 | CTCCTGCGCACGGGCGCCCG | CGG | chr1 | 55039914 | 55039933 | 55039917 | - |
| SEQ ID NO 45572 | TCCTGCGCACGGGCGCCCGC | GGG | chr1 | 55039913 | 55039932 | 55039916 | - |
| SEQ ID NO 45573 | GCACGGGCGCCCGCGGGACC | CAG | chr1 | 55039907 | 55039926 | 55039910 | - |
| SEQ ID NO 45574 | CACGGGCGCCCGCGGGACCC | AGG | chr1 | 55039906 | 55039925 | 55039909 | - |
| SEQ ID NO 45575 | CGGGCGCCCGCGGGACCCAG | GAG | chr1 | 55039904 | 55039923 | 55039907 | - |
| SEQ ID NO 45576 | GCGCCCGCGGGACCCAGGAG | CAG | chr1 | 55039901 | 55039920 | 55039904 | - |
| SEQ ID NO 45577 | CCCGCGGGACCCAGGAGCAG | CAG | chr1 | 55039898 | 55039917 | 55039901 | - |
| SEQ ID NO 45578 | GCGGGACCCAGGAGCAGCAG | CAG | chr1 | 55039895 | 55039914 | 55039898 | - |
| SEQ ID NO 45579 | GGACCCAGGAGCAGCAGCAG | CAG | chr1 | 55039892 | 55039911 | 55039895 | - |
| SEQ ID NO 45580 | CCCAGGAGCAGCAGCAGCAG | CAG | chr1 | 55039889 | 55039908 | 55039892 | - |
| SEQ ID NO 45581 | AGGAGCAGCAGCAGCAGCAG | CAG | chr1 | 55039886 | 55039905 | 55039889 | - |
| SEQ ID NO 45582 | AGCAGCAGCAGCAGCAGCAG | CAG | chr1 | 55039883 | 55039902 | 55039886 | - |
| SEQ ID NO 45583 | AGCAGCAGCAGCAGCAGCAG | TGG | chr1 | 55039880 | 55039899 | 55039883 | - |
| SEQ ID NO 45584 | AGCAGCAGCAGCAGCAGTGG | CAG | chr1 | 55039877 | 55039896 | 55039880 | - |
| SEQ ID NO 45585 | AGCAGCAGCAGCAGTGGCAG | CGG | chr1 | 55039874 | 55039893 | 55039877 | - |
| SEQ ID NO 45586 | GCAGCAGTGGCAGCGGCCAC | CAG | chr1 | 55039867 | 55039886 | 55039870 | - |
| SEQ ID NO 45587 | CAGCAGTGGCAGCGGCCACC | AGG | chr1 | 55039866 | 55039885 | 55039869 | - |

Figure 61 (Cont'd)

| SEQ ID NO | Sequence | PAM | Chr | Start | End | Pos | Strand |
|---|---|---|---|---|---|---|---|
| SEQ ID NO 45588 | CAGCGGCCACCAGGACCGCC | TGG | chr1 | 55039857 | 55039876 | 55039860 | - |
| SEQ ID NO 45589 | GCGGCCACCAGGACCGCCTG | GAG | chr1 | 55039855 | 55039874 | 55039858 | - |
| SEQ ID NO 45590 | CCAGGACCGCCTGGAGCTGA | CGG | chr1 | 55039848 | 55039867 | 55039851 | - |
| SEQ ID NO 45591 | CTGGAGCTGACGGTGCCCAT | GAG | chr1 | 55039838 | 55039857 | 55039841 | - |
| SEQ ID NO 45592 | TGGAGCTGACGGTGCCCATG | AGG | chr1 | 55039837 | 55039856 | 55039840 | - |
| SEQ ID NO 45593 | GGAGCTGACGGTGCCCATGA | GGG | chr1 | 55039836 | 55039855 | 55039839 | - |
| SEQ ID NO 45594 | CTGACGGTGCCCATGAGGGC | CAG | chr1 | 55039832 | 55039851 | 55039835 | - |
| SEQ ID NO 45595 | TGACGGTGCCCATGAGGGCC | AGG | chr1 | 55039831 | 55039850 | 55039834 | - |
| SEQ ID NO 45596 | GACGGTGCCCATGAGGGCCA | GGG | chr1 | 55039830 | 55039849 | 55039833 | - |
| SEQ ID NO 45597 | ACGGTGCCCATGAGGGCCAG | GGG | chr1 | 55039829 | 55039848 | 55039832 | - |
| SEQ ID NO 45598 | GGTGCCCATGAGGGCCAGGG | GAG | chr1 | 55039827 | 55039846 | 55039830 | - |
| SEQ ID NO 45599 | TGCCCATGAGGGCCAGGGGA | GAG | chr1 | 55039825 | 55039844 | 55039828 | - |
| SEQ ID NO 45600 | GCCCATGAGGGCCAGGGGAG | AGG | chr1 | 55039824 | 55039843 | 55039827 | - |
| SEQ ID NO 45601 | CAGGGGAGAGGTTGCTGTCC | TGG | chr1 | 55039812 | 55039831 | 55039815 | - |
| SEQ ID NO 45602 | GGAGAGGTTGCTGTCCTGGC | GAG | chr1 | 55039808 | 55039827 | 55039811 | - |
| SEQ ID NO 45603 | GAGAGGTTGCTGTCCTGGCG | AGG | chr1 | 55039807 | 55039826 | 55039810 | - |
| SEQ ID NO 45604 | GAGGTTGCTGTCCTGGCGAG | GAG | chr1 | 55039805 | 55039824 | 55039808 | - |
| SEQ ID NO 45605 | GCTGTCCTGGCGAGGAGACC | TAG | chr1 | 55039799 | 55039818 | 55039802 | - |
| SEQ ID NO 45606 | TGTCCTGGCGAGGAGACCTA | GAG | chr1 | 55039797 | 55039816 | 55039800 | - |
| SEQ ID NO 45607 | GTCCTGGCGAGGAGACCTAG | AGG | chr1 | 55039796 | 55039815 | 55039799 | - |
| SEQ ID NO 45608 | GGAGACCTAGAGGCCGTGCG | CGG | chr1 | 55039786 | 55039805 | 55039789 | - |
| SEQ ID NO 45609 | AGGCCGTGCGCGGTCCACGC | CGG | chr1 | 55039776 | 55039795 | 55039779 | - |
| SEQ ID NO 45610 | CCGTGCGCGGTCCACGCCGG | CGG | chr1 | 55039773 | 55039792 | 55039776 | - |
| SEQ ID NO 45611 | GTCCACGCCGGCGGCGCCTT | GAG | chr1 | 55039764 | 55039783 | 55039767 | - |
| SEQ ID NO 45612 | CGGCGGCGCCTTGAGCCTTG | CGG | chr1 | 55039756 | 55039775 | 55039759 | - |
| SEQ ID NO 45613 | CGGCGCCTTGAGCCTTGCGG | TGG | chr1 | 55039753 | 55039772 | 55039756 | - |
| SEQ ID NO 45614 | GGCGCCTTGAGCCTTGCGGT | GGG | chr1 | 55039752 | 55039771 | 55039755 | - |
| SEQ ID NO 45615 | GCGCCTTGAGCCTTGCGGTG | GGG | chr1 | 55039751 | 55039770 | 55039754 | - |
| SEQ ID NO 45616 | GCCTTGAGCCTTGCGGTGGG | GAG | chr1 | 55039749 | 55039768 | 55039752 | - |
| SEQ ID NO 45617 | CCTTGAGCCTTGCGGTGGGG | AGG | chr1 | 55039748 | 55039767 | 55039751 | - |
| SEQ ID NO 45618 | TTGCGGTGGGGAGGACTGTG | CAG | chr1 | 55039739 | 55039758 | 55039742 | - |
| SEQ ID NO 45619 | TGCGGTGGGGAGGACTGTGC | AGG | chr1 | 55039738 | 55039757 | 55039741 | - |
| SEQ ID NO 45620 | CGGTGGGGAGGACTGTGCAG | GAG | chr1 | 55039736 | 55039755 | 55039739 | - |
| SEQ ID NO 45621 | GGAGGACTGTGCAGGAGCTG | AAG | chr1 | 55039730 | 55039749 | 55039733 | - |
| SEQ ID NO 45622 | ACTGTGCAGGAGCTGAAGTT | CAG | chr1 | 55039725 | 55039744 | 55039728 | - |
| SEQ ID NO 45623 | CTGTGCAGGAGCTGAAGTTC | AGG | chr1 | 55039724 | 55039743 | 55039727 | - |
| SEQ ID NO 45624 | GTGCAGGAGCTGAAGTTCAG | GAG | chr1 | 55039722 | 55039741 | 55039725 | - |
| SEQ ID NO 45625 | CAGGAGCTGAAGTTCAGGAG | CAG | chr1 | 55039719 | 55039738 | 55039722 | - |
| SEQ ID NO 45626 | AGGAGCTGAAGTTCAGGAGC | AGG | chr1 | 55039718 | 55039737 | 55039721 | - |
| SEQ ID NO 45627 | GGAGCTGAAGTTCAGGAGCA | GGG | chr1 | 55039717 | 55039736 | 55039720 | - |
| SEQ ID NO 45628 | GTTCAGGAGCAGGGCGCGTG | AAG | chr1 | 55039708 | 55039727 | 55039711 | - |
| SEQ ID NO 45629 | TTCAGGAGCAGGGCGCGTGA | AGG | chr1 | 55039707 | 55039726 | 55039710 | - |
| SEQ ID NO 45630 | TCAGGAGCAGGGCGCGTGAA | GGG | chr1 | 55039706 | 55039725 | 55039709 | - |
| SEQ ID NO 45631 | CAGGAGCAGGGCGCGTGAAG | GGG | chr1 | 55039705 | 55039724 | 55039708 | - |
| SEQ ID NO 45632 | AGGGCGCGTGAAGGGGCGCG | CGG | chr1 | 55039698 | 55039717 | 55039701 | - |
| SEQ ID NO 45633 | TGAAGGGGCGCGCGGAATCC | TGG | chr1 | 55039690 | 55039709 | 55039693 | - |
| SEQ ID NO 45634 | GGGGCGCGCGGAATCCTGGC | TGG | chr1 | 55039686 | 55039705 | 55039689 | - |

Figure 61 (Cont'd)

| SEQ ID NO 45635 | GGGCGCGCGGAATCCTGGCT | GGG | chr1 | 55039685 | 55039704 | 55039688 | - |
| SEQ ID NO 45636 | GCGCGCGGAATCCTGGCTGG | GAG | chr1 | 55039683 | 55039702 | 55039686 | - |
| SEQ ID NO 45637 | GCGGAATCCTGGCTGGGAGC | TGG | chr1 | 55039679 | 55039698 | 55039682 | - |
| SEQ ID NO 45638 | CGGAATCCTGGCTGGGAGCT | GGG | chr1 | 55039678 | 55039697 | 55039681 | - |
| SEQ ID NO 45639 | GAATCCTGGCTGGGAGCTGG | GAG | chr1 | 55039676 | 55039695 | 55039679 | - |
| SEQ ID NO 45640 | GCTGCTGCAACGACGCGTCC | CGG | chr1 | 55039651 | 55039670 | 55039654 | - |
| SEQ ID NO 45641 | CGACGCGTCCCGGCCCGCCC | GAG | chr1 | 55039641 | 55039660 | 55039644 | - |
| SEQ ID NO 45642 | GCGTCCCGGCCCGCCCGAGC | CAG | chr1 | 55039637 | 55039656 | 55039640 | - |
| SEQ ID NO 45643 | CCCGAGCCAGTCTCACTGCC | TGG | chr1 | 55039624 | 55039643 | 55039627 | - |
| SEQ ID NO 45644 | CACTGCCTGGCTCACTCCTC | CAG | chr1 | 55039611 | 55039630 | 55039614 | - |
| SEQ ID NO 45645 | ACTGCCTGGCTCACTCCTCC | AGG | chr1 | 55039610 | 55039629 | 55039613 | - |
| SEQ ID NO 45646 | CTGGCTCACTCCTCCAGGCT | CAG | chr1 | 55039605 | 55039624 | 55039608 | - |
| SEQ ID NO 45647 | GGCTCAGACCCTGAACTGAA | CGG | chr1 | 55039589 | 55039608 | 55039592 | - |
| SEQ ID NO 45648 | TCAGACCCTGAACTGAACGG | CGG | chr1 | 55039586 | 55039605 | 55039589 | - |
| SEQ ID NO 45649 | CGGCGCCCGCCTGCAACCAT | GAG | chr1 | 55039566 | 55039585 | 55039569 | - |
| SEQ ID NO 45650 | TGAGCGCCTCGACGTCGCTG | CGG | chr1 | 55039547 | 55039566 | 55039550 | - |
| SEQ ID NO 45651 | ACGTCGCTGCGGAAACCTTC | TAG | chr1 | 55039536 | 55039555 | 55039539 | - |
| SEQ ID NO 45652 | CGTCGCTGCGGAAACCTTCT | AGG | chr1 | 55039535 | 55039554 | 55039538 | - |
| SEQ ID NO 45653 | GTCGCTGCGGAAACCTTCTA | GGG | chr1 | 55039534 | 55039553 | 55039537 | - |
| SEQ ID NO 45654 | TGCGGAAACCTTCTAGGGTG | TGG | chr1 | 55039529 | 55039548 | 55039532 | - |
| SEQ ID NO 45655 | GCGGAAACCTTCTAGGGTGT | GGG | chr1 | 55039528 | 55039547 | 55039531 | - |
| SEQ ID NO 45656 | GGGTGTGGGTGCTTGACGCC | TGG | chr1 | 55039514 | 55039533 | 55039517 | - |
| SEQ ID NO 45657 | GGTGTGGGTGCTTGACGCCT | GGG | chr1 | 55039513 | 55039532 | 55039516 | - |
| SEQ ID NO 45658 | GTGTGGGTGCTTGACGCCTG | GGG | chr1 | 55039512 | 55039531 | 55039515 | - |
| SEQ ID NO 45659 | TGCTTGACGCCTGGGGCGCG | CAG | chr1 | 55039505 | 55039524 | 55039508 | - |
| SEQ ID NO 45660 | GGGCGCGCAGATCACGCCAC | CAG | chr1 | 55039492 | 55039511 | 55039495 | - |
| SEQ ID NO 45661 | GCGCGCAGATCACGCCACCA | GAG | chr1 | 55039490 | 55039509 | 55039493 | - |
| SEQ ID NO 45662 | TCACGCCACCAGAGCCCCAT | CGG | chr1 | 55039481 | 55039500 | 55039484 | - |
| SEQ ID NO 45663 | CCTATCTGATTAAACATTAA | CGG | chr1 | 55039453 | 55039472 | 55039456 | - |
| SEQ ID NO 45664 | TTAAACATTAACGGAACCCC | CGG | chr1 | 55039444 | 55039463 | 55039447 | - |
| SEQ ID NO 45665 | CATTAACGGAACCCCCGGAC | TGG | chr1 | 55039439 | 55039458 | 55039442 | - |
| SEQ ID NO 45666 | TTAACGGAACCCCCGGACTG | GAG | chr1 | 55039437 | 55039456 | 55039440 | - |
| SEQ ID NO 45667 | TAACGGAACCCCCGGACTGG | AGG | chr1 | 55039436 | 55039455 | 55039439 | - |
| SEQ ID NO 45668 | GAACCCCCGGACTGGAGGAT | CAG | chr1 | 55039431 | 55039450 | 55039434 | - |
| SEQ ID NO 45669 | AACCCCCGGACTGGAGGATC | AGG | chr1 | 55039430 | 55039449 | 55039433 | - |
| SEQ ID NO 45670 | CGGACTGGAGGATCAGGTTT | CGG | chr1 | 55039424 | 55039443 | 55039427 | - |
| SEQ ID NO 45671 | TCGGCCTCGCCCTCCCCAAA | CAG | chr1 | 55039405 | 55039424 | 55039408 | - |
| SEQ ID NO 45672 | TCGCCCTCCCCAAACAGCGT | CAG | chr1 | 55039399 | 55039418 | 55039402 | - |
| SEQ ID NO 45673 | AAACAGCGTCAGATTACGCG | CAG | chr1 | 55039388 | 55039407 | 55039391 | - |
| SEQ ID NO 45674 | ACAGCGTCAGATTACGCGCA | GAG | chr1 | 55039386 | 55039405 | 55039389 | - |
| SEQ ID NO 45675 | CAGCGTCAGATTACGCGCAG | AGG | chr1 | 55039385 | 55039404 | 55039388 | - |
| SEQ ID NO 45676 | AGCGTCAGATTACGCGCAGA | GGG | chr1 | 55039384 | 55039403 | 55039387 | - |
| SEQ ID NO 45677 | GTCAGATTACGCGCAGAGGG | AAG | chr1 | 55039381 | 55039400 | 55039384 | - |
| SEQ ID NO 45678 | AAAAACTCCCAAATCCTAAC | TGG | chr1 | 55039357 | 55039376 | 55039360 | - |
| SEQ ID NO 45679 | AAAACTCCCAAATCCTAACT | GGG | chr1 | 55039356 | 55039375 | 55039359 | - |
| SEQ ID NO 45680 | CTCCCAAATCCTAACTGGGC | TGG | chr1 | 55039352 | 55039371 | 55039355 | - |
| SEQ ID NO 45681 | CCAAATCCTAACTGGGCTGG | AAG | chr1 | 55039349 | 55039368 | 55039352 | - |

Figure 61 (Cont'd)

| SEQ ID NO 45682 | CAAATCCTAACTGGGCTGGA | AGG | chr1 | 55039348 | 55039367 | 55039351 | - |
| SEQ ID NO 45683 | ATCCTAACTGGGCTGGAAGG | CAG | chr1 | 55039345 | 55039364 | 55039348 | - |
| SEQ ID NO 45684 | TCCTAACTGGGCTGGAAGGC | AGG | chr1 | 55039344 | 55039363 | 55039347 | - |
| SEQ ID NO 45685 | AACTGGGCTGGAAGGCAGGC | CGG | chr1 | 55039340 | 55039359 | 55039343 | - |
| SEQ ID NO 45686 | TGGAAGGCAGGCCGGCGCCC | TAG | chr1 | 55039332 | 55039351 | 55039335 | - |
| SEQ ID NO 45687 | GGAAGGCAGGCCGGCGCCCT | AGG | chr1 | 55039331 | 55039350 | 55039334 | - |
| SEQ ID NO 45688 | GAAGGCAGGCCGGCGCCCTA | GGG | chr1 | 55039330 | 55039349 | 55039333 | - |
| SEQ ID NO 45689 | AAGGCAGGCCGGCGCCCTAG | GGG | chr1 | 55039329 | 55039348 | 55039332 | - |
| SEQ ID NO 45690 | CTCCCGCCTCTCACCCTGCG | TGG | chr1 | 55039298 | 55039317 | 55039301 | - |
| SEQ ID NO 45691 | TCCCGCCTCTCACCCTGCGT | GGG | chr1 | 55039297 | 55039316 | 55039300 | - |
| SEQ ID NO 45692 | TCTCACCCTGCGTGGGATGC | CAG | chr1 | 55039290 | 55039309 | 55039293 | - |
| SEQ ID NO 45693 | TGCGTGGGATGCCAGACTCC | AAG | chr1 | 55039282 | 55039301 | 55039285 | - |
| SEQ ID NO 45694 | TGCCAGACTCCAAGTTCTGC | CGG | chr1 | 55039273 | 55039292 | 55039276 | - |
| SEQ ID NO 45695 | GCCAGACTCCAAGTTCTGCC | GGG | chr1 | 55039272 | 55039291 | 55039275 | - |
| SEQ ID NO 45696 | TTCTGCCGGGCCCACCTTTT | CAG | chr1 | 55039259 | 55039278 | 55039262 | - |
| SEQ ID NO 45697 | CCCACCTTTTCAGTGTTTCC | TGG | chr1 | 55039249 | 55039268 | 55039252 | - |
| SEQ ID NO 45698 | CCACCTTTTCAGTGTTTCCT | GGG | chr1 | 55039248 | 55039267 | 55039251 | - |
| SEQ ID NO 45699 | CCACCTTGTCTCCTGCTGAC | CAG | chr1 | 55039224 | 55039243 | 55039227 | - |
| SEQ ID NO 45700 | CTTGTCTCCTGCTGACCAGT | GAG | chr1 | 55039220 | 55039239 | 55039223 | - |
| SEQ ID NO 45701 | CTTCTGAATCAATCCTACTG | TGG | chr1 | 55039196 | 55039215 | 55039199 | - |
| SEQ ID NO 45702 | GCCCACCGAATTCTTTCCAC | TGG | chr1 | 55039163 | 55039182 | 55039166 | - |
| SEQ ID NO 45703 | TCTTTCCACTGGCCTTAACC | TGG | chr1 | 55039152 | 55039171 | 55039155 | - |
| SEQ ID NO 45704 | TTCCACTGGCCTTAACCTGG | CAG | chr1 | 55039149 | 55039168 | 55039152 | - |
| SEQ ID NO 45705 | ACCTGGCAGCCTTCTAAACT | TAG | chr1 | 55039135 | 55039154 | 55039138 | - |
| SEQ ID NO 45706 | GCAGCCTTCTAAACTTAGCC | TGG | chr1 | 55039130 | 55039149 | 55039133 | - |
| SEQ ID NO 45707 | AACTTAGCCTGGACCCCCTC | CGG | chr1 | 55039119 | 55039138 | 55039122 | - |
| SEQ ID NO 45708 | TGCACACTGACCTTACCAAC | TAG | chr1 | 55039076 | 55039095 | 55039079 | - |
| SEQ ID NO 45709 | TACCAACTAGCTGCTCCTTG | AAG | chr1 | 55039063 | 55039082 | 55039066 | - |
| SEQ ID NO 45710 | CCAACTAGCTGCTCCTTGAA | GAG | chr1 | 55039061 | 55039080 | 55039064 | - |
| SEQ ID NO 45711 | GATTGCTTGCTTTTGATGTC | CAG | chr1 | 55039039 | 55039058 | 55039042 | - |
| SEQ ID NO 45712 | GTCCAGCCTACATGCATTTC | AAG | chr1 | 55039022 | 55039041 | 55039025 | - |
| SEQ ID NO 45713 | TCCAGCCTACATGCATTTCA | AGG | chr1 | 55039021 | 55039040 | 55039024 | - |
| SEQ ID NO 45714 | CCAGCCTACATGCATTTCAA | GGG | chr1 | 55039020 | 55039039 | 55039023 | - |
| SEQ ID NO 45715 | TTCAAGGGATTTATACTACA | AAG | chr1 | 55039005 | 55039024 | 55039008 | - |
| SEQ ID NO 45716 | GGATTTATACTACAAAGATT | CAG | chr1 | 55038999 | 55039018 | 55039002 | - |
| SEQ ID NO 45717 | GATTTATACTACAAAGATTC | AGG | chr1 | 55038998 | 55039017 | 55039001 | - |
| SEQ ID NO 45718 | ACTACAAAGATTCAGGTTTT | AAG | chr1 | 55038991 | 55039010 | 55038994 | - |
| SEQ ID NO 45719 | ATTCAGGTTTTAAGTTTGCA | AAG | chr1 | 55038982 | 55039001 | 55038985 | - |
| SEQ ID NO 45720 | AAGTTTGCAAAGACGTCATA | TAG | chr1 | 55038971 | 55038990 | 55038974 | - |
| SEQ ID NO 45721 | AGTTTGCAAAGACGTCATAT | AGG | chr1 | 55038970 | 55038989 | 55038973 | - |
| SEQ ID NO 45722 | AGACGTCATATAGGTACATT | CAG | chr1 | 55038961 | 55038980 | 55038964 | - |
| SEQ ID NO 45723 | TAGGTACATTCAGAATTCTA | TGG | chr1 | 55038951 | 55038970 | 55038954 | - |
| SEQ ID NO 45724 | GTACATTCAGAATTCTATGG | TAG | chr1 | 55038948 | 55038967 | 55038951 | - |
| SEQ ID NO 45725 | TACATTCAGAATTCTATGGT | AGG | chr1 | 55038947 | 55038966 | 55038950 | - |
| SEQ ID NO 45726 | CAGAATTCTATGGTAGGCAC | AAG | chr1 | 55038941 | 55038960 | 55038944 | - |
| SEQ ID NO 45727 | TTCTATGGTAGGCACAAGCT | CAG | chr1 | 55038936 | 55038955 | 55038939 | - |
| SEQ ID NO 45728 | TAGGCACAAGCTCAGCTTTC | CAG | chr1 | 55038928 | 55038947 | 55038931 | - |

Figure 61 (Cont'd)

| SEQ ID NO 45729 | GCACAAGCTCAGCTTTCCAG | AAG | chr1 | 55038925 | 55038944 | 55038928 | - |
|---|---|---|---|---|---|---|---|
| SEQ ID NO 45730 | TCCAGAAGATTCAATTTGCA | AAG | chr1 | 55038910 | 55038929 | 55038913 | - |
| SEQ ID NO 45731 | TCCTTTTACACACCATGTTC | AAG | chr1 | 55038885 | 55038904 | 55038888 | - |
| SEQ ID NO 45732 | ACCATGTTCAAGAAATCAAC | TGG | chr1 | 55038874 | 55038893 | 55038877 | - |
| SEQ ID NO 45733 | GTTCAAGAAATCAACTGGAC | AAG | chr1 | 55038869 | 55038888 | 55038872 | - |
| SEQ ID NO 45734 | AAATCAACTGGACAAGCATC | CAG | chr1 | 55038862 | 55038881 | 55038865 | - |
| SEQ ID NO 45735 | AGTAAACACCTATTGTGTAC | CAG | chr1 | 55038841 | 55038860 | 55038844 | - |
| SEQ ID NO 45736 | GTAAACACCTATTGTGTACC | AGG | chr1 | 55038840 | 55038859 | 55038843 | - |
| SEQ ID NO 45737 | AACACCTATTGTGTACCAGG | CAG | chr1 | 55038837 | 55038856 | 55038840 | - |
| SEQ ID NO 45738 | ACACCTATTGTGTACCAGGC | AGG | chr1 | 55038836 | 55038855 | 55038839 | - |
| SEQ ID NO 45739 | ACCTATTGTGTACCAGGCAG | GAG | chr1 | 55038834 | 55038853 | 55038837 | - |
| SEQ ID NO 45740 | CCTATTGTGTACCAGGCAGG | AGG | chr1 | 55038833 | 55038852 | 55038836 | - |
| SEQ ID NO 45741 | GTACCAGGCAGGAGGATGAA | AAG | chr1 | 55038825 | 55038844 | 55038828 | - |
| SEQ ID NO 45742 | TACCAGGCAGGAGGATGAAA | AGG | chr1 | 55038824 | 55038843 | 55038827 | - |
| SEQ ID NO 45743 | ACCAGGCAGGAGGATGAAAA | GGG | chr1 | 55038823 | 55038842 | 55038826 | - |
| SEQ ID NO 45744 | CCAGGCAGGAGGATGAAAAG | GGG | chr1 | 55038822 | 55038841 | 55038825 | - |
| SEQ ID NO 45745 | GCAGGAGGATGAAAAGGGGA | AAG | chr1 | 55038818 | 55038837 | 55038821 | - |
| SEQ ID NO 45746 | AGGAGGATGAAAAGGGGAAA | GAG | chr1 | 55038816 | 55038835 | 55038819 | - |
| SEQ ID NO 45747 | GAGGATGAAAAGGGGAAAGA | GAG | chr1 | 55038814 | 55038833 | 55038817 | - |
| SEQ ID NO 45748 | AAAAGGGGAAAGAGAGCTCC | TGG | chr1 | 55038807 | 55038826 | 55038810 | - |
| SEQ ID NO 45749 | GGAAAGAGAGCTCCTGGCCT | CAG | chr1 | 55038801 | 55038820 | 55038804 | - |
| SEQ ID NO 45750 | CTGGCCTCAGATTGTACATG | TGG | chr1 | 55038788 | 55038807 | 55038791 | - |
| SEQ ID NO 45751 | TTGTACATGTGGCATGACAT | GAG | chr1 | 55038777 | 55038796 | 55038780 | - |
| SEQ ID NO 45752 | TGTACATGTGGCATGACATG | AGG | chr1 | 55038776 | 55038795 | 55038779 | - |
| SEQ ID NO 45753 | GACATGAGGCTTGCTCTTTC | TGG | chr1 | 55038762 | 55038781 | 55038765 | - |
| SEQ ID NO 45754 | ATGAGGCTTGCTCTTTCTGG | AAG | chr1 | 55038759 | 55038778 | 55038762 | - |
| SEQ ID NO 45755 | TGAGGCTTGCTCTTTCTGGA | AGG | chr1 | 55038758 | 55038777 | 55038761 | - |
| SEQ ID NO 45756 | GAGGCTTGCTCTTTCTGGAA | GGG | chr1 | 55038757 | 55038776 | 55038760 | - |
| SEQ ID NO 45757 | TCTGGAAGGGCTGTCGATAC | TGG | chr1 | 55038744 | 55038763 | 55038747 | - |
| SEQ ID NO 45758 | CTGGAAGGGCTGTCGATACT | GGG | chr1 | 55038743 | 55038762 | 55038746 | - |
| SEQ ID NO 45759 | GAAGGGCTGTCGATACTGGG | AAG | chr1 | 55038740 | 55038759 | 55038743 | - |
| SEQ ID NO 45760 | GTCGATACTGGGAAGAAACA | AAG | chr1 | 55038732 | 55038751 | 55038735 | - |
| SEQ ID NO 45761 | TCGATACTGGGAAGAAACAA | AGG | chr1 | 55038731 | 55038750 | 55038734 | - |
| SEQ ID NO 45762 | GAATTTATGATCCTCCCTTG | CAG | chr1 | 55038707 | 55038726 | 55038710 | - |
| SEQ ID NO 45763 | GATCCTCCCTTGCAGATGCA | CAG | chr1 | 55038699 | 55038718 | 55038702 | - |
| SEQ ID NO 45764 | CCTCCCTTGCAGATGCACAG | CAG | chr1 | 55038696 | 55038715 | 55038699 | - |
| SEQ ID NO 45765 | GCAGATGCACAGCAGATTCC | GAG | chr1 | 55038688 | 55038707 | 55038691 | - |
| SEQ ID NO 45766 | ACAGCAGATTCCGAGTGAAA | TGG | chr1 | 55038680 | 55038699 | 55038683 | - |
| SEQ ID NO 45767 | GAAATGGCCTGCTCTGAATC | TAG | chr1 | 55038664 | 55038683 | 55038667 | - |
| SEQ ID NO 45768 | AAATGGCCTGCTCTGAATCT | AGG | chr1 | 55038663 | 55038682 | 55038666 | - |
| SEQ ID NO 45769 | CCTGCTCTGAATCTAGGTGC | TGG | chr1 | 55038657 | 55038676 | 55038660 | - |
| SEQ ID NO 45770 | TGCTCTGAATCTAGGTGCTG | GAG | chr1 | 55038655 | 55038674 | 55038658 | - |
| SEQ ID NO 45771 | AATCTAGGTGCTGGAGTCCA | AAG | chr1 | 55038648 | 55038667 | 55038651 | - |
| SEQ ID NO 45772 | CTCTTTCCACTTTGTTTGCA | AAG | chr1 | 55038619 | 55038638 | 55038622 | - |
| SEQ ID NO 45773 | TGTTTGCAAAGACCTCACTC | CAG | chr1 | 55038607 | 55038626 | 55038610 | - |
| SEQ ID NO 45774 | TTTGCAAAGACCTCACTCCA | GAG | chr1 | 55038605 | 55038624 | 55038608 | - |
| SEQ ID NO 45775 | TGCAAAGACCTCACTCCAGA | GAG | chr1 | 55038603 | 55038622 | 55038606 | - |

Figure 61 (Cont'd)

| SEQ ID NO 45776 | AAGACCTCACTCCAGAGAGC | CAG | chr1 | 55038599 | 55038618 | 55038602 | - |
| SEQ ID NO 45777 | CTCCAGAGAGCCAGTGCACA | AAG | chr1 | 55038590 | 55038609 | 55038593 | - |
| SEQ ID NO 45778 | AGAGAGCCAGTGCACAAAGA | CAG | chr1 | 55038586 | 55038605 | 55038589 | - |
| SEQ ID NO 45779 | GTGCACAAAGACAGTGCAAC | CAG | chr1 | 55038577 | 55038596 | 55038580 | - |
| SEQ ID NO 45780 | CACAAAGACAGTGCAACCAG | TGG | chr1 | 55038574 | 55038593 | 55038577 | - |
| SEQ ID NO 45781 | ACAAAGACAGTGCAACCAGT | GGG | chr1 | 55038573 | 55038592 | 55038576 | - |
| SEQ ID NO 45782 | CAGTGCAACCAGTGGGTTGA | CAG | chr1 | 55038566 | 55038585 | 55038569 | - |
| SEQ ID NO 45783 | TGGGTTGACAGTGACTCCAT | GAG | chr1 | 55038554 | 55038573 | 55038557 | - |
| SEQ ID NO 45784 | GGGTTGACAGTGACTCCATG | AGG | chr1 | 55038553 | 55038572 | 55038556 | - |
| SEQ ID NO 45785 | TGACAGTGACTCCATGAGGT | AAG | chr1 | 55038549 | 55038568 | 55038552 | - |
| SEQ ID NO 45786 | GACAGTGACTCCATGAGGTA | AGG | chr1 | 55038548 | 55038567 | 55038551 | - |
| SEQ ID NO 45787 | GTGACTCCATGAGGTAAGGT | CAG | chr1 | 55038544 | 55038563 | 55038547 | - |
| SEQ ID NO 45788 | GACTCCATGAGGTAAGGTCA | GAG | chr1 | 55038542 | 55038561 | 55038545 | - |
| SEQ ID NO 45789 | AGGTCAGAGTTATCCCCATC | GAG | chr1 | 55038528 | 55038547 | 55038531 | - |
| SEQ ID NO 45790 | CCCCATCGAGCCGCCATCG | CAG | chr1 | 55038515 | 55038534 | 55038518 | - |
| SEQ ID NO 45791 | TCGAGCCCGCCATCGCAGCA | CAG | chr1 | 55038510 | 55038529 | 55038513 | - |
| SEQ ID NO 45792 | GAGCCCGCCATCGCAGCACA | GAG | chr1 | 55038508 | 55038527 | 55038511 | - |
| SEQ ID NO 45793 | CCCGCCATCGCAGCACAGAG | TAG | chr1 | 55038505 | 55038524 | 55038508 | - |
| SEQ ID NO 45794 | CCGCCATCGCAGCACAGAGT | AGG | chr1 | 55038504 | 55038523 | 55038507 | - |
| SEQ ID NO 45795 | GCCATCGCAGCACAGAGTAG | GAG | chr1 | 55038502 | 55038521 | 55038505 | - |
| SEQ ID NO 45796 | CAGCACAGAGTAGGAGCTCA | TGG | chr1 | 55038495 | 55038514 | 55038498 | - |
| SEQ ID NO 45797 | AGGAGCTCATGGTTTGCTGA | CAG | chr1 | 55038484 | 55038503 | 55038487 | - |
| SEQ ID NO 45798 | GAGCTCATGGTTTGCTGACA | GAG | chr1 | 55038482 | 55038501 | 55038485 | - |
| SEQ ID NO 45799 | AGCTCATGGTTTGCTGACAG | AGG | chr1 | 55038481 | 55038500 | 55038484 | - |
| SEQ ID NO 45800 | TCATGGTTTGCTGACAGAGG | TGG | chr1 | 55038478 | 55038497 | 55038481 | - |
| SEQ ID NO 45801 | TGGTTTGCTGACAGAGGTGG | CAG | chr1 | 55038475 | 55038494 | 55038478 | - |
| SEQ ID NO 45802 | GTTTGCTGACAGAGGTGGCA | GAG | chr1 | 55038473 | 55038492 | 55038476 | - |
| SEQ ID NO 45803 | TTTGCTGACAGAGGTGGCAG | AGG | chr1 | 55038472 | 55038491 | 55038475 | - |
| SEQ ID NO 45804 | GCTGACAGAGGTGGCAGAGG | TGG | chr1 | 55038469 | 55038488 | 55038472 | - |
| SEQ ID NO 45805 | TCCTTCCTGTTGCCTGTAAT | TGG | chr1 | 55038443 | 55038462 | 55038446 | - |
| SEQ ID NO 45806 | TTGTATTTGCAATGTGCTTT | TGG | chr1 | 55038418 | 55038437 | 55038421 | - |
| SEQ ID NO 45807 | TATTTGCAATGTGCTTTTGG | CAG | chr1 | 55038415 | 55038434 | 55038418 | - |
| SEQ ID NO 45808 | TTTTGGCAGCTTCCTCATCA | AAG | chr1 | 55038401 | 55038420 | 55038404 | - |
| SEQ ID NO 45809 | TTTGGCAGCTTCCTCATCAA | AGG | chr1 | 55038400 | 55038419 | 55038403 | - |
| SEQ ID NO 45810 | TCCTCATCAAAGGCCTCCCC | TGG | chr1 | 55038390 | 55038409 | 55038393 | - |
| SEQ ID NO 45811 | CTCATCAAAGGCCTCCCCTG | GAG | chr1 | 55038388 | 55038407 | 55038391 | - |
| SEQ ID NO 45812 | TCAAAGGCCTCCCCTGGAGC | AAG | chr1 | 55038384 | 55038403 | 55038387 | - |
| SEQ ID NO 45813 | GGCCTCCCCTGGAGCAAGAA | TAG | chr1 | 55038379 | 55038398 | 55038382 | - |
| SEQ ID NO 45814 | TCCCCTGGAGCAAGAATAGA | TGG | chr1 | 55038375 | 55038394 | 55038378 | - |
| SEQ ID NO 45815 | CCCCTGGAGCAAGAATAGAT | GGG | chr1 | 55038374 | 55038393 | 55038377 | - |
| SEQ ID NO 45816 | CCTGGAGCAAGAATAGATGG | GAG | chr1 | 55038372 | 55038391 | 55038375 | - |
| SEQ ID NO 45817 | CTTTCCCTGCTGCTCCCCTT | TGG | chr1 | 55038345 | 55038364 | 55038348 | - |
| SEQ ID NO 45818 | TTTCCCTGCTGCTCCCCTTT | GGG | chr1 | 55038344 | 55038363 | 55038347 | - |
| SEQ ID NO 45819 | GCTGCTCCCCTTTGGGACCT | TGG | chr1 | 55038337 | 55038356 | 55038340 | - |
| SEQ ID NO 45820 | GACCTTGGCCTCTCACCTAC | CGG | chr1 | 55038322 | 55038341 | 55038325 | - |
| SEQ ID NO 45821 | ACCTTGGCCTCTCACCTACC | GGG | chr1 | 55038321 | 55038340 | 55038324 | - |
| SEQ ID NO 45822 | CCTTGGCCTCTCACCTACCG | GGG | chr1 | 55038320 | 55038339 | 55038323 | - |

Figure 62

| # | Sequence | PAM | Chr | Start | End | Cuts 5' of | Str |
|---|---|---|---|---|---|---|---|
| SEQ ID NO 45823 | GCTGCGATGGCGGGCTCGAT | GGGGAT | chr1 | 55038511 | 55038530 | 55038527 | + |
| SEQ ID NO 45824 | ATAACTCTGACCTTACCTCA | TGGAGT | chr1 | 55038535 | 55038554 | 55038551 | + |
| SEQ ID NO 45825 | GTCTTTGTGCACTGGCTCTC | TGGAGT | chr1 | 55038585 | 55038604 | 55038601 | + |
| SEQ ID NO 45826 | TCAGAGCAGGCCATTTCACT | CGGAAT | chr1 | 55038667 | 55038686 | 55038683 | + |
| SEQ ID NO 45827 | TCTGCTGTGCATCTGCAAGG | GAGGAT | chr1 | 55038692 | 55038711 | 55038708 | + |
| SEQ ID NO 45828 | TGGTACACAATAGGTGTTTA | CTGGAT | chr1 | 55038839 | 55038858 | 55038855 | + |
| SEQ ID NO 45829 | TCTTGAACATGGTGTGTAAA | AGGAAT | chr1 | 55038881 | 55038900 | 55038897 | + |
| SEQ ID NO 45830 | GTAAAAGGAATCTTTGCAAA | TTGAAT | chr1 | 55038896 | 55038915 | 55038912 | + |
| SEQ ID NO 45831 | AGCTGAGCTTGTGCCTACCA | TAGAAT | chr1 | 55038931 | 55038950 | 55038947 | + |
| SEQ ID NO 45832 | CTTGTGCCTACCATAGAATT | CTGAAT | chr1 | 55038938 | 55038957 | 55038954 | + |
| SEQ ID NO 45833 | CGTCTTTGCAAACTTAAAAC | CTGAAT | chr1 | 55038976 | 55038995 | 55038992 | + |
| SEQ ID NO 45834 | TAGTTGGTAAGGTCAGTGTG | CAGGGT | chr1 | 55039074 | 55039093 | 55039090 | + |
| SEQ ID NO 45835 | CATAAAGGGCAGAGGCCGGA | GGGGGT | chr1 | 55039101 | 55039120 | 55039117 | + |
| SEQ ID NO 45836 | GCCAGGTTAAGGCCAGTGGA | AAGAAT | chr1 | 55039148 | 55039167 | 55039164 | + |
| SEQ ID NO 45837 | AAAGAATTCGGTGGGCAGCG | AGGAGT | chr1 | 55039167 | 55039186 | 55039183 | + |
| SEQ ID NO 45838 | GGGCAGCGAGGAGTCCACAG | TAGGAT | chr1 | 55039179 | 55039198 | 55039195 | + |
| SEQ ID NO 45839 | AAGGTGGGCCCGGCAGAACT | TGGAGT | chr1 | 55039261 | 55039280 | 55039277 | + |
| SEQ ID NO 45840 | TTGGAGTCTGGCATCCCACG | CAGGGT | chr1 | 55039280 | 55039299 | 55039296 | + |
| SEQ ID NO 45841 | GGCCTGCCTTCCAGCCCAGT | TAGGAT | chr1 | 55039339 | 55039358 | 55039355 | + |
| SEQ ID NO 45842 | TTCCAGCCCAGTTAGGATTT | GGGAGT | chr1 | 55039347 | 55039366 | 55039363 | + |
| SEQ ID NO 45843 | GAAACCTGATCCTCCAGTCC | GGGGGT | chr1 | 55039423 | 55039442 | 55039439 | + |
| SEQ ID NO 45844 | TCCGTTAATGTTTAATCAGA | TAGGAT | chr1 | 55039449 | 55039468 | 55039465 | + |
| SEQ ID NO 45845 | GCGGGCGCCGCCGTTCAGTT | CAGGGT | chr1 | 55039576 | 55039595 | 55039592 | + |
| SEQ ID NO 45846 | AGTTCAGGGTCTGAGCCTGG | AGGAGT | chr1 | 55039592 | 55039611 | 55039608 | + |
| SEQ ID NO 45847 | AGCGGCTCCCAGCTCCCAGC | CAGGAT | chr1 | 55039668 | 55039687 | 55039684 | + |
| SEQ ID NO 45848 | TGCTGCTGCTGCTGCTGCTC | CTGGGT | chr1 | 55039884 | 55039903 | 55039900 | + |
| SEQ ID NO 45849 | TTCCACCGCTGCGCCAAGGT | GCGGGT | chr1 | 55040027 | 55040046 | 55040043 | + |
| SEQ ID NO 45850 | CTGCGCCAAGGTGCGGGTGT | AGGGAT | chr1 | 55040035 | 55040054 | 55040051 | + |
| SEQ ID NO 45851 | CCCCCATGTAAGAGAGGAAG | TGGAGT | chr1 | 55040125 | 55040144 | 55040141 | + |
| SEQ ID NO 45852 | AGGCAAGGCGGCGGGGGAGG | ACGGGT | chr1 | 55040196 | 55040215 | 55040212 | + |
| SEQ ID NO 45853 | CTATTCAGTGGGAAGGTTCG | CGGGGT | chr1 | 55040289 | 55040308 | 55040305 | + |
| SEQ ID NO 45854 | AAGGGCGAGCAGAGCACTGC | CAGGAT | chr1 | 55040336 | 55040355 | 55040352 | + |
| SEQ ID NO 45855 | TCTGCCTCGCCGCGGCACAG | GTGGGT | chr1 | 55040384 | 55040403 | 55040400 | + |
| SEQ ID NO 45856 | GCCGCGGCACAGGTGGGTGA | AGGAGT | chr1 | 55040392 | 55040411 | 55040408 | + |
| SEQ ID NO 45857 | CGGCACAGGTGGGTGAAGGA | GTGAAT | chr1 | 55040396 | 55040415 | 55040412 | + |
| SEQ ID NO 45858 | AAAGCGGGCTTGCCATTATA | GTGGGT | chr1 | 55040458 | 55040477 | 55040474 | + |
| SEQ ID NO 45859 | TTTGGAAAACATGGGCAGCG | GAGGGT | chr1 | 55040494 | 55040513 | 55040510 | + |
| SEQ ID NO 45860 | GGCCCTACCCGAGACAGGGG | CGGGGT | chr1 | 55040537 | 55040556 | 55040553 | + |
| SEQ ID NO 45861 | GTCTGCCGACCGTGTGCGGG | GCGAGT | chr1 | 55040818 | 55040837 | 55040834 | + |
| SEQ ID NO 45862 | AGGTTCTGTGTCCCCCAGCT | TGGAGT | chr1 | 55040949 | 55040968 | 55040965 | + |
| SEQ ID NO 45863 | CCCCAGCTTGGAGTCAGATG | TGGGGT | chr1 | 55040961 | 55040980 | 55040977 | + |
| SEQ ID NO 45864 | GCTTGGAGTCAGATGTGGGG | TTGAAT | chr1 | 55040966 | 55040985 | 55040982 | + |
| SEQ ID NO 45865 | AAGGGAAAGTTCTGTTGACC | ATGAGT | chr1 | 55041115 | 55041134 | 55041131 | + |
| SEQ ID NO 45866 | ACTTACAATGCAAGCCCCGG | GGGGAT | chr1 | 55041143 | 55041162 | 55041159 | + |
| SEQ ID NO 45867 | CTGCCTGCCCACGCTTCTGT | CTGAGT | chr1 | 55041272 | 55041291 | 55041288 | + |
| SEQ ID NO 45868 | CACGCTTCTGTCTGAGTGTG | CTGGGT | chr1 | 55041281 | 55041300 | 55041297 | + |
| SEQ ID NO 45869 | TGTCTGAGTGTGCTGGGTGG | CAGGAT | chr1 | 55041289 | 55041308 | 55041305 | + |
| SEQ ID NO 45870 | CTGAGCCTTTGACTTTCTCG | AGGGAT | chr1 | 55041358 | 55041377 | 55041374 | + |

Figure 62 (Cont'd)

| SEQ ID NO 45871 | GACTTTCTCGAGGGATGTTG | TGGGGT | chr1 | 55041368 | 55041387 | 55041384 | + |
| SEQ ID NO 45872 | GGATGTTGTGGGGTTGTGGC | CAGGAT | chr1 | 55041380 | 55041399 | 55041396 | + |
| SEQ ID NO 45873 | AAACAACTGTTCTGGAAATA | GTGAGT | chr1 | 55041438 | 55041457 | 55041454 | + |
| SEQ ID NO 45874 | TGAGTACCCCATCCTGAGAG | GTGAGT | chr1 | 55041459 | 55041478 | 55041475 | + |
| SEQ ID NO 45875 | ACCACCTGAACCAAGCCCTT | GAGGAT | chr1 | 55041501 | 55041520 | 55041517 | + |
| SEQ ID NO 45876 | TCATTCAATGGTTATTTTGT | GGGAAT | chr1 | 55041582 | 55041601 | 55041598 | + |
| SEQ ID NO 45877 | CAATGGTTATTTTGTGGGAA | TCGAAT | chr1 | 55041587 | 55041606 | 55041603 | + |
| SEQ ID NO 45878 | TATTTTGTGGGAATCGAATT | TAGAAT | chr1 | 55041594 | 55041613 | 55041610 | + |
| SEQ ID NO 45879 | TCACCCCAGGTGCATTAGAA | CTGGGT | chr1 | 55041706 | 55041725 | 55041722 | + |
| SEQ ID NO 45880 | AGAACTGACACTCCACTGCA | CAGAGT | chr1 | 55041736 | 55041755 | 55041752 | + |
| SEQ ID NO 45881 | TTAGCGGAAGGCATTTTCAG | ATGGGT | chr1 | 55041788 | 55041807 | 55041804 | + |
| SEQ ID NO 45882 | TGGGTCTTTGAAGCATTAGT | AGGAGT | chr1 | 55041809 | 55041828 | 55041825 | + |
| SEQ ID NO 45883 | TTCAGCGATGATGGTGTCAT | GAGAAT | chr1 | 55041834 | 55041853 | 55041850 | + |
| SEQ ID NO 45884 | GTGTCATGAGAATTTTATTC | TAGGAT | chr1 | 55041847 | 55041866 | 55041863 | + |
| SEQ ID NO 45885 | TTTTTCTTTTTTTTTTGAGA | TGGAGT | chr1 | 55041948 | 55041967 | 55041964 | + |
| SEQ ID NO 45886 | TTCGCTCTTGTTGCCCAGGC | TGGAGT | chr1 | 55041974 | 55041993 | 55041990 | + |
| SEQ ID NO 45887 | CTCACTGCAACATCTGTCTC | CCGGGT | chr1 | 55042018 | 55042037 | 55042034 | + |
| SEQ ID NO 45888 | GCCTCAGCCTCCCAAGAAGC | TGGGAT | chr1 | 55042059 | 55042078 | 55042075 | + |
| SEQ ID NO 45889 | TTTTGTATTTTTAGTAGAGA | AGGGGT | chr1 | 55042115 | 55042134 | 55042131 | + |
| SEQ ID NO 45890 | GCAAACTCCTGACCTCCTCA | GTGGAT | chr1 | 55042165 | 55042184 | 55042181 | + |
| SEQ ID NO 45891 | GCCTCAGCCTCCCAAAGTGC | TCGAAT | chr1 | 55042210 | 55042229 | 55042226 | + |
| SEQ ID NO 45892 | ATTATTTTAATTTAGTTGT | GTGAAT | chr1 | 55042366 | 55042385 | 55042382 | + |
| SEQ ID NO 45893 | ACCGTTTTGGCCCTAAGGCT | TTGGGT | chr1 | 55042509 | 55042528 | 55042525 | + |
| SEQ ID NO 45894 | GCCCTAAGGCTTTGGGTAAA | GGGGGT | chr1 | 55042518 | 55042537 | 55042534 | + |
| SEQ ID NO 45895 | GGACTCTGTTCTACTCTGAC | TGGAGT | chr1 | 55042544 | 55042563 | 55042560 | + |
| SEQ ID NO 45896 | AGATGCATATACAGAGAT | ATGGGT | chr1 | 55042573 | 55042592 | 55042589 | + |
| SEQ ID NO 45897 | GTAGGGGCCAAGGAGGAGCA | TGGAGT | chr1 | 55042623 | 55042642 | 55042639 | + |
| SEQ ID NO 45898 | TGGGGCCTAATGGGAGGTGT | TTGGGT | chr1 | 55042829 | 55042848 | 55042845 | + |
| SEQ ID NO 45899 | TTGGTGCCGTCCTTGTGATA | ATGAGT | chr1 | 55042882 | 55042901 | 55042898 | + |
| SEQ ID NO 45900 | CATGCTTCCTGGAGAGCTTG | CAGAAT | chr1 | 55043088 | 55043107 | 55043104 | + |
| SEQ ID NO 45901 | AGAGCTTGCAGAATCATGAG | CTGAAT | chr1 | 55043100 | 55043119 | 55043116 | + |
| SEQ ID NO 45902 | TGCCTGCATTTGTAGAGCAT | CTGGAT | chr1 | 55043258 | 55043277 | 55043274 | + |
| SEQ ID NO 45903 | GTATCTGAGGCTCCGAGAGG | TTGAGT | chr1 | 55043365 | 55043384 | 55043381 | + |
| SEQ ID NO 45904 | CAACCAGTAAATATTGGAGC | TGGAAT | chr1 | 55043409 | 55043428 | 55043425 | + |
| SEQ ID NO 45905 | TCTGACTGGGGCATGGGGGA | GGGGGT | chr1 | 55043488 | 55043507 | 55043504 | + |
| SEQ ID NO 45906 | GCGACCAGGCCCGTAGAGAG | CTGGGT | chr1 | 55043538 | 55043557 | 55043554 | + |
| SEQ ID NO 45907 | GTACAGAGGAAAACCTGTTG | TCGAGT | chr1 | 55043568 | 55043587 | 55043584 | + |
| SEQ ID NO 45908 | CCCGTAGTTCCCATTTTTGC | CTGAAT | chr1 | 55043598 | 55043617 | 55043614 | + |
| SEQ ID NO 45909 | TGAAAGTGTTATATAACCAT | GTGAAT | chr1 | 55043632 | 55043651 | 55043648 | + |
| SEQ ID NO 45910 | AATAATAATAGTTGGCCTAT | ATGAGT | chr1 | 55043655 | 55043674 | 55043671 | + |
| SEQ ID NO 45911 | TTTTGTTGTAATTTGTAAGT | AGGGGT | chr1 | 55043748 | 55043767 | 55043764 | + |
| SEQ ID NO 45912 | GGGGTGAGATAAAGTACACC | TAGGGT | chr1 | 55043769 | 55043788 | 55043785 | + |
| SEQ ID NO 45913 | TAAAGTACACCTAGGGTTTG | CTGGGT | chr1 | 55043778 | 55043797 | 55043794 | + |
| SEQ ID NO 45914 | TGTTCCTCCTTGCATGGGGC | CAGGAT | chr1 | 55043820 | 55043839 | 55043836 | + |
| SEQ ID NO 45915 | GCAGGCCAGGCTGCCCGCC | GGGGAT | chr1 | 55043929 | 55043948 | 55043945 | + |
| SEQ ID NO 45916 | TTCCTGGCTTCCTGGTGAAG | ATGAGT | chr1 | 55043991 | 55044010 | 55044007 | + |
| SEQ ID NO 45917 | GCTGGTGAGCCACCCTTTTT | GGGAAT | chr1 | 55044031 | 55044050 | 55044047 | + |
| SEQ ID NO 45918 | AAGTATGTATTGAGCACTTA | TCGGGT | chr1 | 55044143 | 55044162 | 55044159 | + |
| SEQ ID NO 45919 | GTAACTACTGGCTTTCTGTA | TAGAAT | chr1 | 55044179 | 55044198 | 55044195 | + |

Figure 62 (Cont'd)

| SEQ ID NO 45920 | AGGGGACCACACAGACAGCT | AGGGGT | chr1 | 55044276 | 55044295 | 55044292 | + |
| SEQ ID NO 45921 | CAGACAGCTAGGGGTAGAGC | CTGGAT | chr1 | 55044287 | 55044306 | 55044303 | + |
| SEQ ID NO 45922 | AACCTGTAGGGACAAGGCCC | TGGGAT | chr1 | 55044371 | 55044390 | 55044387 | + |
| SEQ ID NO 45923 | CCTGGGATGTTCAGTGGAGC | CTGAGT | chr1 | 55044389 | 55044408 | 55044405 | + |
| SEQ ID NO 45924 | TTTATAAAAAGCATGACTC | TAGGGT | chr1 | 55044418 | 55044437 | 55044434 | + |
| SEQ ID NO 45925 | CCTTTGAAGCTGTTGCTATC | CAGAGT | chr1 | 55044452 | 55044471 | 55044468 | + |
| SEQ ID NO 45926 | GTGAAGTCCCTTCTTTAGGA | CAGGGT | chr1 | 55044476 | 55044495 | 55044492 | + |
| SEQ ID NO 45927 | CAGGGTGGCCCTCCTCCCTC | CTGGAT | chr1 | 55044496 | 55044515 | 55044512 | + |
| SEQ ID NO 45928 | GTGGAGGGGCAGAAAGGGGA | CTGGGT | chr1 | 55044534 | 55044553 | 55044550 | + |
| SEQ ID NO 45929 | AAGATTTGAAGCACTAGGGC | CAGGGT | chr1 | 55044575 | 55044594 | 55044578 | - |
| SEQ ID NO 45930 | AGCACTAGGGCCAGGGTGAG | GAGAAT | chr1 | 55044566 | 55044585 | 55044569 | - |
| SEQ ID NO 45931 | CCTAAAGAAGGGACTTCACT | CTGGAT | chr1 | 55044475 | 55044494 | 55044478 | - |
| SEQ ID NO 45932 | CTGGATAGCAACAGCTTCAA | AGGAAT | chr1 | 55044455 | 55044474 | 55044458 | - |
| SEQ ID NO 45933 | TTCAAAGGAATTTTGGACCC | TAGAGT | chr1 | 55044440 | 55044459 | 55044443 | - |
| SEQ ID NO 45934 | GGCAGCAGATGCATTGGCAC | AAGAAT | chr1 | 55044345 | 55044364 | 55044348 | - |
| SEQ ID NO 45935 | AATGGCTGGCAGGCAGACCA | ATGGGT | chr1 | 55044322 | 55044341 | 55044325 | - |
| SEQ ID NO 45936 | GGGGCATGGCCAGGCTTAAA | GGGAAT | chr1 | 55044209 | 55044228 | 55044212 | - |
| SEQ ID NO 45937 | CAGGAAGTGCCATTCCCAAA | AAGGGT | chr1 | 55044048 | 55044067 | 55044051 | - |
| SEQ ID NO 45938 | AGAAGGCCATGGAAGACATG | CAGGAT | chr1 | 55043972 | 55043991 | 55043975 | - |
| SEQ ID NO 45939 | GTGCGCTCTGACTGCGAGAG | GTGGGT | chr1 | 55043897 | 55043916 | 55043900 | - |
| SEQ ID NO 45940 | GTAGGTGCCAGGCAACCTCC | ACGGAT | chr1 | 55043850 | 55043869 | 55043853 | - |
| SEQ ID NO 45941 | TTACAACAAAAGAGACACAA | CAGAGT | chr1 | 55043739 | 55043758 | 55043742 | - |
| SEQ ID NO 45942 | CCCCTCCCCCATGCCCCAGT | CAGAAT | chr1 | 55043492 | 55043511 | 55043495 | - |
| SEQ ID NO 45943 | GGAGCCAGGAAACCGTGGAC | CTGAAT | chr1 | 55043439 | 55043458 | 55043442 | - |
| SEQ ID NO 45944 | ATAGGCCTGCTGGGAAAGTC | AAGAGT | chr1 | 55043310 | 55043329 | 55043313 | - |
| SEQ ID NO 45945 | GCTCTACAAATGCAGGCAGA | AGGGAT | chr1 | 55043256 | 55043275 | 55043259 | - |
| SEQ ID NO 45946 | CCTTTTGTGTTGCTATATAA | AGGAAT | chr1 | 55043168 | 55043187 | 55043171 | - |
| SEQ ID NO 45947 | ATATAAAGGAATACCTGAAG | GTGAGT | chr1 | 55043154 | 55043173 | 55043157 | - |
| SEQ ID NO 45948 | GTGAGTAATTTACAAGGAAA | AGGGAT | chr1 | 55043134 | 55043153 | 55043137 | - |
| SEQ ID NO 45949 | GACGGCACCAAGCCTTTCAC | AGGGGT | chr1 | 55042873 | 55042892 | 55042876 | - |
| SEQ ID NO 45950 | CACTGGCTCCCCACAGCCTC | ATGAAT | chr1 | 55042664 | 55042683 | 55042667 | - |
| SEQ ID NO 45951 | TATGCATCTTGGACTCCAGT | CAGAGT | chr1 | 55042562 | 55042581 | 55042565 | - |
| SEQ ID NO 45952 | GGACTCCAGTCAGAGTAGAA | CAGAGT | chr1 | 55042552 | 55042571 | 55042555 | - |
| SEQ ID NO 45953 | TTTTGAACCTCAGAACTTGT | TTGGAT | chr1 | 55042490 | 55042509 | 55042493 | - |
| SEQ ID NO 45954 | GAAAGGCAGTAATGGGCAAT | CAGAGT | chr1 | 55042460 | 55042479 | 55042463 | - |
| SEQ ID NO 45955 | GGCAATCAGAGTCTGCTTGG | AAGAAT | chr1 | 55042446 | 55042465 | 55042449 | - |
| SEQ ID NO 45956 | TAATCTATGCAGCAAAATAT | ATGAAT | chr1 | 55042404 | 55042423 | 55042407 | - |
| SEQ ID NO 45957 | AACATTTACATTTCAGACG | GTGGAT | chr1 | 55042282 | 55042301 | 55042285 | - |
| SEQ ID NO 45958 | ACTTTGGGAGGCTGAGGCGG | GAGGAT | chr1 | 55042208 | 55042227 | 55042211 | - |
| SEQ ID NO 45959 | GAGGCGGGAGGATCACCTCC | TCGGAT | chr1 | 55042195 | 55042214 | 55042198 | - |
| SEQ ID NO 45960 | TCGGATCCACTGAGGAGGTC | AGGAGT | chr1 | 55042175 | 55042194 | 55042178 | - |
| SEQ ID NO 45961 | TTCATGGTACCTCCTAATCC | TAGAAT | chr1 | 55041869 | 55041888 | 55041872 | - |
| SEQ ID NO 45962 | TGCCTTCCGCTAAATAAAAA | TTGAAT | chr1 | 55041781 | 55041800 | 55041784 | - |
| SEQ ID NO 45963 | TTCCGCTAAATAAAAATTGA | ATGAAT | chr1 | 55041777 | 55041796 | 55041780 | - |
| SEQ ID NO 45964 | ATAAAAATTGAATGAATTGG | GAGAGT | chr1 | 55041768 | 55041787 | 55041771 | - |
| SEQ ID NO 45965 | TGGGAGAGTACTCTGTGCAG | TGGAGT | chr1 | 55041751 | 55041770 | 55041754 | - |
| SEQ ID NO 45966 | AAACCCAGTTCTAATGCACC | TGGGGT | chr1 | 55041714 | 55041733 | 55041717 | - |
| SEQ ID NO 45967 | GTTTCTCATGACTAAAAGAA | AAGGAT | chr1 | 55041666 | 55041685 | 55041669 | - |
| SEQ ID NO 45968 | CGATTCCCACAAAATAACCA | TTGAAT | chr1 | 55041590 | 55041609 | 55041593 | - |

Figure 62 (Cont'd)

| SEQ ID NO 45969 | TCCCACAAAATAACCATTGA | ATGAAT | chr1 | 55041586 | 55041605 | 55041589 | - |
| SEQ ID NO 45970 | ACAAAATAACCATTGAATGA | ATGAAT | chr1 | 55041582 | 55041601 | 55041585 | - |
| SEQ ID NO 45971 | GCCTCTGCTTACTCACCTCT | CAGGAT | chr1 | 55041475 | 55041494 | 55041478 | - |
| SEQ ID NO 45972 | TGCTTACTCACCTCTCAGGA | TGGGGT | chr1 | 55041470 | 55041489 | 55041473 | - |
| SEQ ID NO 45973 | AGGAAGAGGGCTATACTGAG | CTGAGT | chr1 | 55041332 | 55041351 | 55041335 | - |
| SEQ ID NO 45974 | AGAAGCGTGGGCAGGCAGCT | GTGAGT | chr1 | 55041270 | 55041289 | 55041273 | - |
| SEQ ID NO 45975 | GGGCAGGCAGCTGTGAGTGG | CAGAAT | chr1 | 55041262 | 55041281 | 55041265 | - |
| SEQ ID NO 45976 | AGATTAGGCAATGGAGGCTC | AAGGAT | chr1 | 55041040 | 55041059 | 55041043 | - |
| SEQ ID NO 45977 | GCCTGAGGGCCAGAAGCTGG | CAGAGT | chr1 | 55040860 | 55040879 | 55040863 | - |
| SEQ ID NO 45978 | TGAGGCGCCGGGCTCAGCTC | CGGGGT | chr1 | 55040786 | 55040805 | 55040789 | - |
| SEQ ID NO 45979 | CACCAAGGGCCCTTCCCTGC | CTGAGT | chr1 | 55040726 | 55040745 | 55040729 | - |
| SEQ ID NO 45980 | AAAGGACGCCAATGGGCCTC | GAGAAT | chr1 | 55040697 | 55040716 | 55040700 | - |
| SEQ ID NO 45981 | TTTTCTTCGGCTGAAACAGA | TGGAAT | chr1 | 55040634 | 55040653 | 55040637 | - |
| SEQ ID NO 45982 | AACAGATGGAATACTAGAGC | ATGAGT | chr1 | 55040620 | 55040639 | 55040623 | - |
| SEQ ID NO 45983 | CTTCCCACCCCGCCCCTGTC | TCGGGT | chr1 | 55040549 | 55040568 | 55040552 | - |
| SEQ ID NO 45984 | CAGAAACTGGGAAATCTGGG | CAGGAT | chr1 | 55040368 | 55040387 | 55040371 | - |
| SEQ ID NO 45985 | TGCTCGCCCTTCCTCGGCCT | CCGGGT | chr1 | 55040327 | 55040346 | 55040330 | - |
| SEQ ID NO 45986 | CAACCCCGCGAACCTTCCCA | CTGAAT | chr1 | 55040297 | 55040316 | 55040300 | - |
| SEQ ID NO 45987 | AGCACCGCACCGTCCCGGCT | GCGGGT | chr1 | 55040082 | 55040101 | 55040085 | - |
| SEQ ID NO 45988 | AGGTGGCTGTGGTTCCGTGC | TCGGGT | chr1 | 55040008 | 55040027 | 55040011 | - |
| SEQ ID NO 45989 | AGGGCGCGTGAAGGGGCGCG | CGGAAT | chr1 | 55039698 | 55039717 | 55039701 | - |
| SEQ ID NO 45990 | ACGTCGCTGCGGAAACCTTC | TAGGGT | chr1 | 55039536 | 55039555 | 55039539 | - |
| SEQ ID NO 45991 | CTGCGGAAACCTTCTAGGGT | GTGGGT | chr1 | 55039530 | 55039549 | 55039533 | - |
| SEQ ID NO 45992 | TTAACGGAACCCCGGACTG | GAGGAT | chr1 | 55039437 | 55039456 | 55039440 | - |
| SEQ ID NO 45993 | CTCCCGCCTCTCACCCTGCG | TGGGAT | chr1 | 55039298 | 55039317 | 55039301 | - |
| SEQ ID NO 45994 | GCCCACCTTTTCAGTGTTTC | CTGGGT | chr1 | 55039250 | 55039269 | 55039253 | - |
| SEQ ID NO 45995 | CCTGCTGACCAGTGAGACTT | CTGAAT | chr1 | 55039213 | 55039232 | 55039216 | - |
| SEQ ID NO 45996 | TGTGGACTCCTCGCTGCCCA | CCGAAT | chr1 | 55039178 | 55039197 | 55039181 | - |
| SEQ ID NO 45997 | TCCAGCCTACATGCATTTCA | AGGGAT | chr1 | 55039021 | 55039040 | 55039024 | - |
| SEQ ID NO 45998 | AGACGTCATATAGGTACATT | CAGAAT | chr1 | 55038961 | 55038980 | 55038964 | - |
| SEQ ID NO 45999 | ACCTATTGTGTACCAGGCAG | GAGGAT | chr1 | 55038834 | 55038853 | 55038837 | - |
| SEQ ID NO 46000 | GATACTGGGAAGAAACAAAG | GCGAAT | chr1 | 55038729 | 55038748 | 55038732 | - |
| SEQ ID NO 46001 | TTGCAGATGCACAGCAGATT | CCGAGT | chr1 | 55038690 | 55038709 | 55038693 | - |
| SEQ ID NO 46002 | TCCGAGTGAAATGGCCTGCT | CTGAAT | chr1 | 55038671 | 55038690 | 55038674 | - |
| SEQ ID NO 46003 | CCTGCTCTGAATCTAGGTGC | TGGAGT | chr1 | 55038657 | 55038676 | 55038660 | - |
| SEQ ID NO 46004 | GCACAAGACAGTGCAACCA | GTGGGT | chr1 | 55038575 | 55038594 | 55038578 | - |
| SEQ ID NO 46005 | GTGACTCCATGAGGTAAGGT | CAGAGT | chr1 | 55038544 | 55038563 | 55038547 | - |
| SEQ ID NO 46006 | TCGAGCCGCCATCGCAGCA | CAGAGT | chr1 | 55038510 | 55038529 | 55038513 | - |
| SEQ ID NO 46007 | TCCTTCCTGTTGCCTGTAAT | TGGAAT | chr1 | 55038443 | 55038462 | 55038446 | - |
| SEQ ID NO 46008 | TCAAAGGCCTCCCCTGGAGC | AAGAAT | chr1 | 55038384 | 55038403 | 55038387 | - |
| SEQ ID NO 46009 | GACCTTGGCCTCTCACCTAC | CGGGGT | chr1 | 55038322 | 55038341 | 55038325 | - |

Figure 63

| # | Sequence | PAM | Chr | Start | End | Cuts 5' of | Str |
|---|---|---|---|---|---|---|---|
| SEQ ID NO 46010 | TCCCAGTATCGACAGCCCTT | CCAGAAA | chr1 | 55038739 | 55038758 | 55038755 | + |
| SEQ ID NO 46011 | AAGCTGAGCTTGTGCCTACC | ATAGAAT | chr1 | 55038930 | 55038949 | 55038946 | + |
| SEQ ID NO 46012 | TGCCAGGTTAAGGCCAGTGG | AAAGAAT | chr1 | 55039147 | 55039166 | 55039163 | + |
| SEQ ID NO 46013 | CTGGGAACTGCACCAGGCAC | AGAGAAA | chr1 | 55040434 | 55040453 | 55040450 | + |
| SEQ ID NO 46014 | GTATTCCATCTGTTTCAGCC | GAAGAAA | chr1 | 55040626 | 55040645 | 55040642 | + |
| SEQ ID NO 46015 | TTGTGGGGTTGTGGCCAGGA | TAAGAAA | chr1 | 55041385 | 55041404 | 55041401 | + |
| SEQ ID NO 46016 | TTATTTTGTGGGAATCGAAT | TTAGAAT | chr1 | 55041593 | 55041612 | 55041609 | + |
| SEQ ID NO 46017 | ATGAAAATATTTTTTGGCAA | GCAGAAA | chr1 | 55041618 | 55041637 | 55041634 | + |
| SEQ ID NO 46018 | CAATCCTTTTCTTTTAGTCA | TGAGAAA | chr1 | 55041658 | 55041677 | 55041674 | + |
| SEQ ID NO 46019 | GTTCAGCGATGATGGTGTCA | TGAGAAT | chr1 | 55041833 | 55041852 | 55041849 | + |
| SEQ ID NO 46020 | CCATGCTTCCTGGAGAGCTT | GCAGAAT | chr1 | 55043087 | 55043106 | 55043103 | + |
| SEQ ID NO 46021 | AGTAACTACTGGCTTTCTGT | ATAGAAT | chr1 | 55044178 | 55044197 | 55044194 | + |
| SEQ ID NO 46022 | GTCACATCTTCGGTGGAGGG | GCAGAAA | chr1 | 55044522 | 55044541 | 55044538 | + |
| SEQ ID NO 46023 | AAGCACTAGGGCCAGGGTGA | GGAGAAT | chr1 | 55044567 | 55044586 | 55044570 | - |
| SEQ ID NO 46024 | AGGCAGCAGATGCATTGGCA | CAAGAAT | chr1 | 55044346 | 55044365 | 55044349 | - |
| SEQ ID NO 46025 | AGGCTTAAAGGGAATTCTAT | ACAGAAA | chr1 | 55044198 | 55044217 | 55044201 | - |
| SEQ ID NO 46026 | AGGAGGAACATGATGACATG | GAAGAAA | chr1 | 55043810 | 55043829 | 55043813 | - |
| SEQ ID NO 46027 | CCCCCTCCCCCATGCCCCAG | TCAGAAT | chr1 | 55043493 | 55043512 | 55043496 | - |
| SEQ ID NO 46028 | AGGCAACACTTCTTAAAGAG | AGAGAAA | chr1 | 55043216 | 55043235 | 55043219 | - |
| SEQ ID NO 46029 | CCTCAGAACTTGTTTGGATT | TTAGAAA | chr1 | 55042483 | 55042502 | 55042486 | - |
| SEQ ID NO 46030 | GGGCAATCAGAGTCTGCTTG | GAAGAAT | chr1 | 55042447 | 55042466 | 55042450 | - |
| SEQ ID NO 46031 | GAAACTCCATCTCAAAAAAA | AAAGAAA | chr1 | 55041957 | 55041976 | 55041960 | - |
| SEQ ID NO 46032 | GTTCATGGTACCTCCTAATC | CTAGAAT | chr1 | 55041870 | 55041889 | 55041873 | - |
| SEQ ID NO 46033 | GCCTCAGTTTCTCATGACTA | AAAGAAA | chr1 | 55041672 | 55041691 | 55041675 | - |
| SEQ ID NO 46034 | TGTTCCAAACTTCCACCAGA | GAAGAAA | chr1 | 55041535 | 55041554 | 55041538 | - |
| SEQ ID NO 46035 | CACAACCCCACAACATCCCT | CGAGAAA | chr1 | 55041378 | 55041397 | 55041381 | - |
| SEQ ID NO 46036 | TGGGCAGGCAGCTGTGAGTG | GCAGAAT | chr1 | 55041263 | 55041282 | 55041266 | - |
| SEQ ID NO 46037 | AAGTCCTGGGCTGGTAATAC | TTAGAAA | chr1 | 55040924 | 55040943 | 55040927 | - |
| SEQ ID NO 46038 | TAAAGGACGCCAATGGGCCT | CGAGAAT | chr1 | 55040698 | 55040717 | 55040701 | - |
| SEQ ID NO 46039 | GAGCATGAGTTCTGTGTCAT | AAAGAAA | chr1 | 55040604 | 55040623 | 55040607 | - |
| SEQ ID NO 46040 | CCCACCTGTGCCGCGGCGAG | GCAGAAA | chr1 | 55040389 | 55040408 | 55040392 | - |
| SEQ ID NO 46041 | CGTCAGATTACGCGCAGAGG | GAAGAAA | chr1 | 55039382 | 55039401 | 55039385 | - |
| SEQ ID NO 46042 | AAGACGTCATATAGGTACAT | TCAGAAT | chr1 | 55038962 | 55038981 | 55038965 | - |
| SEQ ID NO 46043 | TTCCTTTTACACACCATGTT | CAAGAAA | chr1 | 55038886 | 55038905 | 55038889 | - |
| SEQ ID NO 46044 | GGAAGGGCTGTCGATACTGG | GAAGAAA | chr1 | 55038741 | 55038760 | 55038744 | - |
| SEQ ID NO 46045 | ATCAAAGGCCTCCCCTGGAG | CAAGAAT | chr1 | 55038385 | 55038404 | 55038388 | - |

Figure 64

| # | Sequence | PAM | Chr | Start | End | Cuts 5' of | Str |
|---|---|---|---|---|---|---|---|
| SEQ ID NO 46046 | ATATGACGTCTTTGCAAACT | TAAAAC | chr1 | 55038970 | 55038989 | 55038986 | + |
| SEQ ID NO 46047 | GTGGGTTCCGATTTGGTTTG | GAAAAC | chr1 | 55040478 | 55040497 | 55040494 | + |
| SEQ ID NO 46048 | ATTTCAAGTTACCACTGCTC | CAAAAC | chr1 | 55041416 | 55041435 | 55041432 | + |
| SEQ ID NO 46049 | GAACAAAGATACAGAGCTGG | GAAAAC | chr1 | 55041886 | 55041905 | 55041902 | + |
| SEQ ID NO 46050 | TCTGAAATGTAAAATGTTAC | GAAAAC | chr1 | 55042284 | 55042303 | 55042300 | + |
| SEQ ID NO 46051 | TCCAAACAAGTTCTGAGGTT | CAAAAC | chr1 | 55042485 | 55042504 | 55042501 | + |
| SEQ ID NO 46052 | AGTTGGAGCAGACAAGAGCT | AAAAAC | chr1 | 55042717 | 55042736 | 55042733 | + |
| SEQ ID NO 46053 | AGCTGGGTGCAGGTACAGAG | GAAAAC | chr1 | 55043556 | 55043575 | 55043572 | + |
| SEQ ID NO 46054 | CCTAGTGCTTCAAATCTTAA | AAAAAC | chr1 | 55044577 | 55044596 | 55044593 | + |
| SEQ ID NO 46055 | GGTGGTGCAGAAGCACAAAT | AAAAAC | chr1 | 55044609 | 55044628 | 55044612 | - |
| SEQ ID NO 46056 | TTTACCCAAAGCCTTAGGGC | CAAAAC | chr1 | 55042518 | 55042537 | 55042521 | - |
| SEQ ID NO 46057 | ACCATCAAATAAATCACAAA | AAAAAC | chr1 | 55042321 | 55042340 | 55042324 | - |
| SEQ ID NO 46058 | GGTCACACTGCAGACAGGGA | CAAAAC | chr1 | 55041183 | 55041202 | 55041186 | - |
| SEQ ID NO 46059 | GATTACGCGCAGAGGGAAGA | AAAAAC | chr1 | 55039377 | 55039396 | 55039380 | - |

Figure 65

| # | Sequence | PAM | Chr | Start | End | Cuts 5' of | Str |
|---|---|---|---|---|---|---|---|
| SEQ ID NO 46060 | ATCAACTTTGGACTCCAGCA | CCTAGATT | chr1 | 55038640 | 55038659 | 55038656 | + |
| SEQ ID NO 46061 | AGGGAGGATCATAAATTCGC | CTTTGTTT | chr1 | 55038709 | 55038728 | 55038725 | + |
| SEQ ID NO 46062 | CCTCCTGCCTGGTACACAAT | AGGTGTTT | chr1 | 55038830 | 55038849 | 55038846 | + |
| SEQ ID NO 46063 | GTACACAATAGGTGTTTACT | GGATGCTT | chr1 | 55038841 | 55038860 | 55038857 | + |
| SEQ ID NO 46064 | TGTTTACTGGATGCTTGTCC | AGTTGATT | chr1 | 55038853 | 55038872 | 55038869 | + |
| SEQ ID NO 46065 | AAATTGAATCTTCTGGAAAG | CTGAGCTT | chr1 | 55038913 | 55038932 | 55038929 | + |
| SEQ ID NO 46066 | GAGGCCGGAGGGGTCCAGG | CTAAGTTT | chr1 | 55039112 | 55039131 | 55039128 | + |
| SEQ ID NO 46067 | TGGGCAGCGAGGAGTCCACA | GTAGGATT | chr1 | 55039178 | 55039197 | 55039194 | + |
| SEQ ID NO 46068 | CAGCGAGGAGTCCACAGTAG | GATTGATT | chr1 | 55039182 | 55039201 | 55039198 | + |
| SEQ ID NO 46069 | CGGCCTGCCTTCCAGCCCAG | TTAGGATT | chr1 | 55039338 | 55039357 | 55039354 | + |
| SEQ ID NO 46070 | TTCCAGCCCAGTTAGGATTT | GGGAGTTT | chr1 | 55039347 | 55039366 | 55039363 | + |
| SEQ ID NO 46071 | TCCCTCTGCGCGTAATCTGA | CGCTGTTT | chr1 | 55039380 | 55039399 | 55039396 | + |
| SEQ ID NO 46072 | CTCCAGTCCGGGGGTTCCGT | TAATGTTT | chr1 | 55039434 | 55039453 | 55039450 | + |
| SEQ ID NO 46073 | CGTCAAGCACCCACACCCTA | GAAGGTTT | chr1 | 55039516 | 55039535 | 55039532 | + |
| SEQ ID NO 46074 | CAGCGGCTCCCAGCTCCCAG | CCAGGATT | chr1 | 55039667 | 55039686 | 55039683 | + |
| SEQ ID NO 46075 | CCGCAGCCGGGACGGTGCGG | TGCTGTTT | chr1 | 55040078 | 55040097 | 55040094 | + |
| SEQ ID NO 46076 | GGTGCTGTTTCCTCTCGGGC | CTCAGTTT | chr1 | 55040096 | 55040115 | 55040112 | + |
| SEQ ID NO 46077 | AGTGCAGGTCGCCGAGGGCT | CTTCGCTT | chr1 | 55040148 | 55040167 | 55040164 | + |
| SEQ ID NO 46078 | AGCACTGCCAGGATATCCTG | CCCAGATT | chr1 | 55040348 | 55040367 | 55040364 | + |
| SEQ ID NO 46079 | AGGATATCCTGCCCAGATTT | CCCAGTTT | chr1 | 55040357 | 55040376 | 55040373 | + |
| SEQ ID NO 46080 | CTGCACCAGGCACAGAGAAA | GCGGGCTT | chr1 | 55040441 | 55040460 | 55040457 | + |
| SEQ ID NO 46081 | GGGCTTGCCATTATAGTGGG | TTCCGATT | chr1 | 55040463 | 55040482 | 55040479 | + |
| SEQ ID NO 46082 | GCCATTATAGTGGGTTCCGA | TTTGGTTT | chr1 | 55040469 | 55040488 | 55040485 | + |
| SEQ ID NO 46083 | AACTCATGCTCTAGTATTCC | ATCTGTTT | chr1 | 55040613 | 55040632 | 55040629 | + |
| SEQ ID NO 46084 | GTCTGCCGACCGTGTGCGGG | GCGAGTTT | chr1 | 55040818 | 55040837 | 55040834 | + |
| SEQ ID NO 46085 | CGAGTTGCTCAACAACTCT | GCCAGCTT | chr1 | 55040839 | 55040858 | 55040855 | + |
| SEQ ID NO 46086 | CTTCTGGCCCTCAGGCTGTG | GGAAGCTT | chr1 | 55040864 | 55040883 | 55040880 | + |
| SEQ ID NO 46087 | CTTCTTCCCGGGGCGAGACC | ACTAGCTT | chr1 | 55040889 | 55040908 | 55040905 | + |
| SEQ ID NO 46088 | TTGGCTGAGGTTCTGTGTCC | CCCAGCTT | chr1 | 55040942 | 55040961 | 55040958 | + |
| SEQ ID NO 46089 | AGTCAGATGTGGGGTTGAAT | CTTGGCTT | chr1 | 55040972 | 55040991 | 55040988 | + |
| SEQ ID NO 46090 | TGGCTTCCTCTCACTAGCTG | TGGTGCTT | chr1 | 55040994 | 55041013 | 55041010 | + |
| SEQ ID NO 46091 | CAAGCCCGGGGGGATCACT | TGCAGTTT | chr1 | 55041153 | 55041172 | 55041169 | + |
| SEQ ID NO 46092 | TGCCACTCACAGCTGCCTGC | CCACGCTT | chr1 | 55041260 | 55041279 | 55041276 | + |
| SEQ ID NO 46093 | CACCTGAACCAAGCCCTTGA | GGATGTTT | chr1 | 55041503 | 55041522 | 55041519 | + |
| SEQ ID NO 46094 | GAGGATGTTTCTTCTCTGGT | GGAAGTTT | chr1 | 55041521 | 55041540 | 55041537 | + |
| SEQ ID NO 46095 | TCACCCCAGGTGCATTAGAA | CTGGGTTT | chr1 | 55041706 | 55041725 | 55041722 | + |
| SEQ ID NO 46096 | GGTGTCATGAGAATTTTATT | CTAGGATT | chr1 | 55041846 | 55041865 | 55041862 | + |
| SEQ ID NO 46097 | TTTTTCTTTTTTTTTGAGA | TGGAGTTT | chr1 | 55041948 | 55041967 | 55041964 | + |
| SEQ ID NO 46098 | TGCCTCAGCCTCCCAAGAAG | CTGGGATT | chr1 | 55042058 | 55042077 | 55042074 | + |
| SEQ ID NO 46099 | TTTTGTATTTTTAGTAGAGA | AGGGGTTT | chr1 | 55042115 | 55042134 | 55042131 | + |
| SEQ ID NO 46100 | TGTAAAATGTTACGAAAACC | AAAAGTTT | chr1 | 55042291 | 55042310 | 55042307 | + |
| SEQ ID NO 46101 | ACGAAAACCAAAAGTTTTTT | TTGTGATT | chr1 | 55042302 | 55042321 | 55042318 | + |
| SEQ ID NO 46102 | AGCACCTGACGTGAACTGAC | ATGAGATT | chr1 | 55042341 | 55042360 | 55042357 | + |
| SEQ ID NO 46103 | CATATTCATATATTTTGCTG | CATAGATT | chr1 | 55042395 | 55042414 | 55042411 | + |
| SEQ ID NO 46104 | CATAGATTACAGTATGCAGC | TCCAGATT | chr1 | 55042415 | 55042434 | 55042431 | + |
| SEQ ID NO 46105 | TCCAGATTCTTCCAAGCAGA | CTCTGATT | chr1 | 55042435 | 55042454 | 55042451 | + |
| SEQ ID NO 46106 | AAACAAGTTCTGAGGTTCAA | AACCGTTT | chr1 | 55042488 | 55042507 | 55042504 | + |
| SEQ ID NO 46107 | GTTCAAAACCGTTTTGGCCC | TAAGGCTT | chr1 | 55042502 | 55042521 | 55042518 | + |

Figure 65 (Cont'd)

| | | | | | | | |
|---|---|---|---|---|---|---|---|
| SEQ ID NO 46108 | GTAGGGGCCAAGGAGGAGCA | TGGAGTTT | chr1 | 55042623 | 55042642 | 55042639 | + |
| SEQ ID NO 46109 | AGGAGGAGCATGGAGTTTGG | ACTTGATT | chr1 | 55042633 | 55042652 | 55042649 | + |
| SEQ ID NO 46110 | CATAGATAGTGGCTGCTATA | ATTTGTTT | chr1 | 55042755 | 55042774 | 55042771 | + |
| SEQ ID NO 46111 | TGGAAGTGGGGCCTAATGGG | AGGTGTTT | chr1 | 55042823 | 55042842 | 55042839 | + |
| SEQ ID NO 46112 | ATGGGGGAGGAACCCCTGTG | AAAGGCTT | chr1 | 55042856 | 55042875 | 55042872 | + |
| SEQ ID NO 46113 | ATAATGAGTAAGTTCTCCCG | CTATGATT | chr1 | 55042899 | 55042918 | 55042915 | + |
| SEQ ID NO 46114 | CCGCTATGATTTCCCTTGAA | GGCTGATT | chr1 | 55042916 | 55042935 | 55042932 | + |
| SEQ ID NO 46115 | CTTGAAGGCTGATTATTAAA | AAGAGCTT | chr1 | 55042930 | 55042949 | 55042946 | + |
| SEQ ID NO 46116 | TGGCACCTCCCTCTCTTCTC | TCTTGCTT | chr1 | 55042957 | 55042976 | 55042973 | + |
| SEQ ID NO 46117 | CTCTTGCTTCTTCTCTTGCC | ATGTGATT | chr1 | 55042976 | 55042995 | 55042992 | + |
| SEQ ID NO 46118 | CACCTTCTGCCATCAGTGAA | AGCAGCTT | chr1 | 55043030 | 55043049 | 55043046 | + |
| SEQ ID NO 46119 | ACCAGAAGCAGATGCTGGTG | CCATGCTT | chr1 | 55043067 | 55043086 | 55043083 | + |
| SEQ ID NO 46120 | TGCTGGTGCCATGCTTCCTG | GAGAGCTT | chr1 | 55043079 | 55043098 | 55043095 | + |
| SEQ ID NO 46121 | CATTTGTAGAGCATCTGGAT | GGGAGATT | chr1 | 55043264 | 55043283 | 55043280 | + |
| SEQ ID NO 46122 | TTGGAGCTGGAATTCAGGTC | CACGGTTT | chr1 | 55043422 | 55043441 | 55043438 | + |
| SEQ ID NO 46123 | CGGTTTCCTGGCTCCAAAGC | CCATGATT | chr1 | 55043444 | 55043463 | 55043460 | + |
| SEQ ID NO 46124 | TGGCCTATATGAGTTCTTTA | ATTTGCTT | chr1 | 55043667 | 55043686 | 55043683 | + |
| SEQ ID NO 46125 | GGGGTGAGATAAAGTACACC | TAGGGTTT | chr1 | 55043769 | 55043788 | 55043785 | + |
| SEQ ID NO 46126 | TAAAGTACACCTAGGGTTTG | CTGGGTTT | chr1 | 55043778 | 55043797 | 55043794 | + |
| SEQ ID NO 46127 | ATGTCTTCCATGGCCTTCTT | CCTGGCTT | chr1 | 55043973 | 55043992 | 55043989 | + |
| SEQ ID NO 46128 | CACTGCATATACACTGGGGA | CTGTGCTT | chr1 | 55044080 | 55044099 | 55044096 | + |
| SEQ ID NO 46129 | GGGTACCAAGCACAGTAACT | ACTGGCTT | chr1 | 55044165 | 55044184 | 55044181 | + |
| SEQ ID NO 46130 | TATTCTCCTCACCCTGGCCC | TAGTGCTT | chr1 | 55044559 | 55044578 | 55044575 | + |
| SEQ ID NO 46131 | TAGTGCTTCAAATCTTAAAA | AAACGTTT | chr1 | 55044579 | 55044598 | 55044595 | + |
| SEQ ID NO 46132 | TCTTAAAAAAACGTTTTTAT | TTGTGCTT | chr1 | 55044591 | 55044610 | 55044607 | + |
| SEQ ID NO 46133 | TGGTGCAGAAGCACAAATAA | AAACGTTT | chr1 | 55044607 | 55044626 | 55044610 | - |
| SEQ ID NO 46134 | GCACAAATAAAAACGTTTTT | TTAAGATT | chr1 | 55044597 | 55044616 | 55044600 | - |
| SEQ ID NO 46135 | GGGACTTCACTCTGGATAGC | AACAGCTT | chr1 | 55044466 | 55044485 | 55044469 | - |
| SEQ ID NO 46136 | AGGAATTTTGGACCCTAGAG | TCATGCTT | chr1 | 55044435 | 55044454 | 55044438 | - |
| SEQ ID NO 46137 | CATCCCAGGGCCTTGTCCCT | ACAGGTTT | chr1 | 55044378 | 55044397 | 55044381 | - |
| SEQ ID NO 46138 | AATGGCTGGCAGGCAGACCA | ATGGGTTT | chr1 | 55044322 | 55044341 | 55044325 | - |
| SEQ ID NO 46139 | GACGTACCACTGGGGCATGG | CCAGGCTT | chr1 | 55044220 | 55044239 | 55044223 | - |
| SEQ ID NO 46140 | ATACAGAAAGCCAGTAGTTA | CTGTGCTT | chr1 | 55044180 | 55044199 | 55044183 | - |
| SEQ ID NO 46141 | AATACATACTTGCTGTCCCC | TTCTGATT | chr1 | 55044134 | 55044153 | 55044137 | - |
| SEQ ID NO 46142 | ACTACGGGCCACACTCGACA | ACAGGTTT | chr1 | 55043586 | 55043605 | 55043589 | - |
| SEQ ID NO 46143 | ATAAATTGAGGGAAAAAATC | ATGGGCTT | chr1 | 55043468 | 55043487 | 55043471 | - |
| SEQ ID NO 46144 | GGTGAGTAATTTACAAGGAA | AAGGGATT | chr1 | 55043135 | 55043154 | 55043138 | - |
| SEQ ID NO 46145 | GGAAAAGGGATTTATTCAGC | TCATGATT | chr1 | 55043119 | 55043138 | 55043122 | - |
| SEQ ID NO 46146 | CCAGGAAGCATGGCACCAGC | ATCTGCTT | chr1 | 55043080 | 55043099 | 55043083 | - |
| SEQ ID NO 46147 | TGCTTCTGGTGAGGGCCTTA | AGCTGCTT | chr1 | 55043057 | 55043076 | 55043060 | - |
| SEQ ID NO 46148 | ACTGAGGACCAAATTTCCAC | ATGAGATT | chr1 | 55042801 | 55042820 | 55042804 | - |
| SEQ ID NO 46149 | ATTATAGCAGCCACTATCTA | TGGTGATT | chr1 | 55042757 | 55042776 | 55042760 | - |
| SEQ ID NO 46150 | AGCAGCCACTATCTATGGTG | ATTTGTTT | chr1 | 55042752 | 55042771 | 55042755 | - |
| SEQ ID NO 46151 | CCACTATCTATGGTGATTTG | TTTGGTTT | chr1 | 55042747 | 55042766 | 55042750 | - |
| SEQ ID NO 46152 | AACTGCTCTCAGGCAGACAT | ACCTGCTT | chr1 | 55042701 | 55042720 | 55042704 | - |
| SEQ ID NO 46153 | ACCCAAAGCCTTAGGGCCAA | AACGGTTT | chr1 | 55042515 | 55042534 | 55042518 | - |
| SEQ ID NO 46154 | AAACGGTTTTGAACCTCAGA | ACTTGTTT | chr1 | 55042496 | 55042515 | 55042499 | - |
| SEQ ID NO 46155 | GTTTTGAACCTCAGAACTTG | TTTGGATT | chr1 | 55042491 | 55042510 | 55042494 | - |
| SEQ ID NO 46156 | GGCAGTAATGGGCAATCAGA | GTCTGCTT | chr1 | 55042456 | 55042475 | 55042459 | - |

Figure 65 (Cont'd)

| SEQ ID NO | Sequence | | | | | | |
|---|---|---|---|---|---|---|---|
| SEQ ID NO 46157 | AATAAATCACAAAAAAAACT | TTTGGTTT | chr1 | 55042314 | 55042333 | 55042317 | - |
| SEQ ID NO 46158 | TCGGATCCACTGAGGAGGTC | AGGAGTTT | chr1 | 55042175 | 55042194 | 55042178 | - |
| SEQ ID NO 46159 | TGGTGGCAGGTACCTGTAAT | CCCAGCTT | chr1 | 55042083 | 55042102 | 55042086 | - |
| SEQ ID NO 46160 | TGTGCTCCTTATCTTCCACC | TCTGGTTT | chr1 | 55041916 | 55041935 | 55041919 | - |
| SEQ ID NO 46161 | CATCATCGCTGAACTCCTAC | TAATGCTT | chr1 | 55041827 | 55041846 | 55041830 | - |
| SEQ ID NO 46162 | GTGACCTCCTCTCTCTGGGC | CTCAGTTT | chr1 | 55041690 | 55041709 | 55041693 | - |
| SEQ ID NO 46163 | AGTTTCTCATGACTAAAAGA | AAAGGATT | chr1 | 55041667 | 55041686 | 55041670 | - |
| SEQ ID NO 46164 | GGATTGGTCTAAAAATTATT | TTCTGCTT | chr1 | 55041644 | 55041663 | 55041647 | - |
| SEQ ID NO 46165 | AAAAAATATTTTCATTCTAA | ATTCGATT | chr1 | 55041613 | 55041632 | 55041616 | - |
| SEQ ID NO 46166 | ACCAGAGAAGAAACATCCTC | AAGGGCTT | chr1 | 55041521 | 55041540 | 55041524 | - |
| SEQ ID NO 46167 | GGTTCAGGTGGTCATACAGC | CTCTGCTT | chr1 | 55041493 | 55041512 | 55041496 | - |
| SEQ ID NO 46168 | GTACTCACTATTTCCAGAAC | AGTTGTTT | chr1 | 55041446 | 55041465 | 55041449 | - |
| SEQ ID NO 46169 | TTCCCTCTGCCCCAGGAGC | TGTGGTTT | chr1 | 55041235 | 55041254 | 55041238 | - |
| SEQ ID NO 46170 | AAAACTGCAAGTGATCCCCC | CGGGGCTT | chr1 | 55041162 | 55041181 | 55041165 | - |
| SEQ ID NO 46171 | CTGCTGCCACTGAGCCGTAG | GGACGATT | chr1 | 55041084 | 55041103 | 55041087 | - |
| SEQ ID NO 46172 | GACGATTGTCACCTCCCTTT | TAAAGATT | chr1 | 55041063 | 55041082 | 55041066 | - |
| SEQ ID NO 46173 | CCACAGCTAGTGAGAGGAAG | CCAAGATT | chr1 | 55040997 | 55041016 | 55041000 | - |
| SEQ ID NO 46174 | CTAGTGGTCTCGCCCCGGGA | AGAAGCTT | chr1 | 55040894 | 55040913 | 55040897 | - |
| SEQ ID NO 46175 | GGCCCTCCACCCTCCGCTGC | CCATGTTT | chr1 | 55040508 | 55040527 | 55040511 | - |
| SEQ ID NO 46176 | GGAACCCACTATAATGGCAA | GCCCGCTT | chr1 | 55040467 | 55040486 | 55040470 | - |
| SEQ ID NO 46177 | GTGGCTGTGGTTCCGTGCTC | GGGTGCTT | chr1 | 55040006 | 55040025 | 55040009 | - |
| SEQ ID NO 46178 | GCGGAAACCTTCTAGGGTGT | GGGTGCTT | chr1 | 55039528 | 55039547 | 55039531 | - |
| SEQ ID NO 46179 | GAGCCCCATCGGACGATCCT | ATCTGATT | chr1 | 55039470 | 55039489 | 55039473 | - |
| SEQ ID NO 46180 | GGAACCCCGGACTGGAGGA | TCAGGTTT | chr1 | 55039432 | 55039451 | 55039435 | - |
| SEQ ID NO 46181 | CCTCGCCCTCCCCAAACAGC | GTCAGATT | chr1 | 55039401 | 55039420 | 55039404 | - |
| SEQ ID NO 46182 | TTCTGCCGGGCCCACCTTTT | CAGTGTTT | chr1 | 55039259 | 55039278 | 55039262 | - |
| SEQ ID NO 46183 | TACCAACTAGCTGCTCCTTG | AAGAGATT | chr1 | 55039063 | 55039082 | 55039066 | - |
| SEQ ID NO 46184 | AACTAGCTGCTCCTTGAAGA | GATTGCTT | chr1 | 55039059 | 55039078 | 55039062 | - |
| SEQ ID NO 46185 | AGCTGCTCCTTGAAGAGATT | GCTTGCTT | chr1 | 55039055 | 55039074 | 55039058 | - |
| SEQ ID NO 46186 | GTCCAGCCTACATGCATTTC | AAGGGATT | chr1 | 55039022 | 55039041 | 55039025 | - |
| SEQ ID NO 46187 | ATTTCAAGGGATTTATACTA | CAAAGATT | chr1 | 55039007 | 55039026 | 55039010 | - |
| SEQ ID NO 46188 | GGGATTTATACTACAAAGAT | TCAGGTTT | chr1 | 55039000 | 55039019 | 55039003 | - |
| SEQ ID NO 46189 | ATACTACAAAGATTCAGGTT | TTAAGTTT | chr1 | 55038993 | 55039012 | 55038996 | - |
| SEQ ID NO 46190 | AATTCTATGGTAGGCACAAG | CTCAGCTT | chr1 | 55038938 | 55038957 | 55038941 | - |
| SEQ ID NO 46191 | AGGCACAAGCTCAGCTTTCC | AGAAGATT | chr1 | 55038927 | 55038946 | 55038930 | - |
| SEQ ID NO 46192 | TTTCCAGAAGATTCAATTTG | CAAAGATT | chr1 | 55038912 | 55038931 | 55038915 | - |
| SEQ ID NO 46193 | GGGGAAAGAGAGCTCCTGGC | CTCAGATT | chr1 | 55038803 | 55038822 | 55038806 | - |
| SEQ ID NO 46194 | ATTGTACATGTGGCATGACA | TGAGGCTT | chr1 | 55038778 | 55038797 | 55038781 | - |
| SEQ ID NO 46195 | ATCCTCCCTTGCAGATGCAC | AGCAGATT | chr1 | 55038698 | 55038717 | 55038701 | - |
| SEQ ID NO 46196 | CAAAGTTGATGCTCTTTCCA | CTTTGTTT | chr1 | 55038630 | 55038649 | 55038633 | - |
| SEQ ID NO 46197 | CGCAGCACAGAGTAGGAGCT | CATGGTTT | chr1 | 55038497 | 55038516 | 55038500 | - |
| SEQ ID NO 46198 | TAATTGGAATTGTATTTGCA | ATGTGCTT | chr1 | 55038427 | 55038446 | 55038430 | - |
| SEQ ID NO 46199 | TGTATTTGCAATGTGCTTTT | GGCAGCTT | chr1 | 55038417 | 55038436 | 55038420 | - |

Figure 66

| # | Sequence | PAM | Chr | Start | End | Cut site 1 (5' of) | Cut site 2 (5' of) | Str |
|---|----------|-----|-----|-------|-----|--------------------|--------------------|-----|
| SEQ ID NO 46200 | GCTCCCATCTATTCTTGCTCCA | TTA | chr1 | 55038368 | 55038389 | 55038385 | 55038390 | + |
| SEQ ID NO 46201 | CCATCTATTCTTGCTCCAGGGG | CTC | chr1 | 55038372 | 55038393 | 55038389 | 55038394 | + |
| SEQ ID NO 46202 | TTCTTGCTCCAGGGGAGGCCTT | CTA | chr1 | 55038379 | 55038400 | 55038396 | 55038401 | + |
| SEQ ID NO 46203 | TTGCTCCAGGGGAGGCCTTTGA | TTC | chr1 | 55038382 | 55038403 | 55038399 | 55038404 | + |
| SEQ ID NO 46204 | GCTCCAGGGGAGGCCTTTGATG | CTT | chr1 | 55038384 | 55038405 | 55038401 | 55038406 | + |
| SEQ ID NO 46205 | CTCCAGGGGAGGCCTTTGATGA | TTG | chr1 | 55038385 | 55038406 | 55038402 | 55038407 | + |
| SEQ ID NO 46206 | CAGGGGAGGCCTTTGATGAGGA | CTC | chr1 | 55038388 | 55038409 | 55038405 | 55038410 | + |
| SEQ ID NO 46207 | TGATGAGGAAGCTGCCAAAAGC | CTT | chr1 | 55038401 | 55038422 | 55038418 | 55038423 | + |
| SEQ ID NO 46208 | GATGAGGAAGCTGCCAAAAGCA | TTT | chr1 | 55038402 | 55038423 | 55038419 | 55038424 | + |
| SEQ ID NO 46209 | ATGAGGAAGCTGCCAAAAGCAC | TTG | chr1 | 55038403 | 55038424 | 55038420 | 55038425 | + |
| SEQ ID NO 46210 | CCAAAAGCACATTGCAAATACA | CTG | chr1 | 55038415 | 55038436 | 55038432 | 55038437 | + |
| SEQ ID NO 46211 | CAAATACAATTCCAATTACAGG | TTG | chr1 | 55038429 | 55038450 | 55038446 | 55038451 | + |
| SEQ ID NO 46212 | CAATTACAGGCAACAGGAAGGA | TTC | chr1 | 55038441 | 55038462 | 55038458 | 55038463 | + |
| SEQ ID NO 46213 | CAGGCAACAGGAAGGAGAACCA | TTA | chr1 | 55038447 | 55038468 | 55038464 | 55038469 | + |
| SEQ ID NO 46214 | TGCCACCTCTGTCAGCAAACCA | CTC | chr1 | 55038473 | 55038494 | 55038490 | 55038495 | + |
| SEQ ID NO 46215 | CCACCTCTGTCAGCAAACCATG | CTG | chr1 | 55038475 | 55038496 | 55038492 | 55038497 | + |
| SEQ ID NO 46216 | TGTCAGCAAACCATGAGCTCCT | CTC | chr1 | 55038482 | 55038503 | 55038499 | 55038504 | + |
| SEQ ID NO 46217 | TCAGCAAACCATGAGCTCCTAC | CTG | chr1 | 55038484 | 55038505 | 55038501 | 55038506 | + |
| SEQ ID NO 46218 | CTACTCTGTGCTGCGATGGCGG | CTC | chr1 | 55038502 | 55038523 | 55038519 | 55038524 | + |
| SEQ ID NO 46219 | CTCTGTGCTGCGATGGCGGGCT | CTA | chr1 | 55038505 | 55038526 | 55038522 | 55038527 | + |
| SEQ ID NO 46220 | TGTGCTGCGATGGCGGGCTCGA | CTC | chr1 | 55038508 | 55038529 | 55038525 | 55038530 | + |
| SEQ ID NO 46221 | TGCTGCGATGGCGGGCTCGATG | CTG | chr1 | 55038510 | 55038531 | 55038527 | 55038532 | + |
| SEQ ID NO 46222 | CGATGGCGGGCTCGATGGGGAT | CTG | chr1 | 55038515 | 55038536 | 55038532 | 55038537 | + |
| SEQ ID NO 46223 | GATGGGGATAACTCTGACCTTA | CTC | chr1 | 55038528 | 55038549 | 55038545 | 55038550 | + |
| SEQ ID NO 46224 | TGACCTTACCTCATGGAGTCAC | CTC | chr1 | 55038542 | 55038563 | 55038559 | 55038564 | + |
| SEQ ID NO 46225 | ACCTTACCTCATGGAGTCACTG | CTG | chr1 | 55038544 | 55038565 | 55038561 | 55038566 | + |
| SEQ ID NO 46226 | ACCTCATGGAGTCACTGTCAAC | CTT | chr1 | 55038549 | 55038570 | 55038566 | 55038571 | + |
| SEQ ID NO 46227 | CCTCATGGAGTCACTGTCAACC | TTA | chr1 | 55038550 | 55038571 | 55038567 | 55038572 | + |
| SEQ ID NO 46228 | ATGGAGTCACTGTCAACCCACT | CTC | chr1 | 55038554 | 55038575 | 55038571 | 55038576 | + |
| SEQ ID NO 46229 | TCAACCCACTGGTTGCACTGTC | CTG | chr1 | 55038566 | 55038587 | 55038583 | 55038588 | + |
| SEQ ID NO 46230 | GTTGCACTGTCTTTGTGCACTG | CTG | chr1 | 55038577 | 55038598 | 55038594 | 55038599 | + |
| SEQ ID NO 46231 | CACTGTCTTTGTGCACTGGCTC | TTG | chr1 | 55038581 | 55038602 | 55038598 | 55038603 | + |
| SEQ ID NO 46232 | TCTTTGTGCACTGGCTCTCTGG | CTG | chr1 | 55038586 | 55038607 | 55038603 | 55038608 | + |
| SEQ ID NO 46233 | TGTGCACTGGCTCTCTGGAGTG | CTT | chr1 | 55038590 | 55038611 | 55038607 | 55038612 | + |
| SEQ ID NO 46234 | GTGCACTGGCTCTCTGGAGTGA | TTT | chr1 | 55038591 | 55038612 | 55038608 | 55038613 | + |
| SEQ ID NO 46235 | TGCACTGGCTCTCTGGAGTGAG | TTG | chr1 | 55038592 | 55038613 | 55038609 | 55038614 | + |
| SEQ ID NO 46236 | GCTCTCTGGAGTGAGGTCTTTG | CTG | chr1 | 55038599 | 55038620 | 55038616 | 55038621 | + |
| SEQ ID NO 46237 | TCTGGAGTGAGGTCTTTGCAAA | CTC | chr1 | 55038603 | 55038624 | 55038620 | 55038625 | + |
| SEQ ID NO 46238 | TGGAGTGAGGTCTTTGCAAACA | CTC | chr1 | 55038605 | 55038626 | 55038622 | 55038627 | + |
| SEQ ID NO 46239 | GAGTGAGGTCTTTGCAAACAAA | CTG | chr1 | 55038607 | 55038628 | 55038624 | 55038629 | + |
| SEQ ID NO 46240 | TGCAAACAAAGTGGAAAGAGCA | CTT | chr1 | 55038619 | 55038640 | 55038636 | 55038641 | + |
| SEQ ID NO 46241 | GCAAACAAAGTGGAAAGAGCAT | TTT | chr1 | 55038620 | 55038641 | 55038637 | 55038642 | + |
| SEQ ID NO 46242 | CAAACAAAGTGGAAAGAGCATC | TTG | chr1 | 55038621 | 55038642 | 55038638 | 55038643 | + |
| SEQ ID NO 46243 | TGGACTCCAGCACCTAGATTCA | CTT | chr1 | 55038648 | 55038669 | 55038665 | 55038670 | + |
| SEQ ID NO 46244 | GGACTCCAGCACCTAGATTCAG | TTT | chr1 | 55038649 | 55038670 | 55038666 | 55038671 | + |
| SEQ ID NO 46245 | GACTCCAGCACCTAGATTCAGA | TTG | chr1 | 55038650 | 55038671 | 55038667 | 55038672 | + |
| SEQ ID NO 46246 | CAGCACCTAGATTCAGAGCAGG | CTC | chr1 | 55038655 | 55038676 | 55038672 | 55038677 | + |
| SEQ ID NO 46247 | GATTCAGAGCAGGCCATTTCAC | CTA | chr1 | 55038664 | 55038685 | 55038681 | 55038686 | + |
| SEQ ID NO 46248 | AGAGCAGGCCATTTCACTCGGA | TTC | chr1 | 55038669 | 55038690 | 55038686 | 55038691 | + |
| SEQ ID NO 46249 | CACTCGGAATCTGCTGTGCATC | TTT | chr1 | 55038683 | 55038704 | 55038700 | 55038705 | + |
| SEQ ID NO 46250 | ACTCGGAATCTGCTGTGCATCT | TTC | chr1 | 55038684 | 55038705 | 55038701 | 55038706 | + |
| SEQ ID NO 46251 | GGAATCTGCTGTGCATCTGCAA | CTC | chr1 | 55038688 | 55038709 | 55038705 | 55038710 | + |
| SEQ ID NO 46252 | CTGTGCATCTGCAAGGGAGGAT | CTG | chr1 | 55038696 | 55038717 | 55038713 | 55038718 | + |
| SEQ ID NO 46253 | TGCATCTGCAAGGGAGGATCAT | CTG | chr1 | 55038699 | 55038720 | 55038716 | 55038721 | + |
| SEQ ID NO 46254 | CAAGGGAGGATCATAAATTCGC | CTG | chr1 | 55038707 | 55038728 | 55038724 | 55038729 | + |
| SEQ ID NO 46255 | GCCTTTGTTTCTTCCCAGTATC | TTC | chr1 | 55038727 | 55038748 | 55038744 | 55038749 | + |
| SEQ ID NO 46256 | TGTTTCTTCCCAGTATCGACAG | CTT | chr1 | 55038732 | 55038753 | 55038749 | 55038754 | + |

Figure 66 (Cont'd)

| SEQ ID NO 46257 | GTTTCTTCCCAGTATCGACAGC | TTT | chr1 | 55038733 | 55038754 | 55038750 | 55038755 | + |
| SEQ ID NO 46258 | TTTCTTCCCAGTATCGACAGCC | TTG | chr1 | 55038734 | 55038755 | 55038751 | 55038756 | + |
| SEQ ID NO 46259 | CTTCCCAGTATCGACAGCCCTT | TTT | chr1 | 55038737 | 55038758 | 55038754 | 55038759 | + |
| SEQ ID NO 46260 | TTCCCAGTATCGACAGCCCTTC | TTC | chr1 | 55038738 | 55038759 | 55038755 | 55038760 | + |
| SEQ ID NO 46261 | CCCAGTATCGACAGCCCTTCCA | CTT | chr1 | 55038740 | 55038761 | 55038757 | 55038762 | + |
| SEQ ID NO 46262 | CCAGTATCGACAGCCCTTCCAG | TTC | chr1 | 55038741 | 55038762 | 55038758 | 55038763 | + |
| SEQ ID NO 46263 | CCAGAAAGAGCAAGCCTCATGT | CTT | chr1 | 55038759 | 55038780 | 55038776 | 55038781 | + |
| SEQ ID NO 46264 | CAGAAAGAGCAAGCCTCATGTC | TTC | chr1 | 55038760 | 55038781 | 55038777 | 55038782 | + |
| SEQ ID NO 46265 | ATGTCATGCCACATGTACAATC | CTC | chr1 | 55038777 | 55038798 | 55038794 | 55038799 | + |
| SEQ ID NO 46266 | AGGCCAGGAGCTCTCTTTCCCC | CTG | chr1 | 55038801 | 55038822 | 55038818 | 55038823 | + |
| SEQ ID NO 46267 | TCTTTCCCCTTTTCATCCTCCT | CTC | chr1 | 55038814 | 55038835 | 55038831 | 55038836 | + |
| SEQ ID NO 46268 | TTTCCCCTTTTCATCCTCCTGC | CTC | chr1 | 55038816 | 55038837 | 55038833 | 55038838 | + |
| SEQ ID NO 46269 | TCCCCTTTTCATCCTCCTGCCT | CTT | chr1 | 55038818 | 55038839 | 55038835 | 55038840 | + |
| SEQ ID NO 46270 | CCCCTTTTCATCCTCCTGCCTG | TTT | chr1 | 55038819 | 55038840 | 55038836 | 55038841 | + |
| SEQ ID NO 46271 | CCCTTTTCATCCTCCTGCCTGG | TTC | chr1 | 55038820 | 55038841 | 55038837 | 55038842 | + |
| SEQ ID NO 46272 | TTCATCCTCCTGCCTGGTACAC | CTT | chr1 | 55038825 | 55038846 | 55038842 | 55038847 | + |
| SEQ ID NO 46273 | TCATCCTCCTGCCTGGTACACA | TTT | chr1 | 55038826 | 55038847 | 55038843 | 55038848 | + |
| SEQ ID NO 46274 | CATCCTCCTGCCTGGTACACAA | TTT | chr1 | 55038827 | 55038848 | 55038844 | 55038849 | + |
| SEQ ID NO 46275 | ATCCTCCTGCCTGGTACACAAT | TTC | chr1 | 55038828 | 55038849 | 55038845 | 55038850 | + |
| SEQ ID NO 46276 | CTGCCTGGTACACAATAGGTGT | CTC | chr1 | 55038834 | 55038855 | 55038851 | 55038856 | + |
| SEQ ID NO 46277 | CCTGGTACACAATAGGTGTTTA | CTG | chr1 | 55038837 | 55038858 | 55038854 | 55038859 | + |
| SEQ ID NO 46278 | GTACACAATAGGTGTTTACTGG | CTG | chr1 | 55038841 | 55038862 | 55038858 | 55038863 | + |
| SEQ ID NO 46279 | ACTGGATGCTTGTCCAGTTGAT | TTT | chr1 | 55038858 | 55038879 | 55038875 | 55038880 | + |
| SEQ ID NO 46280 | CTGGATGCTTGTCCAGTTGATT | TTA | chr1 | 55038859 | 55038880 | 55038876 | 55038881 | + |
| SEQ ID NO 46281 | GATGCTTGTCCAGTTGATTTCT | CTG | chr1 | 55038862 | 55038883 | 55038879 | 55038884 | + |
| SEQ ID NO 46282 | GTCCAGTTGATTTCTTGAACAT | CTT | chr1 | 55038869 | 55038890 | 55038886 | 55038891 | + |
| SEQ ID NO 46283 | TCCAGTTGATTTCTTGAACATG | TTG | chr1 | 55038870 | 55038891 | 55038887 | 55038892 | + |
| SEQ ID NO 46284 | ATTTCTTGAACATGGTGTGTAA | TTG | chr1 | 55038878 | 55038899 | 55038895 | 55038900 | + |
| SEQ ID NO 46285 | CTTGAACATGGTGTGTAAAAGG | TTT | chr1 | 55038882 | 55038903 | 55038899 | 55038904 | + |
| SEQ ID NO 46286 | TTGAACATGGTGTGTAAAAGGA | TTC | chr1 | 55038883 | 55038904 | 55038900 | 55038905 | + |
| SEQ ID NO 46287 | GAACATGGTGTGTAAAAGGAAT | CTT | chr1 | 55038885 | 55038906 | 55038902 | 55038907 | + |
| SEQ ID NO 46288 | AACATGGTGTGTAAAAGGAATC | TTG | chr1 | 55038886 | 55038907 | 55038903 | 55038908 | + |
| SEQ ID NO 46289 | TGCAAATTGAATCTTCTGGAAA | CTT | chr1 | 55038910 | 55038931 | 55038927 | 55038932 | + |
| SEQ ID NO 46290 | GCAAATTGAATCTTCTGGAAAG | TTT | chr1 | 55038911 | 55038932 | 55038928 | 55038933 | + |
| SEQ ID NO 46291 | CAAATTGAATCTTCTGGAAAGC | TTG | chr1 | 55038912 | 55038933 | 55038929 | 55038934 | + |
| SEQ ID NO 46292 | AATCTTCTGGAAAGCTGAGCTT | TTG | chr1 | 55038919 | 55038940 | 55038936 | 55038941 | + |
| SEQ ID NO 46293 | CTGGAAAGCTGAGCTTGTGCCT | CTT | chr1 | 55038925 | 55038946 | 55038942 | 55038947 | + |
| SEQ ID NO 46294 | TGGAAAGCTGAGCTTGTGCCTA | TTC | chr1 | 55038926 | 55038947 | 55038943 | 55038948 | + |
| SEQ ID NO 46295 | GAAAGCTGAGCTTGTGCCTACC | CTG | chr1 | 55038928 | 55038949 | 55038945 | 55038950 | + |
| SEQ ID NO 46296 | AGCTTGTGCCTACCATAGAATT | CTG | chr1 | 55038936 | 55038957 | 55038953 | 55038958 | + |
| SEQ ID NO 46297 | GTGCCTACCATAGAATTCTGAA | CTT | chr1 | 55038941 | 55038962 | 55038958 | 55038963 | + |
| SEQ ID NO 46298 | TGCCTACCATAGAATTCTGAAT | TTG | chr1 | 55038942 | 55038963 | 55038959 | 55038964 | + |
| SEQ ID NO 46299 | CCATAGAATTCTGAATGTACCT | CTA | chr1 | 55038948 | 55038969 | 55038965 | 55038970 | + |
| SEQ ID NO 46300 | TGAATGTACCTATATGACGTCT | TTC | chr1 | 55038959 | 55038980 | 55038976 | 55038981 | + |
| SEQ ID NO 46301 | AATGTACCTATATGACGTCTTT | CTG | chr1 | 55038961 | 55038982 | 55038978 | 55038983 | + |
| SEQ ID NO 46302 | TATGACGTCTTTGCAAACTTAA | CTA | chr1 | 55038971 | 55038992 | 55038988 | 55038993 | + |
| SEQ ID NO 46303 | TGCAAACTTAAAACCTGAATCT | CTT | chr1 | 55038982 | 55039003 | 55038999 | 55039004 | + |
| SEQ ID NO 46304 | GCAAACTTAAAACCTGAATCTT | TTT | chr1 | 55038983 | 55039004 | 55039000 | 55039005 | + |
| SEQ ID NO 46305 | CAAACTTAAAACCTGAATCTTT | TTG | chr1 | 55038984 | 55039005 | 55039001 | 55039006 | + |
| SEQ ID NO 46306 | AAAACCTGAATCTTTGTAGTAT | CTT | chr1 | 55038991 | 55039012 | 55039008 | 55039013 | + |
| SEQ ID NO 46307 | AAACCTGAATCTTTGTAGTATA | TTA | chr1 | 55038992 | 55039013 | 55039009 | 55039014 | + |
| SEQ ID NO 46308 | AATCTTTGTAGTATAAATCCCT | CTG | chr1 | 55038999 | 55039020 | 55039016 | 55039021 | + |
| SEQ ID NO 46309 | TGTAGTATAAATCCCTTGAAAT | CTT | chr1 | 55039005 | 55039026 | 55039022 | 55039027 | + |
| SEQ ID NO 46310 | GTAGTATAAATCCCTTGAAATG | TTT | chr1 | 55039006 | 55039027 | 55039023 | 55039028 | + |
| SEQ ID NO 46311 | TAGTATAAATCCCTTGAAATGC | TTG | chr1 | 55039007 | 55039028 | 55039024 | 55039029 | + |
| SEQ ID NO 46312 | GAAATGCATGTAGGCTGGACAT | CTT | chr1 | 55039022 | 55039043 | 55039039 | 55039044 | + |
| SEQ ID NO 46313 | AAATGCATGTAGGCTGGACATC | TTG | chr1 | 55039023 | 55039044 | 55039040 | 55039045 | + |
| SEQ ID NO 46314 | GACATCAAAAGCAAGCAATCTC | CTG | chr1 | 55039039 | 55039060 | 55039056 | 55039061 | + |

Figure 66 (Cont'd)

| | | | | | | | | |
|---|---|---|---|---|---|---|---|---|
| SEQ ID NO 46315 | TTCAAGGAGCAGCTAGTTGGTA | CTC | chr1 | 55039061 | 55039082 | 55039078 | 55039083 | + |
| SEQ ID NO 46316 | CAAGGAGCAGCTAGTTGGTAAG | CTT | chr1 | 55039063 | 55039084 | 55039080 | 55039085 | + |
| SEQ ID NO 46317 | AAGGAGCAGCTAGTTGGTAAGG | TTC | chr1 | 55039064 | 55039085 | 55039081 | 55039086 | + |
| SEQ ID NO 46318 | GTTGGTAAGGTCAGTGTGCAGG | CTA | chr1 | 55039076 | 55039097 | 55039093 | 55039098 | + |
| SEQ ID NO 46319 | GTAAGGTCAGTGTGCAGGGTGC | TTG | chr1 | 55039080 | 55039101 | 55039097 | 55039102 | + |
| SEQ ID NO 46320 | AGTTTAGAAGGCTGCCAGGTTA | CTA | chr1 | 55039135 | 55039156 | 55039152 | 55039157 | + |
| SEQ ID NO 46321 | AGAAGGCTGCCAGGTTAAGGCC | TTT | chr1 | 55039140 | 55039161 | 55039157 | 55039162 | + |
| SEQ ID NO 46322 | GAAGGCTGCCAGGTTAAGGCCA | TTA | chr1 | 55039141 | 55039162 | 55039158 | 55039163 | + |
| SEQ ID NO 46323 | CCAGGTTAAGGCCAGTGGAAAG | CTG | chr1 | 55039149 | 55039170 | 55039166 | 55039171 | + |
| SEQ ID NO 46324 | AGGCCAGTGGAAAGAATTCGGT | TTA | chr1 | 55039157 | 55039178 | 55039174 | 55039179 | + |
| SEQ ID NO 46325 | GGTGGGCAGCGAGGAGTCCACA | TTC | chr1 | 55039176 | 55039197 | 55039193 | 55039198 | + |
| SEQ ID NO 46326 | ATTCAGAAGTCTCACTGGTCAG | TTG | chr1 | 55039207 | 55039228 | 55039224 | 55039229 | + |
| SEQ ID NO 46327 | AGAAGTCTCACTGGTCAGCAGG | TTC | chr1 | 55039211 | 55039232 | 55039228 | 55039233 | + |
| SEQ ID NO 46328 | ACTGGTCAGCAGGAGACAAGGT | CTC | chr1 | 55039220 | 55039241 | 55039237 | 55039242 | + |
| SEQ ID NO 46329 | GTCAGCAGGAGACAAGGTGGAC | CTG | chr1 | 55039224 | 55039245 | 55039241 | 55039246 | + |
| SEQ ID NO 46330 | AAAAGGTGGGCCCGGCAGAACT | CTG | chr1 | 55039259 | 55039280 | 55039276 | 55039281 | + |
| SEQ ID NO 46331 | GGAGTCTGGCATCCCACGCAGG | CTT | chr1 | 55039282 | 55039303 | 55039299 | 55039304 | + |
| SEQ ID NO 46332 | GAGTCTGGCATCCCACGCAGGG | TTG | chr1 | 55039283 | 55039304 | 55039300 | 55039305 | + |
| SEQ ID NO 46333 | GCATCCCACGCAGGGTGAGAGG | CTG | chr1 | 55039290 | 55039311 | 55039307 | 55039312 | + |
| SEQ ID NO 46334 | GGGCGCCGGCCTGCCTTCCAGC | CTA | chr1 | 55039332 | 55039353 | 55039349 | 55039354 | + |
| SEQ ID NO 46335 | CCTTCCAGCCCAGTTAGGATTT | CTG | chr1 | 55039345 | 55039366 | 55039362 | 55039367 | + |
| SEQ ID NO 46336 | CCAGCCCAGTTAGGATTTGGGA | CTT | chr1 | 55039349 | 55039370 | 55039366 | 55039371 | + |
| SEQ ID NO 46337 | CAGCCCAGTTAGGATTTGGGAG | TTC | chr1 | 55039350 | 55039371 | 55039367 | 55039372 | + |
| SEQ ID NO 46338 | GGATTTGGGAGTTTTTTCTTCC | TTA | chr1 | 55039361 | 55039382 | 55039378 | 55039383 | + |
| SEQ ID NO 46339 | GGGAGTTTTTTCTTCCCTCTGC | TTT | chr1 | 55039367 | 55039388 | 55039384 | 55039389 | + |
| SEQ ID NO 46340 | GGAGTTTTTTCTTCCCTCTGCG | TTG | chr1 | 55039368 | 55039389 | 55039385 | 55039390 | + |
| SEQ ID NO 46341 | TTTCTTCCCTCTGCGCGTAATC | TTT | chr1 | 55039375 | 55039396 | 55039392 | 55039397 | + |
| SEQ ID NO 46342 | TTCTTCCCTCTGCGCGTAATCT | TTT | chr1 | 55039376 | 55039397 | 55039393 | 55039398 | + |
| SEQ ID NO 46343 | TCTTCCCTCTGCGCGTAATCTG | TTT | chr1 | 55039377 | 55039398 | 55039394 | 55039399 | + |
| SEQ ID NO 46344 | CTTCCCTCTGCGCGTAATCTGA | TTT | chr1 | 55039378 | 55039399 | 55039395 | 55039400 | + |
| SEQ ID NO 46345 | TTCCCTCTGCGCGTAATCTGAC | TTC | chr1 | 55039379 | 55039400 | 55039396 | 55039401 | + |
| SEQ ID NO 46346 | CCCTCTGCGCGTAATCTGACGC | CTT | chr1 | 55039381 | 55039402 | 55039398 | 55039403 | + |
| SEQ ID NO 46347 | CCTCTGCGCGTAATCTGACGCT | TTC | chr1 | 55039382 | 55039403 | 55039399 | 55039404 | + |
| SEQ ID NO 46348 | TGCGCGTAATCTGACGCTGTTT | CTC | chr1 | 55039386 | 55039407 | 55039403 | 55039408 | + |
| SEQ ID NO 46349 | CGCGTAATCTGACGCTGTTTGG | CTG | chr1 | 55039388 | 55039409 | 55039405 | 55039410 | + |
| SEQ ID NO 46350 | ACGCTGTTTGGGGAGGGCGAGG | CTG | chr1 | 55039399 | 55039420 | 55039416 | 55039421 | + |
| SEQ ID NO 46351 | TTTGGGGAGGGCGAGGCCGAAA | CTG | chr1 | 55039405 | 55039426 | 55039422 | 55039427 | + |
| SEQ ID NO 46352 | GGGGAGGGCGAGGCCGAAACCT | TTT | chr1 | 55039408 | 55039429 | 55039425 | 55039430 | + |
| SEQ ID NO 46353 | GGGAGGGCGAGGCCGAAACCTG | TTG | chr1 | 55039409 | 55039430 | 55039426 | 55039431 | + |
| SEQ ID NO 46354 | ATCCTCCAGTCCGGGGGTTCCG | CTG | chr1 | 55039431 | 55039452 | 55039448 | 55039453 | + |
| SEQ ID NO 46355 | CAGTCCGGGGGTTCCGTTAATG | CTC | chr1 | 55039437 | 55039458 | 55039454 | 55039459 | + |
| SEQ ID NO 46356 | CGTTAATGTTTAATCAGATAGG | TTC | chr1 | 55039451 | 55039472 | 55039468 | 55039473 | + |
| SEQ ID NO 46357 | ATGTTTAATCAGATAGGATCGT | TTA | chr1 | 55039456 | 55039477 | 55039473 | 55039478 | + |
| SEQ ID NO 46358 | AATCAGATAGGATCGTCCGATG | TTT | chr1 | 55039462 | 55039483 | 55039479 | 55039484 | + |
| SEQ ID NO 46359 | ATCAGATAGGATCGTCCGATGG | TTA | chr1 | 55039463 | 55039484 | 55039480 | 55039485 | + |
| SEQ ID NO 46360 | TGGTGGCGTGATCTGCGCGCCC | CTC | chr1 | 55039490 | 55039511 | 55039507 | 55039512 | + |
| SEQ ID NO 46361 | GTGGCGTGATCTGCGCGCCCCA | CTG | chr1 | 55039492 | 55039513 | 55039509 | 55039514 | + |
| SEQ ID NO 46362 | CGCGCCCAGGCGTCAAGCACC | CTG | chr1 | 55039505 | 55039526 | 55039522 | 55039527 | + |
| SEQ ID NO 46363 | GAAGGTTCCGCAGCGACGTCG | CTA | chr1 | 55039536 | 55039557 | 55039553 | 55039558 | + |
| SEQ ID NO 46364 | CCGCAGCGACGTCGAGGCGCTC | TTT | chr1 | 55039544 | 55039565 | 55039561 | 55039566 | + |
| SEQ ID NO 46365 | CGCAGCGACGTCGAGGCGCTCA | TTC | chr1 | 55039545 | 55039566 | 55039562 | 55039567 | + |
| SEQ ID NO 46366 | ATGGTTGCAGGCGGGCGCCGCC | CTC | chr1 | 55039566 | 55039587 | 55039583 | 55039588 | + |
| SEQ ID NO 46367 | CAGGCGGGCGCCGCCGTTCAGT | TTG | chr1 | 55039573 | 55039594 | 55039590 | 55039595 | + |
| SEQ ID NO 46368 | AGTTCAGGGTCTGAGCCTGGAG | TTC | chr1 | 55039592 | 55039613 | 55039609 | 55039614 | + |
| SEQ ID NO 46369 | AGGGTCTGAGCCTGGAGGAGTG | TTC | chr1 | 55039597 | 55039618 | 55039614 | 55039619 | + |
| SEQ ID NO 46370 | AGCCTGGAGGAGTGAGCCAGGC | CTG | chr1 | 55039605 | 55039626 | 55039622 | 55039627 | + |
| SEQ ID NO 46371 | GAGGAGTGAGCCAGGCAGTGAG | CTG | chr1 | 55039611 | 55039632 | 55039628 | 55039633 | + |
| SEQ ID NO 46372 | GCTCGGGCGGGCCGGGACGCGT | CTG | chr1 | 55039637 | 55039658 | 55039654 | 55039659 | + |

Figure 66 (Cont'd)

| SEQ ID NO 46373 | GGGCGGGCCGGGACGCGTCGTT | CTC | chr1 | 55039641 | 55039662 | 55039658 | 55039663 | + |
|---|---|---|---|---|---|---|---|---|
| SEQ ID NO 46374 | CAGCAGCGGCTCCCAGCTCCCA | TTG | chr1 | 55039664 | 55039685 | 55039681 | 55039686 | + |
| SEQ ID NO 46375 | CCAGCTCCCAGCCAGGATTCCG | CTC | chr1 | 55039676 | 55039697 | 55039693 | 55039698 | + |
| SEQ ID NO 46376 | CCAGCCAGGATTCCGCGCGCCC | CTC | chr1 | 55039683 | 55039704 | 55039700 | 55039705 | + |
| SEQ ID NO 46377 | CGCGCGCCCCTTCACGCGCCCT | TTC | chr1 | 55039696 | 55039717 | 55039713 | 55039718 | + |
| SEQ ID NO 46378 | CACGCGCCCTGCTCCTGAACTT | CTT | chr1 | 55039708 | 55039729 | 55039725 | 55039730 | + |
| SEQ ID NO 46379 | ACGCGCCCTGCTCCTGAACTTC | TTC | chr1 | 55039709 | 55039730 | 55039726 | 55039731 | + |
| SEQ ID NO 46380 | CTCCTGAACTTCAGCTCCTGCA | CTG | chr1 | 55039719 | 55039740 | 55039736 | 55039741 | + |
| SEQ ID NO 46381 | CTGAACTTCAGCTCCTGCACAG | CTC | chr1 | 55039722 | 55039743 | 55039739 | 55039744 | + |
| SEQ ID NO 46382 | AACTTCAGCTCCTGCACAGTCC | CTG | chr1 | 55039725 | 55039746 | 55039742 | 55039747 | + |
| SEQ ID NO 46383 | CAGCTCCTGCACAGTCCTCCCC | CTT | chr1 | 55039730 | 55039751 | 55039747 | 55039752 | + |
| SEQ ID NO 46384 | AGCTCCTGCACAGTCCTCCCCA | TTC | chr1 | 55039731 | 55039752 | 55039748 | 55039753 | + |
| SEQ ID NO 46385 | CTGCACAGTCCTCCCCACCGCA | CTC | chr1 | 55039736 | 55039757 | 55039753 | 55039758 | + |
| SEQ ID NO 46386 | CACAGTCCTCCCCACCGCAAGG | CTG | chr1 | 55039739 | 55039760 | 55039756 | 55039761 | + |
| SEQ ID NO 46387 | CCCACCGCAAGGCTCAAGGCGC | CTC | chr1 | 55039749 | 55039770 | 55039766 | 55039771 | + |
| SEQ ID NO 46388 | AAGGCGCCGCCGGCGTGGACCG | CTC | chr1 | 55039764 | 55039785 | 55039781 | 55039786 | + |
| SEQ ID NO 46389 | TAGGTCTCCTCGCCAGGACAGC | CTC | chr1 | 55039797 | 55039818 | 55039814 | 55039819 | + |
| SEQ ID NO 46390 | GGTCTCCTCGCCAGGACAGCAA | CTA | chr1 | 55039799 | 55039820 | 55039816 | 55039821 | + |
| SEQ ID NO 46391 | CTCGCCAGGACAGCAACCTCTC | CTC | chr1 | 55039805 | 55039826 | 55039822 | 55039827 | + |
| SEQ ID NO 46392 | GCCAGGACAGCAACCTCTCCCC | CTC | chr1 | 55039808 | 55039829 | 55039825 | 55039830 | + |
| SEQ ID NO 46393 | TCCCCTGGCCCTCATGGGCACC | CTC | chr1 | 55039825 | 55039846 | 55039842 | 55039847 | + |
| SEQ ID NO 46394 | CCCTGGCCCTCATGGGCACCGT | CTC | chr1 | 55039827 | 55039848 | 55039844 | 55039849 | + |
| SEQ ID NO 46395 | GCCCTCATGGGCACCGTCAGCT | CTG | chr1 | 55039832 | 55039853 | 55039849 | 55039854 | + |
| SEQ ID NO 46396 | ATGGGCACCGTCAGCTCCAGGC | CTC | chr1 | 55039838 | 55039859 | 55039855 | 55039860 | + |
| SEQ ID NO 46397 | CAGGCGGTCCTGGTGGCCGCTG | CTC | chr1 | 55039855 | 55039876 | 55039872 | 55039877 | + |
| SEQ ID NO 46398 | GTGGCCGCTGCCACTGCTGCTG | CTG | chr1 | 55039867 | 55039888 | 55039884 | 55039889 | + |
| SEQ ID NO 46399 | CCACTGCTGCTGCTGCTGCTGC | CTG | chr1 | 55039877 | 55039898 | 55039894 | 55039899 | + |
| SEQ ID NO 46400 | CTGCTGCTGCTGCTGCTGCTCC | CTG | chr1 | 55039883 | 55039904 | 55039900 | 55039905 | + |
| SEQ ID NO 46401 | CTGCTGCTGCTGCTGCTCCTGG | CTG | chr1 | 55039886 | 55039907 | 55039903 | 55039908 | + |
| SEQ ID NO 46402 | CTGCTGCTGCTGCTCCTGGGTC | CTG | chr1 | 55039889 | 55039910 | 55039906 | 55039911 | + |
| SEQ ID NO 46403 | CTGCTGCTGCTCCTGGGTCCCG | CTG | chr1 | 55039892 | 55039913 | 55039909 | 55039914 | + |
| SEQ ID NO 46404 | CTGCTGCTCCTGGGTCCCGCGG | CTG | chr1 | 55039895 | 55039916 | 55039912 | 55039917 | + |
| SEQ ID NO 46405 | CTGCTCCTGGGTCCCGCGGGCG | CTG | chr1 | 55039898 | 55039919 | 55039915 | 55039920 | + |
| SEQ ID NO 46406 | CTCCTGGGTCCCGCGGGCGCCC | CTG | chr1 | 55039901 | 55039922 | 55039918 | 55039923 | + |
| SEQ ID NO 46407 | CTGGGTCCCGCGGGCGCCCGTG | CTC | chr1 | 55039904 | 55039925 | 55039921 | 55039926 | + |
| SEQ ID NO 46408 | GGTCCCGCGGGCGCCCGTGCGC | CTG | chr1 | 55039907 | 55039928 | 55039924 | 55039929 | + |
| SEQ ID NO 46409 | CGAGGAGCTGGTGCTAGCCTTG | CTA | chr1 | 55039951 | 55039972 | 55039968 | 55039973 | + |
| SEQ ID NO 46410 | GTGCTAGCCTTGCGTTCCGAGG | CTG | chr1 | 55039961 | 55039982 | 55039978 | 55039983 | + |
| SEQ ID NO 46411 | GCCTTGCGTTCCGAGGAGGACG | CTA | chr1 | 55039967 | 55039988 | 55039984 | 55039989 | + |
| SEQ ID NO 46412 | GCGTTCCGAGGAGGACGGCCTG | CTT | chr1 | 55039972 | 55039993 | 55039989 | 55039994 | + |
| SEQ ID NO 46413 | CGTTCCGAGGAGGACGGCCTGG | TTG | chr1 | 55039973 | 55039994 | 55039990 | 55039995 | + |
| SEQ ID NO 46414 | CGAGGAGGACGGCCTGGCCGAA | TTC | chr1 | 55039978 | 55039999 | 55039995 | 55040000 | + |
| SEQ ID NO 46415 | GCCGAAGCACCCGAGCACGGAA | CTG | chr1 | 55039994 | 55040015 | 55040011 | 55040016 | + |
| SEQ ID NO 46416 | CCACCGCTGCGCCAAGGTGCGG | CTT | chr1 | 55040029 | 55040050 | 55040046 | 55040051 | + |
| SEQ ID NO 46417 | CACCGCTGCGCCAAGGTGCGGG | TTC | chr1 | 55040030 | 55040051 | 55040047 | 55040052 | + |
| SEQ ID NO 46418 | CGCCAAGGTGCGGGTGTAGGGA | CTG | chr1 | 55040038 | 55040059 | 55040055 | 55040060 | + |
| SEQ ID NO 46419 | TTTCCTCTCGGGCCTCAGTTTC | CTG | chr1 | 55040103 | 55040124 | 55040120 | 55040125 | + |
| SEQ ID NO 46420 | CCTCTCGGGCCTCAGTTTCCCC | TTT | chr1 | 55040106 | 55040127 | 55040123 | 55040128 | + |
| SEQ ID NO 46421 | CTCTCGGGCCTCAGTTTCCCCC | TTC | chr1 | 55040107 | 55040128 | 55040124 | 55040129 | + |
| SEQ ID NO 46422 | TCGGGCCTCAGTTTCCCCCCAT | CTC | chr1 | 55040110 | 55040131 | 55040127 | 55040132 | + |
| SEQ ID NO 46423 | GGGCCTCAGTTTCCCCCCATGT | CTC | chr1 | 55040112 | 55040133 | 55040129 | 55040134 | + |
| SEQ ID NO 46424 | AGTTTCCCCCCATGTAAGAGAG | CTC | chr1 | 55040119 | 55040140 | 55040136 | 55040141 | + |
| SEQ ID NO 46425 | CCCCCATGTAAGAGAGGAAGT | TTT | chr1 | 55040124 | 55040145 | 55040141 | 55040146 | + |
| SEQ ID NO 46426 | CCCCCATGTAAGAGAGGAAGTG | TTC | chr1 | 55040125 | 55040146 | 55040142 | 55040147 | + |
| SEQ ID NO 46427 | TTCGCTTGGCACGATCTTGGGG | CTC | chr1 | 55040169 | 55040190 | 55040186 | 55040191 | + |
| SEQ ID NO 46428 | CGCTTGGCACGATCTTGGGGAC | CTT | chr1 | 55040171 | 55040192 | 55040188 | 55040193 | + |
| SEQ ID NO 46429 | GCTTGGCACGATCTTGGGGACT | TTC | chr1 | 55040172 | 55040193 | 55040189 | 55040194 | + |
| SEQ ID NO 46430 | GGCACGATCTTGGGGACTGCAG | CTT | chr1 | 55040176 | 55040197 | 55040193 | 55040198 | + |

Figure 66 (Cont'd)

| | | | | | | | | |
|---|---|---|---|---|---|---|---|---|
| SEQ ID NO 46431 | GCACGATCTTGGGGACTGCAGG | TTG | chr1 | 55040177 | 55040198 | 55040194 | 55040199 | + |
| SEQ ID NO 46432 | GGGGACTGCAGGCAAGGCGGCG | CTT | chr1 | 55040187 | 55040208 | 55040204 | 55040209 | + |
| SEQ ID NO 46433 | GGGACTGCAGGCAAGGCGGCGG | TTG | chr1 | 55040188 | 55040209 | 55040205 | 55040210 | + |
| SEQ ID NO 46434 | CAGGCAAGGCGGCGGGGGAGGA | CTG | chr1 | 55040195 | 55040216 | 55040212 | 55040217 | + |
| SEQ ID NO 46435 | TTTGGGGACTTGCTGGGGCGTG | CTC | chr1 | 55040259 | 55040280 | 55040276 | 55040281 | + |
| SEQ ID NO 46436 | TGGGGACTTGCTGGGGCGTGCG | CTT | chr1 | 55040261 | 55040282 | 55040278 | 55040283 | + |
| SEQ ID NO 46437 | GGGGACTTGCTGGGGCGTGCGG | TTT | chr1 | 55040262 | 55040283 | 55040279 | 55040284 | + |
| SEQ ID NO 46438 | GGGACTTGCTGGGGCGTGCGGC | TTG | chr1 | 55040263 | 55040284 | 55040280 | 55040285 | + |
| SEQ ID NO 46439 | GCTGGGGCGTGCGGCTGCGCTA | CTT | chr1 | 55040270 | 55040291 | 55040287 | 55040292 | + |
| SEQ ID NO 46440 | CTGGGGCGTGCGGCTGCGCTAT | TTG | chr1 | 55040271 | 55040292 | 55040288 | 55040293 | + |
| SEQ ID NO 46441 | GGGCGTGCGGCTGCGCTATTCA | CTG | chr1 | 55040274 | 55040295 | 55040291 | 55040296 | + |
| SEQ ID NO 46442 | CGCTATTCAGTGGGAAGGTTCG | CTG | chr1 | 55040287 | 55040308 | 55040304 | 55040309 | + |
| SEQ ID NO 46443 | TTCAGTGGGAAGGTTCGCGGGG | CTA | chr1 | 55040292 | 55040313 | 55040309 | 55040314 | + |
| SEQ ID NO 46444 | AGTGGGAAGGTTCGCGGGGTTG | TTC | chr1 | 55040295 | 55040316 | 55040312 | 55040317 | + |
| SEQ ID NO 46445 | GCGGGGTTGGGAGACCCGGAGG | TTC | chr1 | 55040308 | 55040329 | 55040325 | 55040330 | + |
| SEQ ID NO 46446 | GGAGACCCGGAGGCCGAGGAAG | TTG | chr1 | 55040317 | 55040338 | 55040334 | 55040339 | + |
| SEQ ID NO 46447 | CCAGGATATCCTGCCCAGATTT | CTG | chr1 | 55040355 | 55040376 | 55040372 | 55040377 | + |
| SEQ ID NO 46448 | CCCAGATTTCCCAGTTTCTGCC | CTG | chr1 | 55040368 | 55040389 | 55040385 | 55040390 | + |
| SEQ ID NO 46449 | CCCAGTTTCTGCCTCGCCGCGG | TTT | chr1 | 55040377 | 55040398 | 55040394 | 55040399 | + |
| SEQ ID NO 46450 | CCAGTTTCTGCCTCGCCGCGGC | TTC | chr1 | 55040378 | 55040399 | 55040395 | 55040400 | + |
| SEQ ID NO 46451 | CTGCCTCGCCGCGGCACAGGTG | TTT | chr1 | 55040385 | 55040406 | 55040402 | 55040407 | + |
| SEQ ID NO 46452 | TGCCTCGCCGCGGCACAGGTGG | TTC | chr1 | 55040386 | 55040407 | 55040403 | 55040408 | + |
| SEQ ID NO 46453 | CCTCGCCGCGGCACAGGTGGGT | CTG | chr1 | 55040388 | 55040409 | 55040405 | 55040410 | + |
| SEQ ID NO 46454 | GCCGCGGCACAGGTGGGTGAAG | CTC | chr1 | 55040392 | 55040413 | 55040409 | 55040414 | + |
| SEQ ID NO 46455 | GAACGTACTGGGAACTGCACCA | CTG | chr1 | 55040427 | 55040448 | 55040444 | 55040449 | + |
| SEQ ID NO 46456 | GGAACTGCACCAGGCACAGAGA | CTG | chr1 | 55040437 | 55040458 | 55040454 | 55040459 | + |
| SEQ ID NO 46457 | CACCAGGCACAGAGAAAGCGGG | CTG | chr1 | 55040444 | 55040465 | 55040461 | 55040466 | + |
| SEQ ID NO 46458 | GCCATTATAGTGGGTTCCGATT | CTT | chr1 | 55040469 | 55040490 | 55040486 | 55040491 | + |
| SEQ ID NO 46459 | CCATTATAGTGGGTTCCGATTT | TTG | chr1 | 55040470 | 55040491 | 55040487 | 55040492 | + |
| SEQ ID NO 46460 | TAGTGGGTTCCGATTTGGTTTG | TTA | chr1 | 55040476 | 55040497 | 55040493 | 55040498 | + |
| SEQ ID NO 46461 | CGATTTGGTTTGGAAAACATGG | TTC | chr1 | 55040486 | 55040507 | 55040503 | 55040508 | + |
| SEQ ID NO 46462 | GGTTTGGAAAACATGGGCAGCG | TTT | chr1 | 55040492 | 55040513 | 55040509 | 55040514 | + |
| SEQ ID NO 46463 | GTTTGGAAAACATGGGCAGCGG | TTG | chr1 | 55040493 | 55040514 | 55040510 | 55040515 | + |
| SEQ ID NO 46464 | GGAAAACATGGGCAGCGGAGGG | TTT | chr1 | 55040497 | 55040518 | 55040514 | 55040519 | + |
| SEQ ID NO 46465 | GAAAACATGGGCAGCGGAGGGT | TTG | chr1 | 55040498 | 55040519 | 55040515 | 55040520 | + |
| SEQ ID NO 46466 | GAGAGAAGGCCCTACCCGAGAC | CTG | chr1 | 55040530 | 55040551 | 55040547 | 55040552 | + |
| SEQ ID NO 46467 | CCCGAGACAGGGGCGGGGTGGG | CTA | chr1 | 55040544 | 55040565 | 55040561 | 55040566 | + |
| SEQ ID NO 46468 | GGAGCACGAGGCAATTTCTTTA | CTG | chr1 | 55040583 | 55040604 | 55040600 | 55040605 | + |
| SEQ ID NO 46469 | CTTTATGACACAGAACTCATGC | TTT | chr1 | 55040600 | 55040621 | 55040617 | 55040622 | + |
| SEQ ID NO 46470 | TTTATGACACAGAACTCATGCT | TTC | chr1 | 55040601 | 55040622 | 55040618 | 55040623 | + |
| SEQ ID NO 46471 | TATGACACAGAACTCATGCTCT | CTT | chr1 | 55040603 | 55040624 | 55040620 | 55040625 | + |
| SEQ ID NO 46472 | ATGACACAGAACTCATGCTCTA | TTT | chr1 | 55040604 | 55040625 | 55040621 | 55040626 | + |
| SEQ ID NO 46473 | TGACACAGAACTCATGCTCTAG | TTA | chr1 | 55040605 | 55040626 | 55040622 | 55040627 | + |
| SEQ ID NO 46474 | ATGCTCTAGTATTCCATCTGTT | CTC | chr1 | 55040618 | 55040639 | 55040635 | 55040640 | + |
| SEQ ID NO 46475 | TAGTATTCCATCTGTTTCAGCC | CTC | chr1 | 55040624 | 55040645 | 55040641 | 55040646 | + |
| SEQ ID NO 46476 | GTATTCCATCTGTTTCAGCCGA | CTA | chr1 | 55040626 | 55040647 | 55040643 | 55040648 | + |
| SEQ ID NO 46477 | CATCTGTTTCAGCCGAAGAAAA | TTC | chr1 | 55040632 | 55040653 | 55040649 | 55040654 | + |
| SEQ ID NO 46478 | TTTCAGCCGAAGAAAAGAACCA | CTG | chr1 | 55040638 | 55040659 | 55040655 | 55040660 | + |
| SEQ ID NO 46479 | CAGCCGAAGAAAAGAACCAGCT | TTT | chr1 | 55040641 | 55040662 | 55040658 | 55040663 | + |
| SEQ ID NO 46480 | AGCCGAAGAAAAGAACCAGCTG | TTC | chr1 | 55040642 | 55040663 | 55040659 | 55040664 | + |
| SEQ ID NO 46481 | AAGGGGCAGGGGAGAAGGGGCG | CTG | chr1 | 55040664 | 55040685 | 55040681 | 55040686 | + |
| SEQ ID NO 46482 | TCGAGGCCCATTGGCGTCCTTT | TTC | chr1 | 55040695 | 55040716 | 55040712 | 55040717 | + |
| SEQ ID NO 46483 | GAGGCCCATTGGCGTCCTTTAG | CTC | chr1 | 55040697 | 55040718 | 55040714 | 55040719 | + |
| SEQ ID NO 46484 | GCGTCCTTTAGGACTCAGGCAG | TTG | chr1 | 55040708 | 55040729 | 55040725 | 55040730 | + |
| SEQ ID NO 46485 | TAGGACTCAGGCAGGGAAGGGC | CTT | chr1 | 55040716 | 55040737 | 55040733 | 55040738 | + |
| SEQ ID NO 46486 | AGGACTCAGGCAGGGAAGGGCC | TTT | chr1 | 55040717 | 55040738 | 55040734 | 55040739 | + |
| SEQ ID NO 46487 | GGACTCAGGCAGGGAAGGGCCC | TTA | chr1 | 55040718 | 55040739 | 55040735 | 55040740 | + |
| SEQ ID NO 46488 | AGGCAGGGAAGGGCCCTTGGTG | CTC | chr1 | 55040724 | 55040745 | 55040741 | 55040746 | + |

Figure 66 (Cont'd)

| | | | | | | | | |
|---|---|---|---|---|---|---|---|---|
| SEQ ID NO 46489 | GGTGCTCTGGAGCCGGAGGTGG | CTT | chr1 | 55040742 | 55040763 | 55040759 | 55040764 | + |
| SEQ ID NO 46490 | GTGCTCTGGAGCCGGAGGTGGT | TTG | chr1 | 55040743 | 55040764 | 55040760 | 55040765 | + |
| SEQ ID NO 46491 | TGGAGCCGGAGGTGGTGCGCCT | CTC | chr1 | 55040749 | 55040770 | 55040766 | 55040771 | + |
| SEQ ID NO 46492 | GAGCCGGAGGTGGTGCGCCTGG | CTG | chr1 | 55040751 | 55040772 | 55040768 | 55040773 | + |
| SEQ ID NO 46493 | GTACTGGGACCCGGGAGCTGAG | CTG | chr1 | 55040772 | 55040793 | 55040789 | 55040794 | + |
| SEQ ID NO 46494 | GGACCCCGGAGCTGAGCCCGGC | CTG | chr1 | 55040778 | 55040799 | 55040795 | 55040800 | + |
| SEQ ID NO 46495 | AGCCCGGCGCCTCAGCCCACCT | CTG | chr1 | 55040792 | 55040813 | 55040809 | 55040814 | + |
| SEQ ID NO 46496 | AGCCCACCTGGCTGTCTGCCGA | CTC | chr1 | 55040805 | 55040826 | 55040822 | 55040827 | + |
| SEQ ID NO 46497 | GCTGTCTGCCGACCGTGTGCGG | CTG | chr1 | 55040815 | 55040836 | 55040832 | 55040837 | + |
| SEQ ID NO 46498 | TCTGCCGACCGTGTGCGGGCG | CTG | chr1 | 55040819 | 55040840 | 55040836 | 55040841 | + |
| SEQ ID NO 46499 | CCGACCGTGTGCGGGGCGAGTT | CTG | chr1 | 55040823 | 55040844 | 55040840 | 55040845 | + |
| SEQ ID NO 46500 | GCTCAACAACTCTGCCAGCTTC | TTT | chr1 | 55040846 | 55040867 | 55040863 | 55040868 | + |
| SEQ ID NO 46501 | CTCAACAACTCTGCCAGCTTCT | TTG | chr1 | 55040847 | 55040868 | 55040864 | 55040869 | + |
| SEQ ID NO 46502 | AACAACTCTGCCAGCTTCTGGC | CTC | chr1 | 55040850 | 55040871 | 55040867 | 55040872 | + |
| SEQ ID NO 46503 | TGCCAGCTTCTGGCCCTCAGGC | CTC | chr1 | 55040858 | 55040879 | 55040875 | 55040880 | + |
| SEQ ID NO 46504 | CCAGCTTCTGGCCCTCAGGCTG | CTG | chr1 | 55040860 | 55040881 | 55040877 | 55040882 | + |
| SEQ ID NO 46505 | CTGGCCCTCAGGCTGTGGGAAG | CTT | chr1 | 55040867 | 55040888 | 55040884 | 55040889 | + |
| SEQ ID NO 46506 | TGGCCCTCAGGCTGTGGGAAGC | TTC | chr1 | 55040868 | 55040889 | 55040885 | 55040890 | + |
| SEQ ID NO 46507 | GCCCTCAGGCTGTGGGAAGCTT | CTG | chr1 | 55040870 | 55040891 | 55040887 | 55040892 | + |
| SEQ ID NO 46508 | AGGCTGTGGGAAGCTTCTTCCC | CTC | chr1 | 55040876 | 55040897 | 55040893 | 55040898 | + |
| SEQ ID NO 46509 | TGGGAAGCTTCTTCCCGGGGCG | CTG | chr1 | 55040882 | 55040903 | 55040899 | 55040904 | + |
| SEQ ID NO 46510 | CTTCCGGGGCGAGACCACTAG | CTT | chr1 | 55040892 | 55040913 | 55040909 | 55040914 | + |
| SEQ ID NO 46511 | TTCCCGGGGCGAGACCACTAGC | TTC | chr1 | 55040893 | 55040914 | 55040910 | 55040915 | + |
| SEQ ID NO 46512 | CCCGGGGCGAGACCACTAGCTT | CTT | chr1 | 55040895 | 55040916 | 55040912 | 55040917 | + |
| SEQ ID NO 46513 | CCGGGGCGAGACCACTAGCTTT | TTC | chr1 | 55040896 | 55040917 | 55040913 | 55040918 | + |
| SEQ ID NO 46514 | GCTTTTTCTAAGTATTACCAGC | CTA | chr1 | 55040913 | 55040934 | 55040930 | 55040935 | + |
| SEQ ID NO 46515 | TTTCTAAGTATTACCAGCCCAG | CTT | chr1 | 55040917 | 55040938 | 55040934 | 55040939 | + |
| SEQ ID NO 46516 | TTCTAAGTATTACCAGCCCAGG | TTT | chr1 | 55040918 | 55040939 | 55040935 | 55040940 | + |
| SEQ ID NO 46517 | TCTAAGTATTACCAGCCCAGGA | TTT | chr1 | 55040919 | 55040940 | 55040936 | 55040941 | + |
| SEQ ID NO 46518 | CTAAGTATTACCAGCCCAGGAC | TTT | chr1 | 55040920 | 55040941 | 55040937 | 55040942 | + |
| SEQ ID NO 46519 | TAAGTATTACCAGCCCAGGACT | TTC | chr1 | 55040921 | 55040942 | 55040938 | 55040943 | + |
| SEQ ID NO 46520 | AGTATTACCAGCCCAGGACTTG | CTA | chr1 | 55040923 | 55040944 | 55040940 | 55040945 | + |
| SEQ ID NO 46521 | CCAGCCCAGGACTTGGCTGAGG | TTA | chr1 | 55040930 | 55040951 | 55040947 | 55040952 | + |
| SEQ ID NO 46522 | GGCTGAGGTTCTGTGTCCCCCA | CTT | chr1 | 55040944 | 55040965 | 55040961 | 55040966 | + |
| SEQ ID NO 46523 | GCTGAGGTTCTGTGTCCCCCAG | TTG | chr1 | 55040945 | 55040966 | 55040962 | 55040967 | + |
| SEQ ID NO 46524 | AGGTTCTGTGTCCCCCAGCTTG | CTG | chr1 | 55040949 | 55040970 | 55040966 | 55040971 | + |
| SEQ ID NO 46525 | TGTGTCCCCAGCTTGGAGTCA | TTC | chr1 | 55040955 | 55040976 | 55040972 | 55040977 | + |
| SEQ ID NO 46526 | TGTCCCCCAGCTTGGAGTCAGA | CTG | chr1 | 55040957 | 55040978 | 55040974 | 55040979 | + |
| SEQ ID NO 46527 | GGAGTCAGATGTGGGGTTGAAT | CTT | chr1 | 55040970 | 55040991 | 55040987 | 55040992 | + |
| SEQ ID NO 46528 | GAGTCAGATGTGGGGTTGAATC | TTG | chr1 | 55040971 | 55040992 | 55040988 | 55040993 | + |
| SEQ ID NO 46529 | AATCTTGGCTTCCTCTCACTAG | TTG | chr1 | 55040989 | 55041010 | 55041006 | 55041011 | + |
| SEQ ID NO 46530 | GGCTTCCTCTCACTAGCTGTGG | CTT | chr1 | 55040995 | 55041016 | 55041012 | 55041017 | + |
| SEQ ID NO 46531 | GCTTCCTCTCACTAGCTGTGGT | TTG | chr1 | 55040996 | 55041017 | 55041013 | 55041018 | + |
| SEQ ID NO 46532 | CCTCTCACTAGCTGTGGTGCTT | CTT | chr1 | 55041000 | 55041021 | 55041017 | 55041022 | + |
| SEQ ID NO 46533 | CTCTCACTAGCTGTGGTGCTTG | TTC | chr1 | 55041001 | 55041022 | 55041018 | 55041023 | + |
| SEQ ID NO 46534 | TCACTAGCTGTGGTGCTTGACA | CTC | chr1 | 55041004 | 55041025 | 55041021 | 55041026 | + |
| SEQ ID NO 46535 | ACTAGCTGTGGTGCTTGACAAG | CTC | chr1 | 55041006 | 55041027 | 55041023 | 55041028 | + |
| SEQ ID NO 46536 | GCTGTGGTGCTTGACAAGTCAC | CTA | chr1 | 55041010 | 55041031 | 55041027 | 55041032 | + |
| SEQ ID NO 46537 | TGGTGCTTGACAAGTCACTTAT | CTG | chr1 | 55041014 | 55041035 | 55041031 | 55041036 | + |
| SEQ ID NO 46538 | GACAAGTCACTTATCCTTGAGC | CTT | chr1 | 55041022 | 55041043 | 55041039 | 55041044 | + |
| SEQ ID NO 46539 | ACAAGTCACTTATCCTTGAGCC | TTG | chr1 | 55041023 | 55041044 | 55041040 | 55041045 | + |
| SEQ ID NO 46540 | ATCCTTGAGCCTCCATTGCCTA | CTT | chr1 | 55041034 | 55041055 | 55041051 | 55041056 | + |
| SEQ ID NO 46541 | TCCTTGAGCCTCCATTGCCTAA | TTA | chr1 | 55041035 | 55041056 | 55041052 | 55041057 | + |
| SEQ ID NO 46542 | GAGCCTCCATTGCCTAATCTTT | CTT | chr1 | 55041040 | 55041061 | 55041057 | 55041062 | + |
| SEQ ID NO 46543 | AGCCTCCATTGCCTAATCTTTA | TTG | chr1 | 55041041 | 55041062 | 55041058 | 55041063 | + |
| SEQ ID NO 46544 | CATTGCCTAATCTTTAAAAGGG | CTC | chr1 | 55041047 | 55041068 | 55041064 | 55041069 | + |
| SEQ ID NO 46545 | CCTAATCTTTAAAAGGGAGGTG | TTG | chr1 | 55041052 | 55041073 | 55041069 | 55041074 | + |
| SEQ ID NO 46546 | ATCTTTAAAAGGGAGGTGACAA | CTA | chr1 | 55041056 | 55041077 | 55041073 | 55041078 | + |

Figure 66 (Cont'd)

| | | | | | | | | |
|---|---|---|---|---|---|---|---|---|
| SEQ ID NO 46547 | TAAAAGGGAGGTGACAATCGTC | CTT | chr1 | 55041061 | 55041082 | 55041078 | 55041083 | + |
| SEQ ID NO 46548 | AAAAGGGAGGTGACAATCGTCC | TTT | chr1 | 55041062 | 55041083 | 55041079 | 55041084 | + |
| SEQ ID NO 46549 | AAAGGGAGGTGACAATCGTCCC | TTA | chr1 | 55041063 | 55041084 | 55041080 | 55041085 | + |
| SEQ ID NO 46550 | CGGCTCAGTGGCAGCAGATGGG | CTA | chr1 | 55041087 | 55041108 | 55041104 | 55041109 | + |
| SEQ ID NO 46551 | AGTGGCAGCAGATGGGGAGATG | CTC | chr1 | 55041093 | 55041114 | 55041110 | 55041115 | + |
| SEQ ID NO 46552 | TGTTGACCATGAGTGAACTTAC | TTC | chr1 | 55041127 | 55041148 | 55041144 | 55041149 | + |
| SEQ ID NO 46553 | TTGACCATGAGTGAACTTACAA | CTG | chr1 | 55041129 | 55041150 | 55041146 | 55041151 | + |
| SEQ ID NO 46554 | ACCATGAGTGAACTTACAATGC | TTG | chr1 | 55041132 | 55041153 | 55041149 | 55041154 | + |
| SEQ ID NO 46555 | ACAATGCAAGCCCCGGGGGGAT | CTT | chr1 | 55041147 | 55041168 | 55041164 | 55041169 | + |
| SEQ ID NO 46556 | CAATGCAAGCCCCGGGGGATC | TTA | chr1 | 55041148 | 55041169 | 55041165 | 55041170 | + |
| SEQ ID NO 46557 | GCAGTTTTGTCCCTGTCTGCAG | CTT | chr1 | 55041174 | 55041195 | 55041191 | 55041196 | + |
| SEQ ID NO 46558 | CAGTTTTGTCCCTGTCTGCAGT | TTG | chr1 | 55041175 | 55041196 | 55041192 | 55041197 | + |
| SEQ ID NO 46559 | TGTCCCTGTCTGCAGTGTGACC | TTT | chr1 | 55041181 | 55041202 | 55041198 | 55041203 | + |
| SEQ ID NO 46560 | GTCCCTGTCTGCAGTGTGACCT | TTT | chr1 | 55041182 | 55041203 | 55041199 | 55041204 | + |
| SEQ ID NO 46561 | TCCCTGTCTGCAGTGTGACCTG | TTG | chr1 | 55041183 | 55041204 | 55041200 | 55041205 | + |
| SEQ ID NO 46562 | TCTGCAGTGTGACCTGTTGGTG | CTG | chr1 | 55041189 | 55041210 | 55041206 | 55041211 | + |
| SEQ ID NO 46563 | CAGTGTGACCTGTTGGTGACAT | CTG | chr1 | 55041193 | 55041214 | 55041210 | 55041215 | + |
| SEQ ID NO 46564 | TTGGTGACATTGTCTTTGCTCC | CTG | chr1 | 55041205 | 55041226 | 55041222 | 55041227 | + |
| SEQ ID NO 46565 | GTGACATTGTCTTTGCTCCAAA | TTG | chr1 | 55041208 | 55041229 | 55041225 | 55041230 | + |
| SEQ ID NO 46566 | TCTTTGCTCCAAACCACAGCTC | TTG | chr1 | 55041217 | 55041238 | 55041234 | 55041239 | + |
| SEQ ID NO 46567 | TGCTCCAAACCACAGCTCCTGG | CTT | chr1 | 55041221 | 55041242 | 55041238 | 55041243 | + |
| SEQ ID NO 46568 | GCTCCAAACCACAGCTCCTGGG | TTT | chr1 | 55041222 | 55041243 | 55041239 | 55041244 | + |
| SEQ ID NO 46569 | CTCCAAACCACAGCTCCTGGGG | TTG | chr1 | 55041223 | 55041244 | 55041240 | 55041245 | + |
| SEQ ID NO 46570 | CAAACCACAGCTCCTGGGGCAG | CTC | chr1 | 55041226 | 55041247 | 55041243 | 55041248 | + |
| SEQ ID NO 46571 | CTGGGGCAGAGGGGAAAATTCT | CTC | chr1 | 55041239 | 55041260 | 55041256 | 55041261 | + |
| SEQ ID NO 46572 | GGGCAGAGGGGAAAATTCTGCC | CTG | chr1 | 55041242 | 55041263 | 55041259 | 55041264 | + |
| SEQ ID NO 46573 | TGCCACTCACAGCTGCCTGCCC | TTC | chr1 | 55041260 | 55041281 | 55041277 | 55041282 | + |
| SEQ ID NO 46574 | CCACTCACAGCTGCCTGCCCAC | CTG | chr1 | 55041262 | 55041283 | 55041279 | 55041284 | + |
| SEQ ID NO 46575 | ACAGCTGCCTGCCCACGCTTCT | CTC | chr1 | 55041268 | 55041289 | 55041285 | 55041290 | + |
| SEQ ID NO 46576 | CCTGCCCACGCTTCTGTCTGAG | CTG | chr1 | 55041275 | 55041296 | 55041292 | 55041297 | + |
| SEQ ID NO 46577 | CCCACGCTTCTGTCTGAGTGTG | CTG | chr1 | 55041279 | 55041300 | 55041296 | 55041301 | + |
| SEQ ID NO 46578 | CTGTCTGAGTGTGCTGGGTGGC | CTT | chr1 | 55041288 | 55041309 | 55041305 | 55041310 | + |
| SEQ ID NO 46579 | TGTCTGAGTGTGCTGGGTGGCA | TTC | chr1 | 55041289 | 55041310 | 55041306 | 55041311 | + |
| SEQ ID NO 46580 | TCTGAGTGTGCTGGGTGGCAGG | CTG | chr1 | 55041291 | 55041312 | 55041308 | 55041313 | + |
| SEQ ID NO 46581 | AGTGTGCTGGGTGGCAGGATGG | CTG | chr1 | 55041295 | 55041316 | 55041312 | 55041317 | + |
| SEQ ID NO 46582 | GGTGGCAGGATGGCAAGTCCTT | CTG | chr1 | 55041304 | 55041325 | 55041321 | 55041326 | + |
| SEQ ID NO 46583 | ACTCAGCTCAGTATAGCCCTCT | CTT | chr1 | 55041326 | 55041347 | 55041343 | 55041348 | + |
| SEQ ID NO 46584 | CTCAGCTCAGTATAGCCCTCTT | TTA | chr1 | 55041327 | 55041348 | 55041344 | 55041349 | + |
| SEQ ID NO 46585 | AGCTCAGTATAGCCCTCTTCCT | CTC | chr1 | 55041330 | 55041351 | 55041347 | 55041352 | + |
| SEQ ID NO 46586 | AGTATAGCCCTCTTCCTTGTTC | CTC | chr1 | 55041335 | 55041356 | 55041352 | 55041357 | + |
| SEQ ID NO 46587 | TTCCTTGTTCCCTGAGCCTTTG | CTC | chr1 | 55041347 | 55041368 | 55041364 | 55041369 | + |
| SEQ ID NO 46588 | CCTTGTTCCCTGAGCCTTTGAC | CTT | chr1 | 55041349 | 55041370 | 55041366 | 55041371 | + |
| SEQ ID NO 46589 | CTTGTTCCCTGAGCCTTTGACT | TTC | chr1 | 55041350 | 55041371 | 55041367 | 55041372 | + |
| SEQ ID NO 46590 | GTTCCCTGAGCCTTTGACTTTC | CTT | chr1 | 55041353 | 55041374 | 55041370 | 55041375 | + |
| SEQ ID NO 46591 | TTCCCTGAGCCTTTGACTTTCT | TTG | chr1 | 55041354 | 55041375 | 55041371 | 55041376 | + |
| SEQ ID NO 46592 | CCTGAGCCTTTGACTTTCTCGA | TTC | chr1 | 55041357 | 55041378 | 55041374 | 55041379 | + |
| SEQ ID NO 46593 | AGCCTTTGACTTTCTCGAGGGA | CTG | chr1 | 55041361 | 55041382 | 55041378 | 55041383 | + |
| SEQ ID NO 46594 | TGACTTTCTCGAGGGATGTTGT | CTT | chr1 | 55041367 | 55041388 | 55041384 | 55041389 | + |
| SEQ ID NO 46595 | GACTTTCTCGAGGGATGTTGTG | TTT | chr1 | 55041368 | 55041389 | 55041385 | 55041390 | + |
| SEQ ID NO 46596 | ACTTTCTCGAGGGATGTTGTGG | TTG | chr1 | 55041369 | 55041390 | 55041386 | 55041391 | + |
| SEQ ID NO 46597 | TCTCGAGGGATGTTGTGGGGTT | CTT | chr1 | 55041373 | 55041394 | 55041390 | 55041395 | + |
| SEQ ID NO 46598 | CTCGAGGGATGTTGTGGGGTTG | TTT | chr1 | 55041374 | 55041395 | 55041391 | 55041396 | + |
| SEQ ID NO 46599 | TCGAGGGATGTTGTGGGGTTGT | TTC | chr1 | 55041375 | 55041396 | 55041392 | 55041397 | + |
| SEQ ID NO 46600 | GAGGGATGTTGTGGGGTTGTGG | CTC | chr1 | 55041377 | 55041398 | 55041394 | 55041399 | + |
| SEQ ID NO 46601 | TGGGGTTGTGGCCAGGATAAGA | TTG | chr1 | 55041388 | 55041409 | 55041405 | 55041410 | + |
| SEQ ID NO 46602 | TGGCCAGGATAAGAAAGGGCAT | TTG | chr1 | 55041396 | 55041417 | 55041413 | 55041418 | + |
| SEQ ID NO 46603 | CAAGTTACCACTGCTCCAAAAC | TTT | chr1 | 55041420 | 55041441 | 55041437 | 55041442 | + |
| SEQ ID NO 46604 | AAGTTACCACTGCTCCAAAACA | TTC | chr1 | 55041421 | 55041442 | 55041438 | 55041443 | + |

Figure 66 (Cont'd)

| | | | | | | | | |
|---|---|---|---|---|---|---|---|---|
| SEQ ID NO 46605 | CCACTGCTCCAAAACAACTGTT | TTA | chr1 | 55041427 | 55041448 | 55041444 | 55041449 | + |
| SEQ ID NO 46606 | CTCCAAAACAACTGTTCTGGAA | CTG | chr1 | 55041433 | 55041454 | 55041450 | 55041455 | + |
| SEQ ID NO 46607 | CAAAACAACTGTTCTGGAAATA | CTC | chr1 | 55041436 | 55041457 | 55041453 | 55041458 | + |
| SEQ ID NO 46608 | TTCTGGAAATAGTGAGTACCCC | CTG | chr1 | 55041447 | 55041468 | 55041464 | 55041469 | + |
| SEQ ID NO 46609 | TGGAAATAGTGAGTACCCCATC | TTC | chr1 | 55041450 | 55041471 | 55041467 | 55041472 | + |
| SEQ ID NO 46610 | GAAATAGTGAGTACCCCATCCT | CTG | chr1 | 55041452 | 55041473 | 55041469 | 55041474 | + |
| SEQ ID NO 46611 | AGAGGTGAGTAAGCAGAGGCTG | CTG | chr1 | 55041475 | 55041496 | 55041492 | 55041497 | + |
| SEQ ID NO 46612 | TATGACCACCTGAACCAAGCCC | CTG | chr1 | 55041497 | 55041518 | 55041514 | 55041519 | + |
| SEQ ID NO 46613 | AACCAAGCCCTTGAGGATGTTT | CTG | chr1 | 55041509 | 55041530 | 55041526 | 55041531 | + |
| SEQ ID NO 46614 | GAGGATGTTTCTTCTCTGGTGG | CTT | chr1 | 55041521 | 55041542 | 55041538 | 55041543 | + |
| SEQ ID NO 46615 | AGGATGTTTCTTCTCTGGTGGA | TTG | chr1 | 55041522 | 55041543 | 55041539 | 55041544 | + |
| SEQ ID NO 46616 | CTTCTCTGGTGGAAGTTTGGAA | TTT | chr1 | 55041531 | 55041552 | 55041548 | 55041553 | + |
| SEQ ID NO 46617 | TTCTCTGGTGGAAGTTTGGAAC | TTC | chr1 | 55041532 | 55041553 | 55041549 | 55041554 | + |
| SEQ ID NO 46618 | CTCTGGTGGAAGTTTGGAACAG | CTT | chr1 | 55041534 | 55041555 | 55041551 | 55041556 | + |
| SEQ ID NO 46619 | TCTGGTGGAAGTTTGGAACAGG | TTC | chr1 | 55041535 | 55041556 | 55041552 | 55041557 | + |
| SEQ ID NO 46620 | TGGTGGAAGTTTGGAACAGGAG | CTC | chr1 | 55041537 | 55041558 | 55041554 | 55041559 | + |
| SEQ ID NO 46621 | GTGGAAGTTTGGAACAGGAGCC | CTG | chr1 | 55041539 | 55041560 | 55041556 | 55041561 | + |
| SEQ ID NO 46622 | GGAACAGGAGCCTCCTCAAGTT | TTT | chr1 | 55041549 | 55041570 | 55041566 | 55041571 | + |
| SEQ ID NO 46623 | GAACAGGAGCCTCCTCAAGTTC | TTG | chr1 | 55041550 | 55041571 | 55041567 | 55041572 | + |
| SEQ ID NO 46624 | CTCAAGTTCATTTATTCATTCA | CTC | chr1 | 55041563 | 55041584 | 55041580 | 55041585 | + |
| SEQ ID NO 46625 | AAGTTCATTTATTCATTCATTC | CTC | chr1 | 55041566 | 55041587 | 55041583 | 55041588 | + |
| SEQ ID NO 46626 | ATTTATTCATTCATTCAATGGT | TTC | chr1 | 55041572 | 55041593 | 55041589 | 55041594 | + |
| SEQ ID NO 46627 | ATTCATTCATTCAATGGTTATT | TTT | chr1 | 55041576 | 55041597 | 55041593 | 55041598 | + |
| SEQ ID NO 46628 | TTCATTCATTCAATGGTTATTT | TTA | chr1 | 55041577 | 55041598 | 55041594 | 55041599 | + |
| SEQ ID NO 46629 | ATTCATTCAATGGTTATTTTGT | TTC | chr1 | 55041580 | 55041601 | 55041597 | 55041602 | + |
| SEQ ID NO 46630 | ATTCAATGGTTATTTTGTGGGA | TTC | chr1 | 55041584 | 55041605 | 55041601 | 55041606 | + |
| SEQ ID NO 46631 | AATGGTTATTTTGTGGGAATCG | TTC | chr1 | 55041588 | 55041609 | 55041605 | 55041610 | + |
| SEQ ID NO 46632 | TTTTGTGGGAATCGAATTTAGA | TTA | chr1 | 55041596 | 55041617 | 55041613 | 55041618 | + |
| SEQ ID NO 46633 | TGTGGGAATCGAATTTAGAATG | TTT | chr1 | 55041599 | 55041620 | 55041616 | 55041621 | + |
| SEQ ID NO 46634 | GTGGGAATCGAATTTAGAATGA | TTT | chr1 | 55041600 | 55041621 | 55041617 | 55041622 | + |
| SEQ ID NO 46635 | TGGGAATCGAATTTAGAATGAA | TTG | chr1 | 55041601 | 55041622 | 55041618 | 55041623 | + |
| SEQ ID NO 46636 | AGAATGAAAATATTTTTTGGCA | TTT | chr1 | 55041615 | 55041636 | 55041632 | 55041637 | + |
| SEQ ID NO 46637 | GAATGAAAATATTTTTTGGCAA | TTA | chr1 | 55041616 | 55041637 | 55041633 | 55041638 | + |
| SEQ ID NO 46638 | TTTGGCAAGCAGAAAATAATTT | TTT | chr1 | 55041630 | 55041651 | 55041647 | 55041652 | + |
| SEQ ID NO 46639 | TTGGCAAGCAGAAAATAATTTT | TTT | chr1 | 55041631 | 55041652 | 55041648 | 55041653 | + |
| SEQ ID NO 46640 | TGGCAAGCAGAAAATAATTTTT | TTT | chr1 | 55041632 | 55041653 | 55041649 | 55041654 | + |
| SEQ ID NO 46641 | GGCAAGCAGAAAATAATTTTTA | TTT | chr1 | 55041633 | 55041654 | 55041650 | 55041655 | + |
| SEQ ID NO 46642 | GCAAGCAGAAAATAATTTTTAG | TTG | chr1 | 55041634 | 55041655 | 55041651 | 55041656 | + |
| SEQ ID NO 46643 | TTAGACCAATCCTTTTCTTTTA | TTT | chr1 | 55041652 | 55041673 | 55041669 | 55041674 | + |
| SEQ ID NO 46644 | TAGACCAATCCTTTTCTTTTAG | TTT | chr1 | 55041653 | 55041674 | 55041670 | 55041675 | + |
| SEQ ID NO 46645 | AGACCAATCCTTTTCTTTTAGT | TTT | chr1 | 55041654 | 55041675 | 55041671 | 55041676 | + |
| SEQ ID NO 46646 | GACCAATCCTTTTCTTTTAGTC | TTA | chr1 | 55041655 | 55041676 | 55041672 | 55041677 | + |
| SEQ ID NO 46647 | TTCTTTTAGTCATGAGAAACTG | CTT | chr1 | 55041666 | 55041687 | 55041683 | 55041688 | + |
| SEQ ID NO 46648 | TCTTTTAGTCATGAGAAACTGA | TTT | chr1 | 55041667 | 55041688 | 55041684 | 55041689 | + |
| SEQ ID NO 46649 | CTTTTAGTCATGAGAAACTGAG | TTT | chr1 | 55041668 | 55041689 | 55041685 | 55041690 | + |
| SEQ ID NO 46650 | TTTTAGTCATGAGAAACTGAGG | TTC | chr1 | 55041669 | 55041690 | 55041686 | 55041691 | + |
| SEQ ID NO 46651 | TTAGTCATGAGAAACTGAGGCC | CTT | chr1 | 55041671 | 55041692 | 55041688 | 55041693 | + |
| SEQ ID NO 46652 | TAGTCATGAGAAACTGAGGCCC | TTT | chr1 | 55041672 | 55041693 | 55041689 | 55041694 | + |
| SEQ ID NO 46653 | AGTCATGAGAAACTGAGGCCCA | TTT | chr1 | 55041673 | 55041694 | 55041690 | 55041695 | + |
| SEQ ID NO 46654 | GTCATGAGAAACTGAGGCCCAG | TTA | chr1 | 55041674 | 55041695 | 55041691 | 55041696 | + |
| SEQ ID NO 46655 | AGGCCCAGAGAGAGGAGGTCAC | CTG | chr1 | 55041688 | 55041709 | 55041705 | 55041710 | + |
| SEQ ID NO 46656 | GAACTGGGTTTCCAGAACTGAC | TTA | chr1 | 55041723 | 55041744 | 55041740 | 55041745 | + |
| SEQ ID NO 46657 | GGTTTCCAGAACTGACACTCCA | CTG | chr1 | 55041729 | 55041750 | 55041746 | 55041751 | + |
| SEQ ID NO 46658 | CCAGAACTGACACTCCACTGCA | TTT | chr1 | 55041734 | 55041755 | 55041751 | 55041756 | + |
| SEQ ID NO 46659 | CAGAACTGACACTCCACTGCAC | TTC | chr1 | 55041735 | 55041756 | 55041752 | 55041757 | + |
| SEQ ID NO 46660 | ACACTCCACTGCACAGAGTACT | CTG | chr1 | 55041743 | 55041764 | 55041760 | 55041765 | + |
| SEQ ID NO 46661 | CACTGCACAGAGTACTCTCCCA | CTC | chr1 | 55041749 | 55041770 | 55041766 | 55041771 | + |
| SEQ ID NO 46662 | CACAGAGTACTCTCCCAATTCA | CTG | chr1 | 55041754 | 55041775 | 55041771 | 55041776 | + |

Figure 66 (Cont'd)

| | | | | | | | | |
|---|---|---|---|---|---|---|---|---|
| SEQ ID NO 46663 | TCCCAATTCATTCAATTTTTAT | CTC | chr1 | 55041766 | 55041787 | 55041783 | 55041788 | + |
| SEQ ID NO 46664 | CCAATTCATTCAATTTTTATTT | CTC | chr1 | 55041768 | 55041789 | 55041785 | 55041790 | + |
| SEQ ID NO 46665 | ATTCAATTTTTATTTAGCGGAA | TTC | chr1 | 55041775 | 55041796 | 55041792 | 55041797 | + |
| SEQ ID NO 46666 | AATTTTTATTTAGCGGAAGGCA | TTC | chr1 | 55041779 | 55041800 | 55041796 | 55041801 | + |
| SEQ ID NO 46667 | TTATTTAGCGGAAGGCATTTTC | TTT | chr1 | 55041784 | 55041805 | 55041801 | 55041806 | + |
| SEQ ID NO 46668 | TATTTAGCGGAAGGCATTTTCA | TTT | chr1 | 55041785 | 55041806 | 55041802 | 55041807 | + |
| SEQ ID NO 46669 | ATTTAGCGGAAGGCATTTTCAG | TTT | chr1 | 55041786 | 55041807 | 55041803 | 55041808 | + |
| SEQ ID NO 46670 | TTTAGCGGAAGGCATTTTCAGA | TTA | chr1 | 55041787 | 55041808 | 55041804 | 55041809 | + |
| SEQ ID NO 46671 | AGCGGAAGGCATTTTCAGATGG | TTT | chr1 | 55041790 | 55041811 | 55041807 | 55041812 | + |
| SEQ ID NO 46672 | GCGGAAGGCATTTTCAGATGGG | TTA | chr1 | 55041791 | 55041812 | 55041808 | 55041813 | + |
| SEQ ID NO 46673 | TCAGATGGGTCTTTGAAGCATT | TTT | chr1 | 55041804 | 55041825 | 55041821 | 55041826 | + |
| SEQ ID NO 46674 | CAGATGGGTCTTTGAAGCATTA | TTT | chr1 | 55041805 | 55041826 | 55041822 | 55041827 | + |
| SEQ ID NO 46675 | AGATGGGTCTTTGAAGCATTAG | TTC | chr1 | 55041806 | 55041827 | 55041823 | 55041828 | + |
| SEQ ID NO 46676 | TGAAGCATTAGTAGGAGTTCAG | CTT | chr1 | 55041817 | 55041838 | 55041834 | 55041839 | + |
| SEQ ID NO 46677 | GAAGCATTAGTAGGAGTTCAGC | TTT | chr1 | 55041818 | 55041839 | 55041835 | 55041840 | + |
| SEQ ID NO 46678 | AAGCATTAGTAGGAGTTCAGCG | TTG | chr1 | 55041819 | 55041840 | 55041836 | 55041841 | + |
| SEQ ID NO 46679 | GTAGGAGTTCAGCGATGATGGT | TTA | chr1 | 55041827 | 55041848 | 55041844 | 55041849 | + |
| SEQ ID NO 46680 | AGCGATGATGGTGTCATGAGAA | TTC | chr1 | 55041837 | 55041858 | 55041854 | 55041859 | + |
| SEQ ID NO 46681 | TATTCTAGGATTAGGAGGTACC | TTT | chr1 | 55041862 | 55041883 | 55041879 | 55041884 | + |
| SEQ ID NO 46682 | ATTCTAGGATTAGGAGGTACCA | TTT | chr1 | 55041863 | 55041884 | 55041880 | 55041885 | + |
| SEQ ID NO 46683 | TTCTAGGATTAGGAGGTACCAT | TTA | chr1 | 55041864 | 55041885 | 55041881 | 55041886 | + |
| SEQ ID NO 46684 | TAGGATTAGGAGGTACCATGAA | TTC | chr1 | 55041867 | 55041888 | 55041884 | 55041889 | + |
| SEQ ID NO 46685 | GGATTAGGAGGTACCATGAACA | CTA | chr1 | 55041869 | 55041890 | 55041886 | 55041891 | + |
| SEQ ID NO 46686 | GGAGGTACCATGAACAAAGATA | TTA | chr1 | 55041875 | 55041896 | 55041892 | 55041897 | + |
| SEQ ID NO 46687 | GGAAAACCAGAGGTGGAAGATA | CTG | chr1 | 55041905 | 55041926 | 55041922 | 55041927 | + |
| SEQ ID NO 46688 | TTTTTCTTTTTTTTTGAGATG | TTC | chr1 | 55041948 | 55041969 | 55041965 | 55041970 | + |
| SEQ ID NO 46689 | TTTCTTTTTTTTTGAGATGGA | CTT | chr1 | 55041950 | 55041971 | 55041967 | 55041972 | + |
| SEQ ID NO 46690 | TTCTTTTTTTTTGAGATGGAG | TTT | chr1 | 55041951 | 55041972 | 55041968 | 55041973 | + |
| SEQ ID NO 46691 | TCTTTTTTTTTGAGATGGAGT | TTT | chr1 | 55041952 | 55041973 | 55041969 | 55041974 | + |
| SEQ ID NO 46692 | CTTTTTTTTTGAGATGGAGTT | TTT | chr1 | 55041953 | 55041974 | 55041970 | 55041975 | + |
| SEQ ID NO 46693 | TTTTTTTTTGAGATGGAGTTT | TTC | chr1 | 55041954 | 55041975 | 55041971 | 55041976 | + |
| SEQ ID NO 46694 | TTTTTTTTGAGATGGAGTTTCG | CTT | chr1 | 55041956 | 55041977 | 55041973 | 55041978 | + |
| SEQ ID NO 46695 | TTTTTTTGAGATGGAGTTTCGC | TTT | chr1 | 55041957 | 55041978 | 55041974 | 55041979 | + |
| SEQ ID NO 46696 | TTTTTTGAGATGGAGTTTCGCT | TTT | chr1 | 55041958 | 55041979 | 55041975 | 55041980 | + |
| SEQ ID NO 46697 | TTTTTGAGATGGAGTTTCGCTC | TTT | chr1 | 55041959 | 55041980 | 55041976 | 55041981 | + |
| SEQ ID NO 46698 | TTTTGAGATGGAGTTTCGCTCT | TTT | chr1 | 55041960 | 55041981 | 55041977 | 55041982 | + |
| SEQ ID NO 46699 | TTTGAGATGGAGTTTCGCTCTT | TTT | chr1 | 55041961 | 55041982 | 55041978 | 55041983 | + |
| SEQ ID NO 46700 | TTGAGATGGAGTTTCGCTCTTG | TTT | chr1 | 55041962 | 55041983 | 55041979 | 55041984 | + |
| SEQ ID NO 46701 | TGAGATGGAGTTTCGCTCTTGT | TTT | chr1 | 55041963 | 55041984 | 55041980 | 55041985 | + |
| SEQ ID NO 46702 | GAGATGGAGTTTCGCTCTTGTT | TTT | chr1 | 55041964 | 55041985 | 55041981 | 55041986 | + |
| SEQ ID NO 46703 | AGATGGAGTTTCGCTCTTGTTG | TTG | chr1 | 55041965 | 55041986 | 55041982 | 55041987 | + |
| SEQ ID NO 46704 | CGCTCTTGTTGCCCAGGCTGGA | TTT | chr1 | 55041976 | 55041997 | 55041993 | 55041998 | + |
| SEQ ID NO 46705 | GCTCTTGTTGCCCAGGCTGGAG | TTC | chr1 | 55041977 | 55041998 | 55041994 | 55041999 | + |
| SEQ ID NO 46706 | TTGTTGCCCAGGCTGGAGTGCA | CTC | chr1 | 55041981 | 55042002 | 55041998 | 55042003 | + |
| SEQ ID NO 46707 | GTTGCCCAGGCTGGAGTGCAAT | CTT | chr1 | 55041983 | 55042004 | 55042000 | 55042005 | + |
| SEQ ID NO 46708 | TTGCCCAGGCTGGAGTGCAATG | TTG | chr1 | 55041984 | 55042005 | 55042001 | 55042006 | + |
| SEQ ID NO 46709 | CCCAGGCTGGAGTGCAATGGTG | TTG | chr1 | 55041987 | 55042008 | 55042004 | 55042009 | + |
| SEQ ID NO 46710 | GAGTGCAATGGTGCAGTCTCAG | CTG | chr1 | 55041996 | 55042017 | 55042013 | 55042018 | + |
| SEQ ID NO 46711 | AGCTCACTGCAACATCTGTCTC | CTC | chr1 | 55042016 | 55042037 | 55042033 | 55042038 | + |
| SEQ ID NO 46712 | ACTGCAACATCTGTCTCCCGGG | CTC | chr1 | 55042021 | 55042042 | 55042038 | 55042043 | + |
| SEQ ID NO 46713 | CAACATCTGTCTCCCGGGTTCA | CTG | chr1 | 55042025 | 55042046 | 55042042 | 55042047 | + |
| SEQ ID NO 46714 | TCTCCCGGGTTCAAGTGGTTCT | CTG | chr1 | 55042034 | 55042055 | 55042051 | 55042056 | + |
| SEQ ID NO 46715 | CCGGGTTCAAGTGGTTCTCCTG | CTC | chr1 | 55042038 | 55042059 | 55042055 | 55042060 | + |
| SEQ ID NO 46716 | AAGTGGTTCTCCTGCCTCAGCC | TTC | chr1 | 55042046 | 55042067 | 55042063 | 55042068 | + |
| SEQ ID NO 46717 | TCCTGCCTCAGCCTCCCAAGAA | TTC | chr1 | 55042055 | 55042076 | 55042072 | 55042077 | + |
| SEQ ID NO 46718 | CTGCCTCAGCCTCCCAAGAAGC | CTC | chr1 | 55042057 | 55042078 | 55042074 | 55042079 | + |
| SEQ ID NO 46719 | CCTCAGCCTCCCAAGAAGCTGG | CTG | chr1 | 55042060 | 55042081 | 55042077 | 55042082 | + |
| SEQ ID NO 46720 | AGCCTCCCAAGAAGCTGGGATT | CTC | chr1 | 55042064 | 55042085 | 55042081 | 55042086 | + |

Figure 66 (Cont'd)

| | | | | | | | | |
|---|---|---|---|---|---|---|---|---|
| SEQ ID NO 46721 | CCAAGAAGCTGGGATTACAGGT | CTC | chr1 | 55042070 | 55042091 | 55042087 | 55042092 | + |
| SEQ ID NO 46722 | GGATTACAGGTACCTGCCACCA | CTG | chr1 | 55042081 | 55042102 | 55042098 | 55042103 | + |
| SEQ ID NO 46723 | CAGGTACCTGCCACCACGCCCG | TTA | chr1 | 55042087 | 55042108 | 55042104 | 55042109 | + |
| SEQ ID NO 46724 | CCACCACGCCCGGCTAATTTTT | CTG | chr1 | 55042097 | 55042118 | 55042114 | 55042119 | + |
| SEQ ID NO 46725 | ATTTTTGTATTTTTAGTAGAGA | CTA | chr1 | 55042113 | 55042134 | 55042130 | 55042135 | + |
| SEQ ID NO 46726 | TTGTATTTTTAGTAGAGAAGGG | TTT | chr1 | 55042117 | 55042138 | 55042134 | 55042139 | + |
| SEQ ID NO 46727 | TGTATTTTTAGTAGAGAAGGGG | TTT | chr1 | 55042118 | 55042139 | 55042135 | 55042140 | + |
| SEQ ID NO 46728 | GTATTTTTAGTAGAGAAGGGGT | TTT | chr1 | 55042119 | 55042140 | 55042136 | 55042141 | + |
| SEQ ID NO 46729 | TATTTTTAGTAGAGAAGGGGTT | TTG | chr1 | 55042120 | 55042141 | 55042137 | 55042142 | + |
| SEQ ID NO 46730 | TTAGTAGAGAAGGGGTTTCACC | TTT | chr1 | 55042125 | 55042146 | 55042142 | 55042147 | + |
| SEQ ID NO 46731 | TAGTAGAGAAGGGGTTTCACCA | TTT | chr1 | 55042126 | 55042147 | 55042143 | 55042148 | + |
| SEQ ID NO 46732 | AGTAGAGAAGGGGTTTCACCAC | TTT | chr1 | 55042127 | 55042148 | 55042144 | 55042149 | + |
| SEQ ID NO 46733 | GTAGAGAAGGGGTTTCACCACG | TTA | chr1 | 55042128 | 55042149 | 55042145 | 55042150 | + |
| SEQ ID NO 46734 | CACCACGTTGGCCAGGCTAGTC | TTT | chr1 | 55042143 | 55042164 | 55042160 | 55042165 | + |
| SEQ ID NO 46735 | ACCACGTTGGCCAGGCTAGTCG | TTC | chr1 | 55042144 | 55042165 | 55042161 | 55042166 | + |
| SEQ ID NO 46736 | GCCAGGCTAGTCGCAAACTCCT | TTG | chr1 | 55042153 | 55042174 | 55042170 | 55042175 | + |
| SEQ ID NO 46737 | GTCGCAAACTCCTGACCTCCTC | CTA | chr1 | 55042162 | 55042183 | 55042179 | 55042184 | + |
| SEQ ID NO 46738 | CTGACCTCCTCAGTGGATCCGA | CTC | chr1 | 55042173 | 55042194 | 55042190 | 55042195 | + |
| SEQ ID NO 46739 | ACCTCCTCAGTGGATCCGAGGA | CTG | chr1 | 55042176 | 55042197 | 55042193 | 55042198 | + |
| SEQ ID NO 46740 | CTCAGTGGATCCGAGGAGGTGA | CTC | chr1 | 55042181 | 55042202 | 55042198 | 55042203 | + |
| SEQ ID NO 46741 | AGTGGATCCGAGGAGGTGATCC | CTC | chr1 | 55042184 | 55042205 | 55042201 | 55042206 | + |
| SEQ ID NO 46742 | CCGCCTCAGCCTCCCAAAGTGC | CTC | chr1 | 55042208 | 55042229 | 55042225 | 55042230 | + |
| SEQ ID NO 46743 | AGCCTCCCAAAGTGCTCGAATT | CTC | chr1 | 55042215 | 55042236 | 55042232 | 55042237 | + |
| SEQ ID NO 46744 | CCAAAGTGCTCGAATTACAGGT | CTC | chr1 | 55042221 | 55042242 | 55042238 | 55042243 | + |
| SEQ ID NO 46745 | GAATTACAGGTGTGAGCCACCA | CTC | chr1 | 55042232 | 55042253 | 55042249 | 55042254 | + |
| SEQ ID NO 46746 | CAGGTGTGAGCCACCACGCCTG | TTA | chr1 | 55042238 | 55042259 | 55042255 | 55042260 | + |
| SEQ ID NO 46747 | GCCTCCACAGTTCTTTATCCAC | CTG | chr1 | 55042260 | 55042281 | 55042277 | 55042282 | + |
| SEQ ID NO 46748 | CACAGTTCTTTATCCACCGTCT | CTC | chr1 | 55042265 | 55042286 | 55042282 | 55042287 | + |
| SEQ ID NO 46749 | TTTATCCACCGTCTGAAATGTA | TTC | chr1 | 55042273 | 55042294 | 55042290 | 55042295 | + |
| SEQ ID NO 46750 | TATCCACCGTCTGAAATGTAAA | CTT | chr1 | 55042275 | 55042296 | 55042292 | 55042297 | + |
| SEQ ID NO 46751 | ATCCACCGTCTGAAATGTAAAA | TTT | chr1 | 55042276 | 55042297 | 55042293 | 55042298 | + |
| SEQ ID NO 46752 | TCCACCGTCTGAAATGTAAAAT | TTA | chr1 | 55042277 | 55042298 | 55042294 | 55042299 | + |
| SEQ ID NO 46753 | AAATGTAAAATGTTACGAAAAC | CTG | chr1 | 55042288 | 55042309 | 55042305 | 55042310 | + |
| SEQ ID NO 46754 | CGAAAACCAAAAGTTTTTTTTG | TTA | chr1 | 55042303 | 55042324 | 55042320 | 55042325 | + |
| SEQ ID NO 46755 | TTTTTGTGATTTATTTGATGGT | TTT | chr1 | 55042319 | 55042340 | 55042336 | 55042341 | + |
| SEQ ID NO 46756 | TTTTGTGATTTATTTGATGGTA | TTT | chr1 | 55042320 | 55042341 | 55042337 | 55042342 | + |
| SEQ ID NO 46757 | TTTGTGATTTATTTGATGGTAG | TTT | chr1 | 55042321 | 55042342 | 55042338 | 55042343 | + |
| SEQ ID NO 46758 | TTGTGATTTATTTGATGGTAGC | TTT | chr1 | 55042322 | 55042343 | 55042339 | 55042344 | + |
| SEQ ID NO 46759 | TGTGATTTATTTGATGGTAGCA | TTT | chr1 | 55042323 | 55042344 | 55042340 | 55042345 | + |
| SEQ ID NO 46760 | GTGATTTATTTGATGGTAGCAC | TTT | chr1 | 55042324 | 55042345 | 55042341 | 55042346 | + |
| SEQ ID NO 46761 | TGATTTATTTGATGGTAGCACC | TTG | chr1 | 55042325 | 55042346 | 55042342 | 55042347 | + |
| SEQ ID NO 46762 | ATTTGATGGTAGCACCTGACGT | TTT | chr1 | 55042331 | 55042352 | 55042348 | 55042353 | + |
| SEQ ID NO 46763 | TTTGATGGTAGCACCTGACGTG | TTA | chr1 | 55042332 | 55042353 | 55042349 | 55042354 | + |
| SEQ ID NO 46764 | GATGGTAGCACCTGACGTGAAC | TTT | chr1 | 55042335 | 55042356 | 55042352 | 55042357 | + |
| SEQ ID NO 46765 | ATGGTAGCACCTGACGTGAACT | TTG | chr1 | 55042336 | 55042357 | 55042353 | 55042358 | + |
| SEQ ID NO 46766 | ACGTGAACTGACATGAGATTAT | CTG | chr1 | 55042349 | 55042370 | 55042366 | 55042371 | + |
| SEQ ID NO 46767 | ACATGAGATTATTTTAATTTA | CTG | chr1 | 55042359 | 55042380 | 55042376 | 55042381 | + |
| SEQ ID NO 46768 | TTTTTAATTTAGTTGTGTGAAT | TTA | chr1 | 55042370 | 55042391 | 55042387 | 55042392 | + |
| SEQ ID NO 46769 | TTAATTTAGTTGTGTGAATATG | TTT | chr1 | 55042373 | 55042394 | 55042390 | 55042395 | + |
| SEQ ID NO 46770 | TAATTTAGTTGTGTGAATATGC | TTT | chr1 | 55042374 | 55042395 | 55042391 | 55042396 | + |
| SEQ ID NO 46771 | AATTTAGTTGTGTGAATATGCA | TTT | chr1 | 55042375 | 55042396 | 55042392 | 55042397 | + |
| SEQ ID NO 46772 | ATTTAGTTGTGTGAATATGCAT | TTA | chr1 | 55042376 | 55042397 | 55042393 | 55042398 | + |
| SEQ ID NO 46773 | AGTTGTGTGAATATGCATATTC | TTT | chr1 | 55042380 | 55042401 | 55042397 | 55042402 | + |
| SEQ ID NO 46774 | GTTGTGTGAATATGCATATTCA | TTA | chr1 | 55042381 | 55042402 | 55042398 | 55042403 | + |
| SEQ ID NO 46775 | TGTGAATATGCATATTCATATA | TTG | chr1 | 55042385 | 55042406 | 55042402 | 55042407 | + |
| SEQ ID NO 46776 | ATATATTTTGCTGCATAGATTA | TTC | chr1 | 55042402 | 55042423 | 55042419 | 55042424 | + |
| SEQ ID NO 46777 | TGCTGCATAGATTACAGTATGC | TTT | chr1 | 55042410 | 55042431 | 55042427 | 55042432 | + |
| SEQ ID NO 46778 | GCTGCATAGATTACAGTATGCA | TTT | chr1 | 55042411 | 55042432 | 55042428 | 55042433 | + |

Figure 66 (Cont'd)

| | | | | | | | | |
|---|---|---|---|---|---|---|---|---|
| SEQ ID NO 46779 | CTGCATAGATTACAGTATGCAG | TTG | chr1 | 55042412 | 55042433 | 55042429 | 55042434 | + |
| SEQ ID NO 46780 | CATAGATTACAGTATGCAGCTC | CTG | chr1 | 55042415 | 55042436 | 55042432 | 55042437 | + |
| SEQ ID NO 46781 | CAGTATGCAGCTCCAGATTCTT | TTA | chr1 | 55042424 | 55042445 | 55042441 | 55042446 | + |
| SEQ ID NO 46782 | CAGATTCTTCCAAGCAGACTCT | CTC | chr1 | 55042437 | 55042458 | 55042454 | 55042459 | + |
| SEQ ID NO 46783 | TTCCAAGCAGACTCTGATTGCC | TTC | chr1 | 55042444 | 55042465 | 55042461 | 55042466 | + |
| SEQ ID NO 46784 | CCAAGCAGACTCTGATTGCCCA | CTT | chr1 | 55042446 | 55042467 | 55042463 | 55042468 | + |
| SEQ ID NO 46785 | CAAGCAGACTCTGATTGCCCAT | TTC | chr1 | 55042447 | 55042468 | 55042464 | 55042469 | + |
| SEQ ID NO 46786 | TGATTGCCCATTACTGCCTTTC | CTC | chr1 | 55042458 | 55042479 | 55042475 | 55042480 | + |
| SEQ ID NO 46787 | ATTGCCCATTACTGCCTTTCTA | CTG | chr1 | 55042460 | 55042481 | 55042477 | 55042482 | + |
| SEQ ID NO 46788 | CCCATTACTGCCTTTCTAAAAT | TTG | chr1 | 55042464 | 55042485 | 55042481 | 55042486 | + |
| SEQ ID NO 46789 | CTGCCTTTCTAAAATCCAAACA | TTA | chr1 | 55042471 | 55042492 | 55042488 | 55042493 | + |
| SEQ ID NO 46790 | CCTTTCTAAAATCCAAACAAGT | CTG | chr1 | 55042474 | 55042495 | 55042491 | 55042496 | + |
| SEQ ID NO 46791 | TCTAAAATCCAAACAAGTTCTG | CTT | chr1 | 55042478 | 55042499 | 55042495 | 55042500 | + |
| SEQ ID NO 46792 | CTAAAATCCAAACAAGTTCTGA | TTT | chr1 | 55042479 | 55042500 | 55042496 | 55042501 | + |
| SEQ ID NO 46793 | TAAAATCCAAACAAGTTCTGAG | TTC | chr1 | 55042480 | 55042501 | 55042497 | 55042502 | + |
| SEQ ID NO 46794 | AAATCCAAACAAGTTCTGAGGT | CTA | chr1 | 55042482 | 55042503 | 55042499 | 55042504 | + |
| SEQ ID NO 46795 | TGAGGTTCAAAACCGTTTTGGC | TTC | chr1 | 55042498 | 55042519 | 55042515 | 55042520 | + |
| SEQ ID NO 46796 | AGGTTCAAAACCGTTTTGGCCC | CTG | chr1 | 55042500 | 55042521 | 55042517 | 55042522 | + |
| SEQ ID NO 46797 | AAAACCGTTTTGGCCCTAAGGC | TTC | chr1 | 55042506 | 55042527 | 55042523 | 55042528 | + |
| SEQ ID NO 46798 | TGGCCCTAAGGCTTTGGGTAAA | TTT | chr1 | 55042516 | 55042537 | 55042533 | 55042538 | + |
| SEQ ID NO 46799 | GGCCCTAAGGCTTTGGGTAAAG | TTT | chr1 | 55042517 | 55042538 | 55042534 | 55042539 | + |
| SEQ ID NO 46800 | GCCCTAAGGCTTTGGGTAAAGG | TTG | chr1 | 55042518 | 55042539 | 55042535 | 55042540 | + |
| SEQ ID NO 46801 | AGGCTTTGGGTAAAGGGGTGG | CTA | chr1 | 55042524 | 55042545 | 55042541 | 55042546 | + |
| SEQ ID NO 46802 | TGGGTAAAGGGGTGGACTCTG | CTT | chr1 | 55042530 | 55042551 | 55042547 | 55042552 | + |
| SEQ ID NO 46803 | GGGTAAAGGGGTGGACTCTGT | TTT | chr1 | 55042531 | 55042552 | 55042548 | 55042553 | + |
| SEQ ID NO 46804 | GGTAAAGGGGTGGACTCTGTT | TTG | chr1 | 55042532 | 55042553 | 55042549 | 55042554 | + |
| SEQ ID NO 46805 | TGTTCTACTCTGACTGGAGTCC | CTC | chr1 | 55042550 | 55042571 | 55042567 | 55042572 | + |
| SEQ ID NO 46806 | TTCTACTCTGACTGGAGTCCAA | CTG | chr1 | 55042552 | 55042573 | 55042569 | 55042574 | + |
| SEQ ID NO 46807 | TACTCTGACTGGAGTCCAAGAT | TTC | chr1 | 55042555 | 55042576 | 55042572 | 55042577 | + |
| SEQ ID NO 46808 | CTCTGACTGGAGTCCAAGATGC | CTA | chr1 | 55042557 | 55042578 | 55042574 | 55042579 | + |
| SEQ ID NO 46809 | TGACTGGAGTCCAAGATGCATA | CTC | chr1 | 55042560 | 55042581 | 55042577 | 55042582 | + |
| SEQ ID NO 46810 | ACTGGAGTCCAAGATGCATATA | CTG | chr1 | 55042562 | 55042583 | 55042579 | 55042584 | + |
| SEQ ID NO 46811 | GAGTCCAAGATGCATATATACA | CTG | chr1 | 55042566 | 55042587 | 55042583 | 55042588 | + |
| SEQ ID NO 46812 | CAAGGTAGGTTGAGGTAGGGGC | CTG | chr1 | 55042609 | 55042630 | 55042626 | 55042631 | + |
| SEQ ID NO 46813 | AGGTAGGGGCCAAGGAGGAGCA | TTG | chr1 | 55042621 | 55042642 | 55042638 | 55042643 | + |
| SEQ ID NO 46814 | GGACTTGATTCATGAGGCTGTG | TTT | chr1 | 55042651 | 55042672 | 55042668 | 55042673 | + |
| SEQ ID NO 46815 | GACTTGATTCATGAGGCTGTGG | TTG | chr1 | 55042652 | 55042673 | 55042669 | 55042674 | + |
| SEQ ID NO 46816 | GATTCATGAGGCTGTGGGGAGC | CTT | chr1 | 55042657 | 55042678 | 55042674 | 55042679 | + |
| SEQ ID NO 46817 | ATTCATGAGGCTGTGGGGAGCC | TTG | chr1 | 55042658 | 55042679 | 55042675 | 55042680 | + |
| SEQ ID NO 46818 | ATGAGGCTGTGGGGAGCCAGTG | TTC | chr1 | 55042662 | 55042683 | 55042679 | 55042684 | + |
| SEQ ID NO 46819 | TGGGGAGCCAGTGAAGGTTCTT | CTG | chr1 | 55042671 | 55042692 | 55042688 | 55042693 | + |
| SEQ ID NO 46820 | TTAAGCAGGTATGTCTGCCTGA | TTC | chr1 | 55042691 | 55042712 | 55042708 | 55042713 | + |
| SEQ ID NO 46821 | AAGCAGGTATGTCTGCCTGAGA | CTT | chr1 | 55042693 | 55042714 | 55042710 | 55042715 | + |
| SEQ ID NO 46822 | AGCAGGTATGTCTGCCTGAGAG | TTA | chr1 | 55042694 | 55042715 | 55042711 | 55042716 | + |
| SEQ ID NO 46823 | CCTGAGAGCAGTTGGAGCAGAC | CTG | chr1 | 55042708 | 55042729 | 55042725 | 55042730 | + |
| SEQ ID NO 46824 | AGAGCAGTTGGAGCAGACAAGA | CTG | chr1 | 55042712 | 55042733 | 55042729 | 55042734 | + |
| SEQ ID NO 46825 | GAGCAGACAAGAGCTAAAAACC | TTG | chr1 | 55042722 | 55042743 | 55042739 | 55042744 | + |
| SEQ ID NO 46826 | AAAACCAAACAAATCACCATAG | CTA | chr1 | 55042738 | 55042759 | 55042755 | 55042760 | + |
| SEQ ID NO 46827 | CTATAATTTGTTTGTCCCCTCC | CTG | chr1 | 55042770 | 55042791 | 55042787 | 55042792 | + |
| SEQ ID NO 46828 | TAATTTGTTTGTCCCCTCCAAA | CTA | chr1 | 55042773 | 55042794 | 55042790 | 55042795 | + |
| SEQ ID NO 46829 | GTTTGTCCCCTCCAAATCTCAT | TTT | chr1 | 55042779 | 55042800 | 55042796 | 55042801 | + |
| SEQ ID NO 46830 | TTTGTCCCCTCCAAATCTCATG | TTG | chr1 | 55042780 | 55042801 | 55042797 | 55042802 | + |
| SEQ ID NO 46831 | GTCCCCTCCAAATCTCATGTGG | TTT | chr1 | 55042783 | 55042804 | 55042800 | 55042805 | + |
| SEQ ID NO 46832 | TCCCCTCCAAATCTCATGTGGA | TTG | chr1 | 55042784 | 55042805 | 55042801 | 55042806 | + |
| SEQ ID NO 46833 | CAAATCTCATGTGGAAATTTGG | CTC | chr1 | 55042791 | 55042812 | 55042808 | 55042813 | + |
| SEQ ID NO 46834 | ATGTGGAAATTTGGTCCTCAGT | CTC | chr1 | 55042799 | 55042820 | 55042816 | 55042821 | + |
| SEQ ID NO 46835 | GGTCCTCAGTGTTGGAAGTGGG | TTT | chr1 | 55042811 | 55042832 | 55042828 | 55042833 | + |
| SEQ ID NO 46836 | GTCCTCAGTGTTGGAAGTGGGG | TTG | chr1 | 55042812 | 55042833 | 55042829 | 55042834 | + |

Figure 66 (Cont'd)

| | | | | | | | | |
|---|---|---|---|---|---|---|---|---|
| SEQ ID NO 46837 | AGTGTTGGAAGTGGGGCCTAAT | CTC | chr1 | 55042818 | 55042839 | 55042835 | 55042840 | + |
| SEQ ID NO 46838 | GAAGTGGGGCCTAATGGGAGGT | TTG | chr1 | 55042825 | 55042846 | 55042842 | 55042847 | + |
| SEQ ID NO 46839 | ATGGGAGGTGTTTGGGTCATGG | CTA | chr1 | 55042838 | 55042859 | 55042855 | 55042860 | + |
| SEQ ID NO 46840 | GGGTCATGGGGGAGGAACCCCT | TTT | chr1 | 55042851 | 55042872 | 55042868 | 55042873 | + |
| SEQ ID NO 46841 | GGTCATGGGGGAGGAACCCCTG | TTG | chr1 | 55042852 | 55042873 | 55042869 | 55042874 | + |
| SEQ ID NO 46842 | TGAAAGGCTTGGTGCCGTCCTT | CTG | chr1 | 55042874 | 55042895 | 55042891 | 55042896 | + |
| SEQ ID NO 46843 | GGTGCCGTCCTTGTGATAATGA | CTT | chr1 | 55042884 | 55042905 | 55042901 | 55042906 | + |
| SEQ ID NO 46844 | GTGCCGTCCTTGTGATAATGAG | TTG | chr1 | 55042885 | 55042906 | 55042902 | 55042907 | + |
| SEQ ID NO 46845 | GTGATAATGAGTAAGTTCTCCC | CTT | chr1 | 55042896 | 55042917 | 55042913 | 55042918 | + |
| SEQ ID NO 46846 | TGATAATGAGTAAGTTCTCCCG | TTG | chr1 | 55042897 | 55042918 | 55042914 | 55042919 | + |
| SEQ ID NO 46847 | TCCCGCTATGATTTCCCTTGAA | TTC | chr1 | 55042914 | 55042935 | 55042931 | 55042936 | + |
| SEQ ID NO 46848 | CCGCTATGATTTCCCTTGAAGG | CTC | chr1 | 55042916 | 55042937 | 55042933 | 55042938 | + |
| SEQ ID NO 46849 | TGATTTCCCTTGAAGGCTGATT | CTA | chr1 | 55042922 | 55042943 | 55042939 | 55042944 | + |
| SEQ ID NO 46850 | CCCTTGAAGGCTGATTATTAAA | TTT | chr1 | 55042928 | 55042949 | 55042945 | 55042950 | + |
| SEQ ID NO 46851 | CCTTGAAGGCTGATTATTAAAA | TTC | chr1 | 55042929 | 55042950 | 55042946 | 55042951 | + |
| SEQ ID NO 46852 | GAAGGCTGATTATTAAAAGAG | CTT | chr1 | 55042933 | 55042954 | 55042950 | 55042955 | + |
| SEQ ID NO 46853 | AAGGCTGATTATTAAAAGAGC | TTG | chr1 | 55042934 | 55042955 | 55042951 | 55042956 | + |
| SEQ ID NO 46854 | ATTATTAAAAGAGCTTGGCAC | CTG | chr1 | 55042941 | 55042962 | 55042958 | 55042963 | + |
| SEQ ID NO 46855 | TTAAAAGAGCTTGGCACCTCC | TTA | chr1 | 55042945 | 55042966 | 55042962 | 55042967 | + |
| SEQ ID NO 46856 | AAAAGAGCTTGGCACCTCCCTC | TTA | chr1 | 55042948 | 55042969 | 55042965 | 55042970 | + |
| SEQ ID NO 46857 | GGCACCTCCCTCTCTTCTCTCT | CTT | chr1 | 55042958 | 55042979 | 55042975 | 55042980 | + |
| SEQ ID NO 46858 | GCACCTCCCTCTCTTCTCTCTT | TTG | chr1 | 55042959 | 55042980 | 55042976 | 55042981 | + |
| SEQ ID NO 46859 | CCTCTCTTCTCTCTTGCTTCTT | CTC | chr1 | 55042966 | 55042987 | 55042983 | 55042988 | + |
| SEQ ID NO 46860 | TCTTCTCTCTTGCTTCTTCTCT | CTC | chr1 | 55042970 | 55042991 | 55042987 | 55042992 | + |
| SEQ ID NO 46861 | TTCTCTCTTGCTTCTTCTCTTG | CTC | chr1 | 55042972 | 55042993 | 55042989 | 55042994 | + |
| SEQ ID NO 46862 | CTCTCTTGCTTCTTCTCTTGCC | CTT | chr1 | 55042974 | 55042995 | 55042991 | 55042996 | + |
| SEQ ID NO 46863 | TCTCTTGCTTCTTCTCTTGCCA | TTC | chr1 | 55042975 | 55042996 | 55042992 | 55042997 | + |
| SEQ ID NO 46864 | TCTTGCTTCTTCTCTTGCCATG | CTC | chr1 | 55042977 | 55042998 | 55042994 | 55042999 | + |
| SEQ ID NO 46865 | TTGCTTCTTCTCTTGCCATGTG | CTC | chr1 | 55042979 | 55043000 | 55042996 | 55043001 | + |
| SEQ ID NO 46866 | GCTTCTTCTCTTGCCATGTGAT | CTT | chr1 | 55042981 | 55043002 | 55042998 | 55043003 | + |
| SEQ ID NO 46867 | CTTCTTCTCTTGCCATGTGATT | TTG | chr1 | 55042982 | 55043003 | 55042999 | 55043004 | + |
| SEQ ID NO 46868 | CTTCTCTTGCCATGTGATTGAT | CTT | chr1 | 55042985 | 55043006 | 55043002 | 55043007 | + |
| SEQ ID NO 46869 | TTCTCTTGCCATGTGATTGATC | TTC | chr1 | 55042986 | 55043007 | 55043003 | 55043008 | + |
| SEQ ID NO 46870 | CTCTTGCCATGTGATTGATCTC | CTT | chr1 | 55042988 | 55043009 | 55043005 | 55043010 | + |
| SEQ ID NO 46871 | TCTTGCCATGTGATTGATCTCT | TTC | chr1 | 55042989 | 55043010 | 55043006 | 55043011 | + |
| SEQ ID NO 46872 | TTGCCATGTGATTGATCTCTGC | CTC | chr1 | 55042991 | 55043012 | 55043008 | 55043013 | + |
| SEQ ID NO 46873 | GCCATGTGATTGATCTCTGCAC | CTT | chr1 | 55042993 | 55043014 | 55043010 | 55043015 | + |
| SEQ ID NO 46874 | CCATGTGATTGATCTCTGCACA | TTG | chr1 | 55042994 | 55043015 | 55043011 | 55043016 | + |
| SEQ ID NO 46875 | ATCTCTGCACATGTAGGCTCCC | TTG | chr1 | 55043005 | 55043026 | 55043022 | 55043027 | + |
| SEQ ID NO 46876 | TGCACATGTAGGCTCCCCTTCA | CTC | chr1 | 55043010 | 55043031 | 55043027 | 55043032 | + |
| SEQ ID NO 46877 | CACATGTAGGCTCCCCTTCACC | CTG | chr1 | 55043012 | 55043033 | 55043029 | 55043034 | + |
| SEQ ID NO 46878 | CCCTTCACCTTCTGCCATCAGT | CTC | chr1 | 55043025 | 55043046 | 55043042 | 55043047 | + |
| SEQ ID NO 46879 | CACCTTCTGCCATCAGTGAAAG | CTT | chr1 | 55043030 | 55043051 | 55043047 | 55043052 | + |
| SEQ ID NO 46880 | ACCTTCTGCCATCAGTGAAAGC | TTC | chr1 | 55043031 | 55043052 | 55043048 | 55043053 | + |
| SEQ ID NO 46881 | CTGCCATCAGTGAAAGCAGCTT | CTT | chr1 | 55043036 | 55043057 | 55043053 | 55043058 | + |
| SEQ ID NO 46882 | TGCCATCAGTGAAAGCAGCTTA | TTC | chr1 | 55043037 | 55043058 | 55043054 | 55043059 | + |
| SEQ ID NO 46883 | CCATCAGTGAAAGCAGCTTAAG | CTG | chr1 | 55043039 | 55043060 | 55043056 | 55043061 | + |
| SEQ ID NO 46884 | AAGGCCCTCACCAGAAGCAGAT | CTT | chr1 | 55043058 | 55043079 | 55043075 | 55043080 | + |
| SEQ ID NO 46885 | AGGCCCTCACCAGAAGCAGATG | TTA | chr1 | 55043059 | 55043080 | 55043076 | 55043081 | + |
| SEQ ID NO 46886 | ACCAGAAGCAGATGCTGGTGCC | CTC | chr1 | 55043067 | 55043088 | 55043084 | 55043089 | + |
| SEQ ID NO 46887 | GTGCCATGCTTCCTGGAGAGCT | CTG | chr1 | 55043084 | 55043105 | 55043101 | 55043106 | + |
| SEQ ID NO 46888 | CCTGGAGAGCTTGCAGAATCAT | CTT | chr1 | 55043095 | 55043116 | 55043112 | 55043117 | + |
| SEQ ID NO 46889 | CTGGAGAGCTTGCAGAATCATG | TTC | chr1 | 55043096 | 55043117 | 55043113 | 55043118 | + |
| SEQ ID NO 46890 | GAGAGCTTGCAGAATCATGAGC | CTG | chr1 | 55043099 | 55043120 | 55043116 | 55043121 | + |
| SEQ ID NO 46891 | GCAGAATCATGAGCTGAATAAA | CTT | chr1 | 55043107 | 55043128 | 55043124 | 55043129 | + |
| SEQ ID NO 46892 | CAGAATCATGAGCTGAATAAAT | TTG | chr1 | 55043108 | 55043129 | 55043125 | 55043130 | + |
| SEQ ID NO 46893 | AATAAATCCCTTTTCCTTGTAA | CTG | chr1 | 55043123 | 55043144 | 55043140 | 55043145 | + |
| SEQ ID NO 46894 | TTCCTTGTAAATTACTCACCTT | CTT | chr1 | 55043135 | 55043156 | 55043152 | 55043157 | + |

Figure 66 (Cont'd)

| SEQ ID NO 46895 | TCCTTGTAAATTACTCACCTTC | TTT | chr1 | 55043136 | 55043157 | 55043153 | 55043158 | + |
|---|---|---|---|---|---|---|---|---|
| SEQ ID NO 46896 | CCTTGTAAATTACTCACCTTCA | TTT | chr1 | 55043137 | 55043158 | 55043154 | 55043159 | + |
| SEQ ID NO 46897 | CTTGTAAATTACTCACCTTCAG | TTC | chr1 | 55043138 | 55043159 | 55043155 | 55043160 | + |
| SEQ ID NO 46898 | GTAAATTACTCACCTTCAGGTA | CTT | chr1 | 55043141 | 55043162 | 55043158 | 55043163 | + |
| SEQ ID NO 46899 | TAAATTACTCACCTTCAGGTAT | TTG | chr1 | 55043142 | 55043163 | 55043159 | 55043164 | + |
| SEQ ID NO 46900 | CTCACCTTCAGGTATTCCTTTA | TTA | chr1 | 55043149 | 55043170 | 55043166 | 55043171 | + |
| SEQ ID NO 46901 | ACCTTCAGGTATTCCTTTATAT | CTC | chr1 | 55043152 | 55043173 | 55043169 | 55043174 | + |
| SEQ ID NO 46902 | CAGGTATTCCTTTATATAGCAA | CTT | chr1 | 55043157 | 55043178 | 55043174 | 55043179 | + |
| SEQ ID NO 46903 | AGGTATTCCTTTATATAGCAAC | TTC | chr1 | 55043158 | 55043179 | 55043175 | 55043180 | + |
| SEQ ID NO 46904 | CTTTATATAGCAACACAAAAGG | TTC | chr1 | 55043166 | 55043187 | 55043183 | 55043188 | + |
| SEQ ID NO 46905 | TATATAGCAACACAAAAGGACT | CTT | chr1 | 55043169 | 55043190 | 55043186 | 55043191 | + |
| SEQ ID NO 46906 | ATATAGCAACACAAAAGGACTA | TTT | chr1 | 55043170 | 55043191 | 55043187 | 55043192 | + |
| SEQ ID NO 46907 | TATAGCAACACAAAAGGACTAA | TTA | chr1 | 55043171 | 55043192 | 55043188 | 55043193 | + |
| SEQ ID NO 46908 | AGACAGTGGCCTTGACTTTTCT | CTA | chr1 | 55043192 | 55043213 | 55043209 | 55043214 | + |
| SEQ ID NO 46909 | GACTTTTCTCTCTCTTTAAGAA | CTT | chr1 | 55043205 | 55043226 | 55043222 | 55043227 | + |
| SEQ ID NO 46910 | ACTTTTCTCTCTCTTTAAGAAG | TTG | chr1 | 55043206 | 55043227 | 55043223 | 55043228 | + |
| SEQ ID NO 46911 | TTCTCTCTCTTTAAGAAGTGTT | CTT | chr1 | 55043210 | 55043231 | 55043227 | 55043232 | + |
| SEQ ID NO 46912 | TCTCTCTCTTTAAGAAGTGTTG | TTT | chr1 | 55043211 | 55043232 | 55043228 | 55043233 | + |
| SEQ ID NO 46913 | CTCTCTCTTTAAGAAGTGTTGC | TTT | chr1 | 55043212 | 55043233 | 55043229 | 55043234 | + |
| SEQ ID NO 46914 | TCTCTCTTTAAGAAGTGTTGCC | TTC | chr1 | 55043213 | 55043234 | 55043230 | 55043235 | + |
| SEQ ID NO 46915 | TCTCTTTAAGAAGTGTTGCCTT | CTC | chr1 | 55043215 | 55043236 | 55043232 | 55043237 | + |
| SEQ ID NO 46916 | TCTTTAAGAAGTGTTGCCTTTG | CTC | chr1 | 55043217 | 55043238 | 55043234 | 55043239 | + |
| SEQ ID NO 46917 | TTTAAGAAGTGTTGCCTTTGCT | CTC | chr1 | 55043219 | 55043240 | 55043236 | 55043241 | + |
| SEQ ID NO 46918 | TAAGAAGTGTTGCCTTTGCTCA | CTT | chr1 | 55043221 | 55043242 | 55043238 | 55043243 | + |
| SEQ ID NO 46919 | AAGAAGTGTTGCCTTTGCTCAC | TTT | chr1 | 55043222 | 55043243 | 55043239 | 55043244 | + |
| SEQ ID NO 46920 | AGAAGTGTTGCCTTTGCTCACT | TTA | chr1 | 55043223 | 55043244 | 55043240 | 55043245 | + |
| SEQ ID NO 46921 | CCTTTGCTCACTTAGTCATCCC | TTG | chr1 | 55043233 | 55043254 | 55043250 | 55043255 | + |
| SEQ ID NO 46922 | TGCTCACTTAGTCATCCCTTCT | CTT | chr1 | 55043237 | 55043258 | 55043254 | 55043259 | + |
| SEQ ID NO 46923 | GCTCACTTAGTCATCCCTTCTG | TTT | chr1 | 55043238 | 55043259 | 55043255 | 55043260 | + |
| SEQ ID NO 46924 | CTCACTTAGTCATCCCTTCTGC | TTG | chr1 | 55043239 | 55043260 | 55043256 | 55043261 | + |
| SEQ ID NO 46925 | ACTTAGTCATCCCTTCTGCCTG | CTC | chr1 | 55043242 | 55043263 | 55043259 | 55043264 | + |
| SEQ ID NO 46926 | AGTCATCCCTTCTGCCTGCATT | CTT | chr1 | 55043246 | 55043267 | 55043263 | 55043268 | + |
| SEQ ID NO 46927 | GTCATCCCTTCTGCCTGCATTT | TTA | chr1 | 55043247 | 55043268 | 55043264 | 55043269 | + |
| SEQ ID NO 46928 | CTGCCTGCATTTGTAGAGCATC | CTT | chr1 | 55043257 | 55043278 | 55043274 | 55043279 | + |
| SEQ ID NO 46929 | TGCCTGCATTTGTAGAGCATCT | TTC | chr1 | 55043258 | 55043279 | 55043275 | 55043280 | + |
| SEQ ID NO 46930 | CCTGCATTTGTAGAGCATCTGG | CTG | chr1 | 55043260 | 55043281 | 55043277 | 55043282 | + |
| SEQ ID NO 46931 | CATTTGTAGAGCATCTGGATGG | CTG | chr1 | 55043264 | 55043285 | 55043281 | 55043286 | + |
| SEQ ID NO 46932 | GTAGAGCATCTGGATGGGAGAT | TTT | chr1 | 55043269 | 55043290 | 55043286 | 55043291 | + |
| SEQ ID NO 46933 | TAGAGCATCTGGATGGGAGATT | TTG | chr1 | 55043270 | 55043291 | 55043287 | 55043292 | + |
| SEQ ID NO 46934 | GATGGGAGATTTATATAACCGT | CTG | chr1 | 55043281 | 55043302 | 55043298 | 55043303 | + |
| SEQ ID NO 46935 | ATATAACCGTCACTCTTGACTT | TTT | chr1 | 55043293 | 55043314 | 55043310 | 55043315 | + |
| SEQ ID NO 46936 | TATAACCGTCACTCTTGACTTT | TTA | chr1 | 55043294 | 55043315 | 55043311 | 55043316 | + |
| SEQ ID NO 46937 | TTGACTTTCCCAGCAGGCCTAT | CTC | chr1 | 55043308 | 55043329 | 55043325 | 55043330 | + |
| SEQ ID NO 46938 | GACTTTCCCAGCAGGCCTATGT | CTT | chr1 | 55043310 | 55043331 | 55043327 | 55043332 | + |
| SEQ ID NO 46939 | ACTTTCCCAGCAGGCCTATGTC | TTG | chr1 | 55043311 | 55043332 | 55043328 | 55043333 | + |
| SEQ ID NO 46940 | TCCCAGCAGGCCTATGTCATAG | CTT | chr1 | 55043315 | 55043336 | 55043332 | 55043337 | + |
| SEQ ID NO 46941 | CCCAGCAGGCCTATGTCATAGG | TTT | chr1 | 55043316 | 55043337 | 55043333 | 55043338 | + |
| SEQ ID NO 46942 | CCAGCAGGCCTATGTCATAGGT | TTC | chr1 | 55043317 | 55043338 | 55043334 | 55043339 | + |
| SEQ ID NO 46943 | TGTCATAGGTACTGTGGTCTCT | CTA | chr1 | 55043329 | 55043350 | 55043346 | 55043351 | + |
| SEQ ID NO 46944 | TGGTCTCTACAATACAGCAGAG | CTG | chr1 | 55043343 | 55043364 | 55043360 | 55043365 | + |
| SEQ ID NO 46945 | TACAATACAGCAGAGGTATCTG | CTC | chr1 | 55043350 | 55043371 | 55043367 | 55043372 | + |
| SEQ ID NO 46946 | CAATACAGCAGAGGTATCTGAG | CTA | chr1 | 55043352 | 55043373 | 55043369 | 55043374 | + |
| SEQ ID NO 46947 | AGGCTCCGAGAGGTTGAGTGAC | CTG | chr1 | 55043372 | 55043393 | 55043389 | 55043394 | + |
| SEQ ID NO 46948 | CGAGAGGTTGAGTGACTTGCTC | CTC | chr1 | 55043378 | 55043399 | 55043395 | 55043400 | + |
| SEQ ID NO 46949 | AGTGACTTGCTCATGGCTGCAC | TTG | chr1 | 55043388 | 55043409 | 55043405 | 55043410 | + |
| SEQ ID NO 46950 | GCTCATGGCTGCACAACCAGTA | CTT | chr1 | 55043396 | 55043417 | 55043413 | 55043418 | + |
| SEQ ID NO 46951 | CTCATGGCTGCACAACCAGTAA | TTG | chr1 | 55043397 | 55043418 | 55043414 | 55043419 | + |
| SEQ ID NO 46952 | ATGGCTGCACAACCAGTAAATA | CTC | chr1 | 55043400 | 55043421 | 55043417 | 55043422 | + |

Figure 66 (Cont'd)

| | | | | | | | | |
|---|---|---|---|---|---|---|---|---|
| SEQ ID NO 46953 | CACAACCAGTAAATATTGGAGC | CTG | chr1 | 55043407 | 55043428 | 55043424 | 55043429 | + |
| SEQ ID NO 46954 | GAGCTGGAATTCAGGTCCACGG | TTG | chr1 | 55043425 | 55043446 | 55043442 | 55043447 | + |
| SEQ ID NO 46955 | GAATTCAGGTCCACGGTTTCCT | CTG | chr1 | 55043431 | 55043452 | 55043448 | 55043453 | + |
| SEQ ID NO 46956 | AGGTCCACGGTTTCCTGGCTCC | TTC | chr1 | 55043437 | 55043458 | 55043454 | 55043459 | + |
| SEQ ID NO 46957 | CCTGGCTCCAAAGCCCATGATT | TTT | chr1 | 55043450 | 55043471 | 55043467 | 55043472 | + |
| SEQ ID NO 46958 | CTGGCTCCAAAGCCCATGATTT | TTC | chr1 | 55043451 | 55043472 | 55043468 | 55043473 | + |
| SEQ ID NO 46959 | GCTCCAAAGCCCATGATTTTTT | CTG | chr1 | 55043454 | 55043475 | 55043471 | 55043476 | + |
| SEQ ID NO 46960 | CAAAGCCCATGATTTTTTCCCT | CTC | chr1 | 55043458 | 55043479 | 55043475 | 55043480 | + |
| SEQ ID NO 46961 | TTTCCCTCAATTTATTCTGACT | TTT | chr1 | 55043473 | 55043494 | 55043490 | 55043495 | + |
| SEQ ID NO 46962 | TTCCCTCAATTTATTCTGACTG | TTT | chr1 | 55043474 | 55043495 | 55043491 | 55043496 | + |
| SEQ ID NO 46963 | TCCCTCAATTTATTCTGACTGG | TTT | chr1 | 55043475 | 55043496 | 55043492 | 55043497 | + |
| SEQ ID NO 46964 | CCCTCAATTTATTCTGACTGGG | TTT | chr1 | 55043476 | 55043497 | 55043493 | 55043498 | + |
| SEQ ID NO 46965 | CCTCAATTTATTCTGACTGGGG | TTC | chr1 | 55043477 | 55043498 | 55043494 | 55043499 | + |
| SEQ ID NO 46966 | AATTTATTCTGACTGGGGCATG | CTC | chr1 | 55043481 | 55043502 | 55043498 | 55043503 | + |
| SEQ ID NO 46967 | ATTCTGACTGGGGCATGGGGGA | TTT | chr1 | 55043486 | 55043507 | 55043503 | 55043508 | + |
| SEQ ID NO 46968 | TTCTGACTGGGGCATGGGGGAG | TTA | chr1 | 55043487 | 55043508 | 55043504 | 55043509 | + |
| SEQ ID NO 46969 | TGACTGGGGCATGGGGGAGGGG | TTC | chr1 | 55043490 | 55043511 | 55043507 | 55043512 | + |
| SEQ ID NO 46970 | ACTGGGGCATGGGGGAGGGGGT | CTG | chr1 | 55043492 | 55043513 | 55043509 | 55043514 | + |
| SEQ ID NO 46971 | GGGCATGGGGGAGGGGGTGGCC | CTG | chr1 | 55043496 | 55043517 | 55043513 | 55043518 | + |
| SEQ ID NO 46972 | TGGGCAGGGCCACCAGGAGCGA | CTT | chr1 | 55043520 | 55043541 | 55043537 | 55043542 | + |
| SEQ ID NO 46973 | GGGCAGGGCCACCAGGAGCGAC | TTT | chr1 | 55043521 | 55043542 | 55043538 | 55043543 | + |
| SEQ ID NO 46974 | GGCAGGGCCACCAGGAGCGACC | TTG | chr1 | 55043522 | 55043543 | 55043539 | 55043544 | + |
| SEQ ID NO 46975 | GGTGCAGGTACAGAGGAAAACC | CTG | chr1 | 55043561 | 55043582 | 55043578 | 55043583 | + |
| SEQ ID NO 46976 | TTGTCGAGTGTGGCCCGTAGTT | CTG | chr1 | 55043585 | 55043606 | 55043602 | 55043607 | + |
| SEQ ID NO 46977 | TCGAGTGTGGCCCGTAGTTCCC | TTG | chr1 | 55043588 | 55043609 | 55043605 | 55043610 | + |
| SEQ ID NO 46978 | CCATTTTTGCCTGAATGGCACA | TTC | chr1 | 55043608 | 55043629 | 55043625 | 55043630 | + |
| SEQ ID NO 46979 | TTGCCTGAATGGCACATTTGAA | TTT | chr1 | 55043614 | 55043635 | 55043631 | 55043636 | + |
| SEQ ID NO 46980 | TGCCTGAATGGCACATTTGAAA | TTT | chr1 | 55043615 | 55043636 | 55043632 | 55043637 | + |
| SEQ ID NO 46981 | GCCTGAATGGCACATTTGAAAG | TTT | chr1 | 55043616 | 55043637 | 55043633 | 55043638 | + |
| SEQ ID NO 46982 | CCTGAATGGCACATTTGAAAGT | TTG | chr1 | 55043617 | 55043638 | 55043634 | 55043639 | + |
| SEQ ID NO 46983 | AATGGCACATTTGAAAGTGTTA | CTG | chr1 | 55043621 | 55043642 | 55043638 | 55043643 | + |
| SEQ ID NO 46984 | GAAAGTGTTATATAACCATGTG | TTT | chr1 | 55043633 | 55043654 | 55043650 | 55043655 | + |
| SEQ ID NO 46985 | AAAGTGTTATATAACCATGTGA | TTG | chr1 | 55043634 | 55043655 | 55043651 | 55043656 | + |
| SEQ ID NO 46986 | TATAACCATGTGAATAATAATA | TTA | chr1 | 55043643 | 55043664 | 55043660 | 55043665 | + |
| SEQ ID NO 46987 | GCCTATATGAGTTCTTTAATTT | TTG | chr1 | 55043669 | 55043690 | 55043686 | 55043691 | + |
| SEQ ID NO 46988 | TATGAGTTCTTTAATTTGCTTT | CTA | chr1 | 55043674 | 55043695 | 55043691 | 55043696 | + |
| SEQ ID NO 46989 | TTTAATTTGCTTTTTGGTCCGC | TTC | chr1 | 55043683 | 55043704 | 55043700 | 55043705 | + |
| SEQ ID NO 46990 | TAATTTGCTTTTTGGTCCGCAT | CTT | chr1 | 55043685 | 55043706 | 55043702 | 55043707 | + |
| SEQ ID NO 46991 | AATTTGCTTTTTGGTCCGCATT | TTT | chr1 | 55043686 | 55043707 | 55043703 | 55043708 | + |
| SEQ ID NO 46992 | ATTTGCTTTTTGGTCCGCATTT | TTA | chr1 | 55043687 | 55043708 | 55043704 | 55043709 | + |
| SEQ ID NO 46993 | GCTTTTTGGTCCGCATTTGGTA | TTT | chr1 | 55043691 | 55043712 | 55043708 | 55043713 | + |
| SEQ ID NO 46994 | CTTTTTGGTCCGCATTTGGTAA | TTG | chr1 | 55043692 | 55043713 | 55043709 | 55043714 | + |
| SEQ ID NO 46995 | TTTGGTCCGCATTTGGTAACTT | CTT | chr1 | 55043695 | 55043716 | 55043712 | 55043717 | + |
| SEQ ID NO 46996 | TTGGTCCGCATTTGGTAACTTC | TTT | chr1 | 55043696 | 55043717 | 55043713 | 55043718 | + |
| SEQ ID NO 46997 | TGGTCCGCATTTGGTAACTTCT | TTT | chr1 | 55043697 | 55043718 | 55043714 | 55043719 | + |
| SEQ ID NO 46998 | GGTCCGCATTTGGTAACTTCTT | TTT | chr1 | 55043698 | 55043719 | 55043715 | 55043720 | + |
| SEQ ID NO 46999 | GTCCGCATTTGGTAACTTCTTT | TTG | chr1 | 55043699 | 55043720 | 55043716 | 55043721 | + |
| SEQ ID NO 47000 | GGTAACTTCTTTATCATCTACT | TTT | chr1 | 55043709 | 55043730 | 55043726 | 55043731 | + |
| SEQ ID NO 47001 | GTAACTTCTTTATCATCTACTA | TTG | chr1 | 55043710 | 55043731 | 55043727 | 55043732 | + |
| SEQ ID NO 47002 | CTTTATCATCTACTATACTCTG | CTT | chr1 | 55043717 | 55043738 | 55043734 | 55043739 | + |
| SEQ ID NO 47003 | TTTATCATCTACTATACTCTGT | TTC | chr1 | 55043718 | 55043739 | 55043735 | 55043740 | + |
| SEQ ID NO 47004 | TATCATCTACTATACTCTGTTG | CTT | chr1 | 55043720 | 55043741 | 55043737 | 55043742 | + |
| SEQ ID NO 47005 | ATCATCTACTATACTCTGTTGT | TTT | chr1 | 55043721 | 55043742 | 55043738 | 55043743 | + |
| SEQ ID NO 47006 | TCATCTACTATACTCTGTTGTG | TTA | chr1 | 55043722 | 55043743 | 55043739 | 55043744 | + |
| SEQ ID NO 47007 | CTATACTCTGTTGTGTCTCTTT | CTA | chr1 | 55043729 | 55043750 | 55043746 | 55043751 | + |
| SEQ ID NO 47008 | TACTCTGTTGTGTCTCTTTTGT | CTA | chr1 | 55043732 | 55043753 | 55043749 | 55043754 | + |
| SEQ ID NO 47009 | TGTTGTGTCTCTTTTGTTGTAA | CTC | chr1 | 55043737 | 55043758 | 55043754 | 55043759 | + |
| SEQ ID NO 47010 | TTGTGTCTCTTTTGTTGTAATT | CTG | chr1 | 55043739 | 55043760 | 55043756 | 55043761 | + |

Figure 66 (Cont'd)

| | | | | | | | | |
|---|---|---|---|---|---|---|---|---|
| SEQ ID NO 47011 | TGTCTCTTTTGTTGTAATTTGT | TTG | chr1 | 55043742 | 55043763 | 55043759 | 55043764 | + |
| SEQ ID NO 47012 | TTTTGTTGTAATTTGTAAGTAG | CTC | chr1 | 55043748 | 55043769 | 55043765 | 55043770 | + |
| SEQ ID NO 47013 | TTGTTGTAATTTGTAAGTAGGG | CTT | chr1 | 55043750 | 55043771 | 55043767 | 55043772 | + |
| SEQ ID NO 47014 | TGTTGTAATTTGTAAGTAGGGG | TTT | chr1 | 55043751 | 55043772 | 55043768 | 55043773 | + |
| SEQ ID NO 47015 | GTTGTAATTTGTAAGTAGGGGT | TTT | chr1 | 55043752 | 55043773 | 55043769 | 55043774 | + |
| SEQ ID NO 47016 | TTGTAATTTGTAAGTAGGGGTG | TTG | chr1 | 55043753 | 55043774 | 55043770 | 55043775 | + |
| SEQ ID NO 47017 | TAATTTGTAAGTAGGGGTGAGA | TTG | chr1 | 55043756 | 55043777 | 55043773 | 55043778 | + |
| SEQ ID NO 47018 | GTAAGTAGGGGTGAGATAAAGT | TTT | chr1 | 55043762 | 55043783 | 55043779 | 55043784 | + |
| SEQ ID NO 47019 | TAAGTAGGGGTGAGATAAAGTA | TTG | chr1 | 55043763 | 55043784 | 55043780 | 55043785 | + |
| SEQ ID NO 47020 | GGGTTTGCTGGGTTTCTTCCAT | CTA | chr1 | 55043791 | 55043812 | 55043808 | 55043813 | + |
| SEQ ID NO 47021 | GCTGGGTTTCTTCCATGTCATC | TTT | chr1 | 55043797 | 55043818 | 55043814 | 55043819 | + |
| SEQ ID NO 47022 | CTGGGTTTCTTCCATGTCATCA | TTG | chr1 | 55043798 | 55043819 | 55043815 | 55043820 | + |
| SEQ ID NO 47023 | GGTTTCTTCCATGTCATCATGT | CTG | chr1 | 55043801 | 55043822 | 55043818 | 55043823 | + |
| SEQ ID NO 47024 | CTTCCATGTCATCATGTTCCTC | TTT | chr1 | 55043806 | 55043827 | 55043823 | 55043828 | + |
| SEQ ID NO 47025 | TTCCATGTCATCATGTTCCTCC | TTC | chr1 | 55043807 | 55043828 | 55043824 | 55043829 | + |
| SEQ ID NO 47026 | CCATGTCATCATGTTCCTCCTT | CTT | chr1 | 55043809 | 55043830 | 55043826 | 55043831 | + |
| SEQ ID NO 47027 | CATGTCATCATGTTCCTCCTTG | TTC | chr1 | 55043810 | 55043831 | 55043827 | 55043832 | + |
| SEQ ID NO 47028 | CTCCTTGCATGGGGCCAGGATC | TTC | chr1 | 55043825 | 55043846 | 55043842 | 55043847 | + |
| SEQ ID NO 47029 | CTTGCATGGGGCCAGGATCCGT | CTC | chr1 | 55043828 | 55043849 | 55043845 | 55043850 | + |
| SEQ ID NO 47030 | GCATGGGGCCAGGATCCGTGGA | CTT | chr1 | 55043831 | 55043852 | 55043848 | 55043853 | + |
| SEQ ID NO 47031 | CATGGGGCCAGGATCCGTGGAG | TTG | chr1 | 55043832 | 55043853 | 55043849 | 55043854 | + |
| SEQ ID NO 47032 | CCTGGCACCTACGTGGTGGTGC | TTG | chr1 | 55043858 | 55043879 | 55043875 | 55043880 | + |
| SEQ ID NO 47033 | GCACCTACGTGGTGGTGCTGAA | CTG | chr1 | 55043862 | 55043883 | 55043879 | 55043884 | + |
| SEQ ID NO 47034 | CGTGGTGGTGCTGAAGGAGGAG | CTA | chr1 | 55043869 | 55043890 | 55043886 | 55043891 | + |
| SEQ ID NO 47035 | AAGGAGGAGACCCACCTCTCGC | CTG | chr1 | 55043882 | 55043903 | 55043899 | 55043904 | + |
| SEQ ID NO 47036 | TCGCAGTCAGAGCGCACTGCCC | CTC | chr1 | 55043900 | 55043921 | 55043917 | 55043922 | + |
| SEQ ID NO 47037 | GCAGTCAGAGCGCACTGCCCGC | CTC | chr1 | 55043902 | 55043923 | 55043919 | 55043924 | + |
| SEQ ID NO 47038 | CCCGCCGCCTGCAGGCCCAGGC | CTG | chr1 | 55043919 | 55043940 | 55043936 | 55043941 | + |
| SEQ ID NO 47039 | CAGGCCCAGGCTGCCCGCCGGG | CTG | chr1 | 55043930 | 55043951 | 55043947 | 55043952 | + |
| SEQ ID NO 47040 | CCCGCCGGGGATACCTCACCAA | CTG | chr1 | 55043943 | 55043964 | 55043960 | 55043965 | + |
| SEQ ID NO 47041 | ACCAAGATCCTGCATGTCTTCC | CTC | chr1 | 55043960 | 55043981 | 55043977 | 55043982 | + |
| SEQ ID NO 47042 | CATGTCTTCCATGGCCTTCTTC | CTG | chr1 | 55043972 | 55043993 | 55043989 | 55043994 | + |
| SEQ ID NO 47043 | CCATGGCCTTCTTCCTGGCTTC | CTT | chr1 | 55043980 | 55044001 | 55043997 | 55044002 | + |
| SEQ ID NO 47044 | CATGGCCTTCTTCCTGGCTTCC | TTC | chr1 | 55043981 | 55044002 | 55043998 | 55044003 | + |
| SEQ ID NO 47045 | CTTCCTGGCTTCCTGGTGAAGA | CTT | chr1 | 55043990 | 55044011 | 55044007 | 55044012 | + |
| SEQ ID NO 47046 | TTCCTGGCTTCCTGGTGAAGAT | TTC | chr1 | 55043991 | 55044012 | 55044008 | 55044013 | + |
| SEQ ID NO 47047 | CCTGGCTTCCTGGTGAAGATGA | CTT | chr1 | 55043993 | 55044014 | 55044010 | 55044015 | + |
| SEQ ID NO 47048 | CTGGCTTCCTGGTGAAGATGAG | TTC | chr1 | 55043994 | 55044015 | 55044011 | 55044016 | + |
| SEQ ID NO 47049 | GCTTCCTGGTGAAGATGAGTGG | CTG | chr1 | 55043997 | 55044018 | 55044014 | 55044019 | + |
| SEQ ID NO 47050 | CCTGGTGAAGATGAGTGGCGAC | CTT | chr1 | 55044001 | 55044022 | 55044018 | 55044023 | + |
| SEQ ID NO 47051 | CTGGTGAAGATGAGTGGCGACC | TTC | chr1 | 55044002 | 55044023 | 55044019 | 55044024 | + |
| SEQ ID NO 47052 | GTGAAGATGAGTGGCGACCTGC | CTG | chr1 | 55044005 | 55044026 | 55044022 | 55044027 | + |
| SEQ ID NO 47053 | CTGGAGCTGGTGAGCCACCCTT | CTG | chr1 | 55044026 | 55044047 | 55044043 | 55044048 | + |
| SEQ ID NO 47054 | GAGCTGGTGAGCCACCCTTTTT | CTG | chr1 | 55044029 | 55044050 | 55044046 | 55044051 | + |
| SEQ ID NO 47055 | GTGAGCCACCCTTTTTGGGAAT | CTG | chr1 | 55044035 | 55044056 | 55044052 | 55044057 | + |
| SEQ ID NO 47056 | TTTGGGAATGGCACTTCCTGAT | CTT | chr1 | 55044048 | 55044069 | 55044065 | 55044070 | + |
| SEQ ID NO 47057 | TTGGGAATGGCACTTCCTGATA | TTT | chr1 | 55044049 | 55044070 | 55044066 | 55044071 | + |
| SEQ ID NO 47058 | TGGGAATGGCACTTCCTGATAG | TTT | chr1 | 55044050 | 55044071 | 55044067 | 55044072 | + |
| SEQ ID NO 47059 | GGGAATGGCACTTCCTGATAGG | TTT | chr1 | 55044051 | 55044072 | 55044068 | 55044073 | + |
| SEQ ID NO 47060 | GGAATGGCACTTCCTGATAGGG | TTG | chr1 | 55044052 | 55044073 | 55044069 | 55044074 | + |
| SEQ ID NO 47061 | CCTGATAGGGCTGGGCCACTGC | CTT | chr1 | 55044064 | 55044085 | 55044081 | 55044086 | + |
| SEQ ID NO 47062 | CTGATAGGGCTGGGCCACTGCA | TTC | chr1 | 55044065 | 55044086 | 55044082 | 55044087 | + |
| SEQ ID NO 47063 | ATAGGGCTGGGCCACTGCATAT | CTG | chr1 | 55044068 | 55044089 | 55044085 | 55044090 | + |
| SEQ ID NO 47064 | GGCCACTGCATATACACTGGGA | CTG | chr1 | 55044077 | 55044098 | 55044094 | 55044099 | + |
| SEQ ID NO 47065 | CATATACACTGGGGACTGTGCT | CTG | chr1 | 55044085 | 55044106 | 55044102 | 55044107 | + |
| SEQ ID NO 47066 | GGGACTGTGCTTAGTAGGCCCA | CTG | chr1 | 55044096 | 55044117 | 55044113 | 55044118 | + |
| SEQ ID NO 47067 | TGCTTAGTAGGCCCATTGCTGA | CTG | chr1 | 55044103 | 55044124 | 55044120 | 55044125 | + |
| SEQ ID NO 47068 | AGTAGGCCCATTGCTGAAAATC | CTT | chr1 | 55044108 | 55044129 | 55044125 | 55044130 | + |

Figure 66 (Cont'd)

| | | | | | | | | |
|---|---|---|---|---|---|---|---|---|
| SEQ ID NO 47069 | GTAGGCCCATTGCTGAAAATCA | TTA | chr1 | 55044109 | 55044130 | 55044126 | 55044131 | + |
| SEQ ID NO 47070 | CTGAAAATCAGAAGGGGACAGC | TTG | chr1 | 55044121 | 55044142 | 55044138 | 55044143 | + |
| SEQ ID NO 47071 | AAAATCAGAAGGGGACAGCAAG | CTG | chr1 | 55044124 | 55044145 | 55044141 | 55044146 | + |
| SEQ ID NO 47072 | AGCACTTATCGGGTACCAAGCA | TTG | chr1 | 55044155 | 55044176 | 55044172 | 55044177 | + |
| SEQ ID NO 47073 | ATCGGGTACCAAGCACAGTAAC | CTT | chr1 | 55044162 | 55044183 | 55044179 | 55044184 | + |
| SEQ ID NO 47074 | TCGGGTACCAAGCACAGTAACT | TTA | chr1 | 55044163 | 55044184 | 55044180 | 55044185 | + |
| SEQ ID NO 47075 | CTGGCTTTCTGTATAGAATTCC | CTA | chr1 | 55044186 | 55044207 | 55044203 | 55044208 | + |
| SEQ ID NO 47076 | GCTTTCTGTATAGAATTCCCTT | CTG | chr1 | 55044189 | 55044210 | 55044206 | 55044211 | + |
| SEQ ID NO 47077 | TCTGTATAGAATTCCCTTTAAG | CTT | chr1 | 55044193 | 55044214 | 55044210 | 55044215 | + |
| SEQ ID NO 47078 | CTGTATAGAATTCCCTTTAAGC | TTT | chr1 | 55044194 | 55044215 | 55044211 | 55044216 | + |
| SEQ ID NO 47079 | TGTATAGAATTCCCTTTAAGCC | TTC | chr1 | 55044195 | 55044216 | 55044212 | 55044217 | + |
| SEQ ID NO 47080 | TATAGAATTCCCTTTAAGCCTG | CTG | chr1 | 55044197 | 55044218 | 55044214 | 55044219 | + |
| SEQ ID NO 47081 | CCTTTAAGCCTGGCCATGCCCC | TTC | chr1 | 55044207 | 55044228 | 55044224 | 55044229 | + |
| SEQ ID NO 47082 | TAAGCCTGGCCATGCCCCAGTG | CTT | chr1 | 55044211 | 55044232 | 55044228 | 55044233 | + |
| SEQ ID NO 47083 | AAGCCTGGCCATGCCCCAGTGG | TTT | chr1 | 55044212 | 55044233 | 55044229 | 55044234 | + |
| SEQ ID NO 47084 | AGCCTGGCCATGCCCCAGTGGT | TTA | chr1 | 55044213 | 55044234 | 55044230 | 55044235 | + |
| SEQ ID NO 47085 | GCCATGCCCCAGTGGTACGTCT | CTG | chr1 | 55044219 | 55044240 | 55044236 | 55044241 | + |
| SEQ ID NO 47086 | TCTTCATTTGAAAGACGAGGAG | CTA | chr1 | 55044242 | 55044263 | 55044259 | 55044264 | + |
| SEQ ID NO 47087 | CATTTGAAAGACGAGGAGACTG | CTT | chr1 | 55044246 | 55044267 | 55044263 | 55044268 | + |
| SEQ ID NO 47088 | ATTTGAAAGACGAGGAGACTGA | TTC | chr1 | 55044247 | 55044268 | 55044264 | 55044269 | + |
| SEQ ID NO 47089 | GAAAGACGAGGAGACTGAAGTT | TTT | chr1 | 55044251 | 55044272 | 55044268 | 55044273 | + |
| SEQ ID NO 47090 | AAAGACGAGGAGACTGAAGTTC | TTG | chr1 | 55044252 | 55044273 | 55044269 | 55044274 | + |
| SEQ ID NO 47091 | AAGTTCAGAGGGGACCACACAG | CTG | chr1 | 55044268 | 55044289 | 55044285 | 55044290 | + |
| SEQ ID NO 47092 | AGAGGGGACCACACAGACAGCT | TTC | chr1 | 55044274 | 55044295 | 55044291 | 55044296 | + |
| SEQ ID NO 47093 | GGGGTAGAGCCTGGATCAAACC | CTA | chr1 | 55044297 | 55044318 | 55044314 | 55044319 | + |
| SEQ ID NO 47094 | GATCAAACCCATTGGTCTGCCT | CTG | chr1 | 55044310 | 55044331 | 55044327 | 55044332 | + |
| SEQ ID NO 47095 | GTCTGCCTGCCAGCCATTCTTG | TTG | chr1 | 55044324 | 55044345 | 55044341 | 55044346 | + |
| SEQ ID NO 47096 | CCTGCCAGCCATTCTTGTGCCA | CTG | chr1 | 55044329 | 55044350 | 55044346 | 55044351 | + |
| SEQ ID NO 47097 | CCAGCCATTCTTGTGCCAATGC | CTG | chr1 | 55044333 | 55044354 | 55044350 | 55044355 | + |
| SEQ ID NO 47098 | TTGTGCCAATGCATCTGCTGCC | TTC | chr1 | 55044343 | 55044364 | 55044360 | 55044365 | + |
| SEQ ID NO 47099 | GTGCCAATGCATCTGCTGCCTA | CTT | chr1 | 55044345 | 55044366 | 55044362 | 55044367 | + |
| SEQ ID NO 47100 | TGCCAATGCATCTGCTGCCTAC | TTG | chr1 | 55044346 | 55044367 | 55044363 | 55044368 | + |
| SEQ ID NO 47101 | CTGCCTACGGAAACCTGTAGGG | CTG | chr1 | 55044360 | 55044381 | 55044377 | 55044382 | + |
| SEQ ID NO 47102 | CCTACGGAAACCTGTAGGGACA | CTG | chr1 | 55044363 | 55044384 | 55044380 | 55044385 | + |
| SEQ ID NO 47103 | CGGAAACCTGTAGGGACAAGGC | CTA | chr1 | 55044367 | 55044388 | 55044384 | 55044389 | + |
| SEQ ID NO 47104 | TAGGGACAAGGCCCTGGGATGT | CTG | chr1 | 55044377 | 55044398 | 55044394 | 55044399 | + |
| SEQ ID NO 47105 | GGATGTTCAGTGGAGCCTGAGT | CTG | chr1 | 55044393 | 55044414 | 55044410 | 55044415 | + |
| SEQ ID NO 47106 | AGTGGAGCCTGAGTCATTTTAT | TTC | chr1 | 55044401 | 55044422 | 55044418 | 55044423 | + |
| SEQ ID NO 47107 | AGTCATTTTATAAAAAGCATG | CTG | chr1 | 55044412 | 55044433 | 55044429 | 55044434 | + |
| SEQ ID NO 47108 | TATAAAAAGCATGACTCTAGG | TTT | chr1 | 55044420 | 55044441 | 55044437 | 55044442 | + |
| SEQ ID NO 47109 | ATAAAAAGCATGACTCTAGGG | TTT | chr1 | 55044421 | 55044442 | 55044438 | 55044443 | + |
| SEQ ID NO 47110 | TAAAAAGCATGACTCTAGGGT | TTA | chr1 | 55044422 | 55044443 | 55044439 | 55044444 | + |
| SEQ ID NO 47111 | TAGGGTCCAAAATTCCTTTGAA | CTC | chr1 | 55044438 | 55044459 | 55044455 | 55044460 | + |
| SEQ ID NO 47112 | GGGTCCAAAATTCCTTTGAAGC | CTA | chr1 | 55044440 | 55044461 | 55044457 | 55044462 | + |
| SEQ ID NO 47113 | CTTTGAAGCTGTTGCTATCCAG | TTC | chr1 | 55044453 | 55044474 | 55044470 | 55044475 | + |
| SEQ ID NO 47114 | TGAAGCTGTTGCTATCCAGAGT | CTT | chr1 | 55044456 | 55044477 | 55044473 | 55044478 | + |
| SEQ ID NO 47115 | GAAGCTGTTGCTATCCAGAGTG | TTT | chr1 | 55044457 | 55044478 | 55044474 | 55044479 | + |
| SEQ ID NO 47116 | AAGCTGTTGCTATCCAGAGTGA | TTG | chr1 | 55044458 | 55044479 | 55044475 | 55044480 | + |
| SEQ ID NO 47117 | TTGCTATCCAGAGTGAAGTCCC | CTG | chr1 | 55044464 | 55044485 | 55044481 | 55044486 | + |
| SEQ ID NO 47118 | CTATCCAGAGTGAAGTCCCTTC | TTG | chr1 | 55044467 | 55044488 | 55044484 | 55044489 | + |
| SEQ ID NO 47119 | TCCAGAGTGAAGTCCCTTCTTT | CTA | chr1 | 55044470 | 55044491 | 55044487 | 55044492 | + |
| SEQ ID NO 47120 | CTTTAGGACAGGGTGGCCCTCC | CTT | chr1 | 55044488 | 55044509 | 55044505 | 55044510 | + |
| SEQ ID NO 47121 | TTTAGGACAGGGTGGCCCTCCT | TTC | chr1 | 55044489 | 55044510 | 55044506 | 55044511 | + |
| SEQ ID NO 47122 | TAGGACAGGGTGGCCCTCCTCC | CTT | chr1 | 55044491 | 55044512 | 55044508 | 55044513 | + |
| SEQ ID NO 47123 | AGGACAGGGTGGCCCTCCTCCC | TTT | chr1 | 55044492 | 55044513 | 55044509 | 55044514 | + |
| SEQ ID NO 47124 | GGACAGGGTGGCCCTCCTCCCT | TTA | chr1 | 55044493 | 55044514 | 55044510 | 55044515 | + |
| SEQ ID NO 47125 | CTCCCTCCTGGATGTCACATCT | CTC | chr1 | 55044509 | 55044530 | 55044526 | 55044531 | + |
| SEQ ID NO 47126 | CCTCCTGGATGTCACATCTTCG | CTC | chr1 | 55044512 | 55044533 | 55044529 | 55044534 | + |

Figure 66 (Cont'd)

| | | | | | | | | |
|---|---|---|---|---|---|---|---|---|
| SEQ ID NO 47127 | CTGGATGTCACATCTTCGGTGG | CTC | chr1 | 55044516 | 55044537 | 55044533 | 55044538 | + |
| SEQ ID NO 47128 | GATGTCACATCTTCGGTGGAGG | CTG | chr1 | 55044519 | 55044540 | 55044536 | 55044541 | + |
| SEQ ID NO 47129 | CGGTGGAGGGGCAGAAAGGGGA | CTT | chr1 | 55044532 | 55044553 | 55044549 | 55044554 | + |
| SEQ ID NO 47130 | GGTGGAGGGGCAGAAAGGGGAC | TTC | chr1 | 55044533 | 55044554 | 55044550 | 55044555 | + |
| SEQ ID NO 47131 | GGTATTCTCCTCACCCTGGCCC | CTG | chr1 | 55044557 | 55044578 | 55044574 | 55044579 | + |
| SEQ ID NO 47132 | TCCTCACCCTGGCCCTAGTGCT | TTC | chr1 | 55044564 | 55044585 | 55044581 | 55044586 | + |
| SEQ ID NO 47133 | CTCACCCTGGCCCTAGTGCTTC | CTC | chr1 | 55044566 | 55044587 | 55044583 | 55044588 | + |
| SEQ ID NO 47134 | ACCCTGGCCCTAGTGCTTCAAA | CTC | chr1 | 55044569 | 55044590 | 55044586 | 55044591 | + |
| SEQ ID NO 47135 | GCCCTAGTGCTTCAAATCTTAA | CTG | chr1 | 55044575 | 55044596 | 55044592 | 55044597 | + |
| SEQ ID NO 47136 | GTGCTTCAAATCTTAAAAAAAC | CTA | chr1 | 55044581 | 55044602 | 55044598 | 55044603 | + |
| SEQ ID NO 47137 | CAAATCTTAAAAAAACGTTTTT | CTT | chr1 | 55044587 | 55044608 | 55044604 | 55044609 | + |
| SEQ ID NO 47138 | AAATCTTAAAAAAACGTTTTTA | TTC | chr1 | 55044588 | 55044609 | 55044605 | 55044610 | + |
| SEQ ID NO 47139 | AAAAAAACGTTTTTATTTGTGC | CTT | chr1 | 55044595 | 55044616 | 55044612 | 55044617 | + |
| SEQ ID NO 47140 | AAAAAACGTTTTTATTTGTGCT | TTA | chr1 | 55044596 | 55044617 | 55044613 | 55044618 | + |
| SEQ ID NO 47141 | TTATTTGTGCTTCTGCACCACC | TTT | chr1 | 55044607 | 55044628 | 55044624 | 55044629 | + |
| SEQ ID NO 47142 | TATTTGTGCTTCTGCACCACCT | TTT | chr1 | 55044608 | 55044629 | 55044625 | 55044630 | + |
| SEQ ID NO 47143 | ATTTGTGCTTCTGCACCACCTT | TTT | chr1 | 55044609 | 55044630 | 55044626 | 55044631 | + |
| SEQ ID NO 47144 | TTTGTGCTTCTGCACCACCTTC | TTA | chr1 | 55044610 | 55044631 | 55044627 | 55044632 | + |
| SEQ ID NO 47145 | GTGCTTCTGCACCACCTTCTAG | TTT | chr1 | 55044613 | 55044634 | 55044630 | 55044635 | + |
| SEQ ID NO 47146 | TGCTTCTGCACCACCTTCTAGC | TTG | chr1 | 55044614 | 55044635 | 55044631 | 55044636 | + |
| SEQ ID NO 47147 | GAAGGTGGTGCAGAAGCACAAA | CTA | chr1 | 55044610 | 55044631 | 55044615 | 55044610 | - |
| SEQ ID NO 47148 | TTTTAAGATTTGAAGCACTAGG | TTT | chr1 | 55044577 | 55044598 | 55044582 | 55044577 | - |
| SEQ ID NO 47149 | TTTAAGATTTGAAGCACTAGGG | TTT | chr1 | 55044576 | 55044597 | 55044581 | 55044576 | - |
| SEQ ID NO 47150 | TTAAGATTTGAAGCACTAGGGC | TTT | chr1 | 55044575 | 55044596 | 55044580 | 55044575 | - |
| SEQ ID NO 47151 | TAAGATTTGAAGCACTAGGGCC | TTT | chr1 | 55044574 | 55044595 | 55044579 | 55044574 | - |
| SEQ ID NO 47152 | AAGATTTGAAGCACTAGGGCCA | TTT | chr1 | 55044573 | 55044594 | 55044578 | 55044573 | - |
| SEQ ID NO 47153 | AGATTTGAAGCACTAGGGCCAG | TTA | chr1 | 55044572 | 55044593 | 55044577 | 55044572 | - |
| SEQ ID NO 47154 | GAAGCACTAGGGCCAGGGTGAG | TTT | chr1 | 55044566 | 55044587 | 55044571 | 55044566 | - |
| SEQ ID NO 47155 | AAGCACTAGGGCCAGGGTGAGG | TTG | chr1 | 55044565 | 55044586 | 55044570 | 55044565 | - |
| SEQ ID NO 47156 | GGGCCAGGGTGAGGAGAATACC | CTA | chr1 | 55044557 | 55044578 | 55044562 | 55044557 | - |
| SEQ ID NO 47157 | TCTGCCCCTCCACCGAAGATGT | CTT | chr1 | 55044525 | 55044546 | 55044530 | 55044525 | - |
| SEQ ID NO 47158 | CTGCCCCTCCACCGAAGATGTG | TTT | chr1 | 55044524 | 55044545 | 55044529 | 55044524 | - |
| SEQ ID NO 47159 | TGCCCCTCCACCGAAGATGTGA | TTC | chr1 | 55044523 | 55044544 | 55044528 | 55044523 | - |
| SEQ ID NO 47160 | CCCCTCCACCGAAGATGTGACA | CTG | chr1 | 55044521 | 55044542 | 55044526 | 55044521 | - |
| SEQ ID NO 47161 | CACCGAAGATGTGACATCCAGG | CTC | chr1 | 55044515 | 55044536 | 55044520 | 55044515 | - |
| SEQ ID NO 47162 | TCCTAAAGAAGGGACTTCACTC | CTG | chr1 | 55044474 | 55044495 | 55044479 | 55044474 | - |
| SEQ ID NO 47163 | AAGAAGGGACTTCACTCTGGAT | CTA | chr1 | 55044469 | 55044490 | 55044474 | 55044469 | - |
| SEQ ID NO 47164 | CACTCTGGATAGCAACAGCTTC | CTT | chr1 | 55044457 | 55044478 | 55044462 | 55044457 | - |
| SEQ ID NO 47165 | ACTCTGGATAGCAACAGCTTCA | TTC | chr1 | 55044456 | 55044477 | 55044461 | 55044456 | - |
| SEQ ID NO 47166 | TGGATAGCAACAGCTTCAAAGG | CTC | chr1 | 55044452 | 55044473 | 55044457 | 55044452 | - |
| SEQ ID NO 47167 | GATAGCAACAGCTTCAAAGGAA | CTG | chr1 | 55044450 | 55044471 | 55044455 | 55044450 | - |
| SEQ ID NO 47168 | CAAAGGAATTTTGGACCCTAGA | CTT | chr1 | 55044436 | 55044457 | 55044441 | 55044436 | - |
| SEQ ID NO 47169 | AAAGGAATTTTGGACCCTAGAG | TTC | chr1 | 55044435 | 55044456 | 55044440 | 55044435 | - |
| SEQ ID NO 47170 | TGGACCCTAGAGTCATGCTTTT | TTT | chr1 | 55044425 | 55044446 | 55044430 | 55044425 | - |
| SEQ ID NO 47171 | GGACCCTAGAGTCATGCTTTTT | TTT | chr1 | 55044424 | 55044445 | 55044429 | 55044424 | - |
| SEQ ID NO 47172 | GACCCTAGAGTCATGCTTTTTT | TTG | chr1 | 55044423 | 55044444 | 55044428 | 55044423 | - |
| SEQ ID NO 47173 | GAGTCATGCTTTTTTATAAAAT | CTA | chr1 | 55044416 | 55044437 | 55044421 | 55044416 | - |
| SEQ ID NO 47174 | TTTTATAAAATGACTCAGGCTC | CTT | chr1 | 55044405 | 55044426 | 55044410 | 55044405 | - |
| SEQ ID NO 47175 | TTTATAAAATGACTCAGGCTCC | TTT | chr1 | 55044404 | 55044425 | 55044409 | 55044404 | - |
| SEQ ID NO 47176 | TTATAAAATGACTCAGGCTCCA | TTT | chr1 | 55044403 | 55044424 | 55044408 | 55044403 | - |
| SEQ ID NO 47177 | TATAAAATGACTCAGGCTCCAC | TTT | chr1 | 55044402 | 55044423 | 55044407 | 55044402 | - |
| SEQ ID NO 47178 | ATAAAATGACTCAGGCTCCACT | TTT | chr1 | 55044401 | 55044422 | 55044406 | 55044401 | - |
| SEQ ID NO 47179 | TAAAATGACTCAGGCTCCACTG | TTA | chr1 | 55044400 | 55044421 | 55044405 | 55044400 | - |
| SEQ ID NO 47180 | AGGCTCCACTGAACATCCCAGG | CTC | chr1 | 55044389 | 55044410 | 55044394 | 55044389 | - |
| SEQ ID NO 47181 | CACTGAACATCCCAGGGCCTTG | CTC | chr1 | 55044383 | 55044404 | 55044388 | 55044383 | - |
| SEQ ID NO 47182 | AACATCCCAGGGCCTTGTCCCT | CTG | chr1 | 55044378 | 55044399 | 55044383 | 55044378 | - |
| SEQ ID NO 47183 | GTCCCTACAGGTTTCCGTAGGC | CTT | chr1 | 55044362 | 55044383 | 55044367 | 55044362 | - |
| SEQ ID NO 47184 | TCCCTACAGGTTTCCGTAGGCA | TTG | chr1 | 55044361 | 55044382 | 55044366 | 55044361 | - |

Figure 66 (Cont'd)

| | | | | | | | | |
|---|---|---|---|---|---|---|---|---|
| SEQ ID NO 47185 | CAGGTTTCCGTAGGCAGCAGAT | CTA | chr1 | 55044355 | 55044376 | 55044360 | 55044355 | - |
| SEQ ID NO 47186 | CCGTAGGCAGCAGATGCATTGG | TTT | chr1 | 55044348 | 55044369 | 55044353 | 55044348 | - |
| SEQ ID NO 47187 | CGTAGGCAGCAGATGCATTGGC | TTC | chr1 | 55044347 | 55044368 | 55044352 | 55044347 | - |
| SEQ ID NO 47188 | GCACAAGAATGGCTGGCAGGCA | TTG | chr1 | 55044327 | 55044348 | 55044332 | 55044327 | - |
| SEQ ID NO 47189 | GCAGGCAGACCAATGGGTTTGA | CTG | chr1 | 55044312 | 55044333 | 55044317 | 55044312 | - |
| SEQ ID NO 47190 | GATCCAGGCTCTACCCCTAGCT | TTT | chr1 | 55044292 | 55044313 | 55044297 | 55044292 | - |
| SEQ ID NO 47191 | ATCCAGGCTCTACCCCTAGCTG | TTG | chr1 | 55044291 | 55044312 | 55044296 | 55044291 | - |
| SEQ ID NO 47192 | TACCCCTAGCTGTCTGTGTGGT | CTC | chr1 | 55044281 | 55044302 | 55044286 | 55044281 | - |
| SEQ ID NO 47193 | CCCCTAGCTGTCTGTGTGGTCC | CTA | chr1 | 55044279 | 55044300 | 55044284 | 55044279 | - |
| SEQ ID NO 47194 | GCTGTCTGTGTGGTCCCCTCTG | CTA | chr1 | 55044273 | 55044294 | 55044278 | 55044273 | - |
| SEQ ID NO 47195 | TCTGTGTGGTCCCCTCTGAACT | CTG | chr1 | 55044269 | 55044290 | 55044274 | 55044269 | - |
| SEQ ID NO 47196 | TGTGGTCCCCTCTGAACTTCAG | CTG | chr1 | 55044265 | 55044286 | 55044270 | 55044265 | - |
| SEQ ID NO 47197 | TGAACTTCAGTCTCCTCGTCTT | CTC | chr1 | 55044253 | 55044274 | 55044258 | 55044253 | - |
| SEQ ID NO 47198 | AACTTCAGTCTCCTCGTCTTTC | CTG | chr1 | 55044251 | 55044272 | 55044256 | 55044251 | - |
| SEQ ID NO 47199 | CAGTCTCCTCGTCTTTCAAATG | CTT | chr1 | 55044246 | 55044267 | 55044251 | 55044246 | - |
| SEQ ID NO 47200 | AGTCTCCTCGTCTTTCAAATGA | TTC | chr1 | 55044245 | 55044266 | 55044250 | 55044245 | - |
| SEQ ID NO 47201 | CTCGTCTTTCAAATGAAGATAG | CTC | chr1 | 55044239 | 55044260 | 55044244 | 55044239 | - |
| SEQ ID NO 47202 | GTCTTTCAAATGAAGATAGACG | CTC | chr1 | 55044236 | 55044257 | 55044241 | 55044236 | - |
| SEQ ID NO 47203 | TCAAATGAAGATAGACGTACCA | CTT | chr1 | 55044231 | 55044252 | 55044236 | 55044231 | - |
| SEQ ID NO 47204 | CAAATGAAGATAGACGTACCAC | TTT | chr1 | 55044230 | 55044251 | 55044235 | 55044230 | - |
| SEQ ID NO 47205 | AAATGAAGATAGACGTACCACT | TTC | chr1 | 55044229 | 55044250 | 55044234 | 55044229 | - |
| SEQ ID NO 47206 | GGGCATGGCCAGGCTTAAAGGG | CTG | chr1 | 55044206 | 55044227 | 55044211 | 55044206 | - |
| SEQ ID NO 47207 | AAAGGGAATTCTATACAGAAAG | CTT | chr1 | 55044190 | 55044211 | 55044195 | 55044190 | - |
| SEQ ID NO 47208 | AAGGGAATTCTATACAGAAAGC | TTA | chr1 | 55044189 | 55044210 | 55044194 | 55044189 | - |
| SEQ ID NO 47209 | TATACAGAAAGCCAGTAGTTAC | TTC | chr1 | 55044179 | 55044200 | 55044184 | 55044179 | - |
| SEQ ID NO 47210 | TACAGAAAGCCAGTAGTTACTG | CTA | chr1 | 55044177 | 55044198 | 55044182 | 55044177 | - |
| SEQ ID NO 47211 | CTGTGCTTGGTACCCGATAAGT | TTA | chr1 | 55044158 | 55044179 | 55044163 | 55044158 | - |
| SEQ ID NO 47212 | TGCTTGGTACCCGATAAGTGCT | CTG | chr1 | 55044155 | 55044176 | 55044160 | 55044155 | - |
| SEQ ID NO 47213 | GGTACCCGATAAGTGCTCAATA | CTT | chr1 | 55044150 | 55044171 | 55044155 | 55044150 | - |
| SEQ ID NO 47214 | GTACCCGATAAGTGCTCAATAC | TTG | chr1 | 55044149 | 55044170 | 55044154 | 55044149 | - |
| SEQ ID NO 47215 | AATACATACTTGCTGTCCCCTT | CTC | chr1 | 55044132 | 55044153 | 55044137 | 55044132 | - |
| SEQ ID NO 47216 | GCTGTCCCCTTCTGATTTTCAG | CTT | chr1 | 55044121 | 55044142 | 55044126 | 55044121 | - |
| SEQ ID NO 47217 | CTGTCCCCTTCTGATTTTCAGC | TTG | chr1 | 55044120 | 55044141 | 55044125 | 55044120 | - |
| SEQ ID NO 47218 | TCCCCTTCTGATTTTCAGCAAT | CTG | chr1 | 55044117 | 55044138 | 55044122 | 55044117 | - |
| SEQ ID NO 47219 | CTGATTTTCAGCAATGGGCCTA | CTT | chr1 | 55044110 | 55044131 | 55044115 | 55044110 | - |
| SEQ ID NO 47220 | TGATTTTCAGCAATGGGCCTAC | TTC | chr1 | 55044109 | 55044130 | 55044114 | 55044109 | - |
| SEQ ID NO 47221 | ATTTTCAGCAATGGGCCTACTA | CTG | chr1 | 55044107 | 55044128 | 55044112 | 55044107 | - |
| SEQ ID NO 47222 | TCAGCAATGGGCCTACTAAGCA | TTT | chr1 | 55044103 | 55044124 | 55044108 | 55044103 | - |
| SEQ ID NO 47223 | CAGCAATGGGCCTACTAAGCAC | TTT | chr1 | 55044102 | 55044123 | 55044107 | 55044102 | - |
| SEQ ID NO 47224 | AGCAATGGGCCTACTAAGCACA | TTC | chr1 | 55044101 | 55044122 | 55044106 | 55044101 | - |
| SEQ ID NO 47225 | CTAAGCACAGTCCCCAGTGTAT | CTA | chr1 | 55044088 | 55044109 | 55044093 | 55044088 | - |
| SEQ ID NO 47226 | AGCACAGTCCCCAGTGTATATG | CTA | chr1 | 55044085 | 55044106 | 55044090 | 55044085 | - |
| SEQ ID NO 47227 | TCAGGAAGTGCCATTCCCAAAA | CTA | chr1 | 55044047 | 55044068 | 55044052 | 55044047 | - |
| SEQ ID NO 47228 | CCAAAAAGGGTGGCTCACCAGC | TTC | chr1 | 55044031 | 55044052 | 55044036 | 55044031 | - |
| SEQ ID NO 47229 | ACCAGCTCCAGCAGGTCGCCAC | CTC | chr1 | 55044015 | 55044036 | 55044020 | 55044015 | - |
| SEQ ID NO 47230 | CAGCAGGTCGCCACTCATCTTC | CTC | chr1 | 55044007 | 55044028 | 55044012 | 55044007 | - |
| SEQ ID NO 47231 | ATCTTCACCAGGAAGCCAGGAA | CTC | chr1 | 55043991 | 55044012 | 55043996 | 55043991 | - |
| SEQ ID NO 47232 | CACCAGGAAGCCAGGAAGAAGG | CTT | chr1 | 55043986 | 55044007 | 55043991 | 55043986 | - |
| SEQ ID NO 47233 | ACCAGGAAGCCAGGAAGAAGGC | TTC | chr1 | 55043985 | 55044006 | 55043990 | 55043985 | - |
| SEQ ID NO 47234 | GGTGAGGTATCCCCGGCGGGCA | CTT | chr1 | 55043941 | 55043962 | 55043946 | 55043941 | - |
| SEQ ID NO 47235 | GTGAGGTATCCCCGGCGGGCAG | TTG | chr1 | 55043940 | 55043961 | 55043945 | 55043940 | - |
| SEQ ID NO 47236 | GGCCTGCAGGCGGCGGGCAGTG | CTG | chr1 | 55043914 | 55043935 | 55043919 | 55043914 | - |
| SEQ ID NO 47237 | CAGGCGGCGGGCAGTGCGCTCT | CTG | chr1 | 55043908 | 55043929 | 55043913 | 55043908 | - |
| SEQ ID NO 47238 | TGACTGCGAGAGGTGGGTCTCC | CTC | chr1 | 55043887 | 55043908 | 55043892 | 55043887 | - |
| SEQ ID NO 47239 | ACTGCGAGAGGTGGGTCTCCTC | CTG | chr1 | 55043885 | 55043906 | 55043890 | 55043885 | - |
| SEQ ID NO 47240 | CGAGAGGTGGGTCTCCTCCTTC | CTG | chr1 | 55043881 | 55043902 | 55043886 | 55043881 | - |
| SEQ ID NO 47241 | CTCCTTCAGCACCACCACGTAG | CTC | chr1 | 55043866 | 55043887 | 55043871 | 55043866 | - |
| SEQ ID NO 47242 | CTTCAGCACCACCACGTAGGTG | CTC | chr1 | 55043863 | 55043884 | 55043868 | 55043863 | - |

Figure 66 (Cont'd)

| SEQ ID NO 47243 | CAGCACCACCACGTAGGTGCCA | CTT | chr1 | 55043860 | 55043881 | 55043865 | 55043860 | - |
|---|---|---|---|---|---|---|---|---|
| SEQ ID NO 47244 | AGCACCACCACGTAGGTGCCAG | TTC | chr1 | 55043859 | 55043880 | 55043864 | 55043859 | - |
| SEQ ID NO 47245 | CACGGATCCTGGCCCCATGCAA | CTC | chr1 | 55043829 | 55043850 | 55043834 | 55043829 | - |
| SEQ ID NO 47246 | GCCCCATGCAAGGAGGAACATG | CTG | chr1 | 55043818 | 55043839 | 55043823 | 55043818 | - |
| SEQ ID NO 47247 | GGTGTACTTTATCTCACCCCTA | CTA | chr1 | 55043767 | 55043788 | 55043772 | 55043767 | - |
| SEQ ID NO 47248 | TATCTCACCCCTACTTACAAAT | CTT | chr1 | 55043758 | 55043779 | 55043763 | 55043758 | - |
| SEQ ID NO 47249 | ATCTCACCCCTACTTACAAATT | TTT | chr1 | 55043757 | 55043778 | 55043762 | 55043757 | - |
| SEQ ID NO 47250 | TCTCACCCCTACTTACAAATTA | TTA | chr1 | 55043756 | 55043777 | 55043761 | 55043756 | - |
| SEQ ID NO 47251 | ACCCCTACTTACAAATTACAAC | CTC | chr1 | 55043752 | 55043773 | 55043757 | 55043752 | - |
| SEQ ID NO 47252 | CTTACAAATTACAACAAAGAG | CTA | chr1 | 55043745 | 55043766 | 55043750 | 55043745 | - |
| SEQ ID NO 47253 | ACAAATTACAACAAAGAGACA | CTT | chr1 | 55043742 | 55043763 | 55043747 | 55043742 | - |
| SEQ ID NO 47254 | CAAATTACAACAAAGAGACAC | TTA | chr1 | 55043741 | 55043762 | 55043746 | 55043741 | - |
| SEQ ID NO 47255 | CAACAAAGAGACACAACAGAG | TTA | chr1 | 55043734 | 55043755 | 55043739 | 55043734 | - |
| SEQ ID NO 47256 | CCAAATGCGGACCAAAAAGCAA | TTA | chr1 | 55043689 | 55043710 | 55043694 | 55043689 | - |
| SEQ ID NO 47257 | AAGAACTCATATAGGCCAACTA | TTA | chr1 | 55043663 | 55043684 | 55043668 | 55043663 | - |
| SEQ ID NO 47258 | ATATAGGCCAACTATTATTATT | CTC | chr1 | 55043655 | 55043676 | 55043660 | 55043655 | - |
| SEQ ID NO 47259 | TTATTATTCACATGGTTATATA | CTA | chr1 | 55043641 | 55043662 | 55043646 | 55043641 | - |
| SEQ ID NO 47260 | TTATTCACATGGTTATATAACA | TTA | chr1 | 55043638 | 55043659 | 55043643 | 55043638 | - |
| SEQ ID NO 47261 | TTCACATGGTTATATAACACTT | TTA | chr1 | 55043635 | 55043656 | 55043640 | 55043635 | - |
| SEQ ID NO 47262 | ACATGGTTATATAACACTTTCA | TTC | chr1 | 55043632 | 55043653 | 55043637 | 55043632 | - |
| SEQ ID NO 47263 | TATAACACTTTCAAATGTGCCA | TTA | chr1 | 55043623 | 55043644 | 55043628 | 55043623 | - |
| SEQ ID NO 47264 | TCAAATGTGCCATTCAGGCAAA | CTT | chr1 | 55043613 | 55043634 | 55043618 | 55043613 | - |
| SEQ ID NO 47265 | CAAATGTGCCATTCAGGCAAAA | TTT | chr1 | 55043612 | 55043633 | 55043617 | 55043612 | - |
| SEQ ID NO 47266 | AAATGTGCCATTCAGGCAAAAA | TTC | chr1 | 55043611 | 55043632 | 55043616 | 55043611 | - |
| SEQ ID NO 47267 | AGGCAAAATGGGAACTACGGG | TTC | chr1 | 55043598 | 55043619 | 55043603 | 55043598 | - |
| SEQ ID NO 47268 | CGGGCCACACTCGACAACAGGT | CTA | chr1 | 55043580 | 55043601 | 55043585 | 55043580 | - |
| SEQ ID NO 47269 | GACAACAGGTTTTCCTCTGTAC | CTC | chr1 | 55043568 | 55043589 | 55043573 | 55043568 | - |
| SEQ ID NO 47270 | TCCTCTGTACCTGCACCCAGCT | TTT | chr1 | 55043556 | 55043577 | 55043561 | 55043556 | - |
| SEQ ID NO 47271 | CCTCTGTACCTGCACCCAGCTC | TTT | chr1 | 55043555 | 55043576 | 55043560 | 55043555 | - |
| SEQ ID NO 47272 | CTCTGTACCTGCACCCAGCTCT | TTC | chr1 | 55043554 | 55043575 | 55043559 | 55043554 | - |
| SEQ ID NO 47273 | TGTACCTGCACCCAGCTCTCTA | CTC | chr1 | 55043551 | 55043572 | 55043556 | 55043551 | - |
| SEQ ID NO 47274 | TACCTGCACCCAGCTCTCTACG | CTG | chr1 | 55043549 | 55043570 | 55043554 | 55043549 | - |
| SEQ ID NO 47275 | CACCCAGCTCTCTACGGGCCTG | CTG | chr1 | 55043543 | 55043564 | 55043548 | 55043543 | - |
| SEQ ID NO 47276 | TCTACGGGCCTGGTCGCTCCTG | CTC | chr1 | 55043533 | 55043554 | 55043538 | 55043533 | - |
| SEQ ID NO 47277 | TACGGGCCTGGTCGCTCCTGGT | CTC | chr1 | 55043531 | 55043552 | 55043536 | 55043531 | - |
| SEQ ID NO 47278 | CGGGCCTGGTCGCTCCTGGTGG | CTA | chr1 | 55043529 | 55043550 | 55043534 | 55043529 | - |
| SEQ ID NO 47279 | GTCGCTCCTGGTGGCCCTGCCC | CTG | chr1 | 55043521 | 55043542 | 55043526 | 55043521 | - |
| SEQ ID NO 47280 | CTGGTGGCCCTGCCCAAAGGCC | CTC | chr1 | 55043514 | 55043535 | 55043519 | 55043514 | - |
| SEQ ID NO 47281 | GTGGCCCTGCCCAAAGGCCACC | CTG | chr1 | 55043511 | 55043532 | 55043516 | 55043511 | - |
| SEQ ID NO 47282 | CCCAAAGGCCACCCCCTCCCCC | CTG | chr1 | 55043502 | 55043523 | 55043507 | 55043502 | - |
| SEQ ID NO 47283 | CCCCATGCCCCAGTCAGAATAA | CTC | chr1 | 55043484 | 55043505 | 55043489 | 55043484 | - |
| SEQ ID NO 47284 | AGGGAAAAATCATGGGCTTTG | TTG | chr1 | 55043458 | 55043479 | 55043463 | 55043458 | - |
| SEQ ID NO 47285 | TGGAGCCAGGAAACCGTGGACC | CTT | chr1 | 55043438 | 55043459 | 55043443 | 55043438 | - |
| SEQ ID NO 47286 | GGAGCCAGGAAACCGTGGACCT | TTT | chr1 | 55043437 | 55043458 | 55043442 | 55043437 | - |
| SEQ ID NO 47287 | GAGCCAGGAAACCGTGGACCTG | TTG | chr1 | 55043436 | 55043457 | 55043441 | 55043436 | - |
| SEQ ID NO 47288 | AATTCCAGCTCCAATATTTACT | CTG | chr1 | 55043414 | 55043435 | 55043419 | 55043414 | - |
| SEQ ID NO 47289 | CAGCTCCAATATTTACTGGTTG | TTC | chr1 | 55043409 | 55043430 | 55043414 | 55043409 | - |
| SEQ ID NO 47290 | CAATATTTACTGGTTGTGCAGC | CTC | chr1 | 55043403 | 55043424 | 55043408 | 55043403 | - |
| SEQ ID NO 47291 | ACTGGTTGTGCAGCCATGAGCA | TTT | chr1 | 55043395 | 55043416 | 55043400 | 55043395 | - |
| SEQ ID NO 47292 | CTGGTTGTGCAGCCATGAGCAA | TTA | chr1 | 55043394 | 55043415 | 55043399 | 55043394 | - |
| SEQ ID NO 47293 | GTTGTGCAGCCATGAGCAAGTC | CTG | chr1 | 55043391 | 55043412 | 55043396 | 55043391 | - |
| SEQ ID NO 47294 | TGCAGCCATGAGCAAGTCACTC | TTG | chr1 | 55043387 | 55043408 | 55043392 | 55043387 | - |
| SEQ ID NO 47295 | AACCTCTGGAGCCTCAGATAC | CTC | chr1 | 55043365 | 55043386 | 55043370 | 55043365 | - |
| SEQ ID NO 47296 | TCGGAGCCTCAGATACCTCTGC | CTC | chr1 | 55043359 | 55043380 | 55043364 | 55043359 | - |
| SEQ ID NO 47297 | GGAGCCTCAGATACCTCTGCTG | CTC | chr1 | 55043357 | 55043378 | 55043362 | 55043357 | - |
| SEQ ID NO 47298 | AGATACCTCTGCTGTATTGTAG | CTC | chr1 | 55043349 | 55043370 | 55043354 | 55043349 | - |
| SEQ ID NO 47299 | TGCTGTATTGTAGAGACCACAG | CTC | chr1 | 55043340 | 55043361 | 55043345 | 55043340 | - |
| SEQ ID NO 47300 | CTGTATTGTAGAGACCACAGTA | CTG | chr1 | 55043338 | 55043359 | 55043343 | 55043338 | - |

Figure 66 (Cont'd)

| | | | | | | | |
|---|---|---|---|---|---|---|---|
| SEQ ID NO 47301 | TATTGTAGAGACCACAGTACCT | CTG | chr1 | 55043335 | 55043356 | 55043340 | 55043335 | - |
| SEQ ID NO 47302 | TAGAGACCACAGTACCTATGAC | TTG | chr1 | 55043330 | 55043351 | 55043335 | 55043330 | - |
| SEQ ID NO 47303 | TGACATAGGCCTGCTGGGAAAG | CTA | chr1 | 55043312 | 55043333 | 55043317 | 55043312 | - |
| SEQ ID NO 47304 | CTGGGAAAGTCAAGAGTGACGG | CTG | chr1 | 55043299 | 55043320 | 55043304 | 55043299 | - |
| SEQ ID NO 47305 | GGAAAGTCAAGAGTGACGGTTA | CTG | chr1 | 55043296 | 55043317 | 55043301 | 55043296 | - |
| SEQ ID NO 47306 | TATAAATCTCCCATCCAGATGC | TTA | chr1 | 55043274 | 55043295 | 55043279 | 55043274 | - |
| SEQ ID NO 47307 | CCATCCAGATGCTCTACAAATG | CTC | chr1 | 55043264 | 55043285 | 55043269 | 55043264 | - |
| SEQ ID NO 47308 | TACAAATGCAGGCAGAAGGGAT | CTC | chr1 | 55043250 | 55043271 | 55043255 | 55043250 | - |
| SEQ ID NO 47309 | CAAATGCAGGCAGAAGGGATGA | CTA | chr1 | 55043248 | 55043269 | 55043253 | 55043248 | - |
| SEQ ID NO 47310 | AGTGAGCAAAGGCAACACTTCT | CTA | chr1 | 55043223 | 55043244 | 55043228 | 55043223 | - |
| SEQ ID NO 47311 | CTTAAAGAGAGAGAAAAGTCAA | CTT | chr1 | 55043203 | 55043224 | 55043208 | 55043203 | - |
| SEQ ID NO 47312 | TTAAAGAGAGAGAAAAGTCAAG | TTC | chr1 | 55043202 | 55043223 | 55043207 | 55043202 | - |
| SEQ ID NO 47313 | AAAGAGAGAGAAAAGTCAAGGC | CTT | chr1 | 55043200 | 55043221 | 55043205 | 55043200 | - |
| SEQ ID NO 47314 | AAGAGAGAGAAAAGTCAAGGCC | TTA | chr1 | 55043199 | 55043220 | 55043204 | 55043199 | - |
| SEQ ID NO 47315 | TCTTAGTCCTTTTGTGTTGCTA | CTG | chr1 | 55043173 | 55043194 | 55043178 | 55043173 | - |
| SEQ ID NO 47316 | AGTCCTTTTGTGTTGCTATATA | CTT | chr1 | 55043169 | 55043190 | 55043174 | 55043169 | - |
| SEQ ID NO 47317 | GTCCTTTTGTGTTGCTATATAA | TTA | chr1 | 55043168 | 55043189 | 55043173 | 55043168 | - |
| SEQ ID NO 47318 | TTGTGTTGCTATATAAAGGAAT | CTT | chr1 | 55043162 | 55043183 | 55043167 | 55043162 | - |
| SEQ ID NO 47319 | TGTGTTGCTATATAAAGGAATA | TTT | chr1 | 55043161 | 55043182 | 55043166 | 55043161 | - |
| SEQ ID NO 47320 | GTGTTGCTATATAAAGGAATAC | TTT | chr1 | 55043160 | 55043181 | 55043165 | 55043160 | - |
| SEQ ID NO 47321 | TGTTGCTATATAAAGGAATACC | TTG | chr1 | 55043159 | 55043180 | 55043164 | 55043159 | - |
| SEQ ID NO 47322 | CTATATAAAGGAATACCTGAAG | TTG | chr1 | 55043154 | 55043175 | 55043159 | 55043154 | - |
| SEQ ID NO 47323 | TATAAAGGAATACCTGAAGGTG | CTA | chr1 | 55043151 | 55043172 | 55043156 | 55043151 | - |
| SEQ ID NO 47324 | AAGGTGAGTAATTTACAAGGAA | CTG | chr1 | 55043135 | 55043156 | 55043140 | 55043135 | - |
| SEQ ID NO 47325 | ACAAGGAAAAGGGATTTATTCA | TTT | chr1 | 55043121 | 55043142 | 55043126 | 55043121 | - |
| SEQ ID NO 47326 | CAAGGAAAAGGGATTTATTCAG | TTA | chr1 | 55043120 | 55043141 | 55043125 | 55043120 | - |
| SEQ ID NO 47327 | ATTCAGCTCATGATTCTGCAAG | TTT | chr1 | 55043104 | 55043125 | 55043109 | 55043104 | - |
| SEQ ID NO 47328 | TTCAGCTCATGATTCTGCAAGC | TTA | chr1 | 55043103 | 55043124 | 55043108 | 55043103 | - |
| SEQ ID NO 47329 | AGCTCATGATTCTGCAAGCTCT | TTC | chr1 | 55043100 | 55043121 | 55043105 | 55043100 | - |
| SEQ ID NO 47330 | ATGATTCTGCAAGCTCTCCAGG | CTC | chr1 | 55043095 | 55043116 | 55043100 | 55043095 | - |
| SEQ ID NO 47331 | TGCAAGCTCTCCAGGAAGCATG | TTC | chr1 | 55043088 | 55043109 | 55043093 | 55043088 | - |
| SEQ ID NO 47332 | CAAGCTCTCCAGGAAGCATGGC | CTG | chr1 | 55043086 | 55043107 | 55043091 | 55043086 | - |
| SEQ ID NO 47333 | TCCAGGAAGCATGGCACCAGCA | CTC | chr1 | 55043079 | 55043100 | 55043084 | 55043079 | - |
| SEQ ID NO 47334 | CAGGAAGCATGGCACCAGCATC | CTC | chr1 | 55043077 | 55043098 | 55043082 | 55043077 | - |
| SEQ ID NO 47335 | CTTCTGGTGAGGGCCTTAAGCT | CTG | chr1 | 55043053 | 55043074 | 55043058 | 55043053 | - |
| SEQ ID NO 47336 | CTGGTGAGGGCCTTAAGCTGCT | CTT | chr1 | 55043050 | 55043071 | 55043055 | 55043050 | - |
| SEQ ID NO 47337 | TGGTGAGGGCCTTAAGCTGCTT | TTC | chr1 | 55043049 | 55043070 | 55043054 | 55043049 | - |
| SEQ ID NO 47338 | GTGAGGGCCTTAAGCTGCTTTC | CTG | chr1 | 55043047 | 55043068 | 55043052 | 55043047 | - |
| SEQ ID NO 47339 | AAGCTGCTTTCACTGATGGCAG | CTT | chr1 | 55043036 | 55043057 | 55043041 | 55043036 | - |
| SEQ ID NO 47340 | AGCTGCTTTCACTGATGGCAGA | TTA | chr1 | 55043035 | 55043056 | 55043040 | 55043035 | - |
| SEQ ID NO 47341 | CTTTCACTGATGGCAGAAGGTG | CTG | chr1 | 55043030 | 55043051 | 55043035 | 55043030 | - |
| SEQ ID NO 47342 | TCACTGATGGCAGAAGGTGAAG | CTT | chr1 | 55043027 | 55043048 | 55043032 | 55043027 | - |
| SEQ ID NO 47343 | CACTGATGGCAGAAGGTGAAGG | TTT | chr1 | 55043026 | 55043047 | 55043031 | 55043026 | - |
| SEQ ID NO 47344 | ACTGATGGCAGAAGGTGAAGGG | TTC | chr1 | 55043025 | 55043046 | 55043030 | 55043025 | - |
| SEQ ID NO 47345 | ATGGCAGAAGGTGAAGGGGAGC | CTG | chr1 | 55043021 | 55043042 | 55043026 | 55043021 | - |
| SEQ ID NO 47346 | CATGTGCAGAGATCAATCACAT | CTA | chr1 | 55042996 | 55043017 | 55043001 | 55042996 | - |
| SEQ ID NO 47347 | TTTTTAATAATCAGCCTTCAAG | CTC | chr1 | 55042930 | 55042951 | 55042935 | 55042930 | - |
| SEQ ID NO 47348 | TTTAATAATCAGCCTTCAAGGG | CTT | chr1 | 55042928 | 55042949 | 55042933 | 55042928 | - |
| SEQ ID NO 47349 | TTAATAATCAGCCTTCAAGGGA | TTT | chr1 | 55042927 | 55042948 | 55042932 | 55042927 | - |
| SEQ ID NO 47350 | TAATAATCAGCCTTCAAGGGAA | TTT | chr1 | 55042926 | 55042947 | 55042931 | 55042926 | - |
| SEQ ID NO 47351 | AATAATCAGCCTTCAAGGGAAA | TTT | chr1 | 55042925 | 55042946 | 55042930 | 55042925 | - |
| SEQ ID NO 47352 | ATAATCAGCCTTCAAGGGAAAT | TTA | chr1 | 55042924 | 55042945 | 55042929 | 55042924 | - |
| SEQ ID NO 47353 | CAAGGGAAATCATAGCGGGAGA | CTT | chr1 | 55042912 | 55042933 | 55042917 | 55042912 | - |
| SEQ ID NO 47354 | AAGGGAAATCATAGCGGGAGAA | TTC | chr1 | 55042911 | 55042932 | 55042916 | 55042911 | - |
| SEQ ID NO 47355 | ACTCATTATCACAAGGACGGCA | CTT | chr1 | 55042886 | 55042907 | 55042891 | 55042886 | - |
| SEQ ID NO 47356 | CTCATTATCACAAGGACGGCAC | TTA | chr1 | 55042885 | 55042906 | 55042890 | 55042885 | - |
| SEQ ID NO 47357 | ATTATCACAAGGACGGCACCAA | CTC | chr1 | 55042882 | 55042903 | 55042887 | 55042882 | - |
| SEQ ID NO 47358 | TCACAAGGACGGCACCAAGCCT | TTA | chr1 | 55042878 | 55042899 | 55042883 | 55042878 | - |

Figure 66 (Cont'd)

| SEQ ID NO 47359 | TCACAGGGGTTCCTCCCCCATG | CTT | chr1 | 55042855 | 55042876 | 55042860 | 55042855 | - |
|---|---|---|---|---|---|---|---|---|
| SEQ ID NO 47360 | CACAGGGGTTCCTCCCCCATGA | TTT | chr1 | 55042854 | 55042875 | 55042859 | 55042854 | - |
| SEQ ID NO 47361 | ACAGGGGTTCCTCCCCCATGAC | TTC | chr1 | 55042853 | 55042874 | 55042858 | 55042853 | - |
| SEQ ID NO 47362 | CTCCCCCATGACCCAAACACCT | TTC | chr1 | 55042843 | 55042864 | 55042848 | 55042843 | - |
| SEQ ID NO 47363 | CCCCATGACCCAAACACCTCCC | CTC | chr1 | 55042840 | 55042861 | 55042845 | 55042840 | - |
| SEQ ID NO 47364 | CCATTAGGCCCCACTTCCAACA | CTC | chr1 | 55042820 | 55042841 | 55042825 | 55042820 | - |
| SEQ ID NO 47365 | GGCCCCACTTCCAACACTGAGG | TTA | chr1 | 55042814 | 55042835 | 55042819 | 55042814 | - |
| SEQ ID NO 47366 | CCAACACTGAGGACCAAATTTC | CTT | chr1 | 55042804 | 55042825 | 55042809 | 55042804 | - |
| SEQ ID NO 47367 | CAACACTGAGGACCAAATTTCC | TTC | chr1 | 55042803 | 55042824 | 55042808 | 55042803 | - |
| SEQ ID NO 47368 | AGGACCAAATTTCCACATGAGA | CTG | chr1 | 55042795 | 55042816 | 55042800 | 55042795 | - |
| SEQ ID NO 47369 | CCACATGAGATTTGGAGGGGAC | TTT | chr1 | 55042783 | 55042804 | 55042788 | 55042783 | - |
| SEQ ID NO 47370 | CACATGAGATTTGGAGGGGACA | TTC | chr1 | 55042782 | 55042803 | 55042787 | 55042782 | - |
| SEQ ID NO 47371 | GGAGGGGACAAACAAATTATAG | TTT | chr1 | 55042770 | 55042791 | 55042775 | 55042770 | - |
| SEQ ID NO 47372 | GAGGGGACAAACAAATTATAGC | TTG | chr1 | 55042769 | 55042790 | 55042774 | 55042769 | - |
| SEQ ID NO 47373 | TAGCAGCCACTATCTATGGTGA | TTA | chr1 | 55042751 | 55042772 | 55042756 | 55042751 | - |
| SEQ ID NO 47374 | TCTATGGTGATTTGTTTGGTTT | CTA | chr1 | 55042739 | 55042760 | 55042744 | 55042739 | - |
| SEQ ID NO 47375 | TGGTGATTTGTTTGGTTTTTAG | CTA | chr1 | 55042735 | 55042756 | 55042740 | 55042735 | - |
| SEQ ID NO 47376 | GTTTGGTTTTTAGCTCTTGTCT | TTT | chr1 | 55042726 | 55042747 | 55042731 | 55042726 | - |
| SEQ ID NO 47377 | TTTGGTTTTTAGCTCTTGTCTG | TTG | chr1 | 55042725 | 55042746 | 55042730 | 55042725 | - |
| SEQ ID NO 47378 | GGTTTTTAGCTCTTGTCTGCTC | TTT | chr1 | 55042722 | 55042743 | 55042727 | 55042722 | - |
| SEQ ID NO 47379 | GTTTTTAGCTCTTGTCTGCTCC | TTG | chr1 | 55042721 | 55042742 | 55042726 | 55042721 | - |
| SEQ ID NO 47380 | TTAGCTCTTGTCTGCTCCAACT | TTT | chr1 | 55042717 | 55042738 | 55042722 | 55042717 | - |
| SEQ ID NO 47381 | TAGCTCTTGTCTGCTCCAACTG | TTT | chr1 | 55042716 | 55042737 | 55042721 | 55042716 | - |
| SEQ ID NO 47382 | AGCTCTTGTCTGCTCCAACTGC | TTT | chr1 | 55042715 | 55042736 | 55042720 | 55042715 | - |
| SEQ ID NO 47383 | GCTCTTGTCTGCTCCAACTGCT | TTA | chr1 | 55042714 | 55042735 | 55042719 | 55042714 | - |
| SEQ ID NO 47384 | TTGTCTGCTCCAACTGCTCTCA | CTC | chr1 | 55042710 | 55042731 | 55042715 | 55042710 | - |
| SEQ ID NO 47385 | GTCTGCTCCAACTGCTCTCAGG | CTT | chr1 | 55042708 | 55042729 | 55042713 | 55042708 | - |
| SEQ ID NO 47386 | TCTGCTCCAACTGCTCTCAGGC | TTG | chr1 | 55042707 | 55042728 | 55042712 | 55042707 | - |
| SEQ ID NO 47387 | CTCCAACTGCTCTCAGGCAGAC | CTG | chr1 | 55042703 | 55042724 | 55042708 | 55042703 | - |
| SEQ ID NO 47388 | CAACTGCTCTCAGGCAGACATA | CTC | chr1 | 55042700 | 55042721 | 55042705 | 55042700 | - |
| SEQ ID NO 47389 | CTCTCAGGCAGACATACCTGCT | CTG | chr1 | 55042694 | 55042715 | 55042699 | 55042694 | - |
| SEQ ID NO 47390 | TCAGGCAGACATACCTGCTTAA | CTC | chr1 | 55042691 | 55042712 | 55042696 | 55042691 | - |
| SEQ ID NO 47391 | AGGCAGACATACCTGCTTAAGA | CTC | chr1 | 55042689 | 55042710 | 55042694 | 55042689 | - |
| SEQ ID NO 47392 | CTTAAGAACCTTCACTGGCTCC | CTG | chr1 | 55042674 | 55042695 | 55042679 | 55042674 | - |
| SEQ ID NO 47393 | AAGAACCTTCACTGGCTCCCCA | CTT | chr1 | 55042671 | 55042692 | 55042676 | 55042671 | - |
| SEQ ID NO 47394 | AGAACCTTCACTGGCTCCCCAC | TTA | chr1 | 55042670 | 55042691 | 55042675 | 55042670 | - |
| SEQ ID NO 47395 | CACTGGCTCCCCACAGCCTCAT | CTT | chr1 | 55042662 | 55042683 | 55042667 | 55042662 | - |
| SEQ ID NO 47396 | ACTGGCTCCCCACAGCCTCATG | TTC | chr1 | 55042661 | 55042682 | 55042666 | 55042661 | - |
| SEQ ID NO 47397 | GCTCCCCACAGCCTCATGAATC | CTG | chr1 | 55042657 | 55042678 | 55042662 | 55042657 | - |
| SEQ ID NO 47398 | CCCACAGCCTCATGAATCAAGT | CTC | chr1 | 55042653 | 55042674 | 55042658 | 55042653 | - |
| SEQ ID NO 47399 | ATGAATCAAGTCCAAACTCCAT | CTC | chr1 | 55042642 | 55042663 | 55042647 | 55042642 | - |
| SEQ ID NO 47400 | CATGCTCCTCCTTGGCCCCTAC | CTC | chr1 | 55042623 | 55042644 | 55042628 | 55042623 | - |
| SEQ ID NO 47401 | CTCCTTGGCCCCTACCTCAACC | CTC | chr1 | 55042616 | 55042637 | 55042621 | 55042616 | - |
| SEQ ID NO 47402 | CTTGGCCCCTACCTCAACCTAC | CTC | chr1 | 55042613 | 55042634 | 55042618 | 55042613 | - |
| SEQ ID NO 47403 | GGCCCCTACCTCAACCTACCTT | CTT | chr1 | 55042610 | 55042631 | 55042615 | 55042610 | - |
| SEQ ID NO 47404 | GCCCCTACCTCAACCTACCTTG | TTG | chr1 | 55042609 | 55042630 | 55042614 | 55042609 | - |
| SEQ ID NO 47405 | CCTCAACCTACCTTGCAGCCCC | CTA | chr1 | 55042602 | 55042623 | 55042607 | 55042602 | - |
| SEQ ID NO 47406 | AACCTACCTTGCAGCCCCATCA | CTC | chr1 | 55042598 | 55042619 | 55042603 | 55042598 | - |
| SEQ ID NO 47407 | CCTTGCAGCCCCATCACCCATA | CTA | chr1 | 55042592 | 55042613 | 55042597 | 55042592 | - |
| SEQ ID NO 47408 | GCAGCCCCATCACCCATATCTC | CTT | chr1 | 55042588 | 55042609 | 55042593 | 55042588 | - |
| SEQ ID NO 47409 | CAGCCCCATCACCCATATCTCT | TTG | chr1 | 55042587 | 55042608 | 55042592 | 55042587 | - |
| SEQ ID NO 47410 | TGTATATATGCATCTTGGACTC | CTC | chr1 | 55042566 | 55042587 | 55042571 | 55042566 | - |
| SEQ ID NO 47411 | TATATATGCATCTTGGACTCCA | CTG | chr1 | 55042564 | 55042585 | 55042569 | 55042564 | - |
| SEQ ID NO 47412 | GGACTCCAGTCAGAGTAGAACA | CTT | chr1 | 55042550 | 55042571 | 55042555 | 55042550 | - |
| SEQ ID NO 47413 | GACTCCAGTCAGAGTAGAACAG | TTG | chr1 | 55042549 | 55042570 | 55042554 | 55042549 | - |
| SEQ ID NO 47414 | CAGTCAGAGTAGAACAGAGTCC | CTC | chr1 | 55042544 | 55042565 | 55042549 | 55042544 | - |
| SEQ ID NO 47415 | TACCCAAAGCCTTAGGGCCAAA | CTT | chr1 | 55042514 | 55042535 | 55042519 | 55042514 | - |
| SEQ ID NO 47416 | ACCCAAAGCCTTAGGGCCAAAA | TTT | chr1 | 55042513 | 55042534 | 55042518 | 55042513 | - |

Figure 66 (Cont'd)

| | | | | | | | | |
|---|---|---|---|---|---|---|---|---|
| SEQ ID NO 47417 | CCCAAAGCCTTAGGGCCAAAAC | TTA | chr1 | 55042512 | 55042533 | 55042517 | 55042512 | - |
| SEQ ID NO 47418 | AGGGCCAAAACGGTTTTGAACC | CTT | chr1 | 55042501 | 55042522 | 55042506 | 55042501 | - |
| SEQ ID NO 47419 | GGGCCAAAACGGTTTTGAACCT | TTA | chr1 | 55042500 | 55042521 | 55042505 | 55042500 | - |
| SEQ ID NO 47420 | TGAACCTCAGAACTTGTTTGGA | TTT | chr1 | 55042485 | 55042506 | 55042490 | 55042485 | - |
| SEQ ID NO 47421 | GAACCTCAGAACTTGTTTGGAT | TTT | chr1 | 55042484 | 55042505 | 55042489 | 55042484 | - |
| SEQ ID NO 47422 | AACCTCAGAACTTGTTTGGATT | TTG | chr1 | 55042483 | 55042504 | 55042488 | 55042483 | - |
| SEQ ID NO 47423 | AGAACTTGTTTGGATTTTAGAA | CTC | chr1 | 55042477 | 55042498 | 55042482 | 55042477 | - |
| SEQ ID NO 47424 | GTTTGGATTTTAGAAAGGCAGT | CTT | chr1 | 55042470 | 55042491 | 55042475 | 55042470 | - |
| SEQ ID NO 47425 | TTTGGATTTTAGAAAGGCAGTA | TTG | chr1 | 55042469 | 55042490 | 55042474 | 55042469 | - |
| SEQ ID NO 47426 | GGATTTTAGAAAGGCAGTAATG | TTT | chr1 | 55042466 | 55042487 | 55042471 | 55042466 | - |
| SEQ ID NO 47427 | GATTTTAGAAAGGCAGTAATGG | TTG | chr1 | 55042465 | 55042486 | 55042470 | 55042465 | - |
| SEQ ID NO 47428 | TAGAAAGGCAGTAATGGGCAAT | TTT | chr1 | 55042460 | 55042481 | 55042465 | 55042460 | - |
| SEQ ID NO 47429 | AGAAAGGCAGTAATGGGCAATC | TTT | chr1 | 55042459 | 55042480 | 55042464 | 55042459 | - |
| SEQ ID NO 47430 | GAAAGGCAGTAATGGGCAATCA | TTA | chr1 | 55042458 | 55042479 | 55042463 | 55042458 | - |
| SEQ ID NO 47431 | CTTGGAAGAATCTGGAGCTGCA | CTG | chr1 | 55042429 | 55042450 | 55042434 | 55042429 | - |
| SEQ ID NO 47432 | GGAAGAATCTGGAGCTGCATAC | CTT | chr1 | 55042426 | 55042447 | 55042431 | 55042426 | - |
| SEQ ID NO 47433 | GAAGAATCTGGAGCTGCATACT | TTG | chr1 | 55042425 | 55042446 | 55042430 | 55042425 | - |
| SEQ ID NO 47434 | GAGCTGCATACTGTAATCTATG | CTG | chr1 | 55042415 | 55042436 | 55042420 | 55042415 | - |
| SEQ ID NO 47435 | CATACTGTAATCTATGCAGCAA | CTG | chr1 | 55042409 | 55042430 | 55042414 | 55042409 | - |
| SEQ ID NO 47436 | TAATCTATGCAGCAAAATATAT | CTG | chr1 | 55042402 | 55042423 | 55042407 | 55042402 | - |
| SEQ ID NO 47437 | TGCAGCAAAATATATGAATATG | CTA | chr1 | 55042395 | 55042416 | 55042400 | 55042395 | - |
| SEQ ID NO 47438 | ACACAACTAAATTAAAAATAAT | TTC | chr1 | 55042366 | 55042387 | 55042371 | 55042366 | - |
| SEQ ID NO 47439 | AATTAAAAATAATCTCATGTCA | CTA | chr1 | 55042357 | 55042378 | 55042362 | 55042357 | - |
| SEQ ID NO 47440 | AAAATAATCTCATGTCAGTTCA | TTA | chr1 | 55042352 | 55042373 | 55042357 | 55042352 | - |
| SEQ ID NO 47441 | ATGTCAGTTCACGTCAGGTGCT | CTC | chr1 | 55042341 | 55042362 | 55042346 | 55042341 | - |
| SEQ ID NO 47442 | ACGTCAGGTGCTACCATCAAAT | TTC | chr1 | 55042331 | 55042352 | 55042336 | 55042331 | - |
| SEQ ID NO 47443 | CCATCAAATAAATCACAAAAAA | CTA | chr1 | 55042318 | 55042339 | 55042323 | 55042318 | - |
| SEQ ID NO 47444 | TTGGTTTTCGTAACATTTTACA | CTT | chr1 | 55042291 | 55042312 | 55042296 | 55042291 | - |
| SEQ ID NO 47445 | TGGTTTTCGTAACATTTTACAT | TTT | chr1 | 55042290 | 55042311 | 55042295 | 55042290 | - |
| SEQ ID NO 47446 | GGTTTTCGTAACATTTTACATT | TTT | chr1 | 55042289 | 55042310 | 55042294 | 55042289 | - |
| SEQ ID NO 47447 | GTTTTCGTAACATTTTACATTT | TTG | chr1 | 55042288 | 55042309 | 55042293 | 55042288 | - |
| SEQ ID NO 47448 | TCGTAACATTTTACATTTCAGA | TTT | chr1 | 55042284 | 55042305 | 55042289 | 55042284 | - |
| SEQ ID NO 47449 | CGTAACATTTTACATTTCAGAC | TTT | chr1 | 55042283 | 55042304 | 55042288 | 55042283 | - |
| SEQ ID NO 47450 | GTAACATTTTACATTTCAGACG | TTC | chr1 | 55042282 | 55042303 | 55042287 | 55042282 | - |
| SEQ ID NO 47451 | TACATTTCAGACGGTGGATAAA | TTT | chr1 | 55042273 | 55042294 | 55042278 | 55042273 | - |
| SEQ ID NO 47452 | ACATTTCAGACGGTGGATAAAG | TTT | chr1 | 55042272 | 55042293 | 55042277 | 55042272 | - |
| SEQ ID NO 47453 | CATTTCAGACGGTGGATAAAGA | TTA | chr1 | 55042271 | 55042292 | 55042276 | 55042271 | - |
| SEQ ID NO 47454 | CAGACGGTGGATAAAGAACTGT | TTT | chr1 | 55042266 | 55042287 | 55042271 | 55042266 | - |
| SEQ ID NO 47455 | AGACGGTGGATAAAGAACTGTG | TTC | chr1 | 55042265 | 55042286 | 55042270 | 55042265 | - |
| SEQ ID NO 47456 | TGGAGGCCAGGCGTGGTGGCTC | CTG | chr1 | 55042245 | 55042266 | 55042250 | 55042245 | - |
| SEQ ID NO 47457 | ACACCTGTAATTCGAGCACTTT | CTC | chr1 | 55042223 | 55042244 | 55042228 | 55042223 | - |
| SEQ ID NO 47458 | TAATTCGAGCACTTTGGGAGGC | CTG | chr1 | 55042216 | 55042237 | 55042221 | 55042216 | - |
| SEQ ID NO 47459 | GAGCACTTTGGGAGGCTGAGGC | TTC | chr1 | 55042210 | 55042231 | 55042215 | 55042210 | - |
| SEQ ID NO 47460 | TGGGAGGCTGAGGCGGGAGGAT | CTT | chr1 | 55042202 | 55042223 | 55042207 | 55042202 | - |
| SEQ ID NO 47461 | GGGAGGCTGAGGCGGGAGGATC | TTT | chr1 | 55042201 | 55042222 | 55042206 | 55042201 | - |
| SEQ ID NO 47462 | GGAGGCTGAGGCGGGAGGATCA | TTG | chr1 | 55042200 | 55042221 | 55042205 | 55042200 | - |
| SEQ ID NO 47463 | AGGCGGGAGGATCACCTCCTCG | CTG | chr1 | 55042192 | 55042213 | 55042197 | 55042192 | - |
| SEQ ID NO 47464 | CTCGGATCCACTGAGGAGGTCA | CTC | chr1 | 55042174 | 55042195 | 55042179 | 55042174 | - |
| SEQ ID NO 47465 | GGATCCACTGAGGAGGTCAGGA | CTC | chr1 | 55042171 | 55042192 | 55042176 | 55042171 | - |
| SEQ ID NO 47466 | AGGAGGTCAGGAGTTTGCGACT | CTG | chr1 | 55042161 | 55042182 | 55042166 | 55042161 | - |
| SEQ ID NO 47467 | GCGACTAGCCTGGCCAACGTGG | TTT | chr1 | 55042145 | 55042166 | 55042150 | 55042145 | - |
| SEQ ID NO 47468 | CGACTAGCCTGGCCAACGTGGT | TTG | chr1 | 55042144 | 55042165 | 55042149 | 55042144 | - |
| SEQ ID NO 47469 | GCCTGGCCAACGTGGTGAAACC | CTA | chr1 | 55042138 | 55042159 | 55042143 | 55042138 | - |
| SEQ ID NO 47470 | GCCAACGTGGTGAAACCCCTTC | CTG | chr1 | 55042133 | 55042154 | 55042138 | 55042133 | - |
| SEQ ID NO 47471 | CTCTACTAAAAATACAAAAATT | CTT | chr1 | 55042112 | 55042133 | 55042117 | 55042112 | - |
| SEQ ID NO 47472 | TCTACTAAAAATACAAAAATTA | TTC | chr1 | 55042111 | 55042132 | 55042116 | 55042111 | - |
| SEQ ID NO 47473 | TACTAAAAATACAAAAATTAGC | CTC | chr1 | 55042109 | 55042130 | 55042114 | 55042109 | - |
| SEQ ID NO 47474 | CTAAAAATACAAAAATTAGCCG | CTA | chr1 | 55042107 | 55042128 | 55042112 | 55042107 | - |

Figure 66 (Cont'd)

| | | | | | | | | |
|---|---|---|---|---|---|---|---|---|
| SEQ ID NO 47475 | AAAATACAAAAATTAGCCGGGC | CTA | chr1 | 55042104 | 55042125 | 55042109 | 55042104 | - |
| SEQ ID NO 47476 | GCCGGGCGTGGTGGCAGGTACC | TTA | chr1 | 55042089 | 55042110 | 55042094 | 55042089 | - |
| SEQ ID NO 47477 | TAATCCCAGCTTCTTGGGAGGC | CTG | chr1 | 55042065 | 55042086 | 55042070 | 55042065 | - |
| SEQ ID NO 47478 | CTTGGGAGGCTGAGGCAGGAGA | CTT | chr1 | 55042053 | 55042074 | 55042058 | 55042053 | - |
| SEQ ID NO 47479 | TTGGGAGGCTGAGGCAGGAGAA | TTC | chr1 | 55042052 | 55042073 | 55042057 | 55042052 | - |
| SEQ ID NO 47480 | GGGAGGCTGAGGCAGGAGAACC | CTT | chr1 | 55042050 | 55042071 | 55042055 | 55042050 | - |
| SEQ ID NO 47481 | GGAGGCTGAGGCAGGAGAACCA | TTG | chr1 | 55042049 | 55042070 | 55042054 | 55042049 | - |
| SEQ ID NO 47482 | AGGCAGGAGAACCACTTGAACC | CTG | chr1 | 55042041 | 55042062 | 55042046 | 55042041 | - |
| SEQ ID NO 47483 | GAACCCGGGAGACAGATGTTGC | CTT | chr1 | 55042024 | 55042045 | 55042029 | 55042024 | - |
| SEQ ID NO 47484 | AACCCGGGAGACAGATGTTGCA | TTG | chr1 | 55042023 | 55042044 | 55042028 | 55042023 | - |
| SEQ ID NO 47485 | CAGTGAGCTGAGACTGCACCAT | TTG | chr1 | 55042003 | 55042024 | 55042008 | 55042003 | - |
| SEQ ID NO 47486 | AGACTGCACCATTGCACTCCAG | CTG | chr1 | 55041993 | 55042014 | 55041998 | 55041993 | - |
| SEQ ID NO 47487 | CACCATTGCACTCCAGCCTGGG | CTG | chr1 | 55041987 | 55042008 | 55041992 | 55041987 | - |
| SEQ ID NO 47488 | CACTCCAGCCTGGGCAACAAGA | TTG | chr1 | 55041979 | 55042000 | 55041984 | 55041979 | - |
| SEQ ID NO 47489 | CAGCCTGGGCAACAAGAGCGAA | CTC | chr1 | 55041974 | 55041995 | 55041979 | 55041974 | - |
| SEQ ID NO 47490 | GGCAACAAGAGCGAAACTCCAT | CTG | chr1 | 55041967 | 55041988 | 55041972 | 55041967 | - |
| SEQ ID NO 47491 | CATCTCAAAAAAAAAGAAAAA | CTC | chr1 | 55041948 | 55041969 | 55041953 | 55041948 | - |
| SEQ ID NO 47492 | AAAAAAAAAGAAAAAGAACTG | CTC | chr1 | 55041942 | 55041963 | 55041947 | 55041942 | - |
| SEQ ID NO 47493 | TGGACATGTGCTCCTTATCTTC | CTG | chr1 | 55041920 | 55041941 | 55041925 | 55041920 | - |
| SEQ ID NO 47494 | CTTATCTTCCACCTCTGGTTTT | CTC | chr1 | 55041907 | 55041928 | 55041912 | 55041907 | - |
| SEQ ID NO 47495 | ATCTTCCACCTCTGGTTTTCCC | CTT | chr1 | 55041904 | 55041925 | 55041909 | 55041904 | - |
| SEQ ID NO 47496 | TCTTCCACCTCTGGTTTTCCCA | TTA | chr1 | 55041903 | 55041924 | 55041908 | 55041903 | - |
| SEQ ID NO 47497 | CCACCTCTGGTTTTCCCAGCTC | CTT | chr1 | 55041899 | 55041920 | 55041904 | 55041899 | - |
| SEQ ID NO 47498 | CACCTCTGGTTTTCCCAGCTCT | TTC | chr1 | 55041898 | 55041919 | 55041903 | 55041898 | - |
| SEQ ID NO 47499 | TGGTTTTCCCAGCTCTGTATCT | CTC | chr1 | 55041892 | 55041913 | 55041897 | 55041892 | - |
| SEQ ID NO 47500 | GTTTTCCCAGCTCTGTATCTTT | CTG | chr1 | 55041890 | 55041911 | 55041895 | 55041890 | - |
| SEQ ID NO 47501 | TCCCAGCTCTGTATCTTTGTTC | TTT | chr1 | 55041886 | 55041907 | 55041891 | 55041886 | - |
| SEQ ID NO 47502 | CCCAGCTCTGTATCTTTGTTCA | TTT | chr1 | 55041885 | 55041906 | 55041890 | 55041885 | - |
| SEQ ID NO 47503 | CCAGCTCTGTATCTTTGTTCAT | TTC | chr1 | 55041884 | 55041905 | 55041889 | 55041884 | - |
| SEQ ID NO 47504 | TGTATCTTTGTTCATGGTACCT | CTC | chr1 | 55041877 | 55041898 | 55041882 | 55041877 | - |
| SEQ ID NO 47505 | TATCTTTGTTCATGGTACCTCC | CTG | chr1 | 55041875 | 55041896 | 55041880 | 55041875 | - |
| SEQ ID NO 47506 | TGTTCATGGTACCTCCTAATCC | CTT | chr1 | 55041869 | 55041890 | 55041874 | 55041869 | - |
| SEQ ID NO 47507 | GTTCATGGTACCTCCTAATCCT | TTT | chr1 | 55041868 | 55041889 | 55041873 | 55041868 | - |
| SEQ ID NO 47508 | TTCATGGTACCTCCTAATCCTA | TTG | chr1 | 55041867 | 55041888 | 55041872 | 55041867 | - |
| SEQ ID NO 47509 | ATGGTACCTCCTAATCCTAGAA | TTC | chr1 | 55041864 | 55041885 | 55041869 | 55041864 | - |
| SEQ ID NO 47510 | CTAATCCTAGAATAAATTCTC | CTC | chr1 | 55041854 | 55041875 | 55041859 | 55041854 | - |
| SEQ ID NO 47511 | ATCCTAGAATAAATTCTCATG | CTA | chr1 | 55041851 | 55041872 | 55041856 | 55041851 | - |
| SEQ ID NO 47512 | GAATAAAATTCTCATGACACCA | CTA | chr1 | 55041845 | 55041866 | 55041850 | 55041845 | - |
| SEQ ID NO 47513 | TCATGACACCATCATCGCTGAA | TTC | chr1 | 55041834 | 55041855 | 55041839 | 55041834 | - |
| SEQ ID NO 47514 | ATGACACCATCATCGCTGAACT | CTC | chr1 | 55041832 | 55041853 | 55041837 | 55041832 | - |
| SEQ ID NO 47515 | AACTCCTACTAATGCTTCAAAG | CTG | chr1 | 55041814 | 55041835 | 55041819 | 55041814 | - |
| SEQ ID NO 47516 | CTACTAATGCTTCAAAGACCCA | CTC | chr1 | 55041809 | 55041830 | 55041814 | 55041809 | - |
| SEQ ID NO 47517 | CTAATGCTTCAAAGACCCATCT | CTA | chr1 | 55041806 | 55041827 | 55041811 | 55041806 | - |
| SEQ ID NO 47518 | ATGCTTCAAAGACCCATCTGAA | CTA | chr1 | 55041803 | 55041824 | 55041808 | 55041803 | - |
| SEQ ID NO 47519 | CAAAGACCCATCTGAAAATGCC | CTT | chr1 | 55041797 | 55041818 | 55041802 | 55041797 | - |
| SEQ ID NO 47520 | AAAGACCCATCTGAAAATGCCT | TTC | chr1 | 55041796 | 55041817 | 55041801 | 55041796 | - |
| SEQ ID NO 47521 | AAAATGCCTTCCGCTAAATAAA | CTG | chr1 | 55041783 | 55041804 | 55041788 | 55041783 | - |
| SEQ ID NO 47522 | CCGCTAAATAAAAATTGAATGA | CTT | chr1 | 55041773 | 55041794 | 55041778 | 55041773 | - |
| SEQ ID NO 47523 | CGCTAAATAAAAATTGAATGAA | TTC | chr1 | 55041772 | 55041793 | 55041777 | 55041772 | - |
| SEQ ID NO 47524 | AATAAAAATTGAATGAATTGGG | CTA | chr1 | 55041767 | 55041788 | 55041772 | 55041767 | - |
| SEQ ID NO 47525 | AATGAATTGGGAGAGTACTCTG | TTG | chr1 | 55041756 | 55041777 | 55041761 | 55041756 | - |
| SEQ ID NO 47526 | GGAGAGTACTCTGTGCAGTGGA | TTG | chr1 | 55041747 | 55041768 | 55041752 | 55041747 | - |
| SEQ ID NO 47527 | TGTGCAGTGGAGTGTCAGTTCT | CTC | chr1 | 55041736 | 55041757 | 55041741 | 55041736 | - |
| SEQ ID NO 47528 | TGCAGTGGAGTGTCAGTTCTGG | CTG | chr1 | 55041734 | 55041755 | 55041739 | 55041734 | - |
| SEQ ID NO 47529 | TGGAAACCCAGTTCTAATGCAC | TTC | chr1 | 55041715 | 55041736 | 55041720 | 55041715 | - |
| SEQ ID NO 47530 | GAAACCCAGTTCTAATGCACCT | CTG | chr1 | 55041713 | 55041734 | 55041718 | 55041713 | - |
| SEQ ID NO 47531 | TAATGCACCTGGGGTGACCTCC | TTC | chr1 | 55041701 | 55041722 | 55041706 | 55041701 | - |
| SEQ ID NO 47532 | ATGCACCTGGGGTGACCTCCTC | CTA | chr1 | 55041699 | 55041720 | 55041704 | 55041699 | - |

Figure 66 (Cont'd)

| | | | | | | | | |
|---|---|---|---|---|---|---|---|---|
| SEQ ID NO 47533 | GGGTGACCTCCTCTCTCTGGGC | CTG | chr1 | 55041690 | 55041711 | 55041695 | 55041690 | - |
| SEQ ID NO 47534 | CTCTCTCTGGGCCTCAGTTTCT | CTC | chr1 | 55041680 | 55041701 | 55041685 | 55041680 | - |
| SEQ ID NO 47535 | TCTCTGGGCCTCAGTTTCTCAT | CTC | chr1 | 55041677 | 55041698 | 55041682 | 55041677 | - |
| SEQ ID NO 47536 | TCTGGGCCTCAGTTTCTCATGA | CTC | chr1 | 55041675 | 55041696 | 55041680 | 55041675 | - |
| SEQ ID NO 47537 | TGGGCCTCAGTTTCTCATGACT | CTC | chr1 | 55041673 | 55041694 | 55041678 | 55041673 | - |
| SEQ ID NO 47538 | GGCCTCAGTTTCTCATGACTAA | CTG | chr1 | 55041671 | 55041692 | 55041676 | 55041671 | - |
| SEQ ID NO 47539 | AGTTTCTCATGACTAAAAGAAA | CTC | chr1 | 55041665 | 55041686 | 55041670 | 55041665 | - |
| SEQ ID NO 47540 | CTCATGACTAAAAGAAAGGAT | TTT | chr1 | 55041660 | 55041681 | 55041665 | 55041660 | - |
| SEQ ID NO 47541 | TCATGACTAAAAGAAAGGATT | TTC | chr1 | 55041659 | 55041680 | 55041664 | 55041659 | - |
| SEQ ID NO 47542 | ATGACTAAAAGAAAGGATTGG | CTC | chr1 | 55041657 | 55041678 | 55041662 | 55041657 | - |
| SEQ ID NO 47543 | AAAGAAAGGATTGGTCTAAAA | CTA | chr1 | 55041650 | 55041671 | 55041655 | 55041650 | - |
| SEQ ID NO 47544 | GTCTAAAAATTATTTTCTGCTT | TTG | chr1 | 55041636 | 55041657 | 55041641 | 55041636 | - |
| SEQ ID NO 47545 | AAAATTATTTTCTGCTTGCCAA | CTA | chr1 | 55041631 | 55041652 | 55041636 | 55041631 | - |
| SEQ ID NO 47546 | TTTTCTGCTTGCCAAAAAATAT | TTA | chr1 | 55041624 | 55041645 | 55041629 | 55041624 | - |
| SEQ ID NO 47547 | TCTGCTTGCCAAAAAATATTTT | TTT | chr1 | 55041621 | 55041642 | 55041626 | 55041621 | - |
| SEQ ID NO 47548 | CTGCTTGCCAAAAAATATTTTC | TTT | chr1 | 55041620 | 55041641 | 55041625 | 55041620 | - |
| SEQ ID NO 47549 | TGCTTGCCAAAAAATATTTTCA | TTC | chr1 | 55041619 | 55041640 | 55041624 | 55041619 | - |
| SEQ ID NO 47550 | CTTGCCAAAAAATATTTTCATT | CTG | chr1 | 55041617 | 55041638 | 55041622 | 55041617 | - |
| SEQ ID NO 47551 | GCCAAAAAATATTTTCATTCTA | CTT | chr1 | 55041614 | 55041635 | 55041619 | 55041614 | - |
| SEQ ID NO 47552 | CCAAAAAATATTTTCATTCTAA | TTG | chr1 | 55041613 | 55041634 | 55041618 | 55041613 | - |
| SEQ ID NO 47553 | TCATTCTAAATTCGATTCCCAC | TTT | chr1 | 55041600 | 55041621 | 55041605 | 55041600 | - |
| SEQ ID NO 47554 | CATTCTAAATTCGATTCCCACA | TTT | chr1 | 55041599 | 55041620 | 55041604 | 55041599 | - |
| SEQ ID NO 47555 | ATTCTAAATTCGATTCCCACAA | TTC | chr1 | 55041598 | 55041619 | 55041603 | 55041598 | - |
| SEQ ID NO 47556 | TAAATTCGATTCCCACAAAATA | TTC | chr1 | 55041594 | 55041615 | 55041599 | 55041594 | - |
| SEQ ID NO 47557 | AATTCGATTCCCACAAAATAAC | CTA | chr1 | 55041592 | 55041613 | 55041597 | 55041592 | - |
| SEQ ID NO 47558 | GATTCCCACAAAATAACCATTG | TTC | chr1 | 55041587 | 55041608 | 55041592 | 55041587 | - |
| SEQ ID NO 47559 | CCACAAAATAACCATTGAATGA | TTC | chr1 | 55041582 | 55041603 | 55041587 | 55041582 | - |
| SEQ ID NO 47560 | AATGAATGAATAAATGAACTTG | TTG | chr1 | 55041565 | 55041586 | 55041570 | 55041565 | - |
| SEQ ID NO 47561 | GAGGAGGCTCCTGTTCCAAACT | CTT | chr1 | 55041544 | 55041565 | 55041549 | 55041544 | - |
| SEQ ID NO 47562 | AGGAGGCTCCTGTTCCAAACTT | TTG | chr1 | 55041543 | 55041564 | 55041548 | 55041543 | - |
| SEQ ID NO 47563 | CTGTTCCAAACTTCCACCAGAG | CTC | chr1 | 55041534 | 55041555 | 55041539 | 55041534 | - |
| SEQ ID NO 47564 | TTCCAAACTTCCACCAGAGAAG | CTG | chr1 | 55041531 | 55041552 | 55041536 | 55041531 | - |
| SEQ ID NO 47565 | CAAACTTCCACCAGAGAAGAAA | TTC | chr1 | 55041528 | 55041549 | 55041533 | 55041528 | - |
| SEQ ID NO 47566 | CCACCAGAGAAGAAACATCCTC | CTT | chr1 | 55041521 | 55041542 | 55041526 | 55041521 | - |
| SEQ ID NO 47567 | CACCAGAGAAGAAACATCCTCA | TTC | chr1 | 55041520 | 55041541 | 55041525 | 55041520 | - |
| SEQ ID NO 47568 | AAGGGCTTGGTTCAGGTGGTCA | CTC | chr1 | 55041499 | 55041520 | 55041504 | 55041499 | - |
| SEQ ID NO 47569 | GGTTCAGGTGGTCATACAGCCT | CTT | chr1 | 55041491 | 55041512 | 55041496 | 55041491 | - |
| SEQ ID NO 47570 | GTTCAGGTGGTCATACAGCCTC | TTG | chr1 | 55041490 | 55041511 | 55041495 | 55041490 | - |
| SEQ ID NO 47571 | AGGTGGTCATACAGCCTCTGCT | TTC | chr1 | 55041486 | 55041507 | 55041491 | 55041486 | - |
| SEQ ID NO 47572 | TGCTTACTCACCTCTCAGGATG | CTC | chr1 | 55041468 | 55041489 | 55041473 | 55041468 | - |
| SEQ ID NO 47573 | CTTACTCACCTCTCAGGATGGG | CTG | chr1 | 55041466 | 55041487 | 55041471 | 55041466 | - |
| SEQ ID NO 47574 | ACTCACCTCTCAGGATGGGGTA | CTT | chr1 | 55041463 | 55041484 | 55041468 | 55041463 | - |
| SEQ ID NO 47575 | CTCACCTCTCAGGATGGGGTAC | TTA | chr1 | 55041462 | 55041483 | 55041467 | 55041462 | - |
| SEQ ID NO 47576 | ACCTCTCAGGATGGGGTACTCA | CTC | chr1 | 55041459 | 55041480 | 55041464 | 55041459 | - |
| SEQ ID NO 47577 | TCAGGATGGGGTACTCACTATT | CTC | chr1 | 55041454 | 55041475 | 55041459 | 55041454 | - |
| SEQ ID NO 47578 | AGGATGGGGTACTCACTATTTC | CTC | chr1 | 55041452 | 55041473 | 55041457 | 55041452 | - |
| SEQ ID NO 47579 | ACTATTTCCAGAACAGTTGTTT | CTC | chr1 | 55041438 | 55041459 | 55041443 | 55041438 | - |
| SEQ ID NO 47580 | TTTCCAGAACAGTTGTTTTGGA | CTA | chr1 | 55041434 | 55041455 | 55041439 | 55041434 | - |
| SEQ ID NO 47581 | CCAGAACAGTTGTTTTGGAGCA | TTT | chr1 | 55041431 | 55041452 | 55041436 | 55041431 | - |
| SEQ ID NO 47582 | CAGAACAGTTGTTTTGGAGCAG | TTC | chr1 | 55041430 | 55041451 | 55041435 | 55041430 | - |
| SEQ ID NO 47583 | TTTTGGAGCAGTGGTAACTTGA | TTG | chr1 | 55041419 | 55041440 | 55041424 | 55041419 | - |
| SEQ ID NO 47584 | TGGAGCAGTGGTAACTTGAAAT | TTT | chr1 | 55041416 | 55041437 | 55041421 | 55041416 | - |
| SEQ ID NO 47585 | GGAGCAGTGGTAACTTGAAATG | TTT | chr1 | 55041415 | 55041436 | 55041420 | 55041415 | - |
| SEQ ID NO 47586 | GAGCAGTGGTAACTTGAAATGC | TTG | chr1 | 55041414 | 55041435 | 55041419 | 55041414 | - |
| SEQ ID NO 47587 | GAAATGCCCTTTCTTATCCTGG | CTT | chr1 | 55041399 | 55041420 | 55041404 | 55041399 | - |
| SEQ ID NO 47588 | AAATGCCCTTTCTTATCCTGGC | TTG | chr1 | 55041398 | 55041419 | 55041403 | 55041398 | - |
| SEQ ID NO 47589 | TCTTATCCTGGCCACAACCCCA | CTT | chr1 | 55041388 | 55041409 | 55041393 | 55041388 | - |
| SEQ ID NO 47590 | CTTATCCTGGCCACAACCCCAC | TTT | chr1 | 55041387 | 55041408 | 55041392 | 55041387 | - |

Figure 66 (Cont'd)

| | | | | | | | | |
|---|---|---|---|---|---|---|---|---|
| SEQ ID NO 47591 | TTATCCTGGCCACAACCCCACA | TTC | chr1 | 55041386 | 55041407 | 55041391 | 55041386 | - |
| SEQ ID NO 47592 | ATCCTGGCCACAACCCCACAAC | CTT | chr1 | 55041384 | 55041405 | 55041389 | 55041384 | - |
| SEQ ID NO 47593 | TCCTGGCCACAACCCCACAACA | TTA | chr1 | 55041383 | 55041404 | 55041388 | 55041383 | - |
| SEQ ID NO 47594 | GCCACAACCCCACAACATCCCT | CTG | chr1 | 55041378 | 55041399 | 55041383 | 55041378 | - |
| SEQ ID NO 47595 | GAGAAAGTCAAAGGCTCAGGGA | CTC | chr1 | 55041355 | 55041376 | 55041360 | 55041355 | - |
| SEQ ID NO 47596 | AGGGAACAAGGAAGAGGGCTAT | CTC | chr1 | 55041338 | 55041359 | 55041343 | 55041338 | - |
| SEQ ID NO 47597 | TACTGAGCTGAGTAAGGACTTG | CTA | chr1 | 55041317 | 55041338 | 55041322 | 55041317 | - |
| SEQ ID NO 47598 | AGCTGAGTAAGGACTTGCCATC | CTG | chr1 | 55041312 | 55041333 | 55041317 | 55041312 | - |
| SEQ ID NO 47599 | AGTAAGGACTTGCCATCCTGCC | CTG | chr1 | 55041307 | 55041328 | 55041312 | 55041307 | - |
| SEQ ID NO 47600 | GCCATCCTGCCACCCAGCACAC | CTT | chr1 | 55041296 | 55041317 | 55041301 | 55041296 | - |
| SEQ ID NO 47601 | CCATCCTGCCACCCAGCACACT | TTG | chr1 | 55041295 | 55041316 | 55041300 | 55041295 | - |
| SEQ ID NO 47602 | CCACCCAGCACACTCAGACAGA | CTG | chr1 | 55041287 | 55041308 | 55041292 | 55041287 | - |
| SEQ ID NO 47603 | AGACAGAAGCGTGGGCAGGCAG | CTC | chr1 | 55041272 | 55041293 | 55041277 | 55041272 | - |
| SEQ ID NO 47604 | TGAGTGGCAGAATTTTCCCCTC | CTG | chr1 | 55041247 | 55041268 | 55041252 | 55041247 | - |
| SEQ ID NO 47605 | TCCCCTCTGCCCCAGGAGCTGT | TTT | chr1 | 55041232 | 55041253 | 55041237 | 55041232 | - |
| SEQ ID NO 47606 | CCCCTCTGCCCCAGGAGCTGTG | TTT | chr1 | 55041231 | 55041252 | 55041236 | 55041231 | - |
| SEQ ID NO 47607 | CCCTCTGCCCCAGGAGCTGTGG | TTC | chr1 | 55041230 | 55041251 | 55041235 | 55041230 | - |
| SEQ ID NO 47608 | TGCCCCAGGAGCTGTGGTTTGG | CTC | chr1 | 55041225 | 55041246 | 55041230 | 55041225 | - |
| SEQ ID NO 47609 | CCCCAGGAGCTGTGGTTTGGAG | CTG | chr1 | 55041223 | 55041244 | 55041228 | 55041223 | - |
| SEQ ID NO 47610 | TGGTTTGGAGCAAAGACAATGT | CTG | chr1 | 55041211 | 55041232 | 55041216 | 55041211 | - |
| SEQ ID NO 47611 | GGAGCAAAGACAATGTCACCAA | TTT | chr1 | 55041205 | 55041226 | 55041210 | 55041205 | - |
| SEQ ID NO 47612 | GAGCAAAGACAATGTCACCAAC | TTG | chr1 | 55041204 | 55041225 | 55041209 | 55041204 | - |
| SEQ ID NO 47613 | CAGACAGGGACAAAACTGCAAG | CTG | chr1 | 55041171 | 55041192 | 55041176 | 55041171 | - |
| SEQ ID NO 47614 | CAAGTGATCCCCCCGGGGCTTG | CTG | chr1 | 55041153 | 55041174 | 55041158 | 55041153 | - |
| SEQ ID NO 47615 | GCATTGTAAGTTCACTCATGGT | CTT | chr1 | 55041132 | 55041153 | 55041137 | 55041132 | - |
| SEQ ID NO 47616 | CATTGTAAGTTCACTCATGGTC | TTG | chr1 | 55041131 | 55041152 | 55041136 | 55041131 | - |
| SEQ ID NO 47617 | TAAGTTCACTCATGGTCAACAG | TTG | chr1 | 55041126 | 55041147 | 55041131 | 55041126 | - |
| SEQ ID NO 47618 | ACTCATGGTCAACAGAACTTTC | TTC | chr1 | 55041119 | 55041140 | 55041124 | 55041119 | - |
| SEQ ID NO 47619 | ATGGTCAACAGAACTTTCCCTT | CTC | chr1 | 55041115 | 55041136 | 55041120 | 55041115 | - |
| SEQ ID NO 47620 | TCCCTTCATCTCCCCATCTGCT | CTT | chr1 | 55041099 | 55041120 | 55041104 | 55041099 | - |
| SEQ ID NO 47621 | CCCTTCATCTCCCCATCTGCTG | TTT | chr1 | 55041098 | 55041119 | 55041103 | 55041098 | - |
| SEQ ID NO 47622 | CCTTCATCTCCCCATCTGCTGC | TTC | chr1 | 55041097 | 55041118 | 55041102 | 55041097 | - |
| SEQ ID NO 47623 | CATCTCCCCATCTGCTGCCACT | CTT | chr1 | 55041093 | 55041114 | 55041098 | 55041093 | - |
| SEQ ID NO 47624 | ATCTCCCCATCTGCTGCCACTG | TTC | chr1 | 55041092 | 55041113 | 55041097 | 55041092 | - |
| SEQ ID NO 47625 | CCCATCTGCTGCCACTGAGCCG | CTC | chr1 | 55041087 | 55041108 | 55041092 | 55041087 | - |
| SEQ ID NO 47626 | CTGCCACTGAGCCGTAGGGACG | CTG | chr1 | 55041079 | 55041100 | 55041084 | 55041079 | - |
| SEQ ID NO 47627 | CCACTGAGCCGTAGGGACGATT | CTG | chr1 | 55041076 | 55041097 | 55041081 | 55041076 | - |
| SEQ ID NO 47628 | AGCCGTAGGGACGATTGTCACC | CTG | chr1 | 55041070 | 55041091 | 55041075 | 55041070 | - |
| SEQ ID NO 47629 | TCACCTCCCTTTTAAAGATTAG | TTG | chr1 | 55041053 | 55041074 | 55041058 | 55041053 | - |
| SEQ ID NO 47630 | CCTTTTAAAGATTAGGCAATGG | CTC | chr1 | 55041046 | 55041067 | 55041051 | 55041046 | - |
| SEQ ID NO 47631 | TTAAAGATTAGGCAATGGAGGC | CTT | chr1 | 55041042 | 55041063 | 55041047 | 55041042 | - |
| SEQ ID NO 47632 | TAAAGATTAGGCAATGGAGGCT | TTT | chr1 | 55041041 | 55041062 | 55041046 | 55041041 | - |
| SEQ ID NO 47633 | AAAGATTAGGCAATGGAGGCTC | TTT | chr1 | 55041040 | 55041061 | 55041045 | 55041040 | - |
| SEQ ID NO 47634 | AAGATTAGGCAATGGAGGCTCA | TTA | chr1 | 55041039 | 55041060 | 55041044 | 55041039 | - |
| SEQ ID NO 47635 | GGCAATGGAGGCTCAAGGATAA | TTA | chr1 | 55041032 | 55041053 | 55041037 | 55041032 | - |
| SEQ ID NO 47636 | AAGGATAAGTGACTTGTCAAGC | CTC | chr1 | 55041018 | 55041039 | 55041023 | 55041018 | - |
| SEQ ID NO 47637 | GTCAAGCACCACAGCTAGTGAG | CTT | chr1 | 55041003 | 55041024 | 55041008 | 55041003 | - |
| SEQ ID NO 47638 | TCAAGCACCACAGCTAGTGAGA | TTG | chr1 | 55041002 | 55041023 | 55041007 | 55041002 | - |
| SEQ ID NO 47639 | GTGAGAGGAAGCCAAGATTCAA | CTA | chr1 | 55040986 | 55041007 | 55040991 | 55040986 | - |
| SEQ ID NO 47640 | AACCCCACATCTGACTCCAAGC | TTC | chr1 | 55040966 | 55040987 | 55040971 | 55040966 | - |
| SEQ ID NO 47641 | ACTCCAAGCTGGGGACACAGA | CTG | chr1 | 55040953 | 55040974 | 55040958 | 55040953 | - |
| SEQ ID NO 47642 | CAAGCTGGGGACACAGAACCT | CTC | chr1 | 55040949 | 55040970 | 55040954 | 55040949 | - |
| SEQ ID NO 47643 | GGGGACACAGAACCTCAGCCAA | CTG | chr1 | 55040942 | 55040963 | 55040947 | 55040942 | - |
| SEQ ID NO 47644 | AGCCAAGTCCTGGGCTGGTAAT | CTC | chr1 | 55040926 | 55040947 | 55040931 | 55040926 | - |
| SEQ ID NO 47645 | GGCTGGTAATACTTAGAAAAAG | CTG | chr1 | 55040914 | 55040935 | 55040919 | 55040914 | - |
| SEQ ID NO 47646 | GTAATACTTAGAAAAGCTAGT | CTG | chr1 | 55040909 | 55040930 | 55040914 | 55040909 | - |
| SEQ ID NO 47647 | AGAAAAGCTAGTGGTCTCGCC | CTT | chr1 | 55040900 | 55040921 | 55040905 | 55040900 | - |
| SEQ ID NO 47648 | GAAAAAGCTAGTGGTCTCGCCC | TTA | chr1 | 55040899 | 55040920 | 55040904 | 55040899 | - |

Figure 66 (Cont'd)

| | | | | | | | | |
|---|---|---|---|---|---|---|---|---|
| SEQ ID NO 47649 | GTGGTCTCGCCCCGGGAAGAAG | CTA | chr1 | 55040889 | 55040910 | 55040894 | 55040889 | - |
| SEQ ID NO 47650 | GCCCCGGGAAGAAGCTTCCCAC | CTC | chr1 | 55040881 | 55040902 | 55040886 | 55040881 | - |
| SEQ ID NO 47651 | CCCACAGCCTGAGGGCCAGAAG | CTT | chr1 | 55040864 | 55040885 | 55040869 | 55040864 | - |
| SEQ ID NO 47652 | CCACAGCCTGAGGGCCAGAAGC | TTC | chr1 | 55040863 | 55040884 | 55040868 | 55040863 | - |
| SEQ ID NO 47653 | AGGGCCAGAAGCTGGCAGAGTT | CTG | chr1 | 55040853 | 55040874 | 55040858 | 55040853 | - |
| SEQ ID NO 47654 | GCAGAGTTGTTGAGCAAACTCG | CTG | chr1 | 55040839 | 55040860 | 55040844 | 55040839 | - |
| SEQ ID NO 47655 | TTGAGCAAACTCGCCCCGCACA | TTG | chr1 | 55040830 | 55040851 | 55040835 | 55040830 | - |
| SEQ ID NO 47656 | AGCAAACTCGCCCCGCACACGG | TTG | chr1 | 55040827 | 55040848 | 55040832 | 55040827 | - |
| SEQ ID NO 47657 | GCCCCGCACACGGTCGGCAGAC | CTC | chr1 | 55040818 | 55040839 | 55040823 | 55040818 | - |
| SEQ ID NO 47658 | AGGCGCCGGGCTCAGCTCCGGG | CTG | chr1 | 55040782 | 55040803 | 55040787 | 55040782 | - |
| SEQ ID NO 47659 | AGCTCCGGGGTCCCAGTACCAG | CTC | chr1 | 55040769 | 55040790 | 55040774 | 55040769 | - |
| SEQ ID NO 47660 | CGGGGTCCCAGTACCAGGCGCA | CTC | chr1 | 55040764 | 55040785 | 55040769 | 55040764 | - |
| SEQ ID NO 47661 | CGGCTCCAGAGCACCAAGGGCC | CTC | chr1 | 55040735 | 55040756 | 55040740 | 55040735 | - |
| SEQ ID NO 47662 | CAGAGCACCAAGGGCCCTTCCC | CTC | chr1 | 55040729 | 55040750 | 55040734 | 55040729 | - |
| SEQ ID NO 47663 | CCCTGCCTGAGTCCTAAAGGAC | CTT | chr1 | 55040710 | 55040731 | 55040715 | 55040710 | - |
| SEQ ID NO 47664 | CCTGCCTGAGTCCTAAAGGACG | TTC | chr1 | 55040709 | 55040730 | 55040714 | 55040709 | - |
| SEQ ID NO 47665 | CCTGAGTCCTAAAGGACGCCAA | CTG | chr1 | 55040705 | 55040726 | 55040710 | 55040705 | - |
| SEQ ID NO 47666 | AGTCCTAAAGGACGCCAATGGG | CTG | chr1 | 55040701 | 55040722 | 55040706 | 55040701 | - |
| SEQ ID NO 47667 | AAGGACGCCAATGGGCCTCGAG | CTA | chr1 | 55040694 | 55040715 | 55040699 | 55040694 | - |
| SEQ ID NO 47668 | GAGAATACCTCCGCCCCTTCTC | CTC | chr1 | 55040675 | 55040696 | 55040680 | 55040675 | - |
| SEQ ID NO 47669 | CGCCCCTTCTCCCCTGCCCCTT | CTC | chr1 | 55040664 | 55040685 | 55040669 | 55040664 | - |
| SEQ ID NO 47670 | CTCCCCTGCCCCTTCAGCTGGT | CTT | chr1 | 55040656 | 55040677 | 55040661 | 55040656 | - |
| SEQ ID NO 47671 | TCCCCTGCCCCTTCAGCTGGTT | TTC | chr1 | 55040655 | 55040676 | 55040660 | 55040655 | - |
| SEQ ID NO 47672 | CCCTGCCCCTTCAGCTGGTTCT | CTC | chr1 | 55040653 | 55040674 | 55040658 | 55040653 | - |
| SEQ ID NO 47673 | CCCCTTCAGCTGGTTCTTTTCT | CTG | chr1 | 55040648 | 55040669 | 55040653 | 55040648 | - |
| SEQ ID NO 47674 | CAGCTGGTTCTTTTCTTCGGCT | CTT | chr1 | 55040642 | 55040663 | 55040647 | 55040642 | - |
| SEQ ID NO 47675 | AGCTGGTTCTTTTCTTCGGCTG | TTC | chr1 | 55040641 | 55040662 | 55040646 | 55040641 | - |
| SEQ ID NO 47676 | GTTCTTTTCTTCGGCTGAAACA | CTG | chr1 | 55040636 | 55040657 | 55040641 | 55040636 | - |
| SEQ ID NO 47677 | TTTTCTTCGGCTGAAACAGATG | TTC | chr1 | 55040632 | 55040653 | 55040637 | 55040632 | - |
| SEQ ID NO 47678 | TTCTTCGGCTGAAACAGATGGA | CTT | chr1 | 55040630 | 55040651 | 55040635 | 55040630 | - |
| SEQ ID NO 47679 | TCTTCGGCTGAAACAGATGGAA | TTT | chr1 | 55040629 | 55040650 | 55040634 | 55040629 | - |
| SEQ ID NO 47680 | CTTCGGCTGAAACAGATGGAAT | TTT | chr1 | 55040628 | 55040649 | 55040633 | 55040628 | - |
| SEQ ID NO 47681 | TTCGGCTGAAACAGATGGAATA | TTC | chr1 | 55040627 | 55040648 | 55040632 | 55040627 | - |
| SEQ ID NO 47682 | CGGCTGAAACAGATGGAATACT | CTT | chr1 | 55040625 | 55040646 | 55040630 | 55040625 | - |
| SEQ ID NO 47683 | GGCTGAAACAGATGGAATACTA | TTC | chr1 | 55040624 | 55040645 | 55040629 | 55040624 | - |
| SEQ ID NO 47684 | AAACAGATGGAATACTAGAGCA | CTG | chr1 | 55040619 | 55040640 | 55040624 | 55040619 | - |
| SEQ ID NO 47685 | GAGCATGAGTTCTGTGTCATAA | CTA | chr1 | 55040602 | 55040623 | 55040607 | 55040602 | - |
| SEQ ID NO 47686 | TGTGTCATAAAGAAATTGCCTC | TTC | chr1 | 55040590 | 55040611 | 55040595 | 55040590 | - |
| SEQ ID NO 47687 | TGTCATAAAGAAATTGCCTCGT | CTG | chr1 | 55040588 | 55040609 | 55040593 | 55040588 | - |
| SEQ ID NO 47688 | CCTCGTGCTCCCAGCATCTGCC | TTG | chr1 | 55040572 | 55040593 | 55040577 | 55040572 | - |
| SEQ ID NO 47689 | GTGCTCCCAGCATCTGCCGTCC | CTC | chr1 | 55040568 | 55040589 | 55040573 | 55040568 | - |
| SEQ ID NO 47690 | CCAGCATCTGCCGTCCTTCCCA | CTC | chr1 | 55040562 | 55040583 | 55040567 | 55040562 | - |
| SEQ ID NO 47691 | CCGTCCTTCCCACCCCGCCCCT | CTG | chr1 | 55040552 | 55040573 | 55040557 | 55040552 | - |
| SEQ ID NO 47692 | CCCACCCCGCCCCTGTCTCGGG | CTT | chr1 | 55040544 | 55040565 | 55040549 | 55040544 | - |
| SEQ ID NO 47693 | CCACCCCGCCCCTGTCTCGGGT | TTC | chr1 | 55040543 | 55040564 | 55040548 | 55040543 | - |
| SEQ ID NO 47694 | TCTCGGGTAGGGCCTTCTCTCC | CTG | chr1 | 55040529 | 55040550 | 55040534 | 55040529 | - |
| SEQ ID NO 47695 | GGGTAGGGCCTTCTCTCCAGGC | CTC | chr1 | 55040525 | 55040546 | 55040530 | 55040525 | - |
| SEQ ID NO 47696 | CTCTCCAGGCCCTCCACCCTCC | CTT | chr1 | 55040513 | 55040534 | 55040518 | 55040513 | - |
| SEQ ID NO 47697 | TCTCCAGGCCCTCCACCCTCCG | TTC | chr1 | 55040512 | 55040533 | 55040517 | 55040512 | - |
| SEQ ID NO 47698 | TCCAGGCCCTCCACCCTCCGCT | CTC | chr1 | 55040510 | 55040531 | 55040515 | 55040510 | - |
| SEQ ID NO 47699 | CAGGCCCTCCACCCTCCGCTGC | CTC | chr1 | 55040508 | 55040529 | 55040513 | 55040508 | - |
| SEQ ID NO 47700 | CACCCTCCGCTGCCCATGTTTT | CTC | chr1 | 55040499 | 55040520 | 55040504 | 55040499 | - |
| SEQ ID NO 47701 | CGCTGCCCATGTTTTCCAAACC | CTC | chr1 | 55040492 | 55040513 | 55040497 | 55040492 | - |
| SEQ ID NO 47702 | CCCATGTTTTCCAAACCAAATC | CTG | chr1 | 55040487 | 55040508 | 55040492 | 55040487 | - |
| SEQ ID NO 47703 | TCCAAACCAAATCGGAACCCAC | TTT | chr1 | 55040478 | 55040499 | 55040483 | 55040478 | - |
| SEQ ID NO 47704 | CCAAACCAAATCGGAACCCACT | TTT | chr1 | 55040477 | 55040498 | 55040482 | 55040477 | - |
| SEQ ID NO 47705 | CAAACCAAATCGGAACCCACTA | TTC | chr1 | 55040476 | 55040497 | 55040481 | 55040476 | - |
| SEQ ID NO 47706 | TAATGGCAAGCCCGCTTTCTCT | CTA | chr1 | 55040454 | 55040475 | 55040459 | 55040454 | - |

Figure 66 (Cont'd)

| | | | | | | | | |
|---|---|---|---|---|---|---|---|---|
| SEQ ID NO 47707 | TCTCTGTGCCTGGTGCAGTTCC | CTT | chr1 | 55040437 | 55040458 | 55040442 | 55040437 | - |
| SEQ ID NO 47708 | CTCTGTGCCTGGTGCAGTTCCC | TTT | chr1 | 55040436 | 55040457 | 55040441 | 55040436 | - |
| SEQ ID NO 47709 | TCTGTGCCTGGTGCAGTTCCCA | TTC | chr1 | 55040435 | 55040456 | 55040440 | 55040435 | - |
| SEQ ID NO 47710 | TGTGCCTGGTGCAGTTCCCAGT | CTC | chr1 | 55040433 | 55040454 | 55040438 | 55040433 | - |
| SEQ ID NO 47711 | TGCCTGGTGCAGTTCCCAGTAC | CTG | chr1 | 55040431 | 55040452 | 55040436 | 55040431 | - |
| SEQ ID NO 47712 | GTGCAGTTCCCAGTACGTTCCA | CTG | chr1 | 55040425 | 55040446 | 55040430 | 55040425 | - |
| SEQ ID NO 47713 | CCAGTACGTTCCAGGCATTCAC | TTC | chr1 | 55040416 | 55040437 | 55040421 | 55040416 | - |
| SEQ ID NO 47714 | CAGGCATTCACTCCTTCACCCA | TTC | chr1 | 55040405 | 55040426 | 55040410 | 55040405 | - |
| SEQ ID NO 47715 | ACTCCTTCACCCACCTGTGCCG | TTC | chr1 | 55040396 | 55040417 | 55040401 | 55040396 | - |
| SEQ ID NO 47716 | CTTCACCCACCTGTGCCGCGGC | CTC | chr1 | 55040392 | 55040413 | 55040397 | 55040392 | - |
| SEQ ID NO 47717 | CACCCACCTGTGCCGCGGCGAG | CTT | chr1 | 55040389 | 55040410 | 55040394 | 55040389 | - |
| SEQ ID NO 47718 | ACCCACCTGTGCCGCGGCGAGG | TTC | chr1 | 55040388 | 55040409 | 55040393 | 55040388 | - |
| SEQ ID NO 47719 | TGCCGCGGCGAGGCAGAAACTG | CTG | chr1 | 55040379 | 55040400 | 55040384 | 55040379 | - |
| SEQ ID NO 47720 | GGAAATCTGGGCAGGATATCCT | CTG | chr1 | 55040357 | 55040378 | 55040362 | 55040357 | - |
| SEQ ID NO 47721 | GGCAGGATATCCTGGCAGTGCT | CTG | chr1 | 55040348 | 55040369 | 55040353 | 55040348 | - |
| SEQ ID NO 47722 | GCAGTGCTCTGCTCGCCCTTCC | CTG | chr1 | 55040334 | 55040355 | 55040339 | 55040334 | - |
| SEQ ID NO 47723 | TGCTCGCCCTTCCTCGGCCTCC | CTC | chr1 | 55040325 | 55040346 | 55040330 | 55040325 | - |
| SEQ ID NO 47724 | CTCGCCCTTCCTCGGCCTCCGG | CTG | chr1 | 55040323 | 55040344 | 55040328 | 55040323 | - |
| SEQ ID NO 47725 | GCCCTTCCTCGGCCTCCGGGTC | CTC | chr1 | 55040320 | 55040341 | 55040325 | 55040320 | - |
| SEQ ID NO 47726 | CCTCGGCCTCCGGGTCTCCCAA | CTT | chr1 | 55040314 | 55040335 | 55040319 | 55040314 | - |
| SEQ ID NO 47727 | CTCGGCCTCCGGGTCTCCCAAC | TTC | chr1 | 55040313 | 55040334 | 55040318 | 55040313 | - |
| SEQ ID NO 47728 | GGCCTCCGGGTCTCCCAACCCC | CTC | chr1 | 55040310 | 55040331 | 55040315 | 55040310 | - |
| SEQ ID NO 47729 | CGGGTCTCCCAACCCCGCGAAC | CTC | chr1 | 55040304 | 55040325 | 55040309 | 55040304 | - |
| SEQ ID NO 47730 | CCAACCCCGCGAACCTTCCCAC | CTC | chr1 | 55040296 | 55040317 | 55040301 | 55040296 | - |
| SEQ ID NO 47731 | CCCACTGAATAGCGCAGCCGCA | CTT | chr1 | 55040279 | 55040300 | 55040284 | 55040279 | - |
| SEQ ID NO 47732 | CCACTGAATAGCGCAGCCGCAC | TTC | chr1 | 55040278 | 55040299 | 55040283 | 55040278 | - |
| SEQ ID NO 47733 | AATAGCGCAGCCGCACGCCCCA | CTG | chr1 | 55040272 | 55040293 | 55040277 | 55040272 | - |
| SEQ ID NO 47734 | TCCACCGTGCTCCCCACTACCC | CTC | chr1 | 55040218 | 55040239 | 55040223 | 55040218 | - |
| SEQ ID NO 47735 | CACCGTGCTCCCCACTACCCGT | CTC | chr1 | 55040216 | 55040237 | 55040221 | 55040216 | - |
| SEQ ID NO 47736 | CCCACTACCCGTCCTCCCCCGC | CTC | chr1 | 55040206 | 55040227 | 55040211 | 55040206 | - |
| SEQ ID NO 47737 | CCCGTCCTCCCCCGCCGCCTTG | CTA | chr1 | 55040199 | 55040220 | 55040204 | 55040199 | - |
| SEQ ID NO 47738 | CCCCGCCGCCTTGCCTGCAGTC | CTC | chr1 | 55040190 | 55040211 | 55040195 | 55040190 | - |
| SEQ ID NO 47739 | GCCTGCAGTCCCCAAGATCGTG | CTT | chr1 | 55040178 | 55040199 | 55040183 | 55040178 | - |
| SEQ ID NO 47740 | CCTGCAGTCCCCAAGATCGTGC | TTG | chr1 | 55040177 | 55040198 | 55040182 | 55040177 | - |
| SEQ ID NO 47741 | CAGTCCCCAAGATCGTGCCAAG | CTG | chr1 | 55040173 | 55040194 | 55040178 | 55040173 | - |
| SEQ ID NO 47742 | GGCGACCTGCACTCCACTTCCT | CTC | chr1 | 55040139 | 55040160 | 55040144 | 55040139 | - |
| SEQ ID NO 47743 | CACTCCACTTCCTCTCTTACAT | CTG | chr1 | 55040130 | 55040151 | 55040135 | 55040130 | - |
| SEQ ID NO 47744 | CACTTCCTCTCTTACATGGGGG | CTC | chr1 | 55040125 | 55040146 | 55040130 | 55040125 | - |
| SEQ ID NO 47745 | CCTCTCTTACATGGGGGGAAAC | CTT | chr1 | 55040120 | 55040141 | 55040125 | 55040120 | - |
| SEQ ID NO 47746 | CTCTCTTACATGGGGGGAAACT | TTC | chr1 | 55040119 | 55040140 | 55040124 | 55040119 | - |
| SEQ ID NO 47747 | TCTTACATGGGGGGAAACTGAG | CTC | chr1 | 55040116 | 55040137 | 55040121 | 55040116 | - |
| SEQ ID NO 47748 | TTACATGGGGGGAAACTGAGGC | CTC | chr1 | 55040114 | 55040135 | 55040119 | 55040114 | - |
| SEQ ID NO 47749 | ACATGGGGGGAAACTGAGGCCC | CTT | chr1 | 55040112 | 55040133 | 55040117 | 55040112 | - |
| SEQ ID NO 47750 | CATGGGGGGAAACTGAGGCCCG | TTA | chr1 | 55040111 | 55040132 | 55040116 | 55040111 | - |
| SEQ ID NO 47751 | AGGCCCGAGAGGAAACAGCACC | CTG | chr1 | 55040096 | 55040117 | 55040101 | 55040096 | - |
| SEQ ID NO 47752 | CGGGTTCGCCCCGGCCTCCCAT | CTG | chr1 | 55040059 | 55040080 | 55040064 | 55040059 | - |
| SEQ ID NO 47753 | GCCCCGGCCTCCCATCCCTACA | TTC | chr1 | 55040052 | 55040073 | 55040057 | 55040052 | - |
| SEQ ID NO 47754 | CCATCCCTACACCCGCACCTTG | CTC | chr1 | 55040041 | 55040062 | 55040046 | 55040041 | - |
| SEQ ID NO 47755 | CACCCGCACCTTGGCGCAGCGG | CTA | chr1 | 55040032 | 55040053 | 55040037 | 55040032 | - |
| SEQ ID NO 47756 | GGCGCAGCGGTGGAAGGTGGCT | CTT | chr1 | 55040020 | 55040041 | 55040025 | 55040020 | - |
| SEQ ID NO 47757 | GCGCAGCGGTGGAAGGTGGCTG | TTG | chr1 | 55040019 | 55040040 | 55040024 | 55040019 | - |
| SEQ ID NO 47758 | TGGTTCCGTGCTCGGGTGCTTC | CTG | chr1 | 55039997 | 55040018 | 55040002 | 55039997 | - |
| SEQ ID NO 47759 | CGTGCTCGGGTGCTTCGGCCAG | TTC | chr1 | 55039991 | 55040012 | 55039996 | 55039991 | - |
| SEQ ID NO 47760 | GGGTGCTTCGGCCAGGCCGTCC | CTC | chr1 | 55039984 | 55040005 | 55039989 | 55039984 | - |
| SEQ ID NO 47761 | CGGCCAGGCCGTCCTCCTCGGA | CTT | chr1 | 55039976 | 55039997 | 55039981 | 55039976 | - |
| SEQ ID NO 47762 | GGCCAGGCCGTCCTCCTCGGAA | TTC | chr1 | 55039975 | 55039996 | 55039980 | 55039975 | - |
| SEQ ID NO 47763 | CTCGGAACGCAAGGCTAGCACC | CTC | chr1 | 55039960 | 55039981 | 55039965 | 55039960 | - |
| SEQ ID NO 47764 | GGAACGCAAGGCTAGCACCAGC | CTC | chr1 | 55039957 | 55039978 | 55039962 | 55039957 | - |

Figure 66 (Cont'd)

| | | | | | | | | |
|---|---|---|---|---|---|---|---|---|
| SEQ ID NO 47765 | GCACCAGCTCCTCGTAGTCGCC | CTA | chr1 | 55039943 | 55039964 | 55039948 | 55039943 | - |
| SEQ ID NO 47766 | CTCGTAGTCGCCGTCCTCGTCC | CTC | chr1 | 55039933 | 55039954 | 55039938 | 55039933 | - |
| SEQ ID NO 47767 | GTAGTCGCCGTCCTCGTCCTCC | CTC | chr1 | 55039930 | 55039951 | 55039935 | 55039930 | - |
| SEQ ID NO 47768 | GTCCTCCTGCGCACGGGCGCCC | CTC | chr1 | 55039915 | 55039936 | 55039920 | 55039915 | - |
| SEQ ID NO 47769 | CTGCGCACGGGCGCCCGCGGGA | CTC | chr1 | 55039909 | 55039930 | 55039914 | 55039909 | - |
| SEQ ID NO 47770 | CGCACGGGCGCCCGCGGGACCC | CTG | chr1 | 55039906 | 55039927 | 55039911 | 55039906 | - |
| SEQ ID NO 47771 | GAGCTGACGGTGCCCATGAGGG | CTG | chr1 | 55039833 | 55039854 | 55039838 | 55039833 | - |
| SEQ ID NO 47772 | ACGGTGCCCATGAGGGCCAGGG | CTG | chr1 | 55039827 | 55039848 | 55039832 | 55039827 | - |
| SEQ ID NO 47773 | CTGTCCTGGCGAGGAGACCTAG | TTG | chr1 | 55039796 | 55039817 | 55039801 | 55039796 | - |
| SEQ ID NO 47774 | TCCTGGCGAGGAGACCTAGAGG | CTG | chr1 | 55039793 | 55039814 | 55039798 | 55039793 | - |
| SEQ ID NO 47775 | GCGAGGAGACCTAGAGGCCGTG | CTG | chr1 | 55039788 | 55039809 | 55039793 | 55039788 | - |
| SEQ ID NO 47776 | GAGGCCGTGCGCGGTCCACGCC | CTA | chr1 | 55039775 | 55039796 | 55039780 | 55039775 | - |
| SEQ ID NO 47777 | GAGCCTTGCGGTGGGGAGGACT | CTT | chr1 | 55039742 | 55039763 | 55039747 | 55039742 | - |
| SEQ ID NO 47778 | AGCCTTGCGGTGGGGAGGACTG | TTG | chr1 | 55039741 | 55039762 | 55039746 | 55039741 | - |
| SEQ ID NO 47779 | GCGGTGGGGAGGACTGTGCAGG | CTT | chr1 | 55039735 | 55039756 | 55039740 | 55039735 | - |
| SEQ ID NO 47780 | CGGTGGGGAGGACTGTGCAGGA | TTG | chr1 | 55039734 | 55039755 | 55039739 | 55039734 | - |
| SEQ ID NO 47781 | TGCAGGAGCTGAAGTTCAGGAG | CTG | chr1 | 55039719 | 55039740 | 55039724 | 55039719 | - |
| SEQ ID NO 47782 | AAGTTCAGGAGCAGGGCGCGTG | CTG | chr1 | 55039708 | 55039729 | 55039713 | 55039708 | - |
| SEQ ID NO 47783 | AGGAGCAGGGCGCGTGAAGGGG | TTC | chr1 | 55039702 | 55039723 | 55039707 | 55039702 | - |
| SEQ ID NO 47784 | GCTGGGAGCTGGGAGCCGCTGC | CTG | chr1 | 55039666 | 55039687 | 55039671 | 55039666 | - |
| SEQ ID NO 47785 | GGAGCTGGGAGCCGCTGCTGCA | CTG | chr1 | 55039662 | 55039683 | 55039667 | 55039662 | - |
| SEQ ID NO 47786 | GGAGCCGCTGCTGCAACGACGC | CTG | chr1 | 55039655 | 55039676 | 55039660 | 55039655 | - |
| SEQ ID NO 47787 | CTGCAACGACGCGTCCGGCCC | CTG | chr1 | 55039645 | 55039666 | 55039650 | 55039645 | - |
| SEQ ID NO 47788 | CAACGACGCGTCCGGCCCGCC | CTG | chr1 | 55039642 | 55039663 | 55039647 | 55039642 | - |
| SEQ ID NO 47789 | ACTGCCTGGCTCACTCCTCCAG | CTC | chr1 | 55039608 | 55039629 | 55039613 | 55039608 | - |
| SEQ ID NO 47790 | CCTGGCTCACTCCTCCAGGCTC | CTG | chr1 | 55039604 | 55039625 | 55039609 | 55039604 | - |
| SEQ ID NO 47791 | GCTCACTCCTCCAGGCTCAGAC | CTG | chr1 | 55039600 | 55039621 | 55039605 | 55039600 | - |
| SEQ ID NO 47792 | ACTCCTCCAGGCTCAGACCCTG | CTC | chr1 | 55039596 | 55039617 | 55039601 | 55039596 | - |
| SEQ ID NO 47793 | CTCCAGGCTCAGACCCTGAACT | CTC | chr1 | 55039592 | 55039613 | 55039597 | 55039592 | - |
| SEQ ID NO 47794 | CAGGCTCAGACCCTGAACTGAA | CTC | chr1 | 55039589 | 55039610 | 55039594 | 55039589 | - |
| SEQ ID NO 47795 | AGACCCTGAACTGAACGGCGGC | CTC | chr1 | 55039582 | 55039603 | 55039587 | 55039582 | - |
| SEQ ID NO 47796 | AACTGAACGGCGGCGCCCGCCT | CTG | chr1 | 55039574 | 55039595 | 55039579 | 55039574 | - |
| SEQ ID NO 47797 | AACGGCGGCGCCCGCCTGCAAC | CTG | chr1 | 55039569 | 55039590 | 55039574 | 55039569 | - |
| SEQ ID NO 47798 | CAACCATGAGCGCCTCGACGTC | CTG | chr1 | 55039551 | 55039572 | 55039556 | 55039551 | - |
| SEQ ID NO 47799 | GACGTCGCTGCGGAAACCTTCT | CTC | chr1 | 55039535 | 55039556 | 55039540 | 55039535 | - |
| SEQ ID NO 47800 | CGGAAACCTTCTAGGGTGTGGG | CTG | chr1 | 55039525 | 55039546 | 55039530 | 55039525 | - |
| SEQ ID NO 47801 | CTAGGGTGTGGGTGCTTGACGC | CTT | chr1 | 55039515 | 55039536 | 55039520 | 55039515 | - |
| SEQ ID NO 47802 | TAGGGTGTGGGTGCTTGACGCC | TTC | chr1 | 55039514 | 55039535 | 55039519 | 55039514 | - |
| SEQ ID NO 47803 | GGGTGTGGGTGCTTGACGCCTG | CTA | chr1 | 55039512 | 55039533 | 55039517 | 55039512 | - |
| SEQ ID NO 47804 | GACGCCTGGGGCGCGCAGATCA | CTT | chr1 | 55039498 | 55039519 | 55039503 | 55039498 | - |
| SEQ ID NO 47805 | ACGCCTGGGGCGCGCAGATCAC | TTG | chr1 | 55039497 | 55039518 | 55039502 | 55039497 | - |
| SEQ ID NO 47806 | GGGCGCGCAGATCACGCCACCA | CTG | chr1 | 55039490 | 55039511 | 55039495 | 55039490 | - |
| SEQ ID NO 47807 | TCTGATTAAACATTAACGGAAC | CTA | chr1 | 55039447 | 55039468 | 55039452 | 55039447 | - |
| SEQ ID NO 47808 | ATTAAACATTAACGGAACCCCC | CTG | chr1 | 55039443 | 55039464 | 55039448 | 55039443 | - |
| SEQ ID NO 47809 | AACATTAACGGAACCCCCGGAC | TTA | chr1 | 55039439 | 55039460 | 55039444 | 55039439 | - |
| SEQ ID NO 47810 | ACGGAACCCCCGGACTGGAGGA | TTA | chr1 | 55039432 | 55039453 | 55039437 | 55039432 | - |
| SEQ ID NO 47811 | GAGGATCAGGTTTCGGCCTCGC | CTG | chr1 | 55039415 | 55039436 | 55039420 | 55039415 | - |
| SEQ ID NO 47812 | CGGCCTCGCCCTCCCAAACAG | TTT | chr1 | 55039402 | 55039423 | 55039407 | 55039402 | - |
| SEQ ID NO 47813 | GGCCTCGCCCTCCCAAACAGC | TTC | chr1 | 55039401 | 55039422 | 55039406 | 55039401 | - |
| SEQ ID NO 47814 | GCCCTCCCAAACAGCGTCAGA | CTC | chr1 | 55039395 | 55039416 | 55039400 | 55039395 | - |
| SEQ ID NO 47815 | CCCAAACAGCGTCAGATTACGC | CTC | chr1 | 55039389 | 55039410 | 55039394 | 55039389 | - |
| SEQ ID NO 47816 | CGCGCAGAGGGAAGAAAAAACT | TTA | chr1 | 55039370 | 55039391 | 55039375 | 55039370 | - |
| SEQ ID NO 47817 | CCAAATCCTAACTGGGCTGGAA | CTC | chr1 | 55039347 | 55039368 | 55039352 | 55039347 | - |
| SEQ ID NO 47818 | ACTGGGCTGGAAGGCAGGCCGG | CTA | chr1 | 55039337 | 55039358 | 55039342 | 55039337 | - |
| SEQ ID NO 47819 | GGCTGGAAGGCAGGCCGGCGCC | CTG | chr1 | 55039333 | 55039354 | 55039338 | 55039333 | - |
| SEQ ID NO 47820 | GAAGGCAGGCCGGCGCCCTAGG | CTG | chr1 | 55039328 | 55039349 | 55039333 | 55039328 | - |
| SEQ ID NO 47821 | GGGGCTCCTCCTCTCCCGCCTC | CTA | chr1 | 55039308 | 55039329 | 55039313 | 55039308 | - |
| SEQ ID NO 47822 | CTCCTCTCCCGCCTCTCACCCT | CTC | chr1 | 55039301 | 55039322 | 55039306 | 55039301 | - |

Figure 66 (Cont'd)

| | | | | | | | | |
|---|---|---|---|---|---|---|---|---|
| SEQ ID NO 47823 | CTCTCCCGCCTCTCACCCTGCG | CTC | chr1 | 55039298 | 55039319 | 55039303 | 55039298 | - |
| SEQ ID NO 47824 | TCCCGCCTCTCACCCTGCGTGG | CTC | chr1 | 55039295 | 55039316 | 55039300 | 55039295 | - |
| SEQ ID NO 47825 | CCGCCTCTCACCCTGCGTGGGA | CTC | chr1 | 55039293 | 55039314 | 55039298 | 55039293 | - |
| SEQ ID NO 47826 | TCACCCTGCGTGGGATGCCAGA | CTC | chr1 | 55039286 | 55039307 | 55039291 | 55039286 | - |
| SEQ ID NO 47827 | ACCCTGCGTGGGATGCCAGACT | CTC | chr1 | 55039284 | 55039305 | 55039289 | 55039284 | - |
| SEQ ID NO 47828 | CGTGGGATGCCAGACTCCAAGT | CTG | chr1 | 55039278 | 55039299 | 55039283 | 55039278 | - |
| SEQ ID NO 47829 | CAAGTTCTGCCGGGCCCACCTT | CTC | chr1 | 55039261 | 55039282 | 55039266 | 55039261 | - |
| SEQ ID NO 47830 | TGCCGGGCCCACCTTTTCAGTG | TTC | chr1 | 55039254 | 55039275 | 55039259 | 55039254 | - |
| SEQ ID NO 47831 | CCGGGCCCACCTTTTCAGTGTT | CTG | chr1 | 55039252 | 55039273 | 55039257 | 55039252 | - |
| SEQ ID NO 47832 | TTCAGTGTTTCCTGGGTCCACC | CTT | chr1 | 55039239 | 55039260 | 55039244 | 55039239 | - |
| SEQ ID NO 47833 | TCAGTGTTTCCTGGGTCCACCT | TTT | chr1 | 55039238 | 55039259 | 55039243 | 55039238 | - |
| SEQ ID NO 47834 | CAGTGTTTCCTGGGTCCACCTT | TTT | chr1 | 55039237 | 55039258 | 55039242 | 55039237 | - |
| SEQ ID NO 47835 | AGTGTTTCCTGGGTCCACCTTG | TTC | chr1 | 55039236 | 55039257 | 55039241 | 55039236 | - |
| SEQ ID NO 47836 | CCTGGGTCCACCTTGTCTCCTG | TTT | chr1 | 55039229 | 55039250 | 55039234 | 55039229 | - |
| SEQ ID NO 47837 | CTGGGTCCACCTTGTCTCCTGC | TTC | chr1 | 55039228 | 55039249 | 55039233 | 55039228 | - |
| SEQ ID NO 47838 | GGTCCACCTTGTCTCCTGCTGA | CTG | chr1 | 55039225 | 55039246 | 55039230 | 55039225 | - |
| SEQ ID NO 47839 | GTCTCCTGCTGACCAGTGAGAC | CTT | chr1 | 55039215 | 55039236 | 55039220 | 55039215 | - |
| SEQ ID NO 47840 | TCTCCTGCTGACCAGTGAGACT | TTG | chr1 | 55039214 | 55039235 | 55039219 | 55039214 | - |
| SEQ ID NO 47841 | CTGCTGACCAGTGAGACTTCTG | CTC | chr1 | 55039210 | 55039231 | 55039215 | 55039210 | - |
| SEQ ID NO 47842 | CTGACCAGTGAGACTTCTGAAT | CTG | chr1 | 55039207 | 55039228 | 55039212 | 55039207 | - |
| SEQ ID NO 47843 | ACCAGTGAGACTTCTGAATCAA | CTG | chr1 | 55039204 | 55039225 | 55039209 | 55039204 | - |
| SEQ ID NO 47844 | CTGAATCAATCCTACTGTGGAC | CTT | chr1 | 55039191 | 55039212 | 55039196 | 55039191 | - |
| SEQ ID NO 47845 | TGAATCAATCCTACTGTGGACT | TTC | chr1 | 55039190 | 55039211 | 55039195 | 55039190 | - |
| SEQ ID NO 47846 | AATCAATCCTACTGTGGACTCC | CTG | chr1 | 55039188 | 55039209 | 55039193 | 55039188 | - |
| SEQ ID NO 47847 | CTGTGGACTCCTCGCTGCCCAC | CTA | chr1 | 55039177 | 55039198 | 55039182 | 55039177 | - |
| SEQ ID NO 47848 | TGGACTCCTCGCTGCCCACCGA | CTG | chr1 | 55039174 | 55039195 | 55039179 | 55039174 | - |
| SEQ ID NO 47849 | CTCGCTGCCCACCGAATTCTTT | CTC | chr1 | 55039167 | 55039188 | 55039172 | 55039167 | - |
| SEQ ID NO 47850 | GCTGCCCACCGAATTCTTTCCA | CTC | chr1 | 55039164 | 55039185 | 55039169 | 55039164 | - |
| SEQ ID NO 47851 | CCCACCGAATTCTTTCCACTGG | CTG | chr1 | 55039160 | 55039181 | 55039165 | 55039160 | - |
| SEQ ID NO 47852 | TTTCCACTGGCCTTAACCTGGC | TTC | chr1 | 55039148 | 55039169 | 55039153 | 55039148 | - |
| SEQ ID NO 47853 | TCCACTGGCCTTAACCTGGCAG | CTT | chr1 | 55039146 | 55039167 | 55039151 | 55039146 | - |
| SEQ ID NO 47854 | CCACTGGCCTTAACCTGGCAGC | TTT | chr1 | 55039145 | 55039166 | 55039150 | 55039145 | - |
| SEQ ID NO 47855 | CACTGGCCTTAACCTGGCAGCC | TTC | chr1 | 55039144 | 55039165 | 55039149 | 55039144 | - |
| SEQ ID NO 47856 | GCCTTAACCTGGCAGCCTTCTA | CTG | chr1 | 55039139 | 55039160 | 55039144 | 55039139 | - |
| SEQ ID NO 47857 | AACCTGGCAGCCTTCTAAACTT | CTT | chr1 | 55039134 | 55039155 | 55039139 | 55039134 | - |
| SEQ ID NO 47858 | ACCTGGCAGCCTTCTAAACTTA | TTA | chr1 | 55039133 | 55039154 | 55039138 | 55039133 | - |
| SEQ ID NO 47859 | GCAGCCTTCTAAACTTAGCCTG | CTG | chr1 | 55039128 | 55039149 | 55039133 | 55039128 | - |
| SEQ ID NO 47860 | CTAAACTTAGCCTGGACCCCCT | CTT | chr1 | 55039120 | 55039141 | 55039125 | 55039120 | - |
| SEQ ID NO 47861 | TAAACTTAGCCTGGACCCCCTC | TTC | chr1 | 55039119 | 55039140 | 55039124 | 55039119 | - |
| SEQ ID NO 47862 | AACTTAGCCTGGACCCCCTCCG | CTA | chr1 | 55039117 | 55039138 | 55039122 | 55039117 | - |
| SEQ ID NO 47863 | AGCCTGGACCCCCTCCGGCCTC | CTT | chr1 | 55039112 | 55039133 | 55039117 | 55039112 | - |
| SEQ ID NO 47864 | GCCTGGACCCCCTCCGGCCTCT | TTA | chr1 | 55039111 | 55039132 | 55039116 | 55039111 | - |
| SEQ ID NO 47865 | GACCCCCTCCGGCCTCTGCCCT | CTG | chr1 | 55039106 | 55039127 | 55039111 | 55039106 | - |
| SEQ ID NO 47866 | CGGCCTCTGCCCTTTATGCACC | CTC | chr1 | 55039097 | 55039118 | 55039102 | 55039097 | - |
| SEQ ID NO 47867 | TGCCCTTTATGCACCCTGCACA | CTC | chr1 | 55039090 | 55039111 | 55039095 | 55039090 | - |
| SEQ ID NO 47868 | CCCTTTATGCACCCTGCACACT | CTG | chr1 | 55039088 | 55039109 | 55039093 | 55039088 | - |
| SEQ ID NO 47869 | TATGCACCCTGCACACTGACCT | CTT | chr1 | 55039083 | 55039104 | 55039088 | 55039083 | - |
| SEQ ID NO 47870 | ATGCACCCTGCACACTGACCTT | TTT | chr1 | 55039082 | 55039103 | 55039087 | 55039082 | - |
| SEQ ID NO 47871 | TGCACCCTGCACACTGACCTTA | TTA | chr1 | 55039081 | 55039102 | 55039086 | 55039081 | - |
| SEQ ID NO 47872 | CACACTGACCTTACCAACTAGC | CTG | chr1 | 55039072 | 55039093 | 55039077 | 55039072 | - |
| SEQ ID NO 47873 | ACCTTACCAACTAGCTGCTCCT | CTG | chr1 | 55039065 | 55039086 | 55039070 | 55039065 | - |
| SEQ ID NO 47874 | ACCAACTAGCTGCTCCTTGAAG | CTT | chr1 | 55039060 | 55039081 | 55039065 | 55039060 | - |
| SEQ ID NO 47875 | CCAACTAGCTGCTCCTTGAAGA | TTA | chr1 | 55039059 | 55039080 | 55039064 | 55039059 | - |
| SEQ ID NO 47876 | GCTGCTCCTTGAAGAGATTGCT | CTA | chr1 | 55039052 | 55039073 | 55039057 | 55039052 | - |
| SEQ ID NO 47877 | CTCCTTGAAGAGATTGCTTGCT | CTG | chr1 | 55039048 | 55039069 | 55039053 | 55039048 | - |
| SEQ ID NO 47878 | CTTGAAGAGATTGCTTGCTTTT | CTC | chr1 | 55039045 | 55039066 | 55039050 | 55039045 | - |
| SEQ ID NO 47879 | GAAGAGATTGCTTGCTTTTGAT | CTT | chr1 | 55039042 | 55039063 | 55039047 | 55039042 | - |
| SEQ ID NO 47880 | AAGAGATTGCTTGCTTTTGATG | TTG | chr1 | 55039041 | 55039062 | 55039046 | 55039041 | - |

Figure 66 (Cont'd)

| | | | | | | | | |
|---|---|---|---|---|---|---|---|---|
| SEQ ID NO 47881 | CTTGCTTTTGATGTCCAGCCTA | TTG | chr1 | 55039032 | 55039053 | 55039037 | 55039032 | - |
| SEQ ID NO 47882 | GCTTTTGATGTCCAGCCTACAT | CTT | chr1 | 55039029 | 55039050 | 55039034 | 55039029 | - |
| SEQ ID NO 47883 | CTTTTGATGTCCAGCCTACATG | TTG | chr1 | 55039028 | 55039049 | 55039033 | 55039028 | - |
| SEQ ID NO 47884 | TTGATGTCCAGCCTACATGCAT | CTT | chr1 | 55039025 | 55039046 | 55039030 | 55039025 | - |
| SEQ ID NO 47885 | TGATGTCCAGCCTACATGCATT | TTT | chr1 | 55039024 | 55039045 | 55039029 | 55039024 | - |
| SEQ ID NO 47886 | GATGTCCAGCCTACATGCATTT | TTT | chr1 | 55039023 | 55039044 | 55039028 | 55039023 | - |
| SEQ ID NO 47887 | ATGTCCAGCCTACATGCATTTC | TTG | chr1 | 55039022 | 55039043 | 55039027 | 55039022 | - |
| SEQ ID NO 47888 | CATGCATTTCAAGGGATTTATA | CTA | chr1 | 55039010 | 55039031 | 55039015 | 55039010 | - |
| SEQ ID NO 47889 | CAAGGGATTTATACTACAAAGA | TTT | chr1 | 55039001 | 55039022 | 55039006 | 55039001 | - |
| SEQ ID NO 47890 | AAGGGATTTATACTACAAAGAT | TTC | chr1 | 55039000 | 55039021 | 55039005 | 55039000 | - |
| SEQ ID NO 47891 | ATACTACAAAGATTCAGGTTTT | TTT | chr1 | 55038991 | 55039012 | 55038996 | 55038991 | - |
| SEQ ID NO 47892 | TACTACAAAGATTCAGGTTTTA | TTA | chr1 | 55038990 | 55039011 | 55038995 | 55038990 | - |
| SEQ ID NO 47893 | CAAAGATTCAGGTTTTAAGTTT | CTA | chr1 | 55038985 | 55039006 | 55038990 | 55038985 | - |
| SEQ ID NO 47894 | AGGTTTTAAGTTTGCAAAGACG | TTC | chr1 | 55038976 | 55038997 | 55038981 | 55038976 | - |
| SEQ ID NO 47895 | TAAGTTTGCAAAGACGTCATAT | TTT | chr1 | 55038970 | 55038991 | 55038975 | 55038970 | - |
| SEQ ID NO 47896 | AAGTTTGCAAAGACGTCATATA | TTT | chr1 | 55038969 | 55038990 | 55038974 | 55038969 | - |
| SEQ ID NO 47897 | AGTTTGCAAAGACGTCATATAG | TTA | chr1 | 55038968 | 55038989 | 55038973 | 55038968 | - |
| SEQ ID NO 47898 | GCAAAGACGTCATATAGGTACA | TTT | chr1 | 55038963 | 55038984 | 55038968 | 55038963 | - |
| SEQ ID NO 47899 | CAAAGACGTCATATAGGTACAT | TTG | chr1 | 55038962 | 55038983 | 55038967 | 55038962 | - |
| SEQ ID NO 47900 | AGAATTCTATGGTAGGCACAAG | TTC | chr1 | 55038938 | 55038959 | 55038943 | 55038938 | - |
| SEQ ID NO 47901 | TATGGTAGGCACAAGCTCAGCT | TTC | chr1 | 55038931 | 55038952 | 55038936 | 55038931 | - |
| SEQ ID NO 47902 | TGGTAGGCACAAGCTCAGCTTT | CTA | chr1 | 55038929 | 55038950 | 55038934 | 55038929 | - |
| SEQ ID NO 47903 | AGCTTTCCAGAAGATTCAATTT | CTC | chr1 | 55038913 | 55038934 | 55038918 | 55038913 | - |
| SEQ ID NO 47904 | TCCAGAAGATTCAATTTGCAAA | CTT | chr1 | 55038908 | 55038929 | 55038913 | 55038908 | - |
| SEQ ID NO 47905 | CCAGAAGATTCAATTTGCAAAG | TTT | chr1 | 55038907 | 55038928 | 55038912 | 55038907 | - |
| SEQ ID NO 47906 | CAGAAGATTCAATTTGCAAAGA | TTC | chr1 | 55038906 | 55038927 | 55038911 | 55038906 | - |
| SEQ ID NO 47907 | AATTTGCAAAGATTCCTTTTAC | TTC | chr1 | 55038896 | 55038917 | 55038901 | 55038896 | - |
| SEQ ID NO 47908 | GCAAAGATTCCTTTTACACACC | TTT | chr1 | 55038891 | 55038912 | 55038896 | 55038891 | - |
| SEQ ID NO 47909 | CAAAGATTCCTTTTACACACCA | TTG | chr1 | 55038890 | 55038911 | 55038895 | 55038890 | - |
| SEQ ID NO 47910 | CTTTTACACACCATGTTCAAGA | TTC | chr1 | 55038881 | 55038902 | 55038886 | 55038881 | - |
| SEQ ID NO 47911 | TTACACACCATGTTCAAGAAAT | CTT | chr1 | 55038878 | 55038899 | 55038883 | 55038878 | - |
| SEQ ID NO 47912 | TACACACCATGTTCAAGAAATC | TTT | chr1 | 55038877 | 55038898 | 55038882 | 55038877 | - |
| SEQ ID NO 47913 | ACACACCATGTTCAAGAAATCA | TTT | chr1 | 55038876 | 55038897 | 55038881 | 55038876 | - |
| SEQ ID NO 47914 | CACACCATGTTCAAGAAATCAA | TTA | chr1 | 55038875 | 55038896 | 55038880 | 55038875 | - |
| SEQ ID NO 47915 | AAGAAATCAACTGGACAAGCAT | TTC | chr1 | 55038863 | 55038884 | 55038868 | 55038863 | - |
| SEQ ID NO 47916 | GACAAGCATCCAGTAAACACCT | CTG | chr1 | 55038850 | 55038871 | 55038855 | 55038850 | - |
| SEQ ID NO 47917 | TTGTGTACCAGGCAGGAGGATG | CTA | chr1 | 55038827 | 55038848 | 55038832 | 55038827 | - |
| SEQ ID NO 47918 | TGTACCAGGCAGGAGGATGAAA | TTG | chr1 | 55038824 | 55038845 | 55038829 | 55038824 | - |
| SEQ ID NO 47919 | CTGGCCTCAGATTGTACATGTG | CTC | chr1 | 55038786 | 55038807 | 55038791 | 55038786 | - |
| SEQ ID NO 47920 | GCCTCAGATTGTACATGTGGCA | CTG | chr1 | 55038783 | 55038804 | 55038788 | 55038783 | - |
| SEQ ID NO 47921 | AGATTGTACATGTGGCATGACA | CTC | chr1 | 55038778 | 55038799 | 55038783 | 55038778 | - |
| SEQ ID NO 47922 | TACATGTGGCATGACATGAGGC | TTG | chr1 | 55038772 | 55038793 | 55038777 | 55038772 | - |
| SEQ ID NO 47923 | GCTCTTTCTGGAAGGGCTGTCG | CTT | chr1 | 55038748 | 55038769 | 55038753 | 55038748 | - |
| SEQ ID NO 47924 | CTCTTTCTGGAAGGGCTGTCGA | TTG | chr1 | 55038747 | 55038768 | 55038752 | 55038747 | - |
| SEQ ID NO 47925 | TTTCTGGAAGGGCTGTCGATAC | CTC | chr1 | 55038744 | 55038765 | 55038749 | 55038744 | - |
| SEQ ID NO 47926 | TCTGGAAGGGCTGTCGATACTG | CTT | chr1 | 55038742 | 55038763 | 55038747 | 55038742 | - |
| SEQ ID NO 47927 | CTGGAAGGGCTGTCGATACTGG | TTT | chr1 | 55038741 | 55038762 | 55038746 | 55038741 | - |
| SEQ ID NO 47928 | TGGAAGGGCTGTCGATACTGGG | TTC | chr1 | 55038740 | 55038761 | 55038745 | 55038740 | - |
| SEQ ID NO 47929 | GAAGGGCTGTCGATACTGGGAA | CTG | chr1 | 55038738 | 55038759 | 55038743 | 55038738 | - |
| SEQ ID NO 47930 | TCGATACTGGGAAGAAACAAAG | CTG | chr1 | 55038729 | 55038750 | 55038734 | 55038729 | - |
| SEQ ID NO 47931 | GGAAGAAACAAAGGCGAATTTA | CTG | chr1 | 55038720 | 55038741 | 55038725 | 55038720 | - |
| SEQ ID NO 47932 | ATGATCCTCCCTTGCAGATGCA | TTT | chr1 | 55038699 | 55038720 | 55038704 | 55038699 | - |
| SEQ ID NO 47933 | TGATCCTCCCTTGCAGATGCAC | TTA | chr1 | 55038698 | 55038719 | 55038703 | 55038698 | - |
| SEQ ID NO 47934 | CCTTGCAGATGCACAGCAGATT | CTC | chr1 | 55038690 | 55038711 | 55038695 | 55038690 | - |
| SEQ ID NO 47935 | GCAGATGCACAGCAGATTCCGA | CTT | chr1 | 55038686 | 55038707 | 55038691 | 55038686 | - |
| SEQ ID NO 47936 | CAGATGCACAGCAGATTCCGAG | TTG | chr1 | 55038685 | 55038706 | 55038690 | 55038685 | - |
| SEQ ID NO 47937 | CGAGTGAAATGGCCTGCTCTGA | TTC | chr1 | 55038667 | 55038688 | 55038672 | 55038667 | - |
| SEQ ID NO 47938 | CTCTGAATCTAGGTGCTGGAGT | CTG | chr1 | 55038651 | 55038672 | 55038656 | 55038651 | - |

Figure 66 (Cont'd)

| SEQ ID NO 47939 | TGAATCTAGGTGCTGGAGTCCA | CTC | chr1 | 55038648 | 55038669 | 55038653 | 55038648 | - |
|---|---|---|---|---|---|---|---|---|
| SEQ ID NO 47940 | AATCTAGGTGCTGGAGTCCAAA | CTG | chr1 | 55038646 | 55038667 | 55038651 | 55038646 | - |
| SEQ ID NO 47941 | GGTGCTGGAGTCCAAAGTTGAT | CTA | chr1 | 55038640 | 55038661 | 55038645 | 55038640 | - |
| SEQ ID NO 47942 | GAGTCCAAAGTTGATGCTCTTT | CTG | chr1 | 55038633 | 55038654 | 55038638 | 55038633 | - |
| SEQ ID NO 47943 | ATGCTCTTTCCACTTTGTTTGC | TTG | chr1 | 55038620 | 55038641 | 55038625 | 55038620 | - |
| SEQ ID NO 47944 | TTTCCACTTTGTTTGCAAAGAC | CTC | chr1 | 55038614 | 55038635 | 55038619 | 55038614 | - |
| SEQ ID NO 47945 | TCCACTTTGTTTGCAAAGACCT | CTT | chr1 | 55038612 | 55038633 | 55038617 | 55038612 | - |
| SEQ ID NO 47946 | CCACTTTGTTTGCAAAGACCTC | TTT | chr1 | 55038611 | 55038632 | 55038616 | 55038611 | - |
| SEQ ID NO 47947 | CACTTTGTTTGCAAAGACCTCA | TTC | chr1 | 55038610 | 55038631 | 55038615 | 55038610 | - |
| SEQ ID NO 47948 | TGTTTGCAAAGACCTCACTCCA | CTT | chr1 | 55038605 | 55038626 | 55038610 | 55038605 | - |
| SEQ ID NO 47949 | GTTTGCAAAGACCTCACTCCAG | TTT | chr1 | 55038604 | 55038625 | 55038609 | 55038604 | - |
| SEQ ID NO 47950 | TTTGCAAAGACCTCACTCCAGA | TTG | chr1 | 55038603 | 55038624 | 55038608 | 55038603 | - |
| SEQ ID NO 47951 | GCAAAGACCTCACTCCAGAGAG | TTT | chr1 | 55038600 | 55038621 | 55038605 | 55038600 | - |
| SEQ ID NO 47952 | CAAAGACCTCACTCCAGAGAGC | TTG | chr1 | 55038599 | 55038620 | 55038604 | 55038599 | - |
| SEQ ID NO 47953 | ACTCCAGAGAGCCAGTGCACAA | CTC | chr1 | 55038589 | 55038610 | 55038594 | 55038589 | - |
| SEQ ID NO 47954 | CAGAGAGCCAGTGCACAAAGAC | CTC | chr1 | 55038585 | 55038606 | 55038590 | 55038585 | - |
| SEQ ID NO 47955 | ACAGTGACTCCATGAGGTAAGG | TTG | chr1 | 55038545 | 55038566 | 55038550 | 55038545 | - |
| SEQ ID NO 47956 | CATGAGGTAAGGTCAGAGTTAT | CTC | chr1 | 55038535 | 55038556 | 55038540 | 55038535 | - |
| SEQ ID NO 47957 | TCCCCATCGAGCCCGCCATCGC | TTA | chr1 | 55038514 | 55038535 | 55038519 | 55038514 | - |
| SEQ ID NO 47958 | ATGGTTTGCTGACAGAGGTGGC | CTC | chr1 | 55038474 | 55038495 | 55038479 | 55038474 | - |
| SEQ ID NO 47959 | GCTGACAGAGGTGGCAGAGGTG | TTT | chr1 | 55038467 | 55038488 | 55038472 | 55038467 | - |
| SEQ ID NO 47960 | CTGACAGAGGTGGCAGAGGTGG | TTG | chr1 | 55038466 | 55038487 | 55038471 | 55038466 | - |
| SEQ ID NO 47961 | ACAGAGGTGGCAGAGGTGGTTC | CTG | chr1 | 55038463 | 55038484 | 55038468 | 55038463 | - |
| SEQ ID NO 47962 | TCCTTCCTGTTGCCTGTAATTG | TTC | chr1 | 55038441 | 55038462 | 55038446 | 55038441 | - |
| SEQ ID NO 47963 | CTTCCTGTTGCCTGTAATTGGA | CTC | chr1 | 55038439 | 55038460 | 55038444 | 55038439 | - |
| SEQ ID NO 47964 | CCTGTTGCCTGTAATTGGAATT | CTT | chr1 | 55038436 | 55038457 | 55038441 | 55038436 | - |
| SEQ ID NO 47965 | CTGTTGCCTGTAATTGGAATTG | TTC | chr1 | 55038435 | 55038456 | 55038440 | 55038435 | - |
| SEQ ID NO 47966 | TTGCCTGTAATTGGAATTGTAT | CTG | chr1 | 55038432 | 55038453 | 55038437 | 55038432 | - |
| SEQ ID NO 47967 | CCTGTAATTGGAATTGTATTTG | TTG | chr1 | 55038429 | 55038450 | 55038434 | 55038429 | - |
| SEQ ID NO 47968 | TAATTGGAATTGTATTTGCAAT | CTG | chr1 | 55038425 | 55038446 | 55038430 | 55038425 | - |
| SEQ ID NO 47969 | GAATTGTATTTGCAATGTGCTT | TTG | chr1 | 55038419 | 55038440 | 55038424 | 55038419 | - |
| SEQ ID NO 47970 | TATTTGCAATGTGCTTTTGGCA | TTG | chr1 | 55038413 | 55038434 | 55038418 | 55038413 | - |
| SEQ ID NO 47971 | GCAATGTGCTTTTGGCAGCTTC | TTT | chr1 | 55038408 | 55038429 | 55038413 | 55038408 | - |
| SEQ ID NO 47972 | CAATGTGCTTTTGGCAGCTTCC | TTG | chr1 | 55038407 | 55038428 | 55038412 | 55038407 | - |
| SEQ ID NO 47973 | TTGGCAGCTTCCTCATCAAAGG | CTT | chr1 | 55038397 | 55038418 | 55038402 | 55038397 | - |
| SEQ ID NO 47974 | TGGCAGCTTCCTCATCAAAGGC | TTT | chr1 | 55038396 | 55038417 | 55038401 | 55038396 | - |
| SEQ ID NO 47975 | GGCAGCTTCCTCATCAAAGGCC | TTT | chr1 | 55038395 | 55038416 | 55038400 | 55038395 | - |
| SEQ ID NO 47976 | GCAGCTTCCTCATCAAAGGCCT | TTG | chr1 | 55038394 | 55038415 | 55038399 | 55038394 | - |
| SEQ ID NO 47977 | CCTCATCAAAGGCCTCCCCTGG | CTT | chr1 | 55038387 | 55038408 | 55038392 | 55038387 | - |
| SEQ ID NO 47978 | CTCATCAAAGGCCTCCCCTGGA | TTC | chr1 | 55038386 | 55038407 | 55038391 | 55038386 | - |
| SEQ ID NO 47979 | ATCAAAGGCCTCCCCTGGAGCA | CTC | chr1 | 55038383 | 55038404 | 55038388 | 55038383 | - |
| SEQ ID NO 47980 | CCCTGGAGCAAGAATAGATGGG | CTC | chr1 | 55038371 | 55038392 | 55038376 | 55038371 | - |
| SEQ ID NO 47981 | GAGCAAGAATAGATGGGAGCTA | CTG | chr1 | 55038366 | 55038387 | 55038371 | 55038366 | - |
| SEQ ID NO 47982 | ACTTTCCCTGCTGCTCCCCTTT | CTA | chr1 | 55038344 | 55038365 | 55038349 | 55038344 | - |
| SEQ ID NO 47983 | TCCCTGCTGCTCCCCTTTGGGA | CTT | chr1 | 55038340 | 55038361 | 55038345 | 55038340 | - |
| SEQ ID NO 47984 | CCCTGCTGCTCCCCTTTGGGAC | TTT | chr1 | 55038339 | 55038360 | 55038344 | 55038339 | - |
| SEQ ID NO 47985 | CCTGCTGCTCCCCTTTGGGACC | TTC | chr1 | 55038338 | 55038359 | 55038343 | 55038338 | - |
| SEQ ID NO 47986 | CTGCTCCCCTTTGGGACCTTGG | CTG | chr1 | 55038334 | 55038355 | 55038339 | 55038334 | - |
| SEQ ID NO 47987 | CTCCCCTTTGGGACCTTGGCCT | CTG | chr1 | 55038331 | 55038352 | 55038336 | 55038331 | - |
| SEQ ID NO 47988 | CCCTTTGGGACCTTGGCCTCTC | CTC | chr1 | 55038328 | 55038349 | 55038333 | 55038328 | - |
| SEQ ID NO 47989 | TGGGACCTTGGCCTCTCACCTA | CTT | chr1 | 55038323 | 55038344 | 55038328 | 55038323 | - |
| SEQ ID NO 47990 | GGGACCTTGGCCTCTCACCTAC | TTT | chr1 | 55038322 | 55038343 | 55038327 | 55038322 | - |
| SEQ ID NO 47991 | GGACCTTGGCCTCTCACCTACC | TTG | chr1 | 55038321 | 55038342 | 55038326 | 55038321 | - |
| SEQ ID NO 47992 | GGCCTCTCACCTACCGGGGTCG | CTT | chr1 | 55038314 | 55038335 | 55038319 | 55038314 | - |
| SEQ ID NO 47993 | GCCTCTCACCTACCGGGGTCGT | TTG | chr1 | 55038313 | 55038334 | 55038318 | 55038313 | - |

Figure 67

| # | Sequence | PAM | Chr | Start | End | Cuts 5' of | Str |
|---|---|---|---|---|---|---|---|
| SEQ ID NO 47994 | GTAAGGCTGAGGCCTGGCAC | AGG | chr14 | 94387996 | 94388015 | 94388012 | + |
| SEQ ID NO 47995 | GCCTGGCACAGGTCTGTTCC | TGG | chr14 | 94388007 | 94388026 | 94388023 | + |
| SEQ ID NO 47996 | GGTCTGTTCCTGGTCATATC | TGG | chr14 | 94388017 | 94388036 | 94388033 | + |
| SEQ ID NO 47997 | TCTGTTCCTGGTCATATCTG | GAG | chr14 | 94388019 | 94388038 | 94388035 | + |
| SEQ ID NO 47998 | CTGTTCCTGGTCATATCTGG | AGG | chr14 | 94388020 | 94388039 | 94388036 | + |
| SEQ ID NO 47999 | TGTTCCTGGTCATATCTGGA | GGG | chr14 | 94388021 | 94388040 | 94388037 | + |
| SEQ ID NO 48000 | GTTCCTGGTCATATCTGGAG | GGG | chr14 | 94388022 | 94388041 | 94388038 | + |
| SEQ ID NO 48001 | CTGGTCATATCTGGAGGGGA | TGG | chr14 | 94388026 | 94388045 | 94388042 | + |
| SEQ ID NO 48002 | GGTCATATCTGGAGGGGATG | GAG | chr14 | 94388028 | 94388047 | 94388044 | + |
| SEQ ID NO 48003 | CTGGAGGGGATGGAGAATGT | GAG | chr14 | 94388036 | 94388055 | 94388052 | + |
| SEQ ID NO 48004 | AGGGGATGGAGAATGTGAGC | CGG | chr14 | 94388040 | 94388059 | 94388056 | + |
| SEQ ID NO 48005 | CGTTCCTCCCCACCCCTCTC | TGG | chr14 | 94388063 | 94388082 | 94388079 | + |
| SEQ ID NO 48006 | GACCTTAACCTCCTCATCTA | TAG | chr14 | 94388085 | 94388104 | 94388101 | + |
| SEQ ID NO 48007 | CTTAACCTCCTCATCTATAG | AAG | chr14 | 94388088 | 94388107 | 94388104 | + |
| SEQ ID NO 48008 | TTAACCTCCTCATCTATAGA | AGG | chr14 | 94388089 | 94388108 | 94388105 | + |
| SEQ ID NO 48009 | TAACCTCCTCATCTATAGAA | GGG | chr14 | 94388090 | 94388109 | 94388106 | + |
| SEQ ID NO 48010 | AACCTCCTCATCTATAGAAG | GGG | chr14 | 94388091 | 94388110 | 94388107 | + |
| SEQ ID NO 48011 | CCTCCTCATCTATAGAAGGG | GAG | chr14 | 94388093 | 94388112 | 94388109 | + |
| SEQ ID NO 48012 | CTCATCTATAGAAGGGGAGA | AAG | chr14 | 94388097 | 94388116 | 94388113 | + |
| SEQ ID NO 48013 | GGGGAGAAAGATGCATGCCC | AAG | chr14 | 94388110 | 94388129 | 94388126 | + |
| SEQ ID NO 48014 | GAGAAAGATGCATGCCCAAG | CAG | chr14 | 94388113 | 94388132 | 94388129 | + |
| SEQ ID NO 48015 | AAAGATGCATGCCCAAGCAG | TAG | chr14 | 94388116 | 94388135 | 94388132 | + |
| SEQ ID NO 48016 | AAGATGCATGCCCAAGCAGT | AGG | chr14 | 94388117 | 94388136 | 94388133 | + |
| SEQ ID NO 48017 | GATGCATGCCCAAGCAGTAG | GAG | chr14 | 94388119 | 94388138 | 94388135 | + |
| SEQ ID NO 48018 | TGCATGCCCAAGCAGTAGGA | GAG | chr14 | 94388121 | 94388140 | 94388137 | + |
| SEQ ID NO 48019 | GCATGCCCAAGCAGTAGGAG | AGG | chr14 | 94388122 | 94388141 | 94388138 | + |
| SEQ ID NO 48020 | TGCCCAAGCAGTAGGAGAGG | TGG | chr14 | 94388125 | 94388144 | 94388141 | + |
| SEQ ID NO 48021 | CAAGCAGTAGGAGAGGTGGT | GAG | chr14 | 94388129 | 94388148 | 94388145 | + |
| SEQ ID NO 48022 | AAGCAGTAGGAGAGGTGGTG | AGG | chr14 | 94388130 | 94388149 | 94388146 | + |
| SEQ ID NO 48023 | AGGAGAGGTGGTGAGGCTTA | TAG | chr14 | 94388137 | 94388156 | 94388153 | + |
| SEQ ID NO 48024 | GGAGAGGTGGTGAGGCTTAT | AGG | chr14 | 94388138 | 94388157 | 94388154 | + |
| SEQ ID NO 48025 | AGAGGTGGTGAGGCTTATAG | GAG | chr14 | 94388140 | 94388159 | 94388156 | + |
| SEQ ID NO 48026 | GTGAGGCTTATAGGAGACAA | CAG | chr14 | 94388147 | 94388166 | 94388163 | + |
| SEQ ID NO 48027 | GGCTTATAGGAGACAACAGA | CAG | chr14 | 94388151 | 94388170 | 94388167 | + |
| SEQ ID NO 48028 | GCTTATAGGAGACAACAGAC | AGG | chr14 | 94388152 | 94388171 | 94388168 | + |
| SEQ ID NO 48029 | TTATAGGAGACAACAGACAG | GAG | chr14 | 94388154 | 94388173 | 94388170 | + |
| SEQ ID NO 48030 | CAACAGACAGGAGCCCCGA | CAG | chr14 | 94388164 | 94388183 | 94388180 | + |
| SEQ ID NO 48031 | AGACAGGAGCCCCGACAGA | CAG | chr14 | 94388168 | 94388187 | 94388184 | + |
| SEQ ID NO 48032 | ACAGGAGCCCCGACAGACA | GAG | chr14 | 94388170 | 94388189 | 94388186 | + |
| SEQ ID NO 48033 | CAGGAGCCCCGACAGACAG | AGG | chr14 | 94388171 | 94388190 | 94388187 | + |
| SEQ ID NO 48034 | GGAGCCCCGACAGACAGAG | GAG | chr14 | 94388173 | 94388192 | 94388189 | + |
| SEQ ID NO 48035 | AGACAGAGGAGCTGTGCAAA | CAG | chr14 | 94388185 | 94388204 | 94388201 | + |
| SEQ ID NO 48036 | AGAGGAGCTGTGCAAACAGA | AAG | chr14 | 94388189 | 94388208 | 94388205 | + |
| SEQ ID NO 48037 | GCTGTGCAAACAGAAAGAAA | TGG | chr14 | 94388195 | 94388214 | 94388211 | + |
| SEQ ID NO 48038 | TTGTTGCTGTTGCTGTATCT | TGG | chr14 | 94388225 | 94388244 | 94388241 | + |
| SEQ ID NO 48039 | TGCTGTTGCTGTATCTTGGC | TGG | chr14 | 94388229 | 94388248 | 94388245 | + |
| SEQ ID NO 48040 | TTGGCTGGTGTCCCCCATCC | TGG | chr14 | 94388244 | 94388263 | 94388260 | + |

Figure 67 (Cont'd)

| | | | | | | | |
|---|---|---|---|---|---|---|---|
| SEQ ID NO 48041 | TGGCTGGTGTCCCCCATCCT | GGG | chr14 | 94388245 | 94388264 | 94388261 | + |
| SEQ ID NO 48042 | GGCTGGTGTCCCCCATCCTG | GGG | chr14 | 94388246 | 94388265 | 94388262 | + |
| SEQ ID NO 48043 | TGTCCCCCATCCTGGGGTGC | CAG | chr14 | 94388252 | 94388271 | 94388268 | + |
| SEQ ID NO 48044 | GTCCCCCATCCTGGGGTGCC | AGG | chr14 | 94388253 | 94388272 | 94388269 | + |
| SEQ ID NO 48045 | ATCCTGGGGTGCCAGGACTG | CAG | chr14 | 94388260 | 94388279 | 94388276 | + |
| SEQ ID NO 48046 | GGGTGCCAGGACTGCAGACC | TAG | chr14 | 94388266 | 94388285 | 94388282 | + |
| SEQ ID NO 48047 | CCCTCATCCACTTCTGCTTA | CAG | chr14 | 94388292 | 94388311 | 94388308 | + |
| SEQ ID NO 48048 | CCTCATCCACTTCTGCTTAC | AGG | chr14 | 94388293 | 94388312 | 94388309 | + |
| SEQ ID NO 48049 | CCACTTCTGCTTACAGGAAC | CAG | chr14 | 94388299 | 94388318 | 94388315 | + |
| SEQ ID NO 48050 | ACAGGAACCAGTGTATCCAC | CAG | chr14 | 94388311 | 94388330 | 94388327 | + |
| SEQ ID NO 48051 | CAGGAACCAGTGTATCCACC | AGG | chr14 | 94388312 | 94388331 | 94388328 | + |
| SEQ ID NO 48052 | GGAACCAGTGTATCCACCAG | GAG | chr14 | 94388314 | 94388333 | 94388330 | + |
| SEQ ID NO 48053 | GAACCAGTGTATCCACCAGG | AGG | chr14 | 94388315 | 94388334 | 94388331 | + |
| SEQ ID NO 48054 | TGTATCCACCAGGAGGTACC | GAG | chr14 | 94388322 | 94388341 | 94388338 | + |
| SEQ ID NO 48055 | GTATCCACCAGGAGGTACCG | AGG | chr14 | 94388323 | 94388342 | 94388339 | + |
| SEQ ID NO 48056 | TATCCACCAGGAGGTACCGA | GGG | chr14 | 94388324 | 94388343 | 94388340 | + |
| SEQ ID NO 48057 | ATCCACCAGGAGGTACCGAG | GGG | chr14 | 94388325 | 94388344 | 94388341 | + |
| SEQ ID NO 48058 | TCCACCAGGAGGTACCGAGG | GGG | chr14 | 94388326 | 94388345 | 94388342 | + |
| SEQ ID NO 48059 | CCACCAGGAGGTACCGAGGG | GGG | chr14 | 94388327 | 94388346 | 94388343 | + |
| SEQ ID NO 48060 | AGGAGGTACCGAGGGGGAC | CGG | chr14 | 94388332 | 94388351 | 94388348 | + |
| SEQ ID NO 48061 | GGAGGTACCGAGGGGGACC | GGG | chr14 | 94388333 | 94388352 | 94388349 | + |
| SEQ ID NO 48062 | GGTACCGAGGGGGACCGGG | CAG | chr14 | 94388336 | 94388355 | 94388352 | + |
| SEQ ID NO 48063 | GTACCGAGGGGGACCGGGC | AGG | chr14 | 94388337 | 94388356 | 94388353 | + |
| SEQ ID NO 48064 | GAGGGGGACCGGGCAGGAC | TGG | chr14 | 94388342 | 94388361 | 94388358 | + |
| SEQ ID NO 48065 | AGGGGGACCGGGCAGGACT | GGG | chr14 | 94388343 | 94388362 | 94388359 | + |
| SEQ ID NO 48066 | GACCGGGCAGGACTGGGAAA | CAG | chr14 | 94388349 | 94388368 | 94388365 | + |
| SEQ ID NO 48067 | ACCGGGCAGGACTGGGAAAC | AGG | chr14 | 94388350 | 94388369 | 94388366 | + |
| SEQ ID NO 48068 | GAAACAGGACACAACCCTCA | TGG | chr14 | 94388365 | 94388384 | 94388381 | + |
| SEQ ID NO 48069 | GGCTGCTGTTATTATGAAAA | TAG | chr14 | 94388386 | 94388405 | 94388402 | + |
| SEQ ID NO 48070 | GCTGCTGTTATTATGAAAAT | AGG | chr14 | 94388387 | 94388406 | 94388403 | + |
| SEQ ID NO 48071 | TGCTGTTATTATGAAAATAG | GAG | chr14 | 94388389 | 94388408 | 94388405 | + |
| SEQ ID NO 48072 | TTATTATGAAAATAGGAGCT | CAG | chr14 | 94388394 | 94388413 | 94388410 | + |
| SEQ ID NO 48073 | TGAAAATAGGAGCTCAGCTG | CAG | chr14 | 94388400 | 94388419 | 94388416 | + |
| SEQ ID NO 48074 | TCTCCATCTGCCCTGCACCT | CAG | chr14 | 94388425 | 94388444 | 94388441 | + |
| SEQ ID NO 48075 | CCATCTGCCCTGCACCTCAG | CAG | chr14 | 94388428 | 94388447 | 94388444 | + |
| SEQ ID NO 48076 | CATCTGCCCTGCACCTCAGC | AGG | chr14 | 94388429 | 94388448 | 94388445 | + |
| SEQ ID NO 48077 | CTGCCCTGCACCTCAGCAGG | CGG | chr14 | 94388432 | 94388451 | 94388448 | + |
| SEQ ID NO 48078 | CCACAACCCCCTCCTGCCC | CAG | chr14 | 94388464 | 94388483 | 94388480 | + |
| SEQ ID NO 48079 | CCCCAGACCTGCTGCCTGCC | TGG | chr14 | 94388481 | 94388500 | 94388497 | + |
| SEQ ID NO 48080 | CCCAGACCTGCTGCCTGCCT | GGG | chr14 | 94388482 | 94388501 | 94388498 | + |
| SEQ ID NO 48081 | CCTGCTGCCTGCCTGGGCCA | TGG | chr14 | 94388488 | 94388507 | 94388504 | + |
| SEQ ID NO 48082 | CTGCTGCCTGCCTGGGCCAT | GGG | chr14 | 94388489 | 94388508 | 94388505 | + |
| SEQ ID NO 48083 | TGCTGCCTGCCTGGGCCATG | GGG | chr14 | 94388490 | 94388509 | 94388506 | + |
| SEQ ID NO 48084 | CTGCCTGCCTGGGCCATGGG | GAG | chr14 | 94388492 | 94388511 | 94388508 | + |
| SEQ ID NO 48085 | TGCCTGGGCCATGGGGAGCT | CAG | chr14 | 94388497 | 94388516 | 94388513 | + |
| SEQ ID NO 48086 | CTGGGCCATGGGGAGCTCAG | AAG | chr14 | 94388500 | 94388519 | 94388516 | + |
| SEQ ID NO 48087 | GGGGAGCTCAGAAGCCTCTC | CAG | chr14 | 94388509 | 94388528 | 94388525 | + |
| SEQ ID NO 48088 | AGCCTCTCCAGAACCTCTCG | CAG | chr14 | 94388521 | 94388540 | 94388537 | + |

Figure 67 (Cont'd)

| | | | | | | | |
|---|---|---|---|---|---|---|---|
| SEQ ID NO 48089 | TCCAGAACCTCTCGCAGTGA | AAG | chr14 | 94388527 | 94388546 | 94388543 | + |
| SEQ ID NO 48090 | CCAGAACCTCTCGCAGTGAA | AGG | chr14 | 94388528 | 94388547 | 94388544 | + |
| SEQ ID NO 48091 | ATACTTACGATTCACTGTCC | CAG | chr14 | 94388552 | 94388571 | 94388568 | + |
| SEQ ID NO 48092 | TACTTACGATTCACTGTCCC | AGG | chr14 | 94388553 | 94388572 | 94388569 | + |
| SEQ ID NO 48093 | TACGATTCACTGTCCAGGT | CAG | chr14 | 94388557 | 94388576 | 94388573 | + |
| SEQ ID NO 48094 | GATTCACTGTCCAGGTCAG | TGG | chr14 | 94388560 | 94388579 | 94388576 | + |
| SEQ ID NO 48095 | TCACTGTCCAGGTCAGTGG | TGG | chr14 | 94388563 | 94388582 | 94388579 | + |
| SEQ ID NO 48096 | CAGGTCAGTGGTGGTGCCTG | AAG | chr14 | 94388572 | 94388591 | 94388588 | + |
| SEQ ID NO 48097 | CAGTGGTGGTGCCTGAAGCT | GAG | chr14 | 94388577 | 94388596 | 94388593 | + |
| SEQ ID NO 48098 | AGTGGTGGTGCCTGAAGCTG | AGG | chr14 | 94388578 | 94388597 | 94388594 | + |
| SEQ ID NO 48099 | TGGTGGTGCCTGAAGCTGAG | GAG | chr14 | 94388580 | 94388599 | 94388596 | + |
| SEQ ID NO 48100 | GGTGCCTGAAGCTGAGGAGA | CAG | chr14 | 94388584 | 94388603 | 94388600 | + |
| SEQ ID NO 48101 | GTGCCTGAAGCTGAGGAGAC | AGG | chr14 | 94388585 | 94388604 | 94388601 | + |
| SEQ ID NO 48102 | TGCCTGAAGCTGAGGAGACA | GGG | chr14 | 94388586 | 94388605 | 94388602 | + |
| SEQ ID NO 48103 | CCCTGTCCTCGTCCGTATTT | AAG | chr14 | 94388609 | 94388628 | 94388625 | + |
| SEQ ID NO 48104 | TGTCCTCGTCCGTATTTAAG | CAG | chr14 | 94388612 | 94388631 | 94388628 | + |
| SEQ ID NO 48105 | CCTCGTCCGTATTTAAGCAG | TGG | chr14 | 94388615 | 94388634 | 94388631 | + |
| SEQ ID NO 48106 | CCGTATTTAAGCAGTGGATC | CAG | chr14 | 94388621 | 94388640 | 94388637 | + |
| SEQ ID NO 48107 | GTATTTAAGCAGTGGATCCA | GAG | chr14 | 94388623 | 94388642 | 94388639 | + |
| SEQ ID NO 48108 | TATTTAAGCAGTGGATCCAG | AGG | chr14 | 94388624 | 94388643 | 94388640 | + |
| SEQ ID NO 48109 | ATTTAAGCAGTGGATCCAGA | GGG | chr14 | 94388625 | 94388644 | 94388641 | + |
| SEQ ID NO 48110 | TTTAAGCAGTGGATCCAGAG | GGG | chr14 | 94388626 | 94388645 | 94388642 | + |
| SEQ ID NO 48111 | CAGTGGATCCAGAGGGGCAA | CGG | chr14 | 94388632 | 94388651 | 94388648 | + |
| SEQ ID NO 48112 | AGTGGATCCAGAGGGGCAAC | GGG | chr14 | 94388633 | 94388652 | 94388649 | + |
| SEQ ID NO 48113 | GTGGATCCAGAGGGGCAACG | GGG | chr14 | 94388634 | 94388653 | 94388650 | + |
| SEQ ID NO 48114 | TGGATCCAGAGGGGCAACGG | GGG | chr14 | 94388635 | 94388654 | 94388651 | + |
| SEQ ID NO 48115 | GATCCAGAGGGGCAACGGGG | GAG | chr14 | 94388637 | 94388656 | 94388653 | + |
| SEQ ID NO 48116 | ATCCAGAGGGGCAACGGGGG | AGG | chr14 | 94388638 | 94388657 | 94388654 | + |
| SEQ ID NO 48117 | GGGGCAACGGGGGAGGCTGC | TGG | chr14 | 94388645 | 94388664 | 94388661 | + |
| SEQ ID NO 48118 | GCTGCTGGTGAATATTAACC | AAG | chr14 | 94388660 | 94388679 | 94388676 | + |
| SEQ ID NO 48119 | CTGCTGGTGAATATTAACCA | AGG | chr14 | 94388661 | 94388680 | 94388677 | + |
| SEQ ID NO 48120 | AATATTAACCAAGGTCACCC | CAG | chr14 | 94388670 | 94388689 | 94388686 | + |
| SEQ ID NO 48121 | ACCAAGGTCACCCCAGTTAT | CGG | chr14 | 94388677 | 94388696 | 94388693 | + |
| SEQ ID NO 48122 | CAAGGTCACCCCAGTTATCG | GAG | chr14 | 94388679 | 94388698 | 94388695 | + |
| SEQ ID NO 48123 | AAGGTCACCCCAGTTATCGG | AGG | chr14 | 94388680 | 94388699 | 94388696 | + |
| SEQ ID NO 48124 | GGTCACCCCAGTTATCGGAG | GAG | chr14 | 94388682 | 94388701 | 94388698 | + |
| SEQ ID NO 48125 | CCAGTTATCGGAGGAGCAAA | CAG | chr14 | 94388689 | 94388708 | 94388705 | + |
| SEQ ID NO 48126 | CAGTTATCGGAGGAGCAAAC | AGG | chr14 | 94388690 | 94388709 | 94388706 | + |
| SEQ ID NO 48127 | AGTTATCGGAGGAGCAAACA | GGG | chr14 | 94388691 | 94388710 | 94388707 | + |
| SEQ ID NO 48128 | GTTATCGGAGGAGCAAACAG | GGG | chr14 | 94388692 | 94388711 | 94388708 | + |
| SEQ ID NO 48129 | CGGAGGAGCAAACAGGGGCT | AAG | chr14 | 94388697 | 94388716 | 94388713 | + |
| SEQ ID NO 48130 | CAAACAGGGGCTAAGTCCAC | TGG | chr14 | 94388705 | 94388724 | 94388721 | + |
| SEQ ID NO 48131 | CAGGGGCTAAGTCCACTGGC | TGG | chr14 | 94388709 | 94388728 | 94388725 | + |
| SEQ ID NO 48132 | AGGGGCTAAGTCCACTGGCT | GGG | chr14 | 94388710 | 94388729 | 94388726 | + |
| SEQ ID NO 48133 | AAGTCCACTGGCTGGGATCT | GAG | chr14 | 94388717 | 94388736 | 94388733 | + |
| SEQ ID NO 48134 | AGTCGCCCGCCTACGCTGCC | CGG | chr14 | 94388738 | 94388757 | 94388754 | + |
| SEQ ID NO 48135 | CGCTGCCCGGACGCTTTGCC | TGG | chr14 | 94388751 | 94388770 | 94388767 | + |
| SEQ ID NO 48136 | GCTGCCCGGACGCTTTGCCT | GGG | chr14 | 94388752 | 94388771 | 94388768 | + |

Figure 67 (Cont'd)

| SEQ ID NO 48137 | GCCCGGACGCTTTGCCTGGG | CAG | chr14 | 94388755 | 94388774 | 94388771 | + |
| SEQ ID NO 48138 | CGCTTTGCCTGGGCAGTGTA | CAG | chr14 | 94388762 | 94388781 | 94388778 | + |
| SEQ ID NO 48139 | GCTTCCACTGCACTTACCGA | AAG | chr14 | 94388784 | 94388803 | 94388800 | + |
| SEQ ID NO 48140 | CTTCCACTGCACTTACCGAA | AGG | chr14 | 94388785 | 94388804 | 94388801 | + |
| SEQ ID NO 48141 | TCCACTGCACTTACCGAAAG | GAG | chr14 | 94388787 | 94388806 | 94388803 | + |
| SEQ ID NO 48142 | CCGAAAGGAGTCATTGTACC | TGG | chr14 | 94388800 | 94388819 | 94388816 | + |
| SEQ ID NO 48143 | AGGAGTCATTGTACCTGGCT | CAG | chr14 | 94388805 | 94388824 | 94388821 | + |
| SEQ ID NO 48144 | TGTACCTGGCTCAGAAACCA | CAG | chr14 | 94388814 | 94388833 | 94388830 | + |
| SEQ ID NO 48145 | AACCACAGCGTCCTGTGTCC | AAG | chr14 | 94388829 | 94388848 | 94388845 | + |
| SEQ ID NO 48146 | ACCACAGCGTCCTGTGTCCA | AGG | chr14 | 94388830 | 94388849 | 94388846 | + |
| SEQ ID NO 48147 | ACAGCGTCCTGTGTCCAAGG | TGG | chr14 | 94388833 | 94388852 | 94388849 | + |
| SEQ ID NO 48148 | AGCGTCCTGTGTCCAAGGTG | GAG | chr14 | 94388835 | 94388854 | 94388851 | + |
| SEQ ID NO 48149 | GCGTCCTGTGTCCAAGGTGG | AGG | chr14 | 94388836 | 94388855 | 94388852 | + |
| SEQ ID NO 48150 | CGTCCTGTGTCCAAGGTGGA | GGG | chr14 | 94388837 | 94388856 | 94388853 | + |
| SEQ ID NO 48151 | GTCCTGTGTCCAAGGTGGAG | GGG | chr14 | 94388838 | 94388857 | 94388854 | + |
| SEQ ID NO 48152 | TCCTGTGTCCAAGGTGGAGG | GGG | chr14 | 94388839 | 94388858 | 94388855 | + |
| SEQ ID NO 48153 | TGTGTCCAAGGTGGAGGGGG | TGG | chr14 | 94388842 | 94388861 | 94388858 | + |
| SEQ ID NO 48154 | CAAGGTGGAGGGGTGGCGT | GAG | chr14 | 94388848 | 94388867 | 94388864 | + |
| SEQ ID NO 48155 | GTGGAGGGGTGGCGTGAGT | CAG | chr14 | 94388852 | 94388871 | 94388868 | + |
| SEQ ID NO 48156 | AGGGGGTGGCGTGAGTCAGA | CAG | chr14 | 94388856 | 94388875 | 94388872 | + |
| SEQ ID NO 48157 | GGCGTGAGTCAGACAGTCTC | TGG | chr14 | 94388863 | 94388882 | 94388879 | + |
| SEQ ID NO 48158 | GCGTGAGTCAGACAGTCTCT | GGG | chr14 | 94388864 | 94388883 | 94388880 | + |
| SEQ ID NO 48159 | GTGAGTCAGACAGTCTCTGG | GAG | chr14 | 94388866 | 94388885 | 94388882 | + |
| SEQ ID NO 48160 | GAGTCAGACAGTCTCTGGGA | GAG | chr14 | 94388868 | 94388887 | 94388884 | + |
| SEQ ID NO 48161 | GTCTCTGGGAGAGTACCACT | TAG | chr14 | 94388878 | 94388897 | 94388894 | + |
| SEQ ID NO 48162 | CTGGGAGAGTACCACTTAGC | TGG | chr14 | 94388882 | 94388901 | 94388898 | + |
| SEQ ID NO 48163 | CTGGCCCTCTGCTCTCACTG | CAG | chr14 | 94388901 | 94388920 | 94388917 | + |
| SEQ ID NO 48164 | TGCTCTCACTGCAGAATCCT | TAG | chr14 | 94388910 | 94388929 | 94388926 | + |
| SEQ ID NO 48165 | TCTCACTGCAGAATCCTTAG | TGG | chr14 | 94388913 | 94388932 | 94388929 | + |
| SEQ ID NO 48166 | ATCCTTAGTGGCTGTTCCAC | TGG | chr14 | 94388925 | 94388944 | 94388941 | + |
| SEQ ID NO 48167 | CTTAGTGGCTGTTCCACTGG | TAG | chr14 | 94388928 | 94388947 | 94388944 | + |
| SEQ ID NO 48168 | GTGGCTGTTCCACTGGTAGC | AAG | chr14 | 94388932 | 94388951 | 94388948 | + |
| SEQ ID NO 48169 | AGCAAGATCTACCATTTACT | GAG | chr14 | 94388949 | 94388968 | 94388965 | + |
| SEQ ID NO 48170 | CCCCAAAATGCCTGATGCTG | AAG | chr14 | 94388975 | 94388994 | 94388991 | + |
| SEQ ID NO 48171 | CTGAAGACTTACTGCCGCCC | TGG | chr14 | 94388992 | 94389011 | 94389008 | + |
| SEQ ID NO 48172 | TGAAGACTTACTGCCGCCCT | GGG | chr14 | 94388993 | 94389012 | 94389009 | + |
| SEQ ID NO 48173 | AAGACTTACTGCCGCCCTGG | GAG | chr14 | 94388995 | 94389014 | 94389011 | + |
| SEQ ID NO 48174 | TTACTGCCGCCCTGGGAGAT | CAG | chr14 | 94389000 | 94389019 | 94389016 | + |
| SEQ ID NO 48175 | ACTGCCGCCCTGGGAGATCA | GAG | chr14 | 94389002 | 94389021 | 94389018 | + |
| SEQ ID NO 48176 | GCCGCCCTGGGAGATCAGAG | TGG | chr14 | 94389005 | 94389024 | 94389021 | + |
| SEQ ID NO 48177 | CCGCCCTGGGAGATCAGAGT | GGG | chr14 | 94389006 | 94389025 | 94389022 | + |
| SEQ ID NO 48178 | CCTGGGAGATCAGAGTGGGT | TAG | chr14 | 94389010 | 94389029 | 94389026 | + |
| SEQ ID NO 48179 | TGGGAGATCAGAGTGGGTTA | GAG | chr14 | 94389012 | 94389031 | 94389028 | + |
| SEQ ID NO 48180 | GTGGGTTAGAGCCCATTTGA | CAG | chr14 | 94389024 | 94389043 | 94389040 | + |
| SEQ ID NO 48181 | TTAGAGCCCATTTGACAGAT | GAG | chr14 | 94389029 | 94389048 | 94389045 | + |
| SEQ ID NO 48182 | TAGAGCCCATTTGACAGATG | AGG | chr14 | 94389030 | 94389049 | 94389046 | + |
| SEQ ID NO 48183 | CCATTTGACAGATGAGGAAA | CAG | chr14 | 94389036 | 94389055 | 94389052 | + |
| SEQ ID NO 48184 | CATTTGACAGATGAGGAAAC | AGG | chr14 | 94389037 | 94389056 | 94389053 | + |

Figure 67 (Cont'd)

| SEQ ID NO 48185 | GACAGATGAGGAAACAGGCT | CAG | chr14 | 94389042 | 94389061 | 94389058 | + |
| SEQ ID NO 48186 | CAGATGAGGAAACAGGCTCA | GAG | chr14 | 94389044 | 94389063 | 94389060 | + |
| SEQ ID NO 48187 | ATGAGGAAACAGGCTCAGAG | CGG | chr14 | 94389047 | 94389066 | 94389063 | + |
| SEQ ID NO 48188 | GAGGAAACAGGCTCAGAGCG | GAG | chr14 | 94389049 | 94389068 | 94389065 | + |
| SEQ ID NO 48189 | GGAAACAGGCTCAGAGCGGA | GAG | chr14 | 94389051 | 94389070 | 94389067 | + |
| SEQ ID NO 48190 | GCGGAGAGACCGCTCATCCA | AAG | chr14 | 94389066 | 94389085 | 94389082 | + |
| SEQ ID NO 48191 | ACCGCTCATCCAAAGTTACC | CAG | chr14 | 94389074 | 94389093 | 94389090 | + |
| SEQ ID NO 48192 | CTCATCCAAAGTTACCCAGT | CAG | chr14 | 94389078 | 94389097 | 94389094 | + |
| SEQ ID NO 48193 | CAAAGTTACCCAGTCAGCCT | TAG | chr14 | 94389084 | 94389103 | 94389100 | + |
| SEQ ID NO 48194 | AGACACAAACACCCTCTTGA | TGG | chr14 | 94389105 | 94389124 | 94389121 | + |
| SEQ ID NO 48195 | CACCCTCTTGATGGTCCCGA | TGG | chr14 | 94389114 | 94389133 | 94389130 | + |
| SEQ ID NO 48196 | TGATGGTCCCGATGGAAAAA | TGG | chr14 | 94389122 | 94389141 | 94389138 | + |
| SEQ ID NO 48197 | ATGGTCCCGATGGAAAAATG | GAG | chr14 | 94389124 | 94389143 | 94389140 | + |
| SEQ ID NO 48198 | TGGAAAAATGGAGCATGACT | GAG | chr14 | 94389134 | 94389153 | 94389150 | + |
| SEQ ID NO 48199 | GGAAAAATGGAGCATGACTG | AGG | chr14 | 94389135 | 94389154 | 94389151 | + |
| SEQ ID NO 48200 | AAAATGGAGCATGACTGAGG | CAG | chr14 | 94389138 | 94389157 | 94389154 | + |
| SEQ ID NO 48201 | ACTGAGGCAGACACAACCGT | CAG | chr14 | 94389151 | 94389170 | 94389167 | + |
| SEQ ID NO 48202 | CTGAGGCAGACACAACCGTC | AGG | chr14 | 94389152 | 94389171 | 94389168 | + |
| SEQ ID NO 48203 | GGCAGACACAACCGTCAGGC | TGG | chr14 | 94389156 | 94389175 | 94389172 | + |
| SEQ ID NO 48204 | ACACAACCGTCAGGCTGGCA | TGG | chr14 | 94389161 | 94389180 | 94389177 | + |
| SEQ ID NO 48205 | CACAACCGTCAGGCTGGCAT | GGG | chr14 | 94389162 | 94389181 | 94389178 | + |
| SEQ ID NO 48206 | ACAACCGTCAGGCTGGCATG | GGG | chr14 | 94389163 | 94389182 | 94389179 | + |
| SEQ ID NO 48207 | CAACCGTCAGGCTGGCATGG | GGG | chr14 | 94389164 | 94389183 | 94389180 | + |
| SEQ ID NO 48208 | AACCGTCAGGCTGGCATGGG | GGG | chr14 | 94389165 | 94389184 | 94389181 | + |
| SEQ ID NO 48209 | AGGCTGGCATGGGGGGCCGT | GAG | chr14 | 94389172 | 94389191 | 94389188 | + |
| SEQ ID NO 48210 | TGGCATGGGGGGCCGTGAGA | CAG | chr14 | 94389176 | 94389195 | 94389192 | + |
| SEQ ID NO 48211 | GGCATGGGGGGCCGTGAGAC | AGG | chr14 | 94389177 | 94389196 | 94389193 | + |
| SEQ ID NO 48212 | GCATGGGGGGCCGTGAGACA | GGG | chr14 | 94389178 | 94389197 | 94389194 | + |
| SEQ ID NO 48213 | TGGGGGGCCGTGAGACAGGG | TAG | chr14 | 94389181 | 94389200 | 94389197 | + |
| SEQ ID NO 48214 | GGGGGCCGTGAGACAGGGTA | GAG | chr14 | 94389183 | 94389202 | 94389199 | + |
| SEQ ID NO 48215 | GGGGCCGTGAGACAGGGTAG | AGG | chr14 | 94389184 | 94389203 | 94389200 | + |
| SEQ ID NO 48216 | GCCGTGAGACAGGGTAGAGG | TGG | chr14 | 94389187 | 94389206 | 94389203 | + |
| SEQ ID NO 48217 | CCGTGAGACAGGGTAGAGGT | GGG | chr14 | 94389188 | 94389207 | 94389204 | + |
| SEQ ID NO 48218 | CGTGAGACAGGGTAGAGGTG | GGG | chr14 | 94389189 | 94389208 | 94389205 | + |
| SEQ ID NO 48219 | GAGACAGGGTAGAGGTGGGG | AAG | chr14 | 94389192 | 94389211 | 94389208 | + |
| SEQ ID NO 48220 | GGTGGGGAAGCACATCTGTA | AAG | chr14 | 94389205 | 94389224 | 94389221 | + |
| SEQ ID NO 48221 | GGGGAAGCACATCTGTAAAG | AAG | chr14 | 94389208 | 94389227 | 94389224 | + |
| SEQ ID NO 48222 | GGAAGCACATCTGTAAAGAA | GAG | chr14 | 94389210 | 94389229 | 94389226 | + |
| SEQ ID NO 48223 | AAAGAAGAGCTGTGCTGCCT | CAG | chr14 | 94389224 | 94389243 | 94389240 | + |
| SEQ ID NO 48224 | AAGAAGAGCTGTGCTGCCTC | AGG | chr14 | 94389225 | 94389244 | 94389241 | + |
| SEQ ID NO 48225 | AAGAGCTGTGCTGCCTCAGG | CAG | chr14 | 94389228 | 94389247 | 94389244 | + |
| SEQ ID NO 48226 | AGAGCTGTGCTGCCTCAGGC | AGG | chr14 | 94389229 | 94389248 | 94389245 | + |
| SEQ ID NO 48227 | GCCGCTTCACCTCTCTGAAC | CAG | chr14 | 94389251 | 94389270 | 94389267 | + |
| SEQ ID NO 48228 | CCGCTTCACCTCTCTGAACC | AGG | chr14 | 94389252 | 94389271 | 94389268 | + |
| SEQ ID NO 48229 | ACTGTTTCACCTGCATCCCA | AAG | chr14 | 94389276 | 94389295 | 94389292 | + |
| SEQ ID NO 48230 | TGTTTCACCTGCATCCCAAA | GAG | chr14 | 94389278 | 94389297 | 94389294 | + |
| SEQ ID NO 48231 | TCACCTGCATCCCAAAGAGT | TGG | chr14 | 94389282 | 94389301 | 94389298 | + |
| SEQ ID NO 48232 | CCTGCATCCCAAAGAGTTGG | AAG | chr14 | 94389285 | 94389304 | 94389301 | + |

Figure 67 (Cont'd)

| | | | | | | | |
|---|---|---|---|---|---|---|---|
| SEQ ID NO 48233 | GAGTTGGAAGTTTCATTCCC | AAG | chr14 | 94389298 | 94389317 | 94389314 | + |
| SEQ ID NO 48234 | CATTCCCAAGCATGCTTGTG | AAG | chr14 | 94389311 | 94389330 | 94389327 | + |
| SEQ ID NO 48235 | AGCATGCTTGTGAAGTGCCT | CGG | chr14 | 94389319 | 94389338 | 94389335 | + |
| SEQ ID NO 48236 | GCATGCTTGTGAAGTGCCTC | GGG | chr14 | 94389320 | 94389339 | 94389336 | + |
| SEQ ID NO 48237 | CTTGTGAAGTGCCTCGGGTG | AAG | chr14 | 94389325 | 94389344 | 94389341 | + |
| SEQ ID NO 48238 | AGTGCCTCGGGTGAAGTGCC | TGG | chr14 | 94389332 | 94389351 | 94389348 | + |
| SEQ ID NO 48239 | CGGGTGAAGTGCCTGGCACA | CAG | chr14 | 94389339 | 94389358 | 94389355 | + |
| SEQ ID NO 48240 | GTGAAGTGCCTGGCACACAG | TAG | chr14 | 94389342 | 94389361 | 94389358 | + |
| SEQ ID NO 48241 | TGAAGTGCCTGGCACACAGT | AGG | chr14 | 94389343 | 94389362 | 94389359 | + |
| SEQ ID NO 48242 | CACACAGTAGGCTCTTTATG | TGG | chr14 | 94389355 | 94389374 | 94389371 | + |
| SEQ ID NO 48243 | ACACAGTAGGCTCTTTATGT | GGG | chr14 | 94389356 | 94389375 | 94389372 | + |
| SEQ ID NO 48244 | GCTCTTTATGTGGGTCTGCA | CAG | chr14 | 94389365 | 94389384 | 94389381 | + |
| SEQ ID NO 48245 | GGTCTGCACAGCCCTCTGCT | TAG | chr14 | 94389377 | 94389396 | 94389393 | + |
| SEQ ID NO 48246 | CCTCTGCTTAGTCTGCCCCC | CAG | chr14 | 94389389 | 94389408 | 94389405 | + |
| SEQ ID NO 48247 | CTCTGCTTAGTCTGCCCCCC | AGG | chr14 | 94389390 | 94389409 | 94389406 | + |
| SEQ ID NO 48248 | AGTCTGCCCCCAGGCTGCT | CAG | chr14 | 94389398 | 94389417 | 94389414 | + |
| SEQ ID NO 48249 | TCTGCCCCCAGGCTGCTCA | GAG | chr14 | 94389400 | 94389419 | 94389416 | + |
| SEQ ID NO 48250 | GCCCCCAGGCTGCTCAGAG | CAG | chr14 | 94389403 | 94389422 | 94389419 | + |
| SEQ ID NO 48251 | CCCCCAGGCTGCTCAGAGC | AGG | chr14 | 94389404 | 94389423 | 94389420 | + |
| SEQ ID NO 48252 | CCCCAGGCTGCTCAGAGCAG | GAG | chr14 | 94389406 | 94389425 | 94389422 | + |
| SEQ ID NO 48253 | CCCAGGCTGCTCAGAGCAGG | AGG | chr14 | 94389407 | 94389426 | 94389423 | + |
| SEQ ID NO 48254 | CAGGCTGCTCAGAGCAGGAG | GAG | chr14 | 94389409 | 94389428 | 94389425 | + |
| SEQ ID NO 48255 | AGGCTGCTCAGAGCAGGAGG | AGG | chr14 | 94389410 | 94389429 | 94389426 | + |
| SEQ ID NO 48256 | GGAGGAGGTTCAATTTTGAC | CAG | chr14 | 94389425 | 94389444 | 94389441 | + |
| SEQ ID NO 48257 | GGTTCAATTTTGACCAGCCT | CAG | chr14 | 94389431 | 94389450 | 94389447 | + |
| SEQ ID NO 48258 | GTTCAATTTTGACCAGCCTC | AGG | chr14 | 94389432 | 94389451 | 94389448 | + |
| SEQ ID NO 48259 | CCTGTTTCTGTTTTTGCTCC | TGG | chr14 | 94389455 | 94389474 | 94389471 | + |
| SEQ ID NO 48260 | TGTTTTTGCTCCTGGAAAAC | CAG | chr14 | 94389463 | 94389482 | 94389479 | + |
| SEQ ID NO 48261 | AAACCAGTGTGATCCGTATA | CAG | chr14 | 94389479 | 94389498 | 94389495 | + |
| SEQ ID NO 48262 | AGTGTGATCCGTATACAGCT | TGG | chr14 | 94389484 | 94389503 | 94389500 | + |
| SEQ ID NO 48263 | TGTGATCCGTATACAGCTTG | GAG | chr14 | 94389486 | 94389505 | 94389502 | + |
| SEQ ID NO 48264 | TATACAGCTTGGAGTTTCTT | TGG | chr14 | 94389495 | 94389514 | 94389511 | + |
| SEQ ID NO 48265 | TTGGAGTTTCTTTGGATACA | TGG | chr14 | 94389503 | 94389522 | 94389519 | + |
| SEQ ID NO 48266 | TGGATACATGGCCCCACTC | TGG | chr14 | 94389515 | 94389534 | 94389531 | + |
| SEQ ID NO 48267 | GGATACATGGCCCCACTCT | GGG | chr14 | 94389516 | 94389535 | 94389532 | + |
| SEQ ID NO 48268 | GATACATGGCCCCACTCTG | GGG | chr14 | 94389517 | 94389536 | 94389533 | + |
| SEQ ID NO 48269 | GGCCCCACTCTGGGGTTGT | TGG | chr14 | 94389524 | 94389543 | 94389540 | + |
| SEQ ID NO 48270 | CCCCACTCTGGGGTTGTTG | GAG | chr14 | 94389526 | 94389545 | 94389542 | + |
| SEQ ID NO 48271 | CCCCACTCTGGGGTTGTTGG | AGG | chr14 | 94389527 | 94389546 | 94389543 | + |
| SEQ ID NO 48272 | CTGGGGTTGTTGGAGGCCTT | TGG | chr14 | 94389534 | 94389553 | 94389550 | + |
| SEQ ID NO 48273 | GGGGTTGTTGGAGGCCTTTG | GAG | chr14 | 94389536 | 94389555 | 94389552 | + |
| SEQ ID NO 48274 | TGGAGGCCTTTGGAGACTGC | TGG | chr14 | 94389544 | 94389563 | 94389560 | + |
| SEQ ID NO 48275 | GGAGGCCTTTGGAGACTGCT | GGG | chr14 | 94389545 | 94389564 | 94389561 | + |
| SEQ ID NO 48276 | GAGGCCTTTGGAGACTGCTG | GGG | chr14 | 94389546 | 94389565 | 94389562 | + |
| SEQ ID NO 48277 | AGGCCTTTGGAGACTGCTGG | GGG | chr14 | 94389547 | 94389566 | 94389563 | + |
| SEQ ID NO 48278 | CCTTTGGAGACTGCTGGGGG | TGG | chr14 | 94389550 | 94389569 | 94389566 | + |
| SEQ ID NO 48279 | TTTGGAGACTGCTGGGGGTG | GAG | chr14 | 94389552 | 94389571 | 94389568 | + |
| SEQ ID NO 48280 | TTGGAGACTGCTGGGGGTGG | AGG | chr14 | 94389553 | 94389572 | 94389569 | + |

Figure 67 (Cont'd)

| | | | | | | | |
|---|---|---|---|---|---|---|---|
| SEQ ID NO 48281 | TGGAGACTGCTGGGGGTGGA | GGG | chr14 | 94389554 | 94389573 | 94389570 | + |
| SEQ ID NO 48282 | GGAGACTGCTGGGGGTGGAG | GGG | chr14 | 94389555 | 94389574 | 94389571 | + |
| SEQ ID NO 48283 | AGACTGCTGGGGGTGGAGGG | GAG | chr14 | 94389557 | 94389576 | 94389573 | + |
| SEQ ID NO 48284 | GACTGCTGGGGGTGGAGGGG | AGG | chr14 | 94389558 | 94389577 | 94389574 | + |
| SEQ ID NO 48285 | ACTGCTGGGGGTGGAGGGGA | GGG | chr14 | 94389559 | 94389578 | 94389575 | + |
| SEQ ID NO 48286 | CTGCTGGGGGTGGAGGGGAG | GGG | chr14 | 94389560 | 94389579 | 94389576 | + |
| SEQ ID NO 48287 | GCTGGGGGTGGAGGGGAGGG | GAG | chr14 | 94389562 | 94389581 | 94389578 | + |
| SEQ ID NO 48288 | CTGGGGGTGGAGGGGAGGGG | AGG | chr14 | 94389563 | 94389582 | 94389579 | + |
| SEQ ID NO 48289 | GGTGGAGGGGAGGGGAGGTA | CAG | chr14 | 94389568 | 94389587 | 94389584 | + |
| SEQ ID NO 48290 | GTGGAGGGGAGGGGAGGTAC | AGG | chr14 | 94389569 | 94389588 | 94389585 | + |
| SEQ ID NO 48291 | TGGAGGGGAGGGGAGGTACA | GGG | chr14 | 94389570 | 94389589 | 94389586 | + |
| SEQ ID NO 48292 | GGGAGGGGAGGTACAGGGTT | GAG | chr14 | 94389575 | 94389594 | 94389591 | + |
| SEQ ID NO 48293 | GGAGGGGAGGTACAGGGTTG | AGG | chr14 | 94389576 | 94389595 | 94389592 | + |
| SEQ ID NO 48294 | GGGAGGTACAGGGTTGAGGC | TAG | chr14 | 94389580 | 94389599 | 94389596 | + |
| SEQ ID NO 48295 | AGGTACAGGGTTGAGGCTAG | TGG | chr14 | 94389583 | 94389602 | 94389599 | + |
| SEQ ID NO 48296 | GGTACAGGGTTGAGGCTAGT | GGG | chr14 | 94389584 | 94389603 | 94389600 | + |
| SEQ ID NO 48297 | GTACAGGGTTGAGGCTAGTG | GGG | chr14 | 94389585 | 94389604 | 94389601 | + |
| SEQ ID NO 48298 | CTTGATTGCAATCCCTTTAA | AAG | chr14 | 94389613 | 94389632 | 94389629 | + |
| SEQ ID NO 48299 | ATCCCTTTAAAAGCCTAAAT | CAG | chr14 | 94389623 | 94389642 | 94389639 | + |
| SEQ ID NO 48300 | GTGCAACCCGCAAACCTGCT | TGG | chr14 | 94389661 | 94389680 | 94389677 | + |
| SEQ ID NO 48301 | TGCAACCCGCAAACCTGCTT | GGG | chr14 | 94389662 | 94389681 | 94389678 | + |
| SEQ ID NO 48302 | CAACCCGCAAACCTGCTTGG | GAG | chr14 | 94389664 | 94389683 | 94389680 | + |
| SEQ ID NO 48303 | CCGCAAACCTGCTTGGGAGC | TGG | chr14 | 94389668 | 94389687 | 94389684 | + |
| SEQ ID NO 48304 | GGGAGCTGGCGTACGTGCCG | TAG | chr14 | 94389682 | 94389701 | 94389698 | + |
| SEQ ID NO 48305 | GTACGTGCCGTAGATACTTG | CAG | chr14 | 94389692 | 94389711 | 94389708 | + |
| SEQ ID NO 48306 | ACGTGCCGTAGATACTTGCA | GAG | chr14 | 94389694 | 94389713 | 94389710 | + |
| SEQ ID NO 48307 | GTAGATACTTGCAGAGTGAA | TGG | chr14 | 94389701 | 94389720 | 94389717 | + |
| SEQ ID NO 48308 | TACTTGCAGAGTGAATGGAT | GAG | chr14 | 94389706 | 94389725 | 94389722 | + |
| SEQ ID NO 48309 | TTGCCCCTTCTGTCATTCAC | CAG | chr14 | 94389736 | 94389755 | 94389752 | + |
| SEQ ID NO 48310 | TCCCATTTATGCCTCCACCT | TGG | chr14 | 94389759 | 94389778 | 94389775 | + |
| SEQ ID NO 48311 | CCCATTTATGCCTCCACCTT | GGG | chr14 | 94389760 | 94389779 | 94389776 | + |
| SEQ ID NO 48312 | CCATTTATGCCTCCACCTTG | GGG | chr14 | 94389761 | 94389780 | 94389777 | + |
| SEQ ID NO 48313 | CCTCCACCTTGGGGCTCTAC | CAG | chr14 | 94389770 | 94389789 | 94389786 | + |
| SEQ ID NO 48314 | CTCCACCTTGGGGCTCTACC | AGG | chr14 | 94389771 | 94389790 | 94389787 | + |
| SEQ ID NO 48315 | ACCTTGGGGCTCTACCAGGC | GAG | chr14 | 94389775 | 94389794 | 94389791 | + |
| SEQ ID NO 48316 | TCTACCAGGCGAGTGACCCA | CAG | chr14 | 94389785 | 94389804 | 94389801 | + |
| SEQ ID NO 48317 | CTACCAGGCGAGTGACCCAC | AGG | chr14 | 94389786 | 94389805 | 94389802 | + |
| SEQ ID NO 48318 | GAGTGACCCACAGGATCCTC | CAG | chr14 | 94389795 | 94389814 | 94389811 | + |
| SEQ ID NO 48319 | GATCCTCCAGCACACACATT | CAG | chr14 | 94389808 | 94389827 | 94389824 | + |
| SEQ ID NO 48320 | TCCAGCACACACATTCAGAC | CAG | chr14 | 94389813 | 94389832 | 94389829 | + |
| SEQ ID NO 48321 | CCAGCACACACATTCAGACC | AGG | chr14 | 94389814 | 94389833 | 94389830 | + |
| SEQ ID NO 48322 | CAGCACACACATTCAGACCA | GGG | chr14 | 94389815 | 94389834 | 94389831 | + |
| SEQ ID NO 48323 | AGACCAGGGAACCCACTTAC | TGG | chr14 | 94389829 | 94389848 | 94389845 | + |
| SEQ ID NO 48324 | GGAACCCACTTACTGGCTGT | GAG | chr14 | 94389836 | 94389855 | 94389852 | + |
| SEQ ID NO 48325 | GAACCCACTTACTGGCTGTG | AGG | chr14 | 94389837 | 94389856 | 94389853 | + |
| SEQ ID NO 48326 | ACTTACTGGCTGTGAGGCCT | CAG | chr14 | 94389843 | 94389862 | 94389859 | + |
| SEQ ID NO 48327 | CTTACTGGCTGTGAGGCCTC | AGG | chr14 | 94389844 | 94389863 | 94389860 | + |
| SEQ ID NO 48328 | CTGGCTGTGAGGCCTCAGGT | GAG | chr14 | 94389848 | 94389867 | 94389864 | + |

Figure 67 (Cont'd)

| SEQ ID NO 48329 | GTGAGTTGTTTAACCGCTCC | GAG | chr14 | 94389866 | 94389885 | 94389882 | + |
| SEQ ID NO 48330 | CAATTTCCCTATCTGTAAAA | TGG | chr14 | 94389892 | 94389911 | 94389908 | + |
| SEQ ID NO 48331 | AATTTCCCTATCTGTAAAAT | GGG | chr14 | 94389893 | 94389912 | 94389909 | + |
| SEQ ID NO 48332 | ATTTCCCTATCTGTAAAATG | GGG | chr14 | 94389894 | 94389913 | 94389910 | + |
| SEQ ID NO 48333 | CCCTATCTGTAAAATGGGGA | TGG | chr14 | 94389898 | 94389917 | 94389914 | + |
| SEQ ID NO 48334 | CTGTAAAATGGGGATGGTGA | CGG | chr14 | 94389904 | 94389923 | 94389920 | + |
| SEQ ID NO 48335 | GTGACGGTATGTACCTTGTT | GAG | chr14 | 94389920 | 94389939 | 94389936 | + |
| SEQ ID NO 48336 | GTACCTTGTTGAGCTGCTGT | GAG | chr14 | 94389930 | 94389949 | 94389946 | + |
| SEQ ID NO 48337 | TACCTTGTTGAGCTGCTGTG | AGG | chr14 | 94389931 | 94389950 | 94389947 | + |
| SEQ ID NO 48338 | CTGTGAGGATTAAAATGCAA | CAG | chr14 | 94389946 | 94389965 | 94389962 | + |
| SEQ ID NO 48339 | GGATTAAAATGCAACAGTTC | AAG | chr14 | 94389952 | 94389971 | 94389968 | + |
| SEQ ID NO 48340 | GATTAAAATGCAACAGTTCA | AGG | chr14 | 94389953 | 94389972 | 94389969 | + |
| SEQ ID NO 48341 | AAAATGCAACAGTTCAAGGA | AAG | chr14 | 94389957 | 94389976 | 94389973 | + |
| SEQ ID NO 48342 | GCAACAGTTCAAGGAAAGCT | CAG | chr14 | 94389962 | 94389981 | 94389978 | + |
| SEQ ID NO 48343 | AACAGTTCAAGGAAAGCTCA | GAG | chr14 | 94389964 | 94389983 | 94389980 | + |
| SEQ ID NO 48344 | GTTCAAGGAAAGCTCAGAGA | CGG | chr14 | 94389968 | 94389987 | 94389984 | + |
| SEQ ID NO 48345 | TTCAAGGAAAGCTCAGAGAC | GGG | chr14 | 94389969 | 94389988 | 94389985 | + |
| SEQ ID NO 48346 | GAAAGCTCAGAGACGGGTAC | TGG | chr14 | 94389975 | 94389994 | 94389991 | + |
| SEQ ID NO 48347 | AAAGCTCAGAGACGGGTACT | GGG | chr14 | 94389976 | 94389995 | 94389992 | + |
| SEQ ID NO 48348 | AGACGGGTACTGGGTGTGCC | CAG | chr14 | 94389985 | 94390004 | 94390001 | + |
| SEQ ID NO 48349 | GGGTACTGGGTGTGCCCAGA | AAG | chr14 | 94389989 | 94390008 | 94390005 | + |
| SEQ ID NO 48350 | CTGCCCTCCCTCCCCGTGT | CAG | chr14 | 94390024 | 94390043 | 94390040 | + |
| SEQ ID NO 48351 | TGCCCTCCCTCCCCGTGTC | AGG | chr14 | 94390025 | 94390044 | 94390041 | + |
| SEQ ID NO 48352 | GCCCTCCCTCCCCGTGTCA | GGG | chr14 | 94390026 | 94390045 | 94390042 | + |
| SEQ ID NO 48353 | CCCTCCCTCCCCGTGTCAG | GGG | chr14 | 94390027 | 94390046 | 94390043 | + |
| SEQ ID NO 48354 | CCCTCCCCGTGTCAGGGGC | TGG | chr14 | 94390031 | 94390050 | 94390047 | + |
| SEQ ID NO 48355 | GTGTCAGGGGCTGGTGTCAC | TGG | chr14 | 94390040 | 94390059 | 94390056 | + |
| SEQ ID NO 48356 | TGTCAGGGGCTGGTGTCACT | GGG | chr14 | 94390041 | 94390060 | 94390057 | + |
| SEQ ID NO 48357 | GTCAGGGGCTGGTGTCACTG | GGG | chr14 | 94390042 | 94390061 | 94390058 | + |
| SEQ ID NO 48358 | AGGGGCTGGTGTCACTGGGG | TGG | chr14 | 94390045 | 94390064 | 94390061 | + |
| SEQ ID NO 48359 | GGGGCTGGTGTCACTGGGGT | GGG | chr14 | 94390046 | 94390065 | 94390062 | + |
| SEQ ID NO 48360 | GGGCTGGTGTCACTGGGGTG | GGG | chr14 | 94390047 | 94390066 | 94390063 | + |
| SEQ ID NO 48361 | CTGGTGTCACTGGGGTGGGG | TGG | chr14 | 94390050 | 94390069 | 94390066 | + |
| SEQ ID NO 48362 | TGGTGTCACTGGGGTGGGGT | GGG | chr14 | 94390051 | 94390070 | 94390067 | + |
| SEQ ID NO 48363 | GGTGGGGTGGGCCACACTTG | AAG | chr14 | 94390063 | 94390082 | 94390079 | + |
| SEQ ID NO 48364 | TGGGGTGGGCCACACTTGAA | GAG | chr14 | 94390065 | 94390084 | 94390081 | + |
| SEQ ID NO 48365 | ACACTTGAAGAGCTTTCCTC | CAG | chr14 | 94390076 | 94390095 | 94390092 | + |
| SEQ ID NO 48366 | CACTTGAAGAGCTTTCCTCC | AGG | chr14 | 94390077 | 94390096 | 94390093 | + |
| SEQ ID NO 48367 | TTGAAGAGCTTTCCTCCAGG | CAG | chr14 | 94390080 | 94390099 | 94390096 | + |
| SEQ ID NO 48368 | CCTCCAGGCAGTCTCTCATT | CAG | chr14 | 94390092 | 94390111 | 94390108 | + |
| SEQ ID NO 48369 | TCTCATTCAGTTACCCTGTG | AAG | chr14 | 94390105 | 94390124 | 94390121 | + |
| SEQ ID NO 48370 | CTCATTCAGTTACCCTGTGA | AGG | chr14 | 94390106 | 94390125 | 94390122 | + |
| SEQ ID NO 48371 | TCATTCAGTTACCCTGTGAA | GGG | chr14 | 94390107 | 94390126 | 94390123 | + |
| SEQ ID NO 48372 | ATTCAGTTACCCTGTGAAGG | GAG | chr14 | 94390109 | 94390128 | 94390125 | + |
| SEQ ID NO 48373 | CAGTTACCCTGTGAAGGGAG | TAG | chr14 | 94390112 | 94390131 | 94390128 | + |
| SEQ ID NO 48374 | AGTTACCCTGTGAAGGGAGT | AGG | chr14 | 94390113 | 94390132 | 94390129 | + |
| SEQ ID NO 48375 | AGTAGGTACCACCCTCCTTT | CAG | chr14 | 94390130 | 94390149 | 94390146 | + |
| SEQ ID NO 48376 | GTAGGTACCACCCTCCTTTC | AGG | chr14 | 94390131 | 94390150 | 94390147 | + |

Figure 67 (Cont'd)

| | | | | | | | |
|---|---|---|---|---|---|---|---|
| SEQ ID NO 48377 | GGTACCACCCTCCTTTCAGG | CAG | chr14 | 94390134 | 94390153 | 94390150 | + |
| SEQ ID NO 48378 | ACCACCCTCCTTTCAGGCAG | CGG | chr14 | 94390137 | 94390156 | 94390153 | + |
| SEQ ID NO 48379 | CCACCCTCCTTTCAGGCAGC | GGG | chr14 | 94390138 | 94390157 | 94390154 | + |
| SEQ ID NO 48380 | CTTTCAGGCAGCGGGAAACT | GAG | chr14 | 94390146 | 94390165 | 94390162 | + |
| SEQ ID NO 48381 | AGGCAGCGGGAAACTGAGCT | CAG | chr14 | 94390151 | 94390170 | 94390167 | + |
| SEQ ID NO 48382 | ACTCCCTCCCCTTCTCTCT | GAG | chr14 | 94390174 | 94390193 | 94390190 | + |
| SEQ ID NO 48383 | TCTCTGAGCTCCCTTCCCTG | CAG | chr14 | 94390189 | 94390208 | 94390205 | + |
| SEQ ID NO 48384 | TTCCCTGCAGCTCCATCCCC | TGG | chr14 | 94390202 | 94390221 | 94390218 | + |
| SEQ ID NO 48385 | GCAGCTCCATCCCCTGGCTT | CAG | chr14 | 94390208 | 94390227 | 94390224 | + |
| SEQ ID NO 48386 | CAGCTCCATCCCCTGGCTTC | AGG | chr14 | 94390209 | 94390228 | 94390225 | + |
| SEQ ID NO 48387 | AGCTCCATCCCCTGGCTTCA | GGG | chr14 | 94390210 | 94390229 | 94390226 | + |
| SEQ ID NO 48388 | AGGGCCCTGTCCTTCCCCT | GAG | chr14 | 94390229 | 94390248 | 94390245 | + |
| SEQ ID NO 48389 | CCCCTGTCCTTCCCCTGAGC | TGG | chr14 | 94390233 | 94390252 | 94390249 | + |
| SEQ ID NO 48390 | CTTCCCCTGAGCTGGCTGAA | TGG | chr14 | 94390241 | 94390260 | 94390257 | + |
| SEQ ID NO 48391 | CGCTGCTCTACATCCACTCA | CAG | chr14 | 94390270 | 94390289 | 94390286 | + |
| SEQ ID NO 48392 | TCTACATCCACTCACAGCTC | CAG | chr14 | 94390276 | 94390295 | 94390292 | + |
| SEQ ID NO 48393 | TCCACTCACAGCTCCAGCAC | TGG | chr14 | 94390282 | 94390301 | 94390298 | + |
| SEQ ID NO 48394 | CCACTCACAGCTCCAGCACT | GGG | chr14 | 94390283 | 94390302 | 94390299 | + |
| SEQ ID NO 48395 | ACAGCTCCAGCACTGGGCTG | TGG | chr14 | 94390289 | 94390308 | 94390305 | + |
| SEQ ID NO 48396 | TCCAGCACTGGGCTGTGGTT | GAG | chr14 | 94390294 | 94390313 | 94390310 | + |
| SEQ ID NO 48397 | CCAGCACTGGGCTGTGGTTG | AGG | chr14 | 94390295 | 94390314 | 94390311 | + |
| SEQ ID NO 48398 | TGGTTGAGGTCGCCTGCCCT | CGG | chr14 | 94390309 | 94390328 | 94390325 | + |
| SEQ ID NO 48399 | TTGAGGTCGCCTGCCCTCGG | TAG | chr14 | 94390312 | 94390331 | 94390328 | + |
| SEQ ID NO 48400 | CGCCTGCCCTCGGTAGCTCC | TGG | chr14 | 94390319 | 94390338 | 94390335 | + |
| SEQ ID NO 48401 | GCCTGCCCTCGGTAGCTCCT | GGG | chr14 | 94390320 | 94390339 | 94390336 | + |
| SEQ ID NO 48402 | TGGGCATTTCTTCCCCTCTC | TGG | chr14 | 94390339 | 94390358 | 94390355 | + |
| SEQ ID NO 48403 | GGGCATTTCTTCCCCTCTCT | GGG | chr14 | 94390340 | 94390359 | 94390356 | + |
| SEQ ID NO 48404 | TGCACAATGACCCCCACTCT | AAG | chr14 | 94390379 | 94390398 | 94390395 | + |
| SEQ ID NO 48405 | CCTGCTGTCCCTCCCACCTG | TGG | chr14 | 94390403 | 94390422 | 94390419 | + |
| SEQ ID NO 48406 | TCCCTCCCACCTGTGGAACT | GAG | chr14 | 94390410 | 94390429 | 94390426 | + |
| SEQ ID NO 48407 | TCCCACCTGTGGAACTGAGT | GAG | chr14 | 94390414 | 94390433 | 94390430 | + |
| SEQ ID NO 48408 | CACCTGTGGAACTGAGTGAG | CAG | chr14 | 94390417 | 94390436 | 94390433 | + |
| SEQ ID NO 48409 | CTGTGGAACTGAGTGAGCAG | CAG | chr14 | 94390420 | 94390439 | 94390436 | + |
| SEQ ID NO 48410 | TGGAACTGAGTGAGCAGCAG | CAG | chr14 | 94390423 | 94390442 | 94390439 | + |
| SEQ ID NO 48411 | CCACCTTTCCTGCTCTCCTC | AAG | chr14 | 94390453 | 94390472 | 94390469 | + |
| SEQ ID NO 48412 | GCTCTCCTCAAGCTCTCCTC | AAG | chr14 | 94390464 | 94390483 | 94390480 | + |
| SEQ ID NO 48413 | TCCTCAAGCTCTGTCTCTTC | TGG | chr14 | 94390479 | 94390498 | 94390495 | + |
| SEQ ID NO 48414 | TCAAGCTCTGTCTCTTCTGG | CAG | chr14 | 94390482 | 94390501 | 94390498 | + |
| SEQ ID NO 48415 | CAAGCTCTGTCTCTTCTGGC | AGG | chr14 | 94390483 | 94390502 | 94390499 | + |
| SEQ ID NO 48416 | TCTGTCTCTTCTGGCAGGCA | CAG | chr14 | 94390488 | 94390507 | 94390504 | + |
| SEQ ID NO 48417 | CTGTCTCTTCTGGCAGGCAC | AGG | chr14 | 94390489 | 94390508 | 94390505 | + |
| SEQ ID NO 48418 | GTCTCTTCTGGCAGGCACAG | GAG | chr14 | 94390491 | 94390510 | 94390507 | + |
| SEQ ID NO 48419 | CTCTTCTGGCAGGCACAGGA | GAG | chr14 | 94390493 | 94390512 | 94390509 | + |
| SEQ ID NO 48420 | TTCTGGCAGGCACAGGAGAG | TGG | chr14 | 94390496 | 94390515 | 94390512 | + |
| SEQ ID NO 48421 | AGGCACAGGAGAGTGGCCTG | AAG | chr14 | 94390503 | 94390522 | 94390519 | + |
| SEQ ID NO 48422 | GGCACAGGAGAGTGGCCTGA | AGG | chr14 | 94390504 | 94390523 | 94390520 | + |
| SEQ ID NO 48423 | CAGGAGAGTGGCCTGAAGGC | TGG | chr14 | 94390508 | 94390527 | 94390524 | + |
| SEQ ID NO 48424 | GAGAGTGGCCTGAAGGCTGG | CAG | chr14 | 94390511 | 94390530 | 94390527 | + |

Figure 67 (Cont'd)

| | | | | | | | |
|---|---|---|---|---|---|---|---|
| SEQ ID NO 48425 | AGAGTGGCCTGAAGGCTGGC | AGG | chr14 | 94390512 | 94390531 | 94390528 | + |
| SEQ ID NO 48426 | AGTGGCCTGAAGGCTGGCAG | GAG | chr14 | 94390514 | 94390533 | 94390530 | + |
| SEQ ID NO 48427 | GTGGCCTGAAGGCTGGCAGG | AGG | chr14 | 94390515 | 94390534 | 94390531 | + |
| SEQ ID NO 48428 | AGGTTGCCGCCCCTCCAACC | TGG | chr14 | 94390535 | 94390554 | 94390551 | + |
| SEQ ID NO 48429 | CCCCTCCAACCTGGAATTCC | TGG | chr14 | 94390544 | 94390563 | 94390560 | + |
| SEQ ID NO 48430 | CTCCAACCTGGAATTCCTGG | CAG | chr14 | 94390547 | 94390566 | 94390563 | + |
| SEQ ID NO 48431 | CAACCTGGAATTCCTGGCAG | CAG | chr14 | 94390550 | 94390569 | 94390566 | + |
| SEQ ID NO 48432 | CCTGGAATTCCTGGCAGCAG | CAG | chr14 | 94390553 | 94390572 | 94390569 | + |
| SEQ ID NO 48433 | GGAATTCCTGGCAGCAGCAG | CGG | chr14 | 94390556 | 94390575 | 94390572 | + |
| SEQ ID NO 48434 | TTCCTGGCAGCAGCAGCGGC | TAG | chr14 | 94390560 | 94390579 | 94390576 | + |
| SEQ ID NO 48435 | TCCTGGCAGCAGCAGCGGCT | AGG | chr14 | 94390561 | 94390580 | 94390577 | + |
| SEQ ID NO 48436 | AGCAGCGGCTAGGCCTTCCT | CGG | chr14 | 94390571 | 94390590 | 94390587 | + |
| SEQ ID NO 48437 | CAGCGGCTAGGCCTTCCTCG | GAG | chr14 | 94390573 | 94390592 | 94390589 | + |
| SEQ ID NO 48438 | AGCGGCTAGGCCTTCCTCGG | AGG | chr14 | 94390574 | 94390593 | 94390590 | + |
| SEQ ID NO 48439 | CCCGACCCCTCCTCCTTCT | TGG | chr14 | 94390597 | 94390616 | 94390613 | + |
| SEQ ID NO 48440 | CCCCTCCTCCTTCTTGGTT | CAG | chr14 | 94390602 | 94390621 | 94390618 | + |
| SEQ ID NO 48441 | TCCTCCTTCTTGGTTCAGCT | CAG | chr14 | 94390607 | 94390626 | 94390623 | + |
| SEQ ID NO 48442 | CCTCCTTCTTGGTTCAGCTC | AGG | chr14 | 94390608 | 94390627 | 94390624 | + |
| SEQ ID NO 48443 | TTGGTTCAGCTCAGGACTCT | GAG | chr14 | 94390616 | 94390635 | 94390632 | + |
| SEQ ID NO 48444 | TGGTTCAGCTCAGGACTCTG | AGG | chr14 | 94390617 | 94390636 | 94390633 | + |
| SEQ ID NO 48445 | GGTTCAGCTCAGGACTCTGA | GGG | chr14 | 94390618 | 94390637 | 94390634 | + |
| SEQ ID NO 48446 | GGACTCTGAGGGTTGCTGCG | TGG | chr14 | 94390629 | 94390648 | 94390645 | + |
| SEQ ID NO 48447 | ACTCTGAGGGTTGCTGCGTG | GAG | chr14 | 94390631 | 94390650 | 94390647 | + |
| SEQ ID NO 48448 | CTCTGAGGGTTGCTGCGTGG | AGG | chr14 | 94390632 | 94390651 | 94390648 | + |
| SEQ ID NO 48449 | TGAGGGTTGCTGCGTGGAGG | CAG | chr14 | 94390635 | 94390654 | 94390651 | + |
| SEQ ID NO 48450 | CGTGGAGGCAGTGCATGCCC | TGG | chr14 | 94390647 | 94390666 | 94390663 | + |
| SEQ ID NO 48451 | GTGGAGGCAGTGCATGCCCT | GGG | chr14 | 94390648 | 94390667 | 94390664 | + |
| SEQ ID NO 48452 | GGCAGTGCATGCCCTGGGCA | CAG | chr14 | 94390653 | 94390672 | 94390669 | + |
| SEQ ID NO 48453 | CATGCCCTGGGCACAGTGCC | CAG | chr14 | 94390660 | 94390679 | 94390676 | + |
| SEQ ID NO 48454 | GTGCCCAGTTCCTGCCCACC | CAG | chr14 | 94390675 | 94390694 | 94390691 | + |
| SEQ ID NO 48455 | TGCCCAGTTCCTGCCCACCC | AGG | chr14 | 94390676 | 94390695 | 94390692 | + |
| SEQ ID NO 48456 | CCAGTTCCTGCCCACCCAGG | AAG | chr14 | 94390679 | 94390698 | 94390695 | + |
| SEQ ID NO 48457 | GTTCCTGCCCACCCAGGAAG | TAG | chr14 | 94390682 | 94390701 | 94390698 | + |
| SEQ ID NO 48458 | CCCACCCAGGAAGTAGACTT | CGG | chr14 | 94390689 | 94390708 | 94390705 | + |
| SEQ ID NO 48459 | CCACCCAGGAAGTAGACTTC | GGG | chr14 | 94390690 | 94390709 | 94390706 | + |
| SEQ ID NO 48460 | CCCAGGAAGTAGACTTCGGG | TGG | chr14 | 94390693 | 94390712 | 94390709 | + |
| SEQ ID NO 48461 | CAGGAAGTAGACTTCGGGTG | GAG | chr14 | 94390695 | 94390714 | 94390711 | + |
| SEQ ID NO 48462 | AGGAAGTAGACTTCGGGTGG | AGG | chr14 | 94390696 | 94390715 | 94390712 | + |
| SEQ ID NO 48463 | AAGTAGACTTCGGGTGGAGG | CAG | chr14 | 94390699 | 94390718 | 94390715 | + |
| SEQ ID NO 48464 | TAGACTTCGGGTGGAGGCAG | TAG | chr14 | 94390702 | 94390721 | 94390718 | + |
| SEQ ID NO 48465 | AGACTTCGGGTGGAGGCAGT | AGG | chr14 | 94390703 | 94390722 | 94390719 | + |
| SEQ ID NO 48466 | TTCGGGTGGAGGCAGTAGGC | TGG | chr14 | 94390707 | 94390726 | 94390723 | + |
| SEQ ID NO 48467 | TCGGGTGGAGGCAGTAGGCT | GGG | chr14 | 94390708 | 94390727 | 94390724 | + |
| SEQ ID NO 48468 | CGGGTGGAGGCAGTAGGCTG | GGG | chr14 | 94390709 | 94390728 | 94390725 | + |
| SEQ ID NO 48469 | GGTGGAGGCAGTAGGCTGGG | GAG | chr14 | 94390711 | 94390730 | 94390727 | + |
| SEQ ID NO 48470 | GTGGAGGCAGTAGGCTGGGG | AGG | chr14 | 94390712 | 94390731 | 94390728 | + |
| SEQ ID NO 48471 | TGGAGGCAGTAGGCTGGGGA | GGG | chr14 | 94390713 | 94390732 | 94390729 | + |
| SEQ ID NO 48472 | GGAGGCAGTAGGCTGGGGAG | GGG | chr14 | 94390714 | 94390733 | 94390730 | + |

Figure 67 (Cont'd)

| | | | | | | | |
|---|---|---|---|---|---|---|---|
| SEQ ID NO 48473 | GGCAGTAGGCTGGGGAGGGG | CGG | chr14 | 94390717 | 94390736 | 94390733 | + |
| SEQ ID NO 48474 | GCAGTAGGCTGGGGAGGGGC | GGG | chr14 | 94390718 | 94390737 | 94390734 | + |
| SEQ ID NO 48475 | CAGTAGGCTGGGGAGGGGCG | GGG | chr14 | 94390719 | 94390738 | 94390735 | + |
| SEQ ID NO 48476 | GTAGGCTGGGGAGGGGCGGG | GAG | chr14 | 94390721 | 94390740 | 94390737 | + |
| SEQ ID NO 48477 | CTGGGGAGGGGCGGGGAGCT | TGG | chr14 | 94390726 | 94390745 | 94390742 | + |
| SEQ ID NO 48478 | GGAGGGGCGGGGAGCTTGGA | CAG | chr14 | 94390730 | 94390749 | 94390746 | + |
| SEQ ID NO 48479 | GAGGGGCGGGGAGCTTGGAC | AGG | chr14 | 94390731 | 94390750 | 94390747 | + |
| SEQ ID NO 48480 | GGGCGGGGAGCTTGGACAGG | AAG | chr14 | 94390734 | 94390753 | 94390750 | + |
| SEQ ID NO 48481 | GGCGGGGAGCTTGGACAGGA | AGG | chr14 | 94390735 | 94390754 | 94390751 | + |
| SEQ ID NO 48482 | CGGGGAGCTTGGACAGGAAG | GAG | chr14 | 94390737 | 94390756 | 94390753 | + |
| SEQ ID NO 48483 | AAGGAGCCTTGCTCATTGCC | CGG | chr14 | 94390754 | 94390773 | 94390770 | + |
| SEQ ID NO 48484 | GAGCCTTGCTCATTGCCCGG | CAG | chr14 | 94390757 | 94390776 | 94390773 | + |
| SEQ ID NO 48485 | GCTCATTGCCCGGCAGACAC | AAG | chr14 | 94390764 | 94390783 | 94390780 | + |
| SEQ ID NO 48486 | TTGCCCGGCAGACACAAGAC | TGG | chr14 | 94390769 | 94390788 | 94390785 | + |
| SEQ ID NO 48487 | TGCCCGGCAGACACAAGACT | GGG | chr14 | 94390770 | 94390789 | 94390786 | + |
| SEQ ID NO 48488 | AGACTGGGCCCTCATAAACT | CAG | chr14 | 94390785 | 94390804 | 94390801 | + |
| SEQ ID NO 48489 | TGGGCCCTCATAAACTCAGA | CAG | chr14 | 94390789 | 94390808 | 94390805 | + |
| SEQ ID NO 48490 | CCTCATAAACTCAGACAGCC | CGG | chr14 | 94390794 | 94390813 | 94390810 | + |
| SEQ ID NO 48491 | ACCTGTTGTACCTGCCCTTT | CAG | chr14 | 94390823 | 94390842 | 94390839 | + |
| SEQ ID NO 48492 | GCCCTTTCAGCTCTGTGACC | CGG | chr14 | 94390836 | 94390855 | 94390852 | + |
| SEQ ID NO 48493 | CCCTTTCAGCTCTGTGACCC | GGG | chr14 | 94390837 | 94390856 | 94390853 | + |
| SEQ ID NO 48494 | TCAGCTCTGTGACCCGGGAC | AAG | chr14 | 94390842 | 94390861 | 94390858 | + |
| SEQ ID NO 48495 | ACAAGTCACCCTCTCCCTTT | GAG | chr14 | 94390860 | 94390879 | 94390876 | + |
| SEQ ID NO 48496 | CTCTCCCTTTGAGTTGCCGC | AAG | chr14 | 94390870 | 94390889 | 94390886 | + |
| SEQ ID NO 48497 | CTCCCTTTGAGTTGCCGCAA | GAG | chr14 | 94390872 | 94390891 | 94390888 | + |
| SEQ ID NO 48498 | TCCCTTTGAGTTGCCGCAAG | AGG | chr14 | 94390873 | 94390892 | 94390889 | + |
| SEQ ID NO 48499 | TTGAGTTGCCGCAAGAGGTA | CAG | chr14 | 94390878 | 94390897 | 94390894 | + |
| SEQ ID NO 48500 | AGAGGTACAGTCACACTGCC | CAG | chr14 | 94390891 | 94390910 | 94390907 | + |
| SEQ ID NO 48501 | AGGTACAGTCACACTGCCCA | GAG | chr14 | 94390893 | 94390912 | 94390909 | + |
| SEQ ID NO 48502 | GGTACAGTCACACTGCCCAG | AGG | chr14 | 94390894 | 94390913 | 94390910 | + |
| SEQ ID NO 48503 | CACACTGCCCAGAGGATTAC | TAG | chr14 | 94390902 | 94390921 | 94390918 | + |
| SEQ ID NO 48504 | CAGAGGATTACTAGAAATGA | CAG | chr14 | 94390911 | 94390930 | 94390927 | + |
| SEQ ID NO 48505 | AGAGGATTACTAGAAATGAC | AGG | chr14 | 94390912 | 94390931 | 94390928 | + |
| SEQ ID NO 48506 | AATGACAGGCCTCGCCCTCC | TGG | chr14 | 94390926 | 94390945 | 94390942 | + |
| SEQ ID NO 48507 | CAGGCCTCGCCCTCCTGGCA | CAG | chr14 | 94390931 | 94390950 | 94390947 | + |
| SEQ ID NO 48508 | TCGCCCTCCTGGCACAGACC | TGG | chr14 | 94390937 | 94390956 | 94390953 | + |
| SEQ ID NO 48509 | ACAGACCTGGCACCAATAAC | TGG | chr14 | 94390950 | 94390969 | 94390966 | + |
| SEQ ID NO 48510 | GACCTGGCACCAATAACTGG | CAG | chr14 | 94390953 | 94390972 | 94390969 | + |
| SEQ ID NO 48511 | ACCTGGCACCAATAACTGGC | AGG | chr14 | 94390954 | 94390973 | 94390970 | + |
| SEQ ID NO 48512 | ACCAATAACTGGCAGGTTTC | TGG | chr14 | 94390961 | 94390980 | 94390977 | + |
| SEQ ID NO 48513 | CCAATAACTGGCAGGTTTCT | GGG | chr14 | 94390962 | 94390981 | 94390978 | + |
| SEQ ID NO 48514 | CAATAACTGGCAGGTTTCTG | GGG | chr14 | 94390963 | 94390982 | 94390979 | + |
| SEQ ID NO 48515 | AACTGGCAGGTTTCTGGGGC | CAG | chr14 | 94390967 | 94390986 | 94390983 | + |
| SEQ ID NO 48516 | CAGGTTTCTGGGGCCAGCTG | CAG | chr14 | 94390973 | 94390992 | 94390989 | + |
| SEQ ID NO 48517 | GGTTTCTGGGGCCAGCTGCA | GAG | chr14 | 94390975 | 94390994 | 94390991 | + |
| SEQ ID NO 48518 | GTTTCTGGGGCCAGCTGCAG | AGG | chr14 | 94390976 | 94390995 | 94390992 | + |
| SEQ ID NO 48519 | TTTCTGGGGCCAGCTGCAGA | GGG | chr14 | 94390977 | 94390996 | 94390993 | + |
| SEQ ID NO 48520 | CTGGGGCCAGCTGCAGAGGG | AAG | chr14 | 94390980 | 94390999 | 94390996 | + |

Figure 67 (Cont'd)

| | | | | | | | |
|---|---|---|---|---|---|---|---|
| SEQ ID NO 48521 | GGGGCCAGCTGCAGAGGGAA | GAG | chr14 | 94390982 | 94391001 | 94390998 | + |
| SEQ ID NO 48522 | GGGCCAGCTGCAGAGGGAAG | AGG | chr14 | 94390983 | 94391002 | 94390999 | + |
| SEQ ID NO 48523 | GCTGCAGAGGGAAGAGGACT | GAG | chr14 | 94390989 | 94391008 | 94391005 | + |
| SEQ ID NO 48524 | TGAGCCACCTATGAAATGCC | CAG | chr14 | 94391008 | 94391027 | 94391024 | + |
| SEQ ID NO 48525 | GCCACCTATGAAATGCCCAG | TGG | chr14 | 94391011 | 94391030 | 94391027 | + |
| SEQ ID NO 48526 | CCACCTATGAAATGCCCAGT | GGG | chr14 | 94391012 | 94391031 | 94391028 | + |
| SEQ ID NO 48527 | CCTATGAAATGCCCAGTGGG | CAG | chr14 | 94391015 | 94391034 | 94391031 | + |
| SEQ ID NO 48528 | ATGCCCAGTGGGCAGCCCCA | CAG | chr14 | 94391023 | 94391042 | 94391039 | + |
| SEQ ID NO 48529 | CCAGTGGGCAGCCCCACAGT | TGG | chr14 | 94391027 | 94391046 | 94391043 | + |
| SEQ ID NO 48530 | CAGTGGGCAGCCCCACAGTT | GGG | chr14 | 94391028 | 94391047 | 94391044 | + |
| SEQ ID NO 48531 | TGGGCAGCCCCACAGTTGGG | CAG | chr14 | 94391031 | 94391050 | 94391047 | + |
| SEQ ID NO 48532 | GGGCAGCCCCACAGTTGGGC | AGG | chr14 | 94391032 | 94391051 | 94391048 | + |
| SEQ ID NO 48533 | TTGGGCAGGTCTGTGTGCAC | TGG | chr14 | 94391046 | 94391065 | 94391062 | + |
| SEQ ID NO 48534 | TGGGCAGGTCTGTGTGCACT | GGG | chr14 | 94391047 | 94391066 | 94391063 | + |
| SEQ ID NO 48535 | GGGCAGGTCTGTGTGCACTG | GGG | chr14 | 94391048 | 94391067 | 94391064 | + |
| SEQ ID NO 48536 | GCAGGTCTGTGTGCACTGGG | GAG | chr14 | 94391050 | 94391069 | 94391066 | + |
| SEQ ID NO 48537 | CAGGTCTGTGTGCACTGGGG | AGG | chr14 | 94391051 | 94391070 | 94391067 | + |
| SEQ ID NO 48538 | CACTGGGGAGGTGTGTGTCA | TAG | chr14 | 94391063 | 94391082 | 94391079 | + |
| SEQ ID NO 48539 | ACTGGGGAGGTGTGTGTCAT | AGG | chr14 | 94391064 | 94391083 | 94391080 | + |
| SEQ ID NO 48540 | GAGGTGTGTGTCATAGGACC | TGG | chr14 | 94391070 | 94391089 | 94391086 | + |
| SEQ ID NO 48541 | TCCTATGACACACACCTCCC | CAG | chr14 | 94391068 | 94391087 | 94391071 | - |
| SEQ ID NO 48542 | ACACACCTCCCCAGTGCACA | CAG | chr14 | 94391059 | 94391078 | 94391062 | - |
| SEQ ID NO 48543 | CACACAGACCTGCCCAACTG | TGG | chr14 | 94391043 | 94391062 | 94391046 | - |
| SEQ ID NO 48544 | ACACAGACCTGCCCAACTGT | GGG | chr14 | 94391042 | 94391061 | 94391045 | - |
| SEQ ID NO 48545 | CACAGACCTGCCCAACTGTG | GGG | chr14 | 94391041 | 94391060 | 94391044 | - |
| SEQ ID NO 48546 | CCAACTGTGGGGCTGCCCAC | TGG | chr14 | 94391030 | 94391049 | 94391033 | - |
| SEQ ID NO 48547 | CAACTGTGGGGCTGCCCACT | GGG | chr14 | 94391029 | 94391048 | 94391032 | - |
| SEQ ID NO 48548 | GCTGCCCACTGGGCATTTCA | TAG | chr14 | 94391019 | 94391038 | 94391022 | - |
| SEQ ID NO 48549 | CTGCCCACTGGGCATTTCAT | AGG | chr14 | 94391018 | 94391037 | 94391021 | - |
| SEQ ID NO 48550 | CCCACTGGGCATTTCATAGG | TGG | chr14 | 94391015 | 94391034 | 94391018 | - |
| SEQ ID NO 48551 | TGGGCATTTCATAGGTGGCT | CAG | chr14 | 94391010 | 94391029 | 94391013 | - |
| SEQ ID NO 48552 | GCTCAGTCCTCTTCCCTCTG | CAG | chr14 | 94390993 | 94391012 | 94390996 | - |
| SEQ ID NO 48553 | AGTCCTCTTCCCTCTGCAGC | TGG | chr14 | 94390989 | 94391008 | 94390992 | - |
| SEQ ID NO 48554 | CTTCCCTCTGCAGCTGGCCC | CAG | chr14 | 94390983 | 94391002 | 94390986 | - |
| SEQ ID NO 48555 | AGCTGGCCCCAGAAACCTGC | CAG | chr14 | 94390972 | 94390991 | 94390975 | - |
| SEQ ID NO 48556 | CCCAGAAACCTGCCAGTTAT | TGG | chr14 | 94390965 | 94390984 | 94390968 | - |
| SEQ ID NO 48557 | AACCTGCCAGTTATTGGTGC | CAG | chr14 | 94390959 | 94390978 | 94390962 | - |
| SEQ ID NO 48558 | ACCTGCCAGTTATTGGTGCC | AGG | chr14 | 94390958 | 94390977 | 94390961 | - |
| SEQ ID NO 48559 | TATTGGTGCCAGGTCTGTGC | CAG | chr14 | 94390948 | 94390967 | 94390951 | - |
| SEQ ID NO 48560 | ATTGGTGCCAGGTCTGTGCC | AGG | chr14 | 94390947 | 94390966 | 94390950 | - |
| SEQ ID NO 48561 | TGGTGCCAGGTCTGTGCCAG | GAG | chr14 | 94390945 | 94390964 | 94390948 | - |
| SEQ ID NO 48562 | GGTGCCAGGTCTGTGCCAGG | AGG | chr14 | 94390944 | 94390963 | 94390947 | - |
| SEQ ID NO 48563 | GTGCCAGGTCTGTGCCAGGA | GGG | chr14 | 94390943 | 94390962 | 94390946 | - |
| SEQ ID NO 48564 | CAGGTCTGTGCCAGGAGGGC | GAG | chr14 | 94390939 | 94390958 | 94390942 | - |
| SEQ ID NO 48565 | AGGTCTGTGCCAGGAGGGCG | AGG | chr14 | 94390938 | 94390957 | 94390941 | - |
| SEQ ID NO 48566 | AGGGCGAGGCCTGTCATTTC | TAG | chr14 | 94390924 | 94390943 | 94390927 | - |
| SEQ ID NO 48567 | TGTCATTTCTAGTAATCCTC | TGG | chr14 | 94390913 | 94390932 | 94390916 | - |
| SEQ ID NO 48568 | GTCATTTCTAGTAATCCTCT | GGG | chr14 | 94390912 | 94390931 | 94390915 | - |

Figure 67 (Cont'd)

| | | | | | | | |
|---|---|---|---|---|---|---|---|
| SEQ ID NO 48569 | ATTTCTAGTAATCCTCTGGG | CAG | chr14 | 94390909 | 94390928 | 94390912 | - |
| SEQ ID NO 48570 | CAGTGTGACTGTACCTCTTG | CGG | chr14 | 94390889 | 94390908 | 94390892 | - |
| SEQ ID NO 48571 | GTACCTCTTGCGGCAACTCA | AAG | chr14 | 94390879 | 94390898 | 94390882 | - |
| SEQ ID NO 48572 | TACCTCTTGCGGCAACTCAA | AGG | chr14 | 94390878 | 94390897 | 94390881 | - |
| SEQ ID NO 48573 | ACCTCTTGCGGCAACTCAAA | GGG | chr14 | 94390877 | 94390896 | 94390880 | - |
| SEQ ID NO 48574 | CTCTTGCGGCAACTCAAAGG | GAG | chr14 | 94390875 | 94390894 | 94390878 | - |
| SEQ ID NO 48575 | CTTGCGGCAACTCAAAGGGA | GAG | chr14 | 94390873 | 94390892 | 94390876 | - |
| SEQ ID NO 48576 | TTGCGGCAACTCAAAGGGAG | AGG | chr14 | 94390872 | 94390891 | 94390875 | - |
| SEQ ID NO 48577 | TGCGGCAACTCAAAGGGAGA | GGG | chr14 | 94390871 | 94390890 | 94390874 | - |
| SEQ ID NO 48578 | AGGGAGAGGGTGACTTGTCC | CGG | chr14 | 94390858 | 94390877 | 94390861 | - |
| SEQ ID NO 48579 | GGGAGAGGGTGACTTGTCCC | GGG | chr14 | 94390857 | 94390876 | 94390860 | - |
| SEQ ID NO 48580 | GGGTGACTTGTCCCGGGTCA | CAG | chr14 | 94390851 | 94390870 | 94390854 | - |
| SEQ ID NO 48581 | GTGACTTGTCCCGGGTCACA | GAG | chr14 | 94390849 | 94390868 | 94390852 | - |
| SEQ ID NO 48582 | GTCCCGGGTCACAGAGCTGA | AAG | chr14 | 94390842 | 94390861 | 94390845 | - |
| SEQ ID NO 48583 | TCCCGGGTCACAGAGCTGAA | AGG | chr14 | 94390841 | 94390860 | 94390844 | - |
| SEQ ID NO 48584 | CCCGGGTCACAGAGCTGAAA | GGG | chr14 | 94390840 | 94390859 | 94390843 | - |
| SEQ ID NO 48585 | GGGTCACAGAGCTGAAAGGG | CAG | chr14 | 94390837 | 94390856 | 94390840 | - |
| SEQ ID NO 48586 | GGTCACAGAGCTGAAAGGGC | AGG | chr14 | 94390836 | 94390855 | 94390839 | - |
| SEQ ID NO 48587 | AGCTGAAAGGGCAGGTACAA | CAG | chr14 | 94390828 | 94390847 | 94390831 | - |
| SEQ ID NO 48588 | GCTGAAAGGGCAGGTACAAC | AGG | chr14 | 94390827 | 94390846 | 94390830 | - |
| SEQ ID NO 48589 | AGGTACAACAGGTGACATGC | CGG | chr14 | 94390816 | 94390835 | 94390819 | - |
| SEQ ID NO 48590 | GGTACAACAGGTGACATGCC | GGG | chr14 | 94390815 | 94390834 | 94390818 | - |
| SEQ ID NO 48591 | GGTGACATGCCGGGCTGTCT | GAG | chr14 | 94390806 | 94390825 | 94390809 | - |
| SEQ ID NO 48592 | GCCGGGCTGTCTGAGTTTAT | GAG | chr14 | 94390798 | 94390817 | 94390801 | - |
| SEQ ID NO 48593 | CCGGGCTGTCTGAGTTTATG | AGG | chr14 | 94390797 | 94390816 | 94390800 | - |
| SEQ ID NO 48594 | CGGGCTGTCTGAGTTTATGA | GGG | chr14 | 94390796 | 94390815 | 94390799 | - |
| SEQ ID NO 48595 | TGTCTGAGTTTATGAGGGCC | CAG | chr14 | 94390791 | 94390810 | 94390794 | - |
| SEQ ID NO 48596 | GGGCCAGTCTTGTGTCTGC | CGG | chr14 | 94390776 | 94390795 | 94390779 | - |
| SEQ ID NO 48597 | GGCCCAGTCTTGTGTCTGCC | GGG | chr14 | 94390775 | 94390794 | 94390778 | - |
| SEQ ID NO 48598 | TCTTGTGTCTGCCGGGCAAT | GAG | chr14 | 94390768 | 94390787 | 94390771 | - |
| SEQ ID NO 48599 | GTGTCTGCCGGGCAATGAGC | AAG | chr14 | 94390764 | 94390783 | 94390767 | - |
| SEQ ID NO 48600 | TGTCTGCCGGGCAATGAGCA | AGG | chr14 | 94390763 | 94390782 | 94390766 | - |
| SEQ ID NO 48601 | AGCAAGGCTCCTTCCTGTCC | AAG | chr14 | 94390747 | 94390766 | 94390750 | - |
| SEQ ID NO 48602 | CCAAGCTCCCCGCCCCTCCC | CAG | chr14 | 94390729 | 94390748 | 94390732 | - |
| SEQ ID NO 48603 | CAGCCTACTGCCTCCACCCG | AAG | chr14 | 94390709 | 94390728 | 94390712 | - |
| SEQ ID NO 48604 | TCCACCCGAAGTCTACTTCC | TGG | chr14 | 94390697 | 94390716 | 94390700 | - |
| SEQ ID NO 48605 | CCACCCGAAGTCTACTTCCT | GGG | chr14 | 94390696 | 94390715 | 94390699 | - |
| SEQ ID NO 48606 | CCCGAAGTCTACTTCCTGGG | TGG | chr14 | 94390693 | 94390712 | 94390696 | - |
| SEQ ID NO 48607 | CCGAAGTCTACTTCCTGGGT | GGG | chr14 | 94390692 | 94390711 | 94390695 | - |
| SEQ ID NO 48608 | AAGTCTACTTCCTGGGTGGG | CAG | chr14 | 94390689 | 94390708 | 94390692 | - |
| SEQ ID NO 48609 | AGTCTACTTCCTGGGTGGGC | AGG | chr14 | 94390688 | 94390707 | 94390691 | - |
| SEQ ID NO 48610 | CTTCCTGGGTGGGCAGGAAC | TGG | chr14 | 94390682 | 94390701 | 94390685 | - |
| SEQ ID NO 48611 | TTCCTGGGTGGGCAGGAACT | GGG | chr14 | 94390681 | 94390700 | 94390684 | - |
| SEQ ID NO 48612 | CAGGAACTGGGCACTGTGCC | CAG | chr14 | 94390669 | 94390688 | 94390672 | - |
| SEQ ID NO 48613 | AGGAACTGGGCACTGTGCCC | AGG | chr14 | 94390668 | 94390687 | 94390671 | - |
| SEQ ID NO 48614 | GGAACTGGGCACTGTGCCCA | GGG | chr14 | 94390667 | 94390686 | 94390670 | - |
| SEQ ID NO 48615 | GGGCATGCACTGCCTCCACG | CAG | chr14 | 94390647 | 94390666 | 94390650 | - |
| SEQ ID NO 48616 | TGCCTCCACGCAGCAACCCT | CAG | chr14 | 94390637 | 94390656 | 94390640 | - |

Figure 67 (Cont'd)

| | | | | | | | |
|---|---|---|---|---|---|---|---|
| SEQ ID NO 48617 | CCTCCACGCAGCAACCCTCA | GAG | chr14 | 94390635 | 94390654 | 94390638 | - |
| SEQ ID NO 48618 | GCAGCAACCCTCAGAGTCCT | GAG | chr14 | 94390628 | 94390647 | 94390631 | - |
| SEQ ID NO 48619 | TCAGAGTCCTGAGCTGAACC | AAG | chr14 | 94390618 | 94390637 | 94390621 | - |
| SEQ ID NO 48620 | GAGTCCTGAGCTGAACCAAG | AAG | chr14 | 94390615 | 94390634 | 94390618 | - |
| SEQ ID NO 48621 | AGTCCTGAGCTGAACCAAGA | AGG | chr14 | 94390614 | 94390633 | 94390617 | - |
| SEQ ID NO 48622 | TCCTGAGCTGAACCAAGAAG | GAG | chr14 | 94390612 | 94390631 | 94390615 | - |
| SEQ ID NO 48623 | CCTGAGCTGAACCAAGAAGG | AGG | chr14 | 94390611 | 94390630 | 94390614 | - |
| SEQ ID NO 48624 | TGAGCTGAACCAAGAAGGAG | GAG | chr14 | 94390609 | 94390628 | 94390612 | - |
| SEQ ID NO 48625 | GAGCTGAACCAAGAAGGAGG | AGG | chr14 | 94390608 | 94390627 | 94390611 | - |
| SEQ ID NO 48626 | AGCTGAACCAAGAAGGAGGA | GGG | chr14 | 94390607 | 94390626 | 94390610 | - |
| SEQ ID NO 48627 | GCTGAACCAAGAAGGAGGAG | GGG | chr14 | 94390606 | 94390625 | 94390609 | - |
| SEQ ID NO 48628 | CTGAACCAAGAAGGAGGAGG | GGG | chr14 | 94390605 | 94390624 | 94390608 | - |
| SEQ ID NO 48629 | ACCAAGAAGGAGGAGGGGGT | CGG | chr14 | 94390601 | 94390620 | 94390604 | - |
| SEQ ID NO 48630 | CCAAGAAGGAGGAGGGGGTC | GGG | chr14 | 94390600 | 94390619 | 94390603 | - |
| SEQ ID NO 48631 | GAGGAGGGGGTCGGGCCTCC | GAG | chr14 | 94390592 | 94390611 | 94390595 | - |
| SEQ ID NO 48632 | AGGAGGGGGTCGGGCCTCCG | AGG | chr14 | 94390591 | 94390610 | 94390594 | - |
| SEQ ID NO 48633 | AGGGGGTCGGGCCTCCGAGG | AAG | chr14 | 94390588 | 94390607 | 94390591 | - |
| SEQ ID NO 48634 | GGGGGTCGGGCCTCCGAGGA | AGG | chr14 | 94390587 | 94390606 | 94390590 | - |
| SEQ ID NO 48635 | TCGGGCCTCCGAGGAAGGCC | TAG | chr14 | 94390582 | 94390601 | 94390585 | - |
| SEQ ID NO 48636 | GGCCTAGCCGCTGCTGCTGC | CAG | chr14 | 94390566 | 94390585 | 94390569 | - |
| SEQ ID NO 48637 | GCCTAGCCGCTGCTGCTGCC | AGG | chr14 | 94390565 | 94390584 | 94390568 | - |
| SEQ ID NO 48638 | GCTGCTGCTGCCAGGAATTC | CAG | chr14 | 94390557 | 94390576 | 94390560 | - |
| SEQ ID NO 48639 | CTGCTGCTGCCAGGAATTCC | AGG | chr14 | 94390556 | 94390575 | 94390559 | - |
| SEQ ID NO 48640 | TGCTGCCAGGAATTCCAGGT | TGG | chr14 | 94390552 | 94390571 | 94390555 | - |
| SEQ ID NO 48641 | CTGCCAGGAATTCCAGGTTG | GAG | chr14 | 94390550 | 94390569 | 94390553 | - |
| SEQ ID NO 48642 | TGCCAGGAATTCCAGGTTGG | AGG | chr14 | 94390549 | 94390568 | 94390552 | - |
| SEQ ID NO 48643 | GCCAGGAATTCCAGGTTGGA | GGG | chr14 | 94390548 | 94390567 | 94390551 | - |
| SEQ ID NO 48644 | CCAGGAATTCCAGGTTGGAG | GGG | chr14 | 94390547 | 94390566 | 94390550 | - |
| SEQ ID NO 48645 | GGAATTCCAGGTTGGAGGGG | CGG | chr14 | 94390544 | 94390563 | 94390547 | - |
| SEQ ID NO 48646 | GAGGGGCGGCAACCTCCTGC | CAG | chr14 | 94390530 | 94390549 | 94390533 | - |
| SEQ ID NO 48647 | GGCAACCTCCTGCCAGCCTT | CAG | chr14 | 94390523 | 94390542 | 94390526 | - |
| SEQ ID NO 48648 | GCAACCTCCTGCCAGCCTTC | AGG | chr14 | 94390522 | 94390541 | 94390525 | - |
| SEQ ID NO 48649 | GGCCACTCTCCTGTGCCTGC | CAG | chr14 | 94390501 | 94390520 | 94390504 | - |
| SEQ ID NO 48650 | CACTCTCCTGTGCCTGCCAG | AAG | chr14 | 94390498 | 94390517 | 94390501 | - |
| SEQ ID NO 48651 | CTCTCCTGTGCCTGCCAGAA | GAG | chr14 | 94390496 | 94390515 | 94390499 | - |
| SEQ ID NO 48652 | CCTGTGCCTGCCAGAAGAGA | CAG | chr14 | 94390492 | 94390511 | 94390495 | - |
| SEQ ID NO 48653 | TGTGCCTGCCAGAAGAGACA | GAG | chr14 | 94390490 | 94390509 | 94390493 | - |
| SEQ ID NO 48654 | TGCCAGAAGAGACAGAGCTT | GAG | chr14 | 94390484 | 94390503 | 94390487 | - |
| SEQ ID NO 48655 | GCCAGAAGAGACAGAGCTTG | AGG | chr14 | 94390483 | 94390502 | 94390486 | - |
| SEQ ID NO 48656 | CAGAAGAGACAGAGCTTGAG | GAG | chr14 | 94390481 | 94390500 | 94390484 | - |
| SEQ ID NO 48657 | GAAGAGACAGAGCTTGAGGA | GAG | chr14 | 94390479 | 94390498 | 94390482 | - |
| SEQ ID NO 48658 | ACAGAGCTTGAGGAGAGCTT | GAG | chr14 | 94390473 | 94390492 | 94390476 | - |
| SEQ ID NO 48659 | CAGAGCTTGAGGAGAGCTTG | AGG | chr14 | 94390472 | 94390491 | 94390475 | - |
| SEQ ID NO 48660 | GAGCTTGAGGAGAGCTTGAG | GAG | chr14 | 94390470 | 94390489 | 94390473 | - |
| SEQ ID NO 48661 | GCTTGAGGAGAGCTTGAGGA | GAG | chr14 | 94390468 | 94390487 | 94390471 | - |
| SEQ ID NO 48662 | TGAGGAGAGCTTGAGGAGAG | CAG | chr14 | 94390465 | 94390484 | 94390468 | - |
| SEQ ID NO 48663 | GAGGAGAGCTTGAGGAGAGC | AGG | chr14 | 94390464 | 94390483 | 94390467 | - |
| SEQ ID NO 48664 | AGAGCTTGAGGAGAGCAGGA | AAG | chr14 | 94390460 | 94390479 | 94390463 | - |

Figure 67 (Cont'd)

| SEQ ID NO 48665 | GAGCTTGAGGAGAGCAGGAA | AGG | chr14 | 94390459 | 94390478 | 94390462 | - |
| SEQ ID NO 48666 | CTTGAGGAGAGCAGGAAAGG | TGG | chr14 | 94390456 | 94390475 | 94390459 | - |
| SEQ ID NO 48667 | TTGAGGAGAGCAGGAAAGGT | GGG | chr14 | 94390455 | 94390474 | 94390458 | - |
| SEQ ID NO 48668 | CATTGCTGCTGCTGCTCACT | CAG | chr14 | 94390431 | 94390450 | 94390434 | - |
| SEQ ID NO 48669 | CTGCTGCTCACTCAGTTCCA | CAG | chr14 | 94390423 | 94390442 | 94390426 | - |
| SEQ ID NO 48670 | TGCTGCTCACTCAGTTCCAC | AGG | chr14 | 94390422 | 94390441 | 94390425 | - |
| SEQ ID NO 48671 | TGCTCACTCAGTTCCACAGG | TGG | chr14 | 94390419 | 94390438 | 94390422 | - |
| SEQ ID NO 48672 | GCTCACTCAGTTCCACAGGT | GGG | chr14 | 94390418 | 94390437 | 94390421 | - |
| SEQ ID NO 48673 | TCACTCAGTTCCACAGGTGG | GAG | chr14 | 94390416 | 94390435 | 94390419 | - |
| SEQ ID NO 48674 | CACTCAGTTCCACAGGTGGG | AGG | chr14 | 94390415 | 94390434 | 94390418 | - |
| SEQ ID NO 48675 | ACTCAGTTCCACAGGTGGGA | GGG | chr14 | 94390414 | 94390433 | 94390417 | - |
| SEQ ID NO 48676 | AGTTCCACAGGTGGGAGGGA | CAG | chr14 | 94390410 | 94390429 | 94390413 | - |
| SEQ ID NO 48677 | TCCACAGGTGGGAGGGACAG | CAG | chr14 | 94390407 | 94390426 | 94390410 | - |
| SEQ ID NO 48678 | CCACAGGTGGGAGGGACAGC | AGG | chr14 | 94390406 | 94390425 | 94390409 | - |
| SEQ ID NO 48679 | CACAGGTGGGAGGGACAGCA | GGG | chr14 | 94390405 | 94390424 | 94390408 | - |
| SEQ ID NO 48680 | GTGGGAGGGACAGCAGGGCT | TAG | chr14 | 94390400 | 94390419 | 94390403 | - |
| SEQ ID NO 48681 | GGGAGGGACAGCAGGGCTTA | GAG | chr14 | 94390398 | 94390417 | 94390401 | - |
| SEQ ID NO 48682 | AGGGACAGCAGGGCTTAGAG | TGG | chr14 | 94390395 | 94390414 | 94390398 | - |
| SEQ ID NO 48683 | GGGACAGCAGGGCTTAGAGT | GGG | chr14 | 94390394 | 94390413 | 94390397 | - |
| SEQ ID NO 48684 | GGACAGCAGGGCTTAGAGTG | GGG | chr14 | 94390393 | 94390412 | 94390396 | - |
| SEQ ID NO 48685 | GACAGCAGGGCTTAGAGTGG | GGG | chr14 | 94390392 | 94390411 | 94390395 | - |
| SEQ ID NO 48686 | TTAGAGTGGGGGTCATTGTG | CAG | chr14 | 94390381 | 94390400 | 94390384 | - |
| SEQ ID NO 48687 | AGTGGGGGTCATTGTGCAGA | TGG | chr14 | 94390377 | 94390396 | 94390380 | - |
| SEQ ID NO 48688 | GTGGGGGTCATTGTGCAGAT | GGG | chr14 | 94390376 | 94390395 | 94390379 | - |
| SEQ ID NO 48689 | ATTGTGCAGATGGGAAAACA | AAG | chr14 | 94390367 | 94390386 | 94390370 | - |
| SEQ ID NO 48690 | TTGTGCAGATGGGAAAACAA | AGG | chr14 | 94390366 | 94390385 | 94390369 | - |
| SEQ ID NO 48691 | CAGATGGGAAAACAAAGGCC | CAG | chr14 | 94390361 | 94390380 | 94390364 | - |
| SEQ ID NO 48692 | GATGGGAAAACAAAGGCCCA | GAG | chr14 | 94390359 | 94390378 | 94390362 | - |
| SEQ ID NO 48693 | TGGGAAAACAAAGGCCCAGA | GAG | chr14 | 94390357 | 94390376 | 94390360 | - |
| SEQ ID NO 48694 | GGGAAAACAAAGGCCCAGAG | AGG | chr14 | 94390356 | 94390375 | 94390359 | - |
| SEQ ID NO 48695 | GGAAAACAAAGGCCCAGAGA | GGG | chr14 | 94390355 | 94390374 | 94390358 | - |
| SEQ ID NO 48696 | GAAAACAAAGGCCCAGAGAG | GGG | chr14 | 94390354 | 94390373 | 94390357 | - |
| SEQ ID NO 48697 | AACAAAGGCCCAGAGAGGGG | AAG | chr14 | 94390351 | 94390370 | 94390354 | - |
| SEQ ID NO 48698 | CAGAGAGGGGAAGAAATGCC | CAG | chr14 | 94390341 | 94390360 | 94390344 | - |
| SEQ ID NO 48699 | AGAGAGGGGAAGAAATGCCC | AGG | chr14 | 94390340 | 94390359 | 94390343 | - |
| SEQ ID NO 48700 | AGAGGGGAAGAAATGCCCAG | GAG | chr14 | 94390338 | 94390357 | 94390341 | - |
| SEQ ID NO 48701 | AGAAATGCCCAGGAGCTACC | GAG | chr14 | 94390330 | 94390349 | 94390333 | - |
| SEQ ID NO 48702 | GAAATGCCCAGGAGCTACCG | AGG | chr14 | 94390329 | 94390348 | 94390332 | - |
| SEQ ID NO 48703 | AAATGCCCAGGAGCTACCGA | GGG | chr14 | 94390328 | 94390347 | 94390331 | - |
| SEQ ID NO 48704 | TGCCCAGGAGCTACCGAGGG | CAG | chr14 | 94390325 | 94390344 | 94390328 | - |
| SEQ ID NO 48705 | GCCCAGGAGCTACCGAGGGC | AGG | chr14 | 94390324 | 94390343 | 94390327 | - |
| SEQ ID NO 48706 | AGGGCAGGCGACCTCAACCA | CAG | chr14 | 94390309 | 94390328 | 94390312 | - |
| SEQ ID NO 48707 | AGGCGACCTCAACCACAGCC | CAG | chr14 | 94390304 | 94390323 | 94390307 | - |
| SEQ ID NO 48708 | CCTCAACCACAGCCCAGTGC | TGG | chr14 | 94390298 | 94390317 | 94390301 | - |
| SEQ ID NO 48709 | TCAACCACAGCCCAGTGCTG | GAG | chr14 | 94390296 | 94390315 | 94390299 | - |
| SEQ ID NO 48710 | CAGCCCAGTGCTGGAGCTGT | GAG | chr14 | 94390289 | 94390308 | 94390292 | - |
| SEQ ID NO 48711 | CCCAGTGCTGGAGCTGTGAG | TGG | chr14 | 94390286 | 94390305 | 94390289 | - |
| SEQ ID NO 48712 | GCTGGAGCTGTGAGTGGATG | TAG | chr14 | 94390280 | 94390299 | 94390283 | - |

Figure 67 (Cont'd)

| | | | | | | | |
|---|---|---|---|---|---|---|---|
| SEQ ID NO 48713 | TGGAGCTGTGAGTGGATGTA | GAG | chr14 | 94390278 | 94390297 | 94390281 | - |
| SEQ ID NO 48714 | AGCTGTGAGTGGATGTAGAG | CAG | chr14 | 94390275 | 94390294 | 94390278 | - |
| SEQ ID NO 48715 | TGTGAGTGGATGTAGAGCAG | CGG | chr14 | 94390272 | 94390291 | 94390275 | - |
| SEQ ID NO 48716 | AGAGCAGCGGAATATCCATT | CAG | chr14 | 94390259 | 94390278 | 94390262 | - |
| SEQ ID NO 48717 | CAGCGGAATATCCATTCAGC | CAG | chr14 | 94390255 | 94390274 | 94390258 | - |
| SEQ ID NO 48718 | GAATATCCATTCAGCCAGCT | CAG | chr14 | 94390250 | 94390269 | 94390253 | - |
| SEQ ID NO 48719 | AATATCCATTCAGCCAGCTC | AGG | chr14 | 94390249 | 94390268 | 94390252 | - |
| SEQ ID NO 48720 | ATATCCATTCAGCCAGCTCA | GGG | chr14 | 94390248 | 94390267 | 94390251 | - |
| SEQ ID NO 48721 | TATCCATTCAGCCAGCTCAG | GGG | chr14 | 94390247 | 94390266 | 94390250 | - |
| SEQ ID NO 48722 | CCATTCAGCCAGCTCAGGGG | AAG | chr14 | 94390244 | 94390263 | 94390247 | - |
| SEQ ID NO 48723 | CATTCAGCCAGCTCAGGGGA | AGG | chr14 | 94390243 | 94390262 | 94390246 | - |
| SEQ ID NO 48724 | CAGCCAGCTCAGGGGAAGGA | CAG | chr14 | 94390239 | 94390258 | 94390242 | - |
| SEQ ID NO 48725 | AGCCAGCTCAGGGGAAGGAC | AGG | chr14 | 94390238 | 94390257 | 94390241 | - |
| SEQ ID NO 48726 | GCCAGCTCAGGGGAAGGACA | GGG | chr14 | 94390237 | 94390256 | 94390240 | - |
| SEQ ID NO 48727 | CCAGCTCAGGGGAAGGACAG | GGG | chr14 | 94390236 | 94390255 | 94390239 | - |
| SEQ ID NO 48728 | GGGGAAGGACAGGGGCCCTG | AAG | chr14 | 94390228 | 94390247 | 94390231 | - |
| SEQ ID NO 48729 | AAGGACAGGGGCCCTGAAGC | CAG | chr14 | 94390224 | 94390243 | 94390227 | - |
| SEQ ID NO 48730 | AGGACAGGGGCCCTGAAGCC | AGG | chr14 | 94390223 | 94390242 | 94390226 | - |
| SEQ ID NO 48731 | GGACAGGGGCCCTGAAGCCA | GGG | chr14 | 94390222 | 94390241 | 94390225 | - |
| SEQ ID NO 48732 | GACAGGGGCCCTGAAGCCAG | GGG | chr14 | 94390221 | 94390240 | 94390224 | - |
| SEQ ID NO 48733 | GGGGCCCTGAAGCCAGGGGA | TGG | chr14 | 94390217 | 94390236 | 94390220 | - |
| SEQ ID NO 48734 | GGCCCTGAAGCCAGGGGATG | GAG | chr14 | 94390215 | 94390234 | 94390218 | - |
| SEQ ID NO 48735 | GAAGCCAGGGGATGGAGCTG | CAG | chr14 | 94390209 | 94390228 | 94390212 | - |
| SEQ ID NO 48736 | AAGCCAGGGGATGGAGCTGC | AGG | chr14 | 94390208 | 94390227 | 94390211 | - |
| SEQ ID NO 48737 | AGCCAGGGGATGGAGCTGCA | GGG | chr14 | 94390207 | 94390226 | 94390210 | - |
| SEQ ID NO 48738 | CAGGGGATGGAGCTGCAGGG | AAG | chr14 | 94390204 | 94390223 | 94390207 | - |
| SEQ ID NO 48739 | AGGGGATGGAGCTGCAGGGA | AGG | chr14 | 94390203 | 94390222 | 94390206 | - |
| SEQ ID NO 48740 | GGGGATGGAGCTGCAGGGAA | GGG | chr14 | 94390202 | 94390221 | 94390205 | - |
| SEQ ID NO 48741 | GGATGGAGCTGCAGGGAAGG | GAG | chr14 | 94390200 | 94390219 | 94390203 | - |
| SEQ ID NO 48742 | GAGCTGCAGGGAAGGGAGCT | CAG | chr14 | 94390195 | 94390214 | 94390198 | - |
| SEQ ID NO 48743 | GCTGCAGGGAAGGGAGCTCA | GAG | chr14 | 94390193 | 94390212 | 94390196 | - |
| SEQ ID NO 48744 | TGCAGGGAAGGGAGCTCAGA | GAG | chr14 | 94390191 | 94390210 | 94390194 | - |
| SEQ ID NO 48745 | AGGGAAGGGAGCTCAGAGAG | AAG | chr14 | 94390188 | 94390207 | 94390191 | - |
| SEQ ID NO 48746 | GGGAAGGGAGCTCAGAGAGA | AGG | chr14 | 94390187 | 94390206 | 94390190 | - |
| SEQ ID NO 48747 | GGAAGGGAGCTCAGAGAGAA | GGG | chr14 | 94390186 | 94390205 | 94390189 | - |
| SEQ ID NO 48748 | GAAGGGAGCTCAGAGAGAAG | GGG | chr14 | 94390185 | 94390204 | 94390188 | - |
| SEQ ID NO 48749 | AGGGAGCTCAGAGAGAAGGG | GAG | chr14 | 94390183 | 94390202 | 94390186 | - |
| SEQ ID NO 48750 | GGGAGCTCAGAGAGAAGGGG | AGG | chr14 | 94390182 | 94390201 | 94390185 | - |
| SEQ ID NO 48751 | GGAGCTCAGAGAGAAGGGGA | GGG | chr14 | 94390181 | 94390200 | 94390184 | - |
| SEQ ID NO 48752 | GAGCTCAGAGAGAAGGGGAG | GGG | chr14 | 94390180 | 94390199 | 94390183 | - |
| SEQ ID NO 48753 | GCTCAGAGAGAAGGGGAGGG | GAG | chr14 | 94390178 | 94390197 | 94390181 | - |
| SEQ ID NO 48754 | AGAGAAGGGGAGGGGAGTCT | GAG | chr14 | 94390172 | 94390191 | 94390175 | - |
| SEQ ID NO 48755 | AGGGGAGGGGAGTCTGAGCT | CAG | chr14 | 94390167 | 94390186 | 94390170 | - |
| SEQ ID NO 48756 | CTCAGTTTCCCGCTGCCTGA | AAG | chr14 | 94390149 | 94390168 | 94390152 | - |
| SEQ ID NO 48757 | TCAGTTTCCCGCTGCCTGAA | AGG | chr14 | 94390148 | 94390167 | 94390151 | - |
| SEQ ID NO 48758 | AGTTTCCCGCTGCCTGAAAG | GAG | chr14 | 94390146 | 94390165 | 94390149 | - |
| SEQ ID NO 48759 | GTTTCCCGCTGCCTGAAAGG | AGG | chr14 | 94390145 | 94390164 | 94390148 | - |
| SEQ ID NO 48760 | TTTCCCGCTGCCTGAAAGGA | GGG | chr14 | 94390144 | 94390163 | 94390147 | - |

Figure 67 (Cont'd)

| | | | | | | | |
|---|---|---|---|---|---|---|---|
| SEQ ID NO 48761 | CCCGCTGCCTGAAAGGAGGG | TGG | chr14 | 94390141 | 94390160 | 94390144 | - |
| SEQ ID NO 48762 | GGTGGTACCTACTCCCTTCA | CAG | chr14 | 94390123 | 94390142 | 94390126 | - |
| SEQ ID NO 48763 | GTGGTACCTACTCCCTTCAC | AGG | chr14 | 94390122 | 94390141 | 94390125 | - |
| SEQ ID NO 48764 | TGGTACCTACTCCCTTCACA | GGG | chr14 | 94390121 | 94390140 | 94390124 | - |
| SEQ ID NO 48765 | CCTTCACAGGGTAACTGAAT | GAG | chr14 | 94390109 | 94390128 | 94390112 | - |
| SEQ ID NO 48766 | TTCACAGGGTAACTGAATGA | GAG | chr14 | 94390107 | 94390126 | 94390110 | - |
| SEQ ID NO 48767 | TAACTGAATGAGAGACTGCC | TGG | chr14 | 94390098 | 94390117 | 94390101 | - |
| SEQ ID NO 48768 | ACTGAATGAGAGACTGCCTG | GAG | chr14 | 94390096 | 94390115 | 94390099 | - |
| SEQ ID NO 48769 | CTGAATGAGAGACTGCCTGG | AGG | chr14 | 94390095 | 94390114 | 94390098 | - |
| SEQ ID NO 48770 | ATGAGAGACTGCCTGGAGGA | AAG | chr14 | 94390091 | 94390110 | 94390094 | - |
| SEQ ID NO 48771 | TGCCTGGAGGAAAGCTCTTC | AAG | chr14 | 94390082 | 94390101 | 94390085 | - |
| SEQ ID NO 48772 | GGAGGAAAGCTCTTCAAGTG | TGG | chr14 | 94390077 | 94390096 | 94390080 | - |
| SEQ ID NO 48773 | AAGTGTGGCCCACCCCACCC | CAG | chr14 | 94390062 | 94390081 | 94390065 | - |
| SEQ ID NO 48774 | CCACCCCACCCCAGTGACAC | CAG | chr14 | 94390053 | 94390072 | 94390056 | - |
| SEQ ID NO 48775 | AGTGACACCAGCCCCTGACA | CGG | chr14 | 94390041 | 94390060 | 94390044 | - |
| SEQ ID NO 48776 | GTGACACCAGCCCCTGACAC | GGG | chr14 | 94390040 | 94390059 | 94390043 | - |
| SEQ ID NO 48777 | TGACACCAGCCCCTGACACG | GGG | chr14 | 94390039 | 94390058 | 94390042 | - |
| SEQ ID NO 48778 | GACACCAGCCCCTGACACGG | GGG | chr14 | 94390038 | 94390057 | 94390041 | - |
| SEQ ID NO 48779 | CACCAGCCCCTGACACGGGG | GAG | chr14 | 94390036 | 94390055 | 94390039 | - |
| SEQ ID NO 48780 | ACCAGCCCCTGACACGGGGG | AGG | chr14 | 94390035 | 94390054 | 94390038 | - |
| SEQ ID NO 48781 | CCAGCCCCTGACACGGGGGA | GGG | chr14 | 94390034 | 94390053 | 94390037 | - |
| SEQ ID NO 48782 | AGCCCCTGACACGGGGGAGG | GAG | chr14 | 94390032 | 94390051 | 94390035 | - |
| SEQ ID NO 48783 | GCCCCTGACACGGGGGAGGG | AGG | chr14 | 94390031 | 94390050 | 94390034 | - |
| SEQ ID NO 48784 | CCCCTGACACGGGGGAGGGA | GGG | chr14 | 94390030 | 94390049 | 94390033 | - |
| SEQ ID NO 48785 | CTGACACGGGGGAGGGAGGG | CAG | chr14 | 94390027 | 94390046 | 94390030 | - |
| SEQ ID NO 48786 | CGGGGGAGGGAGGGCAGCAT | CAG | chr14 | 94390021 | 94390040 | 94390024 | - |
| SEQ ID NO 48787 | GGGGGAGGGAGGGCAGCATC | AGG | chr14 | 94390020 | 94390039 | 94390023 | - |
| SEQ ID NO 48788 | GGGAGGGAGGGCAGCATCAG | GAG | chr14 | 94390018 | 94390037 | 94390021 | - |
| SEQ ID NO 48789 | GGAGGGAGGGCAGCATCAGG | AGG | chr14 | 94390017 | 94390036 | 94390020 | - |
| SEQ ID NO 48790 | GAGGGAGGGCAGCATCAGGA | GGG | chr14 | 94390016 | 94390035 | 94390019 | - |
| SEQ ID NO 48791 | AGGGAGGGCAGCATCAGGAG | GGG | chr14 | 94390015 | 94390034 | 94390018 | - |
| SEQ ID NO 48792 | CAGCATCAGGAGGGCTTTC | TGG | chr14 | 94390007 | 94390026 | 94390010 | - |
| SEQ ID NO 48793 | AGCATCAGGAGGGCTTTCT | GGG | chr14 | 94390006 | 94390025 | 94390009 | - |
| SEQ ID NO 48794 | AGGGGCTTTCTGGGCACACC | CAG | chr14 | 94389997 | 94390016 | 94390000 | - |
| SEQ ID NO 48795 | CACACCCAGTACCCGTCTCT | GAG | chr14 | 94389983 | 94390002 | 94389986 | - |
| SEQ ID NO 48796 | CTGTTGCATTTTAATCCTCA | CAG | chr14 | 94389949 | 94389968 | 94389952 | - |
| SEQ ID NO 48797 | TTGCATTTTAATCCTCACAG | CAG | chr14 | 94389946 | 94389965 | 94389949 | - |
| SEQ ID NO 48798 | AATCCTCACAGCAGCTCAAC | AAG | chr14 | 94389937 | 94389956 | 94389940 | - |
| SEQ ID NO 48799 | ATCCTCACAGCAGCTCAACA | AGG | chr14 | 94389936 | 94389955 | 94389939 | - |
| SEQ ID NO 48800 | CCGTCACCATCCCCATTTTA | CAG | chr14 | 94389907 | 94389926 | 94389910 | - |
| SEQ ID NO 48801 | CACCATCCCCATTTTACAGA | TAG | chr14 | 94389903 | 94389922 | 94389906 | - |
| SEQ ID NO 48802 | ACCATCCCCATTTTACAGAT | AGG | chr14 | 94389902 | 94389921 | 94389905 | - |
| SEQ ID NO 48803 | CCATCCCCATTTTACAGATA | GGG | chr14 | 94389901 | 94389920 | 94389904 | - |
| SEQ ID NO 48804 | ATTTTACAGATAGGGAAATT | GAG | chr14 | 94389893 | 94389912 | 94389896 | - |
| SEQ ID NO 48805 | TTTTACAGATAGGGAAATTG | AGG | chr14 | 94389892 | 94389911 | 94389895 | - |
| SEQ ID NO 48806 | CAGATAGGGAAATTGAGGCT | CGG | chr14 | 94389887 | 94389906 | 94389890 | - |
| SEQ ID NO 48807 | GATAGGGAAATTGAGGCTCG | GAG | chr14 | 94389885 | 94389904 | 94389888 | - |
| SEQ ID NO 48808 | AGGGAAATTGAGGCTCGGAG | CGG | chr14 | 94389882 | 94389901 | 94389885 | - |

Figure 67 (Cont'd)

| SEQ ID NO 48809 | AGCGGTTAAACAACTCACCT | GAG | chr14 | 94389864 | 94389883 | 94389867 | - |
| SEQ ID NO 48810 | GCGGTTAAACAACTCACCTG | AGG | chr14 | 94389863 | 94389882 | 94389866 | - |
| SEQ ID NO 48811 | ACAACTCACCTGAGGCCTCA | CAG | chr14 | 94389855 | 94389874 | 94389858 | - |
| SEQ ID NO 48812 | CTCACCTGAGGCCTCACAGC | CAG | chr14 | 94389851 | 94389870 | 94389854 | - |
| SEQ ID NO 48813 | CCTGAGGCCTCACAGCCAGT | AAG | chr14 | 94389847 | 94389866 | 94389850 | - |
| SEQ ID NO 48814 | GAGGCCTCACAGCCAGTAAG | TGG | chr14 | 94389844 | 94389863 | 94389847 | - |
| SEQ ID NO 48815 | AGGCCTCACAGCCAGTAAGT | GGG | chr14 | 94389843 | 94389862 | 94389846 | - |
| SEQ ID NO 48816 | CAGCCAGTAAGTGGGTTCCC | TGG | chr14 | 94389835 | 94389854 | 94389838 | - |
| SEQ ID NO 48817 | CCTGGTCTGAATGTGTGTGC | TGG | chr14 | 94389817 | 94389836 | 94389820 | - |
| SEQ ID NO 48818 | TGGTCTGAATGTGTGTGCTG | GAG | chr14 | 94389815 | 94389834 | 94389818 | - |
| SEQ ID NO 48819 | GGTCTGAATGTGTGTGCTGG | AGG | chr14 | 94389814 | 94389833 | 94389817 | - |
| SEQ ID NO 48820 | GTGTGTGCTGGAGGATCCTG | TGG | chr14 | 94389805 | 94389824 | 94389808 | - |
| SEQ ID NO 48821 | TGTGTGCTGGAGGATCCTGT | GGG | chr14 | 94389804 | 94389823 | 94389807 | - |
| SEQ ID NO 48822 | GATCCTGTGGGTCACTCGCC | TGG | chr14 | 94389792 | 94389811 | 94389795 | - |
| SEQ ID NO 48823 | CCTGTGGGTCACTCGCCTGG | TAG | chr14 | 94389789 | 94389808 | 94389792 | - |
| SEQ ID NO 48824 | TGTGGGTCACTCGCCTGGTA | GAG | chr14 | 94389787 | 94389806 | 94389790 | - |
| SEQ ID NO 48825 | CACTCGCCTGGTAGAGCCCC | AAG | chr14 | 94389780 | 94389799 | 94389783 | - |
| SEQ ID NO 48826 | ACTCGCCTGGTAGAGCCCCA | AGG | chr14 | 94389779 | 94389798 | 94389782 | - |
| SEQ ID NO 48827 | CGCCTGGTAGAGCCCCAAGG | TGG | chr14 | 94389776 | 94389795 | 94389779 | - |
| SEQ ID NO 48828 | CCTGGTAGAGCCCCAAGGTG | GAG | chr14 | 94389774 | 94389793 | 94389777 | - |
| SEQ ID NO 48829 | CTGGTAGAGCCCCAAGGTGG | AGG | chr14 | 94389773 | 94389792 | 94389776 | - |
| SEQ ID NO 48830 | CCCCAAGGTGGAGGCATAAA | TGG | chr14 | 94389764 | 94389783 | 94389767 | - |
| SEQ ID NO 48831 | CCCAAGGTGGAGGCATAAAT | GGG | chr14 | 94389763 | 94389782 | 94389766 | - |
| SEQ ID NO 48832 | GGTGGAGGCATAAATGGGAC | TGG | chr14 | 94389758 | 94389777 | 94389761 | - |
| SEQ ID NO 48833 | TAAATGGGACTGGTGAATGA | CAG | chr14 | 94389748 | 94389767 | 94389751 | - |
| SEQ ID NO 48834 | ATGGGACTGGTGAATGACAG | AAG | chr14 | 94389745 | 94389764 | 94389748 | - |
| SEQ ID NO 48835 | TGGGACTGGTGAATGACAGA | AGG | chr14 | 94389744 | 94389763 | 94389747 | - |
| SEQ ID NO 48836 | GGGACTGGTGAATGACAGAA | GGG | chr14 | 94389743 | 94389762 | 94389746 | - |
| SEQ ID NO 48837 | GGACTGGTGAATGACAGAAG | GGG | chr14 | 94389742 | 94389761 | 94389745 | - |
| SEQ ID NO 48838 | CACTCATCCATTCACTCTGC | AAG | chr14 | 94389711 | 94389730 | 94389714 | - |
| SEQ ID NO 48839 | ATTCACTCTGCAAGTATCTA | CGG | chr14 | 94389702 | 94389721 | 94389705 | - |
| SEQ ID NO 48840 | AGTATCTACGGCACGTACGC | CAG | chr14 | 94389690 | 94389709 | 94389693 | - |
| SEQ ID NO 48841 | CGGCACGTACGCCAGCTCCC | AAG | chr14 | 94389682 | 94389701 | 94389685 | - |
| SEQ ID NO 48842 | CACGTACGCCAGCTCCCAAG | CAG | chr14 | 94389679 | 94389698 | 94389682 | - |
| SEQ ID NO 48843 | ACGTACGCCAGCTCCCAAGC | AGG | chr14 | 94389678 | 94389697 | 94389681 | - |
| SEQ ID NO 48844 | CCAGCTCCCAAGCAGGTTTG | CGG | chr14 | 94389671 | 94389690 | 94389674 | - |
| SEQ ID NO 48845 | CAGCTCCCAAGCAGGTTTGC | GGG | chr14 | 94389670 | 94389689 | 94389673 | - |
| SEQ ID NO 48846 | AAGCAGGTTTGCGGGTTGCA | CAG | chr14 | 94389662 | 94389681 | 94389665 | - |
| SEQ ID NO 48847 | CAGGTTTGCGGGTTGCACAG | CGG | chr14 | 94389659 | 94389678 | 94389662 | - |
| SEQ ID NO 48848 | AGGTTTGCGGGTTGCACAGC | GGG | chr14 | 94389658 | 94389677 | 94389661 | - |
| SEQ ID NO 48849 | GCGGGCGATGCAATCTGATT | TAG | chr14 | 94389640 | 94389659 | 94389643 | - |
| SEQ ID NO 48850 | CGGGCGATGCAATCTGATTT | AGG | chr14 | 94389639 | 94389658 | 94389642 | - |
| SEQ ID NO 48851 | CAATCTGATTTAGGCTTTTA | AAG | chr14 | 94389630 | 94389649 | 94389633 | - |
| SEQ ID NO 48852 | AATCTGATTTAGGCTTTTAA | AGG | chr14 | 94389629 | 94389648 | 94389632 | - |
| SEQ ID NO 48853 | ATCTGATTTAGGCTTTTAAA | GGG | chr14 | 94389628 | 94389647 | 94389631 | - |
| SEQ ID NO 48854 | CTTTTAAAGGGATTGCAATC | AAG | chr14 | 94389616 | 94389635 | 94389619 | - |
| SEQ ID NO 48855 | TTAAAGGGATTGCAATCAAG | TGG | chr14 | 94389613 | 94389632 | 94389616 | - |
| SEQ ID NO 48856 | TAAAGGGATTGCAATCAAGT | GGG | chr14 | 94389612 | 94389631 | 94389615 | - |

Figure 67 (Cont'd)

| | | | | | | | |
|---|---|---|---|---|---|---|---|
| SEQ ID NO 48857 | AAAGGGATTGCAATCAAGTG | GGG | chr14 | 94389611 | 94389630 | 94389614 | - |
| SEQ ID NO 48858 | GCAATCAAGTGGGGCCCCAC | TAG | chr14 | 94389602 | 94389621 | 94389605 | - |
| SEQ ID NO 48859 | CCTCCCCTCCCCTCCACCCC | CAG | chr14 | 94389566 | 94389585 | 94389569 | - |
| SEQ ID NO 48860 | CCCCTCCCCTCCACCCCCAG | CAG | chr14 | 94389563 | 94389582 | 94389566 | - |
| SEQ ID NO 48861 | TCCACCCCCAGCAGTCTCCA | AAG | chr14 | 94389554 | 94389573 | 94389557 | - |
| SEQ ID NO 48862 | CCACCCCCAGCAGTCTCCAA | AGG | chr14 | 94389553 | 94389572 | 94389556 | - |
| SEQ ID NO 48863 | CCAAAGGCCTCCAACAACCC | CAG | chr14 | 94389537 | 94389556 | 94389540 | - |
| SEQ ID NO 48864 | AAAGGCCTCCAACAACCCCA | GAG | chr14 | 94389535 | 94389554 | 94389538 | - |
| SEQ ID NO 48865 | GGCCTCCAACAACCCCAGAG | TGG | chr14 | 94389532 | 94389551 | 94389535 | - |
| SEQ ID NO 48866 | GCCTCCAACAACCCCAGAGT | GGG | chr14 | 94389531 | 94389550 | 94389534 | - |
| SEQ ID NO 48867 | CCTCCAACAACCCCAGAGTG | GGG | chr14 | 94389530 | 94389549 | 94389533 | - |
| SEQ ID NO 48868 | CTCCAACAACCCCAGAGTGG | GGG | chr14 | 94389529 | 94389548 | 94389532 | - |
| SEQ ID NO 48869 | GAGTGGGGGCCATGTATCCA | AAG | chr14 | 94389515 | 94389534 | 94389518 | - |
| SEQ ID NO 48870 | CATGTATCCAAAGAAACTCC | AAG | chr14 | 94389505 | 94389524 | 94389508 | - |
| SEQ ID NO 48871 | AAGAAACTCCAAGCTGTATA | CGG | chr14 | 94389495 | 94389514 | 94389498 | - |
| SEQ ID NO 48872 | AAGCTGTATACGGATCACAC | TGG | chr14 | 94389485 | 94389504 | 94389488 | - |
| SEQ ID NO 48873 | TACGGATCACACTGGTTTTC | CAG | chr14 | 94389477 | 94389496 | 94389480 | - |
| SEQ ID NO 48874 | ACGGATCACACTGGTTTTCC | AGG | chr14 | 94389476 | 94389495 | 94389479 | - |
| SEQ ID NO 48875 | GGATCACACTGGTTTTCCAG | GAG | chr14 | 94389474 | 94389493 | 94389477 | - |
| SEQ ID NO 48876 | TGGTTTTCCAGGAGCAAAAA | CAG | chr14 | 94389465 | 94389484 | 94389468 | - |
| SEQ ID NO 48877 | TCCAGGAGCAAAAACAGAAA | CAG | chr14 | 94389459 | 94389478 | 94389462 | - |
| SEQ ID NO 48878 | CCAGGAGCAAAAACAGAAAC | AGG | chr14 | 94389458 | 94389477 | 94389461 | - |
| SEQ ID NO 48879 | GCAAAAACAGAAACAGGCCT | GAG | chr14 | 94389452 | 94389471 | 94389455 | - |
| SEQ ID NO 48880 | CAAAAACAGAAACAGGCCTG | AGG | chr14 | 94389451 | 94389470 | 94389454 | - |
| SEQ ID NO 48881 | AACAGAAACAGGCCTGAGGC | TGG | chr14 | 94389447 | 94389466 | 94389450 | - |
| SEQ ID NO 48882 | ATTGAACCTCCTCCTGCTCT | GAG | chr14 | 94389419 | 94389438 | 94389422 | - |
| SEQ ID NO 48883 | GAACCTCCTCCTGCTCTGAG | CAG | chr14 | 94389416 | 94389435 | 94389419 | - |
| SEQ ID NO 48884 | TCCTCCTGCTCTGAGCAGCC | TGG | chr14 | 94389411 | 94389430 | 94389414 | - |
| SEQ ID NO 48885 | CCTCCTGCTCTGAGCAGCCT | GGG | chr14 | 94389410 | 94389429 | 94389413 | - |
| SEQ ID NO 48886 | CTCCTGCTCTGAGCAGCCTG | GGG | chr14 | 94389409 | 94389428 | 94389412 | - |
| SEQ ID NO 48887 | TCCTGCTCTGAGCAGCCTGG | GGG | chr14 | 94389408 | 94389427 | 94389411 | - |
| SEQ ID NO 48888 | CCTGCTCTGAGCAGCCTGGG | GGG | chr14 | 94389407 | 94389426 | 94389410 | - |
| SEQ ID NO 48889 | GCTCTGAGCAGCCTGGGGGG | CAG | chr14 | 94389404 | 94389423 | 94389407 | - |
| SEQ ID NO 48890 | AGCAGCCTGGGGGGCAGACT | AAG | chr14 | 94389398 | 94389417 | 94389401 | - |
| SEQ ID NO 48891 | AGCCTGGGGGGCAGACTAAG | CAG | chr14 | 94389395 | 94389414 | 94389398 | - |
| SEQ ID NO 48892 | CCTGGGGGGCAGACTAAGCA | GAG | chr14 | 94389393 | 94389412 | 94389396 | - |
| SEQ ID NO 48893 | CTGGGGGGCAGACTAAGCAG | AGG | chr14 | 94389392 | 94389411 | 94389395 | - |
| SEQ ID NO 48894 | TGGGGGGCAGACTAAGCAGA | GGG | chr14 | 94389391 | 94389410 | 94389394 | - |
| SEQ ID NO 48895 | AGACTAAGCAGAGGGCTGTG | CAG | chr14 | 94389383 | 94389402 | 94389386 | - |
| SEQ ID NO 48896 | GGGCTGTGCAGACCCACATA | AAG | chr14 | 94389371 | 94389390 | 94389374 | - |
| SEQ ID NO 48897 | GCTGTGCAGACCCACATAAA | GAG | chr14 | 94389369 | 94389388 | 94389372 | - |
| SEQ ID NO 48898 | ATAAAGAGCCTACTGTGTGC | CAG | chr14 | 94389354 | 94389373 | 94389357 | - |
| SEQ ID NO 48899 | TAAAGAGCCTACTGTGTGCC | AGG | chr14 | 94389353 | 94389372 | 94389356 | - |
| SEQ ID NO 48900 | GTGTGCCAGGCACTTCACCC | GAG | chr14 | 94389340 | 94389359 | 94389343 | - |
| SEQ ID NO 48901 | TGTGCCAGGCACTTCACCCG | AGG | chr14 | 94389339 | 94389358 | 94389342 | - |
| SEQ ID NO 48902 | CTTCACCCGAGGCACTTCAC | AAG | chr14 | 94389328 | 94389347 | 94389331 | - |
| SEQ ID NO 48903 | AGGCACTTCACAAGCATGCT | TGG | chr14 | 94389319 | 94389338 | 94389322 | - |
| SEQ ID NO 48904 | GGCACTTCACAAGCATGCTT | GGG | chr14 | 94389318 | 94389337 | 94389321 | - |

Figure 67 (Cont'd)

| | | | | | | | |
|---|---|---|---|---|---|---|---|
| SEQ ID NO 48905 | GAATGAAACTTCCAACTCTT | TGG | chr14 | 94389296 | 94389315 | 94389299 | - |
| SEQ ID NO 48906 | AATGAAACTTCCAACTCTTT | GGG | chr14 | 94389295 | 94389314 | 94389298 | - |
| SEQ ID NO 48907 | ACTTCCAACTCTTTGGGATG | CAG | chr14 | 94389289 | 94389308 | 94389292 | - |
| SEQ ID NO 48908 | CTTCCAACTCTTTGGGATGC | AGG | chr14 | 94389288 | 94389307 | 94389291 | - |
| SEQ ID NO 48909 | TCTTTGGGATGCAGGTGAAA | CAG | chr14 | 94389280 | 94389299 | 94389283 | - |
| SEQ ID NO 48910 | GATGCAGGTGAAACAGTTCC | TGG | chr14 | 94389273 | 94389292 | 94389276 | - |
| SEQ ID NO 48911 | AGGTGAAACAGTTCCTGGTT | CAG | chr14 | 94389268 | 94389287 | 94389271 | - |
| SEQ ID NO 48912 | GTGAAACAGTTCCTGGTTCA | GAG | chr14 | 94389266 | 94389285 | 94389269 | - |
| SEQ ID NO 48913 | GAAACAGTTCCTGGTTCAGA | GAG | chr14 | 94389264 | 94389283 | 94389267 | - |
| SEQ ID NO 48914 | AAACAGTTCCTGGTTCAGAG | AGG | chr14 | 94389263 | 94389282 | 94389266 | - |
| SEQ ID NO 48915 | GTTCCTGGTTCAGAGAGGTG | AAG | chr14 | 94389258 | 94389277 | 94389261 | - |
| SEQ ID NO 48916 | CCTGGTTCAGAGAGGTGAAG | CGG | chr14 | 94389255 | 94389274 | 94389258 | - |
| SEQ ID NO 48917 | AGAGGTGAAGCGGCCTGCCT | GAG | chr14 | 94389245 | 94389264 | 94389248 | - |
| SEQ ID NO 48918 | GAGGTGAAGCGGCCTGCCTG | AGG | chr14 | 94389244 | 94389263 | 94389247 | - |
| SEQ ID NO 48919 | GTGAAGCGGCCTGCCTGAGG | CAG | chr14 | 94389241 | 94389260 | 94389244 | - |
| SEQ ID NO 48920 | GCGGCCTGCCTGAGGCAGCA | CAG | chr14 | 94389236 | 94389255 | 94389239 | - |
| SEQ ID NO 48921 | GGCAGCACAGCTCTTCTTTA | CAG | chr14 | 94389223 | 94389242 | 94389226 | - |
| SEQ ID NO 48922 | CCCACCTCTACCCTGTCTCA | CGG | chr14 | 94389191 | 94389210 | 94389194 | - |
| SEQ ID NO 48923 | TGTCTCACGGCCCCCATGC | CAG | chr14 | 94389178 | 94389197 | 94389181 | - |
| SEQ ID NO 48924 | GGCCCCCATGCCAGCCTGA | CGG | chr14 | 94389170 | 94389189 | 94389173 | - |
| SEQ ID NO 48925 | CCTGACGGTTGTGTCTGCCT | CAG | chr14 | 94389155 | 94389174 | 94389158 | - |
| SEQ ID NO 48926 | GTCATGCTCCATTTTTCCAT | CGG | chr14 | 94389133 | 94389152 | 94389136 | - |
| SEQ ID NO 48927 | TCATGCTCCATTTTTCCATC | GGG | chr14 | 94389132 | 94389151 | 94389135 | - |
| SEQ ID NO 48928 | ATTTTTCCATCGGGACCATC | AAG | chr14 | 94389123 | 94389142 | 94389126 | - |
| SEQ ID NO 48929 | TTTTCCATCGGGACCATCAA | GAG | chr14 | 94389121 | 94389140 | 94389124 | - |
| SEQ ID NO 48930 | TTTCCATCGGGACCATCAAG | AGG | chr14 | 94389120 | 94389139 | 94389123 | - |
| SEQ ID NO 48931 | TTCCATCGGGACCATCAAGA | GGG | chr14 | 94389119 | 94389138 | 94389122 | - |
| SEQ ID NO 48932 | TCAAGAGGGTGTTTGTGTCT | AAG | chr14 | 94389105 | 94389124 | 94389108 | - |
| SEQ ID NO 48933 | CAAGAGGGTGTTTGTGTCTA | AGG | chr14 | 94389104 | 94389123 | 94389107 | - |
| SEQ ID NO 48934 | TGTTTGTGTCTAAGGCTGAC | TGG | chr14 | 94389096 | 94389115 | 94389099 | - |
| SEQ ID NO 48935 | GTTTGTGTCTAAGGCTGACT | GGG | chr14 | 94389095 | 94389114 | 94389098 | - |
| SEQ ID NO 48936 | TAAGGCTGACTGGGTAACTT | TGG | chr14 | 94389086 | 94389105 | 94389089 | - |
| SEQ ID NO 48937 | CTGACTGGGTAACTTTGGAT | GAG | chr14 | 94389081 | 94389100 | 94389084 | - |
| SEQ ID NO 48938 | ACTGGGTAACTTTGGATGAG | CGG | chr14 | 94389078 | 94389097 | 94389081 | - |
| SEQ ID NO 48939 | ATGAGCGGTCTCTCCGCTCT | GAG | chr14 | 94389063 | 94389082 | 94389066 | - |
| SEQ ID NO 48940 | CTGTTTCCTCATCTGTCAAA | TGG | chr14 | 94389039 | 94389058 | 94389042 | - |
| SEQ ID NO 48941 | TGTTTCCTCATCTGTCAAAT | GGG | chr14 | 94389038 | 94389057 | 94389041 | - |
| SEQ ID NO 48942 | TCTAACCCACTCTGATCTCC | CAG | chr14 | 94389014 | 94389033 | 94389017 | - |
| SEQ ID NO 48943 | CTAACCCACTCTGATCTCCC | AGG | chr14 | 94389013 | 94389032 | 94389016 | - |
| SEQ ID NO 48944 | TAACCCACTCTGATCTCCCA | GGG | chr14 | 94389012 | 94389031 | 94389015 | - |
| SEQ ID NO 48945 | CCCACTCTGATCTCCCAGGG | CGG | chr14 | 94389009 | 94389028 | 94389012 | - |
| SEQ ID NO 48946 | ACTCTGATCTCCCAGGGCGG | CAG | chr14 | 94389006 | 94389025 | 94389009 | - |
| SEQ ID NO 48947 | TGATCTCCCAGGGCGGCAGT | AAG | chr14 | 94389002 | 94389021 | 94389005 | - |
| SEQ ID NO 48948 | CCAGGGCGGCAGTAAGTCTT | CAG | chr14 | 94388995 | 94389014 | 94388998 | - |
| SEQ ID NO 48949 | CGGCAGTAAGTCTTCAGCAT | CAG | chr14 | 94388989 | 94389008 | 94388992 | - |
| SEQ ID NO 48950 | GGCAGTAAGTCTTCAGCATC | AGG | chr14 | 94388988 | 94389007 | 94388991 | - |
| SEQ ID NO 48951 | GTCTTCAGCATCAGGCATTT | TGG | chr14 | 94388980 | 94388999 | 94388983 | - |
| SEQ ID NO 48952 | TCTTCAGCATCAGGCATTTT | GGG | chr14 | 94388979 | 94388998 | 94388982 | - |

Figure 67 (Cont'd)

| SEQ ID NO 48953 | CTTCAGCATCAGGCATTTTG | GGG | chr14 | 94388978 | 94388997 | 94388981 | - |
| SEQ ID NO 48954 | TCAGGCATTTTGGGGTGACT | CAG | chr14 | 94388970 | 94388989 | 94388973 | - |
| SEQ ID NO 48955 | TTTTGGGGTGACTCAGTAAA | TGG | chr14 | 94388963 | 94388982 | 94388966 | - |
| SEQ ID NO 48956 | TGGGGTGACTCAGTAAATGG | TAG | chr14 | 94388960 | 94388979 | 94388963 | - |
| SEQ ID NO 48957 | TAAATGGTAGATCTTGCTAC | CAG | chr14 | 94388947 | 94388966 | 94388950 | - |
| SEQ ID NO 48958 | ATGGTAGATCTTGCTACCAG | TGG | chr14 | 94388944 | 94388963 | 94388947 | - |
| SEQ ID NO 48959 | AGATCTTGCTACCAGTGGAA | CAG | chr14 | 94388939 | 94388958 | 94388942 | - |
| SEQ ID NO 48960 | CTACCAGTGGAACAGCCACT | AAG | chr14 | 94388931 | 94388950 | 94388934 | - |
| SEQ ID NO 48961 | TACCAGTGGAACAGCCACTA | AGG | chr14 | 94388930 | 94388949 | 94388933 | - |
| SEQ ID NO 48962 | AACAGCCACTAAGGATTCTG | CAG | chr14 | 94388921 | 94388940 | 94388924 | - |
| SEQ ID NO 48963 | GCCACTAAGGATTCTGCAGT | GAG | chr14 | 94388917 | 94388936 | 94388920 | - |
| SEQ ID NO 48964 | CACTAAGGATTCTGCAGTGA | GAG | chr14 | 94388915 | 94388934 | 94388918 | - |
| SEQ ID NO 48965 | TAAGGATTCTGCAGTGAGAG | CAG | chr14 | 94388912 | 94388931 | 94388915 | - |
| SEQ ID NO 48966 | AGGATTCTGCAGTGAGAGCA | GAG | chr14 | 94388910 | 94388929 | 94388913 | - |
| SEQ ID NO 48967 | GGATTCTGCAGTGAGAGCAG | AGG | chr14 | 94388909 | 94388928 | 94388912 | - |
| SEQ ID NO 48968 | GATTCTGCAGTGAGAGCAGA | GGG | chr14 | 94388908 | 94388927 | 94388911 | - |
| SEQ ID NO 48969 | CTGCAGTGAGAGCAGAGGGC | CAG | chr14 | 94388904 | 94388923 | 94388907 | - |
| SEQ ID NO 48970 | GTGAGAGCAGAGGGCCAGCT | AAG | chr14 | 94388899 | 94388918 | 94388902 | - |
| SEQ ID NO 48971 | AGAGCAGAGGGCCAGCTAAG | TGG | chr14 | 94388896 | 94388915 | 94388899 | - |
| SEQ ID NO 48972 | CCAGCTAAGTGGTACTCTCC | CAG | chr14 | 94388885 | 94388904 | 94388888 | - |
| SEQ ID NO 48973 | AGCTAAGTGGTACTCTCCCA | GAG | chr14 | 94388883 | 94388902 | 94388886 | - |
| SEQ ID NO 48974 | TCACGCCACCCCTCCACCT | TGG | chr14 | 94388850 | 94388869 | 94388853 | - |
| SEQ ID NO 48975 | CACCCCTCCACCTTGGACA | CAG | chr14 | 94388844 | 94388863 | 94388847 | - |
| SEQ ID NO 48976 | ACCCCCTCCACCTTGGACAC | AGG | chr14 | 94388843 | 94388862 | 94388846 | - |
| SEQ ID NO 48977 | ACCTTGGACACAGGACGCTG | TGG | chr14 | 94388834 | 94388853 | 94388837 | - |
| SEQ ID NO 48978 | CACAGGACGCTGTGGTTTCT | GAG | chr14 | 94388826 | 94388845 | 94388829 | - |
| SEQ ID NO 48979 | GGACGCTGTGGTTTCTGAGC | CAG | chr14 | 94388822 | 94388841 | 94388825 | - |
| SEQ ID NO 48980 | GACGCTGTGGTTTCTGAGCC | AGG | chr14 | 94388821 | 94388840 | 94388824 | - |
| SEQ ID NO 48981 | CCAGGTACAATGACTCCTTT | CGG | chr14 | 94388803 | 94388822 | 94388806 | - |
| SEQ ID NO 48982 | GTACAATGACTCCTTTCGGT | AAG | chr14 | 94388799 | 94388818 | 94388802 | - |
| SEQ ID NO 48983 | ATGACTCCTTTCGGTAAGTG | CAG | chr14 | 94388794 | 94388813 | 94388797 | - |
| SEQ ID NO 48984 | ACTCCTTTCGGTAAGTGCAG | TGG | chr14 | 94388791 | 94388810 | 94388794 | - |
| SEQ ID NO 48985 | CCTTTCGGTAAGTGCAGTGG | AAG | chr14 | 94388788 | 94388807 | 94388791 | - |
| SEQ ID NO 48986 | AGTGGAAGCTGTACACTGCC | CAG | chr14 | 94388773 | 94388792 | 94388776 | - |
| SEQ ID NO 48987 | GTGGAAGCTGTACACTGCCC | AGG | chr14 | 94388772 | 94388791 | 94388775 | - |
| SEQ ID NO 48988 | AGCTGTACACTGCCCAGGCA | AAG | chr14 | 94388767 | 94388786 | 94388770 | - |
| SEQ ID NO 48989 | CACTGCCCAGGCAAAGCGTC | CGG | chr14 | 94388760 | 94388779 | 94388763 | - |
| SEQ ID NO 48990 | ACTGCCCAGGCAAAGCGTCC | GGG | chr14 | 94388759 | 94388778 | 94388762 | - |
| SEQ ID NO 48991 | GCCCAGGCAAAGCGTCCGGG | CAG | chr14 | 94388756 | 94388775 | 94388759 | - |
| SEQ ID NO 48992 | GGCAAAGCGTCCGGGCAGCG | TAG | chr14 | 94388751 | 94388770 | 94388754 | - |
| SEQ ID NO 48993 | GCAAAGCGTCCGGGCAGCGT | AGG | chr14 | 94388750 | 94388769 | 94388753 | - |
| SEQ ID NO 48994 | AAGCGTCCGGGCAGCGTAGG | CGG | chr14 | 94388747 | 94388766 | 94388750 | - |
| SEQ ID NO 48995 | AGCGTCCGGGCAGCGTAGGC | GGG | chr14 | 94388746 | 94388765 | 94388749 | - |
| SEQ ID NO 48996 | GGCAGCGTAGGCGGGCGACT | CAG | chr14 | 94388738 | 94388757 | 94388741 | - |
| SEQ ID NO 48997 | TAGGCGGGCGACTCAGATCC | CAG | chr14 | 94388731 | 94388750 | 94388734 | - |
| SEQ ID NO 48998 | CGGGCGACTCAGATCCCAGC | CAG | chr14 | 94388727 | 94388746 | 94388730 | - |
| SEQ ID NO 48999 | GCGACTCAGATCCCAGCCAG | TGG | chr14 | 94388724 | 94388743 | 94388727 | - |
| SEQ ID NO 49000 | CAGATCCCAGCCAGTGGACT | TAG | chr14 | 94388718 | 94388737 | 94388721 | - |

Figure 67 (Cont'd)

| SEQ ID NO 49001 | CTGTTTGCTCCTCCGATAAC | TGG | chr14 | 94388692 | 94388711 | 94388695 | - |
| SEQ ID NO 49002 | TGTTTGCTCCTCCGATAACT | GGG | chr14 | 94388691 | 94388710 | 94388694 | - |
| SEQ ID NO 49003 | GTTTGCTCCTCCGATAACTG | GGG | chr14 | 94388690 | 94388709 | 94388693 | - |
| SEQ ID NO 49004 | TCCGATAACTGGGGTGACCT | TGG | chr14 | 94388681 | 94388700 | 94388684 | - |
| SEQ ID NO 49005 | TGACCTTGGTTAATATTCAC | CAG | chr14 | 94388667 | 94388686 | 94388670 | - |
| SEQ ID NO 49006 | CCTTGGTTAATATTCACCAG | CAG | chr14 | 94388664 | 94388683 | 94388667 | - |
| SEQ ID NO 49007 | AGCCTCCCCGTTGCCCCTC | TGG | chr14 | 94388643 | 94388662 | 94388646 | - |
| SEQ ID NO 49008 | CTGGATCCACTGCTTAAATA | CGG | chr14 | 94388624 | 94388643 | 94388627 | - |
| SEQ ID NO 49009 | TCCACTGCTTAAATACGGAC | GAG | chr14 | 94388619 | 94388638 | 94388622 | - |
| SEQ ID NO 49010 | CCACTGCTTAAATACGGACG | AGG | chr14 | 94388618 | 94388637 | 94388621 | - |
| SEQ ID NO 49011 | TGCTTAAATACGGACGAGGA | CAG | chr14 | 94388614 | 94388633 | 94388617 | - |
| SEQ ID NO 49012 | GCTTAAATACGGACGAGGAC | AGG | chr14 | 94388613 | 94388632 | 94388616 | - |
| SEQ ID NO 49013 | CTTAAATACGGACGAGGACA | GGG | chr14 | 94388612 | 94388631 | 94388615 | - |
| SEQ ID NO 49014 | AGGACAGGGCCCTGTCTCCT | CAG | chr14 | 94388598 | 94388617 | 94388601 | - |
| SEQ ID NO 49015 | GGGCCCTGTCTCCTCAGCTT | CAG | chr14 | 94388592 | 94388611 | 94388595 | - |
| SEQ ID NO 49016 | GGCCCTGTCTCCTCAGCTTC | AGG | chr14 | 94388591 | 94388610 | 94388594 | - |
| SEQ ID NO 49017 | TTCAGGCACCACCACTGACC | TGG | chr14 | 94388574 | 94388593 | 94388577 | - |
| SEQ ID NO 49018 | TCAGGCACCACCACTGACCT | GGG | chr14 | 94388573 | 94388592 | 94388576 | - |
| SEQ ID NO 49019 | GCACCACCACTGACCTGGGA | CAG | chr14 | 94388569 | 94388588 | 94388572 | - |
| SEQ ID NO 49020 | GACCTGGGACAGTGAATCGT | AAG | chr14 | 94388558 | 94388577 | 94388561 | - |
| SEQ ID NO 49021 | GTAAGTATGCCTTTCACTGC | GAG | chr14 | 94388540 | 94388559 | 94388543 | - |
| SEQ ID NO 49022 | AAGTATGCCTTTCACTGCGA | GAG | chr14 | 94388538 | 94388557 | 94388541 | - |
| SEQ ID NO 49023 | AGTATGCCTTTCACTGCGAG | AGG | chr14 | 94388537 | 94388556 | 94388540 | - |
| SEQ ID NO 49024 | CCTTTCACTGCGAGAGGTTC | TGG | chr14 | 94388531 | 94388550 | 94388534 | - |
| SEQ ID NO 49025 | TTTCACTGCGAGAGGTTCTG | GAG | chr14 | 94388529 | 94388548 | 94388532 | - |
| SEQ ID NO 49026 | TCACTGCGAGAGGTTCTGGA | GAG | chr14 | 94388527 | 94388546 | 94388530 | - |
| SEQ ID NO 49027 | CACTGCGAGAGGTTCTGGAG | AGG | chr14 | 94388526 | 94388545 | 94388529 | - |
| SEQ ID NO 49028 | GAGGTTCTGGAGAGGCTTCT | GAG | chr14 | 94388518 | 94388537 | 94388521 | - |
| SEQ ID NO 49029 | AGAGGCTTCTGAGCTCCCCA | TGG | chr14 | 94388508 | 94388527 | 94388511 | - |
| SEQ ID NO 49030 | CTTCTGAGCTCCCCATGGCC | CAG | chr14 | 94388503 | 94388522 | 94388506 | - |
| SEQ ID NO 49031 | TTCTGAGCTCCCCATGGCCC | AGG | chr14 | 94388502 | 94388521 | 94388505 | - |
| SEQ ID NO 49032 | TGAGCTCCCCATGGCCCAGG | CAG | chr14 | 94388499 | 94388518 | 94388502 | - |
| SEQ ID NO 49033 | GAGCTCCCCATGGCCCAGGC | AGG | chr14 | 94388498 | 94388517 | 94388501 | - |
| SEQ ID NO 49034 | CTCCCCATGGCCCAGGCAGG | CAG | chr14 | 94388495 | 94388514 | 94388498 | - |
| SEQ ID NO 49035 | CCCATGGCCCAGGCAGGCAG | CAG | chr14 | 94388492 | 94388511 | 94388495 | - |
| SEQ ID NO 49036 | CCATGGCCCAGGCAGGCAGC | AGG | chr14 | 94388491 | 94388510 | 94388494 | - |
| SEQ ID NO 49037 | GCCCAGGCAGGCAGCAGGTC | TGG | chr14 | 94388486 | 94388505 | 94388489 | - |
| SEQ ID NO 49038 | CCCAGGCAGGCAGCAGGTCT | GGG | chr14 | 94388485 | 94388504 | 94388488 | - |
| SEQ ID NO 49039 | CCAGGCAGGCAGCAGGTCTG | GGG | chr14 | 94388484 | 94388503 | 94388487 | - |
| SEQ ID NO 49040 | GGCAGGCAGCAGGTCTGGGG | CAG | chr14 | 94388481 | 94388500 | 94388484 | - |
| SEQ ID NO 49041 | GCAGGCAGCAGGTCTGGGGC | AGG | chr14 | 94388480 | 94388499 | 94388483 | - |
| SEQ ID NO 49042 | AGGCAGCAGGTCTGGGGCAG | GAG | chr14 | 94388478 | 94388497 | 94388481 | - |
| SEQ ID NO 49043 | GGCAGCAGGTCTGGGGCAGG | AGG | chr14 | 94388477 | 94388496 | 94388480 | - |
| SEQ ID NO 49044 | GCAGCAGGTCTGGGGCAGGA | GGG | chr14 | 94388476 | 94388495 | 94388479 | - |
| SEQ ID NO 49045 | CAGCAGGTCTGGGGCAGGAG | GGG | chr14 | 94388475 | 94388494 | 94388478 | - |
| SEQ ID NO 49046 | AGCAGGTCTGGGGCAGGAGG | GGG | chr14 | 94388474 | 94388493 | 94388477 | - |
| SEQ ID NO 49047 | GCAGGTCTGGGGCAGGAGGG | GGG | chr14 | 94388473 | 94388492 | 94388476 | - |
| SEQ ID NO 49048 | CTGGGGCAGGAGGGGGGTTG | TGG | chr14 | 94388467 | 94388486 | 94388470 | - |

Figure 67 (Cont'd)

| | | | | | | | |
|---|---|---|---|---|---|---|---|
| SEQ ID NO 49049 | GGGGCAGGAGGGGGGTTGTG | GAG | chr14 | 94388465 | 94388484 | 94388468 | - |
| SEQ ID NO 49050 | GCAGGAGGGGGGTTGTGGAG | TGG | chr14 | 94388462 | 94388481 | 94388465 | - |
| SEQ ID NO 49051 | CAGGAGGGGGGTTGTGGAGT | GGG | chr14 | 94388461 | 94388480 | 94388464 | - |
| SEQ ID NO 49052 | GGAGTGGGTATCCGCCTGCT | GAG | chr14 | 94388446 | 94388465 | 94388449 | - |
| SEQ ID NO 49053 | GAGTGGGTATCCGCCTGCTG | AGG | chr14 | 94388445 | 94388464 | 94388448 | - |
| SEQ ID NO 49054 | GGTATCCGCCTGCTGAGGTG | CAG | chr14 | 94388440 | 94388459 | 94388443 | - |
| SEQ ID NO 49055 | GTATCCGCCTGCTGAGGTGC | AGG | chr14 | 94388439 | 94388458 | 94388442 | - |
| SEQ ID NO 49056 | TATCCGCCTGCTGAGGTGCA | GGG | chr14 | 94388438 | 94388457 | 94388441 | - |
| SEQ ID NO 49057 | CCGCCTGCTGAGGTGCAGGG | CAG | chr14 | 94388435 | 94388454 | 94388438 | - |
| SEQ ID NO 49058 | CTGCTGAGGTGCAGGGCAGA | TGG | chr14 | 94388431 | 94388450 | 94388434 | - |
| SEQ ID NO 49059 | GCTGAGGTGCAGGGCAGATG | GAG | chr14 | 94388429 | 94388448 | 94388432 | - |
| SEQ ID NO 49060 | TGAGGTGCAGGGCAGATGGA | GAG | chr14 | 94388427 | 94388446 | 94388430 | - |
| SEQ ID NO 49061 | GAGGTGCAGGGCAGATGGAG | AGG | chr14 | 94388426 | 94388445 | 94388429 | - |
| SEQ ID NO 49062 | CAGGGCAGATGGAGAGGCTG | CAG | chr14 | 94388420 | 94388439 | 94388423 | - |
| SEQ ID NO 49063 | CAGATGGAGAGGCTGCAGCT | GAG | chr14 | 94388415 | 94388434 | 94388418 | - |
| SEQ ID NO 49064 | AGCTCCTATTTTCATAATAA | CAG | chr14 | 94388394 | 94388413 | 94388397 | - |
| SEQ ID NO 49065 | TCCTATTTTCATAATAACAG | CAG | chr14 | 94388391 | 94388410 | 94388394 | - |
| SEQ ID NO 49066 | TTCATAATAACAGCAGCCAT | GAG | chr14 | 94388384 | 94388403 | 94388387 | - |
| SEQ ID NO 49067 | TCATAATAACAGCAGCCATG | AGG | chr14 | 94388383 | 94388402 | 94388386 | - |
| SEQ ID NO 49068 | CATAATAACAGCAGCCATGA | GGG | chr14 | 94388382 | 94388401 | 94388385 | - |
| SEQ ID NO 49069 | GAGGGTTGTGTCCTGTTTCC | CAG | chr14 | 94388364 | 94388383 | 94388367 | - |
| SEQ ID NO 49070 | TCCTGTTTCCCAGTCCTGCC | CGG | chr14 | 94388354 | 94388373 | 94388357 | - |
| SEQ ID NO 49071 | AGTCCTGCCCGGTCCCCCCT | CGG | chr14 | 94388343 | 94388362 | 94388346 | - |
| SEQ ID NO 49072 | GGTCCCCCCTCGGTACCTCC | TGG | chr14 | 94388333 | 94388352 | 94388336 | - |
| SEQ ID NO 49073 | CCCCCCTCGGTACCTCCTGG | TGG | chr14 | 94388330 | 94388349 | 94388333 | - |
| SEQ ID NO 49074 | GTACCTCCTGGTGGATACAC | TGG | chr14 | 94388321 | 94388340 | 94388324 | - |
| SEQ ID NO 49075 | GTGGATACACTGGTTCCTGT | AAG | chr14 | 94388311 | 94388330 | 94388314 | - |
| SEQ ID NO 49076 | GATACACTGGTTCCTGTAAG | CAG | chr14 | 94388308 | 94388327 | 94388311 | - |
| SEQ ID NO 49077 | ACACTGGTTCCTGTAAGCAG | AAG | chr14 | 94388305 | 94388324 | 94388308 | - |
| SEQ ID NO 49078 | CTGGTTCCTGTAAGCAGAAG | TGG | chr14 | 94388302 | 94388321 | 94388305 | - |
| SEQ ID NO 49079 | TCCTGTAAGCAGAAGTGGAT | GAG | chr14 | 94388297 | 94388316 | 94388300 | - |
| SEQ ID NO 49080 | CCTGTAAGCAGAAGTGGATG | AGG | chr14 | 94388296 | 94388315 | 94388299 | - |
| SEQ ID NO 49081 | CTGTAAGCAGAAGTGGATGA | GGG | chr14 | 94388295 | 94388314 | 94388298 | - |
| SEQ ID NO 49082 | CAGAAGTGGATGAGGGTGTC | TAG | chr14 | 94388288 | 94388307 | 94388291 | - |
| SEQ ID NO 49083 | AGAAGTGGATGAGGGTGTCT | AGG | chr14 | 94388287 | 94388306 | 94388290 | - |
| SEQ ID NO 49084 | GATGAGGGTGTCTAGGTCTG | CAG | chr14 | 94388280 | 94388299 | 94388283 | - |
| SEQ ID NO 49085 | GGTGTCTAGGTCTGCAGTCC | TGG | chr14 | 94388274 | 94388293 | 94388277 | - |
| SEQ ID NO 49086 | GGTCTGCAGTCCTGGCACCC | CAG | chr14 | 94388266 | 94388285 | 94388269 | - |
| SEQ ID NO 49087 | GTCTGCAGTCCTGGCACCCC | AGG | chr14 | 94388265 | 94388284 | 94388268 | - |
| SEQ ID NO 49088 | GCAGTCCTGGCACCCCAGGA | TGG | chr14 | 94388261 | 94388280 | 94388264 | - |
| SEQ ID NO 49089 | CAGTCCTGGCACCCCAGGAT | GGG | chr14 | 94388260 | 94388279 | 94388263 | - |
| SEQ ID NO 49090 | AGTCCTGGCACCCCAGGATG | GGG | chr14 | 94388259 | 94388278 | 94388262 | - |
| SEQ ID NO 49091 | GTCCTGGCACCCCAGGATGG | GGG | chr14 | 94388258 | 94388277 | 94388261 | - |
| SEQ ID NO 49092 | CACCCAGGATGGGGACAC | CAG | chr14 | 94388251 | 94388270 | 94388254 | - |
| SEQ ID NO 49093 | CAGGATGGGGACACCAGCC | AAG | chr14 | 94388246 | 94388265 | 94388249 | - |
| SEQ ID NO 49094 | GGGGGACACCAGCCAAGATA | CAG | chr14 | 94388240 | 94388259 | 94388243 | - |
| SEQ ID NO 49095 | CACCAGCCAAGATACAGCAA | CAG | chr14 | 94388234 | 94388253 | 94388237 | - |
| SEQ ID NO 49096 | AAGATACAGCAACAGCAACA | AAG | chr14 | 94388226 | 94388245 | 94388229 | - |

Figure 67 (Cont'd)

| SEQ ID NO 49097 | ACAGCAACAGCAACAAAGCG | CAG | chr14 | 94388221 | 94388240 | 94388224 | - |
| SEQ ID NO 49098 | GCCATTTCTTTCTGTTTGCA | CAG | chr14 | 94388199 | 94388218 | 94388202 | - |
| SEQ ID NO 49099 | TGCACAGCTCCTCTGTCTGT | CGG | chr14 | 94388183 | 94388202 | 94388186 | - |
| SEQ ID NO 49100 | GCACAGCTCCTCTGTCTGTC | GGG | chr14 | 94388182 | 94388201 | 94388185 | - |
| SEQ ID NO 49101 | CACAGCTCCTCTGTCTGTCG | GGG | chr14 | 94388181 | 94388200 | 94388184 | - |
| SEQ ID NO 49102 | ACAGCTCCTCTGTCTGTCGG | GGG | chr14 | 94388180 | 94388199 | 94388183 | - |
| SEQ ID NO 49103 | TCCTGTCTGTTGTCTCCTAT | AAG | chr14 | 94388156 | 94388175 | 94388159 | - |
| SEQ ID NO 49104 | TCACCACCTCTCCTACTGCT | TGG | chr14 | 94388131 | 94388150 | 94388134 | - |
| SEQ ID NO 49105 | CACCACCTCTCCTACTGCTT | GGG | chr14 | 94388130 | 94388149 | 94388133 | - |
| SEQ ID NO 49106 | TGCATCTTTCTCCCCTTCTA | TAG | chr14 | 94388105 | 94388124 | 94388108 | - |
| SEQ ID NO 49107 | CTTTCTCCCCTTCTATAGAT | GAG | chr14 | 94388100 | 94388119 | 94388103 | - |
| SEQ ID NO 49108 | TTTCTCCCCTTCTATAGATG | AGG | chr14 | 94388099 | 94388118 | 94388102 | - |
| SEQ ID NO 49109 | TCTCCCCTTCTATAGATGAG | GAG | chr14 | 94388097 | 94388116 | 94388100 | - |
| SEQ ID NO 49110 | CTCCCCTTCTATAGATGAGG | AGG | chr14 | 94388096 | 94388115 | 94388099 | - |
| SEQ ID NO 49111 | CTTCTATAGATGAGGAGGTT | AAG | chr14 | 94388091 | 94388110 | 94388094 | - |
| SEQ ID NO 49112 | TTCTATAGATGAGGAGGTTA | AGG | chr14 | 94388090 | 94388109 | 94388093 | - |
| SEQ ID NO 49113 | TAGATGAGGAGGTTAAGGTC | CAG | chr14 | 94388085 | 94388104 | 94388088 | - |
| SEQ ID NO 49114 | GATGAGGAGGTTAAGGTCCA | GAG | chr14 | 94388083 | 94388102 | 94388086 | - |
| SEQ ID NO 49115 | TGAGGAGGTTAAGGTCCAGA | GAG | chr14 | 94388081 | 94388100 | 94388084 | - |
| SEQ ID NO 49116 | GAGGAGGTTAAGGTCCAGAG | AGG | chr14 | 94388080 | 94388099 | 94388083 | - |
| SEQ ID NO 49117 | AGGAGGTTAAGGTCCAGAGA | GGG | chr14 | 94388079 | 94388098 | 94388082 | - |
| SEQ ID NO 49118 | GGAGGTTAAGGTCCAGAGAG | GGG | chr14 | 94388078 | 94388097 | 94388081 | - |
| SEQ ID NO 49119 | GGTTAAGGTCCAGAGAGGGG | TGG | chr14 | 94388075 | 94388094 | 94388078 | - |
| SEQ ID NO 49120 | GTTAAGGTCCAGAGAGGGGT | GGG | chr14 | 94388074 | 94388093 | 94388077 | - |
| SEQ ID NO 49121 | TTAAGGTCCAGAGAGGGGTG | GGG | chr14 | 94388073 | 94388092 | 94388076 | - |
| SEQ ID NO 49122 | AAGGTCCAGAGAGGGGTGGG | GAG | chr14 | 94388071 | 94388090 | 94388074 | - |
| SEQ ID NO 49123 | AGGTCCAGAGAGGGGTGGGG | AGG | chr14 | 94388070 | 94388089 | 94388073 | - |
| SEQ ID NO 49124 | AGAGGGGTGGGGAGGAACGC | CGG | chr14 | 94388062 | 94388081 | 94388065 | - |
| SEQ ID NO 49125 | CTCACATTCTCCATCCCCTC | CAG | chr14 | 94388039 | 94388058 | 94388042 | - |
| SEQ ID NO 49126 | CCATCCCCTCCAGATATGAC | CAG | chr14 | 94388029 | 94388048 | 94388032 | - |
| SEQ ID NO 49127 | CATCCCCTCCAGATATGACC | AGG | chr14 | 94388028 | 94388047 | 94388031 | - |
| SEQ ID NO 49128 | CCTCCAGATATGACCAGGAA | CAG | chr14 | 94388023 | 94388042 | 94388026 | - |
| SEQ ID NO 49129 | GACCAGGAACAGACCTGTGC | CAG | chr14 | 94388012 | 94388031 | 94388015 | - |
| SEQ ID NO 49130 | ACCAGGAACAGACCTGTGCC | AGG | chr14 | 94388011 | 94388030 | 94388014 | - |
| SEQ ID NO 49131 | AACAGACCTGTGCCAGGCCT | CAG | chr14 | 94388005 | 94388024 | 94388008 | - |

Figure 68

| # | Sequence | PAM | Chr | Start | End | Cuts 5' of | Str |
|---|---|---|---|---|---|---|---|
| SEQ ID NO 49132 | TGTTCCTGGTCATATCTGGA | GGGGAT | chr14 | 94388021 | 94388040 | 94388037 | + |
| SEQ ID NO 49133 | GGTCATATCTGGAGGGGATG | GAGAAT | chr14 | 94388028 | 94388047 | 94388044 | + |
| SEQ ID NO 49134 | TTGGCTGGTGTCCCCCATCC | TGGGGT | chr14 | 94388244 | 94388263 | 94388260 | + |
| SEQ ID NO 49135 | TCTGCCCTGCACCTCAGCAG | GCGGAT | chr14 | 94388431 | 94388450 | 94388447 | + |
| SEQ ID NO 49136 | TCCTCGTCCGTATTTAAGCA | GTGGAT | chr14 | 94388614 | 94388633 | 94388630 | + |
| SEQ ID NO 49137 | GGCAACGGGGGAGGCTGCTG | GTGAAT | chr14 | 94388647 | 94388666 | 94388663 | + |
| SEQ ID NO 49138 | CAGGGGCTAAGTCCACTGGC | TGGGAT | chr14 | 94388709 | 94388728 | 94388725 | + |
| SEQ ID NO 49139 | CTAAGTCCACTGGCTGGGAT | CTGAGT | chr14 | 94388715 | 94388734 | 94388731 | + |
| SEQ ID NO 49140 | CTTCCACTGCACTTACCGAA | AGGAGT | chr14 | 94388785 | 94388804 | 94388801 | + |
| SEQ ID NO 49141 | CGTCCTGTGTCCAAGGTGGA | GGGGGT | chr14 | 94388837 | 94388856 | 94388853 | + |
| SEQ ID NO 49142 | TCCAAGGTGGAGGGGGTGGC | GTGAGT | chr14 | 94388846 | 94388865 | 94388862 | + |
| SEQ ID NO 49143 | GTGAGTCAGACAGTCTCTGG | GAGAGT | chr14 | 94388866 | 94388885 | 94388882 | + |
| SEQ ID NO 49144 | CTGGCCCTCTGCTCTCACTG | CAGAAT | chr14 | 94388901 | 94388920 | 94388917 | + |
| SEQ ID NO 49145 | GTAGCAAGATCTACCATTTA | CTGAGT | chr14 | 94388947 | 94388966 | 94388963 | + |
| SEQ ID NO 49146 | TTACTGCCGCCCTGGGAGAT | CAGAGT | chr14 | 94389000 | 94389019 | 94389016 | + |
| SEQ ID NO 49147 | TGCCGCCCTGGGAGATCAGA | GTGGGT | chr14 | 94389004 | 94389023 | 94389020 | + |
| SEQ ID NO 49148 | TGGCATGGGGGCCGTGAGA | CAGGGT | chr14 | 94389176 | 94389195 | 94389192 | + |
| SEQ ID NO 49149 | ACTGTTTCACCTGCATCCCA | AAGAGT | chr14 | 94389276 | 94389295 | 94389292 | + |
| SEQ ID NO 49150 | AAGCATGCTTGTGAAGTGCC | TCGGGT | chr14 | 94389318 | 94389337 | 94389334 | + |
| SEQ ID NO 49151 | GCACACAGTAGGCTCTTTAT | GTGGGT | chr14 | 94389354 | 94389373 | 94389370 | + |
| SEQ ID NO 49152 | AGTGTGATCCGTATACAGCT | TGGAGT | chr14 | 94389484 | 94389503 | 94389500 | + |
| SEQ ID NO 49153 | GTATACAGCTTGGAGTTTCT | TTGGAT | chr14 | 94389494 | 94389513 | 94389510 | + |
| SEQ ID NO 49154 | TGGATACATGGCCCCCACTC | TGGGGT | chr14 | 94389515 | 94389534 | 94389531 | + |
| SEQ ID NO 49155 | GGAGGCCTTTGGAGACTGCT | GGGGGT | chr14 | 94389545 | 94389564 | 94389561 | + |
| SEQ ID NO 49156 | GGTGGAGGGGAGGGGAGGTA | CAGGGT | chr14 | 94389568 | 94389587 | 94389584 | + |
| SEQ ID NO 49157 | GTACGTGCCGTAGATACTTG | CAGAGT | chr14 | 94389692 | 94389711 | 94389708 | + |
| SEQ ID NO 49158 | GTGCCGTAGATACTTGCAGA | GTGAAT | chr14 | 94389696 | 94389715 | 94389712 | + |
| SEQ ID NO 49159 | CGTAGATACTTGCAGAGTGA | ATGGAT | chr14 | 94389700 | 94389719 | 94389716 | + |
| SEQ ID NO 49160 | GATACTTGCAGAGTGAATGG | ATGAGT | chr14 | 94389704 | 94389723 | 94389720 | + |
| SEQ ID NO 49161 | CCACCTTGGGGCTCTACCAG | GCGAGT | chr14 | 94389773 | 94389792 | 94389789 | + |
| SEQ ID NO 49162 | TCTACCAGGCGAGTGACCCA | CAGGAT | chr14 | 94389785 | 94389804 | 94389801 | + |
| SEQ ID NO 49163 | TACTGGCTGTGAGGCCTCAG | GTGAGT | chr14 | 94389846 | 94389865 | 94389862 | + |
| SEQ ID NO 49164 | AATTTCCCTATCTGTAAAAT | GGGGAT | chr14 | 94389893 | 94389912 | 94389909 | + |
| SEQ ID NO 49165 | GTACCTTGTTGAGCTGCTGT | GAGGAT | chr14 | 94389930 | 94389949 | 94389946 | + |
| SEQ ID NO 49166 | AGTTCAAGGAAAGCTCAGAG | ACGGGT | chr14 | 94389967 | 94389986 | 94389983 | + |
| SEQ ID NO 49167 | GGAAAGCTCAGAGACGGGTA | CTGGGT | chr14 | 94389974 | 94389993 | 94389990 | + |
| SEQ ID NO 49168 | GTGTCAGGGCTGGTGTCAC | TGGGGT | chr14 | 94390040 | 94390059 | 94390056 | + |
| SEQ ID NO 49169 | AGGGGCTGGTGTCACTGGGG | TGGGGT | chr14 | 94390045 | 94390064 | 94390061 | + |
| SEQ ID NO 49170 | TCATTCAGTTACCCTGTGAA | GGGAGT | chr14 | 94390107 | 94390126 | 94390123 | + |
| SEQ ID NO 49171 | CTGTCCTTCCCCTGAGCTGG | CTGAAT | chr14 | 94390236 | 94390255 | 94390252 | + |
| SEQ ID NO 49172 | CCTTCCCCTGAGCTGGCTGA | ATGGAT | chr14 | 94390240 | 94390259 | 94390256 | + |
| SEQ ID NO 49173 | TGTCCCTCCCACCTGTGGAA | CTGAGT | chr14 | 94390408 | 94390427 | 94390424 | + |
| SEQ ID NO 49174 | GTCTCTTCTGGCAGGCACAG | GAGAGT | chr14 | 94390491 | 94390510 | 94390507 | + |
| SEQ ID NO 49175 | AGGTTGCCGCCCTCCAACC | TGGAAT | chr14 | 94390535 | 94390554 | 94390551 | + |
| SEQ ID NO 49176 | TTGGTTCAGCTCAGGACTCT | GAGGGT | chr14 | 94390616 | 94390635 | 94390632 | + |
| SEQ ID NO 49177 | GCCCACCCAGGAAGTAGACT | TCGGGT | chr14 | 94390688 | 94390707 | 94390704 | + |
| SEQ ID NO 49178 | GGACAAGTCACCCTCTCCCT | TTGAGT | chr14 | 94390858 | 94390877 | 94390874 | + |
| SEQ ID NO 49179 | AGGTACAGTCACACTGCCCA | GAGGAT | chr14 | 94390893 | 94390912 | 94390909 | + |

Figure 68 (Cont'd)

| SEQ ID NO | Sequence | | | | | | |
|---|---|---|---|---|---|---|---|
| SEQ ID NO 49180 | CTTGCGGCAACTCAAAGGGA | GAGGGT | chr14 | 94390873 | 94390892 | 94390876 | - |
| SEQ ID NO 49181 | AAGGGAGAGGGTGACTTGTC | CCGGGT | chr14 | 94390859 | 94390878 | 94390862 | - |
| SEQ ID NO 49182 | CAGGTGACATGCCGGGCTGT | CTGAGT | chr14 | 94390808 | 94390827 | 94390811 | - |
| SEQ ID NO 49183 | CTCCACCCGAAGTCTACTTC | CTGGGT | chr14 | 94390698 | 94390717 | 94390701 | - |
| SEQ ID NO 49184 | TGCCTCCACGCAGCAACCCT | CAGAGT | chr14 | 94390637 | 94390656 | 94390640 | - |
| SEQ ID NO 49185 | AGCTGAACCAAGAAGGAGGA | GGGGGT | chr14 | 94390607 | 94390626 | 94390610 | - |
| SEQ ID NO 49186 | GCCTAGCCGCTGCTGCTGCC | AGGAAT | chr14 | 94390565 | 94390584 | 94390568 | - |
| SEQ ID NO 49187 | GTGGGAGGGACAGCAGGGCT | TAGAGT | chr14 | 94390400 | 94390419 | 94390403 | - |
| SEQ ID NO 49188 | GGGACAGCAGGGCTTAGAGT | GGGGGT | chr14 | 94390394 | 94390413 | 94390397 | - |
| SEQ ID NO 49189 | CACAGCCCAGTGCTGGAGCT | GTGAGT | chr14 | 94390291 | 94390310 | 94390294 | - |
| SEQ ID NO 49190 | GCCCAGTGCTGGAGCTGTGA | GTGGAT | chr14 | 94390287 | 94390306 | 94390290 | - |
| SEQ ID NO 49191 | TGTGAGTGGATGTAGAGCAG | CGGAAT | chr14 | 94390272 | 94390291 | 94390275 | - |
| SEQ ID NO 49192 | GGACAGGGGCCCTGAAGCCA | GGGGAT | chr14 | 94390222 | 94390241 | 94390225 | - |
| SEQ ID NO 49193 | GAGCTCAGAGAGAAGGGGAG | GGGAGT | chr14 | 94390180 | 94390199 | 94390183 | - |
| SEQ ID NO 49194 | AGTTTCCCGCTGCCTGAAAG | GAGGGT | chr14 | 94390146 | 94390165 | 94390149 | - |
| SEQ ID NO 49195 | GGTGGTACCTACTCCCTTCA | CAGGGT | chr14 | 94390123 | 94390142 | 94390126 | - |
| SEQ ID NO 49196 | CTACTCCCTTCACAGGGTAA | CTGAAT | chr14 | 94390115 | 94390134 | 94390118 | - |
| SEQ ID NO 49197 | TGAGGCCTCACAGCCAGTAA | GTGGGT | chr14 | 94389845 | 94389864 | 94389848 | - |
| SEQ ID NO 49198 | CAGTAAGTGGGTTCCCTGGT | CTGAAT | chr14 | 94389831 | 94389850 | 94389834 | - |
| SEQ ID NO 49199 | TGGTCTGAATGTGTGTGCTG | GAGGAT | chr14 | 94389815 | 94389834 | 94389818 | - |
| SEQ ID NO 49200 | TGTGTGTGCTGGAGGATCCT | GTGGGT | chr14 | 94389806 | 94389825 | 94389809 | - |
| SEQ ID NO 49201 | TGGAGGCATAAATGGGACTG | GTGAAT | chr14 | 94389756 | 94389775 | 94389759 | - |
| SEQ ID NO 49202 | GCCAGCTCCCAAGCAGGTTT | GCGGGT | chr14 | 94389672 | 94389691 | 94389675 | - |
| SEQ ID NO 49203 | AATCTGATTTAGGCTTTTAA | AGGGAT | chr14 | 94389629 | 94389648 | 94389632 | - |
| SEQ ID NO 49204 | CCAAAGGCCTCCAACAACCC | CAGAGT | chr14 | 94389537 | 94389556 | 94389540 | - |
| SEQ ID NO 49205 | AAAGAAACTCCAAGCTGTAT | ACGGAT | chr14 | 94389496 | 94389515 | 94389499 | - |
| SEQ ID NO 49206 | GGCACTTCACAAGCATGCTT | GGGAAT | chr14 | 94389318 | 94389337 | 94389321 | - |
| SEQ ID NO 49207 | GAATGAAACTTCCAACTCTT | TGGAT | chr14 | 94389296 | 94389315 | 94389299 | - |
| SEQ ID NO 49208 | TTTTCCATCGGGACCATCAA | GAGGGT | chr14 | 94389121 | 94389140 | 94389124 | - |
| SEQ ID NO 49209 | GTGTTTGTGTCTAAGGCTGA | CTGGGT | chr14 | 94389097 | 94389116 | 94389100 | - |
| SEQ ID NO 49210 | CTAAGGCTGACTGGGTAACT | TTGGAT | chr14 | 94389087 | 94389106 | 94389090 | - |
| SEQ ID NO 49211 | GTCTTCAGCATCAGGCATTT | TGGGGT | chr14 | 94388980 | 94388999 | 94388983 | - |
| SEQ ID NO 49212 | CTACCAGTGGAACAGCCACT | AAGGAT | chr14 | 94388931 | 94388950 | 94388934 | - |
| SEQ ID NO 49213 | CTGTTTGCTCCTCCGATAAC | TGGGT | chr14 | 94388692 | 94388711 | 94388695 | - |
| SEQ ID NO 49214 | CAGCCTCCCCGTTGCCCCT | CTGGAT | chr14 | 94388644 | 94388663 | 94388647 | - |
| SEQ ID NO 49215 | ACCACCACTGACCTGGGACA | GTGAAT | chr14 | 94388567 | 94388586 | 94388570 | - |
| SEQ ID NO 49216 | CAGCAGGTCTGGGGCAGGAG | GGGGGT | chr14 | 94388475 | 94388494 | 94388478 | - |
| SEQ ID NO 49217 | CTGGGGCAGGAGGGGGTTG | TGGAGT | chr14 | 94388467 | 94388486 | 94388470 | - |
| SEQ ID NO 49218 | GGCAGGAGGGGGTTGTGGA | GTGGGT | chr14 | 94388463 | 94388482 | 94388466 | - |
| SEQ ID NO 49219 | TTCATAATAACAGCAGCCAT | GAGGGT | chr14 | 94388384 | 94388403 | 94388387 | - |
| SEQ ID NO 49220 | TCCCCCCTCGGTACCTCCTG | GTGGAT | chr14 | 94388331 | 94388350 | 94388334 | - |
| SEQ ID NO 49221 | ACTGGTTCCTGTAAGCAGAA | GTGGAT | chr14 | 94388303 | 94388322 | 94388306 | - |
| SEQ ID NO 49222 | TCCTGTAAGCAGAAGTGGAT | GAGGGT | chr14 | 94388297 | 94388316 | 94388300 | - |
| SEQ ID NO 49223 | GGTCTGCAGTCCTGGCACCC | CAGGAT | chr14 | 94388266 | 94388285 | 94388269 | - |
| SEQ ID NO 49224 | GAGGAGGTTAAGGTCCAGAG | AGGGGT | chr14 | 94388080 | 94388099 | 94388083 | - |

Figure 69

| # | Sequence | PAM | Chr | Start | End | Cuts 5' of | Str |
|---|---|---|---|---|---|---|---|
| SEQ ID NO 49225 | TGGTCATATCTGGAGGGGAT | GGAGAAT | chr14 | 94388027 | 94388046 | 94388043 | + |
| SEQ ID NO 49226 | ACCTCCTCATCTATAGAAGG | GGAGAAA | chr14 | 94388092 | 94388111 | 94388108 | + |
| SEQ ID NO 49227 | CAGACAGAGGAGCTGTGCAA | ACAGAAA | chr14 | 94388184 | 94388203 | 94388200 | + |
| SEQ ID NO 49228 | CAGAGGAGCTGTGCAAACAG | AAAGAAA | chr14 | 94388188 | 94388207 | 94388204 | + |
| SEQ ID NO 49229 | AAGGAGTCATTGTACCTGGC | TCAGAAA | chr14 | 94388804 | 94388823 | 94388820 | + |
| SEQ ID NO 49230 | GCTGGCCCTCTGCTCTCACT | GCAGAAT | chr14 | 94388900 | 94388919 | 94388916 | + |
| SEQ ID NO 49231 | GAGACGGGTACTGGGTGTGC | CCAGAAA | chr14 | 94389984 | 94390003 | 94390000 | + |
| SEQ ID NO 49232 | TCACACTGCCCAGAGGATTA | CTAGAAA | chr14 | 94390901 | 94390920 | 94390917 | + |
| SEQ ID NO 49233 | TCTTCCCTCTGCAGCTGGCC | CCAGAAA | chr14 | 94390984 | 94391003 | 94390987 | - |
| SEQ ID NO 49234 | AAACAAAGGCCCAGAGAGGG | GAAGAAA | chr14 | 94390352 | 94390371 | 94390355 | - |
| SEQ ID NO 49235 | AGAGTGGGGCCATGTATCC | AAAGAAA | chr14 | 94389516 | 94389535 | 94389519 | - |
| SEQ ID NO 49236 | CTGGTTTTCCAGGAGCAAAA | ACAGAAA | chr14 | 94389466 | 94389485 | 94389469 | - |

Figure 70

| # | Sequence | PAM | Chr | Start | End | Cuts 5' of | Str |
|---|---|---|---|---|---|---|---|
| SEQ ID NO 49237 | TGTTTCTGTTTTTGCTCCTG | GAAAAC | chr14 | 94389457 | 94389476 | 94389473 | + |
| SEQ ID NO 49238 | GGGGGTCATTGTGCAGATGG | GAAAAC | chr14 | 94390374 | 94390393 | 94390377 | - |
| SEQ ID NO 49239 | CACACTGGTTTTCCAGGAGC | AAAAAC | chr14 | 94389470 | 94389489 | 94389473 | - |

Figure 71

| # | Sequence | PAM | Chr | Start | End | Cuts 5' of | Str |
|---|---|---|---|---|---|---|---|
| SEQ ID NO 49240 | CCAAGCAGTAGGAGAGGTGG | TGAGGCTT | chr14 | 94388128 | 94388147 | 94388144 | + |
| SEQ ID NO 49241 | GTGCAAACAGAAAGAAATGG | CTGCGCTT | chr14 | 94388198 | 94388217 | 94388214 | + |
| SEQ ID NO 49242 | ACCTAGACACCCTCATCCAC | TTCTGCTT | chr14 | 94388283 | 94388302 | 94388299 | + |
| SEQ ID NO 49243 | TCTCGCAGTGAAAGGCATAC | TTACGATT | chr14 | 94388536 | 94388555 | 94388552 | + |
| SEQ ID NO 49244 | GTCGCCCGCCTACGCTGCCC | GGACGCTT | chr14 | 94388739 | 94388758 | 94388755 | + |
| SEQ ID NO 49245 | GACGCTTTGCCTGGGCAGTG | TACAGCTT | chr14 | 94388760 | 94388779 | 94388776 | + |
| SEQ ID NO 49246 | GAGCTGTGCTGCCTCAGGCA | GGCCGCTT | chr14 | 94389230 | 94389249 | 94389246 | + |
| SEQ ID NO 49247 | CTTCACCTCTCTGAACCAGG | AACTGTTT | chr14 | 94389255 | 94389274 | 94389271 | + |
| SEQ ID NO 49248 | CACCTGCATCCCAAAGAGTT | GGAAGTTT | chr14 | 94389283 | 94389302 | 94389299 | + |
| SEQ ID NO 49249 | GTTGGAAGTTTCATTCCCAA | GCATGCTT | chr14 | 94389300 | 94389319 | 94389316 | + |
| SEQ ID NO 49250 | TTATGTGGGTCTGCACAGCC | CTCTGCTT | chr14 | 94389370 | 94389389 | 94389386 | + |
| SEQ ID NO 49251 | TCAATTTTGACCAGCCTCAG | GCCTGTTT | chr14 | 94389434 | 94389453 | 94389450 | + |
| SEQ ID NO 49252 | TTGACCAGCCTCAGGCCTGT | TTCTGTTT | chr14 | 94389440 | 94389459 | 94389456 | + |
| SEQ ID NO 49253 | GAAAACCAGTGTGATCCGTA | TACAGCTT | chr14 | 94389477 | 94389496 | 94389493 | + |
| SEQ ID NO 49254 | AGTGTGATCCGTATACAGCT | TGGAGTTT | chr14 | 94389484 | 94389503 | 94389500 | + |
| SEQ ID NO 49255 | GTTGAGGCTAGTGGGGCCCC | ACTTGATT | chr14 | 94389592 | 94389611 | 94389608 | + |
| SEQ ID NO 49256 | CAATCCCTTTAAAAGCCTAA | ATCAGATT | chr14 | 94389621 | 94389640 | 94389637 | + |
| SEQ ID NO 49257 | GCCCGCTGTGCAACCCGCAA | ACCTGCTT | chr14 | 94389654 | 94389673 | 94389670 | + |
| SEQ ID NO 49258 | TGGCTGTGAGGCCTCAGGTG | AGTTGTTT | chr14 | 94389849 | 94389868 | 94389865 | + |
| SEQ ID NO 49259 | TGTACCTTGTTGAGCTGCTG | TGAGGATT | chr14 | 94389929 | 94389948 | 94389945 | + |
| SEQ ID NO 49260 | GGTGGGGTGGGCCACACTTG | AAGAGCTT | chr14 | 94390063 | 94390082 | 94390079 | + |
| SEQ ID NO 49261 | CCTTCCCTGCAGCTCCATCC | CCTGGCTT | chr14 | 94390200 | 94390219 | 94390216 | + |
| SEQ ID NO 49262 | ATTTCTTCCCCTCTCTGGGC | CTTTGTTT | chr14 | 94390344 | 94390363 | 94390360 | + |
| SEQ ID NO 49263 | CAGTAGGCTGGGGAGGGGCG | GGGAGCTT | chr14 | 94390719 | 94390738 | 94390735 | + |
| SEQ ID NO 49264 | GAGGTACAGTCACACTGCCC | AGAGGATT | chr14 | 94390892 | 94390911 | 94390908 | + |
| SEQ ID NO 49265 | AGACCTGGCACCAATAACTG | GCAGGTTT | chr14 | 94390952 | 94390971 | 94390968 | + |
| SEQ ID NO 49266 | CAGGTGACATGCCGGGCTGT | CTGAGTTT | chr14 | 94390808 | 94390827 | 94390811 | - |
| SEQ ID NO 49267 | CCTGTGCCTGCCAGAAGAGA | CAGAGCTT | chr14 | 94390492 | 94390511 | 94390495 | - |
| SEQ ID NO 49268 | CAGAAGAGACAGAGCTTGAG | GAGAGCTT | chr14 | 94390481 | 94390500 | 94390484 | - |
| SEQ ID NO 49269 | TCCACAGGTGGGAGGGACAG | CAGGGCTT | chr14 | 94390407 | 94390426 | 94390410 | - |
| SEQ ID NO 49270 | GAAGGGGAGGGGAGTCTGAG | CTCAGTTT | chr14 | 94390169 | 94390188 | 94390172 | - |
| SEQ ID NO 49271 | GGAGGGAGGGCAGCATCAGG | AGGGCTT | chr14 | 94390017 | 94390036 | 94390020 | - |
| SEQ ID NO 49272 | GGCACACCCAGTACCCGTCT | CTGAGCTT | chr14 | 94389985 | 94390004 | 94389988 | - |
| SEQ ID NO 49273 | GCACGTACGCCAGCTCCAA | GCAGGTTT | chr14 | 94389680 | 94389699 | 94389683 | - |
| SEQ ID NO 49274 | GTTGCACAGCGGGCGATGCA | ATCTGATT | chr14 | 94389648 | 94389667 | 94389651 | - |
| SEQ ID NO 49275 | AGCGGGCGATGCAATCTGAT | TTAGGCTT | chr14 | 94389641 | 94389660 | 94389644 | - |
| SEQ ID NO 49276 | CAATCTGATTTAGGCTTTTA | AAGGGATT | chr14 | 94389630 | 94389649 | 94389633 | - |
| SEQ ID NO 49277 | CCAAGCTGTATACGGATCAC | ACTGGTTT | chr14 | 94389487 | 94389506 | 94389490 | - |
| SEQ ID NO 49278 | TCACCCGAGGCACTTCACAA | GCATGCTT | chr14 | 94389326 | 94389345 | 94389329 | - |
| SEQ ID NO 49279 | AGCACAGCTCTTCTTTACAG | ATGTGCTT | chr14 | 94389220 | 94389239 | 94389223 | - |
| SEQ ID NO 49280 | TTCCATCGGGACCATCAAGA | GGGTGTTT | chr14 | 94389119 | 94389138 | 94389122 | - |
| SEQ ID NO 49281 | GAGCGGTCTCTCCGCTCTGA | GCCTGTTT | chr14 | 94389061 | 94389080 | 94389064 | - |
| SEQ ID NO 49282 | GCTACCAGTGGAACAGCCAC | TAAGGATT | chr14 | 94388932 | 94388951 | 94388935 | - |
| SEQ ID NO 49283 | CCACCTTGGACACAGGACGC | TGTGGTTT | chr14 | 94388836 | 94388855 | 94388839 | - |
| SEQ ID NO 49284 | TCCCAGCCAGTGGACTTAGC | CCCTGTTT | chr14 | 94388714 | 94388733 | 94388717 | - |
| SEQ ID NO 49285 | CCCCGTTGCCCCTCTGGATC | CACTGCTT | chr14 | 94388637 | 94388656 | 94388640 | - |
| SEQ ID NO 49286 | CGAGGACAGGGCCCTGTCTC | CTCAGCTT | chr14 | 94388600 | 94388619 | 94388603 | - |
| SEQ ID NO 49287 | TTCACTGCGAGAGGTTCTGG | AGAGGCTT | chr14 | 94388528 | 94388547 | 94388531 | - |
| SEQ ID NO 49288 | CAGCAGCCATGAGGGTTGTG | TCCTGTTT | chr14 | 94388374 | 94388393 | 94388377 | - |
| SEQ ID NO 49289 | AACAAAGCGCAGCCATTTCT | TTCTGTTT | chr14 | 94388210 | 94388229 | 94388213 | - |

Figure 71 (Cont'd)

SEQ ID NO 49290  ATAAGCCTCACCACCTCTCC    TACTGCTT    chr14    94388138    94388157    94388141    -

Figure 72

| # | Sequence | PAM | Chr | Start | End | Cut site 1 (5' of) | Cut site 2 (5' of) | Str |
|---|---|---|---|---|---|---|---|---|
| SEQ ID NO 49291 | AGGCCTGGCACAGGTCTGTTCC | CTG | chr14 | 94388005 | 94388026 | 94388022 | 94388027 | + |
| SEQ ID NO 49292 | GCACAGGTCTGTTCCTGGTCAT | CTG | chr14 | 94388012 | 94388033 | 94388029 | 94388034 | + |
| SEQ ID NO 49293 | TTCCTGGTCATATCTGGAGGGG | CTG | chr14 | 94388023 | 94388044 | 94388040 | 94388045 | + |
| SEQ ID NO 49294 | CTGGTCATATCTGGAGGGGATG | TTC | chr14 | 94388026 | 94388047 | 94388043 | 94388048 | + |
| SEQ ID NO 49295 | GTCATATCTGGAGGGGATGGAG | CTG | chr14 | 94388029 | 94388050 | 94388046 | 94388051 | + |
| SEQ ID NO 49296 | GAGGGGATGGAGAATGTGAGCC | CTG | chr14 | 94388039 | 94388060 | 94388056 | 94388061 | + |
| SEQ ID NO 49297 | CTCCCCACCCCTCTCTGGACCT | TTC | chr14 | 94388068 | 94388089 | 94388085 | 94388090 | + |
| SEQ ID NO 49298 | CCCACCCCTCTCTGGACCTTAA | CTC | chr14 | 94388071 | 94388092 | 94388088 | 94388093 | + |
| SEQ ID NO 49299 | TCTGGACCTTAACCTCCTCATC | CTC | chr14 | 94388081 | 94388102 | 94388098 | 94388103 | + |
| SEQ ID NO 49300 | TGGACCTTAACCTCCTCATCTA | CTC | chr14 | 94388083 | 94388104 | 94388100 | 94388105 | + |
| SEQ ID NO 49301 | GACCTTAACCTCCTCATCTATA | CTG | chr14 | 94388085 | 94388106 | 94388102 | 94388107 | + |
| SEQ ID NO 49302 | AACCTCCTCATCTATAGAAGGG | CTT | chr14 | 94388091 | 94388112 | 94388108 | 94388113 | + |
| SEQ ID NO 49303 | ACCTCCTCATCTATAGAAGGGG | TTA | chr14 | 94388092 | 94388113 | 94388109 | 94388114 | + |
| SEQ ID NO 49304 | CTCATCTATAGAAGGGGAGAAA | CTC | chr14 | 94388097 | 94388118 | 94388114 | 94388119 | + |
| SEQ ID NO 49305 | ATCTATAGAAGGGGAGAAAGAT | CTC | chr14 | 94388100 | 94388121 | 94388117 | 94388122 | + |
| SEQ ID NO 49306 | TAGAAGGGGAGAAAGATGCATG | CTA | chr14 | 94388105 | 94388126 | 94388122 | 94388127 | + |
| SEQ ID NO 49307 | ATAGGAGACAACAGACAGGAGC | CTT | chr14 | 94388156 | 94388177 | 94388173 | 94388178 | + |
| SEQ ID NO 49308 | TAGGAGACAACAGACAGGAGCC | TTA | chr14 | 94388157 | 94388178 | 94388174 | 94388179 | + |
| SEQ ID NO 49309 | TGCAAACAGAAAGAAATGGCTG | CTG | chr14 | 94388199 | 94388220 | 94388216 | 94388221 | + |
| SEQ ID NO 49310 | CGCTTTGTTGCTGTTGCTGTAT | CTG | chr14 | 94388221 | 94388242 | 94388238 | 94388243 | + |
| SEQ ID NO 49311 | TGTTGCTGTTGCTGTATCTTGG | CTT | chr14 | 94388226 | 94388247 | 94388243 | 94388248 | + |
| SEQ ID NO 49312 | GTTGCTGTTGCTGTATCTTGGC | TTT | chr14 | 94388227 | 94388248 | 94388244 | 94388249 | + |
| SEQ ID NO 49313 | TTGCTGTTGCTGTATCTTGGCT | TTG | chr14 | 94388228 | 94388249 | 94388245 | 94388250 | + |
| SEQ ID NO 49314 | CTGTTGCTGTATCTTGGCTGGT | TTG | chr14 | 94388231 | 94388252 | 94388248 | 94388253 | + |
| SEQ ID NO 49315 | TTGCTGTATCTTGGCTGGTGTC | CTG | chr14 | 94388234 | 94388255 | 94388251 | 94388256 | + |
| SEQ ID NO 49316 | CTGTATCTTGGCTGGTGTCCCC | TTG | chr14 | 94388237 | 94388258 | 94388254 | 94388259 | + |
| SEQ ID NO 49317 | TATCTTGGCTGGTGTCCCCCAT | CTG | chr14 | 94388240 | 94388261 | 94388257 | 94388262 | + |
| SEQ ID NO 49318 | GGCTGGTGTCCCCCATCCTGGG | CTT | chr14 | 94388246 | 94388267 | 94388263 | 94388268 | + |
| SEQ ID NO 49319 | GCTGGTGTCCCCCATCCTGGGG | TTG | chr14 | 94388247 | 94388268 | 94388264 | 94388269 | + |
| SEQ ID NO 49320 | GTGTCCCCCATCCTGGGGTGCC | CTG | chr14 | 94388251 | 94388272 | 94388268 | 94388273 | + |
| SEQ ID NO 49321 | GGGTGCCAGGACTGCAGACCTA | CTG | chr14 | 94388266 | 94388287 | 94388283 | 94388288 | + |
| SEQ ID NO 49322 | CAGACCTAGACACCCTCATCCA | CTG | chr14 | 94388280 | 94388301 | 94388297 | 94388302 | + |
| SEQ ID NO 49323 | GACACCCTCATCCACTTCTGCT | CTA | chr14 | 94388288 | 94388309 | 94388305 | 94388310 | + |
| SEQ ID NO 49324 | ATCCACTTCTGCTTACAGGAAC | CTC | chr14 | 94388297 | 94388318 | 94388314 | 94388319 | + |
| SEQ ID NO 49325 | CTGCTTACAGGAACCAGTGTAT | CTT | chr14 | 94388305 | 94388326 | 94388322 | 94388327 | + |
| SEQ ID NO 49326 | TGCTTACAGGAACCAGTGTATC | TTC | chr14 | 94388306 | 94388327 | 94388323 | 94388328 | + |
| SEQ ID NO 49327 | CTTACAGGAACCAGTGTATCCA | CTG | chr14 | 94388308 | 94388329 | 94388325 | 94388330 | + |
| SEQ ID NO 49328 | ACAGGAACCAGTGTATCCACCA | CTT | chr14 | 94388311 | 94388332 | 94388328 | 94388333 | + |
| SEQ ID NO 49329 | CAGGAACCAGTGTATCCACCAG | TTA | chr14 | 94388312 | 94388333 | 94388329 | 94388334 | + |
| SEQ ID NO 49330 | GGAAACAGGACACAACCCTCAT | CTG | chr14 | 94388364 | 94388385 | 94388381 | 94388386 | + |
| SEQ ID NO 49331 | ATGGCTGCTGTTATTATGAAAA | CTC | chr14 | 94388384 | 94388405 | 94388401 | 94388406 | + |
| SEQ ID NO 49332 | CTGTTATTATGAAAATAGGAGC | CTG | chr14 | 94388391 | 94388412 | 94388408 | 94388413 | + |
| SEQ ID NO 49333 | TTATTATGAAAATAGGAGCTCA | CTG | chr14 | 94388394 | 94388415 | 94388411 | 94388416 | + |
| SEQ ID NO 49334 | TTATGAAAATAGGAGCTCAGCT | TTA | chr14 | 94388397 | 94388418 | 94388414 | 94388419 | + |
| SEQ ID NO 49335 | TGAAAATAGGAGCTCAGCTGCA | TTA | chr14 | 94388400 | 94388421 | 94388417 | 94388422 | + |
| SEQ ID NO 49336 | AGCTGCAGCCTCTCCATCTGCC | CTC | chr14 | 94388415 | 94388436 | 94388432 | 94388437 | + |
| SEQ ID NO 49337 | CAGCCTCTCCATCTGCCCTGCA | CTG | chr14 | 94388420 | 94388441 | 94388437 | 94388442 | + |
| SEQ ID NO 49338 | TCCATCTGCCCTGCACCTCAGC | CTC | chr14 | 94388427 | 94388448 | 94388444 | 94388449 | + |
| SEQ ID NO 49339 | CATCTGCCCTGCACCTCAGCAG | CTC | chr14 | 94388429 | 94388450 | 94388446 | 94388451 | + |
| SEQ ID NO 49340 | CCCTGCACCTCAGCAGGCGGAT | CTG | chr14 | 94388435 | 94388456 | 94388452 | 94388457 | + |
| SEQ ID NO 49341 | CACCTCAGCAGGCGGATACCCA | CTG | chr14 | 94388440 | 94388461 | 94388457 | 94388462 | + |
| SEQ ID NO 49342 | AGCAGGCGGATACCCACTCCAC | CTC | chr14 | 94388446 | 94388467 | 94388463 | 94388468 | + |
| SEQ ID NO 49343 | CACAACCCCCTCCTGCCCCAG | CTC | chr14 | 94388465 | 94388486 | 94388482 | 94388487 | + |
| SEQ ID NO 49344 | CTGCCCCAGACCTGCTGCCTGC | CTC | chr14 | 94388478 | 94388499 | 94388495 | 94388500 | + |
| SEQ ID NO 49345 | CCCCAGACCTGCTGCCTGCCTG | CTG | chr14 | 94388481 | 94388502 | 94388498 | 94388503 | + |
| SEQ ID NO 49346 | CTGCCTGCCTGGGCCATGGGGA | CTG | chr14 | 94388492 | 94388513 | 94388509 | 94388514 | + |
| SEQ ID NO 49347 | CCTGCCTGGGCCATGGGAGCT | CTG | chr14 | 94388495 | 94388516 | 94388512 | 94388517 | + |
| SEQ ID NO 49348 | CCTGGGCCATGGGGAGCTCAGA | CTG | chr14 | 94388499 | 94388520 | 94388516 | 94388521 | + |

Figure 72 (Cont'd)

| SEQ ID NO 49349 | GGCCATGGGGAGCTCAGAAGCC | CTG | chr14 | 94388503 | 94388524 | 94388520 | 94388525 | + |
| SEQ ID NO 49350 | AGAAGCCTCTCCAGAACCTCTC | CTC | chr14 | 94388518 | 94388539 | 94388535 | 94388540 | + |
| SEQ ID NO 49351 | TCCAGAACCTCTCGCAGTGAAA | CTC | chr14 | 94388527 | 94388548 | 94388544 | 94388549 | + |
| SEQ ID NO 49352 | CAGAACCTCTCGCAGTGAAAGG | CTC | chr14 | 94388529 | 94388550 | 94388546 | 94388551 | + |
| SEQ ID NO 49353 | TCGCAGTGAAAGGCATACTTAC | CTC | chr14 | 94388538 | 94388559 | 94388555 | 94388560 | + |
| SEQ ID NO 49354 | GCAGTGAAAGGCATACTTACGA | CTC | chr14 | 94388540 | 94388561 | 94388557 | 94388562 | + |
| SEQ ID NO 49355 | ACGATTCACTGTCCCAGGTCAG | CTT | chr14 | 94388558 | 94388579 | 94388575 | 94388580 | + |
| SEQ ID NO 49356 | CGATTCACTGTCCCAGGTCAGT | TTA | chr14 | 94388559 | 94388580 | 94388576 | 94388581 | + |
| SEQ ID NO 49357 | ACTGTCCCAGGTCAGTGGTGGT | TTC | chr14 | 94388565 | 94388586 | 94388582 | 94388587 | + |
| SEQ ID NO 49358 | TCCCAGGTCAGTGGTGGTGCCT | CTG | chr14 | 94388569 | 94388590 | 94388586 | 94388591 | + |
| SEQ ID NO 49359 | AAGCTGAGGAGACAGGGCCCTG | CTG | chr14 | 94388592 | 94388613 | 94388609 | 94388614 | + |
| SEQ ID NO 49360 | AGGAGACAGGGCCCTGTCCTCG | CTG | chr14 | 94388598 | 94388619 | 94388615 | 94388620 | + |
| SEQ ID NO 49361 | TCCTCGTCCGTATTTAAGCAGT | CTG | chr14 | 94388614 | 94388635 | 94388631 | 94388636 | + |
| SEQ ID NO 49362 | GTCCGTATTTAAGCAGTGGATC | CTC | chr14 | 94388619 | 94388640 | 94388636 | 94388641 | + |
| SEQ ID NO 49363 | AAGCAGTGGATCCAGAGGGGCA | TTT | chr14 | 94388629 | 94388650 | 94388646 | 94388651 | + |
| SEQ ID NO 49364 | AGCAGTGGATCCAGAGGGGCAA | TTA | chr14 | 94388630 | 94388651 | 94388647 | 94388652 | + |
| SEQ ID NO 49365 | CTGGTGAATATTAACCAAGGTC | CTG | chr14 | 94388664 | 94388685 | 94388681 | 94388686 | + |
| SEQ ID NO 49366 | GTGAATATTAACCAAGGTCACC | CTG | chr14 | 94388667 | 94388688 | 94388684 | 94388689 | + |
| SEQ ID NO 49367 | ACCAAGGTCACCCCAGTTATCG | TTA | chr14 | 94388677 | 94388698 | 94388694 | 94388699 | + |
| SEQ ID NO 49368 | TCGGAGGAGCAAACAGGGGCTA | TTA | chr14 | 94388696 | 94388717 | 94388713 | 94388718 | + |
| SEQ ID NO 49369 | AGTCCACTGGCTGGGATCTGAG | CTA | chr14 | 94388718 | 94388739 | 94388735 | 94388740 | + |
| SEQ ID NO 49370 | GCTGGGATCTGAGTCGCCCGCC | CTG | chr14 | 94388727 | 94388748 | 94388744 | 94388749 | + |
| SEQ ID NO 49371 | GGATCTGAGTCGCCCGCCTACG | CTG | chr14 | 94388731 | 94388752 | 94388748 | 94388753 | + |
| SEQ ID NO 49372 | AGTCGCCCGCCTACGCTGCCCG | CTG | chr14 | 94388738 | 94388759 | 94388755 | 94388760 | + |
| SEQ ID NO 49373 | CGCTGCCCGGACGCTTTGCCTG | CTA | chr14 | 94388751 | 94388772 | 94388768 | 94388773 | + |
| SEQ ID NO 49374 | CCCGGACGCTTTGCCTGGGCAG | CTG | chr14 | 94388756 | 94388777 | 94388773 | 94388778 | + |
| SEQ ID NO 49375 | TGCCTGGGCAGTGTACAGCTTC | CTT | chr14 | 94388767 | 94388788 | 94388784 | 94388789 | + |
| SEQ ID NO 49376 | GCCTGGGCAGTGTACAGCTTCC | TTT | chr14 | 94388768 | 94388789 | 94388785 | 94388790 | + |
| SEQ ID NO 49377 | CCTGGGCAGTGTACAGCTTCCA | TTG | chr14 | 94388769 | 94388790 | 94388786 | 94388791 | + |
| SEQ ID NO 49378 | GGCAGTGTACAGCTTCCACTGC | CTG | chr14 | 94388773 | 94388794 | 94388790 | 94388795 | + |
| SEQ ID NO 49379 | CCACTGCACTTACCGAAAGGAG | CTT | chr14 | 94388788 | 94388809 | 94388805 | 94388810 | + |
| SEQ ID NO 49380 | CACTGCACTTACCGAAAGGAGT | TTC | chr14 | 94388789 | 94388810 | 94388806 | 94388811 | + |
| SEQ ID NO 49381 | CACTTACCGAAAGGAGTCATTG | CTG | chr14 | 94388794 | 94388815 | 94388811 | 94388816 | + |
| SEQ ID NO 49382 | ACCGAAAGGAGTCATTGTACCT | CTT | chr14 | 94388799 | 94388820 | 94388816 | 94388821 | + |
| SEQ ID NO 49383 | CCGAAAGGAGTCATTGTACCTG | TTA | chr14 | 94388800 | 94388821 | 94388817 | 94388822 | + |
| SEQ ID NO 49384 | TACCTGGCTCAGAAACCACAGC | TTG | chr14 | 94388816 | 94388837 | 94388833 | 94388838 | + |
| SEQ ID NO 49385 | GCTCAGAAACCACAGCGTCCTG | CTG | chr14 | 94388822 | 94388843 | 94388839 | 94388844 | + |
| SEQ ID NO 49386 | AGAAACCACAGCGTCCTGTGTC | CTC | chr14 | 94388826 | 94388847 | 94388843 | 94388848 | + |
| SEQ ID NO 49387 | TGTCCAAGGTGGAGGGGGTGGC | CTG | chr14 | 94388844 | 94388865 | 94388861 | 94388866 | + |
| SEQ ID NO 49388 | TGGGAGAGTACCACTTAGCTGG | CTC | chr14 | 94388883 | 94388904 | 94388900 | 94388905 | + |
| SEQ ID NO 49389 | GGAGAGTACCACTTAGCTGGCC | CTG | chr14 | 94388885 | 94388906 | 94388902 | 94388907 | + |
| SEQ ID NO 49390 | AGCTGGCCCTCTGCTCTCACTG | CTT | chr14 | 94388899 | 94388920 | 94388916 | 94388921 | + |
| SEQ ID NO 49391 | GCTGGCCCTCTGCTCTCACTGC | TTA | chr14 | 94388900 | 94388921 | 94388917 | 94388922 | + |
| SEQ ID NO 49392 | GCCCTCTGCTCTCACTGCAGAA | CTG | chr14 | 94388904 | 94388925 | 94388921 | 94388926 | + |
| SEQ ID NO 49393 | TGCTCTCACTGCAGAATCCTTA | CTC | chr14 | 94388910 | 94388931 | 94388927 | 94388932 | + |
| SEQ ID NO 49394 | CTCTCACTGCAGAATCCTTAGT | CTG | chr14 | 94388912 | 94388933 | 94388929 | 94388934 | + |
| SEQ ID NO 49395 | TCACTGCAGAATCCTTAGTGGC | CTC | chr14 | 94388915 | 94388936 | 94388932 | 94388937 | + |
| SEQ ID NO 49396 | ACTGCAGAATCCTTAGTGGCTG | CTC | chr14 | 94388917 | 94388938 | 94388934 | 94388939 | + |
| SEQ ID NO 49397 | CAGAATCCTTAGTGGCTGTTCC | CTG | chr14 | 94388921 | 94388942 | 94388938 | 94388943 | + |
| SEQ ID NO 49398 | AGTGGCTGTTCCACTGGTAGCA | CTT | chr14 | 94388931 | 94388952 | 94388948 | 94388953 | + |
| SEQ ID NO 49399 | GTGGCTGTTCCACTGGTAGCAA | TTA | chr14 | 94388932 | 94388953 | 94388949 | 94388954 | + |
| SEQ ID NO 49400 | TTCCACTGGTAGCAAGATCTAC | CTG | chr14 | 94388939 | 94388960 | 94388956 | 94388961 | + |
| SEQ ID NO 49401 | CACTGGTAGCAAGATCTACCAT | TTC | chr14 | 94388942 | 94388963 | 94388959 | 94388964 | + |
| SEQ ID NO 49402 | GTAGCAAGATCTACCATTTACT | CTG | chr14 | 94388947 | 94388968 | 94388964 | 94388969 | + |
| SEQ ID NO 49403 | CCATTTACTGAGTCACCCCAAA | CTA | chr14 | 94388960 | 94388981 | 94388977 | 94388982 | + |
| SEQ ID NO 49404 | ACTGAGTCACCCCAAAATGCCT | TTT | chr14 | 94388966 | 94388987 | 94388983 | 94388988 | + |
| SEQ ID NO 49405 | CTGAGTCACCCCAAAATGCCTG | TTA | chr14 | 94388967 | 94388988 | 94388984 | 94388989 | + |
| SEQ ID NO 49406 | AGTCACCCCAAAATGCCTGATG | CTG | chr14 | 94388970 | 94388991 | 94388987 | 94388992 | + |
| SEQ ID NO 49407 | ATGCTGAAGACTTACTGCCGCC | CTG | chr14 | 94388989 | 94389010 | 94389006 | 94389011 | + |

Figure 72 (Cont'd)

| | | | | | | | |
|---|---|---|---|---|---|---|---|
| SEQ ID NO 49408 | AAGACTTACTGCCGCCCTGGGA | CTG | chr14 | 94388995 | 94389016 | 94389012 | 94389017 | + |
| SEQ ID NO 49409 | ACTGCCGCCCTGGGAGATCAGA | CTT | chr14 | 94389002 | 94389023 | 94389019 | 94389024 | + |
| SEQ ID NO 49410 | CTGCCGCCCTGGGAGATCAGAG | TTA | chr14 | 94389003 | 94389024 | 94389020 | 94389025 | + |
| SEQ ID NO 49411 | CCGCCCTGGGAGATCAGAGTGG | CTG | chr14 | 94389006 | 94389027 | 94389023 | 94389028 | + |
| SEQ ID NO 49412 | GGAGATCAGAGTGGGTTAGAGC | CTG | chr14 | 94389014 | 94389035 | 94389031 | 94389036 | + |
| SEQ ID NO 49413 | GAGCCCATTTGACAGATGAGGA | TTA | chr14 | 94389032 | 94389053 | 94389049 | 94389054 | + |
| SEQ ID NO 49414 | GACAGATGAGGAAACAGGCTCA | TTT | chr14 | 94389042 | 94389063 | 94389059 | 94389064 | + |
| SEQ ID NO 49415 | ACAGATGAGGAAACAGGCTCAG | TTG | chr14 | 94389043 | 94389064 | 94389060 | 94389065 | + |
| SEQ ID NO 49416 | AGAGCGGAGAGACCGCTCATCC | CTC | chr14 | 94389063 | 94389084 | 94389080 | 94389085 | + |
| SEQ ID NO 49417 | ATCCAAAGTTACCCAGTCAGCC | CTC | chr14 | 94389081 | 94389102 | 94389098 | 94389103 | + |
| SEQ ID NO 49418 | CCCAGTCAGCCTTAGACACAAA | TTA | chr14 | 94389092 | 94389113 | 94389109 | 94389114 | + |
| SEQ ID NO 49419 | AGACACAAACACCCTCTTGATG | CTT | chr14 | 94389105 | 94389126 | 94389122 | 94389127 | + |
| SEQ ID NO 49420 | GACACAAACACCCTCTTGATGG | TTA | chr14 | 94389106 | 94389127 | 94389123 | 94389128 | + |
| SEQ ID NO 49421 | TTGATGGTCCCGATGGAAAAAT | CTC | chr14 | 94389121 | 94389142 | 94389138 | 94389143 | + |
| SEQ ID NO 49422 | GATGGTCCCGATGGAAAAATGG | CTT | chr14 | 94389123 | 94389144 | 94389140 | 94389145 | + |
| SEQ ID NO 49423 | ATGGTCCCGATGGAAAAATGGA | TTG | chr14 | 94389124 | 94389145 | 94389141 | 94389146 | + |
| SEQ ID NO 49424 | AGGCAGACACAACCGTCAGGCT | CTG | chr14 | 94389155 | 94389176 | 94389172 | 94389177 | + |
| SEQ ID NO 49425 | GCATGGGGGCCGTGAGACAGG | CTG | chr14 | 94389178 | 94389199 | 94389195 | 94389200 | + |
| SEQ ID NO 49426 | TAAAGAAGAGCTGTGCTGCCTC | CTG | chr14 | 94389223 | 94389244 | 94389240 | 94389245 | + |
| SEQ ID NO 49427 | TGCTGCCTCAGGCAGGCCGCTT | CTG | chr14 | 94389236 | 94389257 | 94389253 | 94389258 | + |
| SEQ ID NO 49428 | CCTCAGGCAGGCCGCTTCACCT | CTG | chr14 | 94389241 | 94389262 | 94389258 | 94389263 | + |
| SEQ ID NO 49429 | AGGCAGGCCGCTTCACCTCTCT | CTC | chr14 | 94389245 | 94389266 | 94389262 | 94389267 | + |
| SEQ ID NO 49430 | CACCTCTCTGAACCAGGAACTG | CTT | chr14 | 94389258 | 94389279 | 94389275 | 94389280 | + |
| SEQ ID NO 49431 | ACCTCTCTGAACCAGGAACTGT | TTC | chr14 | 94389259 | 94389280 | 94389276 | 94389281 | + |
| SEQ ID NO 49432 | TCTGAACCAGGAACTGTTTCAC | CTC | chr14 | 94389264 | 94389285 | 94389281 | 94389286 | + |
| SEQ ID NO 49433 | TGAACCAGGAACTGTTTCACCT | CTC | chr14 | 94389266 | 94389287 | 94389283 | 94389288 | + |
| SEQ ID NO 49434 | AACCAGGAACTGTTTCACCTGC | CTG | chr14 | 94389268 | 94389289 | 94389285 | 94389290 | + |
| SEQ ID NO 49435 | TTTCACCTGCATCCCAAAGAGT | CTG | chr14 | 94389280 | 94389301 | 94389297 | 94389302 | + |
| SEQ ID NO 49436 | CACCTGCATCCCAAAGAGTTGG | TTT | chr14 | 94389283 | 94389304 | 94389300 | 94389305 | + |
| SEQ ID NO 49437 | ACCTGCATCCCAAAGAGTTGGA | TTC | chr14 | 94389284 | 94389305 | 94389301 | 94389306 | + |
| SEQ ID NO 49438 | CATCCCAAAGAGTTGGAAGTTT | CTG | chr14 | 94389289 | 94389310 | 94389306 | 94389311 | + |
| SEQ ID NO 49439 | GAAGTTTCATTCCCAAGCATGC | TTG | chr14 | 94389304 | 94389325 | 94389321 | 94389326 | + |
| SEQ ID NO 49440 | CATTCCCAAGCATGCTTGTGAA | TTT | chr14 | 94389311 | 94389332 | 94389328 | 94389333 | + |
| SEQ ID NO 49441 | ATTCCCAAGCATGCTTGTGAAG | TTC | chr14 | 94389312 | 94389333 | 94389329 | 94389334 | + |
| SEQ ID NO 49442 | CCAAGCATGCTTGTGAAGTGCC | TTC | chr14 | 94389316 | 94389337 | 94389333 | 94389338 | + |
| SEQ ID NO 49443 | GTGAAGTGCCTCGGGTGAAGTG | CTT | chr14 | 94389328 | 94389349 | 94389345 | 94389350 | + |
| SEQ ID NO 49444 | TGAAGTGCCTCGGGTGAAGTGC | TTG | chr14 | 94389329 | 94389350 | 94389346 | 94389351 | + |
| SEQ ID NO 49445 | GGGTGAAGTGCCTGGCACACAG | CTC | chr14 | 94389340 | 94389361 | 94389357 | 94389362 | + |
| SEQ ID NO 49446 | GCACACAGTAGGCTCTTTATGT | CTG | chr14 | 94389354 | 94389375 | 94389371 | 94389376 | + |
| SEQ ID NO 49447 | TTTATGTGGGTCTGCACAGCCC | CTC | chr14 | 94389369 | 94389390 | 94389386 | 94389391 | + |
| SEQ ID NO 49448 | TATGTGGGTCTGCACAGCCCTC | CTT | chr14 | 94389371 | 94389392 | 94389388 | 94389393 | + |
| SEQ ID NO 49449 | ATGTGGGTCTGCACAGCCCTCT | TTT | chr14 | 94389372 | 94389393 | 94389389 | 94389394 | + |
| SEQ ID NO 49450 | TGTGGGTCTGCACAGCCCTCTG | TTA | chr14 | 94389373 | 94389394 | 94389390 | 94389395 | + |
| SEQ ID NO 49451 | CACAGCCCTCTGCTTAGTCTGC | CTG | chr14 | 94389383 | 94389404 | 94389400 | 94389405 | + |
| SEQ ID NO 49452 | TGCTTAGTCTGCCCCCCAGGCT | CTC | chr14 | 94389393 | 94389414 | 94389410 | 94389415 | + |
| SEQ ID NO 49453 | CTTAGTCTGCCCCCCAGGCTGC | CTG | chr14 | 94389395 | 94389416 | 94389412 | 94389417 | + |
| SEQ ID NO 49454 | AGTCTGCCCCCCAGGCTGCTCA | CTT | chr14 | 94389398 | 94389419 | 94389415 | 94389420 | + |
| SEQ ID NO 49455 | GTCTGCCCCCCAGGCTGCTCAG | TTA | chr14 | 94389399 | 94389420 | 94389416 | 94389421 | + |
| SEQ ID NO 49456 | CCCCCAGGCTGCTCAGAGCAG | CTG | chr14 | 94389404 | 94389425 | 94389421 | 94389426 | + |
| SEQ ID NO 49457 | CTCAGAGCAGGAGGAGGTTCAA | CTG | chr14 | 94389416 | 94389437 | 94389433 | 94389438 | + |
| SEQ ID NO 49458 | AGAGCAGGAGGAGGTTCAATTT | CTC | chr14 | 94389419 | 94389440 | 94389436 | 94389441 | + |
| SEQ ID NO 49459 | AATTTTGACCAGCCTCAGGCCT | TTC | chr14 | 94389436 | 94389457 | 94389453 | 94389458 | + |
| SEQ ID NO 49460 | TGACCAGCCTCAGGCCTGTTTC | TTT | chr14 | 94389441 | 94389462 | 94389458 | 94389463 | + |
| SEQ ID NO 49461 | GACCAGCCTCAGGCCTGTTTCT | TTT | chr14 | 94389442 | 94389463 | 94389459 | 94389464 | + |
| SEQ ID NO 49462 | ACCAGCCTCAGGCCTGTTTCTG | TTG | chr14 | 94389443 | 94389464 | 94389460 | 94389465 | + |
| SEQ ID NO 49463 | AGGCCTGTTTCTGTTTTTGCTC | CTC | chr14 | 94389452 | 94389473 | 94389469 | 94389474 | + |
| SEQ ID NO 49464 | TTTCTGTTTTTGCTCCTGGAAA | CTG | chr14 | 94389459 | 94389480 | 94389476 | 94389481 | + |
| SEQ ID NO 49465 | CTGTTTTTGCTCCTGGAAAACC | TTT | chr14 | 94389462 | 94389483 | 94389479 | 94389484 | + |
| SEQ ID NO 49466 | TGTTTTTGCTCCTGGAAAACCA | TTC | chr14 | 94389463 | 94389484 | 94389480 | 94389485 | + |

Figure 72 (Cont'd)

| SEQ ID NO 49467 | TTTTTGCTCCTGGAAAACCAGT | CTG | chr14 | 94389465 | 94389486 | 94389482 | 94389487 | + |
| SEQ ID NO 49468 | TTGCTCCTGGAAAACCAGTGTG | TTT | chr14 | 94389468 | 94389489 | 94389485 | 94389490 | + |
| SEQ ID NO 49469 | TGCTCCTGGAAAACCAGTGTGA | TTT | chr14 | 94389469 | 94389490 | 94389486 | 94389491 | + |
| SEQ ID NO 49470 | GCTCCTGGAAAACCAGTGTGAT | TTT | chr14 | 94389470 | 94389491 | 94389487 | 94389492 | + |
| SEQ ID NO 49471 | CTCCTGGAAAACCAGTGTGATC | TTG | chr14 | 94389471 | 94389492 | 94389488 | 94389493 | + |
| SEQ ID NO 49472 | CTGGAAAACCAGTGTGATCCGT | CTC | chr14 | 94389474 | 94389495 | 94389491 | 94389496 | + |
| SEQ ID NO 49473 | GAAAACCAGTGTGATCCGTATA | CTG | chr14 | 94389477 | 94389498 | 94389494 | 94389499 | + |
| SEQ ID NO 49474 | GGAGTTTCTTTGGATACATGGC | CTT | chr14 | 94389505 | 94389526 | 94389522 | 94389527 | + |
| SEQ ID NO 49475 | GAGTTTCTTTGGATACATGGCC | TTG | chr14 | 94389506 | 94389527 | 94389523 | 94389528 | + |
| SEQ ID NO 49476 | CTTTGGATACATGGCCCCCACT | TTT | chr14 | 94389512 | 94389533 | 94389529 | 94389534 | + |
| SEQ ID NO 49477 | TTTGGATACATGGCCCCCACTC | TTC | chr14 | 94389513 | 94389534 | 94389530 | 94389535 | + |
| SEQ ID NO 49478 | TGGATACATGGCCCCCACTCTG | CTT | chr14 | 94389515 | 94389536 | 94389532 | 94389537 | + |
| SEQ ID NO 49479 | GGATACATGGCCCCCACTCTGG | TTT | chr14 | 94389516 | 94389537 | 94389533 | 94389538 | + |
| SEQ ID NO 49480 | GATACATGGCCCCCACTCTGGG | TTG | chr14 | 94389517 | 94389538 | 94389534 | 94389539 | + |
| SEQ ID NO 49481 | TGGGGTTGTTGGAGGCCTTTGG | CTC | chr14 | 94389535 | 94389556 | 94389552 | 94389557 | + |
| SEQ ID NO 49482 | GGGTTGTTGGAGGCCTTTGGAG | CTG | chr14 | 94389537 | 94389558 | 94389554 | 94389559 | + |
| SEQ ID NO 49483 | TTGGAGGCCTTTGGAGACTGCT | TTG | chr14 | 94389543 | 94389564 | 94389560 | 94389565 | + |
| SEQ ID NO 49484 | GAGGCCTTTGGAGACTGCTGGG | TTG | chr14 | 94389546 | 94389567 | 94389563 | 94389568 | + |
| SEQ ID NO 49485 | TGGAGACTGCTGGGGGTGGAGG | CTT | chr14 | 94389554 | 94389575 | 94389571 | 94389576 | + |
| SEQ ID NO 49486 | GGAGACTGCTGGGGGTGGAGGG | TTT | chr14 | 94389555 | 94389576 | 94389572 | 94389577 | + |
| SEQ ID NO 49487 | GAGACTGCTGGGGGTGGAGGGG | TTG | chr14 | 94389556 | 94389577 | 94389573 | 94389578 | + |
| SEQ ID NO 49488 | CTGGGGGTGGAGGGGAGGGGAG | CTG | chr14 | 94389563 | 94389584 | 94389580 | 94389585 | + |
| SEQ ID NO 49489 | GGGGTGGAGGGGAGGGGAGGTA | CTG | chr14 | 94389566 | 94389587 | 94389583 | 94389588 | + |
| SEQ ID NO 49490 | AGGCTAGTGGGGCCCCACTTGA | TTG | chr14 | 94389596 | 94389617 | 94389613 | 94389618 | + |
| SEQ ID NO 49491 | GTGGGGCCCCACTTGATTGCAA | CTA | chr14 | 94389602 | 94389623 | 94389619 | 94389624 | + |
| SEQ ID NO 49492 | GATTGCAATCCCTTTAAAAGCC | CTT | chr14 | 94389616 | 94389637 | 94389633 | 94389638 | + |
| SEQ ID NO 49493 | ATTGCAATCCCTTTAAAAGCCT | TTG | chr14 | 94389617 | 94389638 | 94389634 | 94389639 | + |
| SEQ ID NO 49494 | CAATCCCTTTAAAAGCCTAAAT | TTG | chr14 | 94389621 | 94389642 | 94389638 | 94389643 | + |
| SEQ ID NO 49495 | TAAAAGCCTAAATCAGATTGCA | CTT | chr14 | 94389630 | 94389651 | 94389647 | 94389652 | + |
| SEQ ID NO 49496 | AAAAGCCTAAATCAGATTGCAT | TTT | chr14 | 94389631 | 94389652 | 94389648 | 94389653 | + |
| SEQ ID NO 49497 | AAAGCCTAAATCAGATTGCATC | TTA | chr14 | 94389632 | 94389653 | 94389649 | 94389654 | + |
| SEQ ID NO 49498 | AATCAGATTGCATCGCCCGCTG | CTA | chr14 | 94389640 | 94389661 | 94389657 | 94389662 | + |
| SEQ ID NO 49499 | CATCGCCCGCTGTGCAACCCGC | TTG | chr14 | 94389650 | 94389671 | 94389667 | 94389672 | + |
| SEQ ID NO 49500 | TGCAACCCGCAAACCTGCTTGG | CTG | chr14 | 94389662 | 94389683 | 94389679 | 94389684 | + |
| SEQ ID NO 49501 | CTTGGGAGCTGGCGTACGTGCC | CTG | chr14 | 94389679 | 94389700 | 94389696 | 94389701 | + |
| SEQ ID NO 49502 | GGGAGCTGGCGTACGTGCCGTA | CTT | chr14 | 94389682 | 94389703 | 94389699 | 94389704 | + |
| SEQ ID NO 49503 | GGAGCTGGCGTACGTGCCGTAG | TTG | chr14 | 94389683 | 94389704 | 94389700 | 94389705 | + |
| SEQ ID NO 49504 | GCGTACGTGCCGTAGATACTTG | CTG | chr14 | 94389690 | 94389711 | 94389707 | 94389712 | + |
| SEQ ID NO 49505 | GCAGAGTGAATGGATGAGTGCA | CTT | chr14 | 94389711 | 94389732 | 94389728 | 94389733 | + |
| SEQ ID NO 49506 | CAGAGTGAATGGATGAGTGCAT | TTG | chr14 | 94389712 | 94389733 | 94389729 | 94389734 | + |
| SEQ ID NO 49507 | TTGCCCCTTCTGTCATTCACCA | TTT | chr14 | 94389736 | 94389757 | 94389753 | 94389758 | + |
| SEQ ID NO 49508 | TGCCCCTTCTGTCATTCACCAG | TTT | chr14 | 94389737 | 94389758 | 94389754 | 94389759 | + |
| SEQ ID NO 49509 | GCCCCTTCTGTCATTCACCAGT | TTT | chr14 | 94389738 | 94389759 | 94389755 | 94389760 | + |
| SEQ ID NO 49510 | CCCCTTCTGTCATTCACCAGTC | TTG | chr14 | 94389739 | 94389760 | 94389756 | 94389761 | + |
| SEQ ID NO 49511 | CTGTCATTCACCAGTCCCATTT | CTT | chr14 | 94389745 | 94389766 | 94389762 | 94389767 | + |
| SEQ ID NO 49512 | TGTCATTCACCAGTCCCATTTA | TTC | chr14 | 94389746 | 94389767 | 94389763 | 94389768 | + |
| SEQ ID NO 49513 | TCATTCACCAGTCCCATTTATG | CTG | chr14 | 94389748 | 94389769 | 94389765 | 94389770 | + |
| SEQ ID NO 49514 | ACCAGTCCCATTTATGCCTCCA | TTC | chr14 | 94389754 | 94389775 | 94389771 | 94389776 | + |
| SEQ ID NO 49515 | ATGCCTCCACCTTGGGGCTCTA | TTT | chr14 | 94389767 | 94389788 | 94389784 | 94389789 | + |
| SEQ ID NO 49516 | TGCCTCCACCTTGGGGCTCTAC | TTA | chr14 | 94389768 | 94389789 | 94389785 | 94389790 | + |
| SEQ ID NO 49517 | CACCTTGGGGCTCTACCAGGCG | CTC | chr14 | 94389774 | 94389795 | 94389791 | 94389796 | + |
| SEQ ID NO 49518 | GGGGCTCTACCAGGCGAGTGAC | CTT | chr14 | 94389780 | 94389801 | 94389797 | 94389802 | + |
| SEQ ID NO 49519 | GGGCTCTACCAGGCGAGTGACC | TTG | chr14 | 94389781 | 94389802 | 94389798 | 94389803 | + |
| SEQ ID NO 49520 | TACCAGGCGAGTGACCCACAGG | CTC | chr14 | 94389787 | 94389808 | 94389804 | 94389809 | + |
| SEQ ID NO 49521 | CCAGGCGAGTGACCCACAGGAT | CTA | chr14 | 94389789 | 94389810 | 94389806 | 94389811 | + |
| SEQ ID NO 49522 | CAGCACACACATTCAGACCAGG | CTC | chr14 | 94389815 | 94389836 | 94389832 | 94389837 | + |
| SEQ ID NO 49523 | AGACCAGGGAACCCACTTACTG | TTC | chr14 | 94389829 | 94389850 | 94389846 | 94389851 | + |
| SEQ ID NO 49524 | ACTGGCTGTGAGGCCTCAGGTG | CTT | chr14 | 94389847 | 94389868 | 94389864 | 94389869 | + |
| SEQ ID NO 49525 | CTGGCTGTGAGGCCTCAGGTGA | TTA | chr14 | 94389848 | 94389869 | 94389865 | 94389870 | + |

Figure 72 (Cont'd)

| | | | | | | | | |
|---|---|---|---|---|---|---|---|---|
| SEQ ID NO 49526 | GCTGTGAGGCCTCAGGTGAGTT | CTG | chr14 | 94389851 | 94389872 | 94389868 | 94389873 | + |
| SEQ ID NO 49527 | TGAGGCCTCAGGTGAGTTGTTT | CTG | chr14 | 94389855 | 94389876 | 94389872 | 94389877 | + |
| SEQ ID NO 49528 | AGGTGAGTTGTTTAACCGCTCC | CTC | chr14 | 94389864 | 94389885 | 94389881 | 94389886 | + |
| SEQ ID NO 49529 | TTTAACCGCTCCGAGCCTCAAT | TTG | chr14 | 94389874 | 94389895 | 94389891 | 94389896 | + |
| SEQ ID NO 49530 | AACCGCTCCGAGCCTCAATTTC | TTT | chr14 | 94389877 | 94389898 | 94389894 | 94389899 | + |
| SEQ ID NO 49531 | ACCGCTCCGAGCCTCAATTTCC | TTA | chr14 | 94389878 | 94389899 | 94389895 | 94389900 | + |
| SEQ ID NO 49532 | CGAGCCTCAATTTCCCTATCTG | CTC | chr14 | 94389885 | 94389906 | 94389902 | 94389907 | + |
| SEQ ID NO 49533 | AATTTCCCTATCTGTAAAATGG | CTC | chr14 | 94389893 | 94389914 | 94389910 | 94389915 | + |
| SEQ ID NO 49534 | CCCTATCTGTAAAATGGGGATG | TTT | chr14 | 94389898 | 94389919 | 94389915 | 94389920 | + |
| SEQ ID NO 49535 | CCTATCTGTAAAATGGGGATGG | TTC | chr14 | 94389899 | 94389920 | 94389916 | 94389921 | + |
| SEQ ID NO 49536 | TCTGTAAAATGGGGATGGTGAC | CTA | chr14 | 94389903 | 94389924 | 94389920 | 94389925 | + |
| SEQ ID NO 49537 | TAAAATGGGGATGGTGACGGTA | CTG | chr14 | 94389907 | 94389928 | 94389924 | 94389929 | + |
| SEQ ID NO 49538 | GTTGAGCTGCTGTGAGGATTAA | CTT | chr14 | 94389937 | 94389958 | 94389954 | 94389959 | + |
| SEQ ID NO 49539 | TTGAGCTGCTGTGAGGATTAAA | TTG | chr14 | 94389938 | 94389959 | 94389955 | 94389960 | + |
| SEQ ID NO 49540 | AGCTGCTGTGAGGATTAAAATG | TTG | chr14 | 94389941 | 94389962 | 94389958 | 94389963 | + |
| SEQ ID NO 49541 | CTGTGAGGATTAAAATGCAACA | CTG | chr14 | 94389946 | 94389967 | 94389963 | 94389968 | + |
| SEQ ID NO 49542 | TGAGGATTAAAATGCAACAGTT | CTG | chr14 | 94389949 | 94389970 | 94389966 | 94389971 | + |
| SEQ ID NO 49543 | AAATGCAACAGTTCAAGGAAAG | TTA | chr14 | 94389958 | 94389979 | 94389975 | 94389980 | + |
| SEQ ID NO 49544 | AAGGAAAGCTCAGAGACGGGTA | TTC | chr14 | 94389972 | 94389993 | 94389989 | 94389994 | + |
| SEQ ID NO 49545 | AGAGACGGGTACTGGGTGTGCC | CTC | chr14 | 94389983 | 94390004 | 94390000 | 94390005 | + |
| SEQ ID NO 49546 | GGTGTGCCCAGAAAGCCCCTCC | CTG | chr14 | 94389997 | 94390018 | 94390014 | 94390019 | + |
| SEQ ID NO 49547 | CTGATGCTGCCCTCCCTCCCCC | CTC | chr14 | 94390018 | 94390039 | 94390035 | 94390040 | + |
| SEQ ID NO 49548 | ATGCTGCCCTCCCTCCCCGTG | CTG | chr14 | 94390021 | 94390042 | 94390038 | 94390043 | + |
| SEQ ID NO 49549 | CCCTCCCTCCCCGTGTCAGGG | CTG | chr14 | 94390027 | 94390048 | 94390044 | 94390049 | + |
| SEQ ID NO 49550 | CCTCCCCGTGTCAGGGGCTGG | CTC | chr14 | 94390032 | 94390053 | 94390049 | 94390054 | + |
| SEQ ID NO 49551 | CCCCGTGTCAGGGGCTGGTGTC | CTC | chr14 | 94390036 | 94390057 | 94390053 | 94390058 | + |
| SEQ ID NO 49552 | GTGTCACTGGGGTGGGGTGGGC | CTG | chr14 | 94390053 | 94390074 | 94390070 | 94390075 | + |
| SEQ ID NO 49553 | GGGTGGGGTGGGCCACACTTGA | CTG | chr14 | 94390062 | 94390083 | 94390079 | 94390084 | + |
| SEQ ID NO 49554 | GAAAGAGCTTTCCTCCAGGCAGT | CTT | chr14 | 94390082 | 94390103 | 94390099 | 94390104 | + |
| SEQ ID NO 49555 | AAGAGCTTTCCTCCAGGCAGTC | TTG | chr14 | 94390083 | 94390104 | 94390100 | 94390105 | + |
| SEQ ID NO 49556 | TCCTCCAGGCAGTCTCTCATTC | CTT | chr14 | 94390091 | 94390112 | 94390108 | 94390113 | + |
| SEQ ID NO 49557 | CCTCCAGGCAGTCTCTCATTCA | TTT | chr14 | 94390092 | 94390113 | 94390109 | 94390114 | + |
| SEQ ID NO 49558 | CTCCAGGCAGTCTCTCATTCAG | TTC | chr14 | 94390093 | 94390114 | 94390110 | 94390115 | + |
| SEQ ID NO 49559 | CAGGCAGTCTCTCATTCAGTTA | CTC | chr14 | 94390096 | 94390117 | 94390113 | 94390118 | + |
| SEQ ID NO 49560 | TCATTCAGTTACCCTGTGAAGG | CTC | chr14 | 94390107 | 94390128 | 94390124 | 94390129 | + |
| SEQ ID NO 49561 | ATTCAGTTACCCTGTGAAGGGA | CTC | chr14 | 94390109 | 94390130 | 94390126 | 94390131 | + |
| SEQ ID NO 49562 | AGTTACCCTGTGAAGGGAGTAG | TTC | chr14 | 94390113 | 94390134 | 94390130 | 94390135 | + |
| SEQ ID NO 49563 | CCCTGTGAAGGGAGTAGGTACC | TTA | chr14 | 94390118 | 94390139 | 94390135 | 94390140 | + |
| SEQ ID NO 49564 | TGAAGGGAGTAGGTACCACCCT | CTG | chr14 | 94390123 | 94390144 | 94390140 | 94390145 | + |
| SEQ ID NO 49565 | CTTTCAGGCAGCGGGAAACTGA | CTC | chr14 | 94390146 | 94390167 | 94390163 | 94390168 | + |
| SEQ ID NO 49566 | TCAGGCAGCGGGAAACTGAGCT | CTT | chr14 | 94390149 | 94390170 | 94390166 | 94390171 | + |
| SEQ ID NO 49567 | CAGGCAGCGGGAAACTGAGCTC | TTT | chr14 | 94390150 | 94390171 | 94390167 | 94390172 | + |
| SEQ ID NO 49568 | AGGCAGCGGGAAACTGAGCTCA | TTC | chr14 | 94390151 | 94390172 | 94390168 | 94390173 | + |
| SEQ ID NO 49569 | AGCTCAGACTCCCCTCCCCTTC | CTG | chr14 | 94390167 | 94390188 | 94390184 | 94390189 | + |
| SEQ ID NO 49570 | AGACTCCCCTCCCCTTCTCTCT | CTC | chr14 | 94390172 | 94390193 | 94390189 | 94390194 | + |
| SEQ ID NO 49571 | CCCTCCCCTTCTCTCTGAGCTC | CTC | chr14 | 94390178 | 94390199 | 94390195 | 94390200 | + |
| SEQ ID NO 49572 | CCCTTCTCTCTGAGCTCCCTTC | CTC | chr14 | 94390183 | 94390204 | 94390200 | 94390205 | + |
| SEQ ID NO 49573 | CTCTGAGCTCCCTTCCCTGC | CTT | chr14 | 94390188 | 94390209 | 94390205 | 94390210 | + |
| SEQ ID NO 49574 | TCTCTGAGCTCCCTTCCCTGCA | TTC | chr14 | 94390189 | 94390210 | 94390206 | 94390211 | + |
| SEQ ID NO 49575 | TCTGAGCTCCCTTCCCTGCAGC | CTC | chr14 | 94390191 | 94390212 | 94390208 | 94390213 | + |
| SEQ ID NO 49576 | TGAGCTCCCTTCCCTGCAGCTC | CTC | chr14 | 94390193 | 94390214 | 94390210 | 94390215 | + |
| SEQ ID NO 49577 | AGCTCCCTTCCCTGCAGCTCCA | CTG | chr14 | 94390195 | 94390216 | 94390212 | 94390217 | + |
| SEQ ID NO 49578 | CCTTCCCTGCAGCTCCATCCCC | CTC | chr14 | 94390200 | 94390221 | 94390217 | 94390222 | + |
| SEQ ID NO 49579 | CCCTGCAGCTCCATCCCCTGGC | CTT | chr14 | 94390204 | 94390225 | 94390221 | 94390226 | + |
| SEQ ID NO 49580 | CCTGCAGCTCCATCCCCTGGCT | TTC | chr14 | 94390205 | 94390226 | 94390222 | 94390227 | + |
| SEQ ID NO 49581 | CAGCTCCATCCCCTGGCTTCAG | CTG | chr14 | 94390209 | 94390230 | 94390226 | 94390231 | + |
| SEQ ID NO 49582 | CATCCCCTGGCTTCAGGGCCCC | CTC | chr14 | 94390215 | 94390236 | 94390232 | 94390237 | + |
| SEQ ID NO 49583 | GCTTCAGGGCCCCTGTCCTTCC | CTG | chr14 | 94390224 | 94390245 | 94390241 | 94390246 | + |
| SEQ ID NO 49584 | CAGGGCCCCTGTCCTTCCCCTG | CTT | chr14 | 94390228 | 94390249 | 94390245 | 94390250 | + |

Figure 72 (Cont'd)

| | | | | | | | | |
|---|---|---|---|---|---|---|---|---|
| SEQ ID NO 49585 | AGGGCCCCTGTCCTTCCCCTGA | TTC | chr14 | 94390229 | 94390250 | 94390246 | 94390251 | + |
| SEQ ID NO 49586 | TCCTTCCCCTGAGCTGGCTGAA | CTG | chr14 | 94390239 | 94390260 | 94390256 | 94390261 | + |
| SEQ ID NO 49587 | CCCCTGAGCTGGCTGAATGGAT | CTT | chr14 | 94390244 | 94390265 | 94390261 | 94390266 | + |
| SEQ ID NO 49588 | CCCTGAGCTGGCTGAATGGATA | TTC | chr14 | 94390245 | 94390266 | 94390262 | 94390267 | + |
| SEQ ID NO 49589 | AGCTGGCTGAATGGATATTCCG | CTG | chr14 | 94390250 | 94390271 | 94390267 | 94390272 | + |
| SEQ ID NO 49590 | GCTGAATGGATATTCCGCTGCT | CTG | chr14 | 94390255 | 94390276 | 94390272 | 94390277 | + |
| SEQ ID NO 49591 | AATGGATATTCCGCTGCTCTAC | CTG | chr14 | 94390259 | 94390280 | 94390276 | 94390281 | + |
| SEQ ID NO 49592 | CGCTGCTCTACATCCACTCACA | TTC | chr14 | 94390270 | 94390291 | 94390287 | 94390292 | + |
| SEQ ID NO 49593 | CTCTACATCCACTCACAGCTCC | CTG | chr14 | 94390275 | 94390296 | 94390292 | 94390297 | + |
| SEQ ID NO 49594 | TACATCCACTCACAGCTCCAGC | CTC | chr14 | 94390278 | 94390299 | 94390295 | 94390300 | + |
| SEQ ID NO 49595 | CATCCACTCACAGCTCCAGCAC | CTA | chr14 | 94390280 | 94390301 | 94390297 | 94390302 | + |
| SEQ ID NO 49596 | ACAGCTCCAGCACTGGGCTGTG | CTC | chr14 | 94390289 | 94390310 | 94390306 | 94390311 | + |
| SEQ ID NO 49597 | CAGCACTGGGCTGTGGTTGAGG | CTC | chr14 | 94390296 | 94390317 | 94390313 | 94390318 | + |
| SEQ ID NO 49598 | GGCTGTGGTTGAGGTCGCCTGC | CTG | chr14 | 94390304 | 94390325 | 94390321 | 94390326 | + |
| SEQ ID NO 49599 | TGGTTGAGGTCGCCTGCCCTCG | CTG | chr14 | 94390309 | 94390330 | 94390326 | 94390331 | + |
| SEQ ID NO 49600 | AGGTCGCCTGCCCTCGGTAGCT | TTG | chr14 | 94390315 | 94390336 | 94390332 | 94390337 | + |
| SEQ ID NO 49601 | CCCTCGGTAGCTCCTGGGCATT | CTG | chr14 | 94390325 | 94390346 | 94390342 | 94390347 | + |
| SEQ ID NO 49602 | GGTAGCTCCTGGGCATTTCTTC | CTC | chr14 | 94390330 | 94390351 | 94390347 | 94390352 | + |
| SEQ ID NO 49603 | CTGGGCATTTCTTCCCCTCTCT | CTC | chr14 | 94390338 | 94390359 | 94390355 | 94390360 | + |
| SEQ ID NO 49604 | GGCATTTCTTCCCCTCTCTGGG | CTG | chr14 | 94390341 | 94390362 | 94390358 | 94390363 | + |
| SEQ ID NO 49605 | CTTCCCCTCTCTGGGCCTTTGT | TTT | chr14 | 94390348 | 94390369 | 94390365 | 94390370 | + |
| SEQ ID NO 49606 | TTCCCCTCTCTGGGCCTTTGTT | TTC | chr14 | 94390349 | 94390370 | 94390366 | 94390371 | + |
| SEQ ID NO 49607 | CCCCTCTCTGGGCCTTTGTTTT | CTT | chr14 | 94390351 | 94390372 | 94390368 | 94390373 | + |
| SEQ ID NO 49608 | CCCTCTCTGGGCCTTTGTTTTC | TTC | chr14 | 94390352 | 94390373 | 94390369 | 94390374 | + |
| SEQ ID NO 49609 | TCTGGGCCTTTGTTTTCCCATC | CTC | chr14 | 94390357 | 94390378 | 94390374 | 94390379 | + |
| SEQ ID NO 49610 | TGGGCCTTTGTTTTCCCATCTG | CTC | chr14 | 94390359 | 94390380 | 94390376 | 94390381 | + |
| SEQ ID NO 49611 | GGCCTTTGTTTTCCCATCTGCA | CTG | chr14 | 94390361 | 94390382 | 94390378 | 94390383 | + |
| SEQ ID NO 49612 | TGTTTTCCCATCTGCACAATGA | CTT | chr14 | 94390367 | 94390388 | 94390384 | 94390389 | + |
| SEQ ID NO 49613 | GTTTTCCCATCTGCACAATGAC | TTT | chr14 | 94390368 | 94390389 | 94390385 | 94390390 | + |
| SEQ ID NO 49614 | TTTTCCCATCTGCACAATGACC | TTG | chr14 | 94390369 | 94390390 | 94390386 | 94390391 | + |
| SEQ ID NO 49615 | TCCCATCTGCACAATGACCCCC | TTT | chr14 | 94390372 | 94390393 | 94390389 | 94390394 | + |
| SEQ ID NO 49616 | CCCATCTGCACAATGACCCCCA | TTT | chr14 | 94390373 | 94390394 | 94390390 | 94390395 | + |
| SEQ ID NO 49617 | CCATCTGCACAATGACCCCCAC | TTC | chr14 | 94390374 | 94390395 | 94390391 | 94390396 | + |
| SEQ ID NO 49618 | CACAATGACCCCCACTCTAAGC | CTG | chr14 | 94390381 | 94390402 | 94390398 | 94390403 | + |
| SEQ ID NO 49619 | TAAGCCCTGCTGTCCCTCCCAC | CTC | chr14 | 94390398 | 94390419 | 94390415 | 94390420 | + |
| SEQ ID NO 49620 | AGCCCTGCTGTCCCTCCCACCT | CTA | chr14 | 94390400 | 94390421 | 94390417 | 94390422 | + |
| SEQ ID NO 49621 | CTGTCCCTCCCACCTGTGGAAC | CTG | chr14 | 94390407 | 94390428 | 94390424 | 94390429 | + |
| SEQ ID NO 49622 | TCCCTCCCACCTGTGGAACTGA | CTG | chr14 | 94390410 | 94390431 | 94390427 | 94390432 | + |
| SEQ ID NO 49623 | CCACCTGTGGAACTGAGTGAGC | CTC | chr14 | 94390416 | 94390437 | 94390433 | 94390438 | + |
| SEQ ID NO 49624 | TGGAACTGAGTGAGCAGCAGCA | CTG | chr14 | 94390423 | 94390444 | 94390440 | 94390445 | + |
| SEQ ID NO 49625 | AGTGAGCAGCAGCAGCAATGTC | CTG | chr14 | 94390431 | 94390452 | 94390448 | 94390453 | + |
| SEQ ID NO 49626 | TCCTGCTCTCCTCAAGCTCTCC | CTT | chr14 | 94390460 | 94390481 | 94390477 | 94390482 | + |
| SEQ ID NO 49627 | CCTGCTCTCCTCAAGCTCTCCT | TTT | chr14 | 94390461 | 94390482 | 94390478 | 94390483 | + |
| SEQ ID NO 49628 | CTGCTCTCCTCAAGCTCTCCTC | TTC | chr14 | 94390462 | 94390483 | 94390479 | 94390484 | + |
| SEQ ID NO 49629 | CTCCTCAAGCTCTCCTCAAG | CTG | chr14 | 94390465 | 94390486 | 94390482 | 94390487 | + |
| SEQ ID NO 49630 | TCCTCAAGCTCTCCTCAAGCTC | CTC | chr14 | 94390468 | 94390489 | 94390485 | 94390490 | + |
| SEQ ID NO 49631 | CTCAAGCTCTCCTCAAGCTCTG | CTC | chr14 | 94390470 | 94390491 | 94390487 | 94390492 | + |
| SEQ ID NO 49632 | AAGCTCTCCTCAAGCTCTGTCT | CTC | chr14 | 94390473 | 94390494 | 94390490 | 94390495 | + |
| SEQ ID NO 49633 | TCCTCAAGCTCTGTCTCTTCTG | CTC | chr14 | 94390479 | 94390500 | 94390496 | 94390501 | + |
| SEQ ID NO 49634 | CTCAAGCTCTGTCTCTTCTGGC | CTC | chr14 | 94390481 | 94390502 | 94390498 | 94390503 | + |
| SEQ ID NO 49635 | AAGCTCTGTCTCTTCTGGCAGG | CTC | chr14 | 94390484 | 94390505 | 94390501 | 94390506 | + |
| SEQ ID NO 49636 | TGTCTCTTCTGGCAGGCACAGG | CTC | chr14 | 94390490 | 94390511 | 94390507 | 94390512 | + |
| SEQ ID NO 49637 | TCTCTTCTGGCAGGCACAGGAG | CTG | chr14 | 94390492 | 94390513 | 94390509 | 94390514 | + |
| SEQ ID NO 49638 | TTCTGGCAGGCACAGGAGAGTG | CTC | chr14 | 94390496 | 94390517 | 94390513 | 94390518 | + |
| SEQ ID NO 49639 | CTGGCAGGCACAGGAGAGTGGC | CTT | chr14 | 94390498 | 94390519 | 94390515 | 94390520 | + |
| SEQ ID NO 49640 | TGGCAGGCACAGGAGAGTGGCC | TTC | chr14 | 94390499 | 94390520 | 94390516 | 94390521 | + |
| SEQ ID NO 49641 | GCAGGCACAGGAGAGTGGCCTG | CTG | chr14 | 94390501 | 94390522 | 94390518 | 94390523 | + |
| SEQ ID NO 49642 | AAGGCTGGCAGGAGGTTGCCGC | CTG | chr14 | 94390523 | 94390544 | 94390540 | 94390545 | + |
| SEQ ID NO 49643 | GCAGGAGGTTGCCGCCCCTCCA | CTG | chr14 | 94390530 | 94390551 | 94390547 | 94390552 | + |

Figure 72 (Cont'd)

| | | | | | | | | |
|---|---|---|---|---|---|---|---|---|
| SEQ ID NO 49644 | CCGCCCCTCCAACCTGGAATTC | TTG | chr14 | 94390541 | 94390562 | 94390558 | 94390563 | + |
| SEQ ID NO 49645 | CAACCTGGAATTCCTGGCAGCA | CTC | chr14 | 94390550 | 94390571 | 94390567 | 94390572 | + |
| SEQ ID NO 49646 | GAATTCCTGGCAGCAGCAGCGG | CTG | chr14 | 94390557 | 94390578 | 94390574 | 94390579 | + |
| SEQ ID NO 49647 | CTGGCAGCAGCAGCGGCTAGGC | TTC | chr14 | 94390563 | 94390584 | 94390580 | 94390585 | + |
| SEQ ID NO 49648 | GCAGCAGCAGCGGCTAGGCCTT | CTG | chr14 | 94390566 | 94390587 | 94390583 | 94390588 | + |
| SEQ ID NO 49649 | GGCCTTCCTCGGAGGCCCGACC | CTA | chr14 | 94390582 | 94390603 | 94390599 | 94390604 | + |
| SEQ ID NO 49650 | CCTCGGAGGCCCGACCCCCTCC | CTT | chr14 | 94390588 | 94390609 | 94390605 | 94390610 | + |
| SEQ ID NO 49651 | CTCGGAGGCCCGACCCCCTCCT | TTC | chr14 | 94390589 | 94390610 | 94390606 | 94390611 | + |
| SEQ ID NO 49652 | GGAGGCCCGACCCCCTCCTCCT | CTC | chr14 | 94390592 | 94390613 | 94390609 | 94390614 | + |
| SEQ ID NO 49653 | CTCCTTCTTGGTTCAGCTCAGG | CTC | chr14 | 94390609 | 94390630 | 94390626 | 94390631 | + |
| SEQ ID NO 49654 | CTTCTTGGTTCAGCTCAGGACT | CTC | chr14 | 94390612 | 94390633 | 94390629 | 94390634 | + |
| SEQ ID NO 49655 | CTTGGTTCAGCTCAGGACTCTG | CTT | chr14 | 94390615 | 94390636 | 94390632 | 94390637 | + |
| SEQ ID NO 49656 | TTGGTTCAGCTCAGGACTCTGA | TTC | chr14 | 94390616 | 94390637 | 94390633 | 94390638 | + |
| SEQ ID NO 49657 | GGTTCAGCTCAGGACTCTGAGG | CTT | chr14 | 94390618 | 94390639 | 94390635 | 94390640 | + |
| SEQ ID NO 49658 | GTTCAGCTCAGGACTCTGAGGG | TTG | chr14 | 94390619 | 94390640 | 94390636 | 94390641 | + |
| SEQ ID NO 49659 | AGCTCAGGACTCTGAGGGTTGC | TTC | chr14 | 94390623 | 94390644 | 94390640 | 94390645 | + |
| SEQ ID NO 49660 | AGGACTCTGAGGGTTGCTGCGT | CTC | chr14 | 94390628 | 94390649 | 94390645 | 94390650 | + |
| SEQ ID NO 49661 | TGAGGGTTGCTGCGTGGAGGCA | CTC | chr14 | 94390635 | 94390656 | 94390652 | 94390657 | + |
| SEQ ID NO 49662 | AGGGTTGCTGCGTGGAGGCAGT | CTG | chr14 | 94390637 | 94390658 | 94390654 | 94390659 | + |
| SEQ ID NO 49663 | CTGCGTGGAGGCAGTGCATGCC | TTG | chr14 | 94390644 | 94390665 | 94390661 | 94390666 | + |
| SEQ ID NO 49664 | CGTGGAGGCAGTGCATGCCCTG | CTG | chr14 | 94390647 | 94390668 | 94390664 | 94390669 | + |
| SEQ ID NO 49665 | GGCACAGTGCCCAGTTCCTGCC | CTG | chr14 | 94390669 | 94390690 | 94390686 | 94390691 | + |
| SEQ ID NO 49666 | CTGCCCACCCAGGAAGTAGACT | TTC | chr14 | 94390686 | 94390707 | 94390703 | 94390708 | + |
| SEQ ID NO 49667 | CCCACCCAGGAAGTAGACTTCG | CTG | chr14 | 94390689 | 94390710 | 94390706 | 94390711 | + |
| SEQ ID NO 49668 | CGGGTGGAGGCAGTAGGCTGGG | CTT | chr14 | 94390709 | 94390730 | 94390726 | 94390731 | + |
| SEQ ID NO 49669 | GGGTGGAGGCAGTAGGCTGGGG | TTC | chr14 | 94390710 | 94390731 | 94390727 | 94390732 | + |
| SEQ ID NO 49670 | GGGAGGGGCGGGGAGCTTGGAC | CTG | chr14 | 94390729 | 94390750 | 94390746 | 94390751 | + |
| SEQ ID NO 49671 | GGACAGGAAGGAGCCTTGCTCA | CTT | chr14 | 94390747 | 94390768 | 94390764 | 94390769 | + |
| SEQ ID NO 49672 | GACAGGAAGGAGCCTTGCTCAT | TTG | chr14 | 94390748 | 94390769 | 94390765 | 94390770 | + |
| SEQ ID NO 49673 | GCTCATTGCCCGGCAGACACAA | CTT | chr14 | 94390764 | 94390785 | 94390781 | 94390786 | + |
| SEQ ID NO 49674 | CTCATTGCCCGGCAGACACAAG | TTG | chr14 | 94390765 | 94390786 | 94390782 | 94390787 | + |
| SEQ ID NO 49675 | ATTGCCCGGCAGACACAAGACT | CTC | chr14 | 94390768 | 94390789 | 94390785 | 94390790 | + |
| SEQ ID NO 49676 | CCCGGCAGACACAAGACTGGGC | TTG | chr14 | 94390772 | 94390793 | 94390789 | 94390794 | + |
| SEQ ID NO 49677 | GGCCCTCATAAACTCAGACAGC | CTG | chr14 | 94390791 | 94390812 | 94390808 | 94390813 | + |
| SEQ ID NO 49678 | ATAAACTCAGACAGCCCGGCAT | CTC | chr14 | 94390798 | 94390819 | 94390815 | 94390820 | + |
| SEQ ID NO 49679 | AGACAGCCCGGCATGTCACCTG | CTC | chr14 | 94390806 | 94390827 | 94390823 | 94390828 | + |
| SEQ ID NO 49680 | TTGTACCTGCCCTTTCAGCTCT | CTG | chr14 | 94390828 | 94390849 | 94390845 | 94390850 | + |
| SEQ ID NO 49681 | TACCTGCCCTTTCAGCTCTGTG | TTG | chr14 | 94390831 | 94390852 | 94390848 | 94390853 | + |
| SEQ ID NO 49682 | CCCTTTCAGCTCTGTGACCCGG | CTG | chr14 | 94390837 | 94390858 | 94390854 | 94390859 | + |
| SEQ ID NO 49683 | TCAGCTCTGTGACCCGGGACAA | CTT | chr14 | 94390842 | 94390863 | 94390859 | 94390864 | + |
| SEQ ID NO 49684 | CAGCTCTGTGACCCGGGACAAG | TTT | chr14 | 94390843 | 94390864 | 94390860 | 94390865 | + |
| SEQ ID NO 49685 | AGCTCTGTGACCCGGGACAAGT | TTC | chr14 | 94390844 | 94390865 | 94390861 | 94390866 | + |
| SEQ ID NO 49686 | TGTGACCCGGGACAAGTCACCC | CTC | chr14 | 94390849 | 94390870 | 94390866 | 94390871 | + |
| SEQ ID NO 49687 | TGACCCGGGACAAGTCACCCTC | CTG | chr14 | 94390851 | 94390872 | 94390868 | 94390873 | + |
| SEQ ID NO 49688 | TCCCTTTGAGTTGCCGCAAGAG | CTC | chr14 | 94390873 | 94390894 | 94390890 | 94390895 | + |
| SEQ ID NO 49689 | CCTTTGAGTTGCCGCAAGAGGT | CTC | chr14 | 94390875 | 94390896 | 94390892 | 94390897 | + |
| SEQ ID NO 49690 | TGAGTTGCCGCAAGAGGTACAG | CTT | chr14 | 94390879 | 94390900 | 94390896 | 94390901 | + |
| SEQ ID NO 49691 | GAGTTGCCGCAAGAGGTACAGT | TTT | chr14 | 94390880 | 94390901 | 94390897 | 94390902 | + |
| SEQ ID NO 49692 | AGTTGCCGCAAGAGGTACAGTC | TTG | chr14 | 94390881 | 94390902 | 94390898 | 94390903 | + |
| SEQ ID NO 49693 | CCGCAAGAGGTACAGTCACACT | TTG | chr14 | 94390886 | 94390907 | 94390903 | 94390908 | + |
| SEQ ID NO 49694 | CCCAGAGGATTACTAGAAATGA | CTG | chr14 | 94390909 | 94390930 | 94390926 | 94390931 | + |
| SEQ ID NO 49695 | CTAGAAATGACAGGCCTCGCCC | TTA | chr14 | 94390921 | 94390942 | 94390938 | 94390943 | + |
| SEQ ID NO 49696 | GAAATGACAGGCCTCGCCCTCC | CTA | chr14 | 94390924 | 94390945 | 94390941 | 94390946 | + |
| SEQ ID NO 49697 | GCCCTCCTGGCACAGACCTGGC | CTC | chr14 | 94390939 | 94390960 | 94390956 | 94390961 | + |
| SEQ ID NO 49698 | CTGGCACAGACCTGGCACCAAT | CTC | chr14 | 94390945 | 94390966 | 94390962 | 94390967 | + |
| SEQ ID NO 49699 | GCACAGACCTGGCACCAATAAC | CTG | chr14 | 94390948 | 94390969 | 94390965 | 94390970 | + |
| SEQ ID NO 49700 | GCACCAATAACTGGCAGGTTTC | CTG | chr14 | 94390959 | 94390980 | 94390976 | 94390981 | + |
| SEQ ID NO 49701 | GCAGGTTTCTGGGGCCAGCTGC | CTG | chr14 | 94390972 | 94390993 | 94390989 | 94390994 | + |
| SEQ ID NO 49702 | CTGGGGCCAGCTGCAGAGGGAA | TTT | chr14 | 94390980 | 94391001 | 94390997 | 94391002 | + |

Figure 72 (Cont'd)

| SEQ ID NO | Sequence | | Chr | Pos1 | Pos2 | Pos3 | Pos4 | Strand |
|---|---|---|---|---|---|---|---|---|
| SEQ ID NO 49703 | TGGGGCCAGCTGCAGAGGGAAG | TTC | chr14 | 94390981 | 94391002 | 94390998 | 94391003 | + |
| SEQ ID NO 49704 | GGGCCAGCTGCAGAGGGAAGAG | CTG | chr14 | 94390983 | 94391004 | 94391000 | 94391005 | + |
| SEQ ID NO 49705 | CAGAGGGAAGAGGACTGAGCCA | CTG | chr14 | 94390993 | 94391014 | 94391010 | 94391015 | + |
| SEQ ID NO 49706 | AGCCACCTATGAAATGCCCAGT | CTG | chr14 | 94391010 | 94391031 | 94391027 | 94391032 | + |
| SEQ ID NO 49707 | TGAAATGCCCAGTGGGCAGCCC | CTA | chr14 | 94391019 | 94391040 | 94391036 | 94391041 | + |
| SEQ ID NO 49708 | GGCAGGTCTGTGTGCACTGGGG | TTG | chr14 | 94391049 | 94391070 | 94391066 | 94391071 | + |
| SEQ ID NO 49709 | TGTGCACTGGGGAGGTGTGTGT | CTG | chr14 | 94391059 | 94391080 | 94391076 | 94391081 | + |
| SEQ ID NO 49710 | GGGAGGTGTGTGTCATAGGACC | CTG | chr14 | 94391068 | 94391089 | 94391085 | 94391090 | + |
| SEQ ID NO 49711 | TGACACACACCTCCCCAGTGCA | CTA | chr14 | 94391061 | 94391082 | 94391066 | 94391061 | - |
| SEQ ID NO 49712 | CCCAGTGCACACAGACCTGCCC | CTC | chr14 | 94391048 | 94391069 | 94391053 | 94391048 | - |
| SEQ ID NO 49713 | CCCAACTGTGGGGCTGCCCACT | CTG | chr14 | 94391029 | 94391050 | 94391034 | 94391029 | - |
| SEQ ID NO 49714 | TGGGGCTGCCCACTGGGCATTT | CTG | chr14 | 94391021 | 94391042 | 94391026 | 94391021 | - |
| SEQ ID NO 49715 | CCCACTGGGCATTTCATAGGTG | CTG | chr14 | 94391013 | 94391034 | 94391018 | 94391013 | - |
| SEQ ID NO 49716 | GGCATTTCATAGGTGGCTCAGT | CTG | chr14 | 94391006 | 94391027 | 94391011 | 94391006 | - |
| SEQ ID NO 49717 | CATAGGTGGCTCAGTCCTCTTC | TTT | chr14 | 94390999 | 94391020 | 94391004 | 94390999 | - |
| SEQ ID NO 49718 | ATAGGTGGCTCAGTCCTCTTCC | TTC | chr14 | 94390998 | 94391019 | 94391003 | 94390998 | - |
| SEQ ID NO 49719 | AGTCCTCTTCCCTCTGCAGCTG | CTC | chr14 | 94390987 | 94391008 | 94390992 | 94390987 | - |
| SEQ ID NO 49720 | TTCCCTCTGCAGCTGGCCCCAG | CTC | chr14 | 94390980 | 94391001 | 94390985 | 94390980 | - |
| SEQ ID NO 49721 | CCCTCTGCAGCTGGCCCCAGAA | CTT | chr14 | 94390978 | 94390999 | 94390983 | 94390978 | - |
| SEQ ID NO 49722 | CCTCTGCAGCTGGCCCCAGAAA | TTC | chr14 | 94390977 | 94390998 | 94390982 | 94390977 | - |
| SEQ ID NO 49723 | TGCAGCTGGCCCCAGAAACCTG | CTC | chr14 | 94390973 | 94390994 | 94390978 | 94390973 | - |
| SEQ ID NO 49724 | CAGCTGGCCCCAGAAACCTGCC | CTG | chr14 | 94390971 | 94390992 | 94390976 | 94390971 | - |
| SEQ ID NO 49725 | GCCCCAGAAACCTGCCAGTTAT | CTG | chr14 | 94390965 | 94390986 | 94390970 | 94390965 | - |
| SEQ ID NO 49726 | CCAGTTATTGGTGCCAGGTCTG | CTG | chr14 | 94390951 | 94390972 | 94390956 | 94390951 | - |
| SEQ ID NO 49727 | TTGGTGCCAGGTCTGTGCCAGG | TTA | chr14 | 94390944 | 94390965 | 94390949 | 94390944 | - |
| SEQ ID NO 49728 | GTGCCAGGTCTGTGCCAGGAGG | TTG | chr14 | 94390941 | 94390962 | 94390946 | 94390941 | - |
| SEQ ID NO 49729 | TGCCAGGAGGGCGAGGCCTGTC | CTG | chr14 | 94390929 | 94390950 | 94390934 | 94390929 | - |
| SEQ ID NO 49730 | TCATTTCTAGTAATCCTCTGGG | CTG | chr14 | 94390909 | 94390930 | 94390914 | 94390909 | - |
| SEQ ID NO 49731 | CTAGTAATCCTCTGGGCAGTGT | TTT | chr14 | 94390903 | 94390924 | 94390908 | 94390903 | - |
| SEQ ID NO 49732 | TAGTAATCCTCTGGGCAGTGTG | TTC | chr14 | 94390902 | 94390923 | 94390907 | 94390902 | - |
| SEQ ID NO 49733 | GTAATCCTCTGGGCAGTGTGAC | CTA | chr14 | 94390900 | 94390921 | 94390905 | 94390900 | - |
| SEQ ID NO 49734 | TGGGCAGTGTGACTGTACCTCT | CTC | chr14 | 94390891 | 94390912 | 94390896 | 94390891 | - |
| SEQ ID NO 49735 | GGCAGTGTGACTGTACCTCTTG | CTG | chr14 | 94390889 | 94390910 | 94390894 | 94390889 | - |
| SEQ ID NO 49736 | TACCTCTTGCGGCAACTCAAAG | CTG | chr14 | 94390876 | 94390897 | 94390881 | 94390876 | - |
| SEQ ID NO 49737 | TTGCGGCAACTCAAAGGGAGAG | CTC | chr14 | 94390870 | 94390891 | 94390875 | 94390870 | - |
| SEQ ID NO 49738 | GCGGCAACTCAAAGGGAGAGGG | CTT | chr14 | 94390868 | 94390889 | 94390873 | 94390868 | - |
| SEQ ID NO 49739 | CGGCAACTCAAAGGGAGAGGGT | TTG | chr14 | 94390867 | 94390888 | 94390872 | 94390867 | - |
| SEQ ID NO 49740 | AAAGGGAGAGGGTGACTTGTCC | CTC | chr14 | 94390858 | 94390879 | 94390863 | 94390858 | - |
| SEQ ID NO 49741 | GTCCCGGGTCACAGAGCTGAAA | CTT | chr14 | 94390840 | 94390861 | 94390845 | 94390840 | - |
| SEQ ID NO 49742 | TCCCGGGTCACAGAGCTGAAAG | TTG | chr14 | 94390839 | 94390860 | 94390844 | 94390839 | - |
| SEQ ID NO 49743 | AAAGGGCAGGTACAACAGGTGA | CTG | chr14 | 94390821 | 94390842 | 94390826 | 94390821 | - |
| SEQ ID NO 49744 | TCTGAGTTTATGAGGGCCCAGT | CTG | chr14 | 94390787 | 94390808 | 94390792 | 94390787 | - |
| SEQ ID NO 49745 | AGTTTATGAGGGCCCAGTCTTG | CTG | chr14 | 94390783 | 94390804 | 94390788 | 94390783 | - |
| SEQ ID NO 49746 | ATGAGGGCCCAGTCTTGTGTCT | TTT | chr14 | 94390778 | 94390799 | 94390783 | 94390778 | - |
| SEQ ID NO 49747 | TGAGGGCCCAGTCTTGTGTCTG | TTA | chr14 | 94390777 | 94390798 | 94390782 | 94390777 | - |
| SEQ ID NO 49748 | GTGTCTGCCGGGCAATGAGCAA | CTT | chr14 | 94390762 | 94390783 | 94390767 | 94390762 | - |
| SEQ ID NO 49749 | TGTCTGCCGGGCAATGAGCAAG | TTG | chr14 | 94390761 | 94390782 | 94390766 | 94390761 | - |
| SEQ ID NO 49750 | CCGGGCAATGAGCAAGGCTCCT | CTG | chr14 | 94390755 | 94390776 | 94390760 | 94390755 | - |
| SEQ ID NO 49751 | CTTCCTGTCCAAGCTCCCCGCC | CTC | chr14 | 94390735 | 94390756 | 94390740 | 94390735 | - |
| SEQ ID NO 49752 | CCTGTCCAAGCTCCCCGCCCCT | CTT | chr14 | 94390732 | 94390753 | 94390737 | 94390732 | - |
| SEQ ID NO 49753 | CTGTCCAAGCTCCCCGCCCCTC | TTC | chr14 | 94390731 | 94390752 | 94390736 | 94390731 | - |
| SEQ ID NO 49754 | TCCAAGCTCCCCGCCCCTCCCC | CTG | chr14 | 94390728 | 94390749 | 94390733 | 94390728 | - |
| SEQ ID NO 49755 | CCCGCCCCTCCCCAGCCTACTG | CTC | chr14 | 94390719 | 94390740 | 94390724 | 94390719 | - |
| SEQ ID NO 49756 | CCCAGCCTACTGCCTCCACCCG | CTC | chr14 | 94390709 | 94390730 | 94390714 | 94390709 | - |
| SEQ ID NO 49757 | CTGCCTCCACCCGAAGTCTACT | CTA | chr14 | 94390700 | 94390721 | 94390705 | 94390700 | - |
| SEQ ID NO 49758 | CCTCCACCCGAAGTCTACTTCC | CTG | chr14 | 94390697 | 94390718 | 94390702 | 94390697 | - |
| SEQ ID NO 49759 | CACCCGAAGTCTACTTCCTGGG | CTC | chr14 | 94390693 | 94390714 | 94390698 | 94390693 | - |
| SEQ ID NO 49760 | CTTCCTGGGTGGGCAGGAACTG | CTA | chr14 | 94390680 | 94390701 | 94390685 | 94390680 | - |
| SEQ ID NO 49761 | CCTGGGTGGGCAGGAACTGGGC | CTT | chr14 | 94390677 | 94390698 | 94390682 | 94390677 | - |

Figure 72 (Cont'd)

| SEQ ID NO 49762 | CTGGGTGGGCAGGAACTGGGCA | TTC | chr14 | 94390676 | 94390697 | 94390681 | 94390676 | - |
|---|---|---|---|---|---|---|---|---|
| SEQ ID NO 49763 | GGTGGGCAGGAACTGGGCACTG | CTG | chr14 | 94390673 | 94390694 | 94390678 | 94390673 | - |
| SEQ ID NO 49764 | GGCACTGTGCCCAGGGCATGCA | CTG | chr14 | 94390658 | 94390679 | 94390663 | 94390658 | - |
| SEQ ID NO 49765 | TGCCCAGGGCATGCACTGCCTC | CTG | chr14 | 94390651 | 94390672 | 94390656 | 94390651 | - |
| SEQ ID NO 49766 | CCTCCACGCAGCAACCCTCAGA | CTG | chr14 | 94390633 | 94390654 | 94390638 | 94390633 | - |
| SEQ ID NO 49767 | CACGCAGCAACCCTCAGAGTCC | CTC | chr14 | 94390629 | 94390650 | 94390634 | 94390629 | - |
| SEQ ID NO 49768 | AGAGTCCTGAGCTGAACCAAGA | CTC | chr14 | 94390614 | 94390635 | 94390619 | 94390614 | - |
| SEQ ID NO 49769 | AGCTGAACCAAGAAGGAGGAGG | CTG | chr14 | 94390605 | 94390626 | 94390610 | 94390605 | - |
| SEQ ID NO 49770 | AACCAAGAAGGAGGAGGGGGTC | CTG | chr14 | 94390600 | 94390621 | 94390605 | 94390600 | - |
| SEQ ID NO 49771 | CGAGGAAGGCCTAGCCGCTGCT | CTC | chr14 | 94390571 | 94390592 | 94390576 | 94390571 | - |
| SEQ ID NO 49772 | GCCGCTGCTGCTGCCAGGAATT | CTA | chr14 | 94390558 | 94390579 | 94390563 | 94390558 | - |
| SEQ ID NO 49773 | CTGCTGCCAGGAATTCCAGGTT | CTG | chr14 | 94390551 | 94390572 | 94390556 | 94390551 | - |
| SEQ ID NO 49774 | CTGCCAGGAATTCCAGGTTGGA | CTG | chr14 | 94390548 | 94390569 | 94390553 | 94390548 | - |
| SEQ ID NO 49775 | CCAGGAATTCCAGGTTGGAGGG | CTG | chr14 | 94390545 | 94390566 | 94390550 | 94390545 | - |
| SEQ ID NO 49776 | CAGGTTGGAGGGGCGGCAACCT | TTC | chr14 | 94390535 | 94390556 | 94390540 | 94390535 | - |
| SEQ ID NO 49777 | GAGGGGCGGCAACCTCCTGCCA | TTG | chr14 | 94390528 | 94390549 | 94390533 | 94390528 | - |
| SEQ ID NO 49778 | CTGCCAGCCTTCAGGCCACTCT | CTC | chr14 | 94390512 | 94390533 | 94390517 | 94390512 | - |
| SEQ ID NO 49779 | CCAGCCTTCAGGCCACTCTCCT | CTG | chr14 | 94390509 | 94390530 | 94390514 | 94390509 | - |
| SEQ ID NO 49780 | CAGGCCACTCTCCTGTGCCTGC | CTT | chr14 | 94390501 | 94390522 | 94390506 | 94390501 | - |
| SEQ ID NO 49781 | AGGCCACTCTCCTGTGCCTGCC | TTC | chr14 | 94390500 | 94390521 | 94390505 | 94390500 | - |
| SEQ ID NO 49782 | TCCTGTGCCTGCCAGAAGAGAC | CTC | chr14 | 94390491 | 94390512 | 94390496 | 94390491 | - |
| SEQ ID NO 49783 | CTGTGCCTGCCAGAAGAGACAG | CTC | chr14 | 94390489 | 94390510 | 94390494 | 94390489 | - |
| SEQ ID NO 49784 | TGCCTGCCAGAAGAGACAGAGC | CTG | chr14 | 94390486 | 94390507 | 94390491 | 94390486 | - |
| SEQ ID NO 49785 | CCAGAAGAGACAGAGCTTGAGG | CTG | chr14 | 94390480 | 94390501 | 94390485 | 94390480 | - |
| SEQ ID NO 49786 | GAGGAGAGCTTGAGGAGAGCAG | CTT | chr14 | 94390462 | 94390483 | 94390467 | 94390462 | - |
| SEQ ID NO 49787 | AGGAGAGCTTGAGGAGAGCAGG | TTG | chr14 | 94390461 | 94390482 | 94390466 | 94390461 | - |
| SEQ ID NO 49788 | GAGGAGAGCAGGAAAGGTGGGA | CTT | chr14 | 94390451 | 94390472 | 94390456 | 94390451 | - |
| SEQ ID NO 49789 | AGGAGAGCAGGAAAGGTGGGAC | TTG | chr14 | 94390450 | 94390471 | 94390455 | 94390450 | - |
| SEQ ID NO 49790 | CTGCTGCTGCTCACTCAGTTCC | TTG | chr14 | 94390424 | 94390445 | 94390429 | 94390424 | - |
| SEQ ID NO 49791 | CTGCTGCTCACTCAGTTCCACA | CTG | chr14 | 94390421 | 94390442 | 94390426 | 94390421 | - |
| SEQ ID NO 49792 | CTGCTCACTCAGTTCCACAGGT | CTG | chr14 | 94390418 | 94390439 | 94390423 | 94390418 | - |
| SEQ ID NO 49793 | CTCACTCAGTTCCACAGGTGGG | CTG | chr14 | 94390415 | 94390436 | 94390420 | 94390415 | - |
| SEQ ID NO 49794 | ACTCAGTTCCACAGGTGGGAGG | CTC | chr14 | 94390412 | 94390433 | 94390417 | 94390412 | - |
| SEQ ID NO 49795 | AGTTCCACAGGTGGGAGGGACA | CTC | chr14 | 94390408 | 94390429 | 94390413 | 94390408 | - |
| SEQ ID NO 49796 | CACAGGTGGGAGGGACAGCAGG | TTC | chr14 | 94390403 | 94390424 | 94390408 | 94390403 | - |
| SEQ ID NO 49797 | AGAGTGGGGTCATTGTGCAGA | CTT | chr14 | 94390377 | 94390398 | 94390382 | 94390377 | - |
| SEQ ID NO 49798 | GAGTGGGGTCATTGTGCAGAT | TTA | chr14 | 94390376 | 94390397 | 94390381 | 94390376 | - |
| SEQ ID NO 49799 | TGCAGATGGGAAAACAAAGGCC | TTG | chr14 | 94390361 | 94390382 | 94390366 | 94390361 | - |
| SEQ ID NO 49800 | CCGAGGGCAGGCGACCTCAACC | CTA | chr14 | 94390310 | 94390331 | 94390315 | 94390310 | - |
| SEQ ID NO 49801 | AACCACAGCCCAGTGCTGGAGC | CTC | chr14 | 94390292 | 94390313 | 94390297 | 94390292 | - |
| SEQ ID NO 49802 | GAGCTGTGAGTGGATGTAGAGC | CTG | chr14 | 94390274 | 94390295 | 94390279 | 94390274 | - |
| SEQ ID NO 49803 | TGAGTGGATGTAGAGCAGCGGA | CTG | chr14 | 94390268 | 94390289 | 94390273 | 94390268 | - |
| SEQ ID NO 49804 | AGCCAGCTCAGGGGAAGGACAG | TTC | chr14 | 94390236 | 94390257 | 94390241 | 94390236 | - |
| SEQ ID NO 49805 | AGGGGAAGGACAGGGGCCCTGA | CTC | chr14 | 94390227 | 94390248 | 94390232 | 94390227 | - |
| SEQ ID NO 49806 | AAGCCAGGGGATGGAGCTGCAG | CTG | chr14 | 94390206 | 94390227 | 94390211 | 94390206 | - |
| SEQ ID NO 49807 | CAGGGAAGGGAGCTCAGAGAGA | CTG | chr14 | 94390187 | 94390208 | 94390192 | 94390187 | - |
| SEQ ID NO 49808 | AGAGAAGGGGAGGGGAGTCT | CTC | chr14 | 94390172 | 94390193 | 94390177 | 94390172 | - |
| SEQ ID NO 49809 | AGCTCAGTTTCCCGCTGCCTGA | CTG | chr14 | 94390149 | 94390170 | 94390154 | 94390149 | - |
| SEQ ID NO 49810 | AGTTTCCCGCTGCCTGAAAGGA | CTC | chr14 | 94390144 | 94390165 | 94390149 | 94390144 | - |
| SEQ ID NO 49811 | CCCGCTGCCTGAAAGGAGGGTG | TTT | chr14 | 94390139 | 94390160 | 94390144 | 94390139 | - |
| SEQ ID NO 49812 | CCGCTGCCTGAAAGGAGGGTGG | TTC | chr14 | 94390138 | 94390159 | 94390143 | 94390138 | - |
| SEQ ID NO 49813 | CCTGAAAGGAGGGTGGTACCTA | CTG | chr14 | 94390132 | 94390153 | 94390137 | 94390132 | - |
| SEQ ID NO 49814 | AAAGGAGGGTGGTACCTACTCC | CTG | chr14 | 94390128 | 94390149 | 94390133 | 94390128 | - |
| SEQ ID NO 49815 | CTCCCTTCACAGGGTAACTGAA | CTA | chr14 | 94390110 | 94390131 | 94390115 | 94390110 | - |
| SEQ ID NO 49816 | CCTTCACAGGGTAACTGAATGA | CTC | chr14 | 94390107 | 94390128 | 94390112 | 94390107 | - |
| SEQ ID NO 49817 | CACAGGGTAACTGAATGAGAGA | CTT | chr14 | 94390103 | 94390124 | 94390108 | 94390103 | - |
| SEQ ID NO 49818 | ACAGGGTAACTGAATGAGAGAC | TTC | chr14 | 94390102 | 94390123 | 94390107 | 94390102 | - |
| SEQ ID NO 49819 | AATGAGAGACTGCCTGGAGGAA | CTG | chr14 | 94390090 | 94390111 | 94390095 | 94390090 | - |
| SEQ ID NO 49820 | CCTGGAGGAAAGCTCTTCAAGT | CTG | chr14 | 94390078 | 94390099 | 94390083 | 94390078 | - |

Figure 72 (Cont'd)

| SEQ ID NO 49821 | GAGGAAAGCTCTTCAAGTGTGG | CTG | chr14 | 94390074 | 94390095 | 94390079 | 94390074 | - |
|---|---|---|---|---|---|---|---|---|
| SEQ ID NO 49822 | TTCAAGTGTGGCCCACCCCACC | CTC | chr14 | 94390063 | 94390084 | 94390068 | 94390063 | - |
| SEQ ID NO 49823 | CAAGTGTGGCCCACCCCACCCC | CTT | chr14 | 94390061 | 94390082 | 94390066 | 94390061 | - |
| SEQ ID NO 49824 | AAGTGTGGCCCACCCCACCCCA | TTC | chr14 | 94390060 | 94390081 | 94390065 | 94390060 | - |
| SEQ ID NO 49825 | ACACGGGGGAGGGAGGGCAGCA | CTG | chr14 | 94390022 | 94390043 | 94390027 | 94390022 | - |
| SEQ ID NO 49826 | TCTGGGCACACCCAGTACCCGT | CTT | chr14 | 94389987 | 94390008 | 94389992 | 94389987 | - |
| SEQ ID NO 49827 | CTGGGCACACCCAGTACCCGTC | TTT | chr14 | 94389986 | 94390007 | 94389991 | 94389986 | - |
| SEQ ID NO 49828 | TGGGCACACCCAGTACCCGTCT | TTC | chr14 | 94389985 | 94390006 | 94389990 | 94389985 | - |
| SEQ ID NO 49829 | GGCACACCCAGTACCCGTCTCT | CTG | chr14 | 94389983 | 94390004 | 94389988 | 94389983 | - |
| SEQ ID NO 49830 | TGAGCTTTCCTTGAACTGTTGC | CTC | chr14 | 94389962 | 94389983 | 94389967 | 94389962 | - |
| SEQ ID NO 49831 | AGCTTTCCTTGAACTGTTGCAT | CTG | chr14 | 94389960 | 94389981 | 94389965 | 94389960 | - |
| SEQ ID NO 49832 | TCCTTGAACTGTTGCATTTTAA | CTT | chr14 | 94389955 | 94389976 | 94389960 | 94389955 | - |
| SEQ ID NO 49833 | CCTTGAACTGTTGCATTTTAAT | TTT | chr14 | 94389954 | 94389975 | 94389959 | 94389954 | - |
| SEQ ID NO 49834 | CTTGAACTGTTGCATTTTAATC | TTC | chr14 | 94389953 | 94389974 | 94389958 | 94389953 | - |
| SEQ ID NO 49835 | GAACTGTTGCATTTTAATCCTC | CTT | chr14 | 94389950 | 94389971 | 94389955 | 94389950 | - |
| SEQ ID NO 49836 | AACTGTTGCATTTTAATCCTCA | TTG | chr14 | 94389949 | 94389970 | 94389954 | 94389949 | - |
| SEQ ID NO 49837 | TTGCATTTTAATCCTCACAGCA | CTG | chr14 | 94389944 | 94389965 | 94389949 | 94389944 | - |
| SEQ ID NO 49838 | CATTTTAATCCTCACAGCAGCT | TTG | chr14 | 94389941 | 94389962 | 94389946 | 94389941 | - |
| SEQ ID NO 49839 | TAATCCTCACAGCAGCTCAACA | TTT | chr14 | 94389936 | 94389957 | 94389941 | 94389936 | - |
| SEQ ID NO 49840 | AATCCTCACAGCAGCTCAACAA | TTT | chr14 | 94389935 | 94389956 | 94389940 | 94389935 | - |
| SEQ ID NO 49841 | ATCCTCACAGCAGCTCAACAAG | TTA | chr14 | 94389934 | 94389955 | 94389939 | 94389934 | - |
| SEQ ID NO 49842 | ACAGCAGCTCAACAAGGTACAT | CTC | chr14 | 94389928 | 94389949 | 94389933 | 94389928 | - |
| SEQ ID NO 49843 | AACAAGGTACATACCGTCACCA | CTC | chr14 | 94389918 | 94389939 | 94389923 | 94389918 | - |
| SEQ ID NO 49844 | TACAGATAGGGAAATTGAGGCT | TTT | chr14 | 94389887 | 94389908 | 94389892 | 94389887 | - |
| SEQ ID NO 49845 | ACAGATAGGGAAATTGAGGCTC | TTT | chr14 | 94389886 | 94389907 | 94389891 | 94389886 | - |
| SEQ ID NO 49846 | CAGATAGGGAAATTGAGGCTCG | TTA | chr14 | 94389885 | 94389906 | 94389890 | 94389885 | - |
| SEQ ID NO 49847 | AGGCTCGGAGCGGTTAAACAAC | TTG | chr14 | 94389870 | 94389891 | 94389875 | 94389870 | - |
| SEQ ID NO 49848 | GGAGCGGTTAAACAACTCACCT | CTC | chr14 | 94389864 | 94389885 | 94389869 | 94389864 | - |
| SEQ ID NO 49849 | AACAACTCACCTGAGGCCTCAC | TTA | chr14 | 94389854 | 94389875 | 94389859 | 94389854 | - |
| SEQ ID NO 49850 | ACCTGAGGCCTCACAGCCAGTA | CTC | chr14 | 94389846 | 94389867 | 94389851 | 94389846 | - |
| SEQ ID NO 49851 | AGGCCTCACAGCCAGTAAGTGG | CTG | chr14 | 94389841 | 94389862 | 94389846 | 94389841 | - |
| SEQ ID NO 49852 | ACAGCCAGTAAGTGGGTTCCCT | CTC | chr14 | 94389834 | 94389855 | 94389839 | 94389834 | - |
| SEQ ID NO 49853 | CCTGGTCTGAATGTGTGTGCTG | TTC | chr14 | 94389815 | 94389836 | 94389820 | 94389815 | - |
| SEQ ID NO 49854 | GTCTGAATGTGTGTGCTGGAGG | CTG | chr14 | 94389811 | 94389832 | 94389816 | 94389811 | - |
| SEQ ID NO 49855 | AATGTGTGTGCTGGAGGATCCT | CTG | chr14 | 94389806 | 94389827 | 94389811 | 94389806 | - |
| SEQ ID NO 49856 | GAGGATCCTGTGGGTCACTCGC | CTG | chr14 | 94389793 | 94389814 | 94389798 | 94389793 | - |
| SEQ ID NO 49857 | TGGGTCACTCGCCTGGTAGAGC | CTG | chr14 | 94389783 | 94389804 | 94389788 | 94389783 | - |
| SEQ ID NO 49858 | GCCTGGTAGAGCCCCAAGGTGG | CTC | chr14 | 94389773 | 94389794 | 94389778 | 94389773 | - |
| SEQ ID NO 49859 | GTAGAGCCCCAAGGTGGAGGCA | CTG | chr14 | 94389768 | 94389789 | 94389773 | 94389768 | - |
| SEQ ID NO 49860 | GTGAATGACAGAAGGGGCAAAA | CTG | chr14 | 94389734 | 94389755 | 94389739 | 94389734 | - |
| SEQ ID NO 49861 | ATCCATTCACTCTGCAAGTATC | CTC | chr14 | 94389704 | 94389725 | 94389709 | 94389704 | - |
| SEQ ID NO 49862 | ACTCTGCAAGTATCTACGGCAC | TTC | chr14 | 94389696 | 94389717 | 94389701 | 94389696 | - |
| SEQ ID NO 49863 | TGCAAGTATCTACGGCACGTAC | CTC | chr14 | 94389692 | 94389713 | 94389697 | 94389692 | - |
| SEQ ID NO 49864 | CAAGTATCTACGGCACGTACG | CTG | chr14 | 94389690 | 94389711 | 94389695 | 94389690 | - |
| SEQ ID NO 49865 | CGGCACGTACGCCAGCTCCAA | CTA | chr14 | 94389680 | 94389701 | 94389685 | 94389680 | - |
| SEQ ID NO 49866 | CCAAGCAGGTTTGCGGGTTGCA | CTC | chr14 | 94389662 | 94389683 | 94389667 | 94389662 | - |
| SEQ ID NO 49867 | GCGGGTTGCACAGCGGGCGATG | TTT | chr14 | 94389650 | 94389671 | 94389655 | 94389650 | - |
| SEQ ID NO 49868 | CGGGTTGCACAGCGGGCGATGC | TTG | chr14 | 94389649 | 94389670 | 94389654 | 94389649 | - |
| SEQ ID NO 49869 | CACAGCGGGCGATGCAATCTGA | TTG | chr14 | 94389642 | 94389663 | 94389647 | 94389642 | - |
| SEQ ID NO 49870 | ATTTAGGCTTTTAAAGGGATTG | CTG | chr14 | 94389621 | 94389642 | 94389626 | 94389621 | - |
| SEQ ID NO 49871 | AGGCTTTTAAAGGGATTGCAAT | TTT | chr14 | 94389617 | 94389638 | 94389622 | 94389617 | - |
| SEQ ID NO 49872 | GGCTTTTAAAGGGATTGCAATC | TTA | chr14 | 94389616 | 94389637 | 94389621 | 94389616 | - |
| SEQ ID NO 49873 | TTAAAGGGATTGCAATCAAGTG | CTT | chr14 | 94389611 | 94389632 | 94389616 | 94389611 | - |
| SEQ ID NO 49874 | TAAAGGGATTGCAATCAAGTGG | TTT | chr14 | 94389610 | 94389631 | 94389615 | 94389610 | - |
| SEQ ID NO 49875 | AAAGGGATTGCAATCAAGTGGG | TTT | chr14 | 94389609 | 94389630 | 94389614 | 94389609 | - |
| SEQ ID NO 49876 | AAGGGATTGCAATCAAGTGGGG | TTA | chr14 | 94389608 | 94389629 | 94389613 | 94389608 | - |
| SEQ ID NO 49877 | CAATCAAGTGGGGCCCCACTAG | TTG | chr14 | 94389599 | 94389620 | 94389604 | 94389599 | - |
| SEQ ID NO 49878 | GCCTCAACCCTGTACCTCCCCT | CTA | chr14 | 94389578 | 94389599 | 94389583 | 94389578 | - |
| SEQ ID NO 49879 | AACCCTGTACCTCCCCTCCCCT | CTC | chr14 | 94389573 | 94389594 | 94389578 | 94389573 | - |

Figure 72 (Cont'd)

| SEQ ID NO 49880 | TACCTCCCCTCCCCTCCACCCC | CTG | chr14 | 94389566 | 94389587 | 94389571 | 94389566 | - |
|---|---|---|---|---|---|---|---|---|
| SEQ ID NO 49881 | CCCTCCCCTCCACCCCCAGCAG | CTC | chr14 | 94389560 | 94389581 | 94389565 | 94389560 | - |
| SEQ ID NO 49882 | CCCTCCACCCCCAGCAGTCTCC | CTC | chr14 | 94389555 | 94389576 | 94389560 | 94389555 | - |
| SEQ ID NO 49883 | CACCCCCAGCAGTCTCCAAAGG | CTC | chr14 | 94389550 | 94389571 | 94389555 | 94389550 | - |
| SEQ ID NO 49884 | CAAAGGCCTCCAACAACCCCAG | CTC | chr14 | 94389534 | 94389555 | 94389539 | 94389534 | - |
| SEQ ID NO 49885 | CAACAACCCCAGAGTGGGGGCC | CTC | chr14 | 94389524 | 94389545 | 94389529 | 94389524 | - |
| SEQ ID NO 49886 | CAAGCTGTATACGGATCACACT | CTC | chr14 | 94389484 | 94389505 | 94389489 | 94389484 | - |
| SEQ ID NO 49887 | TATACGGATCACACTGGTTTTC | CTG | chr14 | 94389477 | 94389498 | 94389482 | 94389477 | - |
| SEQ ID NO 49888 | GTTTTCCAGGAGCAAAAACAGA | CTG | chr14 | 94389461 | 94389482 | 94389466 | 94389461 | - |
| SEQ ID NO 49889 | TCCAGGAGCAAAAACAGAAACA | TTT | chr14 | 94389457 | 94389478 | 94389462 | 94389457 | - |
| SEQ ID NO 49890 | CCAGGAGCAAAAACAGAAACAG | TTT | chr14 | 94389456 | 94389477 | 94389461 | 94389456 | - |
| SEQ ID NO 49891 | CAGGAGCAAAAACAGAAACAGG | TTC | chr14 | 94389455 | 94389476 | 94389460 | 94389455 | - |
| SEQ ID NO 49892 | AGGCTGGTCAAAATTGAACCTC | CTG | chr14 | 94389429 | 94389450 | 94389434 | 94389429 | - |
| SEQ ID NO 49893 | GTCAAAATTGAACCTCCTCCTG | CTG | chr14 | 94389423 | 94389444 | 94389428 | 94389423 | - |
| SEQ ID NO 49894 | AACCTCCTCCTGCTCTGAGCAG | TTG | chr14 | 94389413 | 94389434 | 94389418 | 94389413 | - |
| SEQ ID NO 49895 | CTCCTGCTCTGAGCAGCCTGGG | CTC | chr14 | 94389407 | 94389428 | 94389412 | 94389407 | - |
| SEQ ID NO 49896 | CTGCTCTGAGCAGCCTGGGGGG | CTC | chr14 | 94389404 | 94389425 | 94389409 | 94389404 | - |
| SEQ ID NO 49897 | CTCTGAGCAGCCTGGGGGGCAG | CTG | chr14 | 94389401 | 94389422 | 94389406 | 94389401 | - |
| SEQ ID NO 49898 | TGAGCAGCCTGGGGGGCAGACT | CTC | chr14 | 94389398 | 94389419 | 94389403 | 94389398 | - |
| SEQ ID NO 49899 | AGCAGCCTGGGGGGCAGACTAA | CTG | chr14 | 94389396 | 94389417 | 94389401 | 94389396 | - |
| SEQ ID NO 49900 | GGGGGCAGACTAAGCAGAGGGC | CTG | chr14 | 94389387 | 94389408 | 94389392 | 94389387 | - |
| SEQ ID NO 49901 | AGCAGAGGGCTGTGCAGACCCA | CTA | chr14 | 94389375 | 94389396 | 94389380 | 94389375 | - |
| SEQ ID NO 49902 | TGCAGACCCACATAAAGAGCCT | CTG | chr14 | 94389363 | 94389384 | 94389368 | 94389363 | - |
| SEQ ID NO 49903 | CTGTGTGCCAGGCACTTCACCC | CTA | chr14 | 94389340 | 94389361 | 94389345 | 94389340 | - |
| SEQ ID NO 49904 | TGTGCCAGGCACTTCACCCGAG | CTG | chr14 | 94389337 | 94389358 | 94389342 | 94389337 | - |
| SEQ ID NO 49905 | CACCCGAGGCACTTCACAAGCA | CTT | chr14 | 94389323 | 94389344 | 94389328 | 94389323 | - |
| SEQ ID NO 49906 | ACCCGAGGCACTTCACAAGCAT | TTC | chr14 | 94389322 | 94389343 | 94389327 | 94389322 | - |
| SEQ ID NO 49907 | CACAAGCATGCTTGGGAATGAA | CTT | chr14 | 94389309 | 94389330 | 94389314 | 94389309 | - |
| SEQ ID NO 49908 | ACAAGCATGCTTGGGAATGAAA | TTC | chr14 | 94389308 | 94389329 | 94389313 | 94389308 | - |
| SEQ ID NO 49909 | GGGAATGAAACTTCCAACTCTT | CTT | chr14 | 94389296 | 94389317 | 94389301 | 94389296 | - |
| SEQ ID NO 49910 | GGAATGAAACTTCCAACTCTTT | TTG | chr14 | 94389295 | 94389316 | 94389300 | 94389295 | - |
| SEQ ID NO 49911 | CCAACTCTTTGGGATGCAGGTG | CTT | chr14 | 94389283 | 94389304 | 94389288 | 94389283 | - |
| SEQ ID NO 49912 | CAACTCTTTGGGATGCAGGTGA | TTC | chr14 | 94389282 | 94389303 | 94389287 | 94389282 | - |
| SEQ ID NO 49913 | TTTGGGATGCAGGTGAAACAGT | CTC | chr14 | 94389276 | 94389297 | 94389281 | 94389276 | - |
| SEQ ID NO 49914 | TGGGATGCAGGTGAAACAGTTC | CTT | chr14 | 94389274 | 94389295 | 94389279 | 94389274 | - |
| SEQ ID NO 49915 | GGGATGCAGGTGAAACAGTTCC | TTT | chr14 | 94389273 | 94389294 | 94389278 | 94389273 | - |
| SEQ ID NO 49916 | GGATGCAGGTGAAACAGTTCCT | TTG | chr14 | 94389272 | 94389293 | 94389277 | 94389272 | - |
| SEQ ID NO 49917 | CTGGTTCAGAGAGGTGAAGCGG | TTC | chr14 | 94389252 | 94389273 | 94389257 | 94389252 | - |
| SEQ ID NO 49918 | GTTCAGAGAGGTGAAGCGGCCT | CTG | chr14 | 94389249 | 94389270 | 94389254 | 94389249 | - |
| SEQ ID NO 49919 | AGAGAGGTGAAGCGGCCTGCCT | TTC | chr14 | 94389245 | 94389266 | 94389250 | 94389245 | - |
| SEQ ID NO 49920 | CCTGAGGCAGCACAGCTCTTCT | CTG | chr14 | 94389226 | 94389247 | 94389231 | 94389226 | - |
| SEQ ID NO 49921 | AGGCAGCACAGCTCTTCTTTAC | CTG | chr14 | 94389222 | 94389243 | 94389227 | 94389222 | - |
| SEQ ID NO 49922 | TTCTTTACAGATGTGCTTCCCC | CTC | chr14 | 94389208 | 94389229 | 94389213 | 94389208 | - |
| SEQ ID NO 49923 | CTTTACAGATGTGCTTCCCCAC | CTT | chr14 | 94389206 | 94389227 | 94389211 | 94389206 | - |
| SEQ ID NO 49924 | TTTACAGATGTGCTTCCCCACC | TTC | chr14 | 94389205 | 94389226 | 94389210 | 94389205 | - |
| SEQ ID NO 49925 | TACAGATGTGCTTCCCCACCTC | CTT | chr14 | 94389203 | 94389224 | 94389208 | 94389203 | - |
| SEQ ID NO 49926 | ACAGATGTGCTTCCCCACCTCT | TTT | chr14 | 94389202 | 94389223 | 94389207 | 94389202 | - |
| SEQ ID NO 49927 | CAGATGTGCTTCCCCACCTCTA | TTA | chr14 | 94389201 | 94389222 | 94389206 | 94389201 | - |
| SEQ ID NO 49928 | CCCCACCTCTACCCTGTCTCAC | CTT | chr14 | 94389190 | 94389211 | 94389195 | 94389190 | - |
| SEQ ID NO 49929 | CCCACCTCTACCCTGTCTCACG | TTC | chr14 | 94389189 | 94389210 | 94389194 | 94389189 | - |
| SEQ ID NO 49930 | TACCCTGTCTCACGGCCCCCCA | CTC | chr14 | 94389181 | 94389202 | 94389186 | 94389181 | - |
| SEQ ID NO 49931 | CCCTGTCTCACGGCCCCCCATG | CTA | chr14 | 94389179 | 94389200 | 94389184 | 94389179 | - |
| SEQ ID NO 49932 | TCTCACGGCCCCCCATGCCAGC | CTG | chr14 | 94389174 | 94389195 | 94389179 | 94389174 | - |
| SEQ ID NO 49933 | ACGGCCCCCCATGCCAGCCTGA | CTC | chr14 | 94389170 | 94389191 | 94389175 | 94389170 | - |
| SEQ ID NO 49934 | ACGGTTGTGTCTGCCTCAGTCA | CTG | chr14 | 94389149 | 94389170 | 94389154 | 94389149 | - |
| SEQ ID NO 49935 | TGTCTGCCTCAGTCATGCTCCA | TTG | chr14 | 94389142 | 94389163 | 94389147 | 94389142 | - |
| SEQ ID NO 49936 | CCTCAGTCATGCTCCATTTTTC | CTG | chr14 | 94389136 | 94389157 | 94389141 | 94389136 | - |
| SEQ ID NO 49937 | AGTCATGCTCCATTTTTCCATC | CTC | chr14 | 94389132 | 94389153 | 94389137 | 94389132 | - |
| SEQ ID NO 49938 | CATTTTTCCATCGGGACCATCA | CTC | chr14 | 94389122 | 94389143 | 94389127 | 94389122 | - |

Figure 72 (Cont'd)

| SEQ ID NO 49939 | TTCCATCGGGACCATCAAGAGG | TTT | chr14 | 94389117 | 94389138 | 94389122 | 94389117 | - |
|---|---|---|---|---|---|---|---|---|
| SEQ ID NO 49940 | TCCATCGGGACCATCAAGAGGG | TTT | chr14 | 94389116 | 94389137 | 94389121 | 94389116 | - |
| SEQ ID NO 49941 | CCATCGGGACCATCAAGAGGGT | TTT | chr14 | 94389115 | 94389136 | 94389120 | 94389115 | - |
| SEQ ID NO 49942 | CATCGGGACCATCAAGAGGGTG | TTC | chr14 | 94389114 | 94389135 | 94389119 | 94389114 | - |
| SEQ ID NO 49943 | GTGTCTAAGGCTGACTGGGTAA | TTT | chr14 | 94389089 | 94389110 | 94389094 | 94389089 | - |
| SEQ ID NO 49944 | TGTCTAAGGCTGACTGGGTAAC | TTG | chr14 | 94389088 | 94389109 | 94389093 | 94389088 | - |
| SEQ ID NO 49945 | AGGCTGACTGGGTAACTTTGGA | CTA | chr14 | 94389082 | 94389103 | 94389087 | 94389082 | - |
| SEQ ID NO 49946 | ACTGGGTAACTTTGGATGAGCG | CTG | chr14 | 94389076 | 94389097 | 94389081 | 94389076 | - |
| SEQ ID NO 49947 | GGTAACTTTGGATGAGCGGTCT | CTG | chr14 | 94389072 | 94389093 | 94389077 | 94389072 | - |
| SEQ ID NO 49948 | TGGATGAGCGGTCTCTCCGCTC | CTT | chr14 | 94389064 | 94389085 | 94389069 | 94389064 | - |
| SEQ ID NO 49949 | GGATGAGCGGTCTCTCCGCTCT | TTT | chr14 | 94389063 | 94389084 | 94389068 | 94389063 | - |
| SEQ ID NO 49950 | GATGAGCGGTCTCTCCGCTCTG | TTG | chr14 | 94389062 | 94389083 | 94389067 | 94389062 | - |
| SEQ ID NO 49951 | TCCGCTCTGAGCCTGTTTCCTC | CTC | chr14 | 94389049 | 94389070 | 94389054 | 94389049 | - |
| SEQ ID NO 49952 | CGCTCTGAGCCTGTTTCCTCAT | CTC | chr14 | 94389047 | 94389068 | 94389052 | 94389047 | - |
| SEQ ID NO 49953 | TGAGCCTGTTTCCTCATCTGTC | CTC | chr14 | 94389042 | 94389063 | 94389047 | 94389042 | - |
| SEQ ID NO 49954 | AGCCTGTTTCCTCATCTGTCAA | CTG | chr14 | 94389040 | 94389061 | 94389045 | 94389040 | - |
| SEQ ID NO 49955 | TTTCCTCATCTGTCAAATGGGC | CTG | chr14 | 94389034 | 94389055 | 94389039 | 94389034 | - |
| SEQ ID NO 49956 | CCTCATCTGTCAAATGGGCTCT | TTT | chr14 | 94389031 | 94389052 | 94389036 | 94389031 | - |
| SEQ ID NO 49957 | CTCATCTGTCAAATGGGCTCTA | TTC | chr14 | 94389030 | 94389051 | 94389035 | 94389030 | - |
| SEQ ID NO 49958 | ATCTGTCAAATGGGCTCTAACC | CTC | chr14 | 94389027 | 94389048 | 94389032 | 94389027 | - |
| SEQ ID NO 49959 | TCAAATGGGCTCTAACCCACTC | CTG | chr14 | 94389022 | 94389043 | 94389027 | 94389022 | - |
| SEQ ID NO 49960 | TAACCCACTCTGATCTCCCAGG | CTC | chr14 | 94389010 | 94389031 | 94389015 | 94389010 | - |
| SEQ ID NO 49961 | ACCCACTCTGATCTCCCAGGGC | CTA | chr14 | 94389008 | 94389029 | 94389013 | 94389008 | - |
| SEQ ID NO 49962 | TGATCTCCCAGGGCGGCAGTAA | CTC | chr14 | 94389000 | 94389021 | 94389005 | 94389000 | - |
| SEQ ID NO 49963 | ATCTCCCAGGGCGGCAGTAAGT | CTG | chr14 | 94388998 | 94389019 | 94389003 | 94388998 | - |
| SEQ ID NO 49964 | CCAGGGCGGCAGTAAGTCTTCA | CTC | chr14 | 94388993 | 94389014 | 94388998 | 94388993 | - |
| SEQ ID NO 49965 | CAGCATCAGGCATTTTGGGGTG | CTT | chr14 | 94388973 | 94388994 | 94388978 | 94388973 | - |
| SEQ ID NO 49966 | AGCATCAGGCATTTTGGGGTGA | TTC | chr14 | 94388972 | 94388993 | 94388977 | 94388972 | - |
| SEQ ID NO 49967 | TGGGGTGACTCAGTAAATGGTA | TTT | chr14 | 94388958 | 94388979 | 94388963 | 94388958 | - |
| SEQ ID NO 49968 | GGGGTGACTCAGTAAATGGTAG | TTT | chr14 | 94388957 | 94388978 | 94388962 | 94388957 | - |
| SEQ ID NO 49969 | GGGTGACTCAGTAAATGGTAGA | TTG | chr14 | 94388956 | 94388977 | 94388961 | 94388956 | - |
| SEQ ID NO 49970 | AGTAAATGGTAGATCTTGCTAC | CTC | chr14 | 94388947 | 94388968 | 94388952 | 94388947 | - |
| SEQ ID NO 49971 | GCTACCAGTGGAACAGCCACTA | CTT | chr14 | 94388930 | 94388951 | 94388935 | 94388930 | - |
| SEQ ID NO 49972 | CTACCAGTGGAACAGCCACTAA | TTG | chr14 | 94388929 | 94388950 | 94388934 | 94388929 | - |
| SEQ ID NO 49973 | CCAGTGGAACAGCCACTAAGGA | CTA | chr14 | 94388926 | 94388947 | 94388931 | 94388926 | - |
| SEQ ID NO 49974 | AGGATTCTGCAGTGAGAGCAGA | CTA | chr14 | 94388908 | 94388929 | 94388913 | 94388908 | - |
| SEQ ID NO 49975 | TGCAGTGAGAGCAGAGGGCCAG | TTC | chr14 | 94388901 | 94388922 | 94388906 | 94388901 | - |
| SEQ ID NO 49976 | CAGTGAGAGCAGAGGGCCAGCT | CTG | chr14 | 94388899 | 94388920 | 94388904 | 94388899 | - |
| SEQ ID NO 49977 | AGTGGTACTCTCCCAGAGACTG | CTA | chr14 | 94388876 | 94388897 | 94388881 | 94388876 | - |
| SEQ ID NO 49978 | TCCCAGAGACTGTCTGACTCAC | CTC | chr14 | 94388866 | 94388887 | 94388871 | 94388866 | - |
| SEQ ID NO 49979 | CCAGAGACTGTCTGACTCACGC | CTC | chr14 | 94388864 | 94388885 | 94388869 | 94388864 | - |
| SEQ ID NO 49980 | TCTGACTCACGCCACCCCTCC | CTG | chr14 | 94388854 | 94388875 | 94388859 | 94388854 | - |
| SEQ ID NO 49981 | ACTCACGCCACCCCTCCACCT | CTG | chr14 | 94388850 | 94388871 | 94388855 | 94388850 | - |
| SEQ ID NO 49982 | ACGCCACCCCTCCACCTTGGA | CTC | chr14 | 94388846 | 94388867 | 94388851 | 94388846 | - |
| SEQ ID NO 49983 | CACCTTGGACACAGGACGCTGT | CTC | chr14 | 94388833 | 94388854 | 94388838 | 94388833 | - |
| SEQ ID NO 49984 | GGACACAGGACGCTGTGGTTTC | CTT | chr14 | 94388827 | 94388848 | 94388832 | 94388827 | - |
| SEQ ID NO 49985 | GACACAGGACGCTGTGGTTTCT | TTG | chr14 | 94388826 | 94388847 | 94388831 | 94388826 | - |
| SEQ ID NO 49986 | TGGTTTCTGAGCCAGGTACAAT | CTG | chr14 | 94388812 | 94388833 | 94388817 | 94388812 | - |
| SEQ ID NO 49987 | CTGAGCCAGGTACAATGACTCC | TTT | chr14 | 94388806 | 94388827 | 94388811 | 94388806 | - |
| SEQ ID NO 49988 | TGAGCCAGGTACAATGACTCCT | TTC | chr14 | 94388805 | 94388826 | 94388810 | 94388805 | - |
| SEQ ID NO 49989 | AGCCAGGTACAATGACTCCTTT | CTG | chr14 | 94388803 | 94388824 | 94388808 | 94388803 | - |
| SEQ ID NO 49990 | CTTTCGGTAAGTGCAGTGGAAG | CTC | chr14 | 94388785 | 94388806 | 94388790 | 94388785 | - |
| SEQ ID NO 49991 | TCGGTAAGTGCAGTGGAAGCTG | CTT | chr14 | 94388782 | 94388803 | 94388787 | 94388782 | - |
| SEQ ID NO 49992 | CGGTAAGTGCAGTGGAAGCTGT | TTT | chr14 | 94388781 | 94388802 | 94388786 | 94388781 | - |
| SEQ ID NO 49993 | GGTAAGTGCAGTGGAAGCTGTA | TTC | chr14 | 94388780 | 94388801 | 94388785 | 94388780 | - |
| SEQ ID NO 49994 | TACACTGCCCAGGCAAAGCGTC | CTG | chr14 | 94388760 | 94388781 | 94388765 | 94388760 | - |
| SEQ ID NO 49995 | CCCAGGCAAAGCGTCCGGGCAG | CTG | chr14 | 94388753 | 94388774 | 94388758 | 94388753 | - |
| SEQ ID NO 49996 | AGATCCCAGCCAGTGGACTTAG | CTC | chr14 | 94388715 | 94388736 | 94388720 | 94388715 | - |
| SEQ ID NO 49997 | AGCCCCTGTTTGCTCCTCCGAT | CTT | chr14 | 94388695 | 94388716 | 94388700 | 94388695 | - |

Figure 72 (Cont'd)

| | | | | | | | | |
|---|---|---|---|---|---|---|---|---|
| SEQ ID NO 49998 | GCCCCTGTTTGCTCCTCCGATA | TTA | chr14 | 94388694 | 94388715 | 94388699 | 94388694 | - |
| SEQ ID NO 49999 | TTTGCTCCTCCGATAACTGGGG | CTG | chr14 | 94388687 | 94388708 | 94388692 | 94388687 | - |
| SEQ ID NO 50000 | GCTCCTCCGATAACTGGGGTGA | TTT | chr14 | 94388684 | 94388705 | 94388689 | 94388684 | - |
| SEQ ID NO 50001 | CTCCTCCGATAACTGGGGTGAC | TTG | chr14 | 94388683 | 94388704 | 94388688 | 94388683 | - |
| SEQ ID NO 50002 | CTCCGATAACTGGGGTGACCTT | CTC | chr14 | 94388680 | 94388701 | 94388685 | 94388680 | - |
| SEQ ID NO 50003 | CGATAACTGGGGTGACCTTGGT | CTC | chr14 | 94388677 | 94388698 | 94388682 | 94388677 | - |
| SEQ ID NO 50004 | GGGTGACCTTGGTTAATATTCA | CTG | chr14 | 94388668 | 94388689 | 94388673 | 94388668 | - |
| SEQ ID NO 50005 | GGTTAATATTCACCAGCAGCCT | CTT | chr14 | 94388658 | 94388679 | 94388663 | 94388658 | - |
| SEQ ID NO 50006 | GTTAATATTCACCAGCAGCCTC | TTG | chr14 | 94388657 | 94388678 | 94388662 | 94388657 | - |
| SEQ ID NO 50007 | ATATTCACCAGCAGCCTCCCCC | TTA | chr14 | 94388653 | 94388674 | 94388658 | 94388653 | - |
| SEQ ID NO 50008 | ACCAGCAGCCTCCCCCGTTGCC | TTC | chr14 | 94388647 | 94388668 | 94388652 | 94388647 | - |
| SEQ ID NO 50009 | CCCCGTTGCCCCTCTGGATCCA | CTC | chr14 | 94388635 | 94388656 | 94388640 | 94388635 | - |
| SEQ ID NO 50010 | CCCCTCTGGATCCACTGCTTAA | TTG | chr14 | 94388627 | 94388648 | 94388632 | 94388627 | - |
| SEQ ID NO 50011 | TGGATCCACTGCTTAAATACGG | CTC | chr14 | 94388621 | 94388642 | 94388626 | 94388621 | - |
| SEQ ID NO 50012 | GATCCACTGCTTAAATACGGAC | CTG | chr14 | 94388619 | 94388640 | 94388624 | 94388619 | - |
| SEQ ID NO 50013 | CTTAAATACGGACGAGGACAGG | CTG | chr14 | 94388610 | 94388631 | 94388615 | 94388610 | - |
| SEQ ID NO 50014 | AAATACGGACGAGGACAGGGCC | CTT | chr14 | 94388607 | 94388628 | 94388612 | 94388607 | - |
| SEQ ID NO 50015 | AATACGGACGAGGACAGGGCCC | TTA | chr14 | 94388606 | 94388627 | 94388611 | 94388606 | - |
| SEQ ID NO 50016 | TCTCCTCAGCTTCAGGCACCAC | CTG | chr14 | 94388582 | 94388603 | 94388587 | 94388582 | - |
| SEQ ID NO 50017 | CTCAGCTTCAGGCACCACCACT | CTC | chr14 | 94388578 | 94388599 | 94388583 | 94388578 | - |
| SEQ ID NO 50018 | AGCTTCAGGCACCACCACTGAC | CTC | chr14 | 94388575 | 94388596 | 94388580 | 94388575 | - |
| SEQ ID NO 50019 | CAGGCACCACCACTGACCTGGG | CTT | chr14 | 94388570 | 94388591 | 94388575 | 94388570 | - |
| SEQ ID NO 50020 | AGGCACCACCACTGACCTGGGA | TTC | chr14 | 94388569 | 94388590 | 94388574 | 94388569 | - |
| SEQ ID NO 50021 | ACCTGGGACAGTGAATCGTAAG | CTG | chr14 | 94388555 | 94388576 | 94388560 | 94388555 | - |
| SEQ ID NO 50022 | GGACAGTGAATCGTAAGTATGC | CTG | chr14 | 94388550 | 94388571 | 94388555 | 94388550 | - |
| SEQ ID NO 50023 | TCACTGCGAGAGGTTCTGGAGA | CTT | chr14 | 94388525 | 94388546 | 94388530 | 94388525 | - |
| SEQ ID NO 50024 | CACTGCGAGAGGTTCTGGAGAG | TTT | chr14 | 94388524 | 94388545 | 94388529 | 94388524 | - |
| SEQ ID NO 50025 | ACTGCGAGAGGTTCTGGAGAGG | TTC | chr14 | 94388523 | 94388544 | 94388528 | 94388523 | - |
| SEQ ID NO 50026 | CGAGAGGTTCTGGAGAGGCTTC | CTG | chr14 | 94388519 | 94388540 | 94388524 | 94388519 | - |
| SEQ ID NO 50027 | TGGAGAGGCTTCTGAGCTCCCC | TTC | chr14 | 94388509 | 94388530 | 94388514 | 94388509 | - |
| SEQ ID NO 50028 | GAGAGGCTTCTGAGCTCCCCAT | CTG | chr14 | 94388507 | 94388528 | 94388512 | 94388507 | - |
| SEQ ID NO 50029 | CTGAGCTCCCCATGGCCCAGGC | CTT | chr14 | 94388498 | 94388519 | 94388503 | 94388498 | - |
| SEQ ID NO 50030 | TGAGCTCCCCATGGCCCAGGCA | TTC | chr14 | 94388497 | 94388518 | 94388502 | 94388497 | - |
| SEQ ID NO 50031 | AGCTCCCCATGGCCCAGGCAGG | CTG | chr14 | 94388495 | 94388516 | 94388500 | 94388495 | - |
| SEQ ID NO 50032 | CCCATGGCCCAGGCAGGCAGCA | CTC | chr14 | 94388490 | 94388511 | 94388495 | 94388490 | - |
| SEQ ID NO 50033 | GGGCAGGAGGGGGTTGTGGAG | CTG | chr14 | 94388462 | 94388483 | 94388467 | 94388462 | - |
| SEQ ID NO 50034 | TGGAGTGGGTATCCGCCTGCTG | TTG | chr14 | 94388445 | 94388466 | 94388450 | 94388445 | - |
| SEQ ID NO 50035 | CTGAGGTGCAGGGCAGATGGAG | CTG | chr14 | 94388426 | 94388447 | 94388431 | 94388426 | - |
| SEQ ID NO 50036 | AGGTGCAGGGCAGATGGAGAGG | CTG | chr14 | 94388423 | 94388444 | 94388428 | 94388423 | - |
| SEQ ID NO 50037 | CAGCTGAGCTCCTATTTTCATA | CTG | chr14 | 94388398 | 94388419 | 94388403 | 94388398 | - |
| SEQ ID NO 50038 | AGCTCCTATTTTCATAATAACA | CTG | chr14 | 94388392 | 94388413 | 94388397 | 94388392 | - |
| SEQ ID NO 50039 | CTATTTTCATAATAACAGCAGC | CTC | chr14 | 94388387 | 94388408 | 94388392 | 94388387 | - |
| SEQ ID NO 50040 | TTTTCATAATAACAGCAGCCAT | CTA | chr14 | 94388384 | 94388405 | 94388389 | 94388384 | - |
| SEQ ID NO 50041 | TCATAATAACAGCAGCCATGAG | TTT | chr14 | 94388381 | 94388402 | 94388386 | 94388381 | - |
| SEQ ID NO 50042 | CATAATAACAGCAGCCATGAGG | TTT | chr14 | 94388380 | 94388401 | 94388385 | 94388380 | - |
| SEQ ID NO 50043 | ATAATAACAGCAGCCATGAGGG | TTC | chr14 | 94388379 | 94388400 | 94388384 | 94388379 | - |
| SEQ ID NO 50044 | TGTCCTGTTTCCCAGTCCTGCC | TTG | chr14 | 94388354 | 94388375 | 94388359 | 94388354 | - |
| SEQ ID NO 50045 | TTTCCCAGTCCTGCCCGGTCCC | CTG | chr14 | 94388347 | 94388368 | 94388352 | 94388347 | - |
| SEQ ID NO 50046 | CCCAGTCCTGCCCGGTCCCCCC | TTT | chr14 | 94388344 | 94388365 | 94388349 | 94388344 | - |
| SEQ ID NO 50047 | CCAGTCCTGCCCGGTCCCCCCT | TTC | chr14 | 94388343 | 94388364 | 94388348 | 94388343 | - |
| SEQ ID NO 50048 | CCCGGTCCCCCCTCGGTACCTC | CTG | chr14 | 94388334 | 94388355 | 94388339 | 94388334 | - |
| SEQ ID NO 50049 | GGTACCTCCTGGTGGATACACT | CTC | chr14 | 94388320 | 94388341 | 94388325 | 94388320 | - |
| SEQ ID NO 50050 | CTGGTGGATACACTGGTTCCTG | CTC | chr14 | 94388312 | 94388333 | 94388317 | 94388312 | - |
| SEQ ID NO 50051 | GTGGATACACTGGTTCCTGTAA | CTG | chr14 | 94388309 | 94388330 | 94388314 | 94388309 | - |
| SEQ ID NO 50052 | GTTCCTGTAAGCAGAAGTGGAT | CTG | chr14 | 94388297 | 94388318 | 94388302 | 94388297 | - |
| SEQ ID NO 50053 | CTGTAAGCAGAAGTGGATGAGG | TTC | chr14 | 94388293 | 94388314 | 94388298 | 94388293 | - |
| SEQ ID NO 50054 | TAAGCAGAAGTGGATGAGGGTG | CTG | chr14 | 94388290 | 94388311 | 94388295 | 94388290 | - |
| SEQ ID NO 50055 | GGTCTGCAGTCCTGGCACCCCA | CTA | chr14 | 94388264 | 94388285 | 94388269 | 94388264 | - |
| SEQ ID NO 50056 | CAGTCCTGGCACCCCAGGATGG | CTG | chr14 | 94388258 | 94388279 | 94388263 | 94388258 | - |

Figure 72 (Cont'd)

| | | | | | | | | |
|---|---|---|---|---|---|---|---|---|
| SEQ ID NO 50057 | GCACCCCAGGATGGGGGACACC | CTG | chr14 | 94388250 | 94388271 | 94388255 | 94388250 | - |
| SEQ ID NO 50058 | CTTTCTGTTTGCACAGCTCCTC | TTT | chr14 | 94388190 | 94388211 | 94388195 | 94388190 | - |
| SEQ ID NO 50059 | TTTCTGTTTGCACAGCTCCTCT | TTC | chr14 | 94388189 | 94388210 | 94388194 | 94388189 | - |
| SEQ ID NO 50060 | TCTGTTTGCACAGCTCCTCTGT | CTT | chr14 | 94388187 | 94388208 | 94388192 | 94388187 | - |
| SEQ ID NO 50061 | CTGTTTGCACAGCTCCTCTGTC | TTT | chr14 | 94388186 | 94388207 | 94388191 | 94388186 | - |
| SEQ ID NO 50062 | TGTTTGCACAGCTCCTCTGTCT | TTC | chr14 | 94388185 | 94388206 | 94388190 | 94388185 | - |
| SEQ ID NO 50063 | TTTGCACAGCTCCTCTGTCTGT | CTG | chr14 | 94388183 | 94388204 | 94388188 | 94388183 | - |
| SEQ ID NO 50064 | GCACAGCTCCTCTGTCTGTCGG | TTT | chr14 | 94388180 | 94388201 | 94388185 | 94388180 | - |
| SEQ ID NO 50065 | CACAGCTCCTCTGTCTGTCGGG | TTG | chr14 | 94388179 | 94388200 | 94388184 | 94388179 | - |
| SEQ ID NO 50066 | CTCTGTCTGTCGGGGGCTCCTG | CTC | chr14 | 94388171 | 94388192 | 94388176 | 94388171 | - |
| SEQ ID NO 50067 | TGTCTGTCGGGGGCTCCTGTCT | CTC | chr14 | 94388168 | 94388189 | 94388173 | 94388168 | - |
| SEQ ID NO 50068 | TCTGTCGGGGGCTCCTGTCTGT | CTG | chr14 | 94388166 | 94388187 | 94388171 | 94388166 | - |
| SEQ ID NO 50069 | TCGGGGGCTCCTGTCTGTTGTC | CTG | chr14 | 94388162 | 94388183 | 94388167 | 94388162 | - |
| SEQ ID NO 50070 | CTGTCTGTTGTCTCCTATAAGC | CTC | chr14 | 94388152 | 94388173 | 94388157 | 94388152 | - |
| SEQ ID NO 50071 | TCTGTTGTCTCCTATAAGCCTC | CTG | chr14 | 94388149 | 94388170 | 94388154 | 94388149 | - |
| SEQ ID NO 50072 | TTGTCTCCTATAAGCCTCACCA | CTG | chr14 | 94388145 | 94388166 | 94388150 | 94388145 | - |
| SEQ ID NO 50073 | TCTCCTATAAGCCTCACCACCT | TTG | chr14 | 94388142 | 94388163 | 94388147 | 94388142 | - |
| SEQ ID NO 50074 | CTATAAGCCTCACCACCTCTCC | CTC | chr14 | 94388138 | 94388159 | 94388143 | 94388138 | - |
| SEQ ID NO 50075 | TAAGCCTCACCACCTCTCCTAC | CTA | chr14 | 94388135 | 94388156 | 94388140 | 94388135 | - |
| SEQ ID NO 50076 | ACCACCTCTCCTACTGCTTGGG | CTC | chr14 | 94388127 | 94388148 | 94388132 | 94388127 | - |
| SEQ ID NO 50077 | TCCTACTGCTTGGGCATGCATC | CTC | chr14 | 94388119 | 94388140 | 94388124 | 94388119 | - |
| SEQ ID NO 50078 | CTACTGCTTGGGCATGCATCTT | CTC | chr14 | 94388117 | 94388138 | 94388122 | 94388117 | - |
| SEQ ID NO 50079 | CTGCTTGGGCATGCATCTTTCT | CTA | chr14 | 94388114 | 94388135 | 94388119 | 94388114 | - |
| SEQ ID NO 50080 | CTTGGGCATGCATCTTTCTCCC | CTG | chr14 | 94388111 | 94388132 | 94388116 | 94388111 | - |
| SEQ ID NO 50081 | GGGCATGCATCTTTCTCCCCTT | CTT | chr14 | 94388108 | 94388129 | 94388113 | 94388108 | - |
| SEQ ID NO 50082 | GGCATGCATCTTTCTCCCCTTC | TTG | chr14 | 94388107 | 94388128 | 94388112 | 94388107 | - |
| SEQ ID NO 50083 | TCTCCCCTTCTATAGATGAGGA | CTT | chr14 | 94388095 | 94388116 | 94388100 | 94388095 | - |
| SEQ ID NO 50084 | CTCCCCTTCTATAGATGAGGAG | TTT | chr14 | 94388094 | 94388115 | 94388099 | 94388094 | - |
| SEQ ID NO 50085 | TCCCCTTCTATAGATGAGGAGG | TTC | chr14 | 94388093 | 94388114 | 94388098 | 94388093 | - |
| SEQ ID NO 50086 | CCCTTCTATAGATGAGGAGGTT | CTC | chr14 | 94388091 | 94388112 | 94388096 | 94388091 | - |
| SEQ ID NO 50087 | CTATAGATGAGGAGGTTAAGGT | CTT | chr14 | 94388086 | 94388107 | 94388091 | 94388086 | - |
| SEQ ID NO 50088 | TATAGATGAGGAGGTTAAGGTC | TTC | chr14 | 94388085 | 94388106 | 94388090 | 94388085 | - |
| SEQ ID NO 50089 | TAGATGAGGAGGTTAAGGTCCA | CTA | chr14 | 94388083 | 94388104 | 94388088 | 94388083 | - |
| SEQ ID NO 50090 | AGGTCCAGAGAGGGGTGGGGAG | TTA | chr14 | 94388068 | 94388089 | 94388073 | 94388068 | - |
| SEQ ID NO 50091 | ACATTCTCCATCCCCTCCAGAT | CTC | chr14 | 94388034 | 94388055 | 94388039 | 94388034 | - |
| SEQ ID NO 50092 | TCCATCCCCTCCAGATATGACC | TTC | chr14 | 94388028 | 94388049 | 94388033 | 94388028 | - |
| SEQ ID NO 50093 | CATCCCCTCCAGATATGACCAG | CTC | chr14 | 94388026 | 94388047 | 94388031 | 94388026 | - |
| SEQ ID NO 50094 | CAGATATGACCAGGAACAGACC | CTC | chr14 | 94388017 | 94388038 | 94388022 | 94388017 | - |

Figure 73

| # | Sequence | PAM | Chr | Start | End | Cuts 5' of | Str |
|---|---|---|---|---|---|---|---|
| SEQ ID NO 50095 | CGAGCGAGCCGCGATGACAA | TGG | chr3 | 133746139 | 133746158 | 133746155 | + |
| SEQ ID NO 50096 | TCCCATCAACATTTCTGTGC | TGG | chr3 | 133746184 | 133746203 | 133746200 | + |
| SEQ ID NO 50097 | TGCTGGACTCCTTCCACTCG | CGG | chr3 | 133746201 | 133746220 | 133746217 | + |
| SEQ ID NO 50098 | GCTGGACTCCTTCCACTCGC | GGG | chr3 | 133746202 | 133746221 | 133746218 | + |
| SEQ ID NO 50099 | TTCCACTCGCGGGTCGTCTC | CAG | chr3 | 133746212 | 133746231 | 133746228 | + |
| SEQ ID NO 50100 | CCACTCGCGGGTCGTCTCCA | GAG | chr3 | 133746214 | 133746233 | 133746230 | + |
| SEQ ID NO 50101 | CGCGGGTCGTCTCCAGAGCT | CAG | chr3 | 133746219 | 133746238 | 133746235 | + |
| SEQ ID NO 50102 | GTCTCCAGAGCTCAGAAAAT | GAG | chr3 | 133746227 | 133746246 | 133746243 | + |
| SEQ ID NO 50103 | TCTCCAGAGCTCAGAAAATG | AGG | chr3 | 133746228 | 133746247 | 133746244 | + |
| SEQ ID NO 50104 | AGCTCAGAAAATGAGGTGAT | CAG | chr3 | 133746235 | 133746254 | 133746251 | + |
| SEQ ID NO 50105 | TCAGAAAATGAGGTGATCAG | TGG | chr3 | 133746238 | 133746257 | 133746254 | + |
| SEQ ID NO 50106 | CAGAAAATGAGGTGATCAGT | GGG | chr3 | 133746239 | 133746258 | 133746255 | + |
| SEQ ID NO 50107 | AATGAGGTGATCAGTGGGAC | GAG | chr3 | 133746244 | 133746263 | 133746260 | + |
| SEQ ID NO 50108 | AGGTGATCAGTGGGACGAGT | AAG | chr3 | 133746248 | 133746267 | 133746264 | + |
| SEQ ID NO 50109 | GGTGATCAGTGGGACGAGTA | AGG | chr3 | 133746249 | 133746268 | 133746265 | + |
| SEQ ID NO 50110 | GATCAGTGGGACGAGTAAGG | AAG | chr3 | 133746252 | 133746271 | 133746268 | + |
| SEQ ID NO 50111 | ATCAGTGGGACGAGTAAGGA | AGG | chr3 | 133746253 | 133746272 | 133746269 | + |
| SEQ ID NO 50112 | TCAGTGGGACGAGTAAGGAA | GGG | chr3 | 133746254 | 133746273 | 133746270 | + |
| SEQ ID NO 50113 | CAGTGGGACGAGTAAGGAAG | GGG | chr3 | 133746255 | 133746274 | 133746271 | + |
| SEQ ID NO 50114 | AGTGGGACGAGTAAGGAAGG | GGG | chr3 | 133746256 | 133746275 | 133746272 | + |
| SEQ ID NO 50115 | GTGGGACGAGTAAGGAAGGG | GGG | chr3 | 133746257 | 133746276 | 133746273 | + |
| SEQ ID NO 50116 | GACGAGTAAGGAAGGGGGGT | TGG | chr3 | 133746261 | 133746280 | 133746277 | + |
| SEQ ID NO 50117 | ACGAGTAAGGAAGGGGGGTT | GGG | chr3 | 133746262 | 133746281 | 133746278 | + |
| SEQ ID NO 50118 | GAGTAAGGAAGGGGGGTTGG | GAG | chr3 | 133746264 | 133746283 | 133746280 | + |
| SEQ ID NO 50119 | GTAAGGAAGGGGGGTTGGGA | GAG | chr3 | 133746266 | 133746285 | 133746282 | + |
| SEQ ID NO 50120 | TAAGGAAGGGGGGTTGGGAG | AGG | chr3 | 133746267 | 133746286 | 133746283 | + |
| SEQ ID NO 50121 | AAGGAAGGGGGGTTGGGAGA | GGG | chr3 | 133746268 | 133746287 | 133746284 | + |
| SEQ ID NO 50122 | AGGAAGGGGGGTTGGGAGAG | GGG | chr3 | 133746269 | 133746288 | 133746285 | + |
| SEQ ID NO 50123 | GGGGTTGGGAGAGGGGCGAT | TGG | chr3 | 133746276 | 133746295 | 133746292 | + |
| SEQ ID NO 50124 | GGGTTGGGAGAGGGGCGATT | GGG | chr3 | 133746277 | 133746296 | 133746293 | + |
| SEQ ID NO 50125 | AGAGGGGCGATTGGGCAACC | CGG | chr3 | 133746285 | 133746304 | 133746301 | + |
| SEQ ID NO 50126 | GCAACCCGGCTGCACAAACA | CGG | chr3 | 133746299 | 133746318 | 133746315 | + |
| SEQ ID NO 50127 | CAACCCGGCTGCACAAACAC | GGG | chr3 | 133746300 | 133746319 | 133746316 | + |
| SEQ ID NO 50128 | ACCCGGCTGCACAAACACGG | GAG | chr3 | 133746302 | 133746321 | 133746318 | + |
| SEQ ID NO 50129 | CCCGGCTGCACAAACACGGG | AGG | chr3 | 133746303 | 133746322 | 133746319 | + |
| SEQ ID NO 50130 | TGCACAAACACGGGAGGTCA | AAG | chr3 | 133746309 | 133746328 | 133746325 | + |
| SEQ ID NO 50131 | GGGAGGTCAAAGATTGCGCC | CAG | chr3 | 133746320 | 133746339 | 133746336 | + |
| SEQ ID NO 50132 | AAGATTGCGCCCAGCCCGCC | CAG | chr3 | 133746329 | 133746348 | 133746345 | + |
| SEQ ID NO 50133 | AGATTGCGCCCAGCCCGCCC | AGG | chr3 | 133746330 | 133746349 | 133746346 | + |
| SEQ ID NO 50134 | TGCGCCCAGCCCGCCCAGGC | CGG | chr3 | 133746334 | 133746353 | 133746350 | + |
| SEQ ID NO 50135 | GCGCCCAGCCCGCCCAGGCC | GGG | chr3 | 133746335 | 133746354 | 133746351 | + |
| SEQ ID NO 50136 | CAGCCCGCCCAGGCCGGGAA | TGG | chr3 | 133746340 | 133746359 | 133746356 | + |
| SEQ ID NO 50137 | CCCAGGCCGGGAATGGAATA | AAG | chr3 | 133746347 | 133746366 | 133746363 | + |
| SEQ ID NO 50138 | CCAGGCCGGGAATGGAATAA | AGG | chr3 | 133746348 | 133746367 | 133746364 | + |
| SEQ ID NO 50139 | CAGGCCGGGAATGGAATAAA | GGG | chr3 | 133746349 | 133746368 | 133746365 | + |
| SEQ ID NO 50140 | GGGAATGGAATAAAGGGACG | CGG | chr3 | 133746355 | 133746374 | 133746371 | + |
| SEQ ID NO 50141 | GGAATGGAATAAAGGGACGC | GGG | chr3 | 133746356 | 133746375 | 133746372 | + |
| SEQ ID NO 50142 | GAATGGAATAAAGGGACGCG | GGG | chr3 | 133746357 | 133746376 | 133746373 | + |

Figure 73 (Cont'd)

| SEQ ID NO 50143 | AATAAAGGGACGCGGGGCGC | CGG | chr3 | 133746363 | 133746382 | 133746379 | + |
| SEQ ID NO 50144 | TAAAGGGACGCGGGGCGCCG | GAG | chr3 | 133746365 | 133746384 | 133746381 | + |
| SEQ ID NO 50145 | AAAGGGACGCGGGGCGCCGG | AGG | chr3 | 133746366 | 133746385 | 133746382 | + |
| SEQ ID NO 50146 | GCGGGGCGCCGGAGGCTGCA | CAG | chr3 | 133746374 | 133746393 | 133746390 | + |
| SEQ ID NO 50147 | GGGCGCCGGAGGCTGCACAG | AAG | chr3 | 133746377 | 133746396 | 133746393 | + |
| SEQ ID NO 50148 | GCCGGAGGCTGCACAGAAGC | GAG | chr3 | 133746381 | 133746400 | 133746397 | + |
| SEQ ID NO 50149 | GTCCGACTGTGCTCGCTGCT | CAG | chr3 | 133746403 | 133746422 | 133746419 | + |
| SEQ ID NO 50150 | TCGCTGCTCAGCGCCGCACC | CGG | chr3 | 133746415 | 133746434 | 133746431 | + |
| SEQ ID NO 50151 | CTGCTCAGCGCCGCACCCGG | AAG | chr3 | 133746418 | 133746437 | 133746434 | + |
| SEQ ID NO 50152 | CAGCGCCGCACCCGGAAGAT | GAG | chr3 | 133746423 | 133746442 | 133746439 | + |
| SEQ ID NO 50153 | AGCGCCGCACCCGGAAGATG | AGG | chr3 | 133746424 | 133746443 | 133746440 | + |
| SEQ ID NO 50154 | CCGGAAGATGAGGCTCGCCG | TGG | chr3 | 133746434 | 133746453 | 133746450 | + |
| SEQ ID NO 50155 | CGGAAGATGAGGCTCGCCGT | GGG | chr3 | 133746435 | 133746454 | 133746451 | + |
| SEQ ID NO 50156 | GAAGATGAGGCTCGCCGTGG | GAG | chr3 | 133746437 | 133746456 | 133746453 | + |
| SEQ ID NO 50157 | GCTCGCCGTGGGAGCCCTGC | TGG | chr3 | 133746446 | 133746465 | 133746462 | + |
| SEQ ID NO 50158 | CCTGCTGGTCTGCGCCGTCC | TGG | chr3 | 133746461 | 133746480 | 133746477 | + |
| SEQ ID NO 50159 | CTGCTGGTCTGCGCCGTCCT | GGG | chr3 | 133746462 | 133746481 | 133746478 | + |
| SEQ ID NO 50160 | TGGTCTGCGCCGTCCTGGGT | GAG | chr3 | 133746466 | 133746485 | 133746482 | + |
| SEQ ID NO 50161 | TGCGCCGTCCTGGGTGAGTG | CGG | chr3 | 133746471 | 133746490 | 133746487 | + |
| SEQ ID NO 50162 | GCGCCGTCCTGGGTGAGTGC | GGG | chr3 | 133746472 | 133746491 | 133746488 | + |
| SEQ ID NO 50163 | GTCCTGGGTGAGTGCGGGCA | CGG | chr3 | 133746477 | 133746496 | 133746493 | + |
| SEQ ID NO 50164 | TCCTGGGTGAGTGCGGGCAC | GGG | chr3 | 133746478 | 133746497 | 133746494 | + |
| SEQ ID NO 50165 | CCTGGGTGAGTGCGGGCACG | GGG | chr3 | 133746479 | 133746498 | 133746495 | + |
| SEQ ID NO 50166 | GGGTGAGTGCGGGCACGGGG | TAG | chr3 | 133746482 | 133746501 | 133746498 | + |
| SEQ ID NO 50167 | GCGGGCACGGGGTAGCACCG | CAG | chr3 | 133746490 | 133746509 | 133746506 | + |
| SEQ ID NO 50168 | GGGCACGGGGTAGCACCGCA | GAG | chr3 | 133746492 | 133746511 | 133746508 | + |
| SEQ ID NO 50169 | GGGTAGCACCGCAGAGTCGC | TGG | chr3 | 133746499 | 133746518 | 133746515 | + |
| SEQ ID NO 50170 | CCCGCGCGTTCCCTGCAACC | CGG | chr3 | 133746522 | 133746541 | 133746538 | + |
| SEQ ID NO 50171 | CCGCGCGTTCCCTGCAACCC | GGG | chr3 | 133746523 | 133746542 | 133746539 | + |
| SEQ ID NO 50172 | CGCGTTCCCTGCAACCCGGG | CGG | chr3 | 133746526 | 133746545 | 133746542 | + |
| SEQ ID NO 50173 | CAACCCGGGCGGCCACCGCG | CAG | chr3 | 133746537 | 133746556 | 133746553 | + |
| SEQ ID NO 50174 | GCCTGCATGCACTCCGCGCT | CAG | chr3 | 133746559 | 133746578 | 133746575 | + |
| SEQ ID NO 50175 | CCTGCATGCACTCCGCGCTC | AGG | chr3 | 133746560 | 133746579 | 133746576 | + |
| SEQ ID NO 50176 | CATGCACTCCGCGCTCAGGC | TGG | chr3 | 133746564 | 133746583 | 133746580 | + |
| SEQ ID NO 50177 | GCACTCCGCGCTCAGGCTGG | AAG | chr3 | 133746567 | 133746586 | 133746583 | + |
| SEQ ID NO 50178 | CCGCGCTCAGGCTGGAAGCC | TGG | chr3 | 133746572 | 133746591 | 133746588 | + |
| SEQ ID NO 50179 | CGCGCTCAGGCTGGAAGCCT | GGG | chr3 | 133746573 | 133746592 | 133746589 | + |
| SEQ ID NO 50180 | AGGCTGGAAGCCTGGGTGTC | TGG | chr3 | 133746580 | 133746599 | 133746596 | + |
| SEQ ID NO 50181 | GGCTGGAAGCCTGGGTGTCT | GGG | chr3 | 133746581 | 133746600 | 133746597 | + |
| SEQ ID NO 50182 | GCCTCTCTACGCCCCACCCC | TGG | chr3 | 133746616 | 133746635 | 133746632 | + |
| SEQ ID NO 50183 | CCCCACCCCTGGCCTTTGCT | TGG | chr3 | 133746627 | 133746646 | 133746643 | + |
| SEQ ID NO 50184 | CCCACCCCTGGCCTTTGCTT | GGG | chr3 | 133746628 | 133746647 | 133746644 | + |
| SEQ ID NO 50185 | CTGGCCTTTGCTTGGGCTTC | TAG | chr3 | 133746635 | 133746654 | 133746651 | + |
| SEQ ID NO 50186 | TCCCCTCCTCCTCTTTGTC | CAG | chr3 | 133746685 | 133746704 | 133746701 | + |
| SEQ ID NO 50187 | TCTTTGTCCAGTAAATCTTG | CAG | chr3 | 133746697 | 133746716 | 133746713 | + |
| SEQ ID NO 50188 | TTGTCCAGTAAATCTTGCAG | CAG | chr3 | 133746700 | 133746719 | 133746716 | + |
| SEQ ID NO 50189 | AGCAGTGAAATACAATAAAT | CAG | chr3 | 133746718 | 133746737 | 133746734 | + |
| SEQ ID NO 50190 | CAGTGAAATACAATAAATCA | GAG | chr3 | 133746720 | 133746739 | 133746736 | + |
| SEQ ID NO 50191 | TAAATCAGAGCACGTCTAAC | CAG | chr3 | 133746733 | 133746752 | 133746749 | + |

Figure 73 (Cont'd)

| SEQ ID NO 50192 | AAATCAGAGCACGTCTAACC | AGG | chr3 | 133746734 | 133746753 | 133746750 | + |
| SEQ ID NO 50193 | CTTTGCTGCTGCCTCTTGTC | AAG | chr3 | 133746768 | 133746787 | 133746784 | + |
| SEQ ID NO 50194 | CTTGTCAAGTCCGAACTCCT | TAG | chr3 | 133746782 | 133746801 | 133746798 | + |
| SEQ ID NO 50195 | CAAGTCCGAACTCCTTAGCA | TGG | chr3 | 133746787 | 133746806 | 133746803 | + |
| SEQ ID NO 50196 | AACTCCTTAGCATGGCATTC | AAG | chr3 | 133746795 | 133746814 | 133746811 | + |
| SEQ ID NO 50197 | ACTCCTTAGCATGGCATTCA | AGG | chr3 | 133746796 | 133746815 | 133746812 | + |
| SEQ ID NO 50198 | GCATGGCATTCAAGGCCTCC | CGG | chr3 | 133746804 | 133746823 | 133746820 | + |
| SEQ ID NO 50199 | CATGGCATTCAAGGCCTCCC | GGG | chr3 | 133746805 | 133746824 | 133746821 | + |
| SEQ ID NO 50200 | GGGTCTGACCATTCCCCTTT | CAG | chr3 | 133746825 | 133746844 | 133746841 | + |
| SEQ ID NO 50201 | GTCTGACCATTCCCCTTTCA | GAG | chr3 | 133746827 | 133746846 | 133746843 | + |
| SEQ ID NO 50202 | TCTGACCATTCCCCTTTCAG | AGG | chr3 | 133746828 | 133746847 | 133746844 | + |
| SEQ ID NO 50203 | TTTCAGAGGCTGATGTCCCC | TGG | chr3 | 133746842 | 133746861 | 133746858 | + |
| SEQ ID NO 50204 | TTCAGAGGCTGATGTCCCCT | GGG | chr3 | 133746843 | 133746862 | 133746859 | + |
| SEQ ID NO 50205 | CTGATGTCCCCTGGGTGCCC | TGG | chr3 | 133746851 | 133746870 | 133746867 | + |
| SEQ ID NO 50206 | TGATGTCCCCTGGGTGCCCT | GGG | chr3 | 133746852 | 133746871 | 133746868 | + |
| SEQ ID NO 50207 | ATGTCCCCTGGGTGCCCTGG | GAG | chr3 | 133746854 | 133746873 | 133746870 | + |
| SEQ ID NO 50208 | CCTGGGTGCCCTGGGAGCTG | TAG | chr3 | 133746860 | 133746879 | 133746876 | + |
| SEQ ID NO 50209 | GGAGCTGTAGATGTCCTGCC | AAG | chr3 | 133746873 | 133746892 | 133746889 | + |
| SEQ ID NO 50210 | GAGCTGTAGATGTCCTGCCA | AGG | chr3 | 133746874 | 133746893 | 133746890 | + |
| SEQ ID NO 50211 | CTGTAGATGTCCTGCCAAGG | AAG | chr3 | 133746877 | 133746896 | 133746893 | + |
| SEQ ID NO 50212 | TAGATGTCCTGCCAAGGAAG | CGG | chr3 | 133746880 | 133746899 | 133746896 | + |
| SEQ ID NO 50213 | GCCAAGGAAGCGGTGCCATC | GAG | chr3 | 133746890 | 133746909 | 133746906 | + |
| SEQ ID NO 50214 | AAGGAAGCGGTGCCATCGAG | CGG | chr3 | 133746893 | 133746912 | 133746909 | + |
| SEQ ID NO 50215 | AAGCGGTGCCATCGAGCGGT | CAG | chr3 | 133746897 | 133746916 | 133746913 | + |
| SEQ ID NO 50216 | GCGGTGCCATCGAGCGGTCA | GAG | chr3 | 133746899 | 133746918 | 133746915 | + |
| SEQ ID NO 50217 | GCCATCGAGCGGTCAGAGCA | TGG | chr3 | 133746904 | 133746923 | 133746920 | + |
| SEQ ID NO 50218 | CCATCGAGCGGTCAGAGCAT | GGG | chr3 | 133746905 | 133746924 | 133746921 | + |
| SEQ ID NO 50219 | CATCGAGCGGTCAGAGCATG | GGG | chr3 | 133746906 | 133746925 | 133746922 | + |
| SEQ ID NO 50220 | CGGTCAGAGCATGGGGTTTG | AAG | chr3 | 133746913 | 133746932 | 133746929 | + |
| SEQ ID NO 50221 | CAGAGCATGGGGTTTGAAGC | CAG | chr3 | 133746917 | 133746936 | 133746933 | + |
| SEQ ID NO 50222 | GGGTTTGAAGCCAGACTTCT | TGG | chr3 | 133746926 | 133746945 | 133746942 | + |
| SEQ ID NO 50223 | AAGCCAGACTTCTTGGATCC | AAG | chr3 | 133746933 | 133746952 | 133746949 | + |
| SEQ ID NO 50224 | GACTTCTTGGATCCAAGTCC | TGG | chr3 | 133746939 | 133746958 | 133746955 | + |
| SEQ ID NO 50225 | TCTTGGATCCAAGTCCTGGC | CGG | chr3 | 133746943 | 133746962 | 133746959 | + |
| SEQ ID NO 50226 | AGTCCTGGCCGGCTCCTCAC | CAG | chr3 | 133746954 | 133746973 | 133746970 | + |
| SEQ ID NO 50227 | GTCCTGGCCGGCTCCTCACC | AGG | chr3 | 133746955 | 133746974 | 133746971 | + |
| SEQ ID NO 50228 | TCCTGGCCGGCTCCTCACCA | GGG | chr3 | 133746956 | 133746975 | 133746972 | + |
| SEQ ID NO 50229 | CTGGCCGGCTCCTCACCAGG | GAG | chr3 | 133746958 | 133746977 | 133746974 | + |
| SEQ ID NO 50230 | TGGCCGGCTCCTCACCAGGG | AGG | chr3 | 133746959 | 133746978 | 133746975 | + |
| SEQ ID NO 50231 | GGCCGGCTCCTCACCAGGGA | GGG | chr3 | 133746960 | 133746979 | 133746976 | + |
| SEQ ID NO 50232 | GCCGGCTCCTCACCAGGGAG | GGG | chr3 | 133746961 | 133746980 | 133746977 | + |
| SEQ ID NO 50233 | CCGGCTCCTCACCAGGGAGG | GGG | chr3 | 133746962 | 133746981 | 133746978 | + |
| SEQ ID NO 50234 | CACCAGGGAGGGGTCATCA | CAG | chr3 | 133746971 | 133746990 | 133746987 | + |
| SEQ ID NO 50235 | GGGTCATCACAGCACTTGCC | TGG | chr3 | 133746982 | 133747001 | 133746998 | + |
| SEQ ID NO 50236 | GGTCATCACAGCACTTGCCT | GGG | chr3 | 133746983 | 133747002 | 133746999 | + |
| SEQ ID NO 50237 | TCATCACAGCACTTGCCTGG | GAG | chr3 | 133746985 | 133747004 | 133747001 | + |
| SEQ ID NO 50238 | CATCACAGCACTTGCCTGGG | AGG | chr3 | 133746986 | 133747005 | 133747002 | + |
| SEQ ID NO 50239 | ATCACAGCACTTGCCTGGGA | GGG | chr3 | 133746987 | 133747006 | 133747003 | + |
| SEQ ID NO 50240 | CTTGCCTGGGAGGGTCAAAT | GAG | chr3 | 133746996 | 133747015 | 133747012 | + |

Figure 73 (Cont'd)

| SEQ ID NO 50241 | TTGCCTGGGAGGGTCAAATG | AGG | chr3 | 133746997 | 133747016 | 133747013 | + |
| SEQ ID NO 50242 | TGCCTGGGAGGGTCAAATGA | GGG | chr3 | 133746998 | 133747017 | 133747014 | + |
| SEQ ID NO 50243 | TGGGAGGGTCAAATGAGGGT | CAG | chr3 | 133747002 | 133747021 | 133747018 | + |
| SEQ ID NO 50244 | AGGGTCAAATGAGGGTCAGC | GAG | chr3 | 133747006 | 133747025 | 133747022 | + |
| SEQ ID NO 50245 | GGGTCAAATGAGGGTCAGCG | AGG | chr3 | 133747007 | 133747026 | 133747023 | + |
| SEQ ID NO 50246 | TCAAATGAGGGTCAGCGAGG | TGG | chr3 | 133747010 | 133747029 | 133747026 | + |
| SEQ ID NO 50247 | AATGAGGGTCAGCGAGGTGG | CAG | chr3 | 133747013 | 133747032 | 133747029 | + |
| SEQ ID NO 50248 | TCAGCGAGGTGGCAGATGCT | GAG | chr3 | 133747021 | 133747040 | 133747037 | + |
| SEQ ID NO 50249 | AGGTGGCAGATGCTGAGTAC | CAG | chr3 | 133747027 | 133747046 | 133747043 | + |
| SEQ ID NO 50250 | TGGCAGATGCTGAGTACCAG | TGG | chr3 | 133747030 | 133747049 | 133747046 | + |
| SEQ ID NO 50251 | CAGATGCTGAGTACCAGTGG | CAG | chr3 | 133747033 | 133747052 | 133747049 | + |
| SEQ ID NO 50252 | ATGTTGCACACATCCTGCTA | TGG | chr3 | 133747056 | 133747075 | 133747072 | + |
| SEQ ID NO 50253 | TGTTGCACACATCCTGCTAT | GGG | chr3 | 133747057 | 133747076 | 133747073 | + |
| SEQ ID NO 50254 | GTTGCACACATCCTGCTATG | GGG | chr3 | 133747058 | 133747077 | 133747074 | + |
| SEQ ID NO 50255 | GCACACATCCTGCTATGGGG | CAG | chr3 | 133747061 | 133747080 | 133747077 | + |
| SEQ ID NO 50256 | CACATCCTGCTATGGGGCAG | TGG | chr3 | 133747064 | 133747083 | 133747080 | + |
| SEQ ID NO 50257 | GCCACACTCCCCGACCTCCT | GAG | chr3 | 133747092 | 133747111 | 133747108 | + |
| SEQ ID NO 50258 | CCACACTCCCCGACCTCCTG | AGG | chr3 | 133747093 | 133747112 | 133747109 | + |
| SEQ ID NO 50259 | CACTCCCCGACCTCCTGAGG | TGG | chr3 | 133747096 | 133747115 | 133747112 | + |
| SEQ ID NO 50260 | ACTCCCCGACCTCCTGAGGT | GGG | chr3 | 133747097 | 133747116 | 133747113 | + |
| SEQ ID NO 50261 | CTCCCCGACCTCCTGAGGTG | GGG | chr3 | 133747098 | 133747117 | 133747114 | + |
| SEQ ID NO 50262 | TAACTTCTGCCTGCCATTCA | TGG | chr3 | 133747135 | 133747154 | 133747151 | + |
| SEQ ID NO 50263 | AACTTCTGCCTGCCATTCAT | GGG | chr3 | 133747136 | 133747155 | 133747152 | + |
| SEQ ID NO 50264 | ACTTCTGCCTGCCATTCATG | GGG | chr3 | 133747137 | 133747156 | 133747153 | + |
| SEQ ID NO 50265 | TGGGGCATTTGTCACACTGT | TGG | chr3 | 133747155 | 133747174 | 133747171 | + |
| SEQ ID NO 50266 | GGGGCATTTGTCACACTGTT | GGG | chr3 | 133747156 | 133747175 | 133747172 | + |
| SEQ ID NO 50267 | GGGCATTTGTCACACTGTTG | GGG | chr3 | 133747157 | 133747176 | 133747173 | + |
| SEQ ID NO 50268 | ACTGTTGGGGCTTCCACGTT | TAG | chr3 | 133747170 | 133747189 | 133747186 | + |
| SEQ ID NO 50269 | GTTTAGTTTTCTCTCCCCAT | AAG | chr3 | 133747187 | 133747206 | 133747203 | + |
| SEQ ID NO 50270 | AGTTTTCTCTCCCCATAAGC | TAG | chr3 | 133747191 | 133747210 | 133747207 | + |
| SEQ ID NO 50271 | CCATAAGCTAGCAATTCCTT | GAG | chr3 | 133747203 | 133747222 | 133747219 | + |
| SEQ ID NO 50272 | ATAAGCTAGCAATTCCTTGA | GAG | chr3 | 133747205 | 133747224 | 133747221 | + |
| SEQ ID NO 50273 | AAGCTAGCAATTCCTTGAGA | GAG | chr3 | 133747207 | 133747226 | 133747223 | + |
| SEQ ID NO 50274 | AGCTAGCAATTCCTTGAGAG | AGG | chr3 | 133747208 | 133747227 | 133747224 | + |
| SEQ ID NO 50275 | TACTTGCCTTTATCCCCGCA | CAG | chr3 | 133747240 | 133747259 | 133747256 | + |
| SEQ ID NO 50276 | CTTGCCTTTATCCCCGCACA | GAG | chr3 | 133747242 | 133747261 | 133747258 | + |
| SEQ ID NO 50277 | TCCCCGCACAGAGCACTTCA | CAG | chr3 | 133747252 | 133747271 | 133747268 | + |
| SEQ ID NO 50278 | CCCCGCACAGAGCACTTCAC | AGG | chr3 | 133747253 | 133747272 | 133747269 | + |
| SEQ ID NO 50279 | GAGCACTTCACAGGCTGTGC | AAG | chr3 | 133747262 | 133747281 | 133747278 | + |
| SEQ ID NO 50280 | AGCACTTCACAGGCTGTGCA | AGG | chr3 | 133747263 | 133747282 | 133747279 | + |
| SEQ ID NO 50281 | GTGCAAGGTAATGCTCCACT | GAG | chr3 | 133747278 | 133747297 | 133747294 | + |
| SEQ ID NO 50282 | TGCAAGGTAATGCTCCACTG | AGG | chr3 | 133747279 | 133747298 | 133747295 | + |
| SEQ ID NO 50283 | TGAGGACACATTCTCGCCTA | TGG | chr3 | 133747297 | 133747316 | 133747313 | + |
| SEQ ID NO 50284 | GAGGACACATTCTCGCCTAT | GGG | chr3 | 133747298 | 133747317 | 133747314 | + |
| SEQ ID NO 50285 | ATTCTCGCCTATGGGAACTC | TGG | chr3 | 133747306 | 133747325 | 133747322 | + |
| SEQ ID NO 50286 | TCTCGCCTATGGGAACTCTG | GAG | chr3 | 133747308 | 133747327 | 133747324 | + |
| SEQ ID NO 50287 | CTCGCCTATGGGAACTCTGG | AGG | chr3 | 133747309 | 133747328 | 133747325 | + |
| SEQ ID NO 50288 | GCCTATGGGAACTCTGGAGG | CAG | chr3 | 133747312 | 133747331 | 133747328 | + |
| SEQ ID NO 50289 | CCTATGGGAACTCTGGAGGC | AGG | chr3 | 133747313 | 133747332 | 133747329 | + |

Figure 73 (Cont'd)

| SEQ ID NO 50290 | CTATGGGAACTCTGGAGGCA | GGG | chr3 | 133747314 | 133747333 | 133747330 | + |
| SEQ ID NO 50291 | ACTCTGGAGGCAGGGCTTTG | TGG | chr3 | 133747322 | 133747341 | 133747338 | + |
| SEQ ID NO 50292 | TCTGGAGGCAGGGCTTTGTG | GAG | chr3 | 133747324 | 133747343 | 133747340 | + |
| SEQ ID NO 50293 | CTGGAGGCAGGGCTTTGTGG | AGG | chr3 | 133747325 | 133747344 | 133747341 | + |
| SEQ ID NO 50294 | TGGAGGCAGGGCTTTGTGGA | GGG | chr3 | 133747326 | 133747345 | 133747342 | + |
| SEQ ID NO 50295 | GGAGGCAGGGCTTTGTGGAG | GGG | chr3 | 133747327 | 133747346 | 133747343 | + |
| SEQ ID NO 50296 | GCTTTGTGGAGGGGCTGCCA | CAG | chr3 | 133747336 | 133747355 | 133747352 | + |
| SEQ ID NO 50297 | CTTTGTGGAGGGGCTGCCAC | AGG | chr3 | 133747337 | 133747356 | 133747353 | + |
| SEQ ID NO 50298 | CACAGGCTTATGTTGCCTCC | TAG | chr3 | 133747354 | 133747373 | 133747370 | + |
| SEQ ID NO 50299 | ACAGGCTTATGTTGCCTCCT | AGG | chr3 | 133747355 | 133747374 | 133747371 | + |
| SEQ ID NO 50300 | TTGCCTCCTAGGATTTCCCA | TGG | chr3 | 133747366 | 133747385 | 133747382 | + |
| SEQ ID NO 50301 | TGCCTCCTAGGATTTCCCAT | GGG | chr3 | 133747367 | 133747386 | 133747383 | + |
| SEQ ID NO 50302 | CCTAGGATTTCCCATGGGCC | AAG | chr3 | 133747372 | 133747391 | 133747388 | + |
| SEQ ID NO 50303 | TAGGATTTCCCATGGGCCAA | GAG | chr3 | 133747374 | 133747393 | 133747390 | + |
| SEQ ID NO 50304 | AGGATTTCCCATGGGCCAAG | AGG | chr3 | 133747375 | 133747394 | 133747391 | + |
| SEQ ID NO 50305 | GGATTTCCCATGGGCCAAGA | GGG | chr3 | 133747376 | 133747395 | 133747392 | + |
| SEQ ID NO 50306 | CCATGGGCCAAGAGGGAAAA | TGG | chr3 | 133747383 | 133747402 | 133747399 | + |
| SEQ ID NO 50307 | CATGGGCCAAGAGGGAAAAT | GGG | chr3 | 133747384 | 133747403 | 133747400 | + |
| SEQ ID NO 50308 | ATGGGCCAAGAGGGAAAATG | GGG | chr3 | 133747385 | 133747404 | 133747401 | + |
| SEQ ID NO 50309 | TGGGCCAAGAGGGAAAATGG | GGG | chr3 | 133747386 | 133747405 | 133747402 | + |
| SEQ ID NO 50310 | AGAGGGAAAATGGGGTCGC | TGG | chr3 | 133747393 | 133747412 | 133747409 | + |
| SEQ ID NO 50311 | GAGGGAAAATGGGGTCGCT | GGG | chr3 | 133747394 | 133747413 | 133747410 | + |
| SEQ ID NO 50312 | AGGGAAAATGGGGTCGCTG | GGG | chr3 | 133747395 | 133747414 | 133747411 | + |
| SEQ ID NO 50313 | GAAAATGGGGTCGCTGGGG | TGG | chr3 | 133747398 | 133747417 | 133747414 | + |
| SEQ ID NO 50314 | GTCGCTGGGGTGGCCATCCC | TGG | chr3 | 133747408 | 133747427 | 133747424 | + |
| SEQ ID NO 50315 | GCTGGGGTGGCCATCCCTGG | TGG | chr3 | 133747411 | 133747430 | 133747427 | + |
| SEQ ID NO 50316 | TGGCCCTCCTCATGCATCC | TGG | chr3 | 133747431 | 133747450 | 133747447 | + |
| SEQ ID NO 50317 | GCCCCTCCTCATGCATCCTG | GAG | chr3 | 133747433 | 133747452 | 133747449 | + |
| SEQ ID NO 50318 | CCCTCCTCATGCATCCTGGA | GAG | chr3 | 133747435 | 133747454 | 133747451 | + |
| SEQ ID NO 50319 | TCATGCATCCTGGAGAGCTG | TGG | chr3 | 133747441 | 133747460 | 133747457 | + |
| SEQ ID NO 50320 | CATGCATCCTGGAGAGCTGT | GGG | chr3 | 133747442 | 133747461 | 133747458 | + |
| SEQ ID NO 50321 | AGCTGTGGGCCTCCTCTCCA | CAG | chr3 | 133747456 | 133747475 | 133747472 | + |
| SEQ ID NO 50322 | GCTGTGGGCCTCCTCTCCAC | AGG | chr3 | 133747457 | 133747476 | 133747473 | + |
| SEQ ID NO 50323 | CCTCCTCTCCACAGGCTTTG | TGG | chr3 | 133747465 | 133747484 | 133747481 | + |
| SEQ ID NO 50324 | CAGGCTTTGTGGATCTTCTT | CAG | chr3 | 133747476 | 133747495 | 133747492 | + |
| SEQ ID NO 50325 | GGCTTTGTGGATCTTCTTCA | GAG | chr3 | 133747478 | 133747497 | 133747494 | + |
| SEQ ID NO 50326 | TTGTGGATCTTCTTCAGAGC | CAG | chr3 | 133747482 | 133747501 | 133747498 | + |
| SEQ ID NO 50327 | GGATCTTCTTCAGAGCCAGT | GAG | chr3 | 133747486 | 133747505 | 133747502 | + |
| SEQ ID NO 50328 | CTTCTTCAGAGCCAGTGAGT | CAG | chr3 | 133747490 | 133747509 | 133747506 | + |
| SEQ ID NO 50329 | CCAGTGAGTCAGCCTTGCTG | TGG | chr3 | 133747501 | 133747520 | 133747517 | + |
| SEQ ID NO 50330 | GTGAGTCAGCCTTGCTGTGG | TGG | chr3 | 133747504 | 133747523 | 133747520 | + |
| SEQ ID NO 50331 | GCCTTGCTGTGGTGGCCCAC | AAG | chr3 | 133747512 | 133747531 | 133747528 | + |
| SEQ ID NO 50332 | CCTTGCTGTGGTGGCCCACA | AGG | chr3 | 133747513 | 133747532 | 133747529 | + |
| SEQ ID NO 50333 | TTGCTGTGGTGGCCCACAAG | GAG | chr3 | 133747515 | 133747534 | 133747531 | + |
| SEQ ID NO 50334 | CTGTGGTGGCCCACAAGGAG | TGG | chr3 | 133747518 | 133747537 | 133747534 | + |
| SEQ ID NO 50335 | GTGGTGGCCCACAAGGAGTG | GAG | chr3 | 133747520 | 133747539 | 133747536 | + |
| SEQ ID NO 50336 | CCCACAAGGAGTGGAGATGA | CAG | chr3 | 133747527 | 133747546 | 133747543 | + |
| SEQ ID NO 50337 | CACAAGGAGTGGAGATGACA | GAG | chr3 | 133747529 | 133747548 | 133747545 | + |
| SEQ ID NO 50338 | ACAAGGAGTGGAGATGACAG | AGG | chr3 | 133747530 | 133747549 | 133747546 | + |

Figure 73 (Cont'd)

| | | | | | | | |
|---|---|---|---|---|---|---|---|
| SEQ ID NO 50339 | CAAGGAGTGGAGATGACAGA | GGG | chr3 | 133747531 | 133747550 | 133747547 | + |
| SEQ ID NO 50340 | GTGGAGATGACAGAGGGCCT | TGG | chr3 | 133747537 | 133747556 | 133747553 | + |
| SEQ ID NO 50341 | TGGAGATGACAGAGGGCCTT | GGG | chr3 | 133747538 | 133747557 | 133747554 | + |
| SEQ ID NO 50342 | GGAGATGACAGAGGGCCTTG | GGG | chr3 | 133747539 | 133747558 | 133747555 | + |
| SEQ ID NO 50343 | ATGACAGAGGGCCTTGGGGA | CAG | chr3 | 133747543 | 133747562 | 133747559 | + |
| SEQ ID NO 50344 | TGACAGAGGGCCTTGGGGAC | AGG | chr3 | 133747544 | 133747563 | 133747560 | + |
| SEQ ID NO 50345 | GACAGAGGGCCTTGGGGACA | GGG | chr3 | 133747545 | 133747564 | 133747561 | + |
| SEQ ID NO 50346 | GGGCCTTGGGGACAGGGCAA | AAG | chr3 | 133747551 | 133747570 | 133747567 | + |
| SEQ ID NO 50347 | CAGGGCAAAAGCTCATGTGA | TAG | chr3 | 133747563 | 133747582 | 133747579 | + |
| SEQ ID NO 50348 | AGGGCAAAAGCTCATGTGAT | AGG | chr3 | 133747564 | 133747583 | 133747580 | + |
| SEQ ID NO 50349 | GGGCAAAAGCTCATGTGATA | GGG | chr3 | 133747565 | 133747584 | 133747581 | + |
| SEQ ID NO 50350 | ATGCTGTCTGCAACCACA | TGG | chr3 | 133747588 | 133747607 | 133747604 | + |
| SEQ ID NO 50351 | TGCAACCACATGGATTTTAA | TAG | chr3 | 133747598 | 133747617 | 133747614 | + |
| SEQ ID NO 50352 | TGGATTTTAATAGTTACCCA | TGG | chr3 | 133747608 | 133747627 | 133747624 | + |
| SEQ ID NO 50353 | TTTTAATAGTTACCCATGGC | TGG | chr3 | 133747612 | 133747631 | 133747628 | + |
| SEQ ID NO 50354 | TAGTTACCCATGGCTGGCTT | CAG | chr3 | 133747618 | 133747637 | 133747634 | + |
| SEQ ID NO 50355 | GCTTCAGCTTTTTTTGTGAA | TGG | chr3 | 133747634 | 133747653 | 133747650 | + |
| SEQ ID NO 50356 | TCAGCTTTTTTTGTGAATGG | CAG | chr3 | 133747637 | 133747656 | 133747653 | + |
| SEQ ID NO 50357 | TTTTGTGAATGGCAGCCAAA | AAG | chr3 | 133747645 | 133747664 | 133747661 | + |
| SEQ ID NO 50358 | TGAATGGCAGCCAAAAGTG | TGG | chr3 | 133747650 | 133747669 | 133747666 | + |
| SEQ ID NO 50359 | GCCAAAAGTGTGGTGAAAA | TGG | chr3 | 133747659 | 133747678 | 133747675 | + |
| SEQ ID NO 50360 | CAAAAGTGTGGTGAAAATG | GAG | chr3 | 133747661 | 133747680 | 133747677 | + |
| SEQ ID NO 50361 | AAAAGTGTGGTGAAAATGG | AGG | chr3 | 133747662 | 133747681 | 133747678 | + |
| SEQ ID NO 50362 | AAAAGTGTGGTGAAAATGGA | GGG | chr3 | 133747663 | 133747682 | 133747679 | + |
| SEQ ID NO 50363 | GTGTGGTGAAAATGGAGGGA | TAG | chr3 | 133747667 | 133747686 | 133747683 | + |
| SEQ ID NO 50364 | GTGAAAATGGAGGGATAGTT | CAG | chr3 | 133747672 | 133747691 | 133747688 | + |
| SEQ ID NO 50365 | AAAATGGAGGGATAGTTCAG | TGG | chr3 | 133747675 | 133747694 | 133747691 | + |
| SEQ ID NO 50366 | AATGGAGGGATAGTTCAGTG | GAG | chr3 | 133747677 | 133747696 | 133747693 | + |
| SEQ ID NO 50367 | GAGGGATAGTTCAGTGGAGA | CAG | chr3 | 133747681 | 133747700 | 133747697 | + |
| SEQ ID NO 50368 | GGGATAGTTCAGTGGAGACA | GAG | chr3 | 133747683 | 133747702 | 133747699 | + |
| SEQ ID NO 50369 | GGATAGTTCAGTGGAGACAG | AGG | chr3 | 133747684 | 133747703 | 133747700 | + |
| SEQ ID NO 50370 | GATAGTTCAGTGGAGACAGA | GGG | chr3 | 133747685 | 133747704 | 133747701 | + |
| SEQ ID NO 50371 | ATAGTTCAGTGGAGACAGAG | GGG | chr3 | 133747686 | 133747705 | 133747702 | + |
| SEQ ID NO 50372 | AGTTCAGTGGAGACAGAGGG | GAG | chr3 | 133747688 | 133747707 | 133747704 | + |
| SEQ ID NO 50373 | AGGGGAGACTGTTGAATTTG | TGG | chr3 | 133747704 | 133747723 | 133747720 | + |
| SEQ ID NO 50374 | GGGAGACTGTTGAATTTGTG | GAG | chr3 | 133747706 | 133747725 | 133747722 | + |
| SEQ ID NO 50375 | TGTTGAATTTGTGGAGTTTT | TAG | chr3 | 133747713 | 133747732 | 133747729 | + |
| SEQ ID NO 50376 | AGTTTTAGTTCTTCCTAAA | CAG | chr3 | 133747727 | 133747746 | 133747743 | + |
| SEQ ID NO 50377 | TTTTTAGTTCTTCCTAAACA | GAG | chr3 | 133747729 | 133747748 | 133747745 | + |
| SEQ ID NO 50378 | TTTAGTTCTTCCTAAACAGA | GAG | chr3 | 133747731 | 133747750 | 133747747 | + |
| SEQ ID NO 50379 | TCTTCCTAAACAGAGAGCAA | CAG | chr3 | 133747737 | 133747756 | 133747753 | + |
| SEQ ID NO 50380 | CTAAACAGAGAGCAACAGAC | AAG | chr3 | 133747742 | 133747761 | 133747758 | + |
| SEQ ID NO 50381 | AAACAGAGAGCAACAGACAA | GAG | chr3 | 133747744 | 133747763 | 133747760 | + |
| SEQ ID NO 50382 | AGAGCAACAGACAAGAGTTA | CAG | chr3 | 133747750 | 133747769 | 133747766 | + |
| SEQ ID NO 50383 | GTTAATTTACCCTCAACTAC | TGG | chr3 | 133747790 | 133747809 | 133747806 | + |
| SEQ ID NO 50384 | TTTACCCTCAACTACTGGCC | AAG | chr3 | 133747795 | 133747814 | 133747811 | + |
| SEQ ID NO 50385 | ACCCTCAACTACTGGCCAAG | AAG | chr3 | 133747798 | 133747817 | 133747814 | + |
| SEQ ID NO 50386 | CCCTCAACTACTGGCCAAGA | AGG | chr3 | 133747799 | 133747818 | 133747815 | + |
| SEQ ID NO 50387 | CCTCAACTACTGGCCAAGAA | GGG | chr3 | 133747800 | 133747819 | 133747816 | + |

Figure 73 (Cont'd)

| SEQ ID NO 50388 | CTCAACTACTGGCCAAGAAG | GGG | chr3 | 133747801 | 133747820 | 133747817 | + |
| SEQ ID NO 50389 | GGCCAAGAAGGGGTGTAACT | CAG | chr3 | 133747811 | 133747830 | 133747827 | + |
| SEQ ID NO 50390 | GTTTTCTTCTTTTGTGCCCT | GAG | chr3 | 133747837 | 133747856 | 133747853 | + |
| SEQ ID NO 50391 | TTCTTCTTTTGTGCCCTGAG | TAG | chr3 | 133747840 | 133747859 | 133747856 | + |
| SEQ ID NO 50392 | TTCTTTTGTGCCCTGAGTAG | CAG | chr3 | 133747843 | 133747862 | 133747859 | + |
| SEQ ID NO 50393 | TGTGCCCTGAGTAGCAGACC | CAG | chr3 | 133747849 | 133747868 | 133747865 | + |
| SEQ ID NO 50394 | TGCCCTGAGTAGCAGACCCA | GAG | chr3 | 133747851 | 133747870 | 133747867 | + |
| SEQ ID NO 50395 | TGAGTAGCAGACCCAGAGTC | TGG | chr3 | 133747856 | 133747875 | 133747872 | + |
| SEQ ID NO 50396 | AGTAGCAGACCCAGAGTCTG | GAG | chr3 | 133747858 | 133747877 | 133747874 | + |
| SEQ ID NO 50397 | AGACCCAGAGTCTGGAGACC | CAG | chr3 | 133747864 | 133747883 | 133747880 | + |
| SEQ ID NO 50398 | GAGTCTGGAGACCCAGATTC | TAG | chr3 | 133747871 | 133747890 | 133747887 | + |
| SEQ ID NO 50399 | AGTCTGGAGACCCAGATTCT | AGG | chr3 | 133747872 | 133747891 | 133747888 | + |
| SEQ ID NO 50400 | GGAGACCCAGATTCTAGGCC | TGG | chr3 | 133747877 | 133747896 | 133747893 | + |
| SEQ ID NO 50401 | CCCAGATTCTAGGCCTGGCT | TGG | chr3 | 133747882 | 133747901 | 133747898 | + |
| SEQ ID NO 50402 | GGCCTGGCTTGGCCAACGAC | AAG | chr3 | 133747893 | 133747912 | 133747909 | + |
| SEQ ID NO 50403 | CTGGCTTGGCCAACGACAAG | CAG | chr3 | 133747896 | 133747915 | 133747912 | + |
| SEQ ID NO 50404 | TGGCTTGGCCAACGACAAGC | AGG | chr3 | 133747897 | 133747916 | 133747913 | + |
| SEQ ID NO 50405 | GGCTTGGCCAACGACAAGCA | GGG | chr3 | 133747898 | 133747917 | 133747914 | + |
| SEQ ID NO 50406 | AACGACAAGCAGGGTGACCT | TGG | chr3 | 133747907 | 133747926 | 133747923 | + |
| SEQ ID NO 50407 | ACGACAAGCAGGGTGACCTT | GGG | chr3 | 133747908 | 133747927 | 133747924 | + |
| SEQ ID NO 50408 | CCTTGGGTTAAAAAAAAAAA | AAG | chr3 | 133747924 | 133747943 | 133747940 | + |
| SEQ ID NO 50409 | CTTGGGTTAAAAAAAAAAAA | AGG | chr3 | 133747925 | 133747944 | 133747941 | + |
| SEQ ID NO 50410 | AAAAAAGGCATCATTCTCT | GAG | chr3 | 133747939 | 133747958 | 133747955 | + |
| SEQ ID NO 50411 | TCTCACTCCCTCTTCTCAAA | AAG | chr3 | 133747962 | 133747981 | 133747978 | + |
| SEQ ID NO 50412 | ACTCCCTCTTCTCAAAAGA | TGG | chr3 | 133747966 | 133747985 | 133747982 | + |
| SEQ ID NO 50413 | GATGGCAATTCCTCCCCCGC | TGG | chr3 | 133747984 | 133748003 | 133748000 | + |
| SEQ ID NO 50414 | CCTCCCCCGCTGGTTTTCCA | TAG | chr3 | 133747994 | 133748013 | 133748010 | + |
| SEQ ID NO 50415 | CCCGCTGGTTTTCCATAGTT | GAG | chr3 | 133747999 | 133748018 | 133748015 | + |
| SEQ ID NO 50416 | CCGCTGGTTTTCCATAGTTG | AGG | chr3 | 133748000 | 133748019 | 133748016 | + |
| SEQ ID NO 50417 | CTGGTTTTCCATAGTTGAGG | TAG | chr3 | 133748003 | 133748022 | 133748019 | + |
| SEQ ID NO 50418 | TTTTCCATAGTTGAGGTAGC | AAG | chr3 | 133748007 | 133748026 | 133748023 | + |
| SEQ ID NO 50419 | GAGGTAGCAAGCCAATGTGT | TGG | chr3 | 133748019 | 133748038 | 133748035 | + |
| SEQ ID NO 50420 | AGGTAGCAAGCCAATGTGTT | GGG | chr3 | 133748020 | 133748039 | 133748036 | + |
| SEQ ID NO 50421 | GGTAGCAAGCCAATGTGTTG | GGG | chr3 | 133748021 | 133748040 | 133748037 | + |
| SEQ ID NO 50422 | AGCAAGCCAATGTGTTGGGG | TAG | chr3 | 133748024 | 133748043 | 133748040 | + |
| SEQ ID NO 50423 | GAAAACGCCCTGTGCATACT | GAG | chr3 | 133748049 | 133748068 | 133748065 | + |
| SEQ ID NO 50424 | AAAACGCCCTGTGCATACTG | AGG | chr3 | 133748050 | 133748069 | 133748066 | + |
| SEQ ID NO 50425 | ATACTGAGGCTTATGTTCCA | TGG | chr3 | 133748064 | 133748083 | 133748080 | + |
| SEQ ID NO 50426 | TACTGAGGCTTATGTTCCAT | GGG | chr3 | 133748065 | 133748084 | 133748081 | + |
| SEQ ID NO 50427 | ACTGAGGCTTATGTTCCATG | GGG | chr3 | 133748066 | 133748085 | 133748082 | + |
| SEQ ID NO 50428 | CTGAGGCTTATGTTCCATGG | GGG | chr3 | 133748067 | 133748086 | 133748083 | + |
| SEQ ID NO 50429 | TGAGGCTTATGTTCCATGGG | GGG | chr3 | 133748068 | 133748087 | 133748084 | + |
| SEQ ID NO 50430 | GCTTATGTTCCATGGGGGGC | CAG | chr3 | 133748072 | 133748091 | 133748088 | + |
| SEQ ID NO 50431 | CTTATGTTCCATGGGGGGCC | AGG | chr3 | 133748073 | 133748092 | 133748089 | + |
| SEQ ID NO 50432 | TTATGTTCCATGGGGGGCCA | GGG | chr3 | 133748074 | 133748093 | 133748090 | + |
| SEQ ID NO 50433 | TATGTTCCATGGGGGGCCAG | GGG | chr3 | 133748075 | 133748094 | 133748091 | + |
| SEQ ID NO 50434 | TTCCATGGGGGGCCAGGGGC | CAG | chr3 | 133748079 | 133748098 | 133748095 | + |
| SEQ ID NO 50435 | TCCATGGGGGGCCAGGGGCC | AGG | chr3 | 133748080 | 133748099 | 133748096 | + |
| SEQ ID NO 50436 | TGGGGGGCCAGGGGCCAGGA | CAG | chr3 | 133748084 | 133748103 | 133748100 | + |

Figure 73 (Cont'd)

| SEQ ID NO 50437 | GCCAGGGGCCAGGACAGTGA | TGG | chr3 | 133748090 | 133748109 | 133748106 | + |
| SEQ ID NO 50438 | CCAGGGGCCAGGACAGTGAT | GGG | chr3 | 133748091 | 133748110 | 133748107 | + |
| SEQ ID NO 50439 | AGGGGCCAGGACAGTGATGG | GAG | chr3 | 133748093 | 133748112 | 133748109 | + |
| SEQ ID NO 50440 | GGGGCCAGGACAGTGATGGG | AGG | chr3 | 133748094 | 133748113 | 133748110 | + |
| SEQ ID NO 50441 | GGCCAGGACAGTGATGGGAG | GAG | chr3 | 133748096 | 133748115 | 133748112 | + |
| SEQ ID NO 50442 | GGACAGTGATGGGAGGAGAC | AAG | chr3 | 133748101 | 133748120 | 133748117 | + |
| SEQ ID NO 50443 | GACAGTGATGGGAGGAGACA | AGG | chr3 | 133748102 | 133748121 | 133748118 | + |
| SEQ ID NO 50444 | AGTGATGGGAGGAGACAAGG | CGG | chr3 | 133748105 | 133748124 | 133748121 | + |
| SEQ ID NO 50445 | GGGAGGAGACAAGGCGGATA | CAG | chr3 | 133748111 | 133748130 | 133748127 | + |
| SEQ ID NO 50446 | GAGGAGACAAGGCGGATACA | GAG | chr3 | 133748113 | 133748132 | 133748129 | + |
| SEQ ID NO 50447 | AGGAGACAAGGCGGATACAG | AGG | chr3 | 133748114 | 133748133 | 133748130 | + |
| SEQ ID NO 50448 | GAGACAAGGCGGATACAGAG | GAG | chr3 | 133748116 | 133748135 | 133748132 | + |
| SEQ ID NO 50449 | ACAAGGCGGATACAGAGGAG | CAG | chr3 | 133748119 | 133748138 | 133748135 | + |
| SEQ ID NO 50450 | GAGGAGCAGATTGTCATCTC | CAG | chr3 | 133748133 | 133748152 | 133748149 | + |
| SEQ ID NO 50451 | AGCAGATTGTCATCTCCAGC | TGG | chr3 | 133748137 | 133748156 | 133748153 | + |
| SEQ ID NO 50452 | GCAGATTGTCATCTCCAGCT | GGG | chr3 | 133748138 | 133748157 | 133748154 | + |
| SEQ ID NO 50453 | AGATTGTCATCTCCAGCTGG | GAG | chr3 | 133748140 | 133748159 | 133748156 | + |
| SEQ ID NO 50454 | GATTGTCATCTCCAGCTGGG | AGG | chr3 | 133748141 | 133748160 | 133748157 | + |
| SEQ ID NO 50455 | CATCTCCAGCTGGGAGGTGA | TGG | chr3 | 133748147 | 133748166 | 133748163 | + |
| SEQ ID NO 50456 | TGGCCATGCCTGCACCCCTC | TGG | chr3 | 133748167 | 133748186 | 133748183 | + |
| SEQ ID NO 50457 | CATGCCTGCACCCCTCTGGC | CAG | chr3 | 133748171 | 133748190 | 133748187 | + |
| SEQ ID NO 50458 | GCCTGCACCCCTCTGGCCAG | CAG | chr3 | 133748174 | 133748193 | 133748190 | + |
| SEQ ID NO 50459 | CTGCACCCCTCTGGCCAGCA | GAG | chr3 | 133748176 | 133748195 | 133748192 | + |
| SEQ ID NO 50460 | TGCACCCCTCTGGCCAGCAG | AGG | chr3 | 133748177 | 133748196 | 133748193 | + |
| SEQ ID NO 50461 | GCACCCCTCTGGCCAGCAGA | GGG | chr3 | 133748178 | 133748197 | 133748194 | + |
| SEQ ID NO 50462 | CCCCTCTGGCCAGCAGAGGG | TGG | chr3 | 133748181 | 133748200 | 133748197 | + |
| SEQ ID NO 50463 | TCTGGCCAGCAGAGGGTGGT | CAG | chr3 | 133748185 | 133748204 | 133748201 | + |
| SEQ ID NO 50464 | GGCCAGCAGAGGGTGGTCAG | TAG | chr3 | 133748188 | 133748207 | 133748204 | + |
| SEQ ID NO 50465 | GCCAGCAGAGGGTGGTCAGT | AGG | chr3 | 133748189 | 133748208 | 133748205 | + |
| SEQ ID NO 50466 | GAGGGTGGTCAGTAGGAAAC | TGG | chr3 | 133748196 | 133748215 | 133748212 | + |
| SEQ ID NO 50467 | AGGGTGGTCAGTAGGAAACT | GGG | chr3 | 133748197 | 133748216 | 133748213 | + |
| SEQ ID NO 50468 | GGTGGTCAGTAGGAAACTGG | GAG | chr3 | 133748199 | 133748218 | 133748215 | + |
| SEQ ID NO 50469 | GTGGTCAGTAGGAAACTGGG | AGG | chr3 | 133748200 | 133748219 | 133748216 | + |
| SEQ ID NO 50470 | GTAGGAAACTGGGAGGCCAT | TAG | chr3 | 133748207 | 133748226 | 133748223 | + |
| SEQ ID NO 50471 | TAGGAAACTGGGAGGCCATT | AGG | chr3 | 133748208 | 133748227 | 133748224 | + |
| SEQ ID NO 50472 | AGGAAACTGGGAGGCCATTA | GGG | chr3 | 133748209 | 133748228 | 133748225 | + |
| SEQ ID NO 50473 | CCATTAGGGCAACCTTCTAT | TGG | chr3 | 133748223 | 133748242 | 133748239 | + |
| SEQ ID NO 50474 | AGGGCAACCTTCTATTGGCT | CAG | chr3 | 133748228 | 133748247 | 133748244 | + |
| SEQ ID NO 50475 | ACCTTCTATTGGCTCAGACT | CAG | chr3 | 133748234 | 133748253 | 133748250 | + |
| SEQ ID NO 50476 | ATTGGCTCAGACTCAGAATG | CAG | chr3 | 133748241 | 133748260 | 133748257 | + |
| SEQ ID NO 50477 | GGCTCAGACTCAGAATGCAG | TAG | chr3 | 133748244 | 133748263 | 133748260 | + |
| SEQ ID NO 50478 | GCAGTAGAACTTGTGCCCTG | TAG | chr3 | 133748260 | 133748279 | 133748276 | + |
| SEQ ID NO 50479 | CTTGTGCCCTGTAGTGTTCA | TGG | chr3 | 133748269 | 133748288 | 133748285 | + |
| SEQ ID NO 50480 | TGCCCTGTAGTGTTCATGGA | CAG | chr3 | 133748273 | 133748292 | 133748289 | + |
| SEQ ID NO 50481 | GCCCTGTAGTGTTCATGGAC | AGG | chr3 | 133748274 | 133748293 | 133748290 | + |
| SEQ ID NO 50482 | CCTGTAGTGTTCATGGACAG | GAG | chr3 | 133748276 | 133748295 | 133748292 | + |
| SEQ ID NO 50483 | TAGTGTTCATGGACAGGAGT | GAG | chr3 | 133748280 | 133748299 | 133748296 | + |
| SEQ ID NO 50484 | GTGTTCATGGACAGGAGTGA | GAG | chr3 | 133748282 | 133748301 | 133748298 | + |
| SEQ ID NO 50485 | TGTTCATGGACAGGAGTGAG | AGG | chr3 | 133748283 | 133748302 | 133748299 | + |

Figure 73 (Cont'd)

| | | | | | | | |
|---|---|---|---|---|---|---|---|
| SEQ ID NO 50486 | TTCATGGACAGGAGTGAGAG | GAG | chr3 | 133748285 | 133748304 | 133748301 | + |
| SEQ ID NO 50487 | TCATGGACAGGAGTGAGAGG | AGG | chr3 | 133748286 | 133748305 | 133748302 | + |
| SEQ ID NO 50488 | GGACAGGAGTGAGAGGAGGA | CAG | chr3 | 133748290 | 133748309 | 133748306 | + |
| SEQ ID NO 50489 | GACAGGAGTGAGAGGAGGAC | AGG | chr3 | 133748291 | 133748310 | 133748307 | + |
| SEQ ID NO 50490 | AGTGAGAGGAGGACAGGACT | GAG | chr3 | 133748297 | 133748316 | 133748313 | + |
| SEQ ID NO 50491 | GTGAGAGGAGGACAGGACTG | AGG | chr3 | 133748298 | 133748317 | 133748314 | + |
| SEQ ID NO 50492 | TGAGAGGAGGACAGGACTGA | GGG | chr3 | 133748299 | 133748318 | 133748315 | + |
| SEQ ID NO 50493 | GAGAGGAGGACAGGACTGAG | GGG | chr3 | 133748300 | 133748319 | 133748316 | + |
| SEQ ID NO 50494 | AGGACAGGACTGAGGGGATG | TGG | chr3 | 133748306 | 133748325 | 133748322 | + |
| SEQ ID NO 50495 | ACTGAGGGGATGTGGCTGTC | AAG | chr3 | 133748314 | 133748333 | 133748330 | + |
| SEQ ID NO 50496 | CTGAGGGGATGTGGCTGTCA | AGG | chr3 | 133748315 | 133748334 | 133748331 | + |
| SEQ ID NO 50497 | TGTGGCTGTCAAGGCCTTTC | TAG | chr3 | 133748324 | 133748343 | 133748340 | + |
| SEQ ID NO 50498 | GTGGCTGTCAAGGCCTTTCT | AGG | chr3 | 133748325 | 133748344 | 133748341 | + |
| SEQ ID NO 50499 | TGGCTGTCAAGGCCTTTCTA | GGG | chr3 | 133748326 | 133748345 | 133748342 | + |
| SEQ ID NO 50500 | GGCTGTCAAGGCCTTTCTAG | GGG | chr3 | 133748327 | 133748346 | 133748343 | + |
| SEQ ID NO 50501 | GGGCGATGCTGTCTCTCCCT | CAG | chr3 | 133748347 | 133748366 | 133748363 | + |
| SEQ ID NO 50502 | ATGCTGTCTCCCTCAGCA | TAG | chr3 | 133748352 | 133748371 | 133748368 | + |
| SEQ ID NO 50503 | TGCTGTCTCTCCCTCAGCAT | AGG | chr3 | 133748353 | 133748372 | 133748369 | + |
| SEQ ID NO 50504 | GCTGTCTCTCCCTCAGCATA | GGG | chr3 | 133748354 | 133748373 | 133748370 | + |
| SEQ ID NO 50505 | TGTCTCTCCCTCAGCATAGG | GAG | chr3 | 133748356 | 133748375 | 133748372 | + |
| SEQ ID NO 50506 | CTCTCCCTCAGCATAGGGAG | TGG | chr3 | 133748359 | 133748378 | 133748375 | + |
| SEQ ID NO 50507 | TCTCCCTCAGCATAGGGAGT | GGG | chr3 | 133748360 | 133748379 | 133748376 | + |
| SEQ ID NO 50508 | GGAGTGGGCCCTTCCACCTC | TGG | chr3 | 133748375 | 133748394 | 133748391 | + |
| SEQ ID NO 50509 | CACCTCTGGCCTCTCTCCCC | CAG | chr3 | 133748389 | 133748408 | 133748405 | + |
| SEQ ID NO 50510 | ACCTCTGGCCTCTCTCCCCC | AGG | chr3 | 133748390 | 133748409 | 133748406 | + |
| SEQ ID NO 50511 | CCTCTGGCCTCTCTCCCCCA | GGG | chr3 | 133748391 | 133748410 | 133748407 | + |
| SEQ ID NO 50512 | CTCTCCCCAGGGCTGTGTC | TGG | chr3 | 133748401 | 133748420 | 133748417 | + |
| SEQ ID NO 50513 | GCTGTCCTGATAAAACTGT | GAG | chr3 | 133748423 | 133748442 | 133748439 | + |
| SEQ ID NO 50514 | TCCCTGATAAAACTGTGAGA | TGG | chr3 | 133748427 | 133748446 | 133748443 | + |
| SEQ ID NO 50515 | TAAAACTGTGAGATGGTGTG | CAG | chr3 | 133748434 | 133748453 | 133748450 | + |
| SEQ ID NO 50516 | TGTGAGATGGTGTGCAGTGT | CGG | chr3 | 133748440 | 133748459 | 133748456 | + |
| SEQ ID NO 50517 | TGAGATGGTGTGCAGTGTCG | GAG | chr3 | 133748442 | 133748461 | 133748458 | + |
| SEQ ID NO 50518 | GGTGTGCAGTGTCGGAGCAT | GAG | chr3 | 133748448 | 133748467 | 133748464 | + |
| SEQ ID NO 50519 | GTGTGCAGTGTCGGAGCATG | AGG | chr3 | 133748449 | 133748468 | 133748465 | + |
| SEQ ID NO 50520 | TGTCGGAGCATGAGGCCACT | AAG | chr3 | 133748457 | 133748476 | 133748473 | + |
| SEQ ID NO 50521 | AGCATGAGGCCACTAAGTGC | CAG | chr3 | 133748463 | 133748482 | 133748479 | + |
| SEQ ID NO 50522 | CATGAGGCCACTAAGTGCCA | GAG | chr3 | 133748465 | 133748484 | 133748481 | + |
| SEQ ID NO 50523 | AGTTCCGCGACCATATGAA | AAG | chr3 | 133748486 | 133748505 | 133748502 | + |
| SEQ ID NO 50524 | AAAAGCGTCATTCCATCCGA | TGG | chr3 | 133748504 | 133748523 | 133748520 | + |
| SEQ ID NO 50525 | GTCATTCCATCCGATGGTCC | CAG | chr3 | 133748510 | 133748529 | 133748526 | + |
| SEQ ID NO 50526 | GTCCAGTGTTGCTTGTGTG | AAG | chr3 | 133748526 | 133748545 | 133748542 | + |
| SEQ ID NO 50527 | CAGTGTTGCTTGTGTGAAGA | AAG | chr3 | 133748530 | 133748549 | 133748546 | + |
| SEQ ID NO 50528 | GCCTCCTACCTTGATTGCAT | CAG | chr3 | 133748552 | 133748571 | 133748568 | + |
| SEQ ID NO 50529 | CCTCCTACCTTGATTGCATC | AGG | chr3 | 133748553 | 133748572 | 133748569 | + |
| SEQ ID NO 50530 | CTCCTACCTTGATTGCATCA | GGG | chr3 | 133748554 | 133748573 | 133748570 | + |
| SEQ ID NO 50531 | GCAATGGCCCTGATGCAATC | AAG | chr3 | 133748564 | 133748583 | 133748567 | - |
| SEQ ID NO 50532 | CAATGGCCCTGATGCAATCA | AGG | chr3 | 133748563 | 133748582 | 133748566 | - |
| SEQ ID NO 50533 | TGGCCCTGATGCAATCAAGG | TAG | chr3 | 133748560 | 133748579 | 133748563 | - |
| SEQ ID NO 50534 | GGCCCTGATGCAATCAAGGT | AGG | chr3 | 133748559 | 133748578 | 133748562 | - |

Figure 73 (Cont'd)

| | | | | | | | |
|---|---|---|---|---|---|---|---|
| SEQ ID NO 50535 | CCCTGATGCAATCAAGGTAG | GAG | chr3 | 133748557 | 133748576 | 133748560 | - |
| SEQ ID NO 50536 | CCTGATGCAATCAAGGTAGG | AGG | chr3 | 133748556 | 133748575 | 133748559 | - |
| SEQ ID NO 50537 | GTAGGAGGCTTTCTTCACAC | AAG | chr3 | 133748541 | 133748560 | 133748544 | - |
| SEQ ID NO 50538 | TTTCTTCACACAAGCAACAC | TGG | chr3 | 133748532 | 133748551 | 133748535 | - |
| SEQ ID NO 50539 | TTCTTCACACAAGCAACACT | GGG | chr3 | 133748531 | 133748550 | 133748534 | - |
| SEQ ID NO 50540 | ACAAGCAACACTGGGACCAT | CGG | chr3 | 133748523 | 133748542 | 133748526 | - |
| SEQ ID NO 50541 | GCAACACTGGGACCATCGGA | TGG | chr3 | 133748519 | 133748538 | 133748522 | - |
| SEQ ID NO 50542 | ATGGAATGACGCTTTTCATA | TGG | chr3 | 133748500 | 133748519 | 133748503 | - |
| SEQ ID NO 50543 | TGACGCTTTTCATATGGTCG | CGG | chr3 | 133748494 | 133748513 | 133748497 | - |
| SEQ ID NO 50544 | TCATATGGTCGCGGAAACTC | TGG | chr3 | 133748485 | 133748504 | 133748488 | - |
| SEQ ID NO 50545 | GTCGCGGAAACTCTGGCACT | TAG | chr3 | 133748478 | 133748497 | 133748481 | - |
| SEQ ID NO 50546 | GCGGAAACTCTGGCACTTAG | TGG | chr3 | 133748475 | 133748494 | 133748478 | - |
| SEQ ID NO 50547 | CGACACTGCACACCATCTCA | CAG | chr3 | 133748442 | 133748461 | 133748445 | - |
| SEQ ID NO 50548 | ACACCATCTCACAGTTTTAT | CAG | chr3 | 133748433 | 133748452 | 133748436 | - |
| SEQ ID NO 50549 | CACCATCTCACAGTTTTATC | AGG | chr3 | 133748432 | 133748451 | 133748435 | - |
| SEQ ID NO 50550 | ACCATCTCACAGTTTTATCA | GGG | chr3 | 133748431 | 133748450 | 133748434 | - |
| SEQ ID NO 50551 | TCTCACAGTTTTATCAGGGA | CAG | chr3 | 133748427 | 133748446 | 133748430 | - |
| SEQ ID NO 50552 | ACAGTTTTATCAGGGACAGC | CAG | chr3 | 133748423 | 133748442 | 133748426 | - |
| SEQ ID NO 50553 | TTATCAGGGACAGCCAGACA | CAG | chr3 | 133748417 | 133748436 | 133748420 | - |
| SEQ ID NO 50554 | GGGACAGCCAGACACAGCCC | TGG | chr3 | 133748411 | 133748430 | 133748414 | - |
| SEQ ID NO 50555 | GGACAGCCAGACACAGCCCT | GGG | chr3 | 133748410 | 133748429 | 133748413 | - |
| SEQ ID NO 50556 | GACAGCCAGACACAGCCCTG | GGG | chr3 | 133748409 | 133748428 | 133748412 | - |
| SEQ ID NO 50557 | ACAGCCAGACACAGCCCTGG | GGG | chr3 | 133748408 | 133748427 | 133748411 | - |
| SEQ ID NO 50558 | AGCCAGACACAGCCCTGGGG | GAG | chr3 | 133748406 | 133748425 | 133748409 | - |
| SEQ ID NO 50559 | CCAGACACAGCCCTGGGGGA | GAG | chr3 | 133748404 | 133748423 | 133748407 | - |
| SEQ ID NO 50560 | AGACACAGCCCTGGGGGAGA | GAG | chr3 | 133748402 | 133748421 | 133748405 | - |
| SEQ ID NO 50561 | GACACAGCCCTGGGGGAGAG | AGG | chr3 | 133748401 | 133748420 | 133748404 | - |
| SEQ ID NO 50562 | CAGCCCTGGGGGAGAGAGGC | CAG | chr3 | 133748397 | 133748416 | 133748400 | - |
| SEQ ID NO 50563 | GCCCTGGGGGAGAGAGGCCA | GAG | chr3 | 133748395 | 133748414 | 133748398 | - |
| SEQ ID NO 50564 | CCCTGGGGGAGAGAGGCCAG | AGG | chr3 | 133748394 | 133748413 | 133748397 | - |
| SEQ ID NO 50565 | TGGGGGAGAGAGGCCAGAGG | TGG | chr3 | 133748391 | 133748410 | 133748394 | - |
| SEQ ID NO 50566 | GGGAGAGAGGCCAGAGGTGG | AAG | chr3 | 133748388 | 133748407 | 133748391 | - |
| SEQ ID NO 50567 | GGAGAGAGGCCAGAGGTGGA | AGG | chr3 | 133748387 | 133748406 | 133748390 | - |
| SEQ ID NO 50568 | GAGAGAGGCCAGAGGTGGAA | GGG | chr3 | 133748386 | 133748405 | 133748389 | - |
| SEQ ID NO 50569 | AAGGGCCCACTCCCTATGCT | GAG | chr3 | 133748368 | 133748387 | 133748371 | - |
| SEQ ID NO 50570 | AGGGCCCACTCCCTATGCTG | AGG | chr3 | 133748367 | 133748386 | 133748370 | - |
| SEQ ID NO 50571 | GGGCCCACTCCCTATGCTGA | GGG | chr3 | 133748366 | 133748385 | 133748369 | - |
| SEQ ID NO 50572 | GCCCACTCCCTATGCTGAGG | GAG | chr3 | 133748364 | 133748383 | 133748367 | - |
| SEQ ID NO 50573 | CCACTCCCTATGCTGAGGGA | GAG | chr3 | 133748362 | 133748381 | 133748365 | - |
| SEQ ID NO 50574 | TCCCTATGCTGAGGGAGAGA | CAG | chr3 | 133748358 | 133748377 | 133748361 | - |
| SEQ ID NO 50575 | GGGAGAGACAGCATCGCCCC | TAG | chr3 | 133748346 | 133748365 | 133748349 | - |
| SEQ ID NO 50576 | GAGACAGCATCGCCCCTAGA | AAG | chr3 | 133748342 | 133748361 | 133748345 | - |
| SEQ ID NO 50577 | AGACAGCATCGCCCCTAGAA | AGG | chr3 | 133748341 | 133748360 | 133748344 | - |
| SEQ ID NO 50578 | CGCCCCTAGAAAGGCCTTGA | CAG | chr3 | 133748332 | 133748351 | 133748335 | - |
| SEQ ID NO 50579 | CCTTGACAGCCACATCCCCT | CAG | chr3 | 133748318 | 133748337 | 133748321 | - |
| SEQ ID NO 50580 | ACTCCTGTCCATGAACACTA | CAG | chr3 | 133748280 | 133748299 | 133748283 | - |
| SEQ ID NO 50581 | CTCCTGTCCATGAACACTAC | AGG | chr3 | 133748279 | 133748298 | 133748282 | - |
| SEQ ID NO 50582 | TCCTGTCCATGAACACTACA | GGG | chr3 | 133748278 | 133748297 | 133748281 | - |
| SEQ ID NO 50583 | CCATGAACACTACAGGGCAC | AAG | chr3 | 133748272 | 133748291 | 133748275 | - |

Figure 73 (Cont'd)

| SEQ ID NO 50584 | CACAAGTTCTACTGCATTCT | GAG | chr3 | 133748255 | 133748274 | 133748258 | - |
| SEQ ID NO 50585 | TTCTACTGCATTCTGAGTCT | GAG | chr3 | 133748249 | 133748268 | 133748252 | - |
| SEQ ID NO 50586 | GCATTCTGAGTCTGAGCCAA | TAG | chr3 | 133748242 | 133748261 | 133748245 | - |
| SEQ ID NO 50587 | TTCTGAGTCTGAGCCAATAG | AAG | chr3 | 133748239 | 133748258 | 133748242 | - |
| SEQ ID NO 50588 | TCTGAGTCTGAGCCAATAGA | AGG | chr3 | 133748238 | 133748257 | 133748241 | - |
| SEQ ID NO 50589 | CCAATAGAAGGTTGCCCTAA | TGG | chr3 | 133748226 | 133748245 | 133748229 | - |
| SEQ ID NO 50590 | AGGTTGCCCTAATGGCCTCC | CAG | chr3 | 133748218 | 133748237 | 133748221 | - |
| SEQ ID NO 50591 | TCCTACTGACCACCCTCTGC | TGG | chr3 | 133748193 | 133748212 | 133748196 | - |
| SEQ ID NO 50592 | ACTGACCACCCTCTGCTGGC | CAG | chr3 | 133748189 | 133748208 | 133748192 | - |
| SEQ ID NO 50593 | TGACCACCCTCTGCTGGCCA | GAG | chr3 | 133748187 | 133748206 | 133748190 | - |
| SEQ ID NO 50594 | GACCACCCTCTGCTGGCCAG | AGG | chr3 | 133748186 | 133748205 | 133748189 | - |
| SEQ ID NO 50595 | ACCACCCTCTGCTGGCCAGA | GGG | chr3 | 133748185 | 133748204 | 133748188 | - |
| SEQ ID NO 50596 | CCACCCTCTGCTGGCCAGAG | GGG | chr3 | 133748184 | 133748203 | 133748187 | - |
| SEQ ID NO 50597 | CTCTGCTGGCCAGAGGGGTG | CAG | chr3 | 133748179 | 133748198 | 133748182 | - |
| SEQ ID NO 50598 | TCTGCTGGCCAGAGGGGTGC | AGG | chr3 | 133748178 | 133748197 | 133748181 | - |
| SEQ ID NO 50599 | TGGCCAGAGGGGTGCAGGCA | TGG | chr3 | 133748173 | 133748192 | 133748176 | - |
| SEQ ID NO 50600 | CAGGCATGGCCATCACCTCC | CAG | chr3 | 133748159 | 133748178 | 133748162 | - |
| SEQ ID NO 50601 | CATGGCCATCACCTCCCAGC | TGG | chr3 | 133748155 | 133748174 | 133748158 | - |
| SEQ ID NO 50602 | TGGCCATCACCTCCCAGCTG | GAG | chr3 | 133748153 | 133748172 | 133748156 | - |
| SEQ ID NO 50603 | GTCTCCTCCCATCACTGTCC | TGG | chr3 | 133748101 | 133748120 | 133748104 | - |
| SEQ ID NO 50604 | CCCATCACTGTCCTGGCCCC | TGG | chr3 | 133748094 | 133748113 | 133748097 | - |
| SEQ ID NO 50605 | TCCTGGCCCCTGGCCCCCCA | TGG | chr3 | 133748084 | 133748103 | 133748087 | - |
| SEQ ID NO 50606 | CCTGGCCCCCATGGAACAT | AAG | chr3 | 133748076 | 133748095 | 133748079 | - |
| SEQ ID NO 50607 | CCCCCATGGAACATAAGCCT | CAG | chr3 | 133748070 | 133748089 | 133748073 | - |
| SEQ ID NO 50608 | AACATAAGCCTCAGTATGCA | CAG | chr3 | 133748061 | 133748080 | 133748064 | - |
| SEQ ID NO 50609 | ACATAAGCCTCAGTATGCAC | AGG | chr3 | 133748060 | 133748079 | 133748063 | - |
| SEQ ID NO 50610 | CATAAGCCTCAGTATGCACA | GGG | chr3 | 133748059 | 133748078 | 133748062 | - |
| SEQ ID NO 50611 | CAGTATGCACAGGGCGTTTT | CAG | chr3 | 133748050 | 133748069 | 133748053 | - |
| SEQ ID NO 50612 | TTTCAGCTACCCCAACACAT | TGG | chr3 | 133748033 | 133748052 | 133748036 | - |
| SEQ ID NO 50613 | TTGGCTTGCTACCTCAACTA | TGG | chr3 | 133748014 | 133748033 | 133748017 | - |
| SEQ ID NO 50614 | CTACCTCAACTATGGAAAAC | CAG | chr3 | 133748006 | 133748025 | 133748009 | - |
| SEQ ID NO 50615 | CCTCAACTATGGAAACCAG | CGG | chr3 | 133748003 | 133748022 | 133748006 | - |
| SEQ ID NO 50616 | CTCAACTATGGAAAACCAGC | GGG | chr3 | 133748002 | 133748021 | 133748005 | - |
| SEQ ID NO 50617 | TCAACTATGGAAAACCAGCG | GGG | chr3 | 133748001 | 133748020 | 133748004 | - |
| SEQ ID NO 50618 | CAACTATGGAAACCAGCGG | GGG | chr3 | 133748000 | 133748019 | 133748003 | - |
| SEQ ID NO 50619 | ACTATGGAAAACCAGCGGGG | GAG | chr3 | 133747998 | 133748017 | 133748001 | - |
| SEQ ID NO 50620 | CTATGGAAAACCAGCGGGGG | AGG | chr3 | 133747997 | 133748016 | 133748000 | - |
| SEQ ID NO 50621 | GGAGGAATTGCCATCTTTTT | GAG | chr3 | 133747979 | 133747998 | 133747982 | - |
| SEQ ID NO 50622 | GGAATTGCCATCTTTTTGAG | AAG | chr3 | 133747976 | 133747995 | 133747979 | - |
| SEQ ID NO 50623 | AATTGCCATCTTTTTGAGAA | GAG | chr3 | 133747974 | 133747993 | 133747977 | - |
| SEQ ID NO 50624 | ATTGCCATCTTTTTGAGAAG | AGG | chr3 | 133747973 | 133747992 | 133747976 | - |
| SEQ ID NO 50625 | TTGCCATCTTTTTGAGAAGA | GGG | chr3 | 133747972 | 133747991 | 133747975 | - |
| SEQ ID NO 50626 | GCCATCTTTTTGAGAAGAGG | GAG | chr3 | 133747970 | 133747989 | 133747973 | - |
| SEQ ID NO 50627 | TCTTTTTGAGAAGAGGGAGT | GAG | chr3 | 133747966 | 133747985 | 133747969 | - |
| SEQ ID NO 50628 | TGAGAAGAGGGAGTGAGACT | CAG | chr3 | 133747960 | 133747979 | 133747963 | - |
| SEQ ID NO 50629 | AGAAGAGGGAGTGAGACTCA | GAG | chr3 | 133747958 | 133747977 | 133747961 | - |
| SEQ ID NO 50630 | CCTTTTTTTTTTTTAACCC | AAG | chr3 | 133747928 | 133747947 | 133747931 | - |
| SEQ ID NO 50631 | CTTTTTTTTTTTTAACCCA | AGG | chr3 | 133747927 | 133747946 | 133747930 | - |
| SEQ ID NO 50632 | AAGGTCACCCTGCTTGTCGT | TGG | chr3 | 133747908 | 133747927 | 133747911 | - |

Figure 73 (Cont'd)

| SEQ ID NO 50633 | CACCCTGCTTGTCGTTGGCC | AAG | chr3 | 133747903 | 133747922 | 133747906 | - |
| SEQ ID NO 50634 | CTGCTTGTCGTTGGCCAAGC | CAG | chr3 | 133747899 | 133747918 | 133747902 | - |
| SEQ ID NO 50635 | TGCTTGTCGTTGGCCAAGCC | AGG | chr3 | 133747898 | 133747917 | 133747901 | - |
| SEQ ID NO 50636 | GTCGTTGGCCAAGCCAGGCC | TAG | chr3 | 133747893 | 133747912 | 133747896 | - |
| SEQ ID NO 50637 | GCCAAGCCAGGCCTAGAATC | TGG | chr3 | 133747886 | 133747905 | 133747889 | - |
| SEQ ID NO 50638 | CCAAGCCAGGCCTAGAATCT | GGG | chr3 | 133747885 | 133747904 | 133747888 | - |
| SEQ ID NO 50639 | AGGCCTAGAATCTGGGTCTC | CAG | chr3 | 133747878 | 133747897 | 133747881 | - |
| SEQ ID NO 50640 | GAATCTGGGTCTCCAGACTC | TGG | chr3 | 133747871 | 133747890 | 133747874 | - |
| SEQ ID NO 50641 | AATCTGGGTCTCCAGACTCT | GGG | chr3 | 133747870 | 133747889 | 133747873 | - |
| SEQ ID NO 50642 | CAGACTCTGGGTCTGCTACT | CAG | chr3 | 133747858 | 133747877 | 133747861 | - |
| SEQ ID NO 50643 | AGACTCTGGGTCTGCTACTC | AGG | chr3 | 133747857 | 133747876 | 133747860 | - |
| SEQ ID NO 50644 | GACTCTGGGTCTGCTACTCA | GGG | chr3 | 133747856 | 133747875 | 133747859 | - |
| SEQ ID NO 50645 | GTCTGCTACTCAGGGCACAA | AAG | chr3 | 133747848 | 133747867 | 133747851 | - |
| SEQ ID NO 50646 | TGCTACTCAGGGCACAAAAG | AAG | chr3 | 133747845 | 133747864 | 133747848 | - |
| SEQ ID NO 50647 | ACAAAAGAAGAAAACATTCT | GAG | chr3 | 133747832 | 133747851 | 133747835 | - |
| SEQ ID NO 50648 | TTCTGAGTTACACCCCTTCT | TGG | chr3 | 133747816 | 133747835 | 133747819 | - |
| SEQ ID NO 50649 | GAGTTACACCCCTTCTTGGC | CAG | chr3 | 133747812 | 133747831 | 133747815 | - |
| SEQ ID NO 50650 | TTACACCCCTTCTTGGCCAG | TAG | chr3 | 133747809 | 133747828 | 133747812 | - |
| SEQ ID NO 50651 | CCCCTTCTTGGCCAGTAGTT | GAG | chr3 | 133747804 | 133747823 | 133747807 | - |
| SEQ ID NO 50652 | CCCTTCTTGGCCAGTAGTTG | AGG | chr3 | 133747803 | 133747822 | 133747806 | - |
| SEQ ID NO 50653 | CCTTCTTGGCCAGTAGTTGA | GGG | chr3 | 133747802 | 133747821 | 133747805 | - |
| SEQ ID NO 50654 | GTTGAGGGTAAATTAACGAA | AAG | chr3 | 133747787 | 133747806 | 133747790 | - |
| SEQ ID NO 50655 | CTTGTCTGTTGCTCTCTGTT | TAG | chr3 | 133747745 | 133747764 | 133747748 | - |
| SEQ ID NO 50656 | TTGTCTGTTGCTCTCTGTTT | AGG | chr3 | 133747744 | 133747763 | 133747747 | - |
| SEQ ID NO 50657 | TCTGTTGCTCTCTGTTTAGG | AAG | chr3 | 133747741 | 133747760 | 133747744 | - |
| SEQ ID NO 50658 | TAAAAACTCCACAAATTCAA | CAG | chr3 | 133747715 | 133747734 | 133747718 | - |
| SEQ ID NO 50659 | TCCATTTTCACCACACTTTT | TGG | chr3 | 133747663 | 133747682 | 133747666 | - |
| SEQ ID NO 50660 | TTGGCTGCCATTCACAAAAA | AAG | chr3 | 133747644 | 133747663 | 133747647 | - |
| SEQ ID NO 50661 | GCCATTCACAAAAAAGCTG | AAG | chr3 | 133747638 | 133747657 | 133747641 | - |
| SEQ ID NO 50662 | TTCACAAAAAAGCTGAAGC | CAG | chr3 | 133747634 | 133747653 | 133747637 | - |
| SEQ ID NO 50663 | AAAAAAGCTGAAGCCAGCCA | TGG | chr3 | 133747628 | 133747647 | 133747631 | - |
| SEQ ID NO 50664 | AAAAAGCTGAAGCCAGCCAT | GGG | chr3 | 133747627 | 133747646 | 133747630 | - |
| SEQ ID NO 50665 | GGTAACTATTAAAATCCATG | TGG | chr3 | 133747606 | 133747625 | 133747609 | - |
| SEQ ID NO 50666 | TATTAAAATCCATGTGGTTG | CAG | chr3 | 133747600 | 133747619 | 133747603 | - |
| SEQ ID NO 50667 | TTAAAATCCATGTGGTTGCA | GAG | chr3 | 133747598 | 133747617 | 133747601 | - |
| SEQ ID NO 50668 | AATCCATGTGGTTGCAGAGA | CAG | chr3 | 133747594 | 133747613 | 133747597 | - |
| SEQ ID NO 50669 | AGACAGCATCCCTATCACAT | GAG | chr3 | 133747577 | 133747596 | 133747580 | - |
| SEQ ID NO 50670 | TGAGCTTTTGCCCTGTCCCC | AAG | chr3 | 133747558 | 133747577 | 133747561 | - |
| SEQ ID NO 50671 | GAGCTTTTGCCCTGTCCCCA | AGG | chr3 | 133747557 | 133747576 | 133747560 | - |
| SEQ ID NO 50672 | TCTGTCATCTCCACTCCTTG | TGG | chr3 | 133747531 | 133747550 | 133747534 | - |
| SEQ ID NO 50673 | CTGTCATCTCCACTCCTTGT | GGG | chr3 | 133747530 | 133747549 | 133747533 | - |
| SEQ ID NO 50674 | CCACTCCTTGTGGGCCACCA | CAG | chr3 | 133747521 | 133747540 | 133747524 | - |
| SEQ ID NO 50675 | TCCTTGTGGGCCACCACAGC | AAG | chr3 | 133747517 | 133747536 | 133747520 | - |
| SEQ ID NO 50676 | CCTTGTGGGCCACCACAGCA | AGG | chr3 | 133747516 | 133747535 | 133747519 | - |
| SEQ ID NO 50677 | CCACAGCAAGGCTGACTCAC | TGG | chr3 | 133747504 | 133747523 | 133747507 | - |
| SEQ ID NO 50678 | AGGCTGACTCACTGGCTCTG | AAG | chr3 | 133747496 | 133747515 | 133747499 | - |
| SEQ ID NO 50679 | CTGACTCACTGGCTCTGAAG | AAG | chr3 | 133747493 | 133747512 | 133747496 | - |
| SEQ ID NO 50680 | GGCTCTGAAGAAGATCCACA | AAG | chr3 | 133747483 | 133747502 | 133747486 | - |
| SEQ ID NO 50681 | AAGAAGATCCACAAAGCCTG | TGG | chr3 | 133747476 | 133747495 | 133747479 | - |

Figure 73 (Cont'd)

| | | | | | | | |
|---|---|---|---|---|---|---|---|
| SEQ ID NO 50682 | GAAGATCCACAAAGCCTGTG | GAG | chr3 | 133747474 | 133747493 | 133747477 | - |
| SEQ ID NO 50683 | AGATCCACAAAGCCTGTGGA | GAG | chr3 | 133747472 | 133747491 | 133747475 | - |
| SEQ ID NO 50684 | GATCCACAAAGCCTGTGGAG | AGG | chr3 | 133747471 | 133747490 | 133747474 | - |
| SEQ ID NO 50685 | TCCACAAAGCCTGTGGAGAG | GAG | chr3 | 133747469 | 133747488 | 133747472 | - |
| SEQ ID NO 50686 | CCACAAAGCCTGTGGAGAGG | AGG | chr3 | 133747468 | 133747487 | 133747471 | - |
| SEQ ID NO 50687 | GCCTGTGGAGAGGAGGCCCA | CAG | chr3 | 133747461 | 133747480 | 133747464 | - |
| SEQ ID NO 50688 | AGAGGAGGCCCACAGCTCTC | CAG | chr3 | 133747453 | 133747472 | 133747456 | - |
| SEQ ID NO 50689 | GAGGAGGCCCACAGCTCTCC | AGG | chr3 | 133747452 | 133747471 | 133747455 | - |
| SEQ ID NO 50690 | CACAGCTCTCCAGGATGCAT | GAG | chr3 | 133747443 | 133747462 | 133747446 | - |
| SEQ ID NO 50691 | ACAGCTCTCCAGGATGCATG | AGG | chr3 | 133747442 | 133747461 | 133747445 | - |
| SEQ ID NO 50692 | AGCTCTCCAGGATGCATGAG | GAG | chr3 | 133747440 | 133747459 | 133747443 | - |
| SEQ ID NO 50693 | GCTCTCCAGGATGCATGAGG | AGG | chr3 | 133747439 | 133747458 | 133747442 | - |
| SEQ ID NO 50694 | CTCTCCAGGATGCATGAGGA | GGG | chr3 | 133747438 | 133747457 | 133747441 | - |
| SEQ ID NO 50695 | TCTCCAGGATGCATGAGGAG | GGG | chr3 | 133747437 | 133747456 | 133747440 | - |
| SEQ ID NO 50696 | GATGCATGAGGAGGGGCCAC | CAG | chr3 | 133747430 | 133747449 | 133747433 | - |
| SEQ ID NO 50697 | ATGCATGAGGAGGGGCCACC | AGG | chr3 | 133747429 | 133747448 | 133747432 | - |
| SEQ ID NO 50698 | TGCATGAGGAGGGGCCACCA | GGG | chr3 | 133747428 | 133747447 | 133747431 | - |
| SEQ ID NO 50699 | TGAGGAGGGGCCACCAGGGA | TGG | chr3 | 133747424 | 133747443 | 133747427 | - |
| SEQ ID NO 50700 | GCCACCAGGGATGGCCACCC | CAG | chr3 | 133747415 | 133747434 | 133747418 | - |
| SEQ ID NO 50701 | GCGACCCCATTTTCCCTCT | TGG | chr3 | 133747393 | 133747412 | 133747396 | - |
| SEQ ID NO 50702 | CCATTTTCCCTCTTGGCCCA | TGG | chr3 | 133747386 | 133747405 | 133747389 | - |
| SEQ ID NO 50703 | CATTTTCCCTCTTGGCCCAT | GGG | chr3 | 133747385 | 133747404 | 133747388 | - |
| SEQ ID NO 50704 | TCTTGGCCCATGGGAAATCC | TAG | chr3 | 133747376 | 133747395 | 133747379 | - |
| SEQ ID NO 50705 | CTTGGCCCATGGGAAATCCT | AGG | chr3 | 133747375 | 133747394 | 133747378 | - |
| SEQ ID NO 50706 | TGGCCCATGGGAAATCCTAG | GAG | chr3 | 133747373 | 133747392 | 133747376 | - |
| SEQ ID NO 50707 | GGCCCATGGGAAATCCTAGG | AGG | chr3 | 133747372 | 133747391 | 133747375 | - |
| SEQ ID NO 50708 | GAAATCCTAGGAGGCAACAT | AAG | chr3 | 133747363 | 133747382 | 133747366 | - |
| SEQ ID NO 50709 | TAGGAGGCAACATAAGCCTG | TGG | chr3 | 133747356 | 133747375 | 133747359 | - |
| SEQ ID NO 50710 | GAGGCAACATAAGCCTGTGG | CAG | chr3 | 133747353 | 133747372 | 133747356 | - |
| SEQ ID NO 50711 | CCTGTGGCAGCCCCTCCACA | AAG | chr3 | 133747340 | 133747359 | 133747343 | - |
| SEQ ID NO 50712 | CCTCCACAAAGCCCTGCCTC | CAG | chr3 | 133747328 | 133747347 | 133747331 | - |
| SEQ ID NO 50713 | TCCACAAAGCCCTGCCTCCA | GAG | chr3 | 133747326 | 133747345 | 133747329 | - |
| SEQ ID NO 50714 | CCCTGCCTCCAGAGTTCCCA | TAG | chr3 | 133747317 | 133747336 | 133747320 | - |
| SEQ ID NO 50715 | CCTGCCTCCAGAGTTCCCAT | AGG | chr3 | 133747316 | 133747335 | 133747319 | - |
| SEQ ID NO 50716 | CCTCCAGAGTTCCCATAGGC | GAG | chr3 | 133747312 | 133747331 | 133747315 | - |
| SEQ ID NO 50717 | CATAGGCGAGAATGTGTCCT | CAG | chr3 | 133747299 | 133747318 | 133747302 | - |
| SEQ ID NO 50718 | AGGCGAGAATGTGTCCTCAG | TGG | chr3 | 133747296 | 133747315 | 133747299 | - |
| SEQ ID NO 50719 | GCGAGAATGTGTCCTCAGTG | GAG | chr3 | 133747294 | 133747313 | 133747297 | - |
| SEQ ID NO 50720 | CAGTGGAGCATTACCTTGCA | CAG | chr3 | 133747279 | 133747298 | 133747282 | - |
| SEQ ID NO 50721 | ATTACCTTGCACAGCCTGTG | AAG | chr3 | 133747270 | 133747289 | 133747273 | - |
| SEQ ID NO 50722 | AGCCTGTGAAGTGCTCTGTG | CGG | chr3 | 133747258 | 133747277 | 133747261 | - |
| SEQ ID NO 50723 | GCCTGTGAAGTGCTCTGTGC | GGG | chr3 | 133747257 | 133747276 | 133747260 | - |
| SEQ ID NO 50724 | CCTGTGAAGTGCTCTGTGCG | GGG | chr3 | 133747256 | 133747275 | 133747259 | - |
| SEQ ID NO 50725 | AAGTGCTCTGTGCGGGATA | AAG | chr3 | 133747250 | 133747269 | 133747253 | - |
| SEQ ID NO 50726 | AGTGCTCTGTGCGGGGATAA | AGG | chr3 | 133747249 | 133747268 | 133747252 | - |
| SEQ ID NO 50727 | CTCTGTGCGGGGATAAAGGC | AAG | chr3 | 133747245 | 133747264 | 133747248 | - |
| SEQ ID NO 50728 | GGGGATAAAGGCAAGTAACG | TGG | chr3 | 133747237 | 133747256 | 133747240 | - |
| SEQ ID NO 50729 | GGGATAAAGGCAAGTAACGT | GGG | chr3 | 133747236 | 133747255 | 133747239 | - |
| SEQ ID NO 50730 | GGATAAAGGCAAGTAACGTG | GGG | chr3 | 133747235 | 133747254 | 133747238 | - |

Figure 73 (Cont'd)

| | | | | | | | |
|---|---|---|---|---|---|---|---|
| SEQ ID NO 50731 | GTAACGTGGGGTCCTCTCTC | AAG | chr3 | 133747223 | 133747242 | 133747226 | - |
| SEQ ID NO 50732 | TAACGTGGGGTCCTCTCTCA | AGG | chr3 | 133747222 | 133747241 | 133747225 | - |
| SEQ ID NO 50733 | GTCCTCTCTCAAGGAATTGC | TAG | chr3 | 133747213 | 133747232 | 133747216 | - |
| SEQ ID NO 50734 | CTCAAGGAATTGCTAGCTTA | TGG | chr3 | 133747206 | 133747225 | 133747209 | - |
| SEQ ID NO 50735 | TCAAGGAATTGCTAGCTTAT | GGG | chr3 | 133747205 | 133747224 | 133747208 | - |
| SEQ ID NO 50736 | CAAGGAATTGCTAGCTTATG | GGG | chr3 | 133747204 | 133747223 | 133747207 | - |
| SEQ ID NO 50737 | AGGAATTGCTAGCTTATGGG | GAG | chr3 | 133747202 | 133747221 | 133747205 | - |
| SEQ ID NO 50738 | GAATTGCTAGCTTATGGGGA | GAG | chr3 | 133747200 | 133747219 | 133747203 | - |
| SEQ ID NO 50739 | TGGGGAGAGAAAACTAAACG | TGG | chr3 | 133747186 | 133747205 | 133747189 | - |
| SEQ ID NO 50740 | GGAGAGAAAACTAAACGTGG | AAG | chr3 | 133747183 | 133747202 | 133747186 | - |
| SEQ ID NO 50741 | ACTAAACGTGGAAGCCCCAA | CAG | chr3 | 133747174 | 133747193 | 133747177 | - |
| SEQ ID NO 50742 | TGTGACAAATGCCCCATGAA | TGG | chr3 | 133747151 | 133747170 | 133747154 | - |
| SEQ ID NO 50743 | GACAAATGCCCCATGAATGG | CAG | chr3 | 133747148 | 133747167 | 133747151 | - |
| SEQ ID NO 50744 | ACAAATGCCCCATGAATGGC | AGG | chr3 | 133747147 | 133747166 | 133747150 | - |
| SEQ ID NO 50745 | AATGCCCCATGAATGGCAGG | CAG | chr3 | 133747144 | 133747163 | 133747147 | - |
| SEQ ID NO 50746 | GCCCCATGAATGGCAGGCAG | AAG | chr3 | 133747141 | 133747160 | 133747144 | - |
| SEQ ID NO 50747 | CATGAATGGCAGGCAGAAGT | TAG | chr3 | 133747137 | 133747156 | 133747140 | - |
| SEQ ID NO 50748 | TGAATGGCAGGCAGAAGTTA | GAG | chr3 | 133747135 | 133747154 | 133747138 | - |
| SEQ ID NO 50749 | CAGGCAGAAGTTAGAGTATG | AAG | chr3 | 133747128 | 133747147 | 133747131 | - |
| SEQ ID NO 50750 | AGGCAGAAGTTAGAGTATGA | AGG | chr3 | 133747127 | 133747146 | 133747130 | - |
| SEQ ID NO 50751 | GGCAGAAGTTAGAGTATGAA | GGG | chr3 | 133747126 | 133747145 | 133747129 | - |
| SEQ ID NO 50752 | GCAGAAGTTAGAGTATGAAG | GGG | chr3 | 133747125 | 133747144 | 133747128 | - |
| SEQ ID NO 50753 | CAGAAGTTAGAGTATGAAGG | GGG | chr3 | 133747124 | 133747143 | 133747127 | - |
| SEQ ID NO 50754 | GTATGAAGGGGCCCCACCT | CAG | chr3 | 133747113 | 133747132 | 133747116 | - |
| SEQ ID NO 50755 | TATGAAGGGGCCCCACCTC | AGG | chr3 | 133747112 | 133747131 | 133747115 | - |
| SEQ ID NO 50756 | TGAAGGGGCCCCACCTCAG | GAG | chr3 | 133747110 | 133747129 | 133747113 | - |
| SEQ ID NO 50757 | GAAGGGGCCCCACCTCAGG | AGG | chr3 | 133747109 | 133747128 | 133747112 | - |
| SEQ ID NO 50758 | GGGGCCCCACCTCAGGAGGT | CGG | chr3 | 133747105 | 133747124 | 133747108 | - |
| SEQ ID NO 50759 | GGGCCCCACCTCAGGAGGTC | GGG | chr3 | 133747104 | 133747123 | 133747107 | - |
| SEQ ID NO 50760 | GGCCCCACCTCAGGAGGTCG | GGG | chr3 | 133747103 | 133747122 | 133747106 | - |
| SEQ ID NO 50761 | CCCCACCTCAGGAGGTCGGG | GAG | chr3 | 133747101 | 133747120 | 133747104 | - |
| SEQ ID NO 50762 | CCTCAGGAGGTCGGGGAGTG | TGG | chr3 | 133747096 | 133747115 | 133747099 | - |
| SEQ ID NO 50763 | GAGGTCGGGGAGTGTGGCGT | CAG | chr3 | 133747090 | 133747109 | 133747093 | - |
| SEQ ID NO 50764 | TGGCGTCAGCCACTGCCCCA | TAG | chr3 | 133747076 | 133747095 | 133747079 | - |
| SEQ ID NO 50765 | CGTCAGCCACTGCCCCATAG | CAG | chr3 | 133747073 | 133747092 | 133747076 | - |
| SEQ ID NO 50766 | GTCAGCCACTGCCCCATAGC | AGG | chr3 | 133747072 | 133747091 | 133747075 | - |
| SEQ ID NO 50767 | ATGTGTGCAACATCTGCCAC | TGG | chr3 | 133747049 | 133747068 | 133747052 | - |
| SEQ ID NO 50768 | CAACATCTGCCACTGGTACT | CAG | chr3 | 133747042 | 133747061 | 133747045 | - |
| SEQ ID NO 50769 | TGACCCTCATTTGACCCTCC | CAG | chr3 | 133747004 | 133747023 | 133747007 | - |
| SEQ ID NO 50770 | GACCCTCATTTGACCCTCCC | AGG | chr3 | 133747003 | 133747022 | 133747006 | - |
| SEQ ID NO 50771 | CTCATTTGACCCTCCCAGGC | AAG | chr3 | 133746999 | 133747018 | 133747002 | - |
| SEQ ID NO 50772 | TGCTGTGATGACCCCCTCCC | TGG | chr3 | 133746976 | 133746995 | 133746979 | - |
| SEQ ID NO 50773 | GTGATGACCCCCTCCCTGGT | GAG | chr3 | 133746972 | 133746991 | 133746975 | - |
| SEQ ID NO 50774 | TGATGACCCCCTCCCTGGTG | AGG | chr3 | 133746971 | 133746990 | 133746974 | - |
| SEQ ID NO 50775 | ATGACCCCCTCCCTGGTGAG | GAG | chr3 | 133746969 | 133746988 | 133746972 | - |
| SEQ ID NO 50776 | CCCCCTCCCTGGTGAGGAGC | CGG | chr3 | 133746965 | 133746984 | 133746968 | - |
| SEQ ID NO 50777 | CTCCCTGGTGAGGAGCCGGC | CAG | chr3 | 133746961 | 133746980 | 133746964 | - |
| SEQ ID NO 50778 | TCCCTGGTGAGGAGCCGGCC | AGG | chr3 | 133746960 | 133746979 | 133746963 | - |
| SEQ ID NO 50779 | GTGAGGAGCCGGCCAGGACT | TGG | chr3 | 133746954 | 133746973 | 133746957 | - |

Figure 73 (Cont'd)

| | | | | | | | |
|---|---|---|---|---|---|---|---|
| SEQ ID NO 50780 | GCCGGCCAGGACTTGGATCC | AAG | chr3 | 133746947 | 133746966 | 133746950 | - |
| SEQ ID NO 50781 | GGCCAGGACTTGGATCCAAG | AAG | chr3 | 133746944 | 133746963 | 133746947 | - |
| SEQ ID NO 50782 | GGACTTGGATCCAAGAAGTC | TGG | chr3 | 133746939 | 133746958 | 133746942 | - |
| SEQ ID NO 50783 | CCCATGCTCTGACCGCTCGA | TGG | chr3 | 133746908 | 133746927 | 133746911 | - |
| SEQ ID NO 50784 | GCTCGATGGCACCGCTTCCT | TGG | chr3 | 133746894 | 133746913 | 133746897 | - |
| SEQ ID NO 50785 | CGATGGCACCGCTTCCTTGG | CAG | chr3 | 133746891 | 133746910 | 133746894 | - |
| SEQ ID NO 50786 | GATGGCACCGCTTCCTTGGC | AGG | chr3 | 133746890 | 133746909 | 133746893 | - |
| SEQ ID NO 50787 | CTTCCTTGGCAGGACATCTA | CAG | chr3 | 133746880 | 133746899 | 133746883 | - |
| SEQ ID NO 50788 | GGCAGGACATCTACAGCTCC | CAG | chr3 | 133746873 | 133746892 | 133746876 | - |
| SEQ ID NO 50789 | GCAGGACATCTACAGCTCCC | AGG | chr3 | 133746872 | 133746891 | 133746875 | - |
| SEQ ID NO 50790 | CAGGACATCTACAGCTCCCA | GGG | chr3 | 133746871 | 133746890 | 133746874 | - |
| SEQ ID NO 50791 | TCTACAGCTCCCAGGGCACC | CAG | chr3 | 133746864 | 133746883 | 133746867 | - |
| SEQ ID NO 50792 | CTACAGCTCCCAGGGCACCC | AGG | chr3 | 133746863 | 133746882 | 133746866 | - |
| SEQ ID NO 50793 | TACAGCTCCCAGGGCACCCA | GGG | chr3 | 133746862 | 133746881 | 133746865 | - |
| SEQ ID NO 50794 | ACAGCTCCCAGGGCACCCAG | GGG | chr3 | 133746861 | 133746880 | 133746864 | - |
| SEQ ID NO 50795 | CCAGGGCACCCAGGGGACAT | CAG | chr3 | 133746854 | 133746873 | 133746857 | - |
| SEQ ID NO 50796 | CAGGGGACATCAGCCTCTGA | AAG | chr3 | 133746844 | 133746863 | 133746847 | - |
| SEQ ID NO 50797 | AGGGGACATCAGCCTCTGAA | AGG | chr3 | 133746843 | 133746862 | 133746846 | - |
| SEQ ID NO 50798 | GGGGACATCAGCCTCTGAAA | GGG | chr3 | 133746842 | 133746861 | 133746845 | - |
| SEQ ID NO 50799 | GGGACATCAGCCTCTGAAAG | GGG | chr3 | 133746841 | 133746860 | 133746844 | - |
| SEQ ID NO 50800 | ATCAGCCTCTGAAAGGGGAA | TGG | chr3 | 133746836 | 133746855 | 133746839 | - |
| SEQ ID NO 50801 | GCCTCTGAAAGGGGAATGGT | CAG | chr3 | 133746832 | 133746851 | 133746835 | - |
| SEQ ID NO 50802 | GAAAGGGGAATGGTCAGACC | CGG | chr3 | 133746826 | 133746845 | 133746829 | - |
| SEQ ID NO 50803 | AAAGGGGAATGGTCAGACCC | GGG | chr3 | 133746825 | 133746844 | 133746828 | - |
| SEQ ID NO 50804 | AGGGGAATGGTCAGACCCGG | GAG | chr3 | 133746823 | 133746842 | 133746826 | - |
| SEQ ID NO 50805 | GGGGAATGGTCAGACCCGGG | AGG | chr3 | 133746822 | 133746841 | 133746825 | - |
| SEQ ID NO 50806 | GAGGCCTTGAATGCCATGCT | AAG | chr3 | 133746803 | 133746822 | 133746806 | - |
| SEQ ID NO 50807 | AGGCCTTGAATGCCATGCTA | AGG | chr3 | 133746802 | 133746821 | 133746805 | - |
| SEQ ID NO 50808 | GCCTTGAATGCCATGCTAAG | GAG | chr3 | 133746800 | 133746819 | 133746803 | - |
| SEQ ID NO 50809 | GAATGCCATGCTAAGGAGTT | CGG | chr3 | 133746795 | 133746814 | 133746798 | - |
| SEQ ID NO 50810 | CTAAGGAGTTCGGACTTGAC | AAG | chr3 | 133746785 | 133746804 | 133746788 | - |
| SEQ ID NO 50811 | AAGGAGTTCGGACTTGACAA | GAG | chr3 | 133746783 | 133746802 | 133746786 | - |
| SEQ ID NO 50812 | AGGAGTTCGGACTTGACAAG | AGG | chr3 | 133746782 | 133746801 | 133746785 | - |
| SEQ ID NO 50813 | AGTTCGGACTTGACAAGAGG | CAG | chr3 | 133746779 | 133746798 | 133746782 | - |
| SEQ ID NO 50814 | TCGGACTTGACAAGAGGCAG | CAG | chr3 | 133746776 | 133746795 | 133746779 | - |
| SEQ ID NO 50815 | CTTGACAAGAGGCAGCAGCA | AAG | chr3 | 133746771 | 133746790 | 133746774 | - |
| SEQ ID NO 50816 | TTGACAAGAGGCAGCAGCAA | AGG | chr3 | 133746770 | 133746789 | 133746773 | - |
| SEQ ID NO 50817 | TGACAAGAGGCAGCAGCAAA | GGG | chr3 | 133746769 | 133746788 | 133746772 | - |
| SEQ ID NO 50818 | AGCAAAGGGTTTTGATAACC | TGG | chr3 | 133746755 | 133746774 | 133746758 | - |
| SEQ ID NO 50819 | AAGGGTTTTGATAACCTGGT | TAG | chr3 | 133746751 | 133746770 | 133746754 | - |
| SEQ ID NO 50820 | TTATTGTATTTCACTGCTGC | AAG | chr3 | 133746716 | 133746735 | 133746719 | - |
| SEQ ID NO 50821 | TTCACTGCTGCAAGATTTAC | TGG | chr3 | 133746707 | 133746726 | 133746710 | - |
| SEQ ID NO 50822 | GCTGCAAGATTTACTGGACA | AAG | chr3 | 133746701 | 133746720 | 133746704 | - |
| SEQ ID NO 50823 | TGCAAGATTTACTGGACAAA | GAG | chr3 | 133746699 | 133746718 | 133746702 | - |
| SEQ ID NO 50824 | GCAAGATTTACTGGACAAAG | AGG | chr3 | 133746698 | 133746717 | 133746701 | - |
| SEQ ID NO 50825 | AAGATTTACTGGACAAAGAG | GAG | chr3 | 133746696 | 133746715 | 133746699 | - |
| SEQ ID NO 50826 | AGATTTACTGGACAAAGAGG | AGG | chr3 | 133746695 | 133746714 | 133746698 | - |
| SEQ ID NO 50827 | ATTTACTGGACAAAGAGGAG | GAG | chr3 | 133746693 | 133746712 | 133746696 | - |
| SEQ ID NO 50828 | TTTACTGGACAAAGAGGAGG | AGG | chr3 | 133746692 | 133746711 | 133746695 | - |

Figure 73 (Cont'd)

| | | | | | | | |
|---|---|---|---|---|---|---|---|
| SEQ ID NO 50829 | TTACTGGACAAAGAGGAGGA | GGG | chr3 | 133746691 | 133746710 | 133746694 | - |
| SEQ ID NO 50830 | TACTGGACAAAGAGGAGGAG | GGG | chr3 | 133746690 | 133746709 | 133746693 | - |
| SEQ ID NO 50831 | ACTGGACAAAGAGGAGGAGG | GGG | chr3 | 133746689 | 133746708 | 133746692 | - |
| SEQ ID NO 50832 | TGGACAAAGAGGAGGAGGGG | GAG | chr3 | 133746687 | 133746706 | 133746690 | - |
| SEQ ID NO 50833 | ACAAAGAGGAGGAGGGGGAG | AAG | chr3 | 133746684 | 133746703 | 133746687 | - |
| SEQ ID NO 50834 | AGAGGAGGAGGGGGAGAAGA | CAG | chr3 | 133746680 | 133746699 | 133746683 | - |
| SEQ ID NO 50835 | GAGGAGGGGGAGAAGACAGT | GAG | chr3 | 133746676 | 133746695 | 133746679 | - |
| SEQ ID NO 50836 | GGGGGAGAAGACAGTGAGTG | CAG | chr3 | 133746671 | 133746690 | 133746674 | - |
| SEQ ID NO 50837 | GAAGACAGTGAGTGCAGTGA | AAG | chr3 | 133746665 | 133746684 | 133746668 | - |
| SEQ ID NO 50838 | AAGACAGTGAGTGCAGTGAA | AGG | chr3 | 133746664 | 133746683 | 133746667 | - |
| SEQ ID NO 50839 | TGAGTGCAGTGAAAGGTGTC | TAG | chr3 | 133746657 | 133746676 | 133746660 | - |
| SEQ ID NO 50840 | GTGCAGTGAAAGGTGTCTAG | AAG | chr3 | 133746654 | 133746673 | 133746657 | - |
| SEQ ID NO 50841 | TGAAAGGTGTCTAGAAGCCC | AAG | chr3 | 133746648 | 133746667 | 133746651 | - |
| SEQ ID NO 50842 | GGTGTCTAGAAGCCCAAGCA | AAG | chr3 | 133746643 | 133746662 | 133746646 | - |
| SEQ ID NO 50843 | GTGTCTAGAAGCCCAAGCAA | AGG | chr3 | 133746642 | 133746661 | 133746645 | - |
| SEQ ID NO 50844 | CTAGAAGCCCAAGCAAAGGC | CAG | chr3 | 133746638 | 133746657 | 133746641 | - |
| SEQ ID NO 50845 | TAGAAGCCCAAGCAAAGGCC | AGG | chr3 | 133746637 | 133746656 | 133746640 | - |
| SEQ ID NO 50846 | AGAAGCCCAAGCAAAGGCCA | GGG | chr3 | 133746636 | 133746655 | 133746639 | - |
| SEQ ID NO 50847 | GAAGCCCAAGCAAAGGCCAG | GGG | chr3 | 133746635 | 133746654 | 133746638 | - |
| SEQ ID NO 50848 | GCCCAAGCAAAGGCCAGGGG | TGG | chr3 | 133746632 | 133746651 | 133746635 | - |
| SEQ ID NO 50849 | CCCAAGCAAAGGCCAGGGGT | GGG | chr3 | 133746631 | 133746650 | 133746634 | - |
| SEQ ID NO 50850 | CCAAGCAAAGGCCAGGGGTG | GGG | chr3 | 133746630 | 133746649 | 133746633 | - |
| SEQ ID NO 50851 | CAAAGGCCAGGGGTGGGGCG | TAG | chr3 | 133746625 | 133746644 | 133746628 | - |
| SEQ ID NO 50852 | AAGGCCAGGGGTGGGGCGTA | GAG | chr3 | 133746623 | 133746642 | 133746626 | - |
| SEQ ID NO 50853 | GGCCAGGGGTGGGGCGTAGA | GAG | chr3 | 133746621 | 133746640 | 133746624 | - |
| SEQ ID NO 50854 | GCCAGGGGTGGGGCGTAGAG | AGG | chr3 | 133746620 | 133746639 | 133746623 | - |
| SEQ ID NO 50855 | GGTGGGGCGTAGAGAGGCAA | TGG | chr3 | 133746614 | 133746633 | 133746617 | - |
| SEQ ID NO 50856 | GGGCGTAGAGAGGCAATGGA | AAG | chr3 | 133746610 | 133746629 | 133746613 | - |
| SEQ ID NO 50857 | GGCGTAGAGAGGCAATGGAA | AGG | chr3 | 133746609 | 133746628 | 133746612 | - |
| SEQ ID NO 50858 | AGAGGCAATGGAAAGGCACC | CAG | chr3 | 133746602 | 133746621 | 133746605 | - |
| SEQ ID NO 50859 | TGGAAAGGCACCCAGACACC | CAG | chr3 | 133746594 | 133746613 | 133746597 | - |
| SEQ ID NO 50860 | GGAAAGGCACCCAGACACCC | AGG | chr3 | 133746593 | 133746612 | 133746596 | - |
| SEQ ID NO 50861 | CACCCAGACACCCAGGCTTC | CAG | chr3 | 133746586 | 133746605 | 133746589 | - |
| SEQ ID NO 50862 | GACACCCAGGCTTCCAGCCT | GAG | chr3 | 133746580 | 133746599 | 133746583 | - |
| SEQ ID NO 50863 | CCAGGCTTCCAGCCTGAGCG | CGG | chr3 | 133746575 | 133746594 | 133746578 | - |
| SEQ ID NO 50864 | AGGCTTCCAGCCTGAGCGCG | GAG | chr3 | 133746573 | 133746592 | 133746576 | - |
| SEQ ID NO 50865 | GCCTGAGCGCGGAGTGCATG | CAG | chr3 | 133746564 | 133746583 | 133746567 | - |
| SEQ ID NO 50866 | CCTGAGCGCGGAGTGCATGC | AGG | chr3 | 133746563 | 133746582 | 133746566 | - |
| SEQ ID NO 50867 | CGGAGTGCATGCAGGCTGCG | CGG | chr3 | 133746555 | 133746574 | 133746558 | - |
| SEQ ID NO 50868 | AGTGCATGCAGGCTGCGCGG | TGG | chr3 | 133746552 | 133746571 | 133746555 | - |
| SEQ ID NO 50869 | CAGGCTGCGCGGTGGCCGCC | CGG | chr3 | 133746544 | 133746563 | 133746547 | - |
| SEQ ID NO 50870 | AGGCTGCGCGGTGGCCGCCC | GGG | chr3 | 133746543 | 133746562 | 133746546 | - |
| SEQ ID NO 50871 | CGCGGTGGCCGCCCGGGTTG | CAG | chr3 | 133746537 | 133746556 | 133746540 | - |
| SEQ ID NO 50872 | GCGGTGGCCGCCCGGGTTGC | AGG | chr3 | 133746536 | 133746555 | 133746539 | - |
| SEQ ID NO 50873 | CGGTGGCCGCCCGGGTTGCA | GGG | chr3 | 133746535 | 133746554 | 133746538 | - |
| SEQ ID NO 50874 | CCCGGGTTGCAGGGAACGCG | CGG | chr3 | 133746526 | 133746545 | 133746529 | - |
| SEQ ID NO 50875 | CCGGGTTGCAGGGAACGCGC | GGG | chr3 | 133746525 | 133746544 | 133746528 | - |
| SEQ ID NO 50876 | GTTGCAGGGAACGCGCGGGC | CAG | chr3 | 133746521 | 133746540 | 133746524 | - |
| SEQ ID NO 50877 | CGCGCGGGCCAGCGACTCTG | CGG | chr3 | 133746510 | 133746529 | 133746513 | - |

Figure 73 (Cont'd)

| SEQ ID NO 50878 | ACCCCGTGCCCGCACTCACC | CAG | chr3 | 133746483 | 133746502 | 133746486 | - |
| SEQ ID NO 50879 | CCCCGTGCCCGCACTCACCC | AGG | chr3 | 133746482 | 133746501 | 133746485 | - |
| SEQ ID NO 50880 | GTGCCCGCACTCACCCAGGA | CGG | chr3 | 133746478 | 133746497 | 133746481 | - |
| SEQ ID NO 50881 | CGCACTCACCCAGGACGGCG | CAG | chr3 | 133746473 | 133746492 | 133746476 | - |
| SEQ ID NO 50882 | TCACCCAGGACGGCGCAGAC | CAG | chr3 | 133746468 | 133746487 | 133746471 | - |
| SEQ ID NO 50883 | CCCAGGACGGCGCAGACCAG | CAG | chr3 | 133746465 | 133746484 | 133746468 | - |
| SEQ ID NO 50884 | CCAGGACGGCGCAGACCAGC | AGG | chr3 | 133746464 | 133746483 | 133746467 | - |
| SEQ ID NO 50885 | CAGGACGGCGCAGACCAGCA | GGG | chr3 | 133746463 | 133746482 | 133746466 | - |
| SEQ ID NO 50886 | GCAGACCAGCAGGGCTCCCA | CGG | chr3 | 133746454 | 133746473 | 133746457 | - |
| SEQ ID NO 50887 | ACCAGCAGGGCTCCCACGGC | GAG | chr3 | 133746450 | 133746469 | 133746453 | - |
| SEQ ID NO 50888 | CCACGGCGAGCCTCATCTTC | CGG | chr3 | 133746437 | 133746456 | 133746440 | - |
| SEQ ID NO 50889 | CACGGCGAGCCTCATCTTCC | GGG | chr3 | 133746436 | 133746455 | 133746439 | - |
| SEQ ID NO 50890 | CGAGCCTCATCTTCCGGGTG | CGG | chr3 | 133746431 | 133746450 | 133746434 | - |
| SEQ ID NO 50891 | CATCTTCCGGGTGCGGCGCT | GAG | chr3 | 133746424 | 133746443 | 133746427 | - |
| SEQ ID NO 50892 | CTTCCGGGTGCGGCGCTGAG | CAG | chr3 | 133746421 | 133746440 | 133746424 | - |
| SEQ ID NO 50893 | CGGGTGCGGCGCTGAGCAGC | GAG | chr3 | 133746417 | 133746436 | 133746420 | - |
| SEQ ID NO 50894 | GCGGCGCTGAGCAGCGAGCA | CAG | chr3 | 133746412 | 133746431 | 133746415 | - |
| SEQ ID NO 50895 | CGCTGAGCAGCGAGCACAGT | CGG | chr3 | 133746408 | 133746427 | 133746411 | - |
| SEQ ID NO 50896 | CAGTCGGACTCGCTTCTGTG | CAG | chr3 | 133746392 | 133746411 | 133746395 | - |
| SEQ ID NO 50897 | ACTCGCTTCTGTGCAGCCTC | CGG | chr3 | 133746385 | 133746404 | 133746388 | - |
| SEQ ID NO 50898 | GCGTCCCTTTATTCCATTCC | CGG | chr3 | 133746356 | 133746375 | 133746359 | - |
| SEQ ID NO 50899 | CCTTTATTCCATTCCCGGCC | TGG | chr3 | 133746351 | 133746370 | 133746354 | - |
| SEQ ID NO 50900 | CTTTATTCCATTCCCGGCCT | GGG | chr3 | 133746350 | 133746369 | 133746353 | - |
| SEQ ID NO 50901 | TATTCCATTCCCGGCCTGGG | CGG | chr3 | 133746347 | 133746366 | 133746350 | - |
| SEQ ID NO 50902 | ATTCCATTCCCGGCCTGGGC | GGG | chr3 | 133746346 | 133746365 | 133746349 | - |
| SEQ ID NO 50903 | CATTCCCGGCCTGGGCGGGC | TGG | chr3 | 133746342 | 133746361 | 133746345 | - |
| SEQ ID NO 50904 | ATTCCCGGCCTGGGCGGGCT | GGG | chr3 | 133746341 | 133746360 | 133746344 | - |
| SEQ ID NO 50905 | TTTGACCTCCGTGTTTGTG | CAG | chr3 | 133746311 | 133746330 | 133746314 | - |
| SEQ ID NO 50906 | ACCTCCGTGTTTGTGCAGC | CGG | chr3 | 133746307 | 133746326 | 133746310 | - |
| SEQ ID NO 50907 | CCTCCCGTGTTTGTGCAGCC | GGG | chr3 | 133746306 | 133746325 | 133746309 | - |
| SEQ ID NO 50908 | CACTGATCACCTCATTTTCT | GAG | chr3 | 133746240 | 133746259 | 133746243 | - |
| SEQ ID NO 50909 | TCACCTCATTTTCTGAGCTC | TGG | chr3 | 133746234 | 133746253 | 133746237 | - |
| SEQ ID NO 50910 | ACCTCATTTTCTGAGCTCTG | GAG | chr3 | 133746232 | 133746251 | 133746235 | - |
| SEQ ID NO 50911 | GAGCTCTGGAGACGACCCGC | GAG | chr3 | 133746220 | 133746239 | 133746223 | - |
| SEQ ID NO 50912 | CTCTGGAGACGACCCGCGAG | TGG | chr3 | 133746217 | 133746236 | 133746220 | - |
| SEQ ID NO 50913 | TGGAGACGACCCGCGAGTGG | AAG | chr3 | 133746214 | 133746233 | 133746217 | - |
| SEQ ID NO 50914 | GGAGACGACCCGCGAGTGGA | AGG | chr3 | 133746213 | 133746232 | 133746216 | - |
| SEQ ID NO 50915 | AGACGACCCGCGAGTGGAAG | GAG | chr3 | 133746211 | 133746230 | 133746214 | - |
| SEQ ID NO 50916 | ACCCGCGAGTGGAAGGAGTC | CAG | chr3 | 133746206 | 133746225 | 133746209 | - |
| SEQ ID NO 50917 | CGAGTGGAAGGAGTCCAGCA | CAG | chr3 | 133746201 | 133746220 | 133746204 | - |
| SEQ ID NO 50918 | GTCCAGCACAGAAATGTTGA | TGG | chr3 | 133746189 | 133746208 | 133746192 | - |
| SEQ ID NO 50919 | TCCAGCACAGAAATGTTGAT | GGG | chr3 | 133746188 | 133746207 | 133746191 | - |
| SEQ ID NO 50920 | AGCACAGAAATGTTGATGGG | AAG | chr3 | 133746185 | 133746204 | 133746188 | - |
| SEQ ID NO 50921 | GCACAGAAATGTTGATGGGA | AGG | chr3 | 133746184 | 133746203 | 133746187 | - |
| SEQ ID NO 50922 | CACAGAAATGTTGATGGGAA | GGG | chr3 | 133746183 | 133746202 | 133746186 | - |
| SEQ ID NO 50923 | TGTTGATGGGAAGGGACATG | AAG | chr3 | 133746175 | 133746194 | 133746178 | - |
| SEQ ID NO 50924 | AAGGGACATGAAGCACAATG | CAG | chr3 | 133746165 | 133746184 | 133746168 | - |
| SEQ ID NO 50925 | CAATGCAGCCATTGTCATCG | CGG | chr3 | 133746150 | 133746169 | 133746153 | - |
| SEQ ID NO 50926 | CATTGTCATCGCGGCTCGCT | CGG | chr3 | 133746141 | 133746160 | 133746144 | - |

Figure 74

| # | Sequence | PAM | Chr | Start | End | Cuts 5' of | Str |
|---|---|---|---|---|---|---|---|
| SEQ ID NO 50927 | GTGCTGGACTCCTTCCACTC | GCGGGT | chr3 | 133746200 | 133746219 | 133746216 | + |
| SEQ ID NO 50928 | AAAATGAGGTGATCAGTGGG | ACGAGT | chr3 | 133746242 | 133746261 | 133746258 | + |
| SEQ ID NO 50929 | CAGTGGGACGAGTAAGGAAG | GGGGGT | chr3 | 133746255 | 133746274 | 133746271 | + |
| SEQ ID NO 50930 | GCGCCCAGCCCGCCCAGGCC | GGGAAT | chr3 | 133746335 | 133746354 | 133746351 | + |
| SEQ ID NO 50931 | CAGCCCGCCCAGGCCGGGAA | TGGAAT | chr3 | 133746340 | 133746359 | 133746356 | + |
| SEQ ID NO 50932 | GCGCCGGAGGCTGCACAGAA | GCGAGT | chr3 | 133746379 | 133746398 | 133746395 | + |
| SEQ ID NO 50933 | CCCTGCTGGTCTGCGCCGTC | CTGGGT | chr3 | 133746460 | 133746479 | 133746476 | + |
| SEQ ID NO 50934 | GCTGGTCTGCGCCGTCCTGG | GTGAGT | chr3 | 133746464 | 133746483 | 133746480 | + |
| SEQ ID NO 50935 | GTCCTGGGTGAGTGCGGGCA | CGGGGT | chr3 | 133746477 | 133746496 | 133746493 | + |
| SEQ ID NO 50936 | GCGGGCACGGGGTAGCACCG | CAGAGT | chr3 | 133746490 | 133746509 | 133746506 | + |
| SEQ ID NO 50937 | TCCGCGCTCAGGCTGGAAGC | CTGGGT | chr3 | 133746571 | 133746590 | 133746587 | + |
| SEQ ID NO 50938 | CAGGCTGGAAGCCTGGGTGT | CTGGGT | chr3 | 133746579 | 133746598 | 133746595 | + |
| SEQ ID NO 50939 | AGCATGGCATTCAAGGCCTC | CCGGGT | chr3 | 133746803 | 133746822 | 133746819 | + |
| SEQ ID NO 50940 | CTTTCAGAGGCTGATGTCCC | CTGGGT | chr3 | 133746841 | 133746860 | 133746857 | + |
| SEQ ID NO 50941 | GCCATCGAGCGGTCAGAGCA | TGGGGT | chr3 | 133746904 | 133746923 | 133746920 | + |
| SEQ ID NO 50942 | GGGGTTTGAAGCCAGACTTC | TTGGAT | chr3 | 133746925 | 133746944 | 133746941 | + |
| SEQ ID NO 50943 | GGCCGGCTCCTCACCAGGGA | GGGGGT | chr3 | 133746960 | 133746979 | 133746976 | + |
| SEQ ID NO 50944 | TCATCACAGCACTTGCCTGG | GAGGGT | chr3 | 133746985 | 133747004 | 133747001 | + |
| SEQ ID NO 50945 | CTTGCCTGGGAGGGTCAAAT | GAGGGT | chr3 | 133746996 | 133747015 | 133747012 | + |
| SEQ ID NO 50946 | GGTCAGCGAGGTGGCAGATG | CTGAGT | chr3 | 133747019 | 133747038 | 133747035 | + |
| SEQ ID NO 50947 | CACAGGCTTATGTTGCCTCC | TAGGAT | chr3 | 133747354 | 133747373 | 133747370 | + |
| SEQ ID NO 50948 | CATGGGCCAAGAGGGAAAAT | GGGGGT | chr3 | 133747384 | 133747403 | 133747400 | + |
| SEQ ID NO 50949 | AGAGGGAAAATGGGGGTCGC | TGGGGT | chr3 | 133747393 | 133747412 | 133747409 | + |
| SEQ ID NO 50950 | GCCTCCTCTCCACAGGCTTT | GTGGAT | chr3 | 133747464 | 133747483 | 133747480 | + |
| SEQ ID NO 50951 | GTGGATCTTCTTCAGAGCCA | GTGAGT | chr3 | 133747484 | 133747503 | 133747500 | + |
| SEQ ID NO 50952 | CCTTGCTGTGGTGGCCCACA | AGGAGT | chr3 | 133747513 | 133747532 | 133747529 | + |
| SEQ ID NO 50953 | AGGGCAAAAGCTCATGTGAT | AGGGAT | chr3 | 133747564 | 133747583 | 133747580 | + |
| SEQ ID NO 50954 | GATGCTGTCTCTGCAACCAC | ATGGAT | chr3 | 133747587 | 133747606 | 133747603 | + |
| SEQ ID NO 50955 | GGCTGGCTTCAGCTTTTTTT | GTGAAT | chr3 | 133747629 | 133747648 | 133747645 | + |
| SEQ ID NO 50956 | AAAAAGTGTGGTGAAAATGG | AGGGAT | chr3 | 133747662 | 133747681 | 133747678 | + |
| SEQ ID NO 50957 | TGGAGACAGAGGGGAGACTG | TTGAAT | chr3 | 133747695 | 133747714 | 133747711 | + |
| SEQ ID NO 50958 | AGGGGAGACTGTTGAATTTG | TGGAGT | chr3 | 133747704 | 133747723 | 133747720 | + |
| SEQ ID NO 50959 | CTAAACAGAGAGCAACAGAC | AAGAGT | chr3 | 133747742 | 133747761 | 133747758 | + |
| SEQ ID NO 50960 | CCCTCAACTACTGGCCAAGA | AGGGGT | chr3 | 133747799 | 133747818 | 133747815 | + |
| SEQ ID NO 50961 | GGCCAAGAAGGGGTGTAACT | CAGAAT | chr3 | 133747811 | 133747830 | 133747827 | + |
| SEQ ID NO 50962 | ATGTTTTCTTCTTTTGTGCC | CTGAGT | chr3 | 133747835 | 133747854 | 133747851 | + |
| SEQ ID NO 50963 | TGTGCCCTGAGTAGCAGACC | CAGAGT | chr3 | 133747849 | 133747868 | 133747865 | + |
| SEQ ID NO 50964 | CTGGCTTGGCCAACGACAAG | CAGGGT | chr3 | 133747896 | 133747915 | 133747912 | + |
| SEQ ID NO 50965 | CAACGACAAGCAGGGTGACC | TTGGGT | chr3 | 133747906 | 133747925 | 133747922 | + |
| SEQ ID NO 50966 | AAAAAAAAAGGCATCATTCT | CTGAGT | chr3 | 133747937 | 133747956 | 133747953 | + |
| SEQ ID NO 50967 | GAGGTAGCAAGCCAATGTGT | TGGGGT | chr3 | 133748019 | 133748038 | 133748035 | + |
| SEQ ID NO 50968 | CAGTGATGGGAGGAGACAAG | GCGGAT | chr3 | 133748104 | 133748123 | 133748120 | + |
| SEQ ID NO 50969 | CTGCACCCCTCTGGCCAGCA | GAGGGT | chr3 | 133748176 | 133748195 | 133748192 | + |
| SEQ ID NO 50970 | ACCTTCTATTGGCTCAGACT | CAGAAT | chr3 | 133748234 | 133748253 | 133748250 | + |
| SEQ ID NO 50971 | GCCCTGTAGTGTTCATGGAC | AGGAGT | chr3 | 133748274 | 133748293 | 133748290 | + |
| SEQ ID NO 50972 | TGAGAGGAGGACAGGACTGA | GGGGAT | chr3 | 133748299 | 133748318 | 133748315 | + |
| SEQ ID NO 50973 | GCTGTCTCTCCCTCAGCATA | GGGAGT | chr3 | 133748354 | 133748373 | 133748370 | + |
| SEQ ID NO 50974 | AGCATGAGGCCACTAAGTGC | CAGAGT | chr3 | 133748463 | 133748482 | 133748479 | + |

Figure 74 (Cont'd)

| | | | | | | | |
|---|---|---|---|---|---|---|---|
| SEQ ID NO 50975 | CACAAGCAACACTGGGACCA | TCGGAT | chr3 | 133748524 | 133748543 | 133748527 | - |
| SEQ ID NO 50976 | GCAACACTGGGACCATCGGA | TGGAAT | chr3 | 133748519 | 133748538 | 133748522 | - |
| SEQ ID NO 50977 | GGCACAAGTTCTACTGCATT | CTGAGT | chr3 | 133748257 | 133748276 | 133748260 | - |
| SEQ ID NO 50978 | GACCACCCTCTGCTGGCCAG | AGGGGT | chr3 | 133748186 | 133748205 | 133748189 | - |
| SEQ ID NO 50979 | CTATGGAAAACCAGCGGGGG | AGGAAT | chr3 | 133747997 | 133748016 | 133748000 | - |
| SEQ ID NO 50980 | TTGCCATCTTTTTGAGAAGA | GGGAGT | chr3 | 133747972 | 133747991 | 133747975 | - |
| SEQ ID NO 50981 | AGAAGAGGGAGTGAGACTCA | GAGAAT | chr3 | 133747958 | 133747977 | 133747961 | - |
| SEQ ID NO 50982 | GTCGTTGGCCAAGCCAGGCC | TAGAAT | chr3 | 133747893 | 133747912 | 133747896 | - |
| SEQ ID NO 50983 | GGCCAAGCCAGGCCTAGAAT | CTGGGT | chr3 | 133747887 | 133747906 | 133747890 | - |
| SEQ ID NO 50984 | AGAATCTGGGTCTCCAGACT | CTGGGT | chr3 | 133747872 | 133747891 | 133747875 | - |
| SEQ ID NO 50985 | GCACAAAGAAGAAAACATT | CTGAGT | chr3 | 133747834 | 133747853 | 133747837 | - |
| SEQ ID NO 50986 | CCCCTTCTTGGCCAGTAGTT | GAGGGT | chr3 | 133747804 | 133747823 | 133747807 | - |
| SEQ ID NO 50987 | GTTGAGGGTAAATTAACGAA | AAGAAT | chr3 | 133747787 | 133747806 | 133747790 | - |
| SEQ ID NO 50988 | AAAAAAAGCTGAAGCCAGCC | ATGGGT | chr3 | 133747629 | 133747648 | 133747632 | - |
| SEQ ID NO 50989 | AGAGGAGGCCCACAGCTCTC | CAGGAT | chr3 | 133747453 | 133747472 | 133747456 | - |
| SEQ ID NO 50990 | ATGCATGAGGAGGGGCCACC | AGGGAT | chr3 | 133747429 | 133747448 | 133747432 | - |
| SEQ ID NO 50991 | CCTCCACAAAGCCCTGCCTC | CAGAGT | chr3 | 133747328 | 133747347 | 133747331 | - |
| SEQ ID NO 50992 | CCTCCAGAGTTCCCATAGGC | GAGAAT | chr3 | 133747312 | 133747331 | 133747315 | - |
| SEQ ID NO 50993 | GCCTGTGAAGTGCTCTGTGC | GGGGAT | chr3 | 133747257 | 133747276 | 133747260 | - |
| SEQ ID NO 50994 | GGGGATAAAGGCAAGTAACG | TGGGGT | chr3 | 133747237 | 133747256 | 133747240 | - |
| SEQ ID NO 50995 | TAACGTGGGGTCCTCTCTCA | AGGAAT | chr3 | 133747222 | 133747241 | 133747225 | - |
| SEQ ID NO 50996 | AACAGTGTGACAAATGCCCC | ATGAAT | chr3 | 133747156 | 133747175 | 133747159 | - |
| SEQ ID NO 50997 | CATGAATGGCAGGCAGAAGT | TAGAGT | chr3 | 133747137 | 133747156 | 133747140 | - |
| SEQ ID NO 50998 | GGCCCCACCTCAGGAGGTCG | GGGAGT | chr3 | 133747103 | 133747122 | 133747106 | - |
| SEQ ID NO 50999 | CGTCAGCCACTGCCCCATAG | CAGGAT | chr3 | 133747073 | 133747092 | 133747076 | - |
| SEQ ID NO 51000 | GGTGAGGAGCCGGCCAGGAC | TTGGAT | chr3 | 133746955 | 133746974 | 133746958 | - |
| SEQ ID NO 51001 | GGGACATCAGCCTCTGAAAG | GGGAAT | chr3 | 133746841 | 133746860 | 133746844 | - |
| SEQ ID NO 51002 | ATGGTCAGACCCGGGAGGCC | TTGAAT | chr3 | 133746817 | 133746836 | 133746820 | - |
| SEQ ID NO 51003 | AGGCCTTGAATGCCATGCTA | AGGAGT | chr3 | 133746802 | 133746821 | 133746805 | - |
| SEQ ID NO 51004 | CTTGACAAGAGGCAGCAGCA | AAGGGT | chr3 | 133746771 | 133746790 | 133746774 | - |
| SEQ ID NO 51005 | AGGAGGAGGGGAGAAGACA | GTGAGT | chr3 | 133746678 | 133746697 | 133746681 | - |
| SEQ ID NO 51006 | TAGAAGCCCAAGCAAAGGCC | AGGGGT | chr3 | 133746637 | 133746656 | 133746640 | - |
| SEQ ID NO 51007 | CCAGGCTTCCAGCCTGAGCG | CGGAGT | chr3 | 133746575 | 133746594 | 133746578 | - |
| SEQ ID NO 51008 | GCAGGCTGCGCGGTGGCCGC | CCGGGT | chr3 | 133746545 | 133746564 | 133746548 | - |
| SEQ ID NO 51009 | CCCACGGCGAGCCTCATCTT | CCGGGT | chr3 | 133746438 | 133746457 | 133746441 | - |
| SEQ ID NO 51010 | GACCTCCCGTGTTTGTGCAG | CCGGGT | chr3 | 133746308 | 133746327 | 133746311 | - |
| SEQ ID NO 51011 | CTGAGCTCTGGAGACGACCC | GCGAGT | chr3 | 133746222 | 133746241 | 133746225 | - |
| SEQ ID NO 51012 | GGAGACGACCCGCGAGTGGA | AGGAGT | chr3 | 133746213 | 133746232 | 133746216 | - |

Figure 75

| # | Sequence | PAM | Chr | Start | End | Cuts 5' of | Str |
|---|---|---|---|---|---|---|---|
| SEQ ID NO 51013 | TCGCGGGTCGTCTCCAGAGC | TCAGAAA | chr3 | 133746218 | 133746237 | 133746234 | + |
| SEQ ID NO 51014 | TGGCCAAGAAGGGGTGTAAC | TCAGAAT | chr3 | 133747810 | 133747829 | 133747826 | + |
| SEQ ID NO 51015 | AACCTTCTATTGGCTCAGAC | TCAGAAT | chr3 | 133748233 | 133748252 | 133748249 | + |
| SEQ ID NO 51016 | GGTCCCAGTGTTGCTTGTGT | GAAGAAA | chr3 | 133748525 | 133748544 | 133748541 | + |
| SEQ ID NO 51017 | AGGGAGAGACAGCATCGCCC | CTAGAAA | chr3 | 133748347 | 133748366 | 133748350 | - |
| SEQ ID NO 51018 | GAGAAGAGGGAGTGAGACTC | AGAGAAT | chr3 | 133747959 | 133747978 | 133747962 | - |
| SEQ ID NO 51019 | TGTCGTTGGCCAAGCCAGGC | CTAGAAT | chr3 | 133747894 | 133747913 | 133747897 | - |
| SEQ ID NO 51020 | CTGCTACTCAGGGCACAAAA | GAAGAAA | chr3 | 133747846 | 133747865 | 133747849 | - |
| SEQ ID NO 51021 | AGTTGAGGGTAAATTAACGA | AAAGAAT | chr3 | 133747788 | 133747807 | 133747791 | - |
| SEQ ID NO 51022 | GCCTCCAGAGTTCCCATAGG | CGAGAAT | chr3 | 133747313 | 133747332 | 133747316 | - |
| SEQ ID NO 51023 | GGAATTGCTAGCTTATGGGG | AGAGAAA | chr3 | 133747201 | 133747220 | 133747204 | - |
| SEQ ID NO 51024 | GCGAGTGGAAGGAGTCCAGC | ACAGAAA | chr3 | 133746202 | 133746221 | 133746205 | - |

Figure 76

| # | Sequence | PAM | Chr | Start | End | Cuts 5' of | Str |
|---|---|---|---|---|---|---|---|
| SEQ ID NO 51025 | AGCACGTCTAACCAGGTTAT | CAAAAC | chr3 | 133746741 | 133746760 | 133746757 | + |
| SEQ ID NO 51026 | GCCAATGTGTTGGGGTAGCT | GAAAAC | chr3 | 133748029 | 133748048 | 133748045 | + |
| SEQ ID NO 51027 | CTGTGTCTGGCTGTCCCTGA | TAAAAC | chr3 | 133748414 | 133748433 | 133748430 | + |
| SEQ ID NO 51028 | GGCTTGCTACCTCAACTATG | GAAAAC | chr3 | 133748012 | 133748031 | 133748015 | - |
| SEQ ID NO 51029 | CTACTCAGGGCACAAAAGAA | GAAAAC | chr3 | 133747843 | 133747862 | 133747846 | - |
| SEQ ID NO 51030 | CTCTCTGTTTAGGAAGAACT | AAAAAC | chr3 | 133747734 | 133747753 | 133747737 | - |
| SEQ ID NO 51031 | ATTGCTAGCTTATGGGGAGA | GAAAAC | chr3 | 133747198 | 133747217 | 133747201 | - |

Figure 77

| # | Sequence | PAM | Chr | Start | End | Cuts 5' of | Str |
|---|---|---|---|---|---|---|---|
| SEQ ID NO 51032 | CCGCGATGACAATGGCTGCA | TTGTGCTT | chr3 | 133746147 | 133746166 | 133746163 | + |
| SEQ ID NO 51033 | AGGAAGGGGGGTTGGGAGAG | GGGCGATT | chr3 | 133746269 | 133746288 | 133746285 | + |
| SEQ ID NO 51034 | GCTGCACAAACACGGGAGGT | CAAAGATT | chr3 | 133746307 | 133746326 | 133746323 | + |
| SEQ ID NO 51035 | CTCTACGCCCACCCCTGGC | CTTTGCTT | chr3 | 133746620 | 133746639 | 133746636 | + |
| SEQ ID NO 51036 | GCCCCACCCCTGGCCTTTGC | TTGGGCTT | chr3 | 133746626 | 133746645 | 133746642 | + |
| SEQ ID NO 51037 | GCCATCGAGCGGTCAGAGCA | TGGGGTTT | chr3 | 133746904 | 133746923 | 133746920 | + |
| SEQ ID NO 51038 | TGGGGCATTTGTCACACTGT | TGGGGCTT | chr3 | 133747155 | 133747174 | 133747171 | + |
| SEQ ID NO 51039 | TTGTCACACTGTTGGGGCTT | CCACGTTT | chr3 | 133747163 | 133747182 | 133747179 | + |
| SEQ ID NO 51040 | ACACTGTTGGGGCTTCCACG | TTTAGTTT | chr3 | 133747168 | 133747187 | 133747184 | + |
| SEQ ID NO 51041 | GCCTATGGGAACTCTGGAGG | CAGGGCTT | chr3 | 133747312 | 133747331 | 133747328 | + |
| SEQ ID NO 51042 | GGCTTTGTGGAGGGGCTGCC | ACAGGCTT | chr3 | 133747335 | 133747354 | 133747351 | + |
| SEQ ID NO 51043 | CCACAGGCTTATGTTGCCTC | CTAGGATT | chr3 | 133747353 | 133747372 | 133747369 | + |
| SEQ ID NO 51044 | GAGCTGTGGGCCTCCTCTCC | ACAGGCTT | chr3 | 133747455 | 133747474 | 133747471 | + |
| SEQ ID NO 51045 | GGATGCTGTCTCTGCAACCA | CATGGATT | chr3 | 133747586 | 133747605 | 133747602 | + |
| SEQ ID NO 51046 | GATTTTAATAGTTACCCATG | GCTGGCTT | chr3 | 133747610 | 133747629 | 133747626 | + |
| SEQ ID NO 51047 | AATAGTTACCCATGGCTGGC | TTCAGCTT | chr3 | 133747616 | 133747635 | 133747632 | + |
| SEQ ID NO 51048 | AGGGGAGACTGTTGAATTTG | TGGAGTTT | chr3 | 133747704 | 133747723 | 133747720 | + |
| SEQ ID NO 51049 | CCAAGAAGGGGTGTAACTCA | GAATGTTT | chr3 | 133747813 | 133747832 | 133747829 | + |
| SEQ ID NO 51050 | GCAGACCCAGAGTCTGGAGA | CCCAGATT | chr3 | 133747862 | 133747881 | 133747878 | + |
| SEQ ID NO 51051 | CTGGAGACCCAGATTCTAGG | CCTGGCTT | chr3 | 133747875 | 133747894 | 133747891 | + |
| SEQ ID NO 51052 | AAGATGGCAATTCCTCCCCC | GCTGGTTT | chr3 | 133747982 | 133748001 | 133747998 | + |
| SEQ ID NO 51053 | TGAAAACGCCCTGTGCATAC | TGAGGCTT | chr3 | 133748048 | 133748067 | 133748064 | + |
| SEQ ID NO 51054 | AGACAAGGCGGATACAGAGG | AGCAGATT | chr3 | 133748117 | 133748136 | 133748133 | + |
| SEQ ID NO 51055 | AGCATGAGGCCACTAAGTGC | CAGAGTTT | chr3 | 133748463 | 133748482 | 133748479 | + |
| SEQ ID NO 51056 | ATTCCATCCGATGGTCCCAG | TGTTGCTT | chr3 | 133748513 | 133748532 | 133748529 | + |
| SEQ ID NO 51057 | TGTGTGAAGAAAGCCTCCTA | CCTTGATT | chr3 | 133748540 | 133748559 | 133748556 | + |
| SEQ ID NO 51058 | GCCCTGATGCAATCAAGGTA | GGAGGCTT | chr3 | 133748558 | 133748577 | 133748561 | - |
| SEQ ID NO 51059 | ACTGGGACCATCGGATGGAA | TGACGCTT | chr3 | 133748514 | 133748533 | 133748517 | - |
| SEQ ID NO 51060 | TCCGACACTGCACACCATCT | CACAGTTT | chr3 | 133748444 | 133748463 | 133748447 | - |
| SEQ ID NO 51061 | GAAGGTTGCCCTAATGGCCT | CCCAGTTT | chr3 | 133748220 | 133748239 | 133748223 | - |
| SEQ ID NO 51062 | CATAAGCCTCAGTATGCACA | GGGCGTTT | chr3 | 133748059 | 133748078 | 133748062 | - |
| SEQ ID NO 51063 | GTTTTCAGCTACCCCAACAC | ATTGGCTT | chr3 | 133748035 | 133748054 | 133748038 | - |
| SEQ ID NO 51064 | TTTTTTTTAACCCAAGGTCA | CCCTGCTT | chr3 | 133747921 | 133747940 | 133747924 | - |
| SEQ ID NO 51065 | TGTAACTCTTGTCTGTTGCT | CTCTGTTT | chr3 | 133747752 | 133747771 | 133747755 | - |
| SEQ ID NO 51066 | AGAGACAGCATCCCTATCAC | ATGAGCTT | chr3 | 133747579 | 133747598 | 133747582 | - |
| SEQ ID NO 51067 | GGGTCCTCTCTCAAGGAATT | GCTAGCTT | chr3 | 133747215 | 133747234 | 133747218 | - |
| SEQ ID NO 51068 | CAGGACTTGGATCCAAGAAG | TCTGGCTT | chr3 | 133746941 | 133746960 | 133746944 | - |
| SEQ ID NO 51069 | ATGCTCTGACCGCTCGATGG | CACCGCTT | chr3 | 133746905 | 133746924 | 133746908 | - |
| SEQ ID NO 51070 | CTTGACAAGAGGCAGCAGCA | AAGGGTTT | chr3 | 133746771 | 133746790 | 133746774 | - |
| SEQ ID NO 51071 | TGATAACCTGGTTAGACGTG | CTCTGATT | chr3 | 133746743 | 133746762 | 133746746 | - |
| SEQ ID NO 51072 | ATTTATTGTATTTCACTGCT | GCAAGATT | chr3 | 133746718 | 133746737 | 133746721 | - |
| SEQ ID NO 51073 | ATGGAAAGGCACCCAGACAC | CCAGGCTT | chr3 | 133746595 | 133746614 | 133746598 | - |
| SEQ ID NO 51074 | TGAGCAGCGAGCACAGTCGG | ACTCGCTT | chr3 | 133746405 | 133746424 | 133746408 | - |
| SEQ ID NO 51075 | TGGGCGCAATCTTTGACCTC | CCGTGTTT | chr3 | 133746322 | 133746341 | 133746325 | - |

Figure 78

| # | Sequence | PAM | Chr | Start | End | Cut site 1 (5' of) | Cut site 2 (5' of) | Str |
|---|---|---|---|---|---|---|---|---|
| SEQ ID NO 51076 | CATTGTGCTTCATGTCCCTTCC | CTG | chr3 | 133746165 | 133746186 | 133746182 | 133746187 | + |
| SEQ ID NO 51077 | TGCTTCATGTCCCTTCCCATCA | TTG | chr3 | 133746170 | 133746191 | 133746187 | 133746192 | + |
| SEQ ID NO 51078 | CATGTCCCTTCCCATCAACATT | CTT | chr3 | 133746175 | 133746196 | 133746192 | 133746197 | + |
| SEQ ID NO 51079 | ATGTCCCTTCCCATCAACATTT | TTC | chr3 | 133746176 | 133746197 | 133746193 | 133746198 | + |
| SEQ ID NO 51080 | CCCATCAACATTTCTGTGCTGG | CTT | chr3 | 133746185 | 133746206 | 133746202 | 133746207 | + |
| SEQ ID NO 51081 | CCATCAACATTTCTGTGCTGGA | TTC | chr3 | 133746186 | 133746207 | 133746203 | 133746208 | + |
| SEQ ID NO 51082 | CTGTGCTGGACTCCTTCCACTC | TTT | chr3 | 133746198 | 133746219 | 133746215 | 133746220 | + |
| SEQ ID NO 51083 | TGTGCTGGACTCCTTCCACTCG | TTC | chr3 | 133746199 | 133746220 | 133746216 | 133746221 | + |
| SEQ ID NO 51084 | TGCTGGACTCCTTCCACTCGCG | CTG | chr3 | 133746201 | 133746222 | 133746218 | 133746223 | + |
| SEQ ID NO 51085 | GACTCCTTCCACTCGCGGTCG | CTG | chr3 | 133746206 | 133746227 | 133746223 | 133746228 | + |
| SEQ ID NO 51086 | CTTCCACTCGCGGTCGTCTCC | CTC | chr3 | 133746211 | 133746232 | 133746228 | 133746233 | + |
| SEQ ID NO 51087 | CCACTCGCGGGTCGTCTCCAGA | CTT | chr3 | 133746214 | 133746235 | 133746231 | 133746236 | + |
| SEQ ID NO 51088 | CACTCGCGGGTCGTCTCCAGAG | TTC | chr3 | 133746215 | 133746236 | 133746232 | 133746237 | + |
| SEQ ID NO 51089 | GCGGGTCGTCTCCAGAGCTCAG | CTC | chr3 | 133746220 | 133746241 | 133746237 | 133746242 | + |
| SEQ ID NO 51090 | CAGAGCTCAGAAAATGAGGTGA | CTC | chr3 | 133746232 | 133746253 | 133746249 | 133746254 | + |
| SEQ ID NO 51091 | AGAAAATGAGGTGATCAGTGGG | CTC | chr3 | 133746240 | 133746261 | 133746257 | 133746262 | + |
| SEQ ID NO 51092 | GGAGAGGGGCGATTGGGCAACC | TTG | chr3 | 133746283 | 133746304 | 133746300 | 133746305 | + |
| SEQ ID NO 51093 | GGCAACCCGGCTGCACAAACAC | TTG | chr3 | 133746298 | 133746319 | 133746315 | 133746320 | + |
| SEQ ID NO 51094 | CACAAACACGGGAGGTCAAAGA | CTG | chr3 | 133746311 | 133746332 | 133746328 | 133746333 | + |
| SEQ ID NO 51095 | CGCCCAGCCCGCCCAGGCCGGG | TTG | chr3 | 133746336 | 133746357 | 133746353 | 133746358 | + |
| SEQ ID NO 51096 | CACAGAAGCGAGTCCGACTGTG | CTG | chr3 | 133746392 | 133746413 | 133746409 | 133746414 | + |
| SEQ ID NO 51097 | TGCTCGCTGCTCAGCGCCGCAC | CTG | chr3 | 133746412 | 133746433 | 133746429 | 133746434 | + |
| SEQ ID NO 51098 | GCTGCTCAGCGCCGCACCCGGA | CTC | chr3 | 133746417 | 133746438 | 133746434 | 133746439 | + |
| SEQ ID NO 51099 | CTCAGCGCCGCACCCGGAAGAT | CTG | chr3 | 133746421 | 133746442 | 133746438 | 133746443 | + |
| SEQ ID NO 51100 | AGCGCCGCACCCGGAAGATGAG | CTC | chr3 | 133746424 | 133746445 | 133746441 | 133746446 | + |
| SEQ ID NO 51101 | GCCGTGGGAGCCCTGCTGGTCT | CTC | chr3 | 133746450 | 133746471 | 133746467 | 133746472 | + |
| SEQ ID NO 51102 | CTGGTCTGCGCCGTCCTGGGTG | CTG | chr3 | 133746465 | 133746486 | 133746482 | 133746487 | + |
| SEQ ID NO 51103 | GTCTGCGCCGTCCTGGGTGAGT | CTG | chr3 | 133746468 | 133746489 | 133746485 | 133746490 | + |
| SEQ ID NO 51104 | CGCCGTCCTGGGTGAGTGCGGG | CTG | chr3 | 133746473 | 133746494 | 133746490 | 133746495 | + |
| SEQ ID NO 51105 | GGTGAGTGCGGGCACGGGGTAG | CTG | chr3 | 133746483 | 133746504 | 133746500 | 133746505 | + |
| SEQ ID NO 51106 | GCCCGCGCGTTCCCTGCAACCC | CTG | chr3 | 133746521 | 133746542 | 133746538 | 133746543 | + |
| SEQ ID NO 51107 | CCTGCAACCCGGGCGGCCACCG | TTC | chr3 | 133746533 | 133746554 | 133746550 | 133746555 | + |
| SEQ ID NO 51108 | CAACCCGGCGGCCACCGCGCA | CTG | chr3 | 133746537 | 133746558 | 133746554 | 133746559 | + |
| SEQ ID NO 51109 | CATGCACTCCGCGCTCAGGCTG | CTG | chr3 | 133746564 | 133746585 | 133746581 | 133746586 | + |
| SEQ ID NO 51110 | CGCGCTCAGGCTGGAAGCCTGG | CTC | chr3 | 133746573 | 133746594 | 133746590 | 133746595 | + |
| SEQ ID NO 51111 | AGGCTGGAAGCCTGGGTGTCTG | CTC | chr3 | 133746580 | 133746601 | 133746597 | 133746602 | + |
| SEQ ID NO 51112 | GAAGCCTGGGTGTCTGGGTGCC | CTG | chr3 | 133746586 | 133746607 | 133746603 | 133746608 | + |
| SEQ ID NO 51113 | GGTGTCTGGGTGCCTTTCCATT | CTG | chr3 | 133746594 | 133746615 | 133746611 | 133746616 | + |
| SEQ ID NO 51114 | GGTGCCTTTCCATTGCCTCTCT | CTG | chr3 | 133746602 | 133746623 | 133746619 | 133746624 | + |
| SEQ ID NO 51115 | TCCATTGCCTCTCTACGCCCCA | CTT | chr3 | 133746610 | 133746631 | 133746627 | 133746632 | + |
| SEQ ID NO 51116 | CCATTGCCTCTCTACGCCCCAC | TTT | chr3 | 133746611 | 133746632 | 133746628 | 133746633 | + |
| SEQ ID NO 51117 | CATTGCCTCTCTACGCCCCACC | TTC | chr3 | 133746612 | 133746633 | 133746629 | 133746634 | + |
| SEQ ID NO 51118 | CCTCTCTACGCCCCACCCCTGG | TTG | chr3 | 133746617 | 133746638 | 133746634 | 133746639 | + |
| SEQ ID NO 51119 | TCTACGCCCCACCCCTGGCCTT | CTC | chr3 | 133746621 | 133746642 | 133746638 | 133746643 | + |
| SEQ ID NO 51120 | TACGCCCCACCCCTGGCCTTTG | CTC | chr3 | 133746623 | 133746644 | 133746640 | 133746645 | + |
| SEQ ID NO 51121 | CGCCCCACCCCTGGCCTTTGCT | CTA | chr3 | 133746625 | 133746646 | 133746642 | 133746647 | + |
| SEQ ID NO 51122 | GCCTTTGCTTGGGCTTCTAGAC | CTG | chr3 | 133746638 | 133746659 | 133746655 | 133746660 | + |
| SEQ ID NO 51123 | TGCTTGGGCTTCTAGACACCTT | CTT | chr3 | 133746643 | 133746664 | 133746660 | 133746665 | + |
| SEQ ID NO 51124 | GCTTGGGCTTCTAGACACCTTT | TTT | chr3 | 133746644 | 133746665 | 133746661 | 133746666 | + |
| SEQ ID NO 51125 | CTTGGGCTTCTAGACACCTTTC | TTG | chr3 | 133746645 | 133746666 | 133746662 | 133746667 | + |
| SEQ ID NO 51126 | GGGCTTCTAGACACCTTTCACT | CTT | chr3 | 133746648 | 133746669 | 133746665 | 133746670 | + |
| SEQ ID NO 51127 | GGCTTCTAGACACCTTTCACTG | TTG | chr3 | 133746649 | 133746670 | 133746666 | 133746671 | + |
| SEQ ID NO 51128 | CTAGACACCTTTCACTGCACTC | CTT | chr3 | 133746654 | 133746675 | 133746671 | 133746676 | + |
| SEQ ID NO 51129 | TAGACACCTTTCACTGCACTCA | TTC | chr3 | 133746655 | 133746676 | 133746672 | 133746677 | + |
| SEQ ID NO 51130 | GACACCTTTCACTGCACTCACT | CTA | chr3 | 133746657 | 133746678 | 133746674 | 133746679 | + |
| SEQ ID NO 51131 | TCACTGCACTCACTGTCTTCTC | CTT | chr3 | 133746665 | 133746686 | 133746682 | 133746687 | + |
| SEQ ID NO 51132 | CACTGCACTCACTGTCTTCTCC | TTT | chr3 | 133746666 | 133746687 | 133746683 | 133746688 | + |
| SEQ ID NO 51133 | ACTGCACTCACTGTCTTCTCCC | TTC | chr3 | 133746667 | 133746688 | 133746684 | 133746689 | + |

Figure 78 (Cont'd)

| SEQ ID NO 51134 | CACTCACTGTCTTCTCCCCCTC | CTG | chr3 | 133746671 | 133746692 | 133746688 | 133746693 | + |
|---|---|---|---|---|---|---|---|---|
| SEQ ID NO 51135 | ACTGTCTTCTCCCCCTCCTCCT | CTC | chr3 | 133746676 | 133746697 | 133746693 | 133746698 | + |
| SEQ ID NO 51136 | TCTTCTCCCCCTCCTCCTCTTT | CTG | chr3 | 133746680 | 133746701 | 133746697 | 133746702 | + |
| SEQ ID NO 51137 | CTCCCCCTCCTCCTCTTTGTCC | CTT | chr3 | 133746684 | 133746705 | 133746701 | 133746706 | + |
| SEQ ID NO 51138 | TCCCCCTCCTCCTCTTTGTCCA | TTC | chr3 | 133746685 | 133746706 | 133746702 | 133746707 | + |
| SEQ ID NO 51139 | CCCCTCCTCCTCTTTGTCCAGT | CTC | chr3 | 133746687 | 133746708 | 133746704 | 133746709 | + |
| SEQ ID NO 51140 | CTCCTCTTTGTCCAGTAAATCT | CTC | chr3 | 133746693 | 133746714 | 133746710 | 133746715 | + |
| SEQ ID NO 51141 | CTCTTTGTCCAGTAAATCTTGC | CTC | chr3 | 133746696 | 133746717 | 133746713 | 133746718 | + |
| SEQ ID NO 51142 | TTTGTCCAGTAAATCTTGCAGC | CTC | chr3 | 133746699 | 133746720 | 133746716 | 133746721 | + |
| SEQ ID NO 51143 | TGTCCAGTAAATCTTGCAGCAG | CTT | chr3 | 133746701 | 133746722 | 133746718 | 133746723 | + |
| SEQ ID NO 51144 | GTCCAGTAAATCTTGCAGCAGT | TTT | chr3 | 133746702 | 133746723 | 133746719 | 133746724 | + |
| SEQ ID NO 51145 | TCCAGTAAATCTTGCAGCAGTG | TTG | chr3 | 133746703 | 133746724 | 133746720 | 133746725 | + |
| SEQ ID NO 51146 | GCAGCAGTGAAATACAATAAAT | CTT | chr3 | 133746716 | 133746737 | 133746733 | 133746738 | + |
| SEQ ID NO 51147 | CAGCAGTGAAATACAATAAATC | TTG | chr3 | 133746717 | 133746738 | 133746734 | 133746739 | + |
| SEQ ID NO 51148 | ACCAGGTTATCAAAACCCTTTG | CTA | chr3 | 133746751 | 133746772 | 133746768 | 133746773 | + |
| SEQ ID NO 51149 | TCAAAACCCTTTGCTGCTGCCT | TTA | chr3 | 133746760 | 133746781 | 133746777 | 133746782 | + |
| SEQ ID NO 51150 | TGCTGCTGCCTCTTGTCAAGTC | CTT | chr3 | 133746771 | 133746792 | 133746788 | 133746793 | + |
| SEQ ID NO 51151 | GCTGCTGCCTCTTGTCAAGTCC | TTT | chr3 | 133746772 | 133746793 | 133746789 | 133746794 | + |
| SEQ ID NO 51152 | CTGCTGCCTCTTGTCAAGTCCG | TTG | chr3 | 133746773 | 133746794 | 133746790 | 133746795 | + |
| SEQ ID NO 51153 | CTGCCTCTTGTCAAGTCCGAAC | CTG | chr3 | 133746776 | 133746797 | 133746793 | 133746798 | + |
| SEQ ID NO 51154 | CCTCTTGTCAAGTCCGAACTCC | CTG | chr3 | 133746779 | 133746800 | 133746796 | 133746801 | + |
| SEQ ID NO 51155 | TTGTCAAGTCCGAACTCCTTAG | CTC | chr3 | 133746783 | 133746804 | 133746800 | 133746805 | + |
| SEQ ID NO 51156 | GTCAAGTCCGAACTCCTTAGCA | CTT | chr3 | 133746785 | 133746806 | 133746802 | 133746807 | + |
| SEQ ID NO 51157 | TCAAGTCCGAACTCCTTAGCAT | TTG | chr3 | 133746786 | 133746807 | 133746803 | 133746808 | + |
| SEQ ID NO 51158 | CTTAGCATGGCATTCAAGGCCT | CTC | chr3 | 133746800 | 133746821 | 133746817 | 133746822 | + |
| SEQ ID NO 51159 | AGCATGGCATTCAAGGCCTCCC | CTT | chr3 | 133746803 | 133746824 | 133746820 | 133746825 | + |
| SEQ ID NO 51160 | GCATGGCATTCAAGGCCTCCCG | TTA | chr3 | 133746804 | 133746825 | 133746821 | 133746826 | + |
| SEQ ID NO 51161 | AAGGCCTCCCGGGTCTGACCAT | TTC | chr3 | 133746815 | 133746836 | 133746832 | 133746837 | + |
| SEQ ID NO 51162 | CCGGGTCTGACCATTCCCCTTT | CTC | chr3 | 133746823 | 133746844 | 133746840 | 133746845 | + |
| SEQ ID NO 51163 | ACCATTCCCCTTTCAGAGGCTG | CTG | chr3 | 133746832 | 133746853 | 133746849 | 133746854 | + |
| SEQ ID NO 51164 | CCCTTTCAGAGGCTGATGTCCC | TTC | chr3 | 133746839 | 133746860 | 133746856 | 133746861 | + |
| SEQ ID NO 51165 | TCAGAGGCTGATGTCCCCTGGG | CTT | chr3 | 133746844 | 133746865 | 133746861 | 133746866 | + |
| SEQ ID NO 51166 | CAGAGGCTGATGTCCCCTGGGT | TTT | chr3 | 133746845 | 133746866 | 133746862 | 133746867 | + |
| SEQ ID NO 51167 | AGAGGCTGATGTCCCCTGGGTG | TTC | chr3 | 133746846 | 133746867 | 133746863 | 133746868 | + |
| SEQ ID NO 51168 | ATGTCCCCTGGGTGCCCTGGGA | CTG | chr3 | 133746854 | 133746875 | 133746871 | 133746876 | + |
| SEQ ID NO 51169 | GGTGCCCTGGGAGCTGTAGATG | CTG | chr3 | 133746864 | 133746885 | 133746881 | 133746886 | + |
| SEQ ID NO 51170 | GGAGCTGTAGATGTCCTGCCAA | CTG | chr3 | 133746873 | 133746894 | 133746890 | 133746895 | + |
| SEQ ID NO 51171 | TAGATGTCCTGCCAAGGAAGCG | CTG | chr3 | 133746880 | 133746901 | 133746897 | 133746902 | + |
| SEQ ID NO 51172 | CCAAGGAAGCGGTGCCATCGAG | CTG | chr3 | 133746891 | 133746912 | 133746908 | 133746913 | + |
| SEQ ID NO 51173 | GAAGCCAGACTTCTTGGATCCA | TTT | chr3 | 133746932 | 133746953 | 133746949 | 133746954 | + |
| SEQ ID NO 51174 | AAGCCAGACTTCTTGGATCCAA | TTG | chr3 | 133746933 | 133746954 | 133746950 | 133746955 | + |
| SEQ ID NO 51175 | CTTGGATCCAAGTCCTGGCCGG | CTT | chr3 | 133746944 | 133746965 | 133746961 | 133746966 | + |
| SEQ ID NO 51176 | TTGGATCCAAGTCCTGGCCGGC | TTC | chr3 | 133746945 | 133746966 | 133746962 | 133746967 | + |
| SEQ ID NO 51177 | GGATCCAAGTCCTGGCCGGCTC | CTT | chr3 | 133746947 | 133746968 | 133746964 | 133746969 | + |
| SEQ ID NO 51178 | GATCCAAGTCCTGGCCGGCTCC | TTG | chr3 | 133746948 | 133746969 | 133746965 | 133746970 | + |
| SEQ ID NO 51179 | GCCGGCTCCTCACCAGGGAGGG | CTG | chr3 | 133746961 | 133746982 | 133746978 | 133746983 | + |
| SEQ ID NO 51180 | CTCACCAGGGAGGGGGTCATCA | CTC | chr3 | 133746969 | 133746990 | 133746986 | 133746991 | + |
| SEQ ID NO 51181 | ACCAGGGAGGGGGTCATCACAG | CTC | chr3 | 133746972 | 133746993 | 133746989 | 133746994 | + |
| SEQ ID NO 51182 | GCCTGGGAGGGTCAAATGAGGG | CTT | chr3 | 133746999 | 133747020 | 133747016 | 133747021 | + |
| SEQ ID NO 51183 | CCTGGGAGGGTCAAATGAGGGT | TTG | chr3 | 133747000 | 133747021 | 133747017 | 133747022 | + |
| SEQ ID NO 51184 | GGAGGGTCAAATGAGGGTCAGC | CTG | chr3 | 133747004 | 133747025 | 133747021 | 133747026 | + |
| SEQ ID NO 51185 | AGTACCAGTGGCAGATGTTGCA | CTG | chr3 | 133747042 | 133747063 | 133747059 | 133747064 | + |
| SEQ ID NO 51186 | CACACATCCTGCTATGGGGCAG | TTG | chr3 | 133747062 | 133747083 | 133747079 | 133747084 | + |
| SEQ ID NO 51187 | CTATGGGGCAGTGGCTGACGCC | CTG | chr3 | 133747073 | 133747094 | 133747090 | 133747095 | + |
| SEQ ID NO 51188 | TGGGGCAGTGGCTGACGCCACA | CTA | chr3 | 133747076 | 133747097 | 133747093 | 133747098 | + |
| SEQ ID NO 51189 | ACGCCACACTCCCCGACCTCCT | CTG | chr3 | 133747090 | 133747111 | 133747107 | 133747112 | + |
| SEQ ID NO 51190 | CCCGACCTCCTGAGGTGGGGCC | CTC | chr3 | 133747101 | 133747122 | 133747118 | 133747123 | + |
| SEQ ID NO 51191 | CTGAGGTGGGGCCCCCTTCATA | CTC | chr3 | 133747110 | 133747131 | 133747127 | 133747132 | + |
| SEQ ID NO 51192 | AGGTGGGGCCCCCTTCATACTC | CTG | chr3 | 133747113 | 133747134 | 133747130 | 133747135 | + |

Figure 78 (Cont'd)

| SEQ ID NO 51193 | CATACTCTAACTTCTGCCTGCC | CTT | chr3 | 133747128 | 133747149 | 133747145 | 133747150 | + |
|---|---|---|---|---|---|---|---|---|
| SEQ ID NO 51194 | ATACTCTAACTTCTGCCTGCCA | TTC | chr3 | 133747129 | 133747150 | 133747146 | 133747151 | + |
| SEQ ID NO 51195 | TAACTTCTGCCTGCCATTCATG | CTC | chr3 | 133747135 | 133747156 | 133747152 | 133747157 | + |
| SEQ ID NO 51196 | ACTTCTGCCTGCCATTCATGGG | CTA | chr3 | 133747137 | 133747158 | 133747154 | 133747159 | + |
| SEQ ID NO 51197 | CTGCCTGCCATTCATGGGGCAT | CTT | chr3 | 133747141 | 133747162 | 133747158 | 133747163 | + |
| SEQ ID NO 51198 | TGCCTGCCATTCATGGGGCATT | TTC | chr3 | 133747142 | 133747163 | 133747159 | 133747164 | + |
| SEQ ID NO 51199 | CCTGCCATTCATGGGGCATTTG | CTG | chr3 | 133747144 | 133747165 | 133747161 | 133747166 | + |
| SEQ ID NO 51200 | CCATTCATGGGGCATTTGTCAC | CTG | chr3 | 133747148 | 133747169 | 133747165 | 133747170 | + |
| SEQ ID NO 51201 | ATGGGGCATTTGTCACACTGTT | TTC | chr3 | 133747154 | 133747175 | 133747171 | 133747176 | + |
| SEQ ID NO 51202 | GTCACACTGTTGGGGCTTCCAC | TTT | chr3 | 133747165 | 133747186 | 133747182 | 133747187 | + |
| SEQ ID NO 51203 | TCACACTGTTGGGGCTTCCACG | TTG | chr3 | 133747166 | 133747187 | 133747183 | 133747188 | + |
| SEQ ID NO 51204 | TTGGGGCTTCCACGTTTAGTTT | CTG | chr3 | 133747174 | 133747195 | 133747191 | 133747196 | + |
| SEQ ID NO 51205 | GGGCTTCCACGTTTAGTTTTCT | TTG | chr3 | 133747177 | 133747198 | 133747194 | 133747199 | + |
| SEQ ID NO 51206 | CCACGTTTAGTTTTCTCTCCCC | CTT | chr3 | 133747183 | 133747204 | 133747200 | 133747205 | + |
| SEQ ID NO 51207 | CACGTTTAGTTTTCTCTCCCCA | TTC | chr3 | 133747184 | 133747205 | 133747201 | 133747206 | + |
| SEQ ID NO 51208 | AGTTTTCTCTCCCCATAAGCTA | TTT | chr3 | 133747191 | 133747212 | 133747208 | 133747213 | + |
| SEQ ID NO 51209 | GTTTTCTCTCCCCATAAGCTAG | TTA | chr3 | 133747192 | 133747213 | 133747209 | 133747214 | + |
| SEQ ID NO 51210 | TCTCTCCCCATAAGCTAGCAAT | TTT | chr3 | 133747196 | 133747217 | 133747213 | 133747218 | + |
| SEQ ID NO 51211 | CTCTCCCCATAAGCTAGCAATT | TTT | chr3 | 133747197 | 133747218 | 133747214 | 133747219 | + |
| SEQ ID NO 51212 | TCTCCCCATAAGCTAGCAATTC | TTC | chr3 | 133747198 | 133747219 | 133747215 | 133747220 | + |
| SEQ ID NO 51213 | TCCCCATAAGCTAGCAATTCCT | CTC | chr3 | 133747200 | 133747221 | 133747217 | 133747222 | + |
| SEQ ID NO 51214 | CCCATAAGCTAGCAATTCCTTG | CTC | chr3 | 133747202 | 133747223 | 133747219 | 133747224 | + |
| SEQ ID NO 51215 | GCAATTCCTTGAGAGAGGACCC | CTA | chr3 | 133747213 | 133747234 | 133747230 | 133747235 | + |
| SEQ ID NO 51216 | CTTGAGAGAGGACCCCACGTTA | TTC | chr3 | 133747220 | 133747241 | 133747237 | 133747242 | + |
| SEQ ID NO 51217 | GAGAGAGGACCCCACGTTACTT | CTT | chr3 | 133747223 | 133747244 | 133747240 | 133747245 | + |
| SEQ ID NO 51218 | AGAGAGGACCCCACGTTACTTG | TTG | chr3 | 133747224 | 133747245 | 133747241 | 133747246 | + |
| SEQ ID NO 51219 | CTTGCCTTTATCCCCGCACAGA | TTA | chr3 | 133747242 | 133747263 | 133747259 | 133747264 | + |
| SEQ ID NO 51220 | GCCTTTATCCCCGCACAGAGCA | CTT | chr3 | 133747245 | 133747266 | 133747262 | 133747267 | + |
| SEQ ID NO 51221 | CCTTTATCCCCGCACAGAGCAC | TTG | chr3 | 133747246 | 133747267 | 133747263 | 133747268 | + |
| SEQ ID NO 51222 | TATCCCCGCACAGAGCACTTCA | CTT | chr3 | 133747250 | 133747271 | 133747267 | 133747272 | + |
| SEQ ID NO 51223 | ATCCCCGCACAGAGCACTTCAC | TTT | chr3 | 133747251 | 133747272 | 133747268 | 133747273 | + |
| SEQ ID NO 51224 | TCCCCGCACAGAGCACTTCACA | TTA | chr3 | 133747252 | 133747273 | 133747269 | 133747274 | + |
| SEQ ID NO 51225 | CACAGGCTGTGCAAGGTAATGC | CTT | chr3 | 133747270 | 133747291 | 133747287 | 133747292 | + |
| SEQ ID NO 51226 | ACAGGCTGTGCAAGGTAATGCT | TTC | chr3 | 133747271 | 133747292 | 133747288 | 133747293 | + |
| SEQ ID NO 51227 | TGCAAGGTAATGCTCCACTGAG | CTG | chr3 | 133747279 | 133747300 | 133747296 | 133747301 | + |
| SEQ ID NO 51228 | CACTGAGGACACATTCTCGCCT | CTC | chr3 | 133747294 | 133747315 | 133747311 | 133747316 | + |
| SEQ ID NO 51229 | AGGACACATTCTCGCCTATGGG | CTG | chr3 | 133747299 | 133747320 | 133747316 | 133747321 | + |
| SEQ ID NO 51230 | TCGCCTATGGGAACTCTGGAGG | TTC | chr3 | 133747310 | 133747331 | 133747327 | 133747332 | + |
| SEQ ID NO 51231 | GCCTATGGGAACTCTGGAGGCA | CTC | chr3 | 133747312 | 133747333 | 133747329 | 133747334 | + |
| SEQ ID NO 51232 | TGGGAACTCTGGAGGCAGGGCT | CTA | chr3 | 133747317 | 133747338 | 133747334 | 133747339 | + |
| SEQ ID NO 51233 | TGGAGGCAGGGCTTTGTGGAGG | CTC | chr3 | 133747326 | 133747347 | 133747343 | 133747348 | + |
| SEQ ID NO 51234 | GAGGCAGGGCTTTGTGGAGGGG | CTG | chr3 | 133747328 | 133747349 | 133747345 | 133747350 | + |
| SEQ ID NO 51235 | TGTGGAGGGGCTGCCACAGGCT | CTT | chr3 | 133747340 | 133747361 | 133747357 | 133747362 | + |
| SEQ ID NO 51236 | GTGGAGGGGCTGCCACAGGCTT | TTT | chr3 | 133747341 | 133747362 | 133747358 | 133747363 | + |
| SEQ ID NO 51237 | TGGAGGGGCTGCCACAGGCTTA | TTG | chr3 | 133747342 | 133747363 | 133747359 | 133747364 | + |
| SEQ ID NO 51238 | CCACAGGCTTATGTTGCCTCCT | CTG | chr3 | 133747353 | 133747374 | 133747370 | 133747375 | + |
| SEQ ID NO 51239 | ATGTTGCCTCCTAGGATTTCCC | CTT | chr3 | 133747363 | 133747384 | 133747380 | 133747385 | + |
| SEQ ID NO 51240 | TGTTGCCTCCTAGGATTTCCCA | TTA | chr3 | 133747364 | 133747385 | 133747381 | 133747386 | + |
| SEQ ID NO 51241 | CCTCCTAGGATTTCCCATGGGC | TTG | chr3 | 133747369 | 133747390 | 133747386 | 133747391 | + |
| SEQ ID NO 51242 | CTAGGATTTCCCATGGGCCAAG | CTC | chr3 | 133747373 | 133747394 | 133747390 | 133747395 | + |
| SEQ ID NO 51243 | GGATTTCCCATGGGCCAAGAGG | CTA | chr3 | 133747376 | 133747397 | 133747393 | 133747398 | + |
| SEQ ID NO 51244 | CCCATGGGCCAAGAGGGAAAAT | TTT | chr3 | 133747382 | 133747403 | 133747399 | 133747404 | + |
| SEQ ID NO 51245 | CCATGGGCCAAGAGGGAAAATG | TTC | chr3 | 133747383 | 133747404 | 133747400 | 133747405 | + |
| SEQ ID NO 51246 | GGGTGGCCATCCCTGGTGGCCC | CTG | chr3 | 133747415 | 133747436 | 133747432 | 133747437 | + |
| SEQ ID NO 51247 | GTGGCCCCTCCTCATGCATCCT | CTG | chr3 | 133747430 | 133747451 | 133747447 | 133747452 | + |
| SEQ ID NO 51248 | CTCATGCATCCTGGAGAGCTGT | CTC | chr3 | 133747440 | 133747461 | 133747457 | 133747462 | + |
| SEQ ID NO 51249 | ATGCATCCTGGAGAGCTGTGGG | CTC | chr3 | 133747443 | 133747464 | 133747460 | 133747465 | + |
| SEQ ID NO 51250 | GAGAGCTGTGGGCCTCCTCTCC | CTG | chr3 | 133747453 | 133747474 | 133747470 | 133747475 | + |
| SEQ ID NO 51251 | TGGGCCTCCTCTCCACAGGCTT | CTG | chr3 | 133747461 | 133747482 | 133747478 | 133747483 | + |

Figure 78 (Cont'd)

| SEQ ID NO | Sequence | Codon | Chr | Pos1 | Pos2 | Pos3 | Pos4 | Strand |
|---|---|---|---|---|---|---|---|---|
| SEQ ID NO 51252 | CTCTCCACAGGCTTTGTGGATC | CTC | chr3 | 133747469 | 133747490 | 133747486 | 133747491 | + |
| SEQ ID NO 51253 | TCCACAGGCTTTGTGGATCTTC | CTC | chr3 | 133747472 | 133747493 | 133747489 | 133747494 | + |
| SEQ ID NO 51254 | CACAGGCTTTGTGGATCTTCTT | CTC | chr3 | 133747474 | 133747495 | 133747491 | 133747496 | + |
| SEQ ID NO 51255 | TGTGGATCTTCTTCAGAGCCAG | CTT | chr3 | 133747483 | 133747504 | 133747500 | 133747505 | + |
| SEQ ID NO 51256 | GTGGATCTTCTTCAGAGCCAGT | TTT | chr3 | 133747484 | 133747505 | 133747501 | 133747506 | + |
| SEQ ID NO 51257 | TGGATCTTCTTCAGAGCCAGTG | TTG | chr3 | 133747485 | 133747506 | 133747502 | 133747507 | + |
| SEQ ID NO 51258 | CTTCAGAGCCAGTGAGTCAGCC | CTT | chr3 | 133747493 | 133747514 | 133747510 | 133747515 | + |
| SEQ ID NO 51259 | TTCAGAGCCAGTGAGTCAGCCT | TTC | chr3 | 133747494 | 133747515 | 133747511 | 133747516 | + |
| SEQ ID NO 51260 | CAGAGCCAGTGAGTCAGCCTTG | CTT | chr3 | 133747496 | 133747517 | 133747513 | 133747518 | + |
| SEQ ID NO 51261 | AGAGCCAGTGAGTCAGCCTTGC | TTC | chr3 | 133747497 | 133747518 | 133747514 | 133747519 | + |
| SEQ ID NO 51262 | GCTGTGGTGGCCCACAAGGAGT | CTT | chr3 | 133747517 | 133747538 | 133747534 | 133747539 | + |
| SEQ ID NO 51263 | CTGTGGTGGCCCACAAGGAGTG | TTG | chr3 | 133747518 | 133747539 | 133747535 | 133747540 | + |
| SEQ ID NO 51264 | TGGTGGCCCACAAGGAGTGGAG | CTG | chr3 | 133747521 | 133747542 | 133747538 | 133747543 | + |
| SEQ ID NO 51265 | GGGGACAGGGCAAAAGCTCATG | CTT | chr3 | 133747558 | 133747579 | 133747575 | 133747580 | + |
| SEQ ID NO 51266 | GGGACAGGGCAAAAGCTCATGT | TTG | chr3 | 133747559 | 133747580 | 133747576 | 133747581 | + |
| SEQ ID NO 51267 | ATGTGATAGGGATGCTGTCTCT | CTC | chr3 | 133747577 | 133747598 | 133747594 | 133747599 | + |
| SEQ ID NO 51268 | TCTCTGCAACCACATGGATTTT | CTG | chr3 | 133747594 | 133747615 | 133747611 | 133747616 | + |
| SEQ ID NO 51269 | TGCAACCACATGGATTTTAATA | CTC | chr3 | 133747598 | 133747619 | 133747615 | 133747620 | + |
| SEQ ID NO 51270 | CAACCACATGGATTTTAATAGT | CTG | chr3 | 133747600 | 133747621 | 133747617 | 133747622 | + |
| SEQ ID NO 51271 | TAATAGTTACCCATGGCTGGCT | TTT | chr3 | 133747615 | 133747636 | 133747632 | 133747637 | + |
| SEQ ID NO 51272 | AATAGTTACCCATGGCTGGCTT | TTT | chr3 | 133747616 | 133747637 | 133747633 | 133747638 | + |
| SEQ ID NO 51273 | ATAGTTACCCATGGCTGGCTTC | TTA | chr3 | 133747617 | 133747638 | 133747634 | 133747639 | + |
| SEQ ID NO 51274 | CCCATGGCTGGCTTCAGCTTTT | TTA | chr3 | 133747624 | 133747645 | 133747641 | 133747646 | + |
| SEQ ID NO 51275 | GCTTCAGCTTTTTTTGTGAATG | CTG | chr3 | 133747634 | 133747655 | 133747651 | 133747656 | + |
| SEQ ID NO 51276 | CAGCTTTTTTTGTGAATGGCAG | CTT | chr3 | 133747638 | 133747659 | 133747655 | 133747660 | + |
| SEQ ID NO 51277 | AGCTTTTTTTGTGAATGGCAGC | TTC | chr3 | 133747639 | 133747660 | 133747656 | 133747661 | + |
| SEQ ID NO 51278 | TTTTTGTGAATGGCAGCCAAAA | CTT | chr3 | 133747644 | 133747665 | 133747661 | 133747666 | + |
| SEQ ID NO 51279 | TTTTGTGAATGGCAGCCAAAAA | TTT | chr3 | 133747645 | 133747666 | 133747662 | 133747667 | + |
| SEQ ID NO 51280 | TTTGTGAATGGCAGCCAAAAAG | TTT | chr3 | 133747646 | 133747667 | 133747663 | 133747668 | + |
| SEQ ID NO 51281 | TTGTGAATGGCAGCCAAAAAGT | TTT | chr3 | 133747647 | 133747668 | 133747664 | 133747669 | + |
| SEQ ID NO 51282 | TGTGAATGGCAGCCAAAAAGTG | TTT | chr3 | 133747648 | 133747669 | 133747665 | 133747670 | + |
| SEQ ID NO 51283 | GTGAATGGCAGCCAAAAAGTGT | TTT | chr3 | 133747649 | 133747670 | 133747666 | 133747671 | + |
| SEQ ID NO 51284 | TGAATGGCAGCCAAAAAGTGTG | TTG | chr3 | 133747650 | 133747671 | 133747667 | 133747672 | + |
| SEQ ID NO 51285 | AGTGGAGACAGAGGGGAGACTG | TTC | chr3 | 133747693 | 133747714 | 133747710 | 133747715 | + |
| SEQ ID NO 51286 | TTGAATTTGTGGAGTTTTTAGT | CTG | chr3 | 133747715 | 133747736 | 133747732 | 133747737 | + |
| SEQ ID NO 51287 | AATTTGTGGAGTTTTTAGTTCT | TTG | chr3 | 133747718 | 133747739 | 133747735 | 133747740 | + |
| SEQ ID NO 51288 | GTGGAGTTTTTAGTTCTTCCTA | TTT | chr3 | 133747723 | 133747744 | 133747740 | 133747745 | + |
| SEQ ID NO 51289 | TGGAGTTTTTAGTTCTTCCTAA | TTG | chr3 | 133747724 | 133747745 | 133747741 | 133747746 | + |
| SEQ ID NO 51290 | TTAGTTCTTCCTAAACAGAGAG | TTT | chr3 | 133747732 | 133747753 | 133747749 | 133747754 | + |
| SEQ ID NO 51291 | TAGTTCTTCCTAAACAGAGAGC | TTT | chr3 | 133747733 | 133747754 | 133747750 | 133747755 | + |
| SEQ ID NO 51292 | AGTTCTTCCTAAACAGAGAGCA | TTT | chr3 | 133747734 | 133747755 | 133747751 | 133747756 | + |
| SEQ ID NO 51293 | GTTCTTCCTAAACAGAGAGCAA | TTA | chr3 | 133747735 | 133747756 | 133747752 | 133747757 | + |
| SEQ ID NO 51294 | TTCCTAAACAGAGAGCAACAGA | TTC | chr3 | 133747739 | 133747760 | 133747756 | 133747761 | + |
| SEQ ID NO 51295 | CCTAAACAGAGAGCAACAGACA | CTT | chr3 | 133747741 | 133747762 | 133747758 | 133747763 | + |
| SEQ ID NO 51296 | CTAAACAGAGAGCAACAGACAA | TTC | chr3 | 133747742 | 133747763 | 133747759 | 133747764 | + |
| SEQ ID NO 51297 | AACAGAGAGCAACAGACAAGAG | CTA | chr3 | 133747745 | 133747766 | 133747762 | 133747767 | + |
| SEQ ID NO 51298 | CAGACAAATTAATTCTTTTCGT | TTA | chr3 | 133747770 | 133747791 | 133747787 | 133747792 | + |
| SEQ ID NO 51299 | ATTCTTTTCGTTAATTTACCCT | TTA | chr3 | 133747781 | 133747802 | 133747798 | 133747803 | + |
| SEQ ID NO 51300 | TTTTCGTTAATTTACCCTCAAC | TTC | chr3 | 133747785 | 133747806 | 133747802 | 133747807 | + |
| SEQ ID NO 51301 | TTCGTTAATTTACCCTCAACTA | CTT | chr3 | 133747787 | 133747808 | 133747804 | 133747809 | + |
| SEQ ID NO 51302 | TCGTTAATTTACCCTCAACTAC | TTT | chr3 | 133747788 | 133747809 | 133747805 | 133747810 | + |
| SEQ ID NO 51303 | CGTTAATTTACCCTCAACTACT | TTT | chr3 | 133747789 | 133747810 | 133747806 | 133747811 | + |
| SEQ ID NO 51304 | GTTAATTTACCCTCAACTACTG | TTC | chr3 | 133747790 | 133747811 | 133747807 | 133747812 | + |
| SEQ ID NO 51305 | ATTTACCCTCAACTACTGGCCA | TTA | chr3 | 133747794 | 133747815 | 133747811 | 133747816 | + |
| SEQ ID NO 51306 | ACCCTCAACTACTGGCCAAGAA | TTT | chr3 | 133747798 | 133747819 | 133747815 | 133747820 | + |
| SEQ ID NO 51307 | CCCTCAACTACTGGCCAAGAAG | TTA | chr3 | 133747799 | 133747820 | 133747816 | 133747821 | + |
| SEQ ID NO 51308 | AACTACTGGCCAAGAAGGGGTG | CTC | chr3 | 133747804 | 133747825 | 133747821 | 133747826 | + |
| SEQ ID NO 51309 | CTGGCCAAGAAGGGGTGTAACT | CTA | chr3 | 133747809 | 133747830 | 133747826 | 133747831 | + |
| SEQ ID NO 51310 | GCCAAGAAGGGGTGTAACTCAG | CTG | chr3 | 133747812 | 133747833 | 133747829 | 133747834 | + |

Figure 78 (Cont'd)

| | | | | | | | | |
|---|---|---|---|---|---|---|---|---|
| SEQ ID NO 51311 | AGAATGTTTTCTTCTTTTGTGC | CTC | chr3 | 133747832 | 133747853 | 133747849 | 133747854 | + |
| SEQ ID NO 51312 | TCTTCTTTTGTGCCCTGAGTAG | TTT | chr3 | 133747841 | 133747862 | 133747858 | 133747863 | + |
| SEQ ID NO 51313 | CTTCTTTTGTGCCCTGAGTAGC | TTT | chr3 | 133747842 | 133747863 | 133747859 | 133747864 | + |
| SEQ ID NO 51314 | TTCTTTTGTGCCCTGAGTAGCA | TTC | chr3 | 133747843 | 133747864 | 133747860 | 133747865 | + |
| SEQ ID NO 51315 | CTTTTGTGCCCTGAGTAGCAGA | CTT | chr3 | 133747845 | 133747866 | 133747862 | 133747867 | + |
| SEQ ID NO 51316 | TTTTGTGCCCTGAGTAGCAGAC | TTC | chr3 | 133747846 | 133747867 | 133747863 | 133747868 | + |
| SEQ ID NO 51317 | TTGTGCCCTGAGTAGCAGACCC | CTT | chr3 | 133747848 | 133747869 | 133747865 | 133747870 | + |
| SEQ ID NO 51318 | TGTGCCCTGAGTAGCAGACCCA | TTT | chr3 | 133747849 | 133747870 | 133747866 | 133747871 | + |
| SEQ ID NO 51319 | GTGCCCTGAGTAGCAGACCCAG | TTT | chr3 | 133747850 | 133747871 | 133747867 | 133747872 | + |
| SEQ ID NO 51320 | TGCCCTGAGTAGCAGACCCAGA | TTG | chr3 | 133747851 | 133747872 | 133747868 | 133747873 | + |
| SEQ ID NO 51321 | AGTAGCAGACCCAGAGTCTGGA | CTG | chr3 | 133747858 | 133747879 | 133747875 | 133747880 | + |
| SEQ ID NO 51322 | GAGACCCAGATTCTAGGCCTGG | CTG | chr3 | 133747878 | 133747899 | 133747895 | 133747900 | + |
| SEQ ID NO 51323 | TAGGCCTGGCTTGGCCAACGAC | TTC | chr3 | 133747891 | 133747912 | 133747908 | 133747913 | + |
| SEQ ID NO 51324 | GGCCTGGCTTGGCCAACGACAA | CTA | chr3 | 133747893 | 133747914 | 133747910 | 133747915 | + |
| SEQ ID NO 51325 | GCTTGGCCAACGACAAGCAGGG | CTG | chr3 | 133747899 | 133747920 | 133747916 | 133747921 | + |
| SEQ ID NO 51326 | GGCCAACGACAAGCAGGGTGAC | CTT | chr3 | 133747903 | 133747924 | 133747920 | 133747925 | + |
| SEQ ID NO 51327 | GCCAACGACAAGCAGGGTGACC | TTG | chr3 | 133747904 | 133747925 | 133747921 | 133747926 | + |
| SEQ ID NO 51328 | GGGTTAAAAAAAAAAAAAGGCA | CTT | chr3 | 133747928 | 133747949 | 133747945 | 133747950 | + |
| SEQ ID NO 51329 | GGTTAAAAAAAAAAAAAGGCAT | TTG | chr3 | 133747929 | 133747950 | 133747946 | 133747951 | + |
| SEQ ID NO 51330 | AAAAAAAAAAAAGGCATCATTC | TTA | chr3 | 133747934 | 133747955 | 133747951 | 133747956 | + |
| SEQ ID NO 51331 | TCTGAGTCTCACTCCCTCTTCT | TTC | chr3 | 133747956 | 133747977 | 133747973 | 133747978 | + |
| SEQ ID NO 51332 | TGAGTCTCACTCCCTCTTCTCA | CTC | chr3 | 133747958 | 133747979 | 133747975 | 133747980 | + |
| SEQ ID NO 51333 | AGTCTCACTCCCTCTTCTCAAA | CTG | chr3 | 133747960 | 133747981 | 133747977 | 133747982 | + |
| SEQ ID NO 51334 | ACTCCCTCTTCTCAAAAGATG | CTC | chr3 | 133747966 | 133747987 | 133747983 | 133747988 | + |
| SEQ ID NO 51335 | CCTCTTCTCAAAAGATGGCAA | CTC | chr3 | 133747970 | 133747991 | 133747987 | 133747992 | + |
| SEQ ID NO 51336 | TTCTCAAAAGATGGCAATTCC | CTC | chr3 | 133747974 | 133747995 | 133747991 | 133747996 | + |
| SEQ ID NO 51337 | CTCAAAAGATGGCAATTCCTC | CTT | chr3 | 133747976 | 133747997 | 133747993 | 133747998 | + |
| SEQ ID NO 51338 | TCAAAAGATGGCAATTCCTCC | TTC | chr3 | 133747977 | 133747998 | 133747994 | 133747999 | + |
| SEQ ID NO 51339 | AAAAAGATGGCAATTCCTCCCC | CTC | chr3 | 133747979 | 133748000 | 133747996 | 133748001 | + |
| SEQ ID NO 51340 | CTCCCCGCTGGTTTTCCATAG | TTC | chr3 | 133747995 | 133748016 | 133748012 | 133748017 | + |
| SEQ ID NO 51341 | CCCCGCTGGTTTTCCATAGTTG | CTC | chr3 | 133747998 | 133748019 | 133748015 | 133748020 | + |
| SEQ ID NO 51342 | GTTTTCCATAGTTGAGGTAGCA | CTG | chr3 | 133748006 | 133748027 | 133748023 | 133748028 | + |
| SEQ ID NO 51343 | TCCATAGTTGAGGTAGCAAGCC | TTT | chr3 | 133748010 | 133748031 | 133748027 | 133748032 | + |
| SEQ ID NO 51344 | CCATAGTTGAGGTAGCAAGCCA | TTT | chr3 | 133748011 | 133748032 | 133748028 | 133748033 | + |
| SEQ ID NO 51345 | CATAGTTGAGGTAGCAAGCCAA | TTC | chr3 | 133748012 | 133748033 | 133748029 | 133748034 | + |
| SEQ ID NO 51346 | AGGTAGCAAGCCAATGTGTTGG | TTG | chr3 | 133748020 | 133748041 | 133748037 | 133748042 | + |
| SEQ ID NO 51347 | GGGTAGCTGAAAACGCCCTGTG | TTG | chr3 | 133748041 | 133748062 | 133748058 | 133748063 | + |
| SEQ ID NO 51348 | AAAACGCCCTGTGCATACTGAG | CTG | chr3 | 133748050 | 133748071 | 133748067 | 133748072 | + |
| SEQ ID NO 51349 | TGCATACTGAGGCTTATGTTCC | CTG | chr3 | 133748061 | 133748082 | 133748078 | 133748083 | + |
| SEQ ID NO 51350 | AGGCTTATGTTCCATGGGGGGC | CTG | chr3 | 133748070 | 133748091 | 133748087 | 133748092 | + |
| SEQ ID NO 51351 | ATGTTCCATGGGGGGCCAGGGG | CTT | chr3 | 133748076 | 133748097 | 133748093 | 133748098 | + |
| SEQ ID NO 51352 | TGTTCCATGGGGGGCCAGGGGC | TTA | chr3 | 133748077 | 133748098 | 133748094 | 133748099 | + |
| SEQ ID NO 51353 | CATGGGGGGCCAGGGGCCAGGA | TTC | chr3 | 133748082 | 133748103 | 133748099 | 133748104 | + |
| SEQ ID NO 51354 | TCATCTCCAGCTGGGAGGTGAT | TTG | chr3 | 133748146 | 133748167 | 133748163 | 133748168 | + |
| SEQ ID NO 51355 | CAGCTGGGAGGTGATGGCCATG | CTC | chr3 | 133748153 | 133748174 | 133748170 | 133748175 | + |
| SEQ ID NO 51356 | GGAGGTGATGGCCATGCCTGCA | CTG | chr3 | 133748159 | 133748180 | 133748176 | 133748181 | + |
| SEQ ID NO 51357 | CACCCCTCTGGCCAGCAGAGGG | CTG | chr3 | 133748179 | 133748200 | 133748196 | 133748201 | + |
| SEQ ID NO 51358 | TGGCCAGCAGAGGGTGGTCAGT | CTC | chr3 | 133748187 | 133748208 | 133748204 | 133748209 | + |
| SEQ ID NO 51359 | GCCAGCAGAGGGTGGTCAGTAG | CTG | chr3 | 133748189 | 133748210 | 133748206 | 133748211 | + |
| SEQ ID NO 51360 | GGAGGCCATTAGGGCAACCTTC | CTG | chr3 | 133748218 | 133748239 | 133748235 | 133748240 | + |
| SEQ ID NO 51361 | GGGCAACCTTCTATTGGCTCAG | TTA | chr3 | 133748229 | 133748250 | 133748246 | 133748251 | + |
| SEQ ID NO 51362 | CTATTGGCTCAGACTCAGAATG | CTT | chr3 | 133748239 | 133748260 | 133748256 | 133748261 | + |
| SEQ ID NO 51363 | TATTGGCTCAGACTCAGAATGC | TTC | chr3 | 133748240 | 133748261 | 133748257 | 133748262 | + |
| SEQ ID NO 51364 | TTGGCTCAGACTCAGAATGCAG | CTA | chr3 | 133748242 | 133748263 | 133748259 | 133748264 | + |
| SEQ ID NO 51365 | GCTCAGACTCAGAATGCAGTAG | TTG | chr3 | 133748245 | 133748266 | 133748262 | 133748267 | + |
| SEQ ID NO 51366 | AGACTCAGAATGCAGTAGAACT | CTC | chr3 | 133748249 | 133748270 | 133748266 | 133748271 | + |
| SEQ ID NO 51367 | AGAATGCAGTAGAACTTGTGCC | CTC | chr3 | 133748255 | 133748276 | 133748272 | 133748277 | + |
| SEQ ID NO 51368 | GTGCCCTGTAGTGTTCATGGAC | CTT | chr3 | 133748272 | 133748293 | 133748289 | 133748294 | + |
| SEQ ID NO 51369 | TGCCCTGTAGTGTTCATGGACA | TTG | chr3 | 133748273 | 133748294 | 133748290 | 133748295 | + |

Figure 78 (Cont'd)

| SEQ ID NO | Sequence | Codon | Chr | Pos1 | Pos2 | Pos3 | Pos4 | Strand |
|---|---|---|---|---|---|---|---|---|
| SEQ ID NO 51370 | TAGTGTTCATGGACAGGAGTGA | CTG | chr3 | 133748280 | 133748301 | 133748297 | 133748302 | + |
| SEQ ID NO 51371 | ATGGACAGGAGTGAGAGGAGGA | TTC | chr3 | 133748288 | 133748309 | 133748305 | 133748310 | + |
| SEQ ID NO 51372 | AGGGGATGTGGCTGTCAAGGCC | CTG | chr3 | 133748318 | 133748339 | 133748335 | 133748340 | + |
| SEQ ID NO 51373 | TCAAGGCCTTTCTAGGGGCGAT | CTG | chr3 | 133748332 | 133748353 | 133748349 | 133748354 | + |
| SEQ ID NO 51374 | TCTAGGGGCGATGCTGTCTCTC | CTT | chr3 | 133748342 | 133748363 | 133748359 | 133748364 | + |
| SEQ ID NO 51375 | CTAGGGGCGATGCTGTCTCTCC | TTT | chr3 | 133748343 | 133748364 | 133748360 | 133748365 | + |
| SEQ ID NO 51376 | TAGGGGCGATGCTGTCTCTCCC | TTC | chr3 | 133748344 | 133748365 | 133748361 | 133748366 | + |
| SEQ ID NO 51377 | GGGGCGATGCTGTCTCTCCCTC | CTA | chr3 | 133748346 | 133748367 | 133748363 | 133748368 | + |
| SEQ ID NO 51378 | TCTCTCCCTCAGCATAGGGAGT | CTG | chr3 | 133748358 | 133748379 | 133748375 | 133748380 | + |
| SEQ ID NO 51379 | TCCCTCAGCATAGGGAGTGGGC | CTC | chr3 | 133748362 | 133748383 | 133748379 | 133748384 | + |
| SEQ ID NO 51380 | CCTCAGCATAGGGAGTGGGCCC | CTC | chr3 | 133748364 | 133748385 | 133748381 | 133748386 | + |
| SEQ ID NO 51381 | AGCATAGGGAGTGGGCCCTTCC | CTC | chr3 | 133748368 | 133748389 | 133748385 | 133748390 | + |
| SEQ ID NO 51382 | CCACCTCTGGCCTCTCTCCCCC | CTT | chr3 | 133748388 | 133748409 | 133748405 | 133748410 | + |
| SEQ ID NO 51383 | CACCTCTGGCCTCTCTCCCCCA | TTC | chr3 | 133748389 | 133748410 | 133748406 | 133748411 | + |
| SEQ ID NO 51384 | TGGCCTCTCTCCCCAGGGCTG | CTC | chr3 | 133748395 | 133748416 | 133748412 | 133748417 | + |
| SEQ ID NO 51385 | GCCTCTCTCCCCAGGGCTGTG | CTG | chr3 | 133748397 | 133748418 | 133748414 | 133748419 | + |
| SEQ ID NO 51386 | TCTCCCCAGGGCTGTGTCTGG | CTC | chr3 | 133748402 | 133748423 | 133748419 | 133748424 | + |
| SEQ ID NO 51387 | TCCCCCAGGGCTGTGTCTGGCT | CTC | chr3 | 133748404 | 133748425 | 133748421 | 133748426 | + |
| SEQ ID NO 51388 | CCCCAGGGCTGTGTCTGGCTGT | CTC | chr3 | 133748406 | 133748427 | 133748423 | 133748428 | + |
| SEQ ID NO 51389 | TGTCTGGCTGTCCCTGATAAAA | CTG | chr3 | 133748417 | 133748438 | 133748434 | 133748439 | + |
| SEQ ID NO 51390 | GCTGTCCCTGATAAAACTGTGA | CTG | chr3 | 133748423 | 133748444 | 133748440 | 133748445 | + |
| SEQ ID NO 51391 | TCCCTGATAAAACTGTGAGATG | CTG | chr3 | 133748427 | 133748448 | 133748444 | 133748449 | + |
| SEQ ID NO 51392 | ATAAAACTGTGAGATGGTGTGC | CTG | chr3 | 133748433 | 133748454 | 133748450 | 133748455 | + |
| SEQ ID NO 51393 | TGAGATGGTGTGCAGTGTCGGA | CTG | chr3 | 133748442 | 133748463 | 133748459 | 133748464 | + |
| SEQ ID NO 51394 | AGTGCCAGAGTTTCCGCGACCA | CTA | chr3 | 133748478 | 133748499 | 133748495 | 133748500 | + |
| SEQ ID NO 51395 | CCGCGACCATATGAAAAGCGTC | TTT | chr3 | 133748491 | 133748512 | 133748508 | 133748513 | + |
| SEQ ID NO 51396 | CGCGACCATATGAAAAGCGTCA | TTC | chr3 | 133748492 | 133748513 | 133748509 | 133748514 | + |
| SEQ ID NO 51397 | CATCCGATGGTCCCAGTGTTGC | TTC | chr3 | 133748517 | 133748538 | 133748534 | 133748539 | + |
| SEQ ID NO 51398 | CTTGTGTGAAGAAAGCCTCCTA | TTG | chr3 | 133748538 | 133748559 | 133748555 | 133748560 | + |
| SEQ ID NO 51399 | GTGTGAAGAAAGCCTCCTACCT | CTT | chr3 | 133748541 | 133748562 | 133748558 | 133748563 | + |
| SEQ ID NO 51400 | TGTGAAGAAAGCCTCCTACCTT | TTG | chr3 | 133748542 | 133748563 | 133748559 | 133748564 | + |
| SEQ ID NO 51401 | CTACCTTGATTGCATCAGGGCC | CTC | chr3 | 133748557 | 133748578 | 133748574 | 133748579 | + |
| SEQ ID NO 51402 | CCTTGATTGCATCAGGGCCATT | CTA | chr3 | 133748560 | 133748581 | 133748577 | 133748582 | + |
| SEQ ID NO 51403 | ATGCAATCAAGGTAGGAGGCTT | CTG | chr3 | 133748550 | 133748571 | 133748555 | 133748550 | - |
| SEQ ID NO 51404 | TCTTCACACAAGCAACACTGGG | CTT | chr3 | 133748528 | 133748549 | 133748533 | 133748528 | - |
| SEQ ID NO 51405 | CTTCACACAAGCAACACTGGGA | TTT | chr3 | 133748527 | 133748548 | 133748532 | 133748527 | - |
| SEQ ID NO 51406 | TTCACACAAGCAACACTGGGAC | TTC | chr3 | 133748526 | 133748547 | 133748531 | 133748526 | - |
| SEQ ID NO 51407 | CACACAAGCAACACTGGGACCA | CTT | chr3 | 133748524 | 133748545 | 133748529 | 133748524 | - |
| SEQ ID NO 51408 | ACACAAGCAACACTGGGACCAT | TTC | chr3 | 133748523 | 133748544 | 133748528 | 133748523 | - |
| SEQ ID NO 51409 | GGACCATCGGATGGAATGACGC | CTG | chr3 | 133748508 | 133748529 | 133748513 | 133748508 | - |
| SEQ ID NO 51410 | TTCATATGGTCGCGGAAACTCT | CTT | chr3 | 133748484 | 133748505 | 133748489 | 133748484 | - |
| SEQ ID NO 51411 | TCATATGGTCGCGGAAACTCTG | TTT | chr3 | 133748483 | 133748504 | 133748488 | 133748483 | - |
| SEQ ID NO 51412 | CATATGGTCGCGGAAACTCTGG | TTT | chr3 | 133748482 | 133748503 | 133748487 | 133748482 | - |
| SEQ ID NO 51413 | ATATGGTCGCGGAAACTCTGGC | TTC | chr3 | 133748481 | 133748502 | 133748486 | 133748481 | - |
| SEQ ID NO 51414 | TGGCACTTAGTGGCCTCATGCT | CTC | chr3 | 133748463 | 133748484 | 133748468 | 133748463 | - |
| SEQ ID NO 51415 | GCACTTAGTGGCCTCATGCTCC | CTG | chr3 | 133748461 | 133748482 | 133748466 | 133748461 | - |
| SEQ ID NO 51416 | AGTGGCCTCATGCTCCGACACT | CTT | chr3 | 133748455 | 133748476 | 133748460 | 133748455 | - |
| SEQ ID NO 51417 | GTGGCCTCATGCTCCGACACTG | TTA | chr3 | 133748454 | 133748475 | 133748459 | 133748454 | - |
| SEQ ID NO 51418 | ATGCTCCGACACTGCACACCAT | CTC | chr3 | 133748446 | 133748467 | 133748451 | 133748446 | - |
| SEQ ID NO 51419 | CGACACTGCACACCATCTCACA | CTC | chr3 | 133748440 | 133748461 | 133748445 | 133748440 | - |
| SEQ ID NO 51420 | CACACCATCTCACAGTTTTATC | CTG | chr3 | 133748432 | 133748453 | 133748437 | 133748432 | - |
| SEQ ID NO 51421 | ACAGTTTTATCAGGGACAGCCA | CTC | chr3 | 133748421 | 133748442 | 133748426 | 133748421 | - |
| SEQ ID NO 51422 | TATCAGGGACAGCCAGACACAG | TTT | chr3 | 133748414 | 133748435 | 133748419 | 133748414 | - |
| SEQ ID NO 51423 | ATCAGGGACAGCCAGACACAGC | TTT | chr3 | 133748413 | 133748434 | 133748418 | 133748413 | - |
| SEQ ID NO 51424 | TCAGGGACAGCCAGACACAGCC | TTA | chr3 | 133748412 | 133748433 | 133748417 | 133748412 | - |
| SEQ ID NO 51425 | GGGGAGAGAGGCCAGAGGTGGA | CTG | chr3 | 133748387 | 133748408 | 133748392 | 133748387 | - |
| SEQ ID NO 51426 | CCTATGCTGAGGGAGAGACAGC | CTC | chr3 | 133748354 | 133748375 | 133748359 | 133748354 | - |
| SEQ ID NO 51427 | TGCTGAGGGAGAGACAGCATCG | CTA | chr3 | 133748350 | 133748371 | 133748355 | 133748350 | - |
| SEQ ID NO 51428 | AGGGAGAGACAGCATCGCCCCT | CTG | chr3 | 133748345 | 133748366 | 133748350 | 133748345 | - |

Figure 78 (Cont'd)

| SEQ ID NO | Sequence | | | | | | |
|---|---|---|---|---|---|---|---|
| SEQ ID NO 51429 | GAAAGGCCTTGACAGCCACATC | CTA | chr3 | 133748322 | 133748343 | 133748327 | 133748322 | - |
| SEQ ID NO 51430 | GACAGCCACATCCCCTCAGTCC | CTT | chr3 | 133748312 | 133748333 | 133748317 | 133748312 | - |
| SEQ ID NO 51431 | ACAGCCACATCCCCTCAGTCCT | TTG | chr3 | 133748311 | 133748332 | 133748316 | 133748311 | - |
| SEQ ID NO 51432 | AGTCCTGTCCTCCTCTCACTCC | CTC | chr3 | 133748295 | 133748316 | 133748300 | 133748295 | - |
| SEQ ID NO 51433 | TCCTCCTCTCACTCCTGTCCAT | CTG | chr3 | 133748288 | 133748309 | 133748293 | 133748288 | - |
| SEQ ID NO 51434 | CTCTCACTCCTGTCCATGAACA | CTC | chr3 | 133748283 | 133748304 | 133748288 | 133748283 | - |
| SEQ ID NO 51435 | TCACTCCTGTCCATGAACACTA | CTC | chr3 | 133748280 | 133748301 | 133748285 | 133748280 | - |
| SEQ ID NO 51436 | ACTCCTGTCCATGAACACTACA | CTC | chr3 | 133748278 | 133748299 | 133748283 | 133748278 | - |
| SEQ ID NO 51437 | CTGTCCATGAACACTACAGGGC | CTC | chr3 | 133748274 | 133748295 | 133748279 | 133748274 | - |
| SEQ ID NO 51438 | TCCATGAACACTACAGGGCACA | CTG | chr3 | 133748271 | 133748292 | 133748276 | 133748271 | - |
| SEQ ID NO 51439 | CAGGGCACAAGTTCTACTGCAT | CTA | chr3 | 133748258 | 133748279 | 133748263 | 133748258 | - |
| SEQ ID NO 51440 | TACTGCATTCTGAGTCTGAGCC | TTC | chr3 | 133748244 | 133748265 | 133748249 | 133748244 | - |
| SEQ ID NO 51441 | CTGCATTCTGAGTCTGAGCCAA | CTA | chr3 | 133748242 | 133748263 | 133748247 | 133748242 | - |
| SEQ ID NO 51442 | CATTCTGAGTCTGAGCCAATAG | CTG | chr3 | 133748239 | 133748260 | 133748244 | 133748239 | - |
| SEQ ID NO 51443 | TGAGTCTGAGCCAATAGAAGGT | TTC | chr3 | 133748234 | 133748255 | 133748239 | 133748234 | - |
| SEQ ID NO 51444 | AGTCTGAGCCAATAGAAGGTTG | CTG | chr3 | 133748232 | 133748253 | 133748237 | 133748232 | - |
| SEQ ID NO 51445 | AGCCAATAGAAGGTTGCCCTAA | CTG | chr3 | 133748226 | 133748247 | 133748231 | 133748226 | - |
| SEQ ID NO 51446 | CCCTAATGGCCTCCCAGTTTCC | TTG | chr3 | 133748210 | 133748231 | 133748215 | 133748210 | - |
| SEQ ID NO 51447 | ATGGCCTCCCAGTTTCCTACTG | CTA | chr3 | 133748205 | 133748226 | 133748210 | 133748205 | - |
| SEQ ID NO 51448 | CCAGTTTCCTACTGACCACCCT | CTC | chr3 | 133748197 | 133748218 | 133748202 | 133748197 | - |
| SEQ ID NO 51449 | CCTACTGACCACCCTCTGCTGG | TTT | chr3 | 133748190 | 133748211 | 133748195 | 133748190 | - |
| SEQ ID NO 51450 | CTACTGACCACCCTCTGCTGGC | TTC | chr3 | 133748189 | 133748210 | 133748194 | 133748189 | - |
| SEQ ID NO 51451 | CTGACCACCCTCTGCTGGCCAG | CTA | chr3 | 133748186 | 133748207 | 133748191 | 133748186 | - |
| SEQ ID NO 51452 | ACCACCCTCTGCTGGCCAGAGG | CTG | chr3 | 133748183 | 133748204 | 133748188 | 133748183 | - |
| SEQ ID NO 51453 | TGCTGGCCAGAGGGGTGCAGGC | CTC | chr3 | 133748174 | 133748195 | 133748179 | 133748174 | - |
| SEQ ID NO 51454 | CTGGCCAGAGGGGTGCAGGCAT | CTG | chr3 | 133748172 | 133748193 | 133748177 | 133748172 | - |
| SEQ ID NO 51455 | GCCAGAGGGGTGCAGGCATGGC | CTG | chr3 | 133748169 | 133748190 | 133748174 | 133748169 | - |
| SEQ ID NO 51456 | CCAGCTGGAGATGACAATCTGC | CTC | chr3 | 133748138 | 133748159 | 133748143 | 133748138 | - |
| SEQ ID NO 51457 | GAGATGACAATCTGCTCCTCTG | CTG | chr3 | 133748131 | 133748152 | 133748136 | 133748131 | - |
| SEQ ID NO 51458 | CTCCTCTGTATCCGCCTTGTCT | CTG | chr3 | 133748117 | 133748138 | 133748122 | 133748117 | - |
| SEQ ID NO 51459 | CTCTGTATCCGCCTTGTCTCCT | CTC | chr3 | 133748114 | 133748135 | 133748119 | 133748114 | - |
| SEQ ID NO 51460 | TGTATCCGCCTTGTCTCCTCCC | CTC | chr3 | 133748111 | 133748132 | 133748116 | 133748111 | - |
| SEQ ID NO 51461 | TATCCGCCTTGTCTCCTCCCAT | CTG | chr3 | 133748109 | 133748130 | 133748114 | 133748109 | - |
| SEQ ID NO 51462 | GTCCTCCCCATCACTGTCCTG | CTT | chr3 | 133748099 | 133748120 | 133748104 | 133748099 | - |
| SEQ ID NO 51463 | TCTCCTCCCATCACTGTCCTGG | TTG | chr3 | 133748098 | 133748119 | 133748103 | 133748098 | - |
| SEQ ID NO 51464 | CTCCCATCACTGTCCTGGCCCC | CTC | chr3 | 133748094 | 133748115 | 133748099 | 133748094 | - |
| SEQ ID NO 51465 | CCATCACTGTCCTGGCCCCTGG | CTC | chr3 | 133748091 | 133748112 | 133748096 | 133748091 | - |
| SEQ ID NO 51466 | TCCTGGCCCCTGGCCCCCCATG | CTG | chr3 | 133748082 | 133748103 | 133748087 | 133748082 | - |
| SEQ ID NO 51467 | GCCCCTGGCCCCCATGGAACA | CTG | chr3 | 133748077 | 133748098 | 133748082 | 133748077 | - |
| SEQ ID NO 51468 | GCCCCCCATGGAACATAAGCCT | CTG | chr3 | 133748070 | 133748091 | 133748075 | 133748070 | - |
| SEQ ID NO 51469 | AGTATGCACAGGGCGTTTTCAG | CTC | chr3 | 133748047 | 133748068 | 133748052 | 133748047 | - |
| SEQ ID NO 51470 | TCAGCTACCCCAACACATTGGC | TTT | chr3 | 133748029 | 133748050 | 133748034 | 133748029 | - |
| SEQ ID NO 51471 | CAGCTACCCCAACACATTGGCT | TTT | chr3 | 133748028 | 133748049 | 133748033 | 133748028 | - |
| SEQ ID NO 51472 | AGCTACCCCAACACATTGGCTT | TTC | chr3 | 133748027 | 133748048 | 133748032 | 133748027 | - |
| SEQ ID NO 51473 | CCCCAACACATTGGCTTGCTAC | CTA | chr3 | 133748022 | 133748043 | 133748027 | 133748022 | - |
| SEQ ID NO 51474 | GCTTGCTACCTCAACTATGGAA | TTG | chr3 | 133748009 | 133748030 | 133748014 | 133748009 | - |
| SEQ ID NO 51475 | GCTACCTCAACTATGGAAAACC | CTT | chr3 | 133748005 | 133748026 | 133748010 | 133748005 | - |
| SEQ ID NO 51476 | CTACCTCAACTATGGAAAACCA | TTG | chr3 | 133748004 | 133748025 | 133748009 | 133748004 | - |
| SEQ ID NO 51477 | CCTCAACTATGGAAAACCAGCG | CTA | chr3 | 133748001 | 133748022 | 133748006 | 133748001 | - |
| SEQ ID NO 51478 | AACTATGGAAAACCAGCGGGGG | CTC | chr3 | 133747997 | 133748018 | 133748002 | 133747997 | - |
| SEQ ID NO 51479 | TGGAAAACCAGCGGGGGAGGAA | CTA | chr3 | 133747992 | 133748013 | 133747997 | 133747992 | - |
| SEQ ID NO 51480 | CCATCTTTTTGAGAAGAGGGAG | TTG | chr3 | 133747967 | 133747988 | 133747972 | 133747967 | - |
| SEQ ID NO 51481 | TTTGAGAAGAGGGAGTGAGACT | CTT | chr3 | 133747960 | 133747981 | 133747965 | 133747960 | - |
| SEQ ID NO 51482 | TTGAGAAGAGGGAGTGAGACTC | TTT | chr3 | 133747959 | 133747980 | 133747964 | 133747959 | - |
| SEQ ID NO 51483 | TGAGAAGAGGGAGTGAGACTCA | TTT | chr3 | 133747958 | 133747979 | 133747963 | 133747958 | - |
| SEQ ID NO 51484 | GAGAAGAGGGAGTGAGACTCAG | TTT | chr3 | 133747957 | 133747978 | 133747962 | 133747957 | - |
| SEQ ID NO 51485 | AGAAGAGGGAGTGAGACTCAGA | TTG | chr3 | 133747956 | 133747977 | 133747961 | 133747956 | - |
| SEQ ID NO 51486 | AGAGAATGATGCCTTTTTTTTT | CTC | chr3 | 133747937 | 133747958 | 133747942 | 133747937 | - |
| SEQ ID NO 51487 | TTTTTTTTTTAACCCAAGGTC | CTT | chr3 | 133747922 | 133747943 | 133747927 | 133747922 | - |

Figure 78 (Cont'd)

| | | | | | | | | |
|---|---|---|---|---|---|---|---|---|
| SEQ ID NO 51488 | TTTTTTTTTTAACCCAAGGTCA | TTT | chr3 | 133747921 | 133747942 | 133747926 | 133747921 | - |
| SEQ ID NO 51489 | TTTTTTTTTAACCCAAGGTCAC | TTT | chr3 | 133747920 | 133747941 | 133747925 | 133747920 | - |
| SEQ ID NO 51490 | TTTTTTTTAACCCAAGGTCACC | TTT | chr3 | 133747919 | 133747940 | 133747924 | 133747919 | - |
| SEQ ID NO 51491 | TTTTTTTAACCCAAGGTCACCC | TTT | chr3 | 133747918 | 133747939 | 133747923 | 133747918 | - |
| SEQ ID NO 51492 | TTTTTTAACCCAAGGTCACCCT | TTT | chr3 | 133747917 | 133747938 | 133747922 | 133747917 | - |
| SEQ ID NO 51493 | TTTTTAACCCAAGGTCACCCTG | TTT | chr3 | 133747916 | 133747937 | 133747921 | 133747916 | - |
| SEQ ID NO 51494 | TTTTAACCCAAGGTCACCCTGC | TTT | chr3 | 133747915 | 133747936 | 133747920 | 133747915 | - |
| SEQ ID NO 51495 | TTTAACCCAAGGTCACCCTGCT | TTT | chr3 | 133747914 | 133747935 | 133747919 | 133747914 | - |
| SEQ ID NO 51496 | TTAACCCAAGGTCACCCTGCTT | TTT | chr3 | 133747913 | 133747934 | 133747918 | 133747913 | - |
| SEQ ID NO 51497 | TAACCCAAGGTCACCCTGCTTG | TTT | chr3 | 133747912 | 133747933 | 133747917 | 133747912 | - |
| SEQ ID NO 51498 | AACCCAAGGTCACCCTGCTTGT | TTT | chr3 | 133747911 | 133747932 | 133747916 | 133747911 | - |
| SEQ ID NO 51499 | ACCCAAGGTCACCCTGCTTGTC | TTA | chr3 | 133747910 | 133747931 | 133747915 | 133747910 | - |
| SEQ ID NO 51500 | CTTGTCGTTGGCCAAGCCAGGC | CTG | chr3 | 133747894 | 133747915 | 133747899 | 133747894 | - |
| SEQ ID NO 51501 | GTCGTTGGCCAAGCCAGGCCTA | CTT | chr3 | 133747891 | 133747912 | 133747896 | 133747891 | - |
| SEQ ID NO 51502 | TCGTTGGCCAAGCCAGGCCTAG | TTG | chr3 | 133747890 | 133747911 | 133747895 | 133747890 | - |
| SEQ ID NO 51503 | GCCAAGCCAGGCCTAGAATCTG | TTG | chr3 | 133747884 | 133747905 | 133747889 | 133747884 | - |
| SEQ ID NO 51504 | GAATCTGGGTCTCCAGACTCTG | CTA | chr3 | 133747869 | 133747890 | 133747874 | 133747869 | - |
| SEQ ID NO 51505 | GGTCTCCAGACTCTGGGTCTGC | CTG | chr3 | 133747862 | 133747883 | 133747867 | 133747862 | - |
| SEQ ID NO 51506 | CAGACTCTGGGTCTGCTACTCA | CTC | chr3 | 133747856 | 133747877 | 133747861 | 133747856 | - |
| SEQ ID NO 51507 | TGGGTCTGCTACTCAGGGCACA | CTC | chr3 | 133747849 | 133747870 | 133747854 | 133747849 | - |
| SEQ ID NO 51508 | GGTCTGCTACTCAGGGCACAAA | CTG | chr3 | 133747847 | 133747868 | 133747852 | 133747847 | - |
| SEQ ID NO 51509 | CTACTCAGGGCACAAAAGAAGA | CTG | chr3 | 133747841 | 133747862 | 133747846 | 133747841 | - |
| SEQ ID NO 51510 | CTCAGGGCACAAAAGAAGAAAA | CTA | chr3 | 133747838 | 133747859 | 133747843 | 133747838 | - |
| SEQ ID NO 51511 | AGGGCACAAAAGAAGAAAACAT | CTC | chr3 | 133747835 | 133747856 | 133747840 | 133747835 | - |
| SEQ ID NO 51512 | TGAGTTACACCCCTTCTTGGCC | TTC | chr3 | 133747811 | 133747832 | 133747816 | 133747811 | - |
| SEQ ID NO 51513 | AGTTACACCCCTTCTTGGCCAG | CTG | chr3 | 133747809 | 133747830 | 133747814 | 133747809 | - |
| SEQ ID NO 51514 | CACCCCTTCTTGGCCAGTAGTT | TTA | chr3 | 133747804 | 133747825 | 133747809 | 133747804 | - |
| SEQ ID NO 51515 | CTTGGCCAGTAGTTGAGGGTAA | CTT | chr3 | 133747796 | 133747817 | 133747801 | 133747796 | - |
| SEQ ID NO 51516 | TTGGCCAGTAGTTGAGGGTAAA | TTC | chr3 | 133747795 | 133747816 | 133747800 | 133747795 | - |
| SEQ ID NO 51517 | GGCCAGTAGTTGAGGGTAAATT | CTT | chr3 | 133747793 | 133747814 | 133747798 | 133747793 | - |
| SEQ ID NO 51518 | GCCAGTAGTTGAGGGTAAATTA | TTG | chr3 | 133747792 | 133747813 | 133747797 | 133747792 | - |
| SEQ ID NO 51519 | AGGGTAAATTAACGAAAAGAAT | TTG | chr3 | 133747781 | 133747802 | 133747786 | 133747781 | - |
| SEQ ID NO 51520 | ACGAAAAGAATTAATTTGTCTG | TTA | chr3 | 133747770 | 133747791 | 133747775 | 133747770 | - |
| SEQ ID NO 51521 | ATTTGTCTGTAACTCTTGTCTG | TTA | chr3 | 133747757 | 133747778 | 133747762 | 133747757 | - |
| SEQ ID NO 51522 | GTCTGTAACTCTTGTCTGTTGC | TTT | chr3 | 133747753 | 133747774 | 133747758 | 133747753 | - |
| SEQ ID NO 51523 | TCTGTAACTCTTGTCTGTTGCT | TTG | chr3 | 133747752 | 133747773 | 133747757 | 133747752 | - |
| SEQ ID NO 51524 | TAACTCTTGTCTGTTGCTCTCT | CTG | chr3 | 133747748 | 133747769 | 133747753 | 133747748 | - |
| SEQ ID NO 51525 | TTGTCTGTTGCTCTCTGTTTAG | CTC | chr3 | 133747742 | 133747763 | 133747747 | 133747742 | - |
| SEQ ID NO 51526 | GTCTGTTGCTCTCTGTTAGGA | CTT | chr3 | 133747740 | 133747761 | 133747745 | 133747740 | - |
| SEQ ID NO 51527 | TCTGTTGCTCTCTGTTTAGGAA | TTG | chr3 | 133747739 | 133747760 | 133747744 | 133747739 | - |
| SEQ ID NO 51528 | TTGCTCTCTGTTAGGAAGAAC | CTG | chr3 | 133747735 | 133747756 | 133747740 | 133747735 | - |
| SEQ ID NO 51529 | CTCTCTGTTTAGGAAGAACTAA | TTG | chr3 | 133747732 | 133747753 | 133747737 | 133747732 | - |
| SEQ ID NO 51530 | TCTGTTTAGGAAGAACTAAAAA | CTC | chr3 | 133747729 | 133747750 | 133747734 | 133747729 | - |
| SEQ ID NO 51531 | TGTTTAGGAAGAACTAAAAACT | CTC | chr3 | 133747727 | 133747748 | 133747732 | 133747727 | - |
| SEQ ID NO 51532 | TTTAGGAAGAACTAAAAACTCC | CTG | chr3 | 133747725 | 133747746 | 133747730 | 133747725 | - |
| SEQ ID NO 51533 | AGGAAGAACTAAAAACTCCACA | TTT | chr3 | 133747722 | 133747743 | 133747727 | 133747722 | - |
| SEQ ID NO 51534 | GGAAGAACTAAAAACTCCACAA | TTA | chr3 | 133747721 | 133747742 | 133747726 | 133747721 | - |
| SEQ ID NO 51535 | AAAACTCCACAAATTCAACAGT | CTA | chr3 | 133747711 | 133747732 | 133747716 | 133747711 | - |
| SEQ ID NO 51536 | CACAAATTCAACAGTCTCCCCT | CTC | chr3 | 133747704 | 133747725 | 133747709 | 133747704 | - |
| SEQ ID NO 51537 | AACAGTCTCCCCTCTGTCTCCA | TTC | chr3 | 133747695 | 133747716 | 133747700 | 133747695 | - |
| SEQ ID NO 51538 | CCCTCTGTCTCCACTGAACTAT | CTC | chr3 | 133747686 | 133747707 | 133747691 | 133747686 | - |
| SEQ ID NO 51539 | TGTCTCCACTGAACTATCCCTC | CTC | chr3 | 133747681 | 133747702 | 133747686 | 133747681 | - |
| SEQ ID NO 51540 | TCTCCACTGAACTATCCCTCCA | CTG | chr3 | 133747679 | 133747700 | 133747684 | 133747679 | - |
| SEQ ID NO 51541 | CACTGAACTATCCCTCCATTTT | CTC | chr3 | 133747675 | 133747696 | 133747680 | 133747675 | - |
| SEQ ID NO 51542 | AACTATCCCTCCATTTTCACCA | CTG | chr3 | 133747670 | 133747691 | 133747675 | 133747670 | - |
| SEQ ID NO 51543 | TCCCTCCATTTTCACCACACTT | CTA | chr3 | 133747665 | 133747686 | 133747670 | 133747665 | - |
| SEQ ID NO 51544 | CATTTTCACCACACTTTTTGGC | CTC | chr3 | 133747659 | 133747680 | 133747664 | 133747659 | - |
| SEQ ID NO 51545 | TCACCACACTTTTTGGCTGCCA | TTT | chr3 | 133747654 | 133747675 | 133747659 | 133747654 | - |
| SEQ ID NO 51546 | CACCACACTTTTTGGCTGCCAT | TTT | chr3 | 133747653 | 133747674 | 133747658 | 133747653 | - |

Figure 78 (Cont'd)

| | | | | | | | | |
|---|---|---|---|---|---|---|---|---|
| SEQ ID NO 51547 | ACCACACTTTTTGGCTGCCATT | TTC | chr3 | 133747652 | 133747673 | 133747657 | 133747652 | - |
| SEQ ID NO 51548 | TTTGGCTGCCATTCACAAAAAA | CTT | chr3 | 133747643 | 133747664 | 133747648 | 133747643 | - |
| SEQ ID NO 51549 | TTGGCTGCCATTCACAAAAAAA | TTT | chr3 | 133747642 | 133747663 | 133747647 | 133747642 | - |
| SEQ ID NO 51550 | TGGCTGCCATTCACAAAAAAAG | TTT | chr3 | 133747641 | 133747662 | 133747646 | 133747641 | - |
| SEQ ID NO 51551 | GGCTGCCATTCACAAAAAAAGC | TTT | chr3 | 133747640 | 133747661 | 133747645 | 133747640 | - |
| SEQ ID NO 51552 | GCTGCCATTCACAAAAAAAGCT | TTG | chr3 | 133747639 | 133747660 | 133747644 | 133747639 | - |
| SEQ ID NO 51553 | CCATTCACAAAAAAAGCTGAAG | CTG | chr3 | 133747635 | 133747656 | 133747640 | 133747635 | - |
| SEQ ID NO 51554 | ACAAAAAAAGCTGAAGCCAGCC | TTC | chr3 | 133747629 | 133747650 | 133747634 | 133747629 | - |
| SEQ ID NO 51555 | AAGCCAGCCATGGGTAACTATT | CTG | chr3 | 133747616 | 133747637 | 133747621 | 133747616 | - |
| SEQ ID NO 51556 | TTAAAATCCATGTGGTTGCAGA | CTA | chr3 | 133747596 | 133747617 | 133747601 | 133747596 | - |
| SEQ ID NO 51557 | AAATCCATGTGGTTGCAGAGAC | TTA | chr3 | 133747593 | 133747614 | 133747598 | 133747593 | - |
| SEQ ID NO 51558 | CAGAGACAGCATCCCTATCACA | TTG | chr3 | 133747578 | 133747599 | 133747583 | 133747578 | - |
| SEQ ID NO 51559 | TCACATGAGCTTTTGCCCTGTC | CTA | chr3 | 133747561 | 133747582 | 133747566 | 133747561 | - |
| SEQ ID NO 51560 | TTGCCCTGTCCCCAAGGCCCTC | CTT | chr3 | 133747549 | 133747570 | 133747554 | 133747549 | - |
| SEQ ID NO 51561 | TGCCCTGTCCCCAAGGCCCTCT | TTT | chr3 | 133747548 | 133747569 | 133747553 | 133747548 | - |
| SEQ ID NO 51562 | GCCCTGTCCCCAAGGCCCTCTG | TTT | chr3 | 133747547 | 133747568 | 133747552 | 133747547 | - |
| SEQ ID NO 51563 | CCCTGTCCCCAAGGCCCTCTGT | TTG | chr3 | 133747546 | 133747567 | 133747551 | 133747546 | - |
| SEQ ID NO 51564 | TCCCCAAGGCCCTCTGTCATCT | CTG | chr3 | 133747541 | 133747562 | 133747546 | 133747541 | - |
| SEQ ID NO 51565 | TGTCATCTCCACTCCTTGTGGG | CTC | chr3 | 133747527 | 133747548 | 133747532 | 133747527 | - |
| SEQ ID NO 51566 | TCATCTCCACTCCTTGTGGGCC | CTG | chr3 | 133747525 | 133747546 | 133747530 | 133747525 | - |
| SEQ ID NO 51567 | CACTCCTTGTGGGCCACCACAG | CTC | chr3 | 133747518 | 133747539 | 133747523 | 133747518 | - |
| SEQ ID NO 51568 | CTTGTGGGCCACCACAGCAAGG | CTC | chr3 | 133747513 | 133747534 | 133747518 | 133747513 | - |
| SEQ ID NO 51569 | GTGGGCCACCACAGCAAGGCTG | CTT | chr3 | 133747510 | 133747531 | 133747515 | 133747510 | - |
| SEQ ID NO 51570 | TGGGCCACCACAGCAAGGCTGA | TTG | chr3 | 133747509 | 133747530 | 133747514 | 133747509 | - |
| SEQ ID NO 51571 | ACTCACTGGCTCTGAAGAAGAT | CTG | chr3 | 133747488 | 133747509 | 133747493 | 133747488 | - |
| SEQ ID NO 51572 | ACTGGCTCTGAAGAAGATCCAC | CTC | chr3 | 133747484 | 133747505 | 133747489 | 133747484 | - |
| SEQ ID NO 51573 | GCTCTGAAGAAGATCCACAAAG | CTG | chr3 | 133747480 | 133747501 | 133747485 | 133747480 | - |
| SEQ ID NO 51574 | TGAAGAAGATCCACAAAGCCTG | CTC | chr3 | 133747476 | 133747497 | 133747481 | 133747476 | - |
| SEQ ID NO 51575 | AAGAAGATCCACAAAGCCTGTG | CTG | chr3 | 133747474 | 133747495 | 133747479 | 133747474 | - |
| SEQ ID NO 51576 | TGGAGAGGAGGCCCACAGCTCT | CTG | chr3 | 133747454 | 133747475 | 133747459 | 133747454 | - |
| SEQ ID NO 51577 | TCCAGGATGCATGAGGAGGGGC | CTC | chr3 | 133747433 | 133747454 | 133747438 | 133747433 | - |
| SEQ ID NO 51578 | CAGGATGCATGAGGAGGGGCCA | CTC | chr3 | 133747431 | 133747452 | 133747436 | 133747431 | - |
| SEQ ID NO 51579 | TCCCTCTTGGCCCATGGGAAAT | TTT | chr3 | 133747378 | 133747399 | 133747383 | 133747378 | - |
| SEQ ID NO 51580 | CCCTCTTGGCCCATGGGAAATC | TTT | chr3 | 133747377 | 133747398 | 133747382 | 133747377 | - |
| SEQ ID NO 51581 | CCTCTTGGCCCATGGGAAATCC | TTC | chr3 | 133747376 | 133747397 | 133747381 | 133747376 | - |
| SEQ ID NO 51582 | TTGGCCCATGGGAAATCCTAGG | CTC | chr3 | 133747372 | 133747393 | 133747377 | 133747372 | - |
| SEQ ID NO 51583 | GGCCCATGGGAAATCCTAGGAG | CTT | chr3 | 133747370 | 133747391 | 133747375 | 133747370 | - |
| SEQ ID NO 51584 | GCCCATGGGAAATCCTAGGAGG | TTG | chr3 | 133747369 | 133747390 | 133747374 | 133747369 | - |
| SEQ ID NO 51585 | GGAGGCAACATAAGCCTGTGGC | CTA | chr3 | 133747352 | 133747373 | 133747357 | 133747352 | - |
| SEQ ID NO 51586 | TGGCAGCCCTCCACAAAGCCC | CTG | chr3 | 133747334 | 133747355 | 133747339 | 133747334 | - |
| SEQ ID NO 51587 | CACAAAGCCCTGCCTCCAGAGT | CTC | chr3 | 133747322 | 133747343 | 133747327 | 133747322 | - |
| SEQ ID NO 51588 | CCTCCAGAGTTCCCATAGGCGA | CTG | chr3 | 133747310 | 133747331 | 133747315 | 133747310 | - |
| SEQ ID NO 51589 | CAGAGTTCCCATAGGCGAGAAT | CTC | chr3 | 133747306 | 133747327 | 133747311 | 133747306 | - |
| SEQ ID NO 51590 | CCATAGGCGAGAATGTGTCCTC | TTC | chr3 | 133747298 | 133747319 | 133747303 | 133747298 | - |
| SEQ ID NO 51591 | AGTGGAGCATTACCTTGCACAG | CTC | chr3 | 133747276 | 133747297 | 133747281 | 133747276 | - |
| SEQ ID NO 51592 | CCTTGCACAGCCTGTGAAGTGC | TTA | chr3 | 133747264 | 133747285 | 133747269 | 133747264 | - |
| SEQ ID NO 51593 | GCACAGCCTGTGAAGTGCTCTG | CTT | chr3 | 133747260 | 133747281 | 133747265 | 133747260 | - |
| SEQ ID NO 51594 | CACAGCCTGTGAAGTGCTCTGT | TTG | chr3 | 133747259 | 133747280 | 133747264 | 133747259 | - |
| SEQ ID NO 51595 | TGAAGTGCTCTGTGCGGGATA | CTG | chr3 | 133747250 | 133747271 | 133747255 | 133747250 | - |
| SEQ ID NO 51596 | TGTGCGGGATAAAGGCAAGTA | CTC | chr3 | 133747240 | 133747261 | 133747245 | 133747240 | - |
| SEQ ID NO 51597 | TGCGGGATAAAGGCAAGTAAC | CTG | chr3 | 133747238 | 133747259 | 133747243 | 133747238 | - |
| SEQ ID NO 51598 | TCTCAAGGAATTGCTAGCTTAT | CTC | chr3 | 133747205 | 133747226 | 133747210 | 133747205 | - |
| SEQ ID NO 51599 | TCAAGGAATTGCTAGCTTATGG | CTC | chr3 | 133747203 | 133747224 | 133747208 | 133747203 | - |
| SEQ ID NO 51600 | AAGGAATTGCTAGCTTATGGGG | CTC | chr3 | 133747201 | 133747222 | 133747206 | 133747201 | - |
| SEQ ID NO 51601 | CTAGCTTATGGGGAGAGAAAAC | TTG | chr3 | 133747192 | 133747213 | 133747197 | 133747192 | - |
| SEQ ID NO 51602 | GCTTATGGGGAGAGAAAACTAA | CTA | chr3 | 133747189 | 133747210 | 133747194 | 133747189 | - |
| SEQ ID NO 51603 | ATGGGGAGAGAAAACTAAACGT | CTT | chr3 | 133747185 | 133747206 | 133747190 | 133747185 | - |
| SEQ ID NO 51604 | TGGGGAGAGAAAACTAAACGTG | TTA | chr3 | 133747184 | 133747205 | 133747189 | 133747184 | - |
| SEQ ID NO 51605 | AACGTGGAAGCCCCAACAGTGT | CTA | chr3 | 133747168 | 133747189 | 133747173 | 133747168 | - |

Figure 78 (Cont'd)

| | | | | | | | | |
|---|---|---|---|---|---|---|---|---|
| SEQ ID NO 51606 | GAGTATGAAGGGGGCCCCACCT | TTA | chr3 | 133747113 | 133747134 | 133747118 | 133747113 | - |
| SEQ ID NO 51607 | AGGAGGTCGGGGAGTGTGGCGT | CTC | chr3 | 133747090 | 133747111 | 133747095 | 133747090 | - |
| SEQ ID NO 51608 | CCCCATAGCAGGATGTGTGCAA | CTG | chr3 | 133747059 | 133747080 | 133747064 | 133747059 | - |
| SEQ ID NO 51609 | CCACTGGTACTCAGCATCTGCC | CTG | chr3 | 133747031 | 133747052 | 133747036 | 133747031 | - |
| SEQ ID NO 51610 | GTACTCAGCATCTGCCACCTCG | CTG | chr3 | 133747025 | 133747046 | 133747030 | 133747025 | - |
| SEQ ID NO 51611 | AGCATCTGCCACCTCGCTGACC | CTC | chr3 | 133747019 | 133747040 | 133747024 | 133747019 | - |
| SEQ ID NO 51612 | CCACCTCGCTGACCCTCATTTG | CTG | chr3 | 133747011 | 133747032 | 133747016 | 133747011 | - |
| SEQ ID NO 51613 | GCTGACCCTCATTTGACCCTCC | CTC | chr3 | 133747004 | 133747025 | 133747009 | 133747004 | - |
| SEQ ID NO 51614 | ACCCTCATTTGACCCTCCCAGG | CTG | chr3 | 133747000 | 133747021 | 133747005 | 133747000 | - |
| SEQ ID NO 51615 | ATTTGACCCTCCCAGGCAAGTG | CTC | chr3 | 133746994 | 133747015 | 133746999 | 133746994 | - |
| SEQ ID NO 51616 | GACCCTCCCAGGCAAGTGCTGT | TTT | chr3 | 133746990 | 133747011 | 133746995 | 133746990 | - |
| SEQ ID NO 51617 | ACCCTCCCAGGCAAGTGCTGTG | TTG | chr3 | 133746989 | 133747010 | 133746994 | 133746989 | - |
| SEQ ID NO 51618 | CCAGGCAAGTGCTGTGATGACC | CTC | chr3 | 133746983 | 133747004 | 133746988 | 133746983 | - |
| SEQ ID NO 51619 | TGATGACCCCCTCCCTGGTGAG | CTG | chr3 | 133746969 | 133746990 | 133746974 | 133746969 | - |
| SEQ ID NO 51620 | CCTGGTGAGGAGCCGGCCAGGA | CTC | chr3 | 133746956 | 133746977 | 133746961 | 133746956 | - |
| SEQ ID NO 51621 | GTGAGGAGCCGGCCAGGACTTG | CTG | chr3 | 133746952 | 133746973 | 133746957 | 133746952 | - |
| SEQ ID NO 51622 | GGATCCAAGAAGTCTGGCTTCA | CTT | chr3 | 133746931 | 133746952 | 133746936 | 133746931 | - |
| SEQ ID NO 51623 | GATCCAAGAAGTCTGGCTTCAA | TTG | chr3 | 133746930 | 133746951 | 133746935 | 133746930 | - |
| SEQ ID NO 51624 | GCTTCAAACCCCATGCTCTGAC | CTG | chr3 | 133746915 | 133746936 | 133746920 | 133746915 | - |
| SEQ ID NO 51625 | CAAACCCCATGCTCTGACCGCT | CTT | chr3 | 133746911 | 133746932 | 133746916 | 133746911 | - |
| SEQ ID NO 51626 | AAACCCCATGCTCTGACCGCTC | TTC | chr3 | 133746910 | 133746931 | 133746915 | 133746910 | - |
| SEQ ID NO 51627 | TGACCGCTCGATGGCACCGCTT | CTC | chr3 | 133746897 | 133746918 | 133746902 | 133746897 | - |
| SEQ ID NO 51628 | ACCGCTCGATGGCACCGCTTCC | CTG | chr3 | 133746895 | 133746916 | 133746900 | 133746895 | - |
| SEQ ID NO 51629 | GATGGCACCGCTTCCTTGGCAG | CTC | chr3 | 133746888 | 133746909 | 133746893 | 133746888 | - |
| SEQ ID NO 51630 | CCTTGGCAGGACATCTACAGCT | CTT | chr3 | 133746875 | 133746896 | 133746880 | 133746875 | - |
| SEQ ID NO 51631 | CTTGGCAGGACATCTACAGCTC | TTC | chr3 | 133746874 | 133746895 | 133746879 | 133746874 | - |
| SEQ ID NO 51632 | GGCAGGACATCTACAGCTCCCA | CTT | chr3 | 133746871 | 133746892 | 133746876 | 133746871 | - |
| SEQ ID NO 51633 | GCAGGACATCTACAGCTCCCAG | TTG | chr3 | 133746870 | 133746891 | 133746875 | 133746870 | - |
| SEQ ID NO 51634 | CAGCTCCCAGGGCACCCAGGGG | CTA | chr3 | 133746858 | 133746879 | 133746863 | 133746858 | - |
| SEQ ID NO 51635 | CCAGGGCACCCAGGGGACATCA | CTC | chr3 | 133746852 | 133746873 | 133746857 | 133746852 | - |
| SEQ ID NO 51636 | TGAAAGGGGAATGGTCAGACCC | CTC | chr3 | 133746825 | 133746846 | 133746830 | 133746825 | - |
| SEQ ID NO 51637 | AAAGGGGAATGGTCAGACCCGG | CTG | chr3 | 133746823 | 133746844 | 133746828 | 133746823 | - |
| SEQ ID NO 51638 | GAATGCCATGCTAAGGAGTTCG | CTT | chr3 | 133746793 | 133746814 | 133746798 | 133746793 | - |
| SEQ ID NO 51639 | AATGCCATGCTAAGGAGTTCGG | TTG | chr3 | 133746792 | 133746813 | 133746797 | 133746792 | - |
| SEQ ID NO 51640 | AGGAGTTCGGACTTGACAAGAG | CTA | chr3 | 133746780 | 133746801 | 133746785 | 133746780 | - |
| SEQ ID NO 51641 | GGACTTGACAAGAGGCAGCAGC | TTC | chr3 | 133746772 | 133746793 | 133746777 | 133746772 | - |
| SEQ ID NO 51642 | GACAAGAGGCAGCAGCAAAGGG | CTT | chr3 | 133746766 | 133746787 | 133746771 | 133746766 | - |
| SEQ ID NO 51643 | ACAAGAGGCAGCAGCAAAGGGT | TTG | chr3 | 133746765 | 133746786 | 133746770 | 133746765 | - |
| SEQ ID NO 51644 | TGATAACCTGGTTAGACGTGCT | TTT | chr3 | 133746741 | 133746762 | 133746746 | 133746741 | - |
| SEQ ID NO 51645 | GATAACCTGGTTAGACGTGCTC | TTT | chr3 | 133746740 | 133746761 | 133746745 | 133746740 | - |
| SEQ ID NO 51646 | ATAACCTGGTTAGACGTGCTCT | TTG | chr3 | 133746739 | 133746760 | 133746744 | 133746739 | - |
| SEQ ID NO 51647 | GTTAGACGTGCTCTGATTTATT | CTG | chr3 | 133746731 | 133746752 | 133746736 | 133746731 | - |
| SEQ ID NO 51648 | GACGTGCTCTGATTTATTGTAT | TTA | chr3 | 133746727 | 133746748 | 133746732 | 133746727 | - |
| SEQ ID NO 51649 | TGATTTATTGTATTTCACTGCT | CTC | chr3 | 133746718 | 133746739 | 133746723 | 133746718 | - |
| SEQ ID NO 51650 | ATTTATTGTATTTCACTGCTGC | CTG | chr3 | 133746716 | 133746737 | 133746721 | 133746716 | - |
| SEQ ID NO 51651 | ATTGTATTTCACTGCTGCAAGA | TTT | chr3 | 133746712 | 133746733 | 133746717 | 133746712 | - |
| SEQ ID NO 51652 | TTGTATTTCACTGCTGCAAGAT | TTA | chr3 | 133746711 | 133746732 | 133746716 | 133746711 | - |
| SEQ ID NO 51653 | TATTTCACTGCTGCAAGATTTA | TTG | chr3 | 133746708 | 133746729 | 133746713 | 133746708 | - |
| SEQ ID NO 51654 | CACTGCTGCAAGATTTACTGGA | TTT | chr3 | 133746703 | 133746724 | 133746708 | 133746703 | - |
| SEQ ID NO 51655 | ACTGCTGCAAGATTTACTGGAC | TTC | chr3 | 133746702 | 133746723 | 133746707 | 133746702 | - |
| SEQ ID NO 51656 | CTGCAAGATTTACTGGACAAAG | CTG | chr3 | 133746698 | 133746719 | 133746703 | 133746698 | - |
| SEQ ID NO 51657 | CAAGATTTACTGGACAAAGAGG | CTG | chr3 | 133746695 | 133746716 | 133746700 | 133746695 | - |
| SEQ ID NO 51658 | ACTGGACAAAGAGGAGGAGGGG | TTT | chr3 | 133746687 | 133746708 | 133746692 | 133746687 | - |
| SEQ ID NO 51659 | CTGGACAAAGAGGAGGAGGGGG | TTA | chr3 | 133746686 | 133746707 | 133746691 | 133746686 | - |
| SEQ ID NO 51660 | GACAAAGAGGAGGAGGGGAGA | CTG | chr3 | 133746683 | 133746704 | 133746688 | 133746683 | - |
| SEQ ID NO 51661 | GAAGCCCAAGCAAAGGCCAGGG | CTA | chr3 | 133746633 | 133746654 | 133746638 | 133746633 | - |
| SEQ ID NO 51662 | CCAGCCTGAGCGCGGAGTGCAT | CTT | chr3 | 133746565 | 133746586 | 133746570 | 133746565 | - |
| SEQ ID NO 51663 | CAGCCTGAGCGCGGAGTGCATG | TTC | chr3 | 133746564 | 133746585 | 133746569 | 133746564 | - |
| SEQ ID NO 51664 | AGCGCGGAGTGCATGCAGGCTG | CTG | chr3 | 133746557 | 133746578 | 133746562 | 133746557 | - |

Figure 78 (Cont'd)

| | | | | | | | | |
|---|---|---|---|---|---|---|---|---|
| SEQ ID NO 51665 | CGCGGTGGCCGCCCGGGTTGCA | CTG | chr3 | 133746535 | 133746556 | 133746540 | 133746535 | - |
| SEQ ID NO 51666 | CAGGGAACGCGCGGGCCAGCGA | TTG | chr3 | 133746515 | 133746536 | 133746520 | 133746515 | - |
| SEQ ID NO 51667 | TGCGGTGCTACCCCGTGCCCGC | CTC | chr3 | 133746490 | 133746511 | 133746495 | 133746490 | - |
| SEQ ID NO 51668 | CGGTGCTACCCCGTGCCCGCAC | CTG | chr3 | 133746488 | 133746509 | 133746493 | 133746488 | - |
| SEQ ID NO 51669 | CCCCGTGCCCGCACTCACCCAG | CTA | chr3 | 133746480 | 133746501 | 133746485 | 133746480 | - |
| SEQ ID NO 51670 | ACCCAGGACGGCGCAGACCAGC | CTC | chr3 | 133746464 | 133746485 | 133746469 | 133746464 | - |
| SEQ ID NO 51671 | CCACGGCGAGCCTCATCTTCCG | CTC | chr3 | 133746435 | 133746456 | 133746440 | 133746435 | - |
| SEQ ID NO 51672 | ATCTTCCGGGTGCGGCGCTGAG | CTC | chr3 | 133746421 | 133746442 | 133746426 | 133746421 | - |
| SEQ ID NO 51673 | CCGGGTGCGGCGCTGAGCAGCG | CTT | chr3 | 133746416 | 133746437 | 133746421 | 133746416 | - |
| SEQ ID NO 51674 | CGGGTGCGGCGCTGAGCAGCGA | TTC | chr3 | 133746415 | 133746436 | 133746420 | 133746415 | - |
| SEQ ID NO 51675 | AGCAGCGAGCACAGTCGGACTC | CTG | chr3 | 133746401 | 133746422 | 133746406 | 133746401 | - |
| SEQ ID NO 51676 | GCTTCTGTGCAGCCTCCGGCGC | CTC | chr3 | 133746379 | 133746400 | 133746384 | 133746379 | - |
| SEQ ID NO 51677 | CTGTGCAGCCTCCGGCGCCCCG | CTT | chr3 | 133746375 | 133746396 | 133746380 | 133746375 | - |
| SEQ ID NO 51678 | TGTGCAGCCTCCGGCGCCCCGC | TTC | chr3 | 133746374 | 133746395 | 133746379 | 133746374 | - |
| SEQ ID NO 51679 | TGCAGCCTCCGGCGCCCCGCGT | CTG | chr3 | 133746372 | 133746393 | 133746377 | 133746372 | - |
| SEQ ID NO 51680 | CGGCGCCCCGCGTCCCTTTATT | CTC | chr3 | 133746363 | 133746384 | 133746368 | 133746363 | - |
| SEQ ID NO 51681 | TATTCCATTCCCGGCCTGGGCG | CTT | chr3 | 133746345 | 133746366 | 133746350 | 133746345 | - |
| SEQ ID NO 51682 | ATTCCATTCCCGGCCTGGGCGG | TTT | chr3 | 133746344 | 133746365 | 133746349 | 133746344 | - |
| SEQ ID NO 51683 | TTCCATTCCCGGCCTGGGCGGG | TTA | chr3 | 133746343 | 133746364 | 133746348 | 133746343 | - |
| SEQ ID NO 51684 | CATTCCCGGCCTGGGCGGGCTG | TTC | chr3 | 133746340 | 133746361 | 133746345 | 133746340 | - |
| SEQ ID NO 51685 | CCGGCCTGGGCGGGCTGGGCGC | TTC | chr3 | 133746335 | 133746356 | 133746340 | 133746335 | - |
| SEQ ID NO 51686 | GGCGGGCTGGGCGCAATCTTTG | CTG | chr3 | 133746327 | 133746348 | 133746332 | 133746327 | - |
| SEQ ID NO 51687 | GGCGCAATCTTTGACCTCCCGT | CTG | chr3 | 133746318 | 133746339 | 133746323 | 133746318 | - |
| SEQ ID NO 51688 | TGACCTCCCGTGTTTGTGCAGC | CTT | chr3 | 133746307 | 133746328 | 133746312 | 133746307 | - |
| SEQ ID NO 51689 | GACCTCCCGTGTTTGTGCAGCC | TTT | chr3 | 133746306 | 133746327 | 133746311 | 133746306 | - |
| SEQ ID NO 51690 | ACCTCCCGTGTTTGTGCAGCCG | TTG | chr3 | 133746305 | 133746326 | 133746310 | 133746305 | - |
| SEQ ID NO 51691 | CCGTGTTTGTGCAGCCGGGTTG | CTC | chr3 | 133746300 | 133746321 | 133746305 | 133746300 | - |
| SEQ ID NO 51692 | GTGCAGCCGGGTTGCCCAATCG | TTT | chr3 | 133746292 | 133746313 | 133746297 | 133746292 | - |
| SEQ ID NO 51693 | TGCAGCCGGGTTGCCCAATCGC | TTG | chr3 | 133746291 | 133746312 | 133746296 | 133746291 | - |
| SEQ ID NO 51694 | CCCAATCGCCCCTCTCCCAACC | TTG | chr3 | 133746278 | 133746299 | 133746283 | 133746278 | - |
| SEQ ID NO 51695 | TCCCAACCCCCCTTCCTTACTC | CTC | chr3 | 133746264 | 133746285 | 133746269 | 133746264 | - |
| SEQ ID NO 51696 | CCAACCCCCCTTCCTTACTCGT | CTC | chr3 | 133746262 | 133746283 | 133746267 | 133746262 | - |
| SEQ ID NO 51697 | CCTTACTCGTCCCACTGATCAC | CTT | chr3 | 133746250 | 133746271 | 133746255 | 133746250 | - |
| SEQ ID NO 51698 | CTTACTCGTCCCACTGATCACC | TTC | chr3 | 133746249 | 133746270 | 133746254 | 133746249 | - |
| SEQ ID NO 51699 | ACTCGTCCCACTGATCACCTCA | CTT | chr3 | 133746246 | 133746267 | 133746251 | 133746246 | - |
| SEQ ID NO 51700 | CTCGTCCCACTGATCACCTCAT | TTA | chr3 | 133746245 | 133746266 | 133746250 | 133746245 | - |
| SEQ ID NO 51701 | GTCCCACTGATCACCTCATTTT | CTC | chr3 | 133746242 | 133746263 | 133746247 | 133746242 | - |
| SEQ ID NO 51702 | ATCACCTCATTTTCTGAGCTCT | CTG | chr3 | 133746233 | 133746254 | 133746238 | 133746233 | - |
| SEQ ID NO 51703 | ATTTTCTGAGCTCTGGAGACGA | CTC | chr3 | 133746225 | 133746246 | 133746230 | 133746225 | - |
| SEQ ID NO 51704 | TCTGAGCTCTGGAGACGACCCG | TTT | chr3 | 133746221 | 133746242 | 133746226 | 133746221 | - |
| SEQ ID NO 51705 | CTGAGCTCTGGAGACGACCCGC | TTT | chr3 | 133746220 | 133746241 | 133746225 | 133746220 | - |
| SEQ ID NO 51706 | TGAGCTCTGGAGACGACCCGCG | TTC | chr3 | 133746219 | 133746240 | 133746224 | 133746219 | - |
| SEQ ID NO 51707 | AGCTCTGGAGACGACCCGCGAG | CTG | chr3 | 133746217 | 133746238 | 133746222 | 133746217 | - |
| SEQ ID NO 51708 | TGGAGACGACCCGCGAGTGGAA | CTC | chr3 | 133746212 | 133746233 | 133746217 | 133746212 | - |
| SEQ ID NO 51709 | GAGACGACCCGCGAGTGGAAGG | CTG | chr3 | 133746210 | 133746231 | 133746215 | 133746210 | - |
| SEQ ID NO 51710 | ATGGGAAGGGACATGAAGCACA | TTG | chr3 | 133746168 | 133746189 | 133746173 | 133746168 | - |
| SEQ ID NO 51711 | TCATCGCGGCTCGCTCGGTGCC | TTG | chr3 | 133746134 | 133746155 | 133746139 | 133746134 | - |

Figure 79

| # | Sequence | PAM | Chr | Start | End | Cuts 5' of | Str |
|---|---|---|---|---|---|---|---|
| SEQ ID NO 51712 | ACTAAGTCAATAATCAGAAT | CAG | chr18 | 31591771 | 31591790 | 31591787 | + |
| SEQ ID NO 51713 | AAGTCAATAATCAGAATCAG | CAG | chr18 | 31591774 | 31591793 | 31591790 | + |
| SEQ ID NO 51714 | AGTCAATAATCAGAATCAGC | AGG | chr18 | 31591775 | 31591794 | 31591791 | + |
| SEQ ID NO 51715 | AATCAGAATCAGCAGGTTTG | CAG | chr18 | 31591782 | 31591801 | 31591798 | + |
| SEQ ID NO 51716 | AGAATCAGCAGGTTTGCAGT | CAG | chr18 | 31591786 | 31591805 | 31591802 | + |
| SEQ ID NO 51717 | CAGCAGGTTTGCAGTCAGAT | TGG | chr18 | 31591791 | 31591810 | 31591807 | + |
| SEQ ID NO 51718 | CAGGTTTGCAGTCAGATTGG | CAG | chr18 | 31591794 | 31591813 | 31591810 | + |
| SEQ ID NO 51719 | AGGTTTGCAGTCAGATTGGC | AGG | chr18 | 31591795 | 31591814 | 31591811 | + |
| SEQ ID NO 51720 | GGTTTGCAGTCAGATTGGCA | GGG | chr18 | 31591796 | 31591815 | 31591812 | + |
| SEQ ID NO 51721 | GCAGTCAGATTGGCAGGGAT | AAG | chr18 | 31591801 | 31591820 | 31591817 | + |
| SEQ ID NO 51722 | GTCAGATTGGCAGGGATAAG | CAG | chr18 | 31591804 | 31591823 | 31591820 | + |
| SEQ ID NO 51723 | ATTGGCAGGGATAAGCAGCC | TAG | chr18 | 31591809 | 31591828 | 31591825 | + |
| SEQ ID NO 51724 | CAGGGATAAGCAGCCTAGCT | CAG | chr18 | 31591814 | 31591833 | 31591830 | + |
| SEQ ID NO 51725 | AGGGATAAGCAGCCTAGCTC | AGG | chr18 | 31591815 | 31591834 | 31591831 | + |
| SEQ ID NO 51726 | GGATAAGCAGCCTAGCTCAG | GAG | chr18 | 31591817 | 31591836 | 31591833 | + |
| SEQ ID NO 51727 | TAAGCAGCCTAGCTCAGGAG | AAG | chr18 | 31591820 | 31591839 | 31591836 | + |
| SEQ ID NO 51728 | CAGCCTAGCTCAGGAGAAGT | GAG | chr18 | 31591824 | 31591843 | 31591840 | + |
| SEQ ID NO 51729 | CTCAGGAGAAGTGAGTATAA | AAG | chr18 | 31591832 | 31591851 | 31591848 | + |
| SEQ ID NO 51730 | AGAAGTGAGTATAAAAGCCC | CAG | chr18 | 31591838 | 31591857 | 31591854 | + |
| SEQ ID NO 51731 | GAAGTGAGTATAAAAGCCCC | AGG | chr18 | 31591839 | 31591858 | 31591855 | + |
| SEQ ID NO 51732 | TGAGTATAAAAGCCCCAGGC | TGG | chr18 | 31591843 | 31591862 | 31591859 | + |
| SEQ ID NO 51733 | GAGTATAAAAGCCCCAGGCT | GGG | chr18 | 31591844 | 31591863 | 31591860 | + |
| SEQ ID NO 51734 | GTATAAAAGCCCCAGGCTGG | GAG | chr18 | 31591846 | 31591865 | 31591862 | + |
| SEQ ID NO 51735 | TAAAAGCCCCAGGCTGGGAG | CAG | chr18 | 31591849 | 31591868 | 31591865 | + |
| SEQ ID NO 51736 | CAGGCTGGGAGCAGCCATCA | CAG | chr18 | 31591858 | 31591877 | 31591874 | + |
| SEQ ID NO 51737 | GCTGGGAGCAGCCATCACAG | AAG | chr18 | 31591861 | 31591880 | 31591877 | + |
| SEQ ID NO 51738 | CACAGAAGTCCACTCATTCT | TGG | chr18 | 31591876 | 31591895 | 31591892 | + |
| SEQ ID NO 51739 | AGAAGTCCACTCATTCTTGG | CAG | chr18 | 31591879 | 31591898 | 31591895 | + |
| SEQ ID NO 51740 | GAAGTCCACTCATTCTTGGC | AGG | chr18 | 31591880 | 31591899 | 31591896 | + |
| SEQ ID NO 51741 | TCCACTCATTCTTGGCAGGA | TGG | chr18 | 31591884 | 31591903 | 31591900 | + |
| SEQ ID NO 51742 | CTGCTCCTCCTCTGCCTTGC | TGG | chr18 | 31591918 | 31591937 | 31591934 | + |
| SEQ ID NO 51743 | CCTCCTCTGCCTTGCTGGAC | TGG | chr18 | 31591923 | 31591942 | 31591939 | + |
| SEQ ID NO 51744 | CTGGACTGGTATTTGTGTCT | GAG | chr18 | 31591937 | 31591956 | 31591953 | + |
| SEQ ID NO 51745 | TGGACTGGTATTTGTGTCTG | AGG | chr18 | 31591938 | 31591957 | 31591954 | Str |
| SEQ ID NO 51746 | CTGGTATTTGTGTCTGAGGC | TGG | chr18 | 31591942 | 31591961 | 31591958 | + |
| SEQ ID NO 51747 | TGTGTCTGAGGCTGGCCCTA | CGG | chr18 | 31591950 | 31591969 | 31591966 | + |
| SEQ ID NO 51748 | TCTGAGGCTGGCCCTACGGT | GAG | chr18 | 31591954 | 31591973 | 31591970 | + |
| SEQ ID NO 51749 | GACATCCCATTCCTACATTT | AAG | chr18 | 31591986 | 31592005 | 31592002 | + |
| SEQ ID NO 51750 | TTTAAGATTCACGCTAAATG | AAG | chr18 | 31592003 | 31592022 | 31592019 | + |
| SEQ ID NO 51751 | AAGATTCACGCTAAATGAAG | TAG | chr18 | 31592006 | 31592025 | 31592022 | + |
| SEQ ID NO 51752 | ATTCACGCTAAATGAAGTAG | AAG | chr18 | 31592009 | 31592028 | 31592025 | + |
| SEQ ID NO 51753 | GAAGTAGAAGTGACTCCTTC | CAG | chr18 | 31592022 | 31592041 | 31592038 | + |
| SEQ ID NO 51754 | CTCCTTCCAGCTTTGCCAAC | CAG | chr18 | 31592035 | 31592054 | 31592051 | + |
| SEQ ID NO 51755 | TGCCAACCAGCTTTTATTAC | TAG | chr18 | 31592048 | 31592067 | 31592064 | + |
| SEQ ID NO 51756 | GCCAACCAGCTTTTATTACT | AGG | chr18 | 31592049 | 31592068 | 31592065 | + |
| SEQ ID NO 51757 | CCAACCAGCTTTTATTACTA | GGG | chr18 | 31592050 | 31592069 | 31592066 | + |
| SEQ ID NO 51758 | CCAGCTTTTATTACTAGGGC | AAG | chr18 | 31592054 | 31592073 | 31592070 | + |

Figure 79 (Cont'd)

| | | | | | | | |
|---|---|---|---|---|---|---|---|
| SEQ ID NO 51759 | CAGCTTTTATTACTAGGGCA | AGG | chr18 | 31592055 | 31592074 | 31592071 | + |
| SEQ ID NO 51760 | AGCTTTTATTACTAGGGCAA | GGG | chr18 | 31592056 | 31592075 | 31592072 | + |
| SEQ ID NO 51761 | ATTACTAGGGCAAGGGTACC | CAG | chr18 | 31592063 | 31592082 | 31592079 | + |
| SEQ ID NO 51762 | TAATTAATTCAAACTTCAAA | AAG | chr18 | 31592101 | 31592120 | 31592117 | + |
| SEQ ID NO 51763 | TTCAAACTTCAAAAGAATG | AAG | chr18 | 31592108 | 31592127 | 31592124 | + |
| SEQ ID NO 51764 | AAAAGAATGAAGTTCCACT | GAG | chr18 | 31592118 | 31592137 | 31592134 | + |
| SEQ ID NO 51765 | GAAGTTCCACTGAGCTTACT | GAG | chr18 | 31592127 | 31592146 | 31592143 | + |
| SEQ ID NO 51766 | TTCCACTGAGCTTACTGAGC | TGG | chr18 | 31592131 | 31592150 | 31592147 | + |
| SEQ ID NO 51767 | TCCACTGAGCTTACTGAGCT | GGG | chr18 | 31592132 | 31592151 | 31592148 | + |
| SEQ ID NO 51768 | TGAGCTGGGACTTGAACTCT | GAG | chr18 | 31592146 | 31592165 | 31592162 | + |
| SEQ ID NO 51769 | AGCATTCACCTCATTGCTT | TGG | chr18 | 31592167 | 31592186 | 31592183 | + |
| SEQ ID NO 51770 | ACCTCATTGCTTTGGTGCAT | TAG | chr18 | 31592175 | 31592194 | 31592191 | + |
| SEQ ID NO 51771 | CCTCATTGCTTTGGTGCATT | AGG | chr18 | 31592176 | 31592195 | 31592192 | + |
| SEQ ID NO 51772 | TGCATTAGGTTTGTAATATC | TGG | chr18 | 31592190 | 31592209 | 31592206 | + |
| SEQ ID NO 51773 | ATCTGGTACCTCTGTTTCCT | CAG | chr18 | 31592207 | 31592226 | 31592223 | + |
| SEQ ID NO 51774 | GGTACCTCTGTTTCCTCAGA | TAG | chr18 | 31592211 | 31592230 | 31592227 | + |
| SEQ ID NO 51775 | CTGTTTCCTCAGATAGATGA | TAG | chr18 | 31592218 | 31592237 | 31592234 | + |
| SEQ ID NO 51776 | TCAGATAGATGATAGAAATA | AAG | chr18 | 31592226 | 31592245 | 31592242 | + |
| SEQ ID NO 51777 | AGAAATAAAGATATGATATT | AAG | chr18 | 31592239 | 31592258 | 31592255 | + |
| SEQ ID NO 51778 | GAAATAAAGATATGATATTA | AGG | chr18 | 31592240 | 31592259 | 31592256 | + |
| SEQ ID NO 51779 | ATAAAGATATGATATTAAGG | AAG | chr18 | 31592243 | 31592262 | 31592259 | + |
| SEQ ID NO 51780 | AGCTGTTAATACTGAATTTT | CAG | chr18 | 31592264 | 31592283 | 31592280 | + |
| SEQ ID NO 51781 | TTAATACTGAATTTTCAGAA | AAG | chr18 | 31592269 | 31592288 | 31592285 | + |
| SEQ ID NO 51782 | ATCCCTCCATAAAATGTATT | TGG | chr18 | 31592293 | 31592312 | 31592309 | + |
| SEQ ID NO 51783 | TCCCTCCATAAAATGTATTT | GGG | chr18 | 31592294 | 31592313 | 31592310 | + |
| SEQ ID NO 51784 | CCCTCCATAAAATGTATTTG | GGG | chr18 | 31592295 | 31592314 | 31592311 | + |
| SEQ ID NO 51785 | CCTCCATAAAATGTATTTGG | GGG | chr18 | 31592296 | 31592315 | 31592312 | + |
| SEQ ID NO 51786 | TGTATTTGGGGGACAAACTG | CAG | chr18 | 31592307 | 31592326 | 31592323 | + |
| SEQ ID NO 51787 | GTATTTGGGGGACAAACTGC | AGG | chr18 | 31592308 | 31592327 | 31592324 | + |
| SEQ ID NO 51788 | ATTTGGGGGACAAACTGCAG | GAG | chr18 | 31592310 | 31592329 | 31592326 | + |
| SEQ ID NO 51789 | AACTGCAGGAGATTATATTC | TGG | chr18 | 31592322 | 31592341 | 31592338 | + |
| SEQ ID NO 51790 | GAGATTATATTCTGGCCCTA | TAG | chr18 | 31592330 | 31592349 | 31592346 | + |
| SEQ ID NO 51791 | ATTTATTGATTAATCTTTAA | AAG | chr18 | 31592366 | 31592385 | 31592382 | + |
| SEQ ID NO 51792 | TTTATTGATTAATCTTTAAA | AGG | chr18 | 31592367 | 31592386 | 31592383 | + |
| SEQ ID NO 51793 | TGATTAATCTTTAAAAGGCT | TAG | chr18 | 31592372 | 31592391 | 31592388 | + |
| SEQ ID NO 51794 | AGGCTTAGTGAACAATATTC | TAG | chr18 | 31592387 | 31592406 | 31592403 | + |
| SEQ ID NO 51795 | TTAGTGAACAATATTCTAGT | CAG | chr18 | 31592391 | 31592410 | 31592407 | + |
| SEQ ID NO 51796 | TATCTAATTCTTAAATCCTC | TAG | chr18 | 31592415 | 31592434 | 31592431 | + |
| SEQ ID NO 51797 | CTAATTCTTAAATCCTCTAG | AAG | chr18 | 31592418 | 31592437 | 31592434 | + |
| SEQ ID NO 51798 | AATTAACTAATACTATAAAA | TGG | chr18 | 31592441 | 31592460 | 31592457 | + |
| SEQ ID NO 51799 | ATTAACTAATACTATAAAAT | GGG | chr18 | 31592442 | 31592461 | 31592458 | + |
| SEQ ID NO 51800 | CTAATACTATAAAATGGGTC | TGG | chr18 | 31592447 | 31592466 | 31592463 | + |
| SEQ ID NO 51801 | CTATAAAATGGGTCTGGATG | TAG | chr18 | 31592453 | 31592472 | 31592469 | + |
| SEQ ID NO 51802 | TGACATTATTTTATAACAAC | TGG | chr18 | 31592479 | 31592498 | 31592495 | + |
| SEQ ID NO 51803 | ATTATTTTATAACAACTGGT | AAG | chr18 | 31592483 | 31592502 | 31592499 | + |
| SEQ ID NO 51804 | TATTTTATAACAACTGGTAA | GAG | chr18 | 31592485 | 31592504 | 31592501 | + |
| SEQ ID NO 51805 | ATTTTATAACAACTGGTAAG | AGG | chr18 | 31592486 | 31592505 | 31592502 | + |
| SEQ ID NO 51806 | TTTTATAACAACTGGTAAGA | GGG | chr18 | 31592487 | 31592506 | 31592503 | + |

Figure 79 (Cont'd)

| | | | | | | | |
|---|---|---|---|---|---|---|---|
| SEQ ID NO 51807 | TTATAACAACTGGTAAGAGG | GAG | chr18 | 31592489 | 31592508 | 31592505 | + |
| SEQ ID NO 51808 | CTGGTAAGAGGGAGTGACTA | TAG | chr18 | 31592498 | 31592517 | 31592514 | + |
| SEQ ID NO 51809 | AGCAACAACTAAAATGATCT | CAG | chr18 | 31592519 | 31592538 | 31592535 | + |
| SEQ ID NO 51810 | GCAACAACTAAAATGATCTC | AGG | chr18 | 31592520 | 31592539 | 31592536 | + |
| SEQ ID NO 51811 | TGATCTCAGGAAAACCTGTT | TGG | chr18 | 31592533 | 31592552 | 31592549 | + |
| SEQ ID NO 51812 | AACCTGTTTGGCCCTATGTA | TGG | chr18 | 31592545 | 31592564 | 31592561 | + |
| SEQ ID NO 51813 | TATGGTACATTACATCTTTT | CAG | chr18 | 31592563 | 31592582 | 31592579 | + |
| SEQ ID NO 51814 | TTTCAGTAATTCCACTCAAA | TGG | chr18 | 31592580 | 31592599 | 31592596 | + |
| SEQ ID NO 51815 | TCAGTAATTCCACTCAAATG | GAG | chr18 | 31592582 | 31592601 | 31592598 | + |
| SEQ ID NO 51816 | TCAAATGGAGACTTTTAACA | AAG | chr18 | 31592595 | 31592614 | 31592611 | + |
| SEQ ID NO 51817 | TTTAACAAAGCAACTGTTCT | CAG | chr18 | 31592608 | 31592627 | 31592624 | + |
| SEQ ID NO 51818 | TTAACAAAGCAACTGTTCTC | AGG | chr18 | 31592609 | 31592628 | 31592625 | + |
| SEQ ID NO 51819 | TAACAAAGCAACTGTTCTCA | GGG | chr18 | 31592610 | 31592629 | 31592626 | + |
| SEQ ID NO 51820 | AACAAAGCAACTGTTCTCAG | GGG | chr18 | 31592611 | 31592630 | 31592627 | + |
| SEQ ID NO 51821 | AAATTCATTATACACATCCC | TGG | chr18 | 31592651 | 31592670 | 31592667 | + |
| SEQ ID NO 51822 | TTATACACATCCCTGGTTGA | TAG | chr18 | 31592658 | 31592677 | 31592674 | + |
| SEQ ID NO 51823 | TACACATCCCTGGTTGATAG | CAG | chr18 | 31592661 | 31592680 | 31592677 | + |
| SEQ ID NO 51824 | CTGGTTGATAGCAGTGTGTC | TGG | chr18 | 31592670 | 31592689 | 31592686 | + |
| SEQ ID NO 51825 | GGTTGATAGCAGTGTGTCTG | GAG | chr18 | 31592672 | 31592691 | 31592688 | + |
| SEQ ID NO 51826 | GTTGATAGCAGTGTGTCTGG | AGG | chr18 | 31592673 | 31592692 | 31592689 | + |
| SEQ ID NO 51827 | GATAGCAGTGTGTCTGGAGG | CAG | chr18 | 31592676 | 31592695 | 31592692 | + |
| SEQ ID NO 51828 | GGCAGAAACCATTCTTGCTT | TGG | chr18 | 31592694 | 31592713 | 31592710 | + |
| SEQ ID NO 51829 | AATTACGTCTGTGTTATACT | GAG | chr18 | 31592721 | 31592740 | 31592737 | + |
| SEQ ID NO 51830 | TACGTCTGTGTTATACTGAG | TAG | chr18 | 31592724 | 31592743 | 31592740 | + |
| SEQ ID NO 51831 | ACGTCTGTGTTATACTGAGT | AGG | chr18 | 31592725 | 31592744 | 31592741 | + |
| SEQ ID NO 51832 | CGTCTGTGTTATACTGAGTA | GGG | chr18 | 31592726 | 31592745 | 31592742 | + |
| SEQ ID NO 51833 | CTGTGTTATACTGAGTAGGG | AAG | chr18 | 31592729 | 31592748 | 31592745 | + |
| SEQ ID NO 51834 | GACACTTACGTTCCTGATAA | TGG | chr18 | 31592765 | 31592784 | 31592781 | + |
| SEQ ID NO 51835 | ACACTTACGTTCCTGATAAT | GGG | chr18 | 31592766 | 31592785 | 31592782 | + |
| SEQ ID NO 51836 | TACGTTCCTGATAATGGGAT | CAG | chr18 | 31592771 | 31592790 | 31592787 | + |
| SEQ ID NO 51837 | GTGTAATTCTTGTTTCGCTC | CAG | chr18 | 31592795 | 31592814 | 31592811 | + |
| SEQ ID NO 51838 | TCCAGATTTCTAATACCACA | AAG | chr18 | 31592813 | 31592832 | 31592829 | + |
| SEQ ID NO 51839 | TCACGTGTCTTCTCTACACC | CAG | chr18 | 31592873 | 31592892 | 31592889 | + |
| SEQ ID NO 51840 | CACGTGTCTTCTCTACACCC | AGG | chr18 | 31592874 | 31592893 | 31592890 | + |
| SEQ ID NO 51841 | ACGTGTCTTCTCTACACCCA | GGG | chr18 | 31592875 | 31592894 | 31592891 | + |
| SEQ ID NO 51842 | CTTCTCTACACCCAGGGCAC | CGG | chr18 | 31592881 | 31592900 | 31592897 | + |
| SEQ ID NO 51843 | CCCAGGGCACCGGTGAATCC | AAG | chr18 | 31592891 | 31592910 | 31592907 | + |
| SEQ ID NO 51844 | TGAATCCAAGTGTCCTCTGA | TGG | chr18 | 31592904 | 31592923 | 31592920 | + |
| SEQ ID NO 51845 | CAAGTGTCCTCTGATGGTCA | AAG | chr18 | 31592910 | 31592929 | 31592926 | + |
| SEQ ID NO 51846 | TCCTCTGATGGTCAAAGTTC | TAG | chr18 | 31592916 | 31592935 | 31592932 | + |
| SEQ ID NO 51847 | CAAAGTTCTAGATGCTGTCC | GAG | chr18 | 31592928 | 31592947 | 31592944 | + |
| SEQ ID NO 51848 | AAAGTTCTAGATGCTGTCCG | AGG | chr18 | 31592929 | 31592948 | 31592945 | + |
| SEQ ID NO 51849 | GTTCTAGATGCTGTCCGAGG | CAG | chr18 | 31592932 | 31592951 | 31592948 | + |
| SEQ ID NO 51850 | AGGCAGTCCTGCCATCAATG | TGG | chr18 | 31592949 | 31592968 | 31592965 | + |
| SEQ ID NO 51851 | AATGTGGCCGTGCATGTGTT | CAG | chr18 | 31592965 | 31592984 | 31592981 | + |
| SEQ ID NO 51852 | TGGCCGTGCATGTGTTCAGA | AAG | chr18 | 31592969 | 31592988 | 31592985 | + |
| SEQ ID NO 51853 | GGCCGTGCATGTGTTCAGAA | AGG | chr18 | 31592970 | 31592989 | 31592986 | + |
| SEQ ID NO 51854 | GAAAGGCTGCTGATGACACC | TGG | chr18 | 31592987 | 31593006 | 31593003 | + |

Figure 79 (Cont'd)

| | | | | | | | |
|---|---|---|---|---|---|---|---|
| SEQ ID NO 51855 | AAAGGCTGCTGATGACACCT | GGG | chr18 | 31592988 | 31593007 | 31593004 | + |
| SEQ ID NO 51856 | AGGCTGCTGATGACACCTGG | GAG | chr18 | 31592990 | 31593009 | 31593006 | + |
| SEQ ID NO 51857 | ACCTGGGAGCCATTTGCCTC | TGG | chr18 | 31593004 | 31593023 | 31593020 | + |
| SEQ ID NO 51858 | AAATGGCTCCCAGGTGTCAT | CAG | chr18 | 31592999 | 31593018 | 31593002 | - |
| SEQ ID NO 51859 | TGGCTCCCAGGTGTCATCAG | CAG | chr18 | 31592996 | 31593015 | 31592999 | - |
| SEQ ID NO 51860 | AGCCTTTCTGAACACATGCA | CGG | chr18 | 31592975 | 31592994 | 31592978 | - |
| SEQ ID NO 51861 | CACATGCACGGCCACATTGA | TGG | chr18 | 31592963 | 31592982 | 31592966 | - |
| SEQ ID NO 51862 | ATGCACGGCCACATTGATGG | CAG | chr18 | 31592960 | 31592979 | 31592963 | - |
| SEQ ID NO 51863 | TGCACGGCCACATTGATGGC | AGG | chr18 | 31592959 | 31592978 | 31592962 | - |
| SEQ ID NO 51864 | CATTGATGGCAGGACTGCCT | CGG | chr18 | 31592949 | 31592968 | 31592952 | - |
| SEQ ID NO 51865 | GATGGCAGGACTGCCTCGGA | CAG | chr18 | 31592945 | 31592964 | 31592948 | - |
| SEQ ID NO 51866 | GGACTGCCTCGGACAGCATC | TAG | chr18 | 31592938 | 31592957 | 31592941 | - |
| SEQ ID NO 51867 | GCATCTAGAACTTTGACCAT | CAG | chr18 | 31592923 | 31592942 | 31592926 | - |
| SEQ ID NO 51868 | ATCTAGAACTTTGACCATCA | GAG | chr18 | 31592921 | 31592940 | 31592924 | - |
| SEQ ID NO 51869 | TCTAGAACTTTGACCATCAG | AGG | chr18 | 31592920 | 31592939 | 31592923 | - |
| SEQ ID NO 51870 | TTTGACCATCAGAGGACACT | TGG | chr18 | 31592912 | 31592931 | 31592915 | - |
| SEQ ID NO 51871 | CAGAGGACACTTGGATTCAC | CGG | chr18 | 31592903 | 31592922 | 31592906 | - |
| SEQ ID NO 51872 | ACTTGGATTCACCGGTGCCC | TGG | chr18 | 31592895 | 31592914 | 31592898 | - |
| SEQ ID NO 51873 | CTTGGATTCACCGGTGCCCT | GGG | chr18 | 31592894 | 31592913 | 31592897 | - |
| SEQ ID NO 51874 | ATTCACCGGTGCCCTGGGTG | TAG | chr18 | 31592889 | 31592908 | 31592892 | - |
| SEQ ID NO 51875 | TCACCGGTGCCCTGGGTGTA | GAG | chr18 | 31592887 | 31592906 | 31592890 | - |
| SEQ ID NO 51876 | CCGGTGCCCTGGGTGTAGAG | AAG | chr18 | 31592884 | 31592903 | 31592887 | - |
| SEQ ID NO 51877 | TGGGTGTAGAGAAGACACGT | GAG | chr18 | 31592875 | 31592894 | 31592878 | - |
| SEQ ID NO 51878 | GTGTAGAGAAGACACGTGAG | AAG | chr18 | 31592872 | 31592891 | 31592875 | - |
| SEQ ID NO 51879 | GAGAAGTTAACAAAATTGAT | CAG | chr18 | 31592855 | 31592874 | 31592858 | - |
| SEQ ID NO 51880 | GAAGTTAACAAAATTGATCA | GAG | chr18 | 31592853 | 31592872 | 31592856 | - |
| SEQ ID NO 51881 | AACAAAATTGATCAGAGTGA | AAG | chr18 | 31592847 | 31592866 | 31592850 | - |
| SEQ ID NO 51882 | ACAAAATTGATCAGAGTGAA | AGG | chr18 | 31592846 | 31592865 | 31592849 | - |
| SEQ ID NO 51883 | GTGAAAGGATTTATTCTTTG | TGG | chr18 | 31592831 | 31592850 | 31592834 | - |
| SEQ ID NO 51884 | GGATTTATTCTTTGTGGTAT | TAG | chr18 | 31592825 | 31592844 | 31592828 | - |
| SEQ ID NO 51885 | TCTTTGTGGTATTAGAAATC | TGG | chr18 | 31592817 | 31592836 | 31592820 | - |
| SEQ ID NO 51886 | TTTGTGGTATTAGAAATCTG | GAG | chr18 | 31592815 | 31592834 | 31592818 | - |
| SEQ ID NO 51887 | TTAGAAATCTGGAGCGAAAC | AAG | chr18 | 31592806 | 31592825 | 31592809 | - |
| SEQ ID NO 51888 | TTACACTGATCCCATTAT | CAG | chr18 | 31592781 | 31592800 | 31592784 | - |
| SEQ ID NO 51889 | TACACTGATCCCATTATC | AGG | chr18 | 31592780 | 31592799 | 31592783 | - |
| SEQ ID NO 51890 | GATCCCATTATCAGGAACGT | AAG | chr18 | 31592772 | 31592791 | 31592775 | - |
| SEQ ID NO 51891 | CGTAAGTGTCGACAATTAAT | GAG | chr18 | 31592755 | 31592774 | 31592758 | - |
| SEQ ID NO 51892 | AATTAATGAGCTTCCCTACT | CAG | chr18 | 31592742 | 31592761 | 31592745 | - |
| SEQ ID NO 51893 | CTTCCCTACTCAGTATAACA | CAG | chr18 | 31592732 | 31592751 | 31592735 | - |
| SEQ ID NO 51894 | CACAGACGTAATTGTTTCCA | AAG | chr18 | 31592714 | 31592733 | 31592717 | - |
| SEQ ID NO 51895 | GACGTAATTGTTTCCAAAGC | AAG | chr18 | 31592710 | 31592729 | 31592713 | - |
| SEQ ID NO 51896 | AATTGTTTCCAAAGCAAGAA | TGG | chr18 | 31592705 | 31592724 | 31592708 | - |
| SEQ ID NO 51897 | GCAAGAATGGTTTCTGCCTC | CAG | chr18 | 31592692 | 31592711 | 31592695 | - |
| SEQ ID NO 51898 | CCAGACACACTGCTATCAAC | CAG | chr18 | 31592673 | 31592692 | 31592676 | - |
| SEQ ID NO 51899 | CAGACACACTGCTATCAACC | AGG | chr18 | 31592672 | 31592691 | 31592675 | - |
| SEQ ID NO 51900 | AGACACACTGCTATCAACCA | GGG | chr18 | 31592671 | 31592690 | 31592674 | - |
| SEQ ID NO 51901 | GGATGTGTATAATGAATTTT | AAG | chr18 | 31592650 | 31592669 | 31592653 | - |
| SEQ ID NO 51902 | GATGTGTATAATGAATTTTA | AGG | chr18 | 31592649 | 31592668 | 31592652 | - |

Figure 79 (Cont'd)

| | | | | | | | |
|---|---|---|---|---|---|---|---|
| SEQ ID NO 51903 | ATGTGTATAATGAATTTTAA | GGG | chr18 | 31592648 | 31592667 | 31592651 | - |
| SEQ ID NO 51904 | GTGTATAATGAATTTTAAGG | GAG | chr18 | 31592646 | 31592665 | 31592649 | - |
| SEQ ID NO 51905 | ATGAATTTTAAGGGAGAAAA | TAG | chr18 | 31592639 | 31592658 | 31592642 | - |
| SEQ ID NO 51906 | TGAATTTTAAGGGAGAAAAT | AGG | chr18 | 31592638 | 31592657 | 31592641 | - |
| SEQ ID NO 51907 | AGGGAGAAAATAGGTCCCCT | GAG | chr18 | 31592629 | 31592648 | 31592632 | - |
| SEQ ID NO 51908 | GAAAATAGGTCCCCTGAGAA | CAG | chr18 | 31592624 | 31592643 | 31592627 | - |
| SEQ ID NO 51909 | GAGAACAGTTGCTTTGTTAA | AAG | chr18 | 31592609 | 31592628 | 31592612 | - |
| SEQ ID NO 51910 | TTTGTTAAAAGTCTCCATTT | GAG | chr18 | 31592597 | 31592616 | 31592600 | - |
| SEQ ID NO 51911 | GTTAAAAGTCTCCATTTGAG | TGG | chr18 | 31592594 | 31592613 | 31592597 | - |
| SEQ ID NO 51912 | ATTTGAGTGGAATTACTGAA | AAG | chr18 | 31592581 | 31592600 | 31592584 | - |
| SEQ ID NO 51913 | AAGATGTAATGTACCATACA | TAG | chr18 | 31592561 | 31592580 | 31592564 | - |
| SEQ ID NO 51914 | AGATGTAATGTACCATACAT | AGG | chr18 | 31592560 | 31592579 | 31592563 | - |
| SEQ ID NO 51915 | GATGTAATGTACCATACATA | GGG | chr18 | 31592559 | 31592578 | 31592562 | - |
| SEQ ID NO 51916 | GTACCATACATAGGGCCAAA | CAG | chr18 | 31592551 | 31592570 | 31592554 | - |
| SEQ ID NO 51917 | TACCATACATAGGGCCAAAC | AGG | chr18 | 31592550 | 31592569 | 31592553 | - |
| SEQ ID NO 51918 | AGGGCCAAACAGGTTTTCCT | GAG | chr18 | 31592540 | 31592559 | 31592543 | - |
| SEQ ID NO 51919 | AGGTTTTCCTGAGATCATTT | TAG | chr18 | 31592530 | 31592549 | 31592533 | - |
| SEQ ID NO 51920 | GATCATTTTAGTTGTTGCTA | TAG | chr18 | 31592518 | 31592537 | 31592521 | - |
| SEQ ID NO 51921 | CTATAGTCACTCCCTCTTAC | CAG | chr18 | 31592501 | 31592520 | 31592504 | - |
| SEQ ID NO 51922 | CAGTTGTTATAAAATAATGT | CAG | chr18 | 31592481 | 31592500 | 31592484 | - |
| SEQ ID NO 51923 | AATAATGTCAGAACTACATC | CAG | chr18 | 31592469 | 31592488 | 31592472 | - |
| SEQ ID NO 51924 | CTACATCCAGACCCATTTTA | TAG | chr18 | 31592456 | 31592475 | 31592459 | - |
| SEQ ID NO 51925 | CCAGACCCATTTTATAGTAT | TAG | chr18 | 31592450 | 31592469 | 31592453 | - |
| SEQ ID NO 51926 | ATAGTATTAGTTAATTCTTC | TAG | chr18 | 31592437 | 31592456 | 31592440 | - |
| SEQ ID NO 51927 | AGTATTAGTTAATTCTTCTA | GAG | chr18 | 31592435 | 31592454 | 31592438 | - |
| SEQ ID NO 51928 | GTATTAGTTAATTCTTCTAG | AGG | chr18 | 31592434 | 31592453 | 31592437 | - |
| SEQ ID NO 51929 | TTAATTCTTCTAGAGGATTT | AAG | chr18 | 31592427 | 31592446 | 31592430 | - |
| SEQ ID NO 51930 | CTTCTAGAGGATTTAAGAAT | TAG | chr18 | 31592421 | 31592440 | 31592424 | - |
| SEQ ID NO 51931 | TTAAGAATTAGATATCTGAC | TAG | chr18 | 31592409 | 31592428 | 31592412 | - |
| SEQ ID NO 51932 | TGACTAGAATATTGTTCACT | AAG | chr18 | 31592393 | 31592412 | 31592396 | - |
| SEQ ID NO 51933 | ATTGTTCACTAAGCCTTTTA | AAG | chr18 | 31592383 | 31592402 | 31592386 | - |
| SEQ ID NO 51934 | AAATACGTTTTGAATAACTA | TAG | chr18 | 31592350 | 31592369 | 31592353 | - |
| SEQ ID NO 51935 | AATACGTTTTGAATAACTAT | AGG | chr18 | 31592349 | 31592368 | 31592352 | - |
| SEQ ID NO 51936 | ATACGTTTTGAATAACTATA | GGG | chr18 | 31592348 | 31592367 | 31592351 | - |
| SEQ ID NO 51937 | GTTTTGAATAACTATAGGGC | CAG | chr18 | 31592344 | 31592363 | 31592347 | - |
| SEQ ID NO 51938 | GGCCAGAATATAATCTCCTG | CAG | chr18 | 31592327 | 31592346 | 31592330 | - |
| SEQ ID NO 51939 | TGTCCCCCAAATACATTTTA | TGG | chr18 | 31592302 | 31592321 | 31592305 | - |
| SEQ ID NO 51940 | TCCCCCAAATACATTTTATG | GAG | chr18 | 31592300 | 31592319 | 31592303 | - |
| SEQ ID NO 51941 | CCCCCAAATACATTTTATGG | AGG | chr18 | 31592299 | 31592318 | 31592302 | - |
| SEQ ID NO 51942 | CCCCAAATACATTTTATGGA | GGG | chr18 | 31592298 | 31592317 | 31592301 | - |
| SEQ ID NO 51943 | GGGATACTTTTCTGAAAATT | CAG | chr18 | 31592278 | 31592297 | 31592281 | - |
| SEQ ID NO 51944 | TTCTGAAAATTCAGTATTAA | CAG | chr18 | 31592269 | 31592288 | 31592272 | - |
| SEQ ID NO 51945 | TTTATTTCTATCATCTATCT | GAG | chr18 | 31592228 | 31592247 | 31592231 | - |
| SEQ ID NO 51946 | TTATTTCTATCATCTATCTG | AGG | chr18 | 31592227 | 31592246 | 31592230 | - |
| SEQ ID NO 51947 | CTATCATCTATCTGAGGAAA | CAG | chr18 | 31592221 | 31592240 | 31592224 | - |
| SEQ ID NO 51948 | ATCATCTATCTGAGGAAACA | GAG | chr18 | 31592219 | 31592238 | 31592222 | - |
| SEQ ID NO 51949 | TCATCTATCTGAGGAAACAG | AGG | chr18 | 31592218 | 31592237 | 31592221 | - |
| SEQ ID NO 51950 | ATCTGAGGAAACAGAGGTAC | CAG | chr18 | 31592212 | 31592231 | 31592215 | - |

Figure 79 (Cont'd)

| | | | | | | | |
|---|---|---|---|---|---|---|---|
| SEQ ID NO 51951 | ATTACAAACCTAATGCACCA | AAG | chr18 | 31592187 | 31592206 | 31592190 | - |
| SEQ ID NO 51952 | ACCTAATGCACCAAAGCAAT | GAG | chr18 | 31592180 | 31592199 | 31592183 | - |
| SEQ ID NO 51953 | CCTAATGCACCAAAGCAATG | AGG | chr18 | 31592179 | 31592198 | 31592182 | - |
| SEQ ID NO 51954 | AATGCACCAAAGCAATGAGG | TAG | chr18 | 31592176 | 31592195 | 31592179 | - |
| SEQ ID NO 51955 | AAGCAATGAGGTAGAATGCT | CAG | chr18 | 31592167 | 31592186 | 31592170 | - |
| SEQ ID NO 51956 | GCAATGAGGTAGAATGCTCA | GAG | chr18 | 31592165 | 31592184 | 31592168 | - |
| SEQ ID NO 51957 | AGGTAGAATGCTCAGAGTTC | AAG | chr18 | 31592159 | 31592178 | 31592162 | - |
| SEQ ID NO 51958 | AATGCTCAGAGTTCAAGTCC | CAG | chr18 | 31592153 | 31592172 | 31592156 | - |
| SEQ ID NO 51959 | TCAGAGTTCAAGTCCCAGCT | CAG | chr18 | 31592148 | 31592167 | 31592151 | - |
| SEQ ID NO 51960 | AGTTCAAGTCCCAGCTCAGT | AAG | chr18 | 31592144 | 31592163 | 31592147 | - |
| SEQ ID NO 51961 | AAGTCCCAGCTCAGTAAGCT | CAG | chr18 | 31592139 | 31592158 | 31592142 | - |
| SEQ ID NO 51962 | TCCCAGCTCAGTAAGCTCAG | TGG | chr18 | 31592136 | 31592155 | 31592139 | - |
| SEQ ID NO 51963 | GTGGAACTTCATTCTTTTTG | AAG | chr18 | 31592117 | 31592136 | 31592120 | - |
| SEQ ID NO 51964 | TGAATTAATTATATTAAAAA | TAG | chr18 | 31592092 | 31592111 | 31592095 | - |
| SEQ ID NO 51965 | ATTTATATTAAAAATAGATGC | TGG | chr18 | 31592085 | 31592104 | 31592088 | - |
| SEQ ID NO 51966 | TTATATTAAAAATAGATGCT | GGG | chr18 | 31592084 | 31592103 | 31592087 | - |
| SEQ ID NO 51967 | GATGCTGGGTACCCTTGCCC | TAG | chr18 | 31592070 | 31592089 | 31592073 | - |
| SEQ ID NO 51968 | TACCCTTGCCCTAGTAATAA | AAG | chr18 | 31592061 | 31592080 | 31592064 | - |
| SEQ ID NO 51969 | CTTGCCCTAGTAATAAAAGC | TGG | chr18 | 31592057 | 31592076 | 31592060 | - |
| SEQ ID NO 51970 | CCCTAGTAATAAAAGCTGGT | TGG | chr18 | 31592053 | 31592072 | 31592056 | - |
| SEQ ID NO 51971 | GTAATAAAAGCTGGTTGGCA | AAG | chr18 | 31592048 | 31592067 | 31592051 | - |
| SEQ ID NO 51972 | TAAAAGCTGGTTGGCAAAGC | TGG | chr18 | 31592044 | 31592063 | 31592047 | - |
| SEQ ID NO 51973 | AAGCTGGTTGGCAAAGCTGG | AAG | chr18 | 31592041 | 31592060 | 31592044 | - |
| SEQ ID NO 51974 | AGCTGGTTGGCAAAGCTGGA | AGG | chr18 | 31592040 | 31592059 | 31592043 | - |
| SEQ ID NO 51975 | CTGGTTGGCAAAGCTGGAAG | GAG | chr18 | 31592038 | 31592057 | 31592041 | - |
| SEQ ID NO 51976 | GGAGTCACTTCTACTTCATT | TAG | chr18 | 31592019 | 31592038 | 31592022 | - |
| SEQ ID NO 51977 | TTTAGCGTGAATCTTAAATG | TAG | chr18 | 31592001 | 31592020 | 31592004 | - |
| SEQ ID NO 51978 | TTAGCGTGAATCTTAAATGT | AGG | chr18 | 31592000 | 31592019 | 31592003 | - |
| SEQ ID NO 51979 | GTGAATCTTAAATGTAGGAA | TGG | chr18 | 31591995 | 31592014 | 31591998 | - |
| SEQ ID NO 51980 | TGAATCTTAAATGTAGGAAT | GGG | chr18 | 31591994 | 31592013 | 31591997 | - |
| SEQ ID NO 51981 | AATGTAGGAATGGGATGTCA | CAG | chr18 | 31591985 | 31592004 | 31591988 | - |
| SEQ ID NO 51982 | TGTCACAGAAACACTCACCG | TAG | chr18 | 31591970 | 31591989 | 31591973 | - |
| SEQ ID NO 51983 | GTCACAGAAACACTCACCGT | AGG | chr18 | 31591969 | 31591988 | 31591972 | - |
| SEQ ID NO 51984 | TCACAGAAACACTCACCGTA | GGG | chr18 | 31591968 | 31591987 | 31591971 | - |
| SEQ ID NO 51985 | AGAAACACTCACCGTAGGGC | CAG | chr18 | 31591964 | 31591983 | 31591967 | - |
| SEQ ID NO 51986 | ACTCACCGTAGGGCCAGCCT | CAG | chr18 | 31591958 | 31591977 | 31591961 | - |
| SEQ ID NO 51987 | CCAGCCTCAGACACAAATAC | CAG | chr18 | 31591945 | 31591964 | 31591948 | - |
| SEQ ID NO 51988 | CTCAGACACAAATACCAGTC | CAG | chr18 | 31591940 | 31591959 | 31591943 | - |
| SEQ ID NO 51989 | GACACAAATACCAGTCCAGC | AAG | chr18 | 31591936 | 31591955 | 31591939 | - |
| SEQ ID NO 51990 | ACACAAATACCAGTCCAGCA | AGG | chr18 | 31591935 | 31591954 | 31591938 | - |
| SEQ ID NO 51991 | CAAATACCAGTCCAGCAAGG | CAG | chr18 | 31591932 | 31591951 | 31591935 | - |
| SEQ ID NO 51992 | AATACCAGTCCAGCAAGGCA | GAG | chr18 | 31591930 | 31591949 | 31591933 | - |
| SEQ ID NO 51993 | ATACCAGTCCAGCAAGGCAG | AGG | chr18 | 31591929 | 31591948 | 31591932 | - |
| SEQ ID NO 51994 | ACCAGTCCAGCAAGGCAGAG | GAG | chr18 | 31591927 | 31591946 | 31591930 | - |
| SEQ ID NO 51995 | CCAGTCCAGCAAGGCAGAGG | AGG | chr18 | 31591926 | 31591945 | 31591929 | - |
| SEQ ID NO 51996 | AGTCCAGCAAGGCAGAGGAG | GAG | chr18 | 31591924 | 31591943 | 31591927 | - |
| SEQ ID NO 51997 | CCAGCAAGGCAGAGGAGGAG | CAG | chr18 | 31591921 | 31591940 | 31591924 | - |
| SEQ ID NO 51998 | GCAGAGGAGGAGCAGACGAT | GAG | chr18 | 31591913 | 31591932 | 31591916 | - |

Figure 79 (Cont'd)

| | | | | | | | |
|---|---|---|---|---|---|---|---|
| SEQ ID NO 51999 | GAGGAGGAGCAGACGATGAG | AAG | chr18 | 31591910 | 31591929 | 31591913 | - |
| SEQ ID NO 52000 | CGATGAGAAGCCATCCTGCC | AAG | chr18 | 31591897 | 31591916 | 31591900 | - |
| SEQ ID NO 52001 | GAAGCCATCCTGCCAAGAAT | GAG | chr18 | 31591891 | 31591910 | 31591894 | - |
| SEQ ID NO 52002 | GCCATCCTGCCAAGAATGAG | TGG | chr18 | 31591888 | 31591907 | 31591891 | - |
| SEQ ID NO 52003 | GAATGAGTGGACTTCTGTGA | TGG | chr18 | 31591875 | 31591894 | 31591878 | - |
| SEQ ID NO 52004 | ACTTCTGTGATGGCTGCTCC | CAG | chr18 | 31591865 | 31591884 | 31591868 | - |
| SEQ ID NO 52005 | TGTGATGGCTGCTCCCAGCC | TGG | chr18 | 31591860 | 31591879 | 31591863 | - |
| SEQ ID NO 52006 | GTGATGGCTGCTCCCAGCCT | GGG | chr18 | 31591859 | 31591878 | 31591862 | - |
| SEQ ID NO 52007 | TGATGGCTGCTCCCAGCCTG | GGG | chr18 | 31591858 | 31591877 | 31591861 | - |
| SEQ ID NO 52008 | CTTTTATACTCACTTCTCCT | GAG | chr18 | 31591835 | 31591854 | 31591838 | - |
| SEQ ID NO 52009 | TATACTCACTTCTCCTGAGC | TAG | chr18 | 31591831 | 31591850 | 31591834 | - |
| SEQ ID NO 52010 | ATACTCACTTCTCCTGAGCT | AGG | chr18 | 31591830 | 31591849 | 31591833 | - |
| SEQ ID NO 52011 | GCTGATTCTGATTATTGACT | TAG | chr18 | 31591775 | 31591794 | 31591778 | - |

Figure 80

| # | Sequence | PAM | Chr | Start | End | Cuts 5' of | Str |
|---|---|---|---|---|---|---|---|
| SEQ ID NO 52012 | AGGTTTGCAGTCAGATTGGC | AGGGAT | chr18 | 31591795 | 31591814 | 31591811 | + |
| SEQ ID NO 52013 | AGCAGCCTAGCTCAGGAGAA | GTGAGT | chr18 | 31591822 | 31591841 | 31591838 | + |
| SEQ ID NO 52014 | AGAAGTCCACTCATTCTTGG | CAGGAT | chr18 | 31591879 | 31591898 | 31591895 | + |
| SEQ ID NO 52015 | TGTCTGAGGCTGGCCCTACG | GTGAGT | chr18 | 31591952 | 31591971 | 31591968 | + |
| SEQ ID NO 52016 | CCAGCTTTTATTACTAGGGC | AAGGGT | chr18 | 31592054 | 31592073 | 31592070 | + |
| SEQ ID NO 52017 | TAATTAATTCAAACTTCAAA | AAGAAT | chr18 | 31592101 | 31592120 | 31592117 | + |
| SEQ ID NO 52018 | TATTAAGGAAGCTGTTAATA | CTGAAT | chr18 | 31592255 | 31592274 | 31592271 | + |
| SEQ ID NO 52019 | CTAATTCTTAAATCCTCTAG | AAGAAT | chr18 | 31592418 | 31592437 | 31592434 | + |
| SEQ ID NO 52020 | GAATTAACTAATACTATAAA | ATGGGT | chr18 | 31592440 | 31592459 | 31592456 | + |
| SEQ ID NO 52021 | ACTAATACTATAAAATGGGT | CTGGAT | chr18 | 31592446 | 31592465 | 31592462 | + |
| SEQ ID NO 52022 | TTTTATAACAACTGGTAAGA | GGGAGT | chr18 | 31592487 | 31592506 | 31592503 | + |
| SEQ ID NO 52023 | ACAATTACGTCTGTGTTATA | CTGAGT | chr18 | 31592719 | 31592738 | 31592735 | + |
| SEQ ID NO 52024 | GACACTTACGTTCCTGATAA | TGGGAT | chr18 | 31592765 | 31592784 | 31592781 | + |
| SEQ ID NO 52025 | TCCAGATTTCTAATACCACA | AAGAAT | chr18 | 31592813 | 31592832 | 31592829 | + |
| SEQ ID NO 52026 | TCTCTACACCCAGGGCACCG | GTGAAT | chr18 | 31592883 | 31592902 | 31592899 | + |
| SEQ ID NO 52027 | CTTTGACCATCAGAGGACAC | TTGGAT | chr18 | 31592913 | 31592932 | 31592916 | - |
| SEQ ID NO 52028 | CACTTGGATTCACCGGTGCC | CTGGGT | chr18 | 31592896 | 31592915 | 31592899 | - |
| SEQ ID NO 52029 | GAGAAGTTAACAAAATTGAT | CAGAGT | chr18 | 31592855 | 31592874 | 31592858 | - |
| SEQ ID NO 52030 | AACAAAATTGATCAGAGTGA | AAGGAT | chr18 | 31592847 | 31592866 | 31592850 | - |
| SEQ ID NO 52031 | TTAGAAATCTGGAGCGAAAC | AAGAAT | chr18 | 31592806 | 31592825 | 31592809 | - |
| SEQ ID NO 52032 | GACGTAATTGTTTCCAAAGC | AAGAAT | chr18 | 31592710 | 31592729 | 31592713 | - |
| SEQ ID NO 52033 | CAGACACACTGCTATCAACC | AGGGAT | chr18 | 31592672 | 31592691 | 31592675 | - |
| SEQ ID NO 52034 | ATCAACCAGGGATGTGTATA | ATGAAT | chr18 | 31592659 | 31592678 | 31592662 | - |
| SEQ ID NO 52035 | GCTTGTTAAAAGTCTCCAT | TTGAGT | chr18 | 31592599 | 31592618 | 31592602 | - |
| SEQ ID NO 52036 | GTTAAAAGTCTCCATTTGAG | TGGAAT | chr18 | 31592594 | 31592613 | 31592597 | - |
| SEQ ID NO 52037 | AGTATTAGTTAATTCTTCTA | GAGGAT | chr18 | 31592435 | 31592454 | 31592438 | - |
| SEQ ID NO 52038 | TTAATTCTTCTAGAGGATTT | AAGAAT | chr18 | 31592427 | 31592446 | 31592430 | - |
| SEQ ID NO 52039 | TTAAGAATTAGATATCTGAC | TAGAAT | chr18 | 31592409 | 31592428 | 31592412 | - |
| SEQ ID NO 52040 | GATTAATCAATAAATACGTT | TTGAAT | chr18 | 31592361 | 31592380 | 31592364 | - |
| SEQ ID NO 52041 | GTTTGAATAACTATAGGGC | CAGAAT | chr18 | 31592344 | 31592363 | 31592347 | - |
| SEQ ID NO 52042 | CCCCCAAATACATTTTATGG | AGGGAT | chr18 | 31592299 | 31592318 | 31592302 | - |
| SEQ ID NO 52043 | AATGCACCAAAGCAATGAGG | TAGAAT | chr18 | 31592176 | 31592195 | 31592179 | - |
| SEQ ID NO 52044 | AAGCAATGAGGTAGAATGCT | CAGAGT | chr18 | 31592167 | 31592186 | 31592170 | - |
| SEQ ID NO 52045 | AACTTCATTCTTTTTGAAGT | TTGAAT | chr18 | 31592113 | 31592132 | 31592116 | - |
| SEQ ID NO 52046 | AATTATATTAAAAATAGATG | CTGGGT | chr18 | 31592086 | 31592105 | 31592089 | - |
| SEQ ID NO 52047 | AGCTGGTTGGCAAAGCTGGA | AGGAGT | chr18 | 31592040 | 31592059 | 31592043 | - |
| SEQ ID NO 52048 | TCACTTCTACTTCATTTAGC | GTGAAT | chr18 | 31592015 | 31592034 | 31592018 | - |
| SEQ ID NO 52049 | TTAGCGTGAATCTTAAATGT | AGGAAT | chr18 | 31592000 | 31592019 | 31592003 | - |
| SEQ ID NO 52050 | GTGAATCTTAAATGTAGGAA | TGGGAT | chr18 | 31591995 | 31592014 | 31591998 | - |
| SEQ ID NO 52051 | CGATGAGAAGCCATCCTGCC | AAGAAT | chr18 | 31591897 | 31591916 | 31591900 | - |
| SEQ ID NO 52052 | GAGAAGCCATCCTGCCAAGA | ATGAGT | chr18 | 31591893 | 31591912 | 31591896 | - |

Figure 81

| # | Sequence | PAM | Chr | Start | End | Cuts 5' of | Str |
|---|---|---|---|---|---|---|---|
| SEQ ID NO 52053 | ATAATTAATTCAAACTTCAA | AAAGAAT | chr18 | 31592100 | 31592119 | 31592116 | + |
| SEQ ID NO 52054 | TCTGTTTCCTCAGATAGATG | ATAGAAA | chr18 | 31592217 | 31592236 | 31592233 | + |
| SEQ ID NO 52055 | AAGCTGTTAATACTGAATTT | TCAGAAA | chr18 | 31592263 | 31592282 | 31592279 | + |
| SEQ ID NO 52056 | TCTAATTCTTAAATCCTCTA | GAAGAAT | chr18 | 31592417 | 31592436 | 31592433 | + |
| SEQ ID NO 52057 | TGATAGCAGTGTGTCTGGAG | GCAGAAA | chr18 | 31592675 | 31592694 | 31592691 | + |
| SEQ ID NO 52058 | CTCCAGATTTCTAATACCAC | AAAGAAT | chr18 | 31592812 | 31592831 | 31592828 | + |
| SEQ ID NO 52059 | CAATGTGGCCGTGCATGTGT | TCAGAAA | chr18 | 31592964 | 31592983 | 31592980 | + |
| SEQ ID NO 52060 | AGGATTTATTCTTTGTGGTA | TTAGAAA | chr18 | 31592826 | 31592845 | 31592829 | - |
| SEQ ID NO 52061 | ATTAGAAATCTGGAGCGAAA | CAAGAAT | chr18 | 31592807 | 31592826 | 31592810 | - |
| SEQ ID NO 52062 | AGACGTAATTGTTTCCAAAG | CAAGAAT | chr18 | 31592711 | 31592730 | 31592714 | - |
| SEQ ID NO 52063 | TGTGTATAATGAATTTTAAG | GGAGAAA | chr18 | 31592647 | 31592666 | 31592650 | - |
| SEQ ID NO 52064 | GTTAATTCTTCTAGAGGATT | TAAGAAT | chr18 | 31592428 | 31592447 | 31592431 | - |
| SEQ ID NO 52065 | TTTAAGAATTAGATATCTGA | CTAGAAT | chr18 | 31592410 | 31592429 | 31592413 | - |
| SEQ ID NO 52066 | CGTTTTGAATAACTATAGGG | CCAGAAT | chr18 | 31592345 | 31592364 | 31592348 | - |
| SEQ ID NO 52067 | TAATGCACCAAAGCAATGAG | GTAGAAT | chr18 | 31592177 | 31592196 | 31592180 | - |
| SEQ ID NO 52068 | AAATGTAGGAATGGGATGTC | ACAGAAA | chr18 | 31591986 | 31592005 | 31591989 | - |
| SEQ ID NO 52069 | ACGATGAGAAGCCATCCTGC | CAAGAAT | chr18 | 31591898 | 31591917 | 31591901 | - |

Figure 82

| # | Sequence | PAM | Chr | Start | End | Cuts 5' of | Str |
|---|---|---|---|---|---|---|---|
| SEQ ID NO 52070 | ATTCTGGCCCTATAGTTATT | CAAAAC | chr18 | 31592338 | 31592357 | 31592354 | + |
| SEQ ID NO 52071 | AACAACTAAAATGATCTCAG | GAAAAC | chr18 | 31592522 | 31592541 | 31592538 | + |

Figure 83

| # | Sequence | PAM | Chr | Start | End | Cuts 5' of | Str |
|---|---|---|---|---|---|---|---|
| SEQ ID NO 52072 | TAAGTCAATAATCAGAATCA | GCAGGTTT | chr18 | 31591773 | 31591792 | 31591789 | + |
| SEQ ID NO 52073 | TCAGAATCAGCAGGTTTGCA | GTCAGATT | chr18 | 31591784 | 31591803 | 31591800 | + |
| SEQ ID NO 52074 | AGTCCACTCATTCTTGGCAG | GATGGCTT | chr18 | 31591882 | 31591901 | 31591898 | + |
| SEQ ID NO 52075 | TCTGAGGCTGGCCCTACGGT | GAGTGTTT | chr18 | 31591954 | 31591973 | 31591970 | + |
| SEQ ID NO 52076 | GTGACATCCCATTCCTACAT | TTAAGATT | chr18 | 31591984 | 31592003 | 31592000 | + |
| SEQ ID NO 52077 | ATGAAGTAGAAGTGACTCCT | TCCAGCTT | chr18 | 31592020 | 31592039 | 31592036 | + |
| SEQ ID NO 52078 | GACTCCTTCCAGCTTTGCCA | ACCAGCTT | chr18 | 31592033 | 31592052 | 31592049 | + |
| SEQ ID NO 52079 | TCAAAAGAATGAAGTTCCA | CTGAGCTT | chr18 | 31592116 | 31592135 | 31592132 | + |
| SEQ ID NO 52080 | GAACTCTGAGCATTCTACCT | CATTGCTT | chr18 | 31592159 | 31592178 | 31592175 | + |
| SEQ ID NO 52081 | TACCTCATTGCTTTGGTGCA | TTAGGTTT | chr18 | 31592174 | 31592193 | 31592190 | + |
| SEQ ID NO 52082 | AGGTTTGTAATATCTGGTAC | CTCTGTTT | chr18 | 31592196 | 31592215 | 31592212 | + |
| SEQ ID NO 52083 | GTATTTGGGGACAAACTGC | AGGAGATT | chr18 | 31592308 | 31592327 | 31592324 | + |
| SEQ ID NO 52084 | ATAGTTATTCAAAACGTATT | TATTGATT | chr18 | 31592349 | 31592368 | 31592365 | + |
| SEQ ID NO 52085 | TATTTATTGATTAATCTTTA | AAAGGCTT | chr18 | 31592365 | 31592384 | 31592381 | + |
| SEQ ID NO 52086 | ACTAAAATGATCTCAGGAAA | ACCTGTTT | chr18 | 31592526 | 31592545 | 31592542 | + |
| SEQ ID NO 52087 | TGTCTGGAGGCAGAAACCAT | TCTTGCTT | chr18 | 31592686 | 31592705 | 31592702 | + |
| SEQ ID NO 52088 | TAATGGGATCAGTGTGTAAT | TCTTGTTT | chr18 | 31592782 | 31592801 | 31592798 | + |
| SEQ ID NO 52089 | GTGTGTAATTCTTGTTTCGC | TCCAGATT | chr18 | 31592793 | 31592812 | 31592809 | + |
| SEQ ID NO 52090 | ACTTGACCATCAGAGGACA | CTTGGATT | chr18 | 31592914 | 31592933 | 31592917 | - |
| SEQ ID NO 52091 | TAACAAATTGATCAGAGTG | AAAGGATT | chr18 | 31592848 | 31592867 | 31592851 | - |
| SEQ ID NO 52092 | AACGTAAGTGTCGACAATTA | ATGAGCTT | chr18 | 31592757 | 31592776 | 31592760 | - |
| SEQ ID NO 52093 | ACTCAGTATAACACAGACGT | AATTGTTT | chr18 | 31592725 | 31592744 | 31592728 | - |
| SEQ ID NO 52094 | GTAATTGTTTCCAAAGCAAG | AATGGTTT | chr18 | 31592707 | 31592726 | 31592710 | - |
| SEQ ID NO 52095 | AAAATAGGTCCCCTGAGAAC | AGTTGCTT | chr18 | 31592623 | 31592642 | 31592626 | - |
| SEQ ID NO 52096 | TGTACCATACATAGGGCCAA | ACAGGTTT | chr18 | 31592552 | 31592571 | 31592555 | - |
| SEQ ID NO 52097 | TAGTATTAGTTAATTCTTCT | AGAGGATT | chr18 | 31592436 | 31592455 | 31592439 | - |
| SEQ ID NO 52098 | ATATTGTTCACTAAGCCTTT | TAAAGATT | chr18 | 31592385 | 31592404 | 31592388 | - |
| SEQ ID NO 52099 | TTTTAAAGATTAATCAATAA | ATACGTTT | chr18 | 31592368 | 31592387 | 31592371 | - |
| SEQ ID NO 52100 | AGGGCCAGAATATAATCTCC | TGCAGTTT | chr18 | 31592329 | 31592348 | 31592332 | - |
| SEQ ID NO 52101 | TTTTCTGAAAATTCAGTATT | AACAGCTT | chr18 | 31592271 | 31592290 | 31592274 | - |
| SEQ ID NO 52102 | CAGTGGAACTTCATTCTTTT | TGAAGTTT | chr18 | 31592119 | 31592138 | 31592122 | - |
| SEQ ID NO 52103 | TGTGATGGCTGCTCCCAGCC | TGGGGCTT | chr18 | 31591860 | 31591879 | 31591863 | - |
| SEQ ID NO 52104 | TACTCACTTCTCCTGAGCTA | GGCTGCTT | chr18 | 31591829 | 31591848 | 31591832 | - |
| SEQ ID NO 52105 | TGCCAATCTGACTGCAAACC | TGCTGATT | chr18 | 31591796 | 31591815 | 31591799 | - |
| SEQ ID NO 52106 | TCTGACTGCAAACCTGCTGA | TTCTGATT | chr18 | 31591790 | 31591809 | 31591793 | - |

Figure 84

| # | Sequence | PAM | Chr | Start | End | Cut site 1 (5' of) | Cut site 2 (5' of) | Str |
|---|---|---|---|---|---|---|---|---|
| SEQ ID NO 52107 | ACTAAGTCAATAATCAGAATCA | TTG | chr18 | 31591771 | 31591792 | 31591788 | 31591793 | + |
| SEQ ID NO 52108 | AGTCAATAATCAGAATCAGCAG | CTA | chr18 | 31591775 | 31591796 | 31591792 | 31591797 | + |
| SEQ ID NO 52109 | GCAGTCAGATTGGCAGGGATAA | TTT | chr18 | 31591801 | 31591822 | 31591818 | 31591823 | + |
| SEQ ID NO 52110 | CAGTCAGATTGGCAGGGATAAG | TTG | chr18 | 31591802 | 31591823 | 31591819 | 31591824 | + |
| SEQ ID NO 52111 | GCAGGGATAAGCAGCCTAGCTC | TTG | chr18 | 31591813 | 31591834 | 31591830 | 31591835 | + |
| SEQ ID NO 52112 | GCTCAGGAGAAGTGAGTATAAA | CTA | chr18 | 31591831 | 31591852 | 31591848 | 31591853 | + |
| SEQ ID NO 52113 | AGGAGAAGTGAGTATAAAAGCC | CTC | chr18 | 31591835 | 31591856 | 31591852 | 31591857 | + |
| SEQ ID NO 52114 | GGAGCAGCCATCACAGAAGTCC | CTG | chr18 | 31591865 | 31591886 | 31591882 | 31591887 | + |
| SEQ ID NO 52115 | ATTCTTGGCAGGATGGCTTCTC | CTC | chr18 | 31591891 | 31591912 | 31591908 | 31591913 | + |
| SEQ ID NO 52116 | TTGGCAGGATGGCTTCTCATCG | TTC | chr18 | 31591895 | 31591916 | 31591912 | 31591917 | + |
| SEQ ID NO 52117 | GGCAGGATGGCTTCTCATCGTC | CTT | chr18 | 31591897 | 31591918 | 31591914 | 31591919 | + |
| SEQ ID NO 52118 | GCAGGATGGCTTCTCATCGTCT | TTG | chr18 | 31591898 | 31591919 | 31591915 | 31591920 | + |
| SEQ ID NO 52119 | CTCATCGTCTGCTCCTCCTCTG | CTT | chr18 | 31591910 | 31591931 | 31591927 | 31591932 | + |
| SEQ ID NO 52120 | TCATCGTCTGCTCCTCCTCTGC | TTC | chr18 | 31591911 | 31591932 | 31591928 | 31591933 | + |
| SEQ ID NO 52121 | ATCGTCTGCTCCTCCTCTGCCT | CTC | chr18 | 31591913 | 31591934 | 31591930 | 31591935 | + |
| SEQ ID NO 52122 | CTCCTCCTCTGCCTTGCTGGAC | CTG | chr18 | 31591921 | 31591942 | 31591938 | 31591943 | + |
| SEQ ID NO 52123 | CTCCTCTGCCTTGCTGGACTGG | CTC | chr18 | 31591924 | 31591945 | 31591941 | 31591946 | + |
| SEQ ID NO 52124 | CTCTGCCTTGCTGGACTGGTAT | CTC | chr18 | 31591927 | 31591948 | 31591944 | 31591949 | + |
| SEQ ID NO 52125 | TGCCTTGCTGGACTGGTATTTG | CTC | chr18 | 31591930 | 31591951 | 31591947 | 31591952 | + |
| SEQ ID NO 52126 | CCTTGCTGGACTGGTATTTGTG | CTG | chr18 | 31591932 | 31591953 | 31591949 | 31591954 | + |
| SEQ ID NO 52127 | GCTGGACTGGTATTTGTGTCTG | CTT | chr18 | 31591936 | 31591957 | 31591953 | 31591958 | + |
| SEQ ID NO 52128 | CTGGACTGGTATTTGTGTCTGA | TTG | chr18 | 31591937 | 31591958 | 31591954 | 31591959 | + |
| SEQ ID NO 52129 | GACTGGTATTTGTGTCTGAGGC | CTG | chr18 | 31591940 | 31591961 | 31591957 | 31591962 | + |
| SEQ ID NO 52130 | GTATTTGTGTCTGAGGCTGGCC | CTG | chr18 | 31591945 | 31591966 | 31591962 | 31591967 | + |
| SEQ ID NO 52131 | GTGTCTGAGGCTGGCCCTACGG | TTT | chr18 | 31591951 | 31591972 | 31591968 | 31591973 | + |
| SEQ ID NO 52132 | TGTCTGAGGCTGGCCCTACGGT | TTG | chr18 | 31591952 | 31591973 | 31591969 | 31591974 | + |
| SEQ ID NO 52133 | AGGCTGGCCCTACGGTGAGTGT | CTG | chr18 | 31591958 | 31591979 | 31591975 | 31591980 | + |
| SEQ ID NO 52134 | GCCCTACGGTGAGTGTTTCTGT | CTG | chr18 | 31591964 | 31591985 | 31591981 | 31591986 | + |
| SEQ ID NO 52135 | CGGTGAGTGTTTCTGTGACATC | CTA | chr18 | 31591970 | 31591991 | 31591987 | 31591992 | + |
| SEQ ID NO 52136 | CTGTGACATCCCATTCCTACAT | TTT | chr18 | 31591982 | 31592003 | 31591999 | 31592004 | + |
| SEQ ID NO 52137 | TGTGACATCCCATTCCTACATT | TTC | chr18 | 31591983 | 31592004 | 31592000 | 31592005 | + |
| SEQ ID NO 52138 | TGACATCCCATTCCTACATTTA | CTG | chr18 | 31591985 | 31592006 | 31592002 | 31592007 | + |
| SEQ ID NO 52139 | CTACATTTAAGATTCACGCTAA | TTC | chr18 | 31591998 | 31592019 | 31592015 | 31592020 | + |
| SEQ ID NO 52140 | CATTTAAGATTCACGCTAAATG | CTA | chr18 | 31592001 | 31592022 | 31592018 | 31592023 | + |
| SEQ ID NO 52141 | AAGATTCACGCTAAATGAAGTA | TTT | chr18 | 31592006 | 31592027 | 31592023 | 31592028 | + |
| SEQ ID NO 52142 | AGATTCACGCTAAATGAAGTAG | TTA | chr18 | 31592007 | 31592028 | 31592024 | 31592029 | + |
| SEQ ID NO 52143 | ACGCTAAATGAAGTAGAAGTGA | TTC | chr18 | 31592013 | 31592034 | 31592030 | 31592035 | + |
| SEQ ID NO 52144 | AATGAAGTAGAAGTGACTCCTT | CTA | chr18 | 31592019 | 31592040 | 31592036 | 31592041 | + |
| SEQ ID NO 52145 | CTTCCAGCTTTGCCAACCAGCT | CTC | chr18 | 31592038 | 31592059 | 31592055 | 31592060 | + |
| SEQ ID NO 52146 | CCAGCTTTGCCAACCAGCTTTT | CTT | chr18 | 31592041 | 31592062 | 31592058 | 31592063 | + |
| SEQ ID NO 52147 | CAGCTTTGCCAACCAGCTTTTA | TTC | chr18 | 31592042 | 31592063 | 31592059 | 31592064 | + |
| SEQ ID NO 52148 | TGCCAACCAGCTTTTATTACTA | CTT | chr18 | 31592048 | 31592069 | 31592065 | 31592070 | + |
| SEQ ID NO 52149 | GCCAACCAGCTTTTATTACTAG | TTT | chr18 | 31592049 | 31592070 | 31592066 | 31592071 | + |
| SEQ ID NO 52150 | CCAACCAGCTTTTATTACTAGG | TTG | chr18 | 31592050 | 31592071 | 31592067 | 31592072 | + |
| SEQ ID NO 52151 | TTATTACTAGGGCAAGGGTACC | CTT | chr18 | 31592061 | 31592082 | 31592078 | 31592083 | + |
| SEQ ID NO 52152 | TATTACTAGGGCAAGGGTACCC | TTT | chr18 | 31592062 | 31592083 | 31592079 | 31592084 | + |
| SEQ ID NO 52153 | ATTACTAGGGCAAGGGTACCCA | TTT | chr18 | 31592063 | 31592084 | 31592080 | 31592085 | + |
| SEQ ID NO 52154 | TTACTAGGGCAAGGGTACCCAG | TTA | chr18 | 31592064 | 31592085 | 31592081 | 31592086 | + |
| SEQ ID NO 52155 | CTAGGGCAAGGGTACCCAGCAT | TTA | chr18 | 31592067 | 31592088 | 31592084 | 31592089 | + |
| SEQ ID NO 52156 | GGGCAAGGGTACCCAGCATCTA | CTA | chr18 | 31592070 | 31592091 | 31592087 | 31592092 | + |
| SEQ ID NO 52157 | TTTTTAATATAATTAATTCAAA | CTA | chr18 | 31592092 | 31592113 | 31592109 | 31592114 | + |
| SEQ ID NO 52158 | TTAATATAATTAATTCAAACTT | TTT | chr18 | 31592095 | 31592116 | 31592112 | 31592117 | + |
| SEQ ID NO 52159 | TAATATAATTAATTCAAACTTC | TTT | chr18 | 31592096 | 31592117 | 31592113 | 31592118 | + |
| SEQ ID NO 52160 | AATATAATTAATTCAAACTTCA | TTT | chr18 | 31592097 | 31592118 | 31592114 | 31592119 | + |
| SEQ ID NO 52161 | ATATAATTAATTCAAACTTCAA | TTA | chr18 | 31592098 | 31592119 | 31592115 | 31592120 | + |
| SEQ ID NO 52162 | ATTCAAACTTCAAAAAGAATGA | TTA | chr18 | 31592107 | 31592128 | 31592124 | 31592129 | + |
| SEQ ID NO 52163 | AAACTTCAAAAAGAATGAAGTT | TTC | chr18 | 31592111 | 31592132 | 31592128 | 31592133 | + |

Figure 84 (Cont'd)

| SEQ ID NO 52164 | CAAAAAGAATGAAGTTCCACTG | CTT | chr18 | 31592117 | 31592138 | 31592134 | 31592139 | + |
| SEQ ID NO 52165 | AAAAAGAATGAAGTTCCACTGA | TTC | chr18 | 31592118 | 31592139 | 31592135 | 31592140 | + |
| SEQ ID NO 52166 | CACTGAGCTTACTGAGCTGGGA | TTC | chr18 | 31592134 | 31592155 | 31592151 | 31592156 | + |
| SEQ ID NO 52167 | AGCTTACTGAGCTGGGACTTGA | CTG | chr18 | 31592139 | 31592160 | 31592156 | 31592161 | + |
| SEQ ID NO 52168 | ACTGAGCTGGGACTTGAACTCT | CTT | chr18 | 31592144 | 31592165 | 31592161 | 31592166 | + |
| SEQ ID NO 52169 | CTGAGCTGGGACTTGAACTCTG | TTA | chr18 | 31592145 | 31592166 | 31592162 | 31592167 | + |
| SEQ ID NO 52170 | AGCTGGGACTTGAACTCTGAGC | CTG | chr18 | 31592148 | 31592169 | 31592165 | 31592170 | + |
| SEQ ID NO 52171 | GGACTTGAACTCTGAGCATTCT | CTG | chr18 | 31592153 | 31592174 | 31592170 | 31592175 | + |
| SEQ ID NO 52172 | GAACTCTGAGCATTCTACCTCA | CTT | chr18 | 31592159 | 31592180 | 31592176 | 31592181 | + |
| SEQ ID NO 52173 | AACTCTGAGCATTCTACCTCAT | TTG | chr18 | 31592160 | 31592181 | 31592177 | 31592182 | + |
| SEQ ID NO 52174 | TGAGCATTCTACCTCATTGCTT | CTC | chr18 | 31592165 | 31592186 | 31592182 | 31592187 | + |
| SEQ ID NO 52175 | AGCATTCTACCTCATTGCTTTG | CTG | chr18 | 31592167 | 31592188 | 31592184 | 31592189 | + |
| SEQ ID NO 52176 | TACCTCATTGCTTTGGTGCATT | TTC | chr18 | 31592174 | 31592195 | 31592191 | 31592196 | + |
| SEQ ID NO 52177 | CCTCATTGCTTTGGTGCATTAG | CTA | chr18 | 31592176 | 31592197 | 31592193 | 31592198 | + |
| SEQ ID NO 52178 | ATTGCTTTGGTGCATTAGGTTT | CTC | chr18 | 31592180 | 31592201 | 31592197 | 31592202 | + |
| SEQ ID NO 52179 | CTTTGGTGCATTAGGTTTGTAA | TTG | chr18 | 31592184 | 31592205 | 31592201 | 31592206 | + |
| SEQ ID NO 52180 | TGGTGCATTAGGTTTGTAATAT | CTT | chr18 | 31592187 | 31592208 | 31592204 | 31592209 | + |
| SEQ ID NO 52181 | GGTGCATTAGGTTTGTAATATC | TTT | chr18 | 31592188 | 31592209 | 31592205 | 31592210 | + |
| SEQ ID NO 52182 | GTGCATTAGGTTTGTAATATCT | TTG | chr18 | 31592189 | 31592210 | 31592206 | 31592211 | + |
| SEQ ID NO 52183 | GGTTTGTAATATCTGGTACCTC | TTA | chr18 | 31592197 | 31592218 | 31592214 | 31592219 | + |
| SEQ ID NO 52184 | GTAATATCTGGTACCTCTGTTT | TTT | chr18 | 31592202 | 31592223 | 31592219 | 31592224 | + |
| SEQ ID NO 52185 | TAATATCTGGTACCTCTGTTTC | TTG | chr18 | 31592203 | 31592224 | 31592220 | 31592225 | + |
| SEQ ID NO 52186 | GTACCTCTGTTTCCTCAGATAG | CTG | chr18 | 31592212 | 31592233 | 31592229 | 31592234 | + |
| SEQ ID NO 52187 | TGTTTCCTCAGATAGATGATAG | CTC | chr18 | 31592219 | 31592240 | 31592236 | 31592241 | + |
| SEQ ID NO 52188 | TTTCCTCAGATAGATGATAGAA | CTG | chr18 | 31592221 | 31592242 | 31592238 | 31592243 | + |
| SEQ ID NO 52189 | CCTCAGATAGATGATAGAAATA | TTT | chr18 | 31592224 | 31592245 | 31592241 | 31592246 | + |
| SEQ ID NO 52190 | CTCAGATAGATGATAGAAATAA | TTC | chr18 | 31592225 | 31592246 | 31592242 | 31592247 | + |
| SEQ ID NO 52191 | AGATAGATGATAGAAATAAAGA | CTC | chr18 | 31592228 | 31592249 | 31592245 | 31592250 | + |
| SEQ ID NO 52192 | AGGAAGCTGTTAATACTGAATT | TTA | chr18 | 31592260 | 31592281 | 31592277 | 31592282 | + |
| SEQ ID NO 52193 | TTAATACTGAATTTTCAGAAAA | CTG | chr18 | 31592269 | 31592290 | 31592286 | 31592291 | + |
| SEQ ID NO 52194 | ATACTGAATTTTCAGAAAAGTA | TTA | chr18 | 31592272 | 31592293 | 31592289 | 31592294 | + |
| SEQ ID NO 52195 | AATTTTCAGAAAAGTATCCCTC | CTG | chr18 | 31592278 | 31592299 | 31592295 | 31592300 | + |
| SEQ ID NO 52196 | TCAGAAAAGTATCCCTCCATAA | TTT | chr18 | 31592283 | 31592304 | 31592300 | 31592305 | + |
| SEQ ID NO 52197 | CAGAAAAGTATCCCTCCATAAA | TTT | chr18 | 31592284 | 31592305 | 31592301 | 31592306 | + |
| SEQ ID NO 52198 | AGAAAAGTATCCCTCCATAAAA | TTC | chr18 | 31592285 | 31592306 | 31592302 | 31592307 | + |
| SEQ ID NO 52199 | CATAAAATGTATTTGGGGGACA | CTC | chr18 | 31592300 | 31592321 | 31592317 | 31592322 | + |
| SEQ ID NO 52200 | GGGGGACAAACTGCAGGAGATT | TTT | chr18 | 31592314 | 31592335 | 31592331 | 31592336 | + |
| SEQ ID NO 52201 | GGGGACAAACTGCAGGAGATTA | TTG | chr18 | 31592315 | 31592336 | 31592332 | 31592337 | + |
| SEQ ID NO 52202 | CAGGAGATTATATTCTGGCCCT | CTG | chr18 | 31592327 | 31592348 | 31592344 | 31592349 | + |
| SEQ ID NO 52203 | TATTCTGGCCCTATAGTTATTC | TTA | chr18 | 31592337 | 31592358 | 31592354 | 31592359 | + |
| SEQ ID NO 52204 | TGGCCCTATAGTTATTCAAAAC | TTC | chr18 | 31592342 | 31592363 | 31592359 | 31592364 | + |
| SEQ ID NO 52205 | GCCCTATAGTTATTCAAAACGT | CTG | chr18 | 31592344 | 31592365 | 31592361 | 31592366 | + |
| SEQ ID NO 52206 | TAGTTATTCAAAACGTATTTAT | CTA | chr18 | 31592350 | 31592371 | 31592367 | 31592372 | + |
| SEQ ID NO 52207 | TTCAAAACGTATTTATTGATTA | TTA | chr18 | 31592356 | 31592377 | 31592373 | 31592378 | + |
| SEQ ID NO 52208 | AAAACGTATTTATTGATTAATC | TTC | chr18 | 31592359 | 31592380 | 31592376 | 31592381 | + |
| SEQ ID NO 52209 | ATTGATTAATCTTTAAAAGGCT | TTT | chr18 | 31592370 | 31592391 | 31592387 | 31592392 | + |
| SEQ ID NO 52210 | TTGATTAATCTTTAAAAGGCTT | TTA | chr18 | 31592371 | 31592392 | 31592388 | 31592393 | + |
| SEQ ID NO 52211 | ATTAATCTTTAAAAGGCTTAGT | TTG | chr18 | 31592374 | 31592395 | 31592391 | 31592396 | + |
| SEQ ID NO 52212 | ATCTTTAAAAGGCTTAGTGAAC | TTA | chr18 | 31592378 | 31592399 | 31592395 | 31592400 | + |
| SEQ ID NO 52213 | TAAAAGGCTTAGTGAACAATAT | CTT | chr18 | 31592383 | 31592404 | 31592400 | 31592405 | + |
| SEQ ID NO 52214 | AAAAGGCTTAGTGAACAATATT | TTT | chr18 | 31592384 | 31592405 | 31592401 | 31592406 | + |
| SEQ ID NO 52215 | AAAGGCTTAGTGAACAATATTC | TTA | chr18 | 31592385 | 31592406 | 31592402 | 31592407 | + |
| SEQ ID NO 52216 | AGTGAACAATATTCTAGTCAGA | CTT | chr18 | 31592393 | 31592414 | 31592410 | 31592415 | + |
| SEQ ID NO 52217 | GTGAACAATATTCTAGTCAGAT | TTA | chr18 | 31592394 | 31592415 | 31592411 | 31592416 | + |
| SEQ ID NO 52218 | TAGTCAGATATCTAATTCTTAA | TTC | chr18 | 31592407 | 31592428 | 31592424 | 31592429 | + |
| SEQ ID NO 52219 | GTCAGATATCTAATTCTTAAAT | CTA | chr18 | 31592409 | 31592430 | 31592426 | 31592431 | + |
| SEQ ID NO 52220 | ATTCTTAAATCCTCTAGAAGAA | CTA | chr18 | 31592421 | 31592442 | 31592438 | 31592443 | + |
| SEQ ID NO 52221 | TTAAATCCTCTAGAAGAATTAA | TTC | chr18 | 31592425 | 31592446 | 31592442 | 31592447 | + |

Figure 84 (Cont'd)

| SEQ ID NO 52222 | AAATCCTCTAGAAGAATTAACT | CTT | chr18 | 31592427 | 31592448 | 31592444 | 31592449 | + |
| SEQ ID NO 52223 | AATCCTCTAGAAGAATTAACTA | TTA | chr18 | 31592428 | 31592449 | 31592445 | 31592450 | + |
| SEQ ID NO 52224 | TAGAAGAATTAACTAATACTAT | CTC | chr18 | 31592435 | 31592456 | 31592452 | 31592457 | + |
| SEQ ID NO 52225 | GAAGAATTAACTAATACTATAA | CTA | chr18 | 31592437 | 31592458 | 31592454 | 31592459 | + |
| SEQ ID NO 52226 | ACTAATACTATAAAATGGGTCT | TTA | chr18 | 31592446 | 31592467 | 31592463 | 31592468 | + |
| SEQ ID NO 52227 | ATACTATAAAATGGGTCTGGAT | CTA | chr18 | 31592450 | 31592471 | 31592467 | 31592472 | + |
| SEQ ID NO 52228 | TAAAATGGGTCTGGATGTAGTT | CTA | chr18 | 31592456 | 31592477 | 31592473 | 31592478 | + |
| SEQ ID NO 52229 | GATGTAGTTCTGACATTATTTT | CTG | chr18 | 31592469 | 31592490 | 31592486 | 31592491 | + |
| SEQ ID NO 52230 | TGACATTATTTTATAACAACTG | TTC | chr18 | 31592479 | 31592500 | 31592496 | 31592501 | + |
| SEQ ID NO 52231 | ACATTATTTTATAACAACTGGT | CTG | chr18 | 31592481 | 31592502 | 31592498 | 31592503 | + |
| SEQ ID NO 52232 | TTTTATAACAACTGGTAAGAGG | TTA | chr18 | 31592487 | 31592508 | 31592504 | 31592509 | + |
| SEQ ID NO 52233 | TATAACAACTGGTAAGAGGGAG | TTT | chr18 | 31592490 | 31592511 | 31592507 | 31592512 | + |
| SEQ ID NO 52234 | ATAACAACTGGTAAGAGGGAGT | TTT | chr18 | 31592491 | 31592512 | 31592508 | 31592513 | + |
| SEQ ID NO 52235 | TAACAACTGGTAAGAGGGAGTG | TTA | chr18 | 31592492 | 31592513 | 31592509 | 31592514 | + |
| SEQ ID NO 52236 | GTAAGAGGGAGTGACTATAGCA | CTG | chr18 | 31592501 | 31592522 | 31592518 | 31592523 | + |
| SEQ ID NO 52237 | TAGCAACAACTAAAATGATCTC | CTA | chr18 | 31592518 | 31592539 | 31592535 | 31592540 | + |
| SEQ ID NO 52238 | AAATGATCTCAGGAAAACCTGT | CTA | chr18 | 31592530 | 31592551 | 31592547 | 31592552 | + |
| SEQ ID NO 52239 | AGGAAAACCTGTTTGGCCCTAT | CTC | chr18 | 31592540 | 31592561 | 31592557 | 31592562 | + |
| SEQ ID NO 52240 | TTTGGCCCTATGTATGGTACAT | CTG | chr18 | 31592551 | 31592572 | 31592568 | 31592573 | + |
| SEQ ID NO 52241 | GGCCCTATGTATGGTACATTAC | TTT | chr18 | 31592554 | 31592575 | 31592571 | 31592576 | + |
| SEQ ID NO 52242 | GCCCTATGTATGGTACATTACA | TTG | chr18 | 31592555 | 31592576 | 31592572 | 31592577 | + |
| SEQ ID NO 52243 | TGTATGGTACATTACATCTTTT | CTA | chr18 | 31592561 | 31592582 | 31592578 | 31592583 | + |
| SEQ ID NO 52244 | CATCTTTTCAGTAATTCCACTC | TTA | chr18 | 31592575 | 31592596 | 31592592 | 31592597 | + |
| SEQ ID NO 52245 | TTCAGTAATTCCACTCAAATGG | CTT | chr18 | 31592581 | 31592602 | 31592598 | 31592603 | + |
| SEQ ID NO 52246 | TCAGTAATTCCACTCAAATGGA | TTT | chr18 | 31592582 | 31592603 | 31592599 | 31592604 | + |
| SEQ ID NO 52247 | CAGTAATTCCACTCAAATGGAG | TTT | chr18 | 31592583 | 31592604 | 31592600 | 31592605 | + |
| SEQ ID NO 52248 | AGTAATTCCACTCAAATGGAGA | TTC | chr18 | 31592584 | 31592605 | 31592601 | 31592606 | + |
| SEQ ID NO 52249 | CACTCAAATGGAGACTTTTAAC | TTC | chr18 | 31592592 | 31592613 | 31592609 | 31592614 | + |
| SEQ ID NO 52250 | AAATGGAGACTTTTAACAAAGC | CTC | chr18 | 31592597 | 31592618 | 31592614 | 31592619 | + |
| SEQ ID NO 52251 | TTAACAAAGCAACTGTTCTCAG | CTT | chr18 | 31592609 | 31592630 | 31592626 | 31592631 | + |
| SEQ ID NO 52252 | TAACAAAGCAACTGTTCTCAGG | TTT | chr18 | 31592610 | 31592631 | 31592627 | 31592632 | + |
| SEQ ID NO 52253 | AACAAAGCAACTGTTCTCAGGG | TTT | chr18 | 31592611 | 31592632 | 31592628 | 31592633 | + |
| SEQ ID NO 52254 | ACAAAGCAACTGTTCTCAGGGG | TTA | chr18 | 31592612 | 31592633 | 31592629 | 31592634 | + |
| SEQ ID NO 52255 | TTCTCAGGGGACCTATTTTCTC | CTG | chr18 | 31592624 | 31592645 | 31592641 | 31592646 | + |
| SEQ ID NO 52256 | TCAGGGGACCTATTTTCTCCCT | TTC | chr18 | 31592627 | 31592648 | 31592644 | 31592649 | + |
| SEQ ID NO 52257 | AGGGGACCTATTTTCTCCCTTA | CTC | chr18 | 31592629 | 31592650 | 31592646 | 31592651 | + |
| SEQ ID NO 52258 | TTTTCTCCCTTAAAATTCATTA | CTA | chr18 | 31592639 | 31592660 | 31592656 | 31592661 | + |
| SEQ ID NO 52259 | TCTCCCTTAAAATTCATTATAC | TTT | chr18 | 31592642 | 31592663 | 31592659 | 31592664 | + |
| SEQ ID NO 52260 | CTCCCTTAAAATTCATTATACA | TTT | chr18 | 31592643 | 31592664 | 31592660 | 31592665 | + |
| SEQ ID NO 52261 | TCCCTTAAAATTCATTATACAC | TTC | chr18 | 31592644 | 31592665 | 31592661 | 31592666 | + |
| SEQ ID NO 52262 | CCTTAAAATTCATTATACACAT | CTC | chr18 | 31592646 | 31592667 | 31592663 | 31592668 | + |
| SEQ ID NO 52263 | AAAATTCATTATACACATCCCT | CTT | chr18 | 31592650 | 31592671 | 31592667 | 31592672 | + |
| SEQ ID NO 52264 | AAATTCATTATACACATCCCTG | TTA | chr18 | 31592651 | 31592672 | 31592668 | 31592673 | + |
| SEQ ID NO 52265 | ATTATACACATCCCTGGTTGAT | TTC | chr18 | 31592657 | 31592678 | 31592674 | 31592679 | + |
| SEQ ID NO 52266 | TACACATCCCTGGTTGATAGCA | TTA | chr18 | 31592661 | 31592682 | 31592678 | 31592683 | + |
| SEQ ID NO 52267 | GTTGATAGCAGTGTGTCTGGAG | CTG | chr18 | 31592673 | 31592694 | 31592690 | 31592695 | + |
| SEQ ID NO 52268 | ATAGCAGTGTGTCTGGAGGCAG | TTG | chr18 | 31592677 | 31592698 | 31592694 | 31592699 | + |
| SEQ ID NO 52269 | GAGGCAGAAACCATTCTTGCTT | CTG | chr18 | 31592692 | 31592713 | 31592709 | 31592714 | + |
| SEQ ID NO 52270 | TTGCTTTGGAAACAATTACGTC | TTC | chr18 | 31592708 | 31592729 | 31592725 | 31592730 | + |
| SEQ ID NO 52271 | GCTTTGGAAACAATTACGTCTG | CTT | chr18 | 31592710 | 31592731 | 31592727 | 31592732 | + |
| SEQ ID NO 52272 | CTTTGGAAACAATTACGTCTGT | TTG | chr18 | 31592711 | 31592732 | 31592728 | 31592733 | + |
| SEQ ID NO 52273 | TGGAAACAATTACGTCTGTGTT | CTT | chr18 | 31592714 | 31592735 | 31592731 | 31592736 | + |
| SEQ ID NO 52274 | GGAAACAATTACGTCTGTGTTA | TTT | chr18 | 31592715 | 31592736 | 31592732 | 31592737 | + |
| SEQ ID NO 52275 | GAAACAATTACGTCTGTGTTAT | TTG | chr18 | 31592716 | 31592737 | 31592733 | 31592738 | + |
| SEQ ID NO 52276 | CGTCTGTGTTATACTGAGTAGG | TTA | chr18 | 31592726 | 31592747 | 31592743 | 31592748 | + |
| SEQ ID NO 52277 | TGTTATACTGAGTAGGGAAGCT | CTG | chr18 | 31592732 | 31592753 | 31592749 | 31592754 | + |
| SEQ ID NO 52278 | TACTGAGTAGGGAAGCTCATTA | TTA | chr18 | 31592737 | 31592758 | 31592754 | 31592759 | + |
| SEQ ID NO 52279 | AGTAGGGAAGCTCATTAATTGT | CTG | chr18 | 31592742 | 31592763 | 31592759 | 31592764 | + |

Figure 84 (Cont'd)

| | | | | | | | | |
|---|---|---|---|---|---|---|---|---|
| SEQ ID NO 52280 | ATTAATTGTCGACACTTACGTT | CTC | chr18 | 31592755 | 31592776 | 31592772 | 31592777 | + |
| SEQ ID NO 52281 | ATTGTCGACACTTACGTTCCTG | TTA | chr18 | 31592759 | 31592780 | 31592776 | 31592781 | + |
| SEQ ID NO 52282 | TCGACACTTACGTTCCTGATAA | TTG | chr18 | 31592763 | 31592784 | 31592780 | 31592785 | + |
| SEQ ID NO 52283 | ACGTTCCTGATAATGGGATCAG | CTT | chr18 | 31592772 | 31592793 | 31592789 | 31592794 | + |
| SEQ ID NO 52284 | CGTTCCTGATAATGGGATCAGT | TTA | chr18 | 31592773 | 31592794 | 31592790 | 31592795 | + |
| SEQ ID NO 52285 | CTGATAATGGGATCAGTGTGTA | TTC | chr18 | 31592778 | 31592799 | 31592795 | 31592800 | + |
| SEQ ID NO 52286 | ATAATGGGATCAGTGTGTAATT | CTG | chr18 | 31592781 | 31592802 | 31592798 | 31592803 | + |
| SEQ ID NO 52287 | TTGTTTCGCTCCAGATTTCTAA | TTC | chr18 | 31592804 | 31592825 | 31592821 | 31592826 | + |
| SEQ ID NO 52288 | GTTTCGCTCCAGATTTCTAATA | CTT | chr18 | 31592806 | 31592827 | 31592823 | 31592828 | + |
| SEQ ID NO 52289 | TTTCGCTCCAGATTTCTAATAC | TTG | chr18 | 31592807 | 31592828 | 31592824 | 31592829 | + |
| SEQ ID NO 52290 | CGCTCCAGATTTCTAATACCAC | TTT | chr18 | 31592810 | 31592831 | 31592827 | 31592832 | + |
| SEQ ID NO 52291 | GCTCCAGATTTCTAATACCACA | TTC | chr18 | 31592811 | 31592832 | 31592828 | 31592833 | + |
| SEQ ID NO 52292 | CAGATTTCTAATACCACAAAGA | CTC | chr18 | 31592815 | 31592836 | 31592832 | 31592837 | + |
| SEQ ID NO 52293 | CTAATACCACAAAGAATAAATC | TTT | chr18 | 31592822 | 31592843 | 31592839 | 31592844 | + |
| SEQ ID NO 52294 | TAATACCACAAAGAATAAATCC | TTC | chr18 | 31592823 | 31592844 | 31592840 | 31592845 | + |
| SEQ ID NO 52295 | ATACCACAAAGAATAAATCCTT | CTA | chr18 | 31592825 | 31592846 | 31592842 | 31592847 | + |
| SEQ ID NO 52296 | TCACTCTGATCAATTTTGTTAA | CTT | chr18 | 31592847 | 31592868 | 31592864 | 31592869 | + |
| SEQ ID NO 52297 | CACTCTGATCAATTTTGTTAAC | TTT | chr18 | 31592848 | 31592869 | 31592865 | 31592870 | + |
| SEQ ID NO 52298 | ACTCTGATCAATTTTGTTAACT | TTC | chr18 | 31592849 | 31592870 | 31592866 | 31592871 | + |
| SEQ ID NO 52299 | TGATCAATTTTGTTAACTTCTC | CTC | chr18 | 31592853 | 31592874 | 31592870 | 31592875 | + |
| SEQ ID NO 52300 | ATCAATTTTGTTAACTTCTCAC | CTG | chr18 | 31592855 | 31592876 | 31592872 | 31592877 | + |
| SEQ ID NO 52301 | TGTTAACTTCTCACGTGTCTTC | TTT | chr18 | 31592863 | 31592884 | 31592880 | 31592885 | + |
| SEQ ID NO 52302 | GTTAACTTCTCACGTGTCTTCT | TTT | chr18 | 31592864 | 31592885 | 31592881 | 31592886 | + |
| SEQ ID NO 52303 | TTAACTTCTCACGTGTCTTCTC | TTG | chr18 | 31592865 | 31592886 | 31592882 | 31592887 | + |
| SEQ ID NO 52304 | ACTTCTCACGTGTCTTCTCTAC | TTA | chr18 | 31592868 | 31592889 | 31592885 | 31592890 | + |
| SEQ ID NO 52305 | CTCACGTGTCTTCTCTACACCC | CTT | chr18 | 31592872 | 31592893 | 31592889 | 31592894 | + |
| SEQ ID NO 52306 | TCACGTGTCTTCTCTACACCCA | TTC | chr18 | 31592873 | 31592894 | 31592890 | 31592895 | + |
| SEQ ID NO 52307 | ACGTGTCTTCTCTACACCCAGG | CTC | chr18 | 31592875 | 31592896 | 31592892 | 31592897 | + |
| SEQ ID NO 52308 | CTCTACACCCAGGGCACCGGTG | CTT | chr18 | 31592884 | 31592905 | 31592901 | 31592906 | + |
| SEQ ID NO 52309 | TCTACACCCAGGGCACCGGTGA | TTC | chr18 | 31592885 | 31592906 | 31592902 | 31592907 | + |
| SEQ ID NO 52310 | TACACCCAGGGCACCGGTGAAT | CTC | chr18 | 31592887 | 31592908 | 31592904 | 31592909 | + |
| SEQ ID NO 52311 | CACCCAGGGCACCGGTGAATCC | CTA | chr18 | 31592889 | 31592910 | 31592906 | 31592911 | + |
| SEQ ID NO 52312 | TGATGGTCAAAGTTCTAGATGC | CTC | chr18 | 31592921 | 31592942 | 31592938 | 31592943 | + |
| SEQ ID NO 52313 | ATGGTCAAAGTTCTAGATGCTG | CTG | chr18 | 31592923 | 31592944 | 31592940 | 31592945 | + |
| SEQ ID NO 52314 | TAGATGCTGTCCGAGGCAGTCC | TTC | chr18 | 31592936 | 31592957 | 31592953 | 31592958 | + |
| SEQ ID NO 52315 | GATGCTGTCCGAGGCAGTCCTG | CTA | chr18 | 31592938 | 31592959 | 31592955 | 31592960 | + |
| SEQ ID NO 52316 | TCCGAGGCAGTCCTGCCATCAA | CTG | chr18 | 31592945 | 31592966 | 31592962 | 31592967 | + |
| SEQ ID NO 52317 | CCATCAATGTGGCCGTGCATGT | CTG | chr18 | 31592960 | 31592981 | 31592977 | 31592982 | + |
| SEQ ID NO 52318 | AGAAAGGCTGCTGATGACACCT | TTC | chr18 | 31592986 | 31593007 | 31593003 | 31593008 | + |
| SEQ ID NO 52319 | CTGATGACACCTGGGAGCCATT | CTG | chr18 | 31592996 | 31593017 | 31593013 | 31593018 | + |
| SEQ ID NO 52320 | ATGACACCTGGGAGCCATTTGC | CTG | chr18 | 31592999 | 31593020 | 31593016 | 31593021 | + |
| SEQ ID NO 52321 | CCAGGTGTCATCAGCAGCCTTT | CTC | chr18 | 31592988 | 31593009 | 31592993 | 31592988 | - |
| SEQ ID NO 52322 | TCTGAACACATGCACGGCCACA | CTT | chr18 | 31592967 | 31592988 | 31592972 | 31592967 | - |
| SEQ ID NO 52323 | CTGAACACATGCACGGCCACAT | TTT | chr18 | 31592966 | 31592987 | 31592971 | 31592966 | - |
| SEQ ID NO 52324 | TGAACACATGCACGGCCACATT | TTC | chr18 | 31592965 | 31592986 | 31592970 | 31592965 | - |
| SEQ ID NO 52325 | AACACATGCACGGCCACATTGA | CTG | chr18 | 31592963 | 31592984 | 31592968 | 31592963 | - |
| SEQ ID NO 52326 | ATGGCAGGACTGCCTCGGACAG | TTG | chr18 | 31592942 | 31592963 | 31592947 | 31592942 | - |
| SEQ ID NO 52327 | CCTCGGACAGCATCTAGAACTT | CTG | chr18 | 31592930 | 31592951 | 31592935 | 31592930 | - |
| SEQ ID NO 52328 | GGACAGCATCTAGAACTTTGAC | CTC | chr18 | 31592926 | 31592947 | 31592931 | 31592926 | - |
| SEQ ID NO 52329 | GAACTTTGACCATCAGAGGACA | CTA | chr18 | 31592914 | 31592935 | 31592919 | 31592914 | - |
| SEQ ID NO 52330 | TGACCATCAGAGGACACTTGGA | CTT | chr18 | 31592908 | 31592929 | 31592913 | 31592908 | - |
| SEQ ID NO 52331 | GACCATCAGAGGACACTTGGAT | TTT | chr18 | 31592907 | 31592928 | 31592912 | 31592907 | - |
| SEQ ID NO 52332 | ACCATCAGAGGACACTTGGATT | TTG | chr18 | 31592906 | 31592927 | 31592911 | 31592906 | - |
| SEQ ID NO 52333 | GGATTCACCGGTGCCCTGGGTG | CTT | chr18 | 31592889 | 31592910 | 31592894 | 31592889 | - |
| SEQ ID NO 52334 | GATTCACCGGTGCCCTGGGTGT | TTG | chr18 | 31592888 | 31592909 | 31592893 | 31592888 | - |
| SEQ ID NO 52335 | ACCGGTGCCCTGGGTGTAGAGA | TTC | chr18 | 31592883 | 31592904 | 31592888 | 31592883 | - |
| SEQ ID NO 52336 | GGTGTAGAGAAGACACGTGAGA | CTG | chr18 | 31592871 | 31592892 | 31592876 | 31592871 | - |
| SEQ ID NO 52337 | ACAAAATTGATCAGAGTGAAAG | TTA | chr18 | 31592844 | 31592865 | 31592849 | 31592844 | - |

Figure 84 (Cont'd)

| | | | | | | | | |
|---|---|---|---|---|---|---|---|---|
| SEQ ID NO 52338 | ATCAGAGTGAAAGGATTTATTC | TTG | chr18 | 31592835 | 31592856 | 31592840 | 31592835 | - |
| SEQ ID NO 52339 | ATTCTTTGTGGTATTAGAAATC | TTT | chr18 | 31592817 | 31592838 | 31592822 | 31592817 | - |
| SEQ ID NO 52340 | TTCTTTGTGGTATTAGAAATCT | TTA | chr18 | 31592816 | 31592837 | 31592821 | 31592816 | - |
| SEQ ID NO 52341 | TTTGTGGTATTAGAAATCTGGA | TTC | chr18 | 31592813 | 31592834 | 31592818 | 31592813 | - |
| SEQ ID NO 52342 | TGTGGTATTAGAAATCTGGAGC | CTT | chr18 | 31592811 | 31592832 | 31592816 | 31592811 | - |
| SEQ ID NO 52343 | GTGGTATTAGAAATCTGGAGCG | TTT | chr18 | 31592810 | 31592831 | 31592815 | 31592810 | - |
| SEQ ID NO 52344 | TGGTATTAGAAATCTGGAGCGA | TTG | chr18 | 31592809 | 31592830 | 31592814 | 31592809 | - |
| SEQ ID NO 52345 | GAAATCTGGAGCGAAACAAGAA | TTA | chr18 | 31592801 | 31592822 | 31592806 | 31592801 | - |
| SEQ ID NO 52346 | GAGCGAAACAAGAATTACACAC | CTG | chr18 | 31592793 | 31592814 | 31592798 | 31592793 | - |
| SEQ ID NO 52347 | CACACTGATCCCATTATCAGGA | TTA | chr18 | 31592776 | 31592797 | 31592781 | 31592776 | - |
| SEQ ID NO 52348 | ATCCCATTATCAGGAACGTAAG | CTG | chr18 | 31592769 | 31592790 | 31592774 | 31592769 | - |
| SEQ ID NO 52349 | TCAGGAACGTAAGTGTCGACAA | TTA | chr18 | 31592760 | 31592781 | 31592765 | 31592760 | - |
| SEQ ID NO 52350 | ATGAGCTTCCCTACTCAGTATA | TTA | chr18 | 31592735 | 31592756 | 31592740 | 31592735 | - |
| SEQ ID NO 52351 | CCCTACTCAGTATAACACAGAC | CTT | chr18 | 31592727 | 31592748 | 31592732 | 31592727 | - |
| SEQ ID NO 52352 | CCTACTCAGTATAACACAGACG | TTC | chr18 | 31592726 | 31592747 | 31592731 | 31592726 | - |
| SEQ ID NO 52353 | CTCAGTATAACACAGACGTAAT | CTA | chr18 | 31592722 | 31592743 | 31592727 | 31592722 | - |
| SEQ ID NO 52354 | AGTATAACACAGACGTAATTGT | CTC | chr18 | 31592719 | 31592740 | 31592724 | 31592719 | - |
| SEQ ID NO 52355 | TTTCCAAAGCAAGAATGGTTTC | TTG | chr18 | 31592698 | 31592719 | 31592703 | 31592698 | - |
| SEQ ID NO 52356 | CCAAAGCAAGAATGGTTTCTGC | TTT | chr18 | 31592695 | 31592716 | 31592700 | 31592695 | - |
| SEQ ID NO 52357 | CAAAGCAAGAATGGTTTCTGCC | TTC | chr18 | 31592694 | 31592715 | 31592699 | 31592694 | - |
| SEQ ID NO 52358 | CTGCCTCCAGACACACTGCTAT | TTT | chr18 | 31592677 | 31592698 | 31592682 | 31592677 | - |
| SEQ ID NO 52359 | TGCCTCCAGACACACTGCTATC | TTC | chr18 | 31592676 | 31592697 | 31592681 | 31592676 | - |
| SEQ ID NO 52360 | CCTCCAGACACACTGCTATCAA | CTG | chr18 | 31592674 | 31592695 | 31592679 | 31592674 | - |
| SEQ ID NO 52361 | CAGACACACTGCTATCAACCAG | CTC | chr18 | 31592670 | 31592691 | 31592675 | 31592670 | - |
| SEQ ID NO 52362 | CTATCAACCAGGGATGTGTATA | CTG | chr18 | 31592659 | 31592680 | 31592664 | 31592659 | - |
| SEQ ID NO 52363 | TCAACCAGGGATGTGTATAATG | CTA | chr18 | 31592656 | 31592677 | 31592661 | 31592656 | - |
| SEQ ID NO 52364 | TAAGGGAGAAAATAGGTCCCCT | TTT | chr18 | 31592629 | 31592650 | 31592634 | 31592629 | - |
| SEQ ID NO 52365 | AAGGGAGAAAATAGGTCCCCTG | TTT | chr18 | 31592628 | 31592649 | 31592633 | 31592628 | - |
| SEQ ID NO 52366 | AGGGAGAAAATAGGTCCCCTGA | TTA | chr18 | 31592627 | 31592648 | 31592632 | 31592627 | - |
| SEQ ID NO 52367 | AGAACAGTTGCTTTGTTAAAAG | CTG | chr18 | 31592606 | 31592627 | 31592611 | 31592606 | - |
| SEQ ID NO 52368 | CTTTGTTAAAAGTCTCCATTTG | TTG | chr18 | 31592596 | 31592617 | 31592601 | 31592596 | - |
| SEQ ID NO 52369 | TGTTAAAAGTCTCCATTTGAGT | CTT | chr18 | 31592593 | 31592614 | 31592598 | 31592593 | - |
| SEQ ID NO 52370 | GTTAAAAGTCTCCATTTGAGTG | TTT | chr18 | 31592592 | 31592613 | 31592597 | 31592592 | - |
| SEQ ID NO 52371 | TTAAAAGTCTCCATTTGAGTGG | TTG | chr18 | 31592591 | 31592612 | 31592596 | 31592591 | - |
| SEQ ID NO 52372 | AAAGTCTCCATTTGAGTGGAAT | TTA | chr18 | 31592588 | 31592609 | 31592593 | 31592588 | - |
| SEQ ID NO 52373 | CATTTGAGTGGAATTACTGAAA | CTC | chr18 | 31592580 | 31592601 | 31592585 | 31592580 | - |
| SEQ ID NO 52374 | GAGTGGAATTACTGAAAAGATG | TTT | chr18 | 31592575 | 31592596 | 31592580 | 31592575 | - |
| SEQ ID NO 52375 | AGTGGAATTACTGAAAAGATGT | TTG | chr18 | 31592574 | 31592595 | 31592579 | 31592574 | - |
| SEQ ID NO 52376 | CTGAAAAGATGTAATGTACCAT | TTA | chr18 | 31592564 | 31592585 | 31592569 | 31592564 | - |
| SEQ ID NO 52377 | AAAAGATGTAATGTACCATACA | CTG | chr18 | 31592561 | 31592582 | 31592566 | 31592561 | - |
| SEQ ID NO 52378 | TCCTGAGATCATTTTAGTTGTT | TTT | chr18 | 31592522 | 31592543 | 31592527 | 31592522 | - |
| SEQ ID NO 52379 | CCTGAGATCATTTTAGTTGTTG | TTT | chr18 | 31592521 | 31592542 | 31592526 | 31592521 | - |
| SEQ ID NO 52380 | CTGAGATCATTTTAGTTGTTGC | TTC | chr18 | 31592520 | 31592541 | 31592525 | 31592520 | - |
| SEQ ID NO 52381 | AGATCATTTTAGTTGTTGCTAT | CTG | chr18 | 31592517 | 31592538 | 31592522 | 31592517 | - |
| SEQ ID NO 52382 | TAGTTGTTGCTATAGTCACTCC | TTT | chr18 | 31592508 | 31592529 | 31592513 | 31592508 | - |
| SEQ ID NO 52383 | AGTTGTTGCTATAGTCACTCCC | TTT | chr18 | 31592507 | 31592528 | 31592512 | 31592507 | - |
| SEQ ID NO 52384 | GTTGTTGCTATAGTCACTCCCT | TTA | chr18 | 31592506 | 31592527 | 31592511 | 31592506 | - |
| SEQ ID NO 52385 | TTGCTATAGTCACTCCCTCTTA | TTG | chr18 | 31592502 | 31592523 | 31592507 | 31592502 | - |
| SEQ ID NO 52386 | CTATAGTCACTCCCTCTTACCA | TTG | chr18 | 31592499 | 31592520 | 31592504 | 31592499 | - |
| SEQ ID NO 52387 | TAGTCACTCCCTCTTACCAGTT | CTA | chr18 | 31592496 | 31592517 | 31592501 | 31592496 | - |
| SEQ ID NO 52388 | CCTCTTACCAGTTGTTATAAAA | CTC | chr18 | 31592487 | 31592508 | 31592492 | 31592487 | - |
| SEQ ID NO 52389 | TTACCAGTTGTTATAAAATAAT | CTC | chr18 | 31592483 | 31592504 | 31592488 | 31592483 | - |
| SEQ ID NO 52390 | ACCAGTTGTTATAAAATAATGT | CTT | chr18 | 31592481 | 31592502 | 31592486 | 31592481 | - |
| SEQ ID NO 52391 | CCAGTTGTTATAAAATAATGTC | TTA | chr18 | 31592480 | 31592501 | 31592485 | 31592480 | - |
| SEQ ID NO 52392 | TTATAAAATAATGTCAGAACTA | TTG | chr18 | 31592473 | 31592494 | 31592478 | 31592473 | - |
| SEQ ID NO 52393 | TAAAATAATGTCAGAACTACAT | TTA | chr18 | 31592470 | 31592491 | 31592475 | 31592470 | - |
| SEQ ID NO 52394 | CATCCAGACCCATTTTATAGTA | CTA | chr18 | 31592451 | 31592472 | 31592456 | 31592451 | - |
| SEQ ID NO 52395 | TATAGTATTAGTTAATTCTTCT | TTT | chr18 | 31592436 | 31592457 | 31592441 | 31592436 | - |

Figure 84 (Cont'd)

| SEQ ID NO 52396 | ATAGTATTAGTTAATTCTTCTA | TTT | chr18 | 31592435 | 31592456 | 31592440 | 31592435 | - |
|---|---|---|---|---|---|---|---|---|
| SEQ ID NO 52397 | TAGTATTAGTTAATTCTTCTAG | TTA | chr18 | 31592434 | 31592455 | 31592439 | 31592434 | - |
| SEQ ID NO 52398 | GTTAATTCTTCTAGAGGATTTA | TTA | chr18 | 31592426 | 31592447 | 31592431 | 31592426 | - |
| SEQ ID NO 52399 | ATTCTTCTAGAGGATTTAAGAA | TTA | chr18 | 31592422 | 31592443 | 31592427 | 31592422 | - |
| SEQ ID NO 52400 | TTCTAGAGGATTTAAGAATTAG | TTC | chr18 | 31592418 | 31592439 | 31592423 | 31592418 | - |
| SEQ ID NO 52401 | CTAGAGGATTTAAGAATTAGAT | CTT | chr18 | 31592416 | 31592437 | 31592421 | 31592416 | - |
| SEQ ID NO 52402 | TAGAGGATTTAAGAATTAGATA | TTC | chr18 | 31592415 | 31592436 | 31592420 | 31592415 | - |
| SEQ ID NO 52403 | GAGGATTTAAGAATTAGATATC | CTA | chr18 | 31592413 | 31592434 | 31592418 | 31592413 | - |
| SEQ ID NO 52404 | AAGAATTAGATATCTGACTAGA | TTT | chr18 | 31592405 | 31592426 | 31592410 | 31592405 | - |
| SEQ ID NO 52405 | AGAATTAGATATCTGACTAGAA | TTA | chr18 | 31592404 | 31592425 | 31592409 | 31592404 | - |
| SEQ ID NO 52406 | GATATCTGACTAGAATATTGTT | TTA | chr18 | 31592397 | 31592418 | 31592402 | 31592397 | - |
| SEQ ID NO 52407 | ACTAGAATATTGTTCACTAAGC | CTG | chr18 | 31592389 | 31592410 | 31592394 | 31592389 | - |
| SEQ ID NO 52408 | GAATATTGTTCACTAAGCCTTT | CTA | chr18 | 31592385 | 31592406 | 31592390 | 31592385 | - |
| SEQ ID NO 52409 | TTCACTAAGCCTTTTAAAGATT | TTG | chr18 | 31592377 | 31592398 | 31592382 | 31592377 | - |
| SEQ ID NO 52410 | ACTAAGCCTTTTAAAGATTAAT | TTC | chr18 | 31592374 | 31592395 | 31592379 | 31592374 | - |
| SEQ ID NO 52411 | AGCCTTTTAAAGATTAATCAAT | CTA | chr18 | 31592370 | 31592391 | 31592375 | 31592370 | - |
| SEQ ID NO 52412 | TTAAAGATTAATCAATAAATAC | CTT | chr18 | 31592364 | 31592385 | 31592369 | 31592364 | - |
| SEQ ID NO 52413 | TAAAGATTAATCAATAAATACG | TTT | chr18 | 31592363 | 31592384 | 31592368 | 31592363 | - |
| SEQ ID NO 52414 | AAAGATTAATCAATAAATACGT | TTT | chr18 | 31592362 | 31592383 | 31592367 | 31592362 | - |
| SEQ ID NO 52415 | AAGATTAATCAATAAATACGTT | TTA | chr18 | 31592361 | 31592382 | 31592366 | 31592361 | - |
| SEQ ID NO 52416 | ATCAATAAATACGTTTTGAATA | TTA | chr18 | 31592354 | 31592375 | 31592359 | 31592354 | - |
| SEQ ID NO 52417 | TGAATAACTATAGGGCCAGAAT | TTT | chr18 | 31592338 | 31592359 | 31592343 | 31592338 | - |
| SEQ ID NO 52418 | GAATAACTATAGGGCCAGAATA | TTT | chr18 | 31592337 | 31592358 | 31592342 | 31592337 | - |
| SEQ ID NO 52419 | AATAACTATAGGGCCAGAATAT | TTG | chr18 | 31592336 | 31592357 | 31592341 | 31592336 | - |
| SEQ ID NO 52420 | TAGGGCCAGAATATAATCTCCT | CTA | chr18 | 31592328 | 31592349 | 31592333 | 31592328 | - |
| SEQ ID NO 52421 | CTGCAGTTTGTCCCCCAAATAC | CTC | chr18 | 31592308 | 31592329 | 31592313 | 31592308 | - |
| SEQ ID NO 52422 | CAGTTTGTCCCCCAAATACATT | CTG | chr18 | 31592305 | 31592326 | 31592310 | 31592305 | - |
| SEQ ID NO 52423 | GTCCCCCAAATACATTTTATGG | TTT | chr18 | 31592299 | 31592320 | 31592304 | 31592299 | - |
| SEQ ID NO 52424 | TCCCCCAAATACATTTTATGGA | TTG | chr18 | 31592298 | 31592319 | 31592303 | 31592298 | - |
| SEQ ID NO 52425 | TATGGAGGGATACTTTTCTGAA | TTT | chr18 | 31592282 | 31592303 | 31592287 | 31592282 | - |
| SEQ ID NO 52426 | ATGGAGGGATACTTTTCTGAAA | TTT | chr18 | 31592281 | 31592302 | 31592286 | 31592281 | - |
| SEQ ID NO 52427 | TGGAGGGATACTTTTCTGAAAA | TTA | chr18 | 31592280 | 31592301 | 31592285 | 31592280 | - |
| SEQ ID NO 52428 | TTCTGAAAATTCAGTATTAACA | CTT | chr18 | 31592267 | 31592288 | 31592272 | 31592267 | - |
| SEQ ID NO 52429 | TCTGAAAATTCAGTATTAACAG | TTT | chr18 | 31592266 | 31592287 | 31592271 | 31592266 | - |
| SEQ ID NO 52430 | CTGAAAATTCAGTATTAACAGC | TTT | chr18 | 31592265 | 31592286 | 31592270 | 31592265 | - |
| SEQ ID NO 52431 | TGAAAATTCAGTATTAACAGCT | TTC | chr18 | 31592264 | 31592285 | 31592269 | 31592264 | - |
| SEQ ID NO 52432 | AAAATTCAGTATTAACAGCTTC | CTG | chr18 | 31592262 | 31592283 | 31592267 | 31592262 | - |
| SEQ ID NO 52433 | AGTATTAACAGCTTCCTTAATA | TTC | chr18 | 31592255 | 31592276 | 31592260 | 31592255 | - |
| SEQ ID NO 52434 | ACAGCTTCCTTAATATCATATC | TTA | chr18 | 31592248 | 31592269 | 31592253 | 31592248 | - |
| SEQ ID NO 52435 | CCTTAATATCATATCTTTATTT | CTT | chr18 | 31592241 | 31592262 | 31592246 | 31592241 | - |
| SEQ ID NO 52436 | CTTAATATCATATCTTTATTTC | TTC | chr18 | 31592240 | 31592261 | 31592245 | 31592240 | - |
| SEQ ID NO 52437 | AATATCATATCTTTATTTCTAT | CTT | chr18 | 31592237 | 31592258 | 31592242 | 31592237 | - |
| SEQ ID NO 52438 | ATATCATATCTTTATTTCTATC | TTA | chr18 | 31592236 | 31592257 | 31592241 | 31592236 | - |
| SEQ ID NO 52439 | TATTTCTATCATCTATCTGAGG | CTT | chr18 | 31592224 | 31592245 | 31592229 | 31592224 | - |
| SEQ ID NO 52440 | ATTTCTATCATCTATCTGAGGA | TTT | chr18 | 31592223 | 31592244 | 31592228 | 31592223 | - |
| SEQ ID NO 52441 | TTTCTATCATCTATCTGAGGAA | TTA | chr18 | 31592222 | 31592243 | 31592227 | 31592222 | - |
| SEQ ID NO 52442 | CTATCATCTATCTGAGGAAACA | TTT | chr18 | 31592219 | 31592240 | 31592224 | 31592219 | - |
| SEQ ID NO 52443 | TATCATCTATCTGAGGAAACAG | TTC | chr18 | 31592218 | 31592239 | 31592223 | 31592218 | - |
| SEQ ID NO 52444 | TCATCTATCTGAGGAAACAGAG | CTA | chr18 | 31592216 | 31592237 | 31592221 | 31592216 | - |
| SEQ ID NO 52445 | TCTGAGGAAACAGAGGTACCAG | CTA | chr18 | 31592209 | 31592230 | 31592214 | 31592209 | - |
| SEQ ID NO 52446 | AGGAAACAGAGGTACCAGATAT | CTG | chr18 | 31592205 | 31592226 | 31592210 | 31592205 | - |
| SEQ ID NO 52447 | CAAACCTAATGCACCAAAGCAA | TTA | chr18 | 31592181 | 31592202 | 31592186 | 31592181 | - |
| SEQ ID NO 52448 | ATGCACCAAAGCAATGAGGTAG | CTA | chr18 | 31592173 | 31592194 | 31592178 | 31592173 | - |
| SEQ ID NO 52449 | AGAGTTCAAGTCCCAGCTCAGT | CTC | chr18 | 31592144 | 31592165 | 31592149 | 31592144 | - |
| SEQ ID NO 52450 | AAGTCCCAGCTCAGTAAGCTCA | TTC | chr18 | 31592137 | 31592158 | 31592142 | 31592137 | - |
| SEQ ID NO 52451 | AGTAAGCTCAGTGGAACTTCAT | CTC | chr18 | 31592125 | 31592146 | 31592130 | 31592125 | - |
| SEQ ID NO 52452 | AGTGGAACTTCATTCTTTTGA | CTC | chr18 | 31592116 | 31592137 | 31592121 | 31592116 | - |
| SEQ ID NO 52453 | CATTCTTTTTGAAGTTTGAATT | CTT | chr18 | 31592106 | 31592127 | 31592111 | 31592106 | - |

Figure 84 (Cont'd)

| SEQ ID NO | Sequence | Triplet | Chr | Start | End | Pos3 | Pos4 | - |
|---|---|---|---|---|---|---|---|---|
| SEQ ID NO 52454 | ATTCTTTTTGAAGTTTGAATTA | TTC | chr18 | 31592105 | 31592126 | 31592110 | 31592105 | - |
| SEQ ID NO 52455 | TTTTTGAAGTTTGAATTAATTA | TTC | chr18 | 31592101 | 31592122 | 31592106 | 31592101 | - |
| SEQ ID NO 52456 | TTTGAAGTTTGAATTAATTATA | CTT | chr18 | 31592099 | 31592120 | 31592104 | 31592099 | - |
| SEQ ID NO 52457 | TTGAAGTTTGAATTAATTATAT | TTT | chr18 | 31592098 | 31592119 | 31592103 | 31592098 | - |
| SEQ ID NO 52458 | TGAAGTTTGAATTAATTATATT | TTT | chr18 | 31592097 | 31592118 | 31592102 | 31592097 | - |
| SEQ ID NO 52459 | GAAGTTTGAATTAATTATATTA | TTT | chr18 | 31592096 | 31592117 | 31592101 | 31592096 | - |
| SEQ ID NO 52460 | AAGTTTGAATTAATTATATTAA | TTG | chr18 | 31592095 | 31592116 | 31592100 | 31592095 | - |
| SEQ ID NO 52461 | GAATTAATTATATTAAAAATAG | TTT | chr18 | 31592089 | 31592110 | 31592094 | 31592089 | - |
| SEQ ID NO 52462 | AATTAATTATATTAAAAATAGA | TTG | chr18 | 31592088 | 31592109 | 31592093 | 31592088 | - |
| SEQ ID NO 52463 | ATTATATTAAAAATAGATGCTG | TTA | chr18 | 31592083 | 31592104 | 31592088 | 31592083 | - |
| SEQ ID NO 52464 | TATTAAAAATAGATGCTGGGTA | TTA | chr18 | 31592079 | 31592100 | 31592084 | 31592079 | - |
| SEQ ID NO 52465 | AAAATAGATGCTGGGTACCCTT | TTA | chr18 | 31592074 | 31592095 | 31592079 | 31592074 | - |
| SEQ ID NO 52466 | GGTACCCTTGCCCTAGTAATAA | CTG | chr18 | 31592061 | 31592082 | 31592066 | 31592061 | - |
| SEQ ID NO 52467 | GCCCTAGTAATAAAAGCTGGTT | CTT | chr18 | 31592052 | 31592073 | 31592057 | 31592052 | - |
| SEQ ID NO 52468 | CCCTAGTAATAAAAGCTGGTTG | TTG | chr18 | 31592051 | 31592072 | 31592056 | 31592051 | - |
| SEQ ID NO 52469 | GTAATAAAAGCTGGTTGGCAAA | CTA | chr18 | 31592046 | 31592067 | 31592051 | 31592046 | - |
| SEQ ID NO 52470 | GTTGGCAAAGCTGGAAGGAGTC | CTG | chr18 | 31592033 | 31592054 | 31592038 | 31592033 | - |
| SEQ ID NO 52471 | GCAAAGCTGGAAGGAGTCACTT | TTG | chr18 | 31592029 | 31592050 | 31592034 | 31592029 | - |
| SEQ ID NO 52472 | GAAGGAGTCACTTCTACTTCAT | CTG | chr18 | 31592020 | 31592041 | 31592025 | 31592020 | - |
| SEQ ID NO 52473 | CTACTTCATTTAGCGTGAATCT | CTT | chr18 | 31592007 | 31592028 | 31592012 | 31592007 | - |
| SEQ ID NO 52474 | TACTTCATTTAGCGTGAATCTT | TTC | chr18 | 31592006 | 31592027 | 31592011 | 31592006 | - |
| SEQ ID NO 52475 | CTTCATTTAGCGTGAATCTTAA | CTA | chr18 | 31592004 | 31592025 | 31592009 | 31592004 | - |
| SEQ ID NO 52476 | CATTTAGCGTGAATCTTAAATG | CTT | chr18 | 31592001 | 31592022 | 31592006 | 31592001 | - |
| SEQ ID NO 52477 | ATTTAGCGTGAATCTTAAATGT | TTC | chr18 | 31592000 | 31592021 | 31592005 | 31592000 | - |
| SEQ ID NO 52478 | AGCGTGAATCTTAAATGTAGGA | TTT | chr18 | 31591996 | 31592017 | 31592001 | 31591996 | - |
| SEQ ID NO 52479 | GCGTGAATCTTAAATGTAGGAA | TTA | chr18 | 31591995 | 31592016 | 31592000 | 31591995 | - |
| SEQ ID NO 52480 | AAATGTAGGAATGGGATGTCAC | CTT | chr18 | 31591984 | 31592005 | 31591989 | 31591984 | - |
| SEQ ID NO 52481 | AATGTAGGAATGGGATGTCACA | TTA | chr18 | 31591983 | 31592004 | 31591988 | 31591983 | - |
| SEQ ID NO 52482 | ACCGTAGGGCCAGCCTCAGACA | CTC | chr18 | 31591952 | 31591973 | 31591957 | 31591952 | - |
| SEQ ID NO 52483 | AGACACAAATACCAGTCCAGCA | CTC | chr18 | 31591935 | 31591956 | 31591940 | 31591935 | - |
| SEQ ID NO 52484 | CCAAGAATGAGTGGACTTCTGT | CTG | chr18 | 31591877 | 31591898 | 31591882 | 31591877 | - |
| SEQ ID NO 52485 | CTGTGATGGCTGCTCCCAGCCT | CTT | chr18 | 31591859 | 31591880 | 31591864 | 31591859 | - |
| SEQ ID NO 52486 | TGTGATGGCTGCTCCCAGCCTG | TTC | chr18 | 31591858 | 31591879 | 31591863 | 31591858 | - |
| SEQ ID NO 52487 | TGATGGCTGCTCCCAGCCTGGG | CTG | chr18 | 31591856 | 31591877 | 31591861 | 31591856 | - |
| SEQ ID NO 52488 | CTCCCAGCCTGGGGCTTTTATA | CTG | chr18 | 31591847 | 31591868 | 31591852 | 31591847 | - |
| SEQ ID NO 52489 | CCAGCCTGGGGCTTTTATACTC | CTC | chr18 | 31591844 | 31591865 | 31591849 | 31591844 | - |
| SEQ ID NO 52490 | GGGCTTTTATACTCACTTCTCC | CTG | chr18 | 31591836 | 31591857 | 31591841 | 31591836 | - |
| SEQ ID NO 52491 | TTATACTCACTTCTCCTGAGCT | CTT | chr18 | 31591830 | 31591851 | 31591835 | 31591830 | - |
| SEQ ID NO 52492 | TATACTCACTTCTCCTGAGCTA | TTT | chr18 | 31591829 | 31591850 | 31591834 | 31591829 | - |
| SEQ ID NO 52493 | ATACTCACTTCTCCTGAGCTAG | TTT | chr18 | 31591828 | 31591849 | 31591833 | 31591828 | - |
| SEQ ID NO 52494 | TACTCACTTCTCCTGAGCTAGG | TTA | chr18 | 31591827 | 31591848 | 31591832 | 31591827 | - |
| SEQ ID NO 52495 | ACTTCTCCTGAGCTAGGCTGCT | CTC | chr18 | 31591822 | 31591843 | 31591827 | 31591822 | - |
| SEQ ID NO 52496 | CTCCTGAGCTAGGCTGCTTATC | CTT | chr18 | 31591818 | 31591839 | 31591823 | 31591818 | - |
| SEQ ID NO 52497 | TCCTGAGCTAGGCTGCTTATCC | TTC | chr18 | 31591817 | 31591838 | 31591822 | 31591817 | - |
| SEQ ID NO 52498 | CTGAGCTAGGCTGCTTATCCCT | CTC | chr18 | 31591815 | 31591836 | 31591820 | 31591815 | - |
| SEQ ID NO 52499 | AGCTAGGCTGCTTATCCCTGCC | CTG | chr18 | 31591812 | 31591833 | 31591817 | 31591812 | - |
| SEQ ID NO 52500 | GGCTGCTTATCCCTGCCAATCT | CTA | chr18 | 31591807 | 31591828 | 31591812 | 31591807 | - |
| SEQ ID NO 52501 | CTTATCCCTGCCAATCTGACTG | CTG | chr18 | 31591802 | 31591823 | 31591807 | 31591802 | - |
| SEQ ID NO 52502 | ATCCCTGCCAATCTGACTGCAA | CTT | chr18 | 31591799 | 31591820 | 31591804 | 31591799 | - |
| SEQ ID NO 52503 | TCCCTGCCAATCTGACTGCAAA | TTA | chr18 | 31591798 | 31591819 | 31591803 | 31591798 | - |
| SEQ ID NO 52504 | CCAATCTGACTGCAAACCTGCT | CTG | chr18 | 31591792 | 31591813 | 31591797 | 31591792 | - |
| SEQ ID NO 52505 | ACTGCAAACCTGCTGATTCTGA | CTG | chr18 | 31591784 | 31591805 | 31591789 | 31591784 | - |
| SEQ ID NO 52506 | CAAACCTGCTGATTCTGATTAT | CTG | chr18 | 31591780 | 31591801 | 31591785 | 31591780 | - |
| SEQ ID NO 52507 | CTGATTCTGATTATTGACTTAG | CTG | chr18 | 31591772 | 31591793 | 31591777 | 31591772 | - |
| SEQ ID NO 52508 | ATTCTGATTATTGACTTAGTCA | CTG | chr18 | 31591769 | 31591790 | 31591774 | 31591769 | - |

Figure 85

| # | Sequence | PAM | Chr | Start | End | Cuts 5' of | Str |
|---|---|---|---|---|---|---|---|
| SEQ ID NO 52509 | GGTTTGGTGGTGTGCGCCTG | TAG | chr17 | 42897805 | 42897824 | 42897821 | + |
| SEQ ID NO 52510 | GTTTGGTGGTGTGCGCCTGT | AGG | chr17 | 42897806 | 42897825 | 42897822 | + |
| SEQ ID NO 52511 | GTGGTGTGCGCCTGTAGGCC | CAG | chr17 | 42897811 | 42897830 | 42897827 | + |
| SEQ ID NO 52512 | CGCCTGTAGGCCCAGCTACC | CAG | chr17 | 42897819 | 42897838 | 42897835 | + |
| SEQ ID NO 52513 | CCTGTAGGCCCAGCTACCCA | GAG | chr17 | 42897821 | 42897840 | 42897837 | + |
| SEQ ID NO 52514 | CTGATGCAAAACGATCCCTT | AAG | chr17 | 42897845 | 42897864 | 42897861 | + |
| SEQ ID NO 52515 | GCAAAACGATCCCTTAAGCC | CAG | chr17 | 42897850 | 42897869 | 42897866 | + |
| SEQ ID NO 52516 | CAAAACGATCCCTTAAGCCC | AGG | chr17 | 42897851 | 42897870 | 42897867 | + |
| SEQ ID NO 52517 | AAACGATCCCTTAAGCCCAG | GAG | chr17 | 42897853 | 42897872 | 42897869 | + |
| SEQ ID NO 52518 | TCCCTTAAGCCCAGGAGACT | GAG | chr17 | 42897859 | 42897878 | 42897875 | + |
| SEQ ID NO 52519 | CCCTTAAGCCCAGGAGACTG | AGG | chr17 | 42897860 | 42897879 | 42897876 | + |
| SEQ ID NO 52520 | AGCCCAGGAGACTGAGGCTG | CAG | chr17 | 42897866 | 42897885 | 42897882 | + |
| SEQ ID NO 52521 | CAGGAGACTGAGGCTGCAGT | GAG | chr17 | 42897870 | 42897889 | 42897886 | + |
| SEQ ID NO 52522 | GAGGCTGCAGTGAGCTGTGA | TGG | chr17 | 42897879 | 42897898 | 42897895 | + |
| SEQ ID NO 52523 | GTGATGGTGCCACCGCACTC | CAG | chr17 | 42897895 | 42897914 | 42897911 | + |
| SEQ ID NO 52524 | GGTGCCACCGCACTCCAGCC | TGG | chr17 | 42897900 | 42897919 | 42897916 | + |
| SEQ ID NO 52525 | GTGCCACCGCACTCCAGCCT | GGG | chr17 | 42897901 | 42897920 | 42897917 | + |
| SEQ ID NO 52526 | CCGCACTCCAGCCTGGGTAA | CAG | chr17 | 42897907 | 42897926 | 42897923 | + |
| SEQ ID NO 52527 | GCACTCCAGCCTGGGTAACA | GAG | chr17 | 42897909 | 42897928 | 42897925 | + |
| SEQ ID NO 52528 | TCCAGCCTGGGTAACAGAGT | GAG | chr17 | 42897913 | 42897932 | 42897929 | + |
| SEQ ID NO 52529 | GAGACCCGTCTCAAATAAA | CAG | chr17 | 42897933 | 42897952 | 42897949 | + |
| SEQ ID NO 52530 | TCTCAAATAAACAGATAAAT | GAG | chr17 | 42897942 | 42897961 | 42897958 | + |
| SEQ ID NO 52531 | CAAATAAACAGATAAATGAG | TGG | chr17 | 42897945 | 42897964 | 42897961 | + |
| SEQ ID NO 52532 | CAGATAAATGAGTGGATTCT | CAG | chr17 | 42897953 | 42897972 | 42897969 | + |
| SEQ ID NO 52533 | TGGATTCTCAGCAAAACTTC | TAG | chr17 | 42897965 | 42897984 | 42897981 | + |
| SEQ ID NO 52534 | CACTCGCCTCATATATCCAC | AAG | chr17 | 42897989 | 42898008 | 42898005 | + |
| SEQ ID NO 52535 | CATATATCCACAAGACCTTT | GAG | chr17 | 42897998 | 42898017 | 42898014 | + |
| SEQ ID NO 52536 | ACAAGACCTTTGAGAATCCA | CGG | chr17 | 42898007 | 42898026 | 42898023 | + |
| SEQ ID NO 52537 | GAATCCACGGTGTCTCGATG | CAG | chr17 | 42898020 | 42898039 | 42898036 | + |
| SEQ ID NO 52538 | CCACGGTGTCTCGATGCAGT | CAG | chr17 | 42898024 | 42898043 | 42898040 | + |
| SEQ ID NO 52539 | GATGCAGTCAGCTTTCTAAC | AAG | chr17 | 42898036 | 42898055 | 42898052 | + |
| SEQ ID NO 52540 | CAGTCAGCTTTCTAACAAGC | TGG | chr17 | 42898040 | 42898059 | 42898056 | + |
| SEQ ID NO 52541 | AGTCAGCTTTCTAACAAGCT | GGG | chr17 | 42898041 | 42898060 | 42898057 | + |
| SEQ ID NO 52542 | GTCAGCTTTCTAACAAGCTG | GGG | chr17 | 42898042 | 42898061 | 42898058 | + |
| SEQ ID NO 52543 | GGGCCTCACCTGTTTTCCCA | CGG | chr17 | 42898062 | 42898081 | 42898078 | + |
| SEQ ID NO 52544 | TCCCACGGATAAAAACGTGC | TGG | chr17 | 42898077 | 42898096 | 42898093 | + |
| SEQ ID NO 52545 | CCACGGATAAAAACGTGCTG | GAG | chr17 | 42898079 | 42898098 | 42898095 | + |
| SEQ ID NO 52546 | CACGGATAAAAACGTGCTGG | AGG | chr17 | 42898080 | 42898099 | 42898096 | + |
| SEQ ID NO 52547 | GGATAAAAACGTGCTGGAGG | AAG | chr17 | 42898083 | 42898102 | 42898099 | + |
| SEQ ID NO 52548 | TAAAAACGTGCTGGAGGAAG | CAG | chr17 | 42898086 | 42898105 | 42898102 | + |
| SEQ ID NO 52549 | AACGTGCTGGAGGAAGCAGA | AAG | chr17 | 42898090 | 42898109 | 42898106 | + |
| SEQ ID NO 52550 | ACGTGCTGGAGGAAGCAGAA | AGG | chr17 | 42898091 | 42898110 | 42898107 | + |
| SEQ ID NO 52551 | CGTGCTGGAGGAAGCAGAAA | GGG | chr17 | 42898092 | 42898111 | 42898108 | + |
| SEQ ID NO 52552 | GTGCTGGAGGAAGCAGAAAG | GGG | chr17 | 42898093 | 42898112 | 42898109 | + |
| SEQ ID NO 52553 | TGGAGGAAGCAGAAAGGGGC | TGG | chr17 | 42898097 | 42898116 | 42898113 | + |
| SEQ ID NO 52554 | AGGAAGCAGAAAGGGGCTGG | CAG | chr17 | 42898100 | 42898119 | 42898116 | + |

Figure 85 (Cont'd)

| | | | | | | | |
|---|---|---|---|---|---|---|---|
| SEQ ID NO 52555 | GGAAGCAGAAAGGGGCTGGC | AGG | chr17 | 42898101 | 42898120 | 42898117 | + |
| SEQ ID NO 52556 | AGCAGAAAGGGGCTGGCAGG | TGG | chr17 | 42898104 | 42898123 | 42898120 | + |
| SEQ ID NO 52557 | GAAAGGGGCTGGCAGGTGGA | AAG | chr17 | 42898108 | 42898127 | 42898124 | + |
| SEQ ID NO 52558 | GGGCTGGCAGGTGGAAAGAT | GAG | chr17 | 42898113 | 42898132 | 42898129 | + |
| SEQ ID NO 52559 | GGCTGGCAGGTGGAAAGATG | AGG | chr17 | 42898114 | 42898133 | 42898130 | + |
| SEQ ID NO 52560 | GCAGGTGGAAAGATGAGGAC | CAG | chr17 | 42898119 | 42898138 | 42898135 | + |
| SEQ ID NO 52561 | GCTCATCGTCTCATGACTAT | GAG | chr17 | 42898141 | 42898160 | 42898157 | + |
| SEQ ID NO 52562 | CTCATCGTCTCATGACTATG | AGG | chr17 | 42898142 | 42898161 | 42898158 | + |
| SEQ ID NO 52563 | ACTATGAGGTTGCTCTGATC | CAG | chr17 | 42898156 | 42898175 | 42898172 | + |
| SEQ ID NO 52564 | TATGAGGTTGCTCTGATCCA | GAG | chr17 | 42898158 | 42898177 | 42898174 | + |
| SEQ ID NO 52565 | ATGAGGTTGCTCTGATCCAG | AGG | chr17 | 42898159 | 42898178 | 42898175 | + |
| SEQ ID NO 52566 | TGAGGTTGCTCTGATCCAGA | GGG | chr17 | 42898160 | 42898179 | 42898176 | + |
| SEQ ID NO 52567 | ATCCAGAGGGTCCCCCTGCC | TGG | chr17 | 42898173 | 42898192 | 42898189 | + |
| SEQ ID NO 52568 | CAGAGGGTCCCCCTGCCTGG | TGG | chr17 | 42898176 | 42898195 | 42898192 | + |
| SEQ ID NO 52569 | CCTGCCTGGTGGCCCACCGC | CAG | chr17 | 42898187 | 42898206 | 42898203 | + |
| SEQ ID NO 52570 | CTGCCTGGTGGCCCACCGCC | AGG | chr17 | 42898188 | 42898207 | 42898204 | + |
| SEQ ID NO 52571 | CCTGGTGGCCCACCGCCAGG | AAG | chr17 | 42898191 | 42898210 | 42898207 | + |
| SEQ ID NO 52572 | AGGAAGACTCCCACTGTCCC | TGG | chr17 | 42898208 | 42898227 | 42898224 | + |
| SEQ ID NO 52573 | TCCCACTGTCCCTGGATGCC | CAG | chr17 | 42898216 | 42898235 | 42898232 | + |
| SEQ ID NO 52574 | CCACTGTCCCTGGATGCCCA | GAG | chr17 | 42898218 | 42898237 | 42898234 | + |
| SEQ ID NO 52575 | CTGTCCCTGGATGCCCAGAG | TGG | chr17 | 42898221 | 42898240 | 42898237 | + |
| SEQ ID NO 52576 | TGTCCCTGGATGCCCAGAGT | GGG | chr17 | 42898222 | 42898241 | 42898238 | + |
| SEQ ID NO 52577 | ACTTATCAACTCCTTATCCA | TAG | chr17 | 42898259 | 42898278 | 42898275 | + |
| SEQ ID NO 52578 | CTTATCAACTCCTTATCCAT | AGG | chr17 | 42898260 | 42898279 | 42898276 | + |
| SEQ ID NO 52579 | TTATCAACTCCTTATCCATA | GGG | chr17 | 42898261 | 42898280 | 42898277 | + |
| SEQ ID NO 52580 | TATCAACTCCTTATCCATAG | GGG | chr17 | 42898262 | 42898281 | 42898278 | + |
| SEQ ID NO 52581 | TCCATAGGGGTATTCTTCCT | GAG | chr17 | 42898275 | 42898294 | 42898291 | + |
| SEQ ID NO 52582 | CCATAGGGGTATTCTTCCTG | AGG | chr17 | 42898276 | 42898295 | 42898292 | + |
| SEQ ID NO 52583 | GTATTCTTCCTGAGGCGTCT | CAG | chr17 | 42898284 | 42898303 | 42898300 | + |
| SEQ ID NO 52584 | TCCTGAGGCGTCTCAGAAAA | CAG | chr17 | 42898291 | 42898310 | 42898307 | + |
| SEQ ID NO 52585 | CCTGAGGCGTCTCAGAAAAC | AGG | chr17 | 42898292 | 42898311 | 42898308 | + |
| SEQ ID NO 52586 | CTGAGGCGTCTCAGAAAACA | GGG | chr17 | 42898293 | 42898312 | 42898309 | + |
| SEQ ID NO 52587 | CCCATATGCTGACCACATAA | TAG | chr17 | 42898321 | 42898340 | 42898337 | + |
| SEQ ID NO 52588 | TAATAGAACCCCTCCCAACT | CAG | chr17 | 42898338 | 42898357 | 42898354 | + |
| SEQ ID NO 52589 | ATAGAACCCCTCCCAACTCA | GAG | chr17 | 42898340 | 42898359 | 42898356 | + |
| SEQ ID NO 52590 | CCCTCCCAACTCAGAGACCC | TGG | chr17 | 42898347 | 42898366 | 42898363 | + |
| SEQ ID NO 52591 | AACTCAGAGACCCTGGCTGC | TAG | chr17 | 42898354 | 42898373 | 42898370 | + |
| SEQ ID NO 52592 | ACCCTGGCTGCTAGCTGCCC | TGG | chr17 | 42898363 | 42898382 | 42898379 | + |
| SEQ ID NO 52593 | CTAGCTGCCCTGGCATGACC | CAG | chr17 | 42898373 | 42898392 | 42898389 | + |
| SEQ ID NO 52594 | CTGCCCTGGCATGACCAGA | CAG | chr17 | 42898377 | 42898396 | 42898393 | + |
| SEQ ID NO 52595 | CCCTGGCATGACCCAGACAG | TGG | chr17 | 42898380 | 42898399 | 42898396 | + |
| SEQ ID NO 52596 | GTGGCCTTTGTATATGTTTT | TAG | chr17 | 42898399 | 42898418 | 42898415 | + |
| SEQ ID NO 52597 | CCTTGACTCACCTCTGACCA | TAG | chr17 | 42898427 | 42898446 | 42898443 | + |
| SEQ ID NO 52598 | GACCATAGAAACTCTCATCC | CAG | chr17 | 42898442 | 42898461 | 42898458 | + |
| SEQ ID NO 52599 | CCATAGAAACTCTCATCCCA | GAG | chr17 | 42898444 | 42898463 | 42898460 | + |
| SEQ ID NO 52600 | CATAGAAACTCTCATCCCAG | AGG | chr17 | 42898445 | 42898464 | 42898461 | + |
| SEQ ID NO 52601 | CATCCCAGAGGTCACTGCAA | TAG | chr17 | 42898457 | 42898476 | 42898473 | + |

Figure 85 (Cont'd)

| | | | | | | | |
|---|---|---|---|---|---|---|---|
| SEQ ID NO 52602 | CTGCAATAGTTACTCCACAA | CAG | chr17 | 42898471 | 42898490 | 42898487 | + |
| SEQ ID NO 52603 | GCAATAGTTACTCCACAACA | GAG | chr17 | 42898473 | 42898492 | 42898489 | + |
| SEQ ID NO 52604 | CAATAGTTACTCCACAACAG | AGG | chr17 | 42898474 | 42898493 | 42898490 | + |
| SEQ ID NO 52605 | CTCCACAACAGAGGCTTATC | TGG | chr17 | 42898483 | 42898502 | 42898499 | + |
| SEQ ID NO 52606 | TCCACAACAGAGGCTTATCT | GGG | chr17 | 42898484 | 42898503 | 42898500 | + |
| SEQ ID NO 52607 | ACAACAGAGGCTTATCTGGG | TAG | chr17 | 42898487 | 42898506 | 42898503 | + |
| SEQ ID NO 52608 | AACAGAGGCTTATCTGGGTA | GAG | chr17 | 42898489 | 42898508 | 42898505 | + |
| SEQ ID NO 52609 | ACAGAGGCTTATCTGGGTAG | AGG | chr17 | 42898490 | 42898509 | 42898506 | + |
| SEQ ID NO 52610 | CAGAGGCTTATCTGGGTAGA | GGG | chr17 | 42898491 | 42898510 | 42898507 | + |
| SEQ ID NO 52611 | GAGGCTTATCTGGGTAGAGG | GAG | chr17 | 42898493 | 42898512 | 42898509 | + |
| SEQ ID NO 52612 | AGGCTTATCTGGGTAGAGGG | AGG | chr17 | 42898494 | 42898513 | 42898510 | + |
| SEQ ID NO 52613 | AGAGGGAGGCTCCCTACCTA | TGG | chr17 | 42898508 | 42898527 | 42898524 | + |
| SEQ ID NO 52614 | GAGGCTCCCTACCTATGGCC | CAG | chr17 | 42898513 | 42898532 | 42898529 | + |
| SEQ ID NO 52615 | GCTCCCTACCTATGGCCCAG | CAG | chr17 | 42898516 | 42898535 | 42898532 | + |
| SEQ ID NO 52616 | CTATGGCCCAGCAGCCCTGA | CAG | chr17 | 42898525 | 42898544 | 42898541 | + |
| SEQ ID NO 52617 | GCCCAGCAGCCCTGACAGTG | CAG | chr17 | 42898530 | 42898549 | 42898546 | + |
| SEQ ID NO 52618 | ATCACATATACCCCACGCCC | CAG | chr17 | 42898553 | 42898572 | 42898569 | + |
| SEQ ID NO 52619 | CCAGCACTGCCTGCCACGCA | TGG | chr17 | 42898572 | 42898591 | 42898588 | + |
| SEQ ID NO 52620 | CAGCACTGCCTGCCACGCAT | GGG | chr17 | 42898573 | 42898592 | 42898589 | + |
| SEQ ID NO 52621 | GCTTACTTTACACCCACCCA | CAG | chr17 | 42898595 | 42898614 | 42898611 | + |
| SEQ ID NO 52622 | CAACACATTACCTGCTCTCC | AAG | chr17 | 42898622 | 42898641 | 42898638 | + |
| SEQ ID NO 52623 | AACACATTACCTGCTCTCCA | AGG | chr17 | 42898623 | 42898642 | 42898639 | + |
| SEQ ID NO 52624 | CATTACCTGCTCTCCAAGGT | TAG | chr17 | 42898627 | 42898646 | 42898643 | + |
| SEQ ID NO 52625 | ATTACCTGCTCTCCAAGGTT | AGG | chr17 | 42898628 | 42898647 | 42898644 | + |
| SEQ ID NO 52626 | CTGCTCTCCAAGGTTAGGCG | TGG | chr17 | 42898633 | 42898652 | 42898649 | + |
| SEQ ID NO 52627 | CTCTCCAAGGTTAGGCGTGG | CAG | chr17 | 42898636 | 42898655 | 42898652 | + |
| SEQ ID NO 52628 | TCTCCAAGGTTAGGCGTGGC | AGG | chr17 | 42898637 | 42898656 | 42898653 | + |
| SEQ ID NO 52629 | TCCAAGGTTAGGCGTGGCAG | GAG | chr17 | 42898639 | 42898658 | 42898655 | + |
| SEQ ID NO 52630 | AAGGTTAGGCGTGGCAGGAG | AAG | chr17 | 42898642 | 42898661 | 42898658 | + |
| SEQ ID NO 52631 | CGTGGCAGGAGAAGTTTGCT | TGG | chr17 | 42898651 | 42898670 | 42898667 | + |
| SEQ ID NO 52632 | CAGGAGAAGTTTGCTTGGAC | CAG | chr17 | 42898656 | 42898675 | 42898672 | + |
| SEQ ID NO 52633 | GAGAAGTTTGCTTGGACCAG | CAG | chr17 | 42898659 | 42898678 | 42898675 | + |
| SEQ ID NO 52634 | TTGGACCAGCAGAAACCATG | CAG | chr17 | 42898670 | 42898689 | 42898686 | + |
| SEQ ID NO 52635 | CCAGCAGAAACCATGCAGTC | AAG | chr17 | 42898675 | 42898694 | 42898691 | + |
| SEQ ID NO 52636 | CAGCAGAAACCATGCAGTCA | AGG | chr17 | 42898676 | 42898695 | 42898692 | + |
| SEQ ID NO 52637 | ACCATGCAGTCAAGGACAAC | TGG | chr17 | 42898684 | 42898703 | 42898700 | + |
| SEQ ID NO 52638 | CATGCAGTCAAGGACAACTG | GAG | chr17 | 42898686 | 42898705 | 42898702 | + |
| SEQ ID NO 52639 | CAGTCAAGGACAACTGGAGT | CAG | chr17 | 42898690 | 42898709 | 42898706 | + |
| SEQ ID NO 52640 | AAGGACAACTGGAGTCAGCA | TGG | chr17 | 42898695 | 42898714 | 42898711 | + |
| SEQ ID NO 52641 | AGGACAACTGGAGTCAGCAT | GGG | chr17 | 42898696 | 42898715 | 42898712 | + |
| SEQ ID NO 52642 | CAACTGGAGTCAGCATGGGC | TGG | chr17 | 42898700 | 42898719 | 42898716 | + |
| SEQ ID NO 52643 | AACTGGAGTCAGCATGGGCT | GGG | chr17 | 42898701 | 42898720 | 42898717 | + |
| SEQ ID NO 52644 | AGTCAGCATGGGCTGGGTGC | GAG | chr17 | 42898707 | 42898726 | 42898723 | + |
| SEQ ID NO 52645 | ATGGGCTGGGTGCGAGCCCT | TGG | chr17 | 42898714 | 42898733 | 42898730 | + |
| SEQ ID NO 52646 | GGCTGGGTGCGAGCCCTTGG | TGG | chr17 | 42898717 | 42898736 | 42898733 | + |
| SEQ ID NO 52647 | GCTGGGTGCGAGCCCTTGGT | GGG | chr17 | 42898718 | 42898737 | 42898734 | + |
| SEQ ID NO 52648 | CTGGGTGCGAGCCCTTGGTG | GGG | chr17 | 42898719 | 42898738 | 42898735 | + |

Figure 85 (Cont'd)

| | | | | | | | |
|---|---|---|---|---|---|---|---|
| SEQ ID NO 52649 | GGTGCGAGCCCTTGGTGGGG | TGG | chr17 | 42898722 | 42898741 | 42898738 | + |
| SEQ ID NO 52650 | GTGCGAGCCCTTGGTGGGGT | GGG | chr17 | 42898723 | 42898742 | 42898739 | + |
| SEQ ID NO 52651 | TGCGAGCCCTTGGTGGGGTG | GGG | chr17 | 42898724 | 42898743 | 42898740 | + |
| SEQ ID NO 52652 | CGAGCCCTTGGTGGGGTGGG | GAG | chr17 | 42898726 | 42898745 | 42898742 | + |
| SEQ ID NO 52653 | GAGCCCTTGGTGGGGTGGGG | AGG | chr17 | 42898727 | 42898746 | 42898743 | + |
| SEQ ID NO 52654 | GCCCTTGGTGGGGTGGGGAG | GAG | chr17 | 42898729 | 42898748 | 42898745 | + |
| SEQ ID NO 52655 | GTGGGGTGGGGAGGAGACTC | CAG | chr17 | 42898736 | 42898755 | 42898752 | + |
| SEQ ID NO 52656 | TGGGGTGGGGAGGAGACTCC | AGG | chr17 | 42898737 | 42898756 | 42898753 | + |
| SEQ ID NO 52657 | AGACTCCAGGTCATACCTCC | TGG | chr17 | 42898750 | 42898769 | 42898766 | + |
| SEQ ID NO 52658 | ACTCCAGGTCATACCTCCTG | GAG | chr17 | 42898752 | 42898771 | 42898768 | + |
| SEQ ID NO 52659 | CTCCAGGTCATACCTCCTGG | AGG | chr17 | 42898753 | 42898772 | 42898769 | + |
| SEQ ID NO 52660 | GAGGATGTTTAATCATTTC | CAG | chr17 | 42898772 | 42898791 | 42898788 | + |
| SEQ ID NO 52661 | TGTTTTAATCATTTCCAGCA | TGG | chr17 | 42898777 | 42898796 | 42898793 | + |
| SEQ ID NO 52662 | AATGCTGTCAACTTTTGCCA | CAG | chr17 | 42898800 | 42898819 | 42898816 | + |
| SEQ ID NO 52663 | AACTTTTGCCACAGATTCAT | TAG | chr17 | 42898809 | 42898828 | 42898825 | + |
| SEQ ID NO 52664 | GCCACAGATTCATTAGCTCT | GAG | chr17 | 42898816 | 42898835 | 42898832 | + |
| SEQ ID NO 52665 | GAGTTTCTTTTTCTGTCCC | CAG | chr17 | 42898836 | 42898855 | 42898852 | + |
| SEQ ID NO 52666 | CTACCCCTTACATGTCAATA | TGG | chr17 | 42898859 | 42898878 | 42898875 | + |
| SEQ ID NO 52667 | TGTCAATATGGACTTAATGA | TGG | chr17 | 42898871 | 42898890 | 42898887 | + |
| SEQ ID NO 52668 | GTCAATATGGACTTAATGAT | GGG | chr17 | 42898872 | 42898891 | 42898888 | + |
| SEQ ID NO 52669 | GGACTTAATGATGGGAAATT | CAG | chr17 | 42898880 | 42898899 | 42898896 | + |
| SEQ ID NO 52670 | GACTTAATGATGGGAAATTC | AGG | chr17 | 42898881 | 42898900 | 42898897 | + |
| SEQ ID NO 52671 | TAATGATGGGAAATTCAGGC | AAG | chr17 | 42898885 | 42898904 | 42898901 | + |
| SEQ ID NO 52672 | TTTAAACATTTTATTCCCCC | TGG | chr17 | 42898910 | 42898929 | 42898926 | + |
| SEQ ID NO 52673 | CCTCAAAAAATGCATGAATT | TGG | chr17 | 42898940 | 42898959 | 42898956 | + |
| SEQ ID NO 52674 | TCAAAAAATGCATGAATTTG | GAG | chr17 | 42898942 | 42898961 | 42898958 | + |
| SEQ ID NO 52675 | CAAAAAATGCATGAATTTGG | AGG | chr17 | 42898943 | 42898962 | 42898959 | + |
| SEQ ID NO 52676 | AAAATGCATGAATTTGGAGG | CAG | chr17 | 42898946 | 42898965 | 42898962 | + |
| SEQ ID NO 52677 | ATGCATGAATTTGGAGGCAG | TGG | chr17 | 42898949 | 42898968 | 42898965 | + |
| SEQ ID NO 52678 | CTGTAATCCCAATGCTTTGC | TAG | chr17 | 42898979 | 42898998 | 42898995 | + |
| SEQ ID NO 52679 | TGTAATCCCAATGCTTTGCT | AGG | chr17 | 42898980 | 42898999 | 42898996 | + |
| SEQ ID NO 52680 | TCCCAATGCTTTGCTAGGTT | GAG | chr17 | 42898985 | 42899004 | 42899001 | + |
| SEQ ID NO 52681 | CCCAATGCTTTGCTAGGTTG | AGG | chr17 | 42898986 | 42899005 | 42899002 | + |
| SEQ ID NO 52682 | AATGCTTTGCTAGGTTGAGG | CGG | chr17 | 42898989 | 42899008 | 42899005 | + |
| SEQ ID NO 52683 | ATGCTTTGCTAGGTTGAGGC | GGG | chr17 | 42898990 | 42899009 | 42899006 | + |
| SEQ ID NO 52684 | GCTTTGCTAGGTTGAGGCGG | GAG | chr17 | 42898992 | 42899011 | 42899008 | + |
| SEQ ID NO 52685 | CTTTGCTAGGTTGAGGCGGG | AGG | chr17 | 42898993 | 42899012 | 42899009 | + |
| SEQ ID NO 52686 | TGAGGCGGGAGGATCACTTG | AAG | chr17 | 42899004 | 42899023 | 42899020 | + |
| SEQ ID NO 52687 | GCGGGAGGATCACTTGAAGC | CAG | chr17 | 42899008 | 42899027 | 42899024 | + |
| SEQ ID NO 52688 | CGGGAGGATCACTTGAAGCC | AGG | chr17 | 42899009 | 42899028 | 42899025 | + |
| SEQ ID NO 52689 | TCACTTGAAGCCAGGAATTT | GAG | chr17 | 42899017 | 42899036 | 42899033 | + |
| SEQ ID NO 52690 | TGAAGCCAGGAATTTGAGAC | CAG | chr17 | 42899022 | 42899041 | 42899038 | + |
| SEQ ID NO 52691 | CCAGGAATTTGAGACCAGCC | TGG | chr17 | 42899027 | 42899046 | 42899043 | + |
| SEQ ID NO 52692 | CAGGAATTTGAGACCAGCCT | GGG | chr17 | 42899028 | 42899047 | 42899044 | + |
| SEQ ID NO 52693 | TGAGACCAGCCTGGGCCGCA | TAG | chr17 | 42899036 | 42899055 | 42899052 | + |
| SEQ ID NO 52694 | ACCAGCCTGGGCCGCATAGT | GAG | chr17 | 42899040 | 42899059 | 42899056 | + |
| SEQ ID NO 52695 | AATAAATAAATAATAAATAA | TAG | chr17 | 42899083 | 42899102 | 42899099 | + |

Figure 85 (Cont'd)

| | | | | | | | |
|---|---|---|---|---|---|---|---|
| SEQ ID NO 52696 | TAATAAATAATAGTGATATG | AAG | chr17 | 42899093 | 42899112 | 42899109 | + |
| SEQ ID NO 52697 | TGATATGAAGCATGATTAAA | TAG | chr17 | 42899106 | 42899125 | 42899122 | + |
| SEQ ID NO 52698 | CCCTATTTTTTAAAATGCAT | GAG | chr17 | 42899129 | 42899148 | 42899145 | + |
| SEQ ID NO 52699 | TCGTTACCTGATTCATTCCC | TGG | chr17 | 42899153 | 42899172 | 42899169 | + |
| SEQ ID NO 52700 | TCATTCCCTGGTTCCTTTCA | CAG | chr17 | 42899165 | 42899184 | 42899181 | + |
| SEQ ID NO 52701 | TTCACAGTCCTCCGTGACCC | AAG | chr17 | 42899181 | 42899200 | 42899197 | + |
| SEQ ID NO 52702 | GTCCTCCGTGACCCAAGTGT | TAG | chr17 | 42899187 | 42899206 | 42899203 | + |
| SEQ ID NO 52703 | TCCTCCGTGACCCAAGTGTT | AGG | chr17 | 42899188 | 42899207 | 42899204 | + |
| SEQ ID NO 52704 | CCTCCGTGACCCAAGTGTTA | GGG | chr17 | 42899189 | 42899208 | 42899205 | + |
| SEQ ID NO 52705 | TGACCCAAGTGTTAGGGTTT | TGG | chr17 | 42899195 | 42899214 | 42899211 | + |
| SEQ ID NO 52706 | TTTGGTCTCTCTACTATTTG | TAG | chr17 | 42899213 | 42899232 | 42899229 | + |
| SEQ ID NO 52707 | TTGGTCTCTCTACTATTTGT | AGG | chr17 | 42899214 | 42899233 | 42899230 | + |
| SEQ ID NO 52708 | ACTATTTGTAGGCTGATATA | TAG | chr17 | 42899225 | 42899244 | 42899241 | + |
| SEQ ID NO 52709 | CACACACATATACACACACA | CAG | chr17 | 42899264 | 42899283 | 42899280 | + |
| SEQ ID NO 52710 | ACACACACAGTGTATCTT | GAG | chr17 | 42899275 | 42899294 | 42899291 | + |
| SEQ ID NO 52711 | ATATCTACACACATATGTAT | AAG | chr17 | 42899309 | 42899328 | 42899325 | + |
| SEQ ID NO 52712 | CTACACACATATGTATAAGA | AAG | chr17 | 42899313 | 42899332 | 42899329 | + |
| SEQ ID NO 52713 | ACATATGTATAAGAAAGCTC | AAG | chr17 | 42899319 | 42899338 | 42899335 | + |
| SEQ ID NO 52714 | GTATAAGAAAGCTCAAGATA | TAG | chr17 | 42899325 | 42899344 | 42899341 | + |
| SEQ ID NO 52715 | TAAGAAAGCTCAAGATATAG | AAG | chr17 | 42899328 | 42899347 | 42899344 | + |
| SEQ ID NO 52716 | CCTTTTTCAAAAATAACTGA | AAG | chr17 | 42899352 | 42899371 | 42899368 | + |
| SEQ ID NO 52717 | CTGAAAGTTTCAAACTCTTT | AAG | chr17 | 42899368 | 42899387 | 42899384 | + |
| SEQ ID NO 52718 | TTTCAAACTCTTTAAGTCTC | CAG | chr17 | 42899375 | 42899394 | 42899391 | + |
| SEQ ID NO 52719 | GTCTCCAGTTACCATTTTGC | TGG | chr17 | 42899390 | 42899409 | 42899406 | + |
| SEQ ID NO 52720 | ATTTTGCTGGTATTCTTATT | TGG | chr17 | 42899403 | 42899422 | 42899419 | + |
| SEQ ID NO 52721 | ACATTCATCATATTGTTGCA | CAG | chr17 | 42899432 | 42899451 | 42899448 | + |
| SEQ ID NO 52722 | TCATCATATTGTTGCACAGT | AAG | chr17 | 42899436 | 42899455 | 42899452 | + |
| SEQ ID NO 52723 | ATTATTTTGCTTAAACGTAT | GAG | chr17 | 42899470 | 42899489 | 42899486 | + |
| SEQ ID NO 52724 | AACGTATGAGTTAAAACACT | TGG | chr17 | 42899483 | 42899502 | 42899499 | + |
| SEQ ID NO 52725 | TATGAGTTAAAACACTTGGC | CAG | chr17 | 42899487 | 42899506 | 42899503 | + |
| SEQ ID NO 52726 | ATGAGTTAAAACACTTGGCC | AGG | chr17 | 42899488 | 42899507 | 42899504 | + |
| SEQ ID NO 52727 | TTAAAACACTTGGCCAGGCA | TGG | chr17 | 42899493 | 42899512 | 42899509 | + |
| SEQ ID NO 52728 | AAACACTTGGCCAGGCATGG | TGG | chr17 | 42899496 | 42899515 | 42899512 | + |
| SEQ ID NO 52729 | GTGGTTCACACCTGTAATCC | CAG | chr17 | 42899515 | 42899534 | 42899531 | + |
| SEQ ID NO 52730 | GGTTCACACCTGTAATCCCA | GAG | chr17 | 42899517 | 42899536 | 42899533 | + |
| SEQ ID NO 52731 | CACCTGTAATCCCAGAGCTT | TGG | chr17 | 42899523 | 42899542 | 42899539 | + |
| SEQ ID NO 52732 | ACCTGTAATCCCAGAGCTTT | GGG | chr17 | 42899524 | 42899543 | 42899540 | + |
| SEQ ID NO 52733 | TGTAATCCCAGAGCTTTGGG | AAG | chr17 | 42899527 | 42899546 | 42899543 | + |
| SEQ ID NO 52734 | TCCCAGAGCTTTGGGAAGCC | AAG | chr17 | 42899532 | 42899551 | 42899548 | + |
| SEQ ID NO 52735 | GAGCTTTGGGAAGCCAAGAC | TGG | chr17 | 42899537 | 42899556 | 42899553 | + |
| SEQ ID NO 52736 | CTTTGGGAAGCCAAGACTGG | CAG | chr17 | 42899540 | 42899559 | 42899556 | + |
| SEQ ID NO 52737 | CCAAGACTGGCAGATCTCTT | GAG | chr17 | 42899550 | 42899569 | 42899566 | + |
| SEQ ID NO 52738 | ACTGGCAGATCTCTTGAGCT | CAG | chr17 | 42899555 | 42899574 | 42899571 | + |
| SEQ ID NO 52739 | CTGGCAGATCTCTTGAGCTC | AGG | chr17 | 42899556 | 42899575 | 42899572 | + |
| SEQ ID NO 52740 | TCTCTTGAGCTCAGGAATTC | AAG | chr17 | 42899564 | 42899583 | 42899580 | + |
| SEQ ID NO 52741 | TGAGCTCAGGAATTCAAGAC | CAG | chr17 | 42899569 | 42899588 | 42899585 | + |
| SEQ ID NO 52742 | TCAGGAATTCAAGACCAGCC | TGG | chr17 | 42899574 | 42899593 | 42899590 | + |

Figure 85 (Cont'd)

| | | | | | | | |
|---|---|---|---|---|---|---|---|
| SEQ ID NO 52743 | CAGGAATTCAAGACCAGCCT | GGG | chr17 | 42899575 | 42899594 | 42899591 | + |
| SEQ ID NO 52744 | CAAGACCAGCCTGGGCAACA | TGG | chr17 | 42899583 | 42899602 | 42899599 | + |
| SEQ ID NO 52745 | GAAAAACCCCATCTCTACAA | AAG | chr17 | 42899605 | 42899624 | 42899621 | + |
| SEQ ID NO 52746 | AACCCCATCTCTACAAAAGA | TAG | chr17 | 42899609 | 42899628 | 42899625 | + |
| SEQ ID NO 52747 | TCTACAAAAGATAGAAAAAT | TAG | chr17 | 42899618 | 42899637 | 42899634 | + |
| SEQ ID NO 52748 | CAAAAGATAGAAAAATTAGC | CAG | chr17 | 42899622 | 42899641 | 42899638 | + |
| SEQ ID NO 52749 | AAAAGATAGAAAAATTAGCC | AGG | chr17 | 42899623 | 42899642 | 42899639 | + |
| SEQ ID NO 52750 | ATAGAAAAATTAGCCAGGCA | TGG | chr17 | 42899628 | 42899647 | 42899644 | + |
| SEQ ID NO 52751 | GAAAAATTAGCCAGGCATGG | TGG | chr17 | 42899631 | 42899650 | 42899647 | + |
| SEQ ID NO 52752 | GGCATGGTGGCGTGTGCCTG | TGG | chr17 | 42899644 | 42899663 | 42899660 | + |
| SEQ ID NO 52753 | GTGGCGTGTGCCTGTGGTCC | CAG | chr17 | 42899650 | 42899669 | 42899666 | + |
| SEQ ID NO 52754 | TGCCTGTGGTCCCAGCTACT | CAG | chr17 | 42899658 | 42899677 | 42899674 | + |
| SEQ ID NO 52755 | GCCTGTGGTCCCAGCTACTC | AGG | chr17 | 42899659 | 42899678 | 42899675 | + |
| SEQ ID NO 52756 | CTGTGGTCCCAGCTACTCAG | GAG | chr17 | 42899661 | 42899680 | 42899677 | + |
| SEQ ID NO 52757 | TGTGGTCCCAGCTACTCAGG | AGG | chr17 | 42899662 | 42899681 | 42899678 | + |
| SEQ ID NO 52758 | TCCCAGCTACTCAGGAGGCT | GAG | chr17 | 42899667 | 42899686 | 42899683 | + |
| SEQ ID NO 52759 | CCCAGCTACTCAGGAGGCTG | AGG | chr17 | 42899668 | 42899687 | 42899684 | + |
| SEQ ID NO 52760 | AGCTACTCAGGAGGCTGAGG | TGG | chr17 | 42899671 | 42899690 | 42899687 | + |
| SEQ ID NO 52761 | GCTACTCAGGAGGCTGAGGT | GGG | chr17 | 42899672 | 42899691 | 42899688 | + |
| SEQ ID NO 52762 | TACTCAGGAGGCTGAGGTGG | GAG | chr17 | 42899674 | 42899693 | 42899690 | + |
| SEQ ID NO 52763 | ACTCAGGAGGCTGAGGTGGG | AGG | chr17 | 42899675 | 42899694 | 42899691 | + |
| SEQ ID NO 52764 | CTGAGGTGGGAGGATCACAT | TAG | chr17 | 42899685 | 42899704 | 42899701 | + |
| SEQ ID NO 52765 | GTGGGAGGATCACATTAGCC | CAG | chr17 | 42899690 | 42899709 | 42899706 | + |
| SEQ ID NO 52766 | TGGGAGGATCACATTAGCCC | AGG | chr17 | 42899691 | 42899710 | 42899707 | + |
| SEQ ID NO 52767 | GGAGGATCACATTAGCCCAG | GAG | chr17 | 42899693 | 42899712 | 42899709 | + |
| SEQ ID NO 52768 | GAGGATCACATTAGCCCAGG | AGG | chr17 | 42899694 | 42899713 | 42899710 | + |
| SEQ ID NO 52769 | TCACATTAGCCCAGGAGGTT | GAG | chr17 | 42899699 | 42899718 | 42899715 | + |
| SEQ ID NO 52770 | CACATTAGCCCAGGAGGTTG | AGG | chr17 | 42899700 | 42899719 | 42899716 | + |
| SEQ ID NO 52771 | AGCCCAGGAGGTTGAGGCTG | CAG | chr17 | 42899706 | 42899725 | 42899722 | + |
| SEQ ID NO 52772 | CAGGAGGTTGAGGCTGCAGT | GAG | chr17 | 42899710 | 42899729 | 42899726 | + |
| SEQ ID NO 52773 | GTGATTATGCCACTGCACTC | CAG | chr17 | 42899735 | 42899754 | 42899751 | + |
| SEQ ID NO 52774 | TATGCCACTGCACTCCAGCC | TGG | chr17 | 42899740 | 42899759 | 42899756 | + |
| SEQ ID NO 52775 | ATGCCACTGCACTCCAGCCT | GGG | chr17 | 42899741 | 42899760 | 42899757 | + |
| SEQ ID NO 52776 | GCCACTGCACTCCAGCCTGG | GAG | chr17 | 42899743 | 42899762 | 42899759 | + |
| SEQ ID NO 52777 | CTGCACTCCAGCCTGGGAGA | CAG | chr17 | 42899747 | 42899766 | 42899763 | + |
| SEQ ID NO 52778 | GCACTCCAGCCTGGGAGACA | GAG | chr17 | 42899749 | 42899768 | 42899765 | + |
| SEQ ID NO 52779 | TCCAGCCTGGGAGACAGAGT | GAG | chr17 | 42899753 | 42899772 | 42899769 | + |
| SEQ ID NO 52780 | TGAGACCCTGTTTCAAAAAA | AAG | chr17 | 42899772 | 42899791 | 42899788 | + |
| SEQ ID NO 52781 | AGACCCTGTTTCAAAAAAAA | GAG | chr17 | 42899774 | 42899793 | 42899790 | + |
| SEQ ID NO 52782 | ACCCTGTTTCAAAAAAAAGA | GAG | chr17 | 42899776 | 42899795 | 42899792 | + |
| SEQ ID NO 52783 | CCTGTTTCAAAAAAAAGAGA | GAG | chr17 | 42899778 | 42899797 | 42899794 | + |
| SEQ ID NO 52784 | AAGAGAGAGAAAATTTAAAA | AAG | chr17 | 42899792 | 42899811 | 42899808 | + |
| SEQ ID NO 52785 | TTAAAAAGAAAACAACACC | AAG | chr17 | 42899806 | 42899825 | 42899822 | + |
| SEQ ID NO 52786 | TAAAAAGAAAACAACACCA | AGG | chr17 | 42899807 | 42899826 | 42899823 | + |
| SEQ ID NO 52787 | AAAAAGAAAACAACACCAA | GGG | chr17 | 42899808 | 42899827 | 42899824 | + |
| SEQ ID NO 52788 | ACACCAAGGGCTGTAACTTT | AAG | chr17 | 42899821 | 42899840 | 42899837 | + |
| SEQ ID NO 52789 | CACCAAGGGCTGTAACTTTA | AGG | chr17 | 42899822 | 42899841 | 42899838 | + |

Figure 85 (Cont'd)

| | | | | | | | |
|---|---|---|---|---|---|---|---|
| SEQ ID NO 52790 | ATTCAAAAACGATTACTTTC | TGG | chr17 | 42899868 | 42899887 | 42899884 | + |
| SEQ ID NO 52791 | AACGATTACTTTCTGGCCCT | AAG | chr17 | 42899875 | 42899894 | 42899891 | + |
| SEQ ID NO 52792 | CGATTACTTTCTGGCCCTAA | GAG | chr17 | 42899877 | 42899896 | 42899893 | + |
| SEQ ID NO 52793 | TTTCTGGCCCTAAGAGACAT | GAG | chr17 | 42899884 | 42899903 | 42899900 | + |
| SEQ ID NO 52794 | TTCTGGCCCTAAGAGACATG | AGG | chr17 | 42899885 | 42899904 | 42899901 | + |
| SEQ ID NO 52795 | AAGAGACATGAGGCCAATAC | CAG | chr17 | 42899895 | 42899914 | 42899911 | + |
| SEQ ID NO 52796 | AGAGACATGAGGCCAATACC | AGG | chr17 | 42899896 | 42899915 | 42899912 | + |
| SEQ ID NO 52797 | GACATGAGGCCAATACCAGG | AAG | chr17 | 42899899 | 42899918 | 42899915 | + |
| SEQ ID NO 52798 | ACATGAGGCCAATACCAGGA | AGG | chr17 | 42899900 | 42899919 | 42899916 | + |
| SEQ ID NO 52799 | CATGAGGCCAATACCAGGAA | GGG | chr17 | 42899901 | 42899920 | 42899917 | + |
| SEQ ID NO 52800 | ATGAGGCCAATACCAGGAAG | GGG | chr17 | 42899902 | 42899921 | 42899918 | + |
| SEQ ID NO 52801 | TGAGGCCAATACCAGGAAGG | GGG | chr17 | 42899903 | 42899922 | 42899919 | + |
| SEQ ID NO 52802 | AGGGGTTGATCTCCCAAAC | CAG | chr17 | 42899920 | 42899939 | 42899936 | + |
| SEQ ID NO 52803 | GGGGTTGATCTCCCAAACCA | GAG | chr17 | 42899922 | 42899941 | 42899938 | + |
| SEQ ID NO 52804 | GGGTTGATCTCCCAAACCAG | AGG | chr17 | 42899923 | 42899942 | 42899939 | + |
| SEQ ID NO 52805 | TTGATCTCCCAAACCAGAGG | CAG | chr17 | 42899926 | 42899945 | 42899942 | + |
| SEQ ID NO 52806 | CCCAAACCAGAGGCAGACCC | TAG | chr17 | 42899933 | 42899952 | 42899949 | + |
| SEQ ID NO 52807 | GCAGACCCTAGACTCTAATA | CAG | chr17 | 42899945 | 42899964 | 42899961 | + |
| SEQ ID NO 52808 | CCCTAGACTCTAATACAGTT | AAG | chr17 | 42899950 | 42899969 | 42899966 | + |
| SEQ ID NO 52809 | CCTAGACTCTAATACAGTTA | AGG | chr17 | 42899951 | 42899970 | 42899967 | + |
| SEQ ID NO 52810 | GACTCTAATACAGTTAAGGA | AAG | chr17 | 42899955 | 42899974 | 42899971 | + |
| SEQ ID NO 52811 | TAATACAGTTAAGGAAAGAC | CAG | chr17 | 42899960 | 42899979 | 42899976 | + |
| SEQ ID NO 52812 | ACAGTTAAGGAAAGACCAGC | AAG | chr17 | 42899964 | 42899983 | 42899980 | + |
| SEQ ID NO 52813 | AGGAAAGACCAGCAAGATGA | TAG | chr17 | 42899971 | 42899990 | 42899987 | + |
| SEQ ID NO 52814 | GATGATAGTCCCCAATACAA | TAG | chr17 | 42899986 | 42900005 | 42900002 | + |
| SEQ ID NO 52815 | GATAGTCCCCAATACAATAG | AAG | chr17 | 42899989 | 42900008 | 42900005 | + |
| SEQ ID NO 52816 | TGTTTTGTTTTGTTTTGTTT | TAG | chr17 | 42900051 | 42900070 | 42900067 | + |
| SEQ ID NO 52817 | TTTTGTTTTGTTTTGTTTTA | GAG | chr17 | 42900053 | 42900072 | 42900069 | + |
| SEQ ID NO 52818 | TTTTGTTTTGTTTTAGAGAC | TGG | chr17 | 42900058 | 42900077 | 42900074 | + |
| SEQ ID NO 52819 | TTTGTTTTGTTTTAGAGACT | GGG | chr17 | 42900059 | 42900078 | 42900075 | + |
| SEQ ID NO 52820 | TTGTTTTGTTTTAGAGACTG | GGG | chr17 | 42900060 | 42900079 | 42900076 | + |
| SEQ ID NO 52821 | TGGGGTCTTGCTCGATTGCC | CAG | chr17 | 42900078 | 42900097 | 42900094 | + |
| SEQ ID NO 52822 | GGGGTCTTGCTCGATTGCCC | AGG | chr17 | 42900079 | 42900098 | 42900095 | + |
| SEQ ID NO 52823 | TTGCTCGATTGCCCAGGCTG | TAG | chr17 | 42900085 | 42900104 | 42900101 | + |
| SEQ ID NO 52824 | CGATTGCCCAGGCTGTAGTG | CAG | chr17 | 42900090 | 42900109 | 42900106 | + |
| SEQ ID NO 52825 | TTGCCCAGGCTGTAGTGCAG | CGG | chr17 | 42900093 | 42900112 | 42900109 | + |
| SEQ ID NO 52826 | CCCAGGCTGTAGTGCAGCGG | TGG | chr17 | 42900096 | 42900115 | 42900112 | + |
| SEQ ID NO 52827 | CCAGGCTGTAGTGCAGCGGT | GGG | chr17 | 42900097 | 42900116 | 42900113 | + |
| SEQ ID NO 52828 | GTAGTGCAGCGGTGGGACAA | TAG | chr17 | 42900104 | 42900123 | 42900120 | + |
| SEQ ID NO 52829 | GGTGGGACAATAGCTCACTG | CAG | chr17 | 42900114 | 42900133 | 42900130 | + |
| SEQ ID NO 52830 | TCACTGCAGACTCCAACTCC | TGG | chr17 | 42900128 | 42900147 | 42900144 | + |
| SEQ ID NO 52831 | CACTGCAGACTCCAACTCCT | GGG | chr17 | 42900129 | 42900148 | 42900145 | + |
| SEQ ID NO 52832 | AGACTCCAACTCCTGGGCTC | AAG | chr17 | 42900135 | 42900154 | 42900151 | + |
| SEQ ID NO 52833 | CTCAAGCAATCCTCCTGCCT | CAG | chr17 | 42900152 | 42900171 | 42900168 | + |
| SEQ ID NO 52834 | TCCTGCCTCAGCCTCCTGAA | TAG | chr17 | 42900164 | 42900183 | 42900180 | + |
| SEQ ID NO 52835 | GCCTCAGCCTCCTGAATAGC | TGG | chr17 | 42900168 | 42900187 | 42900184 | + |
| SEQ ID NO 52836 | CCTCAGCCTCCTGAATAGCT | GGG | chr17 | 42900169 | 42900188 | 42900185 | + |

Figure 85 (Cont'd)

| | | | | | | | |
|---|---|---|---|---|---|---|---|
| SEQ ID NO 52837 | TCCTGAATAGCTGGGACTAC | AAG | chr17 | 42900177 | 42900196 | 42900193 | + |
| SEQ ID NO 52838 | CCTGAATAGCTGGGACTACA | AGG | chr17 | 42900178 | 42900197 | 42900194 | + |
| SEQ ID NO 52839 | CTGAATAGCTGGGACTACAA | GGG | chr17 | 42900179 | 42900198 | 42900195 | + |
| SEQ ID NO 52840 | CAATTTTTTAAATTTTTGTG | TAG | chr17 | 42900224 | 42900243 | 42900240 | + |
| SEQ ID NO 52841 | TTAAATTTTGTGTAGAAAC | GAG | chr17 | 42900231 | 42900250 | 42900247 | + |
| SEQ ID NO 52842 | TAAATTTTGTGTAGAAACG | AGG | chr17 | 42900232 | 42900251 | 42900248 | + |
| SEQ ID NO 52843 | AAATTTTGTGTAGAAACGA | GGG | chr17 | 42900233 | 42900252 | 42900249 | + |
| SEQ ID NO 52844 | GAGGGTCTTGCTTTGTTGCC | CAG | chr17 | 42900251 | 42900270 | 42900267 | + |
| SEQ ID NO 52845 | AGGGTCTTGCTTTGTTGCCC | AGG | chr17 | 42900252 | 42900271 | 42900268 | + |
| SEQ ID NO 52846 | TCTTGCTTTGTTGCCCAGGC | TGG | chr17 | 42900256 | 42900275 | 42900272 | + |
| SEQ ID NO 52847 | CCAGGCTGGTCTCCAACTCC | TGG | chr17 | 42900270 | 42900289 | 42900286 | + |
| SEQ ID NO 52848 | GGTCTCCAACTCCTGGCTTC | AAG | chr17 | 42900277 | 42900296 | 42900293 | + |
| SEQ ID NO 52849 | GTCTCCAACTCCTGGCTTCA | AGG | chr17 | 42900278 | 42900297 | 42900294 | + |
| SEQ ID NO 52850 | TCTCCAACTCCTGGCTTCAA | GGG | chr17 | 42900279 | 42900298 | 42900295 | + |
| SEQ ID NO 52851 | TTCAAGGGATCCTCCCACCT | CAG | chr17 | 42900294 | 42900313 | 42900310 | + |
| SEQ ID NO 52852 | ACCTCAGCCTCCCAAATTGC | TGG | chr17 | 42900310 | 42900329 | 42900326 | + |
| SEQ ID NO 52853 | CCTCAGCCTCCCAAATTGCT | GGG | chr17 | 42900311 | 42900330 | 42900327 | + |
| SEQ ID NO 52854 | CTCCCAAATTGCTGGGATTA | CAG | chr17 | 42900318 | 42900337 | 42900334 | + |
| SEQ ID NO 52855 | TCCCAAATTGCTGGGATTAC | AGG | chr17 | 42900319 | 42900338 | 42900335 | + |
| SEQ ID NO 52856 | ATTGCTGGGATTACAGGTGT | GAG | chr17 | 42900325 | 42900344 | 42900341 | + |
| SEQ ID NO 52857 | CAGGTGTGAGCCACCACAAC | CAG | chr17 | 42900338 | 42900357 | 42900354 | + |
| SEQ ID NO 52858 | TGTGAGCCACCACAACCAGC | CAG | chr17 | 42900342 | 42900361 | 42900358 | + |
| SEQ ID NO 52859 | ACTTTACTAATTTTAAAATT | AAG | chr17 | 42900366 | 42900385 | 42900382 | + |
| SEQ ID NO 52860 | TTAAGAACTTAAAACTTGAA | TAG | chr17 | 42900384 | 42900403 | 42900400 | + |
| SEQ ID NO 52861 | GAACTTAAAACTTGAATAGC | TAG | chr17 | 42900388 | 42900407 | 42900404 | + |
| SEQ ID NO 52862 | ACTTAAAACTTGAATAGCTA | GAG | chr17 | 42900390 | 42900409 | 42900406 | + |
| SEQ ID NO 52863 | ACTTGAATAGCTAGAGCACC | AAG | chr17 | 42900397 | 42900416 | 42900413 | + |
| SEQ ID NO 52864 | ATTTTTCTTTGTCCCCAAAT | AAG | chr17 | 42900420 | 42900439 | 42900436 | + |
| SEQ ID NO 52865 | TCTTTGTCCCCAAATAAGTG | CAG | chr17 | 42900425 | 42900444 | 42900441 | + |
| SEQ ID NO 52866 | TCCCCAAATAAGTGCAGTTG | CAG | chr17 | 42900431 | 42900450 | 42900447 | + |
| SEQ ID NO 52867 | CCCCAAATAAGTGCAGTTGC | AGG | chr17 | 42900432 | 42900451 | 42900448 | + |
| SEQ ID NO 52868 | AATAAGTGCAGTTGCAGGCA | TAG | chr17 | 42900437 | 42900456 | 42900453 | + |
| SEQ ID NO 52869 | AGAAAATCTGACATCTTTGC | AAG | chr17 | 42900458 | 42900477 | 42900474 | + |
| SEQ ID NO 52870 | CATCTTTGCAAGAATCATCG | TGG | chr17 | 42900469 | 42900488 | 42900485 | + |
| SEQ ID NO 52871 | TGCAAGAATCATCGTGGATG | TAG | chr17 | 42900475 | 42900494 | 42900491 | + |
| SEQ ID NO 52872 | TAGACTCTGTCCTGTGTCTC | TGG | chr17 | 42900495 | 42900514 | 42900511 | + |
| SEQ ID NO 52873 | TCTGTCCTGTGTCTCTGGCC | TGG | chr17 | 42900500 | 42900519 | 42900516 | + |
| SEQ ID NO 52874 | CTGTGTCTCTGGCCTGGTTT | CGG | chr17 | 42900506 | 42900525 | 42900522 | + |
| SEQ ID NO 52875 | TGTGTCTCTGGCCTGGTTTC | GGG | chr17 | 42900507 | 42900526 | 42900523 | + |
| SEQ ID NO 52876 | GTGTCTCTGGCCTGGTTTCG | GGG | chr17 | 42900508 | 42900527 | 42900524 | + |
| SEQ ID NO 52877 | TCTGGCCTGGTTTCGGGGAC | CAG | chr17 | 42900513 | 42900532 | 42900529 | + |
| SEQ ID NO 52878 | CTGGCCTGGTTTCGGGGACC | AGG | chr17 | 42900514 | 42900533 | 42900530 | + |
| SEQ ID NO 52879 | GGCCTGGTTTCGGGGACCAG | GAG | chr17 | 42900516 | 42900535 | 42900532 | + |
| SEQ ID NO 52880 | GCCTGGTTTCGGGGACCAGG | AGG | chr17 | 42900517 | 42900536 | 42900533 | + |
| SEQ ID NO 52881 | CCTGGTTTCGGGGACCAGGA | GGG | chr17 | 42900518 | 42900537 | 42900534 | + |
| SEQ ID NO 52882 | GGTTTCGGGGACCAGGAGGG | CAG | chr17 | 42900521 | 42900540 | 42900537 | + |
| SEQ ID NO 52883 | GGGCAGACCCTTGCACTGCC | AAG | chr17 | 42900538 | 42900557 | 42900554 | + |

Figure 85 (Cont'd)

| | | | | | | | |
|---|---|---|---|---|---|---|---|
| SEQ ID NO 52884 | CAGACCCTTGCACTGCCAAG | AAG | chr17 | 42900541 | 42900560 | 42900557 | + |
| SEQ ID NO 52885 | CACTGCCAAGAAGCATGCCA | AAG | chr17 | 42900551 | 42900570 | 42900567 | + |
| SEQ ID NO 52886 | AGCATGCCAAAGTTAATCAT | TGG | chr17 | 42900562 | 42900581 | 42900578 | + |
| SEQ ID NO 52887 | AGTTAATCATTGGCCCTGCT | GAG | chr17 | 42900572 | 42900591 | 42900588 | + |
| SEQ ID NO 52888 | CATTGGCCCTGCTGAGTACA | TGG | chr17 | 42900579 | 42900598 | 42900595 | + |
| SEQ ID NO 52889 | CTGCTGAGTACATGGCCGAT | CAG | chr17 | 42900587 | 42900606 | 42900603 | + |
| SEQ ID NO 52890 | TGCTGAGTACATGGCCGATC | AGG | chr17 | 42900588 | 42900607 | 42900604 | + |
| SEQ ID NO 52891 | ACATGTTTGCATCAACCTAC | TGG | chr17 | 42900656 | 42900675 | 42900672 | + |
| SEQ ID NO 52892 | CACCTTTGATCAATACATTT | TAG | chr17 | 42900684 | 42900703 | 42900700 | + |
| SEQ ID NO 52893 | CAATACATTTTAGACAAACG | TGG | chr17 | 42900694 | 42900713 | 42900710 | + |
| SEQ ID NO 52894 | TTTAGACAAACGTGGTTTTT | GAG | chr17 | 42900702 | 42900721 | 42900718 | + |
| SEQ ID NO 52895 | AAACGTGGTTTTTGAGTCCA | AAG | chr17 | 42900709 | 42900728 | 42900725 | + |
| SEQ ID NO 52896 | TGGTTTTTGAGTCCAAAGAT | CAG | chr17 | 42900714 | 42900733 | 42900730 | + |
| SEQ ID NO 52897 | GGTTTTTGAGTCCAAAGATC | AGG | chr17 | 42900715 | 42900734 | 42900731 | + |
| SEQ ID NO 52898 | GTTTTTGAGTCCAAAGATCA | GGG | chr17 | 42900716 | 42900735 | 42900732 | + |
| SEQ ID NO 52899 | TTGAGTCCAAAGATCAGGGC | TGG | chr17 | 42900720 | 42900739 | 42900736 | + |
| SEQ ID NO 52900 | TGAGTCCAAAGATCAGGGCT | GGG | chr17 | 42900721 | 42900740 | 42900737 | + |
| SEQ ID NO 52901 | GGCTGGGTTGACCTGAATAC | TGG | chr17 | 42900737 | 42900756 | 42900753 | + |
| SEQ ID NO 52902 | GTTGACCTGAATACTGGATA | CAG | chr17 | 42900743 | 42900762 | 42900759 | + |
| SEQ ID NO 52903 | TTGACCTGAATACTGGATAC | AGG | chr17 | 42900744 | 42900763 | 42900760 | + |
| SEQ ID NO 52904 | TGACCTGAATACTGGATACA | GGG | chr17 | 42900745 | 42900764 | 42900761 | + |
| SEQ ID NO 52905 | TGGATACAGGGCATATAAAA | CAG | chr17 | 42900757 | 42900776 | 42900773 | + |
| SEQ ID NO 52906 | GGATACAGGGCATATAAAAC | AGG | chr17 | 42900758 | 42900777 | 42900774 | + |
| SEQ ID NO 52907 | GATACAGGGCATATAAAACA | GGG | chr17 | 42900759 | 42900778 | 42900775 | + |
| SEQ ID NO 52908 | ATACAGGGCATATAAAACAG | GGG | chr17 | 42900760 | 42900779 | 42900776 | + |
| SEQ ID NO 52909 | AGGGCATATAAAACAGGGGC | AAG | chr17 | 42900764 | 42900783 | 42900780 | + |
| SEQ ID NO 52910 | GGGCATATAAAACAGGGGCA | AGG | chr17 | 42900765 | 42900784 | 42900781 | + |
| SEQ ID NO 52911 | TATAAAACAGGGGCAAGGCA | CAG | chr17 | 42900770 | 42900789 | 42900786 | + |
| SEQ ID NO 52912 | AGGGGCAAGGCACAGACTCA | TAG | chr17 | 42900778 | 42900797 | 42900794 | + |
| SEQ ID NO 52913 | GGCAAGGCACAGACTCATAG | CAG | chr17 | 42900781 | 42900800 | 42900797 | + |
| SEQ ID NO 52914 | CAAGGCACAGACTCATAGCA | GAG | chr17 | 42900783 | 42900802 | 42900799 | + |
| SEQ ID NO 52915 | ATAGCAGAGCAATCACCACC | AAG | chr17 | 42900797 | 42900816 | 42900813 | + |
| SEQ ID NO 52916 | AGAGCAATCACCACCAAGCC | TGG | chr17 | 42900802 | 42900821 | 42900818 | + |
| SEQ ID NO 52917 | ACCAAGCCTGGAATAACTGC | AAG | chr17 | 42900814 | 42900833 | 42900830 | + |
| SEQ ID NO 52918 | CCAAGCCTGGAATAACTGCA | AGG | chr17 | 42900815 | 42900834 | 42900831 | + |
| SEQ ID NO 52919 | CAAGCCTGGAATAACTGCAA | GGG | chr17 | 42900816 | 42900835 | 42900832 | + |
| SEQ ID NO 52920 | GGCTCTGCTGACATCTTCCT | GAG | chr17 | 42900837 | 42900856 | 42900853 | + |
| SEQ ID NO 52921 | GCTCTGCTGACATCTTCCTG | AGG | chr17 | 42900838 | 42900857 | 42900854 | + |
| SEQ ID NO 52922 | TGACATCTTCCTGAGGTGCC | AAG | chr17 | 42900845 | 42900864 | 42900861 | + |
| SEQ ID NO 52923 | GACATCTTCCTGAGGTGCCA | AGG | chr17 | 42900846 | 42900865 | 42900862 | + |
| SEQ ID NO 52924 | TCCTGAGGTGCCAAGGAAAT | GAG | chr17 | 42900853 | 42900872 | 42900869 | + |
| SEQ ID NO 52925 | CCTGAGGTGCCAAGGAAATG | AGG | chr17 | 42900854 | 42900873 | 42900870 | + |
| SEQ ID NO 52926 | AGGTGCCAAGGAAATGAGGA | TGG | chr17 | 42900858 | 42900877 | 42900874 | + |
| SEQ ID NO 52927 | GTGCCAAGGAAATGAGGATG | GAG | chr17 | 42900860 | 42900879 | 42900876 | + |
| SEQ ID NO 52928 | TGCCAAGGAAATGAGGATGG | AGG | chr17 | 42900861 | 42900880 | 42900877 | + |
| SEQ ID NO 52929 | CAAGGAAATGAGGATGGAGG | AAG | chr17 | 42900864 | 42900883 | 42900880 | + |
| SEQ ID NO 52930 | AAGGAAATGAGGATGGAGGA | AGG | chr17 | 42900865 | 42900884 | 42900881 | + |

Figure 85 (Cont'd)

| | | | | | | | |
|---|---|---|---|---|---|---|---|
| SEQ ID NO 52931 | ATGAATGTTCTCCATGACTT | TGG | chr17 | 42900889 | 42900908 | 42900905 | + |
| SEQ ID NO 52932 | TGAATGTTCTCCATGACTTT | GGG | chr17 | 42900890 | 42900909 | 42900906 | + |
| SEQ ID NO 52933 | TTCTCCATGACTTTGGGATC | CAG | chr17 | 42900896 | 42900915 | 42900912 | + |
| SEQ ID NO 52934 | TCCAGTCAACACATTACCTC | CAG | chr17 | 42900914 | 42900933 | 42900930 | + |
| SEQ ID NO 52935 | CCAGTCAACACATTACCTCC | AGG | chr17 | 42900915 | 42900934 | 42900931 | + |
| SEQ ID NO 52936 | TTACCTCCAGGTGAATTACC | AAG | chr17 | 42900927 | 42900946 | 42900943 | + |
| SEQ ID NO 52937 | AGGTGAATTACCAAGACTCC | CAG | chr17 | 42900935 | 42900954 | 42900951 | + |
| SEQ ID NO 52938 | GGTGAATTACCAAGACTCCC | AGG | chr17 | 42900936 | 42900955 | 42900952 | + |
| SEQ ID NO 52939 | ATTACCAAGACTCCCAGGAC | TGG | chr17 | 42900941 | 42900960 | 42900957 | + |
| SEQ ID NO 52940 | CTCCCAGGACTGGTTCATCT | TGG | chr17 | 42900951 | 42900970 | 42900967 | + |
| SEQ ID NO 52941 | CATCTTGGTGTCCGTGATCG | CAG | chr17 | 42900966 | 42900985 | 42900982 | + |
| SEQ ID NO 52942 | GTGTCCGTGATCGCAGACCT | CAG | chr17 | 42900973 | 42900992 | 42900989 | + |
| SEQ ID NO 52943 | TGTCCGTGATCGCAGACCTC | AGG | chr17 | 42900974 | 42900993 | 42900990 | + |
| SEQ ID NO 52944 | TCTACGTCCTCTTCCCCATC | TGG | chr17 | 42901004 | 42901023 | 42901020 | + |
| SEQ ID NO 52945 | TCCCCATCTGGTTCCATCTT | CAG | chr17 | 42901016 | 42901035 | 42901032 | + |
| SEQ ID NO 52946 | CCCCATCTGGTTCCATCTTC | AGG | chr17 | 42901017 | 42901036 | 42901033 | + |
| SEQ ID NO 52947 | CATCTGGTTCCATCTTCAGG | AAG | chr17 | 42901020 | 42901039 | 42901036 | + |
| SEQ ID NO 52948 | GTTCCATCTTCAGGAAGCTG | TGG | chr17 | 42901026 | 42901045 | 42901042 | + |
| SEQ ID NO 52949 | TTCCATCTTCAGGAAGCTGT | GGG | chr17 | 42901027 | 42901046 | 42901043 | + |
| SEQ ID NO 52950 | CTGTGGGCATTAAACTCCTT | TGG | chr17 | 42901043 | 42901062 | 42901059 | + |
| SEQ ID NO 52951 | TGTGGGCATTAAACTCCTTT | GGG | chr17 | 42901044 | 42901063 | 42901060 | + |
| SEQ ID NO 52952 | GGGCATTAAACTCCTTTGGG | TAG | chr17 | 42901047 | 42901066 | 42901063 | + |
| SEQ ID NO 52953 | CTCCTTTGGGTAGCTGTGAT | TGG | chr17 | 42901057 | 42901076 | 42901073 | + |
| SEQ ID NO 52954 | CCTTTGGGTAGCTGTGATTG | GAG | chr17 | 42901059 | 42901078 | 42901075 | + |
| SEQ ID NO 52955 | GGGTAGCTGTGATTGGAGAC | TGG | chr17 | 42901064 | 42901083 | 42901080 | + |
| SEQ ID NO 52956 | ACTGGCTCAACCTCGTCTTT | AAG | chr17 | 42901082 | 42901101 | 42901098 | + |
| SEQ ID NO 52957 | GGCTCAACCTCGTCTTTAAG | TGG | chr17 | 42901085 | 42901104 | 42901101 | + |
| SEQ ID NO 52958 | CAACCTCGTCTTTAAGTGGT | AAG | chr17 | 42901089 | 42901108 | 42901105 | + |
| SEQ ID NO 52959 | TTTAAGTGGTAAGAACCATA | TAG | chr17 | 42901099 | 42901118 | 42901115 | + |
| SEQ ID NO 52960 | TAAGTGGTAAGAACCATATA | GAG | chr17 | 42901101 | 42901120 | 42901117 | + |
| SEQ ID NO 52961 | AGTGGTAAGAACCATATAGA | GAG | chr17 | 42901103 | 42901122 | 42901119 | + |
| SEQ ID NO 52962 | GTGGTAAGAACCATATAGAG | AGG | chr17 | 42901104 | 42901123 | 42901120 | + |
| SEQ ID NO 52963 | GGTAAGAACCATATAGAGAG | GAG | chr17 | 42901106 | 42901125 | 42901122 | + |
| SEQ ID NO 52964 | GAACCATATAGAGGAGAT | CAG | chr17 | 42901111 | 42901130 | 42901127 | + |
| SEQ ID NO 52965 | CATATAGAGAGGAGATCAGC | AAG | chr17 | 42901115 | 42901134 | 42901131 | + |
| SEQ ID NO 52966 | AGAGAGGAGATCAGCAAGAA | AAG | chr17 | 42901120 | 42901139 | 42901136 | + |
| SEQ ID NO 52967 | AGAGGAGATCAGCAAGAAAA | GAG | chr17 | 42901122 | 42901141 | 42901138 | + |
| SEQ ID NO 52968 | GAGGAGATCAGCAAGAAAAG | AGG | chr17 | 42901123 | 42901142 | 42901139 | + |
| SEQ ID NO 52969 | AGATCAGCAAGAAAAGAGGC | TGG | chr17 | 42901127 | 42901146 | 42901143 | + |
| SEQ ID NO 52970 | CTCTCGCAATGTCTGTCCAT | CAG | chr17 | 42901156 | 42901175 | 42901172 | + |
| SEQ ID NO 52971 | TCGCAATGTCTGTCCATCAG | AAG | chr17 | 42901159 | 42901178 | 42901175 | + |
| SEQ ID NO 52972 | CCATCAGAAGTTGCTTTCCC | CAG | chr17 | 42901172 | 42901191 | 42901188 | + |
| SEQ ID NO 52973 | CATCAGAAGTTGCTTTCCCC | AGG | chr17 | 42901173 | 42901192 | 42901189 | + |
| SEQ ID NO 52974 | GTTGCTTTCCCCAGGCTATT | CAG | chr17 | 42901181 | 42901200 | 42901197 | + |
| SEQ ID NO 52975 | TTGCTTTCCCCAGGCTATTC | AGG | chr17 | 42901182 | 42901201 | 42901198 | + |
| SEQ ID NO 52976 | CTTTCCCCAGGCTATTCAGG | AAG | chr17 | 42901185 | 42901204 | 42901201 | + |
| SEQ ID NO 52977 | CCAGGCTATTCAGGAAGCCA | CGG | chr17 | 42901191 | 42901210 | 42901207 | + |

Figure 85 (Cont'd)

| | | | | | | | |
|---|---|---|---|---|---|---|---|
| SEQ ID NO 52978 | CAGGCTATTCAGGAAGCCAC | GGG | chr17 | 42901192 | 42901211 | 42901208 | + |
| SEQ ID NO 52979 | CCAACCCTCTCTCTGACTT | TGG | chr17 | 42901227 | 42901246 | 42901243 | + |
| SEQ ID NO 52980 | GACTTTGGATCATCTACATA | AAG | chr17 | 42901242 | 42901261 | 42901258 | + |
| SEQ ID NO 52981 | ACTTTGGATCATCTACATAA | AGG | chr17 | 42901243 | 42901262 | 42901259 | + |
| SEQ ID NO 52982 | CTTTGGATCATCTACATAAA | GGG | chr17 | 42901244 | 42901263 | 42901260 | + |
| SEQ ID NO 52983 | TTTGGATCATCTACATAAAG | GGG | chr17 | 42901245 | 42901264 | 42901261 | + |
| SEQ ID NO 52984 | TTGGATCATCTACATAAAGG | GGG | chr17 | 42901246 | 42901265 | 42901262 | + |
| SEQ ID NO 52985 | GATCATCTACATAAAGGGGG | AAG | chr17 | 42901249 | 42901268 | 42901265 | + |
| SEQ ID NO 52986 | ATCTACATAAAGGGGGAAGA | CAG | chr17 | 42901253 | 42901272 | 42901269 | + |
| SEQ ID NO 52987 | GAAGACAGAAAAAATCCTAC | CAG | chr17 | 42901268 | 42901287 | 42901284 | + |
| SEQ ID NO 52988 | ACAGAAAAAATCCTACCAGT | GAG | chr17 | 42901272 | 42901291 | 42901288 | + |
| SEQ ID NO 52989 | CTACCAGTGAGTTGAAAATA | CAG | chr17 | 42901284 | 42901303 | 42901300 | + |
| SEQ ID NO 52990 | TACCAGTGAGTTGAAAATAC | AGG | chr17 | 42901285 | 42901304 | 42901301 | + |
| SEQ ID NO 52991 | AGTGAGTTGAAAATACAGGA | AAG | chr17 | 42901289 | 42901308 | 42901305 | + |
| SEQ ID NO 52992 | ACAGGAAAGCCTATTTCATA | TGG | chr17 | 42901303 | 42901322 | 42901319 | + |
| SEQ ID NO 52993 | CAGGAAAGCCTATTTCATAT | GGG | chr17 | 42901304 | 42901323 | 42901320 | + |
| SEQ ID NO 52994 | AGCCTATTTCATATGGGTTA | AAG | chr17 | 42901310 | 42901329 | 42901326 | + |
| SEQ ID NO 52995 | GCCTATTTCATATGGGTTAA | AGG | chr17 | 42901311 | 42901330 | 42901327 | + |
| SEQ ID NO 52996 | CCTATTTCATATGGGTTAAA | GGG | chr17 | 42901312 | 42901331 | 42901328 | + |
| SEQ ID NO 52997 | ATTTCATATGGGTTAAAGGG | TAG | chr17 | 42901315 | 42901334 | 42901331 | + |
| SEQ ID NO 52998 | TTTCATATGGGTTAAAGGGT | AGG | chr17 | 42901316 | 42901335 | 42901332 | + |
| SEQ ID NO 52999 | ATATGGGTTAAAGGGTAGGA | CAG | chr17 | 42901320 | 42901339 | 42901336 | + |
| SEQ ID NO 53000 | GGACAGTTGAATTTCGTGAA | AAG | chr17 | 42901337 | 42901356 | 42901353 | + |
| SEQ ID NO 53001 | TTGAATTTCGTGAAAAGTCT | GAG | chr17 | 42901343 | 42901362 | 42901359 | + |
| SEQ ID NO 53002 | CGTGAAAAGTCTGAGTTATA | TAG | chr17 | 42901351 | 42901370 | 42901367 | + |
| SEQ ID NO 53003 | GTGAAAAGTCTGAGTTATAT | AGG | chr17 | 42901352 | 42901371 | 42901368 | + |
| SEQ ID NO 53004 | GTCTGAGTTATATAGGCTTT | GAG | chr17 | 42901359 | 42901378 | 42901375 | + |
| SEQ ID NO 53005 | AGTTATATAGGCTTTGAGCA | AAG | chr17 | 42901364 | 42901383 | 42901380 | + |
| SEQ ID NO 53006 | TTATATAGGCTTTGAGCAAA | GAG | chr17 | 42901366 | 42901385 | 42901382 | + |
| SEQ ID NO 53007 | CTTTGAGCAAAGAGTTTTAT | TAG | chr17 | 42901375 | 42901394 | 42901391 | + |
| SEQ ID NO 53008 | CAAAGAGTTTTATTAGTATG | AAG | chr17 | 42901382 | 42901401 | 42901398 | + |
| SEQ ID NO 53009 | AGAGTTTTATTAGTATGAAG | CAG | chr17 | 42901385 | 42901404 | 42901401 | + |
| SEQ ID NO 53010 | GTTTTATTAGTATGAAGCAG | AAG | chr17 | 42901388 | 42901407 | 42901404 | + |
| SEQ ID NO 53011 | TTTATTAGTATGAAGCAGAA | GAG | chr17 | 42901390 | 42901409 | 42901406 | + |
| SEQ ID NO 53012 | TTATTAGTATGAAGCAGAAG | AGG | chr17 | 42901391 | 42901410 | 42901407 | + |
| SEQ ID NO 53013 | GAAGCAGAAGAGGTAACATA | AAG | chr17 | 42901401 | 42901420 | 42901417 | + |
| SEQ ID NO 53014 | CAGAAGAGGTAACATAAAGA | AAG | chr17 | 42901405 | 42901424 | 42901421 | + |
| SEQ ID NO 53015 | GTAACATAAAGAAAGATGTA | TGG | chr17 | 42901413 | 42901432 | 42901429 | + |
| SEQ ID NO 53016 | TAACATAAAGAAAGATGTAT | GGG | chr17 | 42901414 | 42901433 | 42901430 | + |
| SEQ ID NO 53017 | AACATAAAGAAAGATGTATG | GGG | chr17 | 42901415 | 42901434 | 42901431 | + |
| SEQ ID NO 53018 | TAAAGAAAGATGTATGGGGC | CAG | chr17 | 42901419 | 42901438 | 42901435 | + |
| SEQ ID NO 53019 | AAAGAAAGATGTATGGGGCC | AGG | chr17 | 42901420 | 42901439 | 42901436 | + |
| SEQ ID NO 53020 | AAGATGTATGGGGCCAGGCA | TGG | chr17 | 42901425 | 42901444 | 42901441 | + |
| SEQ ID NO 53021 | ATGTATGGGGCCAGGCATGG | TGG | chr17 | 42901428 | 42901447 | 42901444 | + |
| SEQ ID NO 53022 | GTGGCTCACACCTGTAATCC | CAG | chr17 | 42901447 | 42901466 | 42901463 | + |
| SEQ ID NO 53023 | CACCTGTAATCCCAGCACTT | TGG | chr17 | 42901455 | 42901474 | 42901471 | + |
| SEQ ID NO 53024 | ACCTGTAATCCCAGCACTTT | GGG | chr17 | 42901456 | 42901475 | 42901472 | + |

Figure 85 (Cont'd)

| SEQ ID NO 53025 | CTGTAATCCCAGCACTTTGG | GAG | chr17 | 42901458 | 42901477 | 42901474 | + |
| SEQ ID NO 53026 | TGTAATCCCAGCACTTTGGG | AGG | chr17 | 42901459 | 42901478 | 42901475 | + |
| SEQ ID NO 53027 | TCCCAGCACTTTGGGAGGCC | GAG | chr17 | 42901464 | 42901483 | 42901480 | + |
| SEQ ID NO 53028 | CCCAGCACTTTGGGAGGCCG | AGG | chr17 | 42901465 | 42901484 | 42901481 | + |
| SEQ ID NO 53029 | AGCACTTTGGGAGGCCGAGG | TGG | chr17 | 42901468 | 42901487 | 42901484 | + |
| SEQ ID NO 53030 | GCACTTTGGGAGGCCGAGGT | GGG | chr17 | 42901469 | 42901488 | 42901485 | + |
| SEQ ID NO 53031 | CGAGGTGGGCGAATCACTCC | TGG | chr17 | 42901483 | 42901502 | 42901499 | + |
| SEQ ID NO 53032 | GAGGTGGGCGAATCACTCCT | GGG | chr17 | 42901484 | 42901503 | 42901500 | + |
| SEQ ID NO 53033 | GAATCACTCCTGGGTGAACT | CAG | chr17 | 42901493 | 42901512 | 42901509 | + |
| SEQ ID NO 53034 | AATCACTCCTGGGTGAACTC | AGG | chr17 | 42901494 | 42901513 | 42901510 | + |
| SEQ ID NO 53035 | TCACTCCTGGGTGAACTCAG | GAG | chr17 | 42901496 | 42901515 | 42901512 | + |
| SEQ ID NO 53036 | CTGGGTGAACTCAGGAGTTC | AAG | chr17 | 42901502 | 42901521 | 42901518 | + |
| SEQ ID NO 53037 | TGAACTCAGGAGTTCAAGAC | CAG | chr17 | 42901507 | 42901526 | 42901523 | + |
| SEQ ID NO 53038 | TCAGGAGTTCAAGACCAGCC | TGG | chr17 | 42901512 | 42901531 | 42901528 | + |
| SEQ ID NO 53039 | CAGGAGTTCAAGACCAGCCT | GGG | chr17 | 42901513 | 42901532 | 42901529 | + |
| SEQ ID NO 53040 | CAAGACCAGCCTGGGCAACA | TGG | chr17 | 42901521 | 42901540 | 42901537 | + |
| SEQ ID NO 53041 | TACAAAAACATTACGAAAAT | TAG | chr17 | 42901558 | 42901577 | 42901574 | + |
| SEQ ID NO 53042 | AAAACATTACGAAAATTAGC | TGG | chr17 | 42901562 | 42901581 | 42901578 | + |
| SEQ ID NO 53043 | AAACATTACGAAAATTAGCT | GGG | chr17 | 42901563 | 42901582 | 42901579 | + |
| SEQ ID NO 53044 | CGAAAATTAGCTGGGCGTGT | TGG | chr17 | 42901571 | 42901590 | 42901587 | + |
| SEQ ID NO 53045 | AGCTGGGCGTGTTGGTGCTG | TAG | chr17 | 42901579 | 42901598 | 42901595 | + |
| SEQ ID NO 53046 | GCGTGTTGGTGCTGTAGTCC | CAG | chr17 | 42901585 | 42901604 | 42901601 | + |
| SEQ ID NO 53047 | GTGCTGTAGTCCCAGCTACT | CAG | chr17 | 42901593 | 42901612 | 42901609 | + |
| SEQ ID NO 53048 | TGCTGTAGTCCCAGCTACTC | AGG | chr17 | 42901594 | 42901613 | 42901610 | + |
| SEQ ID NO 53049 | CTGTAGTCCCAGCTACTCAG | GAG | chr17 | 42901596 | 42901615 | 42901612 | + |
| SEQ ID NO 53050 | TGTAGTCCCAGCTACTCAGG | AGG | chr17 | 42901597 | 42901616 | 42901613 | + |
| SEQ ID NO 53051 | TCCCAGCTACTCAGGAGGCT | GAG | chr17 | 42901602 | 42901621 | 42901618 | + |
| SEQ ID NO 53052 | CCCAGCTACTCAGGAGGCTG | AGG | chr17 | 42901603 | 42901622 | 42901619 | + |
| SEQ ID NO 53053 | GCTACTCAGGAGGCTGAGGT | GAG | chr17 | 42901607 | 42901626 | 42901623 | + |
| SEQ ID NO 53054 | TACTCAGGAGGCTGAGGTGA | GAG | chr17 | 42901609 | 42901628 | 42901625 | + |
| SEQ ID NO 53055 | ACTCAGGAGGCTGAGGTGAG | AGG | chr17 | 42901610 | 42901629 | 42901626 | + |
| SEQ ID NO 53056 | CAGGAGGCTGAGGTGAGAGG | CGG | chr17 | 42901613 | 42901632 | 42901629 | + |
| SEQ ID NO 53057 | GGAGGCTGAGGTGAGAGGCG | GAG | chr17 | 42901615 | 42901634 | 42901631 | + |
| SEQ ID NO 53058 | GAGGCTGAGGTGAGAGGCGG | AGG | chr17 | 42901616 | 42901635 | 42901632 | + |
| SEQ ID NO 53059 | GGCTGAGGTGAGAGGCGGAG | GAG | chr17 | 42901618 | 42901637 | 42901634 | + |
| SEQ ID NO 53060 | GCTGAGGTGAGAGGCGGAGG | AGG | chr17 | 42901619 | 42901638 | 42901635 | + |
| SEQ ID NO 53061 | GTGAGAGGCGGAGGAGGTTG | CAG | chr17 | 42901625 | 42901644 | 42901641 | + |
| SEQ ID NO 53062 | GAGGCGGAGGAGGTTGCAGT | GAG | chr17 | 42901629 | 42901648 | 42901645 | + |
| SEQ ID NO 53063 | GGAGGAGGTTGCAGTGAGTC | AAG | chr17 | 42901634 | 42901653 | 42901650 | + |
| SEQ ID NO 53064 | AAGATCATGCCACTGCACTC | CAG | chr17 | 42901654 | 42901673 | 42901670 | + |
| SEQ ID NO 53065 | CATGCCACTGCACTCCAGCC | TGG | chr17 | 42901659 | 42901678 | 42901675 | + |
| SEQ ID NO 53066 | ATGCCACTGCACTCCAGCCT | GGG | chr17 | 42901660 | 42901679 | 42901676 | + |
| SEQ ID NO 53067 | CTGCACTCCAGCCTGGGCAA | CAG | chr17 | 42901666 | 42901685 | 42901682 | + |
| SEQ ID NO 53068 | GCACTCCAGCCTGGGCAACA | GAG | chr17 | 42901668 | 42901687 | 42901684 | + |
| SEQ ID NO 53069 | TCCAGCCTGGGCAACAGAGT | AAG | chr17 | 42901672 | 42901691 | 42901688 | + |
| SEQ ID NO 53070 | CCTGTCTCAAAAAAAAAAAA | AAG | chr17 | 42901697 | 42901716 | 42901713 | + |
| SEQ ID NO 53071 | TCTCAAAAAAAAAAAAAAGA | TAG | chr17 | 42901701 | 42901720 | 42901717 | + |

Figure 85 (Cont'd)

| | | | | | | | |
|---|---|---|---|---|---|---|---|
| SEQ ID NO 53072 | TGATGTATGCTGTATGAAAA | AAG | chr17 | 42901725 | 42901744 | 42901741 | + |
| SEQ ID NO 53073 | GATGTATGCTGTATGAAAAA | AGG | chr17 | 42901726 | 42901745 | 42901742 | + |
| SEQ ID NO 53074 | GTATGAAAAAGGAAACACA | CAG | chr17 | 42901736 | 42901755 | 42901752 | + |
| SEQ ID NO 53075 | GAAACACACAGATGATTCAA | CAG | chr17 | 42901748 | 42901767 | 42901764 | + |
| SEQ ID NO 53076 | TGATTCAACAGCCTGTTTTG | TGG | chr17 | 42901760 | 42901779 | 42901776 | + |
| SEQ ID NO 53077 | GATTCAACAGCCTGTTTTGT | GGG | chr17 | 42901761 | 42901780 | 42901777 | + |
| SEQ ID NO 53078 | ATTCAACAGCCTGTTTTGTG | GGG | chr17 | 42901762 | 42901781 | 42901778 | + |
| SEQ ID NO 53079 | CTGTTTTGTGGGGTAATGAA | AAG | chr17 | 42901772 | 42901791 | 42901788 | + |
| SEQ ID NO 53080 | GGGGTAATGAAAAGTCACCC | TGG | chr17 | 42901781 | 42901800 | 42901797 | + |
| SEQ ID NO 53081 | GGGTAATGAAAAGTCACCCT | GGG | chr17 | 42901782 | 42901801 | 42901798 | + |
| SEQ ID NO 53082 | TGAAAAGTCACCCTGGGAAC | TGG | chr17 | 42901788 | 42901807 | 42901804 | + |
| SEQ ID NO 53083 | GAAAAGTCACCCTGGGAACT | GGG | chr17 | 42901789 | 42901808 | 42901805 | + |
| SEQ ID NO 53084 | TCACCCTGGGAACTGGGCTC | CAG | chr17 | 42901795 | 42901814 | 42901811 | + |
| SEQ ID NO 53085 | ACCCACCAACTACATGTCCT | TGG | chr17 | 42901831 | 42901850 | 42901847 | + |
| SEQ ID NO 53086 | ACCAACTACATGTCCTTGGC | AAG | chr17 | 42901835 | 42901854 | 42901851 | + |
| SEQ ID NO 53087 | GCAAGTCATATCAATTATCT | GAG | chr17 | 42901853 | 42901872 | 42901869 | + |
| SEQ ID NO 53088 | TCTGTTTTATAATCTACAAA | TAG | chr17 | 42901878 | 42901897 | 42901894 | + |
| SEQ ID NO 53089 | CTGTTTTATAATCTACAAAT | AGG | chr17 | 42901879 | 42901898 | 42901895 | + |
| SEQ ID NO 53090 | ATCTACAAATAGGTTATCTC | TGG | chr17 | 42901889 | 42901908 | 42901905 | + |
| SEQ ID NO 53091 | TACAAATAGGTTATCTCTGG | CAG | chr17 | 42901892 | 42901911 | 42901908 | + |
| SEQ ID NO 53092 | TCTGGCAGCTTAATAATAAT | CAG | chr17 | 42901907 | 42901926 | 42901923 | + |
| SEQ ID NO 53093 | CTGGCAGCTTAATAATAATC | AGG | chr17 | 42901908 | 42901927 | 42901924 | + |
| SEQ ID NO 53094 | TGGCAGCTTAATAATAATCA | GGG | chr17 | 42901909 | 42901928 | 42901925 | + |
| SEQ ID NO 53095 | CAGGGTTAACATTTATTAAA | CAG | chr17 | 42901927 | 42901946 | 42901943 | + |
| SEQ ID NO 53096 | ATTTATTAAACAGTGTGTGC | CAG | chr17 | 42901937 | 42901956 | 42901953 | + |
| SEQ ID NO 53097 | TGTGCTATGTGCTTTTCTGT | GAG | chr17 | 42901964 | 42901983 | 42901980 | + |
| SEQ ID NO 53098 | GTGCTATGTGCTTTTCTGTG | AGG | chr17 | 42901965 | 42901984 | 42901981 | + |
| SEQ ID NO 53099 | CTATGTGCTTTTCTGTGAGG | TAG | chr17 | 42901968 | 42901987 | 42901984 | + |
| SEQ ID NO 53100 | GAGGTAGTTACTGCTATTTA | CAG | chr17 | 42901984 | 42902003 | 42902000 | + |
| SEQ ID NO 53101 | GTTACTGCTATTTACAGAAA | CAG | chr17 | 42901990 | 42902009 | 42902006 | + |
| SEQ ID NO 53102 | ACTGCTATTTACAGAAACAG | TAG | chr17 | 42901993 | 42902012 | 42902009 | + |
| SEQ ID NO 53103 | ATTTACAGAAACAGTAGATG | CAG | chr17 | 42901999 | 42902018 | 42902015 | + |
| SEQ ID NO 53104 | TTACAGAAACAGTAGATGCA | GAG | chr17 | 42902001 | 42902020 | 42902017 | + |
| SEQ ID NO 53105 | AAACAGTAGATGCAGAGACC | AAG | chr17 | 42902007 | 42902026 | 42902023 | + |
| SEQ ID NO 53106 | AACAGTAGATGCAGAGACCA | AGG | chr17 | 42902008 | 42902027 | 42902024 | + |
| SEQ ID NO 53107 | GATGCAGAGACCAAGGTGCT | GAG | chr17 | 42902015 | 42902034 | 42902031 | + |
| SEQ ID NO 53108 | AAGGTGCTGAGTTAAATGAT | TAG | chr17 | 42902027 | 42902046 | 42902043 | + |
| SEQ ID NO 53109 | AGGTGCTGAGTTAAATGATT | AGG | chr17 | 42902028 | 42902047 | 42902044 | + |
| SEQ ID NO 53110 | AGTTAAATGATTAGGCCAAC | AAG | chr17 | 42902036 | 42902055 | 42902052 | + |
| SEQ ID NO 53111 | GTTAAATGATTAGGCCAACA | AGG | chr17 | 42902037 | 42902056 | 42902053 | + |
| SEQ ID NO 53112 | AATGATTAGGCCAACAAGGT | TAG | chr17 | 42902041 | 42902060 | 42902057 | + |
| SEQ ID NO 53113 | CAACAAGGTTAGTACATGCC | GAG | chr17 | 42902052 | 42902071 | 42902068 | + |
| SEQ ID NO 53114 | AAGGTTAGTACATGCCGAGC | CAG | chr17 | 42902056 | 42902075 | 42902072 | + |
| SEQ ID NO 53115 | AGGTTAGTACATGCCGAGCC | AGG | chr17 | 42902057 | 42902076 | 42902073 | + |
| SEQ ID NO 53116 | TAGTACATGCCGAGCCAGGA | TGG | chr17 | 42902061 | 42902080 | 42902077 | + |
| SEQ ID NO 53117 | TACATGCCGAGCCAGGATGG | AAG | chr17 | 42902064 | 42902083 | 42902080 | + |
| SEQ ID NO 53118 | GCCGAGCCAGGATGGAAGCC | CAG | chr17 | 42902069 | 42902088 | 42902085 | + |

Figure 85 (Cont'd)

| SEQ ID NO 53119 | CCGAGCCAGGATGGAAGCCC | AGG | chr17 | 42902070 | 42902089 | 42902086 | + |
| SEQ ID NO 53120 | AGCCAGGATGGAAGCCCAGG | TAG | chr17 | 42902073 | 42902092 | 42902089 | + |
| SEQ ID NO 53121 | GCCAGGATGGAAGCCCAGGT | AGG | chr17 | 42902074 | 42902093 | 42902090 | + |
| SEQ ID NO 53122 | AGGATGGAAGCCCAGGTAGG | CAG | chr17 | 42902077 | 42902096 | 42902093 | + |
| SEQ ID NO 53123 | GGATGGAAGCCCAGGTAGGC | AGG | chr17 | 42902078 | 42902097 | 42902094 | + |
| SEQ ID NO 53124 | GGAAGCCCAGGTAGGCAGGC | TGG | chr17 | 42902082 | 42902101 | 42902098 | + |
| SEQ ID NO 53125 | GGTAGGCAGGCTGGCTTCCG | CGG | chr17 | 42902091 | 42902110 | 42902107 | + |
| SEQ ID NO 53126 | CTTATGAACTATGTTACGTC | CAG | chr17 | 42902121 | 42902140 | 42902137 | + |
| SEQ ID NO 53127 | GTGCTGATAAACTGACTCTC | TGG | chr17 | 42902143 | 42902162 | 42902159 | + |
| SEQ ID NO 53128 | TGCTGATAAACTGACTCTCT | GGG | chr17 | 42902144 | 42902163 | 42902160 | + |
| SEQ ID NO 53129 | GCTGATAAACTGACTCTCTG | GGG | chr17 | 42902145 | 42902164 | 42902161 | + |
| SEQ ID NO 53130 | TGATAAACTGACTCTCTGGG | GAG | chr17 | 42902147 | 42902166 | 42902163 | + |
| SEQ ID NO 53131 | TAAACTGACTCTCTGGGGAG | CAG | chr17 | 42902150 | 42902169 | 42902166 | + |
| SEQ ID NO 53132 | AAACTGACTCTCTGGGGAGC | AGG | chr17 | 42902151 | 42902170 | 42902167 | + |
| SEQ ID NO 53133 | AACTGACTCTCTGGGGAGCA | GGG | chr17 | 42902152 | 42902171 | 42902168 | + |
| SEQ ID NO 53134 | ACTGACTCTCTGGGGAGCAG | GGG | chr17 | 42902153 | 42902172 | 42902169 | + |
| SEQ ID NO 53135 | ACTCTCTGGGGAGCAGGGGA | AAG | chr17 | 42902157 | 42902176 | 42902173 | + |
| SEQ ID NO 53136 | GGGGAGCAGGGGAAAGCCCT | GAG | chr17 | 42902164 | 42902183 | 42902180 | + |
| SEQ ID NO 53137 | GCAGGGGAAAGCCCTGAGTT | TAG | chr17 | 42902169 | 42902188 | 42902185 | + |
| SEQ ID NO 53138 | TCACGTAAACATTCCCATTC | TGG | chr17 | 42902208 | 42902227 | 42902224 | + |
| SEQ ID NO 53139 | TTTCTTTTGTTTGTTTGTTT | GAG | chr17 | 42902247 | 42902266 | 42902263 | + |
| SEQ ID NO 53140 | TTTTGTTTGTTTGTTTGAGA | TGG | chr17 | 42902251 | 42902270 | 42902267 | + |
| SEQ ID NO 53141 | TTGTTTGTTTGTTTGAGATG | GAG | chr17 | 42902253 | 42902272 | 42902269 | + |
| SEQ ID NO 53142 | TGGAGTCTCGCACTGTTGCC | TGG | chr17 | 42902271 | 42902290 | 42902287 | + |
| SEQ ID NO 53143 | GTCTCGCACTGTTGCCTGGC | TGG | chr17 | 42902275 | 42902294 | 42902291 | + |
| SEQ ID NO 53144 | CTCGCACTGTTGCCTGGCTG | GAG | chr17 | 42902277 | 42902296 | 42902293 | + |
| SEQ ID NO 53145 | GTTGCCTGGCTGGAGTGCAA | TGG | chr17 | 42902285 | 42902304 | 42902301 | + |
| SEQ ID NO 53146 | GGAGTGCAATGGTGCAATCT | CAG | chr17 | 42902296 | 42902315 | 42902312 | + |
| SEQ ID NO 53147 | CACTGCAACCTCTGCCTCTC | CGG | chr17 | 42902321 | 42902340 | 42902337 | + |
| SEQ ID NO 53148 | AACCTCTGCCTCTCCGGTTC | AAG | chr17 | 42902327 | 42902346 | 42902343 | + |
| SEQ ID NO 53149 | TTCAAGTGATTCTCCTGCCT | CAG | chr17 | 42902344 | 42902363 | 42902360 | + |
| SEQ ID NO 53150 | TTCTCCTGCCTCAGCCTCCC | AAG | chr17 | 42902353 | 42902372 | 42902369 | + |
| SEQ ID NO 53151 | TCCTGCCTCAGCCTCCCAAG | TAG | chr17 | 42902356 | 42902375 | 42902372 | + |
| SEQ ID NO 53152 | GCCTCAGCCTCCCAAGTAGC | TGG | chr17 | 42902360 | 42902379 | 42902376 | + |
| SEQ ID NO 53153 | CCTCAGCCTCCCAAGTAGCT | GGG | chr17 | 42902361 | 42902380 | 42902377 | + |
| SEQ ID NO 53154 | CTCCCAAGTAGCTGGGATTA | CAG | chr17 | 42902368 | 42902387 | 42902384 | + |
| SEQ ID NO 53155 | TCCCAAGTAGCTGGGATTAC | AGG | chr17 | 42902369 | 42902388 | 42902385 | + |
| SEQ ID NO 53156 | CAGGTGCCCGCCACCATGCC | CAG | chr17 | 42902388 | 42902407 | 42902404 | + |
| SEQ ID NO 53157 | GCTAATTTTTTTGTATTTT | TAG | chr17 | 42902410 | 42902429 | 42902426 | + |
| SEQ ID NO 53158 | AATTTTTTTTGTATTTTTAG | TAG | chr17 | 42902413 | 42902432 | 42902429 | + |
| SEQ ID NO 53159 | TTTTTTTTGTATTTTTAGTA | GAG | chr17 | 42902415 | 42902434 | 42902431 | + |
| SEQ ID NO 53160 | TTGTATTTTTAGTAGAGACA | TGG | chr17 | 42902421 | 42902440 | 42902437 | + |
| SEQ ID NO 53161 | CATGGTTTCACTATGTTGAC | TAG | chr17 | 42902439 | 42902458 | 42902455 | + |
| SEQ ID NO 53162 | ATGGTTTCACTATGTTGACT | AGG | chr17 | 42902440 | 42902459 | 42902456 | + |
| SEQ ID NO 53163 | TTTCACTATGTTGACTAGGC | TGG | chr17 | 42902444 | 42902463 | 42902460 | + |
| SEQ ID NO 53164 | ACCTCATGATCTGCCTGCCT | TGG | chr17 | 42902480 | 42902499 | 42902496 | + |
| SEQ ID NO 53165 | CTGCCTGCCTTGGCCTCCCT | AAG | chr17 | 42902490 | 42902509 | 42902506 | + |

Figure 85 (Cont'd)

| SEQ ID NO 53166 | GCCTTGGCCTCCCTAAGTGC | TAG | chr17 | 42902496 | 42902515 | 42902512 | + |
| SEQ ID NO 53167 | CCTTGGCCTCCCTAAGTGCT | AGG | chr17 | 42902497 | 42902516 | 42902513 | + |
| SEQ ID NO 53168 | CTCCCTAAGTGCTAGGATTA | CAG | chr17 | 42902504 | 42902523 | 42902520 | + |
| SEQ ID NO 53169 | TCCCTAAGTGCTAGGATTAC | AGG | chr17 | 42902505 | 42902524 | 42902521 | + |
| SEQ ID NO 53170 | AGTGCTAGGATTACAGGCGT | GAG | chr17 | 42902511 | 42902530 | 42902527 | + |
| SEQ ID NO 53171 | CAGGCGTGAGCCACTACACC | CAG | chr17 | 42902524 | 42902543 | 42902540 | + |
| SEQ ID NO 53172 | GCATGATTCTAAAAATAAA | AAG | chr17 | 42902549 | 42902568 | 42902565 | + |
| SEQ ID NO 53173 | TTCTAAAAATAAAAAGATG | AAG | chr17 | 42902555 | 42902574 | 42902571 | + |
| SEQ ID NO 53174 | CAAACATCTGATCTCCATTG | AAG | chr17 | 42902586 | 42902605 | 42902602 | + |
| SEQ ID NO 53175 | GAAGAACCATGCAATCTCTC | TGG | chr17 | 42902605 | 42902624 | 42902621 | + |
| SEQ ID NO 53176 | AAGAACCATGCAATCTCTCT | GGG | chr17 | 42902606 | 42902625 | 42902622 | + |
| SEQ ID NO 53177 | ATGCAATCTCTCTGGGTTGA | TAG | chr17 | 42902613 | 42902632 | 42902629 | + |
| SEQ ID NO 53178 | GCAATCTCTCTGGGTTGATA | GAG | chr17 | 42902615 | 42902634 | 42902631 | + |
| SEQ ID NO 53179 | CAATCTCTCTGGGTTGATAG | AGG | chr17 | 42902616 | 42902635 | 42902632 | + |
| SEQ ID NO 53180 | CTCTCTGGGTTGATAGAGGC | CAG | chr17 | 42902620 | 42902639 | 42902636 | + |
| SEQ ID NO 53181 | CTCTGGGTTGATAGAGGCCA | GAG | chr17 | 42902622 | 42902641 | 42902638 | + |
| SEQ ID NO 53182 | GGGTTGATAGAGGCCAGAGT | TAG | chr17 | 42902626 | 42902645 | 42902642 | + |
| SEQ ID NO 53183 | TTGATAGAGGCCAGAGTTAG | TGG | chr17 | 42902629 | 42902648 | 42902645 | + |
| SEQ ID NO 53184 | TTAGTGGCTCTCCCTGATTT | CGG | chr17 | 42902645 | 42902664 | 42902661 | + |
| SEQ ID NO 53185 | TGGCTCTCCCTGATTTCGGT | GAG | chr17 | 42902649 | 42902668 | 42902665 | + |
| SEQ ID NO 53186 | AAATCACTATTCCACCATCA | CGG | chr17 | 42902672 | 42902691 | 42902688 | + |
| SEQ ID NO 53187 | AATCACTATTCCACCATCAC | GGG | chr17 | 42902673 | 42902692 | 42902689 | + |
| SEQ ID NO 53188 | ATTCCACCATCACGGGATAA | AAG | chr17 | 42902680 | 42902699 | 42902696 | + |
| SEQ ID NO 53189 | TTCCACCATCACGGGATAAA | AGG | chr17 | 42902681 | 42902700 | 42902697 | + |
| SEQ ID NO 53190 | GGGATAAAAGGCATCCTGAC | TGG | chr17 | 42902693 | 42902712 | 42902709 | + |
| SEQ ID NO 53191 | ATAAAAGGCATCCTGACTGG | CGG | chr17 | 42902696 | 42902715 | 42902712 | + |
| SEQ ID NO 53192 | GCGGTTGACACCTATTTCCA | CAG | chr17 | 42902715 | 42902734 | 42902731 | + |
| SEQ ID NO 53193 | GACACCTATTTCCACAGTGA | AAG | chr17 | 42902721 | 42902740 | 42902737 | + |
| SEQ ID NO 53194 | TCCACAGTGAAAGATATATC | TAG | chr17 | 42902731 | 42902750 | 42902747 | + |
| SEQ ID NO 53195 | AGATATATCTAGTACTTTTA | AAG | chr17 | 42902742 | 42902761 | 42902758 | + |
| SEQ ID NO 53196 | GATATATCTAGTACTTTTAA | AGG | chr17 | 42902743 | 42902762 | 42902759 | + |
| SEQ ID NO 53197 | ATATATCTAGTACTTTTAAA | GGG | chr17 | 42902744 | 42902763 | 42902760 | + |
| SEQ ID NO 53198 | TATATCTAGTACTTTTAAAG | GGG | chr17 | 42902745 | 42902764 | 42902761 | + |
| SEQ ID NO 53199 | ATCTAGTACTTTTAAAGGGG | AAG | chr17 | 42902748 | 42902767 | 42902764 | + |
| SEQ ID NO 53200 | TAGTACTTTTAAAGGGGAAG | TGG | chr17 | 42902751 | 42902770 | 42902767 | + |
| SEQ ID NO 53201 | AAAGGGGAAGTGGTTTGTCT | GAG | chr17 | 42902761 | 42902780 | 42902777 | + |
| SEQ ID NO 53202 | GTCTGAGATACTCTGTTTCA | AAG | chr17 | 42902777 | 42902796 | 42902793 | + |
| SEQ ID NO 53203 | TGAGATACTCTGTTTCAAAG | TAG | chr17 | 42902780 | 42902799 | 42902796 | + |
| SEQ ID NO 53204 | AGATACTCTGTTTCAAAGTA | GAG | chr17 | 42902782 | 42902801 | 42902798 | + |
| SEQ ID NO 53205 | ATACTCTGTTTCAAAGTAGA | GAG | chr17 | 42902784 | 42902803 | 42902800 | + |
| SEQ ID NO 53206 | TACTCTGTTTCAAAGTAGAG | AGG | chr17 | 42902785 | 42902804 | 42902801 | + |
| SEQ ID NO 53207 | GTTTCAAAGTAGAGAGGATA | CAG | chr17 | 42902791 | 42902810 | 42902807 | + |
| SEQ ID NO 53208 | AAGTAGAGAGGATACAGAAC | AAG | chr17 | 42902797 | 42902816 | 42902813 | + |
| SEQ ID NO 53209 | GGATACAGAACAAGCATCTG | AAG | chr17 | 42902806 | 42902825 | 42902822 | + |
| SEQ ID NO 53210 | TGAAGCTATATACATCCTTA | CAG | chr17 | 42902824 | 42902843 | 42902840 | + |
| SEQ ID NO 53211 | AAGCTATATACATCCTTACA | GAG | chr17 | 42902826 | 42902845 | 42902842 | + |
| SEQ ID NO 53212 | GCTATATACATCCTTACAGA | GAG | chr17 | 42902828 | 42902847 | 42902844 | + |

Figure 85 (Cont'd)

| | | | | | | | |
|---|---|---|---|---|---|---|---|
| SEQ ID NO 53213 | CTTACAGAGAGCAATTCTGA | TGG | chr17 | 42902840 | 42902859 | 42902856 | + |
| SEQ ID NO 53214 | GAGCAATTCTGATGGAAATG | CAG | chr17 | 42902848 | 42902867 | 42902864 | + |
| SEQ ID NO 53215 | AGCAATTCTGATGGAAATGC | AGG | chr17 | 42902849 | 42902868 | 42902865 | + |
| SEQ ID NO 53216 | AAATGCAGGCCATGTTTCCC | TGG | chr17 | 42902863 | 42902882 | 42902879 | + |
| SEQ ID NO 53217 | AATGCAGGCCATGTTTCCCT | GGG | chr17 | 42902864 | 42902883 | 42902880 | + |
| SEQ ID NO 53218 | ATGCAGGCCATGTTTCCCTG | GGG | chr17 | 42902865 | 42902884 | 42902881 | + |
| SEQ ID NO 53219 | TGCAGGCCATGTTTCCCTGG | GGG | chr17 | 42902866 | 42902885 | 42902882 | + |
| SEQ ID NO 53220 | GCAGGCCATGTTTCCCTGGG | GGG | chr17 | 42902867 | 42902886 | 42902883 | + |
| SEQ ID NO 53221 | CAGGCCATGTTTCCCTGGGG | GGG | chr17 | 42902868 | 42902887 | 42902884 | + |
| SEQ ID NO 53222 | AGGCCATGTTTCCCTGGGGG | GGG | chr17 | 42902869 | 42902888 | 42902885 | + |
| SEQ ID NO 53223 | TCCCTGGGGGGGCTCGTCC | TAG | chr17 | 42902879 | 42902898 | 42902895 | + |
| SEQ ID NO 53224 | CCCTGGGGGGGCTCGTCCT | AGG | chr17 | 42902880 | 42902899 | 42902896 | + |
| SEQ ID NO 53225 | CCTGGGGGGGCTCGTCCTA | GGG | chr17 | 42902881 | 42902900 | 42902897 | + |
| SEQ ID NO 53226 | CTGGGGGGGCTCGTCCTAG | GGG | chr17 | 42902882 | 42902901 | 42902898 | + |
| SEQ ID NO 53227 | GGGGGGCTCGTCCTAGGGGC | TGG | chr17 | 42902886 | 42902905 | 42902902 | + |
| SEQ ID NO 53228 | GGGGCTCGTCCTAGGGCTG | GAG | chr17 | 42902888 | 42902907 | 42902904 | + |
| SEQ ID NO 53229 | TGGAGTGCATTCTCTGATGT | CAG | chr17 | 42902906 | 42902925 | 42902922 | + |
| SEQ ID NO 53230 | GAGTGCATTCTCTGATGTCA | GAG | chr17 | 42902908 | 42902927 | 42902924 | + |
| SEQ ID NO 53231 | AGTGCATTCTCTGATGTCAG | AGG | chr17 | 42902909 | 42902928 | 42902925 | + |
| SEQ ID NO 53232 | TCTGATGTCAGAGGAAATGC | AAG | chr17 | 42902918 | 42902937 | 42902934 | + |
| SEQ ID NO 53233 | GAGGAAATGCAAGATTCCCT | GAG | chr17 | 42902928 | 42902947 | 42902944 | + |
| SEQ ID NO 53234 | AGGAAATGCAAGATTCCCTG | AGG | chr17 | 42902929 | 42902948 | 42902945 | + |
| SEQ ID NO 53235 | TGCAAGATTCCCTGAGGCCT | GAG | chr17 | 42902935 | 42902954 | 42902951 | + |
| SEQ ID NO 53236 | GCAAGATTCCCTGAGGCCTG | AGG | chr17 | 42902936 | 42902955 | 42902952 | + |
| SEQ ID NO 53237 | CAAGATTCCCTGAGGCCTGA | GGG | chr17 | 42902937 | 42902956 | 42902953 | + |
| SEQ ID NO 53238 | CTGAGGCCTGAGGGAACCCA | TGG | chr17 | 42902946 | 42902965 | 42902962 | + |
| SEQ ID NO 53239 | AGGGAACCCATGGTATATGC | AAG | chr17 | 42902956 | 42902975 | 42902972 | + |
| SEQ ID NO 53240 | CCCATGGTATATGCAAGTCC | AAG | chr17 | 42902962 | 42902981 | 42902978 | + |
| SEQ ID NO 53241 | CAAGTCCAAGTTTCAAACTG | TAG | chr17 | 42902975 | 42902994 | 42902991 | + |
| SEQ ID NO 53242 | TAGTTCCATATGCATTCTTC | CAG | chr17 | 42902995 | 42903014 | 42903011 | + |
| SEQ ID NO 53243 | AGTTCCATATGCATTCTTCC | AGG | chr17 | 42902996 | 42903015 | 42903012 | + |
| SEQ ID NO 53244 | TTCCAGGACAAATACTTCTT | GAG | chr17 | 42903012 | 42903031 | 42903028 | + |
| SEQ ID NO 53245 | TCCAGGACAAATACTTCTTG | AGG | chr17 | 42903013 | 42903032 | 42903029 | + |
| SEQ ID NO 53246 | TTCTTGAGGTTAAAAAAAAA | AAG | chr17 | 42903027 | 42903046 | 42903043 | + |
| SEQ ID NO 53247 | GTTAAAAAAAAAAAGTCACA | TAG | chr17 | 42903035 | 42903054 | 42903051 | + |
| SEQ ID NO 53248 | GTCACATAGCTGCCATTTTA | TGG | chr17 | 42903049 | 42903068 | 42903065 | + |
| SEQ ID NO 53249 | AGCTGCCATTTTATGGATTT | CAG | chr17 | 42903056 | 42903075 | 42903072 | + |
| SEQ ID NO 53250 | GCTGCCATTTTATGGATTTC | AGG | chr17 | 42903057 | 42903076 | 42903073 | + |
| SEQ ID NO 53251 | ATTTTTTTTTTTTTTTTTTT | GAG | chr17 | 42903080 | 42903099 | 42903096 | + |
| SEQ ID NO 53252 | TTTTTTTTTTTTTTTTGAGA | TGG | chr17 | 42903084 | 42903103 | 42903100 | + |
| SEQ ID NO 53253 | TTTTTTTTTTTTTGAGATG | GAG | chr17 | 42903086 | 42903105 | 42903102 | + |
| SEQ ID NO 53254 | TGGAGTCTTGCTCTGTCACC | CAG | chr17 | 42903104 | 42903123 | 42903120 | + |
| SEQ ID NO 53255 | TTGCTCTGTCACCCAGCCTG | TAG | chr17 | 42903111 | 42903130 | 42903127 | + |
| SEQ ID NO 53256 | CTGTCACCCAGCCTGTAGTG | CAG | chr17 | 42903116 | 42903135 | 42903132 | + |
| SEQ ID NO 53257 | TCACCCAGCCTGTAGTGCAG | TGG | chr17 | 42903119 | 42903138 | 42903135 | + |
| SEQ ID NO 53258 | GTAGTGCAGTGGCATAATCT | CGG | chr17 | 42903130 | 42903149 | 42903146 | + |
| SEQ ID NO 53259 | AGTGGCATAATCTCGGCTCA | CGG | chr17 | 42903137 | 42903156 | 42903153 | + |

Figure 85 (Cont'd)

| | | | | | | | |
|---|---|---|---|---|---|---|---|
| SEQ ID NO 53260 | TCACGGCAACCTCCGCCTCC | CAG | chr17 | 42903154 | 42903173 | 42903170 | + |
| SEQ ID NO 53261 | CACGGCAACCTCCGCCTCCC | AGG | chr17 | 42903155 | 42903174 | 42903171 | + |
| SEQ ID NO 53262 | AACCTCCGCCTCCCAGGTTC | AAG | chr17 | 42903161 | 42903180 | 42903177 | + |
| SEQ ID NO 53263 | TTCAAGCGATTCTCTTGCCT | TAG | chr17 | 42903178 | 42903197 | 42903194 | + |
| SEQ ID NO 53264 | TTCTCTTGCCTTAGCCTCCC | GAG | chr17 | 42903187 | 42903206 | 42903203 | + |
| SEQ ID NO 53265 | TCTTGCCTTAGCCTCCCGAG | TAG | chr17 | 42903190 | 42903209 | 42903206 | + |
| SEQ ID NO 53266 | GCCTTAGCCTCCCGAGTAGC | TGG | chr17 | 42903194 | 42903213 | 42903210 | + |
| SEQ ID NO 53267 | CCTTAGCCTCCCGAGTAGCT | GGG | chr17 | 42903195 | 42903214 | 42903211 | + |
| SEQ ID NO 53268 | CTCCCGAGTAGCTGGGATTA | CAG | chr17 | 42903202 | 42903221 | 42903218 | + |
| SEQ ID NO 53269 | CAGTCACGCACCACCACATC | TGG | chr17 | 42903222 | 42903241 | 42903238 | + |
| SEQ ID NO 53270 | GGCTAATTCTTTATATTTTT | TGG | chr17 | 42903243 | 42903262 | 42903259 | + |
| SEQ ID NO 53271 | TAATTCTTTATATTTTTGG | TAG | chr17 | 42903246 | 42903265 | 42903262 | + |
| SEQ ID NO 53272 | TTTATATTTTTGGTAGAAA | CGG | chr17 | 42903252 | 42903271 | 42903268 | + |
| SEQ ID NO 53273 | GAAACGGTGTTTCACCATGT | TGG | chr17 | 42903268 | 42903287 | 42903284 | + |
| SEQ ID NO 53274 | CGGTGTTTCACCATGTTGGC | CAG | chr17 | 42903272 | 42903291 | 42903288 | + |
| SEQ ID NO 53275 | GGTGTTTCACCATGTTGGCC | AGG | chr17 | 42903273 | 42903292 | 42903289 | + |
| SEQ ID NO 53276 | TTTCACCATGTTGGCCAGGC | TGG | chr17 | 42903277 | 42903296 | 42903293 | + |
| SEQ ID NO 53277 | CTCATGTGATCTGCCTGCCT | TGG | chr17 | 42903315 | 42903334 | 42903331 | + |
| SEQ ID NO 53278 | CTGCCTGCCTTGGCCTCCCA | AAG | chr17 | 42903325 | 42903344 | 42903341 | + |
| SEQ ID NO 53279 | CCTTGGCCTCCCAAAGTGCT | GAG | chr17 | 42903332 | 42903351 | 42903348 | + |
| SEQ ID NO 53280 | CTCCCAAAGTGCTGAGATTA | CAG | chr17 | 42903339 | 42903358 | 42903355 | + |
| SEQ ID NO 53281 | TCCCAAAGTGCTGAGATTAC | AGG | chr17 | 42903340 | 42903359 | 42903356 | + |
| SEQ ID NO 53282 | AGTGCTGAGATTACAGGTGT | GAG | chr17 | 42903346 | 42903365 | 42903362 | + |
| SEQ ID NO 53283 | TGTGAGCCACCGCGCCTGCC | TGG | chr17 | 42903363 | 42903382 | 42903379 | + |
| SEQ ID NO 53284 | TGAGCCACCGCGCCTGCCTG | GAG | chr17 | 42903365 | 42903384 | 42903381 | + |
| SEQ ID NO 53285 | CACCGCGCCTGCCTGGAGTT | CAG | chr17 | 42903370 | 42903389 | 42903386 | + |
| SEQ ID NO 53286 | CTGCCTGGAGTTCAGAATCT | TGG | chr17 | 42903378 | 42903397 | 42903394 | + |
| SEQ ID NO 53287 | TGCCTGGAGTTCAGAATCTT | GGG | chr17 | 42903379 | 42903398 | 42903395 | + |
| SEQ ID NO 53288 | CTTCATTATTTGTGTTTAAA | TAG | chr17 | 42903402 | 42903421 | 42903418 | + |
| SEQ ID NO 53289 | TTGTGTTTAAATAGATCATA | CAG | chr17 | 42903411 | 42903430 | 42903427 | + |
| SEQ ID NO 53290 | GTTTAAATAGATCATACAGT | CAG | chr17 | 42903415 | 42903434 | 42903431 | + |
| SEQ ID NO 53291 | TTTAAATAGATCATACAGTC | AGG | chr17 | 42903416 | 42903435 | 42903432 | + |
| SEQ ID NO 53292 | ATAGATCATACAGTCAGGCA | CGG | chr17 | 42903421 | 42903440 | 42903437 | + |
| SEQ ID NO 53293 | GATCATACAGTCAGGCACGG | TGG | chr17 | 42903424 | 42903443 | 42903440 | + |
| SEQ ID NO 53294 | GTGGCTCATGCCTGTAATCC | CAG | chr17 | 42903443 | 42903462 | 42903459 | + |
| SEQ ID NO 53295 | TGCCTGTAATCCCAGCACTT | TGG | chr17 | 42903451 | 42903470 | 42903467 | + |
| SEQ ID NO 53296 | GCCTGTAATCCCAGCACTTT | GGG | chr17 | 42903452 | 42903471 | 42903468 | + |
| SEQ ID NO 53297 | CTGTAATCCCAGCACTTTGG | GAG | chr17 | 42903454 | 42903473 | 42903470 | + |
| SEQ ID NO 53298 | TGTAATCCCAGCACTTTGGG | AGG | chr17 | 42903455 | 42903474 | 42903471 | + |
| SEQ ID NO 53299 | TCCCAGCACTTTGGGAGGCT | GAG | chr17 | 42903460 | 42903479 | 42903476 | + |
| SEQ ID NO 53300 | CCCAGCACTTTGGGAGGCTG | AGG | chr17 | 42903461 | 42903480 | 42903477 | + |
| SEQ ID NO 53301 | AGCACTTTGGGAGGCTGAGG | TGG | chr17 | 42903464 | 42903483 | 42903480 | + |
| SEQ ID NO 53302 | GCACTTTGGGAGGCTGAGGT | GGG | chr17 | 42903465 | 42903484 | 42903481 | + |
| SEQ ID NO 53303 | ACTTTGGGAGGCTGAGGTGG | GAG | chr17 | 42903467 | 42903486 | 42903483 | + |
| SEQ ID NO 53304 | CTTTGGGAGGCTGAGGTGGG | AGG | chr17 | 42903468 | 42903487 | 42903484 | + |
| SEQ ID NO 53305 | CTGAGGTGGGAGGATTGCCT | GAG | chr17 | 42903478 | 42903497 | 42903494 | + |
| SEQ ID NO 53306 | GTGGGAGGATTGCCTGAGTT | CAG | chr17 | 42903483 | 42903502 | 42903499 | + |

Figure 85 (Cont'd)

| | | | | | | | |
|---|---|---|---|---|---|---|---|
| SEQ ID NO 53307 | TGGGAGGATTGCCTGAGTTC | AGG | chr17 | 42903484 | 42903503 | 42903500 | + |
| SEQ ID NO 53308 | GGAGGATTGCCTGAGTTCAG | GAG | chr17 | 42903486 | 42903505 | 42903502 | + |
| SEQ ID NO 53309 | GATTGCCTGAGTTCAGGAGA | TGG | chr17 | 42903490 | 42903509 | 42903506 | + |
| SEQ ID NO 53310 | TTGCCTGAGTTCAGGAGATG | GAG | chr17 | 42903492 | 42903511 | 42903508 | + |
| SEQ ID NO 53311 | TGAGTTCAGGAGATGGAGAC | CAG | chr17 | 42903497 | 42903516 | 42903513 | + |
| SEQ ID NO 53312 | TCAGGAGATGGAGACCAGCC | TGG | chr17 | 42903502 | 42903521 | 42903518 | + |
| SEQ ID NO 53313 | CAGGAGATGGAGACCAGCCT | GGG | chr17 | 42903503 | 42903522 | 42903519 | + |
| SEQ ID NO 53314 | GGAGACCAGCCTGGGCAACA | TGG | chr17 | 42903511 | 42903530 | 42903527 | + |
| SEQ ID NO 53315 | TCTACTAAAAATACAAAAAC | TAG | chr17 | 42903546 | 42903565 | 42903562 | + |
| SEQ ID NO 53316 | CTAAAAATACAAAAACTAGC | TGG | chr17 | 42903550 | 42903569 | 42903566 | + |
| SEQ ID NO 53317 | ATACAAAACTAGCTGGATG | TGG | chr17 | 42903556 | 42903575 | 42903572 | + |
| SEQ ID NO 53318 | CAAAAACTAGCTGGATGTGG | TGG | chr17 | 42903559 | 42903578 | 42903575 | + |
| SEQ ID NO 53319 | GATGTGGTGGCACACACCTG | TAG | chr17 | 42903572 | 42903591 | 42903588 | + |
| SEQ ID NO 53320 | GTGGCACACACCTGTAGTCC | CAG | chr17 | 42903578 | 42903597 | 42903594 | + |
| SEQ ID NO 53321 | CACCTGTAGTCCCAGCTATT | CAG | chr17 | 42903586 | 42903605 | 42903602 | + |
| SEQ ID NO 53322 | ACCTGTAGTCCCAGCTATTC | AGG | chr17 | 42903587 | 42903606 | 42903603 | + |
| SEQ ID NO 53323 | CTGTAGTCCCAGCTATTCAG | GAG | chr17 | 42903589 | 42903608 | 42903605 | + |
| SEQ ID NO 53324 | TGTAGTCCCAGCTATTCAGG | AGG | chr17 | 42903590 | 42903609 | 42903606 | + |
| SEQ ID NO 53325 | TCCCAGCTATTCAGGAGGCT | GAG | chr17 | 42903595 | 42903614 | 42903611 | + |
| SEQ ID NO 53326 | CCCAGCTATTCAGGAGGCTG | AGG | chr17 | 42903596 | 42903615 | 42903612 | + |
| SEQ ID NO 53327 | AGCTATTCAGGAGGCTGAGG | TGG | chr17 | 42903599 | 42903618 | 42903615 | + |
| SEQ ID NO 53328 | GCTATTCAGGAGGCTGAGGT | GGG | chr17 | 42903600 | 42903619 | 42903616 | + |
| SEQ ID NO 53329 | TATTCAGGAGGCTGAGGTGG | GAG | chr17 | 42903602 | 42903621 | 42903618 | + |
| SEQ ID NO 53330 | ATTCAGGAGGCTGAGGTGGG | AGG | chr17 | 42903603 | 42903622 | 42903619 | + |
| SEQ ID NO 53331 | AGGCTGAGGTGGGAGGATCC | CAG | chr17 | 42903610 | 42903629 | 42903626 | + |
| SEQ ID NO 53332 | GGCTGAGGTGGGAGGATCCC | AGG | chr17 | 42903611 | 42903630 | 42903627 | + |
| SEQ ID NO 53333 | CTGAGGTGGGAGGATCCCAG | GAG | chr17 | 42903613 | 42903632 | 42903629 | + |
| SEQ ID NO 53334 | TGAGGTGGGAGGATCCCAGG | AGG | chr17 | 42903614 | 42903633 | 42903630 | + |
| SEQ ID NO 53335 | GGTGGGAGGATCCCAGGAGG | TAG | chr17 | 42903617 | 42903636 | 42903633 | + |
| SEQ ID NO 53336 | TGGGAGGATCCCAGGAGGTA | GAG | chr17 | 42903619 | 42903638 | 42903635 | + |
| SEQ ID NO 53337 | GGGAGGATCCCAGGAGGTAG | AGG | chr17 | 42903620 | 42903639 | 42903636 | + |
| SEQ ID NO 53338 | CAGGAGGTAGAGGTCACAAT | GAG | chr17 | 42903630 | 42903649 | 42903646 | + |
| SEQ ID NO 53339 | GGTAGAGGTCACAATGAGCC | GAG | chr17 | 42903635 | 42903654 | 42903651 | + |
| SEQ ID NO 53340 | GAGATTGCGCCACTGCACTC | CAG | chr17 | 42903655 | 42903674 | 42903671 | + |
| SEQ ID NO 53341 | AGATTGCGCCACTGCACTCC | AGG | chr17 | 42903656 | 42903675 | 42903672 | + |
| SEQ ID NO 53342 | TGCGCCACTGCACTCCAGGC | TGG | chr17 | 42903660 | 42903679 | 42903676 | + |
| SEQ ID NO 53343 | GCGCCACTGCACTCCAGGCT | GGG | chr17 | 42903661 | 42903680 | 42903677 | + |
| SEQ ID NO 53344 | GCACTCCAGGCTGGGTTACT | GAG | chr17 | 42903669 | 42903688 | 42903685 | + |
| SEQ ID NO 53345 | TCCAGGCTGGGTTACTGAGC | CAG | chr17 | 42903673 | 42903692 | 42903689 | + |
| SEQ ID NO 53346 | ATCCTGTCTCAAAAAAAAAA | AAG | chr17 | 42903696 | 42903715 | 42903712 | + |
| SEQ ID NO 53347 | AAAAAGATAATACATTCAAA | CAG | chr17 | 42903713 | 42903732 | 42903729 | + |
| SEQ ID NO 53348 | TCAAACAGTTCAAAATGCAA | AAG | chr17 | 42903728 | 42903747 | 42903744 | + |
| SEQ ID NO 53349 | AATGCAAAAGTTACATACAT | AAG | chr17 | 42903741 | 42903760 | 42903757 | + |
| SEQ ID NO 53350 | ATGCAAAAGTTACATACATA | AGG | chr17 | 42903742 | 42903761 | 42903758 | + |
| SEQ ID NO 53351 | CAAAAGTTACATACATAAGG | AAG | chr17 | 42903745 | 42903764 | 42903761 | + |
| SEQ ID NO 53352 | CTCCCTCTCACACTTCTCCC | CAG | chr17 | 42903781 | 42903800 | 42903797 | + |
| SEQ ID NO 53353 | CACACTTCTCCCCAGCCACC | CAG | chr17 | 42903789 | 42903808 | 42903805 | + |

Figure 85 (Cont'd)

| | | | | | | | |
|---|---|---|---|---|---|---|---|
| SEQ ID NO 53354 | AGCCACCCAGTTCTCCCTTC | TAG | chr17 | 42903802 | 42903821 | 42903818 | + |
| SEQ ID NO 53355 | CCACCCAGTTCTCCCTTCTA | GAG | chr17 | 42903804 | 42903823 | 42903820 | + |
| SEQ ID NO 53356 | CACCCAGTTCTCCCTTCTAG | AGG | chr17 | 42903805 | 42903824 | 42903821 | + |
| SEQ ID NO 53357 | GCAACATGTGAAATCCTTCT | CAG | chr17 | 42903827 | 42903846 | 42903843 | + |
| SEQ ID NO 53358 | CAACATGTGAAATCCTTCTC | AGG | chr17 | 42903828 | 42903847 | 42903844 | + |
| SEQ ID NO 53359 | CTCAGGCTACACTCTTCTTG | AAG | chr17 | 42903845 | 42903864 | 42903861 | + |
| SEQ ID NO 53360 | TCAGGCTACACTCTTCTTGA | AGG | chr17 | 42903846 | 42903865 | 42903862 | + |
| SEQ ID NO 53361 | CTACACTCTTCTTGAAGGTG | TAG | chr17 | 42903851 | 42903870 | 42903867 | + |
| SEQ ID NO 53362 | TACACTCTTCTTGAAGGTGT | AGG | chr17 | 42903852 | 42903871 | 42903868 | + |
| SEQ ID NO 53363 | CTTCTTGAAGGTGTAGGCTT | TGG | chr17 | 42903858 | 42903877 | 42903874 | + |
| SEQ ID NO 53364 | TTCTTGAAGGTGTAGGCTTT | GGG | chr17 | 42903859 | 42903878 | 42903875 | + |
| SEQ ID NO 53365 | AAGGTGTAGGCTTTGGGCAA | AAG | chr17 | 42903865 | 42903884 | 42903881 | + |
| SEQ ID NO 53366 | TTTGGGCAAAAGCATTCATT | CAG | chr17 | 42903876 | 42903895 | 42903892 | + |
| SEQ ID NO 53367 | AAGCATTCATTCAGTAACCC | CAG | chr17 | 42903885 | 42903904 | 42903901 | + |
| SEQ ID NO 53368 | AAACTTGTTCTGTTTTTCCA | TAG | chr17 | 42903908 | 42903927 | 42903924 | + |
| SEQ ID NO 53369 | AACTTGTTCTGTTTTTCCAT | AGG | chr17 | 42903909 | 42903928 | 42903925 | + |
| SEQ ID NO 53370 | TTTTTCCATAGGATTCTCTT | TGG | chr17 | 42903920 | 42903939 | 42903936 | + |
| SEQ ID NO 53371 | TCCATAGGATTCTCTTTGGA | CAG | chr17 | 42903924 | 42903943 | 42903940 | + |
| SEQ ID NO 53372 | TCTTTGGACAGCGTCCATAC | TGG | chr17 | 42903936 | 42903955 | 42903952 | + |
| SEQ ID NO 53373 | TTGGACAGCGTCCATACTGG | TGG | chr17 | 42903939 | 42903958 | 42903955 | + |
| SEQ ID NO 53374 | TGGACAGCGTCCATACTGGT | GGG | chr17 | 42903940 | 42903959 | 42903956 | + |
| SEQ ID NO 53375 | GCGTCCATACTGGTGGGTTT | TGG | chr17 | 42903946 | 42903965 | 42903962 | + |
| SEQ ID NO 53376 | GTTTTGGATACTGACTACTA | CAG | chr17 | 42903962 | 42903981 | 42903978 | + |
| SEQ ID NO 53377 | ACACTTCCGTGCCCCTGATA | AAG | chr17 | 42903987 | 42904006 | 42904003 | + |
| SEQ ID NO 53378 | CTTCCGTGCCCCTGATAAAG | CAG | chr17 | 42903990 | 42904009 | 42904006 | + |
| SEQ ID NO 53379 | AGCAGTTCCCTGTAACCTGT | GAG | chr17 | 42904008 | 42904027 | 42904024 | + |
| SEQ ID NO 53380 | TTCCCTGTAACCTGTGAGAC | TGG | chr17 | 42904013 | 42904032 | 42904029 | + |
| SEQ ID NO 53381 | TGTAACCTGTGAGACTGGAC | CAG | chr17 | 42904018 | 42904037 | 42904034 | + |
| SEQ ID NO 53382 | GTAACCTGTGAGACTGGACC | AGG | chr17 | 42904019 | 42904038 | 42904035 | + |
| SEQ ID NO 53383 | CCTGTGAGACTGGACCAGGT | AAG | chr17 | 42904023 | 42904042 | 42904039 | + |
| SEQ ID NO 53384 | ACTGGACCAGGTAAGCGTCC | CAG | chr17 | 42904031 | 42904050 | 42904047 | + |
| SEQ ID NO 53385 | GGTAAGCGTCCCAGCCCCTG | CAG | chr17 | 42904040 | 42904059 | 42904056 | + |
| SEQ ID NO 53386 | AGCGTCCCAGCCCCTGCAGA | CAG | chr17 | 42904044 | 42904063 | 42904060 | + |
| SEQ ID NO 53387 | GTCCCAGCCCCTGCAGACAG | AAG | chr17 | 42904047 | 42904066 | 42904063 | + |
| SEQ ID NO 53388 | AGCCCCTGCAGACAGAAGCT | GAG | chr17 | 42904052 | 42904071 | 42904068 | + |
| SEQ ID NO 53389 | CCCTGCAGACAGAAGCTGAG | TGG | chr17 | 42904055 | 42904074 | 42904071 | + |
| SEQ ID NO 53390 | TGGACCTCGTTTACCTGTTA | TGG | chr17 | 42904075 | 42904094 | 42904091 | + |
| SEQ ID NO 53391 | TTATGGATGAAACTGACCTT | GAG | chr17 | 42904092 | 42904111 | 42904108 | + |
| SEQ ID NO 53392 | TATGGATGAAACTGACCTTG | AGG | chr17 | 42904093 | 42904112 | 42904109 | + |
| SEQ ID NO 53393 | ATGGATGAAACTGACCTTGA | GGG | chr17 | 42904094 | 42904113 | 42904110 | + |
| SEQ ID NO 53394 | TGGATGAAACTGACCTTGAG | GGG | chr17 | 42904095 | 42904114 | 42904111 | + |
| SEQ ID NO 53395 | AACTGACCTTGAGGGGACAT | GAG | chr17 | 42904102 | 42904121 | 42904118 | + |
| SEQ ID NO 53396 | ACTGACCTTGAGGGGACATG | AGG | chr17 | 42904103 | 42904122 | 42904119 | + |
| SEQ ID NO 53397 | TGACCTTGAGGGGACATGAG | GAG | chr17 | 42904105 | 42904124 | 42904121 | + |
| SEQ ID NO 53398 | ACCTTGAGGGGACATGAGGA | GAG | chr17 | 42904107 | 42904126 | 42904123 | + |
| SEQ ID NO 53399 | CTTTTGTCATGCTCTTCAAT | TGG | chr17 | 42904143 | 42904162 | 42904159 | + |
| SEQ ID NO 53400 | TTCTGCAATACTTTCCTGAA | TAG | chr17 | 42904181 | 42904200 | 42904197 | + |

Figure 85 (Cont'd)

| | | | | | | | |
|---|---|---|---|---|---|---|---|
| SEQ ID NO 53401 | CAATACTTTCCTGAATAGCA | CAG | chr17 | 42904186 | 42904205 | 42904202 | + |
| SEQ ID NO 53402 | TACTTTCCTGAATAGCACAG | TAG | chr17 | 42904189 | 42904208 | 42904205 | + |
| SEQ ID NO 53403 | CCTGAATAGCACAGTAGTAT | TGG | chr17 | 42904195 | 42904214 | 42904211 | + |
| SEQ ID NO 53404 | TATTGGAAATCTGCCTATTA | CAG | chr17 | 42904212 | 42904231 | 42904228 | + |
| SEQ ID NO 53405 | AATCTGCCTATTACAGAACC | TGG | chr17 | 42904219 | 42904238 | 42904235 | + |
| SEQ ID NO 53406 | TGCCTATTACAGAACCTGGA | TGG | chr17 | 42904223 | 42904242 | 42904239 | + |
| SEQ ID NO 53407 | CCTATTACAGAACCTGGATG | GAG | chr17 | 42904225 | 42904244 | 42904241 | + |
| SEQ ID NO 53408 | TACAGAACCTGGATGGAGTC | CAG | chr17 | 42904230 | 42904249 | 42904246 | + |
| SEQ ID NO 53409 | CAGAACCTGGATGGAGTCCA | GAG | chr17 | 42904232 | 42904251 | 42904248 | + |
| SEQ ID NO 53410 | GAACCTGGATGGAGTCCAGA | GAG | chr17 | 42904234 | 42904253 | 42904250 | + |
| SEQ ID NO 53411 | AACCTGGATGGAGTCCAGAG | AGG | chr17 | 42904235 | 42904254 | 42904251 | + |
| SEQ ID NO 53412 | GGATGGAGTCCAGAGAGGCA | CGG | chr17 | 42904240 | 42904259 | 42904256 | + |
| SEQ ID NO 53413 | GATGGAGTCCAGAGAGGCAC | GGG | chr17 | 42904241 | 42904260 | 42904257 | + |
| SEQ ID NO 53414 | CAGAGAGGCACGGGCATCCA | TGG | chr17 | 42904250 | 42904269 | 42904266 | + |
| SEQ ID NO 53415 | AGAGAGGCACGGGCATCCAT | GGG | chr17 | 42904251 | 42904270 | 42904267 | + |
| SEQ ID NO 53416 | GGCACGGGCATCCATGGGCA | AAG | chr17 | 42904256 | 42904275 | 42904272 | + |
| SEQ ID NO 53417 | GCACGGGCATCCATGGGCAA | AGG | chr17 | 42904257 | 42904276 | 42904273 | + |
| SEQ ID NO 53418 | CACGGGCATCCATGGGCAAA | GGG | chr17 | 42904258 | 42904277 | 42904274 | + |
| SEQ ID NO 53419 | TCCATGGGCAAAGGGCTCGT | GAG | chr17 | 42904266 | 42904285 | 42904282 | + |
| SEQ ID NO 53420 | CATGGGCAAAGGGCTCGTGA | GAG | chr17 | 42904268 | 42904287 | 42904284 | + |
| SEQ ID NO 53421 | TCGTGAGAGTCACCGCCCTG | CAG | chr17 | 42904282 | 42904301 | 42904298 | + |
| SEQ ID NO 53422 | GCCCTGCAGCGCTGTGTCCT | GAG | chr17 | 42904296 | 42904315 | 42904312 | + |
| SEQ ID NO 53423 | TGCAGCGCTGTGTCCTGAGA | AAG | chr17 | 42904300 | 42904319 | 42904316 | + |
| SEQ ID NO 53424 | GCAGCGCTGTGTCCTGAGAA | AGG | chr17 | 42904301 | 42904320 | 42904317 | + |
| SEQ ID NO 53425 | AGCGCTGTGTCCTGAGAAAG | GAG | chr17 | 42904303 | 42904322 | 42904319 | + |
| SEQ ID NO 53426 | GCGCTGTGTCCTGAGAAAGG | AGG | chr17 | 42904304 | 42904323 | 42904320 | + |
| SEQ ID NO 53427 | CGCTGTGTCCTGAGAAAGGA | GGG | chr17 | 42904305 | 42904324 | 42904321 | + |
| SEQ ID NO 53428 | GCTGTGTCCTGAGAAAGGAG | GGG | chr17 | 42904306 | 42904325 | 42904322 | + |
| SEQ ID NO 53429 | CTGTGTCCTGAGAAAGGAGG | GGG | chr17 | 42904307 | 42904326 | 42904323 | + |
| SEQ ID NO 53430 | TGTCCTGAGAAAGGAGGGGG | CAG | chr17 | 42904310 | 42904329 | 42904326 | + |
| SEQ ID NO 53431 | CCTGAGAAAGGAGGGGGCAG | AAG | chr17 | 42904313 | 42904332 | 42904329 | + |
| SEQ ID NO 53432 | AAAGGAGGGGGCAGAAGCCT | GAG | chr17 | 42904319 | 42904338 | 42904335 | + |
| SEQ ID NO 53433 | GGGGCAGAAGCCTGAGCTTC | TGG | chr17 | 42904326 | 42904345 | 42904342 | + |
| SEQ ID NO 53434 | GGGCAGAAGCCTGAGCTTCT | GGG | chr17 | 42904327 | 42904346 | 42904343 | + |
| SEQ ID NO 53435 | GGCAGAAGCCTGAGCTTCTG | GGG | chr17 | 42904328 | 42904347 | 42904344 | + |
| SEQ ID NO 53436 | GCAGAAGCCTGAGCTTCTGG | GGG | chr17 | 42904329 | 42904348 | 42904345 | + |
| SEQ ID NO 53437 | CTTCTGGGGGTCCTTCCCAA | TGG | chr17 | 42904342 | 42904361 | 42904358 | + |
| SEQ ID NO 53438 | GGGGGTCCTTCCCAATGGCC | TGG | chr17 | 42904347 | 42904366 | 42904363 | + |
| SEQ ID NO 53439 | TTCCCAATGGCCTGGCCCAC | TGG | chr17 | 42904355 | 42904374 | 42904371 | + |
| SEQ ID NO 53440 | CCCACTGGATGTGCCCTCCT | GAG | chr17 | 42904370 | 42904389 | 42904386 | + |
| SEQ ID NO 53441 | TCTCTGTGCCTACGTTTTAT | TAG | chr17 | 42904415 | 42904434 | 42904431 | + |
| SEQ ID NO 53442 | TGCCTACGTTTTATTAGTTA | CAG | chr17 | 42904421 | 42904440 | 42904437 | + |
| SEQ ID NO 53443 | TACGTTTTATTAGTTACAGC | CAG | chr17 | 42904425 | 42904444 | 42904441 | + |
| SEQ ID NO 53444 | TTTTATTAGTTACAGCCAGA | TGG | chr17 | 42904429 | 42904448 | 42904445 | + |
| SEQ ID NO 53445 | GTTACTGTCAAATCAAATGA | TAG | chr17 | 42904451 | 42904470 | 42904467 | + |
| SEQ ID NO 53446 | CAAATGATAGATTTCATTTT | CAG | chr17 | 42904464 | 42904483 | 42904480 | + |
| SEQ ID NO 53447 | ATTTCATTTTCAGTATGTAA | TAG | chr17 | 42904474 | 42904493 | 42904490 | + |

Figure 85 (Cont'd)

| SEQ ID NO 53448 | TTTCATTTTCAGTATGTAAT | AGG | chr17 | 42904475 | 42904494 | 42904491 | + |
| SEQ ID NO 53449 | CATTTTCAGTATGTAATAGG | AAG | chr17 | 42904478 | 42904497 | 42904494 | + |
| SEQ ID NO 53450 | GAAGCCCTCCCTCACCCTA | AAG | chr17 | 42904497 | 42904516 | 42904513 | + |
| SEQ ID NO 53451 | CCTCCCTCACCCTAAAGTCT | CAG | chr17 | 42904503 | 42904522 | 42904519 | + |
| SEQ ID NO 53452 | TAAAGTCTCAGCTGCCCTCT | AAG | chr17 | 42904515 | 42904534 | 42904531 | + |
| SEQ ID NO 53453 | TCTCAGCTGCCCTCTAAGAC | TAG | chr17 | 42904520 | 42904539 | 42904536 | + |
| SEQ ID NO 53454 | CTCTAAGACTAGTACTCTCT | AAG | chr17 | 42904531 | 42904550 | 42904547 | + |
| SEQ ID NO 53455 | TCTAAGACTAGTACTCTCTA | AGG | chr17 | 42904532 | 42904551 | 42904548 | + |
| SEQ ID NO 53456 | ACTAGTACTCTCTAAGGTAC | TAG | chr17 | 42904538 | 42904557 | 42904554 | + |
| SEQ ID NO 53457 | AGGTACTAGTATCCCTTCCT | CAG | chr17 | 42904552 | 42904571 | 42904568 | + |
| SEQ ID NO 53458 | GTACTAGTATCCCTTCCTCA | GAG | chr17 | 42904554 | 42904573 | 42904570 | + |
| SEQ ID NO 53459 | CCTTTCCCTGACCCCAAAAC | TAG | chr17 | 42904579 | 42904598 | 42904595 | + |
| SEQ ID NO 53460 | CTTTCCCTGACCCCAAAACT | AGG | chr17 | 42904580 | 42904599 | 42904596 | + |
| SEQ ID NO 53461 | TTTCCCTGACCCCAAAACTA | GGG | chr17 | 42904581 | 42904600 | 42904597 | + |
| SEQ ID NO 53462 | CCCTGACCCCAAAACTAGGG | AAG | chr17 | 42904584 | 42904603 | 42904600 | + |
| SEQ ID NO 53463 | CCTGACCCCAAAACTAGGGA | AGG | chr17 | 42904585 | 42904604 | 42904601 | + |
| SEQ ID NO 53464 | CAAAACTAGGGAAGGTCCCT | TAG | chr17 | 42904593 | 42904612 | 42904609 | + |
| SEQ ID NO 53465 | CCCTTAGTTATTTGCTCTCA | CAG | chr17 | 42904609 | 42904628 | 42904625 | + |
| SEQ ID NO 53466 | CACAGACCACGCATTTACCT | CAG | chr17 | 42904627 | 42904646 | 42904643 | + |
| SEQ ID NO 53467 | CAGACCACGCATTTACCTCA | GAG | chr17 | 42904629 | 42904648 | 42904645 | + |
| SEQ ID NO 53468 | TCAGAGCATATTCACTCATT | CAG | chr17 | 42904646 | 42904665 | 42904662 | + |
| SEQ ID NO 53469 | TCATTCAGCTGTTACTTACC | AAG | chr17 | 42904661 | 42904680 | 42904677 | + |
| SEQ ID NO 53470 | GTTACTTACCAAGCACCTAC | TGG | chr17 | 42904671 | 42904690 | 42904687 | + |
| SEQ ID NO 53471 | TTACTTACCAAGCACCTACT | GGG | chr17 | 42904672 | 42904691 | 42904688 | + |
| SEQ ID NO 53472 | ACTTACCAAGCACCTACTGG | GAG | chr17 | 42904674 | 42904693 | 42904690 | + |
| SEQ ID NO 53473 | CTATACACTGTTCTATGTGC | TAG | chr17 | 42904697 | 42904716 | 42904713 | + |
| SEQ ID NO 53474 | TATACACTGTTCTATGTGCT | AGG | chr17 | 42904698 | 42904717 | 42904714 | + |
| SEQ ID NO 53475 | ATACACTGTTCTATGTGCTA | GGG | chr17 | 42904699 | 42904718 | 42904715 | + |
| SEQ ID NO 53476 | TGTGCTAGGGATACCTCTGT | CAG | chr17 | 42904712 | 42904731 | 42904728 | + |
| SEQ ID NO 53477 | ACCTCTGTCAGTGAACAACA | CAG | chr17 | 42904724 | 42904743 | 42904740 | + |
| SEQ ID NO 53478 | CAGTGAACAACACAGACACA | AAG | chr17 | 42904732 | 42904751 | 42904748 | + |
| SEQ ID NO 53479 | CACAAAGATCCCTGCCCTTG | TGG | chr17 | 42904748 | 42904767 | 42904764 | + |
| SEQ ID NO 53480 | CAAAGATCCCTGCCCTTGTG | GAG | chr17 | 42904750 | 42904769 | 42904766 | + |
| SEQ ID NO 53481 | TTGTGGAGCTGAAATCTGAA | TAG | chr17 | 42904765 | 42904784 | 42904781 | + |
| SEQ ID NO 53482 | GTGGAGCTGAAATCTGAATA | GAG | chr17 | 42904767 | 42904786 | 42904783 | + |
| SEQ ID NO 53483 | TGGAGCTGAAATCTGAATAG | AGG | chr17 | 42904768 | 42904787 | 42904784 | + |
| SEQ ID NO 53484 | GAGCTGAAATCTGAATAGAG | GAG | chr17 | 42904770 | 42904789 | 42904786 | + |
| SEQ ID NO 53485 | AGCTGAAATCTGAATAGAGG | AGG | chr17 | 42904771 | 42904790 | 42904787 | + |
| SEQ ID NO 53486 | ATACAAAATTATAATAAAT | AAG | chr17 | 42904800 | 42904819 | 42904816 | + |
| SEQ ID NO 53487 | ATTATAATAAATAAGTAAAC | TAG | chr17 | 42904808 | 42904827 | 42904824 | + |
| SEQ ID NO 53488 | TTATAATAAATAAGTAAACT | AGG | chr17 | 42904809 | 42904828 | 42904825 | + |
| SEQ ID NO 53489 | AATAAATAAGTAAACTAGGC | CAG | chr17 | 42904813 | 42904832 | 42904829 | + |
| SEQ ID NO 53490 | TAAGTAAACTAGGCCAGTTG | TGG | chr17 | 42904819 | 42904838 | 42904835 | + |
| SEQ ID NO 53491 | GTTGCTCATGCCTGTAATCC | CAG | chr17 | 42904841 | 42904860 | 42904857 | + |
| SEQ ID NO 53492 | TGCCTGTAATCCCAGCACTT | TGG | chr17 | 42904849 | 42904868 | 42904865 | + |
| SEQ ID NO 53493 | GCCTGTAATCCCAGCACTTT | GGG | chr17 | 42904850 | 42904869 | 42904866 | + |
| SEQ ID NO 53494 | TGTAATCCCAGCACTTTGGG | AAG | chr17 | 42904853 | 42904872 | 42904869 | + |

Figure 85 (Cont'd)

| SEQ ID NO 53495 | TCCCAGCACTTTGGGAAGCC | AAG | chr17 | 42904858 | 42904877 | 42904874 | + |
| SEQ ID NO 53496 | CCCAGCACTTTGGGAAGCCA | AGG | chr17 | 42904859 | 42904878 | 42904875 | + |
| SEQ ID NO 53497 | AGCACTTTGGGAAGCCAAGG | TAG | chr17 | 42904862 | 42904881 | 42904878 | + |
| SEQ ID NO 53498 | GCACTTTGGGAAGCCAAGGT | AGG | chr17 | 42904863 | 42904882 | 42904879 | + |
| SEQ ID NO 53499 | CTTTGGGAAGCCAAGGTAGG | TAG | chr17 | 42904866 | 42904885 | 42904882 | + |
| SEQ ID NO 53500 | CCAAGGTAGGTAGATCACCT | GAG | chr17 | 42904876 | 42904895 | 42904892 | + |
| SEQ ID NO 53501 | CAAGGTAGGTAGATCACCTG | AGG | chr17 | 42904877 | 42904896 | 42904893 | + |
| SEQ ID NO 53502 | GTAGGTAGATCACCTGAGGT | CAG | chr17 | 42904881 | 42904900 | 42904897 | + |
| SEQ ID NO 53503 | TAGGTAGATCACCTGAGGTC | AGG | chr17 | 42904882 | 42904901 | 42904898 | + |
| SEQ ID NO 53504 | GGTAGATCACCTGAGGTCAG | GAG | chr17 | 42904884 | 42904903 | 42904900 | + |
| SEQ ID NO 53505 | TGAGGTCAGGAGTTCAAAAC | CAG | chr17 | 42904895 | 42904914 | 42904911 | + |
| SEQ ID NO 53506 | TCAGGAGTTCAAAACCAGCC | TGG | chr17 | 42904900 | 42904919 | 42904916 | + |
| SEQ ID NO 53507 | AATCCTGTCTTTACTAAAAA | TGG | chr17 | 42904935 | 42904954 | 42904951 | + |
| SEQ ID NO 53508 | TTTACTAAAAATGGAAAAAT | TGG | chr17 | 42904944 | 42904963 | 42904960 | + |
| SEQ ID NO 53509 | CTAAAAATGGAAAAATTGGT | CAG | chr17 | 42904948 | 42904967 | 42904964 | + |
| SEQ ID NO 53510 | TAAAAATGGAAAAATTGGTC | AGG | chr17 | 42904949 | 42904968 | 42904965 | + |
| SEQ ID NO 53511 | GAAAAATTGGTCAGGCGTGA | TGG | chr17 | 42904957 | 42904976 | 42904973 | + |
| SEQ ID NO 53512 | GGCGTGATGGCACACGCCTG | TAG | chr17 | 42904970 | 42904989 | 42904986 | + |
| SEQ ID NO 53513 | ATGGCACACGCCTGTAGTCT | CAG | chr17 | 42904976 | 42904995 | 42904992 | + |
| SEQ ID NO 53514 | CGCCTGTAGTCTCAGCTACC | TGG | chr17 | 42904984 | 42905003 | 42905000 | + |
| SEQ ID NO 53515 | GCCTGTAGTCTCAGCTACCT | GGG | chr17 | 42904985 | 42905004 | 42905001 | + |
| SEQ ID NO 53516 | CTGTAGTCTCAGCTACCTGG | GAG | chr17 | 42904987 | 42905006 | 42905003 | + |
| SEQ ID NO 53517 | TGTAGTCTCAGCTACCTGGG | AGG | chr17 | 42904988 | 42905007 | 42905004 | + |
| SEQ ID NO 53518 | TCTCAGCTACCTGGGAGGCT | GAG | chr17 | 42904993 | 42905012 | 42905009 | + |
| SEQ ID NO 53519 | CTCAGCTACCTGGGAGGCTG | AGG | chr17 | 42904994 | 42905013 | 42905010 | + |
| SEQ ID NO 53520 | AGCTACCTGGGAGGCTGAGG | CAG | chr17 | 42904997 | 42905016 | 42905013 | + |
| SEQ ID NO 53521 | GCTACCTGGGAGGCTGAGGC | AGG | chr17 | 42904998 | 42905017 | 42905014 | + |
| SEQ ID NO 53522 | TACCTGGGAGGCTGAGGCAG | GAG | chr17 | 42905000 | 42905019 | 42905016 | + |
| SEQ ID NO 53523 | GCAGGAGAATCGCTTGAACC | TGG | chr17 | 42905016 | 42905035 | 42905032 | + |
| SEQ ID NO 53524 | CAGGAGAATCGCTTGAACCT | GGG | chr17 | 42905017 | 42905036 | 42905033 | + |
| SEQ ID NO 53525 | GGAGAATCGCTTGAACCTGG | GAG | chr17 | 42905019 | 42905038 | 42905035 | + |
| SEQ ID NO 53526 | GAGAATCGCTTGAACCTGGG | AGG | chr17 | 42905020 | 42905039 | 42905036 | + |
| SEQ ID NO 53527 | AATCGCTTGAACCTGGGAGG | CAG | chr17 | 42905023 | 42905042 | 42905039 | + |
| SEQ ID NO 53528 | TCGCTTGAACCTGGGAGGCA | GAG | chr17 | 42905025 | 42905044 | 42905041 | + |
| SEQ ID NO 53529 | CGCTTGAACCTGGGAGGCAG | AGG | chr17 | 42905026 | 42905045 | 42905042 | + |
| SEQ ID NO 53530 | AACCTGGGAGGCAGAGGTTG | CAG | chr17 | 42905032 | 42905051 | 42905048 | + |
| SEQ ID NO 53531 | GGCAGAGGTTGCAGTGAACC | GAG | chr17 | 42905041 | 42905060 | 42905057 | + |
| SEQ ID NO 53532 | AGGTTGCAGTGAACCGAGAT | CGG | chr17 | 42905046 | 42905065 | 42905062 | + |
| SEQ ID NO 53533 | GAGATCGGACCACTGCACTC | CAG | chr17 | 42905061 | 42905080 | 42905077 | + |
| SEQ ID NO 53534 | CTGCACTCCAGCCTGAATGA | CAG | chr17 | 42905073 | 42905092 | 42905089 | + |
| SEQ ID NO 53535 | TCCAGCCTGAATGACAGAAC | GAG | chr17 | 42905079 | 42905098 | 42905095 | + |
| SEQ ID NO 53536 | GAGACTCTGTCTCAAAAAAA | AAG | chr17 | 42905099 | 42905118 | 42905115 | + |
| SEQ ID NO 53537 | AAAAGTAAACTATTAATATG | TAG | chr17 | 42905117 | 42905136 | 42905133 | + |
| SEQ ID NO 53538 | AAAGTAAACTATTAATATGT | AGG | chr17 | 42905118 | 42905137 | 42905134 | + |
| SEQ ID NO 53539 | TAAACTATTAATATGTAGGA | TAG | chr17 | 42905122 | 42905141 | 42905138 | + |
| SEQ ID NO 53540 | AAACTATTAATATGTAGGAT | AGG | chr17 | 42905123 | 42905142 | 42905139 | + |
| SEQ ID NO 53541 | TATTAATATGTAGGATAGGC | CAG | chr17 | 42905127 | 42905146 | 42905143 | + |

Figure 85 (Cont'd)

| | | | | | | | |
|---|---|---|---|---|---|---|---|
| SEQ ID NO 53542 | ATTAATATGTAGGATAGGCC | AGG | chr17 | 42905128 | 42905147 | 42905144 | + |
| SEQ ID NO 53543 | TATGTAGGATAGGCCAGGCA | CGG | chr17 | 42905133 | 42905152 | 42905149 | + |
| SEQ ID NO 53544 | GTAGGATAGGCCAGGCACGG | TGG | chr17 | 42905136 | 42905155 | 42905152 | + |
| SEQ ID NO 53545 | GGTGGCTCACCCTGTAATCC | CAG | chr17 | 42905154 | 42905173 | 42905170 | + |
| SEQ ID NO 53546 | ACCCTGTAATCCCAGCACTT | TGG | chr17 | 42905162 | 42905181 | 42905178 | + |
| SEQ ID NO 53547 | CCCTGTAATCCCAGCACTTT | GGG | chr17 | 42905163 | 42905182 | 42905179 | + |
| SEQ ID NO 53548 | CTGTAATCCCAGCACTTTGG | GAG | chr17 | 42905165 | 42905184 | 42905181 | + |
| SEQ ID NO 53549 | TGTAATCCCAGCACTTTGGG | AGG | chr17 | 42905166 | 42905185 | 42905182 | + |
| SEQ ID NO 53550 | TCCCAGCACTTTGGGAGGCT | GAG | chr17 | 42905171 | 42905190 | 42905187 | + |
| SEQ ID NO 53551 | CCCAGCACTTTGGGAGGCTG | AGG | chr17 | 42905172 | 42905191 | 42905188 | + |
| SEQ ID NO 53552 | AGCACTTTGGGAGGCTGAGG | CGG | chr17 | 42905175 | 42905194 | 42905191 | + |
| SEQ ID NO 53553 | GCACTTTGGGAGGCTGAGGC | GGG | chr17 | 42905176 | 42905195 | 42905192 | + |
| SEQ ID NO 53554 | CTTTGGGAGGCTGAGGCGGG | TGG | chr17 | 42905179 | 42905198 | 42905195 | + |
| SEQ ID NO 53555 | CTGAGGCGGGTGGATCACCT | GAG | chr17 | 42905189 | 42905208 | 42905205 | + |
| SEQ ID NO 53556 | TGAGGCGGGTGGATCACCTG | AGG | chr17 | 42905190 | 42905209 | 42905206 | + |
| SEQ ID NO 53557 | GCGGGTGGATCACCTGAGGT | GAG | chr17 | 42905194 | 42905213 | 42905210 | + |
| SEQ ID NO 53558 | CGGGTGGATCACCTGAGGTG | AGG | chr17 | 42905195 | 42905214 | 42905211 | + |
| SEQ ID NO 53559 | GGTGGATCACCTGAGGTGAG | GAG | chr17 | 42905197 | 42905216 | 42905213 | + |
| SEQ ID NO 53560 | TCACCTGAGGTGAGGAGTTC | AAG | chr17 | 42905203 | 42905222 | 42905219 | + |
| SEQ ID NO 53561 | TGAGGTGAGGAGTTCAAGAC | CAG | chr17 | 42905208 | 42905227 | 42905224 | + |
| SEQ ID NO 53562 | TGAGGAGTTCAAGACCAGCC | TGG | chr17 | 42905213 | 42905232 | 42905229 | + |
| SEQ ID NO 53563 | CAAGACCAGCCTGGCCAACA | TGG | chr17 | 42905222 | 42905241 | 42905238 | + |
| SEQ ID NO 53564 | TCTACTAAAAATACAAAAAT | TAG | chr17 | 42905257 | 42905276 | 42905273 | + |
| SEQ ID NO 53565 | CTAAAAATACAAAAATTAGC | TGG | chr17 | 42905261 | 42905280 | 42905277 | + |
| SEQ ID NO 53566 | TAAAAATACAAAAATTAGCT | GGG | chr17 | 42905262 | 42905281 | 42905278 | + |
| SEQ ID NO 53567 | CAAAAATTAGCTGGGTGTCC | TGG | chr17 | 42905270 | 42905289 | 42905286 | + |
| SEQ ID NO 53568 | CTGGTGCATGCCTGTAATCT | GAG | chr17 | 42905289 | 42905308 | 42905305 | + |
| SEQ ID NO 53569 | TGCCTGTAATCTGAGCTACT | CAG | chr17 | 42905297 | 42905316 | 42905313 | + |
| SEQ ID NO 53570 | GCCTGTAATCTGAGCTACTC | AGG | chr17 | 42905298 | 42905317 | 42905314 | + |
| SEQ ID NO 53571 | CTGTAATCTGAGCTACTCAG | GAG | chr17 | 42905300 | 42905319 | 42905316 | + |
| SEQ ID NO 53572 | TGTAATCTGAGCTACTCAGG | AGG | chr17 | 42905301 | 42905320 | 42905317 | + |
| SEQ ID NO 53573 | TCTGAGCTACTCAGGAGGCT | AAG | chr17 | 42905306 | 42905325 | 42905322 | + |
| SEQ ID NO 53574 | CTGAGCTACTCAGGAGGCTA | AGG | chr17 | 42905307 | 42905326 | 42905323 | + |
| SEQ ID NO 53575 | AGCTACTCAGGAGGCTAAGG | CAG | chr17 | 42905310 | 42905329 | 42905326 | + |
| SEQ ID NO 53576 | GCTACTCAGGAGGCTAAGGC | AGG | chr17 | 42905311 | 42905330 | 42905327 | + |
| SEQ ID NO 53577 | TACTCAGGAGGCTAAGGCAG | GAG | chr17 | 42905313 | 42905332 | 42905329 | + |
| SEQ ID NO 53578 | GCAGGAGAATCGCTTGAACC | TGG | chr17 | 42905329 | 42905348 | 42905345 | + |
| SEQ ID NO 53579 | CAGGAGAATCGCTTGAACCT | GGG | chr17 | 42905330 | 42905349 | 42905346 | + |
| SEQ ID NO 53580 | GGAGAATCGCTTGAACCTGG | GAG | chr17 | 42905332 | 42905351 | 42905348 | + |
| SEQ ID NO 53581 | GAGAATCGCTTGAACCTGGG | AGG | chr17 | 42905333 | 42905352 | 42905349 | + |
| SEQ ID NO 53582 | AATCGCTTGAACCTGGGAGG | TGG | chr17 | 42905336 | 42905355 | 42905352 | + |
| SEQ ID NO 53583 | GCTTGAACCTGGGAGGTGGT | GAG | chr17 | 42905340 | 42905359 | 42905356 | + |
| SEQ ID NO 53584 | AACCTGGGAGGTGGTGAGCC | AAG | chr17 | 42905345 | 42905364 | 42905361 | + |
| SEQ ID NO 53585 | AAGATTGCGCCATTGCACTC | CAG | chr17 | 42905365 | 42905384 | 42905381 | + |
| SEQ ID NO 53586 | TGCGCCATTGCACTCCAGCC | TGG | chr17 | 42905370 | 42905389 | 42905386 | + |
| SEQ ID NO 53587 | GCGCCATTGCACTCCAGCCT | GGG | chr17 | 42905371 | 42905390 | 42905387 | + |
| SEQ ID NO 53588 | TCCAGCCTGGGCGACAAAAT | GAG | chr17 | 42905383 | 42905402 | 42905399 | + |

Figure 85 (Cont'd)

| | | | | | | | |
|---|---|---|---|---|---|---|---|
| SEQ ID NO 53589 | CACACACACACATATAATAC | TAG | chr17 | 42905465 | 42905484 | 42905481 | + |
| SEQ ID NO 53590 | TACTAGAAAATGATTGTTTA | TAG | chr17 | 42905482 | 42905501 | 42905498 | + |
| SEQ ID NO 53591 | ACTAGAAAATGATTGTTTAT | AGG | chr17 | 42905483 | 42905502 | 42905499 | + |
| SEQ ID NO 53592 | TATAGGCAAAAAAAAAAAAA | AAG | chr17 | 42905500 | 42905519 | 42905516 | + |
| SEQ ID NO 53593 | AGGCAAAAAAAAAAAAAAAG | AAG | chr17 | 42905503 | 42905522 | 42905519 | + |
| SEQ ID NO 53594 | CAAAAAAAAAAAAAAAGAAG | AAG | chr17 | 42905506 | 42905525 | 42905522 | + |
| SEQ ID NO 53595 | AAAAAAAAAAAAAGAAGAAG | AAG | chr17 | 42905509 | 42905528 | 42905525 | + |
| SEQ ID NO 53596 | AAAAAAAAAGAAGAAGAAG | AAG | chr17 | 42905512 | 42905531 | 42905528 | + |
| SEQ ID NO 53597 | AAAAGAAGAAGAAGAAGAA | AAG | chr17 | 42905517 | 42905536 | 42905533 | + |
| SEQ ID NO 53598 | AAAAGAAGAAGAAGAAGAAA | AGG | chr17 | 42905518 | 42905537 | 42905534 | + |
| SEQ ID NO 53599 | GAAGAAGAAGAAGAAAAGGA | AAG | chr17 | 42905522 | 42905541 | 42905538 | + |
| SEQ ID NO 53600 | AAGAAGAAGAAAAGGAA | AGG | chr17 | 42905523 | 42905542 | 42905539 | + |
| SEQ ID NO 53601 | GAAGAAGAAAAGGAAAG | GAG | chr17 | 42905525 | 42905544 | 42905541 | + |
| SEQ ID NO 53602 | GAAGAAGAAAGGAAAGGAG | AAG | chr17 | 42905528 | 42905547 | 42905544 | + |
| SEQ ID NO 53603 | AAGAAGAAAGGAAAGGAGA | AGG | chr17 | 42905529 | 42905548 | 42905545 | + |
| SEQ ID NO 53604 | AGAAAAGGAAAGGAGAAGGA | AAG | chr17 | 42905533 | 42905552 | 42905549 | + |
| SEQ ID NO 53605 | AAAGGAAGGAGAAGGAAAG | AAG | chr17 | 42905536 | 42905555 | 42905552 | + |
| SEQ ID NO 53606 | AAGGAAGGAGAAGGAAAGA | AGG | chr17 | 42905537 | 42905556 | 42905553 | + |
| SEQ ID NO 53607 | GAAGGACCAAACATCTTTTG | TAG | chr17 | 42905555 | 42905574 | 42905571 | + |
| SEQ ID NO 53608 | TATGTTTGCTTTCATCATAA | CAG | chr17 | 42905581 | 42905600 | 42905597 | + |
| SEQ ID NO 53609 | CATCATAACAGCTTGTTATC | AAG | chr17 | 42905593 | 42905612 | 42905609 | + |
| SEQ ID NO 53610 | ATCATAACAGCTTGTTATCA | AGG | chr17 | 42905594 | 42905613 | 42905610 | + |
| SEQ ID NO 53611 | GAATTTCTCCCTGAAATTAA | TGG | chr17 | 42905619 | 42905638 | 42905635 | + |
| SEQ ID NO 53612 | ATTTCTCCCTGAAATTAATG | GAG | chr17 | 42905621 | 42905640 | 42905637 | + |
| SEQ ID NO 53613 | TTTCTCCCTGAAATTAATGG | AGG | chr17 | 42905622 | 42905641 | 42905638 | + |
| SEQ ID NO 53614 | CCCTGAAATTAATGGAGGCA | CAG | chr17 | 42905627 | 42905646 | 42905643 | + |
| SEQ ID NO 53615 | AAATTAATGGAGGCACAGAC | TGG | chr17 | 42905632 | 42905651 | 42905648 | + |
| SEQ ID NO 53616 | TAATGGAGGCACAGACTGGA | AAG | chr17 | 42905636 | 42905655 | 42905652 | + |
| SEQ ID NO 53617 | GGCACAGACTGGAAAGTTTA | AAG | chr17 | 42905643 | 42905662 | 42905659 | + |
| SEQ ID NO 53618 | ACAGACTGGAAAGTTTAAAG | TGG | chr17 | 42905646 | 42905665 | 42905662 | + |
| SEQ ID NO 53619 | GGAAAGTTTAAAGTGGCTTT | AAG | chr17 | 42905653 | 42905672 | 42905669 | + |
| SEQ ID NO 53620 | AAAGTTTAAAGTGGCTTTAA | GAG | chr17 | 42905655 | 42905674 | 42905671 | + |
| SEQ ID NO 53621 | AAGTTTAAAGTGGCTTTAAG | AGG | chr17 | 42905656 | 42905675 | 42905672 | + |
| SEQ ID NO 53622 | CTTTAAGAGGTTATTTATT | TAG | chr17 | 42905669 | 42905688 | 42905685 | + |
| SEQ ID NO 53623 | TATTTAGTCCTCTGTCTTAA | TAG | chr17 | 42905685 | 42905704 | 42905701 | + |
| SEQ ID NO 53624 | TTAGTCCTCTGTCTTAATAG | AAG | chr17 | 42905688 | 42905707 | 42905704 | + |
| SEQ ID NO 53625 | AAATTATTATCTCTGCTCCT | TAG | chr17 | 42905712 | 42905731 | 42905728 | + |
| SEQ ID NO 53626 | AATTATTATCTCTGCTCCTT | AGG | chr17 | 42905713 | 42905732 | 42905729 | + |
| SEQ ID NO 53627 | TATTATCTCTGCTCCTTAGG | TAG | chr17 | 42905716 | 42905735 | 42905732 | + |
| SEQ ID NO 53628 | TTATCTCTGCTCCTTAGGTA | GAG | chr17 | 42905718 | 42905737 | 42905734 | + |
| SEQ ID NO 53629 | TCTCTGCTCCTTAGGTAGAG | TAG | chr17 | 42905721 | 42905740 | 42905737 | + |
| SEQ ID NO 53630 | GCTCCTTAGGTAGAGTAGCT | AAG | chr17 | 42905726 | 42905745 | 42905742 | + |
| SEQ ID NO 53631 | CTCCTTAGGTAGAGTAGCTA | AGG | chr17 | 42905727 | 42905746 | 42905743 | + |
| SEQ ID NO 53632 | TAGGTAGAGTAGCTAAGGCT | CAG | chr17 | 42905732 | 42905751 | 42905748 | + |
| SEQ ID NO 53633 | TAGAGTAGCTAAGGCTCAGA | AAG | chr17 | 42905736 | 42905755 | 42905752 | + |
| SEQ ID NO 53634 | AGTAGCTAAGGCTCAGAAAG | TAG | chr17 | 42905739 | 42905758 | 42905755 | + |
| SEQ ID NO 53635 | GTAGCTAAGGCTCAGAAAGT | AGG | chr17 | 42905740 | 42905759 | 42905756 | + |

Figure 85 (Cont'd)

| SEQ ID NO 53636 | CTAAGGCTCAGAAAGTAGGC | CGG | chr17 | 42905744 | 42905763 | 42905760 | + |
| SEQ ID NO 53637 | TAAGGCTCAGAAAGTAGGCC | GGG | chr17 | 42905745 | 42905764 | 42905761 | + |
| SEQ ID NO 53638 | CTCAGAAAGTAGGCCGGGCG | CGG | chr17 | 42905750 | 42905769 | 42905766 | + |
| SEQ ID NO 53639 | AGAAAGTAGGCCGGGCGCGG | TGG | chr17 | 42905753 | 42905772 | 42905769 | + |
| SEQ ID NO 53640 | GTGGCTCACGCCTGTAATCC | TAG | chr17 | 42905772 | 42905791 | 42905788 | + |
| SEQ ID NO 53641 | CGCCTGTAATCCTAGCACTT | TGG | chr17 | 42905780 | 42905799 | 42905796 | + |
| SEQ ID NO 53642 | GCCTGTAATCCTAGCACTTT | GGG | chr17 | 42905781 | 42905800 | 42905797 | + |
| SEQ ID NO 53643 | CTGTAATCCTAGCACTTTGG | GAG | chr17 | 42905783 | 42905802 | 42905799 | + |
| SEQ ID NO 53644 | TGTAATCCTAGCACTTTGGG | AGG | chr17 | 42905784 | 42905803 | 42905800 | + |
| SEQ ID NO 53645 | AGCACTTTGGGAGGCCAACG | CAG | chr17 | 42905793 | 42905812 | 42905809 | + |
| SEQ ID NO 53646 | GCACTTTGGGAGGCCAACGC | AGG | chr17 | 42905794 | 42905813 | 42905810 | + |
| SEQ ID NO 53647 | CTTTGGGAGGCCAACGCAGG | TGG | chr17 | 42905797 | 42905816 | 42905813 | + |
| SEQ ID NO 53648 | CCAACGCAGGTGGATCACCT | GAG | chr17 | 42905807 | 42905826 | 42905823 | + |
| SEQ ID NO 53649 | CAACGCAGGTGGATCACCTG | AGG | chr17 | 42905808 | 42905827 | 42905824 | + |
| SEQ ID NO 53650 | GCAGGTGGATCACCTGAGGT | CAG | chr17 | 42905812 | 42905831 | 42905828 | + |
| SEQ ID NO 53651 | CAGGTGGATCACCTGAGGTC | AGG | chr17 | 42905813 | 42905832 | 42905829 | + |
| SEQ ID NO 53652 | GGTGGATCACCTGAGGTCAG | GAG | chr17 | 42905815 | 42905834 | 42905831 | + |
| SEQ ID NO 53653 | TCACCTGAGGTCAGGAGTTT | GAG | chr17 | 42905821 | 42905840 | 42905837 | + |
| SEQ ID NO 53654 | TGAGGTCAGGAGTTTGAGAC | CAG | chr17 | 42905826 | 42905845 | 42905842 | + |
| SEQ ID NO 53655 | TCAGGAGTTTGAGACCAGCC | TGG | chr17 | 42905831 | 42905850 | 42905847 | + |
| SEQ ID NO 53656 | TGAGACCAGCCTGGCCAACA | TGG | chr17 | 42905840 | 42905859 | 42905856 | + |
| SEQ ID NO 53657 | AATAAAAAAATACAAAAACT | TAG | chr17 | 42905878 | 42905897 | 42905894 | + |
| SEQ ID NO 53658 | AAAAAATACAAAAACTTAGC | CAG | chr17 | 42905882 | 42905901 | 42905898 | + |
| SEQ ID NO 53659 | AAAAATACAAAAACTTAGCC | AGG | chr17 | 42905883 | 42905902 | 42905899 | + |
| SEQ ID NO 53660 | TACAAAAACTTAGCCAGGCA | TGG | chr17 | 42905888 | 42905907 | 42905904 | + |
| SEQ ID NO 53661 | AAAAACTTAGCCAGGCATGG | TGG | chr17 | 42905891 | 42905910 | 42905907 | + |
| SEQ ID NO 53662 | AACTTAGCCAGGCATGGTGG | CGG | chr17 | 42905894 | 42905913 | 42905910 | + |
| SEQ ID NO 53663 | ACTTAGCCAGGCATGGTGGC | GGG | chr17 | 42905895 | 42905914 | 42905911 | + |
| SEQ ID NO 53664 | GTGGCGGGCGCCTGTAATCC | CAG | chr17 | 42905910 | 42905929 | 42905926 | + |
| SEQ ID NO 53665 | CGCCTGTAATCCCAGCTACC | CAG | chr17 | 42905918 | 42905937 | 42905934 | + |
| SEQ ID NO 53666 | GCCTGTAATCCCAGCTACCC | AGG | chr17 | 42905919 | 42905938 | 42905935 | + |
| SEQ ID NO 53667 | CTGTAATCCCAGCTACCCAG | GAG | chr17 | 42905921 | 42905940 | 42905937 | + |
| SEQ ID NO 53668 | TGTAATCCCAGCTACCCAGG | AGG | chr17 | 42905922 | 42905941 | 42905938 | + |
| SEQ ID NO 53669 | CCCAGCTACCCAGGAGGCTG | CGG | chr17 | 42905928 | 42905947 | 42905944 | + |
| SEQ ID NO 53670 | AGCTACCCAGGAGGCTGCGG | CAG | chr17 | 42905931 | 42905950 | 42905947 | + |
| SEQ ID NO 53671 | GCTACCCAGGAGGCTGCGGC | AGG | chr17 | 42905932 | 42905951 | 42905948 | + |
| SEQ ID NO 53672 | TACCCAGGAGGCTGCGGCAG | GAG | chr17 | 42905934 | 42905953 | 42905950 | + |
| SEQ ID NO 53673 | GCAGGAGAATCACTTCAACC | CGG | chr17 | 42905950 | 42905969 | 42905966 | + |
| SEQ ID NO 53674 | CAGGAGAATCACTTCAACCC | GGG | chr17 | 42905951 | 42905970 | 42905967 | + |
| SEQ ID NO 53675 | GGAGAATCACTTCAACCCGG | GAG | chr17 | 42905953 | 42905972 | 42905969 | + |
| SEQ ID NO 53676 | GAGAATCACTTCAACCCGGG | AGG | chr17 | 42905954 | 42905973 | 42905970 | + |
| SEQ ID NO 53677 | AATCACTTCAACCCGGGAGG | CAG | chr17 | 42905957 | 42905976 | 42905973 | + |
| SEQ ID NO 53678 | TCACTTCAACCCGGGAGGCA | GAG | chr17 | 42905959 | 42905978 | 42905975 | + |
| SEQ ID NO 53679 | CACTTCAACCCGGGAGGCAG | AGG | chr17 | 42905960 | 42905979 | 42905976 | + |
| SEQ ID NO 53680 | AACCCGGGAGGCAGAGGTTG | CAG | chr17 | 42905966 | 42905985 | 42905982 | + |
| SEQ ID NO 53681 | CGGGAGGCAGAGGTTGCAGT | GAG | chr17 | 42905970 | 42905989 | 42905986 | + |
| SEQ ID NO 53682 | GAAATCACACCACTGCACTC | CAG | chr17 | 42905995 | 42906014 | 42906011 | + |

Figure 85 (Cont'd)

| | | | | | | | |
|---|---|---|---|---|---|---|---|
| SEQ ID NO 53683 | ACACCACTGCACTCCAGCCT | TGG | chr17 | 42906001 | 42906020 | 42906017 | + |
| SEQ ID NO 53684 | CTGCACTCCAGCCTTGGTGA | CAG | chr17 | 42906007 | 42906026 | 42906023 | + |
| SEQ ID NO 53685 | GCACTCCAGCCTTGGTGACA | GAG | chr17 | 42906009 | 42906028 | 42906025 | + |
| SEQ ID NO 53686 | TCCAGCCTTGGTGACAGAGA | AAG | chr17 | 42906013 | 42906032 | 42906029 | + |
| SEQ ID NO 53687 | GTGACAGAGAAAGATTCTGT | CAG | chr17 | 42906023 | 42906042 | 42906039 | + |
| SEQ ID NO 53688 | TGACAGAGAAAGATTCTGTC | AGG | chr17 | 42906024 | 42906043 | 42906040 | + |
| SEQ ID NO 53689 | CTGTCAGGAAAAAAAAAAAA | AAG | chr17 | 42906039 | 42906058 | 42906055 | + |
| SEQ ID NO 53690 | AAAGTTTAAATGAATTACCC | AAG | chr17 | 42906058 | 42906077 | 42906074 | + |
| SEQ ID NO 53691 | AAGTTTAAATGAATTACCCA | AGG | chr17 | 42906059 | 42906078 | 42906075 | + |
| SEQ ID NO 53692 | TACCCAAGGTATATAATTGT | TAG | chr17 | 42906073 | 42906092 | 42906089 | + |
| SEQ ID NO 53693 | AGGTATATAATTGTTAGTGT | TAG | chr17 | 42906079 | 42906098 | 42906095 | + |
| SEQ ID NO 53694 | TATATAATTGTTAGTGTTAG | AAG | chr17 | 42906082 | 42906101 | 42906098 | + |
| SEQ ID NO 53695 | ATATAATTGTTAGTGTTAGA | AGG | chr17 | 42906083 | 42906102 | 42906099 | + |
| SEQ ID NO 53696 | TAATTGTTAGTGTTAGAAGG | AAG | chr17 | 42906086 | 42906105 | 42906102 | + |
| SEQ ID NO 53697 | TTGTTAGTGTTAGAAGGAAG | AAG | chr17 | 42906089 | 42906108 | 42906105 | + |
| SEQ ID NO 53698 | TTAGTGTTAGAAGGAAGAAG | AAG | chr17 | 42906092 | 42906111 | 42906108 | + |
| SEQ ID NO 53699 | TAGTGTTAGAAGGAAGAAGA | AGG | chr17 | 42906093 | 42906112 | 42906109 | + |
| SEQ ID NO 53700 | AGTGTTAGAAGGAAGAAGAA | GGG | chr17 | 42906094 | 42906113 | 42906110 | + |
| SEQ ID NO 53701 | TGTTAGAAGGAAGAAGAAGG | GAG | chr17 | 42906096 | 42906115 | 42906112 | + |
| SEQ ID NO 53702 | GTTAGAAGGAAGAAGAAGGG | AGG | chr17 | 42906097 | 42906116 | 42906113 | + |
| SEQ ID NO 53703 | TTAGAAGGAAGAAGAAGGGA | GGG | chr17 | 42906098 | 42906117 | 42906114 | + |
| SEQ ID NO 53704 | AGAAGGAAGAAGAAGGGAGG | GAG | chr17 | 42906100 | 42906119 | 42906116 | + |
| SEQ ID NO 53705 | GAAGGAAGAAGAAGGGAGGG | AGG | chr17 | 42906101 | 42906120 | 42906117 | + |
| SEQ ID NO 53706 | GGAAGAAGAAGGGAGGGAGG | AAG | chr17 | 42906104 | 42906123 | 42906120 | + |
| SEQ ID NO 53707 | GAAGAAGAAGGGAGGGAGGA | AGG | chr17 | 42906105 | 42906124 | 42906121 | + |
| SEQ ID NO 53708 | GAAGAAGGGAGGGAGGAAGG | AAG | chr17 | 42906108 | 42906127 | 42906124 | + |
| SEQ ID NO 53709 | AAGAAGGGAGGGAGGAAGGA | AGG | chr17 | 42906109 | 42906128 | 42906125 | + |
| SEQ ID NO 53710 | AGAAGGGAGGGAGGAAGGAA | GGG | chr17 | 42906110 | 42906129 | 42906126 | + |
| SEQ ID NO 53711 | AAGGGAGGGAGGAAGGAAGG | GAG | chr17 | 42906112 | 42906131 | 42906128 | + |
| SEQ ID NO 53712 | GAGGGAGGAAGGAAGGGAGA | AAG | chr17 | 42906116 | 42906135 | 42906132 | + |
| SEQ ID NO 53713 | GAGGAAGGAAGGGAGAAAGA | AAG | chr17 | 42906120 | 42906139 | 42906136 | + |
| SEQ ID NO 53714 | AGGAAGGAAGGGAGAAAGAA | AGG | chr17 | 42906121 | 42906140 | 42906137 | + |
| SEQ ID NO 53715 | GGAAGGAAGGGAGAAAGAAA | GGG | chr17 | 42906122 | 42906141 | 42906138 | + |
| SEQ ID NO 53716 | AGGAAGGGAGAAAGAAAGGG | AAG | chr17 | 42906125 | 42906144 | 42906141 | + |
| SEQ ID NO 53717 | GGAAGGGAGAAAGAAAGGGA | AGG | chr17 | 42906126 | 42906145 | 42906142 | + |
| SEQ ID NO 53718 | AAGGGAGAAAGAAAGGGAAG | GAG | chr17 | 42906128 | 42906147 | 42906144 | + |
| SEQ ID NO 53719 | AGGGAGAAAGAAAGGGAAGG | AGG | chr17 | 42906129 | 42906148 | 42906145 | + |
| SEQ ID NO 53720 | GAGAAAGAAAGGGAAGGAGG | AAG | chr17 | 42906132 | 42906151 | 42906148 | + |
| SEQ ID NO 53721 | AGAAAGAAAGGGAAGGAGGA | AGG | chr17 | 42906133 | 42906152 | 42906149 | + |
| SEQ ID NO 53722 | GAAAGAAAGGGAAGGAGGAA | GGG | chr17 | 42906134 | 42906153 | 42906150 | + |
| SEQ ID NO 53723 | AAGAAAGGGAAGGAGGAAGG | GAG | chr17 | 42906136 | 42906155 | 42906152 | + |
| SEQ ID NO 53724 | AGAAAGGGAAGGAGGAAGGG | AGG | chr17 | 42906137 | 42906156 | 42906153 | + |
| SEQ ID NO 53725 | GAAAGGGAAGGAGGAAGGGA | GGG | chr17 | 42906138 | 42906157 | 42906154 | + |
| SEQ ID NO 53726 | AAGGGAAGGAGGAAGGGAGG | GAG | chr17 | 42906140 | 42906159 | 42906156 | + |
| SEQ ID NO 53727 | AGGGAAGGAGGAAGGGAGGG | AGG | chr17 | 42906141 | 42906160 | 42906157 | + |
| SEQ ID NO 53728 | GGGAAGGAGGAAGGGAGGGA | GGG | chr17 | 42906142 | 42906161 | 42906158 | + |
| SEQ ID NO 53729 | AAGGAGGAAGGGAGGGAGGG | AAG | chr17 | 42906145 | 42906164 | 42906161 | + |

Figure 85 (Cont'd)

| | | | | | | | |
|---|---|---|---|---|---|---|---|
| SEQ ID NO 53730 | AGGAAGGGAGGGAGGGAAGA | AAG | chr17 | 42906149 | 42906168 | 42906165 | + |
| SEQ ID NO 53731 | AGAAAGCCTTTATTTATCTA | TGG | chr17 | 42906166 | 42906185 | 42906182 | + |
| SEQ ID NO 53732 | GAAAGCCTTTATTTATCTAT | GGG | chr17 | 42906167 | 42906186 | 42906183 | + |
| SEQ ID NO 53733 | AAAGCCTTTATTTATCTATG | GGG | chr17 | 42906168 | 42906187 | 42906184 | + |
| SEQ ID NO 53734 | TATTTATCTATGGGGTTCCC | TGG | chr17 | 42906176 | 42906195 | 42906192 | + |
| SEQ ID NO 53735 | TATCTATGGGGTTCCCTGGA | AAG | chr17 | 42906180 | 42906199 | 42906196 | + |
| SEQ ID NO 53736 | CTATGGGGTTCCCTGGAAAG | CAG | chr17 | 42906183 | 42906202 | 42906199 | + |
| SEQ ID NO 53737 | TATGGGGTTCCCTGGAAAGC | AGG | chr17 | 42906184 | 42906203 | 42906200 | + |
| SEQ ID NO 53738 | CCCTGGAAAGCAGGCTGAAA | TGG | chr17 | 42906193 | 42906212 | 42906209 | + |
| SEQ ID NO 53739 | CTGGAAAGCAGGCTGAAATG | GAG | chr17 | 42906195 | 42906214 | 42906211 | + |
| SEQ ID NO 53740 | CTGAAATGGAGATTCACGTG | CAG | chr17 | 42906207 | 42906226 | 42906223 | + |
| SEQ ID NO 53741 | TGAAATGGAGATTCACGTGC | AGG | chr17 | 42906208 | 42906227 | 42906224 | + |
| SEQ ID NO 53742 | AAATGGAGATTCACGTGCAG | GAG | chr17 | 42906210 | 42906229 | 42906226 | + |
| SEQ ID NO 53743 | GAGATTCACGTGCAGGAGTT | TAG | chr17 | 42906215 | 42906234 | 42906231 | + |
| SEQ ID NO 53744 | GTGCAGGAGTTTAGATACTC | TGG | chr17 | 42906224 | 42906243 | 42906240 | + |
| SEQ ID NO 53745 | TGCAGGAGTTTAGATACTCT | GGG | chr17 | 42906225 | 42906244 | 42906241 | + |
| SEQ ID NO 53746 | GCAGGAGTTTAGATACTCTG | GGG | chr17 | 42906226 | 42906245 | 42906242 | + |
| SEQ ID NO 53747 | ACTCTGGGGAACTATACTTG | TAG | chr17 | 42906240 | 42906259 | 42906256 | + |
| SEQ ID NO 53748 | CTGGGGAACTATACTTGTAG | AAG | chr17 | 42906243 | 42906262 | 42906259 | + |
| SEQ ID NO 53749 | TGGGGAACTATACTTGTAGA | AGG | chr17 | 42906244 | 42906263 | 42906260 | + |
| SEQ ID NO 53750 | GGGGAACTATACTTGTAGAA | GGG | chr17 | 42906245 | 42906264 | 42906261 | + |
| SEQ ID NO 53751 | GAACTATACTTGTAGAAGGG | AAG | chr17 | 42906248 | 42906267 | 42906264 | + |
| SEQ ID NO 53752 | AACTATACTTGTAGAAGGGA | AGG | chr17 | 42906249 | 42906268 | 42906265 | + |
| SEQ ID NO 53753 | TACTTGTAGAAGGGAAGGAA | CAG | chr17 | 42906254 | 42906273 | 42906270 | + |
| SEQ ID NO 53754 | ACTTGTAGAAGGGAAGGAAC | AGG | chr17 | 42906255 | 42906274 | 42906271 | + |
| SEQ ID NO 53755 | TAGAAGGGAAGGAACAGGAA | CAG | chr17 | 42906260 | 42906279 | 42906276 | + |
| SEQ ID NO 53756 | AGAAGGGAAGGAACAGGAAC | AGG | chr17 | 42906261 | 42906280 | 42906277 | + |
| SEQ ID NO 53757 | GAAGGGAAGGAACAGGAACA | GGG | chr17 | 42906262 | 42906281 | 42906278 | + |
| SEQ ID NO 53758 | GGGAAGGAACAGGAACAGGG | CAG | chr17 | 42906265 | 42906284 | 42906281 | + |
| SEQ ID NO 53759 | AAGGAACAGGAACAGGGCAG | AAG | chr17 | 42906268 | 42906287 | 42906284 | + |
| SEQ ID NO 53760 | AGGAACAGGAACAGGGCAGA | AGG | chr17 | 42906269 | 42906288 | 42906285 | + |
| SEQ ID NO 53761 | GAACAGGAACAGGGCAGAAG | GAG | chr17 | 42906271 | 42906290 | 42906287 | + |
| SEQ ID NO 53762 | ACAGGAACAGGGCAGAAGGA | GAG | chr17 | 42906273 | 42906292 | 42906289 | + |
| SEQ ID NO 53763 | CAGGAACAGGGCAGAAGGAG | AGG | chr17 | 42906274 | 42906293 | 42906290 | + |
| SEQ ID NO 53764 | ACAGGGCAGAAGGAGAGGTC | CGG | chr17 | 42906279 | 42906298 | 42906295 | + |
| SEQ ID NO 53765 | TTCTGCCTCATCCAACCCCA | CAG | chr17 | 42906308 | 42906327 | 42906324 | + |
| SEQ ID NO 53766 | GCCTCATCCAACCCCACAGC | GAG | chr17 | 42906312 | 42906331 | 42906328 | + |
| SEQ ID NO 53767 | CAACCCCACAGCGAGCTCTG | AAG | chr17 | 42906320 | 42906339 | 42906336 | + |
| SEQ ID NO 53768 | CCCACAGCGAGCTCTGAAGC | TGG | chr17 | 42906324 | 42906343 | 42906340 | + |
| SEQ ID NO 53769 | CCACAGCGAGCTCTGAAGCT | GGG | chr17 | 42906325 | 42906344 | 42906341 | + |
| SEQ ID NO 53770 | CACAGCGAGCTCTGAAGCTG | GGG | chr17 | 42906326 | 42906345 | 42906342 | + |
| SEQ ID NO 53771 | GCGAGCTCTGAAGCTGGGGA | TGG | chr17 | 42906330 | 42906349 | 42906346 | + |
| SEQ ID NO 53772 | TGAAGCTGGGGATGGCTCCT | CAG | chr17 | 42906338 | 42906357 | 42906354 | + |
| SEQ ID NO 53773 | AAGCTGGGGATGGCTCCTCA | GAG | chr17 | 42906340 | 42906359 | 42906356 | + |
| SEQ ID NO 53774 | TGGGGATGGCTCCTCAGAGT | TGG | chr17 | 42906344 | 42906363 | 42906360 | + |
| SEQ ID NO 53775 | TGGCTCCTCAGAGTTGGTCC | AAG | chr17 | 42906350 | 42906369 | 42906366 | + |
| SEQ ID NO 53776 | TCCTCAGAGTTGGTCCAAGT | TGG | chr17 | 42906354 | 42906373 | 42906370 | + |

Figure 85 (Cont'd)

| | | | | | | | |
|---|---|---|---|---|---|---|---|
| SEQ ID NO 53777 | CCTCAGAGTTGGTCCAAGTT | GGG | chr17 | 42906355 | 42906374 | 42906371 | + |
| SEQ ID NO 53778 | GAGTTGGTCCAAGTTGGGAC | AAG | chr17 | 42906360 | 42906379 | 42906376 | + |
| SEQ ID NO 53779 | AGTTGGTCCAAGTTGGGACA | AGG | chr17 | 42906361 | 42906380 | 42906377 | + |
| SEQ ID NO 53780 | GTTGGTCCAAGTTGGGACAA | GGG | chr17 | 42906362 | 42906381 | 42906378 | + |
| SEQ ID NO 53781 | CCAAGTTGGGACAAGGGAAT | CAG | chr17 | 42906368 | 42906387 | 42906384 | + |
| SEQ ID NO 53782 | GGGACAAGGGAATCAGACCC | TGG | chr17 | 42906375 | 42906394 | 42906391 | + |
| SEQ ID NO 53783 | GGACAAGGGAATCAGACCCT | GGG | chr17 | 42906376 | 42906395 | 42906392 | + |
| SEQ ID NO 53784 | GACAAGGGAATCAGACCCTG | GGG | chr17 | 42906377 | 42906396 | 42906393 | + |
| SEQ ID NO 53785 | CAAGGGAATCAGACCCTGGG | GAG | chr17 | 42906379 | 42906398 | 42906395 | + |
| SEQ ID NO 53786 | AGGGAATCAGACCCTGGGGA | GAG | chr17 | 42906381 | 42906400 | 42906397 | + |
| SEQ ID NO 53787 | GGGAGAGCGTAACCTTGATC | AAG | chr17 | 42906397 | 42906416 | 42906413 | + |
| SEQ ID NO 53788 | GGAGAGCGTAACCTTGATCA | AGG | chr17 | 42906398 | 42906417 | 42906414 | + |
| SEQ ID NO 53789 | TTGATCAAGGCGACTCTCTT | TAG | chr17 | 42906411 | 42906430 | 42906427 | + |
| SEQ ID NO 53790 | CAAGGCGACTCTCTTTAGCC | CAG | chr17 | 42906416 | 42906435 | 42906432 | + |
| SEQ ID NO 53791 | AAGGCGACTCTCTTTAGCCC | AGG | chr17 | 42906417 | 42906436 | 42906433 | + |
| SEQ ID NO 53792 | AGGCGACTCTCTTTAGCCCA | GGG | chr17 | 42906418 | 42906437 | 42906434 | + |
| SEQ ID NO 53793 | TCTTTAGCCCAGGGCAATGC | CAG | chr17 | 42906427 | 42906446 | 42906443 | + |
| SEQ ID NO 53794 | CTTTAGCCCAGGGCAATGCC | AGG | chr17 | 42906428 | 42906447 | 42906444 | + |
| SEQ ID NO 53795 | TTAGCCCAGGGCAATGCCAG | GAG | chr17 | 42906430 | 42906449 | 42906446 | + |
| SEQ ID NO 53796 | GCCCAGGGCAATGCCAGGAG | AAG | chr17 | 42906433 | 42906452 | 42906449 | + |
| SEQ ID NO 53797 | CCCAGGGCAATGCCAGGAGA | AGG | chr17 | 42906434 | 42906453 | 42906450 | + |
| SEQ ID NO 53798 | GGCAATGCCAGGAGAAGGCT | GAG | chr17 | 42906439 | 42906458 | 42906455 | + |
| SEQ ID NO 53799 | CAATGCCAGGAGAAGGCTGA | GAG | chr17 | 42906441 | 42906460 | 42906457 | + |
| SEQ ID NO 53800 | TGCCAGGAGAAGGCTGAGAG | CAG | chr17 | 42906444 | 42906463 | 42906460 | + |
| SEQ ID NO 53801 | AGGAGAAGGCTGAGAGCAGA | AAG | chr17 | 42906448 | 42906467 | 42906464 | + |
| SEQ ID NO 53802 | ATCTACCATCACACTCTCAA | CAG | chr17 | 42906473 | 42906492 | 42906489 | + |
| SEQ ID NO 53803 | ACTCTCAACAGCTACGAAAT | AAG | chr17 | 42906485 | 42906504 | 42906501 | + |
| SEQ ID NO 53804 | CAGCTACGAAATAAGTCCTG | CAG | chr17 | 42906493 | 42906512 | 42906509 | + |
| SEQ ID NO 53805 | ACGAAATAAGTCCTGCAGTT | CAG | chr17 | 42906498 | 42906517 | 42906514 | + |
| SEQ ID NO 53806 | CGAAATAAGTCCTGCAGTTC | AGG | chr17 | 42906499 | 42906518 | 42906515 | + |
| SEQ ID NO 53807 | AAATAAGTCCTGCAGTTCAG | GAG | chr17 | 42906501 | 42906520 | 42906517 | + |
| SEQ ID NO 53808 | AATAAGTCCTGCAGTTCAGG | AGG | chr17 | 42906502 | 42906521 | 42906518 | + |
| SEQ ID NO 53809 | ATAAGTCCTGCAGTTCAGGA | GGG | chr17 | 42906503 | 42906522 | 42906519 | + |
| SEQ ID NO 53810 | AAGTCCTGCAGTTCAGGAGG | GAG | chr17 | 42906505 | 42906524 | 42906521 | + |
| SEQ ID NO 53811 | AGTCCTGCAGTTCAGGAGGG | AGG | chr17 | 42906506 | 42906525 | 42906522 | + |
| SEQ ID NO 53812 | TGCAGTTCAGGAGGGAGGTC | TGG | chr17 | 42906511 | 42906530 | 42906527 | + |
| SEQ ID NO 53813 | GCAGTTCAGGAGGGAGGTCT | GGG | chr17 | 42906512 | 42906531 | 42906528 | + |
| SEQ ID NO 53814 | GTTCAGGAGGGAGGTCTGGG | CGG | chr17 | 42906515 | 42906534 | 42906531 | + |
| SEQ ID NO 53815 | GAGGTCTGGGCGGCACATCT | CAG | chr17 | 42906525 | 42906544 | 42906541 | + |
| SEQ ID NO 53816 | AGGTCTGGGCGGCACATCTC | AGG | chr17 | 42906526 | 42906545 | 42906542 | + |
| SEQ ID NO 53817 | TCTCAGGACCCTCTATCTCT | CAG | chr17 | 42906542 | 42906561 | 42906558 | + |
| SEQ ID NO 53818 | CTCAGGACCCTCTATCTCTC | AGG | chr17 | 42906543 | 42906562 | 42906559 | + |
| SEQ ID NO 53819 | TCAGGACCCTCTATCTCTCA | GGG | chr17 | 42906544 | 42906563 | 42906560 | + |
| SEQ ID NO 53820 | GGACCCTCTATCTCTCAGGG | TAG | chr17 | 42906547 | 42906566 | 42906563 | + |
| SEQ ID NO 53821 | ACCCTCTATCTCTCAGGGTA | GAG | chr17 | 42906549 | 42906568 | 42906565 | + |
| SEQ ID NO 53822 | CCCTCTATCTCTCAGGGTAG | AGG | chr17 | 42906550 | 42906569 | 42906566 | + |
| SEQ ID NO 53823 | TCTCTCAGGGTAGAGGAATT | AAG | chr17 | 42906557 | 42906576 | 42906573 | + |

Figure 85 (Cont'd)

| SEQ ID NO 53824 | CAGGGTAGAGGAATTAAGAA | TGG | chr17 | 42906562 | 42906581 | 42906578 | + |
| SEQ ID NO 53825 | AGGGTAGAGGAATTAAGAAT | GGG | chr17 | 42906563 | 42906582 | 42906579 | + |
| SEQ ID NO 53826 | TAGAGGAATTAAGAATGGGA | TGG | chr17 | 42906567 | 42906586 | 42906583 | + |
| SEQ ID NO 53827 | AGAGGAATTAAGAATGGGAT | GGG | chr17 | 42906568 | 42906587 | 42906584 | + |
| SEQ ID NO 53828 | ATTAAGAATGGGATGGGAAC | CAG | chr17 | 42906574 | 42906593 | 42906590 | + |
| SEQ ID NO 53829 | AGAATGGGATGGGAACCAGA | CGG | chr17 | 42906578 | 42906597 | 42906594 | + |
| SEQ ID NO 53830 | GAATGGGATGGGAACCAGAC | GGG | chr17 | 42906579 | 42906598 | 42906595 | + |
| SEQ ID NO 53831 | GATGGGAACCAGACGGGCCA | TGG | chr17 | 42906585 | 42906604 | 42906601 | + |
| SEQ ID NO 53832 | GGGAACCAGACGGGCCATGG | TGG | chr17 | 42906588 | 42906607 | 42906604 | + |
| SEQ ID NO 53833 | CACCTATAATCCCAACACTT | TGG | chr17 | 42906615 | 42906634 | 42906631 | + |
| SEQ ID NO 53834 | ACCTATAATCCCAACACTTT | GGG | chr17 | 42906616 | 42906635 | 42906632 | + |
| SEQ ID NO 53835 | CTATAATCCCAACACTTTGG | GAG | chr17 | 42906618 | 42906637 | 42906634 | + |
| SEQ ID NO 53836 | TATAATCCCAACACTTTGGG | AGG | chr17 | 42906619 | 42906638 | 42906635 | + |
| SEQ ID NO 53837 | TCCCAACACTTTGGGAGGCC | AAG | chr17 | 42906624 | 42906643 | 42906640 | + |
| SEQ ID NO 53838 | CCCAACACTTTGGGAGGCCA | AGG | chr17 | 42906625 | 42906644 | 42906641 | + |
| SEQ ID NO 53839 | CCAACACTTTGGGAGGCCAA | GGG | chr17 | 42906626 | 42906645 | 42906642 | + |
| SEQ ID NO 53840 | ACACTTTGGGAGGCCAAGGG | TAG | chr17 | 42906629 | 42906648 | 42906645 | + |
| SEQ ID NO 53841 | CACTTTGGGAGGCCAAGGGT | AGG | chr17 | 42906630 | 42906649 | 42906646 | + |
| SEQ ID NO 53842 | CTTTGGGAGGCCAAGGGTAG | GAG | chr17 | 42906632 | 42906651 | 42906648 | + |
| SEQ ID NO 53843 | TTTGGGAGGCCAAGGGTAGG | AGG | chr17 | 42906633 | 42906652 | 42906649 | + |
| SEQ ID NO 53844 | CAAGGGTAGGAGGATTGCTT | GAG | chr17 | 42906643 | 42906662 | 42906659 | + |
| SEQ ID NO 53845 | TAGGAGGATTGCTTGAGCCC | AAG | chr17 | 42906649 | 42906668 | 42906665 | + |
| SEQ ID NO 53846 | GGAGGATTGCTTGAGCCCAA | GAG | chr17 | 42906651 | 42906670 | 42906667 | + |
| SEQ ID NO 53847 | TGAGCCCAAGAGTTCAAAAC | CAG | chr17 | 42906662 | 42906681 | 42906678 | + |
| SEQ ID NO 53848 | CCAAGAGTTCAAAACCAGCC | TGG | chr17 | 42906667 | 42906686 | 42906683 | + |
| SEQ ID NO 53849 | CAAGAGTTCAAAACCAGCCT | GGG | chr17 | 42906668 | 42906687 | 42906684 | + |
| SEQ ID NO 53850 | TTTAAAAATTTGCTGTGTG | TGG | chr17 | 42906722 | 42906741 | 42906738 | + |
| SEQ ID NO 53851 | AAAAAATTTGCTGTGTGTGG | TGG | chr17 | 42906725 | 42906744 | 42906741 | + |
| SEQ ID NO 53852 | TGTGTGGTGGTGTGCACCTG | TGG | chr17 | 42906738 | 42906757 | 42906754 | + |
| SEQ ID NO 53853 | GTGGTGTGCACCTGTGGTCC | CAG | chr17 | 42906744 | 42906763 | 42906760 | + |
| SEQ ID NO 53854 | CACCTGTGGTCCCAGCTACT | CAG | chr17 | 42906752 | 42906771 | 42906768 | + |
| SEQ ID NO 53855 | ACCTGTGGTCCCAGCTACTC | AGG | chr17 | 42906753 | 42906772 | 42906769 | + |
| SEQ ID NO 53856 | CCTGTGGTCCCAGCTACTCA | GGG | chr17 | 42906754 | 42906773 | 42906770 | + |
| SEQ ID NO 53857 | CTGTGGTCCCAGCTACTCAG | GGG | chr17 | 42906755 | 42906774 | 42906771 | + |
| SEQ ID NO 53858 | TGTGGTCCCAGCTACTCAGG | GGG | chr17 | 42906756 | 42906775 | 42906772 | + |
| SEQ ID NO 53859 | TCCCAGCTACTCAGGGGGCT | GAG | chr17 | 42906761 | 42906780 | 42906777 | + |
| SEQ ID NO 53860 | CCCAGCTACTCAGGGGGCTG | AGG | chr17 | 42906762 | 42906781 | 42906778 | + |
| SEQ ID NO 53861 | AGCTACTCAGGGGGCTGAGG | TGG | chr17 | 42906765 | 42906784 | 42906781 | + |
| SEQ ID NO 53862 | GCTACTCAGGGGGCTGAGGT | GGG | chr17 | 42906766 | 42906785 | 42906782 | + |
| SEQ ID NO 53863 | TACTCAGGGGGCTGAGGTGG | GAG | chr17 | 42906768 | 42906787 | 42906784 | + |
| SEQ ID NO 53864 | ACTCAGGGGGCTGAGGTGGG | AGG | chr17 | 42906769 | 42906788 | 42906785 | + |
| SEQ ID NO 53865 | CTGAGGTGGGAGGATTGCTT | GAG | chr17 | 42906779 | 42906798 | 42906795 | + |
| SEQ ID NO 53866 | GTGGGAGGATTGCTTGAGTC | CAG | chr17 | 42906784 | 42906803 | 42906800 | + |
| SEQ ID NO 53867 | TGGGAGGATTGCTTGAGTCC | AGG | chr17 | 42906785 | 42906804 | 42906801 | + |
| SEQ ID NO 53868 | GGAGGATTGCTTGAGTCCAG | GAG | chr17 | 42906787 | 42906806 | 42906803 | + |
| SEQ ID NO 53869 | GAGGATTGCTTGAGTCCAGG | AGG | chr17 | 42906788 | 42906807 | 42906804 | + |
| SEQ ID NO 53870 | TTGCTTGAGTCCAGGAGGTC | GAG | chr17 | 42906793 | 42906812 | 42906809 | + |

Figure 85 (Cont'd)

| SEQ ID NO 53871 | TGCTTGAGTCCAGGAGGTCG | AGG | chr17 | 42906794 | 42906813 | 42906810 | + |
| SEQ ID NO 53872 | AGTCCAGGAGGTCGAGGCTG | CAG | chr17 | 42906800 | 42906819 | 42906816 | + |
| SEQ ID NO 53873 | CAGGAGGTCGAGGCTGCAGT | GAG | chr17 | 42906804 | 42906823 | 42906820 | + |
| SEQ ID NO 53874 | GCTGCAGTGAGCTATGATCA | TGG | chr17 | 42906816 | 42906835 | 42906832 | + |
| SEQ ID NO 53875 | ATGATCATGGCACTGCATTG | CAG | chr17 | 42906829 | 42906848 | 42906845 | + |
| SEQ ID NO 53876 | CATGGCACTGCATTGCAGCC | TAG | chr17 | 42906834 | 42906853 | 42906850 | + |
| SEQ ID NO 53877 | ATGGCACTGCATTGCAGCCT | AGG | chr17 | 42906835 | 42906854 | 42906851 | + |
| SEQ ID NO 53878 | GGCACTGCATTGCAGCCTAG | GAG | chr17 | 42906837 | 42906856 | 42906853 | + |
| SEQ ID NO 53879 | GCATTGCAGCCTAGGAGACA | AAG | chr17 | 42906843 | 42906862 | 42906859 | + |
| SEQ ID NO 53880 | TGCAGCCTAGGAGACAAAGC | AAG | chr17 | 42906847 | 42906866 | 42906863 | + |
| SEQ ID NO 53881 | AAACAAACAAATAAAAAAA | CGG | chr17 | 42906891 | 42906910 | 42906907 | + |
| SEQ ID NO 53882 | AACAAATAAAAAAACGGAAC | CGG | chr17 | 42906897 | 42906916 | 42906913 | + |
| SEQ ID NO 53883 | AAAAAAACGGAACCGGTTGC | AAG | chr17 | 42906904 | 42906923 | 42906920 | + |
| SEQ ID NO 53884 | AAAACGGAACCGGTTGCAAG | CAG | chr17 | 42906907 | 42906926 | 42906923 | + |
| SEQ ID NO 53885 | AAACGGAACCGGTTGCAAGC | AGG | chr17 | 42906908 | 42906927 | 42906924 | + |
| SEQ ID NO 53886 | AACGGAACCGGTTGCAAGCA | GGG | chr17 | 42906909 | 42906928 | 42906925 | + |
| SEQ ID NO 53887 | CGGTTGCAAGCAGGGTTAAA | TAG | chr17 | 42906917 | 42906936 | 42906933 | + |
| SEQ ID NO 53888 | GCAAGCAGGGTTAAATAGCG | TGG | chr17 | 42906922 | 42906941 | 42906938 | + |
| SEQ ID NO 53889 | GCAGGGTTAAATAGCGTGGT | CAG | chr17 | 42906926 | 42906945 | 42906942 | + |
| SEQ ID NO 53890 | AGGGTTAAATAGCGTGGTCA | GAG | chr17 | 42906928 | 42906947 | 42906944 | + |
| SEQ ID NO 53891 | GTTAAATAGCGTGGTCAGAG | TAG | chr17 | 42906931 | 42906950 | 42906947 | + |
| SEQ ID NO 53892 | TTAAATAGCGTGGTCAGAGT | AGG | chr17 | 42906932 | 42906951 | 42906948 | + |
| SEQ ID NO 53893 | TGGTCAGAGTAGGACTCACT | GAG | chr17 | 42906942 | 42906961 | 42906958 | + |
| SEQ ID NO 53894 | GTAGGACTCACTGAGAATAT | GAG | chr17 | 42906950 | 42906969 | 42906966 | + |
| SEQ ID NO 53895 | TCACTGAGAATATGAGATCT | GAG | chr17 | 42906957 | 42906976 | 42906973 | + |
| SEQ ID NO 53896 | GAGAATATGAGATCTGAGTC | AAG | chr17 | 42906962 | 42906981 | 42906978 | + |
| SEQ ID NO 53897 | GAGATCTGAGTCAAGTCTTC | AAG | chr17 | 42906970 | 42906989 | 42906986 | + |
| SEQ ID NO 53898 | AGATCTGAGTCAAGTCTTCA | AGG | chr17 | 42906971 | 42906990 | 42906987 | + |
| SEQ ID NO 53899 | AGTCAAGTCTTCAAGGATGT | GAG | chr17 | 42906978 | 42906997 | 42906994 | + |
| SEQ ID NO 53900 | GTCAAGTCTTCAAGGATGTG | AGG | chr17 | 42906979 | 42906998 | 42906995 | + |
| SEQ ID NO 53901 | AAGTCTTCAAGGATGTGAGG | AAG | chr17 | 42906982 | 42907001 | 42906998 | + |
| SEQ ID NO 53902 | CTTCAAGGATGTGAGGAAGT | AAG | chr17 | 42906986 | 42907005 | 42907002 | + |
| SEQ ID NO 53903 | GATGTGAGGAAGTAAGTTTC | TGG | chr17 | 42906993 | 42907012 | 42907009 | + |
| SEQ ID NO 53904 | GTGAGGAAGTAAGTTTCTGG | CAG | chr17 | 42906996 | 42907015 | 42907012 | + |
| SEQ ID NO 53905 | AGGAAGTAAGTTTCTGGCAG | AAG | chr17 | 42906999 | 42907018 | 42907015 | + |
| SEQ ID NO 53906 | GAAGTAAGTTTCTGGCAGAA | GAG | chr17 | 42907001 | 42907020 | 42907017 | + |
| SEQ ID NO 53907 | TTTCTGGCAGAAGAGCTGTG | AAG | chr17 | 42907009 | 42907028 | 42907025 | + |
| SEQ ID NO 53908 | TTCTGGCAGAAGAGCTGTGA | AGG | chr17 | 42907010 | 42907029 | 42907026 | + |
| SEQ ID NO 53909 | TCTGGCAGAAGAGCTGTGAA | GGG | chr17 | 42907011 | 42907030 | 42907027 | + |
| SEQ ID NO 53910 | AAGAGCTGTGAAGGGCTGTC | TGG | chr17 | 42907019 | 42907038 | 42907035 | + |
| SEQ ID NO 53911 | GCTGTGAAGGGCTGTCTGGC | CAG | chr17 | 42907023 | 42907042 | 42907039 | + |
| SEQ ID NO 53912 | TGTGAAGGGCTGTCTGGCCA | GAG | chr17 | 42907025 | 42907044 | 42907041 | + |
| SEQ ID NO 53913 | GAAGGGCTGTCTGGCCAGAG | AAG | chr17 | 42907028 | 42907047 | 42907044 | + |
| SEQ ID NO 53914 | CAGAGAAGATTGCAATGCAA | AAG | chr17 | 42907043 | 42907062 | 42907059 | + |
| SEQ ID NO 53915 | GATTGCAATGCAAAAGCCCT | GAG | chr17 | 42907050 | 42907069 | 42907066 | + |
| SEQ ID NO 53916 | ATTGCAATGCAAAAGCCCTG | AGG | chr17 | 42907051 | 42907070 | 42907067 | + |
| SEQ ID NO 53917 | GCAATGCAAAAGCCCTGAGG | TGG | chr17 | 42907054 | 42907073 | 42907070 | + |

Figure 85 (Cont'd)

| SEQ ID NO 53918 | CAATGCAAAAGCCCTGAGGT | GGG | chr17 | 42907055 | 42907074 | 42907071 | + |
| SEQ ID NO 53919 | CCCTGAGGTGGGAACGTGTT | TGG | chr17 | 42907066 | 42907085 | 42907082 | + |
| SEQ ID NO 53920 | GAACGTGTTTGGTGTGTTTA | AAG | chr17 | 42907077 | 42907096 | 42907093 | + |
| SEQ ID NO 53921 | AACGTGTTTGGTGTGTTTAA | AGG | chr17 | 42907078 | 42907097 | 42907094 | + |
| SEQ ID NO 53922 | TGTTTGGTGTGTTTAAAGGA | AAG | chr17 | 42907082 | 42907101 | 42907098 | + |
| SEQ ID NO 53923 | TGTGTTTAAAGGAAAGCAAT | GAG | chr17 | 42907089 | 42907108 | 42907105 | + |
| SEQ ID NO 53924 | GTGTTTAAAGGAAAGCAATG | AGG | chr17 | 42907090 | 42907109 | 42907106 | + |
| SEQ ID NO 53925 | TTAAAGGAAAGCAATGAGGC | CAG | chr17 | 42907094 | 42907113 | 42907110 | + |
| SEQ ID NO 53926 | GGAAAGCAATGAGGCCAGTG | TAG | chr17 | 42907099 | 42907118 | 42907115 | + |
| SEQ ID NO 53927 | AGCAATGAGGCCAGTGTAGC | CAG | chr17 | 42907103 | 42907122 | 42907119 | + |
| SEQ ID NO 53928 | TGAGGCCAGTGTAGCCAGAA | CAG | chr17 | 42907108 | 42907127 | 42907124 | + |
| SEQ ID NO 53929 | AGGCCAGTGTAGCCAGAACA | GAG | chr17 | 42907110 | 42907129 | 42907126 | + |
| SEQ ID NO 53930 | GTAGCCAGAACAGAGTGTGC | AAG | chr17 | 42907118 | 42907137 | 42907134 | + |
| SEQ ID NO 53931 | TAGCCAGAACAGAGTGTGCA | AGG | chr17 | 42907119 | 42907138 | 42907135 | + |
| SEQ ID NO 53932 | GCCAGAACAGAGTGTGCAAG | GAG | chr17 | 42907121 | 42907140 | 42907137 | + |
| SEQ ID NO 53933 | CAGAACAGAGTGTGCAAGGA | GAG | chr17 | 42907123 | 42907142 | 42907139 | + |
| SEQ ID NO 53934 | AACAGAGTGTGCAAGGAGAG | AAG | chr17 | 42907126 | 42907145 | 42907142 | + |
| SEQ ID NO 53935 | ACAGAGTGTGCAAGGAGAGA | AGG | chr17 | 42907127 | 42907146 | 42907143 | + |
| SEQ ID NO 53936 | GTGTGCAAGGAGAGAAGGAA | CAG | chr17 | 42907132 | 42907151 | 42907148 | + |
| SEQ ID NO 53937 | TGCAAGGAGAGAAGGAACAG | AAG | chr17 | 42907135 | 42907154 | 42907151 | + |
| SEQ ID NO 53938 | GAGAGAAGGAACAGAAGATG | TGG | chr17 | 42907141 | 42907160 | 42907157 | + |
| SEQ ID NO 53939 | GAGAAGGAACAGAAGATGTG | GAG | chr17 | 42907143 | 42907162 | 42907159 | + |
| SEQ ID NO 53940 | AGAAGGAACAGAAGATGTGG | AGG | chr17 | 42907144 | 42907163 | 42907160 | + |
| SEQ ID NO 53941 | GAAGGAACAGAAGATGTGGA | GGG | chr17 | 42907145 | 42907164 | 42907161 | + |
| SEQ ID NO 53942 | GGAACAGAAGATGTGGAGGG | CAG | chr17 | 42907148 | 42907167 | 42907164 | + |
| SEQ ID NO 53943 | AGAAGATGTGGAGGGCAGAT | CAG | chr17 | 42907153 | 42907172 | 42907169 | + |
| SEQ ID NO 53944 | TCAGTTTGTAATTGTACGCC | CAG | chr17 | 42907172 | 42907191 | 42907188 | + |
| SEQ ID NO 53945 | CTGATTCTTTGTGTAATCTC | CAG | chr17 | 42907199 | 42907218 | 42907215 | + |
| SEQ ID NO 53946 | TCCAGACTGTATTAAACTGC | AAG | chr17 | 42907217 | 42907236 | 42907233 | + |
| SEQ ID NO 53947 | CAGACTGTATTAAACTGCAA | GAG | chr17 | 42907219 | 42907238 | 42907235 | + |
| SEQ ID NO 53948 | ACTGTATTAAACTGCAAGAG | CAG | chr17 | 42907222 | 42907241 | 42907238 | + |
| SEQ ID NO 53949 | CTGTATTAAACTGCAAGAGC | AGG | chr17 | 42907223 | 42907242 | 42907239 | + |
| SEQ ID NO 53950 | TGTATTAAACTGCAAGAGCA | GGG | chr17 | 42907224 | 42907243 | 42907240 | + |
| SEQ ID NO 53951 | GCAAGAGCAGGGCCCCTCTC | TGG | chr17 | 42907235 | 42907254 | 42907251 | + |
| SEQ ID NO 53952 | TTTGCTCATCATTGTATTCC | CAG | chr17 | 42907259 | 42907278 | 42907275 | + |
| SEQ ID NO 53953 | TGCTCATCATTGTATTCCCA | GAG | chr17 | 42907261 | 42907280 | 42907277 | + |
| SEQ ID NO 53954 | CCAGAGCCTTGCACAATGCT | TGG | chr17 | 42907278 | 42907297 | 42907294 | + |
| SEQ ID NO 53955 | CTTGCACAATGCTTGGTGCA | TAG | chr17 | 42907285 | 42907304 | 42907301 | + |
| SEQ ID NO 53956 | TTGCACAATGCTTGGTGCAT | AGG | chr17 | 42907286 | 42907305 | 42907302 | + |
| SEQ ID NO 53957 | GCACAATGCTTGGTGCATAG | GAG | chr17 | 42907288 | 42907307 | 42907304 | + |
| SEQ ID NO 53958 | AATGCTTGGTGCATAGGAGA | TGG | chr17 | 42907292 | 42907311 | 42907308 | + |
| SEQ ID NO 53959 | TTTGTTAAATAAATGAATTA | TGG | chr17 | 42907318 | 42907337 | 42907334 | + |
| SEQ ID NO 53960 | AATGAATTATGGATAACGAA | TGG | chr17 | 42907329 | 42907348 | 42907345 | + |
| SEQ ID NO 53961 | AATTATGGATAACGAATGGA | TGG | chr17 | 42907333 | 42907352 | 42907349 | + |
| SEQ ID NO 53962 | ATGGATAACGAATGGATGGT | AAG | chr17 | 42907337 | 42907356 | 42907353 | + |
| SEQ ID NO 53963 | ATAACGAATGGATGGTAAGA | TGG | chr17 | 42907341 | 42907360 | 42907357 | + |
| SEQ ID NO 53964 | TAACGAATGGATGGTAAGAT | GGG | chr17 | 42907342 | 42907361 | 42907358 | + |

Figure 85 (Cont'd)

| | | | | | | | |
|---|---|---|---|---|---|---|---|
| SEQ ID NO 53965 | CGAATGGATGGTAAGATGGG | TGG | chr17 | 42907345 | 42907364 | 42907361 | + |
| SEQ ID NO 53966 | TGGATGGTAAGATGGGTGGA | TGG | chr17 | 42907349 | 42907368 | 42907365 | + |
| SEQ ID NO 53967 | TGGTAAGATGGGTGGATGGA | TGG | chr17 | 42907353 | 42907372 | 42907369 | + |
| SEQ ID NO 53968 | GGTAAGATGGGTGGATGGAT | GGG | chr17 | 42907354 | 42907373 | 42907370 | + |
| SEQ ID NO 53969 | GTAAGATGGGTGGATGGATG | GGG | chr17 | 42907355 | 42907374 | 42907371 | + |
| SEQ ID NO 53970 | TAAGATGGGTGGATGGATGG | GGG | chr17 | 42907356 | 42907375 | 42907372 | + |
| SEQ ID NO 53971 | AAGATGGGTGGATGGATGGG | GGG | chr17 | 42907357 | 42907376 | 42907373 | + |
| SEQ ID NO 53972 | GTGGATGGATGGGGGGTGAA | CGG | chr17 | 42907364 | 42907383 | 42907380 | + |
| SEQ ID NO 53973 | ATGGATGGGGGGTGAACGGA | TGG | chr17 | 42907368 | 42907387 | 42907384 | + |
| SEQ ID NO 53974 | ATGGGGGGTGAACGGATGGA | TGG | chr17 | 42907372 | 42907391 | 42907388 | + |
| SEQ ID NO 53975 | TGGGGGGTGAACGGATGGAT | GGG | chr17 | 42907373 | 42907392 | 42907389 | + |
| SEQ ID NO 53976 | GGGGGGTGAACGGATGGATG | GGG | chr17 | 42907374 | 42907393 | 42907390 | + |
| SEQ ID NO 53977 | GGGGGTGAACGGATGGATGG | GGG | chr17 | 42907375 | 42907394 | 42907391 | + |
| SEQ ID NO 53978 | GGGGTGAACGGATGGATGGG | GGG | chr17 | 42907376 | 42907395 | 42907392 | + |
| SEQ ID NO 53979 | ACGGATGGATGGGGGGTGAA | TGG | chr17 | 42907383 | 42907402 | 42907399 | + |
| SEQ ID NO 53980 | ATGGATGGGGGGTGAATGGA | TGG | chr17 | 42907387 | 42907406 | 42907403 | + |
| SEQ ID NO 53981 | GGGGTGAATGGATGGATGAA | TGG | chr17 | 42907395 | 42907414 | 42907411 | + |
| SEQ ID NO 53982 | GGGTGAATGGATGGATGAAT | GGG | chr17 | 42907396 | 42907415 | 42907412 | + |
| SEQ ID NO 53983 | TGAATGGATGGATGAATGGG | TAG | chr17 | 42907399 | 42907418 | 42907415 | + |
| SEQ ID NO 53984 | TGGATGGATGAATGGGTAGA | TGG | chr17 | 42907403 | 42907422 | 42907419 | + |
| SEQ ID NO 53985 | GGATGGATGAATGGGTAGAT | GGG | chr17 | 42907404 | 42907423 | 42907420 | + |
| SEQ ID NO 53986 | TGGATGAATGGGTAGATGGG | TGG | chr17 | 42907407 | 42907426 | 42907423 | + |
| SEQ ID NO 53987 | TGAATGGGTAGATGGGTGGA | TAG | chr17 | 42907411 | 42907430 | 42907427 | + |
| SEQ ID NO 53988 | GAATGGGTAGATGGGTGGAT | AGG | chr17 | 42907412 | 42907431 | 42907428 | + |
| SEQ ID NO 53989 | AATGGGTAGATGGGTGGATA | GGG | chr17 | 42907413 | 42907432 | 42907429 | + |
| SEQ ID NO 53990 | ATGGGTAGATGGGTGGATAG | GGG | chr17 | 42907414 | 42907433 | 42907430 | + |
| SEQ ID NO 53991 | TGGGTAGATGGGTGGATAGG | GGG | chr17 | 42907415 | 42907434 | 42907431 | + |
| SEQ ID NO 53992 | TAGATGGGTGGATAGGGGGA | TGG | chr17 | 42907419 | 42907438 | 42907435 | + |
| SEQ ID NO 53993 | TGGGTGGATAGGGGGATGGC | TGG | chr17 | 42907423 | 42907442 | 42907439 | + |
| SEQ ID NO 53994 | GGGTGGATAGGGGGATGGCT | GGG | chr17 | 42907424 | 42907443 | 42907440 | + |
| SEQ ID NO 53995 | TGGATAGGGGGATGGCTGGG | TGG | chr17 | 42907427 | 42907446 | 42907443 | + |
| SEQ ID NO 53996 | TAGGGGGATGGCTGGGTGGC | TGG | chr17 | 42907431 | 42907450 | 42907447 | + |
| SEQ ID NO 53997 | AGGGGGATGGCTGGGTGGCT | GGG | chr17 | 42907432 | 42907451 | 42907448 | + |
| SEQ ID NO 53998 | GGGATGGCTGGGTGGCTGGG | TAG | chr17 | 42907435 | 42907454 | 42907451 | + |
| SEQ ID NO 53999 | GTAGATGATGCACTGTCTCC | CAG | chr17 | 42907454 | 42907473 | 42907470 | + |
| SEQ ID NO 54000 | TGATGCACTGTCTCCCAGAT | GAG | chr17 | 42907459 | 42907478 | 42907475 | + |
| SEQ ID NO 54001 | GATGCACTGTCTCCCAGATG | AGG | chr17 | 42907460 | 42907479 | 42907476 | + |
| SEQ ID NO 54002 | CCATTCTCTTTCCTGCCCTT | TAG | chr17 | 42907500 | 42907519 | 42907516 | + |
| SEQ ID NO 54003 | CATTCTCTTTCCTGCCCTTT | AGG | chr17 | 42907501 | 42907520 | 42907517 | + |
| SEQ ID NO 54004 | ATTCTCTTTCCTGCCCTTTA | GGG | chr17 | 42907502 | 42907521 | 42907518 | + |
| SEQ ID NO 54005 | TCTCTTTCCTGCCCTTTAGG | GAG | chr17 | 42907504 | 42907523 | 42907520 | + |
| SEQ ID NO 54006 | TGCCCTTTAGGGAGCCCCTC | TGG | chr17 | 42907513 | 42907532 | 42907529 | + |
| SEQ ID NO 54007 | GAGCCCCTCTGGCCATGCCA | TGG | chr17 | 42907524 | 42907543 | 42907540 | + |
| SEQ ID NO 54008 | AGCCCCTCTGGCCATGCCAT | GGG | chr17 | 42907525 | 42907544 | 42907541 | + |
| SEQ ID NO 54009 | CTCTGGCCATGCCATGGGCA | CAG | chr17 | 42907530 | 42907549 | 42907546 | + |
| SEQ ID NO 54010 | TGGCCATGCCATGGGCACAG | CAG | chr17 | 42907533 | 42907552 | 42907549 | + |
| SEQ ID NO 54011 | GGCCATGCCATGGGCACAGC | AGG | chr17 | 42907534 | 42907553 | 42907550 | + |

Figure 85 (Cont'd)

| | | | | | | | |
|---|---|---|---|---|---|---|---|
| SEQ ID NO 54012 | AGCAGGTGTATACTACGTGA | TGG | chr17 | 42907551 | 42907570 | 42907567 | + |
| SEQ ID NO 54013 | CATCTACTCTTTCCATCTTT | CAG | chr17 | 42907577 | 42907596 | 42907593 | + |
| SEQ ID NO 54014 | ATCTACTCTTTCCATCTTTC | AGG | chr17 | 42907578 | 42907597 | 42907594 | + |
| SEQ ID NO 54015 | TCTACTCTTTCCATCTTTCA | GGG | chr17 | 42907579 | 42907598 | 42907595 | + |
| SEQ ID NO 54016 | CTCTTTCCATCTTTCAGGGA | AAG | chr17 | 42907583 | 42907602 | 42907599 | + |
| SEQ ID NO 54017 | CCATCTTTCAGGGAAAGATA | AAG | chr17 | 42907589 | 42907608 | 42907605 | + |
| SEQ ID NO 54018 | GGAAAGATAAAGCCGACCTA | CAG | chr17 | 42907600 | 42907619 | 42907616 | + |
| SEQ ID NO 54019 | TAAAGCCGACCTACAGATTT | CGG | chr17 | 42907607 | 42907626 | 42907623 | + |
| SEQ ID NO 54020 | GCCGACCTACAGATTTCGGT | AAG | chr17 | 42907611 | 42907630 | 42907627 | + |
| SEQ ID NO 54021 | TTTCGGTAAGAACTCACCAC | TGG | chr17 | 42907624 | 42907643 | 42907640 | + |
| SEQ ID NO 54022 | TTCGGTAAGAACTCACCACT | GGG | chr17 | 42907625 | 42907644 | 42907641 | + |
| SEQ ID NO 54023 | TCGGTAAGAACTCACCACTG | GGG | chr17 | 42907626 | 42907645 | 42907642 | + |
| SEQ ID NO 54024 | AAGAACTCACCACTGGGGTG | TAG | chr17 | 42907631 | 42907650 | 42907647 | + |
| SEQ ID NO 54025 | AGAACTCACCACTGGGGTGT | AGG | chr17 | 42907632 | 42907651 | 42907648 | + |
| SEQ ID NO 54026 | ACTCACCACTGGGGTGTAGG | TGG | chr17 | 42907635 | 42907654 | 42907651 | + |
| SEQ ID NO 54027 | CACCACTGGGGTGTAGGTGG | TGG | chr17 | 42907638 | 42907657 | 42907654 | + |
| SEQ ID NO 54028 | CCACTGGGGTGTAGGTGGTG | GAG | chr17 | 42907640 | 42907659 | 42907656 | + |
| SEQ ID NO 54029 | CACTGGGGTGTAGGTGGTGG | AGG | chr17 | 42907641 | 42907660 | 42907657 | + |
| SEQ ID NO 54030 | ACTGGGGTGTAGGTGGTGGA | GGG | chr17 | 42907642 | 42907661 | 42907658 | + |
| SEQ ID NO 54031 | GGGGTGTAGGTGGTGGAGGG | CAG | chr17 | 42907645 | 42907664 | 42907661 | + |
| SEQ ID NO 54032 | GGGTGTAGGTGGTGGAGGGC | AGG | chr17 | 42907646 | 42907665 | 42907662 | + |
| SEQ ID NO 54033 | GTGTAGGTGGTGGAGGGCAG | GAG | chr17 | 42907648 | 42907667 | 42907664 | + |
| SEQ ID NO 54034 | TGTAGGTGGTGGAGGGCAGG | AGG | chr17 | 42907649 | 42907668 | 42907665 | + |
| SEQ ID NO 54035 | AGGTGGTGGAGGGCAGGAGG | CAG | chr17 | 42907652 | 42907671 | 42907668 | + |
| SEQ ID NO 54036 | GCAGGAGGCAGCTCTCTCTG | TAG | chr17 | 42907664 | 42907683 | 42907680 | + |
| SEQ ID NO 54037 | TATTCTTCCTCACATCCCCC | TAG | chr17 | 42907700 | 42907719 | 42907716 | + |
| SEQ ID NO 54038 | CCCTAGCCCGCTCCCACACC | TGG | chr17 | 42907717 | 42907736 | 42907733 | + |
| SEQ ID NO 54039 | CCTAGCCCGCTCCCACACCT | GGG | chr17 | 42907718 | 42907737 | 42907734 | + |
| SEQ ID NO 54040 | AGCCCGCTCCCACACCTGGG | CAG | chr17 | 42907721 | 42907740 | 42907737 | + |
| SEQ ID NO 54041 | CACCTGGGCAGCCGCTGATT | AAG | chr17 | 42907733 | 42907752 | 42907749 | + |
| SEQ ID NO 54042 | CCTGGGCAGCCGCTGATTAA | GAG | chr17 | 42907735 | 42907754 | 42907751 | + |
| SEQ ID NO 54043 | CAGCCGCTGATTAAGAGTTG | TGG | chr17 | 42907741 | 42907760 | 42907757 | + |
| SEQ ID NO 54044 | GATTAAGAGTTGTGGCACTT | TGG | chr17 | 42907749 | 42907768 | 42907765 | + |
| SEQ ID NO 54045 | AAGAGTTGTGGCACTTTGGA | TAG | chr17 | 42907753 | 42907772 | 42907769 | + |
| SEQ ID NO 54046 | AGAGTTGTGGCACTTTGGAT | AGG | chr17 | 42907754 | 42907773 | 42907770 | + |
| SEQ ID NO 54047 | GAGTTGTGGCACTTTGGATA | GGG | chr17 | 42907755 | 42907774 | 42907771 | + |
| SEQ ID NO 54048 | CTTTGGATAGGGATAAACCT | CAG | chr17 | 42907766 | 42907785 | 42907782 | + |
| SEQ ID NO 54049 | TTGGATAGGGATAAACCTCA | GAG | chr17 | 42907768 | 42907787 | 42907784 | + |
| SEQ ID NO 54050 | ATAGGGATAAACCTCAGAGT | CAG | chr17 | 42907772 | 42907791 | 42907788 | + |
| SEQ ID NO 54051 | TAGGGATAAACCTCAGAGTC | AGG | chr17 | 42907773 | 42907792 | 42907789 | + |
| SEQ ID NO 54052 | AGGGATAAACCTCAGAGTCA | GGG | chr17 | 42907774 | 42907793 | 42907790 | + |
| SEQ ID NO 54053 | CCTCAGAGTCAGGGAATGTT | TGG | chr17 | 42907783 | 42907802 | 42907799 | + |
| SEQ ID NO 54054 | CTCAGAGTCAGGGAATGTTT | GGG | chr17 | 42907784 | 42907803 | 42907800 | + |
| SEQ ID NO 54055 | TCAGGGAATGTTTGGGCTGA | AAG | chr17 | 42907791 | 42907810 | 42907807 | + |
| SEQ ID NO 54056 | CAGGGAATGTTTGGGCTGAA | AGG | chr17 | 42907792 | 42907811 | 42907808 | + |
| SEQ ID NO 54057 | AGGGAATGTTTGGGCTGAAA | GGG | chr17 | 42907793 | 42907812 | 42907809 | + |
| SEQ ID NO 54058 | TGTTTGGGCTGAAAGGGATC | CAG | chr17 | 42907799 | 42907818 | 42907815 | + |

Figure 85 (Cont'd)

| | | | | | | | |
|---|---|---|---|---|---|---|---|
| SEQ ID NO 54059 | TTGGGCTGAAAGGGATCCAG | TAG | chr17 | 42907802 | 42907821 | 42907818 | + |
| SEQ ID NO 54060 | TAGTGCAATCCGTTGTTTTA | CAG | chr17 | 42907822 | 42907841 | 42907838 | + |
| SEQ ID NO 54061 | CAATCCGTTGTTTTACAGAT | AAG | chr17 | 42907827 | 42907846 | 42907843 | + |
| SEQ ID NO 54062 | AATCCGTTGTTTTACAGATA | AGG | chr17 | 42907828 | 42907847 | 42907844 | + |
| SEQ ID NO 54063 | GTTTTACAGATAAGGAAACA | AAG | chr17 | 42907836 | 42907855 | 42907852 | + |
| SEQ ID NO 54064 | AAACAAAGCCCAACACCATG | AAG | chr17 | 42907851 | 42907870 | 42907867 | + |
| SEQ ID NO 54065 | AACAAAGCCCAACACCATGA | AGG | chr17 | 42907852 | 42907871 | 42907868 | + |
| SEQ ID NO 54066 | ACAAAGCCCAACACCATGAA | GGG | chr17 | 42907853 | 42907872 | 42907869 | + |
| SEQ ID NO 54067 | ATGAAGGGACTTATAAAAAT | AAG | chr17 | 42907868 | 42907887 | 42907884 | + |
| SEQ ID NO 54068 | TGAAGGGACTTATAAAAATA | AGG | chr17 | 42907869 | 42907888 | 42907885 | + |
| SEQ ID NO 54069 | AGGGACTTATAAAAATAAGG | TAG | chr17 | 42907872 | 42907891 | 42907888 | + |
| SEQ ID NO 54070 | CTTATAAAAATAAGGTAGTG | AAG | chr17 | 42907877 | 42907896 | 42907893 | + |
| SEQ ID NO 54071 | ATAAAAATAAGGTAGTGAAG | TAG | chr17 | 42907880 | 42907899 | 42907896 | + |
| SEQ ID NO 54072 | AAAATAAGGTAGTGAAGTAG | CAG | chr17 | 42907883 | 42907902 | 42907899 | + |
| SEQ ID NO 54073 | ATAAGGTAGTGAAGTAGCAG | CAG | chr17 | 42907886 | 42907905 | 42907902 | + |
| SEQ ID NO 54074 | TAAGGTAGTGAAGTAGCAGC | AGG | chr17 | 42907887 | 42907906 | 42907903 | + |
| SEQ ID NO 54075 | AAGGTAGTGAAGTAGCAGCA | GGG | chr17 | 42907888 | 42907907 | 42907904 | + |
| SEQ ID NO 54076 | ACCCATGTCTGTACCAACCA | CAG | chr17 | 42907922 | 42907941 | 42907938 | + |
| SEQ ID NO 54077 | CCATGTCTGTACCAACCACA | GAG | chr17 | 42907924 | 42907943 | 42907940 | + |
| SEQ ID NO 54078 | CAACCACAGAGTCACCCATC | CAG | chr17 | 42907936 | 42907955 | 42907952 | + |
| SEQ ID NO 54079 | AACCACAGAGTCACCCATCC | AGG | chr17 | 42907937 | 42907956 | 42907953 | + |
| SEQ ID NO 54080 | CCCATCCAGGTTAAAATAAC | CAG | chr17 | 42907950 | 42907969 | 42907966 | + |
| SEQ ID NO 54081 | CATCCAGGTTAAAATAACCA | GAG | chr17 | 42907952 | 42907971 | 42907968 | + |
| SEQ ID NO 54082 | GGTTAAAATAACCAGAGAAA | CAG | chr17 | 42907958 | 42907977 | 42907974 | + |
| SEQ ID NO 54083 | TAAAATAACCAGAGAAACAG | AAG | chr17 | 42907961 | 42907980 | 42907977 | + |
| SEQ ID NO 54084 | AACAGAAGATATTCCTACTA | CAG | chr17 | 42907976 | 42907995 | 42907992 | + |
| SEQ ID NO 54085 | CAGAAGATATTCCTACTACA | GAG | chr17 | 42907978 | 42907997 | 42907994 | + |
| SEQ ID NO 54086 | ATTCCTACTACAGAGAATTC | CGG | chr17 | 42907986 | 42908005 | 42908002 | + |
| SEQ ID NO 54087 | TTCCTACTACAGAGAATTCC | GGG | chr17 | 42907987 | 42908006 | 42908003 | + |
| SEQ ID NO 54088 | TACAGAGAATTCCGGGTGTG | CAG | chr17 | 42907994 | 42908013 | 42908010 | + |
| SEQ ID NO 54089 | GAATTCCGGGTGTGCAGCCA | CAG | chr17 | 42908000 | 42908019 | 42908016 | + |
| SEQ ID NO 54090 | TCCTTTTTATTTTTATTTTT | GAG | chr17 | 42908029 | 42908048 | 42908045 | + |
| SEQ ID NO 54091 | TTATTTTTATTTTTGAGATG | CAG | chr17 | 42908035 | 42908054 | 42908051 | + |
| SEQ ID NO 54092 | TGCAGTCTCGCTCTGTCATC | CAG | chr17 | 42908053 | 42908072 | 42908069 | + |
| SEQ ID NO 54093 | GCAGTCTCGCTCTGTCATCC | AGG | chr17 | 42908054 | 42908073 | 42908070 | + |
| SEQ ID NO 54094 | TCGCTCTGTCATCCAGGCTG | AAG | chr17 | 42908060 | 42908079 | 42908076 | + |
| SEQ ID NO 54095 | CTGTCATCCAGGCTGAAGTG | CAG | chr17 | 42908065 | 42908084 | 42908081 | + |
| SEQ ID NO 54096 | TCATCCAGGCTGAAGTGCAG | TGG | chr17 | 42908068 | 42908087 | 42908084 | + |
| SEQ ID NO 54097 | TCGCTGCAACCTCTGCCTCC | CAG | chr17 | 42908103 | 42908122 | 42908119 | + |
| SEQ ID NO 54098 | CGCTGCAACCTCTGCCTCCC | AGG | chr17 | 42908104 | 42908123 | 42908120 | + |
| SEQ ID NO 54099 | AACCTCTGCCTCCCAGGCTC | AAG | chr17 | 42908110 | 42908129 | 42908126 | + |
| SEQ ID NO 54100 | CTCAAGCGATCCTCCCACCT | CAG | chr17 | 42908127 | 42908146 | 42908143 | + |
| SEQ ID NO 54101 | TCCTCCCACCTCAGCCATCT | GAG | chr17 | 42908136 | 42908155 | 42908152 | + |
| SEQ ID NO 54102 | TCCCACCTCAGCCATCTGAG | TAG | chr17 | 42908139 | 42908158 | 42908155 | + |
| SEQ ID NO 54103 | ACCTCAGCCATCTGAGTAGC | TGG | chr17 | 42908143 | 42908162 | 42908159 | + |
| SEQ ID NO 54104 | CCTCAGCCATCTGAGTAGCT | GGG | chr17 | 42908144 | 42908163 | 42908160 | + |
| SEQ ID NO 54105 | CATCTGAGTAGCTGGGACCA | CAG | chr17 | 42908151 | 42908170 | 42908167 | + |

Figure 85 (Cont'd)

| SEQ ID NO 54106 | ATCTGAGTAGCTGGGACCAC | AGG | chr17 | 42908152 | 42908171 | 42908168 | + |
| SEQ ID NO 54107 | CACAGGCCACACACCACACC | CAG | chr17 | 42908169 | 42908188 | 42908185 | + |
| SEQ ID NO 54108 | TAATTTCTCGTATCTTTTTG | TAG | chr17 | 42908193 | 42908212 | 42908209 | + |
| SEQ ID NO 54109 | ATTTCTCGTATCTTTTTGTA | GAG | chr17 | 42908195 | 42908214 | 42908211 | + |
| SEQ ID NO 54110 | CTCGTATCTTTTTGTAGAGA | CAG | chr17 | 42908199 | 42908218 | 42908215 | + |
| SEQ ID NO 54111 | CGTATCTTTTTGTAGAGACA | GAG | chr17 | 42908201 | 42908220 | 42908217 | + |
| SEQ ID NO 54112 | CAGAGTTCTGCTATGTTGCC | CAG | chr17 | 42908219 | 42908238 | 42908235 | + |
| SEQ ID NO 54113 | AGAGTTCTGCTATGTTGCCC | AGG | chr17 | 42908220 | 42908239 | 42908236 | + |
| SEQ ID NO 54114 | TCTGCTATGTTGCCCAGGCT | CAG | chr17 | 42908225 | 42908244 | 42908241 | + |
| SEQ ID NO 54115 | CTGCTATGTTGCCCAGGCTC | AGG | chr17 | 42908226 | 42908245 | 42908242 | + |
| SEQ ID NO 54116 | TATGTTGCCCAGGCTCAGGC | TGG | chr17 | 42908230 | 42908249 | 42908246 | + |
| SEQ ID NO 54117 | CTCAGGCTGGTCTTGATCTC | AAG | chr17 | 42908243 | 42908262 | 42908259 | + |
| SEQ ID NO 54118 | TGGTCTTGATCTCAAGCAAT | TGG | chr17 | 42908250 | 42908269 | 42908266 | + |
| SEQ ID NO 54119 | CTCAAGCAATTGGCTTGCCT | CAG | chr17 | 42908260 | 42908279 | 42908276 | + |
| SEQ ID NO 54120 | GCCTCAGCCTCCTAAAATAT | TGG | chr17 | 42908276 | 42908295 | 42908292 | + |
| SEQ ID NO 54121 | CCTCAGCCTCCTAAAATATT | GGG | chr17 | 42908277 | 42908296 | 42908293 | + |
| SEQ ID NO 54122 | CTCCTAAAATATTGGGATTA | CAG | chr17 | 42908284 | 42908303 | 42908300 | + |
| SEQ ID NO 54123 | TCCTAAAATATTGGGATTAC | AGG | chr17 | 42908285 | 42908304 | 42908301 | + |
| SEQ ID NO 54124 | AATATTGGGATTACAGGCAT | GAG | chr17 | 42908291 | 42908310 | 42908307 | + |
| SEQ ID NO 54125 | ACAGGCATGAGCCACCGCGC | CAG | chr17 | 42908303 | 42908322 | 42908319 | + |
| SEQ ID NO 54126 | GCAAATCCTTAATTATCAAA | CAG | chr17 | 42908330 | 42908349 | 42908346 | + |
| SEQ ID NO 54127 | TAATTATCAAACAGATAAAA | TAG | chr17 | 42908339 | 42908358 | 42908355 | + |
| SEQ ID NO 54128 | AATTATCAAACAGATAAAAT | AGG | chr17 | 42908340 | 42908359 | 42908356 | + |
| SEQ ID NO 54129 | ATTATCAAACAGATAAAATA | GGG | chr17 | 42908341 | 42908360 | 42908357 | + |
| SEQ ID NO 54130 | ATCAAACAGATAAAATAGGG | AAG | chr17 | 42908344 | 42908363 | 42908360 | + |
| SEQ ID NO 54131 | AAGTTAAAATTCATATACAC | AAG | chr17 | 42908364 | 42908383 | 42908380 | + |
| SEQ ID NO 54132 | AGTTAAAATTCATATACACA | AGG | chr17 | 42908365 | 42908384 | 42908381 | + |
| SEQ ID NO 54133 | GTTAAAATTCATATACACAA | GGG | chr17 | 42908366 | 42908385 | 42908382 | + |
| SEQ ID NO 54134 | CAAGGGTTAACCACTTGCCA | CAG | chr17 | 42908383 | 42908402 | 42908399 | + |
| SEQ ID NO 54135 | AAGGGTTAACCACTTGCCAC | AGG | chr17 | 42908384 | 42908403 | 42908400 | + |
| SEQ ID NO 54136 | GGCATTTTTTTTTTTTTTTT | GAG | chr17 | 42908405 | 42908424 | 42908421 | + |
| SEQ ID NO 54137 | TTTTTTTTTTTTTTTTGAGA | CGG | chr17 | 42908409 | 42908428 | 42908425 | + |
| SEQ ID NO 54138 | CGGAATCTCGCTCTGTTGCC | CAG | chr17 | 42908429 | 42908448 | 42908445 | + |
| SEQ ID NO 54139 | GGAATCTCGCTCTGTTGCCC | AGG | chr17 | 42908430 | 42908449 | 42908446 | + |
| SEQ ID NO 54140 | TCTCGCTCTGTTGCCCAGGC | TGG | chr17 | 42908434 | 42908453 | 42908450 | + |
| SEQ ID NO 54141 | TCGCTCTGTTGCCCAGGCTG | GAG | chr17 | 42908436 | 42908455 | 42908452 | + |
| SEQ ID NO 54142 | CTGTTGCCCAGGCTGGAGTG | CAG | chr17 | 42908441 | 42908460 | 42908457 | + |
| SEQ ID NO 54143 | TTGCCCAGGCTGGAGTGCAG | TGG | chr17 | 42908444 | 42908463 | 42908460 | + |
| SEQ ID NO 54144 | TCACTGCAACCTCCGCTTCC | TGG | chr17 | 42908479 | 42908498 | 42908495 | + |
| SEQ ID NO 54145 | CACTGCAACCTCCGCTTCCT | GGG | chr17 | 42908480 | 42908499 | 42908496 | + |
| SEQ ID NO 54146 | AACCTCCGCTTCCTGGGTTC | AAG | chr17 | 42908486 | 42908505 | 42908502 | + |
| SEQ ID NO 54147 | TTCAAGCTATTCTTCTGCCT | CAG | chr17 | 42908503 | 42908522 | 42908519 | + |
| SEQ ID NO 54148 | TTCTTCTGCCTCAGCCTACC | GAG | chr17 | 42908512 | 42908531 | 42908528 | + |
| SEQ ID NO 54149 | TTCTGCCTCAGCCTACCGAG | TAG | chr17 | 42908515 | 42908534 | 42908531 | + |
| SEQ ID NO 54150 | GCCTCAGCCTACCGAGTAGC | TGG | chr17 | 42908519 | 42908538 | 42908535 | + |
| SEQ ID NO 54151 | CCTCAGCCTACCGAGTAGCT | GGG | chr17 | 42908520 | 42908539 | 42908536 | + |
| SEQ ID NO 54152 | CTACCGAGTAGCTGGGACTA | CAG | chr17 | 42908527 | 42908546 | 42908543 | + |

Figure 85 (Cont'd)

| | | | | | | | |
|---|---|---|---|---|---|---|---|
| SEQ ID NO 54153 | TACCGAGTAGCTGGGACTAC | AGG | chr17 | 42908528 | 42908547 | 42908544 | + |
| SEQ ID NO 54154 | CAGGCACGTGCCACCACACC | TGG | chr17 | 42908547 | 42908566 | 42908563 | + |
| SEQ ID NO 54155 | CTGGCTAATTTTTTTATTTT | TAG | chr17 | 42908566 | 42908585 | 42908582 | + |
| SEQ ID NO 54156 | GCTAATTTTTTTATTTTTAG | TAG | chr17 | 42908569 | 42908588 | 42908585 | + |
| SEQ ID NO 54157 | TAATTTTTTTATTTTTAGTA | GAG | chr17 | 42908571 | 42908590 | 42908587 | + |
| SEQ ID NO 54158 | TTTTTTATTTTTAGTAGAGA | TGG | chr17 | 42908575 | 42908594 | 42908591 | + |
| SEQ ID NO 54159 | TTTTTATTTTTAGTAGAGAT | GGG | chr17 | 42908576 | 42908595 | 42908592 | + |
| SEQ ID NO 54160 | TTTTATTTTTAGTAGAGATG | GGG | chr17 | 42908577 | 42908596 | 42908593 | + |
| SEQ ID NO 54161 | GAGATGGGGTTTCACCATAT | TGG | chr17 | 42908591 | 42908610 | 42908607 | + |
| SEQ ID NO 54162 | TGGGGTTTCACCATATTGGC | CAG | chr17 | 42908595 | 42908614 | 42908611 | + |
| SEQ ID NO 54163 | GGGGTTTCACCATATTGGCC | AGG | chr17 | 42908596 | 42908615 | 42908612 | + |
| SEQ ID NO 54164 | TTTCACCATATTGGCCAGGC | TGG | chr17 | 42908600 | 42908619 | 42908616 | + |
| SEQ ID NO 54165 | CTGGTCTTGAACTCCTGACC | TAG | chr17 | 42908619 | 42908638 | 42908635 | + |
| SEQ ID NO 54166 | ACCTAGTGATCCATCCGCCT | CAG | chr17 | 42908636 | 42908655 | 42908652 | + |
| SEQ ID NO 54167 | CCATCCGCCTCAGCCTCCCA | AAG | chr17 | 42908646 | 42908665 | 42908662 | + |
| SEQ ID NO 54168 | GCCTCAGCCTCCCAAAGTGC | TGG | chr17 | 42908652 | 42908671 | 42908668 | + |
| SEQ ID NO 54169 | CCTCAGCCTCCCAAAGTGCT | GGG | chr17 | 42908653 | 42908672 | 42908669 | + |
| SEQ ID NO 54170 | CTCCCAAAGTGCTGGGATTG | CAG | chr17 | 42908660 | 42908679 | 42908676 | + |
| SEQ ID NO 54171 | TCCCAAAGTGCTGGGATTGC | AGG | chr17 | 42908661 | 42908680 | 42908677 | + |
| SEQ ID NO 54172 | AGTGCTGGGATTGCAGGCAT | GAG | chr17 | 42908667 | 42908686 | 42908683 | + |
| SEQ ID NO 54173 | CAGGCATGAGCCACCGCGCC | TGG | chr17 | 42908680 | 42908699 | 42908696 | + |
| SEQ ID NO 54174 | GGCCTTTTTTTTTTTTTTTT | GAG | chr17 | 42908701 | 42908720 | 42908717 | + |
| SEQ ID NO 54175 | TTTTTTTTTTTTTTTGAGA | CGG | chr17 | 42908705 | 42908724 | 42908721 | + |
| SEQ ID NO 54176 | TTTTTTTTTTTTTGAGACG | GAG | chr17 | 42908707 | 42908726 | 42908723 | + |
| SEQ ID NO 54177 | GGAGTTTTGCTCTTGTTGCC | CAG | chr17 | 42908726 | 42908745 | 42908742 | + |
| SEQ ID NO 54178 | GAGTTTTGCTCTTGTTGCCC | AGG | chr17 | 42908727 | 42908746 | 42908743 | + |
| SEQ ID NO 54179 | TTTGCTCTTGTTGCCCAGGC | TAG | chr17 | 42908731 | 42908750 | 42908747 | + |
| SEQ ID NO 54180 | TGCTCTTGTTGCCCAGGCTA | GAG | chr17 | 42908733 | 42908752 | 42908749 | + |
| SEQ ID NO 54181 | TTGTTGCCCAGGCTAGAGTG | CAG | chr17 | 42908738 | 42908757 | 42908754 | + |
| SEQ ID NO 54182 | TTGCCCAGGCTAGAGTGCAG | TGG | chr17 | 42908741 | 42908760 | 42908757 | + |
| SEQ ID NO 54183 | CAGGCTAGAGTGCAGTGGCG | CAG | chr17 | 42908746 | 42908765 | 42908762 | + |
| SEQ ID NO 54184 | AGAGTGCAGTGGCGCAGTCT | CGG | chr17 | 42908752 | 42908771 | 42908768 | + |
| SEQ ID NO 54185 | CACTGTAACCTCCACCTCCT | GAG | chr17 | 42908777 | 42908796 | 42908793 | + |
| SEQ ID NO 54186 | AACCTCCACCTCCTGAGTTC | AAG | chr17 | 42908783 | 42908802 | 42908799 | + |
| SEQ ID NO 54187 | TTCAAGCAATTCTCCTGCCT | CAG | chr17 | 42908800 | 42908819 | 42908816 | + |
| SEQ ID NO 54188 | TCCTGCCTCAGCCTCTCAAA | TAG | chr17 | 42908812 | 42908831 | 42908828 | + |
| SEQ ID NO 54189 | GCCTCAGCCTCTCAAATAGC | TGG | chr17 | 42908816 | 42908835 | 42908832 | + |
| SEQ ID NO 54190 | CCTCAGCCTCTCAAATAGCT | GGG | chr17 | 42908817 | 42908836 | 42908833 | + |
| SEQ ID NO 54191 | CTCTCAAATAGCTGGGATTA | CAG | chr17 | 42908824 | 42908843 | 42908840 | + |
| SEQ ID NO 54192 | TCTCAAATAGCTGGGATTAC | AGG | chr17 | 42908825 | 42908844 | 42908841 | + |
| SEQ ID NO 54193 | ATAGCTGGGATTACAGGCGT | GAG | chr17 | 42908831 | 42908850 | 42908847 | + |
| SEQ ID NO 54194 | CAGGCGTGAGCCACCCCACC | TGG | chr17 | 42908844 | 42908863 | 42908860 | + |
| SEQ ID NO 54195 | TAATTTTGTAATTTTTTTTT | TAG | chr17 | 42908868 | 42908887 | 42908884 | + |
| SEQ ID NO 54196 | TTTTGTAATTTTTTTTTTAG | TAG | chr17 | 42908871 | 42908890 | 42908887 | + |
| SEQ ID NO 54197 | TTGTAATTTTTTTTTTAGTA | GAG | chr17 | 42908873 | 42908892 | 42908889 | + |
| SEQ ID NO 54198 | AATTTTTTTTTTAGTAGAGA | TGG | chr17 | 42908877 | 42908896 | 42908893 | + |
| SEQ ID NO 54199 | ATTTTTTTTTTAGTAGAGAT | GGG | chr17 | 42908878 | 42908897 | 42908894 | + |

Figure 85 (Cont'd)

| | | | | | | | |
|---|---|---|---|---|---|---|---|
| SEQ ID NO 54200 | TTTTTTTTTTAGTAGAGATG | GGG | chr17 | 42908879 | 42908898 | 42908895 | + |
| SEQ ID NO 54201 | ATGGGGTTTCACCTGTTGAT | CAG | chr17 | 42908896 | 42908915 | 42908912 | + |
| SEQ ID NO 54202 | TGGGGTTTCACCTGTTGATC | AGG | chr17 | 42908897 | 42908916 | 42908913 | + |
| SEQ ID NO 54203 | GTTTCACCTGTTGATCAGGC | TGG | chr17 | 42908901 | 42908920 | 42908917 | + |
| SEQ ID NO 54204 | GGTCTCAAACTCCTGACCTC | AAG | chr17 | 42908922 | 42908941 | 42908938 | + |
| SEQ ID NO 54205 | CTCAAGTGATCCACCCACCT | CGG | chr17 | 42908939 | 42908958 | 42908955 | + |
| SEQ ID NO 54206 | CCACCCACCTCGGCCTCCCA | AAG | chr17 | 42908949 | 42908968 | 42908965 | + |
| SEQ ID NO 54207 | ACCTCGGCCTCCCAAAGTGC | TGG | chr17 | 42908955 | 42908974 | 42908971 | + |
| SEQ ID NO 54208 | CCTCGGCCTCCCAAAGTGCT | GGG | chr17 | 42908956 | 42908975 | 42908972 | + |
| SEQ ID NO 54209 | TCCCAAAGTGCTGGGATTAC | AAG | chr17 | 42908964 | 42908983 | 42908980 | + |
| SEQ ID NO 54210 | AGTGCTGGGATTACAAGCAT | AAG | chr17 | 42908970 | 42908989 | 42908986 | + |
| SEQ ID NO 54211 | CAAGCATAAGCCACCGTGCC | TGG | chr17 | 42908983 | 42909002 | 42908999 | + |
| SEQ ID NO 54212 | GTCAATTTTGATCTTTTTTA | AAG | chr17 | 42909005 | 42909024 | 42909021 | + |
| SEQ ID NO 54213 | CAATTTTGATCTTTTTTAAA | GAG | chr17 | 42909007 | 42909026 | 42909023 | + |
| SEQ ID NO 54214 | TTTGATCTTTTTTAAAGAGA | CAG | chr17 | 42909011 | 42909030 | 42909027 | + |
| SEQ ID NO 54215 | TTGATCTTTTTTAAAGAGAC | AGG | chr17 | 42909012 | 42909031 | 42909028 | + |
| SEQ ID NO 54216 | TGATCTTTTTTAAAGAGACA | GGG | chr17 | 42909013 | 42909032 | 42909029 | + |
| SEQ ID NO 54217 | GATCTTTTTTAAAGAGACAG | GGG | chr17 | 42909014 | 42909033 | 42909030 | + |
| SEQ ID NO 54218 | AGGGGTCTTGCTATGTTGCC | CAG | chr17 | 42909032 | 42909051 | 42909048 | + |
| SEQ ID NO 54219 | TCTTGCTATGTTGCCCAGAC | TAG | chr17 | 42909037 | 42909056 | 42909053 | + |
| SEQ ID NO 54220 | CCAGACTAGTCTTGAACTCC | TGG | chr17 | 42909051 | 42909070 | 42909067 | + |
| SEQ ID NO 54221 | AGTCTTGAACTCCTGGCCTC | AAG | chr17 | 42909058 | 42909077 | 42909074 | + |
| SEQ ID NO 54222 | CTCAAGTGATCCTCTCACCT | CGG | chr17 | 42909075 | 42909094 | 42909091 | + |
| SEQ ID NO 54223 | CCTCTCACCTCGGCCTCCCA | AAG | chr17 | 42909085 | 42909104 | 42909101 | + |
| SEQ ID NO 54224 | ACCTCGGCCTCCCAAAGTAT | TGG | chr17 | 42909091 | 42909110 | 42909107 | + |
| SEQ ID NO 54225 | CCTCGGCCTCCCAAAGTATT | GGG | chr17 | 42909092 | 42909111 | 42909108 | + |
| SEQ ID NO 54226 | CTCCCAAAGTATTGGGATTA | CAG | chr17 | 42909099 | 42909118 | 42909115 | + |
| SEQ ID NO 54227 | TCCCAAAGTATTGGGATTAC | AGG | chr17 | 42909100 | 42909119 | 42909116 | + |
| SEQ ID NO 54228 | AGTATTGGGATTACAGGTCT | GAG | chr17 | 42909106 | 42909125 | 42909122 | + |
| SEQ ID NO 54229 | CAGGTCTGAGCCGCTGCACC | CAG | chr17 | 42909119 | 42909138 | 42909135 | + |
| SEQ ID NO 54230 | CCGCTGCACCCAGCCCCCAA | CAG | chr17 | 42909129 | 42909148 | 42909145 | + |
| SEQ ID NO 54231 | CGCTGCACCCAGCCCCCAAC | AGG | chr17 | 42909130 | 42909149 | 42909146 | + |
| SEQ ID NO 54232 | CAGCCCCCAACAGGCATCTT | TGG | chr17 | 42909139 | 42909158 | 42909155 | + |
| SEQ ID NO 54233 | ACAGGCATCTTTGGACTTTT | GAG | chr17 | 42909148 | 42909167 | 42909164 | + |
| SEQ ID NO 54234 | ATCTTTGGACTTTTGAGTAC | TGG | chr17 | 42909154 | 42909173 | 42909170 | + |
| SEQ ID NO 54235 | TAATTTACAAAAATTCCACT | GAG | chr17 | 42909180 | 42909199 | 42909196 | + |
| SEQ ID NO 54236 | ATTTACAAAAATTCCACTGA | GAG | chr17 | 42909182 | 42909201 | 42909198 | + |
| SEQ ID NO 54237 | AAATTCCACTGAGAGCACCT | AAG | chr17 | 42909190 | 42909209 | 42909206 | + |
| SEQ ID NO 54238 | CTGAGAGCACCTAAGTTTGC | CAG | chr17 | 42909198 | 42909217 | 42909214 | + |
| SEQ ID NO 54239 | TGAGAGCACCTAAGTTTGCC | AGG | chr17 | 42909199 | 42909218 | 42909215 | + |
| SEQ ID NO 54240 | GCCAGGCTCCAACATTTCTG | CAG | chr17 | 42909216 | 42909235 | 42909232 | + |
| SEQ ID NO 54241 | CCAGGCTCCAACATTTCTGC | AGG | chr17 | 42909217 | 42909236 | 42909233 | + |
| SEQ ID NO 54242 | CAGGCTCCAACATTTCTGCA | GGG | chr17 | 42909218 | 42909237 | 42909234 | + |
| SEQ ID NO 54243 | AGGCTCCAACATTTCTGCAG | GGG | chr17 | 42909219 | 42909238 | 42909235 | + |
| SEQ ID NO 54244 | AGGGGCTGTTTTCTTTGCTG | AAG | chr17 | 42909237 | 42909256 | 42909253 | + |
| SEQ ID NO 54245 | GGGGCTGTTTTCTTTGCTGA | AGG | chr17 | 42909238 | 42909257 | 42909254 | + |
| SEQ ID NO 54246 | TCTGCACCTGTGTTCTGTTA | TGG | chr17 | 42909262 | 42909281 | 42909278 | + |

Figure 85 (Cont'd)

| | | | | | | | |
|---|---|---|---|---|---|---|---|
| SEQ ID NO 54247 | TATGGTTGCCTCTTCTGTTG | CAG | chr17 | 42909280 | 42909299 | 42909296 | + |
| SEQ ID NO 54248 | ATGGTTGCCTCTTCTGTTGC | AGG | chr17 | 42909281 | 42909300 | 42909297 | + |
| SEQ ID NO 54249 | GGTGCTTGAATGTCATTTTG | TGG | chr17 | 42909302 | 42909321 | 42909318 | + |
| SEQ ID NO 54250 | CTTGAATGTCATTTTGTGGT | TGG | chr17 | 42909306 | 42909325 | 42909322 | + |
| SEQ ID NO 54251 | TTGAATGTCATTTTGTGGTT | GGG | chr17 | 42909307 | 42909326 | 42909323 | + |
| SEQ ID NO 54252 | TCATTTTGTGGTTGGGATTC | TGG | chr17 | 42909314 | 42909333 | 42909330 | + |
| SEQ ID NO 54253 | CATTTTGTGGTTGGGATTCT | GGG | chr17 | 42909315 | 42909334 | 42909331 | + |
| SEQ ID NO 54254 | GGTTGGGATTCTGGGCTGTG | CAG | chr17 | 42909323 | 42909342 | 42909339 | + |
| SEQ ID NO 54255 | TGCTGCTCATTTTCCTCATC | AAG | chr17 | 42909375 | 42909394 | 42909391 | + |
| SEQ ID NO 54256 | TTTCCTCATCAAGTTGTTGC | TGG | chr17 | 42909385 | 42909404 | 42909401 | + |
| SEQ ID NO 54257 | TCCTCATCAAGTTGTTGCTG | GAG | chr17 | 42909387 | 42909406 | 42909403 | + |
| SEQ ID NO 54258 | AGTTGTTGCTGGAGTCCTGT | CAG | chr17 | 42909396 | 42909415 | 42909412 | + |
| SEQ ID NO 54259 | GTTGTTGCTGGAGTCCTGTC | AGG | chr17 | 42909397 | 42909416 | 42909413 | + |
| SEQ ID NO 54260 | TGCTGGAGTCCTGTCAGGTA | TGG | chr17 | 42909402 | 42909421 | 42909418 | + |
| SEQ ID NO 54261 | GCTGGAGTCCTGTCAGGTAT | GGG | chr17 | 42909403 | 42909422 | 42909419 | + |
| SEQ ID NO 54262 | ATTCCGTTTCTCTCCCTAAT | CAG | chr17 | 42909460 | 42909479 | 42909476 | + |
| SEQ ID NO 54263 | TTCCGTTTCTCTCCCTAATC | AGG | chr17 | 42909461 | 42909480 | 42909477 | + |
| SEQ ID NO 54264 | CCCTAATCAGGACAAAATCC | CAG | chr17 | 42909473 | 42909492 | 42909489 | + |
| SEQ ID NO 54265 | AGGACAAAATCCCAGCATTC | CAG | chr17 | 42909481 | 42909500 | 42909497 | + |
| SEQ ID NO 54266 | AGCCACATCCTGTGTGTAAT | CAG | chr17 | 42909502 | 42909521 | 42909518 | + |
| SEQ ID NO 54267 | CTGTGTGTAATCAGTACTGT | TAG | chr17 | 42909511 | 42909530 | 42909527 | + |
| SEQ ID NO 54268 | CAGTACTGTTAGCATTTCTG | TGG | chr17 | 42909522 | 42909541 | 42909538 | + |
| SEQ ID NO 54269 | AGTACTGTTAGCATTTCTGT | GGG | chr17 | 42909523 | 42909542 | 42909539 | + |
| SEQ ID NO 54270 | TTAGCATTTCTGTGGGTTGA | AAG | chr17 | 42909530 | 42909549 | 42909546 | + |
| SEQ ID NO 54271 | ATTTCTGTGGGTTGAAAGTC | AAG | chr17 | 42909535 | 42909554 | 42909551 | + |
| SEQ ID NO 54272 | GTGGGTTGAAAGTCAAGAAT | GAG | chr17 | 42909541 | 42909560 | 42909557 | + |
| SEQ ID NO 54273 | TTGAAATGATTAATTTCTAT | AAG | chr17 | 42909568 | 42909587 | 42909584 | + |
| SEQ ID NO 54274 | GAAATGATTAATTTCTATAA | GAG | chr17 | 42909570 | 42909589 | 42909586 | + |
| SEQ ID NO 54275 | TTAATTTCTATAAGAGTGCC | CAG | chr17 | 42909577 | 42909596 | 42909593 | + |
| SEQ ID NO 54276 | TATAAGAGTGCCCAGATCTA | TAG | chr17 | 42909585 | 42909604 | 42909601 | + |
| SEQ ID NO 54277 | GATCTATAGAATGAATTGTG | TAG | chr17 | 42909599 | 42909618 | 42909615 | + |
| SEQ ID NO 54278 | CTATAGAATGAATTGTGTAG | AAG | chr17 | 42909602 | 42909621 | 42909618 | + |
| SEQ ID NO 54279 | ATTAACGCACCAAATTGAAT | TAG | chr17 | 42909639 | 42909658 | 42909655 | + |
| SEQ ID NO 54280 | ATTGAATTAGCTTGAAATCT | CAG | chr17 | 42909652 | 42909671 | 42909668 | + |
| SEQ ID NO 54281 | TGAATTAGCTTGAAATCTCA | GAG | chr17 | 42909654 | 42909673 | 42909670 | + |
| SEQ ID NO 54282 | TTACAATCTTTATTTCTTAC | TGG | chr17 | 42909681 | 42909700 | 42909697 | + |
| SEQ ID NO 54283 | TATTTCTTACTGGTCTTCAA | CAG | chr17 | 42909691 | 42909710 | 42909707 | + |
| SEQ ID NO 54284 | ATTTCTTACTGGTCTTCAAC | AGG | chr17 | 42909692 | 42909711 | 42909708 | + |
| SEQ ID NO 54285 | ACAGGCCCTAATTTACTTTT | CAG | chr17 | 42909710 | 42909729 | 42909726 | + |
| SEQ ID NO 54286 | CAGGCCCTAATTTACTTTTC | AGG | chr17 | 42909711 | 42909730 | 42909727 | + |
| SEQ ID NO 54287 | AGGCCCTAATTTACTTTTCA | GGG | chr17 | 42909712 | 42909731 | 42909728 | + |
| SEQ ID NO 54288 | AACAAATTAACACGATGTCC | TAG | chr17 | 42909749 | 42909768 | 42909765 | + |
| SEQ ID NO 54289 | ACAAATTAACACGATGTCCT | AGG | chr17 | 42909750 | 42909769 | 42909766 | + |
| SEQ ID NO 54290 | ATTAACACGATGTCCTAGGA | AAG | chr17 | 42909754 | 42909773 | 42909770 | + |
| SEQ ID NO 54291 | ACATTCATTTGCAAACCTAA | TAG | chr17 | 42909791 | 42909810 | 42909807 | + |
| SEQ ID NO 54292 | GCAAACCTAATAGATAACTG | CAG | chr17 | 42909801 | 42909820 | 42909817 | + |
| SEQ ID NO 54293 | ACTGCAGTTGATCTCTTTTA | TAG | chr17 | 42909817 | 42909836 | 42909833 | + |

Figure 85 (Cont'd)

| | | | | | | | |
|---|---|---|---|---|---|---|---|
| SEQ ID NO 54294 | CTGCAGTTGATCTCTTTTAT | AGG | chr17 | 42909818 | 42909837 | 42909834 | + |
| SEQ ID NO 54295 | GTTGATCTCTTTTATAGGTT | CAG | chr17 | 42909823 | 42909842 | 42909839 | + |
| SEQ ID NO 54296 | TGATCTCTTTTATAGGTTCA | GAG | chr17 | 42909825 | 42909844 | 42909841 | + |
| SEQ ID NO 54297 | TTTTTTTGTTTTTTTTTTTT | GAG | chr17 | 42909861 | 42909880 | 42909877 | + |
| SEQ ID NO 54298 | TTTGTTTTTTTTTTTGAGA | TGG | chr17 | 42909865 | 42909884 | 42909881 | + |
| SEQ ID NO 54299 | TGTTTTTTTTTTTGAGATG | GAG | chr17 | 42909867 | 42909886 | 42909883 | + |
| SEQ ID NO 54300 | TGGAGTCTCGCTCTGTGACC | CAG | chr17 | 42909885 | 42909904 | 42909901 | + |
| SEQ ID NO 54301 | GGAGTCTCGCTCTGTGACCC | AGG | chr17 | 42909886 | 42909905 | 42909902 | + |
| SEQ ID NO 54302 | TCTCGCTCTGTGACCCAGGC | TAG | chr17 | 42909890 | 42909909 | 42909906 | + |
| SEQ ID NO 54303 | TCGCTCTGTGACCCAGGCTA | GAG | chr17 | 42909892 | 42909911 | 42909908 | + |
| SEQ ID NO 54304 | CTGTGACCCAGGCTAGAGTG | CAG | chr17 | 42909897 | 42909916 | 42909913 | + |
| SEQ ID NO 54305 | TGACCCAGGCTAGAGTGCAG | TGG | chr17 | 42909900 | 42909919 | 42909916 | + |
| SEQ ID NO 54306 | AGAGTGCAGTGGTGCGATCT | CGG | chr17 | 42909911 | 42909930 | 42909927 | + |
| SEQ ID NO 54307 | GTGCGATCTCGGCTCACTGC | AAG | chr17 | 42909922 | 42909941 | 42909938 | + |
| SEQ ID NO 54308 | TCACTGCAAGCTCCACCTCC | TGG | chr17 | 42909935 | 42909954 | 42909951 | + |
| SEQ ID NO 54309 | CACTGCAAGCTCCACCTCCT | GGG | chr17 | 42909936 | 42909955 | 42909952 | + |
| SEQ ID NO 54310 | TTCACGCCATTCTCCTGCCT | CAG | chr17 | 42909959 | 42909978 | 42909975 | + |
| SEQ ID NO 54311 | TCTCCTGCCTCAGCCTCTCC | GAG | chr17 | 42909969 | 42909988 | 42909985 | + |
| SEQ ID NO 54312 | CCTGCCTCAGCCTCTCCGAG | TAG | chr17 | 42909972 | 42909991 | 42909988 | + |
| SEQ ID NO 54313 | CCTCAGCCTCTCCGAGTAGC | TGG | chr17 | 42909976 | 42909995 | 42909992 | + |
| SEQ ID NO 54314 | CTCAGCCTCTCCGAGTAGCT | GGG | chr17 | 42909977 | 42909996 | 42909993 | + |
| SEQ ID NO 54315 | TCTCCGAGTAGCTGGGACTA | CAG | chr17 | 42909984 | 42910003 | 42910000 | + |
| SEQ ID NO 54316 | CTCCGAGTAGCTGGGACTAC | AGG | chr17 | 42909985 | 42910004 | 42910001 | + |
| SEQ ID NO 54317 | CAGGCGCCCGCCACCATGCC | CGG | chr17 | 42910004 | 42910023 | 42910020 | + |
| SEQ ID NO 54318 | CGGCTAATTTTTTGTATTTT | TAG | chr17 | 42910024 | 42910043 | 42910040 | + |
| SEQ ID NO 54319 | CTAATTTTTTGTATTTTTAG | CAG | chr17 | 42910027 | 42910046 | 42910043 | + |
| SEQ ID NO 54320 | AATTTTTTGTATTTTTAGCA | GAG | chr17 | 42910029 | 42910048 | 42910045 | + |
| SEQ ID NO 54321 | TTTTGTATTTTTAGCAGAGA | CGG | chr17 | 42910033 | 42910052 | 42910049 | + |
| SEQ ID NO 54322 | TTTGTATTTTTAGCAGAGAC | GGG | chr17 | 42910034 | 42910053 | 42910050 | + |
| SEQ ID NO 54323 | TTGTATTTTTAGCAGAGACG | GGG | chr17 | 42910035 | 42910054 | 42910051 | + |
| SEQ ID NO 54324 | GCAGAGACGGGGTTTCACCG | TGG | chr17 | 42910046 | 42910065 | 42910062 | + |
| SEQ ID NO 54325 | ACCTCGTGATCCGCCCGCCT | CGG | chr17 | 42910082 | 42910101 | 42910098 | + |
| SEQ ID NO 54326 | CCGCCCGCCTCGGCCTCCCA | AAG | chr17 | 42910092 | 42910111 | 42910108 | + |
| SEQ ID NO 54327 | GCCTCGGCCTCCCAAAGCGC | TGG | chr17 | 42910098 | 42910117 | 42910114 | + |
| SEQ ID NO 54328 | CCTCGGCCTCCCAAAGCGCT | GGG | chr17 | 42910099 | 42910118 | 42910115 | + |
| SEQ ID NO 54329 | TCCCAAAGCGCTGGGATTAC | AAG | chr17 | 42910107 | 42910126 | 42910123 | + |
| SEQ ID NO 54330 | CCCAAAGCGCTGGGATTACA | AGG | chr17 | 42910108 | 42910127 | 42910124 | + |
| SEQ ID NO 54331 | CCAAAGCGCTGGGATTACAA | GGG | chr17 | 42910109 | 42910128 | 42910125 | + |
| SEQ ID NO 54332 | AGCGCTGGGATTACAAGGGT | GAG | chr17 | 42910113 | 42910132 | 42910129 | + |
| SEQ ID NO 54333 | TGCCTGAATATGTGTTTTCT | TAG | chr17 | 42910147 | 42910166 | 42910163 | + |
| SEQ ID NO 54334 | TTTTCTTAGATCCAATTAAC | AAG | chr17 | 42910161 | 42910180 | 42910177 | + |
| SEQ ID NO 54335 | TTTCTTAGATCCAATTAACA | AGG | chr17 | 42910162 | 42910181 | 42910178 | + |
| SEQ ID NO 54336 | TTCTTAGATCCAATTAACAA | GGG | chr17 | 42910163 | 42910182 | 42910179 | + |
| SEQ ID NO 54337 | TAGATCCAATTAACAAGGGT | AAG | chr17 | 42910167 | 42910186 | 42910183 | + |
| SEQ ID NO 54338 | CCAATTAACAAGGGTAAGAC | AAG | chr17 | 42910172 | 42910191 | 42910188 | + |
| SEQ ID NO 54339 | ACAAGGGTAAGACAAGATTT | AAG | chr17 | 42910179 | 42910198 | 42910195 | + |
| SEQ ID NO 54340 | GGTAAGACAAGATTTAAGTT | AAG | chr17 | 42910184 | 42910203 | 42910200 | + |

Figure 85 (Cont'd)

| | | | | | | | |
|---|---|---|---|---|---|---|---|
| SEQ ID NO 54341 | ACAAGATTTAAGTTAAGCAT | AAG | chr17 | 42910190 | 42910209 | 42910206 | + |
| SEQ ID NO 54342 | GATTTAAGTTAAGCATAAGA | AAG | chr17 | 42910194 | 42910213 | 42910210 | + |
| SEQ ID NO 54343 | TAAGCATAAGAAAGATTTTG | TGG | chr17 | 42910203 | 42910222 | 42910219 | + |
| SEQ ID NO 54344 | AAGCATAAGAAAGATTTTGT | GGG | chr17 | 42910204 | 42910223 | 42910220 | + |
| SEQ ID NO 54345 | GCATAAGAAAGATTTTGTGG | GAG | chr17 | 42910206 | 42910225 | 42910222 | + |
| SEQ ID NO 54346 | CATAAGAAAGATTTTGTGGG | AGG | chr17 | 42910207 | 42910226 | 42910223 | + |
| SEQ ID NO 54347 | AAAGATTTTGTGGGAGGCAC | TGG | chr17 | 42910213 | 42910232 | 42910229 | + |
| SEQ ID NO 54348 | TGTGGGAGGCACTGGAATAT | AAG | chr17 | 42910221 | 42910240 | 42910237 | + |
| SEQ ID NO 54349 | ATAAGACCTTAACAAAACTG | TGG | chr17 | 42910239 | 42910258 | 42910255 | + |
| SEQ ID NO 54350 | AAACTGTGGAATTTCTCCCC | TGG | chr17 | 42910253 | 42910272 | 42910269 | + |
| SEQ ID NO 54351 | ACTGTGGAATTTCTCCCCTG | GAG | chr17 | 42910255 | 42910274 | 42910271 | + |
| SEQ ID NO 54352 | TTTCTCCCCTGGAGATTTGT | AAG | chr17 | 42910264 | 42910283 | 42910280 | + |
| SEQ ID NO 54353 | CCCCTGGAGATTTGTAAGAA | CGG | chr17 | 42910269 | 42910288 | 42910285 | + |
| SEQ ID NO 54354 | AGATTTGTAAGAACGGAACA | TAG | chr17 | 42910276 | 42910295 | 42910292 | + |
| SEQ ID NO 54355 | TTTGTAAGAACGGAACATAG | CAG | chr17 | 42910279 | 42910298 | 42910295 | + |
| SEQ ID NO 54356 | ACGGAACATAGCAGCATTCA | AAG | chr17 | 42910288 | 42910307 | 42910304 | + |
| SEQ ID NO 54357 | GAACATAGCAGCATTCAAAG | AAG | chr17 | 42910291 | 42910310 | 42910307 | + |
| SEQ ID NO 54358 | AGCATTCAAAGAAGAATGTT | GAG | chr17 | 42910300 | 42910319 | 42910316 | + |
| SEQ ID NO 54359 | CAAAGAAGAATGTTGAGAAC | AAG | chr17 | 42910306 | 42910325 | 42910322 | + |
| SEQ ID NO 54360 | AAAGAAGAATGTTGAGAACA | AGG | chr17 | 42910307 | 42910326 | 42910323 | + |
| SEQ ID NO 54361 | AAGAAGAATGTTGAGAACAA | GGG | chr17 | 42910308 | 42910327 | 42910324 | + |
| SEQ ID NO 54362 | GAAGAATGTTGAGAACAAGG | GAG | chr17 | 42910310 | 42910329 | 42910326 | + |
| SEQ ID NO 54363 | GTTGAGAACAAGGGAGATAA | TGG | chr17 | 42910317 | 42910336 | 42910333 | + |
| SEQ ID NO 54364 | CAAGGGAGATAATGGTTTCA | TGG | chr17 | 42910325 | 42910344 | 42910341 | + |
| SEQ ID NO 54365 | TGGTTTCATGGTAATCACAA | AAG | chr17 | 42910337 | 42910356 | 42910353 | + |
| SEQ ID NO 54366 | TGGTAATCACAAAAGTAACA | CAG | chr17 | 42910345 | 42910364 | 42910361 | + |
| SEQ ID NO 54367 | CACAAAAGTAACACAGCATT | TAG | chr17 | 42910352 | 42910371 | 42910368 | + |
| SEQ ID NO 54368 | AGTAACACAGCATTTAGTAC | TGG | chr17 | 42910358 | 42910377 | 42910374 | + |
| SEQ ID NO 54369 | GTAACACAGCATTTAGTACT | GGG | chr17 | 42910359 | 42910378 | 42910375 | + |
| SEQ ID NO 54370 | TAGTACTGGGTTCCATGTTT | GAG | chr17 | 42910372 | 42910391 | 42910388 | + |
| SEQ ID NO 54371 | AGTACTGGGTTCCATGTTTG | AGG | chr17 | 42910373 | 42910392 | 42910389 | + |
| SEQ ID NO 54372 | ACTGGGTTCCATGTTTGAGG | AAG | chr17 | 42910376 | 42910395 | 42910392 | + |
| SEQ ID NO 54373 | TCCATGTTTGAGGAAGAACC | TGG | chr17 | 42910383 | 42910402 | 42910399 | + |
| SEQ ID NO 54374 | ATGTTTGAGGAAGAACCTGG | AAG | chr17 | 42910386 | 42910405 | 42910402 | + |
| SEQ ID NO 54375 | GCCATATCACATGAAAAACC | TGG | chr17 | 42910408 | 42910427 | 42910424 | + |
| SEQ ID NO 54376 | CCATATCACATGAAAAACCT | GGG | chr17 | 42910409 | 42910428 | 42910425 | + |
| SEQ ID NO 54377 | ATGAAAAACCTGGGAATGTT | TAG | chr17 | 42910418 | 42910437 | 42910434 | + |
| SEQ ID NO 54378 | TGAAAAACCTGGGAATGTTT | AGG | chr17 | 42910419 | 42910438 | 42910435 | + |
| SEQ ID NO 54379 | AAACCTGGGAATGTTTAGGT | TAG | chr17 | 42910423 | 42910442 | 42910439 | + |
| SEQ ID NO 54380 | ACCTGGGAATGTTTAGGTTA | GAG | chr17 | 42910425 | 42910444 | 42910441 | + |
| SEQ ID NO 54381 | CTGGGAATGTTTAGGTTAGA | GAG | chr17 | 42910427 | 42910446 | 42910443 | + |
| SEQ ID NO 54382 | AACTGTGTTCAAATGTGTGA | CAG | chr17 | 42910453 | 42910472 | 42910469 | + |
| SEQ ID NO 54383 | CTGTGTTCAAATGTGTGACA | GAG | chr17 | 42910455 | 42910474 | 42910471 | + |
| SEQ ID NO 54384 | TGTGTTCAAATGTGTGACAG | AGG | chr17 | 42910456 | 42910475 | 42910472 | + |
| SEQ ID NO 54385 | GTGTTCAAATGTGTGACAGA | GGG | chr17 | 42910457 | 42910476 | 42910473 | + |
| SEQ ID NO 54386 | CAAATGTGTGACAGAGGGAC | TAG | chr17 | 42910462 | 42910481 | 42910478 | + |
| SEQ ID NO 54387 | TCATCACTTACTAACTCCTG | CAG | chr17 | 42910487 | 42910506 | 42910503 | + |

Figure 85 (Cont'd)

| SEQ ID NO 54388 | CACTTACTAACTCCTGCAGA | AAG | chr17 | 42910491 | 42910510 | 42910507 | + |
| SEQ ID NO 54389 | TAACTCCTGCAGAAAGAACT | GAG | chr17 | 42910498 | 42910517 | 42910514 | + |
| SEQ ID NO 54390 | GCAGAAAGAACTGAGAAAAA | TAG | chr17 | 42910506 | 42910525 | 42910522 | + |
| SEQ ID NO 54391 | AAAGAACTGAGAAAATAGA | CAG | chr17 | 42910510 | 42910529 | 42910526 | + |
| SEQ ID NO 54392 | CTGAGAAAATAGACAGTAT | TAG | chr17 | 42910516 | 42910535 | 42910532 | + |
| SEQ ID NO 54393 | GAGAAAATAGACAGTATTA | GAG | chr17 | 42910518 | 42910537 | 42910534 | + |
| SEQ ID NO 54394 | AGAAAATAGACAGTATTAG | AGG | chr17 | 42910519 | 42910538 | 42910535 | + |
| SEQ ID NO 54395 | GAAAATAGACAGTATTAGA | GGG | chr17 | 42910520 | 42910539 | 42910536 | + |
| SEQ ID NO 54396 | AAAATAGACAGTATTAGAG | GGG | chr17 | 42910521 | 42910540 | 42910537 | + |
| SEQ ID NO 54397 | AAATAGACAGTATTAGAGG | GGG | chr17 | 42910522 | 42910541 | 42910538 | + |
| SEQ ID NO 54398 | AGACAGTATTAGAGGGGAC | CAG | chr17 | 42910527 | 42910546 | 42910543 | + |
| SEQ ID NO 54399 | AGAGGGGACCAGTTTCACA | CAG | chr17 | 42910537 | 42910556 | 42910553 | + |
| SEQ ID NO 54400 | GGGACCAGTTTCACACAGAC | AAG | chr17 | 42910542 | 42910561 | 42910558 | + |
| SEQ ID NO 54401 | GGACCAGTTTCACACAGACA | AGG | chr17 | 42910543 | 42910562 | 42910559 | + |
| SEQ ID NO 54402 | CCAGTTTCACACAGACAAGG | AAG | chr17 | 42910546 | 42910565 | 42910562 | + |
| SEQ ID NO 54403 | ACAGACAAGGAAGAACTATT | CAG | chr17 | 42910556 | 42910575 | 42910572 | + |
| SEQ ID NO 54404 | TCAGCAATCAATTCCGTTCA | AAG | chr17 | 42910575 | 42910594 | 42910591 | + |
| SEQ ID NO 54405 | AATTCCGTTCAAAGATAAAA | TGG | chr17 | 42910584 | 42910603 | 42910600 | + |
| SEQ ID NO 54406 | AAAGATAAAATGGACTGTTA | TAG | chr17 | 42910594 | 42910613 | 42910610 | + |
| SEQ ID NO 54407 | GATAAAATGGACTGTTATAG | TGG | chr17 | 42910597 | 42910616 | 42910613 | + |
| SEQ ID NO 54408 | ATAAAATGGACTGTTATAGT | GGG | chr17 | 42910598 | 42910617 | 42910614 | + |
| SEQ ID NO 54409 | TAAAATGGACTGTTATAGTG | GGG | chr17 | 42910599 | 42910618 | 42910615 | + |
| SEQ ID NO 54410 | AAAATGGACTGTTATAGTGG | GGG | chr17 | 42910600 | 42910619 | 42910616 | + |
| SEQ ID NO 54411 | TGGACTGTTATAGTGGGGGT | GAG | chr17 | 42910604 | 42910623 | 42910620 | + |
| SEQ ID NO 54412 | GGGGTGAGCTCCCTACCTCT | GAG | chr17 | 42910619 | 42910638 | 42910635 | + |
| SEQ ID NO 54413 | GGGTGAGCTCCCTACCTCTG | AGG | chr17 | 42910620 | 42910639 | 42910636 | + |
| SEQ ID NO 54414 | GGTGAGCTCCCTACCTCTGA | GGG | chr17 | 42910621 | 42910640 | 42910637 | + |
| SEQ ID NO 54415 | CCTACCTCTGAGGGTATTTC | AAG | chr17 | 42910630 | 42910649 | 42910646 | + |
| SEQ ID NO 54416 | ACCTCTGAGGGTATTTCAAG | TAG | chr17 | 42910633 | 42910652 | 42910649 | + |
| SEQ ID NO 54417 | CTCTGAGGGTATTTCAAGTA | GAG | chr17 | 42910635 | 42910654 | 42910651 | + |
| SEQ ID NO 54418 | GAGGGTATTTCAAGTAGAGA | TAG | chr17 | 42910639 | 42910658 | 42910655 | + |
| SEQ ID NO 54419 | AGGGTATTTCAAGTAGAGAT | AGG | chr17 | 42910640 | 42910659 | 42910656 | + |
| SEQ ID NO 54420 | GGTATTTCAAGTAGAGATAG | GAG | chr17 | 42910642 | 42910661 | 42910658 | + |
| SEQ ID NO 54421 | GTATTTCAAGTAGAGATAGG | AGG | chr17 | 42910643 | 42910662 | 42910659 | + |
| SEQ ID NO 54422 | GTAGAGATAGGAGGACCTCC | TGG | chr17 | 42910652 | 42910671 | 42910668 | + |
| SEQ ID NO 54423 | GAGATAGGAGGACCTCCTGG | TAG | chr17 | 42910655 | 42910674 | 42910671 | + |
| SEQ ID NO 54424 | AGATAGGAGGACCTCCTGGT | AGG | chr17 | 42910656 | 42910675 | 42910672 | + |
| SEQ ID NO 54425 | CCTGGTAGGAAATTTGCATA | CGG | chr17 | 42910670 | 42910689 | 42910686 | + |
| SEQ ID NO 54426 | GGTAGGAAATTTGCATACGG | TGG | chr17 | 42910673 | 42910692 | 42910689 | + |
| SEQ ID NO 54427 | GTAGGAAATTTGCATACGGT | GGG | chr17 | 42910674 | 42910693 | 42910690 | + |
| SEQ ID NO 54428 | AGGAAATTTGCATACGGTGG | GAG | chr17 | 42910676 | 42910695 | 42910692 | + |
| SEQ ID NO 54429 | GTGGGAGATTGTACGTGATA | TGG | chr17 | 42910692 | 42910711 | 42910708 | + |
| SEQ ID NO 54430 | GATATGGCACCTCCATCTGA | AAG | chr17 | 42910708 | 42910727 | 42910724 | + |
| SEQ ID NO 54431 | TATGGCACCTCCATCTGAAA | GAG | chr17 | 42910710 | 42910729 | 42910726 | + |
| SEQ ID NO 54432 | CATCTGAAAGAGTCTATATT | GAG | chr17 | 42910721 | 42910740 | 42910737 | + |
| SEQ ID NO 54433 | ATCTGAAAGAGTCTATATTG | AGG | chr17 | 42910722 | 42910741 | 42910738 | + |
| SEQ ID NO 54434 | TCTGAAAGAGTCTATATTGA | GGG | chr17 | 42910723 | 42910742 | 42910739 | + |

Figure 85 (Cont'd)

| | | | | | | | |
|---|---|---|---|---|---|---|---|
| SEQ ID NO 54435 | GAAAGAGTCTATATTGAGGG | CAG | chr17 | 42910726 | 42910745 | 42910742 | + |
| SEQ ID NO 54436 | AAAGAGTCTATATTGAGGGC | AGG | chr17 | 42910727 | 42910746 | 42910743 | + |
| SEQ ID NO 54437 | AGTCTATATTGAGGGCAGGC | TGG | chr17 | 42910731 | 42910750 | 42910747 | + |
| SEQ ID NO 54438 | TCTATATTGAGGGCAGGCTG | GAG | chr17 | 42910733 | 42910752 | 42910749 | + |
| SEQ ID NO 54439 | GGGCAGGCTGGAGTCACACA | TGG | chr17 | 42910743 | 42910762 | 42910759 | + |
| SEQ ID NO 54440 | GGCAGGCTGGAGTCACACAT | GGG | chr17 | 42910744 | 42910763 | 42910760 | + |
| SEQ ID NO 54441 | CTGGAGTCACACATGGGAAT | AAG | chr17 | 42910750 | 42910769 | 42910766 | + |
| SEQ ID NO 54442 | AGTCACACATGGGAATAAGC | CAG | chr17 | 42910754 | 42910773 | 42910770 | + |
| SEQ ID NO 54443 | GTCACACATGGGAATAAGCC | AGG | chr17 | 42910755 | 42910774 | 42910771 | + |
| SEQ ID NO 54444 | CCATCTGTGATTTAATTCCA | CAG | chr17 | 42910793 | 42910812 | 42910809 | + |
| SEQ ID NO 54445 | GTGATTTAATTCCACAGTCG | CAG | chr17 | 42910799 | 42910818 | 42910815 | + |
| SEQ ID NO 54446 | TTAATTCCACAGTCGCAGAA | CGG | chr17 | 42910804 | 42910823 | 42910820 | + |
| SEQ ID NO 54447 | TTCCACAGTCGCAGAACGGA | TGG | chr17 | 42910808 | 42910827 | 42910824 | + |
| SEQ ID NO 54448 | CACTCCTCCAAACCCACCTC | TAG | chr17 | 42910840 | 42910859 | 42910856 | + |
| SEQ ID NO 54449 | CTCCAAACCCACCTCTAGCA | AAG | chr17 | 42910845 | 42910864 | 42910861 | + |
| SEQ ID NO 54450 | TCCAAACCCACCTCTAGCAA | AGG | chr17 | 42910846 | 42910865 | 42910862 | + |
| SEQ ID NO 54451 | CAAATCCTTCCTATCTCTCA | CAG | chr17 | 42910872 | 42910891 | 42910888 | + |
| SEQ ID NO 54452 | CAGTCATGCTTTCTTCCACT | CAG | chr17 | 42910892 | 42910911 | 42910908 | + |
| SEQ ID NO 54453 | AGTCATGCTTTCTTCCACTC | AGG | chr17 | 42910893 | 42910912 | 42910909 | + |
| SEQ ID NO 54454 | CCACTCAGGCATTGCTGTTG | CAG | chr17 | 42910907 | 42910926 | 42910923 | + |
| SEQ ID NO 54455 | ATTGCTGTTGCAGAAACTTT | CAG | chr17 | 42910917 | 42910936 | 42910933 | + |
| SEQ ID NO 54456 | GAAACTTTCAGCCACATCCA | CAG | chr17 | 42910929 | 42910948 | 42910945 | + |
| SEQ ID NO 54457 | ATCCACAGCATCTATAATGC | CAG | chr17 | 42910944 | 42910963 | 42910960 | + |
| SEQ ID NO 54458 | GCATCTATAATGCCAGCCTC | AAG | chr17 | 42910951 | 42910970 | 42910967 | + |
| SEQ ID NO 54459 | CTCATTACCTTCTTCCTGTT | CAG | chr17 | 42910983 | 42911002 | 42910999 | + |
| SEQ ID NO 54460 | TTCCTGTTCAGCTTCGCCAT | CGG | chr17 | 42910995 | 42911014 | 42911011 | + |
| SEQ ID NO 54461 | TCGGATTTTATCTGCTGCTC | AAG | chr17 | 42911014 | 42911033 | 42911030 | + |
| SEQ ID NO 54462 | CGGATTTTATCTGCTGCTCA | AGG | chr17 | 42911015 | 42911034 | 42911031 | + |
| SEQ ID NO 54463 | GGATTTTATCTGCTGCTCAA | GGG | chr17 | 42911016 | 42911035 | 42911032 | + |
| SEQ ID NO 54464 | TTATCTGCTGCTCAAGGGAC | TGG | chr17 | 42911021 | 42911040 | 42911037 | + |
| SEQ ID NO 54465 | TATCTGCTGCTCAAGGGACT | GGG | chr17 | 42911022 | 42911041 | 42911038 | + |
| SEQ ID NO 54466 | GCTGCTCAAGGGACTGGGTG | TAG | chr17 | 42911027 | 42911046 | 42911043 | + |
| SEQ ID NO 54467 | GACTGGGTGTAGACCTCCTG | TGG | chr17 | 42911038 | 42911057 | 42911054 | + |
| SEQ ID NO 54468 | TGTAGACCTCCTGTGGACTC | TGG | chr17 | 42911045 | 42911064 | 42911061 | + |
| SEQ ID NO 54469 | TAGACCTCCTGTGGACTCTG | GAG | chr17 | 42911047 | 42911066 | 42911063 | + |
| SEQ ID NO 54470 | CCTCCTGTGGACTCTGGAGA | AAG | chr17 | 42911051 | 42911070 | 42911067 | + |
| SEQ ID NO 54471 | TGTGGACTCTGGAGAAAGCC | CAG | chr17 | 42911056 | 42911075 | 42911072 | + |
| SEQ ID NO 54472 | TGGACTCTGGAGAAAGCCCA | GAG | chr17 | 42911058 | 42911077 | 42911074 | + |
| SEQ ID NO 54473 | GGACTCTGGAGAAAGCCCAG | AGG | chr17 | 42911059 | 42911078 | 42911075 | + |
| SEQ ID NO 54474 | CTCTGGAGAAAGCCCAGAGG | TGG | chr17 | 42911062 | 42911081 | 42911078 | + |
| SEQ ID NO 54475 | AGAAAGCCCAGAGGTGGTGC | GAG | chr17 | 42911068 | 42911087 | 42911084 | + |
| SEQ ID NO 54476 | AAGCCCAGAGGTGGTGCGAG | CAG | chr17 | 42911071 | 42911090 | 42911087 | + |
| SEQ ID NO 54477 | CCAGAGGTGGTGCGAGCAGC | CAG | chr17 | 42911075 | 42911094 | 42911091 | + |
| SEQ ID NO 54478 | GGTGGTGCGAGCAGCCAGAA | TGG | chr17 | 42911080 | 42911099 | 42911096 | + |
| SEQ ID NO 54479 | GTGGTGCGAGCAGCCAGAAT | GGG | chr17 | 42911081 | 42911100 | 42911097 | + |
| SEQ ID NO 54480 | ATTGACACCACACCCTTTGC | CAG | chr17 | 42911109 | 42911128 | 42911125 | + |
| SEQ ID NO 54481 | CACCCTTTGCCAGCCTCCTC | AAG | chr17 | 42911119 | 42911138 | 42911135 | + |

Figure 85 (Cont'd)

| | | | | | | | |
|---|---|---|---|---|---|---|---|
| SEQ ID NO 54482 | TGCCAGCCTCCTCAAGAACC | TGG | chr17 | 42911126 | 42911145 | 42911142 | + |
| SEQ ID NO 54483 | GCCAGCCTCCTCAAGAACCT | GGG | chr17 | 42911127 | 42911146 | 42911143 | + |
| SEQ ID NO 54484 | AAGAACCTGGGCACGCTCTT | TGG | chr17 | 42911139 | 42911158 | 42911155 | + |
| SEQ ID NO 54485 | CCTGGGCACGCTCTTTGGCC | TGG | chr17 | 42911144 | 42911163 | 42911160 | + |
| SEQ ID NO 54486 | CTGGGCACGCTCTTTGGCCT | GGG | chr17 | 42911145 | 42911164 | 42911161 | + |
| SEQ ID NO 54487 | TGGGCACGCTCTTTGGCCTG | GGG | chr17 | 42911146 | 42911165 | 42911162 | + |
| SEQ ID NO 54488 | CACGCTCTTTGGCCTGGGGC | TGG | chr17 | 42911150 | 42911169 | 42911166 | + |
| SEQ ID NO 54489 | CTGGGGCTGGCTCTCAACTC | CAG | chr17 | 42911163 | 42911182 | 42911179 | + |
| SEQ ID NO 54490 | GCTCTCAACTCCAGCATGTA | CAG | chr17 | 42911172 | 42911191 | 42911188 | + |
| SEQ ID NO 54491 | CTCTCAACTCCAGCATGTAC | AGG | chr17 | 42911173 | 42911192 | 42911189 | + |
| SEQ ID NO 54492 | TCTCAACTCCAGCATGTACA | GGG | chr17 | 42911174 | 42911193 | 42911190 | + |
| SEQ ID NO 54493 | TCAACTCCAGCATGTACAGG | GAG | chr17 | 42911176 | 42911195 | 42911192 | + |
| SEQ ID NO 54494 | AACTCCAGCATGTACAGGGA | GAG | chr17 | 42911178 | 42911197 | 42911194 | + |
| SEQ ID NO 54495 | GCATGTACAGGGAGAGCTGC | AAG | chr17 | 42911185 | 42911204 | 42911201 | + |
| SEQ ID NO 54496 | CATGTACAGGGAGAGCTGCA | AGG | chr17 | 42911186 | 42911205 | 42911202 | + |
| SEQ ID NO 54497 | ATGTACAGGGAGAGCTGCAA | GGG | chr17 | 42911187 | 42911206 | 42911203 | + |
| SEQ ID NO 54498 | TGTACAGGGAGAGCTGCAAG | GGG | chr17 | 42911188 | 42911207 | 42911204 | + |
| SEQ ID NO 54499 | GAGAGCTGCAAGGGGAAACT | CAG | chr17 | 42911196 | 42911215 | 42911212 | + |
| SEQ ID NO 54500 | GCTGCAAGGGGAAACTCAGC | AAG | chr17 | 42911200 | 42911219 | 42911216 | + |
| SEQ ID NO 54501 | GCAAGGGGAAACTCAGCAAG | TGG | chr17 | 42911203 | 42911222 | 42911219 | + |
| SEQ ID NO 54502 | AAGTGGCTCCCATTCCGCCT | CAG | chr17 | 42911220 | 42911239 | 42911236 | + |
| SEQ ID NO 54503 | ATTCCGCCTCAGCTCTATTG | TAG | chr17 | 42911231 | 42911250 | 42911247 | + |
| SEQ ID NO 54504 | CTCCTTGAAACCCCATCCC | AAG | chr17 | 42911282 | 42911301 | 42911298 | + |
| SEQ ID NO 54505 | TGAAACCCCATCCCAAGTC | GAG | chr17 | 42911287 | 42911306 | 42911303 | + |
| SEQ ID NO 54506 | ACCCCATCCCAAGTCGAGC | TGG | chr17 | 42911291 | 42911310 | 42911307 | + |
| SEQ ID NO 54507 | TCTACGTCTTGTCCTTCTGC | AAG | chr17 | 42911317 | 42911336 | 42911333 | + |
| SEQ ID NO 54508 | TACGTCTTGTCCTTCTGCAA | GAG | chr17 | 42911319 | 42911338 | 42911335 | + |
| SEQ ID NO 54509 | CTTGTCCTTCTGCAAGAGTG | CGG | chr17 | 42911324 | 42911343 | 42911340 | + |
| SEQ ID NO 54510 | GTCCTTCTGCAAGAGTGCGG | TAG | chr17 | 42911327 | 42911346 | 42911343 | + |
| SEQ ID NO 54511 | CAAGAGTGCGGTAGTGCCCC | TGG | chr17 | 42911336 | 42911355 | 42911352 | + |
| SEQ ID NO 54512 | GTAGTGCCCCTGGCATCCGT | CAG | chr17 | 42911346 | 42911365 | 42911362 | + |
| SEQ ID NO 54513 | TCATCCCCTACTGCCTCGCC | CAG | chr17 | 42911371 | 42911390 | 42911387 | + |
| SEQ ID NO 54514 | CATCCCCTACTGCCTCGCCC | AGG | chr17 | 42911372 | 42911391 | 42911388 | + |
| SEQ ID NO 54515 | CTACTGCCTCGCCCAGGTCC | TGG | chr17 | 42911378 | 42911397 | 42911394 | + |
| SEQ ID NO 54516 | TACTGCCTCGCCCAGGTCCT | GGG | chr17 | 42911379 | 42911398 | 42911395 | + |
| SEQ ID NO 54517 | GCCTCGCCCAGGTCCTGGGC | CAG | chr17 | 42911383 | 42911402 | 42911399 | + |
| SEQ ID NO 54518 | AGGTCCTGGGCCAGCCGCAC | AAG | chr17 | 42911392 | 42911411 | 42911408 | + |
| SEQ ID NO 54519 | TCCTGGGCCAGCCGCACAAG | AAG | chr17 | 42911395 | 42911414 | 42911411 | + |
| SEQ ID NO 54520 | GCCGCACAAGAAGTCGTTGT | AAG | chr17 | 42911405 | 42911424 | 42911421 | + |
| SEQ ID NO 54521 | CGCACAAGAAGTCGTTGTAA | GAG | chr17 | 42911407 | 42911426 | 42911423 | + |
| SEQ ID NO 54522 | AGAAGTCGTTGTAAGAGATG | TGG | chr17 | 42911413 | 42911432 | 42911429 | + |
| SEQ ID NO 54523 | AAGTCGTTGTAAGAGATGTG | GAG | chr17 | 42911415 | 42911434 | 42911431 | + |
| SEQ ID NO 54524 | TGTAAGAGATGTGGAGTCTT | CGG | chr17 | 42911422 | 42911441 | 42911438 | + |
| SEQ ID NO 54525 | TGTGGAGTCTTCGGTGTTTA | AAG | chr17 | 42911431 | 42911450 | 42911447 | + |
| SEQ ID NO 54526 | TTTAAAGTCAACAACCATGC | CAG | chr17 | 42911447 | 42911466 | 42911463 | + |
| SEQ ID NO 54527 | TTAAAGTCAACAACCATGCC | AGG | chr17 | 42911448 | 42911467 | 42911464 | + |
| SEQ ID NO 54528 | TAAAGTCAACAACCATGCCA | GGG | chr17 | 42911449 | 42911468 | 42911465 | + |

Figure 85 (Cont'd)

| | | | | | | | |
|---|---|---|---|---|---|---|---|
| SEQ ID NO 54529 | CAACAACCATGCCAGGGATT | GAG | chr17 | 42911455 | 42911474 | 42911471 | + |
| SEQ ID NO 54530 | AACAACCATGCCAGGGATTG | AGG | chr17 | 42911456 | 42911475 | 42911472 | + |
| SEQ ID NO 54531 | CAACCATGCCAGGGATTGAG | GAG | chr17 | 42911458 | 42911477 | 42911474 | + |
| SEQ ID NO 54532 | AACCATGCCAGGGATTGAGG | AGG | chr17 | 42911459 | 42911478 | 42911475 | + |
| SEQ ID NO 54533 | TTGAGGAGGACTACTATTTG | AAG | chr17 | 42911473 | 42911492 | 42911489 | + |
| SEQ ID NO 54534 | AGGACTACTATTTGAAGCAA | TGG | chr17 | 42911479 | 42911498 | 42911495 | + |
| SEQ ID NO 54535 | GGACTACTATTTGAAGCAAT | GGG | chr17 | 42911480 | 42911499 | 42911496 | + |
| SEQ ID NO 54536 | CTATTTGAAGCAATGGGCAC | TGG | chr17 | 42911486 | 42911505 | 42911502 | + |
| SEQ ID NO 54537 | AAGCAATGGGCACTGGTATT | TGG | chr17 | 42911493 | 42911512 | 42911509 | + |
| SEQ ID NO 54538 | GCAATGGGCACTGGTATTTG | GAG | chr17 | 42911495 | 42911514 | 42911511 | + |
| SEQ ID NO 54539 | TGGGCACTGGTATTTGGAGC | AAG | chr17 | 42911499 | 42911518 | 42911515 | + |
| SEQ ID NO 54540 | TGCCATCCATTCTGCCGTCG | TGG | chr17 | 42911527 | 42911546 | 42911543 | + |
| SEQ ID NO 54541 | GCCGTCGTGGAATTAAATCA | CGG | chr17 | 42911540 | 42911559 | 42911556 | + |
| SEQ ID NO 54542 | TCGTGGAATTAAATCACGGA | TGG | chr17 | 42911544 | 42911563 | 42911560 | + |
| SEQ ID NO 54543 | TGGAATTAAATCACGGATGG | CAG | chr17 | 42911547 | 42911566 | 42911563 | + |
| SEQ ID NO 54544 | TTAAATCACGGATGGCAGAT | TGG | chr17 | 42911552 | 42911571 | 42911568 | + |
| SEQ ID NO 54545 | AAATCACGGATGGCAGATTG | GAG | chr17 | 42911554 | 42911573 | 42911570 | + |
| SEQ ID NO 54546 | AATCACGGATGGCAGATTGG | AGG | chr17 | 42911555 | 42911574 | 42911571 | + |
| SEQ ID NO 54547 | ATCACGGATGGCAGATTGGA | GGG | chr17 | 42911556 | 42911575 | 42911572 | + |
| SEQ ID NO 54548 | TGGCAGATTGGAGGGTCGCC | TGG | chr17 | 42911564 | 42911583 | 42911580 | + |
| SEQ ID NO 54549 | CTTATTCCCATGTGTGACTC | CAG | chr17 | 42911587 | 42911606 | 42911603 | + |
| SEQ ID NO 54550 | GTGTGACTCCAGCCTGCCCT | CAG | chr17 | 42911598 | 42911617 | 42911614 | + |
| SEQ ID NO 54551 | ACTCCAGCCTGCCCTCAGCA | CAG | chr17 | 42911603 | 42911622 | 42911619 | + |
| SEQ ID NO 54552 | GCCCTCAGCACAGACTCTTT | CAG | chr17 | 42911613 | 42911632 | 42911629 | + |
| SEQ ID NO 54553 | TCAGCACAGACTCTTTCAGA | TGG | chr17 | 42911617 | 42911636 | 42911633 | + |
| SEQ ID NO 54554 | AGCACAGACTCTTTCAGATG | GAG | chr17 | 42911619 | 42911638 | 42911635 | + |
| SEQ ID NO 54555 | GCACAGACTCTTTCAGATGG | AGG | chr17 | 42911620 | 42911639 | 42911636 | + |
| SEQ ID NO 54556 | ATATCACGTACACCATATGC | AAG | chr17 | 42911647 | 42911666 | 42911663 | + |
| SEQ ID NO 54557 | ACCATATGCAAGTTTCCCGC | CAG | chr17 | 42911658 | 42911677 | 42911674 | + |
| SEQ ID NO 54558 | CCATATGCAAGTTTCCCGCC | AGG | chr17 | 42911659 | 42911678 | 42911675 | + |
| SEQ ID NO 54559 | ATATGCAAGTTTCCCGCCAG | GAG | chr17 | 42911661 | 42911680 | 42911677 | + |
| SEQ ID NO 54560 | TATGCAAGTTTCCCGCCAGG | AGG | chr17 | 42911662 | 42911681 | 42911678 | + |
| SEQ ID NO 54561 | CTCTACTTGAATACTCTCAC | AAG | chr17 | 42911694 | 42911713 | 42911710 | + |
| SEQ ID NO 54562 | TACTTGAATACTCTCACAAG | TAG | chr17 | 42911697 | 42911716 | 42911713 | + |
| SEQ ID NO 54563 | ACTTGAATACTCTCACAAGT | AGG | chr17 | 42911698 | 42911717 | 42911714 | + |
| SEQ ID NO 54564 | CTTGAATACTCTCACAAGTA | GGG | chr17 | 42911699 | 42911718 | 42911715 | + |
| SEQ ID NO 54565 | TGAATACTCTCACAAGTAGG | GAG | chr17 | 42911701 | 42911720 | 42911717 | + |
| SEQ ID NO 54566 | AGTAGGGAGCTCACTCCCAC | TGG | chr17 | 42911715 | 42911734 | 42911731 | + |
| SEQ ID NO 54567 | GGAGCTCACTCCCACTGGAA | CAG | chr17 | 42911720 | 42911739 | 42911736 | + |
| SEQ ID NO 54568 | CAGCCCATTTTATCTTTGAA | TGG | chr17 | 42911740 | 42911759 | 42911756 | + |
| SEQ ID NO 54569 | ATCTTTGAATGGTCTTCTGC | CAG | chr17 | 42911751 | 42911770 | 42911767 | + |
| SEQ ID NO 54570 | GTCTTCTGCCAGCCCATTTT | GAG | chr17 | 42911762 | 42911781 | 42911778 | + |
| SEQ ID NO 54571 | TCTTCTGCCAGCCCATTTTG | AGG | chr17 | 42911763 | 42911782 | 42911779 | + |
| SEQ ID NO 54572 | CTGCCAGCCCATTTTGAGGC | CAG | chr17 | 42911767 | 42911786 | 42911783 | + |
| SEQ ID NO 54573 | GCCAGCCCATTTTGAGGCCA | GAG | chr17 | 42911769 | 42911788 | 42911785 | + |
| SEQ ID NO 54574 | CCAGCCCATTTTGAGGCCAG | AGG | chr17 | 42911770 | 42911789 | 42911786 | + |
| SEQ ID NO 54575 | TTTGAGGCCAGAGGTGCTGT | CAG | chr17 | 42911779 | 42911798 | 42911795 | + |

Figure 85 (Cont'd)

| | | | | | | | |
|---|---|---|---|---|---|---|---|
| SEQ ID NO 54576 | GGCCAGAGGTGCTGTCAGCT | CAG | chr17 | 42911784 | 42911803 | 42911800 | + |
| SEQ ID NO 54577 | GCCAGAGGTGCTGTCAGCTC | AGG | chr17 | 42911785 | 42911804 | 42911801 | + |
| SEQ ID NO 54578 | AGAGGTGCTGTCAGCTCAGG | TGG | chr17 | 42911788 | 42911807 | 42911804 | + |
| SEQ ID NO 54579 | TTTTACAATCCTAATCATAT | TGG | chr17 | 42911816 | 42911835 | 42911832 | + |
| SEQ ID NO 54580 | TTTACAATCCTAATCATATT | GGG | chr17 | 42911817 | 42911836 | 42911833 | + |
| SEQ ID NO 54581 | TATTGGGTAATGTTTTTGAA | AAG | chr17 | 42911833 | 42911852 | 42911849 | + |
| SEQ ID NO 54582 | ATGTTTTTGAAAAGCTAATG | AAG | chr17 | 42911842 | 42911861 | 42911858 | + |
| SEQ ID NO 54583 | GAAAAGCTAATGAAGCTATT | GAG | chr17 | 42911850 | 42911869 | 42911866 | + |
| SEQ ID NO 54584 | AGCTAATGAAGCTATTGAGA | AAG | chr17 | 42911854 | 42911873 | 42911870 | + |
| SEQ ID NO 54585 | TATTGAGAAAGACCTGTTGC | TAG | chr17 | 42911866 | 42911885 | 42911882 | + |
| SEQ ID NO 54586 | TGAGAAAGACCTGTTGCTAG | AAG | chr17 | 42911869 | 42911888 | 42911885 | + |
| SEQ ID NO 54587 | AAAGACCTGTTGCTAGAAGT | TGG | chr17 | 42911873 | 42911892 | 42911889 | + |
| SEQ ID NO 54588 | AAGACCTGTTGCTAGAAGTT | GGG | chr17 | 42911874 | 42911893 | 42911890 | + |
| SEQ ID NO 54589 | TGCTAGAAGTTGGGTTGTTC | TGG | chr17 | 42911883 | 42911902 | 42911899 | + |
| SEQ ID NO 54590 | TTGTTCTGGATTTTCCCCTG | AAG | chr17 | 42911897 | 42911916 | 42911913 | + |
| SEQ ID NO 54591 | TTCTTCCGTCACATATACAA | AAG | chr17 | 42911929 | 42911948 | 42911945 | + |
| SEQ ID NO 54592 | TCCGTCACATATACAAAAGC | AAG | chr17 | 42911933 | 42911952 | 42911949 | + |
| SEQ ID NO 54593 | ATATACAAAAGCAAGACTTC | CAG | chr17 | 42911941 | 42911960 | 42911957 | + |
| SEQ ID NO 54594 | TATACAAAAGCAAGACTTCC | AGG | chr17 | 42911942 | 42911961 | 42911958 | + |
| SEQ ID NO 54595 | ACAAAAGCAAGACTTCCAGG | TAG | chr17 | 42911945 | 42911964 | 42911961 | + |
| SEQ ID NO 54596 | CAAAAGCAAGACTTCCAGGT | AGG | chr17 | 42911946 | 42911965 | 42911962 | + |
| SEQ ID NO 54597 | AAAAGCAAGACTTCCAGGTA | GGG | chr17 | 42911947 | 42911966 | 42911963 | + |
| SEQ ID NO 54598 | GCAAGACTTCCAGGTAGGGC | CAG | chr17 | 42911951 | 42911970 | 42911967 | + |
| SEQ ID NO 54599 | TCCAGGTAGGGCCAGCTCAC | AAG | chr17 | 42911959 | 42911978 | 42911975 | + |
| SEQ ID NO 54600 | GTAGGGCCAGCTCACAAGCC | CAG | chr17 | 42911964 | 42911983 | 42911980 | + |
| SEQ ID NO 54601 | TAGGGCCAGCTCACAAGCCC | AGG | chr17 | 42911965 | 42911984 | 42911981 | + |
| SEQ ID NO 54602 | GCCAGCTCACAAGCCCAGGC | TGG | chr17 | 42911969 | 42911988 | 42911985 | + |
| SEQ ID NO 54603 | CAGCTCACAAGCCCAGGCTG | GAG | chr17 | 42911971 | 42911990 | 42911987 | + |
| SEQ ID NO 54604 | CCAGGCTGGAGATCCTAACT | GAG | chr17 | 42911983 | 42912002 | 42911999 | + |
| SEQ ID NO 54605 | TACCTGTGTTCATTCTTACC | GAG | chr17 | 42912013 | 42912032 | 42912029 | + |
| SEQ ID NO 54606 | GTGTTCATTCTTACCGAGAA | AAG | chr17 | 42912018 | 42912037 | 42912034 | + |
| SEQ ID NO 54607 | TGTTCATTCTTACCGAGAAA | AGG | chr17 | 42912019 | 42912038 | 42912035 | + |
| SEQ ID NO 54608 | TTCATTCTTACCGAGAAAAG | GAG | chr17 | 42912021 | 42912040 | 42912037 | + |
| SEQ ID NO 54609 | TTCTTACCGAGAAAAGGAGA | AAG | chr17 | 42912025 | 42912044 | 42912041 | + |
| SEQ ID NO 54610 | TCTTACCGAGAAAAGGAGAA | AGG | chr17 | 42912026 | 42912045 | 42912042 | + |
| SEQ ID NO 54611 | TTACCGAGAAAAGGAGAAAG | GAG | chr17 | 42912028 | 42912047 | 42912044 | + |
| SEQ ID NO 54612 | GAAAGGAGCTCTGAATCTGA | TAG | chr17 | 42912043 | 42912062 | 42912059 | + |
| SEQ ID NO 54613 | AAAGGAGCTCTGAATCTGAT | AGG | chr17 | 42912044 | 42912063 | 42912060 | + |
| SEQ ID NO 54614 | AGCTCTGAATCTGATAGGAA | AAG | chr17 | 42912049 | 42912068 | 42912065 | + |
| SEQ ID NO 54615 | TCTGAATCTGATAGGAAAAG | AAG | chr17 | 42912052 | 42912071 | 42912068 | + |
| SEQ ID NO 54616 | CTGAATCTGATAGGAAAAGA | AGG | chr17 | 42912053 | 42912072 | 42912069 | + |
| SEQ ID NO 54617 | ATAGGAAAAGAAGGCTGCCT | AAG | chr17 | 42912062 | 42912081 | 42912078 | + |
| SEQ ID NO 54618 | TAGGAAAAGAAGGCTGCCTA | AGG | chr17 | 42912063 | 42912082 | 42912079 | + |
| SEQ ID NO 54619 | GGAAAAGAAGGCTGCCTAAG | GAG | chr17 | 42912065 | 42912084 | 42912081 | + |
| SEQ ID NO 54620 | GAAAAGAAGGCTGCCTAAGG | AGG | chr17 | 42912066 | 42912085 | 42912082 | + |
| SEQ ID NO 54621 | AAAGAAGGCTGCCTAAGGAG | GAG | chr17 | 42912068 | 42912087 | 42912084 | + |
| SEQ ID NO 54622 | GCTGCCTAAGGAGGAGTTTT | TAG | chr17 | 42912075 | 42912094 | 42912091 | + |

Figure 85 (Cont'd)

| SEQ ID NO 54623 | AAGGAGGAGTTTTTAGTATG | TGG | chr17 | 42912082 | 42912101 | 42912098 | + |
| SEQ ID NO 54624 | TAGTATGTGGCGTATCATGC | AAG | chr17 | 42912095 | 42912114 | 42912111 | + |
| SEQ ID NO 54625 | TATCATGCAAGTGCTATGCC | AAG | chr17 | 42912107 | 42912126 | 42912123 | + |
| SEQ ID NO 54626 | TATGCCAAGCCATGTCTAAA | TGG | chr17 | 42912121 | 42912140 | 42912137 | + |
| SEQ ID NO 54627 | TCTAAATGGCTTTAATTATA | TAG | chr17 | 42912135 | 42912154 | 42912151 | + |
| SEQ ID NO 54628 | ATTATATAGTAATGCACTCT | CAG | chr17 | 42912149 | 42912168 | 42912165 | + |
| SEQ ID NO 54629 | TAGTAATGCACTCTCAGTAA | TGG | chr17 | 42912155 | 42912174 | 42912171 | + |
| SEQ ID NO 54630 | AGTAATGCACTCTCAGTAAT | GGG | chr17 | 42912156 | 42912175 | 42912172 | + |
| SEQ ID NO 54631 | GTAATGCACTCTCAGTAATG | GGG | chr17 | 42912157 | 42912176 | 42912173 | + |
| SEQ ID NO 54632 | TAATGCACTCTCAGTAATGG | GGG | chr17 | 42912158 | 42912177 | 42912174 | + |
| SEQ ID NO 54633 | CACTCTCAGTAATGGGGAC | CAG | chr17 | 42912163 | 42912182 | 42912179 | + |
| SEQ ID NO 54634 | CAGTAATGGGGGACCAGCTT | AAG | chr17 | 42912169 | 42912188 | 42912185 | + |
| SEQ ID NO 54635 | ACCAGCTTAAGTATAATTAA | TAG | chr17 | 42912181 | 42912200 | 42912197 | + |
| SEQ ID NO 54636 | GCTTAAGTATAATTAATAGA | TGG | chr17 | 42912185 | 42912204 | 42912201 | + |
| SEQ ID NO 54637 | AAGTATAATTAATAGATGGT | TAG | chr17 | 42912189 | 42912208 | 42912205 | + |
| SEQ ID NO 54638 | TATAATTAATAGATGGTTAG | TGG | chr17 | 42912192 | 42912211 | 42912208 | + |
| SEQ ID NO 54639 | ATAATTAATAGATGGTTAGT | GGG | chr17 | 42912193 | 42912212 | 42912209 | + |
| SEQ ID NO 54640 | TAATTAATAGATGGTTAGTG | GGG | chr17 | 42912194 | 42912213 | 42912210 | + |
| SEQ ID NO 54641 | TAGTGGGGTAATTCTGCTTC | TAG | chr17 | 42912209 | 42912228 | 42912225 | + |
| SEQ ID NO 54642 | ACATGTTCATCGTATTTCCT | TGG | chr17 | 42912251 | 42912270 | 42912267 | + |
| SEQ ID NO 54643 | TATTTCCTTGGATTTCTGAA | TGG | chr17 | 42912263 | 42912282 | 42912279 | + |
| SEQ ID NO 54644 | CTTGGATTTCTGAATGGCTG | CAG | chr17 | 42912269 | 42912288 | 42912285 | + |
| SEQ ID NO 54645 | TCTGAATGGCTGCAGTGACC | CAG | chr17 | 42912277 | 42912296 | 42912293 | + |
| SEQ ID NO 54646 | CAGTGACCCAGATATTGCAC | TAG | chr17 | 42912289 | 42912308 | 42912305 | + |
| SEQ ID NO 54647 | AGTGACCCAGATATTGCACT | AGG | chr17 | 42912290 | 42912309 | 42912306 | + |
| SEQ ID NO 54648 | TTGCACTAGGTCAAAACATT | CAG | chr17 | 42912303 | 42912322 | 42912319 | + |
| SEQ ID NO 54649 | TGCACTAGGTCAAAACATTC | AGG | chr17 | 42912304 | 42912323 | 42912320 | + |
| SEQ ID NO 54650 | TAGGTCAAAACATTCAGGTA | TAG | chr17 | 42912309 | 42912328 | 42912325 | + |
| SEQ ID NO 54651 | CATTACATCATCCTCCTTAT | AAG | chr17 | 42912350 | 42912369 | 42912366 | + |
| SEQ ID NO 54652 | CATCATCCTCCTTATAAGCC | CAG | chr17 | 42912355 | 42912374 | 42912371 | + |
| SEQ ID NO 54653 | AAGCCCAGCTCTGCTTTTTC | CAG | chr17 | 42912370 | 42912389 | 42912386 | + |
| SEQ ID NO 54654 | CTTTTTCCAGATTCTTCCAC | TGG | chr17 | 42912383 | 42912402 | 42912399 | + |
| SEQ ID NO 54655 | TGGCTCCACATCCACCCCAC | TGG | chr17 | 42912403 | 42912422 | 42912419 | + |
| SEQ ID NO 54656 | CATCCACCCCACTGGATCTT | CAG | chr17 | 42912411 | 42912430 | 42912427 | + |
| SEQ ID NO 54657 | CCACCCCACTGGATCTTCAG | AAG | chr17 | 42912414 | 42912433 | 42912430 | + |
| SEQ ID NO 54658 | CACCCCACTGGATCTTCAGA | AGG | chr17 | 42912415 | 42912434 | 42912431 | + |
| SEQ ID NO 54659 | CCACTGGATCTTCAGAAGGC | TAG | chr17 | 42912419 | 42912438 | 42912435 | + |
| SEQ ID NO 54660 | ACTGGATCTTCAGAAGGCTA | GAG | chr17 | 42912421 | 42912440 | 42912437 | + |
| SEQ ID NO 54661 | CTGGATCTTCAGAAGGCTAG | AGG | chr17 | 42912422 | 42912441 | 42912438 | + |
| SEQ ID NO 54662 | TGGATCTTCAGAAGGCTAGA | GGG | chr17 | 42912423 | 42912442 | 42912439 | + |
| SEQ ID NO 54663 | AGAAGGCTAGAGGGCGACTC | TGG | chr17 | 42912432 | 42912451 | 42912448 | + |
| SEQ ID NO 54664 | AGGCTAGAGGGCGACTCTGG | TGG | chr17 | 42912435 | 42912454 | 42912451 | + |
| SEQ ID NO 54665 | GTGCTTTTGTATGTTTCAAT | TAG | chr17 | 42912457 | 42912476 | 42912473 | + |
| SEQ ID NO 54666 | TGCTTTTGTATGTTTCAATT | AGG | chr17 | 42912458 | 42912477 | 42912474 | + |
| SEQ ID NO 54667 | TCAATTAGGCTCTGAAATCT | TGG | chr17 | 42912472 | 42912491 | 42912488 | + |
| SEQ ID NO 54668 | CAATTAGGCTCTGAAATCTT | GGG | chr17 | 42912473 | 42912492 | 42912489 | + |
| SEQ ID NO 54669 | GAAATCTTGGGCAAAATGAC | AAG | chr17 | 42912485 | 42912504 | 42912501 | + |

Figure 85 (Cont'd)

| SEQ ID NO 54670 | AAATCTTGGGCAAAATGACA | AGG | chr17 | 42912486 | 42912505 | 42912502 | + |
| SEQ ID NO 54671 | AATCTTGGGCAAAATGACAA | GGG | chr17 | 42912487 | 42912506 | 42912503 | + |
| SEQ ID NO 54672 | ATCTTGGGCAAAATGACAAG | GGG | chr17 | 42912488 | 42912507 | 42912504 | + |
| SEQ ID NO 54673 | CTTGGGCAAAATGACAAGGG | GAG | chr17 | 42912490 | 42912509 | 42912506 | + |
| SEQ ID NO 54674 | TTGGGCAAAATGACAAGGGG | AGG | chr17 | 42912491 | 42912510 | 42912507 | + |
| SEQ ID NO 54675 | TGGGCAAAATGACAAGGGGA | GGG | chr17 | 42912492 | 42912511 | 42912508 | + |
| SEQ ID NO 54676 | CAAAATGACAAGGGGAGGGC | CAG | chr17 | 42912496 | 42912515 | 42912512 | + |
| SEQ ID NO 54677 | AAAATGACAAGGGGAGGGCC | AGG | chr17 | 42912497 | 42912516 | 42912513 | + |
| SEQ ID NO 54678 | GAGGGCCAGGATTCCTCTCT | CAG | chr17 | 42912510 | 42912529 | 42912526 | + |
| SEQ ID NO 54679 | AGGGCCAGGATTCCTCTCTC | AGG | chr17 | 42912511 | 42912530 | 42912527 | + |
| SEQ ID NO 54680 | ATTCCTCTCTCAGGTCACTC | CAG | chr17 | 42912520 | 42912539 | 42912536 | + |
| SEQ ID NO 54681 | CCAGTGTTACTTTTAATTCC | TAG | chr17 | 42912539 | 42912558 | 42912555 | + |
| SEQ ID NO 54682 | AGTGTTACTTTTAATTCCTA | GAG | chr17 | 42912541 | 42912560 | 42912557 | + |
| SEQ ID NO 54683 | GTGTTACTTTTAATTCCTAG | AGG | chr17 | 42912542 | 42912561 | 42912558 | + |
| SEQ ID NO 54684 | TGTTACTTTTAATTCCTAGA | GGG | chr17 | 42912543 | 42912562 | 42912559 | + |
| SEQ ID NO 54685 | ATGACTCCTTTCTCTATCCC | AAG | chr17 | 42912571 | 42912590 | 42912587 | + |
| SEQ ID NO 54686 | TTCTATCCCAAGCCAACC | AAG | chr17 | 42912580 | 42912599 | 42912596 | + |
| SEQ ID NO 54687 | CTCTATCCCAAGCCAACCAA | GAG | chr17 | 42912582 | 42912601 | 42912598 | + |
| SEQ ID NO 54688 | CAACCAAGAGCACATTCTTA | AAG | chr17 | 42912595 | 42912614 | 42912611 | + |
| SEQ ID NO 54689 | AACCAAGAGCACATTCTTAA | AGG | chr17 | 42912596 | 42912615 | 42912612 | + |
| SEQ ID NO 54690 | AGAGCACATTCTTAAAGGAA | AAG | chr17 | 42912601 | 42912620 | 42912617 | + |
| SEQ ID NO 54691 | CTCTCTTTTTTTTTTTTTTT | GAG | chr17 | 42912634 | 42912653 | 42912650 | + |
| SEQ ID NO 54692 | CTTTTTTTTTTTTTTTGAGA | CAG | chr17 | 42912638 | 42912657 | 42912654 | + |
| SEQ ID NO 54693 | TTTTTTTTTTTTTTGAGAC | AGG | chr17 | 42912639 | 42912658 | 42912655 | + |
| SEQ ID NO 54694 | TTTTTTTTTTTTTGAGACA | GGG | chr17 | 42912640 | 42912659 | 42912656 | + |
| SEQ ID NO 54695 | CAGGGTCTCACTATGTTGCC | CAG | chr17 | 42912658 | 42912677 | 42912674 | + |
| SEQ ID NO 54696 | AGGGTCTCACTATGTTGCCC | AGG | chr17 | 42912659 | 42912678 | 42912675 | + |
| SEQ ID NO 54697 | CCAGGCTGCTCTTGAATTCC | TGG | chr17 | 42912677 | 42912696 | 42912693 | + |
| SEQ ID NO 54698 | CAGGCTGCTCTTGAATTCCT | GGG | chr17 | 42912678 | 42912697 | 42912694 | + |
| SEQ ID NO 54699 | GCTCTTGAATTCCTGGGCTC | AAG | chr17 | 42912684 | 42912703 | 42912700 | + |
| SEQ ID NO 54700 | CTTGAATTCCTGGGCTCAAG | CAG | chr17 | 42912687 | 42912706 | 42912703 | + |
| SEQ ID NO 54701 | GCAGTCCTCCCACCCTACCA | CAG | chr17 | 42912706 | 42912725 | 42912722 | + |
| SEQ ID NO 54702 | CCCTACCACAGCGTCCCGCG | TAG | chr17 | 42912718 | 42912737 | 42912734 | + |
| SEQ ID NO 54703 | ACCACAGCGTCCCGCGTAGC | TGG | chr17 | 42912722 | 42912741 | 42912738 | + |
| SEQ ID NO 54704 | CCACAGCGTCCCGCGTAGCT | GGG | chr17 | 42912723 | 42912742 | 42912739 | + |
| SEQ ID NO 54705 | GTCCCGCGTAGCTGGGACTA | CAG | chr17 | 42912730 | 42912749 | 42912746 | + |
| SEQ ID NO 54706 | TCCCGCGTAGCTGGGACTAC | AGG | chr17 | 42912731 | 42912750 | 42912747 | + |
| SEQ ID NO 54707 | GTAGCTGGGACTACAGGTGC | AAG | chr17 | 42912737 | 42912756 | 42912753 | + |
| SEQ ID NO 54708 | CAGGTGCAAGCCACTATGTC | CAG | chr17 | 42912750 | 42912769 | 42912766 | + |
| SEQ ID NO 54709 | TGCAAGCCACTATGTCCAGC | TAG | chr17 | 42912754 | 42912773 | 42912770 | + |
| SEQ ID NO 54710 | TTCTTTTTTTTCTTTTTTT | GAG | chr17 | 42912798 | 42912817 | 42912814 | + |
| SEQ ID NO 54711 | TTTTTTTTCTTTTTTGAGA | CGG | chr17 | 42912802 | 42912821 | 42912818 | + |
| SEQ ID NO 54712 | GAGACGGCGCACCTATCACC | CAG | chr17 | 42912818 | 42912837 | 42912834 | + |
| SEQ ID NO 54713 | AGACGGCGCACCTATCACCC | AGG | chr17 | 42912819 | 42912838 | 42912835 | + |
| SEQ ID NO 54714 | GGCGCACCTATCACCCAGGC | TGG | chr17 | 42912823 | 42912842 | 42912839 | + |
| SEQ ID NO 54715 | CGCACCTATCACCCAGGCTG | GAG | chr17 | 42912825 | 42912844 | 42912841 | + |
| SEQ ID NO 54716 | ACCTATCACCCAGGCTGGAG | TGG | chr17 | 42912828 | 42912847 | 42912844 | + |

Figure 85 (Cont'd)

| | | | | | | | |
|---|---|---|---|---|---|---|---|
| SEQ ID NO 54717 | CTATCACCCAGGCTGGAGTG | GAG | chr17 | 42912830 | 42912849 | 42912846 | + |
| SEQ ID NO 54718 | TCACCCAGGCTGGAGTGGAG | TGG | chr17 | 42912833 | 42912852 | 42912849 | + |
| SEQ ID NO 54719 | GGAGTGGAGTGGCACGATCT | TGG | chr17 | 42912844 | 42912863 | 42912860 | + |
| SEQ ID NO 54720 | TCACTGCAACCTCTTCCTCC | TGG | chr17 | 42912868 | 42912887 | 42912884 | + |
| SEQ ID NO 54721 | CAACCTCTTCCTCCTGGTTC | AAG | chr17 | 42912874 | 42912893 | 42912890 | + |
| SEQ ID NO 54722 | TTCAAGCGATTCTCATGTCT | CAG | chr17 | 42912891 | 42912910 | 42912907 | + |
| SEQ ID NO 54723 | TTCTCATGTCTCAGCCTCCT | CAG | chr17 | 42912900 | 42912919 | 42912916 | + |
| SEQ ID NO 54724 | TCATGTCTCAGCCTCCTCAG | TAG | chr17 | 42912903 | 42912922 | 42912919 | + |
| SEQ ID NO 54725 | GTCTCAGCCTCCTCAGTAGC | TAG | chr17 | 42912907 | 42912926 | 42912923 | + |
| SEQ ID NO 54726 | TCTCAGCCTCCTCAGTAGCT | AGG | chr17 | 42912908 | 42912927 | 42912924 | + |
| SEQ ID NO 54727 | TCCTCAGTAGCTAGGACTAC | CGG | chr17 | 42912916 | 42912935 | 42912932 | + |
| SEQ ID NO 54728 | ACCGGCGTGCACCACCATGC | CAG | chr17 | 42912934 | 42912953 | 42912950 | + |
| SEQ ID NO 54729 | CCGGCGTGCACCACCATGCC | AGG | chr17 | 42912935 | 42912954 | 42912951 | + |
| SEQ ID NO 54730 | CAGGCTAATTTTTATATTTT | TAG | chr17 | 42912954 | 42912973 | 42912970 | + |
| SEQ ID NO 54731 | TTTTTATATTTTTAGAATTT | TAG | chr17 | 42912962 | 42912981 | 42912978 | + |
| SEQ ID NO 54732 | TTATATTTTTAGAATTTTAG | AAG | chr17 | 42912965 | 42912984 | 42912981 | + |
| SEQ ID NO 54733 | ATATTTTTAGAATTTTAGAA | GAG | chr17 | 42912967 | 42912986 | 42912983 | + |
| SEQ ID NO 54734 | TTTTAGAATTTTAGAAGAGA | TGG | chr17 | 42912971 | 42912990 | 42912987 | + |
| SEQ ID NO 54735 | TTTAGAATTTTAGAAGAGAT | GGG | chr17 | 42912972 | 42912991 | 42912988 | + |
| SEQ ID NO 54736 | GAGATGGGATTTCATCATGT | TGG | chr17 | 42912987 | 42913006 | 42913003 | + |
| SEQ ID NO 54737 | TGGGATTTCATCATGTTGGC | CAG | chr17 | 42912991 | 42913010 | 42913007 | + |
| SEQ ID NO 54738 | GGGATTTCATCATGTTGGCC | AGG | chr17 | 42912992 | 42913011 | 42913008 | + |
| SEQ ID NO 54739 | TTTCATCATGTTGGCCAGGC | TGG | chr17 | 42912996 | 42913015 | 42913012 | + |
| SEQ ID NO 54740 | GGTCTCGAACTCCTGACCTC | AAG | chr17 | 42913017 | 42913036 | 42913033 | + |
| SEQ ID NO 54741 | CTCAAGTGATCCACCTGCCT | TGG | chr17 | 42913034 | 42913053 | 42913050 | + |
| SEQ ID NO 54742 | TCCACCTGCCTTGGCCTCCC | AAG | chr17 | 42913043 | 42913062 | 42913059 | + |
| SEQ ID NO 54743 | CCACCTGCCTTGGCCTCCCA | AGG | chr17 | 42913044 | 42913063 | 42913060 | + |
| SEQ ID NO 54744 | GCCTTGGCCTCCCAAGGTGC | TAG | chr17 | 42913050 | 42913069 | 42913066 | + |
| SEQ ID NO 54745 | CCTTGGCCTCCCAAGGTGCT | AGG | chr17 | 42913051 | 42913070 | 42913067 | + |
| SEQ ID NO 54746 | CTCCCAAGGTGCTAGGATTA | CAG | chr17 | 42913058 | 42913077 | 42913074 | + |
| SEQ ID NO 54747 | TCCCAAGGTGCTAGGATTAC | AGG | chr17 | 42913059 | 42913078 | 42913075 | + |
| SEQ ID NO 54748 | GGTGCTAGGATTACAGGCAT | GAG | chr17 | 42913065 | 42913084 | 42913081 | + |
| SEQ ID NO 54749 | ACAGGCATGAGCCACCGCAC | CGG | chr17 | 42913077 | 42913096 | 42913093 | + |
| SEQ ID NO 54750 | CAGGCATGAGCCACCGCACC | GGG | chr17 | 42913078 | 42913097 | 42913094 | + |
| SEQ ID NO 54751 | TTTCAATCTCATCTGATATG | CAG | chr17 | 42913116 | 42913135 | 42913132 | + |
| SEQ ID NO 54752 | TCAATCTCATCTGATATGCA | GAG | chr17 | 42913118 | 42913137 | 42913134 | + |
| SEQ ID NO 54753 | ACCCACCTACCCCCCAAAAA | AAG | chr17 | 42913153 | 42913172 | 42913169 | + |
| SEQ ID NO 54754 | CTACCCCCAAAAAAAGCTG | AAG | chr17 | 42913159 | 42913178 | 42913175 | + |
| SEQ ID NO 54755 | GCTGAAGCCTATTTATTTGA | AAG | chr17 | 42913175 | 42913194 | 42913191 | + |
| SEQ ID NO 54756 | TGTTTTTGCTACTAATTATA | TAG | chr17 | 42913202 | 42913221 | 42913218 | + |
| SEQ ID NO 54757 | CTGCTCATAACATCTTTGAA | AAG | chr17 | 42913257 | 42913276 | 42913273 | + |
| SEQ ID NO 54758 | AAAAGAAAAATATATATGTG | CAG | chr17 | 42913275 | 42913294 | 42913291 | + |
| SEQ ID NO 54759 | ATATGTGCAGTATTTTATTA | AAG | chr17 | 42913288 | 42913307 | 42913304 | + |
| SEQ ID NO 54760 | ATTAAAGCAACATTTTATTT | AAG | chr17 | 42913304 | 42913323 | 42913320 | + |
| SEQ ID NO 54761 | CAACATTTTATTTAAGAATA | AAG | chr17 | 42913311 | 42913330 | 42913327 | + |
| SEQ ID NO 54762 | TCTTGTTAATTACTATATTT | TAG | chr17 | 42913334 | 42913353 | 42913350 | + |
| SEQ ID NO 54763 | TTTAGATGCAATGTGATCTG | AAG | chr17 | 42913352 | 42913371 | 42913368 | + |

Figure 85 (Cont'd)

| SEQ ID NO 54764 | TGATCTGAAGTTTCTAATTC | TGG | chr17 | 42913365 | 42913384 | 42913381 | + |
| SEQ ID NO 54765 | TTCTGGCCCAACTAAATTTC | TAG | chr17 | 42913382 | 42913401 | 42913398 | + |
| SEQ ID NO 54766 | GTTTCCCTAAACAAATAATT | TGG | chr17 | 42913409 | 42913428 | 42913425 | + |
| SEQ ID NO 54767 | CTGTGCCTGCATTTTCCCTT | TGG | chr17 | 42913437 | 42913456 | 42913453 | + |
| SEQ ID NO 54768 | GTGCCTGCATTTTCCCTTTG | GAG | chr17 | 42913439 | 42913458 | 42913455 | + |
| SEQ ID NO 54769 | CCTGCATTTTCCCTTTGGAG | AAG | chr17 | 42913442 | 42913461 | 42913458 | + |
| SEQ ID NO 54770 | ATTTTCCCTTTGGAGAAGAA | AAG | chr17 | 42913447 | 42913466 | 42913463 | + |
| SEQ ID NO 54771 | GAAGAAAAGTGCTCTCTCTT | GAG | chr17 | 42913461 | 42913480 | 42913477 | + |
| SEQ ID NO 54772 | TGCTCTCTCTTGAGTTGACC | GAG | chr17 | 42913470 | 42913489 | 42913486 | + |
| SEQ ID NO 54773 | CTCTCTCTTGAGTTGACCGA | GAG | chr17 | 42913472 | 42913491 | 42913488 | + |
| SEQ ID NO 54774 | GAGTTGACCGAGAGTCCCAT | TAG | chr17 | 42913481 | 42913500 | 42913497 | + |
| SEQ ID NO 54775 | AGTTGACCGAGAGTCCCATT | AGG | chr17 | 42913482 | 42913501 | 42913498 | + |
| SEQ ID NO 54776 | GTTGACCGAGAGTCCCATTA | GGG | chr17 | 42913483 | 42913502 | 42913499 | + |
| SEQ ID NO 54777 | ACCGAGAGTCCCATTAGGGA | TAG | chr17 | 42913487 | 42913506 | 42913503 | + |
| SEQ ID NO 54778 | CCGAGAGTCCCATTAGGGAT | AGG | chr17 | 42913488 | 42913507 | 42913504 | + |
| SEQ ID NO 54779 | CGAGAGTCCCATTAGGGATA | GGG | chr17 | 42913489 | 42913508 | 42913505 | + |
| SEQ ID NO 54780 | AGAGTCCCATTAGGGATAGG | GAG | chr17 | 42913491 | 42913510 | 42913507 | + |
| SEQ ID NO 54781 | GGGAGACTTAAATGCATCCA | CAG | chr17 | 42913509 | 42913528 | 42913525 | + |
| SEQ ID NO 54782 | GGAGACTTAAATGCATCCAC | AGG | chr17 | 42913510 | 42913529 | 42913526 | + |
| SEQ ID NO 54783 | GAGACTTAAATGCATCCACA | GGG | chr17 | 42913511 | 42913530 | 42913527 | + |
| SEQ ID NO 54784 | AGACTTAAATGCATCCACAG | GGG | chr17 | 42913512 | 42913531 | 42913528 | + |
| SEQ ID NO 54785 | TAAATGCATCCACAGGGGCA | CAG | chr17 | 42913517 | 42913536 | 42913533 | + |
| SEQ ID NO 54786 | AAATGCATCCACAGGGGCAC | AGG | chr17 | 42913518 | 42913537 | 42913534 | + |
| SEQ ID NO 54787 | TGCATCCACAGGGGCACAGG | CAG | chr17 | 42913521 | 42913540 | 42913537 | + |
| SEQ ID NO 54788 | CATCCACAGGGGCACAGGCA | GAG | chr17 | 42913523 | 42913542 | 42913539 | + |
| SEQ ID NO 54789 | ACAGGGGCACAGGCAGAGTT | GAG | chr17 | 42913528 | 42913547 | 42913544 | + |
| SEQ ID NO 54790 | GGCAGAGTTGAGCACATAAA | CGG | chr17 | 42913539 | 42913558 | 42913555 | + |
| SEQ ID NO 54791 | CAGAGTTGAGCACATAAACG | GAG | chr17 | 42913541 | 42913560 | 42913557 | + |
| SEQ ID NO 54792 | AGAGTTGAGCACATAAACGG | AGG | chr17 | 42913542 | 42913561 | 42913558 | + |
| SEQ ID NO 54793 | CATAAACGGAGGCCCAAAAT | CAG | chr17 | 42913553 | 42913572 | 42913569 | + |
| SEQ ID NO 54794 | ACGGAGGCCCAAAATCAGCA | TAG | chr17 | 42913558 | 42913577 | 42913574 | + |
| SEQ ID NO 54795 | GCCCAAAATCAGCATAGAAC | CAG | chr17 | 42913564 | 42913583 | 42913580 | + |
| SEQ ID NO 54796 | AAAATCAGCATAGAACCAGA | AAG | chr17 | 42913568 | 42913587 | 42913584 | + |
| SEQ ID NO 54797 | AGCATAGAACCAGAAAGATT | CAG | chr17 | 42913574 | 42913593 | 42913590 | + |
| SEQ ID NO 54798 | CATAGAACCAGAAAGATTCA | GAG | chr17 | 42913576 | 42913595 | 42913592 | + |
| SEQ ID NO 54799 | GAACCAGAAAGATTCAGAGT | TGG | chr17 | 42913580 | 42913599 | 42913596 | + |
| SEQ ID NO 54800 | AGAAAGATTCAGAGTTGGCC | AAG | chr17 | 42913585 | 42913604 | 42913601 | + |
| SEQ ID NO 54801 | AGTTGGCCAAGAATGAACAT | TGG | chr17 | 42913597 | 42913616 | 42913613 | + |
| SEQ ID NO 54802 | CAAGAATGAACATTGGCTAC | CAG | chr17 | 42913604 | 42913623 | 42913620 | + |
| SEQ ID NO 54803 | AACATTGGCTACCAGACCAC | AAG | chr17 | 42913612 | 42913631 | 42913628 | + |
| SEQ ID NO 54804 | TTGGCTACCAGACCACAAGT | CAG | chr17 | 42913616 | 42913635 | 42913632 | + |
| SEQ ID NO 54805 | ACCAGACCACAAGTCAGCAT | GAG | chr17 | 42913622 | 42913641 | 42913638 | + |
| SEQ ID NO 54806 | AGTCAGCATGAGTTGCTCTA | TGG | chr17 | 42913633 | 42913652 | 42913649 | + |
| SEQ ID NO 54807 | ATGGCATCAAATTGCAACTT | GAG | chr17 | 42913652 | 42913671 | 42913668 | + |
| SEQ ID NO 54808 | GGCATCAAATTGCAACTTGA | GAG | chr17 | 42913654 | 42913673 | 42913670 | + |
| SEQ ID NO 54809 | ATCAAATTGCAACTTGAGAG | TAG | chr17 | 42913657 | 42913676 | 42913673 | + |
| SEQ ID NO 54810 | AATTGCAACTTGAGAGTAGA | TGG | chr17 | 42913661 | 42913680 | 42913677 | + |

Figure 85 (Cont'd)

| SEQ ID NO 54811 | ATTGCAACTTGAGAGTAGAT | GGG | chr17 | 42913662 | 42913681 | 42913678 | + |
| SEQ ID NO 54812 | GCAACTTGAGAGTAGATGGG | CAG | chr17 | 42913665 | 42913684 | 42913681 | + |
| SEQ ID NO 54813 | CAACTTGAGAGTAGATGGGC | AGG | chr17 | 42913666 | 42913685 | 42913682 | + |
| SEQ ID NO 54814 | AACTTGAGAGTAGATGGGCA | GGG | chr17 | 42913667 | 42913686 | 42913683 | + |
| SEQ ID NO 54815 | GGCAGGGTCACTATCAAATT | AAG | chr17 | 42913683 | 42913702 | 42913699 | + |
| SEQ ID NO 54816 | TCACTATCAAATTAAGCAAT | CAG | chr17 | 42913690 | 42913709 | 42913706 | + |
| SEQ ID NO 54817 | CACTATCAAATTAAGCAATC | AGG | chr17 | 42913691 | 42913710 | 42913707 | + |
| SEQ ID NO 54818 | ACTATCAAATTAAGCAATCA | GGG | chr17 | 42913692 | 42913711 | 42913708 | + |
| SEQ ID NO 54819 | ATTAAGCAATCAGGGCACAC | AAG | chr17 | 42913700 | 42913719 | 42913716 | + |
| SEQ ID NO 54820 | CAATCAGGGCACACAAGTTG | CAG | chr17 | 42913706 | 42913725 | 42913722 | + |
| SEQ ID NO 54821 | ACAAGTTGCAGTAACACAAC | AAG | chr17 | 42913718 | 42913737 | 42913734 | + |
| SEQ ID NO 54822 | TTGCAGTAACACAACAAGAC | TAG | chr17 | 42913723 | 42913742 | 42913739 | + |
| SEQ ID NO 54823 | TGCAGTAACACAACAAGACT | AGG | chr17 | 42913724 | 42913743 | 42913740 | + |
| SEQ ID NO 54824 | GTAACACAACAAGACTAGGC | CAG | chr17 | 42913728 | 42913747 | 42913744 | + |
| SEQ ID NO 54825 | CAACAAGACTAGGCCAGCTC | TGG | chr17 | 42913734 | 42913753 | 42913750 | + |
| SEQ ID NO 54826 | ACTAGGCCAGCTCTGGAATC | CAG | chr17 | 42913741 | 42913760 | 42913757 | + |
| SEQ ID NO 54827 | AGCTCTGGAATCCAGTAACT | CAG | chr17 | 42913749 | 42913768 | 42913765 | + |
| SEQ ID NO 54828 | GGAATCCAGTAACTCAGTGT | CAG | chr17 | 42913755 | 42913774 | 42913771 | + |
| SEQ ID NO 54829 | TCCAGTAACTCAGTGTCAGC | AAG | chr17 | 42913759 | 42913778 | 42913775 | + |
| SEQ ID NO 54830 | CCAGTAACTCAGTGTCAGCA | AGG | chr17 | 42913760 | 42913779 | 42913776 | + |
| SEQ ID NO 54831 | ACTCAGTGTCAGCAAGGTTT | TGG | chr17 | 42913766 | 42913785 | 42913782 | + |
| SEQ ID NO 54832 | CTCAGTGTCAGCAAGGTTTT | GGG | chr17 | 42913767 | 42913786 | 42913783 | + |
| SEQ ID NO 54833 | GTCAGCAAGGTTTTGGGTTA | TAG | chr17 | 42913773 | 42913792 | 42913789 | + |
| SEQ ID NO 54834 | AAGGTTTTGGGTTATAGTTC | AAG | chr17 | 42913779 | 42913798 | 42913795 | + |
| SEQ ID NO 54835 | TTTTGGGTTATAGTTCAAGA | AAG | chr17 | 42913783 | 42913802 | 42913799 | + |
| SEQ ID NO 54836 | ATAGTTCAAGAAAGTCTAAA | CAG | chr17 | 42913792 | 42913811 | 42913808 | + |
| SEQ ID NO 54837 | AGTTCAAGAAAGTCTAAACA | GAG | chr17 | 42913794 | 42913813 | 42913810 | + |
| SEQ ID NO 54838 | CAAGAAAGTCTAAACAGAGC | CAG | chr17 | 42913798 | 42913817 | 42913814 | + |
| SEQ ID NO 54839 | AGTCTAAACAGAGCCAGTCA | CAG | chr17 | 42913804 | 42913823 | 42913820 | + |
| SEQ ID NO 54840 | ACAGAGCCAGTCACAGCACC | AAG | chr17 | 42913811 | 42913830 | 42913827 | + |
| SEQ ID NO 54841 | CAGAGCCAGTCACAGCACCA | AGG | chr17 | 42913812 | 42913831 | 42913828 | + |
| SEQ ID NO 54842 | CACAGCACCAAGGAATGCTC | AAG | chr17 | 42913822 | 42913841 | 42913838 | + |
| SEQ ID NO 54843 | ACAGCACCAAGGAATGCTCA | AGG | chr17 | 42913823 | 42913842 | 42913839 | + |
| SEQ ID NO 54844 | CAGCACCAAGGAATGCTCAA | GGG | chr17 | 42913824 | 42913843 | 42913840 | + |
| SEQ ID NO 54845 | GCACCAAGGAATGCTCAAGG | GAG | chr17 | 42913826 | 42913845 | 42913842 | + |
| SEQ ID NO 54846 | AATGCTCAAGGGAGCTATTG | CAG | chr17 | 42913835 | 42913854 | 42913851 | + |
| SEQ ID NO 54847 | ATGCTCAAGGGAGCTATTGC | AGG | chr17 | 42913836 | 42913855 | 42913852 | + |
| SEQ ID NO 54848 | CTATTGCAGGTTTCTCTGCT | AAG | chr17 | 42913849 | 42913868 | 42913865 | + |
| SEQ ID NO 54849 | ATTGCAGGTTTCTCTGCTAA | GAG | chr17 | 42913851 | 42913870 | 42913867 | + |
| SEQ ID NO 54850 | CTAAGAGATTTATTTCATCC | TGG | chr17 | 42913867 | 42913886 | 42913883 | + |
| SEQ ID NO 54851 | TAAGAGATTTATTTCATCCT | GGG | chr17 | 42913868 | 42913887 | 42913884 | + |
| SEQ ID NO 54852 | GATTTATTTCATCCTGGGTG | CAG | chr17 | 42913873 | 42913892 | 42913889 | + |
| SEQ ID NO 54853 | ATTTATTTCATCCTGGGTGC | AGG | chr17 | 42913874 | 42913893 | 42913890 | + |
| SEQ ID NO 54854 | TTTATTTCATCCTGGGTGCA | GGG | chr17 | 42913875 | 42913894 | 42913891 | + |
| SEQ ID NO 54855 | GGTGCAGGGTTCGACCTCCA | AAG | chr17 | 42913889 | 42913908 | 42913905 | + |
| SEQ ID NO 54856 | GTGCAGGGTTCGACCTCCAA | AGG | chr17 | 42913890 | 42913909 | 42913906 | + |
| SEQ ID NO 54857 | TCAAATCATCACCGTATCAA | TGG | chr17 | 42913915 | 42913934 | 42913931 | + |

Figure 85 (Cont'd)

| | | | | | | | |
|---|---|---|---|---|---|---|---|
| SEQ ID NO 54858 | ACCGTATCAATGGATTTCCT | GAG | chr17 | 42913925 | 42913944 | 42913941 | + |
| SEQ ID NO 54859 | CCGTATCAATGGATTTCCTG | AGG | chr17 | 42913926 | 42913945 | 42913942 | + |
| SEQ ID NO 54860 | CGTATCAATGGATTTCCTGA | GGG | chr17 | 42913927 | 42913946 | 42913943 | + |
| SEQ ID NO 54861 | TCAATGGATTTCCTGAGGGT | AAG | chr17 | 42913931 | 42913950 | 42913947 | + |
| SEQ ID NO 54862 | GCTATTTCACACCTGAACTC | CGG | chr17 | 42913958 | 42913977 | 42913974 | + |
| SEQ ID NO 54863 | TATTTCACACCTGAACTCCG | GAG | chr17 | 42913960 | 42913979 | 42913976 | + |
| SEQ ID NO 54864 | AACTCCGGAGTCTGTATATT | CAG | chr17 | 42913973 | 42913992 | 42913989 | + |
| SEQ ID NO 54865 | ACTCCGGAGTCTGTATATTC | AGG | chr17 | 42913974 | 42913993 | 42913990 | + |
| SEQ ID NO 54866 | CTCCGGAGTCTGTATATTCA | GGG | chr17 | 42913975 | 42913994 | 42913991 | + |
| SEQ ID NO 54867 | CGGAGTCTGTATATTCAGGG | AAG | chr17 | 42913978 | 42913997 | 42913994 | + |
| SEQ ID NO 54868 | GGAAGATTGCATTCTCCTAC | TGG | chr17 | 42913996 | 42914015 | 42914012 | + |
| SEQ ID NO 54869 | TTGCATTCTCCTACTGGATT | TGG | chr17 | 42914002 | 42914021 | 42914018 | + |
| SEQ ID NO 54870 | TGCATTCTCCTACTGGATTT | GGG | chr17 | 42914003 | 42914022 | 42914019 | + |
| SEQ ID NO 54871 | TCCTACTGGATTTGGGCTCT | CAG | chr17 | 42914010 | 42914029 | 42914026 | + |
| SEQ ID NO 54872 | CTACTGGATTTGGGCTCTCA | GAG | chr17 | 42914012 | 42914031 | 42914028 | + |
| SEQ ID NO 54873 | TACTGGATTTGGGCTCTCAG | AGG | chr17 | 42914013 | 42914032 | 42914029 | + |
| SEQ ID NO 54874 | ACTGGATTTGGGCTCTCAGA | GGG | chr17 | 42914014 | 42914033 | 42914030 | + |
| SEQ ID NO 54875 | TGGGCTCTCAGAGGGCGTTG | TGG | chr17 | 42914022 | 42914041 | 42914038 | + |
| SEQ ID NO 54876 | GGGCTCTCAGAGGGCGTTGT | GGG | chr17 | 42914023 | 42914042 | 42914039 | + |
| SEQ ID NO 54877 | TCAGAGGGCGTTGTGGGAAC | CAG | chr17 | 42914029 | 42914048 | 42914045 | + |
| SEQ ID NO 54878 | CAGAGGGCGTTGTGGGAACC | AGG | chr17 | 42914030 | 42914049 | 42914046 | + |
| SEQ ID NO 54879 | TGTGGGAACCAGGCCCCTCA | CAG | chr17 | 42914040 | 42914059 | 42914056 | + |
| SEQ ID NO 54880 | AGGCCCCTCACAGAATCAAA | TGG | chr17 | 42914050 | 42914069 | 42914066 | + |
| SEQ ID NO 54881 | CAGAATCAAATGGTCCCAAC | CAG | chr17 | 42914060 | 42914079 | 42914076 | + |
| SEQ ID NO 54882 | AGAATCAAATGGTCCCAACC | AGG | chr17 | 42914061 | 42914080 | 42914077 | + |
| SEQ ID NO 54883 | GAATCAAATGGTCCCAACCA | GGG | chr17 | 42914062 | 42914081 | 42914078 | + |
| SEQ ID NO 54884 | ATCAAATGGTCCCAACCAGG | GAG | chr17 | 42914064 | 42914083 | 42914080 | + |
| SEQ ID NO 54885 | AATGGTCCCAACCAGGGAGA | AAG | chr17 | 42914068 | 42914087 | 42914084 | + |
| SEQ ID NO 54886 | CCAACCAGGGAGAAAGAAAA | TAG | chr17 | 42914075 | 42914094 | 42914091 | + |
| SEQ ID NO 54887 | AGTCTTTTTTTTTTTTTTAA | TAG | chr17 | 42914096 | 42914115 | 42914112 | + |
| SEQ ID NO 54888 | TCTTTTTTTTTTTTTTAATA | GAG | chr17 | 42914098 | 42914117 | 42914114 | + |
| SEQ ID NO 54889 | TTTTTTTTTTTTAATAGAGA | TGG | chr17 | 42914102 | 42914121 | 42914118 | + |
| SEQ ID NO 54890 | TTTTTTTTTTTAATAGAGAT | GGG | chr17 | 42914103 | 42914122 | 42914119 | + |
| SEQ ID NO 54891 | TTTTTTTTTTAATAGAGATG | GGG | chr17 | 42914104 | 42914123 | 42914120 | + |
| SEQ ID NO 54892 | TTTTTTTTTAATAGAGATGG | GGG | chr17 | 42914105 | 42914124 | 42914121 | + |
| SEQ ID NO 54893 | GGGGGTCTCACTATGCTGCC | CAG | chr17 | 42914123 | 42914142 | 42914139 | + |
| SEQ ID NO 54894 | GGGGTCTCACTATGCTGCCC | AGG | chr17 | 42914124 | 42914143 | 42914140 | + |
| SEQ ID NO 54895 | TCTCACTATGCTGCCCAGGC | TGG | chr17 | 42914128 | 42914147 | 42914144 | + |
| SEQ ID NO 54896 | CCAGGCTGGTCTTGAACTCC | TGG | chr17 | 42914142 | 42914161 | 42914158 | + |
| SEQ ID NO 54897 | CAGGCTGGTCTTGAACTCCT | GGG | chr17 | 42914143 | 42914162 | 42914159 | + |
| SEQ ID NO 54898 | GGTCTTGAACTCCTGGGTTC | AAG | chr17 | 42914149 | 42914168 | 42914165 | + |
| SEQ ID NO 54899 | TTCAAGTGATCCTCCTGCCT | CAG | chr17 | 42914166 | 42914185 | 42914182 | + |
| SEQ ID NO 54900 | CCTCCTGCCTCAGCCTCCCA | AAG | chr17 | 42914176 | 42914195 | 42914192 | + |
| SEQ ID NO 54901 | GCCTCAGCCTCCCAAAGTGC | TGG | chr17 | 42914182 | 42914201 | 42914198 | + |
| SEQ ID NO 54902 | CCTCAGCCTCCCAAAGTGCT | GGG | chr17 | 42914183 | 42914202 | 42914199 | + |
| SEQ ID NO 54903 | CTCCCAAAGTGCTGGGATTA | CAG | chr17 | 42914190 | 42914209 | 42914206 | + |
| SEQ ID NO 54904 | AAGTGCTGGGATTACAGTGT | GAG | chr17 | 42914196 | 42914215 | 42914212 | + |

Figure 85 (Cont'd)

| | | | | | | | |
|---|---|---|---|---|---|---|---|
| SEQ ID NO 54905 | ACAGTGTGAGCCACTGCGCT | TGG | chr17 | 42914209 | 42914228 | 42914225 | + |
| SEQ ID NO 54906 | TGTGAGCCACTGCGCTTGGC | CAG | chr17 | 42914213 | 42914232 | 42914229 | + |
| SEQ ID NO 54907 | CCACTGCGCTTGGCCAGAAA | TGG | chr17 | 42914219 | 42914238 | 42914235 | + |
| SEQ ID NO 54908 | CTGAACTGAACCCTACTGCT | TAG | chr17 | 42914253 | 42914272 | 42914269 | + |
| SEQ ID NO 54909 | TGAACTGAACCCTACTGCTT | AGG | chr17 | 42914254 | 42914273 | 42914270 | + |
| SEQ ID NO 54910 | TGAACCCTACTGCTTAGGCA | TAG | chr17 | 42914259 | 42914278 | 42914275 | + |
| SEQ ID NO 54911 | TTGATAATCTATTTGCTCCC | AAG | chr17 | 42914290 | 42914309 | 42914306 | + |
| SEQ ID NO 54912 | TGATAATCTATTTGCTCCCA | AGG | chr17 | 42914291 | 42914310 | 42914307 | + |
| SEQ ID NO 54913 | TCTATTTGCTCCCAAGGACC | AAG | chr17 | 42914297 | 42914316 | 42914313 | + |
| SEQ ID NO 54914 | TGCTCCCAAGGACCAAGTCC | AAG | chr17 | 42914303 | 42914322 | 42914319 | + |
| SEQ ID NO 54915 | ACCAAGTCCAAGATCCTTAC | AAG | chr17 | 42914314 | 42914333 | 42914330 | + |
| SEQ ID NO 54916 | AGTCCAAGATCCTTACAAGA | AAG | chr17 | 42914318 | 42914337 | 42914334 | + |
| SEQ ID NO 54917 | GTCCAAGATCCTTACAAGAA | AGG | chr17 | 42914319 | 42914338 | 42914335 | + |
| SEQ ID NO 54918 | TCCTTACAAGAAAGGTCTGC | CAG | chr17 | 42914327 | 42914346 | 42914343 | + |
| SEQ ID NO 54919 | TACAAGAAAGGTCTGCCAGA | AAG | chr17 | 42914331 | 42914350 | 42914347 | + |
| SEQ ID NO 54920 | AATACTGCCCCACTCCCTG | AAG | chr17 | 42914356 | 42914375 | 42914372 | + |
| SEQ ID NO 54921 | CCCCACTCCCTGAAGTTTAT | GAG | chr17 | 42914364 | 42914383 | 42914380 | + |
| SEQ ID NO 54922 | CCCACTCCCTGAAGTTTATG | AGG | chr17 | 42914365 | 42914384 | 42914381 | + |
| SEQ ID NO 54923 | CTGAAGTTTATGAGGTTGAT | AAG | chr17 | 42914373 | 42914392 | 42914389 | + |
| SEQ ID NO 54924 | AGGTTGATAAGAAAACATAA | CAG | chr17 | 42914385 | 42914404 | 42914401 | + |
| SEQ ID NO 54925 | ATAAGAAAACATAACAGATA | AAG | chr17 | 42914391 | 42914410 | 42914407 | + |
| SEQ ID NO 54926 | CATAACAGATAAAGTTTATT | GAG | chr17 | 42914400 | 42914419 | 42914416 | + |
| SEQ ID NO 54927 | ATTGAGTGCTAACTTTATGC | CAG | chr17 | 42914417 | 42914436 | 42914433 | + |
| SEQ ID NO 54928 | ATTTATACAATTAACTCGCT | TAG | chr17 | 42914459 | 42914478 | 42914475 | + |
| SEQ ID NO 54929 | AGTTCTCCCAACATCTCTGT | GAG | chr17 | 42914480 | 42914499 | 42914496 | + |
| SEQ ID NO 54930 | CTCCCAACATCTCTGTGAGT | TGG | chr17 | 42914484 | 42914503 | 42914500 | + |
| SEQ ID NO 54931 | ATTTATCCTTATATTACAAA | TAG | chr17 | 42914515 | 42914534 | 42914531 | + |
| SEQ ID NO 54932 | TTTATCCTTATATTACAAAT | AGG | chr17 | 42914516 | 42914535 | 42914532 | + |
| SEQ ID NO 54933 | CCTTATATTACAAATAGGTC | CAG | chr17 | 42914521 | 42914540 | 42914537 | + |
| SEQ ID NO 54934 | TTATATTACAAATAGGTCCA | GAG | chr17 | 42914523 | 42914542 | 42914539 | + |
| SEQ ID NO 54935 | TATATTACAAATAGGTCCAG | AGG | chr17 | 42914524 | 42914543 | 42914540 | + |
| SEQ ID NO 54936 | ATATTACAAATAGGTCCAGA | GGG | chr17 | 42914525 | 42914544 | 42914541 | + |
| SEQ ID NO 54937 | TATTACAAATAGGTCCAGAG | GGG | chr17 | 42914526 | 42914545 | 42914542 | + |
| SEQ ID NO 54938 | ACAAATAGGTCCAGAGGGGT | TAG | chr17 | 42914530 | 42914549 | 42914546 | + |
| SEQ ID NO 54939 | GAGGGGTTAGTCATCTTGTC | CAG | chr17 | 42914543 | 42914562 | 42914559 | + |
| SEQ ID NO 54940 | GTTAGTCATCTTGTCCAGAA | TGG | chr17 | 42914548 | 42914567 | 42914564 | + |
| SEQ ID NO 54941 | AGTCATCTTGTCCAGAATGG | TGG | chr17 | 42914551 | 42914570 | 42914567 | + |
| SEQ ID NO 54942 | CTTGTCCAGAATGGTGGAAC | CAG | chr17 | 42914557 | 42914576 | 42914573 | + |
| SEQ ID NO 54943 | TTGTCCAGAATGGTGGAACC | AGG | chr17 | 42914558 | 42914577 | 42914574 | + |
| SEQ ID NO 54944 | CAGAATGGTGGAACCAGGTT | AAG | chr17 | 42914563 | 42914582 | 42914579 | + |
| SEQ ID NO 54945 | AGAATGGTGGAACCAGGTTA | AGG | chr17 | 42914564 | 42914583 | 42914580 | + |
| SEQ ID NO 54946 | GGTGGAACCAGGTTAAGGAT | CAG | chr17 | 42914569 | 42914588 | 42914585 | + |
| SEQ ID NO 54947 | GTGGAACCAGGTTAAGGATC | AGG | chr17 | 42914570 | 42914589 | 42914586 | + |
| SEQ ID NO 54948 | GAACCAGGTTAAGGATCAGG | CAG | chr17 | 42914573 | 42914592 | 42914589 | + |
| SEQ ID NO 54949 | AGGTTAAGGATCAGGCAGTC | TGG | chr17 | 42914578 | 42914597 | 42914594 | + |
| SEQ ID NO 54950 | GGTTAAGGATCAGGCAGTCT | GGG | chr17 | 42914579 | 42914598 | 42914595 | + |
| SEQ ID NO 54951 | AAGGATCAGGCAGTCTGGGC | TGG | chr17 | 42914583 | 42914602 | 42914599 | + |

Figure 85 (Cont'd)

| SEQ ID NO 54952 | AGGATCAGGCAGTCTGGGCT | GGG | chr17 | 42914584 | 42914603 | 42914600 | + |
| SEQ ID NO 54953 | CAGGCAGTCTGGGCTGGGCA | TGG | chr17 | 42914589 | 42914608 | 42914605 | + |
| SEQ ID NO 54954 | GCAGTCTGGGCTGGGCATGG | TGG | chr17 | 42914592 | 42914611 | 42914608 | + |
| SEQ ID NO 54955 | GTGGCTCACATCTGTAATCC | CAG | chr17 | 42914611 | 42914630 | 42914627 | + |
| SEQ ID NO 54956 | CATCTGTAATCCCAGCACTT | TGG | chr17 | 42914619 | 42914638 | 42914635 | + |
| SEQ ID NO 54957 | ATCTGTAATCCCAGCACTTT | GGG | chr17 | 42914620 | 42914639 | 42914636 | + |
| SEQ ID NO 54958 | CTGTAATCCCAGCACTTTGG | GAG | chr17 | 42914622 | 42914641 | 42914638 | + |
| SEQ ID NO 54959 | TGTAATCCCAGCACTTTGGG | AGG | chr17 | 42914623 | 42914642 | 42914639 | + |
| SEQ ID NO 54960 | TCCCAGCACTTTGGGAGGCT | GAG | chr17 | 42914628 | 42914647 | 42914644 | + |
| SEQ ID NO 54961 | CCCAGCACTTTGGGAGGCTG | AGG | chr17 | 42914629 | 42914648 | 42914645 | + |
| SEQ ID NO 54962 | AGCACTTTGGGAGGCTGAGG | TGG | chr17 | 42914632 | 42914651 | 42914648 | + |
| SEQ ID NO 54963 | ACTTTGGGAGGCTGAGGTGG | CAG | chr17 | 42914635 | 42914654 | 42914651 | + |
| SEQ ID NO 54964 | GCTGAGGTGGCAGATTGCCT | GAG | chr17 | 42914645 | 42914664 | 42914661 | + |
| SEQ ID NO 54965 | GGTGGCAGATTGCCTGAGCT | CAG | chr17 | 42914650 | 42914669 | 42914666 | + |
| SEQ ID NO 54966 | GTGGCAGATTGCCTGAGCTC | AGG | chr17 | 42914651 | 42914670 | 42914667 | + |
| SEQ ID NO 54967 | GGCAGATTGCCTGAGCTCAG | GAG | chr17 | 42914653 | 42914672 | 42914669 | + |
| SEQ ID NO 54968 | TTGCCTGAGCTCAGGAGTTC | GAG | chr17 | 42914659 | 42914678 | 42914675 | + |
| SEQ ID NO 54969 | TGAGCTCAGGAGTTCGAGAC | CAG | chr17 | 42914664 | 42914683 | 42914680 | + |
| SEQ ID NO 54970 | TCAGGAGTTCGAGACCAGCC | TGG | chr17 | 42914669 | 42914688 | 42914685 | + |
| SEQ ID NO 54971 | CAGGAGTTCGAGACCAGCCT | GGG | chr17 | 42914670 | 42914689 | 42914686 | + |
| SEQ ID NO 54972 | CGAGACCAGCCTGGGCAACA | TGG | chr17 | 42914678 | 42914697 | 42914694 | + |
| SEQ ID NO 54973 | ACCAGCCTGGGCAACATGGT | GAG | chr17 | 42914682 | 42914701 | 42914698 | + |
| SEQ ID NO 54974 | ATACCAAAATACAAAACAT | TAG | chr17 | 42914715 | 42914734 | 42914731 | + |
| SEQ ID NO 54975 | AAAAATACAAAACATTAGCC | AAG | chr17 | 42914720 | 42914739 | 42914736 | + |
| SEQ ID NO 54976 | TACAAAACATTAGCCAAGCG | TGG | chr17 | 42914725 | 42914744 | 42914741 | + |
| SEQ ID NO 54977 | AAAACATTAGCCAAGCGTGG | TGG | chr17 | 42914728 | 42914747 | 42914744 | + |
| SEQ ID NO 54978 | AGCGTGGTGGTGCATGCCTG | TGG | chr17 | 42914741 | 42914760 | 42914757 | + |
| SEQ ID NO 54979 | TGCCTGTGGTCCTAACTACT | CAG | chr17 | 42914755 | 42914774 | 42914771 | + |
| SEQ ID NO 54980 | GCCTGTGGTCCTAACTACTC | AGG | chr17 | 42914756 | 42914775 | 42914772 | + |
| SEQ ID NO 54981 | TGTGGTCCTAACTACTCAGG | TGG | chr17 | 42914759 | 42914778 | 42914775 | + |
| SEQ ID NO 54982 | TCCTAACTACTCAGGTGGCT | GAG | chr17 | 42914764 | 42914783 | 42914780 | + |
| SEQ ID NO 54983 | CCTAACTACTCAGGTGGCTG | AGG | chr17 | 42914765 | 42914784 | 42914781 | + |
| SEQ ID NO 54984 | AACTACTCAGGTGGCTGAGG | TGG | chr17 | 42914768 | 42914787 | 42914784 | + |
| SEQ ID NO 54985 | ACTACTCAGGTGGCTGAGGT | GGG | chr17 | 42914769 | 42914788 | 42914785 | + |
| SEQ ID NO 54986 | TACTCAGGTGGCTGAGGTGG | GAG | chr17 | 42914771 | 42914790 | 42914787 | + |
| SEQ ID NO 54987 | CTGAGGTGGGAGAATCCCTT | GAG | chr17 | 42914782 | 42914801 | 42914798 | + |
| SEQ ID NO 54988 | GTGGGAGAATCCCTTGAGCT | CAG | chr17 | 42914787 | 42914806 | 42914803 | + |
| SEQ ID NO 54989 | GGGAGAATCCCTTGAGCTCA | GAG | chr17 | 42914789 | 42914808 | 42914805 | + |
| SEQ ID NO 54990 | GGAGAATCCCTTGAGCTCAG | AGG | chr17 | 42914790 | 42914809 | 42914806 | + |
| SEQ ID NO 54991 | TCCCTTGAGCTCAGAGGTTG | CAG | chr17 | 42914796 | 42914815 | 42914812 | + |
| SEQ ID NO 54992 | TTGAGCTCAGAGGTTGCAGT | GAG | chr17 | 42914800 | 42914819 | 42914816 | + |
| SEQ ID NO 54993 | CTCAGAGGTTGCAGTGAGCC | AAG | chr17 | 42914805 | 42914824 | 42914821 | + |
| SEQ ID NO 54994 | AAGATTATGCCACTGCACTC | CAG | chr17 | 42914825 | 42914844 | 42914841 | + |
| SEQ ID NO 54995 | TATGCCACTGCACTCCAGCC | TGG | chr17 | 42914830 | 42914849 | 42914846 | + |
| SEQ ID NO 54996 | ATGCCACTGCACTCCAGCCT | GGG | chr17 | 42914831 | 42914850 | 42914847 | + |
| SEQ ID NO 54997 | CTGCACTCCAGCCTGGGTGA | CAG | chr17 | 42914837 | 42914856 | 42914853 | + |
| SEQ ID NO 54998 | GCACTCCAGCCTGGGTGACA | GAG | chr17 | 42914839 | 42914858 | 42914855 | + |

Figure 85 (Cont'd)

| | | | | | | | |
|---|---|---|---|---|---|---|---|
| SEQ ID NO 54999 | TCCAGCCTGGGTGACAGAGT | GAG | chr17 | 42914843 | 42914862 | 42914859 | + |
| SEQ ID NO 55000 | GACAGAGTGAGACCCTGTCT | CAG | chr17 | 42914855 | 42914874 | 42914871 | + |
| SEQ ID NO 55001 | TCTCAGAAAAAAAAAAAAAA | AAG | chr17 | 42914872 | 42914891 | 42914888 | + |
| SEQ ID NO 55002 | CAGAAAAAAAAAAAAAAAAG | AAG | chr17 | 42914875 | 42914894 | 42914891 | + |
| SEQ ID NO 55003 | AAAAAAAAAAAAAAAGAAGC | AAG | chr17 | 42914879 | 42914898 | 42914895 | + |
| SEQ ID NO 55004 | AAAAAAAAAAAGAAGCAAG | CAG | chr17 | 42914882 | 42914901 | 42914898 | + |
| SEQ ID NO 55005 | AAAAAAGAAGCAAGCAGTC | TGG | chr17 | 42914887 | 42914906 | 42914903 | + |
| SEQ ID NO 55006 | AAAAAGAAGCAAGCAGTCT | GGG | chr17 | 42914888 | 42914907 | 42914904 | + |
| SEQ ID NO 55007 | AGAAGCAAGCAGTCTGGGC | TGG | chr17 | 42914892 | 42914911 | 42914908 | + |
| SEQ ID NO 55008 | AGAAGCAAGCAGTCTGGGCT | GGG | chr17 | 42914893 | 42914912 | 42914909 | + |
| SEQ ID NO 55009 | GCAGTCTGGGCTGGGTGCTG | TGG | chr17 | 42914901 | 42914920 | 42914917 | + |
| SEQ ID NO 55010 | GTGGCTCGCGCCTGTAATCC | CAG | chr17 | 42914920 | 42914939 | 42914936 | + |
| SEQ ID NO 55011 | TTGTAATATATCCTGCTTAT | TAG | chr17 | 42914959 | 42914978 | 42914975 | + |
| SEQ ID NO 55012 | AATATATCCTGCTTATTAGA | CAG | chr17 | 42914963 | 42914982 | 42914979 | + |
| SEQ ID NO 55013 | TGATCACTCATCTGTTCCCT | AAG | chr17 | 42914993 | 42915012 | 42915009 | + |
| SEQ ID NO 55014 | CTCATCTGTTCCCTAAGTTA | TAG | chr17 | 42914999 | 42915018 | 42915015 | + |
| SEQ ID NO 55015 | TTATAGATTTACGTCCACTT | TAG | chr17 | 42915016 | 42915035 | 42915032 | + |
| SEQ ID NO 55016 | ATTTACGTCCACTTTAGAAA | TGG | chr17 | 42915022 | 42915041 | 42915038 | + |
| SEQ ID NO 55017 | CCACTTTAGAAATGGCTTGT | GAG | chr17 | 42915030 | 42915049 | 42915046 | + |
| SEQ ID NO 55018 | CACTTTAGAAATGGCTTGTG | AGG | chr17 | 42915031 | 42915050 | 42915047 | + |
| SEQ ID NO 55019 | TTAGAAATGGCTTGTGAGGC | AAG | chr17 | 42915035 | 42915054 | 42915051 | + |
| SEQ ID NO 55020 | ATGGCTTGTGAGGCAAGTTT | AAG | chr17 | 42915041 | 42915060 | 42915057 | + |
| SEQ ID NO 55021 | CAAGTTTAAGTGACCGATGA | CAG | chr17 | 42915054 | 42915073 | 42915070 | + |
| SEQ ID NO 55022 | AGTGACCGATGACAGTTTTA | AAG | chr17 | 42915062 | 42915081 | 42915078 | + |
| SEQ ID NO 55023 | ACCGATGACAGTTTTAAAGC | AAG | chr17 | 42915066 | 42915085 | 42915082 | + |
| SEQ ID NO 55024 | CCGATGACAGTTTTAAAGCA | AGG | chr17 | 42915067 | 42915086 | 42915083 | + |
| SEQ ID NO 55025 | GCAAGGTCCATGTCATGTTA | TGG | chr17 | 42915084 | 42915103 | 42915100 | + |
| SEQ ID NO 55026 | TGTCATGTTATGGCATAATT | TGG | chr17 | 42915094 | 42915113 | 42915110 | + |
| SEQ ID NO 55027 | CATGTTATGGCATAATTTGG | TAG | chr17 | 42915097 | 42915116 | 42915113 | + |
| SEQ ID NO 55028 | CATAATTTGGTAGAATGTTC | TAG | chr17 | 42915107 | 42915126 | 42915123 | + |
| SEQ ID NO 55029 | AATTTGGTAGAATGTTCTAG | TAG | chr17 | 42915110 | 42915129 | 42915126 | + |
| SEQ ID NO 55030 | AGAATGTTCTAGTAGTGTAT | CAG | chr17 | 42915118 | 42915137 | 42915134 | + |
| SEQ ID NO 55031 | TCTAGTAGTGTATCAGTTTT | CAG | chr17 | 42915125 | 42915144 | 42915141 | + |
| SEQ ID NO 55032 | CTAGTAGTGTATCAGTTTTC | AGG | chr17 | 42915126 | 42915145 | 42915142 | + |
| SEQ ID NO 55033 | GTAGTGTATCAGTTTTCAGG | TGG | chr17 | 42915129 | 42915148 | 42915145 | + |
| SEQ ID NO 55034 | GTGTATCAGTTTTCAGGTGG | TAG | chr17 | 42915132 | 42915151 | 42915148 | + |
| SEQ ID NO 55035 | TGTATCAGTTTTCAGGTGGT | AGG | chr17 | 42915133 | 42915152 | 42915149 | + |
| SEQ ID NO 55036 | AGTTTTCAGGTGGTAGGCTT | GAG | chr17 | 42915139 | 42915158 | 42915155 | + |
| SEQ ID NO 55037 | GTTTTCAGGTGGTAGGCTTG | AGG | chr17 | 42915140 | 42915159 | 42915156 | + |
| SEQ ID NO 55038 | TGCAATTCTATTATTGCCCA | AAG | chr17 | 42915188 | 42915207 | 42915204 | + |
| SEQ ID NO 55039 | CTATTATTGCCCAAAGAAAA | TAG | chr17 | 42915195 | 42915214 | 42915211 | + |
| SEQ ID NO 55040 | CCAAAGAAAATAGACCCATT | AAG | chr17 | 42915205 | 42915224 | 42915221 | + |
| SEQ ID NO 55041 | CAAAGAAAATAGACCCATTA | AGG | chr17 | 42915206 | 42915225 | 42915222 | + |
| SEQ ID NO 55042 | AGAAAATAGACCCATTAAGG | AAG | chr17 | 42915209 | 42915228 | 42915225 | + |
| SEQ ID NO 55043 | GAAGTCCAACTTCTGCTGCG | TGG | chr17 | 42915228 | 42915247 | 42915244 | + |
| SEQ ID NO 55044 | CCAACTTCTGCTGCGTGGAC | CAG | chr17 | 42915233 | 42915252 | 42915249 | + |
| SEQ ID NO 55045 | CAGTGCTGCCACATCACACA | TAG | chr17 | 42915253 | 42915272 | 42915269 | + |

Figure 85 (Cont'd)

| SEQ ID NO 55046 | GCCACATCACACATAGACCA | AAG | chr17 | 42915260 | 42915279 | 42915276 | + |
| SEQ ID NO 55047 | CCACATCACACATAGACCAA | AGG | chr17 | 42915261 | 42915280 | 42915277 | + |
| SEQ ID NO 55048 | TCACACATAGACCAAAGGCT | TAG | chr17 | 42915266 | 42915285 | 42915282 | + |
| SEQ ID NO 55049 | CACACATAGACCAAAGGCTT | AGG | chr17 | 42915267 | 42915286 | 42915283 | + |
| SEQ ID NO 55050 | ACCAAAGGCTTAGGTTTTTG | TGG | chr17 | 42915276 | 42915295 | 42915292 | + |
| SEQ ID NO 55051 | GGCTTAGGTTTTTGTGGTTT | TGG | chr17 | 42915282 | 42915301 | 42915298 | + |
| SEQ ID NO 55052 | TTTATTTTATTTTATTATTT | GAG | chr17 | 42915346 | 42915365 | 42915362 | + |
| SEQ ID NO 55053 | TTTTATTTTATTATTTGAGA | TGG | chr17 | 42915350 | 42915369 | 42915366 | + |
| SEQ ID NO 55054 | TTATTTTATTATTTGAGATG | GAG | chr17 | 42915352 | 42915371 | 42915368 | + |
| SEQ ID NO 55055 | TGGAGTCTCACTCTGTCACC | CAG | chr17 | 42915370 | 42915389 | 42915386 | + |
| SEQ ID NO 55056 | GGAGTCTCACTCTGTCACCC | AGG | chr17 | 42915371 | 42915390 | 42915387 | + |
| SEQ ID NO 55057 | TCTCACTCTGTCACCCAGGC | TGG | chr17 | 42915375 | 42915394 | 42915391 | + |
| SEQ ID NO 55058 | CTCACTCTGTCACCCAGGCT | GGG | chr17 | 42915376 | 42915395 | 42915392 | + |
| SEQ ID NO 55059 | TCACTCTGTCACCCAGGCTG | GGG | chr17 | 42915377 | 42915396 | 42915393 | + |
| SEQ ID NO 55060 | TCACCCAGGCTGGGGTGCAA | TGG | chr17 | 42915385 | 42915404 | 42915401 | + |
| SEQ ID NO 55061 | GGGGTGCAATGGCGCAATCT | CAG | chr17 | 42915396 | 42915415 | 42915412 | + |
| SEQ ID NO 55062 | TCACTGCAACCTCCAACTCC | TGG | chr17 | 42915420 | 42915439 | 42915436 | + |
| SEQ ID NO 55063 | CACTGCAACCTCCAACTCCT | GGG | chr17 | 42915421 | 42915440 | 42915437 | + |
| SEQ ID NO 55064 | ACTGCAACCTCCAACTCCTG | GGG | chr17 | 42915422 | 42915441 | 42915438 | + |
| SEQ ID NO 55065 | CTGGGGCTCAAATGATCCTC | CAG | chr17 | 42915439 | 42915458 | 42915455 | + |
| SEQ ID NO 55066 | CTCAAATGATCCTCCAGCCT | CAG | chr17 | 42915445 | 42915464 | 42915461 | + |
| SEQ ID NO 55067 | TCCAGCCTCAGCCTCCCGAA | TAG | chr17 | 42915457 | 42915476 | 42915473 | + |
| SEQ ID NO 55068 | GCCTCAGCCTCCCGAATAGC | TGG | chr17 | 42915461 | 42915480 | 42915477 | + |
| SEQ ID NO 55069 | CCTCAGCCTCCCGAATAGCT | GGG | chr17 | 42915462 | 42915481 | 42915478 | + |
| SEQ ID NO 55070 | CTCCCGAATAGCTGGGACTA | CAG | chr17 | 42915469 | 42915488 | 42915485 | + |
| SEQ ID NO 55071 | CAGATGCGTACCACCATGCC | TGG | chr17 | 42915489 | 42915508 | 42915505 | + |
| SEQ ID NO 55072 | GCTAATTTTTTATTTTTTG | TAG | chr17 | 42915511 | 42915530 | 42915527 | + |
| SEQ ID NO 55073 | TAATTTTTTATTTTTTGTA | GAG | chr17 | 42915513 | 42915532 | 42915529 | + |
| SEQ ID NO 55074 | TTTTTTATTTTTTGTAGAGA | CAG | chr17 | 42915517 | 42915536 | 42915533 | + |
| SEQ ID NO 55075 | TTTTTATTTTTTGTAGAGAC | AGG | chr17 | 42915518 | 42915537 | 42915534 | + |
| SEQ ID NO 55076 | TTTTATTTTTTGTAGAGACA | GGG | chr17 | 42915519 | 42915538 | 42915535 | + |
| SEQ ID NO 55077 | TTTTGTAGAGACAGGGTCTC | AAG | chr17 | 42915526 | 42915545 | 42915542 | + |
| SEQ ID NO 55078 | TCTCAAGCATCCTCCCGCCT | TAG | chr17 | 42915542 | 42915561 | 42915558 | + |
| SEQ ID NO 55079 | CCTCCCGCCTTAGCCTCCCA | AAG | chr17 | 42915552 | 42915571 | 42915568 | + |
| SEQ ID NO 55080 | GCCTTAGCCTCCCAAAGTGC | TGG | chr17 | 42915558 | 42915577 | 42915574 | + |
| SEQ ID NO 55081 | CCTTAGCCTCCCAAAGTGCT | GGG | chr17 | 42915559 | 42915578 | 42915575 | + |
| SEQ ID NO 55082 | CTCCCAAAGTGCTGGGATAA | CAG | chr17 | 42915566 | 42915585 | 42915582 | + |
| SEQ ID NO 55083 | TCCCAAAGTGCTGGGATAAC | AGG | chr17 | 42915567 | 42915586 | 42915583 | + |
| SEQ ID NO 55084 | AGTGCTGGGATAACAGGCAT | GAG | chr17 | 42915573 | 42915592 | 42915589 | + |
| SEQ ID NO 55085 | CAGGCATGAGCTGCTGCACT | CAG | chr17 | 42915586 | 42915605 | 42915602 | + |
| SEQ ID NO 55086 | CCTTAAAAAAATGTATAAC | AAG | chr17 | 42915641 | 42915660 | 42915657 | + |
| SEQ ID NO 55087 | CTTAAAAAAATGTATAACA | AGG | chr17 | 42915642 | 42915661 | 42915658 | + |
| SEQ ID NO 55088 | AAAAAATGTATAACAAGGC | CGG | chr17 | 42915646 | 42915665 | 42915662 | + |
| SEQ ID NO 55089 | AAAAATGTATAACAAGGCC | GGG | chr17 | 42915647 | 42915666 | 42915663 | + |
| SEQ ID NO 55090 | ATGTATAACAAGGCCGGGCA | CGG | chr17 | 42915652 | 42915671 | 42915668 | + |
| SEQ ID NO 55091 | TATAACAAGGCCGGGCACGG | TGG | chr17 | 42915655 | 42915674 | 42915671 | + |
| SEQ ID NO 55092 | GTGGCTCATGCCTGTAATCC | CAG | chr17 | 42915674 | 42915693 | 42915690 | + |

Figure 85 (Cont'd)

| SEQ ID NO 55093 | TGCCTGTAATCCCAGCACTT | TGG | chr17 | 42915682 | 42915701 | 42915698 | + |
| --- | --- | --- | --- | --- | --- | --- | --- |
| SEQ ID NO 55094 | GCCTGTAATCCCAGCACTTT | GGG | chr17 | 42915683 | 42915702 | 42915699 | + |
| SEQ ID NO 55095 | TGTAATCCCAGCACTTTGGG | AAG | chr17 | 42915686 | 42915705 | 42915702 | + |
| SEQ ID NO 55096 | TCCCAGCACTTTGGGAAGCC | AAG | chr17 | 42915691 | 42915710 | 42915707 | + |
| SEQ ID NO 55097 | CCCAGCACTTTGGGAAGCCA | AGG | chr17 | 42915692 | 42915711 | 42915708 | + |
| SEQ ID NO 55098 | AGCACTTTGGGAAGCCAAGG | CAG | chr17 | 42915695 | 42915714 | 42915711 | + |
| SEQ ID NO 55099 | GCACTTTGGGAAGCCAAGGC | AGG | chr17 | 42915696 | 42915715 | 42915712 | + |
| SEQ ID NO 55100 | CTTTGGGAAGCCAAGGCAGG | CAG | chr17 | 42915699 | 42915718 | 42915715 | + |
| SEQ ID NO 55101 | CCAAGGCAGGCAGATCACCT | GAG | chr17 | 42915709 | 42915728 | 42915725 | + |
| SEQ ID NO 55102 | GCAGGCAGATCACCTGAGAT | CAG | chr17 | 42915714 | 42915733 | 42915730 | + |
| SEQ ID NO 55103 | CAGGCAGATCACCTGAGATC | AGG | chr17 | 42915715 | 42915734 | 42915731 | + |
| SEQ ID NO 55104 | GGCAGATCACCTGAGATCAG | GAG | chr17 | 42915717 | 42915736 | 42915733 | + |
| SEQ ID NO 55105 | GGAGTTCGACCTGACCAACA | TGG | chr17 | 42915736 | 42915755 | 42915752 | + |
| SEQ ID NO 55106 | CTACTAAAAATACAAAAAAT | TAG | chr17 | 42915772 | 42915791 | 42915788 | + |
| SEQ ID NO 55107 | TAAAAATACAAAAAATTAGC | CAG | chr17 | 42915776 | 42915795 | 42915792 | + |
| SEQ ID NO 55108 | TACAAAAAATTAGCCAGACG | TGG | chr17 | 42915782 | 42915801 | 42915798 | + |
| SEQ ID NO 55109 | AAAAAATTAGCCAGACGTGG | TGG | chr17 | 42915785 | 42915804 | 42915801 | + |
| SEQ ID NO 55110 | GTGGCACATGCATGTAATCC | CAG | chr17 | 42915804 | 42915823 | 42915820 | + |
| SEQ ID NO 55111 | GCATGTAATCCCAGCTACTT | GAG | chr17 | 42915813 | 42915832 | 42915829 | + |
| SEQ ID NO 55112 | ATGTAATCCCAGCTACTTGA | GAG | chr17 | 42915815 | 42915834 | 42915831 | + |
| SEQ ID NO 55113 | TGTAATCCCAGCTACTTGAG | AGG | chr17 | 42915816 | 42915835 | 42915832 | + |
| SEQ ID NO 55114 | TCCCAGCTACTTGAGAGGCT | GAG | chr17 | 42915821 | 42915840 | 42915837 | + |
| SEQ ID NO 55115 | AGCTACTTGAGAGGCTGAGA | CAG | chr17 | 42915825 | 42915844 | 42915841 | + |
| SEQ ID NO 55116 | GCTACTTGAGAGGCTGAGAC | AGG | chr17 | 42915826 | 42915845 | 42915842 | + |
| SEQ ID NO 55117 | TACTTGAGAGGCTGAGACAG | GAG | chr17 | 42915828 | 42915847 | 42915844 | + |
| SEQ ID NO 55118 | GACAGGAGAACTGCTTGAAC | CGG | chr17 | 42915843 | 42915862 | 42915859 | + |
| SEQ ID NO 55119 | ACAGGAGAACTGCTTGAACC | GGG | chr17 | 42915844 | 42915863 | 42915860 | + |
| SEQ ID NO 55120 | CAGGAGAACTGCTTGAACCG | GGG | chr17 | 42915845 | 42915864 | 42915861 | + |
| SEQ ID NO 55121 | GGAGAACTGCTTGAACCGGG | GAG | chr17 | 42915847 | 42915866 | 42915863 | + |
| SEQ ID NO 55122 | GAGAACTGCTTGAACCGGGG | AGG | chr17 | 42915848 | 42915867 | 42915864 | + |
| SEQ ID NO 55123 | AACTGCTTGAACCGGGGAGG | CAG | chr17 | 42915851 | 42915870 | 42915867 | + |
| SEQ ID NO 55124 | CTGCTTGAACCGGGGAGGCA | GAG | chr17 | 42915853 | 42915872 | 42915869 | + |
| SEQ ID NO 55125 | TGCTTGAACCGGGGAGGCAG | AGG | chr17 | 42915854 | 42915873 | 42915870 | + |
| SEQ ID NO 55126 | AACCGGGGAGGCAGAGGTTG | CAG | chr17 | 42915860 | 42915879 | 42915876 | + |
| SEQ ID NO 55127 | GGGGAGGCAGAGGTTGCAGT | GAG | chr17 | 42915864 | 42915883 | 42915880 | + |
| SEQ ID NO 55128 | GGCAGAGGTTGCAGTGAGCC | CAG | chr17 | 42915869 | 42915888 | 42915885 | + |
| SEQ ID NO 55129 | CACACCATTGCACTCCAACC | TGG | chr17 | 42915894 | 42915913 | 42915910 | + |
| SEQ ID NO 55130 | ACACCATTGCACTCCAACCT | GGG | chr17 | 42915895 | 42915914 | 42915911 | + |
| SEQ ID NO 55131 | TGCACTCCAACCTGGGCAAC | AAG | chr17 | 42915902 | 42915921 | 42915918 | + |
| SEQ ID NO 55132 | CACTCCAACCTGGGCAACAA | GAG | chr17 | 42915904 | 42915923 | 42915920 | + |
| SEQ ID NO 55133 | CTCCATCTCAAAAAAAAAAA | AAG | chr17 | 42915932 | 42915951 | 42915948 | + |
| SEQ ID NO 55134 | AAAAAAAAAAAGCTGTATAA | CAG | chr17 | 42915943 | 42915962 | 42915959 | + |
| SEQ ID NO 55135 | AAAAGCTGTATAACAGCTT | GAG | chr17 | 42915949 | 42915968 | 42915965 | + |
| SEQ ID NO 55136 | CCATACAATTCACTCATTTA | AAG | chr17 | 42915987 | 42916006 | 42916003 | + |
| SEQ ID NO 55137 | CTCATTTAAAGTGTACAATT | CAG | chr17 | 42915999 | 42916018 | 42916015 | + |
| SEQ ID NO 55138 | TCATTTAAAGTGTACAATTC | AGG | chr17 | 42916000 | 42916019 | 42916016 | + |
| SEQ ID NO 55139 | CATTTAAAGTGTACAATTCA | GGG | chr17 | 42916001 | 42916020 | 42916017 | + |

Figure 85 (Cont'd)

| SEQ ID NO 55140 | ATTTAAAGTGTACAATTCAG | GGG | chr17 | 42916002 | 42916021 | 42916018 | + |
| SEQ ID NO 55141 | CATTCCACTCCAACCCACTC | AAG | chr17 | 42916029 | 42916048 | 42916045 | + |
| SEQ ID NO 55142 | CACTCCAACCCACTCAAGCC | TAG | chr17 | 42916034 | 42916053 | 42916050 | + |
| SEQ ID NO 55143 | ACTCCAACCCACTCAAGCCT | AGG | chr17 | 42916035 | 42916054 | 42916051 | + |
| SEQ ID NO 55144 | CTAATCTACTTTCTGTCTCA | TAG | chr17 | 42916064 | 42916083 | 42916080 | + |
| SEQ ID NO 55145 | GTCTCATAGATTTGCCTATT | TGG | chr17 | 42916078 | 42916097 | 42916094 | + |
| SEQ ID NO 55146 | TCTCATAGATTTGCCTATTT | GGG | chr17 | 42916079 | 42916098 | 42916095 | + |
| SEQ ID NO 55147 | CTCATAGATTTGCCTATTTG | GGG | chr17 | 42916080 | 42916099 | 42916096 | + |
| SEQ ID NO 55148 | TTTGGGGCATTTCATATAAA | TAG | chr17 | 42916096 | 42916115 | 42916112 | + |
| SEQ ID NO 55149 | AAATAGACTCCTACAATATG | TGG | chr17 | 42916113 | 42916132 | 42916129 | + |
| SEQ ID NO 55150 | AATATGTGGCCTTTTGTGTC | TGG | chr17 | 42916127 | 42916146 | 42916143 | + |
| SEQ ID NO 55151 | TGTGTCTGGCCTCTTTCACT | TAG | chr17 | 42916141 | 42916160 | 42916157 | + |
| SEQ ID NO 55152 | TCACTTAGCATGATGTTTTC | AAG | chr17 | 42916156 | 42916175 | 42916172 | + |
| SEQ ID NO 55153 | CACTTAGCATGATGTTTTCA | AGG | chr17 | 42916157 | 42916176 | 42916173 | + |
| SEQ ID NO 55154 | ATCTGTGTTATAACATATAT | TGG | chr17 | 42916183 | 42916202 | 42916199 | + |
| SEQ ID NO 55155 | TGGTACTTCATTTCTTTTTA | TGG | chr17 | 42916203 | 42916222 | 42916219 | + |
| SEQ ID NO 55156 | CTTCATTTCTTTTTATGGAC | AAG | chr17 | 42916208 | 42916227 | 42916224 | + |
| SEQ ID NO 55157 | CATTTTATTTATCTGTTTAT | CAG | chr17 | 42916275 | 42916294 | 42916291 | + |
| SEQ ID NO 55158 | ATTTTATTTATCTGTTTATC | AGG | chr17 | 42916276 | 42916295 | 42916292 | + |
| SEQ ID NO 55159 | TATTTATCTGTTTATCAGGC | CAG | chr17 | 42916280 | 42916299 | 42916296 | + |
| SEQ ID NO 55160 | ATTTATCTGTTTATCAGGCC | AGG | chr17 | 42916281 | 42916300 | 42916297 | + |
| SEQ ID NO 55161 | TCTGTTTATCAGGCCAGGCA | TGG | chr17 | 42916286 | 42916305 | 42916302 | + |
| SEQ ID NO 55162 | GTTTATCAGGCCAGGCATGG | TGG | chr17 | 42916289 | 42916308 | 42916305 | + |
| SEQ ID NO 55163 | GTGGCTCACATCTGTAATCC | CAG | chr17 | 42916308 | 42916327 | 42916324 | + |
| SEQ ID NO 55164 | CATCTGTAATCCCAGCACTT | TGG | chr17 | 42916316 | 42916335 | 42916332 | + |
| SEQ ID NO 55165 | ATCTGTAATCCCAGCACTTT | GGG | chr17 | 42916317 | 42916336 | 42916333 | + |
| SEQ ID NO 55166 | CTGTAATCCCAGCACTTTGG | GAG | chr17 | 42916319 | 42916338 | 42916335 | + |
| SEQ ID NO 55167 | TGTAATCCCAGCACTTTGGG | AGG | chr17 | 42916320 | 42916339 | 42916336 | + |
| SEQ ID NO 55168 | TCCCAGCACTTTGGGAGGCT | GAG | chr17 | 42916325 | 42916344 | 42916341 | + |
| SEQ ID NO 55169 | CCCAGCACTTTGGGAGGCTG | AGG | chr17 | 42916326 | 42916345 | 42916342 | + |
| SEQ ID NO 55170 | AGCACTTTGGGAGGCTGAGG | CAG | chr17 | 42916329 | 42916348 | 42916345 | + |
| SEQ ID NO 55171 | GCACTTTGGGAGGCTGAGGC | AGG | chr17 | 42916330 | 42916349 | 42916346 | + |
| SEQ ID NO 55172 | ACTTTGGGAGGCTGAGGCAG | GAG | chr17 | 42916332 | 42916351 | 42916348 | + |
| SEQ ID NO 55173 | CTTTGGGAGGCTGAGGCAGG | AGG | chr17 | 42916333 | 42916352 | 42916349 | + |
| SEQ ID NO 55174 | CTGAGGCAGGAGGATTACTT | GAG | chr17 | 42916343 | 42916362 | 42916359 | + |
| SEQ ID NO 55175 | CTCAAGTAATCCTCCTGCCT | CAG | chr17 | 42916346 | 42916365 | 42916349 | - |
| SEQ ID NO 55176 | CCTCCTGCCTCAGCCTCCCA | AAG | chr17 | 42916336 | 42916355 | 42916339 | - |
| SEQ ID NO 55177 | GCCTCAGCCTCCCAAAGTGC | TGG | chr17 | 42916330 | 42916349 | 42916333 | - |
| SEQ ID NO 55178 | CCTCAGCCTCCCAAAGTGCT | GGG | chr17 | 42916329 | 42916348 | 42916332 | - |
| SEQ ID NO 55179 | CTCCCAAAGTGCTGGGATTA | CAG | chr17 | 42916322 | 42916341 | 42916325 | - |
| SEQ ID NO 55180 | AGTGCTGGGATTACAGATGT | GAG | chr17 | 42916315 | 42916334 | 42916318 | - |
| SEQ ID NO 55181 | CAGATGTGAGCCACCATGCC | TGG | chr17 | 42916302 | 42916321 | 42916305 | - |
| SEQ ID NO 55182 | ACCATGCCTGGCCTGATAAA | CAG | chr17 | 42916290 | 42916309 | 42916293 | - |
| SEQ ID NO 55183 | ATAAACAGATAAATAAAATG | TGG | chr17 | 42916275 | 42916294 | 42916278 | - |
| SEQ ID NO 55184 | AATGTTATATATTCATACAA | TGG | chr17 | 42916241 | 42916260 | 42916244 | - |
| SEQ ID NO 55185 | GAATATTACTTGTCCATAAA | AAG | chr17 | 42916219 | 42916238 | 42916222 | - |
| SEQ ID NO 55186 | CTTGTCCATAAAAAGAAATG | AAG | chr17 | 42916211 | 42916230 | 42916214 | - |

Figure 85 (Cont'd)

| SEQ ID NO 55187 | TACCAATATATGTTATAACA | CAG | chr17 | 42916188 | 42916207 | 42916191 | - |
| --- | --- | --- | --- | --- | --- | --- | --- |
| SEQ ID NO 55188 | AACCTTGAAAACATCATGCT | AAG | chr17 | 42916162 | 42916181 | 42916165 | - |
| SEQ ID NO 55189 | GAAAACATCATGCTAAGTGA | AAG | chr17 | 42916156 | 42916175 | 42916159 | - |
| SEQ ID NO 55190 | AAACATCATGCTAAGTGAAA | GAG | chr17 | 42916154 | 42916173 | 42916157 | - |
| SEQ ID NO 55191 | AACATCATGCTAAGTGAAAG | AGG | chr17 | 42916153 | 42916172 | 42916156 | - |
| SEQ ID NO 55192 | TCATGCTAAGTGAAAGAGGC | CAG | chr17 | 42916149 | 42916168 | 42916152 | - |
| SEQ ID NO 55193 | GTGAAAGAGGCCAGACACAA | AAG | chr17 | 42916140 | 42916159 | 42916143 | - |
| SEQ ID NO 55194 | TGAAAGAGGCCAGACACAAA | AGG | chr17 | 42916139 | 42916158 | 42916142 | - |
| SEQ ID NO 55195 | ACACAAAGGCCACATATTG | TAG | chr17 | 42916126 | 42916145 | 42916129 | - |
| SEQ ID NO 55196 | CACAAAAGGCCACATATTGT | AGG | chr17 | 42916125 | 42916144 | 42916128 | - |
| SEQ ID NO 55197 | CAAAAGGCCACATATTGTAG | GAG | chr17 | 42916123 | 42916142 | 42916126 | - |
| SEQ ID NO 55198 | TTTATATGAAATGCCCCAAA | TAG | chr17 | 42916096 | 42916115 | 42916099 | - |
| SEQ ID NO 55199 | TTATATGAAATGCCCCAAAT | AGG | chr17 | 42916095 | 42916114 | 42916098 | - |
| SEQ ID NO 55200 | CCCCAAATAGGCAAATCTAT | GAG | chr17 | 42916083 | 42916102 | 42916086 | - |
| SEQ ID NO 55201 | AAATAGGCAAATCTATGAGA | CAG | chr17 | 42916079 | 42916098 | 42916082 | - |
| SEQ ID NO 55202 | AGGCAAATCTATGAGACAGA | AAG | chr17 | 42916075 | 42916094 | 42916078 | - |
| SEQ ID NO 55203 | CAAATCTATGAGACAGAAAG | TAG | chr17 | 42916072 | 42916091 | 42916075 | - |
| SEQ ID NO 55204 | CTATGAGACAGAAAGTAGAT | TAG | chr17 | 42916067 | 42916086 | 42916070 | - |
| SEQ ID NO 55205 | TGAGACAGAAAGTAGATTAG | TGG | chr17 | 42916064 | 42916083 | 42916067 | - |
| SEQ ID NO 55206 | AAAGTAGATTAGTGGTTGCC | TAG | chr17 | 42916056 | 42916075 | 42916059 | - |
| SEQ ID NO 55207 | AAGTAGATTAGTGGTTGCCT | AGG | chr17 | 42916055 | 42916074 | 42916058 | - |
| SEQ ID NO 55208 | ATTAGTGGTTGCCTAGGCTT | GAG | chr17 | 42916049 | 42916068 | 42916052 | - |
| SEQ ID NO 55209 | AGTGGTTGCCTAGGCTTGAG | TGG | chr17 | 42916046 | 42916065 | 42916049 | - |
| SEQ ID NO 55210 | GTGGTTGCCTAGGCTTGAGT | GGG | chr17 | 42916045 | 42916064 | 42916048 | - |
| SEQ ID NO 55211 | TTGCCTAGGCTTGAGTGGGT | TGG | chr17 | 42916041 | 42916060 | 42916044 | - |
| SEQ ID NO 55212 | GCCTAGGCTTGAGTGGGTTG | GAG | chr17 | 42916039 | 42916058 | 42916042 | - |
| SEQ ID NO 55213 | TAGGCTTGAGTGGGTTGGAG | TGG | chr17 | 42916036 | 42916055 | 42916039 | - |
| SEQ ID NO 55214 | CTGAATTGTACACTTTAAAT | GAG | chr17 | 42916002 | 42916021 | 42916005 | - |
| SEQ ID NO 55215 | CTTTAAATGAGTGAATTGTA | TGG | chr17 | 42915990 | 42916009 | 42915993 | - |
| SEQ ID NO 55216 | GGTATTGTGAATTATATCTC | AAG | chr17 | 42915969 | 42915988 | 42915972 | - |
| SEQ ID NO 55217 | TTATATCTCAAGCTGTTATA | CAG | chr17 | 42915958 | 42915977 | 42915961 | - |
| SEQ ID NO 55218 | ATACAGCTTTTTTTTTTTTT | GAG | chr17 | 42915941 | 42915960 | 42915944 | - |
| SEQ ID NO 55219 | AGCTTTTTTTTTTTTGAGA | TGG | chr17 | 42915937 | 42915956 | 42915940 | - |
| SEQ ID NO 55220 | CTTTTTTTTTTTTGAGATG | GAG | chr17 | 42915935 | 42915954 | 42915938 | - |
| SEQ ID NO 55221 | GGAGTTTCACTCTTGTTGCC | CAG | chr17 | 42915916 | 42915935 | 42915919 | - |
| SEQ ID NO 55222 | GAGTTTCACTCTTGTTGCCC | AGG | chr17 | 42915915 | 42915934 | 42915918 | - |
| SEQ ID NO 55223 | TTCACTCTTGTTGCCCAGGT | TGG | chr17 | 42915911 | 42915930 | 42915914 | - |
| SEQ ID NO 55224 | CACTCTTGTTGCCCAGGTTG | GAG | chr17 | 42915909 | 42915928 | 42915912 | - |
| SEQ ID NO 55225 | TTGCCCAGGTTGGAGTGCAA | TGG | chr17 | 42915901 | 42915920 | 42915904 | - |
| SEQ ID NO 55226 | TGGAGTGCAATGGTGTGATC | TGG | chr17 | 42915891 | 42915910 | 42915894 | - |
| SEQ ID NO 55227 | GGAGTGCAATGGTGTGATCT | GGG | chr17 | 42915890 | 42915909 | 42915893 | - |
| SEQ ID NO 55228 | CACTGCAACCTCTGCCTCCC | CGG | chr17 | 42915865 | 42915884 | 42915868 | - |
| SEQ ID NO 55229 | AACCTCTGCCTCCCCGGTTC | AAG | chr17 | 42915859 | 42915878 | 42915862 | - |
| SEQ ID NO 55230 | CTCTGCCTCCCCGGTTCAAG | CAG | chr17 | 42915856 | 42915875 | 42915859 | - |
| SEQ ID NO 55231 | TTCAAGCAGTTCTCCTGTCT | CAG | chr17 | 42915842 | 42915861 | 42915845 | - |
| SEQ ID NO 55232 | TTCTCCTGTCTCAGCCTCTC | AAG | chr17 | 42915833 | 42915852 | 42915836 | - |
| SEQ ID NO 55233 | TCCTGTCTCAGCCTCTCAAG | TAG | chr17 | 42915830 | 42915849 | 42915833 | - |

Figure 85 (Cont'd)

| SEQ ID NO 55234 | GTCTCAGCCTCTCAAGTAGC | TGG | chr17 | 42915826 | 42915845 | 42915829 | - |
| SEQ ID NO 55235 | TCTCAGCCTCTCAAGTAGCT | GGG | chr17 | 42915825 | 42915844 | 42915828 | - |
| SEQ ID NO 55236 | CATGCATGTGCCACCACGTC | TGG | chr17 | 42915798 | 42915817 | 42915801 | - |
| SEQ ID NO 55237 | TGGCTAATTTTTTGTATTTT | TAG | chr17 | 42915778 | 42915797 | 42915781 | - |
| SEQ ID NO 55238 | CTAATTTTTTGTATTTTTAG | TAG | chr17 | 42915775 | 42915794 | 42915778 | - |
| SEQ ID NO 55239 | AATTTTTTGTATTTTTAGTA | GAG | chr17 | 42915773 | 42915792 | 42915776 | - |
| SEQ ID NO 55240 | TTGTATTTTTAGTAGAGACG | CGG | chr17 | 42915767 | 42915786 | 42915770 | - |
| SEQ ID NO 55241 | GAGACGCGGTTTCACCATGT | TGG | chr17 | 42915753 | 42915772 | 42915756 | - |
| SEQ ID NO 55242 | CGCGGTTTCACCATGTTGGT | CAG | chr17 | 42915749 | 42915768 | 42915752 | - |
| SEQ ID NO 55243 | GCGGTTTCACCATGTTGGTC | AGG | chr17 | 42915748 | 42915767 | 42915751 | - |
| SEQ ID NO 55244 | TCAGGTCGAACTCCTGATCT | CAG | chr17 | 42915730 | 42915749 | 42915733 | - |
| SEQ ID NO 55245 | CAGGTCGAACTCCTGATCTC | AGG | chr17 | 42915729 | 42915748 | 42915732 | - |
| SEQ ID NO 55246 | CTCAGGTGATCTGCCTGCCT | TGG | chr17 | 42915712 | 42915731 | 42915715 | - |
| SEQ ID NO 55247 | CTGCCTGCCTTGGCTTCCCA | AAG | chr17 | 42915702 | 42915721 | 42915705 | - |
| SEQ ID NO 55248 | GCCTTGGCTTCCCAAAGTGC | TGG | chr17 | 42915696 | 42915715 | 42915699 | - |
| SEQ ID NO 55249 | CCTTGGCTTCCCAAAGTGCT | GGG | chr17 | 42915695 | 42915714 | 42915698 | - |
| SEQ ID NO 55250 | TTCCCAAAGTGCTGGGATTA | CAG | chr17 | 42915688 | 42915707 | 42915691 | - |
| SEQ ID NO 55251 | TCCCAAAGTGCTGGGATTAC | AGG | chr17 | 42915687 | 42915706 | 42915690 | - |
| SEQ ID NO 55252 | AGTGCTGGGATTACAGGCAT | GAG | chr17 | 42915681 | 42915700 | 42915684 | - |
| SEQ ID NO 55253 | CAGGCATGAGCCACCGTGCC | CGG | chr17 | 42915668 | 42915687 | 42915671 | - |
| SEQ ID NO 55254 | CCTTGTTATACATTTTTTTT | AAG | chr17 | 42915645 | 42915664 | 42915648 | - |
| SEQ ID NO 55255 | CTTGTTATACATTTTTTTTA | AGG | chr17 | 42915644 | 42915663 | 42915647 | - |
| SEQ ID NO 55256 | TTTGTTAAAAATCAAAAACA | TGG | chr17 | 42915612 | 42915631 | 42915615 | - |
| SEQ ID NO 55257 | TAAAAATCAAAAACATGGCT | GAG | chr17 | 42915607 | 42915626 | 42915610 | - |
| SEQ ID NO 55258 | ATCAAAAACATGGCTGAGTG | CAG | chr17 | 42915602 | 42915621 | 42915605 | - |
| SEQ ID NO 55259 | AAAAACATGGCTGAGTGCAG | CAG | chr17 | 42915599 | 42915618 | 42915602 | - |
| SEQ ID NO 55260 | GCAGCTCATGCCTGTTATCC | CAG | chr17 | 42915580 | 42915599 | 42915583 | - |
| SEQ ID NO 55261 | TGCCTGTTATCCCAGCACTT | TGG | chr17 | 42915572 | 42915591 | 42915575 | - |
| SEQ ID NO 55262 | GCCTGTTATCCCAGCACTTT | GGG | chr17 | 42915571 | 42915590 | 42915574 | - |
| SEQ ID NO 55263 | CTGTTATCCCAGCACTTTGG | GAG | chr17 | 42915569 | 42915588 | 42915572 | - |
| SEQ ID NO 55264 | TGTTATCCCAGCACTTTGGG | AGG | chr17 | 42915568 | 42915587 | 42915571 | - |
| SEQ ID NO 55265 | TCCCAGCACTTTGGGAGGCT | AAG | chr17 | 42915563 | 42915582 | 42915566 | - |
| SEQ ID NO 55266 | CCCAGCACTTTGGGAGGCTA | AGG | chr17 | 42915562 | 42915581 | 42915565 | - |
| SEQ ID NO 55267 | AGCACTTTGGGAGGCTAAGG | CGG | chr17 | 42915559 | 42915578 | 42915562 | - |
| SEQ ID NO 55268 | GCACTTTGGGAGGCTAAGGC | GGG | chr17 | 42915558 | 42915577 | 42915561 | - |
| SEQ ID NO 55269 | ACTTTGGGAGGCTAAGGCGG | GAG | chr17 | 42915556 | 42915575 | 42915559 | - |
| SEQ ID NO 55270 | CTTTGGGAGGCTAAGGCGGG | AGG | chr17 | 42915555 | 42915574 | 42915558 | - |
| SEQ ID NO 55271 | GCTAAGGCGGGAGGATGCTT | GAG | chr17 | 42915546 | 42915565 | 42915549 | - |
| SEQ ID NO 55272 | TCTACAAAAATAAAAAAAAT | TAG | chr17 | 42915515 | 42915534 | 42915518 | - |
| SEQ ID NO 55273 | CAAAAAATAAAAAATTAGC | CAG | chr17 | 42915511 | 42915530 | 42915514 | - |
| SEQ ID NO 55274 | AAAAAATAAAAAATTAGCC | AGG | chr17 | 42915510 | 42915529 | 42915513 | - |
| SEQ ID NO 55275 | ATAAAAAATTAGCCAGGCA | TGG | chr17 | 42915505 | 42915524 | 42915508 | - |
| SEQ ID NO 55276 | AAAAAATTAGCCAGGCATGG | TGG | chr17 | 42915502 | 42915521 | 42915505 | - |
| SEQ ID NO 55277 | GGCATGGTGGTACGCATCTG | TAG | chr17 | 42915489 | 42915508 | 42915492 | - |
| SEQ ID NO 55278 | GTGGTACGCATCTGTAGTCC | CAG | chr17 | 42915483 | 42915502 | 42915486 | - |
| SEQ ID NO 55279 | CATCTGTAGTCCCAGCTATT | CGG | chr17 | 42915475 | 42915494 | 42915478 | - |
| SEQ ID NO 55280 | ATCTGTAGTCCCAGCTATTC | GGG | chr17 | 42915474 | 42915493 | 42915477 | - |

Figure 85 (Cont'd)

| SEQ ID NO 55281 | CTGTAGTCCCAGCTATTCGG | GAG | chr17 | 42915472 | 42915491 | 42915475 | - |
| SEQ ID NO 55282 | TGTAGTCCCAGCTATTCGGG | AGG | chr17 | 42915471 | 42915490 | 42915474 | - |
| SEQ ID NO 55283 | TCCCAGCTATTCGGGAGGCT | GAG | chr17 | 42915466 | 42915485 | 42915469 | - |
| SEQ ID NO 55284 | CCCAGCTATTCGGGAGGCTG | AGG | chr17 | 42915465 | 42915484 | 42915468 | - |
| SEQ ID NO 55285 | GCTATTCGGGAGGCTGAGGC | TGG | chr17 | 42915461 | 42915480 | 42915464 | - |
| SEQ ID NO 55286 | TATTCGGGAGGCTGAGGCTG | GAG | chr17 | 42915459 | 42915478 | 42915462 | - |
| SEQ ID NO 55287 | ATTCGGGAGGCTGAGGCTGG | AGG | chr17 | 42915458 | 42915477 | 42915461 | - |
| SEQ ID NO 55288 | CTGAGGCTGGAGGATCATTT | GAG | chr17 | 42915448 | 42915467 | 42915451 | - |
| SEQ ID NO 55289 | CTGGAGGATCATTTGAGCCC | CAG | chr17 | 42915442 | 42915461 | 42915445 | - |
| SEQ ID NO 55290 | TGGAGGATCATTTGAGCCCC | AGG | chr17 | 42915441 | 42915460 | 42915444 | - |
| SEQ ID NO 55291 | GAGGATCATTTGAGCCCCAG | GAG | chr17 | 42915439 | 42915458 | 42915442 | - |
| SEQ ID NO 55292 | ATCATTTGAGCCCCAGGAGT | TGG | chr17 | 42915435 | 42915454 | 42915438 | - |
| SEQ ID NO 55293 | CATTTGAGCCCCAGGAGTTG | GAG | chr17 | 42915433 | 42915452 | 42915436 | - |
| SEQ ID NO 55294 | ATTTGAGCCCCAGGAGTTGG | AGG | chr17 | 42915432 | 42915451 | 42915435 | - |
| SEQ ID NO 55295 | GCCCCAGGAGTTGGAGGTTG | CAG | chr17 | 42915426 | 42915445 | 42915429 | - |
| SEQ ID NO 55296 | CAGGAGTTGGAGGTTGCAGT | GAG | chr17 | 42915422 | 42915441 | 42915425 | - |
| SEQ ID NO 55297 | GTTGGAGGTTGCAGTGAGCT | GAG | chr17 | 42915417 | 42915436 | 42915420 | - |
| SEQ ID NO 55298 | GAGATTGCGCCATTGCACCC | CAG | chr17 | 42915397 | 42915416 | 42915400 | - |
| SEQ ID NO 55299 | TGCGCCATTGCACCCCAGCC | TGG | chr17 | 42915392 | 42915411 | 42915395 | - |
| SEQ ID NO 55300 | GCGCCATTGCACCCCAGCCT | GGG | chr17 | 42915391 | 42915410 | 42915394 | - |
| SEQ ID NO 55301 | TTGCACCCCAGCCTGGGTGA | CAG | chr17 | 42915385 | 42915404 | 42915388 | - |
| SEQ ID NO 55302 | GCACCCCAGCCTGGGTGACA | GAG | chr17 | 42915383 | 42915402 | 42915386 | - |
| SEQ ID NO 55303 | CCCAGCCTGGGTGACAGAGT | GAG | chr17 | 42915379 | 42915398 | 42915382 | - |
| SEQ ID NO 55304 | AAAATAAAATAAAATAAAAT | AAG | chr17 | 42915339 | 42915358 | 42915342 | - |
| SEQ ID NO 55305 | ATAAGATAAAATAAAATAAA | AAG | chr17 | 42915321 | 42915340 | 42915324 | - |
| SEQ ID NO 55306 | AACCAAAACCACAAAAACCT | AAG | chr17 | 42915287 | 42915306 | 42915290 | - |
| SEQ ID NO 55307 | ACCACAAAAACCTAAGCCTT | TGG | chr17 | 42915280 | 42915299 | 42915283 | - |
| SEQ ID NO 55308 | CCTTTGGTCTATGTGTGATG | TGG | chr17 | 42915264 | 42915283 | 42915267 | - |
| SEQ ID NO 55309 | TTGGTCTATGTGTGATGTGG | CAG | chr17 | 42915261 | 42915280 | 42915264 | - |
| SEQ ID NO 55310 | TATGTGTGATGTGGCAGCAC | TGG | chr17 | 42915255 | 42915274 | 42915258 | - |
| SEQ ID NO 55311 | TGTGGCAGCACTGGTCCACG | CAG | chr17 | 42915246 | 42915265 | 42915249 | - |
| SEQ ID NO 55312 | GGCAGCACTGGTCCACGCAG | CAG | chr17 | 42915243 | 42915262 | 42915246 | - |
| SEQ ID NO 55313 | AGCACTGGTCCACGCAGCAG | AAG | chr17 | 42915240 | 42915259 | 42915243 | - |
| SEQ ID NO 55314 | CTGGTCCACGCAGCAGAAGT | TGG | chr17 | 42915236 | 42915255 | 42915239 | - |
| SEQ ID NO 55315 | CAGAAGTTGGACTTCCTTAA | TGG | chr17 | 42915223 | 42915242 | 42915226 | - |
| SEQ ID NO 55316 | AGAAGTTGGACTTCCTTAAT | GGG | chr17 | 42915222 | 42915241 | 42915225 | - |
| SEQ ID NO 55317 | CTTAATGGGTCTATTTTCTT | TGG | chr17 | 42915208 | 42915227 | 42915211 | - |
| SEQ ID NO 55318 | TTAATGGGTCTATTTTCTTT | GGG | chr17 | 42915207 | 42915226 | 42915210 | - |
| SEQ ID NO 55319 | CTATTTTCTTTGGGCAATAA | TAG | chr17 | 42915198 | 42915217 | 42915201 | - |
| SEQ ID NO 55320 | TGTGTGTGTGTATCATCCTC | AAG | chr17 | 42915159 | 42915178 | 42915162 | - |
| SEQ ID NO 55321 | CCTGAAAACTGATACACTAC | TAG | chr17 | 42915129 | 42915148 | 42915132 | - |
| SEQ ID NO 55322 | AATTATGCCATAACATGACA | TGG | chr17 | 42915094 | 42915113 | 42915097 | - |
| SEQ ID NO 55323 | CCTTGCTTTAAAACTGTCAT | CGG | chr17 | 42915070 | 42915089 | 42915073 | - |
| SEQ ID NO 55324 | GTCACTTAAACTTGCCTCAC | AAG | chr17 | 42915048 | 42915067 | 42915051 | - |
| SEQ ID NO 55325 | TGCCTCACAAGCCATTTCTA | AAG | chr17 | 42915036 | 42915055 | 42915039 | - |
| SEQ ID NO 55326 | CTCACAAGCCATTTCTAAAG | TGG | chr17 | 42915033 | 42915052 | 42915036 | - |
| SEQ ID NO 55327 | GTGGACGTAAATCTATAACT | TAG | chr17 | 42915014 | 42915033 | 42915017 | - |

Figure 85 (Cont'd)

| SEQ ID NO 55328 | TGGACGTAAATCTATAACTT | AGG | chr17 | 42915013 | 42915032 | 42915016 | - |
| SEQ ID NO 55329 | GGACGTAAATCTATAACTTA | GGG | chr17 | 42915012 | 42915031 | 42915015 | - |
| SEQ ID NO 55330 | TAAATCTATAACTTAGGGAA | CAG | chr17 | 42915007 | 42915026 | 42915010 | - |
| SEQ ID NO 55331 | CTATAACTTAGGGAACAGAT | GAG | chr17 | 42915002 | 42915021 | 42915005 | - |
| SEQ ID NO 55332 | ATCAAAATGTTCTGTCTAAT | AAG | chr17 | 42914977 | 42914996 | 42914980 | - |
| SEQ ID NO 55333 | AAAATGTTCTGTCTAATAAG | CAG | chr17 | 42914974 | 42914993 | 42914977 | - |
| SEQ ID NO 55334 | AAATGTTCTGTCTAATAAGC | AGG | chr17 | 42914973 | 42914992 | 42914976 | - |
| SEQ ID NO 55335 | CAAAATGATTATTTTGTATC | TGG | chr17 | 42914942 | 42914961 | 42914945 | - |
| SEQ ID NO 55336 | AAAATGATTATTTTGTATCT | GGG | chr17 | 42914941 | 42914960 | 42914944 | - |
| SEQ ID NO 55337 | TTATTTTGTATCTGGGATTA | CAG | chr17 | 42914934 | 42914953 | 42914937 | - |
| SEQ ID NO 55338 | TATTTTGTATCTGGGATTAC | AGG | chr17 | 42914933 | 42914952 | 42914936 | - |
| SEQ ID NO 55339 | GTATCTGGGATTACAGGCGC | GAG | chr17 | 42914927 | 42914946 | 42914930 | - |
| SEQ ID NO 55340 | GGGATTACAGGCGCGAGCCA | CAG | chr17 | 42914921 | 42914940 | 42914924 | - |
| SEQ ID NO 55341 | CAGGCGCGAGCCACAGCACC | CAG | chr17 | 42914914 | 42914933 | 42914917 | - |
| SEQ ID NO 55342 | GCGAGCCACAGCACCCAGCC | CAG | chr17 | 42914909 | 42914928 | 42914912 | - |
| SEQ ID NO 55343 | TCTTTTTTTTTTTTTTTTCT | GAG | chr17 | 42914876 | 42914895 | 42914879 | - |
| SEQ ID NO 55344 | TTTTTTTTTTTTTTCTGAGA | CAG | chr17 | 42914872 | 42914891 | 42914875 | - |
| SEQ ID NO 55345 | TTTTTTTTTTTTTCTGAGAC | AGG | chr17 | 42914871 | 42914890 | 42914874 | - |
| SEQ ID NO 55346 | TTTTTTTTTTTTCTGAGACA | GGG | chr17 | 42914870 | 42914889 | 42914873 | - |
| SEQ ID NO 55347 | CAGGGTCTCACTCTGTCACC | CAG | chr17 | 42914852 | 42914871 | 42914855 | - |
| SEQ ID NO 55348 | AGGGTCTCACTCTGTCACCC | AGG | chr17 | 42914851 | 42914870 | 42914854 | - |
| SEQ ID NO 55349 | TCTCACTCTGTCACCCAGGC | TGG | chr17 | 42914847 | 42914866 | 42914850 | - |
| SEQ ID NO 55350 | TCACTCTGTCACCCAGGCTG | GAG | chr17 | 42914845 | 42914864 | 42914848 | - |
| SEQ ID NO 55351 | CTGTCACCCAGGCTGGAGTG | CAG | chr17 | 42914840 | 42914859 | 42914843 | - |
| SEQ ID NO 55352 | TCACCCAGGCTGGAGTGCAG | TGG | chr17 | 42914837 | 42914856 | 42914840 | - |
| SEQ ID NO 55353 | GGAGTGCAGTGGCATAATCT | TGG | chr17 | 42914826 | 42914845 | 42914829 | - |
| SEQ ID NO 55354 | CTTGGCTCACTGCAACCTCT | GAG | chr17 | 42914808 | 42914827 | 42914811 | - |
| SEQ ID NO 55355 | TCACTGCAACCTCTGAGCTC | AAG | chr17 | 42914802 | 42914821 | 42914805 | - |
| SEQ ID NO 55356 | CACTGCAACCTCTGAGCTCA | AGG | chr17 | 42914801 | 42914820 | 42914804 | - |
| SEQ ID NO 55357 | ACTGCAACCTCTGAGCTCAA | GGG | chr17 | 42914800 | 42914819 | 42914803 | - |
| SEQ ID NO 55358 | CTCAAGGGATTCTCCCACCT | CAG | chr17 | 42914785 | 42914804 | 42914788 | - |
| SEQ ID NO 55359 | TTCTCCCACCTCAGCCACCT | GAG | chr17 | 42914776 | 42914795 | 42914779 | - |
| SEQ ID NO 55360 | TCCCACCTCAGCCACCTGAG | TAG | chr17 | 42914773 | 42914792 | 42914776 | - |
| SEQ ID NO 55361 | ACCTCAGCCACCTGAGTAGT | TAG | chr17 | 42914769 | 42914788 | 42914772 | - |
| SEQ ID NO 55362 | CCTCAGCCACCTGAGTAGTT | AGG | chr17 | 42914768 | 42914787 | 42914771 | - |
| SEQ ID NO 55363 | CACCTGAGTAGTTAGGACCA | CAG | chr17 | 42914761 | 42914780 | 42914764 | - |
| SEQ ID NO 55364 | ACCTGAGTAGTTAGGACCAC | AGG | chr17 | 42914760 | 42914779 | 42914763 | - |
| SEQ ID NO 55365 | CAGGCATGCACCACCACGCT | TGG | chr17 | 42914741 | 42914760 | 42914744 | - |
| SEQ ID NO 55366 | TGGCTAATGTTTTGTATTTT | TGG | chr17 | 42914721 | 42914740 | 42914724 | - |
| SEQ ID NO 55367 | AATGTTTTGTATTTTGGTA | TAG | chr17 | 42914716 | 42914735 | 42914719 | - |
| SEQ ID NO 55368 | TTTTGTATTTTGGTATAGA | CGG | chr17 | 42914712 | 42914731 | 42914715 | - |
| SEQ ID NO 55369 | TTTGTATTTTGGTATAGAC | GGG | chr17 | 42914711 | 42914730 | 42914714 | - |
| SEQ ID NO 55370 | TTGTATTTTGGTATAGACG | GGG | chr17 | 42914710 | 42914729 | 42914713 | - |
| SEQ ID NO 55371 | TGTATTTTGGTATAGACGG | GGG | chr17 | 42914709 | 42914728 | 42914712 | - |
| SEQ ID NO 55372 | GGGGGTCTCACCATGTTGCC | CAG | chr17 | 42914691 | 42914710 | 42914694 | - |
| SEQ ID NO 55373 | GGGGTCTCACCATGTTGCCC | AGG | chr17 | 42914690 | 42914709 | 42914693 | - |
| SEQ ID NO 55374 | TCTCACCATGTTGCCCAGGC | TGG | chr17 | 42914686 | 42914705 | 42914689 | - |

Figure 85 (Cont'd)

| | | | | | | | |
|---|---|---|---|---|---|---|---|
| SEQ ID NO 55375 | CAGGCTGGTCTCGAACTCCT | GAG | chr17 | 42914671 | 42914690 | 42914674 | - |
| SEQ ID NO 55376 | TGGTCTCGAACTCCTGAGCT | CAG | chr17 | 42914666 | 42914685 | 42914669 | - |
| SEQ ID NO 55377 | GGTCTCGAACTCCTGAGCTC | AGG | chr17 | 42914665 | 42914684 | 42914668 | - |
| SEQ ID NO 55378 | GCTCAGGCAATCTGCCACCT | CAG | chr17 | 42914649 | 42914668 | 42914652 | - |
| SEQ ID NO 55379 | TCTGCCACCTCAGCCTCCCA | AAG | chr17 | 42914639 | 42914658 | 42914642 | - |
| SEQ ID NO 55380 | ACCTCAGCCTCCCAAAGTGC | TGG | chr17 | 42914633 | 42914652 | 42914636 | - |
| SEQ ID NO 55381 | CCTCAGCCTCCCAAAGTGCT | GGG | chr17 | 42914632 | 42914651 | 42914635 | - |
| SEQ ID NO 55382 | CTCCCAAAGTGCTGGGATTA | CAG | chr17 | 42914625 | 42914644 | 42914628 | - |
| SEQ ID NO 55383 | AGTGCTGGGATTACAGATGT | GAG | chr17 | 42914618 | 42914637 | 42914621 | - |
| SEQ ID NO 55384 | CAGATGTGAGCCACCATGCC | CAG | chr17 | 42914605 | 42914624 | 42914608 | - |
| SEQ ID NO 55385 | GTGAGCCACCATGCCCAGCC | CAG | chr17 | 42914600 | 42914619 | 42914603 | - |
| SEQ ID NO 55386 | AGACTGCCTGATCCTTAACC | TGG | chr17 | 42914579 | 42914598 | 42914582 | - |
| SEQ ID NO 55387 | TTAACCTGGTTCCACCATTC | TGG | chr17 | 42914565 | 42914584 | 42914568 | - |
| SEQ ID NO 55388 | CTGGTTCCACCATTCTGGAC | AAG | chr17 | 42914560 | 42914579 | 42914563 | - |
| SEQ ID NO 55389 | GACAAGATGACTAACCCCTC | TGG | chr17 | 42914543 | 42914562 | 42914546 | - |
| SEQ ID NO 55390 | TCTGGACCTATTTGTAATAT | AAG | chr17 | 42914525 | 42914544 | 42914528 | - |
| SEQ ID NO 55391 | CTGGACCTATTTGTAATATA | AGG | chr17 | 42914524 | 42914543 | 42914527 | - |
| SEQ ID NO 55392 | TGTAATATAAGGATAAATGA | CAG | chr17 | 42914513 | 42914532 | 42914516 | - |
| SEQ ID NO 55393 | AATATAAGGATAAATGACAG | TAG | chr17 | 42914510 | 42914529 | 42914513 | - |
| SEQ ID NO 55394 | AAATGACAGTAGCCAACTCA | CAG | chr17 | 42914499 | 42914518 | 42914502 | - |
| SEQ ID NO 55395 | ATGACAGTAGCCAACTCACA | GAG | chr17 | 42914497 | 42914516 | 42914500 | - |
| SEQ ID NO 55396 | TAGCCAACTCACAGAGATGT | TGG | chr17 | 42914490 | 42914509 | 42914493 | - |
| SEQ ID NO 55397 | AGCCAACTCACAGAGATGTT | GGG | chr17 | 42914489 | 42914508 | 42914492 | - |
| SEQ ID NO 55398 | CCAACTCACAGAGATGTTGG | GAG | chr17 | 42914487 | 42914506 | 42914490 | - |
| SEQ ID NO 55399 | ACAGAGATGTTGGGAGAACT | AAG | chr17 | 42914480 | 42914499 | 42914483 | - |
| SEQ ID NO 55400 | AGATGTTGGGAGAACTAAGC | GAG | chr17 | 42914476 | 42914495 | 42914479 | - |
| SEQ ID NO 55401 | GCGAGTTAATTGTATAAATA | AAG | chr17 | 42914458 | 42914477 | 42914461 | - |
| SEQ ID NO 55402 | AATTGTATAAATAAAGTACA | TAG | chr17 | 42914451 | 42914470 | 42914454 | - |
| SEQ ID NO 55403 | TATAAATAAAGTACATAGAA | CAG | chr17 | 42914446 | 42914465 | 42914449 | - |
| SEQ ID NO 55404 | AAAGTACATAGAACAGAATC | TGG | chr17 | 42914439 | 42914458 | 42914442 | - |
| SEQ ID NO 55405 | ATAGAACAGAATCTGGCATA | AAG | chr17 | 42914432 | 42914451 | 42914435 | - |
| SEQ ID NO 55406 | AACAGAATCTGGCATAAAGT | TAG | chr17 | 42914428 | 42914447 | 42914431 | - |
| SEQ ID NO 55407 | CTTATCAACCTCATAAACTT | CAG | chr17 | 42914376 | 42914395 | 42914379 | - |
| SEQ ID NO 55408 | TTATCAACCTCATAAACTTC | AGG | chr17 | 42914375 | 42914394 | 42914378 | - |
| SEQ ID NO 55409 | TATCAACCTCATAAACTTCA | GGG | chr17 | 42914374 | 42914393 | 42914377 | - |
| SEQ ID NO 55410 | TCAACCTCATAAACTTCAGG | GAG | chr17 | 42914372 | 42914391 | 42914375 | - |
| SEQ ID NO 55411 | ACCTCATAAACTTCAGGGAG | TGG | chr17 | 42914369 | 42914388 | 42914372 | - |
| SEQ ID NO 55412 | CCTCATAAACTTCAGGGAGT | GGG | chr17 | 42914368 | 42914387 | 42914371 | - |
| SEQ ID NO 55413 | CTCATAAACTTCAGGGAGTG | GGG | chr17 | 42914367 | 42914386 | 42914370 | - |
| SEQ ID NO 55414 | TCATAAACTTCAGGGAGTGG | GGG | chr17 | 42914366 | 42914385 | 42914369 | - |
| SEQ ID NO 55415 | TAAACTTCAGGGAGTGGGGG | CAG | chr17 | 42914363 | 42914382 | 42914366 | - |
| SEQ ID NO 55416 | TGGGGGCAGTATTTACTTTC | TGG | chr17 | 42914349 | 42914368 | 42914352 | - |
| SEQ ID NO 55417 | GGGCAGTATTTACTTTCTGG | CAG | chr17 | 42914346 | 42914365 | 42914349 | - |
| SEQ ID NO 55418 | TTCTGGCAGACCTTTCTTGT | AAG | chr17 | 42914332 | 42914351 | 42914335 | - |
| SEQ ID NO 55419 | TCTGGCAGACCTTTCTTGTA | AGG | chr17 | 42914331 | 42914350 | 42914334 | - |
| SEQ ID NO 55420 | GACCTTTCTTGTAAGGATCT | TGG | chr17 | 42914324 | 42914343 | 42914327 | - |
| SEQ ID NO 55421 | TCTTGTAAGGATCTTGGACT | TGG | chr17 | 42914318 | 42914337 | 42914321 | - |

Figure 85 (Cont'd)

| SEQ ID NO 55422 | AGGATCTTGGACTTGGTCCTT | TGG | chr17 | 42914311 | 42914330 | 42914314 | - |
| SEQ ID NO 55423 | GGATCTTGGACTTGGTCCTT | GGG | chr17 | 42914310 | 42914329 | 42914313 | - |
| SEQ ID NO 55424 | ATCTTGGACTTGGTCCTTGG | GAG | chr17 | 42914308 | 42914327 | 42914311 | - |
| SEQ ID NO 55425 | ACTTGGTCCTTGGGAGCAAA | TAG | chr17 | 42914301 | 42914320 | 42914304 | - |
| SEQ ID NO 55426 | TTGGGAGCAAATAGATTATC | AAG | chr17 | 42914292 | 42914311 | 42914295 | - |
| SEQ ID NO 55427 | TGGGAGCAAATAGATTATCA | AGG | chr17 | 42914291 | 42914310 | 42914294 | - |
| SEQ ID NO 55428 | AGCAAATAGATTATCAAGGA | TGG | chr17 | 42914287 | 42914306 | 42914290 | - |
| SEQ ID NO 55429 | GCAAATAGATTATCAAGGAT | GGG | chr17 | 42914286 | 42914305 | 42914289 | - |
| SEQ ID NO 55430 | CAAATAGATTATCAAGGATG | GGG | chr17 | 42914285 | 42914304 | 42914288 | - |
| SEQ ID NO 55431 | TCAAGGATGGGGCTATGCCT | AAG | chr17 | 42914274 | 42914293 | 42914277 | - |
| SEQ ID NO 55432 | AGGATGGGGCTATGCCTAAG | CAG | chr17 | 42914271 | 42914290 | 42914274 | - |
| SEQ ID NO 55433 | ATGGGGCTATGCCTAAGCAG | TAG | chr17 | 42914268 | 42914287 | 42914271 | - |
| SEQ ID NO 55434 | TGGGGCTATGCCTAAGCAGT | AGG | chr17 | 42914267 | 42914286 | 42914270 | - |
| SEQ ID NO 55435 | GGGGCTATGCCTAAGCAGTA | GGG | chr17 | 42914266 | 42914285 | 42914269 | - |
| SEQ ID NO 55436 | TATGCCTAAGCAGTAGGGTT | CAG | chr17 | 42914261 | 42914280 | 42914264 | - |
| SEQ ID NO 55437 | CTAAGCAGTAGGGTTCAGTT | CAG | chr17 | 42914256 | 42914275 | 42914259 | - |
| SEQ ID NO 55438 | GCAGTAGGGTTCAGTTCAGA | CAG | chr17 | 42914252 | 42914271 | 42914255 | - |
| SEQ ID NO 55439 | AGACAGATCAAAACCATTTC | TGG | chr17 | 42914235 | 42914254 | 42914238 | - |
| SEQ ID NO 55440 | GATCAAAACCATTTCTGGCC | AAG | chr17 | 42914230 | 42914249 | 42914233 | - |
| SEQ ID NO 55441 | AAACCATTTCTGGCCAAGCG | CAG | chr17 | 42914225 | 42914244 | 42914228 | - |
| SEQ ID NO 55442 | CCATTTCTGGCCAAGCGCAG | TGG | chr17 | 42914222 | 42914241 | 42914225 | - |
| SEQ ID NO 55443 | AGTGGCTCACACTGTAATCC | CAG | chr17 | 42914204 | 42914223 | 42914207 | - |
| SEQ ID NO 55444 | ACACTGTAATCCCAGCACTT | TGG | chr17 | 42914196 | 42914215 | 42914199 | - |
| SEQ ID NO 55445 | CACTGTAATCCCAGCACTTT | GGG | chr17 | 42914195 | 42914214 | 42914198 | - |
| SEQ ID NO 55446 | CTGTAATCCCAGCACTTTGG | GAG | chr17 | 42914193 | 42914212 | 42914196 | - |
| SEQ ID NO 55447 | TGTAATCCCAGCACTTTGGG | AGG | chr17 | 42914192 | 42914211 | 42914195 | - |
| SEQ ID NO 55448 | TCCCAGCACTTTGGGAGGCT | GAG | chr17 | 42914187 | 42914206 | 42914190 | - |
| SEQ ID NO 55449 | CCCAGCACTTTGGGAGGCTG | AGG | chr17 | 42914186 | 42914205 | 42914189 | - |
| SEQ ID NO 55450 | AGCACTTTGGGAGGCTGAGG | CAG | chr17 | 42914183 | 42914202 | 42914186 | - |
| SEQ ID NO 55451 | GCACTTTGGGAGGCTGAGGC | AGG | chr17 | 42914182 | 42914201 | 42914185 | - |
| SEQ ID NO 55452 | ACTTTGGGAGGCTGAGGCAG | GAG | chr17 | 42914180 | 42914199 | 42914183 | - |
| SEQ ID NO 55453 | CTTTGGGAGGCTGAGGCAGG | AGG | chr17 | 42914179 | 42914198 | 42914182 | - |
| SEQ ID NO 55454 | GCAGGAGGATCACTTGAACC | CAG | chr17 | 42914164 | 42914183 | 42914167 | - |
| SEQ ID NO 55455 | CAGGAGGATCACTTGAACCC | AGG | chr17 | 42914163 | 42914182 | 42914166 | - |
| SEQ ID NO 55456 | GGAGGATCACTTGAACCCAG | GAG | chr17 | 42914161 | 42914180 | 42914164 | - |
| SEQ ID NO 55457 | TCACTTGAACCCAGGAGTTC | AAG | chr17 | 42914155 | 42914174 | 42914158 | - |
| SEQ ID NO 55458 | TGAACCCAGGAGTTCAAGAC | CAG | chr17 | 42914150 | 42914169 | 42914153 | - |
| SEQ ID NO 55459 | CCAGGAGTTCAAGACCAGCC | TGG | chr17 | 42914145 | 42914164 | 42914148 | - |
| SEQ ID NO 55460 | CAGGAGTTCAAGACCAGCCT | GGG | chr17 | 42914144 | 42914163 | 42914147 | - |
| SEQ ID NO 55461 | GAGTTCAAGACCAGCCTGGG | CAG | chr17 | 42914141 | 42914160 | 42914144 | - |
| SEQ ID NO 55462 | CAAGACCAGCCTGGGCAGCA | TAG | chr17 | 42914136 | 42914155 | 42914139 | - |
| SEQ ID NO 55463 | ACCAGCCTGGGCAGCATAGT | GAG | chr17 | 42914132 | 42914151 | 42914135 | - |
| SEQ ID NO 55464 | TCTCTATTAAAAAAAAAAAA | AAG | chr17 | 42914102 | 42914121 | 42914105 | - |
| SEQ ID NO 55465 | AAGACTATTTTCTTTCTCCC | TGG | chr17 | 42914082 | 42914101 | 42914085 | - |
| SEQ ID NO 55466 | CTATTTTCTTTCTCCCTGGT | TGG | chr17 | 42914078 | 42914097 | 42914081 | - |
| SEQ ID NO 55467 | TATTTTCTTTCTCCCTGGTT | GGG | chr17 | 42914077 | 42914096 | 42914080 | - |
| SEQ ID NO 55468 | TTGGGACCATTTGATTCTGT | GAG | chr17 | 42914059 | 42914078 | 42914062 | - |

Figure 85 (Cont'd)

| SEQ ID NO 55469 | TGGGACCATTTGATTCTGTG | AGG | chr17 | 42914058 | 42914077 | 42914061 | - |
| SEQ ID NO 55470 | GGGACCATTTGATTCTGTGA | GGG | chr17 | 42914057 | 42914076 | 42914060 | - |
| SEQ ID NO 55471 | GGACCATTTGATTCTGTGAG | GGG | chr17 | 42914056 | 42914075 | 42914059 | - |
| SEQ ID NO 55472 | ATTTGATTCTGTGAGGGGCC | TGG | chr17 | 42914051 | 42914070 | 42914054 | - |
| SEQ ID NO 55473 | TGGTTCCCACAACGCCCTCT | GAG | chr17 | 42914031 | 42914050 | 42914034 | - |
| SEQ ID NO 55474 | GTTCCCACAACGCCCTCTGA | GAG | chr17 | 42914029 | 42914048 | 42914032 | - |
| SEQ ID NO 55475 | GCCCTCTGAGAGCCCAAATC | CAG | chr17 | 42914018 | 42914037 | 42914021 | - |
| SEQ ID NO 55476 | CTCTGAGAGCCCAAATCCAG | TAG | chr17 | 42914015 | 42914034 | 42914018 | - |
| SEQ ID NO 55477 | TCTGAGAGCCCAAATCCAGT | AGG | chr17 | 42914014 | 42914033 | 42914017 | - |
| SEQ ID NO 55478 | TGAGAGCCCAAATCCAGTAG | GAG | chr17 | 42914012 | 42914031 | 42914015 | - |
| SEQ ID NO 55479 | TGCAATCTTCCCTGAATATA | CAG | chr17 | 42913987 | 42914006 | 42913990 | - |
| SEQ ID NO 55480 | TTCCCTGAATATACAGACTC | CGG | chr17 | 42913980 | 42913999 | 42913983 | - |
| SEQ ID NO 55481 | CCCTGAATATACAGACTCCG | GAG | chr17 | 42913978 | 42913997 | 42913981 | - |
| SEQ ID NO 55482 | AATATACAGACTCCGGAGTT | CAG | chr17 | 42913973 | 42913992 | 42913976 | - |
| SEQ ID NO 55483 | ATATACAGACTCCGGAGTTC | AGG | chr17 | 42913972 | 42913991 | 42913975 | - |
| SEQ ID NO 55484 | TCCGGAGTTCAGGTGTGAAA | TAG | chr17 | 42913962 | 42913981 | 42913965 | - |
| SEQ ID NO 55485 | GGAGTTCAGGTGTGAAATAG | CGG | chr17 | 42913959 | 42913978 | 42913962 | - |
| SEQ ID NO 55486 | AGTTCAGGTGTGAAATAGCG | GAG | chr17 | 42913957 | 42913976 | 42913960 | - |
| SEQ ID NO 55487 | GAAATAGCGGAGCTTACCCT | CAG | chr17 | 42913946 | 42913965 | 42913949 | - |
| SEQ ID NO 55488 | AAATAGCGGAGCTTACCCTC | AGG | chr17 | 42913945 | 42913964 | 42913948 | - |
| SEQ ID NO 55489 | CCTCAGGAAATCCATTGATA | CGG | chr17 | 42913929 | 42913948 | 42913932 | - |
| SEQ ID NO 55490 | CATTGATACGGTGATGATTT | GAG | chr17 | 42913917 | 42913936 | 42913920 | - |
| SEQ ID NO 55491 | ATTGATACGGTGATGATTTG | AGG | chr17 | 42913916 | 42913935 | 42913919 | - |
| SEQ ID NO 55492 | CGGTGATGATTTGAGGCCTT | TGG | chr17 | 42913909 | 42913928 | 42913912 | - |
| SEQ ID NO 55493 | GTGATGATTTGAGGCCTTTG | GAG | chr17 | 42913907 | 42913926 | 42913910 | - |
| SEQ ID NO 55494 | TGATGATTTGAGGCCTTTGG | AGG | chr17 | 42913906 | 42913925 | 42913909 | - |
| SEQ ID NO 55495 | TGGAGGTCGAACCCTGCACC | CAG | chr17 | 42913889 | 42913908 | 42913892 | - |
| SEQ ID NO 55496 | GGAGGTCGAACCCTGCACCC | AGG | chr17 | 42913888 | 42913907 | 42913891 | - |
| SEQ ID NO 55497 | CCAGGATGAAATAAATCTCT | TAG | chr17 | 42913870 | 42913889 | 42913873 | - |
| SEQ ID NO 55498 | GGATGAAATAAATCTCTTAG | CAG | chr17 | 42913867 | 42913886 | 42913870 | - |
| SEQ ID NO 55499 | ATGAAATAAATCTCTTAGCA | GAG | chr17 | 42913865 | 42913884 | 42913868 | - |
| SEQ ID NO 55500 | CTTAGCAGAGAAACCTGCAA | TAG | chr17 | 42913852 | 42913871 | 42913855 | - |
| SEQ ID NO 55501 | AAACCTGCAATAGCTCCCTT | GAG | chr17 | 42913842 | 42913861 | 42913845 | - |
| SEQ ID NO 55502 | TAGCTCCCTTGAGCATTCCT | TGG | chr17 | 42913832 | 42913851 | 42913835 | - |
| SEQ ID NO 55503 | GCATTCCTTGGTGCTGTGAC | TGG | chr17 | 42913820 | 42913839 | 42913823 | - |
| SEQ ID NO 55504 | GTGCTGTGACTGGCTCTGTT | TAG | chr17 | 42913810 | 42913829 | 42913813 | - |
| SEQ ID NO 55505 | CCCAAAACCTTGCTGACACT | GAG | chr17 | 42913770 | 42913789 | 42913773 | - |
| SEQ ID NO 55506 | CCTTGCTGACACTGAGTTAC | TGG | chr17 | 42913763 | 42913782 | 42913766 | - |
| SEQ ID NO 55507 | GACACTGAGTTACTGGATTC | CAG | chr17 | 42913756 | 42913775 | 42913759 | - |
| SEQ ID NO 55508 | CACTGAGTTACTGGATTCCA | GAG | chr17 | 42913754 | 42913773 | 42913757 | - |
| SEQ ID NO 55509 | GAGTTACTGGATTCCAGAGC | TGG | chr17 | 42913750 | 42913769 | 42913753 | - |
| SEQ ID NO 55510 | ACTGGATTCCAGAGCTGGCC | TAG | chr17 | 42913745 | 42913764 | 42913748 | - |
| SEQ ID NO 55511 | GCCCTGATTGCTTAATTTGA | TAG | chr17 | 42913696 | 42913715 | 42913699 | - |
| SEQ ID NO 55512 | GACCCTGCCCATCTACTCTC | AAG | chr17 | 42913672 | 42913691 | 42913675 | - |
| SEQ ID NO 55513 | CAAGTTGCAATTTGATGCCA | TAG | chr17 | 42913653 | 42913672 | 42913656 | - |
| SEQ ID NO 55514 | AGTTGCAATTTGATGCCATA | GAG | chr17 | 42913651 | 42913670 | 42913654 | - |
| SEQ ID NO 55515 | GAGCAACTCATGCTGACTTG | TGG | chr17 | 42913631 | 42913650 | 42913634 | - |

Figure 85 (Cont'd)

| | | | | | | | |
|---|---|---|---|---|---|---|---|
| SEQ ID NO 55516 | ACTCATGCTGACTTGTGGTC | TGG | chr17 | 42913626 | 42913645 | 42913629 | - |
| SEQ ID NO 55517 | CATGCTGACTTGTGGTCTGG | TAG | chr17 | 42913623 | 42913642 | 42913626 | - |
| SEQ ID NO 55518 | TGGTAGCCAATGTTCATTCT | TGG | chr17 | 42913606 | 42913625 | 42913609 | - |
| SEQ ID NO 55519 | TGGCCAACTCTGAATCTTTC | TGG | chr17 | 42913586 | 42913605 | 42913589 | - |
| SEQ ID NO 55520 | TTCTGGTTCTATGCTGATTT | TGG | chr17 | 42913569 | 42913588 | 42913572 | - |
| SEQ ID NO 55521 | TCTGGTTCTATGCTGATTTT | GGG | chr17 | 42913568 | 42913587 | 42913571 | - |
| SEQ ID NO 55522 | CAACTCTGCCTGTGCCCCTG | TGG | chr17 | 42913529 | 42913548 | 42913532 | - |
| SEQ ID NO 55523 | GTGCCCCTGTGGATGCATTT | AAG | chr17 | 42913518 | 42913537 | 42913521 | - |
| SEQ ID NO 55524 | TTAAGTCTCCCTATCCCTAA | TGG | chr17 | 42913500 | 42913519 | 42913503 | - |
| SEQ ID NO 55525 | TAAGTCTCCCTATCCCTAAT | GGG | chr17 | 42913499 | 42913518 | 42913502 | - |
| SEQ ID NO 55526 | CCTATCCCTAATGGGACTCT | CGG | chr17 | 42913491 | 42913510 | 42913494 | - |
| SEQ ID NO 55527 | ATGGGACTCTCGGTCAACTC | AAG | chr17 | 42913481 | 42913500 | 42913484 | - |
| SEQ ID NO 55528 | GGGACTCTCGGTCAACTCAA | GAG | chr17 | 42913479 | 42913498 | 42913482 | - |
| SEQ ID NO 55529 | GACTCTCGGTCAACTCAAGA | GAG | chr17 | 42913477 | 42913496 | 42913480 | - |
| SEQ ID NO 55530 | CTCTCGGTCAACTCAAGAGA | GAG | chr17 | 42913475 | 42913494 | 42913478 | - |
| SEQ ID NO 55531 | GAGAGCACTTTCTTCTCCA | AAG | chr17 | 42913457 | 42913476 | 42913460 | - |
| SEQ ID NO 55532 | AGAGCACTTTTCTTCTCCAA | AGG | chr17 | 42913456 | 42913475 | 42913459 | - |
| SEQ ID NO 55533 | GAGCACTTTTCTTCTCCAAA | GGG | chr17 | 42913455 | 42913474 | 42913458 | - |
| SEQ ID NO 55534 | TCTTCTCCAAAGGGAAAATG | CAG | chr17 | 42913446 | 42913465 | 42913449 | - |
| SEQ ID NO 55535 | CTTCTCCAAAGGGAAAATGC | AGG | chr17 | 42913445 | 42913464 | 42913448 | - |
| SEQ ID NO 55536 | CCAAAGGGAAAATGCAGGCA | CAG | chr17 | 42913440 | 42913459 | 42913443 | - |
| SEQ ID NO 55537 | AAAGGGAAAATGCAGGCACA | GAG | chr17 | 42913438 | 42913457 | 42913441 | - |
| SEQ ID NO 55538 | GAGAAACCAAATTATTTGTT | TAG | chr17 | 42913418 | 42913437 | 42913421 | - |
| SEQ ID NO 55539 | AGAAACCAAATTATTTGTTT | AGG | chr17 | 42913417 | 42913436 | 42913420 | - |
| SEQ ID NO 55540 | GAAACCAAATTATTTGTTTA | GGG | chr17 | 42913416 | 42913435 | 42913419 | - |
| SEQ ID NO 55541 | AAATTATTTGTTTAGGGAAA | CAG | chr17 | 42913410 | 42913429 | 42913413 | - |
| SEQ ID NO 55542 | ATTATTTGTTTAGGGAAACA | GAG | chr17 | 42913408 | 42913427 | 42913411 | - |
| SEQ ID NO 55543 | TTTGTTTAGGGAAACAGAGC | TAG | chr17 | 42913404 | 42913423 | 42913407 | - |
| SEQ ID NO 55544 | GGGAAACAGAGCTAGAAATT | TAG | chr17 | 42913396 | 42913415 | 42913399 | - |
| SEQ ID NO 55545 | AACAGAGCTAGAAATTTAGT | TGG | chr17 | 42913392 | 42913411 | 42913395 | - |
| SEQ ID NO 55546 | ACAGAGCTAGAAATTTAGTT | GGG | chr17 | 42913391 | 42913410 | 42913394 | - |
| SEQ ID NO 55547 | AGCTAGAAATTTAGTTGGGC | CAG | chr17 | 42913387 | 42913406 | 42913390 | - |
| SEQ ID NO 55548 | AAATTTAGTTGGGCCAGAAT | TAG | chr17 | 42913381 | 42913400 | 42913384 | - |
| SEQ ID NO 55549 | TGGGCCAGAATTAGAAACTT | CAG | chr17 | 42913372 | 42913391 | 42913375 | - |
| SEQ ID NO 55550 | ATCACATTGCATCTAAAATA | TAG | chr17 | 42913349 | 42913368 | 42913352 | - |
| SEQ ID NO 55551 | TCTAAAATATAGTAATTAAC | AAG | chr17 | 42913338 | 42913357 | 42913341 | - |
| SEQ ID NO 55552 | CATATATATTTTTCTTTTCA | AAG | chr17 | 42913273 | 42913292 | 42913276 | - |
| SEQ ID NO 55553 | TTTCTTTTCAAAGATGTTAT | GAG | chr17 | 42913263 | 42913282 | 42913266 | - |
| SEQ ID NO 55554 | CTTTTCAAAGATGTTATGAG | CAG | chr17 | 42913260 | 42913279 | 42913263 | - |
| SEQ ID NO 55555 | TTTTCAAAGATGTTATGAGC | AGG | chr17 | 42913259 | 42913278 | 42913262 | - |
| SEQ ID NO 55556 | CAAAGATGTTATGAGCAGGA | TGG | chr17 | 42913255 | 42913274 | 42913258 | - |
| SEQ ID NO 55557 | TTGTTTTGAATGATAATGTA | TGG | chr17 | 42913232 | 42913251 | 42913235 | - |
| SEQ ID NO 55558 | TGTATGGTATACTATATAAT | TAG | chr17 | 42913216 | 42913235 | 42913219 | - |
| SEQ ID NO 55559 | ATGGTATACTATATAATTAG | TAG | chr17 | 42913213 | 42913232 | 42913216 | - |
| SEQ ID NO 55560 | ATATAATTAGTAGCAAAAC | AAG | chr17 | 42913203 | 42913222 | 42913206 | - |
| SEQ ID NO 55561 | TATAATTAGTAGCAAAAACA | AGG | chr17 | 42913202 | 42913221 | 42913205 | - |
| SEQ ID NO 55562 | AACAAGGACTTTCAAATAAA | TAG | chr17 | 42913186 | 42913205 | 42913189 | - |

Figure 85 (Cont'd)

| SEQ ID NO | Sequence | | Chr | Pos1 | Pos2 | Pos3 | Strand |
|---|---|---|---|---|---|---|---|
| SEQ ID NO 55563 | ACAAGGACTTTCAAATAAAT | AGG | chr17 | 42913185 | 42913204 | 42913188 | - |
| SEQ ID NO 55564 | ACTTTCAAATAAATAGGCTT | CAG | chr17 | 42913179 | 42913198 | 42913182 | - |
| SEQ ID NO 55565 | AAATAGGCTTCAGCTTTTTT | TGG | chr17 | 42913169 | 42913188 | 42913172 | - |
| SEQ ID NO 55566 | AATAGGCTTCAGCTTTTTTT | GGG | chr17 | 42913168 | 42913187 | 42913171 | - |
| SEQ ID NO 55567 | ATAGGCTTCAGCTTTTTTTG | GGG | chr17 | 42913167 | 42913186 | 42913170 | - |
| SEQ ID NO 55568 | TAGGCTTCAGCTTTTTTTGG | GGG | chr17 | 42913166 | 42913185 | 42913169 | - |
| SEQ ID NO 55569 | AGGCTTCAGCTTTTTTTGGG | GGG | chr17 | 42913165 | 42913184 | 42913168 | - |
| SEQ ID NO 55570 | CTTCAGCTTTTTTTGGGGGG | TAG | chr17 | 42913162 | 42913181 | 42913165 | - |
| SEQ ID NO 55571 | TTCAGCTTTTTTTGGGGGGT | AGG | chr17 | 42913161 | 42913180 | 42913164 | - |
| SEQ ID NO 55572 | AGCTTTTTTTGGGGGGTAGG | TGG | chr17 | 42913158 | 42913177 | 42913161 | - |
| SEQ ID NO 55573 | GCTTTTTTTGGGGGGTAGGT | GGG | chr17 | 42913157 | 42913176 | 42913160 | - |
| SEQ ID NO 55574 | TTTTTTGGGGGGTAGGTGGG | TGG | chr17 | 42913154 | 42913173 | 42913157 | - |
| SEQ ID NO 55575 | TTTTTGGGGGGTAGGTGGGT | GGG | chr17 | 42913153 | 42913172 | 42913156 | - |
| SEQ ID NO 55576 | TTTTGGGGGGTAGGTGGGTG | GGG | chr17 | 42913152 | 42913171 | 42913155 | - |
| SEQ ID NO 55577 | TGGGGGGTAGGTGGGTGGGG | CAG | chr17 | 42913149 | 42913168 | 42913152 | - |
| SEQ ID NO 55578 | GGCAGAAATACTCTGCATAT | CAG | chr17 | 42913131 | 42913150 | 42913134 | - |
| SEQ ID NO 55579 | AAATACTCTGCATATCAGAT | GAG | chr17 | 42913126 | 42913145 | 42913129 | - |
| SEQ ID NO 55580 | TATCAGATGAGATTGAAAAA | CAG | chr17 | 42913114 | 42913133 | 42913117 | - |
| SEQ ID NO 55581 | ATCAGATGAGATTGAAAAAC | AGG | chr17 | 42913113 | 42913132 | 42913116 | - |
| SEQ ID NO 55582 | GATGAGATTGAAAAACAGGC | AAG | chr17 | 42913109 | 42913128 | 42913112 | - |
| SEQ ID NO 55583 | ATGAGATTGAAAAACAGGCA | AGG | chr17 | 42913108 | 42913127 | 42913111 | - |
| SEQ ID NO 55584 | GAGATTGAAAAACAGGCAAG | GAG | chr17 | 42913106 | 42913125 | 42913109 | - |
| SEQ ID NO 55585 | AGATTGAAAAACAGGCAAGG | AGG | chr17 | 42913105 | 42913124 | 42913108 | - |
| SEQ ID NO 55586 | GATTGAAAAACAGGCAAGGA | GGG | chr17 | 42913104 | 42913123 | 42913107 | - |
| SEQ ID NO 55587 | AAAAACAGGCAAGGAGGGCC | CGG | chr17 | 42913099 | 42913118 | 42913102 | - |
| SEQ ID NO 55588 | CAGGCAAGGAGGGCCCGGTG | CGG | chr17 | 42913094 | 42913113 | 42913097 | - |
| SEQ ID NO 55589 | GCAAGGAGGGCCCGGTGCGG | TGG | chr17 | 42913091 | 42913110 | 42913094 | - |
| SEQ ID NO 55590 | GTGGCTCATGCCTGTAATCC | TAG | chr17 | 42913072 | 42913091 | 42913075 | - |
| SEQ ID NO 55591 | TGCCTGTAATCCTAGCACCT | TGG | chr17 | 42913064 | 42913083 | 42913067 | - |
| SEQ ID NO 55592 | GCCTGTAATCCTAGCACCTT | GGG | chr17 | 42913063 | 42913082 | 42913066 | - |
| SEQ ID NO 55593 | CTGTAATCCTAGCACCTTGG | GAG | chr17 | 42913061 | 42913080 | 42913064 | - |
| SEQ ID NO 55594 | TGTAATCCTAGCACCTTGGG | AGG | chr17 | 42913060 | 42913079 | 42913063 | - |
| SEQ ID NO 55595 | TCCTAGCACCTTGGGAGGCC | AAG | chr17 | 42913055 | 42913074 | 42913058 | - |
| SEQ ID NO 55596 | CCTAGCACCTTGGGAGGCCA | AGG | chr17 | 42913054 | 42913073 | 42913057 | - |
| SEQ ID NO 55597 | AGCACCTTGGGAGGCCAAGG | CAG | chr17 | 42913051 | 42913070 | 42913054 | - |
| SEQ ID NO 55598 | GCACCTTGGGAGGCCAAGGC | AGG | chr17 | 42913050 | 42913069 | 42913053 | - |
| SEQ ID NO 55599 | CCTTGGGAGGCCAAGGCAGG | TGG | chr17 | 42913047 | 42913066 | 42913050 | - |
| SEQ ID NO 55600 | CCAAGGCAGGTGGATCACTT | GAG | chr17 | 42913037 | 42913056 | 42913040 | - |
| SEQ ID NO 55601 | CAAGGCAGGTGGATCACTTG | AGG | chr17 | 42913036 | 42913055 | 42913039 | - |
| SEQ ID NO 55602 | GCAGGTGGATCACTTGAGGT | CAG | chr17 | 42913032 | 42913051 | 42913035 | - |
| SEQ ID NO 55603 | CAGGTGGATCACTTGAGGTC | AGG | chr17 | 42913031 | 42913050 | 42913034 | - |
| SEQ ID NO 55604 | GGTGGATCACTTGAGGTCAG | GAG | chr17 | 42913029 | 42913048 | 42913032 | - |
| SEQ ID NO 55605 | TCACTTGAGGTCAGGAGTTC | GAG | chr17 | 42913023 | 42913042 | 42913026 | - |
| SEQ ID NO 55606 | TGAGGTCAGGAGTTCGAGAC | CAG | chr17 | 42913018 | 42913037 | 42913021 | - |
| SEQ ID NO 55607 | TCAGGAGTTCGAGACCAGCC | TGG | chr17 | 42913013 | 42913032 | 42913016 | - |
| SEQ ID NO 55608 | AATTCTAAAAATATAAAAAT | TAG | chr17 | 42912961 | 42912980 | 42912964 | - |
| SEQ ID NO 55609 | TAAAAATATAAAAATTAGCC | TGG | chr17 | 42912956 | 42912975 | 42912959 | - |

Figure 85 (Cont'd)

| SEQ ID NO 55610 | ATATAAAAATTAGCCTGGCA | TGG | chr17 | 42912951 | 42912970 | 42912954 | - |
| SEQ ID NO 55611 | TAAAAATTAGCCTGGCATGG | TGG | chr17 | 42912948 | 42912967 | 42912951 | - |
| SEQ ID NO 55612 | CCTGGCATGGTGGTGCACGC | CGG | chr17 | 42912938 | 42912957 | 42912941 | - |
| SEQ ID NO 55613 | GGCATGGTGGTGCACGCCGG | TAG | chr17 | 42912935 | 42912954 | 42912938 | - |
| SEQ ID NO 55614 | GTGGTGCACGCCGGTAGTCC | TAG | chr17 | 42912929 | 42912948 | 42912932 | - |
| SEQ ID NO 55615 | CGCCGGTAGTCCTAGCTACT | GAG | chr17 | 42912921 | 42912940 | 42912924 | - |
| SEQ ID NO 55616 | GCCGGTAGTCCTAGCTACTG | AGG | chr17 | 42912920 | 42912939 | 42912923 | - |
| SEQ ID NO 55617 | CGGTAGTCCTAGCTACTGAG | GAG | chr17 | 42912918 | 42912937 | 42912921 | - |
| SEQ ID NO 55618 | GGTAGTCCTAGCTACTGAGG | AGG | chr17 | 42912917 | 42912936 | 42912920 | - |
| SEQ ID NO 55619 | TCCTAGCTACTGAGGAGGCT | GAG | chr17 | 42912912 | 42912931 | 42912915 | - |
| SEQ ID NO 55620 | TACTGAGGAGGCTGAGACAT | GAG | chr17 | 42912905 | 42912924 | 42912908 | - |
| SEQ ID NO 55621 | GACATGAGAATCGCTTGAAC | CAG | chr17 | 42912890 | 42912909 | 42912893 | - |
| SEQ ID NO 55622 | ACATGAGAATCGCTTGAACC | AGG | chr17 | 42912889 | 42912908 | 42912892 | - |
| SEQ ID NO 55623 | ATGAGAATCGCTTGAACCAG | GAG | chr17 | 42912887 | 42912906 | 42912890 | - |
| SEQ ID NO 55624 | TGAGAATCGCTTGAACCAGG | AGG | chr17 | 42912886 | 42912905 | 42912889 | - |
| SEQ ID NO 55625 | GAATCGCTTGAACCAGGAGG | AAG | chr17 | 42912883 | 42912902 | 42912886 | - |
| SEQ ID NO 55626 | ATCGCTTGAACCAGGAGGAA | GAG | chr17 | 42912881 | 42912900 | 42912884 | - |
| SEQ ID NO 55627 | TCGCTTGAACCAGGAGGAAG | AGG | chr17 | 42912880 | 42912899 | 42912883 | - |
| SEQ ID NO 55628 | GAACCAGGAGGAAGAGGTTG | CAG | chr17 | 42912874 | 42912893 | 42912877 | - |
| SEQ ID NO 55629 | CAGGAGGAAGAGGTTGCAGT | GAG | chr17 | 42912870 | 42912889 | 42912873 | - |
| SEQ ID NO 55630 | GGAAGAGGTTGCAGTGAGCC | AAG | chr17 | 42912865 | 42912884 | 42912868 | - |
| SEQ ID NO 55631 | AAGATCGTGCCACTCCACTC | CAG | chr17 | 42912845 | 42912864 | 42912848 | - |
| SEQ ID NO 55632 | CGTGCCACTCCACTCCAGCC | TGG | chr17 | 42912840 | 42912859 | 42912843 | - |
| SEQ ID NO 55633 | GTGCCACTCCACTCCAGCCT | GGG | chr17 | 42912839 | 42912858 | 42912842 | - |
| SEQ ID NO 55634 | CTCCACTCCAGCCTGGGTGA | TAG | chr17 | 42912833 | 42912852 | 42912836 | - |
| SEQ ID NO 55635 | TCCACTCCAGCCTGGGTGAT | AGG | chr17 | 42912832 | 42912851 | 42912835 | - |
| SEQ ID NO 55636 | TAGGTGCGCCGTCTCAAAAA | AAG | chr17 | 42912813 | 42912832 | 42912816 | - |
| SEQ ID NO 55637 | GTCTCAAAAAAGAAAAAAA | AAG | chr17 | 42912803 | 42912822 | 42912806 | - |
| SEQ ID NO 55638 | AAAAAAAGAAAAAAAAGAA | AAG | chr17 | 42912798 | 42912817 | 42912801 | - |
| SEQ ID NO 55639 | AAAAGAAAAAAAAGAAAAG | CAG | chr17 | 42912795 | 42912814 | 42912798 | - |
| SEQ ID NO 55640 | AAAGAAAAAAAAGAAAAGC | AGG | chr17 | 42912794 | 42912813 | 42912797 | - |
| SEQ ID NO 55641 | AAAAAAAAGAAAAGCAGGC | AAG | chr17 | 42912790 | 42912809 | 42912793 | - |
| SEQ ID NO 55642 | AAAAAAAGAAAAGCAGGCA | AGG | chr17 | 42912789 | 42912808 | 42912792 | - |
| SEQ ID NO 55643 | AAAAAGAAAAGCAGGCAAG | GAG | chr17 | 42912787 | 42912806 | 42912790 | - |
| SEQ ID NO 55644 | AAAAGAAAAGCAGGCAAGG | AGG | chr17 | 42912786 | 42912805 | 42912789 | - |
| SEQ ID NO 55645 | AAAGAAAAGCAGGCAAGGAG | GAG | chr17 | 42912784 | 42912803 | 42912787 | - |
| SEQ ID NO 55646 | AAAAGCAGGCAAGGAGGAGT | TGG | chr17 | 42912780 | 42912799 | 42912783 | - |
| SEQ ID NO 55647 | GCAGGCAAGGAGGAGTTGGC | TAG | chr17 | 42912776 | 42912795 | 42912779 | - |
| SEQ ID NO 55648 | GCAAGGAGGAGTTGGCTAGC | TGG | chr17 | 42912772 | 42912791 | 42912775 | - |
| SEQ ID NO 55649 | AGGAGTTGGCTAGCTGGACA | TAG | chr17 | 42912766 | 42912785 | 42912769 | - |
| SEQ ID NO 55650 | AGTTGGCTAGCTGGACATAG | TGG | chr17 | 42912763 | 42912782 | 42912766 | - |
| SEQ ID NO 55651 | GACATAGTGGCTTGCACCTG | TAG | chr17 | 42912750 | 42912769 | 42912753 | - |
| SEQ ID NO 55652 | GTGGCTTGCACCTGTAGTCC | CAG | chr17 | 42912744 | 42912763 | 42912747 | - |
| SEQ ID NO 55653 | CACCTGTAGTCCCAGCTACG | CGG | chr17 | 42912736 | 42912755 | 42912739 | - |
| SEQ ID NO 55654 | ACCTGTAGTCCCAGCTACGC | GGG | chr17 | 42912735 | 42912754 | 42912738 | - |
| SEQ ID NO 55655 | CCCAGCTACGCGGGACGCTG | TGG | chr17 | 42912726 | 42912745 | 42912729 | - |
| SEQ ID NO 55656 | AGCTACGCGGGACGCTGTGG | TAG | chr17 | 42912723 | 42912742 | 42912726 | - |

Figure 85 (Cont'd)

| SEQ ID NO 55657 | GCTACGCGGGACGCTGTGGT | AGG | chr17 | 42912722 | 42912741 | 42912725 | - |
| SEQ ID NO 55658 | CTACGCGGGACGCTGTGGTA | GGG | chr17 | 42912721 | 42912740 | 42912724 | - |
| SEQ ID NO 55659 | CGCGGGACGCTGTGGTAGGG | TGG | chr17 | 42912718 | 42912737 | 42912721 | - |
| SEQ ID NO 55660 | GCGGGACGCTGTGGTAGGGT | GGG | chr17 | 42912717 | 42912736 | 42912720 | - |
| SEQ ID NO 55661 | GGGACGCTGTGGTAGGGTGG | GAG | chr17 | 42912715 | 42912734 | 42912718 | - |
| SEQ ID NO 55662 | GGACGCTGTGGTAGGGTGGG | AGG | chr17 | 42912714 | 42912733 | 42912717 | - |
| SEQ ID NO 55663 | GTAGGGTGGGAGGACTGCTT | GAG | chr17 | 42912704 | 42912723 | 42912707 | - |
| SEQ ID NO 55664 | GTGGGAGGACTGCTTGAGCC | CAG | chr17 | 42912699 | 42912718 | 42912702 | - |
| SEQ ID NO 55665 | TGGGAGGACTGCTTGAGCCC | AGG | chr17 | 42912698 | 42912717 | 42912701 | - |
| SEQ ID NO 55666 | CTGCTTGAGCCCAGGAATTC | AAG | chr17 | 42912690 | 42912709 | 42912693 | - |
| SEQ ID NO 55667 | GCTTGAGCCCAGGAATTCAA | GAG | chr17 | 42912688 | 42912707 | 42912691 | - |
| SEQ ID NO 55668 | TGAGCCCAGGAATTCAAGAG | CAG | chr17 | 42912685 | 42912704 | 42912688 | - |
| SEQ ID NO 55669 | CCAGGAATTCAAGAGCAGCC | TGG | chr17 | 42912680 | 42912699 | 42912683 | - |
| SEQ ID NO 55670 | CAGGAATTCAAGAGCAGCCT | GGG | chr17 | 42912679 | 42912698 | 42912682 | - |
| SEQ ID NO 55671 | CAAGAGCAGCCTGGGCAACA | TAG | chr17 | 42912671 | 42912690 | 42912674 | - |
| SEQ ID NO 55672 | AGCAGCCTGGGCAACATAGT | GAG | chr17 | 42912667 | 42912686 | 42912670 | - |
| SEQ ID NO 55673 | CTGTCTCAAAAAAAAAAAAA | AAG | chr17 | 42912641 | 42912660 | 42912644 | - |
| SEQ ID NO 55674 | GTCTCAAAAAAAAAAAAAAA | GAG | chr17 | 42912639 | 42912658 | 42912642 | - |
| SEQ ID NO 55675 | CTCAAAAAAAAAAAAAAAGA | GAG | chr17 | 42912637 | 42912656 | 42912640 | - |
| SEQ ID NO 55676 | AAAAAAAAAAAAAAAGAGAG | AAG | chr17 | 42912634 | 42912653 | 42912637 | - |
| SEQ ID NO 55677 | AAGATGTTGACTTTTCCTTT | AAG | chr17 | 42912614 | 42912633 | 42912617 | - |
| SEQ ID NO 55678 | TTCCTTTAAGAATGTGCTCT | TGG | chr17 | 42912601 | 42912620 | 42912604 | - |
| SEQ ID NO 55679 | TTTAAGAATGTGCTCTTGGT | TGG | chr17 | 42912597 | 42912616 | 42912600 | - |
| SEQ ID NO 55680 | GAATGTGCTCTTGGTTGGCT | TGG | chr17 | 42912592 | 42912611 | 42912595 | - |
| SEQ ID NO 55681 | AATGTGCTCTTGGTTGGCTT | GGG | chr17 | 42912591 | 42912610 | 42912594 | - |
| SEQ ID NO 55682 | TGCTCTTGGTTGGCTTGGGA | TAG | chr17 | 42912587 | 42912606 | 42912590 | - |
| SEQ ID NO 55683 | CTCTTGGTTGGCTTGGGATA | GAG | chr17 | 42912585 | 42912604 | 42912588 | - |
| SEQ ID NO 55684 | TGGTTGGCTTGGGATAGAGA | AAG | chr17 | 42912581 | 42912600 | 42912584 | - |
| SEQ ID NO 55685 | GGTTGGCTTGGGATAGAGAA | AGG | chr17 | 42912580 | 42912599 | 42912583 | - |
| SEQ ID NO 55686 | TTGGCTTGGGATAGAGAAAG | GAG | chr17 | 42912578 | 42912597 | 42912581 | - |
| SEQ ID NO 55687 | AAGGAGTCATATTTACCCTC | TAG | chr17 | 42912561 | 42912580 | 42912564 | - |
| SEQ ID NO 55688 | AGGAGTCATATTTACCCTCT | AGG | chr17 | 42912560 | 42912579 | 42912563 | - |
| SEQ ID NO 55689 | ATTTACCCTCTAGGAATTAA | AAG | chr17 | 42912551 | 42912570 | 42912554 | - |
| SEQ ID NO 55690 | CTAGGAATTAAAAGTAACAC | TGG | chr17 | 42912542 | 42912561 | 42912545 | - |
| SEQ ID NO 55691 | AGGAATTAAAAGTAACACTG | GAG | chr17 | 42912540 | 42912559 | 42912543 | - |
| SEQ ID NO 55692 | AAGTAACACTGGAGTGACCT | GAG | chr17 | 42912531 | 42912550 | 42912534 | - |
| SEQ ID NO 55693 | GTAACACTGGAGTGACCTGA | GAG | chr17 | 42912529 | 42912548 | 42912532 | - |
| SEQ ID NO 55694 | AACACTGGAGTGACCTGAGA | GAG | chr17 | 42912527 | 42912546 | 42912530 | - |
| SEQ ID NO 55695 | ACACTGGAGTGACCTGAGAG | AGG | chr17 | 42912526 | 42912545 | 42912529 | - |
| SEQ ID NO 55696 | GTGACCTGAGAGAGGAATCC | TGG | chr17 | 42912518 | 42912537 | 42912521 | - |
| SEQ ID NO 55697 | CTCCCCTTGTCATTTGCCC | AAG | chr17 | 42912493 | 42912512 | 42912496 | - |
| SEQ ID NO 55698 | TGTCATTTGCCCAAGATTT | CAG | chr17 | 42912486 | 42912505 | 42912489 | - |
| SEQ ID NO 55699 | TCATTTGCCCAAGATTTCA | GAG | chr17 | 42912484 | 42912503 | 42912487 | - |
| SEQ ID NO 55700 | AGCCTAATTGAAACATACAA | AAG | chr17 | 42912463 | 42912482 | 42912466 | - |
| SEQ ID NO 55701 | GAAACATACAAAAGCACCAC | CAG | chr17 | 42912454 | 42912473 | 42912457 | - |
| SEQ ID NO 55702 | AACATACAAAAGCACCACCA | GAG | chr17 | 42912452 | 42912471 | 42912455 | - |
| SEQ ID NO 55703 | GCACCACCAGAGTCGCCCTC | TAG | chr17 | 42912441 | 42912460 | 42912444 | - |

Figure 85 (Cont'd)

| SEQ ID NO 55704 | AGTCGCCCTCTAGCCTTCTG | AAG | chr17 | 42912431 | 42912450 | 42912434 | - |
|---|---|---|---|---|---|---|---|
| SEQ ID NO 55705 | CCTCTAGCCTTCTGAAGATC | CAG | chr17 | 42912425 | 42912444 | 42912428 | - |
| SEQ ID NO 55706 | CTAGCCTTCTGAAGATCCAG | TGG | chr17 | 42912422 | 42912441 | 42912425 | - |
| SEQ ID NO 55707 | TAGCCTTCTGAAGATCCAGT | GGG | chr17 | 42912421 | 42912440 | 42912424 | - |
| SEQ ID NO 55708 | AGCCTTCTGAAGATCCAGTG | GGG | chr17 | 42912420 | 42912439 | 42912423 | - |
| SEQ ID NO 55709 | CTTCTGAAGATCCAGTGGGG | TGG | chr17 | 42912417 | 42912436 | 42912420 | - |
| SEQ ID NO 55710 | AAGATCCAGTGGGGTGGATG | TGG | chr17 | 42912411 | 42912430 | 42912414 | - |
| SEQ ID NO 55711 | GATCCAGTGGGGTGGATGTG | GAG | chr17 | 42912409 | 42912428 | 42912412 | - |
| SEQ ID NO 55712 | CAGTGGGGTGGATGTGGAGC | CAG | chr17 | 42912405 | 42912424 | 42912408 | - |
| SEQ ID NO 55713 | TGGGGTGGATGTGGAGCCAG | TGG | chr17 | 42912402 | 42912421 | 42912405 | - |
| SEQ ID NO 55714 | GGTGGATGTGGAGCCAGTGG | AAG | chr17 | 42912399 | 42912418 | 42912402 | - |
| SEQ ID NO 55715 | GTGGAGCCAGTGGAAGAATC | TGG | chr17 | 42912392 | 42912411 | 42912395 | - |
| SEQ ID NO 55716 | CCAGTGGAAGAATCTGGAAA | AAG | chr17 | 42912386 | 42912405 | 42912389 | - |
| SEQ ID NO 55717 | GTGGAAGAATCTGGAAAAAG | CAG | chr17 | 42912383 | 42912402 | 42912386 | - |
| SEQ ID NO 55718 | GGAAGAATCTGGAAAAAGCA | GAG | chr17 | 42912381 | 42912400 | 42912384 | - |
| SEQ ID NO 55719 | GAATCTGGAAAAAGCAGAGC | TGG | chr17 | 42912377 | 42912396 | 42912380 | - |
| SEQ ID NO 55720 | AATCTGGAAAAAGCAGAGCT | GGG | chr17 | 42912376 | 42912395 | 42912379 | - |
| SEQ ID NO 55721 | AAAAGCAGAGCTGGGCTTAT | AAG | chr17 | 42912368 | 42912387 | 42912371 | - |
| SEQ ID NO 55722 | AAAGCAGAGCTGGGCTTATA | AGG | chr17 | 42912367 | 42912386 | 42912370 | - |
| SEQ ID NO 55723 | AGCAGAGCTGGGCTTATAAG | GAG | chr17 | 42912365 | 42912384 | 42912368 | - |
| SEQ ID NO 55724 | GCAGAGCTGGGCTTATAAGG | AGG | chr17 | 42912364 | 42912383 | 42912367 | - |
| SEQ ID NO 55725 | AGGAGGATGATGTAATGTGA | TAG | chr17 | 42912347 | 42912366 | 42912350 | - |
| SEQ ID NO 55726 | GAGGATGATGTAATGTGATA | GAG | chr17 | 42912345 | 42912364 | 42912348 | - |
| SEQ ID NO 55727 | AGGATGATGTAATGTGATAG | AGG | chr17 | 42912344 | 42912363 | 42912347 | - |
| SEQ ID NO 55728 | GATGATGTAATGTGATAGAG | GAG | chr17 | 42912342 | 42912361 | 42912345 | - |
| SEQ ID NO 55729 | TAATGTGATAGAGGAGATGT | CAG | chr17 | 42912335 | 42912354 | 42912338 | - |
| SEQ ID NO 55730 | TATACCTGAATGTTTTGACC | TAG | chr17 | 42912311 | 42912330 | 42912314 | - |
| SEQ ID NO 55731 | TTTTGACCTAGTGCAATATC | TGG | chr17 | 42912299 | 42912318 | 42912302 | - |
| SEQ ID NO 55732 | TTTGACCTAGTGCAATATCT | GGG | chr17 | 42912298 | 42912317 | 42912301 | - |
| SEQ ID NO 55733 | GTGCAATATCTGGGTCACTG | CAG | chr17 | 42912289 | 42912308 | 42912292 | - |
| SEQ ID NO 55734 | TCTGGGTCACTGCAGCCATT | CAG | chr17 | 42912281 | 42912300 | 42912284 | - |
| SEQ ID NO 55735 | CTGCAGCCATTCAGAAATCC | AAG | chr17 | 42912272 | 42912291 | 42912275 | - |
| SEQ ID NO 55736 | TGCAGCCATTCAGAAATCCA | AGG | chr17 | 42912271 | 42912290 | 42912274 | - |
| SEQ ID NO 55737 | ATACGATGAACATGTATGCA | CAG | chr17 | 42912246 | 42912265 | 42912249 | - |
| SEQ ID NO 55738 | ATGCACAGTAAAAAAAATAC | TAG | chr17 | 42912231 | 42912250 | 42912234 | - |
| SEQ ID NO 55739 | CACAGTAAAAAAAATACTAG | AAG | chr17 | 42912228 | 42912247 | 42912231 | - |
| SEQ ID NO 55740 | AGTAAAAAAAATACTAGAAG | CAG | chr17 | 42912225 | 42912244 | 42912228 | - |
| SEQ ID NO 55741 | ACCATCTATTAATTATACTT | AAG | chr17 | 42912189 | 42912208 | 42912192 | - |
| SEQ ID NO 55742 | TCTATTAATTATACTTAAGC | TGG | chr17 | 42912185 | 42912204 | 42912188 | - |
| SEQ ID NO 55743 | TAAGCTGGTCCCCATTACT | GAG | chr17 | 42912170 | 42912189 | 42912173 | - |
| SEQ ID NO 55744 | AGCTGGTCCCCATTACTGA | GAG | chr17 | 42912168 | 42912187 | 42912171 | - |
| SEQ ID NO 55745 | AGTGCATTACTATATAATTA | AAG | chr17 | 42912147 | 42912166 | 42912150 | - |
| SEQ ID NO 55746 | ACTATATAATTAAAGCCATT | TAG | chr17 | 42912139 | 42912158 | 42912142 | - |
| SEQ ID NO 55747 | TAATTAAAGCCATTTAGACA | TGG | chr17 | 42912133 | 42912152 | 42912136 | - |
| SEQ ID NO 55748 | AAAGCCATTTAGACATGGCT | TGG | chr17 | 42912128 | 42912147 | 42912131 | - |
| SEQ ID NO 55749 | CATTTAGACATGGCTTGGCA | TAG | chr17 | 42912123 | 42912142 | 42912126 | - |
| SEQ ID NO 55750 | ACATACTAAAAACTCCTCCT | TAG | chr17 | 42912083 | 42912102 | 42912086 | - |

Figure 85 (Cont'd)

| SEQ ID NO | Sequence | PAM | Chr | Start | End | Cut | Strand |
|---|---|---|---|---|---|---|---|
| SEQ ID NO 55751 | CATACTAAAAACTCCTCCTT | AGG | chr17 | 42912082 | 42912101 | 42912085 | - |
| SEQ ID NO 55752 | ACTAAAAACTCCTCCTTAGG | CAG | chr17 | 42912079 | 42912098 | 42912082 | - |
| SEQ ID NO 55753 | AGGCAGCCTTCTTTTCCTAT | CAG | chr17 | 42912062 | 42912081 | 42912065 | - |
| SEQ ID NO 55754 | CCTTCTTTTCCTATCAGATT | CAG | chr17 | 42912056 | 42912075 | 42912059 | - |
| SEQ ID NO 55755 | TTCTTTTCCTATCAGATTCA | GAG | chr17 | 42912054 | 42912073 | 42912057 | - |
| SEQ ID NO 55756 | GAGCTCCTTTCTCCTTTTCT | CGG | chr17 | 42912034 | 42912053 | 42912037 | - |
| SEQ ID NO 55757 | TCCTTTCTCCTTTTCTCGGT | AAG | chr17 | 42912030 | 42912049 | 42912033 | - |
| SEQ ID NO 55758 | TTTCTCGGTAAGAATGAACA | CAG | chr17 | 42912019 | 42912038 | 42912022 | - |
| SEQ ID NO 55759 | TTCTCGGTAAGAATGAACAC | AGG | chr17 | 42912018 | 42912037 | 42912021 | - |
| SEQ ID NO 55760 | TCGGTAAGAATGAACACAGG | TAG | chr17 | 42912015 | 42912034 | 42912018 | - |
| SEQ ID NO 55761 | GAACACAGGTAGAAAATTCT | CAG | chr17 | 42912004 | 42912023 | 42912007 | - |
| SEQ ID NO 55762 | ACAGGTAGAAAATTCTCAGT | TAG | chr17 | 42912000 | 42912019 | 42912003 | - |
| SEQ ID NO 55763 | CAGGTAGAAAATTCTCAGTT | AGG | chr17 | 42911999 | 42912018 | 42912002 | - |
| SEQ ID NO 55764 | AAATTCTCAGTTAGGATCTC | CAG | chr17 | 42911991 | 42912010 | 42911994 | - |
| SEQ ID NO 55765 | CTCAGTTAGGATCTCCAGCC | TGG | chr17 | 42911986 | 42912005 | 42911989 | - |
| SEQ ID NO 55766 | TCAGTTAGGATCTCCAGCCT | GGG | chr17 | 42911985 | 42912004 | 42911988 | - |
| SEQ ID NO 55767 | GATCTCCAGCCTGGGCTTGT | GAG | chr17 | 42911977 | 42911996 | 42911980 | - |
| SEQ ID NO 55768 | TCCAGCCTGGGCTTGTGAGC | TGG | chr17 | 42911973 | 42911992 | 42911976 | - |
| SEQ ID NO 55769 | GCTTGTGAGCTGGCCCTACC | TGG | chr17 | 42911963 | 42911982 | 42911966 | - |
| SEQ ID NO 55770 | TGTGAGCTGGCCCTACCTGG | AAG | chr17 | 42911960 | 42911979 | 42911963 | - |
| SEQ ID NO 55771 | TCTTGCTTTTGTATATGTGA | CGG | chr17 | 42911937 | 42911956 | 42911940 | - |
| SEQ ID NO 55772 | TGCTTTTGTATATGTGACGG | AAG | chr17 | 42911934 | 42911953 | 42911937 | - |
| SEQ ID NO 55773 | TGTATATGTGACGGAAGAAT | AAG | chr17 | 42911928 | 42911947 | 42911931 | - |
| SEQ ID NO 55774 | TATGTGACGGAAGAATAAGT | AAG | chr17 | 42911924 | 42911943 | 42911927 | - |
| SEQ ID NO 55775 | CGGAAGAATAAGTAAGTCTT | CAG | chr17 | 42911917 | 42911936 | 42911920 | - |
| SEQ ID NO 55776 | GGAAGAATAAGTAAGTCTTC | AGG | chr17 | 42911916 | 42911935 | 42911919 | - |
| SEQ ID NO 55777 | GAAGAATAAGTAAGTCTTCA | GGG | chr17 | 42911915 | 42911934 | 42911918 | - |
| SEQ ID NO 55778 | AAGAATAAGTAAGTCTTCAG | GGG | chr17 | 42911914 | 42911933 | 42911917 | - |
| SEQ ID NO 55779 | TAAGTCTTCAGGGGAAAATC | CAG | chr17 | 42911905 | 42911924 | 42911908 | - |
| SEQ ID NO 55780 | ATCCAGAACAACCCAACTTC | TAG | chr17 | 42911888 | 42911907 | 42911891 | - |
| SEQ ID NO 55781 | AACAACCCAACTTCTAGCAA | CAG | chr17 | 42911882 | 42911901 | 42911885 | - |
| SEQ ID NO 55782 | ACAACCCAACTTCTAGCAAC | AGG | chr17 | 42911881 | 42911900 | 42911884 | - |
| SEQ ID NO 55783 | TAGCAACAGGTCTTTCTCAA | TAG | chr17 | 42911868 | 42911887 | 42911871 | - |
| SEQ ID NO 55784 | GTCTTTCTCAATAGCTTCAT | TAG | chr17 | 42911859 | 42911878 | 42911862 | - |
| SEQ ID NO 55785 | AAAACATTACCCAATATGAT | TAG | chr17 | 42911829 | 42911848 | 42911832 | - |
| SEQ ID NO 55786 | AAACATTACCCAATATGATT | AGG | chr17 | 42911828 | 42911847 | 42911831 | - |
| SEQ ID NO 55787 | CAATATGATTAGGATTGTAA | AAG | chr17 | 42911818 | 42911837 | 42911821 | - |
| SEQ ID NO 55788 | ATATGATTAGGATTGTAAAA | GAG | chr17 | 42911816 | 42911835 | 42911819 | - |
| SEQ ID NO 55789 | TATGATTAGGATTGTAAAAG | AGG | chr17 | 42911815 | 42911834 | 42911818 | - |
| SEQ ID NO 55790 | ATTGTAAAAGAGGACCACCT | GAG | chr17 | 42911805 | 42911824 | 42911808 | - |
| SEQ ID NO 55791 | AAGAGGACCACCTGAGCTGA | CAG | chr17 | 42911798 | 42911817 | 42911801 | - |
| SEQ ID NO 55792 | ACCTGAGCTGACAGCACCTC | TGG | chr17 | 42911789 | 42911808 | 42911792 | - |
| SEQ ID NO 55793 | CAGCACCTCTGGCCTCAAAA | TGG | chr17 | 42911778 | 42911797 | 42911781 | - |
| SEQ ID NO 55794 | AGCACCTCTGGCCTCAAAAT | GGG | chr17 | 42911777 | 42911796 | 42911780 | - |
| SEQ ID NO 55795 | CCTCTGGCCTCAAAATGGGC | TGG | chr17 | 42911773 | 42911792 | 42911776 | - |
| SEQ ID NO 55796 | CTGGCCTCAAAATGGGCTGG | CAG | chr17 | 42911770 | 42911789 | 42911773 | - |
| SEQ ID NO 55797 | GCCTCAAAATGGGCTGGCAG | AAG | chr17 | 42911767 | 42911786 | 42911770 | - |

Figure 85 (Cont'd)

| | | | | | | | |
|---|---|---|---|---|---|---|---|
| SEQ ID NO 55798 | GGCTGGCAGAAGACCATTCA | AAG | chr17 | 42911756 | 42911775 | 42911759 | - |
| SEQ ID NO 55799 | AAGACCATTCAAAGATAAAA | TGG | chr17 | 42911747 | 42911766 | 42911750 | - |
| SEQ ID NO 55800 | AGACCATTCAAAGATAAAAT | GGG | chr17 | 42911746 | 42911765 | 42911749 | - |
| SEQ ID NO 55801 | AAAGATAAAATGGGCTGTTC | CAG | chr17 | 42911737 | 42911756 | 42911740 | - |
| SEQ ID NO 55802 | GATAAAATGGGCTGTTCCAG | TGG | chr17 | 42911734 | 42911753 | 42911737 | - |
| SEQ ID NO 55803 | ATAAAATGGGCTGTTCCAGT | GGG | chr17 | 42911733 | 42911752 | 42911736 | - |
| SEQ ID NO 55804 | AAAATGGGCTGTTCCAGTGG | GAG | chr17 | 42911731 | 42911750 | 42911734 | - |
| SEQ ID NO 55805 | TGGGCTGTTCCAGTGGGAGT | GAG | chr17 | 42911727 | 42911746 | 42911730 | - |
| SEQ ID NO 55806 | GGAGTGAGCTCCCTACTTGT | GAG | chr17 | 42911712 | 42911731 | 42911715 | - |
| SEQ ID NO 55807 | AGTGAGCTCCCTACTTGTGA | GAG | chr17 | 42911710 | 42911729 | 42911713 | - |
| SEQ ID NO 55808 | CCCTACTTGTGAGAGTATTC | AAG | chr17 | 42911702 | 42911721 | 42911705 | - |
| SEQ ID NO 55809 | TACTTGTGAGAGTATTCAAG | TAG | chr17 | 42911699 | 42911718 | 42911702 | - |
| SEQ ID NO 55810 | CTTGTGAGAGTATTCAAGTA | GAG | chr17 | 42911697 | 42911716 | 42911700 | - |
| SEQ ID NO 55811 | TGTGAGAGTATTCAAGTAGA | GAG | chr17 | 42911695 | 42911714 | 42911698 | - |
| SEQ ID NO 55812 | TGAGAGTATTCAAGTAGAGA | GAG | chr17 | 42911693 | 42911712 | 42911696 | - |
| SEQ ID NO 55813 | GAGAGTATTCAAGTAGAGAG | AGG | chr17 | 42911692 | 42911711 | 42911695 | - |
| SEQ ID NO 55814 | GAGTATTCAAGTAGAGAGAG | GAG | chr17 | 42911690 | 42911709 | 42911693 | - |
| SEQ ID NO 55815 | AGTATTCAAGTAGAGAGAGG | AGG | chr17 | 42911689 | 42911708 | 42911692 | - |
| SEQ ID NO 55816 | GTAGAGAGAGGAGGACCTCC | TGG | chr17 | 42911680 | 42911699 | 42911683 | - |
| SEQ ID NO 55817 | GAGAGAGGAGGACCTCCTGG | CGG | chr17 | 42911677 | 42911696 | 42911680 | - |
| SEQ ID NO 55818 | AGAGAGGAGGACCTCCTGGC | GGG | chr17 | 42911676 | 42911695 | 42911679 | - |
| SEQ ID NO 55819 | CCTGGCGGGAAACTTGCATA | TGG | chr17 | 42911662 | 42911681 | 42911665 | - |
| SEQ ID NO 55820 | TGCATATGGTGTACGTGATA | TGG | chr17 | 42911648 | 42911667 | 42911651 | - |
| SEQ ID NO 55821 | GATATGGCACCTCCATCTGA | AAG | chr17 | 42911632 | 42911651 | 42911635 | - |
| SEQ ID NO 55822 | TATGGCACCTCCATCTGAAA | GAG | chr17 | 42911630 | 42911649 | 42911633 | - |
| SEQ ID NO 55823 | CATCTGAAAGAGTCTGTGCT | GAG | chr17 | 42911619 | 42911638 | 42911622 | - |
| SEQ ID NO 55824 | ATCTGAAAGAGTCTGTGCTG | AGG | chr17 | 42911618 | 42911637 | 42911621 | - |
| SEQ ID NO 55825 | TCTGAAAGAGTCTGTGCTGA | GGG | chr17 | 42911617 | 42911636 | 42911620 | - |
| SEQ ID NO 55826 | GAAAGAGTCTGTGCTGAGGG | CAG | chr17 | 42911614 | 42911633 | 42911617 | - |
| SEQ ID NO 55827 | AAAGAGTCTGTGCTGAGGGC | AGG | chr17 | 42911613 | 42911632 | 42911616 | - |
| SEQ ID NO 55828 | AGTCTGTGCTGAGGGCAGGC | TGG | chr17 | 42911609 | 42911628 | 42911612 | - |
| SEQ ID NO 55829 | TCTGTGCTGAGGGCAGGCTG | GAG | chr17 | 42911607 | 42911626 | 42911610 | - |
| SEQ ID NO 55830 | GGGCAGGCTGGAGTCACACA | TGG | chr17 | 42911597 | 42911616 | 42911600 | - |
| SEQ ID NO 55831 | GGCAGGCTGGAGTCACACAT | GGG | chr17 | 42911596 | 42911615 | 42911599 | - |
| SEQ ID NO 55832 | CTGGAGTCACACATGGGAAT | AAG | chr17 | 42911590 | 42911609 | 42911593 | - |
| SEQ ID NO 55833 | AGTCACACATGGGAATAAGC | CAG | chr17 | 42911586 | 42911605 | 42911589 | - |
| SEQ ID NO 55834 | GTCACACATGGGAATAAGCC | AGG | chr17 | 42911585 | 42911604 | 42911588 | - |
| SEQ ID NO 55835 | TCCGTGATTTAATTCCACGA | CGG | chr17 | 42911544 | 42911563 | 42911547 | - |
| SEQ ID NO 55836 | GTGATTTAATTCCACGACGG | CAG | chr17 | 42911541 | 42911560 | 42911544 | - |
| SEQ ID NO 55837 | TTAATTCCACGACGGCAGAA | TGG | chr17 | 42911536 | 42911555 | 42911539 | - |
| SEQ ID NO 55838 | TTCCACGACGGCAGAATGGA | TGG | chr17 | 42911532 | 42911551 | 42911535 | - |
| SEQ ID NO 55839 | ATGTCACTTGCTCCAAATAC | CAG | chr17 | 42911508 | 42911527 | 42911511 | - |
| SEQ ID NO 55840 | CCAGTGCCCATTGCTTCAAA | TAG | chr17 | 42911489 | 42911508 | 42911492 | - |
| SEQ ID NO 55841 | GTGCCCATTGCTTCAAATAG | TAG | chr17 | 42911486 | 42911505 | 42911489 | - |
| SEQ ID NO 55842 | TAGTAGTCCTCCTCAATCCC | TGG | chr17 | 42911469 | 42911488 | 42911472 | - |
| SEQ ID NO 55843 | GTCCTCCTCAATCCCTGGCA | TGG | chr17 | 42911464 | 42911483 | 42911467 | - |
| SEQ ID NO 55844 | GTTGTTGACTTTAAACACCG | AAG | chr17 | 42911442 | 42911461 | 42911445 | - |

Figure 85 (Cont'd)

| | | | | | | | |
|---|---|---|---|---|---|---|---|
| SEQ ID NO 55845 | TCTTACAACGACTTCTTGTG | CGG | chr17 | 42911409 | 42911428 | 42911412 | - |
| SEQ ID NO 55846 | ACAACGACTTCTTGTGCGGC | TGG | chr17 | 42911405 | 42911424 | 42911408 | - |
| SEQ ID NO 55847 | GACTTCTTGTGCGGCTGGCC | CAG | chr17 | 42911400 | 42911419 | 42911403 | - |
| SEQ ID NO 55848 | ACTTCTTGTGCGGCTGGCCC | AGG | chr17 | 42911399 | 42911418 | 42911402 | - |
| SEQ ID NO 55849 | TGTGCGGCTGGCCCAGGACC | TGG | chr17 | 42911393 | 42911412 | 42911396 | - |
| SEQ ID NO 55850 | GTGCGGCTGGCCCAGGACCT | GGG | chr17 | 42911392 | 42911411 | 42911395 | - |
| SEQ ID NO 55851 | GGCTGGCCCAGGACCTGGGC | GAG | chr17 | 42911388 | 42911407 | 42911391 | - |
| SEQ ID NO 55852 | GCTGGCCCAGGACCTGGGCG | AGG | chr17 | 42911387 | 42911406 | 42911390 | - |
| SEQ ID NO 55853 | GGCCCAGGACCTGGGCGAGG | CAG | chr17 | 42911384 | 42911403 | 42911387 | - |
| SEQ ID NO 55854 | CCAGGACCTGGGCGAGGCAG | TAG | chr17 | 42911381 | 42911400 | 42911384 | - |
| SEQ ID NO 55855 | CAGGACCTGGGCGAGGCAGT | AGG | chr17 | 42911380 | 42911399 | 42911383 | - |
| SEQ ID NO 55856 | AGGACCTGGGCGAGGCAGTA | GGG | chr17 | 42911379 | 42911398 | 42911382 | - |
| SEQ ID NO 55857 | GGACCTGGGCGAGGCAGTAG | GGG | chr17 | 42911378 | 42911397 | 42911381 | - |
| SEQ ID NO 55858 | GCAGTAGGGGATGACACTGA | CGG | chr17 | 42911365 | 42911384 | 42911368 | - |
| SEQ ID NO 55859 | GGGATGACACTGACGGATGC | CAG | chr17 | 42911358 | 42911377 | 42911361 | - |
| SEQ ID NO 55860 | GGATGACACTGACGGATGCC | AGG | chr17 | 42911357 | 42911376 | 42911360 | - |
| SEQ ID NO 55861 | GATGACACTGACGGATGCCA | GGG | chr17 | 42911356 | 42911375 | 42911359 | - |
| SEQ ID NO 55862 | ATGACACTGACGGATGCCAG | GGG | chr17 | 42911355 | 42911374 | 42911358 | - |
| SEQ ID NO 55863 | GGGGCACTACCGCACTCTTG | CAG | chr17 | 42911336 | 42911355 | 42911339 | - |
| SEQ ID NO 55864 | GCACTACCGCACTCTTGCAG | AAG | chr17 | 42911333 | 42911352 | 42911336 | - |
| SEQ ID NO 55865 | CACTACCGCACTCTTGCAGA | AGG | chr17 | 42911332 | 42911351 | 42911335 | - |
| SEQ ID NO 55866 | CCGCACTCTTGCAGAAGGAC | AAG | chr17 | 42911327 | 42911346 | 42911330 | - |
| SEQ ID NO 55867 | TCTTGCAGAAGGACAAGACG | TAG | chr17 | 42911321 | 42911340 | 42911324 | - |
| SEQ ID NO 55868 | TGCAGAAGGACAAGACGTAG | AAG | chr17 | 42911318 | 42911337 | 42911321 | - |
| SEQ ID NO 55869 | AAGGACAAGACGTAGAAGAC | CAG | chr17 | 42911313 | 42911332 | 42911316 | - |
| SEQ ID NO 55870 | CGTAGAAGACCAGCTCGACT | TGG | chr17 | 42911303 | 42911322 | 42911306 | - |
| SEQ ID NO 55871 | GTAGAAGACCAGCTCGACTT | GGG | chr17 | 42911302 | 42911321 | 42911305 | - |
| SEQ ID NO 55872 | AAGACCAGCTCGACTTGGGA | TGG | chr17 | 42911298 | 42911317 | 42911301 | - |
| SEQ ID NO 55873 | AGACCAGCTCGACTTGGGAT | GGG | chr17 | 42911297 | 42911316 | 42911300 | - |
| SEQ ID NO 55874 | GACCAGCTCGACTTGGGATG | GGG | chr17 | 42911296 | 42911315 | 42911299 | - |
| SEQ ID NO 55875 | ACCAGCTCGACTTGGGATGG | GGG | chr17 | 42911295 | 42911314 | 42911298 | - |
| SEQ ID NO 55876 | CGACTTGGGATGGGGGTTTC | AAG | chr17 | 42911288 | 42911307 | 42911291 | - |
| SEQ ID NO 55877 | GACTTGGGATGGGGGTTTCA | AGG | chr17 | 42911287 | 42911306 | 42911290 | - |
| SEQ ID NO 55878 | CTTGGGATGGGGGTTTCAAG | GAG | chr17 | 42911285 | 42911304 | 42911288 | - |
| SEQ ID NO 55879 | ATGGGGGTTTCAAGGAGTCA | AAG | chr17 | 42911279 | 42911298 | 42911282 | - |
| SEQ ID NO 55880 | TTCAAGGAGTCAAAGACGTG | CAG | chr17 | 42911271 | 42911290 | 42911274 | - |
| SEQ ID NO 55881 | TCAAGGAGTCAAAGACGTGC | AGG | chr17 | 42911270 | 42911289 | 42911273 | - |
| SEQ ID NO 55882 | AAGGAGTCAAAGACGTGCAG | GAG | chr17 | 42911268 | 42911287 | 42911271 | - |
| SEQ ID NO 55883 | AGGAGTCAAAGACGTGCAGG | AGG | chr17 | 42911267 | 42911286 | 42911270 | - |
| SEQ ID NO 55884 | TCAAAGACGTGCAGGAGGAC | GAG | chr17 | 42911262 | 42911281 | 42911265 | - |
| SEQ ID NO 55885 | CAAAGACGTGCAGGAGGACG | AGG | chr17 | 42911261 | 42911280 | 42911264 | - |
| SEQ ID NO 55886 | AAAGACGTGCAGGAGGACGA | GGG | chr17 | 42911260 | 42911279 | 42911263 | - |
| SEQ ID NO 55887 | AGACGTGCAGGAGGACGAGG | GAG | chr17 | 42911258 | 42911277 | 42911261 | - |
| SEQ ID NO 55888 | GACGTGCAGGAGGACGAGGG | AGG | chr17 | 42911257 | 42911276 | 42911260 | - |
| SEQ ID NO 55889 | GAGGACGAGGGAGGCTACAA | TAG | chr17 | 42911248 | 42911267 | 42911251 | - |
| SEQ ID NO 55890 | GGACGAGGGAGGCTACAATA | GAG | chr17 | 42911246 | 42911265 | 42911249 | - |
| SEQ ID NO 55891 | AGGGAGGCTACAATAGAGCT | GAG | chr17 | 42911241 | 42911260 | 42911244 | - |

Figure 85 (Cont'd)

| SEQ ID NO 55892 | GGGAGGCTACAATAGAGCTG | AGG | chr17 | 42911240 | 42911259 | 42911243 | - |
| SEQ ID NO 55893 | AGGCTACAATAGAGCTGAGG | CGG | chr17 | 42911237 | 42911256 | 42911240 | - |
| SEQ ID NO 55894 | ACAATAGAGCTGAGGCGGAA | TGG | chr17 | 42911232 | 42911251 | 42911235 | - |
| SEQ ID NO 55895 | CAATAGAGCTGAGGCGGAAT | GGG | chr17 | 42911231 | 42911250 | 42911234 | - |
| SEQ ID NO 55896 | ATAGAGCTGAGGCGGAATGG | GAG | chr17 | 42911229 | 42911248 | 42911232 | - |
| SEQ ID NO 55897 | CGGAATGGGAGCCACTTGCT | GAG | chr17 | 42911217 | 42911236 | 42911220 | - |
| SEQ ID NO 55898 | ACTTGCTGAGTTTCCCCTTG | CAG | chr17 | 42911204 | 42911223 | 42911207 | - |
| SEQ ID NO 55899 | GCAGCTCTCCTGTACATGC | TGG | chr17 | 42911185 | 42911204 | 42911188 | - |
| SEQ ID NO 55900 | AGCTCTCCTGTACATGCTG | GAG | chr17 | 42911183 | 42911202 | 42911186 | - |
| SEQ ID NO 55901 | TCCCTGTACATGCTGGAGTT | GAG | chr17 | 42911178 | 42911197 | 42911181 | - |
| SEQ ID NO 55902 | CCTGTACATGCTGGAGTTGA | GAG | chr17 | 42911176 | 42911195 | 42911179 | - |
| SEQ ID NO 55903 | TACATGCTGGAGTTGAGAGC | CAG | chr17 | 42911172 | 42911191 | 42911175 | - |
| SEQ ID NO 55904 | CTGGAGTTGAGAGCCAGCCC | CAG | chr17 | 42911166 | 42911185 | 42911169 | - |
| SEQ ID NO 55905 | TGGAGTTGAGAGCCAGCCCC | AGG | chr17 | 42911165 | 42911184 | 42911168 | - |
| SEQ ID NO 55906 | TGAGAGCCAGCCCCAGGCCA | AAG | chr17 | 42911159 | 42911178 | 42911162 | - |
| SEQ ID NO 55907 | AGAGCCAGCCCCAGGCCAAA | GAG | chr17 | 42911157 | 42911176 | 42911160 | - |
| SEQ ID NO 55908 | CCCAGGCCAAAGAGCGTGCC | CAG | chr17 | 42911148 | 42911167 | 42911151 | - |
| SEQ ID NO 55909 | CCAGGCCAAAGAGCGTGCCC | AGG | chr17 | 42911147 | 42911166 | 42911150 | - |
| SEQ ID NO 55910 | AAGAGCGTGCCCAGGTTCTT | GAG | chr17 | 42911139 | 42911158 | 42911142 | - |
| SEQ ID NO 55911 | AGAGCGTGCCCAGGTTCTTG | AGG | chr17 | 42911138 | 42911157 | 42911141 | - |
| SEQ ID NO 55912 | AGCGTGCCCAGGTTCTTGAG | GAG | chr17 | 42911136 | 42911155 | 42911139 | - |
| SEQ ID NO 55913 | GCGTGCCCAGGTTCTTGAGG | AGG | chr17 | 42911135 | 42911154 | 42911138 | - |
| SEQ ID NO 55914 | GCCCAGGTTCTTGAGGAGGC | TGG | chr17 | 42911131 | 42911150 | 42911134 | - |
| SEQ ID NO 55915 | GGTTCTTGAGGAGGCTGGCA | AAG | chr17 | 42911126 | 42911145 | 42911129 | - |
| SEQ ID NO 55916 | GTTCTTGAGGAGGCTGGCAA | AGG | chr17 | 42911125 | 42911144 | 42911128 | - |
| SEQ ID NO 55917 | TTCTTGAGGAGGCTGGCAAA | GGG | chr17 | 42911124 | 42911143 | 42911127 | - |
| SEQ ID NO 55918 | GAGGAGGCTGGCAAAGGGTG | TGG | chr17 | 42911119 | 42911138 | 42911122 | - |
| SEQ ID NO 55919 | CAAAGGGTGTGGTGTCAATG | TGG | chr17 | 42911108 | 42911127 | 42911111 | - |
| SEQ ID NO 55920 | GTGTCAATGTGGACCCATTC | TGG | chr17 | 42911097 | 42911116 | 42911100 | - |
| SEQ ID NO 55921 | CTGGCTGCTCGCACCACCTC | TGG | chr17 | 42911078 | 42911097 | 42911081 | - |
| SEQ ID NO 55922 | TGGCTGCTCGCACCACCTCT | GGG | chr17 | 42911077 | 42911096 | 42911080 | - |
| SEQ ID NO 55923 | CACCACCTCTGGGCTTTCTC | CAG | chr17 | 42911067 | 42911086 | 42911070 | - |
| SEQ ID NO 55924 | CCACCTCTGGGCTTTCTCCA | GAG | chr17 | 42911065 | 42911084 | 42911068 | - |
| SEQ ID NO 55925 | TGGGCTTTCTCCAGAGTCCA | CAG | chr17 | 42911058 | 42911077 | 42911061 | - |
| SEQ ID NO 55926 | GGGCTTTCTCCAGAGTCCAC | AGG | chr17 | 42911057 | 42911076 | 42911060 | - |
| SEQ ID NO 55927 | GCTTTCTCCAGAGTCCACAG | GAG | chr17 | 42911055 | 42911074 | 42911058 | - |
| SEQ ID NO 55928 | CTTTCTCCAGAGTCCACAGG | AGG | chr17 | 42911054 | 42911073 | 42911057 | - |
| SEQ ID NO 55929 | GTCCACAGGAGGTCTACACC | CAG | chr17 | 42911043 | 42911062 | 42911046 | - |
| SEQ ID NO 55930 | AGGTCTACACCCAGTCCCTT | GAG | chr17 | 42911034 | 42911053 | 42911037 | - |
| SEQ ID NO 55931 | TCTACACCCAGTCCCTTGAG | CAG | chr17 | 42911031 | 42911050 | 42911034 | - |
| SEQ ID NO 55932 | ACACCCAGTCCCTTGAGCAG | CAG | chr17 | 42911028 | 42911047 | 42911031 | - |
| SEQ ID NO 55933 | GAGCAGCAGATAAAATCCGA | TGG | chr17 | 42911014 | 42911033 | 42911017 | - |
| SEQ ID NO 55934 | GCAGATAAAATCCGATGGCG | AAG | chr17 | 42911009 | 42911028 | 42911012 | - |
| SEQ ID NO 55935 | AATCCGATGGCGAAGCTGAA | CAG | chr17 | 42911001 | 42911020 | 42911004 | - |
| SEQ ID NO 55936 | ATCCGATGGCGAAGCTGAAC | AGG | chr17 | 42911000 | 42911019 | 42911003 | - |
| SEQ ID NO 55937 | CGATGGCGAAGCTGAACAGG | AAG | chr17 | 42910997 | 42911016 | 42911000 | - |
| SEQ ID NO 55938 | TGGCGAAGCTGAACAGGAAG | AAG | chr17 | 42910994 | 42911013 | 42910997 | - |

Figure 85 (Cont'd)

| SEQ ID NO 55939 | GGCGAAGCTGAACAGGAAGA | AGG | chr17 | 42910993 | 42911012 | 42910996 | - |
| SEQ ID NO 55940 | CTGAACAGGAAGAAGGTAAT | GAG | chr17 | 42910986 | 42911005 | 42910989 | - |
| SEQ ID NO 55941 | GTAATGAGAAAATATTTCTT | GAG | chr17 | 42910971 | 42910990 | 42910974 | - |
| SEQ ID NO 55942 | TAATGAGAAAATATTTCTTG | AGG | chr17 | 42910970 | 42910989 | 42910973 | - |
| SEQ ID NO 55943 | GAGAAAATATTTCTTGAGGC | TGG | chr17 | 42910966 | 42910985 | 42910969 | - |
| SEQ ID NO 55944 | ATTTCTTGAGGCTGGCATTA | TAG | chr17 | 42910958 | 42910977 | 42910961 | - |
| SEQ ID NO 55945 | GGCTGGCATTATAGATGCTG | TGG | chr17 | 42910949 | 42910968 | 42910952 | - |
| SEQ ID NO 55946 | CATTATAGATGCTGTGGATG | TGG | chr17 | 42910943 | 42910962 | 42910946 | - |
| SEQ ID NO 55947 | GATGCTGTGGATGTGGCTGA | AAG | chr17 | 42910936 | 42910955 | 42910939 | - |
| SEQ ID NO 55948 | GTGGCTGAAAGTTTCTGCAA | CAG | chr17 | 42910924 | 42910943 | 42910927 | - |
| SEQ ID NO 55949 | TTTCTGCAACAGCAATGCCT | GAG | chr17 | 42910913 | 42910932 | 42910916 | - |
| SEQ ID NO 55950 | CTGCAACAGCAATGCCTGAG | TGG | chr17 | 42910910 | 42910929 | 42910913 | - |
| SEQ ID NO 55951 | CAACAGCAATGCCTGAGTGG | AAG | chr17 | 42910907 | 42910926 | 42910910 | - |
| SEQ ID NO 55952 | AGCAATGCCTGAGTGGAAGA | AAG | chr17 | 42910903 | 42910922 | 42910906 | - |
| SEQ ID NO 55953 | GTGGAAGAAAGCATGACTGT | GAG | chr17 | 42910891 | 42910910 | 42910894 | - |
| SEQ ID NO 55954 | GGAAGAAAGCATGACTGTGA | GAG | chr17 | 42910889 | 42910908 | 42910892 | - |
| SEQ ID NO 55955 | GAAAGCATGACTGTGAGAGA | TAG | chr17 | 42910885 | 42910904 | 42910888 | - |
| SEQ ID NO 55956 | AAAGCATGACTGTGAGAGAT | AGG | chr17 | 42910884 | 42910903 | 42910887 | - |
| SEQ ID NO 55957 | GCATGACTGTGAGAGATAGG | AAG | chr17 | 42910881 | 42910900 | 42910884 | - |
| SEQ ID NO 55958 | CATGACTGTGAGAGATAGGA | AGG | chr17 | 42910880 | 42910899 | 42910883 | - |
| SEQ ID NO 55959 | TGTGAGAGATAGGAAGGATT | TGG | chr17 | 42910874 | 42910893 | 42910877 | - |
| SEQ ID NO 55960 | GTGAGAGATAGGAAGGATTT | GGG | chr17 | 42910873 | 42910892 | 42910876 | - |
| SEQ ID NO 55961 | GAAGGATTTGGGACCTTTGC | TAG | chr17 | 42910862 | 42910881 | 42910865 | - |
| SEQ ID NO 55962 | AGGATTTGGGACCTTTGCTA | GAG | chr17 | 42910860 | 42910879 | 42910863 | - |
| SEQ ID NO 55963 | GGATTTGGGACCTTTGCTAG | AGG | chr17 | 42910859 | 42910878 | 42910862 | - |
| SEQ ID NO 55964 | TTTGGGACCTTTGCTAGAGG | TGG | chr17 | 42910856 | 42910875 | 42910859 | - |
| SEQ ID NO 55965 | TTGGGACCTTTGCTAGAGGT | GGG | chr17 | 42910855 | 42910874 | 42910858 | - |
| SEQ ID NO 55966 | ACCTTTGCTAGAGGTGGGTT | TGG | chr17 | 42910850 | 42910869 | 42910853 | - |
| SEQ ID NO 55967 | CTTTGCTAGAGGTGGGTTTG | GAG | chr17 | 42910848 | 42910867 | 42910851 | - |
| SEQ ID NO 55968 | TTTGCTAGAGGTGGGTTTGG | AGG | chr17 | 42910847 | 42910866 | 42910850 | - |
| SEQ ID NO 55969 | TGCTAGAGGTGGGTTTGGAG | GAG | chr17 | 42910845 | 42910864 | 42910848 | - |
| SEQ ID NO 55970 | TAGAGGTGGGTTTGGAGGAG | TGG | chr17 | 42910842 | 42910861 | 42910845 | - |
| SEQ ID NO 55971 | AGAGGTGGGTTTGGAGGAGT | GGG | chr17 | 42910841 | 42910860 | 42910844 | - |
| SEQ ID NO 55972 | TGCCATCCGTTCTGCGACTG | TGG | chr17 | 42910813 | 42910832 | 42910816 | - |
| SEQ ID NO 55973 | GCGACTGTGGAATTAAATCA | CAG | chr17 | 42910800 | 42910819 | 42910803 | - |
| SEQ ID NO 55974 | CTGTGGAATTAAATCACAGA | TGG | chr17 | 42910796 | 42910815 | 42910799 | - |
| SEQ ID NO 55975 | TGGAATTAAATCACAGATGG | CAG | chr17 | 42910793 | 42910812 | 42910796 | - |
| SEQ ID NO 55976 | ATTAAATCACAGATGGCAGA | TGG | chr17 | 42910789 | 42910808 | 42910792 | - |
| SEQ ID NO 55977 | TTAAATCACAGATGGCAGAT | GGG | chr17 | 42910788 | 42910807 | 42910791 | - |
| SEQ ID NO 55978 | AAATCACAGATGGCAGATGG | GAG | chr17 | 42910786 | 42910805 | 42910789 | - |
| SEQ ID NO 55979 | AATCACAGATGGCAGATGGG | AGG | chr17 | 42910785 | 42910804 | 42910788 | - |
| SEQ ID NO 55980 | ATCACAGATGGCAGATGGGA | GGG | chr17 | 42910784 | 42910803 | 42910787 | - |
| SEQ ID NO 55981 | TGGCAGATGGAGGGTCGCC | TGG | chr17 | 42910776 | 42910795 | 42910779 | - |
| SEQ ID NO 55982 | CTTATTCCCATGTGTGACTC | CAG | chr17 | 42910753 | 42910772 | 42910756 | - |
| SEQ ID NO 55983 | ACTCCAGCCTGCCCTCAATA | TAG | chr17 | 42910737 | 42910756 | 42910740 | - |
| SEQ ID NO 55984 | GCCCTCAATATAGACTCTTT | CAG | chr17 | 42910727 | 42910746 | 42910730 | - |
| SEQ ID NO 55985 | TCAATATAGACTCTTTCAGA | TGG | chr17 | 42910723 | 42910742 | 42910726 | - |

Figure 85 (Cont'd)

| SEQ ID NO 55986 | AATATAGACTCTTTCAGATG | GAG | chr17 | 42910721 | 42910740 | 42910724 | - |
|---|---|---|---|---|---|---|---|
| SEQ ID NO 55987 | ATATAGACTCTTTCAGATGG | AGG | chr17 | 42910720 | 42910739 | 42910723 | - |
| SEQ ID NO 55988 | ACCGTATGCAAATTTCCTAC | CAG | chr17 | 42910674 | 42910693 | 42910677 | - |
| SEQ ID NO 55989 | CCGTATGCAAATTTCCTACC | AGG | chr17 | 42910673 | 42910692 | 42910676 | - |
| SEQ ID NO 55990 | GTATGCAAATTTCCTACCAG | GAG | chr17 | 42910671 | 42910690 | 42910674 | - |
| SEQ ID NO 55991 | TATGCAAATTTCCTACCAGG | AGG | chr17 | 42910670 | 42910689 | 42910673 | - |
| SEQ ID NO 55992 | ATCTCTACTTGAAATACCCT | CAG | chr17 | 42910640 | 42910659 | 42910643 | - |
| SEQ ID NO 55993 | CTCTACTTGAAATACCCTCA | GAG | chr17 | 42910638 | 42910657 | 42910641 | - |
| SEQ ID NO 55994 | TCTACTTGAAATACCCTCAG | AGG | chr17 | 42910637 | 42910656 | 42910640 | - |
| SEQ ID NO 55995 | ACTTGAAATACCCTCAGAGG | TAG | chr17 | 42910634 | 42910653 | 42910637 | - |
| SEQ ID NO 55996 | CTTGAAATACCCTCAGAGGT | AGG | chr17 | 42910633 | 42910652 | 42910636 | - |
| SEQ ID NO 55997 | TTGAAATACCCTCAGAGGTA | GGG | chr17 | 42910632 | 42910651 | 42910635 | - |
| SEQ ID NO 55998 | GAAATACCCTCAGAGGTAGG | GAG | chr17 | 42910630 | 42910649 | 42910633 | - |
| SEQ ID NO 55999 | GGAGCTCACCCCCACTATAA | CAG | chr17 | 42910611 | 42910630 | 42910614 | - |
| SEQ ID NO 56000 | CAGTCCATTTTATCTTTGAA | CGG | chr17 | 42910591 | 42910610 | 42910594 | - |
| SEQ ID NO 56001 | GAACGGAATTGATTGCTGAA | TAG | chr17 | 42910574 | 42910593 | 42910577 | - |
| SEQ ID NO 56002 | CTTCCTTGTCTGTGTGAAAC | TGG | chr17 | 42910549 | 42910568 | 42910552 | - |
| SEQ ID NO 56003 | CTAATACTGTCTATTTTTCT | CAG | chr17 | 42910519 | 42910538 | 42910522 | - |
| SEQ ID NO 56004 | ATTTTTCTCAGTTCTTTCTG | CAG | chr17 | 42910507 | 42910526 | 42910510 | - |
| SEQ ID NO 56005 | TTTTTCTCAGTTCTTTCTGC | AGG | chr17 | 42910506 | 42910525 | 42910509 | - |
| SEQ ID NO 56006 | TTTCTCAGTTCTTTCTGCAG | GAG | chr17 | 42910504 | 42910523 | 42910507 | - |
| SEQ ID NO 56007 | TCAGTTCTTTCTGCAGGAGT | TAG | chr17 | 42910500 | 42910519 | 42910503 | - |
| SEQ ID NO 56008 | TTCTTTCTGCAGGAGTTAGT | AAG | chr17 | 42910496 | 42910515 | 42910499 | - |
| SEQ ID NO 56009 | GAGTTAGTAAGTGATGAATC | TAG | chr17 | 42910484 | 42910503 | 42910487 | - |
| SEQ ID NO 56010 | CTCTGTCACACATTTGAACA | CAG | chr17 | 42910458 | 42910477 | 42910461 | - |
| SEQ ID NO 56011 | CTCTCTAACCTAAACATTCC | CAG | chr17 | 42910430 | 42910449 | 42910433 | - |
| SEQ ID NO 56012 | TCTCTAACCTAAACATTCCC | AGG | chr17 | 42910429 | 42910448 | 42910432 | - |
| SEQ ID NO 56013 | CCCAGGTTTTTCATGTGATA | TGG | chr17 | 42910412 | 42910431 | 42910415 | - |
| SEQ ID NO 56014 | TTTTCATGTGATATGGCTTC | CAG | chr17 | 42910405 | 42910424 | 42910408 | - |
| SEQ ID NO 56015 | TTTCATGTGATATGGCTTCC | AGG | chr17 | 42910404 | 42910423 | 42910407 | - |
| SEQ ID NO 56016 | TCCAGGTTCTTCCTCAAACA | TGG | chr17 | 42910387 | 42910406 | 42910390 | - |
| SEQ ID NO 56017 | TCTTCCTCAAACATGGAACC | CAG | chr17 | 42910380 | 42910399 | 42910383 | - |
| SEQ ID NO 56018 | GTTCCGTTCTTACAAATCTC | CAG | chr17 | 42910275 | 42910294 | 42910278 | - |
| SEQ ID NO 56019 | TTCCGTTCTTACAAATCTCC | AGG | chr17 | 42910274 | 42910293 | 42910277 | - |
| SEQ ID NO 56020 | TCCGTTCTTACAAATCTCCA | GGG | chr17 | 42910273 | 42910292 | 42910276 | - |
| SEQ ID NO 56021 | CCGTTCTTACAAATCTCCAG | GGG | chr17 | 42910272 | 42910291 | 42910275 | - |
| SEQ ID NO 56022 | GTTCTTACAAATCTCCAGGG | GAG | chr17 | 42910270 | 42910289 | 42910273 | - |
| SEQ ID NO 56023 | TCTCCAGGGGAGAAATTCCA | CAG | chr17 | 42910259 | 42910278 | 42910262 | - |
| SEQ ID NO 56024 | AGAAATTCCACAGTTTTGTT | AAG | chr17 | 42910249 | 42910268 | 42910252 | - |
| SEQ ID NO 56025 | GAAATTCCACAGTTTTGTTA | AGG | chr17 | 42910248 | 42910267 | 42910251 | - |
| SEQ ID NO 56026 | TTTGTTAAGGTCTTATATTC | CAG | chr17 | 42910235 | 42910254 | 42910238 | - |
| SEQ ID NO 56027 | CTTGTCTTACCCTTGTTAAT | TGG | chr17 | 42910175 | 42910194 | 42910178 | - |
| SEQ ID NO 56028 | TACCCTTGTTAATTGGATCT | AAG | chr17 | 42910168 | 42910187 | 42910171 | - |
| SEQ ID NO 56029 | GATCTAAGAAAACACATATT | CAG | chr17 | 42910153 | 42910172 | 42910156 | - |
| SEQ ID NO 56030 | ATCTAAGAAAACACATATTC | AGG | chr17 | 42910152 | 42910171 | 42910155 | - |
| SEQ ID NO 56031 | TAAGAAAACACATATTCAGG | CAG | chr17 | 42910149 | 42910168 | 42910152 | - |
| SEQ ID NO 56032 | AAGAAAACACATATTCAGGC | AGG | chr17 | 42910148 | 42910167 | 42910151 | - |

Figure 85 (Cont'd)

| SEQ ID NO 56033 | AGAAAACACATATTCAGGCA | GGG | chr17 | 42910147 | 42910166 | 42910150 | - |
| SEQ ID NO 56034 | ACACATATTCAGGCAGGGTG | CGG | chr17 | 42910142 | 42910161 | 42910145 | - |
| SEQ ID NO 56035 | CATATTCAGGCAGGGTGCGG | TGG | chr17 | 42910139 | 42910158 | 42910142 | - |
| SEQ ID NO 56036 | GTGGCTCACCCTTGTAATCC | CAG | chr17 | 42910120 | 42910139 | 42910123 | - |
| SEQ ID NO 56037 | CCCTTGTAATCCCAGCGCTT | TGG | chr17 | 42910112 | 42910131 | 42910115 | - |
| SEQ ID NO 56038 | CCTTGTAATCCCAGCGCTTT | GGG | chr17 | 42910111 | 42910130 | 42910114 | - |
| SEQ ID NO 56039 | TTGTAATCCCAGCGCTTTGG | GAG | chr17 | 42910109 | 42910128 | 42910112 | - |
| SEQ ID NO 56040 | TGTAATCCCAGCGCTTTGGG | AGG | chr17 | 42910108 | 42910127 | 42910111 | - |
| SEQ ID NO 56041 | TCCCAGCGCTTTGGGAGGCC | GAG | chr17 | 42910103 | 42910122 | 42910106 | - |
| SEQ ID NO 56042 | CCCAGCGCTTTGGGAGGCCG | AGG | chr17 | 42910102 | 42910121 | 42910105 | - |
| SEQ ID NO 56043 | AGCGCTTTGGGAGGCCGAGG | CGG | chr17 | 42910099 | 42910118 | 42910102 | - |
| SEQ ID NO 56044 | GCGCTTTGGGAGGCCGAGGC | GGG | chr17 | 42910098 | 42910117 | 42910101 | - |
| SEQ ID NO 56045 | CTTTGGGAGGCCGAGGCGGG | CGG | chr17 | 42910095 | 42910114 | 42910098 | - |
| SEQ ID NO 56046 | GGCCGAGGCGGGCGGATCAC | GAG | chr17 | 42910087 | 42910106 | 42910090 | - |
| SEQ ID NO 56047 | GCCGAGGCGGGCGGATCACG | AGG | chr17 | 42910086 | 42910105 | 42910089 | - |
| SEQ ID NO 56048 | AGGCGGGCGGATCACGAGGT | CAG | chr17 | 42910082 | 42910101 | 42910085 | - |
| SEQ ID NO 56049 | GGCGGGCGGATCACGAGGTC | AGG | chr17 | 42910081 | 42910100 | 42910084 | - |
| SEQ ID NO 56050 | CGGGCGGATCACGAGGTCAG | GAG | chr17 | 42910079 | 42910098 | 42910082 | - |
| SEQ ID NO 56051 | GATCACGAGGTCAGGAGATC | AAG | chr17 | 42910073 | 42910092 | 42910076 | - |
| SEQ ID NO 56052 | AGGTCAGGAGATCAAGACCA | CGG | chr17 | 42910066 | 42910085 | 42910069 | - |
| SEQ ID NO 56053 | CTGCTAAAAATACAAAAAAT | TAG | chr17 | 42910030 | 42910049 | 42910033 | - |
| SEQ ID NO 56054 | TAAAAATACAAAAAATTAGC | CGG | chr17 | 42910026 | 42910045 | 42910029 | - |
| SEQ ID NO 56055 | AAAAATACAAAAAATTAGCC | GGG | chr17 | 42910025 | 42910044 | 42910028 | - |
| SEQ ID NO 56056 | TACAAAAAATTAGCCGGGCA | TGG | chr17 | 42910020 | 42910039 | 42910023 | - |
| SEQ ID NO 56057 | AAAAAATTAGCCGGGCATGG | TGG | chr17 | 42910017 | 42910036 | 42910020 | - |
| SEQ ID NO 56058 | AAATTAGCCGGGCATGGTGG | CGG | chr17 | 42910014 | 42910033 | 42910017 | - |
| SEQ ID NO 56059 | AATTAGCCGGGCATGGTGGC | GGG | chr17 | 42910013 | 42910032 | 42910016 | - |
| SEQ ID NO 56060 | GGCATGGTGGCGGGCGCCTG | TAG | chr17 | 42910004 | 42910023 | 42910007 | - |
| SEQ ID NO 56061 | GTGGCGGGCGCCTGTAGTCC | CAG | chr17 | 42909998 | 42910017 | 42910001 | - |
| SEQ ID NO 56062 | CGCCTGTAGTCCCAGCTACT | CGG | chr17 | 42909990 | 42910009 | 42909993 | - |
| SEQ ID NO 56063 | CCTGTAGTCCCAGCTACTCG | GAG | chr17 | 42909988 | 42910007 | 42909991 | - |
| SEQ ID NO 56064 | TGTAGTCCCAGCTACTCGGA | GAG | chr17 | 42909986 | 42910005 | 42909989 | - |
| SEQ ID NO 56065 | GTAGTCCCAGCTACTCGGAG | AGG | chr17 | 42909985 | 42910004 | 42909988 | - |
| SEQ ID NO 56066 | CCCAGCTACTCGGAGAGGCT | GAG | chr17 | 42909980 | 42909999 | 42909983 | - |
| SEQ ID NO 56067 | CCAGCTACTCGGAGAGGCTG | AGG | chr17 | 42909979 | 42909998 | 42909982 | - |
| SEQ ID NO 56068 | GCTACTCGGAGAGGCTGAGG | CAG | chr17 | 42909976 | 42909995 | 42909979 | - |
| SEQ ID NO 56069 | CTACTCGGAGAGGCTGAGGC | AGG | chr17 | 42909975 | 42909994 | 42909978 | - |
| SEQ ID NO 56070 | ACTCGGAGAGGCTGAGGCAG | GAG | chr17 | 42909973 | 42909992 | 42909976 | - |
| SEQ ID NO 56071 | GAGAGGCTGAGGCAGGAGAA | TGG | chr17 | 42909968 | 42909987 | 42909971 | - |
| SEQ ID NO 56072 | GCAGGAGAATGGCGTGAACC | CAG | chr17 | 42909957 | 42909976 | 42909960 | - |
| SEQ ID NO 56073 | CAGGAGAATGGCGTGAACCC | AGG | chr17 | 42909956 | 42909975 | 42909959 | - |
| SEQ ID NO 56074 | GGAGAATGGCGTGAACCCAG | GAG | chr17 | 42909954 | 42909973 | 42909957 | - |
| SEQ ID NO 56075 | GAGAATGGCGTGAACCCAGG | AGG | chr17 | 42909953 | 42909972 | 42909956 | - |
| SEQ ID NO 56076 | AATGGCGTGAACCCAGGAGG | TGG | chr17 | 42909950 | 42909969 | 42909953 | - |
| SEQ ID NO 56077 | TGGCGTGAACCCAGGAGGTG | GAG | chr17 | 42909948 | 42909967 | 42909951 | - |
| SEQ ID NO 56078 | AACCCAGGAGGTGGAGCTTG | CAG | chr17 | 42909941 | 42909960 | 42909944 | - |
| SEQ ID NO 56079 | CAGGAGGTGGAGCTTGCAGT | GAG | chr17 | 42909937 | 42909956 | 42909940 | - |

Figure 85 (Cont'd)

| SEQ ID NO 56080 | GGTGGAGCTTGCAGTGAGCC | GAG | chr17 | 42909932 | 42909951 | 42909935 | - |
| SEQ ID NO 56081 | GAGATCGCACCACTGCACTC | TAG | chr17 | 42909912 | 42909931 | 42909915 | - |
| SEQ ID NO 56082 | CGCACCACTGCACTCTAGCC | TGG | chr17 | 42909907 | 42909926 | 42909910 | - |
| SEQ ID NO 56083 | GCACCACTGCACTCTAGCCT | GGG | chr17 | 42909906 | 42909925 | 42909909 | - |
| SEQ ID NO 56084 | CTGCACTCTAGCCTGGGTCA | CAG | chr17 | 42909900 | 42909919 | 42909903 | - |
| SEQ ID NO 56085 | GCACTCTAGCCTGGGTCACA | GAG | chr17 | 42909898 | 42909917 | 42909901 | - |
| SEQ ID NO 56086 | TCTAGCCTGGGTCACAGAGC | GAG | chr17 | 42909894 | 42909913 | 42909897 | - |
| SEQ ID NO 56087 | TCAAAACTCTGAACCTATAA | AAG | chr17 | 42909834 | 42909853 | 42909837 | - |
| SEQ ID NO 56088 | AAAACTCTGAACCTATAAAA | GAG | chr17 | 42909832 | 42909851 | 42909835 | - |
| SEQ ID NO 56089 | CCTATAAAGAGATCAACTG | CAG | chr17 | 42909821 | 42909840 | 42909824 | - |
| SEQ ID NO 56090 | GATCAACTGCAGTTATCTAT | TAG | chr17 | 42909810 | 42909829 | 42909813 | - |
| SEQ ID NO 56091 | ATCAACTGCAGTTATCTATT | AGG | chr17 | 42909809 | 42909828 | 42909812 | - |
| SEQ ID NO 56092 | AATGAATGTATTTAAATGAA | CAG | chr17 | 42909780 | 42909799 | 42909783 | - |
| SEQ ID NO 56093 | ATTTAAATGAACAGCTTTCC | TAG | chr17 | 42909771 | 42909790 | 42909774 | - |
| SEQ ID NO 56094 | TTTAAATGAACAGCTTTCCT | AGG | chr17 | 42909770 | 42909789 | 42909773 | - |
| SEQ ID NO 56095 | TCGTGTTAATTTGTTAAATT | TGG | chr17 | 42909744 | 42909763 | 42909747 | - |
| SEQ ID NO 56096 | TGTTAATTTGTTAAATTTGG | CAG | chr17 | 42909741 | 42909760 | 42909744 | - |
| SEQ ID NO 56097 | AATTTGGCAGATTCCCTGAA | AAG | chr17 | 42909728 | 42909747 | 42909731 | - |
| SEQ ID NO 56098 | AGATTCCCTGAAAAGTAAAT | TAG | chr17 | 42909720 | 42909739 | 42909723 | - |
| SEQ ID NO 56099 | GATTCCCTGAAAAGTAAATT | AGG | chr17 | 42909719 | 42909738 | 42909722 | - |
| SEQ ID NO 56100 | ATTCCCTGAAAAGTAAATTA | GGG | chr17 | 42909718 | 42909737 | 42909721 | - |
| SEQ ID NO 56101 | AAGTAAATTAGGGCCTGTTG | AAG | chr17 | 42909708 | 42909727 | 42909711 | - |
| SEQ ID NO 56102 | AATTAGGGCCTGTTGAAGAC | CAG | chr17 | 42909703 | 42909722 | 42909706 | - |
| SEQ ID NO 56103 | AGGGCCTGTTGAAGACCAGT | AAG | chr17 | 42909699 | 42909718 | 42909702 | - |
| SEQ ID NO 56104 | TTGAAGACCAGTAAGAAATA | AAG | chr17 | 42909691 | 42909710 | 42909694 | - |
| SEQ ID NO 56105 | TAAGAAATAAAGATTGTAAA | AAG | chr17 | 42909680 | 42909699 | 42909683 | - |
| SEQ ID NO 56106 | TAAAGATTGTAAAAGCTCT | GAG | chr17 | 42909673 | 42909692 | 42909676 | - |
| SEQ ID NO 56107 | GTAAAAGCTCTGAGATTTC | AAG | chr17 | 42909665 | 42909684 | 42909668 | - |
| SEQ ID NO 56108 | GATTTCAAGCTAATTCAATT | TGG | chr17 | 42909651 | 42909670 | 42909654 | - |
| SEQ ID NO 56109 | TGGTGCGTTAATTTGATGTA | TGG | chr17 | 42909631 | 42909650 | 42909634 | - |
| SEQ ID NO 56110 | CTTCTACACAATTCATTCTA | TAG | chr17 | 42909605 | 42909624 | 42909608 | - |
| SEQ ID NO 56111 | CACAATTCATTCTATAGATC | TGG | chr17 | 42909599 | 42909618 | 42909602 | - |
| SEQ ID NO 56112 | ACAATTCATTCTATAGATCT | GGG | chr17 | 42909598 | 42909617 | 42909601 | - |
| SEQ ID NO 56113 | TATAGATCTGGGCACTCTTA | TAG | chr17 | 42909587 | 42909606 | 42909590 | - |
| SEQ ID NO 56114 | TTATAGAAATTAATCATTTC | AAG | chr17 | 42909570 | 42909589 | 42909573 | - |
| SEQ ID NO 56115 | CATTCTTGACTTTCAACCCA | CAG | chr17 | 42909542 | 42909561 | 42909545 | - |
| SEQ ID NO 56116 | TCAACCCACAGAAATGCTAA | CAG | chr17 | 42909530 | 42909549 | 42909533 | - |
| SEQ ID NO 56117 | CTAACAGTACTGATTACACA | CAG | chr17 | 42909514 | 42909533 | 42909517 | - |
| SEQ ID NO 56118 | TAACAGTACTGATTACACAC | AGG | chr17 | 42909513 | 42909532 | 42909516 | - |
| SEQ ID NO 56119 | TACTGATTACACACAGGATG | TGG | chr17 | 42909507 | 42909526 | 42909510 | - |
| SEQ ID NO 56120 | GATTACACACAGGATGTGGC | TGG | chr17 | 42909503 | 42909522 | 42909506 | - |
| SEQ ID NO 56121 | ACAGGATGTGGCTGGAATGC | TGG | chr17 | 42909495 | 42909514 | 42909498 | - |
| SEQ ID NO 56122 | CAGGATGTGGCTGGAATGCT | GGG | chr17 | 42909494 | 42909513 | 42909497 | - |
| SEQ ID NO 56123 | TGCTGGGATTTTGTCCTGAT | TAG | chr17 | 42909478 | 42909497 | 42909481 | - |
| SEQ ID NO 56124 | GCTGGGATTTTGTCCTGATT | AGG | chr17 | 42909477 | 42909496 | 42909480 | - |
| SEQ ID NO 56125 | CTGGGATTTTGTCCTGATTA | GGG | chr17 | 42909476 | 42909495 | 42909479 | - |
| SEQ ID NO 56126 | GGGATTTTGTCCTGATTAGG | GAG | chr17 | 42909474 | 42909493 | 42909477 | - |

Figure 85 (Cont'd)

| SEQ ID NO | Sequence | PAM | Chr | Start | End | Cut | Strand |
|---|---|---|---|---|---|---|---|
| SEQ ID NO 56127 | GATTTTGTCCTGATTAGGGA | GAG | chr17 | 42909472 | 42909491 | 42909475 | - |
| SEQ ID NO 56128 | GTCCTGATTAGGGAGAGAAA | CGG | chr17 | 42909466 | 42909485 | 42909469 | - |
| SEQ ID NO 56129 | GATTAGGGAGAGAAACGGAA | TGG | chr17 | 42909461 | 42909480 | 42909464 | - |
| SEQ ID NO 56130 | ATTAGGGAGAGAAACGGAAT | GGG | chr17 | 42909460 | 42909479 | 42909463 | - |
| SEQ ID NO 56131 | TTAGGGAGAGAAACGGAATG | GGG | chr17 | 42909459 | 42909478 | 42909462 | - |
| SEQ ID NO 56132 | GAGAGAAACGGAATGGGGTT | TGG | chr17 | 42909454 | 42909473 | 42909457 | - |
| SEQ ID NO 56133 | AGAGAAACGGAATGGGGTTT | GGG | chr17 | 42909453 | 42909472 | 42909456 | - |
| SEQ ID NO 56134 | GAGAAACGGAATGGGGTTTG | GGG | chr17 | 42909452 | 42909471 | 42909455 | - |
| SEQ ID NO 56135 | AGAAACGGAATGGGGTTTGG | GGG | chr17 | 42909451 | 42909470 | 42909454 | - |
| SEQ ID NO 56136 | AAACGGAATGGGGTTTGGGG | GAG | chr17 | 42909449 | 42909468 | 42909452 | - |
| SEQ ID NO 56137 | CGGAATGGGGTTTGGGGGAG | AAG | chr17 | 42909446 | 42909465 | 42909449 | - |
| SEQ ID NO 56138 | GGAATGGGGTTTGGGGGAGA | AGG | chr17 | 42909445 | 42909464 | 42909448 | - |
| SEQ ID NO 56139 | ATGGGGTTTGGGGGAGAAGG | AAG | chr17 | 42909442 | 42909461 | 42909445 | - |
| SEQ ID NO 56140 | TGGGGTTTGGGGGAGAAGGA | AGG | chr17 | 42909441 | 42909460 | 42909444 | - |
| SEQ ID NO 56141 | GGGGTTTGGGGGAGAAGGAA | GGG | chr17 | 42909440 | 42909459 | 42909443 | - |
| SEQ ID NO 56142 | GGTTTGGGGGAGAAGGAAGG | GAG | chr17 | 42909438 | 42909457 | 42909441 | - |
| SEQ ID NO 56143 | TGGGGGAGAAGGAAGGGAGT | CAG | chr17 | 42909434 | 42909453 | 42909437 | - |
| SEQ ID NO 56144 | GAGAAGGAAGGGAGTCAGAT | CAG | chr17 | 42909429 | 42909448 | 42909432 | - |
| SEQ ID NO 56145 | TCAGATCAGCCCATACCTGA | CAG | chr17 | 42909415 | 42909434 | 42909418 | - |
| SEQ ID NO 56146 | CAGATCAGCCCATACCTGAC | AGG | chr17 | 42909414 | 42909433 | 42909417 | - |
| SEQ ID NO 56147 | GCCCATACCTGACAGGACTC | CAG | chr17 | 42909407 | 42909426 | 42909410 | - |
| SEQ ID NO 56148 | GACTCCAGCAACAACTTGAT | GAG | chr17 | 42909392 | 42909411 | 42909395 | - |
| SEQ ID NO 56149 | ACTCCAGCAACAACTTGATG | AGG | chr17 | 42909391 | 42909410 | 42909394 | - |
| SEQ ID NO 56150 | AACAACTTGATGAGGAAAAT | GAG | chr17 | 42909383 | 42909402 | 42909386 | - |
| SEQ ID NO 56151 | AACTTGATGAGGAAAATGAG | CAG | chr17 | 42909380 | 42909399 | 42909383 | - |
| SEQ ID NO 56152 | TGATGAGGAAAATGAGCAGC | AAG | chr17 | 42909376 | 42909395 | 42909379 | - |
| SEQ ID NO 56153 | GATGAGGAAAATGAGCAGCA | AGG | chr17 | 42909375 | 42909394 | 42909378 | - |
| SEQ ID NO 56154 | GAGGAAAATGAGCAGCAAGG | TAG | chr17 | 42909372 | 42909391 | 42909375 | - |
| SEQ ID NO 56155 | GCAGCAAGGTAGATTCGTGA | CAG | chr17 | 42909361 | 42909380 | 42909364 | - |
| SEQ ID NO 56156 | CAAGGTAGATTCGTGACAGA | CAG | chr17 | 42909357 | 42909376 | 42909360 | - |
| SEQ ID NO 56157 | ATTCGTGACAGACAGACATT | CAG | chr17 | 42909349 | 42909368 | 42909352 | - |
| SEQ ID NO 56158 | CAGACAGACATTCAGCTGCA | CAG | chr17 | 42909341 | 42909360 | 42909344 | - |
| SEQ ID NO 56159 | AGACATTCAGCTGCACAGCC | CAG | chr17 | 42909336 | 42909355 | 42909339 | - |
| SEQ ID NO 56160 | CCAACCACAAAATGACATTC | AAG | chr17 | 42909309 | 42909328 | 42909312 | - |
| SEQ ID NO 56161 | TGACATTCAAGCACCTGCAA | CAG | chr17 | 42909297 | 42909316 | 42909300 | - |
| SEQ ID NO 56162 | CATTCAAGCACCTGCAACAG | AAG | chr17 | 42909294 | 42909313 | 42909297 | - |
| SEQ ID NO 56163 | TTCAAGCACCTGCAACAGAA | GAG | chr17 | 42909292 | 42909311 | 42909295 | - |
| SEQ ID NO 56164 | TCAAGCACCTGCAACAGAAG | AGG | chr17 | 42909291 | 42909310 | 42909294 | - |
| SEQ ID NO 56165 | AACAGAAGAGGCAACCATAA | CAG | chr17 | 42909279 | 42909298 | 42909282 | - |
| SEQ ID NO 56166 | GAGGCAACCATAACAGAACA | CAG | chr17 | 42909272 | 42909291 | 42909275 | - |
| SEQ ID NO 56167 | AGGCAACCATAACAGAACAC | AGG | chr17 | 42909271 | 42909290 | 42909274 | - |
| SEQ ID NO 56168 | ACCATAACAGAACACAGGTG | CAG | chr17 | 42909266 | 42909285 | 42909269 | - |
| SEQ ID NO 56169 | GAACACAGGTGCAGATCCTT | CAG | chr17 | 42909257 | 42909276 | 42909260 | - |
| SEQ ID NO 56170 | CAGGTGCAGATCCTTCAGCA | AAG | chr17 | 42909252 | 42909271 | 42909255 | - |
| SEQ ID NO 56171 | AGATCCTTCAGCAAAGAAAA | CAG | chr17 | 42909245 | 42909264 | 42909248 | - |
| SEQ ID NO 56172 | AGCAAAGAAAACAGCCCCTG | CAG | chr17 | 42909236 | 42909255 | 42909239 | - |
| SEQ ID NO 56173 | AACAGCCCCTGCAGAAATGT | TGG | chr17 | 42909227 | 42909246 | 42909230 | - |

Figure 85 (Cont'd)

| SEQ ID NO 56174 | CAGCCCTGCAGAAATGTTG | GAG | chr17 | 42909225 | 42909244 | 42909228 | - |
| SEQ ID NO 56175 | CCTGCAGAAATGTTGGAGCC | TGG | chr17 | 42909220 | 42909239 | 42909223 | - |
| SEQ ID NO 56176 | ATGTTGGAGCCTGGCAAACT | TAG | chr17 | 42909211 | 42909230 | 42909214 | - |
| SEQ ID NO 56177 | TGTTGGAGCCTGGCAAACTT | AGG | chr17 | 42909210 | 42909229 | 42909213 | - |
| SEQ ID NO 56178 | CTGGCAAACTTAGGTGCTCT | CAG | chr17 | 42909201 | 42909220 | 42909204 | - |
| SEQ ID NO 56179 | GCAAACTTAGGTGCTCTCAG | TGG | chr17 | 42909198 | 42909217 | 42909201 | - |
| SEQ ID NO 56180 | AGTGGAATTTTTGTAAATTA | AAG | chr17 | 42909180 | 42909199 | 42909183 | - |
| SEQ ID NO 56181 | GAATTTTTGTAAATTAAAGC | CAG | chr17 | 42909176 | 42909195 | 42909179 | - |
| SEQ ID NO 56182 | AAATTAAAGCCAGTACTCAA | AAG | chr17 | 42909166 | 42909185 | 42909169 | - |
| SEQ ID NO 56183 | AGCCAGTACTCAAAAGTCCA | AAG | chr17 | 42909159 | 42909178 | 42909162 | - |
| SEQ ID NO 56184 | AAAAGTCCAAAGATGCCTGT | TGG | chr17 | 42909148 | 42909167 | 42909151 | - |
| SEQ ID NO 56185 | AAAGTCCAAAGATGCCTGTT | GGG | chr17 | 42909147 | 42909166 | 42909150 | - |
| SEQ ID NO 56186 | AAGTCCAAAGATGCCTGTTG | GGG | chr17 | 42909146 | 42909165 | 42909149 | - |
| SEQ ID NO 56187 | AGTCCAAAGATGCCTGTTGG | GGG | chr17 | 42909145 | 42909164 | 42909148 | - |
| SEQ ID NO 56188 | CAAAGATGCCTGTTGGGGGC | TGG | chr17 | 42909141 | 42909160 | 42909144 | - |
| SEQ ID NO 56189 | AAAGATGCCTGTTGGGGGCT | GGG | chr17 | 42909140 | 42909159 | 42909143 | - |
| SEQ ID NO 56190 | TGCCTGTTGGGGGCTGGGTG | CAG | chr17 | 42909135 | 42909154 | 42909138 | - |
| SEQ ID NO 56191 | CTGTTGGGGGCTGGGTGCAG | CGG | chr17 | 42909132 | 42909151 | 42909135 | - |
| SEQ ID NO 56192 | GGGGGCTGGGTGCAGCGGCT | CAG | chr17 | 42909127 | 42909146 | 42909130 | - |
| SEQ ID NO 56193 | GACCTGTAATCCCAATACTT | TGG | chr17 | 42909105 | 42909124 | 42909108 | - |
| SEQ ID NO 56194 | ACCTGTAATCCCAATACTTT | GGG | chr17 | 42909104 | 42909123 | 42909107 | - |
| SEQ ID NO 56195 | CTGTAATCCCAATACTTTGG | GAG | chr17 | 42909102 | 42909121 | 42909105 | - |
| SEQ ID NO 56196 | TGTAATCCCAATACTTTGGG | AGG | chr17 | 42909101 | 42909120 | 42909104 | - |
| SEQ ID NO 56197 | TCCCAATACTTTGGGAGGCC | GAG | chr17 | 42909096 | 42909115 | 42909099 | - |
| SEQ ID NO 56198 | CCCAATACTTTGGGAGGCCG | AGG | chr17 | 42909095 | 42909114 | 42909098 | - |
| SEQ ID NO 56199 | ATACTTTGGGAGGCCGAGGT | GAG | chr17 | 42909091 | 42909110 | 42909094 | - |
| SEQ ID NO 56200 | ACTTTGGGAGGCCGAGGTGA | GAG | chr17 | 42909089 | 42909108 | 42909092 | - |
| SEQ ID NO 56201 | CTTTGGGAGGCCGAGGTGAG | AGG | chr17 | 42909088 | 42909107 | 42909091 | - |
| SEQ ID NO 56202 | CCGAGGTGAGAGGATCACTT | GAG | chr17 | 42909078 | 42909097 | 42909081 | - |
| SEQ ID NO 56203 | CGAGGTGAGAGGATCACTTG | AGG | chr17 | 42909077 | 42909096 | 42909080 | - |
| SEQ ID NO 56204 | GTGAGAGGATCACTTGAGGC | CAG | chr17 | 42909073 | 42909092 | 42909076 | - |
| SEQ ID NO 56205 | TGAGAGGATCACTTGAGGCC | AGG | chr17 | 42909072 | 42909091 | 42909075 | - |
| SEQ ID NO 56206 | AGAGGATCACTTGAGGCCAG | GAG | chr17 | 42909070 | 42909089 | 42909073 | - |
| SEQ ID NO 56207 | TCACTTGAGGCCAGGAGTTC | AAG | chr17 | 42909064 | 42909083 | 42909067 | - |
| SEQ ID NO 56208 | TGAGGCCAGGAGTTCAAGAC | TAG | chr17 | 42909059 | 42909078 | 42909062 | - |
| SEQ ID NO 56209 | CCAGGAGTTCAAGACTAGTC | TGG | chr17 | 42909054 | 42909073 | 42909057 | - |
| SEQ ID NO 56210 | CAGGAGTTCAAGACTAGTCT | GGG | chr17 | 42909053 | 42909072 | 42909056 | - |
| SEQ ID NO 56211 | CAAGACTAGTCTGGGCAACA | TAG | chr17 | 42909045 | 42909064 | 42909048 | - |
| SEQ ID NO 56212 | ACTAGTCTGGGCAACATAGC | AAG | chr17 | 42909041 | 42909060 | 42909044 | - |
| SEQ ID NO 56213 | AGACCCTGTCTCTTTAAAA | AAG | chr17 | 42909020 | 42909039 | 42909023 | - |
| SEQ ID NO 56214 | TAAAAAGATCAAAATTGAC | CAG | chr17 | 42909005 | 42909024 | 42909008 | - |
| SEQ ID NO 56215 | AAAAAAGATCAAAATTGACC | AGG | chr17 | 42909004 | 42909023 | 42909007 | - |
| SEQ ID NO 56216 | AGATCAAAATTGACCAGGCA | CGG | chr17 | 42908999 | 42909018 | 42909002 | - |
| SEQ ID NO 56217 | TCAAAATTGACCAGGCACGG | TGG | chr17 | 42908996 | 42909015 | 42908999 | - |
| SEQ ID NO 56218 | GTGGCTTATGCTTGTAATCC | CAG | chr17 | 42908977 | 42908996 | 42908980 | - |
| SEQ ID NO 56219 | TGCTTGTAATCCCAGCACTT | TGG | chr17 | 42908969 | 42908988 | 42908972 | - |
| SEQ ID NO 56220 | GCTTGTAATCCCAGCACTTT | GGG | chr17 | 42908968 | 42908987 | 42908971 | - |

Figure 85 (Cont'd)

| | | | | | | | |
|---|---|---|---|---|---|---|---|
| SEQ ID NO 56221 | TTGTAATCCCAGCACTTTGG | GAG | chr17 | 42908966 | 42908985 | 42908969 | - |
| SEQ ID NO 56222 | TGTAATCCCAGCACTTTGGG | AGG | chr17 | 42908965 | 42908984 | 42908968 | - |
| SEQ ID NO 56223 | TCCCAGCACTTTGGGAGGCC | GAG | chr17 | 42908960 | 42908979 | 42908963 | - |
| SEQ ID NO 56224 | CCCAGCACTTTGGGAGGCCG | AGG | chr17 | 42908959 | 42908978 | 42908962 | - |
| SEQ ID NO 56225 | AGCACTTTGGGAGGCCGAGG | TGG | chr17 | 42908956 | 42908975 | 42908959 | - |
| SEQ ID NO 56226 | GCACTTTGGGAGGCCGAGGT | GGG | chr17 | 42908955 | 42908974 | 42908958 | - |
| SEQ ID NO 56227 | CTTTGGGAGGCCGAGGTGGG | TGG | chr17 | 42908952 | 42908971 | 42908955 | - |
| SEQ ID NO 56228 | CCGAGGTGGGTGGATCACTT | GAG | chr17 | 42908942 | 42908961 | 42908945 | - |
| SEQ ID NO 56229 | CGAGGTGGGTGGATCACTTG | AGG | chr17 | 42908941 | 42908960 | 42908944 | - |
| SEQ ID NO 56230 | GTGGGTGGATCACTTGAGGT | CAG | chr17 | 42908937 | 42908956 | 42908940 | - |
| SEQ ID NO 56231 | TGGGTGGATCACTTGAGGTC | AGG | chr17 | 42908936 | 42908955 | 42908939 | - |
| SEQ ID NO 56232 | GGTGGATCACTTGAGGTCAG | GAG | chr17 | 42908934 | 42908953 | 42908937 | - |
| SEQ ID NO 56233 | TCACTTGAGGTCAGGAGTTT | GAG | chr17 | 42908928 | 42908947 | 42908931 | - |
| SEQ ID NO 56234 | TGAGGTCAGGAGTTTGAGAC | CAG | chr17 | 42908923 | 42908942 | 42908926 | - |
| SEQ ID NO 56235 | TTTGAGACCAGCCTGATCAA | CAG | chr17 | 42908911 | 42908930 | 42908914 | - |
| SEQ ID NO 56236 | TTGAGACCAGCCTGATCAAC | AGG | chr17 | 42908910 | 42908929 | 42908913 | - |
| SEQ ID NO 56237 | TAAAAAAAAAATTACAAAAT | TAG | chr17 | 42908870 | 42908889 | 42908873 | - |
| SEQ ID NO 56238 | AAAAAAATTACAAAATTAGC | CAG | chr17 | 42908866 | 42908885 | 42908869 | - |
| SEQ ID NO 56239 | AAAAAATTACAAAATTAGCC | AGG | chr17 | 42908865 | 42908884 | 42908868 | - |
| SEQ ID NO 56240 | AAATTACAAAATTAGCCAGG | TGG | chr17 | 42908862 | 42908881 | 42908865 | - |
| SEQ ID NO 56241 | AATTACAAAATTAGCCAGGT | GGG | chr17 | 42908861 | 42908880 | 42908864 | - |
| SEQ ID NO 56242 | ATTACAAAATTAGCCAGGTG | GGG | chr17 | 42908860 | 42908879 | 42908863 | - |
| SEQ ID NO 56243 | ACAAAATTAGCCAGGTGGGG | TGG | chr17 | 42908857 | 42908876 | 42908860 | - |
| SEQ ID NO 56244 | GTGGCTCACGCCTGTAATCC | CAG | chr17 | 42908838 | 42908857 | 42908841 | - |
| SEQ ID NO 56245 | GCCTGTAATCCCAGCTATTT | GAG | chr17 | 42908829 | 42908848 | 42908832 | - |
| SEQ ID NO 56246 | CTGTAATCCCAGCTATTTGA | GAG | chr17 | 42908827 | 42908846 | 42908830 | - |
| SEQ ID NO 56247 | TGTAATCCCAGCTATTTGAG | AGG | chr17 | 42908826 | 42908845 | 42908829 | - |
| SEQ ID NO 56248 | TCCCAGCTATTTGAGAGGCT | GAG | chr17 | 42908821 | 42908840 | 42908824 | - |
| SEQ ID NO 56249 | CCCAGCTATTTGAGAGGCTG | AGG | chr17 | 42908820 | 42908839 | 42908823 | - |
| SEQ ID NO 56250 | AGCTATTTGAGAGGCTGAGG | CAG | chr17 | 42908817 | 42908836 | 42908820 | - |
| SEQ ID NO 56251 | GCTATTTGAGAGGCTGAGGC | AGG | chr17 | 42908816 | 42908835 | 42908819 | - |
| SEQ ID NO 56252 | TATTTGAGAGGCTGAGGCAG | GAG | chr17 | 42908814 | 42908833 | 42908817 | - |
| SEQ ID NO 56253 | GCAGGAGAATTGCTTGAACT | CAG | chr17 | 42908798 | 42908817 | 42908801 | - |
| SEQ ID NO 56254 | CAGGAGAATTGCTTGAACTC | AGG | chr17 | 42908797 | 42908816 | 42908800 | - |
| SEQ ID NO 56255 | GGAGAATTGCTTGAACTCAG | GAG | chr17 | 42908795 | 42908814 | 42908798 | - |
| SEQ ID NO 56256 | GAGAATTGCTTGAACTCAGG | AGG | chr17 | 42908794 | 42908813 | 42908797 | - |
| SEQ ID NO 56257 | AATTGCTTGAACTCAGGAGG | TGG | chr17 | 42908791 | 42908810 | 42908794 | - |
| SEQ ID NO 56258 | TTGCTTGAACTCAGGAGGTG | GAG | chr17 | 42908789 | 42908808 | 42908792 | - |
| SEQ ID NO 56259 | TGCTTGAACTCAGGAGGTGG | AGG | chr17 | 42908788 | 42908807 | 42908791 | - |
| SEQ ID NO 56260 | AACTCAGGAGGTGGAGGTTA | CAG | chr17 | 42908782 | 42908801 | 42908785 | - |
| SEQ ID NO 56261 | CAGGAGGTGGAGGTTACAGT | GAG | chr17 | 42908778 | 42908797 | 42908781 | - |
| SEQ ID NO 56262 | GGTGGAGGTTACAGTGAGCC | GAG | chr17 | 42908773 | 42908792 | 42908776 | - |
| SEQ ID NO 56263 | GAGACTGCGCCACTGCACTC | TAG | chr17 | 42908753 | 42908772 | 42908756 | - |
| SEQ ID NO 56264 | TGCGCCACTGCACTCTAGCC | TGG | chr17 | 42908748 | 42908767 | 42908751 | - |
| SEQ ID NO 56265 | GCGCCACTGCACTCTAGCCT | GGG | chr17 | 42908747 | 42908766 | 42908750 | - |
| SEQ ID NO 56266 | TGCACTCTAGCCTGGGCAAC | AAG | chr17 | 42908740 | 42908759 | 42908743 | - |
| SEQ ID NO 56267 | CACTCTAGCCTGGGCAACAA | GAG | chr17 | 42908738 | 42908757 | 42908741 | - |

Figure 85 (Cont'd)

| | | | | | | | |
|---|---|---|---|---|---|---|---|
| SEQ ID NO 56268 | CGTCTCAAAAAAAAAAAAAA | AAG | chr17 | 42908707 | 42908726 | 42908710 | - |
| SEQ ID NO 56269 | GTCTCAAAAAAAAAAAAAAA | AGG | chr17 | 42908706 | 42908725 | 42908709 | - |
| SEQ ID NO 56270 | CAAAAAAAAAAAAAAAGGC | CAG | chr17 | 42908702 | 42908721 | 42908705 | - |
| SEQ ID NO 56271 | AAAAAAAAAAAAAAAGGCC | AGG | chr17 | 42908701 | 42908720 | 42908704 | - |
| SEQ ID NO 56272 | AAAAAAAAAAGGCCAGGCG | CGG | chr17 | 42908696 | 42908715 | 42908699 | - |
| SEQ ID NO 56273 | AAAAAAAGGCCAGGCGCGG | TGG | chr17 | 42908693 | 42908712 | 42908696 | - |
| SEQ ID NO 56274 | GTGGCTCATGCCTGCAATCC | CAG | chr17 | 42908674 | 42908693 | 42908677 | - |
| SEQ ID NO 56275 | TGCCTGCAATCCCAGCACTT | TGG | chr17 | 42908666 | 42908685 | 42908669 | - |
| SEQ ID NO 56276 | GCCTGCAATCCCAGCACTTT | GGG | chr17 | 42908665 | 42908684 | 42908668 | - |
| SEQ ID NO 56277 | CTGCAATCCCAGCACTTTGG | GAG | chr17 | 42908663 | 42908682 | 42908666 | - |
| SEQ ID NO 56278 | TGCAATCCCAGCACTTTGGG | AGG | chr17 | 42908662 | 42908681 | 42908665 | - |
| SEQ ID NO 56279 | TCCCAGCACTTTGGGAGGCT | GAG | chr17 | 42908657 | 42908676 | 42908660 | - |
| SEQ ID NO 56280 | CCCAGCACTTTGGGAGGCTG | AGG | chr17 | 42908656 | 42908675 | 42908659 | - |
| SEQ ID NO 56281 | AGCACTTTGGGAGGCTGAGG | CGG | chr17 | 42908653 | 42908672 | 42908656 | - |
| SEQ ID NO 56282 | CTTTGGGAGGCTGAGGCGGA | TGG | chr17 | 42908649 | 42908668 | 42908652 | - |
| SEQ ID NO 56283 | GGCTGAGGCGGATGGATCAC | TAG | chr17 | 42908641 | 42908660 | 42908644 | - |
| SEQ ID NO 56284 | GCTGAGGCGGATGGATCACT | AGG | chr17 | 42908640 | 42908659 | 42908643 | - |
| SEQ ID NO 56285 | AGGCGGATGGATCACTAGGT | CAG | chr17 | 42908636 | 42908655 | 42908639 | - |
| SEQ ID NO 56286 | GGCGGATGGATCACTAGGTC | AGG | chr17 | 42908635 | 42908654 | 42908638 | - |
| SEQ ID NO 56287 | CGGATGGATCACTAGGTCAG | GAG | chr17 | 42908633 | 42908652 | 42908636 | - |
| SEQ ID NO 56288 | GATCACTAGGTCAGGAGTTC | AAG | chr17 | 42908627 | 42908646 | 42908630 | - |
| SEQ ID NO 56289 | CTAGGTCAGGAGTTCAAGAC | CAG | chr17 | 42908622 | 42908641 | 42908625 | - |
| SEQ ID NO 56290 | TCAGGAGTTCAAGACCAGCC | TGG | chr17 | 42908617 | 42908636 | 42908620 | - |
| SEQ ID NO 56291 | CAAGACCAGCCTGGCCAATA | TGG | chr17 | 42908608 | 42908627 | 42908611 | - |
| SEQ ID NO 56292 | TCTACTAAAAATAAAAAAAT | TAG | chr17 | 42908573 | 42908592 | 42908576 | - |
| SEQ ID NO 56293 | CTAAAAATAAAAAAATTAGC | CAG | chr17 | 42908569 | 42908588 | 42908572 | - |
| SEQ ID NO 56294 | TAAAAATAAAAAAATTAGCC | AGG | chr17 | 42908568 | 42908587 | 42908571 | - |
| SEQ ID NO 56295 | ATAAAAAATTAGCCAGGTG | TGG | chr17 | 42908563 | 42908582 | 42908566 | - |
| SEQ ID NO 56296 | AAAAAATTAGCCAGGTGTGG | TGG | chr17 | 42908560 | 42908579 | 42908563 | - |
| SEQ ID NO 56297 | GGTGTGGTGGCACGTGCCTG | TAG | chr17 | 42908547 | 42908566 | 42908550 | - |
| SEQ ID NO 56298 | GTGGCACGTGCCTGTAGTCC | CAG | chr17 | 42908541 | 42908560 | 42908544 | - |
| SEQ ID NO 56299 | TGCCTGTAGTCCCAGCTACT | CGG | chr17 | 42908533 | 42908552 | 42908536 | - |
| SEQ ID NO 56300 | CTGTAGTCCCAGCTACTCGG | TAG | chr17 | 42908530 | 42908549 | 42908533 | - |
| SEQ ID NO 56301 | TGTAGTCCCAGCTACTCGGT | AGG | chr17 | 42908529 | 42908548 | 42908532 | - |
| SEQ ID NO 56302 | TCCCAGCTACTCGGTAGGCT | GAG | chr17 | 42908524 | 42908543 | 42908527 | - |
| SEQ ID NO 56303 | CCCAGCTACTCGGTAGGCTG | AGG | chr17 | 42908523 | 42908542 | 42908526 | - |
| SEQ ID NO 56304 | AGCTACTCGGTAGGCTGAGG | CAG | chr17 | 42908520 | 42908539 | 42908523 | - |
| SEQ ID NO 56305 | TACTCGGTAGGCTGAGGCAG | AAG | chr17 | 42908517 | 42908536 | 42908520 | - |
| SEQ ID NO 56306 | GGTAGGCTGAGGCAGAAGAA | TAG | chr17 | 42908512 | 42908531 | 42908515 | - |
| SEQ ID NO 56307 | GCAGAAGAATAGCTTGAACC | CAG | chr17 | 42908501 | 42908520 | 42908504 | - |
| SEQ ID NO 56308 | CAGAAGAATAGCTTGAACCC | AGG | chr17 | 42908500 | 42908519 | 42908503 | - |
| SEQ ID NO 56309 | AAGAATAGCTTGAACCCAGG | AAG | chr17 | 42908497 | 42908516 | 42908500 | - |
| SEQ ID NO 56310 | AATAGCTTGAACCCAGGAAG | CGG | chr17 | 42908494 | 42908513 | 42908497 | - |
| SEQ ID NO 56311 | TAGCTTGAACCCAGGAAGCG | GAG | chr17 | 42908492 | 42908511 | 42908495 | - |
| SEQ ID NO 56312 | AGCTTGAACCCAGGAAGCGG | AGG | chr17 | 42908491 | 42908510 | 42908494 | - |
| SEQ ID NO 56313 | AACCCAGGAAGCGGAGGTTG | CAG | chr17 | 42908485 | 42908504 | 42908488 | - |
| SEQ ID NO 56314 | CAGGAAGCGGAGGTTGCAGT | GAG | chr17 | 42908481 | 42908500 | 42908484 | - |

Figure 85 (Cont'd)

| SEQ ID NO 56315 | AGGAAGCGGAGGTTGCAGTG | AGG | chr17 | 42908480 | 42908499 | 42908483 | - |
| SEQ ID NO 56316 | AGCGGAGGTTGCAGTGAGGC | GAG | chr17 | 42908476 | 42908495 | 42908479 | - |
| SEQ ID NO 56317 | GAGGTTGCAGTGAGGCGAGA | TGG | chr17 | 42908472 | 42908491 | 42908475 | - |
| SEQ ID NO 56318 | GAGATGGCGCCACTGCACTC | CAG | chr17 | 42908456 | 42908475 | 42908459 | - |
| SEQ ID NO 56319 | GGCGCCACTGCACTCCAGCC | TGG | chr17 | 42908451 | 42908470 | 42908454 | - |
| SEQ ID NO 56320 | GCGCCACTGCACTCCAGCCT | GGG | chr17 | 42908450 | 42908469 | 42908453 | - |
| SEQ ID NO 56321 | CTGCACTCCAGCCTGGGCAA | CAG | chr17 | 42908444 | 42908463 | 42908447 | - |
| SEQ ID NO 56322 | GCACTCCAGCCTGGGCAACA | GAG | chr17 | 42908442 | 42908461 | 42908445 | - |
| SEQ ID NO 56323 | TCCAGCCTGGGCAACAGAGC | GAG | chr17 | 42908438 | 42908457 | 42908441 | - |
| SEQ ID NO 56324 | AAAAAAAAAAAAAATGCCTG | TGG | chr17 | 42908403 | 42908422 | 42908406 | - |
| SEQ ID NO 56325 | AAAAAAAAAATGCCTGTGGC | AAG | chr17 | 42908399 | 42908418 | 42908402 | - |
| SEQ ID NO 56326 | AAAAAAATGCCTGTGGCAAG | TGG | chr17 | 42908396 | 42908415 | 42908399 | - |
| SEQ ID NO 56327 | ATTTTATCTGTTTGATAATT | AAG | chr17 | 42908340 | 42908359 | 42908343 | - |
| SEQ ID NO 56328 | TTTTATCTGTTTGATAATTA | AGG | chr17 | 42908339 | 42908358 | 42908342 | - |
| SEQ ID NO 56329 | TTGATAATTAAGGATTTGCA | TGG | chr17 | 42908329 | 42908348 | 42908332 | - |
| SEQ ID NO 56330 | TAATTAAGGATTTGCATGGC | TGG | chr17 | 42908325 | 42908344 | 42908328 | - |
| SEQ ID NO 56331 | AAGGATTTGCATGGCTGGCG | CGG | chr17 | 42908320 | 42908339 | 42908323 | - |
| SEQ ID NO 56332 | GATTTGCATGGCTGGCGCGG | TGG | chr17 | 42908317 | 42908336 | 42908320 | - |
| SEQ ID NO 56333 | TGCCTGTAATCCCAATATTT | TAG | chr17 | 42908290 | 42908309 | 42908293 | - |
| SEQ ID NO 56334 | GCCTGTAATCCCAATATTTT | AGG | chr17 | 42908289 | 42908308 | 42908292 | - |
| SEQ ID NO 56335 | CTGTAATCCCAATATTTTAG | GAG | chr17 | 42908287 | 42908306 | 42908290 | - |
| SEQ ID NO 56336 | TGTAATCCCAATATTTTAGG | AGG | chr17 | 42908286 | 42908305 | 42908289 | - |
| SEQ ID NO 56337 | TCCCAATATTTTAGGAGGCT | GAG | chr17 | 42908281 | 42908300 | 42908284 | - |
| SEQ ID NO 56338 | CCCAATATTTTAGGAGGCTG | AGG | chr17 | 42908280 | 42908299 | 42908283 | - |
| SEQ ID NO 56339 | ATATTTTAGGAGGCTGAGGC | AAG | chr17 | 42908276 | 42908295 | 42908279 | - |
| SEQ ID NO 56340 | CTGAGGCAAGCCAATTGCTT | GAG | chr17 | 42908263 | 42908282 | 42908266 | - |
| SEQ ID NO 56341 | CAAGCCAATTGCTTGAGATC | AAG | chr17 | 42908257 | 42908276 | 42908260 | - |
| SEQ ID NO 56342 | CAATTGCTTGAGATCAAGAC | CAG | chr17 | 42908252 | 42908271 | 42908255 | - |
| SEQ ID NO 56343 | CTTGAGATCAAGACCAGCCT | GAG | chr17 | 42908246 | 42908265 | 42908249 | - |
| SEQ ID NO 56344 | GATCAAGACCAGCCTGAGCC | TGG | chr17 | 42908241 | 42908260 | 42908244 | - |
| SEQ ID NO 56345 | ATCAAGACCAGCCTGAGCCT | GGG | chr17 | 42908240 | 42908259 | 42908243 | - |
| SEQ ID NO 56346 | CAGCCTGAGCCTGGGCAACA | TAG | chr17 | 42908232 | 42908251 | 42908235 | - |
| SEQ ID NO 56347 | CCTGAGCCTGGGCAACATAG | CAG | chr17 | 42908229 | 42908248 | 42908232 | - |
| SEQ ID NO 56348 | CAGAACTCTGTCTCTACAAA | AAG | chr17 | 42908209 | 42908228 | 42908212 | - |
| SEQ ID NO 56349 | CTGTCTCTACAAAAGATAC | GAG | chr17 | 42908202 | 42908221 | 42908205 | - |
| SEQ ID NO 56350 | TACAAAAGATACGAGAAAT | TAG | chr17 | 42908195 | 42908214 | 42908198 | - |
| SEQ ID NO 56351 | AAAAGATACGAGAAATTAGC | TGG | chr17 | 42908191 | 42908210 | 42908194 | - |
| SEQ ID NO 56352 | AAAGATACGAGAAATTAGCT | GGG | chr17 | 42908190 | 42908209 | 42908193 | - |
| SEQ ID NO 56353 | TACGAGAAATTAGCTGGGT | TGG | chr17 | 42908185 | 42908204 | 42908188 | - |
| SEQ ID NO 56354 | AATTAGCTGGGTGTGGTGTG | TGG | chr17 | 42908178 | 42908197 | 42908181 | - |
| SEQ ID NO 56355 | TGGGTGTGGTGTGTGGCCTG | TGG | chr17 | 42908171 | 42908190 | 42908174 | - |
| SEQ ID NO 56356 | TGGTGTGTGGCCTGTGGTCC | CAG | chr17 | 42908165 | 42908184 | 42908168 | - |
| SEQ ID NO 56357 | GGCCTGTGGTCCCAGCTACT | CAG | chr17 | 42908157 | 42908176 | 42908160 | - |
| SEQ ID NO 56358 | TGTGGTCCCAGCTACTCAGA | TGG | chr17 | 42908153 | 42908172 | 42908156 | - |
| SEQ ID NO 56359 | TCCCAGCTACTCAGATGGCT | GAG | chr17 | 42908148 | 42908167 | 42908151 | - |
| SEQ ID NO 56360 | CCCAGCTACTCAGATGGCTG | AGG | chr17 | 42908147 | 42908166 | 42908150 | - |
| SEQ ID NO 56361 | AGCTACTCAGATGGCTGAGG | TGG | chr17 | 42908144 | 42908163 | 42908147 | - |

Figure 85 (Cont'd)

| SEQ ID NO 56362 | GCTACTCAGATGGCTGAGGT | GGG | chr17 | 42908143 | 42908162 | 42908146 | - |
| SEQ ID NO 56363 | TACTCAGATGGCTGAGGTGG | GAG | chr17 | 42908141 | 42908160 | 42908144 | - |
| SEQ ID NO 56364 | ACTCAGATGGCTGAGGTGGG | AGG | chr17 | 42908140 | 42908159 | 42908143 | - |
| SEQ ID NO 56365 | CTGAGGTGGGAGGATCGCTT | GAG | chr17 | 42908130 | 42908149 | 42908133 | - |
| SEQ ID NO 56366 | GTGGGAGGATCGCTTGAGCC | TGG | chr17 | 42908125 | 42908144 | 42908128 | - |
| SEQ ID NO 56367 | TGGGAGGATCGCTTGAGCCT | GGG | chr17 | 42908124 | 42908143 | 42908127 | - |
| SEQ ID NO 56368 | GGAGGATCGCTTGAGCCTGG | GAG | chr17 | 42908122 | 42908141 | 42908125 | - |
| SEQ ID NO 56369 | GAGGATCGCTTGAGCCTGGG | AGG | chr17 | 42908121 | 42908140 | 42908124 | - |
| SEQ ID NO 56370 | GATCGCTTGAGCCTGGGAGG | CAG | chr17 | 42908118 | 42908137 | 42908121 | - |
| SEQ ID NO 56371 | TCGCTTGAGCCTGGGAGGCA | GAG | chr17 | 42908116 | 42908135 | 42908119 | - |
| SEQ ID NO 56372 | CGCTTGAGCCTGGGAGGCAG | AGG | chr17 | 42908115 | 42908134 | 42908118 | - |
| SEQ ID NO 56373 | AGCCTGGGAGGCAGAGGTTG | CAG | chr17 | 42908109 | 42908128 | 42908112 | - |
| SEQ ID NO 56374 | TGGGAGGCAGAGGTTGCAGC | GAG | chr17 | 42908105 | 42908124 | 42908108 | - |
| SEQ ID NO 56375 | ATGATCGTGCCACTGCACTT | CAG | chr17 | 42908080 | 42908099 | 42908083 | - |
| SEQ ID NO 56376 | CGTGCCACTGCACTTCAGCC | TGG | chr17 | 42908075 | 42908094 | 42908078 | - |
| SEQ ID NO 56377 | CTGCACTTCAGCCTGGATGA | CAG | chr17 | 42908068 | 42908087 | 42908071 | - |
| SEQ ID NO 56378 | GCACTTCAGCCTGGATGACA | GAG | chr17 | 42908066 | 42908085 | 42908069 | - |
| SEQ ID NO 56379 | TTCAGCCTGGATGACAGAGC | GAG | chr17 | 42908062 | 42908081 | 42908065 | - |
| SEQ ID NO 56380 | ATCTCAAAATAAAAATAAA | AAG | chr17 | 42908034 | 42908053 | 42908037 | - |
| SEQ ID NO 56381 | TCTCAAAATAAAAATAAAA | AGG | chr17 | 42908033 | 42908052 | 42908036 | - |
| SEQ ID NO 56382 | AATAAAAAGGATTTGCACTG | TGG | chr17 | 42908020 | 42908039 | 42908023 | - |
| SEQ ID NO 56383 | TTGCACTGTGGCTGCACACC | CGG | chr17 | 42908008 | 42908027 | 42908011 | - |
| SEQ ID NO 56384 | TGCACACCCGGAATTCTCTG | TAG | chr17 | 42907996 | 42908015 | 42907999 | - |
| SEQ ID NO 56385 | ACACCCGGAATTCTCTGTAG | TAG | chr17 | 42907993 | 42908012 | 42907996 | - |
| SEQ ID NO 56386 | CACCCGGAATTCTCTGTAGT | AGG | chr17 | 42907992 | 42908011 | 42907995 | - |
| SEQ ID NO 56387 | AGGAATATCTTCTGTTTCTC | TGG | chr17 | 42907972 | 42907991 | 42907975 | - |
| SEQ ID NO 56388 | TTTCTCTGGTTATTTTAACC | TGG | chr17 | 42907958 | 42907977 | 42907961 | - |
| SEQ ID NO 56389 | TCTGGTTATTTTAACCTGGA | TGG | chr17 | 42907954 | 42907973 | 42907957 | - |
| SEQ ID NO 56390 | CTGGTTATTTTAACCTGGAT | GGG | chr17 | 42907953 | 42907972 | 42907956 | - |
| SEQ ID NO 56391 | AACCTGGATGGGTGACTCTG | TGG | chr17 | 42907942 | 42907961 | 42907945 | - |
| SEQ ID NO 56392 | TGGATGGGTGACTCTGTGGT | TGG | chr17 | 42907938 | 42907957 | 42907941 | - |
| SEQ ID NO 56393 | GGGTGACTCTGTGGTTGGTA | CAG | chr17 | 42907933 | 42907952 | 42907936 | - |
| SEQ ID NO 56394 | CTCTGTGGTTGGTACAGACA | TGG | chr17 | 42907927 | 42907946 | 42907930 | - |
| SEQ ID NO 56395 | TCTGTGGTTGGTACAGACAT | GGG | chr17 | 42907926 | 42907945 | 42907929 | - |
| SEQ ID NO 56396 | ACAGACATGGTTTTTATTT | AAG | chr17 | 42907914 | 42907933 | 42907917 | - |
| SEQ ID NO 56397 | CTTCACTACCTTATTTTTAT | AAG | chr17 | 42907880 | 42907899 | 42907883 | - |
| SEQ ID NO 56398 | TATTTTTATAAGTCCCTTCA | TGG | chr17 | 42907869 | 42907888 | 42907872 | - |
| SEQ ID NO 56399 | TATAAGTCCCTTCATGGTGT | TGG | chr17 | 42907863 | 42907882 | 42907866 | - |
| SEQ ID NO 56400 | ATAAGTCCCTTCATGGTGTT | GGG | chr17 | 42907862 | 42907881 | 42907865 | - |
| SEQ ID NO 56401 | TTTCCTTATCTGTAAAACAA | CGG | chr17 | 42907834 | 42907853 | 42907837 | - |
| SEQ ID NO 56402 | AAAACAACGGATTGCACTAC | TGG | chr17 | 42907821 | 42907840 | 42907824 | - |
| SEQ ID NO 56403 | TTGCACTACTGGATCCCTTT | CAG | chr17 | 42907810 | 42907829 | 42907813 | - |
| SEQ ID NO 56404 | CCCAAACATTCCCTGACTCT | GAG | chr17 | 42907787 | 42907806 | 42907790 | - |
| SEQ ID NO 56405 | CCAAACATTCCCTGACTCTG | AGG | chr17 | 42907786 | 42907805 | 42907789 | - |
| SEQ ID NO 56406 | CTGAGGTTTATCCCTATCCA | AAG | chr17 | 42907769 | 42907788 | 42907772 | - |
| SEQ ID NO 56407 | AAAGTGCCACAACTCTTAAT | CAG | chr17 | 42907750 | 42907769 | 42907753 | - |
| SEQ ID NO 56408 | GTGCCACAACTCTTAATCAG | CGG | chr17 | 42907747 | 42907766 | 42907750 | - |

Figure 85 (Cont'd)

| SEQ ID NO | Sequence | PAM | Chr | Start | End | Pos | Strand |
|---|---|---|---|---|---|---|---|
| SEQ ID NO 56409 | ACTCTTAATCAGCGGCTGCC | CAG | chr17 | 42907739 | 42907758 | 42907742 | - |
| SEQ ID NO 56410 | CTCTTAATCAGCGGCTGCCC | AGG | chr17 | 42907738 | 42907757 | 42907741 | - |
| SEQ ID NO 56411 | AATCAGCGGCTGCCCAGGTG | TGG | chr17 | 42907733 | 42907752 | 42907736 | - |
| SEQ ID NO 56412 | ATCAGCGGCTGCCCAGGTGT | GGG | chr17 | 42907732 | 42907751 | 42907735 | - |
| SEQ ID NO 56413 | CAGCGGCTGCCCAGGTGTGG | GAG | chr17 | 42907730 | 42907749 | 42907733 | - |
| SEQ ID NO 56414 | CGGCTGCCCAGGTGTGGGAG | CGG | chr17 | 42907727 | 42907746 | 42907730 | - |
| SEQ ID NO 56415 | GGCTGCCCAGGTGTGGGAGC | GGG | chr17 | 42907726 | 42907745 | 42907729 | - |
| SEQ ID NO 56416 | GCCCAGGTGTGGGAGCGGGC | TAG | chr17 | 42907722 | 42907741 | 42907725 | - |
| SEQ ID NO 56417 | CCCAGGTGTGGGAGCGGGCT | AGG | chr17 | 42907721 | 42907740 | 42907724 | - |
| SEQ ID NO 56418 | CCAGGTGTGGGAGCGGGCTA | GGG | chr17 | 42907720 | 42907739 | 42907723 | - |
| SEQ ID NO 56419 | CAGGTGTGGGAGCGGGCTAG | GGG | chr17 | 42907719 | 42907738 | 42907722 | - |
| SEQ ID NO 56420 | AGGTGTGGGAGCGGGCTAGG | GGG | chr17 | 42907718 | 42907737 | 42907721 | - |
| SEQ ID NO 56421 | GGAGCGGGCTAGGGGATGT | GAG | chr17 | 42907711 | 42907730 | 42907714 | - |
| SEQ ID NO 56422 | GAGCGGGCTAGGGGATGTG | AGG | chr17 | 42907710 | 42907729 | 42907713 | - |
| SEQ ID NO 56423 | CGGGCTAGGGGATGTGAGG | AAG | chr17 | 42907707 | 42907726 | 42907710 | - |
| SEQ ID NO 56424 | GGGATGTGAGGAAGAATACG | TGG | chr17 | 42907698 | 42907717 | 42907701 | - |
| SEQ ID NO 56425 | AGGAAGAATACGTGGTGTGT | CAG | chr17 | 42907690 | 42907709 | 42907693 | - |
| SEQ ID NO 56426 | AATACGTGGTGTGTCAGCTA | CAG | chr17 | 42907684 | 42907703 | 42907687 | - |
| SEQ ID NO 56427 | TACGTGGTGTGTCAGCTACA | GAG | chr17 | 42907682 | 42907701 | 42907685 | - |
| SEQ ID NO 56428 | CGTGGTGTGTCAGCTACAGA | GAG | chr17 | 42907680 | 42907699 | 42907683 | - |
| SEQ ID NO 56429 | TGGTGTGTCAGCTACAGAGA | GAG | chr17 | 42907678 | 42907697 | 42907681 | - |
| SEQ ID NO 56430 | GCCCTCCACCACCTACACCC | CAG | chr17 | 42907646 | 42907665 | 42907649 | - |
| SEQ ID NO 56431 | CTCCACCACCTACACCCCAG | TGG | chr17 | 42907643 | 42907662 | 42907646 | - |
| SEQ ID NO 56432 | ACCACCTACACCCCAGTGGT | GAG | chr17 | 42907639 | 42907658 | 42907642 | - |
| SEQ ID NO 56433 | TGAGTTCTTACCGAAATCTG | TAG | chr17 | 42907620 | 42907639 | 42907623 | - |
| SEQ ID NO 56434 | GAGTTCTTACCGAAATCTGT | AGG | chr17 | 42907619 | 42907638 | 42907622 | - |
| SEQ ID NO 56435 | TCTTACCGAAATCTGTAGGT | CGG | chr17 | 42907615 | 42907634 | 42907618 | - |
| SEQ ID NO 56436 | TCGGCTTTATCTTTCCCTGA | AAG | chr17 | 42907596 | 42907615 | 42907599 | - |
| SEQ ID NO 56437 | CTTTATCTTTCCCTGAAAGA | TGG | chr17 | 42907592 | 42907611 | 42907595 | - |
| SEQ ID NO 56438 | ATCTTTCCCTGAAAGATGGA | AAG | chr17 | 42907588 | 42907607 | 42907591 | - |
| SEQ ID NO 56439 | CTTTCCCTGAAAGATGGAAA | GAG | chr17 | 42907586 | 42907605 | 42907589 | - |
| SEQ ID NO 56440 | TCCCTGAAAGATGGAAAGAG | TAG | chr17 | 42907583 | 42907602 | 42907586 | - |
| SEQ ID NO 56441 | GAGTAGATGTGACCATCACG | TAG | chr17 | 42907566 | 42907585 | 42907569 | - |
| SEQ ID NO 56442 | GTATACACCTGCTGTGCCCA | TGG | chr17 | 42907544 | 42907563 | 42907547 | - |
| SEQ ID NO 56443 | CACCTGCTGTGCCCATGGCA | TGG | chr17 | 42907539 | 42907558 | 42907542 | - |
| SEQ ID NO 56444 | TGCTGTGCCCATGGCATGGC | CAG | chr17 | 42907535 | 42907554 | 42907538 | - |
| SEQ ID NO 56445 | CTGTGCCCATGGCATGGCCA | GAG | chr17 | 42907533 | 42907552 | 42907536 | - |
| SEQ ID NO 56446 | TGTGCCCATGGCATGGCCAG | AGG | chr17 | 42907532 | 42907551 | 42907535 | - |
| SEQ ID NO 56447 | GTGCCCATGGCATGGCCAGA | GGG | chr17 | 42907531 | 42907550 | 42907534 | - |
| SEQ ID NO 56448 | TGCCCATGGCATGGCCAGAG | GGG | chr17 | 42907530 | 42907549 | 42907533 | - |
| SEQ ID NO 56449 | ATGGCCAGAGGGCTCCCTA | AAG | chr17 | 42907520 | 42907539 | 42907523 | - |
| SEQ ID NO 56450 | TGGCCAGAGGGGCTCCCTAA | AGG | chr17 | 42907519 | 42907538 | 42907522 | - |
| SEQ ID NO 56451 | GGCCAGAGGGGCTCCCTAAA | GGG | chr17 | 42907518 | 42907537 | 42907521 | - |
| SEQ ID NO 56452 | CAGAGGGGCTCCCTAAAGGG | CAG | chr17 | 42907515 | 42907534 | 42907518 | - |
| SEQ ID NO 56453 | AGAGGGGCTCCCTAAAGGGC | AGG | chr17 | 42907514 | 42907533 | 42907517 | - |
| SEQ ID NO 56454 | GGGCTCCCTAAAGGGCAGGA | AAG | chr17 | 42907510 | 42907529 | 42907513 | - |
| SEQ ID NO 56455 | GCTCCCTAAAGGGCAGGAAA | GAG | chr17 | 42907508 | 42907527 | 42907511 | - |

Figure 85 (Cont'd)

| | | | | | | | |
|---|---|---|---|---|---|---|---|
| SEQ ID NO 56456 | CTAAAGGGCAGGAAAGAGAA | TGG | chr17 | 42907503 | 42907522 | 42907506 | - |
| SEQ ID NO 56457 | AAAGGGCAGGAAAGAGAATG | GAG | chr17 | 42907501 | 42907520 | 42907504 | - |
| SEQ ID NO 56458 | GCAGGAAAGAGAATGGAGTA | AAG | chr17 | 42907496 | 42907515 | 42907499 | - |
| SEQ ID NO 56459 | CAGGAAAGAGAATGGAGTAA | AGG | chr17 | 42907495 | 42907514 | 42907498 | - |
| SEQ ID NO 56460 | GAGAATGGAGTAAAGGTGAA | AAG | chr17 | 42907488 | 42907507 | 42907491 | - |
| SEQ ID NO 56461 | AGAATGGAGTAAAGGTGAAA | AGG | chr17 | 42907487 | 42907506 | 42907490 | - |
| SEQ ID NO 56462 | AAGGTGAAAGGTCCTCATC | TGG | chr17 | 42907476 | 42907495 | 42907479 | - |
| SEQ ID NO 56463 | AGGTGAAAGGTCCTCATCT | GGG | chr17 | 42907475 | 42907494 | 42907478 | - |
| SEQ ID NO 56464 | GTGAAAGGTCCTCATCTGG | GAG | chr17 | 42907473 | 42907492 | 42907476 | - |
| SEQ ID NO 56465 | AAAGGTCCTCATCTGGGAGA | CAG | chr17 | 42907469 | 42907488 | 42907472 | - |
| SEQ ID NO 56466 | GAGACAGTGCATCATCTACC | CAG | chr17 | 42907453 | 42907472 | 42907456 | - |
| SEQ ID NO 56467 | GCATCATCTACCCAGCCACC | CAG | chr17 | 42907445 | 42907464 | 42907448 | - |
| SEQ ID NO 56468 | ATTTCCATCCTATGCACC | AAG | chr17 | 42907299 | 42907318 | 42907302 | - |
| SEQ ID NO 56469 | CTATGCACCAAGCATTGTGC | AAG | chr17 | 42907288 | 42907307 | 42907291 | - |
| SEQ ID NO 56470 | TATGCACCAAGCATTGTGCA | AGG | chr17 | 42907287 | 42907306 | 42907290 | - |
| SEQ ID NO 56471 | CCAAGCATTGTGCAAGGCTC | TGG | chr17 | 42907281 | 42907300 | 42907284 | - |
| SEQ ID NO 56472 | CAAGCATTGTGCAAGGCTCT | GGG | chr17 | 42907280 | 42907299 | 42907283 | - |
| SEQ ID NO 56473 | GGCTCTGGGAATACAATGAT | GAG | chr17 | 42907266 | 42907285 | 42907269 | - |
| SEQ ID NO 56474 | TGGGAATACAATGATGAGCA | AAG | chr17 | 42907261 | 42907280 | 42907264 | - |
| SEQ ID NO 56475 | AATACAATGATGAGCAAAGC | CAG | chr17 | 42907257 | 42907276 | 42907260 | - |
| SEQ ID NO 56476 | TACAATGATGAGCAAAGCCA | GAG | chr17 | 42907255 | 42907274 | 42907258 | - |
| SEQ ID NO 56477 | CAATGATGAGCAAAGCCAGA | GAG | chr17 | 42907253 | 42907272 | 42907256 | - |
| SEQ ID NO 56478 | AATGATGAGCAAAGCCAGAG | AGG | chr17 | 42907252 | 42907271 | 42907255 | - |
| SEQ ID NO 56479 | ATGATGAGCAAAGCCAGAGA | GGG | chr17 | 42907251 | 42907270 | 42907254 | - |
| SEQ ID NO 56480 | TGATGAGCAAAGCCAGAGAG | GGG | chr17 | 42907250 | 42907269 | 42907253 | - |
| SEQ ID NO 56481 | AGAGAGGGGCCCTGCTCTTG | CAG | chr17 | 42907236 | 42907255 | 42907239 | - |
| SEQ ID NO 56482 | CCTGCTCTTGCAGTTTAATA | CAG | chr17 | 42907226 | 42907245 | 42907229 | - |
| SEQ ID NO 56483 | TCTTGCAGTTTAATACAGTC | TGG | chr17 | 42907221 | 42907240 | 42907224 | - |
| SEQ ID NO 56484 | TTGCAGTTTAATACAGTCTG | GAG | chr17 | 42907219 | 42907238 | 42907222 | - |
| SEQ ID NO 56485 | TACAGTCTGGAGATTACACA | AAG | chr17 | 42907208 | 42907227 | 42907211 | - |
| SEQ ID NO 56486 | CTGGAGATTACACAAAGAAT | CAG | chr17 | 42907202 | 42907221 | 42907205 | - |
| SEQ ID NO 56487 | TACACAAAGAATCAGCATAC | TGG | chr17 | 42907194 | 42907213 | 42907197 | - |
| SEQ ID NO 56488 | ACACAAAGAATCAGCATACT | GGG | chr17 | 42907193 | 42907212 | 42907196 | - |
| SEQ ID NO 56489 | TCTCCTTGCACACTCTGTTC | TGG | chr17 | 42907125 | 42907144 | 42907128 | - |
| SEQ ID NO 56490 | ACACTCTGTTCTGGCTACAC | TGG | chr17 | 42907116 | 42907135 | 42907119 | - |
| SEQ ID NO 56491 | CACCAAACACGTTCCCACCT | CAG | chr17 | 42907071 | 42907090 | 42907074 | - |
| SEQ ID NO 56492 | ACCAAACACGTTCCCACCTC | AGG | chr17 | 42907070 | 42907089 | 42907073 | - |
| SEQ ID NO 56493 | CCAAACACGTTCCCACCTCA | GGG | chr17 | 42907069 | 42907088 | 42907072 | - |
| SEQ ID NO 56494 | TTTTGCATTGCAATCTTCTC | TGG | chr17 | 42907045 | 42907064 | 42907048 | - |
| SEQ ID NO 56495 | GCATTGCAATCTTCTCTGGC | CAG | chr17 | 42907041 | 42907060 | 42907044 | - |
| SEQ ID NO 56496 | TGCAATCTTCTCTGGCCAGA | CAG | chr17 | 42907037 | 42907056 | 42907040 | - |
| SEQ ID NO 56497 | TCTGGCCAGACAGCCCTTCA | CAG | chr17 | 42907027 | 42907046 | 42907030 | - |
| SEQ ID NO 56498 | GCCCTTCACAGCTCTTCTGC | CAG | chr17 | 42907015 | 42907034 | 42907018 | - |
| SEQ ID NO 56499 | CTTACTTCCTCACATCCTTG | AAG | chr17 | 42906989 | 42907008 | 42906992 | - |
| SEQ ID NO 56500 | ACATCCTTGAAGACTTGACT | CAG | chr17 | 42906978 | 42906997 | 42906981 | - |
| SEQ ID NO 56501 | TGACTCAGATCTCATATTCT | CAG | chr17 | 42906963 | 42906982 | 42906966 | - |
| SEQ ID NO 56502 | TCAGATCTCATATTCTCAGT | GAG | chr17 | 42906959 | 42906978 | 42906962 | - |

Figure 85 (Cont'd)

| SEQ ID NO 56503 | TATTTAACCCTGCTTGCAAC | CGG | chr17 | 42906919 | 42906938 | 42906922 | - |
| SEQ ID NO 56504 | TTGTTTGTTTTTTGTTTTTT | TAG | chr17 | 42906882 | 42906901 | 42906885 | - |
| SEQ ID NO 56505 | GTTTGTTTTTTGTTTTTTTA | GAG | chr17 | 42906880 | 42906899 | 42906883 | - |
| SEQ ID NO 56506 | GTTTTTTGTTTTTTTAGAGA | CAG | chr17 | 42906876 | 42906895 | 42906879 | - |
| SEQ ID NO 56507 | CAGTGTCTTGCTTTGTCTCC | TAG | chr17 | 42906856 | 42906875 | 42906859 | - |
| SEQ ID NO 56508 | AGTGTCTTGCTTTGTCTCCT | AGG | chr17 | 42906855 | 42906874 | 42906858 | - |
| SEQ ID NO 56509 | TTGTCTCCTAGGCTGCAATG | CAG | chr17 | 42906844 | 42906863 | 42906847 | - |
| SEQ ID NO 56510 | GCAATGCAGTGCCATGATCA | TAG | chr17 | 42906830 | 42906849 | 42906833 | - |
| SEQ ID NO 56511 | GCCATGATCATAGCTCACTG | CAG | chr17 | 42906820 | 42906839 | 42906823 | - |
| SEQ ID NO 56512 | TCACTGCAGCCTCGACCTCC | TGG | chr17 | 42906806 | 42906825 | 42906809 | - |
| SEQ ID NO 56513 | AGCCTCGACCTCCTGGACTC | AAG | chr17 | 42906799 | 42906818 | 42906802 | - |
| SEQ ID NO 56514 | CTCAAGCAATCCTCCCACCT | CAG | chr17 | 42906782 | 42906801 | 42906785 | - |
| SEQ ID NO 56515 | TCCTCCCACCTCAGCCCCCT | GAG | chr17 | 42906773 | 42906792 | 42906776 | - |
| SEQ ID NO 56516 | TCCCACCTCAGCCCCCTGAG | TAG | chr17 | 42906770 | 42906789 | 42906773 | - |
| SEQ ID NO 56517 | ACCTCAGCCCCCTGAGTAGC | TGG | chr17 | 42906766 | 42906785 | 42906769 | - |
| SEQ ID NO 56518 | CCTCAGCCCCCTGAGTAGCT | GGG | chr17 | 42906765 | 42906784 | 42906768 | - |
| SEQ ID NO 56519 | CCCCTGAGTAGCTGGGACCA | CAG | chr17 | 42906758 | 42906777 | 42906761 | - |
| SEQ ID NO 56520 | CCCTGAGTAGCTGGGACCAC | AGG | chr17 | 42906757 | 42906776 | 42906760 | - |
| SEQ ID NO 56521 | CAGGTGCACACCACCACACA | CAG | chr17 | 42906738 | 42906757 | 42906741 | - |
| SEQ ID NO 56522 | TTTGTTTGATTGTTTTTGCC | CAG | chr17 | 42906689 | 42906708 | 42906692 | - |
| SEQ ID NO 56523 | TTGTTTGATTGTTTTGCCC | AGG | chr17 | 42906688 | 42906707 | 42906691 | - |
| SEQ ID NO 56524 | TTGATTGTTTTGCCCAGGC | TGG | chr17 | 42906684 | 42906703 | 42906687 | - |
| SEQ ID NO 56525 | CCAGGCTGGTTTTGAACTCT | TGG | chr17 | 42906670 | 42906689 | 42906673 | - |
| SEQ ID NO 56526 | CAGGCTGGTTTTGAACTCTT | GGG | chr17 | 42906669 | 42906688 | 42906672 | - |
| SEQ ID NO 56527 | GGTTTTGAACTCTTGGGCTC | AAG | chr17 | 42906663 | 42906682 | 42906666 | - |
| SEQ ID NO 56528 | TCAAGCAATCCTCCTACCCT | TGG | chr17 | 42906645 | 42906664 | 42906648 | - |
| SEQ ID NO 56529 | CTCCTACCCTTGGCCTCCCA | AAG | chr17 | 42906635 | 42906654 | 42906638 | - |
| SEQ ID NO 56530 | CCCTTGGCCTCCCAAAGTGT | TGG | chr17 | 42906629 | 42906648 | 42906632 | - |
| SEQ ID NO 56531 | CCTTGGCCTCCCAAAGTGTT | GGG | chr17 | 42906628 | 42906647 | 42906631 | - |
| SEQ ID NO 56532 | CTCCCAAAGTGTTGGGATTA | TAG | chr17 | 42906621 | 42906640 | 42906624 | - |
| SEQ ID NO 56533 | TCCCAAAGTGTTGGGATTAT | AGG | chr17 | 42906620 | 42906639 | 42906623 | - |
| SEQ ID NO 56534 | AGTGTTGGGATTATAGGTGT | GAG | chr17 | 42906614 | 42906633 | 42906617 | - |
| SEQ ID NO 56535 | ATTATAGGTGTGAGCCACCA | TGG | chr17 | 42906605 | 42906624 | 42906608 | - |
| SEQ ID NO 56536 | GTGAGCCACCATGGCCCGTC | TGG | chr17 | 42906596 | 42906615 | 42906599 | - |
| SEQ ID NO 56537 | ATTCTTAATTCCTCTACCCT | GAG | chr17 | 42906563 | 42906582 | 42906566 | - |
| SEQ ID NO 56538 | TCTTAATTCCTCTACCCTGA | GAG | chr17 | 42906561 | 42906580 | 42906564 | - |
| SEQ ID NO 56539 | AATTCCTCTACCCTGAGAGA | TAG | chr17 | 42906557 | 42906576 | 42906560 | - |
| SEQ ID NO 56540 | TTCCTCTACCCTGAGAGATA | GAG | chr17 | 42906555 | 42906574 | 42906558 | - |
| SEQ ID NO 56541 | TCCTCTACCCTGAGAGATAG | AGG | chr17 | 42906554 | 42906573 | 42906557 | - |
| SEQ ID NO 56542 | CCTCTACCCTGAGAGATAGA | GGG | chr17 | 42906553 | 42906572 | 42906556 | - |
| SEQ ID NO 56543 | CCTGAGAGATAGAGGGTCCT | GAG | chr17 | 42906546 | 42906565 | 42906549 | - |
| SEQ ID NO 56544 | GGGTCCTGAGATGTGCCGCC | CAG | chr17 | 42906533 | 42906552 | 42906536 | - |
| SEQ ID NO 56545 | CAGACCTCCTCCTGAACTG | CAG | chr17 | 42906513 | 42906532 | 42906516 | - |
| SEQ ID NO 56546 | AGACCTCCTCCTGAACTGC | AGG | chr17 | 42906512 | 42906531 | 42906515 | - |
| SEQ ID NO 56547 | GAACTGCAGGACTTATTTCG | TAG | chr17 | 42906499 | 42906518 | 42906502 | - |
| SEQ ID NO 56548 | GGACTTATTTCGTAGCTGTT | GAG | chr17 | 42906491 | 42906510 | 42906494 | - |
| SEQ ID NO 56549 | ACTTATTTCGTAGCTGTTGA | GAG | chr17 | 42906489 | 42906508 | 42906492 | - |

Figure 85 (Cont'd)

| SEQ ID NO 56550 | CGTAGCTGTTGAGAGTGTGA | TGG | chr17 | 42906481 | 42906500 | 42906484 | - |
| SEQ ID NO 56551 | AGCTGTTGAGAGTGTGATGG | TAG | chr17 | 42906478 | 42906497 | 42906481 | - |
| SEQ ID NO 56552 | GTTGAGAGTGTGATGGTAGA | TGG | chr17 | 42906474 | 42906493 | 42906477 | - |
| SEQ ID NO 56553 | GGTAGATGGCTTTCTGCTCT | CAG | chr17 | 42906460 | 42906479 | 42906463 | - |
| SEQ ID NO 56554 | TTCTGCTCTCAGCCTTCTCC | TGG | chr17 | 42906449 | 42906468 | 42906452 | - |
| SEQ ID NO 56555 | GCCTTCTCCTGGCATTGCCC | TGG | chr17 | 42906438 | 42906457 | 42906441 | - |
| SEQ ID NO 56556 | CCTTCTCCTGGCATTGCCCT | GGG | chr17 | 42906437 | 42906456 | 42906440 | - |
| SEQ ID NO 56557 | CCTGGCATTGCCCTGGGCTA | AAG | chr17 | 42906431 | 42906450 | 42906434 | - |
| SEQ ID NO 56558 | TGGCATTGCCCTGGGCTAAA | GAG | chr17 | 42906429 | 42906448 | 42906432 | - |
| SEQ ID NO 56559 | GCATTGCCCTGGGCTAAAGA | GAG | chr17 | 42906427 | 42906446 | 42906430 | - |
| SEQ ID NO 56560 | TAAAGAGAGTCGCCTTGATC | AAG | chr17 | 42906413 | 42906432 | 42906416 | - |
| SEQ ID NO 56561 | AAAGAGAGTCGCCTTGATCA | AGG | chr17 | 42906412 | 42906431 | 42906415 | - |
| SEQ ID NO 56562 | GATCAAGGTTACGCTCTCCC | CAG | chr17 | 42906397 | 42906416 | 42906400 | - |
| SEQ ID NO 56563 | ATCAAGGTTACGCTCTCCCC | AGG | chr17 | 42906396 | 42906415 | 42906399 | - |
| SEQ ID NO 56564 | TCAAGGTTACGCTCTCCCCA | GGG | chr17 | 42906395 | 42906414 | 42906398 | - |
| SEQ ID NO 56565 | CTGATTCCCTTGTCCCAACT | TGG | chr17 | 42906371 | 42906390 | 42906374 | - |
| SEQ ID NO 56566 | TCCCAACTTGGACCAACTCT | GAG | chr17 | 42906359 | 42906378 | 42906362 | - |
| SEQ ID NO 56567 | CCCAACTTGGACCAACTCTG | AGG | chr17 | 42906358 | 42906377 | 42906361 | - |
| SEQ ID NO 56568 | CAACTTGGACCAACTCTGAG | GAG | chr17 | 42906356 | 42906375 | 42906359 | - |
| SEQ ID NO 56569 | CAACTCTGAGGAGCCATCCC | CAG | chr17 | 42906346 | 42906365 | 42906349 | - |
| SEQ ID NO 56570 | TGAGGAGCCATCCCCAGCTT | CAG | chr17 | 42906340 | 42906359 | 42906343 | - |
| SEQ ID NO 56571 | AGGAGCCATCCCCAGCTTCA | GAG | chr17 | 42906338 | 42906357 | 42906341 | - |
| SEQ ID NO 56572 | CCCAGCTTCAGAGCTCGCTG | TGG | chr17 | 42906328 | 42906347 | 42906331 | - |
| SEQ ID NO 56573 | CCAGCTTCAGAGCTCGCTGT | GGG | chr17 | 42906327 | 42906346 | 42906330 | - |
| SEQ ID NO 56574 | CAGCTTCAGAGCTCGCTGTG | GGG | chr17 | 42906326 | 42906345 | 42906329 | - |
| SEQ ID NO 56575 | TTCAGAGCTCGCTGTGGGGT | TGG | chr17 | 42906322 | 42906341 | 42906325 | - |
| SEQ ID NO 56576 | AGCTCGCTGTGGGGTTGGAT | GAG | chr17 | 42906317 | 42906336 | 42906320 | - |
| SEQ ID NO 56577 | GCTCGCTGTGGGGTTGGATG | AGG | chr17 | 42906316 | 42906335 | 42906319 | - |
| SEQ ID NO 56578 | CGCTGTGGGGTTGGATGAGG | CAG | chr17 | 42906313 | 42906332 | 42906316 | - |
| SEQ ID NO 56579 | GGATGAGGCAGAATCACAAC | CGG | chr17 | 42906301 | 42906320 | 42906304 | - |
| SEQ ID NO 56580 | TCCTGTTCCTTCCCTTCTAC | AAG | chr17 | 42906259 | 42906278 | 42906262 | - |
| SEQ ID NO 56581 | TTCCTTCCCTTCTACAAGTA | TAG | chr17 | 42906254 | 42906273 | 42906257 | - |
| SEQ ID NO 56582 | CTTCTACAAGTATAGTTCCC | CAG | chr17 | 42906246 | 42906265 | 42906249 | - |
| SEQ ID NO 56583 | TCTACAAGTATAGTTCCCCA | GAG | chr17 | 42906244 | 42906263 | 42906247 | - |
| SEQ ID NO 56584 | CTGCACGTGAATCTCCATTT | CAG | chr17 | 42906210 | 42906229 | 42906213 | - |
| SEQ ID NO 56585 | CTCCATTTCAGCCTGCTTTC | CAG | chr17 | 42906198 | 42906217 | 42906201 | - |
| SEQ ID NO 56586 | TCCATTTCAGCCTGCTTTCC | AGG | chr17 | 42906197 | 42906216 | 42906200 | - |
| SEQ ID NO 56587 | CCATTTCAGCCTGCTTTCCA | GGG | chr17 | 42906196 | 42906215 | 42906199 | - |
| SEQ ID NO 56588 | CTGCTTTCCAGGGAACCCCA | TAG | chr17 | 42906186 | 42906205 | 42906189 | - |
| SEQ ID NO 56589 | GGGAACCCCATAGATAAATA | AAG | chr17 | 42906176 | 42906195 | 42906179 | - |
| SEQ ID NO 56590 | GGAACCCCATAGATAAATAA | AGG | chr17 | 42906175 | 42906194 | 42906178 | - |
| SEQ ID NO 56591 | ACACTAACAATTATATACCT | TGG | chr17 | 42906079 | 42906098 | 42906082 | - |
| SEQ ID NO 56592 | CACTAACAATTATATACCTT | GGG | chr17 | 42906078 | 42906097 | 42906081 | - |
| SEQ ID NO 56593 | CTTTTTTTTTTTTTTCCTGA | CAG | chr17 | 42906042 | 42906061 | 42906045 | - |
| SEQ ID NO 56594 | CAGAATCTTTCTCTGTCACC | AAG | chr17 | 42906022 | 42906041 | 42906025 | - |
| SEQ ID NO 56595 | AGAATCTTTCTCTGTCACCA | AGG | chr17 | 42906021 | 42906040 | 42906024 | - |
| SEQ ID NO 56596 | TCTTTCTCTGTCACCAAGGC | TGG | chr17 | 42906017 | 42906036 | 42906020 | - |

Figure 85 (Cont'd)

| | | | | | | | |
|---|---|---|---|---|---|---|---|
| SEQ ID NO 56597 | TTTCTCTGTCACCAAGGCTG | GAG | chr17 | 42906015 | 42906034 | 42906018 | - |
| SEQ ID NO 56598 | CTGTCACCAAGGCTGGAGTG | CAG | chr17 | 42906010 | 42906029 | 42906013 | - |
| SEQ ID NO 56599 | TCACCAAGGCTGGAGTGCAG | TGG | chr17 | 42906007 | 42906026 | 42906010 | - |
| SEQ ID NO 56600 | GGAGTGCAGTGGTGTGATTT | CAG | chr17 | 42905996 | 42906015 | 42905999 | - |
| SEQ ID NO 56601 | TCACTGCAACCTCTGCCTCC | CGG | chr17 | 42905972 | 42905991 | 42905975 | - |
| SEQ ID NO 56602 | CACTGCAACCTCTGCCTCCC | GGG | chr17 | 42905971 | 42905990 | 42905974 | - |
| SEQ ID NO 56603 | AACCTCTGCCTCCCGGGTTG | AAG | chr17 | 42905965 | 42905984 | 42905968 | - |
| SEQ ID NO 56604 | TTGAAGTGATTCTCCTGCCG | CAG | chr17 | 42905948 | 42905967 | 42905951 | - |
| SEQ ID NO 56605 | ATTCTCCTGCCGCAGCCTCC | TGG | chr17 | 42905940 | 42905959 | 42905943 | - |
| SEQ ID NO 56606 | TTCTCCTGCCGCAGCCTCCT | GGG | chr17 | 42905939 | 42905958 | 42905942 | - |
| SEQ ID NO 56607 | TCCTGCCGCAGCCTCCTGGG | TAG | chr17 | 42905936 | 42905955 | 42905939 | - |
| SEQ ID NO 56608 | GCCGCAGCCTCCTGGGTAGC | TGG | chr17 | 42905932 | 42905951 | 42905935 | - |
| SEQ ID NO 56609 | CCGCAGCCTCCTGGGTAGCT | GGG | chr17 | 42905931 | 42905950 | 42905934 | - |
| SEQ ID NO 56610 | CTCCTGGGTAGCTGGGATTA | CAG | chr17 | 42905924 | 42905943 | 42905927 | - |
| SEQ ID NO 56611 | TCCTGGGTAGCTGGGATTAC | AGG | chr17 | 42905923 | 42905942 | 42905926 | - |
| SEQ ID NO 56612 | CAGGCGCCCGCCACCATGCC | TGG | chr17 | 42905904 | 42905923 | 42905907 | - |
| SEQ ID NO 56613 | GCCCGCCACCATGCCTGGCT | AAG | chr17 | 42905899 | 42905918 | 42905902 | - |
| SEQ ID NO 56614 | AAGTTTTGTATTTTTTTAT | TAG | chr17 | 42905879 | 42905898 | 42905882 | - |
| SEQ ID NO 56615 | TGTATTTTTTTATTAGTGAC | GAG | chr17 | 42905872 | 42905891 | 42905875 | - |
| SEQ ID NO 56616 | GTATTTTTTTATTAGTGACG | AGG | chr17 | 42905871 | 42905890 | 42905874 | - |
| SEQ ID NO 56617 | GTGACGAGGTTTCACCATGT | TGG | chr17 | 42905857 | 42905876 | 42905860 | - |
| SEQ ID NO 56618 | CGAGGTTTCACCATGTTGGC | CAG | chr17 | 42905853 | 42905872 | 42905856 | - |
| SEQ ID NO 56619 | GAGGTTTCACCATGTTGGCC | AGG | chr17 | 42905852 | 42905871 | 42905855 | - |
| SEQ ID NO 56620 | TTTCACCATGTTGGCCAGGC | TGG | chr17 | 42905848 | 42905867 | 42905851 | - |
| SEQ ID NO 56621 | TGGTCTCAAACTCCTGACCT | CAG | chr17 | 42905828 | 42905847 | 42905831 | - |
| SEQ ID NO 56622 | GGTCTCAAACTCCTGACCTC | AGG | chr17 | 42905827 | 42905846 | 42905830 | - |
| SEQ ID NO 56623 | CTCAGGTGATCCACCTGCGT | TGG | chr17 | 42905810 | 42905829 | 42905813 | - |
| SEQ ID NO 56624 | CCACCTGCGTTGGCCTCCCA | AAG | chr17 | 42905800 | 42905819 | 42905803 | - |
| SEQ ID NO 56625 | GCGTTGGCCTCCCAAAGTGC | TAG | chr17 | 42905794 | 42905813 | 42905797 | - |
| SEQ ID NO 56626 | CGTTGGCCTCCCAAAGTGCT | AGG | chr17 | 42905793 | 42905812 | 42905796 | - |
| SEQ ID NO 56627 | CTCCCAAAGTGCTAGGATTA | CAG | chr17 | 42905786 | 42905805 | 42905789 | - |
| SEQ ID NO 56628 | TCCCAAAGTGCTAGGATTAC | AGG | chr17 | 42905785 | 42905804 | 42905788 | - |
| SEQ ID NO 56629 | AGTGCTAGGATTACAGGCGT | GAG | chr17 | 42905779 | 42905798 | 42905782 | - |
| SEQ ID NO 56630 | CAGGCGTGAGCCACCGCGCC | CGG | chr17 | 42905766 | 42905785 | 42905769 | - |
| SEQ ID NO 56631 | CCGCGCCCGGCCTACTTTCT | GAG | chr17 | 42905753 | 42905772 | 42905756 | - |
| SEQ ID NO 56632 | CCGGCCTACTTTCTGAGCCT | TAG | chr17 | 42905747 | 42905766 | 42905750 | - |
| SEQ ID NO 56633 | GAGCCTTAGCTACTCTACCT | AAG | chr17 | 42905733 | 42905752 | 42905736 | - |
| SEQ ID NO 56634 | AGCCTTAGCTACTCTACCTA | AGG | chr17 | 42905732 | 42905751 | 42905735 | - |
| SEQ ID NO 56635 | CCTTAGCTACTCTACCTAAG | GAG | chr17 | 42905730 | 42905749 | 42905733 | - |
| SEQ ID NO 56636 | TAGCTACTCTACCTAAGGAG | CAG | chr17 | 42905727 | 42905746 | 42905730 | - |
| SEQ ID NO 56637 | GCTACTCTACCTAAGGAGCA | GAG | chr17 | 42905725 | 42905744 | 42905728 | - |
| SEQ ID NO 56638 | GATAATAATTTGCTTCTATT | AAG | chr17 | 42905703 | 42905722 | 42905706 | - |
| SEQ ID NO 56639 | ATAATTTGCTTCTATTAAGA | CAG | chr17 | 42905699 | 42905718 | 42905702 | - |
| SEQ ID NO 56640 | AATTTGCTTCTATTAAGACA | GAG | chr17 | 42905697 | 42905716 | 42905700 | - |
| SEQ ID NO 56641 | ATTTGCTTCTATTAAGACAG | AGG | chr17 | 42905696 | 42905715 | 42905699 | - |
| SEQ ID NO 56642 | CTAAATAAAATAACCTCTTA | AAG | chr17 | 42905672 | 42905691 | 42905675 | - |
| SEQ ID NO 56643 | TAAAGCCACTTTAAACTTTC | CAG | chr17 | 42905654 | 42905673 | 42905657 | - |

Figure 85 (Cont'd)

| | | | | | | | |
|---|---|---|---|---|---|---|---|
| SEQ ID NO 56644 | GTCTGTGCCTCCATTAATTT | CAG | chr17 | 42905632 | 42905651 | 42905635 | - |
| SEQ ID NO 56645 | TCTGTGCCTCCATTAATTTC | AGG | chr17 | 42905631 | 42905650 | 42905634 | - |
| SEQ ID NO 56646 | CTGTGCCTCCATTAATTTCA | GGG | chr17 | 42905630 | 42905649 | 42905633 | - |
| SEQ ID NO 56647 | GTGCCTCCATTAATTTCAGG | GAG | chr17 | 42905628 | 42905647 | 42905631 | - |
| SEQ ID NO 56648 | AGAAATTCATCCTTGATAAC | AAG | chr17 | 42905607 | 42905626 | 42905610 | - |
| SEQ ID NO 56649 | ATAACAAGCTGTTATGATGA | AAG | chr17 | 42905592 | 42905611 | 42905595 | - |
| SEQ ID NO 56650 | AAGCAAACATATTTCTACAA | AAG | chr17 | 42905572 | 42905591 | 42905575 | - |
| SEQ ID NO 56651 | ATATTTCTACAAAAGATGTT | TGG | chr17 | 42905564 | 42905583 | 42905567 | - |
| SEQ ID NO 56652 | GCCTATAAACAATCATTTTC | TAG | chr17 | 42905487 | 42905506 | 42905490 | - |
| SEQ ID NO 56653 | ATATATTTTTTTTTTTTTTT | CAG | chr17 | 42905416 | 42905435 | 42905419 | - |
| SEQ ID NO 56654 | ATTTTTTTTTTTTTTTCAGA | TGG | chr17 | 42905412 | 42905431 | 42905415 | - |
| SEQ ID NO 56655 | TGGTGTCTCATTTTGTCGCC | CAG | chr17 | 42905392 | 42905411 | 42905395 | - |
| SEQ ID NO 56656 | GGTGTCTCATTTTGTCGCCC | AGG | chr17 | 42905391 | 42905410 | 42905394 | - |
| SEQ ID NO 56657 | TCTCATTTTGTCGCCCAGGC | TGG | chr17 | 42905387 | 42905406 | 42905390 | - |
| SEQ ID NO 56658 | TCATTTTGTCGCCCAGGCTG | GAG | chr17 | 42905385 | 42905404 | 42905388 | - |
| SEQ ID NO 56659 | TCGCCCAGGCTGGAGTGCAA | TGG | chr17 | 42905377 | 42905396 | 42905380 | - |
| SEQ ID NO 56660 | GGAGTGCAATGGCGCAATCT | TGG | chr17 | 42905366 | 42905385 | 42905369 | - |
| SEQ ID NO 56661 | AATCTTGGCTCACCACCTCC | CAG | chr17 | 42905351 | 42905370 | 42905354 | - |
| SEQ ID NO 56662 | ATCTTGGCTCACCACCTCCC | AGG | chr17 | 42905350 | 42905369 | 42905353 | - |
| SEQ ID NO 56663 | GCTCACCACCTCCCAGGTTC | AAG | chr17 | 42905344 | 42905363 | 42905347 | - |
| SEQ ID NO 56664 | TTCAAGCGATTCTCCTGCCT | TAG | chr17 | 42905327 | 42905346 | 42905330 | - |
| SEQ ID NO 56665 | TTCTCCTGCCTTAGCCTCCT | GAG | chr17 | 42905318 | 42905337 | 42905321 | - |
| SEQ ID NO 56666 | TCCTGCCTTAGCCTCCTGAG | TAG | chr17 | 42905315 | 42905334 | 42905318 | - |
| SEQ ID NO 56667 | CCTTAGCCTCCTGAGTAGCT | CAG | chr17 | 42905310 | 42905329 | 42905313 | - |
| SEQ ID NO 56668 | CTCCTGAGTAGCTCAGATTA | CAG | chr17 | 42905303 | 42905322 | 42905306 | - |
| SEQ ID NO 56669 | TCCTGAGTAGCTCAGATTAC | AGG | chr17 | 42905302 | 42905321 | 42905305 | - |
| SEQ ID NO 56670 | CTCAGATTACAGGCATGCAC | CAG | chr17 | 42905292 | 42905311 | 42905295 | - |
| SEQ ID NO 56671 | TCAGATTACAGGCATGCACC | AGG | chr17 | 42905291 | 42905310 | 42905294 | - |
| SEQ ID NO 56672 | CAGGCATGCACCAGGACACC | CAG | chr17 | 42905283 | 42905302 | 42905286 | - |
| SEQ ID NO 56673 | CCAGCTAATTTTTGTATTTT | TAG | chr17 | 42905264 | 42905283 | 42905267 | - |
| SEQ ID NO 56674 | GCTAATTTTTGTATTTTTAG | TAG | chr17 | 42905261 | 42905280 | 42905264 | - |
| SEQ ID NO 56675 | TAATTTTTGTATTTTTAGTA | GAG | chr17 | 42905259 | 42905278 | 42905262 | - |
| SEQ ID NO 56676 | TTTTGTATTTTTAGTAGAGA | CAG | chr17 | 42905255 | 42905274 | 42905258 | - |
| SEQ ID NO 56677 | TTTGTATTTTTAGTAGAGAC | AGG | chr17 | 42905254 | 42905273 | 42905257 | - |
| SEQ ID NO 56678 | TTGTATTTTTAGTAGAGACA | GGG | chr17 | 42905253 | 42905272 | 42905256 | - |
| SEQ ID NO 56679 | GAGACAGGGTTTTGCCATGT | TGG | chr17 | 42905239 | 42905258 | 42905242 | - |
| SEQ ID NO 56680 | CAGGGTTTTGCCATGTTGGC | CAG | chr17 | 42905235 | 42905254 | 42905238 | - |
| SEQ ID NO 56681 | AGGGTTTTGCCATGTTGGCC | AGG | chr17 | 42905234 | 42905253 | 42905237 | - |
| SEQ ID NO 56682 | TTTTGCCATGTTGGCCAGGC | TGG | chr17 | 42905230 | 42905249 | 42905233 | - |
| SEQ ID NO 56683 | TGGTCTTGAACTCCTCACCT | CAG | chr17 | 42905210 | 42905229 | 42905213 | - |
| SEQ ID NO 56684 | GGTCTTGAACTCCTCACCTC | AGG | chr17 | 42905209 | 42905228 | 42905212 | - |
| SEQ ID NO 56685 | CTCAGGTGATCCACCCGCCT | CAG | chr17 | 42905192 | 42905211 | 42905195 | - |
| SEQ ID NO 56686 | CCACCCGCCTCAGCCTCCCA | AAG | chr17 | 42905182 | 42905201 | 42905185 | - |
| SEQ ID NO 56687 | GCCTCAGCCTCCCAAAGTGC | TGG | chr17 | 42905176 | 42905195 | 42905179 | - |
| SEQ ID NO 56688 | CCTCAGCCTCCCAAAGTGCT | GGG | chr17 | 42905175 | 42905194 | 42905178 | - |
| SEQ ID NO 56689 | CTCCCAAAGTGCTGGGATTA | CAG | chr17 | 42905168 | 42905187 | 42905171 | - |
| SEQ ID NO 56690 | TCCCAAAGTGCTGGGATTAC | AGG | chr17 | 42905167 | 42905186 | 42905170 | - |

Figure 85 (Cont'd)

| SEQ ID NO 56691 | CCCAAAGTGCTGGGATTACA | GGG | chr17 | 42905166 | 42905185 | 42905169 | - |
| SEQ ID NO 56692 | AAGTGCTGGGATTACAGGGT | GAG | chr17 | 42905162 | 42905181 | 42905165 | - |
| SEQ ID NO 56693 | ACAGGGTGAGCCACCGTGCC | TGG | chr17 | 42905149 | 42905168 | 42905152 | - |
| SEQ ID NO 56694 | TGGCCTATCCTACATATTAA | TAG | chr17 | 42905129 | 42905148 | 42905132 | - |
| SEQ ID NO 56695 | TAATAGTTTACTTTTTTTTT | GAG | chr17 | 42905112 | 42905131 | 42905115 | - |
| SEQ ID NO 56696 | AGTTTACTTTTTTTTGAGA | CAG | chr17 | 42905108 | 42905127 | 42905111 | - |
| SEQ ID NO 56697 | TTTACTTTTTTTTGAGACA | GAG | chr17 | 42905106 | 42905125 | 42905109 | - |
| SEQ ID NO 56698 | CAGAGTCTCGTTCTGTCATT | CAG | chr17 | 42905088 | 42905107 | 42905091 | - |
| SEQ ID NO 56699 | AGAGTCTCGTTCTGTCATTC | AGG | chr17 | 42905087 | 42905106 | 42905090 | - |
| SEQ ID NO 56700 | TCTCGTTCTGTCATTCAGGC | TGG | chr17 | 42905083 | 42905102 | 42905086 | - |
| SEQ ID NO 56701 | TCGTTCTGTCATTCAGGCTG | GAG | chr17 | 42905081 | 42905100 | 42905084 | - |
| SEQ ID NO 56702 | CTGTCATTCAGGCTGGAGTG | CAG | chr17 | 42905076 | 42905095 | 42905079 | - |
| SEQ ID NO 56703 | TCATTCAGGCTGGAGTGCAG | TGG | chr17 | 42905073 | 42905092 | 42905076 | - |
| SEQ ID NO 56704 | GGAGTGCAGTGGTCCGATCT | CGG | chr17 | 42905062 | 42905081 | 42905065 | - |
| SEQ ID NO 56705 | TCACTGCAACCTCTGCCTCC | CAG | chr17 | 42905038 | 42905057 | 42905041 | - |
| SEQ ID NO 56706 | CACTGCAACCTCTGCCTCCC | AGG | chr17 | 42905037 | 42905056 | 42905040 | - |
| SEQ ID NO 56707 | AACCTCTGCCTCCAGGTTC | AAG | chr17 | 42905031 | 42905050 | 42905034 | - |
| SEQ ID NO 56708 | TTCAAGCGATTCTCCTGCCT | CAG | chr17 | 42905014 | 42905033 | 42905017 | - |
| SEQ ID NO 56709 | ATTCTCCTGCCTCAGCCTCC | CAG | chr17 | 42905006 | 42905025 | 42905009 | - |
| SEQ ID NO 56710 | TTCTCCTGCCTCAGCCTCCC | AGG | chr17 | 42905005 | 42905024 | 42905008 | - |
| SEQ ID NO 56711 | TCCTGCCTCAGCCTCCCAGG | TAG | chr17 | 42905002 | 42905021 | 42905005 | - |
| SEQ ID NO 56712 | CCTCAGCCTCCCAGGTAGCT | GAG | chr17 | 42904997 | 42905016 | 42905000 | - |
| SEQ ID NO 56713 | CTCCCAGGTAGCTGAGACTA | CAG | chr17 | 42904990 | 42905009 | 42904993 | - |
| SEQ ID NO 56714 | TCCCAGGTAGCTGAGACTAC | AGG | chr17 | 42904989 | 42905008 | 42904992 | - |
| SEQ ID NO 56715 | CTGACCAATTTTTCCATTTT | TAG | chr17 | 42904951 | 42904970 | 42904954 | - |
| SEQ ID NO 56716 | CAATTTTTCCATTTTTAGTA | AAG | chr17 | 42904946 | 42904965 | 42904949 | - |
| SEQ ID NO 56717 | TTTTCCATTTTTAGTAAAGA | CAG | chr17 | 42904942 | 42904961 | 42904945 | - |
| SEQ ID NO 56718 | TTTCCATTTTTAGTAAAGAC | AGG | chr17 | 42904941 | 42904960 | 42904944 | - |
| SEQ ID NO 56719 | AAGACAGGATTTTGCAATGT | TGG | chr17 | 42904926 | 42904945 | 42904929 | - |
| SEQ ID NO 56720 | CAGGATTTTGCAATGTTGGC | CAG | chr17 | 42904922 | 42904941 | 42904925 | - |
| SEQ ID NO 56721 | AGGATTTTGCAATGTTGGCC | AGG | chr17 | 42904921 | 42904940 | 42904924 | - |
| SEQ ID NO 56722 | TTTTGCAATGTTGGCCAGGC | TGG | chr17 | 42904917 | 42904936 | 42904920 | - |
| SEQ ID NO 56723 | TGGTTTTGAACTCCTGACCT | CAG | chr17 | 42904897 | 42904916 | 42904900 | - |
| SEQ ID NO 56724 | GGTTTTGAACTCCTGACCTC | AGG | chr17 | 42904896 | 42904915 | 42904899 | - |
| SEQ ID NO 56725 | CTCAGGTGATCTACCTACCT | TGG | chr17 | 42904879 | 42904898 | 42904882 | - |
| SEQ ID NO 56726 | CTACCTACCTTGGCTTCCCA | AAG | chr17 | 42904869 | 42904888 | 42904872 | - |
| SEQ ID NO 56727 | ACCTTGGCTTCCCAAAGTGC | TGG | chr17 | 42904863 | 42904882 | 42904866 | - |
| SEQ ID NO 56728 | CCTTGGCTTCCCAAAGTGCT | GGG | chr17 | 42904862 | 42904881 | 42904865 | - |
| SEQ ID NO 56729 | TTCCCAAAGTGCTGGGATTA | CAG | chr17 | 42904855 | 42904874 | 42904858 | - |
| SEQ ID NO 56730 | TCCCAAAGTGCTGGGATTAC | AGG | chr17 | 42904854 | 42904873 | 42904857 | - |
| SEQ ID NO 56731 | AGTGCTGGGATTACAGGCAT | GAG | chr17 | 42904848 | 42904867 | 42904851 | - |
| SEQ ID NO 56732 | CAGGCATGAGCAACCACAAC | TGG | chr17 | 42904835 | 42904854 | 42904838 | - |
| SEQ ID NO 56733 | ATGAGCAACCACAACTGGCC | TAG | chr17 | 42904830 | 42904849 | 42904833 | - |
| SEQ ID NO 56734 | TATATTTCACCTCCTCTATT | CAG | chr17 | 42904783 | 42904802 | 42904786 | - |
| SEQ ID NO 56735 | CACCTCCTCTATTCAGATTT | CAG | chr17 | 42904776 | 42904795 | 42904779 | - |
| SEQ ID NO 56736 | TATTCAGATTTCAGCTCCAC | AAG | chr17 | 42904767 | 42904786 | 42904770 | - |
| SEQ ID NO 56737 | ATTCAGATTTCAGCTCCACA | AGG | chr17 | 42904766 | 42904785 | 42904769 | - |

Figure 85 (Cont'd)

| | | | | | | | |
|---|---|---|---|---|---|---|---|
| SEQ ID NO 56738 | TTCAGATTTCAGCTCCACAA | GGG | chr17 | 42904765 | 42904784 | 42904768 | - |
| SEQ ID NO 56739 | AGATTTCAGCTCCACAAGGG | CAG | chr17 | 42904762 | 42904781 | 42904765 | - |
| SEQ ID NO 56740 | GATTTCAGCTCCACAAGGGC | AGG | chr17 | 42904761 | 42904780 | 42904764 | - |
| SEQ ID NO 56741 | ATTTCAGCTCCACAAGGGCA | GGG | chr17 | 42904760 | 42904779 | 42904763 | - |
| SEQ ID NO 56742 | GTGTCTGTGTTGTTCACTGA | CAG | chr17 | 42904731 | 42904750 | 42904734 | - |
| SEQ ID NO 56743 | GTCTGTGTTGTTCACTGACA | GAG | chr17 | 42904729 | 42904748 | 42904732 | - |
| SEQ ID NO 56744 | TCTGTGTTGTTCACTGACAG | AGG | chr17 | 42904728 | 42904747 | 42904731 | - |
| SEQ ID NO 56745 | TTCACTGACAGAGGTATCCC | TAG | chr17 | 42904719 | 42904738 | 42904722 | - |
| SEQ ID NO 56746 | ACAGAGGTATCCCTAGCACA | TAG | chr17 | 42904712 | 42904731 | 42904715 | - |
| SEQ ID NO 56747 | GGTATCCCTAGCACATAGAA | CAG | chr17 | 42904707 | 42904726 | 42904710 | - |
| SEQ ID NO 56748 | CTAGCACATAGAACAGTGTA | TAG | chr17 | 42904700 | 42904719 | 42904703 | - |
| SEQ ID NO 56749 | ATAGAACAGTGTATAGCTCC | CAG | chr17 | 42904693 | 42904712 | 42904696 | - |
| SEQ ID NO 56750 | GAACAGTGTATAGCTCCCAG | TAG | chr17 | 42904690 | 42904709 | 42904693 | - |
| SEQ ID NO 56751 | AACAGTGTATAGCTCCCAGT | AGG | chr17 | 42904689 | 42904708 | 42904692 | - |
| SEQ ID NO 56752 | TATAGCTCCCAGTAGGTGCT | TGG | chr17 | 42904682 | 42904701 | 42904685 | - |
| SEQ ID NO 56753 | GCTCCCAGTAGGTGCTTGGT | AAG | chr17 | 42904678 | 42904697 | 42904681 | - |
| SEQ ID NO 56754 | AGTAGGTGCTTGGTAAGTAA | CAG | chr17 | 42904672 | 42904691 | 42904675 | - |
| SEQ ID NO 56755 | TTGGTAAGTAACAGCTGAAT | GAG | chr17 | 42904663 | 42904682 | 42904666 | - |
| SEQ ID NO 56756 | TGAATGAGTGAATATGCTCT | GAG | chr17 | 42904648 | 42904667 | 42904651 | - |
| SEQ ID NO 56757 | GAATGAGTGAATATGCTCTG | AGG | chr17 | 42904647 | 42904666 | 42904650 | - |
| SEQ ID NO 56758 | TATGCTCTGAGGTAAATGCG | TGG | chr17 | 42904636 | 42904655 | 42904639 | - |
| SEQ ID NO 56759 | GAGGTAAATGCGTGGTCTGT | GAG | chr17 | 42904628 | 42904647 | 42904631 | - |
| SEQ ID NO 56760 | GGTAAATGCGTGGTCTGTGA | GAG | chr17 | 42904626 | 42904645 | 42904629 | - |
| SEQ ID NO 56761 | GTCTGTGAGAGCAAATAACT | AAG | chr17 | 42904614 | 42904633 | 42904617 | - |
| SEQ ID NO 56762 | TCTGTGAGAGCAAATAACTA | AGG | chr17 | 42904613 | 42904632 | 42904616 | - |
| SEQ ID NO 56763 | CTGTGAGAGCAAATAACTAA | GGG | chr17 | 42904612 | 42904631 | 42904615 | - |
| SEQ ID NO 56764 | AATAACTAAGGGACCTTCCC | TAG | chr17 | 42904601 | 42904620 | 42904604 | - |
| SEQ ID NO 56765 | TAAGGGACCTTCCCTAGTTT | TGG | chr17 | 42904595 | 42904614 | 42904598 | - |
| SEQ ID NO 56766 | AAGGGACCTTCCCTAGTTTT | GGG | chr17 | 42904594 | 42904613 | 42904597 | - |
| SEQ ID NO 56767 | AGGGACCTTCCCTAGTTTTG | GGG | chr17 | 42904593 | 42904612 | 42904596 | - |
| SEQ ID NO 56768 | ACCTTCCCTAGTTTTGGGGT | CAG | chr17 | 42904589 | 42904608 | 42904592 | - |
| SEQ ID NO 56769 | CCTTCCCTAGTTTTGGGGTC | AGG | chr17 | 42904588 | 42904607 | 42904591 | - |
| SEQ ID NO 56770 | CTTCCCTAGTTTTGGGGTCA | GGG | chr17 | 42904587 | 42904606 | 42904590 | - |
| SEQ ID NO 56771 | CCTAGTTTTGGGGTCAGGGA | AAG | chr17 | 42904583 | 42904602 | 42904586 | - |
| SEQ ID NO 56772 | CTAGTTTTGGGGTCAGGGAA | AGG | chr17 | 42904582 | 42904601 | 42904585 | - |
| SEQ ID NO 56773 | TAGTTTTGGGGTCAGGGAAA | GGG | chr17 | 42904581 | 42904600 | 42904584 | - |
| SEQ ID NO 56774 | GGGTCAGGGAAAGGGTCTCT | GAG | chr17 | 42904573 | 42904592 | 42904576 | - |
| SEQ ID NO 56775 | GGTCAGGGAAAGGGTCTCTG | AGG | chr17 | 42904572 | 42904591 | 42904575 | - |
| SEQ ID NO 56776 | CAGGGAAAGGGTCTCTGAGG | AAG | chr17 | 42904569 | 42904588 | 42904572 | - |
| SEQ ID NO 56777 | AGGGAAAGGGTCTCTGAGGA | AGG | chr17 | 42904568 | 42904587 | 42904571 | - |
| SEQ ID NO 56778 | GGGAAAGGGTCTCTGAGGAA | GGG | chr17 | 42904567 | 42904586 | 42904570 | - |
| SEQ ID NO 56779 | GGTCTCTGAGGAAGGGATAC | TAG | chr17 | 42904560 | 42904579 | 42904563 | - |
| SEQ ID NO 56780 | AGGAAGGGATACTAGTACCT | TAG | chr17 | 42904552 | 42904571 | 42904555 | - |
| SEQ ID NO 56781 | GAAGGGATACTAGTACCTTA | GAG | chr17 | 42904550 | 42904569 | 42904553 | - |
| SEQ ID NO 56782 | AGGGATACTAGTACCTTAGA | GAG | chr17 | 42904548 | 42904567 | 42904551 | - |
| SEQ ID NO 56783 | ACTAGTACCTTAGAGAGTAC | TAG | chr17 | 42904542 | 42904561 | 42904545 | - |
| SEQ ID NO 56784 | ACCTTAGAGAGTACTAGTCT | TAG | chr17 | 42904536 | 42904555 | 42904539 | - |

Figure 85 (Cont'd)

| SEQ ID NO 56785 | CTTAGAGAGTACTAGTCTTA | GAG | chr17 | 42904534 | 42904553 | 42904537 | - |
| SEQ ID NO 56786 | TTAGAGAGTACTAGTCTTAG | AGG | chr17 | 42904533 | 42904552 | 42904536 | - |
| SEQ ID NO 56787 | TAGAGAGTACTAGTCTTAGA | GGG | chr17 | 42904532 | 42904551 | 42904535 | - |
| SEQ ID NO 56788 | AGAGTACTAGTCTTAGAGGG | CAG | chr17 | 42904529 | 42904548 | 42904532 | - |
| SEQ ID NO 56789 | ACTAGTCTTAGAGGGCAGCT | GAG | chr17 | 42904524 | 42904543 | 42904527 | - |
| SEQ ID NO 56790 | TTAGAGGGCAGCTGAGACTT | TAG | chr17 | 42904517 | 42904536 | 42904520 | - |
| SEQ ID NO 56791 | TAGAGGGCAGCTGAGACTTT | AGG | chr17 | 42904516 | 42904535 | 42904519 | - |
| SEQ ID NO 56792 | AGAGGGCAGCTGAGACTTTA | GGG | chr17 | 42904515 | 42904534 | 42904518 | - |
| SEQ ID NO 56793 | GGCAGCTGAGACTTTAGGGT | GAG | chr17 | 42904511 | 42904530 | 42904514 | - |
| SEQ ID NO 56794 | GCAGCTGAGACTTTAGGGTG | AGG | chr17 | 42904510 | 42904529 | 42904513 | - |
| SEQ ID NO 56795 | CAGCTGAGACTTTAGGGTGA | GGG | chr17 | 42904509 | 42904528 | 42904512 | - |
| SEQ ID NO 56796 | GCTGAGACTTTAGGGTGAGG | GAG | chr17 | 42904507 | 42904526 | 42904510 | - |
| SEQ ID NO 56797 | CTGAGACTTTAGGGTGAGGG | AGG | chr17 | 42904506 | 42904525 | 42904509 | - |
| SEQ ID NO 56798 | TGAGACTTTAGGGTGAGGGA | GGG | chr17 | 42904505 | 42904524 | 42904508 | - |
| SEQ ID NO 56799 | GAGACTTTAGGGTGAGGGAG | GGG | chr17 | 42904504 | 42904523 | 42904507 | - |
| SEQ ID NO 56800 | AAATCTATCATTTGATTTGA | CAG | chr17 | 42904458 | 42904477 | 42904461 | - |
| SEQ ID NO 56801 | TTGATTTGACAGTAACCATC | TGG | chr17 | 42904447 | 42904466 | 42904450 | - |
| SEQ ID NO 56802 | TGGCTGTAACTAATAAAACG | TAG | chr17 | 42904427 | 42904446 | 42904430 | - |
| SEQ ID NO 56803 | GGCTGTAACTAATAAAACGT | AGG | chr17 | 42904426 | 42904445 | 42904429 | - |
| SEQ ID NO 56804 | TAACTAATAAAACGTAGGCA | CAG | chr17 | 42904421 | 42904440 | 42904424 | - |
| SEQ ID NO 56805 | ACTAATAAAACGTAGGCACA | GAG | chr17 | 42904419 | 42904438 | 42904422 | - |
| SEQ ID NO 56806 | TAATAAAACGTAGGCACAGA | GAG | chr17 | 42904417 | 42904436 | 42904420 | - |
| SEQ ID NO 56807 | AATAAAACGTAGGCACAGAG | AGG | chr17 | 42904416 | 42904435 | 42904419 | - |
| SEQ ID NO 56808 | ATAAAACGTAGGCACAGAGA | GGG | chr17 | 42904415 | 42904434 | 42904418 | - |
| SEQ ID NO 56809 | AACGTAGGCACAGAGAGGGC | AAG | chr17 | 42904411 | 42904430 | 42904414 | - |
| SEQ ID NO 56810 | ACGTAGGCACAGAGAGGGCA | AGG | chr17 | 42904410 | 42904429 | 42904413 | - |
| SEQ ID NO 56811 | CGTAGGCACAGAGAGGGCAA | GGG | chr17 | 42904409 | 42904428 | 42904412 | - |
| SEQ ID NO 56812 | GCACAGAGAGGGCAAGGGAT | TGG | chr17 | 42904404 | 42904423 | 42904407 | - |
| SEQ ID NO 56813 | AGAGAGGGCAAGGGATTGGA | CGG | chr17 | 42904400 | 42904419 | 42904403 | - |
| SEQ ID NO 56814 | AGGGCAAGGGATTGGACGGT | CAG | chr17 | 42904396 | 42904415 | 42904399 | - |
| SEQ ID NO 56815 | AAGGGATTGGACGGTCAGCT | CAG | chr17 | 42904391 | 42904410 | 42904394 | - |
| SEQ ID NO 56816 | AGGGATTGGACGGTCAGCTC | AGG | chr17 | 42904390 | 42904409 | 42904393 | - |
| SEQ ID NO 56817 | GGATTGGACGGTCAGCTCAG | GAG | chr17 | 42904388 | 42904407 | 42904391 | - |
| SEQ ID NO 56818 | GATTGGACGGTCAGCTCAGG | AGG | chr17 | 42904387 | 42904406 | 42904390 | - |
| SEQ ID NO 56819 | ATTGGACGGTCAGCTCAGGA | GGG | chr17 | 42904386 | 42904405 | 42904389 | - |
| SEQ ID NO 56820 | TCAGCTCAGGAGGGCACATC | CAG | chr17 | 42904377 | 42904396 | 42904380 | - |
| SEQ ID NO 56821 | GCTCAGGAGGGCACATCCAG | TGG | chr17 | 42904374 | 42904393 | 42904377 | - |
| SEQ ID NO 56822 | CTCAGGAGGGCACATCCAGT | GGG | chr17 | 42904373 | 42904392 | 42904376 | - |
| SEQ ID NO 56823 | GGAGGGCACATCCAGTGGGC | CAG | chr17 | 42904369 | 42904388 | 42904372 | - |
| SEQ ID NO 56824 | GAGGGCACATCCAGTGGGCC | AGG | chr17 | 42904368 | 42904387 | 42904371 | - |
| SEQ ID NO 56825 | CATCCAGTGGGCCAGGCCAT | TGG | chr17 | 42904361 | 42904380 | 42904364 | - |
| SEQ ID NO 56826 | ATCCAGTGGGCCAGGCCATT | GGG | chr17 | 42904360 | 42904379 | 42904363 | - |
| SEQ ID NO 56827 | CAGTGGGCCAGGCCATTGGG | AAG | chr17 | 42904357 | 42904376 | 42904360 | - |
| SEQ ID NO 56828 | AGTGGGCCAGGCCATTGGGA | AGG | chr17 | 42904356 | 42904375 | 42904359 | - |
| SEQ ID NO 56829 | AGGCCATTGGGAAGGACCCC | CAG | chr17 | 42904348 | 42904367 | 42904351 | - |
| SEQ ID NO 56830 | CCATTGGGAAGGACCCCCAG | AAG | chr17 | 42904345 | 42904364 | 42904348 | - |
| SEQ ID NO 56831 | GGGAAGGACCCCCAGAAGCT | CAG | chr17 | 42904340 | 42904359 | 42904343 | - |

Figure 85 (Cont'd)

| SEQ ID NO 56832 | GGAAGGACCCCCAGAAGCTC | AGG | chr17 | 42904339 | 42904358 | 42904342 | - |
|---|---|---|---|---|---|---|---|
| SEQ ID NO 56833 | GCTTCTGCCCCCTCCTTTCT | CAG | chr17 | 42904317 | 42904336 | 42904320 | - |
| SEQ ID NO 56834 | CTTCTGCCCCCTCCTTTCTC | AGG | chr17 | 42904316 | 42904335 | 42904319 | - |
| SEQ ID NO 56835 | CCCCCTCCTTTCTCAGGACA | CAG | chr17 | 42904310 | 42904329 | 42904313 | - |
| SEQ ID NO 56836 | TTTCTCAGGACACAGCGCTG | CAG | chr17 | 42904302 | 42904321 | 42904305 | - |
| SEQ ID NO 56837 | TTCTCAGGACACAGCGCTGC | AGG | chr17 | 42904301 | 42904320 | 42904304 | - |
| SEQ ID NO 56838 | TCTCAGGACACAGCGCTGCA | GGG | chr17 | 42904300 | 42904319 | 42904303 | - |
| SEQ ID NO 56839 | CAGGACACAGCGCTGCAGGG | CGG | chr17 | 42904297 | 42904316 | 42904300 | - |
| SEQ ID NO 56840 | TGCAGGGCGGTGACTCTCAC | GAG | chr17 | 42904284 | 42904303 | 42904287 | - |
| SEQ ID NO 56841 | TCTCACGAGCCCTTTGCCCA | TGG | chr17 | 42904270 | 42904289 | 42904273 | - |
| SEQ ID NO 56842 | CATGGATGCCCGTGCCTCTC | TGG | chr17 | 42904252 | 42904271 | 42904255 | - |
| SEQ ID NO 56843 | GTGCCTCTCTGGACTCCATC | CAG | chr17 | 42904241 | 42904260 | 42904244 | - |
| SEQ ID NO 56844 | TGCCTCTCTGGACTCCATCC | AGG | chr17 | 42904240 | 42904259 | 42904243 | - |
| SEQ ID NO 56845 | ACTCCATCCAGGTTCTGTAA | TAG | chr17 | 42904229 | 42904248 | 42904232 | - |
| SEQ ID NO 56846 | CTCCATCCAGGTTCTGTAAT | AGG | chr17 | 42904228 | 42904247 | 42904231 | - |
| SEQ ID NO 56847 | CATCCAGGTTCTGTAATAGG | CAG | chr17 | 42904225 | 42904244 | 42904228 | - |
| SEQ ID NO 56848 | TCCAATACTACTGTGCTATT | CAG | chr17 | 42904199 | 42904218 | 42904202 | - |
| SEQ ID NO 56849 | CCAATACTACTGTGCTATTC | AGG | chr17 | 42904198 | 42904217 | 42904201 | - |
| SEQ ID NO 56850 | TACTACTGTGCTATTCAGGA | AAG | chr17 | 42904194 | 42904213 | 42904197 | - |
| SEQ ID NO 56851 | TGCTATTCAGGAAAGTATTG | CAG | chr17 | 42904186 | 42904205 | 42904189 | - |
| SEQ ID NO 56852 | TATTCAGGAAAGTATTGCAG | AAG | chr17 | 42904183 | 42904202 | 42904186 | - |
| SEQ ID NO 56853 | GAATTAATTTGTGCCAATTG | AAG | chr17 | 42904159 | 42904178 | 42904162 | - |
| SEQ ID NO 56854 | ATTAATTTGTGCCAATTGAA | GAG | chr17 | 42904157 | 42904176 | 42904160 | - |
| SEQ ID NO 56855 | CCAATTGAAGAGCATGACAA | AAG | chr17 | 42904146 | 42904165 | 42904149 | - |
| SEQ ID NO 56856 | AAGAGCATGACAAAAGTACA | AAG | chr17 | 42904139 | 42904158 | 42904142 | - |
| SEQ ID NO 56857 | AGAGCATGACAAAAGTACAA | AGG | chr17 | 42904138 | 42904157 | 42904141 | - |
| SEQ ID NO 56858 | ATGACAAAAGTACAAAGGAA | TGG | chr17 | 42904133 | 42904152 | 42904136 | - |
| SEQ ID NO 56859 | GGCTCTCCTCATGTCCCTC | AAG | chr17 | 42904112 | 42904131 | 42904115 | - |
| SEQ ID NO 56860 | GCTCTCCTCATGTCCCTCA | AGG | chr17 | 42904111 | 42904130 | 42904114 | - |
| SEQ ID NO 56861 | TCCTCATGTCCCTCAAGGT | CAG | chr17 | 42904107 | 42904126 | 42904110 | - |
| SEQ ID NO 56862 | AAGGTCAGTTTCATCCATAA | CAG | chr17 | 42904092 | 42904111 | 42904095 | - |
| SEQ ID NO 56863 | AGGTCAGTTTCATCCATAAC | AGG | chr17 | 42904091 | 42904110 | 42904094 | - |
| SEQ ID NO 56864 | TTCATCCATAACAGGTAAAC | GAG | chr17 | 42904083 | 42904102 | 42904086 | - |
| SEQ ID NO 56865 | TCATCCATAACAGGTAAACG | AGG | chr17 | 42904082 | 42904101 | 42904085 | - |
| SEQ ID NO 56866 | ACAGGTAAACGAGGTCCACT | CAG | chr17 | 42904073 | 42904092 | 42904076 | - |
| SEQ ID NO 56867 | GTCCACTCAGCTTCTGTCTG | CAG | chr17 | 42904060 | 42904079 | 42904063 | - |
| SEQ ID NO 56868 | TCCACTCAGCTTCTGTCTGC | AGG | chr17 | 42904059 | 42904078 | 42904062 | - |
| SEQ ID NO 56869 | CCACTCAGCTTCTGTCTGCA | GGG | chr17 | 42904058 | 42904077 | 42904061 | - |
| SEQ ID NO 56870 | CACTCAGCTTCTGTCTGCAG | GGG | chr17 | 42904057 | 42904076 | 42904060 | - |
| SEQ ID NO 56871 | CAGCTTCTGTCTGCAGGGGC | TGG | chr17 | 42904053 | 42904072 | 42904056 | - |
| SEQ ID NO 56872 | AGCTTCTGTCTGCAGGGGCT | GGG | chr17 | 42904052 | 42904071 | 42904055 | - |
| SEQ ID NO 56873 | CAGGGGCTGGGACGCTTACC | TGG | chr17 | 42904040 | 42904059 | 42904043 | - |
| SEQ ID NO 56874 | GCTGGGACGCTTACCTGGTC | CAG | chr17 | 42904035 | 42904054 | 42904038 | - |
| SEQ ID NO 56875 | GCTTACCTGGTCCAGTCTCA | CAG | chr17 | 42904027 | 42904046 | 42904030 | - |
| SEQ ID NO 56876 | CTTACCTGGTCCAGTCTCAC | AGG | chr17 | 42904026 | 42904045 | 42904029 | - |
| SEQ ID NO 56877 | TGGTCCAGTCTCACAGGTTA | CAG | chr17 | 42904020 | 42904039 | 42904023 | - |
| SEQ ID NO 56878 | GGTCCAGTCTCACAGGTTAC | AGG | chr17 | 42904019 | 42904038 | 42904022 | - |

Figure 85 (Cont'd)

| SEQ ID NO 56879 | GTCCAGTCTCACAGGTTACA | GGG | chr17 | 42904018 | 42904037 | 42904021 | - |
|---|---|---|---|---|---|---|---|
| SEQ ID NO 56880 | GTTACAGGGAACTGCTTTAT | CAG | chr17 | 42904004 | 42904023 | 42904007 | - |
| SEQ ID NO 56881 | TTACAGGGAACTGCTTTATC | AGG | chr17 | 42904003 | 42904022 | 42904006 | - |
| SEQ ID NO 56882 | TACAGGGAACTGCTTTATCA | GGG | chr17 | 42904002 | 42904021 | 42904005 | - |
| SEQ ID NO 56883 | ACAGGGAACTGCTTTATCAG | GGG | chr17 | 42904001 | 42904020 | 42904004 | - |
| SEQ ID NO 56884 | GAACTGCTTTATCAGGGGCA | CGG | chr17 | 42903996 | 42904015 | 42903999 | - |
| SEQ ID NO 56885 | CTGCTTTATCAGGGGCACGG | AAG | chr17 | 42903993 | 42904012 | 42903996 | - |
| SEQ ID NO 56886 | GGGGCACGGAAGTGTTGCTG | TAG | chr17 | 42903982 | 42904001 | 42903985 | - |
| SEQ ID NO 56887 | GCACGGAAGTGTTGCTGTAG | TAG | chr17 | 42903979 | 42903998 | 42903982 | - |
| SEQ ID NO 56888 | GGAAGTGTTGCTGTAGTAGT | CAG | chr17 | 42903975 | 42903994 | 42903978 | - |
| SEQ ID NO 56889 | AGTCAGTATCCAAAACCCAC | CAG | chr17 | 42903958 | 42903977 | 42903961 | - |
| SEQ ID NO 56890 | GTATCCAAAACCCACCAGTA | TGG | chr17 | 42903953 | 42903972 | 42903956 | - |
| SEQ ID NO 56891 | ACCAGTATGGACGCTGTCCA | AAG | chr17 | 42903940 | 42903959 | 42903943 | - |
| SEQ ID NO 56892 | CAGTATGGACGCTGTCCAAA | GAG | chr17 | 42903938 | 42903957 | 42903941 | - |
| SEQ ID NO 56893 | GCTGTCCAAAGAGAATCCTA | TGG | chr17 | 42903928 | 42903947 | 42903931 | - |
| SEQ ID NO 56894 | AAGAGAATCCTATGGAAAAA | CAG | chr17 | 42903920 | 42903939 | 42903923 | - |
| SEQ ID NO 56895 | ATCCTATGGAAAAACAGAAC | AAG | chr17 | 42903914 | 42903933 | 42903917 | - |
| SEQ ID NO 56896 | GGAAAAACAGAACAAGTTTC | TGG | chr17 | 42903907 | 42903926 | 42903910 | - |
| SEQ ID NO 56897 | GAAAAACAGAACAAGTTTCT | GGG | chr17 | 42903906 | 42903925 | 42903909 | - |
| SEQ ID NO 56898 | AAAAACAGAACAAGTTTCTG | GGG | chr17 | 42903905 | 42903924 | 42903908 | - |
| SEQ ID NO 56899 | TGAATGAATGCTTTTGCCCA | AAG | chr17 | 42903878 | 42903897 | 42903881 | - |
| SEQ ID NO 56900 | TGCCCAAAGCCTACACCTTC | AAG | chr17 | 42903864 | 42903883 | 42903867 | - |
| SEQ ID NO 56901 | CCAAAGCCTACACCTTCAAG | AAG | chr17 | 42903861 | 42903880 | 42903864 | - |
| SEQ ID NO 56902 | AAAGCCTACACCTTCAAGAA | GAG | chr17 | 42903859 | 42903878 | 42903862 | - |
| SEQ ID NO 56903 | CTACACCTTCAAGAAGAGTG | TAG | chr17 | 42903854 | 42903873 | 42903857 | - |
| SEQ ID NO 56904 | CTTCAAGAAGAGTGTAGCCT | GAG | chr17 | 42903848 | 42903867 | 42903851 | - |
| SEQ ID NO 56905 | CAAGAAGAGTGTAGCCTGAG | AAG | chr17 | 42903845 | 42903864 | 42903848 | - |
| SEQ ID NO 56906 | AAGAAGAGTGTAGCCTGAGA | AGG | chr17 | 42903844 | 42903863 | 42903847 | - |
| SEQ ID NO 56907 | AGGATTTCACATGTTGCCTC | TAG | chr17 | 42903824 | 42903843 | 42903827 | - |
| SEQ ID NO 56908 | ATTTCACATGTTGCCTCTAG | AAG | chr17 | 42903821 | 42903840 | 42903824 | - |
| SEQ ID NO 56909 | TTTCACATGTTGCCTCTAGA | AGG | chr17 | 42903820 | 42903839 | 42903823 | - |
| SEQ ID NO 56910 | TTCACATGTTGCCTCTAGAA | GGG | chr17 | 42903819 | 42903838 | 42903822 | - |
| SEQ ID NO 56911 | CACATGTTGCCTCTAGAAGG | GAG | chr17 | 42903817 | 42903836 | 42903820 | - |
| SEQ ID NO 56912 | TTGCCTCTAGAAGGGAGAAC | TGG | chr17 | 42903811 | 42903830 | 42903814 | - |
| SEQ ID NO 56913 | TGCCTCTAGAAGGGAGAACT | GGG | chr17 | 42903810 | 42903829 | 42903813 | - |
| SEQ ID NO 56914 | CTCTAGAAGGGAGAACTGGG | TGG | chr17 | 42903807 | 42903826 | 42903810 | - |
| SEQ ID NO 56915 | AGAAGGGAGAACTGGGTGGC | TGG | chr17 | 42903803 | 42903822 | 42903806 | - |
| SEQ ID NO 56916 | GAAGGGAGAACTGGGTGGCT | GGG | chr17 | 42903802 | 42903821 | 42903805 | - |
| SEQ ID NO 56917 | AAGGGAGAACTGGGTGGCTG | GGG | chr17 | 42903801 | 42903820 | 42903804 | - |
| SEQ ID NO 56918 | GGGAGAACTGGGTGGCTGGG | GAG | chr17 | 42903799 | 42903818 | 42903802 | - |
| SEQ ID NO 56919 | AGAACTGGGTGGCTGGGGAG | AAG | chr17 | 42903796 | 42903815 | 42903799 | - |
| SEQ ID NO 56920 | GGGTGGCTGGGGAGAAGTGT | GAG | chr17 | 42903790 | 42903809 | 42903793 | - |
| SEQ ID NO 56921 | GTGGCTGGGGAGAAGTGTGA | GAG | chr17 | 42903788 | 42903807 | 42903791 | - |
| SEQ ID NO 56922 | TGGCTGGGGAGAAGTGTGAG | AGG | chr17 | 42903787 | 42903806 | 42903790 | - |
| SEQ ID NO 56923 | GGCTGGGGAGAAGTGTGAGA | GGG | chr17 | 42903786 | 42903805 | 42903789 | - |
| SEQ ID NO 56924 | CTGGGGAGAAGTGTGAGAGG | GAG | chr17 | 42903784 | 42903803 | 42903787 | - |
| SEQ ID NO 56925 | GTATTATCTTTTTTTTTTTT | GAG | chr17 | 42903706 | 42903725 | 42903709 | - |

Figure 85 (Cont'd)

| | | | | | | | |
|---|---|---|---|---|---|---|---|
| SEQ ID NO 56926 | TATCTTTTTTTTTTTGAGA | CAG | chr17 | 42903702 | 42903721 | 42903705 | - |
| SEQ ID NO 56927 | ATCTTTTTTTTTTTGAGAC | AGG | chr17 | 42903701 | 42903720 | 42903704 | - |
| SEQ ID NO 56928 | TTTTTTTTTGAGACAGGATC | TGG | chr17 | 42903695 | 42903714 | 42903698 | - |
| SEQ ID NO 56929 | TTTTGAGACAGGATCTGGCT | CAG | chr17 | 42903690 | 42903709 | 42903693 | - |
| SEQ ID NO 56930 | CAGGATCTGGCTCAGTAACC | CAG | chr17 | 42903682 | 42903701 | 42903685 | - |
| SEQ ID NO 56931 | TCTGGCTCAGTAACCCAGCC | TGG | chr17 | 42903677 | 42903696 | 42903680 | - |
| SEQ ID NO 56932 | TGGCTCAGTAACCCAGCCTG | GAG | chr17 | 42903675 | 42903694 | 42903678 | - |
| SEQ ID NO 56933 | CAGTAACCCAGCCTGGAGTG | CAG | chr17 | 42903670 | 42903689 | 42903673 | - |
| SEQ ID NO 56934 | TAACCCAGCCTGGAGTGCAG | TGG | chr17 | 42903667 | 42903686 | 42903670 | - |
| SEQ ID NO 56935 | GGAGTGCAGTGGCGCAATCT | CGG | chr17 | 42903656 | 42903675 | 42903659 | - |
| SEQ ID NO 56936 | TCATTGTGACCTCTACCTCC | TGG | chr17 | 42903632 | 42903651 | 42903635 | - |
| SEQ ID NO 56937 | CATTGTGACCTCTACCTCCT | GGG | chr17 | 42903631 | 42903650 | 42903634 | - |
| SEQ ID NO 56938 | CTCCTGGGATCCTCCCACCT | CAG | chr17 | 42903616 | 42903635 | 42903619 | - |
| SEQ ID NO 56939 | TCCCACCTCAGCCTCCTGAA | TAG | chr17 | 42903604 | 42903623 | 42903607 | - |
| SEQ ID NO 56940 | ACCTCAGCCTCCTGAATAGC | TGG | chr17 | 42903600 | 42903619 | 42903603 | - |
| SEQ ID NO 56941 | CCTCAGCCTCCTGAATAGCT | GGG | chr17 | 42903599 | 42903618 | 42903602 | - |
| SEQ ID NO 56942 | CTCCTGAATAGCTGGGACTA | CAG | chr17 | 42903592 | 42903611 | 42903595 | - |
| SEQ ID NO 56943 | TCCTGAATAGCTGGGACTAC | AGG | chr17 | 42903591 | 42903610 | 42903594 | - |
| SEQ ID NO 56944 | CAGGTGTGTGCCACCACATC | CAG | chr17 | 42903572 | 42903591 | 42903575 | - |
| SEQ ID NO 56945 | TGTGTGCCACCACATCCAGC | TAG | chr17 | 42903568 | 42903587 | 42903571 | - |
| SEQ ID NO 56946 | CCAGCTAGTTTTTGTATTTT | TAG | chr17 | 42903553 | 42903572 | 42903556 | - |
| SEQ ID NO 56947 | GCTAGTTTTTGTATTTTTAG | TAG | chr17 | 42903550 | 42903569 | 42903553 | - |
| SEQ ID NO 56948 | TAGTTTTTGTATTTTTAGTA | GAG | chr17 | 42903548 | 42903567 | 42903551 | - |
| SEQ ID NO 56949 | TTTTGTATTTTTAGTAGAGA | CGG | chr17 | 42903544 | 42903563 | 42903547 | - |
| SEQ ID NO 56950 | TTTGTATTTTTAGTAGAGAC | GGG | chr17 | 42903543 | 42903562 | 42903546 | - |
| SEQ ID NO 56951 | TTGTATTTTTAGTAGAGACG | GGG | chr17 | 42903542 | 42903561 | 42903545 | - |
| SEQ ID NO 56952 | CGGGGTTTCACCATGTTGCC | CAG | chr17 | 42903524 | 42903543 | 42903527 | - |
| SEQ ID NO 56953 | GGGGTTTCACCATGTTGCCC | AGG | chr17 | 42903523 | 42903542 | 42903526 | - |
| SEQ ID NO 56954 | TTTCACCATGTTGCCCAGGC | TGG | chr17 | 42903519 | 42903538 | 42903522 | - |
| SEQ ID NO 56955 | TGGTCTCCATCTCCTGAACT | CAG | chr17 | 42903499 | 42903518 | 42903502 | - |
| SEQ ID NO 56956 | GGTCTCCATCTCCTGAACTC | AGG | chr17 | 42903498 | 42903517 | 42903501 | - |
| SEQ ID NO 56957 | CTCAGGCAATCCTCCCACCT | CAG | chr17 | 42903481 | 42903500 | 42903484 | - |
| SEQ ID NO 56958 | CCTCCCACCTCAGCCTCCCA | AAG | chr17 | 42903471 | 42903490 | 42903474 | - |
| SEQ ID NO 56959 | ACCTCAGCCTCCCAAAGTGC | TGG | chr17 | 42903465 | 42903484 | 42903468 | - |
| SEQ ID NO 56960 | CCTCAGCCTCCCAAAGTGCT | GGG | chr17 | 42903464 | 42903483 | 42903467 | - |
| SEQ ID NO 56961 | CTCCCAAAGTGCTGGGATTA | CAG | chr17 | 42903457 | 42903476 | 42903460 | - |
| SEQ ID NO 56962 | TCCCAAAGTGCTGGGATTAC | AGG | chr17 | 42903456 | 42903475 | 42903459 | - |
| SEQ ID NO 56963 | AGTGCTGGGATTACAGGCAT | GAG | chr17 | 42903450 | 42903469 | 42903453 | - |
| SEQ ID NO 56964 | CTATTTAAACACAAATAATG | AAG | chr17 | 42903405 | 42903424 | 42903408 | - |
| SEQ ID NO 56965 | AAACACAAATAATGAAGCCC | AAG | chr17 | 42903399 | 42903418 | 42903402 | - |
| SEQ ID NO 56966 | AAGCCCAAGATTCTGAACTC | CAG | chr17 | 42903385 | 42903404 | 42903388 | - |
| SEQ ID NO 56967 | AGCCCAAGATTCTGAACTCC | AGG | chr17 | 42903384 | 42903403 | 42903387 | - |
| SEQ ID NO 56968 | CCAAGATTCTGAACTCCAGG | CAG | chr17 | 42903381 | 42903400 | 42903384 | - |
| SEQ ID NO 56969 | CAAGATTCTGAACTCCAGGC | AGG | chr17 | 42903380 | 42903399 | 42903383 | - |
| SEQ ID NO 56970 | TTCTGAACTCCAGGCAGGCG | CGG | chr17 | 42903375 | 42903394 | 42903378 | - |
| SEQ ID NO 56971 | TGAACTCCAGGCAGGCGCGG | TGG | chr17 | 42903372 | 42903391 | 42903375 | - |
| SEQ ID NO 56972 | GTGGCTCACACCTGTAATCT | CAG | chr17 | 42903353 | 42903372 | 42903356 | - |

Figure 85 (Cont'd)

| SEQ ID | Sequence | PAM | Chr | Start | End | Pos | Strand |
|---|---|---|---|---|---|---|---|
| SEQ ID NO 56973 | CACCTGTAATCTCAGCACTT | TGG | chr17 | 42903345 | 42903364 | 42903348 | - |
| SEQ ID NO 56974 | ACCTGTAATCTCAGCACTTT | GGG | chr17 | 42903344 | 42903363 | 42903347 | - |
| SEQ ID NO 56975 | CTGTAATCTCAGCACTTTGG | GAG | chr17 | 42903342 | 42903361 | 42903345 | - |
| SEQ ID NO 56976 | TGTAATCTCAGCACTTTGGG | AGG | chr17 | 42903341 | 42903360 | 42903344 | - |
| SEQ ID NO 56977 | TCTCAGCACTTTGGGAGGCC | AAG | chr17 | 42903336 | 42903355 | 42903339 | - |
| SEQ ID NO 56978 | CTCAGCACTTTGGGAGGCCA | AGG | chr17 | 42903335 | 42903354 | 42903338 | - |
| SEQ ID NO 56979 | AGCACTTTGGGAGGCCAAGG | CAG | chr17 | 42903332 | 42903351 | 42903335 | - |
| SEQ ID NO 56980 | GCACTTTGGGAGGCCAAGGC | AGG | chr17 | 42903331 | 42903350 | 42903334 | - |
| SEQ ID NO 56981 | CTTTGGGAGGCCAAGGCAGG | CAG | chr17 | 42903328 | 42903347 | 42903331 | - |
| SEQ ID NO 56982 | CCAAGGCAGGCAGATCACAT | GAG | chr17 | 42903318 | 42903337 | 42903321 | - |
| SEQ ID NO 56983 | CAAGGCAGGCAGATCACATG | AGG | chr17 | 42903317 | 42903336 | 42903320 | - |
| SEQ ID NO 56984 | GCAGGCAGATCACATGAGGT | CAG | chr17 | 42903313 | 42903332 | 42903316 | - |
| SEQ ID NO 56985 | CAGGCAGATCACATGAGGTC | AGG | chr17 | 42903312 | 42903331 | 42903315 | - |
| SEQ ID NO 56986 | GGCAGATCACATGAGGTCAG | GAG | chr17 | 42903310 | 42903329 | 42903313 | - |
| SEQ ID NO 56987 | TCACATGAGGTCAGGAGTTT | GAG | chr17 | 42903304 | 42903323 | 42903307 | - |
| SEQ ID NO 56988 | TGAGGTCAGGAGTTTGAGAC | CAG | chr17 | 42903299 | 42903318 | 42903302 | - |
| SEQ ID NO 56989 | TCAGGAGTTTGAGACCAGCC | TGG | chr17 | 42903294 | 42903313 | 42903297 | - |
| SEQ ID NO 56990 | TGAGACCAGCCTGGCCAACA | TGG | chr17 | 42903285 | 42903304 | 42903288 | - |
| SEQ ID NO 56991 | CGTTTCTACCAAAAAATATA | AAG | chr17 | 42903254 | 42903273 | 42903257 | - |
| SEQ ID NO 56992 | TACCAAAAAATATAAAGAAT | TAG | chr17 | 42903248 | 42903267 | 42903251 | - |
| SEQ ID NO 56993 | AAAAAATATAAAGAATTAGC | CAG | chr17 | 42903244 | 42903263 | 42903247 | - |
| SEQ ID NO 56994 | TATAAAGAATTAGCCAGATG | TGG | chr17 | 42903238 | 42903257 | 42903241 | - |
| SEQ ID NO 56995 | AAAGAATTAGCCAGATGTGG | TGG | chr17 | 42903235 | 42903254 | 42903238 | - |
| SEQ ID NO 56996 | GTGGTGCGTGACTGTAATCC | CAG | chr17 | 42903216 | 42903235 | 42903219 | - |
| SEQ ID NO 56997 | TGACTGTAATCCCAGCTACT | CGG | chr17 | 42903208 | 42903227 | 42903211 | - |
| SEQ ID NO 56998 | GACTGTAATCCCAGCTACTC | GGG | chr17 | 42903207 | 42903226 | 42903210 | - |
| SEQ ID NO 56999 | CTGTAATCCCAGCTACTCGG | GAG | chr17 | 42903205 | 42903224 | 42903208 | - |
| SEQ ID NO 57000 | TGTAATCCCAGCTACTCGGG | AGG | chr17 | 42903204 | 42903223 | 42903207 | - |
| SEQ ID NO 57001 | TCCCAGCTACTCGGGAGGCT | AAG | chr17 | 42903199 | 42903218 | 42903202 | - |
| SEQ ID NO 57002 | CCCAGCTACTCGGGAGGCTA | AGG | chr17 | 42903198 | 42903217 | 42903201 | - |
| SEQ ID NO 57003 | GCTACTCGGGAGGCTAAGGC | AAG | chr17 | 42903194 | 42903213 | 42903197 | - |
| SEQ ID NO 57004 | TACTCGGGAGGCTAAGGCAA | GAG | chr17 | 42903192 | 42903211 | 42903195 | - |
| SEQ ID NO 57005 | GCAAGAGAATCGCTTGAACC | TGG | chr17 | 42903176 | 42903195 | 42903179 | - |
| SEQ ID NO 57006 | CAAGAGAATCGCTTGAACCT | GGG | chr17 | 42903175 | 42903194 | 42903178 | - |
| SEQ ID NO 57007 | AGAGAATCGCTTGAACCTGG | GAG | chr17 | 42903173 | 42903192 | 42903176 | - |
| SEQ ID NO 57008 | GAGAATCGCTTGAACCTGGG | AGG | chr17 | 42903172 | 42903191 | 42903175 | - |
| SEQ ID NO 57009 | AATCGCTTGAACCTGGGAGG | CGG | chr17 | 42903169 | 42903188 | 42903172 | - |
| SEQ ID NO 57010 | TCGCTTGAACCTGGGAGGCG | GAG | chr17 | 42903167 | 42903186 | 42903170 | - |
| SEQ ID NO 57011 | CGCTTGAACCTGGGAGGCGG | AGG | chr17 | 42903166 | 42903185 | 42903169 | - |
| SEQ ID NO 57012 | TGGGAGGCGGAGGTTGCCGT | GAG | chr17 | 42903156 | 42903175 | 42903159 | - |
| SEQ ID NO 57013 | GGCGGAGGTTGCCGTGAGCC | GAG | chr17 | 42903151 | 42903170 | 42903154 | - |
| SEQ ID NO 57014 | GAGATTATGCCACTGCACTA | CAG | chr17 | 42903131 | 42903150 | 42903134 | - |
| SEQ ID NO 57015 | AGATTATGCCACTGCACTAC | AGG | chr17 | 42903130 | 42903149 | 42903133 | - |
| SEQ ID NO 57016 | TATGCCACTGCACTACAGGC | TGG | chr17 | 42903126 | 42903145 | 42903129 | - |
| SEQ ID NO 57017 | ATGCCACTGCACTACAGGCT | GGG | chr17 | 42903125 | 42903144 | 42903128 | - |
| SEQ ID NO 57018 | CTGCACTACAGGCTGGGTGA | CAG | chr17 | 42903119 | 42903138 | 42903122 | - |
| SEQ ID NO 57019 | GCACTACAGGCTGGGTGACA | GAG | chr17 | 42903117 | 42903136 | 42903120 | - |

Figure 85 (Cont'd)

| SEQ ID NO 57020 | TACAGGCTGGGTGACAGAGC | AAG | chr17 | 42903113 | 42903132 | 42903116 | - |
| SEQ ID NO 57021 | AAATCCTGAAATCCATAAAA | TGG | chr17 | 42903064 | 42903083 | 42903067 | - |
| SEQ ID NO 57022 | TCCTGAAATCCATAAAATGG | CAG | chr17 | 42903061 | 42903080 | 42903064 | - |
| SEQ ID NO 57023 | GACTTTTTTTTTTAACCTC | AAG | chr17 | 42903032 | 42903051 | 42903035 | - |
| SEQ ID NO 57024 | TTTTTTTTTTAACCTCAAG | AAG | chr17 | 42903029 | 42903048 | 42903032 | - |
| SEQ ID NO 57025 | ACCTCAAGAAGTATTTGTCC | TGG | chr17 | 42903017 | 42903036 | 42903020 | - |
| SEQ ID NO 57026 | TCAAGAAGTATTTGTCCTGG | AAG | chr17 | 42903014 | 42903033 | 42903017 | - |
| SEQ ID NO 57027 | TTGTCCTGGAAGAATGCATA | TGG | chr17 | 42903003 | 42903022 | 42903006 | - |
| SEQ ID NO 57028 | GAAGAATGCATATGGAACTA | CAG | chr17 | 42902995 | 42903014 | 42902998 | - |
| SEQ ID NO 57029 | TGGAACTACAGTTTGAAACT | TGG | chr17 | 42902983 | 42903002 | 42902986 | - |
| SEQ ID NO 57030 | ACTTGGACTTGCATATACCA | TGG | chr17 | 42902966 | 42902985 | 42902969 | - |
| SEQ ID NO 57031 | CTTGGACTTGCATATACCAT | GGG | chr17 | 42902965 | 42902984 | 42902968 | - |
| SEQ ID NO 57032 | GCATATACCATGGGTTCCCT | CAG | chr17 | 42902956 | 42902975 | 42902959 | - |
| SEQ ID NO 57033 | CATATACCATGGGTTCCCTC | AGG | chr17 | 42902955 | 42902974 | 42902958 | - |
| SEQ ID NO 57034 | CCATGGGTTCCCTCAGGCCT | CAG | chr17 | 42902949 | 42902968 | 42902952 | - |
| SEQ ID NO 57035 | CATGGGTTCCCTCAGGCCTC | AGG | chr17 | 42902948 | 42902967 | 42902951 | - |
| SEQ ID NO 57036 | ATGGGTTCCCTCAGGCCTCA | GGG | chr17 | 42902947 | 42902966 | 42902950 | - |
| SEQ ID NO 57037 | TCTTGCATTTCCTCTGACAT | CAG | chr17 | 42902922 | 42902941 | 42902925 | - |
| SEQ ID NO 57038 | TTGCATTTCCTCTGACATCA | GAG | chr17 | 42902920 | 42902939 | 42902923 | - |
| SEQ ID NO 57039 | TGACATCAGAGAATGCACTC | CAG | chr17 | 42902908 | 42902927 | 42902911 | - |
| SEQ ID NO 57040 | AGAGAATGCACTCCAGCCCC | TAG | chr17 | 42902901 | 42902920 | 42902904 | - |
| SEQ ID NO 57041 | GAGAATGCACTCCAGCCCCT | AGG | chr17 | 42902900 | 42902919 | 42902903 | - |
| SEQ ID NO 57042 | TGCACTCCAGCCCCTAGGAC | GAG | chr17 | 42902895 | 42902914 | 42902898 | - |
| SEQ ID NO 57043 | CCCCTAGGACGAGCCCCCCC | CAG | chr17 | 42902885 | 42902904 | 42902888 | - |
| SEQ ID NO 57044 | CCCTAGGACGAGCCCCCCCC | AGG | chr17 | 42902884 | 42902903 | 42902887 | - |
| SEQ ID NO 57045 | CCTAGGACGAGCCCCCCCCA | GGG | chr17 | 42902883 | 42902902 | 42902886 | - |
| SEQ ID NO 57046 | GAGCCCCCCCCAGGGAAACA | TGG | chr17 | 42902875 | 42902894 | 42902878 | - |
| SEQ ID NO 57047 | AACATGGCCTGCATTTCCAT | CAG | chr17 | 42902859 | 42902878 | 42902862 | - |
| SEQ ID NO 57048 | CCATCAGAATTGCTCTCTGT | AAG | chr17 | 42902843 | 42902862 | 42902846 | - |
| SEQ ID NO 57049 | CATCAGAATTGCTCTCTGTA | AGG | chr17 | 42902842 | 42902861 | 42902845 | - |
| SEQ ID NO 57050 | GCTCTCTGTAAGGATGTATA | TAG | chr17 | 42902832 | 42902851 | 42902835 | - |
| SEQ ID NO 57051 | TGTAAGGATGTATATAGCTT | CAG | chr17 | 42902826 | 42902845 | 42902829 | - |
| SEQ ID NO 57052 | GTATCCTCTCTACTTTGAAA | CAG | chr17 | 42902792 | 42902811 | 42902795 | - |
| SEQ ID NO 57053 | ATCCTCTCTACTTTGAAACA | GAG | chr17 | 42902790 | 42902809 | 42902793 | - |
| SEQ ID NO 57054 | TACTTTGAAACAGAGTATCT | CAG | chr17 | 42902782 | 42902801 | 42902785 | - |
| SEQ ID NO 57055 | ACAAACCACTTCCCCTTTAA | AAG | chr17 | 42902759 | 42902778 | 42902762 | - |
| SEQ ID NO 57056 | CACTTCCCCTTTAAAAGTAC | TAG | chr17 | 42902753 | 42902772 | 42902756 | - |
| SEQ ID NO 57057 | ACTAGATATATCTTTCACTG | TGG | chr17 | 42902735 | 42902754 | 42902738 | - |
| SEQ ID NO 57058 | TATATCTTTCACTGTGGAAA | TAG | chr17 | 42902729 | 42902748 | 42902732 | - |
| SEQ ID NO 57059 | ATATCTTTCACTGTGGAAAT | AGG | chr17 | 42902728 | 42902747 | 42902731 | - |
| SEQ ID NO 57060 | TGGAAATAGGTGTCAACCGC | CAG | chr17 | 42902715 | 42902734 | 42902718 | - |
| SEQ ID NO 57061 | AATAGGTGTCAACCGCCAGT | CAG | chr17 | 42902711 | 42902730 | 42902714 | - |
| SEQ ID NO 57062 | ATAGGTGTCAACCGCCAGTC | AGG | chr17 | 42902710 | 42902729 | 42902713 | - |
| SEQ ID NO 57063 | GGATGCCTTTTATCCCGTGA | TGG | chr17 | 42902689 | 42902708 | 42902692 | - |
| SEQ ID NO 57064 | TGCCTTTTATCCCGTGATGG | TGG | chr17 | 42902686 | 42902705 | 42902689 | - |
| SEQ ID NO 57065 | TTTATCCCGTGATGGTGGAA | TAG | chr17 | 42902681 | 42902700 | 42902684 | - |
| SEQ ID NO 57066 | TAGTGATTTCTCACCGAAAT | CAG | chr17 | 42902661 | 42902680 | 42902664 | - |

Figure 85 (Cont'd)

| | | | | | | | |
|---|---|---|---|---|---|---|---|
| SEQ ID NO 57067 | AGTGATTTCTCACCGAAATC | AGG | chr17 | 42902660 | 42902679 | 42902663 | - |
| SEQ ID NO 57068 | GTGATTTCTCACCGAAATCA | GGG | chr17 | 42902659 | 42902678 | 42902662 | - |
| SEQ ID NO 57069 | GATTTCTCACCGAAATCAGG | GAG | chr17 | 42902657 | 42902676 | 42902660 | - |
| SEQ ID NO 57070 | TTTCTCACCGAAATCAGGGA | GAG | chr17 | 42902655 | 42902674 | 42902658 | - |
| SEQ ID NO 57071 | TCAGGGAGAGCCACTAACTC | TGG | chr17 | 42902642 | 42902661 | 42902645 | - |
| SEQ ID NO 57072 | AACTCTGGCCTCTATCAACC | CAG | chr17 | 42902627 | 42902646 | 42902630 | - |
| SEQ ID NO 57073 | CTCTGGCCTCTATCAACCCA | GAG | chr17 | 42902625 | 42902644 | 42902628 | - |
| SEQ ID NO 57074 | CTGGCCTCTATCAACCCAGA | GAG | chr17 | 42902623 | 42902642 | 42902626 | - |
| SEQ ID NO 57075 | ATCAACCCAGAGAGATTGCA | TGG | chr17 | 42902614 | 42902633 | 42902617 | - |
| SEQ ID NO 57076 | GAGATTGCATGGTTCTTCAA | TGG | chr17 | 42902603 | 42902622 | 42902606 | - |
| SEQ ID NO 57077 | GATTGCATGGTTCTTCAATG | GAG | chr17 | 42902601 | 42902620 | 42902604 | - |
| SEQ ID NO 57078 | CATGGTTCTTCAATGGAGAT | CAG | chr17 | 42902596 | 42902615 | 42902599 | - |
| SEQ ID NO 57079 | TTCAATGGAGATCAGATGTT | TGG | chr17 | 42902588 | 42902607 | 42902591 | - |
| SEQ ID NO 57080 | CACTTCATCTTTTTATTTTT | TAG | chr17 | 42902560 | 42902579 | 42902563 | - |
| SEQ ID NO 57081 | TTTTATTTTTTAGAATCATG | CGG | chr17 | 42902550 | 42902569 | 42902553 | - |
| SEQ ID NO 57082 | ATTTTTTAGAATCATGCGGC | TGG | chr17 | 42902546 | 42902565 | 42902549 | - |
| SEQ ID NO 57083 | TTTTTTAGAATCATGCGGCT | GGG | chr17 | 42902545 | 42902564 | 42902548 | - |
| SEQ ID NO 57084 | TAGAATCATGCGGCTGGGTG | TAG | chr17 | 42902540 | 42902559 | 42902543 | - |
| SEQ ID NO 57085 | AATCATGCGGCTGGGTGTAG | TGG | chr17 | 42902537 | 42902556 | 42902540 | - |
| SEQ ID NO 57086 | GTGGCTCACGCCTGTAATCC | TAG | chr17 | 42902518 | 42902537 | 42902521 | - |
| SEQ ID NO 57087 | ACGCCTGTAATCCTAGCACT | TAG | chr17 | 42902511 | 42902530 | 42902514 | - |
| SEQ ID NO 57088 | CGCCTGTAATCCTAGCACTT | AGG | chr17 | 42902510 | 42902529 | 42902513 | - |
| SEQ ID NO 57089 | GCCTGTAATCCTAGCACTTA | GGG | chr17 | 42902509 | 42902528 | 42902512 | - |
| SEQ ID NO 57090 | CTGTAATCCTAGCACTTAGG | GAG | chr17 | 42902507 | 42902526 | 42902510 | - |
| SEQ ID NO 57091 | TGTAATCCTAGCACTTAGGG | AGG | chr17 | 42902506 | 42902525 | 42902509 | - |
| SEQ ID NO 57092 | TCCTAGCACTTAGGGAGGCC | AAG | chr17 | 42902501 | 42902520 | 42902504 | - |
| SEQ ID NO 57093 | CCTAGCACTTAGGGAGGCCA | AGG | chr17 | 42902500 | 42902519 | 42902503 | - |
| SEQ ID NO 57094 | AGCACTTAGGGAGGCCAAGG | CAG | chr17 | 42902497 | 42902516 | 42902500 | - |
| SEQ ID NO 57095 | GCACTTAGGGAGGCCAAGGC | AGG | chr17 | 42902496 | 42902515 | 42902499 | - |
| SEQ ID NO 57096 | CTTAGGGAGGCCAAGGCAGG | CAG | chr17 | 42902493 | 42902512 | 42902496 | - |
| SEQ ID NO 57097 | GGCCAAGGCAGGCAGATCAT | GAG | chr17 | 42902485 | 42902504 | 42902488 | - |
| SEQ ID NO 57098 | GCCAAGGCAGGCAGATCATG | AGG | chr17 | 42902484 | 42902503 | 42902487 | - |
| SEQ ID NO 57099 | AGGCAGGCAGATCATGAGGT | CAG | chr17 | 42902480 | 42902499 | 42902483 | - |
| SEQ ID NO 57100 | GGCAGGCAGATCATGAGGTC | AGG | chr17 | 42902479 | 42902498 | 42902482 | - |
| SEQ ID NO 57101 | CAGGCAGATCATGAGGTCAG | GAG | chr17 | 42902477 | 42902496 | 42902480 | - |
| SEQ ID NO 57102 | GATCATGAGGTCAGGAGTTC | GAG | chr17 | 42902471 | 42902490 | 42902474 | - |
| SEQ ID NO 57103 | TGAGGTCAGGAGTTCGAGAC | CAG | chr17 | 42902466 | 42902485 | 42902469 | - |
| SEQ ID NO 57104 | TCAGGAGTTCGAGACCAGCC | TAG | chr17 | 42902461 | 42902480 | 42902464 | - |
| SEQ ID NO 57105 | CGAGACCAGCCTAGTCAACA | TAG | chr17 | 42902452 | 42902471 | 42902455 | - |
| SEQ ID NO 57106 | ACTAAAAATACAAAAAAAAT | TAG | chr17 | 42902414 | 42902433 | 42902417 | - |
| SEQ ID NO 57107 | AAAATACAAAAAAATTAGC | TGG | chr17 | 42902410 | 42902429 | 42902413 | - |
| SEQ ID NO 57108 | AAATACAAAAAAATTAGCT | GGG | chr17 | 42902409 | 42902428 | 42902412 | - |
| SEQ ID NO 57109 | CAAAAAAATTAGCTGGGCA | TGG | chr17 | 42902404 | 42902423 | 42902407 | - |
| SEQ ID NO 57110 | AAAAAATTAGCTGGGCATGG | TGG | chr17 | 42902401 | 42902420 | 42902404 | - |
| SEQ ID NO 57111 | AAATTAGCTGGGCATGGTGG | CGG | chr17 | 42902398 | 42902417 | 42902401 | - |
| SEQ ID NO 57112 | AATTAGCTGGGCATGGTGGC | GGG | chr17 | 42902397 | 42902416 | 42902400 | - |
| SEQ ID NO 57113 | GTGGCGGGCACCTGTAATCC | CAG | chr17 | 42902382 | 42902401 | 42902385 | - |

Figure 85 (Cont'd)

| SEQ ID NO 57114 | CACCTGTAATCCCAGCTACT | TGG | chr17 | 42902374 | 42902393 | 42902377 | - |
| SEQ ID NO 57115 | ACCTGTAATCCCAGCTACTT | GGG | chr17 | 42902373 | 42902392 | 42902376 | - |
| SEQ ID NO 57116 | CTGTAATCCCAGCTACTTGG | GAG | chr17 | 42902371 | 42902390 | 42902374 | - |
| SEQ ID NO 57117 | TGTAATCCCAGCTACTTGGG | AGG | chr17 | 42902370 | 42902389 | 42902373 | - |
| SEQ ID NO 57118 | TCCCAGCTACTTGGGAGGCT | GAG | chr17 | 42902365 | 42902384 | 42902368 | - |
| SEQ ID NO 57119 | CCCAGCTACTTGGGAGGCTG | AGG | chr17 | 42902364 | 42902383 | 42902367 | - |
| SEQ ID NO 57120 | AGCTACTTGGGAGGCTGAGG | CAG | chr17 | 42902361 | 42902380 | 42902364 | - |
| SEQ ID NO 57121 | GCTACTTGGGAGGCTGAGGC | AGG | chr17 | 42902360 | 42902379 | 42902363 | - |
| SEQ ID NO 57122 | TACTTGGGAGGCTGAGGCAG | GAG | chr17 | 42902358 | 42902377 | 42902361 | - |
| SEQ ID NO 57123 | GGCAGGAGAATCACTTGAAC | CGG | chr17 | 42902343 | 42902362 | 42902346 | - |
| SEQ ID NO 57124 | CAGGAGAATCACTTGAACCG | GAG | chr17 | 42902341 | 42902360 | 42902344 | - |
| SEQ ID NO 57125 | GGAGAATCACTTGAACCGGA | GAG | chr17 | 42902339 | 42902358 | 42902342 | - |
| SEQ ID NO 57126 | GAGAATCACTTGAACCGGAG | AGG | chr17 | 42902338 | 42902357 | 42902341 | - |
| SEQ ID NO 57127 | AATCACTTGAACCGGAGAGG | CAG | chr17 | 42902335 | 42902354 | 42902338 | - |
| SEQ ID NO 57128 | TCACTTGAACCGGAGAGGCA | GAG | chr17 | 42902333 | 42902352 | 42902336 | - |
| SEQ ID NO 57129 | CACTTGAACCGGAGAGGCAG | AGG | chr17 | 42902332 | 42902351 | 42902335 | - |
| SEQ ID NO 57130 | AACCGGAGAGGCAGAGGTTG | CAG | chr17 | 42902326 | 42902345 | 42902329 | - |
| SEQ ID NO 57131 | GGAGAGGCAGAGGTTGCAGT | GAG | chr17 | 42902322 | 42902341 | 42902325 | - |
| SEQ ID NO 57132 | GGCAGAGGTTGCAGTGAGCT | GAG | chr17 | 42902317 | 42902336 | 42902320 | - |
| SEQ ID NO 57133 | GAGATTGCACCATTGCACTC | CAG | chr17 | 42902297 | 42902316 | 42902300 | - |
| SEQ ID NO 57134 | TTGCACCATTGCACTCCAGC | CAG | chr17 | 42902293 | 42902312 | 42902296 | - |
| SEQ ID NO 57135 | TGCACCATTGCACTCCAGCC | AGG | chr17 | 42902292 | 42902311 | 42902295 | - |
| SEQ ID NO 57136 | ATTGCACTCCAGCCAGGCAA | CAG | chr17 | 42902286 | 42902305 | 42902289 | - |
| SEQ ID NO 57137 | CTCCAGCCAGGCAACAGTGC | GAG | chr17 | 42902280 | 42902299 | 42902283 | - |
| SEQ ID NO 57138 | CATCTCAAACAAACAAACAA | AAG | chr17 | 42902253 | 42902272 | 42902256 | - |
| SEQ ID NO 57139 | TCAAACAAACAAACAAAAGA | AAG | chr17 | 42902249 | 42902268 | 42902252 | - |
| SEQ ID NO 57140 | ACAAACAAACAAAAGAAAGA | AAG | chr17 | 42902245 | 42902264 | 42902248 | - |
| SEQ ID NO 57141 | ACAAACAAAAGAAAGAAAGA | AAG | chr17 | 42902241 | 42902260 | 42902244 | - |
| SEQ ID NO 57142 | ACAAAAGAAAGAAAGAAAGA | AAG | chr17 | 42902237 | 42902256 | 42902240 | - |
| SEQ ID NO 57143 | AAAGAAAGAAAGAAAGAAAG | TGG | chr17 | 42902234 | 42902253 | 42902237 | - |
| SEQ ID NO 57144 | AAAGAAAGAAAGAAAGTGGC | CAG | chr17 | 42902230 | 42902249 | 42902233 | - |
| SEQ ID NO 57145 | AAGAAAGAAAGTGGCCAGAA | TGG | chr17 | 42902225 | 42902244 | 42902228 | - |
| SEQ ID NO 57146 | AGAAAGAAAGTGGCCAGAAT | GGG | chr17 | 42902224 | 42902243 | 42902227 | - |
| SEQ ID NO 57147 | GAATGGGAATGTTTACGTGA | TAG | chr17 | 42902208 | 42902227 | 42902211 | - |
| SEQ ID NO 57148 | AATGTTTACGTGATAGAAAT | TGG | chr17 | 42902201 | 42902220 | 42902204 | - |
| SEQ ID NO 57149 | AAATTGGCAAATGCTAAACT | CAG | chr17 | 42902185 | 42902204 | 42902188 | - |
| SEQ ID NO 57150 | AATTGGCAAATGCTAAACTC | AGG | chr17 | 42902184 | 42902203 | 42902187 | - |
| SEQ ID NO 57151 | ATTGGCAAATGCTAAACTCA | GGG | chr17 | 42902183 | 42902202 | 42902186 | - |
| SEQ ID NO 57152 | CAGGGCTTTCCCCTGCTCCC | CAG | chr17 | 42902165 | 42902184 | 42902168 | - |
| SEQ ID NO 57153 | GGGCTTTCCCCTGCTCCCCA | GAG | chr17 | 42902163 | 42902182 | 42902166 | - |
| SEQ ID NO 57154 | GCTTTCCCCTGCTCCCCAGA | GAG | chr17 | 42902161 | 42902180 | 42902164 | - |
| SEQ ID NO 57155 | TCCCCTGCTCCCCAGAGAGT | CAG | chr17 | 42902157 | 42902176 | 42902160 | - |
| SEQ ID NO 57156 | TCCCCAGAGAGTCAGTTTAT | CAG | chr17 | 42902149 | 42902168 | 42902152 | - |
| SEQ ID NO 57157 | GAGAGTCAGTTTATCAGCAC | TGG | chr17 | 42902143 | 42902162 | 42902146 | - |
| SEQ ID NO 57158 | TATCAGCACTGGACGTAACA | TAG | chr17 | 42902132 | 42902151 | 42902135 | - |
| SEQ ID NO 57159 | CTGGACGTAACATAGTTCAT | AAG | chr17 | 42902124 | 42902143 | 42902127 | - |
| SEQ ID NO 57160 | GGACGTAACATAGTTCATAA | GAG | chr17 | 42902122 | 42902141 | 42902125 | - |

Figure 85 (Cont'd)

| | | | | | | | |
|---|---|---|---|---|---|---|---|
| SEQ ID NO 57161 | AGTTCATAAGAGCATTGCCG | CGG | chr17 | 42902111 | 42902130 | 42902114 | - |
| SEQ ID NO 57162 | TCATAAGAGCATTGCCGCGG | AAG | chr17 | 42902108 | 42902127 | 42902111 | - |
| SEQ ID NO 57163 | AAGAGCATTGCCGCGGAAGC | CAG | chr17 | 42902104 | 42902123 | 42902107 | - |
| SEQ ID NO 57164 | CGGAAGCCAGCCTGCCTACC | TGG | chr17 | 42902091 | 42902110 | 42902094 | - |
| SEQ ID NO 57165 | GGAAGCCAGCCTGCCTACCT | GGG | chr17 | 42902090 | 42902109 | 42902093 | - |
| SEQ ID NO 57166 | GCCTACCTGGGCTTCCATCC | TGG | chr17 | 42902078 | 42902097 | 42902081 | - |
| SEQ ID NO 57167 | CCTGGGCTTCCATCCTGGCT | CGG | chr17 | 42902073 | 42902092 | 42902076 | - |
| SEQ ID NO 57168 | TCGGCATGTACTAACCTTGT | TGG | chr17 | 42902054 | 42902073 | 42902057 | - |
| SEQ ID NO 57169 | GTTGGCCTAATCATTTAACT | CAG | chr17 | 42902036 | 42902055 | 42902039 | - |
| SEQ ID NO 57170 | AATCATTTAACTCAGCACCT | TGG | chr17 | 42902028 | 42902047 | 42902031 | - |
| SEQ ID NO 57171 | GCATCTACTGTTTCTGTAAA | TAG | chr17 | 42902000 | 42902019 | 42902003 | - |
| SEQ ID NO 57172 | TCTACTGTTTCTGTAAATAG | CAG | chr17 | 42901997 | 42902016 | 42902000 | - |
| SEQ ID NO 57173 | AAATAGCAGTAACTACCTCA | CAG | chr17 | 42901983 | 42902002 | 42901986 | - |
| SEQ ID NO 57174 | GCAGTAACTACCTCACAGAA | AAG | chr17 | 42901978 | 42901997 | 42901981 | - |
| SEQ ID NO 57175 | CTACCTCACAGAAAAGCACA | TAG | chr17 | 42901971 | 42901990 | 42901974 | - |
| SEQ ID NO 57176 | ACAGAAAAGCACATAGCACA | TGG | chr17 | 42901964 | 42901983 | 42901967 | - |
| SEQ ID NO 57177 | AAAGCACATAGCACATGGAC | TGG | chr17 | 42901959 | 42901978 | 42901962 | - |
| SEQ ID NO 57178 | TGTTAACCCTGATTATTATT | AAG | chr17 | 42901918 | 42901937 | 42901921 | - |
| SEQ ID NO 57179 | CCTGATTATTATTAAGCTGC | CAG | chr17 | 42901911 | 42901930 | 42901914 | - |
| SEQ ID NO 57180 | TGATTATTATTAAGCTGCCA | GAG | chr17 | 42901909 | 42901928 | 42901912 | - |
| SEQ ID NO 57181 | TGCCAGAGATAACCTATTTG | TAG | chr17 | 42901894 | 42901913 | 42901897 | - |
| SEQ ID NO 57182 | CCTATTTGTAGATTATAAAA | CAG | chr17 | 42901882 | 42901901 | 42901885 | - |
| SEQ ID NO 57183 | TAGATTATAAAACAGAAACT | CAG | chr17 | 42901874 | 42901893 | 42901877 | - |
| SEQ ID NO 57184 | GATAATTGATATGACTTGCC | AAG | chr17 | 42901852 | 42901871 | 42901855 | - |
| SEQ ID NO 57185 | ATAATTGATATGACTTGCCA | AGG | chr17 | 42901851 | 42901870 | 42901854 | - |
| SEQ ID NO 57186 | TATGACTTGCCAAGGACATG | TAG | chr17 | 42901843 | 42901862 | 42901846 | - |
| SEQ ID NO 57187 | ACTTGCCAAGGACATGTAGT | TGG | chr17 | 42901839 | 42901858 | 42901842 | - |
| SEQ ID NO 57188 | TGCCAAGGACATGTAGTTGG | TGG | chr17 | 42901836 | 42901855 | 42901839 | - |
| SEQ ID NO 57189 | GCCAAGGACATGTAGTTGGT | GGG | chr17 | 42901835 | 42901854 | 42901838 | - |
| SEQ ID NO 57190 | AAGGACATGTAGTTGGTGGG | TGG | chr17 | 42901832 | 42901851 | 42901835 | - |
| SEQ ID NO 57191 | GACATGTAGTTGGTGGGTGG | CAG | chr17 | 42901829 | 42901848 | 42901832 | - |
| SEQ ID NO 57192 | TAGTTGGTGGGTGGCAGAAC | GAG | chr17 | 42901823 | 42901842 | 42901826 | - |
| SEQ ID NO 57193 | AGTTGGTGGGTGGCAGAACG | AGG | chr17 | 42901822 | 42901841 | 42901825 | - |
| SEQ ID NO 57194 | GTTGGTGGGTGGCAGAACGA | GGG | chr17 | 42901821 | 42901840 | 42901824 | - |
| SEQ ID NO 57195 | GTGGGTGGCAGAACGAGGGC | TGG | chr17 | 42901817 | 42901836 | 42901820 | - |
| SEQ ID NO 57196 | GGGTGGCAGAACGAGGGCTG | GAG | chr17 | 42901815 | 42901834 | 42901818 | - |
| SEQ ID NO 57197 | GCAGAACGAGGGCTGGAGCC | CAG | chr17 | 42901810 | 42901829 | 42901813 | - |
| SEQ ID NO 57198 | GAGGGCTGGAGCCCAGTTCC | CAG | chr17 | 42901803 | 42901822 | 42901806 | - |
| SEQ ID NO 57199 | AGGGCTGGAGCCCAGTTCCC | AGG | chr17 | 42901802 | 42901821 | 42901805 | - |
| SEQ ID NO 57200 | GGGCTGGAGCCCAGTTCCCA | GGG | chr17 | 42901801 | 42901820 | 42901804 | - |
| SEQ ID NO 57201 | CTTTTCATTACCCCACAAAA | CAG | chr17 | 42901775 | 42901794 | 42901778 | - |
| SEQ ID NO 57202 | TTTTCATTACCCCACAAAAC | AGG | chr17 | 42901774 | 42901793 | 42901777 | - |
| SEQ ID NO 57203 | GTGTGTTCCTTTTTTCATA | CAG | chr17 | 42901737 | 42901756 | 42901740 | - |
| SEQ ID NO 57204 | TCTATCTTTTTTTTTTTTTT | GAG | chr17 | 42901705 | 42901724 | 42901708 | - |
| SEQ ID NO 57205 | TCTTTTTTTTTTTTTTGAGA | CAG | chr17 | 42901701 | 42901720 | 42901704 | - |
| SEQ ID NO 57206 | CTTTTTTTTTTTTTGAGAC | AGG | chr17 | 42901700 | 42901719 | 42901703 | - |
| SEQ ID NO 57207 | TTTTTTTTTTTTTTGAGACA | GGG | chr17 | 42901699 | 42901718 | 42901702 | - |

Figure 85 (Cont'd)

| | | | | | | | |
|---|---|---|---|---|---|---|---|
| SEQ ID NO 57208 | CAGGGTCTTACTCTGTTGCC | CAG | chr17 | 42901681 | 42901700 | 42901684 | - |
| SEQ ID NO 57209 | AGGGTCTTACTCTGTTGCCC | AGG | chr17 | 42901680 | 42901699 | 42901683 | - |
| SEQ ID NO 57210 | TCTTACTCTGTTGCCCAGGC | TGG | chr17 | 42901676 | 42901695 | 42901679 | - |
| SEQ ID NO 57211 | TTACTCTGTTGCCCAGGCTG | GAG | chr17 | 42901674 | 42901693 | 42901677 | - |
| SEQ ID NO 57212 | CTGTTGCCCAGGCTGGAGTG | CAG | chr17 | 42901669 | 42901688 | 42901672 | - |
| SEQ ID NO 57213 | TTGCCCAGGCTGGAGTGCAG | TGG | chr17 | 42901666 | 42901685 | 42901669 | - |
| SEQ ID NO 57214 | ACCTCCTCCGCCTCTCACCT | CAG | chr17 | 42901623 | 42901642 | 42901626 | - |
| SEQ ID NO 57215 | GCCTCTCACCTCAGCCTCCT | GAG | chr17 | 42901614 | 42901633 | 42901617 | - |
| SEQ ID NO 57216 | TCTCACCTCAGCCTCCTGAG | TAG | chr17 | 42901611 | 42901630 | 42901614 | - |
| SEQ ID NO 57217 | ACCTCAGCCTCCTGAGTAGC | TGG | chr17 | 42901607 | 42901626 | 42901610 | - |
| SEQ ID NO 57218 | CCTCAGCCTCCTGAGTAGCT | GGG | chr17 | 42901606 | 42901625 | 42901609 | - |
| SEQ ID NO 57219 | CTCCTGAGTAGCTGGGACTA | CAG | chr17 | 42901599 | 42901618 | 42901602 | - |
| SEQ ID NO 57220 | GACTACAGCACCAACACGCC | CAG | chr17 | 42901584 | 42901603 | 42901587 | - |
| SEQ ID NO 57221 | TAATTTTCGTAATGTTTTTG | TAG | chr17 | 42901560 | 42901579 | 42901563 | - |
| SEQ ID NO 57222 | ATTTTCGTAATGTTTTTGTA | GAG | chr17 | 42901558 | 42901577 | 42901561 | - |
| SEQ ID NO 57223 | TCGTAATGTTTTTGTAGAGA | TGG | chr17 | 42901554 | 42901573 | 42901557 | - |
| SEQ ID NO 57224 | GTAATGTTTTTGTAGAGATG | GAG | chr17 | 42901552 | 42901571 | 42901555 | - |
| SEQ ID NO 57225 | TGGAGTTTCGCCATGTTGCC | CAG | chr17 | 42901534 | 42901553 | 42901537 | - |
| SEQ ID NO 57226 | GGAGTTTCGCCATGTTGCCC | AGG | chr17 | 42901533 | 42901552 | 42901536 | - |
| SEQ ID NO 57227 | TTTCGCCATGTTGCCCAGGC | TGG | chr17 | 42901529 | 42901548 | 42901532 | - |
| SEQ ID NO 57228 | CAGGCTGGTCTTGAACTCCT | GAG | chr17 | 42901514 | 42901533 | 42901517 | - |
| SEQ ID NO 57229 | CTTGAACTCCTGAGTTCACC | CAG | chr17 | 42901505 | 42901524 | 42901508 | - |
| SEQ ID NO 57230 | TTGAACTCCTGAGTTCACCC | AGG | chr17 | 42901504 | 42901523 | 42901507 | - |
| SEQ ID NO 57231 | GAACTCCTGAGTTCACCCAG | GAG | chr17 | 42901502 | 42901521 | 42901505 | - |
| SEQ ID NO 57232 | CAGGAGTGATTCGCCCACCT | CGG | chr17 | 42901485 | 42901504 | 42901488 | - |
| SEQ ID NO 57233 | TCGCCCACCTCGGCCTCCCA | AAG | chr17 | 42901475 | 42901494 | 42901478 | - |
| SEQ ID NO 57234 | ACCTCGGCCTCCCAAAGTGC | TGG | chr17 | 42901469 | 42901488 | 42901472 | - |
| SEQ ID NO 57235 | CCTCGGCCTCCCAAAGTGCT | GGG | chr17 | 42901468 | 42901487 | 42901471 | - |
| SEQ ID NO 57236 | CTCCCAAAGTGCTGGGATTA | CAG | chr17 | 42901461 | 42901480 | 42901464 | - |
| SEQ ID NO 57237 | TCCCAAAGTGCTGGGATTAC | AGG | chr17 | 42901460 | 42901479 | 42901463 | - |
| SEQ ID NO 57238 | AGTGCTGGGATTACAGGTGT | GAG | chr17 | 42901454 | 42901473 | 42901457 | - |
| SEQ ID NO 57239 | CAGGTGTGAGCCACCATGCC | TGG | chr17 | 42901441 | 42901460 | 42901444 | - |
| SEQ ID NO 57240 | CTAATAAAACTCTTTGCTCA | AAG | chr17 | 42901378 | 42901397 | 42901381 | - |
| SEQ ID NO 57241 | TGCTCAAAGCCTATATAACT | CAG | chr17 | 42901364 | 42901383 | 42901367 | - |
| SEQ ID NO 57242 | ACCCTTTAACCCATATGAAA | TAG | chr17 | 42901316 | 42901335 | 42901319 | - |
| SEQ ID NO 57243 | CCCTTTAACCCATATGAAAT | AGG | chr17 | 42901315 | 42901334 | 42901318 | - |
| SEQ ID NO 57244 | TTCCTGTATTTTCAACTCAC | TGG | chr17 | 42901290 | 42901309 | 42901293 | - |
| SEQ ID NO 57245 | CTGTATTTTCAACTCACTGG | TAG | chr17 | 42901287 | 42901306 | 42901290 | - |
| SEQ ID NO 57246 | TGTATTTTCAACTCACTGGT | AGG | chr17 | 42901286 | 42901305 | 42901289 | - |
| SEQ ID NO 57247 | TTCTGTCTTCCCCCTTTATG | TAG | chr17 | 42901258 | 42901277 | 42901261 | - |
| SEQ ID NO 57248 | CCCTTTATGTAGATGATCCA | AAG | chr17 | 42901247 | 42901266 | 42901250 | - |
| SEQ ID NO 57249 | TTATGTAGATGATCCAAAGT | CAG | chr17 | 42901243 | 42901262 | 42901246 | - |
| SEQ ID NO 57250 | ATGTAGATGATCCAAAGTCA | GAG | chr17 | 42901241 | 42901260 | 42901244 | - |
| SEQ ID NO 57251 | GTAGATGATCCAAAGTCAGA | GAG | chr17 | 42901239 | 42901258 | 42901242 | - |
| SEQ ID NO 57252 | AGATGATCCAAAGTCAGAGA | GAG | chr17 | 42901237 | 42901256 | 42901240 | - |
| SEQ ID NO 57253 | GATGATCCAAAGTCAGAGAG | AGG | chr17 | 42901236 | 42901255 | 42901239 | - |
| SEQ ID NO 57254 | ATGATCCAAAGTCAGAGAGA | GGG | chr17 | 42901235 | 42901254 | 42901238 | - |

Figure 85 (Cont'd)

| | | | | | | | |
|---|---|---|---|---|---|---|---|
| SEQ ID NO 57255 | TGATCCAAAGTCAGAGAGAG | GGG | chr17 | 42901234 | 42901253 | 42901237 | - |
| SEQ ID NO 57256 | CCAAAGTCAGAGAGAGGGGT | TGG | chr17 | 42901230 | 42901249 | 42901233 | - |
| SEQ ID NO 57257 | AAGTCAGAGAGAGGGGTTGG | AAG | chr17 | 42901227 | 42901246 | 42901230 | - |
| SEQ ID NO 57258 | GAGAGAGGGGTTGGAAGCAT | GAG | chr17 | 42901221 | 42901240 | 42901224 | - |
| SEQ ID NO 57259 | AGAGGGGTTGGAAGCATGAG | TAG | chr17 | 42901218 | 42901237 | 42901221 | - |
| SEQ ID NO 57260 | TTGGAAGCATGAGTAGCCCG | TGG | chr17 | 42901211 | 42901230 | 42901214 | - |
| SEQ ID NO 57261 | GTAGCCCGTGGCTTCCTGAA | TAG | chr17 | 42901199 | 42901218 | 42901202 | - |
| SEQ ID NO 57262 | CCGTGGCTTCCTGAATAGCC | TGG | chr17 | 42901194 | 42901213 | 42901197 | - |
| SEQ ID NO 57263 | CGTGGCTTCCTGAATAGCCT | GGG | chr17 | 42901193 | 42901212 | 42901196 | - |
| SEQ ID NO 57264 | GTGGCTTCCTGAATAGCCTG | GGG | chr17 | 42901192 | 42901211 | 42901195 | - |
| SEQ ID NO 57265 | CTTCCTGAATAGCCTGGGGA | AAG | chr17 | 42901188 | 42901207 | 42901191 | - |
| SEQ ID NO 57266 | CTGGGGAAAGCAACTTCTGA | TGG | chr17 | 42901175 | 42901194 | 42901178 | - |
| SEQ ID NO 57267 | GGAAAGCAACTTCTGATGGA | CAG | chr17 | 42901171 | 42901190 | 42901174 | - |
| SEQ ID NO 57268 | TTCTGATGGACAGACATTGC | GAG | chr17 | 42901161 | 42901180 | 42901164 | - |
| SEQ ID NO 57269 | CTGATGGACAGACATTGCGA | GAG | chr17 | 42901159 | 42901178 | 42901162 | - |
| SEQ ID NO 57270 | GACATTGCGAGAGCGAATGC | CAG | chr17 | 42901149 | 42901168 | 42901152 | - |
| SEQ ID NO 57271 | TTGCTGATCCTCTCTATA | TGG | chr17 | 42901117 | 42901136 | 42901120 | - |
| SEQ ID NO 57272 | TATATGGTTCTTACCACTTA | AAG | chr17 | 42901101 | 42901120 | 42901104 | - |
| SEQ ID NO 57273 | GGTTCTTACCACTTAAAGAC | GAG | chr17 | 42901096 | 42901115 | 42901099 | - |
| SEQ ID NO 57274 | GTTCTTACCACTTAAAGACG | AGG | chr17 | 42901095 | 42901114 | 42901098 | - |
| SEQ ID NO 57275 | TACCACTTAAAGACGAGGTT | GAG | chr17 | 42901090 | 42901109 | 42901093 | - |
| SEQ ID NO 57276 | ACTTAAAGACGAGGTTGAGC | CAG | chr17 | 42901086 | 42901105 | 42901089 | - |
| SEQ ID NO 57277 | GTTGAGCCAGTCTCCAATCA | CAG | chr17 | 42901073 | 42901092 | 42901076 | - |
| SEQ ID NO 57278 | TCTCCAATCACAGCTACCCA | AAG | chr17 | 42901063 | 42901082 | 42901066 | - |
| SEQ ID NO 57279 | CTCCAATCACAGCTACCCAA | AGG | chr17 | 42901062 | 42901081 | 42901065 | - |
| SEQ ID NO 57280 | CCAATCACAGCTACCCAAAG | GAG | chr17 | 42901060 | 42901079 | 42901063 | - |
| SEQ ID NO 57281 | CCAAAGGAGTTTAATGCCCA | CAG | chr17 | 42901046 | 42901065 | 42901049 | - |
| SEQ ID NO 57282 | TTAATGCCCACAGCTTCCTG | AAG | chr17 | 42901036 | 42901055 | 42901039 | - |
| SEQ ID NO 57283 | TGCCCACAGCTTCCTGAAGA | TGG | chr17 | 42901032 | 42901051 | 42901035 | - |
| SEQ ID NO 57284 | CAGCTTCCTGAAGATGGAAC | CAG | chr17 | 42901026 | 42901045 | 42901029 | - |
| SEQ ID NO 57285 | TTCCTGAAGATGGAACCAGA | TGG | chr17 | 42901022 | 42901041 | 42901025 | - |
| SEQ ID NO 57286 | TCCTGAAGATGGAACCAGAT | GGG | chr17 | 42901021 | 42901040 | 42901024 | - |
| SEQ ID NO 57287 | CCTGAAGATGGAACCAGATG | GGG | chr17 | 42901020 | 42901039 | 42901023 | - |
| SEQ ID NO 57288 | GAAGATGGAACCAGATGGGG | AAG | chr17 | 42901017 | 42901036 | 42901020 | - |
| SEQ ID NO 57289 | AGATGGAACCAGATGGGGAA | GAG | chr17 | 42901015 | 42901034 | 42901018 | - |
| SEQ ID NO 57290 | GATGGAACCAGATGGGGAAG | AGG | chr17 | 42901014 | 42901033 | 42901017 | - |
| SEQ ID NO 57291 | ACCAGATGGGGAAGAGGACG | TAG | chr17 | 42901008 | 42901027 | 42901011 | - |
| SEQ ID NO 57292 | AGATGGGGAAGAGGACGTAG | AAG | chr17 | 42901005 | 42901024 | 42901008 | - |
| SEQ ID NO 57293 | GATGGGGAAGAGGACGTAGA | AGG | chr17 | 42901004 | 42901023 | 42901007 | - |
| SEQ ID NO 57294 | AGGACGTAGAAGGCATTCCT | GAG | chr17 | 42900994 | 42901013 | 42900997 | - |
| SEQ ID NO 57295 | GGACGTAGAAGGCATTCCTG | AGG | chr17 | 42900993 | 42901012 | 42900996 | - |
| SEQ ID NO 57296 | ATTCCTGAGGTCTGCGATCA | CGG | chr17 | 42900980 | 42900999 | 42900983 | - |
| SEQ ID NO 57297 | GGTCTGCGATCACGGACACC | AAG | chr17 | 42900972 | 42900991 | 42900975 | - |
| SEQ ID NO 57298 | TCACGGACACCAAGATGAAC | CAG | chr17 | 42900963 | 42900982 | 42900966 | - |
| SEQ ID NO 57299 | ACACCAAGATGAACCAGTCC | TGG | chr17 | 42900957 | 42900976 | 42900960 | - |
| SEQ ID NO 57300 | CACCAAGATGAACCAGTCCT | GGG | chr17 | 42900956 | 42900975 | 42900959 | - |
| SEQ ID NO 57301 | CCAAGATGAACCAGTCCTGG | GAG | chr17 | 42900954 | 42900973 | 42900957 | - |

Figure 85 (Cont'd)

| SEQ ID NO 57302 | TGAACCAGTCCTGGGAGTCT | TGG | chr17 | 42900948 | 42900967 | 42900951 | - |
| SEQ ID NO 57303 | GGGAGTCTTGGTAATTCACC | TGG | chr17 | 42900936 | 42900955 | 42900939 | - |
| SEQ ID NO 57304 | GAGTCTTGGTAATTCACCTG | GAG | chr17 | 42900934 | 42900953 | 42900937 | - |
| SEQ ID NO 57305 | AGTCTTGGTAATTCACCTGG | AGG | chr17 | 42900933 | 42900952 | 42900936 | - |
| SEQ ID NO 57306 | CCTGGAGGTAATGTGTTGAC | TGG | chr17 | 42900918 | 42900937 | 42900921 | - |
| SEQ ID NO 57307 | AATGTGTTGACTGGATCCCA | AAG | chr17 | 42900909 | 42900928 | 42900912 | - |
| SEQ ID NO 57308 | TTGACTGGATCCCAAAGTCA | TGG | chr17 | 42900903 | 42900922 | 42900906 | - |
| SEQ ID NO 57309 | GACTGGATCCCAAAGTCATG | GAG | chr17 | 42900901 | 42900920 | 42900904 | - |
| SEQ ID NO 57310 | TTCCTCCATCCTCATTTCCT | TGG | chr17 | 42900866 | 42900885 | 42900869 | - |
| SEQ ID NO 57311 | TCCTCATTTCCTTGGCACCT | CAG | chr17 | 42900858 | 42900877 | 42900861 | - |
| SEQ ID NO 57312 | CCTCATTTCCTTGGCACCTC | AGG | chr17 | 42900857 | 42900876 | 42900860 | - |
| SEQ ID NO 57313 | CATTTCCTTGGCACCTCAGG | AAG | chr17 | 42900854 | 42900873 | 42900857 | - |
| SEQ ID NO 57314 | TTGGCACCTCAGGAAGATGT | CAG | chr17 | 42900847 | 42900866 | 42900850 | - |
| SEQ ID NO 57315 | GCACCTCAGGAAGATGTCAG | CAG | chr17 | 42900844 | 42900863 | 42900847 | - |
| SEQ ID NO 57316 | ACCTCAGGAAGATGTCAGCA | GAG | chr17 | 42900842 | 42900861 | 42900845 | - |
| SEQ ID NO 57317 | AGATGTCAGCAGAGCCCTTG | CAG | chr17 | 42900833 | 42900852 | 42900836 | - |
| SEQ ID NO 57318 | CAGAGCCCTTGCAGTTATTC | CAG | chr17 | 42900824 | 42900843 | 42900827 | - |
| SEQ ID NO 57319 | AGAGCCCTTGCAGTTATTCC | AGG | chr17 | 42900823 | 42900842 | 42900826 | - |
| SEQ ID NO 57320 | CCTTGCAGTTATTCCAGGCT | TGG | chr17 | 42900818 | 42900837 | 42900821 | - |
| SEQ ID NO 57321 | TGCAGTTATTCCAGGCTTGG | TGG | chr17 | 42900815 | 42900834 | 42900818 | - |
| SEQ ID NO 57322 | GGTGGTGATTGCTCTGCTAT | GAG | chr17 | 42900797 | 42900816 | 42900800 | - |
| SEQ ID NO 57323 | TGTTTTATATGCCCTGTATC | CAG | chr17 | 42900759 | 42900778 | 42900762 | - |
| SEQ ID NO 57324 | TATGCCCTGTATCCAGTATT | CAG | chr17 | 42900752 | 42900771 | 42900755 | - |
| SEQ ID NO 57325 | ATGCCCTGTATCCAGTATTC | AGG | chr17 | 42900751 | 42900770 | 42900754 | - |
| SEQ ID NO 57326 | ATCCAGTATTCAGGTCAACC | CAG | chr17 | 42900742 | 42900761 | 42900745 | - |
| SEQ ID NO 57327 | GTCAACCCAGCCCTGATCTT | TGG | chr17 | 42900729 | 42900748 | 42900732 | - |
| SEQ ID NO 57328 | TGTCTAAAATGTATTGATCA | AAG | chr17 | 42900690 | 42900709 | 42900693 | - |
| SEQ ID NO 57329 | GTCTAAAATGTATTGATCAA | AGG | chr17 | 42900689 | 42900708 | 42900692 | - |
| SEQ ID NO 57330 | ATTGATCAAGGTGCATCAC | CAG | chr17 | 42900678 | 42900697 | 42900681 | - |
| SEQ ID NO 57331 | GATCAAAGGTGCATCACCAG | TAG | chr17 | 42900675 | 42900694 | 42900678 | - |
| SEQ ID NO 57332 | ATCAAAGGTGCATCACCAGT | AGG | chr17 | 42900674 | 42900693 | 42900677 | - |
| SEQ ID NO 57333 | TAGGTTGATGCAAACATGTT | CAG | chr17 | 42900655 | 42900674 | 42900658 | - |
| SEQ ID NO 57334 | AGGTTGATGCAAACATGTTC | AGG | chr17 | 42900654 | 42900673 | 42900657 | - |
| SEQ ID NO 57335 | GGTTGATGCAAACATGTTCA | GGG | chr17 | 42900653 | 42900672 | 42900656 | - |
| SEQ ID NO 57336 | TCAGGGTGATTTACGTAAAA | TAG | chr17 | 42900636 | 42900655 | 42900639 | - |
| SEQ ID NO 57337 | ATTTACGTAAAATAGAAAAA | CAG | chr17 | 42900628 | 42900647 | 42900631 | - |
| SEQ ID NO 57338 | TTTACGTAAAATAGAAAAAC | AGG | chr17 | 42900627 | 42900646 | 42900630 | - |
| SEQ ID NO 57339 | GAAAAACAGGCACACAAAAA | CAG | chr17 | 42900614 | 42900633 | 42900617 | - |
| SEQ ID NO 57340 | GCACACAAAACAGCCTGAT | CGG | chr17 | 42900605 | 42900624 | 42900608 | - |
| SEQ ID NO 57341 | AGCCTGATCGGCCATGTACT | CAG | chr17 | 42900593 | 42900612 | 42900596 | - |
| SEQ ID NO 57342 | CTGATCGGCCATGTACTCAG | CAG | chr17 | 42900590 | 42900609 | 42900593 | - |
| SEQ ID NO 57343 | TGATCGGCCATGTACTCAGC | AGG | chr17 | 42900589 | 42900608 | 42900592 | - |
| SEQ ID NO 57344 | GATCGGCCATGTACTCAGCA | GGG | chr17 | 42900588 | 42900607 | 42900591 | - |
| SEQ ID NO 57345 | GCAGGGCCAATGATTAACTT | TGG | chr17 | 42900571 | 42900590 | 42900574 | - |
| SEQ ID NO 57346 | ATTAACTTTGGCATGCTTCT | TGG | chr17 | 42900559 | 42900578 | 42900562 | - |
| SEQ ID NO 57347 | AACTTTGGCATGCTTCTTGG | CAG | chr17 | 42900556 | 42900575 | 42900559 | - |
| SEQ ID NO 57348 | GGCATGCTTCTTGGCAGTGC | AAG | chr17 | 42900550 | 42900569 | 42900553 | - |

Figure 85 (Cont'd)

| SEQ ID NO 57349 | GCATGCTTCTTGGCAGTGCA | AGG | chr17 | 42900549 | 42900568 | 42900552 | - |
| SEQ ID NO 57350 | CATGCTTCTTGGCAGTGCAA | GGG | chr17 | 42900548 | 42900567 | 42900551 | - |
| SEQ ID NO 57351 | AGTGCAAGGGTCTGCCCTCC | TGG | chr17 | 42900535 | 42900554 | 42900538 | - |
| SEQ ID NO 57352 | GCCCTCCTGGTCCCCGAAAC | CAG | chr17 | 42900522 | 42900541 | 42900525 | - |
| SEQ ID NO 57353 | CCCTCCTGGTCCCCGAAACC | AGG | chr17 | 42900521 | 42900540 | 42900524 | - |
| SEQ ID NO 57354 | CCTGGTCCCCGAAACCAGGC | CAG | chr17 | 42900517 | 42900536 | 42900520 | - |
| SEQ ID NO 57355 | TGGTCCCCGAAACCAGGCCA | GAG | chr17 | 42900515 | 42900534 | 42900518 | - |
| SEQ ID NO 57356 | CCGAAACCAGGCCAGAGACA | CAG | chr17 | 42900509 | 42900528 | 42900512 | - |
| SEQ ID NO 57357 | CGAAACCAGGCCAGAGACAC | AGG | chr17 | 42900508 | 42900527 | 42900511 | - |
| SEQ ID NO 57358 | ACCAGGCCAGAGACACAGGA | CAG | chr17 | 42900504 | 42900523 | 42900507 | - |
| SEQ ID NO 57359 | CAGGCCAGAGACACAGGACA | GAG | chr17 | 42900502 | 42900521 | 42900505 | - |
| SEQ ID NO 57360 | CATCCACGATGATTCTTGCA | AAG | chr17 | 42900475 | 42900494 | 42900478 | - |
| SEQ ID NO 57361 | GATGATTCTTGCAAAGATGT | CAG | chr17 | 42900468 | 42900487 | 42900471 | - |
| SEQ ID NO 57362 | TGCCTGCAACTGCACTTATT | TGG | chr17 | 42900437 | 42900456 | 42900440 | - |
| SEQ ID NO 57363 | GCCTGCAACTGCACTTATTT | GGG | chr17 | 42900436 | 42900455 | 42900439 | - |
| SEQ ID NO 57364 | CCTGCAACTGCACTTATTTG | GGG | chr17 | 42900435 | 42900454 | 42900438 | - |
| SEQ ID NO 57365 | ACTGCACTTATTTGGGGACA | AAG | chr17 | 42900429 | 42900448 | 42900432 | - |
| SEQ ID NO 57366 | TTGGGGACAAAGAAAAATCT | TGG | chr17 | 42900418 | 42900437 | 42900421 | - |
| SEQ ID NO 57367 | AAAGAAAAATCTTGGTGCTC | TAG | chr17 | 42900410 | 42900429 | 42900413 | - |
| SEQ ID NO 57368 | TCTTGGTGCTCTAGCTATTC | AAG | chr17 | 42900401 | 42900420 | 42900404 | - |
| SEQ ID NO 57369 | GCTCTAGCTATTCAAGTTTT | AAG | chr17 | 42900394 | 42900413 | 42900397 | - |
| SEQ ID NO 57370 | TAAGTTCTTAATTTTAAAAT | TAG | chr17 | 42900375 | 42900394 | 42900378 | - |
| SEQ ID NO 57371 | TCTTAATTTTAAAATTAGTA | AAG | chr17 | 42900370 | 42900389 | 42900373 | - |
| SEQ ID NO 57372 | TTTTAAAATTAGTAAAGTTC | TGG | chr17 | 42900364 | 42900383 | 42900367 | - |
| SEQ ID NO 57373 | AAAATTAGTAAAGTTCTGGC | TGG | chr17 | 42900360 | 42900379 | 42900363 | - |
| SEQ ID NO 57374 | AGTAAAGTTCTGGCTGGTTG | TGG | chr17 | 42900354 | 42900373 | 42900357 | - |
| SEQ ID NO 57375 | AAAGTTCTGGCTGGTTGTGG | TGG | chr17 | 42900351 | 42900370 | 42900354 | - |
| SEQ ID NO 57376 | GTGGCTCACACCTGTAATCC | CAG | chr17 | 42900332 | 42900351 | 42900335 | - |
| SEQ ID NO 57377 | CACCTGTAATCCCAGCAATT | TGG | chr17 | 42900324 | 42900343 | 42900327 | - |
| SEQ ID NO 57378 | ACCTGTAATCCCAGCAATTT | GGG | chr17 | 42900323 | 42900342 | 42900326 | - |
| SEQ ID NO 57379 | CTGTAATCCCAGCAATTTGG | GAG | chr17 | 42900321 | 42900340 | 42900324 | - |
| SEQ ID NO 57380 | TGTAATCCCAGCAATTTGGG | AGG | chr17 | 42900320 | 42900339 | 42900323 | - |
| SEQ ID NO 57381 | TCCCAGCAATTTGGGAGGCT | GAG | chr17 | 42900315 | 42900334 | 42900318 | - |
| SEQ ID NO 57382 | CCCAGCAATTTGGGAGGCTG | AGG | chr17 | 42900314 | 42900333 | 42900317 | - |
| SEQ ID NO 57383 | AGCAATTTGGGAGGCTGAGG | TGG | chr17 | 42900311 | 42900330 | 42900314 | - |
| SEQ ID NO 57384 | GCAATTTGGGAGGCTGAGGT | GGG | chr17 | 42900310 | 42900329 | 42900313 | - |
| SEQ ID NO 57385 | AATTTGGGAGGCTGAGGTGG | GAG | chr17 | 42900308 | 42900327 | 42900311 | - |
| SEQ ID NO 57386 | ATTTGGGAGGCTGAGGTGGG | AGG | chr17 | 42900307 | 42900326 | 42900310 | - |
| SEQ ID NO 57387 | TGAGGTGGGAGGATCCCTTG | AAG | chr17 | 42900296 | 42900315 | 42900299 | - |
| SEQ ID NO 57388 | GTGGGAGGATCCCTTGAAGC | CAG | chr17 | 42900292 | 42900311 | 42900295 | - |
| SEQ ID NO 57389 | TGGGAGGATCCCTTGAAGCC | AGG | chr17 | 42900291 | 42900310 | 42900294 | - |
| SEQ ID NO 57390 | GGAGGATCCCTTGAAGCCAG | GAG | chr17 | 42900289 | 42900308 | 42900292 | - |
| SEQ ID NO 57391 | GATCCCTTGAAGCCAGGAGT | TGG | chr17 | 42900285 | 42900304 | 42900288 | - |
| SEQ ID NO 57392 | TCCCTTGAAGCCAGGAGTTG | GAG | chr17 | 42900283 | 42900302 | 42900286 | - |
| SEQ ID NO 57393 | TGAAGCCAGGAGTTGGAGAC | CAG | chr17 | 42900278 | 42900297 | 42900281 | - |
| SEQ ID NO 57394 | CCAGGAGTTGGAGACCAGCC | TGG | chr17 | 42900273 | 42900292 | 42900276 | - |
| SEQ ID NO 57395 | CAGGAGTTGGAGACCAGCCT | GGG | chr17 | 42900272 | 42900291 | 42900275 | - |

Figure 85 (Cont'd)

| SEQ ID NO 57396 | GGAGACCAGCCTGGGCAACA | AAG | chr17 | 42900264 | 42900283 | 42900267 | - |
| SEQ ID NO 57397 | ACCAGCCTGGGCAACAAAGC | AAG | chr17 | 42900260 | 42900279 | 42900263 | - |
| SEQ ID NO 57398 | AAAAATTTAAAAAATTGTTT | TGG | chr17 | 42900221 | 42900240 | 42900224 | - |
| SEQ ID NO 57399 | AATTGTTTTGGTGTGTGTGA | TGG | chr17 | 42900209 | 42900228 | 42900212 | - |
| SEQ ID NO 57400 | TGTGTGATGGTGTACCCTTG | TAG | chr17 | 42900196 | 42900215 | 42900199 | - |
| SEQ ID NO 57401 | ATGGTGTACCCTTGTAGTCC | CAG | chr17 | 42900190 | 42900209 | 42900193 | - |
| SEQ ID NO 57402 | CCCTTGTAGTCCCAGCTATT | CAG | chr17 | 42900182 | 42900201 | 42900185 | - |
| SEQ ID NO 57403 | CCTTGTAGTCCCAGCTATTC | AGG | chr17 | 42900181 | 42900200 | 42900184 | - |
| SEQ ID NO 57404 | TTGTAGTCCCAGCTATTCAG | GAG | chr17 | 42900179 | 42900198 | 42900182 | - |
| SEQ ID NO 57405 | TGTAGTCCCAGCTATTCAGG | AGG | chr17 | 42900178 | 42900197 | 42900181 | - |
| SEQ ID NO 57406 | TCCCAGCTATTCAGGAGGCT | GAG | chr17 | 42900173 | 42900192 | 42900176 | - |
| SEQ ID NO 57407 | CCCAGCTATTCAGGAGGCTG | AGG | chr17 | 42900172 | 42900191 | 42900175 | - |
| SEQ ID NO 57408 | AGCTATTCAGGAGGCTGAGG | CAG | chr17 | 42900169 | 42900188 | 42900172 | - |
| SEQ ID NO 57409 | GCTATTCAGGAGGCTGAGGC | AGG | chr17 | 42900168 | 42900187 | 42900171 | - |
| SEQ ID NO 57410 | TATTCAGGAGGCTGAGGCAG | GAG | chr17 | 42900166 | 42900185 | 42900169 | - |
| SEQ ID NO 57411 | ATTCAGGAGGCTGAGGCAGG | AGG | chr17 | 42900165 | 42900184 | 42900168 | - |
| SEQ ID NO 57412 | CTGAGGCAGGAGGATTGCTT | GAG | chr17 | 42900155 | 42900174 | 42900158 | - |
| SEQ ID NO 57413 | GCAGGAGGATTGCTTGAGCC | CAG | chr17 | 42900150 | 42900169 | 42900153 | - |
| SEQ ID NO 57414 | CAGGAGGATTGCTTGAGCCC | AGG | chr17 | 42900149 | 42900168 | 42900152 | - |
| SEQ ID NO 57415 | GGAGGATTGCTTGAGCCCAG | GAG | chr17 | 42900147 | 42900166 | 42900150 | - |
| SEQ ID NO 57416 | GATTGCTTGAGCCCAGGAGT | TGG | chr17 | 42900143 | 42900162 | 42900146 | - |
| SEQ ID NO 57417 | TTGCTTGAGCCCAGGAGTTG | GAG | chr17 | 42900141 | 42900160 | 42900144 | - |
| SEQ ID NO 57418 | AGCCCAGGAGTTGGAGTCTG | CAG | chr17 | 42900134 | 42900153 | 42900137 | - |
| SEQ ID NO 57419 | CAGGAGTTGGAGTCTGCAGT | GAG | chr17 | 42900130 | 42900149 | 42900133 | - |
| SEQ ID NO 57420 | ATTGTCCACCGCTGCACTA | CAG | chr17 | 42900105 | 42900124 | 42900108 | - |
| SEQ ID NO 57421 | CCCACCGCTGCACTACAGCC | TGG | chr17 | 42900100 | 42900119 | 42900103 | - |
| SEQ ID NO 57422 | CCACCGCTGCACTACAGCCT | GGG | chr17 | 42900099 | 42900118 | 42900102 | - |
| SEQ ID NO 57423 | GCACTACAGCCTGGGCAATC | GAG | chr17 | 42900091 | 42900110 | 42900094 | - |
| SEQ ID NO 57424 | TACAGCCTGGGCAATCGAGC | AAG | chr17 | 42900087 | 42900106 | 42900090 | - |
| SEQ ID NO 57425 | TGGGCAATCGAGCAAGACCC | CAG | chr17 | 42900080 | 42900099 | 42900083 | - |
| SEQ ID NO 57426 | AACAAAACAAAACAAAACAA | AAG | chr17 | 42900040 | 42900059 | 42900043 | - |
| SEQ ID NO 57427 | GAAAAACAACAAATAAAATA | TAG | chr17 | 42900018 | 42900037 | 42900021 | - |
| SEQ ID NO 57428 | TATAGTAACTTCTATTGTAT | TGG | chr17 | 42900000 | 42900019 | 42900003 | - |
| SEQ ID NO 57429 | ATAGTAACTTCTATTGTATT | GGG | chr17 | 42899999 | 42900018 | 42900002 | - |
| SEQ ID NO 57430 | TAGTAACTTCTATTGTATTG | GGG | chr17 | 42899998 | 42900017 | 42900001 | - |
| SEQ ID NO 57431 | ATTGGGGACTATCATCTTGC | TGG | chr17 | 42899982 | 42900001 | 42899985 | - |
| SEQ ID NO 57432 | TGGTCTTTCCTTAACTGTAT | TAG | chr17 | 42899962 | 42899981 | 42899965 | - |
| SEQ ID NO 57433 | GTCTTTCCTTAACTGTATTA | GAG | chr17 | 42899960 | 42899979 | 42899963 | - |
| SEQ ID NO 57434 | TCCTTAACTGTATTAGAGTC | TAG | chr17 | 42899955 | 42899974 | 42899958 | - |
| SEQ ID NO 57435 | CCTTAACTGTATTAGAGTCT | AGG | chr17 | 42899954 | 42899973 | 42899957 | - |
| SEQ ID NO 57436 | CTTAACTGTATTAGAGTCTA | GGG | chr17 | 42899953 | 42899972 | 42899956 | - |
| SEQ ID NO 57437 | TAGAGTCTAGGGTCTGCCTC | TGG | chr17 | 42899942 | 42899961 | 42899945 | - |
| SEQ ID NO 57438 | TCTAGGGTCTGCCTCTGGTT | TGG | chr17 | 42899937 | 42899956 | 42899940 | - |
| SEQ ID NO 57439 | CTAGGGTCTGCCTCTGGTTT | GGG | chr17 | 42899936 | 42899955 | 42899939 | - |
| SEQ ID NO 57440 | AGGGTCTGCCTCTGGTTTGG | GAG | chr17 | 42899934 | 42899953 | 42899937 | - |
| SEQ ID NO 57441 | TGGGAGATCAACCCCCTTCC | TGG | chr17 | 42899917 | 42899936 | 42899920 | - |
| SEQ ID NO 57442 | ATCAACCCCCTTCCTGGTAT | TGG | chr17 | 42899911 | 42899930 | 42899914 | - |

Figure 85 (Cont'd)

| SEQ ID NO 57443 | GGTATTGGCCTCATGTCTCT | TAG | chr17 | 42899896 | 42899915 | 42899899 | - |
| SEQ ID NO 57444 | GTATTGGCCTCATGTCTCTT | AGG | chr17 | 42899895 | 42899914 | 42899898 | - |
| SEQ ID NO 57445 | TATTGGCCTCATGTCTCTTA | GGG | chr17 | 42899894 | 42899913 | 42899897 | - |
| SEQ ID NO 57446 | GGCCTCATGTCTCTTAGGGC | CAG | chr17 | 42899890 | 42899909 | 42899893 | - |
| SEQ ID NO 57447 | TCATGTCTCTTAGGGCCAGA | AAG | chr17 | 42899886 | 42899905 | 42899889 | - |
| SEQ ID NO 57448 | AAAGTAATCGTTTTTGAATG | CAG | chr17 | 42899867 | 42899886 | 42899870 | - |
| SEQ ID NO 57449 | TAATTCATTTAATGACCTTA | AAG | chr17 | 42899840 | 42899859 | 42899843 | - |
| SEQ ID NO 57450 | ATTTAATGACCTTAAAGTTA | CAG | chr17 | 42899834 | 42899853 | 42899837 | - |
| SEQ ID NO 57451 | GACCTTAAAGTTACAGCCCT | TGG | chr17 | 42899827 | 42899846 | 42899830 | - |
| SEQ ID NO 57452 | TCTCTCTCTTTTTTTTGAAA | CAG | chr17 | 42899782 | 42899801 | 42899785 | - |
| SEQ ID NO 57453 | CTCTCTCTTTTTTTTGAAAC | AGG | chr17 | 42899781 | 42899800 | 42899784 | - |
| SEQ ID NO 57454 | TCTCTCTTTTTTTTGAAACA | GGG | chr17 | 42899780 | 42899799 | 42899783 | - |
| SEQ ID NO 57455 | CAGGGTCTCACTCTGTCTCC | CAG | chr17 | 42899762 | 42899781 | 42899765 | - |
| SEQ ID NO 57456 | AGGGTCTCACTCTGTCTCCC | AGG | chr17 | 42899761 | 42899780 | 42899764 | - |
| SEQ ID NO 57457 | TCTCACTCTGTCTCCCAGGC | TGG | chr17 | 42899757 | 42899776 | 42899760 | - |
| SEQ ID NO 57458 | TCACTCTGTCTCCCAGGCTG | GAG | chr17 | 42899755 | 42899774 | 42899758 | - |
| SEQ ID NO 57459 | CTGTCTCCCAGGCTGGAGTG | CAG | chr17 | 42899750 | 42899769 | 42899753 | - |
| SEQ ID NO 57460 | TCTCCCAGGCTGGAGTGCAG | TGG | chr17 | 42899747 | 42899766 | 42899750 | - |
| SEQ ID NO 57461 | GGAGTGCAGTGGCATAATCA | CGG | chr17 | 42899736 | 42899755 | 42899739 | - |
| SEQ ID NO 57462 | GGCATAATCACGGCTCACTG | CAG | chr17 | 42899726 | 42899745 | 42899729 | - |
| SEQ ID NO 57463 | TCACTGCAGCCTCAACCTCC | TGG | chr17 | 42899712 | 42899731 | 42899715 | - |
| SEQ ID NO 57464 | CACTGCAGCCTCAACCTCCT | GGG | chr17 | 42899711 | 42899730 | 42899714 | - |
| SEQ ID NO 57465 | CTAATGTGATCCTCCCACCT | CAG | chr17 | 42899688 | 42899707 | 42899691 | - |
| SEQ ID NO 57466 | TCCTCCCACCTCAGCCTCCT | GAG | chr17 | 42899679 | 42899698 | 42899682 | - |
| SEQ ID NO 57467 | TCCCACCTCAGCCTCCTGAG | TAG | chr17 | 42899676 | 42899695 | 42899679 | - |
| SEQ ID NO 57468 | ACCTCAGCCTCCTGAGTAGC | TGG | chr17 | 42899672 | 42899691 | 42899675 | - |
| SEQ ID NO 57469 | CCTCAGCCTCCTGAGTAGCT | GGG | chr17 | 42899671 | 42899690 | 42899674 | - |
| SEQ ID NO 57470 | CTCCTGAGTAGCTGGGACCA | CAG | chr17 | 42899664 | 42899683 | 42899667 | - |
| SEQ ID NO 57471 | TCCTGAGTAGCTGGGACCAC | AGG | chr17 | 42899663 | 42899682 | 42899666 | - |
| SEQ ID NO 57472 | CAGGCACACGCCACCATGCC | TGG | chr17 | 42899644 | 42899663 | 42899647 | - |
| SEQ ID NO 57473 | GCTAATTTTTCTATCTTTTG | TAG | chr17 | 42899622 | 42899641 | 42899625 | - |
| SEQ ID NO 57474 | TAATTTTTCTATCTTTTGTA | GAG | chr17 | 42899620 | 42899639 | 42899623 | - |
| SEQ ID NO 57475 | TTTTCTATCTTTTGTAGAGA | TGG | chr17 | 42899616 | 42899635 | 42899619 | - |
| SEQ ID NO 57476 | TTTCTATCTTTTGTAGAGAT | GGG | chr17 | 42899615 | 42899634 | 42899618 | - |
| SEQ ID NO 57477 | TTCTATCTTTTGTAGAGATG | GGG | chr17 | 42899614 | 42899633 | 42899617 | - |
| SEQ ID NO 57478 | TGGGGTTTTTCCATGTTGCC | CAG | chr17 | 42899596 | 42899615 | 42899599 | - |
| SEQ ID NO 57479 | GGGGTTTTTCCATGTTGCCC | AGG | chr17 | 42899595 | 42899614 | 42899598 | - |
| SEQ ID NO 57480 | TTTTTCCATGTTGCCCAGGC | TGG | chr17 | 42899591 | 42899610 | 42899594 | - |
| SEQ ID NO 57481 | CAGGCTGGTCTTGAATTCCT | GAG | chr17 | 42899576 | 42899595 | 42899579 | - |
| SEQ ID NO 57482 | GGTCTTGAATTCCTGAGCTC | AAG | chr17 | 42899570 | 42899589 | 42899573 | - |
| SEQ ID NO 57483 | TCTTGAATTCCTGAGCTCAA | GAG | chr17 | 42899568 | 42899587 | 42899571 | - |
| SEQ ID NO 57484 | CCTGAGCTCAAGAGATCTGC | CAG | chr17 | 42899559 | 42899578 | 42899562 | - |
| SEQ ID NO 57485 | CTCAAGAGATCTGCCAGTCT | TGG | chr17 | 42899553 | 42899572 | 42899556 | - |
| SEQ ID NO 57486 | CTGCCAGTCTTGGCTTCCCA | AAG | chr17 | 42899543 | 42899562 | 42899546 | - |
| SEQ ID NO 57487 | GTCTTGGCTTCCCAAAGCTC | TGG | chr17 | 42899537 | 42899556 | 42899540 | - |
| SEQ ID NO 57488 | TCTTGGCTTCCCAAAGCTCT | GGG | chr17 | 42899536 | 42899555 | 42899539 | - |
| SEQ ID NO 57489 | TTCCCAAAGCTCTGGGATTA | CAG | chr17 | 42899529 | 42899548 | 42899532 | - |

Figure 85 (Cont'd)

| | | | | | | | |
|---|---|---|---|---|---|---|---|
| SEQ ID NO 57490 | TCCCAAAGCTCTGGGATTAC | AGG | chr17 | 42899528 | 42899547 | 42899531 | - |
| SEQ ID NO 57491 | CAGGTGTGAACCACCATGCC | TGG | chr17 | 42899509 | 42899528 | 42899512 | - |
| SEQ ID NO 57492 | GTGAACCACCATGCCTGGCC | AAG | chr17 | 42899504 | 42899523 | 42899507 | - |
| SEQ ID NO 57493 | GTGTTTTAACTCATACGTTT | AAG | chr17 | 42899482 | 42899501 | 42899485 | - |
| SEQ ID NO 57494 | TAAGCAAAATAATGAATGTA | TAG | chr17 | 42899463 | 42899482 | 42899466 | - |
| SEQ ID NO 57495 | GCAACAATATGATGAATGTA | TGG | chr17 | 42899431 | 42899450 | 42899434 | - |
| SEQ ID NO 57496 | ATGAATGTATGGTTCCAAAT | AAG | chr17 | 42899420 | 42899439 | 42899423 | - |
| SEQ ID NO 57497 | ATGGTTCCAAATAAGAATAC | CAG | chr17 | 42899412 | 42899431 | 42899415 | - |
| SEQ ID NO 57498 | AAATAAGAATACCAGCAAAA | TGG | chr17 | 42899404 | 42899423 | 42899407 | - |
| SEQ ID NO 57499 | AATACCAGCAAAATGGTAAC | TGG | chr17 | 42899397 | 42899416 | 42899400 | - |
| SEQ ID NO 57500 | TACCAGCAAAATGGTAACTG | GAG | chr17 | 42899395 | 42899414 | 42899398 | - |
| SEQ ID NO 57501 | AAATGGTAACTGGAGACTTA | AAG | chr17 | 42899387 | 42899406 | 42899390 | - |
| SEQ ID NO 57502 | ATGGTAACTGGAGACTTAAA | GAG | chr17 | 42899385 | 42899404 | 42899388 | - |
| SEQ ID NO 57503 | CTTAAAGAGTTTGAAACTTT | CAG | chr17 | 42899371 | 42899390 | 42899374 | - |
| SEQ ID NO 57504 | ACTTTCAGTTATTTTTGAAA | AAG | chr17 | 42899356 | 42899375 | 42899359 | - |
| SEQ ID NO 57505 | CTTTCAGTTATTTTTGAAAA | AGG | chr17 | 42899355 | 42899374 | 42899358 | - |
| SEQ ID NO 57506 | TTTCAGTTATTTTTGAAAAA | GGG | chr17 | 42899354 | 42899373 | 42899357 | - |
| SEQ ID NO 57507 | AAAAGGGCTTCTATATCTT | GAG | chr17 | 42899339 | 42899358 | 42899342 | - |
| SEQ ID NO 57508 | CTTTCTTATACATATGTGTG | TAG | chr17 | 42899316 | 42899335 | 42899319 | - |
| SEQ ID NO 57509 | ATATGTGTGTAGATATACAA | AAG | chr17 | 42899305 | 42899324 | 42899308 | - |
| SEQ ID NO 57510 | GTGTGTAGATATACAAAGA | AAG | chr17 | 42899301 | 42899320 | 42899304 | - |
| SEQ ID NO 57511 | AGATATACAAAAGAAAGCTC | AAG | chr17 | 42899295 | 42899314 | 42899298 | - |
| SEQ ID NO 57512 | TGTGTGTGTATACTATATAT | CAG | chr17 | 42899240 | 42899259 | 42899243 | - |
| SEQ ID NO 57513 | ACTATATATCAGCCTACAAA | TAG | chr17 | 42899229 | 42899248 | 42899232 | - |
| SEQ ID NO 57514 | ATATATCAGCCTACAAATAG | TAG | chr17 | 42899226 | 42899245 | 42899229 | - |
| SEQ ID NO 57515 | ATATCAGCCTACAAATAGTA | GAG | chr17 | 42899224 | 42899243 | 42899227 | - |
| SEQ ID NO 57516 | ATCAGCCTACAAATAGAGA | GAG | chr17 | 42899222 | 42899241 | 42899225 | - |
| SEQ ID NO 57517 | GAGACCAAAACCCTAACACT | TGG | chr17 | 42899202 | 42899221 | 42899205 | - |
| SEQ ID NO 57518 | AGACCAAAACCCTAACACTT | GGG | chr17 | 42899201 | 42899220 | 42899204 | - |
| SEQ ID NO 57519 | AAACCCTAACACTTGGGTCA | CGG | chr17 | 42899195 | 42899214 | 42899198 | - |
| SEQ ID NO 57520 | ACCCTAACACTTGGGTCACG | GAG | chr17 | 42899193 | 42899212 | 42899196 | - |
| SEQ ID NO 57521 | CCCTAACACTTGGGTCACGG | AGG | chr17 | 42899192 | 42899211 | 42899195 | - |
| SEQ ID NO 57522 | TGGGTCACGGAGGACTGTGA | AAG | chr17 | 42899182 | 42899201 | 42899185 | - |
| SEQ ID NO 57523 | GGGTCACGGAGGACTGTGAA | AGG | chr17 | 42899181 | 42899200 | 42899184 | - |
| SEQ ID NO 57524 | CGGAGGACTGTGAAAGGAAC | CAG | chr17 | 42899175 | 42899194 | 42899178 | - |
| SEQ ID NO 57525 | GGAGGACTGTGAAAGGAACC | AGG | chr17 | 42899174 | 42899193 | 42899177 | - |
| SEQ ID NO 57526 | GAGGACTGTGAAAGGAACCA | GGG | chr17 | 42899173 | 42899192 | 42899176 | - |
| SEQ ID NO 57527 | AAAGGAACCAGGGAATGAAT | CAG | chr17 | 42899163 | 42899182 | 42899166 | - |
| SEQ ID NO 57528 | AAGGAACCAGGGAATGAATC | AGG | chr17 | 42899162 | 42899181 | 42899165 | - |
| SEQ ID NO 57529 | AACTCATGCATTTTAAAAAA | TAG | chr17 | 42899134 | 42899153 | 42899137 | - |
| SEQ ID NO 57530 | ACTCATGCATTTTAAAAAAT | AGG | chr17 | 42899133 | 42899152 | 42899136 | - |
| SEQ ID NO 57531 | CTCATGCATTTTAAAAAATA | GGG | chr17 | 42899132 | 42899151 | 42899135 | - |
| SEQ ID NO 57532 | TATTTATTTATTTATTTTTG | TAG | chr17 | 42899075 | 42899094 | 42899078 | - |
| SEQ ID NO 57533 | TTTATTTATTTTTGTAGAAA | CGG | chr17 | 42899069 | 42899088 | 42899072 | - |
| SEQ ID NO 57534 | TTATTTATTTTTGTAGAAAC | GGG | chr17 | 42899068 | 42899087 | 42899071 | - |
| SEQ ID NO 57535 | TATTTATTTTTGTAGAAACG | GGG | chr17 | 42899067 | 42899086 | 42899070 | - |
| SEQ ID NO 57536 | AGAAACGGGGTCTCACTATG | CGG | chr17 | 42899054 | 42899073 | 42899057 | - |

Figure 85 (Cont'd)

| | | | | | | | |
|---|---|---|---|---|---|---|---|
| SEQ ID NO 57537 | CGGGGTCTCACTATGCGGCC | CAG | chr17 | 42899049 | 42899068 | 42899052 | - |
| SEQ ID NO 57538 | GGGGTCTCACTATGCGGCCC | AGG | chr17 | 42899048 | 42899067 | 42899051 | - |
| SEQ ID NO 57539 | TCTCACTATGCGGCCCAGGC | TGG | chr17 | 42899044 | 42899063 | 42899047 | - |
| SEQ ID NO 57540 | CCAGGCTGGTCTCAAATTCC | TGG | chr17 | 42899030 | 42899049 | 42899033 | - |
| SEQ ID NO 57541 | GGTCTCAAATTCCTGGCTTC | AAG | chr17 | 42899023 | 42899042 | 42899026 | - |
| SEQ ID NO 57542 | GTGATCCTCCCGCCTCAACC | TAG | chr17 | 42899001 | 42899020 | 42899004 | - |
| SEQ ID NO 57543 | CCTCCCGCCTCAACCTAGCA | AAG | chr17 | 42898996 | 42899015 | 42898999 | - |
| SEQ ID NO 57544 | GCCTCAACCTAGCAAAGCAT | TGG | chr17 | 42898990 | 42899009 | 42898993 | - |
| SEQ ID NO 57545 | CCTCAACCTAGCAAAGCATT | GGG | chr17 | 42898989 | 42899008 | 42898992 | - |
| SEQ ID NO 57546 | CTAGCAAAGCATTGGGATTA | CAG | chr17 | 42898982 | 42899001 | 42898985 | - |
| SEQ ID NO 57547 | TAGCAAAGCATTGGGATTAC | AGG | chr17 | 42898981 | 42899000 | 42898984 | - |
| SEQ ID NO 57548 | AGCATTGGGATTACAGGCAT | GAG | chr17 | 42898975 | 42898994 | 42898978 | - |
| SEQ ID NO 57549 | TCCAAATTCATGCATTTTTT | GAG | chr17 | 42898944 | 42898963 | 42898947 | - |
| SEQ ID NO 57550 | CCAAATTCATGCATTTTTTG | AGG | chr17 | 42898943 | 42898962 | 42898946 | - |
| SEQ ID NO 57551 | TTCATGCATTTTTTGAGGAT | AAG | chr17 | 42898938 | 42898957 | 42898941 | - |
| SEQ ID NO 57552 | CATGCATTTTTTGAGGATAA | GAG | chr17 | 42898936 | 42898955 | 42898939 | - |
| SEQ ID NO 57553 | CATTTTTTGAGGATAAGAGC | CAG | chr17 | 42898932 | 42898951 | 42898935 | - |
| SEQ ID NO 57554 | ATTTTTTGAGGATAAGAGCC | AGG | chr17 | 42898931 | 42898950 | 42898934 | - |
| SEQ ID NO 57555 | TTTTTTGAGGATAAGAGCCA | GGG | chr17 | 42898930 | 42898949 | 42898933 | - |
| SEQ ID NO 57556 | TTTTTGAGGATAAGAGCCAG | GGG | chr17 | 42898929 | 42898948 | 42898932 | - |
| SEQ ID NO 57557 | TTTTGAGGATAAGAGCCAGG | GGG | chr17 | 42898928 | 42898947 | 42898931 | - |
| SEQ ID NO 57558 | TGCCTGAATTTCCCATCATT | AAG | chr17 | 42898886 | 42898905 | 42898889 | - |
| SEQ ID NO 57559 | TTAAGTCCATATTGACATGT | AAG | chr17 | 42898868 | 42898887 | 42898871 | - |
| SEQ ID NO 57560 | TAAGTCCATATTGACATGTA | AGG | chr17 | 42898867 | 42898886 | 42898870 | - |
| SEQ ID NO 57561 | AAGTCCATATTGACATGTAA | GGG | chr17 | 42898866 | 42898885 | 42898869 | - |
| SEQ ID NO 57562 | AGTCCATATTGACATGTAAG | GGG | chr17 | 42898865 | 42898884 | 42898868 | - |
| SEQ ID NO 57563 | CCATATTGACATGTAAGGGG | TAG | chr17 | 42898862 | 42898881 | 42898865 | - |
| SEQ ID NO 57564 | ATTGACATGTAAGGGGTAGC | TGG | chr17 | 42898858 | 42898877 | 42898861 | - |
| SEQ ID NO 57565 | TTGACATGTAAGGGGTAGCT | GGG | chr17 | 42898857 | 42898876 | 42898860 | - |
| SEQ ID NO 57566 | TGACATGTAAGGGGTAGCTG | GGG | chr17 | 42898856 | 42898875 | 42898859 | - |
| SEQ ID NO 57567 | ATGTAAGGGGTAGCTGGGGA | CAG | chr17 | 42898852 | 42898871 | 42898855 | - |
| SEQ ID NO 57568 | GGGTAGCTGGGGACAGAAAA | AAG | chr17 | 42898845 | 42898864 | 42898848 | - |
| SEQ ID NO 57569 | GGGGACAGAAAAAAGAAACT | CAG | chr17 | 42898837 | 42898856 | 42898840 | - |
| SEQ ID NO 57570 | GGACAGAAAAAAGAAACTCA | GAG | chr17 | 42898835 | 42898854 | 42898838 | - |
| SEQ ID NO 57571 | ACTCAGAGCTAATGAATCTG | TGG | chr17 | 42898820 | 42898839 | 42898823 | - |
| SEQ ID NO 57572 | AGCTAATGAATCTGTGGCAA | AAG | chr17 | 42898814 | 42898833 | 42898817 | - |
| SEQ ID NO 57573 | GAATCTGTGGCAAAAGTTGA | CAG | chr17 | 42898807 | 42898826 | 42898810 | - |
| SEQ ID NO 57574 | AAGTTGACAGCATTCCATGC | TGG | chr17 | 42898794 | 42898813 | 42898797 | - |
| SEQ ID NO 57575 | GAAATGATTAAAACATCCTC | CAG | chr17 | 42898772 | 42898791 | 42898775 | - |
| SEQ ID NO 57576 | AAATGATTAAAACATCCTCC | AGG | chr17 | 42898771 | 42898790 | 42898774 | - |
| SEQ ID NO 57577 | ATGATTAAAACATCCTCCAG | GAG | chr17 | 42898769 | 42898788 | 42898772 | - |
| SEQ ID NO 57578 | TGATTAAAACATCCTCCAGG | AGG | chr17 | 42898768 | 42898787 | 42898771 | - |
| SEQ ID NO 57579 | ATCCTCCAGGAGGTATGACC | TGG | chr17 | 42898758 | 42898777 | 42898761 | - |
| SEQ ID NO 57580 | CCTCCAGGAGGTATGACCTG | GAG | chr17 | 42898756 | 42898775 | 42898759 | - |
| SEQ ID NO 57581 | AGTCTCCTCCCCACCCCACC | AAG | chr17 | 42898735 | 42898754 | 42898738 | - |
| SEQ ID NO 57582 | GTCTCCTCCCCACCCCACCA | AGG | chr17 | 42898734 | 42898753 | 42898737 | - |
| SEQ ID NO 57583 | TCTCCTCCCCACCCCACCAA | GGG | chr17 | 42898733 | 42898752 | 42898736 | - |

Figure 85 (Cont'd)

| | | | | | | | |
|---|---|---|---|---|---|---|---|
| SEQ ID NO 57584 | CCCCACCAAGGGCTCGCACC | CAG | chr17 | 42898722 | 42898741 | 42898725 | - |
| SEQ ID NO 57585 | CACCCAGCCCATGCTGACTC | CAG | chr17 | 42898706 | 42898725 | 42898709 | - |
| SEQ ID NO 57586 | TCCAGTTGTCCTTGACTGCA | TGG | chr17 | 42898688 | 42898707 | 42898691 | - |
| SEQ ID NO 57587 | CTTGACTGCATGGTTTCTGC | TGG | chr17 | 42898678 | 42898697 | 42898681 | - |
| SEQ ID NO 57588 | TGCATGGTTTCTGCTGGTCC | AAG | chr17 | 42898672 | 42898691 | 42898675 | - |
| SEQ ID NO 57589 | TCTCCTGCCACGCCTAACCT | TGG | chr17 | 42898643 | 42898662 | 42898646 | - |
| SEQ ID NO 57590 | TCCTGCCACGCCTAACCTTG | GAG | chr17 | 42898641 | 42898660 | 42898644 | - |
| SEQ ID NO 57591 | CTGCCACGCCTAACCTTGGA | GAG | chr17 | 42898639 | 42898658 | 42898642 | - |
| SEQ ID NO 57592 | CCACGCCTAACCTTGGAGAG | CAG | chr17 | 42898636 | 42898655 | 42898639 | - |
| SEQ ID NO 57593 | CACGCCTAACCTTGGAGAGC | AGG | chr17 | 42898635 | 42898654 | 42898638 | - |
| SEQ ID NO 57594 | TTGGAGAGCAGGTAATGTGT | TGG | chr17 | 42898624 | 42898643 | 42898627 | - |
| SEQ ID NO 57595 | AGGTAATGTGTTGGTGACTG | TGG | chr17 | 42898615 | 42898634 | 42898618 | - |
| SEQ ID NO 57596 | GGTAATGTGTTGGTGACTGT | GGG | chr17 | 42898614 | 42898633 | 42898617 | - |
| SEQ ID NO 57597 | AATGTGTTGGTGACTGTGGG | TGG | chr17 | 42898611 | 42898630 | 42898614 | - |
| SEQ ID NO 57598 | ATGTGTTGGTGACTGTGGGT | GGG | chr17 | 42898610 | 42898629 | 42898613 | - |
| SEQ ID NO 57599 | GGTGACTGTGGGTGGGTGTA | AAG | chr17 | 42898603 | 42898622 | 42898606 | - |
| SEQ ID NO 57600 | ACTGTGGGTGGGTGTAAAGT | AAG | chr17 | 42898599 | 42898618 | 42898602 | - |
| SEQ ID NO 57601 | GTGTAAAGTAAGCCCATGCG | TGG | chr17 | 42898588 | 42898607 | 42898591 | - |
| SEQ ID NO 57602 | TAAAGTAAGCCCATGCGTGG | CAG | chr17 | 42898585 | 42898604 | 42898588 | - |
| SEQ ID NO 57603 | AAAGTAAGCCCATGCGTGGC | AGG | chr17 | 42898584 | 42898603 | 42898587 | - |
| SEQ ID NO 57604 | GTAAGCCCATGCGTGGCAGG | CAG | chr17 | 42898581 | 42898600 | 42898584 | - |
| SEQ ID NO 57605 | CCATGCGTGGCAGGCAGTGC | TGG | chr17 | 42898575 | 42898594 | 42898578 | - |
| SEQ ID NO 57606 | CATGCGTGGCAGGCAGTGCT | GGG | chr17 | 42898574 | 42898593 | 42898577 | - |
| SEQ ID NO 57607 | ATGCGTGGCAGGCAGTGCTG | GGG | chr17 | 42898573 | 42898592 | 42898576 | - |
| SEQ ID NO 57608 | TGGCAGGCAGTGCTGGGGCG | TGG | chr17 | 42898568 | 42898587 | 42898571 | - |
| SEQ ID NO 57609 | GGCAGGCAGTGCTGGGGCGT | GGG | chr17 | 42898567 | 42898586 | 42898570 | - |
| SEQ ID NO 57610 | GCAGGCAGTGCTGGGGCGTG | GGG | chr17 | 42898566 | 42898585 | 42898569 | - |
| SEQ ID NO 57611 | GTATATGTGATCTGCACTGT | CAG | chr17 | 42898544 | 42898563 | 42898547 | - |
| SEQ ID NO 57612 | TATATGTGATCTGCACTGTC | AGG | chr17 | 42898543 | 42898562 | 42898546 | - |
| SEQ ID NO 57613 | ATATGTGATCTGCACTGTCA | GGG | chr17 | 42898542 | 42898561 | 42898545 | - |
| SEQ ID NO 57614 | ATCTGCACTGTCAGGGCTGC | TGG | chr17 | 42898535 | 42898554 | 42898538 | - |
| SEQ ID NO 57615 | TCTGCACTGTCAGGGCTGCT | GGG | chr17 | 42898534 | 42898553 | 42898537 | - |
| SEQ ID NO 57616 | CTGTCAGGGCTGCTGGGCCA | TAG | chr17 | 42898528 | 42898547 | 42898531 | - |
| SEQ ID NO 57617 | TGTCAGGGCTGCTGGGCCAT | AGG | chr17 | 42898527 | 42898546 | 42898530 | - |
| SEQ ID NO 57618 | CAGGGCTGCTGGGCCATAGG | TAG | chr17 | 42898524 | 42898543 | 42898527 | - |
| SEQ ID NO 57619 | AGGGCTGCTGGGCCATAGGT | AGG | chr17 | 42898523 | 42898542 | 42898526 | - |
| SEQ ID NO 57620 | GGGCTGCTGGGCCATAGGTA | GGG | chr17 | 42898522 | 42898541 | 42898525 | - |
| SEQ ID NO 57621 | GCTGCTGGGCCATAGGTAGG | GAG | chr17 | 42898520 | 42898539 | 42898523 | - |
| SEQ ID NO 57622 | GTAGGGAGCCTCCCTCTACC | CAG | chr17 | 42898505 | 42898524 | 42898508 | - |
| SEQ ID NO 57623 | GAGCCTCCCTCTACCCAGAT | AAG | chr17 | 42898500 | 42898519 | 42898503 | - |
| SEQ ID NO 57624 | ACCCAGATAAGCCTCTGTTG | TGG | chr17 | 42898488 | 42898507 | 42898491 | - |
| SEQ ID NO 57625 | CCAGATAAGCCTCTGTTGTG | GAG | chr17 | 42898486 | 42898505 | 42898489 | - |
| SEQ ID NO 57626 | CTGTTGTGGAGTAACTATTG | CAG | chr17 | 42898474 | 42898493 | 42898477 | - |
| SEQ ID NO 57627 | GTAACTATTGCAGTGACCTC | TGG | chr17 | 42898464 | 42898483 | 42898467 | - |
| SEQ ID NO 57628 | TAACTATTGCAGTGACCTCT | GGG | chr17 | 42898463 | 42898482 | 42898466 | - |
| SEQ ID NO 57629 | ATTGCAGTGACCTCTGGGAT | GAG | chr17 | 42898458 | 42898477 | 42898461 | - |
| SEQ ID NO 57630 | TGCAGTGACCTCTGGGATGA | GAG | chr17 | 42898456 | 42898475 | 42898459 | - |

Figure 85 (Cont'd)

| | | | | | | | |
|---|---|---|---|---|---|---|---|
| SEQ ID NO 57631 | CTCTGGGATGAGAGTTTCTA | TGG | chr17 | 42898447 | 42898466 | 42898450 | - |
| SEQ ID NO 57632 | GGGATGAGAGTTTCTATGGT | CAG | chr17 | 42898443 | 42898462 | 42898446 | - |
| SEQ ID NO 57633 | GATGAGAGTTTCTATGGTCA | GAG | chr17 | 42898441 | 42898460 | 42898444 | - |
| SEQ ID NO 57634 | ATGAGAGTTTCTATGGTCAG | AGG | chr17 | 42898440 | 42898459 | 42898443 | - |
| SEQ ID NO 57635 | GAGTTTCTATGGTCAGAGGT | GAG | chr17 | 42898436 | 42898455 | 42898439 | - |
| SEQ ID NO 57636 | TCTATGGTCAGAGGTGAGTC | AAG | chr17 | 42898431 | 42898450 | 42898434 | - |
| SEQ ID NO 57637 | CTATGGTCAGAGGTGAGTCA | AGG | chr17 | 42898430 | 42898449 | 42898433 | - |
| SEQ ID NO 57638 | GGTCAGAGGTGAGTCAAGGT | GAG | chr17 | 42898426 | 42898445 | 42898429 | - |
| SEQ ID NO 57639 | TGAGTCTAAAAACATATACA | AAG | chr17 | 42898407 | 42898426 | 42898410 | - |
| SEQ ID NO 57640 | GAGTCTAAAAACATATACAA | AGG | chr17 | 42898406 | 42898425 | 42898409 | - |
| SEQ ID NO 57641 | CATATACAAAGGCCACTGTC | TGG | chr17 | 42898395 | 42898414 | 42898398 | - |
| SEQ ID NO 57642 | ATATACAAAGGCCACTGTCT | GGG | chr17 | 42898394 | 42898413 | 42898397 | - |
| SEQ ID NO 57643 | GGCCACTGTCTGGGTCATGC | CAG | chr17 | 42898385 | 42898404 | 42898388 | - |
| SEQ ID NO 57644 | GCCACTGTCTGGGTCATGCC | AGG | chr17 | 42898384 | 42898403 | 42898387 | - |
| SEQ ID NO 57645 | CCACTGTCTGGGTCATGCCA | GGG | chr17 | 42898383 | 42898402 | 42898386 | - |
| SEQ ID NO 57646 | CTGTCTGGGTCATGCCAGGG | CAG | chr17 | 42898380 | 42898399 | 42898383 | - |
| SEQ ID NO 57647 | CTGGGTCATGCCAGGGCAGC | TAG | chr17 | 42898376 | 42898395 | 42898379 | - |
| SEQ ID NO 57648 | GGTCATGCCAGGGCAGCTAG | CAG | chr17 | 42898373 | 42898392 | 42898376 | - |
| SEQ ID NO 57649 | ATGCCAGGGCAGCTAGCAGC | CAG | chr17 | 42898369 | 42898388 | 42898372 | - |
| SEQ ID NO 57650 | TGCCAGGGCAGCTAGCAGCC | AGG | chr17 | 42898368 | 42898387 | 42898371 | - |
| SEQ ID NO 57651 | GCCAGGGCAGCTAGCAGCCA | GGG | chr17 | 42898367 | 42898386 | 42898370 | - |
| SEQ ID NO 57652 | AGCTAGCAGCCAGGGTCTCT | GAG | chr17 | 42898359 | 42898378 | 42898362 | - |
| SEQ ID NO 57653 | AGCAGCCAGGGTCTCTGAGT | TGG | chr17 | 42898355 | 42898374 | 42898358 | - |
| SEQ ID NO 57654 | GCAGCCAGGGTCTCTGAGTT | GGG | chr17 | 42898354 | 42898373 | 42898357 | - |
| SEQ ID NO 57655 | AGCCAGGGTCTCTGAGTTGG | GAG | chr17 | 42898352 | 42898371 | 42898355 | - |
| SEQ ID NO 57656 | GCCAGGGTCTCTGAGTTGGG | AGG | chr17 | 42898351 | 42898370 | 42898354 | - |
| SEQ ID NO 57657 | CCAGGGTCTCTGAGTTGGGA | GGG | chr17 | 42898350 | 42898369 | 42898353 | - |
| SEQ ID NO 57658 | CAGGGTCTCTGAGTTGGGAG | GGG | chr17 | 42898349 | 42898368 | 42898352 | - |
| SEQ ID NO 57659 | TTGGGAGGGGTTCTATTATG | TGG | chr17 | 42898336 | 42898355 | 42898339 | - |
| SEQ ID NO 57660 | GAGGGGTTCTATTATGTGGT | CAG | chr17 | 42898332 | 42898351 | 42898335 | - |
| SEQ ID NO 57661 | TCTATTATGTGGTCAGCATA | TGG | chr17 | 42898325 | 42898344 | 42898328 | - |
| SEQ ID NO 57662 | CTATTATGTGGTCAGCATAT | GGG | chr17 | 42898324 | 42898343 | 42898327 | - |
| SEQ ID NO 57663 | TATTATGTGGTCAGCATATG | GGG | chr17 | 42898323 | 42898342 | 42898326 | - |
| SEQ ID NO 57664 | TTATGTGGTCAGCATATGGG | GAG | chr17 | 42898321 | 42898340 | 42898324 | - |
| SEQ ID NO 57665 | TATGTGGTCAGCATATGGGG | AGG | chr17 | 42898320 | 42898339 | 42898323 | - |
| SEQ ID NO 57666 | ATGTGGTCAGCATATGGGGA | GGG | chr17 | 42898319 | 42898338 | 42898322 | - |
| SEQ ID NO 57667 | TGGGGAGGGCCCTGTTTTCT | GAG | chr17 | 42898305 | 42898324 | 42898308 | - |
| SEQ ID NO 57668 | CCCTGTTTTCTGAGACGCCT | CAG | chr17 | 42898296 | 42898315 | 42898299 | - |
| SEQ ID NO 57669 | CCTGTTTTCTGAGACGCCTC | AGG | chr17 | 42898295 | 42898314 | 42898298 | - |
| SEQ ID NO 57670 | GTTTTCTGAGACGCCTCAGG | AAG | chr17 | 42898292 | 42898311 | 42898295 | - |
| SEQ ID NO 57671 | CCTCAGGAAGAATACCCCTA | TGG | chr17 | 42898279 | 42898298 | 42898282 | - |
| SEQ ID NO 57672 | GGAAGAATACCCCTATGGAT | AAG | chr17 | 42898274 | 42898293 | 42898277 | - |
| SEQ ID NO 57673 | GAAGAATACCCCTATGGATA | AGG | chr17 | 42898273 | 42898292 | 42898276 | - |
| SEQ ID NO 57674 | AGAATACCCCTATGGATAAG | GAG | chr17 | 42898271 | 42898290 | 42898274 | - |
| SEQ ID NO 57675 | CCTATGGATAAGGAGTTGAT | AAG | chr17 | 42898263 | 42898282 | 42898266 | - |
| SEQ ID NO 57676 | GATAAGGAGTTGATAAGTGA | TGG | chr17 | 42898257 | 42898276 | 42898260 | - |
| SEQ ID NO 57677 | TAAGGAGTTGATAAGTGATG | GAG | chr17 | 42898255 | 42898274 | 42898258 | - |

Figure 85 (Cont'd)

| SEQ ID NO 57678 | ATGGAGTTGACATCCCACTC | TGG | chr17 | 42898238 | 42898257 | 42898241 | - |
| SEQ ID NO 57679 | TGGAGTTGACATCCCACTCT | GGG | chr17 | 42898237 | 42898256 | 42898240 | - |
| SEQ ID NO 57680 | GACATCCCACTCTGGGCATC | CAG | chr17 | 42898230 | 42898249 | 42898233 | - |
| SEQ ID NO 57681 | ACATCCCACTCTGGGCATCC | AGG | chr17 | 42898229 | 42898248 | 42898232 | - |
| SEQ ID NO 57682 | CATCCCACTCTGGGCATCCA | GGG | chr17 | 42898228 | 42898247 | 42898231 | - |
| SEQ ID NO 57683 | CCACTCTGGGCATCCAGGGA | CAG | chr17 | 42898224 | 42898243 | 42898227 | - |
| SEQ ID NO 57684 | CTCTGGGCATCCAGGGACAG | TGG | chr17 | 42898221 | 42898240 | 42898224 | - |
| SEQ ID NO 57685 | TCTGGGCATCCAGGGACAGT | GGG | chr17 | 42898220 | 42898239 | 42898223 | - |
| SEQ ID NO 57686 | TGGGCATCCAGGGACAGTGG | GAG | chr17 | 42898218 | 42898237 | 42898221 | - |
| SEQ ID NO 57687 | AGGGACAGTGGGAGTCTTCC | TGG | chr17 | 42898209 | 42898228 | 42898212 | - |
| SEQ ID NO 57688 | GACAGTGGGAGTCTTCCTGG | CGG | chr17 | 42898206 | 42898225 | 42898209 | - |
| SEQ ID NO 57689 | AGTGGGAGTCTTCCTGGCGG | TGG | chr17 | 42898203 | 42898222 | 42898206 | - |
| SEQ ID NO 57690 | GTGGGAGTCTTCCTGGCGGT | GGG | chr17 | 42898202 | 42898221 | 42898205 | - |
| SEQ ID NO 57691 | TCTTCCTGGCGGTGGGCCAC | CAG | chr17 | 42898195 | 42898214 | 42898198 | - |
| SEQ ID NO 57692 | CTTCCTGGCGGTGGGCCACC | AGG | chr17 | 42898194 | 42898213 | 42898197 | - |
| SEQ ID NO 57693 | CCTGGCGGTGGGCCACCAGG | CAG | chr17 | 42898191 | 42898210 | 42898194 | - |
| SEQ ID NO 57694 | CTGGCGGTGGGCCACCAGGC | AGG | chr17 | 42898190 | 42898209 | 42898193 | - |
| SEQ ID NO 57695 | TGGCGGTGGGCCACCAGGCA | GGG | chr17 | 42898189 | 42898208 | 42898192 | - |
| SEQ ID NO 57696 | GGCGGTGGGCCACCAGGCAG | GGG | chr17 | 42898188 | 42898207 | 42898191 | - |
| SEQ ID NO 57697 | GCGGTGGGCCACCAGGCAGG | GGG | chr17 | 42898187 | 42898206 | 42898190 | - |
| SEQ ID NO 57698 | CACCAGGCAGGGGGACCCTC | TGG | chr17 | 42898178 | 42898197 | 42898181 | - |
| SEQ ID NO 57699 | GGCAGGGGGACCCTCTGGAT | CAG | chr17 | 42898173 | 42898192 | 42898176 | - |
| SEQ ID NO 57700 | CAGGGGGACCCTCTGGATCA | GAG | chr17 | 42898171 | 42898190 | 42898174 | - |
| SEQ ID NO 57701 | TCTGGATCAGAGCAACCTCA | TAG | chr17 | 42898160 | 42898179 | 42898163 | - |
| SEQ ID NO 57702 | CAGAGCAACCTCATAGTCAT | GAG | chr17 | 42898153 | 42898172 | 42898156 | - |
| SEQ ID NO 57703 | CCTCATAGTCATGAGACGAT | GAG | chr17 | 42898145 | 42898164 | 42898148 | - |
| SEQ ID NO 57704 | ATAGTCATGAGACGATGAGC | TGG | chr17 | 42898141 | 42898160 | 42898144 | - |
| SEQ ID NO 57705 | GTCCTCATCTTTCCACCTGC | CAG | chr17 | 42898119 | 42898138 | 42898122 | - |
| SEQ ID NO 57706 | CAGCCCCTTTCTGCTTCCTC | CAG | chr17 | 42898099 | 42898118 | 42898102 | - |
| SEQ ID NO 57707 | CTCCAGCACGTTTTTATCCG | TGG | chr17 | 42898082 | 42898101 | 42898085 | - |
| SEQ ID NO 57708 | TCCAGCACGTTTTTATCCGT | GGG | chr17 | 42898081 | 42898100 | 42898084 | - |
| SEQ ID NO 57709 | CGTTTTTATCCGTGGGAAAA | CAG | chr17 | 42898074 | 42898093 | 42898077 | - |
| SEQ ID NO 57710 | GTTTTTATCCGTGGGAAAAC | AGG | chr17 | 42898073 | 42898092 | 42898076 | - |
| SEQ ID NO 57711 | TTATCCGTGGGAAAACAGGT | GAG | chr17 | 42898069 | 42898088 | 42898072 | - |
| SEQ ID NO 57712 | TATCCGTGGGAAAACAGGTG | AGG | chr17 | 42898068 | 42898087 | 42898071 | - |
| SEQ ID NO 57713 | TGGGAAAACAGGTGAGGCCC | CAG | chr17 | 42898062 | 42898081 | 42898065 | - |
| SEQ ID NO 57714 | CAGGTGAGGCCCCAGCTTGT | TAG | chr17 | 42898054 | 42898073 | 42898057 | - |
| SEQ ID NO 57715 | TGAGGCCCCAGCTTGTTAGA | AAG | chr17 | 42898050 | 42898069 | 42898053 | - |
| SEQ ID NO 57716 | GTTAGAAAGCTGACTGCATC | GAG | chr17 | 42898036 | 42898055 | 42898039 | - |
| SEQ ID NO 57717 | CTGACTGCATCGAGACACCG | TGG | chr17 | 42898027 | 42898046 | 42898030 | - |
| SEQ ID NO 57718 | CGAGACACCGTGGATTCTCA | AAG | chr17 | 42898017 | 42898036 | 42898020 | - |
| SEQ ID NO 57719 | GAGACACCGTGGATTCTCAA | AGG | chr17 | 42898016 | 42898035 | 42898019 | - |
| SEQ ID NO 57720 | GTGGATTCTCAAAGGTCTTG | TGG | chr17 | 42898008 | 42898027 | 42898011 | - |
| SEQ ID NO 57721 | CAAAGGTCTTGTGGATATAT | GAG | chr17 | 42897999 | 42898018 | 42898002 | - |
| SEQ ID NO 57722 | AAAGGTCTTGTGGATATATG | AGG | chr17 | 42897998 | 42898017 | 42898001 | - |
| SEQ ID NO 57723 | GTCTTGTGGATATATGAGGC | GAG | chr17 | 42897994 | 42898013 | 42897997 | - |
| SEQ ID NO 57724 | TTGTGGATATATGAGGCGAG | TGG | chr17 | 42897991 | 42898010 | 42897994 | - |

Figure 85 (Cont'd)

| | | | | | | | |
|---|---|---|---|---|---|---|---|
| SEQ ID NO 57725 | GGATATATGAGGCGAGTGGC | TAG | chr17 | 42897987 | 42898006 | 42897990 | - |
| SEQ ID NO 57726 | TATATGAGGCGAGTGGCTAG | AAG | chr17 | 42897984 | 42898003 | 42897987 | - |
| SEQ ID NO 57727 | GAGTGGCTAGAAGTTTTGCT | GAG | chr17 | 42897974 | 42897993 | 42897977 | - |
| SEQ ID NO 57728 | ACTCATTTATCTGTTTATTT | GAG | chr17 | 42897946 | 42897965 | 42897949 | - |
| SEQ ID NO 57729 | ATTTATCTGTTTATTTGAGA | CGG | chr17 | 42897942 | 42897961 | 42897945 | - |
| SEQ ID NO 57730 | TTTATCTGTTTATTTGAGAC | GGG | chr17 | 42897941 | 42897960 | 42897944 | - |
| SEQ ID NO 57731 | TTATCTGTTTATTTGAGACG | GGG | chr17 | 42897940 | 42897959 | 42897943 | - |
| SEQ ID NO 57732 | CGGGGTCTCACTCTGTTACC | CAG | chr17 | 42897922 | 42897941 | 42897925 | - |
| SEQ ID NO 57733 | GGGGTCTCACTCTGTTACCC | AGG | chr17 | 42897921 | 42897940 | 42897924 | - |
| SEQ ID NO 57734 | TCTCACTCTGTTACCCAGGC | TGG | chr17 | 42897917 | 42897936 | 42897920 | - |
| SEQ ID NO 57735 | TCACTCTGTTACCCAGGCTG | GAG | chr17 | 42897915 | 42897934 | 42897918 | - |
| SEQ ID NO 57736 | CTGTTACCCAGGCTGGAGTG | CGG | chr17 | 42897910 | 42897929 | 42897913 | - |
| SEQ ID NO 57737 | TTACCCAGGCTGGAGTGCGG | TGG | chr17 | 42897907 | 42897926 | 42897910 | - |
| SEQ ID NO 57738 | GGAGTGCGGTGGCACCATCA | CAG | chr17 | 42897896 | 42897915 | 42897899 | - |
| SEQ ID NO 57739 | GGCACCATCACAGCTCACTG | CAG | chr17 | 42897886 | 42897905 | 42897889 | - |
| SEQ ID NO 57740 | ATCACAGCTCACTGCAGCCT | CAG | chr17 | 42897880 | 42897899 | 42897883 | - |
| SEQ ID NO 57741 | TCACTGCAGCCTCAGTCTCC | TGG | chr17 | 42897872 | 42897891 | 42897875 | - |
| SEQ ID NO 57742 | CACTGCAGCCTCAGTCTCCT | GGG | chr17 | 42897871 | 42897890 | 42897874 | - |
| SEQ ID NO 57743 | AGCCTCAGTCTCCTGGGCTT | AAG | chr17 | 42897865 | 42897884 | 42897868 | - |
| SEQ ID NO 57744 | GCCTCAGTCTCCTGGGCTTA | AGG | chr17 | 42897864 | 42897883 | 42897867 | - |
| SEQ ID NO 57745 | CCTCAGTCTCCTGGGCTTAA | GGG | chr17 | 42897863 | 42897882 | 42897866 | - |
| SEQ ID NO 57746 | CTTAAGGGATCGTTTTGCAT | CAG | chr17 | 42897848 | 42897867 | 42897851 | - |
| SEQ ID NO 57747 | GATCGTTTTGCATCAGTCTC | TGG | chr17 | 42897841 | 42897860 | 42897844 | - |
| SEQ ID NO 57748 | ATCGTTTTGCATCAGTCTCT | GGG | chr17 | 42897840 | 42897859 | 42897843 | - |
| SEQ ID NO 57749 | GTTTTGCATCAGTCTCTGGG | TAG | chr17 | 42897837 | 42897856 | 42897840 | - |
| SEQ ID NO 57750 | TGCATCAGTCTCTGGGTAGC | TGG | chr17 | 42897833 | 42897852 | 42897836 | - |
| SEQ ID NO 57751 | GCATCAGTCTCTGGGTAGCT | GGG | chr17 | 42897832 | 42897851 | 42897835 | - |
| SEQ ID NO 57752 | TCTCTGGGTAGCTGGGCCTA | CAG | chr17 | 42897825 | 42897844 | 42897828 | - |
| SEQ ID NO 57753 | CTCTGGGTAGCTGGGCCTAC | AGG | chr17 | 42897824 | 42897843 | 42897827 | - |
| SEQ ID NO 57754 | CAGGCGCACACCACCAAACC | CAG | chr17 | 42897805 | 42897824 | 42897808 | - |

Figure 86

| # | Sequence | PAM | Chr | Start | End | Cuts 5' of | Str |
|---|---|---|---|---|---|---|---|
| SEQ ID NO 57755 | TGGTGCCACCGCACTCCAGC | CTGGGT | chr17 | 42897899 | 42897918 | 42897915 | + |
| SEQ ID NO 57756 | CCGCACTCCAGCCTGGGTAA | CAGAGT | chr17 | 42897907 | 42897926 | 42897923 | + |
| SEQ ID NO 57757 | CGTCTCAAATAAACAGATAA | ATGAGT | chr17 | 42897940 | 42897959 | 42897956 | + |
| SEQ ID NO 57758 | TCAAATAAACAGATAAATGA | GTGGAT | chr17 | 42897944 | 42897963 | 42897960 | + |
| SEQ ID NO 57759 | CATATATCCACAAGACCTTT | GAGAAT | chr17 | 42897998 | 42898017 | 42898014 | + |
| SEQ ID NO 57760 | GGGGCCTCACCTGTTTTCCC | ACGGAT | chr17 | 42898061 | 42898080 | 42898077 | + |
| SEQ ID NO 57761 | TATGAGGTTGCTCTGATCCA | GAGGGT | chr17 | 42898158 | 42898177 | 42898174 | + |
| SEQ ID NO 57762 | CAGGAAGACTCCCACTGTCC | CTGGAT | chr17 | 42898207 | 42898226 | 42898223 | + |
| SEQ ID NO 57763 | TCCCACTGTCCCTGGATGCC | CAGAGT | chr17 | 42898216 | 42898235 | 42898232 | + |
| SEQ ID NO 57764 | CTGTCCCTGGATGCCCAGAG | TGGGAT | chr17 | 42898221 | 42898240 | 42898237 | + |
| SEQ ID NO 57765 | CTTATCAACTCCTTATCCAT | AGGGGT | chr17 | 42898260 | 42898279 | 42898276 | + |
| SEQ ID NO 57766 | ACTCCACAACAGAGGCTTAT | CTGGGT | chr17 | 42898482 | 42898501 | 42898498 | + |
| SEQ ID NO 57767 | ACCATGCAGTCAAGGACAAC | TGGAGT | chr17 | 42898684 | 42898703 | 42898700 | + |
| SEQ ID NO 57768 | ACAACTGGAGTCAGCATGGG | CTGGGT | chr17 | 42898699 | 42898718 | 42898715 | + |
| SEQ ID NO 57769 | GGCTGGGTGCGAGCCCTTGG | TGGGGT | chr17 | 42898717 | 42898736 | 42898733 | + |
| SEQ ID NO 57770 | ACTCCAGGTCATACCTCCTG | GAGGAT | chr17 | 42898752 | 42898771 | 42898768 | + |
| SEQ ID NO 57771 | TGTTTTAATCATTTCCAGCA | TGGAAT | chr17 | 42898777 | 42898796 | 42898793 | + |
| SEQ ID NO 57772 | TTGCCACAGATTCATTAGCT | CTGAGT | chr17 | 42898814 | 42898833 | 42898830 | + |
| SEQ ID NO 57773 | CTCTTATCCTCAAAAAATGC | ATGAAT | chr17 | 42898933 | 42898952 | 42898949 | + |
| SEQ ID NO 57774 | GCTTTGCTAGGTTGAGGCGG | GAGGAT | chr17 | 42898992 | 42899011 | 42899008 | + |
| SEQ ID NO 57775 | CGGGAGGATCACTTGAAGCC | AGGAAT | chr17 | 42899009 | 42899028 | 42899025 | + |
| SEQ ID NO 57776 | AGCCCTATTTTTTAAAATGC | ATGAGT | chr17 | 42899127 | 42899146 | 42899143 | + |
| SEQ ID NO 57777 | GTCCTCCGTGACCCAAGTGT | TAGGGT | chr17 | 42899187 | 42899206 | 42899203 | + |
| SEQ ID NO 57778 | TCATTATTTTGCTTAAACGT | ATGAGT | chr17 | 42899468 | 42899487 | 42899484 | + |
| SEQ ID NO 57779 | CTGGCAGATCTCTTGAGCTC | AGGAAT | chr17 | 42899556 | 42899575 | 42899572 | + |
| SEQ ID NO 57780 | TACTCAGGAGGCTGAGGTGG | GAGGAT | chr17 | 42899674 | 42899693 | 42899690 | + |
| SEQ ID NO 57781 | CTGCACTCCAGCCTGGGAGA | CAGAGT | chr17 | 42899747 | 42899766 | 42899763 | + |
| SEQ ID NO 57782 | TGTAACTTTAAGGTCATTAA | ATGAAT | chr17 | 42899832 | 42899851 | 42899848 | + |
| SEQ ID NO 57783 | CATGAGGCCAATACCAGGAA | GGGGGT | chr17 | 42899901 | 42899920 | 42899917 | + |
| SEQ ID NO 57784 | TTTTGTTTTGTTTTAGAGAC | TGGGGT | chr17 | 42900058 | 42900077 | 42900074 | + |
| SEQ ID NO 57785 | AATCCTCCTGCCTCAGCCTC | CTGAAT | chr17 | 42900159 | 42900178 | 42900175 | + |
| SEQ ID NO 57786 | TCCTGAATAGCTGGGACTAC | AAGGGT | chr17 | 42900177 | 42900196 | 42900193 | + |
| SEQ ID NO 57787 | TTAAATTTTGTGTAGAAAC | GAGGGT | chr17 | 42900231 | 42900250 | 42900247 | + |
| SEQ ID NO 57788 | GTCCCAACTCCTGGCTTCA | AGGGAT | chr17 | 42900278 | 42900297 | 42900294 | + |
| SEQ ID NO 57789 | ACCTCAGCCTCCCAAATTGC | TGGGAT | chr17 | 42900310 | 42900329 | 42900326 | + |
| SEQ ID NO 57790 | TAAAATTAAGAACTTAAAAC | TTGAAT | chr17 | 42900379 | 42900398 | 42900395 | + |
| SEQ ID NO 57791 | AGAAAATCTGACATCTTTGC | AAGAAT | chr17 | 42900458 | 42900477 | 42900474 | + |
| SEQ ID NO 57792 | ACATCTTTGCAAGAATCATC | GTGGAT | chr17 | 42900468 | 42900487 | 42900484 | + |
| SEQ ID NO 57793 | AAAGTTAATCATTGGCCCTG | CTGAGT | chr17 | 42900570 | 42900589 | 42900586 | + |
| SEQ ID NO 57794 | ATTTTAGACAAACGTGGTTT | TTGAGT | chr17 | 42900700 | 42900719 | 42900716 | + |
| SEQ ID NO 57795 | TTTGAGTCCAAAGATCAGGG | CTGGGT | chr17 | 42900719 | 42900738 | 42900735 | + |
| SEQ ID NO 57796 | AAGATCAGGGCTGGGTTGAC | CTGAAT | chr17 | 42900729 | 42900748 | 42900745 | + |
| SEQ ID NO 57797 | GGGCTGGGTTGACCTGAATA | CTGGAT | chr17 | 42900736 | 42900755 | 42900752 | + |
| SEQ ID NO 57798 | AGAGCAATCACCACCAAGCC | TGGAAT | chr17 | 42900802 | 42900821 | 42900818 | + |
| SEQ ID NO 57799 | TCCTGAGGTGCCAAGGAAAT | GAGGAT | chr17 | 42900853 | 42900872 | 42900869 | + |
| SEQ ID NO 57800 | AAGGAAATGAGGATGGAGGA | AGGAAT | chr17 | 42900865 | 42900884 | 42900881 | + |
| SEQ ID NO 57801 | AAATGAGGATGGAGGAAGGA | ATGAAT | chr17 | 42900869 | 42900888 | 42900885 | + |
| SEQ ID NO 57802 | ATGAATGTTCTCCATGACTT | TGGGAT | chr17 | 42900889 | 42900908 | 42900905 | + |
| SEQ ID NO 57803 | AGTCAACACATTACCTCCAG | GTGAAT | chr17 | 42900917 | 42900936 | 42900933 | + |
| SEQ ID NO 57804 | TGTCCGTGATCGCAGACCTC | AGGAAT | chr17 | 42900974 | 42900993 | 42900990 | + |

Figure 86 (Cont'd)

| SEQ ID NO 57805 | GCTGTGGGCATTAAACTCCT | TTGGGT | chr17 | 42901042 | 42901061 | 42901058 | + |
| SEQ ID NO 57806 | TCCAACCCCTCTCTCTGACT | TTGGAT | chr17 | 42901226 | 42901245 | 42901242 | + |
| SEQ ID NO 57807 | AGACAGAAAAAATCCTACCA | GTGAGT | chr17 | 42901270 | 42901289 | 42901286 | + |
| SEQ ID NO 57808 | TACAGGAAAGCCTATTTCAT | ATGGGT | chr17 | 42901302 | 42901321 | 42901318 | + |
| SEQ ID NO 57809 | AGCCTATTTCATATGGGTTA | AAGGGT | chr17 | 42901310 | 42901329 | 42901326 | + |
| SEQ ID NO 57810 | TGGGTTAAAGGGTAGGACAG | TTGAAT | chr17 | 42901323 | 42901342 | 42901339 | + |
| SEQ ID NO 57811 | AGTTGAATTCGTGAAAAGT | CTGAGT | chr17 | 42901341 | 42901360 | 42901357 | + |
| SEQ ID NO 57812 | AGTTATATAGGCTTTGAGCA | AAGAGT | chr17 | 42901364 | 42901383 | 42901380 | + |
| SEQ ID NO 57813 | ACTTTGGGAGGCCGAGGTGG | GCGAAT | chr17 | 42901471 | 42901490 | 42901487 | + |
| SEQ ID NO 57814 | CCGAGGTGGGCGAATCACTC | CTGGGT | chr17 | 42901482 | 42901501 | 42901498 | + |
| SEQ ID NO 57815 | AATCACTCCTGGGTGAACTC | AGGAGT | chr17 | 42901494 | 42901513 | 42901510 | + |
| SEQ ID NO 57816 | GAGAGGCGGAGGAGGTTGCA | GTGAGT | chr17 | 42901627 | 42901646 | 42901643 | + |
| SEQ ID NO 57817 | CTGCACTCCAGCCTGGGCAA | CAGAGT | chr17 | 42901666 | 42901685 | 42901682 | + |
| SEQ ID NO 57818 | TGATTCAACAGCCTGTTTTG | TGGGGT | chr17 | 42901760 | 42901779 | 42901776 | + |
| SEQ ID NO 57819 | TGGCAAGTCATATCAATTAT | CTGAGT | chr17 | 42901851 | 42901870 | 42901867 | + |
| SEQ ID NO 57820 | TCTGGCAGCTTAATAATAAT | CAGGGT | chr17 | 42901907 | 42901926 | 42901923 | + |
| SEQ ID NO 57821 | TAGATGCAGAGACCAAGGTG | CTGAGT | chr17 | 42902013 | 42902032 | 42902029 | + |
| SEQ ID NO 57822 | AAGGTTAGTACATGCCGAGC | CAGGAT | chr17 | 42902056 | 42902075 | 42902072 | + |
| SEQ ID NO 57823 | CTGGGGAGCAGGGGAAAGCC | CTGAGT | chr17 | 42902162 | 42902181 | 42902178 | + |
| SEQ ID NO 57824 | TTTTGTTTGTTTGTTTGAGA | TGGAGT | chr17 | 42902251 | 42902270 | 42902267 | + |
| SEQ ID NO 57825 | GTCTCGCACTGTTGCCTGGC | TGGAGT | chr17 | 42902275 | 42902294 | 42902291 | + |
| SEQ ID NO 57826 | GCCTCAGCCTCCCAAGTAGC | TGGGAT | chr17 | 42902360 | 42902379 | 42902376 | + |
| SEQ ID NO 57827 | GCCTTGGCCTCCCTAAGTGC | TAGGAT | chr17 | 42902496 | 42902515 | 42902512 | + |
| SEQ ID NO 57828 | TGAAGAACCATGCAATCTCT | CTGGGT | chr17 | 42902604 | 42902623 | 42902620 | + |
| SEQ ID NO 57829 | CTCTCTGGGTTGATAGAGGC | CAGAGT | chr17 | 42902620 | 42902639 | 42902636 | + |
| SEQ ID NO 57830 | AAATCACTATTCCACCATCA | CGGGAT | chr17 | 42902672 | 42902691 | 42902688 | + |
| SEQ ID NO 57831 | ATACTCTGTTTCAAAGTAGA | GAGGAT | chr17 | 42902784 | 42902803 | 42902800 | + |
| SEQ ID NO 57832 | GGGGGGCTCGTCCTAGGGGC | TGGAGT | chr17 | 42902886 | 42902905 | 42902902 | + |
| SEQ ID NO 57833 | AGTCACATAGCTGCCATTTT | ATGGAT | chr17 | 42903048 | 42903067 | 42903064 | + |
| SEQ ID NO 57834 | AGCTGCCATTTTATGGATTT | CAGGAT | chr17 | 42903056 | 42903075 | 42903072 | + |
| SEQ ID NO 57835 | TTTTTTTTTTTTTTTTGAGA | TGGAGT | chr17 | 42903084 | 42903103 | 42903100 | + |
| SEQ ID NO 57836 | GATTCTCTTGCCTTAGCCTC | CCGAGT | chr17 | 42903185 | 42903204 | 42903201 | + |
| SEQ ID NO 57837 | GCCTTAGCCTCCCGAGTAGC | TGGGAT | chr17 | 42903194 | 42903213 | 42903210 | + |
| SEQ ID NO 57838 | TGTGAGCCACCGCGCCTGCC | TGGAGT | chr17 | 42903363 | 42903382 | 42903379 | + |
| SEQ ID NO 57839 | CACCGCGCCTGCCTGGAGTT | CAGAAT | chr17 | 42903370 | 42903389 | 42903386 | + |
| SEQ ID NO 57840 | ACTTTGGGAGGCTGAGGTGG | GAGGAT | chr17 | 42903467 | 42903486 | 42903483 | + |
| SEQ ID NO 57841 | GGCTGAGGTGGGAGGATTGC | CTGAGT | chr17 | 42903476 | 42903495 | 42903492 | + |
| SEQ ID NO 57842 | ACTAAAAATACAAAAACTAG | CTGGAT | chr17 | 42903549 | 42903568 | 42903565 | + |
| SEQ ID NO 57843 | TATTCAGGAGGCTGAGGTGG | GAGGAT | chr17 | 42903602 | 42903621 | 42903618 | + |
| SEQ ID NO 57844 | TTGCGCCACTGCACTCCAGG | CTGGGT | chr17 | 42903659 | 42903678 | 42903675 | + |
| SEQ ID NO 57845 | AAACTTGTTCTGTTTTTCCA | TAGGAT | chr17 | 42903908 | 42903927 | 42903924 | + |
| SEQ ID NO 57846 | TTTGGACAGCGTCCATACTG | GTGGGT | chr17 | 42903938 | 42903957 | 42903954 | + |
| SEQ ID NO 57847 | AGCGTCCATACTGGTGGGTT | TTGGAT | chr17 | 42903945 | 42903964 | 42903961 | + |
| SEQ ID NO 57848 | CCAGCCCTGCAGACAGAAG | CTGAGT | chr17 | 42904050 | 42904069 | 42904066 | + |
| SEQ ID NO 57849 | GTGGACCTCGTTTACCTGTT | ATGGAT | chr17 | 42904074 | 42904093 | 42904090 | + |
| SEQ ID NO 57850 | TTCACTTCTGCAATACTTTC | CTGAAT | chr17 | 42904176 | 42904195 | 42904192 | + |
| SEQ ID NO 57851 | AAATCTGCCTATTACAGAAC | CTGGAT | chr17 | 42904218 | 42904237 | 42904234 | + |
| SEQ ID NO 57852 | TGCCTATTACAGAACCTGGA | TGGAGT | chr17 | 42904223 | 42904242 | 42904239 | + |
| SEQ ID NO 57853 | TCCATGGGCAAAGGGCTCGT | GAGAGT | chr17 | 42904266 | 42904285 | 42904282 | + |
| SEQ ID NO 57854 | GGGCAGAAGCCTGAGCTTCT | GGGGGT | chr17 | 42904327 | 42904346 | 42904343 | + |
| SEQ ID NO 57855 | CTTCCCAATGGCCTGGCCCA | CTGGAT | chr17 | 42904354 | 42904373 | 42904370 | + |

Figure 86 (Cont'd)

| SEQ ID NO 57856 | TATACACTGTTCTATGTGCT | AGGGAT | chr17 | 42904698 | 42904717 | 42904714 | + |
| SEQ ID NO 57857 | TGCCCTTGTGGAGCTGAAAT | CTGAAT | chr17 | 42904760 | 42904779 | 42904776 | + |
| SEQ ID NO 57858 | TAGGTAGATCACCTGAGGTC | AGGAGT | chr17 | 42904882 | 42904901 | 42904898 | + |
| SEQ ID NO 57859 | TACCTGGGAGGCTGAGGCAG | GAGAAT | chr17 | 42905000 | 42905019 | 42905016 | + |
| SEQ ID NO 57860 | TCGGACCACTGCACTCCAGC | CTGAAT | chr17 | 42905065 | 42905084 | 42905081 | + |
| SEQ ID NO 57861 | AAAAGTAAACTATTAATATG | TAGGAT | chr17 | 42905117 | 42905136 | 42905133 | + |
| SEQ ID NO 57862 | CAGCACTTTGGGAGGCTGAG | GCGGGT | chr17 | 42905174 | 42905193 | 42905190 | + |
| SEQ ID NO 57863 | ACTTTGGGAGGCTGAGGCGG | GTGGAT | chr17 | 42905178 | 42905197 | 42905194 | + |
| SEQ ID NO 57864 | CGGGTGGATCACCTGAGGTG | AGGAGT | chr17 | 42905195 | 42905214 | 42905211 | + |
| SEQ ID NO 57865 | ACTAAAAATACAAAAATTAG | CTGGGT | chr17 | 42905260 | 42905279 | 42905276 | + |
| SEQ ID NO 57866 | TACTCAGGAGGCTAAGGCAG | GAGAAT | chr17 | 42905313 | 42905332 | 42905329 | + |
| SEQ ID NO 57867 | CATCATAACAGCTTGTTATC | AAGGAT | chr17 | 42905593 | 42905612 | 42905609 | + |
| SEQ ID NO 57868 | ATAACAGCTTGTTATCAAGG | ATGAAT | chr17 | 42905597 | 42905616 | 42905613 | + |
| SEQ ID NO 57869 | TATTATCTCTGCTCCTTAGG | TAGAGT | chr17 | 42905716 | 42905735 | 42905732 | + |
| SEQ ID NO 57870 | ACTTTGGGAGGCCAACGCAG | GTGGAT | chr17 | 42905796 | 42905815 | 42905812 | + |
| SEQ ID NO 57871 | CAGGTGGATCACCTGAGGTC | AGGAGT | chr17 | 42905813 | 42905832 | 42905829 | + |
| SEQ ID NO 57872 | TACCCAGGAGGCTGCGGCAG | GAGAAT | chr17 | 42905934 | 42905953 | 42905950 | + |
| SEQ ID NO 57873 | AAAAAAAAAAAAAAGTTTAA | ATGAAT | chr17 | 42906047 | 42906066 | 42906063 | + |
| SEQ ID NO 57874 | AGAAAGCCTTTATTTATCTA | TGGGGT | chr17 | 42906166 | 42906185 | 42906182 | + |
| SEQ ID NO 57875 | TGAAATGGAGATTCACGTGC | AGGAGT | chr17 | 42906208 | 42906227 | 42906224 | + |
| SEQ ID NO 57876 | CCACAGCGAGCTCTGAAGCT | GGGGAT | chr17 | 42906325 | 42906344 | 42906341 | + |
| SEQ ID NO 57877 | TGAAGCTGGGGATGGCTCCT | CAGAGT | chr17 | 42906338 | 42906357 | 42906354 | + |
| SEQ ID NO 57878 | GTTGGTCCAAGTTGGGACAA | GGGAAT | chr17 | 42906362 | 42906381 | 42906378 | + |
| SEQ ID NO 57879 | TCTCAGGACCCTCTATCTCT | CAGGGT | chr17 | 42906542 | 42906561 | 42906558 | + |
| SEQ ID NO 57880 | CCCTCTATCTCTCAGGGTAG | AGGAAT | chr17 | 42906550 | 42906569 | 42906566 | + |
| SEQ ID NO 57881 | TCTCTCAGGGTAGAGGAATT | AAGAAT | chr17 | 42906557 | 42906576 | 42906573 | + |
| SEQ ID NO 57882 | CAGGGTAGAGGAATTAAGAA | TGGGAT | chr17 | 42906562 | 42906581 | 42906578 | + |
| SEQ ID NO 57883 | TCCCAACACTTTGGGAGGCC | AAGGGT | chr17 | 42906624 | 42906643 | 42906640 | + |
| SEQ ID NO 57884 | CTTTGGGAGGCCAAGGGTAG | GAGGAT | chr17 | 42906632 | 42906651 | 42906648 | + |
| SEQ ID NO 57885 | TAGGAGGATTGCTTGAGCCC | AAGAGT | chr17 | 42906649 | 42906668 | 42906665 | + |
| SEQ ID NO 57886 | TACTCAGGGGCTGAGGTGG | GAGGAT | chr17 | 42906768 | 42906787 | 42906784 | + |
| SEQ ID NO 57887 | GGCTGAGGTGGGAGGATTGC | TTGAGT | chr17 | 42906777 | 42906796 | 42906793 | + |
| SEQ ID NO 57888 | AAAACGGAACCGGTTGCAAG | CAGGGT | chr17 | 42906907 | 42906926 | 42906923 | + |
| SEQ ID NO 57889 | GCAGGGTTAAATAGCGTGGT | CAGAGT | chr17 | 42906926 | 42906945 | 42906942 | + |
| SEQ ID NO 57890 | TGGTCAGAGTAGGACTCACT | GAGAAT | chr17 | 42906942 | 42906961 | 42906958 | + |
| SEQ ID NO 57891 | ACTCACTGAGAATATGAGAT | CTGAGT | chr17 | 42906955 | 42906974 | 42906971 | + |
| SEQ ID NO 57892 | GAGATCTGAGTCAAGTCTTC | AAGGAT | chr17 | 42906970 | 42906989 | 42906986 | + |
| SEQ ID NO 57893 | TGAGGCCAGTGTAGCCAGAA | CAGAGT | chr17 | 42907108 | 42907127 | 42907124 | + |
| SEQ ID NO 57894 | GATGGAAATTTGTTAAATAA | ATGAAT | chr17 | 42907310 | 42907329 | 42907326 | + |
| SEQ ID NO 57895 | ATTTGTTAAATAAATGAATT | ATGGAT | chr17 | 42907317 | 42907336 | 42907333 | + |
| SEQ ID NO 57896 | AAATAAATGAATTATGGATA | ACGAAT | chr17 | 42907324 | 42907343 | 42907340 | + |
| SEQ ID NO 57897 | AAATGAATTATGGATAACGA | ATGGAT | chr17 | 42907328 | 42907347 | 42907344 | + |
| SEQ ID NO 57898 | GATAACGAATGGATGGTAAG | ATGGGT | chr17 | 42907340 | 42907359 | 42907356 | + |
| SEQ ID NO 57899 | ACGAATGGATGGTAAGATGG | GTGGAT | chr17 | 42907344 | 42907363 | 42907360 | + |
| SEQ ID NO 57900 | ATGGATGGTAAGATGGGTGG | ATGGAT | chr17 | 42907348 | 42907367 | 42907364 | + |
| SEQ ID NO 57901 | GTAAGATGGGTGGATGGATG | GGGGGT | chr17 | 42907355 | 42907374 | 42907371 | + |
| SEQ ID NO 57902 | GGTGGATGGATGGGGGTGA | ACGGAT | chr17 | 42907363 | 42907382 | 42907379 | + |
| SEQ ID NO 57903 | GATGGATGGGGGTGAACGG | ATGGAT | chr17 | 42907367 | 42907386 | 42907383 | + |
| SEQ ID NO 57904 | GGGGGGTGAACGGATGGATG | GGGGGT | chr17 | 42907374 | 42907393 | 42907390 | + |
| SEQ ID NO 57905 | GGTGAACGGATGGATGGGGG | GTGAAT | chr17 | 42907378 | 42907397 | 42907394 | + |
| SEQ ID NO 57906 | AACGGATGGATGGGGGGTGA | ATGGAT | chr17 | 42907382 | 42907401 | 42907398 | + |

Figure 86 (Cont'd)

| SEQ ID NO 57907 | GATGGATGGGGGGTGAATGG | ATGGAT | chr17 | 42907386 | 42907405 | 42907402 | + |
| SEQ ID NO 57908 | GATGGGGGTGAATGGATGG | ATGAAT | chr17 | 42907390 | 42907409 | 42907406 | + |
| SEQ ID NO 57909 | GGGGGTGAATGGATGGATGA | ATGGGT | chr17 | 42907394 | 42907413 | 42907410 | + |
| SEQ ID NO 57910 | ATGGATGGATGAATGGGTAG | ATGGGT | chr17 | 42907402 | 42907421 | 42907418 | + |
| SEQ ID NO 57911 | ATGGATGAATGGGTAGATGG | GTGGAT | chr17 | 42907406 | 42907425 | 42907422 | + |
| SEQ ID NO 57912 | ATGGGTAGATGGGTGGATAG | GGGGAT | chr17 | 42907414 | 42907433 | 42907430 | + |
| SEQ ID NO 57913 | ATGGGTGGATAGGGGGATGG | CTGGGT | chr17 | 42907422 | 42907441 | 42907438 | + |
| SEQ ID NO 57914 | ATAGGGGGATGGCTGGGTGG | CTGGGT | chr17 | 42907430 | 42907449 | 42907446 | + |
| SEQ ID NO 57915 | TTTCGGTAAGAACTCACCAC | TGGGGT | chr17 | 42907624 | 42907643 | 42907640 | + |
| SEQ ID NO 57916 | CACCTGGGCAGCCGCTGATT | AAGAGT | chr17 | 42907733 | 42907752 | 42907749 | + |
| SEQ ID NO 57917 | TGATTAAGAGTTGTGGCACT | TTGGAT | chr17 | 42907748 | 42907767 | 42907764 | + |
| SEQ ID NO 57918 | AGAGTTGTGGCACTTTGGAT | AGGGAT | chr17 | 42907754 | 42907773 | 42907770 | + |
| SEQ ID NO 57919 | CTTTGGATAGGGATAAACCT | CAGAGT | chr17 | 42907766 | 42907785 | 42907782 | + |
| SEQ ID NO 57920 | AGGGATAAACCTCAGAGTCA | GGGAAT | chr17 | 42907774 | 42907793 | 42907790 | + |
| SEQ ID NO 57921 | CAGGGAATGTTTGGGCTGAA | AGGGAT | chr17 | 42907792 | 42907811 | 42907808 | + |
| SEQ ID NO 57922 | ACCCATGTCTGTACCAACCA | CAGAGT | chr17 | 42907922 | 42907941 | 42907938 | + |
| SEQ ID NO 57923 | CAGAAGATATTCCTACTACA | GAGAAT | chr17 | 42907978 | 42907997 | 42907994 | + |
| SEQ ID NO 57924 | TATTCCTACTACAGAGAATT | CCGGGT | chr17 | 42907985 | 42908004 | 42908001 | + |
| SEQ ID NO 57925 | GATCCTCCCACCTCAGCCAT | CTGAGT | chr17 | 42908134 | 42908153 | 42908150 | + |
| SEQ ID NO 57926 | CTCGTATCTTTTGTAGAGA | CAGAGT | chr17 | 42908199 | 42908218 | 42908215 | + |
| SEQ ID NO 57927 | GCCTCAGCCTCCTAAAATAT | TGGGAT | chr17 | 42908276 | 42908295 | 42908292 | + |
| SEQ ID NO 57928 | AAGTTAAAATTCATATACAC | AAGGGT | chr17 | 42908364 | 42908383 | 42908380 | + |
| SEQ ID NO 57929 | TTTTTTTTTTTTTTTGAGA | CGGAAT | chr17 | 42908409 | 42908428 | 42908425 | + |
| SEQ ID NO 57930 | TCTCGCTCTGTTGCCCAGGC | TGGAGT | chr17 | 42908434 | 42908453 | 42908450 | + |
| SEQ ID NO 57931 | CTCACTGCAACCTCCGCTTC | CTGGGT | chr17 | 42908478 | 42908497 | 42908494 | + |
| SEQ ID NO 57932 | TATTCTTCTGCCTCAGCCTA | CCGAGT | chr17 | 42908510 | 42908529 | 42908526 | + |
| SEQ ID NO 57933 | TTTTTTATTTTAGTAGAGA | TGGGGT | chr17 | 42908575 | 42908594 | 42908591 | + |
| SEQ ID NO 57934 | GCCTCAGCCTCCCAAAGTGC | TGGGAT | chr17 | 42908652 | 42908671 | 42908668 | + |
| SEQ ID NO 57935 | TTTTTTTTTTTTTTGAGA | CGGAGT | chr17 | 42908705 | 42908724 | 42908721 | + |
| SEQ ID NO 57936 | TTTGCTCTTGTTGCCCAGGC | TAGAGT | chr17 | 42908731 | 42908750 | 42908747 | + |
| SEQ ID NO 57937 | CTCACTGTAACCTCCACCTC | CTGAGT | chr17 | 42908775 | 42908794 | 42908791 | + |
| SEQ ID NO 57938 | GCCTCAGCCTCTCAAATAGC | TGGGAT | chr17 | 42908816 | 42908835 | 42908832 | + |
| SEQ ID NO 57939 | AATTTTTTTTTAGTAGAGA | TGGGGT | chr17 | 42908877 | 42908896 | 42908893 | + |
| SEQ ID NO 57940 | ACCTCGGCCTCCCAAAGTGC | TGGGAT | chr17 | 42908955 | 42908974 | 42908971 | + |
| SEQ ID NO 57941 | TTGATCTTTTTAAAGAGAC | AGGGGT | chr17 | 42909012 | 42909031 | 42909028 | + |
| SEQ ID NO 57942 | ACCTCGGCCTCCCAAAGTAT | TGGGAT | chr17 | 42909091 | 42909110 | 42909107 | + |
| SEQ ID NO 57943 | CAACAGGCATCTTTGGACTT | TTGAGT | chr17 | 42909146 | 42909165 | 42909162 | + |
| SEQ ID NO 57944 | AGGGGCTGTTTTCTTTGCTG | AAGGAT | chr17 | 42909237 | 42909256 | 42909253 | + |
| SEQ ID NO 57945 | GCCTCTTCTGTTGCAGGTGC | TTGAAT | chr17 | 42909287 | 42909306 | 42909303 | + |
| SEQ ID NO 57946 | CTTGAATGTCATTTTGTGGT | TGGGAT | chr17 | 42909306 | 42909325 | 42909322 | + |
| SEQ ID NO 57947 | TGGGATTCTGGGCTGTGCAG | CTGAAT | chr17 | 42909326 | 42909345 | 42909342 | + |
| SEQ ID NO 57948 | CAGCTGAATGTCTGTCTGTC | ACGAAT | chr17 | 42909343 | 42909362 | 42909359 | + |
| SEQ ID NO 57949 | TTTCCTCATCAAGTTGTTGC | TGGAGT | chr17 | 42909385 | 42909404 | 42909401 | + |
| SEQ ID NO 57950 | TCAGTACTGTTAGCATTTCT | GTGGGT | chr17 | 42909521 | 42909540 | 42909537 | + |
| SEQ ID NO 57951 | ATTTCTGTGGGTTGAAAGTC | AAGAAT | chr17 | 42909535 | 42909554 | 42909551 | + |
| SEQ ID NO 57952 | TTGAAATGATTAATTTCTAT | AAGAGT | chr17 | 42909568 | 42909587 | 42909584 | + |
| SEQ ID NO 57953 | TATAAGAGTGCCCAGATCTA | TAGAAT | chr17 | 42909585 | 42909604 | 42909601 | + |
| SEQ ID NO 57954 | AGAGTGCCCAGATCTATAGA | ATGAAT | chr17 | 42909589 | 42909608 | 42909605 | + |
| SEQ ID NO 57955 | CATCAAATTAACGCACCAAA | TTGAAT | chr17 | 42909633 | 42909652 | 42909649 | + |
| SEQ ID NO 57956 | AGGCCCTAATTTACTTTTCA | GGGAAT | chr17 | 42909712 | 42909731 | 42909728 | + |
| SEQ ID NO 57957 | GTTGATCTCTTTTATAGGTT | CAGAGT | chr17 | 42909823 | 42909842 | 42909839 | + |

Figure 86 (Cont'd)

| | | | | | | | |
|---|---|---|---|---|---|---|---|
| SEQ ID NO 57958 | TCTTTTATAGGTTCAGAGTT | TTGAAT | chr17 | 42909830 | 42909849 | 42909846 | + |
| SEQ ID NO 57959 | TTTGTTTTTTTTTTTTGAGA | TGGAGT | chr17 | 42909865 | 42909884 | 42909881 | + |
| SEQ ID NO 57960 | TCTCGCTCTGTGACCCAGGC | TAGAGT | chr17 | 42909890 | 42909909 | 42909906 | + |
| SEQ ID NO 57961 | CTCACTGCAAGCTCCACCTC | CTGGGT | chr17 | 42909934 | 42909953 | 42909950 | + |
| SEQ ID NO 57962 | ATTCTCCTGCCTCAGCCTCT | CCGAGT | chr17 | 42909967 | 42909986 | 42909983 | + |
| SEQ ID NO 57963 | TTTTGTATTTTTAGCAGAGA | CGGGGT | chr17 | 42910033 | 42910052 | 42910049 | + |
| SEQ ID NO 57964 | GCCTCGGCCTCCCAAAGCGC | TGGGAT | chr17 | 42910098 | 42910117 | 42910114 | + |
| SEQ ID NO 57965 | TCCCAAAGCGCTGGGATTAC | AAGGGT | chr17 | 42910107 | 42910126 | 42910123 | + |
| SEQ ID NO 57966 | GGTGAGCCACCGCACCCTGC | CTGAAT | chr17 | 42910130 | 42910149 | 42910146 | + |
| SEQ ID NO 57967 | TTTTCTTAGATCCAATTAAC | AAGGGT | chr17 | 42910161 | 42910180 | 42910177 | + |
| SEQ ID NO 57968 | AAAGATTTTGTGGGAGGCAC | TGGAAT | chr17 | 42910213 | 42910232 | 42910229 | + |
| SEQ ID NO 57969 | ATAAGACCTTAACAAAACTG | TGGAAT | chr17 | 42910239 | 42910258 | 42910255 | + |
| SEQ ID NO 57970 | GAACATAGCAGCATTCAAAG | AAGAAT | chr17 | 42910291 | 42910310 | 42910307 | + |
| SEQ ID NO 57971 | AAGTAACACAGCATTTAGTA | CTGGGT | chr17 | 42910357 | 42910376 | 42910373 | + |
| SEQ ID NO 57972 | CCATATCACATGAAAACCT | GGGAAT | chr17 | 42910409 | 42910428 | 42910425 | + |
| SEQ ID NO 57973 | CTGGGAATGTTTAGGTTAGA | GAGAAT | chr17 | 42910427 | 42910446 | 42910443 | + |
| SEQ ID NO 57974 | ATAAAATGGACTGTTATAGT | GGGGGT | chr17 | 42910598 | 42910617 | 42910614 | + |
| SEQ ID NO 57975 | GGGGTGAGCTCCCTACCTCT | GAGGGT | chr17 | 42910619 | 42910638 | 42910635 | + |
| SEQ ID NO 57976 | GATATGGCACCTCCATCTGA | AAGAGT | chr17 | 42910708 | 42910727 | 42910724 | + |
| SEQ ID NO 57977 | AGTCTATATTGAGGGCAGGC | TGGAGT | chr17 | 42910731 | 42910750 | 42910747 | + |
| SEQ ID NO 57978 | GGCAGGCTGGAGTCACACAT | GGGAAT | chr17 | 42910744 | 42910763 | 42910760 | + |
| SEQ ID NO 57979 | TTTAATTCCACAGTCGCAGA | ACGGAT | chr17 | 42910803 | 42910822 | 42910819 | + |
| SEQ ID NO 57980 | CTTCCTGTTCAGCTTCGCCA | TCGGAT | chr17 | 42910994 | 42911013 | 42911010 | + |
| SEQ ID NO 57981 | TTTATCTGCTGCTCAAGGGA | CTGGGT | chr17 | 42911020 | 42911039 | 42911036 | + |
| SEQ ID NO 57982 | CCAGAGGTGGTGCGAGCAGC | CAGAAT | chr17 | 42911075 | 42911094 | 42911091 | + |
| SEQ ID NO 57983 | AGGTGGTGCGAGCAGCCAGA | ATGGGT | chr17 | 42911079 | 42911098 | 42911095 | + |
| SEQ ID NO 57984 | TCTACGTCTTGTCCTTCTGC | AAGAGT | chr17 | 42911317 | 42911336 | 42911333 | + |
| SEQ ID NO 57985 | AGAAGTCGTTGTAAGAGATG | TGGAGT | chr17 | 42911413 | 42911432 | 42911429 | + |
| SEQ ID NO 57986 | TTAAAGTCAACAACCATGCC | AGGGAT | chr17 | 42911448 | 42911467 | 42911464 | + |
| SEQ ID NO 57987 | TGCCATCCATTCTGCCGTCG | TGGAAT | chr17 | 42911527 | 42911546 | 42911543 | + |
| SEQ ID NO 57988 | TGCCGTCGTGGAATTAAATC | ACGGAT | chr17 | 42911539 | 42911558 | 42911555 | + |
| SEQ ID NO 57989 | AAATCACGGATGGCAGATTG | GAGGGT | chr17 | 42911554 | 42911573 | 42911570 | + |
| SEQ ID NO 57990 | GGAGGTCCTCCTCTCTCTAC | TTGAAT | chr17 | 42911680 | 42911699 | 42911696 | + |
| SEQ ID NO 57991 | TGGAACAGCCCATTTTATCT | TTGAAT | chr17 | 42911735 | 42911754 | 42911751 | + |
| SEQ ID NO 57992 | CTTTTACAATCCTAATCATA | TTGGGT | chr17 | 42911815 | 42911834 | 42911831 | + |
| SEQ ID NO 57993 | GAAAGACCTGTTGCTAGAAG | TTGGGT | chr17 | 42911872 | 42911891 | 42911888 | + |
| SEQ ID NO 57994 | TTGCTAGAAGTTGGGTTGTT | CTGGAT | chr17 | 42911882 | 42911901 | 42911898 | + |
| SEQ ID NO 57995 | CCAGGCTGGAGATCCTAACT | GAGAAT | chr17 | 42911983 | 42912002 | 42911999 | + |
| SEQ ID NO 57996 | GAGAAAAGGAGAAAGGAGCT | CTGAAT | chr17 | 42912033 | 42912052 | 42912049 | + |
| SEQ ID NO 57997 | GAAAAGAAGGCTGCCTAAGG | AGGAGT | chr17 | 42912066 | 42912085 | 42912082 | + |
| SEQ ID NO 57998 | TATAATTAATAGATGGTTAG | TGGGGT | chr17 | 42912192 | 42912211 | 42912208 | + |
| SEQ ID NO 57999 | TACATGTTCATCGTATTTCC | TTGGAT | chr17 | 42912250 | 42912269 | 42912266 | + |
| SEQ ID NO 58000 | CATCGTATTTCCTTGGATTT | CTGAAT | chr17 | 42912258 | 42912277 | 42912274 | + |
| SEQ ID NO 58001 | CTGGCTCCACATCCACCCCA | CTGGAT | chr17 | 42912402 | 42912421 | 42912418 | + |
| SEQ ID NO 58002 | CAAAATGACAAGGGGAGGGC | CAGGAT | chr17 | 42912496 | 42912515 | 42912512 | + |
| SEQ ID NO 58003 | AGTGTTACTTTAATTCCTA | GAGGGT | chr17 | 42912541 | 42912560 | 42912557 | + |
| SEQ ID NO 58004 | CTTTTTTTTTTTTTTGAGA | CAGGGT | chr17 | 42912638 | 42912657 | 42912654 | + |
| SEQ ID NO 58005 | CTATGTTGCCCAGGCTGCTC | TTGAAT | chr17 | 42912668 | 42912687 | 42912684 | + |
| SEQ ID NO 58006 | GGCGCACCTATCACCCAGGC | TGGAGT | chr17 | 42912823 | 42912842 | 42912839 | + |
| SEQ ID NO 58007 | ACCTATCACCCAGGCTGGAG | TGGAGT | chr17 | 42912828 | 42912847 | 42912844 | + |
| SEQ ID NO 58008 | CAGGCTAATTTTTATATTTT | TAGAAT | chr17 | 42912954 | 42912973 | 42912970 | + |

Figure 86 (Cont'd)

| | | | | | | | |
|---|---|---|---|---|---|---|---|
| SEQ ID NO 58009 | TTTTAGAATTTTAGAAGAGA | TGGGAT | chr17 | 42912971 | 42912990 | 42912987 | + |
| SEQ ID NO 58010 | GCCTTGGCCTCCCAAGGTGC | TAGGAT | chr17 | 42913050 | 42913069 | 42913066 | + |
| SEQ ID NO 58011 | TTTCAATCTCATCTGATATG | CAGAGT | chr17 | 42913116 | 42913135 | 42913132 | + |
| SEQ ID NO 58012 | ATTAAAGCAACATTTTATTT | AAGAAT | chr17 | 42913304 | 42913323 | 42913320 | + |
| SEQ ID NO 58013 | GAGAAGAAAAGTGCTCTCTC | TTGAGT | chr17 | 42913459 | 42913478 | 42913475 | + |
| SEQ ID NO 58014 | TGCTCTCTCTTGAGTTGACC | GAGAGT | chr17 | 42913470 | 42913489 | 42913486 | + |
| SEQ ID NO 58015 | AGTTGACCGAGAGTCCCATT | AGGGAT | chr17 | 42913482 | 42913501 | 42913498 | + |
| SEQ ID NO 58016 | TGCATCCACAGGGGCACAGG | CAGAGT | chr17 | 42913521 | 42913540 | 42913537 | + |
| SEQ ID NO 58017 | AGCATAGAACCAGAAAGATT | CAGAGT | chr17 | 42913574 | 42913593 | 42913590 | + |
| SEQ ID NO 58018 | AGAAAGATTCAGAGTTGGCC | AAGAAT | chr17 | 42913585 | 42913604 | 42913601 | + |
| SEQ ID NO 58019 | CTACCAGACCACAAGTCAGC | ATGAGT | chr17 | 42913620 | 42913639 | 42913636 | + |
| SEQ ID NO 58020 | ATGGCATCAAATTGCAACTT | GAGAGT | chr17 | 42913652 | 42913671 | 42913668 | + |
| SEQ ID NO 58021 | GCAACTTGAGAGTAGATGGG | CAGGGT | chr17 | 42913665 | 42913684 | 42913681 | + |
| SEQ ID NO 58022 | CAACAAGACTAGGCCAGCTC | TGGAAT | chr17 | 42913734 | 42913753 | 42913750 | + |
| SEQ ID NO 58023 | AACTCAGTGTCAGCAAGGTT | TTGGGT | chr17 | 42913765 | 42913784 | 42913781 | + |
| SEQ ID NO 58024 | CAGAGCCAGTCACAGCACCA | AGGAAT | chr17 | 42913812 | 42913831 | 42913828 | + |
| SEQ ID NO 58025 | GCTAAGAGATTTATTTCATC | CTGGGT | chr17 | 42913866 | 42913885 | 42913882 | + |
| SEQ ID NO 58026 | GATTTATTTCATCCTGGGTG | CAGGGT | chr17 | 42913873 | 42913892 | 42913889 | + |
| SEQ ID NO 58027 | CTCAAATCATCACCGTATCA | ATGGAT | chr17 | 42913914 | 42913933 | 42913930 | + |
| SEQ ID NO 58028 | ACCGTATCAATGGATTTCCT | GAGGGT | chr17 | 42913925 | 42913944 | 42913941 | + |
| SEQ ID NO 58029 | GCTATTTCACACCTGAACTC | CGGAGT | chr17 | 42913958 | 42913977 | 42913974 | + |
| SEQ ID NO 58030 | GGGAAGATTGCATTCTCCTA | CTGGAT | chr17 | 42913995 | 42914014 | 42914011 | + |
| SEQ ID NO 58031 | TGTGGGAACCAGGCCCCTCA | CAGAAT | chr17 | 42914040 | 42914059 | 42914056 | + |
| SEQ ID NO 58032 | TTTTTTTTTTTAATAGAGAT | GGGGGT | chr17 | 42914103 | 42914122 | 42914119 | + |
| SEQ ID NO 58033 | CCCAGGCTGGTCTTGAACTC | CTGGGT | chr17 | 42914141 | 42914160 | 42914157 | + |
| SEQ ID NO 58034 | GCCTCAGCCTCCCAAAGTGC | TGGGAT | chr17 | 42914182 | 42914201 | 42914198 | + |
| SEQ ID NO 58035 | AACATAACAGATAAAGTTTA | TTGAGT | chr17 | 42914398 | 42914417 | 42914414 | + |
| SEQ ID NO 58036 | TTAGTTCTCCCAACATCTCT | GTGAGT | chr17 | 42914478 | 42914497 | 42914494 | + |
| SEQ ID NO 58037 | TATATTACAAATAGGTCCAG | AGGGGT | chr17 | 42914524 | 42914543 | 42914540 | + |
| SEQ ID NO 58038 | GAGGGGTTAGTCATCTTGTC | CAGAAT | chr17 | 42914543 | 42914562 | 42914559 | + |
| SEQ ID NO 58039 | CAGAATGGTGGAACCAGGTT | AAGGAT | chr17 | 42914563 | 42914582 | 42914579 | + |
| SEQ ID NO 58040 | GTGGCAGATTGCCTGAGCTC | AGGAGT | chr17 | 42914651 | 42914670 | 42914667 | + |
| SEQ ID NO 58041 | TACTCAGGTGGCTGAGGTGG | GAGAAT | chr17 | 42914771 | 42914790 | 42914787 | + |
| SEQ ID NO 58042 | TTATGCCACTGCACTCCAGC | CTGGGT | chr17 | 42914829 | 42914848 | 42914845 | + |
| SEQ ID NO 58043 | CTGCACTCCAGCCTGGGTGA | CAGAGT | chr17 | 42914837 | 42914856 | 42914853 | + |
| SEQ ID NO 58044 | AAAGAAGCAAGCAGTCTGGG | CTGGGT | chr17 | 42914891 | 42914910 | 42914907 | + |
| SEQ ID NO 58045 | CATGTTATGGCATAATTTGG | TAGAAT | chr17 | 42915097 | 42915116 | 42915113 | + |
| SEQ ID NO 58046 | AGTTTTCAGGTGGTAGGCTT | GAGGAT | chr17 | 42915139 | 42915158 | 42915155 | + |
| SEQ ID NO 58047 | TTTTATTTTATTATTTGAGA | TGGAGT | chr17 | 42915350 | 42915369 | 42915366 | + |
| SEQ ID NO 58048 | TCTCACTCTGTCACCCAGGC | TGGGGT | chr17 | 42915375 | 42915394 | 42915391 | + |
| SEQ ID NO 58049 | GATCCTCCAGCCTCAGCCTC | CCGAAT | chr17 | 42915452 | 42915471 | 42915468 | + |
| SEQ ID NO 58050 | TTTTTTATTTTTTGTAGAGA | CAGGGT | chr17 | 42915517 | 42915536 | 42915533 | + |
| SEQ ID NO 58051 | GCCTTAGCCTCCCAAAGTGC | TGGGAT | chr17 | 42915558 | 42915577 | 42915574 | + |
| SEQ ID NO 58052 | CAGGCAGATCACCTGAGATC | AGGAGT | chr17 | 42915715 | 42915734 | 42915731 | + |
| SEQ ID NO 58053 | TGCACTCCAACCTGGGCAAC | AAGAGT | chr17 | 42915902 | 42915921 | 42915918 | + |
| SEQ ID NO 58054 | TCATTTAAAGTGTACAATTC | AGGGGT | chr17 | 42916000 | 42916019 | 42916016 | + |
| SEQ ID NO 58055 | GACAAGTAATATTCCATTGT | ATGAAT | chr17 | 42916225 | 42916244 | 42916241 | + |
| SEQ ID NO 58056 | GTATGAATATATAACATTGT | ATGAAT | chr17 | 42916243 | 42916262 | 42916259 | + |
| SEQ ID NO 58057 | ACTTTGGGAGGCTGAGGCAG | GAGGAT | chr17 | 42916332 | 42916351 | 42916348 | + |
| SEQ ID NO 58058 | GCCTCAGCCTCCCAAAGTGC | TGGGAT | chr17 | 42916330 | 42916349 | 42916333 | - |
| SEQ ID NO 58059 | AATGTTATATATTCATACAA | TGGAAT | chr17 | 42916241 | 42916260 | 42916244 | - |

Figure 86 (Cont'd)

| SEQ ID NO 58060 | CACAAAAGGCCACATATTGT | AGGAGT | chr17 | 42916125 | 42916144 | 42916128 | - |
| SEQ ID NO 58061 | AGATTAGTGGTTGCCTAGGC | TTGAGT | chr17 | 42916051 | 42916070 | 42916054 | - |
| SEQ ID NO 58062 | TAGTGGTTGCCTAGGCTTGA | GTGGGT | chr17 | 42916047 | 42916066 | 42916050 | - |
| SEQ ID NO 58063 | TTGCCTAGGCTTGAGTGGGT | TGGAGT | chr17 | 42916041 | 42916060 | 42916044 | - |
| SEQ ID NO 58064 | TAGGCTTGAGTGGGTTGGAG | TGGAAT | chr17 | 42916036 | 42916055 | 42916039 | - |
| SEQ ID NO 58065 | TTGGAGTGGAATGAAAACCC | CTGAAT | chr17 | 42916022 | 42916041 | 42916025 | - |
| SEQ ID NO 58066 | CCCTGAATTGTACACTTTAA | ATGAGT | chr17 | 42916004 | 42916023 | 42916007 | - |
| SEQ ID NO 58067 | GAATTGTACACTTTAAATGA | GTGAAT | chr17 | 42916000 | 42916019 | 42916003 | - |
| SEQ ID NO 58068 | TGAGTGAATTGTATGGTATT | GTGAAT | chr17 | 42915983 | 42916002 | 42915986 | - |
| SEQ ID NO 58069 | AGCTTTTTTTTTTTTGAGA | TGGAGT | chr17 | 42915937 | 42915956 | 42915940 | - |
| SEQ ID NO 58070 | TTCACTCTTGTTGCCCAGGT | TGGAGT | chr17 | 42915911 | 42915930 | 42915914 | - |
| SEQ ID NO 58071 | GTCTCAGCCTCTCAAGTAGC | TGGGAT | chr17 | 42915826 | 42915845 | 42915829 | - |
| SEQ ID NO 58072 | GCCTTGGCTTCCCAAAGTGC | TGGGAT | chr17 | 42915696 | 42915715 | 42915699 | - |
| SEQ ID NO 58073 | GTTAAAAATCAAAACATGG | CTGAGT | chr17 | 42915609 | 42915628 | 42915612 | - |
| SEQ ID NO 58074 | ACTTTGGGAGGCTAAGGCGG | GAGGAT | chr17 | 42915556 | 42915575 | 42915559 | - |
| SEQ ID NO 58075 | TATTCGGGAGGCTGAGGCTG | GAGGAT | chr17 | 42915459 | 42915478 | 42915462 | - |
| SEQ ID NO 58076 | TGGAGGATCATTTGAGCCCC | AGGAGT | chr17 | 42915441 | 42915460 | 42915444 | - |
| SEQ ID NO 58077 | TTGCGCCATTGCACCCCAGC | CTGGGT | chr17 | 42915393 | 42915412 | 42915396 | - |
| SEQ ID NO 58078 | TTGCACCCCAGCCTGGGTGA | CAGAGT | chr17 | 42915385 | 42915404 | 42915388 | - |
| SEQ ID NO 58079 | GCAGAAGTTGGACTTCCTTA | ATGGGT | chr17 | 42915224 | 42915243 | 42915227 | - |
| SEQ ID NO 58080 | CTATTTTCTTTGGGCAATAA | TAGAAT | chr17 | 42915198 | 42915217 | 42915201 | - |
| SEQ ID NO 58081 | ATCTATAACTTAGGGAACAG | ATGAGT | chr17 | 42915004 | 42915023 | 42915007 | - |
| SEQ ID NO 58082 | AAAATGTTCTGTCTAATAAG | CAGGAT | chr17 | 42914974 | 42914993 | 42914977 | - |
| SEQ ID NO 58083 | CAAAATGATTATTTTGTATC | TGGGAT | chr17 | 42914942 | 42914961 | 42914945 | - |
| SEQ ID NO 58084 | TTTTTTTTTTTTTCTGAGA | CAGGGT | chr17 | 42914872 | 42914891 | 42914875 | - |
| SEQ ID NO 58085 | TCTCACTCTGTCACCCAGGC | TGGAGT | chr17 | 42914847 | 42914866 | 42914850 | - |
| SEQ ID NO 58086 | CACTGCAACCTCTGAGCTCA | AGGGAT | chr17 | 42914801 | 42914820 | 42914804 | - |
| SEQ ID NO 58087 | GATTCTCCCACCTCAGCCAC | CTGAGT | chr17 | 42914778 | 42914797 | 42914781 | - |
| SEQ ID NO 58088 | TTTGTATTTTGGTATAGAC | GGGGGT | chr17 | 42914711 | 42914730 | 42914714 | - |
| SEQ ID NO 58089 | ACCTCAGCCTCCCAAAGTGC | TGGGAT | chr17 | 42914633 | 42914652 | 42914636 | - |
| SEQ ID NO 58090 | TCTGGACCTATTTGTAATAT | AAGGAT | chr17 | 42914525 | 42914544 | 42914528 | - |
| SEQ ID NO 58091 | AGAGATGTTGGGAGAACTAA | GCGAGT | chr17 | 42914478 | 42914497 | 42914481 | - |
| SEQ ID NO 58092 | TATAAATAAAGTACATAGAA | CAGAAT | chr17 | 42914446 | 42914465 | 42914449 | - |
| SEQ ID NO 58093 | TATCAACCTCATAAACTTCA | GGGAGT | chr17 | 42914374 | 42914393 | 42914377 | - |
| SEQ ID NO 58094 | TTCTGGCAGACCTTTCTTGT | AAGGAT | chr17 | 42914332 | 42914351 | 42914335 | - |
| SEQ ID NO 58095 | TTGGGAGCAAATAGATTATC | AAGGAT | chr17 | 42914292 | 42914311 | 42914295 | - |
| SEQ ID NO 58096 | ATGGGGCTATGCCTAAGCAG | TAGGGT | chr17 | 42914268 | 42914287 | 42914271 | - |
| SEQ ID NO 58097 | ACTTTGGGAGGCTGAGGCAG | GAGGAT | chr17 | 42914180 | 42914199 | 42914183 | - |
| SEQ ID NO 58098 | CAGGAGGATCACTTGAACCC | AGGAGT | chr17 | 42914163 | 42914182 | 42914166 | - |
| SEQ ID NO 58099 | TGAGAGCCCAAATCCAGTAG | GAGAAT | chr17 | 42914012 | 42914031 | 42914015 | - |
| SEQ ID NO 58100 | GTAGGAGAATGCAATCTTCC | CTGAAT | chr17 | 42913996 | 42914015 | 42913999 | - |
| SEQ ID NO 58101 | TTCCCTGAATATACAGACTC | CGGAGT | chr17 | 42913980 | 42913999 | 42913983 | - |
| SEQ ID NO 58102 | TGGAGGTCGAACCCTGCACC | CAGGAT | chr17 | 42913889 | 42913908 | 42913892 | - |
| SEQ ID NO 58103 | AACCCAAAACCTTGCTGACA | CTGAGT | chr17 | 42913772 | 42913791 | 42913775 | - |
| SEQ ID NO 58104 | ACCTTGCTGACACTGAGTTA | CTGGAT | chr17 | 42913764 | 42913783 | 42913767 | - |
| SEQ ID NO 58105 | ATGTTCATTCTTGGCCAACT | CTGAAT | chr17 | 42913597 | 42913616 | 42913600 | - |
| SEQ ID NO 58106 | TCAACTCTGCCTGTGCCCCT | GTGGAT | chr17 | 42913530 | 42913549 | 42913533 | - |
| SEQ ID NO 58107 | AGCTAGAAATTTAGTTGGGC | CAGAAT | chr17 | 42913387 | 42913406 | 42913390 | - |
| SEQ ID NO 58108 | CTTTTCAAAGATGTTATGAG | CAGGAT | chr17 | 42913260 | 42913279 | 42913263 | - |
| SEQ ID NO 58109 | TTATGAGCAGGATGGTTGTT | TTGAAT | chr17 | 42913247 | 42913266 | 42913250 | - |
| SEQ ID NO 58110 | ATAGGCTTCAGCTTTTTTTG | GGGGGT | chr17 | 42913167 | 42913186 | 42913170 | - |

Figure 86 (Cont'd)

| SEQ ID NO 58111 | CAGCTTTTTTTGGGGGGTAG | GTGGGT | chr17 | 42913159 | 42913178 | 42913162 | - |
| SEQ ID NO 58112 | ACCTTGGGAGGCCAAGGCAG | GTGGAT | chr17 | 42913048 | 42913067 | 42913051 | - |
| SEQ ID NO 58113 | CAGGTGGATCACTTGAGGTC | AGGAGT | chr17 | 42913031 | 42913050 | 42913034 | - |
| SEQ ID NO 58114 | TACTGAGGAGGCTGAGACAT | GAGAAT | chr17 | 42912905 | 42912924 | 42912908 | - |
| SEQ ID NO 58115 | TCGTGCCACTCCACTCCAGC | CTGGGT | chr17 | 42912841 | 42912860 | 42912844 | - |
| SEQ ID NO 58116 | AAAAAGAAAAGCAGGCAAGG | AGGAGT | chr17 | 42912786 | 42912805 | 42912789 | - |
| SEQ ID NO 58117 | AGCTACGCGGGACGCTGTGG | TAGGGT | chr17 | 42912723 | 42912742 | 42912726 | - |
| SEQ ID NO 58118 | TGGGAGGACTGCTTGAGCCC | AGGAAT | chr17 | 42912698 | 42912717 | 42912701 | - |
| SEQ ID NO 58119 | AAGATGTTGACTTTTCCTTT | AAGAAT | chr17 | 42912614 | 42912633 | 42912617 | - |
| SEQ ID NO 58120 | GAATGTGCTCTTGGTTGGCT | TGGGAT | chr17 | 42912592 | 42912611 | 42912595 | - |
| SEQ ID NO 58121 | GGTTGGCTTGGGATAGAGAA | AGGAGT | chr17 | 42912580 | 42912599 | 42912583 | - |
| SEQ ID NO 58122 | AGGAGTCATATTTACCCTCT | AGGAAT | chr17 | 42912560 | 42912579 | 42912563 | - |
| SEQ ID NO 58123 | CTAGGAATTAAAAGTAACAC | TGGAGT | chr17 | 42912542 | 42912561 | 42912545 | - |
| SEQ ID NO 58124 | ACACTGGAGTGACCTGAGAG | AGGAAT | chr17 | 42912526 | 42912545 | 42912529 | - |
| SEQ ID NO 58125 | GAAACATACAAAAGCACCAC | CAGAGT | chr17 | 42912454 | 42912473 | 42912457 | - |
| SEQ ID NO 58126 | CTAGCCTTCTGAAGATCCAG | TGGGGT | chr17 | 42912422 | 42912441 | 42912425 | - |
| SEQ ID NO 58127 | CCTTCTGAAGATCCAGTGGG | GTGGAT | chr17 | 42912418 | 42912437 | 42912421 | - |
| SEQ ID NO 58128 | GGTGGATGTGGAGCCAGTGG | AAGAAT | chr17 | 42912399 | 42912418 | 42912402 | - |
| SEQ ID NO 58129 | AGCAGAGCTGGGCTTATAAG | GAGGAT | chr17 | 42912365 | 42912384 | 42912368 | - |
| SEQ ID NO 58130 | AGAGGAGATGTCAGCTATAC | CTGAAT | chr17 | 42912326 | 42912345 | 42912329 | - |
| SEQ ID NO 58131 | GTTTTGACCTAGTGCAATAT | CTGGGT | chr17 | 42912300 | 42912319 | 42912303 | - |
| SEQ ID NO 58132 | AGTAAAAAAATACTAGAAG | CAGAAT | chr17 | 42912225 | 42912244 | 42912228 | - |
| SEQ ID NO 58133 | TAAGCTGGTCCCCCATTACT | GAGAGT | chr17 | 42912170 | 42912189 | 42912173 | - |
| SEQ ID NO 58134 | TCCTTTCTCCTTTTCTCGGT | AAGAAT | chr17 | 42912030 | 42912049 | 42912033 | - |
| SEQ ID NO 58135 | ACAGGTAGAAAATTCTCAGT | TAGGAT | chr17 | 42912000 | 42912019 | 42912003 | - |
| SEQ ID NO 58136 | TGCTTTTGTATATGTGACGG | AAGAAT | chr17 | 42911934 | 42911953 | 42911937 | - |
| SEQ ID NO 58137 | AAAACATTACCCAATATGAT | TAGGAT | chr17 | 42911829 | 42911848 | 42911832 | - |
| SEQ ID NO 58138 | ATAAAATGGGCTGTTCCAGT | GGGAGT | chr17 | 42911733 | 42911752 | 42911736 | - |
| SEQ ID NO 58139 | GGAGTGAGCTCCCTACTTGT | GAGAGT | chr17 | 42911712 | 42911731 | 42911715 | - |
| SEQ ID NO 58140 | GATATGGCACCTCCATCTGA | AAGAGT | chr17 | 42911632 | 42911651 | 42911635 | - |
| SEQ ID NO 58141 | AGTCTGTGCTGAGGGCAGGC | TGGAGT | chr17 | 42911609 | 42911628 | 42911612 | - |
| SEQ ID NO 58142 | GGCAGGCTGGAGTCACACAT | GGGAAT | chr17 | 42911596 | 42911615 | 42911599 | - |
| SEQ ID NO 58143 | GTGATTTAATTCCACGACGG | CAGAAT | chr17 | 42911541 | 42911560 | 42911544 | - |
| SEQ ID NO 58144 | TTTAATTCCACGACGGCAGA | ATGGAT | chr17 | 42911537 | 42911556 | 42911540 | - |
| SEQ ID NO 58145 | AGGACCTGGGCGAGGCAGTA | GGGGAT | chr17 | 42911379 | 42911398 | 42911382 | - |
| SEQ ID NO 58146 | GGCAGTAGGGGATGACACTG | ACGGAT | chr17 | 42911366 | 42911385 | 42911369 | - |
| SEQ ID NO 58147 | CGTAGAAGACCAGCTCGACT | TGGAT | chr17 | 42911303 | 42911322 | 42911306 | - |
| SEQ ID NO 58148 | AGACCAGCTCGACTTGGGAT | GGGGGT | chr17 | 42911297 | 42911316 | 42911300 | - |
| SEQ ID NO 58149 | GACTTGGGATGGGGGTTTCA | AGGAGT | chr17 | 42911287 | 42911306 | 42911290 | - |
| SEQ ID NO 58150 | AGGCTACAATAGAGCTGAGG | CGGAAT | chr17 | 42911237 | 42911256 | 42911240 | - |
| SEQ ID NO 58151 | GGCGGAATGGGAGCCACTTG | CTGAGT | chr17 | 42911219 | 42911238 | 42911222 | - |
| SEQ ID NO 58152 | GCAGCTCTCCCTGTACATGC | TGGAGT | chr17 | 42911185 | 42911204 | 42911188 | - |
| SEQ ID NO 58153 | GGTTCTTGAGGAGGCTGGCA | AAGGGT | chr17 | 42911126 | 42911145 | 42911129 | - |
| SEQ ID NO 58154 | CACCACCTCTGGGCTTTCTC | CAGAGT | chr17 | 42911067 | 42911086 | 42911070 | - |
| SEQ ID NO 58155 | AGGCTGGCATTATAGATGCT | GTGGAT | chr17 | 42910950 | 42910969 | 42910953 | - |
| SEQ ID NO 58156 | AGTTTCTGCAACAGCAATGC | CTGAGT | chr17 | 42910915 | 42910934 | 42910918 | - |
| SEQ ID NO 58157 | GCATGACTGTGAGAGATAGG | AAGGAT | chr17 | 42910881 | 42910900 | 42910884 | - |
| SEQ ID NO 58158 | ATTTGGGACCTTTGCTAGAG | GTGGGT | chr17 | 42910857 | 42910876 | 42910860 | - |
| SEQ ID NO 58159 | TTTGCTAGAGGTGGGTTTGG | AGGAGT | chr17 | 42910847 | 42910866 | 42910850 | - |
| SEQ ID NO 58160 | CTAGAGGTGGGTTTGGAGGA | GTGGGT | chr17 | 42910843 | 42910862 | 42910846 | - |
| SEQ ID NO 58161 | TGCCATCCGTTCTGCGACTG | TGGAAT | chr17 | 42910813 | 42910832 | 42910816 | - |

Figure 86 (Cont'd)

| | | | | | | | |
|---|---|---|---|---|---|---|---|
| SEQ ID NO 58162 | AAATCACAGATGGCAGATGG | GAGGGT | chr17 | 42910786 | 42910805 | 42910789 | - |
| SEQ ID NO 58163 | CAGTCCATTTTATCTTTGAA | CGGAAT | chr17 | 42910591 | 42910610 | 42910594 | - |
| SEQ ID NO 58164 | TCTTTGAACGGAATTGATTG | CTGAAT | chr17 | 42910579 | 42910598 | 42910582 | - |
| SEQ ID NO 58165 | TTTTTCTCAGTTCTTTCTGC | AGGAGT | chr17 | 42910506 | 42910525 | 42910509 | - |
| SEQ ID NO 58166 | TCTGCAGGAGTTAGTAAGTG | ATGAAT | chr17 | 42910491 | 42910510 | 42910494 | - |
| SEQ ID NO 58167 | CTTGTTCTCAACATTCTTCT | TTGAAT | chr17 | 42910309 | 42910328 | 42910312 | - |
| SEQ ID NO 58168 | TCTTGTCTTACCCTTGTTAA | TTGGAT | chr17 | 42910176 | 42910195 | 42910179 | - |
| SEQ ID NO 58169 | TAAGAAAACACATATTCAGG | CAGGGT | chr17 | 42910149 | 42910168 | 42910152 | - |
| SEQ ID NO 58170 | GCTTTGGGAGGCCGAGGCGG | GCGGAT | chr17 | 42910096 | 42910115 | 42910099 | - |
| SEQ ID NO 58171 | ACTCGGAGAGGCTGAGGCAG | GAGAAT | chr17 | 42909973 | 42909992 | 42909976 | - |
| SEQ ID NO 58172 | TCGCACCACTGCACTCTAGC | CTGGGT | chr17 | 42909908 | 42909927 | 42909911 | - |
| SEQ ID NO 58173 | GTTATCTATTAGGTTTGCAA | ATGAAT | chr17 | 42909799 | 42909818 | 42909802 | - |
| SEQ ID NO 58174 | CTAACAGTACTGATTACACA | CAGGAT | chr17 | 42909514 | 42909533 | 42909517 | - |
| SEQ ID NO 58175 | GATTACACACAGGATGTGGC | TGGAAT | chr17 | 42909503 | 42909522 | 42909506 | - |
| SEQ ID NO 58176 | ACAGGATGTGGCTGGAATGC | TGGGAT | chr17 | 42909495 | 42909514 | 42909498 | - |
| SEQ ID NO 58177 | GTCCTGATTAGGGAGAGAAA | CGGAAT | chr17 | 42909466 | 42909485 | 42909469 | - |
| SEQ ID NO 58178 | GATTAGGGAGAGAAACGGAA | TGGGGT | chr17 | 42909461 | 42909480 | 42909464 | - |
| SEQ ID NO 58179 | GGGGTTTGGGGGAGAAGGAA | GGGAGT | chr17 | 42909440 | 42909459 | 42909443 | - |
| SEQ ID NO 58180 | AGACATTCAGCTGCACAGCC | CAGAAT | chr17 | 42909336 | 42909355 | 42909339 | - |
| SEQ ID NO 58181 | GCAAACTTAGGTGCTCTCAG | TGGAAT | chr17 | 42909198 | 42909217 | 42909201 | - |
| SEQ ID NO 58182 | CCAAAGATGCCTGTTGGGGG | CTGGGT | chr17 | 42909142 | 42909161 | 42909145 | - |
| SEQ ID NO 58183 | ACTTTGGGAGGCCGAGGTGA | GAGGAT | chr17 | 42909089 | 42909108 | 42909092 | - |
| SEQ ID NO 58184 | TGAGAGGATCACTTGAGGCC | AGGAGT | chr17 | 42909072 | 42909091 | 42909075 | - |
| SEQ ID NO 58185 | CAGCACTTTGGGAGGCCGAG | GTGGGT | chr17 | 42908957 | 42908976 | 42908960 | - |
| SEQ ID NO 58186 | ACTTTGGGAGGCCGAGGTGG | GTGGAT | chr17 | 42908953 | 42908972 | 42908956 | - |
| SEQ ID NO 58187 | TGGGTGGATCACTTGAGGTC | AGGAGT | chr17 | 42908936 | 42908955 | 42908939 | - |
| SEQ ID NO 58188 | AAATTACAAAATTAGCCAGG | TGGGGT | chr17 | 42908862 | 42908881 | 42908865 | - |
| SEQ ID NO 58189 | TATTTGAGAGGCTGAGGCAG | GAGAAT | chr17 | 42908814 | 42908833 | 42908817 | - |
| SEQ ID NO 58190 | CAGCACTTTGGGAGGCTGAG | GCGGAT | chr17 | 42908654 | 42908673 | 42908657 | - |
| SEQ ID NO 58191 | ACTTTGGGAGGCTGAGGCGG | ATGGAT | chr17 | 42908650 | 42908669 | 42908653 | - |
| SEQ ID NO 58192 | GGCGGATGGATCACTAGGTC | AGGAGT | chr17 | 42908635 | 42908654 | 42908638 | - |
| SEQ ID NO 58193 | TACTCGGTAGGCTGAGGCAG | AAGAAT | chr17 | 42908517 | 42908536 | 42908520 | - |
| SEQ ID NO 58194 | AGTGGTTAACCCTTGTGTAT | ATGAAT | chr17 | 42908378 | 42908397 | 42908381 | - |
| SEQ ID NO 58195 | ATTTTATCTGTTTGATAATT | AAGGAT | chr17 | 42908340 | 42908359 | 42908343 | - |
| SEQ ID NO 58196 | AAAAAGATACGAGAAATTAG | CTGGGT | chr17 | 42908192 | 42908211 | 42908195 | - |
| SEQ ID NO 58197 | TACTCAGATGGCTGAGGTGG | GAGGAT | chr17 | 42908141 | 42908160 | 42908144 | - |
| SEQ ID NO 58198 | TCGTGCCACTGCACTTCAGC | CTGGAT | chr17 | 42908076 | 42908095 | 42908079 | - |
| SEQ ID NO 58199 | ATCTCAAAAATAAAAATAAA | AAGGAT | chr17 | 42908034 | 42908053 | 42908037 | - |
| SEQ ID NO 58200 | TTGCACTGTGGCTGCACACC | CGGAAT | chr17 | 42908008 | 42908027 | 42908011 | - |
| SEQ ID NO 58201 | CACCCGGAATTCTCTGTAGT | AGGAAT | chr17 | 42907992 | 42908011 | 42907995 | - |
| SEQ ID NO 58202 | GTTTCTCTGGTTATTTTAAC | CTGGAT | chr17 | 42907959 | 42907978 | 42907962 | - |
| SEQ ID NO 58203 | CTCTGGTTATTTTAACCTGG | ATGGGT | chr17 | 42907955 | 42907974 | 42907958 | - |
| SEQ ID NO 58204 | ACTCTGTGGTTGGTACAGAC | ATGGGT | chr17 | 42907928 | 42907947 | 42907931 | - |
| SEQ ID NO 58205 | GTTTCCTTATCTGTAAAACA | ACGGAT | chr17 | 42907835 | 42907854 | 42907838 | - |
| SEQ ID NO 58206 | TAAAACAACGGATTGCACTA | CTGGAT | chr17 | 42907822 | 42907841 | 42907825 | - |
| SEQ ID NO 58207 | CAGGTGTGGGAGCGGGCTAG | GGGGAT | chr17 | 42907719 | 42907738 | 42907722 | - |
| SEQ ID NO 58208 | CGGGCTAGGGGGATGTGAGG | AAGAAT | chr17 | 42907707 | 42907726 | 42907710 | - |
| SEQ ID NO 58209 | CCACCACCTACACCCCAGTG | GTGAGT | chr17 | 42907641 | 42907660 | 42907644 | - |
| SEQ ID NO 58210 | ATCTTTCCCTGAAAGATGGA | AAGAGT | chr17 | 42907588 | 42907607 | 42907591 | - |
| SEQ ID NO 58211 | GCTCCCTAAAGGGCAGGAAA | GAGAAT | chr17 | 42907508 | 42907527 | 42907511 | - |
| SEQ ID NO 58212 | CTAAAGGGCAGGAAAGAGAA | TGGAGT | chr17 | 42907503 | 42907522 | 42907506 | - |

Figure 86 (Cont'd)

| SEQ ID NO 58213 | CAAGCATTGTGCAAGGCTCT | GGGAAT | chr17 | 42907280 | 42907299 | 42907283 | - |
| SEQ ID NO 58214 | TACAGTCTGGAGATTACACA | AAGAAT | chr17 | 42907208 | 42907227 | 42907211 | - |
| SEQ ID NO 58215 | ACTCAGATCTCATATTCTCA | GTGAGT | chr17 | 42906961 | 42906980 | 42906964 | - |
| SEQ ID NO 58216 | AATCCTCCCACCTCAGCCCC | CTGAGT | chr17 | 42906775 | 42906794 | 42906778 | - |
| SEQ ID NO 58217 | CCCTTGGCCTCCCAAAGTGT | TGGGAT | chr17 | 42906629 | 42906648 | 42906632 | - |
| SEQ ID NO 58218 | TTCCTCTACCCTGAGAGATA | GAGGGT | chr17 | 42906555 | 42906574 | 42906558 | - |
| SEQ ID NO 58219 | GGACTTATTTCGTAGCTGTT | GAGAGT | chr17 | 42906491 | 42906510 | 42906494 | - |
| SEQ ID NO 58220 | TGGCATTGCCCTGGGCTAAA | GAGAGT | chr17 | 42906429 | 42906448 | 42906432 | - |
| SEQ ID NO 58221 | GATCAAGGTTACGCTCTCCC | CAGGGT | chr17 | 42906397 | 42906416 | 42906400 | - |
| SEQ ID NO 58222 | CCCAGCTTCAGAGCTCGCTG | TGGGGT | chr17 | 42906328 | 42906347 | 42906331 | - |
| SEQ ID NO 58223 | CTTCAGAGCTCGCTGTGGGG | TTGGAT | chr17 | 42906323 | 42906342 | 42906326 | - |
| SEQ ID NO 58224 | CGCTGTGGGGTTGGATGAGG | CAGAAT | chr17 | 42906313 | 42906332 | 42906316 | - |
| SEQ ID NO 58225 | CTTCTACAAGTATAGTTCCC | CAGAGT | chr17 | 42906246 | 42906265 | 42906249 | - |
| SEQ ID NO 58226 | GAGTATCTAAACTCCTGCAC | GTGAAT | chr17 | 42906224 | 42906243 | 42906227 | - |
| SEQ ID NO 58227 | AACACTAACAATTATATACC | TTGGGT | chr17 | 42906080 | 42906099 | 42906083 | - |
| SEQ ID NO 58228 | CTTTTTTTTTTTTTTCCTGA | CAGAAT | chr17 | 42906042 | 42906061 | 42906045 | - |
| SEQ ID NO 58229 | TCTTTCTCTGTCACCAAGGC | TGGAGT | chr17 | 42906017 | 42906036 | 42906020 | - |
| SEQ ID NO 58230 | CTCACTGCAACCTCTGCCTC | CCGGGT | chr17 | 42905973 | 42905992 | 42905976 | - |
| SEQ ID NO 58231 | GATTCTCCTGCCGCAGCCTC | CTGGGT | chr17 | 42905941 | 42905960 | 42905944 | - |
| SEQ ID NO 58232 | GCCGCAGCCTCCTGGGTAGC | TGGGAT | chr17 | 42905932 | 42905951 | 42905935 | - |
| SEQ ID NO 58233 | GCGTTGGCCTCCCAAAGTGC | TAGGAT | chr17 | 42905794 | 42905813 | 42905797 | - |
| SEQ ID NO 58234 | TCTCATTTTGTCGCCCAGGC | TGGAGT | chr17 | 42905387 | 42905406 | 42905390 | - |
| SEQ ID NO 58235 | GATTCTCCTGCCTTAGCCTC | CTGAGT | chr17 | 42905320 | 42905339 | 42905323 | - |
| SEQ ID NO 58236 | TTTTGTATTTTTAGTAGAGA | CAGGGT | chr17 | 42905255 | 42905274 | 42905258 | - |
| SEQ ID NO 58237 | GCCTCAGCCTCCCAAAGTGC | TGGGAT | chr17 | 42905176 | 42905195 | 42905179 | - |
| SEQ ID NO 58238 | CTCCCAAAGTGCTGGGATTA | CAGGGT | chr17 | 42905168 | 42905187 | 42905171 | - |
| SEQ ID NO 58239 | AGTTTACTTTTTTTTTGAGA | CAGAGT | chr17 | 42905108 | 42905127 | 42905111 | - |
| SEQ ID NO 58240 | TCTCGTTCTGTCATTCAGGC | TGGAGT | chr17 | 42905083 | 42905102 | 42905086 | - |
| SEQ ID NO 58241 | TTTTCATTTTTAGTAAAGA | CAGGAT | chr17 | 42904942 | 42904961 | 42904945 | - |
| SEQ ID NO 58242 | ACCTTGGCTTCCCAAAGTGC | TGGGAT | chr17 | 42904863 | 42904882 | 42904866 | - |
| SEQ ID NO 58243 | GATTTCAGCTCCACAAGGGC | AGGGAT | chr17 | 42904761 | 42904780 | 42904764 | - |
| SEQ ID NO 58244 | AGGTGCTTGGTAAGTAACAG | CTGAAT | chr17 | 42904669 | 42904688 | 42904672 | - |
| SEQ ID NO 58245 | GCTTGGTAAGTAACAGCTGA | ATGAGT | chr17 | 42904665 | 42904684 | 42904668 | - |
| SEQ ID NO 58246 | GGTAAGTAACAGCTGAATGA | GTGAAT | chr17 | 42904661 | 42904680 | 42904664 | - |
| SEQ ID NO 58247 | TAAGGGACCTTCCCTAGTTT | TGGGGT | chr17 | 42904595 | 42904614 | 42904598 | - |
| SEQ ID NO 58248 | CCTAGTTTTGGGGTCAGGGA | AAGGGT | chr17 | 42904583 | 42904602 | 42904586 | - |
| SEQ ID NO 58249 | AGGGAAAGGGTCTCTGAGGA | AGGGAT | chr17 | 42904568 | 42904587 | 42904571 | - |
| SEQ ID NO 58250 | GAAGGGATACTAGTACCTTA | GAGAGT | chr17 | 42904550 | 42904569 | 42904553 | - |
| SEQ ID NO 58251 | TTAGAGGGCAGCTGAGACTT | TAGGGT | chr17 | 42904517 | 42904536 | 42904520 | - |
| SEQ ID NO 58252 | ACGTAGGCACAGAGAGGGCA | AGGGAT | chr17 | 42904410 | 42904429 | 42904413 | - |
| SEQ ID NO 58253 | CTCTCACGAGCCCTTTGCCC | ATGGAT | chr17 | 42904271 | 42904290 | 42904274 | - |
| SEQ ID NO 58254 | TTCAGGAAAGTATTGCAGAA | GTGAAT | chr17 | 42904181 | 42904200 | 42904184 | - |
| SEQ ID NO 58255 | AGAGCATGACAAAAGTACAA | AGGAAT | chr17 | 42904138 | 42904157 | 42904141 | - |
| SEQ ID NO 58256 | CAGTATGGACGCTGTCCAAA | GAGAAT | chr17 | 42903938 | 42903957 | 42903941 | - |
| SEQ ID NO 58257 | GGAAAAACAGAACAAGTTTC | TGGGGT | chr17 | 42903907 | 42903926 | 42903910 | - |
| SEQ ID NO 58258 | AGAACAAGTTTCTGGGGTTA | CTGAAT | chr17 | 42903899 | 42903918 | 42903902 | - |
| SEQ ID NO 58259 | CAAGTTTCTGGGGTTACTGA | ATGAAT | chr17 | 42903895 | 42903914 | 42903898 | - |
| SEQ ID NO 58260 | CCAAAGCCTACACCTTCAAG | AAGAGT | chr17 | 42903861 | 42903880 | 42903864 | - |
| SEQ ID NO 58261 | CAAGAAGAGTGTAGCCTGAG | AAGGAT | chr17 | 42903845 | 42903864 | 42903848 | - |
| SEQ ID NO 58262 | GTTGCCTCTAGAAGGGAGAA | CTGGGT | chr17 | 42903812 | 42903831 | 42903815 | - |
| SEQ ID NO 58263 | ACTTTTGCATTTTGAACTGT | TTGAAT | chr17 | 42903732 | 42903751 | 42903735 | - |

Figure 86 (Cont'd)

| SEQ ID NO 58264 | TATCTTTTTTTTTTTGAGA | CAGGAT | chr17 | 42903702 | 42903721 | 42903705 | - |
| SEQ ID NO 58265 | TCTGGCTCAGTAACCCAGCC | TGGAGT | chr17 | 42903677 | 42903696 | 42903680 | - |
| SEQ ID NO 58266 | TCATTGTGACCTCTACCTCC | TGGGAT | chr17 | 42903632 | 42903651 | 42903635 | - |
| SEQ ID NO 58267 | GATCCTCCCACCTCAGCCTC | CTGAAT | chr17 | 42903609 | 42903628 | 42903612 | - |
| SEQ ID NO 58268 | TTTTGTATTTTTAGTAGAGA | CGGGGT | chr17 | 42903544 | 42903563 | 42903547 | - |
| SEQ ID NO 58269 | ACCTCAGCCTCCCAAAGTGC | TGGGAT | chr17 | 42903465 | 42903484 | 42903468 | - |
| SEQ ID NO 58270 | CAGGCAGATCACATGAGGTC | AGGAGT | chr17 | 42903312 | 42903331 | 42903315 | - |
| SEQ ID NO 58271 | CGTTTCTACCAAAAAATATA | AAGAAT | chr17 | 42903254 | 42903273 | 42903257 | - |
| SEQ ID NO 58272 | TACTCGGGAGGCTAAGGCAA | GAGAAT | chr17 | 42903192 | 42903211 | 42903195 | - |
| SEQ ID NO 58273 | TTATGCCACTGCACTACAGG | CTGGGT | chr17 | 42903127 | 42903146 | 42903130 | - |
| SEQ ID NO 58274 | TCAAGAAGTATTTGTCCTGG | AAGAAT | chr17 | 42903014 | 42903033 | 42903017 | - |
| SEQ ID NO 58275 | AACTTGGACTTGCATATACC | ATGGGT | chr17 | 42902967 | 42902986 | 42902970 | - |
| SEQ ID NO 58276 | ATGGGTTCCCTCAGGCCTCA | GGGAAT | chr17 | 42902947 | 42902966 | 42902950 | - |
| SEQ ID NO 58277 | TTGCATTTCCTCTGACATCA | GAGAAT | chr17 | 42902920 | 42902939 | 42902923 | - |
| SEQ ID NO 58278 | AACATGGCCTGCATTTCCAT | CAGAAT | chr17 | 42902859 | 42902878 | 42902862 | - |
| SEQ ID NO 58279 | CCATCAGAATTGCTCTCTGT | AAGGAT | chr17 | 42902843 | 42902862 | 42902846 | - |
| SEQ ID NO 58280 | GTATCCTCTCTACTTTGAAA | CAGAGT | chr17 | 42902792 | 42902811 | 42902795 | - |
| SEQ ID NO 58281 | AATAGGTGTCAACCGCCAGT | CAGGAT | chr17 | 42902711 | 42902730 | 42902714 | - |
| SEQ ID NO 58282 | TGCCTTTTATCCCGTGATGG | TGGAAT | chr17 | 42902686 | 42902705 | 42902689 | - |
| SEQ ID NO 58283 | TTCAATGGAGATCAGATGTT | TGGAAT | chr17 | 42902588 | 42902607 | 42902591 | - |
| SEQ ID NO 58284 | CACTTCATCTTTTTATTTTT | TAGAAT | chr17 | 42902560 | 42902579 | 42902563 | - |
| SEQ ID NO 58285 | TATTTTTTAGAATCATGCGG | CTGGGT | chr17 | 42902547 | 42902566 | 42902550 | - |
| SEQ ID NO 58286 | GGCAGGCAGATCATGAGGTC | AGGAGT | chr17 | 42902479 | 42902498 | 42902482 | - |
| SEQ ID NO 58287 | TACTTGGGAGGCTGAGGCAG | GAGAAT | chr17 | 42902358 | 42902377 | 42902361 | - |
| SEQ ID NO 58288 | AAAGAAAGAAAGAAAGTGGC | CAGAAT | chr17 | 42902230 | 42902249 | 42902233 | - |
| SEQ ID NO 58289 | AGAAAGAAAGTGGCCAGAAT | GGGAAT | chr17 | 42902224 | 42902243 | 42902227 | - |
| SEQ ID NO 58290 | GGGCTTTCCCCTGCTCCCA | GAGAGT | chr17 | 42902163 | 42902182 | 42902166 | - |
| SEQ ID NO 58291 | TTGCCAAGGACATGTAGTTG | GTGGGT | chr17 | 42901837 | 42901856 | 42901840 | - |
| SEQ ID NO 58292 | GAGGGCTGGAGCCCAGTTCC | CAGGGT | chr17 | 42901803 | 42901822 | 42901806 | - |
| SEQ ID NO 58293 | TTACCCCACAAAACAGGCTG | TTGAAT | chr17 | 42901768 | 42901787 | 42901771 | - |
| SEQ ID NO 58294 | TCTTTTTTTTTTTTTGAGA | CAGGGT | chr17 | 42901701 | 42901720 | 42901704 | - |
| SEQ ID NO 58295 | TCTTACTCTGTTGCCCAGGC | TGGAGT | chr17 | 42901676 | 42901695 | 42901679 | - |
| SEQ ID NO 58296 | CCGCCTCTCACCTCAGCCTC | CTGAGT | chr17 | 42901616 | 42901635 | 42901619 | - |
| SEQ ID NO 58297 | TCGTAATGTTTTTGTAGAGA | TGGAGT | chr17 | 42901554 | 42901573 | 42901557 | - |
| SEQ ID NO 58298 | CCCAGGCTGGTCTTGAACTC | CTGAGT | chr17 | 42901516 | 42901535 | 42901519 | - |
| SEQ ID NO 58299 | TTGAACTCCTGAGTTCACCC | AGGAGT | chr17 | 42901504 | 42901523 | 42901507 | - |
| SEQ ID NO 58300 | ACCTCGGCCTCCCAAAGTGC | TGGGAT | chr17 | 42901469 | 42901488 | 42901472 | - |
| SEQ ID NO 58301 | CTGTATTTTCAACTCACTGG | TAGGAT | chr17 | 42901287 | 42901306 | 42901290 | - |
| SEQ ID NO 58302 | GATGATCCAAAGTCAGAGAG | AGGGGT | chr17 | 42901236 | 42901255 | 42901239 | - |
| SEQ ID NO 58303 | CAGAGAGAGGGGTTGGAAGC | ATGAGT | chr17 | 42901223 | 42901242 | 42901226 | - |
| SEQ ID NO 58304 | CATGAGTAGCCCGTGGCTTC | CTGAAT | chr17 | 42901204 | 42901223 | 42901207 | - |
| SEQ ID NO 58305 | GATGGACAGACATTGCGAGA | GCGAAT | chr17 | 42901157 | 42901176 | 42901160 | - |
| SEQ ID NO 58306 | CTCCAATCACAGCTACCCAA | AGGAGT | chr17 | 42901062 | 42901081 | 42901065 | - |
| SEQ ID NO 58307 | CACCAAGATGAACCAGTCCT | GGGAGT | chr17 | 42900956 | 42900975 | 42900959 | - |
| SEQ ID NO 58308 | ACCTGGAGGTAATGTGTTGA | CTGGAT | chr17 | 42900919 | 42900938 | 42900922 | - |
| SEQ ID NO 58309 | TTGGTGGTGATTGCTCTGCT | ATGAGT | chr17 | 42900799 | 42900818 | 42900802 | - |
| SEQ ID NO 58310 | TAGGTTGATGCAAACATGTT | CAGGGT | chr17 | 42900655 | 42900674 | 42900658 | - |
| SEQ ID NO 58311 | GGCATGCTTCTTGGCAGTGC | AAGGGT | chr17 | 42900550 | 42900569 | 42900553 | - |
| SEQ ID NO 58312 | ACCAGGCCAGAGACACAGGA | CAGAGT | chr17 | 42900504 | 42900523 | 42900507 | - |
| SEQ ID NO 58313 | AATTTGGAGGCTGAGGTGG | GAGGAT | chr17 | 42900308 | 42900327 | 42900311 | - |
| SEQ ID NO 58314 | TGGGAGGATCCCTTGAAGCC | AGGAGT | chr17 | 42900291 | 42900310 | 42900294 | - |

Figure 86 (Cont'd)

| | | | | | | | |
|---|---|---|---|---|---|---|---|
| SEQ ID NO 58315 | TATTCAGGAGGCTGAGGCAG | GAGGAT | chr17 | 42900166 | 42900185 | 42900169 | - |
| SEQ ID NO 58316 | CAGGAGGATTGCTTGAGCCC | AGGAGT | chr17 | 42900149 | 42900168 | 42900152 | - |
| SEQ ID NO 58317 | GATTGCTTGAGCCCAGGAGT | TGGAGT | chr17 | 42900143 | 42900162 | 42900146 | - |
| SEQ ID NO 58318 | TGGTCTTTCCTTAACTGTAT | TAGAGT | chr17 | 42899962 | 42899981 | 42899965 | - |
| SEQ ID NO 58319 | TCCTTAACTGTATTAGAGTC | TAGGGT | chr17 | 42899955 | 42899974 | 42899958 | - |
| SEQ ID NO 58320 | GGGCCAGAAAGTAATCGTTT | TTGAAT | chr17 | 42899874 | 42899893 | 42899877 | - |
| SEQ ID NO 58321 | TCTCTCTCTTTTTTTTGAAA | CAGGGT | chr17 | 42899782 | 42899801 | 42899785 | - |
| SEQ ID NO 58322 | TCTCACTCTGTCTCCCAGGC | TGGAGT | chr17 | 42899757 | 42899776 | 42899760 | - |
| SEQ ID NO 58323 | GATCCTCCCACCTCAGCCTC | CTGAGT | chr17 | 42899681 | 42899700 | 42899684 | - |
| SEQ ID NO 58324 | TTTTCTATCTTTTGTAGAGA | TGGGGT | chr17 | 42899616 | 42899635 | 42899619 | - |
| SEQ ID NO 58325 | CCATGTTGCCCAGGCTGGTC | TTGAAT | chr17 | 42899586 | 42899605 | 42899589 | - |
| SEQ ID NO 58326 | GTCTTGGCTTCCCAAAGCTC | TGGGAT | chr17 | 42899537 | 42899556 | 42899540 | - |
| SEQ ID NO 58327 | TCATACGTTTAAGCAAAATA | ATGAAT | chr17 | 42899472 | 42899491 | 42899475 | - |
| SEQ ID NO 58328 | TCTTACTGTGCAACAATATG | ATGAAT | chr17 | 42899440 | 42899459 | 42899443 | - |
| SEQ ID NO 58329 | ATGAATGTATGGTTCCAAAT | AAGAAT | chr17 | 42899420 | 42899439 | 42899423 | - |
| SEQ ID NO 58330 | AAATGGTAACTGGAGACTTA | AAGAGT | chr17 | 42899387 | 42899406 | 42899390 | - |
| SEQ ID NO 58331 | AGAGACCAAAACCCTAACAC | TTGGGT | chr17 | 42899203 | 42899222 | 42899206 | - |
| SEQ ID NO 58332 | GAGGACTGTGAAAGGAACCA | GGGAAT | chr17 | 42899173 | 42899192 | 42899176 | - |
| SEQ ID NO 58333 | ACTGTGAAAGGAACCAGGGA | ATGAAT | chr17 | 42899169 | 42899188 | 42899172 | - |
| SEQ ID NO 58334 | TTTATTTATTTTGTAGAAA | CGGGGT | chr17 | 42899069 | 42899088 | 42899072 | - |
| SEQ ID NO 58335 | GCCTCAACCTAGCAAAGCAT | TGGGAT | chr17 | 42898990 | 42899009 | 42898993 | - |
| SEQ ID NO 58336 | TCCAAATTCATGCATTTTTT | GAGGAT | chr17 | 42898944 | 42898963 | 42898947 | - |
| SEQ ID NO 58337 | TTTTGAGGATAAGAGCCAGG | GGGAAT | chr17 | 42898928 | 42898947 | 42898931 | - |
| SEQ ID NO 58338 | TAAAATGTTTAAAAACTTGC | CTGAAT | chr17 | 42898903 | 42898922 | 42898906 | - |
| SEQ ID NO 58339 | TAAGTCCATATTGACATGTA | AGGGGT | chr17 | 42898867 | 42898886 | 42898870 | - |
| SEQ ID NO 58340 | AAAAAAGAAACTCAGAGCTA | ATGAAT | chr17 | 42898829 | 42898848 | 42898832 | - |
| SEQ ID NO 58341 | ATCCTCCAGGAGGTATGACC | TGGAGT | chr17 | 42898758 | 42898777 | 42898761 | - |
| SEQ ID NO 58342 | CAGGTAATGTGTTGGTGACT | GTGGGT | chr17 | 42898616 | 42898635 | 42898619 | - |
| SEQ ID NO 58343 | TAATGTGTTGGTGACTGTGG | GTGGGT | chr17 | 42898612 | 42898631 | 42898615 | - |
| SEQ ID NO 58344 | TGGCAGGCAGTGCTGGGGCG | TGGGGT | chr17 | 42898568 | 42898587 | 42898571 | - |
| SEQ ID NO 58345 | ACCCAGATAAGCCTCTGTTG | TGGAGT | chr17 | 42898488 | 42898507 | 42898491 | - |
| SEQ ID NO 58346 | GTAACTATTGCAGTGACCTC | TGGGAT | chr17 | 42898464 | 42898483 | 42898467 | - |
| SEQ ID NO 58347 | ATTGCAGTGACCTCTGGGAT | GAGAGT | chr17 | 42898458 | 42898477 | 42898461 | - |
| SEQ ID NO 58348 | GAGAGTTTCTATGGTCAGAG | GTGAGT | chr17 | 42898438 | 42898457 | 42898441 | - |
| SEQ ID NO 58349 | ATGGTCAGAGGTGAGTCAAG | GTGAGT | chr17 | 42898428 | 42898447 | 42898431 | - |
| SEQ ID NO 58350 | ACATATACAAAGGCCACTGT | CTGGGT | chr17 | 42898396 | 42898415 | 42898399 | - |
| SEQ ID NO 58351 | ATGCCAGGGCAGCTAGCAGC | CAGGGT | chr17 | 42898369 | 42898388 | 42898372 | - |
| SEQ ID NO 58352 | GCAGCTAGCAGCCAGGGTCT | CTGAGT | chr17 | 42898361 | 42898380 | 42898364 | - |
| SEQ ID NO 58353 | GCCAGGGTCTCTGAGTTGGG | AGGGGT | chr17 | 42898351 | 42898370 | 42898354 | - |
| SEQ ID NO 58354 | GTTTTCTGAGACGCCTCAGG | AAGAAT | chr17 | 42898292 | 42898311 | 42898295 | - |
| SEQ ID NO 58355 | GCCTCAGGAAGAATACCCCT | ATGGAT | chr17 | 42898280 | 42898299 | 42898283 | - |
| SEQ ID NO 58356 | GAAGAATACCCCTATGGATA | AGGAGT | chr17 | 42898273 | 42898292 | 42898276 | - |
| SEQ ID NO 58357 | GATAAGGAGTTGATAAGTGA | TGGAGT | chr17 | 42898257 | 42898276 | 42898260 | - |
| SEQ ID NO 58358 | TCTGGGCATCCAGGGACAGT | GGGAGT | chr17 | 42898220 | 42898239 | 42898223 | - |
| SEQ ID NO 58359 | CCACCAGGCAGGGGGACCCT | CTGGAT | chr17 | 42898179 | 42898198 | 42898182 | - |
| SEQ ID NO 58360 | GCTGACTGCATCGAGACACC | GTGGAT | chr17 | 42898028 | 42898047 | 42898031 | - |
| SEQ ID NO 58361 | CGTGGATTCTCAAAGGTCTT | GTGGAT | chr17 | 42898009 | 42898028 | 42898012 | - |
| SEQ ID NO 58362 | AGGTCTTGTGGATATATGAG | GCGAGT | chr17 | 42897996 | 42898015 | 42897999 | - |
| SEQ ID NO 58363 | GAGTGGCTAGAAGTTTTGCT | GAGAAT | chr17 | 42897974 | 42897993 | 42897977 | - |
| SEQ ID NO 58364 | ATTTATCTGTTTATTTGAGA | CGGGGT | chr17 | 42897942 | 42897961 | 42897945 | - |
| SEQ ID NO 58365 | TCTCACTCTGTTACCCAGGC | TGGAGT | chr17 | 42897917 | 42897936 | 42897920 | - |

Figure 86 (Cont'd)

| | | | | | | | |
|---|---|---|---|---|---|---|---|
| SEQ ID NO 58366 | GCCTCAGTCTCCTGGGCTTA | AGGGAT | chr17 | 42897864 | 42897883 | 42897867 | - |
| SEQ ID NO 58367 | GGATCGTTTTGCATCAGTCT | CTGGGT | chr17 | 42897842 | 42897861 | 42897845 | - |

Figure 87

| # | Sequence | PAM | Chr | Start | End | Cuts 5' of | Str |
|---|---|---|---|---|---|---|---|
| SEQ ID NO 58368 | TCATATATCCACAAGACCTT | TGAGAAT | chr17 | 42897997 | 42898016 | 42898013 | + |
| SEQ ID NO 58369 | ATAAAAACGTGCTGGAGGAA | GCAGAAA | chr17 | 42898085 | 42898104 | 42898101 | + |
| SEQ ID NO 58370 | GGTATTCTTCCTGAGGCGTC | TCAGAAA | chr17 | 42898283 | 42898302 | 42898299 | + |
| SEQ ID NO 58371 | ACCTTGACTCACCTCTGACC | ATAGAAA | chr17 | 42898426 | 42898445 | 42898442 | + |
| SEQ ID NO 58372 | GGAGAAGTTTGCTTGGACCA | GCAGAAA | chr17 | 42898658 | 42898677 | 42898674 | + |
| SEQ ID NO 58373 | TATATCTACACACATATGTA | TAAGAAA | chr17 | 42899308 | 42899327 | 42899324 | + |
| SEQ ID NO 58374 | AAACCCCATCTCTACAAAAG | ATAGAAA | chr17 | 42899608 | 42899627 | 42899624 | + |
| SEQ ID NO 58375 | CCCTGTTTCAAAAAAAAGAG | AGAGAAA | chr17 | 42899777 | 42899796 | 42899793 | + |
| SEQ ID NO 58376 | AAAGAGAGAGAAAATTTAAA | AAAGAAA | chr17 | 42899791 | 42899810 | 42899807 | + |
| SEQ ID NO 58377 | ACAATTTTTTAAATTTTTGT | GTAGAAA | chr17 | 42900223 | 42900242 | 42900239 | + |
| SEQ ID NO 58378 | AAATAAGTGCAGTTGCAGGC | ATAGAAA | chr17 | 42900436 | 42900455 | 42900452 | + |
| SEQ ID NO 58379 | TAGAAAATCTGACATCTTTG | CAAGAAT | chr17 | 42900457 | 42900476 | 42900473 | + |
| SEQ ID NO 58380 | CCATATAGAGAGGAGATCAG | CAAGAAT | chr17 | 42901114 | 42901133 | 42901130 | + |
| SEQ ID NO 58381 | CATCTACATAAAGGGGGAAG | ACAGAAA | chr17 | 42901252 | 42901271 | 42901268 | + |
| SEQ ID NO 58382 | TGAAGCAGAAGAGGTAACAT | AAAGAAA | chr17 | 42901400 | 42901419 | 42901416 | + |
| SEQ ID NO 58383 | TGAGGTAGTTACTGCTATTT | ACAGAAA | chr17 | 42901983 | 42902002 | 42901999 | + |
| SEQ ID NO 58384 | GTGGCTCTCCCTGATTTCGG | TGAGAAA | chr17 | 42902648 | 42902667 | 42902664 | + |
| SEQ ID NO 58385 | CTAATTCTTTATATTTTTTG | GTAGAAA | chr17 | 42903245 | 42903264 | 42903261 | + |
| SEQ ID NO 58386 | CCACCGCGCCTGCCTGGAGT | TCAGAAT | chr17 | 42903369 | 42903388 | 42903385 | + |
| SEQ ID NO 58387 | AAAGCATTCATTCAGTAACC | CCAGAAA | chr17 | 42903884 | 42903903 | 42903900 | + |
| SEQ ID NO 58388 | CGCCCTGCAGCGCTGTGTCC | TGAGAAA | chr17 | 42904295 | 42904314 | 42904311 | + |
| SEQ ID NO 58389 | CTACCTGGGAGGCTGAGGCA | GGAGAAT | chr17 | 42904999 | 42905018 | 42905015 | + |
| SEQ ID NO 58390 | CTACTCAGGAGGCTAAGGCA | GGAGAAT | chr17 | 42905312 | 42905331 | 42905328 | + |
| SEQ ID NO 58391 | ACACACACACACATATAATA | CTAGAAA | chr17 | 42905464 | 42905483 | 42905480 | + |
| SEQ ID NO 58392 | AAAAAAAAAAGAAGAAGAA | GAAGAAA | chr17 | 42905511 | 42905530 | 42905527 | + |
| SEQ ID NO 58393 | AGAAGGACCAAACATCTTTT | GTAGAAA | chr17 | 42905554 | 42905573 | 42905570 | + |
| SEQ ID NO 58394 | TTAGGTAGAGTAGCTAAGGC | TCAGAAA | chr17 | 42905731 | 42905750 | 42905747 | + |
| SEQ ID NO 58395 | CTACCCAGGAGGCTGCGGCA | GGAGAAT | chr17 | 42905933 | 42905952 | 42905949 | + |
| SEQ ID NO 58396 | TGCACTCCAGCCTTGGTGAC | AGAGAAA | chr17 | 42906008 | 42906027 | 42906024 | + |
| SEQ ID NO 58397 | GAAGGGAGGGAGGAAGGAAG | GGAGAAA | chr17 | 42906111 | 42906130 | 42906127 | + |
| SEQ ID NO 58398 | GGAGGGAGGAAGGAAGGGAG | AAAGAAA | chr17 | 42906115 | 42906134 | 42906131 | + |
| SEQ ID NO 58399 | GAAGGAGGAAGGGAGGGAGG | GAAGAAA | chr17 | 42906144 | 42906163 | 42906160 | + |
| SEQ ID NO 58400 | ATGCCAGGAGAAGGCTGAGA | GCAGAAA | chr17 | 42906443 | 42906462 | 42906459 | + |
| SEQ ID NO 58401 | ATCTCTCAGGGTAGAGGAAT | TAAGAAT | chr17 | 42906556 | 42906575 | 42906572 | + |
| SEQ ID NO 58402 | GTGGTCAGAGTAGGACTCAC | TGAGAAT | chr17 | 42906941 | 42906960 | 42906957 | + |
| SEQ ID NO 58403 | CCATCCAGGTTAAAATAACC | AGAGAAA | chr17 | 42907951 | 42907970 | 42907967 | + |
| SEQ ID NO 58404 | ACAGAAGATATTCCTACTAC | AGAGAAT | chr17 | 42907977 | 42907996 | 42907993 | + |
| SEQ ID NO 58405 | CATTTCTGTGGGTTGAAAGT | CAAGAAT | chr17 | 42909534 | 42909553 | 42909550 | + |
| SEQ ID NO 58406 | CTATAAGAGTGCCCAGATCT | ATAGAAT | chr17 | 42909584 | 42909603 | 42909600 | + |
| SEQ ID NO 58407 | GACAAGATTTAAGTTAAGCA | TAAGAAA | chr17 | 42910189 | 42910208 | 42910205 | + |
| SEQ ID NO 58408 | GGAACATAGCAGCATTCAAA | GAAGAAT | chr17 | 42910290 | 42910309 | 42910306 | + |
| SEQ ID NO 58409 | CCTGGGAATGTTTAGGTTAG | AGAGAAT | chr17 | 42910426 | 42910445 | 42910442 | + |
| SEQ ID NO 58410 | TTCATCACTTACTAACTCCT | GCAGAAA | chr17 | 42910486 | 42910505 | 42910502 | + |
| SEQ ID NO 58411 | CTAACTCCTGCAGAAAGAAC | TGAGAAA | chr17 | 42910497 | 42910516 | 42910513 | + |
| SEQ ID NO 58412 | TCCACTCAGGCATTGCTGTT | GCAGAAA | chr17 | 42910906 | 42910925 | 42910922 | + |
| SEQ ID NO 58413 | AGCATCTATAATGCCAGCCT | CAAGAAA | chr17 | 42910950 | 42910969 | 42910966 | + |
| SEQ ID NO 58414 | GTAGACCTCCTGTGGACTCT | GGAGAAA | chr17 | 42911046 | 42911065 | 42911062 | + |
| SEQ ID NO 58415 | CCCAGAGGTGGTGCGAGCAG | CCAGAAT | chr17 | 42911074 | 42911093 | 42911090 | + |
| SEQ ID NO 58416 | TGAAAAGCTAATGAAGCTAT | TGAGAAA | chr17 | 42911849 | 42911868 | 42911865 | + |

Figure 87 (Cont'd)

| | | | | | | | |
|---|---|---|---|---|---|---|---|
| SEQ ID NO 58417 | CCCAGGCTGGAGATCCTAAC | TGAGAAT | chr17 | 42911982 | 42912001 | 42911998 | + |
| SEQ ID NO 58418 | CTACCTGTGTTCATTCTTAC | CGAGAAA | chr17 | 42912012 | 42912031 | 42912028 | + |
| SEQ ID NO 58419 | GTTCATTCTTACCGAGAAAA | GGAGAAA | chr17 | 42912020 | 42912039 | 42912036 | + |
| SEQ ID NO 58420 | CCAGGCTAATTTTTATATTT | TTAGAAT | chr17 | 42912953 | 42912972 | 42912969 | + |
| SEQ ID NO 58421 | CCTGCTCATAACATCTTTGA | AAAGAAA | chr17 | 42913256 | 42913275 | 42913272 | + |
| SEQ ID NO 58422 | TATTAAAGCAACATTTTATT | TAAGAAT | chr17 | 42913303 | 42913322 | 42913319 | + |
| SEQ ID NO 58423 | GCCTGCATTTTCCCTTTGGA | GAAGAAA | chr17 | 42913441 | 42913460 | 42913457 | + |
| SEQ ID NO 58424 | GGCCCAAAATCAGCATAGAA | CCAGAAA | chr17 | 42913563 | 42913582 | 42913579 | + |
| SEQ ID NO 58425 | CAGAAAGATTCAGAGTTGGC | CAAGAAT | chr17 | 42913584 | 42913603 | 42913600 | + |
| SEQ ID NO 58426 | CAAGGTTTTGGGTTATAGTT | CAAGAAA | chr17 | 42913778 | 42913797 | 42913794 | + |
| SEQ ID NO 58427 | TTGTGGGAACCAGGCCCCTC | ACAGAAT | chr17 | 42914039 | 42914058 | 42914055 | + |
| SEQ ID NO 58428 | AATCAAATGGTCCCAACCAG | GGAGAAA | chr17 | 42914063 | 42914082 | 42914079 | + |
| SEQ ID NO 58429 | AAATGGTCCCAACCAGGGAG | AAAGAAA | chr17 | 42914067 | 42914086 | 42914083 | + |
| SEQ ID NO 58430 | GTGTGAGCCACTGCGCTTGG | CCAGAAA | chr17 | 42914212 | 42914231 | 42914228 | + |
| SEQ ID NO 58431 | GACCAAGTCCAAGATCCTTA | CAAGAAA | chr17 | 42914313 | 42914332 | 42914329 | + |
| SEQ ID NO 58432 | ATCCTTACAAGAAAGGTCTG | CCAGAAA | chr17 | 42914326 | 42914345 | 42914342 | + |
| SEQ ID NO 58433 | CCTGAAGTTTATGAGGTTGA | TAAGAAA | chr17 | 42914372 | 42914391 | 42914388 | + |
| SEQ ID NO 58434 | AGAGGGGTTAGTCATCTTGT | CCAGAAT | chr17 | 42914542 | 42914561 | 42914558 | + |
| SEQ ID NO 58435 | CTACTCAGGTGGCTGAGGTG | GGAGAAT | chr17 | 42914770 | 42914789 | 42914786 | + |
| SEQ ID NO 58436 | TGACAGAGTGAGACCCTGTC | TCAGAAA | chr17 | 42914854 | 42914873 | 42914870 | + |
| SEQ ID NO 58437 | GTTATAGATTTACGTCCACT | TTAGAAA | chr17 | 42915015 | 42915034 | 42915031 | + |
| SEQ ID NO 58438 | TCATGTTATGGCATAATTTG | GTAGAAT | chr17 | 42915096 | 42915115 | 42915112 | + |
| SEQ ID NO 58439 | ATGCAATTCTATTATTGCCC | AAAGAAA | chr17 | 42915187 | 42915206 | 42915203 | + |
| SEQ ID NO 58440 | GGAATATTACTTGTCCATAA | AAAGAAA | chr17 | 42916220 | 42916239 | 42916223 | - |
| SEQ ID NO 58441 | CAAATAGGCAAATCTATGAG | ACAGAAA | chr17 | 42916080 | 42916099 | 42916083 | - |
| SEQ ID NO 58442 | TCTATTTTCTTTGGGCAATA | ATAGAAT | chr17 | 42915199 | 42915218 | 42915202 | - |
| SEQ ID NO 58443 | GTATAAATAAAGTACATAGA | ACAGAAT | chr17 | 42914447 | 42914466 | 42914450 | - |
| SEQ ID NO 58444 | CTGAGAGCCCAAATCCAGTA | GGAGAAT | chr17 | 42914013 | 42914032 | 42914016 | - |
| SEQ ID NO 58445 | GATGAAATAAATCTCTTAGC | AGAGAAA | chr17 | 42913866 | 42913885 | 42913869 | - |
| SEQ ID NO 58446 | CAAAGGGAAAATGCAGGCAC | AGAGAAA | chr17 | 42913439 | 42913458 | 42913442 | - |
| SEQ ID NO 58447 | ATTTGTTTAGGGAAACAGAG | CTAGAAA | chr17 | 42913405 | 42913424 | 42913408 | - |
| SEQ ID NO 58448 | GAGCTAGAAATTTAGTTGGG | CCAGAAT | chr17 | 42913388 | 42913407 | 42913391 | - |
| SEQ ID NO 58449 | GAAATTTAGTTGGGCCAGAA | TTAGAAA | chr17 | 42913382 | 42913401 | 42913385 | - |
| SEQ ID NO 58450 | TTGGGGGGTAGGTGGGTGGG | GCAGAAA | chr17 | 42913150 | 42913169 | 42913153 | - |
| SEQ ID NO 58451 | CTACTGAGGAGGCTGAGACA | TGAGAAT | chr17 | 42912906 | 42912925 | 42912909 | - |
| SEQ ID NO 58452 | ATAGGTGCGCCGTCTCAAAA | AAAGAAA | chr17 | 42912814 | 42912833 | 42912817 | - |
| SEQ ID NO 58453 | CGTCTCAAAAAAGAAAAAA | AAAGAAA | chr17 | 42912804 | 42912823 | 42912807 | - |
| SEQ ID NO 58454 | GAAGATGTTGACTTTTCCTT | TAAGAAT | chr17 | 42912615 | 42912634 | 42912618 | - |
| SEQ ID NO 58455 | GCTCTTGGTTGGCTTGGGAT | AGAGAAA | chr17 | 42912586 | 42912605 | 42912589 | - |
| SEQ ID NO 58456 | GGGTGGATGTGGAGCCAGTG | GAAGAAT | chr17 | 42912400 | 42912419 | 42912403 | - |
| SEQ ID NO 58457 | ATCTGGGTCACTGCAGCCAT | TCAGAAA | chr17 | 42912282 | 42912301 | 42912285 | - |
| SEQ ID NO 58458 | CAGTAAAAAAATACTAGAA | GCAGAAT | chr17 | 42912226 | 42912245 | 42912229 | - |
| SEQ ID NO 58459 | CTCCTTTCTCCTTTCTCGG | TAAGAAT | chr17 | 42912031 | 42912050 | 42912034 | - |
| SEQ ID NO 58460 | CTCGGTAAGAATGAACACAG | GTAGAAA | chr17 | 42912016 | 42912035 | 42912019 | - |
| SEQ ID NO 58461 | TTGCTTTTGTATATGTGACG | GAAGAAT | chr17 | 42911935 | 42911954 | 42911938 | - |
| SEQ ID NO 58462 | CGTGATTTAATTCCACGACG | GCAGAAT | chr17 | 42911542 | 42911561 | 42911545 | - |
| SEQ ID NO 58463 | GCTGAACAGGAAGAAGGTAA | TGAGAAA | chr17 | 42910987 | 42911006 | 42910990 | - |
| SEQ ID NO 58464 | GCAACAGCAATGCCTGAGTG | GAAGAAA | chr17 | 42910908 | 42910927 | 42910911 | - |
| SEQ ID NO 58465 | CGTTCTTACAAATCTCCAGG | GGAGAAA | chr17 | 42910271 | 42910290 | 42910274 | - |
| SEQ ID NO 58466 | TTACCCTTGTTAATTGGATC | TAAGAAA | chr17 | 42910169 | 42910188 | 42910172 | - |

Figure 87 (Cont'd)

| SEQ ID NO | Sequence | PAM | Chr | Start | End | Pos | Strand |
|---|---|---|---|---|---|---|---|
| SEQ ID NO 58467 | TACTCGGAGAGGCTGAGGCA | GGAGAAT | chr17 | 42909974 | 42909993 | 42909977 | - |
| SEQ ID NO 58468 | TAGGGCCTGTTGAAGACCAG | TAAGAAA | chr17 | 42909700 | 42909719 | 42909703 | - |
| SEQ ID NO 58469 | CTATAGATCTGGGCACTCTT | ATAGAAA | chr17 | 42909588 | 42909607 | 42909591 | - |
| SEQ ID NO 58470 | TCATTCTTGACTTTCAACCC | ACAGAAA | chr17 | 42909543 | 42909562 | 42909546 | - |
| SEQ ID NO 58471 | GGATTTTGTCCTGATTAGGG | AGAGAAA | chr17 | 42909473 | 42909492 | 42909476 | - |
| SEQ ID NO 58472 | CAGACATTCAGCTGCACAGC | CCAGAAT | chr17 | 42909337 | 42909356 | 42909340 | - |
| SEQ ID NO 58473 | ACAGGTGCAGATCCTTCAGC | AAAGAAA | chr17 | 42909253 | 42909272 | 42909256 | - |
| SEQ ID NO 58474 | CAGCAAAGAAAACAGCCCCT | GCAGAAA | chr17 | 42909237 | 42909256 | 42909240 | - |
| SEQ ID NO 58475 | CTATTTGAGAGGCTGAGGCA | GGAGAAT | chr17 | 42908815 | 42908834 | 42908818 | - |
| SEQ ID NO 58476 | CTACTCGGTAGGCTGAGGCA | GAAGAAT | chr17 | 42908518 | 42908537 | 42908521 | - |
| SEQ ID NO 58477 | TCTGTCTCTACAAAAGATA | CGAGAAA | chr17 | 42908203 | 42908222 | 42908206 | - |
| SEQ ID NO 58478 | GCGGGCTAGGGGATGTGAG | GAAGAAT | chr17 | 42907708 | 42907727 | 42907711 | - |
| SEQ ID NO 58479 | GGCTCCCTAAAGGGCAGGAA | AGAGAAT | chr17 | 42907509 | 42907528 | 42907512 | - |
| SEQ ID NO 58480 | ATACAGTCTGGAGATTACAC | AAAGAAT | chr17 | 42907209 | 42907228 | 42907212 | - |
| SEQ ID NO 58481 | AGCCCTTCACAGCTCTTCTG | CCAGAAA | chr17 | 42907016 | 42907035 | 42907019 | - |
| SEQ ID NO 58482 | TCGCTGTGGGGTTGGATGAG | GCAGAAT | chr17 | 42906314 | 42906333 | 42906317 | - |
| SEQ ID NO 58483 | ACTTTTTTTTTTTTTCCTG | ACAGAAT | chr17 | 42906043 | 42906062 | 42906046 | - |
| SEQ ID NO 58484 | TGTGCCTCCATTAATTTCAG | GGAGAAA | chr17 | 42905629 | 42905648 | 42905632 | - |
| SEQ ID NO 58485 | CCAGTATGGACGCTGTCCAA | AGAGAAT | chr17 | 42903939 | 42903958 | 42903942 | - |
| SEQ ID NO 58486 | CCGTTTCTACCAAAAAATAT | AAAGAAT | chr17 | 42903255 | 42903274 | 42903258 | - |
| SEQ ID NO 58487 | CTACTCGGGAGGCTAAGGCA | AGAGAAT | chr17 | 42903193 | 42903212 | 42903196 | - |
| SEQ ID NO 58488 | CTCAAGAAGTATTTGTCCTG | GAAGAAT | chr17 | 42903015 | 42903034 | 42903018 | - |
| SEQ ID NO 58489 | CTTGCATTTCCTCTGACATC | AGAGAAT | chr17 | 42902921 | 42902940 | 42902924 | - |
| SEQ ID NO 58490 | AAACATGGCCTGCATTTCCA | TCAGAAT | chr17 | 42902860 | 42902879 | 42902863 | - |
| SEQ ID NO 58491 | ACACTTCATCTTTTTATTTT | TTAGAAT | chr17 | 42902561 | 42902580 | 42902564 | - |
| SEQ ID NO 58492 | CTACTTGGGAGGCTGAGGCA | GGAGAAT | chr17 | 42902359 | 42902378 | 42902362 | - |
| SEQ ID NO 58493 | CCATCTCAAACAAACAAACA | AAAGAAA | chr17 | 42902254 | 42902273 | 42902257 | - |
| SEQ ID NO 58494 | CTCAAACAAACAAACAAAG | AAAGAAA | chr17 | 42902250 | 42902269 | 42902253 | - |
| SEQ ID NO 58495 | AACAAACAAACAAAAGAAAG | AAAGAAA | chr17 | 42902246 | 42902265 | 42902249 | - |
| SEQ ID NO 58496 | AACAAACAAAAGAAAGAAAG | AAAGAAA | chr17 | 42902242 | 42902261 | 42902245 | - |
| SEQ ID NO 58497 | GAAAGAAAGAAAGAAAGTGG | CCAGAAT | chr17 | 42902231 | 42902250 | 42902234 | - |
| SEQ ID NO 58498 | AGAATGGGAATGTTTACGTG | ATAGAAA | chr17 | 42902209 | 42902228 | 42902212 | - |
| SEQ ID NO 58499 | TAAATAGCAGTAACTACCTC | ACAGAAA | chr17 | 42901984 | 42902003 | 42901987 | - |
| SEQ ID NO 58500 | ACCTATTTGTAGATTATAAA | ACAGAAA | chr17 | 42901883 | 42901902 | 42901886 | - |
| SEQ ID NO 58501 | TTCAGGGTGATTTACGTAAA | ATAGAAA | chr17 | 42900637 | 42900656 | 42900640 | - |
| SEQ ID NO 58502 | AACTGCACTTATTTGGGGAC | AAAGAAA | chr17 | 42900430 | 42900449 | 42900433 | - |
| SEQ ID NO 58503 | AAACAAAACAAAACAAAACA | AAAGAAA | chr17 | 42900041 | 42900060 | 42900044 | - |
| SEQ ID NO 58504 | TGGCCTCATGTCTCTTAGGG | CCAGAAA | chr17 | 42899891 | 42899910 | 42899894 | - |
| SEQ ID NO 58505 | GATGAATGTATGGTTCCAAA | TAAGAAT | chr17 | 42899421 | 42899440 | 42899424 | - |
| SEQ ID NO 58506 | CATATGTGTGTAGATATACA | AAAGAAA | chr17 | 42899306 | 42899325 | 42899309 | - |
| SEQ ID NO 58507 | TTATTTATTTATTTATTTTT | GTAGAAA | chr17 | 42899076 | 42899095 | 42899079 | - |
| SEQ ID NO 58508 | CATGTAAGGGGTAGCTGGGG | ACAGAAA | chr17 | 42898853 | 42898872 | 42898856 | - |
| SEQ ID NO 58509 | GGGGTAGCTGGGGACAGAAA | AAAGAAA | chr17 | 42898846 | 42898865 | 42898849 | - |
| SEQ ID NO 58510 | TGTTTTCTGAGACGCCTCAG | GAAGAAT | chr17 | 42898293 | 42898312 | 42898296 | - |
| SEQ ID NO 58511 | ACAGGTGAGGCCCCAGCTTG | TTAGAAA | chr17 | 42898055 | 42898074 | 42898058 | - |
| SEQ ID NO 58512 | CGAGTGGCTAGAAGTTTTGC | TGAGAAT | chr17 | 42897975 | 42897994 | 42897978 | - |

Figure 88

| # | Sequence | PAM | Chr | Start | End | Cuts 5' of | Str |
|---|---|---|---|---|---|---|---|
| SEQ ID NO 58513 | CAGCTACCCAGAGACTGATG | CAAAAC | chr17 | 42897831 | 42897850 | 42897847 | + |
| SEQ ID NO 58514 | ATAAATGAGTGGATTCTCAG | CAAAAC | chr17 | 42897956 | 42897975 | 42897972 | + |
| SEQ ID NO 58515 | TCACCTGTTTTCCCACGGAT | AAAAAC | chr17 | 42898067 | 42898086 | 42898083 | + |
| SEQ ID NO 58516 | ATTCTTCCTGAGGCGTCTCA | GAAAAC | chr17 | 42898286 | 42898305 | 42898302 | + |
| SEQ ID NO 58517 | TTTTGCTTAAACGTATGAGT | TAAAAC | chr17 | 42899474 | 42899493 | 42899490 | + |
| SEQ ID NO 58518 | GACCAGCCTGGGCAACATGG | AAAAAC | chr17 | 42899586 | 42899605 | 42899602 | + |
| SEQ ID NO 58519 | GAGAGAGAAAATTTAAAAAA | GAAAAC | chr17 | 42899794 | 42899813 | 42899810 | + |
| SEQ ID NO 58520 | ATGAATTAATCACTGCATTC | AAAAAC | chr17 | 42899852 | 42899871 | 42899868 | + |
| SEQ ID NO 58521 | GGGTACACCATCACACACAC | CAAAAC | chr17 | 42900199 | 42900218 | 42900215 | + |
| SEQ ID NO 58522 | TAATTTTAAAATTAAGAACT | TAAAAC | chr17 | 42900373 | 42900392 | 42900389 | + |
| SEQ ID NO 58523 | AATACTGGATACAGGGCATA | TAAAAC | chr17 | 42900752 | 42900771 | 42900768 | + |
| SEQ ID NO 58524 | TGGCGAAACTCCATCTCTAC | AAAAAC | chr17 | 42901541 | 42901560 | 42901557 | + |
| SEQ ID NO 58525 | CCCGTCTCTACTAAAAATAC | AAAAAC | chr17 | 42903540 | 42903559 | 42903556 | + |
| SEQ ID NO 58526 | AGAGACCCTTTCCCTGACCC | CAAAAC | chr17 | 42904573 | 42904592 | 42904589 | + |
| SEQ ID NO 58527 | ATCACCTGAGGTCAGGAGTT | CAAAAC | chr17 | 42904889 | 42904908 | 42904905 | + |
| SEQ ID NO 58528 | GACCAGCCTGGCCAACATGG | CAAAAC | chr17 | 42905225 | 42905244 | 42905241 | + |
| SEQ ID NO 58529 | CGTCACTAATAAAAAAATAC | AAAAAC | chr17 | 42905871 | 42905890 | 42905887 | + |
| SEQ ID NO 58530 | ATTGCTTGAGCCCAAGAGTT | CAAAAC | chr17 | 42906656 | 42906675 | 42906672 | + |
| SEQ ID NO 58531 | AGTTCAAAACCAGCCTGGGC | AAAAAC | chr17 | 42906672 | 42906691 | 42906688 | + |
| SEQ ID NO 58532 | AAAACAATCAAACAAACAAA | CAAAAC | chr17 | 42906693 | 42906712 | 42906709 | + |
| SEQ ID NO 58533 | AAGCAAGACACTGTCTCTAA | AAAAAC | chr17 | 42906863 | 42906882 | 42906879 | + |
| SEQ ID NO 58534 | ACACTGTCTCTAAAAAAACA | AAAAAC | chr17 | 42906870 | 42906889 | 42906886 | + |
| SEQ ID NO 58535 | AACAAAAAACAAACAAATAA | AAAAAC | chr17 | 42906886 | 42906905 | 42906902 | + |
| SEQ ID NO 58536 | AGTAGCAGCAGGGCTTAAAT | AAAAAC | chr17 | 42907898 | 42907917 | 42907914 | + |
| SEQ ID NO 58537 | ACTGGAATATAAGACCTTAA | CAAAAC | chr17 | 42910231 | 42910250 | 42910247 | + |
| SEQ ID NO 58538 | CCTGGAAGCCATATCACATG | AAAAAC | chr17 | 42910401 | 42910420 | 42910417 | + |
| SEQ ID NO 58539 | ACCCAGATATTGCACTAGGT | CAAAAC | chr17 | 42912294 | 42912313 | 42912310 | + |
| SEQ ID NO 58540 | GTATACCATACATTATCATT | CAAAAC | chr17 | 42913224 | 42913243 | 42913240 | + |
| SEQ ID NO 58541 | GAAGTTTATGAGGTTGATAA | GAAAAC | chr17 | 42914375 | 42914394 | 42914391 | + |
| SEQ ID NO 58542 | CCCCGTCTATACCAAAAATA | CAAAAC | chr17 | 42914707 | 42914726 | 42914723 | + |
| SEQ ID NO 58543 | TTATAACACAGATAAACCTT | GAAAAC | chr17 | 42916176 | 42916195 | 42916179 | - |
| SEQ ID NO 58544 | TGAGTGGGTTGGAGTGGAAT | GAAAAC | chr17 | 42916030 | 42916049 | 42916033 | - |
| SEQ ID NO 58545 | TTACAATTTTGTTAAAAATC | AAAAAC | chr17 | 42915619 | 42915638 | 42915622 | - |
| SEQ ID NO 58546 | AAAAAGATAAAATAAATAAC | CAAAAC | chr17 | 42915304 | 42915323 | 42915307 | - |
| SEQ ID NO 58547 | AAATAAATAACCAAAACCAC | AAAAAC | chr17 | 42915295 | 42915314 | 42915298 | - |
| SEQ ID NO 58548 | CATCCTCAAGCCTACCACCT | GAAAAC | chr17 | 42915146 | 42915165 | 42915149 | - |
| SEQ ID NO 58549 | ACATGACATGGACCTTGCTT | TAAAAC | chr17 | 42915082 | 42915101 | 42915085 | - |
| SEQ ID NO 58550 | AGGGTTCAGTTCAGACAGAT | CAAAAC | chr17 | 42914247 | 42914266 | 42914250 | - |
| SEQ ID NO 58551 | GACTTTCTTGAACTATAACC | CAAAAC | chr17 | 42913788 | 42913807 | 42913791 | - |
| SEQ ID NO 58552 | TATACTATATAATTAGTAGC | AAAAAC | chr17 | 42913209 | 42913228 | 42913212 | - |
| SEQ ID NO 58553 | CTGCATATCAGATGAGATTG | AAAAAC | chr17 | 42913119 | 42913138 | 42913122 | - |
| SEQ ID NO 58554 | TGCATGATACGCCACATACT | AAAAAC | chr17 | 42912096 | 42912115 | 42912099 | - |
| SEQ ID NO 58555 | AATAGCTTCATTAGCTTTTC | AAAAAC | chr17 | 42911850 | 42911869 | 42911853 | - |
| SEQ ID NO 58556 | CCCTTGTTAATTGGATCTAA | GAAAAC | chr17 | 42910166 | 42910185 | 42910169 | - |
| SEQ ID NO 58557 | GAGACTCCATCTCAAAAAAA | AAAAAC | chr17 | 42909874 | 42909893 | 42909877 | - |
| SEQ ID NO 58558 | CTCAAAAAAAAAAACAAAA | AAAAAC | chr17 | 42909864 | 42909883 | 42909867 | - |
| SEQ ID NO 58559 | AAAACAAAAAAAAACATATT | CAAAAC | chr17 | 42909853 | 42909872 | 42909856 | - |
| SEQ ID NO 58560 | GGTGCAGATCCTTCAGCAAA | GAAAAC | chr17 | 42909250 | 42909269 | 42909253 | - |
| SEQ ID NO 58561 | TCTAGCCTGGGCAACAAGAG | CAAAAC | chr17 | 42908735 | 42908754 | 42908738 | - |

Figure 88 (Cont'd)

| | | | | | | | |
|---|---|---|---|---|---|---|---|
| SEQ ID NO 58562 | GGGCTTTGTTTCCTTATCTG | TAAAAC | chr17 | 42907842 | 42907861 | 42907845 | - |
| SEQ ID NO 58563 | AACCATCTGGCTGTAACTAA | TAAAAC | chr17 | 42904434 | 42904453 | 42904437 | - |
| SEQ ID NO 58564 | TTGCTGTAGTAGTCAGTATC | CAAAAC | chr17 | 42903968 | 42903987 | 42903971 | - |
| SEQ ID NO 58565 | GTCCAAAGAGAATCCTATGG | AAAAAC | chr17 | 42903925 | 42903944 | 42903928 | - |
| SEQ ID NO 58566 | GATAACCTATTTGTAGATTA | TAAAAC | chr17 | 42901887 | 42901906 | 42901890 | - |
| SEQ ID NO 58567 | GGTGACTTTTCATTACCCCA | CAAAAC | chr17 | 42901780 | 42901799 | 42901783 | - |
| SEQ ID NO 58568 | CCTCTTCTGCTTCATACTAA | TAAAAC | chr17 | 42901394 | 42901413 | 42901397 | - |
| SEQ ID NO 58569 | CAGCCCTGATCTTTGGACTC | AAAAAC | chr17 | 42900722 | 42900741 | 42900725 | - |
| SEQ ID NO 58570 | GGGTGATTTACGTAAAATAG | AAAAAC | chr17 | 42900633 | 42900652 | 42900636 | - |
| SEQ ID NO 58571 | AAATAGAAAAACAGGCACAC | AAAAAC | chr17 | 42900619 | 42900638 | 42900622 | - |
| SEQ ID NO 58572 | TCGAGCAAGACCCCAGTCTC | TAAAAC | chr17 | 42900073 | 42900092 | 42900076 | - |
| SEQ ID NO 58573 | CAAGACCCCAGTCTCTAAAA | CAAAAC | chr17 | 42900068 | 42900087 | 42900071 | - |
| SEQ ID NO 58574 | CCCCAGTCTCTAAAACAAAA | CAAAAC | chr17 | 42900063 | 42900082 | 42900066 | - |
| SEQ ID NO 58575 | GTCTCTAAAACAAAACAAAA | CAAAAC | chr17 | 42900058 | 42900077 | 42900061 | - |
| SEQ ID NO 58576 | TAAAACAAAACAAAACAAAA | CAAAAC | chr17 | 42900053 | 42900072 | 42900056 | - |
| SEQ ID NO 58577 | CAAAACAAAACAAAACAAAA | CAAAAC | chr17 | 42900048 | 42900067 | 42900051 | - |
| SEQ ID NO 58578 | AAAACAAAACAAAACAAAAG | AAAAAC | chr17 | 42900037 | 42900056 | 42900040 | - |
| SEQ ID NO 58579 | CCTACAAATAGTAGAGAGAC | CAAAAC | chr17 | 42899217 | 42899236 | 42899220 | - |
| SEQ ID NO 58580 | CCAGGGGGAATAAAATGTTT | AAAAAC | chr17 | 42898913 | 42898932 | 42898916 | - |
| SEQ ID NO 58581 | CATTCCATGCTGGAAATGAT | TAAAAC | chr17 | 42898784 | 42898803 | 42898787 | - |
| SEQ ID NO 58582 | AGGTGAGTCAAGGTGAGTCT | AAAAAC | chr17 | 42898420 | 42898439 | 42898423 | - |
| SEQ ID NO 58583 | CAGCACGTTTTTATCCGTGG | GAAAAC | chr17 | 42898079 | 42898098 | 42898082 | - |

Figure 89

| # | Sequence | PAM | Chr | Start | End | Cuts 5' of | Str |
|---|---|---|---|---|---|---|---|
| SEQ ID NO 58584 | CTCAAATAAACAGATAAATG | AGTGGATT | chr17 | 42897943 | 42897962 | 42897959 | + |
| SEQ ID NO 58585 | ATCCACGGTGTCTCGATGCA | GTCAGCTT | chr17 | 42898022 | 42898041 | 42898038 | + |
| SEQ ID NO 58586 | TTCTAACAAGCTGGGGCCTC | ACCTGTTT | chr17 | 42898049 | 42898068 | 42898065 | + |
| SEQ ID NO 58587 | ACCCAGACAGTGGCCTTTGT | ATATGTTT | chr17 | 42898390 | 42898409 | 42898406 | + |
| SEQ ID NO 58588 | TGCAATAGTTACTCCACAAC | AGAGGCTT | chr17 | 42898472 | 42898491 | 42898488 | + |
| SEQ ID NO 58589 | CCCAGCACTGCCTGCCACGC | ATGGGCTT | chr17 | 42898571 | 42898590 | 42898587 | + |
| SEQ ID NO 58590 | CCAAGGTTAGGCGTGGCAGG | AGAAGTTT | chr17 | 42898640 | 42898659 | 42898656 | + |
| SEQ ID NO 58591 | GGTTAGGCGTGGCAGGAGAA | GTTTGCTT | chr17 | 42898644 | 42898663 | 42898660 | + |
| SEQ ID NO 58592 | TCCAGGTCATACCTCCTGGA | GGATGTTT | chr17 | 42898754 | 42898773 | 42898770 | + |
| SEQ ID NO 58593 | GGAATGCTGTCAACTTTTGC | CACAGATT | chr17 | 42898798 | 42898817 | 42898814 | + |
| SEQ ID NO 58594 | TTGCCACAGATTCATTAGCT | CTGAGTTT | chr17 | 42898814 | 42898833 | 42898830 | + |
| SEQ ID NO 58595 | CTTAATGATGGGAAATTCAG | GCAAGTTT | chr17 | 42898883 | 42898902 | 42898899 | + |
| SEQ ID NO 58596 | GTGGCTCATGCCTGTAATCC | CAATGCTT | chr17 | 42898968 | 42898987 | 42898984 | + |
| SEQ ID NO 58597 | GCCTGGGCCGCATAGTGAGA | CCCCGTTT | chr17 | 42899044 | 42899063 | 42899060 | + |
| SEQ ID NO 58598 | ATAAATAATAGTGATATGAA | GCATGATT | chr17 | 42899095 | 42899114 | 42899111 | + |
| SEQ ID NO 58599 | TTAAAATGCATGAGTTCGTT | ACCTGATT | chr17 | 42899138 | 42899157 | 42899154 | + |
| SEQ ID NO 58600 | GTCCTCCGTGACCCAAGTGT | TAGGGTTT | chr17 | 42899187 | 42899206 | 42899203 | + |
| SEQ ID NO 58601 | ATACACACACAGTGTATC | TTGAGCTT | chr17 | 42899273 | 42899292 | 42899289 | + |
| SEQ ID NO 58602 | GCCCTTTTTCAAAAATAACT | GAAAGTTT | chr17 | 42899350 | 42899369 | 42899366 | + |
| SEQ ID NO 58603 | GTAAGACTATACATTCATTA | TTTTGCTT | chr17 | 42899454 | 42899473 | 42899470 | + |
| SEQ ID NO 58604 | GTGGTTCACACCTGTAATCC | CAGAGCTT | chr17 | 42899515 | 42899534 | 42899531 | + |
| SEQ ID NO 58605 | GAGGTTGAGGCTGCAGTGAG | CCGTGATT | chr17 | 42899713 | 42899732 | 42899729 | + |
| SEQ ID NO 58606 | GCCTGGGAGACAGAGTGAGA | CCCTGTTT | chr17 | 42899757 | 42899776 | 42899773 | + |
| SEQ ID NO 58607 | GAATTAATCACTGCATTCAA | AAACGATT | chr17 | 42899854 | 42899873 | 42899870 | + |
| SEQ ID NO 58608 | AGAAGTTACTATATTTTATT | TGTTGTTT | chr17 | 42900007 | 42900026 | 42900023 | + |
| SEQ ID NO 58609 | TATTTTATTTGTTGTTTTTC | TTTTGTTT | chr17 | 42900018 | 42900037 | 42900034 | + |
| SEQ ID NO 58610 | TATTTGTTGTTTTTCTTTTG | TTTTGTTT | chr17 | 42900023 | 42900042 | 42900039 | + |
| SEQ ID NO 58611 | GTTGTTTTTCTTTTGTTTTG | TTTTGTTT | chr17 | 42900028 | 42900047 | 42900044 | + |
| SEQ ID NO 58612 | TTTTCTTTTGTTTTGTTTTG | TTTTGTTT | chr17 | 42900033 | 42900052 | 42900049 | + |
| SEQ ID NO 58613 | TTTTGTTTTGTTTTGTTTTG | TTTTGTTT | chr17 | 42900038 | 42900057 | 42900054 | + |
| SEQ ID NO 58614 | TTTTGTTTTGTTTTGTTTTG | TTTTGTTT | chr17 | 42900043 | 42900062 | 42900059 | + |
| SEQ ID NO 58615 | GTTTTAGAGACTGGGGTCTT | GCTCGATT | chr17 | 42900067 | 42900086 | 42900083 | + |
| SEQ ID NO 58616 | TTTTTGTGTAGAAACGAGGG | TCTTGCTT | chr17 | 42900236 | 42900255 | 42900252 | + |
| SEQ ID NO 58617 | GCCCAGGCTGGTCTCCAACT | CCTGGCTT | chr17 | 42900268 | 42900287 | 42900284 | + |
| SEQ ID NO 58618 | CACCTCAGCCTCCCAAATTG | CTGGGATT | chr17 | 42900309 | 42900328 | 42900325 | + |
| SEQ ID NO 58619 | AAACTTGAATAGCTAGAGCA | CCAAGATT | chr17 | 42900395 | 42900414 | 42900411 | + |
| SEQ ID NO 58620 | ACTCTGTCCTGTGTCTCTGG | CCTGGTTT | chr17 | 42900498 | 42900517 | 42900514 | + |
| SEQ ID NO 58621 | GCTGAGTACATGGCCGATCA | GGCTGTTT | chr17 | 42900589 | 42900608 | 42900605 | + |
| SEQ ID NO 58622 | CGATCAGGCTGTTTTTGTGT | GCCTGTTT | chr17 | 42900603 | 42900622 | 42900619 | + |
| SEQ ID NO 58623 | TTTTACGTAAATCACCCTGA | ACATGTTT | chr17 | 42900636 | 42900655 | 42900652 | + |
| SEQ ID NO 58624 | ATCAATACATTTTAGACAAA | CGTGGTTT | chr17 | 42900692 | 42900711 | 42900708 | + |
| SEQ ID NO 58625 | CATTAAACTCCTTTGGGTAG | CTGTGATT | chr17 | 42901050 | 42901069 | 42901066 | + |
| SEQ ID NO 58626 | CGCAATGTCTGTCCATCAGA | AGTTGCTT | chr17 | 42901160 | 42901179 | 42901176 | + |
| SEQ ID NO 58627 | TTCAGGAAGCCACGGGCTAC | TCATGCTT | chr17 | 42901199 | 42901218 | 42901215 | + |
| SEQ ID NO 58628 | TCGTGAAAAGTCTGAGTTAT | ATAGGCTT | chr17 | 42901350 | 42901369 | 42901366 | + |
| SEQ ID NO 58629 | AGTTATATAGGCTTTGAGCA | AAGAGTTT | chr17 | 42901364 | 42901383 | 42901380 | + |
| SEQ ID NO 58630 | TATGAAAAAGGAAACACAC | AGATGATT | chr17 | 42901737 | 42901756 | 42901753 | + |
| SEQ ID NO 58631 | AACACACAGATGATTCAACA | GCCTGTTT | chr17 | 42901750 | 42901769 | 42901766 | + |
| SEQ ID NO 58632 | TGGCAAGTCATATCAATTAT | CTGAGTTT | chr17 | 42901851 | 42901870 | 42901867 | + |

Figure 89 (Cont'd)

| | | | | | | | |
|---|---|---|---|---|---|---|---|
| SEQ ID NO 58633 | GTCATATCAATTATCTGAGT | TTCTGTTT | chr17 | 42901857 | 42901876 | 42901873 | + |
| SEQ ID NO 58634 | TCTACAAATAGGTTATCTCT | GGCAGCTT | chr17 | 42901890 | 42901909 | 42901906 | + |
| SEQ ID NO 58635 | TGTGTGCCAGTCCATGTGCT | ATGTGCTT | chr17 | 42901950 | 42901969 | 42901966 | + |
| SEQ ID NO 58636 | AGAGACCAAGGTGCTGAGTT | AAATGATT | chr17 | 42902020 | 42902039 | 42902036 | + |
| SEQ ID NO 58637 | ATGGAAGCCCAGGTAGGCAG | GCTGGCTT | chr17 | 42902080 | 42902099 | 42902096 | + |
| SEQ ID NO 58638 | CTGGGGAGCAGGGGAAAGCC | CTGAGTTT | chr17 | 42902162 | 42902181 | 42902178 | + |
| SEQ ID NO 58639 | CCACTTTCTTTCTTTCTTTC | TTTTGTTT | chr17 | 42902231 | 42902250 | 42902247 | + |
| SEQ ID NO 58640 | TTTCTTTCTTTCTTTCTTTT | GTTTGTTT | chr17 | 42902235 | 42902254 | 42902251 | + |
| SEQ ID NO 58641 | TTTCTTTCTTTCTTTTGTTT | GTTTGTTT | chr17 | 42902239 | 42902258 | 42902255 | + |
| SEQ ID NO 58642 | AACCTCTGCCTCTCCGGTTC | AAGTGATT | chr17 | 42902327 | 42902346 | 42902343 | + |
| SEQ ID NO 58643 | TGCCTCAGCCTCCCAAGTAG | CTGGGATT | chr17 | 42902359 | 42902378 | 42902375 | + |
| SEQ ID NO 58644 | TTTTGTATTTTTAGTAGAGA | CATGGTTT | chr17 | 42902419 | 42902438 | 42902435 | + |
| SEQ ID NO 58645 | TGCCTTGGCCTCCCTAAGTG | CTAGGATT | chr17 | 42902495 | 42902514 | 42902511 | + |
| SEQ ID NO 58646 | GTGAGCCACTACACCCAGCC | GCATGATT | chr17 | 42902529 | 42902548 | 42902545 | + |
| SEQ ID NO 58647 | AGGCCAGAGTTAGTGGCTCT | CCCTGATT | chr17 | 42902636 | 42902655 | 42902652 | + |
| SEQ ID NO 58648 | TCTAGTACTTTTAAAGGGGA | AGTGGTTT | chr17 | 42902749 | 42902768 | 42902765 | + |
| SEQ ID NO 58649 | GAAGTGGTTTGTCTGAGATA | CTCTGTTT | chr17 | 42902767 | 42902786 | 42902783 | + |
| SEQ ID NO 58650 | AATTCTGATGGAAATGCAGG | CCATGTTT | chr17 | 42902852 | 42902871 | 42902868 | + |
| SEQ ID NO 58651 | TCTCTGATGTCAGAGGAAAT | GCAAGATT | chr17 | 42902916 | 42902935 | 42902932 | + |
| SEQ ID NO 58652 | AACCCATGGTATATGCAAGT | CCAAGTTT | chr17 | 42902960 | 42902979 | 42902976 | + |
| SEQ ID NO 58653 | AAGTCACATAGCTGCCATTT | TATGGATT | chr17 | 42903047 | 42903066 | 42903063 | + |
| SEQ ID NO 58654 | TAGCTGCCATTTTATGGATT | TCAGGATT | chr17 | 42903055 | 42903074 | 42903071 | + |
| SEQ ID NO 58655 | AACCTCCGCCTCCCAGGTTC | AAGCGATT | chr17 | 42903161 | 42903180 | 42903177 | + |
| SEQ ID NO 58656 | TGCCTTAGCCTCCCGAGTAG | CTGGGATT | chr17 | 42903193 | 42903212 | 42903209 | + |
| SEQ ID NO 58657 | TTTATATTTTTGGTAGAAA | CGGTGTTT | chr17 | 42903252 | 42903271 | 42903268 | + |
| SEQ ID NO 58658 | TGCCTTGGCCTCCCAAAGTG | CTGAGATT | chr17 | 42903330 | 42903349 | 42903346 | + |
| SEQ ID NO 58659 | CCTGCCTGGAGTTCAGAATC | TTGGGCTT | chr17 | 42903377 | 42903396 | 42903393 | + |
| SEQ ID NO 58660 | AGAATCTTGGGCTTCATTAT | TTGTGTTT | chr17 | 42903391 | 42903410 | 42903407 | + |
| SEQ ID NO 58661 | CACTTTGGGAGGCTGAGGTG | GGAGGATT | chr17 | 42903466 | 42903485 | 42903482 | + |
| SEQ ID NO 58662 | GAGGTAGAGGTCACAATGAG | CCGAGATT | chr17 | 42903633 | 42903652 | 42903649 | + |
| SEQ ID NO 58663 | GCTACACTCTTCTTGAAGGT | GTAGGCTT | chr17 | 42903850 | 42903869 | 42903866 | + |
| SEQ ID NO 58664 | TCAGTAACCCCAGAAACTTG | TTCTGTTT | chr17 | 42903895 | 42903914 | 42903911 | + |
| SEQ ID NO 58665 | GAAACTTGTTCTGTTTTTCC | ATAGGATT | chr17 | 42903907 | 42903926 | 42903923 | + |
| SEQ ID NO 58666 | TTTGGACAGCGTCCATACTG | GTGGGTTT | chr17 | 42903938 | 42903957 | 42903954 | + |
| SEQ ID NO 58667 | GCAGACAGAAGCTGAGTGGA | CCTCGTTT | chr17 | 42904059 | 42904078 | 42904075 | + |
| SEQ ID NO 58668 | AGAAGGAGGGGGCAGAAGC | CTGAGCTT | chr17 | 42904317 | 42904336 | 42904333 | + |
| SEQ ID NO 58669 | ATCCCTTGCCCTCTCTGTGC | CTACGTTT | chr17 | 42904404 | 42904423 | 42904420 | + |
| SEQ ID NO 58670 | TGGTTACTGTCAAATCAAAT | GATAGATT | chr17 | 42904449 | 42904468 | 42904465 | + |
| SEQ ID NO 58671 | CTGGGAGGCTGAGGCAGGAG | AATCGCTT | chr17 | 42905003 | 42905022 | 42905019 | + |
| SEQ ID NO 58672 | TCAGGAGGCTAAGGCAGGAG | AATCGCTT | chr17 | 42905316 | 42905335 | 42905332 | + |
| SEQ ID NO 58673 | TGAACCTGGGAGGTGGTGAG | CCAAGATT | chr17 | 42905343 | 42905362 | 42905359 | + |
| SEQ ID NO 58674 | CACACACATATAATACTAGA | AAATGATT | chr17 | 42905469 | 42905488 | 42905485 | + |
| SEQ ID NO 58675 | CACATATAATACTAGAAAAT | GATTGTTT | chr17 | 42905473 | 42905492 | 42905489 | + |
| SEQ ID NO 58676 | ACCAAACATCTTTTGTAGAA | ATATGTTT | chr17 | 42905560 | 42905579 | 42905576 | + |
| SEQ ID NO 58677 | AACATCTTTTGTAGAAATAT | GTTTGCTT | chr17 | 42905564 | 42905583 | 42905580 | + |
| SEQ ID NO 58678 | AATATGTTTGCTTTCATCAT | AACAGCTT | chr17 | 42905579 | 42905598 | 42905595 | + |
| SEQ ID NO 58679 | ATTAATGGAGGCACAGACTG | GAAAGTTT | chr17 | 42905634 | 42905653 | 42905650 | + |
| SEQ ID NO 58680 | GCACAGACTGGAAAGTTTAA | AGTGGCTT | chr17 | 42905644 | 42905663 | 42905660 | + |
| SEQ ID NO 58681 | CAGGTGGATCACCTGAGGTC | AGGAGTTT | chr17 | 42905813 | 42905832 | 42905829 | + |
| SEQ ID NO 58682 | ACTCCAGCCTTGGTGACAGA | GAAAGATT | chr17 | 42906011 | 42906030 | 42906027 | + |

Figure 89 (Cont'd)

| | | | | | | | |
|---|---|---|---|---|---|---|---|
| SEQ ID NO 58683 | TTCTGTCAGGAAAAAAAAAA | AAAAGTTT | chr17 | 42906037 | 42906056 | 42906053 | + |
| SEQ ID NO 58684 | CCCTGGAAAGCAGGCTGAAA | TGGAGATT | chr17 | 42906193 | 42906212 | 42906209 | + |
| SEQ ID NO 58685 | TGAAATGGAGATTCACGTGC | AGGAGTTT | chr17 | 42906208 | 42906227 | 42906224 | + |
| SEQ ID NO 58686 | GGGCAGAAGGAGAGGTCCGG | TTGTGATT | chr17 | 42906282 | 42906301 | 42906298 | + |
| SEQ ID NO 58687 | ACTTTGGGAGGCCAAGGGTA | GGAGGATT | chr17 | 42906631 | 42906650 | 42906647 | + |
| SEQ ID NO 58688 | TGGGAGGCCAAGGGTAGGAG | GATTGCTT | chr17 | 42906635 | 42906654 | 42906651 | + |
| SEQ ID NO 58689 | CTACTCAGGGGGCTGAGGTG | GGAGGATT | chr17 | 42906767 | 42906786 | 42906783 | + |
| SEQ ID NO 58690 | TCAGGGGGCTGAGGTGGGAG | GATTGCTT | chr17 | 42906771 | 42906790 | 42906787 | + |
| SEQ ID NO 58691 | GTCTTCAAGGATGTGAGGAA | GTAAGTTT | chr17 | 42906984 | 42907003 | 42907000 | + |
| SEQ ID NO 58692 | GTGAAGGGCTGTCTGGCCAG | AGAAGATT | chr17 | 42907026 | 42907045 | 42907042 | + |
| SEQ ID NO 58693 | GCAAAAGCCCTGAGGTGGGA | ACGTGTTT | chr17 | 42907059 | 42907078 | 42907075 | + |
| SEQ ID NO 58694 | CTGAGGTGGGAACGTGTTTG | GTGTGTTT | chr17 | 42907068 | 42907087 | 42907084 | + |
| SEQ ID NO 58695 | ACAGAAGATGTGGAGGGCAG | ATCAGTTT | chr17 | 42907151 | 42907170 | 42907167 | + |
| SEQ ID NO 58696 | TTGTAATTGTACGCCCAGTA | TGCTGATT | chr17 | 42907177 | 42907196 | 42907193 | + |
| SEQ ID NO 58697 | CTGCAAGAGCAGGGCCCCTC | TCTGGCTT | chr17 | 42907233 | 42907252 | 42907249 | + |
| SEQ ID NO 58698 | TGTATTCCCAGAGCCTTGCA | CAATGCTT | chr17 | 42907271 | 42907290 | 42907287 | + |
| SEQ ID NO 58699 | AGGGAAAGATAAAGCCGACC | TACAGATT | chr17 | 42907598 | 42907617 | 42907614 | + |
| SEQ ID NO 58700 | CGCTCCCACACCTGGGCAGC | CGCTGATT | chr17 | 42907725 | 42907744 | 42907741 | + |
| SEQ ID NO 58701 | GGATAAACCTCAGAGTCAGG | GAATGTTT | chr17 | 42907776 | 42907795 | 42907792 | + |
| SEQ ID NO 58702 | AGGGATCCAGTAGTGCAATC | CGTTGTTT | chr17 | 42907812 | 42907831 | 42907828 | + |
| SEQ ID NO 58703 | ATAAGGTAGTGAAGTAGCAG | CAGGGCTT | chr17 | 42907886 | 42907905 | 42907902 | + |
| SEQ ID NO 58704 | GCTGGTCTTGATCTCAAGCA | ATTGGCTT | chr17 | 42908248 | 42908267 | 42908264 | + |
| SEQ ID NO 58705 | TGCCTCAGCCTCCTAAAATA | TTGGGATT | chr17 | 42908275 | 42908294 | 42908291 | + |
| SEQ ID NO 58706 | CCATCTCGCCTCACTGCAAC | CTCCGCTT | chr17 | 42908469 | 42908488 | 42908485 | + |
| SEQ ID NO 58707 | TTTTTTATTTTTAGTAGAGA | TGGGGTTT | chr17 | 42908575 | 42908594 | 42908591 | + |
| SEQ ID NO 58708 | CGCCTCAGCCTCCCAAAGTG | CTGGGATT | chr17 | 42908651 | 42908670 | 42908667 | + |
| SEQ ID NO 58709 | TTTTTTTTTTTTTTTTGAGA | CGGAGTTT | chr17 | 42908705 | 42908724 | 42908721 | + |
| SEQ ID NO 58710 | TGCCTCAGCCTCTCAAATAG | CTGGGATT | chr17 | 42908815 | 42908834 | 42908831 | + |
| SEQ ID NO 58711 | AATTTTTTTTTTAGTAGAGA | TGGGGTTT | chr17 | 42908877 | 42908896 | 42908893 | + |
| SEQ ID NO 58712 | CACCTCGGCCTCCCAAAGTG | CTGGGATT | chr17 | 42908954 | 42908973 | 42908970 | + |
| SEQ ID NO 58713 | CACCTCGGCCTCCCAAAGTA | TTGGGATT | chr17 | 42909090 | 42909109 | 42909106 | + |
| SEQ ID NO 58714 | GCATCTTTGGACTTTTGAGT | ACTGGCTT | chr17 | 42909152 | 42909171 | 42909168 | + |
| SEQ ID NO 58715 | AAAAATTCCACTGAGAGCAC | CTAAGTTT | chr17 | 42909188 | 42909207 | 42909204 | + |
| SEQ ID NO 58716 | GGCTCCAACATTTCTGCAGG | GGCTGTTT | chr17 | 42909220 | 42909239 | 42909236 | + |
| SEQ ID NO 58717 | ATGGTTGCCTCTTCTGTTGC | AGGTGCTT | chr17 | 42909281 | 42909300 | 42909297 | + |
| SEQ ID NO 58718 | GCTTGAATGTCATTTTGTGG | TTGGGATT | chr17 | 42909305 | 42909324 | 42909321 | + |
| SEQ ID NO 58719 | TCCTTCTCCCCAAACCCCA | TTCCGTTT | chr17 | 42909441 | 42909460 | 42909457 | + |
| SEQ ID NO 58720 | AGTCAAGAATGAGCAACTTG | AAATGATT | chr17 | 42909551 | 42909570 | 42909567 | + |
| SEQ ID NO 58721 | AAATTAACGCACCAAATTGA | ATTAGCTT | chr17 | 42909637 | 42909656 | 42909653 | + |
| SEQ ID NO 58722 | ATTGAATTAGCTTGAAATCT | CAGAGCTT | chr17 | 42909652 | 42909671 | 42909668 | + |
| SEQ ID NO 58723 | GTTGATCTCTTTTATAGGTT | CAGAGTTT | chr17 | 42909823 | 42909842 | 42909839 | + |
| SEQ ID NO 58724 | TTATAGGTTCAGAGTTTTGA | ATATGTTT | chr17 | 42909834 | 42909853 | 42909850 | + |
| SEQ ID NO 58725 | AGAGTTTTGAATATGTTTTT | TTTTGTTT | chr17 | 42909844 | 42909863 | 42909860 | + |
| SEQ ID NO 58726 | TTTTGTATTTTTAGCAGAGA | CGGGGTTT | chr17 | 42910033 | 42910052 | 42910049 | + |
| SEQ ID NO 58727 | CGCCTCGGCCTCCCAAAGCG | CTGGGATT | chr17 | 42910097 | 42910116 | 42910113 | + |
| SEQ ID NO 58728 | CCACCGCACCCTGCCTGAAT | ATGTGTTT | chr17 | 42910136 | 42910155 | 42910152 | + |
| SEQ ID NO 58729 | ATCCAATTAACAAGGGTAAG | ACAAGATT | chr17 | 42910170 | 42910189 | 42910186 | + |
| SEQ ID NO 58730 | AAGATTTAAGTTAAGCATAA | GAAAGATT | chr17 | 42910192 | 42910211 | 42910208 | + |
| SEQ ID NO 58731 | AAACTGTGGAATTTCTCCCC | TGGAGATT | chr17 | 42910253 | 42910272 | 42910269 | + |
| SEQ ID NO 58732 | ATGTTGAGAACAAGGGAGAT | AATGGTTT | chr17 | 42910315 | 42910334 | 42910331 | + |

Figure 89 (Cont'd)

| | | | | | | | |
|---|---|---|---|---|---|---|---|
| SEQ ID NO 58733 | ACAGCATTTAGTACTGGGTT | CCATGTTT | chr17 | 42910364 | 42910383 | 42910380 | + |
| SEQ ID NO 58734 | ATATCACATGAAAAACCTGG | GAATGTTT | chr17 | 42910411 | 42910430 | 42910427 | + |
| SEQ ID NO 58735 | TTCAAATGTGTGACAGAGGG | ACTAGATT | chr17 | 42910460 | 42910479 | 42910476 | + |
| SEQ ID NO 58736 | ATAGACAGTATTAGAGGGGG | ACCAGTTT | chr17 | 42910525 | 42910544 | 42910541 | + |
| SEQ ID NO 58737 | GTAGGAAATTTGCATACGGT | GGGAGATT | chr17 | 42910674 | 42910693 | 42910690 | + |
| SEQ ID NO 58738 | GCGACCCTCCCATCTGCCAT | CTGTGATT | chr17 | 42910777 | 42910796 | 42910793 | + |
| SEQ ID NO 58739 | ATCCTTCCTATCTCTCACAG | TCATGCTT | chr17 | 42910875 | 42910894 | 42910891 | + |
| SEQ ID NO 58740 | TTCTCATTACCTTCTTCCTG | TTCAGCTT | chr17 | 42910981 | 42911000 | 42910997 | + |
| SEQ ID NO 58741 | TCTTCCTGTTCAGCTTCGCC | ATCGGATT | chr17 | 42910993 | 42911012 | 42911009 | + |
| SEQ ID NO 58742 | TGTAAGAGATGTGGAGTCTT | CGGTGTTT | chr17 | 42911422 | 42911441 | 42911438 | + |
| SEQ ID NO 58743 | TTTAAAGTCAACAACCATGC | CAGGGATT | chr17 | 42911447 | 42911466 | 42911463 | + |
| SEQ ID NO 58744 | CGTGGAATTAAATCACGGAT | GGCAGATT | chr17 | 42911545 | 42911564 | 42911561 | + |
| SEQ ID NO 58745 | GATGGCAGATTGGAGGGTCG | CCTGGCTT | chr17 | 42911562 | 42911581 | 42911578 | + |
| SEQ ID NO 58746 | CCATATCACGTACACCATAT | GCAAGTTT | chr17 | 42911645 | 42911664 | 42911661 | + |
| SEQ ID NO 58747 | ACAATCCTAATCATATTGGG | TAATGTTT | chr17 | 42911820 | 42911839 | 42911836 | + |
| SEQ ID NO 58748 | GTTGCTAGAAGTTGGGTTGT | TCTGGATT | chr17 | 42911881 | 42911900 | 42911897 | + |
| SEQ ID NO 58749 | GAAAAGAAGGCTGCCTAAGG | AGGAGTTT | chr17 | 42912066 | 42912085 | 42912082 | + |
| SEQ ID NO 58750 | GCTATGCCAAGCCATGTCTA | AATGGCTT | chr17 | 42912119 | 42912138 | 42912135 | + |
| SEQ ID NO 58751 | TGCACTCTCAGTAATGGGGG | ACCAGCTT | chr17 | 42912161 | 42912180 | 42912177 | + |
| SEQ ID NO 58752 | ATAGATGGTTAGTGGGGTAA | TTCTGCTT | chr17 | 42912200 | 42912219 | 42912216 | + |
| SEQ ID NO 58753 | ATACATGTTCATCGTATTTC | CTTGGATT | chr17 | 42912249 | 42912268 | 42912265 | + |
| SEQ ID NO 58754 | CATCCTCCTTATAAGCCCAG | CTCTGCTT | chr17 | 42912358 | 42912377 | 42912374 | + |
| SEQ ID NO 58755 | ATAAGCCCAGCTCTGCTTTT | TCCAGATT | chr17 | 42912368 | 42912387 | 42912384 | + |
| SEQ ID NO 58756 | AGGCTAGAGGGCGACTCTGG | TGGTGCTT | chr17 | 42912435 | 42912454 | 42912451 | + |
| SEQ ID NO 58757 | GCGACTCTGGTGGTGCTTTT | GTATGTTT | chr17 | 42912445 | 42912464 | 42912461 | + |
| SEQ ID NO 58758 | GCAAATGACAAGGGGAGGG | CCAGGATT | chr17 | 42912495 | 42912514 | 42912511 | + |
| SEQ ID NO 58759 | CAGCTAGCCAACTCCTCCTT | GCCTGCTT | chr17 | 42912770 | 42912789 | 42912786 | + |
| SEQ ID NO 58760 | CAACCTCTTCCTCCTGGTTC | AAGCGATT | chr17 | 42912874 | 42912893 | 42912890 | + |
| SEQ ID NO 58761 | TTTTTAGAATTTTAGAAGAG | ATGGGATT | chr17 | 42912970 | 42912989 | 42912986 | + |
| SEQ ID NO 58762 | TGCCTTGGCCTCCCAAGGTG | CTAGGATT | chr17 | 42913049 | 42913068 | 42913065 | + |
| SEQ ID NO 58763 | CACCGCACCGGGCCCTCCTT | GCCTGTTT | chr17 | 42913089 | 42913108 | 42913105 | + |
| SEQ ID NO 58764 | AAGCCTATTTATTTGAAAGT | CCTTGTTT | chr17 | 42913179 | 42913198 | 42913195 | + |
| SEQ ID NO 58765 | ATTTTAGATGCAATGTGATC | TGAAGTTT | chr17 | 42913350 | 42913369 | 42913366 | + |
| SEQ ID NO 58766 | TGGCCCAACTAAATTTCTAG | CTCTGTTT | chr17 | 42913385 | 42913404 | 42913401 | + |
| SEQ ID NO 58767 | CTGTTTCCCTAAACAAATAA | TTTGGTTT | chr17 | 42913407 | 42913426 | 42913423 | + |
| SEQ ID NO 58768 | CCAAAATCAGCATAGAACCA | GAAAGATT | chr17 | 42913566 | 42913585 | 42913582 | + |
| SEQ ID NO 58769 | ATCCAGTAACTCAGTGTCAG | CAAGGTTT | chr17 | 42913758 | 42913777 | 42913774 | + |
| SEQ ID NO 58770 | GAATGCTCAAGGGAGCTATT | GCAGGTTT | chr17 | 42913834 | 42913853 | 42913850 | + |
| SEQ ID NO 58771 | CTATTGCAGGTTTCTCTGCT | AAGAGATT | chr17 | 42913849 | 42913868 | 42913865 | + |
| SEQ ID NO 58772 | CCTCAAATCATCACCGTATC | AATGGATT | chr17 | 42913913 | 42913932 | 42913929 | + |
| SEQ ID NO 58773 | TCCGGAGTCTGTATATTCAG | GGAAGATT | chr17 | 42913976 | 42913995 | 42913992 | + |
| SEQ ID NO 58774 | AGGGAAGATTGCATTCTCCT | ACTGGATT | chr17 | 42913994 | 42914013 | 42914010 | + |
| SEQ ID NO 58775 | TGCCTCAGCCTCCCAAAGTG | CTGGGATT | chr17 | 42914181 | 42914200 | 42914197 | + |
| SEQ ID NO 58776 | TGGGATTACAGTGTGAGCCA | CTGCGCTT | chr17 | 42914202 | 42914221 | 42914218 | + |
| SEQ ID NO 58777 | AGCCACTGCGCTTGGCCAGA | AATGGTTT | chr17 | 42914217 | 42914236 | 42914233 | + |
| SEQ ID NO 58778 | GATCTGTCTGAACTGAACCC | TACTGCTT | chr17 | 42914246 | 42914265 | 42914262 | + |
| SEQ ID NO 58779 | TAAATACTGCCCCACTCCC | TGAAGTTT | chr17 | 42914354 | 42914373 | 42914370 | + |
| SEQ ID NO 58780 | TGATAAGAAAACATAACAGA | TAAAGTTT | chr17 | 42914389 | 42914408 | 42914405 | + |
| SEQ ID NO 58781 | TTATTGAGTGCTAACTTTAT | GCCAGATT | chr17 | 42914415 | 42914434 | 42914431 | + |
| SEQ ID NO 58782 | GTACTTTATTTATACAATTA | ACTCGCTT | chr17 | 42914452 | 42914471 | 42914468 | + |

Figure 89 (Cont'd)

| | | | | | | | |
|---|---|---|---|---|---|---|---|
| SEQ ID NO 58783 | GCACTTTGGGAGGCTGAGGT | GGCAGATT | chr17 | 42914633 | 42914652 | 42914649 | + |
| SEQ ID NO 58784 | AGCTCAGAGGTTGCAGTGAG | CCAAGATT | chr17 | 42914803 | 42914822 | 42914819 | + |
| SEQ ID NO 58785 | AATAATCATTTTGTAATATA | TCCTGCTT | chr17 | 42914949 | 42914968 | 42914965 | + |
| SEQ ID NO 58786 | CACTCATCTGTTCCCTAAGT | TATAGATT | chr17 | 42914997 | 42915016 | 42915013 | + |
| SEQ ID NO 58787 | AGATTTACGTCCACTTTAGA | AATGGCTT | chr17 | 42915020 | 42915039 | 42915036 | + |
| SEQ ID NO 58788 | CTTTAGAAATGGCTTGTGAG | GCAAGTTT | chr17 | 42915033 | 42915052 | 42915049 | + |
| SEQ ID NO 58789 | GGCAAGTTTAAGTGACCGAT | GACAGTTT | chr17 | 42915052 | 42915071 | 42915068 | + |
| SEQ ID NO 58790 | GTAGAATGTTCTAGTAGTGT | ATCAGTTT | chr17 | 42915116 | 42915135 | 42915132 | + |
| SEQ ID NO 58791 | AGTGTATCAGTTTTCAGGTG | GTAGGCTT | chr17 | 42915131 | 42915150 | 42915147 | + |
| SEQ ID NO 58792 | TGCCACATCACACATAGACC | AAAGGCTT | chr17 | 42915259 | 42915278 | 42915275 | + |
| SEQ ID NO 58793 | ATCACACATAGACCAAAGGC | TTAGGTTT | chr17 | 42915265 | 42915284 | 42915281 | + |
| SEQ ID NO 58794 | AGACCAAAGGCTTAGGTTTT | TGTGGTTT | chr17 | 42915274 | 42915293 | 42915290 | + |
| SEQ ID NO 58795 | GCATGAGCTGCTGCACTCAG | CCATGTTT | chr17 | 42915589 | 42915608 | 42915605 | + |
| SEQ ID NO 58796 | GCTGCTGCACTCAGCCATGT | TTTTGATT | chr17 | 42915595 | 42915614 | 42915611 | + |
| SEQ ID NO 58797 | TTGAGAGGCTGAGACAGGAG | AACTGCTT | chr17 | 42915831 | 42915850 | 42915847 | + |
| SEQ ID NO 58798 | AAAAAAAAAAAAAGCTGTAT | AACAGCTT | chr17 | 42915941 | 42915960 | 42915957 | + |
| SEQ ID NO 58799 | TCATTTAAAGTGTACAATTC | AGGGGTTT | chr17 | 42916000 | 42916019 | 42916016 | + |
| SEQ ID NO 58800 | CACTAATCTACTTTCTGTCT | CATAGATT | chr17 | 42916062 | 42916081 | 42916078 | + |
| SEQ ID NO 58801 | CTGGCCTCTTTCACTTAGCA | TGATGTTT | chr17 | 42916146 | 42916165 | 42916162 | + |
| SEQ ID NO 58802 | TTCACTTAGCATGATGTTTT | CAAGGTTT | chr17 | 42916155 | 42916174 | 42916171 | + |
| SEQ ID NO 58803 | GAATATACCACATTTTATTT | ATCTGTTT | chr17 | 42916265 | 42916284 | 42916281 | + |
| SEQ ID NO 58804 | CACTTTGGGAGGCTGAGGCA | GGAGGATT | chr17 | 42916331 | 42916350 | 42916347 | + |
| SEQ ID NO 58805 | TGCCTCAGCCTCCCAAAGTG | CTGGGATT | chr17 | 42916331 | 42916350 | 42916334 | - |
| SEQ ID NO 58806 | GGCAAATCTATGAGACAGAA | AGTAGATT | chr17 | 42916074 | 42916093 | 42916077 | - |
| SEQ ID NO 58807 | GAAAGTAGATTAGTGGTTGC | CTAGGCTT | chr17 | 42916057 | 42916076 | 42916060 | - |
| SEQ ID NO 58808 | AATTATATCTCAAGCTGTTA | TACAGCTT | chr17 | 42915960 | 42915979 | 42915963 | - |
| SEQ ID NO 58809 | AGCTTTTTTTTTTTTTGAGA | TGGAGTTT | chr17 | 42915937 | 42915956 | 42915940 | - |
| SEQ ID NO 58810 | TGTCTCAGCCTCTCAAGTAG | CTGGGATT | chr17 | 42915827 | 42915846 | 42915830 | - |
| SEQ ID NO 58811 | TTTTGTATTTTAGTAGAGA | CGCGGTTT | chr17 | 42915769 | 42915788 | 42915772 | - |
| SEQ ID NO 58812 | ATCTCAGGTGATCTGCCTGC | CTTGGCTT | chr17 | 42915714 | 42915733 | 42915717 | - |
| SEQ ID NO 58813 | TGCCTTGGCTTCCCAAAGTG | CTGGGATT | chr17 | 42915697 | 42915716 | 42915700 | - |
| SEQ ID NO 58814 | TTTGGGAGGCTAAGGCGGGA | GGATGCTT | chr17 | 42915554 | 42915573 | 42915557 | - |
| SEQ ID NO 58815 | GAGTTGGAGGTTGCAGTGAG | CTGAGATT | chr17 | 42915419 | 42915438 | 42915422 | - |
| SEQ ID NO 58816 | ATGCCATAACATGACATGGA | CCTTGCTT | chr17 | 42915090 | 42915109 | 42915093 | - |
| SEQ ID NO 58817 | AATAAGCAGGATATATTACA | AAATGATT | chr17 | 42914960 | 42914979 | 42914963 | - |
| SEQ ID NO 58818 | ACAAAATGATTATTTTGTAT | CTGGGATT | chr17 | 42914943 | 42914962 | 42914946 | - |
| SEQ ID NO 58819 | GAGCCACAGCACCCAGCCCA | GACTGCTT | chr17 | 42914907 | 42914926 | 42914910 | - |
| SEQ ID NO 58820 | CACAGCACCCAGCCCAGACT | GCTTGCTT | chr17 | 42914903 | 42914922 | 42914906 | - |
| SEQ ID NO 58821 | TCACTGCAACCTCTGAGCTC | AAGGGATT | chr17 | 42914802 | 42914821 | 42914805 | - |
| SEQ ID NO 58822 | AGGACCACAGGCATGCACCA | CCACGCTT | chr17 | 42914748 | 42914767 | 42914751 | - |
| SEQ ID NO 58823 | CATGCACCACCACGCTTGGC | TAATGTTT | chr17 | 42914737 | 42914756 | 42914740 | - |
| SEQ ID NO 58824 | CACCTCAGCCTCCCAAAGTG | CTGGGATT | chr17 | 42914634 | 42914653 | 42914637 | - |
| SEQ ID NO 58825 | CACTCAATAAACTTTATCTG | TTATGTTT | chr17 | 42914405 | 42914424 | 42914408 | - |
| SEQ ID NO 58826 | GGACTTGGTCCTTGGGAGCA | AATAGATT | chr17 | 42914303 | 42914322 | 42914306 | - |
| SEQ ID NO 58827 | CTTTCTCCCTGGTTGGGACC | ATTTGATT | chr17 | 42914071 | 42914090 | 42914074 | - |
| SEQ ID NO 58828 | GGAGTTCAGGTGTGAAATAG | CGGAGCTT | chr17 | 42913959 | 42913978 | 42913962 | - |
| SEQ ID NO 58829 | CAGGAAATCCATTGATACGG | TGATGATT | chr17 | 42913926 | 42913945 | 42913929 | - |
| SEQ ID NO 58830 | TTCCTTGGTGCTGTGACTGG | CTCTGTTT | chr17 | 42913817 | 42913836 | 42913820 | - |
| SEQ ID NO 58831 | AACCTTGCTGACACTGAGTT | ACTGGATT | chr17 | 42913765 | 42913784 | 42913768 | - |
| SEQ ID NO 58832 | GTGTTACTGCAACTTGTGTG | CCCTGATT | chr17 | 42913715 | 42913734 | 42913718 | - |

Figure 89 (Cont'd)

| SEQ ID NO 58833 | TACTGCAACTTGTGTGCCCT | GATTGCTT | chr17 | 42913711 | 42913730 | 42913714 | - |
| SEQ ID NO 58834 | TCTGAATCTTTCTGGTTCTA | TGCTGATT | chr17 | 42913578 | 42913597 | 42913581 | - |
| SEQ ID NO 58835 | GTTCTATGCTGATTTTGGGC | CTCCGTTT | chr17 | 42913564 | 42913583 | 42913567 | - |
| SEQ ID NO 58836 | AGGCACAGAGAAACCAAATT | ATTTGTTT | chr17 | 42913425 | 42913444 | 42913428 | - |
| SEQ ID NO 58837 | GACTTTATTCTTAAATAAAA | TGTTGCTT | chr17 | 42913316 | 42913335 | 42913319 | - |
| SEQ ID NO 58838 | AAAGATGTTATGAGCAGGAT | GGTTGTTT | chr17 | 42913254 | 42913273 | 42913257 | - |
| SEQ ID NO 58839 | AAACAAGGACTTTCAAATAA | ATAGGCTT | chr17 | 42913187 | 42913206 | 42913190 | - |
| SEQ ID NO 58840 | GGACTTTCAAATAAATAGGC | TTCAGCTT | chr17 | 42913181 | 42913200 | 42913184 | - |
| SEQ ID NO 58841 | AGAAATACTCTGCATATCAG | ATGAGATT | chr17 | 42913128 | 42913147 | 42913131 | - |
| SEQ ID NO 58842 | TGAGGAGGCTGAGACATGAG | AATCGCTT | chr17 | 42912902 | 42912921 | 42912905 | - |
| SEQ ID NO 58843 | GGAGTTGGCTAGCTGGACAT | AGTGGCTT | chr17 | 42912765 | 42912784 | 42912768 | - |
| SEQ ID NO 58844 | ACGCTGTGGTAGGGTGGGAG | GACTGCTT | chr17 | 42912712 | 42912731 | 42912715 | - |
| SEQ ID NO 58845 | CCTTTAAGAATGTGCTCTTG | GTTGGCTT | chr17 | 42912599 | 42912618 | 42912602 | - |
| SEQ ID NO 58846 | CCCTCCCCTTGTCATTTTGC | CCAAGATT | chr17 | 42912495 | 42912514 | 42912498 | - |
| SEQ ID NO 58847 | AGAATCTGGAAAAGCAGAG | CTGGGCTT | chr17 | 42912378 | 42912397 | 42912381 | - |
| SEQ ID NO 58848 | AGGAGATGTCAGCTATACCT | GAATGTTT | chr17 | 42912324 | 42912343 | 42912327 | - |
| SEQ ID NO 58849 | TATAATTAAAGCCATTTAGA | CATGGCTT | chr17 | 42912135 | 42912154 | 42912138 | - |
| SEQ ID NO 58850 | TTAGGCAGCCTTCTTTTCCT | ATCAGATT | chr17 | 42912064 | 42912083 | 42912067 | - |
| SEQ ID NO 58851 | TCTCAGTTAGGATCTCCAGC | CTGGGCTT | chr17 | 42911987 | 42912006 | 42911990 | - |
| SEQ ID NO 58852 | GAGCTGGCCCTACCTGGAAG | TCTTGCTT | chr17 | 42911957 | 42911976 | 42911960 | - |
| SEQ ID NO 58853 | TCTAGCAACAGGTCTTTCTC | AATAGCTT | chr17 | 42911870 | 42911889 | 42911873 | - |
| SEQ ID NO 58854 | AGGTCTTTCTCAATAGCTTC | ATTAGCTT | chr17 | 42911861 | 42911880 | 42911864 | - |
| SEQ ID NO 58855 | CTTTTCAAAAACATTACCCA | ATATGATT | chr17 | 42911836 | 42911855 | 42911839 | - |
| SEQ ID NO 58856 | AAAAACATTACCCAATATGA | TTAGGATT | chr17 | 42911830 | 42911849 | 42911833 | - |
| SEQ ID NO 58857 | GCGACCCTCCAATCTGCCAT | CCGTGATT | chr17 | 42911563 | 42911582 | 42911566 | - |
| SEQ ID NO 58858 | TTGCTCCAAATACCAGTGCC | CATTGCTT | chr17 | 42911501 | 42911520 | 42911504 | - |
| SEQ ID NO 58859 | AGACCAGCTCGACTTGGGAT | GGGGGTTT | chr17 | 42911297 | 42911316 | 42911300 | - |
| SEQ ID NO 58860 | GGCGGAATGGGAGCCACTTG | CTGAGTTT | chr17 | 42911219 | 42911238 | 42911222 | - |
| SEQ ID NO 58861 | TCTGGCTGCTCGCACCACCT | CTGGGCTT | chr17 | 42911079 | 42911098 | 42911082 | - |
| SEQ ID NO 58862 | TAGATGCTGTGGATGTGGCT | GAAAGTTT | chr17 | 42910938 | 42910957 | 42910941 | - |
| SEQ ID NO 58863 | AGCATGACTGTGAGAGATAG | GAAGGATT | chr17 | 42910882 | 42910901 | 42910885 | - |
| SEQ ID NO 58864 | ATTTGGGACCTTTGCTAGAG | GTGGGTTT | chr17 | 42910857 | 42910876 | 42910860 | - |
| SEQ ID NO 58865 | GATGGCAGATGGGAGGGTCG | CCTGGCTT | chr17 | 42910778 | 42910797 | 42910781 | - |
| SEQ ID NO 58866 | TCCATTTTATCTTTGAACGG | AATTGATT | chr17 | 42910588 | 42910607 | 42910591 | - |
| SEQ ID NO 58867 | TCTCTCTAACCTAAACATTC | CCAGGTTT | chr17 | 42910431 | 42910450 | 42910434 | - |
| SEQ ID NO 58868 | TTCCCAGGTTTTTCATGTGA | TATGGCTT | chr17 | 42910414 | 42910433 | 42910417 | - |
| SEQ ID NO 58869 | TACTAAATGCTGTGTTACTT | TTGTGATT | chr17 | 42910357 | 42910376 | 42910360 | - |
| SEQ ID NO 58870 | AATCTCCAGGGGAGAAATTC | CACAGTTT | chr17 | 42910261 | 42910280 | 42910264 | - |
| SEQ ID NO 58871 | TGCCTCCCACAAAATCTTTC | TTATGCTT | chr17 | 42910212 | 42910231 | 42910215 | - |
| SEQ ID NO 58872 | GTGGCTCACCCTTGTAATCC | CAGCGCTT | chr17 | 42910120 | 42910139 | 42910123 | - |
| SEQ ID NO 58873 | AATGGCGTGAACCCAGGAGG | TGGAGCTT | chr17 | 42909950 | 42909969 | 42909953 | - |
| SEQ ID NO 58874 | AGATCAACTGCAGTTATCTA | TTAGGTTT | chr17 | 42909811 | 42909830 | 42909814 | - |
| SEQ ID NO 58875 | CAAATGAATGTATTTAAATG | AACAGCTT | chr17 | 42909782 | 42909801 | 42909785 | - |
| SEQ ID NO 58876 | CGTGTTAATTTGTTAAATTT | GGCAGATT | chr17 | 42909743 | 42909762 | 42909746 | - |
| SEQ ID NO 58877 | TGTTGAAGACCAGTAAGAAA | TAAAGATT | chr17 | 42909693 | 42909712 | 42909696 | - |
| SEQ ID NO 58878 | AATAAAGATTGTAAAAGCT | CTGAGATT | chr17 | 42909675 | 42909694 | 42909678 | - |
| SEQ ID NO 58879 | ACCCACAGAAATGCTAACAG | TACTGATT | chr17 | 42909527 | 42909546 | 42909530 | - |
| SEQ ID NO 58880 | CACAGGATGTGGCTGGAATG | CTGGGATT | chr17 | 42909496 | 42909515 | 42909499 | - |
| SEQ ID NO 58881 | GCTGGAATGCTGGGATTTTG | TCCTGATT | chr17 | 42909485 | 42909504 | 42909488 | - |
| SEQ ID NO 58882 | GATTAGGGAGAGAAACGGAA | TGGGGTTT | chr17 | 42909461 | 42909480 | 42909464 | - |

Figure 89 (Cont'd)

| SEQ ID NO 58883 | ATGAGGAAAATGAGCAGCAA | GGTAGATT | chr17 | 42909374 | 42909393 | 42909377 | - |
|---|---|---|---|---|---|---|---|
| SEQ ID NO 58884 | GATCAAAATTGACCAGGCAC | GGTGGCTT | chr17 | 42908998 | 42909017 | 42909001 | - |
| SEQ ID NO 58885 | AATTGACCAGGCACGGTGGC | TTATGCTT | chr17 | 42908992 | 42909011 | 42908995 | - |
| SEQ ID NO 58886 | TGGGTGGATCACTTGAGGTC | AGGAGTTT | chr17 | 42908936 | 42908955 | 42908939 | - |
| SEQ ID NO 58887 | TTGAGAGGCTGAGGCAGGAG | AATTGCTT | chr17 | 42908811 | 42908830 | 42908814 | - |
| SEQ ID NO 58888 | TCGGTAGGCTGAGGCAGAAG | AATAGCTT | chr17 | 42908514 | 42908533 | 42908517 | - |
| SEQ ID NO 58889 | ACTCCAGCCTGGGCAACAGA | GCGAGATT | chr17 | 42908440 | 42908459 | 42908443 | - |
| SEQ ID NO 58890 | AATTTTAACTTCCCTATTTT | ATCTGTTT | chr17 | 42908355 | 42908374 | 42908358 | - |
| SEQ ID NO 58891 | TATTTTATCTGTTTGATAAT | TAAGGATT | chr17 | 42908341 | 42908360 | 42908344 | - |
| SEQ ID NO 58892 | TTAGGAGGCTGAGGCAAGCC | AATTGCTT | chr17 | 42908271 | 42908290 | 42908274 | - |
| SEQ ID NO 58893 | TCAGATGGCTGAGGTGGGAG | GATCGCTT | chr17 | 42908138 | 42908157 | 42908141 | - |
| SEQ ID NO 58894 | CATCTCAAAAATAAAAATAA | AAAGGATT | chr17 | 42908035 | 42908054 | 42908038 | - |
| SEQ ID NO 58895 | TTCTCTGTAGTAGGAATATC | TTCTGTTT | chr17 | 42907983 | 42908002 | 42907986 | - |
| SEQ ID NO 58896 | ACTCTGTGGTTGGTACAGAC | ATGGGTTT | chr17 | 42907928 | 42907947 | 42907931 | - |
| SEQ ID NO 58897 | TTATAAGTCCCTTCATGGTG | TTGGGCTT | chr17 | 42907864 | 42907883 | 42907867 | - |
| SEQ ID NO 58898 | AGTCCCTTCATGGTGTTGGG | CTTTGTTT | chr17 | 42907859 | 42907878 | 42907862 | - |
| SEQ ID NO 58899 | TGTTTCCTTATCTGTAAAAC | AACGGATT | chr17 | 42907836 | 42907855 | 42907839 | - |
| SEQ ID NO 58900 | GCCCAAACATTCCCTGACTC | TGAGGTTT | chr17 | 42907788 | 42907807 | 42907791 | - |
| SEQ ID NO 58901 | GTTCTTACCGAAATCTGTAG | GTCGGCTT | chr17 | 42907617 | 42907636 | 42907620 | - |
| SEQ ID NO 58902 | CCAGAGAGGGGCCCTGCTCT | TGCAGTTT | chr17 | 42907238 | 42907257 | 42907241 | - |
| SEQ ID NO 58903 | TCTTGCAGTTTAATACAGTC | TGGAGATT | chr17 | 42907221 | 42907240 | 42907224 | - |
| SEQ ID NO 58904 | TGTTCTGGCTACACTGGCCT | CATTGCTT | chr17 | 42907110 | 42907129 | 42907113 | - |
| SEQ ID NO 58905 | CACCAAACACGTTCCCACCT | CAGGGCTT | chr17 | 42907071 | 42907090 | 42907074 | - |
| SEQ ID NO 58906 | ACTCTGACCACGCTATTTAA | CCCTGCTT | chr17 | 42906932 | 42906951 | 42906935 | - |
| SEQ ID NO 58907 | TTAACCCTGCTTGCAACCGG | TTCCGTTT | chr17 | 42906916 | 42906935 | 42906919 | - |
| SEQ ID NO 58908 | GCAACCGGTTCCGTTTTTTT | ATTTGTTT | chr17 | 42906904 | 42906923 | 42906907 | - |
| SEQ ID NO 58909 | CCGGTTCCGTTTTTTTATTT | GTTTGTTT | chr17 | 42906900 | 42906919 | 42906903 | - |
| SEQ ID NO 58910 | CGTTTTTTTATTTGTTTGTT | TTTTGTTT | chr17 | 42906893 | 42906912 | 42906896 | - |
| SEQ ID NO 58911 | TTGTTTTTTAGAGACAGTG | TCTTGCTT | chr17 | 42906871 | 42906890 | 42906874 | - |
| SEQ ID NO 58912 | ACACACAGCAAATTTTTTAA | ATGTGTTT | chr17 | 42906723 | 42906742 | 42906726 | - |
| SEQ ID NO 58913 | CAGCAAATTTTTTAAATGTG | TTTTGTTT | chr17 | 42906718 | 42906737 | 42906721 | - |
| SEQ ID NO 58914 | AAATTTTTTAAATGTGTTTT | GTTTGTTT | chr17 | 42906714 | 42906733 | 42906717 | - |
| SEQ ID NO 58915 | TTTTTAAATGTGTTTTGTTT | GTTTGTTT | chr17 | 42906710 | 42906729 | 42906713 | - |
| SEQ ID NO 58916 | TAAATGTGTTTTGTTTGTTT | GTTTGATT | chr17 | 42906706 | 42906725 | 42906709 | - |
| SEQ ID NO 58917 | TGTGTTTTGTTTGTTTGTTT | GATTGTTT | chr17 | 42906702 | 42906721 | 42906705 | - |
| SEQ ID NO 58918 | GTTTGATTGTTTTGCCCAG | GCTGGTTT | chr17 | 42906686 | 42906705 | 42906689 | - |
| SEQ ID NO 58919 | ACCCTTGGCCTCCCAAAGTG | TTGGGATT | chr17 | 42906630 | 42906649 | 42906633 | - |
| SEQ ID NO 58920 | CTGTTGAGAGTGTGATGGTA | GATGGCTT | chr17 | 42906476 | 42906495 | 42906479 | - |
| SEQ ID NO 58921 | AAGGTTACGCTCTCCCCAGG | GTCTGATT | chr17 | 42906393 | 42906412 | 42906396 | - |
| SEQ ID NO 58922 | ACCAACTCTGAGGAGCCATC | CCCAGCTT | chr17 | 42906348 | 42906367 | 42906351 | - |
| SEQ ID NO 58923 | GCACGTGAATCTCCATTTCA | GCCTGCTT | chr17 | 42906208 | 42906227 | 42906211 | - |
| SEQ ID NO 58924 | AGGGAACCCCATAGATAAAT | AAAGGCTT | chr17 | 42906177 | 42906196 | 42906180 | - |
| SEQ ID NO 58925 | ACCAAGGCTGGAGTGCAGTG | GTGTGATT | chr17 | 42906005 | 42906024 | 42906008 | - |
| SEQ ID NO 58926 | AACCTCTGCCTCCCGGGTTG | AAGTGATT | chr17 | 42905965 | 42905984 | 42905968 | - |
| SEQ ID NO 58927 | TGCCGCAGCCTCCTGGGTAG | CTGGGATT | chr17 | 42905933 | 42905952 | 42905936 | - |
| SEQ ID NO 58928 | GCGCCCGCCACCATGCCTGG | CTAAGTTT | chr17 | 42905901 | 42905920 | 42905904 | - |
| SEQ ID NO 58929 | TTGTATTTTTTATTAGTGA | CGAGGTTT | chr17 | 42905873 | 42905892 | 42905876 | - |
| SEQ ID NO 58930 | TGCGTTGGCCTCCCAAAGTG | CTAGGATT | chr17 | 42905795 | 42905814 | 42905798 | - |
| SEQ ID NO 58931 | CCTAAGGAGCAGAGATAATA | ATTTGCTT | chr17 | 42905716 | 42905735 | 42905719 | - |
| SEQ ID NO 58932 | AGCAAACATATTTCTACAAA | AGATGTTT | chr17 | 42905571 | 42905590 | 42905574 | - |

Figure 89 (Cont'd)

| SEQ ID NO 58933 | GCTCACCACCTCCCAGGTTC | AAGCGATT | chr17 | 42905344 | 42905363 | 42905347 | - |
| SEQ ID NO 58934 | TGCCTTAGCCTCCTGAGTAG | CTCAGATT | chr17 | 42905312 | 42905331 | 42905315 | - |
| SEQ ID NO 58935 | TTTTGTATTTTAGTAGAGA | CAGGGTTT | chr17 | 42905255 | 42905274 | 42905258 | - |
| SEQ ID NO 58936 | CGCCTCAGCCTCCCAAAGTG | CTGGGATT | chr17 | 42905177 | 42905196 | 42905180 | - |
| SEQ ID NO 58937 | CCTGGCCTATCCTACATATT | AATAGTTT | chr17 | 42905131 | 42905150 | 42905134 | - |
| SEQ ID NO 58938 | AACCTCTGCCTCCCAGGTTC | AAGCGATT | chr17 | 42905031 | 42905050 | 42905034 | - |
| SEQ ID NO 58939 | TTTTTCCATTTTTAGTAAAG | ACAGGATT | chr17 | 42904943 | 42904962 | 42904946 | - |
| SEQ ID NO 58940 | GATTTTGCAATGTTGGCCAG | GCTGGTTT | chr17 | 42904919 | 42904938 | 42904922 | - |
| SEQ ID NO 58941 | ACCTCAGGTGATCTACCTAC | CTTGGCTT | chr17 | 42904881 | 42904900 | 42904884 | - |
| SEQ ID NO 58942 | TACCTTGGCTTCCCAAAGTG | CTGGGATT | chr17 | 42904864 | 42904883 | 42904867 | - |
| SEQ ID NO 58943 | GCATGAGCAACCACAACTGG | CCTAGTTT | chr17 | 42904832 | 42904851 | 42904835 | - |
| SEQ ID NO 58944 | TGTATATTTCACCTCCTCTA | TTCAGATT | chr17 | 42904785 | 42904804 | 42904788 | - |
| SEQ ID NO 58945 | AACAGTGTATAGCTCCCAGT | AGGTGCTT | chr17 | 42904689 | 42904708 | 42904692 | - |
| SEQ ID NO 58946 | CAAATAACTAAGGGACCTTC | CCTAGTTT | chr17 | 42904603 | 42904622 | 42904606 | - |
| SEQ ID NO 58947 | CTGAGACTTTAGGGTGAGGG | AGGGGCTT | chr17 | 42904506 | 42904525 | 42904509 | - |
| SEQ ID NO 58948 | TACTGAAAATGAAATCTATC | ATTTGATT | chr17 | 42904469 | 42904488 | 42904472 | - |
| SEQ ID NO 58949 | AACGTAGGCACAGAGAGGGC | AAGGGATT | chr17 | 42904411 | 42904430 | 42904414 | - |
| SEQ ID NO 58950 | TGGGAAGGACCCCCAGAAGC | TCAGGCTT | chr17 | 42904341 | 42904360 | 42904344 | - |
| SEQ ID NO 58951 | TCCATCCAGGTTCTGTAATA | GGCAGATT | chr17 | 42904227 | 42904246 | 42904230 | - |
| SEQ ID NO 58952 | TCTCCTCATGTCCCCTCAAG | GTCAGTTT | chr17 | 42904109 | 42904128 | 42904112 | - |
| SEQ ID NO 58953 | TAACAGGTAAACGAGGTCCA | CTCAGCTT | chr17 | 42904075 | 42904094 | 42904078 | - |
| SEQ ID NO 58954 | GCTTCTGTCTGCAGGGGCTG | GGACGCTT | chr17 | 42904051 | 42904070 | 42904054 | - |
| SEQ ID NO 58955 | CAGTCTCACAGGTTACAGGG | AACTGCTT | chr17 | 42904015 | 42904034 | 42904018 | - |
| SEQ ID NO 58956 | GAATCCTATGGAAAAACAGA | ACAAGTTT | chr17 | 42903916 | 42903935 | 42903919 | - |
| SEQ ID NO 58957 | AGTTTCTGGGGTTACTGAAT | GAATGCTT | chr17 | 42903893 | 42903912 | 42903896 | - |
| SEQ ID NO 58958 | TCAAGAAGAGTGTAGCCTGA | GAAGGATT | chr17 | 42903846 | 42903865 | 42903849 | - |
| SEQ ID NO 58959 | TATGTAACTTTTGCATTTTG | AACTGTTT | chr17 | 42903738 | 42903757 | 42903741 | - |
| SEQ ID NO 58960 | GGTGTGTGCCACCACATCCA | GCTAGTTT | chr17 | 42903570 | 42903589 | 42903573 | - |
| SEQ ID NO 58961 | TTTTGTATTTTAGTAGAGA | CGGGGTTT | chr17 | 42903544 | 42903563 | 42903547 | - |
| SEQ ID NO 58962 | CACCTCAGCCTCCCAAAGTG | CTGGGATT | chr17 | 42903466 | 42903485 | 42903469 | - |
| SEQ ID NO 58963 | TTAAACACAAATAATGAAGC | CCAAGATT | chr17 | 42903401 | 42903420 | 42903404 | - |
| SEQ ID NO 58964 | CAGGCAGATCACATGAGGTC | AGGAGTTT | chr17 | 42903312 | 42903331 | 42903315 | - |
| SEQ ID NO 58965 | GCCTGGCCAACATGGTGAAA | CACCGTTT | chr17 | 42903277 | 42903296 | 42903280 | - |
| SEQ ID NO 58966 | TCGGGAGGCTAAGGCAAGAG | AATCGCTT | chr17 | 42903189 | 42903208 | 42903192 | - |
| SEQ ID NO 58967 | GAGGCGGAGGTTGCCGTGAG | CCGAGATT | chr17 | 42903153 | 42903172 | 42903156 | - |
| SEQ ID NO 58968 | TGGAAGAATGCATATGGAAC | TACAGTTT | chr17 | 42902997 | 42903016 | 42903000 | - |
| SEQ ID NO 58969 | TTGCTCTCTGTAAGGATGTA | TATAGCTT | chr17 | 42902834 | 42902853 | 42902837 | - |
| SEQ ID NO 58970 | GTAAGGATGTATATAGCTTC | AGATGCTT | chr17 | 42902825 | 42902844 | 42902828 | - |
| SEQ ID NO 58971 | TTTATCCCGTGATGGTGGAA | TAGTGATT | chr17 | 42902681 | 42902700 | 42902684 | - |
| SEQ ID NO 58972 | CTCTGGCCTCTATCAACCCA | GAGAGATT | chr17 | 42902625 | 42902644 | 42902628 | - |
| SEQ ID NO 58973 | ATGGTTCTTCAATGGAGATC | AGATGTTT | chr17 | 42902595 | 42902614 | 42902598 | - |
| SEQ ID NO 58974 | GAGGCAGAGGTTGCAGTGAG | CTGAGATT | chr17 | 42902319 | 42902338 | 42902322 | - |
| SEQ ID NO 58975 | AAAGAAAGTGGCCAGAATGG | GAATGTTT | chr17 | 42902222 | 42902241 | 42902225 | - |
| SEQ ID NO 58976 | AAATTGGCAAATGCTAAACT | CAGGGCTT | chr17 | 42902185 | 42902204 | 42902188 | - |
| SEQ ID NO 58977 | TTTCCCCTGCTCCCCAGAGA | GTCAGTTT | chr17 | 42902159 | 42902178 | 42902162 | - |
| SEQ ID NO 58978 | GCGGAAGCCAGCCTGCCTAC | CTGGGCTT | chr17 | 42902092 | 42902111 | 42902095 | - |
| SEQ ID NO 58979 | AGCACCTTGGTCTCTGCATC | TACTGTTT | chr17 | 42902015 | 42902034 | 42902018 | - |
| SEQ ID NO 58980 | ATAGCACATGGACTGGCACA | CACTGTTT | chr17 | 42901952 | 42901971 | 42901955 | - |
| SEQ ID NO 58981 | CACTGTTTAATAAATGTTAA | CCCTGATT | chr17 | 42901932 | 42901951 | 42901935 | - |
| SEQ ID NO 58982 | GCTGCCAGAGATAACCTATT | TGTAGATT | chr17 | 42901896 | 42901915 | 42901899 | - |

Figure 89 (Cont'd)

| SEQ ID NO 58983 | AACAGGCTGTTGAATCATCT | GTGTGTTT | chr17 | 42901757 | 42901776 | 42901760 | - |
| SEQ ID NO 58984 | ACACGCCCAGCTAATTTTCG | TAATGTTT | chr17 | 42901571 | 42901590 | 42901574 | - |
| SEQ ID NO 58985 | TCGTAATGTTTTTGTAGAGA | TGGAGTTT | chr17 | 42901554 | 42901573 | 42901557 | - |
| SEQ ID NO 58986 | GAACTCCTGAGTTCACCCAG | GAGTGATT | chr17 | 42901502 | 42901521 | 42901505 | - |
| SEQ ID NO 58987 | CACCTCGGCCTCCCAAAGTG | CTGGGATT | chr17 | 42901470 | 42901489 | 42901473 | - |
| SEQ ID NO 58988 | ATCTTTCTTTATGTTACCTC | TTCTGCTT | chr17 | 42901410 | 42901429 | 42901413 | - |
| SEQ ID NO 58989 | TACCCTTTAACCCATATGAA | ATAGGCTT | chr17 | 42901317 | 42901336 | 42901320 | - |
| SEQ ID NO 58990 | CCTGTATTTTCAACTCACTG | GTAGGATT | chr17 | 42901288 | 42901307 | 42901291 | - |
| SEQ ID NO 58991 | GGTTGGAAGCATGAGTAGCC | CGTGGCTT | chr17 | 42901213 | 42901232 | 42901216 | - |
| SEQ ID NO 58992 | CTCCAATCACAGCTACCCAA | AGGAGTTT | chr17 | 42901062 | 42901081 | 42901065 | - |
| SEQ ID NO 58993 | ACCCAAAGGAGTTTAATGCC | CACAGCTT | chr17 | 42901048 | 42901067 | 42901051 | - |
| SEQ ID NO 58994 | GCAGAGCCCTTGCAGTTATT | CCAGGCTT | chr17 | 42900825 | 42900844 | 42900828 | - |
| SEQ ID NO 58995 | TGCAGTTATTCCAGGCTTGG | TGGTGATT | chr17 | 42900815 | 42900834 | 42900818 | - |
| SEQ ID NO 58996 | GCTATGAGTCTGTGCCTTGC | CCCTGTTT | chr17 | 42900782 | 42900801 | 42900785 | - |
| SEQ ID NO 58997 | CTGATCTTTGGACTCAAAAA | CCACGTTT | chr17 | 42900717 | 42900736 | 42900720 | - |
| SEQ ID NO 58998 | GGTTGATGCAAACATGTTCA | GGGTGATT | chr17 | 42900653 | 42900672 | 42900656 | - |
| SEQ ID NO 58999 | GGCCATGTACTCAGCAGGGC | CAATGATT | chr17 | 42900584 | 42900603 | 42900587 | - |
| SEQ ID NO 59000 | AGGGCCAATGATTAACTTTG | GCATGCTT | chr17 | 42900569 | 42900588 | 42900572 | - |
| SEQ ID NO 59001 | CAGGACAGAGTCTACATCCA | CGATGATT | chr17 | 42900489 | 42900508 | 42900492 | - |
| SEQ ID NO 59002 | ACGATGATTCTTGCAAAGAT | GTCAGATT | chr17 | 42900470 | 42900489 | 42900473 | - |
| SEQ ID NO 59003 | AATCTTGGTGCTCTAGCTAT | TCAAGTTT | chr17 | 42900403 | 42900422 | 42900406 | - |
| SEQ ID NO 59004 | CCTGGGCAACAAAGCAAGAC | CCTCGTTT | chr17 | 42900255 | 42900274 | 42900258 | - |
| SEQ ID NO 59005 | TTCTACACAAAAATTTAAAA | AATTGTTT | chr17 | 42900229 | 42900248 | 42900232 | - |
| SEQ ID NO 59006 | CTATTCAGGAGGCTGAGGCA | GGAGGATT | chr17 | 42900167 | 42900186 | 42900170 | - |
| SEQ ID NO 59007 | TCAGGAGGCTGAGGCAGGAG | GATTGCTT | chr17 | 42900163 | 42900182 | 42900166 | - |
| SEQ ID NO 59008 | ATTAGAGTCTAGGGTCTGCC | TCTGGTTT | chr17 | 42899944 | 42899963 | 42899947 | - |
| SEQ ID NO 59009 | GTCTCTTAGGGCCAGAAAGT | AATCGTTT | chr17 | 42899882 | 42899901 | 42899885 | - |
| SEQ ID NO 59010 | AAAGTAATCGTTTTTGAATG | CAGTGATT | chr17 | 42899867 | 42899886 | 42899870 | - |
| SEQ ID NO 59011 | CTTAAAGTTACAGCCCTTGG | TGTTGTTT | chr17 | 42899824 | 42899843 | 42899827 | - |
| SEQ ID NO 59012 | TTTTCTATCTTTTGTAGAGA | TGGGGTTT | chr17 | 42899616 | 42899635 | 42899619 | - |
| SEQ ID NO 59013 | AGCTCAAGAGATCTGCCAGT | CTTGGCTT | chr17 | 42899555 | 42899574 | 42899558 | - |
| SEQ ID NO 59014 | AGTCTTGGCTTCCCAAAGCT | CTGGGATT | chr17 | 42899538 | 42899557 | 42899541 | - |
| SEQ ID NO 59015 | GTGAACCACCATGCCTGGCC | AAGTGTTT | chr17 | 42899504 | 42899523 | 42899507 | - |
| SEQ ID NO 59016 | CTGGCCAAGTGTTTTAACTC | ATACGTTT | chr17 | 42899490 | 42899509 | 42899493 | - |
| SEQ ID NO 59017 | AAATGGTAACTGGAGACTTA | AAGAGTTT | chr17 | 42899387 | 42899406 | 42899390 | - |
| SEQ ID NO 59018 | ACTTTCAGTTATTTTTGAAA | AAGGGCTT | chr17 | 42899356 | 42899375 | 42899359 | - |
| SEQ ID NO 59019 | TGAAAAGGGCTTCTATATC | TTGAGCTT | chr17 | 42899341 | 42899360 | 42899344 | - |
| SEQ ID NO 59020 | TAAAAAATAGGGCTATTTAA | TCATGCTT | chr17 | 42899121 | 42899140 | 42899124 | - |
| SEQ ID NO 59021 | GCCCAGGCTGGTCTCAAATT | CCTGGCTT | chr17 | 42899032 | 42899051 | 42899035 | - |
| SEQ ID NO 59022 | CGCCTCAACCTAGCAAAGCA | TTGGGATT | chr17 | 42898991 | 42899010 | 42898994 | - |
| SEQ ID NO 59023 | GATAAGAGCCAGGGGGAATA | AAATGTTT | chr17 | 42898921 | 42898940 | 42898924 | - |
| SEQ ID NO 59024 | TTGACAGCATTCCATGCTGG | AAATGATT | chr17 | 42898791 | 42898810 | 42898794 | - |
| SEQ ID NO 59025 | ACTCCAGTTGTCCTTGACTG | CATGGTTT | chr17 | 42898690 | 42898709 | 42898693 | - |
| SEQ ID NO 59026 | ATTGCAGTGACCTCTGGGAT | GAGAGTTT | chr17 | 42898458 | 42898477 | 42898461 | - |
| SEQ ID NO 59027 | TGGTCAGCATATGGGGAGGG | CCCTGTTT | chr17 | 42898316 | 42898335 | 42898319 | - |
| SEQ ID NO 59028 | CTTTCCACCTGCCAGCCCCT | TTCTGCTT | chr17 | 42898111 | 42898130 | 42898114 | - |
| SEQ ID NO 59029 | GCCCTTTCTGCTTCCTCCA | GCACGTTT | chr17 | 42898097 | 42898116 | 42898100 | - |
| SEQ ID NO 59030 | CGTGGGAAAACAGGTGAGGC | CCCAGCTT | chr17 | 42898064 | 42898083 | 42898067 | - |
| SEQ ID NO 59031 | AGCTGACTGCATCGAGACAC | CGTGGATT | chr17 | 42898029 | 42898048 | 42898032 | - |
| SEQ ID NO 59032 | GATATATGAGGCGAGTGGCT | AGAAGTTT | chr17 | 42897986 | 42898005 | 42897989 | - |

Figure 89 (Cont'd)

| | | | | | | | |
|---|---|---|---|---|---|---|---|
| SEQ ID NO 59033 | TGCTGAGAATCCACTCATTT | ATCTGTTT | chr17 | 42897958 | 42897977 | 42897961 | - |
| SEQ ID NO 59034 | CTCACTGCAGCCTCAGTCTC | CTGGGCTT | chr17 | 42897873 | 42897892 | 42897876 | - |
| SEQ ID NO 59035 | TCAGTCTCCTGGGCTTAAGG | GATCGTTT | chr17 | 42897861 | 42897880 | 42897864 | - |

Figure 90

| # | Sequence | PAM | Chr | Start | End | Cut site 1 (5' of) | Cut site 2 (5' of) | Str |
|---|---|---|---|---|---|---|---|---|
| SEQ ID NO 59036 | GCTGGGTTTGGTGGTGTGCGCC | TTA | chr17 | 42897801 | 42897822 | 42897818 | 42897823 | + |
| SEQ ID NO 59037 | GGTTTGGTGGTGTGCGCCTGTA | CTG | chr17 | 42897805 | 42897826 | 42897822 | 42897827 | + |
| SEQ ID NO 59038 | GGTGGTGTGCGCCTGTAGGCCC | TTT | chr17 | 42897810 | 42897831 | 42897827 | 42897832 | + |
| SEQ ID NO 59039 | GTGGTGTGCGCCTGTAGGCCCA | TTG | chr17 | 42897811 | 42897832 | 42897828 | 42897833 | + |
| SEQ ID NO 59040 | TAGGCCCAGCTACCCAGAGACT | CTG | chr17 | 42897825 | 42897846 | 42897842 | 42897847 | + |
| SEQ ID NO 59041 | CCCAGAGACTGATGCAAAACGA | CTA | chr17 | 42897837 | 42897858 | 42897854 | 42897859 | + |
| SEQ ID NO 59042 | ATGCAAAACGATCCCTTAAGCC | CTG | chr17 | 42897848 | 42897869 | 42897865 | 42897870 | + |
| SEQ ID NO 59043 | AAGCCCAGGAGACTGAGGCTGC | CTT | chr17 | 42897865 | 42897886 | 42897882 | 42897887 | + |
| SEQ ID NO 59044 | AGCCCAGGAGACTGAGGCTGCA | TTA | chr17 | 42897866 | 42897887 | 42897883 | 42897888 | + |
| SEQ ID NO 59045 | AGGCTGCAGTGAGCTGTGATGG | CTG | chr17 | 42897880 | 42897901 | 42897897 | 42897902 | + |
| SEQ ID NO 59046 | CAGTGAGCTGTGATGGTGCCAC | CTG | chr17 | 42897886 | 42897907 | 42897903 | 42897908 | + |
| SEQ ID NO 59047 | TGATGGTGCCACCGCACTCCAG | CTG | chr17 | 42897896 | 42897917 | 42897913 | 42897918 | + |
| SEQ ID NO 59048 | CAGCCTGGGTAACAGAGTGAGA | CTC | chr17 | 42897915 | 42897936 | 42897932 | 42897937 | + |
| SEQ ID NO 59049 | GGTAACAGAGTGAGACCCCGTC | CTG | chr17 | 42897922 | 42897943 | 42897939 | 42897944 | + |
| SEQ ID NO 59050 | AAATAAACAGATAAATGAGTGG | CTC | chr17 | 42897946 | 42897967 | 42897963 | 42897968 | + |
| SEQ ID NO 59051 | TCAGCAAAACTTCTAGCCACTC | TTC | chr17 | 42897972 | 42897993 | 42897989 | 42897994 | + |
| SEQ ID NO 59052 | AGCAAAACTTCTAGCCACTCGC | CTC | chr17 | 42897974 | 42897995 | 42897991 | 42897996 | + |
| SEQ ID NO 59053 | CTAGCCACTCGCCTCATATATC | CTT | chr17 | 42897984 | 42898005 | 42898001 | 42898006 | + |
| SEQ ID NO 59054 | TAGCCACTCGCCTCATATATCC | TTC | chr17 | 42897985 | 42898006 | 42898002 | 42898007 | + |
| SEQ ID NO 59055 | GCCACTCGCCTCATATATCCAC | CTA | chr17 | 42897987 | 42898008 | 42898004 | 42898009 | + |
| SEQ ID NO 59056 | GCCTCATATATCCACAAGACCT | CTC | chr17 | 42897994 | 42898015 | 42898011 | 42898016 | + |
| SEQ ID NO 59057 | ATATATCCACAAGACCTTTGAG | CTC | chr17 | 42897999 | 42898020 | 42898016 | 42898021 | + |
| SEQ ID NO 59058 | TGAGAATCCACGGTGTCTCGAT | CTT | chr17 | 42898017 | 42898038 | 42898034 | 42898039 | + |
| SEQ ID NO 59059 | GAGAATCCACGGTGTCTCGATG | TTT | chr17 | 42898018 | 42898039 | 42898035 | 42898040 | + |
| SEQ ID NO 59060 | AGAATCCACGGTGTCTCGATGC | TTG | chr17 | 42898019 | 42898040 | 42898036 | 42898041 | + |
| SEQ ID NO 59061 | GATGCAGTCAGCTTTCTAACAA | CTC | chr17 | 42898036 | 42898057 | 42898053 | 42898058 | + |
| SEQ ID NO 59062 | TCTAACAAGCTGGGGCCTCACC | CTT | chr17 | 42898050 | 42898071 | 42898067 | 42898072 | + |
| SEQ ID NO 59063 | CTAACAAGCTGGGGCCTCACCT | TTT | chr17 | 42898051 | 42898072 | 42898068 | 42898073 | + |
| SEQ ID NO 59064 | TAACAAGCTGGGGCCTCACCTG | TTC | chr17 | 42898052 | 42898073 | 42898069 | 42898074 | + |
| SEQ ID NO 59065 | ACAAGCTGGGGCCTCACCTGTT | CTA | chr17 | 42898054 | 42898075 | 42898071 | 42898076 | + |
| SEQ ID NO 59066 | GGGCCTCACCTGTTTTCCCACG | CTG | chr17 | 42898062 | 42898083 | 42898079 | 42898084 | + |
| SEQ ID NO 59067 | ACCTGTTTTCCCACGGATAAAA | CTC | chr17 | 42898069 | 42898090 | 42898086 | 42898091 | + |
| SEQ ID NO 59068 | TTTTCCCACGGATAAAAACGTG | CTG | chr17 | 42898074 | 42898095 | 42898091 | 42898096 | + |
| SEQ ID NO 59069 | TCCCACGGATAAAAACGTGCTG | TTT | chr17 | 42898077 | 42898098 | 42898094 | 42898099 | + |
| SEQ ID NO 59070 | CCCACGGATAAAAACGTGCTGG | TTT | chr17 | 42898078 | 42898099 | 42898095 | 42898100 | + |
| SEQ ID NO 59071 | CCACGGATAAAAACGTGCTGGA | TTC | chr17 | 42898079 | 42898100 | 42898096 | 42898101 | + |
| SEQ ID NO 59072 | GAGGAAGCAGAAAGGGGCTGGC | CTG | chr17 | 42898099 | 42898120 | 42898116 | 42898121 | + |
| SEQ ID NO 59073 | GCAGGTGGAAAGATGAGGACCA | CTG | chr17 | 42898119 | 42898140 | 42898136 | 42898141 | + |
| SEQ ID NO 59074 | ATCGTCTCATGACTATGAGGTT | CTC | chr17 | 42898145 | 42898166 | 42898162 | 42898167 | + |
| SEQ ID NO 59075 | ATGACTATGAGGTTGCTCTGAT | CTC | chr17 | 42898153 | 42898174 | 42898170 | 42898175 | + |
| SEQ ID NO 59076 | TGAGGTTGCTCTGATCCAGAGG | CTA | chr17 | 42898160 | 42898181 | 42898177 | 42898182 | + |
| SEQ ID NO 59077 | CTCTGATCCAGAGGGTCCCCCT | TTG | chr17 | 42898168 | 42898189 | 42898185 | 42898190 | + |
| SEQ ID NO 59078 | TGATCCAGAGGGTCCCCCTGCC | CTC | chr17 | 42898171 | 42898192 | 42898188 | 42898193 | + |
| SEQ ID NO 59079 | ATCCAGAGGGTCCCCCTGCCTG | CTG | chr17 | 42898173 | 42898194 | 42898190 | 42898195 | + |
| SEQ ID NO 59080 | CCTGGTGGCCCACCGCCAGGAA | CTG | chr17 | 42898191 | 42898212 | 42898208 | 42898213 | + |
| SEQ ID NO 59081 | GTGGCCCACCGCCAGGAAGACT | CTG | chr17 | 42898195 | 42898216 | 42898212 | 42898217 | + |
| SEQ ID NO 59082 | CCACTGTCCCTGGATGCCCAGA | CTC | chr17 | 42898218 | 42898239 | 42898235 | 42898240 | + |
| SEQ ID NO 59083 | TCCCTGGATGCCCAGAGTGGGA | CTG | chr17 | 42898224 | 42898245 | 42898241 | 42898246 | + |
| SEQ ID NO 59084 | GATGCCCAGAGTGGGATGTCAA | CTG | chr17 | 42898230 | 42898251 | 42898247 | 42898252 | + |
| SEQ ID NO 59085 | CATCACTTATCAACTCCTTATC | CTC | chr17 | 42898255 | 42898276 | 42898272 | 42898277 | + |
| SEQ ID NO 59086 | ATCAACTCCTTATCCATAGGGG | CTT | chr17 | 42898263 | 42898284 | 42898280 | 42898285 | + |
| SEQ ID NO 59087 | TCAACTCCTTATCCATAGGGGT | TTA | chr17 | 42898264 | 42898285 | 42898281 | 42898286 | + |
| SEQ ID NO 59088 | CTTATCCATAGGGGTATTCTTC | CTC | chr17 | 42898271 | 42898292 | 42898288 | 42898293 | + |
| SEQ ID NO 59089 | ATCCATAGGGGTATTCTTCCTG | CTT | chr17 | 42898274 | 42898295 | 42898291 | 42898296 | + |
| SEQ ID NO 59090 | TCCATAGGGGTATTCTTCCTGA | TTA | chr17 | 42898275 | 42898296 | 42898292 | 42898297 | + |
| SEQ ID NO 59091 | TTCCTGAGGCGTCTCAGAAAAC | TTC | chr17 | 42898290 | 42898311 | 42898307 | 42898312 | + |
| SEQ ID NO 59092 | CCTGAGGCGTCTCAGAAAACAG | CTT | chr17 | 42898292 | 42898313 | 42898309 | 42898314 | + |

Figure 90 (Cont'd)

| | | | | | | | | |
|---|---|---|---|---|---|---|---|---|
| SEQ ID NO 59093 | CTGAGGCGTCTCAGAAAACAGG | TTC | chr17 | 42898293 | 42898314 | 42898310 | 42898315 | + |
| SEQ ID NO 59094 | AGGCGTCTCAGAAAACAGGGCC | CTG | chr17 | 42898296 | 42898317 | 42898313 | 42898318 | + |
| SEQ ID NO 59095 | AGAAAACAGGGCCCTCCCCATA | CTC | chr17 | 42898305 | 42898326 | 42898322 | 42898327 | + |
| SEQ ID NO 59096 | CCCATATGCTGACCACATAATA | CTC | chr17 | 42898321 | 42898342 | 42898338 | 42898343 | + |
| SEQ ID NO 59097 | ACCACATAATAGAACCCCTCCC | CTG | chr17 | 42898332 | 42898353 | 42898349 | 42898354 | + |
| SEQ ID NO 59098 | CCAACTCAGAGACCCTGGCTGC | CTC | chr17 | 42898352 | 42898373 | 42898369 | 42898374 | + |
| SEQ ID NO 59099 | AGAGACCCTGGCTGCTAGCTGC | CTC | chr17 | 42898359 | 42898380 | 42898376 | 42898381 | + |
| SEQ ID NO 59100 | GCTGCTAGCTGCCCTGGCATGA | CTG | chr17 | 42898369 | 42898390 | 42898386 | 42898391 | + |
| SEQ ID NO 59101 | CTAGCTGCCCTGGCATGACCCA | CTG | chr17 | 42898373 | 42898394 | 42898390 | 42898395 | + |
| SEQ ID NO 59102 | GCTGCCCTGGCATGACCCAGAC | CTA | chr17 | 42898376 | 42898397 | 42898393 | 42898398 | + |
| SEQ ID NO 59103 | CCCTGGCATGACCCAGACAGTG | CTG | chr17 | 42898380 | 42898401 | 42898397 | 42898402 | + |
| SEQ ID NO 59104 | GCATGACCCAGACAGTGGCCTT | CTG | chr17 | 42898385 | 42898406 | 42898402 | 42898407 | + |
| SEQ ID NO 59105 | TGTATATGTTTTTAGACTCACC | CTT | chr17 | 42898407 | 42898428 | 42898424 | 42898429 | + |
| SEQ ID NO 59106 | GTATATGTTTTTAGACTCACCT | TTT | chr17 | 42898408 | 42898429 | 42898425 | 42898430 | + |
| SEQ ID NO 59107 | TATATGTTTTTAGACTCACCTT | TTG | chr17 | 42898409 | 42898430 | 42898426 | 42898431 | + |
| SEQ ID NO 59108 | TTAGACTCACCTTGACTCACCT | TTT | chr17 | 42898418 | 42898439 | 42898435 | 42898440 | + |
| SEQ ID NO 59109 | TAGACTCACCTTGACTCACCTC | TTT | chr17 | 42898419 | 42898440 | 42898436 | 42898441 | + |
| SEQ ID NO 59110 | AGACTCACCTTGACTCACCTCT | TTT | chr17 | 42898420 | 42898441 | 42898437 | 42898442 | + |
| SEQ ID NO 59111 | GACTCACCTTGACTCACCTCTG | TTA | chr17 | 42898421 | 42898442 | 42898438 | 42898443 | + |
| SEQ ID NO 59112 | ACCTTGACTCACCTCTGACCAT | CTC | chr17 | 42898426 | 42898447 | 42898443 | 42898448 | + |
| SEQ ID NO 59113 | GACTCACCTCTGACCATAGAAA | CTT | chr17 | 42898431 | 42898452 | 42898448 | 42898453 | + |
| SEQ ID NO 59114 | ACTCACCTCTGACCATAGAAAC | TTG | chr17 | 42898432 | 42898453 | 42898449 | 42898454 | + |
| SEQ ID NO 59115 | ACCTCTGACCATAGAAACTCTC | CTC | chr17 | 42898436 | 42898457 | 42898453 | 42898458 | + |
| SEQ ID NO 59116 | TGACCATAGAAACTCTCATCCC | CTC | chr17 | 42898441 | 42898462 | 42898458 | 42898463 | + |
| SEQ ID NO 59117 | ACCATAGAAACTCTCATCCCAG | CTG | chr17 | 42898443 | 42898464 | 42898460 | 42898465 | + |
| SEQ ID NO 59118 | TCATCCCAGAGGTCACTGCAAT | CTC | chr17 | 42898456 | 42898477 | 42898473 | 42898478 | + |
| SEQ ID NO 59119 | ATCCCAGAGGTCACTGCAATAG | CTC | chr17 | 42898458 | 42898479 | 42898475 | 42898480 | + |
| SEQ ID NO 59120 | CAATAGTTACTCCACAACAGAG | CTG | chr17 | 42898474 | 42898495 | 42898491 | 42898496 | + |
| SEQ ID NO 59121 | CTCCACAACAGAGGCTTATCTG | TTA | chr17 | 42898483 | 42898504 | 42898500 | 42898505 | + |
| SEQ ID NO 59122 | CACAACAGAGGCTTATCTGGGT | CTC | chr17 | 42898486 | 42898507 | 42898503 | 42898508 | + |
| SEQ ID NO 59123 | ATCTGGGTAGAGGGAGGCTCCC | CTT | chr17 | 42898500 | 42898521 | 42898517 | 42898522 | + |
| SEQ ID NO 59124 | TCTGGGTAGAGGGAGGCTCCCT | TTA | chr17 | 42898501 | 42898522 | 42898518 | 42898523 | + |
| SEQ ID NO 59125 | GGTAGAGGGAGGCTCCCTACCT | CTG | chr17 | 42898505 | 42898526 | 42898522 | 42898527 | + |
| SEQ ID NO 59126 | CCTACCTATGGCCCAGCAGCCC | CTC | chr17 | 42898520 | 42898541 | 42898537 | 42898542 | + |
| SEQ ID NO 59127 | CCTATGGCCCAGCAGCCCTGAC | CTA | chr17 | 42898524 | 42898545 | 42898541 | 42898546 | + |
| SEQ ID NO 59128 | TGGCCCAGCAGCCCTGACAGTG | CTA | chr17 | 42898528 | 42898549 | 42898545 | 42898550 | + |
| SEQ ID NO 59129 | ACAGTGCAGATCACATATACCC | CTG | chr17 | 42898544 | 42898565 | 42898561 | 42898566 | + |
| SEQ ID NO 59130 | CCTGCCACGCATGGGCTTACTT | CTG | chr17 | 42898581 | 42898602 | 42898598 | 42898603 | + |
| SEQ ID NO 59131 | CCACGCATGGGCTTACTTTACA | CTG | chr17 | 42898585 | 42898606 | 42898602 | 42898607 | + |
| SEQ ID NO 59132 | ACTTTACACCCACCCACAGTCA | CTT | chr17 | 42898599 | 42898620 | 42898616 | 42898621 | + |
| SEQ ID NO 59133 | CTTTACACCCACCCACAGTCAC | TTA | chr17 | 42898600 | 42898621 | 42898617 | 42898622 | + |
| SEQ ID NO 59134 | TACACCCACCCACAGTCACCAA | CTT | chr17 | 42898603 | 42898624 | 42898620 | 42898625 | + |
| SEQ ID NO 59135 | ACACCCACCCACAGTCACCAAC | TTT | chr17 | 42898604 | 42898625 | 42898621 | 42898626 | + |
| SEQ ID NO 59136 | CACCCACCCACAGTCACCAACA | TTA | chr17 | 42898605 | 42898626 | 42898622 | 42898627 | + |
| SEQ ID NO 59137 | CCTGCTCTCCAAGGTTAGGCGT | TTA | chr17 | 42898632 | 42898653 | 42898649 | 42898654 | + |
| SEQ ID NO 59138 | CTCTCCAAGGTTAGGCGTGGCA | CTG | chr17 | 42898636 | 42898657 | 42898653 | 42898658 | + |
| SEQ ID NO 59139 | TCCAAGGTTAGGCGTGGCAGGA | CTC | chr17 | 42898639 | 42898660 | 42898656 | 42898661 | + |
| SEQ ID NO 59140 | CAAGGTTAGGCGTGGCAGGAGA | CTC | chr17 | 42898641 | 42898662 | 42898658 | 42898663 | + |
| SEQ ID NO 59141 | GGCGTGGCAGGAGAAGTTTGCT | TTA | chr17 | 42898649 | 42898670 | 42898666 | 42898671 | + |
| SEQ ID NO 59142 | GCTTGGACCAGCAGAAACCATG | TTT | chr17 | 42898668 | 42898689 | 42898685 | 42898690 | + |
| SEQ ID NO 59143 | CTTGGACCAGCAGAAACCATGC | TTG | chr17 | 42898669 | 42898690 | 42898686 | 42898691 | + |
| SEQ ID NO 59144 | GGACCAGCAGAAACCATGCAGT | CTT | chr17 | 42898672 | 42898693 | 42898689 | 42898694 | + |
| SEQ ID NO 59145 | GACCAGCAGAAACCATGCAGTC | TTG | chr17 | 42898673 | 42898694 | 42898690 | 42898695 | + |
| SEQ ID NO 59146 | GAGTCAGCATGGGCTGGGTGCG | CTG | chr17 | 42898706 | 42898727 | 42898723 | 42898728 | + |
| SEQ ID NO 59147 | GGTGCGAGCCCTTGGTGGGGTG | CTG | chr17 | 42898722 | 42898743 | 42898739 | 42898744 | + |
| SEQ ID NO 59148 | GGTGGGGTGGGGAGGAGACTCC | CTT | chr17 | 42898735 | 42898756 | 42898752 | 42898757 | + |
| SEQ ID NO 59149 | GTGGGGTGGGGAGGAGACTCCA | TTG | chr17 | 42898736 | 42898757 | 42898753 | 42898758 | + |
| SEQ ID NO 59150 | CAGGTCATACCTCCTGGAGGAT | CTC | chr17 | 42898756 | 42898777 | 42898773 | 42898778 | + |

Figure 90 (Cont'd)

| | | | | | | | | |
|---|---|---|---|---|---|---|---|---|
| SEQ ID NO 59151 | CTGGAGGATGTTTTAATCATTT | CTC | chr17 | 42898769 | 42898790 | 42898786 | 42898791 | + |
| SEQ ID NO 59152 | GAGGATGTTTTAATCATTTCCA | CTG | chr17 | 42898772 | 42898793 | 42898789 | 42898794 | + |
| SEQ ID NO 59153 | TAATCATTTCCAGCATGGAATG | TTT | chr17 | 42898782 | 42898803 | 42898799 | 42898804 | + |
| SEQ ID NO 59154 | AATCATTTCCAGCATGGAATGC | TTT | chr17 | 42898783 | 42898804 | 42898800 | 42898805 | + |
| SEQ ID NO 59155 | ATCATTTCCAGCATGGAATGCT | TTA | chr17 | 42898784 | 42898805 | 42898801 | 42898806 | + |
| SEQ ID NO 59156 | CCAGCATGGAATGCTGTCAACT | TTT | chr17 | 42898791 | 42898812 | 42898808 | 42898813 | + |
| SEQ ID NO 59157 | CAGCATGGAATGCTGTCAACTT | TTC | chr17 | 42898792 | 42898813 | 42898809 | 42898814 | + |
| SEQ ID NO 59158 | TCAACTTTTGCCACAGATTCAT | CTG | chr17 | 42898807 | 42898828 | 42898824 | 42898829 | + |
| SEQ ID NO 59159 | TTGCCACAGATTCATTAGCTCT | CTT | chr17 | 42898814 | 42898835 | 42898831 | 42898836 | + |
| SEQ ID NO 59160 | TGCCACAGATTCATTAGCTCTG | TTT | chr17 | 42898815 | 42898836 | 42898832 | 42898837 | + |
| SEQ ID NO 59161 | GCCACAGATTCATTAGCTCTGA | TTT | chr17 | 42898816 | 42898837 | 42898833 | 42898838 | + |
| SEQ ID NO 59162 | CCACAGATTCATTAGCTCTGAG | TTG | chr17 | 42898817 | 42898838 | 42898834 | 42898839 | + |
| SEQ ID NO 59163 | ATTAGCTCTGAGTTTCTTTTTT | TTC | chr17 | 42898827 | 42898848 | 42898844 | 42898849 | + |
| SEQ ID NO 59164 | GCTCTGAGTTTCTTTTTTCTGT | TTA | chr17 | 42898831 | 42898852 | 42898848 | 42898853 | + |
| SEQ ID NO 59165 | TGAGTTTCTTTTTTCTGTCCCC | CTC | chr17 | 42898835 | 42898856 | 42898852 | 42898857 | + |
| SEQ ID NO 59166 | AGTTTCTTTTTTCTGTCCCCAG | CTG | chr17 | 42898837 | 42898858 | 42898854 | 42898859 | + |
| SEQ ID NO 59167 | CTTTTTTCTGTCCCCAGCTACC | TTT | chr17 | 42898842 | 42898863 | 42898859 | 42898864 | + |
| SEQ ID NO 59168 | TTTTTTCTGTCCCCAGCTACCC | TTC | chr17 | 42898843 | 42898864 | 42898860 | 42898865 | + |
| SEQ ID NO 59169 | TTTTCTGTCCCCAGCTACCCCT | CTT | chr17 | 42898845 | 42898866 | 42898862 | 42898867 | + |
| SEQ ID NO 59170 | TTTCTGTCCCCAGCTACCCCTT | TTT | chr17 | 42898846 | 42898867 | 42898863 | 42898868 | + |
| SEQ ID NO 59171 | TTCTGTCCCCAGCTACCCCTTA | TTT | chr17 | 42898847 | 42898868 | 42898864 | 42898869 | + |
| SEQ ID NO 59172 | TCTGTCCCCAGCTACCCCTTAC | TTT | chr17 | 42898848 | 42898869 | 42898865 | 42898870 | + |
| SEQ ID NO 59173 | CTGTCCCCAGCTACCCCTTACA | TTT | chr17 | 42898849 | 42898870 | 42898866 | 42898871 | + |
| SEQ ID NO 59174 | TGTCCCCAGCTACCCCTTACAT | TTC | chr17 | 42898850 | 42898871 | 42898867 | 42898872 | + |
| SEQ ID NO 59175 | TCCCCAGCTACCCCTTACATGT | CTG | chr17 | 42898852 | 42898873 | 42898869 | 42898874 | + |
| SEQ ID NO 59176 | CCCCTTACATGTCAATATGGAC | CTA | chr17 | 42898862 | 42898883 | 42898879 | 42898884 | + |
| SEQ ID NO 59177 | ACATGTCAATATGGACTTAATG | CTT | chr17 | 42898868 | 42898889 | 42898885 | 42898890 | + |
| SEQ ID NO 59178 | CATGTCAATATGGACTTAATGA | TTA | chr17 | 42898869 | 42898890 | 42898886 | 42898891 | + |
| SEQ ID NO 59179 | AATGATGGGAAATTCAGGCAAG | CTT | chr17 | 42898886 | 42898907 | 42898903 | 42898908 | + |
| SEQ ID NO 59180 | ATGATGGGAAATTCAGGCAAGT | TTA | chr17 | 42898887 | 42898908 | 42898904 | 42898909 | + |
| SEQ ID NO 59181 | AGGCAAGTTTTTAAACATTTTA | TTC | chr17 | 42898901 | 42898922 | 42898918 | 42898923 | + |
| SEQ ID NO 59182 | TTAAACATTTTATTCCCCCTGG | TTT | chr17 | 42898911 | 42898932 | 42898928 | 42898933 | + |
| SEQ ID NO 59183 | TAAACATTTTATTCCCCCTGGC | TTT | chr17 | 42898912 | 42898933 | 42898929 | 42898934 | + |
| SEQ ID NO 59184 | AAACATTTTATTCCCCCTGGCT | TTT | chr17 | 42898913 | 42898934 | 42898930 | 42898935 | + |
| SEQ ID NO 59185 | AACATTTTATTCCCCCTGGCTC | TTA | chr17 | 42898914 | 42898935 | 42898931 | 42898936 | + |
| SEQ ID NO 59186 | TATTCCCCCTGGCTCTTATCCT | TTT | chr17 | 42898921 | 42898942 | 42898938 | 42898943 | + |
| SEQ ID NO 59187 | ATTCCCCCTGGCTCTTATCCTC | TTT | chr17 | 42898922 | 42898943 | 42898939 | 42898944 | + |
| SEQ ID NO 59188 | TTCCCCCTGGCTCTTATCCTCA | TTA | chr17 | 42898923 | 42898944 | 42898940 | 42898945 | + |
| SEQ ID NO 59189 | CCCCTGGCTCTTATCCTCAAAA | TTC | chr17 | 42898926 | 42898947 | 42898943 | 42898948 | + |
| SEQ ID NO 59190 | GCTCTTATCCTCAAAAAATGCA | CTG | chr17 | 42898932 | 42898953 | 42898949 | 42898954 | + |
| SEQ ID NO 59191 | TTATCCTCAAAAAATGCATGAA | CTC | chr17 | 42898936 | 42898957 | 42898953 | 42898958 | + |
| SEQ ID NO 59192 | ATCCTCAAAAAATGCATGAATT | CTT | chr17 | 42898938 | 42898959 | 42898955 | 42898960 | + |
| SEQ ID NO 59193 | TCCTCAAAAAATGCATGAATTT | TTA | chr17 | 42898939 | 42898960 | 42898956 | 42898961 | + |
| SEQ ID NO 59194 | AAAAAATGCATGAATTTGGAGG | CTC | chr17 | 42898944 | 42898965 | 42898961 | 42898966 | + |
| SEQ ID NO 59195 | GGAGGCAGTGGCTCATGCCTGT | TTT | chr17 | 42898961 | 42898982 | 42898978 | 42898983 | + |
| SEQ ID NO 59196 | GAGGCAGTGGCTCATGCCTGTA | TTG | chr17 | 42898962 | 42898983 | 42898979 | 42898984 | + |
| SEQ ID NO 59197 | ATGCCTGTAATCCCAATGCTTT | CTC | chr17 | 42898975 | 42898996 | 42898992 | 42898997 | + |
| SEQ ID NO 59198 | TAATCCCAATGCTTTGCTAGGT | CTG | chr17 | 42898982 | 42899003 | 42898999 | 42899004 | + |
| SEQ ID NO 59199 | TGCTAGGTTGAGGCGGGAGGAT | CTT | chr17 | 42898996 | 42899017 | 42899013 | 42899018 | + |
| SEQ ID NO 59200 | GCTAGGTTGAGGCGGGAGGATC | TTT | chr17 | 42898997 | 42899018 | 42899014 | 42899019 | + |
| SEQ ID NO 59201 | CTAGGTTGAGGCGGGAGGATCA | TTG | chr17 | 42898998 | 42899019 | 42899015 | 42899020 | + |
| SEQ ID NO 59202 | GGTTGAGGCGGGAGGATCACTT | CTA | chr17 | 42899001 | 42899022 | 42899018 | 42899023 | + |
| SEQ ID NO 59203 | AGGCGGGAGGATCACTTGAAGC | TTG | chr17 | 42899006 | 42899027 | 42899023 | 42899028 | + |
| SEQ ID NO 59204 | GAAGCCAGGAATTTGAGACCAG | CTT | chr17 | 42899023 | 42899044 | 42899040 | 42899045 | + |
| SEQ ID NO 59205 | AAGCCAGGAATTTGAGACCAGC | TTG | chr17 | 42899024 | 42899045 | 42899041 | 42899046 | + |
| SEQ ID NO 59206 | GAGACCAGCCTGGGCCGCATAG | TTT | chr17 | 42899037 | 42899058 | 42899054 | 42899059 | + |
| SEQ ID NO 59207 | AGACCAGCCTGGGCCGCATAGT | TTG | chr17 | 42899038 | 42899059 | 42899055 | 42899060 | + |
| SEQ ID NO 59208 | GGCCGCATAGTGAGACCCCGTT | CTG | chr17 | 42899049 | 42899070 | 42899066 | 42899071 | + |

Figure 90 (Cont'd)

| | | | | | | | | |
|---|---|---|---|---|---|---|---|---|
| SEQ ID NO 59209 | CTACAAAAATAAATAAATAAAT | TTT | chr17 | 42899072 | 42899093 | 42899089 | 42899094 | + |
| SEQ ID NO 59210 | TACAAAAATAAATAAATAAATA | TTC | chr17 | 42899073 | 42899094 | 42899090 | 42899095 | + |
| SEQ ID NO 59211 | CAAAAATAAATAAATAAATAAT | CTA | chr17 | 42899075 | 42899096 | 42899092 | 42899097 | + |
| SEQ ID NO 59212 | AATAGCCCTATTTTTAAAATG | TTA | chr17 | 42899124 | 42899145 | 42899141 | 42899146 | + |
| SEQ ID NO 59213 | TTTTTTAAAATGCATGAGTTCG | CTA | chr17 | 42899134 | 42899155 | 42899151 | 42899156 | + |
| SEQ ID NO 59214 | TTTAAAATGCATGAGTTCGTTA | TTT | chr17 | 42899137 | 42899158 | 42899154 | 42899159 | + |
| SEQ ID NO 59215 | TTAAAATGCATGAGTTCGTTAC | TTT | chr17 | 42899138 | 42899159 | 42899155 | 42899160 | + |
| SEQ ID NO 59216 | TAAAATGCATGAGTTCGTTACC | TTT | chr17 | 42899139 | 42899160 | 42899156 | 42899161 | + |
| SEQ ID NO 59217 | AAAATGCATGAGTTCGTTACCT | TTT | chr17 | 42899140 | 42899161 | 42899157 | 42899162 | + |
| SEQ ID NO 59218 | AAATGCATGAGTTCGTTACCTG | TTA | chr17 | 42899141 | 42899162 | 42899158 | 42899163 | + |
| SEQ ID NO 59219 | GTTACCTGATTCATTCCCTGGT | TTC | chr17 | 42899155 | 42899176 | 42899172 | 42899177 | + |
| SEQ ID NO 59220 | CCTGATTCATTCCCTGGTTCCT | TTA | chr17 | 42899159 | 42899180 | 42899176 | 42899181 | + |
| SEQ ID NO 59221 | ATTCATTCCCTGGTTCCTTTCA | CTG | chr17 | 42899163 | 42899184 | 42899180 | 42899185 | + |
| SEQ ID NO 59222 | ATTCCCTGGTTCCTTTCACAGT | TTC | chr17 | 42899167 | 42899188 | 42899184 | 42899189 | + |
| SEQ ID NO 59223 | CCTGGTTCCTTTCACAGTCCTC | TTC | chr17 | 42899171 | 42899192 | 42899188 | 42899193 | + |
| SEQ ID NO 59224 | GTTCCTTTCACAGTCCTCCGTG | CTG | chr17 | 42899175 | 42899196 | 42899192 | 42899197 | + |
| SEQ ID NO 59225 | CTTTCACAGTCCTCCGTGACCC | TTC | chr17 | 42899179 | 42899200 | 42899196 | 42899201 | + |
| SEQ ID NO 59226 | TCACAGTCCTCCGTGACCCAAG | CTT | chr17 | 42899182 | 42899203 | 42899199 | 42899204 | + |
| SEQ ID NO 59227 | CACAGTCCTCCGTGACCCAAGT | TTT | chr17 | 42899183 | 42899204 | 42899200 | 42899205 | + |
| SEQ ID NO 59228 | ACAGTCCTCCGTGACCCAAGTG | TTC | chr17 | 42899184 | 42899205 | 42899201 | 42899206 | + |
| SEQ ID NO 59229 | CGTGACCCAAGTGTTAGGGTTT | CTC | chr17 | 42899193 | 42899214 | 42899210 | 42899215 | + |
| SEQ ID NO 59230 | GGGTTTTGGTCTCTCTACTATT | TTA | chr17 | 42899209 | 42899230 | 42899226 | 42899231 | + |
| SEQ ID NO 59231 | TGGTCTCTCTACTATTTGTAGG | TTT | chr17 | 42899215 | 42899236 | 42899232 | 42899237 | + |
| SEQ ID NO 59232 | GGTCTCTCTACTATTTGTAGGC | TTT | chr17 | 42899216 | 42899237 | 42899233 | 42899238 | + |
| SEQ ID NO 59233 | GTCTCTCTACTATTTGTAGGCT | TTG | chr17 | 42899217 | 42899238 | 42899234 | 42899239 | + |
| SEQ ID NO 59234 | TCTACTATTTGTAGGCTGATAT | CTC | chr17 | 42899222 | 42899243 | 42899239 | 42899244 | + |
| SEQ ID NO 59235 | TACTATTTGTAGGCTGATATAT | CTC | chr17 | 42899224 | 42899245 | 42899241 | 42899246 | + |
| SEQ ID NO 59236 | CTATTTGTAGGCTGATATATAG | CTA | chr17 | 42899226 | 42899247 | 42899243 | 42899248 | + |
| SEQ ID NO 59237 | TTTGTAGGCTGATATATAGTAT | CTA | chr17 | 42899229 | 42899250 | 42899246 | 42899251 | + |
| SEQ ID NO 59238 | GTAGGCTGATATATAGTATACA | TTT | chr17 | 42899232 | 42899253 | 42899249 | 42899254 | + |
| SEQ ID NO 59239 | TAGGCTGATATATAGTATACAC | TTG | chr17 | 42899233 | 42899254 | 42899250 | 42899255 | + |
| SEQ ID NO 59240 | ATATATAGTATACACACACACA | CTG | chr17 | 42899240 | 42899261 | 42899257 | 42899262 | + |
| SEQ ID NO 59241 | GAGCTTTCTTTTGTATATCTAC | CTT | chr17 | 42899295 | 42899316 | 42899312 | 42899317 | + |
| SEQ ID NO 59242 | AGCTTTCTTTTGTATATCTACA | TTG | chr17 | 42899296 | 42899317 | 42899313 | 42899318 | + |
| SEQ ID NO 59243 | TCTTTTGTATATCTACACACAT | CTT | chr17 | 42899301 | 42899322 | 42899318 | 42899323 | + |
| SEQ ID NO 59244 | CTTTTGTATATCTACACACATA | TTT | chr17 | 42899302 | 42899323 | 42899319 | 42899324 | + |
| SEQ ID NO 59245 | TTTTGTATATCTACACACATAT | TTC | chr17 | 42899303 | 42899324 | 42899320 | 42899325 | + |
| SEQ ID NO 59246 | TTGTATATCTACACACATATGT | CTT | chr17 | 42899305 | 42899326 | 42899322 | 42899327 | + |
| SEQ ID NO 59247 | TGTATATCTACACACATATGTA | TTT | chr17 | 42899306 | 42899327 | 42899323 | 42899328 | + |
| SEQ ID NO 59248 | GTATATCTACACACATATGTAT | TTT | chr17 | 42899307 | 42899328 | 42899324 | 42899329 | + |
| SEQ ID NO 59249 | TATATCTACACACATATGTATA | TTG | chr17 | 42899308 | 42899329 | 42899325 | 42899330 | + |
| SEQ ID NO 59250 | CACACATATGTATAAGAAAGCT | CTA | chr17 | 42899316 | 42899337 | 42899333 | 42899338 | + |
| SEQ ID NO 59251 | AAGATATAGAAGCCCTTTTTCA | CTC | chr17 | 42899339 | 42899360 | 42899356 | 42899361 | + |
| SEQ ID NO 59252 | TTTCAAAAATAACTGAAAGTTT | CTT | chr17 | 42899356 | 42899377 | 42899373 | 42899378 | + |
| SEQ ID NO 59253 | TTCAAAAATAACTGAAAGTTTC | TTT | chr17 | 42899357 | 42899378 | 42899374 | 42899379 | + |
| SEQ ID NO 59254 | TCAAAAATAACTGAAAGTTTCA | TTT | chr17 | 42899358 | 42899379 | 42899375 | 42899380 | + |
| SEQ ID NO 59255 | CAAAAATAACTGAAAGTTTCAA | TTT | chr17 | 42899359 | 42899380 | 42899376 | 42899381 | + |
| SEQ ID NO 59256 | AAAAATAACTGAAAGTTTCAAA | TTC | chr17 | 42899360 | 42899381 | 42899377 | 42899382 | + |
| SEQ ID NO 59257 | AAAGTTTCAAACTCTTTAAGTC | CTG | chr17 | 42899371 | 42899392 | 42899388 | 42899393 | + |
| SEQ ID NO 59258 | CAAACTCTTTAAGTCTCCAGTT | TTT | chr17 | 42899378 | 42899399 | 42899395 | 42899400 | + |
| SEQ ID NO 59259 | AAACTCTTTAAGTCTCCAGTTA | TTC | chr17 | 42899379 | 42899400 | 42899396 | 42899401 | + |
| SEQ ID NO 59260 | TTTAAGTCTCCAGTTACCATTT | CTC | chr17 | 42899385 | 42899406 | 42899402 | 42899407 | + |
| SEQ ID NO 59261 | TAAGTCTCCAGTTACCATTTTG | CTT | chr17 | 42899387 | 42899408 | 42899404 | 42899409 | + |
| SEQ ID NO 59262 | AAGTCTCCAGTTACCATTTTGC | TTT | chr17 | 42899388 | 42899409 | 42899405 | 42899410 | + |
| SEQ ID NO 59263 | AGTCTCCAGTTACCATTTTGCT | TTA | chr17 | 42899389 | 42899410 | 42899406 | 42899411 | + |
| SEQ ID NO 59264 | CAGTTACCATTTTGCTGGTATT | CTC | chr17 | 42899395 | 42899416 | 42899412 | 42899417 | + |
| SEQ ID NO 59265 | CCATTTTGCTGGTATTCTTATT | TTA | chr17 | 42899401 | 42899422 | 42899418 | 42899423 | + |
| SEQ ID NO 59266 | TGCTGGTATTCTTATTTGGAAC | TTT | chr17 | 42899407 | 42899428 | 42899424 | 42899429 | + |

Figure 90 (Cont'd)

| | | | | | | | | |
|---|---|---|---|---|---|---|---|---|
| SEQ ID NO 59267 | GCTGGTATTCTTATTTGGAACC | TTT | chr17 | 42899408 | 42899429 | 42899425 | 42899430 | + |
| SEQ ID NO 59268 | CTGGTATTCTTATTTGGAACCA | TTG | chr17 | 42899409 | 42899430 | 42899426 | 42899431 | + |
| SEQ ID NO 59269 | GTATTCTTATTTGGAACCATAC | CTG | chr17 | 42899412 | 42899433 | 42899429 | 42899434 | + |
| SEQ ID NO 59270 | TTATTTGGAACCATACATTCAT | TTC | chr17 | 42899418 | 42899439 | 42899435 | 42899440 | + |
| SEQ ID NO 59271 | ATTTGGAACCATACATTCATCA | CTT | chr17 | 42899420 | 42899441 | 42899437 | 42899442 | + |
| SEQ ID NO 59272 | TTTGGAACCATACATTCATCAT | TTA | chr17 | 42899421 | 42899442 | 42899438 | 42899443 | + |
| SEQ ID NO 59273 | GGAACCATACATTCATCATATT | TTT | chr17 | 42899424 | 42899445 | 42899441 | 42899446 | + |
| SEQ ID NO 59274 | GAACCATACATTCATCATATTG | TTG | chr17 | 42899425 | 42899446 | 42899442 | 42899447 | + |
| SEQ ID NO 59275 | ATCATATTGTTGCACAGTAAGA | TTC | chr17 | 42899438 | 42899459 | 42899455 | 42899460 | + |
| SEQ ID NO 59276 | TTGCACAGTAAGACTATACATT | TTG | chr17 | 42899447 | 42899468 | 42899464 | 42899469 | + |
| SEQ ID NO 59277 | CACAGTAAGACTATACATTCAT | TTG | chr17 | 42899450 | 42899471 | 42899467 | 42899472 | + |
| SEQ ID NO 59278 | TACATTCATTATTTTGCTTAAA | CTA | chr17 | 42899463 | 42899484 | 42899480 | 42899485 | + |
| SEQ ID NO 59279 | ATTATTTTGCTTAAACGTATGA | TTC | chr17 | 42899470 | 42899491 | 42899487 | 42899492 | + |
| SEQ ID NO 59280 | TTTTGCTTAAACGTATGAGTTA | TTA | chr17 | 42899474 | 42899495 | 42899491 | 42899496 | + |
| SEQ ID NO 59281 | TGCTTAAACGTATGAGTTAAAA | TTT | chr17 | 42899477 | 42899498 | 42899494 | 42899499 | + |
| SEQ ID NO 59282 | GCTTAAACGTATGAGTTAAAAC | TTT | chr17 | 42899478 | 42899499 | 42899495 | 42899500 | + |
| SEQ ID NO 59283 | CTTAAACGTATGAGTTAAAACA | TTG | chr17 | 42899479 | 42899500 | 42899496 | 42899501 | + |
| SEQ ID NO 59284 | AAACGTATGAGTTAAAACACTT | CTT | chr17 | 42899482 | 42899503 | 42899499 | 42899504 | + |
| SEQ ID NO 59285 | AACGTATGAGTTAAAACACTTG | TTA | chr17 | 42899483 | 42899504 | 42899500 | 42899505 | + |
| SEQ ID NO 59286 | AAACACTTGGCCAGGCATGGTG | TTA | chr17 | 42899496 | 42899517 | 42899513 | 42899518 | + |
| SEQ ID NO 59287 | GGCCAGGCATGGTGGTTCACAC | CTT | chr17 | 42899504 | 42899525 | 42899521 | 42899526 | + |
| SEQ ID NO 59288 | GCCAGGCATGGTGGTTCACACC | TTG | chr17 | 42899505 | 42899526 | 42899522 | 42899527 | + |
| SEQ ID NO 59289 | ACACCTGTAATCCCAGAGCTTT | TTC | chr17 | 42899522 | 42899543 | 42899539 | 42899544 | + |
| SEQ ID NO 59290 | TAATCCCAGAGCTTTGGGAAGC | CTG | chr17 | 42899529 | 42899550 | 42899546 | 42899551 | + |
| SEQ ID NO 59291 | TGGGAAGCCAAGACTGGCAGAT | CTT | chr17 | 42899543 | 42899564 | 42899560 | 42899565 | + |
| SEQ ID NO 59292 | GGGAAGCCAAGACTGGCAGATC | TTT | chr17 | 42899544 | 42899565 | 42899561 | 42899566 | + |
| SEQ ID NO 59293 | GGAAGCCAAGACTGGCAGATCT | TTG | chr17 | 42899545 | 42899566 | 42899562 | 42899567 | + |
| SEQ ID NO 59294 | GCAGATCTCTTGAGCTCAGGAA | CTG | chr17 | 42899559 | 42899580 | 42899576 | 42899581 | + |
| SEQ ID NO 59295 | TTGAGCTCAGGAATTCAAGACC | CTC | chr17 | 42899568 | 42899589 | 42899585 | 42899590 | + |
| SEQ ID NO 59296 | GAGCTCAGGAATTCAAGACCAG | CTT | chr17 | 42899570 | 42899591 | 42899587 | 42899592 | + |
| SEQ ID NO 59297 | AGCTCAGGAATTCAAGACCAGC | TTG | chr17 | 42899571 | 42899592 | 42899588 | 42899593 | + |
| SEQ ID NO 59298 | AGGAATTCAAGACCAGCCTGGG | CTC | chr17 | 42899576 | 42899597 | 42899593 | 42899598 | + |
| SEQ ID NO 59299 | AAGACCAGCCTGGGCAACATGG | TTC | chr17 | 42899584 | 42899605 | 42899601 | 42899606 | + |
| SEQ ID NO 59300 | GGCAACATGGAAAAACCCCATC | CTG | chr17 | 42899596 | 42899617 | 42899613 | 42899618 | + |
| SEQ ID NO 59301 | TACAAAAGATAGAAAAATTAGC | CTC | chr17 | 42899620 | 42899641 | 42899637 | 42899642 | + |
| SEQ ID NO 59302 | CAAAAGATAGAAAAATTAGCCA | CTA | chr17 | 42899622 | 42899643 | 42899639 | 42899644 | + |
| SEQ ID NO 59303 | GCCAGGCATGGTGGCGTGTGCC | TTA | chr17 | 42899640 | 42899661 | 42899657 | 42899662 | + |
| SEQ ID NO 59304 | TGGTCCCAGCTACTCAGGAGGC | CTG | chr17 | 42899664 | 42899685 | 42899681 | 42899686 | + |
| SEQ ID NO 59305 | CTCAGGAGGCTGAGGTGGGAGG | CTA | chr17 | 42899676 | 42899697 | 42899693 | 42899698 | + |
| SEQ ID NO 59306 | AGGAGGCTGAGGTGGGAGGATC | CTC | chr17 | 42899679 | 42899700 | 42899696 | 42899701 | + |
| SEQ ID NO 59307 | AGGTGGGAGGATCACATTAGCC | CTG | chr17 | 42899688 | 42899709 | 42899705 | 42899710 | + |
| SEQ ID NO 59308 | GCCCAGGAGGTTGAGGCTGCAG | TTA | chr17 | 42899707 | 42899728 | 42899724 | 42899729 | + |
| SEQ ID NO 59309 | AGGCTGCAGTGAGCCGTGATTA | TTG | chr17 | 42899720 | 42899741 | 42899737 | 42899742 | + |
| SEQ ID NO 59310 | CAGTGAGCCGTGATTATGCCAC | CTG | chr17 | 42899726 | 42899747 | 42899743 | 42899748 | + |
| SEQ ID NO 59311 | TGCCACTGCACTCCAGCCTGGG | TTA | chr17 | 42899742 | 42899763 | 42899759 | 42899764 | + |
| SEQ ID NO 59312 | CACTCCAGCCTGGGAGACAGAG | CTG | chr17 | 42899750 | 42899771 | 42899767 | 42899772 | + |
| SEQ ID NO 59313 | CAGCCTGGGAGACAGAGTGAGA | CTC | chr17 | 42899755 | 42899776 | 42899772 | 42899777 | + |
| SEQ ID NO 59314 | GGAGACAGAGTGAGACCCTGTT | CTG | chr17 | 42899762 | 42899783 | 42899779 | 42899784 | + |
| SEQ ID NO 59315 | TTTCAAAAAAAGAGAGAGAAA | CTG | chr17 | 42899782 | 42899803 | 42899799 | 42899804 | + |
| SEQ ID NO 59316 | CAAAAAAAGAGAGAGAAAATT | TTT | chr17 | 42899785 | 42899806 | 42899802 | 42899807 | + |
| SEQ ID NO 59317 | AAAAAAAGAGAGAGAAAATTT | TTC | chr17 | 42899786 | 42899807 | 42899803 | 42899808 | + |
| SEQ ID NO 59318 | AAAAAAGAAAACAACACCAAGG | TTT | chr17 | 42899808 | 42899829 | 42899825 | 42899830 | + |
| SEQ ID NO 59319 | AAAAAGAAAACAACACCAAGGG | TTA | chr17 | 42899809 | 42899830 | 42899826 | 42899831 | + |
| SEQ ID NO 59320 | TAACTTTAAGGTCATTAAATGA | CTG | chr17 | 42899834 | 42899855 | 42899851 | 42899856 | + |
| SEQ ID NO 59321 | TAAGGTCATTAAATGAATTAAT | CTT | chr17 | 42899840 | 42899861 | 42899857 | 42899862 | + |
| SEQ ID NO 59322 | AAGGTCATTAAATGAATTAATC | TTT | chr17 | 42899841 | 42899862 | 42899858 | 42899863 | + |
| SEQ ID NO 59323 | AGGTCATTAAATGAATTAATCA | TTA | chr17 | 42899842 | 42899863 | 42899859 | 42899864 | + |
| SEQ ID NO 59324 | AATGAATTAATCACTGCATTCA | TTA | chr17 | 42899851 | 42899872 | 42899868 | 42899873 | + |

Figure 90 (Cont'd)

| | | | | | | | | |
|---|---|---|---|---|---|---|---|---|
| SEQ ID NO 59325 | ATCACTGCATTCAAAAACGATT | TTA | chr17 | 42899860 | 42899881 | 42899877 | 42899882 | + |
| SEQ ID NO 59326 | CATTCAAAAACGATTACTTTCT | CTG | chr17 | 42899867 | 42899888 | 42899884 | 42899889 | + |
| SEQ ID NO 59327 | AAAAACGATTACTTTCTGGCCC | TTC | chr17 | 42899872 | 42899893 | 42899889 | 42899894 | + |
| SEQ ID NO 59328 | CTTTCTGGCCCTAAGAGACATG | TTA | chr17 | 42899883 | 42899904 | 42899900 | 42899905 | + |
| SEQ ID NO 59329 | TCTGGCCCTAAGAGACATGAGG | CTT | chr17 | 42899886 | 42899907 | 42899903 | 42899908 | + |
| SEQ ID NO 59330 | CTGGCCCTAAGAGACATGAGGC | TTT | chr17 | 42899887 | 42899908 | 42899904 | 42899909 | + |
| SEQ ID NO 59331 | TGGCCCTAAGAGACATGAGGCC | TTC | chr17 | 42899888 | 42899909 | 42899905 | 42899910 | + |
| SEQ ID NO 59332 | GCCCTAAGAGACATGAGGCCAA | CTG | chr17 | 42899890 | 42899911 | 42899907 | 42899912 | + |
| SEQ ID NO 59333 | AGAGACATGAGGCCAATACCAG | CTA | chr17 | 42899896 | 42899917 | 42899913 | 42899918 | + |
| SEQ ID NO 59334 | ATCTCCCAAACCAGAGGCAGAC | TTG | chr17 | 42899929 | 42899950 | 42899946 | 42899951 | + |
| SEQ ID NO 59335 | CCAAACCAGAGGCAGACCCTAG | CTC | chr17 | 42899934 | 42899955 | 42899951 | 42899956 | + |
| SEQ ID NO 59336 | GACTCTAATACAGTTAAGGAAA | CTA | chr17 | 42899955 | 42899976 | 42899972 | 42899977 | + |
| SEQ ID NO 59337 | TAATACAGTTAAGGAAAGACCA | CTC | chr17 | 42899960 | 42899981 | 42899977 | 42899982 | + |
| SEQ ID NO 59338 | ATACAGTTAAGGAAAGACCAGC | CTA | chr17 | 42899962 | 42899983 | 42899979 | 42899984 | + |
| SEQ ID NO 59339 | AGGAAAGACCAGCAAGATGATA | TTA | chr17 | 42899971 | 42899992 | 42899988 | 42899993 | + |
| SEQ ID NO 59340 | CTATATTTTATTTGTTGTTTTT | TTA | chr17 | 42900015 | 42900036 | 42900032 | 42900037 | + |
| SEQ ID NO 59341 | TATTTTATTTGTTGTTTTCTT | CTA | chr17 | 42900018 | 42900039 | 42900035 | 42900040 | + |
| SEQ ID NO 59342 | TATTTGTTGTTTTTCTTTTGTT | TTT | chr17 | 42900023 | 42900044 | 42900040 | 42900045 | + |
| SEQ ID NO 59343 | ATTTGTTGTTTTTCTTTTGTTT | TTT | chr17 | 42900024 | 42900045 | 42900041 | 42900046 | + |
| SEQ ID NO 59344 | TTTGTTGTTTTTCTTTTGTTTT | TTA | chr17 | 42900025 | 42900046 | 42900042 | 42900047 | + |
| SEQ ID NO 59345 | GTTGTTTTTCTTTTGTTTTGTT | TTT | chr17 | 42900028 | 42900049 | 42900045 | 42900050 | + |
| SEQ ID NO 59346 | TTGTTTTTCTTTTGTTTTGTTT | TTG | chr17 | 42900029 | 42900050 | 42900046 | 42900051 | + |
| SEQ ID NO 59347 | TTTTTCTTTTGTTTTGTTTTGT | TTG | chr17 | 42900032 | 42900053 | 42900049 | 42900054 | + |
| SEQ ID NO 59348 | TTCTTTTGTTTTGTTTTGTTTT | TTT | chr17 | 42900035 | 42900056 | 42900052 | 42900057 | + |
| SEQ ID NO 59349 | TCTTTTGTTTTGTTTTGTTTTG | TTT | chr17 | 42900036 | 42900057 | 42900053 | 42900058 | + |
| SEQ ID NO 59350 | CTTTTGTTTTGTTTTGTTTTGT | TTT | chr17 | 42900037 | 42900058 | 42900054 | 42900059 | + |
| SEQ ID NO 59351 | TTTTGTTTTGTTTTGTTTTGTT | TTC | chr17 | 42900038 | 42900059 | 42900055 | 42900060 | + |
| SEQ ID NO 59352 | TTGTTTTGTTTTGTTTTGTTTT | CTT | chr17 | 42900040 | 42900061 | 42900057 | 42900062 | + |
| SEQ ID NO 59353 | TGTTTTGTTTTGTTTTGTTTTG | TTT | chr17 | 42900041 | 42900062 | 42900058 | 42900063 | + |
| SEQ ID NO 59354 | GTTTTGTTTTGTTTTGTTTTGT | TTT | chr17 | 42900042 | 42900063 | 42900059 | 42900064 | + |
| SEQ ID NO 59355 | TTTTGTTTTGTTTTGTTTTGTT | TTG | chr17 | 42900043 | 42900064 | 42900060 | 42900065 | + |
| SEQ ID NO 59356 | TGTTTTGTTTTGTTTTGTTTTG | TTT | chr17 | 42900046 | 42900067 | 42900063 | 42900068 | + |
| SEQ ID NO 59357 | GTTTTGTTTTGTTTTGTTTTGT | TTT | chr17 | 42900047 | 42900068 | 42900064 | 42900069 | + |
| SEQ ID NO 59358 | TTTTGTTTTGTTTTGTTTTGTT | TTG | chr17 | 42900048 | 42900069 | 42900065 | 42900070 | + |
| SEQ ID NO 59359 | TGTTTTGTTTTGTTTTGTTTTA | TTT | chr17 | 42900051 | 42900072 | 42900068 | 42900073 | + |
| SEQ ID NO 59360 | GTTTTGTTTTGTTTTGTTTTAG | TTT | chr17 | 42900052 | 42900073 | 42900069 | 42900074 | + |
| SEQ ID NO 59361 | TTTTGTTTTGTTTTGTTTTAGA | TTG | chr17 | 42900053 | 42900074 | 42900070 | 42900075 | + |
| SEQ ID NO 59362 | TGTTTTGTTTTGTTTTAGAGAC | TTT | chr17 | 42900056 | 42900077 | 42900073 | 42900078 | + |
| SEQ ID NO 59363 | GTTTTGTTTTGTTTTAGAGACT | TTT | chr17 | 42900057 | 42900078 | 42900074 | 42900079 | + |
| SEQ ID NO 59364 | TTTTGTTTTGTTTTAGAGACTG | TTG | chr17 | 42900058 | 42900079 | 42900075 | 42900080 | + |
| SEQ ID NO 59365 | TGTTTTGTTTTAGAGACTGGGG | TTT | chr17 | 42900061 | 42900082 | 42900078 | 42900083 | + |
| SEQ ID NO 59366 | GTTTTGTTTTAGAGACTGGGGT | TTT | chr17 | 42900062 | 42900083 | 42900079 | 42900084 | + |
| SEQ ID NO 59367 | TTTTGTTTTAGAGACTGGGGTC | TTG | chr17 | 42900063 | 42900084 | 42900080 | 42900085 | + |
| SEQ ID NO 59368 | TGTTTTAGAGACTGGGGTCTTG | TTT | chr17 | 42900066 | 42900087 | 42900083 | 42900088 | + |
| SEQ ID NO 59369 | GTTTTAGAGACTGGGGTCTTGC | TTT | chr17 | 42900067 | 42900088 | 42900084 | 42900089 | + |
| SEQ ID NO 59370 | TTTTAGAGACTGGGGTCTTGCT | TTG | chr17 | 42900068 | 42900089 | 42900085 | 42900090 | + |
| SEQ ID NO 59371 | TAGAGACTGGGGTCTTGCTCGA | TTT | chr17 | 42900071 | 42900092 | 42900088 | 42900093 | + |
| SEQ ID NO 59372 | AGAGACTGGGGTCTTGCTCGAT | TTT | chr17 | 42900072 | 42900093 | 42900089 | 42900094 | + |
| SEQ ID NO 59373 | GAGACTGGGGTCTTGCTCGATT | TTA | chr17 | 42900073 | 42900094 | 42900090 | 42900095 | + |
| SEQ ID NO 59374 | GGGTCTTGCTCGATTGCCCAGG | CTG | chr17 | 42900080 | 42900101 | 42900097 | 42900102 | + |
| SEQ ID NO 59375 | GCTCGATTGCCCAGGCTGTAGT | CTT | chr17 | 42900087 | 42900108 | 42900104 | 42900109 | + |
| SEQ ID NO 59376 | CTCGATTGCCCAGGCTGTAGTG | TTG | chr17 | 42900088 | 42900109 | 42900105 | 42900110 | + |
| SEQ ID NO 59377 | GATTGCCCAGGCTGTAGTGCAG | CTC | chr17 | 42900091 | 42900112 | 42900108 | 42900113 | + |
| SEQ ID NO 59378 | CCCAGGCTGTAGTGCAGCGGT | TTG | chr17 | 42900096 | 42900117 | 42900113 | 42900118 | + |
| SEQ ID NO 59379 | TAGTGCAGCGGTGGGACAATAG | CTG | chr17 | 42900105 | 42900126 | 42900122 | 42900127 | + |
| SEQ ID NO 59380 | ACTGCAGACTCCAACTCCTGGG | CTC | chr17 | 42900130 | 42900151 | 42900147 | 42900152 | + |
| SEQ ID NO 59381 | CAGACTCCAACTCCTGGGCTCA | CTG | chr17 | 42900134 | 42900155 | 42900151 | 42900156 | + |
| SEQ ID NO 59382 | CAACTCCTGGGCTCAAGCAATC | CTC | chr17 | 42900141 | 42900162 | 42900158 | 42900163 | + |

Figure 90 (Cont'd)

| SEQ ID NO | Sequence | Codon | Chr | Pos1 | Pos2 | Pos3 | Pos4 | Strand |
|---|---|---|---|---|---|---|---|---|
| SEQ ID NO 59383 | CTGGGCTCAAGCAATCCTCCTG | CTC | chr17 | 42900147 | 42900168 | 42900164 | 42900169 | + |
| SEQ ID NO 59384 | GGCTCAAGCAATCCTCCTGCCT | CTG | chr17 | 42900150 | 42900171 | 42900167 | 42900172 | + |
| SEQ ID NO 59385 | AAGCAATCCTCCTGCCTCAGCC | CTC | chr17 | 42900155 | 42900176 | 42900172 | 42900177 | + |
| SEQ ID NO 59386 | CTGCCTCAGCCTCCTGAATAGC | CTC | chr17 | 42900166 | 42900187 | 42900183 | 42900188 | + |
| SEQ ID NO 59387 | CCTCAGCCTCCTGAATAGCTGG | CTG | chr17 | 42900169 | 42900190 | 42900186 | 42900191 | + |
| SEQ ID NO 59388 | AGCCTCCTGAATAGCTGGGACT | CTC | chr17 | 42900173 | 42900194 | 42900190 | 42900195 | + |
| SEQ ID NO 59389 | CTGAATAGCTGGGACTACAAGG | CTC | chr17 | 42900179 | 42900200 | 42900196 | 42900201 | + |
| SEQ ID NO 59390 | AATAGCTGGGACTACAAGGGTA | CTG | chr17 | 42900182 | 42900203 | 42900199 | 42900204 | + |
| SEQ ID NO 59391 | GGACTACAAGGGTACACCATCA | CTG | chr17 | 42900190 | 42900211 | 42900207 | 42900212 | + |
| SEQ ID NO 59392 | CAAGGGTACACCATCACACACA | CTA | chr17 | 42900196 | 42900217 | 42900213 | 42900218 | + |
| SEQ ID NO 59393 | TTTAAATTTTGTGTAGAAACG | TTT | chr17 | 42900230 | 42900251 | 42900247 | 42900252 | + |
| SEQ ID NO 59394 | TTAAATTTTGTGTAGAAACGA | TTT | chr17 | 42900231 | 42900252 | 42900248 | 42900253 | + |
| SEQ ID NO 59395 | TAAATTTTGTGTAGAAACGAG | TTT | chr17 | 42900232 | 42900253 | 42900249 | 42900254 | + |
| SEQ ID NO 59396 | AAATTTTGTGTAGAAACGAGG | TTT | chr17 | 42900233 | 42900254 | 42900250 | 42900255 | + |
| SEQ ID NO 59397 | AATTTTGTGTAGAAACGAGGG | TTA | chr17 | 42900234 | 42900255 | 42900251 | 42900256 | + |
| SEQ ID NO 59398 | TTGTGTAGAAACGAGGGTCTTG | TTT | chr17 | 42900239 | 42900260 | 42900256 | 42900261 | + |
| SEQ ID NO 59399 | TGTGTAGAAACGAGGGTCTTGC | TTT | chr17 | 42900240 | 42900261 | 42900257 | 42900262 | + |
| SEQ ID NO 59400 | GTGTAGAAACGAGGGTCTTGCT | TTT | chr17 | 42900241 | 42900262 | 42900258 | 42900263 | + |
| SEQ ID NO 59401 | TGTAGAAACGAGGGTCTTGCTT | TTG | chr17 | 42900242 | 42900263 | 42900259 | 42900264 | + |
| SEQ ID NO 59402 | GCTTTGTTGCCCAGGCTGGTCT | CTT | chr17 | 42900260 | 42900281 | 42900277 | 42900282 | + |
| SEQ ID NO 59403 | CTTTGTTGCCCAGGCTGGTCTC | TTG | chr17 | 42900261 | 42900282 | 42900278 | 42900283 | + |
| SEQ ID NO 59404 | TGTTGCCCAGGCTGGTCTCCAA | CTT | chr17 | 42900264 | 42900285 | 42900281 | 42900286 | + |
| SEQ ID NO 59405 | GTTGCCCAGGCTGGTCTCCAAC | TTT | chr17 | 42900265 | 42900286 | 42900282 | 42900287 | + |
| SEQ ID NO 59406 | TTGCCCAGGCTGGTCTCCAACT | TTG | chr17 | 42900266 | 42900287 | 42900283 | 42900288 | + |
| SEQ ID NO 59407 | CCCAGGCTGGTCTCCAACTCCT | TTG | chr17 | 42900269 | 42900290 | 42900286 | 42900291 | + |
| SEQ ID NO 59408 | GTCTCCAACTCCTGGCTTCAAG | CTG | chr17 | 42900278 | 42900299 | 42900295 | 42900300 | + |
| SEQ ID NO 59409 | CAACTCCTGGCTTCAAGGGATC | CTC | chr17 | 42900283 | 42900304 | 42900300 | 42900305 | + |
| SEQ ID NO 59410 | CTGGCTTCAAGGGATCCTCCCA | CTC | chr17 | 42900289 | 42900310 | 42900306 | 42900311 | + |
| SEQ ID NO 59411 | GCTTCAAGGGATCCTCCCACCT | CTG | chr17 | 42900292 | 42900313 | 42900309 | 42900314 | + |
| SEQ ID NO 59412 | CAAGGGATCCTCCCACCTCAGC | CTT | chr17 | 42900296 | 42900317 | 42900313 | 42900318 | + |
| SEQ ID NO 59413 | AAGGGATCCTCCCACCTCAGCC | TTC | chr17 | 42900297 | 42900318 | 42900314 | 42900319 | + |
| SEQ ID NO 59414 | CCACCTCAGCCTCCCAAATTGC | CTC | chr17 | 42900308 | 42900329 | 42900325 | 42900330 | + |
| SEQ ID NO 59415 | AGCCTCCCAAATTGCTGGGATT | CTC | chr17 | 42900315 | 42900336 | 42900332 | 42900337 | + |
| SEQ ID NO 59416 | CCAAATTGCTGGGATTACAGGT | CTC | chr17 | 42900321 | 42900342 | 42900338 | 42900343 | + |
| SEQ ID NO 59417 | CTGGGATTACAGGTGTGAGCCA | TTG | chr17 | 42900329 | 42900350 | 42900346 | 42900351 | + |
| SEQ ID NO 59418 | GGATTACAGGTGTGAGCCACCA | CTG | chr17 | 42900332 | 42900353 | 42900349 | 42900354 | + |
| SEQ ID NO 59419 | CAGGTGTGAGCCACCACAACCA | TTA | chr17 | 42900338 | 42900359 | 42900355 | 42900360 | + |
| SEQ ID NO 59420 | TACTAATTTTAAAATTAAGAAC | CTT | chr17 | 42900370 | 42900391 | 42900387 | 42900392 | + |
| SEQ ID NO 59421 | ACTAATTTTAAAATTAAGAACT | TTT | chr17 | 42900371 | 42900392 | 42900388 | 42900393 | + |
| SEQ ID NO 59422 | CTAATTTTAAAATTAAGAACTT | TTA | chr17 | 42900372 | 42900393 | 42900389 | 42900394 | + |
| SEQ ID NO 59423 | ATTTTAAAATTAAGAACTTAAA | CTA | chr17 | 42900375 | 42900396 | 42900392 | 42900397 | + |
| SEQ ID NO 59424 | TAAAATTAAGAACTTAAAACTT | TTT | chr17 | 42900379 | 42900400 | 42900396 | 42900401 | + |
| SEQ ID NO 59425 | AAAATTAAGAACTTAAAACTTG | TTT | chr17 | 42900380 | 42900401 | 42900397 | 42900402 | + |
| SEQ ID NO 59426 | AAATTAAGAACTTAAAACTTGA | TTA | chr17 | 42900381 | 42900402 | 42900398 | 42900403 | + |
| SEQ ID NO 59427 | AGAACTTAAAACTTGAATAGCT | TTA | chr17 | 42900387 | 42900408 | 42900404 | 42900409 | + |
| SEQ ID NO 59428 | AAAACTTGAATAGCTAGAGCAC | CTT | chr17 | 42900394 | 42900415 | 42900411 | 42900416 | + |
| SEQ ID NO 59429 | AAACTTGAATAGCTAGAGCACC | TTA | chr17 | 42900395 | 42900416 | 42900412 | 42900417 | + |
| SEQ ID NO 59430 | GAATAGCTAGAGCACCAAGATT | CTT | chr17 | 42900401 | 42900422 | 42900418 | 42900423 | + |
| SEQ ID NO 59431 | AATAGCTAGAGCACCAAGATTT | TTG | chr17 | 42900402 | 42900423 | 42900419 | 42900424 | + |
| SEQ ID NO 59432 | GAGCACCAAGATTTTCTTTGT | CTA | chr17 | 42900410 | 42900431 | 42900427 | 42900432 | + |
| SEQ ID NO 59433 | TTCTTTGTCCCAAATAAGTGC | TTT | chr17 | 42900424 | 42900445 | 42900441 | 42900446 | + |
| SEQ ID NO 59434 | TCTTTGTCCCAAATAAGTGCA | TTT | chr17 | 42900425 | 42900446 | 42900442 | 42900447 | + |
| SEQ ID NO 59435 | CTTTGTCCCAAATAAGTGCAG | TTT | chr17 | 42900426 | 42900447 | 42900443 | 42900448 | + |
| SEQ ID NO 59436 | TTTGTCCCCAAATAAGTGCAGT | TTC | chr17 | 42900427 | 42900448 | 42900444 | 42900449 | + |
| SEQ ID NO 59437 | TGTCCCCAAATAAGTGCAGTTG | CTT | chr17 | 42900429 | 42900450 | 42900446 | 42900451 | + |
| SEQ ID NO 59438 | GTCCCCAAATAAGTGCAGTTGC | TTT | chr17 | 42900430 | 42900451 | 42900447 | 42900452 | + |
| SEQ ID NO 59439 | TCCCCAAATAAGTGCAGTTGCA | TTG | chr17 | 42900431 | 42900452 | 42900448 | 42900453 | + |
| SEQ ID NO 59440 | CAGGCATAGAAAATCTGACATC | TTG | chr17 | 42900451 | 42900472 | 42900468 | 42900473 | + |

Figure 90 (Cont'd)

| SEQ ID NO 59441 | ACATCTTTGCAAGAATCATCGT | CTG | chr17 | 42900468 | 42900489 | 42900485 | 42900490 | + |
| SEQ ID NO 59442 | TGCAAGAATCATCGTGGATGTA | CTT | chr17 | 42900475 | 42900496 | 42900492 | 42900497 | + |
| SEQ ID NO 59443 | GCAAGAATCATCGTGGATGTAG | TTT | chr17 | 42900476 | 42900497 | 42900493 | 42900498 | + |
| SEQ ID NO 59444 | CAAGAATCATCGTGGATGTAGA | TTG | chr17 | 42900477 | 42900498 | 42900494 | 42900499 | + |
| SEQ ID NO 59445 | TGTCCTGTGTCTCTGGCCTGGT | CTC | chr17 | 42900502 | 42900523 | 42900519 | 42900524 | + |
| SEQ ID NO 59446 | TCCTGTGTCTCTGGCCTGGTTT | CTG | chr17 | 42900504 | 42900525 | 42900521 | 42900526 | + |
| SEQ ID NO 59447 | TGTCTCTGGCCTGGTTTCGGGG | CTG | chr17 | 42900509 | 42900530 | 42900526 | 42900531 | + |
| SEQ ID NO 59448 | TGGCCTGGTTTCGGGGACCAGG | CTC | chr17 | 42900515 | 42900536 | 42900532 | 42900537 | + |
| SEQ ID NO 59449 | GCCTGGTTTCGGGGACCAGGAG | CTG | chr17 | 42900517 | 42900538 | 42900534 | 42900539 | + |
| SEQ ID NO 59450 | GTTTCGGGGACCAGGAGGGCAG | CTG | chr17 | 42900522 | 42900543 | 42900539 | 42900544 | + |
| SEQ ID NO 59451 | CGGGGACCAGGAGGGCAGACCC | TTT | chr17 | 42900526 | 42900547 | 42900543 | 42900548 | + |
| SEQ ID NO 59452 | GGGGACCAGGAGGGCAGACCCT | TTC | chr17 | 42900527 | 42900548 | 42900544 | 42900549 | + |
| SEQ ID NO 59453 | GCACTGCCAAGAAGCATGCCAA | CTT | chr17 | 42900550 | 42900571 | 42900567 | 42900572 | + |
| SEQ ID NO 59454 | CACTGCCAAGAAGCATGCCAAA | TTG | chr17 | 42900551 | 42900572 | 42900568 | 42900573 | + |
| SEQ ID NO 59455 | CCAAGAAGCATGCCAAAGTTAA | CTG | chr17 | 42900556 | 42900577 | 42900573 | 42900578 | + |
| SEQ ID NO 59456 | ATCATTGGCCCTGCTGAGTACA | TTA | chr17 | 42900577 | 42900598 | 42900594 | 42900599 | + |
| SEQ ID NO 59457 | GCCCTGCTGAGTACATGGCCGA | TTG | chr17 | 42900584 | 42900605 | 42900601 | 42900606 | + |
| SEQ ID NO 59458 | CTGAGTACATGGCCGATCAGGC | CTG | chr17 | 42900590 | 42900611 | 42900607 | 42900612 | + |
| SEQ ID NO 59459 | AGTACATGGCCGATCAGGCTGT | CTG | chr17 | 42900593 | 42900614 | 42900610 | 42900615 | + |
| SEQ ID NO 59460 | TTTTTGTGTGCCTGTTTTTCTA | CTG | chr17 | 42900614 | 42900635 | 42900631 | 42900636 | + |
| SEQ ID NO 59461 | TTGTGTGCCTGTTTTTCTATTT | TTT | chr17 | 42900617 | 42900638 | 42900634 | 42900639 | + |
| SEQ ID NO 59462 | TGTGTGCCTGTTTTTCTATTTT | TTT | chr17 | 42900618 | 42900639 | 42900635 | 42900640 | + |
| SEQ ID NO 59463 | GTGTGCCTGTTTTTCTATTTTA | TTT | chr17 | 42900619 | 42900640 | 42900636 | 42900641 | + |
| SEQ ID NO 59464 | TGTGCCTGTTTTTCTATTTTAC | TTG | chr17 | 42900620 | 42900641 | 42900637 | 42900642 | + |
| SEQ ID NO 59465 | TTTTTCTATTTTACGTAAATCA | CTG | chr17 | 42900628 | 42900649 | 42900645 | 42900650 | + |
| SEQ ID NO 59466 | TTCTATTTTACGTAAATCACCC | TTT | chr17 | 42900631 | 42900652 | 42900648 | 42900653 | + |
| SEQ ID NO 59467 | TCTATTTTACGTAAATCACCCT | TTT | chr17 | 42900632 | 42900653 | 42900649 | 42900654 | + |
| SEQ ID NO 59468 | CTATTTTACGTAAATCACCCTG | TTT | chr17 | 42900633 | 42900654 | 42900650 | 42900655 | + |
| SEQ ID NO 59469 | TATTTTACGTAAATCACCCTGA | TTC | chr17 | 42900634 | 42900655 | 42900651 | 42900656 | + |
| SEQ ID NO 59470 | TTTTACGTAAATCACCCTGAAC | CTA | chr17 | 42900636 | 42900657 | 42900653 | 42900658 | + |
| SEQ ID NO 59471 | TACGTAAATCACCCTGAACATG | TTT | chr17 | 42900639 | 42900660 | 42900656 | 42900661 | + |
| SEQ ID NO 59472 | ACGTAAATCACCCTGAACATGT | TTT | chr17 | 42900640 | 42900661 | 42900657 | 42900662 | + |
| SEQ ID NO 59473 | CGTAAATCACCCTGAACATGTT | TTA | chr17 | 42900641 | 42900662 | 42900658 | 42900663 | + |
| SEQ ID NO 59474 | AACATGTTTGCATCAACCTACT | CTG | chr17 | 42900655 | 42900676 | 42900672 | 42900677 | + |
| SEQ ID NO 59475 | GCATCAACCTACTGGTGATGCA | TTT | chr17 | 42900664 | 42900685 | 42900681 | 42900686 | + |
| SEQ ID NO 59476 | CATCAACCTACTGGTGATGCAC | TTG | chr17 | 42900665 | 42900686 | 42900682 | 42900687 | + |
| SEQ ID NO 59477 | CTGGTGATGCACCTTTGATCAA | CTA | chr17 | 42900675 | 42900696 | 42900692 | 42900697 | + |
| SEQ ID NO 59478 | GTGATGCACCTTTGATCAATAC | CTG | chr17 | 42900678 | 42900699 | 42900695 | 42900700 | + |
| SEQ ID NO 59479 | TGATCAATACATTTTAGACAAA | CTT | chr17 | 42900690 | 42900711 | 42900707 | 42900712 | + |
| SEQ ID NO 59480 | GATCAATACATTTTAGACAAAC | TTT | chr17 | 42900691 | 42900712 | 42900708 | 42900713 | + |
| SEQ ID NO 59481 | ATCAATACATTTTAGACAAACG | TTG | chr17 | 42900692 | 42900713 | 42900709 | 42900714 | + |
| SEQ ID NO 59482 | TAGACAAACGTGGTTTTTGAGT | TTT | chr17 | 42900704 | 42900725 | 42900721 | 42900726 | + |
| SEQ ID NO 59483 | AGACAAACGTGGTTTTTGAGTC | TTT | chr17 | 42900705 | 42900726 | 42900722 | 42900727 | + |
| SEQ ID NO 59484 | GACAAACGTGGTTTTTGAGTCC | TTA | chr17 | 42900706 | 42900727 | 42900723 | 42900728 | + |
| SEQ ID NO 59485 | TTGAGTCCAAAGATCAGGGCTG | TTT | chr17 | 42900720 | 42900741 | 42900737 | 42900742 | + |
| SEQ ID NO 59486 | TGAGTCCAAAGATCAGGGCTGG | TTT | chr17 | 42900721 | 42900742 | 42900738 | 42900743 | + |
| SEQ ID NO 59487 | GAGTCCAAAGATCAGGGCTGGG | TTT | chr17 | 42900722 | 42900743 | 42900739 | 42900744 | + |
| SEQ ID NO 59488 | AGTCCAAAGATCAGGGCTGGGT | TTG | chr17 | 42900723 | 42900744 | 42900740 | 42900745 | + |
| SEQ ID NO 59489 | GGTTGACCTGAATACTGGATAC | CTG | chr17 | 42900742 | 42900763 | 42900759 | 42900764 | + |
| SEQ ID NO 59490 | ACCTGAATACTGGATACAGGGC | TTG | chr17 | 42900747 | 42900768 | 42900764 | 42900769 | + |
| SEQ ID NO 59491 | AATACTGGATACAGGGCATATA | CTG | chr17 | 42900752 | 42900773 | 42900769 | 42900774 | + |
| SEQ ID NO 59492 | GATACAGGGCATATAAAACAGG | CTG | chr17 | 42900759 | 42900780 | 42900776 | 42900781 | + |
| SEQ ID NO 59493 | ATAGCAGAGCAATCACCACCAA | CTC | chr17 | 42900797 | 42900818 | 42900814 | 42900819 | + |
| SEQ ID NO 59494 | GAATAACTGCAAGGGCTCTGCT | CTG | chr17 | 42900824 | 42900845 | 42900841 | 42900846 | + |
| SEQ ID NO 59495 | CAAGGGCTCTGCTGACATCTTC | CTG | chr17 | 42900833 | 42900854 | 42900850 | 42900855 | + |
| SEQ ID NO 59496 | TGCTGACATCTTCCTGAGGTGC | CTC | chr17 | 42900842 | 42900863 | 42900859 | 42900864 | + |
| SEQ ID NO 59497 | CTGACATCTTCCTGAGGTGCCA | CTG | chr17 | 42900844 | 42900865 | 42900861 | 42900866 | + |
| SEQ ID NO 59498 | ACATCTTCCTGAGGTGCCAAGG | CTG | chr17 | 42900847 | 42900868 | 42900864 | 42900869 | + |

Figure 90 (Cont'd)

| SEQ ID NO 59499 | CCTGAGGTGCCAAGGAAATGAG | CTT | chr17 | 42900854 | 42900875 | 42900871 | 42900876 | + |
| SEQ ID NO 59500 | CTGAGGTGCCAAGGAAATGAGG | TTC | chr17 | 42900855 | 42900876 | 42900872 | 42900877 | + |
| SEQ ID NO 59501 | AGGTGCCAAGGAAATGAGGATG | CTG | chr17 | 42900858 | 42900879 | 42900875 | 42900880 | + |
| SEQ ID NO 59502 | TCCATGACTTTGGGATCCAGTC | TTC | chr17 | 42900899 | 42900920 | 42900916 | 42900921 | + |
| SEQ ID NO 59503 | CATGACTTTGGGATCCAGTCAA | CTC | chr17 | 42900901 | 42900922 | 42900918 | 42900923 | + |
| SEQ ID NO 59504 | TGGGATCCAGTCAACACATTAC | CTT | chr17 | 42900909 | 42900930 | 42900926 | 42900931 | + |
| SEQ ID NO 59505 | GGGATCCAGTCAACACATTACC | TTT | chr17 | 42900910 | 42900931 | 42900927 | 42900932 | + |
| SEQ ID NO 59506 | GGATCCAGTCAACACATTACCT | TTG | chr17 | 42900911 | 42900932 | 42900928 | 42900933 | + |
| SEQ ID NO 59507 | CCTCCAGGTGAATTACCAAGAC | TTA | chr17 | 42900930 | 42900951 | 42900947 | 42900952 | + |
| SEQ ID NO 59508 | CAGGTGAATTACCAAGACTCCC | CTC | chr17 | 42900934 | 42900955 | 42900951 | 42900956 | + |
| SEQ ID NO 59509 | CCAAGACTCCCAGGACTGGTTC | TTA | chr17 | 42900945 | 42900966 | 42900962 | 42900967 | + |
| SEQ ID NO 59510 | CCAGGACTGGTTCATCTTGGTG | CTC | chr17 | 42900954 | 42900975 | 42900971 | 42900976 | + |
| SEQ ID NO 59511 | GTTCATCTTGGTGTCCGTGATC | CTG | chr17 | 42900963 | 42900984 | 42900980 | 42900985 | + |
| SEQ ID NO 59512 | ATCTTGGTGTCCGTGATCGCAG | TTC | chr17 | 42900967 | 42900988 | 42900984 | 42900989 | + |
| SEQ ID NO 59513 | GGTGTCCGTGATCGCAGACCTC | CTT | chr17 | 42900972 | 42900993 | 42900989 | 42900994 | + |
| SEQ ID NO 59514 | GTGTCCGTGATCGCAGACCTCA | TTG | chr17 | 42900973 | 42900994 | 42900990 | 42900995 | + |
| SEQ ID NO 59515 | AGGAATGCCTTCTACGTCCTCT | CTC | chr17 | 42900994 | 42901015 | 42901011 | 42901016 | + |
| SEQ ID NO 59516 | CTACGTCCTCTTCCCCATCTGG | CTT | chr17 | 42901005 | 42901026 | 42901022 | 42901027 | + |
| SEQ ID NO 59517 | TACGTCCTCTTCCCCATCTGGT | TTC | chr17 | 42901006 | 42901027 | 42901023 | 42901028 | + |
| SEQ ID NO 59518 | CGTCCTCTTCCCCATCTGGTTC | CTA | chr17 | 42901008 | 42901029 | 42901025 | 42901030 | + |
| SEQ ID NO 59519 | TTCCCCATCTGGTTCCATCTTC | CTC | chr17 | 42901015 | 42901036 | 42901032 | 42901037 | + |
| SEQ ID NO 59520 | CCCCATCTGGTTCCATCTTCAG | CTT | chr17 | 42901017 | 42901038 | 42901034 | 42901039 | + |
| SEQ ID NO 59521 | CCCATCTGGTTCCATCTTCAGG | TTC | chr17 | 42901018 | 42901039 | 42901035 | 42901040 | + |
| SEQ ID NO 59522 | GTTCCATCTTCAGGAAGCTGTG | CTG | chr17 | 42901026 | 42901047 | 42901043 | 42901048 | + |
| SEQ ID NO 59523 | CATCTTCAGGAAGCTGTGGGCA | TTC | chr17 | 42901030 | 42901051 | 42901047 | 42901052 | + |
| SEQ ID NO 59524 | CAGGAAGCTGTGGGCATTAAAC | CTT | chr17 | 42901036 | 42901057 | 42901053 | 42901058 | + |
| SEQ ID NO 59525 | AGGAAGCTGTGGGCATTAAACT | TTC | chr17 | 42901037 | 42901058 | 42901054 | 42901059 | + |
| SEQ ID NO 59526 | TGGGCATTAAACTCCTTTGGGT | CTG | chr17 | 42901046 | 42901067 | 42901063 | 42901068 | + |
| SEQ ID NO 59527 | AACTCCTTTGGGTAGCTGTGAT | TTA | chr17 | 42901055 | 42901076 | 42901072 | 42901077 | + |
| SEQ ID NO 59528 | CTTTGGGTAGCTGTGATTGGAG | CTC | chr17 | 42901060 | 42901081 | 42901077 | 42901082 | + |
| SEQ ID NO 59529 | TGGGTAGCTGTGATTGGAGACT | CTT | chr17 | 42901063 | 42901084 | 42901080 | 42901085 | + |
| SEQ ID NO 59530 | GGGTAGCTGTGATTGGAGACTG | TTT | chr17 | 42901064 | 42901085 | 42901081 | 42901086 | + |
| SEQ ID NO 59531 | GGTAGCTGTGATTGGAGACTGG | TTG | chr17 | 42901065 | 42901086 | 42901082 | 42901087 | + |
| SEQ ID NO 59532 | TGATTGGAGACTGGCTCAACCT | CTG | chr17 | 42901073 | 42901094 | 42901090 | 42901095 | + |
| SEQ ID NO 59533 | GAGACTGGCTCAACCTCGTCTT | TTG | chr17 | 42901079 | 42901100 | 42901096 | 42901101 | + |
| SEQ ID NO 59534 | GCTCAACCTCGTCTTTAAGTGG | CTG | chr17 | 42901086 | 42901107 | 42901103 | 42901108 | + |
| SEQ ID NO 59535 | AACCTCGTCTTTAAGTGGTAAG | CTC | chr17 | 42901090 | 42901111 | 42901107 | 42901112 | + |
| SEQ ID NO 59536 | GTCTTTAAGTGGTAAGAACCAT | CTC | chr17 | 42901096 | 42901117 | 42901113 | 42901118 | + |
| SEQ ID NO 59537 | TAAGTGGTAAGAACCATATAGA | CTT | chr17 | 42901101 | 42901122 | 42901118 | 42901123 | + |
| SEQ ID NO 59538 | AAGTGGTAAGAACCATATAGAG | TTT | chr17 | 42901102 | 42901123 | 42901119 | 42901124 | + |
| SEQ ID NO 59539 | AGTGGTAAGAACCATATAGAGA | TTA | chr17 | 42901103 | 42901124 | 42901120 | 42901125 | + |
| SEQ ID NO 59540 | GCATTCGCTCTCGCAATGTCTG | CTG | chr17 | 42901149 | 42901170 | 42901166 | 42901171 | + |
| SEQ ID NO 59541 | GCTCTCGCAATGTCTGTCCATC | TTC | chr17 | 42901155 | 42901176 | 42901172 | 42901177 | + |
| SEQ ID NO 59542 | TCGCAATGTCTGTCCATCAGAA | CTC | chr17 | 42901159 | 42901180 | 42901176 | 42901181 | + |
| SEQ ID NO 59543 | GCAATGTCTGTCCATCAGAAGT | CTC | chr17 | 42901161 | 42901182 | 42901178 | 42901183 | + |
| SEQ ID NO 59544 | TCCATCAGAAGTTGCTTTCCCC | CTG | chr17 | 42901171 | 42901192 | 42901188 | 42901193 | + |
| SEQ ID NO 59545 | CTTTCCCCAGGCTATTCAGGAA | TTG | chr17 | 42901185 | 42901206 | 42901202 | 42901207 | + |
| SEQ ID NO 59546 | TCCCCAGGCTATTCAGGAAGCC | CTT | chr17 | 42901188 | 42901209 | 42901205 | 42901210 | + |
| SEQ ID NO 59547 | CCCCAGGCTATTCAGGAAGCCA | TTT | chr17 | 42901189 | 42901210 | 42901206 | 42901211 | + |
| SEQ ID NO 59548 | CCCAGGCTATTCAGGAAGCCAC | TTC | chr17 | 42901190 | 42901211 | 42901207 | 42901212 | + |
| SEQ ID NO 59549 | TTCAGGAAGCCACGGGCTACTC | CTA | chr17 | 42901199 | 42901220 | 42901216 | 42901221 | + |
| SEQ ID NO 59550 | AGGAAGCCACGGGCTACTCATG | TTC | chr17 | 42901202 | 42901223 | 42901219 | 42901224 | + |
| SEQ ID NO 59551 | CTCATGCTTCCAACCCTCTCT | CTA | chr17 | 42901218 | 42901239 | 42901235 | 42901240 | + |
| SEQ ID NO 59552 | ATGCTTCCAACCCTCTCTCTG | CTC | chr17 | 42901221 | 42901242 | 42901238 | 42901243 | + |
| SEQ ID NO 59553 | CCAACCCCTCTCTCTGACTTTG | CTT | chr17 | 42901227 | 42901248 | 42901244 | 42901249 | + |
| SEQ ID NO 59554 | CAACCCCTCTCTCTGACTTTGG | TTC | chr17 | 42901228 | 42901249 | 42901245 | 42901250 | + |
| SEQ ID NO 59555 | TCTCTGACTTTGGATCATCTAC | CTC | chr17 | 42901237 | 42901258 | 42901254 | 42901259 | + |
| SEQ ID NO 59556 | TCTGACTTTGGATCATCTACAT | CTC | chr17 | 42901239 | 42901260 | 42901256 | 42901261 | + |

Figure 90 (Cont'd)

| | | | | | | | | |
|---|---|---|---|---|---|---|---|---|
| SEQ ID NO 59557 | TGACTTTGGATCATCTACATAA | CTC | chr17 | 42901241 | 42901262 | 42901258 | 42901263 | + |
| SEQ ID NO 59558 | ACTTTGGATCATCTACATAAAG | CTG | chr17 | 42901243 | 42901264 | 42901260 | 42901265 | + |
| SEQ ID NO 59559 | TGGATCATCTACATAAAGGGGG | CTT | chr17 | 42901247 | 42901268 | 42901264 | 42901269 | + |
| SEQ ID NO 59560 | GGATCATCTACATAAAGGGGGA | TTT | chr17 | 42901248 | 42901269 | 42901265 | 42901270 | + |
| SEQ ID NO 59561 | GATCATCTACATAAAGGGGGAA | TTG | chr17 | 42901249 | 42901270 | 42901266 | 42901271 | + |
| SEQ ID NO 59562 | CATAAAGGGGGAAGACAGAAAA | CTA | chr17 | 42901258 | 42901279 | 42901275 | 42901280 | + |
| SEQ ID NO 59563 | CCAGTGAGTTGAAAATACAGGA | CTA | chr17 | 42901287 | 42901308 | 42901304 | 42901309 | + |
| SEQ ID NO 59564 | AAAATACAGGAAAGCCTATTTC | TTG | chr17 | 42901298 | 42901319 | 42901315 | 42901320 | + |
| SEQ ID NO 59565 | TTTCATATGGGTTAAAGGGTAG | CTA | chr17 | 42901316 | 42901337 | 42901333 | 42901338 | + |
| SEQ ID NO 59566 | CATATGGGTTAAAGGGTAGGAC | TTT | chr17 | 42901319 | 42901340 | 42901336 | 42901341 | + |
| SEQ ID NO 59567 | ATATGGGTTAAAGGGTAGGACA | TTC | chr17 | 42901320 | 42901341 | 42901337 | 42901342 | + |
| SEQ ID NO 59568 | AAGGGTAGGACAGTTGAATTTC | TTA | chr17 | 42901330 | 42901351 | 42901347 | 42901352 | + |
| SEQ ID NO 59569 | AATTTCGTGAAAAGTCTGAGTT | TTG | chr17 | 42901346 | 42901367 | 42901363 | 42901368 | + |
| SEQ ID NO 59570 | CGTGAAAAGTCTGAGTTATATA | TTT | chr17 | 42901351 | 42901372 | 42901368 | 42901373 | + |
| SEQ ID NO 59571 | GTGAAAAGTCTGAGTTATATAG | TTC | chr17 | 42901352 | 42901373 | 42901369 | 42901374 | + |
| SEQ ID NO 59572 | AGTTATATAGGCTTTGAGCAAA | CTG | chr17 | 42901364 | 42901385 | 42901381 | 42901386 | + |
| SEQ ID NO 59573 | TATAGGCTTTGAGCAAAGAGTT | TTA | chr17 | 42901369 | 42901390 | 42901386 | 42901391 | + |
| SEQ ID NO 59574 | TGAGCAAAGAGTTTTATTAGTA | CTT | chr17 | 42901378 | 42901399 | 42901395 | 42901400 | + |
| SEQ ID NO 59575 | GAGCAAAGAGTTTTATTAGTAT | TTT | chr17 | 42901379 | 42901400 | 42901396 | 42901401 | + |
| SEQ ID NO 59576 | AGCAAAGAGTTTTATTAGTATG | TTG | chr17 | 42901380 | 42901401 | 42901397 | 42901402 | + |
| SEQ ID NO 59577 | TATTAGTATGAAGCAGAAGAGG | TTT | chr17 | 42901392 | 42901413 | 42901409 | 42901414 | + |
| SEQ ID NO 59578 | ATTAGTATGAAGCAGAAGAGGT | TTT | chr17 | 42901393 | 42901414 | 42901410 | 42901415 | + |
| SEQ ID NO 59579 | TTAGTATGAAGCAGAAGAGGTA | TTA | chr17 | 42901394 | 42901415 | 42901411 | 42901416 | + |
| SEQ ID NO 59580 | GTATGAAGCAGAAGAGGTAACA | TTA | chr17 | 42901397 | 42901418 | 42901414 | 42901419 | + |
| SEQ ID NO 59581 | ACACCTGTAATCCCAGCACTTT | CTC | chr17 | 42901454 | 42901475 | 42901471 | 42901476 | + |
| SEQ ID NO 59582 | TAATCCCAGCACTTTGGGAGGC | CTG | chr17 | 42901461 | 42901482 | 42901478 | 42901483 | + |
| SEQ ID NO 59583 | TGGGAGGCCGAGGTGGGCGAAT | CTT | chr17 | 42901475 | 42901496 | 42901492 | 42901497 | + |
| SEQ ID NO 59584 | GGGAGGCCGAGGTGGGCGAATC | TTT | chr17 | 42901476 | 42901497 | 42901493 | 42901498 | + |
| SEQ ID NO 59585 | GGAGGCCGAGGTGGGCGAATCA | TTG | chr17 | 42901477 | 42901498 | 42901494 | 42901499 | + |
| SEQ ID NO 59586 | CTGGGTGAACTCAGGAGTTCAA | CTC | chr17 | 42901502 | 42901523 | 42901519 | 42901524 | + |
| SEQ ID NO 59587 | GGTGAACTCAGGAGTTCAAGAC | CTG | chr17 | 42901505 | 42901526 | 42901522 | 42901527 | + |
| SEQ ID NO 59588 | AGGAGTTCAAGACCAGCCTGGG | CTC | chr17 | 42901514 | 42901535 | 42901531 | 42901536 | + |
| SEQ ID NO 59589 | AAGACCAGCCTGGGCAACATGG | TTC | chr17 | 42901522 | 42901543 | 42901539 | 42901544 | + |
| SEQ ID NO 59590 | GGCAACATGGCGAAACTCCATC | CTG | chr17 | 42901534 | 42901555 | 42901551 | 42901556 | + |
| SEQ ID NO 59591 | CATCTCTACAAAAACATTACGA | CTC | chr17 | 42901552 | 42901573 | 42901569 | 42901574 | + |
| SEQ ID NO 59592 | TACAAAAACATTACGAAAATTA | CTC | chr17 | 42901558 | 42901579 | 42901575 | 42901580 | + |
| SEQ ID NO 59593 | CAAAAACATTACGAAAATTAGC | CTA | chr17 | 42901560 | 42901581 | 42901577 | 42901582 | + |
| SEQ ID NO 59594 | CGAAAATTAGCTGGGCGTGTTG | TTA | chr17 | 42901571 | 42901592 | 42901588 | 42901593 | + |
| SEQ ID NO 59595 | GCTGGGCGTGTTGGTGCTGTAG | TTA | chr17 | 42901580 | 42901601 | 42901597 | 42901602 | + |
| SEQ ID NO 59596 | GGCGTGTTGGTGCTGTAGTCCC | CTG | chr17 | 42901584 | 42901605 | 42901601 | 42901606 | + |
| SEQ ID NO 59597 | GTGCTGTAGTCCCAGCTACTCA | TTG | chr17 | 42901593 | 42901614 | 42901610 | 42901615 | + |
| SEQ ID NO 59598 | TAGTCCCAGCTACTCAGGAGGC | CTG | chr17 | 42901599 | 42901620 | 42901616 | 42901621 | + |
| SEQ ID NO 59599 | CTCAGGAGGCTGAGGTGAGAGG | CTA | chr17 | 42901611 | 42901632 | 42901628 | 42901633 | + |
| SEQ ID NO 59600 | AGGAGGCTGAGGTGAGAGGCGG | CTC | chr17 | 42901614 | 42901635 | 42901631 | 42901636 | + |
| SEQ ID NO 59601 | AGGTGAGAGGCGGAGGAGGTTG | CTG | chr17 | 42901623 | 42901644 | 42901640 | 42901645 | + |
| SEQ ID NO 59602 | CAGTGAGTCAAGATCATGCCAC | TTG | chr17 | 42901645 | 42901666 | 42901662 | 42901667 | + |
| SEQ ID NO 59603 | CACTCCAGCCTGGGCAACAGAG | CTG | chr17 | 42901669 | 42901690 | 42901686 | 42901691 | + |
| SEQ ID NO 59604 | CAGCCTGGGCAACAGAGTAAGA | CTC | chr17 | 42901674 | 42901695 | 42901691 | 42901696 | + |
| SEQ ID NO 59605 | GGCAACAGAGTAAGACCCTGTC | CTG | chr17 | 42901681 | 42901702 | 42901698 | 42901703 | + |
| SEQ ID NO 59606 | TCTCAAAAAAAAAAAAAGATA | CTG | chr17 | 42901701 | 42901722 | 42901718 | 42901723 | + |
| SEQ ID NO 59607 | AAAAAAAAAAAAAGATAGATG | CTC | chr17 | 42901705 | 42901726 | 42901722 | 42901727 | + |
| SEQ ID NO 59608 | TATGAAAAAAGGAAACACACAG | CTG | chr17 | 42901737 | 42901758 | 42901754 | 42901759 | + |
| SEQ ID NO 59609 | AACAGCCTGTTTTGTGGGGTAA | TTC | chr17 | 42901766 | 42901787 | 42901783 | 42901788 | + |
| SEQ ID NO 59610 | TTTTGTGGGGTAATGAAAAGTC | CTG | chr17 | 42901775 | 42901796 | 42901792 | 42901797 | + |
| SEQ ID NO 59611 | TGTGGGGTAATGAAAAGTCACC | TTT | chr17 | 42901778 | 42901799 | 42901795 | 42901800 | + |
| SEQ ID NO 59612 | GTGGGGTAATGAAAAGTCACCC | TTT | chr17 | 42901779 | 42901800 | 42901796 | 42901801 | + |
| SEQ ID NO 59613 | TGGGGTAATGAAAAGTCACCCT | TTG | chr17 | 42901780 | 42901801 | 42901797 | 42901802 | + |
| SEQ ID NO 59614 | GGAACTGGGCTCCAGCCCTCGT | CTG | chr17 | 42901803 | 42901824 | 42901820 | 42901825 | + |

Figure 90 (Cont'd)

| SEQ ID NO 59615 | GGCTCCAGCCCTCGTTCTGCCA | CTG | chr17 | 42901810 | 42901831 | 42901827 | 42901832 | + |
| SEQ ID NO 59616 | CAGCCCTCGTTCTGCCACCCAC | CTC | chr17 | 42901815 | 42901836 | 42901832 | 42901837 | + |
| SEQ ID NO 59617 | GTTCTGCCACCCACCAACTACA | CTC | chr17 | 42901823 | 42901844 | 42901840 | 42901845 | + |
| SEQ ID NO 59618 | TGCCACCCACCAACTACATGTC | TTC | chr17 | 42901827 | 42901848 | 42901844 | 42901849 | + |
| SEQ ID NO 59619 | CCACCCACCAACTACATGTCCT | CTG | chr17 | 42901829 | 42901850 | 42901846 | 42901851 | + |
| SEQ ID NO 59620 | CATGTCCTTGGCAAGTCATATC | CTA | chr17 | 42901843 | 42901864 | 42901860 | 42901865 | + |
| SEQ ID NO 59621 | GGCAAGTCATATCAATTATCTG | CTT | chr17 | 42901852 | 42901873 | 42901869 | 42901874 | + |
| SEQ ID NO 59622 | GCAAGTCATATCAATTATCTGA | TTG | chr17 | 42901853 | 42901874 | 42901870 | 42901875 | + |
| SEQ ID NO 59623 | TCTGAGTTTCTGTTTTATAATC | TTA | chr17 | 42901870 | 42901891 | 42901887 | 42901892 | + |
| SEQ ID NO 59624 | AGTTTCTGTTTTATAATCTACA | CTG | chr17 | 42901874 | 42901895 | 42901891 | 42901896 | + |
| SEQ ID NO 59625 | CTGTTTTATAATCTACAAATAG | TTT | chr17 | 42901879 | 42901900 | 42901896 | 42901901 | + |
| SEQ ID NO 59626 | TGTTTTATAATCTACAAATAGG | TTC | chr17 | 42901880 | 42901901 | 42901897 | 42901902 | + |
| SEQ ID NO 59627 | TTTTATAATCTACAAATAGGTT | CTG | chr17 | 42901882 | 42901903 | 42901899 | 42901904 | + |
| SEQ ID NO 59628 | TATAATCTACAAATAGGTTATC | TTT | chr17 | 42901885 | 42901906 | 42901902 | 42901907 | + |
| SEQ ID NO 59629 | ATAATCTACAAATAGGTTATCT | TTT | chr17 | 42901886 | 42901907 | 42901903 | 42901908 | + |
| SEQ ID NO 59630 | TAATCTACAAATAGGTTATCTC | TTA | chr17 | 42901887 | 42901908 | 42901904 | 42901909 | + |
| SEQ ID NO 59631 | CAAATAGGTTATCTCTGGCAGC | CTA | chr17 | 42901894 | 42901915 | 42901911 | 42901916 | + |
| SEQ ID NO 59632 | TCTCTGGCAGCTTAATAATAAT | TTA | chr17 | 42901905 | 42901926 | 42901922 | 42901927 | + |
| SEQ ID NO 59633 | TGGCAGCTTAATAATAATCAGG | CTC | chr17 | 42901909 | 42901930 | 42901926 | 42901931 | + |
| SEQ ID NO 59634 | GCAGCTTAATAATAATCAGGGT | CTG | chr17 | 42901911 | 42901932 | 42901928 | 42901933 | + |
| SEQ ID NO 59635 | AATAATAATCAGGGTTAACATT | CTT | chr17 | 42901918 | 42901939 | 42901935 | 42901940 | + |
| SEQ ID NO 59636 | ATAATAATCAGGGTTAACATTT | TTA | chr17 | 42901919 | 42901940 | 42901936 | 42901941 | + |
| SEQ ID NO 59637 | ACATTTATTAAACAGTGTGTGC | TTA | chr17 | 42901935 | 42901956 | 42901952 | 42901957 | + |
| SEQ ID NO 59638 | ATTAAACAGTGTGTGCCAGTCC | TTT | chr17 | 42901941 | 42901962 | 42901958 | 42901963 | + |
| SEQ ID NO 59639 | TTAAACAGTGTGTGCCAGTCCA | TTA | chr17 | 42901942 | 42901963 | 42901959 | 42901964 | + |
| SEQ ID NO 59640 | AACAGTGTGTGCCAGTCCATGT | TTA | chr17 | 42901945 | 42901966 | 42901962 | 42901967 | + |
| SEQ ID NO 59641 | TGTGCTTTCTGTGAGGTAGTT | CTA | chr17 | 42901971 | 42901992 | 42901988 | 42901993 | + |
| SEQ ID NO 59642 | TTCTGTGAGGTAGTTACTGCTA | CTT | chr17 | 42901978 | 42901999 | 42901995 | 42902000 | + |
| SEQ ID NO 59643 | TCTGTGAGGTAGTTACTGCTAT | TTT | chr17 | 42901979 | 42902000 | 42901996 | 42902001 | + |
| SEQ ID NO 59644 | CTGTGAGGTAGTTACTGCTATT | TTT | chr17 | 42901980 | 42902001 | 42901997 | 42902002 | + |
| SEQ ID NO 59645 | TGTGAGGTAGTTACTGCTATTT | TTC | chr17 | 42901981 | 42902002 | 42901998 | 42902003 | + |
| SEQ ID NO 59646 | TGAGGTAGTTACTGCTATTTAC | CTG | chr17 | 42901983 | 42902004 | 42902000 | 42902005 | + |
| SEQ ID NO 59647 | CTGCTATTTACAGAAACAGTAG | TTA | chr17 | 42901994 | 42902015 | 42902011 | 42902016 | + |
| SEQ ID NO 59648 | CTATTTACAGAAACAGTAGATG | CTG | chr17 | 42901997 | 42902018 | 42902014 | 42902019 | + |
| SEQ ID NO 59649 | TTTACAGAAACAGTAGATGCAG | CTA | chr17 | 42902000 | 42902021 | 42902017 | 42902022 | + |
| SEQ ID NO 59650 | ACAGAAACAGTAGATGCAGAGA | TTT | chr17 | 42902003 | 42902024 | 42902020 | 42902025 | + |
| SEQ ID NO 59651 | CAGAAACAGTAGATGCAGAGAC | TTA | chr17 | 42902004 | 42902025 | 42902021 | 42902026 | + |
| SEQ ID NO 59652 | AGTTAAATGATTAGGCCAACAA | CTG | chr17 | 42902036 | 42902057 | 42902053 | 42902058 | + |
| SEQ ID NO 59653 | AATGATTAGGCCAACAAGGTTA | TTA | chr17 | 42902041 | 42902062 | 42902058 | 42902063 | + |
| SEQ ID NO 59654 | GGCCAACAAGGTTAGTACATGC | TTA | chr17 | 42902049 | 42902070 | 42902066 | 42902071 | + |
| SEQ ID NO 59655 | GTACATGCCGAGCCAGGATGGA | TTA | chr17 | 42902063 | 42902084 | 42902080 | 42902085 | + |
| SEQ ID NO 59656 | GCTTCCGCGGCAATGCTCTTAT | CTG | chr17 | 42902104 | 42902125 | 42902121 | 42902126 | + |
| SEQ ID NO 59657 | CCGCGGCAATGCTCTTATGAAC | CTT | chr17 | 42902108 | 42902129 | 42902125 | 42902130 | + |
| SEQ ID NO 59658 | CGCGGCAATGCTCTTATGAACT | TTC | chr17 | 42902109 | 42902130 | 42902126 | 42902131 | + |
| SEQ ID NO 59659 | TTATGAACTATGTTACGTCCAG | CTC | chr17 | 42902122 | 42902143 | 42902139 | 42902144 | + |
| SEQ ID NO 59660 | ATGAACTATGTTACGTCCAGTG | CTT | chr17 | 42902124 | 42902145 | 42902141 | 42902146 | + |
| SEQ ID NO 59661 | TGAACTATGTTACGTCCAGTGC | TTA | chr17 | 42902125 | 42902146 | 42902142 | 42902147 | + |
| SEQ ID NO 59662 | TGTTACGTCCAGTGCTGATAAA | CTA | chr17 | 42902132 | 42902153 | 42902149 | 42902154 | + |
| SEQ ID NO 59663 | CGTCCAGTGCTGATAAACTGAC | TTA | chr17 | 42902137 | 42902158 | 42902154 | 42902159 | + |
| SEQ ID NO 59664 | ATAAACTGACTCTCTGGGGAGC | CTG | chr17 | 42902149 | 42902170 | 42902166 | 42902171 | + |
| SEQ ID NO 59665 | ACTCTCTGGGGAGCAGGGGAAA | CTG | chr17 | 42902157 | 42902178 | 42902174 | 42902179 | + |
| SEQ ID NO 59666 | TCTGGGGAGCAGGGGAAAGCCC | CTC | chr17 | 42902161 | 42902182 | 42902178 | 42902183 | + |
| SEQ ID NO 59667 | TGGGGAGCAGGGGAAAGCCCTG | CTC | chr17 | 42902163 | 42902184 | 42902180 | 42902185 | + |
| SEQ ID NO 59668 | GGGAGCAGGGGAAAGCCCTGAG | CTG | chr17 | 42902165 | 42902186 | 42902182 | 42902187 | + |
| SEQ ID NO 59669 | AGTTTAGCATTTGCCAATTTCT | CTG | chr17 | 42902185 | 42902206 | 42902202 | 42902207 | + |
| SEQ ID NO 59670 | AGCATTTGCCAATTTCTATCAC | TTT | chr17 | 42902190 | 42902211 | 42902207 | 42902212 | + |
| SEQ ID NO 59671 | GCATTTGCCAATTTCTATCACG | TTA | chr17 | 42902191 | 42902212 | 42902208 | 42902213 | + |
| SEQ ID NO 59672 | GCCAATTTCTATCACGTAAACA | TTT | chr17 | 42902197 | 42902218 | 42902214 | 42902219 | + |

Figure 90 (Cont'd)

| | | | | | | | | |
|---|---|---|---|---|---|---|---|---|
| SEQ ID NO 59673 | CCAATTTCTATCACGTAAACAT | TTG | chr17 | 42902198 | 42902219 | 42902215 | 42902220 | + |
| SEQ ID NO 59674 | CTATCACGTAAACATTCCCATT | TTT | chr17 | 42902205 | 42902226 | 42902222 | 42902227 | + |
| SEQ ID NO 59675 | TATCACGTAAACATTCCCATTC | TTC | chr17 | 42902206 | 42902227 | 42902223 | 42902228 | + |
| SEQ ID NO 59676 | TCACGTAAACATTCCCATTCTG | CTA | chr17 | 42902208 | 42902229 | 42902225 | 42902230 | + |
| SEQ ID NO 59677 | CCATTCTGGCCACTTTCTTTCT | TTC | chr17 | 42902222 | 42902243 | 42902239 | 42902244 | + |
| SEQ ID NO 59678 | TGGCCACTTTCTTTCTTTCTTT | TTC | chr17 | 42902228 | 42902249 | 42902245 | 42902250 | + |
| SEQ ID NO 59679 | GCCACTTTCTTTCTTTCTTTCT | CTG | chr17 | 42902230 | 42902251 | 42902247 | 42902252 | + |
| SEQ ID NO 59680 | TCTTTCTTTCTTTCTTTTGTTT | CTT | chr17 | 42902237 | 42902258 | 42902254 | 42902259 | + |
| SEQ ID NO 59681 | CTTTCTTTCTTCTTTTGTTTG | TTT | chr17 | 42902238 | 42902259 | 42902255 | 42902260 | + |
| SEQ ID NO 59682 | TTTCTTTCTTTCTTTTGTTTGT | TTC | chr17 | 42902239 | 42902260 | 42902256 | 42902261 | + |
| SEQ ID NO 59683 | TCTTTCTTTCTTTTGTTTGTTT | CTT | chr17 | 42902241 | 42902262 | 42902258 | 42902263 | + |
| SEQ ID NO 59684 | CTTTCTTTCTTTTGTTTGTTTG | TTT | chr17 | 42902242 | 42902263 | 42902259 | 42902264 | + |
| SEQ ID NO 59685 | TTTCTTTCTTTTGTTTGTTTGT | TTC | chr17 | 42902243 | 42902264 | 42902260 | 42902265 | + |
| SEQ ID NO 59686 | TCTTTCTTTTGTTTGTTTGTTT | CTT | chr17 | 42902245 | 42902266 | 42902262 | 42902267 | + |
| SEQ ID NO 59687 | CTTTCTTTTGTTTGTTTGTTTG | TTT | chr17 | 42902246 | 42902267 | 42902263 | 42902268 | + |
| SEQ ID NO 59688 | TTTCTTTTGTTTGTTTGTTTGA | TTC | chr17 | 42902247 | 42902268 | 42902264 | 42902269 | + |
| SEQ ID NO 59689 | TCTTTTGTTTGTTTGTTTGAGA | CTT | chr17 | 42902249 | 42902270 | 42902266 | 42902271 | + |
| SEQ ID NO 59690 | CTTTTGTTTGTTTGTTTGAGAT | TTT | chr17 | 42902250 | 42902271 | 42902267 | 42902272 | + |
| SEQ ID NO 59691 | TTTTGTTTGTTTGTTTGAGATG | TTC | chr17 | 42902251 | 42902272 | 42902268 | 42902273 | + |
| SEQ ID NO 59692 | TTGTTTGTTTGTTTGAGATGGA | CTT | chr17 | 42902253 | 42902274 | 42902270 | 42902275 | + |
| SEQ ID NO 59693 | TGTTTGTTTGTTTGAGATGGAG | TTT | chr17 | 42902254 | 42902275 | 42902271 | 42902276 | + |
| SEQ ID NO 59694 | GTTTGTTTGTTTGAGATGGAGT | TTT | chr17 | 42902255 | 42902276 | 42902272 | 42902277 | + |
| SEQ ID NO 59695 | TTTGTTTGTTTGAGATGGAGTC | TTG | chr17 | 42902256 | 42902277 | 42902273 | 42902278 | + |
| SEQ ID NO 59696 | GTTTGTTTGAGATGGAGTCTCG | TTT | chr17 | 42902259 | 42902280 | 42902276 | 42902281 | + |
| SEQ ID NO 59697 | TTTGTTTGAGATGGAGTCTCGC | TTG | chr17 | 42902260 | 42902281 | 42902277 | 42902282 | + |
| SEQ ID NO 59698 | GTTTGAGATGGAGTCTCGCACT | TTT | chr17 | 42902263 | 42902284 | 42902280 | 42902285 | + |
| SEQ ID NO 59699 | TTTGAGATGGAGTCTCGCACTG | TTG | chr17 | 42902264 | 42902285 | 42902281 | 42902286 | + |
| SEQ ID NO 59700 | GAGATGGAGTCTCGCACTGTTG | TTT | chr17 | 42902267 | 42902288 | 42902284 | 42902289 | + |
| SEQ ID NO 59701 | AGATGGAGTCTCGCACTGTTGC | TTG | chr17 | 42902268 | 42902289 | 42902285 | 42902290 | + |
| SEQ ID NO 59702 | GCACTGTTGCCTGGCTGGAGTG | CTC | chr17 | 42902280 | 42902301 | 42902297 | 42902302 | + |
| SEQ ID NO 59703 | TTGCCTGGCTGGAGTGCAATGG | CTG | chr17 | 42902286 | 42902307 | 42902303 | 42902308 | + |
| SEQ ID NO 59704 | CCTGGCTGGAGTGCAATGGTGC | TTG | chr17 | 42902289 | 42902310 | 42902306 | 42902311 | + |
| SEQ ID NO 59705 | GCTGGAGTGCAATGGTGCAATC | CTG | chr17 | 42902293 | 42902314 | 42902310 | 42902315 | + |
| SEQ ID NO 59706 | GAGTGCAATGGTGCAATCTCAG | CTG | chr17 | 42902297 | 42902318 | 42902314 | 42902319 | + |
| SEQ ID NO 59707 | AGCTCACTGCAACCTCTGCCTC | CTC | chr17 | 42902317 | 42902338 | 42902334 | 42902339 | + |
| SEQ ID NO 59708 | ACTGCAACCTCTGCCTCTCCGG | CTC | chr17 | 42902322 | 42902343 | 42902339 | 42902344 | + |
| SEQ ID NO 59709 | CAACCTCTGCCTCTCCGGTTCA | CTG | chr17 | 42902326 | 42902347 | 42902343 | 42902348 | + |
| SEQ ID NO 59710 | TGCCTCTCCGGTTCAAGTGATT | CTC | chr17 | 42902333 | 42902354 | 42902350 | 42902355 | + |
| SEQ ID NO 59711 | CCTCTCCGGTTCAAGTGATTCT | CTG | chr17 | 42902335 | 42902356 | 42902352 | 42902357 | + |
| SEQ ID NO 59712 | TCCGGTTCAAGTGATTCTCCTG | CTC | chr17 | 42902339 | 42902360 | 42902356 | 42902361 | + |
| SEQ ID NO 59713 | CGGTTCAAGTGATTCTCCTGCC | CTC | chr17 | 42902341 | 42902362 | 42902358 | 42902363 | + |
| SEQ ID NO 59714 | AAGTGATTCTCCTGCCTCAGCC | TTC | chr17 | 42902347 | 42902368 | 42902364 | 42902369 | + |
| SEQ ID NO 59715 | TCCTGCCTCAGCCTCCCAAGTA | TTC | chr17 | 42902356 | 42902377 | 42902373 | 42902378 | + |
| SEQ ID NO 59716 | CTGCCTCAGCCTCCCAAGTAGC | CTC | chr17 | 42902358 | 42902379 | 42902375 | 42902380 | + |
| SEQ ID NO 59717 | CCTCAGCCTCCCAAGTAGCTGG | CTG | chr17 | 42902361 | 42902382 | 42902378 | 42902383 | + |
| SEQ ID NO 59718 | AGCCTCCCAAGTAGCTGGGATT | CTC | chr17 | 42902365 | 42902386 | 42902382 | 42902387 | + |
| SEQ ID NO 59719 | CCAAGTAGCTGGGATTACAGGT | CTC | chr17 | 42902371 | 42902392 | 42902388 | 42902393 | + |
| SEQ ID NO 59720 | GGATTACAGGTGCCCGCCACCA | CTG | chr17 | 42902382 | 42902403 | 42902399 | 42902404 | + |
| SEQ ID NO 59721 | CAGGTGCCCGCCACCATGCCCA | TTA | chr17 | 42902388 | 42902409 | 42902405 | 42902410 | + |
| SEQ ID NO 59722 | ATTTTTTTTGTATTTTAGTAG | CTA | chr17 | 42902414 | 42902435 | 42902431 | 42902436 | + |
| SEQ ID NO 59723 | TTTTTGTATTTTAGTAGAGAC | TTT | chr17 | 42902418 | 42902439 | 42902435 | 42902440 | + |
| SEQ ID NO 59724 | TTTTGTATTTTAGTAGAGACA | TTT | chr17 | 42902419 | 42902440 | 42902436 | 42902441 | + |
| SEQ ID NO 59725 | TTTGTATTTTAGTAGAGACAT | TTT | chr17 | 42902420 | 42902441 | 42902437 | 42902442 | + |
| SEQ ID NO 59726 | TTGTATTTTAGTAGAGACATG | TTT | chr17 | 42902421 | 42902442 | 42902438 | 42902443 | + |
| SEQ ID NO 59727 | TGTATTTTAGTAGAGACATGG | TTT | chr17 | 42902422 | 42902443 | 42902439 | 42902444 | + |
| SEQ ID NO 59728 | GTATTTTAGTAGAGACATGGT | TTT | chr17 | 42902423 | 42902444 | 42902440 | 42902445 | + |
| SEQ ID NO 59729 | TATTTTAGTAGAGACATGGTT | TTG | chr17 | 42902424 | 42902445 | 42902441 | 42902446 | + |
| SEQ ID NO 59730 | TTAGTAGAGACATGGTTTCACT | TTT | chr17 | 42902429 | 42902450 | 42902446 | 42902451 | + |

Figure 90 (Cont'd)

| SEQ ID NO 59731 | TAGTAGAGACATGGTTTCACTA | TTT | chr17 | 42902430 | 42902451 | 42902447 | 42902452 | + |
|---|---|---|---|---|---|---|---|---|
| SEQ ID NO 59732 | AGTAGAGACATGGTTTCACTAT | TTT | chr17 | 42902431 | 42902452 | 42902448 | 42902453 | + |
| SEQ ID NO 59733 | GTAGAGACATGGTTTCACTATG | TTA | chr17 | 42902432 | 42902453 | 42902449 | 42902454 | + |
| SEQ ID NO 59734 | CACTATGTTGACTAGGCTGGTC | TTT | chr17 | 42902447 | 42902468 | 42902464 | 42902469 | + |
| SEQ ID NO 59735 | ACTATGTTGACTAGGCTGGTCT | TTC | chr17 | 42902448 | 42902469 | 42902465 | 42902470 | + |
| SEQ ID NO 59736 | TGTTGACTAGGCTGGTCTCGAA | CTA | chr17 | 42902452 | 42902473 | 42902469 | 42902474 | + |
| SEQ ID NO 59737 | ACTAGGCTGGTCTCGAACTCCT | TTG | chr17 | 42902457 | 42902478 | 42902474 | 42902479 | + |
| SEQ ID NO 59738 | GGCTGGTCTCGAACTCCTGACC | CTA | chr17 | 42902461 | 42902482 | 42902478 | 42902483 | + |
| SEQ ID NO 59739 | GTCTCGAACTCCTGACCTCATG | CTG | chr17 | 42902466 | 42902487 | 42902483 | 42902488 | + |
| SEQ ID NO 59740 | GAACTCCTGACCTCATGATCTG | CTC | chr17 | 42902471 | 42902492 | 42902488 | 42902493 | + |
| SEQ ID NO 59741 | CTGACCTCATGATCTGCCTGCC | CTC | chr17 | 42902477 | 42902498 | 42902494 | 42902499 | + |
| SEQ ID NO 59742 | ACCTCATGATCTGCCTGCCTTG | CTG | chr17 | 42902480 | 42902501 | 42902497 | 42902502 | + |
| SEQ ID NO 59743 | ATGATCTGCCTGCCTTGGCCTC | CTC | chr17 | 42902485 | 42902506 | 42902502 | 42902507 | + |
| SEQ ID NO 59744 | CCTGCCTTGGCCTCCCTAAGTG | CTG | chr17 | 42902493 | 42902514 | 42902510 | 42902515 | + |
| SEQ ID NO 59745 | CCTTGGCCTCCCTAAGTGCTAG | CTG | chr17 | 42902497 | 42902518 | 42902514 | 42902519 | + |
| SEQ ID NO 59746 | GGCCTCCCTAAGTGCTAGGATT | CTT | chr17 | 42902501 | 42902522 | 42902518 | 42902523 | + |
| SEQ ID NO 59747 | GCCTCCCTAAGTGCTAGGATTA | TTG | chr17 | 42902502 | 42902523 | 42902519 | 42902524 | + |
| SEQ ID NO 59748 | CCTAAGTGCTAGGATTACAGGC | CTC | chr17 | 42902507 | 42902528 | 42902524 | 42902529 | + |
| SEQ ID NO 59749 | AGTGCTAGGATTACAGGCGTGA | CTA | chr17 | 42902511 | 42902532 | 42902528 | 42902533 | + |
| SEQ ID NO 59750 | GGATTACAGGCGTGAGCCACTA | CTA | chr17 | 42902518 | 42902539 | 42902535 | 42902540 | + |
| SEQ ID NO 59751 | CAGGCGTGAGCCACTACACCCA | TTA | chr17 | 42902524 | 42902545 | 42902541 | 42902546 | + |
| SEQ ID NO 59752 | CACCCAGCCGCATGATTCTAAA | CTA | chr17 | 42902540 | 42902561 | 42902557 | 42902562 | + |
| SEQ ID NO 59753 | TAAAAAATAAAAAGATGAAGTG | TTC | chr17 | 42902558 | 42902579 | 42902575 | 42902580 | + |
| SEQ ID NO 59754 | AAAAATAAAAGATGAAGTGTT | CTA | chr17 | 42902560 | 42902581 | 42902577 | 42902582 | + |
| SEQ ID NO 59755 | TTCCAAACATCTGATCTCCATT | TTA | chr17 | 42902583 | 42902604 | 42902600 | 42902605 | + |
| SEQ ID NO 59756 | CAAACATCTGATCTCCATTGAA | TTC | chr17 | 42902586 | 42902607 | 42902603 | 42902608 | + |
| SEQ ID NO 59757 | ATCTCCATTGAAGAACCATGCA | CTG | chr17 | 42902596 | 42902617 | 42902613 | 42902618 | + |
| SEQ ID NO 59758 | CATTGAAGAACCATGCAATCTC | CTC | chr17 | 42902601 | 42902622 | 42902618 | 42902623 | + |
| SEQ ID NO 59759 | AAGAACCATGCAATCTCTCTGG | TTG | chr17 | 42902606 | 42902627 | 42902623 | 42902628 | + |
| SEQ ID NO 59760 | TCTGGGTTGATAGAGGCCAGAG | CTC | chr17 | 42902623 | 42902644 | 42902640 | 42902645 | + |
| SEQ ID NO 59761 | TGGGTTGATAGAGGCCAGAGTT | CTC | chr17 | 42902625 | 42902646 | 42902642 | 42902647 | + |
| SEQ ID NO 59762 | GGTTGATAGAGGCCAGAGTTAG | CTG | chr17 | 42902627 | 42902648 | 42902644 | 42902649 | + |
| SEQ ID NO 59763 | ATAGAGGCCAGAGTTAGTGGCT | TTG | chr17 | 42902632 | 42902653 | 42902649 | 42902654 | + |
| SEQ ID NO 59764 | GTGGCTCTCCCTGATTTCGGTG | TTA | chr17 | 42902648 | 42902669 | 42902665 | 42902670 | + |
| SEQ ID NO 59765 | TCCCTGATTTCGGTGAGAAATC | CTC | chr17 | 42902655 | 42902676 | 42902672 | 42902677 | + |
| SEQ ID NO 59766 | CCTGATTTCGGTGAGAAATCAC | CTC | chr17 | 42902657 | 42902678 | 42902674 | 42902679 | + |
| SEQ ID NO 59767 | ATTTCGGTGAGAAATCACTATT | CTG | chr17 | 42902661 | 42902682 | 42902678 | 42902683 | + |
| SEQ ID NO 59768 | CGGTGAGAAATCACTATTCCAC | TTT | chr17 | 42902665 | 42902686 | 42902682 | 42902687 | + |
| SEQ ID NO 59769 | GGTGAGAAATCACTATTCCACC | TTC | chr17 | 42902666 | 42902687 | 42902683 | 42902688 | + |
| SEQ ID NO 59770 | TTCCACCATCACGGGATAAAAG | CTA | chr17 | 42902681 | 42902702 | 42902698 | 42902703 | + |
| SEQ ID NO 59771 | CACCATCACGGGATAAAAGCA | TTC | chr17 | 42902684 | 42902705 | 42902701 | 42902706 | + |
| SEQ ID NO 59772 | ACTGGCGGTTGACACCTATTTC | CTG | chr17 | 42902711 | 42902732 | 42902728 | 42902733 | + |
| SEQ ID NO 59773 | GCGGTTGACACCTATTTCCACA | CTG | chr17 | 42902715 | 42902736 | 42902732 | 42902737 | + |
| SEQ ID NO 59774 | ACACCTATTTCCACAGTGAAAG | TTG | chr17 | 42902722 | 42902743 | 42902739 | 42902744 | + |
| SEQ ID NO 59775 | TTTCCACAGTGAAAGATATATC | CTA | chr17 | 42902729 | 42902750 | 42902746 | 42902751 | + |
| SEQ ID NO 59776 | CCACAGTGAAAGATATATCTAG | TTT | chr17 | 42902732 | 42902753 | 42902749 | 42902754 | + |
| SEQ ID NO 59777 | CACAGTGAAAGATATATCTAGT | TTC | chr17 | 42902733 | 42902754 | 42902750 | 42902755 | + |
| SEQ ID NO 59778 | GTACTTTTAAAGGGGAAGTGGT | CTA | chr17 | 42902753 | 42902774 | 42902770 | 42902775 | + |
| SEQ ID NO 59779 | TTAAAGGGGAAGTGGTTTGTCT | CTT | chr17 | 42902759 | 42902780 | 42902776 | 42902781 | + |
| SEQ ID NO 59780 | TAAAGGGGAAGTGGTTTGTCTG | TTT | chr17 | 42902760 | 42902781 | 42902777 | 42902782 | + |
| SEQ ID NO 59781 | AAAGGGGAAGTGGTTTGTCTGA | TTT | chr17 | 42902761 | 42902782 | 42902778 | 42902783 | + |
| SEQ ID NO 59782 | AAGGGGAAGTGGTTTGTCTGAG | TTA | chr17 | 42902762 | 42902783 | 42902779 | 42902784 | + |
| SEQ ID NO 59783 | GTCTGAGATACTCTGTTTCAAA | TTT | chr17 | 42902777 | 42902798 | 42902794 | 42902799 | + |
| SEQ ID NO 59784 | TCTGAGATACTCTGTTTCAAAG | TTG | chr17 | 42902778 | 42902799 | 42902795 | 42902800 | + |
| SEQ ID NO 59785 | AGATACTCTGTTTCAAAGTAGA | CTG | chr17 | 42902782 | 42902803 | 42902799 | 42902804 | + |
| SEQ ID NO 59786 | TGTTTCAAAGTAGAGAGGATAC | CTC | chr17 | 42902790 | 42902811 | 42902807 | 42902812 | + |
| SEQ ID NO 59787 | TTTCAAAGTAGAGAGGATACAG | CTG | chr17 | 42902792 | 42902813 | 42902809 | 42902814 | + |
| SEQ ID NO 59788 | CAAAGTAGAGAGGATACAGAAC | TTT | chr17 | 42902795 | 42902816 | 42902812 | 42902817 | + |

Figure 90 (Cont'd)

| | | | | | | | | |
|---|---|---|---|---|---|---|---|---|
| SEQ ID NO 59789 | AAAGTAGAGAGGATACAGAACA | TTC | chr17 | 42902796 | 42902817 | 42902813 | 42902818 | + |
| SEQ ID NO 59790 | AAGCTATATACATCCTTACAGA | CTG | chr17 | 42902826 | 42902847 | 42902843 | 42902848 | + |
| SEQ ID NO 59791 | TATACATCCTTACAGAGAGCAA | CTA | chr17 | 42902832 | 42902853 | 42902849 | 42902854 | + |
| SEQ ID NO 59792 | ACAGAGAGCAATTCTGATGGAA | CTT | chr17 | 42902843 | 42902864 | 42902860 | 42902865 | + |
| SEQ ID NO 59793 | CAGAGAGCAATTCTGATGGAAA | TTA | chr17 | 42902844 | 42902865 | 42902861 | 42902866 | + |
| SEQ ID NO 59794 | TGATGGAAATGCAGGCCATGTT | TTC | chr17 | 42902857 | 42902878 | 42902874 | 42902879 | + |
| SEQ ID NO 59795 | ATGGAAATGCAGGCCATGTTTC | CTG | chr17 | 42902859 | 42902880 | 42902876 | 42902881 | + |
| SEQ ID NO 59796 | CCCTGGGGGGGCTCGTCCTAG | TTT | chr17 | 42902880 | 42902901 | 42902897 | 42902902 | + |
| SEQ ID NO 59797 | CCTGGGGGGGCTCGTCCTAGG | TTC | chr17 | 42902881 | 42902902 | 42902898 | 42902903 | + |
| SEQ ID NO 59798 | GGGGGGGCTCGTCCTAGGGGCT | CTG | chr17 | 42902885 | 42902906 | 42902902 | 42902907 | + |
| SEQ ID NO 59799 | GTCCTAGGGGCTGGAGTGCATT | CTC | chr17 | 42902895 | 42902916 | 42902912 | 42902917 | + |
| SEQ ID NO 59800 | GGGGCTGGAGTGCATTCTCTGA | CTA | chr17 | 42902901 | 42902922 | 42902918 | 42902923 | + |
| SEQ ID NO 59801 | GAGTGCATTCTCTGATGTCAGA | CTG | chr17 | 42902908 | 42902929 | 42902925 | 42902930 | + |
| SEQ ID NO 59802 | TCTGATGTCAGAGGAAATGCAA | TTC | chr17 | 42902918 | 42902939 | 42902935 | 42902940 | + |
| SEQ ID NO 59803 | TGATGTCAGAGGAAATGCAAGA | CTC | chr17 | 42902920 | 42902941 | 42902937 | 42902942 | + |
| SEQ ID NO 59804 | ATGTCAGAGGAAATGCAAGATT | CTG | chr17 | 42902922 | 42902943 | 42902939 | 42902944 | + |
| SEQ ID NO 59805 | CCTGAGGCCTGAGGGAACCCAT | TTC | chr17 | 42902945 | 42902966 | 42902962 | 42902967 | + |
| SEQ ID NO 59806 | AGGCCTGAGGGAACCCATGGTA | CTG | chr17 | 42902949 | 42902970 | 42902966 | 42902971 | + |
| SEQ ID NO 59807 | AGGGAACCCATGGTATATGCAA | CTG | chr17 | 42902956 | 42902977 | 42902973 | 42902978 | + |
| SEQ ID NO 59808 | CAAACTGTAGTTCCATATGCAT | TTT | chr17 | 42902988 | 42903009 | 42903005 | 42903010 | + |
| SEQ ID NO 59809 | AAACTGTAGTTCCATATGCATT | TTC | chr17 | 42902989 | 42903010 | 42903006 | 42903011 | + |
| SEQ ID NO 59810 | TAGTTCCATATGCATTCTTCCA | CTG | chr17 | 42902995 | 42903016 | 42903012 | 42903017 | + |
| SEQ ID NO 59811 | CATATGCATTCTTCCAGGACAA | TTC | chr17 | 42903001 | 42903022 | 42903018 | 42903023 | + |
| SEQ ID NO 59812 | TTCCAGGACAAATACTTCTTGA | TTC | chr17 | 42903012 | 42903033 | 42903029 | 42903034 | + |
| SEQ ID NO 59813 | CCAGGACAAATACTTCTTGAGG | CTT | chr17 | 42903014 | 42903035 | 42903031 | 42903036 | + |
| SEQ ID NO 59814 | CAGGACAAATACTTCTTGAGGT | TTC | chr17 | 42903015 | 42903036 | 42903032 | 42903037 | + |
| SEQ ID NO 59815 | CTTGAGGTTAAAAAAAAAAAGT | CTT | chr17 | 42903029 | 42903050 | 42903046 | 42903051 | + |
| SEQ ID NO 59816 | TTGAGGTTAAAAAAAAAAAGTC | TTC | chr17 | 42903030 | 42903051 | 42903047 | 42903052 | + |
| SEQ ID NO 59817 | GAGGTTAAAAAAAAAAAGTCAC | CTT | chr17 | 42903032 | 42903053 | 42903049 | 42903054 | + |
| SEQ ID NO 59818 | AGGTTAAAAAAAAAAAGTCACA | TTG | chr17 | 42903033 | 42903054 | 42903050 | 42903055 | + |
| SEQ ID NO 59819 | AAAAAAAAAAGTCACATAGCTG | TTA | chr17 | 42903039 | 42903060 | 42903056 | 42903061 | + |
| SEQ ID NO 59820 | CCATTTTATGGATTTCAGGATT | CTG | chr17 | 42903061 | 42903082 | 42903078 | 42903083 | + |
| SEQ ID NO 59821 | TATGGATTTCAGGATTTTTTTT | TTT | chr17 | 42903067 | 42903088 | 42903084 | 42903089 | + |
| SEQ ID NO 59822 | ATGGATTTCAGGATTTTTTTTT | TTT | chr17 | 42903068 | 42903089 | 42903085 | 42903090 | + |
| SEQ ID NO 59823 | TGGATTTCAGGATTTTTTTTTT | TTA | chr17 | 42903069 | 42903090 | 42903086 | 42903091 | + |
| SEQ ID NO 59824 | CAGGATTTTTTTTTTTTTTTTT | TTT | chr17 | 42903076 | 42903097 | 42903093 | 42903098 | + |
| SEQ ID NO 59825 | AGGATTTTTTTTTTTTTTTTTT | TTC | chr17 | 42903077 | 42903098 | 42903094 | 42903099 | + |
| SEQ ID NO 59826 | TTTTTTTTTTTTTTTGAGATG | TTT | chr17 | 42903084 | 42903105 | 42903101 | 42903106 | + |
| SEQ ID NO 59827 | TTTTTTTTTTTTTTGAGATGG | TTT | chr17 | 42903085 | 42903106 | 42903102 | 42903107 | + |
| SEQ ID NO 59828 | TTTTTTTTTTTTTGAGATGGA | TTT | chr17 | 42903086 | 42903107 | 42903103 | 42903108 | + |
| SEQ ID NO 59829 | TTTTTTTTTTTTGAGATGGAG | TTT | chr17 | 42903087 | 42903108 | 42903104 | 42903109 | + |
| SEQ ID NO 59830 | TTTTTTTTTTTGAGATGGAGT | TTT | chr17 | 42903088 | 42903109 | 42903105 | 42903110 | + |
| SEQ ID NO 59831 | TTTTTTTTTTGAGATGGAGTC | TTT | chr17 | 42903089 | 42903110 | 42903106 | 42903111 | + |
| SEQ ID NO 59832 | TTTTTTTTTGAGATGGAGTCT | TTT | chr17 | 42903090 | 42903111 | 42903107 | 42903112 | + |
| SEQ ID NO 59833 | TTTTTTTTGAGATGGAGTCTT | TTT | chr17 | 42903091 | 42903112 | 42903108 | 42903113 | + |
| SEQ ID NO 59834 | TTTTTTTGAGATGGAGTCTTG | TTT | chr17 | 42903092 | 42903113 | 42903109 | 42903114 | + |
| SEQ ID NO 59835 | TTTTTTGAGATGGAGTCTTGC | TTT | chr17 | 42903093 | 42903114 | 42903110 | 42903115 | + |
| SEQ ID NO 59836 | TTTTTGAGATGGAGTCTTGCT | TTT | chr17 | 42903094 | 42903115 | 42903111 | 42903116 | + |
| SEQ ID NO 59837 | TTTTGAGATGGAGTCTTGCTC | TTT | chr17 | 42903095 | 42903116 | 42903112 | 42903117 | + |
| SEQ ID NO 59838 | TTTGAGATGGAGTCTTGCTCT | TTT | chr17 | 42903096 | 42903117 | 42903113 | 42903118 | + |
| SEQ ID NO 59839 | TTGAGATGGAGTCTTGCTCTG | TTT | chr17 | 42903097 | 42903118 | 42903114 | 42903119 | + |
| SEQ ID NO 59840 | TGAGATGGAGTCTTGCTCTGT | TTT | chr17 | 42903098 | 42903119 | 42903115 | 42903120 | + |
| SEQ ID NO 59841 | GAGATGGAGTCTTGCTCTGTC | TTT | chr17 | 42903099 | 42903120 | 42903116 | 42903121 | + |
| SEQ ID NO 59842 | AGATGGAGTCTTGCTCTGTCA | TTT | chr17 | 42903100 | 42903121 | 42903117 | 42903122 | + |
| SEQ ID NO 59843 | AGATGGAGTCTTGCTCTGTCAC | TTG | chr17 | 42903101 | 42903122 | 42903118 | 42903123 | + |
| SEQ ID NO 59844 | GCTCTGTCACCCAGCCTGTAGT | CTT | chr17 | 42903113 | 42903134 | 42903130 | 42903135 | + |
| SEQ ID NO 59845 | CTCTGTCACCCAGCCTGTAGTG | TTG | chr17 | 42903114 | 42903135 | 42903131 | 42903136 | + |
| SEQ ID NO 59846 | TGTCACCCAGCCTGTAGTGCAG | CTC | chr17 | 42903117 | 42903138 | 42903134 | 42903139 | + |

Figure 90 (Cont'd)

| | | | | | | | | |
|---|---|---|---|---|---|---|---|---|
| SEQ ID NO 59847 | TCACCCAGCCTGTAGTGCAGTG | CTG | chr17 | 42903119 | 42903140 | 42903136 | 42903141 | + |
| SEQ ID NO 59848 | TAGTGCAGTGGCATAATCTCGG | CTG | chr17 | 42903131 | 42903152 | 42903148 | 42903153 | + |
| SEQ ID NO 59849 | GGCTCACGGCAACCTCCGCCTC | CTC | chr17 | 42903151 | 42903172 | 42903168 | 42903173 | + |
| SEQ ID NO 59850 | ACGGCAACCTCCGCCTCCCAGG | CTC | chr17 | 42903156 | 42903177 | 42903173 | 42903178 | + |
| SEQ ID NO 59851 | CGCCTCCCAGGTTCAAGCGATT | CTC | chr17 | 42903167 | 42903188 | 42903184 | 42903189 | + |
| SEQ ID NO 59852 | CCAGGTTCAAGCGATTCTCTTG | CTC | chr17 | 42903173 | 42903194 | 42903190 | 42903195 | + |
| SEQ ID NO 59853 | AAGCGATTCTCTTGCCTTAGCC | TTC | chr17 | 42903181 | 42903202 | 42903198 | 42903203 | + |
| SEQ ID NO 59854 | TCTTGCCTTAGCCTCCCGAGTA | TTC | chr17 | 42903190 | 42903211 | 42903207 | 42903212 | + |
| SEQ ID NO 59855 | TTGCCTTAGCCTCCCGAGTAGC | CTC | chr17 | 42903192 | 42903213 | 42903209 | 42903214 | + |
| SEQ ID NO 59856 | GCCTTAGCCTCCCGAGTAGCTG | CTT | chr17 | 42903194 | 42903215 | 42903211 | 42903216 | + |
| SEQ ID NO 59857 | CCTTAGCCTCCCGAGTAGCTGG | TTG | chr17 | 42903195 | 42903216 | 42903212 | 42903217 | + |
| SEQ ID NO 59858 | AGCCTCCCGAGTAGCTGGGATT | CTT | chr17 | 42903199 | 42903220 | 42903216 | 42903221 | + |
| SEQ ID NO 59859 | GCCTCCCGAGTAGCTGGGATTA | TTA | chr17 | 42903200 | 42903221 | 42903217 | 42903222 | + |
| SEQ ID NO 59860 | CCGAGTAGCTGGGATTACAGTC | CTC | chr17 | 42903205 | 42903226 | 42903222 | 42903227 | + |
| SEQ ID NO 59861 | GGATTACAGTCACGCACCACCA | CTG | chr17 | 42903216 | 42903237 | 42903233 | 42903238 | + |
| SEQ ID NO 59862 | CAGTCACGCACCACCACATCTG | TTA | chr17 | 42903222 | 42903243 | 42903239 | 42903244 | + |
| SEQ ID NO 59863 | GCTAATTCTTTATATTTTTTGG | CTG | chr17 | 42903244 | 42903265 | 42903261 | 42903266 | + |
| SEQ ID NO 59864 | ATTCTTTATATTTTTTGGTAGA | CTA | chr17 | 42903248 | 42903269 | 42903265 | 42903270 | + |
| SEQ ID NO 59865 | TTTTATATTTTTTGGTAGAAACG | TTC | chr17 | 42903252 | 42903273 | 42903269 | 42903274 | + |
| SEQ ID NO 59866 | TATATTTTTTGGTAGAAACGGT | CTT | chr17 | 42903254 | 42903275 | 42903271 | 42903276 | + |
| SEQ ID NO 59867 | ATATTTTTTGGTAGAAACGGTG | TTT | chr17 | 42903255 | 42903276 | 42903272 | 42903277 | + |
| SEQ ID NO 59868 | TATTTTTTGGTAGAAACGGTGT | TTA | chr17 | 42903256 | 42903277 | 42903273 | 42903278 | + |
| SEQ ID NO 59869 | TTTGGTAGAAACGGTGTTTCAC | TTT | chr17 | 42903261 | 42903282 | 42903278 | 42903283 | + |
| SEQ ID NO 59870 | TTGGTAGAAACGGTGTTTCACC | TTT | chr17 | 42903262 | 42903283 | 42903279 | 42903284 | + |
| SEQ ID NO 59871 | TGGTAGAAACGGTGTTTCACCA | TTT | chr17 | 42903263 | 42903284 | 42903280 | 42903285 | + |
| SEQ ID NO 59872 | GGTAGAAACGGTGTTTCACCAT | TTT | chr17 | 42903264 | 42903285 | 42903281 | 42903286 | + |
| SEQ ID NO 59873 | GTAGAAACGGTGTTTCACCATG | TTG | chr17 | 42903265 | 42903286 | 42903282 | 42903287 | + |
| SEQ ID NO 59874 | CACCATGTTGGCCAGGCTGGTC | TTT | chr17 | 42903280 | 42903301 | 42903297 | 42903302 | + |
| SEQ ID NO 59875 | ACCATGTTGGCCAGGCTGGTCT | TTC | chr17 | 42903281 | 42903302 | 42903298 | 42903303 | + |
| SEQ ID NO 59876 | GCCAGGCTGGTCTCAAACTCCT | TTG | chr17 | 42903290 | 42903311 | 42903307 | 42903312 | + |
| SEQ ID NO 59877 | GTCTCAAACTCCTGACCTCATG | CTG | chr17 | 42903299 | 42903320 | 42903316 | 42903321 | + |
| SEQ ID NO 59878 | AAACTCCTGACCTCATGTGATC | CTC | chr17 | 42903304 | 42903325 | 42903321 | 42903326 | + |
| SEQ ID NO 59879 | CTGACCTCATGTGATCTGCCTG | CTC | chr17 | 42903310 | 42903331 | 42903327 | 42903332 | + |
| SEQ ID NO 59880 | ACCTCATGTGATCTGCCTGCCT | CTG | chr17 | 42903313 | 42903334 | 42903330 | 42903335 | + |
| SEQ ID NO 59881 | ATGTGATCTGCCTGCCTTGGCC | CTC | chr17 | 42903318 | 42903339 | 42903335 | 42903340 | + |
| SEQ ID NO 59882 | CCTGCCTTGGCCTCCCAAAGTG | CTG | chr17 | 42903328 | 42903349 | 42903345 | 42903350 | + |
| SEQ ID NO 59883 | CCTTGGCCTCCCAAAGTGCTGA | CTG | chr17 | 42903332 | 42903353 | 42903349 | 42903354 | + |
| SEQ ID NO 59884 | GGCCTCCCAAAGTGCTGAGATT | CTT | chr17 | 42903336 | 42903357 | 42903353 | 42903358 | + |
| SEQ ID NO 59885 | GCCTCCCAAAGTGCTGAGATTA | TTG | chr17 | 42903337 | 42903358 | 42903354 | 42903359 | + |
| SEQ ID NO 59886 | CCAAAGTGCTGAGATTACAGGT | CTC | chr17 | 42903342 | 42903363 | 42903359 | 42903364 | + |
| SEQ ID NO 59887 | AGATTACAGGTGTGAGCCACCG | CTG | chr17 | 42903353 | 42903374 | 42903370 | 42903375 | + |
| SEQ ID NO 59888 | CAGGTGTGAGCCACCGCGCCTG | TTA | chr17 | 42903359 | 42903380 | 42903376 | 42903381 | + |
| SEQ ID NO 59889 | CCTGGAGTTCAGAATCTTGGGC | CTG | chr17 | 42903381 | 42903402 | 42903398 | 42903403 | + |
| SEQ ID NO 59890 | GAGTTCAGAATCTTGGGCTTCA | CTG | chr17 | 42903385 | 42903406 | 42903402 | 42903407 | + |
| SEQ ID NO 59891 | AGAATCTTGGGCTTCATTATTT | TTC | chr17 | 42903391 | 42903412 | 42903408 | 42903413 | + |
| SEQ ID NO 59892 | GGGCTTCATTATTTGTGTTTAA | CTT | chr17 | 42903399 | 42903420 | 42903416 | 42903421 | + |
| SEQ ID NO 59893 | GGCTTCATTATTTGTGTTTAAA | TTG | chr17 | 42903400 | 42903421 | 42903417 | 42903422 | + |
| SEQ ID NO 59894 | CATTATTTGTGTTTAAATAGAT | CTT | chr17 | 42903405 | 42903426 | 42903422 | 42903427 | + |
| SEQ ID NO 59895 | ATTATTTGTGTTTAAATAGATC | TTC | chr17 | 42903406 | 42903427 | 42903423 | 42903428 | + |
| SEQ ID NO 59896 | TTTGTGTTTAAATAGATCATAC | TTA | chr17 | 42903410 | 42903431 | 42903427 | 42903432 | + |
| SEQ ID NO 59897 | GTGTTTAAATAGATCATACAGT | TTT | chr17 | 42903413 | 42903434 | 42903430 | 42903435 | + |
| SEQ ID NO 59898 | TGTTTAAATAGATCATACAGTC | TTG | chr17 | 42903414 | 42903435 | 42903431 | 42903436 | + |
| SEQ ID NO 59899 | AAATAGATCATACAGTCAGGCA | TTT | chr17 | 42903419 | 42903440 | 42903436 | 42903441 | + |
| SEQ ID NO 59900 | AATAGATCATACAGTCAGGCAC | TTA | chr17 | 42903420 | 42903441 | 42903437 | 42903442 | + |
| SEQ ID NO 59901 | ATGCCTGTAATCCCAGCACTTT | CTC | chr17 | 42903450 | 42903471 | 42903467 | 42903472 | + |
| SEQ ID NO 59902 | TAATCCCAGCACTTTGGGAGGC | CTG | chr17 | 42903457 | 42903478 | 42903474 | 42903479 | + |
| SEQ ID NO 59903 | TGGGAGGCTGAGGTGGGAGGAT | CTT | chr17 | 42903471 | 42903492 | 42903488 | 42903493 | + |
| SEQ ID NO 59904 | GGGAGGCTGAGGTGGGAGGATT | TTT | chr17 | 42903472 | 42903493 | 42903489 | 42903494 | + |

Figure 90 (Cont'd)

| SEQ ID NO 59905 | GGAGGCTGAGGTGGGAGGATTG | TTG | chr17 | 42903473 | 42903494 | 42903490 | 42903495 | + |
| SEQ ID NO 59906 | AGGTGGGAGGATTGCCTGAGTT | CTG | chr17 | 42903481 | 42903502 | 42903498 | 42903503 | + |
| SEQ ID NO 59907 | CCTGAGTTCAGGAGATGGAGAC | TTG | chr17 | 42903495 | 42903516 | 42903512 | 42903517 | + |
| SEQ ID NO 59908 | AGTTCAGGAGATGGAGACCAGC | CTG | chr17 | 42903499 | 42903520 | 42903516 | 42903521 | + |
| SEQ ID NO 59909 | AGGAGATGGAGACCAGCCTGGG | TTC | chr17 | 42903504 | 42903525 | 42903521 | 42903526 | + |
| SEQ ID NO 59910 | GGCAACATGGTGAAACCCCGTC | CTG | chr17 | 42903524 | 42903545 | 42903541 | 42903546 | + |
| SEQ ID NO 59911 | TACTAAAAATACAAAAACTAGC | CTC | chr17 | 42903548 | 42903569 | 42903565 | 42903570 | + |
| SEQ ID NO 59912 | CTAAAAATACAAAAACTAGCTG | CTA | chr17 | 42903550 | 42903571 | 42903567 | 42903572 | + |
| SEQ ID NO 59913 | AAAATACAAAAACTAGCTGGAT | CTA | chr17 | 42903553 | 42903574 | 42903570 | 42903575 | + |
| SEQ ID NO 59914 | GCTGGATGTGGTGGCACACACC | CTA | chr17 | 42903568 | 42903589 | 42903585 | 42903590 | + |
| SEQ ID NO 59915 | GATGTGGTGGCACACACCTGTA | CTG | chr17 | 42903572 | 42903593 | 42903589 | 42903594 | + |
| SEQ ID NO 59916 | TAGTCCCAGCTATTCAGGAGGC | CTG | chr17 | 42903592 | 42903613 | 42903609 | 42903614 | + |
| SEQ ID NO 59917 | TTCAGGAGGCTGAGGTGGGAGG | CTA | chr17 | 42903604 | 42903625 | 42903621 | 42903626 | + |
| SEQ ID NO 59918 | AGGAGGCTGAGGTGGGAGGATC | TTC | chr17 | 42903607 | 42903628 | 42903624 | 42903629 | + |
| SEQ ID NO 59919 | AGGTGGGAGGATCCCAGGAGGT | CTG | chr17 | 42903616 | 42903637 | 42903633 | 42903638 | + |
| SEQ ID NO 59920 | CGCCACTGCACTCCAGGCTGGG | TTG | chr17 | 42903662 | 42903683 | 42903679 | 42903684 | + |
| SEQ ID NO 59921 | CACTCCAGGCTGGGTTACTGAG | CTG | chr17 | 42903670 | 42903691 | 42903687 | 42903692 | + |
| SEQ ID NO 59922 | CAGGCTGGGTTACTGAGCCAGA | CTC | chr17 | 42903675 | 42903696 | 42903692 | 42903697 | + |
| SEQ ID NO 59923 | GGTTACTGAGCCAGATCCTGTC | CTG | chr17 | 42903682 | 42903703 | 42903699 | 42903704 | + |
| SEQ ID NO 59924 | CTGAGCCAGATCCTGTCTCAAA | TTA | chr17 | 42903687 | 42903708 | 42903704 | 42903709 | + |
| SEQ ID NO 59925 | AGCCAGATCCTGTCTCAAAAAA | CTG | chr17 | 42903690 | 42903711 | 42903707 | 42903712 | + |
| SEQ ID NO 59926 | TCTCAAAAAAAAAAAGATAAT | CTG | chr17 | 42903702 | 42903723 | 42903719 | 42903724 | + |
| SEQ ID NO 59927 | AAAAAAAAAAAAGATAATACAT | CTC | chr17 | 42903706 | 42903727 | 42903723 | 42903728 | + |
| SEQ ID NO 59928 | AAACAGTTCAAAATGCAAAAGT | TTC | chr17 | 42903730 | 42903751 | 42903747 | 42903752 | + |
| SEQ ID NO 59929 | AAAATGCAAAAGTTACATACAT | TTC | chr17 | 42903739 | 42903760 | 42903756 | 42903761 | + |
| SEQ ID NO 59930 | CATACATAAGGAAGTGTCATGA | TTA | chr17 | 42903754 | 42903775 | 42903771 | 42903776 | + |
| SEQ ID NO 59931 | CCTCTCACACTTCTCCCCAGCC | CTC | chr17 | 42903784 | 42903805 | 42903801 | 42903806 | + |
| SEQ ID NO 59932 | TCACACTTCTCCCCAGCCACCC | CTC | chr17 | 42903788 | 42903809 | 42903805 | 42903810 | + |
| SEQ ID NO 59933 | ACACTTCTCCCCAGCCACCCAG | CTC | chr17 | 42903790 | 42903811 | 42903807 | 42903812 | + |
| SEQ ID NO 59934 | CTCCCCAGCCACCCAGTTCTCC | CTT | chr17 | 42903796 | 42903817 | 42903813 | 42903818 | + |
| SEQ ID NO 59935 | TCCCCAGCCACCCAGTTCTCCC | TTC | chr17 | 42903797 | 42903818 | 42903814 | 42903819 | + |
| SEQ ID NO 59936 | CCCAGCCACCCAGTTCTCCCTT | CTC | chr17 | 42903799 | 42903820 | 42903816 | 42903821 | + |
| SEQ ID NO 59937 | TCCCTTCTAGAGGCAACATGTG | TTC | chr17 | 42903815 | 42903836 | 42903832 | 42903837 | + |
| SEQ ID NO 59938 | CCTTCTAGAGGCAACATGTGAA | CTC | chr17 | 42903817 | 42903838 | 42903834 | 42903839 | + |
| SEQ ID NO 59939 | CTAGAGGCAACATGTGAAATCC | CTT | chr17 | 42903821 | 42903842 | 42903838 | 42903843 | + |
| SEQ ID NO 59940 | TAGAGGCAACATGTGAAATCCT | TTC | chr17 | 42903822 | 42903843 | 42903839 | 42903844 | + |
| SEQ ID NO 59941 | GAGGCAACATGTGAAATCCTTC | CTA | chr17 | 42903824 | 42903845 | 42903841 | 42903846 | + |
| SEQ ID NO 59942 | CTCAGGCTACACTCTTCTTGAA | CTT | chr17 | 42903845 | 42903866 | 42903862 | 42903867 | + |
| SEQ ID NO 59943 | TCAGGCTACACTCTTCTTGAAG | TTC | chr17 | 42903846 | 42903867 | 42903863 | 42903868 | + |
| SEQ ID NO 59944 | AGGCTACACTCTTCTTGAAGGT | CTC | chr17 | 42903848 | 42903869 | 42903865 | 42903870 | + |
| SEQ ID NO 59945 | CACTCTTCTTGAAGGTGTAGGC | CTA | chr17 | 42903854 | 42903875 | 42903871 | 42903876 | + |
| SEQ ID NO 59946 | TTCTTGAAGGTGTAGGCTTTGG | CTC | chr17 | 42903859 | 42903880 | 42903876 | 42903881 | + |
| SEQ ID NO 59947 | CTTGAAGGTGTAGGCTTTGGGC | CTT | chr17 | 42903861 | 42903882 | 42903878 | 42903883 | + |
| SEQ ID NO 59948 | TTGAAGGTGTAGGCTTTGGGCA | TTC | chr17 | 42903862 | 42903883 | 42903879 | 42903884 | + |
| SEQ ID NO 59949 | GAAGGTGTAGGCTTTGGGCAAA | CTT | chr17 | 42903864 | 42903885 | 42903881 | 42903886 | + |
| SEQ ID NO 59950 | AAGGTGTAGGCTTTGGGCAAAA | TTG | chr17 | 42903865 | 42903886 | 42903882 | 42903887 | + |
| SEQ ID NO 59951 | TGGGCAAAAGCATTCATTCAGT | CTT | chr17 | 42903878 | 42903899 | 42903895 | 42903900 | + |
| SEQ ID NO 59952 | GGGCAAAAGCATTCATTCAGTA | TTT | chr17 | 42903879 | 42903900 | 42903896 | 42903901 | + |
| SEQ ID NO 59953 | GGCAAAAGCATTCATTCAGTAA | TTG | chr17 | 42903880 | 42903901 | 42903897 | 42903902 | + |
| SEQ ID NO 59954 | ATTCAGTAACCCCAGAAACTTG | TTC | chr17 | 42903893 | 42903914 | 42903910 | 42903915 | + |
| SEQ ID NO 59955 | AGTAACCCCAGAAACTTGTTCT | TTC | chr17 | 42903897 | 42903918 | 42903914 | 42903919 | + |
| SEQ ID NO 59956 | GTTCTGTTTTCCATAGGATTC | CTT | chr17 | 42903914 | 42903935 | 42903931 | 42903936 | + |
| SEQ ID NO 59957 | TTCTGTTTTTCCATAGGATTCT | TTG | chr17 | 42903915 | 42903936 | 42903932 | 42903937 | + |
| SEQ ID NO 59958 | TGTTTTTCCATAGGATTCTCTT | TTC | chr17 | 42903918 | 42903939 | 42903935 | 42903940 | + |
| SEQ ID NO 59959 | TTTTTCCATAGGATTCTCTTTG | CTG | chr17 | 42903920 | 42903941 | 42903937 | 42903942 | + |
| SEQ ID NO 59960 | TTCCATAGGATTCTCTTTGGAC | TTT | chr17 | 42903923 | 42903944 | 42903940 | 42903945 | + |
| SEQ ID NO 59961 | TCCATAGGATTCTCTTTGGACA | TTT | chr17 | 42903924 | 42903945 | 42903941 | 42903946 | + |
| SEQ ID NO 59962 | CCATAGGATTCTCTTTGGACAG | TTT | chr17 | 42903925 | 42903946 | 42903942 | 42903947 | + |

Figure 90 (Cont'd)

| | | | | | | | | |
|---|---|---|---|---|---|---|---|---|
| SEQ ID NO 59963 | CATAGGATTCTCTTTGGACAGC | TTC | chr17 | 42903926 | 42903947 | 42903943 | 42903948 | + |
| SEQ ID NO 59964 | TCTTTGGACAGCGTCCATACTG | TTC | chr17 | 42903936 | 42903957 | 42903953 | 42903958 | + |
| SEQ ID NO 59965 | TTTGGACAGCGTCCATACTGG | CTC | chr17 | 42903938 | 42903959 | 42903955 | 42903960 | + |
| SEQ ID NO 59966 | TGGACAGCGTCCATACTGGTGG | CTT | chr17 | 42903940 | 42903961 | 42903957 | 42903962 | + |
| SEQ ID NO 59967 | GGACAGCGTCCATACTGGTGGG | TTT | chr17 | 42903941 | 42903962 | 42903958 | 42903963 | + |
| SEQ ID NO 59968 | GACAGCGTCCATACTGGTGGGT | TTG | chr17 | 42903942 | 42903963 | 42903959 | 42903964 | + |
| SEQ ID NO 59969 | GTGGGTTTTGGATACTGACTAC | CTG | chr17 | 42903958 | 42903979 | 42903975 | 42903980 | + |
| SEQ ID NO 59970 | TGGATACTGACTACTACAGCAA | TTT | chr17 | 42903966 | 42903987 | 42903983 | 42903988 | + |
| SEQ ID NO 59971 | GGATACTGACTACTACAGCAAC | TTT | chr17 | 42903967 | 42903988 | 42903984 | 42903989 | + |
| SEQ ID NO 59972 | GATACTGACTACTACAGCAACA | TTG | chr17 | 42903968 | 42903989 | 42903985 | 42903990 | + |
| SEQ ID NO 59973 | ACTACTACAGCAACACTTCCGT | CTG | chr17 | 42903975 | 42903996 | 42903992 | 42903997 | + |
| SEQ ID NO 59974 | CTACAGCAACACTTCCGTGCCC | CTA | chr17 | 42903979 | 42904000 | 42903996 | 42904001 | + |
| SEQ ID NO 59975 | CAGCAACACTTCCGTGCCCCTG | CTA | chr17 | 42903982 | 42904003 | 42903999 | 42904004 | + |
| SEQ ID NO 59976 | CCGTGCCCCTGATAAAGCAGTT | CTT | chr17 | 42903993 | 42904014 | 42904010 | 42904015 | + |
| SEQ ID NO 59977 | CGTGCCCCTGATAAAGCAGTTC | TTC | chr17 | 42903994 | 42904015 | 42904011 | 42904016 | + |
| SEQ ID NO 59978 | ATAAAGCAGTTCCCTGTAACCT | CTG | chr17 | 42904004 | 42904025 | 42904021 | 42904026 | + |
| SEQ ID NO 59979 | CCTGTAACCTGTGAGACTGGAC | TTC | chr17 | 42904016 | 42904037 | 42904033 | 42904038 | + |
| SEQ ID NO 59980 | TAACCTGTGAGACTGGACCAGG | CTG | chr17 | 42904020 | 42904041 | 42904037 | 42904042 | + |
| SEQ ID NO 59981 | TGAGACTGGACCAGGTAAGCGT | CTG | chr17 | 42904027 | 42904048 | 42904044 | 42904049 | + |
| SEQ ID NO 59982 | GACCAGGTAAGCGTCCCAGCCC | CTG | chr17 | 42904035 | 42904056 | 42904052 | 42904057 | + |
| SEQ ID NO 59983 | CAGACAGAAGCTGAGTGGACCT | CTG | chr17 | 42904060 | 42904081 | 42904077 | 42904082 | + |
| SEQ ID NO 59984 | AGTGGACCTCGTTTACCTGTTA | CTG | chr17 | 42904073 | 42904094 | 42904090 | 42904095 | + |
| SEQ ID NO 59985 | GTTTACCTGTTATGGATGAAAC | CTC | chr17 | 42904083 | 42904104 | 42904100 | 42904105 | + |
| SEQ ID NO 59986 | ACCTGTTATGGATGAAACTGAC | TTT | chr17 | 42904087 | 42904108 | 42904104 | 42904109 | + |
| SEQ ID NO 59987 | CCTGTTATGGATGAAACTGACC | TTA | chr17 | 42904088 | 42904109 | 42904105 | 42904110 | + |
| SEQ ID NO 59988 | TTATGGATGAAACTGACCTTGA | CTG | chr17 | 42904092 | 42904113 | 42904109 | 42904114 | + |
| SEQ ID NO 59989 | TGGATGAAACTGACCTTGAGGG | TTA | chr17 | 42904095 | 42904116 | 42904112 | 42904117 | + |
| SEQ ID NO 59990 | ACCTTGAGGGGACATGAGGAGA | CTG | chr17 | 42904107 | 42904128 | 42904124 | 42904129 | + |
| SEQ ID NO 59991 | GAGGGGACATGAGGAGAGCCAT | CTT | chr17 | 42904112 | 42904133 | 42904129 | 42904134 | + |
| SEQ ID NO 59992 | AGGGGACATGAGGAGAGCCATT | TTG | chr17 | 42904113 | 42904134 | 42904130 | 42904135 | + |
| SEQ ID NO 59993 | CTTTGTACTTTTGTCATGCTCT | TTC | chr17 | 42904136 | 42904157 | 42904153 | 42904158 | + |
| SEQ ID NO 59994 | TGTACTTTTGTCATGCTCTTCA | CTT | chr17 | 42904139 | 42904160 | 42904156 | 42904161 | + |
| SEQ ID NO 59995 | GTACTTTTGTCATGCTCTTCAA | TTT | chr17 | 42904140 | 42904161 | 42904157 | 42904162 | + |
| SEQ ID NO 59996 | TACTTTTGTCATGCTCTTCAAT | TTG | chr17 | 42904141 | 42904162 | 42904158 | 42904163 | + |
| SEQ ID NO 59997 | TTGTCATGCTCTTCAATTGGCA | CTT | chr17 | 42904146 | 42904167 | 42904163 | 42904168 | + |
| SEQ ID NO 59998 | TGTCATGCTCTTCAATTGGCAC | TTT | chr17 | 42904147 | 42904168 | 42904164 | 42904169 | + |
| SEQ ID NO 59999 | GTCATGCTCTTCAATTGGCACA | TTT | chr17 | 42904148 | 42904169 | 42904165 | 42904170 | + |
| SEQ ID NO 60000 | TCATGCTCTTCAATTGGCACAA | TTG | chr17 | 42904149 | 42904170 | 42904166 | 42904171 | + |
| SEQ ID NO 60001 | TTCAATTGGCACAAATTAATTC | CTC | chr17 | 42904157 | 42904178 | 42904174 | 42904179 | + |
| SEQ ID NO 60002 | CAATTGGCACAAATTAATTCAC | CTT | chr17 | 42904159 | 42904180 | 42904176 | 42904181 | + |
| SEQ ID NO 60003 | AATTGGCACAAATTAATTCACT | TTC | chr17 | 42904160 | 42904181 | 42904177 | 42904182 | + |
| SEQ ID NO 60004 | GCACAAATTAATTCACTTCTGC | TTG | chr17 | 42904165 | 42904186 | 42904182 | 42904187 | + |
| SEQ ID NO 60005 | ATTCACTTCTGCAATACTTTCC | TTA | chr17 | 42904175 | 42904196 | 42904192 | 42904197 | + |
| SEQ ID NO 60006 | ACTTCTGCAATACTTTCCTGAA | TTC | chr17 | 42904179 | 42904200 | 42904196 | 42904201 | + |
| SEQ ID NO 60007 | CTGCAATACTTTCCTGAATAGC | CTT | chr17 | 42904183 | 42904204 | 42904200 | 42904205 | + |
| SEQ ID NO 60008 | TGCAATACTTTCCTGAATAGCA | TTC | chr17 | 42904184 | 42904205 | 42904201 | 42904206 | + |
| SEQ ID NO 60009 | CAATACTTTCCTGAATAGCACA | CTG | chr17 | 42904186 | 42904207 | 42904203 | 42904208 | + |
| SEQ ID NO 60010 | TCCTGAATAGCACAGTAGTATT | CTT | chr17 | 42904194 | 42904215 | 42904211 | 42904216 | + |
| SEQ ID NO 60011 | CCTGAATAGCACAGTAGTATTG | TTT | chr17 | 42904195 | 42904216 | 42904212 | 42904217 | + |
| SEQ ID NO 60012 | CTGAATAGCACAGTAGTATTGG | TTC | chr17 | 42904196 | 42904217 | 42904213 | 42904218 | + |
| SEQ ID NO 60013 | AATAGCACAGTAGTATTGGAAA | CTG | chr17 | 42904199 | 42904220 | 42904216 | 42904221 | + |
| SEQ ID NO 60014 | GAAATCTGCCTATTACAGAACC | TTG | chr17 | 42904217 | 42904238 | 42904234 | 42904239 | + |
| SEQ ID NO 60015 | CCTATTACAGAACCTGGATGGA | CTG | chr17 | 42904225 | 42904246 | 42904242 | 42904247 | + |
| SEQ ID NO 60016 | TTACAGAACCTGGATGGAGTCC | CTA | chr17 | 42904229 | 42904250 | 42904246 | 42904251 | + |
| SEQ ID NO 60017 | CAGAACCTGGATGGAGTCCAGA | TTA | chr17 | 42904232 | 42904253 | 42904249 | 42904254 | + |
| SEQ ID NO 60018 | GATGGAGTCCAGAGAGGCACGG | CTG | chr17 | 42904241 | 42904262 | 42904258 | 42904263 | + |
| SEQ ID NO 60019 | GTGAGAGTCACCGCCCTGCAGC | CTC | chr17 | 42904284 | 42904305 | 42904301 | 42904306 | + |
| SEQ ID NO 60020 | CAGCGCTGTGTCCTGAGAAAGG | CTG | chr17 | 42904302 | 42904323 | 42904319 | 42904324 | + |

Figure 90 (Cont'd)

| | | | | | | | | |
|---|---|---|---|---|---|---|---|---|
| SEQ ID NO 60021 | TGTCCTGAGAAAGGAGGGGGCA | CTG | chr17 | 42904310 | 42904331 | 42904327 | 42904332 | + |
| SEQ ID NO 60022 | AGAAAGGAGGGGGCAGAAGCCT | CTG | chr17 | 42904317 | 42904338 | 42904334 | 42904339 | + |
| SEQ ID NO 60023 | AGCTTCTGGGGGTCCTTCCCAA | CTG | chr17 | 42904340 | 42904361 | 42904357 | 42904362 | + |
| SEQ ID NO 60024 | CTGGGGGTCCTTCCCAATGGCC | CTT | chr17 | 42904345 | 42904366 | 42904362 | 42904367 | + |
| SEQ ID NO 60025 | TGGGGGTCCTTCCCAATGGCCT | TTC | chr17 | 42904346 | 42904367 | 42904363 | 42904368 | + |
| SEQ ID NO 60026 | GGGGTCCTTCCCAATGGCCTGG | CTG | chr17 | 42904348 | 42904369 | 42904365 | 42904370 | + |
| SEQ ID NO 60027 | CCCAATGGCCTGGCCCACTGGA | CTT | chr17 | 42904357 | 42904378 | 42904374 | 42904379 | + |
| SEQ ID NO 60028 | CCAATGGCCTGGCCCACTGGAT | TTC | chr17 | 42904358 | 42904379 | 42904375 | 42904380 | + |
| SEQ ID NO 60029 | GCCCACTGGATGTGCCCTCCTG | CTG | chr17 | 42904369 | 42904390 | 42904386 | 42904391 | + |
| SEQ ID NO 60030 | GATGTGCCCTCCTGAGCTGACC | CTG | chr17 | 42904377 | 42904398 | 42904394 | 42904399 | + |
| SEQ ID NO 60031 | CTGAGCTGACCGTCCAATCCCT | CTC | chr17 | 42904388 | 42904409 | 42904405 | 42904410 | + |
| SEQ ID NO 60032 | AGCTGACCGTCCAATCCCTTGC | CTG | chr17 | 42904391 | 42904412 | 42904408 | 42904413 | + |
| SEQ ID NO 60033 | ACCGTCCAATCCCTTGCCCTCT | CTG | chr17 | 42904396 | 42904417 | 42904413 | 42904418 | + |
| SEQ ID NO 60034 | GCCCTCTCTGTGCCTACGTTTT | CTT | chr17 | 42904411 | 42904432 | 42904428 | 42904433 | + |
| SEQ ID NO 60035 | CCCTCTCTGTGCCTACGTTTTA | TTG | chr17 | 42904412 | 42904433 | 42904429 | 42904434 | + |
| SEQ ID NO 60036 | TCTGTGCCTACGTTTTATTAGT | CTC | chr17 | 42904417 | 42904438 | 42904434 | 42904439 | + |
| SEQ ID NO 60037 | TGTGCCTACGTTTTATTAGTTA | CTC | chr17 | 42904419 | 42904440 | 42904436 | 42904441 | + |
| SEQ ID NO 60038 | TGCCTACGTTTTATTAGTTACA | CTG | chr17 | 42904421 | 42904442 | 42904438 | 42904443 | + |
| SEQ ID NO 60039 | CGTTTTATTAGTTACAGCCAGA | CTA | chr17 | 42904427 | 42904448 | 42904444 | 42904449 | + |
| SEQ ID NO 60040 | TATTAGTTACAGCCAGATGGTT | TTT | chr17 | 42904432 | 42904453 | 42904449 | 42904454 | + |
| SEQ ID NO 60041 | ATTAGTTACAGCCAGATGGTTA | TTT | chr17 | 42904433 | 42904454 | 42904450 | 42904455 | + |
| SEQ ID NO 60042 | TTAGTTACAGCCAGATGGTTAC | TTA | chr17 | 42904434 | 42904455 | 42904451 | 42904456 | + |
| SEQ ID NO 60043 | GTTACAGCCAGATGGTTACTGT | TTA | chr17 | 42904437 | 42904458 | 42904454 | 42904459 | + |
| SEQ ID NO 60044 | CAGCCAGATGGTTACTGTCAAA | TTA | chr17 | 42904441 | 42904462 | 42904458 | 42904463 | + |
| SEQ ID NO 60045 | CTGTCAAATCAAATGATAGATT | TTA | chr17 | 42904455 | 42904476 | 42904472 | 42904477 | + |
| SEQ ID NO 60046 | TCAAATCAAATGATAGATTTCA | CTG | chr17 | 42904458 | 42904479 | 42904475 | 42904480 | + |
| SEQ ID NO 60047 | CATTTTCAGTATGTAATAGGAA | TTT | chr17 | 42904478 | 42904499 | 42904495 | 42904500 | + |
| SEQ ID NO 60048 | ATTTTCAGTATGTAATAGGAAG | TTC | chr17 | 42904479 | 42904500 | 42904496 | 42904501 | + |
| SEQ ID NO 60049 | TCAGTATGTAATAGGAAGCCCC | TTT | chr17 | 42904483 | 42904504 | 42904500 | 42904505 | + |
| SEQ ID NO 60050 | CAGTATGTAATAGGAAGCCCCT | TTT | chr17 | 42904484 | 42904505 | 42904501 | 42904506 | + |
| SEQ ID NO 60051 | AGTATGTAATAGGAAGCCCCTC | TTC | chr17 | 42904485 | 42904506 | 42904502 | 42904507 | + |
| SEQ ID NO 60052 | CCTCACCCTAAAGTCTCAGCTG | CTC | chr17 | 42904507 | 42904528 | 42904524 | 42904529 | + |
| SEQ ID NO 60053 | ACCCTAAAGTCTCAGCTGCCCT | CTC | chr17 | 42904511 | 42904532 | 42904528 | 42904533 | + |
| SEQ ID NO 60054 | AAGTCTCAGCTGCCCTCTAAGA | CTA | chr17 | 42904517 | 42904538 | 42904534 | 42904539 | + |
| SEQ ID NO 60055 | AGCTGCCCTCTAAGACTAGTAC | CTC | chr17 | 42904524 | 42904545 | 42904541 | 42904546 | + |
| SEQ ID NO 60056 | CCCTCTAAGACTAGTACTCTCT | CTG | chr17 | 42904529 | 42904550 | 42904546 | 42904551 | + |
| SEQ ID NO 60057 | TAAGACTAGTACTCTCTAAGGT | CTC | chr17 | 42904534 | 42904555 | 42904551 | 42904556 | + |
| SEQ ID NO 60058 | AGACTAGTACTCTCTAAGGTAC | CTA | chr17 | 42904536 | 42904557 | 42904553 | 42904558 | + |
| SEQ ID NO 60059 | GTACTCTCTAAGGTACTAGTAT | CTA | chr17 | 42904542 | 42904563 | 42904559 | 42904564 | + |
| SEQ ID NO 60060 | TCTAAGGTACTAGTATCCCTTC | CTC | chr17 | 42904548 | 42904569 | 42904565 | 42904570 | + |
| SEQ ID NO 60061 | TAAGGTACTAGTATCCCTTCCT | CTC | chr17 | 42904550 | 42904571 | 42904567 | 42904572 | + |
| SEQ ID NO 60062 | AGGTACTAGTATCCCTTCCTCA | CTA | chr17 | 42904552 | 42904573 | 42904569 | 42904574 | + |
| SEQ ID NO 60063 | GTATCCCTTCCTCAGAGACCCT | CTA | chr17 | 42904560 | 42904581 | 42904577 | 42904582 | + |
| SEQ ID NO 60064 | CCTCAGAGACCCTTTCCCTGAC | CTT | chr17 | 42904569 | 42904590 | 42904586 | 42904591 | + |
| SEQ ID NO 60065 | CTCAGAGACCCTTTCCCTGACC | TTC | chr17 | 42904570 | 42904591 | 42904587 | 42904592 | + |
| SEQ ID NO 60066 | AGAGACCCTTTCCCTGACCCCA | CTC | chr17 | 42904573 | 42904594 | 42904590 | 42904595 | + |
| SEQ ID NO 60067 | TCCCTGACCCCAAAACTAGGGA | CTT | chr17 | 42904583 | 42904604 | 42904600 | 42904605 | + |
| SEQ ID NO 60068 | CCCTGACCCCAAAACTAGGGAA | TTT | chr17 | 42904584 | 42904605 | 42904601 | 42904606 | + |
| SEQ ID NO 60069 | CCTGACCCCAAAACTAGGGAAG | TTC | chr17 | 42904585 | 42904606 | 42904602 | 42904607 | + |
| SEQ ID NO 60070 | ACCCCAAAACTAGGGAAGGTCC | CTG | chr17 | 42904589 | 42904610 | 42904606 | 42904611 | + |
| SEQ ID NO 60071 | GGGAAGGTCCCTTAGTTATTTG | CTA | chr17 | 42904601 | 42904622 | 42904618 | 42904623 | + |
| SEQ ID NO 60072 | AGTTATTTGCTCTCACAGACCA | CTT | chr17 | 42904614 | 42904635 | 42904631 | 42904636 | + |
| SEQ ID NO 60073 | GTTATTTGCTCTCACAGACCAC | TTA | chr17 | 42904615 | 42904636 | 42904632 | 42904637 | + |
| SEQ ID NO 60074 | TTTGCTCTCACAGACCACGCAT | TTA | chr17 | 42904619 | 42904640 | 42904636 | 42904641 | + |
| SEQ ID NO 60075 | GCTCTCACAGACCACGCATTTA | TTT | chr17 | 42904622 | 42904643 | 42904639 | 42904644 | + |
| SEQ ID NO 60076 | CTCTCACAGACCACGCATTTAC | TTG | chr17 | 42904623 | 42904644 | 42904640 | 42904645 | + |
| SEQ ID NO 60077 | TCACAGACCACGCATTTACCTC | CTC | chr17 | 42904626 | 42904647 | 42904643 | 42904648 | + |
| SEQ ID NO 60078 | ACAGACCACGCATTTACCTCAG | CTC | chr17 | 42904628 | 42904649 | 42904645 | 42904650 | + |

Figure 90 (Cont'd)

| SEQ ID NO 60079 | ACCTCAGAGCATATTCACTCAT | TTT | chr17 | 42904643 | 42904664 | 42904660 | 42904665 | + |
|---|---|---|---|---|---|---|---|---|
| SEQ ID NO 60080 | CCTCAGAGCATATTCACTCATT | TTA | chr17 | 42904644 | 42904665 | 42904661 | 42904666 | + |
| SEQ ID NO 60081 | AGAGCATATTCACTCATTCAGC | CTC | chr17 | 42904648 | 42904669 | 42904665 | 42904670 | + |
| SEQ ID NO 60082 | ACTCATTCAGCTGTTACTTACC | TTC | chr17 | 42904659 | 42904680 | 42904676 | 42904681 | + |
| SEQ ID NO 60083 | ATTCAGCTGTTACTTACCAAGC | CTC | chr17 | 42904663 | 42904684 | 42904680 | 42904685 | + |
| SEQ ID NO 60084 | AGCTGTTACTTACCAAGCACCT | TTC | chr17 | 42904667 | 42904688 | 42904684 | 42904689 | + |
| SEQ ID NO 60085 | TTACTTACCAAGCACCTACTGG | CTG | chr17 | 42904672 | 42904693 | 42904689 | 42904694 | + |
| SEQ ID NO 60086 | CTTACCAAGCACCTACTGGGAG | TTA | chr17 | 42904675 | 42904696 | 42904692 | 42904697 | + |
| SEQ ID NO 60087 | ACCAAGCACCTACTGGGAGCTA | CTT | chr17 | 42904678 | 42904699 | 42904695 | 42904700 | + |
| SEQ ID NO 60088 | CCAAGCACCTACTGGGAGCTAT | TTA | chr17 | 42904679 | 42904700 | 42904696 | 42904701 | + |
| SEQ ID NO 60089 | CTGGGAGCTATACACTGTTCTA | CTA | chr17 | 42904690 | 42904711 | 42904707 | 42904712 | + |
| SEQ ID NO 60090 | GGAGCTATACACTGTTCTATGT | CTG | chr17 | 42904693 | 42904714 | 42904710 | 42904715 | + |
| SEQ ID NO 60091 | TACACTGTTCTATGTGCTAGGG | CTA | chr17 | 42904700 | 42904721 | 42904717 | 42904722 | + |
| SEQ ID NO 60092 | TTCTATGTGCTAGGGATACCTC | CTG | chr17 | 42904707 | 42904728 | 42904724 | 42904729 | + |
| SEQ ID NO 60093 | TATGTGCTAGGGATACCTCTGT | TTC | chr17 | 42904710 | 42904731 | 42904727 | 42904732 | + |
| SEQ ID NO 60094 | TGTGCTAGGGATACCTCTGTCA | CTA | chr17 | 42904712 | 42904733 | 42904729 | 42904734 | + |
| SEQ ID NO 60095 | GGGATACCTCTGTCAGTGAACA | CTA | chr17 | 42904719 | 42904740 | 42904736 | 42904741 | + |
| SEQ ID NO 60096 | TGTCAGTGAACAACACAGACAC | CTC | chr17 | 42904729 | 42904750 | 42904746 | 42904751 | + |
| SEQ ID NO 60097 | TCAGTGAACAACACAGACACAA | CTG | chr17 | 42904731 | 42904752 | 42904748 | 42904753 | + |
| SEQ ID NO 60098 | CCCTTGTGGAGCTGAAATCTGA | CTG | chr17 | 42904762 | 42904783 | 42904779 | 42904784 | + |
| SEQ ID NO 60099 | GTGGAGCTGAAATCTGAATAGA | CTT | chr17 | 42904767 | 42904788 | 42904784 | 42904789 | + |
| SEQ ID NO 60100 | TGGAGCTGAAATCTGAATAGAG | TTG | chr17 | 42904768 | 42904789 | 42904785 | 42904790 | + |
| SEQ ID NO 60101 | AAATCTGAATAGAGGAGGTGAA | CTG | chr17 | 42904776 | 42904797 | 42904793 | 42904798 | + |
| SEQ ID NO 60102 | AATAGAGGAGGTGAAATATACA | CTG | chr17 | 42904783 | 42904804 | 42904800 | 42904805 | + |
| SEQ ID NO 60103 | TAATAAATAAGTAAACTAGGCC | TTA | chr17 | 42904812 | 42904833 | 42904829 | 42904834 | + |
| SEQ ID NO 60104 | GGCCAGTTGTGGTTGCTCATGC | CTA | chr17 | 42904830 | 42904851 | 42904847 | 42904852 | + |
| SEQ ID NO 60105 | TGGTTGCTCATGCCTGTAATCC | TTG | chr17 | 42904839 | 42904860 | 42904856 | 42904861 | + |
| SEQ ID NO 60106 | CTCATGCCTGTAATCCCAGCAC | TTG | chr17 | 42904845 | 42904866 | 42904862 | 42904867 | + |
| SEQ ID NO 60107 | ATGCCTGTAATCCCAGCACTTT | CTC | chr17 | 42904848 | 42904869 | 42904865 | 42904870 | + |
| SEQ ID NO 60108 | TAATCCCAGCACTTTGGGAAGC | CTG | chr17 | 42904855 | 42904876 | 42904872 | 42904877 | + |
| SEQ ID NO 60109 | TGGGAAGCCAAGGTAGGTAGAT | CTT | chr17 | 42904869 | 42904890 | 42904886 | 42904891 | + |
| SEQ ID NO 60110 | GGGAAGCCAAGGTAGGTAGATC | TTT | chr17 | 42904870 | 42904891 | 42904887 | 42904892 | + |
| SEQ ID NO 60111 | GGAAGCCAAGGTAGGTAGATCA | TTG | chr17 | 42904871 | 42904892 | 42904888 | 42904893 | + |
| SEQ ID NO 60112 | AGGTCAGGAGTTCAAACCAGC | CTG | chr17 | 42904897 | 42904918 | 42904914 | 42904919 | + |
| SEQ ID NO 60113 | AAAACCAGCCTGGCCAACATTG | TTC | chr17 | 42904910 | 42904931 | 42904927 | 42904932 | + |
| SEQ ID NO 60114 | GCCAACATTGCAAAATCCTGTC | CTG | chr17 | 42904922 | 42904943 | 42904939 | 42904944 | + |
| SEQ ID NO 60115 | CAAAATCCTGTCTTTACTAAAA | TTG | chr17 | 42904932 | 42904953 | 42904949 | 42904954 | + |
| SEQ ID NO 60116 | TCTTTACTAAAAATGGAAAAAT | CTG | chr17 | 42904942 | 42904963 | 42904959 | 42904964 | + |
| SEQ ID NO 60117 | TACTAAAAATGGAAAAATTGGT | CTT | chr17 | 42904946 | 42904967 | 42904963 | 42904968 | + |
| SEQ ID NO 60118 | ACTAAAAATGGAAAAATTGGTC | TTT | chr17 | 42904947 | 42904968 | 42904964 | 42904969 | + |
| SEQ ID NO 60119 | CTAAAAATGGAAAAATTGGTCA | TTA | chr17 | 42904948 | 42904969 | 42904965 | 42904970 | + |
| SEQ ID NO 60120 | AAAATGGAAAAATTGGTCAGGC | CTA | chr17 | 42904951 | 42904972 | 42904968 | 42904973 | + |
| SEQ ID NO 60121 | GTCAGGCGTGATGGCACACGCC | TTG | chr17 | 42904966 | 42904987 | 42904983 | 42904988 | + |
| SEQ ID NO 60122 | TAGTCTCAGCTACCTGGGAGGC | CTG | chr17 | 42904990 | 42905011 | 42905007 | 42905012 | + |
| SEQ ID NO 60123 | AGCTACCTGGGAGGCTGAGGCA | CTC | chr17 | 42904997 | 42905018 | 42905014 | 42905019 | + |
| SEQ ID NO 60124 | CCTGGGAGGCTGAGGCAGGAGA | CTA | chr17 | 42905002 | 42905023 | 42905019 | 42905024 | + |
| SEQ ID NO 60125 | GGAGGCTGAGGCAGGAGAATCG | CTG | chr17 | 42905006 | 42905027 | 42905023 | 42905028 | + |
| SEQ ID NO 60126 | AGGCAGGAGAATCGCTTGAACC | CTG | chr17 | 42905014 | 42905035 | 42905031 | 42905036 | + |
| SEQ ID NO 60127 | GAACCTGGGAGGCAGAGGTTGC | CTT | chr17 | 42905031 | 42905052 | 42905048 | 42905053 | + |
| SEQ ID NO 60128 | AACCTGGGAGGCAGAGGTTGCA | TTG | chr17 | 42905032 | 42905053 | 42905049 | 42905054 | + |
| SEQ ID NO 60129 | GGAGGCAGAGGTTGCAGTGAAC | CTG | chr17 | 42905038 | 42905059 | 42905055 | 42905060 | + |
| SEQ ID NO 60130 | CAGTGAACCGAGATCGGACCAC | TTG | chr17 | 42905052 | 42905073 | 42905069 | 42905074 | + |
| SEQ ID NO 60131 | CACTCCAGCCTGAATGACAGAA | CTG | chr17 | 42905076 | 42905097 | 42905093 | 42905098 | + |
| SEQ ID NO 60132 | CAGCCTGAATGACAGAACGAGA | CTC | chr17 | 42905081 | 42905102 | 42905098 | 42905103 | + |
| SEQ ID NO 60133 | AATGACAGAACGAGACTCTGTC | CTG | chr17 | 42905088 | 42905109 | 42905105 | 42905110 | + |
| SEQ ID NO 60134 | TGTCTCAAAAAAAAAGTAAACT | CTC | chr17 | 42905106 | 42905127 | 42905123 | 42905128 | + |
| SEQ ID NO 60135 | TCTCAAAAAAAAAGTAAACTAT | CTG | chr17 | 42905108 | 42905129 | 42905125 | 42905130 | + |
| SEQ ID NO 60136 | AAAAAAAAAGTAAACTATTAAT | CTC | chr17 | 42905112 | 42905133 | 42905129 | 42905134 | + |

Figure 90 (Cont'd)

| SEQ ID NO 60137 | TTAATATGTAGGATAGGCCAGG | CTA | chr17 | 42905129 | 42905150 | 42905146 | 42905151 | + |
|---|---|---|---|---|---|---|---|---|
| SEQ ID NO 60138 | ATATGTAGGATAGGCCAGGCAC | TTA | chr17 | 42905132 | 42905153 | 42905149 | 42905154 | + |
| SEQ ID NO 60139 | ACCCTGTAATCCCAGCACTTTG | CTC | chr17 | 42905162 | 42905183 | 42905179 | 42905184 | + |
| SEQ ID NO 60140 | TAATCCCAGCACTTTGGGAGGC | CTG | chr17 | 42905168 | 42905189 | 42905185 | 42905190 | + |
| SEQ ID NO 60141 | TGGGAGGCTGAGGCGGGTGGAT | CTT | chr17 | 42905182 | 42905203 | 42905199 | 42905204 | + |
| SEQ ID NO 60142 | GGGAGGCTGAGGCGGGTGGATC | TTT | chr17 | 42905183 | 42905204 | 42905200 | 42905205 | + |
| SEQ ID NO 60143 | GGAGGCTGAGGCGGGTGGATCA | TTG | chr17 | 42905184 | 42905205 | 42905201 | 42905206 | + |
| SEQ ID NO 60144 | AGGCGGGTGGATCACCTGAGGT | CTG | chr17 | 42905192 | 42905213 | 42905209 | 42905214 | + |
| SEQ ID NO 60145 | AGGTGAGGAGTTCAAGACCAGC | CTG | chr17 | 42905210 | 42905231 | 42905227 | 42905232 | + |
| SEQ ID NO 60146 | AAGACCAGCCTGGCCAACATGG | TTC | chr17 | 42905223 | 42905244 | 42905240 | 42905245 | + |
| SEQ ID NO 60147 | GCCAACATGGCAAAACCCTGTC | CTG | chr17 | 42905235 | 42905256 | 42905252 | 42905257 | + |
| SEQ ID NO 60148 | TCTCTACTAAAAATACAAAAAT | CTG | chr17 | 42905255 | 42905276 | 42905272 | 42905277 | + |
| SEQ ID NO 60149 | TACTAAAAATACAAAAATTAGC | CTC | chr17 | 42905259 | 42905280 | 42905276 | 42905281 | + |
| SEQ ID NO 60150 | CTAAAAATACAAAAATTAGCTG | CTA | chr17 | 42905261 | 42905282 | 42905278 | 42905283 | + |
| SEQ ID NO 60151 | AAAATACAAAAATTAGCTGGGT | CTA | chr17 | 42905264 | 42905285 | 42905281 | 42905286 | + |
| SEQ ID NO 60152 | GCTGGGTGTCCTGGTGCATGCC | TTA | chr17 | 42905279 | 42905300 | 42905296 | 42905301 | + |
| SEQ ID NO 60153 | GGTGTCCTGGTGCATGCCTGTA | CTG | chr17 | 42905283 | 42905304 | 42905300 | 42905305 | + |
| SEQ ID NO 60154 | GTGCATGCCTGTAATCTGAGCT | CTG | chr17 | 42905292 | 42905313 | 42905309 | 42905314 | + |
| SEQ ID NO 60155 | TAATCTGAGCTACTCAGGAGGC | CTG | chr17 | 42905303 | 42905324 | 42905320 | 42905325 | + |
| SEQ ID NO 60156 | AGCTACTCAGGAGGCTAAGGCA | CTG | chr17 | 42905310 | 42905331 | 42905327 | 42905332 | + |
| SEQ ID NO 60157 | CTCAGGAGGCTAAGGCAGGAGA | CTA | chr17 | 42905315 | 42905336 | 42905332 | 42905337 | + |
| SEQ ID NO 60158 | AGGAGGCTAAGGCAGGAGAATC | CTC | chr17 | 42905318 | 42905339 | 42905335 | 42905340 | + |
| SEQ ID NO 60159 | AGGCAGGAGAATCGCTTGAACC | CTA | chr17 | 42905327 | 42905348 | 42905344 | 42905349 | + |
| SEQ ID NO 60160 | GAACCTGGGAGGTGGTGAGCCA | CTT | chr17 | 42905344 | 42905365 | 42905361 | 42905366 | + |
| SEQ ID NO 60161 | AACCTGGGAGGTGGTGAGCCAA | TTG | chr17 | 42905345 | 42905366 | 42905362 | 42905367 | + |
| SEQ ID NO 60162 | GGAGGTGGTGAGCCAAGATTGC | CTG | chr17 | 42905351 | 42905372 | 42905368 | 42905373 | + |
| SEQ ID NO 60163 | CGCCATTGCACTCCAGCCTGGG | TTG | chr17 | 42905372 | 42905393 | 42905389 | 42905394 | + |
| SEQ ID NO 60164 | CACTCCAGCCTGGGCGACAAAA | TTG | chr17 | 42905380 | 42905401 | 42905397 | 42905402 | + |
| SEQ ID NO 60165 | CAGCCTGGGCGACAAAATGAGA | CTC | chr17 | 42905385 | 42905406 | 42905402 | 42905407 | + |
| SEQ ID NO 60166 | GGCGACAAAATGAGACACCATC | CTG | chr17 | 42905392 | 42905413 | 42905409 | 42905414 | + |
| SEQ ID NO 60167 | AAAAAAAAAAAAAAATATATAT | CTG | chr17 | 42905416 | 42905437 | 42905433 | 42905438 | + |
| SEQ ID NO 60168 | GAAATGATTGTTTATAGGCAA | CTA | chr17 | 42905487 | 42905508 | 42905504 | 42905509 | + |
| SEQ ID NO 60169 | TTTATAGGCAAAAAAAAAAAAA | TTG | chr17 | 42905498 | 42905519 | 42905515 | 42905520 | + |
| SEQ ID NO 60170 | ATAGGCAAAAAAAAAAAAAAAG | TTT | chr17 | 42905501 | 42905522 | 42905518 | 42905523 | + |
| SEQ ID NO 60171 | TAGGCAAAAAAAAAAAAAAAGA | TTA | chr17 | 42905502 | 42905523 | 42905519 | 42905524 | + |
| SEQ ID NO 60172 | TTGTAGAAATATGTTTGCTTTC | CTT | chr17 | 42905572 | 42905593 | 42905589 | 42905594 | + |
| SEQ ID NO 60173 | TGTAGAAATATGTTTGCTTTCA | TTT | chr17 | 42905573 | 42905594 | 42905590 | 42905595 | + |
| SEQ ID NO 60174 | GTAGAAATATGTTTGCTTTCAT | TTT | chr17 | 42905574 | 42905595 | 42905591 | 42905596 | + |
| SEQ ID NO 60175 | TAGAAATATGTTTGCTTTCATC | TTG | chr17 | 42905575 | 42905596 | 42905592 | 42905597 | + |
| SEQ ID NO 60176 | GCTTTCATCATAACAGCTTGTT | TTT | chr17 | 42905588 | 42905609 | 42905605 | 42905610 | + |
| SEQ ID NO 60177 | CTTTCATCATAACAGCTTGTTA | TTG | chr17 | 42905589 | 42905610 | 42905606 | 42905611 | + |
| SEQ ID NO 60178 | TCATCATAACAGCTTGTTATCA | CTT | chr17 | 42905592 | 42905613 | 42905609 | 42905614 | + |
| SEQ ID NO 60179 | CATCATAACAGCTTGTTATCAA | TTT | chr17 | 42905593 | 42905614 | 42905610 | 42905615 | + |
| SEQ ID NO 60180 | ATCATAACAGCTTGTTATCAAG | TTC | chr17 | 42905594 | 42905615 | 42905611 | 42905616 | + |
| SEQ ID NO 60181 | GTTATCAAGGATGAATTTCTCC | CTT | chr17 | 42905607 | 42905628 | 42905624 | 42905629 | + |
| SEQ ID NO 60182 | TTATCAAGGATGAATTTCTCCC | TTG | chr17 | 42905608 | 42905629 | 42905625 | 42905630 | + |
| SEQ ID NO 60183 | TCAAGGATGAATTTCTCCCTGA | TTA | chr17 | 42905611 | 42905632 | 42905628 | 42905633 | + |
| SEQ ID NO 60184 | CTCCCTGAAATTAATGGAGGCA | TTT | chr17 | 42905625 | 42905646 | 42905642 | 42905647 | + |
| SEQ ID NO 60185 | TCCCTGAAATTAATGGAGGCAC | TTC | chr17 | 42905626 | 42905647 | 42905643 | 42905648 | + |
| SEQ ID NO 60186 | CCTGAAATTAATGGAGGCACAG | CTC | chr17 | 42905628 | 42905649 | 42905645 | 42905650 | + |
| SEQ ID NO 60187 | AAATTAATGGAGGCACAGACTG | CTG | chr17 | 42905632 | 42905653 | 42905649 | 42905654 | + |
| SEQ ID NO 60188 | ATGGAGGCACAGACTGGAAAGT | TTA | chr17 | 42905638 | 42905659 | 42905655 | 42905660 | + |
| SEQ ID NO 60189 | GAAAGTTTAAAGTGGCTTTAAG | CTG | chr17 | 42905654 | 42905675 | 42905671 | 42905676 | + |
| SEQ ID NO 60190 | AAAGTGGCTTTAAGAGGTTATT | TTT | chr17 | 42905662 | 42905683 | 42905679 | 42905684 | + |
| SEQ ID NO 60191 | AGTGGCTTTAAGAGGTTATTT | TTA | chr17 | 42905663 | 42905684 | 42905680 | 42905685 | + |
| SEQ ID NO 60192 | TAAGAGGTTATTTTATTTAGTC | CTT | chr17 | 42905672 | 42905693 | 42905689 | 42905694 | + |
| SEQ ID NO 60193 | AAGAGGTTATTTTATTTAGTCC | TTT | chr17 | 42905673 | 42905694 | 42905690 | 42905695 | + |
| SEQ ID NO 60194 | AGAGGTTATTTTATTTAGTCCT | TTA | chr17 | 42905674 | 42905695 | 42905691 | 42905696 | + |

Figure 90 (Cont'd)

| SEQ ID NO 60195 | TTTTATTTAGTCCTCTGTCTTA | TTA | chr17 | 42905682 | 42905703 | 42905699 | 42905704 | + |
|---|---|---|---|---|---|---|---|---|
| SEQ ID NO 60196 | TATTTAGTCCTCTGTCTTAATA | TTT | chr17 | 42905685 | 42905706 | 42905702 | 42905707 | + |
| SEQ ID NO 60197 | ATTTAGTCCTCTGTCTTAATAG | TTT | chr17 | 42905686 | 42905707 | 42905703 | 42905708 | + |
| SEQ ID NO 60198 | TTTAGTCCTCTGTCTTAATAGA | TTA | chr17 | 42905687 | 42905708 | 42905704 | 42905709 | + |
| SEQ ID NO 60199 | AGTCCTCTGTCTTAATAGAAGC | TTT | chr17 | 42905690 | 42905711 | 42905707 | 42905712 | + |
| SEQ ID NO 60200 | GTCCTCTGTCTTAATAGAAGCA | TTA | chr17 | 42905691 | 42905712 | 42905708 | 42905713 | + |
| SEQ ID NO 60201 | TGTCTTAATAGAAGCAAATTAT | CTC | chr17 | 42905697 | 42905718 | 42905714 | 42905719 | + |
| SEQ ID NO 60202 | TCTTAATAGAAGCAAATTATTA | CTG | chr17 | 42905699 | 42905720 | 42905716 | 42905721 | + |
| SEQ ID NO 60203 | AATAGAAGCAAATTATTATCTC | CTT | chr17 | 42905703 | 42905724 | 42905720 | 42905725 | + |
| SEQ ID NO 60204 | ATAGAAGCAAATTATTATCTCT | TTA | chr17 | 42905704 | 42905725 | 42905721 | 42905726 | + |
| SEQ ID NO 60205 | TTATCTCTGCTCCTTAGGTAGA | TTA | chr17 | 42905718 | 42905739 | 42905735 | 42905740 | + |
| SEQ ID NO 60206 | TCTCTGCTCCTTAGGTAGAGTA | TTA | chr17 | 42905721 | 42905742 | 42905738 | 42905743 | + |
| SEQ ID NO 60207 | TGCTCCTTAGGTAGAGTAGCTA | CTC | chr17 | 42905725 | 42905746 | 42905742 | 42905747 | + |
| SEQ ID NO 60208 | CTCCTTAGGTAGAGTAGCTAAG | CTG | chr17 | 42905727 | 42905748 | 42905744 | 42905749 | + |
| SEQ ID NO 60209 | CTTAGGTAGAGTAGCTAAGGCT | CTC | chr17 | 42905730 | 42905751 | 42905747 | 42905752 | + |
| SEQ ID NO 60210 | AGGTAGAGTAGCTAAGGCTCAG | CTT | chr17 | 42905733 | 42905754 | 42905750 | 42905755 | + |
| SEQ ID NO 60211 | GGTAGAGTAGCTAAGGCTCAGA | TTA | chr17 | 42905734 | 42905755 | 42905751 | 42905756 | + |
| SEQ ID NO 60212 | AGGCTCAGAAAGTAGGCCGGGC | CTA | chr17 | 42905747 | 42905768 | 42905764 | 42905769 | + |
| SEQ ID NO 60213 | AGAAAGTAGGCCGGGCGCGGTG | CTC | chr17 | 42905753 | 42905774 | 42905770 | 42905775 | + |
| SEQ ID NO 60214 | ACGCCTGTAATCCTAGCACTTT | CTC | chr17 | 42905779 | 42905800 | 42905796 | 42905801 | + |
| SEQ ID NO 60215 | TAATCCTAGCACTTTGGGAGGC | CTG | chr17 | 42905786 | 42905807 | 42905803 | 42905808 | + |
| SEQ ID NO 60216 | GCACTTTGGGAGGCCAACGCAG | CTA | chr17 | 42905794 | 42905815 | 42905811 | 42905816 | + |
| SEQ ID NO 60217 | TGGGAGGCCAACGCAGGTGGAT | CTT | chr17 | 42905800 | 42905821 | 42905817 | 42905822 | + |
| SEQ ID NO 60218 | GGGAGGCCAACGCAGGTGGATC | TTT | chr17 | 42905801 | 42905822 | 42905818 | 42905823 | + |
| SEQ ID NO 60219 | GGAGGCCAACGCAGGTGGATCA | TTG | chr17 | 42905802 | 42905823 | 42905819 | 42905824 | + |
| SEQ ID NO 60220 | AGGTCAGGAGTTTGAGACCAGC | CTG | chr17 | 42905828 | 42905849 | 42905845 | 42905850 | + |
| SEQ ID NO 60221 | GAGACCAGCCTGGCCAACATGG | TTT | chr17 | 42905841 | 42905862 | 42905858 | 42905863 | + |
| SEQ ID NO 60222 | AGACCAGCCTGGCCAACATGGT | TTG | chr17 | 42905842 | 42905863 | 42905859 | 42905864 | + |
| SEQ ID NO 60223 | GCCAACATGGTGAAACCTCGTC | CTG | chr17 | 42905853 | 42905874 | 42905870 | 42905875 | + |
| SEQ ID NO 60224 | GTCACTAATAAAAAAATACAAA | CTC | chr17 | 42905872 | 42905893 | 42905889 | 42905894 | + |
| SEQ ID NO 60225 | ATAAAAAAATACAAAAACTTAG | CTA | chr17 | 42905879 | 42905900 | 42905896 | 42905901 | + |
| SEQ ID NO 60226 | AGCCAGGCATGGTGGCGGGCGC | CTT | chr17 | 42905899 | 42905920 | 42905916 | 42905921 | + |
| SEQ ID NO 60227 | GCCAGGCATGGTGGCGGGCGCC | TTA | chr17 | 42905900 | 42905921 | 42905917 | 42905922 | + |
| SEQ ID NO 60228 | TAATCCCAGCTACCCAGGAGGC | CTG | chr17 | 42905924 | 42905945 | 42905941 | 42905946 | + |
| SEQ ID NO 60229 | CCCAGGAGGCTGCGGCAGGAGA | CTA | chr17 | 42905936 | 42905957 | 42905953 | 42905958 | + |
| SEQ ID NO 60230 | CGGCAGGAGAATCACTTCAACC | CTG | chr17 | 42905948 | 42905969 | 42905965 | 42905970 | + |
| SEQ ID NO 60231 | CAACCCGGGAGGCAGAGGTTGC | CTT | chr17 | 42905965 | 42905986 | 42905982 | 42905987 | + |
| SEQ ID NO 60232 | AACCCGGGAGGCAGAGGTTGCA | TTC | chr17 | 42905966 | 42905987 | 42905983 | 42905988 | + |
| SEQ ID NO 60233 | CAGTGAGCTGAAATCACACCAC | TTG | chr17 | 42905986 | 42906007 | 42906003 | 42906008 | + |
| SEQ ID NO 60234 | AAATCACACCACTGCACTCCAG | CTG | chr17 | 42905996 | 42906017 | 42906013 | 42906018 | + |
| SEQ ID NO 60235 | CACTCCAGCCTTGGTGACAGAG | CTG | chr17 | 42906010 | 42906031 | 42906027 | 42906032 | + |
| SEQ ID NO 60236 | CAGCCTTGGTGACAGAGAAAGA | CTC | chr17 | 42906015 | 42906036 | 42906032 | 42906037 | + |
| SEQ ID NO 60237 | GGTGACAGAGAAAGATTCTGTC | CTT | chr17 | 42906022 | 42906043 | 42906039 | 42906044 | + |
| SEQ ID NO 60238 | GTGACAGAGAAAGATTCTGTCA | TTG | chr17 | 42906023 | 42906044 | 42906040 | 42906045 | + |
| SEQ ID NO 60239 | TGTCAGGAAAAAAAAAAAAAAG | TTC | chr17 | 42906040 | 42906061 | 42906057 | 42906062 | + |
| SEQ ID NO 60240 | TCAGGAAAAAAAAAAAAAAGTT | CTG | chr17 | 42906042 | 42906063 | 42906059 | 42906064 | + |
| SEQ ID NO 60241 | AAATGAATTACCCAAGGTATAT | TTT | chr17 | 42906065 | 42906086 | 42906082 | 42906087 | + |
| SEQ ID NO 60242 | AATGAATTACCCAAGGTATATA | TTA | chr17 | 42906066 | 42906087 | 42906083 | 42906088 | + |
| SEQ ID NO 60243 | CCCAAGGTATATAATTGTTAGT | TTA | chr17 | 42906075 | 42906096 | 42906092 | 42906097 | + |
| SEQ ID NO 60244 | TTAGTGTTAGAAGGAAGAAGAA | TTG | chr17 | 42906092 | 42906113 | 42906109 | 42906114 | + |
| SEQ ID NO 60245 | GTGTTAGAAGGAAGAAGAAGGG | TTA | chr17 | 42906095 | 42906116 | 42906112 | 42906117 | + |
| SEQ ID NO 60246 | GAAGGAAGAAGAAGGGAGGGAG | TTA | chr17 | 42906101 | 42906122 | 42906118 | 42906123 | + |
| SEQ ID NO 60247 | TATTTATCTATGGGGTTCCCTG | CTT | chr17 | 42906176 | 42906197 | 42906193 | 42906198 | + |
| SEQ ID NO 60248 | ATTTATCTATGGGGTTCCCTGG | TTT | chr17 | 42906177 | 42906198 | 42906194 | 42906199 | + |
| SEQ ID NO 60249 | TTTATCTATGGGGTTCCCTGGA | TTA | chr17 | 42906178 | 42906199 | 42906195 | 42906200 | + |
| SEQ ID NO 60250 | ATCTATGGGGTTCCCTGGAAAG | TTT | chr17 | 42906181 | 42906202 | 42906198 | 42906203 | + |
| SEQ ID NO 60251 | TCTATGGGGTTCCCTGGAAAGC | TTA | chr17 | 42906182 | 42906203 | 42906199 | 42906204 | + |
| SEQ ID NO 60252 | TGGGGTTCCCTGGAAAGCAGGC | CTA | chr17 | 42906186 | 42906207 | 42906203 | 42906208 | + |

Figure 90 (Cont'd)

| | | | | | | | | |
|---|---|---|---|---|---|---|---|---|
| SEQ ID NO 60253 | CCTGGAAAGCAGGCTGAAATGG | TTC | chr17 | 42906194 | 42906215 | 42906211 | 42906216 | + |
| SEQ ID NO 60254 | GAAAGCAGGCTGAAATGGAGAT | CTG | chr17 | 42906198 | 42906219 | 42906215 | 42906220 | + |
| SEQ ID NO 60255 | AAATGGAGATTCACGTGCAGGA | CTG | chr17 | 42906210 | 42906231 | 42906227 | 42906232 | + |
| SEQ ID NO 60256 | ACGTGCAGGAGTTTAGATACTC | TTC | chr17 | 42906222 | 42906243 | 42906239 | 42906244 | + |
| SEQ ID NO 60257 | AGATACTCTGGGGAACTATACT | TTT | chr17 | 42906236 | 42906257 | 42906253 | 42906258 | + |
| SEQ ID NO 60258 | GATACTCTGGGGAACTATACTT | TTA | chr17 | 42906237 | 42906258 | 42906254 | 42906259 | + |
| SEQ ID NO 60259 | TGGGGAACTATACTTGTAGAAG | CTC | chr17 | 42906244 | 42906265 | 42906261 | 42906266 | + |
| SEQ ID NO 60260 | GGGAACTATACTTGTAGAAGGG | CTG | chr17 | 42906246 | 42906267 | 42906263 | 42906268 | + |
| SEQ ID NO 60261 | TACTTGTAGAAGGGAAGGAACA | CTA | chr17 | 42906254 | 42906275 | 42906271 | 42906276 | + |
| SEQ ID NO 60262 | GTAGAAGGGAAGGAACAGGAAC | CTT | chr17 | 42906259 | 42906280 | 42906276 | 42906281 | + |
| SEQ ID NO 60263 | TAGAAGGGAAGGAACAGGAACA | TTG | chr17 | 42906260 | 42906281 | 42906277 | 42906282 | + |
| SEQ ID NO 60264 | TGATTCTGCCTCATCCAACCCC | TTG | chr17 | 42906305 | 42906326 | 42906322 | 42906327 | + |
| SEQ ID NO 60265 | TGCCTCATCCAACCCCACAGCG | TTC | chr17 | 42906311 | 42906332 | 42906328 | 42906333 | + |
| SEQ ID NO 60266 | CCTCATCCAACCCCACAGCGAG | CTG | chr17 | 42906313 | 42906334 | 42906330 | 42906335 | + |
| SEQ ID NO 60267 | ATCCAACCCCACAGCGAGCTCT | CTC | chr17 | 42906317 | 42906338 | 42906334 | 42906339 | + |
| SEQ ID NO 60268 | TGAAGCTGGGGATGGCTCCTCA | CTC | chr17 | 42906338 | 42906359 | 42906355 | 42906360 | + |
| SEQ ID NO 60269 | AAGCTGGGGATGGCTCCTCAGA | CTG | chr17 | 42906340 | 42906361 | 42906357 | 42906362 | + |
| SEQ ID NO 60270 | GGGATGGCTCCTCAGAGTTGGT | CTG | chr17 | 42906346 | 42906367 | 42906363 | 42906368 | + |
| SEQ ID NO 60271 | CTCAGAGTTGGTCCAAGTTGGG | CTC | chr17 | 42906356 | 42906377 | 42906373 | 42906378 | + |
| SEQ ID NO 60272 | AGAGTTGGTCCAAGTTGGGACA | CTC | chr17 | 42906359 | 42906380 | 42906376 | 42906381 | + |
| SEQ ID NO 60273 | GTCCAAGTTGGGACAAGGGAAT | TTG | chr17 | 42906366 | 42906387 | 42906383 | 42906388 | + |
| SEQ ID NO 60274 | GGACAAGGGAATCAGACCCTGG | TTG | chr17 | 42906376 | 42906397 | 42906393 | 42906398 | + |
| SEQ ID NO 60275 | GGGAGAGCGTAACCTTGATCAA | CTG | chr17 | 42906397 | 42906418 | 42906414 | 42906419 | + |
| SEQ ID NO 60276 | GATCAAGGCGACTCTCTTTAGC | CTT | chr17 | 42906413 | 42906434 | 42906430 | 42906435 | + |
| SEQ ID NO 60277 | ATCAAGGCGACTCTCTTTAGCC | TTG | chr17 | 42906414 | 42906435 | 42906431 | 42906436 | + |
| SEQ ID NO 60278 | TCTTTAGCCCAGGGCAATGCCA | CTC | chr17 | 42906427 | 42906448 | 42906444 | 42906449 | + |
| SEQ ID NO 60279 | TTTAGCCCAGGGCAATGCCAGG | CTC | chr17 | 42906429 | 42906450 | 42906446 | 42906451 | + |
| SEQ ID NO 60280 | TAGCCCAGGGCAATGCCAGGAG | CTT | chr17 | 42906431 | 42906452 | 42906448 | 42906453 | + |
| SEQ ID NO 60281 | AGCCCAGGGCAATGCCAGGAGA | TTT | chr17 | 42906432 | 42906453 | 42906449 | 42906454 | + |
| SEQ ID NO 60282 | GCCCAGGGCAATGCCAGGAGAA | TTA | chr17 | 42906433 | 42906454 | 42906450 | 42906455 | + |
| SEQ ID NO 60283 | AGAGCAGAAAGCCATCTACCAT | CTG | chr17 | 42906460 | 42906481 | 42906477 | 42906482 | + |
| SEQ ID NO 60284 | CCATCACACTCTCAACAGCTAC | CTA | chr17 | 42906478 | 42906499 | 42906495 | 42906500 | + |
| SEQ ID NO 60285 | TCAACAGCTACGAAATAAGTCC | CTC | chr17 | 42906489 | 42906510 | 42906506 | 42906511 | + |
| SEQ ID NO 60286 | AACAGCTACGAAATAAGTCCTG | CTC | chr17 | 42906491 | 42906512 | 42906508 | 42906513 | + |
| SEQ ID NO 60287 | CGAAATAAGTCCTGCAGTTCAG | CTA | chr17 | 42906499 | 42906520 | 42906516 | 42906521 | + |
| SEQ ID NO 60288 | CAGTTCAGGAGGGAGGTCTGGG | CTG | chr17 | 42906513 | 42906534 | 42906530 | 42906535 | + |
| SEQ ID NO 60289 | AGGAGGGAGGTCTGGGCGGCAC | TTC | chr17 | 42906519 | 42906540 | 42906536 | 42906541 | + |
| SEQ ID NO 60290 | GGCGGCACATCTCAGGACCCTC | CTG | chr17 | 42906533 | 42906554 | 42906550 | 42906555 | + |
| SEQ ID NO 60291 | AGGACCCTCTATCTCTCAGGGT | CTC | chr17 | 42906546 | 42906567 | 42906563 | 42906568 | + |
| SEQ ID NO 60292 | TATCTCTCAGGGTAGAGGAATT | CTC | chr17 | 42906555 | 42906576 | 42906572 | 42906577 | + |
| SEQ ID NO 60293 | TCTCTCAGGGTAGAGGAATTAA | CTA | chr17 | 42906557 | 42906578 | 42906574 | 42906579 | + |
| SEQ ID NO 60294 | TCAGGGTAGAGGAATTAAGAAT | CTC | chr17 | 42906561 | 42906582 | 42906578 | 42906583 | + |
| SEQ ID NO 60295 | AGGGTAGAGGAATTAAGAATGG | CTC | chr17 | 42906563 | 42906584 | 42906580 | 42906585 | + |
| SEQ ID NO 60296 | AGAATGGATGGGAACCAGACG | TTA | chr17 | 42906578 | 42906599 | 42906595 | 42906600 | + |
| SEQ ID NO 60297 | ACACCTATAATCCCAACACTTT | CTC | chr17 | 42906614 | 42906635 | 42906631 | 42906636 | + |
| SEQ ID NO 60298 | TAATCCCAACACTTTGGGAGGC | CTA | chr17 | 42906621 | 42906642 | 42906638 | 42906643 | + |
| SEQ ID NO 60299 | TGGGAGGCCAAGGGTAGGAGGA | CTT | chr17 | 42906635 | 42906656 | 42906652 | 42906657 | + |
| SEQ ID NO 60300 | GGGAGGCCAAGGGTAGGAGGAT | TTT | chr17 | 42906636 | 42906657 | 42906653 | 42906658 | + |
| SEQ ID NO 60301 | GGAGGCCAAGGGTAGGAGGATT | TTG | chr17 | 42906637 | 42906658 | 42906654 | 42906659 | + |
| SEQ ID NO 60302 | CTTGAGCCCAAGAGTTCAAAAC | TTG | chr17 | 42906660 | 42906681 | 42906677 | 42906682 | + |
| SEQ ID NO 60303 | GAGCCCAAGAGTTCAAAACCAG | CTT | chr17 | 42906663 | 42906684 | 42906680 | 42906685 | + |
| SEQ ID NO 60304 | AGCCCAAGAGTTCAAAACCAGC | TTG | chr17 | 42906664 | 42906685 | 42906681 | 42906686 | + |
| SEQ ID NO 60305 | AAAACCAGCCTGGGCAAAAACA | TTC | chr17 | 42906677 | 42906698 | 42906694 | 42906699 | + |
| SEQ ID NO 60306 | GGCAAAAACAATCAAACAAACA | CTG | chr17 | 42906689 | 42906710 | 42906706 | 42906711 | + |
| SEQ ID NO 60307 | AAAAAATTTGCTGTGTGTGGTG | TTT | chr17 | 42906725 | 42906746 | 42906742 | 42906747 | + |
| SEQ ID NO 60308 | AAAAATTTGCTGTGTGTGGTGG | TTA | chr17 | 42906726 | 42906747 | 42906743 | 42906748 | + |
| SEQ ID NO 60309 | GCTGTGTGTGGTGGTGTGCACC | TTT | chr17 | 42906734 | 42906755 | 42906751 | 42906756 | + |
| SEQ ID NO 60310 | CTGTGTGTGGTGGTGTGCACCT | TTG | chr17 | 42906735 | 42906756 | 42906752 | 42906757 | + |

Figure 90 (Cont'd)

| SEQ ID NO 60311 | TGTGTGGTGGTGTGCACCTGTG | CTG | chr17 | 42906738 | 42906759 | 42906755 | 42906760 | + |
|---|---|---|---|---|---|---|---|---|
| SEQ ID NO 60312 | TGGTCCCAGCTACTCAGGGGGC | CTG | chr17 | 42906758 | 42906779 | 42906775 | 42906780 | + |
| SEQ ID NO 60313 | CTCAGGGGGCTGAGGTGGGAGG | CTA | chr17 | 42906770 | 42906791 | 42906787 | 42906792 | + |
| SEQ ID NO 60314 | AGGGGGCTGAGGTGGGAGGATT | CTC | chr17 | 42906773 | 42906794 | 42906790 | 42906795 | + |
| SEQ ID NO 60315 | AGGTGGGAGGATTGCTTGAGTC | CTG | chr17 | 42906782 | 42906803 | 42906799 | 42906804 | + |
| SEQ ID NO 60316 | CTTGAGTCCAGGAGGTCGAGGC | TTG | chr17 | 42906796 | 42906817 | 42906813 | 42906818 | + |
| SEQ ID NO 60317 | GAGTCCAGGAGGTCGAGGCTGC | CTT | chr17 | 42906799 | 42906820 | 42906816 | 42906821 | + |
| SEQ ID NO 60318 | AGTCCAGGAGGTCGAGGCTGCA | TTG | chr17 | 42906800 | 42906821 | 42906817 | 42906822 | + |
| SEQ ID NO 60319 | CAGTGAGCTATGATCATGGCAC | CTG | chr17 | 42906820 | 42906841 | 42906837 | 42906842 | + |
| SEQ ID NO 60320 | TGATCATGGCACTGCATTGCAG | CTA | chr17 | 42906830 | 42906851 | 42906847 | 42906852 | + |
| SEQ ID NO 60321 | CATTGCAGCCTAGGAGACAAAG | CTG | chr17 | 42906844 | 42906865 | 42906861 | 42906866 | + |
| SEQ ID NO 60322 | CAGCCTAGGAGACAAAGCAAGA | TTG | chr17 | 42906849 | 42906870 | 42906866 | 42906871 | + |
| SEQ ID NO 60323 | GGAGACAAAGCAAGACACTGTC | CTA | chr17 | 42906856 | 42906877 | 42906873 | 42906878 | + |
| SEQ ID NO 60324 | TCTCTAAAAAAACAAAAAACAA | CTG | chr17 | 42906876 | 42906897 | 42906893 | 42906898 | + |
| SEQ ID NO 60325 | TAAAAAAACAAAAAACAAACAA | CTC | chr17 | 42906880 | 42906901 | 42906897 | 42906902 | + |
| SEQ ID NO 60326 | AAAAAACAAAAAACAAACAAAT | CTA | chr17 | 42906882 | 42906903 | 42906899 | 42906904 | + |
| SEQ ID NO 60327 | CAAGCAGGGTTAAATAGCGTGG | TTG | chr17 | 42906923 | 42906944 | 42906940 | 42906945 | + |
| SEQ ID NO 60328 | AATAGCGTGGTCAGAGTAGGAC | TTA | chr17 | 42906935 | 42906956 | 42906952 | 42906957 | + |
| SEQ ID NO 60329 | ACTGAGAATATGAGATCTGAGT | CTC | chr17 | 42906959 | 42906980 | 42906976 | 42906981 | + |
| SEQ ID NO 60330 | AGAATATGAGATCTGAGTCAAG | CTG | chr17 | 42906963 | 42906984 | 42906980 | 42906985 | + |
| SEQ ID NO 60331 | AGTCAAGTCTTCAAGGATGTGA | CTG | chr17 | 42906978 | 42906999 | 42906995 | 42907000 | + |
| SEQ ID NO 60332 | CAAGGATGTGAGGAAGTAAGTT | CTT | chr17 | 42906989 | 42907010 | 42907006 | 42907011 | + |
| SEQ ID NO 60333 | AAGGATGTGAGGAAGTAAGTTT | TTC | chr17 | 42906990 | 42907011 | 42907007 | 42907012 | + |
| SEQ ID NO 60334 | CTGGCAGAAGAGCTGTGAAGGG | TTT | chr17 | 42907012 | 42907033 | 42907029 | 42907034 | + |
| SEQ ID NO 60335 | TGGCAGAAGAGCTGTGAAGGGC | TTC | chr17 | 42907013 | 42907034 | 42907030 | 42907035 | + |
| SEQ ID NO 60336 | GCAGAAGAGCTGTGAAGGGCTG | CTG | chr17 | 42907015 | 42907036 | 42907032 | 42907037 | + |
| SEQ ID NO 60337 | TGAAGGGCTGTCTGGCCAGAGA | CTG | chr17 | 42907027 | 42907048 | 42907044 | 42907049 | + |
| SEQ ID NO 60338 | TCTGGCCAGAGAAGATTGCAAT | CTG | chr17 | 42907037 | 42907058 | 42907054 | 42907059 | + |
| SEQ ID NO 60339 | GCCAGAGAAGATTGCAATGCAA | CTG | chr17 | 42907041 | 42907062 | 42907058 | 42907063 | + |
| SEQ ID NO 60340 | CAATGCAAAAGCCCTGAGGTGG | TTG | chr17 | 42907055 | 42907076 | 42907072 | 42907077 | + |
| SEQ ID NO 60341 | AGGTGGGAACGTGTTTGGTGTG | CTG | chr17 | 42907071 | 42907092 | 42907088 | 42907093 | + |
| SEQ ID NO 60342 | GGTGTGTTTAAAGGAAAGCAAT | TTT | chr17 | 42907087 | 42907108 | 42907104 | 42907109 | + |
| SEQ ID NO 60343 | GTGTGTTTAAAGGAAAGCAATG | TTG | chr17 | 42907088 | 42907109 | 42907105 | 42907110 | + |
| SEQ ID NO 60344 | AAAGGAAAGCAATGAGGCCAGT | TTT | chr17 | 42907096 | 42907117 | 42907113 | 42907118 | + |
| SEQ ID NO 60345 | AAGGAAAGCAATGAGGCCAGTG | TTA | chr17 | 42907097 | 42907118 | 42907114 | 42907119 | + |
| SEQ ID NO 60346 | GTAATTGTACGCCCAGTATGCT | TTT | chr17 | 42907179 | 42907200 | 42907196 | 42907201 | + |
| SEQ ID NO 60347 | TAATTGTACGCCCAGTATGCTG | TTG | chr17 | 42907180 | 42907201 | 42907197 | 42907202 | + |
| SEQ ID NO 60348 | TACGCCCAGTATGCTGATTCTT | TTG | chr17 | 42907186 | 42907207 | 42907203 | 42907208 | + |
| SEQ ID NO 60349 | ATTCTTTGTGTAATCTCCAGAC | CTG | chr17 | 42907202 | 42907223 | 42907219 | 42907224 | + |
| SEQ ID NO 60350 | TTTGTGTAATCTCCAGACTGTA | TTC | chr17 | 42907206 | 42907227 | 42907223 | 42907228 | + |
| SEQ ID NO 60351 | TGTGTAATCTCCAGACTGTATT | CTT | chr17 | 42907208 | 42907229 | 42907225 | 42907230 | + |
| SEQ ID NO 60352 | GTGTAATCTCCAGACTGTATTA | TTT | chr17 | 42907209 | 42907230 | 42907226 | 42907231 | + |
| SEQ ID NO 60353 | TGTAATCTCCAGACTGTATTAA | TTG | chr17 | 42907210 | 42907231 | 42907227 | 42907232 | + |
| SEQ ID NO 60354 | CAGACTGTATTAAACTGCAAGA | CTC | chr17 | 42907219 | 42907240 | 42907236 | 42907241 | + |
| SEQ ID NO 60355 | TATTAAACTGCAAGAGCAGGGC | CTG | chr17 | 42907226 | 42907247 | 42907243 | 42907248 | + |
| SEQ ID NO 60356 | AACTGCAAGAGCAGGGCCCCTC | TTA | chr17 | 42907231 | 42907252 | 42907248 | 42907253 | + |
| SEQ ID NO 60357 | CAAGAGCAGGGCCCCTCTCTGG | CTG | chr17 | 42907236 | 42907257 | 42907253 | 42907258 | + |
| SEQ ID NO 60358 | TCTGGCTTTGCTCATCATTGTA | CTC | chr17 | 42907253 | 42907274 | 42907270 | 42907275 | + |
| SEQ ID NO 60359 | TGGCTTTGCTCATCATTGTATT | CTC | chr17 | 42907255 | 42907276 | 42907272 | 42907277 | + |
| SEQ ID NO 60360 | GCTTTGCTCATCATTGTATTCC | CTG | chr17 | 42907257 | 42907278 | 42907274 | 42907279 | + |
| SEQ ID NO 60361 | TGCTCATCATTGTATTCCCAGA | CTT | chr17 | 42907261 | 42907282 | 42907278 | 42907283 | + |
| SEQ ID NO 60362 | GCTCATCATTGTATTCCCAGAG | TTT | chr17 | 42907262 | 42907283 | 42907279 | 42907284 | + |
| SEQ ID NO 60363 | CTCATCATTGTATTCCCAGAGC | TTG | chr17 | 42907263 | 42907284 | 42907280 | 42907285 | + |
| SEQ ID NO 60364 | ATCATTGTATTCCCAGAGCCTT | CTC | chr17 | 42907266 | 42907287 | 42907283 | 42907288 | + |
| SEQ ID NO 60365 | TATTCCCAGAGCCTTGCACAAT | TTG | chr17 | 42907273 | 42907294 | 42907290 | 42907295 | + |
| SEQ ID NO 60366 | CCAGAGCCTTGCACAATGCTTG | TTC | chr17 | 42907278 | 42907299 | 42907295 | 42907300 | + |
| SEQ ID NO 60367 | GCACAATGCTTGGTGCATAGGA | CTT | chr17 | 42907288 | 42907309 | 42907305 | 42907310 | + |
| SEQ ID NO 60368 | CACAATGCTTGGTGCATAGGAG | TTG | chr17 | 42907289 | 42907310 | 42907306 | 42907311 | + |

Figure 90 (Cont'd)

| | | | | | | | | |
|---|---|---|---|---|---|---|---|---|
| SEQ ID NO 60369 | GGTGCATAGGAGATGGAAATTT | CTT | chr17 | 42907299 | 42907320 | 42907316 | 42907321 | + |
| SEQ ID NO 60370 | GTGCATAGGAGATGGAAATTTG | TTG | chr17 | 42907300 | 42907321 | 42907317 | 42907322 | + |
| SEQ ID NO 60371 | GTTAAATAAATGAATTATGGAT | TTT | chr17 | 42907321 | 42907342 | 42907338 | 42907343 | + |
| SEQ ID NO 60372 | TTAAATAAATGAATTATGGATA | TTG | chr17 | 42907322 | 42907343 | 42907339 | 42907344 | + |
| SEQ ID NO 60373 | AATAAATGAATTATGGATAACG | TTA | chr17 | 42907325 | 42907346 | 42907342 | 42907347 | + |
| SEQ ID NO 60374 | TGGATAACGAATGGATGGTAAG | TTA | chr17 | 42907338 | 42907359 | 42907355 | 42907360 | + |
| SEQ ID NO 60375 | GGTGGCTGGGTAGATGATGCAC | CTG | chr17 | 42907445 | 42907466 | 42907462 | 42907467 | + |
| SEQ ID NO 60376 | GGTAGATGATGCACTGTCTCCC | CTG | chr17 | 42907453 | 42907474 | 42907470 | 42907475 | + |
| SEQ ID NO 60377 | TCTCCCAGATGAGGACCTTTTC | CTG | chr17 | 42907469 | 42907490 | 42907486 | 42907491 | + |
| SEQ ID NO 60378 | CCAGATGAGGACCTTTTCACCT | CTC | chr17 | 42907473 | 42907494 | 42907490 | 42907495 | + |
| SEQ ID NO 60379 | TTCACCTTTACTCCATTCTCTT | CTT | chr17 | 42907488 | 42907509 | 42907505 | 42907510 | + |
| SEQ ID NO 60380 | TCACCTTTACTCCATTCTCTTT | TTT | chr17 | 42907489 | 42907510 | 42907506 | 42907511 | + |
| SEQ ID NO 60381 | CACCTTTACTCCATTCTCTTTC | TTT | chr17 | 42907490 | 42907511 | 42907507 | 42907512 | + |
| SEQ ID NO 60382 | ACCTTTACTCCATTCTCTTTCC | TTC | chr17 | 42907491 | 42907512 | 42907508 | 42907513 | + |
| SEQ ID NO 60383 | TACTCCATTCTCTTTCCTGCCC | CTT | chr17 | 42907496 | 42907517 | 42907513 | 42907518 | + |
| SEQ ID NO 60384 | ACTCCATTCTCTTTCCTGCCCT | TTT | chr17 | 42907497 | 42907518 | 42907514 | 42907519 | + |
| SEQ ID NO 60385 | CTCCATTCTCTTTCCTGCCCTT | TTA | chr17 | 42907498 | 42907519 | 42907515 | 42907520 | + |
| SEQ ID NO 60386 | CATTCTCTTTCCTGCCCTTTAG | CTC | chr17 | 42907501 | 42907522 | 42907518 | 42907523 | + |
| SEQ ID NO 60387 | TCTTTCCTGCCCTTTAGGGAGC | TTC | chr17 | 42907506 | 42907527 | 42907523 | 42907528 | + |
| SEQ ID NO 60388 | TTTCCTGCCCTTTAGGGAGCCC | CTC | chr17 | 42907508 | 42907529 | 42907525 | 42907530 | + |
| SEQ ID NO 60389 | TCCTGCCCTTTAGGGAGCCCCT | CTT | chr17 | 42907510 | 42907531 | 42907527 | 42907532 | + |
| SEQ ID NO 60390 | CCTGCCCTTTAGGGAGCCCCTC | TTT | chr17 | 42907511 | 42907532 | 42907528 | 42907533 | + |
| SEQ ID NO 60391 | CTGCCCTTTAGGGAGCCCCTCT | TTC | chr17 | 42907512 | 42907533 | 42907529 | 42907534 | + |
| SEQ ID NO 60392 | CCCTTTAGGGAGCCCCTCTGGC | CTG | chr17 | 42907515 | 42907536 | 42907532 | 42907537 | + |
| SEQ ID NO 60393 | TAGGGAGCCCCTCTGGCCATGC | CTT | chr17 | 42907520 | 42907541 | 42907537 | 42907542 | + |
| SEQ ID NO 60394 | AGGGAGCCCCTCTGGCCATGCC | TTT | chr17 | 42907521 | 42907542 | 42907538 | 42907543 | + |
| SEQ ID NO 60395 | GGGAGCCCCTCTGGCCATGCCA | TTA | chr17 | 42907522 | 42907543 | 42907539 | 42907544 | + |
| SEQ ID NO 60396 | TGGCCATGCCATGGGCACAGCA | CTC | chr17 | 42907533 | 42907554 | 42907550 | 42907555 | + |
| SEQ ID NO 60397 | GCCATGCCATGGGCACAGCAGG | CTG | chr17 | 42907535 | 42907556 | 42907552 | 42907557 | + |
| SEQ ID NO 60398 | CGTGATGGTCACATCTACTCTT | CTA | chr17 | 42907566 | 42907587 | 42907583 | 42907588 | + |
| SEQ ID NO 60399 | CTCTTTCCATCTTTCAGGGAAA | CTA | chr17 | 42907583 | 42907604 | 42907600 | 42907605 | + |
| SEQ ID NO 60400 | TTTCCATCTTTCAGGGAAAGAT | CTC | chr17 | 42907586 | 42907607 | 42907603 | 42907608 | + |
| SEQ ID NO 60401 | TCCATCTTTCAGGGAAAGATAA | CTT | chr17 | 42907588 | 42907609 | 42907605 | 42907610 | + |
| SEQ ID NO 60402 | CCATCTTTCAGGGAAAGATAAA | TTT | chr17 | 42907589 | 42907610 | 42907606 | 42907611 | + |
| SEQ ID NO 60403 | CATCTTTCAGGGAAAGATAAAG | TTC | chr17 | 42907590 | 42907611 | 42907607 | 42907612 | + |
| SEQ ID NO 60404 | TCAGGGAAAGATAAAGCCGACC | CTT | chr17 | 42907596 | 42907617 | 42907613 | 42907618 | + |
| SEQ ID NO 60405 | CAGGGAAAGATAAAGCCGACCT | TTT | chr17 | 42907597 | 42907618 | 42907614 | 42907619 | + |
| SEQ ID NO 60406 | AGGGAAAGATAAAGCCGACCTA | TTC | chr17 | 42907598 | 42907619 | 42907615 | 42907620 | + |
| SEQ ID NO 60407 | CAGATTTCGGTAAGAACTCACC | CTA | chr17 | 42907620 | 42907641 | 42907637 | 42907642 | + |
| SEQ ID NO 60408 | CGGTAAGAACTCACCACTGGGG | TTT | chr17 | 42907627 | 42907648 | 42907644 | 42907649 | + |
| SEQ ID NO 60409 | GGTAAGAACTCACCACTGGGGT | TTC | chr17 | 42907628 | 42907649 | 42907645 | 42907650 | + |
| SEQ ID NO 60410 | ACCACTGGGGTGTAGGTGGTGG | CTC | chr17 | 42907639 | 42907660 | 42907656 | 42907661 | + |
| SEQ ID NO 60411 | GGGTGTAGGTGGTGGAGGGCAG | CTG | chr17 | 42907646 | 42907667 | 42907663 | 42907668 | + |
| SEQ ID NO 60412 | TCTCTGTAGCTGACACACCACG | CTC | chr17 | 42907678 | 42907699 | 42907695 | 42907700 | + |
| SEQ ID NO 60413 | TCTGTAGCTGACACACCACGTA | CTC | chr17 | 42907680 | 42907701 | 42907697 | 42907702 | + |
| SEQ ID NO 60414 | TGTAGCTGACACACCACGTATT | CTC | chr17 | 42907682 | 42907703 | 42907699 | 42907704 | + |
| SEQ ID NO 60415 | TAGCTGACACACCACGTATTCT | CTG | chr17 | 42907684 | 42907705 | 42907701 | 42907706 | + |
| SEQ ID NO 60416 | ACACACCACGTATTCTTCCTCA | CTG | chr17 | 42907690 | 42907711 | 42907707 | 42907712 | + |
| SEQ ID NO 60417 | TTCCTCACATCCCCCTAGCCCG | TTC | chr17 | 42907705 | 42907726 | 42907722 | 42907727 | + |
| SEQ ID NO 60418 | CCTCACATCCCCCTAGCCCGCT | CTT | chr17 | 42907707 | 42907728 | 42907724 | 42907729 | + |
| SEQ ID NO 60419 | CTCACATCCCCCTAGCCCGCTC | TTC | chr17 | 42907708 | 42907729 | 42907725 | 42907730 | + |
| SEQ ID NO 60420 | ACATCCCCCTAGCCCGCTCCCA | CTC | chr17 | 42907711 | 42907732 | 42907728 | 42907733 | + |
| SEQ ID NO 60421 | GCCCGCTCCCACACCTGGGCAG | CTA | chr17 | 42907722 | 42907743 | 42907739 | 42907744 | + |
| SEQ ID NO 60422 | CCACACCTGGGCAGCCGCTGAT | CTC | chr17 | 42907730 | 42907751 | 42907747 | 42907752 | + |
| SEQ ID NO 60423 | GGCAGCCGCTGATTAAGAGTTG | CTG | chr17 | 42907739 | 42907760 | 42907756 | 42907761 | + |
| SEQ ID NO 60424 | ATTAAGAGTTGTGGCACTTTGG | CTG | chr17 | 42907750 | 42907771 | 42907767 | 42907772 | + |
| SEQ ID NO 60425 | AGAGTTGTGGCACTTTGGATAG | TTA | chr17 | 42907754 | 42907775 | 42907771 | 42907776 | + |
| SEQ ID NO 60426 | TGGCACTTTGGATAGGGATAAA | TTG | chr17 | 42907761 | 42907782 | 42907778 | 42907783 | + |

Figure 90 (Cont'd)

| | | | | | | | | |
|---|---|---|---|---|---|---|---|---|
| SEQ ID NO 60427 | TGGATAGGGATAAACCTCAGAG | CTT | chr17 | 42907769 | 42907790 | 42907786 | 42907791 | + |
| SEQ ID NO 60428 | GGATAGGGATAAACCTCAGAGT | TTT | chr17 | 42907770 | 42907791 | 42907787 | 42907792 | + |
| SEQ ID NO 60429 | GATAGGGATAAACCTCAGAGTC | TTG | chr17 | 42907771 | 42907792 | 42907788 | 42907793 | + |
| SEQ ID NO 60430 | AGAGTCAGGGAATGTTTGGGCT | CTC | chr17 | 42907787 | 42907808 | 42907804 | 42907809 | + |
| SEQ ID NO 60431 | GGGCTGAAAGGGATCCAGTAGT | TTT | chr17 | 42907804 | 42907825 | 42907821 | 42907826 | + |
| SEQ ID NO 60432 | GGCTGAAAGGGATCCAGTAGTG | TTG | chr17 | 42907805 | 42907826 | 42907822 | 42907827 | + |
| SEQ ID NO 60433 | AAAGGGATCCAGTAGTGCAATC | CTG | chr17 | 42907810 | 42907831 | 42907827 | 42907832 | + |
| SEQ ID NO 60434 | TTTTACAGATAAGGAAACAAAG | TTG | chr17 | 42907837 | 42907858 | 42907854 | 42907859 | + |
| SEQ ID NO 60435 | TACAGATAAGGAAACAAAGCCC | TTT | chr17 | 42907840 | 42907861 | 42907857 | 42907862 | + |
| SEQ ID NO 60436 | ACAGATAAGGAAACAAAGCCCA | TTT | chr17 | 42907841 | 42907862 | 42907858 | 42907863 | + |
| SEQ ID NO 60437 | CAGATAAGGAAACAAAGCCCAA | TTA | chr17 | 42907842 | 42907863 | 42907859 | 42907864 | + |
| SEQ ID NO 60438 | ATAAAAATAAGGTAGTGAAGTA | CTT | chr17 | 42907880 | 42907901 | 42907897 | 42907902 | + |
| SEQ ID NO 60439 | TAAAAATAAGGTAGTGAAGTAG | TTA | chr17 | 42907881 | 42907902 | 42907898 | 42907903 | + |
| SEQ ID NO 60440 | AAATAAAAACCCATGTCTGTAC | CTT | chr17 | 42907914 | 42907935 | 42907931 | 42907936 | + |
| SEQ ID NO 60441 | AATAAAAACCCATGTCTGTACC | TTA | chr17 | 42907915 | 42907936 | 42907932 | 42907937 | + |
| SEQ ID NO 60442 | TACCAACCACAGAGTCACCCAT | CTG | chr17 | 42907933 | 42907954 | 42907950 | 42907955 | + |
| SEQ ID NO 60443 | AAATAACCAGAGAAACAGAAGA | TTA | chr17 | 42907963 | 42907984 | 42907980 | 42907985 | + |
| SEQ ID NO 60444 | CTACTACAGAGAATTCCGGGTG | TTC | chr17 | 42907990 | 42908011 | 42908007 | 42908012 | + |
| SEQ ID NO 60445 | CTACAGAGAATTCCGGGTGTGC | CTA | chr17 | 42907993 | 42908014 | 42908010 | 42908015 | + |
| SEQ ID NO 60446 | CAGAGAATTCCGGGTGTGCAGC | CTA | chr17 | 42907996 | 42908017 | 42908013 | 42908018 | + |
| SEQ ID NO 60447 | CGGGTGTGCAGCCACAGTGCAA | TTC | chr17 | 42908006 | 42908027 | 42908023 | 42908028 | + |
| SEQ ID NO 60448 | TTTATTTTTATTTTTGAGATGC | CTT | chr17 | 42908034 | 42908055 | 42908051 | 42908056 | + |
| SEQ ID NO 60449 | TTATTTTTATTTTTGAGATGCA | TTT | chr17 | 42908035 | 42908056 | 42908052 | 42908057 | + |
| SEQ ID NO 60450 | TATTTTTATTTTTGAGATGCAG | TTT | chr17 | 42908036 | 42908057 | 42908053 | 42908058 | + |
| SEQ ID NO 60451 | ATTTTTATTTTTGAGATGCAGT | TTT | chr17 | 42908037 | 42908058 | 42908054 | 42908059 | + |
| SEQ ID NO 60452 | TTTTTATTTTTGAGATGCAGTC | TTA | chr17 | 42908038 | 42908059 | 42908055 | 42908060 | + |
| SEQ ID NO 60453 | TTATTTTTGAGATGCAGTCTCG | TTT | chr17 | 42908041 | 42908062 | 42908058 | 42908063 | + |
| SEQ ID NO 60454 | TATTTTTGAGATGCAGTCTCGC | TTT | chr17 | 42908042 | 42908063 | 42908059 | 42908064 | + |
| SEQ ID NO 60455 | ATTTTTGAGATGCAGTCTCGCT | TTT | chr17 | 42908043 | 42908064 | 42908060 | 42908065 | + |
| SEQ ID NO 60456 | TTTTTGAGATGCAGTCTCGCTC | TTA | chr17 | 42908044 | 42908065 | 42908061 | 42908066 | + |
| SEQ ID NO 60457 | TTGAGATGCAGTCTCGCTCTGT | TTT | chr17 | 42908047 | 42908068 | 42908064 | 42908069 | + |
| SEQ ID NO 60458 | TGAGATGCAGTCTCGCTCTGTC | TTT | chr17 | 42908048 | 42908069 | 42908065 | 42908070 | + |
| SEQ ID NO 60459 | GAGATGCAGTCTCGCTCTGTCA | TTT | chr17 | 42908049 | 42908070 | 42908066 | 42908071 | + |
| SEQ ID NO 60460 | AGATGCAGTCTCGCTCTGTCAT | TTG | chr17 | 42908050 | 42908071 | 42908067 | 42908072 | + |
| SEQ ID NO 60461 | GCTCTGTCATCCAGGCTGAAGT | CTC | chr17 | 42908062 | 42908083 | 42908079 | 42908084 | + |
| SEQ ID NO 60462 | TGTCATCCAGGCTGAAGTGCAG | CTC | chr17 | 42908066 | 42908087 | 42908083 | 42908088 | + |
| SEQ ID NO 60463 | TCATCCAGGCTGAAGTGCAGTG | CTG | chr17 | 42908068 | 42908089 | 42908085 | 42908090 | + |
| SEQ ID NO 60464 | AAGTGCAGTGGCACGATCATGT | CTG | chr17 | 42908080 | 42908101 | 42908097 | 42908102 | + |
| SEQ ID NO 60465 | GCTGCAACCTCTGCCTCCCAGG | CTC | chr17 | 42908105 | 42908126 | 42908122 | 42908127 | + |
| SEQ ID NO 60466 | CAACCTCTGCCTCCCAGGCTCA | CTG | chr17 | 42908109 | 42908130 | 42908126 | 42908131 | + |
| SEQ ID NO 60467 | TGCCTCCCAGGCTCAAGCGATC | CTC | chr17 | 42908116 | 42908137 | 42908133 | 42908138 | + |
| SEQ ID NO 60468 | CCTCCCAGGCTCAAGCGATCCT | CTG | chr17 | 42908118 | 42908139 | 42908135 | 42908140 | + |
| SEQ ID NO 60469 | CCAGGCTCAAGCGATCCTCCCA | CTC | chr17 | 42908122 | 42908143 | 42908139 | 42908144 | + |
| SEQ ID NO 60470 | AAGCGATCCTCCCACCTCAGCC | CTC | chr17 | 42908130 | 42908151 | 42908147 | 42908152 | + |
| SEQ ID NO 60471 | CCACCTCAGCCATCTGAGTAGC | CTC | chr17 | 42908141 | 42908162 | 42908158 | 42908163 | + |
| SEQ ID NO 60472 | AGCCATCTGAGTAGCTGGGACC | CTC | chr17 | 42908148 | 42908169 | 42908165 | 42908170 | + |
| SEQ ID NO 60473 | AGTAGCTGGGACCACAGGCCAC | CTG | chr17 | 42908157 | 42908178 | 42908174 | 42908179 | + |
| SEQ ID NO 60474 | GGACCACAGGCCACACACCACA | CTG | chr17 | 42908165 | 42908186 | 42908182 | 42908187 | + |
| SEQ ID NO 60475 | ATTTCTCGTATCTTTTGTAGA | CTA | chr17 | 42908195 | 42908216 | 42908212 | 42908217 | + |
| SEQ ID NO 60476 | CTCGTATCTTTTGTAGAGACA | TTT | chr17 | 42908199 | 42908220 | 42908216 | 42908221 | + |
| SEQ ID NO 60477 | TCGTATCTTTTGTAGAGACAG | TTC | chr17 | 42908200 | 42908221 | 42908217 | 42908222 | + |
| SEQ ID NO 60478 | GTATCTTTTGTAGAGACAGAG | CTC | chr17 | 42908202 | 42908223 | 42908219 | 42908224 | + |
| SEQ ID NO 60479 | TTTGTAGAGACAGAGTTCTGCT | CTT | chr17 | 42908209 | 42908230 | 42908226 | 42908231 | + |
| SEQ ID NO 60480 | TTGTAGAGACAGAGTTCTGCTA | TTT | chr17 | 42908210 | 42908231 | 42908227 | 42908232 | + |
| SEQ ID NO 60481 | TGTAGAGACAGAGTTCTGCTAT | TTT | chr17 | 42908211 | 42908232 | 42908228 | 42908233 | + |
| SEQ ID NO 60482 | GTAGAGACAGAGTTCTGCTATG | TTT | chr17 | 42908212 | 42908233 | 42908229 | 42908234 | + |
| SEQ ID NO 60483 | TAGAGACAGAGTTCTGCTATGT | TTG | chr17 | 42908213 | 42908234 | 42908230 | 42908235 | + |
| SEQ ID NO 60484 | TGCTATGTTGCCCAGGCTCAGG | TTC | chr17 | 42908227 | 42908248 | 42908244 | 42908249 | + |

Figure 90 (Cont'd)

| | | | | | | | | |
|---|---|---|---|---|---|---|---|---|
| SEQ ID NO 60485 | CTATGTTGCCCAGGCTCAGGCT | CTG | chr17 | 42908229 | 42908250 | 42908246 | 42908251 | + |
| SEQ ID NO 60486 | TGTTGCCCAGGCTCAGGCTGGT | CTA | chr17 | 42908232 | 42908253 | 42908249 | 42908254 | + |
| SEQ ID NO 60487 | CCCAGGCTCAGGCTGGTCTTGA | TTG | chr17 | 42908237 | 42908258 | 42908254 | 42908259 | + |
| SEQ ID NO 60488 | AGGCTGGTCTTGATCTCAAGCA | CTC | chr17 | 42908246 | 42908267 | 42908263 | 42908268 | + |
| SEQ ID NO 60489 | GTCTTGATCTCAAGCAATTGGC | CTG | chr17 | 42908252 | 42908273 | 42908269 | 42908274 | + |
| SEQ ID NO 60490 | GATCTCAAGCAATTGGCTTGCC | CTT | chr17 | 42908257 | 42908278 | 42908274 | 42908279 | + |
| SEQ ID NO 60491 | ATCTCAAGCAATTGGCTTGCCT | TTG | chr17 | 42908258 | 42908279 | 42908275 | 42908280 | + |
| SEQ ID NO 60492 | AAGCAATTGGCTTGCCTCAGCC | CTC | chr17 | 42908263 | 42908284 | 42908280 | 42908285 | + |
| SEQ ID NO 60493 | GCTTGCCTCAGCCTCCTAAAAT | TTG | chr17 | 42908272 | 42908293 | 42908289 | 42908294 | + |
| SEQ ID NO 60494 | GCCTCAGCCTCCTAAAATATTG | CTT | chr17 | 42908276 | 42908297 | 42908293 | 42908298 | + |
| SEQ ID NO 60495 | CCTCAGCCTCCTAAAATATTGG | TTG | chr17 | 42908277 | 42908298 | 42908294 | 42908299 | + |
| SEQ ID NO 60496 | AGCCTCCTAAAATATTGGGATT | CTC | chr17 | 42908281 | 42908302 | 42908298 | 42908303 | + |
| SEQ ID NO 60497 | CTAAAATATTGGGATTACAGGC | CTC | chr17 | 42908287 | 42908308 | 42908304 | 42908309 | + |
| SEQ ID NO 60498 | AAATATTGGGATTACAGGCATG | CTA | chr17 | 42908290 | 42908311 | 42908307 | 42908312 | + |
| SEQ ID NO 60499 | GGATTACAGGCATGAGCCACCG | TTG | chr17 | 42908298 | 42908319 | 42908315 | 42908320 | + |
| SEQ ID NO 60500 | CAGGCATGAGCCACCGCGCCAG | TTA | chr17 | 42908304 | 42908325 | 42908321 | 42908326 | + |
| SEQ ID NO 60501 | AATTATCAAACAGATAAAATAG | CTT | chr17 | 42908340 | 42908361 | 42908357 | 42908362 | + |
| SEQ ID NO 60502 | ATTATCAAACAGATAAAATAGG | TTA | chr17 | 42908341 | 42908362 | 42908358 | 42908363 | + |
| SEQ ID NO 60503 | TCAAACAGATAAAATAGGGAAG | TTA | chr17 | 42908345 | 42908366 | 42908362 | 42908367 | + |
| SEQ ID NO 60504 | AAATTCATATACACAAGGGTTA | TTA | chr17 | 42908370 | 42908391 | 42908387 | 42908392 | + |
| SEQ ID NO 60505 | ATATACACAAGGGTTAACCACT | TTC | chr17 | 42908376 | 42908397 | 42908393 | 42908398 | + |
| SEQ ID NO 60506 | ACCACTTGCCACAGGCATTTTT | TTA | chr17 | 42908392 | 42908413 | 42908409 | 42908414 | + |
| SEQ ID NO 60507 | GCCACAGGCATTTTTTTTTTTT | CTT | chr17 | 42908399 | 42908420 | 42908416 | 42908421 | + |
| SEQ ID NO 60508 | CCACAGGCATTTTTTTTTTTTT | TTG | chr17 | 42908400 | 42908421 | 42908417 | 42908422 | + |
| SEQ ID NO 60509 | TTTTTTTTTTTTGAGACGGAA | TTT | chr17 | 42908412 | 42908433 | 42908429 | 42908434 | + |
| SEQ ID NO 60510 | TTTTTTTTTTTGAGACGGAAT | TTT | chr17 | 42908413 | 42908434 | 42908430 | 42908435 | + |
| SEQ ID NO 60511 | TTTTTTTTTTGAGACGGAATC | TTT | chr17 | 42908414 | 42908435 | 42908431 | 42908436 | + |
| SEQ ID NO 60512 | TTTTTTTTTGAGACGGAATCT | TTT | chr17 | 42908415 | 42908436 | 42908432 | 42908437 | + |
| SEQ ID NO 60513 | TTTTTTTTGAGACGGAATCTC | TTT | chr17 | 42908416 | 42908437 | 42908433 | 42908438 | + |
| SEQ ID NO 60514 | TTTTTTTGAGACGGAATCTCG | TTT | chr17 | 42908417 | 42908438 | 42908434 | 42908439 | + |
| SEQ ID NO 60515 | TTTTTTGAGACGGAATCTCGC | TTT | chr17 | 42908418 | 42908439 | 42908435 | 42908440 | + |
| SEQ ID NO 60516 | TTTTTGAGACGGAATCTCGCT | TTT | chr17 | 42908419 | 42908440 | 42908436 | 42908441 | + |
| SEQ ID NO 60517 | TTTTGAGACGGAATCTCGCTC | TTT | chr17 | 42908420 | 42908441 | 42908437 | 42908442 | + |
| SEQ ID NO 60518 | TTTGAGACGGAATCTCGCTCT | TTT | chr17 | 42908421 | 42908442 | 42908438 | 42908443 | + |
| SEQ ID NO 60519 | TTGAGACGGAATCTCGCTCTG | TTT | chr17 | 42908422 | 42908443 | 42908439 | 42908444 | + |
| SEQ ID NO 60520 | TGAGACGGAATCTCGCTCTGT | TTT | chr17 | 42908423 | 42908444 | 42908440 | 42908445 | + |
| SEQ ID NO 60521 | TGAGACGGAATCTCGCTCTGTT | TTT | chr17 | 42908424 | 42908445 | 42908441 | 42908446 | + |
| SEQ ID NO 60522 | GAGACGGAATCTCGCTCTGTTG | TTT | chr17 | 42908425 | 42908446 | 42908442 | 42908447 | + |
| SEQ ID NO 60523 | AGACGGAATCTCGCTCTGTTGC | TTG | chr17 | 42908426 | 42908447 | 42908443 | 42908448 | + |
| SEQ ID NO 60524 | GCTCTGTTGCCCAGGCTGGAGT | CTC | chr17 | 42908438 | 42908459 | 42908455 | 42908460 | + |
| SEQ ID NO 60525 | TGTTGCCCAGGCTGGAGTGCAG | CTC | chr17 | 42908442 | 42908463 | 42908459 | 42908464 | + |
| SEQ ID NO 60526 | TTGCCCAGGCTGGAGTGCAGTG | CTG | chr17 | 42908444 | 42908465 | 42908461 | 42908466 | + |
| SEQ ID NO 60527 | CCCAGGCTGGAGTGCAGTGGCG | TTG | chr17 | 42908447 | 42908468 | 42908464 | 42908469 | + |
| SEQ ID NO 60528 | GAGTGCAGTGGCGCCATCTCGC | CTG | chr17 | 42908456 | 42908477 | 42908473 | 42908478 | + |
| SEQ ID NO 60529 | GCCTCACTGCAACCTCCGCTTC | CTC | chr17 | 42908476 | 42908497 | 42908493 | 42908498 | + |
| SEQ ID NO 60530 | ACTGCAACCTCCGCTTCCTGGG | CTC | chr17 | 42908481 | 42908502 | 42908498 | 42908503 | + |
| SEQ ID NO 60531 | CAACCTCCGCTTCCTGGGTTCA | CTG | chr17 | 42908485 | 42908506 | 42908502 | 42908507 | + |
| SEQ ID NO 60532 | CGCTTCCTGGGTTCAAGCTATT | CTC | chr17 | 42908492 | 42908513 | 42908509 | 42908514 | + |
| SEQ ID NO 60533 | CCTGGGTTCAAGCTATTCTTCT | CTT | chr17 | 42908497 | 42908518 | 42908514 | 42908519 | + |
| SEQ ID NO 60534 | CTGGGTTCAAGCTATTCTTCTG | TTC | chr17 | 42908498 | 42908519 | 42908515 | 42908520 | + |
| SEQ ID NO 60535 | GGTTCAAGCTATTCTTCTGCCT | CTG | chr17 | 42908501 | 42908522 | 42908518 | 42908523 | + |
| SEQ ID NO 60536 | AAGCTATTCTTCTGCCTCAGCC | TTC | chr17 | 42908506 | 42908527 | 42908523 | 42908528 | + |
| SEQ ID NO 60537 | TTCTTCTGCCTCAGCCTACCGA | CTA | chr17 | 42908512 | 42908533 | 42908529 | 42908534 | + |
| SEQ ID NO 60538 | TTCTGCCTCAGCCTACCGAGTA | TTC | chr17 | 42908515 | 42908536 | 42908532 | 42908537 | + |
| SEQ ID NO 60539 | CTGCCTCAGCCTACCGAGTAGC | CTT | chr17 | 42908517 | 42908538 | 42908534 | 42908539 | + |
| SEQ ID NO 60540 | TGCCTCAGCCTACCGAGTAGCT | TTC | chr17 | 42908518 | 42908539 | 42908535 | 42908540 | + |
| SEQ ID NO 60541 | CCTCAGCCTACCGAGTAGCTGG | CTG | chr17 | 42908520 | 42908541 | 42908537 | 42908542 | + |
| SEQ ID NO 60542 | AGCCTACCGAGTAGCTGGGACT | CTC | chr17 | 42908524 | 42908545 | 42908541 | 42908546 | + |

Figure 90 (Cont'd)

| | | | | | | | | |
|---|---|---|---|---|---|---|---|---|
| SEQ ID NO 60543 | CCGAGTAGCTGGGACTACAGGC | CTA | chr17 | 42908530 | 42908551 | 42908547 | 42908552 | + |
| SEQ ID NO 60544 | GGACTACAGGCACGTGCCACCA | CTG | chr17 | 42908541 | 42908562 | 42908558 | 42908563 | + |
| SEQ ID NO 60545 | CAGGCACGTGCCACCACACCTG | CTA | chr17 | 42908547 | 42908568 | 42908564 | 42908569 | + |
| SEQ ID NO 60546 | GCTAATTTTTTATTTTTAGTA | CTG | chr17 | 42908569 | 42908590 | 42908586 | 42908591 | + |
| SEQ ID NO 60547 | ATTTTTTTATTTTTAGTAGAGA | CTA | chr17 | 42908573 | 42908594 | 42908590 | 42908595 | + |
| SEQ ID NO 60548 | TTTTATTTTTAGTAGAGATGGG | TTT | chr17 | 42908577 | 42908598 | 42908594 | 42908599 | + |
| SEQ ID NO 60549 | TTTATTTTTAGTAGAGATGGGG | TTT | chr17 | 42908578 | 42908599 | 42908595 | 42908600 | + |
| SEQ ID NO 60550 | TTATTTTTAGTAGAGATGGGGT | TTT | chr17 | 42908579 | 42908600 | 42908596 | 42908601 | + |
| SEQ ID NO 60551 | TATTTTTAGTAGAGATGGGGTT | TTT | chr17 | 42908580 | 42908601 | 42908597 | 42908602 | + |
| SEQ ID NO 60552 | ATTTTTAGTAGAGATGGGGTTT | TTT | chr17 | 42908581 | 42908602 | 42908598 | 42908603 | + |
| SEQ ID NO 60553 | TTTTTAGTAGAGATGGGGTTTC | TTA | chr17 | 42908582 | 42908603 | 42908599 | 42908604 | + |
| SEQ ID NO 60554 | TTAGTAGAGATGGGGTTTCACC | TTT | chr17 | 42908585 | 42908606 | 42908602 | 42908607 | + |
| SEQ ID NO 60555 | TAGTAGAGATGGGGTTTCACCA | TTT | chr17 | 42908586 | 42908607 | 42908603 | 42908608 | + |
| SEQ ID NO 60556 | AGTAGAGATGGGGTTTCACCAT | TTT | chr17 | 42908587 | 42908608 | 42908604 | 42908609 | + |
| SEQ ID NO 60557 | GTAGAGATGGGGTTTCACCATA | TTA | chr17 | 42908588 | 42908609 | 42908605 | 42908610 | + |
| SEQ ID NO 60558 | CACCATATTGGCCAGGCTGGTC | TTT | chr17 | 42908603 | 42908624 | 42908620 | 42908625 | + |
| SEQ ID NO 60559 | ACCATATTGGCCAGGCTGGTCT | TTC | chr17 | 42908604 | 42908625 | 42908621 | 42908626 | + |
| SEQ ID NO 60560 | GCCAGGCTGGTCTTGAACTCCT | TTG | chr17 | 42908613 | 42908634 | 42908630 | 42908635 | + |
| SEQ ID NO 60561 | GTCTTGAACTCCTGACCTAGTG | CTG | chr17 | 42908622 | 42908643 | 42908639 | 42908644 | + |
| SEQ ID NO 60562 | GAACTCCTGACCTAGTGATCCA | CTT | chr17 | 42908627 | 42908648 | 42908644 | 42908649 | + |
| SEQ ID NO 60563 | AACTCCTGACCTAGTGATCCAT | TTG | chr17 | 42908628 | 42908649 | 42908645 | 42908650 | + |
| SEQ ID NO 60564 | CTGACCTAGTGATCCATCCGCC | CTC | chr17 | 42908633 | 42908654 | 42908650 | 42908655 | + |
| SEQ ID NO 60565 | ACCTAGTGATCCATCCGCCTCA | CTG | chr17 | 42908636 | 42908657 | 42908653 | 42908658 | + |
| SEQ ID NO 60566 | GTGATCCATCCGCCTCAGCCTC | CTA | chr17 | 42908641 | 42908662 | 42908658 | 42908663 | + |
| SEQ ID NO 60567 | AGCCTCCCAAAGTGCTGGGATT | CTC | chr17 | 42908657 | 42908678 | 42908674 | 42908679 | + |
| SEQ ID NO 60568 | CCAAAGTGCTGGGATTGCAGGC | CTC | chr17 | 42908663 | 42908684 | 42908680 | 42908685 | + |
| SEQ ID NO 60569 | GGATTGCAGGCATGAGCCACCG | CTG | chr17 | 42908674 | 42908695 | 42908691 | 42908696 | + |
| SEQ ID NO 60570 | CAGGCATGAGCCACCGCGCCTG | TTG | chr17 | 42908680 | 42908701 | 42908697 | 42908702 | + |
| SEQ ID NO 60571 | GCCTTTTTTTTTTTTTTTGAG | CTG | chr17 | 42908702 | 42908723 | 42908719 | 42908724 | + |
| SEQ ID NO 60572 | TTTTTTTTTTTTTTGAGACGGA | CTT | chr17 | 42908707 | 42908728 | 42908724 | 42908729 | + |
| SEQ ID NO 60573 | TTTTTTTTTTTTGAGACGGAG | TTT | chr17 | 42908708 | 42908729 | 42908725 | 42908730 | + |
| SEQ ID NO 60574 | TTTTTTTTTTTGAGACGGAGT | TTT | chr17 | 42908709 | 42908730 | 42908726 | 42908731 | + |
| SEQ ID NO 60575 | TTTTTTTTTTGAGACGGAGTT | TTT | chr17 | 42908710 | 42908731 | 42908727 | 42908732 | + |
| SEQ ID NO 60576 | TTTTTTTTTGAGACGGAGTTT | TTT | chr17 | 42908711 | 42908732 | 42908728 | 42908733 | + |
| SEQ ID NO 60577 | TTTTTTTTGAGACGGAGTTTT | TTT | chr17 | 42908712 | 42908733 | 42908729 | 42908734 | + |
| SEQ ID NO 60578 | TTTTTTTGAGACGGAGTTTTG | TTT | chr17 | 42908713 | 42908734 | 42908730 | 42908735 | + |
| SEQ ID NO 60579 | TTTTTTGAGACGGAGTTTTGC | TTT | chr17 | 42908714 | 42908735 | 42908731 | 42908736 | + |
| SEQ ID NO 60580 | TTTTTGAGACGGAGTTTTGCT | TTT | chr17 | 42908715 | 42908736 | 42908732 | 42908737 | + |
| SEQ ID NO 60581 | TTTTGAGACGGAGTTTTGCTC | TTT | chr17 | 42908716 | 42908737 | 42908733 | 42908738 | + |
| SEQ ID NO 60582 | TTTGAGACGGAGTTTTGCTCT | TTT | chr17 | 42908717 | 42908738 | 42908734 | 42908739 | + |
| SEQ ID NO 60583 | TTTGAGACGGAGTTTTGCTCTT | TTT | chr17 | 42908718 | 42908739 | 42908735 | 42908740 | + |
| SEQ ID NO 60584 | TTGAGACGGAGTTTTGCTCTTG | TTT | chr17 | 42908719 | 42908740 | 42908736 | 42908741 | + |
| SEQ ID NO 60585 | TGAGACGGAGTTTTGCTCTTGT | TTT | chr17 | 42908720 | 42908741 | 42908737 | 42908742 | + |
| SEQ ID NO 60586 | GAGACGGAGTTTTGCTCTTGTT | TTT | chr17 | 42908721 | 42908742 | 42908738 | 42908743 | + |
| SEQ ID NO 60587 | AGACGGAGTTTTGCTCTTGTTG | TTG | chr17 | 42908722 | 42908743 | 42908739 | 42908744 | + |
| SEQ ID NO 60588 | TGCTCTTGTTGCCCAGGCTAGA | TTT | chr17 | 42908733 | 42908754 | 42908750 | 42908755 | + |
| SEQ ID NO 60589 | GCTCTTGTTGCCCAGGCTAGAG | TTT | chr17 | 42908734 | 42908755 | 42908751 | 42908756 | + |
| SEQ ID NO 60590 | CTCTTGTTGCCCAGGCTAGAGT | TTG | chr17 | 42908735 | 42908756 | 42908752 | 42908757 | + |
| SEQ ID NO 60591 | TTGTTGCCCAGGCTAGAGTGCA | CTC | chr17 | 42908738 | 42908759 | 42908755 | 42908760 | + |
| SEQ ID NO 60592 | GTTGCCCAGGCTAGAGTGCAGT | CTT | chr17 | 42908740 | 42908761 | 42908757 | 42908762 | + |
| SEQ ID NO 60593 | TTGCCCAGGCTAGAGTGCAGTG | TTG | chr17 | 42908741 | 42908762 | 42908758 | 42908763 | + |
| SEQ ID NO 60594 | CCCAGGCTAGAGTGCAGTGGCG | TTG | chr17 | 42908744 | 42908765 | 42908761 | 42908766 | + |
| SEQ ID NO 60595 | GAGTGCAGTGGCGCAGTCTCGG | CTA | chr17 | 42908753 | 42908774 | 42908770 | 42908775 | + |
| SEQ ID NO 60596 | GGCTCACTGTAACCTCCACCTC | CTC | chr17 | 42908773 | 42908794 | 42908790 | 42908795 | + |
| SEQ ID NO 60597 | ACTGTAACCTCCACCTCCTGAG | CTC | chr17 | 42908778 | 42908799 | 42908795 | 42908800 | + |
| SEQ ID NO 60598 | TAACCTCCACCTCCTGAGTTCA | CTG | chr17 | 42908782 | 42908803 | 42908799 | 42908804 | + |
| SEQ ID NO 60599 | CACCTCCTGAGTTCAAGCAATT | CTC | chr17 | 42908789 | 42908810 | 42908806 | 42908811 | + |
| SEQ ID NO 60600 | CTGAGTTCAAGCAATTCTCCTG | CTC | chr17 | 42908795 | 42908816 | 42908812 | 42908817 | + |

Figure 90 (Cont'd)

| | | | | | | | | | |
|---|---|---|---|---|---|---|---|---|---|
| SEQ ID NO 60601 | AGTTCAAGCAATTCTCCTGCCT | CTG | chr17 | 42908798 | 42908819 | 42908815 | 42908820 | + |
| SEQ ID NO 60602 | AAGCAATTCTCCTGCCTCAGCC | TTC | chr17 | 42908803 | 42908824 | 42908820 | 42908825 | + |
| SEQ ID NO 60603 | TCCTGCCTCAGCCTCTCAAATA | TTC | chr17 | 42908812 | 42908833 | 42908829 | 42908834 | + |
| SEQ ID NO 60604 | CTGCCTCAGCCTCTCAAATAGC | CTC | chr17 | 42908814 | 42908835 | 42908831 | 42908836 | + |
| SEQ ID NO 60605 | CCTCAGCCTCTCAAATAGCTGG | CTG | chr17 | 42908817 | 42908838 | 42908834 | 42908839 | + |
| SEQ ID NO 60606 | AGCCTCTCAAATAGCTGGGATT | CTC | chr17 | 42908821 | 42908842 | 42908838 | 42908843 | + |
| SEQ ID NO 60607 | TCAAATAGCTGGGATTACAGGC | CTC | chr17 | 42908827 | 42908848 | 42908844 | 42908849 | + |
| SEQ ID NO 60608 | AAATAGCTGGGATTACAGGCGT | CTC | chr17 | 42908829 | 42908850 | 42908846 | 42908851 | + |
| SEQ ID NO 60609 | GGATTACAGGCGTGAGCCACCC | CTG | chr17 | 42908838 | 42908859 | 42908855 | 42908860 | + |
| SEQ ID NO 60610 | CAGGCGTGAGCCACCCCACCTG | TTA | chr17 | 42908844 | 42908865 | 42908861 | 42908866 | + |
| SEQ ID NO 60611 | GCTAATTTTGTAATTTTTTTTT | CTG | chr17 | 42908866 | 42908887 | 42908883 | 42908888 | + |
| SEQ ID NO 60612 | ATTTTGTAATTTTTTTTTTAGT | CTA | chr17 | 42908870 | 42908891 | 42908887 | 42908892 | + |
| SEQ ID NO 60613 | TGTAATTTTTTTTTTAGTAGAG | TTT | chr17 | 42908874 | 42908895 | 42908891 | 42908896 | + |
| SEQ ID NO 60614 | GTAATTTTTTTTTTAGTAGAGA | TTT | chr17 | 42908875 | 42908896 | 42908892 | 42908897 | + |
| SEQ ID NO 60615 | TAATTTTTTTTTTAGTAGAGAT | TTG | chr17 | 42908876 | 42908897 | 42908893 | 42908898 | + |
| SEQ ID NO 60616 | TTTTTTTAGTAGAGATGGGGTT | TTT | chr17 | 42908882 | 42908903 | 42908899 | 42908904 | + |
| SEQ ID NO 60617 | TTTTTTAGTAGAGATGGGGTTT | TTT | chr17 | 42908883 | 42908904 | 42908900 | 42908905 | + |
| SEQ ID NO 60618 | TTTTTAGTAGAGATGGGGTTTC | TTT | chr17 | 42908884 | 42908905 | 42908901 | 42908906 | + |
| SEQ ID NO 60619 | TTTTAGTAGAGATGGGGTTTCA | TTT | chr17 | 42908885 | 42908906 | 42908902 | 42908907 | + |
| SEQ ID NO 60620 | TTTAGTAGAGATGGGGTTTCAC | TTT | chr17 | 42908886 | 42908907 | 42908903 | 42908908 | + |
| SEQ ID NO 60621 | TTAGTAGAGATGGGGTTTCACC | TTT | chr17 | 42908887 | 42908908 | 42908904 | 42908909 | + |
| SEQ ID NO 60622 | TAGTAGAGATGGGGTTTCACCT | TTT | chr17 | 42908888 | 42908909 | 42908905 | 42908910 | + |
| SEQ ID NO 60623 | AGTAGAGATGGGGTTTCACCTG | TTT | chr17 | 42908889 | 42908910 | 42908906 | 42908911 | + |
| SEQ ID NO 60624 | GTAGAGATGGGGTTTCACCTGT | TTA | chr17 | 42908890 | 42908911 | 42908907 | 42908912 | + |
| SEQ ID NO 60625 | CACCTGTTGATCAGGCTGGTCT | TTT | chr17 | 42908905 | 42908926 | 42908922 | 42908927 | + |
| SEQ ID NO 60626 | ACCTGTTGATCAGGCTGGTCTC | TTC | chr17 | 42908906 | 42908927 | 42908923 | 42908928 | + |
| SEQ ID NO 60627 | TTGATCAGGCTGGTCTCAAACT | CTG | chr17 | 42908911 | 42908932 | 42908928 | 42908933 | + |
| SEQ ID NO 60628 | ATCAGGCTGGTCTCAAACTCCT | TTG | chr17 | 42908914 | 42908935 | 42908931 | 42908936 | + |
| SEQ ID NO 60629 | GTCTCAAACTCCTGACCTCAAG | CTG | chr17 | 42908923 | 42908944 | 42908940 | 42908945 | + |
| SEQ ID NO 60630 | AAACTCCTGACCTCAAGTGATC | CTC | chr17 | 42908928 | 42908949 | 42908945 | 42908950 | + |
| SEQ ID NO 60631 | CTGACCTCAAGTGATCCACCCA | CTC | chr17 | 42908934 | 42908955 | 42908951 | 42908956 | + |
| SEQ ID NO 60632 | ACCTCAAGTGATCCACCCACCT | CTG | chr17 | 42908937 | 42908958 | 42908954 | 42908959 | + |
| SEQ ID NO 60633 | AAGTGATCCACCCACCTCGGCC | CTC | chr17 | 42908942 | 42908963 | 42908959 | 42908964 | + |
| SEQ ID NO 60634 | GGCCTCCCAAAGTGCTGGGATT | CTC | chr17 | 42908960 | 42908981 | 42908977 | 42908982 | + |
| SEQ ID NO 60635 | CCAAAGTGCTGGGATTACAAGC | CTC | chr17 | 42908966 | 42908987 | 42908983 | 42908988 | + |
| SEQ ID NO 60636 | GGATTACAAGCATAAGCCACCG | CTG | chr17 | 42908977 | 42908998 | 42908994 | 42908999 | + |
| SEQ ID NO 60637 | CAAGCATAAGCCACCGTGCCTG | TTA | chr17 | 42908983 | 42909004 | 42909000 | 42909005 | + |
| SEQ ID NO 60638 | GTCAATTTTGATCTTTTTTAAA | CTG | chr17 | 42909005 | 42909026 | 42909022 | 42909027 | + |
| SEQ ID NO 60639 | TGATCTTTTTTAAAGAGACAGG | TTT | chr17 | 42909013 | 42909034 | 42909030 | 42909035 | + |
| SEQ ID NO 60640 | GATCTTTTTTAAAGAGACAGGG | TTT | chr17 | 42909014 | 42909035 | 42909031 | 42909036 | + |
| SEQ ID NO 60641 | ATCTTTTTTAAAGAGACAGGGG | TTG | chr17 | 42909015 | 42909036 | 42909032 | 42909037 | + |
| SEQ ID NO 60642 | TTTTAAAGAGACAGGGGTCTTG | CTT | chr17 | 42909020 | 42909041 | 42909037 | 42909042 | + |
| SEQ ID NO 60643 | TTTAAAGAGACAGGGGTCTTGC | TTT | chr17 | 42909021 | 42909042 | 42909038 | 42909043 | + |
| SEQ ID NO 60644 | TTAAAGAGACAGGGGTCTTGCT | TTT | chr17 | 42909022 | 42909043 | 42909039 | 42909044 | + |
| SEQ ID NO 60645 | TAAAGAGACAGGGGTCTTGCTA | TTT | chr17 | 42909023 | 42909044 | 42909040 | 42909045 | + |
| SEQ ID NO 60646 | AAAGAGACAGGGGTCTTGCTAT | TTT | chr17 | 42909024 | 42909045 | 42909041 | 42909046 | + |
| SEQ ID NO 60647 | AAGAGACAGGGGTCTTGCTATG | TTA | chr17 | 42909025 | 42909046 | 42909042 | 42909047 | + |
| SEQ ID NO 60648 | GCTATGTTGCCCAGACTAGTCT | CTT | chr17 | 42909041 | 42909062 | 42909058 | 42909063 | + |
| SEQ ID NO 60649 | CTATGTTGCCCAGACTAGTCTT | TTG | chr17 | 42909042 | 42909063 | 42909059 | 42909064 | + |
| SEQ ID NO 60650 | TGTTGCCCAGACTAGTCTTGAA | CTA | chr17 | 42909045 | 42909066 | 42909062 | 42909067 | + |
| SEQ ID NO 60651 | CCCAGACTAGTCTTGAACTCCT | TTG | chr17 | 42909050 | 42909071 | 42909067 | 42909072 | + |
| SEQ ID NO 60652 | GTCTTGAACTCCTGGCCTCAAG | CTA | chr17 | 42909059 | 42909080 | 42909076 | 42909081 | + |
| SEQ ID NO 60653 | GAACTCCTGGCCTCAAGTGATC | CTT | chr17 | 42909064 | 42909085 | 42909081 | 42909086 | + |
| SEQ ID NO 60654 | AACTCCTGGCCTCAAGTGATCC | TTG | chr17 | 42909065 | 42909086 | 42909082 | 42909087 | + |
| SEQ ID NO 60655 | CTGGCCTCAAGTGATCCTCTCA | CTC | chr17 | 42909070 | 42909091 | 42909087 | 42909092 | + |
| SEQ ID NO 60656 | GCCTCAAGTGATCCTCTCACCT | CTG | chr17 | 42909073 | 42909094 | 42909090 | 42909095 | + |
| SEQ ID NO 60657 | AAGTGATCCTCTCACCTCGGCC | CTC | chr17 | 42909078 | 42909099 | 42909095 | 42909100 | + |
| SEQ ID NO 60658 | TCACCTCGGCCTCCCAAAGTAT | CTC | chr17 | 42909089 | 42909110 | 42909106 | 42909111 | + |

Figure 90 (Cont'd)

| | | | | | | | | |
|---|---|---|---|---|---|---|---|---|
| SEQ ID NO 60659 | ACCTCGGCCTCCCAAAGTATTG | CTC | chr17 | 42909091 | 42909112 | 42909108 | 42909113 | + |
| SEQ ID NO 60660 | GGCCTCCCAAAGTATTGGGATT | CTC | chr17 | 42909096 | 42909117 | 42909113 | 42909118 | + |
| SEQ ID NO 60661 | CCAAAGTATTGGGATTACAGGT | CTC | chr17 | 42909102 | 42909123 | 42909119 | 42909124 | + |
| SEQ ID NO 60662 | GGATTACAGGTCTGAGCCGCTG | TTG | chr17 | 42909113 | 42909134 | 42909130 | 42909135 | + |
| SEQ ID NO 60663 | CAGGTCTGAGCCGCTGCACCCA | TTA | chr17 | 42909119 | 42909140 | 42909136 | 42909141 | + |
| SEQ ID NO 60664 | AGCCGCTGCACCCAGCCCCAA | CTG | chr17 | 42909127 | 42909148 | 42909144 | 42909149 | + |
| SEQ ID NO 60665 | CACCCAGCCCCCAACAGGCATC | CTG | chr17 | 42909135 | 42909156 | 42909152 | 42909157 | + |
| SEQ ID NO 60666 | TGGACTTTTGAGTACTGGCTTT | CTT | chr17 | 42909159 | 42909180 | 42909176 | 42909181 | + |
| SEQ ID NO 60667 | GGACTTTTGAGTACTGGCTTTA | TTT | chr17 | 42909160 | 42909181 | 42909177 | 42909182 | + |
| SEQ ID NO 60668 | GACTTTTGAGTACTGGCTTTAA | TTG | chr17 | 42909161 | 42909182 | 42909178 | 42909183 | + |
| SEQ ID NO 60669 | TTGAGTACTGGCTTTAATTTAC | CTT | chr17 | 42909166 | 42909187 | 42909183 | 42909188 | + |
| SEQ ID NO 60670 | TGAGTACTGGCTTTAATTTACA | TTT | chr17 | 42909167 | 42909188 | 42909184 | 42909189 | + |
| SEQ ID NO 60671 | GAGTACTGGCTTTAATTTACAA | TTT | chr17 | 42909168 | 42909189 | 42909185 | 42909190 | + |
| SEQ ID NO 60672 | AGTACTGGCTTTAATTTACAAA | TTG | chr17 | 42909169 | 42909190 | 42909186 | 42909191 | + |
| SEQ ID NO 60673 | GCTTTAATTTACAAAAATTCCA | CTG | chr17 | 42909176 | 42909197 | 42909193 | 42909198 | + |
| SEQ ID NO 60674 | TAATTTACAAAAATTCCACTGA | CTT | chr17 | 42909180 | 42909201 | 42909197 | 42909202 | + |
| SEQ ID NO 60675 | AATTTACAAAAATTCCACTGAG | TTT | chr17 | 42909181 | 42909202 | 42909198 | 42909203 | + |
| SEQ ID NO 60676 | ATTTACAAAAATTCCACTGAGA | TTA | chr17 | 42909182 | 42909203 | 42909199 | 42909204 | + |
| SEQ ID NO 60677 | ACAAAAATTCCACTGAGAGCAC | TTT | chr17 | 42909186 | 42909207 | 42909203 | 42909208 | + |
| SEQ ID NO 60678 | CAAAAATTCCACTGAGAGCACC | TTA | chr17 | 42909187 | 42909208 | 42909204 | 42909209 | + |
| SEQ ID NO 60679 | CACTGAGAGCACCTAAGTTTGC | TTC | chr17 | 42909196 | 42909217 | 42909213 | 42909218 | + |
| SEQ ID NO 60680 | AGAGCACCTAAGTTTGCCAGGC | CTG | chr17 | 42909201 | 42909222 | 42909218 | 42909223 | + |
| SEQ ID NO 60681 | AGTTTGCCAGGCTCCAACATTT | CTA | chr17 | 42909211 | 42909232 | 42909228 | 42909233 | + |
| SEQ ID NO 60682 | GCCAGGCTCCAACATTTCTGCA | TTT | chr17 | 42909216 | 42909237 | 42909233 | 42909238 | + |
| SEQ ID NO 60683 | CCAGGCTCCAACATTTCTGCAG | TTG | chr17 | 42909217 | 42909238 | 42909234 | 42909239 | + |
| SEQ ID NO 60684 | CAACATTTCTGCAGGGGCTGTT | CTC | chr17 | 42909225 | 42909246 | 42909242 | 42909247 | + |
| SEQ ID NO 60685 | CTGCAGGGGCTGTTTTCTTTGC | TTT | chr17 | 42909233 | 42909254 | 42909250 | 42909255 | + |
| SEQ ID NO 60686 | TGCAGGGGCTGTTTTCTTTGCT | TTC | chr17 | 42909234 | 42909255 | 42909251 | 42909256 | + |
| SEQ ID NO 60687 | CAGGGGCTGTTTTCTTTGCTGA | CTG | chr17 | 42909236 | 42909257 | 42909253 | 42909258 | + |
| SEQ ID NO 60688 | TTTTCTTTGCTGAAGGATCTGC | CTG | chr17 | 42909245 | 42909266 | 42909262 | 42909267 | + |
| SEQ ID NO 60689 | TCTTTGCTGAAGGATCTGCACC | TTT | chr17 | 42909248 | 42909269 | 42909265 | 42909270 | + |
| SEQ ID NO 60690 | CTTTGCTGAAGGATCTGCACCT | TTT | chr17 | 42909249 | 42909270 | 42909266 | 42909271 | + |
| SEQ ID NO 60691 | TTTGCTGAAGGATCTGCACCTG | TTC | chr17 | 42909250 | 42909271 | 42909267 | 42909272 | + |
| SEQ ID NO 60692 | TGCTGAAGGATCTGCACCTGTG | CTT | chr17 | 42909252 | 42909273 | 42909269 | 42909274 | + |
| SEQ ID NO 60693 | GCTGAAGGATCTGCACCTGTGT | TTT | chr17 | 42909253 | 42909274 | 42909270 | 42909275 | + |
| SEQ ID NO 60694 | CTGAAGGATCTGCACCTGTGTT | TTG | chr17 | 42909254 | 42909275 | 42909271 | 42909276 | + |
| SEQ ID NO 60695 | AAGGATCTGCACCTGTGTTCTG | CTG | chr17 | 42909257 | 42909278 | 42909274 | 42909279 | + |
| SEQ ID NO 60696 | CACCTGTGTTCTGTTATGGTTG | CTG | chr17 | 42909266 | 42909287 | 42909283 | 42909288 | + |
| SEQ ID NO 60697 | TGTTCTGTTATGGTTGCCTCTT | CTG | chr17 | 42909272 | 42909293 | 42909289 | 42909294 | + |
| SEQ ID NO 60698 | TGTTATGGTTGCCTCTTCTGTT | TTC | chr17 | 42909277 | 42909298 | 42909294 | 42909299 | + |
| SEQ ID NO 60699 | TTATGGTTGCCTCTTCTGTTGC | CTG | chr17 | 42909279 | 42909300 | 42909296 | 42909301 | + |
| SEQ ID NO 60700 | TGGTTGCCTCTTCTGTTGCAGG | TTA | chr17 | 42909282 | 42909303 | 42909299 | 42909304 | + |
| SEQ ID NO 60701 | CCTCTTCTGTTGCAGGTGCTTG | TTG | chr17 | 42909288 | 42909309 | 42909305 | 42909310 | + |
| SEQ ID NO 60702 | TTCTGTTGCAGGTGCTTGAATG | CTC | chr17 | 42909292 | 42909313 | 42909309 | 42909314 | + |
| SEQ ID NO 60703 | CTGTTGCAGGTGCTTGAATGTC | CTT | chr17 | 42909294 | 42909315 | 42909311 | 42909316 | + |
| SEQ ID NO 60704 | TGTTGCAGGTGCTTGAATGTCA | TTC | chr17 | 42909295 | 42909316 | 42909312 | 42909317 | + |
| SEQ ID NO 60705 | TTGCAGGTGCTTGAATGTCATT | CTG | chr17 | 42909297 | 42909318 | 42909314 | 42909319 | + |
| SEQ ID NO 60706 | CAGGTGCTTGAATGTCATTTTG | TTG | chr17 | 42909300 | 42909321 | 42909317 | 42909322 | + |
| SEQ ID NO 60707 | GAATGTCATTTTGTGGTTGGGA | CTT | chr17 | 42909309 | 42909330 | 42909326 | 42909331 | + |
| SEQ ID NO 60708 | AATGTCATTTTGTGGTTGGGAT | TTG | chr17 | 42909310 | 42909331 | 42909327 | 42909332 | + |
| SEQ ID NO 60709 | TGTGGTTGGGATTCTGGGCTGT | TTT | chr17 | 42909320 | 42909341 | 42909337 | 42909342 | + |
| SEQ ID NO 60710 | GTGGTTGGGATTCTGGGCTGTG | TTT | chr17 | 42909321 | 42909342 | 42909338 | 42909343 | + |
| SEQ ID NO 60711 | TGGTTGGGATTCTGGGCTGTGC | TTG | chr17 | 42909322 | 42909343 | 42909339 | 42909344 | + |
| SEQ ID NO 60712 | GGATTCTGGGCTGTGCAGCTGA | TTG | chr17 | 42909328 | 42909349 | 42909345 | 42909350 | + |
| SEQ ID NO 60713 | TGGGCTGTGCAGCTGAATGTCT | TTC | chr17 | 42909334 | 42909355 | 42909351 | 42909356 | + |
| SEQ ID NO 60714 | GGCTGTGCAGCTGAATGTCTGT | CTG | chr17 | 42909336 | 42909357 | 42909353 | 42909358 | + |
| SEQ ID NO 60715 | TGCAGCTGAATGTCTGTCTGTC | CTG | chr17 | 42909341 | 42909362 | 42909358 | 42909363 | + |
| SEQ ID NO 60716 | AATGTCTGTCTGTCACGAATCT | CTG | chr17 | 42909349 | 42909370 | 42909366 | 42909371 | + |

Figure 90 (Cont'd)

| | | | | | | | | |
|---|---|---|---|---|---|---|---|---|
| SEQ ID NO 60717 | TCTGTCACGAATCTACCTTGCT | CTG | chr17 | 42909357 | 42909378 | 42909374 | 42909379 | + |
| SEQ ID NO 60718 | TCACGAATCTACCTTGCTGCTC | CTG | chr17 | 42909361 | 42909382 | 42909378 | 42909383 | + |
| SEQ ID NO 60719 | CCTTGCTGCTCATTTTCCTCAT | CTA | chr17 | 42909372 | 42909393 | 42909389 | 42909394 | + |
| SEQ ID NO 60720 | GCTGCTCATTTTCCTCATCAAG | CTT | chr17 | 42909376 | 42909397 | 42909393 | 42909398 | + |
| SEQ ID NO 60721 | CTGCTCATTTTCCTCATCAAGT | TTG | chr17 | 42909377 | 42909398 | 42909394 | 42909399 | + |
| SEQ ID NO 60722 | CTCATTTTCCTCATCAAGTTGT | CTG | chr17 | 42909380 | 42909401 | 42909397 | 42909402 | + |
| SEQ ID NO 60723 | ATTTTCCTCATCAAGTTGTTGC | CTC | chr17 | 42909383 | 42909404 | 42909400 | 42909405 | + |
| SEQ ID NO 60724 | TCCTCATCAAGTTGTTGCTGGA | TTT | chr17 | 42909387 | 42909408 | 42909404 | 42909409 | + |
| SEQ ID NO 60725 | CCTCATCAAGTTGTTGCTGGAG | TTT | chr17 | 42909388 | 42909409 | 42909405 | 42909410 | + |
| SEQ ID NO 60726 | CTCATCAAGTTGTTGCTGGAGT | TTC | chr17 | 42909389 | 42909410 | 42909406 | 42909411 | + |
| SEQ ID NO 60727 | ATCAAGTTGTTGCTGGAGTCCT | CTC | chr17 | 42909392 | 42909413 | 42909409 | 42909414 | + |
| SEQ ID NO 60728 | TTGCTGGAGTCCTGTCAGGTAT | TTG | chr17 | 42909401 | 42909422 | 42909418 | 42909423 | + |
| SEQ ID NO 60729 | CTGGAGTCCTGTCAGGTATGGG | TTG | chr17 | 42909404 | 42909425 | 42909421 | 42909426 | + |
| SEQ ID NO 60730 | GAGTCCTGTCAGGTATGGGCTG | CTG | chr17 | 42909407 | 42909428 | 42909424 | 42909429 | + |
| SEQ ID NO 60731 | TCAGGTATGGGCTGATCTGACT | CTG | chr17 | 42909415 | 42909436 | 42909432 | 42909437 | + |
| SEQ ID NO 60732 | ATCTGACTCCCTTCCTTCTCCC | CTG | chr17 | 42909429 | 42909450 | 42909446 | 42909451 | + |
| SEQ ID NO 60733 | ACTCCCTTCCTTCTCCCCCAAA | CTG | chr17 | 42909434 | 42909455 | 42909451 | 42909456 | + |
| SEQ ID NO 60734 | CCTTCCTTCTCCCCCAAACCCC | CTC | chr17 | 42909438 | 42909459 | 42909455 | 42909460 | + |
| SEQ ID NO 60735 | CCTTCTCCCCCAAACCCCATTC | CTT | chr17 | 42909442 | 42909463 | 42909459 | 42909464 | + |
| SEQ ID NO 60736 | CTTCTCCCCCAAACCCCATTCC | TTC | chr17 | 42909443 | 42909464 | 42909460 | 42909465 | + |
| SEQ ID NO 60737 | CTCCCCCAAACCCCATTCCGTT | CTT | chr17 | 42909446 | 42909467 | 42909463 | 42909468 | + |
| SEQ ID NO 60738 | TCCCCCAAACCCCATTCCGTTT | TTC | chr17 | 42909447 | 42909468 | 42909464 | 42909469 | + |
| SEQ ID NO 60739 | CCCCAAACCCCATTCCGTTTCT | CTC | chr17 | 42909449 | 42909470 | 42909466 | 42909471 | + |
| SEQ ID NO 60740 | CGTTTCTCTCCCTAATCAGGAC | TTC | chr17 | 42909464 | 42909485 | 42909481 | 42909486 | + |
| SEQ ID NO 60741 | CTCTCCCTAATCAGGACAAAAT | TTT | chr17 | 42909469 | 42909490 | 42909486 | 42909491 | + |
| SEQ ID NO 60742 | TCTCCCTAATCAGGACAAAATC | TTC | chr17 | 42909470 | 42909491 | 42909487 | 42909492 | + |
| SEQ ID NO 60743 | TCCCTAATCAGGACAAAATCCC | CTC | chr17 | 42909472 | 42909493 | 42909489 | 42909494 | + |
| SEQ ID NO 60744 | CCTAATCAGGACAAAATCCCAG | CTC | chr17 | 42909474 | 42909495 | 42909491 | 42909496 | + |
| SEQ ID NO 60745 | ATCAGGACAAAATCCCAGCATT | CTA | chr17 | 42909478 | 42909499 | 42909495 | 42909500 | + |
| SEQ ID NO 60746 | CAGCCACATCCTGTGTGTAATC | TTC | chr17 | 42909501 | 42909522 | 42909518 | 42909523 | + |
| SEQ ID NO 60747 | TGTGTAATCAGTACTGTTAGCA | CTG | chr17 | 42909514 | 42909535 | 42909531 | 42909536 | + |
| SEQ ID NO 60748 | TTAGCATTTCTGTGGGTTGAAA | CTG | chr17 | 42909530 | 42909551 | 42909547 | 42909552 | + |
| SEQ ID NO 60749 | GCATTTCTGTGGGTTGAAAGTC | TTA | chr17 | 42909533 | 42909554 | 42909550 | 42909555 | + |
| SEQ ID NO 60750 | CTGTGGGTTGAAAGTCAAGAAT | TTT | chr17 | 42909539 | 42909560 | 42909556 | 42909561 | + |
| SEQ ID NO 60751 | TGTGGGTTGAAAGTCAAGAATG | TTC | chr17 | 42909540 | 42909561 | 42909557 | 42909562 | + |
| SEQ ID NO 60752 | TGGGTTGAAAGTCAAGAATGAG | CTG | chr17 | 42909542 | 42909563 | 42909559 | 42909564 | + |
| SEQ ID NO 60753 | AAAGTCAAGAATGAGCAACTTG | TTG | chr17 | 42909549 | 42909570 | 42909566 | 42909571 | + |
| SEQ ID NO 60754 | GAAATGATTAATTTCTATAAGA | CTT | chr17 | 42909570 | 42909591 | 42909587 | 42909592 | + |
| SEQ ID NO 60755 | AAATGATTAATTTCTATAAGAG | TTG | chr17 | 42909571 | 42909592 | 42909588 | 42909593 | + |
| SEQ ID NO 60756 | ATTTCTATAAGAGTGCCCAGAT | TTA | chr17 | 42909580 | 42909601 | 42909597 | 42909602 | + |
| SEQ ID NO 60757 | CTATAAGAGTGCCCAGATCTAT | TTT | chr17 | 42909584 | 42909605 | 42909601 | 42909606 | + |
| SEQ ID NO 60758 | TATAAGAGTGCCCAGATCTATA | TTC | chr17 | 42909585 | 42909606 | 42909602 | 42909607 | + |
| SEQ ID NO 60759 | TAAGAGTGCCCAGATCTATAGA | CTA | chr17 | 42909587 | 42909608 | 42909604 | 42909609 | + |
| SEQ ID NO 60760 | TAGAATGAATTGTGTAGAAGTT | CTA | chr17 | 42909605 | 42909626 | 42909622 | 42909627 | + |
| SEQ ID NO 60761 | TGTAGAAGTTACCATACATCAA | TTG | chr17 | 42909617 | 42909638 | 42909634 | 42909639 | + |
| SEQ ID NO 60762 | CCATACATCAAATTAACGCACC | TTA | chr17 | 42909628 | 42909649 | 42909645 | 42909650 | + |
| SEQ ID NO 60763 | ACGCACCAAATTGAATTAGCTT | TTA | chr17 | 42909643 | 42909664 | 42909660 | 42909665 | + |
| SEQ ID NO 60764 | AATTAGCTTGAAATCTCAGAGC | TTG | chr17 | 42909656 | 42909677 | 42909673 | 42909678 | + |
| SEQ ID NO 60765 | GCTTGAAATCTCAGAGCTTTTT | TTA | chr17 | 42909661 | 42909682 | 42909678 | 42909683 | + |
| SEQ ID NO 60766 | GAAATCTCAGAGCTTTTTACAA | CTT | chr17 | 42909665 | 42909686 | 42909682 | 42909687 | + |
| SEQ ID NO 60767 | AAATCTCAGAGCTTTTTACAAT | TTG | chr17 | 42909666 | 42909687 | 42909683 | 42909688 | + |
| SEQ ID NO 60768 | AGAGCTTTTTACAATCTTTATT | CTC | chr17 | 42909673 | 42909694 | 42909690 | 42909695 | + |
| SEQ ID NO 60769 | TTTACAATCTTTATTTCTTACT | CTT | chr17 | 42909680 | 42909701 | 42909697 | 42909702 | + |
| SEQ ID NO 60770 | TTACAATCTTTATTTCTTACTG | TTT | chr17 | 42909681 | 42909702 | 42909698 | 42909703 | + |
| SEQ ID NO 60771 | TACAATCTTTATTTCTTACTGG | TTT | chr17 | 42909682 | 42909703 | 42909699 | 42909704 | + |
| SEQ ID NO 60772 | ACAATCTTTATTTCTTACTGGT | TTT | chr17 | 42909683 | 42909704 | 42909700 | 42909705 | + |
| SEQ ID NO 60773 | CAATCTTTATTTCTTACTGGTC | TTA | chr17 | 42909684 | 42909705 | 42909701 | 42909706 | + |
| SEQ ID NO 60774 | TATTTCTTACTGGTCTTCAACA | CTT | chr17 | 42909691 | 42909712 | 42909708 | 42909713 | + |

Figure 90 (Cont'd)

| SEQ ID NO 60775 | ATTTCTTACTGGTCTTCAACAG | TTT | chr17 | 42909692 | 42909713 | 42909709 | 42909714 | + |
| SEQ ID NO 60776 | TTTCTTACTGGTCTTCAACAGG | TTA | chr17 | 42909693 | 42909714 | 42909710 | 42909715 | + |
| SEQ ID NO 60777 | CTTACTGGTCTTCAACAGGCCC | TTT | chr17 | 42909696 | 42909717 | 42909713 | 42909718 | + |
| SEQ ID NO 60778 | TTACTGGTCTTCAACAGGCCCT | TTC | chr17 | 42909697 | 42909718 | 42909714 | 42909719 | + |
| SEQ ID NO 60779 | ACTGGTCTTCAACAGGCCCTAA | CTT | chr17 | 42909699 | 42909720 | 42909716 | 42909721 | + |
| SEQ ID NO 60780 | CTGGTCTTCAACAGGCCCTAAT | TTA | chr17 | 42909700 | 42909721 | 42909717 | 42909722 | + |
| SEQ ID NO 60781 | GTCTTCAACAGGCCCTAATTTA | CTG | chr17 | 42909703 | 42909724 | 42909720 | 42909725 | + |
| SEQ ID NO 60782 | CAACAGGCCCTAATTTACTTTT | CTT | chr17 | 42909708 | 42909729 | 42909725 | 42909730 | + |
| SEQ ID NO 60783 | AACAGGCCCTAATTTACTTTTC | TTC | chr17 | 42909709 | 42909730 | 42909726 | 42909731 | + |
| SEQ ID NO 60784 | ATTTACTTTTCAGGGAATCTGC | CTA | chr17 | 42909720 | 42909741 | 42909737 | 42909742 | + |
| SEQ ID NO 60785 | ACTTTTCAGGGAATCTGCCAAA | TTT | chr17 | 42909724 | 42909745 | 42909741 | 42909746 | + |
| SEQ ID NO 60786 | CTTTTCAGGGAATCTGCCAAAT | TTA | chr17 | 42909725 | 42909746 | 42909742 | 42909747 | + |
| SEQ ID NO 60787 | TTCAGGGAATCTGCCAAATTTA | CTT | chr17 | 42909728 | 42909749 | 42909745 | 42909750 | + |
| SEQ ID NO 60788 | TCAGGGAATCTGCCAAATTTAA | TTT | chr17 | 42909729 | 42909750 | 42909746 | 42909751 | + |
| SEQ ID NO 60789 | CAGGGAATCTGCCAAATTTAAC | TTT | chr17 | 42909730 | 42909751 | 42909747 | 42909752 | + |
| SEQ ID NO 60790 | AGGGAATCTGCCAAATTTAACA | TTC | chr17 | 42909731 | 42909752 | 42909748 | 42909753 | + |
| SEQ ID NO 60791 | CCAAATTTAACAAATTAACACG | CTG | chr17 | 42909741 | 42909762 | 42909758 | 42909763 | + |
| SEQ ID NO 60792 | AACAAATTAACACGATGTCCTA | TTT | chr17 | 42909749 | 42909770 | 42909766 | 42909771 | + |
| SEQ ID NO 60793 | ACAAATTAACACGATGTCCTAG | TTA | chr17 | 42909750 | 42909771 | 42909767 | 42909772 | + |
| SEQ ID NO 60794 | ACACGATGTCCTAGGAAAGCTG | TTA | chr17 | 42909758 | 42909779 | 42909775 | 42909780 | + |
| SEQ ID NO 60795 | GGAAAGCTGTTCATTTAAATAC | CTA | chr17 | 42909771 | 42909792 | 42909788 | 42909793 | + |
| SEQ ID NO 60796 | TTCATTTAAATACATTCATTTG | CTG | chr17 | 42909780 | 42909801 | 42909797 | 42909802 | + |
| SEQ ID NO 60797 | ATTTAAATACATTCATTTGCAA | TTC | chr17 | 42909783 | 42909804 | 42909800 | 42909805 | + |
| SEQ ID NO 60798 | AAATACATTCATTTGCAAACCT | TTT | chr17 | 42909787 | 42909808 | 42909804 | 42909809 | + |
| SEQ ID NO 60799 | AATACATTCATTTGCAAACCTA | TTA | chr17 | 42909788 | 42909809 | 42909805 | 42909810 | + |
| SEQ ID NO 60800 | ATTTGCAAACCTAATAGATAAC | TTC | chr17 | 42909797 | 42909818 | 42909814 | 42909819 | + |
| SEQ ID NO 60801 | GCAAACCTAATAGATAACTGCA | TTT | chr17 | 42909801 | 42909822 | 42909818 | 42909823 | + |
| SEQ ID NO 60802 | CAAACCTAATAGATAACTGCAG | TTG | chr17 | 42909802 | 42909823 | 42909819 | 42909824 | + |
| SEQ ID NO 60803 | ATAGATAACTGCAGTTGATCTC | CTA | chr17 | 42909810 | 42909831 | 42909827 | 42909832 | + |
| SEQ ID NO 60804 | CAGTTGATCTCTTTTATAGGTT | CTG | chr17 | 42909821 | 42909842 | 42909838 | 42909843 | + |
| SEQ ID NO 60805 | ATCTCTTTTATAGGTTCAGAGT | TTG | chr17 | 42909827 | 42909848 | 42909844 | 42909849 | + |
| SEQ ID NO 60806 | TTTTATAGGTTCAGAGTTTTGA | CTC | chr17 | 42909832 | 42909853 | 42909849 | 42909854 | + |
| SEQ ID NO 60807 | TTATAGGTTCAGAGTTTTGAAT | CTT | chr17 | 42909834 | 42909855 | 42909851 | 42909856 | + |
| SEQ ID NO 60808 | TATAGGTTCAGAGTTTTGAATA | TTT | chr17 | 42909835 | 42909856 | 42909852 | 42909857 | + |
| SEQ ID NO 60809 | ATAGGTTCAGAGTTTTGAATAT | TTT | chr17 | 42909836 | 42909857 | 42909853 | 42909858 | + |
| SEQ ID NO 60810 | TAGGTTCAGAGTTTTGAATATG | TTA | chr17 | 42909837 | 42909858 | 42909854 | 42909859 | + |
| SEQ ID NO 60811 | AGAGTTTTGAATATGTTTTTTT | TTC | chr17 | 42909844 | 42909865 | 42909861 | 42909866 | + |
| SEQ ID NO 60812 | TGAATATGTTTTTTTTGTTTT | TTT | chr17 | 42909851 | 42909872 | 42909868 | 42909873 | + |
| SEQ ID NO 60813 | GAATATGTTTTTTTTGTTTTT | TTT | chr17 | 42909852 | 42909873 | 42909869 | 42909874 | + |
| SEQ ID NO 60814 | AATATGTTTTTTTTGTTTTTT | TTG | chr17 | 42909853 | 42909874 | 42909870 | 42909875 | + |
| SEQ ID NO 60815 | TTTTTTGTTTTTTTTTTTGAG | TTT | chr17 | 42909862 | 42909883 | 42909879 | 42909884 | + |
| SEQ ID NO 60816 | TTTTTGTTTTTTTTTTTGAGA | TTT | chr17 | 42909863 | 42909884 | 42909880 | 42909885 | + |
| SEQ ID NO 60817 | TTTTGTTTTTTTTTTTGAGAT | TTT | chr17 | 42909864 | 42909885 | 42909881 | 42909886 | + |
| SEQ ID NO 60818 | TTTGTTTTTTTTTTTGAGATG | TTT | chr17 | 42909865 | 42909886 | 42909882 | 42909887 | + |
| SEQ ID NO 60819 | TTGTTTTTTTTTTTGAGATGG | TTT | chr17 | 42909866 | 42909887 | 42909883 | 42909888 | + |
| SEQ ID NO 60820 | TGTTTTTTTTTTTGAGATGGA | TTT | chr17 | 42909867 | 42909888 | 42909884 | 42909889 | + |
| SEQ ID NO 60821 | GTTTTTTTTTTTGAGATGGAG | TTT | chr17 | 42909868 | 42909889 | 42909885 | 42909890 | + |
| SEQ ID NO 60822 | TTTTTTTTTTTGAGATGGAGT | TTG | chr17 | 42909869 | 42909890 | 42909886 | 42909891 | + |
| SEQ ID NO 60823 | TTTTTTTTTTGAGATGGAGTCTC | TTT | chr17 | 42909872 | 42909893 | 42909889 | 42909894 | + |
| SEQ ID NO 60824 | TTTTTTTTTGAGATGGAGTCTCG | TTT | chr17 | 42909873 | 42909894 | 42909890 | 42909895 | + |
| SEQ ID NO 60825 | TTTTTTTTGAGATGGAGTCTCGC | TTT | chr17 | 42909874 | 42909895 | 42909891 | 42909896 | + |
| SEQ ID NO 60826 | TTTTTTGAGATGGAGTCTCGCT | TTT | chr17 | 42909875 | 42909896 | 42909892 | 42909897 | + |
| SEQ ID NO 60827 | TTTTTGAGATGGAGTCTCGCTC | TTT | chr17 | 42909876 | 42909897 | 42909893 | 42909898 | + |
| SEQ ID NO 60828 | TTTTGAGATGGAGTCTCGCTCT | TTT | chr17 | 42909877 | 42909898 | 42909894 | 42909899 | + |
| SEQ ID NO 60829 | TTTGAGATGGAGTCTCGCTCTG | TTT | chr17 | 42909878 | 42909899 | 42909895 | 42909900 | + |
| SEQ ID NO 60830 | TTGAGATGGAGTCTCGCTCTGT | TTT | chr17 | 42909879 | 42909900 | 42909896 | 42909901 | + |
| SEQ ID NO 60831 | TGAGATGGAGTCTCGCTCTGTG | TTT | chr17 | 42909880 | 42909901 | 42909897 | 42909902 | + |
| SEQ ID NO 60832 | GAGATGGAGTCTCGCTCTGTGA | TTT | chr17 | 42909881 | 42909902 | 42909898 | 42909903 | + |

Figure 90 (Cont'd)

| | | | | | | | | |
|---|---|---|---|---|---|---|---|---|
| SEQ ID NO 60833 | AGATGGAGTCTCGCTCTGTGAC | TTG | chr17 | 42909882 | 42909903 | 42909899 | 42909904 | + |
| SEQ ID NO 60834 | GCTCTGTGACCCAGGCTAGAGT | CTC | chr17 | 42909894 | 42909915 | 42909911 | 42909916 | + |
| SEQ ID NO 60835 | TGTGACCCAGGCTAGAGTGCAG | CTC | chr17 | 42909898 | 42909919 | 42909915 | 42909920 | + |
| SEQ ID NO 60836 | TGACCCAGGCTAGAGTGCAGTG | CTG | chr17 | 42909900 | 42909921 | 42909917 | 42909922 | + |
| SEQ ID NO 60837 | GAGTGCAGTGGTGCGATCTCGG | CTA | chr17 | 42909912 | 42909933 | 42909929 | 42909934 | + |
| SEQ ID NO 60838 | GGCTCACTGCAAGCTCCACCTC | CTC | chr17 | 42909932 | 42909953 | 42909949 | 42909954 | + |
| SEQ ID NO 60839 | ACTGCAAGCTCCACCTCCTGGG | CTC | chr17 | 42909937 | 42909958 | 42909954 | 42909959 | + |
| SEQ ID NO 60840 | CAAGCTCCACCTCCTGGGTTCA | CTG | chr17 | 42909941 | 42909962 | 42909958 | 42909963 | + |
| SEQ ID NO 60841 | CACCTCCTGGGTTCACGCCATT | CTC | chr17 | 42909948 | 42909969 | 42909965 | 42909970 | + |
| SEQ ID NO 60842 | CTGGGTTCACGCCATTCTCCTG | CTC | chr17 | 42909954 | 42909975 | 42909971 | 42909976 | + |
| SEQ ID NO 60843 | GGTTCACGCCATTCTCCTGCCT | CTG | chr17 | 42909957 | 42909978 | 42909974 | 42909979 | + |
| SEQ ID NO 60844 | ACGCCATTCTCCTGCCTCAGCC | TTC | chr17 | 42909962 | 42909983 | 42909979 | 42909984 | + |
| SEQ ID NO 60845 | TCCTGCCTCAGCCTCTCCGAGT | TTC | chr17 | 42909971 | 42909992 | 42909988 | 42909993 | + |
| SEQ ID NO 60846 | CTGCCTCAGCCTCTCCGAGTAG | CTC | chr17 | 42909973 | 42909994 | 42909990 | 42909995 | + |
| SEQ ID NO 60847 | CCTCAGCCTCTCCGAGTAGCTG | CTG | chr17 | 42909976 | 42909997 | 42909993 | 42909998 | + |
| SEQ ID NO 60848 | AGCCTCTCCGAGTAGCTGGGAC | CTC | chr17 | 42909980 | 42910001 | 42909997 | 42910002 | + |
| SEQ ID NO 60849 | TCCGAGTAGCTGGGACTACAGG | CTC | chr17 | 42909986 | 42910007 | 42910003 | 42910008 | + |
| SEQ ID NO 60850 | CGAGTAGCTGGGACTACAGGCG | CTC | chr17 | 42909988 | 42910009 | 42910005 | 42910010 | + |
| SEQ ID NO 60851 | GGACTACAGGCGCCCGCCACCA | CTG | chr17 | 42909998 | 42910019 | 42910015 | 42910020 | + |
| SEQ ID NO 60852 | CAGGCGCCCGCCACCATGCCCG | CTA | chr17 | 42910004 | 42910025 | 42910021 | 42910026 | + |
| SEQ ID NO 60853 | ATTTTTTGTATTTTTAGCAGAG | CTA | chr17 | 42910030 | 42910051 | 42910047 | 42910052 | + |
| SEQ ID NO 60854 | TTTGTATTTTTAGCAGAGACGG | TTT | chr17 | 42910034 | 42910055 | 42910051 | 42910056 | + |
| SEQ ID NO 60855 | TTGTATTTTTAGCAGAGACGGG | TTT | chr17 | 42910035 | 42910056 | 42910052 | 42910057 | + |
| SEQ ID NO 60856 | TGTATTTTTAGCAGAGACGGGG | TTT | chr17 | 42910036 | 42910057 | 42910053 | 42910058 | + |
| SEQ ID NO 60857 | GTATTTTTAGCAGAGACGGGGT | TTT | chr17 | 42910037 | 42910058 | 42910054 | 42910059 | + |
| SEQ ID NO 60858 | TATTTTTAGCAGAGACGGGGTT | TTG | chr17 | 42910038 | 42910059 | 42910055 | 42910060 | + |
| SEQ ID NO 60859 | TTAGCAGAGACGGGGTTTCACC | TTT | chr17 | 42910043 | 42910064 | 42910060 | 42910065 | + |
| SEQ ID NO 60860 | TAGCAGAGACGGGGTTTCACCG | TTT | chr17 | 42910044 | 42910065 | 42910061 | 42910066 | + |
| SEQ ID NO 60861 | AGCAGAGACGGGGTTTCACCGT | TTT | chr17 | 42910045 | 42910066 | 42910062 | 42910067 | + |
| SEQ ID NO 60862 | GCAGAGACGGGGTTTCACCGTG | TTA | chr17 | 42910046 | 42910067 | 42910063 | 42910068 | + |
| SEQ ID NO 60863 | CACCGTGGTCTTGATCTCCTGA | TTT | chr17 | 42910061 | 42910082 | 42910078 | 42910083 | + |
| SEQ ID NO 60864 | ACCGTGGTCTTGATCTCCTGAC | TTC | chr17 | 42910062 | 42910083 | 42910079 | 42910084 | + |
| SEQ ID NO 60865 | GATCTCCTGACCTCGTGATCCG | CTT | chr17 | 42910073 | 42910094 | 42910090 | 42910095 | + |
| SEQ ID NO 60866 | ATCTCCTGACCTCGTGATCCGC | TTG | chr17 | 42910074 | 42910095 | 42910091 | 42910096 | + |
| SEQ ID NO 60867 | CTGACCTCGTGATCCGCCCGCC | CTC | chr17 | 42910079 | 42910100 | 42910096 | 42910101 | + |
| SEQ ID NO 60868 | ACCTCGTGATCCGCCCGCCTCG | CTG | chr17 | 42910082 | 42910103 | 42910099 | 42910104 | + |
| SEQ ID NO 60869 | GTGATCCGCCCGCCTCGGCCTC | CTC | chr17 | 42910087 | 42910108 | 42910104 | 42910109 | + |
| SEQ ID NO 60870 | GGCCTCCCAAAGCGCTGGGATT | CTC | chr17 | 42910103 | 42910124 | 42910120 | 42910125 | + |
| SEQ ID NO 60871 | CCAAAGCGCTGGGATTACAAGG | CTC | chr17 | 42910109 | 42910130 | 42910126 | 42910131 | + |
| SEQ ID NO 60872 | GGATTACAAGGGTGAGCCACCG | CTG | chr17 | 42910120 | 42910141 | 42910137 | 42910142 | + |
| SEQ ID NO 60873 | CAAGGGTGAGCCACCGCACCCT | TTA | chr17 | 42910126 | 42910147 | 42910143 | 42910148 | + |
| SEQ ID NO 60874 | CCTGAATATGTGTTTCTTAGA | CTG | chr17 | 42910149 | 42910170 | 42910166 | 42910171 | + |
| SEQ ID NO 60875 | AATATGTGTTTCTTAGATCCA | CTG | chr17 | 42910153 | 42910174 | 42910170 | 42910175 | + |
| SEQ ID NO 60876 | TCTTAGATCCAATTAACAAGGG | TTT | chr17 | 42910164 | 42910185 | 42910181 | 42910186 | + |
| SEQ ID NO 60877 | CTTAGATCCAATTAACAAGGGT | TTT | chr17 | 42910165 | 42910186 | 42910182 | 42910187 | + |
| SEQ ID NO 60878 | TTAGATCCAATTAACAAGGGTA | TTC | chr17 | 42910166 | 42910187 | 42910183 | 42910188 | + |
| SEQ ID NO 60879 | AGATCCAATTAACAAGGGTAAG | CTT | chr17 | 42910168 | 42910189 | 42910185 | 42910190 | + |
| SEQ ID NO 60880 | GATCCAATTAACAAGGGTAAGA | TTA | chr17 | 42910169 | 42910190 | 42910186 | 42910191 | + |
| SEQ ID NO 60881 | ACAAGGGTAAGACAAGATTTAA | TTA | chr17 | 42910179 | 42910200 | 42910196 | 42910201 | + |
| SEQ ID NO 60882 | AAGTTAAGCATAAGAAAGATTT | TTT | chr17 | 42910199 | 42910220 | 42910216 | 42910221 | + |
| SEQ ID NO 60883 | AGTTAAGCATAAGAAAGATTTT | TTA | chr17 | 42910200 | 42910221 | 42910217 | 42910222 | + |
| SEQ ID NO 60884 | AGCATAAGAAAGATTTTGTGGG | TTA | chr17 | 42910205 | 42910226 | 42910222 | 42910227 | + |
| SEQ ID NO 60885 | TGTGGGAGGCACTGGAATATAA | TTT | chr17 | 42910221 | 42910242 | 42910238 | 42910243 | + |
| SEQ ID NO 60886 | GTGGGAGGCACTGGAATATAAG | TTT | chr17 | 42910222 | 42910243 | 42910239 | 42910244 | + |
| SEQ ID NO 60887 | TGGGAGGCACTGGAATATAAGA | TTG | chr17 | 42910223 | 42910244 | 42910240 | 42910245 | + |
| SEQ ID NO 60888 | GAATATAAGACCTTAACAAAAC | CTG | chr17 | 42910235 | 42910256 | 42910252 | 42910257 | + |
| SEQ ID NO 60889 | AACAAAACTGTGGAATTTCTCC | CTT | chr17 | 42910249 | 42910270 | 42910266 | 42910271 | + |
| SEQ ID NO 60890 | ACAAAACTGTGGAATTTCTCCC | TTA | chr17 | 42910250 | 42910271 | 42910267 | 42910272 | + |

Figure 90 (Cont'd)

| SEQ ID NO 60891 | TGGAATTTCTCCCCTGGAGATT | CTG | chr17 | 42910259 | 42910280 | 42910276 | 42910281 | + |
| SEQ ID NO 60892 | CTCCCCTGGAGATTTGTAAGAA | TTT | chr17 | 42910267 | 42910288 | 42910284 | 42910289 | + |
| SEQ ID NO 60893 | TCCCCTGGAGATTTGTAAGAAC | TTC | chr17 | 42910268 | 42910289 | 42910285 | 42910290 | + |
| SEQ ID NO 60894 | CCCTGGAGATTTGTAAGAACGG | CTC | chr17 | 42910270 | 42910291 | 42910287 | 42910292 | + |
| SEQ ID NO 60895 | GAGATTTGTAAGAACGGAACAT | CTG | chr17 | 42910275 | 42910296 | 42910292 | 42910297 | + |
| SEQ ID NO 60896 | GTAAGAACGGAACATAGCAGCA | TTT | chr17 | 42910282 | 42910303 | 42910299 | 42910304 | + |
| SEQ ID NO 60897 | TAAGAACGGAACATAGCAGCAT | TTG | chr17 | 42910283 | 42910304 | 42910300 | 42910305 | + |
| SEQ ID NO 60898 | AAAGAAGAATGTTGAGAACAAG | TTC | chr17 | 42910307 | 42910328 | 42910324 | 42910329 | + |
| SEQ ID NO 60899 | AGAACAAGGGAGATAATGGTTT | TTG | chr17 | 42910321 | 42910342 | 42910338 | 42910343 | + |
| SEQ ID NO 60900 | CATGGTAATCACAAAAGTAACA | TTT | chr17 | 42910343 | 42910364 | 42910360 | 42910365 | + |
| SEQ ID NO 60901 | ATGGTAATCACAAAAGTAACAC | TTC | chr17 | 42910344 | 42910365 | 42910361 | 42910366 | + |
| SEQ ID NO 60902 | AGTACTGGGTTCCATGTTTGAG | TTT | chr17 | 42910373 | 42910394 | 42910390 | 42910395 | + |
| SEQ ID NO 60903 | GTACTGGGTTCCATGTTTGAGG | TTA | chr17 | 42910374 | 42910395 | 42910391 | 42910396 | + |
| SEQ ID NO 60904 | GGTTCCATGTTTGAGGAAGAAC | CTG | chr17 | 42910380 | 42910401 | 42910397 | 42910402 | + |
| SEQ ID NO 60905 | CATGTTTGAGGAAGAACCTGGA | TTC | chr17 | 42910385 | 42910406 | 42910402 | 42910407 | + |
| SEQ ID NO 60906 | GAGGAAGAACCTGGAAGCCATA | TTT | chr17 | 42910392 | 42910413 | 42910409 | 42910414 | + |
| SEQ ID NO 60907 | AGGAAGAACCTGGAAGCCATAT | TTG | chr17 | 42910393 | 42910414 | 42910410 | 42910415 | + |
| SEQ ID NO 60908 | GAAGCCATATCACATGAAAAAC | CTG | chr17 | 42910405 | 42910426 | 42910422 | 42910427 | + |
| SEQ ID NO 60909 | GGAATGTTTAGGTTAGAGAGAA | CTG | chr17 | 42910430 | 42910451 | 42910447 | 42910452 | + |
| SEQ ID NO 60910 | AGGTTAGAGAGAATAACTGTGT | TTT | chr17 | 42910439 | 42910460 | 42910456 | 42910461 | + |
| SEQ ID NO 60911 | GGTTAGAGAGAATAACTGTGTT | TTA | chr17 | 42910440 | 42910461 | 42910457 | 42910462 | + |
| SEQ ID NO 60912 | GAGAGAATAACTGTGTTCAAAT | TTA | chr17 | 42910445 | 42910466 | 42910462 | 42910467 | + |
| SEQ ID NO 60913 | TGTTCAAATGTGTGACAGAGGG | CTG | chr17 | 42910458 | 42910479 | 42910475 | 42910480 | + |
| SEQ ID NO 60914 | AAATGTGTGACAGAGGGACTAG | TTC | chr17 | 42910463 | 42910484 | 42910480 | 42910485 | + |
| SEQ ID NO 60915 | GATTCATCACTTACTAACTCCT | CTA | chr17 | 42910484 | 42910505 | 42910501 | 42910506 | + |
| SEQ ID NO 60916 | ATCACTTACTAACTCCTGCAGA | TTC | chr17 | 42910489 | 42910510 | 42910506 | 42910511 | + |
| SEQ ID NO 60917 | ACTAACTCCTGCAGAAAGAACT | CTT | chr17 | 42910496 | 42910517 | 42910513 | 42910518 | + |
| SEQ ID NO 60918 | CTAACTCCTGCAGAAAGAACTG | TTA | chr17 | 42910497 | 42910518 | 42910514 | 42910519 | + |
| SEQ ID NO 60919 | ACTCCTGCAGAAAGAACTGAGA | CTA | chr17 | 42910500 | 42910521 | 42910517 | 42910522 | + |
| SEQ ID NO 60920 | CTGCAGAAAGAACTGAGAAAAA | CTC | chr17 | 42910504 | 42910525 | 42910521 | 42910526 | + |
| SEQ ID NO 60921 | CAGAAAGAACTGAGAAAAATAG | CTG | chr17 | 42910507 | 42910528 | 42910524 | 42910529 | + |
| SEQ ID NO 60922 | AGAAAAATAGACAGTATTAGAG | CTG | chr17 | 42910519 | 42910540 | 42910536 | 42910541 | + |
| SEQ ID NO 60923 | GAGGGGGACCAGTTTCACACAG | TTA | chr17 | 42910538 | 42910559 | 42910555 | 42910560 | + |
| SEQ ID NO 60924 | CACACAGACAAGGAAGAACTAT | TTT | chr17 | 42910553 | 42910574 | 42910570 | 42910575 | + |
| SEQ ID NO 60925 | ACACAGACAAGGAAGAACTATT | TTC | chr17 | 42910554 | 42910575 | 42910571 | 42910576 | + |
| SEQ ID NO 60926 | TTCAGCAATCAATTCCGTTCAA | CTA | chr17 | 42910574 | 42910595 | 42910591 | 42910596 | + |
| SEQ ID NO 60927 | AGCAATCAATTCCGTTCAAAGA | TTC | chr17 | 42910577 | 42910598 | 42910594 | 42910599 | + |
| SEQ ID NO 60928 | CGTTCAAAGATAAAATGGACTG | TTC | chr17 | 42910589 | 42910610 | 42910606 | 42910611 | + |
| SEQ ID NO 60929 | AAAGATAAAATGGACTGTTATA | TTC | chr17 | 42910594 | 42910615 | 42910611 | 42910616 | + |
| SEQ ID NO 60930 | TTATAGTGGGGGTGAGCTCCCT | CTG | chr17 | 42910611 | 42910632 | 42910628 | 42910633 | + |
| SEQ ID NO 60931 | TAGTGGGGGTGAGCTCCCTACC | TTA | chr17 | 42910614 | 42910635 | 42910631 | 42910636 | + |
| SEQ ID NO 60932 | CCTACCTCTGAGGGTATTTCAA | CTC | chr17 | 42910630 | 42910651 | 42910647 | 42910652 | + |
| SEQ ID NO 60933 | CCTCTGAGGGTATTTCAAGTAG | CTA | chr17 | 42910634 | 42910655 | 42910651 | 42910656 | + |
| SEQ ID NO 60934 | TGAGGGTATTTCAAGTAGAGAT | CTC | chr17 | 42910638 | 42910659 | 42910655 | 42910660 | + |
| SEQ ID NO 60935 | AGGGTATTTCAAGTAGAGATAG | CTG | chr17 | 42910640 | 42910661 | 42910657 | 42910662 | + |
| SEQ ID NO 60936 | CAAGTAGAGATAGGAGGACCTC | TTT | chr17 | 42910649 | 42910670 | 42910666 | 42910671 | + |
| SEQ ID NO 60937 | AAGTAGAGATAGGAGGACCTCC | TTC | chr17 | 42910650 | 42910671 | 42910667 | 42910672 | + |
| SEQ ID NO 60938 | CTGGTAGGAAATTTGCATACGG | CTC | chr17 | 42910671 | 42910692 | 42910688 | 42910693 | + |
| SEQ ID NO 60939 | GTAGGAAATTTGCATACGGTGG | CTG | chr17 | 42910674 | 42910695 | 42910691 | 42910696 | + |
| SEQ ID NO 60940 | GCATACGGTGGGAGATTGTACG | TTT | chr17 | 42910685 | 42910706 | 42910702 | 42910707 | + |
| SEQ ID NO 60941 | CATACGGTGGGAGATTGTACGT | TTG | chr17 | 42910686 | 42910707 | 42910703 | 42910708 | + |
| SEQ ID NO 60942 | TACGTGATATGGCACCTCCATC | TTG | chr17 | 42910703 | 42910724 | 42910720 | 42910725 | + |
| SEQ ID NO 60943 | CATCTGAAAGAGTCTATATTGA | CTC | chr17 | 42910721 | 42910742 | 42910738 | 42910743 | + |
| SEQ ID NO 60944 | AAAGAGTCTATATTGAGGGCAG | CTG | chr17 | 42910727 | 42910748 | 42910744 | 42910749 | + |
| SEQ ID NO 60945 | TATTGAGGGCAGGCTGGAGTCA | CTA | chr17 | 42910737 | 42910758 | 42910754 | 42910759 | + |
| SEQ ID NO 60946 | AGGGCAGGCTGGAGTCACACAT | TTG | chr17 | 42910742 | 42910763 | 42910759 | 42910764 | + |
| SEQ ID NO 60947 | GAGTCACACATGGGAATAAGCC | CTG | chr17 | 42910753 | 42910774 | 42910770 | 42910775 | + |
| SEQ ID NO 60948 | CCATCTGCCATCTGTGATTTAA | CTC | chr17 | 42910786 | 42910807 | 42910803 | 42910808 | + |

Figure 90 (Cont'd)

| SEQ ID NO 60949 | CCATCTGTGATTTAATTCCACA | CTG | chr17 | 42910793 | 42910814 | 42910810 | 42910815 | + |
| SEQ ID NO 60950 | TGATTTAATTCCACAGTCGCAG | CTG | chr17 | 42910800 | 42910821 | 42910817 | 42910822 | + |
| SEQ ID NO 60951 | AATTCCACAGTCGCAGAACGGA | TTT | chr17 | 42910806 | 42910827 | 42910823 | 42910828 | + |
| SEQ ID NO 60952 | ATTCCACAGTCGCAGAACGGAT | TTA | chr17 | 42910807 | 42910828 | 42910824 | 42910829 | + |
| SEQ ID NO 60953 | CACAGTCGCAGAACGGATGGCA | TTC | chr17 | 42910811 | 42910832 | 42910828 | 42910833 | + |
| SEQ ID NO 60954 | CTCCAAACCCACCTCTAGCAAA | CTC | chr17 | 42910845 | 42910866 | 42910862 | 42910867 | + |
| SEQ ID NO 60955 | CAAACCCACCTCTAGCAAAGGT | CTC | chr17 | 42910848 | 42910869 | 42910865 | 42910870 | + |
| SEQ ID NO 60956 | TAGCAAAGGTCCCAAATCCTTC | CTC | chr17 | 42910860 | 42910881 | 42910877 | 42910882 | + |
| SEQ ID NO 60957 | GCAAAGGTCCCAAATCCTTCCT | CTA | chr17 | 42910862 | 42910883 | 42910879 | 42910884 | + |
| SEQ ID NO 60958 | CCTATCTCTCACAGTCATGCTT | CTT | chr17 | 42910881 | 42910902 | 42910898 | 42910903 | + |
| SEQ ID NO 60959 | CTATCTCTCACAGTCATGCTTT | TTC | chr17 | 42910882 | 42910903 | 42910899 | 42910904 | + |
| SEQ ID NO 60960 | TCTCTCACAGTCATGCTTTCTT | CTA | chr17 | 42910885 | 42910906 | 42910902 | 42910907 | + |
| SEQ ID NO 60961 | TCACAGTCATGCTTTCTTCCAC | CTC | chr17 | 42910889 | 42910910 | 42910906 | 42910911 | + |
| SEQ ID NO 60962 | ACAGTCATGCTTTCTTCCACTC | CTC | chr17 | 42910891 | 42910912 | 42910908 | 42910913 | + |
| SEQ ID NO 60963 | TCTTCCACTCAGGCATTGCTGT | CTT | chr17 | 42910903 | 42910924 | 42910920 | 42910925 | + |
| SEQ ID NO 60964 | CTTCCACTCAGGCATTGCTGTT | TTT | chr17 | 42910904 | 42910925 | 42910921 | 42910926 | + |
| SEQ ID NO 60965 | TTCCACTCAGGCATTGCTGTTG | TTC | chr17 | 42910905 | 42910926 | 42910922 | 42910927 | + |
| SEQ ID NO 60966 | CCACTCAGGCATTGCTGTTGCA | CTT | chr17 | 42910907 | 42910928 | 42910924 | 42910929 | + |
| SEQ ID NO 60967 | CACTCAGGCATTGCTGTTGCAG | TTC | chr17 | 42910908 | 42910929 | 42910925 | 42910930 | + |
| SEQ ID NO 60968 | AGGCATTGCTGTTGCAGAAACT | CTC | chr17 | 42910913 | 42910934 | 42910930 | 42910935 | + |
| SEQ ID NO 60969 | CTGTTGCAGAAACTTTCAGCCA | TTG | chr17 | 42910921 | 42910942 | 42910938 | 42910943 | + |
| SEQ ID NO 60970 | TTGCAGAAACTTTCAGCCACAT | CTG | chr17 | 42910924 | 42910945 | 42910941 | 42910946 | + |
| SEQ ID NO 60971 | CAGAAACTTTCAGCCACATCCA | TTG | chr17 | 42910927 | 42910948 | 42910944 | 42910949 | + |
| SEQ ID NO 60972 | TCAGCCACATCCACAGCATCTA | CTT | chr17 | 42910936 | 42910957 | 42910953 | 42910958 | + |
| SEQ ID NO 60973 | CAGCCACATCCACAGCATCTAT | TTT | chr17 | 42910937 | 42910958 | 42910954 | 42910959 | + |
| SEQ ID NO 60974 | AGCCACATCCACAGCATCTATA | TTC | chr17 | 42910938 | 42910959 | 42910955 | 42910960 | + |
| SEQ ID NO 60975 | TAATGCCAGCCTCAAGAAATAT | CTA | chr17 | 42910958 | 42910979 | 42910975 | 42910980 | + |
| SEQ ID NO 60976 | AAGAAATATTTTCTCATTACCT | CTC | chr17 | 42910971 | 42910992 | 42910988 | 42910993 | + |
| SEQ ID NO 60977 | TCTCATTACCTTCTTCCTGTTC | TTT | chr17 | 42910982 | 42911003 | 42910999 | 42911004 | + |
| SEQ ID NO 60978 | CTCATTACCTTCTTCCTGTTCA | TTT | chr17 | 42910983 | 42911004 | 42911000 | 42911005 | + |
| SEQ ID NO 60979 | TCATTACCTTCTTCCTGTTCAG | TTC | chr17 | 42910984 | 42911005 | 42911001 | 42911006 | + |
| SEQ ID NO 60980 | ATTACCTTCTTCCTGTTCAGCT | CTC | chr17 | 42910986 | 42911007 | 42911003 | 42911008 | + |
| SEQ ID NO 60981 | CCTTCTTCCTGTTCAGCTTCGC | TTA | chr17 | 42910990 | 42911011 | 42911007 | 42911012 | + |
| SEQ ID NO 60982 | CTTCCTGTTCAGCTTCGCCATC | CTT | chr17 | 42910994 | 42911015 | 42911011 | 42911016 | + |
| SEQ ID NO 60983 | TTCCTGTTCAGCTTCGCCATCG | TTC | chr17 | 42910995 | 42911016 | 42911012 | 42911017 | + |
| SEQ ID NO 60984 | CCTGTTCAGCTTCGCCATCGGA | CTT | chr17 | 42910997 | 42911018 | 42911014 | 42911019 | + |
| SEQ ID NO 60985 | CTGTTCAGCTTCGCCATCGGAT | TTC | chr17 | 42910998 | 42911019 | 42911015 | 42911020 | + |
| SEQ ID NO 60986 | TTCAGCTTCGCCATCGGATTTT | CTG | chr17 | 42911001 | 42911022 | 42911018 | 42911023 | + |
| SEQ ID NO 60987 | AGCTTCGCCATCGGATTTTATC | TTC | chr17 | 42911004 | 42911025 | 42911021 | 42911026 | + |
| SEQ ID NO 60988 | CGCCATCGGATTTTATCTGCTG | CTT | chr17 | 42911009 | 42911030 | 42911026 | 42911031 | + |
| SEQ ID NO 60989 | GCCATCGGATTTTATCTGCTGC | TTC | chr17 | 42911010 | 42911031 | 42911027 | 42911032 | + |
| SEQ ID NO 60990 | TATCTGCTGCTCAAGGGACTGG | TTT | chr17 | 42911022 | 42911043 | 42911039 | 42911044 | + |
| SEQ ID NO 60991 | ATCTGCTGCTCAAGGGACTGGG | TTT | chr17 | 42911023 | 42911044 | 42911040 | 42911045 | + |
| SEQ ID NO 60992 | TCTGCTGCTCAAGGGACTGGGT | TTA | chr17 | 42911024 | 42911045 | 42911041 | 42911046 | + |
| SEQ ID NO 60993 | CTGCTCAAGGGACTGGGTGTAG | CTG | chr17 | 42911028 | 42911049 | 42911045 | 42911050 | + |
| SEQ ID NO 60994 | CTCAAGGGACTGGGTGTAGACC | CTG | chr17 | 42911031 | 42911052 | 42911048 | 42911053 | + |
| SEQ ID NO 60995 | AAGGGACTGGGTGTAGACCTCC | CTC | chr17 | 42911034 | 42911055 | 42911051 | 42911056 | + |
| SEQ ID NO 60996 | GGTGTAGACCTCCTGTGGACTC | CTG | chr17 | 42911043 | 42911064 | 42911060 | 42911065 | + |
| SEQ ID NO 60997 | CTGTGGACTCTGGAGAAAGCCC | CTC | chr17 | 42911055 | 42911076 | 42911072 | 42911077 | + |
| SEQ ID NO 60998 | TGGACTCTGGAGAAAGCCCAGA | CTG | chr17 | 42911058 | 42911079 | 42911075 | 42911080 | + |
| SEQ ID NO 60999 | TGGAGAAAGCCCAGAGGTGGTG | CTC | chr17 | 42911065 | 42911086 | 42911082 | 42911087 | + |
| SEQ ID NO 61000 | GAGAAAGCCCAGAGGTGGTGCG | CTG | chr17 | 42911067 | 42911088 | 42911084 | 42911089 | + |
| SEQ ID NO 61001 | ACACCACACCCTTTGCCAGCCT | TTG | chr17 | 42911113 | 42911134 | 42911130 | 42911135 | + |
| SEQ ID NO 61002 | TGCCAGCCTCCTCAAGAACCTG | CTT | chr17 | 42911126 | 42911147 | 42911143 | 42911148 | + |
| SEQ ID NO 61003 | GCCAGCCTCCTCAAGAACCTGG | TTT | chr17 | 42911127 | 42911148 | 42911144 | 42911149 | + |
| SEQ ID NO 61004 | CCAGCCTCCTCAAGAACCTGGG | TTG | chr17 | 42911128 | 42911149 | 42911145 | 42911150 | + |
| SEQ ID NO 61005 | CTCAAGAACCTGGGCACGCTCT | CTC | chr17 | 42911136 | 42911157 | 42911153 | 42911158 | + |
| SEQ ID NO 61006 | AAGAACCTGGGCACGCTCTTTG | CTC | chr17 | 42911139 | 42911160 | 42911156 | 42911161 | + |

Figure 90 (Cont'd)

| SEQ ID NO 61007 | GGCACGCTCTTTGGCCTGGGGC | CTG | chr17 | 42911148 | 42911169 | 42911165 | 42911170 | + |
| SEQ ID NO 61008 | TTTGGCCTGGGGCTGGCTCTCA | CTC | chr17 | 42911157 | 42911178 | 42911174 | 42911179 | + |
| SEQ ID NO 61009 | TGGCCTGGGGCTGGCTCTCAAC | CTT | chr17 | 42911159 | 42911180 | 42911176 | 42911181 | + |
| SEQ ID NO 61010 | GGCCTGGGGCTGGCTCTCAACT | TTT | chr17 | 42911160 | 42911181 | 42911177 | 42911182 | + |
| SEQ ID NO 61011 | GCCTGGGGCTGGCTCTCAACTC | TTG | chr17 | 42911161 | 42911182 | 42911178 | 42911183 | + |
| SEQ ID NO 61012 | GGGCTGGCTCTCAACTCCAGCA | CTG | chr17 | 42911166 | 42911187 | 42911183 | 42911188 | + |
| SEQ ID NO 61013 | GCTCTCAACTCCAGCATGTACA | CTG | chr17 | 42911172 | 42911193 | 42911189 | 42911194 | + |
| SEQ ID NO 61014 | TCAACTCCAGCATGTACAGGGA | CTC | chr17 | 42911176 | 42911197 | 42911193 | 42911198 | + |
| SEQ ID NO 61015 | AACTCCAGCATGTACAGGGAGA | CTC | chr17 | 42911178 | 42911199 | 42911195 | 42911200 | + |
| SEQ ID NO 61016 | CAGCATGTACAGGGAGAGCTGC | CTC | chr17 | 42911183 | 42911204 | 42911200 | 42911205 | + |
| SEQ ID NO 61017 | CAAGGGGAAACTCAGCAAGTGG | CTG | chr17 | 42911204 | 42911225 | 42911221 | 42911226 | + |
| SEQ ID NO 61018 | AGCAAGTGGCTCCCATTCCGCC | CTC | chr17 | 42911217 | 42911238 | 42911234 | 42911239 | + |
| SEQ ID NO 61019 | CCATTCCGCCTCAGCTCTATTG | CTC | chr17 | 42911229 | 42911250 | 42911246 | 42911251 | + |
| SEQ ID NO 61020 | CGCCTCAGCTCTATTGTAGCCT | TTC | chr17 | 42911235 | 42911256 | 42911252 | 42911257 | + |
| SEQ ID NO 61021 | AGCTCTATTGTAGCCTCCCTCG | CTC | chr17 | 42911241 | 42911262 | 42911258 | 42911263 | + |
| SEQ ID NO 61022 | TATTGTAGCCTCCCTCGTCCTC | CTC | chr17 | 42911246 | 42911267 | 42911263 | 42911268 | + |
| SEQ ID NO 61023 | TTGTAGCCTCCCTCGTCCTCCT | CTA | chr17 | 42911248 | 42911269 | 42911265 | 42911270 | + |
| SEQ ID NO 61024 | TAGCCTCCCTCGTCCTCCTGCA | TTG | chr17 | 42911251 | 42911272 | 42911268 | 42911273 | + |
| SEQ ID NO 61025 | CCTCGTCCTCCTGCACGTCTTT | CTC | chr17 | 42911258 | 42911279 | 42911275 | 42911280 | + |
| SEQ ID NO 61026 | GTCCTCCTGCACGTCTTTGACT | CTC | chr17 | 42911262 | 42911283 | 42911279 | 42911284 | + |
| SEQ ID NO 61027 | CTGCACGTCTTTGACTCCTTGA | CTC | chr17 | 42911268 | 42911289 | 42911285 | 42911290 | + |
| SEQ ID NO 61028 | CACGTCTTTGACTCCTTGAAAC | CTG | chr17 | 42911271 | 42911292 | 42911288 | 42911293 | + |
| SEQ ID NO 61029 | TGACTCCTTGAAACCCCCATCC | CTT | chr17 | 42911279 | 42911300 | 42911296 | 42911301 | + |
| SEQ ID NO 61030 | GACTCCTTGAAACCCCCATCCC | TTT | chr17 | 42911280 | 42911301 | 42911297 | 42911302 | + |
| SEQ ID NO 61031 | ACTCCTTGAAACCCCCATCCCA | TTG | chr17 | 42911281 | 42911302 | 42911298 | 42911303 | + |
| SEQ ID NO 61032 | CTTGAAACCCCCATCCCAAGTC | CTC | chr17 | 42911285 | 42911306 | 42911302 | 42911307 | + |
| SEQ ID NO 61033 | GAAACCCCCATCCCAAGTCGAG | CTT | chr17 | 42911288 | 42911309 | 42911305 | 42911310 | + |
| SEQ ID NO 61034 | AAACCCCCATCCCAAGTCGAGC | TTG | chr17 | 42911289 | 42911310 | 42911306 | 42911311 | + |
| SEQ ID NO 61035 | GTCTTCTACGTCTTGTCCTTCT | CTG | chr17 | 42911313 | 42911334 | 42911330 | 42911335 | + |
| SEQ ID NO 61036 | CTACGTCTTGTCCTTCTGCAAG | CTT | chr17 | 42911318 | 42911339 | 42911335 | 42911340 | + |
| SEQ ID NO 61037 | TACGTCTTGTCCTTCTGCAAGA | TTC | chr17 | 42911319 | 42911340 | 42911336 | 42911341 | + |
| SEQ ID NO 61038 | CGTCTTGTCCTTCTGCAAGAGT | CTA | chr17 | 42911321 | 42911342 | 42911338 | 42911343 | + |
| SEQ ID NO 61039 | GTCCTTCTGCAAGAGTGCGGTA | CTT | chr17 | 42911327 | 42911348 | 42911344 | 42911349 | + |
| SEQ ID NO 61040 | TCCTTCTGCAAGAGTGCGGTAG | TTG | chr17 | 42911328 | 42911349 | 42911345 | 42911350 | + |
| SEQ ID NO 61041 | CTGCAAGAGTGCGGTAGTGCCC | CTT | chr17 | 42911333 | 42911354 | 42911350 | 42911355 | + |
| SEQ ID NO 61042 | TGCAAGAGTGCGGTAGTGCCCC | TTC | chr17 | 42911334 | 42911355 | 42911351 | 42911356 | + |
| SEQ ID NO 61043 | CAAGAGTGCGGTAGTGCCCCTG | CTG | chr17 | 42911336 | 42911357 | 42911353 | 42911358 | + |
| SEQ ID NO 61044 | GCATCCGTCAGTGTCATCCCCT | CTG | chr17 | 42911358 | 42911379 | 42911375 | 42911380 | + |
| SEQ ID NO 61045 | CTGCCTCGCCCAGGTCCTGGGC | CTA | chr17 | 42911381 | 42911402 | 42911398 | 42911403 | + |
| SEQ ID NO 61046 | CCTCGCCCAGGTCCTGGGCAG | CTG | chr17 | 42911384 | 42911405 | 42911401 | 42911406 | + |
| SEQ ID NO 61047 | GCCCAGGTCCTGGGCCAGCCGC | CTC | chr17 | 42911388 | 42911409 | 42911405 | 42911410 | + |
| SEQ ID NO 61048 | GGCCAGCCGCACAAGAAGTCGT | CTG | chr17 | 42911400 | 42911421 | 42911417 | 42911422 | + |
| SEQ ID NO 61049 | TAAGAGATGTGGAGTCTTCGGT | TTG | chr17 | 42911424 | 42911445 | 42911441 | 42911446 | + |
| SEQ ID NO 61050 | CGGTGTTTAAAGTCAACAACCA | CTT | chr17 | 42911442 | 42911463 | 42911459 | 42911464 | + |
| SEQ ID NO 61051 | GGTGTTTAAAGTCAACAACCAT | TTC | chr17 | 42911443 | 42911464 | 42911460 | 42911465 | + |
| SEQ ID NO 61052 | AAAGTCAACAACCATGCCAGGG | TTT | chr17 | 42911450 | 42911471 | 42911467 | 42911472 | + |
| SEQ ID NO 61053 | AAGTCAACAACCATGCCAGGGA | TTA | chr17 | 42911451 | 42911472 | 42911468 | 42911473 | + |
| SEQ ID NO 61054 | AGGAGGACTACTATTTGAAGCA | TTG | chr17 | 42911476 | 42911497 | 42911493 | 42911498 | + |
| SEQ ID NO 61055 | CTATTTGAAGCAATGGGCACTG | CTA | chr17 | 42911486 | 42911507 | 42911503 | 42911508 | + |
| SEQ ID NO 61056 | TTTGAAGCAATGGGCACTGGTA | CTA | chr17 | 42911489 | 42911510 | 42911506 | 42911511 | + |
| SEQ ID NO 61057 | GAAGCAATGGGCACTGGTATTT | TTT | chr17 | 42911492 | 42911513 | 42911509 | 42911514 | + |
| SEQ ID NO 61058 | AAGCAATGGGCACTGGTATTTG | TTG | chr17 | 42911493 | 42911514 | 42911510 | 42911515 | + |
| SEQ ID NO 61059 | GTATTTGGAGCAAGTGACATGC | CTG | chr17 | 42911508 | 42911529 | 42911525 | 42911530 | + |
| SEQ ID NO 61060 | GGAGCAAGTGACATGCCATCCA | TTT | chr17 | 42911514 | 42911535 | 42911531 | 42911536 | + |
| SEQ ID NO 61061 | GAGCAAGTGACATGCCATCCAT | TTG | chr17 | 42911515 | 42911536 | 42911532 | 42911537 | + |
| SEQ ID NO 61062 | TGCCGTCGTGGAATTAAATCAC | TTC | chr17 | 42911539 | 42911560 | 42911556 | 42911561 | + |
| SEQ ID NO 61063 | CCGTCGTGGAATTAAATCACGG | CTG | chr17 | 42911541 | 42911562 | 42911558 | 42911563 | + |
| SEQ ID NO 61064 | AATCACGGATGGCAGATTGGAG | TTA | chr17 | 42911555 | 42911576 | 42911572 | 42911577 | + |

Figure 90 (Cont'd)

| | | | | | | | | |
|---|---|---|---|---|---|---|---|---|
| SEQ ID NO 61065 | GAGGGTCGCCTGGCTTATTCCC | TTG | chr17 | 42911574 | 42911595 | 42911591 | 42911596 | + |
| SEQ ID NO 61066 | GCTTATTCCCATGTGTGACTCC | CTG | chr17 | 42911586 | 42911607 | 42911603 | 42911608 | + |
| SEQ ID NO 61067 | ATTCCCATGTGTGACTCCAGCC | CTT | chr17 | 42911590 | 42911611 | 42911607 | 42911612 | + |
| SEQ ID NO 61068 | TTCCCATGTGTGACTCCAGCCT | TTA | chr17 | 42911591 | 42911612 | 42911608 | 42911613 | + |
| SEQ ID NO 61069 | CCATGTGTGACTCCAGCCTGCC | TTC | chr17 | 42911594 | 42911615 | 42911611 | 42911616 | + |
| SEQ ID NO 61070 | CAGCCTGCCCTCAGCACAGACT | CTC | chr17 | 42911607 | 42911628 | 42911624 | 42911629 | + |
| SEQ ID NO 61071 | CCCTCAGCACAGACTCTTTCAG | CTG | chr17 | 42911614 | 42911635 | 42911631 | 42911636 | + |
| SEQ ID NO 61072 | AGCACAGACTCTTTCAGATGGA | CTC | chr17 | 42911619 | 42911640 | 42911636 | 42911641 | + |
| SEQ ID NO 61073 | TTTCAGATGGAGGTGCCATATC | CTC | chr17 | 42911630 | 42911651 | 42911647 | 42911652 | + |
| SEQ ID NO 61074 | TCAGATGGAGGTGCCATATCAC | CTT | chr17 | 42911632 | 42911653 | 42911649 | 42911654 | + |
| SEQ ID NO 61075 | CAGATGGAGGTGCCATATCACG | TTT | chr17 | 42911633 | 42911654 | 42911650 | 42911655 | + |
| SEQ ID NO 61076 | AGATGGAGGTGCCATATCACGT | TTC | chr17 | 42911634 | 42911655 | 42911651 | 42911656 | + |
| SEQ ID NO 61077 | CCCGCCAGGAGGTCCTCCTCTC | TTT | chr17 | 42911673 | 42911694 | 42911690 | 42911695 | + |
| SEQ ID NO 61078 | CCGCCAGGAGGTCCTCCTCTCT | TTC | chr17 | 42911674 | 42911695 | 42911691 | 42911696 | + |
| SEQ ID NO 61079 | CTCTCTCTACTTGAATACTCTC | CTC | chr17 | 42911690 | 42911711 | 42911707 | 42911712 | + |
| SEQ ID NO 61080 | TCTCTACTTGAATACTCTCACA | CTC | chr17 | 42911693 | 42911714 | 42911710 | 42911715 | + |
| SEQ ID NO 61081 | TCTACTTGAATACTCTCACAAG | CTC | chr17 | 42911695 | 42911716 | 42911712 | 42911717 | + |
| SEQ ID NO 61082 | TACTTGAATACTCTCACAAGTA | CTC | chr17 | 42911697 | 42911718 | 42911714 | 42911719 | + |
| SEQ ID NO 61083 | CTTGAATACTCTCACAAGTAGG | CTA | chr17 | 42911699 | 42911720 | 42911716 | 42911721 | + |
| SEQ ID NO 61084 | GAATACTCTCACAAGTAGGGAG | CTT | chr17 | 42911702 | 42911723 | 42911719 | 42911724 | + |
| SEQ ID NO 61085 | AATACTCTCACAAGTAGGGAGC | TTG | chr17 | 42911703 | 42911724 | 42911720 | 42911725 | + |
| SEQ ID NO 61086 | TCACAAGTAGGGAGCTCACTCC | CTC | chr17 | 42911710 | 42911731 | 42911727 | 42911732 | + |
| SEQ ID NO 61087 | ACAAGTAGGGAGCTCACTCCCA | CTC | chr17 | 42911712 | 42911733 | 42911729 | 42911734 | + |
| SEQ ID NO 61088 | ACTCCCACTGGAACAGCCCATT | CTC | chr17 | 42911727 | 42911748 | 42911744 | 42911749 | + |
| SEQ ID NO 61089 | CCACTGGAACAGCCCATTTTAT | CTC | chr17 | 42911731 | 42911752 | 42911748 | 42911753 | + |
| SEQ ID NO 61090 | GAACAGCCCATTTTATCTTTGA | CTG | chr17 | 42911737 | 42911758 | 42911754 | 42911759 | + |
| SEQ ID NO 61091 | TATCTTTGAATGGTCTTCTGCC | TTT | chr17 | 42911750 | 42911771 | 42911767 | 42911772 | + |
| SEQ ID NO 61092 | ATCTTTGAATGGTCTTCTGCCA | TTT | chr17 | 42911751 | 42911772 | 42911768 | 42911773 | + |
| SEQ ID NO 61093 | TCTTTGAATGGTCTTCTGCCAG | TTA | chr17 | 42911752 | 42911773 | 42911769 | 42911774 | + |
| SEQ ID NO 61094 | TGAATGGTCTTCTGCCAGCCCA | CTT | chr17 | 42911756 | 42911777 | 42911773 | 42911778 | + |
| SEQ ID NO 61095 | GAATGGTCTTCTGCCAGCCCAT | TTT | chr17 | 42911757 | 42911778 | 42911774 | 42911779 | + |
| SEQ ID NO 61096 | AATGGTCTTCTGCCAGCCCATT | TTG | chr17 | 42911758 | 42911779 | 42911775 | 42911780 | + |
| SEQ ID NO 61097 | CTGCCAGCCCATTTTGAGGCCA | CTT | chr17 | 42911767 | 42911788 | 42911784 | 42911789 | + |
| SEQ ID NO 61098 | TGCCAGCCCATTTTGAGGCCAG | TTC | chr17 | 42911768 | 42911789 | 42911785 | 42911790 | + |
| SEQ ID NO 61099 | CCAGCCCATTTTGAGGCCAGAG | CTG | chr17 | 42911770 | 42911791 | 42911787 | 42911792 | + |
| SEQ ID NO 61100 | TGAGGCCAGAGGTGCTGTCAGC | TTT | chr17 | 42911781 | 42911802 | 42911798 | 42911803 | + |
| SEQ ID NO 61101 | GAGGCCAGAGGTGCTGTCAGCT | TTT | chr17 | 42911782 | 42911803 | 42911799 | 42911804 | + |
| SEQ ID NO 61102 | AGGCCAGAGGTGCTGTCAGCTC | TTG | chr17 | 42911783 | 42911804 | 42911800 | 42911805 | + |
| SEQ ID NO 61103 | TCAGCTCAGGTGGTCCTCTTTT | CTG | chr17 | 42911798 | 42911819 | 42911815 | 42911820 | + |
| SEQ ID NO 61104 | AGGTGGTCCTCTTTTACAATCC | CTC | chr17 | 42911805 | 42911826 | 42911822 | 42911827 | + |
| SEQ ID NO 61105 | TTTTACAATCCTAATCATATTG | CTC | chr17 | 42911816 | 42911837 | 42911833 | 42911838 | + |
| SEQ ID NO 61106 | TTACAATCCTAATCATATTGGG | CTT | chr17 | 42911818 | 42911839 | 42911835 | 42911840 | + |
| SEQ ID NO 61107 | TACAATCCTAATCATATTGGGT | TTT | chr17 | 42911819 | 42911840 | 42911836 | 42911841 | + |
| SEQ ID NO 61108 | ACAATCCTAATCATATTGGGTA | TTT | chr17 | 42911820 | 42911841 | 42911837 | 42911842 | + |
| SEQ ID NO 61109 | CAATCCTAATCATATTGGGTAA | TTA | chr17 | 42911821 | 42911842 | 42911838 | 42911843 | + |
| SEQ ID NO 61110 | ATCATATTGGGTAATGTTTTTG | CTA | chr17 | 42911829 | 42911850 | 42911846 | 42911851 | + |
| SEQ ID NO 61111 | GGTAATGTTTTTGAAAAGCTAA | TTG | chr17 | 42911838 | 42911859 | 42911855 | 42911860 | + |
| SEQ ID NO 61112 | TTGAAAAGCTAATGAAGCTATT | TTT | chr17 | 42911848 | 42911869 | 42911865 | 42911870 | + |
| SEQ ID NO 61113 | TGAAAAGCTAATGAAGCTATTG | TTT | chr17 | 42911849 | 42911870 | 42911866 | 42911871 | + |
| SEQ ID NO 61114 | GAAAAGCTAATGAAGCTATTGA | TTT | chr17 | 42911850 | 42911871 | 42911867 | 42911872 | + |
| SEQ ID NO 61115 | AAAAGCTAATGAAGCTATTGAG | TTG | chr17 | 42911851 | 42911872 | 42911868 | 42911873 | + |
| SEQ ID NO 61116 | ATGAAGCTATTGAGAAAGACCT | CTA | chr17 | 42911859 | 42911880 | 42911876 | 42911881 | + |
| SEQ ID NO 61117 | TTGAGAAAGACCTGTTGCTAGA | CTA | chr17 | 42911868 | 42911889 | 42911885 | 42911890 | + |
| SEQ ID NO 61118 | AGAAAGACCTGTTGCTAGAAGT | TTG | chr17 | 42911871 | 42911892 | 42911888 | 42911893 | + |
| SEQ ID NO 61119 | TTGCTAGAAGTTGGGTTGTTCT | CTG | chr17 | 42911882 | 42911903 | 42911899 | 42911904 | + |
| SEQ ID NO 61120 | CTAGAAGTTGGGTTGTTCTGGA | TTG | chr17 | 42911885 | 42911906 | 42911902 | 42911907 | + |
| SEQ ID NO 61121 | GAAGTTGGGTTGTTCTGGATTT | CTA | chr17 | 42911888 | 42911909 | 42911905 | 42911910 | + |
| SEQ ID NO 61122 | GGTTGTTCTGGATTTTCCCCTG | TTG | chr17 | 42911895 | 42911916 | 42911912 | 42911917 | + |

Figure 90 (Cont'd)

| | | | | | | | | |
|---|---|---|---|---|---|---|---|---|
| SEQ ID NO 61123 | TTCTGGATTTTCCCCTGAAGAC | TTG | chr17 | 42911900 | 42911921 | 42911917 | 42911922 | + |
| SEQ ID NO 61124 | TGGATTTTCCCCTGAAGACTTA | TTC | chr17 | 42911903 | 42911924 | 42911920 | 42911925 | + |
| SEQ ID NO 61125 | GATTTTCCCCTGAAGACTTACT | CTG | chr17 | 42911905 | 42911926 | 42911922 | 42911927 | + |
| SEQ ID NO 61126 | TCCCCTGAAGACTTACTTATTC | TTT | chr17 | 42911910 | 42911931 | 42911927 | 42911932 | + |
| SEQ ID NO 61127 | CCCCTGAAGACTTACTTATTCT | TTT | chr17 | 42911911 | 42911932 | 42911928 | 42911933 | + |
| SEQ ID NO 61128 | CCCTGAAGACTTACTTATTCTT | TTC | chr17 | 42911912 | 42911933 | 42911929 | 42911934 | + |
| SEQ ID NO 61129 | AAGACTTACTTATTCTTCCGTC | CTG | chr17 | 42911917 | 42911938 | 42911934 | 42911939 | + |
| SEQ ID NO 61130 | ACTTATTCTTCCGTCACATATA | CTT | chr17 | 42911924 | 42911945 | 42911941 | 42911946 | + |
| SEQ ID NO 61131 | CTTATTCTTCCGTCACATATAC | TTA | chr17 | 42911925 | 42911946 | 42911942 | 42911947 | + |
| SEQ ID NO 61132 | ATTCTTCCGTCACATATACAAA | CTT | chr17 | 42911928 | 42911949 | 42911945 | 42911950 | + |
| SEQ ID NO 61133 | TTCTTCCGTCACATATACAAAA | TTA | chr17 | 42911929 | 42911950 | 42911946 | 42911951 | + |
| SEQ ID NO 61134 | TTCCGTCACATATACAAAAGCA | TTC | chr17 | 42911932 | 42911953 | 42911949 | 42911954 | + |
| SEQ ID NO 61135 | CCGTCACATATACAAAAGCAAG | CTT | chr17 | 42911934 | 42911955 | 42911951 | 42911956 | + |
| SEQ ID NO 61136 | CGTCACATATACAAAAGCAAGA | TTC | chr17 | 42911935 | 42911956 | 42911952 | 42911957 | + |
| SEQ ID NO 61137 | CCAGGTAGGGCCAGCTCACAAG | CTT | chr17 | 42911960 | 42911981 | 42911977 | 42911982 | + |
| SEQ ID NO 61138 | CAGGTAGGGCCAGCTCACAAGC | TTC | chr17 | 42911961 | 42911982 | 42911978 | 42911983 | + |
| SEQ ID NO 61139 | ACAAGCCCAGGCTGGAGATCCT | CTC | chr17 | 42911977 | 42911998 | 42911994 | 42911999 | + |
| SEQ ID NO 61140 | GAGATCCTAACTGAGAATTTTC | CTG | chr17 | 42911991 | 42912012 | 42912008 | 42912013 | + |
| SEQ ID NO 61141 | ACTGAGAATTTTCTACCTGTGT | CTA | chr17 | 42912000 | 42912021 | 42912017 | 42912022 | + |
| SEQ ID NO 61142 | AGAATTTTCTACCTGTGTTCAT | CTG | chr17 | 42912004 | 42912025 | 42912021 | 42912026 | + |
| SEQ ID NO 61143 | TCTACCTGTGTTCATTCTTACC | TTT | chr17 | 42912011 | 42912032 | 42912028 | 42912033 | + |
| SEQ ID NO 61144 | CTACCTGTGTTCATTCTTACCG | TTT | chr17 | 42912012 | 42912033 | 42912029 | 42912034 | + |
| SEQ ID NO 61145 | TACCTGTGTTCATTCTTACCGA | TTC | chr17 | 42912013 | 42912034 | 42912030 | 42912035 | + |
| SEQ ID NO 61146 | CCTGTGTTCATTCTTACCGAGA | CTA | chr17 | 42912015 | 42912036 | 42912032 | 42912037 | + |
| SEQ ID NO 61147 | TGTTCATTCTTACCGAGAAAAG | CTG | chr17 | 42912019 | 42912040 | 42912036 | 42912041 | + |
| SEQ ID NO 61148 | ATTCTTACCGAGAAAAGGAGAA | TTC | chr17 | 42912024 | 42912045 | 42912041 | 42912046 | + |
| SEQ ID NO 61149 | TTACCGAGAAAAGGAGAAAGGA | TTC | chr17 | 42912028 | 42912049 | 42912045 | 42912050 | + |
| SEQ ID NO 61150 | ACCGAGAAAAGGAGAAAGGAGC | CTT | chr17 | 42912030 | 42912051 | 42912047 | 42912052 | + |
| SEQ ID NO 61151 | CCGAGAAAAGGAGAAAGGAGCT | TTA | chr17 | 42912031 | 42912052 | 42912048 | 42912053 | + |
| SEQ ID NO 61152 | TGAATCTGATAGGAAAAGAAGG | CTC | chr17 | 42912054 | 42912075 | 42912071 | 42912076 | + |
| SEQ ID NO 61153 | AATCTGATAGGAAAAGAAGGCT | CTG | chr17 | 42912056 | 42912077 | 42912073 | 42912078 | + |
| SEQ ID NO 61154 | ATAGGAAAGAAGGCTGCCTAA | CTG | chr17 | 42912062 | 42912083 | 42912079 | 42912084 | + |
| SEQ ID NO 61155 | CCTAAGGAGGAGTTTTTAGTAT | CTG | chr17 | 42912079 | 42912100 | 42912096 | 42912101 | + |
| SEQ ID NO 61156 | AGGAGGAGTTTTTAGTATGTGG | CTA | chr17 | 42912083 | 42912104 | 42912100 | 42912105 | + |
| SEQ ID NO 61157 | TTAGTATGTGGCGTATCATGCA | TTT | chr17 | 42912094 | 42912115 | 42912111 | 42912116 | + |
| SEQ ID NO 61158 | TAGTATGTGGCGTATCATGCAA | TTT | chr17 | 42912095 | 42912116 | 42912112 | 42912117 | + |
| SEQ ID NO 61159 | AGTATGTGGCGTATCATGCAAG | TTT | chr17 | 42912096 | 42912117 | 42912113 | 42912118 | + |
| SEQ ID NO 61160 | GTATGTGGCGTATCATGCAAGT | TTA | chr17 | 42912097 | 42912118 | 42912114 | 42912119 | + |
| SEQ ID NO 61161 | TGCCAAGCCATGTCTAAATGGC | CTA | chr17 | 42912123 | 42912144 | 42912140 | 42912145 | + |
| SEQ ID NO 61162 | AATGGCTTTAATTATATAGTAA | CTA | chr17 | 42912139 | 42912160 | 42912156 | 42912161 | + |
| SEQ ID NO 61163 | TAATTATATAGTAATGCACTCT | CTT | chr17 | 42912147 | 42912168 | 42912164 | 42912169 | + |
| SEQ ID NO 61164 | AATTATATAGTAATGCACTCTC | TTT | chr17 | 42912148 | 42912169 | 42912165 | 42912170 | + |
| SEQ ID NO 61165 | ATTATATAGTAATGCACTCTCA | TTA | chr17 | 42912149 | 42912170 | 42912166 | 42912171 | + |
| SEQ ID NO 61166 | TATAGTAATGCACTCTCAGTAA | TTA | chr17 | 42912153 | 42912174 | 42912170 | 42912175 | + |
| SEQ ID NO 61167 | TCAGTAATGGGGACCAGCTTA | CTC | chr17 | 42912168 | 42912189 | 42912185 | 42912190 | + |
| SEQ ID NO 61168 | AGTAATGGGGACCAGCTTAAG | CTC | chr17 | 42912170 | 42912191 | 42912187 | 42912192 | + |
| SEQ ID NO 61169 | AAGTATAATTAATAGATGGTTA | CTT | chr17 | 42912189 | 42912210 | 42912206 | 42912211 | + |
| SEQ ID NO 61170 | AGTATAATTAATAGATGGTTAG | TTA | chr17 | 42912190 | 42912211 | 42912207 | 42912212 | + |
| SEQ ID NO 61171 | ATAGATGGTTAGTGGGGTAATT | TTA | chr17 | 42912200 | 42912221 | 42912217 | 42912222 | + |
| SEQ ID NO 61172 | GTGGGGTAATTCTGCTTCTAGT | TTA | chr17 | 42912211 | 42912232 | 42912228 | 42912233 | + |
| SEQ ID NO 61173 | TGCTTCTAGTATTTTTTTTACT | TTC | chr17 | 42912223 | 42912244 | 42912240 | 42912245 | + |
| SEQ ID NO 61174 | CTTCTAGTATTTTTTTACTGT | CTG | chr17 | 42912225 | 42912246 | 42912242 | 42912247 | + |
| SEQ ID NO 61175 | CTAGTATTTTTTTACTGTGCA | CTT | chr17 | 42912228 | 42912249 | 42912245 | 42912250 | + |
| SEQ ID NO 61176 | TAGTATTTTTTTACTGTGCAT | TTC | chr17 | 42912229 | 42912250 | 42912246 | 42912251 | + |
| SEQ ID NO 61177 | GTATTTTTTTACTGTGCATAC | CTA | chr17 | 42912231 | 42912252 | 42912248 | 42912253 | + |
| SEQ ID NO 61178 | TTTTTACTGTGCATACATGTTC | TTT | chr17 | 42912237 | 42912258 | 42912254 | 42912259 | + |
| SEQ ID NO 61179 | TTTTACTGTGCATACATGTTCA | TTT | chr17 | 42912238 | 42912259 | 42912255 | 42912260 | + |
| SEQ ID NO 61180 | TTTACTGTGCATACATGTTCAT | TTT | chr17 | 42912239 | 42912260 | 42912256 | 42912261 | + |

Figure 90 (Cont'd)

| SEQ ID | Sequence | | Chr | | | | | |
|---|---|---|---|---|---|---|---|---|
| SEQ ID NO 61181 | TTACTGTGCATACATGTTCATC | TTT | chr17 | 42912240 | 42912261 | 42912257 | 42912262 | + |
| SEQ ID NO 61182 | TACTGTGCATACATGTTCATCG | TTT | chr17 | 42912241 | 42912262 | 42912258 | 42912263 | + |
| SEQ ID NO 61183 | ACTGTGCATACATGTTCATCGT | TTT | chr17 | 42912242 | 42912263 | 42912259 | 42912264 | + |
| SEQ ID NO 61184 | CTGTGCATACATGTTCATCGTA | TTA | chr17 | 42912243 | 42912264 | 42912260 | 42912265 | + |
| SEQ ID NO 61185 | TGCATACATGTTCATCGTATTT | CTG | chr17 | 42912246 | 42912267 | 42912263 | 42912268 | + |
| SEQ ID NO 61186 | ATCGTATTTCCTTGGATTTCTG | TTC | chr17 | 42912259 | 42912280 | 42912276 | 42912281 | + |
| SEQ ID NO 61187 | CCTTGGATTTCTGAATGGCTGC | TTT | chr17 | 42912268 | 42912289 | 42912285 | 42912290 | + |
| SEQ ID NO 61188 | CTTGGATTTCTGAATGGCTGCA | TTC | chr17 | 42912269 | 42912290 | 42912286 | 42912291 | + |
| SEQ ID NO 61189 | GGATTTCTGAATGGCTGCAGTG | CTT | chr17 | 42912272 | 42912293 | 42912289 | 42912294 | + |
| SEQ ID NO 61190 | GATTTCTGAATGGCTGCAGTGA | TTG | chr17 | 42912273 | 42912294 | 42912290 | 42912295 | + |
| SEQ ID NO 61191 | CTGAATGGCTGCAGTGACCCAG | TTT | chr17 | 42912278 | 42912299 | 42912295 | 42912300 | + |
| SEQ ID NO 61192 | TGAATGGCTGCAGTGACCCAGA | TTC | chr17 | 42912279 | 42912300 | 42912296 | 42912301 | + |
| SEQ ID NO 61193 | AATGGCTGCAGTGACCCAGATA | CTG | chr17 | 42912281 | 42912302 | 42912298 | 42912303 | + |
| SEQ ID NO 61194 | CAGTGACCCAGATATTGCACTA | CTG | chr17 | 42912289 | 42912310 | 42912306 | 42912311 | + |
| SEQ ID NO 61195 | CACTAGGTCAAAACATTCAGGT | TTG | chr17 | 42912306 | 42912327 | 42912323 | 42912328 | + |
| SEQ ID NO 61196 | GGTCAAAACATTCAGGTATAGC | CTA | chr17 | 42912311 | 42912332 | 42912328 | 42912333 | + |
| SEQ ID NO 61197 | AGGTATAGCTGACATCTCCTCT | TTC | chr17 | 42912324 | 42912345 | 42912341 | 42912346 | + |
| SEQ ID NO 61198 | ACATCTCCTCTATCACATTACA | CTG | chr17 | 42912335 | 42912356 | 42912352 | 42912357 | + |
| SEQ ID NO 61199 | CTCTATCACATTACATCATCCT | CTC | chr17 | 42912342 | 42912363 | 42912359 | 42912364 | + |
| SEQ ID NO 61200 | TATCACATTACATCATCCTCCT | CTC | chr17 | 42912345 | 42912366 | 42912362 | 42912367 | + |
| SEQ ID NO 61201 | TCACATTACATCATCCTCCTTA | CTA | chr17 | 42912347 | 42912368 | 42912364 | 42912369 | + |
| SEQ ID NO 61202 | CATCATCCTCCTTATAAGCCCA | TTA | chr17 | 42912355 | 42912376 | 42912372 | 42912377 | + |
| SEQ ID NO 61203 | CTTATAAGCCCAGCTCTGCTTT | CTC | chr17 | 42912365 | 42912386 | 42912382 | 42912387 | + |
| SEQ ID NO 61204 | ATAAGCCCAGCTCTGCTTTTTC | CTT | chr17 | 42912368 | 42912389 | 42912385 | 42912390 | + |
| SEQ ID NO 61205 | TAAGCCCAGCTCTGCTTTTTCC | TTA | chr17 | 42912369 | 42912390 | 42912386 | 42912391 | + |
| SEQ ID NO 61206 | TGCTTTTTCCAGATTCTTCCAC | CTC | chr17 | 42912381 | 42912402 | 42912398 | 42912403 | + |
| SEQ ID NO 61207 | CTTTTTCCAGATTCTTCCACTG | CTG | chr17 | 42912383 | 42912404 | 42912400 | 42912405 | + |
| SEQ ID NO 61208 | TTTCCAGATTCTTCCACTGGCT | CTT | chr17 | 42912386 | 42912407 | 42912403 | 42912408 | + |
| SEQ ID NO 61209 | TTCCAGATTCTTCCACTGGCTC | TTT | chr17 | 42912387 | 42912408 | 42912404 | 42912409 | + |
| SEQ ID NO 61210 | TCCAGATTCTTCCACTGGCTCC | TTT | chr17 | 42912388 | 42912409 | 42912405 | 42912410 | + |
| SEQ ID NO 61211 | CCAGATTCTTCCACTGGCTCCA | TTT | chr17 | 42912389 | 42912410 | 42912406 | 42912411 | + |
| SEQ ID NO 61212 | CAGATTCTTCCACTGGCTCCAC | TTC | chr17 | 42912390 | 42912411 | 42912407 | 42912412 | + |
| SEQ ID NO 61213 | TTCCACTGGCTCCACATCCACC | TTC | chr17 | 42912397 | 42912418 | 42912414 | 42912419 | + |
| SEQ ID NO 61214 | CCACTGGCTCCACATCCACCCC | CTT | chr17 | 42912399 | 42912420 | 42912416 | 42912421 | + |
| SEQ ID NO 61215 | CACTGGCTCCACATCCACCCCA | TTC | chr17 | 42912400 | 42912421 | 42912417 | 42912422 | + |
| SEQ ID NO 61216 | GCTCCACATCCACCCCACTGGA | CTG | chr17 | 42912405 | 42912426 | 42912422 | 42912427 | + |
| SEQ ID NO 61217 | CACATCCACCCCACTGGATCTT | CTC | chr17 | 42912409 | 42912430 | 42912426 | 42912431 | + |
| SEQ ID NO 61218 | GATCTTCAGAAGGCTAGAGGGC | CTG | chr17 | 42912425 | 42912446 | 42912442 | 42912447 | + |
| SEQ ID NO 61219 | CAGAAGGCTAGAGGGCGACTCT | CTT | chr17 | 42912431 | 42912452 | 42912448 | 42912453 | + |
| SEQ ID NO 61220 | AGAAGGCTAGAGGGCGACTCTG | TTC | chr17 | 42912432 | 42912453 | 42912449 | 42912454 | + |
| SEQ ID NO 61221 | GAGGGCGACTCTGGTGGTGCTT | CTA | chr17 | 42912441 | 42912462 | 42912458 | 42912463 | + |
| SEQ ID NO 61222 | TGGTGGTGCTTTTGTATGTTTC | CTC | chr17 | 42912452 | 42912473 | 42912469 | 42912474 | + |
| SEQ ID NO 61223 | GTGGTGCTTTTGTATGTTTCAA | CTG | chr17 | 42912454 | 42912475 | 42912471 | 42912476 | + |
| SEQ ID NO 61224 | TTGTATGTTTCAATTAGGCTCT | CTT | chr17 | 42912463 | 42912484 | 42912480 | 42912485 | + |
| SEQ ID NO 61225 | TGTATGTTTCAATTAGGCTCTG | TTT | chr17 | 42912464 | 42912485 | 42912481 | 42912486 | + |
| SEQ ID NO 61226 | GTATGTTTCAATTAGGCTCTGA | TTT | chr17 | 42912465 | 42912486 | 42912482 | 42912487 | + |
| SEQ ID NO 61227 | TATGTTTCAATTAGGCTCTGAA | TTG | chr17 | 42912466 | 42912487 | 42912483 | 42912488 | + |
| SEQ ID NO 61228 | CAATTAGGCTCTGAAATCTTGG | TTT | chr17 | 42912473 | 42912494 | 42912490 | 42912495 | + |
| SEQ ID NO 61229 | AATTAGGCTCTGAAATCTTGGG | TTC | chr17 | 42912474 | 42912495 | 42912491 | 42912496 | + |
| SEQ ID NO 61230 | GGCTCTGAAATCTTGGGCAAAA | TTA | chr17 | 42912479 | 42912500 | 42912496 | 42912501 | + |
| SEQ ID NO 61231 | TGAAATCTTGGGCAAAATGACA | CTC | chr17 | 42912484 | 42912505 | 42912501 | 42912506 | + |
| SEQ ID NO 61232 | AAATCTTGGGCAAAATGACAAG | CTG | chr17 | 42912486 | 42912507 | 42912503 | 42912508 | + |
| SEQ ID NO 61233 | GGGCAAAATGACAAGGGGAGGG | CTT | chr17 | 42912493 | 42912514 | 42912510 | 42912515 | + |
| SEQ ID NO 61234 | GGCAAAATGACAAGGGGAGGGC | TTG | chr17 | 42912494 | 42912515 | 42912511 | 42912516 | + |
| SEQ ID NO 61235 | CTCTCTCAGGTCACTCCAGTGT | TTC | chr17 | 42912524 | 42912545 | 42912541 | 42912546 | + |
| SEQ ID NO 61236 | TCTCAGGTCACTCCAGTGTTAC | CTC | chr17 | 42912527 | 42912548 | 42912544 | 42912549 | + |
| SEQ ID NO 61237 | TCAGGTCACTCCAGTGTTACTT | CTC | chr17 | 42912529 | 42912550 | 42912546 | 42912551 | + |
| SEQ ID NO 61238 | AGGTCACTCCAGTGTTACTTTT | CTC | chr17 | 42912531 | 42912552 | 42912548 | 42912553 | + |

Figure 90 (Cont'd)

| | | | | | | | | |
|---|---|---|---|---|---|---|---|---|
| SEQ ID NO 61239 | CAGTGTTACTTTTAATTCCTAG | CTC | chr17 | 42912540 | 42912561 | 42912557 | 42912562 | + |
| SEQ ID NO 61240 | CTTTTAATTCCTAGAGGGTAAA | TTA | chr17 | 42912548 | 42912569 | 42912565 | 42912570 | + |
| SEQ ID NO 61241 | TTAATTCCTAGAGGGTAAATAT | CTT | chr17 | 42912551 | 42912572 | 42912568 | 42912573 | + |
| SEQ ID NO 61242 | TAATTCCTAGAGGGTAAATATG | TTT | chr17 | 42912552 | 42912573 | 42912569 | 42912574 | + |
| SEQ ID NO 61243 | AATTCCTAGAGGGTAAATATGA | TTT | chr17 | 42912553 | 42912574 | 42912570 | 42912575 | + |
| SEQ ID NO 61244 | ATTCCTAGAGGGTAAATATGAC | TTA | chr17 | 42912554 | 42912575 | 42912571 | 42912576 | + |
| SEQ ID NO 61245 | CTAGAGGGTAAATATGACTCCT | TTC | chr17 | 42912558 | 42912579 | 42912575 | 42912580 | + |
| SEQ ID NO 61246 | GAGGGTAAATATGACTCCTTTC | CTA | chr17 | 42912561 | 42912582 | 42912578 | 42912583 | + |
| SEQ ID NO 61247 | CTTTCTCTATCCCAAGCCAACC | CTC | chr17 | 42912578 | 42912599 | 42912595 | 42912600 | + |
| SEQ ID NO 61248 | TCTCTATCCCAAGCCAACCAAG | CTT | chr17 | 42912581 | 42912602 | 42912598 | 42912603 | + |
| SEQ ID NO 61249 | CTCTATCCCAAGCCAACCAAGA | TTT | chr17 | 42912582 | 42912603 | 42912599 | 42912604 | + |
| SEQ ID NO 61250 | TCTATCCCAAGCCAACCAAGAG | TTC | chr17 | 42912583 | 42912604 | 42912600 | 42912605 | + |
| SEQ ID NO 61251 | TATCCCAAGCCAACCAAGAGCA | CTC | chr17 | 42912585 | 42912606 | 42912602 | 42912607 | + |
| SEQ ID NO 61252 | TCCCAAGCCAACCAAGAGCACA | CTA | chr17 | 42912587 | 42912608 | 42912604 | 42912609 | + |
| SEQ ID NO 61253 | TTAAAGGAAAAGTCAACATCTT | TTC | chr17 | 42912612 | 42912633 | 42912629 | 42912634 | + |
| SEQ ID NO 61254 | AAAGGAAAAGTCAACATCTTCT | CTT | chr17 | 42912614 | 42912635 | 42912631 | 42912636 | + |
| SEQ ID NO 61255 | AAGGAAAAGTCAACATCTTCTC | TTA | chr17 | 42912615 | 42912636 | 42912632 | 42912637 | + |
| SEQ ID NO 61256 | CTCTCTTTTTTTTTTTTTTTGA | CTT | chr17 | 42912634 | 42912655 | 42912651 | 42912656 | + |
| SEQ ID NO 61257 | TCTCTTTTTTTTTTTTTTGAG | TTC | chr17 | 42912635 | 42912656 | 42912652 | 42912657 | + |
| SEQ ID NO 61258 | TCTTTTTTTTTTTTTTGAGAC | CTC | chr17 | 42912637 | 42912658 | 42912654 | 42912659 | + |
| SEQ ID NO 61259 | TTTTTTTTTTTTTTGAGACAG | CTC | chr17 | 42912639 | 42912660 | 42912656 | 42912661 | + |
| SEQ ID NO 61260 | TTTTTTTTTTTTGAGACAGGG | CTT | chr17 | 42912641 | 42912662 | 42912658 | 42912663 | + |
| SEQ ID NO 61261 | TTTTTTTTTTTGAGACAGGGT | TTT | chr17 | 42912642 | 42912663 | 42912659 | 42912664 | + |
| SEQ ID NO 61262 | TTTTTTTTTTGAGACAGGGTC | TTT | chr17 | 42912643 | 42912664 | 42912660 | 42912665 | + |
| SEQ ID NO 61263 | TTTTTTTTTGAGACAGGGTCT | TTT | chr17 | 42912644 | 42912665 | 42912661 | 42912666 | + |
| SEQ ID NO 61264 | TTTTTTTTGAGACAGGGTCTC | TTT | chr17 | 42912645 | 42912666 | 42912662 | 42912667 | + |
| SEQ ID NO 61265 | TTTTTTTGAGACAGGGTCTCA | TTT | chr17 | 42912646 | 42912667 | 42912663 | 42912668 | + |
| SEQ ID NO 61266 | TTTTTTGAGACAGGGTCTCAC | TTT | chr17 | 42912647 | 42912668 | 42912664 | 42912669 | + |
| SEQ ID NO 61267 | TTTTTGAGACAGGGTCTCACT | TTT | chr17 | 42912648 | 42912669 | 42912665 | 42912670 | + |
| SEQ ID NO 61268 | TTTTGAGACAGGGTCTCACTA | TTT | chr17 | 42912649 | 42912670 | 42912666 | 42912671 | + |
| SEQ ID NO 61269 | TTTGAGACAGGGTCTCACTAT | TTT | chr17 | 42912650 | 42912671 | 42912667 | 42912672 | + |
| SEQ ID NO 61270 | TTGAGACAGGGTCTCACTATG | TTT | chr17 | 42912651 | 42912672 | 42912668 | 42912673 | + |
| SEQ ID NO 61271 | TGAGACAGGGTCTCACTATGT | TTT | chr17 | 42912652 | 42912673 | 42912669 | 42912674 | + |
| SEQ ID NO 61272 | GAGACAGGGTCTCACTATGTT | TTT | chr17 | 42912653 | 42912674 | 42912670 | 42912675 | + |
| SEQ ID NO 61273 | AGACAGGGTCTCACTATGTTG | TTT | chr17 | 42912654 | 42912675 | 42912671 | 42912676 | + |
| SEQ ID NO 61274 | GACAGGGTCTCACTATGTTGC | TTG | chr17 | 42912655 | 42912676 | 42912672 | 42912677 | + |
| SEQ ID NO 61275 | ACTATGTTGCCCAGGCTGCTCT | CTC | chr17 | 42912667 | 42912688 | 42912684 | 42912689 | + |
| SEQ ID NO 61276 | TGTTGCCCAGGCTGCTCTTGAA | CTA | chr17 | 42912671 | 42912692 | 42912688 | 42912693 | + |
| SEQ ID NO 61277 | CCCAGGCTGCTCTTGAATTCCT | TTG | chr17 | 42912676 | 42912697 | 42912693 | 42912698 | + |
| SEQ ID NO 61278 | CTCTTGAATTCCTGGGCTCAAG | CTG | chr17 | 42912685 | 42912706 | 42912702 | 42912707 | + |
| SEQ ID NO 61279 | TTGAATTCCTGGGCTCAAGCAG | CTC | chr17 | 42912688 | 42912709 | 42912705 | 42912710 | + |
| SEQ ID NO 61280 | GAATTCCTGGGCTCAAGCAGTC | CTT | chr17 | 42912690 | 42912711 | 42912707 | 42912712 | + |
| SEQ ID NO 61281 | AATTCCTGGGCTCAAGCAGTCC | TTG | chr17 | 42912691 | 42912712 | 42912708 | 42912713 | + |
| SEQ ID NO 61282 | CTGGGCTCAAGCAGTCCTCCCA | TTC | chr17 | 42912696 | 42912717 | 42912713 | 42912718 | + |
| SEQ ID NO 61283 | GGCTCAAGCAGTCCTCCCACCC | CTG | chr17 | 42912699 | 42912720 | 42912716 | 42912721 | + |
| SEQ ID NO 61284 | AAGCAGTCCTCCCACCCTACCA | CTC | chr17 | 42912704 | 42912725 | 42912721 | 42912726 | + |
| SEQ ID NO 61285 | CCACCCTACCACAGCGTCCCGC | CTC | chr17 | 42912715 | 42912736 | 42912732 | 42912737 | + |
| SEQ ID NO 61286 | CCACAGCGTCCCGCGTAGCTGG | CTA | chr17 | 42912723 | 42912744 | 42912740 | 42912745 | + |
| SEQ ID NO 61287 | GGACTACAGGTGCAAGCCACTA | CTG | chr17 | 42912744 | 42912765 | 42912761 | 42912766 | + |
| SEQ ID NO 61288 | CAGGTGCAAGCCACTATGTCCA | CTA | chr17 | 42912750 | 42912771 | 42912767 | 42912772 | + |
| SEQ ID NO 61289 | TGTCCAGCTAGCCAACTCCTCC | CTA | chr17 | 42912766 | 42912787 | 42912783 | 42912788 | + |
| SEQ ID NO 61290 | GCCAACTCCTCCTTGCCTGCTT | CTA | chr17 | 42912776 | 42912797 | 42912793 | 42912798 | + |
| SEQ ID NO 61291 | CTCCTTGCCTGCTTTTCTTTTT | CTC | chr17 | 42912784 | 42912805 | 42912801 | 42912806 | + |
| SEQ ID NO 61292 | CTTGCCTGCTTTTCTTTTTTT | CTC | chr17 | 42912787 | 42912808 | 42912804 | 42912809 | + |
| SEQ ID NO 61293 | GCCTGCTTTTCTTTTTTTTCT | CTT | chr17 | 42912790 | 42912811 | 42912807 | 42912812 | + |
| SEQ ID NO 61294 | CCTGCTTTTCTTTTTTTTCTT | TTG | chr17 | 42912791 | 42912812 | 42912808 | 42912813 | + |
| SEQ ID NO 61295 | CTTTTCTTTTTTTTCTTTTTT | CTG | chr17 | 42912795 | 42912816 | 42912812 | 42912817 | + |
| SEQ ID NO 61296 | TTCTTTTTTTTCTTTTTTTGA | CTT | chr17 | 42912798 | 42912819 | 42912815 | 42912820 | + |

Figure 90 (Cont'd)

| | | | | | | | | |
|---|---|---|---|---|---|---|---|---|
| SEQ ID NO 61297 | TCTTTTTTTTTCTTTTTTTGAG | TTT | chr17 | 42912799 | 42912820 | 42912816 | 42912821 | + |
| SEQ ID NO 61298 | CTTTTTTTTTCTTTTTTTGAGA | TTT | chr17 | 42912800 | 42912821 | 42912817 | 42912822 | + |
| SEQ ID NO 61299 | TTTTTTTTTCTTTTTTTGAGAC | TTC | chr17 | 42912801 | 42912822 | 42912818 | 42912823 | + |
| SEQ ID NO 61300 | TTTTTTTCTTTTTTTGAGACGG | CTT | chr17 | 42912803 | 42912824 | 42912820 | 42912825 | + |
| SEQ ID NO 61301 | TTTTTTCTTTTTTTGAGACGGC | TTT | chr17 | 42912804 | 42912825 | 42912821 | 42912826 | + |
| SEQ ID NO 61302 | TTTTTCTTTTTTTGAGACGGCG | TTT | chr17 | 42912805 | 42912826 | 42912822 | 42912827 | + |
| SEQ ID NO 61303 | TTTTCTTTTTTTGAGACGGCGC | TTT | chr17 | 42912806 | 42912827 | 42912823 | 42912828 | + |
| SEQ ID NO 61304 | TTTCTTTTTTTGAGACGGCGCA | TTT | chr17 | 42912807 | 42912828 | 42912824 | 42912829 | + |
| SEQ ID NO 61305 | TTCTTTTTTTGAGACGGCGCAC | TTT | chr17 | 42912808 | 42912829 | 42912825 | 42912830 | + |
| SEQ ID NO 61306 | TCTTTTTTTGAGACGGCGCACC | TTT | chr17 | 42912809 | 42912830 | 42912826 | 42912831 | + |
| SEQ ID NO 61307 | CTTTTTTTGAGACGGCGCACCT | TTT | chr17 | 42912810 | 42912831 | 42912827 | 42912832 | + |
| SEQ ID NO 61308 | TTTTTTTGAGACGGCGCACCTA | TTC | chr17 | 42912811 | 42912832 | 42912828 | 42912833 | + |
| SEQ ID NO 61309 | TTTTTGAGACGGCGCACCTATC | CTT | chr17 | 42912813 | 42912834 | 42912830 | 42912835 | + |
| SEQ ID NO 61310 | TTTTGAGACGGCGCACCTATCA | TTT | chr17 | 42912814 | 42912835 | 42912831 | 42912836 | + |
| SEQ ID NO 61311 | TTTGAGACGGCGCACCTATCAC | TTT | chr17 | 42912815 | 42912836 | 42912832 | 42912837 | + |
| SEQ ID NO 61312 | TTGAGACGGCGCACCTATCACC | TTT | chr17 | 42912816 | 42912837 | 42912833 | 42912838 | + |
| SEQ ID NO 61313 | TGAGACGGCGCACCTATCACCC | TTT | chr17 | 42912817 | 42912838 | 42912834 | 42912839 | + |
| SEQ ID NO 61314 | GAGACGGCGCACCTATCACCCA | TTT | chr17 | 42912818 | 42912839 | 42912835 | 42912840 | + |
| SEQ ID NO 61315 | AGACGGCGCACCTATCACCCAG | TTG | chr17 | 42912819 | 42912840 | 42912836 | 42912841 | + |
| SEQ ID NO 61316 | TCACCCAGGCTGGAGTGGAGTG | CTA | chr17 | 42912833 | 42912854 | 42912850 | 42912855 | + |
| SEQ ID NO 61317 | GAGTGGAGTGGCACGATCTTGG | CTG | chr17 | 42912845 | 42912866 | 42912862 | 42912867 | + |
| SEQ ID NO 61318 | GGCTCACTGCAACCTCTTCCTC | CTT | chr17 | 42912865 | 42912886 | 42912882 | 42912887 | + |
| SEQ ID NO 61319 | GCTCACTGCAACCTCTTCCTCC | TTG | chr17 | 42912866 | 42912887 | 42912883 | 42912888 | + |
| SEQ ID NO 61320 | ACTGCAACCTCTTCCTCCTGGT | CTC | chr17 | 42912870 | 42912891 | 42912887 | 42912892 | + |
| SEQ ID NO 61321 | CAACCTCTTCCTCCTGGTTCAA | CTG | chr17 | 42912874 | 42912895 | 42912891 | 42912896 | + |
| SEQ ID NO 61322 | TTCCTCCTGGTTCAAGCGATTC | CTC | chr17 | 42912881 | 42912902 | 42912898 | 42912903 | + |
| SEQ ID NO 61323 | CCTCCTGGTTCAAGCGATTCTC | CTT | chr17 | 42912883 | 42912904 | 42912900 | 42912905 | + |
| SEQ ID NO 61324 | CTCCTGGTTCAAGCGATTCTCA | TTC | chr17 | 42912884 | 42912905 | 42912901 | 42912906 | + |
| SEQ ID NO 61325 | CTGGTTCAAGCGATTCTCATGT | CTC | chr17 | 42912887 | 42912908 | 42912904 | 42912909 | + |
| SEQ ID NO 61326 | GTTCAAGCGATTCTCATGTCTC | CTG | chr17 | 42912890 | 42912911 | 42912907 | 42912912 | + |
| SEQ ID NO 61327 | AAGCGATTCTCATGTCTCAGCC | TTC | chr17 | 42912894 | 42912915 | 42912911 | 42912916 | + |
| SEQ ID NO 61328 | TCATGTCTCAGCCTCCTCAGTA | TTC | chr17 | 42912903 | 42912924 | 42912920 | 42912925 | + |
| SEQ ID NO 61329 | ATGTCTCAGCCTCCTCAGTAGC | CTC | chr17 | 42912905 | 42912926 | 42912922 | 42912927 | + |
| SEQ ID NO 61330 | AGCCTCCTCAGTAGCTAGGACT | CTC | chr17 | 42912912 | 42912933 | 42912929 | 42912934 | + |
| SEQ ID NO 61331 | CTCAGTAGCTAGGACTACCGGC | CTC | chr17 | 42912918 | 42912939 | 42912935 | 42912940 | + |
| SEQ ID NO 61332 | AGTAGCTAGGACTACCGGCGTG | CTC | chr17 | 42912921 | 42912942 | 42912938 | 42912943 | + |
| SEQ ID NO 61333 | GGACTACCGGCGTGCACCACCA | CTA | chr17 | 42912929 | 42912950 | 42912946 | 42912951 | + |
| SEQ ID NO 61334 | CCGGCGTGCACCACCATGCCAG | CTA | chr17 | 42912935 | 42912956 | 42912952 | 42912957 | + |
| SEQ ID NO 61335 | ATTTTTATATTTTTAGAATTTT | CTA | chr17 | 42912961 | 42912982 | 42912978 | 42912983 | + |
| SEQ ID NO 61336 | TTATATTTTTAGAATTTTAGAA | TTT | chr17 | 42912965 | 42912986 | 42912982 | 42912987 | + |
| SEQ ID NO 61337 | TATATTTTTAGAATTTTAGAAG | TTT | chr17 | 42912966 | 42912987 | 42912983 | 42912988 | + |
| SEQ ID NO 61338 | ATATTTTTAGAATTTTAGAAGA | TTT | chr17 | 42912967 | 42912988 | 42912984 | 42912989 | + |
| SEQ ID NO 61339 | TATTTTTAGAATTTTAGAAGAG | TTA | chr17 | 42912968 | 42912989 | 42912985 | 42912990 | + |
| SEQ ID NO 61340 | TTAGAATTTTAGAAGAGATGGG | TTT | chr17 | 42912973 | 42912994 | 42912990 | 42912995 | + |
| SEQ ID NO 61341 | TAGAATTTTAGAAGAGATGGGA | TTT | chr17 | 42912974 | 42912995 | 42912991 | 42912996 | + |
| SEQ ID NO 61342 | AGAATTTTAGAAGAGATGGGAT | TTT | chr17 | 42912975 | 42912996 | 42912992 | 42912997 | + |
| SEQ ID NO 61343 | GAATTTTAGAAGAGATGGGATT | TTA | chr17 | 42912976 | 42912997 | 42912993 | 42912998 | + |
| SEQ ID NO 61344 | TAGAAGAGATGGGATTTCATCA | TTT | chr17 | 42912982 | 42913003 | 42912999 | 42913004 | + |
| SEQ ID NO 61345 | AGAAGAGATGGGATTTCATCAT | TTT | chr17 | 42912983 | 42913004 | 42913000 | 42913005 | + |
| SEQ ID NO 61346 | GAAGAGATGGGATTTCATCATG | TTA | chr17 | 42912984 | 42913005 | 42913001 | 42913006 | + |
| SEQ ID NO 61347 | CATCATGTTGGCCAGGCTGGTC | TTT | chr17 | 42912999 | 42913020 | 42913016 | 42913021 | + |
| SEQ ID NO 61348 | ATCATGTTGGCCAGGCTGGTCT | TTC | chr17 | 42913000 | 42913021 | 42913017 | 42913022 | + |
| SEQ ID NO 61349 | GCCAGGCTGGTCTCGAACTCCT | TTG | chr17 | 42913009 | 42913030 | 42913026 | 42913031 | + |
| SEQ ID NO 61350 | GTCTCGAACTCCTGACCTCAAG | CTG | chr17 | 42913018 | 42913039 | 42913035 | 42913040 | + |
| SEQ ID NO 61351 | GAACTCCTGACCTCAAGTGATC | CTC | chr17 | 42913023 | 42913044 | 42913040 | 42913045 | + |
| SEQ ID NO 61352 | CTGACCTCAAGTGATCCACCTG | CTC | chr17 | 42913029 | 42913050 | 42913046 | 42913051 | + |
| SEQ ID NO 61353 | ACCTCAAGTGATCCACCTGCCT | CTG | chr17 | 42913032 | 42913053 | 42913049 | 42913054 | + |
| SEQ ID NO 61354 | AAGTGATCCACCTGCCTTGGCC | CTC | chr17 | 42913037 | 42913058 | 42913054 | 42913059 | + |

Figure 90 (Cont'd)

| | | | | | | | | |
|---|---|---|---|---|---|---|---|---|
| SEQ ID NO 61355 | CCTTGGCCTCCCAAGGTGCTAG | CTG | chr17 | 42913051 | 42913072 | 42913068 | 42913073 | + |
| SEQ ID NO 61356 | GGCCTCCCAAGGTGCTAGGATT | CTT | chr17 | 42913055 | 42913076 | 42913072 | 42913077 | + |
| SEQ ID NO 61357 | GCCTCCCAAGGTGCTAGGATTA | TTG | chr17 | 42913056 | 42913077 | 42913073 | 42913078 | + |
| SEQ ID NO 61358 | CCAAGGTGCTAGGATTACAGGC | CTC | chr17 | 42913061 | 42913082 | 42913078 | 42913083 | + |
| SEQ ID NO 61359 | GGATTACAGGCATGAGCCACCG | CTA | chr17 | 42913072 | 42913093 | 42913089 | 42913094 | + |
| SEQ ID NO 61360 | CAGGCATGAGCCACCGCACCGG | TTA | chr17 | 42913078 | 42913099 | 42913095 | 42913100 | + |
| SEQ ID NO 61361 | CTTGCCTGTTTTTCAATCTCAT | CTC | chr17 | 42913106 | 42913127 | 42913123 | 42913128 | + |
| SEQ ID NO 61362 | GCCTGTTTTTCAATCTCATCTG | CTT | chr17 | 42913109 | 42913130 | 42913126 | 42913131 | + |
| SEQ ID NO 61363 | CCTGTTTTTCAATCTCATCTGA | TTG | chr17 | 42913110 | 42913131 | 42913127 | 42913132 | + |
| SEQ ID NO 61364 | TTTTTCAATCTCATCTGATATG | CTG | chr17 | 42913114 | 42913135 | 42913131 | 42913136 | + |
| SEQ ID NO 61365 | TTCAATCTCATCTGATATGCAG | TTT | chr17 | 42913117 | 42913138 | 42913134 | 42913139 | + |
| SEQ ID NO 61366 | TCAATCTCATCTGATATGCAGA | TTT | chr17 | 42913118 | 42913139 | 42913135 | 42913140 | + |
| SEQ ID NO 61367 | CAATCTCATCTGATATGCAGAG | TTT | chr17 | 42913119 | 42913140 | 42913136 | 42913141 | + |
| SEQ ID NO 61368 | AATCTCATCTGATATGCAGAGT | TTC | chr17 | 42913120 | 42913141 | 42913137 | 42913142 | + |
| SEQ ID NO 61369 | ATCTGATATGCAGAGTATTTCT | CTC | chr17 | 42913126 | 42913147 | 42913143 | 42913148 | + |
| SEQ ID NO 61370 | ATATGCAGAGTATTTCTGCCCC | CTG | chr17 | 42913131 | 42913152 | 42913148 | 42913153 | + |
| SEQ ID NO 61371 | CTGCCCCACCCACCTACCCCCC | TTT | chr17 | 42913146 | 42913167 | 42913163 | 42913168 | + |
| SEQ ID NO 61372 | TGCCCCACCCACCTACCCCCCA | TTC | chr17 | 42913147 | 42913168 | 42913164 | 42913169 | + |
| SEQ ID NO 61373 | CCCCACCCACCTACCCCCCAAA | CTG | chr17 | 42913149 | 42913170 | 42913166 | 42913171 | + |
| SEQ ID NO 61374 | CCCCCCAAAAAAAGCTGAAGCC | CTA | chr17 | 42913162 | 42913183 | 42913179 | 42913184 | + |
| SEQ ID NO 61375 | AAGCCTATTTATTTGAAAGTCC | CTG | chr17 | 42913179 | 42913200 | 42913196 | 42913201 | + |
| SEQ ID NO 61376 | TTTATTTGAAAGTCCTTGTTTT | CTA | chr17 | 42913186 | 42913207 | 42913203 | 42913208 | + |
| SEQ ID NO 61377 | ATTTGAAAGTCCTTGTTTTTGC | TTT | chr17 | 42913189 | 42913210 | 42913206 | 42913211 | + |
| SEQ ID NO 61378 | TTTGAAAGTCCTTGTTTTTGCT | TTA | chr17 | 42913190 | 42913211 | 42913207 | 42913212 | + |
| SEQ ID NO 61379 | GAAAGTCCTTGTTTTTGCTACT | TTT | chr17 | 42913193 | 42913214 | 42913210 | 42913215 | + |
| SEQ ID NO 61380 | AAAGTCCTTGTTTTTGCTACTA | TTG | chr17 | 42913194 | 42913215 | 42913211 | 42913216 | + |
| SEQ ID NO 61381 | GTTTTTGCTACTAATTATATAG | CTT | chr17 | 42913203 | 42913224 | 42913220 | 42913225 | + |
| SEQ ID NO 61382 | TTTTTGCTACTAATTATATAGT | TTG | chr17 | 42913204 | 42913225 | 42913221 | 42913226 | + |
| SEQ ID NO 61383 | TTGCTACTAATTATATAGTATA | TTT | chr17 | 42913207 | 42913228 | 42913224 | 42913229 | + |
| SEQ ID NO 61384 | TGCTACTAATTATATAGTATAC | TTT | chr17 | 42913208 | 42913229 | 42913225 | 42913230 | + |
| SEQ ID NO 61385 | GCTACTAATTATATAGTATACC | TTT | chr17 | 42913209 | 42913230 | 42913226 | 42913231 | + |
| SEQ ID NO 61386 | CTACTAATTATATAGTATACCA | TTG | chr17 | 42913210 | 42913231 | 42913227 | 42913232 | + |
| SEQ ID NO 61387 | CTAATTATATAGTATACCATAC | CTA | chr17 | 42913213 | 42913234 | 42913230 | 42913235 | + |
| SEQ ID NO 61388 | ATTATATAGTATACCATACATT | CTA | chr17 | 42913216 | 42913237 | 42913233 | 42913238 | + |
| SEQ ID NO 61389 | TATAGTATACCATACATTATCA | TTA | chr17 | 42913220 | 42913241 | 42913237 | 42913242 | + |
| SEQ ID NO 61390 | TCATTCAAAACAACCATCCTGC | TTA | chr17 | 42913239 | 42913260 | 42913256 | 42913261 | + |
| SEQ ID NO 61391 | AAAACAACCATCCTGCTCATAA | TTC | chr17 | 42913245 | 42913266 | 42913262 | 42913267 | + |
| SEQ ID NO 61392 | CTCATAACATCTTTGAAAAGAA | CTG | chr17 | 42913260 | 42913281 | 42913277 | 42913282 | + |
| SEQ ID NO 61393 | ATAACATCTTTGAAAAGAAAAA | CTC | chr17 | 42913263 | 42913284 | 42913280 | 42913285 | + |
| SEQ ID NO 61394 | TGAAAAGAAAAATATATATGTG | CTT | chr17 | 42913273 | 42913294 | 42913290 | 42913295 | + |
| SEQ ID NO 61395 | GAAAAGAAAAATATATATGTGC | TTT | chr17 | 42913274 | 42913295 | 42913291 | 42913296 | + |
| SEQ ID NO 61396 | AAAAGAAAAATATATATGTGCA | TTG | chr17 | 42913275 | 42913296 | 42913292 | 42913297 | + |
| SEQ ID NO 61397 | TATTAAAGCAACATTTTATTTA | TTT | chr17 | 42913303 | 42913324 | 42913320 | 42913325 | + |
| SEQ ID NO 61398 | ATTAAAGCAACATTTTATTTAA | TTT | chr17 | 42913304 | 42913325 | 42913321 | 42913326 | + |
| SEQ ID NO 61399 | TTAAAGCAACATTTTATTTAAG | TTA | chr17 | 42913305 | 42913326 | 42913322 | 42913327 | + |
| SEQ ID NO 61400 | AAGCAACATTTTATTTAAGAAT | TTA | chr17 | 42913308 | 42913329 | 42913325 | 42913330 | + |
| SEQ ID NO 61401 | TATTTAAGAATAAAGTCTTGTT | TTT | chr17 | 42913319 | 42913340 | 42913336 | 42913341 | + |
| SEQ ID NO 61402 | ATTTAAGAATAAAGTCTTGTTA | TTT | chr17 | 42913320 | 42913341 | 42913337 | 42913342 | + |
| SEQ ID NO 61403 | TTTAAGAATAAAGTCTTGTTAA | TTA | chr17 | 42913321 | 42913342 | 42913338 | 42913343 | + |
| SEQ ID NO 61404 | AAGAATAAAGTCTTGTTAATTA | TTT | chr17 | 42913324 | 42913345 | 42913341 | 42913346 | + |
| SEQ ID NO 61405 | AGAATAAAGTCTTGTTAATTAC | TTA | chr17 | 42913325 | 42913346 | 42913342 | 42913347 | + |
| SEQ ID NO 61406 | GTTAATTACTATATTTTAGATG | CTT | chr17 | 42913338 | 42913359 | 42913355 | 42913360 | + |
| SEQ ID NO 61407 | TTAATTACTATATTTTAGATGC | TTG | chr17 | 42913339 | 42913360 | 42913356 | 42913361 | + |
| SEQ ID NO 61408 | ATTACTATATTTTAGATGCAAT | TTA | chr17 | 42913342 | 42913363 | 42913359 | 42913364 | + |
| SEQ ID NO 61409 | CTATATTTTAGATGCAATGTGA | TTA | chr17 | 42913346 | 42913367 | 42913363 | 42913368 | + |
| SEQ ID NO 61410 | TATTTTAGATGCAATGTGATCT | CTA | chr17 | 42913349 | 42913370 | 42913366 | 42913371 | + |
| SEQ ID NO 61411 | TAGATGCAATGTGATCTGAAGT | TTT | chr17 | 42913354 | 42913375 | 42913371 | 42913376 | + |
| SEQ ID NO 61412 | AGATGCAATGTGATCTGAAGTT | TTT | chr17 | 42913355 | 42913376 | 42913372 | 42913377 | + |

Figure 90 (Cont'd)

| | | | | | | | | |
|---|---|---|---|---|---|---|---|---|
| SEQ ID NO 61413 | GATGCAATGTGATCTGAAGTTT | TTA | chr17 | 42913356 | 42913377 | 42913373 | 42913378 | + |
| SEQ ID NO 61414 | AAGTTTCTAATTCTGGCCCAAC | CTG | chr17 | 42913372 | 42913393 | 42913389 | 42913394 | + |
| SEQ ID NO 61415 | CTAATTCTGGCCCAACTAAATT | TTT | chr17 | 42913378 | 42913399 | 42913395 | 42913400 | + |
| SEQ ID NO 61416 | TAATTCTGGCCCAACTAAATTT | TTC | chr17 | 42913379 | 42913400 | 42913396 | 42913401 | + |
| SEQ ID NO 61417 | ATTCTGGCCCAACTAAATTTCT | CTA | chr17 | 42913381 | 42913402 | 42913398 | 42913403 | + |
| SEQ ID NO 61418 | TGGCCCAACTAAATTTCTAGCT | TTC | chr17 | 42913385 | 42913406 | 42913402 | 42913407 | + |
| SEQ ID NO 61419 | GCCCAACTAAATTTCTAGCTCT | CTG | chr17 | 42913387 | 42913408 | 42913404 | 42913409 | + |
| SEQ ID NO 61420 | AATTTCTAGCTCTGTTTCCCTA | CTA | chr17 | 42913396 | 42913417 | 42913413 | 42913418 | + |
| SEQ ID NO 61421 | CTAGCTCTGTTTCCCTAAACAA | TTT | chr17 | 42913401 | 42913422 | 42913418 | 42913423 | + |
| SEQ ID NO 61422 | TAGCTCTGTTTCCCTAAACAAA | TTC | chr17 | 42913402 | 42913423 | 42913419 | 42913424 | + |
| SEQ ID NO 61423 | GCTCTGTTTCCCTAAACAAATA | CTA | chr17 | 42913404 | 42913425 | 42913421 | 42913426 | + |
| SEQ ID NO 61424 | TGTTTCCCTAAACAAATAATTT | CTC | chr17 | 42913408 | 42913429 | 42913425 | 42913430 | + |
| SEQ ID NO 61425 | TTTCCCTAAACAAATAATTTGG | CTG | chr17 | 42913410 | 42913431 | 42913427 | 42913432 | + |
| SEQ ID NO 61426 | CCCTAAACAAATAATTTGGTTT | TTT | chr17 | 42913413 | 42913434 | 42913430 | 42913435 | + |
| SEQ ID NO 61427 | CCTAAACAAATAATTTGGTTTC | TTC | chr17 | 42913414 | 42913435 | 42913431 | 42913436 | + |
| SEQ ID NO 61428 | AACAAATAATTTGGTTTCTCTG | CTA | chr17 | 42913418 | 42913439 | 42913435 | 42913440 | + |
| SEQ ID NO 61429 | GGTTTCTCTGTGCCTGCATTTT | TTT | chr17 | 42913430 | 42913451 | 42913447 | 42913452 | + |
| SEQ ID NO 61430 | GTTTCTCTGTGCCTGCATTTTC | TTG | chr17 | 42913431 | 42913452 | 42913448 | 42913453 | + |
| SEQ ID NO 61431 | CTCTGTGCCTGCATTTTCCCTT | TTT | chr17 | 42913435 | 42913456 | 42913452 | 42913457 | + |
| SEQ ID NO 61432 | TCTGTGCCTGCATTTTCCCTTT | TTC | chr17 | 42913436 | 42913457 | 42913453 | 42913458 | + |
| SEQ ID NO 61433 | TGTGCCTGCATTTTCCCTTTGG | CTC | chr17 | 42913438 | 42913459 | 42913455 | 42913460 | + |
| SEQ ID NO 61434 | TGCCTGCATTTTCCCTTTGGAG | CTG | chr17 | 42913440 | 42913461 | 42913457 | 42913462 | + |
| SEQ ID NO 61435 | CATTTTCCCTTTGGAGAAGAAA | CTG | chr17 | 42913446 | 42913467 | 42913463 | 42913468 | + |
| SEQ ID NO 61436 | TCCCTTTGGAGAAGAAAAGTGC | TTT | chr17 | 42913451 | 42913472 | 42913468 | 42913473 | + |
| SEQ ID NO 61437 | CCCTTTGGAGAAGAAAAGTGCT | TTT | chr17 | 42913452 | 42913473 | 42913469 | 42913474 | + |
| SEQ ID NO 61438 | CCTTTGGAGAAGAAAAGTGCTC | TTC | chr17 | 42913453 | 42913474 | 42913470 | 42913475 | + |
| SEQ ID NO 61439 | TGGAGAAGAAAAGTGCTCTCTC | CTT | chr17 | 42913457 | 42913478 | 42913474 | 42913479 | + |
| SEQ ID NO 61440 | GGAGAAGAAAAGTGCTCTCTCT | TTT | chr17 | 42913458 | 42913479 | 42913475 | 42913480 | + |
| SEQ ID NO 61441 | GAGAAGAAAGTGCTCTCTCTT | TTG | chr17 | 42913459 | 42913480 | 42913476 | 42913481 | + |
| SEQ ID NO 61442 | TCTCTTGAGTTGACCGAGAGTC | CTC | chr17 | 42913475 | 42913496 | 42913492 | 42913497 | + |
| SEQ ID NO 61443 | TCTTGAGTTGACCGAGAGTCCC | CTC | chr17 | 42913477 | 42913498 | 42913494 | 42913499 | + |
| SEQ ID NO 61444 | TTGAGTTGACCGAGAGTCCCAT | CTC | chr17 | 42913479 | 42913500 | 42913496 | 42913501 | + |
| SEQ ID NO 61445 | GAGTTGACCGAGAGTCCCATTA | CTT | chr17 | 42913481 | 42913502 | 42913498 | 42913503 | + |
| SEQ ID NO 61446 | AGTTGACCGAGAGTCCCATTAG | TTG | chr17 | 42913482 | 42913503 | 42913499 | 42913504 | + |
| SEQ ID NO 61447 | ACCGAGAGTCCCATTAGGGATA | TTG | chr17 | 42913487 | 42913508 | 42913504 | 42913509 | + |
| SEQ ID NO 61448 | GGGATAGGGAGACTTAAATGCA | TTA | chr17 | 42913503 | 42913524 | 42913520 | 42913525 | + |
| SEQ ID NO 61449 | AAATGCATCCACAGGGGCACAG | CTT | chr17 | 42913518 | 42913539 | 42913535 | 42913540 | + |
| SEQ ID NO 61450 | AATGCATCCACAGGGGCACAGG | TTA | chr17 | 42913519 | 42913540 | 42913536 | 42913541 | + |
| SEQ ID NO 61451 | AGCACATAAACGGAGGCCCAAA | TTG | chr17 | 42913549 | 42913570 | 42913566 | 42913571 | + |
| SEQ ID NO 61452 | AGAGTTGGCCAAGAATGAACAT | TTC | chr17 | 42913595 | 42913616 | 42913612 | 42913617 | + |
| SEQ ID NO 61453 | GCCAAGAATGAACATTGGCTAC | TTG | chr17 | 42913602 | 42913623 | 42913619 | 42913624 | + |
| SEQ ID NO 61454 | GCTACCAGACCACAAGTCAGCA | TTG | chr17 | 42913619 | 42913640 | 42913636 | 42913641 | + |
| SEQ ID NO 61455 | CCAGACCACAAGTCAGCATGAG | CTA | chr17 | 42913623 | 42913644 | 42913640 | 42913645 | + |
| SEQ ID NO 61456 | CTCTATGGCATCAAATTGCAAC | TTG | chr17 | 42913648 | 42913669 | 42913665 | 42913670 | + |
| SEQ ID NO 61457 | TATGGCATCAAATTGCAACTTG | CTC | chr17 | 42913651 | 42913672 | 42913668 | 42913673 | + |
| SEQ ID NO 61458 | TGGCATCAAATTGCAACTTGAG | CTA | chr17 | 42913653 | 42913674 | 42913670 | 42913675 | + |
| SEQ ID NO 61459 | CAACTTGAGAGTAGATGGGCAG | TTG | chr17 | 42913666 | 42913687 | 42913683 | 42913688 | + |
| SEQ ID NO 61460 | GAGAGTAGATGGGCAGGGTCAC | CTT | chr17 | 42913672 | 42913693 | 42913689 | 42913694 | + |
| SEQ ID NO 61461 | AGAGTAGATGGGCAGGGTCACT | TTG | chr17 | 42913673 | 42913694 | 42913690 | 42913695 | + |
| SEQ ID NO 61462 | TCAAATTAAGCAATCAGGGCAC | CTA | chr17 | 42913696 | 42913717 | 42913713 | 42913718 | + |
| SEQ ID NO 61463 | AGCAATCAGGGCACACAAGTTG | TTA | chr17 | 42913704 | 42913725 | 42913721 | 42913726 | + |
| SEQ ID NO 61464 | CAGTAACACAACAAGACTAGGC | TTG | chr17 | 42913726 | 42913747 | 42913743 | 42913748 | + |
| SEQ ID NO 61465 | GGCCAGCTCTGGAATCCAGTAA | CTA | chr17 | 42913745 | 42913766 | 42913762 | 42913767 | + |
| SEQ ID NO 61466 | TGGAATCCAGTAACTCAGTGTC | CTC | chr17 | 42913754 | 42913775 | 42913771 | 42913776 | + |
| SEQ ID NO 61467 | GAATCCAGTAACTCAGTGTCAG | CTG | chr17 | 42913756 | 42913777 | 42913773 | 42913778 | + |
| SEQ ID NO 61468 | AGTGTCAGCAAGGTTTTGGGTT | CTC | chr17 | 42913770 | 42913791 | 42913787 | 42913792 | + |
| SEQ ID NO 61469 | TGGGTTATAGTTCAAGAAAGTC | TTT | chr17 | 42913786 | 42913807 | 42913803 | 42913808 | + |
| SEQ ID NO 61470 | GGGTTATAGTTCAAGAAAGTCT | TTT | chr17 | 42913787 | 42913808 | 42913804 | 42913809 | + |

Figure 90 (Cont'd)

| | | | | | | | | |
|---|---|---|---|---|---|---|---|---|
| SEQ ID NO 61471 | GGTTATAGTTCAAGAAAGTCTA | TTG | chr17 | 42913788 | 42913809 | 42913805 | 42913810 | + |
| SEQ ID NO 61472 | TAGTTCAAGAAAGTCTAAACAG | TTA | chr17 | 42913793 | 42913814 | 42913810 | 42913815 | + |
| SEQ ID NO 61473 | AAGAAAGTCTAAACAGAGCCAG | TTC | chr17 | 42913799 | 42913820 | 42913816 | 42913821 | + |
| SEQ ID NO 61474 | AACAGAGCCAGTCACAGCACCA | CTA | chr17 | 42913810 | 42913831 | 42913827 | 42913832 | + |
| SEQ ID NO 61475 | AAGGGAGCTATTGCAGGTTTCT | CTC | chr17 | 42913842 | 42913863 | 42913859 | 42913864 | + |
| SEQ ID NO 61476 | TTGCAGGTTTCTCTGCTAAGAG | CTA | chr17 | 42913852 | 42913873 | 42913869 | 42913874 | + |
| SEQ ID NO 61477 | CAGGTTTCTCTGCTAAGAGATT | TTG | chr17 | 42913855 | 42913876 | 42913872 | 42913877 | + |
| SEQ ID NO 61478 | CTCTGCTAAGAGATTTATTTCA | TTT | chr17 | 42913862 | 42913883 | 42913879 | 42913884 | + |
| SEQ ID NO 61479 | TCTGCTAAGAGATTTATTTCAT | TTC | chr17 | 42913863 | 42913884 | 42913880 | 42913885 | + |
| SEQ ID NO 61480 | TGCTAAGAGATTTATTTCATCC | CTC | chr17 | 42913865 | 42913886 | 42913882 | 42913887 | + |
| SEQ ID NO 61481 | CTAAGAGATTTATTTCATCCTG | CTG | chr17 | 42913867 | 42913888 | 42913884 | 42913889 | + |
| SEQ ID NO 61482 | AGAGATTTATTTCATCCTGGGT | CTA | chr17 | 42913870 | 42913891 | 42913887 | 42913892 | + |
| SEQ ID NO 61483 | ATTTCATCCTGGGTGCAGGGTT | TTT | chr17 | 42913878 | 42913899 | 42913895 | 42913900 | + |
| SEQ ID NO 61484 | TTTCATCCTGGGTGCAGGGTTC | TTA | chr17 | 42913879 | 42913900 | 42913896 | 42913901 | + |
| SEQ ID NO 61485 | CATCCTGGGTGCAGGGTTCGAC | TTT | chr17 | 42913882 | 42913903 | 42913899 | 42913904 | + |
| SEQ ID NO 61486 | ATCCTGGGTGCAGGGTTCGACC | TTC | chr17 | 42913883 | 42913904 | 42913900 | 42913905 | + |
| SEQ ID NO 61487 | GGTGCAGGGTTCGACCTCCAAA | CTG | chr17 | 42913889 | 42913910 | 42913906 | 42913911 | + |
| SEQ ID NO 61488 | GACCTCCAAAGGCCTCAAATCA | TTC | chr17 | 42913901 | 42913922 | 42913918 | 42913923 | + |
| SEQ ID NO 61489 | CAAAGGCCTCAAATCATCACCG | CTC | chr17 | 42913907 | 42913928 | 42913924 | 42913929 | + |
| SEQ ID NO 61490 | AAATCATCACCGTATCAATGGA | CTC | chr17 | 42913917 | 42913938 | 42913934 | 42913939 | + |
| SEQ ID NO 61491 | CCTGAGGGTAAGCTCCGCTATT | TTT | chr17 | 42913942 | 42913963 | 42913959 | 42913964 | + |
| SEQ ID NO 61492 | CTGAGGGTAAGCTCCGCTATTT | TTC | chr17 | 42913943 | 42913964 | 42913960 | 42913965 | + |
| SEQ ID NO 61493 | AGGGTAAGCTCCGCTATTTCAC | CTG | chr17 | 42913946 | 42913967 | 42913963 | 42913968 | + |
| SEQ ID NO 61494 | CGCTATTTCACACCTGAACTCC | CTC | chr17 | 42913957 | 42913978 | 42913974 | 42913979 | + |
| SEQ ID NO 61495 | TTTCACACCTGAACTCCGGAGT | CTA | chr17 | 42913962 | 42913983 | 42913979 | 42913984 | + |
| SEQ ID NO 61496 | CACACCTGAACTCCGGAGTCTG | TTT | chr17 | 42913965 | 42913986 | 42913982 | 42913987 | + |
| SEQ ID NO 61497 | ACACCTGAACTCCGGAGTCTGT | TTC | chr17 | 42913966 | 42913987 | 42913983 | 42913988 | + |
| SEQ ID NO 61498 | AACTCCGGAGTCTGTATATTCA | CTG | chr17 | 42913973 | 42913994 | 42913990 | 42913995 | + |
| SEQ ID NO 61499 | CGGAGTCTGTATATTCAGGGAA | CTC | chr17 | 42913978 | 42913999 | 42913995 | 42914000 | + |
| SEQ ID NO 61500 | TATATTCAGGGAAGATTGCATT | CTG | chr17 | 42913987 | 42914008 | 42914004 | 42914009 | + |
| SEQ ID NO 61501 | AGGGAAGATTGCATTCTCCTAC | TTC | chr17 | 42913994 | 42914015 | 42914011 | 42914016 | + |
| SEQ ID NO 61502 | CATTCTCCTACTGGATTTGGGC | TTG | chr17 | 42914005 | 42914026 | 42914022 | 42914027 | + |
| SEQ ID NO 61503 | TCCTACTGGATTTGGGCTCTCA | TTC | chr17 | 42914010 | 42914031 | 42914027 | 42914032 | + |
| SEQ ID NO 61504 | CTACTGGATTTGGGCTCTCAGA | CTC | chr17 | 42914012 | 42914033 | 42914029 | 42914034 | + |
| SEQ ID NO 61505 | CTGGATTTGGGCTCTCAGAGGG | CTA | chr17 | 42914015 | 42914036 | 42914032 | 42914037 | + |
| SEQ ID NO 61506 | GATTTGGGCTCTCAGAGGGCGT | CTG | chr17 | 42914018 | 42914039 | 42914035 | 42914040 | + |
| SEQ ID NO 61507 | GGGCTCTCAGAGGGCGTTGTGG | TTT | chr17 | 42914023 | 42914044 | 42914040 | 42914045 | + |
| SEQ ID NO 61508 | GGCTCTCAGAGGGCGTTGTGGG | TTG | chr17 | 42914024 | 42914045 | 42914041 | 42914046 | + |
| SEQ ID NO 61509 | TCAGAGGGCGTTGTGGGAACCA | CTC | chr17 | 42914029 | 42914050 | 42914046 | 42914051 | + |
| SEQ ID NO 61510 | AGAGGGCGTTGTGGGAACCAGG | CTC | chr17 | 42914031 | 42914052 | 42914048 | 42914053 | + |
| SEQ ID NO 61511 | TGGGAACCAGGCCCCTCACAGA | TTG | chr17 | 42914042 | 42914063 | 42914059 | 42914064 | + |
| SEQ ID NO 61512 | ACAGAATCAAATGGTCCCAACC | CTC | chr17 | 42914059 | 42914080 | 42914076 | 42914081 | + |
| SEQ ID NO 61513 | TTTTTTTTTTTAATAGAGATG | CTT | chr17 | 42914102 | 42914123 | 42914119 | 42914124 | + |
| SEQ ID NO 61514 | TTTTTTTTTTAATAGAGATGG | TTT | chr17 | 42914103 | 42914124 | 42914120 | 42914125 | + |
| SEQ ID NO 61515 | TTTTTTTTTAATAGAGATGGG | TTT | chr17 | 42914104 | 42914125 | 42914121 | 42914126 | + |
| SEQ ID NO 61516 | TTTTTTTTAATAGAGATGGGG | TTT | chr17 | 42914105 | 42914126 | 42914122 | 42914127 | + |
| SEQ ID NO 61517 | TTTTTTTAATAGAGATGGGGG | TTT | chr17 | 42914106 | 42914127 | 42914123 | 42914128 | + |
| SEQ ID NO 61518 | TTTTTTAATAGAGATGGGGGT | TTT | chr17 | 42914107 | 42914128 | 42914124 | 42914129 | + |
| SEQ ID NO 61519 | TTTTTAATAGAGATGGGGGTC | TTT | chr17 | 42914108 | 42914129 | 42914125 | 42914130 | + |
| SEQ ID NO 61520 | TTTTAATAGAGATGGGGGTCT | TTT | chr17 | 42914109 | 42914130 | 42914126 | 42914131 | + |
| SEQ ID NO 61521 | TTTAATAGAGATGGGGGTCTC | TTT | chr17 | 42914110 | 42914131 | 42914127 | 42914132 | + |
| SEQ ID NO 61522 | TTAATAGAGATGGGGGTCTCA | TTT | chr17 | 42914111 | 42914132 | 42914128 | 42914133 | + |
| SEQ ID NO 61523 | TAATAGAGATGGGGGTCTCAC | TTT | chr17 | 42914112 | 42914133 | 42914129 | 42914134 | + |
| SEQ ID NO 61524 | AATAGAGATGGGGGTCTCACT | TTT | chr17 | 42914113 | 42914134 | 42914130 | 42914135 | + |
| SEQ ID NO 61525 | ATAGAGATGGGGGTCTCACTA | TTT | chr17 | 42914114 | 42914135 | 42914131 | 42914136 | + |
| SEQ ID NO 61526 | TAGAGATGGGGGTCTCACTAT | TTA | chr17 | 42914115 | 42914136 | 42914132 | 42914137 | + |
| SEQ ID NO 61527 | ACTATGCTGCCCAGGCTGGTCT | CTC | chr17 | 42914132 | 42914153 | 42914149 | 42914154 | + |
| SEQ ID NO 61528 | TGCTGCCCAGGCTGGTCTTGAA | CTA | chr17 | 42914136 | 42914157 | 42914153 | 42914158 | + |

Figure 90 (Cont'd)

| | | | | | | | | |
|---|---|---|---|---|---|---|---|---|
| SEQ ID NO 61529 | CCCAGGCTGGTCTTGAACTCCT | CTG | chr17 | 42914141 | 42914162 | 42914158 | 42914163 | + |
| SEQ ID NO 61530 | GTCTTGAACTCCTGGGTTCAAG | CTG | chr17 | 42914150 | 42914171 | 42914167 | 42914172 | + |
| SEQ ID NO 61531 | GAACTCCTGGGTTCAAGTGATC | CTT | chr17 | 42914155 | 42914176 | 42914172 | 42914177 | + |
| SEQ ID NO 61532 | AACTCCTGGGTTCAAGTGATCC | TTG | chr17 | 42914156 | 42914177 | 42914173 | 42914178 | + |
| SEQ ID NO 61533 | CTGGGTTCAAGTGATCCTCCTG | CTC | chr17 | 42914161 | 42914182 | 42914178 | 42914183 | + |
| SEQ ID NO 61534 | GGTTCAAGTGATCCTCCTGCCT | CTG | chr17 | 42914164 | 42914185 | 42914181 | 42914186 | + |
| SEQ ID NO 61535 | AAGTGATCCTCCTGCCTCAGCC | TTC | chr17 | 42914169 | 42914190 | 42914186 | 42914191 | + |
| SEQ ID NO 61536 | CTGCCTCAGCCTCCCAAAGTGC | CTC | chr17 | 42914180 | 42914201 | 42914197 | 42914202 | + |
| SEQ ID NO 61537 | CCTCAGCCTCCCAAAGTGCTGG | CTG | chr17 | 42914183 | 42914204 | 42914200 | 42914205 | + |
| SEQ ID NO 61538 | AGCCTCCCAAAGTGCTGGGATT | CTC | chr17 | 42914187 | 42914208 | 42914204 | 42914209 | + |
| SEQ ID NO 61539 | CCAAAGTGCTGGGATTACAGTG | CTC | chr17 | 42914193 | 42914214 | 42914210 | 42914215 | + |
| SEQ ID NO 61540 | GGATTACAGTGTGAGCCACTGC | CTG | chr17 | 42914204 | 42914225 | 42914221 | 42914226 | + |
| SEQ ID NO 61541 | CAGTGTGAGCCACTGCGCTTGG | TTA | chr17 | 42914210 | 42914231 | 42914227 | 42914232 | + |
| SEQ ID NO 61542 | CGCTTGGCCAGAAATGGTTTTG | CTG | chr17 | 42914225 | 42914246 | 42914242 | 42914247 | + |
| SEQ ID NO 61543 | GGCCAGAAATGGTTTTGATCTG | CTT | chr17 | 42914230 | 42914251 | 42914247 | 42914252 | + |
| SEQ ID NO 61544 | GCCAGAAATGGTTTTGATCTGT | TTG | chr17 | 42914231 | 42914252 | 42914248 | 42914253 | + |
| SEQ ID NO 61545 | TGATCTGTCTGAACTGAACCCT | TTT | chr17 | 42914245 | 42914266 | 42914262 | 42914267 | + |
| SEQ ID NO 61546 | GATCTGTCTGAACTGAACCCTA | TTT | chr17 | 42914246 | 42914267 | 42914263 | 42914268 | + |
| SEQ ID NO 61547 | ATCTGTCTGAACTGAACCCTAC | TTG | chr17 | 42914247 | 42914268 | 42914264 | 42914269 | + |
| SEQ ID NO 61548 | TCTGAACTGAACCCTACTGCTT | CTG | chr17 | 42914252 | 42914273 | 42914269 | 42914274 | + |
| SEQ ID NO 61549 | AACTGAACCCTACTGCTTAGGC | CTG | chr17 | 42914256 | 42914277 | 42914273 | 42914278 | + |
| SEQ ID NO 61550 | AACCCTACTGCTTAGGCATAGC | CTG | chr17 | 42914261 | 42914282 | 42914278 | 42914283 | + |
| SEQ ID NO 61551 | CTGCTTAGGCATAGCCCCATCC | CTA | chr17 | 42914268 | 42914289 | 42914285 | 42914290 | + |
| SEQ ID NO 61552 | CTTAGGCATAGCCCCATCCTTG | CTG | chr17 | 42914271 | 42914292 | 42914288 | 42914293 | + |
| SEQ ID NO 61553 | AGGCATAGCCCCATCCTTGATA | CTT | chr17 | 42914274 | 42914295 | 42914291 | 42914296 | + |
| SEQ ID NO 61554 | GGCATAGCCCCATCCTTGATAA | TTA | chr17 | 42914275 | 42914296 | 42914292 | 42914297 | + |
| SEQ ID NO 61555 | GATAATCTATTTGCTCCCAAGG | CTT | chr17 | 42914292 | 42914313 | 42914309 | 42914314 | + |
| SEQ ID NO 61556 | ATAATCTATTTGCTCCCAAGGA | TTG | chr17 | 42914293 | 42914314 | 42914310 | 42914315 | + |
| SEQ ID NO 61557 | TTTGCTCCCAAGGACCAAGTCC | CTA | chr17 | 42914301 | 42914322 | 42914318 | 42914323 | + |
| SEQ ID NO 61558 | GCTCCCAAGGACCAAGTCCAAG | TTT | chr17 | 42914304 | 42914325 | 42914321 | 42914326 | + |
| SEQ ID NO 61559 | CTCCCAAGGACCAAGTCCAAGA | TTG | chr17 | 42914305 | 42914326 | 42914322 | 42914327 | + |
| SEQ ID NO 61560 | CCAAGGACCAAGTCCAAGATCC | CTC | chr17 | 42914308 | 42914329 | 42914325 | 42914330 | + |
| SEQ ID NO 61561 | ACAAGAAAGGTCTGCCAGAAAG | CTT | chr17 | 42914332 | 42914353 | 42914349 | 42914354 | + |
| SEQ ID NO 61562 | CAAGAAAGGTCTGCCAGAAAGT | TTA | chr17 | 42914333 | 42914354 | 42914350 | 42914355 | + |
| SEQ ID NO 61563 | CCAGAAAGTAAATACTGCCCCC | CTG | chr17 | 42914346 | 42914367 | 42914363 | 42914368 | + |
| SEQ ID NO 61564 | CCCCCACTCCCTGAAGTTTATG | CTG | chr17 | 42914363 | 42914384 | 42914380 | 42914385 | + |
| SEQ ID NO 61565 | CCTGAAGTTTATGAGGTTGATA | CTC | chr17 | 42914372 | 42914393 | 42914389 | 42914394 | + |
| SEQ ID NO 61566 | AAGTTTATGAGGTTGATAAGAA | CTG | chr17 | 42914376 | 42914397 | 42914393 | 42914398 | + |
| SEQ ID NO 61567 | ATGAGGTTGATAAGAAAACATA | TTT | chr17 | 42914382 | 42914403 | 42914399 | 42914404 | + |
| SEQ ID NO 61568 | TGAGGTTGATAAGAAAACATAA | TTA | chr17 | 42914383 | 42914404 | 42914400 | 42914405 | + |
| SEQ ID NO 61569 | ATAAGAAAACATAACAGATAAA | TTG | chr17 | 42914391 | 42914412 | 42914408 | 42914413 | + |
| SEQ ID NO 61570 | ATTGAGTGCTAACTTTATGCCA | TTT | chr17 | 42914417 | 42914438 | 42914434 | 42914439 | + |
| SEQ ID NO 61571 | TTGAGTGCTAACTTTATGCCAG | TTA | chr17 | 42914418 | 42914439 | 42914435 | 42914440 | + |
| SEQ ID NO 61572 | AGTGCTAACTTTATGCCAGATT | TTG | chr17 | 42914421 | 42914442 | 42914438 | 42914443 | + |
| SEQ ID NO 61573 | ACTTTATGCCAGATTCTGTTCT | CTA | chr17 | 42914428 | 42914449 | 42914445 | 42914450 | + |
| SEQ ID NO 61574 | TATGCCAGATTCTGTTCTATGT | CTT | chr17 | 42914432 | 42914453 | 42914449 | 42914454 | + |
| SEQ ID NO 61575 | ATGCCAGATTCTGTTCTATGTA | TTT | chr17 | 42914433 | 42914454 | 42914450 | 42914455 | + |
| SEQ ID NO 61576 | TGCCAGATTCTGTTCTATGTAC | TTA | chr17 | 42914434 | 42914455 | 42914451 | 42914456 | + |
| SEQ ID NO 61577 | TGTTCTATGTACTTTATTTATA | TTC | chr17 | 42914444 | 42914465 | 42914461 | 42914466 | + |
| SEQ ID NO 61578 | TTCTATGTACTTTATTTATACA | CTG | chr17 | 42914446 | 42914467 | 42914463 | 42914468 | + |
| SEQ ID NO 61579 | TATGTACTTTATTTATACAATT | TTC | chr17 | 42914449 | 42914470 | 42914466 | 42914471 | + |
| SEQ ID NO 61580 | TGTACTTTATTTATACAATTAA | CTA | chr17 | 42914451 | 42914472 | 42914468 | 42914473 | + |
| SEQ ID NO 61581 | TATTTATACAATTAACTCGCTT | CTT | chr17 | 42914458 | 42914479 | 42914475 | 42914480 | + |
| SEQ ID NO 61582 | ATTTATACAATTAACTCGCTTA | TTT | chr17 | 42914459 | 42914480 | 42914476 | 42914481 | + |
| SEQ ID NO 61583 | TTTATACAATTAACTCGCTTAG | TTA | chr17 | 42914460 | 42914481 | 42914477 | 42914482 | + |
| SEQ ID NO 61584 | ATACAATTAACTCGCTTAGTTC | TTT | chr17 | 42914463 | 42914484 | 42914480 | 42914485 | + |
| SEQ ID NO 61585 | TACAATTAACTCGCTTAGTTCT | TTA | chr17 | 42914464 | 42914485 | 42914481 | 42914486 | + |
| SEQ ID NO 61586 | ACTCGCTTAGTTCTCCCAACAT | TTA | chr17 | 42914472 | 42914493 | 42914489 | 42914494 | + |

Figure 90 (Cont'd)

| | | | | | | | | |
|---|---|---|---|---|---|---|---|---|
| SEQ ID NO 61587 | GCTTAGTTCTCCCAACATCTCT | CTC | chr17 | 42914476 | 42914497 | 42914493 | 42914498 | + |
| SEQ ID NO 61588 | AGTTCTCCCAACATCTCTGTGA | CTT | chr17 | 42914480 | 42914501 | 42914497 | 42914502 | + |
| SEQ ID NO 61589 | GTTCTCCCAACATCTCTGTGAG | TTA | chr17 | 42914481 | 42914502 | 42914498 | 42914503 | + |
| SEQ ID NO 61590 | TCCCAACATCTCTGTGAGTTGG | TTC | chr17 | 42914485 | 42914506 | 42914502 | 42914507 | + |
| SEQ ID NO 61591 | CCAACATCTCTGTGAGTTGGCT | CTC | chr17 | 42914487 | 42914508 | 42914504 | 42914509 | + |
| SEQ ID NO 61592 | TGTGAGTTGGCTACTGTCATTT | CTC | chr17 | 42914497 | 42914518 | 42914514 | 42914519 | + |
| SEQ ID NO 61593 | TGAGTTGGCTACTGTCATTTAT | CTG | chr17 | 42914499 | 42914520 | 42914516 | 42914521 | + |
| SEQ ID NO 61594 | GCTACTGTCATTTATCCTTATA | TTG | chr17 | 42914506 | 42914527 | 42914523 | 42914528 | + |
| SEQ ID NO 61595 | CTGTCATTTATCCTTATATTAC | CTA | chr17 | 42914510 | 42914531 | 42914527 | 42914532 | + |
| SEQ ID NO 61596 | TCATTTATCCTTATATTACAAA | CTG | chr17 | 42914513 | 42914534 | 42914530 | 42914535 | + |
| SEQ ID NO 61597 | ATCCTTATATTACAAATAGGTC | TTT | chr17 | 42914519 | 42914540 | 42914536 | 42914541 | + |
| SEQ ID NO 61598 | TCCTTATATTACAAATAGGTCC | TTA | chr17 | 42914520 | 42914541 | 42914537 | 42914542 | + |
| SEQ ID NO 61599 | ATATTACAAATAGGTCCAGAGG | CTT | chr17 | 42914525 | 42914546 | 42914542 | 42914547 | + |
| SEQ ID NO 61600 | TATTACAAATAGGTCCAGAGGG | TTA | chr17 | 42914526 | 42914547 | 42914543 | 42914548 | + |
| SEQ ID NO 61601 | CAAATAGGTCCAGAGGGGTTAG | TTA | chr17 | 42914531 | 42914552 | 42914548 | 42914553 | + |
| SEQ ID NO 61602 | GTCATCTTGTCCAGAATGGTGG | TTA | chr17 | 42914552 | 42914573 | 42914569 | 42914574 | + |
| SEQ ID NO 61603 | GTCCAGAATGGTGGAACCAGGT | CTT | chr17 | 42914560 | 42914581 | 42914577 | 42914582 | + |
| SEQ ID NO 61604 | TCCAGAATGGTGGAACCAGGTT | TTG | chr17 | 42914561 | 42914582 | 42914578 | 42914583 | + |
| SEQ ID NO 61605 | AGGATCAGGCAGTCTGGGCTGG | TTA | chr17 | 42914584 | 42914605 | 42914601 | 42914606 | + |
| SEQ ID NO 61606 | GGCTGGGCATGGTGGCTCACAT | CTG | chr17 | 42914600 | 42914621 | 42914617 | 42914622 | + |
| SEQ ID NO 61607 | GGCATGGTGGCTCACATCTGTA | CTG | chr17 | 42914605 | 42914626 | 42914622 | 42914627 | + |
| SEQ ID NO 61608 | ACATCTGTAATCCCAGCACTTT | CTC | chr17 | 42914618 | 42914639 | 42914635 | 42914640 | + |
| SEQ ID NO 61609 | TAATCCCAGCACTTTGGGAGGC | CTG | chr17 | 42914625 | 42914646 | 42914642 | 42914647 | + |
| SEQ ID NO 61610 | TGGGAGGCTGAGGTGGCAGATT | CTT | chr17 | 42914639 | 42914660 | 42914656 | 42914661 | + |
| SEQ ID NO 61611 | GGGAGGCTGAGGTGGCAGATTG | TTT | chr17 | 42914640 | 42914661 | 42914657 | 42914662 | + |
| SEQ ID NO 61612 | GGAGGCTGAGGTGGCAGATTGC | TTG | chr17 | 42914641 | 42914662 | 42914658 | 42914663 | + |
| SEQ ID NO 61613 | AGGTGGCAGATTGCCTGAGCTC | CTG | chr17 | 42914649 | 42914670 | 42914666 | 42914671 | + |
| SEQ ID NO 61614 | CCTGAGCTCAGGAGTTCGAGAC | TTG | chr17 | 42914662 | 42914683 | 42914679 | 42914684 | + |
| SEQ ID NO 61615 | AGCTCAGGAGTTCGAGACCAGC | CTG | chr17 | 42914666 | 42914687 | 42914683 | 42914688 | + |
| SEQ ID NO 61616 | AGGAGTTCGAGACCAGCCTGGG | CTC | chr17 | 42914671 | 42914692 | 42914688 | 42914693 | + |
| SEQ ID NO 61617 | GAGACCAGCCTGGGCAACATGG | TTC | chr17 | 42914679 | 42914700 | 42914696 | 42914701 | + |
| SEQ ID NO 61618 | GGCAACATGGTGAGACCCCCGT | CTG | chr17 | 42914691 | 42914712 | 42914708 | 42914713 | + |
| SEQ ID NO 61619 | TACCAAAAATACAAAACATTAG | CTA | chr17 | 42914716 | 42914737 | 42914733 | 42914738 | + |
| SEQ ID NO 61620 | GCCAAGCGTGGTGGTGCATGCC | TTA | chr17 | 42914737 | 42914758 | 42914754 | 42914759 | + |
| SEQ ID NO 61621 | TGGTCCTAACTACTCAGGTGGC | CTG | chr17 | 42914761 | 42914782 | 42914778 | 42914783 | + |
| SEQ ID NO 61622 | ACTACTCAGGTGGCTGAGGTGG | CTA | chr17 | 42914769 | 42914790 | 42914786 | 42914791 | + |
| SEQ ID NO 61623 | CTCAGGTGGCTGAGGTGGGAGA | CTA | chr17 | 42914773 | 42914794 | 42914790 | 42914795 | + |
| SEQ ID NO 61624 | AGGTGGCTGAGGTGGGAGAATC | CTC | chr17 | 42914776 | 42914797 | 42914793 | 42914798 | + |
| SEQ ID NO 61625 | AGGTGGGAGAATCCCTTGAGCT | CTG | chr17 | 42914785 | 42914806 | 42914802 | 42914807 | + |
| SEQ ID NO 61626 | GAGCTCAGAGGTTGCAGTGAGC | CTT | chr17 | 42914802 | 42914823 | 42914819 | 42914824 | + |
| SEQ ID NO 61627 | AGCTCAGAGGTTGCAGTGAGCC | TTG | chr17 | 42914803 | 42914824 | 42914820 | 42914825 | + |
| SEQ ID NO 61628 | AGAGGTTGCAGTGAGCCAAGAT | CTC | chr17 | 42914808 | 42914829 | 42914825 | 42914830 | + |
| SEQ ID NO 61629 | CAGTGAGCCAAGATTATGCCAC | TTG | chr17 | 42914816 | 42914837 | 42914833 | 42914838 | + |
| SEQ ID NO 61630 | TGCCACTGCACTCCAGCCTGGG | TTA | chr17 | 42914832 | 42914853 | 42914849 | 42914854 | + |
| SEQ ID NO 61631 | CACTCCAGCCTGGGTGACAGAG | CTG | chr17 | 42914840 | 42914861 | 42914857 | 42914862 | + |
| SEQ ID NO 61632 | CAGCCTGGGTGACAGAGTGAGA | CTC | chr17 | 42914845 | 42914866 | 42914862 | 42914867 | + |
| SEQ ID NO 61633 | GGTGACAGAGTGAGACCCTGTC | CTG | chr17 | 42914852 | 42914873 | 42914869 | 42914874 | + |
| SEQ ID NO 61634 | TCTCAGAAAAAAAAAAAAAAAA | CTG | chr17 | 42914872 | 42914893 | 42914889 | 42914894 | + |
| SEQ ID NO 61635 | AGAAAAAAAAAAAAAAAGAAG | CTC | chr17 | 42914876 | 42914897 | 42914893 | 42914898 | + |
| SEQ ID NO 61636 | GGCTGGGTGCTGTGGCTCGCGC | CTG | chr17 | 42914909 | 42914930 | 42914926 | 42914931 | + |
| SEQ ID NO 61637 | GGTGCTGTGGCTCGCGCCTGTA | CTG | chr17 | 42914914 | 42914935 | 42914931 | 42914936 | + |
| SEQ ID NO 61638 | TGGCTCGCGCCTGTAATCCCAG | CTG | chr17 | 42914921 | 42914942 | 42914938 | 42914943 | + |
| SEQ ID NO 61639 | GCGCCTGTAATCCCAGATACAA | CTC | chr17 | 42914927 | 42914948 | 42914944 | 42914949 | + |
| SEQ ID NO 61640 | TAATCCCAGATACAAAATAATC | CTG | chr17 | 42914934 | 42914955 | 42914951 | 42914956 | + |
| SEQ ID NO 61641 | TGTAATATATCCTGCTTATTAG | TTT | chr17 | 42914960 | 42914981 | 42914977 | 42914982 | + |
| SEQ ID NO 61642 | GTAATATATCCTGCTTATTAGA | TTT | chr17 | 42914961 | 42914982 | 42914978 | 42914983 | + |
| SEQ ID NO 61643 | TAATATATCCTGCTTATTAGAC | TTG | chr17 | 42914962 | 42914983 | 42914979 | 42914984 | + |
| SEQ ID NO 61644 | CTTATTAGACAGAACATTTTGA | CTG | chr17 | 42914974 | 42914995 | 42914991 | 42914996 | + |

Figure 90 (Cont'd)

| | | | | | | | | |
|---|---|---|---|---|---|---|---|---|
| SEQ ID NO 61645 | ATTAGACAGAACATTTTGATCA | CTT | chr17 | 42914977 | 42914998 | 42914994 | 42914999 | + |
| SEQ ID NO 61646 | TTAGACAGAACATTTTGATCAC | TTA | chr17 | 42914978 | 42914999 | 42914995 | 42915000 | + |
| SEQ ID NO 61647 | GACAGAACATTTTGATCACTCA | TTA | chr17 | 42914981 | 42915002 | 42914998 | 42915003 | + |
| SEQ ID NO 61648 | TGATCACTCATCTGTTCCCTAA | TTT | chr17 | 42914993 | 42915014 | 42915010 | 42915015 | + |
| SEQ ID NO 61649 | GATCACTCATCTGTTCCCTAAG | TTT | chr17 | 42914994 | 42915015 | 42915011 | 42915016 | + |
| SEQ ID NO 61650 | ATCACTCATCTGTTCCCTAAGT | TTG | chr17 | 42914995 | 42915016 | 42915012 | 42915017 | + |
| SEQ ID NO 61651 | ATCTGTTCCCTAAGTTATAGAT | CTC | chr17 | 42915002 | 42915023 | 42915019 | 42915024 | + |
| SEQ ID NO 61652 | TTCCCTAAGTTATAGATTTACG | CTG | chr17 | 42915007 | 42915028 | 42915024 | 42915029 | + |
| SEQ ID NO 61653 | CCTAAGTTATAGATTTACGTCC | TTC | chr17 | 42915010 | 42915031 | 42915027 | 42915032 | + |
| SEQ ID NO 61654 | AGTTATAGATTTACGTCCACTT | CTA | chr17 | 42915014 | 42915035 | 42915031 | 42915036 | + |
| SEQ ID NO 61655 | TAGATTTACGTCCACTTTAGAA | TTA | chr17 | 42915019 | 42915040 | 42915036 | 42915041 | + |
| SEQ ID NO 61656 | ACGTCCACTTTAGAAATGGCTT | TTT | chr17 | 42915026 | 42915047 | 42915043 | 42915048 | + |
| SEQ ID NO 61657 | CGTCCACTTTAGAAATGGCTTG | TTA | chr17 | 42915027 | 42915048 | 42915044 | 42915049 | + |
| SEQ ID NO 61658 | TAGAAATGGCTTGTGAGGCAAG | CTT | chr17 | 42915036 | 42915057 | 42915053 | 42915058 | + |
| SEQ ID NO 61659 | AGAAATGGCTTGTGAGGCAAGT | TTT | chr17 | 42915037 | 42915058 | 42915054 | 42915059 | + |
| SEQ ID NO 61660 | GAAATGGCTTGTGAGGCAAGTT | TTA | chr17 | 42915038 | 42915059 | 42915055 | 42915060 | + |
| SEQ ID NO 61661 | GTGAGGCAAGTTTAAGTGACCG | CTT | chr17 | 42915048 | 42915069 | 42915065 | 42915070 | + |
| SEQ ID NO 61662 | TGAGGCAAGTTTAAGTGACCGA | TTG | chr17 | 42915049 | 42915070 | 42915066 | 42915071 | + |
| SEQ ID NO 61663 | AAGTGACCGATGACAGTTTTAA | TTT | chr17 | 42915061 | 42915082 | 42915078 | 42915083 | + |
| SEQ ID NO 61664 | AGTGACCGATGACAGTTTTAAA | TTA | chr17 | 42915062 | 42915083 | 42915079 | 42915084 | + |
| SEQ ID NO 61665 | TAAAGCAAGGTCCATGTCATGT | TTT | chr17 | 42915080 | 42915101 | 42915097 | 42915102 | + |
| SEQ ID NO 61666 | AAAGCAAGGTCCATGTCATGTT | TTT | chr17 | 42915081 | 42915102 | 42915098 | 42915103 | + |
| SEQ ID NO 61667 | AAGCAAGGTCCATGTCATGTTA | TTA | chr17 | 42915082 | 42915103 | 42915099 | 42915104 | + |
| SEQ ID NO 61668 | TGGCATAATTTGGTAGAATGTT | TTA | chr17 | 42915104 | 42915125 | 42915121 | 42915126 | + |
| SEQ ID NO 61669 | GGTAGAATGTTCTAGTAGTGTA | TTT | chr17 | 42915115 | 42915136 | 42915132 | 42915137 | + |
| SEQ ID NO 61670 | GTAGAATGTTCTAGTAGTGTAT | TTG | chr17 | 42915116 | 42915137 | 42915133 | 42915138 | + |
| SEQ ID NO 61671 | TAGTAGTGTATCAGTTTTCAGG | TTC | chr17 | 42915127 | 42915148 | 42915144 | 42915149 | + |
| SEQ ID NO 61672 | GTAGTGTATCAGTTTTCAGGTG | CTA | chr17 | 42915129 | 42915150 | 42915146 | 42915151 | + |
| SEQ ID NO 61673 | TCAGGTGGTAGGCTTGAGGATG | TTT | chr17 | 42915144 | 42915165 | 42915161 | 42915166 | + |
| SEQ ID NO 61674 | CAGGTGGTAGGCTTGAGGATGA | TTT | chr17 | 42915145 | 42915166 | 42915162 | 42915167 | + |
| SEQ ID NO 61675 | AGGTGGTAGGCTTGAGGATGAT | TTC | chr17 | 42915146 | 42915167 | 42915163 | 42915168 | + |
| SEQ ID NO 61676 | GAGGATGATACACACACACACA | CTT | chr17 | 42915159 | 42915180 | 42915176 | 42915181 | + |
| SEQ ID NO 61677 | AGGATGATACACACACACACAC | TTG | chr17 | 42915160 | 42915181 | 42915177 | 42915182 | + |
| SEQ ID NO 61678 | TATTATTGCCCAAAGAAAATAG | TTC | chr17 | 42915196 | 42915217 | 42915213 | 42915218 | + |
| SEQ ID NO 61679 | TTATTGCCCAAAGAAAATAGAC | CTA | chr17 | 42915198 | 42915219 | 42915215 | 42915220 | + |
| SEQ ID NO 61680 | TTGCCCAAAGAAAATAGACCCA | TTA | chr17 | 42915201 | 42915222 | 42915218 | 42915223 | + |
| SEQ ID NO 61681 | CCCAAAGAAAATAGACCCATTA | TTG | chr17 | 42915204 | 42915225 | 42915221 | 42915226 | + |
| SEQ ID NO 61682 | AGGAAGTCCAACTTCTGCTGCG | TTA | chr17 | 42915226 | 42915247 | 42915243 | 42915248 | + |
| SEQ ID NO 61683 | CTGCTGCGTGGACCAGTGCTGC | CTT | chr17 | 42915240 | 42915261 | 42915257 | 42915262 | + |
| SEQ ID NO 61684 | TGCTGCGTGGACCAGTGCTGCC | TTC | chr17 | 42915241 | 42915262 | 42915258 | 42915263 | + |
| SEQ ID NO 61685 | CTGCGTGGACCAGTGCTGCCAC | CTG | chr17 | 42915243 | 42915264 | 42915260 | 42915265 | + |
| SEQ ID NO 61686 | CGTGGACCAGTGCTGCCACATC | CTG | chr17 | 42915246 | 42915267 | 42915263 | 42915268 | + |
| SEQ ID NO 61687 | CCACATCACACATAGACCAAAG | CTG | chr17 | 42915261 | 42915282 | 42915278 | 42915283 | + |
| SEQ ID NO 61688 | AGGTTTTGTGGTTTTGGTTAT | CTT | chr17 | 42915287 | 42915308 | 42915304 | 42915309 | + |
| SEQ ID NO 61689 | GGTTTTTGTGGTTTTGGTTATT | TTA | chr17 | 42915288 | 42915309 | 42915305 | 42915310 | + |
| SEQ ID NO 61690 | TTGTGGTTTTGGTTATTTATTT | TTT | chr17 | 42915293 | 42915314 | 42915310 | 42915315 | + |
| SEQ ID NO 61691 | TGTGGTTTTGGTTATTTATTTT | TTT | chr17 | 42915294 | 42915315 | 42915311 | 42915316 | + |
| SEQ ID NO 61692 | GTGGTTTTGGTTATTTATTTTA | TTT | chr17 | 42915295 | 42915316 | 42915312 | 42915317 | + |
| SEQ ID NO 61693 | TGGTTTTGGTTATTTATTTTAT | TTG | chr17 | 42915296 | 42915317 | 42915313 | 42915318 | + |
| SEQ ID NO 61694 | TGGTTATTTATTTTATCTTTTT | TTT | chr17 | 42915302 | 42915323 | 42915319 | 42915324 | + |
| SEQ ID NO 61695 | GGTTATTTATTTTATCTTTTTA | TTT | chr17 | 42915303 | 42915324 | 42915320 | 42915325 | + |
| SEQ ID NO 61696 | GTTATTTATTTTATCTTTTTAT | TTG | chr17 | 42915304 | 42915325 | 42915321 | 42915326 | + |
| SEQ ID NO 61697 | TTTATTTTATCTTTTTATTTTA | TTA | chr17 | 42915308 | 42915329 | 42915325 | 42915330 | + |
| SEQ ID NO 61698 | ATTTTATCTTTTTATTTTATTT | TTT | chr17 | 42915311 | 42915332 | 42915328 | 42915333 | + |
| SEQ ID NO 61699 | TTTTATCTTTTTATTTTATTTT | TTA | chr17 | 42915312 | 42915333 | 42915329 | 42915334 | + |
| SEQ ID NO 61700 | TATCTTTTTATTTTATTTTATC | TTT | chr17 | 42915315 | 42915336 | 42915332 | 42915337 | + |
| SEQ ID NO 61701 | ATCTTTTTATTTTATTTTATCT | TTT | chr17 | 42915316 | 42915337 | 42915333 | 42915338 | + |
| SEQ ID NO 61702 | TCTTTTTATTTTATTTTATCTT | TTA | chr17 | 42915317 | 42915338 | 42915334 | 42915339 | + |

Figure 90 (Cont'd)

| | | | | | | | | |
|---|---|---|---|---|---|---|---|---|
| SEQ ID NO 61703 | TTTATTTTATTTTATCTTATTTT | CTT | chr17 | 42915321 | 42915342 | 42915338 | 42915343 | + |
| SEQ ID NO 61704 | TTATTTTATTTTATCTTATTTT | TTT | chr17 | 42915322 | 42915343 | 42915339 | 42915344 | + |
| SEQ ID NO 61705 | TATTTTATTTTATCTTATTTTA | TTT | chr17 | 42915323 | 42915344 | 42915340 | 42915345 | + |
| SEQ ID NO 61706 | ATTTTATTTTATCTTATTTTAT | TTT | chr17 | 42915324 | 42915345 | 42915341 | 42915346 | + |
| SEQ ID NO 61707 | TTTTATTTATCTTATTTTATT | TTA | chr17 | 42915325 | 42915346 | 42915342 | 42915347 | + |
| SEQ ID NO 61708 | TATTTATCTTATTTTATTTTA | TTT | chr17 | 42915328 | 42915349 | 42915345 | 42915350 | + |
| SEQ ID NO 61709 | ATTTATCTTATTTTATTTTAT | TTT | chr17 | 42915329 | 42915350 | 42915346 | 42915351 | + |
| SEQ ID NO 61710 | TTTATCTTATTTTATTTTATT | TTA | chr17 | 42915330 | 42915351 | 42915347 | 42915352 | + |
| SEQ ID NO 61711 | TATCTTATTTTATTTTATTTTA | TTT | chr17 | 42915333 | 42915354 | 42915350 | 42915355 | + |
| SEQ ID NO 61712 | ATCTTATTTTATTTTATTTTAT | TTT | chr17 | 42915334 | 42915355 | 42915351 | 42915356 | + |
| SEQ ID NO 61713 | TCTTATTTTATTTTATTTTATT | TTA | chr17 | 42915335 | 42915356 | 42915352 | 42915357 | + |
| SEQ ID NO 61714 | ATTTTATTTTATTTTATTTTAT | CTT | chr17 | 42915339 | 42915360 | 42915356 | 42915361 | + |
| SEQ ID NO 61715 | TTTTATTTTATTTTATTTTATT | TTA | chr17 | 42915340 | 42915361 | 42915357 | 42915362 | + |
| SEQ ID NO 61716 | TATTTTATTTTATTTTATTATT | TTT | chr17 | 42915343 | 42915364 | 42915360 | 42915365 | + |
| SEQ ID NO 61717 | ATTTTATTTTATTTTATTATTT | TTT | chr17 | 42915344 | 42915365 | 42915361 | 42915366 | + |
| SEQ ID NO 61718 | TTTTATTTTATTTTATTATTTG | TTA | chr17 | 42915345 | 42915366 | 42915362 | 42915367 | + |
| SEQ ID NO 61719 | TATTTTATTTTATTATTTGAGA | TTT | chr17 | 42915348 | 42915369 | 42915365 | 42915370 | + |
| SEQ ID NO 61720 | ATTTTATTTTATTATTTGAGAT | TTT | chr17 | 42915349 | 42915370 | 42915366 | 42915371 | + |
| SEQ ID NO 61721 | TTTTATTTTATTATTTGAGATG | TTA | chr17 | 42915350 | 42915371 | 42915367 | 42915372 | + |
| SEQ ID NO 61722 | TATTTTATTATTTGAGATGGAG | TTT | chr17 | 42915353 | 42915374 | 42915370 | 42915375 | + |
| SEQ ID NO 61723 | ATTTTATTATTTGAGATGGAGT | TTT | chr17 | 42915354 | 42915375 | 42915371 | 42915376 | + |
| SEQ ID NO 61724 | TTTTATTATTTGAGATGGAGTC | TTA | chr17 | 42915355 | 42915376 | 42915372 | 42915377 | + |
| SEQ ID NO 61725 | TATTATTTGAGATGGAGTCTCA | TTT | chr17 | 42915358 | 42915379 | 42915375 | 42915380 | + |
| SEQ ID NO 61726 | ATTATTTGAGATGGAGTCTCAC | TTT | chr17 | 42915359 | 42915380 | 42915376 | 42915381 | + |
| SEQ ID NO 61727 | TTATTTGAGATGGAGTCTCACT | TTA | chr17 | 42915360 | 42915381 | 42915377 | 42915382 | + |
| SEQ ID NO 61728 | TTTGAGATGGAGTCTCACTCTG | TTA | chr17 | 42915363 | 42915384 | 42915380 | 42915385 | + |
| SEQ ID NO 61729 | GAGATGGAGTCTCACTCTGTCA | TTT | chr17 | 42915366 | 42915387 | 42915383 | 42915388 | + |
| SEQ ID NO 61730 | AGATGGAGTCTCACTCTGTCAC | TTG | chr17 | 42915367 | 42915388 | 42915384 | 42915389 | + |
| SEQ ID NO 61731 | ACTCTGTCACCCAGGCTGGGGT | CTC | chr17 | 42915379 | 42915400 | 42915396 | 42915401 | + |
| SEQ ID NO 61732 | TGTCACCCAGGCTGGGGTGCAA | CTC | chr17 | 42915383 | 42915404 | 42915400 | 42915405 | + |
| SEQ ID NO 61733 | TCACCCAGGCTGGGGTGCAATG | CTG | chr17 | 42915385 | 42915406 | 42915402 | 42915407 | + |
| SEQ ID NO 61734 | GGGTGCAATGGCGCAATCTCAG | CTG | chr17 | 42915397 | 42915418 | 42915414 | 42915419 | + |
| SEQ ID NO 61735 | AGCTCACTGCAACCTCCAACTC | CTC | chr17 | 42915417 | 42915438 | 42915434 | 42915439 | + |
| SEQ ID NO 61736 | ACTGCAACCTCCAACTCCTGGG | CTC | chr17 | 42915422 | 42915443 | 42915439 | 42915444 | + |
| SEQ ID NO 61737 | CAACCTCCAACTCCTGGGGCTC | CTG | chr17 | 42915426 | 42915447 | 42915443 | 42915448 | + |
| SEQ ID NO 61738 | CAACTCCTGGGGCTCAAATGAT | CTC | chr17 | 42915433 | 42915454 | 42915450 | 42915455 | + |
| SEQ ID NO 61739 | CTGGGGCTCAAATGATCCTCCA | CTC | chr17 | 42915439 | 42915460 | 42915456 | 42915461 | + |
| SEQ ID NO 61740 | GGGCTCAAATGATCCTCCAGCC | CTG | chr17 | 42915442 | 42915463 | 42915459 | 42915464 | + |
| SEQ ID NO 61741 | AAATGATCCTCCAGCCTCAGCC | CTC | chr17 | 42915448 | 42915469 | 42915465 | 42915470 | + |
| SEQ ID NO 61742 | CAGCCTCAGCCTCCCGAATAGC | CTC | chr17 | 42915459 | 42915480 | 42915476 | 42915481 | + |
| SEQ ID NO 61743 | AGCCTCCCGAATAGCTGGGACT | CTC | chr17 | 42915466 | 42915487 | 42915483 | 42915488 | + |
| SEQ ID NO 61744 | CCGAATAGCTGGGACTACAGAT | CTC | chr17 | 42915472 | 42915493 | 42915489 | 42915494 | + |
| SEQ ID NO 61745 | GGACTACAGATGCGTACCACCA | CTG | chr17 | 42915483 | 42915504 | 42915500 | 42915505 | + |
| SEQ ID NO 61746 | CAGATGCGTACCACCATGCCTG | CTA | chr17 | 42915489 | 42915510 | 42915506 | 42915511 | + |
| SEQ ID NO 61747 | GCTAATTTTTTATTTTTTGTA | CTG | chr17 | 42915511 | 42915532 | 42915528 | 42915533 | + |
| SEQ ID NO 61748 | ATTTTTTTATTTTTGTAGAGA | CTA | chr17 | 42915515 | 42915536 | 42915532 | 42915537 | + |
| SEQ ID NO 61749 | TTTTATTTTTGTAGAGACAGG | TTT | chr17 | 42915519 | 42915540 | 42915536 | 42915541 | + |
| SEQ ID NO 61750 | TTTATTTTTGTAGAGACAGGG | TTT | chr17 | 42915520 | 42915541 | 42915537 | 42915542 | + |
| SEQ ID NO 61751 | TTATTTTTGTAGAGACAGGGT | TTT | chr17 | 42915521 | 42915542 | 42915538 | 42915543 | + |
| SEQ ID NO 61752 | TATTTTTGTAGAGACAGGGTC | TTT | chr17 | 42915522 | 42915543 | 42915539 | 42915544 | + |
| SEQ ID NO 61753 | ATTTTTTGTAGAGACAGGGTCT | TTT | chr17 | 42915523 | 42915544 | 42915540 | 42915545 | + |
| SEQ ID NO 61754 | TTTTTTGTAGAGACAGGGTCTC | TTA | chr17 | 42915524 | 42915545 | 42915541 | 42915546 | + |
| SEQ ID NO 61755 | TTTGTAGAGACAGGGTCTCAAG | TTT | chr17 | 42915527 | 42915548 | 42915544 | 42915549 | + |
| SEQ ID NO 61756 | TTGTAGAGACAGGGTCTCAAGC | TTT | chr17 | 42915528 | 42915549 | 42915545 | 42915550 | + |
| SEQ ID NO 61757 | TGTAGAGACAGGGTCTCAAGCA | TTT | chr17 | 42915529 | 42915550 | 42915546 | 42915551 | + |
| SEQ ID NO 61758 | GTAGAGACAGGGTCTCAAGCAT | TTT | chr17 | 42915530 | 42915551 | 42915547 | 42915552 | + |
| SEQ ID NO 61759 | TAGAGACAGGGTCTCAAGCATC | TTG | chr17 | 42915531 | 42915552 | 42915548 | 42915553 | + |
| SEQ ID NO 61760 | AAGCATCCTCCCGCCTTAGCCT | CTC | chr17 | 42915546 | 42915567 | 42915563 | 42915568 | + |

Figure 90 (Cont'd)

| | | | | | | | | |
|---|---|---|---|---|---|---|---|---|
| SEQ ID NO 61761 | CCGCCTTAGCCTCCCAAAGTGC | CTC | chr17 | 42915556 | 42915577 | 42915573 | 42915578 | + |
| SEQ ID NO 61762 | AGCCTCCCAAAGTGCTGGGATA | CTT | chr17 | 42915563 | 42915584 | 42915580 | 42915585 | + |
| SEQ ID NO 61763 | GCCTCCCAAAGTGCTGGGATAA | TTA | chr17 | 42915564 | 42915585 | 42915581 | 42915586 | + |
| SEQ ID NO 61764 | CCAAAGTGCTGGGATAACAGGC | CTC | chr17 | 42915569 | 42915590 | 42915586 | 42915591 | + |
| SEQ ID NO 61765 | GGATAACAGGCATGAGCTGCTG | CTG | chr17 | 42915580 | 42915601 | 42915597 | 42915602 | + |
| SEQ ID NO 61766 | CTGCACTCAGCCATGTTTTTGA | CTG | chr17 | 42915599 | 42915620 | 42915616 | 42915621 | + |
| SEQ ID NO 61767 | CACTCAGCCATGTTTTTGATTT | CTG | chr17 | 42915602 | 42915623 | 42915619 | 42915624 | + |
| SEQ ID NO 61768 | AGCCATGTTTTTGATTTTTAAC | CTC | chr17 | 42915607 | 42915628 | 42915624 | 42915629 | + |
| SEQ ID NO 61769 | TTGATTTTTAACAAAATTGTAA | TTT | chr17 | 42915617 | 42915638 | 42915634 | 42915639 | + |
| SEQ ID NO 61770 | TGATTTTTAACAAAATTGTAAC | TTT | chr17 | 42915618 | 42915639 | 42915635 | 42915640 | + |
| SEQ ID NO 61771 | GATTTTTAACAAAATTGTAACA | TTT | chr17 | 42915619 | 42915640 | 42915636 | 42915641 | + |
| SEQ ID NO 61772 | ATTTTTAACAAAATTGTAACAC | TTG | chr17 | 42915620 | 42915641 | 42915637 | 42915642 | + |
| SEQ ID NO 61773 | TTAACAAAATTGTAACACCTTA | TTT | chr17 | 42915624 | 42915645 | 42915641 | 42915646 | + |
| SEQ ID NO 61774 | TAACAAAATTGTAACACCTTAA | TTT | chr17 | 42915625 | 42915646 | 42915642 | 42915647 | + |
| SEQ ID NO 61775 | AACAAAATTGTAACACCTTAAA | TTT | chr17 | 42915626 | 42915647 | 42915643 | 42915648 | + |
| SEQ ID NO 61776 | ACAAAATTGTAACACCTTAAAA | TTA | chr17 | 42915627 | 42915648 | 42915644 | 42915649 | + |
| SEQ ID NO 61777 | TAACACCTTAAAAAAATGTAT | TTG | chr17 | 42915636 | 42915657 | 42915653 | 42915658 | + |
| SEQ ID NO 61778 | AAAAAAATGTATAACAAGGCC | CTT | chr17 | 42915645 | 42915666 | 42915662 | 42915667 | + |
| SEQ ID NO 61779 | AAAAAAATGTATAACAAGGCCG | TTA | chr17 | 42915646 | 42915667 | 42915663 | 42915668 | + |
| SEQ ID NO 61780 | ATGCCTGTAATCCCAGCACTTT | CTC | chr17 | 42915681 | 42915702 | 42915698 | 42915703 | + |
| SEQ ID NO 61781 | TAATCCCAGCACTTTGGGAAGC | CTG | chr17 | 42915688 | 42915709 | 42915705 | 42915710 | + |
| SEQ ID NO 61782 | TGGGAAGCCAAGGCAGGCAGAT | CTT | chr17 | 42915702 | 42915723 | 42915719 | 42915724 | + |
| SEQ ID NO 61783 | GGGAAGCCAAGGCAGGCAGATC | TTT | chr17 | 42915703 | 42915724 | 42915720 | 42915725 | + |
| SEQ ID NO 61784 | GGAAGCCAAGGCAGGCAGATCA | TTG | chr17 | 42915704 | 42915725 | 42915721 | 42915726 | + |
| SEQ ID NO 61785 | AGATCAGGAGTTCGACCTGACC | CTG | chr17 | 42915730 | 42915751 | 42915747 | 42915752 | + |
| SEQ ID NO 61786 | GACCTGACCAACATGGTGAAAC | TTC | chr17 | 42915743 | 42915764 | 42915760 | 42915765 | + |
| SEQ ID NO 61787 | ACCAACATGGTGAAACCGCGTC | CTG | chr17 | 42915749 | 42915770 | 42915766 | 42915771 | + |
| SEQ ID NO 61788 | TACTAAAAATACAAAAAATTAG | CTC | chr17 | 42915773 | 42915794 | 42915790 | 42915795 | + |
| SEQ ID NO 61789 | CTAAAAATACAAAAAATTAGCC | CTA | chr17 | 42915775 | 42915796 | 42915792 | 42915797 | + |
| SEQ ID NO 61790 | AAAATACAAAAAATTAGCCAGA | CTA | chr17 | 42915778 | 42915799 | 42915795 | 42915800 | + |
| SEQ ID NO 61791 | GCCAGACGTGGTGGCACATGCA | TTA | chr17 | 42915794 | 42915815 | 42915811 | 42915816 | + |
| SEQ ID NO 61792 | CTTGAGAGGCTGAGACAGGAGA | CTA | chr17 | 42915830 | 42915851 | 42915847 | 42915852 | + |
| SEQ ID NO 61793 | GAGAGGCTGAGACAGGAGAACT | CTT | chr17 | 42915833 | 42915854 | 42915850 | 42915855 | + |
| SEQ ID NO 61794 | AGAGGCTGAGACAGGAGAACTG | TTG | chr17 | 42915834 | 42915855 | 42915851 | 42915856 | + |
| SEQ ID NO 61795 | AGACAGGAGAACTGCTTGAACC | CTG | chr17 | 42915842 | 42915863 | 42915859 | 42915864 | + |
| SEQ ID NO 61796 | CTTGAACCGGGGAGGCAGAGGT | CTG | chr17 | 42915856 | 42915877 | 42915873 | 42915878 | + |
| SEQ ID NO 61797 | GAACCGGGGAGGCAGAGGTTGC | CTT | chr17 | 42915859 | 42915880 | 42915876 | 42915881 | + |
| SEQ ID NO 61798 | AACCGGGGAGGCAGAGGTTGCA | TTG | chr17 | 42915860 | 42915881 | 42915877 | 42915882 | + |
| SEQ ID NO 61799 | CAGTGAGCCAGATCACACCAT | TTG | chr17 | 42915880 | 42915901 | 42915897 | 42915902 | + |
| SEQ ID NO 61800 | CACTCCAACCTGGGCAACAAGA | TTG | chr17 | 42915904 | 42915925 | 42915921 | 42915926 | + |
| SEQ ID NO 61801 | CAACCTGGGCAACAAGAGTGAA | CTC | chr17 | 42915909 | 42915930 | 42915926 | 42915931 | + |
| SEQ ID NO 61802 | GGCAACAAGAGTGAAACTCCAT | CTG | chr17 | 42915916 | 42915937 | 42915933 | 42915938 | + |
| SEQ ID NO 61803 | CATCTCAAAAAAAAAAAAAGCT | CTC | chr17 | 42915935 | 42915956 | 42915952 | 42915957 | + |
| SEQ ID NO 61804 | AAAAAAAAAAAAAGCTGTATAA | CTC | chr17 | 42915941 | 42915962 | 42915958 | 42915963 | + |
| SEQ ID NO 61805 | TATAACAGCTTGAGATATAATT | CTG | chr17 | 42915958 | 42915979 | 42915975 | 42915980 | + |
| SEQ ID NO 61806 | GAGATATAATTCACAATACCAT | CTT | chr17 | 42915969 | 42915990 | 42915986 | 42915991 | + |
| SEQ ID NO 61807 | AGATATAATTCACAATACCATA | TTG | chr17 | 42915970 | 42915991 | 42915987 | 42915992 | + |
| SEQ ID NO 61808 | ACAATACCATACAATTCACTCA | TTC | chr17 | 42915981 | 42916002 | 42915998 | 42916003 | + |
| SEQ ID NO 61809 | ACTCATTTAAAGTGTACAATTC | TTC | chr17 | 42915998 | 42916019 | 42916015 | 42916020 | + |
| SEQ ID NO 61810 | ATTTAAAGTGTACAATTCAGGG | CTC | chr17 | 42916002 | 42916023 | 42916019 | 42916024 | + |
| SEQ ID NO 61811 | AAAGTGTACAATTCAGGGGTTT | TTT | chr17 | 42916006 | 42916027 | 42916023 | 42916028 | + |
| SEQ ID NO 61812 | AAGTGTACAATTCAGGGGTTTT | TTA | chr17 | 42916007 | 42916028 | 42916024 | 42916029 | + |
| SEQ ID NO 61813 | AGGGGTTTTCATTCCACTCCAA | TTC | chr17 | 42916020 | 42916041 | 42916037 | 42916042 | + |
| SEQ ID NO 61814 | TCATTCCACTCCAACCCACTCA | TTT | chr17 | 42916028 | 42916049 | 42916045 | 42916050 | + |
| SEQ ID NO 61815 | CATTCCACTCCAACCCACTCAA | TTT | chr17 | 42916029 | 42916050 | 42916046 | 42916051 | + |
| SEQ ID NO 61816 | ATTCCACTCCAACCCACTCAAG | TTC | chr17 | 42916030 | 42916051 | 42916047 | 42916052 | + |
| SEQ ID NO 61817 | CACTCCAACCCACTCAAGCCTA | TTC | chr17 | 42916034 | 42916055 | 42916051 | 42916056 | + |
| SEQ ID NO 61818 | CAACCCACTCAAGCCTAGGCAA | CTC | chr17 | 42916039 | 42916060 | 42916056 | 42916061 | + |

Figure 90 (Cont'd)

| | | | | | | | | |
|---|---|---|---|---|---|---|---|---|
| SEQ ID NO 61819 | AAGCCTAGGCAACCACTAATCT | CTC | chr17 | 42916049 | 42916070 | 42916066 | 42916071 | + |
| SEQ ID NO 61820 | GGCAACCACTAATCTACTTTCT | CTA | chr17 | 42916056 | 42916077 | 42916073 | 42916078 | + |
| SEQ ID NO 61821 | ATCTACTTTCTGTCTCATAGAT | CTA | chr17 | 42916067 | 42916088 | 42916084 | 42916089 | + |
| SEQ ID NO 61822 | CTTTCTGTCTCATAGATTTGCC | CTA | chr17 | 42916072 | 42916093 | 42916089 | 42916094 | + |
| SEQ ID NO 61823 | TCTGTCTCATAGATTTGCCTAT | CTT | chr17 | 42916075 | 42916096 | 42916092 | 42916097 | + |
| SEQ ID NO 61824 | CTGTCTCATAGATTTGCCTATT | TTT | chr17 | 42916076 | 42916097 | 42916093 | 42916098 | + |
| SEQ ID NO 61825 | TGTCTCATAGATTTGCCTATTT | TTC | chr17 | 42916077 | 42916098 | 42916094 | 42916099 | + |
| SEQ ID NO 61826 | TCTCATAGATTTGCCTATTTGG | CTG | chr17 | 42916079 | 42916100 | 42916096 | 42916101 | + |
| SEQ ID NO 61827 | ATAGATTTGCCTATTTGGGGCA | CTC | chr17 | 42916083 | 42916104 | 42916100 | 42916105 | + |
| SEQ ID NO 61828 | GCCTATTTGGGGCATTTCATAT | TTT | chr17 | 42916091 | 42916112 | 42916108 | 42916113 | + |
| SEQ ID NO 61829 | CCTATTTGGGGCATTTCATATA | TTG | chr17 | 42916092 | 42916113 | 42916109 | 42916114 | + |
| SEQ ID NO 61830 | TTTGGGGCATTTCATATAAATA | CTA | chr17 | 42916096 | 42916117 | 42916113 | 42916118 | + |
| SEQ ID NO 61831 | GGGGCATTTCATATAAATAGAC | TTT | chr17 | 42916099 | 42916120 | 42916116 | 42916121 | + |
| SEQ ID NO 61832 | GGGCATTTCATATAAATAGACT | TTG | chr17 | 42916100 | 42916121 | 42916117 | 42916122 | + |
| SEQ ID NO 61833 | CATATAAATAGACTCCTACAAT | TTT | chr17 | 42916108 | 42916129 | 42916125 | 42916130 | + |
| SEQ ID NO 61834 | ATATAAATAGACTCCTACAATA | TTC | chr17 | 42916109 | 42916130 | 42916126 | 42916131 | + |
| SEQ ID NO 61835 | CTACAATATGTGGCCTTTTGTG | CTC | chr17 | 42916123 | 42916144 | 42916140 | 42916145 | + |
| SEQ ID NO 61836 | CAATATGTGGCCTTTTGTGTCT | CTA | chr17 | 42916126 | 42916147 | 42916143 | 42916148 | + |
| SEQ ID NO 61837 | TTGTGTCTGGCCTCTTTCACTT | CTT | chr17 | 42916140 | 42916161 | 42916157 | 42916162 | + |
| SEQ ID NO 61838 | TGTGTCTGGCCTCTTTCACTTA | TTT | chr17 | 42916141 | 42916162 | 42916158 | 42916163 | + |
| SEQ ID NO 61839 | GTGTCTGGCCTCTTTCACTTAG | TTT | chr17 | 42916142 | 42916163 | 42916159 | 42916164 | + |
| SEQ ID NO 61840 | TGTCTGGCCTCTTTCACTTAGC | TTG | chr17 | 42916143 | 42916164 | 42916160 | 42916165 | + |
| SEQ ID NO 61841 | GCCTCTTTCACTTAGCATGATG | CTG | chr17 | 42916149 | 42916170 | 42916166 | 42916171 | + |
| SEQ ID NO 61842 | TTTCACTTAGCATGATGTTTTC | CTC | chr17 | 42916154 | 42916175 | 42916171 | 42916176 | + |
| SEQ ID NO 61843 | TCACTTAGCATGATGTTTTCAA | CTT | chr17 | 42916156 | 42916177 | 42916173 | 42916178 | + |
| SEQ ID NO 61844 | CACTTAGCATGATGTTTTCAAG | TTT | chr17 | 42916157 | 42916178 | 42916174 | 42916179 | + |
| SEQ ID NO 61845 | ACTTAGCATGATGTTTTCAAGG | TTC | chr17 | 42916158 | 42916179 | 42916175 | 42916180 | + |
| SEQ ID NO 61846 | AGCATGATGTTTTCAAGGTTTA | CTT | chr17 | 42916162 | 42916183 | 42916179 | 42916184 | + |
| SEQ ID NO 61847 | GCATGATGTTTTCAAGGTTTAT | TTA | chr17 | 42916163 | 42916184 | 42916180 | 42916185 | + |
| SEQ ID NO 61848 | TCAAGGTTTATCTGTGTTATAA | TTT | chr17 | 42916174 | 42916195 | 42916191 | 42916196 | + |
| SEQ ID NO 61849 | CAAGGTTTATCTGTGTTATAAC | TTT | chr17 | 42916175 | 42916196 | 42916192 | 42916197 | + |
| SEQ ID NO 61850 | AAGGTTTATCTGTGTTATAACA | TTC | chr17 | 42916176 | 42916197 | 42916193 | 42916198 | + |
| SEQ ID NO 61851 | ATCTGTGTTATAACATATATTG | TTT | chr17 | 42916183 | 42916204 | 42916200 | 42916205 | + |
| SEQ ID NO 61852 | TCTGTGTTATAACATATATTGG | TTA | chr17 | 42916184 | 42916205 | 42916201 | 42916206 | + |
| SEQ ID NO 61853 | TGTTATAACATATATTGGTACT | CTG | chr17 | 42916188 | 42916209 | 42916205 | 42916210 | + |
| SEQ ID NO 61854 | TAACATATATTGGTACTTCATT | TTA | chr17 | 42916193 | 42916214 | 42916210 | 42916215 | + |
| SEQ ID NO 61855 | GTACTTCATTTCTTTTTATGGA | TTG | chr17 | 42916205 | 42916226 | 42916222 | 42916227 | + |
| SEQ ID NO 61856 | CATTTCTTTTTATGGACAAGTA | CTT | chr17 | 42916211 | 42916232 | 42916228 | 42916233 | + |
| SEQ ID NO 61857 | ATTTCTTTTTATGGACAAGTAA | TTC | chr17 | 42916212 | 42916233 | 42916229 | 42916234 | + |
| SEQ ID NO 61858 | CTTTTTATGGACAAGTAATATT | TTT | chr17 | 42916216 | 42916237 | 42916233 | 42916238 | + |
| SEQ ID NO 61859 | TTTTTATGGACAAGTAATATTC | TTC | chr17 | 42916217 | 42916238 | 42916234 | 42916239 | + |
| SEQ ID NO 61860 | TTTATGGACAAGTAATATTCCA | CTT | chr17 | 42916219 | 42916240 | 42916236 | 42916241 | + |
| SEQ ID NO 61861 | TTATGGACAAGTAATATTCCAT | TTT | chr17 | 42916220 | 42916241 | 42916237 | 42916242 | + |
| SEQ ID NO 61862 | TATGGACAAGTAATATTCCATT | TTT | chr17 | 42916221 | 42916242 | 42916238 | 42916243 | + |
| SEQ ID NO 61863 | ATGGACAAGTAATATTCCATTG | TTT | chr17 | 42916222 | 42916243 | 42916239 | 42916244 | + |
| SEQ ID NO 61864 | TGGACAAGTAATATTCCATTGT | TTA | chr17 | 42916223 | 42916244 | 42916240 | 42916245 | + |
| SEQ ID NO 61865 | CATTGTATGAATATATAACATT | TTC | chr17 | 42916239 | 42916260 | 42916256 | 42916261 | + |
| SEQ ID NO 61866 | TATGAATATATAACATTGTATG | TTG | chr17 | 42916244 | 42916265 | 42916261 | 42916266 | + |
| SEQ ID NO 61867 | TATGAATATACCACATTTTATT | TTG | chr17 | 42916262 | 42916283 | 42916279 | 42916284 | + |
| SEQ ID NO 61868 | TATTTATCTGTTTATCAGGCCA | TTT | chr17 | 42916280 | 42916301 | 42916297 | 42916302 | + |
| SEQ ID NO 61869 | ATTTATCTGTTTATCAGGCCAG | TTT | chr17 | 42916281 | 42916302 | 42916298 | 42916303 | + |
| SEQ ID NO 61870 | TTTATCTGTTTATCAGGCCAGG | TTA | chr17 | 42916282 | 42916303 | 42916299 | 42916304 | + |
| SEQ ID NO 61871 | ATCTGTTTATCAGGCCAGGCAT | TTT | chr17 | 42916285 | 42916306 | 42916302 | 42916307 | + |
| SEQ ID NO 61872 | TCTGTTTATCAGGCCAGGCATG | TTA | chr17 | 42916286 | 42916307 | 42916303 | 42916308 | + |
| SEQ ID NO 61873 | TTTATCAGGCCAGGCATGGTGG | CTG | chr17 | 42916290 | 42916311 | 42916307 | 42916312 | + |
| SEQ ID NO 61874 | ATCAGGCCAGGCATGGTGGCTC | TTT | chr17 | 42916293 | 42916314 | 42916310 | 42916315 | + |
| SEQ ID NO 61875 | TCAGGCCAGGCATGGTGGCTCA | TTA | chr17 | 42916294 | 42916315 | 42916311 | 42916316 | + |
| SEQ ID NO 61876 | ACATCTGTAATCCCAGCACTTT | CTC | chr17 | 42916315 | 42916336 | 42916332 | 42916337 | + |

Figure 90 (Cont'd)

| | | | | | | | | | |
|---|---|---|---|---|---|---|---|---|---|
| SEQ ID NO 61877 | TAATCCCAGCACTTTGGGAGGC | CTG | chr17 | 42916322 | 42916343 | 42916339 | 42916344 | + |
| SEQ ID NO 61878 | TGGGAGGCTGAGGCAGGAGGAT | CTT | chr17 | 42916336 | 42916357 | 42916353 | 42916358 | + |
| SEQ ID NO 61879 | GGGAGGCTGAGGCAGGAGGATT | TTT | chr17 | 42916337 | 42916358 | 42916354 | 42916359 | + |
| SEQ ID NO 61880 | GGAGGCTGAGGCAGGAGGATTA | TTG | chr17 | 42916338 | 42916359 | 42916355 | 42916360 | + |
| SEQ ID NO 61881 | AGGCAGGAGGATTACTTGAGCC | CTG | chr17 | 42916346 | 42916367 | 42916363 | 42916368 | + |
| SEQ ID NO 61882 | AAGTAATCCTCCTGCCTCAGCC | CTC | chr17 | 42916341 | 42916362 | 42916346 | 42916341 | - |
| SEQ ID NO 61883 | CTGCCTCAGCCTCCCAAAGTGC | CTC | chr17 | 42916330 | 42916351 | 42916335 | 42916330 | - |
| SEQ ID NO 61884 | CCTCAGCCTCCCAAAGTGCTGG | CTG | chr17 | 42916327 | 42916348 | 42916332 | 42916327 | - |
| SEQ ID NO 61885 | AGCCTCCCAAAGTGCTGGGATT | CTC | chr17 | 42916323 | 42916344 | 42916328 | 42916323 | - |
| SEQ ID NO 61886 | CCAAAGTGCTGGGATTACAGAT | CTC | chr17 | 42916317 | 42916338 | 42916322 | 42916317 | - |
| SEQ ID NO 61887 | GGATTACAGATGTGAGCCACCA | CTG | chr17 | 42916306 | 42916327 | 42916311 | 42916306 | - |
| SEQ ID NO 61888 | CAGATGTGAGCCACCATGCCTG | TTA | chr17 | 42916300 | 42916321 | 42916305 | 42916300 | - |
| SEQ ID NO 61889 | GCCTGATAAACAGATAAATAAA | CTG | chr17 | 42916278 | 42916299 | 42916283 | 42916278 | - |
| SEQ ID NO 61890 | ATAAACAGATAAATAAAATGTG | CTG | chr17 | 42916273 | 42916294 | 42916278 | 42916273 | - |
| SEQ ID NO 61891 | ATACAATGTTATATATTCATAC | TTC | chr17 | 42916243 | 42916264 | 42916248 | 42916243 | - |
| SEQ ID NO 61892 | TATATTCATACAATGGAATATT | TTA | chr17 | 42916232 | 42916253 | 42916237 | 42916232 | - |
| SEQ ID NO 61893 | ATACAATGGAATATTACTTGTC | TTC | chr17 | 42916225 | 42916246 | 42916230 | 42916225 | - |
| SEQ ID NO 61894 | CTTGTCCATAAAAAGAAATGAA | TTA | chr17 | 42916209 | 42916230 | 42916214 | 42916209 | - |
| SEQ ID NO 61895 | GTCCATAAAAAGAAATGAAGTA | CTT | chr17 | 42916206 | 42916227 | 42916211 | 42916206 | - |
| SEQ ID NO 61896 | TCCATAAAAAGAAATGAAGTAC | TTG | chr17 | 42916205 | 42916226 | 42916210 | 42916205 | - |
| SEQ ID NO 61897 | TAACACAGATAAACCTTGAAAA | TTA | chr17 | 42916171 | 42916192 | 42916176 | 42916171 | - |
| SEQ ID NO 61898 | GAAAACATCATGCTAAGTGAAA | CTT | chr17 | 42916154 | 42916175 | 42916159 | 42916154 | - |
| SEQ ID NO 61899 | AAAACATCATGCTAAGTGAAAG | TTG | chr17 | 42916153 | 42916174 | 42916158 | 42916153 | - |
| SEQ ID NO 61900 | AGTGAAAGAGGCCAGACACAAA | CTA | chr17 | 42916139 | 42916160 | 42916144 | 42916139 | - |
| SEQ ID NO 61901 | TAGGAGTCTATTTATATGAAAT | TTG | chr17 | 42916104 | 42916125 | 42916109 | 42916104 | - |
| SEQ ID NO 61902 | TTTATATGAAATGCCCCAAATA | CTA | chr17 | 42916094 | 42916115 | 42916099 | 42916094 | - |
| SEQ ID NO 61903 | ATATGAAATGCCCCAAATAGGC | TTT | chr17 | 42916091 | 42916112 | 42916096 | 42916091 | - |
| SEQ ID NO 61904 | TATGAAATGCCCCAAATAGGCA | TTA | chr17 | 42916090 | 42916111 | 42916095 | 42916090 | - |
| SEQ ID NO 61905 | TGAGACAGAAAGTAGATTAGTG | CTA | chr17 | 42916062 | 42916083 | 42916067 | 42916062 | - |
| SEQ ID NO 61906 | GTGGTTGCCTAGGCTTGAGTGG | TTA | chr17 | 42916043 | 42916064 | 42916048 | 42916043 | - |
| SEQ ID NO 61907 | CCTAGGCTTGAGTGGGTTGGAG | TTG | chr17 | 42916036 | 42916057 | 42916041 | 42916036 | - |
| SEQ ID NO 61908 | GGCTTGAGTGGGTTGGAGTGGA | CTA | chr17 | 42916032 | 42916053 | 42916037 | 42916032 | - |
| SEQ ID NO 61909 | GAGTGGGTTGGAGTGGAATGAA | CTT | chr17 | 42916027 | 42916048 | 42916032 | 42916027 | - |
| SEQ ID NO 61910 | AGTGGGTTGGAGTGGAATGAAA | TTG | chr17 | 42916026 | 42916047 | 42916031 | 42916026 | - |
| SEQ ID NO 61911 | GAGTGGAATGAAAACCCCTGAA | TTG | chr17 | 42916017 | 42916038 | 42916022 | 42916017 | - |
| SEQ ID NO 61912 | AATTGTACACTTTAAATGAGTG | CTG | chr17 | 42915997 | 42916018 | 42916002 | 42915997 | - |
| SEQ ID NO 61913 | TACACTTTAAATGAGTGAATTG | TTG | chr17 | 42915992 | 42916013 | 42915997 | 42915992 | - |
| SEQ ID NO 61914 | TAAATGAGTGAATTGTATGGTA | CTT | chr17 | 42915985 | 42916006 | 42915990 | 42915985 | - |
| SEQ ID NO 61915 | AAATGAGTGAATTGTATGGTAT | TTT | chr17 | 42915984 | 42916005 | 42915989 | 42915984 | - |
| SEQ ID NO 61916 | AATGAGTGAATTGTATGGTATT | TTA | chr17 | 42915983 | 42916004 | 42915988 | 42915983 | - |
| SEQ ID NO 61917 | TATGGTATTGTGAATTATATCT | TTG | chr17 | 42915970 | 42915991 | 42915975 | 42915970 | - |
| SEQ ID NO 61918 | TGAATTATATCTCAAGCTGTTA | TTG | chr17 | 42915960 | 42915981 | 42915965 | 42915960 | - |
| SEQ ID NO 61919 | TATCTCAAGCTGTTATACAGCT | TTA | chr17 | 42915953 | 42915974 | 42915958 | 42915953 | - |
| SEQ ID NO 61920 | AAGCTGTTATACAGCTTTTTTT | CTC | chr17 | 42915947 | 42915968 | 42915952 | 42915947 | - |
| SEQ ID NO 61921 | TTATACAGCTTTTTTTTTTTTT | CTG | chr17 | 42915941 | 42915962 | 42915946 | 42915941 | - |
| SEQ ID NO 61922 | TACAGCTTTTTTTTTTTTTGAG | TTA | chr17 | 42915938 | 42915959 | 42915943 | 42915938 | - |
| SEQ ID NO 61923 | TTTTTTTTTTTGAGATGGAGTT | CTT | chr17 | 42915930 | 42915951 | 42915935 | 42915930 | - |
| SEQ ID NO 61924 | TTTTTTTTTTGAGATGGAGTTT | TTT | chr17 | 42915929 | 42915950 | 42915934 | 42915929 | - |
| SEQ ID NO 61925 | TTTTTTTTTGAGATGGAGTTTC | TTT | chr17 | 42915928 | 42915949 | 42915933 | 42915928 | - |
| SEQ ID NO 61926 | TTTTTTTTGAGATGGAGTTTCA | TTT | chr17 | 42915927 | 42915948 | 42915932 | 42915927 | - |
| SEQ ID NO 61927 | TTTTTTTGAGATGGAGTTTCAC | TTT | chr17 | 42915926 | 42915947 | 42915931 | 42915926 | - |
| SEQ ID NO 61928 | TTTTTTGAGATGGAGTTTCACT | TTT | chr17 | 42915925 | 42915946 | 42915930 | 42915925 | - |
| SEQ ID NO 61929 | TTTTTGAGATGGAGTTTCACTC | TTT | chr17 | 42915924 | 42915945 | 42915929 | 42915924 | - |
| SEQ ID NO 61930 | TTTTGAGATGGAGTTTCACTCT | TTT | chr17 | 42915923 | 42915944 | 42915928 | 42915923 | - |
| SEQ ID NO 61931 | TTTGAGATGGAGTTTCACTCTT | TTT | chr17 | 42915922 | 42915943 | 42915927 | 42915922 | - |
| SEQ ID NO 61932 | TTGAGATGGAGTTTCACTCTTG | TTT | chr17 | 42915921 | 42915942 | 42915926 | 42915921 | - |
| SEQ ID NO 61933 | TGAGATGGAGTTTCACTCTTGT | TTT | chr17 | 42915920 | 42915941 | 42915925 | 42915920 | - |
| SEQ ID NO 61934 | GAGATGGAGTTTCACTCTTGTT | TTT | chr17 | 42915919 | 42915940 | 42915924 | 42915919 | - |

Figure 90 (Cont'd)

| | | | | | | | | |
|---|---|---|---|---|---|---|---|---|
| SEQ ID NO 61935 | AGATGGAGTTTCACTCTTGTTT | TTG | chr17 | 42915918 | 42915939 | 42915923 | 42915918 | - |
| SEQ ID NO 61936 | CACTCTTGTTGCCCAGGTTGGA | TTT | chr17 | 42915907 | 42915928 | 42915912 | 42915907 | - |
| SEQ ID NO 61937 | ACTCTTGTTGCCCAGGTTGGAG | TTC | chr17 | 42915906 | 42915927 | 42915911 | 42915906 | - |
| SEQ ID NO 61938 | TTGTTGCCCAGGTTGGAGTGCA | CTC | chr17 | 42915902 | 42915923 | 42915907 | 42915902 | - |
| SEQ ID NO 61939 | GTTGCCCAGGTTGGAGTGCAAT | CTT | chr17 | 42915900 | 42915921 | 42915905 | 42915900 | - |
| SEQ ID NO 61940 | TTGCCCAGGTTGGAGTGCAATG | TTG | chr17 | 42915899 | 42915920 | 42915904 | 42915899 | - |
| SEQ ID NO 61941 | CCCAGGTTGGAGTGCAATGGTG | TTG | chr17 | 42915896 | 42915917 | 42915901 | 42915896 | - |
| SEQ ID NO 61942 | GAGTGCAATGGTGTGATCTGGG | TTG | chr17 | 42915887 | 42915908 | 42915892 | 42915887 | - |
| SEQ ID NO 61943 | GGCTCACTGCAACCTCTGCCTC | CTG | chr17 | 42915867 | 42915888 | 42915872 | 42915867 | - |
| SEQ ID NO 61944 | ACTGCAACCTCTGCCTCCCCGG | CTC | chr17 | 42915862 | 42915883 | 42915867 | 42915862 | - |
| SEQ ID NO 61945 | CAACCTCTGCCTCCCCGGTTCA | CTG | chr17 | 42915858 | 42915879 | 42915863 | 42915858 | - |
| SEQ ID NO 61946 | TGCCTCCCCGGTTCAAGCAGTT | CTC | chr17 | 42915851 | 42915872 | 42915856 | 42915851 | - |
| SEQ ID NO 61947 | CCTCCCCGGTTCAAGCAGTTCT | CTG | chr17 | 42915849 | 42915870 | 42915854 | 42915849 | - |
| SEQ ID NO 61948 | CCCGGTTCAAGCAGTTCTCCTG | CTC | chr17 | 42915845 | 42915866 | 42915850 | 42915845 | - |
| SEQ ID NO 61949 | AAGCAGTTCTCCTGTCTCAGCC | TTC | chr17 | 42915837 | 42915858 | 42915842 | 42915837 | - |
| SEQ ID NO 61950 | TCCTGTCTCAGCCTCTCAAGTA | TTC | chr17 | 42915828 | 42915849 | 42915833 | 42915828 | - |
| SEQ ID NO 61951 | CTGTCTCAGCCTCTCAAGTAGC | CTC | chr17 | 42915826 | 42915847 | 42915831 | 42915826 | - |
| SEQ ID NO 61952 | TCTCAGCCTCTCAAGTAGCTGG | CTG | chr17 | 42915823 | 42915844 | 42915828 | 42915823 | - |
| SEQ ID NO 61953 | AGCCTCTCAAGTAGCTGGGATT | CTC | chr17 | 42915819 | 42915840 | 42915824 | 42915819 | - |
| SEQ ID NO 61954 | TCAAGTAGCTGGGATTACATGC | CTC | chr17 | 42915813 | 42915834 | 42915818 | 42915813 | - |
| SEQ ID NO 61955 | AAGTAGCTGGGATTACATGCAT | CTC | chr17 | 42915811 | 42915832 | 42915816 | 42915811 | - |
| SEQ ID NO 61956 | GGATTACATGCATGTGCCACCA | CTG | chr17 | 42915802 | 42915823 | 42915807 | 42915802 | - |
| SEQ ID NO 61957 | CATGCATGTGCCACCACGTCTG | TTA | chr17 | 42915796 | 42915817 | 42915801 | 42915796 | - |
| SEQ ID NO 61958 | GCTAATTTTTTGTATTTTTAGT | CTG | chr17 | 42915774 | 42915795 | 42915779 | 42915774 | - |
| SEQ ID NO 61959 | ATTTTTTGTATTTTTAGTAGAG | CTA | chr17 | 42915770 | 42915791 | 42915775 | 42915770 | - |
| SEQ ID NO 61960 | TTTGTATTTTTAGTAGAGACGC | TTT | chr17 | 42915766 | 42915787 | 42915771 | 42915766 | - |
| SEQ ID NO 61961 | TTGTATTTTTAGTAGAGACGCG | TTT | chr17 | 42915765 | 42915786 | 42915770 | 42915765 | - |
| SEQ ID NO 61962 | TGTATTTTTAGTAGAGACGCGG | TTT | chr17 | 42915764 | 42915785 | 42915769 | 42915764 | - |
| SEQ ID NO 61963 | GTATTTTTAGTAGAGACGCGGT | TTT | chr17 | 42915763 | 42915784 | 42915768 | 42915763 | - |
| SEQ ID NO 61964 | TATTTTTAGTAGAGACGCGGTT | TTG | chr17 | 42915762 | 42915783 | 42915767 | 42915762 | - |
| SEQ ID NO 61965 | TTAGTAGAGACGCGGTTTCACC | TTT | chr17 | 42915757 | 42915778 | 42915762 | 42915757 | - |
| SEQ ID NO 61966 | TAGTAGAGACGCGGTTTCACCA | TTT | chr17 | 42915756 | 42915777 | 42915761 | 42915756 | - |
| SEQ ID NO 61967 | AGTAGAGACGCGGTTTCACCAT | TTT | chr17 | 42915755 | 42915776 | 42915760 | 42915755 | - |
| SEQ ID NO 61968 | GTAGAGACGCGGTTTCACCATG | TTA | chr17 | 42915754 | 42915775 | 42915759 | 42915754 | - |
| SEQ ID NO 61969 | CACCATGTTGGTCAGGTCGAAC | TTT | chr17 | 42915739 | 42915760 | 42915744 | 42915739 | - |
| SEQ ID NO 61970 | ACCATGTTGGTCAGGTCGAACT | TTC | chr17 | 42915738 | 42915759 | 42915743 | 42915738 | - |
| SEQ ID NO 61971 | GTCAGGTCGAACTCCTGATCTC | TTG | chr17 | 42915729 | 42915750 | 42915734 | 42915729 | - |
| SEQ ID NO 61972 | CTGATCTCAGGTGATCTGCCTG | CTC | chr17 | 42915715 | 42915736 | 42915720 | 42915715 | - |
| SEQ ID NO 61973 | ATCTCAGGTGATCTGCCTGCCT | CTG | chr17 | 42915712 | 42915733 | 42915717 | 42915712 | - |
| SEQ ID NO 61974 | AGGTGATCTGCCTGCCTTGGCT | CTC | chr17 | 42915707 | 42915728 | 42915712 | 42915707 | - |
| SEQ ID NO 61975 | CCTGCCTTGGCTTCCCAAAGTG | CTG | chr17 | 42915697 | 42915718 | 42915702 | 42915697 | - |
| SEQ ID NO 61976 | CCTTGGCTTCCCAAAGTGCTGG | CTG | chr17 | 42915693 | 42915714 | 42915698 | 42915693 | - |
| SEQ ID NO 61977 | GGCTTCCCAAAGTGCTGGGATT | CTT | chr17 | 42915689 | 42915710 | 42915694 | 42915689 | - |
| SEQ ID NO 61978 | GCTTCCCAAAGTGCTGGGATTA | TTG | chr17 | 42915688 | 42915709 | 42915693 | 42915688 | - |
| SEQ ID NO 61979 | CCCAAAGTGCTGGGATTACAGG | CTT | chr17 | 42915684 | 42915705 | 42915689 | 42915684 | - |
| SEQ ID NO 61980 | CCAAAGTGCTGGGATTACAGGC | TTC | chr17 | 42915683 | 42915704 | 42915688 | 42915683 | - |
| SEQ ID NO 61981 | GGATTACAGGCATGAGCCACCG | CTG | chr17 | 42915672 | 42915693 | 42915677 | 42915672 | - |
| SEQ ID NO 61982 | CAGGCATGAGCCACCGTGCCCG | TTA | chr17 | 42915666 | 42915687 | 42915671 | 42915666 | - |
| SEQ ID NO 61983 | GTTATACATTTTTTTAAGGTG | CTT | chr17 | 42915639 | 42915660 | 42915644 | 42915639 | - |
| SEQ ID NO 61984 | TTATACATTTTTTTAAGGTGT | TTG | chr17 | 42915638 | 42915659 | 42915643 | 42915638 | - |
| SEQ ID NO 61985 | TACATTTTTTTAAGGTGTTAC | TTA | chr17 | 42915635 | 42915656 | 42915640 | 42915635 | - |
| SEQ ID NO 61986 | TTTTTAAGGTGTTACAATTTG | TTT | chr17 | 42915628 | 42915649 | 42915633 | 42915628 | - |
| SEQ ID NO 61987 | TTTTAAGGTGTTACAATTTGT | TTT | chr17 | 42915627 | 42915648 | 42915632 | 42915627 | - |
| SEQ ID NO 61988 | TTTAAGGTGTTACAATTTGTT | TTT | chr17 | 42915626 | 42915647 | 42915631 | 42915626 | - |
| SEQ ID NO 61989 | TTAAGGTGTTACAATTTGTTA | TTT | chr17 | 42915625 | 42915646 | 42915630 | 42915625 | - |
| SEQ ID NO 61990 | TAAGGTGTTACAATTTGTTAA | TTT | chr17 | 42915624 | 42915645 | 42915629 | 42915624 | - |
| SEQ ID NO 61991 | AAGGTGTTACAATTTGTTAAA | TTT | chr17 | 42915623 | 42915644 | 42915628 | 42915623 | - |
| SEQ ID NO 61992 | AGGTGTTACAATTTGTTAAAA | TTA | chr17 | 42915622 | 42915643 | 42915627 | 42915622 | - |

Figure 90 (Cont'd)

| | | | | | | | | |
|---|---|---|---|---|---|---|---|---|
| SEQ ID NO 61993 | CAATTTTGTTAAAAATCAAAAA | TTA | chr17 | 42915614 | 42915635 | 42915619 | 42915614 | - |
| SEQ ID NO 61994 | TGTTAAAAATCAAAAACATGGC | TTT | chr17 | 42915608 | 42915629 | 42915613 | 42915608 | - |
| SEQ ID NO 61995 | GTTAAAAATCAAAAACATGGCT | TTT | chr17 | 42915607 | 42915628 | 42915612 | 42915607 | - |
| SEQ ID NO 61996 | TTAAAAATCAAAAACATGGCTG | TTG | chr17 | 42915606 | 42915627 | 42915611 | 42915606 | - |
| SEQ ID NO 61997 | AAAATCAAAAACATGGCTGAGT | TTA | chr17 | 42915603 | 42915624 | 42915608 | 42915603 | - |
| SEQ ID NO 61998 | AGTGCAGCAGCTCATGCCTGTT | CTG | chr17 | 42915584 | 42915605 | 42915589 | 42915584 | - |
| SEQ ID NO 61999 | ATGCCTGTTATCCCAGCACTTT | CTC | chr17 | 42915571 | 42915592 | 42915576 | 42915571 | - |
| SEQ ID NO 62000 | TTATCCCAGCACTTTGGGAGGC | CTG | chr17 | 42915564 | 42915585 | 42915569 | 42915564 | - |
| SEQ ID NO 62001 | TCCCAGCACTTTGGGAGGCTAA | TTA | chr17 | 42915561 | 42915582 | 42915566 | 42915561 | - |
| SEQ ID NO 62002 | TGGGAGGCTAAGGCGGGAGGAT | CTT | chr17 | 42915550 | 42915571 | 42915555 | 42915550 | - |
| SEQ ID NO 62003 | GGGAGGCTAAGGCGGGAGGATG | TTT | chr17 | 42915549 | 42915570 | 42915554 | 42915549 | - |
| SEQ ID NO 62004 | GGAGGCTAAGGCGGGAGGATGC | TTG | chr17 | 42915548 | 42915569 | 42915553 | 42915548 | - |
| SEQ ID NO 62005 | AGGCGGGAGGATGCTTGAGACC | CTA | chr17 | 42915540 | 42915561 | 42915545 | 42915540 | - |
| SEQ ID NO 62006 | GAGACCCTGTCTCTACAAAAAA | CTT | chr17 | 42915524 | 42915545 | 42915529 | 42915524 | - |
| SEQ ID NO 62007 | AGACCCTGTCTCTACAAAAAAT | TTG | chr17 | 42915523 | 42915544 | 42915528 | 42915523 | - |
| SEQ ID NO 62008 | TCTCTACAAAAAATAAAAAAAT | CTG | chr17 | 42915515 | 42915536 | 42915520 | 42915515 | - |
| SEQ ID NO 62009 | TACAAAAAATAAAAAAATTAGC | CTC | chr17 | 42915511 | 42915532 | 42915516 | 42915511 | - |
| SEQ ID NO 62010 | CAAAAAATAAAAAAATTAGCCA | CTA | chr17 | 42915509 | 42915530 | 42915514 | 42915509 | - |
| SEQ ID NO 62011 | GCCAGGCATGGTGGTACGCATC | TTA | chr17 | 42915491 | 42915512 | 42915496 | 42915491 | - |
| SEQ ID NO 62012 | TAGTCCCAGCTATTCGGGAGGC | CTG | chr17 | 42915467 | 42915488 | 42915472 | 42915467 | - |
| SEQ ID NO 62013 | TTCGGGAGGCTGAGGCTGGAGG | CTA | chr17 | 42915455 | 42915476 | 42915460 | 42915455 | - |
| SEQ ID NO 62014 | GGGAGGCTGAGGCTGGAGGATC | TTC | chr17 | 42915452 | 42915473 | 42915457 | 42915452 | - |
| SEQ ID NO 62015 | AGGCTGGAGGATCATTTGAGCC | CTG | chr17 | 42915443 | 42915464 | 42915448 | 42915443 | - |
| SEQ ID NO 62016 | GAGGATCATTTGAGCCCCAGGA | CTG | chr17 | 42915437 | 42915458 | 42915442 | 42915437 | - |
| SEQ ID NO 62017 | GAGCCCCAGGAGTTGGAGGTTG | TTT | chr17 | 42915426 | 42915447 | 42915431 | 42915426 | - |
| SEQ ID NO 62018 | AGCCCCAGGAGTTGGAGGTTGC | TTG | chr17 | 42915425 | 42915446 | 42915430 | 42915425 | - |
| SEQ ID NO 62019 | GAGGTTGCAGTGAGCTGAGATT | TTG | chr17 | 42915411 | 42915432 | 42915416 | 42915411 | - |
| SEQ ID NO 62020 | CAGTGAGCTGAGATTGCGCCAT | TTG | chr17 | 42915404 | 42915425 | 42915409 | 42915404 | - |
| SEQ ID NO 62021 | AGATTGCGCCATTGCACCCCAG | CTG | chr17 | 42915394 | 42915415 | 42915399 | 42915394 | - |
| SEQ ID NO 62022 | CGCCATTGCACCCCAGCCTGGG | TTG | chr17 | 42915388 | 42915409 | 42915393 | 42915388 | - |
| SEQ ID NO 62023 | CACCCCAGCCTGGGTGACAGAG | TTG | chr17 | 42915380 | 42915401 | 42915385 | 42915380 | - |
| SEQ ID NO 62024 | GGTGACAGAGTGAGACTCCATC | CTG | chr17 | 42915368 | 42915389 | 42915373 | 42915368 | - |
| SEQ ID NO 62025 | CATCTCAAATAATAAAATAAAA | CTC | chr17 | 42915350 | 42915371 | 42915355 | 42915350 | - |
| SEQ ID NO 62026 | AAATAATAAAATAAAATAAAT | CTC | chr17 | 42915344 | 42915365 | 42915349 | 42915344 | - |
| SEQ ID NO 62027 | AGCCTTTGGTCTATGTGTGATG | CTA | chr17 | 42915264 | 42915285 | 42915269 | 42915264 | - |
| SEQ ID NO 62028 | TGGTCTATGTGTGATGTGGCAG | CTT | chr17 | 42915258 | 42915279 | 42915263 | 42915258 | - |
| SEQ ID NO 62029 | GGTCTATGTGTGATGTGGCAGC | TTT | chr17 | 42915257 | 42915278 | 42915262 | 42915257 | - |
| SEQ ID NO 62030 | GTCTATGTGTGATGTGGCAGCA | TTG | chr17 | 42915256 | 42915277 | 42915261 | 42915256 | - |
| SEQ ID NO 62031 | TGTGTGATGTGGCAGCACTGGT | CTA | chr17 | 42915251 | 42915272 | 42915256 | 42915251 | - |
| SEQ ID NO 62032 | GTCCACGCAGCAGAAGTTGGAC | CTG | chr17 | 42915231 | 42915252 | 42915236 | 42915231 | - |
| SEQ ID NO 62033 | GACTTCCTTAATGGGTCTATTT | TTG | chr17 | 42915212 | 42915233 | 42915217 | 42915212 | - |
| SEQ ID NO 62034 | CCTTAATGGGTCTATTTTCTTT | CTT | chr17 | 42915207 | 42915228 | 42915212 | 42915207 | - |
| SEQ ID NO 62035 | CTTAATGGGTCTATTTTCTTTG | TTC | chr17 | 42915206 | 42915227 | 42915211 | 42915206 | - |
| SEQ ID NO 62036 | AATGGGTCTATTTTCTTTGGGC | CTT | chr17 | 42915203 | 42915224 | 42915208 | 42915203 | - |
| SEQ ID NO 62037 | ATGGGTCTATTTTCTTTGGGCA | TTA | chr17 | 42915202 | 42915223 | 42915207 | 42915202 | - |
| SEQ ID NO 62038 | TTTTCTTTGGGCAATAATAGAA | CTA | chr17 | 42915193 | 42915214 | 42915198 | 42915193 | - |
| SEQ ID NO 62039 | TCTTTGGGCAATAATAGAATTG | TTT | chr17 | 42915190 | 42915211 | 42915195 | 42915190 | - |
| SEQ ID NO 62040 | CTTTGGGCAATAATAGAATTGC | TTT | chr17 | 42915189 | 42915210 | 42915194 | 42915189 | - |
| SEQ ID NO 62041 | TTTGGGCAATAATAGAATTGCA | TTC | chr17 | 42915188 | 42915209 | 42915193 | 42915188 | - |
| SEQ ID NO 62042 | TGGGCAATAATAGAATTGCATT | CTT | chr17 | 42915186 | 42915207 | 42915191 | 42915186 | - |
| SEQ ID NO 62043 | GGGCAATAATAGAATTGCATTG | TTT | chr17 | 42915185 | 42915206 | 42915190 | 42915185 | - |
| SEQ ID NO 62044 | GGCAATAATAGAATTGCATTGC | TTG | chr17 | 42915184 | 42915205 | 42915189 | 42915184 | - |
| SEQ ID NO 62045 | CATTGCGTGTGTGTGTGTGTGT | TTG | chr17 | 42915168 | 42915189 | 42915173 | 42915168 | - |
| SEQ ID NO 62046 | CGTGTGTGTGTGTGTGTATCAT | TTG | chr17 | 42915163 | 42915184 | 42915168 | 42915163 | - |
| SEQ ID NO 62047 | AAGCCTACCACCTGAAAACTGA | CTC | chr17 | 42915137 | 42915158 | 42915142 | 42915137 | - |
| SEQ ID NO 62048 | CCACCTGAAAACTGATACACTA | CTA | chr17 | 42915130 | 42915151 | 42915135 | 42915130 | - |
| SEQ ID NO 62049 | AAAACTGATACACTACTAGAAC | CTG | chr17 | 42915123 | 42915144 | 42915128 | 42915123 | - |
| SEQ ID NO 62050 | ATACACTACTAGAACATTCTAC | CTG | chr17 | 42915116 | 42915137 | 42915121 | 42915116 | - |

Figure 90 (Cont'd)

| SEQ ID NO 62051 | CTAGAACATTCTACCAAATTAT | CTA | chr17 | 42915108 | 42915129 | 42915113 | 42915108 | - |
|---|---|---|---|---|---|---|---|---|
| SEQ ID NO 62052 | GAACATTCTACCAAATTATGCC | CTA | chr17 | 42915105 | 42915126 | 42915110 | 42915105 | - |
| SEQ ID NO 62053 | TACCAAATTATGCCATAACATG | TTC | chr17 | 42915097 | 42915118 | 42915102 | 42915097 | - |
| SEQ ID NO 62054 | CCAAATTATGCCATAACATGAC | CTA | chr17 | 42915095 | 42915116 | 42915100 | 42915095 | - |
| SEQ ID NO 62055 | TGCCATAACATGACATGGACCT | TTA | chr17 | 42915087 | 42915108 | 42915092 | 42915087 | - |
| SEQ ID NO 62056 | GCTTTAAAACTGTCATCGGTCA | CTT | chr17 | 42915064 | 42915085 | 42915069 | 42915064 | - |
| SEQ ID NO 62057 | CTTTAAAACTGTCATCGGTCAC | TTG | chr17 | 42915063 | 42915084 | 42915068 | 42915063 | - |
| SEQ ID NO 62058 | TAAAACTGTCATCGGTCACTTA | CTT | chr17 | 42915060 | 42915081 | 42915065 | 42915060 | - |
| SEQ ID NO 62059 | AAAACTGTCATCGGTCACTTAA | TTT | chr17 | 42915059 | 42915080 | 42915064 | 42915059 | - |
| SEQ ID NO 62060 | AAACTGTCATCGGTCACTTAAA | TTA | chr17 | 42915058 | 42915079 | 42915063 | 42915058 | - |
| SEQ ID NO 62061 | TCATCGGTCACTTAAACTTGCC | CTG | chr17 | 42915052 | 42915073 | 42915057 | 42915052 | - |
| SEQ ID NO 62062 | AAACTTGCCTCACAAGCCATTT | CTT | chr17 | 42915039 | 42915060 | 42915044 | 42915039 | - |
| SEQ ID NO 62063 | AACTTGCCTCACAAGCCATTTC | TTA | chr17 | 42915038 | 42915059 | 42915043 | 42915038 | - |
| SEQ ID NO 62064 | GCCTCACAAGCCATTTCTAAAG | CTT | chr17 | 42915033 | 42915054 | 42915038 | 42915033 | - |
| SEQ ID NO 62065 | CCTCACAAGCCATTTCTAAAGT | TTG | chr17 | 42915032 | 42915053 | 42915037 | 42915032 | - |
| SEQ ID NO 62066 | ACAAGCCATTTCTAAAGTGGAC | CTC | chr17 | 42915028 | 42915049 | 42915033 | 42915028 | - |
| SEQ ID NO 62067 | CTAAAGTGGACGTAAATCTATA | TTT | chr17 | 42915017 | 42915038 | 42915022 | 42915017 | - |
| SEQ ID NO 62068 | TAAAGTGGACGTAAATCTATAA | TTC | chr17 | 42915016 | 42915037 | 42915021 | 42915016 | - |
| SEQ ID NO 62069 | AAGTGGACGTAAATCTATAACT | CTA | chr17 | 42915014 | 42915035 | 42915019 | 42915014 | - |
| SEQ ID NO 62070 | TAACTTAGGGAACAGATGAGTG | CTA | chr17 | 42914997 | 42915018 | 42915002 | 42914997 | - |
| SEQ ID NO 62071 | AGGGAACAGATGAGTGATCAAA | CTT | chr17 | 42914991 | 42915012 | 42914996 | 42914991 | - |
| SEQ ID NO 62072 | GGGAACAGATGAGTGATCAAAA | TTA | chr17 | 42914990 | 42915011 | 42914995 | 42914990 | - |
| SEQ ID NO 62073 | TGTCTAATAAGCAGGATATATT | TTC | chr17 | 42914963 | 42914984 | 42914968 | 42914963 | - |
| SEQ ID NO 62074 | TCTAATAAGCAGGATATATTAC | CTG | chr17 | 42914961 | 42914982 | 42914966 | 42914961 | - |
| SEQ ID NO 62075 | ATAAGCAGGATATATTACAAAA | CTA | chr17 | 42914957 | 42914978 | 42914962 | 42914957 | - |
| SEQ ID NO 62076 | CAAAATGATTATTTTGTATCTG | TTA | chr17 | 42914940 | 42914961 | 42914945 | 42914940 | - |
| SEQ ID NO 62077 | TTTTGTATCTGGGATTACAGGC | TTA | chr17 | 42914929 | 42914950 | 42914934 | 42914929 | - |
| SEQ ID NO 62078 | TGTATCTGGGATTACAGGCGCG | TTT | chr17 | 42914926 | 42914947 | 42914931 | 42914926 | - |
| SEQ ID NO 62079 | GTATCTGGGATTACAGGCGCGA | TTT | chr17 | 42914925 | 42914946 | 42914930 | 42914925 | - |
| SEQ ID NO 62080 | TATCTGGGATTACAGGCGCGAG | TTG | chr17 | 42914924 | 42914945 | 42914929 | 42914924 | - |
| SEQ ID NO 62081 | GGATTACAGGCGCGAGCCACAG | CTG | chr17 | 42914918 | 42914939 | 42914923 | 42914918 | - |
| SEQ ID NO 62082 | CAGGCGCGAGCCACAGCACCCA | TTA | chr17 | 42914912 | 42914933 | 42914917 | 42914912 | - |
| SEQ ID NO 62083 | CTTGCTTCTTTTTTTTTTTTTT | CTG | chr17 | 42914880 | 42914901 | 42914885 | 42914880 | - |
| SEQ ID NO 62084 | GCTTCTTTTTTTTTTTTTTTTC | CTT | chr17 | 42914877 | 42914898 | 42914882 | 42914877 | - |
| SEQ ID NO 62085 | CTTCTTTTTTTTTTTTTTTTCT | TTG | chr17 | 42914876 | 42914897 | 42914881 | 42914876 | - |
| SEQ ID NO 62086 | CTTTTTTTTTTTTTTTCTGAG | CTT | chr17 | 42914873 | 42914894 | 42914878 | 42914873 | - |
| SEQ ID NO 62087 | TTTTTTTTTTTTTTCTGAGA | TTC | chr17 | 42914872 | 42914893 | 42914877 | 42914872 | - |
| SEQ ID NO 62088 | TTTTTTTTTTTTTCTGAGACA | CTT | chr17 | 42914870 | 42914891 | 42914875 | 42914870 | - |
| SEQ ID NO 62089 | TTTTTTTTTTTTCTGAGACAG | TTT | chr17 | 42914869 | 42914890 | 42914874 | 42914869 | - |
| SEQ ID NO 62090 | TTTTTTTTTTTCTGAGACAGG | TTT | chr17 | 42914868 | 42914889 | 42914873 | 42914868 | - |
| SEQ ID NO 62091 | TTTTTTTTTTCTGAGACAGGG | TTT | chr17 | 42914867 | 42914888 | 42914872 | 42914867 | - |
| SEQ ID NO 62092 | TTTTTTTTTCTGAGACAGGGT | TTT | chr17 | 42914866 | 42914887 | 42914871 | 42914866 | - |
| SEQ ID NO 62093 | TTTTTTTTCTGAGACAGGGTC | TTT | chr17 | 42914865 | 42914886 | 42914870 | 42914865 | - |
| SEQ ID NO 62094 | TTTTTTTCTGAGACAGGGTCT | TTT | chr17 | 42914864 | 42914885 | 42914869 | 42914864 | - |
| SEQ ID NO 62095 | TTTTTTCTGAGACAGGGTCTC | TTT | chr17 | 42914863 | 42914884 | 42914868 | 42914863 | - |
| SEQ ID NO 62096 | TTTTTCTGAGACAGGGTCTCA | TTT | chr17 | 42914862 | 42914883 | 42914867 | 42914862 | - |
| SEQ ID NO 62097 | TTTTCTGAGACAGGGTCTCAC | TTT | chr17 | 42914861 | 42914882 | 42914866 | 42914861 | - |
| SEQ ID NO 62098 | TTTCTGAGACAGGGTCTCACT | TTT | chr17 | 42914860 | 42914881 | 42914865 | 42914860 | - |
| SEQ ID NO 62099 | TTCTGAGACAGGGTCTCACTC | TTT | chr17 | 42914859 | 42914880 | 42914864 | 42914859 | - |
| SEQ ID NO 62100 | TCTGAGACAGGGTCTCACTCT | TTT | chr17 | 42914858 | 42914879 | 42914863 | 42914858 | - |
| SEQ ID NO 62101 | TCTGAGACAGGGTCTCACTCTG | TTT | chr17 | 42914857 | 42914878 | 42914862 | 42914857 | - |
| SEQ ID NO 62102 | CTGAGACAGGGTCTCACTCTGT | TTT | chr17 | 42914856 | 42914877 | 42914861 | 42914856 | - |
| SEQ ID NO 62103 | TGAGACAGGGTCTCACTCTGTC | TTC | chr17 | 42914855 | 42914876 | 42914860 | 42914855 | - |
| SEQ ID NO 62104 | AGACAGGGTCTCACTCTGTCAC | CTG | chr17 | 42914853 | 42914874 | 42914858 | 42914853 | - |
| SEQ ID NO 62105 | ACTCTGTCACCCAGGCTGGAGT | CTC | chr17 | 42914841 | 42914862 | 42914846 | 42914841 | - |
| SEQ ID NO 62106 | TGTCACCCAGGCTGGAGTGCAG | CTC | chr17 | 42914837 | 42914858 | 42914842 | 42914837 | - |
| SEQ ID NO 62107 | TCACCCAGGCTGGAGTGCAGTG | CTG | chr17 | 42914835 | 42914856 | 42914840 | 42914835 | - |
| SEQ ID NO 62108 | GAGTGCAGTGGCATAATCTTGG | CTG | chr17 | 42914823 | 42914844 | 42914828 | 42914823 | - |

Figure 90 (Cont'd)

| SEQ ID NO 62109 | GGCTCACTGCAACCTCTGAGCT | CTT | chr17 | 42914803 | 42914824 | 42914808 | 42914803 | - |
| SEQ ID NO 62110 | GCTCACTGCAACCTCTGAGCTC | TTG | chr17 | 42914802 | 42914823 | 42914807 | 42914802 | - |
| SEQ ID NO 62111 | ACTGCAACCTCTGAGCTCAAGG | CTC | chr17 | 42914798 | 42914819 | 42914803 | 42914798 | - |
| SEQ ID NO 62112 | CAACCTCTGAGCTCAAGGGATT | CTG | chr17 | 42914794 | 42914815 | 42914799 | 42914794 | - |
| SEQ ID NO 62113 | TGAGCTCAAGGGATTCTCCCAC | CTC | chr17 | 42914787 | 42914808 | 42914792 | 42914787 | - |
| SEQ ID NO 62114 | AGCTCAAGGGATTCTCCCACCT | CTG | chr17 | 42914785 | 42914806 | 42914790 | 42914785 | - |
| SEQ ID NO 62115 | AAGGGATTCTCCCACCTCAGCC | CTC | chr17 | 42914780 | 42914801 | 42914785 | 42914780 | - |
| SEQ ID NO 62116 | TCCCACCTCAGCCACCTGAGTA | TTC | chr17 | 42914771 | 42914792 | 42914776 | 42914771 | - |
| SEQ ID NO 62117 | CCACCTCAGCCACCTGAGTAGT | CTC | chr17 | 42914769 | 42914790 | 42914774 | 42914769 | - |
| SEQ ID NO 62118 | AGCCACCTGAGTAGTTAGGACC | CTC | chr17 | 42914762 | 42914783 | 42914767 | 42914762 | - |
| SEQ ID NO 62119 | AGTAGTTAGGACCACAGGCATG | CTG | chr17 | 42914753 | 42914774 | 42914758 | 42914753 | - |
| SEQ ID NO 62120 | GGACCACAGGCATGCACCACCA | TTA | chr17 | 42914745 | 42914766 | 42914750 | 42914745 | - |
| SEQ ID NO 62121 | GGCTAATGTTTTGTATTTTTGG | CTT | chr17 | 42914718 | 42914739 | 42914723 | 42914718 | - |
| SEQ ID NO 62122 | GCTAATGTTTTGTATTTTTGGT | TTG | chr17 | 42914717 | 42914738 | 42914722 | 42914717 | - |
| SEQ ID NO 62123 | ATGTTTTGTATTTTTGGTATAG | CTA | chr17 | 42914713 | 42914734 | 42914718 | 42914713 | - |
| SEQ ID NO 62124 | TGTATTTTTGGTATAGACGGGG | TTT | chr17 | 42914707 | 42914728 | 42914712 | 42914707 | - |
| SEQ ID NO 62125 | GTATTTTTGGTATAGACGGGGG | TTT | chr17 | 42914706 | 42914727 | 42914711 | 42914706 | - |
| SEQ ID NO 62126 | TATTTTTGGTATAGACGGGGGT | TTG | chr17 | 42914705 | 42914726 | 42914710 | 42914705 | - |
| SEQ ID NO 62127 | TTGGTATAGACGGGGGTCTCAC | TTT | chr17 | 42914700 | 42914721 | 42914705 | 42914700 | - |
| SEQ ID NO 62128 | TGGTATAGACGGGGGTCTCACC | TTT | chr17 | 42914699 | 42914720 | 42914704 | 42914699 | - |
| SEQ ID NO 62129 | GGTATAGACGGGGGTCTCACCA | TTT | chr17 | 42914698 | 42914719 | 42914703 | 42914698 | - |
| SEQ ID NO 62130 | GTATAGACGGGGGTCTCACCAT | TTG | chr17 | 42914697 | 42914718 | 42914702 | 42914697 | - |
| SEQ ID NO 62131 | ACCATGTTGCCCAGGCTGGTCT | CTC | chr17 | 42914680 | 42914701 | 42914685 | 42914680 | - |
| SEQ ID NO 62132 | CCCAGGCTGGTCTCGAACTCCT | TTG | chr17 | 42914671 | 42914692 | 42914676 | 42914671 | - |
| SEQ ID NO 62133 | GTCTCGAACTCCTGAGCTCAGG | CTG | chr17 | 42914662 | 42914683 | 42914667 | 42914662 | - |
| SEQ ID NO 62134 | GAACTCCTGAGCTCAGGCAATC | CTC | chr17 | 42914657 | 42914678 | 42914662 | 42914657 | - |
| SEQ ID NO 62135 | CTGAGCTCAGGCAATCTGCCAC | CTC | chr17 | 42914651 | 42914672 | 42914656 | 42914651 | - |
| SEQ ID NO 62136 | AGCTCAGGCAATCTGCCACCTC | CTG | chr17 | 42914648 | 42914669 | 42914653 | 42914648 | - |
| SEQ ID NO 62137 | AGGCAATCTGCCACCTCAGCCT | CTC | chr17 | 42914643 | 42914664 | 42914648 | 42914643 | - |
| SEQ ID NO 62138 | CCACCTCAGCCTCCCAAAGTGC | CTG | chr17 | 42914633 | 42914654 | 42914638 | 42914633 | - |
| SEQ ID NO 62139 | AGCCTCCCAAAGTGCTGGGATT | CTC | chr17 | 42914626 | 42914647 | 42914631 | 42914626 | - |
| SEQ ID NO 62140 | CCAAAGTGCTGGGATTACAGAT | CTC | chr17 | 42914620 | 42914641 | 42914625 | 42914620 | - |
| SEQ ID NO 62141 | GGATTACAGATGTGAGCCACCA | CTG | chr17 | 42914609 | 42914630 | 42914614 | 42914609 | - |
| SEQ ID NO 62142 | CAGATGTGAGCCACCATGCCCA | TTA | chr17 | 42914603 | 42914624 | 42914608 | 42914603 | - |
| SEQ ID NO 62143 | CCTGATCCTTAACCTGGTTCCA | CTG | chr17 | 42914571 | 42914592 | 42914576 | 42914571 | - |
| SEQ ID NO 62144 | ATCCTTAACCTGGTTCCACCAT | CTG | chr17 | 42914567 | 42914588 | 42914572 | 42914567 | - |
| SEQ ID NO 62145 | AACCTGGTTCCACCATTCTGGA | CTT | chr17 | 42914561 | 42914582 | 42914566 | 42914561 | - |
| SEQ ID NO 62146 | ACCTGGTTCCACCATTCTGGAC | TTA | chr17 | 42914560 | 42914581 | 42914565 | 42914560 | - |
| SEQ ID NO 62147 | GTTCCACCATTCTGGACAAGAT | CTG | chr17 | 42914555 | 42914576 | 42914560 | 42914555 | - |
| SEQ ID NO 62148 | CACCATTCTGGACAAGATGACT | TTC | chr17 | 42914551 | 42914572 | 42914556 | 42914551 | - |
| SEQ ID NO 62149 | TGGACAAGATGACTAACCCCTC | TTC | chr17 | 42914543 | 42914564 | 42914548 | 42914543 | - |
| SEQ ID NO 62150 | GACAAGATGACTAACCCCTCTG | CTG | chr17 | 42914541 | 42914562 | 42914546 | 42914541 | - |
| SEQ ID NO 62151 | ACCCCTCTGGACCTATTTGTAA | CTA | chr17 | 42914528 | 42914549 | 42914533 | 42914528 | - |
| SEQ ID NO 62152 | TGGACCTATTTGTAATATAAGG | CTC | chr17 | 42914521 | 42914542 | 42914526 | 42914521 | - |
| SEQ ID NO 62153 | GACCTATTTGTAATATAAGGAT | CTG | chr17 | 42914519 | 42914540 | 42914524 | 42914519 | - |
| SEQ ID NO 62154 | TTTGTAATATAAGGATAAATGA | CTA | chr17 | 42914513 | 42914534 | 42914518 | 42914513 | - |
| SEQ ID NO 62155 | GTAATATAAGGATAAATGACAG | TTT | chr17 | 42914510 | 42914531 | 42914515 | 42914510 | - |
| SEQ ID NO 62156 | TAATATAAGGATAAATGACAGT | TTG | chr17 | 42914509 | 42914530 | 42914514 | 42914509 | - |
| SEQ ID NO 62157 | ACAGAGATGTTGGGAGAACTAA | CTC | chr17 | 42914478 | 42914499 | 42914483 | 42914478 | - |
| SEQ ID NO 62158 | GGAGAACTAAGCGAGTTAATTG | TTG | chr17 | 42914466 | 42914487 | 42914471 | 42914466 | - |
| SEQ ID NO 62159 | AGCGAGTTAATTGTATAAATAA | CTA | chr17 | 42914457 | 42914478 | 42914462 | 42914457 | - |
| SEQ ID NO 62160 | ATTGTATAAATAAAGTACATAG | TTA | chr17 | 42914448 | 42914469 | 42914453 | 42914448 | - |
| SEQ ID NO 62161 | TATAAATAAAGTACATAGAACA | TTG | chr17 | 42914444 | 42914465 | 42914449 | 42914444 | - |
| SEQ ID NO 62162 | GCATAAAGTTAGCACTCAATAA | CTG | chr17 | 42914415 | 42914436 | 42914420 | 42914415 | - |
| SEQ ID NO 62163 | GCACTCAATAAACTTTATCTGT | TTA | chr17 | 42914404 | 42914425 | 42914409 | 42914404 | - |
| SEQ ID NO 62164 | AATAAACTTTATCTGTTATGTT | CTC | chr17 | 42914398 | 42914419 | 42914403 | 42914398 | - |
| SEQ ID NO 62165 | TATCTGTTATGTTTTCTTATCA | CTT | chr17 | 42914389 | 42914410 | 42914394 | 42914389 | - |
| SEQ ID NO 62166 | ATCTGTTATGTTTTCTTATCAA | TTT | chr17 | 42914388 | 42914409 | 42914393 | 42914388 | - |

Figure 90 (Cont'd)

| SEQ ID NO 62167 | TCTGTTATGTTTTCTTATCAAC | TTA | chr17 | 42914387 | 42914408 | 42914392 | 42914387 | - |
|---|---|---|---|---|---|---|---|---|
| SEQ ID NO 62168 | TTATGTTTTCTTATCAACCTCA | CTG | chr17 | 42914383 | 42914404 | 42914388 | 42914383 | - |
| SEQ ID NO 62169 | TGTTTTCTTATCAACCTCATAA | TTA | chr17 | 42914380 | 42914401 | 42914385 | 42914380 | - |
| SEQ ID NO 62170 | TCTTATCAACCTCATAAACTTC | TTT | chr17 | 42914375 | 42914396 | 42914380 | 42914375 | - |
| SEQ ID NO 62171 | CTTATCAACCTCATAAACTTCA | TTT | chr17 | 42914374 | 42914395 | 42914379 | 42914374 | - |
| SEQ ID NO 62172 | TTATCAACCTCATAAACTTCAG | TTC | chr17 | 42914373 | 42914394 | 42914378 | 42914373 | - |
| SEQ ID NO 62173 | ATCAACCTCATAAACTTCAGGG | CTT | chr17 | 42914371 | 42914392 | 42914376 | 42914371 | - |
| SEQ ID NO 62174 | TCAACCTCATAAACTTCAGGGA | TTA | chr17 | 42914370 | 42914391 | 42914375 | 42914370 | - |
| SEQ ID NO 62175 | ATAAACTTCAGGGAGTGGGGGC | CTC | chr17 | 42914362 | 42914383 | 42914367 | 42914362 | - |
| SEQ ID NO 62176 | CAGGGAGTGGGGGCAGTATTTA | CTT | chr17 | 42914354 | 42914375 | 42914359 | 42914354 | - |
| SEQ ID NO 62177 | AGGGAGTGGGGGCAGTATTTAC | TTC | chr17 | 42914353 | 42914374 | 42914358 | 42914353 | - |
| SEQ ID NO 62178 | ACTTTCTGGCAGACCTTTCTTG | TTT | chr17 | 42914333 | 42914354 | 42914338 | 42914333 | - |
| SEQ ID NO 62179 | CTTTCTGGCAGACCTTTCTTGT | TTA | chr17 | 42914332 | 42914353 | 42914337 | 42914332 | - |
| SEQ ID NO 62180 | TCTGGCAGACCTTTCTTGTAAG | CTT | chr17 | 42914329 | 42914350 | 42914334 | 42914329 | - |
| SEQ ID NO 62181 | CTGGCAGACCTTTCTTGTAAGG | TTT | chr17 | 42914328 | 42914349 | 42914333 | 42914328 | - |
| SEQ ID NO 62182 | TGGCAGACCTTTCTTGTAAGGA | TTC | chr17 | 42914327 | 42914348 | 42914332 | 42914327 | - |
| SEQ ID NO 62183 | GCAGACCTTTCTTGTAAGGATC | CTG | chr17 | 42914325 | 42914346 | 42914330 | 42914325 | - |
| SEQ ID NO 62184 | TCTTGTAAGGATCTTGGACTTG | CTT | chr17 | 42914316 | 42914337 | 42914321 | 42914316 | - |
| SEQ ID NO 62185 | CTTGTAAGGATCTTGGACTTGG | TTT | chr17 | 42914315 | 42914336 | 42914320 | 42914315 | - |
| SEQ ID NO 62186 | TTGTAAGGATCTTGGACTTGGT | TTC | chr17 | 42914314 | 42914335 | 42914319 | 42914314 | - |
| SEQ ID NO 62187 | GTAAGGATCTTGGACTTGGTCC | CTT | chr17 | 42914312 | 42914333 | 42914317 | 42914312 | - |
| SEQ ID NO 62188 | TAAGGATCTTGGACTTGGTCCT | TTG | chr17 | 42914311 | 42914332 | 42914316 | 42914311 | - |
| SEQ ID NO 62189 | GGACTTGGTCCTTGGGAGCAAA | CTT | chr17 | 42914301 | 42914322 | 42914306 | 42914301 | - |
| SEQ ID NO 62190 | GACTTGGTCCTTGGGAGCAAAT | TTG | chr17 | 42914300 | 42914321 | 42914305 | 42914300 | - |
| SEQ ID NO 62191 | GGTCCTTGGGAGCAAATAGATT | CTT | chr17 | 42914295 | 42914316 | 42914300 | 42914295 | - |
| SEQ ID NO 62192 | GTCCTTGGGAGCAAATAGATTA | TTG | chr17 | 42914294 | 42914315 | 42914299 | 42914294 | - |
| SEQ ID NO 62193 | GGGAGCAAATAGATTATCAAGG | CTT | chr17 | 42914288 | 42914309 | 42914293 | 42914288 | - |
| SEQ ID NO 62194 | GGAGCAAATAGATTATCAAGGA | TTG | chr17 | 42914287 | 42914308 | 42914292 | 42914287 | - |
| SEQ ID NO 62195 | TCAAGGATGGGCTATGCCTAA | TTA | chr17 | 42914272 | 42914293 | 42914277 | 42914272 | - |
| SEQ ID NO 62196 | TGCCTAAGCAGTAGGGTTCAGT | CTA | chr17 | 42914257 | 42914278 | 42914262 | 42914257 | - |
| SEQ ID NO 62197 | AGCAGTAGGGTTCAGTTCAGAC | CTA | chr17 | 42914251 | 42914272 | 42914256 | 42914251 | - |
| SEQ ID NO 62198 | AGTTCAGACAGATCAAAACCAT | TTC | chr17 | 42914238 | 42914259 | 42914243 | 42914238 | - |
| SEQ ID NO 62199 | AGACAGATCAAAACCATTTCTG | TTC | chr17 | 42914233 | 42914254 | 42914238 | 42914233 | - |
| SEQ ID NO 62200 | CTGGCCAAGCGCAGTGGCTCAC | TTT | chr17 | 42914214 | 42914235 | 42914219 | 42914214 | - |
| SEQ ID NO 62201 | TGGCCAAGCGCAGTGGCTCACA | TTC | chr17 | 42914213 | 42914234 | 42914218 | 42914213 | - |
| SEQ ID NO 62202 | GCCAAGCGCAGTGGCTCACACT | CTG | chr17 | 42914211 | 42914232 | 42914216 | 42914211 | - |
| SEQ ID NO 62203 | ACACTGTAATCCCAGCACTTTG | CTC | chr17 | 42914194 | 42914215 | 42914199 | 42914194 | - |
| SEQ ID NO 62204 | TAATCCCAGCACTTTGGGAGGC | CTG | chr17 | 42914188 | 42914209 | 42914193 | 42914188 | - |
| SEQ ID NO 62205 | TGGGAGGCTGAGGCAGGAGGAT | CTT | chr17 | 42914174 | 42914195 | 42914179 | 42914174 | - |
| SEQ ID NO 62206 | GGGAGGCTGAGGCAGGAGGATC | TTT | chr17 | 42914173 | 42914194 | 42914178 | 42914173 | - |
| SEQ ID NO 62207 | GGAGGCTGAGGCAGGAGGATCA | TTG | chr17 | 42914172 | 42914193 | 42914177 | 42914172 | - |
| SEQ ID NO 62208 | AGGCAGGAGGATCACTTGAACC | CTG | chr17 | 42914164 | 42914185 | 42914169 | 42914164 | - |
| SEQ ID NO 62209 | GAACCCAGGAGTTCAAGACCAG | CTT | chr17 | 42914147 | 42914168 | 42914152 | 42914147 | - |
| SEQ ID NO 62210 | AACCCAGGAGTTCAAGACCAGC | TTG | chr17 | 42914146 | 42914167 | 42914151 | 42914146 | - |
| SEQ ID NO 62211 | AAGACCAGCCTGGGCAGCATAG | TTC | chr17 | 42914133 | 42914154 | 42914138 | 42914133 | - |
| SEQ ID NO 62212 | GGCAGCATAGTGAGACCCCAT | CTG | chr17 | 42914121 | 42914142 | 42914126 | 42914121 | - |
| SEQ ID NO 62213 | TATTAAAAAAAAAAAAAGACT | CTC | chr17 | 42914096 | 42914117 | 42914101 | 42914096 | - |
| SEQ ID NO 62214 | TTAAAAAAAAAAAAAGACTAT | CTA | chr17 | 42914094 | 42914115 | 42914099 | 42914094 | - |
| SEQ ID NO 62215 | AAAAAAAAAAAAGACTATTTT | TTA | chr17 | 42914091 | 42914112 | 42914096 | 42914091 | - |
| SEQ ID NO 62216 | TTTTCTTTCTCCCTGGTTGGGA | CTA | chr17 | 42914073 | 42914094 | 42914078 | 42914073 | - |
| SEQ ID NO 62217 | TCTTTCTCCCTGGTTGGGACCA | TTT | chr17 | 42914070 | 42914091 | 42914075 | 42914070 | - |
| SEQ ID NO 62218 | CTTTCTCCCTGGTTGGGACCAT | TTT | chr17 | 42914069 | 42914090 | 42914074 | 42914069 | - |
| SEQ ID NO 62219 | TTTCTCCCTGGTTGGGACCATT | TTC | chr17 | 42914068 | 42914089 | 42914073 | 42914068 | - |
| SEQ ID NO 62220 | TCTCCCTGGTTGGGACCATTTG | CTT | chr17 | 42914066 | 42914087 | 42914071 | 42914066 | - |
| SEQ ID NO 62221 | CTCCCTGGTTGGGACCATTTGA | TTT | chr17 | 42914065 | 42914086 | 42914070 | 42914065 | - |
| SEQ ID NO 62222 | TCCCTGGTTGGGACCATTTGAT | TTC | chr17 | 42914064 | 42914085 | 42914069 | 42914064 | - |
| SEQ ID NO 62223 | CCTGGTTGGGACCATTTGATTC | CTC | chr17 | 42914062 | 42914083 | 42914067 | 42914062 | - |
| SEQ ID NO 62224 | GTTGGGACCATTTGATTCTGTG | CTG | chr17 | 42914058 | 42914079 | 42914063 | 42914058 | - |

Figure 90 (Cont'd)

| | | | | | | | | |
|---|---|---|---|---|---|---|---|---|
| SEQ ID NO 62225 | GGACCATTTGATTCTGTGAGGG | TTG | chr17 | 42914054 | 42914075 | 42914059 | 42914054 | - |
| SEQ ID NO 62226 | GATTCTGTGAGGGGCCTGGTTC | TTT | chr17 | 42914045 | 42914066 | 42914050 | 42914045 | - |
| SEQ ID NO 62227 | ATTCTGTGAGGGGCCTGGTTCC | TTG | chr17 | 42914044 | 42914065 | 42914049 | 42914044 | - |
| SEQ ID NO 62228 | TGTGAGGGGCCTGGTTCCCACA | TTC | chr17 | 42914040 | 42914061 | 42914045 | 42914040 | - |
| SEQ ID NO 62229 | TGAGGGGCCTGGTTCCCACAAC | CTG | chr17 | 42914038 | 42914059 | 42914043 | 42914038 | - |
| SEQ ID NO 62230 | GTTCCCACAACGCCCTCTGAGA | CTG | chr17 | 42914027 | 42914048 | 42914032 | 42914027 | - |
| SEQ ID NO 62231 | CCACAACGCCCTCTGAGAGCCC | TTC | chr17 | 42914023 | 42914044 | 42914028 | 42914023 | - |
| SEQ ID NO 62232 | TGAGAGCCCAAATCCAGTAGGA | CTC | chr17 | 42914010 | 42914031 | 42914015 | 42914010 | - |
| SEQ ID NO 62233 | AGAGCCCAAATCCAGTAGGAGA | CTG | chr17 | 42914008 | 42914029 | 42914013 | 42914008 | - |
| SEQ ID NO 62234 | CCCTGAATATACAGACTCCGGA | CTT | chr17 | 42913976 | 42913997 | 42913981 | 42913976 | - |
| SEQ ID NO 62235 | CCTGAATATACAGACTCCGGAG | TTC | chr17 | 42913975 | 42913996 | 42913980 | 42913975 | - |
| SEQ ID NO 62236 | AATATACAGACTCCGGAGTTCA | CTG | chr17 | 42913971 | 42913992 | 42913976 | 42913971 | - |
| SEQ ID NO 62237 | CGGAGTTCAGGTGTGAAATAGC | CTC | chr17 | 42913958 | 42913979 | 42913963 | 42913958 | - |
| SEQ ID NO 62238 | AGGTGTGAAATAGCGGAGCTTA | TTC | chr17 | 42913950 | 42913971 | 42913955 | 42913950 | - |
| SEQ ID NO 62239 | ACCCTCAGGAAATCCATTGATA | CTT | chr17 | 42913929 | 42913950 | 42913934 | 42913929 | - |
| SEQ ID NO 62240 | CCCTCAGGAAATCCATTGATAC | TTA | chr17 | 42913928 | 42913949 | 42913933 | 42913928 | - |
| SEQ ID NO 62241 | AGGAAATCCATTGATACGGTGA | CTC | chr17 | 42913923 | 42913944 | 42913928 | 42913923 | - |
| SEQ ID NO 62242 | ATACGGTGATGATTTGAGGCCT | TTG | chr17 | 42913910 | 42913931 | 42913915 | 42913910 | - |
| SEQ ID NO 62243 | GAGGCCTTTGGAGGTCGAACCC | TTT | chr17 | 42913895 | 42913916 | 42913900 | 42913895 | - |
| SEQ ID NO 62244 | AGGCCTTTGGAGGTCGAACCCT | TTG | chr17 | 42913894 | 42913915 | 42913899 | 42913894 | - |
| SEQ ID NO 62245 | TGGAGGTCGAACCCTGCACCCA | CTT | chr17 | 42913887 | 42913908 | 42913892 | 42913887 | - |
| SEQ ID NO 62246 | GGAGGTCGAACCCTGCACCCAG | TTT | chr17 | 42913886 | 42913907 | 42913891 | 42913886 | - |
| SEQ ID NO 62247 | GAGGTCGAACCCTGCACCCAGG | TTG | chr17 | 42913885 | 42913906 | 42913890 | 42913885 | - |
| SEQ ID NO 62248 | CACCCAGGATGAAATAAATCTC | CTG | chr17 | 42913871 | 42913892 | 42913876 | 42913871 | - |
| SEQ ID NO 62249 | TTAGCAGAGAAACCTGCAATAG | CTC | chr17 | 42913849 | 42913870 | 42913854 | 42913849 | - |
| SEQ ID NO 62250 | AGCAGAGAAACCTGCAATAGCT | CTT | chr17 | 42913847 | 42913868 | 42913852 | 42913847 | - |
| SEQ ID NO 62251 | GCAGAGAAACCTGCAATAGCTC | TTA | chr17 | 42913846 | 42913867 | 42913851 | 42913846 | - |
| SEQ ID NO 62252 | CAATAGCTCCCTTGAGCATTCC | CTG | chr17 | 42913833 | 42913854 | 42913838 | 42913833 | - |
| SEQ ID NO 62253 | CCTTGAGCATTCCTTGGTGCTG | CTC | chr17 | 42913824 | 42913845 | 42913829 | 42913824 | - |
| SEQ ID NO 62254 | GAGCATTCCTTGGTGCTGTGAC | CTT | chr17 | 42913820 | 42913841 | 42913825 | 42913820 | - |
| SEQ ID NO 62255 | AGCATTCCTTGGTGCTGTGACT | TTG | chr17 | 42913819 | 42913840 | 42913824 | 42913819 | - |
| SEQ ID NO 62256 | CTTGGTGCTGTGACTGGCTCTG | TTC | chr17 | 42913812 | 42913833 | 42913817 | 42913812 | - |
| SEQ ID NO 62257 | GGTGCTGTGACTGGCTCTGTTT | CTT | chr17 | 42913809 | 42913830 | 42913814 | 42913809 | - |
| SEQ ID NO 62258 | GTGCTGTGACTGGCTCTGTTTA | TTG | chr17 | 42913808 | 42913829 | 42913813 | 42913808 | - |
| SEQ ID NO 62259 | TGACTGGCTCTGTTTAGACTTT | CTG | chr17 | 42913802 | 42913823 | 42913807 | 42913802 | - |
| SEQ ID NO 62260 | GCTCTGTTTAGACTTTCTTGAA | CTG | chr17 | 42913796 | 42913817 | 42913801 | 42913796 | - |
| SEQ ID NO 62261 | TGTTTAGACTTTCTTGAACTAT | CTC | chr17 | 42913792 | 42913813 | 42913797 | 42913792 | - |
| SEQ ID NO 62262 | TTTAGACTTTCTTGAACTATAA | CTG | chr17 | 42913790 | 42913811 | 42913795 | 42913790 | - |
| SEQ ID NO 62263 | AGACTTTCTTGAACTATAACCC | TTT | chr17 | 42913787 | 42913808 | 42913792 | 42913787 | - |
| SEQ ID NO 62264 | GACTTTCTTGAACTATAACCCA | TTA | chr17 | 42913786 | 42913807 | 42913791 | 42913786 | - |
| SEQ ID NO 62265 | TCTTGAACTATAACCCAAAACC | CTT | chr17 | 42913781 | 42913802 | 42913786 | 42913781 | - |
| SEQ ID NO 62266 | CTTGAACTATAACCCAAAACCT | TTT | chr17 | 42913780 | 42913801 | 42913785 | 42913780 | - |
| SEQ ID NO 62267 | TTGAACTATAACCCAAAACCTT | TTC | chr17 | 42913779 | 42913800 | 42913784 | 42913779 | - |
| SEQ ID NO 62268 | GAACTATAACCCAAAACCTTGC | CTT | chr17 | 42913777 | 42913798 | 42913782 | 42913777 | - |
| SEQ ID NO 62269 | AACTATAACCCAAAACCTTGCT | TTG | chr17 | 42913776 | 42913797 | 42913781 | 42913776 | - |
| SEQ ID NO 62270 | TAACCCAAAACCTTGCTGACAC | CTA | chr17 | 42913771 | 42913792 | 42913776 | 42913771 | - |
| SEQ ID NO 62271 | GCTGACACTGAGTTACTGGATT | CTT | chr17 | 42913757 | 42913778 | 42913762 | 42913757 | - |
| SEQ ID NO 62272 | CTGACACTGAGTTACTGGATTC | TTG | chr17 | 42913756 | 42913777 | 42913761 | 42913756 | - |
| SEQ ID NO 62273 | ACACTGAGTTACTGGATTCCAG | CTG | chr17 | 42913753 | 42913774 | 42913758 | 42913753 | - |
| SEQ ID NO 62274 | AGTTACTGGATTCCAGAGCTGG | CTG | chr17 | 42913747 | 42913768 | 42913752 | 42913747 | - |
| SEQ ID NO 62275 | CTGGATTCCAGAGCTGGCCTAG | TTA | chr17 | 42913742 | 42913763 | 42913747 | 42913742 | - |
| SEQ ID NO 62276 | GATTCCAGAGCTGGCCTAGTCT | CTG | chr17 | 42913739 | 42913760 | 42913744 | 42913739 | - |
| SEQ ID NO 62277 | CAGAGCTGGCCTAGTCTTGTTG | TTC | chr17 | 42913734 | 42913755 | 42913739 | 42913734 | - |
| SEQ ID NO 62278 | GCCTAGTCTTGTTGTGTTACTG | CTG | chr17 | 42913726 | 42913747 | 42913731 | 42913726 | - |
| SEQ ID NO 62279 | GTCTTGTTGTGTTACTGCAACT | CTA | chr17 | 42913721 | 42913742 | 42913726 | 42913721 | - |
| SEQ ID NO 62280 | GTTGTGTTACTGCAACTTGTGT | CTT | chr17 | 42913716 | 42913737 | 42913721 | 42913716 | - |
| SEQ ID NO 62281 | TTGTGTTACTGCAACTTGTGTG | TTG | chr17 | 42913715 | 42913736 | 42913720 | 42913715 | - |
| SEQ ID NO 62282 | TGTTACTGCAACTTGTGTGCCC | TTG | chr17 | 42913712 | 42913733 | 42913717 | 42913712 | - |

Figure 90 (Cont'd)

| | | | | | | | | |
|---|---|---|---|---|---|---|---|---|
| SEQ ID NO 62283 | CTGCAACTTGTGTGCCCTGATT | TTA | chr17 | 42913707 | 42913728 | 42913712 | 42913707 | - |
| SEQ ID NO 62284 | CAACTTGTGTGCCCTGATTGCT | CTG | chr17 | 42913704 | 42913725 | 42913709 | 42913704 | - |
| SEQ ID NO 62285 | GTGTGCCCTGATTGCTTAATTT | CTT | chr17 | 42913698 | 42913719 | 42913703 | 42913698 | - |
| SEQ ID NO 62286 | TGTGCCCTGATTGCTTAATTTG | TTG | chr17 | 42913697 | 42913718 | 42913702 | 42913697 | - |
| SEQ ID NO 62287 | ATTGCTTAATTTGATAGTGACC | CTG | chr17 | 42913688 | 42913709 | 42913693 | 42913688 | - |
| SEQ ID NO 62288 | CTTAATTTGATAGTGACCCTGC | TTG | chr17 | 42913684 | 42913705 | 42913689 | 42913684 | - |
| SEQ ID NO 62289 | AATTTGATAGTGACCCTGCCCA | CTT | chr17 | 42913681 | 42913702 | 42913686 | 42913681 | - |
| SEQ ID NO 62290 | ATTTGATAGTGACCCTGCCCAT | TTA | chr17 | 42913680 | 42913701 | 42913685 | 42913680 | - |
| SEQ ID NO 62291 | GATAGTGACCCTGCCCATCTAC | TTT | chr17 | 42913676 | 42913697 | 42913681 | 42913676 | - |
| SEQ ID NO 62292 | ATAGTGACCCTGCCCATCTACT | TTG | chr17 | 42913675 | 42913696 | 42913680 | 42913675 | - |
| SEQ ID NO 62293 | CCCATCTACTCTCAAGTTGCAA | CTG | chr17 | 42913663 | 42913684 | 42913668 | 42913663 | - |
| SEQ ID NO 62294 | CTCTCAAGTTGCAATTTGATGC | CTA | chr17 | 42913655 | 42913676 | 42913660 | 42913655 | - |
| SEQ ID NO 62295 | TCAAGTTGCAATTTGATGCCAT | CTC | chr17 | 42913652 | 42913673 | 42913657 | 42913652 | - |
| SEQ ID NO 62296 | AAGTTGCAATTTGATGCCATAG | CTC | chr17 | 42913650 | 42913671 | 42913655 | 42913650 | - |
| SEQ ID NO 62297 | CAATTTGATGCCATAGAGCAAC | TTG | chr17 | 42913644 | 42913665 | 42913649 | 42913644 | - |
| SEQ ID NO 62298 | GATGCCATAGAGCAACTCATGC | TTT | chr17 | 42913638 | 42913659 | 42913643 | 42913638 | - |
| SEQ ID NO 62299 | ATGCCATAGAGCAACTCATGCT | TTG | chr17 | 42913637 | 42913658 | 42913642 | 42913637 | - |
| SEQ ID NO 62300 | ATGCTGACTTGTGGTCTGGTAG | CTC | chr17 | 42913620 | 42913641 | 42913625 | 42913620 | - |
| SEQ ID NO 62301 | ACTTGTGGTCTGGTAGCCAATG | CTG | chr17 | 42913614 | 42913635 | 42913619 | 42913614 | - |
| SEQ ID NO 62302 | GTGGTCTGGTAGCCAATGTTCA | CTT | chr17 | 42913610 | 42913631 | 42913615 | 42913610 | - |
| SEQ ID NO 62303 | TGGTCTGGTAGCCAATGTTCAT | TTG | chr17 | 42913609 | 42913630 | 42913614 | 42913609 | - |
| SEQ ID NO 62304 | GTAGCCAATGTTCATTCTTGGC | CTG | chr17 | 42913602 | 42913623 | 42913607 | 42913602 | - |
| SEQ ID NO 62305 | ATTCTTGGCCAACTCTGAATCT | TTC | chr17 | 42913589 | 42913610 | 42913594 | 42913589 | - |
| SEQ ID NO 62306 | TTGGCCAACTCTGAATCTTTCT | TTC | chr17 | 42913585 | 42913606 | 42913590 | 42913585 | - |
| SEQ ID NO 62307 | GGCCAACTCTGAATCTTTCTGG | CTT | chr17 | 42913583 | 42913604 | 42913588 | 42913583 | - |
| SEQ ID NO 62308 | GCCAACTCTGAATCTTTCTGGT | TTG | chr17 | 42913582 | 42913603 | 42913587 | 42913582 | - |
| SEQ ID NO 62309 | TGAATCTTTCTGGTTCTATGCT | CTC | chr17 | 42913574 | 42913595 | 42913579 | 42913574 | - |
| SEQ ID NO 62310 | AATCTTTCTGGTTCTATGCTGA | CTG | chr17 | 42913572 | 42913593 | 42913577 | 42913572 | - |
| SEQ ID NO 62311 | TCTGGTTCTATGCTGATTTTGG | CTT | chr17 | 42913566 | 42913587 | 42913571 | 42913566 | - |
| SEQ ID NO 62312 | CTGGTTCTATGCTGATTTTGGG | TTT | chr17 | 42913565 | 42913586 | 42913570 | 42913565 | - |
| SEQ ID NO 62313 | TGGTTCTATGCTGATTTTGGGC | TTC | chr17 | 42913564 | 42913585 | 42913569 | 42913564 | - |
| SEQ ID NO 62314 | GTTCTATGCTGATTTTGGGCCT | CTG | chr17 | 42913562 | 42913583 | 42913567 | 42913562 | - |
| SEQ ID NO 62315 | TATGCTGATTTTGGGCCTCCGT | TTC | chr17 | 42913558 | 42913579 | 42913563 | 42913558 | - |
| SEQ ID NO 62316 | TGCTGATTTTGGGCCTCCGTTT | CTA | chr17 | 42913556 | 42913577 | 42913561 | 42913556 | - |
| SEQ ID NO 62317 | ATTTTGGGCCTCCGTTTATGTG | CTG | chr17 | 42913551 | 42913572 | 42913556 | 42913551 | - |
| SEQ ID NO 62318 | TGGGCCTCCGTTTATGTGCTCA | TTT | chr17 | 42913547 | 42913568 | 42913552 | 42913547 | - |
| SEQ ID NO 62319 | GGGCCTCCGTTTATGTGCTCAA | TTT | chr17 | 42913546 | 42913567 | 42913551 | 42913546 | - |
| SEQ ID NO 62320 | GGCCTCCGTTTATGTGCTCAAC | TTG | chr17 | 42913545 | 42913566 | 42913550 | 42913545 | - |
| SEQ ID NO 62321 | CGTTTATGTGCTCAACTCTGCC | CTC | chr17 | 42913539 | 42913560 | 42913544 | 42913539 | - |
| SEQ ID NO 62322 | ATGTGCTCAACTCTGCCTGTGC | TTT | chr17 | 42913534 | 42913555 | 42913539 | 42913534 | - |
| SEQ ID NO 62323 | TGTGCTCAACTCTGCCTGTGCC | TTA | chr17 | 42913533 | 42913554 | 42913538 | 42913533 | - |
| SEQ ID NO 62324 | AACTCTGCCTGTGCCCCTGTGG | CTC | chr17 | 42913526 | 42913547 | 42913531 | 42913526 | - |
| SEQ ID NO 62325 | TGCCTGTGCCCCTGTGGATGCA | CTC | chr17 | 42913521 | 42913542 | 42913526 | 42913521 | - |
| SEQ ID NO 62326 | CCTGTGCCCCTGTGGATGCATT | CTG | chr17 | 42913519 | 42913540 | 42913524 | 42913519 | - |
| SEQ ID NO 62327 | TGCCCCTGTGGATGCATTTAAG | CTG | chr17 | 42913515 | 42913536 | 42913520 | 42913515 | - |
| SEQ ID NO 62328 | TGGATGCATTTAAGTCTCCCTA | CTG | chr17 | 42913507 | 42913528 | 42913512 | 42913507 | - |
| SEQ ID NO 62329 | AAGTCTCCCTATCCCTAATGGG | TTT | chr17 | 42913496 | 42913517 | 42913501 | 42913496 | - |
| SEQ ID NO 62330 | AGTCTCCCTATCCCTAATGGGA | TTA | chr17 | 42913495 | 42913516 | 42913500 | 42913495 | - |
| SEQ ID NO 62331 | CCTATCCCTAATGGGACTCTCG | CTC | chr17 | 42913489 | 42913510 | 42913494 | 42913489 | - |
| SEQ ID NO 62332 | TCCCTAATGGGACTCTCGGTCA | CTA | chr17 | 42913485 | 42913506 | 42913490 | 42913485 | - |
| SEQ ID NO 62333 | ATGGGACTCTCGGTCAACTCAA | CTA | chr17 | 42913479 | 42913500 | 42913484 | 42913479 | - |
| SEQ ID NO 62334 | TCGGTCAACTCAAGAGAGAGCA | CTC | chr17 | 42913470 | 42913491 | 42913475 | 42913470 | - |
| SEQ ID NO 62335 | GGTCAACTCAAGAGAGAGCACT | CTC | chr17 | 42913468 | 42913489 | 42913473 | 42913468 | - |
| SEQ ID NO 62336 | AAGAGAGAGCACTTTTCTTCTC | CTC | chr17 | 42913459 | 42913480 | 42913464 | 42913459 | - |
| SEQ ID NO 62337 | TTCTTCTCCAAAGGGAAAATGC | CTT | chr17 | 42913445 | 42913466 | 42913450 | 42913445 | - |
| SEQ ID NO 62338 | TCTTCTCCAAAGGGAAAATGCA | TTT | chr17 | 42913444 | 42913465 | 42913449 | 42913444 | - |
| SEQ ID NO 62339 | CTTCTCCAAAGGGAAAATGCAG | TTT | chr17 | 42913443 | 42913464 | 42913448 | 42913443 | - |
| SEQ ID NO 62340 | TTCTCCAAAGGGAAAATGCAGG | TTC | chr17 | 42913442 | 42913463 | 42913447 | 42913442 | - |

Figure 90 (Cont'd)

| SEQ ID NO 62341 | CTCCAAAGGGAAAATGCAGGCA | CTT | chr17 | 42913440 | 42913461 | 42913445 | 42913440 | - |
| SEQ ID NO 62342 | TCCAAAGGGAAAATGCAGGCAC | TTC | chr17 | 42913439 | 42913460 | 42913444 | 42913439 | - |
| SEQ ID NO 62343 | CAAAGGGAAAATGCAGGCACAG | CTC | chr17 | 42913437 | 42913458 | 42913442 | 42913437 | - |
| SEQ ID NO 62344 | TTTGTTTAGGGAAACAGAGCTA | TTA | chr17 | 42913402 | 42913423 | 42913407 | 42913402 | - |
| SEQ ID NO 62345 | GTTTAGGGAAACAGAGCTAGAA | TTT | chr17 | 42913399 | 42913420 | 42913404 | 42913399 | - |
| SEQ ID NO 62346 | TTTAGGGAAACAGAGCTAGAAA | TTG | chr17 | 42913398 | 42913419 | 42913403 | 42913398 | - |
| SEQ ID NO 62347 | AGGGAAACAGAGCTAGAAATTT | TTT | chr17 | 42913395 | 42913416 | 42913400 | 42913395 | - |
| SEQ ID NO 62348 | GGGAAACAGAGCTAGAAATTTA | TTA | chr17 | 42913394 | 42913415 | 42913399 | 42913394 | - |
| SEQ ID NO 62349 | GAAATTTAGTTGGGCCAGAATT | CTA | chr17 | 42913380 | 42913401 | 42913385 | 42913380 | - |
| SEQ ID NO 62350 | AGTTGGGCCAGAATTAGAAACT | TTT | chr17 | 42913373 | 42913394 | 42913378 | 42913373 | - |
| SEQ ID NO 62351 | GTTGGGCCAGAATTAGAAACTT | TTA | chr17 | 42913372 | 42913393 | 42913377 | 42913372 | - |
| SEQ ID NO 62352 | GGCCAGAATTAGAAACTTCAGA | TTG | chr17 | 42913368 | 42913389 | 42913373 | 42913368 | - |
| SEQ ID NO 62353 | GAAACTTCAGATCACATTGCAT | TTA | chr17 | 42913357 | 42913378 | 42913362 | 42913357 | - |
| SEQ ID NO 62354 | CAGATCACATTGCATCTAAAAT | CTT | chr17 | 42913350 | 42913371 | 42913355 | 42913350 | - |
| SEQ ID NO 62355 | AGATCACATTGCATCTAAAATA | TTC | chr17 | 42913349 | 42913370 | 42913354 | 42913349 | - |
| SEQ ID NO 62356 | CATCTAAAATATAGTAATTAAC | TTG | chr17 | 42913338 | 42913359 | 42913343 | 42913338 | - |
| SEQ ID NO 62357 | AAATATAGTAATTAACAAGACT | CTA | chr17 | 42913332 | 42913353 | 42913337 | 42913332 | - |
| SEQ ID NO 62358 | ACAAGACTTTATTCTTAAATAA | TTA | chr17 | 42913318 | 42913339 | 42913323 | 42913318 | - |
| SEQ ID NO 62359 | TATTCTTAAATAAAATGTTGCT | CTT | chr17 | 42913309 | 42913330 | 42913314 | 42913309 | - |
| SEQ ID NO 62360 | ATTCTTAAATAAAATGTTGCTT | TTT | chr17 | 42913308 | 42913329 | 42913313 | 42913308 | - |
| SEQ ID NO 62361 | TTCTTAAATAAAATGTTGCTTT | TTA | chr17 | 42913307 | 42913328 | 42913312 | 42913307 | - |
| SEQ ID NO 62362 | TTAAATAAAATGTTGCTTTAAT | TTC | chr17 | 42913304 | 42913325 | 42913309 | 42913304 | - |
| SEQ ID NO 62363 | AAATAAAATGTTGCTTTAATAA | CTT | chr17 | 42913302 | 42913323 | 42913307 | 42913302 | - |
| SEQ ID NO 62364 | AATAAAATGTTGCTTTAATAAA | TTA | chr17 | 42913301 | 42913322 | 42913306 | 42913301 | - |
| SEQ ID NO 62365 | CTTTAATAAAATACTGCACATA | TTG | chr17 | 42913289 | 42913310 | 42913294 | 42913289 | - |
| SEQ ID NO 62366 | TAATAAAATACTGCACATATAT | CTT | chr17 | 42913286 | 42913307 | 42913291 | 42913286 | - |
| SEQ ID NO 62367 | AATAAAATACTGCACATATATA | TTT | chr17 | 42913285 | 42913306 | 42913290 | 42913285 | - |
| SEQ ID NO 62368 | ATAAAATACTGCACATATATAT | TTA | chr17 | 42913284 | 42913305 | 42913289 | 42913284 | - |
| SEQ ID NO 62369 | CACATATATATTTTTCTTTTCA | CTG | chr17 | 42913273 | 42913294 | 42913278 | 42913273 | - |
| SEQ ID NO 62370 | TTCTTTTCAAAGATGTTATGAG | TTT | chr17 | 42913260 | 42913281 | 42913265 | 42913260 | - |
| SEQ ID NO 62371 | TCTTTTCAAAGATGTTATGAGC | TTT | chr17 | 42913259 | 42913280 | 42913264 | 42913259 | - |
| SEQ ID NO 62372 | CTTTTCAAAGATGTTATGAGCA | TTT | chr17 | 42913258 | 42913279 | 42913263 | 42913258 | - |
| SEQ ID NO 62373 | TTTTCAAAGATGTTATGAGCAG | TTC | chr17 | 42913257 | 42913278 | 42913262 | 42913257 | - |
| SEQ ID NO 62374 | TTCAAAGATGTTATGAGCAGGA | CTT | chr17 | 42913255 | 42913276 | 42913260 | 42913255 | - |
| SEQ ID NO 62375 | TCAAAGATGTTATGAGCAGGAT | TTT | chr17 | 42913254 | 42913275 | 42913259 | 42913254 | - |
| SEQ ID NO 62376 | CAAAGATGTTATGAGCAGGATG | TTT | chr17 | 42913253 | 42913274 | 42913258 | 42913253 | - |
| SEQ ID NO 62377 | AAAGATGTTATGAGCAGGATGG | TTC | chr17 | 42913252 | 42913273 | 42913257 | 42913252 | - |
| SEQ ID NO 62378 | TGAGCAGGATGGTTGTTTGAA | TTA | chr17 | 42913242 | 42913263 | 42913247 | 42913242 | - |
| SEQ ID NO 62379 | TTTTGAATGATAATGTATGGTA | TTG | chr17 | 42913227 | 42913248 | 42913232 | 42913227 | - |
| SEQ ID NO 62380 | TGAATGATAATGTATGGTATAC | TTT | chr17 | 42913224 | 42913245 | 42913229 | 42913224 | - |
| SEQ ID NO 62381 | GAATGATAATGTATGGTATACT | TTT | chr17 | 42913223 | 42913244 | 42913228 | 42913223 | - |
| SEQ ID NO 62382 | AATGATAATGTATGGTATACTA | TTG | chr17 | 42913222 | 42913243 | 42913227 | 42913222 | - |
| SEQ ID NO 62383 | TATAATTAGTAGCAAAACAAG | CTA | chr17 | 42913200 | 42913221 | 42913205 | 42913200 | - |
| SEQ ID NO 62384 | GTAGCAAAACAAGGACTTTCA | TTA | chr17 | 42913192 | 42913213 | 42913197 | 42913192 | - |
| SEQ ID NO 62385 | TCAAATAAATAGGCTTCAGCTT | CTT | chr17 | 42913173 | 42913194 | 42913178 | 42913173 | - |
| SEQ ID NO 62386 | CAAATAAATAGGCTTCAGCTTT | TTT | chr17 | 42913172 | 42913193 | 42913177 | 42913172 | - |
| SEQ ID NO 62387 | AAATAAATAGGCTTCAGCTTTT | TTC | chr17 | 42913171 | 42913192 | 42913176 | 42913171 | - |
| SEQ ID NO 62388 | CAGCTTTTTTTGGGGGGTAGGT | CTT | chr17 | 42913157 | 42913178 | 42913162 | 42913157 | - |
| SEQ ID NO 62389 | AGCTTTTTTTGGGGGGTAGGTG | TTC | chr17 | 42913156 | 42913177 | 42913161 | 42913156 | - |
| SEQ ID NO 62390 | TTTTTGGGGGGTAGGTGGGTGG | CTT | chr17 | 42913151 | 42913172 | 42913156 | 42913151 | - |
| SEQ ID NO 62391 | TTTTGGGGGGTAGGTGGGTGGG | TTT | chr17 | 42913150 | 42913171 | 42913155 | 42913150 | - |
| SEQ ID NO 62392 | TTTGGGGGGTAGGTGGGTGGGG | TTT | chr17 | 42913149 | 42913170 | 42913154 | 42913149 | - |
| SEQ ID NO 62393 | TTGGGGGGTAGGTGGGTGGGGC | TTT | chr17 | 42913148 | 42913169 | 42913153 | 42913148 | - |
| SEQ ID NO 62394 | TGGGGGGTAGGTGGGTGGGGCA | TTT | chr17 | 42913147 | 42913168 | 42913152 | 42913147 | - |
| SEQ ID NO 62395 | GGGGGGTAGGTGGGTGGGGCAG | TTT | chr17 | 42913146 | 42913167 | 42913151 | 42913146 | - |
| SEQ ID NO 62396 | GGGGGTAGGTGGGTGGGGCAGA | TTG | chr17 | 42913145 | 42913166 | 42913150 | 42913145 | - |
| SEQ ID NO 62397 | TGCATATCAGATGAGATTGAAA | CTC | chr17 | 42913116 | 42913137 | 42913121 | 42913116 | - |
| SEQ ID NO 62398 | CATATCAGATGAGATTGAAAAA | CTG | chr17 | 42913114 | 42913135 | 42913119 | 42913114 | - |

Figure 90 (Cont'd)

| | | | | | | | | |
|---|---|---|---|---|---|---|---|---|
| SEQ ID NO 62399 | AAAAACAGGCAAGGAGGGCCCG | TTG | chr17 | 42913097 | 42913118 | 42913102 | 42913097 | - |
| SEQ ID NO 62400 | ATGCCTGTAATCCTAGCACCTT | CTC | chr17 | 42913063 | 42913084 | 42913068 | 42913063 | - |
| SEQ ID NO 62401 | TAATCCTAGCACCTTGGGAGGC | CTG | chr17 | 42913056 | 42913077 | 42913061 | 42913056 | - |
| SEQ ID NO 62402 | GCACCTTGGGAGGCCAAGGCAG | CTA | chr17 | 42913048 | 42913069 | 42913053 | 42913048 | - |
| SEQ ID NO 62403 | GGGAGGCCAAGGCAGGTGGATC | CTT | chr17 | 42913041 | 42913062 | 42913046 | 42913041 | - |
| SEQ ID NO 62404 | GGAGGCCAAGGCAGGTGGATCA | TTG | chr17 | 42913040 | 42913061 | 42913045 | 42913040 | - |
| SEQ ID NO 62405 | GAGGTCAGGAGTTCGAGACCAG | CTT | chr17 | 42913015 | 42913036 | 42913020 | 42913015 | - |
| SEQ ID NO 62406 | AGGTCAGGAGTTCGAGACCAGC | TTG | chr17 | 42913014 | 42913035 | 42913019 | 42913014 | - |
| SEQ ID NO 62407 | GAGACCAGCCTGGCCAACATGA | TTC | chr17 | 42913001 | 42913022 | 42913006 | 42913001 | - |
| SEQ ID NO 62408 | GCCAACATGATGAAATCCCATC | CTG | chr17 | 42912989 | 42913010 | 42912994 | 42912989 | - |
| SEQ ID NO 62409 | TTCTAAAATTCTAAAAATATAA | CTC | chr17 | 42912965 | 42912986 | 42912970 | 42912965 | - |
| SEQ ID NO 62410 | CTAAAATTCTAAAAATATAAAA | CTT | chr17 | 42912963 | 42912984 | 42912968 | 42912963 | - |
| SEQ ID NO 62411 | TAAAATTCTAAAAATATAAAAA | TTC | chr17 | 42912962 | 42912983 | 42912967 | 42912962 | - |
| SEQ ID NO 62412 | AAATTCTAAAAATATAAAAATT | CTA | chr17 | 42912960 | 42912981 | 42912965 | 42912960 | - |
| SEQ ID NO 62413 | TAAAAATATAAAAATTAGCCTG | TTC | chr17 | 42912954 | 42912975 | 42912959 | 42912954 | - |
| SEQ ID NO 62414 | AAAATATAAAAATTAGCCTGGC | CTA | chr17 | 42912952 | 42912973 | 42912957 | 42912952 | - |
| SEQ ID NO 62415 | GCCTGGCATGGTGGTGCACGCC | TTA | chr17 | 42912937 | 42912958 | 42912942 | 42912937 | - |
| SEQ ID NO 62416 | GCATGGTGGTGCACGCCGGTAG | CTG | chr17 | 42912932 | 42912953 | 42912937 | 42912932 | - |
| SEQ ID NO 62417 | GCTACTGAGGAGGCTGAGACAT | CTA | chr17 | 42912905 | 42912926 | 42912910 | 42912905 | - |
| SEQ ID NO 62418 | CTGAGGAGGCTGAGACATGAGA | CTA | chr17 | 42912901 | 42912922 | 42912906 | 42912901 | - |
| SEQ ID NO 62419 | AGGAGGCTGAGACATGAGAATC | CTG | chr17 | 42912898 | 42912919 | 42912903 | 42912898 | - |
| SEQ ID NO 62420 | AGACATGAGAATCGCTTGAACC | CTG | chr17 | 42912889 | 42912910 | 42912894 | 42912889 | - |
| SEQ ID NO 62421 | GAACCAGGAGGAAGAGGTTGCA | CTT | chr17 | 42912872 | 42912893 | 42912877 | 42912872 | - |
| SEQ ID NO 62422 | AACCAGGAGGAAGAGGTTGCAG | TTG | chr17 | 42912871 | 42912892 | 42912876 | 42912871 | - |
| SEQ ID NO 62423 | CAGTGAGCCAAGATCGTGCCAC | TTG | chr17 | 42912852 | 42912873 | 42912857 | 42912852 | - |
| SEQ ID NO 62424 | CACTCCAGCCTGGGTGATAGGT | CTC | chr17 | 42912828 | 42912849 | 42912833 | 42912828 | - |
| SEQ ID NO 62425 | CAGCCTGGGTGATAGGTGCGCC | CTC | chr17 | 42912823 | 42912844 | 42912828 | 42912823 | - |
| SEQ ID NO 62426 | GGTGATAGGTGCGCCGTCTCAA | CTG | chr17 | 42912816 | 42912837 | 42912821 | 42912816 | - |
| SEQ ID NO 62427 | AAAAAAAGAAAAAAAAAGAAAA | CTC | chr17 | 42912796 | 42912817 | 42912801 | 42912796 | - |
| SEQ ID NO 62428 | GCTAGCTGGACATAGTGGCTTG | TTG | chr17 | 42912756 | 42912777 | 42912761 | 42912756 | - |
| SEQ ID NO 62429 | GCTGGACATAGTGGCTTGCACC | CTA | chr17 | 42912752 | 42912773 | 42912757 | 42912752 | - |
| SEQ ID NO 62430 | GACATAGTGGCTTGCACCTGTA | CTG | chr17 | 42912748 | 42912769 | 42912753 | 42912748 | - |
| SEQ ID NO 62431 | GCACCTGTAGTCCCAGCTACGC | CTT | chr17 | 42912735 | 42912756 | 42912740 | 42912735 | - |
| SEQ ID NO 62432 | CACCTGTAGTCCCAGCTACGCG | TTG | chr17 | 42912734 | 42912755 | 42912739 | 42912734 | - |
| SEQ ID NO 62433 | TAGTCCCAGCTACGCGGGACGC | CTG | chr17 | 42912728 | 42912749 | 42912733 | 42912728 | - |
| SEQ ID NO 62434 | CGCGGGACGCTGTGGTAGGGTG | CTA | chr17 | 42912716 | 42912737 | 42912721 | 42912716 | - |
| SEQ ID NO 62435 | TGGTAGGGTGGGAGGACTGCTT | CTG | chr17 | 42912704 | 42912725 | 42912709 | 42912704 | - |
| SEQ ID NO 62436 | CTTGAGCCCAGGAATTCAAGAG | CTG | chr17 | 42912685 | 42912706 | 42912690 | 42912685 | - |
| SEQ ID NO 62437 | GAGCCCAGGAATTCAAGAGCAG | CTT | chr17 | 42912682 | 42912703 | 42912687 | 42912682 | - |
| SEQ ID NO 62438 | AGCCCAGGAATTCAAGAGCAGC | TTG | chr17 | 42912681 | 42912702 | 42912686 | 42912681 | - |
| SEQ ID NO 62439 | AAGAGCAGCCTGGGCAACATAG | TTC | chr17 | 42912668 | 42912689 | 42912673 | 42912668 | - |
| SEQ ID NO 62440 | GGCAACATAGTGAGACCCTGTC | CTG | chr17 | 42912656 | 42912677 | 42912661 | 42912656 | - |
| SEQ ID NO 62441 | TCTCAAAAAAAAAAAAAAAGAG | CTG | chr17 | 42912636 | 42912657 | 42912641 | 42912636 | - |
| SEQ ID NO 62442 | AAAAAAAAAAAAAAAGAGAGAA | CTC | chr17 | 42912632 | 42912653 | 42912637 | 42912632 | - |
| SEQ ID NO 62443 | ACTTTTCCTTTAAGAATGTGCT | TTG | chr17 | 42912603 | 42912624 | 42912608 | 42912603 | - |
| SEQ ID NO 62444 | TTCCTTTAAGAATGTGCTCTTG | CTT | chr17 | 42912599 | 42912620 | 42912604 | 42912599 | - |
| SEQ ID NO 62445 | TCCTTTAAGAATGTGCTCTTGG | TTT | chr17 | 42912598 | 42912619 | 42912603 | 42912598 | - |
| SEQ ID NO 62446 | CCTTTAAGAATGTGCTCTTGGT | TTT | chr17 | 42912597 | 42912618 | 42912602 | 42912597 | - |
| SEQ ID NO 62447 | CTTTAAGAATGTGCTCTTGGTT | TTC | chr17 | 42912596 | 42912617 | 42912601 | 42912596 | - |
| SEQ ID NO 62448 | TAAGAATGTGCTCTTGGTTGGC | CTT | chr17 | 42912593 | 42912614 | 42912598 | 42912593 | - |
| SEQ ID NO 62449 | AAGAATGTGCTCTTGGTTGGCT | TTT | chr17 | 42912592 | 42912613 | 42912597 | 42912592 | - |
| SEQ ID NO 62450 | AGAATGTGCTCTTGGTTGGCTT | TTA | chr17 | 42912591 | 42912612 | 42912596 | 42912591 | - |
| SEQ ID NO 62451 | TTGGTTGGCTTGGGATAGAGAA | CTC | chr17 | 42912580 | 42912601 | 42912585 | 42912580 | - |
| SEQ ID NO 62452 | GGTTGGCTTGGGATAGAGAAAG | CTT | chr17 | 42912578 | 42912599 | 42912583 | 42912578 | - |
| SEQ ID NO 62453 | GTTGGCTTGGGATAGAGAAAGG | TTG | chr17 | 42912577 | 42912598 | 42912582 | 42912577 | - |
| SEQ ID NO 62454 | GCTTGGGATAGAGAAAGGAGTC | TTG | chr17 | 42912573 | 42912594 | 42912578 | 42912573 | - |
| SEQ ID NO 62455 | GGGATAGAGAAAGGAGTCATAT | CTT | chr17 | 42912569 | 42912590 | 42912574 | 42912569 | - |
| SEQ ID NO 62456 | GGATAGAGAAAGGAGTCATATT | TTG | chr17 | 42912568 | 42912589 | 42912573 | 42912568 | - |

Figure 90 (Cont'd)

| SEQ ID NO 62457 | ACCCTCTAGGAATTAAAAGTAA | TTT | chr17 | 42912545 | 42912566 | 42912550 | 42912545 | - |
|---|---|---|---|---|---|---|---|---|
| SEQ ID NO 62458 | CCCTCTAGGAATTAAAAGTAAC | TTA | chr17 | 42912544 | 42912565 | 42912549 | 42912544 | - |
| SEQ ID NO 62459 | TAGGAATTAAAAGTAACACTGG | CTC | chr17 | 42912539 | 42912560 | 42912544 | 42912539 | - |
| SEQ ID NO 62460 | GGAATTAAAAGTAACACTGGAG | CTA | chr17 | 42912537 | 42912558 | 42912542 | 42912537 | - |
| SEQ ID NO 62461 | AAAGTAACACTGGAGTGACCTG | TTA | chr17 | 42912530 | 42912551 | 42912535 | 42912530 | - |
| SEQ ID NO 62462 | GAGTGACCTGAGAGAGGAATCC | CTG | chr17 | 42912518 | 42912539 | 42912523 | 42912518 | - |
| SEQ ID NO 62463 | AGAGAGGAATCCTGGCCCTCCC | CTG | chr17 | 42912508 | 42912529 | 42912513 | 42912508 | - |
| SEQ ID NO 62464 | GCCCTCCCCTTGTCATTTTGCC | CTG | chr17 | 42912494 | 42912515 | 42912499 | 42912494 | - |
| SEQ ID NO 62465 | CCCTTGTCATTTTGCCCAAGAT | CTC | chr17 | 42912488 | 42912509 | 42912493 | 42912488 | - |
| SEQ ID NO 62466 | GTCATTTTGCCCAAGATTTCAG | CTT | chr17 | 42912483 | 42912504 | 42912488 | 42912483 | - |
| SEQ ID NO 62467 | TCATTTTGCCCAAGATTTCAGA | TTG | chr17 | 42912482 | 42912503 | 42912487 | 42912482 | - |
| SEQ ID NO 62468 | TGCCCAAGATTTCAGAGCCTAA | TTT | chr17 | 42912476 | 42912497 | 42912481 | 42912476 | - |
| SEQ ID NO 62469 | GCCCAAGATTTCAGAGCCTAAT | TTT | chr17 | 42912475 | 42912496 | 42912480 | 42912475 | - |
| SEQ ID NO 62470 | CCCAAGATTTCAGAGCCTAATT | TTG | chr17 | 42912474 | 42912495 | 42912479 | 42912474 | - |
| SEQ ID NO 62471 | CAGAGCCTAATTGAAACATACA | TTT | chr17 | 42912464 | 42912485 | 42912469 | 42912464 | - |
| SEQ ID NO 62472 | AGAGCCTAATTGAAACATACAA | TTC | chr17 | 42912463 | 42912484 | 42912468 | 42912463 | - |
| SEQ ID NO 62473 | ATTGAAACATACAAAAGCACCA | CTA | chr17 | 42912455 | 42912476 | 42912460 | 42912455 | - |
| SEQ ID NO 62474 | AAACATACAAAAGCACCACCAG | TTG | chr17 | 42912451 | 42912472 | 42912456 | 42912451 | - |
| SEQ ID NO 62475 | TAGCCTTCTGAAGATCCAGTGG | CTC | chr17 | 42912419 | 42912440 | 42912424 | 42912419 | - |
| SEQ ID NO 62476 | GCCTTCTGAAGATCCAGTGGGG | CTA | chr17 | 42912417 | 42912438 | 42912422 | 42912417 | - |
| SEQ ID NO 62477 | CTGAAGATCCAGTGGGGTGGAT | CTT | chr17 | 42912412 | 42912433 | 42912417 | 42912412 | - |
| SEQ ID NO 62478 | TGAAGATCCAGTGGGGTGGATG | TTC | chr17 | 42912411 | 42912432 | 42912416 | 42912411 | - |
| SEQ ID NO 62479 | AAGATCCAGTGGGGTGGATGTG | CTG | chr17 | 42912409 | 42912430 | 42912414 | 42912409 | - |
| SEQ ID NO 62480 | GAAAAAGCAGAGCTGGGCTTAT | CTG | chr17 | 42912368 | 42912389 | 42912373 | 42912368 | - |
| SEQ ID NO 62481 | GGCTTATAAGGAGGATGATGTA | CTG | chr17 | 42912353 | 42912374 | 42912358 | 42912353 | - |
| SEQ ID NO 62482 | ATAAGGAGGATGATGTAATGTG | CTT | chr17 | 42912348 | 42912369 | 42912353 | 42912348 | - |
| SEQ ID NO 62483 | TAAGGAGGATGATGTAATGTGA | TTA | chr17 | 42912347 | 42912368 | 42912352 | 42912347 | - |
| SEQ ID NO 62484 | TACCTGAATGTTTTGACCTAGT | CTA | chr17 | 42912307 | 42912328 | 42912312 | 42912307 | - |
| SEQ ID NO 62485 | AATGTTTTGACCTAGTGCAATA | CTG | chr17 | 42912301 | 42912322 | 42912306 | 42912301 | - |
| SEQ ID NO 62486 | TGACCTAGTGCAATATCTGGGT | TTT | chr17 | 42912294 | 42912315 | 42912299 | 42912294 | - |
| SEQ ID NO 62487 | GACCTAGTGCAATATCTGGGTC | TTT | chr17 | 42912293 | 42912314 | 42912298 | 42912293 | - |
| SEQ ID NO 62488 | ACCTAGTGCAATATCTGGGTCA | TTG | chr17 | 42912292 | 42912313 | 42912297 | 42912292 | - |
| SEQ ID NO 62489 | GTGCAATATCTGGGTCACTGCA | CTA | chr17 | 42912287 | 42912308 | 42912292 | 42912287 | - |
| SEQ ID NO 62490 | GGTCACTGCAGCCATTCAGAAA | CTG | chr17 | 42912275 | 42912296 | 42912280 | 42912275 | - |
| SEQ ID NO 62491 | CAGCCATTCAGAAATCCAAGGA | CTG | chr17 | 42912267 | 42912288 | 42912272 | 42912267 | - |
| SEQ ID NO 62492 | AGAAATCCAAGGAAATACGATG | TTC | chr17 | 42912258 | 42912279 | 42912263 | 42912258 | - |
| SEQ ID NO 62493 | GAAGCAGAATTACCCCACTAAC | CTA | chr17 | 42912207 | 42912228 | 42912212 | 42912207 | - |
| SEQ ID NO 62494 | CCCCACTAACCATCTATTAATT | TTA | chr17 | 42912195 | 42912216 | 42912200 | 42912195 | - |
| SEQ ID NO 62495 | ACCATCTATTAATTATACTTAA | CTA | chr17 | 42912187 | 42912208 | 42912192 | 42912187 | - |
| SEQ ID NO 62496 | TTAATTATACTTAAGCTGGTCC | CTA | chr17 | 42912179 | 42912200 | 42912184 | 42912179 | - |
| SEQ ID NO 62497 | ATTATACTTAAGCTGGTCCCCC | TTA | chr17 | 42912176 | 42912197 | 42912181 | 42912176 | - |
| SEQ ID NO 62498 | TACTTAAGCTGGTCCCCCATTA | TTA | chr17 | 42912172 | 42912193 | 42912177 | 42912172 | - |
| SEQ ID NO 62499 | AAGCTGGTCCCCCATTACTGAG | CTT | chr17 | 42912167 | 42912188 | 42912172 | 42912167 | - |
| SEQ ID NO 62500 | AGCTGGTCCCCCATTACTGAGA | TTA | chr17 | 42912166 | 42912187 | 42912171 | 42912166 | - |
| SEQ ID NO 62501 | GTCCCCCATTACTGAGAGTGCA | CTG | chr17 | 42912161 | 42912182 | 42912166 | 42912161 | - |
| SEQ ID NO 62502 | CTGAGAGTGCATTACTATATAA | TTA | chr17 | 42912150 | 42912171 | 42912155 | 42912150 | - |
| SEQ ID NO 62503 | AGAGTGCATTACTATATAATTA | CTG | chr17 | 42912147 | 42912168 | 42912152 | 42912147 | - |
| SEQ ID NO 62504 | CTATATAATTAAAGCCATTTAG | TTA | chr17 | 42912136 | 42912157 | 42912141 | 42912136 | - |
| SEQ ID NO 62505 | TATAATTAAAGCCATTTAGACA | CTA | chr17 | 42912133 | 42912154 | 42912138 | 42912133 | - |
| SEQ ID NO 62506 | AAGCCATTTAGACATGGCTTGG | TTA | chr17 | 42912125 | 42912146 | 42912130 | 42912125 | - |
| SEQ ID NO 62507 | AGACATGGCTTGGCATAGCACT | TTT | chr17 | 42912116 | 42912137 | 42912121 | 42912116 | - |
| SEQ ID NO 62508 | GACATGGCTTGGCATAGCACTT | TTA | chr17 | 42912115 | 42912136 | 42912120 | 42912115 | - |
| SEQ ID NO 62509 | GGCATAGCACTTGCATGATACG | CTT | chr17 | 42912105 | 42912126 | 42912110 | 42912105 | - |
| SEQ ID NO 62510 | GCATAGCACTTGCATGATACGC | TTG | chr17 | 42912104 | 42912125 | 42912109 | 42912104 | - |
| SEQ ID NO 62511 | GCATGATACGCCACATACTAAA | CTT | chr17 | 42912093 | 42912114 | 42912098 | 42912093 | - |
| SEQ ID NO 62512 | CATGATACGCCACATACTAAAA | TTG | chr17 | 42912092 | 42912113 | 42912097 | 42912092 | - |
| SEQ ID NO 62513 | AAAACTCCTCCTTAGGCAGCCT | CTA | chr17 | 42912073 | 42912094 | 42912078 | 42912073 | - |
| SEQ ID NO 62514 | CTCCTTAGGCAGCCTTCTTTTC | CTC | chr17 | 42912066 | 42912087 | 42912071 | 42912066 | - |

Figure 90 (Cont'd)

| | | | | | | | | |
|---|---|---|---|---|---|---|---|---|
| SEQ ID NO 62515 | CTTAGGCAGCCTTCTTTTCCTA | CTC | chr17 | 42912063 | 42912084 | 42912068 | 42912063 | - |
| SEQ ID NO 62516 | AGGCAGCCTTCTTTTCCTATCA | CTT | chr17 | 42912060 | 42912081 | 42912065 | 42912060 | - |
| SEQ ID NO 62517 | GGCAGCCTTCTTTTCCTATCAG | TTA | chr17 | 42912059 | 42912080 | 42912064 | 42912059 | - |
| SEQ ID NO 62518 | CTTTTCCTATCAGATTCAGAGC | CTT | chr17 | 42912050 | 42912071 | 42912055 | 42912050 | - |
| SEQ ID NO 62519 | TTTTCCTATCAGATTCAGAGCT | TTC | chr17 | 42912049 | 42912070 | 42912054 | 42912049 | - |
| SEQ ID NO 62520 | TTCCTATCAGATTCAGAGCTCC | CTT | chr17 | 42912047 | 42912068 | 42912052 | 42912047 | - |
| SEQ ID NO 62521 | TCCTATCAGATTCAGAGCTCCT | TTT | chr17 | 42912046 | 42912067 | 42912051 | 42912046 | - |
| SEQ ID NO 62522 | CCTATCAGATTCAGAGCTCCTT | TTT | chr17 | 42912045 | 42912066 | 42912050 | 42912045 | - |
| SEQ ID NO 62523 | CTATCAGATTCAGAGCTCCTTT | TTC | chr17 | 42912044 | 42912065 | 42912049 | 42912044 | - |
| SEQ ID NO 62524 | TCAGATTCAGAGCTCCTTTCTC | CTA | chr17 | 42912041 | 42912062 | 42912046 | 42912041 | - |
| SEQ ID NO 62525 | AGAGCTCCTTTCTCCTTTTCTC | TTC | chr17 | 42912033 | 42912054 | 42912038 | 42912033 | - |
| SEQ ID NO 62526 | CTTTCTCCTTTTCTCGGTAAGA | CTC | chr17 | 42912026 | 42912047 | 42912031 | 42912026 | - |
| SEQ ID NO 62527 | TCTCCTTTTCTCGGTAAGAATG | CTT | chr17 | 42912023 | 42912044 | 42912028 | 42912023 | - |
| SEQ ID NO 62528 | CTCCTTTTCTCGGTAAGAATGA | TTT | chr17 | 42912022 | 42912043 | 42912027 | 42912022 | - |
| SEQ ID NO 62529 | TCCTTTTCTCGGTAAGAATGAA | TTC | chr17 | 42912021 | 42912042 | 42912026 | 42912021 | - |
| SEQ ID NO 62530 | CTTTTCTCGGTAAGAATGAACA | CTC | chr17 | 42912019 | 42912040 | 42912024 | 42912019 | - |
| SEQ ID NO 62531 | TTCTCGGTAAGAATGAACACAG | CTT | chr17 | 42912016 | 42912037 | 42912021 | 42912016 | - |
| SEQ ID NO 62532 | TCTCGGTAAGAATGAACACAGG | TTT | chr17 | 42912015 | 42912036 | 42912020 | 42912015 | - |
| SEQ ID NO 62533 | CTCGGTAAGAATGAACACAGGT | TTT | chr17 | 42912014 | 42912035 | 42912019 | 42912014 | - |
| SEQ ID NO 62534 | TCGGTAAGAATGAACACAGGTA | TTC | chr17 | 42912013 | 42912034 | 42912018 | 42912013 | - |
| SEQ ID NO 62535 | GGTAAGAATGAACACAGGTAGA | CTC | chr17 | 42912011 | 42912032 | 42912016 | 42912011 | - |
| SEQ ID NO 62536 | TCAGTTAGGATCTCCAGCCTGG | TTC | chr17 | 42911983 | 42912004 | 42911988 | 42911983 | - |
| SEQ ID NO 62537 | AGTTAGGATCTCCAGCCTGGGC | CTC | chr17 | 42911981 | 42912002 | 42911986 | 42911981 | - |
| SEQ ID NO 62538 | GGATCTCCAGCCTGGGCTTGTG | TTA | chr17 | 42911976 | 42911997 | 42911981 | 42911976 | - |
| SEQ ID NO 62539 | CAGCCTGGGCTTGTGAGCTGGC | CTC | chr17 | 42911969 | 42911990 | 42911974 | 42911969 | - |
| SEQ ID NO 62540 | GGCTTGTGAGCTGGCCCTACCT | CTG | chr17 | 42911962 | 42911983 | 42911967 | 42911962 | - |
| SEQ ID NO 62541 | GTGAGCTGGCCCTACCTGGAAG | CTT | chr17 | 42911957 | 42911978 | 42911962 | 42911957 | - |
| SEQ ID NO 62542 | TGAGCTGGCCCTACCTGGAAGT | TTG | chr17 | 42911956 | 42911977 | 42911961 | 42911956 | - |
| SEQ ID NO 62543 | GCCCTACCTGGAAGTCTTGCTT | CTG | chr17 | 42911949 | 42911970 | 42911954 | 42911949 | - |
| SEQ ID NO 62544 | CCTGGAAGTCTTGCTTTTGTAT | CTA | chr17 | 42911943 | 42911964 | 42911948 | 42911943 | - |
| SEQ ID NO 62545 | GAAGTCTTGCTTTTGTATATGT | CTG | chr17 | 42911939 | 42911960 | 42911944 | 42911939 | - |
| SEQ ID NO 62546 | GCTTTTGTATATGTGACGGAAG | CTT | chr17 | 42911931 | 42911952 | 42911936 | 42911931 | - |
| SEQ ID NO 62547 | CTTTTGTATATGTGACGGAAGA | TTG | chr17 | 42911930 | 42911951 | 42911935 | 42911930 | - |
| SEQ ID NO 62548 | TTGTATATGTGACGGAAGAATA | CTT | chr17 | 42911927 | 42911948 | 42911932 | 42911927 | - |
| SEQ ID NO 62549 | TGTATATGTGACGGAAGAATAA | TTT | chr17 | 42911926 | 42911947 | 42911931 | 42911926 | - |
| SEQ ID NO 62550 | GTATATGTGACGGAAGAATAAG | TTT | chr17 | 42911925 | 42911946 | 42911930 | 42911925 | - |
| SEQ ID NO 62551 | TATATGTGACGGAAGAATAAGT | TTG | chr17 | 42911924 | 42911945 | 42911929 | 42911924 | - |
| SEQ ID NO 62552 | CAGGGGAAAATCCAGAACAACC | CTT | chr17 | 42911895 | 42911916 | 42911900 | 42911895 | - |
| SEQ ID NO 62553 | AGGGGAAAATCCAGAACAACCC | TTC | chr17 | 42911894 | 42911915 | 42911899 | 42911894 | - |
| SEQ ID NO 62554 | CTAGCAACAGGTCTTTCTCAAT | CTT | chr17 | 42911867 | 42911888 | 42911872 | 42911867 | - |
| SEQ ID NO 62555 | TAGCAACAGGTCTTTCTCAATA | TTC | chr17 | 42911866 | 42911887 | 42911871 | 42911866 | - |
| SEQ ID NO 62556 | GCAACAGGTCTTTCTCAATAGC | CTA | chr17 | 42911864 | 42911885 | 42911869 | 42911864 | - |
| SEQ ID NO 62557 | TCTCAATAGCTTCATTAGCTTT | CTT | chr17 | 42911852 | 42911873 | 42911857 | 42911852 | - |
| SEQ ID NO 62558 | CTCAATAGCTTCATTAGCTTTT | TTT | chr17 | 42911851 | 42911872 | 42911856 | 42911851 | - |
| SEQ ID NO 62559 | TCAATAGCTTCATTAGCTTTTC | TTC | chr17 | 42911850 | 42911871 | 42911855 | 42911850 | - |
| SEQ ID NO 62560 | AATAGCTTCATTAGCTTTTCAA | CTC | chr17 | 42911848 | 42911869 | 42911853 | 42911848 | - |
| SEQ ID NO 62561 | CATTAGCTTTTCAAAAACATTA | CTT | chr17 | 42911840 | 42911861 | 42911845 | 42911840 | - |
| SEQ ID NO 62562 | ATTAGCTTTTCAAAAACATTAC | TTC | chr17 | 42911839 | 42911860 | 42911844 | 42911839 | - |
| SEQ ID NO 62563 | GCTTTTCAAAAACATTACCCAA | TTA | chr17 | 42911835 | 42911856 | 42911840 | 42911835 | - |
| SEQ ID NO 62564 | TTCAAAAACATTACCCAATATG | CTT | chr17 | 42911831 | 42911852 | 42911836 | 42911831 | - |
| SEQ ID NO 62565 | TCAAAAACATTACCCAATATGA | TTT | chr17 | 42911830 | 42911851 | 42911835 | 42911830 | - |
| SEQ ID NO 62566 | CAAAAACATTACCCAATATGAT | TTT | chr17 | 42911829 | 42911850 | 42911834 | 42911829 | - |
| SEQ ID NO 62567 | AAAAACATTACCCAATATGATT | TTC | chr17 | 42911828 | 42911849 | 42911833 | 42911828 | - |
| SEQ ID NO 62568 | CCCAATATGATTAGGATTGTAA | TTA | chr17 | 42911818 | 42911839 | 42911823 | 42911818 | - |
| SEQ ID NO 62569 | GGATTGTAAAAGAGGACCACCT | TTA | chr17 | 42911805 | 42911826 | 42911810 | 42911805 | - |
| SEQ ID NO 62570 | TAAAAGAGGACCACCTGAGCTG | TTG | chr17 | 42911799 | 42911820 | 42911804 | 42911799 | - |
| SEQ ID NO 62571 | AGCTGACAGCACCTCTGGCCTC | CTG | chr17 | 42911782 | 42911803 | 42911787 | 42911782 | - |
| SEQ ID NO 62572 | ACAGCACCTCTGGCCTCAAAAT | CTG | chr17 | 42911777 | 42911798 | 42911782 | 42911777 | - |

Figure 90 (Cont'd)

| | | | | | | | | |
|---|---|---|---|---|---|---|---|---|
| SEQ ID NO 62573 | TGGCCTCAAAATGGGCTGGCAG | CTC | chr17 | 42911767 | 42911788 | 42911772 | 42911767 | - |
| SEQ ID NO 62574 | GCCTCAAAATGGGCTGGCAGAA | CTG | chr17 | 42911765 | 42911786 | 42911770 | 42911765 | - |
| SEQ ID NO 62575 | AAAATGGGCTGGCAGAAGACCA | CTC | chr17 | 42911760 | 42911781 | 42911765 | 42911760 | - |
| SEQ ID NO 62576 | GCAGAAGACCATTCAAAGATAA | CTG | chr17 | 42911749 | 42911770 | 42911754 | 42911749 | - |
| SEQ ID NO 62577 | AAAGATAAAATGGGCTGTTCCA | TTC | chr17 | 42911735 | 42911756 | 42911740 | 42911735 | - |
| SEQ ID NO 62578 | TTCCAGTGGGAGTGAGCTCCCT | CTG | chr17 | 42911718 | 42911739 | 42911723 | 42911718 | - |
| SEQ ID NO 62579 | CAGTGGGAGTGAGCTCCCTACT | TTC | chr17 | 42911715 | 42911736 | 42911720 | 42911715 | - |
| SEQ ID NO 62580 | CCTACTTGTGAGAGTATTCAAG | CTC | chr17 | 42911699 | 42911720 | 42911704 | 42911699 | - |
| SEQ ID NO 62581 | CTTGTGAGAGTATTCAAGTAGA | CTA | chr17 | 42911695 | 42911716 | 42911700 | 42911695 | - |
| SEQ ID NO 62582 | GTGAGAGTATTCAAGTAGAGAG | CTT | chr17 | 42911692 | 42911713 | 42911697 | 42911692 | - |
| SEQ ID NO 62583 | TGAGAGTATTCAAGTAGAGAGA | TTG | chr17 | 42911691 | 42911712 | 42911696 | 42911691 | - |
| SEQ ID NO 62584 | AAGTAGAGAGAGGAGGACCTCC | TTC | chr17 | 42911680 | 42911701 | 42911685 | 42911680 | - |
| SEQ ID NO 62585 | CTGGCGGGAAACTTGCATATGG | CTC | chr17 | 42911659 | 42911680 | 42911664 | 42911659 | - |
| SEQ ID NO 62586 | GCGGGAAACTTGCATATGGTGT | CTG | chr17 | 42911656 | 42911677 | 42911661 | 42911656 | - |
| SEQ ID NO 62587 | GCATATGGTGTACGTGATATGG | CTT | chr17 | 42911645 | 42911666 | 42911650 | 42911645 | - |
| SEQ ID NO 62588 | CATATGGTGTACGTGATATGGC | TTG | chr17 | 42911644 | 42911665 | 42911649 | 42911644 | - |
| SEQ ID NO 62589 | CATCTGAAAGAGTCTGTGCTGA | CTC | chr17 | 42911617 | 42911638 | 42911622 | 42911617 | - |
| SEQ ID NO 62590 | AAAGAGTCTGTGCTGAGGGCAG | CTG | chr17 | 42911611 | 42911632 | 42911616 | 42911611 | - |
| SEQ ID NO 62591 | TGCTGAGGGCAGGCTGGAGTCA | CTG | chr17 | 42911601 | 42911622 | 42911606 | 42911601 | - |
| SEQ ID NO 62592 | AGGGCAGGCTGGAGTCACACAT | CTG | chr17 | 42911596 | 42911617 | 42911601 | 42911596 | - |
| SEQ ID NO 62593 | GAGTCACACATGGGAATAAGCC | CTG | chr17 | 42911585 | 42911606 | 42911590 | 42911585 | - |
| SEQ ID NO 62594 | CAATCTGCCATCCGTGATTTAA | CTC | chr17 | 42911552 | 42911573 | 42911557 | 42911552 | - |
| SEQ ID NO 62595 | CCATCCGTGATTTAATTCCACG | CTG | chr17 | 42911545 | 42911566 | 42911550 | 42911545 | - |
| SEQ ID NO 62596 | AATTCCACGACGGCAGAATGGA | TTT | chr17 | 42911532 | 42911553 | 42911537 | 42911532 | - |
| SEQ ID NO 62597 | ATTCCACGACGGCAGAATGGAT | TTA | chr17 | 42911531 | 42911552 | 42911536 | 42911531 | - |
| SEQ ID NO 62598 | CACGACGGCAGAATGGATGGCA | TTC | chr17 | 42911527 | 42911548 | 42911532 | 42911527 | - |
| SEQ ID NO 62599 | GCTCCAAATACCAGTGCCCATT | CTT | chr17 | 42911497 | 42911518 | 42911502 | 42911497 | - |
| SEQ ID NO 62600 | CTCCAAATACCAGTGCCCATTG | TTG | chr17 | 42911496 | 42911517 | 42911501 | 42911496 | - |
| SEQ ID NO 62601 | CAAATACCAGTGCCCATTGCTT | CTC | chr17 | 42911493 | 42911514 | 42911498 | 42911493 | - |
| SEQ ID NO 62602 | CTTCAAATAGTAGTCCTCCTCA | TTG | chr17 | 42911474 | 42911495 | 42911479 | 42911474 | - |
| SEQ ID NO 62603 | CAAATAGTAGTCCTCCTCAATC | CTT | chr17 | 42911471 | 42911492 | 42911476 | 42911471 | - |
| SEQ ID NO 62604 | AAATAGTAGTCCTCCTCAATCC | TTC | chr17 | 42911470 | 42911491 | 42911475 | 42911470 | - |
| SEQ ID NO 62605 | CTCAATCCCTGGCATGGTTGTT | CTC | chr17 | 42911456 | 42911477 | 42911461 | 42911456 | - |
| SEQ ID NO 62606 | AATCCCTGGCATGGTTGTTGAC | CTC | chr17 | 42911453 | 42911474 | 42911458 | 42911453 | - |
| SEQ ID NO 62607 | GCATGGTTGTTGACTTTAAACA | CTG | chr17 | 42911445 | 42911466 | 42911450 | 42911445 | - |
| SEQ ID NO 62608 | TTGACTTTAAACACCGAAGACT | TTG | chr17 | 42911436 | 42911457 | 42911441 | 42911436 | - |
| SEQ ID NO 62609 | ACTTTAAACACCGAAGACTCCA | TTG | chr17 | 42911433 | 42911454 | 42911438 | 42911433 | - |
| SEQ ID NO 62610 | TAAACACCGAAGACTCCACATC | CTT | chr17 | 42911429 | 42911450 | 42911434 | 42911429 | - |
| SEQ ID NO 62611 | AAACACCGAAGACTCCACATCT | TTT | chr17 | 42911428 | 42911449 | 42911433 | 42911428 | - |
| SEQ ID NO 62612 | AACACCGAAGACTCCACATCTC | TTA | chr17 | 42911427 | 42911448 | 42911432 | 42911427 | - |
| SEQ ID NO 62613 | CACATCTCTTACAACGACTTCT | CTC | chr17 | 42911413 | 42911434 | 42911418 | 42911413 | - |
| SEQ ID NO 62614 | TTACAACGACTTCTTGTGCGGC | CTC | chr17 | 42911405 | 42911426 | 42911410 | 42911405 | - |
| SEQ ID NO 62615 | ACAACGACTTCTTGTGCGGCTG | CTT | chr17 | 42911403 | 42911424 | 42911408 | 42911403 | - |
| SEQ ID NO 62616 | CAACGACTTCTTGTGCGGCTGG | TTA | chr17 | 42911402 | 42911423 | 42911407 | 42911402 | - |
| SEQ ID NO 62617 | CTTGTGCGGCTGGCCCAGGACC | CTT | chr17 | 42911393 | 42911414 | 42911398 | 42911393 | - |
| SEQ ID NO 62618 | TTGTGCGGCTGGCCCAGGACCT | TTC | chr17 | 42911392 | 42911413 | 42911397 | 42911392 | - |
| SEQ ID NO 62619 | GTGCGGCTGGCCCAGGACCTGG | CTT | chr17 | 42911390 | 42911411 | 42911395 | 42911390 | - |
| SEQ ID NO 62620 | TGCGGCTGGCCCAGGACCTGGG | TTG | chr17 | 42911389 | 42911410 | 42911394 | 42911389 | - |
| SEQ ID NO 62621 | GCCCAGGACCTGGGCGAGGCAG | CTG | chr17 | 42911381 | 42911402 | 42911386 | 42911381 | - |
| SEQ ID NO 62622 | GGCGAGGCAGTAGGGGATGACA | CTG | chr17 | 42911369 | 42911390 | 42911374 | 42911369 | - |
| SEQ ID NO 62623 | ACGGATGCCAGGGGCACTACCG | CTG | chr17 | 42911344 | 42911365 | 42911349 | 42911344 | - |
| SEQ ID NO 62624 | CCGCACTCTTGCAGAAGGACAA | CTA | chr17 | 42911325 | 42911346 | 42911330 | 42911325 | - |
| SEQ ID NO 62625 | TTGCAGAAGGACAAGACGTAGA | CTC | chr17 | 42911317 | 42911338 | 42911322 | 42911317 | - |
| SEQ ID NO 62626 | GCAGAAGGACAAGACGTAGAAG | CTT | chr17 | 42911315 | 42911336 | 42911320 | 42911315 | - |
| SEQ ID NO 62627 | CAGAAGGACAAGACGTAGAAGA | TTG | chr17 | 42911314 | 42911335 | 42911319 | 42911314 | - |
| SEQ ID NO 62628 | GACTTGGGATGGGGTTTCAAG | CTC | chr17 | 42911285 | 42911306 | 42911290 | 42911285 | - |
| SEQ ID NO 62629 | GGGATGGGGTTTCAAGGAGTC | CTT | chr17 | 42911280 | 42911301 | 42911285 | 42911280 | - |
| SEQ ID NO 62630 | GGATGGGGTTTCAAGGAGTCA | TTG | chr17 | 42911279 | 42911300 | 42911284 | 42911279 | - |

Figure 90 (Cont'd)

| | | | | | | | | |
|---|---|---|---|---|---|---|---|---|
| SEQ ID NO 62631 | CAAGGAGTCAAAGACGTGCAGG | TTT | chr17 | 42911267 | 42911288 | 42911272 | 42911267 | - |
| SEQ ID NO 62632 | AAGGAGTCAAAGACGTGCAGGA | TTC | chr17 | 42911266 | 42911287 | 42911271 | 42911266 | - |
| SEQ ID NO 62633 | CAATAGAGCTGAGGCGGAATGG | CTA | chr17 | 42911229 | 42911250 | 42911234 | 42911229 | - |
| SEQ ID NO 62634 | AGGCGGAATGGGAGCCACTTGC | CTG | chr17 | 42911218 | 42911239 | 42911223 | 42911218 | - |
| SEQ ID NO 62635 | GCTGAGTTTCCCCTTGCAGCTC | CTT | chr17 | 42911198 | 42911219 | 42911203 | 42911198 | - |
| SEQ ID NO 62636 | CTGAGTTTCCCCTTGCAGCTCT | TTG | chr17 | 42911197 | 42911218 | 42911202 | 42911197 | - |
| SEQ ID NO 62637 | AGTTTCCCCTTGCAGCTCTCCC | CTG | chr17 | 42911194 | 42911215 | 42911199 | 42911194 | - |
| SEQ ID NO 62638 | CCCCTTGCAGCTCTCCCTGTAC | TTT | chr17 | 42911189 | 42911210 | 42911194 | 42911189 | - |
| SEQ ID NO 62639 | CCCTTGCAGCTCTCCCTGTACA | TTC | chr17 | 42911188 | 42911209 | 42911193 | 42911188 | - |
| SEQ ID NO 62640 | GCAGCTCTCCCTGTACATGCTG | CTT | chr17 | 42911183 | 42911204 | 42911188 | 42911183 | - |
| SEQ ID NO 62641 | CAGCTCTCCCTGTACATGCTGG | TTG | chr17 | 42911182 | 42911203 | 42911187 | 42911182 | - |
| SEQ ID NO 62642 | TCCCTGTACATGCTGGAGTTGA | CTC | chr17 | 42911176 | 42911197 | 42911181 | 42911176 | - |
| SEQ ID NO 62643 | CCTGTACATGCTGGAGTTGAGA | CTC | chr17 | 42911174 | 42911195 | 42911179 | 42911174 | - |
| SEQ ID NO 62644 | TACATGCTGGAGTTGAGAGCCA | CTG | chr17 | 42911170 | 42911191 | 42911175 | 42911170 | - |
| SEQ ID NO 62645 | GAGTTGAGAGCCAGCCCCAGGC | CTG | chr17 | 42911161 | 42911182 | 42911166 | 42911161 | - |
| SEQ ID NO 62646 | AGAGCCAGCCCCAGGCCAAAGA | TTG | chr17 | 42911155 | 42911176 | 42911160 | 42911155 | - |
| SEQ ID NO 62647 | TTGAGGAGGCTGGCAAAGGGTG | TTC | chr17 | 42911119 | 42911140 | 42911124 | 42911119 | - |
| SEQ ID NO 62648 | GAGGAGGCTGGCAAAGGGTGTG | CTT | chr17 | 42911117 | 42911138 | 42911122 | 42911117 | - |
| SEQ ID NO 62649 | AGGAGGCTGGCAAAGGGTGTGG | TTG | chr17 | 42911116 | 42911137 | 42911121 | 42911116 | - |
| SEQ ID NO 62650 | GCAAAGGGTGTGGTGTCAATGT | CTG | chr17 | 42911107 | 42911128 | 42911112 | 42911107 | - |
| SEQ ID NO 62651 | TGGCTGCTCGCACCACCTCTGG | TTC | chr17 | 42911075 | 42911096 | 42911080 | 42911075 | - |
| SEQ ID NO 62652 | GCTGCTCGCACCACCTCTGGGC | CTG | chr17 | 42911073 | 42911094 | 42911078 | 42911073 | - |
| SEQ ID NO 62653 | CTCGCACCACCTCTGGGCTTTC | CTG | chr17 | 42911069 | 42911090 | 42911074 | 42911069 | - |
| SEQ ID NO 62654 | GCACCACCTCTGGGCTTTCTCC | CTC | chr17 | 42911066 | 42911087 | 42911071 | 42911066 | - |
| SEQ ID NO 62655 | TGGGCTTTCTCCAGAGTCCACA | CTC | chr17 | 42911056 | 42911077 | 42911061 | 42911056 | - |
| SEQ ID NO 62656 | GGCTTTCTCCAGAGTCCACAGG | CTG | chr17 | 42911054 | 42911075 | 42911059 | 42911054 | - |
| SEQ ID NO 62657 | TCTCCAGAGTCCACAGGAGGTC | CTT | chr17 | 42911049 | 42911070 | 42911054 | 42911049 | - |
| SEQ ID NO 62658 | CTCCAGAGTCCACAGGAGGTCT | TTT | chr17 | 42911048 | 42911069 | 42911053 | 42911048 | - |
| SEQ ID NO 62659 | TCCAGAGTCCACAGGAGGTCTA | TTC | chr17 | 42911047 | 42911068 | 42911052 | 42911047 | - |
| SEQ ID NO 62660 | CAGAGTCCACAGGAGGTCTACA | CTC | chr17 | 42911045 | 42911066 | 42911050 | 42911045 | - |
| SEQ ID NO 62661 | CACCCAGTCCCTTGAGCAGCAG | CTA | chr17 | 42911025 | 42911046 | 42911030 | 42911025 | - |
| SEQ ID NO 62662 | GAGCAGCAGATAAAATCCGATG | CTT | chr17 | 42911012 | 42911033 | 42911017 | 42911012 | - |
| SEQ ID NO 62663 | AGCAGCAGATAAAATCCGATGG | TTG | chr17 | 42911011 | 42911032 | 42911016 | 42911011 | - |
| SEQ ID NO 62664 | AACAGGAAGAAGGTAATGAGAA | CTG | chr17 | 42910981 | 42911002 | 42910986 | 42910981 | - |
| SEQ ID NO 62665 | CTTGAGGCTGGCATTATAGATG | TTT | chr17 | 42910952 | 42910973 | 42910957 | 42910952 | - |
| SEQ ID NO 62666 | TTGAGGCTGGCATTATAGATGC | TTC | chr17 | 42910951 | 42910972 | 42910956 | 42910951 | - |
| SEQ ID NO 62667 | GAGGCTGGCATTATAGATGCTG | CTT | chr17 | 42910949 | 42910970 | 42910954 | 42910949 | - |
| SEQ ID NO 62668 | AGGCTGGCATTATAGATGCTGT | TTG | chr17 | 42910948 | 42910969 | 42910953 | 42910948 | - |
| SEQ ID NO 62669 | GCATTATAGATGCTGTGGATGT | CTG | chr17 | 42910942 | 42910963 | 42910947 | 42910942 | - |
| SEQ ID NO 62670 | TAGATGCTGTGGATGTGGCTGA | TTA | chr17 | 42910936 | 42910957 | 42910941 | 42910936 | - |
| SEQ ID NO 62671 | TGGATGTGGCTGAAAGTTTCTG | CTG | chr17 | 42910927 | 42910948 | 42910932 | 42910927 | - |
| SEQ ID NO 62672 | AAAGTTTCTGCAACAGCAATGC | CTG | chr17 | 42910915 | 42910936 | 42910920 | 42910915 | - |
| SEQ ID NO 62673 | CTGCAACAGCAATGCCTGAGTG | TTT | chr17 | 42910908 | 42910929 | 42910913 | 42910908 | - |
| SEQ ID NO 62674 | TGCAACAGCAATGCCTGAGTGG | TTC | chr17 | 42910907 | 42910928 | 42910912 | 42910907 | - |
| SEQ ID NO 62675 | CAACAGCAATGCCTGAGTGGAA | CTG | chr17 | 42910905 | 42910926 | 42910910 | 42910905 | - |
| SEQ ID NO 62676 | AGTGGAAGAAAGCATGACTGTG | CTG | chr17 | 42910890 | 42910911 | 42910895 | 42910890 | - |
| SEQ ID NO 62677 | TGAGAGATAGGAAGGATTTGGG | CTG | chr17 | 42910870 | 42910891 | 42910875 | 42910870 | - |
| SEQ ID NO 62678 | GGGACCTTTGCTAGAGGTGGGT | TTT | chr17 | 42910851 | 42910872 | 42910856 | 42910851 | - |
| SEQ ID NO 62679 | GGACCTTTGCTAGAGGTGGGTT | TTG | chr17 | 42910850 | 42910871 | 42910855 | 42910850 | - |
| SEQ ID NO 62680 | TGCTAGAGGTGGGTTTGGAGGA | CTT | chr17 | 42910843 | 42910864 | 42910848 | 42910843 | - |
| SEQ ID NO 62681 | GCTAGAGGTGGGTTTGGAGGAG | TTT | chr17 | 42910842 | 42910863 | 42910847 | 42910842 | - |
| SEQ ID NO 62682 | CTAGAGGTGGGTTTGGAGGAGT | TTG | chr17 | 42910841 | 42910862 | 42910846 | 42910841 | - |
| SEQ ID NO 62683 | GAGGTGGGTTTGGAGGAGTGGG | CTA | chr17 | 42910838 | 42910859 | 42910843 | 42910838 | - |
| SEQ ID NO 62684 | GGAGGAGTGGGTGACATGCCAT | TTT | chr17 | 42910827 | 42910848 | 42910832 | 42910827 | - |
| SEQ ID NO 62685 | GAGGAGTGGGTGACATGCCATC | TTG | chr17 | 42910826 | 42910847 | 42910831 | 42910826 | - |
| SEQ ID NO 62686 | TGCGACTGTGGAATTAAATCAC | TTC | chr17 | 42910799 | 42910820 | 42910804 | 42910799 | - |
| SEQ ID NO 62687 | CGACTGTGGAATTAAATCACAG | CTG | chr17 | 42910797 | 42910818 | 42910802 | 42910797 | - |
| SEQ ID NO 62688 | TGGAATTAAATCACAGATGGCA | CTG | chr17 | 42910791 | 42910812 | 42910796 | 42910791 | - |

Figure 90 (Cont'd)

| | | | | | | | | |
|---|---|---|---|---|---|---|---|---|
| SEQ ID NO 62689 | AATCACAGATGGCAGATGGGAG | TTA | chr17 | 42910783 | 42910804 | 42910788 | 42910783 | - |
| SEQ ID NO 62690 | GCTTATTCCCATGTGTGACTCC | CTG | chr17 | 42910752 | 42910773 | 42910757 | 42910752 | - |
| SEQ ID NO 62691 | ATTCCCATGTGTGACTCCAGCC | CTT | chr17 | 42910748 | 42910769 | 42910753 | 42910748 | - |
| SEQ ID NO 62692 | TTCCCATGTGTGACTCCAGCCT | TTA | chr17 | 42910747 | 42910768 | 42910752 | 42910747 | - |
| SEQ ID NO 62693 | CCATGTGTGACTCCAGCCTGCC | TTC | chr17 | 42910744 | 42910765 | 42910749 | 42910744 | - |
| SEQ ID NO 62694 | CAGCCTGCCCTCAATATAGACT | CTC | chr17 | 42910731 | 42910752 | 42910736 | 42910731 | - |
| SEQ ID NO 62695 | CCCTCAATATAGACTCTTTCAG | CTG | chr17 | 42910724 | 42910745 | 42910729 | 42910724 | - |
| SEQ ID NO 62696 | AATATAGACTCTTTCAGATGGA | CTC | chr17 | 42910719 | 42910740 | 42910724 | 42910719 | - |
| SEQ ID NO 62697 | TTTCAGATGGAGGTGCCATATC | CTC | chr17 | 42910708 | 42910729 | 42910713 | 42910708 | - |
| SEQ ID NO 62698 | TCAGATGGAGGTGCCATATCAC | CTT | chr17 | 42910706 | 42910727 | 42910711 | 42910706 | - |
| SEQ ID NO 62699 | CAGATGGAGGTGCCATATCACG | TTT | chr17 | 42910705 | 42910726 | 42910710 | 42910705 | - |
| SEQ ID NO 62700 | AGATGGAGGTGCCATATCACGT | TTC | chr17 | 42910704 | 42910725 | 42910709 | 42910704 | - |
| SEQ ID NO 62701 | CCACCGTATGCAAATTTCCTAC | CTC | chr17 | 42910674 | 42910695 | 42910679 | 42910674 | - |
| SEQ ID NO 62702 | CCTACCAGGAGGTCCTCCTATC | TTT | chr17 | 42910657 | 42910678 | 42910662 | 42910657 | - |
| SEQ ID NO 62703 | CTACCAGGAGGTCCTCCTATCT | TTC | chr17 | 42910656 | 42910677 | 42910661 | 42910656 | - |
| SEQ ID NO 62704 | CCAGGAGGTCCTCCTATCTCTA | CTA | chr17 | 42910653 | 42910674 | 42910658 | 42910653 | - |
| SEQ ID NO 62705 | CTATCTCTACTTGAAATACCCT | CTC | chr17 | 42910640 | 42910661 | 42910645 | 42910640 | - |
| SEQ ID NO 62706 | TCTCTACTTGAAATACCCTCAG | CTA | chr17 | 42910637 | 42910658 | 42910642 | 42910637 | - |
| SEQ ID NO 62707 | TACTTGAAATACCCTCAGAGGT | CTC | chr17 | 42910633 | 42910654 | 42910638 | 42910633 | - |
| SEQ ID NO 62708 | CTTGAAATACCCTCAGAGGTAG | CTA | chr17 | 42910631 | 42910652 | 42910636 | 42910631 | - |
| SEQ ID NO 62709 | GAAATACCCTCAGAGGTAGGGA | CTT | chr17 | 42910628 | 42910649 | 42910633 | 42910628 | - |
| SEQ ID NO 62710 | AAATACCCTCAGAGGTAGGGAG | TTG | chr17 | 42910627 | 42910648 | 42910632 | 42910627 | - |
| SEQ ID NO 62711 | AGAGGTAGGGAGCTCACCCCCA | CTC | chr17 | 42910617 | 42910638 | 42910622 | 42910617 | - |
| SEQ ID NO 62712 | ACCCCACTATAACAGTCCATT | CTC | chr17 | 42910602 | 42910623 | 42910607 | 42910602 | - |
| SEQ ID NO 62713 | TAACAGTCCATTTTATCTTTGA | CTA | chr17 | 42910592 | 42910613 | 42910597 | 42910592 | - |
| SEQ ID NO 62714 | TATCTTTGAACGGAATTGATTG | TTT | chr17 | 42910579 | 42910600 | 42910584 | 42910579 | - |
| SEQ ID NO 62715 | ATCTTTGAACGGAATTGATTGC | TTT | chr17 | 42910578 | 42910599 | 42910583 | 42910578 | - |
| SEQ ID NO 62716 | TCTTTGAACGGAATTGATTGCT | TTA | chr17 | 42910577 | 42910598 | 42910582 | 42910577 | - |
| SEQ ID NO 62717 | TGAACGGAATTGATTGCTGAAT | CTT | chr17 | 42910573 | 42910594 | 42910578 | 42910573 | - |
| SEQ ID NO 62718 | GAACGGAATTGATTGCTGAATA | TTT | chr17 | 42910572 | 42910593 | 42910577 | 42910572 | - |
| SEQ ID NO 62719 | AACGGAATTGATTGCTGAATAG | TTG | chr17 | 42910571 | 42910592 | 42910576 | 42910571 | - |
| SEQ ID NO 62720 | ATTGCTGAATAGTTCTTCCTTG | TTG | chr17 | 42910561 | 42910582 | 42910566 | 42910561 | - |
| SEQ ID NO 62721 | CTGAATAGTTCTTCCTTGTCTG | TTG | chr17 | 42910557 | 42910578 | 42910562 | 42910557 | - |
| SEQ ID NO 62722 | AATAGTTCTTCCTTGTCTGTGT | CTG | chr17 | 42910554 | 42910575 | 42910559 | 42910554 | - |
| SEQ ID NO 62723 | TTCCTTGTCTGTGTGAAACTGG | TTC | chr17 | 42910546 | 42910567 | 42910551 | 42910546 | - |
| SEQ ID NO 62724 | CCTTGTCTGTGTGAAACTGGTC | CTT | chr17 | 42910544 | 42910565 | 42910549 | 42910544 | - |
| SEQ ID NO 62725 | CTTGTCTGTGTGAAACTGGTCC | TTC | chr17 | 42910543 | 42910564 | 42910548 | 42910543 | - |
| SEQ ID NO 62726 | GTCTGTGTGAAACTGGTCCCCC | CTT | chr17 | 42910540 | 42910561 | 42910545 | 42910540 | - |
| SEQ ID NO 62727 | TCTGTGTGAAACTGGTCCCCCT | TTG | chr17 | 42910539 | 42910560 | 42910544 | 42910539 | - |
| SEQ ID NO 62728 | TGTGAAACTGGTCCCCCTCTAA | CTG | chr17 | 42910535 | 42910556 | 42910540 | 42910535 | - |
| SEQ ID NO 62729 | GTCCCCCTCTAATACTGTCTAT | CTG | chr17 | 42910525 | 42910546 | 42910530 | 42910525 | - |
| SEQ ID NO 62730 | TAATACTGTCTATTTTCTCAG | CTC | chr17 | 42910516 | 42910537 | 42910521 | 42910516 | - |
| SEQ ID NO 62731 | ATACTGTCTATTTTTCTCAGTT | CTA | chr17 | 42910514 | 42910535 | 42910519 | 42910514 | - |
| SEQ ID NO 62732 | TCTATTTTTCTCAGTTCTTTCT | CTG | chr17 | 42910508 | 42910529 | 42910513 | 42910508 | - |
| SEQ ID NO 62733 | TTTTTCTCAGTTCTTTCTGCAG | CTA | chr17 | 42910504 | 42910525 | 42910509 | 42910504 | - |
| SEQ ID NO 62734 | TTCTCAGTTCTTTCTGCAGGAG | TTT | chr17 | 42910501 | 42910522 | 42910506 | 42910501 | - |
| SEQ ID NO 62735 | TCTCAGTTCTTTCTGCAGGAGT | TTT | chr17 | 42910500 | 42910521 | 42910505 | 42910500 | - |
| SEQ ID NO 62736 | CTCAGTTCTTTCTGCAGGAGTT | TTT | chr17 | 42910499 | 42910520 | 42910504 | 42910499 | - |
| SEQ ID NO 62737 | TCAGTTCTTTCTGCAGGAGTTA | TTC | chr17 | 42910498 | 42910519 | 42910503 | 42910498 | - |
| SEQ ID NO 62738 | AGTTCTTTCTGCAGGAGTTAGT | CTC | chr17 | 42910496 | 42910517 | 42910501 | 42910496 | - |
| SEQ ID NO 62739 | TTTCTGCAGGAGTTAGTAAGTG | TTC | chr17 | 42910491 | 42910512 | 42910496 | 42910491 | - |
| SEQ ID NO 62740 | TCTGCAGGAGTTAGTAAGTGAT | CTT | chr17 | 42910489 | 42910510 | 42910494 | 42910489 | - |
| SEQ ID NO 62741 | CTGCAGGAGTTAGTAAGTGATG | TTT | chr17 | 42910488 | 42910509 | 42910493 | 42910488 | - |
| SEQ ID NO 62742 | TGCAGGAGTTAGTAAGTGATGA | TTC | chr17 | 42910487 | 42910508 | 42910492 | 42910487 | - |
| SEQ ID NO 62743 | CAGGAGTTAGTAAGTGATGAAT | CTG | chr17 | 42910485 | 42910506 | 42910490 | 42910485 | - |
| SEQ ID NO 62744 | GTAAGTGATGAATCTAGTCCCT | TTA | chr17 | 42910476 | 42910497 | 42910481 | 42910476 | - |
| SEQ ID NO 62745 | GTCCCTCTGTCACACATTTGAA | CTA | chr17 | 42910460 | 42910481 | 42910465 | 42910460 | - |
| SEQ ID NO 62746 | TGTCACACATTTGAACACAGTT | CTC | chr17 | 42910453 | 42910474 | 42910458 | 42910453 | - |

Figure 90 (Cont'd)

| | | | | | | | | |
|---|---|---|---|---|---|---|---|---|
| SEQ ID NO 62747 | TCACACATTTGAACACAGTTAT | CTG | chr17 | 42910451 | 42910472 | 42910456 | 42910451 | - |
| SEQ ID NO 62748 | GAACACAGTTATTCTCTCTAAC | TTT | chr17 | 42910441 | 42910462 | 42910446 | 42910441 | - |
| SEQ ID NO 62749 | AACACAGTTATTCTCTCTAACC | TTG | chr17 | 42910440 | 42910461 | 42910445 | 42910440 | - |
| SEQ ID NO 62750 | TTCTCTCTAACCTAAACATTCC | TTA | chr17 | 42910430 | 42910451 | 42910435 | 42910430 | - |
| SEQ ID NO 62751 | TCTCTAACCTAAACATTCCCAG | TTC | chr17 | 42910427 | 42910448 | 42910432 | 42910427 | - |
| SEQ ID NO 62752 | TCTAACCTAAACATTCCCAGGT | CTC | chr17 | 42910425 | 42910446 | 42910430 | 42910425 | - |
| SEQ ID NO 62753 | TAACCTAAACATTCCCAGGTTT | CTC | chr17 | 42910423 | 42910444 | 42910428 | 42910423 | - |
| SEQ ID NO 62754 | ACCTAAACATTCCCAGGTTTTT | CTA | chr17 | 42910421 | 42910442 | 42910426 | 42910421 | - |
| SEQ ID NO 62755 | AACATTCCCAGGTTTTTCATGT | CTA | chr17 | 42910416 | 42910437 | 42910421 | 42910416 | - |
| SEQ ID NO 62756 | CCAGGTTTTTCATGTGATATGG | TTC | chr17 | 42910409 | 42910430 | 42910414 | 42910409 | - |
| SEQ ID NO 62757 | TTCATGTGATATGGCTTCCAGG | TTT | chr17 | 42910401 | 42910422 | 42910406 | 42910401 | - |
| SEQ ID NO 62758 | TCATGTGATATGGCTTCCAGGT | TTT | chr17 | 42910400 | 42910421 | 42910405 | 42910400 | - |
| SEQ ID NO 62759 | CATGTGATATGGCTTCCAGGTT | TTT | chr17 | 42910399 | 42910420 | 42910404 | 42910399 | - |
| SEQ ID NO 62760 | ATGTGATATGGCTTCCAGGTTC | TTC | chr17 | 42910398 | 42910419 | 42910403 | 42910398 | - |
| SEQ ID NO 62761 | CCAGGTTCTTCCTCAAACATGG | CTT | chr17 | 42910384 | 42910405 | 42910389 | 42910384 | - |
| SEQ ID NO 62762 | CAGGTTCTTCCTCAAACATGGA | TTC | chr17 | 42910383 | 42910404 | 42910388 | 42910383 | - |
| SEQ ID NO 62763 | TTCCTCAAACATGGAACCCAGT | TTC | chr17 | 42910376 | 42910397 | 42910381 | 42910376 | - |
| SEQ ID NO 62764 | CCTCAAACATGGAACCCAGTAC | CTT | chr17 | 42910374 | 42910395 | 42910379 | 42910374 | - |
| SEQ ID NO 62765 | CTCAAACATGGAACCCAGTACT | TTC | chr17 | 42910373 | 42910394 | 42910378 | 42910373 | - |
| SEQ ID NO 62766 | AAACATGGAACCCAGTACTAAA | CTC | chr17 | 42910370 | 42910391 | 42910375 | 42910370 | - |
| SEQ ID NO 62767 | AATGCTGTGTTACTTTTGTGAT | CTA | chr17 | 42910350 | 42910371 | 42910355 | 42910350 | - |
| SEQ ID NO 62768 | TGTTACTTTTGTGATTACCATG | CTG | chr17 | 42910343 | 42910364 | 42910348 | 42910343 | - |
| SEQ ID NO 62769 | CTTTTGTGATTACCATGAAACC | TTA | chr17 | 42910338 | 42910359 | 42910343 | 42910338 | - |
| SEQ ID NO 62770 | TTGTGATTACCATGAAACCATT | CTT | chr17 | 42910335 | 42910356 | 42910340 | 42910335 | - |
| SEQ ID NO 62771 | TGTGATTACCATGAAACCATTA | TTT | chr17 | 42910334 | 42910355 | 42910339 | 42910334 | - |
| SEQ ID NO 62772 | GTGATTACCATGAAACCATTAT | TTT | chr17 | 42910333 | 42910354 | 42910338 | 42910333 | - |
| SEQ ID NO 62773 | TGATTACCATGAAACCATTATC | TTG | chr17 | 42910332 | 42910353 | 42910337 | 42910332 | - |
| SEQ ID NO 62774 | CCATGAAACCATTATCTCCCTT | TTA | chr17 | 42910326 | 42910347 | 42910331 | 42910326 | - |
| SEQ ID NO 62775 | TCTCCCTTGTTCTCAACATTCT | TTA | chr17 | 42910312 | 42910333 | 42910317 | 42910312 | - |
| SEQ ID NO 62776 | CCTTGTTCTCAACATTCTTCTT | CTC | chr17 | 42910308 | 42910329 | 42910313 | 42910308 | - |
| SEQ ID NO 62777 | GTTCTCAACATTCTTCTTTGAA | CTT | chr17 | 42910304 | 42910325 | 42910309 | 42910304 | - |
| SEQ ID NO 62778 | TTCTCAACATTCTTCTTTGAAT | TTG | chr17 | 42910303 | 42910324 | 42910308 | 42910303 | - |
| SEQ ID NO 62779 | TCAACATTCTTCTTTGAATGCT | TTC | chr17 | 42910300 | 42910321 | 42910305 | 42910300 | - |
| SEQ ID NO 62780 | AACATTCTTCTTTGAATGCTGC | CTC | chr17 | 42910298 | 42910319 | 42910303 | 42910298 | - |
| SEQ ID NO 62781 | TTCTTTGAATGCTGCTATGTTC | TTC | chr17 | 42910291 | 42910312 | 42910296 | 42910291 | - |
| SEQ ID NO 62782 | CTTTGAATGCTGCTATGTTCCG | CTT | chr17 | 42910289 | 42910310 | 42910294 | 42910289 | - |
| SEQ ID NO 62783 | TTTGAATGCTGCTATGTTCCGT | TTC | chr17 | 42910288 | 42910309 | 42910293 | 42910288 | - |
| SEQ ID NO 62784 | TGAATGCTGCTATGTTCCGTTC | CTT | chr17 | 42910286 | 42910307 | 42910291 | 42910286 | - |
| SEQ ID NO 62785 | GAATGCTGCTATGTTCCGTTCT | TTT | chr17 | 42910285 | 42910306 | 42910290 | 42910285 | - |
| SEQ ID NO 62786 | AATGCTGCTATGTTCCGTTCTT | TTG | chr17 | 42910284 | 42910305 | 42910289 | 42910284 | - |
| SEQ ID NO 62787 | CTATGTTCCGTTCTTACAAATC | CTG | chr17 | 42910277 | 42910298 | 42910282 | 42910277 | - |
| SEQ ID NO 62788 | TGTTCCGTTCTTACAAATCTCC | CTA | chr17 | 42910274 | 42910295 | 42910279 | 42910274 | - |
| SEQ ID NO 62789 | CGTTCTTACAAATCTCCAGGGG | TTC | chr17 | 42910269 | 42910290 | 42910274 | 42910269 | - |
| SEQ ID NO 62790 | TTACAAATCTCCAGGGGAGAAA | TTC | chr17 | 42910264 | 42910285 | 42910269 | 42910264 | - |
| SEQ ID NO 62791 | ACAAATCTCCAGGGGAGAAATT | CTT | chr17 | 42910262 | 42910283 | 42910267 | 42910262 | - |
| SEQ ID NO 62792 | CAAATCTCCAGGGGAGAAATTC | TTA | chr17 | 42910261 | 42910282 | 42910266 | 42910261 | - |
| SEQ ID NO 62793 | CAGGGGAGAAATTCCACAGTTT | CTC | chr17 | 42910253 | 42910274 | 42910258 | 42910253 | - |
| SEQ ID NO 62794 | CACAGTTTTGTTAAGGTCTTAT | TTC | chr17 | 42910239 | 42910260 | 42910244 | 42910239 | - |
| SEQ ID NO 62795 | TGTTAAGGTCTTATATTCCAGT | TTT | chr17 | 42910231 | 42910252 | 42910236 | 42910231 | - |
| SEQ ID NO 62796 | GTTAAGGTCTTATATTCCAGTG | TTT | chr17 | 42910230 | 42910251 | 42910235 | 42910230 | - |
| SEQ ID NO 62797 | TTAAGGTCTTATATTCCAGTGC | TTG | chr17 | 42910229 | 42910250 | 42910234 | 42910229 | - |
| SEQ ID NO 62798 | AGGTCTTATATTCCAGTGCCTC | TTA | chr17 | 42910226 | 42910247 | 42910231 | 42910226 | - |
| SEQ ID NO 62799 | ATATTCCAGTGCCTCCCACAAA | CTT | chr17 | 42910219 | 42910240 | 42910224 | 42910219 | - |
| SEQ ID NO 62800 | TATTCCAGTGCCTCCCACAAAA | TTA | chr17 | 42910218 | 42910239 | 42910223 | 42910218 | - |
| SEQ ID NO 62801 | CAGTGCCTCCCACAAAATCTTT | TTC | chr17 | 42910213 | 42910234 | 42910218 | 42910213 | - |
| SEQ ID NO 62802 | CCACAAAATCTTTCTTATGCTT | CTC | chr17 | 42910204 | 42910225 | 42910209 | 42910204 | - |
| SEQ ID NO 62803 | TCTTATGCTTAACTTAAATCTT | CTT | chr17 | 42910192 | 42910213 | 42910197 | 42910192 | - |
| SEQ ID NO 62804 | CTTATGCTTAACTTAAATCTTG | TTT | chr17 | 42910191 | 42910212 | 42910196 | 42910191 | - |

Figure 90 (Cont'd)

| | | | | | | | | |
|---|---|---|---|---|---|---|---|---|
| SEQ ID NO 62805 | TTATGCTTAACTTAAATCTTGT | TTC | chr17 | 42910190 | 42910211 | 42910195 | 42910190 | - |
| SEQ ID NO 62806 | ATGCTTAACTTAAATCTTGTCT | CTT | chr17 | 42910188 | 42910209 | 42910193 | 42910188 | - |
| SEQ ID NO 62807 | TGCTTAACTTAAATCTTGTCTT | TTA | chr17 | 42910187 | 42910208 | 42910192 | 42910187 | - |
| SEQ ID NO 62808 | AACTTAAATCTTGTCTTACCCT | CTT | chr17 | 42910182 | 42910203 | 42910187 | 42910182 | - |
| SEQ ID NO 62809 | ACTTAAATCTTGTCTTACCCTT | TTA | chr17 | 42910181 | 42910202 | 42910186 | 42910181 | - |
| SEQ ID NO 62810 | AAATCTTGTCTTACCCTTGTTA | CTT | chr17 | 42910177 | 42910198 | 42910182 | 42910177 | - |
| SEQ ID NO 62811 | AATCTTGTCTTACCCTTGTTAA | TTA | chr17 | 42910176 | 42910197 | 42910181 | 42910176 | - |
| SEQ ID NO 62812 | GTCTTACCCTTGTTAATTGGAT | CTT | chr17 | 42910170 | 42910191 | 42910175 | 42910170 | - |
| SEQ ID NO 62813 | TCTTACCCTTGTTAATTGGATC | TTG | chr17 | 42910169 | 42910190 | 42910174 | 42910169 | - |
| SEQ ID NO 62814 | ACCCTTGTTAATTGGATCTAAG | CTT | chr17 | 42910165 | 42910186 | 42910170 | 42910165 | - |
| SEQ ID NO 62815 | CCCTTGTTAATTGGATCTAAGA | TTA | chr17 | 42910164 | 42910185 | 42910169 | 42910164 | - |
| SEQ ID NO 62816 | GTTAATTGGATCTAAGAAAACA | CTT | chr17 | 42910159 | 42910180 | 42910164 | 42910159 | - |
| SEQ ID NO 62817 | TTAATTGGATCTAAGAAAACAC | TTG | chr17 | 42910158 | 42910179 | 42910163 | 42910158 | - |
| SEQ ID NO 62818 | ATTGGATCTAAGAAAACACATA | TTA | chr17 | 42910155 | 42910176 | 42910160 | 42910155 | - |
| SEQ ID NO 62819 | GATCTAAGAAAACACATATTCA | TTG | chr17 | 42910151 | 42910172 | 42910156 | 42910151 | - |
| SEQ ID NO 62820 | AGAAAACACATATTCAGGCAGG | CTA | chr17 | 42910145 | 42910166 | 42910150 | 42910145 | - |
| SEQ ID NO 62821 | AGGCAGGGTGCGGTGGCTCACC | TTC | chr17 | 42910130 | 42910151 | 42910135 | 42910130 | - |
| SEQ ID NO 62822 | ACCCTGTAATCCCAGCGCTTT | CTC | chr17 | 42910111 | 42910132 | 42910116 | 42910111 | - |
| SEQ ID NO 62823 | GTAATCCCAGCGCTTTGGGAGG | CTT | chr17 | 42910105 | 42910126 | 42910110 | 42910105 | - |
| SEQ ID NO 62824 | TAATCCCAGCGCTTTGGGAGGC | TTG | chr17 | 42910104 | 42910125 | 42910109 | 42910104 | - |
| SEQ ID NO 62825 | TGGGAGGCCGAGGCGGGCGGAT | CTT | chr17 | 42910090 | 42910111 | 42910095 | 42910090 | - |
| SEQ ID NO 62826 | GGGAGGCCGAGGCGGGCGGATC | TTT | chr17 | 42910089 | 42910110 | 42910094 | 42910089 | - |
| SEQ ID NO 62827 | GGAGGCCGAGGCGGGCGGATCA | TTG | chr17 | 42910088 | 42910109 | 42910093 | 42910088 | - |
| SEQ ID NO 62828 | TGCTAAAAATACAAAAAATTAG | CTC | chr17 | 42910027 | 42910048 | 42910032 | 42910027 | - |
| SEQ ID NO 62829 | CTAAAAATACAAAAAATTAGCC | CTG | chr17 | 42910025 | 42910046 | 42910030 | 42910025 | - |
| SEQ ID NO 62830 | AAAATACAAAAAATTAGCCGGG | CTA | chr17 | 42910022 | 42910043 | 42910027 | 42910022 | - |
| SEQ ID NO 62831 | GCCGGGCATGGTGGCGGGCGCC | TTA | chr17 | 42910006 | 42910027 | 42910011 | 42910006 | - |
| SEQ ID NO 62832 | TAGTCCCAGCTACTCGGAGAGG | CTG | chr17 | 42909982 | 42910003 | 42909987 | 42909982 | - |
| SEQ ID NO 62833 | CTCGGAGAGGCTGAGGCAGGAG | CTA | chr17 | 42909970 | 42909991 | 42909975 | 42909970 | - |
| SEQ ID NO 62834 | GGAGAGGCTGAGGCAGGAGAAT | CTC | chr17 | 42909967 | 42909988 | 42909972 | 42909967 | - |
| SEQ ID NO 62835 | AGGCAGGAGAATGGCGTGAACC | CTG | chr17 | 42909957 | 42909978 | 42909962 | 42909957 | - |
| SEQ ID NO 62836 | GCAGTGAGCCGAGATCGCACCA | CTT | chr17 | 42909920 | 42909941 | 42909925 | 42909920 | - |
| SEQ ID NO 62837 | CAGTGAGCCGAGATCGCACCAC | TTG | chr17 | 42909919 | 42909940 | 42909924 | 42909919 | - |
| SEQ ID NO 62838 | CACTCTAGCCTGGGTCACAGAG | CTG | chr17 | 42909895 | 42909916 | 42909900 | 42909895 | - |
| SEQ ID NO 62839 | TAGCCTGGGTCACAGAGCGAGA | CTC | chr17 | 42909890 | 42909911 | 42909895 | 42909890 | - |
| SEQ ID NO 62840 | GCCTGGGTCACAGAGCGAGACT | CTA | chr17 | 42909888 | 42909909 | 42909893 | 42909888 | - |
| SEQ ID NO 62841 | GGTCACAGAGCGAGACTCCATC | CTG | chr17 | 42909883 | 42909904 | 42909888 | 42909883 | - |
| SEQ ID NO 62842 | CATCTCAAAAAAAAAAAACAAA | CTC | chr17 | 42909865 | 42909886 | 42909870 | 42909865 | - |
| SEQ ID NO 62843 | AAAAAAAAAAAACAAAAAAAAA | CTC | chr17 | 42909859 | 42909880 | 42909864 | 42909859 | - |
| SEQ ID NO 62844 | AAAACTCTGAACCTATAAAAGA | TTC | chr17 | 42909830 | 42909851 | 42909835 | 42909830 | - |
| SEQ ID NO 62845 | TGAACCTATAAAAGAGATCAAC | CTC | chr17 | 42909823 | 42909844 | 42909828 | 42909823 | - |
| SEQ ID NO 62846 | AACCTATAAAAGAGATCAACTG | CTG | chr17 | 42909821 | 42909842 | 42909826 | 42909821 | - |
| SEQ ID NO 62847 | TAAAAGAGATCAACTGCAGTTA | CTA | chr17 | 42909815 | 42909836 | 42909820 | 42909815 | - |
| SEQ ID NO 62848 | CAGTTATCTATTAGGTTTGCAA | CTG | chr17 | 42909799 | 42909820 | 42909804 | 42909799 | - |
| SEQ ID NO 62849 | TCTATTAGGTTTGCAAATGAAT | TTA | chr17 | 42909793 | 42909814 | 42909798 | 42909793 | - |
| SEQ ID NO 62850 | TTAGGTTTGCAAATGAATGTAT | CTA | chr17 | 42909789 | 42909810 | 42909794 | 42909789 | - |
| SEQ ID NO 62851 | GGTTTGCAAATGAATGTATTTA | TTA | chr17 | 42909786 | 42909807 | 42909791 | 42909786 | - |
| SEQ ID NO 62852 | GCAAATGAATGTATTTAAATGA | TTT | chr17 | 42909781 | 42909802 | 42909786 | 42909781 | - |
| SEQ ID NO 62853 | CAAATGAATGTATTTAAATGAA | TTG | chr17 | 42909780 | 42909801 | 42909785 | 42909780 | - |
| SEQ ID NO 62854 | AAATGAACAGCTTTCCTAGGAC | TTT | chr17 | 42909765 | 42909786 | 42909770 | 42909765 | - |
| SEQ ID NO 62855 | AATGAACAGCTTTCCTAGGACA | TTA | chr17 | 42909764 | 42909785 | 42909769 | 42909764 | - |
| SEQ ID NO 62856 | TCCTAGGACATCGTGTTAATTT | CTT | chr17 | 42909752 | 42909773 | 42909757 | 42909752 | - |
| SEQ ID NO 62857 | CCTAGGACATCGTGTTAATTTG | TTT | chr17 | 42909751 | 42909772 | 42909756 | 42909751 | - |
| SEQ ID NO 62858 | CTAGGACATCGTGTTAATTTGT | TTC | chr17 | 42909750 | 42909771 | 42909755 | 42909750 | - |
| SEQ ID NO 62859 | GGACATCGTGTTAATTTGTTAA | CTA | chr17 | 42909747 | 42909768 | 42909752 | 42909747 | - |
| SEQ ID NO 62860 | ATTTGTTAAATTTGGCAGATTC | TTA | chr17 | 42909734 | 42909755 | 42909739 | 42909734 | - |
| SEQ ID NO 62861 | GTTAAATTTGGCAGATTCCCTG | TTT | chr17 | 42909730 | 42909751 | 42909735 | 42909730 | - |
| SEQ ID NO 62862 | TTAAATTTGGCAGATTCCCTGA | TTG | chr17 | 42909729 | 42909750 | 42909734 | 42909729 | - |

Figure 90 (Cont'd)

| | | | | | | | | |
|---|---|---|---|---|---|---|---|---|
| SEQ ID NO 62863 | AATTTGGCAGATTCCCTGAAAA | TTA | chr17 | 42909726 | 42909747 | 42909731 | 42909726 | - |
| SEQ ID NO 62864 | GGCAGATTCCCTGAAAAGTAAA | TTT | chr17 | 42909721 | 42909742 | 42909726 | 42909721 | - |
| SEQ ID NO 62865 | GCAGATTCCCTGAAAAGTAAAT | TTG | chr17 | 42909720 | 42909741 | 42909725 | 42909720 | - |
| SEQ ID NO 62866 | CCTGAAAAGTAAATTAGGGCCT | TTC | chr17 | 42909712 | 42909733 | 42909717 | 42909712 | - |
| SEQ ID NO 62867 | AAAAGTAAATTAGGGCCTGTTG | CTG | chr17 | 42909708 | 42909729 | 42909713 | 42909708 | - |
| SEQ ID NO 62868 | GGGCCTGTTGAAGACCAGTAAG | TTA | chr17 | 42909696 | 42909717 | 42909701 | 42909696 | - |
| SEQ ID NO 62869 | TTGAAGACCAGTAAGAAATAAA | CTG | chr17 | 42909689 | 42909710 | 42909694 | 42909689 | - |
| SEQ ID NO 62870 | AAGACCAGTAAGAAATAAAGAT | TTG | chr17 | 42909686 | 42909707 | 42909691 | 42909686 | - |
| SEQ ID NO 62871 | TAAAAAGCTCTGAGATTTCAAG | TTG | chr17 | 42909662 | 42909683 | 42909667 | 42909662 | - |
| SEQ ID NO 62872 | TGAGATTTCAAGCTAATTCAAT | CTC | chr17 | 42909652 | 42909673 | 42909657 | 42909652 | - |
| SEQ ID NO 62873 | AGATTTCAAGCTAATTCAATTT | CTG | chr17 | 42909650 | 42909671 | 42909655 | 42909650 | - |
| SEQ ID NO 62874 | CAAGCTAATTCAATTTGGTGCG | TTT | chr17 | 42909644 | 42909665 | 42909649 | 42909644 | - |
| SEQ ID NO 62875 | AAGCTAATTCAATTTGGTGCGT | TTC | chr17 | 42909643 | 42909664 | 42909648 | 42909643 | - |
| SEQ ID NO 62876 | ATTCAATTTGGTGCGTTAATTT | CTA | chr17 | 42909637 | 42909658 | 42909642 | 42909637 | - |
| SEQ ID NO 62877 | AATTTGGTGCGTTAATTTGATG | TTC | chr17 | 42909633 | 42909654 | 42909638 | 42909633 | - |
| SEQ ID NO 62878 | GGTGCGTTAATTTGATGTATGG | TTT | chr17 | 42909628 | 42909649 | 42909633 | 42909628 | - |
| SEQ ID NO 62879 | GTGCGTTAATTTGATGTATGGT | TTG | chr17 | 42909627 | 42909648 | 42909632 | 42909627 | - |
| SEQ ID NO 62880 | ATTTGATGTATGGTAACTTCTA | TTA | chr17 | 42909619 | 42909640 | 42909624 | 42909619 | - |
| SEQ ID NO 62881 | GATGTATGGTAACTTCTACACA | TTT | chr17 | 42909615 | 42909636 | 42909620 | 42909615 | - |
| SEQ ID NO 62882 | ATGTATGGTAACTTCTACACAA | TTG | chr17 | 42909614 | 42909635 | 42909619 | 42909614 | - |
| SEQ ID NO 62883 | CTACACAATTCATTCTATAGAT | CTT | chr17 | 42909600 | 42909621 | 42909605 | 42909600 | - |
| SEQ ID NO 62884 | TACACAATTCATTCTATAGATC | TTC | chr17 | 42909599 | 42909620 | 42909604 | 42909599 | - |
| SEQ ID NO 62885 | CACAATTCATTCTATAGATCTG | CTA | chr17 | 42909597 | 42909618 | 42909602 | 42909597 | - |
| SEQ ID NO 62886 | ATTCTATAGATCTGGGCACTCT | TTC | chr17 | 42909589 | 42909610 | 42909594 | 42909589 | - |
| SEQ ID NO 62887 | TATAGATCTGGGCACTCTTATA | TTC | chr17 | 42909585 | 42909606 | 42909590 | 42909585 | - |
| SEQ ID NO 62888 | TAGATCTGGGCACTCTTATAGA | CTA | chr17 | 42909583 | 42909604 | 42909588 | 42909583 | - |
| SEQ ID NO 62889 | GGCACTCTTATAGAAATTAATC | CTG | chr17 | 42909575 | 42909596 | 42909580 | 42909575 | - |
| SEQ ID NO 62890 | TTATAGAAATTAATCATTTCAA | CTC | chr17 | 42909568 | 42909589 | 42909573 | 42909568 | - |
| SEQ ID NO 62891 | ATAGAAATTAATCATTTCAAGT | CTT | chr17 | 42909566 | 42909587 | 42909571 | 42909566 | - |
| SEQ ID NO 62892 | TAGAAATTAATCATTTCAAGTT | TTA | chr17 | 42909565 | 42909586 | 42909570 | 42909565 | - |
| SEQ ID NO 62893 | ATCATTTCAAGTTGCTCATTCT | TTA | chr17 | 42909556 | 42909577 | 42909561 | 42909556 | - |
| SEQ ID NO 62894 | CAAGTTGCTCATTCTTGACTTT | TTT | chr17 | 42909549 | 42909570 | 42909554 | 42909549 | - |
| SEQ ID NO 62895 | AAGTTGCTCATTCTTGACTTTC | TTC | chr17 | 42909548 | 42909569 | 42909553 | 42909548 | - |
| SEQ ID NO 62896 | CTCATTCTTGACTTTCAACCCA | TTG | chr17 | 42909542 | 42909563 | 42909547 | 42909542 | - |
| SEQ ID NO 62897 | ATTCTTGACTTTCAACCCACAG | CTC | chr17 | 42909539 | 42909560 | 42909544 | 42909539 | - |
| SEQ ID NO 62898 | TTGACTTTCAACCCACAGAAAT | TTC | chr17 | 42909535 | 42909556 | 42909540 | 42909535 | - |
| SEQ ID NO 62899 | GACTTTCAACCCACAGAAATGC | CTT | chr17 | 42909533 | 42909554 | 42909538 | 42909533 | - |
| SEQ ID NO 62900 | ACTTTCAACCCACAGAAATGCT | TTG | chr17 | 42909532 | 42909553 | 42909537 | 42909532 | - |
| SEQ ID NO 62901 | TCAACCCACAGAAATGCTAACA | CTT | chr17 | 42909528 | 42909549 | 42909533 | 42909528 | - |
| SEQ ID NO 62902 | CAACCCACAGAAATGCTAACAG | TTT | chr17 | 42909527 | 42909548 | 42909532 | 42909527 | - |
| SEQ ID NO 62903 | AACCCACAGAAATGCTAACAGT | TTC | chr17 | 42909526 | 42909547 | 42909531 | 42909526 | - |
| SEQ ID NO 62904 | ACAGTACTGATTACACACAGGA | CTA | chr17 | 42909509 | 42909530 | 42909514 | 42909509 | - |
| SEQ ID NO 62905 | ATTACACACAGGATGTGGCTGG | CTG | chr17 | 42909500 | 42909521 | 42909505 | 42909500 | - |
| SEQ ID NO 62906 | CACACAGGATGTGGCTGGAATG | TTA | chr17 | 42909496 | 42909517 | 42909501 | 42909496 | - |
| SEQ ID NO 62907 | GAATGCTGGGATTTTGTCCTGA | CTG | chr17 | 42909479 | 42909500 | 42909484 | 42909479 | - |
| SEQ ID NO 62908 | GGATTTTGTCCTGATTAGGGAG | CTG | chr17 | 42909471 | 42909492 | 42909476 | 42909471 | - |
| SEQ ID NO 62909 | TGTCCTGATTAGGGAGAGAAAC | TTT | chr17 | 42909465 | 42909486 | 42909470 | 42909465 | - |
| SEQ ID NO 62910 | GTCCTGATTAGGGAGAGAAACG | TTT | chr17 | 42909464 | 42909485 | 42909469 | 42909464 | - |
| SEQ ID NO 62911 | TCCTGATTAGGGAGAGAAACGG | TTG | chr17 | 42909463 | 42909484 | 42909468 | 42909463 | - |
| SEQ ID NO 62912 | ATTAGGGAGAGAAACGGAATGG | CTG | chr17 | 42909458 | 42909479 | 42909463 | 42909458 | - |
| SEQ ID NO 62913 | GGGAGAGAAACGGAATGGGGTT | TTA | chr17 | 42909454 | 42909475 | 42909459 | 42909454 | - |
| SEQ ID NO 62914 | GGGGGAGAAGGAAGGGAGTCAG | TTT | chr17 | 42909431 | 42909452 | 42909436 | 42909431 | - |
| SEQ ID NO 62915 | GGGGAGAAGGAAGGGAGTCAGA | TTG | chr17 | 42909430 | 42909451 | 42909435 | 42909430 | - |
| SEQ ID NO 62916 | ACAGGACTCCAGCAACAACTTG | CTG | chr17 | 42909394 | 42909415 | 42909399 | 42909394 | - |
| SEQ ID NO 62917 | CAGCAACAACTTGATGAGGAAA | CTC | chr17 | 42909385 | 42909406 | 42909390 | 42909385 | - |
| SEQ ID NO 62918 | GATGAGGAAAATGAGCAGCAAG | CTT | chr17 | 42909373 | 42909394 | 42909378 | 42909373 | - |
| SEQ ID NO 62919 | ATGAGGAAAATGAGCAGCAAGG | TTG | chr17 | 42909372 | 42909393 | 42909377 | 42909372 | - |
| SEQ ID NO 62920 | GTGACAGACAGACATTCAGCTG | TTC | chr17 | 42909343 | 42909364 | 42909348 | 42909343 | - |

Figure 90 (Cont'd)

| | | | | | | | | |
|---|---|---|---|---|---|---|---|---|
| SEQ ID NO 62921 | AGCTGCACAGCCCAGAATCCCA | TTC | chr17 | 42909326 | 42909347 | 42909331 | 42909326 | - |
| SEQ ID NO 62922 | CACAGCCCAGAATCCCAACCAC | CTG | chr17 | 42909321 | 42909342 | 42909326 | 42909321 | - |
| SEQ ID NO 62923 | AAGCACCTGCAACAGAAGAGGC | TTC | chr17 | 42909287 | 42909308 | 42909292 | 42909287 | - |
| SEQ ID NO 62924 | CAACAGAAGAGGCAACCATAAC | CTG | chr17 | 42909278 | 42909299 | 42909283 | 42909278 | - |
| SEQ ID NO 62925 | CAGCAAAGAAAACAGCCCCTGC | CTT | chr17 | 42909235 | 42909256 | 42909240 | 42909235 | - |
| SEQ ID NO 62926 | AGCAAAGAAAACAGCCCCTGCA | TTC | chr17 | 42909234 | 42909255 | 42909239 | 42909234 | - |
| SEQ ID NO 62927 | CAGAAATGTTGGAGCCTGGCAA | CTG | chr17 | 42909214 | 42909235 | 42909219 | 42909214 | - |
| SEQ ID NO 62928 | GAGCCTGGCAAACTTAGGTGCT | TTG | chr17 | 42909203 | 42909224 | 42909208 | 42909203 | - |
| SEQ ID NO 62929 | GCAAACTTAGGTGCTCTCAGTG | CTG | chr17 | 42909196 | 42909217 | 42909201 | 42909196 | - |
| SEQ ID NO 62930 | AGGTGCTCTCAGTGGAATTTTT | CTT | chr17 | 42909188 | 42909209 | 42909193 | 42909188 | - |
| SEQ ID NO 62931 | GGTGCTCTCAGTGGAATTTTTG | TTA | chr17 | 42909187 | 42909208 | 42909192 | 42909187 | - |
| SEQ ID NO 62932 | TCAGTGGAATTTTTGTAAATTA | CTC | chr17 | 42909180 | 42909201 | 42909185 | 42909180 | - |
| SEQ ID NO 62933 | AGTGGAATTTTTGTAAATTAAA | CTC | chr17 | 42909178 | 42909199 | 42909183 | 42909178 | - |
| SEQ ID NO 62934 | TTGTAAATTAAAGCCAGTACTC | TTT | chr17 | 42909168 | 42909189 | 42909173 | 42909168 | - |
| SEQ ID NO 62935 | TGTAAATTAAAGCCAGTACTCA | TTT | chr17 | 42909167 | 42909188 | 42909172 | 42909167 | - |
| SEQ ID NO 62936 | GTAAATTAAAGCCAGTACTCAA | TTT | chr17 | 42909166 | 42909187 | 42909171 | 42909166 | - |
| SEQ ID NO 62937 | TAAATTAAAGCCAGTACTCAAA | TTG | chr17 | 42909165 | 42909186 | 42909170 | 42909165 | - |
| SEQ ID NO 62938 | AAGCCAGTACTCAAAAGTCCAA | TTA | chr17 | 42909158 | 42909179 | 42909163 | 42909158 | - |
| SEQ ID NO 62939 | AAAAGTCCAAAGATGCCTGTTG | CTC | chr17 | 42909146 | 42909167 | 42909151 | 42909146 | - |
| SEQ ID NO 62940 | TTGGGGGCTGGGTGCAGCGGCT | CTG | chr17 | 42909127 | 42909148 | 42909132 | 42909127 | - |
| SEQ ID NO 62941 | GGGGCTGGGTGCAGCGGCTCAG | TTG | chr17 | 42909124 | 42909145 | 42909129 | 42909124 | - |
| SEQ ID NO 62942 | GGTGCAGCGGCTCAGACCTGTA | CTG | chr17 | 42909117 | 42909138 | 42909122 | 42909117 | - |
| SEQ ID NO 62943 | AGACCTGTAATCCCAATACTTT | CTC | chr17 | 42909104 | 42909125 | 42909109 | 42909104 | - |
| SEQ ID NO 62944 | TAATCCCAATACTTTGGGAGGC | CTG | chr17 | 42909097 | 42909118 | 42909102 | 42909097 | - |
| SEQ ID NO 62945 | TGGGAGGCCGAGGTGAGAGGAT | CTT | chr17 | 42909083 | 42909104 | 42909088 | 42909083 | - |
| SEQ ID NO 62946 | GGGAGGCCGAGGTGAGAGGATC | TTT | chr17 | 42909082 | 42909103 | 42909087 | 42909082 | - |
| SEQ ID NO 62947 | GGAGGCCGAGGTGAGAGGATCA | TTG | chr17 | 42909081 | 42909102 | 42909086 | 42909081 | - |
| SEQ ID NO 62948 | GAGGCCAGGAGTTCAAGACTAG | CTT | chr17 | 42909056 | 42909077 | 42909061 | 42909056 | - |
| SEQ ID NO 62949 | AGGCCAGGAGTTCAAGACTAGT | TTG | chr17 | 42909055 | 42909076 | 42909060 | 42909055 | - |
| SEQ ID NO 62950 | AAGACTAGTCTGGGCAACATAG | TTC | chr17 | 42909042 | 42909063 | 42909047 | 42909042 | - |
| SEQ ID NO 62951 | GTCTGGGCAACATAGCAAGACC | CTA | chr17 | 42909035 | 42909056 | 42909040 | 42909035 | - |
| SEQ ID NO 62952 | GGCAACATAGCAAGACCCCTGT | CTG | chr17 | 42909030 | 42909051 | 42909035 | 42909030 | - |
| SEQ ID NO 62953 | TCTCTTTAAAAAAGATCAAAAT | CTG | chr17 | 42909009 | 42909030 | 42909014 | 42909009 | - |
| SEQ ID NO 62954 | TTTAAAAAAGATCAAAATTGAC | CTC | chr17 | 42909005 | 42909026 | 42909010 | 42909005 | - |
| SEQ ID NO 62955 | TAAAAAAGATCAAAATTGACCA | CTT | chr17 | 42909003 | 42909024 | 42909008 | 42909003 | - |
| SEQ ID NO 62956 | AAAAAAGATCAAAATTGACCAG | TTT | chr17 | 42909002 | 42909023 | 42909007 | 42909002 | - |
| SEQ ID NO 62957 | AAAAAGATCAAAATTGACCAGG | TTA | chr17 | 42909001 | 42909022 | 42909006 | 42909001 | - |
| SEQ ID NO 62958 | ACCAGGCACGGTGGCTTATGCT | TTG | chr17 | 42908985 | 42909006 | 42908990 | 42908985 | - |
| SEQ ID NO 62959 | ATGCTTGTAATCCCAGCACTTT | CTT | chr17 | 42908968 | 42908989 | 42908973 | 42908968 | - |
| SEQ ID NO 62960 | TGCTTGTAATCCCAGCACTTTG | TTA | chr17 | 42908967 | 42908988 | 42908972 | 42908967 | - |
| SEQ ID NO 62961 | GTAATCCCAGCACTTTGGGAGG | CTT | chr17 | 42908962 | 42908983 | 42908967 | 42908962 | - |
| SEQ ID NO 62962 | TAATCCCAGCACTTTGGGAGGC | TTG | chr17 | 42908961 | 42908982 | 42908966 | 42908961 | - |
| SEQ ID NO 62963 | TGGGAGGCCGAGGTGGGTGGAT | CTT | chr17 | 42908947 | 42908968 | 42908952 | 42908947 | - |
| SEQ ID NO 62964 | GGGAGGCCGAGGTGGGTGGATC | TTT | chr17 | 42908946 | 42908967 | 42908951 | 42908946 | - |
| SEQ ID NO 62965 | GGAGGCCGAGGTGGGTGGATCA | TTG | chr17 | 42908945 | 42908966 | 42908950 | 42908945 | - |
| SEQ ID NO 62966 | GAGGTCAGGAGTTTGAGACCAG | CTT | chr17 | 42908920 | 42908941 | 42908925 | 42908920 | - |
| SEQ ID NO 62967 | AGGTCAGGAGTTTGAGACCAGC | TTG | chr17 | 42908919 | 42908940 | 42908924 | 42908919 | - |
| SEQ ID NO 62968 | GAGACCAGCCTGATCAACAGGT | TTT | chr17 | 42908906 | 42908927 | 42908911 | 42908906 | - |
| SEQ ID NO 62969 | AGACCAGCCTGATCAACAGGTG | TTG | chr17 | 42908905 | 42908926 | 42908910 | 42908905 | - |
| SEQ ID NO 62970 | ATCAACAGGTGAAACCCCATCT | CTG | chr17 | 42908894 | 42908915 | 42908899 | 42908894 | - |
| SEQ ID NO 62971 | TACTAAAAAAAAAATTACAAAA | CTC | chr17 | 42908871 | 42908892 | 42908876 | 42908871 | - |
| SEQ ID NO 62972 | CTAAAAAAAAAATTACAAAATT | CTA | chr17 | 42908869 | 42908890 | 42908874 | 42908869 | - |
| SEQ ID NO 62973 | AAAAAAAAATTACAAAATTAGC | CTA | chr17 | 42908866 | 42908887 | 42908871 | 42908866 | - |
| SEQ ID NO 62974 | CAAAATTAGCCAGGTGGGGTGG | TTA | chr17 | 42908854 | 42908875 | 42908859 | 42908854 | - |
| SEQ ID NO 62975 | GCCAGGTGGGGTGGCTCACGCC | TTA | chr17 | 42908846 | 42908867 | 42908851 | 42908846 | - |
| SEQ ID NO 62976 | ACGCCTGTAATCCCAGCTATTT | CTC | chr17 | 42908829 | 42908850 | 42908834 | 42908829 | - |
| SEQ ID NO 62977 | TAATCCCAGCTATTTGAGAGGC | CTG | chr17 | 42908822 | 42908843 | 42908827 | 42908822 | - |
| SEQ ID NO 62978 | TTTGAGAGGCTGAGGCAGGAGA | CTA | chr17 | 42908810 | 42908831 | 42908815 | 42908810 | - |

Figure 90 (Cont'd)

| | | | | | | | | |
|---|---|---|---|---|---|---|---|---|
| SEQ ID NO 62979 | GAGAGGCTGAGGCAGGAGAATT | TTT | chr17 | 42908807 | 42908828 | 42908812 | 42908807 | - |
| SEQ ID NO 62980 | AGAGGCTGAGGCAGGAGAATTG | TTG | chr17 | 42908806 | 42908827 | 42908811 | 42908806 | - |
| SEQ ID NO 62981 | AGGCAGGAGAATTGCTTGAACT | CTG | chr17 | 42908798 | 42908819 | 42908803 | 42908798 | - |
| SEQ ID NO 62982 | CTTGAACTCAGGAGGTGGAGGT | TTG | chr17 | 42908784 | 42908805 | 42908789 | 42908784 | - |
| SEQ ID NO 62983 | GAACTCAGGAGGTGGAGGTTAC | CTT | chr17 | 42908781 | 42908802 | 42908786 | 42908781 | - |
| SEQ ID NO 62984 | AACTCAGGAGGTGGAGGTTACA | TTG | chr17 | 42908780 | 42908801 | 42908785 | 42908780 | - |
| SEQ ID NO 62985 | AGGAGGTGGAGGTTACAGTGAG | CTC | chr17 | 42908775 | 42908796 | 42908780 | 42908775 | - |
| SEQ ID NO 62986 | CAGTGAGCCGAGACTGCGCCAC | TTA | chr17 | 42908760 | 42908781 | 42908765 | 42908760 | - |
| SEQ ID NO 62987 | CGCCACTGCACTCTAGCCTGGG | CTG | chr17 | 42908744 | 42908765 | 42908749 | 42908744 | - |
| SEQ ID NO 62988 | CACTCTAGCCTGGGCAACAAGA | CTG | chr17 | 42908736 | 42908757 | 42908741 | 42908736 | - |
| SEQ ID NO 62989 | TAGCCTGGGCAACAAGAGCAAA | CTC | chr17 | 42908731 | 42908752 | 42908736 | 42908731 | - |
| SEQ ID NO 62990 | GCCTGGGCAACAAGAGCAAAAC | CTA | chr17 | 42908729 | 42908750 | 42908734 | 42908729 | - |
| SEQ ID NO 62991 | GGCAACAAGAGCAAAACTCCGT | CTG | chr17 | 42908724 | 42908745 | 42908729 | 42908724 | - |
| SEQ ID NO 62992 | CGTCTCAAAAAAAAAAAAAAAA | CTC | chr17 | 42908705 | 42908726 | 42908710 | 42908705 | - |
| SEQ ID NO 62993 | AAAAAAAAAAAAAAAAGGCCAG | CTC | chr17 | 42908699 | 42908720 | 42908704 | 42908699 | - |
| SEQ ID NO 62994 | ATGCCTGCAATCCCAGCACTTT | CTC | chr17 | 42908665 | 42908686 | 42908670 | 42908665 | - |
| SEQ ID NO 62995 | CAATCCCAGCACTTTGGGAGGC | CTG | chr17 | 42908658 | 42908679 | 42908663 | 42908658 | - |
| SEQ ID NO 62996 | TGGGAGGCTGAGGCGGATGGAT | CTT | chr17 | 42908644 | 42908665 | 42908649 | 42908644 | - |
| SEQ ID NO 62997 | GGGAGGCTGAGGCGGATGGATC | TTT | chr17 | 42908643 | 42908664 | 42908648 | 42908643 | - |
| SEQ ID NO 62998 | GGAGGCTGAGGCGGATGGATCA | TTG | chr17 | 42908642 | 42908663 | 42908647 | 42908642 | - |
| SEQ ID NO 62999 | AGGCGGATGGATCACTAGGTCA | CTG | chr17 | 42908634 | 42908655 | 42908639 | 42908634 | - |
| SEQ ID NO 63000 | GGTCAGGAGTTCAAGACCAGCC | CTA | chr17 | 42908617 | 42908638 | 42908622 | 42908617 | - |
| SEQ ID NO 63001 | AAGACCAGCCTGGCCAATATGG | TTC | chr17 | 42908605 | 42908626 | 42908610 | 42908605 | - |
| SEQ ID NO 63002 | GCCAATATGGTGAAACCCCATC | CTG | chr17 | 42908593 | 42908614 | 42908598 | 42908593 | - |
| SEQ ID NO 63003 | TACTAAAAATAAAAAATTAGC | CTC | chr17 | 42908569 | 42908590 | 42908574 | 42908569 | - |
| SEQ ID NO 63004 | CTAAAAATAAAAAAATTAGCCA | CTA | chr17 | 42908567 | 42908588 | 42908572 | 42908567 | - |
| SEQ ID NO 63005 | AAAATAAAAAAATTAGCCAGGT | CTA | chr17 | 42908564 | 42908585 | 42908569 | 42908564 | - |
| SEQ ID NO 63006 | GCCAGGTGTGGTGGCACGTGCC | TTA | chr17 | 42908549 | 42908570 | 42908554 | 42908549 | - |
| SEQ ID NO 63007 | TAGTCCCAGCTACTCGGTAGGC | CTG | chr17 | 42908525 | 42908546 | 42908530 | 42908525 | - |
| SEQ ID NO 63008 | CTCGGTAGGCTGAGGCAGAAGA | CTA | chr17 | 42908513 | 42908534 | 42908518 | 42908513 | - |
| SEQ ID NO 63009 | GGTAGGCTGAGGCAGAAGAATA | CTC | chr17 | 42908510 | 42908531 | 42908515 | 42908510 | - |
| SEQ ID NO 63010 | AGGCAGAAGAATAGCTTGAACC | CTG | chr17 | 42908501 | 42908522 | 42908506 | 42908501 | - |
| SEQ ID NO 63011 | GAACCCAGGAAGCGGAGGTTGC | CTT | chr17 | 42908484 | 42908505 | 42908489 | 42908484 | - |
| SEQ ID NO 63012 | AACCCAGGAAGCGGAGGTTGCA | TTG | chr17 | 42908483 | 42908504 | 42908488 | 42908483 | - |
| SEQ ID NO 63013 | CAGTGAGGCGAGATGGCGCCAC | TTG | chr17 | 42908463 | 42908484 | 42908468 | 42908463 | - |
| SEQ ID NO 63014 | CACTCCAGCCTGGGCAACAGAG | CTG | chr17 | 42908439 | 42908460 | 42908444 | 42908439 | - |
| SEQ ID NO 63015 | CAGCCTGGGCAACAGAGCGAGA | CTC | chr17 | 42908434 | 42908455 | 42908439 | 42908434 | - |
| SEQ ID NO 63016 | GGCAACAGAGCGAGATTCCGTC | CTG | chr17 | 42908427 | 42908448 | 42908432 | 42908427 | - |
| SEQ ID NO 63017 | CGTCTCAAAAAAAAAAAAAAAA | TTC | chr17 | 42908409 | 42908430 | 42908414 | 42908409 | - |
| SEQ ID NO 63018 | AAAAAAAAAAAAAAATGCCTG | CTC | chr17 | 42908403 | 42908424 | 42908408 | 42908403 | - |
| SEQ ID NO 63019 | TGGCAAGTGGTTAACCCTTGTG | CTG | chr17 | 42908381 | 42908402 | 42908386 | 42908381 | - |
| SEQ ID NO 63020 | ACCCTTGTGTATATGAATTTTA | TTA | chr17 | 42908368 | 42908389 | 42908373 | 42908368 | - |
| SEQ ID NO 63021 | GTGTATATGAATTTTAACTTCC | CTT | chr17 | 42908362 | 42908383 | 42908367 | 42908362 | - |
| SEQ ID NO 63022 | TGTATATGAATTTTAACTTCCC | TTG | chr17 | 42908361 | 42908382 | 42908366 | 42908361 | - |
| SEQ ID NO 63023 | TAACTTCCCTATTTTATCTGTT | TTT | chr17 | 42908348 | 42908369 | 42908353 | 42908348 | - |
| SEQ ID NO 63024 | AACTTCCCTATTTTATCTGTTT | TTT | chr17 | 42908347 | 42908368 | 42908352 | 42908347 | - |
| SEQ ID NO 63025 | ACTTCCCTATTTTATCTGTTTG | TTA | chr17 | 42908346 | 42908367 | 42908351 | 42908346 | - |
| SEQ ID NO 63026 | CCCTATTTTATCTGTTTGATAA | CTT | chr17 | 42908342 | 42908363 | 42908347 | 42908342 | - |
| SEQ ID NO 63027 | CCTATTTTATCTGTTTGATAAT | TTC | chr17 | 42908341 | 42908362 | 42908346 | 42908341 | - |
| SEQ ID NO 63028 | TTTTATCTGTTTGATAATTAAG | CTA | chr17 | 42908337 | 42908358 | 42908342 | 42908337 | - |
| SEQ ID NO 63029 | TATCTGTTTGATAATTAAGGAT | TTT | chr17 | 42908334 | 42908355 | 42908339 | 42908334 | - |
| SEQ ID NO 63030 | ATCTGTTTGATAATTAAGGATT | TTT | chr17 | 42908333 | 42908354 | 42908338 | 42908333 | - |
| SEQ ID NO 63031 | TCTGTTTGATAATTAAGGATTT | TTA | chr17 | 42908332 | 42908353 | 42908337 | 42908332 | - |
| SEQ ID NO 63032 | TTTGATAATTAAGGATTTGCAT | CTG | chr17 | 42908328 | 42908349 | 42908333 | 42908328 | - |
| SEQ ID NO 63033 | GATAATTAAGGATTTGCATGGC | TTT | chr17 | 42908325 | 42908346 | 42908330 | 42908325 | - |
| SEQ ID NO 63034 | ATAATTAAGGATTTGCATGGCT | TTG | chr17 | 42908324 | 42908345 | 42908329 | 42908324 | - |
| SEQ ID NO 63035 | AGGATTTGCATGGCTGGCGCGG | TTA | chr17 | 42908317 | 42908338 | 42908322 | 42908317 | - |
| SEQ ID NO 63036 | GCATGGCTGGCGCGGTGGCTCA | TTT | chr17 | 42908310 | 42908331 | 42908315 | 42908310 | - |

Figure 90 (Cont'd)

| | | | | | | | | |
|---|---|---|---|---|---|---|---|---|
| SEQ ID NO 63037 | CATGGCTGGCGCGGTGGCTCAT | TTG | chr17 | 42908309 | 42908330 | 42908314 | 42908309 | - |
| SEQ ID NO 63038 | GCGCGGTGGCTCATGCCTGTAA | CTG | chr17 | 42908301 | 42908322 | 42908306 | 42908301 | - |
| SEQ ID NO 63039 | ATGCCTGTAATCCCAATATTTT | CTC | chr17 | 42908289 | 42908310 | 42908294 | 42908289 | - |
| SEQ ID NO 63040 | TAATCCCAATATTTTAGGAGGC | CTG | chr17 | 42908282 | 42908303 | 42908287 | 42908282 | - |
| SEQ ID NO 63041 | TAGGAGGCTGAGGCAAGCCAAT | TTT | chr17 | 42908268 | 42908289 | 42908273 | 42908268 | - |
| SEQ ID NO 63042 | AGGAGGCTGAGGCAAGCCAATT | TTT | chr17 | 42908267 | 42908288 | 42908272 | 42908267 | - |
| SEQ ID NO 63043 | GGAGGCTGAGGCAAGCCAATTG | TTA | chr17 | 42908266 | 42908287 | 42908271 | 42908266 | - |
| SEQ ID NO 63044 | AGGCAAGCCAATTGCTTGAGAT | CTG | chr17 | 42908258 | 42908279 | 42908263 | 42908258 | - |
| SEQ ID NO 63045 | CTTGAGATCAAGACCAGCCTGA | TTG | chr17 | 42908244 | 42908265 | 42908249 | 42908244 | - |
| SEQ ID NO 63046 | GAGATCAAGACCAGCCTGAGCC | CTT | chr17 | 42908241 | 42908262 | 42908246 | 42908241 | - |
| SEQ ID NO 63047 | AGATCAAGACCAGCCTGAGCCT | TTG | chr17 | 42908240 | 42908261 | 42908245 | 42908240 | - |
| SEQ ID NO 63048 | AGCCTGGGCAACATAGCAGAAC | CTG | chr17 | 42908223 | 42908244 | 42908228 | 42908223 | - |
| SEQ ID NO 63049 | GGCAACATAGCAGAACTCTGTC | CTG | chr17 | 42908217 | 42908238 | 42908222 | 42908217 | - |
| SEQ ID NO 63050 | TGTCTCTACAAAAAGATACGAG | CTC | chr17 | 42908199 | 42908220 | 42908204 | 42908199 | - |
| SEQ ID NO 63051 | TCTCTACAAAAAGATACGAGAA | CTG | chr17 | 42908197 | 42908218 | 42908202 | 42908197 | - |
| SEQ ID NO 63052 | TACAAAAAGATACGAGAAATTA | CTC | chr17 | 42908193 | 42908214 | 42908198 | 42908193 | - |
| SEQ ID NO 63053 | CAAAAAGATACGAGAAATTAGC | CTA | chr17 | 42908191 | 42908212 | 42908196 | 42908191 | - |
| SEQ ID NO 63054 | GCTGGGTGTGGTGTGTGGCCTG | TTA | chr17 | 42908171 | 42908192 | 42908176 | 42908171 | - |
| SEQ ID NO 63055 | GGTGTGGTGTGTGGCCTGTGGT | CTG | chr17 | 42908167 | 42908188 | 42908172 | 42908167 | - |
| SEQ ID NO 63056 | TGGTCCCAGCTACTCAGATGGC | CTG | chr17 | 42908149 | 42908170 | 42908154 | 42908149 | - |
| SEQ ID NO 63057 | CTCAGATGGCTGAGGTGGGAGG | CTA | chr17 | 42908137 | 42908158 | 42908142 | 42908137 | - |
| SEQ ID NO 63058 | AGATGGCTGAGGTGGGAGGATC | CTC | chr17 | 42908134 | 42908155 | 42908139 | 42908134 | - |
| SEQ ID NO 63059 | AGGTGGGAGGATCGCTTGAGCC | CTG | chr17 | 42908125 | 42908146 | 42908130 | 42908125 | - |
| SEQ ID NO 63060 | GAGCCTGGGAGGCAGAGGTTGC | CTT | chr17 | 42908108 | 42908129 | 42908113 | 42908108 | - |
| SEQ ID NO 63061 | AGCCTGGGAGGCAGAGGTTGCA | TTG | chr17 | 42908107 | 42908128 | 42908112 | 42908107 | - |
| SEQ ID NO 63062 | GGAGGCAGAGGTTGCAGCGAGA | CTG | chr17 | 42908101 | 42908122 | 42908106 | 42908101 | - |
| SEQ ID NO 63063 | CAGCGAGACATGATCGTGCCAC | TTG | chr17 | 42908087 | 42908108 | 42908092 | 42908087 | - |
| SEQ ID NO 63064 | CACTTCAGCCTGGATGACAGAG | CTG | chr17 | 42908063 | 42908084 | 42908068 | 42908063 | - |
| SEQ ID NO 63065 | CAGCCTGGATGACAGAGCGAGA | CTT | chr17 | 42908058 | 42908079 | 42908063 | 42908058 | - |
| SEQ ID NO 63066 | AGCCTGGATGACAGAGCGAGAC | TTC | chr17 | 42908057 | 42908078 | 42908062 | 42908057 | - |
| SEQ ID NO 63067 | GATGACAGAGCGAGACTGCATC | CTG | chr17 | 42908051 | 42908072 | 42908056 | 42908051 | - |
| SEQ ID NO 63068 | CATCTCAAAAATAAAAATAAAA | CTG | chr17 | 42908033 | 42908054 | 42908038 | 42908033 | - |
| SEQ ID NO 63069 | AAAAATAAAAATAAAAGGATT | CTC | chr17 | 42908027 | 42908048 | 42908032 | 42908027 | - |
| SEQ ID NO 63070 | GCACTGTGGCTGCACACCCGGA | TTT | chr17 | 42908004 | 42908025 | 42908009 | 42908004 | - |
| SEQ ID NO 63071 | CACTGTGGCTGCACACCCGGAA | TTG | chr17 | 42908003 | 42908024 | 42908008 | 42908003 | - |
| SEQ ID NO 63072 | TGGCTGCACACCCGGAATTCTC | CTG | chr17 | 42907998 | 42908019 | 42908003 | 42907998 | - |
| SEQ ID NO 63073 | CACACCCGGAATTCTCTGTAGT | CTG | chr17 | 42907992 | 42908013 | 42907997 | 42907992 | - |
| SEQ ID NO 63074 | TCTGTAGTAGGAATATCTTCTG | TTC | chr17 | 42907978 | 42907999 | 42907983 | 42907978 | - |
| SEQ ID NO 63075 | TGTAGTAGGAATATCTTCTGTT | CTC | chr17 | 42907976 | 42907997 | 42907981 | 42907976 | - |
| SEQ ID NO 63076 | TAGTAGGAATATCTTCTGTTTC | CTG | chr17 | 42907974 | 42907995 | 42907979 | 42907974 | - |
| SEQ ID NO 63077 | CTGTTTCTCTGGTTATTTTAAC | CTT | chr17 | 42907959 | 42907980 | 42907964 | 42907959 | - |
| SEQ ID NO 63078 | TGTTTCTCTGGTTATTTTAACC | TTC | chr17 | 42907958 | 42907979 | 42907963 | 42907958 | - |
| SEQ ID NO 63079 | TTTCTCTGGTTATTTTAACCTG | CTG | chr17 | 42907956 | 42907977 | 42907961 | 42907956 | - |
| SEQ ID NO 63080 | CTCTGGTTATTTTAACCTGGAT | TTT | chr17 | 42907953 | 42907974 | 42907958 | 42907953 | - |
| SEQ ID NO 63081 | TCTGGTTATTTTAACCTGGATG | TTC | chr17 | 42907952 | 42907973 | 42907957 | 42907952 | - |
| SEQ ID NO 63082 | TGGTTATTTTAACCTGGATGGG | CTC | chr17 | 42907950 | 42907971 | 42907955 | 42907950 | - |
| SEQ ID NO 63083 | GTTATTTTAACCTGGATGGGTG | CTG | chr17 | 42907948 | 42907969 | 42907953 | 42907948 | - |
| SEQ ID NO 63084 | TTTTAACCTGGATGGGTGACTC | TTA | chr17 | 42907944 | 42907965 | 42907949 | 42907944 | - |
| SEQ ID NO 63085 | TAACCTGGATGGGTGACTCTGT | TTT | chr17 | 42907941 | 42907962 | 42907946 | 42907941 | - |
| SEQ ID NO 63086 | AACCTGGATGGGTGACTCTGTG | TTT | chr17 | 42907940 | 42907961 | 42907945 | 42907940 | - |
| SEQ ID NO 63087 | ACCTGGATGGGTGACTCTGTGG | TTA | chr17 | 42907939 | 42907960 | 42907944 | 42907939 | - |
| SEQ ID NO 63088 | GATGGGTGACTCTGTGGTTGGT | CTG | chr17 | 42907934 | 42907955 | 42907939 | 42907934 | - |
| SEQ ID NO 63089 | TGTGGTTGGTACAGACATGGGT | CTC | chr17 | 42907922 | 42907943 | 42907927 | 42907922 | - |
| SEQ ID NO 63090 | TGGTTGGTACAGACATGGGTTT | CTG | chr17 | 42907920 | 42907941 | 42907925 | 42907920 | - |
| SEQ ID NO 63091 | GTACAGACATGGGTTTTTATTT | TTG | chr17 | 42907914 | 42907935 | 42907919 | 42907914 | - |
| SEQ ID NO 63092 | TTATTTAAGCCCTGCTGCTACT | TTT | chr17 | 42907898 | 42907919 | 42907903 | 42907898 | - |
| SEQ ID NO 63093 | TATTTAAGCCCTGCTGCTACTT | TTT | chr17 | 42907897 | 42907918 | 42907902 | 42907897 | - |
| SEQ ID NO 63094 | ATTTAAGCCCTGCTGCTACTTC | TTT | chr17 | 42907896 | 42907917 | 42907901 | 42907896 | - |

Figure 90 (Cont'd)

| | | | | | | | | |
|---|---|---|---|---|---|---|---|---|
| SEQ ID NO 63095 | TTTAAGCCCTGCTGCTACTTCA | TTA | chr17 | 42907895 | 42907916 | 42907900 | 42907895 | - |
| SEQ ID NO 63096 | AAGCCCTGCTGCTACTTCACTA | TTT | chr17 | 42907892 | 42907913 | 42907897 | 42907892 | - |
| SEQ ID NO 63097 | AGCCCTGCTGCTACTTCACTAC | TTA | chr17 | 42907891 | 42907912 | 42907896 | 42907891 | - |
| SEQ ID NO 63098 | CTGCTACTTCACTACCTTATTT | CTG | chr17 | 42907884 | 42907905 | 42907889 | 42907884 | - |
| SEQ ID NO 63099 | CTACTTCACTACCTTATTTTTA | CTG | chr17 | 42907881 | 42907902 | 42907886 | 42907881 | - |
| SEQ ID NO 63100 | CTTCACTACCTTATTTTTATAA | CTA | chr17 | 42907878 | 42907899 | 42907883 | 42907878 | - |
| SEQ ID NO 63101 | CACTACCTTATTTTTATAAGTC | CTT | chr17 | 42907875 | 42907896 | 42907880 | 42907875 | - |
| SEQ ID NO 63102 | ACTACCTTATTTTTATAAGTCC | TTC | chr17 | 42907874 | 42907895 | 42907879 | 42907874 | - |
| SEQ ID NO 63103 | CCTTATTTTTATAAGTCCCTTC | CTA | chr17 | 42907870 | 42907891 | 42907875 | 42907870 | - |
| SEQ ID NO 63104 | ATTTTTATAAGTCCCTTCATGG | CTT | chr17 | 42907866 | 42907887 | 42907871 | 42907866 | - |
| SEQ ID NO 63105 | TTTTTATAAGTCCCTTCATGGT | TTA | chr17 | 42907865 | 42907886 | 42907870 | 42907865 | - |
| SEQ ID NO 63106 | TTATAAGTCCCTTCATGGTGTT | TTT | chr17 | 42907862 | 42907883 | 42907867 | 42907862 | - |
| SEQ ID NO 63107 | TATAAGTCCCTTCATGGTGTTG | TTT | chr17 | 42907861 | 42907882 | 42907866 | 42907861 | - |
| SEQ ID NO 63108 | ATAAGTCCCTTCATGGTGTTGG | TTT | chr17 | 42907860 | 42907881 | 42907865 | 42907860 | - |
| SEQ ID NO 63109 | TAAGTCCCTTCATGGTGTTGGG | TTA | chr17 | 42907859 | 42907880 | 42907864 | 42907859 | - |
| SEQ ID NO 63110 | CATGGTGTTGGGCTTTGTTTCC | CTT | chr17 | 42907849 | 42907870 | 42907854 | 42907849 | - |
| SEQ ID NO 63111 | ATGGTGTTGGGCTTTGTTTCCT | TTC | chr17 | 42907848 | 42907869 | 42907853 | 42907848 | - |
| SEQ ID NO 63112 | GGCTTTGTTTCCTTATCTGTAA | TTG | chr17 | 42907839 | 42907860 | 42907844 | 42907839 | - |
| SEQ ID NO 63113 | TGTTTCCTTATCTGTAAAACAA | CTT | chr17 | 42907834 | 42907855 | 42907839 | 42907834 | - |
| SEQ ID NO 63114 | GTTTCCTTATCTGTAAAACAAC | TTT | chr17 | 42907833 | 42907854 | 42907838 | 42907833 | - |
| SEQ ID NO 63115 | TTTCCTTATCTGTAAAACAACG | TTG | chr17 | 42907832 | 42907853 | 42907837 | 42907832 | - |
| SEQ ID NO 63116 | CCTTATCTGTAAAACAACGGAT | TTT | chr17 | 42907829 | 42907850 | 42907834 | 42907829 | - |
| SEQ ID NO 63117 | CTTATCTGTAAAACAACGGATT | TTC | chr17 | 42907828 | 42907849 | 42907833 | 42907828 | - |
| SEQ ID NO 63118 | ATCTGTAAAACAACGGATTGCA | CTT | chr17 | 42907825 | 42907846 | 42907830 | 42907825 | - |
| SEQ ID NO 63119 | TCTGTAAAACAACGGATTGCAC | TTA | chr17 | 42907824 | 42907845 | 42907829 | 42907824 | - |
| SEQ ID NO 63120 | TAAAACAACGGATTGCACTACT | CTG | chr17 | 42907820 | 42907841 | 42907825 | 42907820 | - |
| SEQ ID NO 63121 | CACTACTGGATCCCTTTCAGCC | TTG | chr17 | 42907805 | 42907826 | 42907810 | 42907805 | - |
| SEQ ID NO 63122 | CTGGATCCCTTTCAGCCCAAAC | CTA | chr17 | 42907800 | 42907821 | 42907805 | 42907800 | - |
| SEQ ID NO 63123 | GATCCCTTTCAGCCCAAACATT | CTG | chr17 | 42907797 | 42907818 | 42907802 | 42907797 | - |
| SEQ ID NO 63124 | TCAGCCCAAACATTCCCTGACT | CTT | chr17 | 42907789 | 42907810 | 42907794 | 42907789 | - |
| SEQ ID NO 63125 | CAGCCCAAACATTCCCTGACTC | TTT | chr17 | 42907788 | 42907809 | 42907793 | 42907788 | - |
| SEQ ID NO 63126 | AGCCCAAACATTCCCTGACTCT | TTC | chr17 | 42907787 | 42907808 | 42907792 | 42907787 | - |
| SEQ ID NO 63127 | CCTGACTCTGAGGTTTATCCCT | TTC | chr17 | 42907774 | 42907795 | 42907779 | 42907774 | - |
| SEQ ID NO 63128 | ACTCTGAGGTTTATCCCTATCC | CTG | chr17 | 42907770 | 42907791 | 42907775 | 42907770 | - |
| SEQ ID NO 63129 | TGAGGTTTATCCCTATCCAAAG | CTC | chr17 | 42907766 | 42907787 | 42907771 | 42907766 | - |
| SEQ ID NO 63130 | AGGTTTATCCCTATCCAAAGTG | CTG | chr17 | 42907764 | 42907785 | 42907769 | 42907764 | - |
| SEQ ID NO 63131 | ATCCCTATCCAAAGTGCCACAA | TTT | chr17 | 42907758 | 42907779 | 42907763 | 42907758 | - |
| SEQ ID NO 63132 | TCCCTATCCAAAGTGCCACAAC | TTA | chr17 | 42907757 | 42907778 | 42907762 | 42907757 | - |
| SEQ ID NO 63133 | TCCAAAGTGCCACAACTCTTAA | CTA | chr17 | 42907751 | 42907772 | 42907756 | 42907751 | - |
| SEQ ID NO 63134 | TTAATCAGCGGCTGCCCAGGTG | CTC | chr17 | 42907733 | 42907754 | 42907738 | 42907733 | - |
| SEQ ID NO 63135 | AATCAGCGGCTGCCCAGGTGTG | CTT | chr17 | 42907731 | 42907752 | 42907736 | 42907731 | - |
| SEQ ID NO 63136 | ATCAGCGGCTGCCCAGGTGTGG | TTA | chr17 | 42907730 | 42907751 | 42907735 | 42907730 | - |
| SEQ ID NO 63137 | CCCAGGTGTGGGAGCGGGCTAG | CTG | chr17 | 42907719 | 42907740 | 42907724 | 42907719 | - |
| SEQ ID NO 63138 | GGGGGATGTGAGGAAGAATACG | CTA | chr17 | 42907698 | 42907719 | 42907703 | 42907698 | - |
| SEQ ID NO 63139 | CAGAGAGAGCTGCCTCCTGCCC | CTA | chr17 | 42907662 | 42907683 | 42907667 | 42907662 | - |
| SEQ ID NO 63140 | CCTCCTGCCCTCCACCACCTAC | CTG | chr17 | 42907650 | 42907671 | 42907655 | 42907650 | - |
| SEQ ID NO 63141 | CTGCCCTCCACCACCTACACCC | CTC | chr17 | 42907646 | 42907667 | 42907651 | 42907646 | - |
| SEQ ID NO 63142 | CCCTCCACCACCTACACCCCAG | CTG | chr17 | 42907643 | 42907664 | 42907648 | 42907643 | - |
| SEQ ID NO 63143 | CACCACCTACACCCCAGTGGTG | CTC | chr17 | 42907638 | 42907659 | 42907643 | 42907638 | - |
| SEQ ID NO 63144 | CACCCCAGTGGTGAGTTCTTAC | CTA | chr17 | 42907629 | 42907650 | 42907634 | 42907629 | - |
| SEQ ID NO 63145 | TTACCGAAATCTGTAGGTCGGC | TTC | chr17 | 42907611 | 42907632 | 42907616 | 42907611 | - |
| SEQ ID NO 63146 | ACCGAAATCTGTAGGTCGGCTT | CTT | chr17 | 42907609 | 42907630 | 42907614 | 42907609 | - |
| SEQ ID NO 63147 | CCGAAATCTGTAGGTCGGCTTT | TTA | chr17 | 42907608 | 42907629 | 42907613 | 42907608 | - |
| SEQ ID NO 63148 | TAGGTCGGCTTTATCTTTCCCT | CTG | chr17 | 42907598 | 42907619 | 42907603 | 42907598 | - |
| SEQ ID NO 63149 | TATCTTTCCCTGAAAGATGGAA | CTT | chr17 | 42907587 | 42907608 | 42907592 | 42907587 | - |
| SEQ ID NO 63150 | ATCTTTCCCTGAAAGATGGAAA | TTT | chr17 | 42907586 | 42907607 | 42907591 | 42907586 | - |
| SEQ ID NO 63151 | TCTTTCCCTGAAAGATGGAAAG | TTA | chr17 | 42907585 | 42907606 | 42907590 | 42907585 | - |
| SEQ ID NO 63152 | TCCCTGAAAGATGGAAAGAGTA | CTT | chr17 | 42907581 | 42907602 | 42907586 | 42907581 | - |

Figure 90 (Cont'd)

| | | | | | | | | |
|---|---|---|---|---|---|---|---|---|
| SEQ ID NO 63153 | CCCTGAAAGATGGAAAGAGTAG | TTT | chr17 | 42907580 | 42907601 | 42907585 | 42907580 | - |
| SEQ ID NO 63154 | CCTGAAAGATGGAAAGAGTAGA | TTC | chr17 | 42907579 | 42907600 | 42907584 | 42907579 | - |
| SEQ ID NO 63155 | AAAGATGGAAAGAGTAGATGTG | CTG | chr17 | 42907575 | 42907596 | 42907580 | 42907575 | - |
| SEQ ID NO 63156 | CTGTGCCCATGGCATGGCCAGA | CTG | chr17 | 42907531 | 42907552 | 42907536 | 42907531 | - |
| SEQ ID NO 63157 | TGCCCATGGCATGGCCAGAGGG | CTG | chr17 | 42907528 | 42907549 | 42907533 | 42907528 | - |
| SEQ ID NO 63158 | CCTAAAGGGCAGGAAAGAGAAT | CTC | chr17 | 42907502 | 42907523 | 42907507 | 42907502 | - |
| SEQ ID NO 63159 | AAGGGCAGGAAAGAGAATGGAG | CTA | chr17 | 42907498 | 42907519 | 42907503 | 42907498 | - |
| SEQ ID NO 63160 | ATCTGGGAGACAGTGCATCATC | CTC | chr17 | 42907457 | 42907478 | 42907462 | 42907457 | - |
| SEQ ID NO 63161 | GGAGACAGTGCATCATCTACCC | CTG | chr17 | 42907452 | 42907473 | 42907457 | 42907452 | - |
| SEQ ID NO 63162 | CCCAGCCACCCAGCCATCCCCC | CTA | chr17 | 42907433 | 42907454 | 42907438 | 42907433 | - |
| SEQ ID NO 63163 | TCCACCCATCTACCCATTCATC | CTA | chr17 | 42907409 | 42907430 | 42907414 | 42907409 | - |
| SEQ ID NO 63164 | CCCATTCATCCATCCATTCACC | CTA | chr17 | 42907397 | 42907418 | 42907402 | 42907397 | - |
| SEQ ID NO 63165 | ATCCATCCATTCACCCCCCATC | TTC | chr17 | 42907390 | 42907411 | 42907395 | 42907390 | - |
| SEQ ID NO 63166 | ACCCCCCATCCATCCGTTCACC | TTC | chr17 | 42907378 | 42907399 | 42907383 | 42907378 | - |
| SEQ ID NO 63167 | ACCCCCCATCCATCCACCCATC | TTC | chr17 | 42907359 | 42907380 | 42907364 | 42907359 | - |
| SEQ ID NO 63168 | ACCATCCATTCGTTATCCATAA | CTT | chr17 | 42907335 | 42907356 | 42907340 | 42907335 | - |
| SEQ ID NO 63169 | CCATCCATTCGTTATCCATAAT | TTA | chr17 | 42907334 | 42907355 | 42907339 | 42907334 | - |
| SEQ ID NO 63170 | GTTATCCATAATTCATTTATTT | TTC | chr17 | 42907324 | 42907345 | 42907329 | 42907324 | - |
| SEQ ID NO 63171 | TCCATAATTCATTTATTTAACA | TTA | chr17 | 42907320 | 42907341 | 42907325 | 42907320 | - |
| SEQ ID NO 63172 | ATTTATTTAACAAATTTCCATC | TTC | chr17 | 42907310 | 42907331 | 42907315 | 42907310 | - |
| SEQ ID NO 63173 | ATTTAACAAATTTCCATCTCCT | TTT | chr17 | 42907306 | 42907327 | 42907311 | 42907306 | - |
| SEQ ID NO 63174 | TTTAACAAATTTCCATCTCCTA | TTA | chr17 | 42907305 | 42907326 | 42907310 | 42907305 | - |
| SEQ ID NO 63175 | AACAAATTTCCATCTCCTATGC | TTT | chr17 | 42907302 | 42907323 | 42907307 | 42907302 | - |
| SEQ ID NO 63176 | ACAAATTTCCATCTCCTATGCA | TTA | chr17 | 42907301 | 42907322 | 42907306 | 42907301 | - |
| SEQ ID NO 63177 | CCATCTCCTATGCACCAAGCAT | TTT | chr17 | 42907293 | 42907314 | 42907298 | 42907293 | - |
| SEQ ID NO 63178 | CATCTCCTATGCACCAAGCATT | TTC | chr17 | 42907292 | 42907313 | 42907297 | 42907292 | - |
| SEQ ID NO 63179 | CTATGCACCAAGCATTGTGCAA | CTC | chr17 | 42907286 | 42907307 | 42907291 | 42907286 | - |
| SEQ ID NO 63180 | TGCACCAAGCATTGTGCAAGGC | CTA | chr17 | 42907283 | 42907304 | 42907288 | 42907283 | - |
| SEQ ID NO 63181 | TGCAAGGCTCTGGGAATACAAT | TTG | chr17 | 42907269 | 42907290 | 42907274 | 42907269 | - |
| SEQ ID NO 63182 | TGGGAATACAATGATGAGCAAA | CTC | chr17 | 42907259 | 42907280 | 42907264 | 42907259 | - |
| SEQ ID NO 63183 | GGAATACAATGATGAGCAAAGC | CTG | chr17 | 42907257 | 42907278 | 42907262 | 42907257 | - |
| SEQ ID NO 63184 | CTCTTGCAGTTTAATACAGTCT | CTG | chr17 | 42907220 | 42907241 | 42907225 | 42907220 | - |
| SEQ ID NO 63185 | TTGCAGTTTAATACAGTCTGGA | CTC | chr17 | 42907217 | 42907238 | 42907222 | 42907217 | - |
| SEQ ID NO 63186 | GCAGTTTAATACAGTCTGGAGA | CTT | chr17 | 42907215 | 42907236 | 42907220 | 42907215 | - |
| SEQ ID NO 63187 | CAGTTTAATACAGTCTGGAGAT | TTG | chr17 | 42907214 | 42907235 | 42907219 | 42907214 | - |
| SEQ ID NO 63188 | AATACAGTCTGGAGATTACACA | TTT | chr17 | 42907208 | 42907229 | 42907213 | 42907208 | - |
| SEQ ID NO 63189 | ATACAGTCTGGAGATTACACAA | TTA | chr17 | 42907207 | 42907228 | 42907212 | 42907207 | - |
| SEQ ID NO 63190 | GAGATTACACAAAGAATCAGCA | CTG | chr17 | 42907197 | 42907218 | 42907202 | 42907197 | - |
| SEQ ID NO 63191 | CACAAAGAATCAGCATACTGGG | TTA | chr17 | 42907190 | 42907211 | 42907195 | 42907190 | - |
| SEQ ID NO 63192 | GGCGTACAATTACAAACTGATC | CTG | chr17 | 42907170 | 42907191 | 42907175 | 42907170 | - |
| SEQ ID NO 63193 | CAAACTGATCTGCCCTCCACAT | TTA | chr17 | 42907158 | 42907179 | 42907163 | 42907158 | - |
| SEQ ID NO 63194 | ATCTGCCCTCCACATCTTCTGT | CTG | chr17 | 42907151 | 42907172 | 42907156 | 42907151 | - |
| SEQ ID NO 63195 | CCCTCCACATCTTCTGTTCCTT | CTG | chr17 | 42907146 | 42907167 | 42907151 | 42907146 | - |
| SEQ ID NO 63196 | CACATCTTCTGTTCCTTCTCTC | CTC | chr17 | 42907141 | 42907162 | 42907146 | 42907141 | - |
| SEQ ID NO 63197 | CTGTTCCTTCTCTCCTTGCACA | CTT | chr17 | 42907133 | 42907154 | 42907138 | 42907133 | - |
| SEQ ID NO 63198 | TGTTCCTTCTCTCCTTGCACAC | TTC | chr17 | 42907132 | 42907153 | 42907137 | 42907132 | - |
| SEQ ID NO 63199 | TTCCTTCTCTCCTTGCACACTC | CTG | chr17 | 42907130 | 42907151 | 42907135 | 42907130 | - |
| SEQ ID NO 63200 | CTTCTCTCCTTGCACACTCTGT | TTC | chr17 | 42907127 | 42907148 | 42907132 | 42907127 | - |
| SEQ ID NO 63201 | CTCTCCTTGCACACTCTGTTCT | CTT | chr17 | 42907124 | 42907145 | 42907129 | 42907124 | - |
| SEQ ID NO 63202 | TCTCCTTGCACACTCTGTTCTG | TTC | chr17 | 42907123 | 42907144 | 42907128 | 42907123 | - |
| SEQ ID NO 63203 | TCCTTGCACACTCTGTTCTGGC | CTC | chr17 | 42907121 | 42907142 | 42907126 | 42907121 | - |
| SEQ ID NO 63204 | CTTGCACACTCTGTTCTGGCTA | CTC | chr17 | 42907119 | 42907140 | 42907124 | 42907119 | - |
| SEQ ID NO 63205 | GCACACTCTGTTCTGGCTACAC | CTT | chr17 | 42907116 | 42907137 | 42907121 | 42907116 | - |
| SEQ ID NO 63206 | CACACTCTGTTCTGGCTACACT | TTG | chr17 | 42907115 | 42907136 | 42907120 | 42907115 | - |
| SEQ ID NO 63207 | TGTTCTGGCTACACTGGCCTCA | CTC | chr17 | 42907108 | 42907129 | 42907113 | 42907108 | - |
| SEQ ID NO 63208 | TTCTGGCTACACTGGCCTCATT | CTG | chr17 | 42907106 | 42907127 | 42907111 | 42907106 | - |
| SEQ ID NO 63209 | TGGCTACACTGGCCTCATTGCT | TTC | chr17 | 42907103 | 42907124 | 42907108 | 42907103 | - |
| SEQ ID NO 63210 | GCTACACTGGCCTCATTGCTTT | CTG | chr17 | 42907101 | 42907122 | 42907106 | 42907101 | - |

Figure 90 (Cont'd)

| SEQ ID NO | Sequence | | | | | | |
|---|---|---|---|---|---|---|---|
| SEQ ID NO 63211 | CACTGGCCTCATTGCTTTCCTT | CTA | chr17 | 42907097 | 42907118 | 42907102 | 42907097 | - |
| SEQ ID NO 63212 | GCCTCATTGCTTTCCTTTAAAC | CTG | chr17 | 42907092 | 42907113 | 42907097 | 42907092 | - |
| SEQ ID NO 63213 | ATTGCTTTCCTTTAAACACACC | CTC | chr17 | 42907087 | 42907108 | 42907092 | 42907087 | - |
| SEQ ID NO 63214 | CTTTCCTTTAAACACACCAAAC | TTG | chr17 | 42907083 | 42907104 | 42907088 | 42907083 | - |
| SEQ ID NO 63215 | TCCTTTAAACACACCAAACACG | CTT | chr17 | 42907080 | 42907101 | 42907085 | 42907080 | - |
| SEQ ID NO 63216 | CCTTTAAACACACCAAACACGT | TTT | chr17 | 42907079 | 42907100 | 42907084 | 42907079 | - |
| SEQ ID NO 63217 | CTTTAAACACACCAAACACGTT | TTC | chr17 | 42907078 | 42907099 | 42907083 | 42907078 | - |
| SEQ ID NO 63218 | TAAACACACCAAACACGTTCCC | CTT | chr17 | 42907075 | 42907096 | 42907080 | 42907075 | - |
| SEQ ID NO 63219 | AAACACACCAAACACGTTCCCA | TTT | chr17 | 42907074 | 42907095 | 42907079 | 42907074 | - |
| SEQ ID NO 63220 | AACACACCAAACACGTTCCCAC | TTA | chr17 | 42907073 | 42907094 | 42907078 | 42907073 | - |
| SEQ ID NO 63221 | CCACCTCAGGGCTTTTGCATTG | TTC | chr17 | 42907055 | 42907076 | 42907060 | 42907055 | - |
| SEQ ID NO 63222 | AGGGCTTTTGCATTGCAATCTT | CTC | chr17 | 42907048 | 42907069 | 42907053 | 42907048 | - |
| SEQ ID NO 63223 | TTGCATTGCAATCTTCTCTGGC | CTT | chr17 | 42907041 | 42907062 | 42907046 | 42907041 | - |
| SEQ ID NO 63224 | TGCATTGCAATCTTCTCTGGCC | TTT | chr17 | 42907040 | 42907061 | 42907045 | 42907040 | - |
| SEQ ID NO 63225 | GCATTGCAATCTTCTCTGGCCA | TTT | chr17 | 42907039 | 42907060 | 42907044 | 42907039 | - |
| SEQ ID NO 63226 | CATTGCAATCTTCTCTGGCCAG | TTG | chr17 | 42907038 | 42907059 | 42907043 | 42907038 | - |
| SEQ ID NO 63227 | CAATCTTCTCTGGCCAGACAGC | TTG | chr17 | 42907033 | 42907054 | 42907038 | 42907033 | - |
| SEQ ID NO 63228 | CTCTGGCCAGACAGCCCTTCAC | CTT | chr17 | 42907026 | 42907047 | 42907031 | 42907026 | - |
| SEQ ID NO 63229 | TCTGGCCAGACAGCCCTTCACA | TTC | chr17 | 42907025 | 42907046 | 42907030 | 42907025 | - |
| SEQ ID NO 63230 | TGGCCAGACAGCCCTTCACAGC | CTC | chr17 | 42907023 | 42907044 | 42907028 | 42907023 | - |
| SEQ ID NO 63231 | GCCAGACAGCCCTTCACAGCTC | CTG | chr17 | 42907021 | 42907042 | 42907026 | 42907021 | - |
| SEQ ID NO 63232 | CACAGCTCTTCTGCCAGAAACT | CTT | chr17 | 42907007 | 42907028 | 42907012 | 42907007 | - |
| SEQ ID NO 63233 | ACAGCTCTTCTGCCAGAAACTT | TTC | chr17 | 42907006 | 42907027 | 42907011 | 42907006 | - |
| SEQ ID NO 63234 | TTCTGCCAGAAACTTACTTCCT | CTC | chr17 | 42906999 | 42907020 | 42907004 | 42906999 | - |
| SEQ ID NO 63235 | CTGCCAGAAACTTACTTCCTCA | CTT | chr17 | 42906997 | 42907018 | 42907002 | 42906997 | - |
| SEQ ID NO 63236 | TGCCAGAAACTTACTTCCTCAC | TTC | chr17 | 42906996 | 42907017 | 42907001 | 42906996 | - |
| SEQ ID NO 63237 | CCAGAAACTTACTTCCTCACAT | CTG | chr17 | 42906994 | 42907015 | 42906999 | 42906994 | - |
| SEQ ID NO 63238 | ACTTCCTCACATCCTTGAAGAC | CTT | chr17 | 42906984 | 42907005 | 42906989 | 42906984 | - |
| SEQ ID NO 63239 | CTTCCTCACATCCTTGAAGACT | TTA | chr17 | 42906983 | 42907004 | 42906988 | 42906983 | - |
| SEQ ID NO 63240 | CCTCACATCCTTGAAGACTTGA | CTT | chr17 | 42906980 | 42907001 | 42906985 | 42906980 | - |
| SEQ ID NO 63241 | CTCACATCCTTGAAGACTTGAC | TTC | chr17 | 42906979 | 42907000 | 42906984 | 42906979 | - |
| SEQ ID NO 63242 | ACATCCTTGAAGACTTGACTCA | CTC | chr17 | 42906976 | 42906997 | 42906981 | 42906976 | - |
| SEQ ID NO 63243 | GAAGACTTGACTCAGATCTCAT | CTT | chr17 | 42906968 | 42906989 | 42906973 | 42906968 | - |
| SEQ ID NO 63244 | AAGACTTGACTCAGATCTCATA | TTG | chr17 | 42906967 | 42906988 | 42906972 | 42906967 | - |
| SEQ ID NO 63245 | GACTCAGATCTCATATTCTCAG | CTT | chr17 | 42906960 | 42906981 | 42906965 | 42906960 | - |
| SEQ ID NO 63246 | ACTCAGATCTCATATTCTCAGT | TTG | chr17 | 42906959 | 42906980 | 42906964 | 42906959 | - |
| SEQ ID NO 63247 | AGATCTCATATTCTCAGTGAGT | CTC | chr17 | 42906955 | 42906976 | 42906960 | 42906955 | - |
| SEQ ID NO 63248 | ATATTCTCAGTGAGTCCTACTC | CTC | chr17 | 42906948 | 42906969 | 42906953 | 42906948 | - |
| SEQ ID NO 63249 | TCAGTGAGTCCTACTCTGACCA | TTC | chr17 | 42906942 | 42906963 | 42906947 | 42906942 | - |
| SEQ ID NO 63250 | AGTGAGTCCTACTCTGACCACG | CTC | chr17 | 42906940 | 42906961 | 42906945 | 42906940 | - |
| SEQ ID NO 63251 | CTCTGACCACGCTATTTAACCC | CTA | chr17 | 42906929 | 42906950 | 42906934 | 42906929 | - |
| SEQ ID NO 63252 | TGACCACGCTATTTAACCCTGC | CTC | chr17 | 42906926 | 42906947 | 42906931 | 42906926 | - |
| SEQ ID NO 63253 | ACCACGCTATTTAACCCTGCTT | CTG | chr17 | 42906924 | 42906945 | 42906929 | 42906924 | - |
| SEQ ID NO 63254 | TTTAACCCTGCTTGCAACCGGT | CTA | chr17 | 42906915 | 42906936 | 42906920 | 42906915 | - |
| SEQ ID NO 63255 | AACCCTGCTTGCAACCGGTTCC | TTT | chr17 | 42906912 | 42906933 | 42906917 | 42906912 | - |
| SEQ ID NO 63256 | ACCCTGCTTGCAACCGGTTCCG | TTA | chr17 | 42906911 | 42906932 | 42906916 | 42906911 | - |
| SEQ ID NO 63257 | CTTGCAACCGGTTCCGTTTTTT | CTG | chr17 | 42906905 | 42906926 | 42906910 | 42906905 | - |
| SEQ ID NO 63258 | GCAACCGGTTCCGTTTTTTTAT | CTT | chr17 | 42906902 | 42906923 | 42906907 | 42906902 | - |
| SEQ ID NO 63259 | CAACCGGTTCCGTTTTTTTATT | TTG | chr17 | 42906901 | 42906922 | 42906906 | 42906901 | - |
| SEQ ID NO 63260 | CGTTTTTTTATTTGTTTGTTTT | TTC | chr17 | 42906891 | 42906912 | 42906896 | 42906891 | - |
| SEQ ID NO 63261 | TTTTATTTGTTTGTTTTTGTT | TTT | chr17 | 42906886 | 42906907 | 42906891 | 42906886 | - |
| SEQ ID NO 63262 | TTTATTTGTTTGTTTTTTGTTT | TTT | chr17 | 42906885 | 42906906 | 42906890 | 42906885 | - |
| SEQ ID NO 63263 | TTATTTGTTTGTTTTTTGTTTT | TTT | chr17 | 42906884 | 42906905 | 42906889 | 42906884 | - |
| SEQ ID NO 63264 | TATTTGTTTGTTTTTTGTTTTT | TTT | chr17 | 42906883 | 42906904 | 42906888 | 42906883 | - |
| SEQ ID NO 63265 | ATTTGTTTGTTTTTTGTTTTTT | TTT | chr17 | 42906882 | 42906903 | 42906887 | 42906882 | - |
| SEQ ID NO 63266 | TTTGTTTGTTTTTTGTTTTTTT | TTA | chr17 | 42906881 | 42906902 | 42906886 | 42906881 | - |
| SEQ ID NO 63267 | GTTTGTTTTTTGTTTTTTTAGA | TTT | chr17 | 42906878 | 42906899 | 42906883 | 42906878 | - |
| SEQ ID NO 63268 | TTTGTTTTTTGTTTTTTTAGAG | TTG | chr17 | 42906877 | 42906898 | 42906882 | 42906877 | - |

Figure 90 (Cont'd)

| SEQ ID NO | Sequence | | | | | | |
|---|---|---|---|---|---|---|---|
| SEQ ID NO 63269 | GTTTTTTGTTTTTTTAGAGACA | TTT | chr17 | 42906874 | 42906895 | 42906879 | 42906874 | - |
| SEQ ID NO 63270 | TTTTTTGTTTTTTAGAGACAG | TTG | chr17 | 42906873 | 42906894 | 42906878 | 42906873 | - |
| SEQ ID NO 63271 | TTTGTTTTTTAGAGACAGTGT | TTT | chr17 | 42906870 | 42906891 | 42906875 | 42906870 | - |
| SEQ ID NO 63272 | TTGTTTTTTAGAGACAGTGTC | TTT | chr17 | 42906869 | 42906890 | 42906874 | 42906869 | - |
| SEQ ID NO 63273 | TGTTTTTTAGAGACAGTGTCT | TTT | chr17 | 42906868 | 42906889 | 42906873 | 42906868 | - |
| SEQ ID NO 63274 | GTTTTTTAGAGACAGTGTCTT | TTT | chr17 | 42906867 | 42906888 | 42906872 | 42906867 | - |
| SEQ ID NO 63275 | TTTTTTAGAGACAGTGTCTTG | TTG | chr17 | 42906866 | 42906887 | 42906871 | 42906866 | - |
| SEQ ID NO 63276 | TTTTAGAGACAGTGTCTTGCTT | TTT | chr17 | 42906863 | 42906884 | 42906868 | 42906863 | - |
| SEQ ID NO 63277 | TTTAGAGACAGTGTCTTGCTTT | TTT | chr17 | 42906862 | 42906883 | 42906867 | 42906862 | - |
| SEQ ID NO 63278 | TTAGAGACAGTGTCTTGCTTTG | TTT | chr17 | 42906861 | 42906882 | 42906866 | 42906861 | - |
| SEQ ID NO 63279 | TAGAGACAGTGTCTTGCTTTGT | TTT | chr17 | 42906860 | 42906881 | 42906865 | 42906860 | - |
| SEQ ID NO 63280 | AGAGACAGTGTCTTGCTTTGTC | TTT | chr17 | 42906859 | 42906880 | 42906864 | 42906859 | - |
| SEQ ID NO 63281 | GAGACAGTGTCTTGCTTTGTCT | TTA | chr17 | 42906858 | 42906879 | 42906863 | 42906858 | - |
| SEQ ID NO 63282 | GCTTTGTCTCCTAGGCTGCAAT | CTT | chr17 | 42906845 | 42906866 | 42906850 | 42906845 | - |
| SEQ ID NO 63283 | CTTTGTCTCCTAGGCTGCAATG | TTG | chr17 | 42906844 | 42906865 | 42906849 | 42906844 | - |
| SEQ ID NO 63284 | TGTCTCCTAGGCTGCAATGCAG | CTT | chr17 | 42906841 | 42906862 | 42906846 | 42906841 | - |
| SEQ ID NO 63285 | GTCTCCTAGGCTGCAATGCAGT | TTT | chr17 | 42906840 | 42906861 | 42906845 | 42906840 | - |
| SEQ ID NO 63286 | TCTCCTAGGCTGCAATGCAGTG | TTG | chr17 | 42906839 | 42906860 | 42906844 | 42906839 | - |
| SEQ ID NO 63287 | CTAGGCTGCAATGCAGTGCCAT | CTC | chr17 | 42906835 | 42906856 | 42906840 | 42906835 | - |
| SEQ ID NO 63288 | GGCTGCAATGCAGTGCCATGAT | CTA | chr17 | 42906832 | 42906853 | 42906837 | 42906832 | - |
| SEQ ID NO 63289 | CAATGCAGTGCCATGATCATAG | CTG | chr17 | 42906827 | 42906848 | 42906832 | 42906827 | - |
| SEQ ID NO 63290 | ACTGCAGCCTCGACCTCCTGGA | CTC | chr17 | 42906802 | 42906823 | 42906807 | 42906802 | - |
| SEQ ID NO 63291 | CAGCCTCGACCTCCTGGACTCA | CTG | chr17 | 42906798 | 42906819 | 42906803 | 42906798 | - |
| SEQ ID NO 63292 | GACCTCCTGGACTCAAGCAATC | CTC | chr17 | 42906791 | 42906812 | 42906796 | 42906791 | - |
| SEQ ID NO 63293 | CTGGACTCAAGCAATCCTCCCA | CTC | chr17 | 42906785 | 42906806 | 42906790 | 42906785 | - |
| SEQ ID NO 63294 | GACTCAAGCAATCCTCCCACCT | CTG | chr17 | 42906782 | 42906803 | 42906787 | 42906782 | - |
| SEQ ID NO 63295 | AAGCAATCCTCCCACCTCAGCC | CTC | chr17 | 42906777 | 42906798 | 42906782 | 42906777 | - |
| SEQ ID NO 63296 | CCACCTCAGCCCCCTGAGTAGC | CTC | chr17 | 42906766 | 42906787 | 42906771 | 42906766 | - |
| SEQ ID NO 63297 | AGCCCCCTGAGTAGCTGGGACC | CTC | chr17 | 42906759 | 42906780 | 42906764 | 42906759 | - |
| SEQ ID NO 63298 | AGTAGCTGGGACCACAGGTGCA | CTG | chr17 | 42906750 | 42906771 | 42906755 | 42906750 | - |
| SEQ ID NO 63299 | GGACCACAGGTGCACACCACCA | CTG | chr17 | 42906742 | 42906763 | 42906747 | 42906742 | - |
| SEQ ID NO 63300 | TTTAAATGTGTTTTGTTTGTTT | TTT | chr17 | 42906706 | 42906727 | 42906711 | 42906706 | - |
| SEQ ID NO 63301 | TTAAATGTGTTTTGTTTGTTTG | TTT | chr17 | 42906705 | 42906726 | 42906710 | 42906705 | - |
| SEQ ID NO 63302 | TAAATGTGTTTTGTTTGTTTGT | TTT | chr17 | 42906704 | 42906725 | 42906709 | 42906704 | - |
| SEQ ID NO 63303 | AAATGTGTTTTGTTTGTTTGTT | TTT | chr17 | 42906703 | 42906724 | 42906708 | 42906703 | - |
| SEQ ID NO 63304 | AATGTGTTTTGTTTGTTTGTTT | TTA | chr17 | 42906702 | 42906723 | 42906707 | 42906702 | - |
| SEQ ID NO 63305 | TGTTTGTTTGTTTGATTGTTTT | TTT | chr17 | 42906693 | 42906714 | 42906698 | 42906693 | - |
| SEQ ID NO 63306 | GTTTGTTTGTTTGATTGTTTTT | TTT | chr17 | 42906692 | 42906713 | 42906697 | 42906692 | - |
| SEQ ID NO 63307 | TTTGTTTGTTTGATTGTTTTTG | TTG | chr17 | 42906691 | 42906712 | 42906696 | 42906691 | - |
| SEQ ID NO 63308 | GTTTGTTTGATTGTTTTTGCCC | TTT | chr17 | 42906688 | 42906709 | 42906693 | 42906688 | - |
| SEQ ID NO 63309 | TTTGTTTGATTGTTTTTGCCCA | TTG | chr17 | 42906687 | 42906708 | 42906692 | 42906687 | - |
| SEQ ID NO 63310 | GTTTGATTGTTTTTGCCCAGGC | TTT | chr17 | 42906684 | 42906705 | 42906689 | 42906684 | - |
| SEQ ID NO 63311 | TTTGATTGTTTTTGCCCAGGCT | TTG | chr17 | 42906683 | 42906704 | 42906688 | 42906683 | - |
| SEQ ID NO 63312 | GATTGTTTTTGCCCAGGCTGGT | TTT | chr17 | 42906680 | 42906701 | 42906685 | 42906680 | - |
| SEQ ID NO 63313 | ATTGTTTTTGCCCAGGCTGGTT | TTG | chr17 | 42906679 | 42906700 | 42906684 | 42906679 | - |
| SEQ ID NO 63314 | TTTTTGCCCAGGCTGGTTTTGA | TTG | chr17 | 42906675 | 42906696 | 42906680 | 42906675 | - |
| SEQ ID NO 63315 | TTGCCCAGGCTGGTTTTGAACT | TTT | chr17 | 42906672 | 42906693 | 42906677 | 42906672 | - |
| SEQ ID NO 63316 | TGCCCAGGCTGGTTTTGAACTC | TTT | chr17 | 42906671 | 42906692 | 42906676 | 42906671 | - |
| SEQ ID NO 63317 | GCCCAGGCTGGTTTTGAACTCT | TTT | chr17 | 42906670 | 42906691 | 42906675 | 42906670 | - |
| SEQ ID NO 63318 | CCCAGGCTGGTTTTGAACTCTT | TTG | chr17 | 42906669 | 42906690 | 42906674 | 42906669 | - |
| SEQ ID NO 63319 | GTTTTGAACTCTTGGGCTCAAG | CTG | chr17 | 42906660 | 42906681 | 42906665 | 42906660 | - |
| SEQ ID NO 63320 | TGAACTCTTGGGCTCAAGCAAT | TTT | chr17 | 42906656 | 42906677 | 42906661 | 42906656 | - |
| SEQ ID NO 63321 | GAACTCTTGGGCTCAAGCAATC | TTT | chr17 | 42906655 | 42906676 | 42906660 | 42906655 | - |
| SEQ ID NO 63322 | AACTCTTGGGCTCAAGCAATCC | TTG | chr17 | 42906654 | 42906675 | 42906659 | 42906654 | - |
| SEQ ID NO 63323 | TTGGGCTCAAGCAATCCTCCTA | CTC | chr17 | 42906649 | 42906670 | 42906654 | 42906649 | - |
| SEQ ID NO 63324 | GGGCTCAAGCAATCCTCCTACC | CTT | chr17 | 42906647 | 42906668 | 42906652 | 42906647 | - |
| SEQ ID NO 63325 | GGCTCAAGCAATCCTCCTACCC | TTG | chr17 | 42906646 | 42906667 | 42906651 | 42906646 | - |
| SEQ ID NO 63326 | AAGCAATCCTCCTACCCTTGGC | CTC | chr17 | 42906641 | 42906662 | 42906646 | 42906641 | - |

Figure 90 (Cont'd)

| SEQ ID NO 63327 | CTACCCTTGGCCTCCCAAAGTG | CTC | chr17 | 42906630 | 42906651 | 42906635 | 42906630 | - |
|---|---|---|---|---|---|---|---|---|
| SEQ ID NO 63328 | CCCTTGGCCTCCCAAAGTGTTG | CTA | chr17 | 42906627 | 42906648 | 42906632 | 42906627 | - |
| SEQ ID NO 63329 | GGCCTCCCAAAGTGTTGGGATT | CTT | chr17 | 42906622 | 42906643 | 42906627 | 42906622 | - |
| SEQ ID NO 63330 | GCCTCCCAAAGTGTTGGGATTA | TTG | chr17 | 42906621 | 42906642 | 42906626 | 42906621 | - |
| SEQ ID NO 63331 | CCAAAGTGTTGGGATTATAGGT | CTC | chr17 | 42906616 | 42906637 | 42906621 | 42906616 | - |
| SEQ ID NO 63332 | GGATTATAGGTGTGAGCCACCA | TTG | chr17 | 42906605 | 42906626 | 42906610 | 42906605 | - |
| SEQ ID NO 63333 | TAGGTGTGAGCCACCATGGCCC | TTA | chr17 | 42906599 | 42906620 | 42906604 | 42906599 | - |
| SEQ ID NO 63334 | GTTCCCATCCCATTCTTAATTC | CTG | chr17 | 42906572 | 42906593 | 42906577 | 42906572 | - |
| SEQ ID NO 63335 | CCATCCCATTCTTAATTCCTCT | TTC | chr17 | 42906568 | 42906589 | 42906573 | 42906568 | - |
| SEQ ID NO 63336 | TTAATTCCTCTACCCTGAGAGA | TTC | chr17 | 42906557 | 42906578 | 42906562 | 42906557 | - |
| SEQ ID NO 63337 | AATTCCTCTACCCTGAGAGATA | CTT | chr17 | 42906555 | 42906576 | 42906560 | 42906555 | - |
| SEQ ID NO 63338 | ATTCCTCTACCCTGAGAGATAG | TTA | chr17 | 42906554 | 42906575 | 42906559 | 42906554 | - |
| SEQ ID NO 63339 | CTCTACCCTGAGAGATAGAGGG | TTC | chr17 | 42906550 | 42906571 | 42906555 | 42906550 | - |
| SEQ ID NO 63340 | TACCCTGAGAGATAGAGGGTCC | CTC | chr17 | 42906547 | 42906568 | 42906552 | 42906547 | - |
| SEQ ID NO 63341 | CCCTGAGAGATAGAGGGTCCTG | CTA | chr17 | 42906545 | 42906566 | 42906550 | 42906545 | - |
| SEQ ID NO 63342 | AGAGATAGAGGGTCCTGAGATG | CTG | chr17 | 42906540 | 42906561 | 42906545 | 42906540 | - |
| SEQ ID NO 63343 | AGATGTGCCGCCCAGACCTCCC | CTG | chr17 | 42906523 | 42906544 | 42906528 | 42906523 | - |
| SEQ ID NO 63344 | CCTCCTGAACTGCAGGACTTAT | CTC | chr17 | 42906503 | 42906524 | 42906508 | 42906503 | - |
| SEQ ID NO 63345 | CTGAACTGCAGGACTTATTTCG | CTC | chr17 | 42906499 | 42906520 | 42906504 | 42906499 | - |
| SEQ ID NO 63346 | AACTGCAGGACTTATTTCGTAG | CTG | chr17 | 42906496 | 42906517 | 42906501 | 42906496 | - |
| SEQ ID NO 63347 | CAGGACTTATTTCGTAGCTGTT | CTG | chr17 | 42906491 | 42906512 | 42906496 | 42906491 | - |
| SEQ ID NO 63348 | ATTTCGTAGCTGTTGAGAGTGT | CTT | chr17 | 42906483 | 42906504 | 42906488 | 42906483 | - |
| SEQ ID NO 63349 | TTTCGTAGCTGTTGAGAGTGTG | TTA | chr17 | 42906482 | 42906503 | 42906487 | 42906482 | - |
| SEQ ID NO 63350 | CGTAGCTGTTGAGAGTGTGATG | TTT | chr17 | 42906479 | 42906500 | 42906484 | 42906479 | - |
| SEQ ID NO 63351 | GTAGCTGTTGAGAGTGTGATGG | TTC | chr17 | 42906478 | 42906499 | 42906483 | 42906478 | - |
| SEQ ID NO 63352 | TTGAGAGTGTGATGGTAGATGG | CTG | chr17 | 42906471 | 42906492 | 42906476 | 42906471 | - |
| SEQ ID NO 63353 | AGAGTGTGATGGTAGATGGCTT | TTG | chr17 | 42906468 | 42906489 | 42906473 | 42906468 | - |
| SEQ ID NO 63354 | TCTGCTCTCAGCCTTCTCCTGG | CTT | chr17 | 42906446 | 42906467 | 42906451 | 42906446 | - |
| SEQ ID NO 63355 | CTGCTCTCAGCCTTCTCCTGGC | TTT | chr17 | 42906445 | 42906466 | 42906450 | 42906445 | - |
| SEQ ID NO 63356 | TGCTCTCAGCCTTCTCCTGGCA | TTC | chr17 | 42906444 | 42906465 | 42906449 | 42906444 | - |
| SEQ ID NO 63357 | CTCTCAGCCTTCTCCTGGCATT | CTG | chr17 | 42906442 | 42906463 | 42906447 | 42906442 | - |
| SEQ ID NO 63358 | TCAGCCTTCTCCTGGCATTGCC | CTC | chr17 | 42906439 | 42906460 | 42906444 | 42906439 | - |
| SEQ ID NO 63359 | AGCCTTCTCCTGGCATTGCCCT | CTC | chr17 | 42906437 | 42906458 | 42906442 | 42906437 | - |
| SEQ ID NO 63360 | CTCCTGGCATTGCCCTGGGCTA | CTT | chr17 | 42906431 | 42906452 | 42906436 | 42906431 | - |
| SEQ ID NO 63361 | TCCTGGCATTGCCCTGGGCTAA | TTC | chr17 | 42906430 | 42906451 | 42906435 | 42906430 | - |
| SEQ ID NO 63362 | CTGGCATTGCCCTGGGCTAAAG | CTC | chr17 | 42906428 | 42906449 | 42906433 | 42906428 | - |
| SEQ ID NO 63363 | GCATTGCCCTGGGCTAAAGAGA | CTG | chr17 | 42906425 | 42906446 | 42906430 | 42906425 | - |
| SEQ ID NO 63364 | CCCTGGGCTAAAGAGAGTCGCC | TTG | chr17 | 42906419 | 42906440 | 42906424 | 42906419 | - |
| SEQ ID NO 63365 | GGCTAAAGAGAGTCGCCTTGAT | CTG | chr17 | 42906414 | 42906435 | 42906419 | 42906414 | - |
| SEQ ID NO 63366 | AAGAGAGTCGCCTTGATCAAGG | CTA | chr17 | 42906409 | 42906430 | 42906414 | 42906409 | - |
| SEQ ID NO 63367 | GATCAAGGTTACGCTCTCCCCA | CTT | chr17 | 42906395 | 42906416 | 42906400 | 42906395 | - |
| SEQ ID NO 63368 | ATCAAGGTTACGCTCTCCCCAG | TTG | chr17 | 42906394 | 42906415 | 42906399 | 42906394 | - |
| SEQ ID NO 63369 | CGCTCTCCCCAGGGTCTGATTC | TTA | chr17 | 42906384 | 42906405 | 42906389 | 42906384 | - |
| SEQ ID NO 63370 | TCCCCAGGGTCTGATTCCCTTG | CTC | chr17 | 42906379 | 42906400 | 42906384 | 42906379 | - |
| SEQ ID NO 63371 | CCCAGGGTCTGATTCCCTTGTC | CTC | chr17 | 42906377 | 42906398 | 42906382 | 42906377 | - |
| SEQ ID NO 63372 | ATTCCCTTGTCCCAACTTGGAC | CTG | chr17 | 42906366 | 42906387 | 42906371 | 42906366 | - |
| SEQ ID NO 63373 | CCTTGTCCCAACTTGGACCAAC | TTC | chr17 | 42906362 | 42906383 | 42906367 | 42906362 | - |
| SEQ ID NO 63374 | GTCCCAACTTGGACCAACTCTG | CTT | chr17 | 42906358 | 42906379 | 42906363 | 42906358 | - |
| SEQ ID NO 63375 | TCCCAACTTGGACCAACTCTGA | TTG | chr17 | 42906357 | 42906378 | 42906362 | 42906357 | - |
| SEQ ID NO 63376 | GGACCAACTCTGAGGAGCCATC | CTT | chr17 | 42906348 | 42906369 | 42906353 | 42906348 | - |
| SEQ ID NO 63377 | GACCAACTCTGAGGAGCCATCC | TTG | chr17 | 42906347 | 42906368 | 42906352 | 42906347 | - |
| SEQ ID NO 63378 | TGAGGAGCCATCCCCAGCTTCA | CTC | chr17 | 42906338 | 42906359 | 42906343 | 42906338 | - |
| SEQ ID NO 63379 | AGGAGCCATCCCCAGCTTCAGA | CTG | chr17 | 42906336 | 42906357 | 42906341 | 42906336 | - |
| SEQ ID NO 63380 | CAGAGCTCGCTGTGGGGTTGGA | CTT | chr17 | 42906318 | 42906339 | 42906323 | 42906318 | - |
| SEQ ID NO 63381 | AGAGCTCGCTGTGGGGTTGGAT | TTC | chr17 | 42906317 | 42906338 | 42906322 | 42906317 | - |
| SEQ ID NO 63382 | GCTGTGGGGTTGGATGAGGCAG | CTC | chr17 | 42906310 | 42906331 | 42906315 | 42906310 | - |
| SEQ ID NO 63383 | TGGGGTTGGATGAGGCAGAATC | CTG | chr17 | 42906306 | 42906327 | 42906311 | 42906306 | - |
| SEQ ID NO 63384 | GATGAGGCAGAATCACAACCGG | TTG | chr17 | 42906298 | 42906319 | 42906303 | 42906298 | - |

Figure 90 (Cont'd)

| | | | | | | | | |
|---|---|---|---|---|---|---|---|---|
| SEQ ID NO 63385 | TCCTTCTGCCCTGTTCCTGTTC | CTC | chr17 | 42906271 | 42906292 | 42906276 | 42906271 | - |
| SEQ ID NO 63386 | CTTCTGCCCTGTTCCTGTTCCT | CTC | chr17 | 42906269 | 42906290 | 42906274 | 42906269 | - |
| SEQ ID NO 63387 | CTGCCCTGTTCCTGTTCCTTCC | CTT | chr17 | 42906266 | 42906287 | 42906271 | 42906266 | - |
| SEQ ID NO 63388 | TGCCCTGTTCCTGTTCCTTCCC | TTC | chr17 | 42906265 | 42906286 | 42906270 | 42906265 | - |
| SEQ ID NO 63389 | CCCTGTTCCTGTTCCTTCCCTT | CTG | chr17 | 42906263 | 42906284 | 42906268 | 42906263 | - |
| SEQ ID NO 63390 | TTCCTGTTCCTTCCCTTCTACA | CTG | chr17 | 42906258 | 42906279 | 42906263 | 42906258 | - |
| SEQ ID NO 63391 | CTGTTCCTTCCCTTCTACAAGT | TTC | chr17 | 42906255 | 42906276 | 42906260 | 42906255 | - |
| SEQ ID NO 63392 | TTCCTTCCCTTCTACAAGTATA | CTG | chr17 | 42906252 | 42906273 | 42906257 | 42906252 | - |
| SEQ ID NO 63393 | CTTCCCTTCTACAAGTATAGTT | TTC | chr17 | 42906249 | 42906270 | 42906254 | 42906249 | - |
| SEQ ID NO 63394 | CCCTTCTACAAGTATAGTTCCC | CTT | chr17 | 42906246 | 42906267 | 42906251 | 42906246 | - |
| SEQ ID NO 63395 | CCTTCTACAAGTATAGTTCCCC | TTC | chr17 | 42906245 | 42906266 | 42906250 | 42906245 | - |
| SEQ ID NO 63396 | CTACAAGTATAGTTCCCCAGAG | CTT | chr17 | 42906241 | 42906262 | 42906246 | 42906241 | - |
| SEQ ID NO 63397 | TACAAGTATAGTTCCCCAGAGT | TTC | chr17 | 42906240 | 42906261 | 42906245 | 42906240 | - |
| SEQ ID NO 63398 | CAAGTATAGTTCCCCAGAGTAT | CTA | chr17 | 42906238 | 42906259 | 42906243 | 42906238 | - |
| SEQ ID NO 63399 | CCCAGAGTATCTAAACTCCTGC | TTC | chr17 | 42906226 | 42906247 | 42906231 | 42906226 | - |
| SEQ ID NO 63400 | AACTCCTGCACGTGAATCTCCA | CTA | chr17 | 42906213 | 42906234 | 42906218 | 42906213 | - |
| SEQ ID NO 63401 | CTGCACGTGAATCTCCATTTCA | CTC | chr17 | 42906208 | 42906229 | 42906213 | 42906208 | - |
| SEQ ID NO 63402 | CACGTGAATCTCCATTTCAGCC | CTG | chr17 | 42906205 | 42906226 | 42906210 | 42906205 | - |
| SEQ ID NO 63403 | CATTTCAGCCTGCTTTCCAGGG | CTC | chr17 | 42906193 | 42906214 | 42906198 | 42906193 | - |
| SEQ ID NO 63404 | CAGCCTGCTTTCCAGGGAACCC | TTT | chr17 | 42906188 | 42906209 | 42906193 | 42906188 | - |
| SEQ ID NO 63405 | AGCCTGCTTTCCAGGGAACCCC | TTC | chr17 | 42906187 | 42906208 | 42906192 | 42906187 | - |
| SEQ ID NO 63406 | CTTTCCAGGGAACCCCATAGAT | CTG | chr17 | 42906181 | 42906202 | 42906186 | 42906181 | - |
| SEQ ID NO 63407 | TCCAGGGAACCCCATAGATAAA | CTT | chr17 | 42906178 | 42906199 | 42906183 | 42906178 | - |
| SEQ ID NO 63408 | CCAGGGAACCCCATAGATAAAT | TTT | chr17 | 42906177 | 42906198 | 42906182 | 42906177 | - |
| SEQ ID NO 63409 | CAGGGAACCCCATAGATAAATA | TTC | chr17 | 42906176 | 42906197 | 42906181 | 42906176 | - |
| SEQ ID NO 63410 | TCTTCCCTCCCTCCCTTCCTCC | CTT | chr17 | 42906147 | 42906168 | 42906152 | 42906147 | - |
| SEQ ID NO 63411 | CTTCCCTCCCTCCCTTCCTCCT | TTT | chr17 | 42906146 | 42906167 | 42906151 | 42906146 | - |
| SEQ ID NO 63412 | TTCCCTCCCTCCCTTCCTCCTT | TTC | chr17 | 42906145 | 42906166 | 42906150 | 42906145 | - |
| SEQ ID NO 63413 | CCCTCCCTCCCTTCCTCCTTCC | CTT | chr17 | 42906143 | 42906164 | 42906148 | 42906143 | - |
| SEQ ID NO 63414 | CCTCCCTCCCTTCCTCCTTCCC | TTC | chr17 | 42906142 | 42906163 | 42906147 | 42906142 | - |
| SEQ ID NO 63415 | CCTCCCTTCCTCCTTCCCTTTC | CTC | chr17 | 42906138 | 42906159 | 42906143 | 42906138 | - |
| SEQ ID NO 63416 | CCTTCCTCCTTCCCTTTCTTTC | CTC | chr17 | 42906134 | 42906155 | 42906139 | 42906134 | - |
| SEQ ID NO 63417 | CCTCCTTCCCTTTCTTTCTCCC | CTT | chr17 | 42906130 | 42906151 | 42906135 | 42906130 | - |
| SEQ ID NO 63418 | CTCCTTCCCTTTCTTTCTCCCT | TTC | chr17 | 42906129 | 42906150 | 42906134 | 42906129 | - |
| SEQ ID NO 63419 | CTTCCCTTTCTTTCTCCCTTCC | CTC | chr17 | 42906126 | 42906147 | 42906131 | 42906126 | - |
| SEQ ID NO 63420 | CCCTTTCTTTCTCCCTTCCTTC | CTT | chr17 | 42906123 | 42906144 | 42906128 | 42906123 | - |
| SEQ ID NO 63421 | CCTTTCTTTCTCCCTTCCTTCC | TTC | chr17 | 42906122 | 42906143 | 42906127 | 42906122 | - |
| SEQ ID NO 63422 | TCTTTCTCCCTTCCTTCCTCCC | CTT | chr17 | 42906118 | 42906139 | 42906123 | 42906118 | - |
| SEQ ID NO 63423 | CTTTCTCCCTTCCTTCCTCCCT | TTT | chr17 | 42906117 | 42906138 | 42906122 | 42906117 | - |
| SEQ ID NO 63424 | TTTCTCCCTTCCTTCCTCCCTC | TTC | chr17 | 42906116 | 42906137 | 42906121 | 42906116 | - |
| SEQ ID NO 63425 | TCTCCCTTCCTTCCTCCCTCCC | CTT | chr17 | 42906114 | 42906135 | 42906119 | 42906114 | - |
| SEQ ID NO 63426 | CTCCCTTCCTTCCTCCCTCCCT | TTT | chr17 | 42906113 | 42906134 | 42906118 | 42906113 | - |
| SEQ ID NO 63427 | TCCCTTCCTTCCTCCCTCCCTT | TTC | chr17 | 42906112 | 42906133 | 42906117 | 42906112 | - |
| SEQ ID NO 63428 | CCTTCCTTCCTCCCTCCCTTCT | CTC | chr17 | 42906110 | 42906131 | 42906115 | 42906110 | - |
| SEQ ID NO 63429 | CCTTCCTCCCTCCCTTCTTCTT | CTT | chr17 | 42906106 | 42906127 | 42906111 | 42906106 | - |
| SEQ ID NO 63430 | CTTCCTCCCTCCCTTCTTCTTC | TTC | chr17 | 42906105 | 42906126 | 42906110 | 42906105 | - |
| SEQ ID NO 63431 | CCTCCCTCCCTTCTTCTTCCTT | CTT | chr17 | 42906102 | 42906123 | 42906107 | 42906102 | - |
| SEQ ID NO 63432 | CTCCCTCCCTTCTTCTTCCTTC | TTC | chr17 | 42906101 | 42906122 | 42906106 | 42906101 | - |
| SEQ ID NO 63433 | CCTCCCTTCTTCTTCCTTCTAA | CTC | chr17 | 42906098 | 42906119 | 42906103 | 42906098 | - |
| SEQ ID NO 63434 | CCTTCTTCTTCCTTCTAACACT | CTC | chr17 | 42906094 | 42906115 | 42906099 | 42906094 | - |
| SEQ ID NO 63435 | CTTCTTCCTTCTAACACTAACA | CTT | chr17 | 42906090 | 42906111 | 42906095 | 42906090 | - |
| SEQ ID NO 63436 | TTCTTCCTTCTAACACTAACAA | TTC | chr17 | 42906089 | 42906110 | 42906094 | 42906089 | - |
| SEQ ID NO 63437 | CTTCCTTCTAACACTAACAATT | CTT | chr17 | 42906087 | 42906108 | 42906092 | 42906087 | - |
| SEQ ID NO 63438 | TTCCTTCTAACACTAACAATTA | TTC | chr17 | 42906086 | 42906107 | 42906091 | 42906086 | - |
| SEQ ID NO 63439 | CCTTCTAACACTAACAATTATA | CTT | chr17 | 42906084 | 42906105 | 42906089 | 42906084 | - |
| SEQ ID NO 63440 | CTTCTAACACTAACAATTATAT | TTC | chr17 | 42906083 | 42906104 | 42906088 | 42906083 | - |
| SEQ ID NO 63441 | CTAACACTAACAATTATATACC | CTT | chr17 | 42906080 | 42906101 | 42906085 | 42906080 | - |
| SEQ ID NO 63442 | TAACACTAACAATTATATACCT | TTC | chr17 | 42906079 | 42906100 | 42906084 | 42906079 | - |

Figure 90 (Cont'd)

| SEQ ID NO 63443 | ACACTAACAATTATATACCTTG | CTA | chr17 | 42906077 | 42906098 | 42906082 | 42906077 | - |
|---|---|---|---|---|---|---|---|---|
| SEQ ID NO 63444 | ACAATTATATACCTTGGGTAAT | CTA | chr17 | 42906071 | 42906092 | 42906076 | 42906071 | - |
| SEQ ID NO 63445 | TATACCTTGGGTAATTCATTTA | TTA | chr17 | 42906064 | 42906085 | 42906069 | 42906064 | - |
| SEQ ID NO 63446 | GGGTAATTCATTTAAACTTTTT | CTT | chr17 | 42906056 | 42906077 | 42906061 | 42906056 | - |
| SEQ ID NO 63447 | GGTAATTCATTTAAACTTTTTT | TTG | chr17 | 42906055 | 42906076 | 42906060 | 42906055 | - |
| SEQ ID NO 63448 | ATTTAAACTTTTTTTTTTTTTT | TTC | chr17 | 42906047 | 42906068 | 42906052 | 42906047 | - |
| SEQ ID NO 63449 | AAACTTTTTTTTTTTTTCCTG | TTT | chr17 | 42906043 | 42906064 | 42906048 | 42906043 | - |
| SEQ ID NO 63450 | AACTTTTTTTTTTTTTCCTGA | TTA | chr17 | 42906042 | 42906063 | 42906047 | 42906042 | - |
| SEQ ID NO 63451 | TTTTTTTTTTTTCCTGACAGAA | CTT | chr17 | 42906037 | 42906058 | 42906042 | 42906037 | - |
| SEQ ID NO 63452 | TTTTTTTTTTTCCTGACAGAAT | TTT | chr17 | 42906036 | 42906057 | 42906041 | 42906036 | - |
| SEQ ID NO 63453 | TTTTTTTTTTCCTGACAGAATC | TTT | chr17 | 42906035 | 42906056 | 42906040 | 42906035 | - |
| SEQ ID NO 63454 | TTTTTTTTTCCTGACAGAATCT | TTT | chr17 | 42906034 | 42906055 | 42906039 | 42906034 | - |
| SEQ ID NO 63455 | TTTTTTTTCCTGACAGAATCTT | TTT | chr17 | 42906033 | 42906054 | 42906038 | 42906033 | - |
| SEQ ID NO 63456 | TTTTTTTCCTGACAGAATCTTT | TTT | chr17 | 42906032 | 42906053 | 42906037 | 42906032 | - |
| SEQ ID NO 63457 | TTTTTTCCTGACAGAATCTTTC | TTT | chr17 | 42906031 | 42906052 | 42906036 | 42906031 | - |
| SEQ ID NO 63458 | TTTTTCCTGACAGAATCTTTCT | TTT | chr17 | 42906030 | 42906051 | 42906035 | 42906030 | - |
| SEQ ID NO 63459 | TTTTCCTGACAGAATCTTTCTC | TTT | chr17 | 42906029 | 42906050 | 42906034 | 42906029 | - |
| SEQ ID NO 63460 | TTTCCTGACAGAATCTTTCTCT | TTT | chr17 | 42906028 | 42906049 | 42906033 | 42906028 | - |
| SEQ ID NO 63461 | TTCCTGACAGAATCTTTCTCTG | TTT | chr17 | 42906027 | 42906048 | 42906032 | 42906027 | - |
| SEQ ID NO 63462 | TCCTGACAGAATCTTTCTCTGT | TTT | chr17 | 42906026 | 42906047 | 42906031 | 42906026 | - |
| SEQ ID NO 63463 | CCTGACAGAATCTTTCTCTGTC | TTT | chr17 | 42906025 | 42906046 | 42906030 | 42906025 | - |
| SEQ ID NO 63464 | CTGACAGAATCTTTCTCTGTCA | TTC | chr17 | 42906024 | 42906045 | 42906029 | 42906024 | - |
| SEQ ID NO 63465 | ACAGAATCTTTCTCTGTCACCA | CTG | chr17 | 42906021 | 42906042 | 42906026 | 42906021 | - |
| SEQ ID NO 63466 | TCTCTGTCACCAAGGCTGGAGT | CTT | chr17 | 42906011 | 42906032 | 42906016 | 42906011 | - |
| SEQ ID NO 63467 | CTCTGTCACCAAGGCTGGAGTG | TTT | chr17 | 42906010 | 42906031 | 42906015 | 42906010 | - |
| SEQ ID NO 63468 | TCTGTCACCAAGGCTGGAGTGC | TTC | chr17 | 42906009 | 42906030 | 42906014 | 42906009 | - |
| SEQ ID NO 63469 | TGTCACCAAGGCTGGAGTGCAG | CTC | chr17 | 42906007 | 42906028 | 42906012 | 42906007 | - |
| SEQ ID NO 63470 | TCACCAAGGCTGGAGTGCAGTG | CTG | chr17 | 42906005 | 42906026 | 42906010 | 42906005 | - |
| SEQ ID NO 63471 | GAGTGCAGTGGTGTGATTTCAG | CTG | chr17 | 42905993 | 42906014 | 42905998 | 42905993 | - |
| SEQ ID NO 63472 | CAGCTCACTGCAACCTCTGCCT | TTT | chr17 | 42905974 | 42905995 | 42905979 | 42905974 | - |
| SEQ ID NO 63473 | AGCTCACTGCAACCTCTGCCTC | TTC | chr17 | 42905973 | 42905994 | 42905978 | 42905973 | - |
| SEQ ID NO 63474 | ACTGCAACCTCTGCCTCCCGGG | CTC | chr17 | 42905968 | 42905989 | 42905973 | 42905968 | - |
| SEQ ID NO 63475 | CAACCTCTGCCTCCCGGGTTGA | CTG | chr17 | 42905964 | 42905985 | 42905969 | 42905964 | - |
| SEQ ID NO 63476 | TGCCTCCCGGGTTGAAGTGATT | CTC | chr17 | 42905957 | 42905978 | 42905962 | 42905957 | - |
| SEQ ID NO 63477 | CCTCCCGGGTTGAAGTGATTCT | CTG | chr17 | 42905955 | 42905976 | 42905960 | 42905955 | - |
| SEQ ID NO 63478 | CCGGGTTGAAGTGATTCTCCTG | CTC | chr17 | 42905951 | 42905972 | 42905956 | 42905951 | - |
| SEQ ID NO 63479 | AAGTGATTCTCCTGCCGCAGCC | TTG | chr17 | 42905943 | 42905964 | 42905948 | 42905943 | - |
| SEQ ID NO 63480 | TCCTGCCGCAGCCTCCTGGGTA | TTC | chr17 | 42905934 | 42905955 | 42905939 | 42905934 | - |
| SEQ ID NO 63481 | CTGCCGCAGCCTCCTGGGTAGC | CTC | chr17 | 42905932 | 42905953 | 42905937 | 42905932 | - |
| SEQ ID NO 63482 | CCGCAGCCTCCTGGGTAGCTGG | CTG | chr17 | 42905929 | 42905950 | 42905934 | 42905929 | - |
| SEQ ID NO 63483 | CTGGGTAGCTGGGATTACAGGC | CTC | chr17 | 42905919 | 42905940 | 42905924 | 42905919 | - |
| SEQ ID NO 63484 | GGTAGCTGGGATTACAGGCGCC | CTG | chr17 | 42905916 | 42905937 | 42905921 | 42905916 | - |
| SEQ ID NO 63485 | GGATTACAGGCGCCCGCCACCA | CTG | chr17 | 42905908 | 42905929 | 42905913 | 42905908 | - |
| SEQ ID NO 63486 | CAGGCGCCCGCCACCATGCCTG | TTA | chr17 | 42905902 | 42905923 | 42905907 | 42905902 | - |
| SEQ ID NO 63487 | GCTAAGTTTTGTATTTTTTTA | CTG | chr17 | 42905880 | 42905901 | 42905885 | 42905880 | - |
| SEQ ID NO 63488 | AGTTTTTGTATTTTTTTATTAG | CTA | chr17 | 42905876 | 42905897 | 42905881 | 42905876 | - |
| SEQ ID NO 63489 | TTGTATTTTTTTATTAGTGACG | TTT | chr17 | 42905871 | 42905892 | 42905876 | 42905871 | - |
| SEQ ID NO 63490 | TGTATTTTTTTATTAGTGACGA | TTT | chr17 | 42905870 | 42905891 | 42905875 | 42905870 | - |
| SEQ ID NO 63491 | GTATTTTTTTATTAGTGACGAG | TTT | chr17 | 42905869 | 42905890 | 42905874 | 42905869 | - |
| SEQ ID NO 63492 | TATTTTTTTATTAGTGACGAGG | TTG | chr17 | 42905868 | 42905889 | 42905873 | 42905868 | - |
| SEQ ID NO 63493 | TTTTATTAGTGACGAGGTTTCA | TTT | chr17 | 42905863 | 42905884 | 42905868 | 42905863 | - |
| SEQ ID NO 63494 | TTTATTAGTGACGAGGTTTCAC | TTT | chr17 | 42905862 | 42905883 | 42905867 | 42905862 | - |
| SEQ ID NO 63495 | TTATTAGTGACGAGGTTTCACC | TTT | chr17 | 42905861 | 42905882 | 42905866 | 42905861 | - |
| SEQ ID NO 63496 | TATTAGTGACGAGGTTTCACCA | TTT | chr17 | 42905860 | 42905881 | 42905865 | 42905860 | - |
| SEQ ID NO 63497 | ATTAGTGACGAGGTTTCACCAT | TTT | chr17 | 42905859 | 42905880 | 42905864 | 42905859 | - |
| SEQ ID NO 63498 | TTAGTGACGAGGTTTCACCATG | TTA | chr17 | 42905858 | 42905879 | 42905863 | 42905858 | - |
| SEQ ID NO 63499 | GTGACGAGGTTTCACCATGTTG | TTA | chr17 | 42905855 | 42905876 | 42905860 | 42905855 | - |
| SEQ ID NO 63500 | CACCATGTTGGCCAGGCTGGTC | TTT | chr17 | 42905843 | 42905864 | 42905848 | 42905843 | - |

Figure 90 (Cont'd)

| | | | | | | | | |
|---|---|---|---|---|---|---|---|---|
| SEQ ID NO 63501 | ACCATGTTGGCCAGGCTGGTCT | TTC | chr17 | 42905842 | 42905863 | 42905847 | 42905842 | - |
| SEQ ID NO 63502 | GCCAGGCTGGTCTCAAACTCCT | TTG | chr17 | 42905833 | 42905854 | 42905838 | 42905833 | - |
| SEQ ID NO 63503 | GTCTCAAACTCCTGACCTCAGG | CTG | chr17 | 42905824 | 42905845 | 42905829 | 42905824 | - |
| SEQ ID NO 63504 | AAACTCCTGACCTCAGGTGATC | CTC | chr17 | 42905819 | 42905840 | 42905824 | 42905819 | - |
| SEQ ID NO 63505 | CTGACCTCAGGTGATCCACCTG | CTC | chr17 | 42905813 | 42905834 | 42905818 | 42905813 | - |
| SEQ ID NO 63506 | ACCTCAGGTGATCCACCTGCGT | CTG | chr17 | 42905810 | 42905831 | 42905815 | 42905810 | - |
| SEQ ID NO 63507 | AGGTGATCCACCTGCGTTGGCC | CTC | chr17 | 42905805 | 42905826 | 42905810 | 42905805 | - |
| SEQ ID NO 63508 | CGTTGGCCTCCCAAAGTGCTAG | CTG | chr17 | 42905791 | 42905812 | 42905796 | 42905791 | - |
| SEQ ID NO 63509 | GCCTCCCAAAGTGCTAGGATTA | TTG | chr17 | 42905786 | 42905807 | 42905791 | 42905786 | - |
| SEQ ID NO 63510 | CCAAAGTGCTAGGATTACAGGC | CTC | chr17 | 42905781 | 42905802 | 42905786 | 42905781 | - |
| SEQ ID NO 63511 | GGATTACAGGCGTGAGCCACCG | CTA | chr17 | 42905770 | 42905791 | 42905775 | 42905770 | - |
| SEQ ID NO 63512 | CAGGCGTGAGCCACCGCGCCCG | TTA | chr17 | 42905764 | 42905785 | 42905769 | 42905764 | - |
| SEQ ID NO 63513 | CTTTCTGAGCCTTAGCTACTCT | CTA | chr17 | 42905737 | 42905758 | 42905742 | 42905737 | - |
| SEQ ID NO 63514 | TCTGAGCCTTAGCTACTCTACC | CTT | chr17 | 42905734 | 42905755 | 42905739 | 42905734 | - |
| SEQ ID NO 63515 | CTGAGCCTTAGCTACTCTACCT | TTT | chr17 | 42905733 | 42905754 | 42905738 | 42905733 | - |
| SEQ ID NO 63516 | TGAGCCTTAGCTACTCTACCTA | TTC | chr17 | 42905732 | 42905753 | 42905737 | 42905732 | - |
| SEQ ID NO 63517 | AGCCTTAGCTACTCTACCTAAG | CTG | chr17 | 42905730 | 42905751 | 42905735 | 42905730 | - |
| SEQ ID NO 63518 | AGCTACTCTACCTAAGGAGCAG | CTT | chr17 | 42905724 | 42905745 | 42905729 | 42905724 | - |
| SEQ ID NO 63519 | GCTACTCTACCTAAGGAGCAGA | TTA | chr17 | 42905723 | 42905744 | 42905728 | 42905723 | - |
| SEQ ID NO 63520 | CTCTACCTAAGGAGCAGAGATA | CTA | chr17 | 42905719 | 42905740 | 42905724 | 42905719 | - |
| SEQ ID NO 63521 | TACCTAAGGAGCAGAGATAATA | CTC | chr17 | 42905716 | 42905737 | 42905721 | 42905716 | - |
| SEQ ID NO 63522 | CCTAAGGAGCAGAGATAATAAT | CTA | chr17 | 42905714 | 42905735 | 42905719 | 42905714 | - |
| SEQ ID NO 63523 | AGGAGCAGAGATAATAATTTGC | CTA | chr17 | 42905710 | 42905731 | 42905715 | 42905710 | - |
| SEQ ID NO 63524 | GCTTCTATTAAGACAGAGGACT | TTT | chr17 | 42905690 | 42905711 | 42905695 | 42905690 | - |
| SEQ ID NO 63525 | CTTCTATTAAGACAGAGGACTA | TTG | chr17 | 42905689 | 42905710 | 42905694 | 42905689 | - |
| SEQ ID NO 63526 | CTATTAAGACAGAGGACTAAAT | CTT | chr17 | 42905686 | 42905707 | 42905691 | 42905686 | - |
| SEQ ID NO 63527 | TATTAAGACAGAGGACTAAATA | TTC | chr17 | 42905685 | 42905706 | 42905690 | 42905685 | - |
| SEQ ID NO 63528 | TTAAGACAGAGGACTAAATAAA | CTA | chr17 | 42905683 | 42905704 | 42905688 | 42905683 | - |
| SEQ ID NO 63529 | AGACAGAGGACTAAATAAAATA | TTA | chr17 | 42905680 | 42905701 | 42905685 | 42905680 | - |
| SEQ ID NO 63530 | AATAAAATAACCTCTTAAAGCC | CTA | chr17 | 42905667 | 42905688 | 42905672 | 42905667 | - |
| SEQ ID NO 63531 | TTAAAGCCACTTTAAACTTTCC | CTC | chr17 | 42905653 | 42905674 | 42905658 | 42905653 | - |
| SEQ ID NO 63532 | AAAGCCACTTTAAACTTTCCAG | CTT | chr17 | 42905651 | 42905672 | 42905656 | 42905651 | - |
| SEQ ID NO 63533 | AAGCCACTTTAAACTTTCCAGT | TTA | chr17 | 42905650 | 42905671 | 42905655 | 42905650 | - |
| SEQ ID NO 63534 | TAAACTTTCCAGTCTGTGCCTC | CTT | chr17 | 42905641 | 42905662 | 42905646 | 42905641 | - |
| SEQ ID NO 63535 | AAACTTTCCAGTCTGTGCCTCC | TTT | chr17 | 42905640 | 42905661 | 42905645 | 42905640 | - |
| SEQ ID NO 63536 | AACTTTCCAGTCTGTGCCTCCA | TTA | chr17 | 42905639 | 42905660 | 42905644 | 42905639 | - |
| SEQ ID NO 63537 | TCCAGTCTGTGCCTCCATTAAT | CTT | chr17 | 42905634 | 42905655 | 42905639 | 42905634 | - |
| SEQ ID NO 63538 | CCAGTCTGTGCCTCCATTAATT | TTT | chr17 | 42905633 | 42905654 | 42905638 | 42905633 | - |
| SEQ ID NO 63539 | CAGTCTGTGCCTCCATTAATTT | TTC | chr17 | 42905632 | 42905653 | 42905637 | 42905632 | - |
| SEQ ID NO 63540 | TGCCTCCATTAATTTCAGGGAG | CTG | chr17 | 42905625 | 42905646 | 42905630 | 42905625 | - |
| SEQ ID NO 63541 | CATTAATTTCAGGGAGAAATTC | CTC | chr17 | 42905619 | 42905640 | 42905624 | 42905619 | - |
| SEQ ID NO 63542 | ATTTCAGGGAGAAATTCATCCT | TTA | chr17 | 42905614 | 42905635 | 42905619 | 42905614 | - |
| SEQ ID NO 63543 | CAGGGAGAAATTCATCCTTGAT | TTT | chr17 | 42905610 | 42905631 | 42905615 | 42905610 | - |
| SEQ ID NO 63544 | AGGGAGAAATTCATCCTTGATA | TTC | chr17 | 42905609 | 42905630 | 42905614 | 42905609 | - |
| SEQ ID NO 63545 | ATCCTTGATAACAAGCTGTTAT | TTC | chr17 | 42905597 | 42905618 | 42905602 | 42905597 | - |
| SEQ ID NO 63546 | GATAACAAGCTGTTATGATGAA | CTT | chr17 | 42905591 | 42905612 | 42905596 | 42905591 | - |
| SEQ ID NO 63547 | ATAACAAGCTGTTATGATGAAA | TTG | chr17 | 42905590 | 42905611 | 42905595 | 42905590 | - |
| SEQ ID NO 63548 | TTATGATGAAAGCAAACATATT | CTG | chr17 | 42905579 | 42905600 | 42905584 | 42905579 | - |
| SEQ ID NO 63549 | TGATGAAAGCAAACATATTTCT | TTA | chr17 | 42905576 | 42905597 | 42905581 | 42905576 | - |
| SEQ ID NO 63550 | CTACAAAAGATGTTTGGTCCTT | TTT | chr17 | 42905556 | 42905577 | 42905561 | 42905556 | - |
| SEQ ID NO 63551 | TACAAAAGATGTTTGGTCCTTC | TTC | chr17 | 42905555 | 42905576 | 42905560 | 42905555 | - |
| SEQ ID NO 63552 | CAAAAGATGTTTGGTCCTTCTT | CTA | chr17 | 42905553 | 42905574 | 42905558 | 42905553 | - |
| SEQ ID NO 63553 | GGTCCTTCTTTCCTTCTCCTTT | TTT | chr17 | 42905541 | 42905562 | 42905546 | 42905541 | - |
| SEQ ID NO 63554 | GTCCTTCTTTCCTTCTCCTTTC | TTG | chr17 | 42905540 | 42905561 | 42905545 | 42905540 | - |
| SEQ ID NO 63555 | CTTTCCTTCTCCTTTCCTTTTC | CTT | chr17 | 42905534 | 42905555 | 42905539 | 42905534 | - |
| SEQ ID NO 63556 | TTTCCTTCTCCTTTCCTTTTCT | TTC | chr17 | 42905533 | 42905554 | 42905538 | 42905533 | - |
| SEQ ID NO 63557 | TCCTTCTCCTTTCCTTTTCTTC | CTT | chr17 | 42905531 | 42905552 | 42905536 | 42905531 | - |
| SEQ ID NO 63558 | CCTTCTCCTTTCCTTTTCTTCT | TTT | chr17 | 42905530 | 42905551 | 42905535 | 42905530 | - |

Figure 90 (Cont'd)

| SEQ ID NO 63559 | CTTCTCCTTTCCTTTTCTTCTT | TTC | chr17 | 42905529 | 42905550 | 42905534 | 42905529 | - |
|---|---|---|---|---|---|---|---|---|
| SEQ ID NO 63560 | CTCCTTTCCTTTTCTTCTTCTT | CTT | chr17 | 42905526 | 42905547 | 42905531 | 42905526 | - |
| SEQ ID NO 63561 | TCCTTTCCTTTTCTTCTTCTTC | TTC | chr17 | 42905525 | 42905546 | 42905530 | 42905525 | - |
| SEQ ID NO 63562 | CTTTCCTTTTCTTCTTCTTCTT | CTC | chr17 | 42905523 | 42905544 | 42905528 | 42905523 | - |
| SEQ ID NO 63563 | TCCTTTTCTTCTTCTTCTTCTT | CTT | chr17 | 42905520 | 42905541 | 42905525 | 42905520 | - |
| SEQ ID NO 63564 | CCTTTTCTTCTTCTTCTTCTTT | TTT | chr17 | 42905519 | 42905540 | 42905524 | 42905519 | - |
| SEQ ID NO 63565 | CTTTTCTTCTTCTTCTTCTTTT | TTC | chr17 | 42905518 | 42905539 | 42905523 | 42905518 | - |
| SEQ ID NO 63566 | TTCTTCTTCTTCTTCTTTTTTT | CTT | chr17 | 42905515 | 42905536 | 42905520 | 42905515 | - |
| SEQ ID NO 63567 | TCTTCTTCTTCTTCTTTTTTTT | TTT | chr17 | 42905514 | 42905535 | 42905519 | 42905514 | - |
| SEQ ID NO 63568 | CTTCTTCTTCTTCTTTTTTTTT | TTT | chr17 | 42905513 | 42905534 | 42905518 | 42905513 | - |
| SEQ ID NO 63569 | TTCTTCTTCTTCTTTTTTTTTT | TTC | chr17 | 42905512 | 42905533 | 42905517 | 42905512 | - |
| SEQ ID NO 63570 | CTTCTTCTTCTTTTTTTTTTTT | CTT | chr17 | 42905510 | 42905531 | 42905515 | 42905510 | - |
| SEQ ID NO 63571 | TTCTTCTTCTTTTTTTTTTTTT | TTC | chr17 | 42905509 | 42905530 | 42905514 | 42905509 | - |
| SEQ ID NO 63572 | CTTCTTCTTTTTTTTTTTTTTT | CTT | chr17 | 42905507 | 42905528 | 42905512 | 42905507 | - |
| SEQ ID NO 63573 | TTCTTCTTTTTTTTTTTTTTTG | TTC | chr17 | 42905506 | 42905527 | 42905511 | 42905506 | - |
| SEQ ID NO 63574 | CTTCTTTTTTTTTTTTTTGCC | CTT | chr17 | 42905504 | 42905525 | 42905509 | 42905504 | - |
| SEQ ID NO 63575 | TTCTTTTTTTTTTTTTTGCCT | TTC | chr17 | 42905503 | 42905524 | 42905508 | 42905503 | - |
| SEQ ID NO 63576 | CTTTTTTTTTTTTTTGCCTAT | CTT | chr17 | 42905501 | 42905522 | 42905506 | 42905501 | - |
| SEQ ID NO 63577 | TTTTTTTTTTTTTTGCCTATA | TTC | chr17 | 42905500 | 42905521 | 42905505 | 42905500 | - |
| SEQ ID NO 63578 | TTTTTTTTTTTTGCCTATAAA | CTT | chr17 | 42905498 | 42905519 | 42905503 | 42905498 | - |
| SEQ ID NO 63579 | TTTTTTTTTTTGCCTATAAAC | TTT | chr17 | 42905497 | 42905518 | 42905502 | 42905497 | - |
| SEQ ID NO 63580 | TTTTTTTTTTGCCTATAAACA | TTT | chr17 | 42905496 | 42905517 | 42905501 | 42905496 | - |
| SEQ ID NO 63581 | TTTTTTTTTGCCTATAAACAA | TTT | chr17 | 42905495 | 42905516 | 42905500 | 42905495 | - |
| SEQ ID NO 63582 | TTTTTTTTGCCTATAAACAAT | TTT | chr17 | 42905494 | 42905515 | 42905499 | 42905494 | - |
| SEQ ID NO 63583 | TTTTTTTGCCTATAAACAATC | TTT | chr17 | 42905493 | 42905514 | 42905498 | 42905493 | - |
| SEQ ID NO 63584 | TTTTTTGCCTATAAACAATCA | TTT | chr17 | 42905492 | 42905513 | 42905497 | 42905492 | - |
| SEQ ID NO 63585 | TTTTTGCCTATAAACAATCAT | TTT | chr17 | 42905491 | 42905512 | 42905496 | 42905491 | - |
| SEQ ID NO 63586 | TTTTGCCTATAAACAATCATT | TTT | chr17 | 42905490 | 42905511 | 42905495 | 42905490 | - |
| SEQ ID NO 63587 | TTTGCCTATAAACAATCATTT | TTT | chr17 | 42905489 | 42905510 | 42905494 | 42905489 | - |
| SEQ ID NO 63588 | TTGCCTATAAACAATCATTTT | TTT | chr17 | 42905488 | 42905509 | 42905493 | 42905488 | - |
| SEQ ID NO 63589 | TGCCTATAAACAATCATTTTC | TTT | chr17 | 42905487 | 42905508 | 42905492 | 42905487 | - |
| SEQ ID NO 63590 | GCCTATAAACAATCATTTTCT | TTT | chr17 | 42905486 | 42905507 | 42905491 | 42905486 | - |
| SEQ ID NO 63591 | CCTATAAACAATCATTTTCTA | TTT | chr17 | 42905485 | 42905506 | 42905490 | 42905485 | - |
| SEQ ID NO 63592 | CTATAAACAATCATTTTCTAG | TTG | chr17 | 42905484 | 42905505 | 42905489 | 42905484 | - |
| SEQ ID NO 63593 | TAAACAATCATTTTCTAGTATT | CTA | chr17 | 42905480 | 42905501 | 42905485 | 42905480 | - |
| SEQ ID NO 63594 | TCTAGTATTATATGTGTGTGTG | TTT | chr17 | 42905467 | 42905488 | 42905472 | 42905467 | - |
| SEQ ID NO 63595 | CTAGTATTATATGTGTGTGTGT | TTT | chr17 | 42905466 | 42905487 | 42905471 | 42905466 | - |
| SEQ ID NO 63596 | TAGTATTATATGTGTGTGTGTG | TTC | chr17 | 42905465 | 42905486 | 42905470 | 42905465 | - |
| SEQ ID NO 63597 | GTATTATATGTGTGTGTGTGTG | CTA | chr17 | 42905463 | 42905484 | 42905468 | 42905463 | - |
| SEQ ID NO 63598 | TATGTGTGTGTGTGTGTGTGTG | TTA | chr17 | 42905457 | 42905478 | 42905462 | 42905457 | - |
| SEQ ID NO 63599 | TTTTTTTTTTTCAGATGGTGT | TTT | chr17 | 42905406 | 42905427 | 42905411 | 42905406 | - |
| SEQ ID NO 63600 | TTTTTTTTTTCAGATGGTGTC | TTT | chr17 | 42905405 | 42905426 | 42905410 | 42905405 | - |
| SEQ ID NO 63601 | TTTTTTTTTCAGATGGTGTCT | TTT | chr17 | 42905404 | 42905425 | 42905409 | 42905404 | - |
| SEQ ID NO 63602 | TTTTTTTTCAGATGGTGTCTC | TTT | chr17 | 42905403 | 42905424 | 42905408 | 42905403 | - |
| SEQ ID NO 63603 | TTTTTTTCAGATGGTGTCTCA | TTT | chr17 | 42905402 | 42905423 | 42905407 | 42905402 | - |
| SEQ ID NO 63604 | TTTTTTCAGATGGTGTCTCAT | TTT | chr17 | 42905401 | 42905422 | 42905406 | 42905401 | - |
| SEQ ID NO 63605 | TTTTTCAGATGGTGTCTCATT | TTT | chr17 | 42905400 | 42905421 | 42905405 | 42905400 | - |
| SEQ ID NO 63606 | TTTTCAGATGGTGTCTCATTT | TTT | chr17 | 42905399 | 42905420 | 42905404 | 42905399 | - |
| SEQ ID NO 63607 | TTTCAGATGGTGTCTCATTTT | TTT | chr17 | 42905398 | 42905419 | 42905403 | 42905398 | - |
| SEQ ID NO 63608 | TTCAGATGGTGTCTCATTTTG | TTT | chr17 | 42905397 | 42905418 | 42905402 | 42905397 | - |
| SEQ ID NO 63609 | TCAGATGGTGTCTCATTTTGT | TTT | chr17 | 42905396 | 42905417 | 42905401 | 42905396 | - |
| SEQ ID NO 63610 | CAGATGGTGTCTCATTTTGTC | TTT | chr17 | 42905395 | 42905416 | 42905400 | 42905395 | - |
| SEQ ID NO 63611 | AGATGGTGTCTCATTTTGTCG | TTT | chr17 | 42905394 | 42905415 | 42905399 | 42905394 | - |
| SEQ ID NO 63612 | GATGGTGTCTCATTTTGTCGC | TTC | chr17 | 42905393 | 42905414 | 42905398 | 42905393 | - |
| SEQ ID NO 63613 | ATTTTGTCGCCCAGGCTGGAGT | CTC | chr17 | 42905381 | 42905402 | 42905386 | 42905381 | - |
| SEQ ID NO 63614 | TGTCGCCCAGGCTGGAGTGCAA | TTT | chr17 | 42905377 | 42905398 | 42905382 | 42905377 | - |
| SEQ ID NO 63615 | GTCGCCCAGGCTGGAGTGCAAT | TTT | chr17 | 42905376 | 42905397 | 42905381 | 42905376 | - |
| SEQ ID NO 63616 | TCGCCCAGGCTGGAGTGCAATG | TTG | chr17 | 42905375 | 42905396 | 42905380 | 42905375 | - |

Figure 90 (Cont'd)

| SEQ ID NO 63617 | GAGTGCAATGGCGCAATCTTGG | CTG | chr17 | 42905363 | 42905384 | 42905368 | 42905363 | - |
|---|---|---|---|---|---|---|---|---|
| SEQ ID NO 63618 | GGCTCACCACCTCCCAGGTTCA | CTT | chr17 | 42905343 | 42905364 | 42905348 | 42905343 | - |
| SEQ ID NO 63619 | GCTCACCACCTCCCAGGTTCAA | TTG | chr17 | 42905342 | 42905363 | 42905347 | 42905342 | - |
| SEQ ID NO 63620 | ACCACCTCCCAGGTTCAAGCGA | CTC | chr17 | 42905338 | 42905359 | 42905343 | 42905338 | - |
| SEQ ID NO 63621 | CCAGGTTCAAGCGATTCTCCTG | CTC | chr17 | 42905330 | 42905351 | 42905335 | 42905330 | - |
| SEQ ID NO 63622 | AAGCGATTCTCCTGCCTTAGCC | TTC | chr17 | 42905322 | 42905343 | 42905327 | 42905322 | - |
| SEQ ID NO 63623 | TCCTGCCTTAGCCTCCTGAGTA | TTC | chr17 | 42905313 | 42905334 | 42905318 | 42905313 | - |
| SEQ ID NO 63624 | CTGCCTTAGCCTCCTGAGTAGC | CTC | chr17 | 42905311 | 42905332 | 42905316 | 42905311 | - |
| SEQ ID NO 63625 | CCTTAGCCTCCTGAGTAGCTCA | CTG | chr17 | 42905308 | 42905329 | 42905313 | 42905308 | - |
| SEQ ID NO 63626 | AGCCTCCTGAGTAGCTCAGATT | CTT | chr17 | 42905304 | 42905325 | 42905309 | 42905304 | - |
| SEQ ID NO 63627 | GCCTCCTGAGTAGCTCAGATTA | TTA | chr17 | 42905303 | 42905324 | 42905308 | 42905303 | - |
| SEQ ID NO 63628 | CTGAGTAGCTCAGATTACAGGC | CTC | chr17 | 42905298 | 42905319 | 42905303 | 42905298 | - |
| SEQ ID NO 63629 | AGTAGCTCAGATTACAGGCATG | CTG | chr17 | 42905295 | 42905316 | 42905300 | 42905295 | - |
| SEQ ID NO 63630 | AGATTACAGGCATGCACCAGGA | CTC | chr17 | 42905287 | 42905308 | 42905292 | 42905287 | - |
| SEQ ID NO 63631 | CAGGCATGCACCAGGACACCCA | TTA | chr17 | 42905281 | 42905302 | 42905286 | 42905281 | - |
| SEQ ID NO 63632 | ATTTTTGTATTTTTAGTAGAGA | CTA | chr17 | 42905255 | 42905276 | 42905260 | 42905255 | - |
| SEQ ID NO 63633 | TTGTATTTTTAGTAGAGACAGG | TTT | chr17 | 42905251 | 42905272 | 42905256 | 42905251 | - |
| SEQ ID NO 63634 | TGTATTTTTAGTAGAGACAGGG | TTT | chr17 | 42905250 | 42905271 | 42905255 | 42905250 | - |
| SEQ ID NO 63635 | GTATTTTTAGTAGAGACAGGGT | TTT | chr17 | 42905249 | 42905270 | 42905254 | 42905249 | - |
| SEQ ID NO 63636 | TATTTTTAGTAGAGACAGGGTT | TTG | chr17 | 42905248 | 42905269 | 42905253 | 42905248 | - |
| SEQ ID NO 63637 | TTAGTAGAGACAGGGTTTTGCC | TTT | chr17 | 42905243 | 42905264 | 42905248 | 42905243 | - |
| SEQ ID NO 63638 | TAGTAGAGACAGGGTTTTGCCA | TTT | chr17 | 42905242 | 42905263 | 42905247 | 42905242 | - |
| SEQ ID NO 63639 | AGTAGAGACAGGGTTTTGCCAT | TTT | chr17 | 42905241 | 42905262 | 42905246 | 42905241 | - |
| SEQ ID NO 63640 | GTAGAGACAGGGTTTTGCCATG | TTA | chr17 | 42905240 | 42905261 | 42905245 | 42905240 | - |
| SEQ ID NO 63641 | TGCCATGTTGGCCAGGCTGGTC | TTT | chr17 | 42905225 | 42905246 | 42905230 | 42905225 | - |
| SEQ ID NO 63642 | GCCATGTTGGCCAGGCTGGTCT | TTT | chr17 | 42905224 | 42905245 | 42905229 | 42905224 | - |
| SEQ ID NO 63643 | CCATGTTGGCCAGGCTGGTCTT | TTG | chr17 | 42905223 | 42905244 | 42905228 | 42905223 | - |
| SEQ ID NO 63644 | GCCAGGCTGGTCTTGAACTCCT | TTG | chr17 | 42905215 | 42905236 | 42905220 | 42905215 | - |
| SEQ ID NO 63645 | GTCTTGAACTCCTCACCTCAGG | CTG | chr17 | 42905206 | 42905227 | 42905211 | 42905206 | - |
| SEQ ID NO 63646 | GAACTCCTCACCTCAGGTGATC | CTT | chr17 | 42905201 | 42905222 | 42905206 | 42905201 | - |
| SEQ ID NO 63647 | AACTCCTCACCTCAGGTGATCC | TTG | chr17 | 42905200 | 42905221 | 42905205 | 42905200 | - |
| SEQ ID NO 63648 | CTCACCTCAGGTGATCCACCCG | CTC | chr17 | 42905195 | 42905216 | 42905200 | 42905195 | - |
| SEQ ID NO 63649 | ACCTCAGGTGATCCACCCGCCT | CTC | chr17 | 42905192 | 42905213 | 42905197 | 42905192 | - |
| SEQ ID NO 63650 | AGGTGATCCACCCGCCTCAGCC | CTC | chr17 | 42905187 | 42905208 | 42905192 | 42905187 | - |
| SEQ ID NO 63651 | AGCCTCCCAAAGTGCTGGGATT | CTC | chr17 | 42905169 | 42905190 | 42905174 | 42905169 | - |
| SEQ ID NO 63652 | CCAAAGTGCTGGGATTACAGGG | CTC | chr17 | 42905163 | 42905184 | 42905168 | 42905163 | - |
| SEQ ID NO 63653 | GGATTACAGGGTGAGCCACCGT | CTG | chr17 | 42905152 | 42905173 | 42905157 | 42905152 | - |
| SEQ ID NO 63654 | CAGGGTGAGCCACCGTGCCTGG | TTA | chr17 | 42905146 | 42905167 | 42905151 | 42905146 | - |
| SEQ ID NO 63655 | GCCTATCCTACATATTAATAGT | CTG | chr17 | 42905125 | 42905146 | 42905130 | 42905125 | - |
| SEQ ID NO 63656 | TCCTACATATTAATAGTTTACT | CTA | chr17 | 42905120 | 42905141 | 42905125 | 42905120 | - |
| SEQ ID NO 63657 | CATATTAATAGTTTACTTTTTT | CTA | chr17 | 42905115 | 42905136 | 42905120 | 42905115 | - |
| SEQ ID NO 63658 | ATAGTTTACTTTTTTTTTGAGA | TTA | chr17 | 42905108 | 42905129 | 42905113 | 42905108 | - |
| SEQ ID NO 63659 | ACTTTTTTTTTGAGACAGAGTC | TTT | chr17 | 42905101 | 42905122 | 42905106 | 42905101 | - |
| SEQ ID NO 63660 | CTTTTTTTTTGAGACAGAGTCT | TTA | chr17 | 42905100 | 42905121 | 42905105 | 42905100 | - |
| SEQ ID NO 63661 | TTTTTTTGAGACAGAGTCTCGT | CTT | chr17 | 42905097 | 42905118 | 42905102 | 42905097 | - |
| SEQ ID NO 63662 | TTTTTTGAGACAGAGTCTCGTT | TTT | chr17 | 42905096 | 42905117 | 42905101 | 42905096 | - |
| SEQ ID NO 63663 | TTTTTGAGACAGAGTCTCGTTC | TTT | chr17 | 42905095 | 42905116 | 42905100 | 42905095 | - |
| SEQ ID NO 63664 | TTTTGAGACAGAGTCTCGTTCT | TTT | chr17 | 42905094 | 42905115 | 42905099 | 42905094 | - |
| SEQ ID NO 63665 | TTTGAGACAGAGTCTCGTTCTG | TTT | chr17 | 42905093 | 42905114 | 42905098 | 42905093 | - |
| SEQ ID NO 63666 | TTGAGACAGAGTCTCGTTCTGT | TTT | chr17 | 42905092 | 42905113 | 42905097 | 42905092 | - |
| SEQ ID NO 63667 | TGAGACAGAGTCTCGTTCTGTC | TTT | chr17 | 42905091 | 42905112 | 42905096 | 42905091 | - |
| SEQ ID NO 63668 | GAGACAGAGTCTCGTTCTGTCA | TTT | chr17 | 42905090 | 42905111 | 42905095 | 42905090 | - |
| SEQ ID NO 63669 | AGACAGAGTCTCGTTCTGTCAT | TTG | chr17 | 42905089 | 42905110 | 42905094 | 42905089 | - |
| SEQ ID NO 63670 | GTTCTGTCATTCAGGCTGGAGT | CTC | chr17 | 42905077 | 42905098 | 42905082 | 42905077 | - |
| SEQ ID NO 63671 | TGTCATTCAGGCTGGAGTGCAG | TTC | chr17 | 42905073 | 42905094 | 42905078 | 42905073 | - |
| SEQ ID NO 63672 | TCATTCAGGCTGGAGTGCAGTG | CTG | chr17 | 42905071 | 42905092 | 42905076 | 42905071 | - |
| SEQ ID NO 63673 | AGGCTGGAGTGCAGTGGTCCGA | TTC | chr17 | 42905065 | 42905086 | 42905070 | 42905065 | - |
| SEQ ID NO 63674 | GAGTGCAGTGGTCCGATCTCGG | CTG | chr17 | 42905059 | 42905080 | 42905064 | 42905059 | - |

Figure 90 (Cont'd)

| | | | | | | | | |
|---|---|---|---|---|---|---|---|---|
| SEQ ID NO 63675 | GGTTCACTGCAACCTCTGCCTC | CTC | chr17 | 42905039 | 42905060 | 42905044 | 42905039 | - |
| SEQ ID NO 63676 | ACTGCAACCTCTGCCTCCCAGG | TTC | chr17 | 42905034 | 42905055 | 42905039 | 42905034 | - |
| SEQ ID NO 63677 | CAACCTCTGCCTCCCAGGTTCA | CTG | chr17 | 42905030 | 42905051 | 42905035 | 42905030 | - |
| SEQ ID NO 63678 | TGCCTCCCAGGTTCAAGCGATT | CTC | chr17 | 42905023 | 42905044 | 42905028 | 42905023 | - |
| SEQ ID NO 63679 | CCTCCCAGGTTCAAGCGATTCT | CTG | chr17 | 42905021 | 42905042 | 42905026 | 42905021 | - |
| SEQ ID NO 63680 | CCAGGTTCAAGCGATTCTCCTG | CTC | chr17 | 42905017 | 42905038 | 42905022 | 42905017 | - |
| SEQ ID NO 63681 | AAGCGATTCTCCTGCCTCAGCC | TTC | chr17 | 42905009 | 42905030 | 42905014 | 42905009 | - |
| SEQ ID NO 63682 | TCCTGCCTCAGCCTCCCAGGTA | TTC | chr17 | 42905000 | 42905021 | 42905005 | 42905000 | - |
| SEQ ID NO 63683 | CTGCCTCAGCCTCCCAGGTAGC | CTC | chr17 | 42904998 | 42905019 | 42905003 | 42904998 | - |
| SEQ ID NO 63684 | CCTCAGCCTCCCAGGTAGCTGA | CTG | chr17 | 42904995 | 42905016 | 42905000 | 42904995 | - |
| SEQ ID NO 63685 | AGCCTCCCAGGTAGCTGAGACT | CTC | chr17 | 42904991 | 42905012 | 42904996 | 42904991 | - |
| SEQ ID NO 63686 | CCAGGTAGCTGAGACTACAGGC | CTC | chr17 | 42904985 | 42905006 | 42904990 | 42904985 | - |
| SEQ ID NO 63687 | AGACTACAGGCGTGTGCCATCA | CTG | chr17 | 42904974 | 42904995 | 42904979 | 42904974 | - |
| SEQ ID NO 63688 | CAGGCGTGTGCCATCACGCCTG | CTA | chr17 | 42904968 | 42904989 | 42904973 | 42904968 | - |
| SEQ ID NO 63689 | ACCAATTTTTCCATTTTTAGTA | CTG | chr17 | 42904946 | 42904967 | 42904951 | 42904946 | - |
| SEQ ID NO 63690 | TTCCATTTTTAGTAAAGACAGG | TTT | chr17 | 42904938 | 42904959 | 42904943 | 42904938 | - |
| SEQ ID NO 63691 | TCCATTTTTAGTAAAGACAGGA | TTT | chr17 | 42904937 | 42904958 | 42904942 | 42904937 | - |
| SEQ ID NO 63692 | CCATTTTTAGTAAAGACAGGAT | TTT | chr17 | 42904936 | 42904957 | 42904941 | 42904936 | - |
| SEQ ID NO 63693 | CATTTTTAGTAAAGACAGGATT | TTC | chr17 | 42904935 | 42904956 | 42904940 | 42904935 | - |
| SEQ ID NO 63694 | TTAGTAAAGACAGGATTTTGCA | TTT | chr17 | 42904930 | 42904951 | 42904935 | 42904930 | - |
| SEQ ID NO 63695 | TAGTAAAGACAGGATTTTGCAA | TTT | chr17 | 42904929 | 42904950 | 42904934 | 42904929 | - |
| SEQ ID NO 63696 | AGTAAAGACAGGATTTTGCAAT | TTT | chr17 | 42904928 | 42904949 | 42904933 | 42904928 | - |
| SEQ ID NO 63697 | GTAAAGACAGGATTTTGCAATG | TTA | chr17 | 42904927 | 42904948 | 42904932 | 42904927 | - |
| SEQ ID NO 63698 | TGCAATGTTGGCCAGGCTGGTT | TTT | chr17 | 42904912 | 42904933 | 42904917 | 42904912 | - |
| SEQ ID NO 63699 | GCAATGTTGGCCAGGCTGGTTT | TTT | chr17 | 42904911 | 42904932 | 42904916 | 42904911 | - |
| SEQ ID NO 63700 | CAATGTTGGCCAGGCTGGTTTT | TTG | chr17 | 42904910 | 42904931 | 42904915 | 42904910 | - |
| SEQ ID NO 63701 | GCCAGGCTGGTTTTGAACTCCT | TTG | chr17 | 42904902 | 42904923 | 42904907 | 42904902 | - |
| SEQ ID NO 63702 | GTTTTGAACTCCTGACCTCAGG | CTG | chr17 | 42904893 | 42904914 | 42904898 | 42904893 | - |
| SEQ ID NO 63703 | TGAACTCCTGACCTCAGGTGAT | TTT | chr17 | 42904889 | 42904910 | 42904894 | 42904889 | - |
| SEQ ID NO 63704 | GAACTCCTGACCTCAGGTGATC | TTT | chr17 | 42904888 | 42904909 | 42904893 | 42904888 | - |
| SEQ ID NO 63705 | AACTCCTGACCTCAGGTGATCT | TTG | chr17 | 42904887 | 42904908 | 42904892 | 42904887 | - |
| SEQ ID NO 63706 | CTGACCTCAGGTGATCTACCTA | CTC | chr17 | 42904882 | 42904903 | 42904887 | 42904882 | - |
| SEQ ID NO 63707 | ACCTCAGGTGATCTACCTACCT | CTG | chr17 | 42904879 | 42904900 | 42904884 | 42904879 | - |
| SEQ ID NO 63708 | AGGTGATCTACCTACCTTGGCT | CTC | chr17 | 42904874 | 42904895 | 42904879 | 42904874 | - |
| SEQ ID NO 63709 | CCTACCTTGGCTTCCCAAAGTG | CTA | chr17 | 42904864 | 42904885 | 42904869 | 42904864 | - |
| SEQ ID NO 63710 | CCTTGGCTTCCCAAAGTGCTGG | CTA | chr17 | 42904860 | 42904881 | 42904865 | 42904860 | - |
| SEQ ID NO 63711 | GGCTTCCCAAAGTGCTGGGATT | CTT | chr17 | 42904856 | 42904877 | 42904861 | 42904856 | - |
| SEQ ID NO 63712 | GCTTCCCAAAGTGCTGGGATTA | TTG | chr17 | 42904855 | 42904876 | 42904860 | 42904855 | - |
| SEQ ID NO 63713 | CCCAAAGTGCTGGGATTACAGG | CTT | chr17 | 42904851 | 42904872 | 42904856 | 42904851 | - |
| SEQ ID NO 63714 | CCAAAGTGCTGGGATTACAGGC | TTC | chr17 | 42904850 | 42904871 | 42904855 | 42904850 | - |
| SEQ ID NO 63715 | GGATTACAGGCATGAGCAACCA | CTG | chr17 | 42904839 | 42904860 | 42904844 | 42904839 | - |
| SEQ ID NO 63716 | CAGGCATGAGCAACCACAACTG | TTA | chr17 | 42904833 | 42904854 | 42904838 | 42904833 | - |
| SEQ ID NO 63717 | GCCTAGTTTACTTATTTATTAT | CTG | chr17 | 42904811 | 42904832 | 42904816 | 42904811 | - |
| SEQ ID NO 63718 | GTTTACTTATTTATTATAATTT | CTA | chr17 | 42904806 | 42904827 | 42904811 | 42904806 | - |
| SEQ ID NO 63719 | ACTTATTTATTATAATTTTTGT | TTT | chr17 | 42904802 | 42904823 | 42904807 | 42904802 | - |
| SEQ ID NO 63720 | CTTATTTATTATAATTTTTGTA | TTA | chr17 | 42904801 | 42904822 | 42904806 | 42904801 | - |
| SEQ ID NO 63721 | ATTTATTAATTTTTGTATAT | CTT | chr17 | 42904798 | 42904819 | 42904803 | 42904798 | - |
| SEQ ID NO 63722 | TTTATTATAATTTTTGTATATT | TTA | chr17 | 42904797 | 42904818 | 42904802 | 42904797 | - |
| SEQ ID NO 63723 | ATTATAATTTTTGTATATTTCA | TTT | chr17 | 42904794 | 42904815 | 42904799 | 42904794 | - |
| SEQ ID NO 63724 | TTATAATTTTTGTATATTTCAC | TTA | chr17 | 42904793 | 42904814 | 42904798 | 42904793 | - |
| SEQ ID NO 63725 | TAATTTTTGTATATTTCACCTC | TTA | chr17 | 42904790 | 42904811 | 42904795 | 42904790 | - |
| SEQ ID NO 63726 | TTGTATATTTCACCTCCTCTAT | TTT | chr17 | 42904784 | 42904805 | 42904789 | 42904784 | - |
| SEQ ID NO 63727 | TGTATATTTCACCTCCTCTATT | TTT | chr17 | 42904783 | 42904804 | 42904788 | 42904783 | - |
| SEQ ID NO 63728 | GTATATTTCACCTCCTCTATTC | TTT | chr17 | 42904782 | 42904803 | 42904787 | 42904782 | - |
| SEQ ID NO 63729 | TATATTTCACCTCCTCTATTCA | TTG | chr17 | 42904781 | 42904802 | 42904786 | 42904781 | - |
| SEQ ID NO 63730 | CACCTCCTCTATTCAGATTTCA | TTT | chr17 | 42904774 | 42904795 | 42904779 | 42904774 | - |
| SEQ ID NO 63731 | ACCTCCTCTATTCAGATTTCAG | TTC | chr17 | 42904773 | 42904794 | 42904778 | 42904773 | - |
| SEQ ID NO 63732 | CTCTATTCAGATTTCAGCTCCA | CTC | chr17 | 42904768 | 42904789 | 42904773 | 42904768 | - |

Figure 90 (Cont'd)

| | | | | | | | | |
|---|---|---|---|---|---|---|---|---|
| SEQ ID NO 63733 | TATTCAGATTTCAGCTCCACAA | CTC | chr17 | 42904765 | 42904786 | 42904770 | 42904765 | - |
| SEQ ID NO 63734 | TTCAGATTTCAGCTCCACAAGG | CTA | chr17 | 42904763 | 42904784 | 42904768 | 42904763 | - |
| SEQ ID NO 63735 | AGATTTCAGCTCCACAAGGGCA | TTC | chr17 | 42904760 | 42904781 | 42904765 | 42904760 | - |
| SEQ ID NO 63736 | CAGCTCCACAAGGGCAGGGATC | TTT | chr17 | 42904754 | 42904775 | 42904759 | 42904754 | - |
| SEQ ID NO 63737 | AGCTCCACAAGGGCAGGGATCT | TTC | chr17 | 42904753 | 42904774 | 42904758 | 42904753 | - |
| SEQ ID NO 63738 | CACAAGGGCAGGGATCTTTGTG | CTC | chr17 | 42904748 | 42904769 | 42904753 | 42904748 | - |
| SEQ ID NO 63739 | TGTGTCTGTGTTGTTCACTGAC | CTT | chr17 | 42904730 | 42904751 | 42904735 | 42904730 | - |
| SEQ ID NO 63740 | GTGTCTGTGTTGTTCACTGACA | TTT | chr17 | 42904729 | 42904750 | 42904734 | 42904729 | - |
| SEQ ID NO 63741 | TGTCTGTGTTGTTCACTGACAG | TTG | chr17 | 42904728 | 42904749 | 42904733 | 42904728 | - |
| SEQ ID NO 63742 | TGTTGTTCACTGACAGAGGTAT | CTG | chr17 | 42904722 | 42904743 | 42904727 | 42904722 | - |
| SEQ ID NO 63743 | TTCACTGACAGAGGTATCCCTA | TTG | chr17 | 42904717 | 42904738 | 42904722 | 42904717 | - |
| SEQ ID NO 63744 | ACTGACAGAGGTATCCCTAGCA | TTC | chr17 | 42904714 | 42904735 | 42904719 | 42904714 | - |
| SEQ ID NO 63745 | ACAGAGGTATCCCTAGCACATA | CTG | chr17 | 42904710 | 42904731 | 42904715 | 42904710 | - |
| SEQ ID NO 63746 | GCACATAGAACAGTGTATAGCT | CTA | chr17 | 42904695 | 42904716 | 42904700 | 42904695 | - |
| SEQ ID NO 63747 | CCAGTAGGTGCTTGGTAAGTAA | CTC | chr17 | 42904672 | 42904693 | 42904677 | 42904672 | - |
| SEQ ID NO 63748 | GGTAAGTAACAGCTGAATGAGT | CTT | chr17 | 42904659 | 42904680 | 42904664 | 42904659 | - |
| SEQ ID NO 63749 | GTAAGTAACAGCTGAATGAGTG | TTG | chr17 | 42904658 | 42904679 | 42904663 | 42904658 | - |
| SEQ ID NO 63750 | AATGAGTGAATATGCTCTGAGG | CTG | chr17 | 42904644 | 42904665 | 42904649 | 42904644 | - |
| SEQ ID NO 63751 | TGAGGTAAATGCGTGGTCTGTG | CTC | chr17 | 42904627 | 42904648 | 42904632 | 42904627 | - |
| SEQ ID NO 63752 | AGGTAAATGCGTGGTCTGTGAG | CTG | chr17 | 42904625 | 42904646 | 42904630 | 42904625 | - |
| SEQ ID NO 63753 | TGAGAGCAAATAACTAAGGGAC | CTG | chr17 | 42904607 | 42904628 | 42904612 | 42904607 | - |
| SEQ ID NO 63754 | AGGGACCTTCCCTAGTTTTGGG | CTA | chr17 | 42904591 | 42904612 | 42904596 | 42904591 | - |
| SEQ ID NO 63755 | CCCTAGTTTTGGGGTCAGGGAA | CTT | chr17 | 42904582 | 42904603 | 42904587 | 42904582 | - |
| SEQ ID NO 63756 | CCTAGTTTTGGGGTCAGGGAAA | TTC | chr17 | 42904581 | 42904602 | 42904586 | 42904581 | - |
| SEQ ID NO 63757 | GTTTTGGGGTCAGGGAAAGGGT | CTA | chr17 | 42904577 | 42904598 | 42904582 | 42904577 | - |
| SEQ ID NO 63758 | TGGGGTCAGGGAAAGGGTCTCT | TTT | chr17 | 42904573 | 42904594 | 42904578 | 42904573 | - |
| SEQ ID NO 63759 | GGGGTCAGGGAAAGGGTCTCTG | TTT | chr17 | 42904572 | 42904593 | 42904577 | 42904572 | - |
| SEQ ID NO 63760 | GGGTCAGGGAAAGGGTCTCTGA | TTG | chr17 | 42904571 | 42904592 | 42904576 | 42904571 | - |
| SEQ ID NO 63761 | TGAGGAAGGGATACTAGTACCT | CTC | chr17 | 42904552 | 42904573 | 42904557 | 42904552 | - |
| SEQ ID NO 63762 | AGGAAGGGATACTAGTACCTTA | CTG | chr17 | 42904550 | 42904571 | 42904555 | 42904550 | - |
| SEQ ID NO 63763 | GTACCTTAGAGAGTACTAGTCT | CTA | chr17 | 42904536 | 42904557 | 42904541 | 42904536 | - |
| SEQ ID NO 63764 | AGAGAGTACTAGTCTTAGAGGG | CTT | chr17 | 42904529 | 42904550 | 42904534 | 42904529 | - |
| SEQ ID NO 63765 | GAGAGTACTAGTCTTAGAGGGC | TTA | chr17 | 42904528 | 42904549 | 42904533 | 42904528 | - |
| SEQ ID NO 63766 | GTCTTAGAGGGCAGCTGAGACT | CTA | chr17 | 42904518 | 42904539 | 42904523 | 42904518 | - |
| SEQ ID NO 63767 | AGAGGGCAGCTGAGACTTTAGG | CTT | chr17 | 42904513 | 42904534 | 42904518 | 42904513 | - |
| SEQ ID NO 63768 | GAGGGCAGCTGAGACTTTAGGG | TTA | chr17 | 42904512 | 42904533 | 42904517 | 42904512 | - |
| SEQ ID NO 63769 | AGACTTTAGGGTGAGGGAGGGG | CTG | chr17 | 42904501 | 42904522 | 42904506 | 42904501 | - |
| SEQ ID NO 63770 | TAGGGTGAGGGAGGGGCTTCCT | CTT | chr17 | 42904495 | 42904516 | 42904500 | 42904495 | - |
| SEQ ID NO 63771 | AGGGTGAGGGAGGGGCTTCCTA | TTT | chr17 | 42904494 | 42904515 | 42904499 | 42904494 | - |
| SEQ ID NO 63772 | GGGTGAGGGAGGGGCTTCCTAT | TTA | chr17 | 42904493 | 42904514 | 42904498 | 42904493 | - |
| SEQ ID NO 63773 | CCTATTACATACTGAAAATGAA | CTT | chr17 | 42904476 | 42904497 | 42904481 | 42904476 | - |
| SEQ ID NO 63774 | CTATTACATACTGAAAATGAAA | TTC | chr17 | 42904475 | 42904496 | 42904480 | 42904475 | - |
| SEQ ID NO 63775 | TTACATACTGAAAATGAAATCT | CTA | chr17 | 42904472 | 42904493 | 42904477 | 42904472 | - |
| SEQ ID NO 63776 | CATACTGAAAATGAAATCTATC | TTA | chr17 | 42904469 | 42904490 | 42904474 | 42904469 | - |
| SEQ ID NO 63777 | AAAATGAAATCTATCATTTGAT | CTG | chr17 | 42904462 | 42904483 | 42904467 | 42904462 | - |
| SEQ ID NO 63778 | TCATTTGATTTGACAGTAACCA | CTA | chr17 | 42904449 | 42904470 | 42904454 | 42904449 | - |
| SEQ ID NO 63779 | GATTTGACAGTAACCATCTGGC | TTT | chr17 | 42904443 | 42904464 | 42904448 | 42904443 | - |
| SEQ ID NO 63780 | ATTTGACAGTAACCATCTGGCT | TTG | chr17 | 42904442 | 42904463 | 42904447 | 42904442 | - |
| SEQ ID NO 63781 | GACAGTAACCATCTGGCTGTAA | TTT | chr17 | 42904438 | 42904459 | 42904443 | 42904438 | - |
| SEQ ID NO 63782 | ACAGTAACCATCTGGCTGTAAC | TTG | chr17 | 42904437 | 42904458 | 42904442 | 42904437 | - |
| SEQ ID NO 63783 | GCTGTAACTAATAAAACGTAGG | CTG | chr17 | 42904423 | 42904444 | 42904428 | 42904423 | - |
| SEQ ID NO 63784 | TAACTAATAAAACGTAGGCACA | CTG | chr17 | 42904419 | 42904440 | 42904424 | 42904419 | - |
| SEQ ID NO 63785 | ATAAAACGTAGGCACAGAGAGG | CTA | chr17 | 42904413 | 42904434 | 42904418 | 42904413 | - |
| SEQ ID NO 63786 | GACGGTCAGCTCAGGAGGGCAC | TTG | chr17 | 42904380 | 42904401 | 42904385 | 42904380 | - |
| SEQ ID NO 63787 | AGGAGGGCACATCCAGTGGGCC | CTC | chr17 | 42904368 | 42904389 | 42904373 | 42904368 | - |
| SEQ ID NO 63788 | GGAAGGACCCCAGAAGCTCAG | TTG | chr17 | 42904337 | 42904358 | 42904342 | 42904337 | - |
| SEQ ID NO 63789 | AGGCTTCTGCCCCCTCCTTTCT | CTC | chr17 | 42904317 | 42904338 | 42904322 | 42904317 | - |
| SEQ ID NO 63790 | CTGCCCCCTCCTTTCTCAGGAC | CTT | chr17 | 42904311 | 42904332 | 42904316 | 42904311 | - |

Figure 90 (Cont'd)

| SEQ ID NO 63791 | TGCCCCCTCCTTTCTCAGGACA | TTC | chr17 | 42904310 | 42904331 | 42904315 | 42904310 | - |
|---|---|---|---|---|---|---|---|---|
| SEQ ID NO 63792 | CCCCCTCCTTTCTCAGGACACA | CTG | chr17 | 42904308 | 42904329 | 42904313 | 42904308 | - |
| SEQ ID NO 63793 | CTTTCTCAGGACACAGCGCTGC | CTC | chr17 | 42904301 | 42904322 | 42904306 | 42904301 | - |
| SEQ ID NO 63794 | TCTCAGGACACAGCGCTGCAGG | CTT | chr17 | 42904298 | 42904319 | 42904303 | 42904298 | - |
| SEQ ID NO 63795 | CTCAGGACACAGCGCTGCAGGG | TTT | chr17 | 42904297 | 42904318 | 42904302 | 42904297 | - |
| SEQ ID NO 63796 | TCAGGACACAGCGCTGCAGGGC | TTC | chr17 | 42904296 | 42904317 | 42904301 | 42904296 | - |
| SEQ ID NO 63797 | AGGACACAGCGCTGCAGGGCGG | CTC | chr17 | 42904294 | 42904315 | 42904299 | 42904294 | - |
| SEQ ID NO 63798 | CAGGGCGGTGACTCTCACGAGC | CTG | chr17 | 42904280 | 42904301 | 42904285 | 42904280 | - |
| SEQ ID NO 63799 | TCACGAGCCCTTTGCCCATGGA | CTC | chr17 | 42904266 | 42904287 | 42904271 | 42904266 | - |
| SEQ ID NO 63800 | ACGAGCCCTTTGCCCATGGATG | CTC | chr17 | 42904264 | 42904285 | 42904269 | 42904264 | - |
| SEQ ID NO 63801 | TGCCCATGGATGCCCGTGCCTC | CTT | chr17 | 42904254 | 42904275 | 42904259 | 42904254 | - |
| SEQ ID NO 63802 | GCCCATGGATGCCCGTGCCTCT | TTT | chr17 | 42904253 | 42904274 | 42904258 | 42904253 | - |
| SEQ ID NO 63803 | CCCATGGATGCCCGTGCCTCTC | TTG | chr17 | 42904252 | 42904273 | 42904257 | 42904252 | - |
| SEQ ID NO 63804 | TCTGGACTCCATCCAGGTTCTG | CTC | chr17 | 42904232 | 42904253 | 42904237 | 42904232 | - |
| SEQ ID NO 63805 | TGGACTCCATCCAGGTTCTGTA | CTC | chr17 | 42904230 | 42904251 | 42904235 | 42904230 | - |
| SEQ ID NO 63806 | GACTCCATCCAGGTTCTGTAAT | CTG | chr17 | 42904228 | 42904249 | 42904233 | 42904228 | - |
| SEQ ID NO 63807 | CATCCAGGTTCTGTAATAGGCA | CTC | chr17 | 42904223 | 42904244 | 42904228 | 42904223 | - |
| SEQ ID NO 63808 | TGTAATAGGCAGATTTCCAATA | TTC | chr17 | 42904212 | 42904233 | 42904217 | 42904212 | - |
| SEQ ID NO 63809 | TAATAGGCAGATTTCCAATACT | CTG | chr17 | 42904210 | 42904231 | 42904215 | 42904210 | - |
| SEQ ID NO 63810 | CCAATACTACTGTGCTATTCAG | TTT | chr17 | 42904196 | 42904217 | 42904201 | 42904196 | - |
| SEQ ID NO 63811 | CAATACTACTGTGCTATTCAGG | TTC | chr17 | 42904195 | 42904216 | 42904200 | 42904195 | - |
| SEQ ID NO 63812 | CTGTGCTATTCAGGAAAGTATT | CTA | chr17 | 42904187 | 42904208 | 42904192 | 42904187 | - |
| SEQ ID NO 63813 | TGCTATTCAGGAAAGTATTGCA | CTG | chr17 | 42904184 | 42904205 | 42904189 | 42904184 | - |
| SEQ ID NO 63814 | TTCAGGAAAGTATTGCAGAAGT | CTA | chr17 | 42904179 | 42904200 | 42904184 | 42904179 | - |
| SEQ ID NO 63815 | AGGAAAGTATTGCAGAAGTGAA | TTC | chr17 | 42904176 | 42904197 | 42904181 | 42904176 | - |
| SEQ ID NO 63816 | CAGAAGTGAATTAATTTGTGCC | TTG | chr17 | 42904164 | 42904185 | 42904169 | 42904164 | - |
| SEQ ID NO 63817 | ATTTGTGCCAATTGAAGAGCAT | TTA | chr17 | 42904151 | 42904172 | 42904156 | 42904151 | - |
| SEQ ID NO 63818 | GTGCCAATTGAAGAGCATGACA | TTT | chr17 | 42904147 | 42904168 | 42904152 | 42904147 | - |
| SEQ ID NO 63819 | TGCCAATTGAAGAGCATGACAA | TTG | chr17 | 42904146 | 42904167 | 42904151 | 42904146 | - |
| SEQ ID NO 63820 | AAGAGCATGACAAAAGTACAAA | TTG | chr17 | 42904137 | 42904158 | 42904142 | 42904137 | - |
| SEQ ID NO 63821 | TCCTCATGTCCCCTCAAGGTCA | CTC | chr17 | 42904105 | 42904126 | 42904110 | 42904105 | - |
| SEQ ID NO 63822 | CTCATGTCCCCTCAAGGTCAGT | CTC | chr17 | 42904103 | 42904124 | 42904108 | 42904103 | - |
| SEQ ID NO 63823 | ATGTCCCCTCAAGGTCAGTTTC | CTC | chr17 | 42904100 | 42904121 | 42904105 | 42904100 | - |
| SEQ ID NO 63824 | AAGGTCAGTTTCATCCATAACA | CTC | chr17 | 42904090 | 42904111 | 42904095 | 42904090 | - |
| SEQ ID NO 63825 | CATCCATAACAGGTAAACGAGG | TTT | chr17 | 42904079 | 42904100 | 42904084 | 42904079 | - |
| SEQ ID NO 63826 | ATCCATAACAGGTAAACGAGGT | TTC | chr17 | 42904078 | 42904099 | 42904083 | 42904078 | - |
| SEQ ID NO 63827 | AGCTTCTGTCTGCAGGGGCTGG | CTC | chr17 | 42904050 | 42904071 | 42904055 | 42904050 | - |
| SEQ ID NO 63828 | CTGTCTGCAGGGGCTGGACGC | CTT | chr17 | 42904045 | 42904066 | 42904050 | 42904045 | - |
| SEQ ID NO 63829 | TGTCTGCAGGGGCTGGACGCT | TTC | chr17 | 42904044 | 42904065 | 42904049 | 42904044 | - |
| SEQ ID NO 63830 | TCTGCAGGGGCTGGACGCTTA | CTG | chr17 | 42904042 | 42904063 | 42904047 | 42904042 | - |
| SEQ ID NO 63831 | CAGGGGCTGGACGCTTACCTG | CTG | chr17 | 42904038 | 42904059 | 42904043 | 42904038 | - |
| SEQ ID NO 63832 | GGACGCTTACCTGGTCCAGTCT | CTG | chr17 | 42904029 | 42904050 | 42904034 | 42904029 | - |
| SEQ ID NO 63833 | ACCTGGTCCAGTCTCACAGGTT | CTT | chr17 | 42904021 | 42904042 | 42904026 | 42904021 | - |
| SEQ ID NO 63834 | CCTGGTCCAGTCTCACAGGTTA | TTA | chr17 | 42904020 | 42904041 | 42904025 | 42904020 | - |
| SEQ ID NO 63835 | GTCCAGTCTCACAGGTTACAGG | CTG | chr17 | 42904016 | 42904037 | 42904021 | 42904016 | - |
| SEQ ID NO 63836 | ACAGGTTACAGGGAACTGCTTT | CTC | chr17 | 42904006 | 42904027 | 42904011 | 42904006 | - |
| SEQ ID NO 63837 | CAGGGAACTGCTTTATCAGGGG | TTA | chr17 | 42903998 | 42904019 | 42904003 | 42903998 | - |
| SEQ ID NO 63838 | CTTTATCAGGGGCACGGAAGTG | CTG | chr17 | 42903988 | 42904009 | 42903993 | 42903988 | - |
| SEQ ID NO 63839 | TATCAGGGGCACGGAAGTGTTG | CTT | chr17 | 42903985 | 42904006 | 42903990 | 42903985 | - |
| SEQ ID NO 63840 | ATCAGGGGCACGGAAGTGTTGC | TTT | chr17 | 42903984 | 42904005 | 42903989 | 42903984 | - |
| SEQ ID NO 63841 | TCAGGGGCACGGAAGTGTTGCT | TTA | chr17 | 42903983 | 42904004 | 42903988 | 42903983 | - |
| SEQ ID NO 63842 | CTGTAGTAGTCAGTATCCAAAA | TTG | chr17 | 42903963 | 42903984 | 42903968 | 42903963 | - |
| SEQ ID NO 63843 | TAGTAGTCAGTATCCAAAACCC | CTG | chr17 | 42903960 | 42903981 | 42903965 | 42903960 | - |
| SEQ ID NO 63844 | TCCAAAGAGAATCCTATGGAAA | CTG | chr17 | 42903922 | 42903943 | 42903927 | 42903922 | - |
| SEQ ID NO 63845 | TGGAAAAACAGAACAAGTTTCT | CTA | chr17 | 42903906 | 42903927 | 42903911 | 42903906 | - |
| SEQ ID NO 63846 | CTGGGGTTACTGAATGAATGCT | TTT | chr17 | 42903886 | 42903907 | 42903891 | 42903886 | - |
| SEQ ID NO 63847 | TGGGGTTACTGAATGAATGCTT | TTC | chr17 | 42903885 | 42903906 | 42903890 | 42903885 | - |
| SEQ ID NO 63848 | GGGTTACTGAATGAATGCTTTT | CTG | chr17 | 42903883 | 42903904 | 42903888 | 42903883 | - |

Figure 90 (Cont'd)

| SEQ ID NO 63849 | CTGAATGAATGCTTTTGCCCAA | TTA | chr17 | 42903877 | 42903898 | 42903882 | 42903877 | - |
| SEQ ID NO 63850 | AATGAATGCTTTTGCCCAAAGC | CTG | chr17 | 42903874 | 42903895 | 42903879 | 42903874 | - |
| SEQ ID NO 63851 | TTGCCCAAAGCCTACACCTTCA | CTT | chr17 | 42903863 | 42903884 | 42903868 | 42903863 | - |
| SEQ ID NO 63852 | TGCCCAAAGCCTACACCTTCAA | TTT | chr17 | 42903862 | 42903883 | 42903867 | 42903862 | - |
| SEQ ID NO 63853 | GCCCAAAGCCTACACCTTCAAG | TTT | chr17 | 42903861 | 42903882 | 42903866 | 42903861 | - |
| SEQ ID NO 63854 | CCCAAAGCCTACACCTTCAAGA | TTG | chr17 | 42903860 | 42903881 | 42903865 | 42903860 | - |
| SEQ ID NO 63855 | CACCTTCAAGAAGAGTGTAGCC | CTA | chr17 | 42903849 | 42903870 | 42903854 | 42903849 | - |
| SEQ ID NO 63856 | CAAGAAGAGTGTAGCCTGAGAA | CTT | chr17 | 42903843 | 42903864 | 42903848 | 42903843 | - |
| SEQ ID NO 63857 | AAGAAGAGTGTAGCCTGAGAAG | TTC | chr17 | 42903842 | 42903863 | 42903847 | 42903842 | - |
| SEQ ID NO 63858 | AGAAGGATTTCACATGTTGCCT | CTG | chr17 | 42903825 | 42903846 | 42903830 | 42903825 | - |
| SEQ ID NO 63859 | CACATGTTGCCTCTAGAAGGGA | TTT | chr17 | 42903815 | 42903836 | 42903820 | 42903815 | - |
| SEQ ID NO 63860 | ACATGTTGCCTCTAGAAGGGAG | TTC | chr17 | 42903814 | 42903835 | 42903819 | 42903814 | - |
| SEQ ID NO 63861 | CCTCTAGAAGGGAGAACTGGGT | TTG | chr17 | 42903806 | 42903827 | 42903811 | 42903806 | - |
| SEQ ID NO 63862 | TAGAAGGGAGAACTGGGTGGCT | CTC | chr17 | 42903802 | 42903823 | 42903807 | 42903802 | - |
| SEQ ID NO 63863 | GAAGGGAGAACTGGGTGGCTGG | CTA | chr17 | 42903800 | 42903821 | 42903805 | 42903800 | - |
| SEQ ID NO 63864 | GGTGGCTGGGGAGAAGTGTGAG | CTG | chr17 | 42903787 | 42903808 | 42903792 | 42903787 | - |
| SEQ ID NO 63865 | GGGAGAAGTGTGAGAGGGAGAT | CTG | chr17 | 42903779 | 42903800 | 42903784 | 42903779 | - |
| SEQ ID NO 63866 | CATGACACTTCCTTATGTATGT | TTT | chr17 | 42903753 | 42903774 | 42903758 | 42903753 | - |
| SEQ ID NO 63867 | ATGACACTTCCTTATGTATGTA | TTC | chr17 | 42903752 | 42903773 | 42903757 | 42903752 | - |
| SEQ ID NO 63868 | CCTTATGTATGTAACTTTTGCA | CTT | chr17 | 42903743 | 42903764 | 42903748 | 42903743 | - |
| SEQ ID NO 63869 | CTTATGTATGTAACTTTTGCAT | TTC | chr17 | 42903742 | 42903763 | 42903747 | 42903742 | - |
| SEQ ID NO 63870 | ATGTATGTAACTTTTGCATTTT | CTT | chr17 | 42903739 | 42903760 | 42903744 | 42903739 | - |
| SEQ ID NO 63871 | TGTATGTAACTTTGCATTTTG | TTA | chr17 | 42903738 | 42903759 | 42903743 | 42903738 | - |
| SEQ ID NO 63872 | TTGCATTTTGAACTGTTTGAAT | CTT | chr17 | 42903726 | 42903747 | 42903731 | 42903726 | - |
| SEQ ID NO 63873 | TGCATTTTGAACTGTTTGAATG | TTT | chr17 | 42903725 | 42903746 | 42903730 | 42903725 | - |
| SEQ ID NO 63874 | GCATTTTGAACTGTTTGAATGT | TTT | chr17 | 42903724 | 42903745 | 42903729 | 42903724 | - |
| SEQ ID NO 63875 | CATTTTGAACTGTTTGAATGTA | TTG | chr17 | 42903723 | 42903744 | 42903728 | 42903723 | - |
| SEQ ID NO 63876 | TGAACTGTTTGAATGTATTATC | TTT | chr17 | 42903718 | 42903739 | 42903723 | 42903718 | - |
| SEQ ID NO 63877 | GAACTGTTTGAATGTATTATCT | TTT | chr17 | 42903717 | 42903738 | 42903722 | 42903717 | - |
| SEQ ID NO 63878 | AACTGTTTGAATGTATTATCTT | TTG | chr17 | 42903716 | 42903737 | 42903721 | 42903716 | - |
| SEQ ID NO 63879 | TTTGAATGTATTATCTTTTTTT | CTG | chr17 | 42903711 | 42903732 | 42903716 | 42903711 | - |
| SEQ ID NO 63880 | GAATGTATTATCTTTTTTTTTT | TTT | chr17 | 42903708 | 42903729 | 42903713 | 42903708 | - |
| SEQ ID NO 63881 | AATGTATTATCTTTTTTTTTTT | TTG | chr17 | 42903707 | 42903728 | 42903712 | 42903707 | - |
| SEQ ID NO 63882 | TCTTTTTTTTTTTTGAGACAGG | TTA | chr17 | 42903698 | 42903719 | 42903703 | 42903698 | - |
| SEQ ID NO 63883 | TTTTTTTTTTGAGACAGGATCT | CTT | chr17 | 42903694 | 42903715 | 42903699 | 42903694 | - |
| SEQ ID NO 63884 | TTTTTTTTTGAGACAGGATCTG | TTT | chr17 | 42903693 | 42903714 | 42903698 | 42903693 | - |
| SEQ ID NO 63885 | TTTTTTTTGAGACAGGATCTGG | TTT | chr17 | 42903692 | 42903713 | 42903697 | 42903692 | - |
| SEQ ID NO 63886 | TTTTTTTGAGACAGGATCTGGC | TTT | chr17 | 42903691 | 42903712 | 42903696 | 42903691 | - |
| SEQ ID NO 63887 | TTTTTTGAGACAGGATCTGGCT | TTT | chr17 | 42903690 | 42903711 | 42903695 | 42903690 | - |
| SEQ ID NO 63888 | TTTTTGAGACAGGATCTGGCTC | TTT | chr17 | 42903689 | 42903710 | 42903694 | 42903689 | - |
| SEQ ID NO 63889 | TTTTGAGACAGGATCTGGCTCA | TTT | chr17 | 42903688 | 42903709 | 42903693 | 42903688 | - |
| SEQ ID NO 63890 | TTTGAGACAGGATCTGGCTCAG | TTT | chr17 | 42903687 | 42903708 | 42903692 | 42903687 | - |
| SEQ ID NO 63891 | TTGAGACAGGATCTGGCTCAGT | TTT | chr17 | 42903686 | 42903707 | 42903691 | 42903686 | - |
| SEQ ID NO 63892 | TGAGACAGGATCTGGCTCAGTA | TTT | chr17 | 42903685 | 42903706 | 42903690 | 42903685 | - |
| SEQ ID NO 63893 | GAGACAGGATCTGGCTCAGTAA | TTT | chr17 | 42903684 | 42903705 | 42903689 | 42903684 | - |
| SEQ ID NO 63894 | AGACAGGATCTGGCTCAGTAAC | TTG | chr17 | 42903683 | 42903704 | 42903688 | 42903683 | - |
| SEQ ID NO 63895 | GCTCAGTAACCCAGCCTGGAGT | CTG | chr17 | 42903671 | 42903692 | 42903676 | 42903671 | - |
| SEQ ID NO 63896 | AGTAACCCAGCCTGGAGTGCAG | CTC | chr17 | 42903667 | 42903688 | 42903672 | 42903667 | - |
| SEQ ID NO 63897 | GAGTGCAGTGGCGCAATCTCGG | CTG | chr17 | 42903653 | 42903674 | 42903658 | 42903653 | - |
| SEQ ID NO 63898 | GGCTCATTGTGACCTCTACCTC | CTC | chr17 | 42903633 | 42903654 | 42903638 | 42903633 | - |
| SEQ ID NO 63899 | ATTGTGACCTCTACCTCCTGGG | CTC | chr17 | 42903628 | 42903649 | 42903633 | 42903628 | - |
| SEQ ID NO 63900 | TGACCTCTACCTCCTGGGATCC | TTG | chr17 | 42903624 | 42903645 | 42903629 | 42903624 | - |
| SEQ ID NO 63901 | TACCTCCTGGGATCCTCCCACC | CTC | chr17 | 42903617 | 42903638 | 42903622 | 42903617 | - |
| SEQ ID NO 63902 | CCTCCTGGGATCCTCCCACCTC | CTA | chr17 | 42903615 | 42903636 | 42903620 | 42903615 | - |
| SEQ ID NO 63903 | CTGGGATCCTCCCACCTCAGCC | CTC | chr17 | 42903611 | 42903632 | 42903616 | 42903611 | - |
| SEQ ID NO 63904 | GGATCCTCCCACCTCAGCCTCC | CTG | chr17 | 42903608 | 42903629 | 42903613 | 42903608 | - |
| SEQ ID NO 63905 | CCACCTCAGCCTCCTGAATAGC | CTC | chr17 | 42903600 | 42903621 | 42903605 | 42903600 | - |
| SEQ ID NO 63906 | AGCCTCCTGAATAGCTGGGACT | CTC | chr17 | 42903593 | 42903614 | 42903598 | 42903593 | - |

Figure 90 (Cont'd)

| SEQ ID NO | Sequence | | | | | | | |
|---|---|---|---|---|---|---|---|---|
| SEQ ID NO 63907 | CTGAATAGCTGGGACTACAGGT | CTC | chr17 | 42903587 | 42903608 | 42903592 | 42903587 | - |
| SEQ ID NO 63908 | AATAGCTGGGACTACAGGTGTG | CTG | chr17 | 42903584 | 42903605 | 42903589 | 42903584 | - |
| SEQ ID NO 63909 | GGACTACAGGTGTGTGCCACCA | CTG | chr17 | 42903576 | 42903597 | 42903581 | 42903576 | - |
| SEQ ID NO 63910 | CAGGTGTGTGCCACCACATCCA | CTA | chr17 | 42903570 | 42903591 | 42903575 | 42903570 | - |
| SEQ ID NO 63911 | GTTTTTGTATTTTTAGTAGAGA | CTA | chr17 | 42903544 | 42903565 | 42903549 | 42903544 | - |
| SEQ ID NO 63912 | TTGTATTTTTAGTAGAGACGGG | TTT | chr17 | 42903540 | 42903561 | 42903545 | 42903540 | - |
| SEQ ID NO 63913 | TGTATTTTTAGTAGAGACGGGG | TTT | chr17 | 42903539 | 42903560 | 42903544 | 42903539 | - |
| SEQ ID NO 63914 | GTATTTTTAGTAGAGACGGGGT | TTT | chr17 | 42903538 | 42903559 | 42903543 | 42903538 | - |
| SEQ ID NO 63915 | TATTTTTAGTAGAGACGGGGTT | TTG | chr17 | 42903537 | 42903558 | 42903542 | 42903537 | - |
| SEQ ID NO 63916 | TTAGTAGAGACGGGGTTTCACC | TTT | chr17 | 42903532 | 42903553 | 42903537 | 42903532 | - |
| SEQ ID NO 63917 | TAGTAGAGACGGGGTTTCACCA | TTT | chr17 | 42903531 | 42903552 | 42903536 | 42903531 | - |
| SEQ ID NO 63918 | AGTAGAGACGGGGTTTCACCAT | TTT | chr17 | 42903530 | 42903551 | 42903535 | 42903530 | - |
| SEQ ID NO 63919 | GTAGAGACGGGGTTTCACCATG | TTA | chr17 | 42903529 | 42903550 | 42903534 | 42903529 | - |
| SEQ ID NO 63920 | CACCATGTTGCCCAGGCTGGTC | TTT | chr17 | 42903514 | 42903535 | 42903519 | 42903514 | - |
| SEQ ID NO 63921 | ACCATGTTGCCCAGGCTGGTCT | TTC | chr17 | 42903513 | 42903534 | 42903518 | 42903513 | - |
| SEQ ID NO 63922 | CCCAGGCTGGTCTCCATCTCCT | TTG | chr17 | 42903504 | 42903525 | 42903509 | 42903504 | - |
| SEQ ID NO 63923 | GTCTCCATCTCCTGAACTCAGG | CTG | chr17 | 42903495 | 42903516 | 42903500 | 42903495 | - |
| SEQ ID NO 63924 | CATCTCCTGAACTCAGGCAATC | CTC | chr17 | 42903490 | 42903511 | 42903495 | 42903490 | - |
| SEQ ID NO 63925 | CTGAACTCAGGCAATCCTCCCA | CTC | chr17 | 42903484 | 42903505 | 42903489 | 42903484 | - |
| SEQ ID NO 63926 | AACTCAGGCAATCCTCCCACCT | CTG | chr17 | 42903481 | 42903502 | 42903486 | 42903481 | - |
| SEQ ID NO 63927 | AGGCAATCCTCCCACCTCAGCC | CTC | chr17 | 42903476 | 42903497 | 42903481 | 42903476 | - |
| SEQ ID NO 63928 | CCACCTCAGCCTCCCAAAGTGC | CTC | chr17 | 42903465 | 42903486 | 42903470 | 42903465 | - |
| SEQ ID NO 63929 | AGCCTCCCAAAGTGCTGGGATT | CTC | chr17 | 42903458 | 42903479 | 42903463 | 42903458 | - |
| SEQ ID NO 63930 | CCAAAGTGCTGGGATTACAGGC | CTC | chr17 | 42903452 | 42903473 | 42903457 | 42903452 | - |
| SEQ ID NO 63931 | GGATTACAGGCATGAGCCACCG | CTG | chr17 | 42903441 | 42903462 | 42903446 | 42903441 | - |
| SEQ ID NO 63932 | CAGGCATGAGCCACCGTGCCTG | TTA | chr17 | 42903435 | 42903456 | 42903440 | 42903435 | - |
| SEQ ID NO 63933 | ACTGTATGATCTATTTAAACAC | CTG | chr17 | 42903413 | 42903434 | 42903418 | 42903413 | - |
| SEQ ID NO 63934 | TATGATCTATTTAAACACAAAT | CTG | chr17 | 42903409 | 42903430 | 42903414 | 42903409 | - |
| SEQ ID NO 63935 | TTTAAACACAAATAATGAAGCC | CTA | chr17 | 42903400 | 42903421 | 42903405 | 42903400 | - |
| SEQ ID NO 63936 | AAAACACAAATAATGAAGCCCAA | TTT | chr17 | 42903397 | 42903418 | 42903402 | 42903397 | - |
| SEQ ID NO 63937 | AACACAAATAATGAAGCCCAAG | TTA | chr17 | 42903396 | 42903417 | 42903401 | 42903396 | - |
| SEQ ID NO 63938 | TGAACTCCAGGCAGGCGCGGTG | TTC | chr17 | 42903370 | 42903391 | 42903375 | 42903370 | - |
| SEQ ID NO 63939 | AACTCCAGGCAGGCGCGGTGGC | CTG | chr17 | 42903368 | 42903389 | 42903373 | 42903368 | - |
| SEQ ID NO 63940 | CAGGCAGGCGCGGTGGCTCACA | CTC | chr17 | 42903363 | 42903384 | 42903368 | 42903363 | - |
| SEQ ID NO 63941 | ACACCTGTAATCTCAGCACTTT | CTC | chr17 | 42903344 | 42903365 | 42903349 | 42903344 | - |
| SEQ ID NO 63942 | TAATCTCAGCACTTTGGGAGGC | CTG | chr17 | 42903337 | 42903358 | 42903342 | 42903337 | - |
| SEQ ID NO 63943 | AGCACTTTGGGAGGCCAAGGCA | CTC | chr17 | 42903330 | 42903351 | 42903335 | 42903330 | - |
| SEQ ID NO 63944 | TGGGAGGCCAAGGCAGGCAGAT | CTT | chr17 | 42903323 | 42903344 | 42903328 | 42903323 | - |
| SEQ ID NO 63945 | GGGAGGCCAAGGCAGGCAGATC | TTT | chr17 | 42903322 | 42903343 | 42903327 | 42903322 | - |
| SEQ ID NO 63946 | GGAGGCCAAGGCAGGCAGATCA | TTG | chr17 | 42903321 | 42903342 | 42903326 | 42903321 | - |
| SEQ ID NO 63947 | GAGACCAGCCTGGCCAACATGG | TTT | chr17 | 42903282 | 42903303 | 42903287 | 42903282 | - |
| SEQ ID NO 63948 | AGACCAGCCTGGCCAACATGGT | TTG | chr17 | 42903281 | 42903302 | 42903286 | 42903281 | - |
| SEQ ID NO 63949 | GCCAACATGGTGAAACACCGTT | CTG | chr17 | 42903270 | 42903291 | 42903275 | 42903270 | - |
| SEQ ID NO 63950 | CTACCAAAAAATATAAAGAATT | TTT | chr17 | 42903247 | 42903268 | 42903252 | 42903247 | - |
| SEQ ID NO 63951 | TACCAAAAAATATAAAGAATTA | TTC | chr17 | 42903246 | 42903267 | 42903251 | 42903246 | - |
| SEQ ID NO 63952 | CCAAAAAATATAAAGAATTAGC | CTA | chr17 | 42903244 | 42903265 | 42903249 | 42903244 | - |
| SEQ ID NO 63953 | GCCAGATGTGGTGGTGCGTGAC | TTA | chr17 | 42903224 | 42903245 | 42903229 | 42903224 | - |
| SEQ ID NO 63954 | TAATCCCAGCTACTCGGGAGGC | CTG | chr17 | 42903200 | 42903221 | 42903205 | 42903200 | - |
| SEQ ID NO 63955 | CTCGGGAGGCTAAGGCAAGAGA | CTA | chr17 | 42903188 | 42903209 | 42903193 | 42903188 | - |
| SEQ ID NO 63956 | GGGAGGCTAAGGCAAGAGAATC | CTC | chr17 | 42903185 | 42903206 | 42903190 | 42903185 | - |
| SEQ ID NO 63957 | AGGCAAGAGAATCGCTTGAACC | CTA | chr17 | 42903176 | 42903197 | 42903181 | 42903176 | - |
| SEQ ID NO 63958 | GAACCTGGGAGGCGGAGGTTGC | CTT | chr17 | 42903159 | 42903180 | 42903164 | 42903159 | - |
| SEQ ID NO 63959 | AACCTGGGAGGCGGAGGTTGCC | TTG | chr17 | 42903158 | 42903179 | 42903163 | 42903158 | - |
| SEQ ID NO 63960 | GGAGGCGGAGGTTGCCGTGAGC | CTG | chr17 | 42903152 | 42903173 | 42903157 | 42903152 | - |
| SEQ ID NO 63961 | CCGTGAGCCGAGATTATGCCAC | TTG | chr17 | 42903138 | 42903159 | 42903143 | 42903138 | - |
| SEQ ID NO 63962 | TGCCACTGCACTACAGGCTGGG | TTA | chr17 | 42903122 | 42903143 | 42903127 | 42903122 | - |
| SEQ ID NO 63963 | CACTACAGGCTGGGTGACAGAG | CTG | chr17 | 42903114 | 42903135 | 42903119 | 42903114 | - |
| SEQ ID NO 63964 | CAGGCTGGGTGACAGAGCAAGA | CTA | chr17 | 42903109 | 42903130 | 42903114 | 42903109 | - |

Figure 90 (Cont'd)

| SEQ ID NO 63965 | GGTGACAGAGCAAGACTCCATC | CTG | chr17 | 42903102 | 42903123 | 42903107 | 42903102 | - |
|---|---|---|---|---|---|---|---|---|
| SEQ ID NO 63966 | CATCTCAAAAAAAAAAAAAAAA | CTC | chr17 | 42903084 | 42903105 | 42903089 | 42903084 | - |
| SEQ ID NO 63967 | AAAAAAAAAAAAAAAAAAATCC | CTC | chr17 | 42903078 | 42903099 | 42903083 | 42903078 | - |
| SEQ ID NO 63968 | AAATCCATAAAATGGCAGCTAT | CTG | chr17 | 42903054 | 42903075 | 42903059 | 42903054 | - |
| SEQ ID NO 63969 | TGTGACTTTTTTTTTTTAACCT | CTA | chr17 | 42903033 | 42903054 | 42903038 | 42903033 | - |
| SEQ ID NO 63970 | TTTTTTTTTAACCTCAAGAAGT | CTT | chr17 | 42903025 | 42903046 | 42903030 | 42903025 | - |
| SEQ ID NO 63971 | TTTTTTTTAACCTCAAGAAGTA | TTT | chr17 | 42903024 | 42903045 | 42903029 | 42903024 | - |
| SEQ ID NO 63972 | TTTTTTTAACCTCAAGAAGTAT | TTT | chr17 | 42903023 | 42903044 | 42903028 | 42903023 | - |
| SEQ ID NO 63973 | TTTTTTAACCTCAAGAAGTATT | TTT | chr17 | 42903022 | 42903043 | 42903027 | 42903022 | - |
| SEQ ID NO 63974 | TTTTTAACCTCAAGAAGTATTT | TTT | chr17 | 42903021 | 42903042 | 42903026 | 42903021 | - |
| SEQ ID NO 63975 | TTTTAACCTCAAGAAGTATTTG | TTT | chr17 | 42903020 | 42903041 | 42903025 | 42903020 | - |
| SEQ ID NO 63976 | TTTAACCTCAAGAAGTATTTGT | TTT | chr17 | 42903019 | 42903040 | 42903024 | 42903019 | - |
| SEQ ID NO 63977 | TTAACCTCAAGAAGTATTTGTC | TTT | chr17 | 42903018 | 42903039 | 42903023 | 42903018 | - |
| SEQ ID NO 63978 | TAACCTCAAGAAGTATTTGTCC | TTT | chr17 | 42903017 | 42903038 | 42903022 | 42903017 | - |
| SEQ ID NO 63979 | AACCTCAAGAAGTATTTGTCCT | TTT | chr17 | 42903016 | 42903037 | 42903021 | 42903016 | - |
| SEQ ID NO 63980 | ACCTCAAGAAGTATTTGTCCTG | TTA | chr17 | 42903015 | 42903036 | 42903020 | 42903015 | - |
| SEQ ID NO 63981 | AAGAAGTATTTGTCCTGGAAGA | CTC | chr17 | 42903010 | 42903031 | 42903015 | 42903010 | - |
| SEQ ID NO 63982 | GTCCTGGAAGAATGCATATGGA | TTT | chr17 | 42902999 | 42903020 | 42903004 | 42902999 | - |
| SEQ ID NO 63983 | TCCTGGAAGAATGCATATGGAA | TTG | chr17 | 42902998 | 42903019 | 42903003 | 42902998 | - |
| SEQ ID NO 63984 | GAAGAATGCATATGGAACTACA | CTG | chr17 | 42902993 | 42903014 | 42902998 | 42902993 | - |
| SEQ ID NO 63985 | CAGTTTGAAACTTGGACTTGCA | CTA | chr17 | 42902973 | 42902994 | 42902978 | 42902973 | - |
| SEQ ID NO 63986 | GAAACTTGGACTTGCATATACC | TTT | chr17 | 42902967 | 42902988 | 42902972 | 42902967 | - |
| SEQ ID NO 63987 | AAACTTGGACTTGCATATACCA | TTG | chr17 | 42902966 | 42902987 | 42902971 | 42902966 | - |
| SEQ ID NO 63988 | GGACTTGCATATACCATGGGTT | CTT | chr17 | 42902960 | 42902981 | 42902965 | 42902960 | - |
| SEQ ID NO 63989 | GACTTGCATATACCATGGGTTC | TTG | chr17 | 42902959 | 42902980 | 42902964 | 42902959 | - |
| SEQ ID NO 63990 | GCATATACCATGGGTTCCCTCA | CTT | chr17 | 42902954 | 42902975 | 42902959 | 42902954 | - |
| SEQ ID NO 63991 | CATATACCATGGGTTCCCTCAG | TTG | chr17 | 42902953 | 42902974 | 42902958 | 42902953 | - |
| SEQ ID NO 63992 | CCTCAGGCCTCAGGGAATCTTG | TTC | chr17 | 42902937 | 42902958 | 42902942 | 42902937 | - |
| SEQ ID NO 63993 | AGGCCTCAGGGAATCTTGCATT | CTC | chr17 | 42902933 | 42902954 | 42902938 | 42902933 | - |
| SEQ ID NO 63994 | AGGGAATCTTGCATTTCCTCTG | CTC | chr17 | 42902926 | 42902947 | 42902931 | 42902926 | - |
| SEQ ID NO 63995 | GCATTTCCTCTGACATCAGAGA | CTT | chr17 | 42902916 | 42902937 | 42902921 | 42902916 | - |
| SEQ ID NO 63996 | CATTTCCTCTGACATCAGAGAA | TTG | chr17 | 42902915 | 42902936 | 42902920 | 42902915 | - |
| SEQ ID NO 63997 | CCTCTGACATCAGAGAATGCAC | TTT | chr17 | 42902910 | 42902931 | 42902915 | 42902910 | - |
| SEQ ID NO 63998 | CTCTGACATCAGAGAATGCACT | TTC | chr17 | 42902909 | 42902930 | 42902914 | 42902909 | - |
| SEQ ID NO 63999 | TGACATCAGAGAATGCACTCCA | CTC | chr17 | 42902906 | 42902927 | 42902911 | 42902906 | - |
| SEQ ID NO 64000 | ACATCAGAGAATGCACTCCAGC | CTG | chr17 | 42902904 | 42902925 | 42902909 | 42902904 | - |
| SEQ ID NO 64001 | CAGCCCCTAGGACGAGCCCCCC | CTC | chr17 | 42902886 | 42902907 | 42902891 | 42902886 | - |
| SEQ ID NO 64002 | GGACGAGCCCCCCCAGGGAAA | CTA | chr17 | 42902877 | 42902898 | 42902882 | 42902877 | - |
| SEQ ID NO 64003 | CATTTCCATCAGAATTGCTCTC | CTG | chr17 | 42902846 | 42902867 | 42902851 | 42902846 | - |
| SEQ ID NO 64004 | CCATCAGAATTGCTCTCTGTAA | TTT | chr17 | 42902841 | 42902862 | 42902846 | 42902841 | - |
| SEQ ID NO 64005 | CATCAGAATTGCTCTCTGTAAG | TTC | chr17 | 42902840 | 42902861 | 42902845 | 42902840 | - |
| SEQ ID NO 64006 | CTCTCTGTAAGGATGTATATAG | TTG | chr17 | 42902829 | 42902850 | 42902834 | 42902829 | - |
| SEQ ID NO 64007 | TCTGTAAGGATGTATATAGCTT | CTC | chr17 | 42902826 | 42902847 | 42902831 | 42902826 | - |
| SEQ ID NO 64008 | TGTAAGGATGTATATAGCTTCA | CTC | chr17 | 42902824 | 42902845 | 42902829 | 42902824 | - |
| SEQ ID NO 64009 | TAAGGATGTATATAGCTTCAGA | CTG | chr17 | 42902822 | 42902843 | 42902827 | 42902822 | - |
| SEQ ID NO 64010 | CAGATGCTTGTTCTGTATCCTC | CTT | chr17 | 42902804 | 42902825 | 42902809 | 42902804 | - |
| SEQ ID NO 64011 | AGATGCTTGTTCTGTATCCTCT | TTC | chr17 | 42902803 | 42902824 | 42902808 | 42902803 | - |
| SEQ ID NO 64012 | GTTCTGTATCCTCTCTACTTTG | CTT | chr17 | 42902795 | 42902816 | 42902800 | 42902795 | - |
| SEQ ID NO 64013 | TTCTGTATCCTCTCTACTTTGA | TTG | chr17 | 42902794 | 42902815 | 42902799 | 42902794 | - |
| SEQ ID NO 64014 | TGTATCCTCTCTACTTTGAAAC | TTC | chr17 | 42902791 | 42902812 | 42902796 | 42902791 | - |
| SEQ ID NO 64015 | TATCCTCTCTACTTTGAAACAG | CTG | chr17 | 42902789 | 42902810 | 42902794 | 42902789 | - |
| SEQ ID NO 64016 | TCTACTTTGAAACAGAGTATCT | CTC | chr17 | 42902782 | 42902803 | 42902787 | 42902782 | - |
| SEQ ID NO 64017 | TACTTTGAAACAGAGTATCTCA | CTC | chr17 | 42902780 | 42902801 | 42902785 | 42902780 | - |
| SEQ ID NO 64018 | CTTTGAAACAGAGTATCTCAGA | CTA | chr17 | 42902778 | 42902799 | 42902783 | 42902778 | - |
| SEQ ID NO 64019 | TGAAACAGAGTATCTCAGACAA | CTT | chr17 | 42902775 | 42902796 | 42902780 | 42902775 | - |
| SEQ ID NO 64020 | GAAACAGAGTATCTCAGACAAA | TTT | chr17 | 42902774 | 42902795 | 42902779 | 42902774 | - |
| SEQ ID NO 64021 | AAACAGAGTATCTCAGACAAAC | TTG | chr17 | 42902773 | 42902794 | 42902778 | 42902773 | - |
| SEQ ID NO 64022 | AGACAAACCACTTCCCCTTTAA | CTC | chr17 | 42902759 | 42902780 | 42902764 | 42902759 | - |

Figure 90 (Cont'd)

| SEQ ID NO 64023 | CCCCTTTAAAAGTACTAGATAT | CTT | chr17 | 42902746 | 42902767 | 42902751 | 42902746 | - |
|---|---|---|---|---|---|---|---|---|
| SEQ ID NO 64024 | CCCTTTAAAAGTACTAGATATA | TTC | chr17 | 42902745 | 42902766 | 42902750 | 42902745 | - |
| SEQ ID NO 64025 | TAAAAGTACTAGATATATCTTT | CTT | chr17 | 42902740 | 42902761 | 42902745 | 42902740 | - |
| SEQ ID NO 64026 | AAAAGTACTAGATATATCTTTC | TTT | chr17 | 42902739 | 42902760 | 42902744 | 42902739 | - |
| SEQ ID NO 64027 | AAAGTACTAGATATATCTTTCA | TTA | chr17 | 42902738 | 42902759 | 42902743 | 42902738 | - |
| SEQ ID NO 64028 | GATATATCTTTCACTGTGGAAA | CTA | chr17 | 42902729 | 42902750 | 42902734 | 42902729 | - |
| SEQ ID NO 64029 | TCACTGTGGAAATAGGTGTCAA | CTT | chr17 | 42902719 | 42902740 | 42902724 | 42902719 | - |
| SEQ ID NO 64030 | CACTGTGGAAATAGGTGTCAAC | TTT | chr17 | 42902718 | 42902739 | 42902723 | 42902718 | - |
| SEQ ID NO 64031 | ACTGTGGAAATAGGTGTCAACC | TTC | chr17 | 42902717 | 42902738 | 42902722 | 42902717 | - |
| SEQ ID NO 64032 | TGGAAATAGGTGTCAACCGCCA | CTG | chr17 | 42902713 | 42902734 | 42902718 | 42902713 | - |
| SEQ ID NO 64033 | TTATCCCGTGATGGTGGAATAG | CTT | chr17 | 42902678 | 42902699 | 42902683 | 42902678 | - |
| SEQ ID NO 64034 | TATCCCGTGATGGTGGAATAGT | TTT | chr17 | 42902677 | 42902698 | 42902682 | 42902677 | - |
| SEQ ID NO 64035 | ATCCCGTGATGGTGGAATAGTG | TTT | chr17 | 42902676 | 42902697 | 42902681 | 42902676 | - |
| SEQ ID NO 64036 | TCCCGTGATGGTGGAATAGTGA | TTA | chr17 | 42902675 | 42902696 | 42902680 | 42902675 | - |
| SEQ ID NO 64037 | CTCACCGAAATCAGGGAGAGCC | TTT | chr17 | 42902650 | 42902671 | 42902655 | 42902650 | - |
| SEQ ID NO 64038 | TCACCGAAATCAGGGAGAGCCA | TTC | chr17 | 42902649 | 42902670 | 42902654 | 42902649 | - |
| SEQ ID NO 64039 | ACCGAAATCAGGGAGAGCCACT | CTC | chr17 | 42902647 | 42902668 | 42902652 | 42902647 | - |
| SEQ ID NO 64040 | ACTCTGGCCTCTATCAACCCAG | CTA | chr17 | 42902624 | 42902645 | 42902629 | 42902624 | - |
| SEQ ID NO 64041 | TGGCCTCTATCAACCCAGAGAG | CTC | chr17 | 42902620 | 42902641 | 42902625 | 42902620 | - |
| SEQ ID NO 64042 | GCCTCTATCAACCCAGAGAGAT | CTG | chr17 | 42902618 | 42902639 | 42902623 | 42902618 | - |
| SEQ ID NO 64043 | TATCAACCCAGAGAGATTGCAT | CTC | chr17 | 42902613 | 42902634 | 42902618 | 42902613 | - |
| SEQ ID NO 64044 | TCAACCCAGAGAGATTGCATGG | CTA | chr17 | 42902611 | 42902632 | 42902616 | 42902611 | - |
| SEQ ID NO 64045 | CATGGTTCTTCAATGGAGATCA | TTG | chr17 | 42902594 | 42902615 | 42902599 | 42902594 | - |
| SEQ ID NO 64046 | TTCAATGGAGATCAGATGTTTG | TTC | chr17 | 42902586 | 42902607 | 42902591 | 42902586 | - |
| SEQ ID NO 64047 | CAATGGAGATCAGATGTTTGGA | CTT | chr17 | 42902584 | 42902605 | 42902589 | 42902584 | - |
| SEQ ID NO 64048 | AATGGAGATCAGATGTTTGGAA | TTC | chr17 | 42902583 | 42902604 | 42902588 | 42902583 | - |
| SEQ ID NO 64049 | GGAATAACACTTCATCTTTTTA | TTT | chr17 | 42902565 | 42902586 | 42902570 | 42902565 | - |
| SEQ ID NO 64050 | GAATAACACTTCATCTTTTTAT | TTG | chr17 | 42902564 | 42902585 | 42902569 | 42902564 | - |
| SEQ ID NO 64051 | CATCTTTTTATTTTTTAGAATC | CTT | chr17 | 42902553 | 42902574 | 42902558 | 42902553 | - |
| SEQ ID NO 64052 | ATCTTTTTATTTTTTAGAATCA | TTC | chr17 | 42902552 | 42902573 | 42902557 | 42902552 | - |
| SEQ ID NO 64053 | TTTATTTTTTAGAATCATGCGG | CTT | chr17 | 42902547 | 42902568 | 42902552 | 42902547 | - |
| SEQ ID NO 64054 | TTATTTTTTAGAATCATGCGGC | TTT | chr17 | 42902546 | 42902567 | 42902551 | 42902546 | - |
| SEQ ID NO 64055 | TATTTTTTAGAATCATGCGGCT | TTT | chr17 | 42902545 | 42902566 | 42902550 | 42902545 | - |
| SEQ ID NO 64056 | ATTTTTTAGAATCATGCGGCTG | TTT | chr17 | 42902544 | 42902565 | 42902549 | 42902544 | - |
| SEQ ID NO 64057 | TTTTTTAGAATCATGCGGCTGG | TTA | chr17 | 42902543 | 42902564 | 42902548 | 42902543 | - |
| SEQ ID NO 64058 | TTTAGAATCATGCGGCTGGGTG | TTT | chr17 | 42902540 | 42902561 | 42902545 | 42902540 | - |
| SEQ ID NO 64059 | TTAGAATCATGCGGCTGGGTGT | TTT | chr17 | 42902539 | 42902560 | 42902544 | 42902539 | - |
| SEQ ID NO 64060 | TAGAATCATGCGGCTGGGTGTA | TTT | chr17 | 42902538 | 42902559 | 42902543 | 42902538 | - |
| SEQ ID NO 64061 | AGAATCATGCGGCTGGGTGTAG | TTT | chr17 | 42902537 | 42902558 | 42902542 | 42902537 | - |
| SEQ ID NO 64062 | GAATCATGCGGCTGGGTGTAGT | TTA | chr17 | 42902536 | 42902557 | 42902541 | 42902536 | - |
| SEQ ID NO 64063 | GGTGTAGTGGCTCACGCCTGTA | CTG | chr17 | 42902522 | 42902543 | 42902527 | 42902522 | - |
| SEQ ID NO 64064 | ACGCCTGTAATCCTAGCACTTA | CTC | chr17 | 42902509 | 42902530 | 42902514 | 42902509 | - |
| SEQ ID NO 64065 | TAATCCTAGCACTTAGGGAGGC | CTG | chr17 | 42902502 | 42902523 | 42902507 | 42902502 | - |
| SEQ ID NO 64066 | GCACTTAGGGAGGCCAAGGCAG | CTA | chr17 | 42902494 | 42902515 | 42902499 | 42902494 | - |
| SEQ ID NO 64067 | AGGGAGGCCAAGGCAGGCAGAT | CTT | chr17 | 42902488 | 42902509 | 42902493 | 42902488 | - |
| SEQ ID NO 64068 | GGGAGGCCAAGGCAGGCAGATC | TTA | chr17 | 42902487 | 42902508 | 42902492 | 42902487 | - |
| SEQ ID NO 64069 | GAGACCAGCCTAGTCAACATAG | TTC | chr17 | 42902449 | 42902470 | 42902454 | 42902449 | - |
| SEQ ID NO 64070 | GTCAACATAGTGAAACCATGTC | CTA | chr17 | 42902437 | 42902458 | 42902442 | 42902437 | - |
| SEQ ID NO 64071 | TACTAAAAATACAAAAAAAATT | CTC | chr17 | 42902413 | 42902434 | 42902418 | 42902413 | - |
| SEQ ID NO 64072 | CTAAAAATACAAAAAAAATTAG | CTA | chr17 | 42902411 | 42902432 | 42902416 | 42902411 | - |
| SEQ ID NO 64073 | AAAATACAAAAAAAATTAGCTG | CTA | chr17 | 42902408 | 42902429 | 42902413 | 42902408 | - |
| SEQ ID NO 64074 | GCTGGGCATGGTGGCGGGCACC | TTA | chr17 | 42902390 | 42902411 | 42902395 | 42902390 | - |
| SEQ ID NO 64075 | GGCATGGTGGCGGGCACCTGTA | CTG | chr17 | 42902386 | 42902407 | 42902391 | 42902386 | - |
| SEQ ID NO 64076 | TAATCCCAGCTACTTGGGAGGC | CTG | chr17 | 42902366 | 42902387 | 42902371 | 42902366 | - |
| SEQ ID NO 64077 | CTTGGGAGGCTGAGGCAGGAGA | CTA | chr17 | 42902354 | 42902375 | 42902359 | 42902354 | - |
| SEQ ID NO 64078 | GGGAGGCTGAGGCAGGAGAATC | CTT | chr17 | 42902351 | 42902372 | 42902356 | 42902351 | - |
| SEQ ID NO 64079 | GGAGGCTGAGGCAGGAGAATCA | TTG | chr17 | 42902350 | 42902371 | 42902355 | 42902350 | - |
| SEQ ID NO 64080 | AGGCAGGAGAATCACTTGAACC | CTG | chr17 | 42902342 | 42902363 | 42902347 | 42902342 | - |

Figure 90 (Cont'd)

| | | | | | | | | |
|---|---|---|---|---|---|---|---|---|
| SEQ ID NO 64081 | GAACCGGAGAGGCAGAGGTTGC | CTT | chr17 | 42902325 | 42902346 | 42902330 | 42902325 | - |
| SEQ ID NO 64082 | AACCGGAGAGGCAGAGGTTGCA | TTG | chr17 | 42902324 | 42902345 | 42902329 | 42902324 | - |
| SEQ ID NO 64083 | CAGTGAGCTGAGATTGCACCAT | TTG | chr17 | 42902304 | 42902325 | 42902309 | 42902304 | - |
| SEQ ID NO 64084 | AGATTGCACCATTGCACTCCAG | CTG | chr17 | 42902294 | 42902315 | 42902299 | 42902294 | - |
| SEQ ID NO 64085 | CACCATTGCACTCCAGCCAGGC | TTG | chr17 | 42902288 | 42902309 | 42902293 | 42902288 | - |
| SEQ ID NO 64086 | CACTCCAGCCAGGCAACAGTGC | TTG | chr17 | 42902280 | 42902301 | 42902285 | 42902280 | - |
| SEQ ID NO 64087 | CAGCCAGGCAACAGTGCGAGAC | CTC | chr17 | 42902275 | 42902296 | 42902280 | 42902275 | - |
| SEQ ID NO 64088 | CATCTCAAACAAACAAACAAAA | CTC | chr17 | 42902251 | 42902272 | 42902256 | 42902251 | - |
| SEQ ID NO 64089 | AAACAAACAAACAAAAGAAAGA | CTC | chr17 | 42902245 | 42902266 | 42902250 | 42902245 | - |
| SEQ ID NO 64090 | ACGTGATAGAAATTGGCAAATG | TTT | chr17 | 42902192 | 42902213 | 42902197 | 42902192 | - |
| SEQ ID NO 64091 | CGTGATAGAAATTGGCAAATGC | TTA | chr17 | 42902191 | 42902212 | 42902196 | 42902191 | - |
| SEQ ID NO 64092 | GCAAATGCTAAACTCAGGGCTT | TTG | chr17 | 42902177 | 42902198 | 42902182 | 42902177 | - |
| SEQ ID NO 64093 | AACTCAGGGCTTTCCCCTGCTC | CTA | chr17 | 42902167 | 42902188 | 42902172 | 42902167 | - |
| SEQ ID NO 64094 | AGGGCTTTCCCCTGCTCCCCAG | CTC | chr17 | 42902162 | 42902183 | 42902167 | 42902162 | - |
| SEQ ID NO 64095 | TCCCCTGCTCCCCAGAGAGTCA | CTT | chr17 | 42902155 | 42902176 | 42902160 | 42902155 | - |
| SEQ ID NO 64096 | CCCCTGCTCCCCAGAGAGTCAG | TTT | chr17 | 42902154 | 42902175 | 42902159 | 42902154 | - |
| SEQ ID NO 64097 | CCCTGCTCCCCAGAGAGTCAGT | TTC | chr17 | 42902153 | 42902174 | 42902158 | 42902153 | - |
| SEQ ID NO 64098 | CTCCCCAGAGAGTCAGTTTATC | CTG | chr17 | 42902148 | 42902169 | 42902153 | 42902148 | - |
| SEQ ID NO 64099 | CCCAGAGAGTCAGTTTATCAGC | CTC | chr17 | 42902145 | 42902166 | 42902150 | 42902145 | - |
| SEQ ID NO 64100 | ATCAGCACTGGACGTAACATAG | TTT | chr17 | 42902129 | 42902150 | 42902134 | 42902129 | - |
| SEQ ID NO 64101 | TCAGCACTGGACGTAACATAGT | TTA | chr17 | 42902128 | 42902149 | 42902133 | 42902128 | - |
| SEQ ID NO 64102 | GACGTAACATAGTTCATAAGAG | CTG | chr17 | 42902119 | 42902140 | 42902124 | 42902119 | - |
| SEQ ID NO 64103 | ATAAGAGCATTGCCGCGGAAGC | TTC | chr17 | 42902104 | 42902125 | 42902109 | 42902104 | - |
| SEQ ID NO 64104 | CCGCGGAAGCCAGCCTGCCTAC | TTG | chr17 | 42902092 | 42902113 | 42902097 | 42902092 | - |
| SEQ ID NO 64105 | CCTACCTGGGCTTCCATCCTGG | CTG | chr17 | 42902075 | 42902096 | 42902080 | 42902075 | - |
| SEQ ID NO 64106 | CCTGGGCTTCCATCCTGGCTCG | CTA | chr17 | 42902071 | 42902092 | 42902076 | 42902071 | - |
| SEQ ID NO 64107 | GGCTTCCATCCTGGCTCGGCAT | CTG | chr17 | 42902067 | 42902088 | 42902072 | 42902067 | - |
| SEQ ID NO 64108 | CCATCCTGGCTCGGCATGTACT | CTT | chr17 | 42902062 | 42902083 | 42902067 | 42902062 | - |
| SEQ ID NO 64109 | CATCCTGGCTCGGCATGTACTA | TTC | chr17 | 42902061 | 42902082 | 42902066 | 42902061 | - |
| SEQ ID NO 64110 | GCTCGGCATGTACTAACCTTGT | CTG | chr17 | 42902054 | 42902075 | 42902059 | 42902054 | - |
| SEQ ID NO 64111 | GGCATGTACTAACCTTGTTGGC | CTC | chr17 | 42902050 | 42902071 | 42902055 | 42902050 | - |
| SEQ ID NO 64112 | ACCTTGTTGGCCTAATCATTTA | CTA | chr17 | 42902039 | 42902060 | 42902044 | 42902039 | - |
| SEQ ID NO 64113 | GTTGGCCTAATCATTTAACTCA | CTT | chr17 | 42902034 | 42902055 | 42902039 | 42902034 | - |
| SEQ ID NO 64114 | TTGGCCTAATCATTTAACTCAG | TTG | chr17 | 42902033 | 42902054 | 42902038 | 42902033 | - |
| SEQ ID NO 64115 | GCCTAATCATTTAACTCAGCAC | TTG | chr17 | 42902030 | 42902051 | 42902035 | 42902030 | - |
| SEQ ID NO 64116 | ATCATTTAACTCAGCACCTTGG | CTA | chr17 | 42902025 | 42902046 | 42902030 | 42902025 | - |
| SEQ ID NO 64117 | AACTCAGCACCTTGGTCTCTGC | TTT | chr17 | 42902018 | 42902039 | 42902023 | 42902018 | - |
| SEQ ID NO 64118 | ACTCAGCACCTTGGTCTCTGCA | TTA | chr17 | 42902017 | 42902038 | 42902022 | 42902017 | - |
| SEQ ID NO 64119 | AGCACCTTGGTCTCTGCATCTA | CTC | chr17 | 42902013 | 42902034 | 42902018 | 42902013 | - |
| SEQ ID NO 64120 | GGTCTCTGCATCTACTGTTTCT | CTT | chr17 | 42902005 | 42902026 | 42902010 | 42902005 | - |
| SEQ ID NO 64121 | GTCTCTGCATCTACTGTTTCTG | TTG | chr17 | 42902004 | 42902025 | 42902009 | 42902004 | - |
| SEQ ID NO 64122 | TGCATCTACTGTTTCTGTAAAT | CTC | chr17 | 42901999 | 42902020 | 42902004 | 42901999 | - |
| SEQ ID NO 64123 | CATCTACTGTTTCTGTAAATAG | CTG | chr17 | 42901997 | 42902018 | 42902002 | 42901997 | - |
| SEQ ID NO 64124 | CTGTTTCTGTAAATAGCAGTAA | CTA | chr17 | 42901991 | 42902012 | 42901996 | 42901991 | - |
| SEQ ID NO 64125 | TTTCTGTAAATAGCAGTAACTA | CTG | chr17 | 42901988 | 42902009 | 42901993 | 42901988 | - |
| SEQ ID NO 64126 | CTGTAAATAGCAGTAACTACCT | TTT | chr17 | 42901985 | 42902006 | 42901990 | 42901985 | - |
| SEQ ID NO 64127 | TGTAAATAGCAGTAACTACCTC | TTC | chr17 | 42901984 | 42902005 | 42901989 | 42901984 | - |
| SEQ ID NO 64128 | TAAATAGCAGTAACTACCTCAC | CTG | chr17 | 42901982 | 42902003 | 42901987 | 42901982 | - |
| SEQ ID NO 64129 | CCTCACAGAAAAGCACATAGCA | CTA | chr17 | 42901966 | 42901987 | 42901971 | 42901966 | - |
| SEQ ID NO 64130 | ACAGAAAAGCACATAGCACATG | CTC | chr17 | 42901962 | 42901983 | 42901967 | 42901962 | - |
| SEQ ID NO 64131 | GCACACACTGTTTAATAAATGT | CTG | chr17 | 42901935 | 42901956 | 42901940 | 42901935 | - |
| SEQ ID NO 64132 | TTTAATAAATGTTAACCCTGAT | CTG | chr17 | 42901925 | 42901946 | 42901930 | 42901925 | - |
| SEQ ID NO 64133 | AATAAATGTTAACCCTGATTAT | TTT | chr17 | 42901922 | 42901943 | 42901927 | 42901922 | - |
| SEQ ID NO 64134 | ATAAATGTTAACCCTGATTATT | TTA | chr17 | 42901921 | 42901942 | 42901926 | 42901921 | - |
| SEQ ID NO 64135 | ACCCTGATTATTATTAAGCTGC | TTA | chr17 | 42901911 | 42901932 | 42901916 | 42901911 | - |
| SEQ ID NO 64136 | ATTATTATTAAGCTGCCAGAGA | CTG | chr17 | 42901905 | 42901926 | 42901910 | 42901905 | - |
| SEQ ID NO 64137 | TTATTAAGCTGCCAGAGATAAC | TTA | chr17 | 42901901 | 42901922 | 42901906 | 42901901 | - |
| SEQ ID NO 64138 | TTAAGCTGCCAGAGATAACCTA | TTA | chr17 | 42901898 | 42901919 | 42901903 | 42901898 | - |

Figure 90 (Cont'd)

| | | | | | | | | |
|---|---|---|---|---|---|---|---|---|
| SEQ ID NO 64139 | AGCTGCCAGAGATAACCTATTT | TTA | chr17 | 42901895 | 42901916 | 42901900 | 42901895 | - |
| SEQ ID NO 64140 | CCAGAGATAACCTATTTGTAGA | CTG | chr17 | 42901890 | 42901911 | 42901895 | 42901890 | - |
| SEQ ID NO 64141 | TTTGTAGATTATAAAACAGAAA | CTA | chr17 | 42901876 | 42901897 | 42901881 | 42901876 | - |
| SEQ ID NO 64142 | GTAGATTATAAAACAGAAACTC | TTT | chr17 | 42901873 | 42901894 | 42901878 | 42901873 | - |
| SEQ ID NO 64143 | TAGATTATAAAACAGAAACTCA | TTG | chr17 | 42901872 | 42901893 | 42901877 | 42901872 | - |
| SEQ ID NO 64144 | TAAAACAGAAACTCAGATAATT | TTA | chr17 | 42901865 | 42901886 | 42901870 | 42901865 | - |
| SEQ ID NO 64145 | AGATAATTGATATGACTTGCCA | CTC | chr17 | 42901851 | 42901872 | 42901856 | 42901851 | - |
| SEQ ID NO 64146 | ATATGACTTGCCAAGGACATGT | TTG | chr17 | 42901842 | 42901863 | 42901847 | 42901842 | - |
| SEQ ID NO 64147 | GCCAAGGACATGTAGTTGGTGG | CTT | chr17 | 42901833 | 42901854 | 42901838 | 42901833 | - |
| SEQ ID NO 64148 | CCAAGGACATGTAGTTGGTGGG | TTG | chr17 | 42901832 | 42901853 | 42901837 | 42901832 | - |
| SEQ ID NO 64149 | GTGGGTGGCAGAACGAGGGCTG | TTG | chr17 | 42901815 | 42901836 | 42901820 | 42901815 | - |
| SEQ ID NO 64150 | GAGCCCAGTTCCCAGGGTGACT | CTG | chr17 | 42901793 | 42901814 | 42901798 | 42901793 | - |
| SEQ ID NO 64151 | CCAGGGTGACTTTTCATTACCC | TTC | chr17 | 42901782 | 42901803 | 42901787 | 42901782 | - |
| SEQ ID NO 64152 | TTCATTACCCCACAAAACAGGC | CTT | chr17 | 42901770 | 42901791 | 42901775 | 42901770 | - |
| SEQ ID NO 64153 | TCATTACCCCACAAAACAGGCT | TTT | chr17 | 42901769 | 42901790 | 42901774 | 42901769 | - |
| SEQ ID NO 64154 | CATTACCCCACAAAACAGGCTG | TTT | chr17 | 42901768 | 42901789 | 42901773 | 42901768 | - |
| SEQ ID NO 64155 | ATTACCCCACAAAACAGGCTGT | TTC | chr17 | 42901767 | 42901788 | 42901772 | 42901767 | - |
| SEQ ID NO 64156 | CCCCACAAAACAGGCTGTTGAA | TTA | chr17 | 42901763 | 42901784 | 42901768 | 42901763 | - |
| SEQ ID NO 64157 | TTGAATCATCTGTGTGTTTCCT | CTG | chr17 | 42901746 | 42901767 | 42901751 | 42901746 | - |
| SEQ ID NO 64158 | AATCATCTGTGTGTTTCCTTTT | TTG | chr17 | 42901743 | 42901764 | 42901748 | 42901743 | - |
| SEQ ID NO 64159 | TGTGTTTCCTTTTTTTCATACAG | CTG | chr17 | 42901734 | 42901755 | 42901739 | 42901734 | - |
| SEQ ID NO 64160 | CCTTTTTTCATACAGCATACAT | TTT | chr17 | 42901727 | 42901748 | 42901732 | 42901727 | - |
| SEQ ID NO 64161 | CTTTTTTCATACAGCATACATC | TTC | chr17 | 42901726 | 42901747 | 42901731 | 42901726 | - |
| SEQ ID NO 64162 | TTTTCATACAGCATACATCATC | CTT | chr17 | 42901723 | 42901744 | 42901728 | 42901723 | - |
| SEQ ID NO 64163 | TTTCATACAGCATACATCATCT | TTT | chr17 | 42901722 | 42901743 | 42901727 | 42901722 | - |
| SEQ ID NO 64164 | TTCATACAGCATACATCATCTA | TTT | chr17 | 42901721 | 42901742 | 42901726 | 42901721 | - |
| SEQ ID NO 64165 | TCATACAGCATACATCATCTAT | TTT | chr17 | 42901720 | 42901741 | 42901725 | 42901720 | - |
| SEQ ID NO 64166 | CATACAGCATACATCATCTATC | TTT | chr17 | 42901719 | 42901740 | 42901724 | 42901719 | - |
| SEQ ID NO 64167 | ATACAGCATACATCATCTATCT | TTC | chr17 | 42901718 | 42901739 | 42901723 | 42901718 | - |
| SEQ ID NO 64168 | TCTTTTTTTTTTTTTGAGACA | CTA | chr17 | 42901699 | 42901720 | 42901704 | 42901699 | - |
| SEQ ID NO 64169 | TTTTTTTTTTTGAGACAGGGT | CTT | chr17 | 42901695 | 42901716 | 42901700 | 42901695 | - |
| SEQ ID NO 64170 | TTTTTTTTTTGAGACAGGGTC | TTT | chr17 | 42901694 | 42901715 | 42901699 | 42901694 | - |
| SEQ ID NO 64171 | TTTTTTTTTGAGACAGGGTCT | TTT | chr17 | 42901693 | 42901714 | 42901698 | 42901693 | - |
| SEQ ID NO 64172 | TTTTTTTTGAGACAGGGTCTT | TTT | chr17 | 42901692 | 42901713 | 42901697 | 42901692 | - |
| SEQ ID NO 64173 | TTTTTTTGAGACAGGGTCTTA | TTT | chr17 | 42901691 | 42901712 | 42901696 | 42901691 | - |
| SEQ ID NO 64174 | TTTTTTGAGACAGGGTCTTAC | TTT | chr17 | 42901690 | 42901711 | 42901695 | 42901690 | - |
| SEQ ID NO 64175 | TTTTTGAGACAGGGTCTTACT | TTT | chr17 | 42901689 | 42901710 | 42901694 | 42901689 | - |
| SEQ ID NO 64176 | TTTTGAGACAGGGTCTTACTC | TTT | chr17 | 42901688 | 42901709 | 42901693 | 42901688 | - |
| SEQ ID NO 64177 | TTTGAGACAGGGTCTTACTCT | TTT | chr17 | 42901687 | 42901708 | 42901692 | 42901687 | - |
| SEQ ID NO 64178 | TTGAGACAGGGTCTTACTCTG | TTT | chr17 | 42901686 | 42901707 | 42901691 | 42901686 | - |
| SEQ ID NO 64179 | TGAGACAGGGTCTTACTCTGT | TTT | chr17 | 42901685 | 42901706 | 42901690 | 42901685 | - |
| SEQ ID NO 64180 | TGAGACAGGGTCTTACTCTGTT | TTT | chr17 | 42901684 | 42901705 | 42901689 | 42901684 | - |
| SEQ ID NO 64181 | GAGACAGGGTCTTACTCTGTTG | TTT | chr17 | 42901683 | 42901704 | 42901688 | 42901683 | - |
| SEQ ID NO 64182 | AGACAGGGTCTTACTCTGTTGC | TTG | chr17 | 42901682 | 42901703 | 42901687 | 42901682 | - |
| SEQ ID NO 64183 | ACTCTGTTGCCCAGGCTGGAGT | CTT | chr17 | 42901670 | 42901691 | 42901675 | 42901670 | - |
| SEQ ID NO 64184 | CTCTGTTGCCCAGGCTGGAGTG | TTA | chr17 | 42901669 | 42901690 | 42901674 | 42901669 | - |
| SEQ ID NO 64185 | TGTTGCCCAGGCTGGAGTGCAG | CTC | chr17 | 42901666 | 42901687 | 42901671 | 42901666 | - |
| SEQ ID NO 64186 | TTGCCCAGGCTGGAGTGCAGTG | CTG | chr17 | 42901664 | 42901685 | 42901669 | 42901664 | - |
| SEQ ID NO 64187 | CCCAGGCTGGAGTGCAGTGGCA | TTG | chr17 | 42901661 | 42901682 | 42901666 | 42901661 | - |
| SEQ ID NO 64188 | GAGTGCAGTGGCATGATCTTGA | CTG | chr17 | 42901652 | 42901673 | 42901657 | 42901652 | - |
| SEQ ID NO 64189 | GACTCACTGCAACCTCCTCCGC | CTT | chr17 | 42901632 | 42901653 | 42901637 | 42901632 | - |
| SEQ ID NO 64190 | ACTCACTGCAACCTCCTCCGCC | TTG | chr17 | 42901631 | 42901652 | 42901636 | 42901631 | - |
| SEQ ID NO 64191 | ACTGCAACCTCCTCCGCCTCTC | CTC | chr17 | 42901627 | 42901648 | 42901632 | 42901627 | - |
| SEQ ID NO 64192 | CAACCTCCTCCGCCTCTCACCT | CTG | chr17 | 42901623 | 42901644 | 42901628 | 42901623 | - |
| SEQ ID NO 64193 | CTCCGCCTCTCACCTCAGCCTC | CTC | chr17 | 42901616 | 42901637 | 42901621 | 42901616 | - |
| SEQ ID NO 64194 | CGCCTCTCACCTCAGCCTCCTG | CTC | chr17 | 42901613 | 42901634 | 42901618 | 42901613 | - |
| SEQ ID NO 64195 | TCACCTCAGCCTCCTGAGTAGC | CTC | chr17 | 42901607 | 42901628 | 42901612 | 42901607 | - |
| SEQ ID NO 64196 | ACCTCAGCCTCCTGAGTAGCTG | CTC | chr17 | 42901605 | 42901626 | 42901610 | 42901605 | - |

Figure 90 (Cont'd)

| | | | | | | | | |
|---|---|---|---|---|---|---|---|---|
| SEQ ID NO 64197 | AGCCTCCTGAGTAGCTGGGACT | CTC | chr17 | 42901600 | 42901621 | 42901605 | 42901600 | - |
| SEQ ID NO 64198 | CTGAGTAGCTGGGACTACAGCA | CTC | chr17 | 42901594 | 42901615 | 42901599 | 42901594 | - |
| SEQ ID NO 64199 | AGTAGCTGGGACTACAGCACCA | CTG | chr17 | 42901591 | 42901612 | 42901596 | 42901591 | - |
| SEQ ID NO 64200 | GGACTACAGCACCAACACGCCC | CTG | chr17 | 42901583 | 42901604 | 42901588 | 42901583 | - |
| SEQ ID NO 64201 | CAGCACCAACACGCCCAGCTAA | CTA | chr17 | 42901577 | 42901598 | 42901582 | 42901577 | - |
| SEQ ID NO 64202 | ATTTTCGTAATGTTTTTGTAGA | CTA | chr17 | 42901556 | 42901577 | 42901561 | 42901556 | - |
| SEQ ID NO 64203 | TCGTAATGTTTTTGTAGAGATG | TTT | chr17 | 42901552 | 42901573 | 42901557 | 42901552 | - |
| SEQ ID NO 64204 | CGTAATGTTTTTGTAGAGATGG | TTT | chr17 | 42901551 | 42901572 | 42901556 | 42901551 | - |
| SEQ ID NO 64205 | GTAATGTTTTTGTAGAGATGGA | TTC | chr17 | 42901550 | 42901571 | 42901555 | 42901550 | - |
| SEQ ID NO 64206 | TTGTAGAGATGGAGTTTCGCCA | TTT | chr17 | 42901541 | 42901562 | 42901546 | 42901541 | - |
| SEQ ID NO 64207 | TGTAGAGATGGAGTTTCGCCAT | TTT | chr17 | 42901540 | 42901561 | 42901545 | 42901540 | - |
| SEQ ID NO 64208 | GTAGAGATGGAGTTTCGCCATG | TTT | chr17 | 42901539 | 42901560 | 42901544 | 42901539 | - |
| SEQ ID NO 64209 | TAGAGATGGAGTTTCGCCATGT | TTG | chr17 | 42901538 | 42901559 | 42901543 | 42901538 | - |
| SEQ ID NO 64210 | CGCCATGTTGCCCAGGCTGGTC | TTT | chr17 | 42901524 | 42901545 | 42901529 | 42901524 | - |
| SEQ ID NO 64211 | GCCATGTTGCCCAGGCTGGTCT | TTC | chr17 | 42901523 | 42901544 | 42901528 | 42901523 | - |
| SEQ ID NO 64212 | CCCAGGCTGGTCTTGAACTCCT | TTG | chr17 | 42901514 | 42901535 | 42901519 | 42901514 | - |
| SEQ ID NO 64213 | GTCTTGAACTCCTGAGTTCACC | CTG | chr17 | 42901505 | 42901526 | 42901510 | 42901505 | - |
| SEQ ID NO 64214 | GAACTCCTGAGTTCACCCAGGA | CTT | chr17 | 42901500 | 42901521 | 42901505 | 42901500 | - |
| SEQ ID NO 64215 | AACTCCTGAGTTCACCCAGGAG | TTG | chr17 | 42901499 | 42901520 | 42901504 | 42901499 | - |
| SEQ ID NO 64216 | CTGAGTTCACCCAGGAGTGATT | CTC | chr17 | 42901494 | 42901515 | 42901499 | 42901494 | - |
| SEQ ID NO 64217 | AGTTCACCCAGGAGTGATTCGC | CTG | chr17 | 42901491 | 42901512 | 42901496 | 42901491 | - |
| SEQ ID NO 64218 | ACCCAGGAGTGATTCGCCCACC | TTC | chr17 | 42901486 | 42901507 | 42901491 | 42901486 | - |
| SEQ ID NO 64219 | GCCCACCTCGGCCTCCCAAAGT | TTC | chr17 | 42901471 | 42901492 | 42901476 | 42901471 | - |
| SEQ ID NO 64220 | GGCCTCCCAAAGTGCTGGGATT | CTC | chr17 | 42901462 | 42901483 | 42901467 | 42901462 | - |
| SEQ ID NO 64221 | CCAAAGTGCTGGGATTACAGGT | CTC | chr17 | 42901456 | 42901477 | 42901461 | 42901456 | - |
| SEQ ID NO 64222 | GGATTACAGGTGTGAGCCACCA | CTG | chr17 | 42901445 | 42901466 | 42901450 | 42901445 | - |
| SEQ ID NO 64223 | CAGGTGTGAGCCACCATGCCTG | TTA | chr17 | 42901439 | 42901460 | 42901444 | 42901439 | - |
| SEQ ID NO 64224 | GCCCCATACATCTTTCTTTATG | CTG | chr17 | 42901417 | 42901438 | 42901422 | 42901417 | - |
| SEQ ID NO 64225 | TCTTTATGTTACCTCTTCTGCT | CTT | chr17 | 42901403 | 42901424 | 42901408 | 42901403 | - |
| SEQ ID NO 64226 | CTTTATGTTACCTCTTCTGCTT | TTT | chr17 | 42901402 | 42901423 | 42901407 | 42901402 | - |
| SEQ ID NO 64227 | TTTATGTTACCTCTTCTGCTTC | TTC | chr17 | 42901401 | 42901422 | 42901406 | 42901401 | - |
| SEQ ID NO 64228 | TATGTTACCTCTTCTGCTTCAT | CTT | chr17 | 42901399 | 42901420 | 42901404 | 42901399 | - |
| SEQ ID NO 64229 | ATGTTACCTCTTCTGCTTCATA | TTT | chr17 | 42901398 | 42901419 | 42901403 | 42901398 | - |
| SEQ ID NO 64230 | TGTTACCTCTTCTGCTTCATAC | TTA | chr17 | 42901397 | 42901418 | 42901402 | 42901397 | - |
| SEQ ID NO 64231 | CCTCTTCTGCTTCATACTAATA | TTA | chr17 | 42901392 | 42901413 | 42901397 | 42901392 | - |
| SEQ ID NO 64232 | TTCTGCTTCATACTAATAAAAC | CTC | chr17 | 42901388 | 42901409 | 42901393 | 42901388 | - |
| SEQ ID NO 64233 | CTGCTTCATACTAATAAAACTC | CTT | chr17 | 42901386 | 42901407 | 42901391 | 42901386 | - |
| SEQ ID NO 64234 | TGCTTCATACTAATAAAACTCT | TTC | chr17 | 42901385 | 42901406 | 42901390 | 42901385 | - |
| SEQ ID NO 64235 | CTTCATACTAATAAAACTCTTT | CTG | chr17 | 42901383 | 42901404 | 42901388 | 42901383 | - |
| SEQ ID NO 64236 | CATACTAATAAAACTCTTTGCT | CTT | chr17 | 42901380 | 42901401 | 42901385 | 42901380 | - |
| SEQ ID NO 64237 | ATACTAATAAAACTCTTTGCTC | TTC | chr17 | 42901379 | 42901400 | 42901384 | 42901379 | - |
| SEQ ID NO 64238 | ATAAAACTCTTTGCTCAAAGCC | CTA | chr17 | 42901373 | 42901394 | 42901378 | 42901373 | - |
| SEQ ID NO 64239 | TTTGCTCAAAGCCTATATAACT | CTC | chr17 | 42901364 | 42901385 | 42901369 | 42901364 | - |
| SEQ ID NO 64240 | TGCTCAAAGCCTATATAACTCA | CTT | chr17 | 42901362 | 42901383 | 42901367 | 42901362 | - |
| SEQ ID NO 64241 | GCTCAAAGCCTATATAACTCAG | TTT | chr17 | 42901361 | 42901382 | 42901366 | 42901361 | - |
| SEQ ID NO 64242 | CTCAAAGCCTATATAACTCAGA | TTG | chr17 | 42901360 | 42901381 | 42901365 | 42901360 | - |
| SEQ ID NO 64243 | AAAGCCTATATAACTCAGACTT | CTC | chr17 | 42901357 | 42901378 | 42901362 | 42901357 | - |
| SEQ ID NO 64244 | TATAACTCAGACTTTTCACGAA | CTA | chr17 | 42901349 | 42901370 | 42901354 | 42901349 | - |
| SEQ ID NO 64245 | AGACTTTTCACGAAATTCAACT | CTC | chr17 | 42901341 | 42901362 | 42901346 | 42901341 | - |
| SEQ ID NO 64246 | TTCACGAAATTCAACTGTCCTA | CTT | chr17 | 42901335 | 42901356 | 42901340 | 42901335 | - |
| SEQ ID NO 64247 | TCACGAAATTCAACTGTCCTAC | TTT | chr17 | 42901334 | 42901355 | 42901339 | 42901334 | - |
| SEQ ID NO 64248 | CACGAAATTCAACTGTCCTACC | TTT | chr17 | 42901333 | 42901354 | 42901338 | 42901333 | - |
| SEQ ID NO 64249 | ACGAAATTCAACTGTCCTACCC | TTC | chr17 | 42901332 | 42901353 | 42901337 | 42901332 | - |
| SEQ ID NO 64250 | AACTGTCCTACCCTTTAACCCA | TTC | chr17 | 42901323 | 42901344 | 42901328 | 42901323 | - |
| SEQ ID NO 64251 | TCCTACCCTTTAACCCATATGA | CTG | chr17 | 42901318 | 42901339 | 42901323 | 42901318 | - |
| SEQ ID NO 64252 | CCCTTTAACCCATATGAAATAG | CTA | chr17 | 42901313 | 42901334 | 42901318 | 42901313 | - |
| SEQ ID NO 64253 | TAACCCATATGAAATAGGCTTT | CTT | chr17 | 42901308 | 42901329 | 42901313 | 42901308 | - |
| SEQ ID NO 64254 | AACCCATATGAAATAGGCTTTC | TTT | chr17 | 42901307 | 42901328 | 42901312 | 42901307 | - |

Figure 90 (Cont'd)

| | | | | | | | | |
|---|---|---|---|---|---|---|---|---|
| SEQ ID NO 64255 | ACCCATATGAAATAGGCTTTCC | TTA | chr17 | 42901306 | 42901327 | 42901311 | 42901306 | - |
| SEQ ID NO 64256 | TCCTGTATTTTCAACTCACTGG | CTT | chr17 | 42901287 | 42901308 | 42901292 | 42901287 | - |
| SEQ ID NO 64257 | CCTGTATTTTCAACTCACTGGT | TTT | chr17 | 42901286 | 42901307 | 42901291 | 42901286 | - |
| SEQ ID NO 64258 | CTGTATTTTCAACTCACTGGTA | TTC | chr17 | 42901285 | 42901306 | 42901290 | 42901285 | - |
| SEQ ID NO 64259 | TATTTTCAACTCACTGGTAGGA | CTG | chr17 | 42901282 | 42901303 | 42901287 | 42901282 | - |
| SEQ ID NO 64260 | TCAACTCACTGGTAGGATTTTT | TTT | chr17 | 42901277 | 42901298 | 42901282 | 42901277 | - |
| SEQ ID NO 64261 | CAACTCACTGGTAGGATTTTTT | TTT | chr17 | 42901276 | 42901297 | 42901281 | 42901276 | - |
| SEQ ID NO 64262 | AACTCACTGGTAGGATTTTTTC | TTC | chr17 | 42901275 | 42901296 | 42901280 | 42901275 | - |
| SEQ ID NO 64263 | ACTGGTAGGATTTTTTCTGTCT | CTC | chr17 | 42901270 | 42901291 | 42901275 | 42901270 | - |
| SEQ ID NO 64264 | GTAGGATTTTTTCTGTCTTCCC | CTG | chr17 | 42901266 | 42901287 | 42901271 | 42901266 | - |
| SEQ ID NO 64265 | TTTCTGTCTTCCCCCTTTATGT | TTT | chr17 | 42901257 | 42901278 | 42901262 | 42901257 | - |
| SEQ ID NO 64266 | TTCTGTCTTCCCCCTTTATGTA | TTT | chr17 | 42901256 | 42901277 | 42901261 | 42901256 | - |
| SEQ ID NO 64267 | TCTGTCTTCCCCCTTTATGTAG | TTT | chr17 | 42901255 | 42901276 | 42901260 | 42901255 | - |
| SEQ ID NO 64268 | CTGTCTTCCCCCTTTATGTAGA | TTT | chr17 | 42901254 | 42901275 | 42901259 | 42901254 | - |
| SEQ ID NO 64269 | TGTCTTCCCCCTTTATGTAGAT | TTC | chr17 | 42901253 | 42901274 | 42901258 | 42901253 | - |
| SEQ ID NO 64270 | TCTTCCCCCTTTATGTAGATGA | CTG | chr17 | 42901251 | 42901272 | 42901256 | 42901251 | - |
| SEQ ID NO 64271 | CCCCCTTTATGTAGATGATCCA | CTT | chr17 | 42901247 | 42901268 | 42901252 | 42901247 | - |
| SEQ ID NO 64272 | CCCCTTTATGTAGATGATCCAA | TTC | chr17 | 42901246 | 42901267 | 42901251 | 42901246 | - |
| SEQ ID NO 64273 | TATGTAGATGATCCAAAGTCAG | CTT | chr17 | 42901240 | 42901261 | 42901245 | 42901240 | - |
| SEQ ID NO 64274 | ATGTAGATGATCCAAAGTCAGA | TTT | chr17 | 42901239 | 42901260 | 42901244 | 42901239 | - |
| SEQ ID NO 64275 | TGTAGATGATCCAAAGTCAGAG | TTA | chr17 | 42901238 | 42901259 | 42901243 | 42901238 | - |
| SEQ ID NO 64276 | GAAGCATGAGTAGCCCGTGGCT | TTG | chr17 | 42901206 | 42901227 | 42901211 | 42901206 | - |
| SEQ ID NO 64277 | CCTGAATAGCCTGGGGAAAGCA | CTT | chr17 | 42901183 | 42901204 | 42901188 | 42901183 | - |
| SEQ ID NO 64278 | CTGAATAGCCTGGGGAAAGCAA | TTC | chr17 | 42901182 | 42901203 | 42901187 | 42901182 | - |
| SEQ ID NO 64279 | AATAGCCTGGGGAAAGCAACTT | CTG | chr17 | 42901179 | 42901200 | 42901184 | 42901179 | - |
| SEQ ID NO 64280 | GGGAAAGCAACTTCTGATGGAC | CTG | chr17 | 42901170 | 42901191 | 42901175 | 42901170 | - |
| SEQ ID NO 64281 | CTGATGGACAGACATTGCGAGA | CTT | chr17 | 42901157 | 42901178 | 42901162 | 42901157 | - |
| SEQ ID NO 64282 | TGATGGACAGACATTGCGAGAG | TTC | chr17 | 42901156 | 42901177 | 42901161 | 42901156 | - |
| SEQ ID NO 64283 | ATGGACAGACATTGCGAGAGCG | CTG | chr17 | 42901154 | 42901175 | 42901159 | 42901154 | - |
| SEQ ID NO 64284 | CGAGAGCGAATGCCAGCCTCTT | TTG | chr17 | 42901140 | 42901161 | 42901145 | 42901140 | - |
| SEQ ID NO 64285 | TTTTCTTGCTGATCTCCTCTCT | CTC | chr17 | 42901120 | 42901141 | 42901125 | 42901120 | - |
| SEQ ID NO 64286 | TTCTTGCTGATCTCCTCTCTAT | CTT | chr17 | 42901118 | 42901139 | 42901123 | 42901118 | - |
| SEQ ID NO 64287 | TCTTGCTGATCTCCTCTCTATA | TTT | chr17 | 42901117 | 42901138 | 42901122 | 42901117 | - |
| SEQ ID NO 64288 | CTTGCTGATCTCCTCTCTATAT | TTT | chr17 | 42901116 | 42901137 | 42901121 | 42901116 | - |
| SEQ ID NO 64289 | TTGCTGATCTCCTCTCTATATG | TTC | chr17 | 42901115 | 42901136 | 42901120 | 42901115 | - |
| SEQ ID NO 64290 | GCTGATCTCCTCTCTATATGGT | CTT | chr17 | 42901113 | 42901134 | 42901118 | 42901113 | - |
| SEQ ID NO 64291 | CTGATCTCCTCTCTATATGGTT | TTG | chr17 | 42901112 | 42901133 | 42901117 | 42901112 | - |
| SEQ ID NO 64292 | ATCTCCTCTCTATATGGTTCTT | CTG | chr17 | 42901109 | 42901130 | 42901114 | 42901109 | - |
| SEQ ID NO 64293 | CTCTCTATATGGTTCTTACCAC | CTC | chr17 | 42901104 | 42901125 | 42901109 | 42901104 | - |
| SEQ ID NO 64294 | TCTATATGGTTCTTACCACTTA | CTC | chr17 | 42901101 | 42901122 | 42901106 | 42901101 | - |
| SEQ ID NO 64295 | TATATGGTTCTTACCACTTAAA | CTC | chr17 | 42901099 | 42901120 | 42901104 | 42901099 | - |
| SEQ ID NO 64296 | TATGGTTCTTACCACTTAAAGA | CTA | chr17 | 42901097 | 42901118 | 42901102 | 42901097 | - |
| SEQ ID NO 64297 | TTACCACTTAAAGACGAGGTTG | TTC | chr17 | 42901089 | 42901110 | 42901094 | 42901089 | - |
| SEQ ID NO 64298 | ACCACTTAAAGACGAGGTTGAG | CTT | chr17 | 42901087 | 42901108 | 42901092 | 42901087 | - |
| SEQ ID NO 64299 | CCACTTAAAGACGAGGTTGAGC | TTA | chr17 | 42901086 | 42901107 | 42901091 | 42901086 | - |
| SEQ ID NO 64300 | AAAGACGAGGTTGAGCCAGTCT | CTT | chr17 | 42901080 | 42901101 | 42901085 | 42901080 | - |
| SEQ ID NO 64301 | AAGACGAGGTTGAGCCAGTCTC | TTA | chr17 | 42901079 | 42901100 | 42901084 | 42901079 | - |
| SEQ ID NO 64302 | AGCCAGTCTCCAATCACAGCTA | TTG | chr17 | 42901067 | 42901088 | 42901072 | 42901067 | - |
| SEQ ID NO 64303 | CAATCACAGCTACCCAAAGGAG | CTC | chr17 | 42901057 | 42901078 | 42901062 | 42901057 | - |
| SEQ ID NO 64304 | CCCAAAGGAGTTTAATGCCCAC | CTA | chr17 | 42901045 | 42901066 | 42901050 | 42901045 | - |
| SEQ ID NO 64305 | AATGCCCACAGCTTCCTGAAGA | TTT | chr17 | 42901032 | 42901053 | 42901037 | 42901032 | - |
| SEQ ID NO 64306 | ATGCCCACAGCTTCCTGAAGAT | TTA | chr17 | 42901031 | 42901052 | 42901036 | 42901031 | - |
| SEQ ID NO 64307 | CCTGAAGATGGAACCAGATGGG | CTT | chr17 | 42901018 | 42901039 | 42901023 | 42901018 | - |
| SEQ ID NO 64308 | CTGAAGATGGAACCAGATGGGG | TTC | chr17 | 42901017 | 42901038 | 42901022 | 42901017 | - |
| SEQ ID NO 64309 | AAGATGGAACCAGATGGGGAAG | CTG | chr17 | 42901014 | 42901035 | 42901019 | 42901014 | - |
| SEQ ID NO 64310 | CTGAGGTCTGCGATCACGGACA | TTC | chr17 | 42900974 | 42900995 | 42900979 | 42900974 | - |
| SEQ ID NO 64311 | AGGTCTGCGATCACGGACACCA | CTG | chr17 | 42900971 | 42900992 | 42900976 | 42900971 | - |
| SEQ ID NO 64312 | CGATCACGGACACCAAGATGAA | CTG | chr17 | 42900964 | 42900985 | 42900969 | 42900964 | - |

Figure 90 (Cont'd)

| SEQ ID NO 64313 | GGAGTCTTGGTAATTCACCTGG | CTG | chr17 | 42900933 | 42900954 | 42900938 | 42900933 | - |
|---|---|---|---|---|---|---|---|---|
| SEQ ID NO 64314 | GGTAATTCACCTGGAGGTAATG | CTT | chr17 | 42900925 | 42900946 | 42900930 | 42900925 | - |
| SEQ ID NO 64315 | GTAATTCACCTGGAGGTAATGT | TTG | chr17 | 42900924 | 42900945 | 42900929 | 42900924 | - |
| SEQ ID NO 64316 | ACCTGGAGGTAATGTGTTGACT | TTC | chr17 | 42900917 | 42900938 | 42900922 | 42900917 | - |
| SEQ ID NO 64317 | GAGGTAATGTGTTGACTGGATC | CTG | chr17 | 42900912 | 42900933 | 42900917 | 42900912 | - |
| SEQ ID NO 64318 | ACTGGATCCCAAAGTCATGGAG | TTG | chr17 | 42900898 | 42900919 | 42900903 | 42900898 | - |
| SEQ ID NO 64319 | GATCCCAAAGTCATGGAGAACA | CTG | chr17 | 42900894 | 42900915 | 42900899 | 42900894 | - |
| SEQ ID NO 64320 | ATTCCTTCCTCCATCCTCATTT | TTC | chr17 | 42900869 | 42900890 | 42900874 | 42900869 | - |
| SEQ ID NO 64321 | CTTCCTCCATCCTCATTTCCTT | TTC | chr17 | 42900865 | 42900886 | 42900870 | 42900865 | - |
| SEQ ID NO 64322 | CCTCCATCCTCATTTCCTTGGC | CTT | chr17 | 42900862 | 42900883 | 42900867 | 42900862 | - |
| SEQ ID NO 64323 | CTCCATCCTCATTTCCTTGGCA | TTC | chr17 | 42900861 | 42900882 | 42900866 | 42900861 | - |
| SEQ ID NO 64324 | CATCCTCATTTCCTTGGCACCT | CTC | chr17 | 42900858 | 42900879 | 42900863 | 42900858 | - |
| SEQ ID NO 64325 | ATTTCCTTGGCACCTCAGGAAG | CTC | chr17 | 42900851 | 42900872 | 42900856 | 42900851 | - |
| SEQ ID NO 64326 | CCTTGGCACCTCAGGAAGATGT | TTT | chr17 | 42900847 | 42900868 | 42900852 | 42900847 | - |
| SEQ ID NO 64327 | CTTGGCACCTCAGGAAGATGTC | TTC | chr17 | 42900846 | 42900867 | 42900851 | 42900846 | - |
| SEQ ID NO 64328 | GGCACCTCAGGAAGATGTCAGC | CTT | chr17 | 42900843 | 42900864 | 42900848 | 42900843 | - |
| SEQ ID NO 64329 | GCACCTCAGGAAGATGTCAGCA | TTG | chr17 | 42900842 | 42900863 | 42900847 | 42900842 | - |
| SEQ ID NO 64330 | AGGAAGATGTCAGCAGAGCCCT | CTC | chr17 | 42900835 | 42900856 | 42900840 | 42900835 | - |
| SEQ ID NO 64331 | GCAGTTATTCCAGGCTTGGTGG | CTT | chr17 | 42900812 | 42900833 | 42900817 | 42900812 | - |
| SEQ ID NO 64332 | CAGTTATTCCAGGCTTGGTGGT | TTG | chr17 | 42900811 | 42900832 | 42900816 | 42900811 | - |
| SEQ ID NO 64333 | TTCCAGGCTTGGTGGTGATTGC | TTA | chr17 | 42900805 | 42900826 | 42900810 | 42900805 | - |
| SEQ ID NO 64334 | CAGGCTTGGTGGTGATTGCTCT | TTC | chr17 | 42900802 | 42900823 | 42900807 | 42900802 | - |
| SEQ ID NO 64335 | GGTGGTGATTGCTCTGCTATGA | CTT | chr17 | 42900795 | 42900816 | 42900800 | 42900795 | - |
| SEQ ID NO 64336 | GTGGTGATTGCTCTGCTATGAG | TTG | chr17 | 42900794 | 42900815 | 42900799 | 42900794 | - |
| SEQ ID NO 64337 | CTCTGCTATGAGTCTGTGCCTT | TTG | chr17 | 42900784 | 42900805 | 42900789 | 42900784 | - |
| SEQ ID NO 64338 | TGCTATGAGTCTGTGCCTTGCC | CTC | chr17 | 42900781 | 42900802 | 42900786 | 42900781 | - |
| SEQ ID NO 64339 | CTATGAGTCTGTGCCTTGCCCC | CTG | chr17 | 42900779 | 42900800 | 42900784 | 42900779 | - |
| SEQ ID NO 64340 | TGAGTCTGTGCCTTGCCCCTGT | CTA | chr17 | 42900776 | 42900797 | 42900781 | 42900776 | - |
| SEQ ID NO 64341 | TGCCTTGCCCCTGTTTTATATG | CTG | chr17 | 42900768 | 42900789 | 42900773 | 42900768 | - |
| SEQ ID NO 64342 | GCCCCTGTTTTATATGCCCTGT | CTT | chr17 | 42900762 | 42900783 | 42900767 | 42900762 | - |
| SEQ ID NO 64343 | CCCCTGTTTTATATGCCCTGTA | TTG | chr17 | 42900761 | 42900782 | 42900766 | 42900761 | - |
| SEQ ID NO 64344 | TTTTATATGCCCTGTATCCAGT | CTG | chr17 | 42900755 | 42900776 | 42900760 | 42900755 | - |
| SEQ ID NO 64345 | TATATGCCCTGTATCCAGTATT | TTT | chr17 | 42900752 | 42900773 | 42900757 | 42900752 | - |
| SEQ ID NO 64346 | ATATGCCCTGTATCCAGTATTC | TTT | chr17 | 42900751 | 42900772 | 42900756 | 42900751 | - |
| SEQ ID NO 64347 | TATGCCCTGTATCCAGTATTCA | TTA | chr17 | 42900750 | 42900771 | 42900755 | 42900750 | - |
| SEQ ID NO 64348 | TATCCAGTATTCAGGTCAACCC | CTG | chr17 | 42900741 | 42900762 | 42900746 | 42900741 | - |
| SEQ ID NO 64349 | AGGTCAACCCAGCCCTGATCTT | TTC | chr17 | 42900729 | 42900750 | 42900734 | 42900729 | - |
| SEQ ID NO 64350 | ATCTTTGGACTCAAAAACCACG | CTG | chr17 | 42900712 | 42900733 | 42900717 | 42900712 | - |
| SEQ ID NO 64351 | TGGACTCAAAAACCACGTTTGT | CTT | chr17 | 42900707 | 42900728 | 42900712 | 42900707 | - |
| SEQ ID NO 64352 | GGACTCAAAAACCACGTTTGTC | TTT | chr17 | 42900706 | 42900727 | 42900711 | 42900706 | - |
| SEQ ID NO 64353 | GACTCAAAAACCACGTTTGTCT | TTG | chr17 | 42900705 | 42900726 | 42900710 | 42900705 | - |
| SEQ ID NO 64354 | AAAAACCACGTTTGTCTAAAAT | CTC | chr17 | 42900700 | 42900721 | 42900705 | 42900700 | - |
| SEQ ID NO 64355 | GTCTAAAATGTATTGATCAAAG | TTT | chr17 | 42900687 | 42900708 | 42900692 | 42900687 | - |
| SEQ ID NO 64356 | TCTAAAATGTATTGATCAAAGG | TTG | chr17 | 42900686 | 42900707 | 42900691 | 42900686 | - |
| SEQ ID NO 64357 | AAATGTATTGATCAAAGGTGCA | CTA | chr17 | 42900682 | 42900703 | 42900687 | 42900682 | - |
| SEQ ID NO 64358 | ATCAAAGGTGCATCACCAGTAG | TTG | chr17 | 42900672 | 42900693 | 42900677 | 42900672 | - |
| SEQ ID NO 64359 | ATGCAAACATGTTCAGGGTGAT | TTG | chr17 | 42900646 | 42900667 | 42900651 | 42900646 | - |
| SEQ ID NO 64360 | AGGGTGATTTACGTAAAATAGA | TTC | chr17 | 42900632 | 42900653 | 42900637 | 42900632 | - |
| SEQ ID NO 64361 | ACGTAAAATAGAAAAACAGGCA | TTT | chr17 | 42900622 | 42900643 | 42900627 | 42900622 | - |
| SEQ ID NO 64362 | CGTAAAATAGAAAAACAGGCAC | TTA | chr17 | 42900621 | 42900642 | 42900626 | 42900621 | - |
| SEQ ID NO 64363 | ATCGGCCATGTACTCAGCAGGG | CTG | chr17 | 42900585 | 42900606 | 42900590 | 42900585 | - |
| SEQ ID NO 64364 | AGCAGGGCCAATGATTAACTTT | CTC | chr17 | 42900570 | 42900591 | 42900575 | 42900570 | - |
| SEQ ID NO 64365 | ACTTTGGCATGCTTCTTGGCAG | TTA | chr17 | 42900553 | 42900574 | 42900558 | 42900553 | - |
| SEQ ID NO 64366 | TGGCATGCTTCTTGGCAGTGCA | CTT | chr17 | 42900549 | 42900570 | 42900554 | 42900549 | - |
| SEQ ID NO 64367 | GGCATGCTTCTTGGCAGTGCAA | TTT | chr17 | 42900548 | 42900569 | 42900553 | 42900548 | - |
| SEQ ID NO 64368 | GCATGCTTCTTGGCAGTGCAAG | TTG | chr17 | 42900547 | 42900568 | 42900552 | 42900547 | - |
| SEQ ID NO 64369 | CTTGGCAGTGCAAGGGTCTGCC | CTT | chr17 | 42900539 | 42900560 | 42900544 | 42900539 | - |
| SEQ ID NO 64370 | TTGGCAGTGCAAGGGTCTGCCC | TTC | chr17 | 42900538 | 42900559 | 42900543 | 42900538 | - |

Figure 90 (Cont'd)

| SEQ ID NO 64371 | GGCAGTGCAAGGGTCTGCCCTC | CTT | chr17 | 42900536 | 42900557 | 42900541 | 42900536 | - |
|---|---|---|---|---|---|---|---|---|
| SEQ ID NO 64372 | GCAGTGCAAGGGTCTGCCCTCC | TTG | chr17 | 42900535 | 42900556 | 42900540 | 42900535 | - |
| SEQ ID NO 64373 | CCCTCCTGGTCCCCGAAACCAG | CTG | chr17 | 42900519 | 42900540 | 42900524 | 42900519 | - |
| SEQ ID NO 64374 | CTGGTCCCCGAAACCAGGCCAG | CTC | chr17 | 42900514 | 42900535 | 42900519 | 42900514 | - |
| SEQ ID NO 64375 | GTCCCCGAAACCAGGCCAGAGA | CTG | chr17 | 42900511 | 42900532 | 42900516 | 42900511 | - |
| SEQ ID NO 64376 | CATCCACGATGATTCTTGCAAA | CTA | chr17 | 42900473 | 42900494 | 42900478 | 42900473 | - |
| SEQ ID NO 64377 | TTGCAAAGATGTCAGATTTTCT | TTC | chr17 | 42900458 | 42900479 | 42900463 | 42900458 | - |
| SEQ ID NO 64378 | GCAAAGATGTCAGATTTTCTAT | CTT | chr17 | 42900456 | 42900477 | 42900461 | 42900456 | - |
| SEQ ID NO 64379 | CAAAGATGTCAGATTTTCTATG | TTG | chr17 | 42900455 | 42900476 | 42900460 | 42900455 | - |
| SEQ ID NO 64380 | TCTATGCCTGCAACTGCACTTA | TTT | chr17 | 42900439 | 42900460 | 42900444 | 42900439 | - |
| SEQ ID NO 64381 | CTATGCCTGCAACTGCACTTAT | TTT | chr17 | 42900438 | 42900459 | 42900443 | 42900438 | - |
| SEQ ID NO 64382 | TATGCCTGCAACTGCACTTATT | TTC | chr17 | 42900437 | 42900458 | 42900442 | 42900437 | - |
| SEQ ID NO 64383 | TGCCTGCAACTGCACTTATTTG | CTA | chr17 | 42900435 | 42900456 | 42900440 | 42900435 | - |
| SEQ ID NO 64384 | CAACTGCACTTATTTGGGGACA | CTG | chr17 | 42900429 | 42900450 | 42900434 | 42900429 | - |
| SEQ ID NO 64385 | CACTTATTTGGGGACAAAGAAA | CTG | chr17 | 42900423 | 42900444 | 42900428 | 42900423 | - |
| SEQ ID NO 64386 | ATTTGGGGACAAAGAAAAATCT | CTT | chr17 | 42900418 | 42900439 | 42900423 | 42900418 | - |
| SEQ ID NO 64387 | TTTGGGGACAAAGAAAAATCTT | TTA | chr17 | 42900417 | 42900438 | 42900422 | 42900417 | - |
| SEQ ID NO 64388 | GGGGACAAAGAAAAATCTTGGT | TTT | chr17 | 42900414 | 42900435 | 42900419 | 42900414 | - |
| SEQ ID NO 64389 | GGGACAAAGAAAAATCTTGGTG | TTG | chr17 | 42900413 | 42900434 | 42900418 | 42900413 | - |
| SEQ ID NO 64390 | GGTGCTCTAGCTATTCAAGTTT | CTT | chr17 | 42900395 | 42900416 | 42900400 | 42900395 | - |
| SEQ ID NO 64391 | GTGCTCTAGCTATTCAAGTTTT | TTG | chr17 | 42900394 | 42900415 | 42900399 | 42900394 | - |
| SEQ ID NO 64392 | TAGCTATTCAAGTTTTAAGTTC | CTC | chr17 | 42900388 | 42900409 | 42900393 | 42900388 | - |
| SEQ ID NO 64393 | GCTATTCAAGTTTTAAGTTCTT | CTA | chr17 | 42900386 | 42900407 | 42900391 | 42900386 | - |
| SEQ ID NO 64394 | TTCAAGTTTTAAGTTCTTAATT | CTA | chr17 | 42900382 | 42900403 | 42900387 | 42900382 | - |
| SEQ ID NO 64395 | AAGTTTTAAGTTCTTAATTTTA | TTC | chr17 | 42900379 | 42900400 | 42900384 | 42900379 | - |
| SEQ ID NO 64396 | TAAGTTCTTAATTTTAAAATTA | TTT | chr17 | 42900373 | 42900394 | 42900378 | 42900373 | - |
| SEQ ID NO 64397 | AAGTTCTTAATTTTAAAATTAG | TTT | chr17 | 42900372 | 42900393 | 42900377 | 42900372 | - |
| SEQ ID NO 64398 | AGTTCTTAATTTTAAAATTAGT | TTA | chr17 | 42900371 | 42900392 | 42900376 | 42900371 | - |
| SEQ ID NO 64399 | TTAATTTTAAAATTAGTAAAGT | TTC | chr17 | 42900366 | 42900387 | 42900371 | 42900366 | - |
| SEQ ID NO 64400 | AATTTTAAAATTAGTAAAGTTC | CTT | chr17 | 42900364 | 42900385 | 42900369 | 42900364 | - |
| SEQ ID NO 64401 | ATTTTAAAATTAGTAAAGTTCT | TTA | chr17 | 42900363 | 42900384 | 42900368 | 42900363 | - |
| SEQ ID NO 64402 | TAAAATTAGTAAAGTTCTGGCT | TTT | chr17 | 42900359 | 42900380 | 42900364 | 42900359 | - |
| SEQ ID NO 64403 | AAAATTAGTAAAGTTCTGGCTG | TTT | chr17 | 42900358 | 42900379 | 42900363 | 42900358 | - |
| SEQ ID NO 64404 | AAATTAGTAAAGTTCTGGCTGG | TTA | chr17 | 42900357 | 42900378 | 42900362 | 42900357 | - |
| SEQ ID NO 64405 | GTAAAGTTCTGGCTGGTTGTGG | TTA | chr17 | 42900351 | 42900372 | 42900356 | 42900351 | - |
| SEQ ID NO 64406 | TGGCTGGTTGTGGTGGCTCACA | TTC | chr17 | 42900342 | 42900363 | 42900347 | 42900342 | - |
| SEQ ID NO 64407 | GCTGGTTGTGGTGGCTCACACC | CTG | chr17 | 42900340 | 42900361 | 42900345 | 42900340 | - |
| SEQ ID NO 64408 | GTTGTGGTGGCTCACACCTGTA | CTG | chr17 | 42900336 | 42900357 | 42900341 | 42900336 | - |
| SEQ ID NO 64409 | TGGTGGCTCACACCTGTAATCC | TTG | chr17 | 42900332 | 42900353 | 42900337 | 42900332 | - |
| SEQ ID NO 64410 | ACACCTGTAATCCCAGCAATTT | CTC | chr17 | 42900323 | 42900344 | 42900328 | 42900323 | - |
| SEQ ID NO 64411 | TAATCCCAGCAATTTGGGAGGC | CTG | chr17 | 42900316 | 42900337 | 42900321 | 42900316 | - |
| SEQ ID NO 64412 | GGGAGGCTGAGGTGGGAGGATC | TTT | chr17 | 42900301 | 42900322 | 42900306 | 42900301 | - |
| SEQ ID NO 64413 | GGAGGCTGAGGTGGGAGGATCC | TTG | chr17 | 42900300 | 42900321 | 42900305 | 42900300 | - |
| SEQ ID NO 64414 | AGGTGGGAGGATCCCTTGAAGC | CTG | chr17 | 42900292 | 42900313 | 42900297 | 42900292 | - |
| SEQ ID NO 64415 | GAAGCCAGGAGTTGGAGACCAG | CTT | chr17 | 42900275 | 42900296 | 42900280 | 42900275 | - |
| SEQ ID NO 64416 | AAGCCAGGAGTTGGAGACCAGC | TTG | chr17 | 42900274 | 42900295 | 42900279 | 42900274 | - |
| SEQ ID NO 64417 | GAGACCAGCCTGGGCAACAAAG | TTG | chr17 | 42900261 | 42900282 | 42900266 | 42900261 | - |
| SEQ ID NO 64418 | GGCAACAAAGCAAGACCCTCGT | CTG | chr17 | 42900249 | 42900270 | 42900254 | 42900249 | - |
| SEQ ID NO 64419 | GTTTCTACACAAAAATTTAAAA | CTC | chr17 | 42900229 | 42900250 | 42900234 | 42900229 | - |
| SEQ ID NO 64420 | CTACACAAAAATTTAAAAAATT | TTT | chr17 | 42900225 | 42900246 | 42900230 | 42900225 | - |
| SEQ ID NO 64421 | TACACAAAAATTTAAAAAATTG | TTC | chr17 | 42900224 | 42900245 | 42900229 | 42900224 | - |
| SEQ ID NO 64422 | CACAAAAATTTAAAAAATTGTT | CTA | chr17 | 42900222 | 42900243 | 42900227 | 42900222 | - |
| SEQ ID NO 64423 | AAAAAATTGTTTTGGTGTGTGT | TTT | chr17 | 42900211 | 42900232 | 42900216 | 42900211 | - |
| SEQ ID NO 64424 | AAAAATTGTTTTGGTGTGTGTG | TTA | chr17 | 42900210 | 42900231 | 42900215 | 42900210 | - |
| SEQ ID NO 64425 | TTTTGGTGTGTGTGATGGTGTA | TTG | chr17 | 42900202 | 42900223 | 42900207 | 42900202 | - |
| SEQ ID NO 64426 | TGGTGTGTGTGATGGTGTACCC | TTT | chr17 | 42900199 | 42900220 | 42900204 | 42900199 | - |
| SEQ ID NO 64427 | GGTGTGTGTGATGGTGTACCCT | TTT | chr17 | 42900198 | 42900219 | 42900203 | 42900198 | - |
| SEQ ID NO 64428 | GTGTGTGTGATGGTGTACCCTT | TTG | chr17 | 42900197 | 42900218 | 42900202 | 42900197 | - |

Figure 90 (Cont'd)

| SEQ ID NO | Sequence | | Chr | Pos1 | Pos2 | Pos3 | Pos4 | |
|---|---|---|---|---|---|---|---|---|
| SEQ ID NO 64429 | GTAGTCCCAGCTATTCAGGAGG | CTT | chr17 | 42900175 | 42900196 | 42900180 | 42900175 | - |
| SEQ ID NO 64430 | TAGTCCCAGCTATTCAGGAGGC | TTG | chr17 | 42900174 | 42900195 | 42900179 | 42900174 | - |
| SEQ ID NO 64431 | TTCAGGAGGCTGAGGCAGGAGG | CTA | chr17 | 42900162 | 42900183 | 42900167 | 42900162 | - |
| SEQ ID NO 64432 | AGGAGGCTGAGGCAGGAGGATT | TTC | chr17 | 42900159 | 42900180 | 42900164 | 42900159 | - |
| SEQ ID NO 64433 | AGGCAGGAGGATTGCTTGAGCC | CTG | chr17 | 42900150 | 42900171 | 42900155 | 42900150 | - |
| SEQ ID NO 64434 | CTTGAGCCCAGGAGTTGGAGTC | TTG | chr17 | 42900136 | 42900157 | 42900141 | 42900136 | - |
| SEQ ID NO 64435 | GAGCCCAGGAGTTGGAGTCTGC | CTT | chr17 | 42900133 | 42900154 | 42900138 | 42900133 | - |
| SEQ ID NO 64436 | AGCCCAGGAGTTGGAGTCTGCA | TTG | chr17 | 42900132 | 42900153 | 42900137 | 42900132 | - |
| SEQ ID NO 64437 | GAGTCTGCAGTGAGCTATTGTC | TTG | chr17 | 42900119 | 42900140 | 42900124 | 42900119 | - |
| SEQ ID NO 64438 | CAGTGAGCTATTGTCCCACCGC | CTG | chr17 | 42900112 | 42900133 | 42900117 | 42900112 | - |
| SEQ ID NO 64439 | TTGTCCCACCGCTGCACTACAG | CTA | chr17 | 42900102 | 42900123 | 42900107 | 42900102 | - |
| SEQ ID NO 64440 | TCCCACCGCTGCACTACAGCCT | TTG | chr17 | 42900099 | 42900120 | 42900104 | 42900099 | - |
| SEQ ID NO 64441 | CACTACAGCCTGGGCAATCGAG | CTG | chr17 | 42900088 | 42900109 | 42900093 | 42900088 | - |
| SEQ ID NO 64442 | CAGCCTGGGCAATCGAGCAAGA | CTA | chr17 | 42900083 | 42900104 | 42900088 | 42900083 | - |
| SEQ ID NO 64443 | GGCAATCGAGCAAGACCCCAGT | CTG | chr17 | 42900076 | 42900097 | 42900081 | 42900076 | - |
| SEQ ID NO 64444 | TAAAACAAAACAAAACAAAACA | CTC | chr17 | 42900051 | 42900072 | 42900056 | 42900051 | - |
| SEQ ID NO 64445 | AAACAAAACAAAACAAAACAAA | CTA | chr17 | 42900049 | 42900070 | 42900054 | 42900049 | - |
| SEQ ID NO 64446 | CTATTGTATTGGGGACTATCAT | CTT | chr17 | 42899987 | 42900008 | 42899992 | 42899987 | - |
| SEQ ID NO 64447 | TATTGTATTGGGGACTATCATC | TTC | chr17 | 42899986 | 42900007 | 42899991 | 42899986 | - |
| SEQ ID NO 64448 | TTGTATTGGGGACTATCATCTT | CTA | chr17 | 42899984 | 42900005 | 42899989 | 42899984 | - |
| SEQ ID NO 64449 | TATTGGGGACTATCATCTTGCT | TTG | chr17 | 42899981 | 42900002 | 42899986 | 42899981 | - |
| SEQ ID NO 64450 | GGGACTATCATCTTGCTGGTCT | TTG | chr17 | 42899976 | 42899997 | 42899981 | 42899976 | - |
| SEQ ID NO 64451 | TCATCTTGCTGGTCTTTCCTTA | CTA | chr17 | 42899969 | 42899990 | 42899974 | 42899969 | - |
| SEQ ID NO 64452 | GCTGGTCTTTCCTTAACTGTAT | CTT | chr17 | 42899962 | 42899983 | 42899967 | 42899962 | - |
| SEQ ID NO 64453 | CTGGTCTTTCCTTAACTGTATT | TTG | chr17 | 42899961 | 42899982 | 42899966 | 42899961 | - |
| SEQ ID NO 64454 | GTCTTTCCTTAACTGTATTAGA | CTG | chr17 | 42899958 | 42899979 | 42899963 | 42899958 | - |
| SEQ ID NO 64455 | TCCTTAACTGTATTAGAGTCTA | CTT | chr17 | 42899953 | 42899974 | 42899958 | 42899953 | - |
| SEQ ID NO 64456 | CCTTAACTGTATTAGAGTCTAG | TTT | chr17 | 42899952 | 42899973 | 42899957 | 42899952 | - |
| SEQ ID NO 64457 | CTTAACTGTATTAGAGTCTAGG | TTC | chr17 | 42899951 | 42899972 | 42899956 | 42899951 | - |
| SEQ ID NO 64458 | AACTGTATTAGAGTCTAGGGTC | CTT | chr17 | 42899948 | 42899969 | 42899953 | 42899948 | - |
| SEQ ID NO 64459 | ACTGTATTAGAGTCTAGGGTCT | TTA | chr17 | 42899947 | 42899968 | 42899952 | 42899947 | - |
| SEQ ID NO 64460 | TATTAGAGTCTAGGGTCTGCCT | CTG | chr17 | 42899943 | 42899964 | 42899948 | 42899943 | - |
| SEQ ID NO 64461 | GAGTCTAGGGTCTGCCTCTGGT | TTA | chr17 | 42899938 | 42899959 | 42899943 | 42899938 | - |
| SEQ ID NO 64462 | GGGTCTGCCTCTGGTTTGGGAG | CTA | chr17 | 42899931 | 42899952 | 42899936 | 42899931 | - |
| SEQ ID NO 64463 | CCTCTGGTTTGGGAGATCAACC | CTG | chr17 | 42899924 | 42899945 | 42899929 | 42899924 | - |
| SEQ ID NO 64464 | TGGTTTGGGAGATCAACCCCCT | CTC | chr17 | 42899920 | 42899941 | 42899925 | 42899920 | - |
| SEQ ID NO 64465 | GTTTGGGAGATCAACCCCCTTC | CTG | chr17 | 42899918 | 42899939 | 42899923 | 42899918 | - |
| SEQ ID NO 64466 | GGGAGATCAACCCCCTTCCTGG | TTT | chr17 | 42899914 | 42899935 | 42899919 | 42899914 | - |
| SEQ ID NO 64467 | GGAGATCAACCCCCTTCCTGGT | TTG | chr17 | 42899913 | 42899934 | 42899918 | 42899913 | - |
| SEQ ID NO 64468 | CCTGGTATTGGCCTCATGTCTC | CTT | chr17 | 42899897 | 42899918 | 42899902 | 42899897 | - |
| SEQ ID NO 64469 | CTGGTATTGGCCTCATGTCTCT | TTC | chr17 | 42899896 | 42899917 | 42899901 | 42899896 | - |
| SEQ ID NO 64470 | GTATTGGCCTCATGTCTCTTAG | CTG | chr17 | 42899893 | 42899914 | 42899898 | 42899893 | - |
| SEQ ID NO 64471 | GCCTCATGTCTCTTAGGGCCAG | TTG | chr17 | 42899887 | 42899908 | 42899892 | 42899887 | - |
| SEQ ID NO 64472 | ATGTCTCTTAGGGCCAGAAAGT | CTC | chr17 | 42899882 | 42899903 | 42899887 | 42899882 | - |
| SEQ ID NO 64473 | TTAGGGCCAGAAAGTAATCGTT | CTC | chr17 | 42899875 | 42899896 | 42899880 | 42899875 | - |
| SEQ ID NO 64474 | AGGGCCAGAAAGTAATCGTTTT | CTT | chr17 | 42899873 | 42899894 | 42899878 | 42899873 | - |
| SEQ ID NO 64475 | GGGCCAGAAAGTAATCGTTTTT | TTA | chr17 | 42899872 | 42899893 | 42899877 | 42899872 | - |
| SEQ ID NO 64476 | TTGAATGCAGTGATTAATTCAT | TTT | chr17 | 42899852 | 42899873 | 42899857 | 42899852 | - |
| SEQ ID NO 64477 | TGAATGCAGTGATTAATTCATT | TTT | chr17 | 42899851 | 42899872 | 42899856 | 42899851 | - |
| SEQ ID NO 64478 | GAATGCAGTGATTAATTCATTT | TTT | chr17 | 42899850 | 42899871 | 42899855 | 42899850 | - |
| SEQ ID NO 64479 | AATGCAGTGATTAATTCATTTA | TTG | chr17 | 42899849 | 42899870 | 42899854 | 42899849 | - |
| SEQ ID NO 64480 | ATTCATTTAATGACCTTAAAGT | TTA | chr17 | 42899836 | 42899857 | 42899841 | 42899836 | - |
| SEQ ID NO 64481 | ATTTAATGACCTTAAAGTTACA | TTC | chr17 | 42899832 | 42899853 | 42899837 | 42899832 | - |
| SEQ ID NO 64482 | AATGACCTTAAAGTTACAGCCC | TTT | chr17 | 42899828 | 42899849 | 42899833 | 42899828 | - |
| SEQ ID NO 64483 | ATGACCTTAAAGTTACAGCCCT | TTA | chr17 | 42899827 | 42899848 | 42899832 | 42899827 | - |
| SEQ ID NO 64484 | AAAGTTACAGCCCTTGGTGTTG | CTT | chr17 | 42899819 | 42899840 | 42899824 | 42899819 | - |
| SEQ ID NO 64485 | AAGTTACAGCCCTTGGTGTTGT | TTA | chr17 | 42899818 | 42899839 | 42899823 | 42899818 | - |
| SEQ ID NO 64486 | CAGCCCTTGGTGTTGTTTTCTT | TTA | chr17 | 42899812 | 42899833 | 42899817 | 42899812 | - |

Figure 90 (Cont'd)

| SEQ ID NO 64487 | GGTGTTGTTTTCTTTTTTAAAT | CTT | chr17 | 42899804 | 42899825 | 42899809 | 42899804 | - |
|---|---|---|---|---|---|---|---|---|
| SEQ ID NO 64488 | GTGTTGTTTTCTTTTTTAAATT | TTG | chr17 | 42899803 | 42899824 | 42899808 | 42899803 | - |
| SEQ ID NO 64489 | TTTTCTTTTTTAAATTTTCTCT | TTG | chr17 | 42899797 | 42899818 | 42899802 | 42899797 | - |
| SEQ ID NO 64490 | TCTTTTTTAAATTTTCTCTCTC | TTT | chr17 | 42899794 | 42899815 | 42899799 | 42899794 | - |
| SEQ ID NO 64491 | CTTTTTTAAATTTTCTCTCTCT | TTT | chr17 | 42899793 | 42899814 | 42899798 | 42899793 | - |
| SEQ ID NO 64492 | TTTTTTAAATTTTCTCTCTCTT | TTC | chr17 | 42899792 | 42899813 | 42899797 | 42899792 | - |
| SEQ ID NO 64493 | TTTTAAATTTTCTCTCTCTTTT | CTT | chr17 | 42899790 | 42899811 | 42899795 | 42899790 | - |
| SEQ ID NO 64494 | TTTAAATTTTCTCTCTCTTTTT | TTT | chr17 | 42899789 | 42899810 | 42899794 | 42899789 | - |
| SEQ ID NO 64495 | TTAAATTTTCTCTCTCTTTTTT | TTT | chr17 | 42899788 | 42899809 | 42899793 | 42899788 | - |
| SEQ ID NO 64496 | TAAATTTTCTCTCTCTTTTTTT | TTT | chr17 | 42899787 | 42899808 | 42899792 | 42899787 | - |
| SEQ ID NO 64497 | AAATTTTCTCTCTCTTTTTTTT | TTT | chr17 | 42899786 | 42899807 | 42899791 | 42899786 | - |
| SEQ ID NO 64498 | AATTTTCTCTCTCTTTTTTTTG | TTA | chr17 | 42899785 | 42899806 | 42899790 | 42899785 | - |
| SEQ ID NO 64499 | TCTCTCTCTTTTTTTTGAAACA | TTT | chr17 | 42899780 | 42899801 | 42899785 | 42899780 | - |
| SEQ ID NO 64500 | CTCTCTCTTTTTTTTGAAACAG | TTT | chr17 | 42899779 | 42899800 | 42899784 | 42899779 | - |
| SEQ ID NO 64501 | TCTCTCTTTTTTTTGAAACAGG | TTC | chr17 | 42899778 | 42899799 | 42899783 | 42899778 | - |
| SEQ ID NO 64502 | TCTCTTTTTTTTGAAACAGGGT | CTC | chr17 | 42899776 | 42899797 | 42899781 | 42899776 | - |
| SEQ ID NO 64503 | TCTTTTTTTTGAAACAGGGTCT | CTC | chr17 | 42899774 | 42899795 | 42899779 | 42899774 | - |
| SEQ ID NO 64504 | TTTTTTTTGAAACAGGGTCTCA | CTC | chr17 | 42899772 | 42899793 | 42899777 | 42899772 | - |
| SEQ ID NO 64505 | TTTTTTGAAACAGGGTCTCACT | CTT | chr17 | 42899770 | 42899791 | 42899775 | 42899770 | - |
| SEQ ID NO 64506 | TTTTTGAAACAGGGTCTCACTC | TTT | chr17 | 42899769 | 42899790 | 42899774 | 42899769 | - |
| SEQ ID NO 64507 | TTTTGAAACAGGGTCTCACTCT | TTT | chr17 | 42899768 | 42899789 | 42899773 | 42899768 | - |
| SEQ ID NO 64508 | TTTGAAACAGGGTCTCACTCTG | TTT | chr17 | 42899767 | 42899788 | 42899772 | 42899767 | - |
| SEQ ID NO 64509 | TTGAAACAGGGTCTCACTCTGT | TTT | chr17 | 42899766 | 42899787 | 42899771 | 42899766 | - |
| SEQ ID NO 64510 | TGAAACAGGGTCTCACTCTGTC | TTT | chr17 | 42899765 | 42899786 | 42899770 | 42899765 | - |
| SEQ ID NO 64511 | GAAACAGGGTCTCACTCTGTCT | TTT | chr17 | 42899764 | 42899785 | 42899769 | 42899764 | - |
| SEQ ID NO 64512 | AAACAGGGTCTCACTCTGTCTC | TTG | chr17 | 42899763 | 42899784 | 42899768 | 42899763 | - |
| SEQ ID NO 64513 | ACTCTGTCTCCCAGGCTGGAGT | CTC | chr17 | 42899751 | 42899772 | 42899756 | 42899751 | - |
| SEQ ID NO 64514 | TGTCTCCCAGGCTGGAGTGCAG | CTC | chr17 | 42899747 | 42899768 | 42899752 | 42899747 | - |
| SEQ ID NO 64515 | TCTCCCAGGCTGGAGTGCAGTG | CTG | chr17 | 42899745 | 42899766 | 42899750 | 42899745 | - |
| SEQ ID NO 64516 | CCAGGCTGGAGTGCAGTGGCAT | CTC | chr17 | 42899741 | 42899762 | 42899746 | 42899741 | - |
| SEQ ID NO 64517 | GAGTGCAGTGGCATAATCACGG | CTG | chr17 | 42899733 | 42899754 | 42899738 | 42899733 | - |
| SEQ ID NO 64518 | ACTGCAGCCTCAACCTCCTGGG | CTC | chr17 | 42899708 | 42899729 | 42899713 | 42899708 | - |
| SEQ ID NO 64519 | CAGCCTCAACCTCCTGGGCTAA | CTG | chr17 | 42899704 | 42899725 | 42899709 | 42899704 | - |
| SEQ ID NO 64520 | AACCTCCTGGGCTAATGTGATC | CTC | chr17 | 42899697 | 42899718 | 42899702 | 42899697 | - |
| SEQ ID NO 64521 | CTGGGCTAATGTGATCCTCCCA | CTC | chr17 | 42899691 | 42899712 | 42899696 | 42899691 | - |
| SEQ ID NO 64522 | GGCTAATGTGATCCTCCCACCT | CTG | chr17 | 42899688 | 42899709 | 42899693 | 42899688 | - |
| SEQ ID NO 64523 | ATGTGATCCTCCCACCTCAGCC | CTA | chr17 | 42899683 | 42899704 | 42899688 | 42899683 | - |
| SEQ ID NO 64524 | CCACCTCAGCCTCCTGAGTAGC | CTC | chr17 | 42899672 | 42899693 | 42899677 | 42899672 | - |
| SEQ ID NO 64525 | AGCCTCCTGAGTAGCTGGGACC | CTC | chr17 | 42899665 | 42899686 | 42899670 | 42899665 | - |
| SEQ ID NO 64526 | CTGAGTAGCTGGGACCACAGGC | CTC | chr17 | 42899659 | 42899680 | 42899664 | 42899659 | - |
| SEQ ID NO 64527 | AGTAGCTGGGACCACAGGCACA | CTG | chr17 | 42899656 | 42899677 | 42899661 | 42899656 | - |
| SEQ ID NO 64528 | GGACCACAGGCACACGCCACCA | CTG | chr17 | 42899648 | 42899669 | 42899653 | 42899648 | - |
| SEQ ID NO 64529 | GCTAATTTTTCTATCTTTTGTA | CTG | chr17 | 42899620 | 42899641 | 42899625 | 42899620 | - |
| SEQ ID NO 64530 | ATTTTTCTATCTTTTGTAGAGA | CTA | chr17 | 42899616 | 42899637 | 42899621 | 42899616 | - |
| SEQ ID NO 64531 | TTCTATCTTTTGTAGAGATGGG | TTT | chr17 | 42899612 | 42899633 | 42899617 | 42899612 | - |
| SEQ ID NO 64532 | TCTATCTTTTGTAGAGATGGGG | TTT | chr17 | 42899611 | 42899632 | 42899616 | 42899611 | - |
| SEQ ID NO 64533 | CTATCTTTTGTAGAGATGGGGT | TTT | chr17 | 42899610 | 42899631 | 42899615 | 42899610 | - |
| SEQ ID NO 64534 | TATCTTTTGTAGAGATGGGGTT | TTC | chr17 | 42899609 | 42899630 | 42899614 | 42899609 | - |
| SEQ ID NO 64535 | TCTTTTGTAGAGATGGGGTTTT | CTA | chr17 | 42899607 | 42899628 | 42899612 | 42899607 | - |
| SEQ ID NO 64536 | TTGTAGAGATGGGGTTTTTCCA | CTT | chr17 | 42899603 | 42899624 | 42899608 | 42899603 | - |
| SEQ ID NO 64537 | TGTAGAGATGGGGTTTTTCCAT | TTT | chr17 | 42899602 | 42899623 | 42899607 | 42899602 | - |
| SEQ ID NO 64538 | GTAGAGATGGGGTTTTTCCATG | TTT | chr17 | 42899601 | 42899622 | 42899606 | 42899601 | - |
| SEQ ID NO 64539 | TAGAGATGGGGTTTTTCCATGT | TTG | chr17 | 42899600 | 42899621 | 42899605 | 42899600 | - |
| SEQ ID NO 64540 | TTCCATGTTGCCCAGGCTGGTC | TTT | chr17 | 42899586 | 42899607 | 42899591 | 42899586 | - |
| SEQ ID NO 64541 | TCCATGTTGCCCAGGCTGGTCT | TTT | chr17 | 42899585 | 42899606 | 42899590 | 42899585 | - |
| SEQ ID NO 64542 | CCATGTTGCCCAGGCTGGTCTT | TTT | chr17 | 42899584 | 42899605 | 42899589 | 42899584 | - |
| SEQ ID NO 64543 | CATGTTGCCCAGGCTGGTCTTG | TTC | chr17 | 42899583 | 42899604 | 42899588 | 42899583 | - |
| SEQ ID NO 64544 | CCCAGGCTGGTCTTGAATTCCT | TTG | chr17 | 42899576 | 42899597 | 42899581 | 42899576 | - |

Figure 90 (Cont'd)

| SEQ ID NO 64545 | GTCTTGAATTCCTGAGCTCAAG | CTG | chr17 | 42899567 | 42899588 | 42899572 | 42899567 | - |
|---|---|---|---|---|---|---|---|---|
| SEQ ID NO 64546 | GAATTCCTGAGCTCAAGAGATC | CTT | chr17 | 42899562 | 42899583 | 42899567 | 42899562 | - |
| SEQ ID NO 64547 | AATTCCTGAGCTCAAGAGATCT | TTG | chr17 | 42899561 | 42899582 | 42899566 | 42899561 | - |
| SEQ ID NO 64548 | CTGAGCTCAAGAGATCTGCCAG | TTC | chr17 | 42899556 | 42899577 | 42899561 | 42899556 | - |
| SEQ ID NO 64549 | AGCTCAAGAGATCTGCCAGTCT | CTG | chr17 | 42899553 | 42899574 | 42899558 | 42899553 | - |
| SEQ ID NO 64550 | AAGAGATCTGCCAGTCTTGGCT | CTC | chr17 | 42899548 | 42899569 | 42899553 | 42899548 | - |
| SEQ ID NO 64551 | CCAGTCTTGGCTTCCCAAAGCT | CTG | chr17 | 42899538 | 42899559 | 42899543 | 42899538 | - |
| SEQ ID NO 64552 | GGCTTCCCAAAGCTCTGGGATT | CTT | chr17 | 42899530 | 42899551 | 42899535 | 42899530 | - |
| SEQ ID NO 64553 | GCTTCCCAAAGCTCTGGGATTA | TTG | chr17 | 42899529 | 42899550 | 42899534 | 42899529 | - |
| SEQ ID NO 64554 | CCCAAAGCTCTGGGATTACAGG | CTT | chr17 | 42899525 | 42899546 | 42899530 | 42899525 | - |
| SEQ ID NO 64555 | CCAAAGCTCTGGGATTACAGGT | TTC | chr17 | 42899524 | 42899545 | 42899529 | 42899524 | - |
| SEQ ID NO 64556 | TGGGATTACAGGTGTGAACCAC | CTC | chr17 | 42899515 | 42899536 | 42899520 | 42899515 | - |
| SEQ ID NO 64557 | GGATTACAGGTGTGAACCACCA | CTG | chr17 | 42899513 | 42899534 | 42899518 | 42899513 | - |
| SEQ ID NO 64558 | CAGGTGTGAACCACCATGCCTG | TTA | chr17 | 42899507 | 42899528 | 42899512 | 42899507 | - |
| SEQ ID NO 64559 | GCCAAGTGTTTTAACTCATACG | CTG | chr17 | 42899485 | 42899506 | 42899490 | 42899485 | - |
| SEQ ID NO 64560 | TAACTCATACGTTTAAGCAAAA | TTT | chr17 | 42899474 | 42899495 | 42899479 | 42899474 | - |
| SEQ ID NO 64561 | AACTCATACGTTTAAGCAAAAT | TTT | chr17 | 42899473 | 42899494 | 42899478 | 42899473 | - |
| SEQ ID NO 64562 | ACTCATACGTTTAAGCAAAATA | TTA | chr17 | 42899472 | 42899493 | 42899477 | 42899472 | - |
| SEQ ID NO 64563 | ATACGTTTAAGCAAAATAATGA | CTC | chr17 | 42899468 | 42899489 | 42899473 | 42899468 | - |
| SEQ ID NO 64564 | AAGCAAAATAATGAATGTATAG | TTT | chr17 | 42899460 | 42899481 | 42899465 | 42899460 | - |
| SEQ ID NO 64565 | AGCAAAATAATGAATGTATAGT | TTA | chr17 | 42899459 | 42899480 | 42899464 | 42899459 | - |
| SEQ ID NO 64566 | ACTGTGCAACAATATGATGAAT | CTT | chr17 | 42899434 | 42899455 | 42899439 | 42899434 | - |
| SEQ ID NO 64567 | CTGTGCAACAATATGATGAATG | TTA | chr17 | 42899433 | 42899454 | 42899438 | 42899433 | - |
| SEQ ID NO 64568 | TGCAACAATATGATGAATGTAT | CTG | chr17 | 42899430 | 42899451 | 42899435 | 42899430 | - |
| SEQ ID NO 64569 | CAAATAAGAATACCAGCAAAAT | TTC | chr17 | 42899403 | 42899424 | 42899408 | 42899403 | - |
| SEQ ID NO 64570 | GAGACTTAAAGAGTTTGAAACT | CTG | chr17 | 42899373 | 42899394 | 42899378 | 42899373 | - |
| SEQ ID NO 64571 | AAAGAGTTTGAAACTTTCAGTT | CTT | chr17 | 42899366 | 42899387 | 42899371 | 42899366 | - |
| SEQ ID NO 64572 | AAGAGTTTGAAACTTTCAGTTA | TTA | chr17 | 42899365 | 42899386 | 42899370 | 42899365 | - |
| SEQ ID NO 64573 | GAAACTTTCAGTTATTTTTGAA | TTT | chr17 | 42899357 | 42899378 | 42899362 | 42899357 | - |
| SEQ ID NO 64574 | AAACTTTCAGTTATTTTTGAAA | TTG | chr17 | 42899356 | 42899377 | 42899361 | 42899356 | - |
| SEQ ID NO 64575 | TCAGTTATTTTTGAAAAGGGC | CTT | chr17 | 42899350 | 42899371 | 42899355 | 42899350 | - |
| SEQ ID NO 64576 | CAGTTATTTTTGAAAAGGGCT | TTT | chr17 | 42899349 | 42899370 | 42899354 | 42899349 | - |
| SEQ ID NO 64577 | AGTTATTTTTGAAAAGGGCTT | TTC | chr17 | 42899348 | 42899369 | 42899353 | 42899348 | - |
| SEQ ID NO 64578 | TTTTTGAAAAGGGCTTCTATA | TTA | chr17 | 42899343 | 42899364 | 42899348 | 42899343 | - |
| SEQ ID NO 64579 | TTGAAAAGGGCTTCTATATCT | TTT | chr17 | 42899340 | 42899361 | 42899345 | 42899340 | - |
| SEQ ID NO 64580 | TGAAAAGGGCTTCTATATCTT | TTT | chr17 | 42899339 | 42899360 | 42899344 | 42899339 | - |
| SEQ ID NO 64581 | GAAAAGGGCTTCTATATCTTG | TTT | chr17 | 42899338 | 42899359 | 42899343 | 42899338 | - |
| SEQ ID NO 64582 | AAAAGGGCTTCTATATCTTGA | TTG | chr17 | 42899337 | 42899358 | 42899342 | 42899337 | - |
| SEQ ID NO 64583 | CTATATCTTGAGCTTTCTTATA | CTT | chr17 | 42899326 | 42899347 | 42899331 | 42899326 | - |
| SEQ ID NO 64584 | TATATCTTGAGCTTTCTTATAC | TTC | chr17 | 42899325 | 42899346 | 42899330 | 42899325 | - |
| SEQ ID NO 64585 | TATCTTGAGCTTTCTTATACAT | CTA | chr17 | 42899323 | 42899344 | 42899328 | 42899323 | - |
| SEQ ID NO 64586 | GAGCTTTCTTATACATATGTGT | CTT | chr17 | 42899317 | 42899338 | 42899322 | 42899317 | - |
| SEQ ID NO 64587 | AGCTTTCTTATACATATGTGTG | TTG | chr17 | 42899316 | 42899337 | 42899321 | 42899316 | - |
| SEQ ID NO 64588 | TCTTATACATATGTGTGTAGAT | CTT | chr17 | 42899311 | 42899332 | 42899316 | 42899311 | - |
| SEQ ID NO 64589 | CTTATACATATGTGTGTAGATA | TTT | chr17 | 42899310 | 42899331 | 42899315 | 42899310 | - |
| SEQ ID NO 64590 | TTATACATATGTGTGTAGATAT | TTC | chr17 | 42899309 | 42899330 | 42899314 | 42899309 | - |
| SEQ ID NO 64591 | ATACATATGTGTGTAGATATAC | CTT | chr17 | 42899307 | 42899328 | 42899312 | 42899307 | - |
| SEQ ID NO 64592 | TACATATGTGTGTAGATATACA | TTA | chr17 | 42899306 | 42899327 | 42899311 | 42899306 | - |
| SEQ ID NO 64593 | AAGATACACTGTGTGTGTGTAT | CTC | chr17 | 42899273 | 42899294 | 42899278 | 42899273 | - |
| SEQ ID NO 64594 | TGTGTGTGTATATGTGTGTGTG | CTG | chr17 | 42899262 | 42899283 | 42899267 | 42899262 | - |
| SEQ ID NO 64595 | TATATCAGCCTACAAATAGTAG | CTA | chr17 | 42899223 | 42899244 | 42899228 | 42899223 | - |
| SEQ ID NO 64596 | CAAATAGTAGAGAGACCAAAC | CTA | chr17 | 42899211 | 42899232 | 42899216 | 42899211 | - |
| SEQ ID NO 64597 | ACACTTGGGTCACGGAGGACTG | CTA | chr17 | 42899185 | 42899206 | 42899190 | 42899185 | - |
| SEQ ID NO 64598 | GGGTCACGGAGGACTGTGAAAG | CTT | chr17 | 42899179 | 42899200 | 42899184 | 42899179 | - |
| SEQ ID NO 64599 | GGTCACGGAGGACTGTGAAAGG | TTG | chr17 | 42899178 | 42899199 | 42899183 | 42899178 | - |
| SEQ ID NO 64600 | TGAAAGGAACCAGGGAATGAAT | CTG | chr17 | 42899163 | 42899184 | 42899168 | 42899163 | - |
| SEQ ID NO 64601 | ATGCATTTTAAAAAATAGGGCT | CTC | chr17 | 42899127 | 42899148 | 42899132 | 42899127 | - |
| SEQ ID NO 64602 | TAAAAAATAGGGCTATTTAATC | TTT | chr17 | 42899119 | 42899140 | 42899124 | 42899119 | - |

Figure 90 (Cont'd)

| SEQ ID NO 64603 | AAAAAATAGGGCTATTTAATCA | TTT | chr17 | 42899118 | 42899139 | 42899123 | 42899118 | - |
|---|---|---|---|---|---|---|---|---|
| SEQ ID NO 64604 | AAAAATAGGGCTATTTAATCAT | TTA | chr17 | 42899117 | 42899138 | 42899122 | 42899117 | - |
| SEQ ID NO 64605 | TTTAATCATGCTTCATATCACT | CTA | chr17 | 42899104 | 42899125 | 42899109 | 42899104 | - |
| SEQ ID NO 64606 | AATCATGCTTCATATCACTATT | TTT | chr17 | 42899101 | 42899122 | 42899106 | 42899101 | - |
| SEQ ID NO 64607 | ATCATGCTTCATATCACTATTA | TTA | chr17 | 42899100 | 42899121 | 42899105 | 42899100 | - |
| SEQ ID NO 64608 | CATATCACTATTATTTATTATT | CTT | chr17 | 42899091 | 42899112 | 42899096 | 42899091 | - |
| SEQ ID NO 64609 | ATATCACTATTATTTATTATTT | TTC | chr17 | 42899090 | 42899111 | 42899095 | 42899090 | - |
| SEQ ID NO 64610 | TTATTTATTTATTTATTTA | CTA | chr17 | 42899081 | 42899102 | 42899086 | 42899081 | - |
| SEQ ID NO 64611 | TTTATTATTTATTTATTTATTT | TTA | chr17 | 42899078 | 42899099 | 42899083 | 42899078 | - |
| SEQ ID NO 64612 | ATTATTTATTTATTTATTTTTG | TTT | chr17 | 42899075 | 42899096 | 42899080 | 42899075 | - |
| SEQ ID NO 64613 | TTATTTATTTATTTATTTTTGT | TTA | chr17 | 42899074 | 42899095 | 42899079 | 42899074 | - |
| SEQ ID NO 64614 | TTTATTTATTTATTTTTGTAGA | TTA | chr17 | 42899071 | 42899092 | 42899076 | 42899071 | - |
| SEQ ID NO 64615 | ATTTATTTATTTTTGTAGAAAC | TTT | chr17 | 42899068 | 42899089 | 42899073 | 42899068 | - |
| SEQ ID NO 64616 | TTTATTTATTTTTGTAGAAACG | TTA | chr17 | 42899067 | 42899088 | 42899072 | 42899067 | - |
| SEQ ID NO 64617 | ATTTATTTTTGTAGAAACGGGG | TTT | chr17 | 42899064 | 42899085 | 42899069 | 42899064 | - |
| SEQ ID NO 64618 | TTTATTTTTGTAGAAACGGGGT | TTA | chr17 | 42899063 | 42899084 | 42899068 | 42899063 | - |
| SEQ ID NO 64619 | ATTTTTGTAGAAACGGGGTCTC | TTT | chr17 | 42899060 | 42899081 | 42899065 | 42899060 | - |
| SEQ ID NO 64620 | TTTTTGTAGAAACGGGGTCTCA | TTA | chr17 | 42899059 | 42899080 | 42899064 | 42899059 | - |
| SEQ ID NO 64621 | TTGTAGAAACGGGGTCTCACTA | TTT | chr17 | 42899056 | 42899077 | 42899061 | 42899056 | - |
| SEQ ID NO 64622 | TGTAGAAACGGGGTCTCACTAT | TTT | chr17 | 42899055 | 42899076 | 42899060 | 42899055 | - |
| SEQ ID NO 64623 | GTAGAAACGGGGTCTCACTATG | TTT | chr17 | 42899054 | 42899075 | 42899059 | 42899054 | - |
| SEQ ID NO 64624 | TAGAAACGGGGTCTCACTATGC | TTG | chr17 | 42899053 | 42899074 | 42899058 | 42899053 | - |
| SEQ ID NO 64625 | ACTATGCGGCCCAGGCTGGTCT | CTC | chr17 | 42899038 | 42899059 | 42899043 | 42899038 | - |
| SEQ ID NO 64626 | TGCGGCCCAGGCTGGTCTCAAA | CTA | chr17 | 42899034 | 42899055 | 42899039 | 42899034 | - |
| SEQ ID NO 64627 | GTCTCAAATTCCTGGCTTCAAG | CTG | chr17 | 42899020 | 42899041 | 42899025 | 42899020 | - |
| SEQ ID NO 64628 | AAATTCCTGGCTTCAAGTGATC | CTC | chr17 | 42899015 | 42899036 | 42899020 | 42899015 | - |
| SEQ ID NO 64629 | CTGGCTTCAAGTGATCCTCCCG | TTC | chr17 | 42899009 | 42899030 | 42899014 | 42899009 | - |
| SEQ ID NO 64630 | GCTTCAAGTGATCCTCCCGCCT | CTG | chr17 | 42899006 | 42899027 | 42899011 | 42899006 | - |
| SEQ ID NO 64631 | CAAGTGATCCTCCCGCCTCAAC | CTT | chr17 | 42899002 | 42899023 | 42899007 | 42899002 | - |
| SEQ ID NO 64632 | AAGTGATCCTCCCGCCTCAACC | TTC | chr17 | 42899001 | 42899022 | 42899006 | 42899001 | - |
| SEQ ID NO 64633 | CCGCCTCAACCTAGCAAAGCAT | CTC | chr17 | 42898990 | 42899011 | 42898995 | 42898990 | - |
| SEQ ID NO 64634 | AACCTAGCAAAGCATTGGGATT | CTC | chr17 | 42898983 | 42899004 | 42898988 | 42898983 | - |
| SEQ ID NO 64635 | GCAAAGCATTGGGATTACAGGC | CTA | chr17 | 42898977 | 42898998 | 42898982 | 42898977 | - |
| SEQ ID NO 64636 | GGATTACAGGCATGAGCCACTG | TTG | chr17 | 42898966 | 42898987 | 42898971 | 42898966 | - |
| SEQ ID NO 64637 | CAGGCATGAGCCACTGCCTCCA | TTA | chr17 | 42898960 | 42898981 | 42898965 | 42898960 | - |
| SEQ ID NO 64638 | CCTCCAAATTCATGCATTTTTT | CTG | chr17 | 42898944 | 42898965 | 42898949 | 42898944 | - |
| SEQ ID NO 64639 | CAAATTCATGCATTTTTTGAGG | CTC | chr17 | 42898940 | 42898961 | 42898945 | 42898940 | - |
| SEQ ID NO 64640 | ATGCATTTTTTGAGGATAAGAG | TTC | chr17 | 42898933 | 42898954 | 42898938 | 42898933 | - |
| SEQ ID NO 64641 | TTTGAGGATAAGAGCCAGGGGG | TTT | chr17 | 42898925 | 42898946 | 42898930 | 42898925 | - |
| SEQ ID NO 64642 | TTGAGGATAAGAGCCAGGGGGA | TTT | chr17 | 42898924 | 42898945 | 42898929 | 42898924 | - |
| SEQ ID NO 64643 | TGAGGATAAGAGCCAGGGGGAA | TTT | chr17 | 42898923 | 42898944 | 42898928 | 42898923 | - |
| SEQ ID NO 64644 | GAGGATAAGAGCCAGGGGGAAT | TTT | chr17 | 42898922 | 42898943 | 42898927 | 42898922 | - |
| SEQ ID NO 64645 | AGGATAAGAGCCAGGGGGAATA | TTG | chr17 | 42898921 | 42898942 | 42898926 | 42898921 | - |
| SEQ ID NO 64646 | AAAAACTTGCCTGAATTTCCCA | TTT | chr17 | 42898891 | 42898912 | 42898896 | 42898891 | - |
| SEQ ID NO 64647 | AAAACTTGCCTGAATTTCCCAT | TTA | chr17 | 42898890 | 42898911 | 42898895 | 42898890 | - |
| SEQ ID NO 64648 | GCCTGAATTTCCCATCATTAAG | CTT | chr17 | 42898883 | 42898904 | 42898888 | 42898883 | - |
| SEQ ID NO 64649 | CCTGAATTTCCCATCATTAAGT | TTG | chr17 | 42898882 | 42898903 | 42898887 | 42898882 | - |
| SEQ ID NO 64650 | AATTTCCCATCATTAAGTCCAT | CTG | chr17 | 42898878 | 42898899 | 42898883 | 42898878 | - |
| SEQ ID NO 64651 | CCCATCATTAAGTCCATATTGA | TTT | chr17 | 42898873 | 42898894 | 42898878 | 42898873 | - |
| SEQ ID NO 64652 | CCATCATTAAGTCCATATTGAC | TTC | chr17 | 42898872 | 42898893 | 42898877 | 42898872 | - |
| SEQ ID NO 64653 | AGTCCATATTGACATGTAAGGG | TTA | chr17 | 42898863 | 42898884 | 42898868 | 42898863 | - |
| SEQ ID NO 64654 | ACATGTAAGGGGTAGCTGGGGA | TTG | chr17 | 42898852 | 42898873 | 42898857 | 42898852 | - |
| SEQ ID NO 64655 | GGGACAGAAAAAAGAAACTCAG | CTG | chr17 | 42898834 | 42898855 | 42898839 | 42898834 | - |
| SEQ ID NO 64656 | AGAGCTAATGAATCGTGGCAA | CTC | chr17 | 42898814 | 42898835 | 42898819 | 42898814 | - |
| SEQ ID NO 64657 | ATGAATCGTGGCAAAAGTTGA | CTA | chr17 | 42898807 | 42898828 | 42898812 | 42898807 | - |
| SEQ ID NO 64658 | TGGCAAAAGTTGACAGCATTCC | CTG | chr17 | 42898798 | 42898819 | 42898803 | 42898798 | - |
| SEQ ID NO 64659 | ACAGCATTCCATGCTGGAAATG | TTG | chr17 | 42898786 | 42898807 | 42898791 | 42898786 | - |
| SEQ ID NO 64660 | CATGCTGGAAATGATTAAAACA | TTC | chr17 | 42898777 | 42898798 | 42898782 | 42898777 | - |

Figure 90 (Cont'd)

| | | | | | | | | |
|---|---|---|---|---|---|---|---|---|
| SEQ ID NO 64661 | GAAATGATTAAAACATCCTCCA | CTG | chr17 | 42898770 | 42898791 | 42898775 | 42898770 | - |
| SEQ ID NO 64662 | AAACATCCTCCAGGAGGTATGA | TTA | chr17 | 42898760 | 42898781 | 42898765 | 42898760 | - |
| SEQ ID NO 64663 | CAGGAGGTATGACCTGGAGTCT | CTC | chr17 | 42898750 | 42898771 | 42898755 | 42898750 | - |
| SEQ ID NO 64664 | GAGTCTCCTCCCCACCCCACCA | CTG | chr17 | 42898734 | 42898755 | 42898739 | 42898734 | - |
| SEQ ID NO 64665 | CTCCCCACCCCACCAAGGGCTC | CTC | chr17 | 42898727 | 42898748 | 42898732 | 42898727 | - |
| SEQ ID NO 64666 | CCCACCCCACCAAGGGCTCGCA | CTC | chr17 | 42898724 | 42898745 | 42898729 | 42898724 | - |
| SEQ ID NO 64667 | GCACCCAGCCCATGCTGACTCC | CTC | chr17 | 42898705 | 42898726 | 42898710 | 42898705 | - |
| SEQ ID NO 64668 | ACTCCAGTTGTCCTTGACTGCA | CTG | chr17 | 42898688 | 42898709 | 42898693 | 42898688 | - |
| SEQ ID NO 64669 | CAGTTGTCCTTGACTGCATGGT | CTC | chr17 | 42898684 | 42898705 | 42898689 | 42898684 | - |
| SEQ ID NO 64670 | TCCTTGACTGCATGGTTTCTGC | TTG | chr17 | 42898678 | 42898699 | 42898683 | 42898678 | - |
| SEQ ID NO 64671 | GACTGCATGGTTTCTGCTGGTC | CTT | chr17 | 42898673 | 42898694 | 42898678 | 42898673 | - |
| SEQ ID NO 64672 | ACTGCATGGTTTCTGCTGGTCC | TTG | chr17 | 42898672 | 42898693 | 42898677 | 42898672 | - |
| SEQ ID NO 64673 | CATGGTTTCTGCTGGTCCAAGC | CTG | chr17 | 42898668 | 42898689 | 42898673 | 42898668 | - |
| SEQ ID NO 64674 | CTGCTGGTCCAAGCAAACTTCT | TTT | chr17 | 42898660 | 42898681 | 42898665 | 42898660 | - |
| SEQ ID NO 64675 | TGCTGGTCCAAGCAAACTTCTC | TTC | chr17 | 42898659 | 42898680 | 42898664 | 42898659 | - |
| SEQ ID NO 64676 | CTGGTCCAAGCAAACTTCTCCT | CTG | chr17 | 42898657 | 42898678 | 42898662 | 42898657 | - |
| SEQ ID NO 64677 | GTCCAAGCAAACTTCTCCTGCC | CTG | chr17 | 42898654 | 42898675 | 42898659 | 42898654 | - |
| SEQ ID NO 64678 | CTCCTGCCACGCCTAACCTTGG | CTT | chr17 | 42898640 | 42898661 | 42898645 | 42898640 | - |
| SEQ ID NO 64679 | TCCTGCCACGCCTAACCTTGGA | TTC | chr17 | 42898639 | 42898660 | 42898644 | 42898639 | - |
| SEQ ID NO 64680 | CTGCCACGCCTAACCTTGGAGA | CTC | chr17 | 42898637 | 42898658 | 42898642 | 42898637 | - |
| SEQ ID NO 64681 | CCACGCCTAACCTTGGAGAGCA | CTG | chr17 | 42898634 | 42898655 | 42898639 | 42898634 | - |
| SEQ ID NO 64682 | ACCTTGGAGAGCAGGTAATGTG | CTA | chr17 | 42898625 | 42898646 | 42898630 | 42898625 | - |
| SEQ ID NO 64683 | GGAGAGCAGGTAATGTGTTGGT | CTT | chr17 | 42898620 | 42898641 | 42898625 | 42898620 | - |
| SEQ ID NO 64684 | GAGAGCAGGTAATGTGTTGGTG | TTG | chr17 | 42898619 | 42898640 | 42898624 | 42898619 | - |
| SEQ ID NO 64685 | GTGACTGTGGGTGGGTGTAAAG | TTG | chr17 | 42898600 | 42898621 | 42898605 | 42898600 | - |
| SEQ ID NO 64686 | TGGGTGGGTGTAAAGTAAGCCC | CTG | chr17 | 42898593 | 42898614 | 42898598 | 42898593 | - |
| SEQ ID NO 64687 | GGGCGTGGGGTATATGTGATCT | CTG | chr17 | 42898551 | 42898572 | 42898556 | 42898551 | - |
| SEQ ID NO 64688 | CACTGTCAGGGCTGCTGGGCCA | CTG | chr17 | 42898528 | 42898549 | 42898533 | 42898528 | - |
| SEQ ID NO 64689 | TCAGGGCTGCTGGGCCATAGGT | CTG | chr17 | 42898523 | 42898544 | 42898528 | 42898523 | - |
| SEQ ID NO 64690 | CTGGGCCATAGGTAGGGAGCCT | CTG | chr17 | 42898514 | 42898535 | 42898519 | 42898514 | - |
| SEQ ID NO 64691 | GGCCATAGGTAGGGAGCCTCCC | CTG | chr17 | 42898511 | 42898532 | 42898516 | 42898511 | - |
| SEQ ID NO 64692 | CCTCTACCCAGATAAGCCTCTG | CTC | chr17 | 42898491 | 42898512 | 42898496 | 42898491 | - |
| SEQ ID NO 64693 | TACCCAGATAAGCCTCTGTTGT | CTC | chr17 | 42898487 | 42898508 | 42898492 | 42898487 | - |
| SEQ ID NO 64694 | CCCAGATAAGCCTCTGTTGTGG | CTA | chr17 | 42898485 | 42898506 | 42898490 | 42898485 | - |
| SEQ ID NO 64695 | TGTTGTGGAGTAACTATTGCAG | CTC | chr17 | 42898471 | 42898492 | 42898476 | 42898471 | - |
| SEQ ID NO 64696 | TTGTGGAGTAACTATTGCAGTG | CTG | chr17 | 42898469 | 42898490 | 42898474 | 42898469 | - |
| SEQ ID NO 64697 | TGGAGTAACTATTGCAGTGACC | TTG | chr17 | 42898466 | 42898487 | 42898471 | 42898466 | - |
| SEQ ID NO 64698 | TTGCAGTGACCTCTGGGATGAG | CTA | chr17 | 42898455 | 42898476 | 42898460 | 42898455 | - |
| SEQ ID NO 64699 | CAGTGACCTCTGGGATGAGAGT | TTG | chr17 | 42898452 | 42898473 | 42898457 | 42898452 | - |
| SEQ ID NO 64700 | TGGGATGAGAGTTTCTATGGTC | CTC | chr17 | 42898442 | 42898463 | 42898447 | 42898442 | - |
| SEQ ID NO 64701 | GGATGAGAGTTTCTATGGTCAG | CTG | chr17 | 42898440 | 42898461 | 42898445 | 42898440 | - |
| SEQ ID NO 64702 | CTATGGTCAGAGGTGAGTCAAG | TTT | chr17 | 42898428 | 42898449 | 42898433 | 42898428 | - |
| SEQ ID NO 64703 | TATGGTCAGAGGTGAGTCAAGG | TTC | chr17 | 42898427 | 42898448 | 42898432 | 42898427 | - |
| SEQ ID NO 64704 | TGGTCAGAGGTGAGTCAAGGTG | CTA | chr17 | 42898425 | 42898446 | 42898430 | 42898425 | - |
| SEQ ID NO 64705 | AAAACATATACAAAGGCCACTG | CTA | chr17 | 42898397 | 42898418 | 42898402 | 42898397 | - |
| SEQ ID NO 64706 | TCTGGGTCATGCCAGGGCAGCT | CTG | chr17 | 42898375 | 42898396 | 42898380 | 42898375 | - |
| SEQ ID NO 64707 | GGTCATGCCAGGGCAGCTAGCA | CTG | chr17 | 42898371 | 42898392 | 42898376 | 42898371 | - |
| SEQ ID NO 64708 | GCAGCCAGGGTCTCTGAGTTGG | CTA | chr17 | 42898352 | 42898373 | 42898357 | 42898352 | - |
| SEQ ID NO 64709 | TGAGTTGGGAGGGGTTCTATTA | CTC | chr17 | 42898338 | 42898359 | 42898343 | 42898338 | - |
| SEQ ID NO 64710 | AGTTGGGAGGGGTTCTATTATG | CTG | chr17 | 42898336 | 42898357 | 42898341 | 42898336 | - |
| SEQ ID NO 64711 | GGAGGGGTTCTATTATGTGGTC | TTG | chr17 | 42898331 | 42898352 | 42898336 | 42898331 | - |
| SEQ ID NO 64712 | TATTATGTGGTCAGCATATGGG | TTC | chr17 | 42898321 | 42898342 | 42898326 | 42898321 | - |
| SEQ ID NO 64713 | TTATGTGGTCAGCATATGGGA | CTA | chr17 | 42898319 | 42898340 | 42898324 | 42898319 | - |
| SEQ ID NO 64714 | TGTGGTCAGCATATGGGAGGG | TTA | chr17 | 42898316 | 42898337 | 42898321 | 42898316 | - |
| SEQ ID NO 64715 | TTTTCTGAGACGCCTCAGGAAG | CTG | chr17 | 42898289 | 42898310 | 42898294 | 42898289 | - |
| SEQ ID NO 64716 | TCTGAGACGCCTCAGGAAGAAT | TTT | chr17 | 42898286 | 42898307 | 42898291 | 42898286 | - |
| SEQ ID NO 64717 | CTGAGACGCCTCAGGAAGAATA | TTT | chr17 | 42898285 | 42898306 | 42898290 | 42898285 | - |
| SEQ ID NO 64718 | TGAGACGCCTCAGGAAGAATAC | TTC | chr17 | 42898284 | 42898305 | 42898289 | 42898284 | - |

Figure 90 (Cont'd)

| | | | | | | | | |
|---|---|---|---|---|---|---|---|---|
| SEQ ID NO 64719 | AGACGCCTCAGGAAGAATACCC | CTG | chr17 | 42898282 | 42898303 | 42898287 | 42898282 | - |
| SEQ ID NO 64720 | AGGAAGAATACCCCTATGGATA | CTC | chr17 | 42898273 | 42898294 | 42898278 | 42898273 | - |
| SEQ ID NO 64721 | TGGATAAGGAGTTGATAAGTGA | CTA | chr17 | 42898257 | 42898278 | 42898262 | 42898257 | - |
| SEQ ID NO 64722 | ATAAGTGATGGAGTTGACATCC | TTG | chr17 | 42898243 | 42898264 | 42898248 | 42898243 | - |
| SEQ ID NO 64723 | ACATCCCACTCTGGGCATCCAG | TTG | chr17 | 42898227 | 42898248 | 42898232 | 42898227 | - |
| SEQ ID NO 64724 | TGGGCATCCAGGGACAGTGGGA | CTC | chr17 | 42898216 | 42898237 | 42898221 | 42898216 | - |
| SEQ ID NO 64725 | GGCATCCAGGGACAGTGGGAGT | CTG | chr17 | 42898214 | 42898235 | 42898219 | 42898214 | - |
| SEQ ID NO 64726 | CCTGGCGGTGGGCCACCAGGCA | CTT | chr17 | 42898189 | 42898210 | 42898194 | 42898189 | - |
| SEQ ID NO 64727 | CTGGCGGTGGGCCACCAGGCAG | TTC | chr17 | 42898188 | 42898209 | 42898193 | 42898188 | - |
| SEQ ID NO 64728 | GCGGTGGGCCACCAGGCAGGGG | CTG | chr17 | 42898185 | 42898206 | 42898190 | 42898185 | - |
| SEQ ID NO 64729 | TGGATCAGAGCAACCTCATAGT | CTC | chr17 | 42898156 | 42898177 | 42898161 | 42898156 | - |
| SEQ ID NO 64730 | GATCAGAGCAACCTCATAGTCA | CTG | chr17 | 42898154 | 42898175 | 42898159 | 42898154 | - |
| SEQ ID NO 64731 | ATAGTCATGAGACGATGAGCTG | CTC | chr17 | 42898139 | 42898160 | 42898144 | 42898139 | - |
| SEQ ID NO 64732 | GTCCTCATCTTTCCACCTGCCA | CTG | chr17 | 42898117 | 42898138 | 42898122 | 42898117 | - |
| SEQ ID NO 64733 | ATCTTTCCACCTGCCAGCCCCT | CTC | chr17 | 42898111 | 42898132 | 42898116 | 42898111 | - |
| SEQ ID NO 64734 | TCCACCTGCCAGCCCCTTTCTG | CTT | chr17 | 42898106 | 42898127 | 42898111 | 42898106 | - |
| SEQ ID NO 64735 | CCACCTGCCAGCCCCTTTCTGC | TTT | chr17 | 42898105 | 42898126 | 42898110 | 42898105 | - |
| SEQ ID NO 64736 | CACCTGCCAGCCCCTTTCTGCT | TTC | chr17 | 42898104 | 42898125 | 42898109 | 42898104 | - |
| SEQ ID NO 64737 | CCAGCCCCTTTCTGCTTCCTCC | CTG | chr17 | 42898098 | 42898119 | 42898103 | 42898098 | - |
| SEQ ID NO 64738 | TCTGCTTCCTCCAGCACGTTTT | CTT | chr17 | 42898088 | 42898109 | 42898093 | 42898088 | - |
| SEQ ID NO 64739 | CTGCTTCCTCCAGCACGTTTTT | TTT | chr17 | 42898087 | 42898108 | 42898092 | 42898087 | - |
| SEQ ID NO 64740 | TGCTTCCTCCAGCACGTTTTTA | TTC | chr17 | 42898086 | 42898107 | 42898091 | 42898086 | - |
| SEQ ID NO 64741 | CTTCCTCCAGCACGTTTTTATC | CTG | chr17 | 42898084 | 42898105 | 42898089 | 42898084 | - |
| SEQ ID NO 64742 | CCTCCAGCACGTTTTTATCCGT | CTT | chr17 | 42898081 | 42898102 | 42898086 | 42898081 | - |
| SEQ ID NO 64743 | CTCCAGCACGTTTTTATCCGTG | TTC | chr17 | 42898080 | 42898101 | 42898085 | 42898080 | - |
| SEQ ID NO 64744 | CAGCACGTTTTTATCCGTGGGA | CTC | chr17 | 42898077 | 42898098 | 42898082 | 42898077 | - |
| SEQ ID NO 64745 | TTATCCGTGGGAAAACAGGTGA | TTT | chr17 | 42898067 | 42898088 | 42898072 | 42898067 | - |
| SEQ ID NO 64746 | TATCCGTGGGAAAACAGGTGAG | TTT | chr17 | 42898066 | 42898087 | 42898071 | 42898066 | - |
| SEQ ID NO 64747 | ATCCGTGGGAAAACAGGTGAGG | TTT | chr17 | 42898065 | 42898086 | 42898070 | 42898065 | - |
| SEQ ID NO 64748 | TCCGTGGGAAAACAGGTGAGGC | TTA | chr17 | 42898064 | 42898085 | 42898069 | 42898064 | - |
| SEQ ID NO 64749 | GTTAGAAAGCTGACTGCATCGA | CTT | chr17 | 42898034 | 42898055 | 42898039 | 42898034 | - |
| SEQ ID NO 64750 | TTAGAAAGCTGACTGCATCGAG | TTG | chr17 | 42898033 | 42898054 | 42898038 | 42898033 | - |
| SEQ ID NO 64751 | GAAAGCTGACTGCATCGAGACA | TTA | chr17 | 42898030 | 42898051 | 42898035 | 42898030 | - |
| SEQ ID NO 64752 | ACTGCATCGAGACACCGTGGAT | CTG | chr17 | 42898022 | 42898043 | 42898027 | 42898022 | - |
| SEQ ID NO 64753 | CATCGAGACACCGTGGATTCTC | CTG | chr17 | 42898018 | 42898039 | 42898023 | 42898018 | - |
| SEQ ID NO 64754 | TCAAAGGTCTTGTGGATATATG | TTC | chr17 | 42897998 | 42898019 | 42898003 | 42897998 | - |
| SEQ ID NO 64755 | AAAGGTCTTGTGGATATATGAG | CTC | chr17 | 42897996 | 42898017 | 42898001 | 42897996 | - |
| SEQ ID NO 64756 | GTGGATATATGAGGCGAGTGGC | CTT | chr17 | 42897987 | 42898008 | 42897992 | 42897987 | - |
| SEQ ID NO 64757 | TGGATATATGAGGCGAGTGGCT | TTG | chr17 | 42897986 | 42898007 | 42897991 | 42897986 | - |
| SEQ ID NO 64758 | GAAGTTTTGCTGAGAATCCACT | CTA | chr17 | 42897963 | 42897984 | 42897968 | 42897963 | - |
| SEQ ID NO 64759 | TGCTGAGAATCCACTCATTTAT | TTT | chr17 | 42897956 | 42897977 | 42897961 | 42897956 | - |
| SEQ ID NO 64760 | GCTGAGAATCCACTCATTTATC | TTT | chr17 | 42897955 | 42897976 | 42897960 | 42897955 | - |
| SEQ ID NO 64761 | CTGAGAATCCACTCATTTATCT | TTG | chr17 | 42897954 | 42897975 | 42897959 | 42897954 | - |
| SEQ ID NO 64762 | AGAATCCACTCATTTATCTGTT | CTG | chr17 | 42897951 | 42897972 | 42897956 | 42897951 | - |
| SEQ ID NO 64763 | ATTTATCTGTTTATTTGAGACG | CTC | chr17 | 42897940 | 42897961 | 42897945 | 42897940 | - |
| SEQ ID NO 64764 | ATCTGTTTATTTGAGACGGGGT | TTT | chr17 | 42897936 | 42897957 | 42897941 | 42897936 | - |
| SEQ ID NO 64765 | TCTGTTTATTTGAGACGGGGTC | TTA | chr17 | 42897935 | 42897956 | 42897940 | 42897935 | - |
| SEQ ID NO 64766 | TTTATTTGAGACGGGGTCTCAC | CTG | chr17 | 42897931 | 42897952 | 42897936 | 42897931 | - |
| SEQ ID NO 64767 | ATTTGAGACGGGGTCTCACTCT | TTT | chr17 | 42897928 | 42897949 | 42897933 | 42897928 | - |
| SEQ ID NO 64768 | TTTGAGACGGGGTCTCACTCTG | TTA | chr17 | 42897927 | 42897948 | 42897932 | 42897927 | - |
| SEQ ID NO 64769 | GAGACGGGGTCTCACTCTGTTA | TTT | chr17 | 42897924 | 42897945 | 42897929 | 42897924 | - |
| SEQ ID NO 64770 | AGACGGGGTCTCACTCTGTTAC | TTG | chr17 | 42897923 | 42897944 | 42897928 | 42897923 | - |
| SEQ ID NO 64771 | ACTCTGTTACCCAGGCTGGAGT | CTC | chr17 | 42897911 | 42897932 | 42897916 | 42897911 | - |
| SEQ ID NO 64772 | TGTTACCCAGGCTGGAGTGCGG | CTC | chr17 | 42897907 | 42897928 | 42897912 | 42897907 | - |
| SEQ ID NO 64773 | TTACCCAGGCTGGAGTGCGGTG | CTG | chr17 | 42897905 | 42897926 | 42897910 | 42897905 | - |
| SEQ ID NO 64774 | CCCAGGCTGGAGTGCGGTGGCA | TTA | chr17 | 42897902 | 42897923 | 42897907 | 42897902 | - |
| SEQ ID NO 64775 | GAGTGCGGTGGCACCATCACAG | CTG | chr17 | 42897893 | 42897914 | 42897898 | 42897893 | - |
| SEQ ID NO 64776 | ACTGCAGCCTCAGTCTCCTGGG | CTC | chr17 | 42897868 | 42897889 | 42897873 | 42897868 | |

Figure 90 (Cont'd)

| | | | | | | | | |
|---|---|---|---|---|---|---|---|---|
| SEQ ID NO 64777 | CAGCCTCAGTCTCCTGGGCTTA | CTG | chr17 | 42897864 | 42897885 | 42897869 | 42897864 | - |
| SEQ ID NO 64778 | AGTCTCCTGGGCTTAAGGGATC | CTC | chr17 | 42897857 | 42897878 | 42897862 | 42897857 | - |
| SEQ ID NO 64779 | CTGGGCTTAAGGGATCGTTTTG | CTC | chr17 | 42897851 | 42897872 | 42897856 | 42897851 | - |
| SEQ ID NO 64780 | GGCTTAAGGGATCGTTTTGCAT | CTG | chr17 | 42897848 | 42897869 | 42897853 | 42897848 | - |
| SEQ ID NO 64781 | AAGGGATCGTTTTGCATCAGTC | CTT | chr17 | 42897843 | 42897864 | 42897848 | 42897843 | - |
| SEQ ID NO 64782 | AGGGATCGTTTTGCATCAGTCT | TTA | chr17 | 42897842 | 42897863 | 42897847 | 42897842 | - |
| SEQ ID NO 64783 | TGCATCAGTCTCTGGGTAGCTG | TTT | chr17 | 42897831 | 42897852 | 42897836 | 42897831 | - |
| SEQ ID NO 64784 | GCATCAGTCTCTGGGTAGCTGG | TTT | chr17 | 42897830 | 42897851 | 42897835 | 42897830 | - |
| SEQ ID NO 64785 | CATCAGTCTCTGGGTAGCTGGG | TTG | chr17 | 42897829 | 42897850 | 42897834 | 42897829 | - |
| SEQ ID NO 64786 | TGGGTAGCTGGGCCTACAGGCG | CTC | chr17 | 42897819 | 42897840 | 42897824 | 42897819 | - |
| SEQ ID NO 64787 | GGTAGCTGGGCCTACAGGCGCA | CTG | chr17 | 42897817 | 42897838 | 42897822 | 42897817 | - |
| SEQ ID NO 64788 | GGCCTACAGGCGCACACCACCA | CTG | chr17 | 42897809 | 42897830 | 42897814 | 42897809 | - |
| SEQ ID NO 64789 | CAGGCGCACACCACCAAACCCA | CTA | chr17 | 42897803 | 42897824 | 42897808 | 42897803 | - |

| # Variant ID | Start | Stop | Variant type | HGVS_g |
|---|---|---|---|---|
| rs80356479 | 42900955 | 42900955 | deletion | NC_000017.11:g.42900955delC |
| rs80356486 | 42911331 | 42911333 | deletion | NC_000017.11:g.42911331_42911333delTTC |
| rs606231368 | 42907561 | 42907562 | insertion | NC_000017.11:g.42907560_42907561dupAT |
| rs80356488 | 42907562 | 42907563 | insertion | NC_000017.11:g.42907561_42907562dupTA |
| rs587776757 | 42901110 | 42901110 | single nucleotide variant | NC_000017.11:g.42901110A>G |
| rs104894565 | 42900989 | 42900989 | single nucleotide variant | NC_000017.11:g.42900989A>T |
| rs104894566 | 42901105 | 42901105 | single nucleotide variant | NC_000017.11:g.42901105T>C |
| rs1801175 | 42903947 | 42903947 | single nucleotide variant | NC_000017.11:g.42903947C>T |
| rs1801176 | 42903948 | 42903948 | single nucleotide variant | NC_000017.11:g.42903948G>A |
| rs104894567 | 42904028 | 42904028 | single nucleotide variant | NC_000017.11:g.42904028G>A |
| rs104894571 | 42909353 | 42909353 | single nucleotide variant | NC_000017.11:g.42909353T>G |
| rs80356482 | 42909418 | 42909418 | single nucleotide variant | NC_000017.11:g.42909418G>A |
| rs80356483 | 42911161 | 42911161 | single nucleotide variant | NC_000017.11:g.42911161G>T |
| rs104894563 | 42911235 | 42911235 | single nucleotide variant | NC_000017.11:g.42911235C>T |
| rs367727229 | 42911364 | 42911364 | single nucleotide variant | NC_000017.11:g.42911364G>A |
| rs387906505 | 42911374 | 42911374 | single nucleotide variant | NC_000017.11:g.42911374T>A |
| rs104894568 | 42907552 | 42907552 | single nucleotide variant | NC_000017.11:g.42907552G>A |
| rs104894569 | 42909407 | 42909407 | single nucleotide variant | NC_000017.11:g.42909407G>A |
| rs80356487 | 42911391 | 42911391 | single nucleotide variant | NC_000017.11:g.42911391C>G |
| rs764920787 | 42901065 | 42901065 | single nucleotide variant | NC_000017.11:g.42901065G>A |
| rs80356485 | 42911076 | 42911076 | single nucleotide variant | NC_000017.11:g.42911076C>T |
| rs780226142 | 42911321 | 42911321 | single nucleotide variant | NC_000017.11:g.42911321C>A |
| rs80356484 | 42911000 | 42911000 | single nucleotide variant | NC_000017.11:g.42911000G>T |

Figure 91A

| # Variant ID | Molecular consequences | Variant allele | Transcript change | Protein change |
|---|---|---|---|---|
| rs80356479 | frameshift variant | delC | c.79delC | Gln27Argfs |
| rs80356486 | inframe variant;3 prime UTR variant | delTTC | c.979_981delTTC | Phe327del |
| rs606231368 | frameshift variant;intron variant | dupAT | c.378_3794dupAT | Tyr128Thrfs |
| rs80356488 | frameshift variant;intron variant | dupTA | c.379_380dupTA | Tyr128Thrfs |
| rs587776757 | intron variant | G | c.230+4A>G | |
| rs104894565 | missense variant | T | c.113A>T | Asp38Val |
| rs104894566 | missense variant | C | c.229T>C | Trp77Arg |
| rs1801175 | missense variant | T | c.247C>T | Arg83Cys |
| rs1801176 | missense variant | A | c.248G>A | Arg83His |
| rs104894567 | missense variant | A | c.328G>A | Glu110Lys |
| rs104894571 | missense variant | G | c.497T>G | Val166Gly |
| rs80356482 | missense variant | A | c.562G>A | Gly188Ser |
| rs80356483 | missense variant;3 prime UTR variant | T | c.809G>T | Gly270Val |
| rs104894563 | missense variant;3 prime UTR variant | T | c.883C>T | Arg295Cys |
| rs367727229 | missense variant;3 prime UTR variant | A | c.1012G>A | Val338Ile |
| rs387906505 | missense variant;3 prime UTR variant | A | c.1022T>A | Ile341Asn |
| rs104894568 | missense variant;intron variant | A | c.370G>A | Ala124Thr |
| rs104894569 | missense variant;nonsense | A | c.551G>A | Gly184Glu |
| rs80356487 | missense variant;nonsense;3 prime UTR variant | G | c.1039C>G | Gln347Glu |
| rs764920787 | nonsense | A | c.189G>A | Trp63Ter |
| rs80356485 | nonsense;3 prime UTR variant | T | c.724C>T | Gln242Ter |
| rs780226142 | nonsense;synonymous variant;3 prime UTR variant | A | c.969C>A | Tyr323Ter |
| rs80356484 | synonymous variant;3 prime UTR variant | T | c.648G>T | Leu216= |

- ODN correspondent to minus strand
+ ODN correspondent to plus strand
∅ no ODN

MATERIALS AND METHODS FOR TREATMENT OF GLYCOGEN STORAGE DISEASE TYPE 1A

RELATED APPLICATIONS

This application is a national phase filing under 35 USC § 371 of International PCT Application No. PCT/IB2016/001709 filed Nov. 7, 2016, which claims the benefit and priority of U.S. Provisional Application No. 62/252,208, filed Nov. 6, 2015; U.S. Provisional No. 62/265,678, filed Dec. 10, 2015; and U.S. Provisional No. 62/324,113, filed Apr. 18, 2016; the contents of each of which are incorporated herein by reference in their entirety.

FIELD OF THE INVENTION

The present application provides materials and methods for treating a patient with Glycogen Storage Disease type 1a (GSD1a) both ex vivo and in vivo. In addition, the present application provides materials and methods for modulating the expression, function, and/or activity of the glucose-6-phosphatase, catalytic (G6PC) gene and/or the glucose-6-phosphatase (G6Pase) protein in a cell by genome editing.

INCORPORATION BY REFERENCE OF SEQUENCE LISTING

The instant application contains a Sequence Listing which has been submitted electronically in ASCII format and is hereby incorporated by reference in its entirety. Said ASCII copy, created on Jan. 14, 2019, is named CRTN_011US_SL.txt and is 13025753 bytes in size.

BACKGROUND OF THE INVENTION

Glycogen storage disease type 1 (GSD1) is a group of diseases resulting from defects of proteins involved in the removal of phosphates from glucose-6-phosphate, which, as the final step in both gluconeogenesis and glycogenolysis, is crucial for the maintenance of blood glucose levels (Arion, W. J., & Canfield, W. K. (1993). Glucose-6-phosphatase and type 1 glycogen storage disease: some critical considerations. Eur J Pediatr, 152(S1), S7-S13; Froissart, R., et al. (2011). Glucose-6-phosphatase deficiency. Orphanet Journal Of Rare Diseases, 6(27); van Schaftingen, E., & Gerin, I. (2002). The glucose-6-phosphatase system. Biochem J, 362 (Pt 3), 513-532). GSD1 is clinically recognized by hepatomegaly (enlargement of the liver due to accumulation of glycogen) and hypoglycemia, and is usually diagnosed between 6 and 8 months of age (Koeberl, et al. (2007). Glycogen storage disease types I and II: treatment updates. J Inherit Metab Dis, 30(2), 159-164. doi:10.1007/s10545-007-0519-9, Rake, J. P. (2002). Glycogen storage disease type I: diagnosis, management, clinical course and outcome. Results of the European Study on Glycogen Storage Disease Type I (ESGSDI). Eur J Pediatr, 161, S20-S34).

The most common form of GSD1 (about 80% of all cases) is GSD1a, which is caused by inactivating mutations to the glucose-6-phosphatase catalytic unit. In addition to the genetic association in patients, the mechanism of the disease was confirmed by association in both mouse and dog disease models (Froissart, R., et al. Orphanet Journal Of Rare Diseases, 2011; Kishnani, P. S., et al. (2001). Canine model and genomic structural organization of glycogen storage disease type Ia (GSD Ia). Vet Pathol, 38(1), 83-91; Mutel, E., et al. (2011). Targeted deletion of liver glucose-6 phosphatase mimics glycogen storage disease type 1a including development of multiple adenomas. J Hepatol, 54(3), 529-537. doi:10.1016/j.jhep.2010.08.014). Without the ability to dephosphorylate glucose for release into the blood, the breakdown of glycogen in liver cells is affected, along with the maintenance of normal blood glucose. This inability to release glucose underlies the symptoms of GSD1, as the body must then rely on alternative fuel sources, which can lead to lactic acidemia and hyperlipidemia (van Schaftingen, E., & Gerin, I. Biochem J, 2002).

GSD1a is a recessively inherited genetic disorder associated with various mutations to the G6PC gene that render it unable to dephosphorylate glucose (Chou, J. Y., & Mansfield, B. C. (2008). Mutations in the Glucose-6-Phosphatase-alpha (G6PC) Gene that Cause Type 1a Glycogen Storage Disease. Hum Mutat, 29(7), 921-930). Preclinical mouse models demonstrate that restoration of 20% of normal glucose-6-phosphatase activity using adeno-associated virus (AAV) gene delivery can normalize blood glucose, triglycerides and uric acid, as well as reduce hepatomegaly and renomegaly (Zingone, A., et al. (2000). Correction of glycogen storage disease type 1a in a mouse model by gene therapy. J Biol Chem, 275(2), 828-832). Another estimate based on human studies places the therapeutic threshold at 10% of normal glucose-6-phosphatase activity (Koeberl, et al. J Inherit Metab Dis, 2007). Both estimates indicate a reasonable and likely achievable goal for gene editing efficacy, suggesting that the G6PC gene may be a good target.

The other aspect of GSD1a that makes it a good candidate for gene therapy is the lack of satisfactory treatments. Current treatments are primarily limited to nutritional supplementation in an effort to maintain normal blood glucose and prevent seizures caused by hypoglycemia (Koeberl, D. D., et al. (2009). Emerging therapies for glycogen storage disease type I. Trends Endocrinol Metab, 20(5), 252-258. doi:10.1016/j.tem.2009.02.003). The primary nutritional therapies are continuous naso-gastric infusion of glucose and frequent administration of uncooked cornstarch (Lee, P. J., et al. (1996). Uncooked cornstarch—efficacy in type I glycogenosis. Arch Dis Child, 74(6), 546-547). While these therapies can help to maintain normoglycemia and aid with amelioration of growth retardation, they do not address renomegaly or hepatomegaly. Though liver transplantation can cure the hepatic manifestations (hepatomegaly, hepatic adenomas) of GSD1, as well as aiding in maintaining normoglycemia, it cannot address all the issues caused by GSD1 (Selby, R., et al. (1993). Liver transplantation for type I and type IV glycogen storage disease. Eur J Pediatr, 152 Suppl 1, S71-76). Hepatocyte transplantation has also been investigated as a possible treatment option, however, long-term engraftment was not achieved and the therapy ultimately failed (Koeberl, et al. Trends Endocrinol Metab, 2009).

To address incomplete and unsatisfactory treatment options, several groups have been working on gene therapy in animal models of the disease, including mice and dogs. Most of these studies have used an AAV vector to convey a corrected version of the gene into hepatocytes, although one used a lentiviral vector (Clar, J., et al. (2015). Hepatic lentiviral gene transfer prevents the long-term onset of hepatic tumours of glycogen storage disease type 1a in mice. Hum Mol Genet, 24(8), 2287-2296. doi:10.1093/hmg/ddu746; Koeberl, et al. Trends Endocrinol Metab, 2009). There have been some successes with this approach, with some studies achieving a temporary or longer term reversal of some disease symptoms with less than 20% restoration of glucose-6-phosphatase activity (Clar, J., et al. Hum Mol Genet, 2015; Lee, Y. M., et al. (2012). Prevention of hepatocellular adenoma and correction of metabolic abnormalities in murine glycogen storage disease type Ia by gene therapy. Hepatology, 56(5), 1719-1729. doi:10.1002/hep.25717; Zingone, A., et al. J Biol Chem, 2000). There is also some evidence in dogs that AAV vector gene therapy can temporarily reduce symptoms of the disease (reviewed in Koeberl, et al. J Inherit Metab Dis, 2007). One mouse study also demonstrated that AAV mediated expression of glucose-6-phosphatase in the liver of as little as 3% normal glucose-6-phosphatase expression could ameliorate GSD1 symptoms and prevent formation of hepatic adenomas. They also demonstrated that even distribution of glucose-6-phosphatase activity is not necessary to observe a phenotypic change, instead noting foci of higher glucose-6-phosphatase activity 9 Clar, J., et al. Hum Mol Genet, 2015; Lee, Y. M., et al. Hepatology, 2012). Overall, the limited-term success of the AAV therapies combined with the lack of adequate available therapies and the reasonable estimates for therapeutic threshold make this disease a good candidate for gene editing therapy based on endonucleases Genome engineering refers to the strategies and techniques for the targeted, specific modification of the genetic information (genome) of living organisms. Genome engineering is a very active field of research because of the wide range of possible applications, particularly in the areas of human health; the correction of a gene carrying a harmful mutation, for example, or to explore the function of a gene. Early technologies developed to insert a gene into a living cell, such as transgenesis, were often limited by the random nature of the insertion of the new sequence into the genome. The new gene was usually positioned blindly, and may have inactivated or disturbed the functioning of other genes, or even caused severe unwanted effects. Furthermore, these technologies generally offered no degree of reproducibility, as there was no guarantee that the new sequence would be inserted at the same place in two different cells. More recent genome engineering strategies, such as ZFNs, TALENs, HEs and MegaTALs, enable a specific area of the DNA to be modified, thereby increasing the precision of the correction or insertion compared to early technologies, and offering some degree of reproducibility. Despite this, such recent genome engineering strategies have limitations.

Despite efforts from researchers and medical professionals worldwide who have been trying to address GSD1a, and despite the promise of genome engineering approaches, there still remains a critical need for developing safe and effective treatments for GSD1a.

Prior approaches addressing GSD1a have severe limitations, such as limited success and lack of adequate available therapies. The present invention solves these problems by using genome engineering tools to create permanent changes to the genome that can restore the glucose-6-phosphatase (G6Pase) protein activity with a single treatment. Thus, the present invention corrects the underlying genetic defect causing the disease.

SUMMARY OF THE INVENTION

Provided herein are cellular, ex vivo and in vivo methods for creating permanent changes to the genome by inserting, correcting, or modulating the expression or function of one or more exons within or near the glucose-6-phosphatase, catalytic (G6PC) gene or other DNA sequences that encode regulatory elements of the G6PC gene by genome editing and restoring glucose-6-phosphatase (G6Pase) protein activity, which can be used to treat Glycogen Storage Disease type 1a (GSD1a). Also provided herein are components, kits and compositions for performing such methods. Also provided are cells produced by such methods.

Provided herein is a method for editing a G6PC gene in a human cell by genome editing, the method comprising the step of introducing into the human cell one or more deoxyribonucleic acid (DNA) endonucleases to effect one or more single-strand breaks (SSBs) or one or more double-strand breaks (DSBs) within or near the G6PC gene or other DNA sequences that encode regulatory elements of the G6PC gene that results in at least one of a permanent insertion, correction, or modulation of expression or function of one or more exons within or near or affecting the expression or function of the G6PC gene or within or near a safe harbor locus that results in a permanent insertion of the G6PC gene and results in restoration of G6Pase protein activity. The human cell can be a liver cell.

Also provided herein is a method for inserting a G6PC gene in a human cell by genome editing, the method comprising the step of: introducing into the human cell one or more deoxyribonucleic acid (DNA) endonucleases to effect one or more single-strand breaks (SSBs) or double-strand breaks (DSBs) within or near a safe harbor locus that results in a permanent insertion of the G6PC gene, and results in restoration of G6Pase protein activity.

In one aspect, provided herein is a method for inserting the glucose-6-phosphatase, catalytic (G6PC) gene in a human cell by genome editing comprising introducing into the human cell one or more deoxyribonucleic acid (DNA) endonucleases to effect one or more single-strand breaks (SSBs) or double-strand breaks (DSBs) within or near the G6PC gene that results in a permanent insertion or correction of one or more mutations within the G6PC gene and restoration of G6Pase protein activity.

In another aspect, provided herein is an ex vivo method for treating a patient with Glycogen Storage Disease type 1a (GSD1a) comprising the steps of: creating a patient specific induced pluripotent stem cell (iPSC); editing within or near the glucose-6-phosphatase, catalytic (G6PC) gene or other DNA sequences that encode regulatory elements of the G6PC gene of the iPSC or editing within or near a safe harbor locus of the iPSC; or editing within or near a locus in the first exon of the HGD gene of the iPSC; differentiating the genome edited iPSC into a hepatocyte; and implanting the hepatocyte into the patient.

In some embodiments, the step of creating a patient specific iPSC comprises: isolating a somatic cell from the patient; and introducing a set of pluripotency-associated genes into the somatic cell to induce the cell to become a pluripotent stem cell. In some embodiments, the somatic cell is a fibroblast. In some embodiments, the set of pluripotency-associated genes is one or more of the genes selected from the group consisting of OCT4, SOX2, KLF4, Lin28, NANOG and cMYC.

The step of editing within or near a G6PC gene or other DNA sequences that encode regulatory elements of the G6PC gene of the iPSC or editing within or near a safe harbor locus of the G6PC gene of the iPSC or editing within or near a locus of the first exon of the HGD gene of the iPSC can comprise introducing into the iPSC one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene that results in a permanent insertion, correction, or modulation of expression or function of one or more exons within or near or affecting the expression or function of the G6PC gene or within or near a safe harbor locus that results in a permanent insertion of the G6PC gene or within or near a locus in the first exon of HGD that results in a permanent insertion of the G6PC gene and results in restoration of G6Pase protein activity. The safe harbor locus can be selected from the group consisting of: AAVS1 (PPP1R12C), ALB, Angptl3, ApoC3, ASGR2, CCR5, FIX (F9), Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In some embodiments, the step of editing the G6PC gene of the iPSC comprises introducing into the iPSC one or more deoxyribonucleic acid (DNA) endonucleases to effect one or more double-strand breaks (DSBs) within the G6PC gene that results in permanent correction of one or more mutations within the G6PC gene and restoration of G6Pase protein activity.

In some embodiments, the step of differentiating the genome edited iPSC into a liver progenitor cell or a hepatocyte comprises one or more of the following: contacting the genome edited iPSC with one or more of activin, B27 supplement, FGF4, HGF, BMP2, BMP4, Oncostatin M, or Dexametason.

In some embodiments, the step of implanting the hepatocyte into the patient comprises implanting the hepatocyte into the patient by transplantation, local injection, or systemic infusion, or combinations thereof.

In yet another aspect, provided herein is an ex vivo method for treating a patient with Glycogen Storage Disease type 1a (GSD1a) comprising the steps of: performing a biopsy of the patient's liver; isolating a liver specific progenitor cell or primary hepatocyte; editing within or near the glucose-6-phosphatase, catalytic (G6PC) gene or other DNA sequences that encode regulatory elements of the G6PC gene of the progenitor cell or primary hepatocyte or editing within or near a safe harbor locus of the progenitor cell or primary hepatocyte; and implanting the genome-edited progenitor cell or primary hepatocyte into the patient.

In some embodiments, the step of isolating a liver specific progenitor cell or primary hepatocyte from the patient comprises: perfusion of fresh liver tissues with digestion enzymes, cell differential centrifugation, cell culturing, or combinations thereof.

In some embodiments, the step of editing within or near the G6PC gene or other DNA sequences that encode regulatory elements of the G6PC gene of the progenitor cell or primary hepatocyte or editing within or near a safe harbor locus of the white blood cell of the progenitor cell or primary hepatocyte comprises introducing into the progenitor cell or primary hepatocyte one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene that results in permanent insertion, correction, or modulation of expression or function of one or more exons within or near or affecting the expression or function of the G6PC gene or within or near a safe harbor locus that results in a permanent insertion or correction of one or more mutations within the G6PC gene and restoration of G6Pase protein activity. The safe harbor locus can be selected from the group consisting of: AAVS1 (PPP1R12C), ALB, Angptl3, ApoC3, ASGR2, CCR5, FIX (F9), Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In some embodiments, the step of implanting the genome-edited liver-specific progenitor cell or primary hepatocyte into the patient comprises implanting the genome-edited liver-specific progenitor cell or primary hepatocyte into the patient by transplantation, local injection, or systemic infusion, or combinations thereof.

Also provided herein is an ex vivo method for treating a patient (e.g., a human) with Glycogen Storage Disease type 1a (GSD1a), the method comprising the steps of: i) isolating a mesenchymal stem cell from the patient; ii) editing within or near a G6PC gene or other DNA sequences that encode regulatory elements of the G6PC gene of the mesenchymal stem cell or editing within or near a safe harbor locus of the G6PC gene of the mesenchymal cell; iii) differentiating the genome-edited mesenchymal stem cell into a hepatocyte; and iv) implanting the hepatocyte into the patient.

In another aspect, provided herein is an ex vivo method for treating a patient with Glycogen Storage Disease type 1a (GSD1a) comprising the steps of: performing a biopsy of the patient's bone marrow; isolating a mesenchymal stem cell; editing the glucose-6-phosphatase, catalytic (G6PC) gene of the stem cell; differentiating the stem cell into a hepatocyte; and implanting the hepatocyte into the patient.

The mesenchymal stem cell can be isolated from the patient's bone marrow by performing a biopsy of the patient's bone marrow or the mesenchymal stem cell can be isolated from peripheral blood.

In some embodiments, the step of isolating a mesenchymal stem cell comprises: aspiration of bone marrow and isolation of mesenchymal cells by density centrifugation using Percoll™.

In some embodiments, the step of editing within or near the G6PC gene or other DNA sequences that encode regulatory elements of the G6PC gene of the mesenchymal stem cell comprises introducing into the mesenchymal stem cell one or more deoxyribonucleic acid (DNA) endonucleases to effect single-strand breaks (SSBs) or one or more double-strand breaks (DSBs) within or near the G6PC gene or other DNA sequences that encode regulatory elements of the G6PC gene or editing within or near a safe harbor locus of the G6PC gene that results in permanent correction or modulation of expression or function of one or more exons within or near or affecting the expression or function of the G6PC gene or within or near a safe harbor locus that results of one or more mutations within the G6PC gene and restoration of G6Pase protein activity. The safe harbor locus can be selected from the group consisting of: AAVS1 (PPP1R12C), ALB, Angptl3, ApoC3, ASGR2, CCR5, FIX (F9), Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In some embodiments, the step of differentiating the genome-edited mesenchymal stem cell into a hepatocyte comprises one or more of the following: contacting the genome edited mesenchymal stem cell with one or more of insulin, transferrin, FGF4, HGF, or bile acids.

In some embodiments, the step of implanting the hepatocyte into the patient comprises implanting the hepatocyte into the patient by transplantation, local injection, or systemic infusion, or combinations thereof.

In a further aspect, provided herein is an in vivo method for treating a patient with Glycogen Storage Disease type 1a (GSD1a) comprising the step of editing the glucose-6-phosphatase, catalytic (G6PC) gene in a cell of the patient, or other DNA sequences that encode regulatory elements of the G6PC gene, or editing within or near a safe harbor locus in a cell of the patient. The cell can be a liver cell.

In some embodiments, the step of editing the G6PC gene in a cell of the patient comprises introducing into the cell one or more deoxyribonucleic acid (DNA) endonucleases to effect one or more double-strand breaks (DSBs) within the G6PC gene that results in permanent correction of one or more mutations within the G6PC gene and restoration of G6Pase protein activity.

In some embodiments, the step of editing a G6PC gene in a cell of the patient comprises introducing into the cell one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene or editing within or near a safe harbor locus of the G6PC gene that results in a permanent insertion, correction, or modulation of expression or function of one or more exons within or near or affecting the expression or function of the G6PC gene and restoration of G6Pase protein activity. The cell can be a hepatocyte, a liver progenitor cell, or combinations thereof.

In some embodiments, the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, recombination of the naturally occurring molecule, codon-optimized, or modified version thereof, and combinations of any of the foregoing.

In some embodiments, the method comprises introducing into the cell one or more polynucleotides encoding the DNA endonuclease. In some embodiments, the method comprises introducing into the cell one or more ribonucleic acids (RNAs) encoding the DNA endonuclease. In some embodiments, the one or more polynucleotides or one or more RNAs is one or more modified polynucleotides or one or more modified RNAs. In some embodiments, the method comprises introducing into the cell one or more DNA endonucleases wherein the endonuclease is a protein or polypeptide.

In some embodiments, the method further comprises introducing into the cell one or more guide ribonucleic acids (gRNAs). In some embodiments, the one or more gRNAs are single-molecule guide RNA (sgRNAs). In some embodiments, the one or more gRNAs or one or more sgRNAs is one or more modified gRNAs, one or more modified sgRNAs, or combinations thereof.

In some embodiments, the one or more DNA endonucleases is pre-complexed with one or more gRNAs, one or more sgRNAs, or combinations thereof.

In some embodiments, the method further comprises introducing into the cell a polynucleotide donor template comprising at least a portion of the wild-type G6PC gene, DNA sequences that encode wild-type regulatory elements of the G6PC gene, and/or cDNA. The at least a portion of the wild-type G6PC gene or cDNA can be exon 1, exon 2, exon 3, exon 4, exon 5, intronic regions, fragments or combinations thereof, or the entire G6PC gene or cDNA. The donor template can be either a single or double stranded polynucleotide. The donor template can have homologous arms to the 17q21 region.

In some embodiments, the method further comprises introducing into the cell one guide ribonucleic acid (gRNA) and a polynucleotide donor template comprising at least a portion of the wild-type G6PC gene. In some embodiments, the method further comprises introducing into the cell one guide ribonucleic acid (gRNA) and a polynucleotide donor template comprising at least a portion of a codon optimized or modified G6PC gene. The one or more DNA endonucleases is one or more Cas9 or Cpf1 endonucleases that effect single-strand break (SSB) or one double-strand break (DSB) at a DSB locus within or near the G6PC gene (or codon optimized or modified G6PC gene) or other DNA sequences that encode regulatory elements of the G6PC gene, or within or near a safe harbor locus, that facilitates insertion of a new sequence from the polynucleotide donor template into the chromosomal DNA at the locus or safe harbor locus that results in a permanent correction of a part of the chromosomal DNA of the G6PC gene or other DNA sequences that encode regulator elements of the G6PC gene proximal to the locus or safe harbor locus and restoration of G6Pase protein activity. In some embodiments, the gRNA comprises a spacer sequence that is complementary to a segment of the locus or safe harbor locus. In some embodiments, proximal means nucleotides both upstream and downstream of the locus or safe harbor locus.

In some embodiments, the method further comprises introducing into the cell two guide ribonucleic acids (gRNAs) and a polynucleotide donor template comprising at least a portion of the wild-type G6PC gene, and wherein the one or more DNA endonucleases is two or more Cas9 or Cpf1 endonucleases that effect or create at least two (e.g., a pair) single-strand breaks (SSBs) and/or a pair of double-strand breaks (DSBs), the first at a 5' DSB locus and the second at a 3' DSB locus, within the G6PC gene or other DNA sequences that encode regulatory elements of the G6PC gene or within or near a safe harbor locus, that facilitates insertion of a new sequence from the polynucleotide donor template into the chromosomal DNA between the 5' DSB locus and the 3' DSB locus that results in permanent correction of the chromosomal DNA between the 5' DSB locus and the 3' DSB locus within the G6PC gene or other DNA sequences that encode regulatory elements of the G6PC gene or within or near a safe harbor locus and restoration of G6Pase protein activity, and wherein the first guide RNA comprises a spacer sequence that is complementary to a segment of the 5' DSB locus and the second guide RNA comprises a spacer sequence that is complementary to a segment of the 3' DSB locus.

In some embodiments, the one or more gRNAs are single-molecule guide RNA (sgRNAs). In some embodiments, the one or more gRNAs or one or more sgRNAs is a modified gRNAs or one or more modified sgRNAs.

In some embodiments, the one or more DNA endonucleases is pre-complexed with one or more gRNAs or one or more sgRNAs.

In some embodiments, the part of the wild-type G6PC gene or cDNA is the entire G6PC gene or cDNA.

In some embodiments, the DSB, or 5' DSB and 3' DSB are in the first exon, first intron, or both the first exon and first intron of the G6PC gene.

In some embodiments, the gRNA or sgRNA is directed to one or more of the following pathological variants: rs80356479, rs80356486, rs606231368, rs80356488, rs587776757, rs104894565, rs104894566, rs1801175, rs1801176, rs104894567, rs104894571, rs80356482, rs80356483, rs104894563, rs367727229, rs387906505, rs104894568, rs104894569, rs80356487, rs764920787, rs80356485, rs780226142, rs80356484.

The at least a portion of the wild-type G6PC gene or cDNA can be exon 1, exon 2, exon 3, exon 4, exon 5, intronic regions, fragments or combinations thereof, or the entire G6PC gene or cDNA.

The donor template can be either a single or double stranded polynucleotide. The donor template can have homologous arms to the 17q21 region.

The SSB, DSB, 5' DSB, and/or 3' DSB can be in the first, second, third, fourth, or fifth exon or introns of the G6PC gene.

In some embodiments, the correction is by homology directed repair (HDR).

In some embodiments, the Cas9 or Cpf1 mRNA, gRNA, and donor template are either each formulated separately into lipid nanoparticles or all co-formulated into a lipid nanoparticle.

In some embodiments, the Cas9 or Cpf1 mRNA, gRNA, and donor template are formulated into separate exosomes or are co-formulated into an exosome.

In some embodiments, the Cas9 or Cpf1 mRNA is formulated into a lipid nanoparticle, and both the gRNA and donor template are delivered to the cell by a viral vector. In some embodiments, the viral vector is an adeno-associated virus (AAV). In some embodiments, the AAV vector is an AAV6 vector.

The Cas9 or Cpf1 mRNA can be formulated into a lipid nanoparticle, and the gRNA can be delivered to the cell by electroporation and donor template can be delivered to the cell by a viral vector. In some embodiments, the viral vector is an adeno-associated virus (AAV) vector. In some embodiments, the AAV vector is an AAV6 vector.

In some embodiments, the G6PC gene is located on Chromosome 17: 42,900,796-42,914,432 (Genome Reference Consortium—GRCh38/hg38).

The restoration of G6Pase protein activity can be compared to wild-type or normal G6Pase protein activity.

In another aspect, provided herein is one or more guide ribonucleic acids (gRNAs) comprising a spacer sequence selected from the group consisting of the sequences in FIGS. 1-90 for editing the glucose-6-phosphatase, catalytic gene in a cell from a patient with Glycogen Storage Disease type 1a. In some embodiments, the one or more gRNAs are single-molecule guide RNAs (sgRNAs). In some embodiments, the one or more gRNAs or one or more sgRNAs is one or more modified gRNAs or one or more modified sgRNAs.

In another aspect, provided herein are cells that have been modified by the preceding methods to permanently correct one or more mutations within the glucose-6-phosphatase, catalytic (G6PC) gene and restore G6Pase protein activity. Further provided herein are methods for ameliorating Glycogen Storage Disease type 1a (GSD1a) by the administration of cells that have been modified by the preceding methods to a GSD1a patient.

In some embodiments, the methods and compositions of the disclosure comprise one or more modified guide ribonucleic acids (gRNAs). Non-limiting examples of modifications can comprise one or more nucleotides modified at the 2' position of the sugar, in some embodiments a 2'-O-alkyl, 2'-O-alkyl-O-alkyl, or 2'-fluoro-modified nucleotide.

In some embodiments, RNA modifications include 2'-fluoro, 2'-amino or 2' O-methyl modifications on the ribose of pyrimidines, abasic residues, desoxy nucleotides, or an inverted base at the 3' end of the RNA.

In some embodiments, the one or more modified guide ribonucleic acids (gRNAs) comprise a modification that makes the modified gRNA more resistant to nuclease digestion than the native oligonucleotide. Non-limiting examples of such modifications include those comprising modified backbones, for example, phosphorothioates, phosphorothyos, phosphotriesters, methyl phosphonates, short chain alkyl or cycloalkyl intersugar linkages or short chain heteroatomic or heterocyclic intersugar linkages.

Various other aspects are described and exemplified herein.

BRIEF DESCRIPTION OF THE DRAWINGS

Various aspects of materials and methods for treatment of Glycogen Storage Disease type 1a (GSD1a) disclosed and described in this specification can be better understood by reference to the accompanying figures, in which:

FIG. 1 is a list of gRNA 20 bp spacer sequences, associated PAM, chromosomal and gene location of the target sequence, cut site, and strand for targeting exons 1-2 of an AAVS1 (PPP1R12C) gene with a *S. pyogenes* Cas9 endonuclease.

FIG. 2 is a list of gRNA 20 bp spacer sequences, associated PAM, chromosomal and gene location of the target sequence, cut site, and strand for targeting exons 1-2 of an AAVS1 (PPP1R12C) gene with a *S. aureus* Cas9 endonuclease.

FIG. 3 is a list of gRNA 20 bp spacer sequences, associated PAM, chromosomal and gene location of the target, cut site, and strand for targeting exons 1-2 of an AAVS1 (PPP1R12C) gene with a *S. thermophilus* Cas9 endonuclease.

FIG. 4 is a list of gRNA 20 bp spacer sequences, associated PAM, chromosomal and gene location of the target, cut site, and strand for targeting exons 1-2 of an AAVS1 (PPP1R12C) gene with a *T. denticola* Cas9 endonuclease.

FIG. 5 is a list of gRNA 20 bp spacer sequences, associated PAM, chromosomal and gene location of the target, cut site, and strand for targeting exons 1-2 of an AAVS1 (PPP1R12C) gene with a *N. meningitides* Cas9 endonuclease.

FIG. 6 is a list of gRNA 22 bp spacer sequences, associated PAM, chromosomal and gene location of the target, two cut sites, and strand for targeting exons 1-2 of an AAVS1 (PPP1R12C) gene with an *Acidominococcus*, Lachnospiraceae, and *Francisella novicida* Cpf1 endonuclease.

FIG. 7 is a list of gRNA 20 bp spacer sequences, associated PAM, chromosomal and gene location of the target sequence, cut site, and strand for targeting exons 1-2 of an Alb gene with a *S. pyogenes* Cas9 endonuclease.

FIG. 8 is a list of gRNA 20 bp spacer sequences, associated PAM, chromosomal and gene location of the target sequence, cut site, and strand for targeting exons 1-2 of an Alb gene with a *S. aureus* Cas9 endonuclease.

FIG. 9 is a list of gRNA 20 bp spacer sequences, associated PAM, chromosomal and gene location of the target, cut site, and strand for targeting exons 1-2 of an Alb gene with a *S. thermophilus* Cas9 endonuclease.

FIG. 10 is a list of gRNA 20 bp spacer sequences, associated PAM, chromosomal and gene location of the target, cut site, and strand for targeting exons 1-2 of an Alb gene with a *T. denticola* Cas9 endonuclease.

FIG. 11 is a list of gRNA 20 bp spacer sequences, associated PAM, chromosomal and gene location of the target, cut site, and strand for targeting exons 1-2 of an Alb gene with a *N. meningitides* Cas9 endonuclease.

FIG. 12 is a list of gRNA 22 bp spacer sequences, associated PAM, chromosomal and gene location of the target, two cut sites, and strand for targeting exons 1-2 of an Alb gene with an *Acidominococcus*, Lachnospiraceae, and *Francisella novicida* Cpf1 endonuclease.

FIG. 13 is a list of gRNA 20 bp spacer sequences, associated PAM, chromosomal and gene location of the target sequence, cut site, and strand for targeting exons 1-2 of an Angptl3 gene with a *S. pyogenes* Cas9 endonuclease.

FIG. 14 is a list of gRNA 20 bp spacer sequences, associated PAM, chromosomal and gene location of the target sequence, cut site, and strand for targeting exons 1-2 of an Angptl3 gene with a *S. aureus* Cas9 endonuclease.

FIG. 15 is a list of gRNA 20 bp spacer sequences, associated PAM, chromosomal and gene location of the target, cut site, and strand for targeting exons 1-2 of an Angptl3 gene with a *S. thermophilus* Cas9 endonuclease.

FIG. 16 is a list of gRNA 20 bp spacer sequences, associated PAM, chromosomal and gene location of the target, cut site, and strand for targeting exons 1-2 of an Angptl3 gene with a *T. denticola* Cas9 endonuclease.

FIG. 17 is a list of gRNA 20 bp spacer sequences, associated PAM, chromosomal and gene location of the target, cut site, and strand for targeting exons 1-2 of an Angptl3 gene with a *N. meningitides* Cas9 endonuclease.

FIG. 18 is a list of gRNA 22 bp spacer sequences, associated PAM, chromosomal and gene location of the target, two cut sites, and strand for targeting exons 1-2 of an Angptl3 gene with an *Acidominococcus*, Lachnospiraceae, and *Francisella novicida* Cpf1 endonuclease.

FIG. 19 is a list of gRNA 20 bp spacer sequences, associated PAM, chromosomal and gene location of the target sequence, cut site, and strand for targeting exons 1-2 of an ApoC3 gene with a *S. pyogenes* Cas9 endonuclease.

FIG. 20 is a list of gRNA 20 bp spacer sequences, associated PAM, chromosomal and gene location of the target sequence, cut site, and strand for targeting exons 1-2 of an ApoC3 gene with a *S. aureus* Cas9 endonuclease.

FIG. 21 is a list of gRNA 20 bp spacer sequences, associated PAM, chromosomal and gene location of the target, cut site, and strand for targeting exons 1-2 of an ApoC3 gene with a *S. thermophilus* Cas9 endonuclease.

FIG. 22 is a list of gRNA 20 bp spacer sequences, associated PAM, chromosomal and gene location of the target, cut site, and strand for targeting exons 1-2 of an ApoC3 gene with a *T. denticola* Cas9 endonuclease.

FIG. 23 is a list of gRNA 20 bp spacer sequences, associated PAM, chromosomal and gene location of the target, cut site, and strand for targeting exons 1-2 of an ApoC3 gene with a *N. meningitides* Cas9 endonuclease.

FIG. 24 is a list of gRNA 22 bp spacer sequences, associated PAM, chromosomal and gene location of the target, two cut sites, and strand for targeting exons 1-2 of an ApoC3 gene with an *Acidominococcus*, Lachnospiraceae, and *Francisella novicida* Cpf1 endonuclease.

FIG. 25 is a list of gRNA 20 bp spacer sequences, associated PAM, chromosomal and gene location of the target sequence, cut site, and strand for targeting exons 1-2 of an ASGR2 gene with a *S. pyogenes* Cas9 endonuclease.

FIG. 26 is a list of gRNA 20 bp spacer sequences, associated PAM, chromosomal and gene location of the target sequence, cut site, and strand for targeting exons 1-2 of an ASGR2 gene with a *S. aureus* Cas9 endonuclease.

FIG. 27 is a list of gRNA 20 bp spacer sequences, associated PAM, chromosomal and gene location of the target, cut site, and strand for targeting exons 1-2 of an ASGR2 gene with a *S. thermophilus* Cas9 endonuclease.

FIG. 28 is a list of gRNA 20 bp spacer sequences, associated PAM, chromosomal and gene location of the target, cut site, and strand for targeting exons 1-2 of an ASGR2 gene with a *T. denticola* Cas9 endonuclease.

FIG. 29 is a list of gRNA 20 bp spacer sequences, associated PAM, chromosomal and gene location of the target, cut site, and strand for targeting exons 1-2 of an ASGR2 gene with a *N. meningitides* Cas9 endonuclease.

FIG. 30 is a list of gRNA 22 bp spacer sequences, associated PAM, chromosomal and gene location of the target, two cut sites, and strand for targeting exons 1-2 of an ASGR2 gene with an *Acidominococcus*, Lachnospiraceae, and *Francisella novicida* Cpf1 endonuclease.

FIG. 31 is a list of gRNA 20 bp spacer sequences, associated PAM, chromosomal and gene location of the target sequence, cut site, and strand for targeting exons 1-2 of a CCR5 gene with a *S. pyogenes* Cas9 endonuclease.

FIG. 32 is a list of gRNA 20 bp spacer sequences, associated PAM, chromosomal and gene location of the target sequence, cut site, and strand for targeting exons 1-2 of a CCR5 gene with a *S. aureus* Cas9 endonuclease.

FIG. 33 is a list of gRNA 20 bp spacer sequences, associated PAM, chromosomal and gene location of the target, cut site, and strand for targeting exons 1-2 of a CCR5 gene with a *S. thermophilus* Cas9 endonuclease.

FIG. 34 is a list of gRNA 20 bp spacer sequences, associated PAM, chromosomal and gene location of the target, cut site, and strand for targeting exons 1-2 of a CCR5 gene with a *T. denticola* Cas9 endonuclease.

FIG. 35 is a list of gRNA 20 bp spacer sequences, associated PAM, chromosomal and gene location of the target, cut site, and strand for targeting exons 1-2 of a CCR5 gene with a *N. meningitides* Cas9 endonuclease.

FIG. 36 is a list of gRNA 22 bp spacer sequences, associated PAM, chromosomal and gene location of the target, two cut sites, and strand for targeting exons 1-2 of a CCR5 gene with an *Acidominococcus*, Lachnospiraceae, and *Francisella novicida* Cpf1 endonuclease.

FIG. 37 is a list of gRNA 20 bp spacer sequences, associated PAM, chromosomal and gene location of the target sequence, cut site, and strand for targeting exons 1-2 of an F9 gene with a *S. pyogenes* Cas9 endonuclease.

FIG. 38 is a list of gRNA 20 bp spacer sequences, associated PAM, chromosomal and gene location of the target sequence, cut site, and strand for targeting exons 1-2 of an F9 gene with a *S. aureus* Cas9 endonuclease.

FIG. 39 is a list of gRNA 20 bp spacer sequences, associated PAM, chromosomal and gene location of the target, cut site, and strand for targeting exons 1-2 of an F9 gene with a *S. thermophilus* Cas9 endonuclease.

FIG. 40 is a list of gRNA 20 bp spacer sequences, associated PAM, chromosomal and gene location of the target, cut site, and strand for targeting exons 1-2 of an F9 gene with a *T. denticola* Cas9 endonuclease.

FIG. 41 is a list of gRNA 20 bp spacer sequences, associated PAM, chromosomal and gene location of the target, cut site, and strand for targeting exons 1-2 of an F9 gene with a *N. meningitides* Cas9 endonuclease.

FIG. 42 is a list of gRNA 22 bp spacer sequences, associated PAM, chromosomal and gene location of the target, two cut sites, and strand for targeting exons 1-2 of an F9 gene with an *Acidominococcus*, Lachnospiraceae, and *Francisella novicida* Cpf1 endonuclease.

FIG. 43 is a list of gRNA 20 bp spacer sequences, associated PAM, chromosomal and gene location of the target sequence, cut site, and strand for targeting exons 1-2 of a Gys2 gene with a *S. pyogenes* Cas9 endonuclease.

FIG. 44 is a list of gRNA 20 bp spacer sequences, associated PAM, chromosomal and gene location of the target sequence, cut site, and strand for targeting exons 1-2 of a Gys2 gene with a *S. aureus* Cas9 endonuclease.

FIG. 45 is a list of gRNA 20 bp spacer sequences, associated PAM, chromosomal and gene location of the target, cut site, and strand for targeting exons 1-2 of a Gys2 gene with a *S. thermophilus* Cas9 endonuclease.

FIG. 46 is a list of gRNA 20 bp spacer sequences, associated PAM, chromosomal and gene location of the target, cut site, and strand for targeting exons 1-2 of a Gys2 gene with a *T. denticola* Cas9 endonuclease.

FIG. 47 is a list of gRNA 20 bp spacer sequences, associated PAM, chromosomal and gene location of the target, cut site, and strand for targeting exons 1-2 of a Gys2 gene with a *N. meningitides* Cas9 endonuclease.

FIG. 48 is a list of gRNA 22 bp spacer sequences, associated PAM, chromosomal and gene location of the target, two cut sites, and strand for targeting exons 1-2 of a Gys2 gene with an *Acidominococcus*, Lachnospiraceae, and *Francisella novicida* Cpf1 endonuclease.

FIG. 49 is a list of gRNA 20 bp spacer sequences, associated PAM, chromosomal and gene location of the target sequence, cut site, and strand for targeting exons 1-2 of an HGD gene with a *S. pyogenes* Cas9 endonuclease.

FIG. 50 is a list of gRNA 20 bp spacer sequences, associated PAM, chromosomal and gene location of the target sequence, cut site, and strand for targeting exons 1-2 of an HGD gene with a *S. aureus* Cas9 endonuclease.

FIG. 51 is a list of gRNA 20 bp spacer sequences, associated PAM, chromosomal and gene location of the target, cut site, and strand for targeting exons 1-2 of an HGD gene with a *S. thermophilus* Cas9 endonuclease.

FIG. 52 is a list of gRNA 20 bp spacer sequences, associated PAM, chromosomal and gene location of the target, cut site, and strand for targeting exons 1-2 of an HGD gene with a *T. denticola* Cas9 endonuclease.

FIG. 53 is a list of gRNA 20 bp spacer sequences, associated PAM, chromosomal and gene location of the target, cut site, and strand for targeting exons 1-2 of an HGD gene with a *N. meningitides* Cas9 endonuclease.

FIG. 54 is a list of gRNA 22 bp spacer sequences, associated PAM, chromosomal and gene location of the target, two cut sites, and strand for targeting exons 1-2 of an HGD gene with an *Acidominococcus*, Lachnospiraceae, and *Francisella novicida* Cpf1 endonuclease.

FIG. 55 is a list of gRNA 20 bp spacer sequences, associated PAM, chromosomal and gene location of the target sequence, cut site, and strand for targeting exons 1-2 of an Lp(a) gene with a *S. pyogenes* Cas9 endonuclease.

FIG. 56 is a list of gRNA 20 bp spacer sequences, associated PAM, chromosomal and gene location of the target sequence, cut site, and strand for targeting exons 1-2 of an Lp(a) gene with a *S. aureus* Cas9 endonuclease.

FIG. 57 is a list of gRNA 20 bp spacer sequences, associated PAM, chromosomal and gene location of the target, cut site, and strand for targeting exons 1-2 of an Lp(a) gene with a *S. thermophilus* Cas9 endonuclease.

FIG. 58 is a list of gRNA 20 bp spacer sequences, associated PAM, chromosomal and gene location of the target, cut site, and strand for targeting exons 1-2 of an Lp(a) gene with a *T. denticola* Cas9 endonuclease.

FIG. 59 is a list of gRNA 20 bp spacer sequences, associated PAM, chromosomal and gene location of the target, cut site, and strand for targeting exons 1-2 of an Lp(a) gene with a *N. meningitides* Cas9 endonuclease.

FIG. 60 is a list of gRNA 22 bp spacer sequences, associated PAM, chromosomal and gene location of the target, two cut sites, and strand for targeting exons 1-2 of an Lp(a) gene with an *Acidominococcus*, Lachnospiraceae, and *Francisella novicida* Cpf1 endonuclease.

FIG. 61 is a list of gRNA 20 bp spacer sequences, associated PAM, chromosomal and gene location of the target sequence, cut site, and strand for targeting exons 1-2 of a PCSK9 gene with a *S. pyogenes* Cas9 endonuclease.

FIG. 62 is a list of gRNA 20 bp spacer sequences, associated PAM, chromosomal and gene location of the target sequence, cut site, and strand for targeting exons 1-2 of a PCSK9 gene with a *S. aureus* Cas9 endonuclease.

FIG. 63 is a list of gRNA 20 bp spacer sequences, associated PAM, chromosomal and gene location of the target, cut site, and strand for targeting exons 1-2 of a PCSK9 gene with a *S. thermophilus* Cas9 endonuclease.

FIG. 64 is a list of gRNA 20 bp spacer sequences, associated PAM, chromosomal and gene location of the target, cut site, and strand for targeting exons 1-2 of a PCSK9 gene with a *T. denticola* Cas9 endonuclease.

FIG. 65 is a list of gRNA 20 bp spacer sequences, associated PAM, chromosomal and gene location of the target, cut site, and strand for targeting exons 1-2 of a PCSK9 gene with a *N. meningitides* Cas9 endonuclease.

FIG. 66 is a list of gRNA 22 bp spacer sequences, associated PAM, chromosomal and gene location of the target, two cut sites, and strand for targeting exons 1-2 of a PCSK9 gene with an *Acidominococcus*, Lachnospiraceae, and *Francisella novicida* Cpf1 endonuclease.

FIG. 67 is a list of gRNA 20 bp spacer sequences, associated PAM, chromosomal and gene location of the target sequence, cut site, and strand for targeting exons 1-2 of a Serpina1 gene with a *S. pyogenes* Cas9 endonuclease.

FIG. 68 is a list of gRNA 20 bp spacer sequences, associated PAM, chromosomal and gene location of the target sequence, cut site, and strand for targeting exons 1-2 of a Serpina1 gene with a *S. aureus* Cas9 endonuclease.

FIG. 69 is a list of gRNA 20 bp spacer sequences, associated PAM, chromosomal and gene location of the target, cut site, and strand for targeting exons 1-2 of a Serpina1 gene with a *S. thermophilus* Cas9 endonuclease.

FIG. 70 is a list of gRNA 20 bp spacer sequences, associated PAM, chromosomal and gene location of the target, cut site, and strand for targeting exons 1-2 of a Serpina1 gene with a *T. denticola* Cas9 endonuclease.

FIG. 71 is a list of gRNA 20 bp spacer sequences, associated PAM, chromosomal and gene location of the target, cut site, and strand for targeting exons 1-2 of a Serpina1 gene with a *N. meningitides* Cas9 endonuclease.

FIG. 72 is a list of gRNA 22 bp spacer sequences, associated PAM, chromosomal and gene location of the target, two cut sites, and strand for targeting exons 1-2 of a Serpina1 gene with an *Acidominococcus*, Lachnospiraceae, and *Francisella novicida* Cpf1 endonuclease.

FIG. 73 is a list of gRNA 20 bp spacer sequences, associated PAM, chromosomal and gene location of the target sequence, cut site, and strand for targeting exons 1-2 of a TF gene with a *S. pyogenes* Cas9 endonuclease.

FIG. 74 is a list of gRNA 20 bp spacer sequences, associated PAM, chromosomal and gene location of the target sequence, cut site, and strand for targeting exons 1-2 of a TF gene with a *S. aureus* Cas9 endonuclease.

FIG. 75 is a list of gRNA 20 bp spacer sequences, associated PAM, chromosomal and gene location of the target, cut site, and strand for targeting exons 1-2 of a TF gene with a *S. thermophilus* Cas9 endonuclease.

FIG. 76 is a list of gRNA 20 bp spacer sequences, associated PAM, chromosomal and gene location of the target, cut site, and strand for targeting exons 1-2 of a TF gene with a *T. denticola* Cas9 endonuclease.

FIG. 77 is a list of gRNA 20 bp spacer sequences, associated PAM, chromosomal and gene location of the target, cut site, and strand for targeting exons 1-2 of a TF gene with a *N. meningitides* Cas9 endonuclease.

FIG. 78 is a list of gRNA 22 bp spacer sequences, associated PAM, chromosomal and gene location of the target, two cut sites, and strand for targeting exons 1-2 of a TF gene with an *Acidominococcus*, Lachnospiraceae, and *Francisella novicida* Cpf1 endonuclease.

FIG. 79 is a list of gRNA 20 bp spacer sequences, associated PAM, chromosomal and gene location of the target sequence, cut site, and strand for targeting exons 1-2 of a TTR gene with a *S. pyogenes* Cas9 endonuclease.

FIG. 80 is a list of gRNA 20 bp spacer sequences, associated PAM, chromosomal and gene location of the target sequence, cut site, and strand for targeting exons 1-2 of a TTR gene with a *S. aureus* Cas9 endonuclease.

FIG. 81 is a list of gRNA 20 bp spacer sequences, associated PAM, chromosomal and gene location of the target, cut site, and strand for targeting exons 1-2 of a TTR gene with a *S. thermophilus* Cas9 endonuclease.

FIG. 82 is a list of gRNA 20 bp spacer sequences, associated PAM, chromosomal and gene location of the target, cut site, and strand for targeting exons 1-2 of a TTR gene with a *T. denticola* Cas9 endonuclease.

FIG. 83 is a list of gRNA 20 bp spacer sequences, associated PAM, chromosomal and gene location of the target, cut site, and strand for targeting exons 1-2 of a TTR gene with a *N. meningitides* Cas9 endonuclease.

FIG. 84 is a list of gRNA 22 bp spacer sequences, associated PAM, chromosomal and gene location of the target, two cut sites, and strand for targeting exons 1-2 of a TTR gene with an *Acidominococcus*, Lachnospiraceae, and *Francisella novicida* Cpf1 endonuclease.

FIG. 85 is a list of gRNA 20 bp spacer sequences, associated PAM, chromosomal and gene location of the target sequence, cut site, and strand for targeting the G6PC gene with a *S. pyogenes* Cas9 endonuclease.

FIG. 86 is a list of gRNA 20 bp spacer sequences, associated PAM, chromosomal and gene location of the target sequence, cut site, and strand for targeting the G6PC gene with a *S. aureus* Cas9 endonuclease.

FIG. 87 is a list of gRNA 20 bp spacer sequences, associated PAM, chromosomal and gene location of the target, cut site, and strand for targeting the G6PC gene with a *S. thermophilus* Cas9 endonuclease.

FIG. 88 is a list of gRNA 20 bp spacer sequences, associated PAM, chromosomal and gene location of the target, cut site, and strand for targeting the G6PC gene with a *T. denticola* Cas9 endonuclease.

FIG. 89 is a list of gRNA 20 bp spacer sequences, associated PAM, chromosomal and gene location of the target, cut site, and strand for targeting the G6PC gene with a *N. meningitides* Cas9 endonuclease.

FIG. 90 is a list of gRNA 22 bp spacer sequences, associated PAM, chromosomal and gene location of the target, two cut sites, and strand for targeting the G6PC gene with an *Acidominococcus*, Lachnospiraceae, and *Francisella novicida* Cpf1 endonuclease.

FIG. 91A is a list of pathological variants of the G6PC gene, the start and stop locations of the variants on the chromosome, the type of variant, and the HGVS_g.

FIG. 91B is a list of pathological variants of the G6PC gene, the molecular consequences of the variant, the variant allele, the transcript change, and the protein change.

FIG. 96 is an illustration depicting a comparison of the single stranded donor oligonucleotide and wt allele, where mismatches are highlighted.

BRIEF DESCRIPTION OF THE SEQUENCE LISTING

Figure 92A:
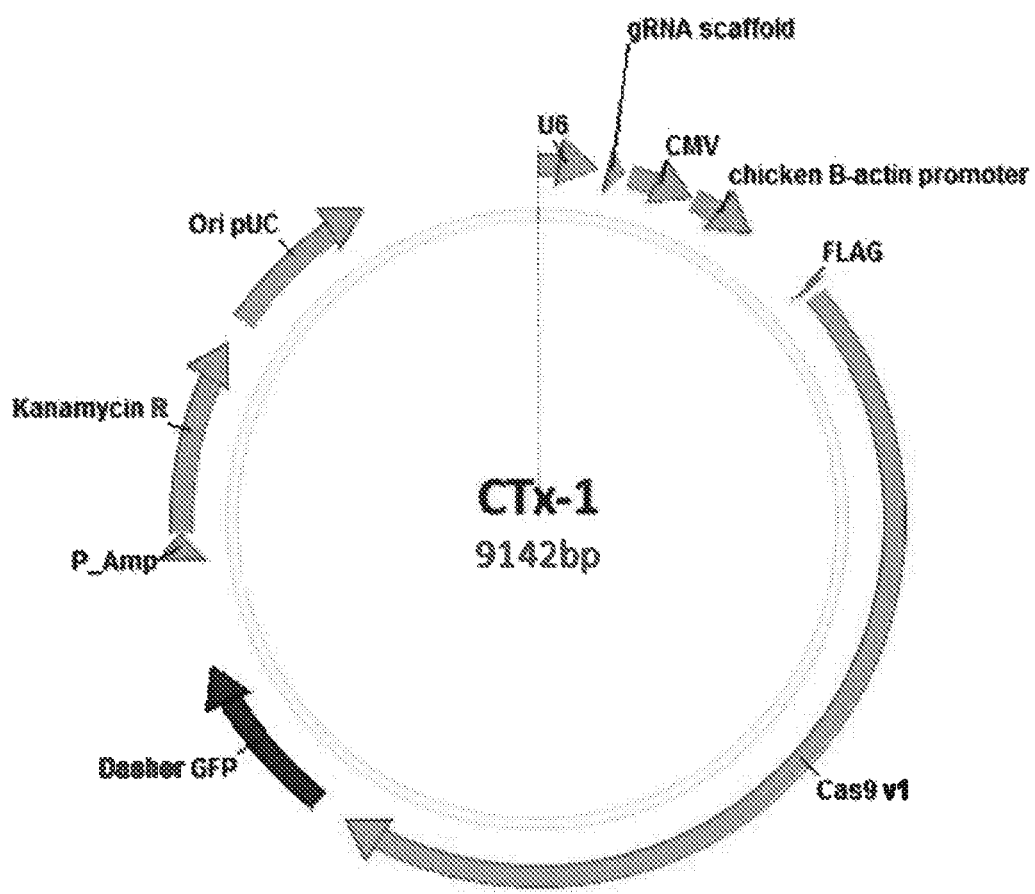
FIG. 92A is an illustration of a plasmid (referred to herein as "CTx-1") comprising a codon optimized gene for *S. pyogenes* Cas9 endonuclease. The CTx-1 plasmid also comprises a gRNA scaffold sequence, which includes a 20 bp spacer sequence from the sequences listed in FIGS. 1, 7, 13, 19, 25, 31, 37, 43, 49, 55, 61, 67, 73, 79, 85, and 91.

SEQ ID NOs: 1-2,032 are 20 bp spacer sequences for targeting exons 1-2 of an AAVS1 (PPP1R12C) gene with a *S. pyogenes* Cas9 endonuclease.

SEQ ID NOs: 2,033-2,203 are 20 bp spacer sequences for targeting exons 1-2 of an AAVS1 (PPP1R12C) gene with a *S. aureus* Cas9 endonuclease.

SEQ ID NOs: 2,204-2,221 are 20 bp spacer sequences for targeting exons 1-2 of an AAVS1 (PPP1R12C) gene with a *S. thermophilus* Cas9 endonuclease.

SEQ ID NOs: 2,222-2,230 are 20 bp spacer sequences for targeting exons 1-2 of an AAVS1 (PPP1R12C) gene with a *T. denticola* Cas9 endonuclease.

SEQ ID NOs: 2,231-2,305 are 20 bp spacer sequences for targeting exons 1-2 of an AAVS1 (PPP1R12C) gene with a *N. meningitides* Cas9 endonuclease.

SEQ ID NOs: 2,306-3,481 are 22 bp spacer sequences for targeting exons 1-2 of an AAVS1 (PPP1R12C) gene with an *Acidominococcus*, Lachnospiraceae, and *Francisella novicida* Cpf1 endonuclease.

SEQ ID NOs: 3,482-3,649 are 20 bp spacer sequences for targeting exons 1-2 of an Alb gene with a *S. pyogenes* Cas9 endonuclease.

SEQ ID NOs: 3,650-3,677 are 20 bp spacer sequences for targeting exons 1-2 of an Alb gene with a *S. aureus* Cas9 endonuclease.

SEQ ID NOs: 3,678-3,695 are 20 bp spacer sequences for targeting exons 1-2 of an Alb gene with a *S. thermophilus* Cas9 endonuclease.

SEQ ID NOs: 3,696-3,700 are 20 bp spacer sequences for targeting exons 1-2 of an Alb gene with a *T. denticola* Cas9 endonuclease.

SEQ ID NOs: 3,701-3,724 are 20 bp spacer sequences for targeting exons 1-2 of an Alb gene with a *N. meningitides* Cas9 endonuclease.

SEQ ID NOs: 3,725-4,103 are 22 bp spacer sequences for targeting exons 1-2 of an Alb gene with an *Acidominococcus*, Lachnospiraceae, and *Francisella novicida* Cpf1 endonuclease.

SEQ ID NOs: 4,104-4,448 are 20 bp spacer sequences for targeting exons 1-2 of an Angptl3 gene with a *S. pyogenes* Cas9 endonuclease.

SEQ ID NOs: 4,449-4,484 are 20 bp spacer sequences for targeting exons 1-2 of an Angptl3 gene with a *S. aureus* Cas9 endonuclease.

SEQ ID NOs: 4,485-4,507 are 20 bp spacer sequences for targeting exons 1-2 of an Angptl3 gene with a *S. thermophilus* Cas9 endonuclease.

SEQ ID NOs: 4,508-4,520 are 20 bp spacer sequences for targeting exons 1-2 of an Angptl3 gene with a *T. denticola* Cas9 endonuclease.

SEQ ID NOs: 4,521-4,583 are 20 bp spacer sequences for targeting exons 1-2 of an Angptl3 gene with a *N. meningitides* Cas9 endonuclease.

SEQ ID NOs: 4,584-5,431 are 22 bp spacer sequences for targeting exons 1-2 of an Angptl3 gene with an *Acidominococcus*, Lachnospiraceae, and *Francisella novicida* Cpf1 endonuclease.

SEQ ID NOs: 5,432-5,834 are 20 bp spacer sequences for targeting exons 1-2 of an ApoC3 gene with a *S. pyogenes* Cas9 endonuclease.

SEQ ID NOs: 5,835-5,859 are 20 bp spacer sequences for targeting exons 1-2 of an ApoC3 gene with a *S. aureus* Cas9 endonuclease.

SEQ ID NOs: 5,860-5,862 are 20 bp spacer sequences for targeting exons 1-2 of an ApoC3 gene with a *S. thermophilus* Cas9 endonuclease.

SEQ ID NOs: 5,863-5,864 are 20 bp spacer sequences for targeting exons 1-2 of an ApoC3 gene with a *T. denticola* Cas9 endonuclease.

SEQ ID NOs: 5,865-5,876 are 20 bp spacer sequences for targeting exons 1-2 of an ApoC3 gene with a *N. meningitides* Cas9 endonuclease.

SEQ ID NOs: 5,877-6,108 are 22 bp spacer sequences for targeting exons 1-2 of an ApoC3 gene with an *Acidominococcus*, Lachnospiraceae, and *Francisella novicida* Cpf1 endonuclease.

SEQ ID NOs: 6,109-7,876 are 20 bp spacer sequences for targeting exons 1-2 of an ASGR2 gene with a *S. pyogenes* Cas9 endonuclease.

SEQ ID NOs: 7,877-8,082 are 20 bp spacer sequences for targeting exons 1-2 of an ASGR2 gene with a *S. aureus* Cas9 endonuclease.

SEQ ID NOs: 8,083-8,106 are 20 bp spacer sequences for targeting exons 1-2 of an ASGR2 gene with a *S. thermophilus* Cas9 endonuclease.

SEQ ID NOs: 8,107-8,118 are 20 bp spacer sequences for targeting exons 1-2 of an ASGR2 gene with a *T. denticola* Cas9 endonuclease.

SEQ ID NOs: 8,119-8,201 are 20 bp spacer sequences for targeting exons 1-2 of an ASGR2 gene with a *N. meningitides* Cas9 endonuclease.

SEQ ID NOs: 8,202-9,641 are 22 bp spacer sequences for targeting exons 1-2 of an ASGR2 gene with an *Acidominococcus*, Lachnospiraceae, and *Francisella novicida* Cpf1 endonuclease.

SEQ ID NOs: 9,642-9,844 are 20 bp spacer sequences for targeting exons 1-2 of a CCR5 gene with a *S. pyogenes* Cas9 endonuclease.

SEQ ID NOs: 9,845-9,876 are 20 bp spacer sequences for targeting exons 1-2 of a CCR5 gene with a *S. aureus* Cas9 endonuclease.

SEQ ID NOs: 9,877-9,890 are 20 bp spacer sequences for targeting exons 1-2 of a CCR5 gene with a *S. thermophilus* Cas9 endonuclease.

SEQ ID NOs: 9,891-9,892 are 20 bp spacer sequences for targeting exons 1-2 of a CCR5 gene with a *T. denticola* Cas9 endonuclease.

SEQ ID NOs: 9,893-9,920 are 20 bp spacer sequences for targeting exons 1-2 of a CCR5 gene with a *N. meningitides* Cas9 endonuclease.

SEQ ID NOs: 9,921-10,220 are 22 bp spacer sequences for targeting exons 1-2 of a CCR5 gene with an *Acidominococcus*, Lachnospiraceae, and *Francisella novicida* Cpf1 endonuclease.

SEQ ID NOs: 10,221-11,686 are 20 bp spacer sequences for targeting exons 1-2 of an F9 gene with a *S. pyogenes* Cas9 endonuclease.

SEQ ID NOs: 11,687-11,849 are 20 bp spacer sequences for targeting exons 1-2 of an F9 gene with a *S. aureus* Cas9 endonuclease.

SEQ ID NOs: 11,850-11,910 are 20 bp spacer sequences for targeting exons 1-2 of an F9 gene with a *S. thermophilus* Cas9 endonuclease.

SEQ ID NOs: 11,911-11,935 are 20 bp spacer sequences for targeting exons 1-2 of an F9 gene with a *T. denticola* Cas9 endonuclease.

SEQ ID NOs: 11,936-12,088 are 20 bp spacer sequences for targeting exons 1-2 of an F9 gene with a *N. meningitides* Cas9 endonuclease.

SEQ ID NOs: 12,089-14,229 are 22 bp spacer sequences for targeting exons 1-2 of an F9 gene with an *Acidominococcus*, Lachnospiraceae, and *Francisella novicida* Cpf1 endonuclease.

SEQ ID NOs: 14,230-19,722 are 20 bp spacer sequences for targeting exons 1-2 of an Gys2 gene with a *S. pyogenes* Cas9 endonuclease.

SEQ ID NOs: 19,723-20,398 are gRNA 20 bp spacer sequences for targeting exons 1-2 of an Gys2 gene with a *S. aureus* Cas9 endonuclease.

SEQ ID NOs: 20,399-20,676 are gRNA 20 bp spacer sequences for targeting exons 1-2 of an Gys2 gene with a *S. thermophilus* Cas9 endonuclease.

SEQ ID NOs: 20,677-20,790 are gRNA 20 bp spacer sequences for targeting exons 1-2 of an Gys2 gene with a *T. denticola* Cas9 endonuclease.

SEQ ID NOs: 20,791-21,470 are gRNA 20 bp spacer sequences for targeting exons 1-2 of an Gys2 gene with a *N. meningitides* Cas9 endonuclease.

SEQ ID NOs: 21,471-29,902 are gRNA 22 bp spacer sequences for targeting exons 1-2 of an Gys2 gene with an *Acidominococcus*, Lachnospiraceae, and *Francisella novicida* Cpf1 endonuclease.

SEQ ID NOs: 29,903-31,595 are gRNA 20 bp spacer sequences for targeting exons 1-2 of an HGD gene with a *S. pyogenes* Cas9 endonuclease.

SEQ ID NOs: 31,596-31,809 are gRNA 20 bp spacer sequences for targeting exons 1-2 of an HGD gene with a *S. aureus* Cas9 endonuclease.

SEQ ID NOs: 31,810-31,892 are gRNA 20 bp spacer sequences for targeting exons 1-2 of an HGD gene with a *S. thermophilus* Cas9 endonuclease.

SEQ ID NOs: 31,893-31,911 are gRNA 20 bp spacer sequences for targeting exons 1-2 of an HGD gene with a *T. denticola* Cas9 endonuclease.

SEQ ID NOs: 31,912-32,112 are gRNA 20 bp spacer sequences for targeting exons 1-2 of an HGD gene with a *N. meningitides* Cas9 endonuclease.

SEQ ID NOs: 32,113-34,437 are gRNA 22 bp spacer sequences for targeting exons 1-2 of an HGD gene with an *Acidominococcus*, Lachnospiraceae, and *Francisella novicida* Cpf1 endonuclease.

SEQ ID NOs: 34,438-38,232 are gRNA 20 bp spacer sequences for targeting exons 1-2 of an Lp(a) gene with a *S. pyogenes* Cas9 endonuclease.

SEQ ID NOs: 38,233-38,642 are gRNA 20 bp spacer sequences for exons 1-2 of targeting the Lp(a) gene with a *S. aureus* Cas9 endonuclease.

SEQ ID NOs: 38,643-38,778 are gRNA 20 bp spacer sequences for targeting the exons 1-2 of Lp(a) gene with a *S. thermophilus* Cas9 endonuclease.

SEQ ID NOs: 38,779-38,813 are gRNA 20 bp spacer sequences for targeting exons 1-2 of an Lp(a) gene with a *T. denticola* Cas9 endonuclease.

SEQ ID NOs: 38,814-39,181 are gRNA 20 bp spacer sequences for targeting exons 1-2 of an Lp(a) gene with a *N. meningitides* Cas9 endonuclease.

SEQ ID NOs: 39,182-43,802 are gRNA 22 bp spacer sequences for targeting exons 1-2 of an Lp(a) gene with an *Acidominococcus*, Lachnospiraceae, and *Francisella novicida* Cpf1 endonuclease.

SEQ ID NOs: 43,803-45,822 are gRNA 20 bp spacer sequences for targeting exons 1-2 of an PCSK9 gene with a *S. pyogenes* Cas9 endonuclease.

SEQ ID NOs: 45,823-46,009 are gRNA 20 bp spacer sequences for targeting exons 1-2 of an PCSK9 gene with a *S. aureus* Cas9 endonuclease.

SEQ ID NOs: 46,010-46,045 are gRNA 20 bp spacer sequences, for targeting exons 1-2 of an PCSK9 gene with a *S. thermophilus* Cas9 endonuclease.

SEQ ID NOs: 46,046-46,059 are gRNA 20 bp spacer sequences for targeting exons 1-2 of an PCSK9 gene with a *T. denticola* Cas9 endonuclease.

SEQ ID NOs: 46,060-46,199 are gRNA 20 bp spacer sequences for targeting exons 1-2 of an PCSK9 gene with a *N. meningitides* Cas9 endonuclease.

SEQ ID NOs: 46,200-47,993 are gRNA 22 bp spacer sequences for targeting exons 1-2 of an PCSK9 gene with an *Acidominococcus*, Lachnospiraceae, and *Francisella novicida* Cpf1 endonuclease.

SEQ ID NOs: 47,994-49,131 are gRNA 20 bp spacer sequences for targeting exons 1-2 of an Serpina1 gene with a *S. pyogenes* Cas9 endonuclease.

SEQ ID NOs: 49,132-49,224 are gRNA 20 bp spacer sequences for targeting exons 1-2 of an Serpina1 gene with a *S. aureus* Cas9 endonuclease.

SEQ ID NOs: 49,225-49,236 are gRNA 20 bp spacer sequences for targeting exons 1-2 of an Serpina1 gene with a *S. thermophilus* Cas9 endonuclease.

SEQ ID NOs: 49,237-49,239 are gRNA 20 bp spacer sequences for targeting exons 1-2 of an Serpina1 gene with a *T. denticola* Cas9 endonuclease.

SEQ ID NOs: 49,240-49,290 are gRNA 20 bp spacer sequences for targeting exons 1-2 of an Serpina1 gene with a *N. meningitides* Cas9 endonuclease.

SEQ ID NOs: 49,291-50,094 are gRNA 22 bp spacer sequences for targeting exons 1-2 of an Serpina1 gene with an *Acidominococcus*, Lachnospiraceae, and *Francisella novicida* Cpf1 endonuclease.

SEQ ID NOs: 50,095-50,926 are gRNA 20 bp spacer sequences for targeting exons 1-2 of an TF gene with a *S. pyogenes* Cas9 endonuclease.

SEQ ID NOs: 50,927-51,012 are gRNA 20 bp spacer sequences for targeting exons 1-2 of an TF gene with a *S. aureus* Cas9 endonuclease.

SEQ ID NOs: 51,013-51,024 are gRNA 20 bp spacer sequences for targeting exons 1-2 of an TF gene with a *S. thermophilus* Cas9 endonuclease.

SEQ ID NOs: 51,025-51,031 are gRNA 20 bp spacer sequences for targeting exons 1-2 of an TF gene with a *T. denticola* Cas9 endonuclease.

SEQ ID NOs: 51,032-51,075 are gRNA 20 bp spacer sequences for targeting exons 1-2 of an TF gene with a *N. meningitides* Cas9 endonuclease.

SEQ ID NOs: 51,076-51,711 are gRNA 22 bp spacer sequences targeting exons 1-2 of an TF gene with an *Acidominococcus*, Lachnospiraceae, and *Francisella novicida* Cpf1 endonuclease.

SEQ ID NOs: 51,712-52,011 are gRNA 20 bp spacer sequences for targeting exons 1-2 of an TTR gene with a *S. pyogenes* Cas9 endonuclease.

SEQ ID NOs: 52,012-52,052 are gRNA 20 bp spacer sequences for targeting exons 1-2 of an TTR gene with a *S. aureus* Cas9 endonuclease.

SEQ ID NOs: 52,053-52,069 are gRNA 20 bp spacer sequences for targeting exons 1-2 of an TTR gene with a *S. thermophilus* Cas9 endonuclease.

SEQ ID NOs: 52,070-52,071 are gRNA 20 bp spacer sequences for targeting exons 1-2 of an TTR gene with a *T. denticola* Cas9 endonuclease.

SEQ ID NOs: 52,072-52,106 are gRNA 20 bp spacer sequences for targeting exons 1-2 of an TTR gene with a *N. meningitides* Cas9 endonuclease.

SEQ ID NOs: 52,107-52,508 are gRNA 22 bp spacer sequences for targeting exons 1-2 of an TTR gene with an *Acidominococcus*, Lachnospiraceae, and *Francisella novicida* Cpf1 endonuclease.

SEQ ID NOs: 52,509-57,754 are gRNA 20 bp spacer sequences for targeting the G6PC gene with a *S. pyogenes* Cas9 endonuclease.

SEQ ID NOs: 57,755-58,367 are gRNA 20 bp spacer sequences for targeting the G6PC gene with a *S. aureus* Cas9 endonuclease.

SEQ ID NOs: 58,368-58,512 are gRNA 20 bp spacer sequences for targeting the G6PC gene with a *S. thermophilus* Cas9 endonuclease.

SEQ ID NOs: 58,513-58,583 are gRNA 20 bp spacer sequences for targeting the G6PC gene with a *T. denticola* Cas9 endonuclease.

SEQ ID NOs: 58,584-59,035 are gRNA 20 bp spacer sequences for targeting the G6PC gene with a *N. meningitides* Cas9 endonuclease.

SEQ ID NOs: 59,036-64,789 are gRNA 22 bp spacer sequences for targeting the G6PC gene with an *Acidominococcus*, Lachnospiraceae, and *Francisella novicida* Cpf1 endonuclease.

DETAILED DESCRIPTION

Glycogen Storage Disease Type 1a (GSD1a)

GSD1a is caused by a homozygous or compound heterozygous mutation that inactivates both copies of the glucose-6-phosphatase, catalytic (G6PC) gene. This gene is located at 17q21 and consists of five exons (OMIM #23220). Glucose-6-Phosphatase (G6Pase) is an endoplasmic reticulum membrane-bound enzyme that catalyzes the removal of phosphate from Glucose-6-Phosphate (van Schaftingen, E., & Gerin, I. Biochem J, 2002). The glucose-6-phosphatase system. Biochem J, 362(Pt 3), 513-532). This is the final step in both gluconeogenesis and glycogenolysis, making G6Pase very important for glucose homeostasis (van Schaftingen, E., & Gerin, I. Biochem J, 2002).

A G6PC knockout mouse model has been generated that demonstrates many of the same disease symptoms, including hyperlipidemia, lactic acidosis, hypoglycemia and hepatomegaly (Mutel, E., et al. J Hepatol, 2011). Not only do G6Pase deficient mice exhibit symptoms similar to those of human GSD1a patients, when these mice are given adenoviral based gene therapy with G6PC, many of the phenotypes associated with GSD1a are reversed (Lee, Y. M., et al. Hepatology, 2012 Zingone, A., et al. J Biol Chem, 2000). These combined studies, as well as results obtained from dogs with a mutation to this gene, indicate that G6PC is the underlying cause of GSD1a (Kishnani, P. S., et al. Vet Pathol, 2001).

There are various mutations associated with GSD1a, which are a combination of missense, nonsense, frameshift and other mutations, with the common effect of inactivating G6Pase (van Schaftingen, E., & Gerin, I. Biochem J, 2002). The various mutations are distributed across the five exons of the gene and appear to be roughly distributed in incidence based on heritage (e.g.: 50% of Caucasians have 130X, while 91% of Japanese patients and carriers have a G>T at base 727) (Kajihara, S., et al. (1995). Exon Redefinition by a Point Mutation within Exon 5 of the Glucose-6-Phosphatase Gene Is the Major Cause of Glycogen Storage Disease type Ia in Japan. Am. J. Hum. Genet., 57, 549-555; Lei, K. J., et al. (1995). Genetic Basis of Glycogen Storage Disease type 1a: Prevalent Mutations at the Glucose-6-Phosphatase Locus. Am. J. Hum. Genet., 57, 766-771). Overall, the most prevalent mutations were at codon 83, with a change from arginine to cysteine or histidine; and at codon 347, with a premature stop (Lei, K. J., et al. Am. J. Hum. Genet., 1995). Codon site 83 resides in the active site of the enzyme, and its charge is critical to its functionality, thus the amino acid change abolishes the action of the enzyme (Chou, J. Y., & Mansfield, B. C. Hum Mutat, 2008).

Though the incidence of the various mutations that cause GSD1a seem to vary based upon population, the overall incidence of the disease is $\frac{1}{100,000}$, with a carrier frequency of $\frac{1}{150}$ (Koeberl, et al. Trends Endocrinol Metab, 2009). There is also an increased prevalence in Ashkenazi Jews, with an incidence of $\frac{1}{20,000}$ (Ekstein, J., et al. (2004). Mutation frequencies for glycogen storage disease Ia in the Ashkenazi Jewish population. Am J Med Genet A, 129A(2), 162-164. doi:10.1002/ajmg.a.30232).

Therapeutic Approach

As the known forms of GSD1a are monogenic disorders with recessive inheritance, it is likely that correcting one of the mutant alleles per cell will be sufficient for correction and restoration or partial restoration of GSD1a function. The correction of one allele can coincide with one copy that remains with the original mutation, or a copy that was cleaved and repaired by non-homologous end joining (NHEJ) and therefore was not properly corrected. Bi-allelic correction can also occur. Various editing strategies that can be employed for specific mutations are discussed below.

Correction of one or possibly both of the mutant alleles provides an important improvement over existing or potential therapies, such as introduction of G6PC expression cassettes through lentivirus delivery and integration. Gene editing has the advantage of precise genome modification and lower adverse effects, for example, the mutation can be corrected by the insertions or deletions that arise due to the NHEJ repair pathway. If the patient's G6PC gene has an inserted or deleted base, a targeted cleavage can result in a NHEJ-mediated insertion or deletion that restores the frame. Missense mutations can also be corrected through NHEJ-mediated correction using one or more guide RNA. The ability or likelihood of the cut(s) to correct the mutation can be designed or evaluated based on the local sequence and micro-homologies. NHEJ can also be used to delete segments of the gene, either directly or by altering splice donor or acceptor sites through cleavage by one gRNA targeting several locations, or several gRNAs. This may be useful if an amino acid, domain or exon contains the mutations and can be removed or inverted, or if the deletion otherwise restored function to the protein. Pairs of guide strands have been used for deletions and corrections of inversions.

Alternatively, the donor for correction by HDR contains the corrected sequence with small or large flanking homology arms to allow for annealing. HDR is essentially an error-free mechanism that uses a supplied homologous DNA sequence as a template during DSB repair. The rate of HDR is a function of the distance between the mutation and the cut site so choosing overlapping or nearby target sites is important. Templates can include extra sequences flanked by the homologous regions or can contain a sequence that differs from the genomic sequence, thus allowing sequence editing.

In addition to correcting mutations by NHEJ or HDR, a range of other options are possible. If there are small or large deletions or multiple mutations, a cDNA can be knocked in that contains the exons affected. A full length cDNA can be knocked into any "safe harbor"—i.e., non-deleterious insertion point that is not the G6PC gene itself—, with or without suitable regulatory sequences. If this construct is knocked-in near the G6PC regulatory elements, it should have physiological control, similar to the normal gene. Two or more (e.g., a pair) nucleases can be used to delete mutated gene regions, though a donor would usually have to be provided to restore function. In this case two gRNA and one donor sequence would be supplied.

Provided herein are methods to correct the specific mutation in the gene by inducing a double stranded break with Cas9 and a sgRNA or a pair of double stranded breaks around the mutation using two appropriate sgRNAs, and to provide a donor DNA template to induce Homology-Directed Repair (HDR). In some embodiments, the donor DNA template can be a short single stranded oligonucleotide, a short double stranded oligonucleotide, a long single or double stranded DNA molecule. These methods use gRNAs and donor DNA molecules for each of the variants of G6PC.

Provided herein are methods to knock-in G6PC cDNA or a minigene (comprised of one or more exons and introns or natural or synthetic introns) into the locus of the corresponding gene. These methods use a pair of sgRNA targeting the first exon and/or the first intron of the G6PC gene. In some embodiments, the donor DNA is single or double stranded DNA having homologous arms to the 17q21 region.

Provided herein are methods to knock-in G6PC cDNA or a minigene (comprised of one or more exons and introns or natural or synthetic introns) into the locus of the hot-spot, e.g. ALB gene. These methods use a pair of sgRNA targeting the first exon and/or the first intron of the gene located in the liver hotspot. In some embodiments, the donor DNA is single or double stranded DNA having homologous arms to the corresponding region.

Provided herein are cellular, ex vivo and in vivo methods for using genome engineering tools to create permanent changes to the genome by: 1) correcting, by insertions or deletions that arise due to the imprecise NHEJ pathway, one or more mutations within or near the G6PC gene, 2) correcting, by HDR, one or more mutations within or near the G6PC gene, or 3) deletion of the mutant region and knocking-in G6PC cDNA or a minigene (comprised of one or more exons and introns or natural or synthetic introns) into the gene locus or a safe harbor locus in the glucose-6-phosphatase, catalytic (G6PC) gene and restoring G6Pase protein activity. Such methods use endonucleases, such as CRISPR-associated (CRISPR/Cas9, Cpf1 and the like) nucleases, to permanently delete, insert, edit, correct, or replace one or more exons (i.e., mutations within or near the coding and/or splicing sequences) in the genomic locus of the G6PC gene or other DNA sequences that encode regulatory elements of the G6PC gene. In this way, examples set forth in the present disclosure can help to restore the reading frame or the wild-type sequence of, or otherwise correct, the gene with a single treatment (rather than deliver potential therapies for the lifetime of the patient). G6PC gene.

Provided herein are methods for treating a patient with GSD1a. An embodiment of such method is an ex vivo cell based therapy. For example, a patient specific induced pluripotent stem cell (iPSC) is created. Then, the chromosomal DNA of these iPS cells is edited using the materials and methods described herein. Next, the genome-edited iPSCs are differentiated into hepatocytes. Finally, the hepatocytes are implanted into the patient.

Another embodiment of such method is an ex vivo cell based therapy. For example, a biopsy of the patient's liver is performed. Then, a liver specific progenitor cell or primary hepatocyte is isolated from the patient, e.g., by a biopsy. Next, the chromosomal DNA of these progenitor cells or primary hepatocytes is edited using the materials and methods described herein. Finally, the genome-edited progenitor cells or primary hepatocytes are implanted into the patient.

Yet another embodiment of such method is an ex vivo cell based therapy. For example, a biopsy of the patient's bone marrow is performed. Then, a mesenchymal stem cell is isolated from the patient, which can be isolated from the patient's bone marrow, e.g., by biopsy, or peripheral blood.

Next, the chromosomal DNA of these mesenchymal stem cells is edited using the materials and methods described herein. Next, the genome-edited mesenchymal stem cells are differentiated into hepatocytes. Finally, these hepatocytes are implanted into the patient.

One advantage of an ex vivo cell therapy approach is the ability to conduct a comprehensive analysis of the therapeutic prior to administration. All nuclease based therapeutics have some level of off-target effects. Performing gene correction ex vivo allows one to fully characterize the corrected cell population prior to implantation. Aspects of the invention include sequencing the entire genome of the corrected cells to ensure that the off-target cuts, if any, are in genomic locations associated with minimal risk to the patient. Furthermore, populations of specific cells, including clonal populations, can be isolated prior to implantation.

Another advantage of ex vivo cell therapy relates to genetic correction in iPSCs compared to other primary cell sources. iPSCs are prolific, making it easy to obtain the large number of cells that will be required for a cell based therapy. Furthermore, iPSCs are an ideal cell type for performing clonal isolations. This allows screening for the correct genomic correction, without risking a decrease in viability. In contrast, other potential cell types, such as primary hepatocytes, are viable for only a few passages and difficult to clonally expand. Thus, manipulation of GSD1a iPSCs will be much easier, and will shorten the amount of time needed to make the desired genetic correction.

Another embodiment of such method is an in vivo based therapy. In this method, the chromosomal DNA of the cells in the patient is corrected using the materials and methods described herein.

An advantage of in vivo gene therapy is the ease of therapeutic production and administration. The same therapeutic approach and therapy will have the potential to be used to treat more than one patient, for example a number of patients who share the same or similar genotype or allele. In contrast, ex vivo cell therapy typically requires using a patient's own cells, which are isolated, manipulated and returned to the same patient.

Also provided herein is a cellular method for editing the glucose-6-phosphatase, catalytic (G6PC) gene in a cell by genome editing. For example, a cell is isolated from a patient or animal. Then, the chromosomal DNA of the cell is edited using the materials and methods described herein.

The methods of the invention, regardless of whether a cellular or ex vivo or in vivo method, can involve one or a combination of the following: 1) correcting, by insertions or deletions that arise due to the imprecise NHEJ pathway, one or more mutations within or near the G6PC gene or other DNA sequences that encode regulatory elements of the G6PC gene, 2) correcting, by HDR, one or more mutations within or near the G6PC gene or other DNA sequences that encode regulatory elements of the G6PC gene, 3) deletion of the mutant region and knocking-in G6PC cDNA or a minigene (comprised of one or more exons and introns or natural or synthetic introns) into the gene locus or at a heterologous location in the genome (such as a safe harbor locus, such as, e.g., targeting exon 1-2 of, an albumin gene, an AAVS1 (PPP1 R12C) gene, an ALB gene, an Angptl3 gene, an ApoC3 gene, an ASGR2 gene, a CCR5 gene, a FIX (F9) gene, a Gys2 gene, an HGD gene, an Lp(a) gene, a Pcsk9 gene, a Serpina1 gene, a TF gene, and/or a TTR gene, or 4) deletion of the mutant region and knocking-in G6PC cDNA or a minigene (comprised of one or more exons and introns or natural or synthetic introns) into the first exon of HGD, leading to disruption of HGD expression. HGD−/− hepatocytes have proliferation advantage when FAH activity is absent or reduced. Inhibition of FAH can be achieved by treatment with shRNA (AAV) targeting FAH, or siRNA (LNP formulated, or conjugate with GalNAc, or with cholesterol) or treatment with CEHPOBA (see e.g., Paulk et al. "In vivo selection of transplanted hepatocytes by pharmacological inhibition of fumarylacetoacetate hydrolase in wild-type mice." Mol Ther 2012, 20(10):1981-1987). Assessment of efficiency of HDR mediated knock-in of cDNA into the first exon can utilize cDNA knock-in into "safe harbor" sites such as: single-stranded or double-stranded DNA having homologous arms to one of the following regions, for example: ApoC3 (chr11:116829908-116833071), Angptl3 (chr1:62,597,487-62,606,305), Serpina1 (chr14:94376747-94390692), Lp(a) (chr6:160531483-160664259), Pcsk9 (chr1:55,039,475-55,064,852), FIX (chrX:139,530,736-139,563,458), ALB (chr4:73,404,254-73,421,411), TTR (chr18:31,591,766-31,599,023), TF (chr3:133,661,997-133,779,005), Gys2 (chr12:21,536,188-21,604,857), AAVS1(PPP1R12C) (chr19:55,090,912-55,117,599), HGD (chr3:120,628,167-120,682,570), CCR5 (chr3:46,370,854-46,376,206), ASGR2 (chr17:7,101,322-7,114,310), 5'UTR correspondent to ASS1 or alternative 5' UTR, complete CDS of G6PC and 3' UTR of G6PC or modified 3' UTR and at least 80 nt of the first intron, alternatively same DNA template sequence will be delivered by AAV. Both the HDR and knock-in strategies utilize a donor DNA template in Homology-Directed Repair (HDR). HDR in either strategy may be accomplished by making one or more single-stranded breaks (SSBs) or one or more double-stranded breaks (DSBs) at specific sites in the genome by using one or more endonucleases.

For example, the NHEJ correction strategy can involve restoring the reading frame in the G6PC gene by inducing one single stranded break or double stranded break in the gene of interest with one or more CRISPR endonucleases and a gRNA (e.g., crRNA+tracrRNA, or sgRNA), or two or more single stranded breaks or double stranded breaks in the gene of interest with two or more CRISPR endonucleases and two or more sgRNAs. This approach can require development and optimization of sgRNAs for the G6PC gene.

For example, the HDR correction strategy involves restoring the reading frame in the G6PC gene by inducing one single stranded break or double stranded break in the gene of interest one or more CRISPR endonucleases and gRNA (e.g., crRNA+tracrRNA, or sgRNA), or two or more single stranded breaks or double stranded breaks in the gene of interest with one or more CRISPR endonucleases and two or more appropriate gRNAs, in the presence of a donor DNA template introduced exogenously to direct the cellular DSB response to Homology-Directed Repair (the donor DNA template can be a short single stranded oligonucleotide, a short double stranded oligonucleotide, a long single or double stranded DNA molecule). This approach requires development and optimization of gRNAS and donor DNA molecules for all major variants of the G6PC gene.

For example, the knock-in strategy involves knocking-in G6PC cDNA or a minigene (comprised of one or more exons and introns or natural or synthetic introns) into the locus of the gene using a gRNA (e.g., crRNA+tracrRNA, or sgRNA) or a pair of gRNAs targeting upstream of or in the first or other exon and/or intron of the G6PC gene, or in a safe harbor site (such as, e.g., exon 1-2 of, AAVS1 (PPP1R12C), ALB, Angptl3, ApoC3, ASGR2, CCR5, FIX (F9), Gys2, HGD, Lp(a), Pcsk9, Serpina1, TF, and/or TTR). The donor DNA will be single or double stranded DNA having homologous arms to the 17q21 region.

The advantages for both strategies (correction and knock-in) are similar, including in principle both short and long term beneficial clinical and laboratory effects. In addition, it may be that only a low percentage of G6Pase activity is required to provide therapeutic benefit. Another advantage for both strategies is that most patients have low-level gene and protein activity, therefore suggesting that additional protein expression, for example following gene correction, should not necessarily lead to an immune response against the target gene product. The knock-in approach does provide one advantage over the correction approach—the ability to treat all patients versus only a subset of patients. While there is a common mutation in this gene (at codon 83), there are also many other possible mutations, and using the knock-in method could treat all of them. The other issue with gene editing in this manner is the need for a DNA donor for HDR.

In addition to the above genome editing strategies, another strategy involves modulating expression, function, or activity of G6PC by editing in the regulatory sequence.

In addition to the editing options listed above, Cas9 or similar proteins can be used to target effector domains to the same target sites that can be identified for editing, or additional target sites within range of the effector domain. A range of chromatin modifying enzymes, methylases or demethlyases can be used to alter expression of the target gene. One possibility is increasing the expression of the G6Pase protein if the mutation leads to lower activity. These types of epigenetic regulation have some advantages, particularly as they are limited in possible off-target effects.

A number of types of genomic target sites are present in addition to mutations in the coding and splicing sequences.

The regulation of transcription and translation implicates a number of different classes of sites that interact with cellular proteins or nucleotides. Often the DNA binding sites of transcription factors or other proteins can be targeted for mutation or deletion to study the role of the site, though they can also be targeted to change gene expression. Sites can be added through non-homologous end joining (NHEJ) or direct genome editing by homology directed repair (HDR). Increased use of genome sequencing, RNA expression and genome-wide studies of transcription factor binding have increased the ability to identify how the sites lead to developmental or temporal gene regulation. These control systems may be direct or may involve extensive cooperative regulation that can require the integration of activities from multiple enhancers. Transcription factors typically bind 6-12 bp-long degenerate DNA sequences. The low level of specificity provided by individual sites suggests that complex interactions and rules are involved in binding and the functional outcome. Binding sites with less degeneracy may provide simpler means of regulation. Artificial transcription factors can be designed to specify longer sequences that have less similar sequences in the genome and have lower potential for off-target cleavage. Any of these types of binding sites can be mutated, deleted or even created to enable changes in gene regulation or expression (Canver, M. C. et al., Nature (2015)).

Another class of gene regulatory regions having these features is microRNA (miRNA) binding sites. miRNAs are non-coding RNAs that play key roles in post-transcriptional gene regulation. miRNA may regulate the expression of 30% of all mammalian protein-encoding genes. Specific and potent gene silencing by double stranded RNA (RNAi) was discovered, plus additional small noncoding RNA (Canver, M. C. et al., Nature (2015)). The largest class of noncoding RNAs important for gene silencing are miRNAs. In mammals, miRNAs are first transcribed as a long RNA transcripts, which can be separate transcriptional units, part of protein introns, or other transcripts. The long transcripts are called primary miRNA (pri-miRNA) that include imperfectly base-paired hairpin structures. These pri-miRNA are cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported, into the mature 19-25 nucleotide miRNA:miRNA* duplexes. The miRNA strand with lower base pairing stability (the guide strand) is loaded onto the RNA-induced silencing complex (RISC). The passenger guide strand (marked with *), may be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. *Cell* 136, 215-233 (2009); Saj, A. & Lai, E. C. *Curr Opin Genet Dev* 21,504-510 (2011)).

miRNAs are important in development, differentiation, cell cycle and growth control, and in virtually all biological pathways in mammals and other multicellular organisms. miRNAs are also involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual transcript can be targeted by many different miRNAs. More than 28645 microRNAs have been annotated in the latest release of miRBase (v.21). Some miRNAs are encoded by multiple loci, some of which are expressed from tandemly co-transcribed clusters. The features allow for complex regulatory networks with multiple pathways and feedback controls. miRNAs are integral parts of these feedback and regulatory circuits and can help regulate gene expression by keeping protein production within limits (Herranz, H. & Cohen, S. M. *Genes Dev* 24, 1339-1344 (2010); Posadas, D. M. & Carthew, R. W. *Curr Opin Genet Dev* 27, 1-6 (2014)).

miRNA are also important in a large number of human diseases that are associated with abnormal miRNA expression. This association underscores the importance of the miRNA regulatory pathway. Recent miRNA deletion studies have linked miRNA with regulation of the immune responses (Stern-Ginossar, N. et al., *Science* 317, 376-381 (2007)).

miRNA also have a strong link to cancer and may play a role in different types of cancer. miRNAs have been found to be downregulated in a number of tumors. miRNA are important in the regulation of key cancer-related pathways, such as cell cycle control and the DNA damage response, and are therefore used in diagnosis and are being targeted clinically. MicroRNAs delicately regulate the balance of angiogenesis, such that experiments depleting all microRNAs suppresses tumor angiogenesis (Chen, S. et al., *Genes Dev* 28, 1054-1067 (2014)).

As has been shown for protein coding genes, miRNA genes are also subject to epigenetic changes occurring with cancer. Many miRNA loci are associated with CpG islands increasing their opportunity for regulation by DNA methylation (Weber, B., Stresemann, C., Brueckner, B. & Lyko, F. *Cell Cycle* 6, 1001-1005 (2007)). The majority of studies have used treatment with chromatin remodeling drugs to reveal epigenetically silenced miRNAs.

In addition to their role in DNA silencing, miRNA can also activate translation (Posadas, D. M. & Carthew, R. W. *Curr Opin Genet Dev* 27, 1-6 (2014)). Knocking out these sites may lead to decreased expression of the targeted gene, while introducing these sites may increase expression.

Individual miRNA can be knocked out most effectively by mutating the seed sequence (bases 2-8 of the microRNA), which is important for binding specificity. Cleavage in this region, followed by mis-repair by NHEJ can effectively abolish miRNA function by blocking binding to target sites. miRNA could also be inhibited by specific targeting of the special loop region adjacent to the palindromic sequence. Catalytically inactive Cas9 can also be used to inhibit shRNA expression (Zhao, Y. et al., *Sci Rep* 4, 3943 (2014)). In addition to targeting the miRNA, the binding sites can also be targeted and mutated to prevent the silencing by miRNA.

Human Cells

For ameliorating GSD1a, as described and illustrated herein, the principal targets for gene editing are human cells. For example, in the ex vivo methods, the human cells are somatic cells, which after being modified using the techniques as described, can give rise to hepatocytes or progenitor cells. For example, in the in vivo methods, the human cells are hepatocytes, renal cells or cells from other affected organs.

By performing gene editing in autologous cells that are derived from and therefore already completely matched with the patient in need, it is possible to generate cells that can be safely re-introduced into the patient, and effectively give rise to a population of cells that will be effective in ameliorating one or more clinical conditions associated with the patient's disease.

Progenitor cells (also referred to as stem cells herein) are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one embodiment, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell may derive from a multipotent cell that itself is derived from a multipotent cell, and so on. While each of these multipotent cells may be considered stem cells, the range of cell types that each can give rise to may vary considerably. Some differentiated cells also have the capacity to give rise to cells of greater developmental potential. Such capacity may be natural or may be induced artificially upon treatment with various factors. In many biological instances, stem cells are also "multipotent" because they can produce progeny of more than one distinct cell type, but this is not required for "stem-ness."

Self-renewal is another important aspect of the stem cell. In theory, self-renewal can occur by either of two major mechanisms. Stem cells may divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, such as a myocyte, which plays a characteristic role in a certain tissue type, and may or may not retain the capacity to proliferate further.

Induced Pluripotent Stem Cells

In some embodiments, the genetically engineered human cells described herein are induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a progenitor cell to be administered to the subject (e.g., autologous cells). Because the progenitors are essentially derived from an autologous source, the risk of engraftment rejection or allergic response is reduced compared to the use of cells from another subject or group of subjects. In addition, the use of iPSCs negates the need for cells obtained from an embryonic source. Thus, in one embodiment, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. In some embodiments, reprogramming encompasses complete reversion of the differentiation state of a differentiated cell (e.g., a somatic cell) to a pluripotent state or a multipotent state. In some embodiments, reprogramming encompasses complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain embodiments described herein, reprogramming of a differentiated cell (e.g., a somatic cell) causes the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a myogenic stem cell). Reprogramming is also distinct from promoting the self-renewal or proliferation of cells that are already pluripotent or multipotent, although the compositions and methods described herein can also be of use for such purposes, in some embodiments.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, Cell 126(4): 663-76 (2006). iPSCs resemble ES cells, as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, Cell Stem Cell. 3(6):595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, Stem Cells Transl Med. 3(4):448-57 (2014); Barrett et al., Stem Cells Trans Med 3:1-6 sctm.2014-0121 (2014); Focosi et al., Blood Cancer Journal 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., Cell Stem Cell, 7(5):618-30 (2010). Reprogramming can be achieved by introducing a combination of nucleic acids encoding stem cell-associated genes, including, for example, Oct-4 (also known as Oct-3/4 or Pouf51), Sox1, Sox2, Sox3, Sox 15, Sox 18, NANOG, Klf1, Klf2, Klf4, Klf5, NR5A2, c-Myc, 1-Myc, n-Myc, Rem2, Tert, and LIN28. In one embodiment, reprogramming using the methods and compositions described herein can further comprise introducing one or more of Oct-3/4, a member of the Sox family, a member of the Klf family, and a member of the Myc family to a somatic cell. In one embodiment, the methods and compositions described herein further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one embodiment the reprogramming is not effected by a method that alters the genome. Thus, in such embodiments, reprogramming is achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., Cell-Stem Cell 2:525-528 (2008); Huangfu et al., Nature Biotechnology 26(7):795-797 (2008) and Marson et al., Cell-Stem Cell 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(1,3-Dioxo-1H,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-Cl-UCHA (e.g., 6-(3-chlorophenylureido) caproic hydroxamic acid), AOE (2-amino-8-oxo-9,10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers are selected from the non-limiting group including SSEA3, SSEA4, CD9, Nanog, Fbxl5, Ecat1, Esg1, Eras, Gdf3, Fgf4, Cripto, Dax1, Zpf296, Slc2a3, Rex1, Utf1, and Nat1. In one embodiment, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. In some embodiments, detection involves not only RT-PCR, but also includes detection of protein markers. Intracellular markers may be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells are introduced into nude mice and histology and/or immunohistochemistry is performed on a tumor arising from the cells. The growth of a tumor comprising cells from all three germ layers, for example, further indicates that the cells are pluripotent stem cells.

Hepatocytes

In some embodiments, the genetically engineered human cells described herein are hepatocytes. A hepatocyte is a cell of the main parenchymal tissue of the liver. Hepatocytes make up 70-85% of the liver's mass. These cells are involved in: protein synthesis; protein storage; transformation of carbohydrates; synthesis of cholesterol, bile salts and phospholipids; detoxification, modification, and excretion of exogenous and endogenous substances; and initiation of formation and secretion of bile.

G6PC is primarily expressed in hepatocytes (parenchymal liver cells) with secondary expression in the cells of the kidney, intestine and salivary glands. Therefore, the correction of G6PC is primarily targeted at hepatocytes and the liver, as well as the secondary sites of expression that are associated with clinical manifestation, for example the kidney.

Creating Patient Specific iPSCs

One step of the ex vivo methods of the invention involves creating a patient specific iPS cell, patient specific iPS cells, or a patient specific iPS cell line. There are many established methods in the art for creating patient specific iPS cells, as described in Takahashi and Yamanaka 2006; Takahashi, Tanabe et al. 2007. For example, the creating step comprises: a) isolating a somatic cell, such as a skin cell or fibroblast from the patient; and b) introducing a set of pluripotency-associated genes into the somatic cell in order to induce the cell to become a pluripotent stem cell. In some embodiments, the set of pluripotency-associated genes is one or more of the genes selected from the group consisting of OCT4, SOX2, KLF4, Lin28, NANOG, and cMYC.

Performing a Biopsy or Spirate of the Patient's Liver or Bone Marrow

A biopsy or aspirate is a sample of tissue or fluid taken from the body. There are many different kinds of biopsies or aspirates. Nearly all of them involve using a sharp tool to remove a small amount of tissue. If the biopsy will be on the skin or other sensitive area, numbing medicine is applied first. A biopsy or aspirate may be performed according to any of the known methods in the art. For example, in a liver biopsy, a needle is injected into the liver through the skin of the belly, capturing the liver tissue. For example, in a bone marrow aspirate, a large needle is used to enter the pelvis bone to collect bone marrow.

Isolating a Liver Specific Progenitor Cell or Primary Hepatocyte

Liver specific progenitor cells and primary hepatocytes may be isolated according to any method known in the art. For example, human hepatocytes are isolated from fresh surgical specimens (e.g., an autologous sample). Healthy liver tissue is used to isolate hepatocytes by collagenase digestion. The obtained cell suspension is filtered through a 100-mm nylon mesh and sedimented by centrifugation at 50 g for 5 minutes, resuspended, and washed two to three times in cold wash medium. Human liver stem cells are obtained by culturing under stringent conditions of hepatocytes obtained from fresh liver preparations. Hepatocytes seeded on collagen-coated plates are cultured for 2 weeks. After 2 weeks, surviving cells are removed, and characterized for expression of stem cells markers (Herrera et al, STEM CELLS 2006;24: 2840-2850).

Isolating a Mesenchymal Stem Cell

Mesenchymal stem cells may be isolated according to any method known in the art, such as from a patient's bone marrow or peripheral blood. For example, marrow aspirate is collected into a syringe with heparin. Cells are washed and centrifuged on a Percoll™. Cells, such as blood cells, liver cells, interstitial cells, macrophages, mast cells, and thymocytes, are separated using Percoll™ The cells are cultured in Dulbecco's modified Eagle's medium (DMEM) (low glucose) containing 10% fetal bovine serum (FBS) (Pittinger M F, Mackay A M, Beck S C et al., Science 1999; 284:143-147).

Genome Editing

Genome editing generally refers to the process of modifying the nucleotide sequence of a genome, preferably in a precise or pre-determined manner. Examples of methods of genome editing described herein include methods of using site-directed nucleases to cut deoxyribonucleic acid (DNA) at precise target locations in the genome, thereby creating double-strand or single-strand DNA breaks at particular locations within the genome. Such breaks can be and regularly are repaired by natural, endogenous cellular processes, such as homology-directed repair (HDR) and non-homologous end-joining (NHEJ), as recently reviewed in Cox et al., Nature Medicine 21(2), 121-31 (2015). These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence may be in the endogenous genome, such as a sister chromatid. Alternatively, the donor may be an exogenous nucleic acid, such as a plasmid, a single-strand oligonucleotide, a double-stranded oligonucleotide, a duplex oligonucleotide or a virus, that has regions of high homology with the nuclease-cleaved locus, but which may also contain additional sequence or sequence changes including deletions that can be incorporated into the cleaved target locus. A third repair mechanism is microhomology-mediated end joining (MMEJ), also referred to as "Alternative NHEJ", in which the genetic outcome is similar to NHEJ in that small deletions and insertions can occur at the cleavage site. MMEJ makes use of homologous sequences of a few basepairs flanking the DNA break site to drive a more favored DNA end joining repair outcome, and recent reports have further elucidated the molecular mechanism of this process; see, e.g., Cho and Greenberg, Nature 518, 174-76 (2015); Kent et al., Nature Structural and Molecular Biology, Adv. Online doi:10.1038/nsmb.2961(2015), Mateos-Gomez et al., Nature 518, 254-57 (2015); Ceccaldi et al., Nature 528, 258-62 (2015). In some instances it may be possible to predict likely repair outcomes based on analysis of potential microhomologies at the site of the DNA break.

Each of these genome editing mechanisms can be used to create desired genomic alterations. A step in the genome editing process is to create one or two DNA breaks, the latter as double-strand breaks or as two single-stranded breaks, in the target locus as close as possible to the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways (e.g., homology-dependent repair or non-homologous end joining or alternative non-homologous end joining (A-NHEJ) or microhomology-mediated end joining). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide, double-stranded oligonucleotide, or viral nucleic acid. With exogenous donor templates, it is common to introduce an additional nucleic acid sequence (such as a transgene) or modification (such as a single or multiple base change or a deletion) between the flanking regions of homology so that the additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination is used to insert an exogenous polynucleotide sequence into the target nucleic acid cleavage site. An exogenous polynucleotide sequence is termed a donor polynucleotide (or donor or donor sequence or polynucleotide donor template) herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary hairpin structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA is modified by endogenous RNaseIII, and then hybridizes to a crRNA repeat in the pre-crRNA array. Endogenous RNaseIII is recruited to cleave the pre-crRNA. Cleaved crRNAs are subjected to exoribonuclease trimming to produce the mature crRNA form (e.g., 5' trimming). The tracrRNA remains hybridized to the crRNA, and the tracrRNA and the crRNA associate with a site-directed polypeptide (e.g., Cas9). The crRNA of the crRNA-tracrRNA-Cas9 complex guides the complex to a target nucleic acid to which the crRNA can hybridize. Hybridization of the crRNA to the target nucleic acid activates Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., Science, 337 (6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays are processed into mature crRNAS without the requirement of an additional trans-activating tracrRNA. The Type V CRISPR array is processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems start with 20-24 nucleotides of spacer sequence followed by about 22 nucleotides of direct repeat. Also, Cpf1 utilizes a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Exemplary CRISPR/Cas polypeptides include the Cas9 polypeptides in FIG. 1 of Fonfara et al., *Nucleic Acids Research*, 42: 2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA. The site-directed may be administered to a cell or a patient as either: one or more polypeptides, or one or more mRNAs encoding the polypeptide.

In the context of a CRISPR/Cas or CRISPR/Cpf1 system, the site-directed polypeptide can bind to a guide RNA that, in turn, specifies the site in the target DNA to which the polypeptide is directed. In embodiments of CRISPR/Cas or CRISPR/Cpf1 systems herein, the site-directed polypeptide is an endonuclease, such as a DNA endonuclease.

In some embodiments, a site-directed polypeptide comprises a plurality of nucleic acid-cleaving (i.e., nuclease) domains. Two or more nucleic acid-cleaving domains can be linked together via a linker. In some embodiments, the linker comprises a flexible linker. Linkers may comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally-occurring and recombinant Cas9s. Cas9 enzymes contemplated herein comprise a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., homology-dependent repair (HDR) or non-homologous end joining (NHEJ) or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide or viral nucleic acid. With exogenous donor templates, it is common to introduce an additional nucleic acid sequence (such as a transgene) or modification (such as a single or multiple base change or a deletion) between the flanking regions of homology so that the additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination is used to insert an exogenous polynucleotide sequence into the target nucleic acid cleavage site. An exogenous polynucleotide sequence is termed a donor polynucleotide (or donor or donor sequence) herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from *S. pyogenes*, US2014/0068797 Sequence ID No. 8 or Sapranauskas et al., *Nucleic Acids Res*, 39(21): 9275-9282 (2011)], and various other site-directed polypeptides).

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to the nuclease domain of a wild-type exemplary site-directed polypeptide (e.g., Cas9 from *S. pyogenes*, supra).

In some embodiments, a site-directed polypeptide comprises at least 70, 75, 80, 85, 90, 95, 97, 99, or 100% identity to a wild-type site-directed polypeptide (e.g., Cas9 from *S. pyogenes*, supra) over 10 contiguous amino acids. In some embodiments, a site-directed polypeptide comprises at most: 70, 75, 80, 85, 90, 95, 97, 99, or 100% identity to a wild-type site-directed polypeptide (e.g., Cas9 from *S. pyogenes*, supra) over 10 contiguous amino acids. In some embodiments, a site-directed polypeptide comprises at least: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. In some embodiments, a site-directed polypeptide comprises at most: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. In some embodiments, a site-directed polypeptide comprises at least: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide. In some embodiments, a site-directed polypeptide comprises at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

In some embodiments, the site-directed polypeptide comprises a modified form of a wild-type exemplary site-directed polypeptide. The modified form of the wild-type exemplary site-directed polypeptide comprises a mutation that reduces the nucleic acid-cleaving activity of the site-directed polypeptide. In some embodiments, the modified form of the wild-type exemplary site-directed polypeptide has less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

In some embodiments, the modified form of the site-directed polypeptide comprises a mutation such that it can induce a single-strand break (SSB) on a target nucleic acid (e.g., by cutting only one of the sugar-phosphate backbones of a double-strand target nucleic acid). In some embodiments, the mutation results in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). In some embodiments, the mutation results in one or more of the plurality of nucleic acid-cleaving domains retaining the ability to cleave the complementary strand of the target nucleic acid, but reducing its ability to cleave the non-complementary strand of the target nucleic acid. In some embodiments, the mutation results in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856, are mutated to inactivate one or more of the plurality of nucleic acid-cleaving domains (e.g., nuclease domains). In some embodiments, the residues to be mutated correspond to residues Asp10, His840, Asn854 and Asn856 in the wild-type exemplary *S. pyogenes* Cas9 polypeptide (e.g., as determined by sequence and/or structural alignment). Non-limiting examples of mutations include D10A, H840A, N854A or N856A. One skilled in the art will recognize that mutations other than alanine substitutions are suitable.

In some embodiments, a D10A mutation is combined with one or more of H840A, N854A, or N856A mutations to produce a site-directed polypeptide substantially lacking DNA cleavage activity. In some embodiments, a H840A mutation is combined with one or more of D10A, N854A, or N856A mutations to produce a site-directed polypeptide substantially lacking DNA cleavage activity. In some embodiments, a N854A mutation is combined with one or more of H840A, D10A, or N856A mutations to produce a site-directed polypeptide substantially lacking DNA cleavage activity. In some embodiments, a N856A mutation is combined with one or more of H840A, N854A, or D10A mutations to produce a site-directed polypeptide substantially lacking DNA cleavage activity. Site-directed polypeptides that comprise one substantially inactive nuclease domain are referred to as "nickases".

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes. Descriptions of various CRISPR/Cas systems for use in gene editing can be found, e.g., in international patent application publication number WO2013/176772, and in *Nature Biotechnology* 32, 347-355 (2014), and references cited therein.

Mutations contemplated include substitutions, additions, and deletions, or any combination thereof. In some embodiments, the mutation converts the mutated amino acid to alanine. In some embodiments, the mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). In some embodiments, the mutation converts the mutated amino acid to a non-natural amino acid (e.g., selenomethionine). In some embodiments, the mutation converts the mutated amino acid to amino acid mimics (e.g., phosphomimics). In some embodiments, the mutation is a conservative mutation. For example, the mutation can convert the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). In some embodiments, the mutation causes a shift in reading frame and/or the creation of a premature stop codon. In some embodiments, mutations cause changes to regulatory regions of genes or loci that affect expression of one or more genes.

In some embodiments, the site-directed polypeptide (e.g., variant, mutated, enzymatically inactive and/or conditionally enzymatically inactive site-directed polypeptide) targets nucleic acid. In some embodiments, the site-directed polypeptide (e.g., variant, mutated, enzymatically inactive and/or conditionally enzymatically inactive endoribonuclease) targets DNA. In some embodiments, the site-directed polypeptide (e.g., variant, mutated, enzymatically inactive and/or conditionally enzymatically inactive endoribonuclease) targets RNA.

In some embodiments, the site-directed polypeptide comprises one or more non-native sequences (e.g., the site-directed polypeptide is a fusion protein).

In some embodiments, the site-directed polypeptide comprises an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., a HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

In some embodiments, the site-directed polypeptide comprises an amino acid sequence comprising at least 15% amino acid identity to a Cas9 from a bacterium (e.g., *S. pyogenes*), two nucleic acid cleaving domains (i.e., a HNH domain and a RuvC domain), and non-native sequence (for example, a nuclear localization signal) or a linker linking the site-directed polypeptide to a non-native sequence.

In some embodiments, the site-directed polypeptide comprises an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains comprises mutation of aspartic acid 10, and/or wherein one of the nuclease domains comprises mutation of histidine 840, and wherein the mutation reduces the cleaving activity of the nuclease domain(s) by at least 50%.

In some embodiments of the invention, the one or more site-directed polypeptides, e.g. DNA endonucleases, include two nickases that together effect one double-strand break at a specific locus in the genome, or four nickases that together effect two double-strand breaks at specific loci in the genome. Alternatively, one site-directed polypeptide, e.g. DNA endonuclease, effects one double-strand break at a specific locus in the genome.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. In some embodiments, the genome-targeting nucleic acid is an RNA. A genome-targeting RNA is referred to as a "guide RNA" or "gRNA" herein. A guide RNA comprises at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex binds a site-directed polypeptide, such that the guide RNA and site-direct polypeptide form a complex. The genome-targeting nucleic acid provides target specificity to the complex by virtue of its association with the site-directed polypeptide. The genome-targeting nucleic acid thus directs the activity of the site-directed polypeptide.

Exemplary guide RNAs include the spacer sequences in FIGS. 1-90, shown with the genome location of their target sequence and the associated Cas9 or Cpf1 cut site, wherein the genome location is based on the GRCh38/hg38 human genome assembly. As is understood by the person of ordinary skill in the art, each guide RNA is designed to include a spacer sequence complementary to its genomic target sequence. For example, each of the spacer sequences in FIGS. 1-90 may be put into a single RNA chimera or a crRNA (along with a corresponding tracrRNA). See Jinek et al., Science, 337, 816-821 (2012) and Deltcheva et al., Nature, 471, 602-607 (2011).

In some embodiments, the genome-targeting nucleic acid is a double-molecule guide RNA. In some embodiments, the genome-targeting nucleic acid is a single-molecule guide RNA.

A double-molecule guide RNA comprises two strands of RNA. The first strand comprises in the 5' to 3' direction, an optional spacer extension sequence, a spacer sequence and a minimum CRISPR repeat sequence. The second strand comprises a minimum tracrRNA sequence (complementary to the minimum CRISPR repeat sequence), a 3' tracrRNA sequence and an optional tracrRNA extension sequence.

A single-molecule guide RNA (sgRNA) in a Type II system comprises, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension may comprise elements that contribute additional functionality (e.g., stability) to the guide RNA. The single-molecule guide linker links the minimum CRISPR repeat and the minimum tracrRNA sequence to form a hairpin structure. The optional tracrRNA extension comprises one or more hairpins.

A single-molecule guide RNA (sgRNA) in a Type V system comprises, in the 5' to 3' direction, a minimum CRISPR repeat sequence and a spacer sequence.

By way of illustration, guide RNAs used in the CRISPR/Cas system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Spacer Extension Sequence

In some embodiments of genome-targeting nucleic acids, a spacer extension sequence can provide stability and/or provide a location for modifications of a genome-targeting nucleic acid. A spacer extension sequence can modify on- or off-target activity or specificity. In some embodiments, a spacer extension sequence is provided. A spacer extension sequence may have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. A spacer extension sequence may have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. In some embodiments, a spacer extension sequence is less than 10 nucleotides in length. In some embodiments, a spacer extension sequence is between 10-30 nucleotides in length. In some embodiments, a spacer extension sequence is between 30-70 nucleotides in length.

In some embodiments, the spacer extension sequence comprises another moiety (e.g., a stability control sequence, an endoribonuclease binding sequence, a ribozyme). In some embodiments, the moiety decreases or increases the stability of a nucleic acid targeting nucleic acid. In some embodiments, the moiety is a transcriptional terminator segment (i.e., a transcription termination sequence). In some embodiments, the moiety functions in a eukaryotic cell. In some embodiments, the moiety functions in a prokaryotic cell. In some embodiments, the moiety functions in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid interacts with a target nucleic acid in a sequence-specific manner via hybridization (i.e., base pairing). The nucleotide sequence of the spacer thus varies depending on the sequence of the target nucleic acid of interest.

In a CRISPR/Cas system herein, the spacer sequence is designed to hybridize to a target nucleic acid that is located 5' of a PAM of the Cas9 enzyme used in the system. The spacer may perfectly match the target sequence or may have mismatches. Each Cas9 enzyme has a particular PAM sequence that it recognizes in a target DNA. For example, S. pyogenes recognizes in a target nucleic acid a PAM that comprises the sequence 5'-NRG-3', where R comprises either A or G, where N is any nucleotide and N is immediately 3' of the target nucleic acid sequence targeted by the spacer sequence.

In some embodiments, the target nucleic acid sequence comprises 20 nucleotides. In some embodiments, the target nucleic acid comprises less than 20 nucleotides. In some embodiments, the target nucleic acid comprises more than 20 nucleotides. In some embodiments, the target nucleic acid comprises at least: 5, 10, 15, 16, 17, 18, 19, 20, 21, 22, 23, 24, 25, 30 or more nucleotides. In some embodiments, the target nucleic acid comprises at most: 5, 10, 15, 16, 17, 18, 19, 20, 21, 22, 23, 24, 25, 30 or more nucleotides. In some embodiments, the target nucleic acid sequence comprises 20 bases immediately 5' of the first nucleotide of the PAM. For example, in a sequence comprising 5'-NNNNNNNNNNNNNNNNNNNNNRG-3' (SEQ ID NO: 64,790), the target nucleic acid comprises the sequence that corresponds to the Ns, wherein N is any nucleotide, and the underlined NRG sequence is the S. pyogenes PAM.

In some embodiments, the spacer sequence that hybridizes to the target nucleic acid has a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some embodiments, the spacer sequence comprises 20 nucleotides. In some embodiments, the spacer comprises 19 nucleotides.

In some embodiments, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some embodiments, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some embodiments, the percent complementarity between the spacer sequence and the target nucleic acid is 100% over the six contiguous 5'-most nucleotides of the target sequence of the complementary strand of the target nucleic acid. In some embodiments, the percent complementarity between the spacer sequence and the target nucleic acid is at least 60% over about 20 contiguous nucleotides. The length of the spacer sequence and the target nucleic acid can differ by 1 to 6 nucleotides, which may be thought of as a bulge or bulges.

In some embodiments, a spacer sequence is designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

In some embodiments, a minimum CRISPR repeat sequence is a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from S. pyogenes).

A minimum CRISPR repeat sequence comprises nucleotides that can hybridize to a minimum tracrRNA sequence in a cell. The minimum CRISPR repeat sequence and a minimum tracrRNA sequence form a duplex, i.e. a base-paired double-stranded structure. Together, the minimum CRISPR repeat sequence and the minimum tracrRNA sequence bind to the site-directed polypeptide. At least a part of the minimum CRISPR repeat sequence hybridizes to the minimum tracrRNA sequence. In some embodiments, at least a part of the minimum CRISPR repeat sequence comprises at least about 30%, about 40%, about 50%, about 60%, about 65%, about 70%, about 75%, about 80%, about 85%, about 90%, about 95%, or 100% complementary to the minimum tracrRNA sequence. In some embodiments, at least a part of the minimum CRISPR repeat sequence comprises at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the minimum CRISPR repeat sequence is approximately 9 nucleotides in length. In some embodiments, the minimum CRISPR repeat sequence is approximately 12 nucleotides in length.

In some embodiments, the minimum CRISPR repeat sequence is at least about 60% identical to a reference minimum CRISPR repeat sequence (e.g., wild-type crRNA from *S. pyogenes*) over a stretch of at least 6, 7, or 8 contiguous nucleotides. For example, the minimum CRISPR repeat sequence is at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

In some embodiments, a minimum tracrRNA sequence is a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence comprises nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat bind to a site-directed polypeptide. At least a part of the minimum tracrRNA sequence can hybridize to the minimum CRISPR repeat sequence. In some embodiments, the minimum tracrRNA sequence is at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. In some embodiments, the minimum tracrRNA sequence is approximately 9 nucleotides in length. In some embodiments, the minimum tracrRNA sequence is approximately 12 nucleotides. In some embodiments, the minimum tracrRNA consists of tracrRNA nt 23-48 described in Jinek et al., supra.

In some embodiments, the minimum tracrRNA sequence is at least about 60% identical to a reference minimum tracrRNA (e.g., wild type, tracrRNA from *S. pyogenes*) sequence over a stretch of at least 6, 7, or 8 contiguous nucleotides. For example, the minimum tracrRNA sequence is at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

In some embodiments, the duplex between the minimum CRISPR RNA and the minimum tracrRNA comprises a double helix. In some embodiments, the duplex between the minimum CRISPR RNA and the minimum tracrRNA comprises at least about 1, 2, 3, 4, 5, 6, 7, 8, 9, or 10 or more nucleotides. In some embodiments, the duplex between the minimum CRISPR RNA and the minimum tracrRNA comprises at most about 1, 2, 3, 4, 5, 6, 7, 8, 9, or 10 or more nucleotides.

In some embodiments, the duplex comprises a mismatch (i.e., the two strands of the duplex are not 100% complementary). In some embodiments, the duplex comprises at least about 1, 2, 3, 4, or 5 or mismatches. In some embodiments, the duplex comprises at most about 1, 2, 3, 4, or 5 or mismatches. In some embodiments, the duplex comprises no more than 2 mismatches.

Bulges

In some embodiments, there is a "bulge" in the duplex between the minimum CRISPR RNA and the minimum tracrRNA. The bulge is an unpaired region of nucleotides within the duplex. In some embodiments, the bulge contributes to the binding of the duplex to the site-directed polypeptide. A bulge comprises, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge comprises an unpaired purine (e.g., adenine) on the minimum CRISPR repeat strand of the bulge. In some embodiments, a bulge comprises an unpaired 5'-AAGY-3' of the minimum tracrRNA sequence strand of the bulge, where Y comprises a nucleotide that can form a wobble pairing with a nucleotide on the minimum CRISPR repeat strand.

In some embodiments, a bulge on the minimum CRISPR repeat side of the duplex comprises at least 1, 2, 3, 4, or 5 or more unpaired nucleotides. In some embodiments, a bulge on the minimum CRISPR repeat side of the duplex comprises at most 1, 2, 3, 4, or 5 or more unpaired nucleotides. In some embodiments, a bulge on the minimum CRISPR repeat side of the duplex comprises 1 unpaired nucleotide.

In some embodiments, a bulge on the minimum tracrRNA sequence side of the duplex comprises at least 1, 2, 3, 4, 5, 6, 7, 8, 9, or 10 or more unpaired nucleotides. In some embodiments, a bulge on the minimum tracrRNA sequence side of the duplex comprises at most 1, 2, 3, 4, 5, 6, 7, 8, 9, or 10 or more unpaired nucleotides. In some embodiments, a bulge on a second side of the duplex (e.g., the minimum tracrRNA sequence side of the duplex) comprises 4 unpaired nucleotides.

In some embodiments, a bulge comprises at least one wobble pairing. In some embodiments, a bulge comprises at most one wobble pairing. In some embodiments, a bulge comprises at least one purine nucleotide. In some embodiments, a bulge comprises at least 3 purine nucleotides. In some embodiments, a bulge sequence comprises at least 5 purine nucleotides. In some embodiments, a bulge sequence comprises at least one guanine nucleotide. In some embodiments, a bulge sequence comprises at least one adenine nucleotide.

Hairpins

In various embodiments, one or more hairpins are located 3' to the minimum tracrRNA in the 3' tracrRNA sequence.

In some embodiments, the hairpin starts at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. In some embodiments, the hairpin can start at most about 1, 2, 3, 4, 5, 6, 7, 8, 9 or 10 or more nucleotides 3' of the last paired nucleotide in the minimum CRISPR repeat and minimum tracrRNA sequence duplex.

In some embodiments, a hairpin comprises at least about 1, 2, 3, 4, 5, 6, 7, 8, 9, 10, 15, or 20 or more consecutive nucleotides. In some embodiments, a hairpin comprises at most about 1, 2, 3, 4, 5, 6, 7, 8, 9, 10, 15, or more consecutive nucleotides.

In some embodiments, a hairpin comprises a CC dinucleotide (i.e., two consecutive cytosine nucleotides).

In some embodiments, a hairpin comprises duplexed nucleotides (e.g., nucleotides in a hairpin, hybridized together). For example, a hairpin comprises a CC dinucleotide that is hybridized to a GG dinucleotide in a hairpin duplex of the 3' tracrRNA sequence.

One or more of the hairpins can interact with guide RNA-interacting regions of a site-directed polypeptide.

In some embodiments, there are two or more hairpins, and in some embodiments there are three or more hairpins.

3' tracrRNA Sequence

In some embodiments, a 3' tracrRNA sequence comprises a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from S. pyogenes).

In some embodiments, the 3' tracrRNA sequence has a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the 3' tracrRNA sequence has a length of approximately 14 nucleotides.

In some embodiments, the 3' tracrRNA sequence is at least about 60% identical to a reference 3' tracrRNA sequence (e.g., wild type 3' tracrRNA sequence from S. pyogenes) over a stretch of at least 6, 7, or 8 contiguous nucleotides. For example, the 3' tracrRNA sequence is at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from S. pyogenes) over a stretch of at least 6, 7, or 8 contiguous nucleotides.

In some embodiments, a 3' tracrRNA sequence comprises more than one duplexed region (e.g., hairpin, hybridized region). In some embodiments, a 3' tracrRNA sequence comprises two duplexed regions.

In some embodiments, the 3' tracrRNA sequence comprises a stem loop structure. In some embodiments, a stem loop structure in the 3' tracrRNA comprises at least 1, 2, 3, 4, 5, 6, 7, 8, 9, 10, 15 or 20 or more nucleotides. In some embodiments, the stem loop structure in the 3' tracrRNA comprises at most 1, 2, 3, 4, 5, 6, 7, 8, 9 or 10 or more nucleotides. In some embodiments, the stem loop structure comprises a functional moiety. For example, the stem loop structure may comprise an aptamer, a ribozyme, a protein-interacting hairpin, a CRISPR array, an intron, or an exon. In some embodiments, the stem loop structure comprises at least about 1, 2, 3, 4, or 5 or more functional moieties. In some embodiments, the stem loop structure comprises at most about 1, 2, 3, 4, or 5 or more functional moieties.

In some embodiments, the hairpin in the 3' tracrRNA sequence comprises a P-domain. In some embodiments, the P-domain comprises a double-stranded region in the hairpin.

tracrRNA Extension Sequence

A tracrRNA extension sequence may be provided whether the tracrRNA is in the context of single-molecule guides or double-molecule guides. In some embodiments, a tracrRNA extension sequence has a length from about 1 nucleotide to about 400 nucleotides. In some embodiments, a tracrRNA extension sequence has a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. In some embodiments, a tracrRNA extension sequence has a length from about 20 to about 5000 or more nucleotides. In some embodiments, a tracrRNA extension sequence has a length of more than 1000 nucleotides. In some embodiments, a tracrRNA extension sequence has a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. In some embodiments, a tracrRNA extension sequence can have a length of less than 1000 nucleotides. In some embodiments, a tracrRNA extension sequence comprises less than 10 nucleotides in length. In some embodiments, a tracrRNA extension sequence is 10-30 nucleotides in length. In some embodiments, tracrRNA extension sequence is 30-70 nucleotides in length.

In some embodiments, the tracrRNA extension sequence comprises a functional moiety (e.g., a stability control sequence, ribozyme, endoribonuclease binding sequence). In some embodiments, the functional moiety comprises a transcriptional terminator segment (i.e., a transcription termination sequence). In some embodiments, the functional moiety has a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the functional moiety functions in a eukaryotic cell. In some embodiments, the functional moiety functions in a prokaryotic cell. In some embodiments, the functional moiety functions in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). In some embodiments, a tracrRNA extension sequence comprises a primer binding site or a molecular index (e.g., barcode sequence). In some embodiments, the tracrRNA extension sequence comprises one or more affinity tags.

Single-Molecule Guide Linker Sequence

In some embodiments, the linker sequence of a single-molecule guide nucleic acid has a length from about 3 nucleotides to about 100 nucleotides. In Jinek et al., supra, for example, a simple 4 nucleotide "tetraloop" (-GAAA-) was used, Science, 337(6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a single-molecule guide nucleic acid is between 4 and 40 nucleotides. In some embodiments, a linker is at least about 100, 500, 1000, 1500, 2000, 2500, 3000, 3500, 4000, 4500, 5000, 5500, 6000, 6500, or 7000 or more nucleotides. In some embodiments, a linker is at most about 100, 500, 1000, 1500, 2000, 2500, 3000, 3500, 4000, 4500, 5000, 5500, 6000, 6500, or 7000 or more nucleotides.

Linkers can comprise any of a variety of sequences, although preferably the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337(6096):816-821 (2012), but numerous other sequences, including longer sequences can likewise be used.

In some embodiments, the linker sequence comprises a functional moiety. For example, the linker sequence may comprise one or more features, including an aptamer, a ribozyme, a protein-interacting hairpin, a protein binding site, a CRISPR array, an intron, or an exon. In some embodiments, the linker sequence comprises at least about 1, 2, 3, 4, or 5 or more functional moieties. In some embodiments, the linker sequence comprises at most about 1, 2, 3, 4, or 5 or more functional moieties.

Genome Engineering Strategies to Correct Cells by Insertion, Correction or Replacement of One or More Mutations within or Near the Gene or by Knocking-In G6PC cDNA or a Minigene into the Locus of the Corresponding Gene or Safe Harbor Site The methods of the present disclosure can involve correction of one or both of the mutant alleles. Gene editing to correct the mutation has the advantage of restoration of correct expression levels and temporal control. Sequencing the patient's G6PC alleles allows for design of the gene editing strategy to best correct the identified mutation(s).

A step of the ex vivo methods of the invention involves editing/correcting the patient specific iPS cells using genome engineering. Alternatively, a step of the ex vivo methods of the invention involves editing/correcting the progenitor cell, primary hepatocyte, or mesenchymal stem cell, or a liver progenitor cell. Likewise, a step of the in vivo methods of the invention involves editing/correcting the cells in a GSD1a patient using genome engineering. Similarly, a step in the cellular methods of the invention involves editing/correcting the G6PC gene in a human cell by genome engineering.

GSD1a patients exhibit one or more mutations in the G6PC gene. Therefore, different patients will generally require different correction strategies. Any CRISPR endonuclease may be used in the methods of the invention, each CRISPR endonuclease having its own associated PAM, which may or may not be disease specific. For example, gRNA spacer sequences for targeting the G6PC gene with a CRISPR/Cas9 endonuclease from *S. pyogenes* have been identified in FIG. 85. gRNA spacer sequences for targeting the G6PC gene with a CRISPR/Cas9 endonuclease from *S. aureus* have been identified in FIG. 86. gRNA spacer sequences for targeting the G6PC gene with a CRISPR/Cas9 endonuclease from *S. thermophilus* have been identified in FIG. 87. gRNA spacer sequences for targeting the G6PC gene with a CRISPR/Cas9 endonuclease from *T. denticola* have been identified in FIG. 88. gRNA spacer sequences for targeting the G6PC gene with a CRISPR/Cas9 endonuclease from *N. meningitides* have been identified in FIG. 89. gRNA spacer sequences for targeting the G6PC gene with a CRISPR/Cpf1 endonuclease from *Acidominococcus*, *Lachnospiracea*, and *Francisella novicida* have been identified in FIG. 90. gRNA spacer sequences for targeting, e.g., targeting exon 1-2 of, AAVS1 (PPP1R12C), ALB, Angptl3, ApoC3, ASGR2, CCR5, FIX (F9), Gys2, HGD, Lp(a), Pcsk9, Serpina1, TF, and TTR with a CRISPR/Cas9 endonuclease from *S. pyogenes* have been identified in FIGS. 1, 7, 13, 19, 25, 31, 37, 43, 49, 55, 61, 67, 73, and 79 respectively. gRNA spacer sequences for targeting, e.g., targeting exon 1-2 of, AAVS1 (PPP1R12C), ALB, Angptl3, ApoC3, ASGR2, CCR5, FIX (F9), Gys2, HGD, Lp(a), Pcsk9, Serpina1, TF, and TTR with a CRISPR/Cas9 endonuclease from *S. aureus* have been identified in FIGS. 8, 14, 20, 26, 32, 38, 44, 50, 56, 62, 68, 74, and 80, respectively. gRNA spacer sequences for targeting, e.g., targeting exon 1-2 of, AAVS1 (PPP1 R12C), ALB, Angptl3, ApoC3, ASGR2, CCR5, FIX (F9), Gys2, HGD, Lp(a), Pcsk9, Serpina1, TF, and TTR with a CRISPR/Cas9 endonuclease from *S. thermophilus* have been identified in FIGS. 9, 15, 21, 27, 33, 39, 45, 51, 57, 63, 69, 75, and 81, respectively. gRNA spacer sequences for targeting, e.g., targeting exon 1-2 of, AAVS1 (PPP1R12C), ALB, Angptl3, ApoC3, ASGR2, CCR5, FIX (F9), Gys2, HGD, Lp(a), Pcsk9, Serpina1, TF, and TTR with a CRISPR/Cas9 endonuclease from *T. denticola* have been identified in FIGS. 10, 16, 22, 28, 34, 40, 46, 52, 58, 64, 70, 76, and 82, respectively. gRNA spacer sequences for targeting, e.g., targeting exon 1-2 of, AAVS1 (PPP1R12C), ALB, Angptl3, ApoC3, ASGR2, CCR5, FIX (F9), Gys2, HGD, Lp(a), Pcsk9, Serpina1, TF, and TTR with a CRISPR/Cas9 endonuclease from *N. meningitides* have been identified in FIGS. 11, 17, 23, 29, 35, 41, 47, 53, 59, 65, 71, 77, and 83, respectively. gRNA spacer sequences for targeting, e.g., targeting exon 1-2 of, AAVS1 (PPP1R12C), ALB, Angptl3, ApoC3, ASGR2, CCR5, FIX (F9), Gys2, HGD, Lp(a), Pcsk9, Serpina1, TF, and TTR with a CRISPR/Cas9 endonuclease from *Acidominococcus*, Lachnospiraceae, and *Francisella novicida* have been identified in FIGS. 12, 18, 24, 30, 36, 42, 48, 54, 60, 66, 72, 78, and 84, respectively.

For example, the mutation can be corrected by the insertions or deletions that arise due to the imprecise NHEJ repair pathway. If the patient's G6PC gene has an inserted or deleted base, a targeted cleavage can result in a NHEJ-mediated insertion or deletion that restores the frame. Missense mutations can also be corrected through NHEJ-mediated correction using one or more guide RNA. The ability or likelihood of the cut(s) to correct the mutation can be designed or evaluated based on the local sequence and micro-homologies. NHEJ can also be used to delete segments of the gene, either directly or by altering splice donor or acceptor sites through cleavage by one gRNA targeting several locations, or several gRNAs. This may be useful if an amino acid, domain or exon contains the mutations and can be removed or inverted, or if the deletion otherwise restored function to the protein. Pairs of guide strands have been used for deletions and corrections of inversions.

Alternatively, the donor for correction by HDR contains the corrected sequence with small or large flanking homology arms to allow for annealing. HDR is essentially an error-free mechanism that uses a supplied homologous DNA sequence as a template during DSB repair. The rate of homology directed repair (HDR) is a function of the distance between the mutation and the cut site so choosing overlapping or nearest target sites is important. Templates can include extra sequences flanked by the homologous regions or can contain a sequence that differs from the genomic sequence, thus allowing sequence editing.

In addition to correcting mutations by NHEJ or HDR, a range of other options are possible. If there are small or large deletions or multiple mutations, a cDNA can be knocked in that contains the exons affected. A full length cDNA can be knocked into any "safe harbor", but must use a supplied or other promoter. If this construct is knocked into the correct location, it will have physiological control, similar to the normal gene. Pairs of nucleases can be used to delete mutated gene regions, though a donor would usually have to be provided to restore function. In this case two gRNA would be supplied and one donor sequence.

Some genome engineering strategies involve correction of one or more mutations in or near the gene, or deleting the mutant G6PC DNA and knocking-in G6PC cDNA or a minigene (comprised of one or more exons and introns or natural or synthetic introns) into the locus of the corresponding gene or a safe harbor locus by homology directed repair (HDR), which is also known as homologous recombination (HR). Homology directed repair is one strategy for treating patients that have inactivating mutations in or near the glucose-6-phosphatase catalytic unit. These strategies will restore the glucose-6-phosphatase catalytic unit and completely reverse, treat, and/or mitigate the diseased state. This strategy will require a more custom approach based on the location of the patient's inactivating mutation(s). Donor nucleotides for correcting mutations are small (<300 bp). This is advantageous, as HDR efficiencies may be inversely related to the size of the donor molecule. Also, it is expected that the donor templates can fit into size constrained viral vector molecules, e.g., adeno-associated virus (AAV) molecules, which have been shown to be an effective means of donor template delivery. Also, it is expected that the donor templates can fit into other size constrained molecules, including, by way of non-limiting example, platelets and/or exosomes or other microvesicles.

Homology direct repair is a cellular mechanism for repairing double-stranded breaks (DSBs). The most common form is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^6$ cells receiving a homologous donor alone. The rate of homology directed repair (HDR) at a particular nucleotide is a function of the distance to the cut site, so choosing overlapping or nearest target sites is important. Gene editing offers the advantage over gene addition, as correcting in situ leaves the rest of the genome unperturbed.

Supplied donors for editing by HDR vary markedly but generally contain the intended sequence with small or large flanking homology arms to allow annealing to the genomic DNA. The homology regions flanking the introduced genetic changes can be 30 bp or smaller, or as large as a multi-kilobase cassette that can contain promoters, cDNAs, etc. Both single-stranded and double-stranded oligonucleotide donors have been used. These oligonucleotides range in size from less than 100 nt to over many kb, though longer ssDNA can also be generated and used. Double-stranded donors are often used, including PCR amplicons, plasmids, and mini-circles. In general, it has been found that an AAV vector is a very effective means of delivery of a donor template, though the packaging limits for individual donors is <5 kb. Active transcription of the donor increased HDR three-fold, indicating the inclusion of promoter may increase conversion. Conversely, CpG methylation of the donor decreased gene expression and HDR.

In addition to wildtype endonucleases, such as Cas9, nickase variants exist that have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nano-particle, micro-injection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

Without a donor present, the ends from a DNA break or ends from different breaks can be joined using the several nonhomologous repair pathways in which the DNA ends are joined with little or no base-pairing at the junction. In addition to canonical NHEJ, there are similar repair mechanisms, such as alt-NHEJ. If there are two breaks, the intervening segment can be deleted or inverted. NHEJ repair pathways can lead to insertions, deletions or mutations at the joints.

NHEJ was used to insert a 15-kb inducible gene expression cassette into a defined locus in human cell lines after nuclease cleavage. Maresca, M., Lin, V. G., Guo, N. & Yang, Y., *Genome Res* 23, 539-546 (2013).

In addition to genome editing by NHEJ or HDR, site-specific gene insertions have been conducted that use both the NHEJ pathway and HR. A combination approach may be applicable in certain settings, possibly including intron/exon borders. NHEJ may prove effective for ligation in the intron, while the error-free HDR may be better suited in the coding region.

As stated previously, the G6PC gene contains 5 exons. Any one or more of the 5 exons or nearby introns may be repaired in order to correct a mutation and restore the inactive G6Pase catalytic unit. Alternatively, there are various mutations associated with GSD1a, which are a combination of insertions, deletions, missense, nonsense, frameshift and other mutations, with the common effect of inactivating G6Pase. Any one or more of the mutations may be repaired in order to restore the inactive G6Pase catalytic unit. For example, one or more of the following pathological variants may be corrected: rs80356479, rs80356486, rs606231368, rs80356488, rs587776757, rs104894565, rs104894566, rs1801175, rs1801176, rs104894567, rs104894571, rs80356482, rs80356483, rs104894563, rs367727229, rs387906505, rs104894568, rs104894569, rs80356487, rs764920787, rs80356485, rs780226142, rs80356484 (see FIGS. 91A and 91B). These variants include deletions, insertions and single nucleotide polymorphisms. As a further alternative, G6PC cDNA or a minigene (comprised of one or more exons and introns or natural or synthetic introns) may be knocked-in to the locus of the corresponding gene or knocked-in to a safe harbor site, such as AAVS1 (PPP1 R12C), ALB, Angptl3, ApoC3, ASGR2, CCR5, FIX (F9), Gys2, HGD, Lp(a), Pcsk9, Serpina1, TF, and/or TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR. In some embodiments, the methods provide one gRNA or a pair of gRNAs that can be used to facilitate incorporation of a new sequence from a polynucleotide donor template to correct one or more mutations or to knock-in a part of or the entire G6PC gene or cDNA.

Some embodiments of the methods provide gRNA pairs that make a deletion by cutting the gene twice, one gRNA cutting at the 5' end of one or more mutations and the other gRNA cutting at the 3' end of one or more mutations that facilitates insertion of a new sequence from a polynucleotide donor template to replace the one or more mutations, or deletion may exclude mutant amino acids or amino acids adjacent to it (e.g., premature stop codon) and lead to expression of a functional protein, or restore an open reading frame. The cutting may be accomplished by a pair of DNA endonucleases that each makes a DSB in the genome, or by multiple nickases that together make a DSB in the genome.

Alternatively, some embodiments of the methods provide one gRNA to make one double-strand cut around one or more mutations that facilitates insertion of a new sequence from a polynucleotide donor template to replace the one or more mutations. The double-strand cut may be made by a single DNA endonuclease or multiple nickases that together make a DSB in the genome, or single gRNA may lead to deletion (MMEJ), which may exclude mutant amino acid (e.g., premature stop codon) and lead to expression of a functional protein, or restore an open reading frame.

Illustrative modifications within the G6PC gene include replacements within or near (proximal) to the mutations referred to above, such as within the region of less than 3 kb, less than 2 kb, less than 1 kb, less than 0.5 kb upstream or downstream of the specific mutation. Given the relatively wide variations of mutations in the G6PC gene, it will be appreciated that numerous variations of the replacements referenced above (including without limitation larger as well as smaller deletions), would be expected to result in restoration of G6Pase protein activity.

Such variants include replacements that are larger in the 5' and/or 3' direction than the specific mutation in question, or smaller in either direction. Accordingly, by "near" or "proximal" with respect to specific replacements, it is intended that the SSB or DSB locus associated with a desired replacement boundary (also referred to herein as an endpoint) may be within a region that is less than about 3 kb from the reference locus noted. In some embodiments, the DSB locus is more proximal and within 2 kb, within 1 kb, within 0.5 kb, or within 0.1 kb. In the case of small replacement, the desired endpoint is at or "adjacent to" the reference locus, by which it is intended that the endpoint is within 100 bp, within 50 bp, within 25 bp, or less than about 10 bp to 5 bp from the reference locus.

Embodiments comprising larger or smaller replacements are expected to provide the same benefit, as long as the G6Pase catalytic unit is restored. It is thus expected that many variations of the replacements described and illustrated herein will be effective for ameliorating GSD1a.

Another genome engineering strategy involves exon deletion. Targeted deletion of specific exons can be an attractive strategy for treating a large subset of patients with a single therapeutic cocktail. Deletions can either be single exon deletions or multi-exon deletions. While multi-exon deletions can reach a larger number of patients, for larger deletions the efficiency of deletion greatly decreases with increased size. Therefore, deletions range can be from 40 to 10,000 base pairs (bp) in size. For example, deletions can range from 40-100; 100-300; 300-500; 500-1,000; 1,000-2,000; 2,000-3,000; 3,000-5,000; or 5,000-10,000 base pairs in size.

Deletions can occur in enhancer, promoter, 1st intron, and/or 3'UTR leading to upregulation of the gene expression, and/or through deletion of the regulatory elements.

In order to ensure that the pre-mRNA is properly processed following deletion, the surrounding splicing signals can be deleted. Splicing donor and acceptors are generally within 100 base pairs of the neighboring intron. Therefore, in some examples, methods can provide all gRNAs that cut approximately +/−100-3100 bp with respect to each exon/intron junction of interest.

For any of the genome editing strategies, gene editing can be confirmed by sequencing or PCR analysis.

Target Sequence Selection

Shifts in the location of the 5' boundary and/or the 3' boundary relative to particular reference loci are used to facilitate or enhance particular applications of gene editing, which depend in part on the endonuclease system selected for the editing, as further described and illustrated herein.

In a first, non-limiting example of such target sequence selection, many endonuclease systems have rules or criteria that guide the initial selection of potential target sites for cleavage, such as the requirement of a PAM sequence motif in a particular position adjacent to the DNA cleavage sites in the case of CRISPR Type II or Type V endonucleases.

In another non-limiting example of target sequence selection or optimization, the frequency of "off-target" activity for a particular combination of target sequence and gene editing endonuclease (i.e. the frequency of DSBs occurring at sites other than the selected target sequence) is assessed relative to the frequency of on-target activity. In some cases, cells that have been correctly edited at the desired locus may have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus may be positively selected for by one or more screening methods used to identify, sort or otherwise select for cells that have been correctly edited. Both selective advantage and directed selection methods may take advantage of the phenotype associated with the correction. In some embodiments, cells may be edited two or more times in order to create a second modification that creates a new phenotype that is used to select or purify the intended population of cells. Such a second modification could be created by adding a second gRNA for a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection is also guided by consideration of off-target frequencies in order to enhance the effectiveness of the application and/or reduce the potential for undesired alterations at sites other than the desired target. As described further and illustrated herein and in the art, the occurrence of off-target activity is influenced by a number of factors including similarities and dissimilarities between the target site and various off target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but may also be enhanced by the occurrence of various events (such as UV light and other inducers of DNA breakage) or the presence of certain agents (such as various chemical inducers). Many such inducers cause DSBs to occur indiscriminately in the genome, and DSBs are regularly being induced and repaired in normal cells. During repair, the original sequence may be reconstructed with complete fidelity, however, in some cases, small insertions or deletions (referred to as "indels") are introduced at the DSB site.

DSBs may also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that may comprise as few as ten basepairs or less, can also be used to bring about desired deletions. For example, a single DSB is introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce replacements that result in restoration of G6Pase activity, as well as the selection of specific target sequences within such regions that are designed to minimize off-target events relative to on-target events.

Nucleic Acid Modifications

In some embodiments, polynucleotides introduced into cells comprise one or more modifications that can be used individually or in combination, for example, to enhance activity, stability or specificity, alter delivery, reduce innate immune responses in host cells, or for other enhancements, as further described herein and known in the art.

In certain embodiments, modified polynucleotides are used in the CRISPR/Cas9/CPf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/CPf1 system to edit any one or more genomic loci.

Using the CRISPR/Cas9/CPf1 system for purposes of nonlimiting illustrations of such uses, modifications of guide RNAs can be used to enhance the formation or stability of the CRISPR/Cas9/CPf1 genome editing complex comprising guide RNAs, which may be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in embodiments in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/CPf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/CPf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating chemically-modified RNAs of greater length is to produce two or more molecules that are ligated together. Much longer RNAs, such as those encoding a Cas9 endonuclease, are more readily generated enzymatically. While fewer types of modifications are generally available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some embodiments a 2'-O-alkyl, 2'-O-alkyl-O-alkyl, or 2'-fluoro-modified nucleotide. In some embodiments, RNA modifications include 2'-fluoro, 2'-amino or 2' O-methyl modifications on the ribose of pyrimidines, abasic residues, or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly CH2-NH—O—CH2, CH, ~N(CH3)~O~CH2 (known as a methylene(methylimino) or MMI backbone), CH2-O—N (CH3)-CH2, CH2-N (CH3)-N (CH3)-CH2 and O—N (CH3)-CH2-CH2 backbones, wherein the native phosphodiester backbone is represented as O—P—CH); amide backbones [see De Mesmaeker et al., Ace. Chem. Res., 28:366-374 (1995)]; morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3' alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2', see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci., 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and CH2 component parts; see U.S. Pat. Nos. 5,034,506; 5,166,315; 5,185, 444; 5,214,134; 5,216,141; 5,235,033; 5,264,562; 5,264, 564; 5,405,938; 5,434,257; 5,466,677; 5,470,967; 5,489, 677; 5,541,307; 5,561,225; 5,596,086; 5,602,240; 5,610, 289; 5,602,240; 5,608,046; 5,610,289; 5,618,704; 5,623, 070; 5,663,312; 5,633,360; 5,677,437; and 5,677,439, each of which is herein incorporated by reference.

One or more substituted sugar moieties can also be included, e.g., one of the following at the 2' position: OH, SH, SCH3, F, OCN, OCH3 OCH3, OCH3O(CH2)n CH3, O(CH2)n NH2, or O(CH2)n CH3, where n is from 1 to about 10; C1 to C10 lower alkyl, alkoxyalkoxy, substituted lower alkyl, alkaryl or aralkyl; Cl; Br; ON; CF3, OCF3, O-, S-, or N-alkyl; O-, S-, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some embodiments, a modification includes 2'-methoxyethoxy (2'-0-CH2CH2OCH3, also known as 2'-O-(2-methoxyethyl)) (Martin et al, Helv. Chim. Acta, 1995, 78, 486). Other modifications include 2'-methoxy (2'-0-CH3), 2'-propoxy (2'-OCH2 CH2CH3) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics, such as cyclobutyls in place of the pentofuranosyl group.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds comprise, but are not limited to, U.S. Pat. Nos. 5,539,082; 5,714,331; and 5,719,262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me—C), 5-hydroxymethylcytosine (HMC), glycosyl HMC and gentobiosyl HMC, as well as synthetic nucleobases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl)adenine, and 2,6-diaminopurine. Kornberg, A., DNA Replication, W. H. Freeman & Co., San Francisco, pp 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are embodiments of base substitutions.

Modified nucleobases comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the invention. These include 5-substituted pyrimidines, 6-azapyrimidines and N-2, N-6 and O-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are embodiments of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and U.S. Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications may be incorporated in a single oligonucleotide, or even in a single nucleoside within an oligonucleotide.

In some embodiments, the guide RNAs and/or mRNA (or DNA) encoding an endonuclease are chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let., 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828, 979; 4,948,882; 5,218,105; 5,525,465; 5,541,313; 5,545, 730; 5,552,538; 5,578,717; 5,580,731; 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241; 5,391,723; 5,416,203, 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599,928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium I,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chernolovskaya et al, Curr Opin Mol Ther., 12(2):158-67 (2010); Deleavey et al., Curr Protoc Nucleic Acid Chem Chapter 16: Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (™), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

In some embodiments, a polynucleotide encoding a site-directed polypeptide is codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

RNPs

As stated previously, the site-directed polypeptide and genome-targeting nucleic acid may each be administered separately to a cell or a patient. On the other hand, the site-directed polypeptide may be pre-complexed with one or more guide RNAs, or one or more crRNA together with a tracrRNA. The pre-complexed material may then be administered to a cell or a patient. Such pre-complexed material is known as a ribonucleoprotein particle (RNP).

Nucleic Acids Encoding System Components

In another aspect, the present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the embodiments of the methods of the disclosure.

In some embodiments, the nucleic acid encoding a genome-targeting nucleic acid of the disclosure, a site-directed polypeptide of the disclosure, and/or any nucleic acid or proteinaceous molecule necessary to carry out the embodiments of the methods of the disclosure comprises a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some embodiments, vectors are capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Figure 92B:
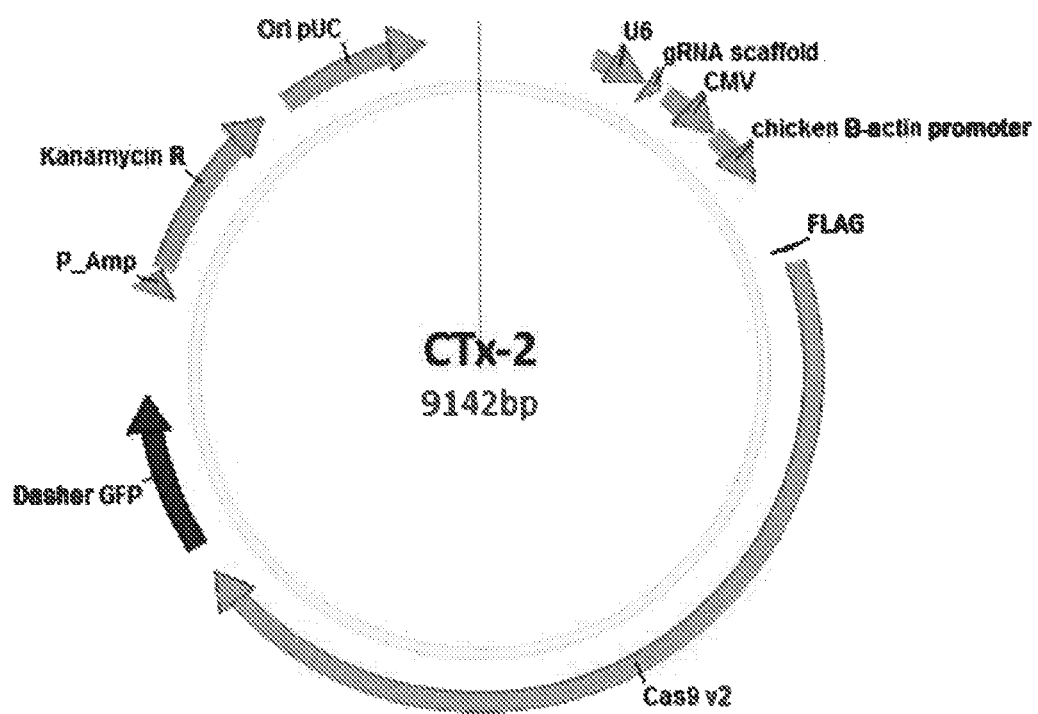
FIG. 92B is an illustration of a plasmid (referred to herein as "CTx-2") comprising a different codon optimized gene for *S. pyogenes* Cas9 endonuclease. The CTx-2 plasmid also comprises a gRNA scaffold sequence, which includes a 20 bp spacer sequence from the sequences listed in FIGS. 1, 7, 13, 19, 25, 31, 37, 43, 49, 55, 61, 67, 73, 79, 85, and 91.
Figure 92C:
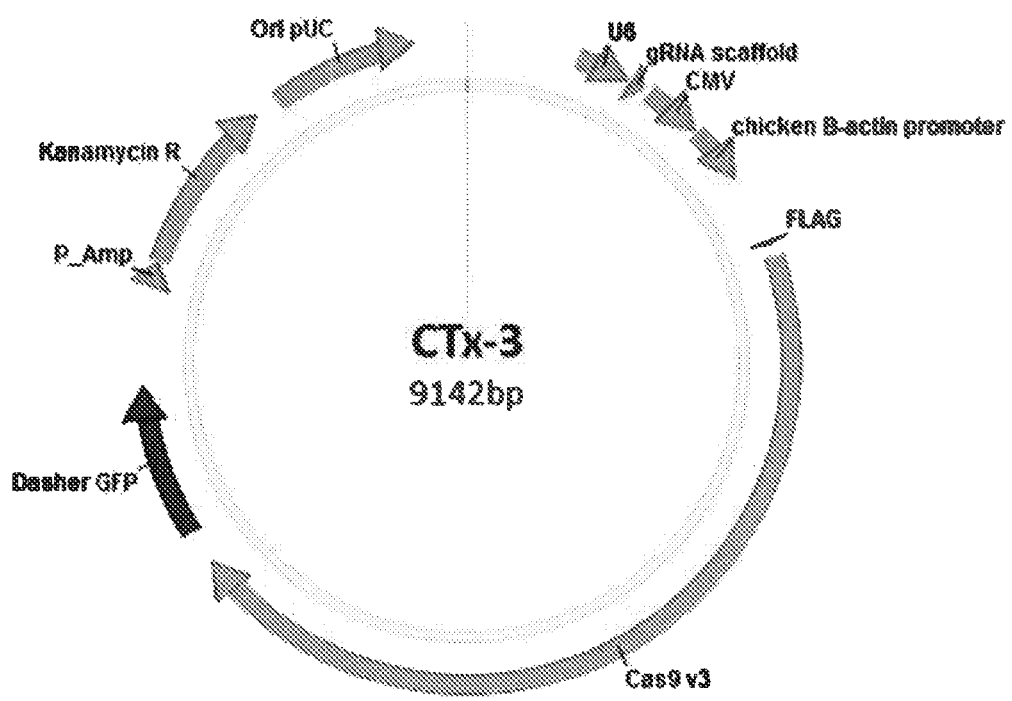
FIG. 92C is an illustration of a plasmid (referred to herein as "CTx-3") comprising yet another different codon optimized gene for *S. pyogenes* Cas9 endonuclease. The CTx-3 plasmid also comprises a gRNA scaffold sequence, which includes a 20 bp spacer sequence from the sequences listed in FIGS. 1, 7, 13, 19, 25, 31, 37, 43, 49, 55, 61, 67, 73, 79, 85, and 91.
Figure 93A:
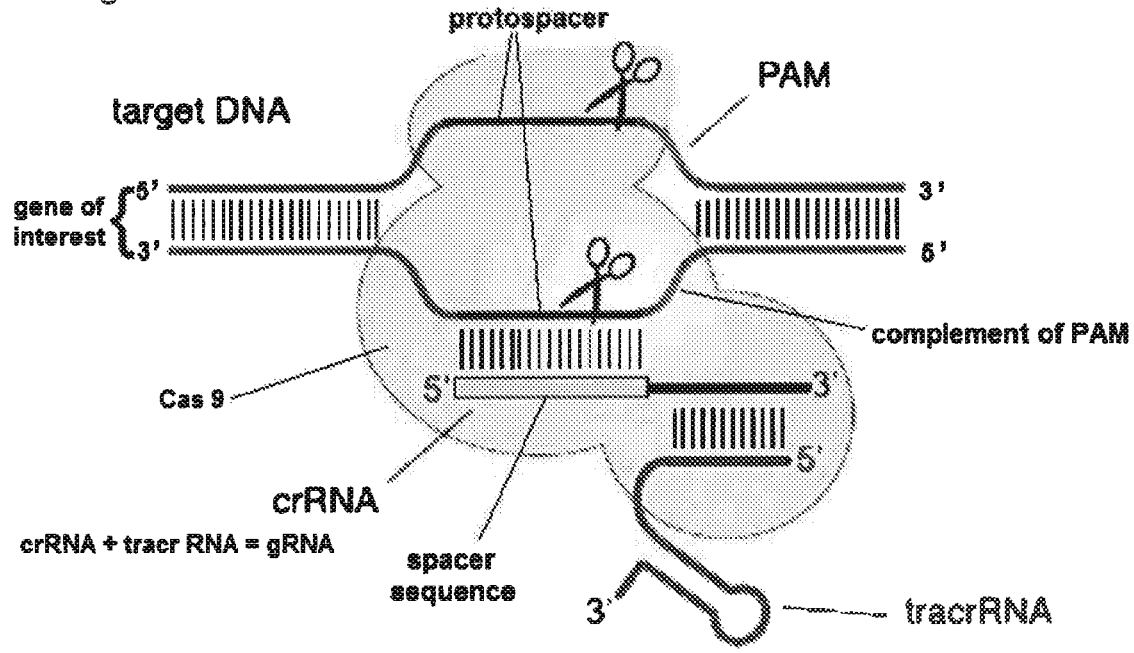
FIG. 93A is an illustration depicting the type II CRISPR/Cas system.
Figure 93B:
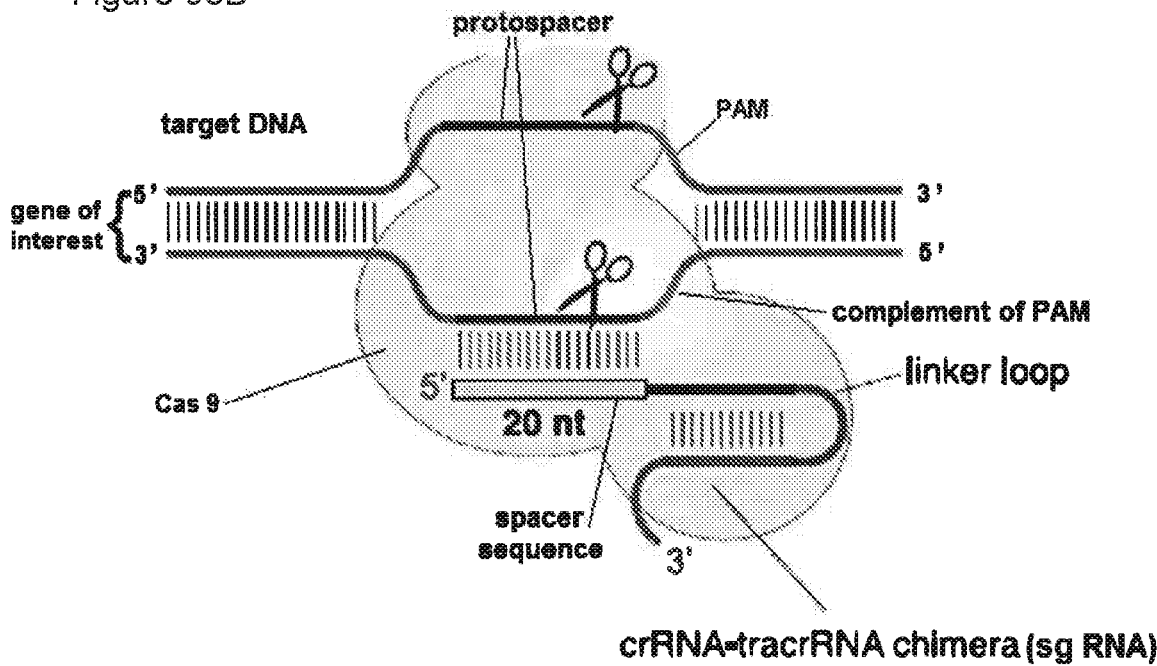
FIG. 93B is another illustration depicting the type II CRISPR/Cas system.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors pCTx-1, pCTx-2, and pCTx-3, which are described in FIGS. 92A to 92C. Other vectors may be used so long as they are compatible with the host cell.

In some embodiments, a vector comprises one or more transcription and/or translation control elements. Depending on the host/vector system utilized, any of a number of suitable transcription and translation control elements, including constitutive and inducible promoters, transcription enhancer elements, transcription terminators, etc. may be used in the expression vector. In some embodiments, the vector is a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy—Nucleic Acids* 3, e161 (2014) doi:10.1038/mtna.2014.12.

The expression vector may also contain a ribosome binding site for translation initiation and a transcription terminator. The expression vector may also include appropriate sequences for amplifying expression. The expression vector may also include nucleotide sequences encoding non-native tags (e.g., histidine tag, hemagglutinin tag, green fluorescent protein, etc.) that are fused to the site-directed polypeptide, thus resulting in a fusion protein.

In some embodiments, a promoter is an inducible promoter (e.g., a heat shock promoter, tetracycline-regulated promoter, steroid-regulated promoter, metal-regulated promoter, estrogen receptor-regulated promoter, etc.). In some embodiments, a promoter is a constitutive promoter (e.g., CMV promoter, UBC promoter). In some embodiments, the promoter is a spatially restricted and/or temporally restricted promoter (e.g., a tissue specific promoter, a cell type specific promoter, etc.).

In some embodiments, the nucleic acid encoding a genome-targeting nucleic acid of the disclosure and/or a site-directed polypeptide are packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) may be delivered by non-viral delivery vehicles known in the art, such as electroporation or lipid nanoparticles. In some embodiments, the DNA endonuclease may be delivered as one or more polypeptides, either alone or pre-complexed with one or more guide RNAs, or one or more crRNA together with a tracrRNA.

Polynucleotides may be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

Polynucleotides, such as guide RNA, sgRNA, and mRNA encoding an endonuclease, may be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle may range in size from 1-1000 nm, 1-500 nm, 1-250 nm, 25-200 nm, 25-100 nm, 35-75 nm, or 25-60 nm.

LNPs may be made from cationic, anionic, or neutral lipids. Neutral lipids, such as the fusogenic phospholipid DOPE or the membrane component cholesterol, may be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs may also be comprised of hydrophobic lipids, hydrophilic lipids, or both hydrophobic and hydrophilic lipids.

Any lipid or combination of lipids that are known in the art may be used to produce a LNP. Examples of lipids used to produce LNPs are: DOTMA, DOS PA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids may be combined in any number of molar ratios to produce a LNP. In addition, the polynucleotide(s) may be combined with lipid(s) in a wide range of molar ratios to produce a LNP.

As stated previously, the site-directed polypeptide and genome-targeting nucleic acid may each be administered separately to a cell or a patient. On the other hand, the site-directed polypeptide may be pre-complexed with one or more guide RNAs, or one or more crRNA together with a tracrRNA. The pre-complexed material may then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP may be modified or unmodified. Likewise, the gRNA, crRNA, tracrRNA, or sgRNA may be modified or unmodified. Numerous modifications are known in the art and may be used.

The endonuclease and sgRNA are generally combined in a 1:1 molar ratio. Alternatively, the endonuclease, crRNA and tracrRNA are generally combined in a 1:1:1 molar ratio. However, a wide range of molar ratios may be used to produce a RNP.

A recombinant adeno-associated virus (AAV) vector may be used for delivery. Techniques to produce rAAV particles, in which an AAV genome to be packaged that includes the polynucleotide to be delivered, rep and cap genes, and helper virus functions are provided to a cell are standard in the art. Production of rAAV requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived, and may be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh.74. Production of pseudotyped rAAV is disclosed in, for example, international patent application publication number WO 01/83692. See Table 1.

TABLE 1

| AAV Serotype | Genbank Accession No. |
|---|---|
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |
| AAV-8 | NC 006261.1 |
| AAV-9 | AX753250.1 |
| AAV-10 | AY631965.1 |
| AAV-11 | AY631966.1 |
| AAV-12 | DQ813647.1 |
| AAV-13 | EU285562.1 |

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line is then infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658.776 WO 95/13392; WO 96/17947; PCT/U598/18600, WO 97/09441 (PCT/U596/14423), WO 97/08298 (PCT/US96/13872), WO 97/21825 (PCT/US96/20777), WO 97/06243 (PCT/FR96/01064), WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types may be transduced by the indicated AAV serotypes among others. See Table 2.

TABLE 2

| Tissue/Cell Type | Serotype |
| --- | --- |
| Liver | AAV3, AAV5, AAV8, AAV9 |
| Skeletal muscle | AAV1, AAV7, AAV6, AAV8, AAV9 |
| Central nervous system | AAV5, AAV1, AAV4 |
| RPE | AAV5, AAV4 |
| Photoreceptor cells | AAV5 |
| Lung | AAV9 |
| Heart | AAV8 |
| Pancreas | AAV8 |
| Kidney | AAV2, AAV8 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovavirusr, poxvirus, vaccinia virus, and herpes simplex virus.

In some embodiments, Cas9 mRNA, sgRNA targeting one or two loci in G6PC genes, and donor DNA are each separately formulated into lipid nanoparticles, or are all co-formulated into one lipid nanoparticle, or co-formulated into two or more lipid nanoparticles.

In some embodiments, Cas9 mRNA is formulated in a lipid nanoparticle, while sgRNA and donor DNA are delivered in an AAV vector. In some embodiments, Cas9 mRNA and sgRNA are co-formulated in a lipid nanoparticle, while donor DNA is delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV, as can donors for HDR. A range of non-viral delivery methods also exist that can deliver each of these components, or non-viral and viral methods can be employed in tandem. For example, nanoparticles can be used to deliver the protein and guide RNA, while AAV can be used to deliver a donor DNA.

Exosomes

Exosomes, a type of microvesicle bound by phospholipid bilayer, can be used to deliver nucleic acids to specific tissue. Many different types of cells within the body naturally secrete exosomes. Exosomes form within the cytoplasm when endosomes invaginate and form multivesicular-endosomes (MVE). When the MVE fuses with the cellular membrane, the exosomes are secreted in the extracellular space. Ranging between 30-120 nm in diameter, exosomes can shuttle various molecules from one cell to another in a form of cell-to-cell communication. Cells that naturally produce exosomes, such as mast cells, can be genetically altered to produce exosomes with surface proteins that target specific tissues, alternatively exosomes can be isolated from the bloodstream. Specific nucleic acids can be placed within the engineered exosomes with electroporation. When introduced systemically, the exosomes can deliver the nucleic acids to the specific target tissue.

Genetically Modified Cells

The term "genetically modified cell" refers to a cell that comprises at least one genetic modification introduced by genome editing (e.g., using the CRISPR/Cas system). In some ex vivo embodiments herein, the genetically modified cell is a genetically modified progenitor cell. In some in vivo embodiments herein, the genetically modified cell is a genetically modified liver cell. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure restoration of G6Pase gene or protein expression or activity, for example, Western Blot analysis of the G6Pase protein or quantifying G6PC mRNA.

The term "isolated cell" refers to a cell that has been removed from an organism in which it was originally found, or a descendant of such a cell. Optionally, the cell has been cultured in vitro, e.g., under defined conditions or in the presence of other cells. Optionally, the cell is later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some embodiments, an isolated population is a substantially pure population of cells, as compared to the heterogeneous population from which the cells were isolated or enriched. In some embodiments, the isolated population is an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating GSD1a.

The term "substantially enriched" with respect to a particular cell population, refers to a population of cells that is at least about 10%, about 20%, about 30%, about 40%, about 50%, about 60%, about 70% or more with respect to the cells making up a total cell population.

The terms "substantially enriched" or "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Differentiation of Genome Edited iPSCs into Hepatocytes

Another step of the ex vivo methods of the invention involves differentiating the genome edited iPSCs into hepatocytes. The differentiating step may be performed according to any method known in the art. For example, hiPSC are differentiated into definitive endoderm using various treatments, including activin and B27 supplement (Life Technology). The definitive endoderm is further differentiated into hepatocyte, the treatment includes: FGF4, HGF, BMP2, BMP4, Oncostatin M, Dexametason, etc. (Duan et al, STEM CELLS; 2010; 28:674-686, Ma et al, STEM CELLS TRANSLATIONAL MEDICINE 2013; 2:409-419).

Differentiation of Genome Edited Mesenchymal Stem Cells into Hepatocytes

Another step of the ex vivo methods of the invention involves differentiating the genome edited mesenchymal stem cells into hepatocytes. The differentiating step may be performed according to any method known in the art. For example, hMSC are treated with various factors and hormones, including insulin, transferrin, FGF4, HGF, bile acids (Sawitza I et al, Sci Rep. 2015; 5: 13320).

Implanting Cells into Patients

Another step of the ex vivo methods of the invention involves implanting the hepatocytes into patients. This implanting step may be accomplished using any method of implantation known in the art. For example, the genetically modified cells may be injected directly in the patient's liver or otherwise administered to the patient.

Another step of the ex vivo methods of the invention involves implanting the progenitor cells or primary hepatocytes into patients. This implanting step may be accomplished using any method of implantation known in the art. For example, the genetically modified cells may be injected directly in the patient's liver or otherwise administered to the patient. The genetically modified cells may be purified ex vivo using a selected marker.

Pharmaceutically Acceptable Carriers

The ex vivo methods of administering progenitor cells to a subject contemplated herein involve the use of therapeutic compositions comprising progenitor cells.

Therapeutic compositions contain a physiologically tolerable carrier together with the cell composition, and optionally at least one additional bioactive agent as described herein, dissolved or dispersed therein as an active ingredient. In some embodiments, the therapeutic composition is not substantially immunogenic when administered to a mammal or human patient for therapeutic purposes, unless so desired.

In general, the progenitor cells described herein are administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition will depend on the nature of the disorder or condition, and can be determined by standard clinical techniques.

Administration & Efficacy

The terms "administering," "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some embodiments described herein, an effective amount of myogenic progenitor cells is administered via a systemic route of administration, such as an intraperitoneal or intravenous route.

The terms "individual", "subject," "host" and "patient" are used interchangeably herein and refer to any subject for whom diagnosis, treatment or therapy is desired. In some embodiments, the subject is a mammal. In some embodiments, the subject is a human being.

When provided prophylactically, progenitor cells described herein can be administered to a subject in advance of any symptom of GSD1a, e.g., prior to the development of seizures caused by hypoglycemia. Accordingly, the prophylactic administration of a liver progenitor cell population serves to prevent GSD1a.

When provided therapeutically, liver progenitor cells are provided at (or after) the onset of a symptom or indication of GSD1a, e.g., upon the onset of abnormal glucose metabolism.

In some embodiments described herein, the liver progenitor cell population being administered according to the methods described herein comprises allogeneic liver progenitor cells obtained from one or more donors. "Allogeneic" refers to a liver progenitor cell or biological samples comprising liver progenitor cells or biological samples obtained from one or more different donors of the same species, where the genes at one or more loci are not identical. For example, a liver progenitor cell population being administered to a subject can be derived from one more unrelated donor subjects, or from one or more non-identical siblings. In some embodiments, syngeneic liver progenitor cell populations can be used, such as those obtained from genetically identical animals, or from identical twins. In other embodiments, the liver progenitor cells are autologous cells; that is, the liver progenitor cells are obtained or isolated from a subject and administered to the same subject, i.e., the donor and recipient are the same.

In one embodiment, the term "effective amount" refers to the amount of a population of progenitor cells or their progeny needed to prevent or alleviate at least one or more signs or symptoms of GSD1a, and relates to a sufficient amount of a composition to provide the desired effect, e.g., to treat a subject having GSD1a. The term "therapeutically effective amount" therefore refers to an amount of progenitor cells or a composition comprising progenitor cells that is sufficient to promote a particular effect when administered to a typical subject, such as one who has or is at risk for GSD1a. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various embodiments described herein, an effective amount of progenitor cells comprises at least $10^2$ progenitor cells, at least $5 \times 10^2$ progenitor cells, at least $10^3$ progenitor cells, at least $5 \times 10^3$ progenitor cells, at least $10^4$ progenitor cells, at least $5 \times 10^4$ progenitor cells, at least $10^5$ progenitor cells, at least $2 \times 10^5$ progenitor cells, at least $3 \times 10^5$ progenitor cells, at least $4 \times 10^5$ progenitor cells, at least $5 \times 10^5$ progenitor cells, at least $6 \times 10^5$ progenitor cells, at least $7 \times 10^5$ progenitor cells, at least $8 \times 10^5$ progenitor cells, at least $9 \times 10^5$ progenitor cells, at least $1 \times 10^6$ progenitor cells, at least $2 \times 10^6$ progenitor cells, at least $3 \times 10^6$ progenitor cells, at least $4 \times 10^6$ progenitor cells, at least $5 \times 10^6$ progenitor cells, at least $6 \times 10^6$ progenitor cells, at least $7 \times 10^6$ progenitor cells, at least $8 \times 10^6$ progenitor cells, at least $9 \times 10^6$ progenitor cells, or multiples thereof. The progenitor cells are derived from one or more donors, or are obtained from an autologous source. In some embodiments described herein, the progenitor cells are expanded in culture prior to administration to a subject in need thereof.

Modest and incremental increases in the levels of functional G6Pase expressed in cells of patients having GSD1a can be beneficial for ameliorating one or more symptoms of the disease, for increasing long-term survival, and/or for reducing side effects associated with other treatments. Upon administration of such cells to human patients, the presence of liver progenitors that are producing increased levels of functional G6Pase is beneficial. In some embodiments, effective treatment of a subject gives rise to at least about 3%, 5% or 7% functional G6Pase relative to total G6Pase in the treated subject. In some embodiments, functional G6Pase will be at least about 10% of total G6Pase. In some embodiments, functional G6Pase will be at least about 20% to 30% of total G6Pase. Similarly, the introduction of even relatively limited subpopulations of cells having significantly elevated levels of functional G6Pase can be beneficial in various patients because in some situations normalized cells will have a selective advantage relative to diseased cells. However, even modest levels of liver progenitors with elevated levels of functional G6Pase can be beneficial for ameliorating one or more aspects of GSD1a in patients. In some embodiments, about 10%, about 20%, about 30%, about 40%, about 50%, about 60%, about 70%, about 80%, about 90% or more of the liver progenitors in patients to whom such cells are administered are producing increased levels of functional G6Pase.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1 \times 10^4$ cells are delivered to the desired site for a period of time. Modes of administration include injection, infusion, instillation, or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some embodiments, the route is intravenous. For the delivery of cells, administration by injection or infusion can be made.

In one embodiment, the cells are administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of GSD1a can be determined by the skilled clinician. However, a treatment is considered "effective treatment," if any one or all of the signs or symptoms of, as but one example, levels of functional G6Pase are altered in a beneficial manner (e.g., increased by at least 10%), or other clinically accepted symptoms or markers of disease are improved or ameliorated. Efficacy can also be measured by failure of an individual to worsen as assessed by hospitalization or need for medical interventions (e.g., normal glucose metabolism, or progression of the disease is halted or at least slowed). Methods of measuring these indicators are known to those of skill in the art and/or described herein. Treatment includes any treatment of a disease in an individual or an animal (some non-limiting examples include a human, ora mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present invention ameliorates one or more symptoms associated with GSD1a by increasing the amount of functional G6Pase in the individual. Early signs typically associated with GSD1a, include for example, seizures due to hypoglycemia.

Kits

The present disclosure provides kits for carrying out the methods of the invention. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the embodiments of the methods of the invention, or any combination thereof.

In some embodiments, a kit comprises: (1) a vector comprising a nucleotide sequence encoding a genome-targeting nucleic acid, and (2) the site-directed polypeptide or a vector comprising a nucleotide sequence encoding the site-directed polypeptide and (3) a reagent for reconstitution and/or dilution of the vector(s) and or polypeptide.

In some embodiments, a kit comprises: (1) a vector comprising (i) a nucleotide sequence encoding a genome-targeting nucleic acid, and (ii) a nucleotide sequence encoding the site-directed polypeptide and (2) a reagent for reconstitution and/or dilution of the vector.

In some embodiments of any of the above kits, the kit comprises a single-molecule guide genome-targeting nucleic acid. In some embodiments of any of the above kits, the kit comprises a double-molecule genome-targeting nucleic acid. In some embodiments of any of the above kits, the kit comprises two or more double-molecule guides or single-molecule guides. In some embodiments, the kits comprise a vector that encodes the nucleic acid targeting nucleic acid.

In some embodiments of any of the above kits, the kit can further comprise a polynucleotide to be inserted to effect the desired genetic modification.

Components of a kit may be in separate containers, or combined in a single container.

In some embodiments, a kit described above further comprises one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. In some embodiments, a kit can also include one or more components that may be used to facilitate or enhance the on-target binding or the cleavage of DNA by the endonuclease, or improve the specificity of targeting.

In addition to the above-mentioned components, a kit can further include instructions for using the components of the kit to practice the methods. The instructions for practicing the methods are generally recorded on a suitable recording medium. For example, the instructions may be printed on a substrate, such as paper or plastic, etc. The instructions may be present in the kits as a package insert, in the labeling of the container of the kit or components thereof (i.e., associated with the packaging or subpackaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this embodiment is a kit that includes a web address where the instructions can be viewed and/or from which the instructions can be downloaded. As with the instructions, this means for obtaining the instructions can be recorded on a suitable substrate.

Guide RNA Formulation

Guide RNAs of the invention are formulated with pharmaceutically acceptable excipients such as carriers, solvents, stabilizers, adjuvants, diluents, etc., depending upon the particular mode of administration and dosage form. Guide RNA compositions are generally formulated to achieve a physiologically compatible pH, and range from a pH of about 3 to a pH of about 11, about pH 3 to about pH 7, depending on the formulation and route of administration. In some embodiments, the pH is adjusted to a range from about pH 5.0 to about pH 8. In some embodiments, the compositions comprise a therapeutically effective amount of at least one compound as described herein, together with one or more pharmaceutically acceptable excipients. Optionally, the compositions comprise a combination of the compounds described herein, or may include a second active ingredient useful in the treatment or prevention of bacterial growth (for example and without limitation, anti-bacterial or anti-microbial agents), or may include a combination of reagents of the invention.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Other Possible Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9. Cas9 cleavage also requires an adjacent motif, the PAM, which differs between different CRISPR systems. Cas9 from Streptococcus pyogenes cleaves using a NRG PAM, CRISPR from Neisseria meningitidis can cleave at sites with PAMs including NNNNGATT, NNNNNGTTT and NNNNGCTT. A number of other Cas9 orthologs target protospacer adjacent to alternative PAMs.

CRISPR endonucleases, such as Cas9 can be used in the methods of the invention. However, the teachings described herein, such as therapeutic target sites, could be applied to other forms of endonucleases, such as ZFNs, TALENs, HEs, or MegaTALs, or using combinations of nucleases. However, in order to apply the teachings of the present invention to such endonucleases, one would need to, among other things, engineer proteins directed to the specific target sites.

Additional binding domains can be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., *Proc Natl Acad Sci USA* 96(6):2758-63 (1999); Dreier B et al., *J Mol Biol.* 303(4):489-502 (2000); Liu Q et al., *J Biol Chem.* 277(6):3850-6 (2002); Dreier et al., *J Biol Chem* 280(42): 35588-97 (2005); and Dreier et al., *J. Biol Chem.* 276(31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefitted from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, *Science* 326(5959):1509-12 (2009); Mak et al., *Science* 335(6069):716-9 (2012); and Moscou et al., *Science* 326(5959):1501 (2009). The use of TALENs based on the "Golden Gate" platform, or cloning scheme, has been described by multiple groups; see, e.g., Cermak et al., *Nucleic Acids Res.* 39(12):e82 (2011); Li et al., *Nucleic Acids Res.* 39(14):6315-25(2011); Weber et al., *PLoS One.* 6(2):e16765 (2011); Wang et al., *J Genet Genomics* 41(6): 339-47, Epub 2014 May 17 (2014); and Cermak T et al., *Methods Mol Biol.* 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including LAGLIDADG (SEQ ID NO: 64,791), GIY-YIG, His-Cis box, H—N—H, PD-(D/E)xK, and Vsr-like that are derived from a broad range of hosts, including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., *Glycobiology* 24(8):663-80 (2014); Belfort and Bonocora, *Methods Mol Biol.* 1123: 1-26 (2014); Hafez and Hausner, *Genome* 55(8):553-69 (2012); and references cited therein.

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., *NAR* 42: 2591-2601 (2014); Kleinstiver et al., *G3* 4:1155-65 (2014); and Boissel and Scharenberg, *Methods Mol. Biol.* 1239: 171-96 (2015).

In a further variation, the MegaTev architecture is the fusion of a meganuclease (Mega) with the nuclease domain derived from the GIY-YIG homing endonuclease I-Tevl (Tev). The two active sites are positioned ~30 bp apart on a DNA substrate and generate two DSBs with non-compatible cohesive ends; see, e.g., Wolfs et al., *NAR* 42, 8816-29 (2014). It is anticipated that other combinations of existing nuclease-based approaches will evolve and be useful in achieving the targeted genome modifications described herein.

dCas9-FokI and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 24 nucleotide sequence in the guide RNA that undergoes Watson-Crick base-pairing with the target DNA (plus an additional 2 bases in the adjacent NAG or NGG PAM sequence in the case of Cas9 or Cpf1 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 catalytic function—retaining the RNA-guided DNA binding function—and instead fusing a FokI domain to the deactivated Cas9; see, e.g., Tsai et al., *Nature Biotech* 32: 569-76 (2014); and Guilinger et al., *Nature Biotech.* 32: 577-82 (2014). Because FokI must dimerize to become catalytically active, two guide RNAs are required to tether two FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-Tevl, takes advantage of both the tunable DNA binding and specificity of the TALE, as well as the cleavage sequence specificity of I-Tevl, with the expectation that off-target cleavage may be further reduced.

Methods and Compositions of the Invention

Accordingly, the present disclosure relates in particular to the following non-limiting inventions: In a first method, Method 1, the present disclosure provides a I method for editing the glucose-6-phosphatase, catalytic (G6PC) gene in a human cell by genome editing, the method comprising the step of: introducing into the human cell one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene that results in a permanent insertion, correction, or modulation of expression of function of one or more exons within or near or affecting the expression or function of the G6PC gene and results in restoration of glucose-6-phosphatase (G6Pase) protein activity.

In another method, Method 2, the present disclosure provides a method for inserting a G6PC gene in a human cell by genome editing, the method comprising introducing into the human cell one or more deoxyribonucleic acid (DNA) endonucleases to effect one or more single-strand breaks (SSBs) or double-strand breaks (DSBs) within or near a safe harbor locus that results in a permanent insertion of the G6PC gene, and results in restoration of G6Pase protein activity.

In another method, Method 3, the present disclosure provides an ex vivo method for treating a patient with Glycogen Storage Disease type 1a (GSD1a), the method comprising the steps of: i) creating a patient specific induced pluripotent stem cell (iPSC), or editing within or near a safe harbor locus of the iPSC; ii) editing within or near a glucose-6-phosphatase, catalytic (G6PC) gene or other DNA sequences that encode regulatory elements of the G6PC gene of the iPSC; iii) differentiating the genome edited iPSC into a hepatocyte; and iv) implanting the hepatocyte into the patient.

In another method, Method 4, the present disclosure provides the method of Method 3, wherein the creating step comprises: a) isolating a somatic cell from the patient; and b) introducing a set of pluripotency-associated genes into the somatic cell to induce the somatic cell to become a pluripotent stem cell.

In another method, Method 5, the present disclosure provides the method of Method 4, wherein the somatic cell is a fibroblast.

In another method, Method 6, the present disclosure provides the method of Method 4, wherein the set of pluripotency-associated genes is one or more of the genes selected from the group consisting of OCT4, SOX2, KLF4, Lin28, NANOG and cMYC.

In another method, Method 7, the present disclosure provides the method of any one of Methods 3-6, wherein the editing step comprises introducing into the iPSC one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene that results in a permanent insertion, correction or modulation of expression or function of one or more exons within or near or affecting the expression or function of the G6PC gene or within or near a safe harbor locus and results in restoration of glucose-6-phosphatase (G6Pase) protein activity.

In another method, Method 8, the present disclosure provides the method of Method 7, wherein the safe harbor locus is selected from the group consisting of AAVS1 (PPP1R12C), ALB, Angptl3, ApoC3, ASGR2, CCR5, FIX (F9), Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In another method, Method 9, the present disclosure provides the method of any one of Methods 3-8, wherein the differentiating step comprises one or more of the following to differentiate the genome edited iPSC into a hepatocyte: contacting the genome edited iPSC with one or more of activin, B27 supplement, FGF4, HGF, BMP2, BMP4, Oncostatin M, Dexametason.

In another method, Method 10, the present disclosure provides the method of any one of Methods 3-9, wherein the implanting step comprises implanting the hepatocyte into the patient by transplantation, local injection, or systemic infusion, or combinations thereof.

In another method, Method 11, the present disclosure provides an ex vivo method for treating a patient with Glycogen Storage Disease type 1a (GSD1a), the method comprising the steps of: i) performing a biopsy of the patient's liver; ii) isolating a liver specific progenitor cell or primary hepatocyte; iii) editing within or near the glucose-6-phosphatase, catalytic (G6PC) gene or other DNA sequences that encode regulatory elements of the G6PC gene of the progenitor cell or primary hepatocyte or editing within or near a safe harbor locus of the progenitor cell or primary hepatocyte; and iv) implanting the genome-edited progenitor cell or primary hepatocyte into the patient.

In another method, Method 12, the present disclosure provides the method of Method 11, wherein the isolating step comprises: perfusion of fresh liver tissues with digestion enzymes, cell differential centrifugation, cell culturing, or combinations thereof.

In another method, Method 13, the present disclosure provides the method of any one of Methods 11-12, wherein the editing step comprises introducing into the progenitor cell or primary hepatocyte one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene or within or near a safe harbor that results in a permanent insertion, correction, or modulation of expression or function of one or more exons within or near or affecting the expression or function of the G6PC gene or within or near a safe harbor locus and restoration of glucose-6-phosphatase (G6Pase) protein activity.

In another method, Method 14, the present disclosure provides the method of Method 13, wherein the safe harbor locus is selected from the group consisting of AAVS1 (PPP1R12C), ALB, Angptl3, ApoC3, ASGR2, CCR5, FIX (F9), Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In another method, Method 15, the present disclosure provides the method of any one of Methods 11-14, wherein the implanting step comprises implanting the genome-edited progenitor cell or primary hepatocyte into the patient by transplantation, local injection, or systemic infusion, or combinations thereof.

In another method, Method 16, the present disclosure provides an ex vivo method for treating a patient with Glycogen Storage Disease type 1a (GSD1a), the method comprising the steps of: i) performing a biopsy of the patient's bone marrow; ii) isolating a mesenchymal stem cell from the patient; iii) editing within or near the glucose-6-phosphatase, catalytic (G6PC) gene or other DNA sequences that encode regulatory elements of the G6PC gene of the mesenchymal stem cell or editing within or near a safe harbor locus of the mesenchymal stem cell; iv) differentiating the genome-edited mesenchymal stem cell into a hepatocyte; and v) implanting the hepatocyte into the patient.

In another method, Method 17, the present disclosure provides the method of Method 16, wherein the mesenchymal stem cell is isolated from the patient's bone marrow or peripheral blood.

In another method, Method 18, the present disclosure provides the method of Method 16, wherein the isolating step comprises: aspiration of bone marrow and isolation of mesenchymal cells by density centrifugation using Percoll™.

In another method, Method 19, the present disclosure provides the method of any one of Methods 16-18, wherein the editing step comprises introducing into the mesenchymal stem cell one or more deoxyribonucleic acid (DNA) endonucleases to effect one or more single-strand breaks (SSBs) or double-strand breaks (DSBs) within or near the G6PC gene or other DNA sequences that encode regulatory elements of the G6PC gene that results in a permanent insertion, correction, or modulation of expression or function of one or more exons within or near or affecting the expression or function of the G6PC gene or within or near a safe harbor locus and restoration of glucose-6-phosphatase (G6Pase) protein activity.

In another method, Method 20, the present disclosure provides the method of Method 19, wherein the safe harbor locus is selected from the group consisting of AAVS1 (PPP1R12C), ALB, Angptl3, ApoC3, ASGR2, CCR5, FIX (F9), Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In another method, Method 21, the present disclosure provides the method of any one of Methods 16-19, wherein the differentiating step comprises one or more of the following to differentiate the genome edited mesenchymal stem cell into a hepatocyte: contacting the genome edited stem cell with one or more of insulin, transferrin, FGF4, HGF, or bile acids.

In another method, Method 22, the present disclosure provides the method of any one of Methods 16-21, wherein the implanting step comprises implanting the hepatocyte into the patient by transplantation, local injection, or systemic infusion, or combinations thereof.

In another method, Method 23, the present disclosure provides an in vivo method for treating a patient with Glycogen Storage Disease type 1a (GSD1a), the method comprising the step of editing the glucose-6-phosphatase, catalytic (G6PC) gene in a cell of the patient, or other DNA sequences that encode regulatory elements of the G6PC gene, or editing within or near a safe harbor locus in a cell of the patient.

In another method, Method 24, the present disclosure provides the method of Method 23, wherein the editing step comprises introducing into the cell one or more deoxyribonucleic acid (DNA) endonucleases to effect one or more single-strand breaks (SSBs) or double-strand breaks (DSBs) within or near the G6PC gene other DNA sequences that encode regulatory elements of the G6PC gene that results in a permanent insertion, correction, or modulation of expression or function of one or more exons within or near or affecting the expression or function of the G6PC gene or within or near a safe harbor locus that results in a permanent insertion of the G6PC gene and restoration of glucose-6-phosphatase (G6Pase) protein activity.

In another method, Method 25, the present disclosure provides the method of any one of Methods 1, 2, 7, 13, 19, or 24, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; ora homolog thereof, recombination of the naturally occurring molecule, codon-optimized, or modified version thereof, and combinations thereof.

In another method, Method 26, the present disclosure provides the method of Method 25, wherein the method comprises introducing into the cell one or more polynucleotides encoding the one or more DNA endonucleases.

In another method, Method 27, the present disclosure provides the method of Method 25, wherein the method comprises introducing into the cell one or more ribonucleic acids (RNAs) encoding the one or more DNA endonucleases.

In another method, Method 28, the present disclosure provides the method of any one of Methods 26 or 27, wherein the one or more polynucleotides or one or more RNAs is one or more modified polynucleotides or one or more modified RNAs.

In another method, Method 29, the present disclosure provides the method of Method 26, wherein the DNA endonuclease is a protein or polypeptide.

In another method, Method 30, the present disclosure provides the method of any one of the preceding Methods, wherein the method further comprises introducing into the cell one or more guide ribonucleic acids (gRNAs).

In another method, Method 31, the present disclosure provides the method of Method 30, wherein the one or more gRNAs are single-molecule guide RNA (sgRNAs).

In another method, Method 32, the present disclosure provides the method of any one of Methods 30-31, wherein the one or more gRNAs or one or more sgRNAs is one or more modified gRNAs or one or more modified sgRNAs.

In another method, Method 33, the present disclosure provides the method of any one of Methods 30-32, wherein the one or more DNA endonucleases is pre-complexed with one or more gRNAs or one or more sgRNAs.

In another method, Method 34, the present disclosure provides the method of any one of the preceding Methods, wherein the method further comprises introducing into the cell a polynucleotide donor template comprising at least a portion of the wild-type G6PC gene or cDNA.

In another method, Method 35, the present disclosure provides the method of Method 34, wherein the at least a portion of the wild-type G6PC gene or cDNA is exon 1, exon 2, exon 3, exon 4, exon 5, intronic regions, fragments or combinations thereof, the entire G6PC gene, DNA sequences that encode wild-type regulatory elements of the G6PC gene, or cDNA.

In another method, Method 36, the present disclosure provides the method of any one of Methods 34-35, wherein the donor template is either a single or double stranded polynucleotide.

In another method, Method 37, the present disclosure provides the method of any one of Methods 34-36, wherein the donor template has homologous arms to the 17q21 region.

In another method, Method 38, the present disclosure provides the method of any one of Methods 1, 2, 7, 13, 19, or 24, wherein the method further comprises introducing into the cell one guide ribonucleic acid (gRNA) and a polynucleotide donor template comprising at least a portion of the wild-type G6PC gene, and wherein the one or more DNA endonucleases is one or more Cas9 endonucleases that effect one single-strand break (SSB) or double-strand break (DSB) at a DSB locus within or near the G6PC gene or other DNA sequences that encode regulatory elements of the G6PC gene or within or near a safe harbor locus that facilitates insertion of a new sequence from the polynucleotide donor template into the chromosomal DNA at the locus or safe harbor locus that results in a permanent insertion or correction of a part of the chromosomal DNA of the G6PC gene or other DNA sequences that encode regulatory elements of the G6PC gene proximal to the locus or safe harbor locus and restoration of G6Pase protein activity, and wherein the gRNA comprises a spacer sequence that is complementary to a segment of the locus or safe harbor locus.

In another method, Method 39, the present disclosure provides the method of Method 38, wherein proximal means nucleotides both upstream and downstream of the locus or safe harbor locus.

In another method, Method 40, the present disclosure provides the method of any one of Methods 1, 2, 7, 13, 19, or 24, wherein the method further comprises introducing into the cell two guide ribonucleic acid (gRNAs) and a polynucleotide donor template comprising at least a portion of the wild-type G6PC gene, and wherein the one or more DNA endonucleases is two or more Cas9 or Cpf1 endonucleases that effect a pair of single-strand breaks (SSBs) or double-strand breaks (DSBs), the first at a 5' locus and the second at a 3' locus, within the G6PC gene or other DNA sequences that encode regulatory elements of the G6PC gene or within or near a safe harbor locus that facilitates insertion of a new sequence from the polynucleotide donor template into the chromosomal DNA between the 5' locus and the 3' locus that results in permanent correction of the chromosomal DNA between the 5' locus and the 3' locus within the G6PC gene or other DNA sequences that encode regulatory elements of the G6PC gene or within or near a safe harbor locus and restoration of G6Pase protein activity, and wherein the first guide RNA comprises a spacer sequence that is complementary to a segment of the 5' locus and the second guide RNA comprises a spacer sequence that is complementary to a segment of the 3' locus.

In another method, Method 41, the present disclosure provides the method of any one of Methods 38-40, wherein the one or two gRNAs are one or two single-molecule guide RNA (sgRNAs).

In another method, Method 42, the present disclosure provides the method of any one of Methods 38-41, wherein the one or two gRNAs or one or two sgRNAs is one or two modified gRNA or one or two modified sgRNA.

In another method, Method 43, the present disclosure provides the method of any one of Methods 38-42, wherein the one or more DNA endonucleases is pre-complexed with one or two gRNAs or one or two sgRNAs.

In another method, Method 44, the present disclosure provides the method of any one of Methods 38-43, wherein the at least a portion of the wild-type G6PC gene or cDNA is exon 1, exon 2, exon 3, exon 4, exon 5, intronic regions, fragments or combinations thereof, the entire G6PC gene, DNA sequences that encode wild-type regulatory elements of the G6PC gene, or cDNA.

In another method, Method 45, the present disclosure provides the method of any one of Methods 38-44, wherein the donor template is either a single or double stranded polynucleotide.

In another method, Method 46, the present disclosure provides the method of any one of Methods 38-45, wherein the donor template has homologous arms to the 17q21 region.

In another method, Method 47, the present disclosure provides the method of Method 3644, wherein the SSB, DSB, or 5' DSB and 3' DSB are in the first, second, third, fourth, fifth exon or intron of the G6PC gene.

In another method, Method 48, the present disclosure provides the method of any one of Methods 1, 2, 7, 13, 19, 24, 30-33, or 38-41, wherein the gRNA or sgRNA is directed to one or more of the following pathological variants: rs80356479, rs80356486, rs606231368, rs80356488, rs587776757, rs104894565, rs104894566, rs1801175, rs1801176, rs104894567, rs104894571, rs80356482, rs80356483, rs104894563, rs367727229, rs387906505, rs104894568, rs104894569, rs80356487, rs764920787, rs80356485, rs780226142, rs80356484.

In another method, Method 49, the present disclosure provides the method of any one of Methods 1, 2, 7, 13, 19 or 24-48, wherein the insertion or correction is by homology directed repair (HDR).

In another method, Method 50, the present disclosure provides the method of any one of Methods 1, 2, 7, 13, 19 or 24-49, wherein the Cas9 mRNA, gRNA, and donor template are either each formulated into separate lipid nanoparticles or all co-formulated into a lipid nanoparticle.

In another method, Method 51, the present disclosure provides the method of any one of Methods 1, 2, 7, 13, 19 or 24-49, wherein the Cas9 or Cpf1 mRNA is formulated into a lipid nanoparticle, and both the gRNA and donor template are delivered to the cell by a viral vector.

In another method, Method 52, the present disclosure provides the method of Method 51, wherein the viral vector is an adeno-associated virus (AAV).

In another method, Method 53, the present disclosure provides the method of Method 52, wherein the AAV vector is an AAV6 vector.

In another method, Method 54, the present disclosure provides the method of any one of Methods 1, 2, 7, 13, 19 or 24-49, wherein the Cas9 or Cpf1 mRNA, gRNA and a donor template are either each formulated into separate exosomes or all co-formulated into an exosome.

5 In another method, Method 55, the present disclosure provides the method of any one of Methods 1, 2, 7, 13, 19 or 24-49, wherein the Cas9 or Cpf1 mRNA is formulated into a lipid nanoparticle, and the gRNA is delivered to the cell by electroporation and donor template is delivered to the cell by a viral vector.

In another method, Method 56, the present disclosure provides the method of Method 55, wherein the viral vector is an adeno-associated virus (AAV) vector.

In another method, Method 57, the present disclosure provides the method of Method 56, wherein the AAV vector is an AAV6 vector.

In another method, Method 58, the present disclosure provides the method of any one of the preceding Methods, wherein the G6PC gene is located on Chromosome 17: 42,900,796-42,914,432 (Genome Reference Consortium—GRCh38/hg38).

In another method, Method 59, the present disclosure provides the method of any one of Methods 1, 2, 7, 13, 19 or 24-49, wherein the restoration of G6Pase protein activity is compared to wild-type or normal G6Pase protein activity.

In another method, Method 60, the present disclosure provides the method of Method 1, wherein the human cell is a liver cell.

In another method, Method 61, the present disclosure provides the method of Method 23, wherein the cell is a liver cell.

In another method, Method 62, the present disclosure provides the method of any one of Methods 1, 2, 7, 13, 19 or 24-49, wherein the G6PC gene is operably linked to an exogenous promoter that drives expression of the G6PC gene.

In another method, Method 63, the present disclosure provides the method of any one of Methods 1, 2, 7, 13, 19 or 24-49, wherein the one or more SSBs or DSBs occurs at a location immediately 3' to an endogenous promoter locus.

The present disclosure also provides a composition, Composition 1, comprising one or more guide ribonucleic acids (gRNAs) or editing a G6PC gene in a cell from a patient with Glycogen Storage Disease type 1a (GSD1a), the one or more gRNAs comprising a spacer sequence selected from the group consisting of the nucleic acid sequences in FIGS. 1-90 for editing the glucose-6-phosphatase, catalytic gene in a cell from a patient with Glycogen Storage Disease type 1a.

In another composition, Composition 2, the present disclosure provides the one or more gRNAs of Composition 1, wherein the one or more gRNAs are one or more single-molecule guide RNAs (sgRNAs).

In another composition, Composition 3, the present disclosure provides the one or more gRNAs or sgRNAs of Composition 1 or 2, wherein the one or more gRNAs or one or more sgRNAs is one or more modified gRNA or one or more modified sgRNA.

In another composition, Composition 4, the present disclosure provides the one or more gRNAs or sgRNAs of Compositions 63-65, wherein the cell is a liver cell.

Definitions

The term "comprising" or "comprises" is used in reference to compositions, methods, and respective component(s) thereof, that are essential to the invention, yet open to the inclusion of unspecified elements, whether essential or not.

The term "consisting essentially of" refers to those elements required for a given embodiment. The term permits the presence of additional elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

The singular forms "a," "an," and "the" include plural references, unless the context clearly dictates otherwise.

Certain numerical values presented herein are preceded by the term "about." The term "about" is used to provide literal support for the numerical value the term "about" precedes, as well as a numerical value that is approximately the numerical value, that is the approximating unrecited numerical value may be a number which, in the context it is presented, is the substantial equivalent of the specifically recited numerical value. The term "about" means numerical values within ±10% of the recited numerical value.

When a range of numerical values is presented herein, it is contemplated that each intervening value between the lower and upper limit of the range, the values that are the upper and lower limits of the range, and all stated values with the range are encompassed within the disclosure. All the possible sub-ranges within the lower and upper limits of the range are also contemplated by the disclosure.

EXAMPLES

The invention will be more fully understood by reference to the following examples, which provide illustrative non-limiting embodiments of the invention.

The examples describe the use of the CRISPR system as an illustrative genome editing technique to create defined therapeutic genomic replacements, termed "genomic modifications" herein, in the G6PC gene that lead to permanent correction of mutations in the genomic locus, or expression at a heterologous locus, that restore G6Pase activity. Introduction of the defined therapeutic modifications represents a novel therapeutic strategy for the potential amelioration of GSD1a, as described and illustrated herein.

Example 1—CRISPR/SpCas9 Target Sites for the AAVS1 (PPP1R12C) Aerie

Exons 1-2 of the AAVS1 (PPP1 R12C) gene were scanned for target sites. Each area was scanned for a protospacer adjacent motif (PAM) having the sequence NRG. gRNA 20 bp spacer sequences corresponding to the PAM were identified, as shown in FIG. 1.

Example 2—CRISPR/SaCas9 Target Sites for the AAVS1 (PPP1R12C) Gene

Exons 1-2 of the AAVS1 (PPP1 R12C) gene were scanned for target sites. Each area was scanned for a protospacer adjacent motif (PAM) having the sequence NNGRRT. gRNA 20 bp spacer sequences corresponding to the PAM were identified, as shown in FIG. 2.

Example 3—CRISPR/StCas9 Target Sites for the AAVS1 (PPP1R12C) Gene

Exons 1-2 of the AAVS1 (PPP1 R12C) gene were scanned for target sites. Each area was scanned for a protospacer adjacent motif (PAM) having the sequence NNAGAAW. gRNA 20 bp spacer sequences corresponding to the PAM were identified, as shown in FIG. 3.

Example 4—CRISPR/TdCas9 Target Sites for the AAVS1 (PPP1R12C) Gene

Exons 1-2 of the AAVS1 (PPP1 R12C) gene were scanned for target sites. Each area was scanned for a protospacer adjacent motif (PAM) having the sequence NAAAAC. gRNA 20 bp spacer sequences corresponding to the PAM were identified, as shown in FIG. 4.

Example 5—CRISPR/NmCas9 Target Sites for the AAVS1 (PPP1R12C) Gene

Exons 1-2 of the AAVS1 (PPP1 R12C) gene were scanned for target sites. Each area was scanned for a protospacer adjacent motif (PAM) having the sequence NNNNGHTT. gRNA 20 bp spacer sequences corresponding to the PAM were identified, as shown in FIG. 5.

Example 6—CRISPR/Cpf1 Target Sites for the AAVS1 (PPP1R12C) Gene

Exons 1-2 of the AAVS1 (PPP1 R12C) gene were scanned for target sites. Each area was scanned for a protospacer adjacent motif (PAM) having the sequence YTN. gRNA 22 bp spacer sequences corresponding to the PAM were identified, as shown in FIG. 6.

Example 7 CRISPR/SpCas9 Target Sites for the ALB Gene

Exons 1-2 of the ALB gene were scanned for target sites. Each area was scanned for a protospacer adjacent motif (PAM) having the sequence NRG. gRNA 20 bp spacer sequences corresponding to the PAM were identified, as shown in FIG. 7.

Example 8—CRISPR/SaCas9 Target Sites for the ALB Gene

Exons 1-2 of the ALB gene were scanned for target sites. Each area was scanned for a protospacer adjacent motif (PAM) having the sequence NNGRRT. gRNA 20 bp spacer sequences corresponding to the PAM were identified, as shown in FIG. 8.

Example 9—CRISPR/StCas9 Target Sites for the ALB Gene

Exons 1-2 of the ALB gene were scanned for target sites. Each area was scanned for a protospacer adjacent motif (PAM) having the sequence NNAGAAW. gRNA 20 bp spacer sequences corresponding to the PAM were identified, as shown in FIG. 9.

Example 10—CRISPR/TdCas9 Target Sites for the ALB Gene

Exons 1-2 of the ALB gene were scanned for target sites. Each area was scanned for a protospacer adjacent motif (PAM) having the sequence NAAAAC. gRNA 20 bp spacer sequences corresponding to the PAM were identified, as shown in FIG. 10.

Example 11—CRISPR/NmCas9 Target Sites for the ALB Gene

Exons 1-2 of the ALB gene were scanned for target sites. Each area was scanned for a protospacer adjacent motif (PAM) having the sequence NNNNGHTT. gRNA 20 bp spacer sequences corresponding to the PAM were identified, as shown in FIG. 11.

Example 12—CRISPR/Cpf1 Target Sites for the ALB Gene

Exons 1-2 of the ALB gene were scanned for target sites. Each area was scanned for a protospacer adjacent motif (PAM) having the sequence YTN. gRNA 22 bp spacer sequences corresponding to the PAM were identified, as shown in FIG. 12.

Example 13—CRISPR/SpCas9 Target Sites for the Angptl3 Gene

Exons 1-2 of the Angptl3 gene were scanned for target sites. Each area was scanned for a protospacer adjacent motif (PAM) having the sequence NRG. gRNA 20 bp spacer sequences corresponding to the PAM were identified, as shown in FIG. 13.

Example 14—CRISPR/SaCas9 Target Sites for the Anciptl3 Gene

Exons 1-2 of the Angptl3 gene were scanned for target sites. Each area was scanned for a protospacer adjacent motif (PAM) having the sequence NNGRRT. gRNA 20 bp spacer sequences corresponding to the PAM were identified, as shown in FIG. 14.

Example 15—CRISPR/StCas9 Target Sites for the Anciptl3 Gene

Exons 1-2 of the Angptl3 gene were scanned for target sites. Each area was scanned for a protospacer adjacent motif (PAM) having the sequence NNAGAAW. gRNA 20 bp spacer sequences corresponding to the PAM were identified, as shown in FIG. 15.

Example 16—CRISPR/TdCas9 Target Sites for the Angptl3 Gene

Exons 1-2 of the Angptl3 gene were scanned for target sites. Each area was scanned for a protospacer adjacent motif (PAM) having the sequence NAAAAC. gRNA 20 bp spacer sequences corresponding to the PAM were identified, as shown in FIG. 16.

Example 17—CRISPR/NmCas9 Target Sites for the Angptl3 Gene

Exons 1-2 of the Angptl3 gene were scanned for target sites. Each area was scanned for a protospacer adjacent motif (PAM) having the sequence NNNNGHTT. gRNA 20 bp spacer sequences corresponding to the PAM were identified, as shown in FIG. 17.

Example 18—CRISPR/Cpf1 Target Sites for the Anciptl3 Gene

Exons 1-2 of the Angptl3 gene were scanned for target sites. Each area was scanned for a protospacer adjacent motif (PAM) having the sequence YTN. gRNA 22 bp spacer sequences corresponding to the PAM were identified, as shown in FIG. 18.

Example 19—CRISPR/SpCas9 Target Sites for the ApoC3 Gene

Exons 1-2 of the ApoC3 gene were scanned for target sites. Each area was scanned for a protospacer adjacent motif (PAM) having the sequence NRG. gRNA 20 bp spacer sequences corresponding to the PAM were identified, as shown in FIG. 19.

Example 20—CRISPR/SaCas9 Target Sites for the ApoC3 Gene

Exons 1-2 of the ApoC3 gene were scanned for target sites. Each area was scanned for a protospacer adjacent motif (PAM) having the sequence NNGRRT. gRNA 20 bp spacer sequences corresponding to the PAM were identified, as shown in FIG. 20.

Example 21—CRISPR/StCas9 Target Sites for the ApoC3 Gene

Exons 1-2 of the ApoC3 gene were scanned for target sites. Each area was scanned for a protospacer adjacent motif (PAM) having the sequence NNAGAAW. gRNA 20 bp spacer sequences corresponding to the PAM were identified, as shown in FIG. 21.

Example 22—CRISPR/TdCas9 Target Sites for the ApoC3 Gene

Exons 1-2 of the ApoC3 gene were scanned for target sites. Each area was scanned for a protospacer adjacent motif (PAM) having the sequence NAAAAC. gRNA 20 bp spacer sequences corresponding to the PAM were identified, as shown in FIG. 22.

Example 23—CRISPR/NmCas9 Target Sites for the ApoC3 Gene

Exons 1-2 of the ApoC3 gene were scanned for target sites. Each area was scanned for a protospacer adjacent motif (PAM) having the sequence NNNNGHTT. gRNA 20 bp spacer sequences corresponding to the PAM were identified, as shown in FIG. 23.

Example 24—CRISPR/Cpf1 Target Sites for the ApoC3 Gene

Exons 1-2 of the ApoC3 gene were scanned for target sites. Each area was scanned for a protospacer adjacent motif (PAM) having the sequence YTN. gRNA 22 bp spacer sequences corresponding to the PAM were identified, as shown in FIG. 24.

Example 25—CRISPR/SpCas9 Target Gites for the ASGR2 Gene

Exons 1-2 of the ASGR2 gene were scanned for target sites. Each area was scanned for a protospacer adjacent motif (PAM) having the sequence NRG. gRNA 20 bp spacer sequences corresponding to the PAM were identified, as shown in FIG. 25.

Example 26—CRISPR/SaCas9 Target Sites for the ASGR2 Gene

Exons 1-2 of the ASGR2 gene were scanned for target sites. Each area was scanned for a protospacer adjacent motif (PAM) having the sequence NNGRRT. gRNA 20 bp spacer sequences corresponding to the PAM were identified, as shown in FIG. 26.

Example 27—CRISPR/StCas9 Target Sites for the ASGR2 Gene

Exons 1-2 of the ASGR2 gene were scanned for target sites. Each area was scanned for a protospacer adjacent motif (PAM) having the sequence NNAGAAW. gRNA 20 bp spacer sequences corresponding to the PAM were identified, as shown in FIG. 27.

Example 28—CRISPR/TdCas9 Target Sites for the ASGR2 Gene

Exons 1-2 of the ASGR2 gene were scanned for target sites. Each area was scanned for a protospacer adjacent motif (PAM) having the sequence NAAAAC. gRNA 20 bp spacer sequences corresponding to the PAM were identified, as shown in FIG. 28.

Example 29—CRISPR/NmCas9 Target Sites for the ASGR2 Gene

Exons 1-2 of the ASGR2 gene were scanned for target sites. Each area was scanned for a protospacer adjacent motif (PAM) having the sequence NNNNGHTT. gRNA 20 bp spacer sequences corresponding to the PAM were identified, as shown in FIG. 29.

Example 30—CRISPR/Cpf1 Target Sites for the ASGR2 Gene

Exons 1-2 of the ASGR2 gene were scanned for target sites. Each area was scanned for a protospacer adjacent motif (PAM) having the sequence YTN. gRNA 22 bp spacer sequences corresponding to the PAM were identified, as shown in FIG. 30.

Example 31—CRISPR/SpCas9 Target Sites for the CCR5 Gene

Exons 1-2 of the CCR5 gene were scanned for target sites. Each area was scanned for a protospacer adjacent motif (PAM) having the sequence NRG. gRNA 20 bp spacer sequences corresponding to the PAM were identified, as shown in FIG. 31.

Example 32—CRISPR/SaCas9 Target Sites for the CCR5 Gene

Exons 1-2 of the CCR5 gene were scanned for target sites. Each area was scanned for a protospacer adjacent motif (PAM) having the sequence NNGRRT. gRNA 20 bp spacer sequences corresponding to the PAM were identified, as shown in FIG. 32.

Example 33—CRISPR/StCas9 Target Sites for the CCR5 Gene

Exons 1-2 of the CCR5 gene were scanned for target sites. Each area was scanned for a protospacer adjacent motif (PAM) having the sequence NNAGAAW. gRNA 20 bp spacer sequences corresponding to the PAM were identified, as shown in FIG. 33.

Example 34—CRISPR/TdCas9 Target Sites for the CCR5 Gene

Exons 1-2 of the CCR5 gene were scanned for target sites. Each area was scanned for a protospacer adjacent motif (PAM) having the sequence NAAAAC. gRNA 20 bp spacer sequences corresponding to the PAM were identified, as shown in FIG. 34.

Example 35—CRISPR/NmCas9 Target Sites for the CCR5 Gene

Exons 1-2 of the CCR5 gene were scanned for target sites. Each area was scanned for a protospacer adjacent motif (PAM) having the sequence NNNNGHTT. gRNA 20 bp spacer sequences corresponding to the PAM were identified, as shown in FIG. 35.

Example 36—CRISPR/Cpf1 Target Sites for the CCR5 Gene

Exons 1-2 of the CCR5 gene were scanned for target sites. Each area was scanned for a protospacer adjacent motif (PAM) having the sequence YTN. gRNA 22 bp spacer sequences corresponding to the PAM were identified, as shown in FIG. 36.

Example 37—CRISPR/SpCas9 Target Sites for the FIX (F9) Gene

Exons 1-2 of the FIX (F9) gene were scanned for target sites. Each area was scanned for a protospacer adjacent motif (PAM) having the sequence NRG. gRNA 20 bp spacer sequences corresponding to the PAM were identified, as shown in FIG. 37.

Example 38—CRISPR/SaCas9 Target Sites for the FIX (F9) Gene

Exons 1-2 of the FIX (F9) gene were scanned for target sites. Each area was scanned for a protospacer adjacent motif (PAM) having the sequence NNGRRT. gRNA 20 bp spacer sequences corresponding to the PAM were identified, as shown in FIG. 38.

Example 39—CRISPR/StCas9 Target Sites for the FIX (F9) Gene

Exons 1-2 of the FIX (F9) gene were scanned for target sites. Each area was scanned for a protospacer adjacent motif (PAM) having the sequence NNAGAAW. gRNA 20 bp spacer sequences corresponding to the PAM were identified, as shown in FIG. 39.

Example 40—CRISPR/TdCas9 Target Sites for the FIX (F9) Gene

Exons 1-2 of the FIX (F9) gene were scanned for target sites. Each area was scanned for a protospacer adjacent motif (PAM) having the sequence NAAAAC. gRNA 20 bp spacer sequences corresponding to the PAM were identified, as shown in FIG. 40.

Example 41—CRISPR/NmCas9 Target Sites for the FIX (F9) Gene

Exons 1-2 of the FIX (F9) gene were scanned for target sites. Each area was scanned for a protospacer adjacent motif (PAM) having the sequence NNNNGHTT. gRNA 20 bp spacer sequences corresponding to the PAM were identified, as shown in FIG. 41.

Example 42—CRISPR/Cpf1 Target Sites for the FIX (F9) Gene

Exons 1-2 of the FIX (F9) gene were scanned for target sites. Each area was scanned for a protospacer adjacent motif (PAM) having the sequence YTN. gRNA 22 bp spacer sequences corresponding to the PAM were identified, as shown in FIG. 42.

Example 43—CRISPR/SpCas9 Target Sites for the Gys2 Gene

Exons 1-2 of the Gys2 gene were scanned for target sites. Each area was scanned for a protospacer adjacent motif (PAM) having the sequence NRG. gRNA 20 bp spacer sequences corresponding to the PAM were identified, as shown in FIG. 43

Example 44—CRISPR/SaCas9 Target Sites for the Gvs2 Gene

Exons 1-2 of the Gys2 gene were scanned for target sites. Each area was scanned for a protospacer adjacent motif (PAM) having the sequence NNGRRT. gRNA 20 bp spacer sequences corresponding to the PAM were identified, as shown in FIG. 44.

Example 45—CRISPR/StCas9 Target Sites for the Gvs2 Gene

Exons 1-2 of the Gys2 gene were scanned for target sites. Each area was scanned for a protospacer adjacent motif (PAM) having the sequence NNAGAAW. gRNA 20 bp spacer sequences corresponding to the PAM were identified, as shown in FIG. 45.

Example 46—CRISPR/TdCas9 Target Sites for the Gvs2 Gene

Exons 1-2 of the Gys2 gene were scanned for target sites. Each area was scanned for a protospacer adjacent motif (PAM) having the sequence NAAAAC. gRNA 20 bp spacer sequences corresponding to the PAM were identified, as shown in FIG. 46.

Example 47—CRISPR/NmCas9 Target Sites for the Gvs2 Gene

Exons 1-2 of the Gys2 gene were scanned for target sites. Each area was scanned for a protospacer adjacent motif (PAM) having the sequence NNNNGHTT. gRNA 20 bp spacer sequences corresponding to the PAM were identified, as shown in FIG. 47.

Example 48—CRISPR/Cpf1 Target Sites for the Gvs2 Gene

Exons 1-2 of the Gys2 gene were scanned for target sites. Each area was scanned for a protospacer adjacent motif (PAM) having the sequence YTN. gRNA 22 bp spacer sequences corresponding to the PAM were identified, as shown in FIG. 48.

Example 49—CRISPR/SpCas9 Target Sites for the HGD Gene

Exons 1-2 of the HGD gene were scanned for target sites. Each area was scanned for a protospacer adjacent motif (PAM) having the sequence NRG. gRNA 20 bp spacer sequences corresponding to the PAM were identified, as shown in FIG. 49.

Example 50—CRISPR/SaCas9 Target Sites for the HGD Gene

Exons 1-2 of the HGD gene were scanned for target sites. Each area was scanned for a protospacer adjacent motif (PAM) having the sequence NNGRRT. gRNA 20 bp spacer sequences corresponding to the PAM were identified, as shown in FIG. 50.

Example 51—CRISPR/StCas9 Target Sites for the HGD Gene

Exons 1-2 of the HGD gene were scanned for target sites. Each area was scanned for a protospacer adjacent motif (PAM) having the sequence NNAGAAW. gRNA 20 bp spacer sequences corresponding to the PAM were identified, as shown in FIG. 51.

Example 52—CRISPR/TdCas9 Target Sites for the HGD Gene

Exons 1-2 of the HGD gene were scanned for target sites. Each area was scanned for a protospacer adjacent motif (PAM) having the sequence NAAAAC. gRNA 20 bp spacer sequences corresponding to the PAM were identified, as shown in FIG. 52.

Example 53—CRISPR/NmCas9 Target Sites for the HGD Gene

Exons 1-2 of the HGD gene were scanned for target sites. Each area was scanned for a protospacer adjacent motif (PAM) having the sequence NNNNGHTT. gRNA 20 bp spacer sequences corresponding to the PAM were identified, as shown in FIG. 53.

Example 54—CRISPR/Cpf1 Target Sites for the HGD Gene

Exons 1-2 of the HGD gene were scanned for target sites. Each area was scanned for a protospacer adjacent motif (PAM) having the sequence YTN. gRNA 22 bp spacer sequences corresponding to the PAM were identified, as shown in FIG. 54.

Example 55—CRISPR/SpCas9 Target Sites for the Lp(a) Gene

Exons 1-2 of the Lp(a) gene were scanned for target sites. Each area was scanned for a protospacer adjacent motif (PAM) having the sequence NRG. gRNA 20 bp spacer sequences corresponding to the PAM were identified, as shown in FIG. 55.

Example 56—CRISPR/SaCas9 Target Sites for the Lp(a) Gene

Exons 1-2 of the Lp(a) gene were scanned for target sites. Each area was scanned for a protospacer adjacent motif (PAM) having the sequence NNGRRT. gRNA 20 bp spacer sequences corresponding to the PAM were identified, as shown in FIG. 56.

Example 57—CRISPR/StCas9 Target Sites for the Lp(a) Gene

Exons 1-2 of the Lp(a) gene were scanned for target sites. Each area was scanned for a protospacer adjacent motif (PAM) having the sequence NNAGAAW. gRNA 20 bp spacer sequences corresponding to the PAM were identified, as shown in FIG. 57.

Example 58—CRISPR/TdCas9 Target Sites for the Lp(a) Gene

Exons 1-2 of the Lp(a) gene were scanned for target sites. Each area was scanned for a protospacer adjacent motif (PAM) having the sequence NAAAAC. gRNA 20 bp spacer sequences corresponding to the PAM were identified, as shown in FIG. 58.

Example 59—CRISPR/NmCas9 Target Sites for the Lp(a) Gene

Exons 1-2 of the Lp(a) gene were scanned for target sites. Each area was scanned for a protospacer adjacent motif (PAM) having the sequence NNNNGHTT. gRNA 20 bp spacer sequences corresponding to the PAM were identified, as shown in FIG. 59.

Example 60—CRISPR/Cpf1 Target Sites for the Lp(a) Gene

Exons 1-2 of the Lp(a) gene were scanned for target sites. Each area was scanned for a protospacer adjacent motif (PAM) having the sequence YTN. gRNA 22 bp spacer sequences corresponding to the PAM were identified, as shown in FIG. 60.

Example 61—CRISPR/SpCas9 Target Sites for the PCSK9 Gene

Exons 1-2 of the PCSK9 gene were scanned for target sites. Each area was scanned for a protospacer adjacent motif (PAM) having the sequence NRG. gRNA 20 bp spacer sequences corresponding to the PAM were identified, as shown in FIG. 61.

Example 62—CRISPR/SaCas9 Target Sites for the PCSK9 Gene

Exons 1-2 of the PCSK9 gene were scanned for target sites. Each area was scanned for a protospacer adjacent motif (PAM) having the sequence NNGRRT. gRNA 20 bp spacer sequences corresponding to the PAM were identified, as shown in FIG. 62.

Example 63—CRISPR/StCas9 Target Sites for the PCSK9 Gene

Exons 1-2 of the PCSK9 gene were scanned for target sites. Each area was scanned for a protospacer adjacent motif (PAM) having the sequence NNAGAAW. gRNA 20 bp spacer sequences corresponding to the PAM were identified, as shown in FIG. 63.

Example 64—CRISPR/TdCas9 Target Sites for the PCSK9 Gene

Exons 1-2 of the PCSK9 gene were scanned for target sites. Each area was scanned for a protospacer adjacent motif (PAM) having the sequence NAAAAC. gRNA 20 bp spacer sequences corresponding to the PAM were identified, as shown in FIG. 64.

Example 65—CRISPR/NmCas9 Target Sites for the PCSK9 Gene

Exons 1-2 of the PCSK9 gene were scanned for target sites. Each area was scanned for a protospacer adjacent motif (PAM) having the sequence NNNNGHTT. gRNA 20 bp spacer sequences corresponding to the PAM were identified, as shown in FIG. 65.

Example 66—CRISPR/Cpf1 Target Sites for the PCSK9 Gene

Exons 1-2 of the PCSK9 gene were scanned for target sites. Each area was scanned for a protospacer adjacent motif (PAM) having the sequence YTN. gRNA 22 bp spacer sequences corresponding to the PAM were identified, as shown in FIG. 66.

Example 67—CRISPR/SpCas9 Target Sites for the Serpina1 Gene

Exons 1-2 of the Serpina1 gene were scanned for target sites. Each area was scanned for a protospacer adjacent motif (PAM) having the sequence NRG. gRNA 20 bp spacer sequences corresponding to the PAM were identified, as shown in FIG. 67.

Example 68—CRISPR/SaCas9 Target Sites for the Serpina1 Gene

Exons 1-2 of the Serpina1 gene were scanned for target sites. Each area was scanned for a protospacer adjacent motif (PAM) having the sequence NNGRRT. gRNA 20 bp spacer sequences corresponding to the PAM were identified, as shown in FIG. 68.

Example 69—CRISPR/StCas9 Target Sites for the Serpina1 Gene

Exons 1-2 of the Serpina1 gene were scanned for target sites. Each area was scanned for a protospacer adjacent motif (PAM) having the sequence NNAGAAW. gRNA 20 bp spacer sequences corresponding to the PAM were identified, as shown in FIG. 69.

Example 70—CRISPR/TdCas9 Target Sites for the Serpina1 Gene

Exons 1-2 of the Serpina1 gene were scanned for target sites. Each area was scanned for a protospacer adjacent motif (PAM) having the sequence NAAAAC. gRNA 20 bp spacer sequences corresponding to the PAM were identified, as shown in FIG. 70.

Example 71—CRISPR/NmCas9 Target Sites for the Serpina1 Gene

Exons 1-2 of the Serpina1 gene were scanned for target sites. Each area was scanned for a protospacer adjacent motif (PAM) having the sequence NNNNGHTT. gRNA 20 bp spacer sequences corresponding to the PAM were identified, as shown in FIG. 71.

Example 72—CRISPR/Cpf1 Target Sites for the Serpina1 Gene

Exons 1-2 of the Serpina1 gene were scanned for target sites. Each area was scanned for a protospacer adjacent motif (PAM) having the sequence YTN. gRNA 22 bp spacer sequences corresponding to the PAM were identified, as shown in FIG. 72.

Example 73—CRISPR/SpCas9 Target Sites for the TF Gene

Exons 1-2 of the TF gene were scanned for target sites. Each area was scanned for a protospacer adjacent motif (PAM) having the sequence NRG. gRNA 20 bp spacer sequences corresponding to the PAM were identified, as shown in FIG. 73.

Example 74—CRISPR/SaCas9 Target Sites for the TF Gene

Exons 1-2 of the TF gene were scanned for target sites. Each area was scanned for a protospacer adjacent motif (PAM) having the sequence NNGRRT. gRNA 20 bp spacer sequences corresponding to the PAM were identified, as shown in FIG. 74.

Example 75—CRISPR/StCas9 Target Sites for the TF Gene

Exons 1-2 of the TF gene were scanned for target sites. Each area was scanned for a protospacer adjacent motif (PAM) having the sequence NNAGAAW. gRNA 20 bp spacer sequences corresponding to the PAM were identified, as shown in FIG. 75.

Example 76—CRISPR/TdCas9 Target Sites for the TF Gene

Exons 1-2 of the TF gene were scanned for target sites. Each area was scanned for a protospacer adjacent motif (PAM) having the sequence NAAAAC. gRNA 20 bp spacer sequences corresponding to the PAM were identified, as shown in FIG. 76.

Example 77—CRISPR/NmCas9 Target Sites for the TF Gene

Exons 1-2 of the TF gene were scanned for target sites. Each area was scanned for a protospacer adjacent motif (PAM) having the sequence NNNNGHTT. gRNA 20 bp spacer sequences corresponding to the PAM were identified, as shown in FIG. 77.

Example 78—CRISPR/Cpf1 Target Sites for the TF Gene

Exons 1-2 of the TF gene were scanned for target sites. Each area was scanned for a protospacer adjacent motif (PAM) having the sequence YTN. gRNA 22 bp spacer sequences corresponding to the PAM were identified, as shown in FIG. 78.

Example 79—CRISPR/SpCas9 Target Sites for the TTR Gene

Exons 1-2 of the TTR gene were scanned for target sites. Each area was scanned for a protospacer adjacent motif (PAM) having the sequence NRG. gRNA 20 bp spacer sequences corresponding to the PAM were identified, as shown in FIG. 79.

Example 80—CRISPR/SaCas9 Target Sites for the TTR Gene

Exons 1-2 of the TTR gene were scanned for target sites. Each area was scanned for a protospacer adjacent motif (PAM) having the sequence NNGRRT. gRNA 20 bp spacer sequences corresponding to the PAM were identified, as shown in FIG. 80.

Example 81—CRISPR/StCas9 Target Sites for the TTR Gene

Exons 1-2 of the TTR gene were scanned for target sites. Each area was scanned for a protospacer adjacent motif (PAM) having the sequence NNAGAAW. gRNA 20 bp spacer sequences corresponding to the PAM were identified, as shown in FIG. 81.

Example 82—CRISPR/TdCas9 Target Sites for the TTR Gene

Exons 1-2 of the TTR gene were scanned for target sites. Each area was scanned for a protospacer adjacent motif (PAM) having the sequence NAAAAC. gRNA 20 bp spacer sequences corresponding to the PAM were identified, as shown in FIG. 82.

Example 83—CRISPR/NmCas9 Target Sites for the TTR Gene

Exons 1-2 of the TTR gene were scanned for target sites. Each area was scanned for a protospacer adjacent motif (PAM) having the sequence NNNNGHTT. gRNA 20 bp spacer sequences corresponding to the PAM were identified, as shown in FIG. 83.

Example 84—CRISPR/Cpf1 Target Sites for the TTR Gene

Exons 1-2 of the TTR gene were scanned for target sites. Each area was scanned for a protospacer adjacent motif (PAM) having the sequence YTN. gRNA 22 bp spacer sequences corresponding to the PAM were identified, as shown in FIG. 84.

Example 85—CRISPR/SpCas9 Target sites for the G6PC Gene

Regions of the G6PC gene were scanned for target sites. Each area was scanned for a protospacer adjacent motif (PAM) having the sequence NRG. gRNA 20 bp spacer sequences corresponding to the PAM were identified, as shown in FIG. 85.

Example 86—CRISPR/SaCas9 Target Sites for the G6PC Gene

Regions of the G6PC gene were scanned for target sites. Each area was scanned for a protospacer adjacent motif (PAM) having the sequence NNGRRT. gRNA 20 bp spacer sequences corresponding to the PAM were identified, as shown in FIG. 86.

Example 87—CRISPR/StCas9 Target Sites for the G6PC Gene

Regions of the G6PC gene were scanned for target sites. Each area was scanned for a protospacer adjacent motif (PAM) having the sequence NNAGAAW. gRNA 20 bp spacer sequences corresponding to the PAM were identified, as shown in FIG. 87.

Example 88—CRISPR/TdCas9 Target Sites for the G6PC Gene

Regions of the G6PC gene were scanned for target sites. Each area was scanned for a protospacer adjacent motif (PAM) having the sequence NAAAAC. gRNA 20 bp spacer sequences corresponding to the PAM were identified, as shown in FIG. 88.

Example 89—CRISPR/NmCas9 Target Sites for the G6PC Gene

Regions of the G6PC gene were scanned for target sites. Each area was scanned for a protospacer adjacent motif (PAM) having the sequence NNNNGHTT. gRNA 20 bp spacer sequences corresponding to the PAM were identified, as shown in FIG. 89.

Example 90—CRISPR/Cpf1 Target Sites for the G6PC Gene

Regions of the G6PC gene were scanned for target sites. Each area was scanned for a protospacer adjacent motif (PAM) having the sequence YTN. gRNA 22 bp spacer sequences corresponding to the PAM were identified, as shown in FIG. 90.

Example 91—Bioinformatics Analysis of the Guide Strands

Candidate guides will be screened and selected in a multi-step process that involves both theoretical binding and experimentally assessed activity. By way of illustration, candidate guides having sequences that match a particular on-target site, such as a site within the G6PC gene, with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR/Cas9/Cpf1 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.bme.gatech.edu) compiles such similarities. Other bioinformatics tools include, but are not limited to, GUIDO, autoCOSMID, and CCtop.

Bioinformatics were used to minimize off-target cleavage in order to reduce the detrimental effects of mutations and chromosomal rearrangements. Studies on CRISPR/Cas9 systems suggested the possibility of high off-target activity due to nonspecific hybridization of the guide strand to DNA sequences with base pair mismatches and/or bulges, particularly at positions distal from the PAM region. Therefore, it is important to have a bioinformatics tool that can identify potential off-target sites that have insertions and/or deletions between the RNA guide strand and genomic sequences, in addition to base-pair mismatches. The bioinformatics-based tool, COSMID (CRISPR Off-target Sites with Mismatches, Insertions and Deletions) was therefore used to search genomes for potential CRISPR off-target sites (available on the web at crispr.bme.gatech.edu). COSMID output ranked lists of the potential off-target sites based on the number and location of mismatches, allowing more informed choice of target sites, and avoiding the use of sites with more likely off-target cleavage.

Additional bioinformatics pipelines were employed that weigh the estimated on- and/or off-target activity of gRNA targeting sites in a region. Other features that may be used to predict activity include information about the cell type in question, DNA accessibility, chromatin state, transcription factor binding sites, transcription factor binding data, and other CHIP-seq data. Additional factors are weighed that predict editing efficiency, such as relative positions and directions of pairs of gRNAs, local sequence features and micro-homologies.

Example 92—Testing of Preferred Guides in Cells for On-Target Activity

The gRNAs predicted to have the lowest off target activity will then be tested for on-target activity in a model cell line, such as Huh-7 cells and evaluated for indel frequency using TIDE or next generation sequencing. TIDE is a web tool to rapidly assess genome editing by CRISPR-Cas9 of a target locus determined by a guide RNA (gRNA or sgRNA). Based on the quantitative sequence trace data from two standard capillary sequencing reactions, the TIDE software quantifies the editing efficacy and identifies the predominant types of insertions and deletions (indels) in the DNA of a targeted cell pool. See Brinkman et al, Nucl. Acids Res. (2014) for a detailed explanation and examples. Next-generation sequencing (NGS), also known as high-throughput sequencing, is the catch-all term used to describe a number of different modern sequencing technologies including: Illumina (Solexa) sequencing, Roche 454 sequencing, Ion torrent: Proton/PGM sequencing, and SOLiD sequencing. These recent technologies allow one to sequence DNA and RNA much more quickly and cheaply than the previously used Sanger sequencing, and as such have revolutionized the study of genomics and molecular biology.

Transfection of tissue culture cells, allows screening of different constructs and a robust means of testing activity and specificity. Tissue culture cell lines, such as Huh-7 cells, are easily transfected and result in high activity. These or other cell lines will be evaluated to determine the cell lines that provide the best surrogate. These cells will then be used for many early stage tests. For example, individual gRNAs for *S. pyogenes* Cas9 will be transfected into the cells using plasmids, such as, for example, CTx-1, CTx-2, or CTx-3 described in FIG. 92A-92C, which are suitable for expression in human cells. Several days later, the genomic DNA is harvested and the target site amplified by PCR. The cutting activity can be measured by the rate of insertions, deletions and mutations introduced by NHEJ repair of the free DNA ends. Although this method cannot differentiate correctly repaired sequences from uncleaved DNA, the level of cutting can be gauged by the amount of mis-repair. Off-target activity can be observed by amplifying identified putative off-target sites and using similar methods to detect cleavage. Translocation can also be assayed using primers flanking cut sites, to determine if specific cutting and translocations happen. Un-guided assays have been developed allowing complementary testing of off-target cleavage including guide-seq. The gRNA or pairs of gRNA with significant activity can then be followed up in cultured cells to measure correction of G6PC mutation. Off-target events can be followed again. These experiments allow optimization of nuclease and donor design and delivery.

Example 93—Testing of Preferred Guides in Cells for Off-Target Activity

The gRNAs having the best on-target activity from the TIDE and next generation sequencing studies in the above example will then be tested for off-target activity using whole genome sequencing.

Example 94—Testing Different Approaches for HDR Gene Editing

After testing the gRNAs for both on-target activity and off-target activity, the mutation correction and knock-in strategies will be tested for HDR gene editing.

For the mutation correction approach, the donor DNA template will be provided as a short single-stranded oligonucleotide, a short double-stranded oligonucleotide (PAM sequence intact/PAM sequence mutated), a long single-stranded DNA molecule (PAM sequence intact/PAM sequence mutated) or a long double-stranded DNA molecule (PAM sequence intact/PAM sequence mutated). In addition, the donor DNA template will be delivered by AAV.

For the cDNA knock-in approach, a single-stranded or double-stranded DNA having homologous arms to the 17q21 region may include more than 40 nt of the first exon (the first coding exon) of the G6PC gene, the complete CDS of the G6PC gene and 3'UTR of the G6PC gene, and at least 40 nt of the following intron. The single-stranded or double-stranded DNA having homologous arms to the 17q21 region, which includes more than 80 nt of the first exon of the G6PC gene, the complete CDS of the G6PC gene and 3'UTR of the G6PC gene, and at least 80 nt of the following intron. The single-stranded or double-stranded DNA having homologous arms to the 17q21 region may include more than 100 nt of the first exon of the G6PC gene, the complete CDS of the G6PC gene and 3'UTR of the G6PC gene, and at least 100 nt of the following intron. The single-stranded or double-stranded DNA having homologous arms to the 17q21 region may include more than 150 nt of the first exon of the G6PC gene, the complete CDS of the G6PC gene and 3'UTR of the G6PC gene, and at least 150 nt of the following intron. The single-stranded or double-stranded DNA having homologous arms to the 17q21 region may include more than 300 nt of the first exon of the G6PC gene, the complete CDS of the G6PC gene and 3'UTR of the G6PC gene, and at least 300 nt of the following intron. The single-stranded or double-stranded DNA having homologous arms to the 17q21 region may include more than 400 nt of the first exon of the G6PC gene, the complete CDS of the G6PC gene and 3'UTR of the G6PC gene, and at least 400 nt of the following the first intron. Alternatively, the DNA template will be delivered by AAV.

Next, the efficiency of HDR mediated correction of the common mutation of G6PC R83 and knock-in of cDNA into the $1^{st}$ exon will be assessed.

Example 95—Re-Assessment of Lead CRISPR-Cas9/DNA Donor Combinations

After testing the different strategies for HDR gene editing, the lead CRISPR-Cas9/DNA donor combinations will be re-assessed in primary human hepatocytes for efficiency of deletion, recombination, and off-target specificity. Cas9 mRNA or RNP will be formulated into lipid nanoparticles for delivery, sgRNAs will be formulated into nanoparticles or delivered as AAV, and donor DNA will be formulated into nanoparticles or delivered as AAV.

Example 96—In Vivo Testing in Relevant Mouse Model

After the CRISPR-Cas9/DNA donor combinations have been re-assessed, the lead formulations will be tested in vivo in an animal model. Suitable animal models include, by way of non-limiting example a FGR mouse model with the livers repopulated with human hepatocytes or iPSC derived hepatocytes (normal or G6PC deficient).

Culture in human cells allows direct testing on the human target and the background human genome, as described above.

Preclinical efficacy and safety evaluations can be observed through engraftment of modified mouse or human hepatocytes in FGR mice. The modified cells can be observed in the months after engraftment.

Example 97—Screening of gRNAs

Figure 94A:
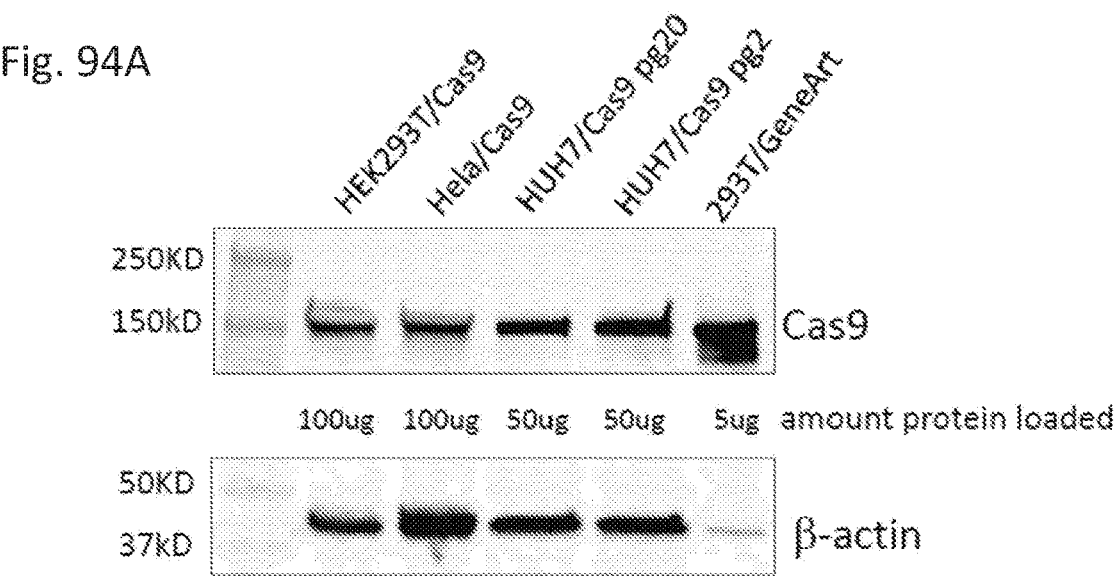
FIG. 94A is an illustration depicting detection of Cas9 mRNA in different cells with constitutive expression (HEK293T, Hela, Huh7) or transient expression (HEK293T) of Cas9. pg2, pg20-2nd and 20th passages are presented for Huh7 cells.
Figure 94B:
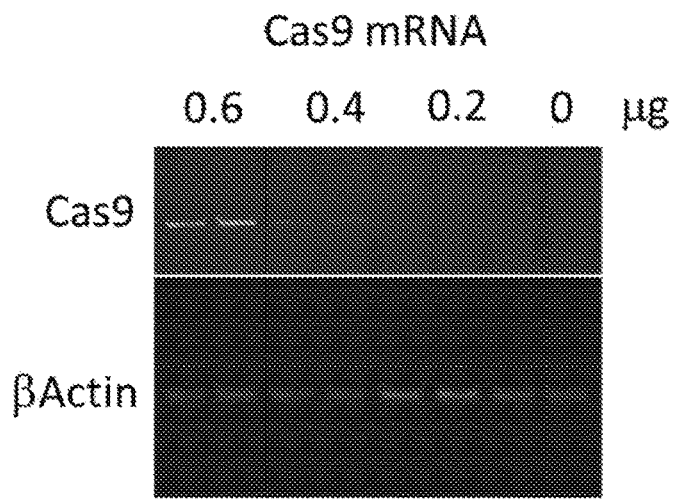
FIG. 94B is an illustration depicting Cas9 expression in HepG2 transfected with mRNA.
Figure 94C:
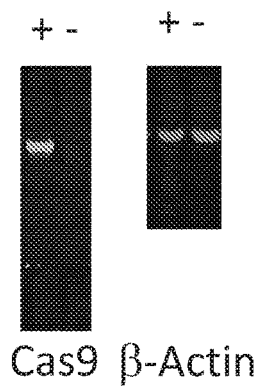
FIG. 94C is an illustration depicting Cas9 expression in human primary hepatocytes transfected with Cas9 mRNA.

The G6PC region (chr17:42,897,797-42,917,433) was used to design 20-nt recognition sites using the CCTOP protocol (Stemmer, M., Thumberger, T., del Sol Keyer, M., Wittbrodt, J. and Mateo, J. L. *CCTop: an intuitive, flexible and reliable CRISPR/Cas9 target prediction tool*. PLOS ONE (2015). doi:10.1371/journal.pone.0124633) to design gRNA targeting various regions of the gene. The gRNAs with lowest off-target scores targeting Exon 1, Exon 2 and 5' end of Exon 5 were purchased from Integrated DNA Technologies in the format of Alt-® CRISPR crRNA. crRNAs were annealed with tracerRNA in the equimolar ratio (incubation at 70° C., 2 min, and 20° C. for 20 min, and keep at 4° C.). The activity of the gRNAs was tested in HuH7 cells constitutively expressing the Cas9 (transduced by lentivirus), FIGS. 94A-94C. 10K cells per well (96-well plate) were plated, and transfected in 16-18 h after plating, briefly, gRNAs were incubated with lipofectamine RNAiMAX according to the manufacturer's protocol, final concentration 25 nM. Cells were incubated with gRNA-lipofectamine complexes for 16-96 h in the complete media comprising DMEM, supplemented by 10% FBS. Cells were lysed in prepGEM (ZyGem) according to the manufacture protocol.

Efficiency of the gRNA was analyzed by Tracking of Indels by Decomposition (TIDE) analysis (Brinkman E K, Chen T, Amendola M, van Steensel B. Easy quantitative assessment of genome editing by sequence trace decomposition. Nucleic Acids Res. 2014 Dec. 16; 42(22):e168. doi: 10.1093/nar/gku936), briefly, genomic DNA was used as a template for PCR using KAPA HiFi PCR Kit using the following primers (Table 3).

TABLE 3 gRNA sequences and activity in Huh7-Cas9

| Exon # | guide ID | gRNA sequence (SEQ ID NO) | Forward TIDE primer | Reverse TIDE primer | Sequencing Primer | Eff. | SD |
|---|---|---|---|---|---|---|---|
| 1 | CH01 | TGTCCGTGAT CGCAGACCTC (52,943) | ATTGGCCCTG CTGAGTACAT (64,792) | ATAGCCTGGG GAAAGCAACT (64,795) | ATAGCCTGGG GAAAGCAACT (64,795) | 6.1 | 2.5 |
| 1 | CH02 | AGAGCCCTTG CAGTTATTCC (57,319) | ATTGGCCCTG CTGAGTACAT (64,792) | ATAGCCTGGG GAAAGCAACT (64,795) | ATAGCCTGGG GAAAGCAACT (64,795) | 32.9 | 2.7 |
| 1 | CH03 | CCTGGAGGTA ATGTGTTGAC (57,306) | ATTGGCCCTG CTGAGTACAT (64,792) | ATAGCCTGGG GAAAGCAACT (64,795) | ATAGCCTGGG GAAAGCAACT (64,795) | 44.8 | 0.0 |
| 1 | CH04 | CCAGTCAACA CATTACCTCC (52,935) | ATTGGCCCTG CTGAGTACAT (64,792) | ATAGCCTGGG GAAAGCAACT (64,795) | ATAGCCTGGG GAAAGCAACT (64,795) | 68.2 | 2.2 |
| 1 | CH05 | AGTCTTGGTA ATTCACCTGG (57,305) | ATTGGCCCTG CTGAGTACAT (64,792) | ATAGCCTGGG GAAAGCAACT (64,795) | ATAGCCTGGG GAAAGCAACT (64,795) | 52.2 | 4.4 |
| 1 | CH06 | GGGAGTCTTG GTAATTCACC (57,303) | ATTGGCCCTG CTGAGTACAT (64,792) | ATAGCCTGGG GAAAGCAACT (64,795) | ATAGCCTGGG GAAAGCAACT (64,795) | 6.2 | 0.6 |
| 1 | CH07 | GGTGAATTAC CAAGACTCCC (52,938) | ATTGGCCCTG CTGAGTACAT (64,792) | ATAGCCTGGG GAAAGCAACT (64,795) | ATAGCCTGGG GAAAGCAACT (64,795) | 45.0 | 7.2 |
| 1 | CH08 | CTCCCAGGAC TGGTTCATCT (52,940) | ATTGGCCCTG CTGAGTACAT (64,792) | ATAGCCTGGG GAAAGCAACT (64,795) | ATAGCCTGGG GAAAGCAACT (64,795) | 55.5 | 1.1 |
| 1 | CH09 | CACCAAGATG AACCAGTCCT (57,300) | ATTGGCCCTG CTGAGTACAT (64,792) | ATAGCCTGGG GAAAGCAACT (64,795) | ATAGCCTGGG GAAAGCAACT (64,795) | 10.7 | 1.6 |
| 1 | CH10 | ATTCCTGAGG TCTGCGATCA (57,296) | ATTGGCCCTG CTGAGTACAT (64,792) | ATAGCCTGGG GAAAGCAACT (64,795) | ATAGCCTGGG GAAAGCAACT (64,795) | 34.9 | 2.3 |
| 1 | CH11 | TGTGGGCATT AAACTCCTTT (52,951) | ATTGGCCCTG CTGAGTACAT (64,792) | ATAGCCTGGG GAAAGCAACT (64,795) | ATAGCCTGGG GAAAGCAACT (64,795) | 66.3 | 0.0 |
| 1 | CH12 | GGGCATATAA AACAGGGGCA (52,910) | ATTGGCCCTG CTGAGTACAT (64,792) | ATAGCCTGGG GAAAGCAACT (64,795) | ATAGCCTGGG GAAAGCAACT (64,795) | 20.9 | 1.5 |
| 1 | CH13 | TGCAGTTATT CCAGGCTTGG (57,321) | ATTGGCCCTG CTGAGTACAT (64,792) | ATAGCCTGGG GAAAGCAACT (64,795) | ATAGCCTGGG GAAAGCAACT (64,795) | 29.7 | 11.8 |
| 1 | CH14 | CCAAGCCTGG AATAACTGCA (52,918) | ATTGGCCCTG CTGAGTACAT (64,792) | ATAGCCTGGG GAAAGCAACT (64,795) | ATAGCCTGGG GAAAGCAACT (64,795) | 68.7 | 0.0 |
| 1 | CH15 | CCTTGCAGTT ATTCCAGGCT (57,320) | ATTGGCCCTG CTGAGTACAT (64,792) | ATAGCCTGGG GAAAGCAACT (64,795) | ATAGCCTGGG GAAAGCAACT (64,795) | 34.0 | 0.0 |
| 1 | CH16 | CAAGCCTGGA ATAACTGCAA (52,919) | ATTGGCCCTG CTGAGTACAT (64,792) | ATAGCCTGGG GAAAGCAACT (64,795) | ATAGCCTGGG GAAAGCAACT (64,795) | 60.2 | 1.5 |
| 1 | CH17 | GACATCTTCC TGAGGTGCCA (52,923) | ATTGGCCCTG CTGAGTACAT (64,792) | ATAGCCTGGG GAAAGCAACT (64,795) | ATAGCCTGGG GAAAGCAACT (64,795) | 35.5 | 2.7 |
| 1 | CH18 | CCTCATTTCC TTGGCACCTC (57,312) | ATTGGCCCTG CTGAGTACAT (64,792) | ATAGCCTGGG GAAAGCAACT (64,795) | ATAGCCTGGG GAAAGCAACT (64,795) | 24.8 | 1.0 |
| 1 | CH19 | TTGACTGGAT CCCAAAGTCA (57,308) | ATTGGCCCTG CTGAGTACAT (64,792) | ATAGCCTGGG GAAAGCAACT (64,795) | ATAGCCTGGG GAAAGCAACT (64,795) | 43.7 | 0.0 |

TABLE 3-continued gRNA sequences and activity in Huh7-Cas9

| Exon # | guide ID | gRNA sequence (SEQ ID NO) | Forward TIDE primer | Reverse TIDE primer | Sequencing Primer | Eff. | SD |
|---|---|---|---|---|---|---|---|
| 1 | CH20 | ATTACCAAGA CTCCCAGGAC (52,939) | ATTGGCCCTG CTGAGTACAT (64,792) | ATAGCCTGGG GAAAGCAACT (64,795) | ATAGCCTGGG GAAAGCAACT (64,795) | 28.7 | 4.0 |
| 1 | CH21 | TGAACCAGTC CTGGGAGTCT (57,302) | ATTGGCCCTG CTGAGTACAT (64,792) | ATAGCCTGGG GAAAGCAACT (64,795) | ATAGCCTGGG GAAAGCAACT (64,795) | 9.2 | 2.7 |
| 1 | CH22 | ACACCAAGAT GAACCAGTCC (57,299) | ATTGGCCCTG CTGAGTACAT (64,792) | ATAGCCTGGG GAAAGCAACT (64,795) | ATAGCCTGGG GAAAGCAACT (64,795) | 20.0 | 5.5 |
| 1 | CH23 | GGACGTAGAA GGCATTCCTG (57,295) | ATTGGCCCTG CTGAGTACAT (64,792) | ATAGCCTGGG GAAAGCAACT (64,795) | ATAGCCTGGG GAAAGCAACT (64,795) | 55.9 | 0.4 |
| 1 | CH24 | TCTACGTCCT CTTCCCCATC (52,944) | ATTGGCCCTG CTGAGTACAT (64,792) | ATAGCCTGGG GAAAGCAACT (64,795) | ATAGCCTGGG GAAAGCAACT (64,795) | 16.6 | 5.6 |
| 1 | CH25 | GGCTCAACCT CGTCTTTAAG (52,957) | ATTGGCCCTG CTGAGTACAT (64,792) | ATAGCCTGGG GAAAGCAACT (64,795) | ATAGCCTGGG GAAAGCAACT (64,795) | 13.9 | 6.5 |
| 1 | CH26 | GTTCTTACCA CTTAAAGACG (57,274) | ATTGGCCCTG CTGAGTACAT (64,792) | ATAGCCTGGG GAAAGCAACT (64,795) | ATAGCCTGGG GAAAGCAACT (64,795) | 19.3 | 2.1 |
| 1 | CH27 | GTGGTAAGAA CCATATAGAG (52,962) | ATTGGCCCTG CTGAGTACAT (64,792) | ATAGCCTGGG GAAAGCAACT (64,795) | ATAGCCTGGG GAAAGCAACT (64,795) | 57.4 | 3.6 |
| 2 | CH28 | TCAGGCTACA CTCTTCTTGA (53,360) | cccaggaggtag aggtcacaatga (64,793) | agagagggcaa gggattggacg (64,835) | agagagggcaa gggattggacg (64,835) | 34.3 | 9.2 |
| 2 | CH29 | TACACTCTTC TTGAAGGTGT (53,362) | cccaggaggtag aggtcacaatga (64,793) | agagagggcaa gggattggacg (64,835) | agagagggcaa gggattggacg (64,835) | 35.7 | 20.9 |
| 2 | CH30 | TTCTTGAAGG TGTAGGCTTT (53,364) | cccaggaggtag aggtcacaatga (64,793) | agagagggcaa gggattggacg (64,835) | agagagggcaa gggattggacg (64,835) | 11.3 | 1.5 |
| 2 | CH31 | GCTGTCCAAA GAGAATCCTA (56,893) | cccaggaggtag aggtcacaatga (64,793) | agagagggcaa gggattggacg (64,835) | agagagggcaa gggattggacg (64,835) | 56.2 | 14.4 |
| 2 | CH32 | TCTTTGGACA GCGTCCATAC (53,372) | cccaggaggtag aggtcacaatga (64,793) | agagagggcaa gggattggacg (64,835) | agagagggcaa gggattggacg (64,835) | 46.0 | 36.6 |
| 2 | CH33 | TTGGACAGCG TCCATACTGG (53,373) | cccaggaggtag aggtcacaatga (64,793) | agagagggcaa gggattggacg (64,835) | agagagggcaa gggattggacg (64,835) | 29.7 | 26.5 |
| 2 | CH34 | TGGACAGCGT CCATACTGGT (53,374) | cccaggaggtag aggtcacaatga (64,793) | agagagggcaa gggattggacg (64,835) | agagagggcaa gggattggacg (64,835) | 63.6 | 14.0 |
| 2 | CH35 | GCGTCCATAC TGGTGGGTTT (53,375) | cccaggaggtag aggtcacaatga (64,793) | agagagggcaa gggattggacg (64,835) | agagagggcaa gggattggacg (64,835) | 16.5 | 14.5 |
| 2 | CH36 | GTATCCAAAA CCCACCAGTA (56,890) | cccaggaggtag aggtcacaatga (64,793) | agagagggcaa gggattggacg (64,835) | agagagggcaa gggattggacg (64,835) | 63.6 | 11.3 |
| 2 | CH37 | GAACTGCTTT ATCAGGGGCA (56,884) | cccaggaggtag aggtcacaatga (64,793) | agagagggcaa gggattggacg (64,835) | agagagggcaa gggattggacg (64,835) | 9.7 | 5.6 |

TABLE 3-continued gRNA sequences and activity in Huh7-Cas9

| Exon # | guide ID | gRNA sequence (SEQ ID NO) | Forward TIDE primer | Reverse TIDE primer | Sequencing Primer | Eff. | SD |
|---|---|---|---|---|---|---|---|
| 2 | CH38 | ACAGGGAACT GCTTTATCAG (56,883) | cccaggaggtag aggtcacaatga (64,793) | agagagggcaa gggattggacg (64,835) | agagagggcaa gggattggacg (64,835) | 75.5 | 7.3 |
| 2 | CH39 | TACAGGGAAC TGCTTTATCA (56,882) | cccaggaggtag aggtcacaatga (64,793) | agagagggcaa gggattggacg (64,835) | agagagggcaa gggattggacg (64,835) | 23.0 | 11.2 |
| 2 | CH40 | TTACAGGGAA CTGCTTTATC (56,881) | cccaggaggtag aggtcacaatga (64,793) | agagagggcaa gggattggacg (64,835) | agagagggcaa gggattggacg (64,835) | 36.3 | 16.8 |
| 2 | CH41 | TTCCCTGTAA CCTGTGAGAC (53,380) | cccaggaggtag aggtcacaatga (64,793) | agagagggcaa gggattggacg (64,835) | agagagggcaa gggattggacg (64,835) | 42.9 | 26.4 |
| 2 | CH42 | GTCCAGTCTC ACAGGTTACA (56,879) | cccaggaggtag aggtcacaatga (64,793) | agagagggcaa gggattggacg (64,835) | agagagggcaa gggattggacg (64,835) | 73.9 | 16.1 |
| 2 | CH43 | GGTCCAGTCT CACAGGTTAC (56,878) | cccaggaggtag aggtcacaatga (64,793) | agagagggcaa gggattggacg (64,835) | agagagggcaa gggattggacg (64,835) | 54.3 | 19.1 |
| 2 | CH44 | GTAACCTGTG AGACTGGACC (53,382) | cccaggaggtag aggtcacaatga (64,793) | agagagggcaa gggattggacg (64,835) | agagagggcaa gggattggacg (64,835) | 49.3 | 5.7 |
| 2 | CH45 | CTTACCTGGT CCAGTCTCAC (56,876) | cccaggaggtag aggtcacaatga (64,793) | agagagggcaa gggattggacg (64,835) | agagagggcaa gggattggacg (64,835) | 60.9 | 14.3 |
| 2 | CH46 | CAGGGGCTGG GACGCTTACC (56,873) | cccaggaggtag aggtcacaatga (64,793) | agagagggcaa gggattggacg (64,835) | agagagggcaa gggattggacg (64,835) | 29.2 | 23.5 |
| 2 | CH47 | TGGACCTCGT TTACCTGTTA (59,984) | cccaggaggtag aggtcacaatga (64,793) | agagagggcaa gggattggacg (64,835) | agagagggcaa gggattggacg (64,835) | 38.9 | 26.3 |
| 2 | CH48 | TCATCCATAA CAGGTAAACG (56,865) | cccaggaggtag aggtcacaatga (64,793) | agagagggcaa gggattggacg (64,835) | agagagggcaa gggattggacg (64,835) | 44.1 | 12.3 |
| 2 | CH49 | AGGTCAGTTT CATCCATAAC (56,863) | cccaggaggtag aggtcacaatga (64,793) | agagagggcaa gggattggacg (64,835) | agagagggcaa gggattggacg (64,835) | 39.5 | 18.2 |
| 2 | CH50 | TATGGATGAA ACTGACCTTG (53,392) | cccaggaggtag aggtcacaatga (64,793) | agagagggcaa gggattggacg (64,835) | agagagggcaa gggattggacg (64,835) | 24.9 | 16.7 |
| 2 | CH51 | CCTGAATAGC ACAGTAGTAT (53,403) | cccaggaggtag aggtcacaatga (64,793) | agagagggcaa gggattggacg (64,835) | agagagggcaa gggattggacg (64,835) | 21.8 | 12.9 |
| 2 | CH79 | TTTCACATGT TGCCTCTAGA (56,909) | cccaggaggtag aggtcacaatga (64,793) | agagagggcaa gggattggacg (64,835) | agagagggcaa gggattggacg (64,835) | 60.1 | 4.1 |
| 2 | CH80 | CAACATGTGA AATCCTTCTC (53,358) | cccaggaggtag aggtcacaatga (64,793) | agagagggcaa gggattggacg (64,835) | agagagggcaa gggattggacg (64,835) | 65.1 | 4.1 |
| 2 | CH81 | AAGAAGAGTG TAGCCTGAGA (56,906) | cccaggaggtag aggtcacaatga (64,793) | agagagggcaa gggattggacg (64,835) | agagagggcaa gggattggacg (64,835) | 5.7 | 0.7 |
| 2 | CH82 | CTTCTTGAAG GTGTAGGCTT (53,363) | cccaggaggtag aggtcacaatga (64,793) | agagagggcaa gggattggacg (64,835) | agagagggcaa gggattggacg (64,835) | 16.5 | 3.1 |

TABLE 3-continued gRNA sequences and activity in Huh7-Cas9

| Exon # | guide ID | gRNA sequence (SEQ ID NO) | Forward TIDE primer | Reverse TIDE primer | Sequencing Primer | Eff. | SD |
|---|---|---|---|---|---|---|---|
| 2 | CH83 | AAAAACAGAACAAGTTTCTG (56,898) | cccaggaggtagaggtcacaatga (64,793) | agagagggcaagggattggacg (64,835) | agagagggcaagggattggacg (64,835) | 57.4 | 3.6 |
| 2 | CH84 | GAAAAACAGAACAAGTTTCT (56,897) | cccaggaggtagaggtcacaatga (64,793) | agagagggcaagggattggacg (64,835) | agagagggcaagggattggacg (64,835) | 7.2 | 1.0 |
| 2 | CH85 | AACTTGTTCTGTTTTTCCAT (53,369) | cccaggaggtagaggtcacaatga (64,793) | agagagggcaagggattggacg (64,835) | agagagggcaagggattggacg (64,835) | 42.3 | 3.8 |
| 2 | CH86 | TTTTTCCATAGGATTCTCTT (53,370) | cccaggaggtagaggtcacaatga (64,793) | agagagggcaagggattggacg (64,835) | agagagggcaagggattggacg (64,835) | 51.7 | 1.6 |
| 2 | CH87 | GCTCTCCTCATGTCCCCTCA (56,860) | cccaggaggtagaggtcacaatga (64,793) | agagagggcaagggattggacg (64,835) | agagagggcaagggattggacg (64,835) | 36.0 | 3.2 |
| 5 | CH52 | ACTTCTTGTGCGGCTGGCCC (55,848) | AACCTGGGCACGCTCTTT (64,794) | AGAGGACCACCTGAGCTGAC (64,796) | TGTAAAAGAGGACCACCTGAGC (64,797) | 5.1 | 3.0 |
| 5 | CH53 | ACAACGACTTCTTGTGCGGC (55,846) | AACCTGGGCACGCTCTTT (64,794) | AGAGGACCACCTGAGCTGAC (64,796) | TGTAAAAGAGGACCACCTGAGC (64,797) | 2.4 | 0.9 |
| 5 | CH54 | TCTTACAACGACTTCTTGTG (55,845) | AACCTGGGCACGCTCTTT (64,794) | AGAGGACCACCTGAGCTGAC (64,796) | TGTAAAAGAGGACCACCTGAGC (64,797) | 44.3 | 15.8 |
| 5 | KB55 | ACCCCCATCCCAAGTCGAGC (54,506) | AACCTGGGCACGCTCTTT (64,794) | AGAGGACCACCTGAGCTGAC (64,796) | TGTAAAAGAGGACCACCTGAGC (64,797) | 13.1 | 0.7 |
| 5 | KB56 | ACCAGCTCGACTTGGGATGG (55,875) | AACCTGGGCACGCTCTTT (64,794) | AGAGGACCACCTGAGCTGAC (64,796) | TGTAAAAGAGGACCACCTGAGC (64,797) | 17.2 | 2.8 |
| 5 | KB57 | GACCAGCTCGACTTGGGATG (55,874) | AACCTGGGCACGCTCTTT (64,794) | AGAGGACCACCTGAGCTGAC (64,796) | TGTAAAAGAGGACCACCTGAGC (64,797) | 13.4 | 4.8 |
| 5 | KB58 | AGACCAGCTCGACTTGGGAT (55,873) | AACCTGGGCACGCTCTTT (64,794) | AGAGGACCACCTGAGCTGAC (64,796) | TGTAAAAGAGGACCACCTGAGC (64,797) | 11.4 | 3.7 |
| 5 | KB59 | AAGACCAGCTCGACTTGGGA (55,872) | AACCTGGGCACGCTCTTT (64,794) | AGAGGACCACCTGAGCTGAC (64,796) | TGTAAAAGAGGACCACCTGAGC (64,797) | 11.1 | 3.0 |
| 5 | KB60 | GTAGAAGACCAGCTCGACTT (55,871) | AACCTGGGCACGCTCTTT (64,794) | AGAGGACCACCTGAGCTGAC (64,796) | TGTAAAAGAGGACCACCTGAGC (64,797) | 3.5 | 1.7 |
| 5 | KB61 | CGTAGAAGACCAGCTCGACT (55,870) | AACCTGGGCACGCTCTTT (64,794) | AGAGGACCACCTGAGCTGAC (64,796) | TGTAAAAGAGGACCACCTGAGC (64,797) | 2.2 | 0.8 |
| 5 | KB62 | CACTACCGCACTCTTGCAGA (55,865) | AACCTGGGCACGCTCTTT (64,794) | AGAGGACCACCTGAGCTGAC (64,796) | TGTAAAAGAGGACCACCTGAGC (64,797) | 3.7 | 1.4 |
| 5 | KB63 | CAAGAGTGCGGTAGTGCCCC (54,511) | AACCTGGGCACGCTCTTT (64,794) | AGAGGACCACCTGAGCTGAC (64,796) | TGTAAAAGAGGACCACCTGAGC (64,797) | 14.8 | 0.2 |
| 5 | KB64 | GATGACACTGACGGATGCCA (55,861) | AACCTGGGCACGCTCTTT (64,794) | AGAGGACCACCTGAGCTGAC (64,796) | TGTAAAAGAGGACCACCTGAGC (64,797) | 20.5 | 4.3 |
| 5 | KB65 | GGATGACACTGACGGATGCC (55,860) | AACCTGGGCACGCTCTTT (64,794) | AGAGGACCACCTGAGCTGAC (64,796) | TGTAAAAGAGGACCACCTGAGC (64,797) | 2.2 | 1.1 |

TABLE 3-continued gRNA sequences and activity in Huh7-Cas9

| Exon # | guide ID | gRNA sequence (SEQ ID NO) | Forward TIDE primer | Reverse TIDE primer | Sequencing Primer | Eff. | SD |
|---|---|---|---|---|---|---|---|
| 5 | KB66 | TAGTAGTCCT CCTCAATCCC (55,842) | AACCTGGGC ACGCTCTTT (64,794) | AGAGGACCAC CTGAGCTGAC (64,796) | TGTAAAAGAGG ACCACCTGAGC (64,797) | 50.1 | 2.1 |
| 5 | KB67 | TGCCATCCAT TCTGCCGTCG (54,540) | AACCTGGGC ACGCTCTTT (64,794) | AGAGGACCAC CTGAGCTGAC (64,796) | TGTAAAAGAGG ACCACCTGAGC (64,797) | 4.0 | 1.0 |
| 5 | KB68 | TTCCACGACG GCAGAATGGA (55,838) | AACCTGGGC ACGCTCTTT (64,794) | AGAGGACCAC CTGAGCTGAC (64,796) | TGTAAAAGAGG ACCACCTGAGC (64,797) | 41.6 | 0.2 |
| 5 | KB69 | TTAATTCCAC GACGGCAGAA (55,837) | AACCTGGGC ACGCTCTTT (64,794) | AGAGGACCAC CTGAGCTGAC (64,796) | TGTAAAAGAGG ACCACCTGAGC (64,797) | 24.4 | 4.1 |
| 5 | KB70 | GCCGTCGTGG AATTAAATCA (54,541) | AACCTGGGC ACGCTCTTT (64,794) | AGAGGACCAC CTGAGCTGAC (64,796) | TGTAAAAGAGG ACCACCTGAGC (64,797) | 50.5 | 2.8 |
| 5 | KB71 | TCCGTGATTT AATTCCACGA (55,835) | AACCTGGGC ACGCTCTTT (64,794) | AGAGGACCAC CTGAGCTGAC (64,796) | TGTAAAAGAGG ACCACCTGAGC (64,797) | 2.8 | 1.0 |
| 5 | KB72 | TCGTGGAATT AAATCACGGA (54,542) | AACCTGGGC ACGCTCTTT (64,794) | AGAGGACCAC CTGAGCTGAC (64,796) | TGTAAAAGAGG ACCACCTGAGC (64,797) | 12.3 | 5.2 |
| 5 | KB73 | TTAAATCACG GATGGCAGAT (54,544) | AACCTGGGC ACGCTCTTT (64,794) | AGAGGACCAC CTGAGCTGAC (64,796) | TGTAAAAGAGG ACCACCTGAGC (64,797) | 17.5 | 1.6 |
| 5 | KB74 | TGGCAGATTG GAGGGTCGCC (54,548) | AACCTGGGC ACGCTCTTT (64,794) | AGAGGACCAC CTGAGCTGAC (64,796) | TGTAAAAGAGG ACCACCTGAGC (64,797) | 4.4 | 0.5 |
| 5 | KB75 | TGCATATGGT GTACGTGATA (55,820) | AACCTGGGC ACGCTCTTT (64,794) | AGAGGACCAC CTGAGCTGAC (64,796) | TGTAAAAGAGG ACCACCTGAGC (64,797) | 35.6 | 4.1 |
| 5 | KB76 | CCATATGCAA GTTTCCCGCC (54,558) | AACCTGGGC ACGCTCTTT (64,794) | AGAGGACCAC CTGAGCTGAC (64,796) | TGTAAAAGAGG ACCACCTGAGC (64,797) | 19.0 | 0.9 |
| 5 | KB77 | CCTGGCGGGA AACTTGCATA (55,819) | AACCTGGGC ACGCTCTTT (64,794) | AGAGGACCAC CTGAGCTGAC (64,796) | TGTAAAAGAGG ACCACCTGAGC (64,797) | 1.6 | 0.8 |
| 5 | KB78 | TATGCAAGTT TCCCGCCAGG (54,560) | AACCTGGGC ACGCTCTTT (64,794) | AGAGGACCAC CTGAGCTGAC (64,796) | TGTAAAAGAGG ACCACCTGAGC (64,797) | 41.4 | 2.5 | exon 1 15 27
exon 2 22 33
exon 3  6 27

*Eff. = efficiency (% indels)

PCR amplicons were purified using the AxyPrep Mag PCR clean-up kit (Axygen). Amplicons were sequenced using the primers listed below and analyzed using decomposition algorithm. gRNA activity was measured as a ratio of alleles with various indels (insertions of 1 to 50 nt, or deletions of 1 to 50 nt) adjacent to predicted cut site of the S.py. Cas9 (i.e., between nucleotides −4 and −3 upstream of PAM (NRG) on a non-target strand and between 3 and 4 nucleotides downstream of PAM complementary sequence (CCN) on a target strand. The activity of the gRNA is listed in Table 3.

These studies demonstrate that 15 out of 27 gRNAs targeting exon 1, 22 out of 33 targeting exon 2 and 6 out of exon 27 targeting exon 5 had in vitro indel efficiency higher than 30%.

Example 98—Activity of the gRNA Targeting Mutant Allele in HuH7 Cells (Wildtype Alleles To assess the activity of the gRNAs preferentially targeting mutant alleles, gRNA overlapping with two the most prevalent mutations of G6PC R83C (rs1801175) and Q347X (rs80356487) were designed, with perfect match with mutant sequence (Table 4). As a surrogate of the activity of the mutant gRNAs, their activity in Huh7-Cas9 cells has been assessed as shown below in Table 4.

TABLE 4 gRNA sequences and activity in Huh7-Cas9

| Exon # | guide ID | gRNA sequence | Forward TIDE primer | Reverse TIDE primer | Sequencing Primer | Eff. | SD |
|---|---|---|---|---|---|---|---|
| 2 | CH31 | GCTGTCCAAA GAGAATCCTA (56,893) | cccaggaggtag aggtcacaatga (64,793) | agagagggcaa gggattggacg (64,835) | agagagggcaa gggattggacg (64,835) | 59.65 | 7 |
| 2 | CH31 mutant | ACTGTCCAAA GAGAATCCTA (64,798) | cccaggaggtag aggtcacaatga (64,793) | agagagggcaa gggattggacg (64,835) | agagagggcaa gggattggacg (64,835) | 43.65 | 7.4 |
| 2 | CH32 | TCTTTGGACA GCGTCCATAC (53,372) | cccaggaggtag aggtcacaatga (64,793) | agagagggcaa gggattggacg (64,835) | agagagggcaa gggattggacg (64,835) | 44.25 | 6.2 |
| 2 | CH32 mutant | TCTTTGGACA GTGTCCATAC (64,799) | cccaggaggtag aggtcacaatga (64,793) | agagagggcaa gggattggacg (64,835) | agagagggcaa gggattggacg (64,835) | 22.65 | 0.7 |
| 2 | CH33 | TTGGACAGCG TCCATACTGG (53,373) | cccaggaggtag aggtcacaatga (64,793) | agagagggcaa gggattggacg (64,835) | agagagggcaa gggattggacg (64,835) | 13.95 | 0.8 |
| 2 | CH33 mutant | TTGGACAGTG TCCATACTGG (64,800) | cccaggaggtag aggtcacaatga (64,793) | agagagggcaa gggattggacg (64,835) | agagagggcaa gggattggacg (64,835) | 6.75 | 2 |
| 2 | CH34 | TGGACAGCGT CCATACTGGT (53,374) | cccaggaggtag aggtcacaatga (64,793) | agagagggcaa gggattggacg (64,835) | agagagggcaa gggattggacg (64,835) | 51.6 | 6 |
| 2 | CH34 mutant | TGGACAGTGT CCATACTGGT (64,801) | cccaggaggtag aggtcacaatga (64,793) | agagagggcaa gggattggacg (64,835) | agagagggcaa gggattggacg (64,835) | 38 | 4.2 |
| 5 | ex5-d1 | CTACTGCCTC GCCTAGGTCC (64,802) | AACCTGGGC ACGCTCTTT (64,794) | AGAGGACCAC CTGAGCTGAC (64,796) | TGTAAAAGAGG ACCACCTGAGC (64,797) | | |
| 5 | ex5-d2 | CATCCCCTAC TGCCTCGCCT (64,803) | AACCTGGGC ACGCTCTTT (64,794) | AGAGGACCAC CTGAGCTGAC (64,796) | TGTAAAAGAGG ACCACCTGAGC (64,797) | | |
| 5 | ex5-d3 | TACTGCCTCG CCTAGGTCCT (64,804) | AACCTGGGC ACGCTCTTT (64,794) | AGAGGACCAC CTGAGCTGAC (64,796) | TGTAAAAGAGG ACCACCTGAGC (64,797) | | |
| 5 | ex5-d4 | AGGACCTAGG CGAGGCAGTA (64,805) | AACCTGGGC ACGCTCTTT (64,794) | AGAGGACCAC CTGAGCTGAC (64,796) | TGTAAAAGAGG ACCACCTGAGC (64,797) | | |
| 5 | ex5-d5 | GCTGGCCCAG GACCTAGGCG (64,806) | AACCTGGGC ACGCTCTTT (64,794) | AGAGGACCAC CTGAGCTGAC (64,796) | TGTAAAAGAGG ACCACCTGAGC (64,797) | | |
| 5 | ex5-d6 | CAGGACCTAG GCGAGGCAGT (64,807) | AACCTGGGC ACGCTCTTT (64,794) | AGAGGACCAC CTGAGCTGAC (64,796) | TGTAAAAGAGG ACCACCTGAGC (64,797) | | |

*Eff. = efficiency (% indels)

These studies demonstrate that gRNAs targeting mutant allele and having one mismatch comparing to wildtype sequence retained 50-74% of the wild type analogues.

Example 99—Activity of 19-mer, 18-mer, 17-mer ciRNA

To analyze whether gRNA with recognition part shorter than 20-mer have some activity, Alt-R gRNA activity in Huh7-Cas9 cells was analyzed, and whether the substitution of Gs to one or two 5' nucleotides would affect the gRNA activity was also analyzed, as shown below in Table 5. These modified lengths and or sequences of gRNA may modify kinetics of double stranded cutting and/or its specificity.

TABLE 5 gRNA sequences and activity in Huh7-Cas9

| gRNA ID | Sequence (SEQ ID NO) | Efficiency | SD |
|---|---|---|---|
| CH31_N20 | GCTGTCCAAAGAGAATCCTA (56,893) | 29.83 | 3.21 |
| CH31_GGN18 | GGTGTCCAAAGAGAATCCTA (64,808) | 23.97 | 2.72 |
| CH31_N19 | CTGTCCAAAGAGAATCCTA (64,809) | 22.67 | 2.41 |

TABLE 5-continued gRNA sequences and activity in Huh7-Cas9

| gRNA ID | Sequence (SEQ ID NO) | Efficiency | SD |
|---|---|---|---|
| CH31_GN18 | GTGTCCAAAGAGAATCCTA (64,810) | 19.77 | 3.32 |
| CH31_N18 | TGTCCAAAGAGAATCCTA (64,811) | 21.10 | 4.45 |
| CH31_GN17 | GGTCCAAAGAGAATCCTA (64,812) | 20.37 | 5.68 |
| CH31_N17 | GTCCAAAGAGAATCCTA (64,813) | 21.20 | 4.60 |
| CH32_N20 | TCTTTGGACAGCGTCCATAC (53,372) | 14.87 | 1.18 |
| CH32_GN19 | GCTTTGGACAGCGTCCATAC (64,814) | 9.17 | 0.62 |
| CH32_GGN18 | GGTTTGGACAGCGTCCATAC (64,815) | 3.07 | 0.61 |
| CH32_N19 | CTTTGGACAGCGTCCATAC (64,816) | 13.13 | 0.65 |
| CH32_GN18 | GTTTGGACAGCGTCCATAC (64,817) | 1.27 | 0.05 |
| CH32_N18 | TTTGGACAGCGTCCATAC (64,818) | 4.37 | 0.45 |
| CH32_GN17 | GTTGGACAGCGTCCATAC (64,819) | 3.30 | 1.36 |
| CH32_N17 | TTGGACAGCGTCCATAC (64,820) | 6.87 | 1.69 |

These studies demonstrate that all shorter analogues of the gRNA CH31 retained more than 66% of indel activity. Only 19-mer analogues of the gRNA CH32 retained activity >60% of the full gRNA.

Example 100—Format of ciRNAs

Figure 95A:
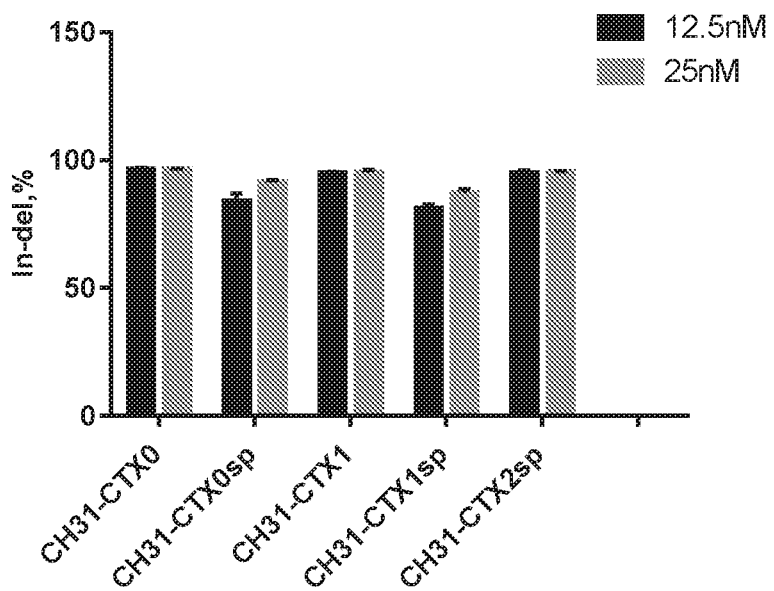
FIGS. 95A and 95B are a series of graphs depicting activity of gRNA CH31, comparison of split gRNA (crRNA+tracerRNA) and single stranded gRNA with various chemical modifications.
Figure 95B:
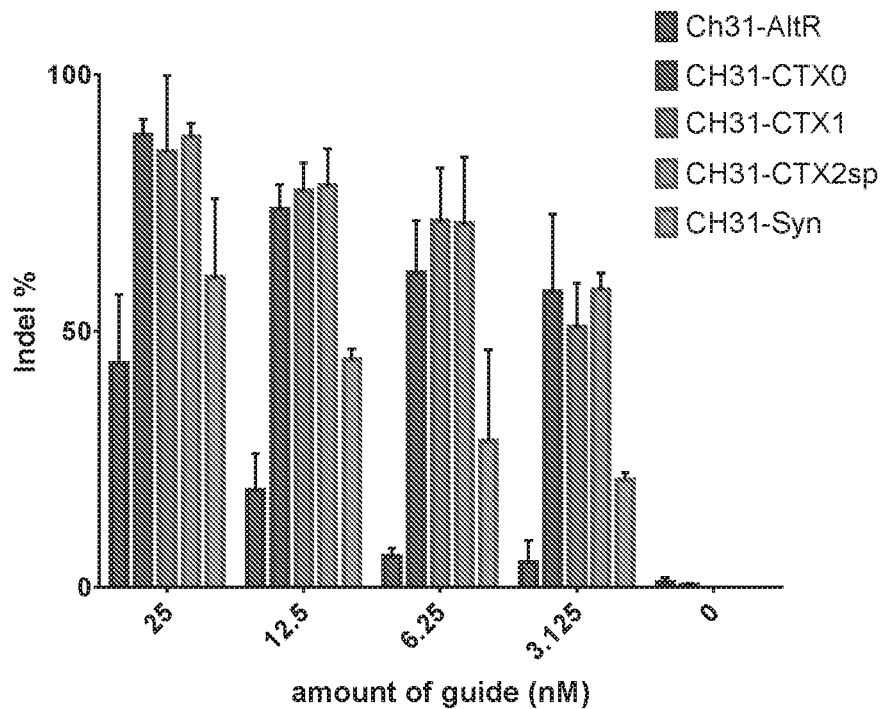

Selected gRNAs were tested in a form of single-stranded gRNA with various chemical modifications, and double-stranded gRNA conjugated by click chemistry with various chemical modifications as shown below in Table 6. Transfection of the gRNAs was performed as described above and their activities at various concentrations (3 nM-25 nM) are presented in FIGS. 95A-95B.

TABLE 6

Examples of the chemical modifications of gRNA

| gRNA name | Chemical modification scheme | Sequence 5' to 3' |
|---|---|---|
| CH31 | CTX0 | gscsusGUCCAAAGAGAAUCCUAGUUUU AGAGCUAGAAAUAGCAAGUUAAAAUAAG GCUAGUCCGUUAUCAACUUGAAAAAGUG GCACCGAGUCGGUGCsusususU (SEQ ID NO: 64,821) |
| CH31 | CTX0split | gscsusGUCCAAAGAGAAUCCUAGUUUU AGAgcuaGAAA (SEQ ID NO: 64,822)-(ABA)(COM)uagcAAGUUA AAAUAAGGCUAGUCCGUUAUCaacuuGA AAaguggcaccgagucggugcsusususU (SEQ ID NO: 64,836) |

TABLE 6-continued

Examples of the chemical modifications of gRNA

| gRNA name | Chemical modification scheme | Sequence 5' to 3' |
|---|---|---|
| CH31 | CTX1 | gscsusGUCCAAAGAGAAUCCUAGUUUU AGAGCUAGAAAUAGCAAGUUAAAAUAAG GCUAGUCCGUUAUCAACUUGAAAAAGUG GCACCGAGUCGGUGCsusususU (SEQ ID NO: 64,821) |
| CH31 | CTX1split | gscsusGUCCAAAGAGAAUCCUAguuuu agagcuagaaa (SEQ ID NO: 64,823)-(NHC6)(ABA)(COM)-uag cAAGUUAAAAUAAGGCUAGUCCGUUAUC aacuuGAAAaaguggcaccgagucggug csusususU (SEQ ID NO: 64,836) |
| CH31 | CTX2split | gscsusGUCCAAAGAGAAUCCUAGUUUU AGAGCUAUGCU (SEQ ID NO: 64,824)-(NHC6)(ABA)(COM)-AGC AUAGCAAGUUAAAAUAAGGCUAGUCCGU UAUCaacuuGAAAaaguggcaccgaguc ggugcsusususU (SEQ ID NO: 64,837) | a, c, g, u: 2'-O-methyl residues
s: phosphorothioate
A, C, G, U: RNA residues

These studies demonstrate that single stranded gRNA or click-conjugated split gRNAs had superior activity than split gRNAs, especially at lower concentrations.

Example 101—gRNA Activity in Primary Human Hepatocytes and HepG2

Selected gRNAs were tested in a form of single-stranded gRNA with various chemical modifications (see Table 6 above). Transfection of the gRNAs was performed using Lipofectamine MessengerMax according to the manufacture protocol. The gRNAs activities at 12.5 nM are presented below in Table 7.

TABLE 7 gRNA activity in HepG2 and PHH transfected with Cas9 mRNA and gRNA

| gRNA | Activity, In-del % | SD | Cell type |
|---|---|---|---|
| CH31-CTX0 | 43.96805556 | 17.657448 | HepG2 |
| CH31-CTX1 | 41.12261905 | 20.441894 | HepG2 |
| CH32-AltR | 13.89166667 | 13.517525 | HepG2 |
| CH31-CTX2 | 20.36944444 | 8.9200085 | PHH |

These studies demonstrate that single stranded gRNAs transfected with Cas9 mRNA were active in both HepG2 cells and primary human hepatocytes.

Example 102—Analysis of the Off-Target Activity of Selected gRNAs

Off-targets (loci in the genome targeted by the CRISPR endonuclease beyond the locus of interest) were predicted by two algorithms, CCTOP (see Example 97) and COSMID (COSMID: A Web-based Tool for Identifying and Validating CRISPR/Cas Off-target Sites. T J Cradick, P Qiu, C M Lee, E J Fine, G Bao. Molecular Therapy—Nucleic Acids 3 (12), e214).

Selected gRNAs were transfected into Huh-7 cells as described above in 24 well format. gDNA was isolated using DNAeasy isolation kit (Qiagen). Off-target activities for the selected gRNAs were measured by two methods:
- TIDE analysis for the top 5-6 off-targets (similar to on target activity), see Table 8B for the example (3-5% of indel is considered as background).
- HiSeq of 200-500 off-target sites. DNA correspondent to off-target sites was enriched by TargetGxOne™ enrichment library preparation and analyzed by 2×125 bp paired end (PE) sequencing on Illumina HiSeq2500 in High Output mode (V4 Chemistry). Off-target activity is defined as the ratio of reads with indels adjacent to the predicted off-target locus to the total number of reads correspondent to the locus, see Table 8A for the example.

TABLE 8A

Examples of analysis of off-target activity by Capture-Seq, in del frequency

|  | CH31 | Control | Comment |
|---|---|---|---|
| chr12:98076278-98076300 (−) | 0.1% | 0.0% |  |
| chr13:84282989-84283011 (+) | 0.3% | 0.0% |  |
| chr17:10714406-10714427 (−) | 0.4% | 0.0% |  |
| chr17:42903925-42903947 (−) | 58.6% | 2.0% | On-Target |
| chr2:158676009-158676031 (+) | 0.5% | 0.0% |  |
| chr2:208579757-208579779 (−) | 1.7% | 0.0% |  |
| chr3:56776643-56776665 (+) | 0.4% | 0.0% |  |
| chr3:142796927-142796949 (+) | 0.3% | 0.0% |  |
| chr4:32556942-32556964 (−) | 3.0% | 0.0% |  |
| chr6:45288091-45288113 (+) | 0.2% | 0.0% |  |
| chr6:167947988-167948010 (−) | 0.1% | 0.0% |  |
| chr7:20703389-20703411 (−) | 0.3% | 0.0% |  |

TABLE 8B

Examples of analysis of off-target activity by TIDE analysis

|  | CH32 |  |
|---|---|---|
| ch17:42903936-42903958 (+) | ~90% | On-Target |
| Ch19: 53480959-53480938 (−) | ~5% |  |
| Chr2: 64486187-64486165 (−) | ~5% |  |

These studies demonstrate that although constitutive expression of Cas9 increases off-targeting potential, the indels in predicted off-target sites for the identified gRNAs were either non-detected or lower than 5% of on-target activity of the correspondent gRNA.

Figure 96:
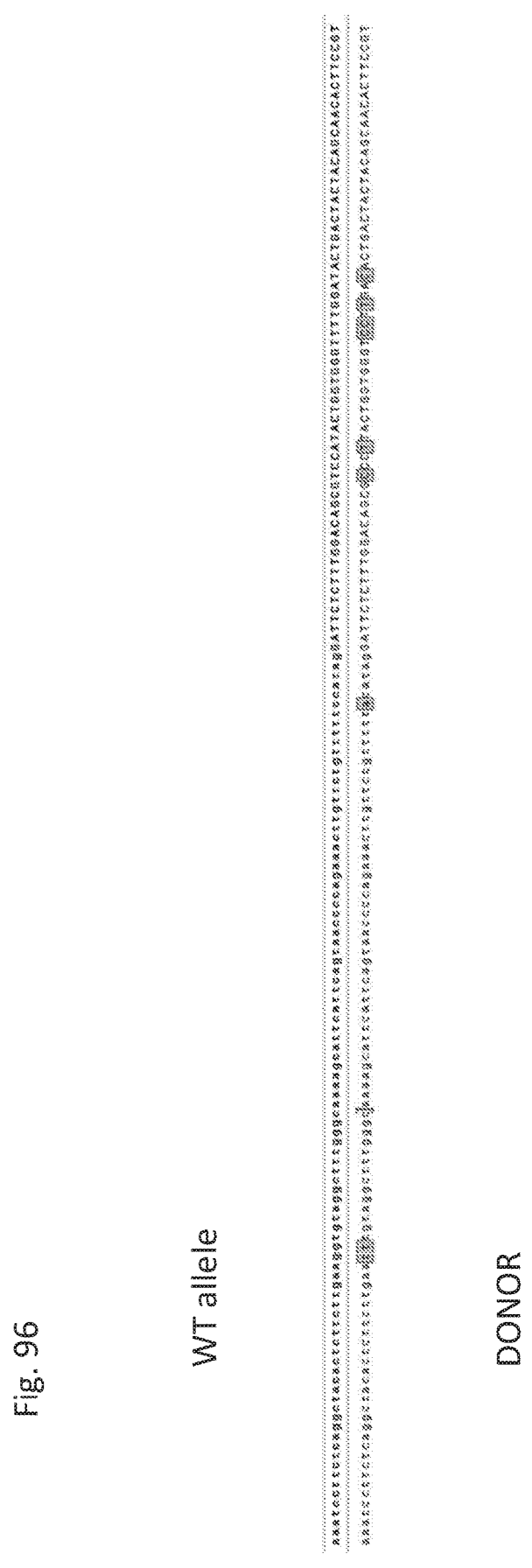

Example 103—Correction of Mutations (Missense, Nonsense) by HDR gRNA targeting DNA in the proximity of the mutation of interest (e.g. R83C (rs1801175) and donor DNA was provided as single stranded (+ or − strands) or double stranded DNA oligo nucleotides (+ strand is presented in FIG. 96). The donor DNA had several sense mismatches (therapeutic donor will have wildtype sequence or sequence with homology to wt>90%).

gRNA and oligonucleotide were co-transfected into Huh-7 cells expressing Cas9 and genomic DNAs were harvested 48-96 hours post transfection. The locus of interest was amplified using primers 5'-cccaggaggtagaggtcacaatga-3' (SEQ ID NO: 64,793) and 5'-agagagggcaagggattggacg-3' (SEQ ID NO: 64,795), and the amplicons were cloned into TOPO-blunt vector and sequenced by Sanger Sequencing. Efficiency of the gene editing as well as an example of the mutated sequence are presented in FIGS. 99A-99C.

Figure 97A:
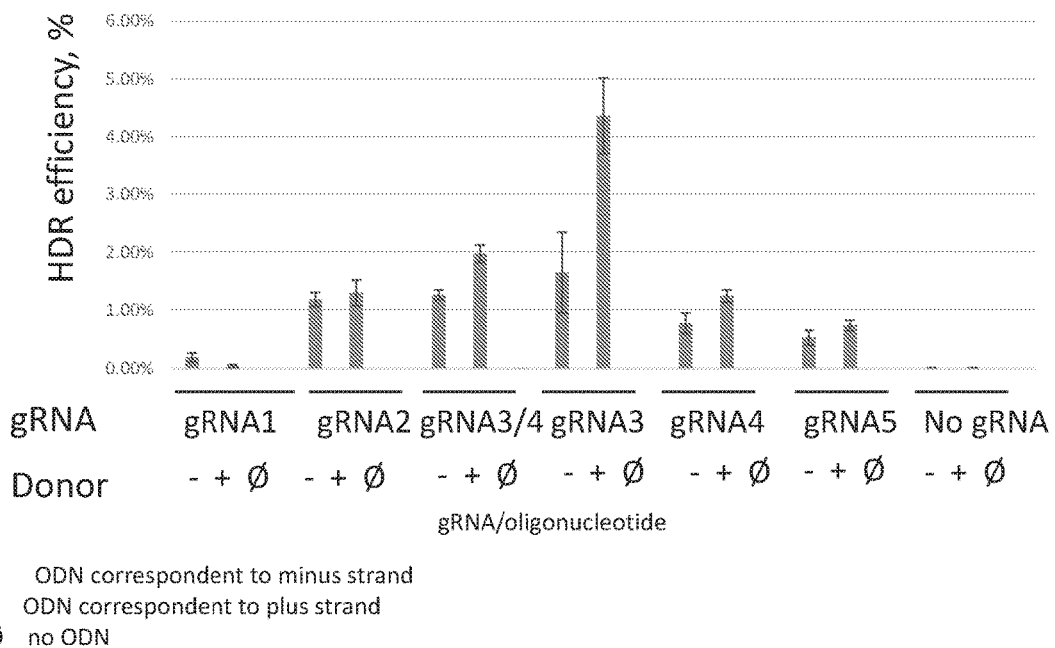
FIG. 97A is a graph depicting efficiency of Cas9/gRNA promoted HDR (− minus strand donor, + plus strand donor, no donor) using NextGen sequencing analysis of different gRNAs.
Figure 97B:
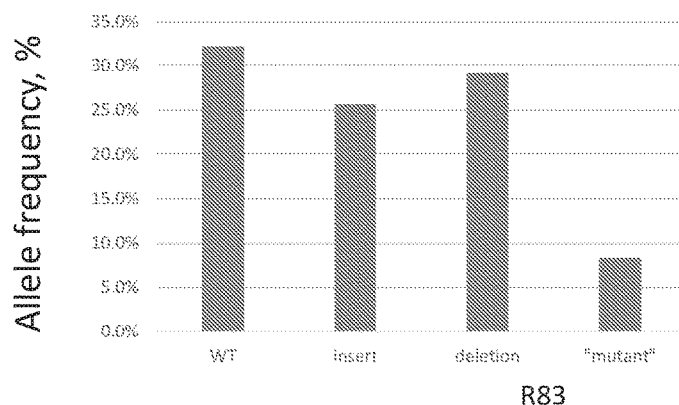
FIG. 97B is a graph depicting efficiency of Cas9/gRNA promoted HDR (− minus strand donor, + plus strand donor, no donor) using Sanger sequencing analysis (200 individual sequences) of the HDR gRNA3 (+ donor).
Figure 97C:
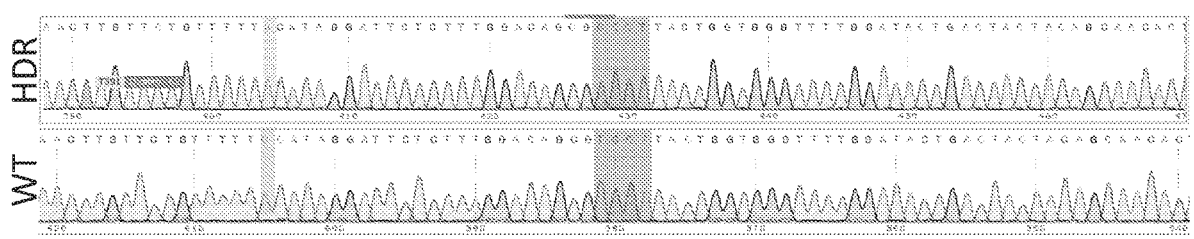
FIG. 97C is a graph depicting efficiency of Cas9/gRNA promoted HDR (− minus strand donor, + plus strand donor, no donor) using representative sequence with correct recombination vs wt allele.

NextGen Sequencing, briefly, primers (5'-cccaggaggtagaggtcacaatga-3' (SEQ ID NO: 64,793) and 5'-agagagggcaagggattggacg-3' (SEQ ID NO: 64,795)) were used to generate amplicons, amplicons were used for nested PCR using following primers (NextGen_G6PC_R83_rev GTCTCGTGGGCTCGGAGATGTGTATAAGAGACAGG GCACGGAAGTGTTGCTG TAGT (SEQ ID NO: 64,825) and NextGen_G6PC_R83_for TCGTCGGCAGCGTCAGA TGTGTATAAGAGACAGCCCTTCTAGAGGCAACAT GT GAA (SEQ ID NO: 64,826) and finally the library was generated using the barcoding primers. The efficiencies of HDR with the above mentioned donor and several gRNAs are presented in the FIGS. 97A-97C.

These studies demonstrate that the in vitro assay provided comparison of the efficiency of different gRNAs to promote HDR around position of interest. This in vitro assay also highlighted the importance of the proximity of the cut site to the mutation.

Example 104—Restoration of the G6PC Activity by Small Deletion Around Mutation

One or two gRNAs targeting DNA in the proximity of the mutation of interest (e.g. Q347X (rs80356487). The DNA cutting will lead to small deletion or insertion around the premature stop codon and may lead to modified amino acid sequence. Examples are shown below:

G6PC Q347X (SEQ ID NO: 64,827)
MEEGMNVLHDFGIQSTHYLQVNYQDSQDWFILVSVIADLRNAFYVLFPIW

FHLQEAVGIKLLWVAVIGDWLNLVFKWILFGQRPYWWVLDTDYYSNTSVP

LIKQFPVTCETGPGSPSGHAMGTAGVYYVMVTSTLSIFQGKIKPTYRFRC

LNVILWLGFWAVQLNVCLSRIYLAAHFPHQVVAGVLSGIAVAETFSHIHS

IYNASLKKYFLITFFLFSFAIGFYLLLKGLGVDLLWTLEKAQRWCEQPEW

VHIDTTPFASLLKNLGTLFGLGLALNSSMYRESCKGKLSKWLPFRLSSIV

ASLVLLHVFDSLKPPSQVELVFYVLSFCKSAVVNPLASVSVIPYCLAXVL

GQPHKKSL

G6PC Δ346-347

(SEQ ID NO: 64,828)
MEEGMNVLHDFGIQSTHYLQVNYQDSQDWFILVSVIADLRNAFYVLFPIW

FHLQEAVGIKLLWVAVIGDWLNLVFKWILFGQRPYWWVLDTDYYSNTSVP

LIKQFPVTCETGPGSPSGHAMGTAGVYYVMVTSTLSIFQGKIKPTYRFRC

LNVILWLGFWAVQLNVCLSRIYLAAHFPHQVVAGVLSGIAVAETFSHIHS

IYNASLKKYFLITFFLFSFAIGFYLLLKGLGVDLLWTLEKAQRWCEQPEW

VHIDTTPFASLLKNLGTLFGLGLALNSSMYRESCKGKLSKWLPFRLSSIV

ASLVLLHVFDSLKPPSQVELVFYVLSFCKSAVVNPLASVSVIPYCLVLGQ

PHKKSL

G6PC Δ347-348

(SEQ ID NO: 64,829)
MEEGMNVLHDFGIQSTHYLQVNYQDSQDWFILVSVIADLRNAFYVLFPIW

FHLQEAVGIKLLWVAVIGDWLNLVFKWILFGQRPYWWVLDTDYYSNTSVP

LIKQFPVTCETGPGSPSGHAMGTAGVYYVMVTSTLSIFQGKIKPTYRFRC

LNVILWLGFWAVQLNVCLSRIYLAAHFPHQVVAGVLSGIAVAETFSHIHS

```
IYNASLKKYFLITFFLFSFAIGFYLLLKGLGVDLLWTLEKAQRWCEQPEW

VHIDTTPFASLLKNLGTLFGLGLALNSSMYRESCKGKLSKWLPFRLSSIV

ASLVLLHVFDSLKPPSQVELVFYVLSFCKSAVVPLASVSVIPYCLALGQP

HKKSL
```

Figure 98:
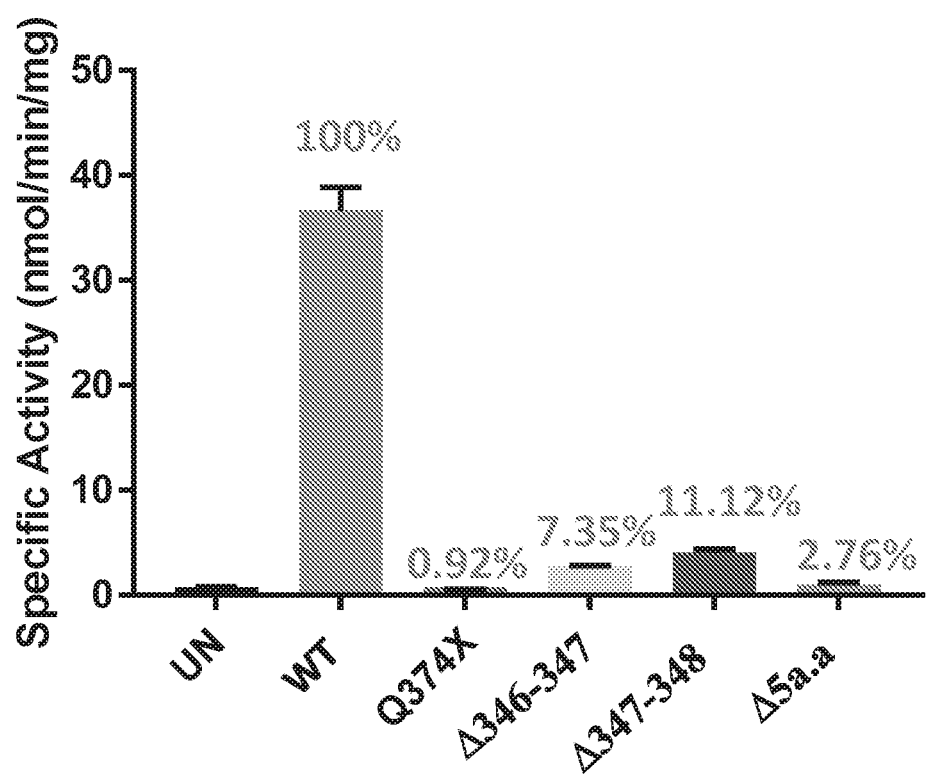
FIG. 98 is a graph depicting specific G6PC activity measured in HEK293 cells transfected with plasmids encoding G6PC protein: wildtype and mutant forms.

The cDNA encoding the above listed proteins were cloned into expression cassette and transfected into HEK293T cells; FIG. 98 demonstrates that while Q347X variant of the enzyme has virtually no activity, Δ346-347 and Δ347-348 variants may have residual phosphatase activity about 10% of the wildtype protein.

These studies demonstrate that G6PC protein with a deletion of the amino acids (346-347 or 347-348) had 10% of wildtype activity (i.e. higher than nonsense mutation Q347X).

Example 105—Restoration of the G6PC Activity by Knock-in of cDNA or Minigene G6PC can be knocked-in in one of the following loci: ApoC3 chr11:116829908-116833071; Angptl3 chr1:62,597, 487-62,606,305; Serpina1 chr14:94376747-94390692; Lp(a) chr6:160531483-160664259; Pcsk9 chr1:55,039,475-55,064,852; FIX chrX:139,530,736-139,563,458; ALB chr4:73,404,254-73,421,411; TTR chr18:31,591,766-31,599,023; TF chr3:133,661,997-133,779,005; Gys2 chr12:21,536,188-21,604,857; AAVS1(PPP1R12C) chr19:55,090,912-55,117,599; HGD chr3:120,628,167-120,682,570; CCR5 chr3:46,370,854-46,376,206; ASGR2 chr17:7,101,322-7,114,310; G6PC 17:42,900,796-42,914,432. Briefly, one or two gRNAs targeting one of these loci, more specifically exon 1 or exon 2 or intron 1.

Figure 99A:
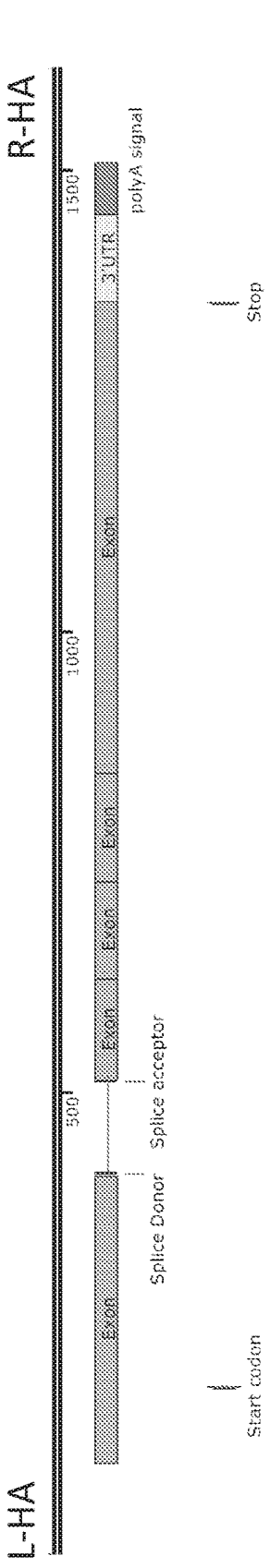
FIGS. 99A-99C are a series of illustrations depicting a schematic representation of the donors for knock-in strategies described herein.
Figure 99B:
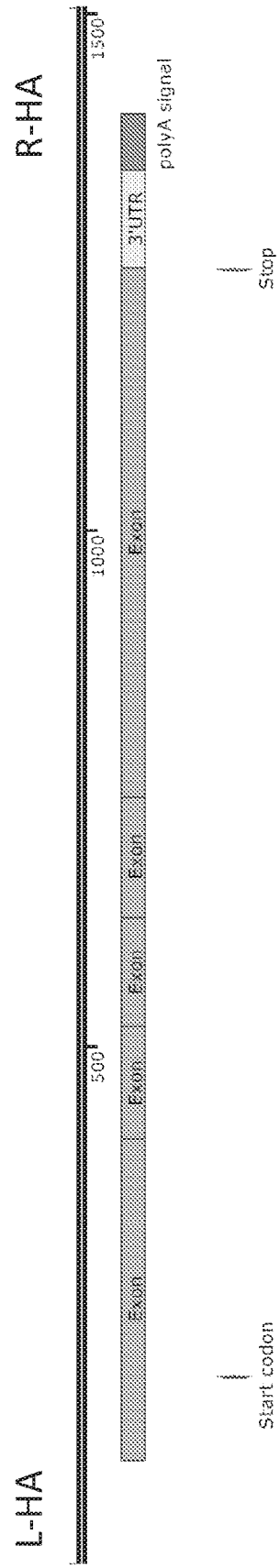
Figure 99C:
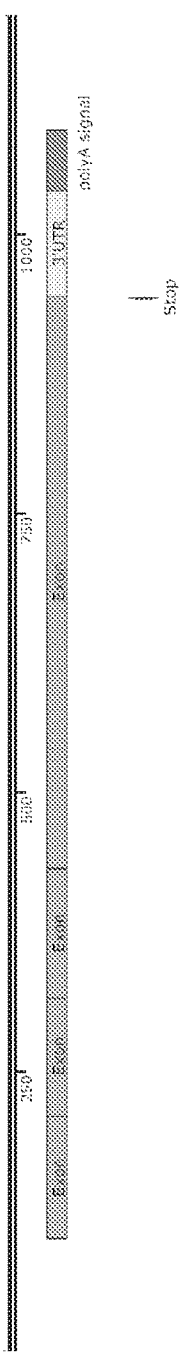

The DNA donors are schematically represented in FIGS. 99A-99C, where examples of 3'UTR and polyadenylation signal are listed below:

```
>mouse a-Globin 3'UTR
                                        (SEQ ID NO: 64,830)
AGCTGCCTTCTGCGGGGCTTGCCTTCTGGCCATGCCCTTCTTCTCTCCCT

TGCACCTGTACCTCTTGGTCTTTGAATAAAGCCTGAGTAGGAAG

>human a-Globin 3'UTR
                                        (SEQ ID NO: 64,831)
GCTGGAGCCTCGGTGGCCATGCTTCTTGCCCCTTGGGCCTCCCCCCAGCC

CCTCCTCCCCTTCCTGCACCCGTACCCCCGTGGTCTTTGAATAAAGTCTG

AGTGGGCGGC

>human G6PC 3'UTR (synthetic short)
                                        (SEQ ID NO: 64,832)
GAGATGTGGAGTCTTCGGTGTTTAAAGTCAACAACCATGCCAGGGATTGA

GGAGGACTACTATTTGAAGCAATGGGCACCAAGTGAAATAAAGTCTTGTT

AATTACTATATTTTAGATGCA

>polyadenylation signal b-Globin
                                        (SEQ ID NO: 64,833)
AATAAAGGAAATTTATTTTCATTGCAATAGTGTGTTGGAATTTTTTGTGT

CTCTCA

>polyadenylation signal SV40
                                        (SEQ ID NO: 64,834)
TTGTTTATTGCAGCTTATAATGGTTACAAATAAAGCAATAGCATCACAAA

TTTCACAAATAAAGCATTTTTTTCACTGCATTCTAGTTGTGGTTTGTCCA

AACTCATCAATGTATCTTAT
```

These studies demonstrate that left homology arm and right homology arm will be specific for each locus, including G6PC. One or two gRNAs targeting the above mentioned loci will be co-delivered with donor encoded by AAV.

Note Regarding Illustrative Embodiments

While the present disclosure provides descriptions of various specific embodiments for the purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative embodiments provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

SEQUENCE LISTING (64837 sequences)

SEQ ID NO: 1 - DNA, 20 bp, Artificial Sequence
  chemically synthesized
tggcgatatctaggtagcca

SEQ ID NO: 2 - DNA, 20 bp, Artificial Sequence
  chemically synthesized
ggcgatatctaggtagccac

SEQ ID NO: 3 - DNA, 20 bp, Artificial Sequence
  chemically synthesized
cgatatctaggtagccacag

SEQ ID NO: 4 - DNA, 20 bp, Artificial Sequence
  chemically synthesized
gatatctaggtagccacagg

SEQ ID NO: 5 - DNA, 20 bp, Artificial Sequence
  chemically synthesized
atctaggtagccacaggagg

SEQ ID NO: 6 - DNA, 20 bp, Artificial Sequence
  chemically synthesized
ccacaggaggcggccacgtg

SEQ ID NO: 7 - DNA, 20 bp, Artificial Sequence
  chemically synthesized
caggaggcggccacgtgcag

SEQ ID NO: 8 - DNA, 20 bp, Artificial Sequence
  chemically synthesized
cggccacgtgcagtggcgtc

SEQ ID NO: 9 - DNA, 20 bp, Artificial Sequence
  chemically synthesized
tccagccctcgttgtctgcc

SEQ ID NO: 10 - DNA, 20 bp, Artificial Sequence
  chemically synthesized
ctcgttgtctgcctggttca

SEQ ID NO: 11 - DNA, 20 bp, Artificial Sequence
  chemically synthesized
gttgtctgcctggttcacag

SEQ ID NO: 12 - DNA, 20 bp, Artificial Sequence
  chemically synthesized
cagtggcgccctgctccacc

SEQ ID NO: 13 - DNA, 20 bp, Artificial Sequence
  chemically synthesized
tggcgccctgctccaccaag

SEQ ID NO: 14 - DNA, 20 bp, Artificial Sequence
  chemically synthesized
accaagaagcgcaccacctc

SEQ ID NO: 15 - DNA, 20 bp, Artificial Sequence
  chemically synthesized
ccaagaagcgcaccacctcc

SEQ ID NO: 16 - DNA, 20 bp, Artificial Sequence
  chemically synthesized
cctccaggttctcatcaatg

SEQ ID NO: 17 - DNA, 20 bp, Artificial Sequence
  chemically synthesized
ctccaggttctcatcaatgc

SEQ ID NO: 18 - DNA, 20 bp, Artificial Sequence
  chemically synthesized
ggttctcatcaatgcaggcc

SEQ ID NO: 19 - DNA, 20 bp, Artificial Sequence
  chemically synthesized
gttctcatcaatgcaggcct

SEQ ID NO: 20 - DNA, 20 bp, Artificial Sequence
  chemically synthesized
ttctcatcaatgcaggcctg

SEQ ID NO: 21 - DNA, 20 bp, Artificial Sequence
  chemically synthesized
tctcatcaatgcaggcctgg

SEQ ID NO: 22 - DNA, 20 bp, Artificial Sequence
  chemically synthesized
catcaatgcaggcctggggg

SEQ ID NO: 23 - DNA, 20 bp, Artificial Sequence
  chemically synthesized
atcaatgcaggcctgggggt

SEQ ID NO: 24 - DNA, 20 bp, Artificial Sequence
  chemically synthesized
gcaggcctgggggtgggaaa

SEQ ID NO: 25 - DNA, 20 bp, Artificial Sequence
  chemically synthesized
tgggggtgggaaacagccgt

SEQ ID NO: 26 - DNA, 20 bp, Artificial Sequence
  chemically synthesized
gccgtcagccgcacctaccc

SEQ ID NO: 27 - DNA, 20 bp, Artificial Sequence
  chemically synthesized
agccgcacctaccccagcca

SEQ ID NO: 28 - DNA, 20 bp, Artificial Sequence
  chemically synthesized
ctaccccagccacggtgtcc

SEQ ID NO: 29 - DNA, 20 bp, Artificial Sequence
  chemically synthesized
cccagccacggtgtcccagc

SEQ ID NO: 30 - DNA, 20 bp, Artificial Sequence
  chemically synthesized
gccacggtgtcccagcaagt

SEQ ID NO: 31 - DNA, 20 bp, Artificial Sequence
  chemically synthesized
ccacggtgtcccagcaagtc

SEQ ID NO: 32 - DNA, 20 bp, Artificial Sequence
  chemically synthesized
gtcccagcaagtcgggactc

SEQ ID NO: 33 - DNA, 20 bp, Artificial Sequence
  chemically synthesized
cccagcaagtcgggactcca

SEQ ID NO: 34 - DNA, 20 bp, Artificial Sequence
  chemically synthesized
ccagcaagtcgggactccag

SEQ ID NO: 35 - DNA, 20 bp, Artificial Sequence
  chemically synthesized
cagcaagtcgggactccaga

SEQ ID NO: 36 - DNA, 20 bp, Artificial Sequence
  chemically synthesized
gcaagtcgggactccagagg

SEQ ID NO: 37 - DNA, 20 bp, Artificial Sequence
  chemically synthesized
tccagagggagccacgaaaa

SEQ ID NO: 38 - DNA, 20 bp, Artificial Sequence
  chemically synthesized
gggagccacgaaaacagatc

SEQ ID NO: 39 - DNA, 20 bp, Artificial Sequence
  chemically synthesized
ggagccacgaaaacagatcc

SEQ ID NO: 40 - DNA, 20 bp, Artificial Sequence
  chemically synthesized
gagccacgaaaacagatcca

SEQ ID NO: 41 - DNA, 20 bp, Artificial Sequence
  chemically synthesized
cgaaaacagatccagggaca

SEQ ID NO: 42 - DNA, 20 bp, Artificial Sequence
  chemically synthesized
cagatccagggacacggtgc

SEQ ID NO: 43 - DNA, 20 bp, Artificial Sequence
  chemically synthesized
agatccagggacacggtgct

SEQ ID NO: 44 - DNA, 20 bp, Artificial Sequence
  chemically synthesized
ccagggacacggtgctagga

SEQ ID NO: 45 - DNA, 20 bp, Artificial Sequence
  chemically synthesized
gggacacggtgctaggacag

SEQ ID NO: 46 - DNA, 20 bp, Artificial Sequence
  chemically synthesized
ggacacggtgctaggacagt

SEQ ID NO: 47 - DNA, 20 bp, Artificial Sequence
  chemically synthesized
gacacggtgctaggacagtg

SEQ ID NO: 48 - DNA, 20 bp, Artificial Sequence
  chemically synthesized
cagtggggaaaatgacccaa

SEQ ID NO: 49 - DNA, 20 bp, Artificial Sequence
  chemically synthesized
gaaaatgacccaacagcctc

SEQ ID NO: 50 - DNA, 20 bp, Artificial Sequence
  chemically synthesized
acccaacagcctctggccac

SEQ ID NO: 51 - DNA, 20 bp, Artificial Sequence
  chemically synthesized
cctctggccactggctgttt

SEQ ID NO: 52 - DNA, 20 bp, Artificial Sequence
  chemically synthesized
ctggctgtttaagatacgcc

SEQ ID NO: 53 - DNA, 20 bp, Artificial Sequence
  chemically synthesized
ttaagatacgcctggttgcc

SEQ ID NO: 54 - DNA, 20 bp, Artificial Sequence
  chemically synthesized
agatacgcctggttgcccag

SEQ ID NO: 55 - DNA, 20 bp, Artificial Sequence
  chemically synthesized
acgcctggttgcccagtggt

SEQ ID NO: 56 - DNA, 20 bp, Artificial Sequence
  chemically synthesized
cgcctggttgcccagtggtc

SEQ ID NO: 57 - DNA, 20 bp, Artificial Sequence
  chemically synthesized
tggttgcccagtggtcaggc

SEQ ID NO: 58 - DNA, 20 bp, Artificial Sequence
  chemically synthesized
tgcccagtggtcaggccggc

SEQ ID NO: 59 - DNA, 20 bp, Artificial Sequence
  chemically synthesized
gcccagtggtcaggccggcc

SEQ ID NO: 60 - DNA, 20 bp, Artificial Sequence
  chemically synthesized
ggtcaggccggccaggcctt

SEQ ID NO: 61 - DNA, 20 bp, Artificial Sequence
  chemically synthesized
ccggccaggccttcagtgct

SEQ ID NO: 62 - DNA, 20 bp, Artificial Sequence
  chemically synthesized
gccaggccttcagtgctcag

SEQ ID NO: 63 - DNA, 20 bp, Artificial Sequence
  chemically synthesized
gtgctcagtggaaaccacga

SEQ ID NO: 64 - DNA, 20 bp, Artificial Sequence
  chemically synthesized
tgctcagtggaaaccacgaa

SEQ ID NO: 65 - DNA, 20 bp, Artificial Sequence
  chemically synthesized
ggaaaccacgaaaggactcc

SEQ ID NO: 66 - DNA, 20 bp, Artificial Sequence
  chemically synthesized
gactcctggctatctgcaaa

SEQ ID NO: 67 - DNA, 20 bp, Artificial Sequence
  chemically synthesized
actcctggctatctgcaaac

SEQ ID NO: 68 - DNA, 20 bp, Artificial Sequence
  chemically synthesized
cctggctatctgcaaacagg

SEQ ID NO: 69 - DNA, 20 bp, Artificial Sequence
  chemically synthesized
atctgcaaacaggaagtgaa

SEQ ID NO: 70 - DNA, 20 bp, Artificial Sequence
  chemically synthesized
tctgcaaacaggaagtgaac

SEQ ID NO: 71 - DNA, 20 bp, Artificial Sequence
  chemically synthesized
ctgcaaacaggaagtgaacg

SEQ ID NO: 72 - DNA, 20 bp, Artificial Sequence
  chemically synthesized
caaacaggaagtgaacgggg

SEQ ID NO: 73 - DNA, 20 bp, Artificial Sequence
  chemically synthesized
aaacaggaagtgaacgggga

SEQ ID NO: 74 - DNA, 20 bp, Artificial Sequence
  chemically synthesized
aacaggaagtgaacggggaa

SEQ ID NO: 75 - DNA, 20 bp, Artificial Sequence
  chemically synthesized
caggaagtgaacggggaagg

SEQ ID NO: 76 - DNA, 20 bp, Artificial Sequence
  chemically synthesized
aggaagtgaacggggaaggg

SEQ ID NO: 77 - DNA, 20 bp, Artificial Sequence
  chemically synthesized
ggaagtgaacggggaaggga

SEQ ID NO: 78 - DNA, 20 bp, Artificial Sequence
  chemically synthesized
gaagtgaacggggaagggag

SEQ ID NO: 79 - DNA, 20 bp, Artificial Sequence
  chemically synthesized
aagtgaacggggaagggagg

SEQ ID NO: 80 - DNA, 20 bp, Artificial Sequence
  chemically synthesized
aagggagggggcttctcatc

SEQ ID NO: 81 - DNA, 20 bp, Artificial Sequence
  chemically synthesized
agggagggggcttctcatct

SEQ ID NO: 82 - DNA, 20 bp, Artificial Sequence
  chemically synthesized
gggggcttctcatctgggtg

SEQ ID NO: 83 - DNA, 20 bp, Artificial Sequence
  chemically synthesized
ggggcttctcatctgggtgc

SEQ ID NO: 84 - DNA, 20 bp, Artificial Sequence
  chemically synthesized
ctgggtgcgggaaccccaca

SEQ ID NO: 85 - DNA, 20 bp, Artificial Sequence
  chemically synthesized
gaaccccacatggtacctgt

SEQ ID NO: 86 - DNA, 20 bp, Artificial Sequence
  chemically synthesized
cacatggtacctgttagaca

SEQ ID NO: 87 - DNA, 20 bp, Artificial Sequence
  chemically synthesized
aaaacccccgtcaccaccca

SEQ ID NO: 88 - DNA, 20 bp, Artificial Sequence
  chemically synthesized
aaacccccgtcaccacccac

SEQ ID NO: 89 - DNA, 20 bp, Artificial Sequence
  chemically synthesized
cccccgtcaccacccacagg

SEQ ID NO: 90 - DNA, 20 bp, Artificial Sequence
  chemically synthesized
ccacccacaggtggcgcttc

SEQ ID NO: 91 - DNA, 20 bp, Artificial Sequence
  chemically synthesized
caggtggcgcttccagtgct

SEQ ID NO: 92 - DNA, 20 bp, Artificial Sequence
  chemically synthesized
ggcgcttccagtgctcagac

SEQ ID NO: 93 - DNA, 20 bp, Artificial Sequence
  chemically synthesized
gcgcttccagtgctcagact

SEQ ID NO: 94 - DNA, 20 bp, Artificial Sequence
  chemically synthesized
cgcttccagtgctcagacta

SEQ ID NO: 95 - DNA, 20 bp, Artificial Sequence
  chemically synthesized
ttccagtgctcagactaggg

SEQ ID NO: 96 - DNA, 20 bp, Artificial Sequence
  chemically synthesized
ccagtgctcagactagggaa

SEQ ID NO: 97 - DNA, 20 bp, Artificial Sequence
  chemically synthesized
cagtgctcagactagggaag

SEQ ID NO: 98 - DNA, 20 bp, Artificial Sequence
  chemically synthesized
tcagactagggaagaggttc

SEQ ID NO: 99 - DNA, 20 bp, Artificial Sequence
  chemically synthesized
ggttccagcccctcctcctt

SEQ ID NO: 100 - DNA, 20 bp, Artificial Sequence
  chemically synthesized
ttccagcccctcctccttca

SEQ ID NO: 101 - DNA, 20 bp, Artificial Sequence
  chemically synthesized
agcccctcctccttcagagc

SEQ ID NO: 102 - DNA, 20 bp, Artificial Sequence
  chemically synthesized
gcccctcctccttcagagcc

SEQ ID NO: 103 - DNA, 20 bp, Artificial Sequence
  chemically synthesized
ccctcctccttcagagccag

SEQ ID NO: 104 - DNA, 20 bp, Artificial Sequence
  chemically synthesized
tccttcagagccaggagtcc

SEQ ID NO: 105 - DNA, 20 bp, Artificial Sequence
  chemically synthesized
gagccaggagtcctggcccc

SEQ ID NO: 106 - DNA, 20 bp, Artificial Sequence
  chemically synthesized
agcccctcctgccttaaacc

SEQ ID NO: 107 - DNA, 20 bp, Artificial Sequence
  chemically synthesized
cctcctgccttaaacccagc

SEQ ID NO: 108 - DNA, 20 bp, Artificial Sequence
  chemically synthesized
ctcctgccttaaacccagcc

SEQ ID NO: 109 - DNA, 20 bp, Artificial Sequence
  chemically synthesized
aaacccagccaggtccttcc

SEQ ID NO: 110 - DNA, 20 bp, Artificial Sequence
  chemically synthesized
aacccagccaggtccttcca

SEQ ID NO: 111 - DNA, 20 bp, Artificial Sequence
  chemically synthesized
acccagccaggtccttccaa

SEQ ID NO: 112 - DNA, 20 bp, Artificial Sequence
  chemically synthesized
gccaggtccttccaagggtc

SEQ ID NO: 113 - DNA, 20 bp, Artificial Sequence
  chemically synthesized
gtccttccaagggtcaagct

SEQ ID NO: 114 - DNA, 20 bp, Artificial Sequence
  chemically synthesized
gtcaagctcggaaaccaccc

SEQ ID NO: 115 - DNA, 20 bp, Artificial Sequence
  chemically synthesized
aagctcggaaaccaccccag

SEQ ID NO: 116 - DNA, 20 bp, Artificial Sequence
  chemically synthesized
ccaccccagcagatactctg

SEQ ID NO: 117 - DNA, 20 bp, Artificial Sequence
  chemically synthesized
caccccagcagatactctgc

SEQ ID NO: 118 - DNA, 20 bp, Artificial Sequence
  chemically synthesized
gcagatactctgcaggaacg

SEQ ID NO: 119 - DNA, 20 bp, Artificial Sequence
  chemically synthesized
actctgcaggaacgaagccg

SEQ ID NO: 120 - DNA, 20 bp, Artificial Sequence
  chemically synthesized
ctctgcaggaacgaagccgt

SEQ ID NO: 121 - DNA, 20 bp, Artificial Sequence
  chemically synthesized
caggaacgaagccgtgggcc

SEQ ID NO: 122 - DNA, 20 bp, Artificial Sequence
  chemically synthesized
aggaacgaagccgtgggccc

SEQ ID NO: 123 - DNA, 20 bp, Artificial Sequence
  chemically synthesized
ggaacgaagccgtgggccca

SEQ ID NO: 124 - DNA, 20 bp, Artificial Sequence
  chemically synthesized
gccgtgggcccagggctatg

SEQ ID NO: 125 - DNA, 20 bp, Artificial Sequence
  chemically synthesized
ccgtgggcccagggctatgc

SEQ ID NO: 126 - DNA, 20 bp, Artificial Sequence
  chemically synthesized
cgtgggcccagggctatgca

SEQ ID NO: 127 - DNA, 20 bp, Artificial Sequence
  chemically synthesized
gggcccagggctatgcaggg

SEQ ID NO: 128 - DNA, 20 bp, Artificial Sequence
  chemically synthesized
gcccagggctatgcagggtg

SEQ ID NO: 129 - DNA, 20 bp, Artificial Sequence
  chemically synthesized
cccagggctatgcagggtgg

SEQ ID NO: 130 - DNA, 20 bp, Artificial Sequence
  chemically synthesized
agggctatgcagggtggagg

SEQ ID NO: 131 - DNA, 20 bp, Artificial Sequence
  chemically synthesized
gggctatgcagggtggagga

SEQ ID NO: 132 - DNA, 20 bp, Artificial Sequence
  chemically synthesized
ggaggaaggccaccctgtgc

SEQ ID NO: 133 - DNA, 20 bp, Artificial Sequence
  chemically synthesized
gaggaaggccaccctgtgct

SEQ ID NO: 134 - DNA, 20 bp, Artificial Sequence
  chemically synthesized
aaggccaccctgtgctggga

SEQ ID NO: 135 - DNA, 20 bp, Artificial Sequence
  chemically synthesized
accctgtgctgggacagact

SEQ ID NO: 136 - DNA, 20 bp, Artificial Sequence
  chemically synthesized
ccctgtgctgggacagactc

SEQ ID NO: 137 - DNA, 20 bp, Artificial Sequence
  chemically synthesized
cctgtgctgggacagactca

SEQ ID NO: 138 - DNA, 20 bp, Artificial Sequence
  chemically synthesized
ctgtgctgggacagactcag

SEQ ID NO: 139 - DNA, 20 bp, Artificial Sequence
  chemically synthesized
ctgggacagactcaggggcc

SEQ ID NO: 140 - DNA, 20 bp, Artificial Sequence
  chemically synthesized
tgggacagactcaggggcct

SEQ ID NO: 141 - DNA, 20 bp, Artificial Sequence
  chemically synthesized
gacagactcaggggcctggg

SEQ ID NO: 142 - DNA, 20 bp, Artificial Sequence
  chemically synthesized
acagactcaggggcctgggc

SEQ ID NO: 143 - DNA, 20 bp, Artificial Sequence
  chemically synthesized
aggggcctgggcgggactcc

SEQ ID NO: 144 - DNA, 20 bp, Artificial Sequence
  chemically synthesized
gggcctgggcgggactccca

SEQ ID NO: 145 - DNA, 20 bp, Artificial Sequence
  chemically synthesized
ggcctgggcgggactcccag

SEQ ID NO: 146 - DNA, 20 bp, Artificial Sequence
  chemically synthesized
gcctgggcgggactcccaga

SEQ ID NO: 147 - DNA, 20 bp, Artificial Sequence
  chemically synthesized
cctgggcgggactcccagag

SEQ ID NO: 148 - DNA, 20 bp, Artificial Sequence
  chemically synthesized
ggcgggactcccagaggggt

SEQ ID NO: 149 - DNA, 20 bp, Artificial Sequence
  chemically synthesized
ggactcccagaggggtgaga

SEQ ID NO: 150 - DNA, 20 bp, Artificial Sequence
  chemically synthesized
cagctgcacacctgtgtgcc

SEQ ID NO: 151 - DNA, 20 bp, Artificial Sequence
  chemically synthesized
agctgcacacctgtgtgcct

SEQ ID NO: 152 - DNA, 20 bp, Artificial Sequence
  chemically synthesized
acacctgtgtgcctgggccc

SEQ ID NO: 153 - DNA, 20 bp, Artificial Sequence
  chemically synthesized
cacctgtgtgcctgggcccc

SEQ ID NO: 154 - DNA, 20 bp, Artificial Sequence
  chemically synthesized
ggccccaggctgtcacactc

SEQ ID NO: 155 - DNA, 20 bp, Artificial Sequence
  chemically synthesized
ctgtcacactccagttcact

SEQ ID NO: 156 - DNA, 20 bp, Artificial Sequence
  chemically synthesized
tgtcacactccagttcactg

SEQ ID NO: 157 - DNA, 20 bp, Artificial Sequence
  chemically synthesized
tcactgaggccccctctgca

SEQ ID NO: 158 - DNA, 20 bp, Artificial Sequence
  chemically synthesized
cactgaggccccctctgcac

SEQ ID NO: 159 - DNA, 20 bp, Artificial Sequence
  chemically synthesized
actgaggccccctctgcacg

SEQ ID NO: 160 - DNA, 20 bp, Artificial Sequence
  chemically synthesized
cccctctgcacggggccctg

SEQ ID NO: 161 - DNA, 20 bp, Artificial Sequence
  chemically synthesized
tctgcacggggccctgcagc

SEQ ID NO: 162 - DNA, 20 bp, Artificial Sequence
  chemically synthesized
ctgcacggggccctgcagcc

SEQ ID NO: 163 - DNA, 20 bp, Artificial Sequence
  chemically synthesized
tgcacggggccctgcagcca

SEQ ID NO: 164 - DNA, 20 bp, Artificial Sequence
  chemically synthesized
gcacggggccctgcagccag

SEQ ID NO: 165 - DNA, 20 bp, Artificial Sequence
  chemically synthesized
cctgcagccaggggctgaca

SEQ ID NO: 166 - DNA, 20 bp, Artificial Sequence
  chemically synthesized
ctgcagccaggggctgacac

SEQ ID NO: 167 - DNA, 20 bp, Artificial Sequence
  chemically synthesized
accgtttctcattcttccct

SEQ ID NO: 168 - DNA, 20 bp, Artificial Sequence
  chemically synthesized
ccgtttctcattcttccctt

SEQ ID NO: 169 - DNA, 20 bp, Artificial Sequence
  chemically synthesized
cgtttctcattcttccctta

SEQ ID NO: 170 - DNA, 20 bp, Artificial Sequence
  chemically synthesized
gtttctcattcttcccttag

SEQ ID NO: 171 - DNA, 20 bp, Artificial Sequence
  chemically synthesized
tcccttaggggtccaaaact

SEQ ID NO: 172 - DNA, 20 bp, Artificial Sequence
  chemically synthesized
cccttaggggtccaaaactt

SEQ ID NO: 173 - DNA, 20 bp, Artificial Sequence
  chemically synthesized
ccttaggggtccaaaacttg

SEQ ID NO: 174 - DNA, 20 bp, Artificial Sequence
  chemically synthesized
cttaggggtccaaaacttgg

SEQ ID NO: 175 - DNA, 20 bp, Artificial Sequence
  chemically synthesized
ttaggggtccaaaacttggg

SEQ ID NO: 176 - DNA, 20 bp, Artificial Sequence
  chemically synthesized
tccaaaacttggggggacaa

SEQ ID NO: 177 - DNA, 20 bp, Artificial Sequence
  chemically synthesized
acttggggggacaaaagccg

SEQ ID NO: 178 - DNA, 20 bp, Artificial Sequence
  chemically synthesized
gggggacaaaagccgaagtc

SEQ ID NO: 179 - DNA, 20 bp, Artificial Sequence
  chemically synthesized
ggggacaaaagccgaagtcc

SEQ ID NO: 180 - DNA, 20 bp, Artificial Sequence
  chemically synthesized
gggacaaaagccgaagtcca

SEQ ID NO: 181 - DNA, 20 bp, Artificial Sequence
  chemically synthesized
ggacaaaagccgaagtccag

SEQ ID NO: 182 - DNA, 20 bp, Artificial Sequence
  chemically synthesized
gacaaaagccgaagtccagg

SEQ ID NO: 183 - DNA, 20 bp, Artificial Sequence
  chemically synthesized
aaagccgaagtccagggggt

SEQ ID NO: 184 - DNA, 20 bp, Artificial Sequence
  chemically synthesized
agccgaagtccagggggtcg

SEQ ID NO: 185 - DNA, 20 bp, Artificial Sequence
  chemically synthesized
gccgaagtccagggggtcgg

SEQ ID NO: 186 - DNA, 20 bp, Artificial Sequence
  chemically synthesized
cgaagtccagggggtcggag

SEQ ID NO: 187 - DNA, 20 bp, Artificial Sequence
  chemically synthesized
gaagtccagggggtcggagg

SEQ ID NO: 188 - DNA, 20 bp, Artificial Sequence
  chemically synthesized
aagtccagggggtcggagga

SEQ ID NO: 189 - DNA, 20 bp, Artificial Sequence
  chemically synthesized
gtcggaggagggacttgccc

SEQ ID NO: 190 - DNA, 20 bp, Artificial Sequence
  chemically synthesized
tcggaggagggacttgcccc

SEQ ID NO: 191 - DNA, 20 bp, Artificial Sequence
  chemically synthesized
gggacttgccccaggccttg

SEQ ID NO: 192 - DNA, 20 bp, Artificial Sequence
  chemically synthesized
gccccaggccttgtggacac

SEQ ID NO: 193 - DNA, 20 bp, Artificial Sequence
  chemically synthesized
ccccaggccttgtggacact

SEQ ID NO: 194 - DNA, 20 bp, Artificial Sequence
  chemically synthesized
caggccttgtggacactggg

SEQ ID NO: 195 - DNA, 20 bp, Artificial Sequence
  chemically synthesized
aggccttgtggacactgggt

SEQ ID NO: 196 - DNA, 20 bp, Artificial Sequence
  chemically synthesized
tgtggacactgggtgggctc

SEQ ID NO: 197 - DNA, 20 bp, Artificial Sequence
  chemically synthesized
gtggacactgggtgggctcc

SEQ ID NO: 198 - DNA, 20 bp, Artificial Sequence
  chemically synthesized
gtgggctccgggacctgaac

SEQ ID NO: 199 - DNA, 20 bp, Artificial Sequence
  chemically synthesized
gggctccgggacctgaactg

SEQ ID NO: 200 - DNA, 20 bp, Artificial Sequence
  chemically synthesized
ccgggacctgaactggagct

SEQ ID NO: 201 - DNA, 20 bp, Artificial Sequence
  chemically synthesized
cgggacctgaactggagctg

SEQ ID NO: 202 - DNA, 20 bp, Artificial Sequence
  chemically synthesized
gacctgaactggagctgagg

SEQ ID NO: 203 - DNA, 20 bp, Artificial Sequence
  chemically synthesized
acctgaactggagctgagga

SEQ ID NO: 204 - DNA, 20 bp, Artificial Sequence
  chemically synthesized
ctgaactggagctgaggaag

SEQ ID NO: 205 - DNA, 20 bp, Artificial Sequence
  chemically synthesized
ctggagctgaggaaggagtg

SEQ ID NO: 206 - DNA, 20 bp, Artificial Sequence
  chemically synthesized
aaggagtgaagctaaactcc

SEQ ID NO: 207 - DNA, 20 bp, Artificial Sequence
  chemically synthesized
aagctaaactcctagatcca

SEQ ID NO: 208 - DNA, 20 bp, Artificial Sequence
  chemically synthesized
agctaaactcctagatccac

SEQ ID NO: 209 - DNA, 20 bp, Artificial Sequence
  chemically synthesized
cacgggataaattacccccc

SEQ ID NO: 210 - DNA, 20 bp, Artificial Sequence
  chemically synthesized
ccaagtccctcacctctcca

SEQ ID NO: 211 - DNA, 20 bp, Artificial Sequence
  chemically synthesized
cctctccaaagctgcccatc

SEQ ID NO: 212 - DNA, 20 bp, Artificial Sequence
  chemically synthesized
tctccaaagctgcccatctg

SEQ ID NO: 213 - DNA, 20 bp, Artificial Sequence
  chemically synthesized
ctccaaagctgcccatctgg

SEQ ID NO: 214 - DNA, 20 bp, Artificial Sequence
  chemically synthesized
ccaaagctgcccatctggag

SEQ ID NO: 215 - DNA, 20 bp, Artificial Sequence
  chemically synthesized
caaagctgcccatctggagg

SEQ ID NO: 216 - DNA, 20 bp, Artificial Sequence
  chemically synthesized
agctgcccatctggaggagg

SEQ ID NO: 217 - DNA, 20 bp, Artificial Sequence
  chemically synthesized
gctgcccatctggaggaggc

SEQ ID NO: 218 - DNA, 20 bp, Artificial Sequence
  chemically synthesized
tgcccatctggaggaggcgg

SEQ ID NO: 219 - DNA, 20 bp, Artificial Sequence
  chemically synthesized
gcccatctggaggaggcggg

SEQ ID NO: 220 - DNA, 20 bp, Artificial Sequence
  chemically synthesized
cccatctggaggaggcggga

SEQ ID NO: 221 - DNA, 20 bp, Artificial Sequence
  chemically synthesized
catctggaggaggcgggagg

SEQ ID NO: 222 - DNA, 20 bp, Artificial Sequence
  chemically synthesized
aggaggcgggagggagctac

SEQ ID NO: 223 - DNA, 20 bp, Artificial Sequence
  chemically synthesized
ggaggcgggagggagctacg

SEQ ID NO: 224 - DNA, 20 bp, Artificial Sequence
  chemically synthesized
gaggcgggagggagctacga

SEQ ID NO: 225 - DNA, 20 bp, Artificial Sequence
  chemically synthesized
gggagggagctacgagggcc

SEQ ID NO: 226 - DNA, 20 bp, Artificial Sequence
  chemically synthesized
gagggagctacgagggccaa

SEQ ID NO: 227 - DNA, 20 bp, Artificial Sequence
  chemically synthesized
gctacgagggccaagagcat

SEQ ID NO: 228 - DNA, 20 bp, Artificial Sequence
  chemically synthesized
ctacgagggccaagagcatg

SEQ ID NO: 229 - DNA, 20 bp, Artificial Sequence
  chemically synthesized
gggccaagagcatgaggtca

SEQ ID NO: 230 - DNA, 20 bp, Artificial Sequence
  chemically synthesized
agcatgaggtcatggaaact

SEQ ID NO: 231 - DNA, 20 bp, Artificial Sequence
  chemically synthesized
gcatgaggtcatggaaactc

SEQ ID NO: 232 - DNA, 20 bp, Artificial Sequence
  chemically synthesized
tcatggaaactcgggctgtg

SEQ ID NO: 233 - DNA, 20 bp, Artificial Sequence
  chemically synthesized
catggaaactcgggctgtga

SEQ ID NO: 234 - DNA, 20 bp, Artificial Sequence
  chemically synthesized
atggaaactcgggctgtgaa

SEQ ID NO: 235 - DNA, 20 bp, Artificial Sequence
  chemically synthesized
tggaaactcgggctgtgaag

SEQ ID NO: 236 - DNA, 20 bp, Artificial Sequence
  chemically synthesized
tgaaggggccgcacgtgccc

SEQ ID NO: 237 - DNA, 20 bp, Artificial Sequence
  chemically synthesized
gaaggggccgcacgtgccct

SEQ ID NO: 238 - DNA, 20 bp, Artificial Sequence
  chemically synthesized
ggccgcacgtgccctgggaa

SEQ ID NO: 239 - DNA, 20 bp, Artificial Sequence
  chemically synthesized
gccgcacgtgccctgggaac

SEQ ID NO: 240 - DNA, 20 bp, Artificial Sequence
  chemically synthesized
ccctgggaacgggatgaact

SEQ ID NO: 241 - DNA, 20 bp, Artificial Sequence
  chemically synthesized
tcggctcgtttatttccacc

SEQ ID NO: 242 - DNA, 20 bp, Artificial Sequence
  chemically synthesized
ttatttccacccagttgtca

SEQ ID NO: 243 - DNA, 20 bp, Artificial Sequence
  chemically synthesized
ccacccagttgtcatggcga

SEQ ID NO: 244 - DNA, 20 bp, Artificial Sequence
  chemically synthesized
cacccagttgtcatggcgat

SEQ ID NO: 245 - DNA, 20 bp, Artificial Sequence
  chemically synthesized
acccagttgtcatggcgata

SEQ ID NO: 246 - DNA, 20 bp, Artificial Sequence
  chemically synthesized
cccagttgtcatggcgatag

SEQ ID NO: 247 - DNA, 20 bp, Artificial Sequence
  chemically synthesized
cagttgtcatggcgataggg

SEQ ID NO: 248 - DNA, 20 bp, Artificial Sequence
  chemically synthesized
agttgtcatggcgatagggg

SEQ ID NO: 249 - DNA, 20 bp, Artificial Sequence
  chemically synthesized
gttgtcatggcgatagggga

SEQ ID NO: 250 - DNA, 20 bp, Artificial Sequence
  chemically synthesized
ttgtcatggcgataggggag

SEQ ID NO: 251 - DNA, 20 bp, Artificial Sequence
  chemically synthesized
tgtcatggcgataggggagg

SEQ ID NO: 252 - DNA, 20 bp, Artificial Sequence
  chemically synthesized
gtcatggcgataggggaggg

SEQ ID NO: 253 - DNA, 20 bp, Artificial Sequence
  chemically synthesized
tggcgataggggaggggggc

SEQ ID NO: 254 - DNA, 20 bp, Artificial Sequence
  chemically synthesized
ggcgataggggaggggggca

SEQ ID NO: 255 - DNA, 20 bp, Artificial Sequence
  chemically synthesized
cgataggggaggggggcaag

SEQ ID NO: 256 - DNA, 20 bp, Artificial Sequence
  chemically synthesized
ataggggaggggggcaagga

SEQ ID NO: 257 - DNA, 20 bp, Artificial Sequence
  chemically synthesized
gaggggggcaaggagagcaa

SEQ ID NO: 258 - DNA, 20 bp, Artificial Sequence
  chemically synthesized
aggggggcaaggagagcaat

SEQ ID NO: 259 - DNA, 20 bp, Artificial Sequence
  chemically synthesized
gcaatgggcctttccctttc

SEQ ID NO: 260 - DNA, 20 bp, Artificial Sequence
  chemically synthesized
caatgggcctttccctttca

SEQ ID NO: 261 - DNA, 20 bp, Artificial Sequence
  chemically synthesized
ttccctttcaaggacctgcc

SEQ ID NO: 262 - DNA, 20 bp, Artificial Sequence
  chemically synthesized
tttcaaggacctgcccagta

SEQ ID NO: 263 - DNA, 20 bp, Artificial Sequence
  chemically synthesized
ttcaaggacctgcccagtac

SEQ ID NO: 264 - DNA, 20 bp, Artificial Sequence
  chemically synthesized
cagtacaggcatccctgtga

SEQ ID NO: 265 - DNA, 20 bp, Artificial Sequence
  chemically synthesized
catccctgtgaaagatgcct

SEQ ID NO: 266 - DNA, 20 bp, Artificial Sequence
  chemically synthesized
atccctgtgaaagatgcctg

SEQ ID NO: 267 - DNA, 20 bp, Artificial Sequence
  chemically synthesized
tgtgaaagatgcctgaggcc

SEQ ID NO: 268 - DNA, 20 bp, Artificial Sequence
  chemically synthesized
gtgaaagatgcctgaggcct

SEQ ID NO: 269 - DNA, 20 bp, Artificial Sequence
  chemically synthesized
gatgcctgaggcctgggcac

SEQ ID NO: 270 - DNA, 20 bp, Artificial Sequence
  chemically synthesized
atgcctgaggcctgggcacc

SEQ ID NO: 271 - DNA, 20 bp, Artificial Sequence
  chemically synthesized
tgcctgaggcctgggcacca

SEQ ID NO: 272 - DNA, 20 bp, Artificial Sequence
  chemically synthesized
ggcctgggcaccagggactc

SEQ ID NO: 273 - DNA, 20 bp, Artificial Sequence
  chemically synthesized
cctgggcaccagggactcca

SEQ ID NO: 274 - DNA, 20 bp, Artificial Sequence
  chemically synthesized
gcaccagggactccagagtc

SEQ ID NO: 275 - DNA, 20 bp, Artificial Sequence
  chemically synthesized
caccagggactccagagtcc

SEQ ID NO: 276 - DNA, 20 bp, Artificial Sequence
  chemically synthesized
caacccctccccattcaacc

SEQ ID NO: 277 - DNA, 20 bp, Artificial Sequence
  chemically synthesized
aacccctccccattcaaccc

SEQ ID NO: 278 - DNA, 20 bp, Artificial Sequence
  chemically synthesized
cccctccccattcaacccag

SEQ ID NO: 279 - DNA, 20 bp, Artificial Sequence
  chemically synthesized
ccctccccattcaacccagg

SEQ ID NO: 280 - DNA, 20 bp, Artificial Sequence
  chemically synthesized
ccccattcaacccaggaggc

SEQ ID NO: 281 - DNA, 20 bp, Artificial Sequence
  chemically synthesized
cccattcaacccaggaggcc

SEQ ID NO: 282 - DNA, 20 bp, Artificial Sequence
  chemically synthesized
caacccaggaggccaggccc

SEQ ID NO: 283 - DNA, 20 bp, Artificial Sequence
  chemically synthesized
ggccccagcccttccgccct

SEQ ID NO: 284 - DNA, 20 bp, Artificial Sequence
  chemically synthesized
agcccttccgccctcagatg

SEQ ID NO: 285 - DNA, 20 bp, Artificial Sequence
  chemically synthesized
gcccttccgccctcagatga

SEQ ID NO: 286 - DNA, 20 bp, Artificial Sequence
  chemically synthesized
ccttccgccctcagatgaag

SEQ ID NO: 287 - DNA, 20 bp, Artificial Sequence
  chemically synthesized
cgccctcagatgaaggagtc

SEQ ID NO: 288 - DNA, 20 bp, Artificial Sequence
  chemically synthesized
gccctcagatgaaggagtcc

SEQ ID NO: 289 - DNA, 20 bp, Artificial Sequence
  chemically synthesized
gatgaaggagtccaggcccc

SEQ ID NO: 290 - DNA, 20 bp, Artificial Sequence
  chemically synthesized
gcccccagcctctccccatt

SEQ ID NO: 291 - DNA, 20 bp, Artificial Sequence
  chemically synthesized
agcctctccccattcagacc

SEQ ID NO: 292 - DNA, 20 bp, Artificial Sequence
  chemically synthesized
gcctctccccattcagaccc

SEQ ID NO: 293 - DNA, 20 bp, Artificial Sequence
  chemically synthesized
cctctccccattcagaccca

SEQ ID NO: 294 - DNA, 20 bp, Artificial Sequence
  chemically synthesized
ctctccccattcagacccag

SEQ ID NO: 295 - DNA, 20 bp, Artificial Sequence
  chemically synthesized
cccattcagacccaggggtc

SEQ ID NO: 296 - DNA, 20 bp, Artificial Sequence
  chemically synthesized
ccattcagacccaggggtcc

SEQ ID NO: 297 - DNA, 20 bp, Artificial Sequence
  chemically synthesized
cagacccaggggtccaggcc

SEQ ID NO: 298 - DNA, 20 bp, Artificial Sequence
  chemically synthesized
aggcccagccccgcctccct

SEQ ID NO: 299 - DNA, 20 bp, Artificial Sequence
  chemically synthesized
agccccgcctccctaagacc

SEQ ID NO: 300 - DNA, 20 bp, Artificial Sequence
  chemically synthesized
cccgcctccctaagacccag

SEQ ID NO: 301 - DNA, 20 bp, Artificial Sequence
  chemically synthesized
ctccctaagacccagaagtc

SEQ ID NO: 302 - DNA, 20 bp, Artificial Sequence
  chemically synthesized
tccctaagacccagaagtcc

SEQ ID NO: 303 - DNA, 20 bp, Artificial Sequence
  chemically synthesized
gacccagaagtccaggcccc

SEQ ID NO: 304 - DNA, 20 bp, Artificial Sequence
  chemically synthesized
gcccccagcccctcctccct

SEQ ID NO: 305 - DNA, 20 bp, Artificial Sequence
  chemically synthesized
ccctcctccctcagacccac

SEQ ID NO: 306 - DNA, 20 bp, Artificial Sequence
  chemically synthesized
ctccctcagacccacgagtc

SEQ ID NO: 307 - DNA, 20 bp, Artificial Sequence
  chemically synthesized
tccctcagacccacgagtcc

SEQ ID NO: 308 - DNA, 20 bp, Artificial Sequence
  chemically synthesized
agacccacgagtccaggccc

SEQ ID NO: 309 - DNA, 20 bp, Artificial Sequence
  chemically synthesized
ggccccagcccctcctccct

SEQ ID NO: 310 - DNA, 20 bp, Artificial Sequence
  chemically synthesized
agcccctcctccctcggacc

SEQ ID NO: 311 - DNA, 20 bp, Artificial Sequence
  chemically synthesized
gcccctcctccctcggaccc

SEQ ID NO: 312 - DNA, 20 bp, Artificial Sequence
  chemically synthesized
ccctcctccctcggacccag

SEQ ID NO: 313 - DNA, 20 bp, Artificial Sequence
  chemically synthesized
ctccctcggacccaggagtc

SEQ ID NO: 314 - DNA, 20 bp, Artificial Sequence
  chemically synthesized
tccctcggacccaggagtcc

SEQ ID NO: 315 - DNA, 20 bp, Artificial Sequence
  chemically synthesized
gacccaggagtccaggcccc

SEQ ID NO: 316 - DNA, 20 bp, Artificial Sequence
  chemically synthesized
gcccccagtccctccaccct

SEQ ID NO: 317 - DNA, 20 bp, Artificial Sequence
  chemically synthesized
agtccctccaccctcagacc

SEQ ID NO: 318 - DNA, 20 bp, Artificial Sequence
  chemically synthesized
gtccctccaccctcagaccc

SEQ ID NO: 319 - DNA, 20 bp, Artificial Sequence
  chemically synthesized
ccctccaccctcagacccag

SEQ ID NO: 320 - DNA, 20 bp, Artificial Sequence
  chemically synthesized
caccctcagacccaggagtc

SEQ ID NO: 321 - DNA, 20 bp, Artificial Sequence
  chemically synthesized
accctcagacccaggagtcc

SEQ ID NO: 322 - DNA, 20 bp, Artificial Sequence
  chemically synthesized
agacccaggagtccaggccc

SEQ ID NO: 323 - DNA, 20 bp, Artificial Sequence
  chemically synthesized
ggccccagcccctcctccct

SEQ ID NO: 324 - DNA, 20 bp, Artificial Sequence
  chemically synthesized
agcccctcctccctcggacc

SEQ ID NO: 325 - DNA, 20 bp, Artificial Sequence
  chemically synthesized
gcccctcctccctcggaccc

SEQ ID NO: 326 - DNA, 20 bp, Artificial Sequence
  chemically synthesized
ccctcctccctcggacccag

SEQ ID NO: 327 - DNA, 20 bp, Artificial Sequence
  chemically synthesized
ctccctcggacccaggagtc

SEQ ID NO: 328 - DNA, 20 bp, Artificial Sequence
  chemically synthesized
tccctcggacccaggagtcc

SEQ ID NO: 329 - DNA, 20 bp, Artificial Sequence
  chemically synthesized
ggacccaggagtccaggccc

SEQ ID NO: 330 - DNA, 20 bp, Artificial Sequence
  chemically synthesized
agcccctcctctctcaaacc

SEQ ID NO: 331 - DNA, 20 bp, Artificial Sequence
  chemically synthesized
gcccctcctctctcaaaccc

SEQ ID NO: 332 - DNA, 20 bp, Artificial Sequence
  chemically synthesized
ccctcctctctcaaacccag

SEQ ID NO: 333 - DNA, 20 bp, Artificial Sequence
  chemically synthesized
ctctctcaaacccaggagcc

SEQ ID NO: 334 - DNA, 20 bp, Artificial Sequence
  chemically synthesized
tctctcaaacccaggagccc

SEQ ID NO: 335 - DNA, 20 bp, Artificial Sequence
  chemically synthesized
aacccaggagcccaggcccc

SEQ ID NO: 336 - DNA, 20 bp, Artificial Sequence
  chemically synthesized
gcccccagctcttctctgtt

SEQ ID NO: 337 - DNA, 20 bp, Artificial Sequence
  chemically synthesized
gctcttctctgttcagccct

SEQ ID NO: 338 - DNA, 20 bp, Artificial Sequence
  chemically synthesized
ctgttcagccctaagaatcc

SEQ ID NO: 339 - DNA, 20 bp, Artificial Sequence
  chemically synthesized
agccctaagaatcctggctc

SEQ ID NO: 340 - DNA, 20 bp, Artificial Sequence
  chemically synthesized
ggctccagcccctcctactc

SEQ ID NO: 341 - DNA, 20 bp, Artificial Sequence
  chemically synthesized
tactctagcccccaaccccc

SEQ ID NO: 342 - DNA, 20 bp, Artificial Sequence
  chemically synthesized
cccccaaccccctagccact

SEQ ID NO: 343 - DNA, 20 bp, Artificial Sequence
  chemically synthesized
ccccaaccccctagccacta

SEQ ID NO: 344 - DNA, 20 bp, Artificial Sequence
  chemically synthesized
cccctagccactaaggcaat

SEQ ID NO: 345 - DNA, 20 bp, Artificial Sequence
  chemically synthesized
ccctagccactaaggcaatt

SEQ ID NO: 346 - DNA, 20 bp, Artificial Sequence
  chemically synthesized
cctagccactaaggcaattg

SEQ ID NO: 347 - DNA, 20 bp, Artificial Sequence
  chemically synthesized
ccactaaggcaattggggtg

SEQ ID NO: 348 - DNA, 20 bp, Artificial Sequence
  chemically synthesized
cactaaggcaattggggtgc

SEQ ID NO: 349 - DNA, 20 bp, Artificial Sequence
  chemically synthesized
aggcaattggggtgcaggaa

SEQ ID NO: 350 - DNA, 20 bp, Artificial Sequence
  chemically synthesized
ggcaattggggtgcaggaat

SEQ ID NO: 351 - DNA, 20 bp, Artificial Sequence
  chemically synthesized
gcaattggggtgcaggaatg

SEQ ID NO: 352 - DNA, 20 bp, Artificial Sequence
  chemically synthesized
caattggggtgcaggaatgg

SEQ ID NO: 353 - DNA, 20 bp, Artificial Sequence
  chemically synthesized
ttggggtgcaggaatggggg

SEQ ID NO: 354 - DNA, 20 bp, Artificial Sequence
  chemically synthesized
tggggtgcaggaatgggggc

SEQ ID NO: 355 - DNA, 20 bp, Artificial Sequence
  chemically synthesized
ggggtgcaggaatgggggca

SEQ ID NO: 356 - DNA, 20 bp, Artificial Sequence
  chemically synthesized
caggaatgggggcagggtac

SEQ ID NO: 357 - DNA, 20 bp, Artificial Sequence
  chemically synthesized
ggcagggtaccagcctcacc

SEQ ID NO: 358 - DNA, 20 bp, Artificial Sequence
  chemically synthesized
agggtaccagcctcaccaag

SEQ ID NO: 359 - DNA, 20 bp, Artificial Sequence
  chemically synthesized
aagtggttgataaacccacg

SEQ ID NO: 360 - DNA, 20 bp, Artificial Sequence
  chemically synthesized
agtggttgataaacccacgt

SEQ ID NO: 361 - DNA, 20 bp, Artificial Sequence
  chemically synthesized
gtggttgataaacccacgtg

SEQ ID NO: 362 - DNA, 20 bp, Artificial Sequence
  chemically synthesized
aaacccacgtggggtaccct

SEQ ID NO: 363 - DNA, 20 bp, Artificial Sequence
  chemically synthesized
cgtggggtaccctaagaact

SEQ ID NO: 364 - DNA, 20 bp, Artificial Sequence
  chemically synthesized
gtggggtaccctaagaactt

SEQ ID NO: 365 - DNA, 20 bp, Artificial Sequence
  chemically synthesized
gtaccctaagaacttgggaa

SEQ ID NO: 366 - DNA, 20 bp, Artificial Sequence
  chemically synthesized
taagaacttgggaacagcca

SEQ ID NO: 367 - DNA, 20 bp, Artificial Sequence
  chemically synthesized
gaacttgggaacagccacag

SEQ ID NO: 368 - DNA, 20 bp, Artificial Sequence
  chemically synthesized
aacttgggaacagccacagc

SEQ ID NO: 369 - DNA, 20 bp, Artificial Sequence
  chemically synthesized
acttgggaacagccacagca

SEQ ID NO: 370 - DNA, 20 bp, Artificial Sequence
  chemically synthesized
cttgggaacagccacagcag

SEQ ID NO: 371 - DNA, 20 bp, Artificial Sequence
  chemically synthesized
ttgggaacagccacagcagg

SEQ ID NO: 372 - DNA, 20 bp, Artificial Sequence
  chemically synthesized
tgggaacagccacagcaggg

SEQ ID NO: 373 - DNA, 20 bp, Artificial Sequence
  chemically synthesized
cacagcaggggggcgatgct

SEQ ID NO: 374 - DNA, 20 bp, Artificial Sequence
  chemically synthesized
acagcaggggggcgatgctt

SEQ ID NO: 375 - DNA, 20 bp, Artificial Sequence
  chemically synthesized
cagcaggggggcgatgcttg

SEQ ID NO: 376 - DNA, 20 bp, Artificial Sequence
  chemically synthesized
gcgatgcttggggacctgcc

SEQ ID NO: 377 - DNA, 20 bp, Artificial Sequence
  chemically synthesized
gatgcttggggacctgcctg

SEQ ID NO: 378 - DNA, 20 bp, Artificial Sequence
  chemically synthesized
gcttggggacctgcctggag

SEQ ID NO: 379 - DNA, 20 bp, Artificial Sequence
  chemically synthesized
cttggggacctgcctggaga

SEQ ID NO: 380 - DNA, 20 bp, Artificial Sequence
  chemically synthesized
gacctgcctggagaaggatg

SEQ ID NO: 381 - DNA, 20 bp, Artificial Sequence
  chemically synthesized
acctgcctggagaaggatgc

SEQ ID NO: 382 - DNA, 20 bp, Artificial Sequence
  chemically synthesized
cctggagaaggatgcaggac

SEQ ID NO: 383 - DNA, 20 bp, Artificial Sequence
  chemically synthesized
aggatgcaggacgagaaaca

SEQ ID NO: 384 - DNA, 20 bp, Artificial Sequence
  chemically synthesized
caggacgagaaacacagccc

SEQ ID NO: 385 - DNA, 20 bp, Artificial Sequence
  chemically synthesized
aggacgagaaacacagcccc

SEQ ID NO: 386 - DNA, 20 bp, Artificial Sequence
  chemically synthesized
acgagaaacacagccccagg

SEQ ID NO: 387 - DNA, 20 bp, Artificial Sequence
  chemically synthesized
gagaaacacagccccaggtg

SEQ ID NO: 388 - DNA, 20 bp, Artificial Sequence
  chemically synthesized
acagccccaggtggagaaac

SEQ ID NO: 389 - DNA, 20 bp, Artificial Sequence
  chemically synthesized
ccccaggtggagaaactggc

SEQ ID NO: 390 - DNA, 20 bp, Artificial Sequence
  chemically synthesized
cccaggtggagaaactggcc

SEQ ID NO: 391 - DNA, 20 bp, Artificial Sequence
  chemically synthesized
ggagaaactggccgggaatc

SEQ ID NO: 392 - DNA, 20 bp, Artificial Sequence
  chemically synthesized
agaaactggccgggaatcaa

SEQ ID NO: 393 - DNA, 20 bp, Artificial Sequence
  chemically synthesized
gccgggaatcaagagtcacc

SEQ ID NO: 394 - DNA, 20 bp, Artificial Sequence
  chemically synthesized
cgggaatcaagagtcaccca

SEQ ID NO: 395 - DNA, 20 bp, Artificial Sequence
  chemically synthesized
aatcaagagtcacccagaga

SEQ ID NO: 396 - DNA, 20 bp, Artificial Sequence
  chemically synthesized
accaaccatccctgttttcc

SEQ ID NO: 397 - DNA, 20 bp, Artificial Sequence
  chemically synthesized
ccaaccatccctgttttcct

SEQ ID NO: 398 - DNA, 20 bp, Artificial Sequence
  chemically synthesized
atccctgttttcctaggact

SEQ ID NO: 399 - DNA, 20 bp, Artificial Sequence
  chemically synthesized
tccctgttttcctaggactg

SEQ ID NO: 400 - DNA, 20 bp, Artificial Sequence
  chemically synthesized
ccctgttttcctaggactga

SEQ ID NO: 401 - DNA, 20 bp, Artificial Sequence
  chemically synthesized
tttcctaggactgagggttt

SEQ ID NO: 402 - DNA, 20 bp, Artificial Sequence
  chemically synthesized
gagggtttcagtgctaaaac

SEQ ID NO: 403 - DNA, 20 bp, Artificial Sequence
  chemically synthesized
agggtttcagtgctaaaact

SEQ ID NO: 404 - DNA, 20 bp, Artificial Sequence
  chemically synthesized
gtgctaaaactaggctgtcc

SEQ ID NO: 405 - DNA, 20 bp, Artificial Sequence
  chemically synthesized
tgctaaaactaggctgtcct

SEQ ID NO: 406 - DNA, 20 bp, Artificial Sequence
  chemically synthesized
actaggctgtcctgggcaaa

SEQ ID NO: 407 - DNA, 20 bp, Artificial Sequence
  chemically synthesized
ctgtcctgggcaaacagcat

SEQ ID NO: 408 - DNA, 20 bp, Artificial Sequence
  chemically synthesized
cctgggcaaacagcataagc

SEQ ID NO: 409 - DNA, 20 bp, Artificial Sequence
  chemically synthesized
taagctggtcaccccacacc

SEQ ID NO: 410 - DNA, 20 bp, Artificial Sequence
  chemically synthesized
acccagacctgacccaaacc

SEQ ID NO: 411 - DNA, 20 bp, Artificial Sequence
  chemically synthesized
aacccagctcccctgcttct

SEQ ID NO: 412 - DNA, 20 bp, Artificial Sequence
  chemically synthesized
gcttcttggccacgtaacct

SEQ ID NO: 413 - DNA, 20 bp, Artificial Sequence
  chemically synthesized
tcttggccacgtaacctgag

SEQ ID NO: 414 - DNA, 20 bp, Artificial Sequence
  chemically synthesized
cttggccacgtaacctgaga

SEQ ID NO: 415 - DNA, 20 bp, Artificial Sequence
  chemically synthesized
ttggccacgtaacctgagaa

SEQ ID NO: 416 - DNA, 20 bp, Artificial Sequence
  chemically synthesized
aatccctcctctctgaaccc

SEQ ID NO: 417 - DNA, 20 bp, Artificial Sequence
  chemically synthesized
cccagcccaccccaatgctc

SEQ ID NO: 418 - DNA, 20 bp, Artificial Sequence
  chemically synthesized
ccagcccaccccaatgctcc

SEQ ID NO: 419 - DNA, 20 bp, Artificial Sequence
  chemically synthesized
ccccaatgctccaggcctcc

SEQ ID NO: 420 - DNA, 20 bp, Artificial Sequence
  chemically synthesized
cccaatgctccaggcctcct

SEQ ID NO: 421 - DNA, 20 bp, Artificial Sequence
  chemically synthesized
aggcctcctgggataccccg

SEQ ID NO: 422 - DNA, 20 bp, Artificial Sequence
  chemically synthesized
gcctcctgggataccccgaa

SEQ ID NO: 423 - DNA, 20 bp, Artificial Sequence
  chemically synthesized
cctgggataccccgaagagt

SEQ ID NO: 424 - DNA, 20 bp, Artificial Sequence
  chemically synthesized
ccccgaagagtgagtttgcc

SEQ ID NO: 425 - DNA, 20 bp, Artificial Sequence
  chemically synthesized
cgaagagtgagtttgccaag

SEQ ID NO: 426 - DNA, 20 bp, Artificial Sequence
  chemically synthesized
tttgccaagcagtcacccca

SEQ ID NO: 427 - DNA, 20 bp, Artificial Sequence
  chemically synthesized
ccaagcagtcaccccacagt

SEQ ID NO: 428 - DNA, 20 bp, Artificial Sequence
  chemically synthesized
aagcagtcaccccacagttg

SEQ ID NO: 429 - DNA, 20 bp, Artificial Sequence
  chemically synthesized
agcagtcaccccacagttgg

SEQ ID NO: 430 - DNA, 20 bp, Artificial Sequence
  chemically synthesized
cagtcaccccacagttggag

SEQ ID NO: 431 - DNA, 20 bp, Artificial Sequence
  chemically synthesized
ttggaggagaatccacccaa

SEQ ID NO: 432 - DNA, 20 bp, Artificial Sequence
  chemically synthesized
tggaggagaatccacccaaa

SEQ ID NO: 433 - DNA, 20 bp, Artificial Sequence
  chemically synthesized
aggagaatccacccaaaagg

SEQ ID NO: 434 - DNA, 20 bp, Artificial Sequence
  chemically synthesized
aatccacccaaaaggcagcc

SEQ ID NO: 435 - DNA, 20 bp, Artificial Sequence
  chemically synthesized
ccacccaaaaggcagcctgg

SEQ ID NO: 436 - DNA, 20 bp, Artificial Sequence
  chemically synthesized
ccaaaaggcagcctggtaga

SEQ ID NO: 437 - DNA, 20 bp, Artificial Sequence
  chemically synthesized
caaaaggcagcctggtagac

SEQ ID NO: 438 - DNA, 20 bp, Artificial Sequence
  chemically synthesized
aaaaggcagcctggtagaca

SEQ ID NO: 439 - DNA, 20 bp, Artificial Sequence
  chemically synthesized
ggcagcctggtagacagggc

SEQ ID NO: 440 - DNA, 20 bp, Artificial Sequence
  chemically synthesized
gcagcctggtagacagggct

SEQ ID NO: 441 - DNA, 20 bp, Artificial Sequence
  chemically synthesized
cagcctggtagacagggctg

SEQ ID NO: 442 - DNA, 20 bp, Artificial Sequence
  chemically synthesized
cctggtagacagggctgggg

SEQ ID NO: 443 - DNA, 20 bp, Artificial Sequence
  chemically synthesized
agggctggggtggcctctcg

SEQ ID NO: 444 - DNA, 20 bp, Artificial Sequence
  chemically synthesized
gggctggggtggcctctcgt

SEQ ID NO: 445 - DNA, 20 bp, Artificial Sequence
  chemically synthesized
ggctggggtggcctctcgtg

SEQ ID NO: 446 - DNA, 20 bp, Artificial Sequence
  chemically synthesized
gggtggcctctcgtggggtc

SEQ ID NO: 447 - DNA, 20 bp, Artificial Sequence
  chemically synthesized
ggtggcctctcgtggggtcc

SEQ ID NO: 448 - DNA, 20 bp, Artificial Sequence
  chemically synthesized
cctctcgtggggtccaggcc

SEQ ID NO: 449 - DNA, 20 bp, Artificial Sequence
  chemically synthesized
ctcgtggggtccaggccaag

SEQ ID NO: 450 - DNA, 20 bp, Artificial Sequence
  chemically synthesized
tcgtggggtccaggccaagt

SEQ ID NO: 451 - DNA, 20 bp, Artificial Sequence
  chemically synthesized
tggggtccaggccaagtagg

SEQ ID NO: 452 - DNA, 20 bp, Artificial Sequence
  chemically synthesized
tccaggccaagtaggtggcc

SEQ ID NO: 453 - DNA, 20 bp, Artificial Sequence
  chemically synthesized
ccaggccaagtaggtggcct

SEQ ID NO: 454 - DNA, 20 bp, Artificial Sequence
  chemically synthesized
caggccaagtaggtggcctg

SEQ ID NO: 455 - DNA, 20 bp, Artificial Sequence
  chemically synthesized
agtaggtggcctggggcctc

SEQ ID NO: 456 - DNA, 20 bp, Artificial Sequence
  chemically synthesized
gtaggtggcctggggcctct

SEQ ID NO: 457 - DNA, 20 bp, Artificial Sequence
  chemically synthesized
taggtggcctggggcctctg

SEQ ID NO: 458 - DNA, 20 bp, Artificial Sequence
  chemically synthesized
aggtggcctggggcctctgg

SEQ ID NO: 459 - DNA, 20 bp, Artificial Sequence
  chemically synthesized
cctggggcctctgggggatg

SEQ ID NO: 460 - DNA, 20 bp, Artificial Sequence
  chemically synthesized
ctggggcctctgggggatgc

SEQ ID NO: 461 - DNA, 20 bp, Artificial Sequence
  chemically synthesized
tggggcctctgggggatgca

SEQ ID NO: 462 - DNA, 20 bp, Artificial Sequence
  chemically synthesized
ggggcctctgggggatgcag

SEQ ID NO: 463 - DNA, 20 bp, Artificial Sequence
  chemically synthesized
gcctctgggggatgcagggg

SEQ ID NO: 464 - DNA, 20 bp, Artificial Sequence
  chemically synthesized
cctctgggggatgcagggga

SEQ ID NO: 465 - DNA, 20 bp, Artificial Sequence
  chemically synthesized
ctctgggggatgcaggggaa

SEQ ID NO: 466 - DNA, 20 bp, Artificial Sequence
  chemically synthesized
tctgggggatgcaggggaag

SEQ ID NO: 467 - DNA, 20 bp, Artificial Sequence
  chemically synthesized
ctgggggatgcaggggaagg

SEQ ID NO: 468 - DNA, 20 bp, Artificial Sequence
  chemically synthesized
gatgcaggggaagggggatg

SEQ ID NO: 469 - DNA, 20 bp, Artificial Sequence
  chemically synthesized
atgcaggggaagggggatgc

SEQ ID NO: 470 - DNA, 20 bp, Artificial Sequence
  chemically synthesized
tgcaggggaagggggatgca

SEQ ID NO: 471 - DNA, 20 bp, Artificial Sequence
  chemically synthesized
gcaggggaagggggatgcag

SEQ ID NO: 472 - DNA, 20 bp, Artificial Sequence
  chemically synthesized
ggaagggggatgcaggggaa

SEQ ID NO: 473 - DNA, 20 bp, Artificial Sequence
  chemically synthesized
gaagggggatgcaggggaac

SEQ ID NO: 474 - DNA, 20 bp, Artificial Sequence
  chemically synthesized
aagggggatgcaggggaacg

SEQ ID NO: 475 - DNA, 20 bp, Artificial Sequence
  chemically synthesized
gatgcaggggaacggggatg

SEQ ID NO: 476 - DNA, 20 bp, Artificial Sequence
  chemically synthesized
atgcaggggaacggggatgc

SEQ ID NO: 477 - DNA, 20 bp, Artificial Sequence
  chemically synthesized
tgcaggggaacggggatgca

SEQ ID NO: 478 - DNA, 20 bp, Artificial Sequence
  chemically synthesized
gcaggggaacggggatgcag

SEQ ID NO: 479 - DNA, 20 bp, Artificial Sequence
  chemically synthesized
ggaacggggatgcaggggaa

SEQ ID NO: 480 - DNA, 20 bp, Artificial Sequence
  chemically synthesized
gaacggggatgcaggggaac

SEQ ID NO: 481 - DNA, 20 bp, Artificial Sequence
  chemically synthesized
aacggggatgcaggggaacg

SEQ ID NO: 482 - DNA, 20 bp, Artificial Sequence
  chemically synthesized
ggatgcaggggaacggggct

SEQ ID NO: 483 - DNA, 20 bp, Artificial Sequence
  chemically synthesized
ggggaacggggctcagtctg

SEQ ID NO: 484 - DNA, 20 bp, Artificial Sequence
  chemically synthesized
ggaacggggctcagtctgaa

SEQ ID NO: 485 - DNA, 20 bp, Artificial Sequence
  chemically synthesized
acggggctcagtctgaagag

SEQ ID NO: 486 - DNA, 20 bp, Artificial Sequence
  chemically synthesized
ggggctcagtctgaagagca

SEQ ID NO: 487 - DNA, 20 bp, Artificial Sequence
  chemically synthesized
ctcagtctgaagagcagagc

SEQ ID NO: 488 - DNA, 20 bp, Artificial Sequence
  chemically synthesized
tcagtctgaagagcagagcc

SEQ ID NO: 489 - DNA, 20 bp, Artificial Sequence
  chemically synthesized
agcagagccaggaacccctg

SEQ ID NO: 490 - DNA, 20 bp, Artificial Sequence
  chemically synthesized
gcagagccaggaacccctgt

SEQ ID NO: 491 - DNA, 20 bp, Artificial Sequence
  chemically synthesized
cagagccaggaacccctgta

SEQ ID NO: 492 - DNA, 20 bp, Artificial Sequence
  chemically synthesized
agccaggaacccctgtaggg

SEQ ID NO: 493 - DNA, 20 bp, Artificial Sequence
  chemically synthesized
gccaggaacccctgtaggga

SEQ ID NO: 494 - DNA, 20 bp, Artificial Sequence
  chemically synthesized
ccaggaacccctgtagggaa

SEQ ID NO: 495 - DNA, 20 bp, Artificial Sequence
  chemically synthesized
caggaacccctgtagggaag

SEQ ID NO: 496 - DNA, 20 bp, Artificial Sequence
  chemically synthesized
gaacccctgtagggaagggg

SEQ ID NO: 497 - DNA, 20 bp, Artificial Sequence
  chemically synthesized
aacccctgtagggaaggggc

SEQ ID NO: 498 - DNA, 20 bp, Artificial Sequence
  chemically synthesized
cccctgtagggaaggggcag

SEQ ID NO: 499 - DNA, 20 bp, Artificial Sequence
  chemically synthesized
cctgtagggaaggggcagga

SEQ ID NO: 500 - DNA, 20 bp, Artificial Sequence
  chemically synthesized
tagggaaggggcaggagagc

SEQ ID NO: 501 - DNA, 20 bp, Artificial Sequence
  chemically synthesized
agggaaggggcaggagagcc

SEQ ID NO: 502 - DNA, 20 bp, Artificial Sequence
  chemically synthesized
gggaaggggcaggagagcca

SEQ ID NO: 503 - DNA, 20 bp, Artificial Sequence
  chemically synthesized
ggaaggggcaggagagccag

SEQ ID NO: 504 - DNA, 20 bp, Artificial Sequence
  chemically synthesized
ggcaggagagccaggggcat

SEQ ID NO: 505 - DNA, 20 bp, Artificial Sequence
  chemically synthesized
ggagagccaggggcatgaga

SEQ ID NO: 506 - DNA, 20 bp, Artificial Sequence
  chemically synthesized
gagccaggggcatgagatgg

SEQ ID NO: 507 - DNA, 20 bp, Artificial Sequence
  chemically synthesized
aggggcatgagatggtggac

SEQ ID NO: 508 - DNA, 20 bp, Artificial Sequence
  chemically synthesized
ggggcatgagatggtggacg

SEQ ID NO: 509 - DNA, 20 bp, Artificial Sequence
  chemically synthesized
gcatgagatggtggacgagg

SEQ ID NO: 510 - DNA, 20 bp, Artificial Sequence
  chemically synthesized
catgagatggtggacgagga

SEQ ID NO: 511 - DNA, 20 bp, Artificial Sequence
  chemically synthesized
atgagatggtggacgaggaa

SEQ ID NO: 512 - DNA, 20 bp, Artificial Sequence
  chemically synthesized
tgagatggtggacgaggaag

SEQ ID NO: 513 - DNA, 20 bp, Artificial Sequence
  chemically synthesized
gagatggtggacgaggaagg

SEQ ID NO: 514 - DNA, 20 bp, Artificial Sequence
  chemically synthesized
tggtggacgaggaaggggga

SEQ ID NO: 515 - DNA, 20 bp, Artificial Sequence
  chemically synthesized
ggtggacgaggaagggggac

SEQ ID NO: 516 - DNA, 20 bp, Artificial Sequence
  chemically synthesized
gtggacgaggaagggggaca

SEQ ID NO: 517 - DNA, 20 bp, Artificial Sequence
  chemically synthesized
gacgaggaagggggacaggg

SEQ ID NO: 518 - DNA, 20 bp, Artificial Sequence
  chemically synthesized
gaagggggacagggaagcct

SEQ ID NO: 519 - DNA, 20 bp, Artificial Sequence
  chemically synthesized
ggaagcctgagcgcctctcc

SEQ ID NO: 520 - DNA, 20 bp, Artificial Sequence
  chemically synthesized
gaagcctgagcgcctctcct

SEQ ID NO: 521 - DNA, 20 bp, Artificial Sequence
  chemically synthesized
gcgcctctcctgggcttgcc

SEQ ID NO: 522 - DNA, 20 bp, Artificial Sequence
  chemically synthesized
cgcctctcctgggcttgcca

SEQ ID NO: 523 - DNA, 20 bp, Artificial Sequence
  chemically synthesized
gcttgccaaggactcaaacc

SEQ ID NO: 524 - DNA, 20 bp, Artificial Sequence
  chemically synthesized
tgccaaggactcaaacccag

SEQ ID NO: 525 - DNA, 20 bp, Artificial Sequence
  chemically synthesized
aggactcaaacccagaagcc

SEQ ID NO: 526 - DNA, 20 bp, Artificial Sequence
  chemically synthesized
gactcaaacccagaagccca

SEQ ID NO: 527 - DNA, 20 bp, Artificial Sequence
  chemically synthesized
tcaaacccagaagcccagag

SEQ ID NO: 528 - DNA, 20 bp, Artificial Sequence
  chemically synthesized
caaacccagaagcccagagc

SEQ ID NO: 529 - DNA, 20 bp, Artificial Sequence
  chemically synthesized
aaacccagaagcccagagca

SEQ ID NO: 530 - DNA, 20 bp, Artificial Sequence
  chemically synthesized
agaagcccagagcagggcct

SEQ ID NO: 531 - DNA, 20 bp, Artificial Sequence
  chemically synthesized
gaagcccagagcagggcctt

SEQ ID NO: 532 - DNA, 20 bp, Artificial Sequence
  chemically synthesized
aagcccagagcagggcctta

SEQ ID NO: 533 - DNA, 20 bp, Artificial Sequence
  chemically synthesized
cccagagcagggccttaggg

SEQ ID NO: 534 - DNA, 20 bp, Artificial Sequence
  chemically synthesized
agagcagggccttagggaag

SEQ ID NO: 535 - DNA, 20 bp, Artificial Sequence
  chemically synthesized
gagcagggccttagggaagc

SEQ ID NO: 536 - DNA, 20 bp, Artificial Sequence
  chemically synthesized
agggaagcgggaccctgctc

SEQ ID NO: 537 - DNA, 20 bp, Artificial Sequence
  chemically synthesized
gggaagcgggaccctgctct

SEQ ID NO: 538 - DNA, 20 bp, Artificial Sequence
  chemically synthesized
aagcgggaccctgctctggg

SEQ ID NO: 539 - DNA, 20 bp, Artificial Sequence
  chemically synthesized
gcgggaccctgctctgggcg

SEQ ID NO: 540 - DNA, 20 bp, Artificial Sequence
  chemically synthesized
cgggaccctgctctgggcgg

SEQ ID NO: 541 - DNA, 20 bp, Artificial Sequence
  chemically synthesized
ctgggcggaggaatatgtcc

SEQ ID NO: 542 - DNA, 20 bp, Artificial Sequence
  chemically synthesized
gcggaggaatatgtcccaga

SEQ ID NO: 543 - DNA, 20 bp, Artificial Sequence
  chemically synthesized
gaatatgtcccagatagcac

SEQ ID NO: 544 - DNA, 20 bp, Artificial Sequence
  chemically synthesized
aatatgtcccagatagcact

SEQ ID NO: 545 - DNA, 20 bp, Artificial Sequence
  chemically synthesized
atatgtcccagatagcactg

SEQ ID NO: 546 - DNA, 20 bp, Artificial Sequence
  chemically synthesized
gatagcactggggactcttt

SEQ ID NO: 547 - DNA, 20 bp, Artificial Sequence
  chemically synthesized
atagcactggggactcttta

SEQ ID NO: 548 - DNA, 20 bp, Artificial Sequence
  chemically synthesized
cactggggactctttaagga

SEQ ID NO: 549 - DNA, 20 bp, Artificial Sequence
  chemically synthesized
tggggactctttaaggaaag

SEQ ID NO: 550 - DNA, 20 bp, Artificial Sequence
  chemically synthesized
ggggactctttaaggaaaga

SEQ ID NO: 551 - DNA, 20 bp, Artificial Sequence
  chemically synthesized
actctttaaggaaagaagga

SEQ ID NO: 552 - DNA, 20 bp, Artificial Sequence
  chemically synthesized
tctttaaggaaagaaggatg

SEQ ID NO: 553 - DNA, 20 bp, Artificial Sequence
  chemically synthesized
taaggaaagaaggatggaga

SEQ ID NO: 554 - DNA, 20 bp, Artificial Sequence
  chemically synthesized
aggaaagaaggatggagaaa

SEQ ID NO: 555 - DNA, 20 bp, Artificial Sequence
  chemically synthesized
aagaaggatggagaaagaga

SEQ ID NO: 556 - DNA, 20 bp, Artificial Sequence
  chemically synthesized
agaaggatggagaaagagaa

SEQ ID NO: 557 - DNA, 20 bp, Artificial Sequence
  chemically synthesized
gaaggatggagaaagagaaa

SEQ ID NO: 558 - DNA, 20 bp, Artificial Sequence
  chemically synthesized
aggatggagaaagagaaagg

SEQ ID NO: 559 - DNA, 20 bp, Artificial Sequence
  chemically synthesized
atggagaaagagaaagggag

SEQ ID NO: 560 - DNA, 20 bp, Artificial Sequence
  chemically synthesized
ggagaaagagaaagggagta

SEQ ID NO: 561 - DNA, 20 bp, Artificial Sequence
  chemically synthesized
gagaaagagaaagggagtag

SEQ ID NO: 562 - DNA, 20 bp, Artificial Sequence
  chemically synthesized
aaagagaaagggagtagagg

SEQ ID NO: 563 - DNA, 20 bp, Artificial Sequence
  chemically synthesized
gagtagaggcggccacgacc

SEQ ID NO: 564 - DNA, 20 bp, Artificial Sequence
  chemically synthesized
gccacgacctggtgaacacc

SEQ ID NO: 565 - DNA, 20 bp, Artificial Sequence
  chemically synthesized
ccacgacctggtgaacacct

SEQ ID NO: 566 - DNA, 20 bp, Artificial Sequence
  chemically synthesized
taggacgcaccattctcaca

SEQ ID NO: 567 - DNA, 20 bp, Artificial Sequence
  chemically synthesized
aggacgcaccattctcacaa

SEQ ID NO: 568 - DNA, 20 bp, Artificial Sequence
  chemically synthesized
ggacgcaccattctcacaaa

SEQ ID NO: 569 - DNA, 20 bp, Artificial Sequence
  chemically synthesized
acgcaccattctcacaaagg

SEQ ID NO: 570 - DNA, 20 bp, Artificial Sequence
  chemically synthesized
cacaaagggagttttccaca

SEQ ID NO: 571 - DNA, 20 bp, Artificial Sequence
  chemically synthesized
ggacacccccctcctcacca

SEQ ID NO: 572 - DNA, 20 bp, Artificial Sequence
  chemically synthesized
cctcctcaccacagccctgc

SEQ ID NO: 573 - DNA, 20 bp, Artificial Sequence
  chemically synthesized
ctcctcaccacagccctgcc

SEQ ID NO: 574 - DNA, 20 bp, Artificial Sequence
  chemically synthesized
tcaccacagccctgccagga

SEQ ID NO: 575 - DNA, 20 bp, Artificial Sequence
  chemically synthesized
caccacagccctgccaggac

SEQ ID NO: 576 - DNA, 20 bp, Artificial Sequence
  chemically synthesized
accacagccctgccaggacg

SEQ ID NO: 577 - DNA, 20 bp, Artificial Sequence
  chemically synthesized
cagccctgccaggacggggc

SEQ ID NO: 578 - DNA, 20 bp, Artificial Sequence
  chemically synthesized
gccaggacggggctggctac

SEQ ID NO: 579 - DNA, 20 bp, Artificial Sequence
  chemically synthesized
tggctactggccttatctca

SEQ ID NO: 580 - DNA, 20 bp, Artificial Sequence
  chemically synthesized
ggctactggccttatctcac

SEQ ID NO: 581 - DNA, 20 bp, Artificial Sequence
  chemically synthesized
tcacaggtaaaactgacgca

SEQ ID NO: 582 - DNA, 20 bp, Artificial Sequence
  chemically synthesized
acaggtaaaactgacgcacg

SEQ ID NO: 583 - DNA, 20 bp, Artificial Sequence
  chemically synthesized
caggtaaaactgacgcacgg

SEQ ID NO: 584 - DNA, 20 bp, Artificial Sequence
  chemically synthesized
cacggaggaacaatataaat

SEQ ID NO: 585 - DNA, 20 bp, Artificial Sequence
  chemically synthesized
acggaggaacaatataaatt

SEQ ID NO: 586 - DNA, 20 bp, Artificial Sequence
  chemically synthesized
cggaggaacaatataaattg

SEQ ID NO: 587 - DNA, 20 bp, Artificial Sequence
  chemically synthesized
gaacaatataaattggggac

SEQ ID NO: 588 - DNA, 20 bp, Artificial Sequence
  chemically synthesized
aatataaattggggactaga

SEQ ID NO: 589 - DNA, 20 bp, Artificial Sequence
  chemically synthesized
atataaattggggactagaa

SEQ ID NO: 590 - DNA, 20 bp, Artificial Sequence
  chemically synthesized
aattggggactagaaaggtg

SEQ ID NO: 591 - DNA, 20 bp, Artificial Sequence
  chemically synthesized
ttggggactagaaaggtgaa

SEQ ID NO: 592 - DNA, 20 bp, Artificial Sequence
  chemically synthesized
actagaaaggtgaagagcca

SEQ ID NO: 593 - DNA, 20 bp, Artificial Sequence
  chemically synthesized
gaaaggtgaagagccaaagt

SEQ ID NO: 594 - DNA, 20 bp, Artificial Sequence
  chemically synthesized
gaagagccaaagttagaact

SEQ ID NO: 595 - DNA, 20 bp, Artificial Sequence
  chemically synthesized
aagagccaaagttagaactc

SEQ ID NO: 596 - DNA, 20 bp, Artificial Sequence
  chemically synthesized
ttccaaactgcttctcctct

SEQ ID NO: 597 - DNA, 20 bp, Artificial Sequence
  chemically synthesized
tccaaactgcttctcctctt

SEQ ID NO: 598 - DNA, 20 bp, Artificial Sequence
  chemically synthesized
aaactgcttctcctcttggg

SEQ ID NO: 599 - DNA, 20 bp, Artificial Sequence
  chemically synthesized
cttctcctcttgggaagtgt

SEQ ID NO: 600 - DNA, 20 bp, Artificial Sequence
  chemically synthesized
ttctcctcttgggaagtgta

SEQ ID NO: 601 - DNA, 20 bp, Artificial Sequence
  chemically synthesized
tcctcttgggaagtgtaagg

SEQ ID NO: 602 - DNA, 20 bp, Artificial Sequence
  chemically synthesized
tgggaagtgtaaggaagctg

SEQ ID NO: 603 - DNA, 20 bp, Artificial Sequence
  chemically synthesized
gtgtaaggaagctgcagcac

SEQ ID NO: 604 - DNA, 20 bp, Artificial Sequence
  chemically synthesized
tgtaaggaagctgcagcacc

SEQ ID NO: 605 - DNA, 20 bp, Artificial Sequence
  chemically synthesized
ggaagctgcagcaccaggat

SEQ ID NO: 606 - DNA, 20 bp, Artificial Sequence
  chemically synthesized
ccaggatcagtgaaacgcac

SEQ ID NO: 607 - DNA, 20 bp, Artificial Sequence
  chemically synthesized
gatcagtgaaacgcaccaga

SEQ ID NO: 608 - DNA, 20 bp, Artificial Sequence
  chemically synthesized
aacgcaccagacggccgcgt

SEQ ID NO: 609 - DNA, 20 bp, Artificial Sequence
  chemically synthesized
cgcaccagacggccgcgtca

SEQ ID NO: 610 - DNA, 20 bp, Artificial Sequence
  chemically synthesized
accagacggccgcgtcagag

SEQ ID NO: 611 - DNA, 20 bp, Artificial Sequence
  chemically synthesized
acggccgcgtcagagcagct

SEQ ID NO: 612 - DNA, 20 bp, Artificial Sequence
  chemically synthesized
cggccgcgtcagagcagctc

SEQ ID NO: 613 - DNA, 20 bp, Artificial Sequence
  chemically synthesized
cgtcagagcagctcaggttc

SEQ ID NO: 614 - DNA, 20 bp, Artificial Sequence
  chemically synthesized
gtcagagcagctcaggttct

SEQ ID NO: 615 - DNA, 20 bp, Artificial Sequence
  chemically synthesized
cagagcagctcaggttctgg

SEQ ID NO: 616 - DNA, 20 bp, Artificial Sequence
  chemically synthesized
gagcagctcaggttctggga

SEQ ID NO: 617 - DNA, 20 bp, Artificial Sequence
  chemically synthesized
agcagctcaggttctgggag

SEQ ID NO: 618 - DNA, 20 bp, Artificial Sequence
  chemically synthesized
gcagctcaggttctgggaga

SEQ ID NO: 619 - DNA, 20 bp, Artificial Sequence
  chemically synthesized
gctcaggttctgggagaggg

SEQ ID NO: 620 - DNA, 20 bp, Artificial Sequence
  chemically synthesized
ggttctgggagagggtagcg

SEQ ID NO: 621 - DNA, 20 bp, Artificial Sequence
  chemically synthesized
gttctgggagagggtagcgc

SEQ ID NO: 622 - DNA, 20 bp, Artificial Sequence
  chemically synthesized
ttctgggagagggtagcgca

SEQ ID NO: 623 - DNA, 20 bp, Artificial Sequence
  chemically synthesized
tgggagagggtagcgcaggg

SEQ ID NO: 624 - DNA, 20 bp, Artificial Sequence
  chemically synthesized
ggtagcgcagggtggccact

SEQ ID NO: 625 - DNA, 20 bp, Artificial Sequence
  chemically synthesized
gcagggtggccactgagaac

SEQ ID NO: 626 - DNA, 20 bp, Artificial Sequence
  chemically synthesized
cagggtggccactgagaacc

SEQ ID NO: 627 - DNA, 20 bp, Artificial Sequence
  chemically synthesized
ggtggccactgagaaccggg

SEQ ID NO: 628 - DNA, 20 bp, Artificial Sequence
  chemically synthesized
gtggccactgagaaccgggc

SEQ ID NO: 629 - DNA, 20 bp, Artificial Sequence
  chemically synthesized
cttccctcccaccccctgcc

SEQ ID NO: 630 - DNA, 20 bp, Artificial Sequence
  chemically synthesized
ccctgccaagctctccctcc

SEQ ID NO: 631 - DNA, 20 bp, Artificial Sequence
  chemically synthesized
cctgccaagctctccctccc

SEQ ID NO: 632 - DNA, 20 bp, Artificial Sequence
  chemically synthesized
ctccctcccaggatcctctc

SEQ ID NO: 633 - DNA, 20 bp, Artificial Sequence
  chemically synthesized
atcctctctggctccatcgt

SEQ ID NO: 634 - DNA, 20 bp, Artificial Sequence
  chemically synthesized
gctccatcgtaagcaaacct

SEQ ID NO: 635 - DNA, 20 bp, Artificial Sequence
  chemically synthesized
tccatcgtaagcaaacctta

SEQ ID NO: 636 - DNA, 20 bp, Artificial Sequence
  chemically synthesized
ccatcgtaagcaaaccttag

SEQ ID NO: 637 - DNA, 20 bp, Artificial Sequence
  chemically synthesized
taagcaaaccttagaggttc

SEQ ID NO: 638 - DNA, 20 bp, Artificial Sequence
  chemically synthesized
caaaccttagaggttctggc

SEQ ID NO: 639 - DNA, 20 bp, Artificial Sequence
  chemically synthesized
aaaccttagaggttctggca

SEQ ID NO: 640 - DNA, 20 bp, Artificial Sequence
  chemically synthesized
accttagaggttctggcaag

SEQ ID NO: 641 - DNA, 20 bp, Artificial Sequence
  chemically synthesized
cttagaggttctggcaagga

SEQ ID NO: 642 - DNA, 20 bp, Artificial Sequence
  chemically synthesized
tagaggttctggcaaggaga

SEQ ID NO: 643 - DNA, 20 bp, Artificial Sequence
  chemically synthesized
ggttctggcaaggagagaga

SEQ ID NO: 644 - DNA, 20 bp, Artificial Sequence
  chemically synthesized
ggcaaggagagagatggctc

SEQ ID NO: 645 - DNA, 20 bp, Artificial Sequence
  chemically synthesized
gcaaggagagagatggctcc

SEQ ID NO: 646 - DNA, 20 bp, Artificial Sequence
  chemically synthesized
agagagatggctccaggaaa

SEQ ID NO: 647 - DNA, 20 bp, Artificial Sequence
  chemically synthesized
gagagatggctccaggaaat

SEQ ID NO: 648 - DNA, 20 bp, Artificial Sequence
  chemically synthesized
agagatggctccaggaaatg

SEQ ID NO: 649 - DNA, 20 bp, Artificial Sequence
  chemically synthesized
gagatggctccaggaaatgg

SEQ ID NO: 650 - DNA, 20 bp, Artificial Sequence
  chemically synthesized
aggaaatgggggtgtgtcac

SEQ ID NO: 651 - DNA, 20 bp, Artificial Sequence
  chemically synthesized
atgggggtgtgtcaccagat

SEQ ID NO: 652 - DNA, 20 bp, Artificial Sequence
  chemically synthesized
tgggggtgtgtcaccagata

SEQ ID NO: 653 - DNA, 20 bp, Artificial Sequence
  chemically synthesized
cagataaggaatctgcctaa

SEQ ID NO: 654 - DNA, 20 bp, Artificial Sequence
  chemically synthesized
agataaggaatctgcctaac

SEQ ID NO: 655 - DNA, 20 bp, Artificial Sequence
  chemically synthesized
ataaggaatctgcctaacag

SEQ ID NO: 656 - DNA, 20 bp, Artificial Sequence
  chemically synthesized
taaggaatctgcctaacagg

SEQ ID NO: 657 - DNA, 20 bp, Artificial Sequence
  chemically synthesized
ggaatctgcctaacaggagg

SEQ ID NO: 658 - DNA, 20 bp, Artificial Sequence
  chemically synthesized
gaatctgcctaacaggaggt

SEQ ID NO: 659 - DNA, 20 bp, Artificial Sequence
  chemically synthesized
aatctgcctaacaggaggtg

SEQ ID NO: 660 - DNA, 20 bp, Artificial Sequence
  chemically synthesized
atctgcctaacaggaggtgg

SEQ ID NO: 661 - DNA, 20 bp, Artificial Sequence
  chemically synthesized
gcctaacaggaggtgggggt

SEQ ID NO: 662 - DNA, 20 bp, Artificial Sequence
  chemically synthesized
gtgggggttagacccaatat

SEQ ID NO: 663 - DNA, 20 bp, Artificial Sequence
  chemically synthesized
tgggggttagacccaatatc

SEQ ID NO: 664 - DNA, 20 bp, Artificial Sequence
  chemically synthesized
ggggttagacccaatatcag

SEQ ID NO: 665 - DNA, 20 bp, Artificial Sequence
  chemically synthesized
tagacccaatatcaggagac

SEQ ID NO: 666 - DNA, 20 bp, Artificial Sequence
  chemically synthesized
agacccaatatcaggagact

SEQ ID NO: 667 - DNA, 20 bp, Artificial Sequence
  chemically synthesized
cccaatatcaggagactagg

SEQ ID NO: 668 - DNA, 20 bp, Artificial Sequence
  chemically synthesized
ccaatatcaggagactagga

SEQ ID NO: 669 - DNA, 20 bp, Artificial Sequence
  chemically synthesized
aatatcaggagactaggaag

SEQ ID NO: 670 - DNA, 20 bp, Artificial Sequence
  chemically synthesized
atatcaggagactaggaagg

SEQ ID NO: 671 - DNA, 20 bp, Artificial Sequence
  chemically synthesized
atcaggagactaggaaggag

SEQ ID NO: 672 - DNA, 20 bp, Artificial Sequence
  chemically synthesized
tcaggagactaggaaggagg

SEQ ID NO: 673 - DNA, 20 bp, Artificial Sequence
  chemically synthesized
gactaggaaggaggaggcct

SEQ ID NO: 674 - DNA, 20 bp, Artificial Sequence
  chemically synthesized
actaggaaggaggaggccta

SEQ ID NO: 675 - DNA, 20 bp, Artificial Sequence
  chemically synthesized
ggaaggaggaggcctaagga

SEQ ID NO: 676 - DNA, 20 bp, Artificial Sequence
  chemically synthesized
gaaggaggaggcctaaggat

SEQ ID NO: 677 - DNA, 20 bp, Artificial Sequence
  chemically synthesized
aaggaggaggcctaaggatg

SEQ ID NO: 678 - DNA, 20 bp, Artificial Sequence
  chemically synthesized
tctgtcaccaatcctgtccc

SEQ ID NO: 679 - DNA, 20 bp, Artificial Sequence
  chemically synthesized
gtcaccaatcctgtccctag

SEQ ID NO: 680 - DNA, 20 bp, Artificial Sequence
  chemically synthesized
tgtccctagtggccccactg

SEQ ID NO: 681 - DNA, 20 bp, Artificial Sequence
  chemically synthesized
gtccctagtggccccactgt

SEQ ID NO: 682 - DNA, 20 bp, Artificial Sequence
  chemically synthesized
tccctagtggccccactgtg

SEQ ID NO: 683 - DNA, 20 bp, Artificial Sequence
  chemically synthesized
ctagtggccccactgtgggg

SEQ ID NO: 684 - DNA, 20 bp, Artificial Sequence
  chemically synthesized
agtggccccactgtggggtg

SEQ ID NO: 685 - DNA, 20 bp, Artificial Sequence
  chemically synthesized
gtggccccactgtggggtgg

SEQ ID NO: 686 - DNA, 20 bp, Artificial Sequence
  chemically synthesized
tggccccactgtggggtgga

SEQ ID NO: 687 - DNA, 20 bp, Artificial Sequence
  chemically synthesized
ggccccactgtggggtggag

SEQ ID NO: 688 - DNA, 20 bp, Artificial Sequence
  chemically synthesized
ccactgtggggtggagggga

SEQ ID NO: 689 - DNA, 20 bp, Artificial Sequence
  chemically synthesized
ggggtggaggggacagataa

SEQ ID NO: 690 - DNA, 20 bp, Artificial Sequence
  chemically synthesized
aggggacagataaaagtacc

SEQ ID NO: 691 - DNA, 20 bp, Artificial Sequence
  chemically synthesized
cagataaaagtacccagaac

SEQ ID NO: 692 - DNA, 20 bp, Artificial Sequence
  chemically synthesized
gataaaagtacccagaacca

SEQ ID NO: 693 - DNA, 20 bp, Artificial Sequence
  chemically synthesized
agaaccagagccacattaac

SEQ ID NO: 694 - DNA, 20 bp, Artificial Sequence
  chemically synthesized
agagccacattaaccggccc

SEQ ID NO: 695 - DNA, 20 bp, Artificial Sequence
  chemically synthesized
gagccacattaaccggccct

SEQ ID NO: 696 - DNA, 20 bp, Artificial Sequence
  chemically synthesized
ttaaccggccctgggaatat

SEQ ID NO: 697 - DNA, 20 bp, Artificial Sequence
  chemically synthesized
taaccggccctgggaatata

SEQ ID NO: 698 - DNA, 20 bp, Artificial Sequence
  chemically synthesized
ccggccctgggaatataagg

SEQ ID NO: 699 - DNA, 20 bp, Artificial Sequence
  chemically synthesized
ctgggaatataaggtggtcc

SEQ ID NO: 700 - DNA, 20 bp, Artificial Sequence
  chemically synthesized
aatataaggtggtcccagct

SEQ ID NO: 701 - DNA, 20 bp, Artificial Sequence
  chemically synthesized
atataaggtggtcccagctc

SEQ ID NO: 702 - DNA, 20 bp, Artificial Sequence
  chemically synthesized
tataaggtggtcccagctcg

SEQ ID NO: 703 - DNA, 20 bp, Artificial Sequence
  chemically synthesized
gtggtcccagctcggggaca

SEQ ID NO: 704 - DNA, 20 bp, Artificial Sequence
  chemically synthesized
tggtcccagctcggggacac

SEQ ID NO: 705 - DNA, 20 bp, Artificial Sequence
  chemically synthesized
gctcggggacacaggatccc

SEQ ID NO: 706 - DNA, 20 bp, Artificial Sequence
  chemically synthesized
tcggggacacaggatccctg

SEQ ID NO: 707 - DNA, 20 bp, Artificial Sequence
  chemically synthesized
cggggacacaggatccctgg

SEQ ID NO: 708 - DNA, 20 bp, Artificial Sequence
  chemically synthesized
ggacacaggatccctggagg

SEQ ID NO: 709 - DNA, 20 bp, Artificial Sequence
  chemically synthesized
gcagcaaacatgctgtcctg

SEQ ID NO: 710 - DNA, 20 bp, Artificial Sequence
  chemically synthesized
gcaaacatgctgtcctgaag

SEQ ID NO: 711 - DNA, 20 bp, Artificial Sequence
  chemically synthesized
atgctgtcctgaagtggaca

SEQ ID NO: 712 - DNA, 20 bp, Artificial Sequence
  chemically synthesized
tgctgtcctgaagtggacat

SEQ ID NO: 713 - DNA, 20 bp, Artificial Sequence
  chemically synthesized
gctgtcctgaagtggacata

SEQ ID NO: 714 - DNA, 20 bp, Artificial Sequence
  chemically synthesized
ctgtcctgaagtggacatag

SEQ ID NO: 715 - DNA, 20 bp, Artificial Sequence
  chemically synthesized
ctgaagtggacataggggcc

SEQ ID NO: 716 - DNA, 20 bp, Artificial Sequence
  chemically synthesized
tgaagtggacataggggccc

SEQ ID NO: 717 - DNA, 20 bp, Artificial Sequence
  chemically synthesized
gtggacataggggcccgggt

SEQ ID NO: 718 - DNA, 20 bp, Artificial Sequence
  chemically synthesized
ggacataggggcccgggttg

SEQ ID NO: 719 - DNA, 20 bp, Artificial Sequence
  chemically synthesized
gacataggggcccgggttgg

SEQ ID NO: 720 - DNA, 20 bp, Artificial Sequence
  chemically synthesized
ataggggcccgggttggagg

SEQ ID NO: 721 - DNA, 20 bp, Artificial Sequence
  chemically synthesized
ggggcccgggttggaggaag

SEQ ID NO: 722 - DNA, 20 bp, Artificial Sequence
  chemically synthesized
ccgggttggaggaagaagac

SEQ ID NO: 723 - DNA, 20 bp, Artificial Sequence
  chemically synthesized
ttggaggaagaagactagct

SEQ ID NO: 724 - DNA, 20 bp, Artificial Sequence
  chemically synthesized
aagaagactagctgagctct

SEQ ID NO: 725 - DNA, 20 bp, Artificial Sequence
  chemically synthesized
tagctgagctctcggacccc

SEQ ID NO: 726 - DNA, 20 bp, Artificial Sequence
  chemically synthesized
ctgagctctcggacccctgg

SEQ ID NO: 727 - DNA, 20 bp, Artificial Sequence
  chemically synthesized
acccctggaagatgccatga

SEQ ID NO: 728 - DNA, 20 bp, Artificial Sequence
  chemically synthesized
cccctggaagatgccatgac

SEQ ID NO: 729 - DNA, 20 bp, Artificial Sequence
  chemically synthesized
ccctggaagatgccatgaca

SEQ ID NO: 730 - DNA, 20 bp, Artificial Sequence
  chemically synthesized
cctggaagatgccatgacag

SEQ ID NO: 731 - DNA, 20 bp, Artificial Sequence
  chemically synthesized
ctggaagatgccatgacagg

SEQ ID NO: 732 - DNA, 20 bp, Artificial Sequence
  chemically synthesized
aagatgccatgacagggggc

SEQ ID NO: 733 - DNA, 20 bp, Artificial Sequence
  chemically synthesized
atgccatgacagggggctgg

SEQ ID NO: 734 - DNA, 20 bp, Artificial Sequence
  chemically synthesized
gccatgacagggggctggaa

SEQ ID NO: 735 - DNA, 20 bp, Artificial Sequence
  chemically synthesized
tgacagggggctggaagagc

SEQ ID NO: 736 - DNA, 20 bp, Artificial Sequence
  chemically synthesized
gggggctggaagagctagca

SEQ ID NO: 737 - DNA, 20 bp, Artificial Sequence
  chemically synthesized
ctggaagagctagcacagac

SEQ ID NO: 738 - DNA, 20 bp, Artificial Sequence
  chemically synthesized
ggaagagctagcacagacta

SEQ ID NO: 739 - DNA, 20 bp, Artificial Sequence
  chemically synthesized
aagagctagcacagactaga

SEQ ID NO: 740 - DNA, 20 bp, Artificial Sequence
  chemically synthesized
agagctagcacagactagag

SEQ ID NO: 741 - DNA, 20 bp, Artificial Sequence
  chemically synthesized
ctagcacagactagagaggt

SEQ ID NO: 742 - DNA, 20 bp, Artificial Sequence
  chemically synthesized
tagcacagactagagaggta

SEQ ID NO: 743 - DNA, 20 bp, Artificial Sequence
  chemically synthesized
agcacagactagagaggtaa

SEQ ID NO: 744 - DNA, 20 bp, Artificial Sequence
  chemically synthesized
gcacagactagagaggtaag

SEQ ID NO: 745 - DNA, 20 bp, Artificial Sequence
  chemically synthesized
cacagactagagaggtaagg

SEQ ID NO: 746 - DNA, 20 bp, Artificial Sequence
  chemically synthesized
acagactagagaggtaaggg

SEQ ID NO: 747 - DNA, 20 bp, Artificial Sequence
  chemically synthesized
gactagagaggtaagggggg

SEQ ID NO: 748 - DNA, 20 bp, Artificial Sequence
  chemically synthesized
actagagaggtaaggggggt

SEQ ID NO: 749 - DNA, 20 bp, Artificial Sequence
  chemically synthesized
ctagagaggtaaggggggta

SEQ ID NO: 750 - DNA, 20 bp, Artificial Sequence
  chemically synthesized
tagagaggtaaggggggtag

SEQ ID NO: 751 - DNA, 20 bp, Artificial Sequence
  chemically synthesized
gagaggtaaggggggtaggg

SEQ ID NO: 752 - DNA, 20 bp, Artificial Sequence
  chemically synthesized
taggggagctgcccaaatga

SEQ ID NO: 753 - DNA, 20 bp, Artificial Sequence
  chemically synthesized
aggggagctgcccaaatgaa

SEQ ID NO: 754 - DNA, 20 bp, Artificial Sequence
  chemically synthesized
gggagctgcccaaatgaaag

SEQ ID NO: 755 - DNA, 20 bp, Artificial Sequence
  chemically synthesized
gctgcccaaatgaaaggagt

SEQ ID NO: 756 - DNA, 20 bp, Artificial Sequence
  chemically synthesized
tgcccaaatgaaaggagtga

SEQ ID NO: 757 - DNA, 20 bp, Artificial Sequence
  chemically synthesized
gcccaaatgaaaggagtgag

SEQ ID NO: 758 - DNA, 20 bp, Artificial Sequence
  chemically synthesized
tgagaggtgacccgaatcca

SEQ ID NO: 759 - DNA, 20 bp, Artificial Sequence
  chemically synthesized
gagaggtgacccgaatccac

SEQ ID NO: 760 - DNA, 20 bp, Artificial Sequence
  chemically synthesized
gaggtgacccgaatccacag

SEQ ID NO: 761 - DNA, 20 bp, Artificial Sequence
  chemically synthesized
gacccgaatccacaggagaa

SEQ ID NO: 762 - DNA, 20 bp, Artificial Sequence
  chemically synthesized
acccgaatccacaggagaac

SEQ ID NO: 763 - DNA, 20 bp, Artificial Sequence
  chemically synthesized
cccgaatccacaggagaacg

SEQ ID NO: 764 - DNA, 20 bp, Artificial Sequence
  chemically synthesized
ccacaggagaacggggtgtc

SEQ ID NO: 765 - DNA, 20 bp, Artificial Sequence
  chemically synthesized
cacaggagaacggggtgtcc

SEQ ID NO: 766 - DNA, 20 bp, Artificial Sequence
  chemically synthesized
gagaacggggtgtccaggca

SEQ ID NO: 767 - DNA, 20 bp, Artificial Sequence
  chemically synthesized
acggggtgtccaggcaaaga

SEQ ID NO: 768 - DNA, 20 bp, Artificial Sequence
  chemically synthesized
ggtgtccaggcaaagaaagc

SEQ ID NO: 769 - DNA, 20 bp, Artificial Sequence
  chemically synthesized
tgtccaggcaaagaaagcaa

SEQ ID NO: 770 - DNA, 20 bp, Artificial Sequence
  chemically synthesized
gtccaggcaaagaaagcaag

SEQ ID NO: 771 - DNA, 20 bp, Artificial Sequence
  chemically synthesized
aggcaaagaaagcaagagga

SEQ ID NO: 772 - DNA, 20 bp, Artificial Sequence
  chemically synthesized
gcaaagaaagcaagaggatg

SEQ ID NO: 773 - DNA, 20 bp, Artificial Sequence
  chemically synthesized
aaagaaagcaagaggatgga

SEQ ID NO: 774 - DNA, 20 bp, Artificial Sequence
  chemically synthesized
aagaaagcaagaggatggag

SEQ ID NO: 775 - DNA, 20 bp, Artificial Sequence
  chemically synthesized
aaagcaagaggatggagagg

SEQ ID NO: 776 - DNA, 20 bp, Artificial Sequence
  chemically synthesized
agaggatggagaggtggcta

SEQ ID NO: 777 - DNA, 20 bp, Artificial Sequence
  chemically synthesized
gatggagaggtggctaaagc

SEQ ID NO: 778 - DNA, 20 bp, Artificial Sequence
  chemically synthesized
atggagaggtggctaaagcc

SEQ ID NO: 779 - DNA, 20 bp, Artificial Sequence
  chemically synthesized
tggagaggtggctaaagcca

SEQ ID NO: 780 - DNA, 20 bp, Artificial Sequence
  chemically synthesized
gagaggtggctaaagccagg

SEQ ID NO: 781 - DNA, 20 bp, Artificial Sequence
  chemically synthesized
ggtggctaaagccagggaga

SEQ ID NO: 782 - DNA, 20 bp, Artificial Sequence
  chemically synthesized
gtggctaaagccagggagac

SEQ ID NO: 783 - DNA, 20 bp, Artificial Sequence
  chemically synthesized
tggctaaagccagggagacg

SEQ ID NO: 784 - DNA, 20 bp, Artificial Sequence
  chemically synthesized
gccagggagacggggtactt

SEQ ID NO: 785 - DNA, 20 bp, Artificial Sequence
  chemically synthesized
ccagggagacggggtacttt

SEQ ID NO: 786 - DNA, 20 bp, Artificial Sequence
  chemically synthesized
cagggagacggggtactttg

SEQ ID NO: 787 - DNA, 20 bp, Artificial Sequence
  chemically synthesized
cggggtactttggggttgtc

SEQ ID NO: 788 - DNA, 20 bp, Artificial Sequence
  chemically synthesized
tttggggttgtccagaaaaa

SEQ ID NO: 789 - DNA, 20 bp, Artificial Sequence
  chemically synthesized
ccagaaaaacggtgatgatg

SEQ ID NO: 790 - DNA, 20 bp, Artificial Sequence
  chemically synthesized
cagaaaaacggtgatgatgc

SEQ ID NO: 791 - DNA, 20 bp, Artificial Sequence
  chemically synthesized
cggtgatgatgcaggcctac

SEQ ID NO: 792 - DNA, 20 bp, Artificial Sequence
  chemically synthesized
tgatgatgcaggcctacaag

SEQ ID NO: 793 - DNA, 20 bp, Artificial Sequence
  chemically synthesized
gatgatgcaggcctacaaga

SEQ ID NO: 794 - DNA, 20 bp, Artificial Sequence
  chemically synthesized
atgatgcaggcctacaagaa

SEQ ID NO: 795 - DNA, 20 bp, Artificial Sequence
  chemically synthesized
tgatgcaggcctacaagaag

SEQ ID NO: 796 - DNA, 20 bp, Artificial Sequence
  chemically synthesized
atgcaggcctacaagaaggg

SEQ ID NO: 797 - DNA, 20 bp, Artificial Sequence
  chemically synthesized
tgcaggcctacaagaagggg

SEQ ID NO: 798 - DNA, 20 bp, Artificial Sequence
  chemically synthesized
aggcctacaagaaggggagg

SEQ ID NO: 799 - DNA, 20 bp, Artificial Sequence
  chemically synthesized
ggcctacaagaaggggaggc

SEQ ID NO: 800 - DNA, 20 bp, Artificial Sequence
  chemically synthesized
aagaaggggaggcgggacgc

SEQ ID NO: 801 - DNA, 20 bp, Artificial Sequence
  chemically synthesized
agaaggggaggcgggacgca

SEQ ID NO: 802 - DNA, 20 bp, Artificial Sequence
  chemically synthesized
gaaggggaggcgggacgcaa

SEQ ID NO: 803 - DNA, 20 bp, Artificial Sequence
  chemically synthesized
aggggaggcgggacgcaagg

SEQ ID NO: 804 - DNA, 20 bp, Artificial Sequence
  chemically synthesized
gacgcaagggagacatccgt

SEQ ID NO: 805 - DNA, 20 bp, Artificial Sequence
  chemically synthesized
cgcaagggagacatccgtcg

SEQ ID NO: 806 - DNA, 20 bp, Artificial Sequence
  chemically synthesized
aagggagacatccgtcggag

SEQ ID NO: 807 - DNA, 20 bp, Artificial Sequence
  chemically synthesized
agggagacatccgtcggaga

SEQ ID NO: 808 - DNA, 20 bp, Artificial Sequence
  chemically synthesized
ccgtcggagaaggccatcct

SEQ ID NO: 809 - DNA, 20 bp, Artificial Sequence
  chemically synthesized
agaaggccatcctaagaaac

SEQ ID NO: 810 - DNA, 20 bp, Artificial Sequence
  chemically synthesized
aaggccatcctaagaaacga

SEQ ID NO: 811 - DNA, 20 bp, Artificial Sequence
  chemically synthesized
ccatcctaagaaacgagaga

SEQ ID NO: 812 - DNA, 20 bp, Artificial Sequence
  chemically synthesized
ctaagaaacgagagatggca

SEQ ID NO: 813 - DNA, 20 bp, Artificial Sequence
  chemically synthesized
taagaaacgagagatggcac

SEQ ID NO: 814 - DNA, 20 bp, Artificial Sequence
  chemically synthesized
acgagagatggcacaggccc

SEQ ID NO: 815 - DNA, 20 bp, Artificial Sequence
  chemically synthesized
agagatggcacaggccccag

SEQ ID NO: 816 - DNA, 20 bp, Artificial Sequence
  chemically synthesized
gagatggcacaggccccaga

SEQ ID NO: 817 - DNA, 20 bp, Artificial Sequence
  chemically synthesized
gatggcacaggccccagaag

SEQ ID NO: 818 - DNA, 20 bp, Artificial Sequence
  chemically synthesized
ggcacaggccccagaaggag

SEQ ID NO: 819 - DNA, 20 bp, Artificial Sequence
  chemically synthesized
gcacaggccccagaaggaga

SEQ ID NO: 820 - DNA, 20 bp, Artificial Sequence
  chemically synthesized
ggccccagaaggagaaggaa

SEQ ID NO: 821 - DNA, 20 bp, Artificial Sequence
  chemically synthesized
gccccagaaggagaaggaaa

SEQ ID NO: 822 - DNA, 20 bp, Artificial Sequence
  chemically synthesized
ccccagaaggagaaggaaaa

SEQ ID NO: 823 - DNA, 20 bp, Artificial Sequence
  chemically synthesized
aggagaaggaaaagggaacc

SEQ ID NO: 824 - DNA, 20 bp, Artificial Sequence
  chemically synthesized
gaaggaaaagggaacccagc

SEQ ID NO: 825 - DNA, 20 bp, Artificial Sequence
  chemically synthesized
aaaagggaacccagcgagtg

SEQ ID NO: 826 - DNA, 20 bp, Artificial Sequence
  chemically synthesized
gggaacccagcgagtgaaga

SEQ ID NO: 827 - DNA, 20 bp, Artificial Sequence
  chemically synthesized
cccagcgagtgaagacggca

SEQ ID NO: 828 - DNA, 20 bp, Artificial Sequence
  chemically synthesized
ccagcgagtgaagacggcat

SEQ ID NO: 829 - DNA, 20 bp, Artificial Sequence
  chemically synthesized
cagcgagtgaagacggcatg

SEQ ID NO: 830 - DNA, 20 bp, Artificial Sequence
  chemically synthesized
gagtgaagacggcatggggt

SEQ ID NO: 831 - DNA, 20 bp, Artificial Sequence
  chemically synthesized
agtgaagacggcatggggtt

SEQ ID NO: 832 - DNA, 20 bp, Artificial Sequence
  chemically synthesized
aagacggcatggggttgggt

SEQ ID NO: 833 - DNA, 20 bp, Artificial Sequence
  chemically synthesized
agacggcatggggttgggtg

SEQ ID NO: 834 - DNA, 20 bp, Artificial Sequence
  chemically synthesized
gacggcatggggttgggtga

SEQ ID NO: 835 - DNA, 20 bp, Artificial Sequence
  chemically synthesized
cggcatggggttgggtgagg

SEQ ID NO: 836 - DNA, 20 bp, Artificial Sequence
  chemically synthesized
ggcatggggttgggtgaggg

SEQ ID NO: 837 - DNA, 20 bp, Artificial Sequence
  chemically synthesized
catggggttgggtgagggag

SEQ ID NO: 838 - DNA, 20 bp, Artificial Sequence
  chemically synthesized
tggggttgggtgagggagga

SEQ ID NO: 839 - DNA, 20 bp, Artificial Sequence
  chemically synthesized
ggtgagggaggagagatgcc

SEQ ID NO: 840 - DNA, 20 bp, Artificial Sequence
  chemically synthesized
tgagggaggagagatgcccg

SEQ ID NO: 841 - DNA, 20 bp, Artificial Sequence
  chemically synthesized
agggaggagagatgcccgga

SEQ ID NO: 842 - DNA, 20 bp, Artificial Sequence
  chemically synthesized
gggaggagagatgcccggag

SEQ ID NO: 843 - DNA, 20 bp, Artificial Sequence
  chemically synthesized
agagatgcccggagaggacc

SEQ ID NO: 844 - DNA, 20 bp, Artificial Sequence
  chemically synthesized
gcccggagaggacccagaca

SEQ ID NO: 845 - DNA, 20 bp, Artificial Sequence
  chemically synthesized
cccggagaggacccagacac

SEQ ID NO: 846 - DNA, 20 bp, Artificial Sequence
  chemically synthesized
ccggagaggacccagacacg

SEQ ID NO: 847 - DNA, 20 bp, Artificial Sequence
  chemically synthesized
ggagaggacccagacacggg

SEQ ID NO: 848 - DNA, 20 bp, Artificial Sequence
  chemically synthesized
gagaggacccagacacgggg

SEQ ID NO: 849 - DNA, 20 bp, Artificial Sequence
  chemically synthesized
agacacggggaggatccgct

SEQ ID NO: 850 - DNA, 20 bp, Artificial Sequence
  chemically synthesized
acacggggaggatccgctca

SEQ ID NO: 851 - DNA, 20 bp, Artificial Sequence
  chemically synthesized
cacggggaggatccgctcag

SEQ ID NO: 852 - DNA, 20 bp, Artificial Sequence
  chemically synthesized
tccgctcagaggacatcacg

SEQ ID NO: 853 - DNA, 20 bp, Artificial Sequence
  chemically synthesized
tcagaggacatcacgtggtg

SEQ ID NO: 854 - DNA, 20 bp, Artificial Sequence
  chemically synthesized
acatcacgtggtgcagcgcc

SEQ ID NO: 855 - DNA, 20 bp, Artificial Sequence
  chemically synthesized
tcacgtggtgcagcgccgag

SEQ ID NO: 856 - DNA, 20 bp, Artificial Sequence
  chemically synthesized
cacgtggtgcagcgccgaga

SEQ ID NO: 857 - DNA, 20 bp, Artificial Sequence
  chemically synthesized
gtggtgcagcgccgagaagg

SEQ ID NO: 858 - DNA, 20 bp, Artificial Sequence
  chemically synthesized
gcgccgagaaggaagtgctc

SEQ ID NO: 859 - DNA, 20 bp, Artificial Sequence
  chemically synthesized
cgagaaggaagtgctccgga

SEQ ID NO: 860 - DNA, 20 bp, Artificial Sequence
  chemically synthesized
agaaggaagtgctccggaaa

SEQ ID NO: 861 - DNA, 20 bp, Artificial Sequence
  chemically synthesized
tgctccggaaagagcatcct

SEQ ID NO: 862 - DNA, 20 bp, Artificial Sequence
  chemically synthesized
gctccggaaagagcatcctt

SEQ ID NO: 863 - DNA, 20 bp, Artificial Sequence
  chemically synthesized
ccggaaagagcatccttggg

SEQ ID NO: 864 - DNA, 20 bp, Artificial Sequence
  chemically synthesized
agcatccttgggcagcaaca

SEQ ID NO: 865 - DNA, 20 bp, Artificial Sequence
  chemically synthesized
atccttgggcagcaacacag

SEQ ID NO: 866 - DNA, 20 bp, Artificial Sequence
  chemically synthesized
ccttgggcagcaacacagca

SEQ ID NO: 867 - DNA, 20 bp, Artificial Sequence
  chemically synthesized
ttgggcagcaacacagcaga

SEQ ID NO: 868 - DNA, 20 bp, Artificial Sequence
  chemically synthesized
gcagcaacacagcagagagc

SEQ ID NO: 869 - DNA, 20 bp, Artificial Sequence
  chemically synthesized
cagcaacacagcagagagca

SEQ ID NO: 870 - DNA, 20 bp, Artificial Sequence
  chemically synthesized
agcaacacagcagagagcaa

SEQ ID NO: 871 - DNA, 20 bp, Artificial Sequence
  chemically synthesized
gcaacacagcagagagcaag

SEQ ID NO: 872 - DNA, 20 bp, Artificial Sequence
  chemically synthesized
acacagcagagagcaagggg

SEQ ID NO: 873 - DNA, 20 bp, Artificial Sequence
  chemically synthesized
acagcagagagcaaggggaa

SEQ ID NO: 874 - DNA, 20 bp, Artificial Sequence
  chemically synthesized
cagcagagagcaaggggaag

SEQ ID NO: 875 - DNA, 20 bp, Artificial Sequence
  chemically synthesized
agcagagagcaaggggaaga

SEQ ID NO: 876 - DNA, 20 bp, Artificial Sequence
  chemically synthesized
cagagagcaaggggaagagg

SEQ ID NO: 877 - DNA, 20 bp, Artificial Sequence
  chemically synthesized
agagcaaggggaagagggag

SEQ ID NO: 878 - DNA, 20 bp, Artificial Sequence
  chemically synthesized
agcaaggggaagagggagtg

SEQ ID NO: 879 - DNA, 20 bp, Artificial Sequence
  chemically synthesized
gcaaggggaagagggagtgg

SEQ ID NO: 880 - DNA, 20 bp, Artificial Sequence
  chemically synthesized
aggggaagagggagtggagg

SEQ ID NO: 881 - DNA, 20 bp, Artificial Sequence
  chemically synthesized
gaagagggagtggaggaaga

SEQ ID NO: 882 - DNA, 20 bp, Artificial Sequence
  chemically synthesized
gtggaggaagacggaacctg

SEQ ID NO: 883 - DNA, 20 bp, Artificial Sequence
  chemically synthesized
tggaggaagacggaacctga

SEQ ID NO: 884 - DNA, 20 bp, Artificial Sequence
  chemically synthesized
gaggaagacggaacctgaag

SEQ ID NO: 885 - DNA, 20 bp, Artificial Sequence
  chemically synthesized
aggaagacggaacctgaagg

SEQ ID NO: 886 - DNA, 20 bp, Artificial Sequence
  chemically synthesized
aagacggaacctgaaggagg

SEQ ID NO: 887 - DNA, 20 bp, Artificial Sequence
  chemically synthesized
acggaacctgaaggaggcgg

SEQ ID NO: 888 - DNA, 20 bp, Artificial Sequence
  chemically synthesized
cggaacctgaaggaggcggc

SEQ ID NO: 889 - DNA, 20 bp, Artificial Sequence
  chemically synthesized
ggaacctgaaggaggcggca

SEQ ID NO: 890 - DNA, 20 bp, Artificial Sequence
  chemically synthesized
acctgaaggaggcggcaggg

SEQ ID NO: 891 - DNA, 20 bp, Artificial Sequence
  chemically synthesized
cctgaaggaggcggcaggga

SEQ ID NO: 892 - DNA, 20 bp, Artificial Sequence
  chemically synthesized
ggaggcggcagggaaggatc

SEQ ID NO: 893 - DNA, 20 bp, Artificial Sequence
  chemically synthesized
gaggcggcagggaaggatct

SEQ ID NO: 894 - DNA, 20 bp, Artificial Sequence
  chemically synthesized
cggcagggaaggatctgggc

SEQ ID NO: 895 - DNA, 20 bp, Artificial Sequence
  chemically synthesized
ggaaggatctgggccagccg

SEQ ID NO: 896 - DNA, 20 bp, Artificial Sequence
  chemically synthesized
aaggatctgggccagccgta

SEQ ID NO: 897 - DNA, 20 bp, Artificial Sequence
  chemically synthesized
aggatctgggccagccgtag

SEQ ID NO: 898 - DNA, 20 bp, Artificial Sequence
  chemically synthesized
ggccagccgtagaggtgacc

SEQ ID NO: 899 - DNA, 20 bp, Artificial Sequence
  chemically synthesized
gccagccgtagaggtgaccc

SEQ ID NO: 900 - DNA, 20 bp, Artificial Sequence
  chemically synthesized
gtagaggtgacccaggccac

SEQ ID NO: 901 - DNA, 20 bp, Artificial Sequence
  chemically synthesized
gtgacccaggccacaagctg

SEQ ID NO: 902 - DNA, 20 bp, Artificial Sequence
  chemically synthesized
cccaggccacaagctgcaga

SEQ ID NO: 903 - DNA, 20 bp, Artificial Sequence
  chemically synthesized
ggccacaagctgcagacaga

SEQ ID NO: 904 - DNA, 20 bp, Artificial Sequence
  chemically synthesized
cacaagctgcagacagaaag

SEQ ID NO: 905 - DNA, 20 bp, Artificial Sequence
  chemically synthesized
gctgcagacagaaagcggca

SEQ ID NO: 906 - DNA, 20 bp, Artificial Sequence
  chemically synthesized
ctgcagacagaaagcggcac

SEQ ID NO: 907 - DNA, 20 bp, Artificial Sequence
  chemically synthesized
gacagaaagcggcacaggcc

SEQ ID NO: 908 - DNA, 20 bp, Artificial Sequence
  chemically synthesized
acagaaagcggcacaggccc

SEQ ID NO: 909 - DNA, 20 bp, Artificial Sequence
  chemically synthesized
cagaaagcggcacaggccca

SEQ ID NO: 910 - DNA, 20 bp, Artificial Sequence
  chemically synthesized
agaaagcggcacaggcccag

SEQ ID NO: 911 - DNA, 20 bp, Artificial Sequence
  chemically synthesized
aaagcggcacaggcccaggg

SEQ ID NO: 912 - DNA, 20 bp, Artificial Sequence
  chemically synthesized
agcggcacaggcccagggga

SEQ ID NO: 913 - DNA, 20 bp, Artificial Sequence
  chemically synthesized
caggcccaggggagagaatg

SEQ ID NO: 914 - DNA, 20 bp, Artificial Sequence
  chemically synthesized
aggcccaggggagagaatgc

SEQ ID NO: 915 - DNA, 20 bp, Artificial Sequence
  chemically synthesized
ccaggggagagaatgcaggt

SEQ ID NO: 916 - DNA, 20 bp, Artificial Sequence
  chemically synthesized
aggggagagaatgcaggtca

SEQ ID NO: 917 - DNA, 20 bp, Artificial Sequence
  chemically synthesized
gagagaatgcaggtcagaga

SEQ ID NO: 918 - DNA, 20 bp, Artificial Sequence
  chemically synthesized
agaatgcaggtcagagaaag

SEQ ID NO: 919 - DNA, 20 bp, Artificial Sequence
  chemically synthesized
gaatgcaggtcagagaaagc

SEQ ID NO: 920 - DNA, 20 bp, Artificial Sequence
  chemically synthesized
cagagaaagcaggacctgcc

SEQ ID NO: 921 - DNA, 20 bp, Artificial Sequence
  chemically synthesized
agagaaagcaggacctgcct

SEQ ID NO: 922 - DNA, 20 bp, Artificial Sequence
  chemically synthesized
gaaagcaggacctgcctggg

SEQ ID NO: 923 - DNA, 20 bp, Artificial Sequence
  chemically synthesized
aaagcaggacctgcctggga

SEQ ID NO: 924 - DNA, 20 bp, Artificial Sequence
  chemically synthesized
aagcaggacctgcctgggaa

SEQ ID NO: 925 - DNA, 20 bp, Artificial Sequence
  chemically synthesized
agcaggacctgcctgggaag

SEQ ID NO: 926 - DNA, 20 bp, Artificial Sequence
  chemically synthesized
acctgcctgggaaggggaaa

SEQ ID NO: 927 - DNA, 20 bp, Artificial Sequence
  chemically synthesized
tgcctgggaaggggaaacag

SEQ ID NO: 928 - DNA, 20 bp, Artificial Sequence
  chemically synthesized
gcctgggaaggggaaacagt

SEQ ID NO: 929 - DNA, 20 bp, Artificial Sequence
  chemically synthesized
gggaaggggaaacagtgggc

SEQ ID NO: 930 - DNA, 20 bp, Artificial Sequence
  chemically synthesized
gaaggggaaacagtgggcca

SEQ ID NO: 931 - DNA, 20 bp, Artificial Sequence
  chemically synthesized
aaggggaaacagtgggccag

SEQ ID NO: 932 - DNA, 20 bp, Artificial Sequence
  chemically synthesized
gggaaacagtgggccagagg

SEQ ID NO: 933 - DNA, 20 bp, Artificial Sequence
  chemically synthesized
acagtgggccagaggcggcg

SEQ ID NO: 934 - DNA, 20 bp, Artificial Sequence
  chemically synthesized
gtgggccagaggcggcgcag

SEQ ID NO: 935 - DNA, 20 bp, Artificial Sequence
  chemically synthesized
gccagaggcggcgcagaagc

SEQ ID NO: 936 - DNA, 20 bp, Artificial Sequence
  chemically synthesized
agaggcggcgcagaagccag

SEQ ID NO: 937 - DNA, 20 bp, Artificial Sequence
  chemically synthesized
aggcggcgcagaagccagta

SEQ ID NO: 938 - DNA, 20 bp, Artificial Sequence
  chemically synthesized
gcagaagccagtagagctca

SEQ ID NO: 939 - DNA, 20 bp, Artificial Sequence
  chemically synthesized
gaagccagtagagctcaaag

SEQ ID NO: 940 - DNA, 20 bp, Artificial Sequence
  chemically synthesized
cagtagagctcaaagtggtc

SEQ ID NO: 941 - DNA, 20 bp, Artificial Sequence
  chemically synthesized
agctcaaagtggtccggact

SEQ ID NO: 942 - DNA, 20 bp, Artificial Sequence
  chemically synthesized
gctcaaagtggtccggactc

SEQ ID NO: 943 - DNA, 20 bp, Artificial Sequence
  chemically synthesized
tcaaagtggtccggactcag

SEQ ID NO: 944 - DNA, 20 bp, Artificial Sequence
  chemically synthesized
aaagtggtccggactcagga

SEQ ID NO: 945 - DNA, 20 bp, Artificial Sequence
  chemically synthesized
agtggtccggactcaggaga

SEQ ID NO: 946 - DNA, 20 bp, Artificial Sequence
  chemically synthesized
gtccggactcaggagagaga

SEQ ID NO: 947 - DNA, 20 bp, Artificial Sequence
  chemically synthesized
cggactcaggagagagacgg

SEQ ID NO: 948 - DNA, 20 bp, Artificial Sequence
  chemically synthesized
caggagagagacggcagcgt

SEQ ID NO: 949 - DNA, 20 bp, Artificial Sequence
  chemically synthesized
ggagagagacggcagcgtta

SEQ ID NO: 950 - DNA, 20 bp, Artificial Sequence
  chemically synthesized
gagagagacggcagcgttag

SEQ ID NO: 951 - DNA, 20 bp, Artificial Sequence
  chemically synthesized
agagagacggcagcgttaga

SEQ ID NO: 952 - DNA, 20 bp, Artificial Sequence
  chemically synthesized
gagacggcagcgttagaggg

SEQ ID NO: 953 - DNA, 20 bp, Artificial Sequence
  chemically synthesized
gacggcagcgttagagggca

SEQ ID NO: 954 - DNA, 20 bp, Artificial Sequence
  chemically synthesized
agcgttagagggcagagttc

SEQ ID NO: 955 - DNA, 20 bp, Artificial Sequence
  chemically synthesized
gttagagggcagagttccgg

SEQ ID NO: 956 - DNA, 20 bp, Artificial Sequence
  chemically synthesized
agggcagagttccggcggca

SEQ ID NO: 957 - DNA, 20 bp, Artificial Sequence
  chemically synthesized
cagagttccggcggcacagc

SEQ ID NO: 958 - DNA, 20 bp, Artificial Sequence
  chemically synthesized
agagttccggcggcacagca

SEQ ID NO: 959 - DNA, 20 bp, Artificial Sequence
  chemically synthesized
gagttccggcggcacagcaa

SEQ ID NO: 960 - DNA, 20 bp, Artificial Sequence
  chemically synthesized
ggcggcacagcaagggcact

SEQ ID NO: 961 - DNA, 20 bp, Artificial Sequence
  chemically synthesized
gcggcacagcaagggcactc

SEQ ID NO: 962 - DNA, 20 bp, Artificial Sequence
  chemically synthesized
cggcacagcaagggcactcg

SEQ ID NO: 963 - DNA, 20 bp, Artificial Sequence
  chemically synthesized
ggcacagcaagggcactcgg

SEQ ID NO: 964 - DNA, 20 bp, Artificial Sequence
  chemically synthesized
cagcaagggcactcgggggc

SEQ ID NO: 965 - DNA, 20 bp, Artificial Sequence
  chemically synthesized
gcaagggcactcgggggcga

SEQ ID NO: 966 - DNA, 20 bp, Artificial Sequence
  chemically synthesized
caagggcactcgggggcgag

SEQ ID NO: 967 - DNA, 20 bp, Artificial Sequence
  chemically synthesized
agggcactcgggggcgagag

SEQ ID NO: 968 - DNA, 20 bp, Artificial Sequence
  chemically synthesized
gggcactcgggggcgagagg

SEQ ID NO: 969 - DNA, 20 bp, Artificial Sequence
  chemically synthesized
ggcactcgggggcgagagga

SEQ ID NO: 970 - DNA, 20 bp, Artificial Sequence
  chemically synthesized
actcgggggcgagaggaggg

SEQ ID NO: 971 - DNA, 20 bp, Artificial Sequence
  chemically synthesized
ggcgagaggagggcagcgca

SEQ ID NO: 972 - DNA, 20 bp, Artificial Sequence
  chemically synthesized
agggcagcgcaaagtgacaa

SEQ ID NO: 973 - DNA, 20 bp, Artificial Sequence
  chemically synthesized
cagcgcaaagtgacaatggc

SEQ ID NO: 974 - DNA, 20 bp, Artificial Sequence
  chemically synthesized
agcgcaaagtgacaatggcc

SEQ ID NO: 975 - DNA, 20 bp, Artificial Sequence
  chemically synthesized
gcgcaaagtgacaatggcca

SEQ ID NO: 976 - DNA, 20 bp, Artificial Sequence
  chemically synthesized
aaagtgacaatggccagggc

SEQ ID NO: 977 - DNA, 20 bp, Artificial Sequence
  chemically synthesized
aagtgacaatggccagggcc

SEQ ID NO: 978 - DNA, 20 bp, Artificial Sequence
  chemically synthesized
tgacaatggccagggccagg

SEQ ID NO: 979 - DNA, 20 bp, Artificial Sequence
  chemically synthesized
aatggccagggccaggcaga

SEQ ID NO: 980 - DNA, 20 bp, Artificial Sequence
  chemically synthesized
ccagggccaggcagatagac

SEQ ID NO: 981 - DNA, 20 bp, Artificial Sequence
  chemically synthesized
ccaggcagatagaccagact

SEQ ID NO: 982 - DNA, 20 bp, Artificial Sequence
  chemically synthesized
agatagaccagactgagcta

SEQ ID NO: 983 - DNA, 20 bp, Artificial Sequence
  chemically synthesized
gatagaccagactgagctat

SEQ ID NO: 984 - DNA, 20 bp, Artificial Sequence
  chemically synthesized
tagaccagactgagctatgg

SEQ ID NO: 985 - DNA, 20 bp, Artificial Sequence
  chemically synthesized
ccagactgagctatgggagc

SEQ ID NO: 986 - DNA, 20 bp, Artificial Sequence
  chemically synthesized
ctgagctatgggagctggct

SEQ ID NO: 987 - DNA, 20 bp, Artificial Sequence
  chemically synthesized
tgagctatgggagctggctc

SEQ ID NO: 988 - DNA, 20 bp, Artificial Sequence
  chemically synthesized
tatgggagctggctcaggtt

SEQ ID NO: 989 - DNA, 20 bp, Artificial Sequence
  chemically synthesized
atgggagctggctcaggttc

SEQ ID NO: 990 - DNA, 20 bp, Artificial Sequence
  chemically synthesized
gggagctggctcaggttcag

SEQ ID NO: 991 - DNA, 20 bp, Artificial Sequence
  chemically synthesized
gagctggctcaggttcagga

SEQ ID NO: 992 - DNA, 20 bp, Artificial Sequence
  chemically synthesized
agctggctcaggttcaggag

SEQ ID NO: 993 - DNA, 20 bp, Artificial Sequence
  chemically synthesized
gctggctcaggttcaggaga

SEQ ID NO: 994 - DNA, 20 bp, Artificial Sequence
  chemically synthesized
ggctcaggttcaggagaggg

SEQ ID NO: 995 - DNA, 20 bp, Artificial Sequence
  chemically synthesized
gctcaggttcaggagagggc

SEQ ID NO: 996 - DNA, 20 bp, Artificial Sequence
  chemically synthesized
ctcaggttcaggagagggca

SEQ ID NO: 997 - DNA, 20 bp, Artificial Sequence
  chemically synthesized
aggttcaggagagggcaggg

SEQ ID NO: 998 - DNA, 20 bp, Artificial Sequence
  chemically synthesized
ggttcaggagagggcagggc

SEQ ID NO: 999 - DNA, 20 bp, Artificial Sequence
  chemically synthesized
gttcaggagagggcagggca

SEQ ID NO: 1000 - DNA, 20 bp, Artificial Sequence
  chemically synthesized
caggagagggcagggcaggg

SEQ ID NO: 1001 - DNA, 20 bp, Artificial Sequence
  chemically synthesized
aggagagggcagggcaggga

SEQ ID NO: 1002 - DNA, 20 bp, Artificial Sequence
  chemically synthesized
gagagggcagggcagggaag

SEQ ID NO: 1003 - DNA, 20 bp, Artificial Sequence
  chemically synthesized
gcagggcagggaaggagaca

SEQ ID NO: 1004 - DNA, 20 bp, Artificial Sequence
  chemically synthesized
gcagggaaggagacaaagtc

SEQ ID NO: 1005 - DNA, 20 bp, Artificial Sequence
  chemically synthesized
cagggaaggagacaaagtcc

SEQ ID NO: 1006 - DNA, 20 bp, Artificial Sequence
  chemically synthesized
aaggagacaaagtccaggac

SEQ ID NO: 1007 - DNA, 20 bp, Artificial Sequence
  chemically synthesized
agacaaagtccaggaccggc

SEQ ID NO: 1008 - DNA, 20 bp, Artificial Sequence
  chemically synthesized
acaaagtccaggaccggctg

SEQ ID NO: 1009 - DNA, 20 bp, Artificial Sequence
  chemically synthesized
caaagtccaggaccggctgg

SEQ ID NO: 1010 - DNA, 20 bp, Artificial Sequence
  chemically synthesized
aaagtccaggaccggctgga

SEQ ID NO: 1011 - DNA, 20 bp, Artificial Sequence
  chemically synthesized
aagtccaggaccggctggag

SEQ ID NO: 1012 - DNA, 20 bp, Artificial Sequence
  chemically synthesized
cggctggaggggctcaacat

SEQ ID NO: 1013 - DNA, 20 bp, Artificial Sequence
  chemically synthesized
ctggaggggctcaacatcgg

SEQ ID NO: 1014 - DNA, 20 bp, Artificial Sequence
  chemically synthesized
ggaggggctcaacatcggaa

SEQ ID NO: 1015 - DNA, 20 bp, Artificial Sequence
  chemically synthesized
gaggggctcaacatcggaag

SEQ ID NO: 1016 - DNA, 20 bp, Artificial Sequence
  chemically synthesized
aggggctcaacatcggaaga

SEQ ID NO: 1017 - DNA, 20 bp, Artificial Sequence
  chemically synthesized
ggggctcaacatcggaagag

SEQ ID NO: 1018 - DNA, 20 bp, Artificial Sequence
  chemically synthesized
gctcaacatcggaagagggg

SEQ ID NO: 1019 - DNA, 20 bp, Artificial Sequence
  chemically synthesized
acatcggaagaggggaagtc

SEQ ID NO: 1020 - DNA, 20 bp, Artificial Sequence
  chemically synthesized
catcggaagaggggaagtcg

SEQ ID NO: 1021 - DNA, 20 bp, Artificial Sequence
  chemically synthesized
atcggaagaggggaagtcga

SEQ ID NO: 1022 - DNA, 20 bp, Artificial Sequence
  chemically synthesized
cggaagaggggaagtcgagg

SEQ ID NO: 1023 - DNA, 20 bp, Artificial Sequence
  chemically synthesized
ggaagaggggaagtcgaggg

SEQ ID NO: 1024 - DNA, 20 bp, Artificial Sequence
  chemically synthesized
gaagaggggaagtcgaggga

SEQ ID NO: 1025 - DNA, 20 bp, Artificial Sequence
  chemically synthesized
aggggaagtcgagggaggga

SEQ ID NO: 1026 - DNA, 20 bp, Artificial Sequence
  chemically synthesized
gaagtcgagggagggatggt

SEQ ID NO: 1027 - DNA, 20 bp, Artificial Sequence
  chemically synthesized
aagtcgagggagggatggta

SEQ ID NO: 1028 - DNA, 20 bp, Artificial Sequence
  chemically synthesized
gtcgagggagggatggtaag

SEQ ID NO: 1029 - DNA, 20 bp, Artificial Sequence
  chemically synthesized
tcgagggagggatggtaagg

SEQ ID NO: 1030 - DNA, 20 bp, Artificial Sequence
  chemically synthesized
ggatggtaaggaggactgca

SEQ ID NO: 1031 - DNA, 20 bp, Artificial Sequence
  chemically synthesized
gatggtaaggaggactgcat

SEQ ID NO: 1032 - DNA, 20 bp, Artificial Sequence
  chemically synthesized
gtaaggaggactgcatgggt

SEQ ID NO: 1033 - DNA, 20 bp, Artificial Sequence
  chemically synthesized
gaggactgcatgggtcagca

SEQ ID NO: 1034 - DNA, 20 bp, Artificial Sequence
  chemically synthesized
aggactgcatgggtcagcac

SEQ ID NO: 1035 - DNA, 20 bp, Artificial Sequence
  chemically synthesized
tgggtcagcacaggctgcca

SEQ ID NO: 1036 - DNA, 20 bp, Artificial Sequence
  chemically synthesized
tcagcacaggctgccaaagc

SEQ ID NO: 1037 - DNA, 20 bp, Artificial Sequence
  chemically synthesized
cagcacaggctgccaaagcc

SEQ ID NO: 1038 - DNA, 20 bp, Artificial Sequence
  chemically synthesized
agcacaggctgccaaagcca

SEQ ID NO: 1039 - DNA, 20 bp, Artificial Sequence
  chemically synthesized
caggctgccaaagccagggc

SEQ ID NO: 1040 - DNA, 20 bp, Artificial Sequence
  chemically synthesized
gccaaagccagggccagtta

SEQ ID NO: 1041 - DNA, 20 bp, Artificial Sequence
  chemically synthesized
cagttaaagcgactccaatg

SEQ ID NO: 1042 - DNA, 20 bp, Artificial Sequence
  chemically synthesized
ttaaagcgactccaatgcgg

SEQ ID NO: 1043 - DNA, 20 bp, Artificial Sequence
  chemically synthesized
aaagcgactccaatgcggaa

SEQ ID NO: 1044 - DNA, 20 bp, Artificial Sequence
  chemically synthesized
agcgactccaatgcggaaga

SEQ ID NO: 1045 - DNA, 20 bp, Artificial Sequence
  chemically synthesized
gactccaatgcggaagagag

SEQ ID NO: 1046 - DNA, 20 bp, Artificial Sequence
  chemically synthesized
actccaatgcggaagagagt

SEQ ID NO: 1047 - DNA, 20 bp, Artificial Sequence
  chemically synthesized
atgcggaagagagtaggtcg

SEQ ID NO: 1048 - DNA, 20 bp, Artificial Sequence
  chemically synthesized
tgcggaagagagtaggtcga

SEQ ID NO: 1049 - DNA, 20 bp, Artificial Sequence
  chemically synthesized
gcggaagagagtaggtcgaa

SEQ ID NO: 1050 - DNA, 20 bp, Artificial Sequence
  chemically synthesized
cggaagagagtaggtcgaag

SEQ ID NO: 1051 - DNA, 20 bp, Artificial Sequence
  chemically synthesized
gagagtaggtcgaaggggaa

SEQ ID NO: 1052 - DNA, 20 bp, Artificial Sequence
  chemically synthesized
gtaggtcgaaggggaatggt

SEQ ID NO: 1053 - DNA, 20 bp, Artificial Sequence
  chemically synthesized
taggtcgaaggggaatggta

SEQ ID NO: 1054 - DNA, 20 bp, Artificial Sequence
  chemically synthesized
ggtcgaaggggaatggtaag

SEQ ID NO: 1055 - DNA, 20 bp, Artificial Sequence
  chemically synthesized
gtcgaaggggaatggtaagg

SEQ ID NO: 1056 - DNA, 20 bp, Artificial Sequence
  chemically synthesized
aggggaatggtaaggaggcc

SEQ ID NO: 1057 - DNA, 20 bp, Artificial Sequence
  chemically synthesized
ggggaatggtaaggaggcct

SEQ ID NO: 1058 - DNA, 20 bp, Artificial Sequence
  chemically synthesized
gggaatggtaaggaggcctg

SEQ ID NO: 1059 - DNA, 20 bp, Artificial Sequence
  chemically synthesized
aatggtaaggaggcctgggg

SEQ ID NO: 1060 - DNA, 20 bp, Artificial Sequence
  chemically synthesized
tggtaaggaggcctggggca

SEQ ID NO: 1061 - DNA, 20 bp, Artificial Sequence
  chemically synthesized
taaggaggcctggggcagag

SEQ ID NO: 1062 - DNA, 20 bp, Artificial Sequence
  chemically synthesized
gaggcctggggcagagtggt

SEQ ID NO: 1063 - DNA, 20 bp, Artificial Sequence
  chemically synthesized
ctggggcagagtggtcagca

SEQ ID NO: 1064 - DNA, 20 bp, Artificial Sequence
  chemically synthesized
ggggcagagtggtcagcaca

SEQ ID NO: 1065 - DNA, 20 bp, Artificial Sequence
  chemically synthesized
gcagagtggtcagcacagag

SEQ ID NO: 1066 - DNA, 20 bp, Artificial Sequence
  chemically synthesized
gtggtcagcacagagtggct

SEQ ID NO: 1067 - DNA, 20 bp, Artificial Sequence
  chemically synthesized
cagcacagagtggctaagcc

SEQ ID NO: 1068 - DNA, 20 bp, Artificial Sequence
  chemically synthesized
agcacagagtggctaagccc

SEQ ID NO: 1069 - DNA, 20 bp, Artificial Sequence
  chemically synthesized
gcacagagtggctaagccca

SEQ ID NO: 1070 - DNA, 20 bp, Artificial Sequence
  chemically synthesized
agagtggctaagcccagggc

SEQ ID NO: 1071 - DNA, 20 bp, Artificial Sequence
  chemically synthesized
gctaagcccagggccagttg

SEQ ID NO: 1072 - DNA, 20 bp, Artificial Sequence
  chemically synthesized
aagcccagggccagttgaag

SEQ ID NO: 1073 - DNA, 20 bp, Artificial Sequence
  chemically synthesized
cagttgaagcggctccaatt

SEQ ID NO: 1074 - DNA, 20 bp, Artificial Sequence
  chemically synthesized
ttgaagcggctccaattcgg

SEQ ID NO: 1075 - DNA, 20 bp, Artificial Sequence
  chemically synthesized
aagcggctccaattcggaag

SEQ ID NO: 1076 - DNA, 20 bp, Artificial Sequence
  chemically synthesized
agcggctccaattcggaagt

SEQ ID NO: 1077 - DNA, 20 bp, Artificial Sequence
  chemically synthesized
gcggctccaattcggaagtg

SEQ ID NO: 1078 - DNA, 20 bp, Artificial Sequence
  chemically synthesized
gctccaattcggaagtgggg

SEQ ID NO: 1079 - DNA, 20 bp, Artificial Sequence
  chemically synthesized
attcggaagtggggtggtcg

SEQ ID NO: 1080 - DNA, 20 bp, Artificial Sequence
  chemically synthesized
ttcggaagtggggtggtcga

SEQ ID NO: 1081 - DNA, 20 bp, Artificial Sequence
  chemically synthesized
tcggaagtggggtggtcgaa

SEQ ID NO: 1082 - DNA, 20 bp, Artificial Sequence
  chemically synthesized
cggaagtggggtggtcgaag

SEQ ID NO: 1083 - DNA, 20 bp, Artificial Sequence
  chemically synthesized
gtggggtggtcgaaggggaa

SEQ ID NO: 1084 - DNA, 20 bp, Artificial Sequence
  chemically synthesized
ggtggtcgaaggggaatggt

SEQ ID NO: 1085 - DNA, 20 bp, Artificial Sequence
  chemically synthesized
gtggtcgaaggggaatggta

SEQ ID NO: 1086 - DNA, 20 bp, Artificial Sequence
  chemically synthesized
tggtcgaaggggaatggtaa

SEQ ID NO: 1087 - DNA, 20 bp, Artificial Sequence
  chemically synthesized
ggtcgaaggggaatggtaag

SEQ ID NO: 1088 - DNA, 20 bp, Artificial Sequence
  chemically synthesized
gtcgaaggggaatggtaagg

SEQ ID NO: 1089 - DNA, 20 bp, Artificial Sequence
  chemically synthesized
aggggaatggtaagggggac

SEQ ID NO: 1090 - DNA, 20 bp, Artificial Sequence
  chemically synthesized
ggggaatggtaagggggact

SEQ ID NO: 1091 - DNA, 20 bp, Artificial Sequence
  chemically synthesized
aatggtaagggggactggga

SEQ ID NO: 1092 - DNA, 20 bp, Artificial Sequence
  chemically synthesized
atggtaagggggactgggac

SEQ ID NO: 1093 - DNA, 20 bp, Artificial Sequence
  chemically synthesized
tggtaagggggactgggacg

SEQ ID NO: 1094 - DNA, 20 bp, Artificial Sequence
  chemically synthesized
gggggactgggacggggtgt

SEQ ID NO: 1095 - DNA, 20 bp, Artificial Sequence
  chemically synthesized
actgggacggggtgtcagca

SEQ ID NO: 1096 - DNA, 20 bp, Artificial Sequence
  chemically synthesized
ctgggacggggtgtcagcat

SEQ ID NO: 1097 - DNA, 20 bp, Artificial Sequence
  chemically synthesized
tgggacggggtgtcagcata

SEQ ID NO: 1098 - DNA, 20 bp, Artificial Sequence
  chemically synthesized
gacggggtgtcagcataggg

SEQ ID NO: 1099 - DNA, 20 bp, Artificial Sequence
  chemically synthesized
ggtgtcagcatagggtggca

SEQ ID NO: 1100 - DNA, 20 bp, Artificial Sequence
  chemically synthesized
cagcatagggtggcaaagcc

SEQ ID NO: 1101 - DNA, 20 bp, Artificial Sequence
  chemically synthesized
agcatagggtggcaaagccc

SEQ ID NO: 1102 - DNA, 20 bp, Artificial Sequence
  chemically synthesized
gcatagggtggcaaagccca

SEQ ID NO: 1103 - DNA, 20 bp, Artificial Sequence
  chemically synthesized
agggtggcaaagcccagggc

SEQ ID NO: 1104 - DNA, 20 bp, Artificial Sequence
  chemically synthesized
gggtggcaaagcccagggcc

SEQ ID NO: 1105 - DNA, 20 bp, Artificial Sequence
  chemically synthesized
aagcccagggccaggaacga

SEQ ID NO: 1106 - DNA, 20 bp, Artificial Sequence
  chemically synthesized
agcccagggccaggaacgac

SEQ ID NO: 1107 - DNA, 20 bp, Artificial Sequence
  chemically synthesized
gcccagggccaggaacgacg

SEQ ID NO: 1108 - DNA, 20 bp, Artificial Sequence
  chemically synthesized
cagggccaggaacgacgggg

SEQ ID NO: 1109 - DNA, 20 bp, Artificial Sequence
  chemically synthesized
caggaacgacggggcggatc

SEQ ID NO: 1110 - DNA, 20 bp, Artificial Sequence
  chemically synthesized
acgacggggcggatcgagac

SEQ ID NO: 1111 - DNA, 20 bp, Artificial Sequence
  chemically synthesized
gggcggatcgagactggcaa

SEQ ID NO: 1112 - DNA, 20 bp, Artificial Sequence
  chemically synthesized
ggcggatcgagactggcaac

SEQ ID NO: 1113 - DNA, 20 bp, Artificial Sequence
  chemically synthesized
gcggatcgagactggcaacg

SEQ ID NO: 1114 - DNA, 20 bp, Artificial Sequence
  chemically synthesized
gatcgagactggcaacgggg

SEQ ID NO: 1115 - DNA, 20 bp, Artificial Sequence
  chemically synthesized
atcgagactggcaacgggga

SEQ ID NO: 1116 - DNA, 20 bp, Artificial Sequence
  chemically synthesized
cgagactggcaacggggaag

SEQ ID NO: 1117 - DNA, 20 bp, Artificial Sequence
  chemically synthesized
gagactggcaacggggaagg

SEQ ID NO: 1118 - DNA, 20 bp, Artificial Sequence
  chemically synthesized
aacggggaaggaggatgccc

SEQ ID NO: 1119 - DNA, 20 bp, Artificial Sequence
  chemically synthesized
acggggaaggaggatgcccc

SEQ ID NO: 1120 - DNA, 20 bp, Artificial Sequence
  chemically synthesized
gggaaggaggatgccccagg

SEQ ID NO: 1121 - DNA, 20 bp, Artificial Sequence
  chemically synthesized
ggaggatgccccaggtggcg

SEQ ID NO: 1122 - DNA, 20 bp, Artificial Sequence
  chemically synthesized
ggatgccccaggtggcgcag

SEQ ID NO: 1123 - DNA, 20 bp, Artificial Sequence
  chemically synthesized
atgccccaggtggcgcagca

SEQ ID NO: 1124 - DNA, 20 bp, Artificial Sequence
  chemically synthesized
tgccccaggtggcgcagcag

SEQ ID NO: 1125 - DNA, 20 bp, Artificial Sequence
  chemically synthesized
gccccaggtggcgcagcaga

SEQ ID NO: 1126 - DNA, 20 bp, Artificial Sequence
  chemically synthesized
ccaggtggcgcagcagaggg

SEQ ID NO: 1127 - DNA, 20 bp, Artificial Sequence
  chemically synthesized
ggcgcagcagagggtggacc

SEQ ID NO: 1128 - DNA, 20 bp, Artificial Sequence
  chemically synthesized
gcagagggtggacctggccc

SEQ ID NO: 1129 - DNA, 20 bp, Artificial Sequence
  chemically synthesized
cagagggtggacctggcccc

SEQ ID NO: 1130 - DNA, 20 bp, Artificial Sequence
  chemically synthesized
gagggtggacctggccccgg

SEQ ID NO: 1131 - DNA, 20 bp, Artificial Sequence
  chemically synthesized
gacctggccccgggagacgc

SEQ ID NO: 1132 - DNA, 20 bp, Artificial Sequence
  chemically synthesized
acctggccccgggagacgcc

SEQ ID NO: 1133 - DNA, 20 bp, Artificial Sequence
  chemically synthesized
tggccccgggagacgccggg

SEQ ID NO: 1134 - DNA, 20 bp, Artificial Sequence
  chemically synthesized
ggccccgggagacgccgggc

SEQ ID NO: 1135 - DNA, 20 bp, Artificial Sequence
  chemically synthesized
gccccgggagacgccgggcg

SEQ ID NO: 1136 - DNA, 20 bp, Artificial Sequence
  chemically synthesized
ccccgggagacgccgggcgg

SEQ ID NO: 1137 - DNA, 20 bp, Artificial Sequence
  chemically synthesized
cccgggagacgccgggcggg

SEQ ID NO: 1138 - DNA, 20 bp, Artificial Sequence
  chemically synthesized
ccgggcggggggcgctgacc

SEQ ID NO: 1139 - DNA, 20 bp, Artificial Sequence
  chemically synthesized
cggggggcgctgacctggtg

SEQ ID NO: 1140 - DNA, 20 bp, Artificial Sequence
  chemically synthesized
ggggggcgctgacctggtgc

SEQ ID NO: 1141 - DNA, 20 bp, Artificial Sequence
  chemically synthesized
gggggcgctgacctggtgca

SEQ ID NO: 1142 - DNA, 20 bp, Artificial Sequence
  chemically synthesized
gtgcagggcgctgataccgt

SEQ ID NO: 1143 - DNA, 20 bp, Artificial Sequence
  chemically synthesized
ggcgctgataccgtcggcgt

SEQ ID NO: 1144 - DNA, 20 bp, Artificial Sequence
  chemically synthesized
gctgataccgtcggcgttgg

SEQ ID NO: 1145 - DNA, 20 bp, Artificial Sequence
  chemically synthesized
tgataccgtcggcgttggtg

SEQ ID NO: 1146 - DNA, 20 bp, Artificial Sequence
  chemically synthesized
ccgtcggcgttggtggagtc

SEQ ID NO: 1147 - DNA, 20 bp, Artificial Sequence
  chemically synthesized
ggcgttggtggagtccagca

SEQ ID NO: 1148 - DNA, 20 bp, Artificial Sequence
  chemically synthesized
tggtggagtccagcacggcg

SEQ ID NO: 1149 - DNA, 20 bp, Artificial Sequence
  chemically synthesized
ggtggagtccagcacggcgc

SEQ ID NO: 1150 - DNA, 20 bp, Artificial Sequence
  chemically synthesized
ggagtccagcacggcgcggg

SEQ ID NO: 1151 - DNA, 20 bp, Artificial Sequence
  chemically synthesized
gagtccagcacggcgcgggc

SEQ ID NO: 1152 - DNA, 20 bp, Artificial Sequence
  chemically synthesized
tccagcacggcgcgggcggg

SEQ ID NO: 1153 - DNA, 20 bp, Artificial Sequence
  chemically synthesized
agcacggcgcgggcgggcgg

SEQ ID NO: 1154 - DNA, 20 bp, Artificial Sequence
  chemically synthesized
ggcgcgggcgggcggcggcg

SEQ ID NO: 1155 - DNA, 20 bp, Artificial Sequence
  chemically synthesized
gcgggcgggcggcggcgcgg

SEQ ID NO: 1156 - DNA, 20 bp, Artificial Sequence
  chemically synthesized
cgggcgggcggcggcgcggc

SEQ ID NO: 1157 - DNA, 20 bp, Artificial Sequence
  chemically synthesized
gggcgggcggcggcgcggcg

SEQ ID NO: 1158 - DNA, 20 bp, Artificial Sequence
  chemically synthesized
ggcggcggcgcggcggggtc

SEQ ID NO: 1159 - DNA, 20 bp, Artificial Sequence
  chemically synthesized
cggcgcggcggggtcgagct

SEQ ID NO: 1160 - DNA, 20 bp, Artificial Sequence
  chemically synthesized
ggcggggtcgagctcggcgc

SEQ ID NO: 1161 - DNA, 20 bp, Artificial Sequence
  chemically synthesized
gcggggtcgagctcggcgcc

SEQ ID NO: 1162 - DNA, 20 bp, Artificial Sequence
  chemically synthesized
cggggtcgagctcggcgccg

SEQ ID NO: 1163 - DNA, 20 bp, Artificial Sequence
  chemically synthesized
gtcgagctcggcgccggggc

SEQ ID NO: 1164 - DNA, 20 bp, Artificial Sequence
  chemically synthesized
tcgagctcggcgccggggcc

SEQ ID NO: 1165 - DNA, 20 bp, Artificial Sequence
  chemically synthesized
cgagctcggcgccggggcca

SEQ ID NO: 1166 - DNA, 20 bp, Artificial Sequence
  chemically synthesized
ctcggcgccggggccagggt

SEQ ID NO: 1167 - DNA, 20 bp, Artificial Sequence
  chemically synthesized
ggcgccggggccagggtcgg

SEQ ID NO: 1168 - DNA, 20 bp, Artificial Sequence
  chemically synthesized
gggccagggtcggcggcgcg

SEQ ID NO: 1169 - DNA, 20 bp, Artificial Sequence
  chemically synthesized
gggtcggcggcgcgcagcat

SEQ ID NO: 1170 - DNA, 20 bp, Artificial Sequence
  chemically synthesized
agcatcagacgcgcctcgtc

SEQ ID NO: 1171 - DNA, 20 bp, Artificial Sequence
  chemically synthesized
gcatcagacgcgcctcgtcc

SEQ ID NO: 1172 - DNA, 20 bp, Artificial Sequence
  chemically synthesized
cgtccaggtcgccgcccgca

SEQ ID NO: 1173 - DNA, 20 bp, Artificial Sequence
  chemically synthesized
gtccaggtcgccgcccgcac

SEQ ID NO: 1174 - DNA, 20 bp, Artificial Sequence
  chemically synthesized
tcgccgcccgcacaggccgc

SEQ ID NO: 1175 - DNA, 20 bp, Artificial Sequence
  chemically synthesized
cgccgcccgcacaggccgcc

SEQ ID NO: 1176 - DNA, 20 bp, Artificial Sequence
  chemically synthesized
cgcacaggccgccaggaact

SEQ ID NO: 1177 - DNA, 20 bp, Artificial Sequence
  chemically synthesized
acaggccgccaggaactcgg

SEQ ID NO: 1178 - DNA, 20 bp, Artificial Sequence
  chemically synthesized
ggaactcggcggcgcgctcg

SEQ ID NO: 1179 - DNA, 20 bp, Artificial Sequence
  chemically synthesized
actcggcggcgcgctcgaag

SEQ ID NO: 1180 - DNA, 20 bp, Artificial Sequence
  chemically synthesized
ggcggcgcgctcgaagcgga

SEQ ID NO: 1181 - DNA, 20 bp, Artificial Sequence
  chemically synthesized
cgcgctcgaagcggacggtg

SEQ ID NO: 1182 - DNA, 20 bp, Artificial Sequence
  chemically synthesized
gcgctcgaagcggacggtgc

SEQ ID NO: 1183 - DNA, 20 bp, Artificial Sequence
  chemically synthesized
cgaagcggacggtgcgggcg

SEQ ID NO: 1184 - DNA, 20 bp, Artificial Sequence
  chemically synthesized
ggtgcgggcgcggcgctctc

SEQ ID NO: 1185 - DNA, 20 bp, Artificial Sequence
  chemically synthesized
gtgcgggcgcggcgctctcc

SEQ ID NO: 1186 - DNA, 20 bp, Artificial Sequence
  chemically synthesized
tgcgggcgcggcgctctccg

SEQ ID NO: 1187 - DNA, 20 bp, Artificial Sequence
  chemically synthesized
ggcgcggcgctctccggggc

SEQ ID NO: 1188 - DNA, 20 bp, Artificial Sequence
  chemically synthesized
gcgcggcgctctccggggcc

SEQ ID NO: 1189 - DNA, 20 bp, Artificial Sequence
  chemically synthesized
gcgctctccggggccaggct

SEQ ID NO: 1190 - DNA, 20 bp, Artificial Sequence
  chemically synthesized
gcccgcgccccccactgccg

SEQ ID NO: 1191 - DNA, 20 bp, Artificial Sequence
  chemically synthesized
gctgctcccgtcgccgctcc

SEQ ID NO: 1192 - DNA, 20 bp, Artificial Sequence
  chemically synthesized
ctgctcccgtcgccgctccc

SEQ ID NO: 1193 - DNA, 20 bp, Artificial Sequence
  chemically synthesized
ctcccgtcgccgctcccggg

SEQ ID NO: 1194 - DNA, 20 bp, Artificial Sequence
  chemically synthesized
gcagccgccgccgccgcccc

SEQ ID NO: 1195 - DNA, 20 bp, Artificial Sequence
  chemically synthesized
cagccgccgccgccgccccc

SEQ ID NO: 1196 - DNA, 20 bp, Artificial Sequence
  chemically synthesized
cgccgccgccgcccccgggc

SEQ ID NO: 1197 - DNA, 20 bp, Artificial Sequence
  chemically synthesized
gccgcccccgggccagccgc

SEQ ID NO: 1198 - DNA, 20 bp, Artificial Sequence
  chemically synthesized
ccgcccccgggccagccgcc

SEQ ID NO: 1199 - DNA, 20 bp, Artificial Sequence
  chemically synthesized
agccgccgggccatcctctc

SEQ ID NO: 1200 - DNA, 20 bp, Artificial Sequence
  chemically synthesized
catcgcaccgcccgcccgcc

SEQ ID NO: 1201 - DNA, 20 bp, Artificial Sequence
  chemically synthesized
gcaccgcccgcccgcccagc

SEQ ID NO: 1202 - DNA, 20 bp, Artificial Sequence
  chemically synthesized
cgcccgcccgcccagcgagc

SEQ ID NO: 1203 - DNA, 20 bp, Artificial Sequence
  chemically synthesized
cgcccgcccagcgagcgagc

SEQ ID NO: 1204 - DNA, 20 bp, Artificial Sequence
  chemically synthesized
ccagcgagcgagcgagcgcc

SEQ ID NO: 1205 - DNA, 20 bp, Artificial Sequence
  chemically synthesized
tggtggcggcggttggggct

SEQ ID NO: 1206 - DNA, 20 bp, Artificial Sequence
  chemically synthesized
ctcggcgctcgctcgctcgc

SEQ ID NO: 1207 - DNA, 20 bp, Artificial Sequence
  chemically synthesized
tcggcgctcgctcgctcgct

SEQ ID NO: 1208 - DNA, 20 bp, Artificial Sequence
  chemically synthesized
gcgctcgctcgctcgctggg

SEQ ID NO: 1209 - DNA, 20 bp, Artificial Sequence
  chemically synthesized
cgctcgctcgctcgctgggc

SEQ ID NO: 1210 - DNA, 20 bp, Artificial Sequence
  chemically synthesized
tcgctcgctcgctgggcggg

SEQ ID NO: 1211 - DNA, 20 bp, Artificial Sequence
  chemically synthesized
cgctcgctcgctgggcgggc

SEQ ID NO: 1212 - DNA, 20 bp, Artificial Sequence
  chemically synthesized
tcgctcgctgggcgggcggg

SEQ ID NO: 1213 - DNA, 20 bp, Artificial Sequence
  chemically synthesized
cgggcgggcggtgcgatgtc

SEQ ID NO: 1214 - DNA, 20 bp, Artificial Sequence
  chemically synthesized
ggcgggcggtgcgatgtccg

SEQ ID NO: 1215 - DNA, 20 bp, Artificial Sequence
  chemically synthesized
cgggcggtgcgatgtccgga

SEQ ID NO: 1216 - DNA, 20 bp, Artificial Sequence
  chemically synthesized
gggcggtgcgatgtccggag

SEQ ID NO: 1217 - DNA, 20 bp, Artificial Sequence
  chemically synthesized
ggtgcgatgtccggagagga

SEQ ID NO: 1218 - DNA, 20 bp, Artificial Sequence
  chemically synthesized
gatgtccggagaggatggcc

SEQ ID NO: 1219 - DNA, 20 bp, Artificial Sequence
  chemically synthesized
gtccggagaggatggcccgg

SEQ ID NO: 1220 - DNA, 20 bp, Artificial Sequence
  chemically synthesized
ggagaggatggcccggcggc

SEQ ID NO: 1221 - DNA, 20 bp, Artificial Sequence
  chemically synthesized
ggatggcccggcggctggcc

SEQ ID NO: 1222 - DNA, 20 bp, Artificial Sequence
  chemically synthesized
gatggcccggcggctggccc

SEQ ID NO: 1223 - DNA, 20 bp, Artificial Sequence
  chemically synthesized
atggcccggcggctggcccg

SEQ ID NO: 1224 - DNA, 20 bp, Artificial Sequence
  chemically synthesized
tggcccggcggctggcccgg

SEQ ID NO: 1225 - DNA, 20 bp, Artificial Sequence
  chemically synthesized
cccggcggctggcccggggg

SEQ ID NO: 1226 - DNA, 20 bp, Artificial Sequence
  chemically synthesized
ggcggctggcccgggggcgg

SEQ ID NO: 1227 - DNA, 20 bp, Artificial Sequence
  chemically synthesized
ggctggcccgggggcggcgg

SEQ ID NO: 1228 - DNA, 20 bp, Artificial Sequence
  chemically synthesized
tggcccgggggcggcggcgg

SEQ ID NO: 1229 - DNA, 20 bp, Artificial Sequence
  chemically synthesized
gggcggcggcggcggctgcc

SEQ ID NO: 1230 - DNA, 20 bp, Artificial Sequence
  chemically synthesized
ggcggcggcggcggctgccc

SEQ ID NO: 1231 - DNA, 20 bp, Artificial Sequence
  chemically synthesized
cggcggcggcggctgcccgg

SEQ ID NO: 1232 - DNA, 20 bp, Artificial Sequence
  chemically synthesized
cggcggcggctgcccgggag

SEQ ID NO: 1233 - DNA, 20 bp, Artificial Sequence
  chemically synthesized
cggctgcccgggagcggcga

SEQ ID NO: 1234 - DNA, 20 bp, Artificial Sequence
  chemically synthesized
ggctgcccgggagcggcgac

SEQ ID NO: 1235 - DNA, 20 bp, Artificial Sequence
  chemically synthesized
ctgcccgggagcggcgacgg

SEQ ID NO: 1236 - DNA, 20 bp, Artificial Sequence
  chemically synthesized
cccgggagcggcgacgggag

SEQ ID NO: 1237 - DNA, 20 bp, Artificial Sequence
  chemically synthesized
agcggcgacgggagcagctg

SEQ ID NO: 1238 - DNA, 20 bp, Artificial Sequence
  chemically synthesized
ggcgacgggagcagctgcgg

SEQ ID NO: 1239 - DNA, 20 bp, Artificial Sequence
  chemically synthesized
gacgggagcagctgcggcag

SEQ ID NO: 1240 - DNA, 20 bp, Artificial Sequence
  chemically synthesized
acgggagcagctgcggcagt

SEQ ID NO: 1241 - DNA, 20 bp, Artificial Sequence
  chemically synthesized
cgggagcagctgcggcagtg

SEQ ID NO: 1242 - DNA, 20 bp, Artificial Sequence
  chemically synthesized
gggagcagctgcggcagtgg

SEQ ID NO: 1243 - DNA, 20 bp, Artificial Sequence
  chemically synthesized
ggagcagctgcggcagtggg

SEQ ID NO: 1244 - DNA, 20 bp, Artificial Sequence
  chemically synthesized
agctgcggcagtggggggcg

SEQ ID NO: 1245 - DNA, 20 bp, Artificial Sequence
  chemically synthesized
gctgcggcagtggggggcgc

SEQ ID NO: 1246 - DNA, 20 bp, Artificial Sequence
  chemically synthesized
gcggcagtggggggcgcggg

SEQ ID NO: 1247 - DNA, 20 bp, Artificial Sequence
  chemically synthesized
cggcagtggggggcgcgggc

SEQ ID NO: 1248 - DNA, 20 bp, Artificial Sequence
  chemically synthesized
ggggggcgcgggcgggcgcc

SEQ ID NO: 1249 - DNA, 20 bp, Artificial Sequence
  chemically synthesized
gcgcgggcgggcgccgagcc

SEQ ID NO: 1250 - DNA, 20 bp, Artificial Sequence
  chemically synthesized
gcgggcgccgagcctggccc

SEQ ID NO: 1251 - DNA, 20 bp, Artificial Sequence
  chemically synthesized
gggcgccgagcctggccccg

SEQ ID NO: 1252 - DNA, 20 bp, Artificial Sequence
  chemically synthesized
gcgccgagcctggccccgga

SEQ ID NO: 1253 - DNA, 20 bp, Artificial Sequence
  chemically synthesized
gcgcccgcaccgtccgcttc

SEQ ID NO: 1254 - DNA, 20 bp, Artificial Sequence
  chemically synthesized
tccgcttcgagcgcgccgcc

SEQ ID NO: 1255 - DNA, 20 bp, Artificial Sequence
  chemically synthesized
cgagcgcgccgccgagttcc

SEQ ID NO: 1256 - DNA, 20 bp, Artificial Sequence
  chemically synthesized
gcgcgccgccgagttcctgg

SEQ ID NO: 1257 - DNA, 20 bp, Artificial Sequence
  chemically synthesized
cgagttcctggcggcctgtg

SEQ ID NO: 1258 - DNA, 20 bp, Artificial Sequence
  chemically synthesized
gagttcctggcggcctgtgc

SEQ ID NO: 1259 - DNA, 20 bp, Artificial Sequence
  chemically synthesized
ttcctggcggcctgtgcggg

SEQ ID NO: 1260 - DNA, 20 bp, Artificial Sequence
  chemically synthesized
ggcctgtgcgggcggcgacc

SEQ ID NO: 1261 - DNA, 20 bp, Artificial Sequence
  chemically synthesized
gtgcgggcggcgacctggac

SEQ ID NO: 1262 - DNA, 20 bp, Artificial Sequence
  chemically synthesized
tgcgggcggcgacctggacg

SEQ ID NO: 1263 - DNA, 20 bp, Artificial Sequence
  chemically synthesized
atgctgcgcgccgccgaccc

SEQ ID NO: 1264 - DNA, 20 bp, Artificial Sequence
  chemically synthesized
cgcgccgccgaccctggccc

SEQ ID NO: 1265 - DNA, 20 bp, Artificial Sequence
  chemically synthesized
ccgaccctggccccggcgcc

SEQ ID NO: 1266 - DNA, 20 bp, Artificial Sequence
  chemically synthesized
gccgcccgcccgcgccgtgc

SEQ ID NO: 1267 - DNA, 20 bp, Artificial Sequence
  chemically synthesized
ctggactccaccaacgccga

SEQ ID NO: 1268 - DNA, 20 bp, Artificial Sequence
  chemically synthesized
tccaccaacgccgacggtat

SEQ ID NO: 1269 - DNA, 20 bp, Artificial Sequence
  chemically synthesized
acggtatcagcgccctgcac

SEQ ID NO: 1270 - DNA, 20 bp, Artificial Sequence
  chemically synthesized
cggtatcagcgccctgcacc

SEQ ID NO: 1271 - DNA, 20 bp, Artificial Sequence
  chemically synthesized
atcagcgccctgcaccaggt

SEQ ID NO: 1272 - DNA, 20 bp, Artificial Sequence
  chemically synthesized
ccaggtcagcgccccccgcc

SEQ ID NO: 1273 - DNA, 20 bp, Artificial Sequence
  chemically synthesized
gccccccgcccggcgtctcc

SEQ ID NO: 1274 - DNA, 20 bp, Artificial Sequence
  chemically synthesized
ccccccgcccggcgtctccc

SEQ ID NO: 1275 - DNA, 20 bp, Artificial Sequence
  chemically synthesized
cccccgcccggcgtctcccg

SEQ ID NO: 1276 - DNA, 20 bp, Artificial Sequence
  chemically synthesized
cgcccggcgtctcccggggc

SEQ ID NO: 1277 - DNA, 20 bp, Artificial Sequence
  chemically synthesized
gcccggcgtctcccggggcc

SEQ ID NO: 1278 - DNA, 20 bp, Artificial Sequence
  chemically synthesized
ccaccctctgctgcgccacc

SEQ ID NO: 1279 - DNA, 20 bp, Artificial Sequence
  chemically synthesized
caccctctgctgcgccacct

SEQ ID NO: 1280 - DNA, 20 bp, Artificial Sequence
  chemically synthesized
accctctgctgcgccacctg

SEQ ID NO: 1281 - DNA, 20 bp, Artificial Sequence
  chemically synthesized
gcatcctccttccccgttgc

SEQ ID NO: 1282 - DNA, 20 bp, Artificial Sequence
  chemically synthesized
tcgatccgccccgtcgttcc

SEQ ID NO: 1283 - DNA, 20 bp, Artificial Sequence
  chemically synthesized
cgccccgtcgttcctggccc

SEQ ID NO: 1284 - DNA, 20 bp, Artificial Sequence
  chemically synthesized
gccccgtcgttcctggccct

SEQ ID NO: 1285 - DNA, 20 bp, Artificial Sequence
  chemically synthesized
cctatgctgacaccccgtcc

SEQ ID NO: 1286 - DNA, 20 bp, Artificial Sequence
  chemically synthesized
cgaccaccccacttccgaat

SEQ ID NO: 1287 - DNA, 20 bp, Artificial Sequence
  chemically synthesized
accaccccacttccgaattg

SEQ ID NO: 1288 - DNA, 20 bp, Artificial Sequence
  chemically synthesized
cgaattggagccgcttcaac

SEQ ID NO: 1289 - DNA, 20 bp, Artificial Sequence
  chemically synthesized
ggagccgcttcaactggccc

SEQ ID NO: 1290 - DNA, 20 bp, Artificial Sequence
  chemically synthesized
gagccgcttcaactggccct

SEQ ID NO: 1291 - DNA, 20 bp, Artificial Sequence
  chemically synthesized
gcttcaactggccctgggct

SEQ ID NO: 1292 - DNA, 20 bp, Artificial Sequence
  chemically synthesized
ctgtgctgaccactctgccc

SEQ ID NO: 1293 - DNA, 20 bp, Artificial Sequence
  chemically synthesized
tgtgctgaccactctgcccc

SEQ ID NO: 1294 - DNA, 20 bp, Artificial Sequence
  chemically synthesized
cgacctactctcttccgcat

SEQ ID NO: 1295 - DNA, 20 bp, Artificial Sequence
  chemically synthesized
acctactctcttccgcattg

SEQ ID NO: 1296 - DNA, 20 bp, Artificial Sequence
  chemically synthesized
cgcattggagtcgctttaac

SEQ ID NO: 1297 - DNA, 20 bp, Artificial Sequence
  chemically synthesized
ggagtcgctttaactggccc

SEQ ID NO: 1298 - DNA, 20 bp, Artificial Sequence
  chemically synthesized
gctttaactggccctggctt

SEQ ID NO: 1299 - DNA, 20 bp, Artificial Sequence
  chemically synthesized
ttaactggccctggctttgg

SEQ ID NO: 1300 - DNA, 20 bp, Artificial Sequence
  chemically synthesized
gcagcctgtgctgacccatg

SEQ ID NO: 1301 - DNA, 20 bp, Artificial Sequence
  chemically synthesized
acttcccctcttccgatgtt

SEQ ID NO: 1302 - DNA, 20 bp, Artificial Sequence
  chemically synthesized
cttccgatgttgagcccctc

SEQ ID NO: 1303 - DNA, 20 bp, Artificial Sequence
  chemically synthesized
cgatgttgagcccctccagc

SEQ ID NO: 1304 - DNA, 20 bp, Artificial Sequence
  chemically synthesized
tgagcccctccagccggtcc

SEQ ID NO: 1305 - DNA, 20 bp, Artificial Sequence
  chemically synthesized
ccctgccctctcctgaacct

SEQ ID NO: 1306 - DNA, 20 bp, Artificial Sequence
  chemically synthesized
gccctctcctgaacctgagc

SEQ ID NO: 1307 - DNA, 20 bp, Artificial Sequence
  chemically synthesized
tgaacctgagccagctccca

SEQ ID NO: 1308 - DNA, 20 bp, Artificial Sequence
  chemically synthesized
ctgagccagctcccatagct

SEQ ID NO: 1309 - DNA, 20 bp, Artificial Sequence
  chemically synthesized
ccagctcccatagctcagtc

SEQ ID NO: 1310 - DNA, 20 bp, Artificial Sequence
  chemically synthesized
ctcagtctggtctatctgcc

SEQ ID NO: 1311 - DNA, 20 bp, Artificial Sequence
  chemically synthesized
ctggtctatctgcctggccc

SEQ ID NO: 1312 - DNA, 20 bp, Artificial Sequence
  chemically synthesized
gctgccctcctctcgccccc

SEQ ID NO: 1313 - DNA, 20 bp, Artificial Sequence
  chemically synthesized
gagtgcccttgctgtgccgc

SEQ ID NO: 1314 - DNA, 20 bp, Artificial Sequence
  chemically synthesized
aacgctgccgtctctctcct

SEQ ID NO: 1315 - DNA, 20 bp, Artificial Sequence
  chemically synthesized
tgccgtctctctcctgagtc

SEQ ID NO: 1316 - DNA, 20 bp, Artificial Sequence
  chemically synthesized
tcctgagtccggaccacttt

SEQ ID NO: 1317 - DNA, 20 bp, Artificial Sequence
  chemically synthesized
cggaccactttgagctctac

SEQ ID NO: 1318 - DNA, 20 bp, Artificial Sequence
  chemically synthesized
actggcttctgcgccgcctc

SEQ ID NO: 1319 - DNA, 20 bp, Artificial Sequence
  chemically synthesized
ggcccactgtttccccttcc

SEQ ID NO: 1320 - DNA, 20 bp, Artificial Sequence
  chemically synthesized
gcccactgtttccccttccc

SEQ ID NO: 1321 - DNA, 20 bp, Artificial Sequence
  chemically synthesized
cactgtttccccttcccagg

SEQ ID NO: 1322 - DNA, 20 bp, Artificial Sequence
  chemically synthesized
actgtttccccttcccaggc

SEQ ID NO: 1323 - DNA, 20 bp, Artificial Sequence
  chemically synthesized
ctgacctgcattctctcccc

SEQ ID NO: 1324 - DNA, 20 bp, Artificial Sequence
  chemically synthesized
tgacctgcattctctcccct

SEQ ID NO: 1325 - DNA, 20 bp, Artificial Sequence
  chemically synthesized
cctgtgccgctttctgtctg

SEQ ID NO: 1326 - DNA, 20 bp, Artificial Sequence
  chemically synthesized
cgctttctgtctgcagcttg

SEQ ID NO: 1327 - DNA, 20 bp, Artificial Sequence
  chemically synthesized
tctgtctgcagcttgtggcc

SEQ ID NO: 1328 - DNA, 20 bp, Artificial Sequence
  chemically synthesized
ctgtctgcagcttgtggcct

SEQ ID NO: 1329 - DNA, 20 bp, Artificial Sequence
  chemically synthesized
tgtggcctgggtcacctcta

SEQ ID NO: 1330 - DNA, 20 bp, Artificial Sequence
  chemically synthesized
gcctgggtcacctctacggc

SEQ ID NO: 1331 - DNA, 20 bp, Artificial Sequence
  chemically synthesized
ggtcacctctacggctggcc

SEQ ID NO: 1332 - DNA, 20 bp, Artificial Sequence
  chemically synthesized
tccttccctgccgcctcctt

SEQ ID NO: 1333 - DNA, 20 bp, Artificial Sequence
  chemically synthesized
ccttccctgccgcctccttc

SEQ ID NO: 1334 - DNA, 20 bp, Artificial Sequence
  chemically synthesized
tctctgctgtgttgctgccc

SEQ ID NO: 1335 - DNA, 20 bp, Artificial Sequence
  chemically synthesized
ctctgctgtgttgctgccca

SEQ ID NO: 1336 - DNA, 20 bp, Artificial Sequence
  chemically synthesized
ctgcccaaggatgctctttc

SEQ ID NO: 1337 - DNA, 20 bp, Artificial Sequence
  chemically synthesized
gcccaaggatgctctttccg

SEQ ID NO: 1338 - DNA, 20 bp, Artificial Sequence
  chemically synthesized
tttccggagcacttccttct

SEQ ID NO: 1339 - DNA, 20 bp, Artificial Sequence
  chemically synthesized
tgcaccacgtgatgtcctct

SEQ ID NO: 1340 - DNA, 20 bp, Artificial Sequence
  chemically synthesized
accacgtgatgtcctctgag

SEQ ID NO: 1341 - DNA, 20 bp, Artificial Sequence
  chemically synthesized
gagcggatcctccccgtgtc

SEQ ID NO: 1342 - DNA, 20 bp, Artificial Sequence
  chemically synthesized
agcggatcctccccgtgtct

SEQ ID NO: 1343 - DNA, 20 bp, Artificial Sequence
  chemically synthesized
ccccgtgtctgggtcctctc

SEQ ID NO: 1344 - DNA, 20 bp, Artificial Sequence
  chemically synthesized
cccgtgtctgggtcctctcc

SEQ ID NO: 1345 - DNA, 20 bp, Artificial Sequence
  chemically synthesized
cccatgccgtcttcactcgc

SEQ ID NO: 1346 - DNA, 20 bp, Artificial Sequence
  chemically synthesized
ccatgccgtcttcactcgct

SEQ ID NO: 1347 - DNA, 20 bp, Artificial Sequence
  chemically synthesized
ttcccttttccttctccttc

SEQ ID NO: 1348 - DNA, 20 bp, Artificial Sequence
  chemically synthesized
tcccttttccttctccttct

SEQ ID NO: 1349 - DNA, 20 bp, Artificial Sequence
  chemically synthesized
cccttttccttctccttctg

SEQ ID NO: 1350 - DNA, 20 bp, Artificial Sequence
  chemically synthesized
ctgtgccatctctcgtttct

SEQ ID NO: 1351 - DNA, 20 bp, Artificial Sequence
  chemically synthesized
tgtgccatctctcgtttctt

SEQ ID NO: 1352 - DNA, 20 bp, Artificial Sequence
  chemically synthesized
ccatctctcgtttcttagga

SEQ ID NO: 1353 - DNA, 20 bp, Artificial Sequence
  chemically synthesized
cttaggatggccttctccga

SEQ ID NO: 1354 - DNA, 20 bp, Artificial Sequence
  chemically synthesized
cgtcccgcctccccttcttg

SEQ ID NO: 1355 - DNA, 20 bp, Artificial Sequence
  chemically synthesized
gtcccgcctccccttcttgt

SEQ ID NO: 1356 - DNA, 20 bp, Artificial Sequence
  chemically synthesized
ctgcatcatcaccgtttttc

SEQ ID NO: 1357 - DNA, 20 bp, Artificial Sequence
  chemically synthesized
cgtttttctggacaacccca

SEQ ID NO: 1358 - DNA, 20 bp, Artificial Sequence
  chemically synthesized
cccaaagtaccccgtctccc

SEQ ID NO: 1359 - DNA, 20 bp, Artificial Sequence
  chemically synthesized
gtaccccgtctccctggctt

SEQ ID NO: 1360 - DNA, 20 bp, Artificial Sequence
  chemically synthesized
atcctcttgctttctttgcc

SEQ ID NO: 1361 - DNA, 20 bp, Artificial Sequence
  chemically synthesized
ctggacaccccgttctcctg

SEQ ID NO: 1362 - DNA, 20 bp, Artificial Sequence
  chemically synthesized
accccgttctcctgtggatt

SEQ ID NO: 1363 - DNA, 20 bp, Artificial Sequence
  chemically synthesized
ccccgttctcctgtggattc

SEQ ID NO: 1364 - DNA, 20 bp, Artificial Sequence
  chemically synthesized
cacctctcactcctttcatt

SEQ ID NO: 1365 - DNA, 20 bp, Artificial Sequence
  chemically synthesized
acctctcactcctttcattt

SEQ ID NO: 1366 - DNA, 20 bp, Artificial Sequence
  chemically synthesized
tctcactcctttcatttggg

SEQ ID NO: 1367 - DNA, 20 bp, Artificial Sequence
  chemically synthesized
ccctaccccccttacctctc

SEQ ID NO: 1368 - DNA, 20 bp, Artificial Sequence
  chemically synthesized
cttacctctctagtctgtgc

SEQ ID NO: 1369 - DNA, 20 bp, Artificial Sequence
  chemically synthesized
ctagtctgtgctagctcttc

SEQ ID NO: 1370 - DNA, 20 bp, Artificial Sequence
  chemically synthesized
gctcttccagccccctgtca

SEQ ID NO: 1371 - DNA, 20 bp, Artificial Sequence
  chemically synthesized
ccccctgtcatggcatcttc

SEQ ID NO: 1372 - DNA, 20 bp, Artificial Sequence
  chemically synthesized
cccctgtcatggcatcttcc

SEQ ID NO: 1373 - DNA, 20 bp, Artificial Sequence
  chemically synthesized
ccctgtcatggcatcttcca

SEQ ID NO: 1374 - DNA, 20 bp, Artificial Sequence
  chemically synthesized
cctgtcatggcatcttccag

SEQ ID NO: 1375 - DNA, 20 bp, Artificial Sequence
  chemically synthesized
atggcatcttccaggggtcc

SEQ ID NO: 1376 - DNA, 20 bp, Artificial Sequence
  chemically synthesized
ggcatcttccaggggtccga

SEQ ID NO: 1377 - DNA, 20 bp, Artificial Sequence
  chemically synthesized
cttccaggggtccgagagct

SEQ ID NO: 1378 - DNA, 20 bp, Artificial Sequence
  chemically synthesized
caggggtccgagagctcagc

SEQ ID NO: 1379 - DNA, 20 bp, Artificial Sequence
  chemically synthesized
ctagtcttcttcctccaacc

SEQ ID NO: 1380 - DNA, 20 bp, Artificial Sequence
  chemically synthesized
tagtcttcttcctccaaccc

SEQ ID NO: 1381 - DNA, 20 bp, Artificial Sequence
  chemically synthesized
ccgggcccctatgtccactt

SEQ ID NO: 1382 - DNA, 20 bp, Artificial Sequence
  chemically synthesized
cgggcccctatgtccacttc

SEQ ID NO: 1383 - DNA, 20 bp, Artificial Sequence
  chemically synthesized
cccctatgtccacttcagga

SEQ ID NO: 1384 - DNA, 20 bp, Artificial Sequence
  chemically synthesized
gacagcatgtttgctgcctc

SEQ ID NO: 1385 - DNA, 20 bp, Artificial Sequence
  chemically synthesized
acagcatgtttgctgcctcc

SEQ ID NO: 1386 - DNA, 20 bp, Artificial Sequence
  chemically synthesized
cagcatgtttgctgcctcca

SEQ ID NO: 1387 - DNA, 20 bp, Artificial Sequence
  chemically synthesized
tccagggatcctgtgtcccc

SEQ ID NO: 1388 - DNA, 20 bp, Artificial Sequence
  chemically synthesized
gggatcctgtgtccccgagc

SEQ ID NO: 1389 - DNA, 20 bp, Artificial Sequence
  chemically synthesized
ggatcctgtgtccccgagct

SEQ ID NO: 1390 - DNA, 20 bp, Artificial Sequence
  chemically synthesized
ctgggaccaccttatattcc

SEQ ID NO: 1391 - DNA, 20 bp, Artificial Sequence
  chemically synthesized
tgggaccaccttatattccc

SEQ ID NO: 1392 - DNA, 20 bp, Artificial Sequence
  chemically synthesized
gggaccaccttatattccca

SEQ ID NO: 1393 - DNA, 20 bp, Artificial Sequence
  chemically synthesized
ccaccttatattcccagggc

SEQ ID NO: 1394 - DNA, 20 bp, Artificial Sequence
  chemically synthesized
attcccagggccggttaatg

SEQ ID NO: 1395 - DNA, 20 bp, Artificial Sequence
  chemically synthesized
agggccggttaatgtggctc

SEQ ID NO: 1396 - DNA, 20 bp, Artificial Sequence
  chemically synthesized
ggttaatgtggctctggttc

SEQ ID NO: 1397 - DNA, 20 bp, Artificial Sequence
  chemically synthesized
gttaatgtggctctggttct

SEQ ID NO: 1398 - DNA, 20 bp, Artificial Sequence
  chemically synthesized
tatctgtcccctccacccca

SEQ ID NO: 1399 - DNA, 20 bp, Artificial Sequence
  chemically synthesized
ctgtcccctccaccccacag

SEQ ID NO: 1400 - DNA, 20 bp, Artificial Sequence
  chemically synthesized
tgtcccctccaccccacagt

SEQ ID NO: 1401 - DNA, 20 bp, Artificial Sequence
  chemically synthesized
gtcccctccaccccacagtg

SEQ ID NO: 1402 - DNA, 20 bp, Artificial Sequence
  chemically synthesized
ccaccccacagtggggccac

SEQ ID NO: 1403 - DNA, 20 bp, Artificial Sequence
  chemically synthesized
caccccacagtggggccact

SEQ ID NO: 1404 - DNA, 20 bp, Artificial Sequence
  chemically synthesized
accccacagtggggccacta

SEQ ID NO: 1405 - DNA, 20 bp, Artificial Sequence
  chemically synthesized
cacagtggggccactaggga

SEQ ID NO: 1406 - DNA, 20 bp, Artificial Sequence
  chemically synthesized
acagtggggccactagggac

SEQ ID NO: 1407 - DNA, 20 bp, Artificial Sequence
  chemically synthesized
ggggccactagggacaggat

SEQ ID NO: 1408 - DNA, 20 bp, Artificial Sequence
  chemically synthesized
actagggacaggattggtga

SEQ ID NO: 1409 - DNA, 20 bp, Artificial Sequence
  chemically synthesized
ggacaggattggtgacagaa

SEQ ID NO: 1410 - DNA, 20 bp, Artificial Sequence
  chemically synthesized
tgacagaaaagccccatcct

SEQ ID NO: 1411 - DNA, 20 bp, Artificial Sequence
  chemically synthesized
gacagaaaagccccatcctt

SEQ ID NO: 1412 - DNA, 20 bp, Artificial Sequence
  chemically synthesized
tccttaggcctcctccttcc

SEQ ID NO: 1413 - DNA, 20 bp, Artificial Sequence
  chemically synthesized
ccttcctagtctcctgatat

SEQ ID NO: 1414 - DNA, 20 bp, Artificial Sequence
  chemically synthesized
cttcctagtctcctgatatt

SEQ ID NO: 1415 - DNA, 20 bp, Artificial Sequence
  chemically synthesized
gtctaacccccacctcctgt

SEQ ID NO: 1416 - DNA, 20 bp, Artificial Sequence
  chemically synthesized
tctaacccccacctcctgtt

SEQ ID NO: 1417 - DNA, 20 bp, Artificial Sequence
  chemically synthesized
aacccccacctcctgttagg

SEQ ID NO: 1418 - DNA, 20 bp, Artificial Sequence
  chemically synthesized
tgttaggcagattccttatc

SEQ ID NO: 1419 - DNA, 20 bp, Artificial Sequence
  chemically synthesized
ggtgacacacccccatttcc

SEQ ID NO: 1420 - DNA, 20 bp, Artificial Sequence
  chemically synthesized
tgacacacccccatttcctg

SEQ ID NO: 1421 - DNA, 20 bp, Artificial Sequence
  chemically synthesized
ggagccatctctctccttgc

SEQ ID NO: 1422 - DNA, 20 bp, Artificial Sequence
  chemically synthesized
ctctccttgccagaacctct

SEQ ID NO: 1423 - DNA, 20 bp, Artificial Sequence
  chemically synthesized
tctccttgccagaacctcta

SEQ ID NO: 1424 - DNA, 20 bp, Artificial Sequence
  chemically synthesized
cctctaaggtttgcttacga

SEQ ID NO: 1425 - DNA, 20 bp, Artificial Sequence
  chemically synthesized
tctaaggtttgcttacgatg

SEQ ID NO: 1426 - DNA, 20 bp, Artificial Sequence
  chemically synthesized
aggtttgcttacgatggagc

SEQ ID NO: 1427 - DNA, 20 bp, Artificial Sequence
  chemically synthesized
gtttgcttacgatggagcca

SEQ ID NO: 1428 - DNA, 20 bp, Artificial Sequence
  chemically synthesized
ttgcttacgatggagccaga

SEQ ID NO: 1429 - DNA, 20 bp, Artificial Sequence
  chemically synthesized
tgcttacgatggagccagag

SEQ ID NO: 1430 - DNA, 20 bp, Artificial Sequence
  chemically synthesized
gatggagccagagaggatcc

SEQ ID NO: 1431 - DNA, 20 bp, Artificial Sequence
  chemically synthesized
atggagccagagaggatcct

SEQ ID NO: 1432 - DNA, 20 bp, Artificial Sequence
  chemically synthesized
ggagccagagaggatcctgg

SEQ ID NO: 1433 - DNA, 20 bp, Artificial Sequence
  chemically synthesized
gagccagagaggatcctggg

SEQ ID NO: 1434 - DNA, 20 bp, Artificial Sequence
  chemically synthesized
agccagagaggatcctggga

SEQ ID NO: 1435 - DNA, 20 bp, Artificial Sequence
  chemically synthesized
ccagagaggatcctgggagg

SEQ ID NO: 1436 - DNA, 20 bp, Artificial Sequence
  chemically synthesized
agagaggatcctgggaggga

SEQ ID NO: 1437 - DNA, 20 bp, Artificial Sequence
  chemically synthesized
ggatcctgggagggagagct

SEQ ID NO: 1438 - DNA, 20 bp, Artificial Sequence
  chemically synthesized
tcctgggagggagagcttgg

SEQ ID NO: 1439 - DNA, 20 bp, Artificial Sequence
  chemically synthesized
cctgggagggagagcttggc

SEQ ID NO: 1440 - DNA, 20 bp, Artificial Sequence
  chemically synthesized
ctgggagggagagcttggca

SEQ ID NO: 1441 - DNA, 20 bp, Artificial Sequence
  chemically synthesized
tgggagggagagcttggcag

SEQ ID NO: 1442 - DNA, 20 bp, Artificial Sequence
  chemically synthesized
gggagggagagcttggcagg

SEQ ID NO: 1443 - DNA, 20 bp, Artificial Sequence
  chemically synthesized
agggagagcttggcaggggg

SEQ ID NO: 1444 - DNA, 20 bp, Artificial Sequence
  chemically synthesized
gggagagcttggcagggggt

SEQ ID NO: 1445 - DNA, 20 bp, Artificial Sequence
  chemically synthesized
gagagcttggcagggggtgg

SEQ ID NO: 1446 - DNA, 20 bp, Artificial Sequence
  chemically synthesized
agagcttggcagggggtggg

SEQ ID NO: 1447 - DNA, 20 bp, Artificial Sequence
  chemically synthesized
gagcttggcagggggtggga

SEQ ID NO: 1448 - DNA, 20 bp, Artificial Sequence
  chemically synthesized
cttggcagggggtgggaggg

SEQ ID NO: 1449 - DNA, 20 bp, Artificial Sequence
  chemically synthesized
ttggcagggggtgggaggga

SEQ ID NO: 1450 - DNA, 20 bp, Artificial Sequence
  chemically synthesized
tggcagggggtgggagggaa

SEQ ID NO: 1451 - DNA, 20 bp, Artificial Sequence
  chemically synthesized
ggcagggggtgggagggaag

SEQ ID NO: 1452 - DNA, 20 bp, Artificial Sequence
  chemically synthesized
gcagggggtgggagggaagg

SEQ ID NO: 1453 - DNA, 20 bp, Artificial Sequence
  chemically synthesized
cagggggtgggagggaaggg

SEQ ID NO: 1454 - DNA, 20 bp, Artificial Sequence
  chemically synthesized
agggggtgggagggaagggg

SEQ ID NO: 1455 - DNA, 20 bp, Artificial Sequence
  chemically synthesized
ggggggatgcgtgacctgcc

SEQ ID NO: 1456 - DNA, 20 bp, Artificial Sequence
  chemically synthesized
tgcgtgacctgcccggttct

SEQ ID NO: 1457 - DNA, 20 bp, Artificial Sequence
  chemically synthesized
gtgacctgcccggttctcag

SEQ ID NO: 1458 - DNA, 20 bp, Artificial Sequence
  chemically synthesized
caccctgcgctaccctctcc

SEQ ID NO: 1459 - DNA, 20 bp, Artificial Sequence
  chemically synthesized
gctaccctctcccagaacct

SEQ ID NO: 1460 - DNA, 20 bp, Artificial Sequence
  chemically synthesized
gaacctgagctgctctgacg

SEQ ID NO: 1461 - DNA, 20 bp, Artificial Sequence
  chemically synthesized
gctgctctgacgcggccgtc

SEQ ID NO: 1462 - DNA, 20 bp, Artificial Sequence
  chemically synthesized
ctggtgcgtttcactgatcc

SEQ ID NO: 1463 - DNA, 20 bp, Artificial Sequence
  chemically synthesized
tttcactgatcctggtgctg

SEQ ID NO: 1464 - DNA, 20 bp, Artificial Sequence
  chemically synthesized
gcagcttccttacacttccc

SEQ ID NO: 1465 - DNA, 20 bp, Artificial Sequence
  chemically synthesized
agcttccttacacttcccaa

SEQ ID NO: 1466 - DNA, 20 bp, Artificial Sequence
  chemically synthesized
gcttccttacacttcccaag

SEQ ID NO: 1467 - DNA, 20 bp, Artificial Sequence
  chemically synthesized
ttccttacacttcccaagag

SEQ ID NO: 1468 - DNA, 20 bp, Artificial Sequence
  chemically synthesized
cttacacttcccaagaggag

SEQ ID NO: 1469 - DNA, 20 bp, Artificial Sequence
  chemically synthesized
acacttcccaagaggagaag

SEQ ID NO: 1470 - DNA, 20 bp, Artificial Sequence
  chemically synthesized
tcccaagaggagaagcagtt

SEQ ID NO: 1471 - DNA, 20 bp, Artificial Sequence
  chemically synthesized
gcagtttggaaaaacaaaat

SEQ ID NO: 1472 - DNA, 20 bp, Artificial Sequence
  chemically synthesized
tggaaaaacaaaatcagaat

SEQ ID NO: 1473 - DNA, 20 bp, Artificial Sequence
  chemically synthesized
aaaacaaaatcagaataagt

SEQ ID NO: 1474 - DNA, 20 bp, Artificial Sequence
  chemically synthesized
aatcagaataagttggtcct

SEQ ID NO: 1475 - DNA, 20 bp, Artificial Sequence
  chemically synthesized
ttggtcctgagttctaactt

SEQ ID NO: 1476 - DNA, 20 bp, Artificial Sequence
  chemically synthesized
actttggctcttcacctttc

SEQ ID NO: 1477 - DNA, 20 bp, Artificial Sequence
  chemically synthesized
tatattgttcctccgtgcgt

SEQ ID NO: 1478 - DNA, 20 bp, Artificial Sequence
  chemically synthesized
cgtgcgtcagttttacctgt

SEQ ID NO: 1479 - DNA, 20 bp, Artificial Sequence
  chemically synthesized
gtcagttttacctgtgagat

SEQ ID NO: 1480 - DNA, 20 bp, Artificial Sequence
  chemically synthesized
tcagttttacctgtgagata

SEQ ID NO: 1481 - DNA, 20 bp, Artificial Sequence
  chemically synthesized
ttttacctgtgagataaggc

SEQ ID NO: 1482 - DNA, 20 bp, Artificial Sequence
  chemically synthesized
tacctgtgagataaggccag

SEQ ID NO: 1483 - DNA, 20 bp, Artificial Sequence
  chemically synthesized
tgtgagataaggccagtagc

SEQ ID NO: 1484 - DNA, 20 bp, Artificial Sequence
  chemically synthesized
gccagtagccagccccgtcc

SEQ ID NO: 1485 - DNA, 20 bp, Artificial Sequence
  chemically synthesized
agtagccagccccgtcctgg

SEQ ID NO: 1486 - DNA, 20 bp, Artificial Sequence
  chemically synthesized
gtagccagccccgtcctggc

SEQ ID NO: 1487 - DNA, 20 bp, Artificial Sequence
  chemically synthesized
tagccagccccgtcctggca

SEQ ID NO: 1488 - DNA, 20 bp, Artificial Sequence
  chemically synthesized
gccccgtcctggcagggctg

SEQ ID NO: 1489 - DNA, 20 bp, Artificial Sequence
  chemically synthesized
cgtcctggcagggctgtggt

SEQ ID NO: 1490 - DNA, 20 bp, Artificial Sequence
  chemically synthesized
gtcctggcagggctgtggtg

SEQ ID NO: 1491 - DNA, 20 bp, Artificial Sequence
  chemically synthesized
cctggcagggctgtggtgag

SEQ ID NO: 1492 - DNA, 20 bp, Artificial Sequence
  chemically synthesized
ctggcagggctgtggtgagg

SEQ ID NO: 1493 - DNA, 20 bp, Artificial Sequence
  chemically synthesized
tggcagggctgtggtgagga

SEQ ID NO: 1494 - DNA, 20 bp, Artificial Sequence
  chemically synthesized
ggcagggctgtggtgaggag

SEQ ID NO: 1495 - DNA, 20 bp, Artificial Sequence
  chemically synthesized
gcagggctgtggtgaggagg

SEQ ID NO: 1496 - DNA, 20 bp, Artificial Sequence
  chemically synthesized
cagggctgtggtgaggaggg

SEQ ID NO: 1497 - DNA, 20 bp, Artificial Sequence
  chemically synthesized
tgaggaggggggtgtccgtg

SEQ ID NO: 1498 - DNA, 20 bp, Artificial Sequence
  chemically synthesized
gtgtggaaaactccctttgt

SEQ ID NO: 1499 - DNA, 20 bp, Artificial Sequence
  chemically synthesized
gaaaactccctttgtgagaa

SEQ ID NO: 1500 - DNA, 20 bp, Artificial Sequence
  chemically synthesized
tttgtgagaatggtgcgtcc

SEQ ID NO: 1501 - DNA, 20 bp, Artificial Sequence
  chemically synthesized
ttgtgagaatggtgcgtcct

SEQ ID NO: 1502 - DNA, 20 bp, Artificial Sequence
  chemically synthesized
ggtgcgtcctaggtgttcac

SEQ ID NO: 1503 - DNA, 20 bp, Artificial Sequence
  chemically synthesized
gtgcgtcctaggtgttcacc

SEQ ID NO: 1504 - DNA, 20 bp, Artificial Sequence
  chemically synthesized
cctaggtgttcaccaggtcg

SEQ ID NO: 1505 - DNA, 20 bp, Artificial Sequence
  chemically synthesized
tctccatccttctttcctta

SEQ ID NO: 1506 - DNA, 20 bp, Artificial Sequence
  chemically synthesized
tccatccttctttccttaaa

SEQ ID NO: 1507 - DNA, 20 bp, Artificial Sequence
  chemically synthesized
ttctttccttaaagagtccc

SEQ ID NO: 1508 - DNA, 20 bp, Artificial Sequence
  chemically synthesized
aaagagtccccagtgctatc

SEQ ID NO: 1509 - DNA, 20 bp, Artificial Sequence
  chemically synthesized
aagagtccccagtgctatct

SEQ ID NO: 1510 - DNA, 20 bp, Artificial Sequence
  chemically synthesized
ctgggacatattcctccgcc

SEQ ID NO: 1511 - DNA, 20 bp, Artificial Sequence
  chemically synthesized
gggacatattcctccgccca

SEQ ID NO: 1512 - DNA, 20 bp, Artificial Sequence
  chemically synthesized
acatattcctccgcccagag

SEQ ID NO: 1513 - DNA, 20 bp, Artificial Sequence
  chemically synthesized
catattcctccgcccagagc

SEQ ID NO: 1514 - DNA, 20 bp, Artificial Sequence
  chemically synthesized
atattcctccgcccagagca

SEQ ID NO: 1515 - DNA, 20 bp, Artificial Sequence
  chemically synthesized
gagcagggtcccgcttccct

SEQ ID NO: 1516 - DNA, 20 bp, Artificial Sequence
  chemically synthesized
agcagggtcccgcttcccta

SEQ ID NO: 1517 - DNA, 20 bp, Artificial Sequence
  chemically synthesized
gcttccctaaggccctgctc

SEQ ID NO: 1518 - DNA, 20 bp, Artificial Sequence
  chemically synthesized
cttccctaaggccctgctct

SEQ ID NO: 1519 - DNA, 20 bp, Artificial Sequence
  chemically synthesized
aaggccctgctctgggcttc

SEQ ID NO: 1520 - DNA, 20 bp, Artificial Sequence
  chemically synthesized
aggccctgctctgggcttct

SEQ ID NO: 1521 - DNA, 20 bp, Artificial Sequence
  chemically synthesized
tgctctgggcttctgggttt

SEQ ID NO: 1522 - DNA, 20 bp, Artificial Sequence
  chemically synthesized
ggcttctgggtttgagtcct

SEQ ID NO: 1523 - DNA, 20 bp, Artificial Sequence
  chemically synthesized
tctgggtttgagtccttggc

SEQ ID NO: 1524 - DNA, 20 bp, Artificial Sequence
  chemically synthesized
gtttgagtccttggcaagcc

SEQ ID NO: 1525 - DNA, 20 bp, Artificial Sequence
  chemically synthesized
tttgagtccttggcaagccc

SEQ ID NO: 1526 - DNA, 20 bp, Artificial Sequence
  chemically synthesized
tgagtccttggcaagcccag

SEQ ID NO: 1527 - DNA, 20 bp, Artificial Sequence
  chemically synthesized
agtccttggcaagcccagga

SEQ ID NO: 1528 - DNA, 20 bp, Artificial Sequence
  chemically synthesized
gtccttggcaagcccaggag

SEQ ID NO: 1529 - DNA, 20 bp, Artificial Sequence
  chemically synthesized
gcaagcccaggagaggcgct

SEQ ID NO: 1530 - DNA, 20 bp, Artificial Sequence
  chemically synthesized
caagcccaggagaggcgctc

SEQ ID NO: 1531 - DNA, 20 bp, Artificial Sequence
  chemically synthesized
cgtccaccatctcatgcccc

SEQ ID NO: 1532 - DNA, 20 bp, Artificial Sequence
  chemically synthesized
gctctcctgccccttcccta

SEQ ID NO: 1533 - DNA, 20 bp, Artificial Sequence
  chemically synthesized
ctctcctgccccttccctac

SEQ ID NO: 1534 - DNA, 20 bp, Artificial Sequence
  chemically synthesized
tctcctgccccttccctaca

SEQ ID NO: 1535 - DNA, 20 bp, Artificial Sequence
  chemically synthesized
ctcctgccccttccctacag

SEQ ID NO: 1536 - DNA, 20 bp, Artificial Sequence
  chemically synthesized
cccttccctacaggggttcc

SEQ ID NO: 1537 - DNA, 20 bp, Artificial Sequence
  chemically synthesized
gggttcctggctctgctctt

SEQ ID NO: 1538 - DNA, 20 bp, Artificial Sequence
  chemically synthesized
ctggctctgctcttcagact

SEQ ID NO: 1539 - DNA, 20 bp, Artificial Sequence
  chemically synthesized
cccccttcccctgcatcccc

SEQ ID NO: 1540 - DNA, 20 bp, Artificial Sequence
  chemically synthesized
cccttcccctgcatccccca

SEQ ID NO: 1541 - DNA, 20 bp, Artificial Sequence
  chemically synthesized
ccttcccctgcatcccccag

SEQ ID NO: 1542 - DNA, 20 bp, Artificial Sequence
  chemically synthesized
cctgcatcccccagaggccc

SEQ ID NO: 1543 - DNA, 20 bp, Artificial Sequence
  chemically synthesized
ctgcatcccccagaggcccc

SEQ ID NO: 1544 - DNA, 20 bp, Artificial Sequence
  chemically synthesized
gaggccccaggccacctact

SEQ ID NO: 1545 - DNA, 20 bp, Artificial Sequence
  chemically synthesized
cccaggccacctacttggcc

SEQ ID NO: 1546 - DNA, 20 bp, Artificial Sequence
  chemically synthesized
ctacttggcctggaccccac

SEQ ID NO: 1547 - DNA, 20 bp, Artificial Sequence
  chemically synthesized
acttggcctggaccccacga

SEQ ID NO: 1548 - DNA, 20 bp, Artificial Sequence
  chemically synthesized
cttggcctggaccccacgag

SEQ ID NO: 1549 - DNA, 20 bp, Artificial Sequence
  chemically synthesized
gaccccacgagaggccaccc

SEQ ID NO: 1550 - DNA, 20 bp, Artificial Sequence
  chemically synthesized
gccaccccagccctgtctac

SEQ ID NO: 1551 - DNA, 20 bp, Artificial Sequence
  chemically synthesized
ccaccccagccctgtctacc

SEQ ID NO: 1552 - DNA, 20 bp, Artificial Sequence
  chemically synthesized
ctgtctaccaggctgccttt

SEQ ID NO: 1553 - DNA, 20 bp, Artificial Sequence
  chemically synthesized
tgtctaccaggctgcctttt

SEQ ID NO: 1554 - DNA, 20 bp, Artificial Sequence
  chemically synthesized
ctaccaggctgccttttggg

SEQ ID NO: 1555 - DNA, 20 bp, Artificial Sequence
  chemically synthesized
ggtggattctcctccaactg

SEQ ID NO: 1556 - DNA, 20 bp, Artificial Sequence
  chemically synthesized
gtggattctcctccaactgt

SEQ ID NO: 1557 - DNA, 20 bp, Artificial Sequence
  chemically synthesized
tggattctcctccaactgtg

SEQ ID NO: 1558 - DNA, 20 bp, Artificial Sequence
  chemically synthesized
ccaactgtggggtgactgct

SEQ ID NO: 1559 - DNA, 20 bp, Artificial Sequence
  chemically synthesized
tgcttggcaaactcactctt

SEQ ID NO: 1560 - DNA, 20 bp, Artificial Sequence
  chemically synthesized
gcttggcaaactcactcttc

SEQ ID NO: 1561 - DNA, 20 bp, Artificial Sequence
  chemically synthesized
cttggcaaactcactcttcg

SEQ ID NO: 1562 - DNA, 20 bp, Artificial Sequence
  chemically synthesized
actcactcttcggggtatcc

SEQ ID NO: 1563 - DNA, 20 bp, Artificial Sequence
  chemically synthesized
ctcactcttcggggtatccc

SEQ ID NO: 1564 - DNA, 20 bp, Artificial Sequence
  chemically synthesized
cactcttcggggtatcccag

SEQ ID NO: 1565 - DNA, 20 bp, Artificial Sequence
  chemically synthesized
actcttcggggtatcccagg

SEQ ID NO: 1566 - DNA, 20 bp, Artificial Sequence
  chemically synthesized
tcggggtatcccaggaggcc

SEQ ID NO: 1567 - DNA, 20 bp, Artificial Sequence
  chemically synthesized
ggggtatcccaggaggcctg

SEQ ID NO: 1568 - DNA, 20 bp, Artificial Sequence
  chemically synthesized
tcccaggaggcctggagcat

SEQ ID NO: 1569 - DNA, 20 bp, Artificial Sequence
  chemically synthesized
cccaggaggcctggagcatt

SEQ ID NO: 1570 - DNA, 20 bp, Artificial Sequence
  chemically synthesized
ccaggaggcctggagcattg

SEQ ID NO: 1571 - DNA, 20 bp, Artificial Sequence
  chemically synthesized
ggaggcctggagcattgggg

SEQ ID NO: 1572 - DNA, 20 bp, Artificial Sequence
  chemically synthesized
gaggcctggagcattggggt

SEQ ID NO: 1573 - DNA, 20 bp, Artificial Sequence
  chemically synthesized
cctggagcattggggtgggc

SEQ ID NO: 1574 - DNA, 20 bp, Artificial Sequence
  chemically synthesized
ctggagcattggggtgggct

SEQ ID NO: 1575 - DNA, 20 bp, Artificial Sequence
  chemically synthesized
tggagcattggggtgggctg

SEQ ID NO: 1576 - DNA, 20 bp, Artificial Sequence
  chemically synthesized
cattggggtgggctggggtt

SEQ ID NO: 1577 - DNA, 20 bp, Artificial Sequence
  chemically synthesized
ttggggtgggctggggttca

SEQ ID NO: 1578 - DNA, 20 bp, Artificial Sequence
  chemically synthesized
ggggtgggctggggttcaga

SEQ ID NO: 1579 - DNA, 20 bp, Artificial Sequence
  chemically synthesized
gggtgggctggggttcagag

SEQ ID NO: 1580 - DNA, 20 bp, Artificial Sequence
  chemically synthesized
gtgggctggggttcagagag

SEQ ID NO: 1581 - DNA, 20 bp, Artificial Sequence
  chemically synthesized
tgggctggggttcagagagg

SEQ ID NO: 1582 - DNA, 20 bp, Artificial Sequence
  chemically synthesized
gggctggggttcagagagga

SEQ ID NO: 1583 - DNA, 20 bp, Artificial Sequence
  chemically synthesized
gagaggagggattcccttct

SEQ ID NO: 1584 - DNA, 20 bp, Artificial Sequence
  chemically synthesized
agaggagggattcccttctc

SEQ ID NO: 1585 - DNA, 20 bp, Artificial Sequence
  chemically synthesized
gattcccttctcaggttacg

SEQ ID NO: 1586 - DNA, 20 bp, Artificial Sequence
  chemically synthesized
ccttctcaggttacgtggcc

SEQ ID NO: 1587 - DNA, 20 bp, Artificial Sequence
  chemically synthesized
tctcaggttacgtggccaag

SEQ ID NO: 1588 - DNA, 20 bp, Artificial Sequence
  chemically synthesized
caggttacgtggccaagaag

SEQ ID NO: 1589 - DNA, 20 bp, Artificial Sequence
  chemically synthesized
aggttacgtggccaagaagc

SEQ ID NO: 1590 - DNA, 20 bp, Artificial Sequence
  chemically synthesized
ggttacgtggccaagaagca

SEQ ID NO: 1591 - DNA, 20 bp, Artificial Sequence
  chemically synthesized
gttacgtggccaagaagcag

SEQ ID NO: 1592 - DNA, 20 bp, Artificial Sequence
  chemically synthesized
tacgtggccaagaagcaggg

SEQ ID NO: 1593 - DNA, 20 bp, Artificial Sequence
  chemically synthesized
tggccaagaagcaggggagc

SEQ ID NO: 1594 - DNA, 20 bp, Artificial Sequence
  chemically synthesized
ggccaagaagcaggggagct

SEQ ID NO: 1595 - DNA, 20 bp, Artificial Sequence
  chemically synthesized
agaagcaggggagctgggtt

SEQ ID NO: 1596 - DNA, 20 bp, Artificial Sequence
  chemically synthesized
gaagcaggggagctgggttt

SEQ ID NO: 1597 - DNA, 20 bp, Artificial Sequence
  chemically synthesized
caggggagctgggtttgggt

SEQ ID NO: 1598 - DNA, 20 bp, Artificial Sequence
  chemically synthesized
aggggagctgggtttgggtc

SEQ ID NO: 1599 - DNA, 20 bp, Artificial Sequence
  chemically synthesized
agctgggtttgggtcaggtc

SEQ ID NO: 1600 - DNA, 20 bp, Artificial Sequence
  chemically synthesized
gctgggtttgggtcaggtct

SEQ ID NO: 1601 - DNA, 20 bp, Artificial Sequence
  chemically synthesized
gtttgggtcaggtctgggtg

SEQ ID NO: 1602 - DNA, 20 bp, Artificial Sequence
  chemically synthesized
tttgggtcaggtctgggtgt

SEQ ID NO: 1603 - DNA, 20 bp, Artificial Sequence
  chemically synthesized
ttgggtcaggtctgggtgtg

SEQ ID NO: 1604 - DNA, 20 bp, Artificial Sequence
  chemically synthesized
aggtctgggtgtggggtgac

SEQ ID NO: 1605 - DNA, 20 bp, Artificial Sequence
  chemically synthesized
accagcttatgctgtttgcc

SEQ ID NO: 1606 - DNA, 20 bp, Artificial Sequence
  chemically synthesized
ccagcttatgctgtttgccc

SEQ ID NO: 1607 - DNA, 20 bp, Artificial Sequence
  chemically synthesized
cttatgctgtttgcccagga

SEQ ID NO: 1608 - DNA, 20 bp, Artificial Sequence
  chemically synthesized
gctgtttgcccaggacagcc

SEQ ID NO: 1609 - DNA, 20 bp, Artificial Sequence
  chemically synthesized
tgcccaggacagcctagttt

SEQ ID NO: 1610 - DNA, 20 bp, Artificial Sequence
  chemically synthesized
agttttagcactgaaaccct

SEQ ID NO: 1611 - DNA, 20 bp, Artificial Sequence
  chemically synthesized
agcactgaaaccctcagtcc

SEQ ID NO: 1612 - DNA, 20 bp, Artificial Sequence
  chemically synthesized
gcactgaaaccctcagtcct

SEQ ID NO: 1613 - DNA, 20 bp, Artificial Sequence
  chemically synthesized
aaccctcagtcctaggaaaa

SEQ ID NO: 1614 - DNA, 20 bp, Artificial Sequence
  chemically synthesized
accctcagtcctaggaaaac

SEQ ID NO: 1615 - DNA, 20 bp, Artificial Sequence
  chemically synthesized
ccctcagtcctaggaaaaca

SEQ ID NO: 1616 - DNA, 20 bp, Artificial Sequence
  chemically synthesized
cagtcctaggaaaacaggga

SEQ ID NO: 1617 - DNA, 20 bp, Artificial Sequence
  chemically synthesized
cctaggaaaacagggatggt

SEQ ID NO: 1618 - DNA, 20 bp, Artificial Sequence
  chemically synthesized
ggatggttggtcactgtctc

SEQ ID NO: 1619 - DNA, 20 bp, Artificial Sequence
  chemically synthesized
gatggttggtcactgtctct

SEQ ID NO: 1620 - DNA, 20 bp, Artificial Sequence
  chemically synthesized
tctgggtgactcttgattcc

SEQ ID NO: 1621 - DNA, 20 bp, Artificial Sequence
  chemically synthesized
ggtgactcttgattcccggc

SEQ ID NO: 1622 - DNA, 20 bp, Artificial Sequence
  chemically synthesized
tcccggccagtttctccacc

SEQ ID NO: 1623 - DNA, 20 bp, Artificial Sequence
  chemically synthesized
cccggccagtttctccacct

SEQ ID NO: 1624 - DNA, 20 bp, Artificial Sequence
  chemically synthesized
ccggccagtttctccacctg

SEQ ID NO: 1625 - DNA, 20 bp, Artificial Sequence
  chemically synthesized
tctcgtcctgcatccttctc

SEQ ID NO: 1626 - DNA, 20 bp, Artificial Sequence
  chemically synthesized
ctcgtcctgcatccttctcc

SEQ ID NO: 1627 - DNA, 20 bp, Artificial Sequence
  chemically synthesized
gtcctgcatccttctccagg

SEQ ID NO: 1628 - DNA, 20 bp, Artificial Sequence
  chemically synthesized
tcctgcatccttctccaggc

SEQ ID NO: 1629 - DNA, 20 bp, Artificial Sequence
  chemically synthesized
ccttctccaggcaggtcccc

SEQ ID NO: 1630 - DNA, 20 bp, Artificial Sequence
  chemically synthesized
caagcatcgcccccctgctg

SEQ ID NO: 1631 - DNA, 20 bp, Artificial Sequence
  chemically synthesized
cccctgctgtggctgttccc

SEQ ID NO: 1632 - DNA, 20 bp, Artificial Sequence
  chemically synthesized
tgtggctgttcccaagttct

SEQ ID NO: 1633 - DNA, 20 bp, Artificial Sequence
  chemically synthesized
gtggctgttcccaagttctt

SEQ ID NO: 1634 - DNA, 20 bp, Artificial Sequence
  chemically synthesized
tggctgttcccaagttctta

SEQ ID NO: 1635 - DNA, 20 bp, Artificial Sequence
  chemically synthesized
agttcttagggtaccccacg

SEQ ID NO: 1636 - DNA, 20 bp, Artificial Sequence
  chemically synthesized
gttcttagggtaccccacgt

SEQ ID NO: 1637 - DNA, 20 bp, Artificial Sequence
  chemically synthesized
acgtgggtttatcaaccact

SEQ ID NO: 1638 - DNA, 20 bp, Artificial Sequence
  chemically synthesized
gggtttatcaaccacttggt

SEQ ID NO: 1639 - DNA, 20 bp, Artificial Sequence
  chemically synthesized
ggtttatcaaccacttggtg

SEQ ID NO: 1640 - DNA, 20 bp, Artificial Sequence
  chemically synthesized
tatcaaccacttggtgaggc

SEQ ID NO: 1641 - DNA, 20 bp, Artificial Sequence
  chemically synthesized
ttcctgcaccccaattgcct

SEQ ID NO: 1642 - DNA, 20 bp, Artificial Sequence
  chemically synthesized
ctgcaccccaattgccttag

SEQ ID NO: 1643 - DNA, 20 bp, Artificial Sequence
  chemically synthesized
accccaattgccttagtggc

SEQ ID NO: 1644 - DNA, 20 bp, Artificial Sequence
  chemically synthesized
ccccaattgccttagtggct

SEQ ID NO: 1645 - DNA, 20 bp, Artificial Sequence
  chemically synthesized
cccaattgccttagtggcta

SEQ ID NO: 1646 - DNA, 20 bp, Artificial Sequence
  chemically synthesized
ccaattgccttagtggctag

SEQ ID NO: 1647 - DNA, 20 bp, Artificial Sequence
  chemically synthesized
caattgccttagtggctagg

SEQ ID NO: 1648 - DNA, 20 bp, Artificial Sequence
  chemically synthesized
tgccttagtggctagggggt

SEQ ID NO: 1649 - DNA, 20 bp, Artificial Sequence
  chemically synthesized
gccttagtggctagggggtt

SEQ ID NO: 1650 - DNA, 20 bp, Artificial Sequence
  chemically synthesized
ccttagtggctagggggttg

SEQ ID NO: 1651 - DNA, 20 bp, Artificial Sequence
  chemically synthesized
cttagtggctagggggttgg

SEQ ID NO: 1652 - DNA, 20 bp, Artificial Sequence
  chemically synthesized
gtggctagggggttgggggc

SEQ ID NO: 1653 - DNA, 20 bp, Artificial Sequence
  chemically synthesized
ggctagggggttgggggcta

SEQ ID NO: 1654 - DNA, 20 bp, Artificial Sequence
  chemically synthesized
tagggggttgggggctagag

SEQ ID NO: 1655 - DNA, 20 bp, Artificial Sequence
  chemically synthesized
agggggttgggggctagagt

SEQ ID NO: 1656 - DNA, 20 bp, Artificial Sequence
  chemically synthesized
ggggttgggggctagagtag

SEQ ID NO: 1657 - DNA, 20 bp, Artificial Sequence
  chemically synthesized
gggttgggggctagagtagg

SEQ ID NO: 1658 - DNA, 20 bp, Artificial Sequence
  chemically synthesized
ggttgggggctagagtagga

SEQ ID NO: 1659 - DNA, 20 bp, Artificial Sequence
  chemically synthesized
gttgggggctagagtaggag

SEQ ID NO: 1660 - DNA, 20 bp, Artificial Sequence
  chemically synthesized
ggggctagagtaggaggggc

SEQ ID NO: 1661 - DNA, 20 bp, Artificial Sequence
  chemically synthesized
ggctagagtaggaggggctg

SEQ ID NO: 1662 - DNA, 20 bp, Artificial Sequence
  chemically synthesized
agagtaggaggggctggagc

SEQ ID NO: 1663 - DNA, 20 bp, Artificial Sequence
  chemically synthesized
gagtaggaggggctggagcc

SEQ ID NO: 1664 - DNA, 20 bp, Artificial Sequence
  chemically synthesized
ggggctggagccaggattct

SEQ ID NO: 1665 - DNA, 20 bp, Artificial Sequence
  chemically synthesized
gggctggagccaggattctt

SEQ ID NO: 1666 - DNA, 20 bp, Artificial Sequence
  chemically synthesized
ggctggagccaggattctta

SEQ ID NO: 1667 - DNA, 20 bp, Artificial Sequence
  chemically synthesized
ccaggattcttagggctgaa

SEQ ID NO: 1668 - DNA, 20 bp, Artificial Sequence
  chemically synthesized
aggattcttagggctgaaca

SEQ ID NO: 1669 - DNA, 20 bp, Artificial Sequence
  chemically synthesized
attcttagggctgaacagag

SEQ ID NO: 1670 - DNA, 20 bp, Artificial Sequence
  chemically synthesized
tcttagggctgaacagagaa

SEQ ID NO: 1671 - DNA, 20 bp, Artificial Sequence
  chemically synthesized
agggctgaacagagaagagc

SEQ ID NO: 1672 - DNA, 20 bp, Artificial Sequence
  chemically synthesized
gggctgaacagagaagagct

SEQ ID NO: 1673 - DNA, 20 bp, Artificial Sequence
  chemically synthesized
ggctgaacagagaagagctg

SEQ ID NO: 1674 - DNA, 20 bp, Artificial Sequence
  chemically synthesized
gctgaacagagaagagctgg

SEQ ID NO: 1675 - DNA, 20 bp, Artificial Sequence
  chemically synthesized
acagagaagagctgggggcc

SEQ ID NO: 1676 - DNA, 20 bp, Artificial Sequence
  chemically synthesized
cagagaagagctgggggcct

SEQ ID NO: 1677 - DNA, 20 bp, Artificial Sequence
  chemically synthesized
gagctgggggcctgggctcc

SEQ ID NO: 1678 - DNA, 20 bp, Artificial Sequence
  chemically synthesized
agctgggggcctgggctcct

SEQ ID NO: 1679 - DNA, 20 bp, Artificial Sequence
  chemically synthesized
gggcctgggctcctgggttt

SEQ ID NO: 1680 - DNA, 20 bp, Artificial Sequence
  chemically synthesized
gcctgggctcctgggtttga

SEQ ID NO: 1681 - DNA, 20 bp, Artificial Sequence
  chemically synthesized
ctgggctcctgggtttgaga

SEQ ID NO: 1682 - DNA, 20 bp, Artificial Sequence
  chemically synthesized
tgggctcctgggtttgagag

SEQ ID NO: 1683 - DNA, 20 bp, Artificial Sequence
  chemically synthesized
ggctcctgggtttgagagag

SEQ ID NO: 1684 - DNA, 20 bp, Artificial Sequence
  chemically synthesized
gctcctgggtttgagagagg

SEQ ID NO: 1685 - DNA, 20 bp, Artificial Sequence
  chemically synthesized
ctcctgggtttgagagagga

SEQ ID NO: 1686 - DNA, 20 bp, Artificial Sequence
  chemically synthesized
tcctgggtttgagagaggag

SEQ ID NO: 1687 - DNA, 20 bp, Artificial Sequence
  chemically synthesized
gggtttgagagaggaggggc

SEQ ID NO: 1688 - DNA, 20 bp, Artificial Sequence
  chemically synthesized
ggtttgagagaggaggggct

SEQ ID NO: 1689 - DNA, 20 bp, Artificial Sequence
  chemically synthesized
gtttgagagaggaggggctg

SEQ ID NO: 1690 - DNA, 20 bp, Artificial Sequence
  chemically synthesized
agagaggaggggctggggcc

SEQ ID NO: 1691 - DNA, 20 bp, Artificial Sequence
  chemically synthesized
ggggctggggcctggactcc

SEQ ID NO: 1692 - DNA, 20 bp, Artificial Sequence
  chemically synthesized
gggctggggcctggactcct

SEQ ID NO: 1693 - DNA, 20 bp, Artificial Sequence
  chemically synthesized
gggcctggactcctgggtcc

SEQ ID NO: 1694 - DNA, 20 bp, Artificial Sequence
  chemically synthesized
ggcctggactcctgggtccg

SEQ ID NO: 1695 - DNA, 20 bp, Artificial Sequence
  chemically synthesized
gcctggactcctgggtccga

SEQ ID NO: 1696 - DNA, 20 bp, Artificial Sequence
  chemically synthesized
ctggactcctgggtccgagg

SEQ ID NO: 1697 - DNA, 20 bp, Artificial Sequence
  chemically synthesized
tggactcctgggtccgaggg

SEQ ID NO: 1698 - DNA, 20 bp, Artificial Sequence
  chemically synthesized
gactcctgggtccgagggag

SEQ ID NO: 1699 - DNA, 20 bp, Artificial Sequence
  chemically synthesized
actcctgggtccgagggagg

SEQ ID NO: 1700 - DNA, 20 bp, Artificial Sequence
  chemically synthesized
ctcctgggtccgagggagga

SEQ ID NO: 1701 - DNA, 20 bp, Artificial Sequence
  chemically synthesized
tcctgggtccgagggaggag

SEQ ID NO: 1702 - DNA, 20 bp, Artificial Sequence
  chemically synthesized
gggtccgagggaggaggggc

SEQ ID NO: 1703 - DNA, 20 bp, Artificial Sequence
  chemically synthesized
ggtccgagggaggaggggct

SEQ ID NO: 1704 - DNA, 20 bp, Artificial Sequence
  chemically synthesized
gtccgagggaggaggggctg

SEQ ID NO: 1705 - DNA, 20 bp, Artificial Sequence
  chemically synthesized
agggaggaggggctggggcc

SEQ ID NO: 1706 - DNA, 20 bp, Artificial Sequence
  chemically synthesized
ggggctggggcctggactcc

SEQ ID NO: 1707 - DNA, 20 bp, Artificial Sequence
  chemically synthesized
gggctggggcctggactcct

SEQ ID NO: 1708 - DNA, 20 bp, Artificial Sequence
  chemically synthesized
gggcctggactcctgggtct

SEQ ID NO: 1709 - DNA, 20 bp, Artificial Sequence
  chemically synthesized
ggcctggactcctgggtctg

SEQ ID NO: 1710 - DNA, 20 bp, Artificial Sequence
  chemically synthesized
gcctggactcctgggtctga

SEQ ID NO: 1711 - DNA, 20 bp, Artificial Sequence
  chemically synthesized
tggactcctgggtctgaggg

SEQ ID NO: 1712 - DNA, 20 bp, Artificial Sequence
  chemically synthesized
gactcctgggtctgagggtg

SEQ ID NO: 1713 - DNA, 20 bp, Artificial Sequence
  chemically synthesized
actcctgggtctgagggtgg

SEQ ID NO: 1714 - DNA, 20 bp, Artificial Sequence
  chemically synthesized
ctcctgggtctgagggtgga

SEQ ID NO: 1715 - DNA, 20 bp, Artificial Sequence
  chemically synthesized
gggtctgagggtggagggac

SEQ ID NO: 1716 - DNA, 20 bp, Artificial Sequence
  chemically synthesized
ggtctgagggtggagggact

SEQ ID NO: 1717 - DNA, 20 bp, Artificial Sequence
  chemically synthesized
gtctgagggtggagggactg

SEQ ID NO: 1718 - DNA, 20 bp, Artificial Sequence
  chemically synthesized
tctgagggtggagggactgg

SEQ ID NO: 1719 - DNA, 20 bp, Artificial Sequence
  chemically synthesized
gggtggagggactgggggcc

SEQ ID NO: 1720 - DNA, 20 bp, Artificial Sequence
  chemically synthesized
ggactgggggcctggactcc

SEQ ID NO: 1721 - DNA, 20 bp, Artificial Sequence
  chemically synthesized
gactgggggcctggactcct

SEQ ID NO: 1722 - DNA, 20 bp, Artificial Sequence
  chemically synthesized
gggcctggactcctgggtcc

SEQ ID NO: 1723 - DNA, 20 bp, Artificial Sequence
  chemically synthesized
ggcctggactcctgggtccg

SEQ ID NO: 1724 - DNA, 20 bp, Artificial Sequence
  chemically synthesized
gcctggactcctgggtccga

SEQ ID NO: 1725 - DNA, 20 bp, Artificial Sequence
  chemically synthesized
ctggactcctgggtccgagg

SEQ ID NO: 1726 - DNA, 20 bp, Artificial Sequence
  chemically synthesized
tggactcctgggtccgaggg

SEQ ID NO: 1727 - DNA, 20 bp, Artificial Sequence
  chemically synthesized
gactcctgggtccgagggag

SEQ ID NO: 1728 - DNA, 20 bp, Artificial Sequence
  chemically synthesized
actcctgggtccgagggagg

SEQ ID NO: 1729 - DNA, 20 bp, Artificial Sequence
  chemically synthesized
ctcctgggtccgagggagga

SEQ ID NO: 1730 - DNA, 20 bp, Artificial Sequence
  chemically synthesized
tcctgggtccgagggaggag

SEQ ID NO: 1731 - DNA, 20 bp, Artificial Sequence
  chemically synthesized
gggtccgagggaggaggggc

SEQ ID NO: 1732 - DNA, 20 bp, Artificial Sequence
  chemically synthesized
ggtccgagggaggaggggct

SEQ ID NO: 1733 - DNA, 20 bp, Artificial Sequence
  chemically synthesized
gtccgagggaggaggggctg

SEQ ID NO: 1734 - DNA, 20 bp, Artificial Sequence
  chemically synthesized
agggaggaggggctggggcc

SEQ ID NO: 1735 - DNA, 20 bp, Artificial Sequence
  chemically synthesized
ggggctggggcctggactcg

SEQ ID NO: 1736 - DNA, 20 bp, Artificial Sequence
  chemically synthesized
gggctggggcctggactcgt

SEQ ID NO: 1737 - DNA, 20 bp, Artificial Sequence
  chemically synthesized
gggcctggactcgtgggtct

SEQ ID NO: 1738 - DNA, 20 bp, Artificial Sequence
  chemically synthesized
ggcctggactcgtgggtctg

SEQ ID NO: 1739 - DNA, 20 bp, Artificial Sequence
  chemically synthesized
gcctggactcgtgggtctga

SEQ ID NO: 1740 - DNA, 20 bp, Artificial Sequence
  chemically synthesized
ctggactcgtgggtctgagg

SEQ ID NO: 1741 - DNA, 20 bp, Artificial Sequence
  chemically synthesized
tggactcgtgggtctgaggg

SEQ ID NO: 1742 - DNA, 20 bp, Artificial Sequence
  chemically synthesized
gactcgtgggtctgagggag

SEQ ID NO: 1743 - DNA, 20 bp, Artificial Sequence
  chemically synthesized
actcgtgggtctgagggagg

SEQ ID NO: 1744 - DNA, 20 bp, Artificial Sequence
  chemically synthesized
ctcgtgggtctgagggagga

SEQ ID NO: 1745 - DNA, 20 bp, Artificial Sequence
  chemically synthesized
tcgtgggtctgagggaggag

SEQ ID NO: 1746 - DNA, 20 bp, Artificial Sequence
  chemically synthesized
gggtctgagggaggaggggc

SEQ ID NO: 1747 - DNA, 20 bp, Artificial Sequence
  chemically synthesized
ggtctgagggaggaggggct

SEQ ID NO: 1748 - DNA, 20 bp, Artificial Sequence
  chemically synthesized
gtctgagggaggaggggctg

SEQ ID NO: 1749 - DNA, 20 bp, Artificial Sequence
  chemically synthesized
tctgagggaggaggggctgg

SEQ ID NO: 1750 - DNA, 20 bp, Artificial Sequence
  chemically synthesized
gggaggaggggctgggggcc

SEQ ID NO: 1751 - DNA, 20 bp, Artificial Sequence
  chemically synthesized
gggctgggggcctggacttc

SEQ ID NO: 1752 - DNA, 20 bp, Artificial Sequence
  chemically synthesized
ggctgggggcctggacttct

SEQ ID NO: 1753 - DNA, 20 bp, Artificial Sequence
  chemically synthesized
gggcctggacttctgggtct

SEQ ID NO: 1754 - DNA, 20 bp, Artificial Sequence
  chemically synthesized
ggcctggacttctgggtctt

SEQ ID NO: 1755 - DNA, 20 bp, Artificial Sequence
  chemically synthesized
gcctggacttctgggtctta

SEQ ID NO: 1756 - DNA, 20 bp, Artificial Sequence
  chemically synthesized
ctggacttctgggtcttagg

SEQ ID NO: 1757 - DNA, 20 bp, Artificial Sequence
  chemically synthesized
tggacttctgggtcttaggg

SEQ ID NO: 1758 - DNA, 20 bp, Artificial Sequence
  chemically synthesized
acttctgggtcttagggagg

SEQ ID NO: 1759 - DNA, 20 bp, Artificial Sequence
  chemically synthesized
cttctgggtcttagggaggc

SEQ ID NO: 1760 - DNA, 20 bp, Artificial Sequence
  chemically synthesized
ttctgggtcttagggaggcg

SEQ ID NO: 1761 - DNA, 20 bp, Artificial Sequence
  chemically synthesized
gggtcttagggaggcggggc

SEQ ID NO: 1762 - DNA, 20 bp, Artificial Sequence
  chemically synthesized
ggtcttagggaggcggggct

SEQ ID NO: 1763 - DNA, 20 bp, Artificial Sequence
  chemically synthesized
tagggaggcggggctgggcc

SEQ ID NO: 1764 - DNA, 20 bp, Artificial Sequence
  chemically synthesized
cggggctgggcctggacccc

SEQ ID NO: 1765 - DNA, 20 bp, Artificial Sequence
  chemically synthesized
ggggctgggcctggacccct

SEQ ID NO: 1766 - DNA, 20 bp, Artificial Sequence
  chemically synthesized
cctggacccctgggtctgaa

SEQ ID NO: 1767 - DNA, 20 bp, Artificial Sequence
  chemically synthesized
ctggacccctgggtctgaat

SEQ ID NO: 1768 - DNA, 20 bp, Artificial Sequence
  chemically synthesized
tggacccctgggtctgaatg

SEQ ID NO: 1769 - DNA, 20 bp, Artificial Sequence
  chemically synthesized
gacccctgggtctgaatggg

SEQ ID NO: 1770 - DNA, 20 bp, Artificial Sequence
  chemically synthesized
cccctgggtctgaatgggga

SEQ ID NO: 1771 - DNA, 20 bp, Artificial Sequence
  chemically synthesized
ccctgggtctgaatggggag

SEQ ID NO: 1772 - DNA, 20 bp, Artificial Sequence
  chemically synthesized
gggtctgaatggggagaggc

SEQ ID NO: 1773 - DNA, 20 bp, Artificial Sequence
  chemically synthesized
ggtctgaatggggagaggct

SEQ ID NO: 1774 - DNA, 20 bp, Artificial Sequence
  chemically synthesized
gtctgaatggggagaggctg

SEQ ID NO: 1775 - DNA, 20 bp, Artificial Sequence
  chemically synthesized
tctgaatggggagaggctgg

SEQ ID NO: 1776 - DNA, 20 bp, Artificial Sequence
  chemically synthesized
atggggagaggctgggggcc

SEQ ID NO: 1777 - DNA, 20 bp, Artificial Sequence
  chemically synthesized
gggcctggactccttcatct

SEQ ID NO: 1778 - DNA, 20 bp, Artificial Sequence
  chemically synthesized
ggcctggactccttcatctg

SEQ ID NO: 1779 - DNA, 20 bp, Artificial Sequence
  chemically synthesized
gcctggactccttcatctga

SEQ ID NO: 1780 - DNA, 20 bp, Artificial Sequence
  chemically synthesized
tggactccttcatctgaggg

SEQ ID NO: 1781 - DNA, 20 bp, Artificial Sequence
  chemically synthesized
actccttcatctgagggcgg

SEQ ID NO: 1782 - DNA, 20 bp, Artificial Sequence
  chemically synthesized
ctccttcatctgagggcgga

SEQ ID NO: 1783 - DNA, 20 bp, Artificial Sequence
  chemically synthesized
tccttcatctgagggcggaa

SEQ ID NO: 1784 - DNA, 20 bp, Artificial Sequence
  chemically synthesized
tcatctgagggcggaagggc

SEQ ID NO: 1785 - DNA, 20 bp, Artificial Sequence
  chemically synthesized
catctgagggcggaagggct

SEQ ID NO: 1786 - DNA, 20 bp, Artificial Sequence
  chemically synthesized
atctgagggcggaagggctg

SEQ ID NO: 1787 - DNA, 20 bp, Artificial Sequence
  chemically synthesized
agggcggaagggctggggcc

SEQ ID NO: 1788 - DNA, 20 bp, Artificial Sequence
  chemically synthesized
agggctggggcctggcctcc

SEQ ID NO: 1789 - DNA, 20 bp, Artificial Sequence
  chemically synthesized
gggctggggcctggcctcct

SEQ ID NO: 1790 - DNA, 20 bp, Artificial Sequence
  chemically synthesized
gcctggcctcctgggttgaa

SEQ ID NO: 1791 - DNA, 20 bp, Artificial Sequence
  chemically synthesized
cctggcctcctgggttgaat

SEQ ID NO: 1792 - DNA, 20 bp, Artificial Sequence
  chemically synthesized
ctggcctcctgggttgaatg

SEQ ID NO: 1793 - DNA, 20 bp, Artificial Sequence
  chemically synthesized
ggcctcctgggttgaatggg

SEQ ID NO: 1794 - DNA, 20 bp, Artificial Sequence
  chemically synthesized
gcctcctgggttgaatgggg

SEQ ID NO: 1795 - DNA, 20 bp, Artificial Sequence
  chemically synthesized
cctcctgggttgaatgggga

SEQ ID NO: 1796 - DNA, 20 bp, Artificial Sequence
  chemically synthesized
ctcctgggttgaatggggag

SEQ ID NO: 1797 - DNA, 20 bp, Artificial Sequence
  chemically synthesized
tgggttgaatggggaggggt

SEQ ID NO: 1798 - DNA, 20 bp, Artificial Sequence
  chemically synthesized
gggttgaatggggaggggtt

SEQ ID NO: 1799 - DNA, 20 bp, Artificial Sequence
  chemically synthesized
gaatggggaggggttgggcc

SEQ ID NO: 1800 - DNA, 20 bp, Artificial Sequence
  chemically synthesized
gaggggttgggcctggactc

SEQ ID NO: 1801 - DNA, 20 bp, Artificial Sequence
  chemically synthesized
ggggttgggcctggactctg

SEQ ID NO: 1802 - DNA, 20 bp, Artificial Sequence
  chemically synthesized
ggcctggactctggagtccc

SEQ ID NO: 1803 - DNA, 20 bp, Artificial Sequence
  chemically synthesized
actctggagtccctggtgcc

SEQ ID NO: 1804 - DNA, 20 bp, Artificial Sequence
  chemically synthesized
ctctggagtccctggtgccc

SEQ ID NO: 1805 - DNA, 20 bp, Artificial Sequence
  chemically synthesized
agtccctggtgcccaggcct

SEQ ID NO: 1806 - DNA, 20 bp, Artificial Sequence
  chemically synthesized
gtccctggtgcccaggcctc

SEQ ID NO: 1807 - DNA, 20 bp, Artificial Sequence
  chemically synthesized
caggcctcaggcatctttca

SEQ ID NO: 1808 - DNA, 20 bp, Artificial Sequence
  chemically synthesized
aggcctcaggcatctttcac

SEQ ID NO: 1809 - DNA, 20 bp, Artificial Sequence
  chemically synthesized
ggcctcaggcatctttcaca

SEQ ID NO: 1810 - DNA, 20 bp, Artificial Sequence
  chemically synthesized
tttcacagggatgcctgtac

SEQ ID NO: 1811 - DNA, 20 bp, Artificial Sequence
  chemically synthesized
ttcacagggatgcctgtact

SEQ ID NO: 1812 - DNA, 20 bp, Artificial Sequence
  chemically synthesized
acagggatgcctgtactggg

SEQ ID NO: 1813 - DNA, 20 bp, Artificial Sequence
  chemically synthesized
cagggatgcctgtactgggc

SEQ ID NO: 1814 - DNA, 20 bp, Artificial Sequence
  chemically synthesized
tgtactgggcaggtccttga

SEQ ID NO: 1815 - DNA, 20 bp, Artificial Sequence
  chemically synthesized
gtactgggcaggtccttgaa

SEQ ID NO: 1816 - DNA, 20 bp, Artificial Sequence
  chemically synthesized
tactgggcaggtccttgaaa

SEQ ID NO: 1817 - DNA, 20 bp, Artificial Sequence
  chemically synthesized
gggcaggtccttgaaaggga

SEQ ID NO: 1818 - DNA, 20 bp, Artificial Sequence
  chemically synthesized
ggcaggtccttgaaagggaa

SEQ ID NO: 1819 - DNA, 20 bp, Artificial Sequence
  chemically synthesized
tcccctatcgccatgacaac

SEQ ID NO: 1820 - DNA, 20 bp, Artificial Sequence
  chemically synthesized
cccctatcgccatgacaact

SEQ ID NO: 1821 - DNA, 20 bp, Artificial Sequence
  chemically synthesized
ctatcgccatgacaactggg

SEQ ID NO: 1822 - DNA, 20 bp, Artificial Sequence
  chemically synthesized
acaactgggtggaaataaac

SEQ ID NO: 1823 - DNA, 20 bp, Artificial Sequence
  chemically synthesized
tgggtggaaataaacgagcc

SEQ ID NO: 1824 - DNA, 20 bp, Artificial Sequence
  chemically synthesized
agccgagttcatcccgttcc

SEQ ID NO: 1825 - DNA, 20 bp, Artificial Sequence
  chemically synthesized
gccgagttcatcccgttccc

SEQ ID NO: 1826 - DNA, 20 bp, Artificial Sequence
  chemically synthesized
ccgagttcatcccgttccca

SEQ ID NO: 1827 - DNA, 20 bp, Artificial Sequence
  chemically synthesized
tcccgttcccagggcacgtg

SEQ ID NO: 1828 - DNA, 20 bp, Artificial Sequence
  chemically synthesized
gggcacgtgcggccccttca

SEQ ID NO: 1829 - DNA, 20 bp, Artificial Sequence
  chemically synthesized
gtgcggccccttcacagccc

SEQ ID NO: 1830 - DNA, 20 bp, Artificial Sequence
  chemically synthesized
tttccatgacctcatgctct

SEQ ID NO: 1831 - DNA, 20 bp, Artificial Sequence
  chemically synthesized
cctcatgctcttggccctcg

SEQ ID NO: 1832 - DNA, 20 bp, Artificial Sequence
  chemically synthesized
tagctccctcccgcctcctc

SEQ ID NO: 1833 - DNA, 20 bp, Artificial Sequence
  chemically synthesized
tccctcccgcctcctccaga

SEQ ID NO: 1834 - DNA, 20 bp, Artificial Sequence
  chemically synthesized
ccctcccgcctcctccagat

SEQ ID NO: 1835 - DNA, 20 bp, Artificial Sequence
  chemically synthesized
tcccgcctcctccagatggg

SEQ ID NO: 1836 - DNA, 20 bp, Artificial Sequence
  chemically synthesized
ctcctccagatgggcagctt

SEQ ID NO: 1837 - DNA, 20 bp, Artificial Sequence
  chemically synthesized
cctccagatgggcagctttg

SEQ ID NO: 1838 - DNA, 20 bp, Artificial Sequence
  chemically synthesized
tccagatgggcagctttgga

SEQ ID NO: 1839 - DNA, 20 bp, Artificial Sequence
  chemically synthesized
ccagatgggcagctttggag

SEQ ID NO: 1840 - DNA, 20 bp, Artificial Sequence
  chemically synthesized
atgggcagctttggagaggt

SEQ ID NO: 1841 - DNA, 20 bp, Artificial Sequence
  chemically synthesized
tgggcagctttggagaggtg

SEQ ID NO: 1842 - DNA, 20 bp, Artificial Sequence
  chemically synthesized
gggcagctttggagaggtga

SEQ ID NO: 1843 - DNA, 20 bp, Artificial Sequence
  chemically synthesized
ctttggagaggtgagggact

SEQ ID NO: 1844 - DNA, 20 bp, Artificial Sequence
  chemically synthesized
tttggagaggtgagggactt

SEQ ID NO: 1845 - DNA, 20 bp, Artificial Sequence
  chemically synthesized
ttggagaggtgagggacttg

SEQ ID NO: 1846 - DNA, 20 bp, Artificial Sequence
  chemically synthesized
tggagaggtgagggacttgg

SEQ ID NO: 1847 - DNA, 20 bp, Artificial Sequence
  chemically synthesized
ggagaggtgagggacttggg

SEQ ID NO: 1848 - DNA, 20 bp, Artificial Sequence
  chemically synthesized
ttggggggtaatttatcccg

SEQ ID NO: 1849 - DNA, 20 bp, Artificial Sequence
  chemically synthesized
ggtaatttatcccgtggatc

SEQ ID NO: 1850 - DNA, 20 bp, Artificial Sequence
  chemically synthesized
gtaatttatcccgtggatct

SEQ ID NO: 1851 - DNA, 20 bp, Artificial Sequence
  chemically synthesized
aatttatcccgtggatctag

SEQ ID NO: 1852 - DNA, 20 bp, Artificial Sequence
  chemically synthesized
atcccgtggatctaggagtt

SEQ ID NO: 1853 - DNA, 20 bp, Artificial Sequence
  chemically synthesized
gtttagcttcactccttcct

SEQ ID NO: 1854 - DNA, 20 bp, Artificial Sequence
  chemically synthesized
cttcactccttcctcagctc

SEQ ID NO: 1855 - DNA, 20 bp, Artificial Sequence
  chemically synthesized
ctccttcctcagctccagtt

SEQ ID NO: 1856 - DNA, 20 bp, Artificial Sequence
  chemically synthesized
tccttcctcagctccagttc

SEQ ID NO: 1857 - DNA, 20 bp, Artificial Sequence
  chemically synthesized
ctcagctccagttcaggtcc

SEQ ID NO: 1858 - DNA, 20 bp, Artificial Sequence
  chemically synthesized
cagctccagttcaggtcccg

SEQ ID NO: 1859 - DNA, 20 bp, Artificial Sequence
  chemically synthesized
ttcaggtcccggagcccacc

SEQ ID NO: 1860 - DNA, 20 bp, Artificial Sequence
  chemically synthesized
ggagcccacccagtgtccac

SEQ ID NO: 1861 - DNA, 20 bp, Artificial Sequence
  chemically synthesized
gagcccacccagtgtccaca

SEQ ID NO: 1862 - DNA, 20 bp, Artificial Sequence
  chemically synthesized
cacccagtgtccacaaggcc

SEQ ID NO: 1863 - DNA, 20 bp, Artificial Sequence
  chemically synthesized
acccagtgtccacaaggcct

SEQ ID NO: 1864 - DNA, 20 bp, Artificial Sequence
  chemically synthesized
cccagtgtccacaaggcctg

SEQ ID NO: 1865 - DNA, 20 bp, Artificial Sequence
  chemically synthesized
gtgtccacaaggcctggggc

SEQ ID NO: 1866 - DNA, 20 bp, Artificial Sequence
  chemically synthesized
aagtccctcctccgaccccc

SEQ ID NO: 1867 - DNA, 20 bp, Artificial Sequence
  chemically synthesized
tcctccgaccccctggactt

SEQ ID NO: 1868 - DNA, 20 bp, Artificial Sequence
  chemically synthesized
acttcggcttttgtcccccc

SEQ ID NO: 1869 - DNA, 20 bp, Artificial Sequence
  chemically synthesized
gcttttgtccccccaagttt

SEQ ID NO: 1870 - DNA, 20 bp, Artificial Sequence
  chemically synthesized
cccccaagttttggacccct

SEQ ID NO: 1871 - DNA, 20 bp, Artificial Sequence
  chemically synthesized
ccccaagttttggaccccta

SEQ ID NO: 1872 - DNA, 20 bp, Artificial Sequence
  chemically synthesized
cccaagttttggacccctaa

SEQ ID NO: 1873 - DNA, 20 bp, Artificial Sequence
  chemically synthesized
aagttttggacccctaaggg

SEQ ID NO: 1874 - DNA, 20 bp, Artificial Sequence
  chemically synthesized
tggacccctaagggaagaat

SEQ ID NO: 1875 - DNA, 20 bp, Artificial Sequence
  chemically synthesized
cctaagggaagaatgagaaa

SEQ ID NO: 1876 - DNA, 20 bp, Artificial Sequence
  chemically synthesized
aagggaagaatgagaaacgg

SEQ ID NO: 1877 - DNA, 20 bp, Artificial Sequence
  chemically synthesized
tgagaaacggtggcccgtgt

SEQ ID NO: 1878 - DNA, 20 bp, Artificial Sequence
  chemically synthesized
cggtggcccgtgtcagcccc

SEQ ID NO: 1879 - DNA, 20 bp, Artificial Sequence
  chemically synthesized
cccgtgtcagcccctggctg

SEQ ID NO: 1880 - DNA, 20 bp, Artificial Sequence
  chemically synthesized
ccgtgtcagcccctggctgc

SEQ ID NO: 1881 - DNA, 20 bp, Artificial Sequence
  chemically synthesized
cgtgtcagcccctggctgca

SEQ ID NO: 1882 - DNA, 20 bp, Artificial Sequence
  chemically synthesized
cctggctgcagggccccgtg

SEQ ID NO: 1883 - DNA, 20 bp, Artificial Sequence
  chemically synthesized
tggctgcagggccccgtgca

SEQ ID NO: 1884 - DNA, 20 bp, Artificial Sequence
  chemically synthesized
ggctgcagggccccgtgcag

SEQ ID NO: 1885 - DNA, 20 bp, Artificial Sequence
  chemically synthesized
gctgcagggccccgtgcaga

SEQ ID NO: 1886 - DNA, 20 bp, Artificial Sequence
  chemically synthesized
ctgcagggccccgtgcagag

SEQ ID NO: 1887 - DNA, 20 bp, Artificial Sequence
  chemically synthesized
tgcagggccccgtgcagagg

SEQ ID NO: 1888 - DNA, 20 bp, Artificial Sequence
  chemically synthesized
gccccgtgcagagggggcct

SEQ ID NO: 1889 - DNA, 20 bp, Artificial Sequence
  chemically synthesized
cagagggggcctcagtgaac

SEQ ID NO: 1890 - DNA, 20 bp, Artificial Sequence
  chemically synthesized
gagggggcctcagtgaactg

SEQ ID NO: 1891 - DNA, 20 bp, Artificial Sequence
  chemically synthesized
ctcagtgaactggagtgtga

SEQ ID NO: 1892 - DNA, 20 bp, Artificial Sequence
  chemically synthesized
tgaactggagtgtgacagcc

SEQ ID NO: 1893 - DNA, 20 bp, Artificial Sequence
  chemically synthesized
gaactggagtgtgacagcct

SEQ ID NO: 1894 - DNA, 20 bp, Artificial Sequence
  chemically synthesized
aactggagtgtgacagcctg

SEQ ID NO: 1895 - DNA, 20 bp, Artificial Sequence
  chemically synthesized
gagtgtgacagcctggggcc

SEQ ID NO: 1896 - DNA, 20 bp, Artificial Sequence
  chemically synthesized
agtgtgacagcctggggccc

SEQ ID NO: 1897 - DNA, 20 bp, Artificial Sequence
  chemically synthesized
cagcctggggcccaggcaca

SEQ ID NO: 1898 - DNA, 20 bp, Artificial Sequence
  chemically synthesized
agcctggggcccaggcacac

SEQ ID NO: 1899 - DNA, 20 bp, Artificial Sequence
  chemically synthesized
ggcccaggcacacaggtgtg

SEQ ID NO: 1900 - DNA, 20 bp, Artificial Sequence
  chemically synthesized
gtgcagctgtctcacccctc

SEQ ID NO: 1901 - DNA, 20 bp, Artificial Sequence
  chemically synthesized
tgcagctgtctcacccctct

SEQ ID NO: 1902 - DNA, 20 bp, Artificial Sequence
  chemically synthesized
cagctgtctcacccctctgg

SEQ ID NO: 1903 - DNA, 20 bp, Artificial Sequence
  chemically synthesized
acccctctgggagtcccgcc

SEQ ID NO: 1904 - DNA, 20 bp, Artificial Sequence
  chemically synthesized
cccctctgggagtcccgccc

SEQ ID NO: 1905 - DNA, 20 bp, Artificial Sequence
  chemically synthesized
ggagtcccgcccaggcccct

SEQ ID NO: 1906 - DNA, 20 bp, Artificial Sequence
  chemically synthesized
ccaggcccctgagtctgtcc

SEQ ID NO: 1907 - DNA, 20 bp, Artificial Sequence
  chemically synthesized
cccctgagtctgtcccagca

SEQ ID NO: 1908 - DNA, 20 bp, Artificial Sequence
  chemically synthesized
ccctgagtctgtcccagcac

SEQ ID NO: 1909 - DNA, 20 bp, Artificial Sequence
  chemically synthesized
cctgagtctgtcccagcaca

SEQ ID NO: 1910 - DNA, 20 bp, Artificial Sequence
  chemically synthesized
gagtctgtcccagcacaggg

SEQ ID NO: 1911 - DNA, 20 bp, Artificial Sequence
  chemically synthesized
tggccttcctccaccctgca

SEQ ID NO: 1912 - DNA, 20 bp, Artificial Sequence
  chemically synthesized
tcctccaccctgcatagccc

SEQ ID NO: 1913 - DNA, 20 bp, Artificial Sequence
  chemically synthesized
cctccaccctgcatagccct

SEQ ID NO: 1914 - DNA, 20 bp, Artificial Sequence
  chemically synthesized
cctgcatagccctgggccca

SEQ ID NO: 1915 - DNA, 20 bp, Artificial Sequence
  chemically synthesized
ggcccacggcttcgttcctg

SEQ ID NO: 1916 - DNA, 20 bp, Artificial Sequence
  chemically synthesized
cccacggcttcgttcctgca

SEQ ID NO: 1917 - DNA, 20 bp, Artificial Sequence
  chemically synthesized
cgttcctgcagagtatctgc

SEQ ID NO: 1918 - DNA, 20 bp, Artificial Sequence
  chemically synthesized
gttcctgcagagtatctgct

SEQ ID NO: 1919 - DNA, 20 bp, Artificial Sequence
  chemically synthesized
ttcctgcagagtatctgctg

SEQ ID NO: 1920 - DNA, 20 bp, Artificial Sequence
  chemically synthesized
ctgcagagtatctgctgggg

SEQ ID NO: 1921 - DNA, 20 bp, Artificial Sequence
  chemically synthesized
tatctgctggggtggtttcc

SEQ ID NO: 1922 - DNA, 20 bp, Artificial Sequence
  chemically synthesized
tggtttccgagcttgaccct

SEQ ID NO: 1923 - DNA, 20 bp, Artificial Sequence
  chemically synthesized
tttccgagcttgacccttgg

SEQ ID NO: 1924 - DNA, 20 bp, Artificial Sequence
  chemically synthesized
ttccgagcttgacccttgga

SEQ ID NO: 1925 - DNA, 20 bp, Artificial Sequence
  chemically synthesized
gcttgacccttggaaggacc

SEQ ID NO: 1926 - DNA, 20 bp, Artificial Sequence
  chemically synthesized
gacccttggaaggacctggc

SEQ ID NO: 1927 - DNA, 20 bp, Artificial Sequence
  chemically synthesized
acccttggaaggacctggct

SEQ ID NO: 1928 - DNA, 20 bp, Artificial Sequence
  chemically synthesized
ggaaggacctggctgggttt

SEQ ID NO: 1929 - DNA, 20 bp, Artificial Sequence
  chemically synthesized
gaaggacctggctgggttta

SEQ ID NO: 1930 - DNA, 20 bp, Artificial Sequence
  chemically synthesized
ggacctggctgggtttaagg

SEQ ID NO: 1931 - DNA, 20 bp, Artificial Sequence
  chemically synthesized
gacctggctgggtttaaggc

SEQ ID NO: 1932 - DNA, 20 bp, Artificial Sequence
  chemically synthesized
cctggctgggtttaaggcag

SEQ ID NO: 1933 - DNA, 20 bp, Artificial Sequence
  chemically synthesized
ctggctgggtttaaggcagg

SEQ ID NO: 1934 - DNA, 20 bp, Artificial Sequence
  chemically synthesized
tggctgggtttaaggcagga

SEQ ID NO: 1935 - DNA, 20 bp, Artificial Sequence
  chemically synthesized
ggctgggtttaaggcaggag

SEQ ID NO: 1936 - DNA, 20 bp, Artificial Sequence
  chemically synthesized
gggtttaaggcaggaggggc

SEQ ID NO: 1937 - DNA, 20 bp, Artificial Sequence
  chemically synthesized
ggtttaaggcaggaggggct

SEQ ID NO: 1938 - DNA, 20 bp, Artificial Sequence
  chemically synthesized
gtttaaggcaggaggggctg

SEQ ID NO: 1939 - DNA, 20 bp, Artificial Sequence
  chemically synthesized
tttaaggcaggaggggctgg

SEQ ID NO: 1940 - DNA, 20 bp, Artificial Sequence
  chemically synthesized
aggcaggaggggctgggggc

SEQ ID NO: 1941 - DNA, 20 bp, Artificial Sequence
  chemically synthesized
ggcaggaggggctgggggcc

SEQ ID NO: 1942 - DNA, 20 bp, Artificial Sequence
  chemically synthesized
gggctgggggccaggactcc

SEQ ID NO: 1943 - DNA, 20 bp, Artificial Sequence
  chemically synthesized
ggccaggactcctggctctg

SEQ ID NO: 1944 - DNA, 20 bp, Artificial Sequence
  chemically synthesized
gccaggactcctggctctga

SEQ ID NO: 1945 - DNA, 20 bp, Artificial Sequence
  chemically synthesized
caggactcctggctctgaag

SEQ ID NO: 1946 - DNA, 20 bp, Artificial Sequence
  chemically synthesized
aggactcctggctctgaagg

SEQ ID NO: 1947 - DNA, 20 bp, Artificial Sequence
  chemically synthesized
gactcctggctctgaaggag

SEQ ID NO: 1948 - DNA, 20 bp, Artificial Sequence
  chemically synthesized
actcctggctctgaaggagg

SEQ ID NO: 1949 - DNA, 20 bp, Artificial Sequence
  chemically synthesized
ctcctggctctgaaggagga

SEQ ID NO: 1950 - DNA, 20 bp, Artificial Sequence
  chemically synthesized
tcctggctctgaaggaggag

SEQ ID NO: 1951 - DNA, 20 bp, Artificial Sequence
  chemically synthesized
ggctctgaaggaggaggggc

SEQ ID NO: 1952 - DNA, 20 bp, Artificial Sequence
  chemically synthesized
aggggctggaacctcttccc

SEQ ID NO: 1953 - DNA, 20 bp, Artificial Sequence
  chemically synthesized
tggaacctcttccctagtct

SEQ ID NO: 1954 - DNA, 20 bp, Artificial Sequence
  chemically synthesized
ctcttccctagtctgagcac

SEQ ID NO: 1955 - DNA, 20 bp, Artificial Sequence
  chemically synthesized
ttccctagtctgagcactgg

SEQ ID NO: 1956 - DNA, 20 bp, Artificial Sequence
  chemically synthesized
agcactggaagcgccacctg

SEQ ID NO: 1957 - DNA, 20 bp, Artificial Sequence
  chemically synthesized
gcactggaagcgccacctgt

SEQ ID NO: 1958 - DNA, 20 bp, Artificial Sequence
  chemically synthesized
ctggaagcgccacctgtggg

SEQ ID NO: 1959 - DNA, 20 bp, Artificial Sequence
  chemically synthesized
gcgccacctgtgggtggtga

SEQ ID NO: 1960 - DNA, 20 bp, Artificial Sequence
  chemically synthesized
cgccacctgtgggtggtgac

SEQ ID NO: 1961 - DNA, 20 bp, Artificial Sequence
  chemically synthesized
gccacctgtgggtggtgacg

SEQ ID NO: 1962 - DNA, 20 bp, Artificial Sequence
  chemically synthesized
ccacctgtgggtggtgacgg

SEQ ID NO: 1963 - DNA, 20 bp, Artificial Sequence
  chemically synthesized
gggggttttgccgtgtctaa

SEQ ID NO: 1964 - DNA, 20 bp, Artificial Sequence
  chemically synthesized
ggggttttgccgtgtctaac

SEQ ID NO: 1965 - DNA, 20 bp, Artificial Sequence
  chemically synthesized
cgtgtctaacaggtaccatg

SEQ ID NO: 1966 - DNA, 20 bp, Artificial Sequence
  chemically synthesized
gtgtctaacaggtaccatgt

SEQ ID NO: 1967 - DNA, 20 bp, Artificial Sequence
  chemically synthesized
tgtctaacaggtaccatgtg

SEQ ID NO: 1968 - DNA, 20 bp, Artificial Sequence
  chemically synthesized
ccatgtggggttcccgcacc

SEQ ID NO: 1969 - DNA, 20 bp, Artificial Sequence
  chemically synthesized
tggggttcccgcacccagat

SEQ ID NO: 1970 - DNA, 20 bp, Artificial Sequence
  chemically synthesized
ggttcccgcacccagatgag

SEQ ID NO: 1971 - DNA, 20 bp, Artificial Sequence
  chemically synthesized
ccccgttcacttcctgtttg

SEQ ID NO: 1972 - DNA, 20 bp, Artificial Sequence
  chemically synthesized
gttcacttcctgtttgcaga

SEQ ID NO: 1973 - DNA, 20 bp, Artificial Sequence
  chemically synthesized
acttcctgtttgcagatagc

SEQ ID NO: 1974 - DNA, 20 bp, Artificial Sequence
  chemically synthesized
cttcctgtttgcagatagcc

SEQ ID NO: 1975 - DNA, 20 bp, Artificial Sequence
  chemically synthesized
tcctgtttgcagatagccag

SEQ ID NO: 1976 - DNA, 20 bp, Artificial Sequence
  chemically synthesized
gatagccaggagtcctttcg

SEQ ID NO: 1977 - DNA, 20 bp, Artificial Sequence
  chemically synthesized
gtcctttcgtggtttccact

SEQ ID NO: 1978 - DNA, 20 bp, Artificial Sequence
  chemically synthesized
gtggtttccactgagcactg

SEQ ID NO: 1979 - DNA, 20 bp, Artificial Sequence
  chemically synthesized
tggtttccactgagcactga

SEQ ID NO: 1980 - DNA, 20 bp, Artificial Sequence
  chemically synthesized
tccactgagcactgaaggcc

SEQ ID NO: 1981 - DNA, 20 bp, Artificial Sequence
  chemically synthesized
ctgagcactgaaggcctggc

SEQ ID NO: 1982 - DNA, 20 bp, Artificial Sequence
  chemically synthesized
ggcctggccggcctgaccac

SEQ ID NO: 1983 - DNA, 20 bp, Artificial Sequence
  chemically synthesized
gcctggccggcctgaccact

SEQ ID NO: 1984 - DNA, 20 bp, Artificial Sequence
  chemically synthesized
cggcctgaccactgggcaac

SEQ ID NO: 1985 - DNA, 20 bp, Artificial Sequence
  chemically synthesized
ggcctgaccactgggcaacc

SEQ ID NO: 1986 - DNA, 20 bp, Artificial Sequence
  chemically synthesized
gcaaccaggcgtatcttaaa

SEQ ID NO: 1987 - DNA, 20 bp, Artificial Sequence
  chemically synthesized
ccaggcgtatcttaaacagc

SEQ ID NO: 1988 - DNA, 20 bp, Artificial Sequence
  chemically synthesized
ggcgtatcttaaacagccag

SEQ ID NO: 1989 - DNA, 20 bp, Artificial Sequence
  chemically synthesized
tatcttaaacagccagtggc

SEQ ID NO: 1990 - DNA, 20 bp, Artificial Sequence
  chemically synthesized
tcttaaacagccagtggcca

SEQ ID NO: 1991 - DNA, 20 bp, Artificial Sequence
  chemically synthesized
cttaaacagccagtggccag

SEQ ID NO: 1992 - DNA, 20 bp, Artificial Sequence
  chemically synthesized
agccagtggccagaggctgt

SEQ ID NO: 1993 - DNA, 20 bp, Artificial Sequence
  chemically synthesized
gccagtggccagaggctgtt

SEQ ID NO: 1994 - DNA, 20 bp, Artificial Sequence
  chemically synthesized
ggtcattttccccactgtcc

SEQ ID NO: 1995 - DNA, 20 bp, Artificial Sequence
  chemically synthesized
ctgtcctagcaccgtgtccc

SEQ ID NO: 1996 - DNA, 20 bp, Artificial Sequence
  chemically synthesized
tgtccctggatctgttttcg

SEQ ID NO: 1997 - DNA, 20 bp, Artificial Sequence
  chemically synthesized
tctgttttcgtggctccctc

SEQ ID NO: 1998 - DNA, 20 bp, Artificial Sequence
  chemically synthesized
tgttttcgtggctccctctg

SEQ ID NO: 1999 - DNA, 20 bp, Artificial Sequence
  chemically synthesized
cctctggagtcccgacttgc

SEQ ID NO: 2000 - DNA, 20 bp, Artificial Sequence
  chemically synthesized
ctctggagtcccgacttgct

SEQ ID NO: 2001 - DNA, 20 bp, Artificial Sequence
  chemically synthesized
cccgacttgctgggacaccg

SEQ ID NO: 2002 - DNA, 20 bp, Artificial Sequence
  chemically synthesized
acttgctgggacaccgtggc

SEQ ID NO: 2003 - DNA, 20 bp, Artificial Sequence
  chemically synthesized
cttgctgggacaccgtggct

SEQ ID NO: 2004 - DNA, 20 bp, Artificial Sequence
  chemically synthesized
ttgctgggacaccgtggctg

SEQ ID NO: 2005 - DNA, 20 bp, Artificial Sequence
  chemically synthesized
ctgggacaccgtggctgggg

SEQ ID NO: 2006 - DNA, 20 bp, Artificial Sequence
  chemically synthesized
tgggacaccgtggctggggt

SEQ ID NO: 2007 - DNA, 20 bp, Artificial Sequence
  chemically synthesized
caccgtggctggggtaggtg

SEQ ID NO: 2008 - DNA, 20 bp, Artificial Sequence
  chemically synthesized
gctggggtaggtgcggctga

SEQ ID NO: 2009 - DNA, 20 bp, Artificial Sequence
  chemically synthesized
tgacggctgtttcccacccc

SEQ ID NO: 2010 - DNA, 20 bp, Artificial Sequence
  chemically synthesized
gacggctgtttcccaccccc

SEQ ID NO: 2011 - DNA, 20 bp, Artificial Sequence
  chemically synthesized
acccccaggcctgcattgat

SEQ ID NO: 2012 - DNA, 20 bp, Artificial Sequence
  chemically synthesized
ggcctgcattgatgagaacc

SEQ ID NO: 2013 - DNA, 20 bp, Artificial Sequence
  chemically synthesized
cctgcattgatgagaacctg

SEQ ID NO: 2014 - DNA, 20 bp, Artificial Sequence
  chemically synthesized
ctgcattgatgagaacctgg

SEQ ID NO: 2015 - DNA, 20 bp, Artificial Sequence
  chemically synthesized
cattgatgagaacctggagg

SEQ ID NO: 2016 - DNA, 20 bp, Artificial Sequence
  chemically synthesized
cctggaggtggtgcgcttct

SEQ ID NO: 2017 - DNA, 20 bp, Artificial Sequence
  chemically synthesized
ggaggtggtgcgcttcttgg

SEQ ID NO: 2018 - DNA, 20 bp, Artificial Sequence
  chemically synthesized
aggtggtgcgcttcttggtg

SEQ ID NO: 2019 - DNA, 20 bp, Artificial Sequence
  chemically synthesized
tggtgcgcttcttggtggag

SEQ ID NO: 2020 - DNA, 20 bp, Artificial Sequence
  chemically synthesized
ggtgcgcttcttggtggagc

SEQ ID NO: 2021 - DNA, 20 bp, Artificial Sequence
  chemically synthesized
gtgcgcttcttggtggagca

SEQ ID NO: 2022 - DNA, 20 bp, Artificial Sequence
  chemically synthesized
agcagggcgccactgtgaac

SEQ ID NO: 2023 - DNA, 20 bp, Artificial Sequence
  chemically synthesized
gcagggcgccactgtgaacc

SEQ ID NO: 2024 - DNA, 20 bp, Artificial Sequence
  chemically synthesized
gggcgccactgtgaaccagg

SEQ ID NO: 2025 - DNA, 20 bp, Artificial Sequence
  chemically synthesized
ctgtgaaccaggcagacaac

SEQ ID NO: 2026 - DNA, 20 bp, Artificial Sequence
  chemically synthesized
tgtgaaccaggcagacaacg

SEQ ID NO: 2027 - DNA, 20 bp, Artificial Sequence
  chemically synthesized
gtgaaccaggcagacaacga

SEQ ID NO: 2028 - DNA, 20 bp, Artificial Sequence
  chemically synthesized
accaggcagacaacgagggc

SEQ ID NO: 2029 - DNA, 20 bp, Artificial Sequence
  chemically synthesized
gggctggacgccactgcacg

SEQ ID NO: 2030 - DNA, 20 bp, Artificial Sequence
  chemically synthesized
ctgcacgtggccgcctcctg

SEQ ID NO: 2031 - DNA, 20 bp, Artificial Sequence
  chemically synthesized
ggccgcctcctgtggctacc

SEQ ID NO: 2032 - DNA, 20 bp, Artificial Sequence
  chemically synthesized
tgtggctacctagatatcgc

SEQ ID NO: 2033 - DNA, 20 bp, Artificial Sequence
  chemically synthesized
gttctcatcaatgcaggcct

SEQ ID NO: 2034 - DNA, 20 bp, Artificial Sequence
  chemically synthesized
gaagggagggggcttctcat

SEQ ID NO: 2035 - DNA, 20 bp, Artificial Sequence
  chemically synthesized
gcccctcctccttcagagcc

SEQ ID NO: 2036 - DNA, 20 bp, Artificial Sequence
  chemically synthesized
aaacccagccaggtccttcc

SEQ ID NO: 2037 - DNA, 20 bp, Artificial Sequence
  chemically synthesized
gccgtgggcccagggctatg

SEQ ID NO: 2038 - DNA, 20 bp, Artificial Sequence
  chemically synthesized
ggcctgggcgggactcccag

SEQ ID NO: 2039 - DNA, 20 bp, Artificial Sequence
  chemically synthesized
ccgtttctcattcttccctt

SEQ ID NO: 2040 - DNA, 20 bp, Artificial Sequence
  chemically synthesized
gggacaaaagccgaagtcca

SEQ ID NO: 2041 - DNA, 20 bp, Artificial Sequence
  chemically synthesized
tgccccaggccttgtggaca

SEQ ID NO: 2042 - DNA, 20 bp, Artificial Sequence
  chemically synthesized
acctgaactggagctgagga

SEQ ID NO: 2043 - DNA, 20 bp, Artificial Sequence
  chemically synthesized
aagctaaactcctagatcca

SEQ ID NO: 2044 - DNA, 20 bp, Artificial Sequence
  chemically synthesized
ggccgcacgtgccctgggaa

SEQ ID NO: 2045 - DNA, 20 bp, Artificial Sequence
  chemically synthesized
ggcctgggcaccagggactc

SEQ ID NO: 2046 - DNA, 20 bp, Artificial Sequence
  chemically synthesized
gcccttccgccctcagatga

SEQ ID NO: 2047 - DNA, 20 bp, Artificial Sequence
  chemically synthesized
gcctctccccattcagaccc

SEQ ID NO: 2048 - DNA, 20 bp, Artificial Sequence
  chemically synthesized
gcccctcctccctcagaccc

SEQ ID NO: 2049 - DNA, 20 bp, Artificial Sequence
  chemically synthesized
gcccctcctccctcggaccc

SEQ ID NO: 2050 - DNA, 20 bp, Artificial Sequence
  chemically synthesized
gtccctccaccctcagaccc

SEQ ID NO: 2051 - DNA, 20 bp, Artificial Sequence
  chemically synthesized
gcccctcctccctcggaccc

SEQ ID NO: 2052 - DNA, 20 bp, Artificial Sequence
  chemically synthesized
gctcttctctgttcagccct

SEQ ID NO: 2053 - DNA, 20 bp, Artificial Sequence
  chemically synthesized
cccctagccactaaggcaat

SEQ ID NO: 2054 - DNA, 20 bp, Artificial Sequence
  chemically synthesized
cactaaggcaattggggtgc

SEQ ID NO: 2055 - DNA, 20 bp, Artificial Sequence
  chemically synthesized
ttggggtgcaggaatggggg

SEQ ID NO: 2056 - DNA, 20 bp, Artificial Sequence
  chemically synthesized
aagtggttgataaacccacg

SEQ ID NO: 2057 - DNA, 20 bp, Artificial Sequence
  chemically synthesized
gcttggggacctgcctggag

SEQ ID NO: 2058 - DNA, 20 bp, Artificial Sequence
  chemically synthesized
cccaggtggagaaactggcc

SEQ ID NO: 2059 - DNA, 20 bp, Artificial Sequence
  chemically synthesized
ggagaaactggccgggaatc

SEQ ID NO: 2060 - DNA, 20 bp, Artificial Sequence
  chemically synthesized
atccctgttttcctaggact

SEQ ID NO: 2061 - DNA, 20 bp, Artificial Sequence
  chemically synthesized
ttggccacgtaacctgagaa

SEQ ID NO: 2062 - DNA, 20 bp, Artificial Sequence
  chemically synthesized
ccccaatgctccaggcctcc

SEQ ID NO: 2063 - DNA, 20 bp, Artificial Sequence
  chemically synthesized
aggcctcctgggataccccg

SEQ ID NO: 2064 - DNA, 20 bp, Artificial Sequence
  chemically synthesized
ctcctgggataccccgaaga

SEQ ID NO: 2065 - DNA, 20 bp, Artificial Sequence
  chemically synthesized
cagtcaccccacagttggag

SEQ ID NO: 2066 - DNA, 20 bp, Artificial Sequence
  chemically synthesized
ggcagcctggtagacagggc

SEQ ID NO: 2067 - DNA, 20 bp, Artificial Sequence
  chemically synthesized
agggctggggtggcctctcg

SEQ ID NO: 2068 - DNA, 20 bp, Artificial Sequence
  chemically synthesized
taggtggcctggggcctctg

SEQ ID NO: 2069 - DNA, 20 bp, Artificial Sequence
  chemically synthesized
tctgggggatgcaggggaag

SEQ ID NO: 2070 - DNA, 20 bp, Artificial Sequence
  chemically synthesized
gaagggggatgcaggggaac

SEQ ID NO: 2071 - DNA, 20 bp, Artificial Sequence
  chemically synthesized
cgggaccctgctctgggcgg

SEQ ID NO: 2072 - DNA, 20 bp, Artificial Sequence
  chemically synthesized
tggggactctttaaggaaag

SEQ ID NO: 2073 - DNA, 20 bp, Artificial Sequence
  chemically synthesized
gaaggatggagaaagagaaa

SEQ ID NO: 2074 - DNA, 20 bp, Artificial Sequence
  chemically synthesized
ggacgcaccattctcacaaa

SEQ ID NO: 2075 - DNA, 20 bp, Artificial Sequence
  chemically synthesized
gtgtaaggaagctgcagcac

SEQ ID NO: 2076 - DNA, 20 bp, Artificial Sequence
  chemically synthesized
gagcagctcaggttctggga

SEQ ID NO: 2077 - DNA, 20 bp, Artificial Sequence
  chemically synthesized
ggttctgggagagggtagcg

SEQ ID NO: 2078 - DNA, 20 bp, Artificial Sequence
  chemically synthesized
ccctgccaagctctccctcc

SEQ ID NO: 2079 - DNA, 20 bp, Artificial Sequence
  chemically synthesized
gagagatggctccaggaaat

SEQ ID NO: 2080 - DNA, 20 bp, Artificial Sequence
  chemically synthesized
tgggggtgtgtcaccagata

SEQ ID NO: 2081 - DNA, 20 bp, Artificial Sequence
  chemically synthesized
gaatctgcctaacaggaggt

SEQ ID NO: 2082 - DNA, 20 bp, Artificial Sequence
  chemically synthesized
gactaggaaggaggaggcct

SEQ ID NO: 2083 - DNA, 20 bp, Artificial Sequence
  chemically synthesized
tgtccctagtggccccactg

SEQ ID NO: 2084 - DNA, 20 bp, Artificial Sequence
  chemically synthesized
gagccacattaaccggccct

SEQ ID NO: 2085 - DNA, 20 bp, Artificial Sequence
  chemically synthesized
gtggtcccagctcggggaca

SEQ ID NO: 2086 - DNA, 20 bp, Artificial Sequence
  chemically synthesized
cctgaagtggacataggggc

SEQ ID NO: 2087 - DNA, 20 bp, Artificial Sequence
  chemically synthesized
gcacagactagagaggtaag

SEQ ID NO: 2088 - DNA, 20 bp, Artificial Sequence
  chemically synthesized
aggggagctgcccaaatgaa

SEQ ID NO: 2089 - DNA, 20 bp, Artificial Sequence
  chemically synthesized
tgaaaggagtgagaggtgac

SEQ ID NO: 2090 - DNA, 20 bp, Artificial Sequence
  chemically synthesized
gacccgaatccacaggagaa

SEQ ID NO: 2091 - DNA, 20 bp, Artificial Sequence
  chemically synthesized
tgtccaggcaaagaaagcaa

SEQ ID NO: 2092 - DNA, 20 bp, Artificial Sequence
  chemically synthesized
ggtggctaaagccagggaga

SEQ ID NO: 2093 - DNA, 20 bp, Artificial Sequence
  chemically synthesized
gccagggagacggggtactt

SEQ ID NO: 2094 - DNA, 20 bp, Artificial Sequence
  chemically synthesized
gagaaggaaaagggaaccca

SEQ ID NO: 2095 - DNA, 20 bp, Artificial Sequence
  chemically synthesized
cccagcgagtgaagacggca

SEQ ID NO: 2096 - DNA, 20 bp, Artificial Sequence
  chemically synthesized
cgagtgaagacggcatgggg

SEQ ID NO: 2097 - DNA, 20 bp, Artificial Sequence
  chemically synthesized
ggagaggacccagacacggg

SEQ ID NO: 2098 - DNA, 20 bp, Artificial Sequence
  chemically synthesized
agcagagagcaaggggaaga

SEQ ID NO: 2099 - DNA, 20 bp, Artificial Sequence
  chemically synthesized
acctgaaggaggcggcaggg

SEQ ID NO: 2100 - DNA, 20 bp, Artificial Sequence
  chemically synthesized
agcggcacaggcccagggga

SEQ ID NO: 2101 - DNA, 20 bp, Artificial Sequence
  chemically synthesized
gagacggcagcgttagaggg

SEQ ID NO: 2102 - DNA, 20 bp, Artificial Sequence
  chemically synthesized
ggaagaggggaagtcgaggg

SEQ ID NO: 2103 - DNA, 20 bp, Artificial Sequence
  chemically synthesized
gggatggtaaggaggactgc

SEQ ID NO: 2104 - DNA, 20 bp, Artificial Sequence
  chemically synthesized
aaagcgactccaatgcggaa

SEQ ID NO: 2105 - DNA, 20 bp, Artificial Sequence
  chemically synthesized
cggaagagagtaggtcgaag

SEQ ID NO: 2106 - DNA, 20 bp, Artificial Sequence
  chemically synthesized
aatggtaaggaggcctgggg

SEQ ID NO: 2107 - DNA, 20 bp, Artificial Sequence
  chemically synthesized
ctggggcagagtggtcagca

SEQ ID NO: 2108 - DNA, 20 bp, Artificial Sequence
  chemically synthesized
aagcggctccaattcggaag

SEQ ID NO: 2109 - DNA, 20 bp, Artificial Sequence
  chemically synthesized
cggaagtggggtggtcgaag

SEQ ID NO: 2110 - DNA, 20 bp, Artificial Sequence
  chemically synthesized
aatggtaagggggactggga

SEQ ID NO: 2111 - DNA, 20 bp, Artificial Sequence
  chemically synthesized
actgggacggggtgtcagca

SEQ ID NO: 2112 - DNA, 20 bp, Artificial Sequence
  chemically synthesized
ccagggccaggaacgacggg

SEQ ID NO: 2113 - DNA, 20 bp, Artificial Sequence
  chemically synthesized
cgagactggcaacggggaag

SEQ ID NO: 2114 - DNA, 20 bp, Artificial Sequence
  chemically synthesized
atgccccaggtggcgcagca

SEQ ID NO: 2115 - DNA, 20 bp, Artificial Sequence
  chemically synthesized
gctgataccgtcggcgttgg

SEQ ID NO: 2116 - DNA, 20 bp, Artificial Sequence
  chemically synthesized
gcgggcgggcggcggcgcgg

SEQ ID NO: 2117 - DNA, 20 bp, Artificial Sequence
  chemically synthesized
gtcgagctcggcgccggggc

SEQ ID NO: 2118 - DNA, 20 bp, Artificial Sequence
  chemically synthesized
cgggcggtgcgatgtccgga

SEQ ID NO: 2119 - DNA, 20 bp, Artificial Sequence
  chemically synthesized
cgtccgcttcgagcgcgccg

SEQ ID NO: 2120 - DNA, 20 bp, Artificial Sequence
  chemically synthesized
ccccttcgaccaccccactt

SEQ ID NO: 2121 - DNA, 20 bp, Artificial Sequence
  chemically synthesized
cgacctactctcttccgcat

SEQ ID NO: 2122 - DNA, 20 bp, Artificial Sequence
  chemically synthesized
gcgctgccctcctctcgccc

SEQ ID NO: 2123 - DNA, 20 bp, Artificial Sequence
  chemically synthesized
ctaacgctgccgtctctctc

SEQ ID NO: 2124 - DNA, 20 bp, Artificial Sequence
  chemically synthesized
ttctgtctgcagcttgtggc

SEQ ID NO: 2125 - DNA, 20 bp, Artificial Sequence
  chemically synthesized
tctctgctgtgttgctgccc

SEQ ID NO: 2126 - DNA, 20 bp, Artificial Sequence
  chemically synthesized
caccacgtgatgtcctctga

SEQ ID NO: 2127 - DNA, 20 bp, Artificial Sequence
  chemically synthesized
tgagcggatcctccccgtgt

SEQ ID NO: 2128 - DNA, 20 bp, Artificial Sequence
  chemically synthesized
ccccatgccgtcttcactcg

SEQ ID NO: 2129 - DNA, 20 bp, Artificial Sequence
  chemically synthesized
ctgtgccatctctcgtttct

SEQ ID NO: 2130 - DNA, 20 bp, Artificial Sequence
  chemically synthesized
tcttaggatggccttctccg

SEQ ID NO: 2131 - DNA, 20 bp, Artificial Sequence
  chemically synthesized
cctggacaccccgttctcct

SEQ ID NO: 2132 - DNA, 20 bp, Artificial Sequence
  chemically synthesized
caccccgttctcctgtggat

SEQ ID NO: 2133 - DNA, 20 bp, Artificial Sequence
  chemically synthesized
cccctgtcatggcatcttcc

SEQ ID NO: 2134 - DNA, 20 bp, Artificial Sequence
  chemically synthesized
acagcatgtttgctgcctcc

SEQ ID NO: 2135 - DNA, 20 bp, Artificial Sequence
  chemically synthesized
cggttaatgtggctctggtt

SEQ ID NO: 2136 - DNA, 20 bp, Artificial Sequence
  chemically synthesized
cacagtggggccactaggga

SEQ ID NO: 2137 - DNA, 20 bp, Artificial Sequence
  chemically synthesized
tccttcctagtctcctgata

SEQ ID NO: 2138 - DNA, 20 bp, Artificial Sequence
  chemically synthesized
ttgcttacgatggagccaga

SEQ ID NO: 2139 - DNA, 20 bp, Artificial Sequence
  chemically synthesized
ctgggagggagagcttggca

SEQ ID NO: 2140 - DNA, 20 bp, Artificial Sequence
  chemically synthesized
cagggggtgggagggaaggg

SEQ ID NO: 2141 - DNA, 20 bp, Artificial Sequence
  chemically synthesized
gcagtttggaaaaacaaaat

SEQ ID NO: 2142 - DNA, 20 bp, Artificial Sequence
  chemically synthesized
aaaatcagaataagttggtc

SEQ ID NO: 2143 - DNA, 20 bp, Artificial Sequence
  chemically synthesized
ggcagggctgtggtgaggag

SEQ ID NO: 2144 - DNA, 20 bp, Artificial Sequence
  chemically synthesized
gtgtggaaaactccctttgt

SEQ ID NO: 2145 - DNA, 20 bp, Artificial Sequence
  chemically synthesized
tctccatccttctttcctta

SEQ ID NO: 2146 - DNA, 20 bp, Artificial Sequence
  chemically synthesized
acatattcctccgcccagag

SEQ ID NO: 2147 - DNA, 20 bp, Artificial Sequence
  chemically synthesized
taaggccctgctctgggctt

SEQ ID NO: 2148 - DNA, 20 bp, Artificial Sequence
  chemically synthesized
cctgctctgggcttctgggt

SEQ ID NO: 2149 - DNA, 20 bp, Artificial Sequence
  chemically synthesized
ctctcctgccccttccctac

SEQ ID NO: 2150 - DNA, 20 bp, Artificial Sequence
  chemically synthesized
cctgtctaccaggctgcctt

SEQ ID NO: 2151 - DNA, 20 bp, Artificial Sequence
  chemically synthesized
tctaccaggctgccttttgg

SEQ ID NO: 2152 - DNA, 20 bp, Artificial Sequence
  chemically synthesized
ggtggattctcctccaactg

SEQ ID NO: 2153 - DNA, 20 bp, Artificial Sequence
  chemically synthesized
tgcttggcaaactcactctt

SEQ ID NO: 2154 - DNA, 20 bp, Artificial Sequence
  chemically synthesized
tcccaggaggcctggagcat

SEQ ID NO: 2155 - DNA, 20 bp, Artificial Sequence
  chemically synthesized
cctggagcattggggtgggc

SEQ ID NO: 2156 - DNA, 20 bp, Artificial Sequence
  chemically synthesized
tgggctggggttcagagagg

SEQ ID NO: 2157 - DNA, 20 bp, Artificial Sequence
  chemically synthesized
gtggccaagaagcaggggag

SEQ ID NO: 2158 - DNA, 20 bp, Artificial Sequence
  chemically synthesized
aagaagcaggggagctgggt

SEQ ID NO: 2159 - DNA, 20 bp, Artificial Sequence
  chemically synthesized
gagctgggtttgggtcaggt

SEQ ID NO: 2160 - DNA, 20 bp, Artificial Sequence
  chemically synthesized
gtttgggtcaggtctgggtg

SEQ ID NO: 2161 - DNA, 20 bp, Artificial Sequence
  chemically synthesized
accctcagtcctaggaaaac

SEQ ID NO: 2162 - DNA, 20 bp, Artificial Sequence
  chemically synthesized
gggatggttggtcactgtct

SEQ ID NO: 2163 - DNA, 20 bp, Artificial Sequence
  chemically synthesized
tgtggctgttcccaagttct

SEQ ID NO: 2164 - DNA, 20 bp, Artificial Sequence
  chemically synthesized
aagttcttagggtaccccac

SEQ ID NO: 2165 - DNA, 20 bp, Artificial Sequence
  chemically synthesized
cccaattgccttagtggcta

SEQ ID NO: 2166 - DNA, 20 bp, Artificial Sequence
  chemically synthesized
gtggctagggggttgggggc

SEQ ID NO: 2167 - DNA, 20 bp, Artificial Sequence
  chemically synthesized
agagtaggaggggctggagc

SEQ ID NO: 2168 - DNA, 20 bp, Artificial Sequence
  chemically synthesized
agagctgggggcctgggctc

SEQ ID NO: 2169 - DNA, 20 bp, Artificial Sequence
  chemically synthesized
aggggctggggcctggactc

SEQ ID NO: 2170 - DNA, 20 bp, Artificial Sequence
  chemically synthesized
aggggctggggcctggactc

SEQ ID NO: 2171 - DNA, 20 bp, Artificial Sequence
  chemically synthesized
gggcctggactcctgggtct

SEQ ID NO: 2172 - DNA, 20 bp, Artificial Sequence
  chemically synthesized
gggactgggggcctggactc

SEQ ID NO: 2173 - DNA, 20 bp, Artificial Sequence
  chemically synthesized
aggggctggggcctggactc

SEQ ID NO: 2174 - DNA, 20 bp, Artificial Sequence
  chemically synthesized
ggggctgggggcctggactt

SEQ ID NO: 2175 - DNA, 20 bp, Artificial Sequence
  chemically synthesized
gcggggctgggcctggaccc

SEQ ID NO: 2176 - DNA, 20 bp, Artificial Sequence
  chemically synthesized
ctgggcctggacccctgggt

SEQ ID NO: 2177 - DNA, 20 bp, Artificial Sequence
  chemically synthesized
aagggctggggcctggcctc

SEQ ID NO: 2178 - DNA, 20 bp, Artificial Sequence
  chemically synthesized
ctggggcctggcctcctggg

SEQ ID NO: 2179 - DNA, 20 bp, Artificial Sequence
  chemically synthesized
gcctcctgggttgaatgggg

SEQ ID NO: 2180 - DNA, 20 bp, Artificial Sequence
  chemically synthesized
gaggggttgggcctggactc

SEQ ID NO: 2181 - DNA, 20 bp, Artificial Sequence
  chemically synthesized
aggcctcaggcatctttcac

SEQ ID NO: 2182 - DNA, 20 bp, Artificial Sequence
  chemically synthesized
ctcccctatcgccatgacaa

SEQ ID NO: 2183 - DNA, 20 bp, Artificial Sequence
  chemically synthesized
actgggtggaaataaacgag

SEQ ID NO: 2184 - DNA, 20 bp, Artificial Sequence
  chemically synthesized
acgtgcggccccttcacagc

SEQ ID NO: 2185 - DNA, 20 bp, Artificial Sequence
  chemically synthesized
ttggagaggtgagggacttg

SEQ ID NO: 2186 - DNA, 20 bp, Artificial Sequence
  chemically synthesized
cttggggggtaatttatccc

SEQ ID NO: 2187 - DNA, 20 bp, Artificial Sequence
  chemically synthesized
gtaatttatcccgtggatct

SEQ ID NO: 2188 - DNA, 20 bp, Artificial Sequence
  chemically synthesized
aagttttggacccctaaggg

SEQ ID NO: 2189 - DNA, 20 bp, Artificial Sequence
  chemically synthesized
cagagggggcctcagtgaac

SEQ ID NO: 2190 - DNA, 20 bp, Artificial Sequence
  chemically synthesized
tgcagctgtctcacccctct

SEQ ID NO: 2191 - DNA, 20 bp, Artificial Sequence
  chemically synthesized
tgggagtcccgcccaggccc

SEQ ID NO: 2192 - DNA, 20 bp, Artificial Sequence
  chemically synthesized
cccctgagtctgtcccagca

SEQ ID NO: 2193 - DNA, 20 bp, Artificial Sequence
  chemically synthesized
ggcccacggcttcgttcctg

SEQ ID NO: 2194 - DNA, 20 bp, Artificial Sequence
  chemically synthesized
cgttcctgcagagtatctgc

SEQ ID NO: 2195 - DNA, 20 bp, Artificial Sequence
  chemically synthesized
tgacccttggaaggacctgg

SEQ ID NO: 2196 - DNA, 20 bp, Artificial Sequence
  chemically synthesized
gagcactggaagcgccacct

SEQ ID NO: 2197 - DNA, 20 bp, Artificial Sequence
  chemically synthesized
cgccacctgtgggtggtgac

SEQ ID NO: 2198 - DNA, 20 bp, Artificial Sequence
  chemically synthesized
cgtgtctaacaggtaccatg

SEQ ID NO: 2199 - DNA, 20 bp, Artificial Sequence
  chemically synthesized
cttcctgtttgcagatagcc

SEQ ID NO: 2200 - DNA, 20 bp, Artificial Sequence
  chemically synthesized
cagccagtggccagaggctg

SEQ ID NO: 2201 - DNA, 20 bp, Artificial Sequence
  chemically synthesized
actgtcctagcaccgtgtcc

SEQ ID NO: 2202 - DNA, 20 bp, Artificial Sequence
  chemically synthesized
tctgttttcgtggctccctc

SEQ ID NO: 2203 - DNA, 20 bp, Artificial Sequence
  chemically synthesized
acttgctgggacaccgtggc

SEQ ID NO: 2204 - DNA, 20 bp, Artificial Sequence
  chemically synthesized
agctcttctctgttcagccc

SEQ ID NO: 2205 - DNA, 20 bp, Artificial Sequence
  chemically synthesized
gcctggagaaggatgcagga

SEQ ID NO: 2206 - DNA, 20 bp, Artificial Sequence
  chemically synthesized
cgagaaacacagccccaggt

SEQ ID NO: 2207 - DNA, 20 bp, Artificial Sequence
  chemically synthesized
gcagtcaccccacagttgga

SEQ ID NO: 2208 - DNA, 20 bp, Artificial Sequence
  chemically synthesized
ctctttaaggaaagaaggat

SEQ ID NO: 2209 - DNA, 20 bp, Artificial Sequence
  chemically synthesized
aaggaaagaaggatggagaa

SEQ ID NO: 2210 - DNA, 20 bp, Artificial Sequence
  chemically synthesized
ggaacaatataaattgggga

SEQ ID NO: 2211 - DNA, 20 bp, Artificial Sequence
  chemically synthesized
ggagaacggggtgtccaggc

SEQ ID NO: 2212 - DNA, 20 bp, Artificial Sequence
  chemically synthesized
acggggtactttggggttgt

SEQ ID NO: 2213 - DNA, 20 bp, Artificial Sequence
  chemically synthesized
tccgtcggagaaggccatcc

SEQ ID NO: 2214 - DNA, 20 bp, Artificial Sequence
  chemically synthesized
acccaggccacaagctgcag

SEQ ID NO: 2215 - DNA, 20 bp, Artificial Sequence
  chemically synthesized
aagcggcacaggcccagggg

SEQ ID NO: 2216 - DNA, 20 bp, Artificial Sequence
  chemically synthesized
caggggagagaatgcaggtc

SEQ ID NO: 2217 - DNA, 20 bp, Artificial Sequence
  chemically synthesized
cactagggacaggattggtg

SEQ ID NO: 2218 - DNA, 20 bp, Artificial Sequence
  chemically synthesized
agcagtttggaaaaacaaaa

SEQ ID NO: 2219 - DNA, 20 bp, Artificial Sequence
  chemically synthesized
cgtgtggaaaactccctttg

SEQ ID NO: 2220 - DNA, 20 bp, Artificial Sequence
  chemically synthesized
caagttttggacccctaagg

SEQ ID NO: 2221 - DNA, 20 bp, Artificial Sequence
  chemically synthesized
ttggacccctaagggaagaa

SEQ ID NO: 2222 - DNA, 20 bp, Artificial Sequence
  chemically synthesized
gggactccagagggagccac

SEQ ID NO: 2223 - DNA, 20 bp, Artificial Sequence
  chemically synthesized
atggtacctgttagacacgg

SEQ ID NO: 2224 - DNA, 20 bp, Artificial Sequence
  chemically synthesized
tcattcttcccttaggggtc

SEQ ID NO: 2225 - DNA, 20 bp, Artificial Sequence
  chemically synthesized
aggactgagggtttcagtgc

SEQ ID NO: 2226 - DNA, 20 bp, Artificial Sequence
  chemically synthesized
tactggccttatctcacagg

SEQ ID NO: 2227 - DNA, 20 bp, Artificial Sequence
  chemically synthesized
ggtactttggggttgtccag

SEQ ID NO: 2228 - DNA, 20 bp, Artificial Sequence
  chemically synthesized
caagaggagaagcagtttgg

SEQ ID NO: 2229 - DNA, 20 bp, Artificial Sequence
  chemically synthesized
aggaggggggtgtccgtgtg

SEQ ID NO: 2230 - DNA, 20 bp, Artificial Sequence
  chemically synthesized
actgaaaccctcagtcctag

SEQ ID NO: 2231 - DNA, 20 bp, Artificial Sequence
  chemically synthesized
cccaacagcctctggccact

SEQ ID NO: 2232 - DNA, 20 bp, Artificial Sequence
  chemically synthesized
ggaagtgaacggggaaggga

SEQ ID NO: 2233 - DNA, 20 bp, Artificial Sequence
  chemically synthesized
cccccgtcaccacccacagg

SEQ ID NO: 2234 - DNA, 20 bp, Artificial Sequence
  chemically synthesized
agccaggggctgacacgggc

SEQ ID NO: 2235 - DNA, 20 bp, Artificial Sequence
  chemically synthesized
ctgggaacgggatgaactcg

SEQ ID NO: 2236 - DNA, 20 bp, Artificial Sequence
  chemically synthesized
gaacagccacagcagggggg

SEQ ID NO: 2237 - DNA, 20 bp, Artificial Sequence
  chemically synthesized
cagagacagtgaccaaccat

SEQ ID NO: 2238 - DNA, 20 bp, Artificial Sequence
  chemically synthesized
atccctgttttcctaggact

SEQ ID NO: 2239 - DNA, 20 bp, Artificial Sequence
  chemically synthesized
acctgacccaaacccagctc

SEQ ID NO: 2240 - DNA, 20 bp, Artificial Sequence
  chemically synthesized
ctcctgggataccccgaaga

SEQ ID NO: 2241 - DNA, 20 bp, Artificial Sequence
  chemically synthesized
gggaagcctgagcgcctctc

SEQ ID NO: 2242 - DNA, 20 bp, Artificial Sequence
  chemically synthesized
ggacgcaccattctcacaaa

SEQ ID NO: 2243 - DNA, 20 bp, Artificial Sequence
  chemically synthesized
tagaactcaggaccaactta

SEQ ID NO: 2244 - DNA, 20 bp, Artificial Sequence
  chemically synthesized
tcaggaccaacttattctga

SEQ ID NO: 2245 - DNA, 20 bp, Artificial Sequence
  chemically synthesized
attctgattttgtttttcca

SEQ ID NO: 2246 - DNA, 20 bp, Artificial Sequence
  chemically synthesized
ggaaggaggaggcctaagga

SEQ ID NO: 2247 - DNA, 20 bp, Artificial Sequence
  chemically synthesized
gagagcgccgcgcccgcacc

SEQ ID NO: 2248 - DNA, 20 bp, Artificial Sequence
  chemically synthesized
ccgccccgtcgttcctggcc

SEQ ID NO: 2249 - DNA, 20 bp, Artificial Sequence
  chemically synthesized
ccaccccacttccgaattgg

SEQ ID NO: 2250 - DNA, 20 bp, Artificial Sequence
  chemically synthesized
tggagccgcttcaactggcc

SEQ ID NO: 2251 - DNA, 20 bp, Artificial Sequence
  chemically synthesized
cctactctcttccgcattgg

SEQ ID NO: 2252 - DNA, 20 bp, Artificial Sequence
  chemically synthesized
ttggagtcgctttaactggc

SEQ ID NO: 2253 - DNA, 20 bp, Artificial Sequence
  chemically synthesized
tccggaccactttgagctct

SEQ ID NO: 2254 - DNA, 20 bp, Artificial Sequence
  chemically synthesized
cttctgcgccgcctctggcc

SEQ ID NO: 2255 - DNA, 20 bp, Artificial Sequence
  chemically synthesized
gtttccccttcccaggcagg

SEQ ID NO: 2256 - DNA, 20 bp, Artificial Sequence
  chemically synthesized
cattctctcccctgggcctg

SEQ ID NO: 2257 - DNA, 20 bp, Artificial Sequence
  chemically synthesized
ggcctgtgccgctttctgtc

SEQ ID NO: 2258 - DNA, 20 bp, Artificial Sequence
  chemically synthesized
cttctggggcctgtgccatc

SEQ ID NO: 2259 - DNA, 20 bp, Artificial Sequence
  chemically synthesized
ttcttgtaggcctgcatcat

SEQ ID NO: 2260 - DNA, 20 bp, Artificial Sequence
  chemically synthesized
accccaaagtaccccgtctc

SEQ ID NO: 2261 - DNA, 20 bp, Artificial Sequence
  chemically synthesized
ctttagccacctctccatcc

SEQ ID NO: 2262 - DNA, 20 bp, Artificial Sequence
  chemically synthesized
gcctggacaccccgttctcc

SEQ ID NO: 2263 - DNA, 20 bp, Artificial Sequence
  chemically synthesized
cctatgtccacttcaggaca

SEQ ID NO: 2264 - DNA, 20 bp, Artificial Sequence
  chemically synthesized
ccacagtggggccactaggg

SEQ ID NO: 2265 - DNA, 20 bp, Artificial Sequence
  chemically synthesized
ctaacccccacctcctgtta

SEQ ID NO: 2266 - DNA, 20 bp, Artificial Sequence
  chemically synthesized
tctctccttgccagaacctc

SEQ ID NO: 2267 - DNA, 20 bp, Artificial Sequence
  chemically synthesized
tccttgccagaacctctaag

SEQ ID NO: 2268 - DNA, 20 bp, Artificial Sequence
  chemically synthesized
ccagagaggatcctgggagg

SEQ ID NO: 2269 - DNA, 20 bp, Artificial Sequence
  chemically synthesized
tgctctgacgcggccgtctg

SEQ ID NO: 2270 - DNA, 20 bp, Artificial Sequence
  chemically synthesized
cgtttcactgatcctggtgc

SEQ ID NO: 2271 - DNA, 20 bp, Artificial Sequence
  chemically synthesized
ttacacttcccaagaggaga

SEQ ID NO: 2272 - DNA, 20 bp, Artificial Sequence
  chemically synthesized
tttatattgttcctccgtgc

SEQ ID NO: 2273 - DNA, 20 bp, Artificial Sequence
  chemically synthesized
ttcctccgcccagagcaggg

SEQ ID NO: 2274 - DNA, 20 bp, Artificial Sequence
  chemically synthesized
cgcttccctaaggccctgct

SEQ ID NO: 2275 - DNA, 20 bp, Artificial Sequence
  chemically synthesized
taaggccctgctctgggctt

SEQ ID NO: 2276 - DNA, 20 bp, Artificial Sequence
  chemically synthesized
ggcaagcccaggagaggcgc

SEQ ID NO: 2277 - DNA, 20 bp, Artificial Sequence
  chemically synthesized
gtctaccaggctgccttttg

SEQ ID NO: 2278 - DNA, 20 bp, Artificial Sequence
  chemically synthesized
ttctcctccaactgtggggt

SEQ ID NO: 2279 - DNA, 20 bp, Artificial Sequence
  chemically synthesized
gtgggctggggttcagagag

SEQ ID NO: 2280 - DNA, 20 bp, Artificial Sequence
  chemically synthesized
gtggccaagaagcaggggag

SEQ ID NO: 2281 - DNA, 20 bp, Artificial Sequence
  chemically synthesized
tcaggtctgggtgtggggtg

SEQ ID NO: 2282 - DNA, 20 bp, Artificial Sequence
  chemically synthesized
ggtgtggggtgaccagctta

SEQ ID NO: 2283 - DNA, 20 bp, Artificial Sequence
  chemically synthesized
atgctgtttgcccaggacag

SEQ ID NO: 2284 - DNA, 20 bp, Artificial Sequence
  chemically synthesized
ggtcactgtctctgggtgac

SEQ ID NO: 2285 - DNA, 20 bp, Artificial Sequence
  chemically synthesized
tgggtgactcttgattcccg

SEQ ID NO: 2286 - DNA, 20 bp, Artificial Sequence
  chemically synthesized
gccagtttctccacctgggg

SEQ ID NO: 2287 - DNA, 20 bp, Artificial Sequence
  chemically synthesized
aagttcttagggtaccccac

SEQ ID NO: 2288 - DNA, 20 bp, Artificial Sequence
  chemically synthesized
tagagtaggaggggctggag

SEQ ID NO: 2289 - DNA, 20 bp, Artificial Sequence
  chemically synthesized
agagctgggggcctgggctc

SEQ ID NO: 2290 - DNA, 20 bp, Artificial Sequence
  chemically synthesized
acgtgcggccccttcacagc

SEQ ID NO: 2291 - DNA, 20 bp, Artificial Sequence
  chemically synthesized
cctcccgcctcctccagatg

SEQ ID NO: 2292 - DNA, 20 bp, Artificial Sequence
  chemically synthesized
gtaatttatcccgtggatct

SEQ ID NO: 2293 - DNA, 20 bp, Artificial Sequence
  chemically synthesized
ttatcccgtggatctaggag

SEQ ID NO: 2294 - DNA, 20 bp, Artificial Sequence
  chemically synthesized
cctcctccgaccccctggac

SEQ ID NO: 2295 - DNA, 20 bp, Artificial Sequence
  chemically synthesized
ggacttcggcttttgtcccc

SEQ ID NO: 2296 - DNA, 20 bp, Artificial Sequence
  chemically synthesized
accctgcatagccctgggcc

SEQ ID NO: 2297 - DNA, 20 bp, Artificial Sequence
  chemically synthesized
tcctgcagagtatctgctgg

SEQ ID NO: 2298 - DNA, 20 bp, Artificial Sequence
  chemically synthesized
agtatctgctggggtggttt

SEQ ID NO: 2299 - DNA, 20 bp, Artificial Sequence
  chemically synthesized
tgacccttggaaggacctgg

SEQ ID NO: 2300 - DNA, 20 bp, Artificial Sequence
  chemically synthesized
cgccacctgtgggtggtgac

SEQ ID NO: 2301 - DNA, 20 bp, Artificial Sequence
  chemically synthesized
ccctcccttccccgttcact

SEQ ID NO: 2302 - DNA, 20 bp, Artificial Sequence
  chemically synthesized
cagatagccaggagtccttt

SEQ ID NO: 2303 - DNA, 20 bp, Artificial Sequence
  chemically synthesized
tcctagcaccgtgtccctgg

SEQ ID NO: 2304 - DNA, 20 bp, Artificial Sequence
  chemically synthesized
ctggggtaggtgcggctgac

SEQ ID NO: 2305 - DNA, 20 bp, Artificial Sequence
  chemically synthesized
ttgatgagaacctggaggtg

SEQ ID NO: 2306 - DNA, 22 bp, Artificial Sequence
  chemically synthesized
gcgatatctaggtagccacagg

SEQ ID NO: 2307 - DNA, 22 bp, Artificial Sequence
  chemically synthesized
ggtagccacaggaggcggccac

SEQ ID NO: 2308 - DNA, 22 bp, Artificial Sequence
  chemically synthesized
gttgtctgcctggttcacagtg

SEQ ID NO: 2309 - DNA, 22 bp, Artificial Sequence
  chemically synthesized
tctgcctggttcacagtggcgc

SEQ ID NO: 2310 - DNA, 22 bp, Artificial Sequence
  chemically synthesized
cctggttcacagtggcgccctg

SEQ ID NO: 2311 - DNA, 22 bp, Artificial Sequence
  chemically synthesized
gttcacagtggcgccctgctcc

SEQ ID NO: 2312 - DNA, 22 bp, Artificial Sequence
  chemically synthesized
acagtggcgccctgctccacca

SEQ ID NO: 2313 - DNA, 22 bp, Artificial Sequence
  chemically synthesized
ctccaccaagaagcgcaccacc

SEQ ID NO: 2314 - DNA, 22 bp, Artificial Sequence
  chemically synthesized
caccaagaagcgcaccacctcc

SEQ ID NO: 2315 - DNA, 22 bp, Artificial Sequence
  chemically synthesized
caggttctcatcaatgcaggcc

SEQ ID NO: 2316 - DNA, 22 bp, Artificial Sequence
  chemically synthesized
tcatcaatgcaggcctgggggt

SEQ ID NO: 2317 - DNA, 22 bp, Artificial Sequence
  chemically synthesized
atcaatgcaggcctgggggtgg

SEQ ID NO: 2318 - DNA, 22 bp, Artificial Sequence
  chemically synthesized
ggggtgggaaacagccgtcagc

SEQ ID NO: 2319 - DNA, 22 bp, Artificial Sequence
  chemically synthesized
ccccagccacggtgtcccagca

SEQ ID NO: 2320 - DNA, 22 bp, Artificial Sequence
  chemically synthesized
cagagggagccacgaaaacaga

SEQ ID NO: 2321 - DNA, 22 bp, Artificial Sequence
  chemically synthesized
ggacagtggggaaaatgaccca

SEQ ID NO: 2322 - DNA, 22 bp, Artificial Sequence
  chemically synthesized
tggccactggctgtttaagata

SEQ ID NO: 2323 - DNA, 22 bp, Artificial Sequence
  chemically synthesized
gccactggctgtttaagatacg

SEQ ID NO: 2324 - DNA, 22 bp, Artificial Sequence
  chemically synthesized
gctgtttaagatacgcctggtt

SEQ ID NO: 2325 - DNA, 22 bp, Artificial Sequence
  chemically synthesized
tttaagatacgcctggttgccc

SEQ ID NO: 2326 - DNA, 22 bp, Artificial Sequence
  chemically synthesized
aagatacgcctggttgcccagt

SEQ ID NO: 2327 - DNA, 22 bp, Artificial Sequence
  chemically synthesized
agatacgcctggttgcccagtg

SEQ ID NO: 2328 - DNA, 22 bp, Artificial Sequence
  chemically synthesized
gttgcccagtggtcaggccggc

SEQ ID NO: 2329 - DNA, 22 bp, Artificial Sequence
  chemically synthesized
cccagtggtcaggccggccagg

SEQ ID NO: 2330 - DNA, 22 bp, Artificial Sequence
  chemically synthesized
cagtgctcagtggaaaccacga

SEQ ID NO: 2331 - DNA, 22 bp, Artificial Sequence
  chemically synthesized
agtgctcagtggaaaccacgaa

SEQ ID NO: 2332 - DNA, 22 bp, Artificial Sequence
  chemically synthesized
agtggaaaccacgaaaggactc

SEQ ID NO: 2333 - DNA, 22 bp, Artificial Sequence
  chemically synthesized
ctggctatctgcaaacaggaag

SEQ ID NO: 2334 - DNA, 22 bp, Artificial Sequence
  chemically synthesized
gctatctgcaaacaggaagtga

SEQ ID NO: 2335 - DNA, 22 bp, Artificial Sequence
  chemically synthesized
tctgcaaacaggaagtgaacgg

SEQ ID NO: 2336 - DNA, 22 bp, Artificial Sequence
  chemically synthesized
caaacaggaagtgaacggggaa

SEQ ID NO: 2337 - DNA, 22 bp, Artificial Sequence
  chemically synthesized
ctcatctgggtgcgggaacccc

SEQ ID NO: 2338 - DNA, 22 bp, Artificial Sequence
  chemically synthesized
tcatctgggtgcgggaacccca

SEQ ID NO: 2339 - DNA, 22 bp, Artificial Sequence
  chemically synthesized
atctgggtgcgggaaccccaca

SEQ ID NO: 2340 - DNA, 22 bp, Artificial Sequence
  chemically synthesized
ggtgcgggaaccccacatggta

SEQ ID NO: 2341 - DNA, 22 bp, Artificial Sequence
  chemically synthesized
ttagacacggcaaaacccccgt

SEQ ID NO: 2342 - DNA, 22 bp, Artificial Sequence
  chemically synthesized
gacacggcaaaacccccgtcac

SEQ ID NO: 2343 - DNA, 22 bp, Artificial Sequence
  chemically synthesized
ccagtgctcagactagggaaga

SEQ ID NO: 2344 - DNA, 22 bp, Artificial Sequence
  chemically synthesized
cagtgctcagactagggaagag

SEQ ID NO: 2345 - DNA, 22 bp, Artificial Sequence
  chemically synthesized
agactagggaagaggttccagc

SEQ ID NO: 2346 - DNA, 22 bp, Artificial Sequence
  chemically synthesized
gggaagaggttccagcccctcc

SEQ ID NO: 2347 - DNA, 22 bp, Artificial Sequence
  chemically synthesized
cagcccctcctccttcagagcc

SEQ ID NO: 2348 - DNA, 22 bp, Artificial Sequence
  chemically synthesized
ctccttcagagccaggagtcct

SEQ ID NO: 2349 - DNA, 22 bp, Artificial Sequence
  chemically synthesized
cttcagagccaggagtcctggc

SEQ ID NO: 2350 - DNA, 22 bp, Artificial Sequence
  chemically synthesized
cagagccaggagtcctggcccc

SEQ ID NO: 2351 - DNA, 22 bp, Artificial Sequence
  chemically synthesized
agagccaggagtcctggccccc

SEQ ID NO: 2352 - DNA, 22 bp, Artificial Sequence
  chemically synthesized
gcccccagcccctcctgcctta

SEQ ID NO: 2353 - DNA, 22 bp, Artificial Sequence
  chemically synthesized
ctgccttaaacccagccaggtc

SEQ ID NO: 2354 - DNA, 22 bp, Artificial Sequence
  chemically synthesized
ccttaaacccagccaggtcctt

SEQ ID NO: 2355 - DNA, 22 bp, Artificial Sequence
  chemically synthesized
aaacccagccaggtccttccaa

SEQ ID NO: 2356 - DNA, 22 bp, Artificial Sequence
  chemically synthesized
aacccagccaggtccttccaag

SEQ ID NO: 2357 - DNA, 22 bp, Artificial Sequence
  chemically synthesized
ccaagggtcaagctcggaaacc

SEQ ID NO: 2358 - DNA, 22 bp, Artificial Sequence
  chemically synthesized
caagggtcaagctcggaaacca

SEQ ID NO: 2359 - DNA, 22 bp, Artificial Sequence
  chemically synthesized
ggaaaccaccccagcagatact

SEQ ID NO: 2360 - DNA, 22 bp, Artificial Sequence
  chemically synthesized
tgcaggaacgaagccgtgggcc

SEQ ID NO: 2361 - DNA, 22 bp, Artificial Sequence
  chemically synthesized
caggaacgaagccgtgggccca

SEQ ID NO: 2362 - DNA, 22 bp, Artificial Sequence
  chemically synthesized
tgcagggtggaggaaggccacc

SEQ ID NO: 2363 - DNA, 22 bp, Artificial Sequence
  chemically synthesized
tgctgggacagactcaggggcc

SEQ ID NO: 2364 - DNA, 22 bp, Artificial Sequence
  chemically synthesized
ggacagactcaggggcctgggc

SEQ ID NO: 2365 - DNA, 22 bp, Artificial Sequence
  chemically synthesized
aggggcctgggcgggactccca

SEQ ID NO: 2366 - DNA, 22 bp, Artificial Sequence
  chemically synthesized
ggcgggactcccagaggggtga

SEQ ID NO: 2367 - DNA, 22 bp, Artificial Sequence
  chemically synthesized
ccagaggggtgagacagctgca

SEQ ID NO: 2368 - DNA, 22 bp, Artificial Sequence
  chemically synthesized
cacacctgtgtgcctgggcccc

SEQ ID NO: 2369 - DNA, 22 bp, Artificial Sequence
  chemically synthesized
tgtgcctgggccccaggctgtc

SEQ ID NO: 2370 - DNA, 22 bp, Artificial Sequence
  chemically synthesized
ggccccaggctgtcacactcca

SEQ ID NO: 2371 - DNA, 22 bp, Artificial Sequence
  chemically synthesized
tcacactccagttcactgaggc

SEQ ID NO: 2372 - DNA, 22 bp, Artificial Sequence
  chemically synthesized
cagttcactgaggccccctctg

SEQ ID NO: 2373 - DNA, 22 bp, Artificial Sequence
  chemically synthesized
actgaggccccctctgcacggg

SEQ ID NO: 2374 - DNA, 22 bp, Artificial Sequence
  chemically synthesized
aggccccctctgcacggggccc

SEQ ID NO: 2375 - DNA, 22 bp, Artificial Sequence
  chemically synthesized
tgcacggggccctgcagccagg

SEQ ID NO: 2376 - DNA, 22 bp, Artificial Sequence
  chemically synthesized
cacggggccctgcagccagggg

SEQ ID NO: 2377 - DNA, 22 bp, Artificial Sequence
  chemically synthesized
cagccaggggctgacacgggcc

SEQ ID NO: 2378 - DNA, 22 bp, Artificial Sequence
  chemically synthesized
acacgggccaccgtttctcatt

SEQ ID NO: 2379 - DNA, 22 bp, Artificial Sequence
  chemically synthesized
ctcattcttcccttaggggtcc

SEQ ID NO: 2380 - DNA, 22 bp, Artificial Sequence
  chemically synthesized
tcattcttcccttaggggtcca

SEQ ID NO: 2381 - DNA, 22 bp, Artificial Sequence
  chemically synthesized
attcttcccttaggggtccaaa

SEQ ID NO: 2382 - DNA, 22 bp, Artificial Sequence
  chemically synthesized
ttcccttaggggtccaaaactt

SEQ ID NO: 2383 - DNA, 22 bp, Artificial Sequence
  chemically synthesized
cccttaggggtccaaaacttgg

SEQ ID NO: 2384 - DNA, 22 bp, Artificial Sequence
  chemically synthesized
ccttaggggtccaaaacttggg

SEQ ID NO: 2385 - DNA, 22 bp, Artificial Sequence
  chemically synthesized
aggggtccaaaacttgggggga

SEQ ID NO: 2386 - DNA, 22 bp, Artificial Sequence
  chemically synthesized
ggggtccaaaacttggggggac

SEQ ID NO: 2387 - DNA, 22 bp, Artificial Sequence
  chemically synthesized
ggggggacaaaagccgaagtcc

SEQ ID NO: 2388 - DNA, 22 bp, Artificial Sequence
  chemically synthesized
gggggacaaaagccgaagtcca

SEQ ID NO: 2389 - DNA, 22 bp, Artificial Sequence
  chemically synthesized
gccccaggccttgtggacactg

SEQ ID NO: 2390 - DNA, 22 bp, Artificial Sequence
  chemically synthesized
ccccaggccttgtggacactgg

SEQ ID NO: 2391 - DNA, 22 bp, Artificial Sequence
  chemically synthesized
gtggacactgggtgggctccgg

SEQ ID NO: 2392 - DNA, 22 bp, Artificial Sequence
  chemically synthesized
tggacactgggtgggctccggg

SEQ ID NO: 2393 - DNA, 22 bp, Artificial Sequence
  chemically synthesized
ggtgggctccgggacctgaact

SEQ ID NO: 2394 - DNA, 22 bp, Artificial Sequence
  chemically synthesized
cgggacctgaactggagctgag

SEQ ID NO: 2395 - DNA, 22 bp, Artificial Sequence
  chemically synthesized
aactggagctgaggaaggagtg

SEQ ID NO: 2396 - DNA, 22 bp, Artificial Sequence
  chemically synthesized
gagctgaggaaggagtgaagct

SEQ ID NO: 2397 - DNA, 22 bp, Artificial Sequence
  chemically synthesized
aggaaggagtgaagctaaactc

SEQ ID NO: 2398 - DNA, 22 bp, Artificial Sequence
  chemically synthesized
aactcctagatccacgggataa

SEQ ID NO: 2399 - DNA, 22 bp, Artificial Sequence
  chemically synthesized
ctagatccacgggataaattac

SEQ ID NO: 2400 - DNA, 22 bp, Artificial Sequence
  chemically synthesized
gatccacgggataaattacccc

SEQ ID NO: 2401 - DNA, 22 bp, Artificial Sequence
  chemically synthesized
ccccccaagtccctcacctctc

SEQ ID NO: 2402 - DNA, 22 bp, Artificial Sequence
  chemically synthesized
acctctccaaagctgcccatct

SEQ ID NO: 2403 - DNA, 22 bp, Artificial Sequence
  chemically synthesized
tccaaagctgcccatctggagg

SEQ ID NO: 2404 - DNA, 22 bp, Artificial Sequence
  chemically synthesized
caaagctgcccatctggaggag

SEQ ID NO: 2405 - DNA, 22 bp, Artificial Sequence
  chemically synthesized
cccatctggaggaggcgggagg

SEQ ID NO: 2406 - DNA, 22 bp, Artificial Sequence
  chemically synthesized
gaggaggcgggagggagctacg

SEQ ID NO: 2407 - DNA, 22 bp, Artificial Sequence
  chemically synthesized
cgagggccaagagcatgaggtc

SEQ ID NO: 2408 - DNA, 22 bp, Artificial Sequence
  chemically synthesized
gggctgtgaaggggccgcacgt

SEQ ID NO: 2409 - DNA, 22 bp, Artificial Sequence
  chemically synthesized
tgaaggggccgcacgtgccctg

SEQ ID NO: 2410 - DNA, 22 bp, Artificial Sequence
  chemically synthesized
ggaacgggatgaactcggctcg

SEQ ID NO: 2411 - DNA, 22 bp, Artificial Sequence
  chemically synthesized
ggctcgtttatttccacccagt

SEQ ID NO: 2412 - DNA, 22 bp, Artificial Sequence
  chemically synthesized
gtttatttccacccagttgtca

SEQ ID NO: 2413 - DNA, 22 bp, Artificial Sequence
  chemically synthesized
atttccacccagttgtcatggc

SEQ ID NO: 2414 - DNA, 22 bp, Artificial Sequence
  chemically synthesized
tttccacccagttgtcatggcg

SEQ ID NO: 2415 - DNA, 22 bp, Artificial Sequence
  chemically synthesized
ccacccagttgtcatggcgata

SEQ ID NO: 2416 - DNA, 22 bp, Artificial Sequence
  chemically synthesized
cacccagttgtcatggcgatag

SEQ ID NO: 2417 - DNA, 22 bp, Artificial Sequence
  chemically synthesized
tcatggcgataggggagggggg

SEQ ID NO: 2418 - DNA, 22 bp, Artificial Sequence
  chemically synthesized
tccctttcaaggacctgcccag

SEQ ID NO: 2419 - DNA, 22 bp, Artificial Sequence
  chemically synthesized
ccctttcaaggacctgcccagt

SEQ ID NO: 2420 - DNA, 22 bp, Artificial Sequence
  chemically synthesized
cctttcaaggacctgcccagta

SEQ ID NO: 2421 - DNA, 22 bp, Artificial Sequence
  chemically synthesized
tcaaggacctgcccagtacagg

SEQ ID NO: 2422 - DNA, 22 bp, Artificial Sequence
  chemically synthesized
caaggacctgcccagtacaggc

SEQ ID NO: 2423 - DNA, 22 bp, Artificial Sequence
  chemically synthesized
aaggacctgcccagtacaggca

SEQ ID NO: 2424 - DNA, 22 bp, Artificial Sequence
  chemically synthesized
cccagtacaggcatccctgtga

SEQ ID NO: 2425 - DNA, 22 bp, Artificial Sequence
  chemically synthesized
tgaaagatgcctgaggcctggg

SEQ ID NO: 2426 - DNA, 22 bp, Artificial Sequence
  chemically synthesized
aggcctgggcaccagggactcc

SEQ ID NO: 2427 - DNA, 22 bp, Artificial Sequence
  chemically synthesized
ggcaccagggactccagagtcc

SEQ ID NO: 2428 - DNA, 22 bp, Artificial Sequence
  chemically synthesized
cagagtccaggcccaacccctc

SEQ ID NO: 2429 - DNA, 22 bp, Artificial Sequence
  chemically synthesized
cccattcaacccaggaggccag

SEQ ID NO: 2430 - DNA, 22 bp, Artificial Sequence
  chemically synthesized
aacccaggaggccaggccccag

SEQ ID NO: 2431 - DNA, 22 bp, Artificial Sequence
  chemically synthesized
ccgccctcagatgaaggagtcc

SEQ ID NO: 2432 - DNA, 22 bp, Artificial Sequence
  chemically synthesized
cgccctcagatgaaggagtcca

SEQ ID NO: 2433 - DNA, 22 bp, Artificial Sequence
  chemically synthesized
agatgaaggagtccaggccccc

SEQ ID NO: 2434 - DNA, 22 bp, Artificial Sequence
  chemically synthesized
tccccattcagacccaggggtc

SEQ ID NO: 2435 - DNA, 22 bp, Artificial Sequence
  chemically synthesized
cccattcagacccaggggtcca

SEQ ID NO: 2436 - DNA, 22 bp, Artificial Sequence
  chemically synthesized
agacccaggggtccaggcccag

SEQ ID NO: 2437 - DNA, 22 bp, Artificial Sequence
  chemically synthesized
cctaagacccagaagtccaggc

SEQ ID NO: 2438 - DNA, 22 bp, Artificial Sequence
  chemically synthesized
agacccagaagtccaggccccc

SEQ ID NO: 2439 - DNA, 22 bp, Artificial Sequence
  chemically synthesized
ctccctcagacccacgagtcca

SEQ ID NO: 2440 - DNA, 22 bp, Artificial Sequence
  chemically synthesized
cctcagacccacgagtccaggc

SEQ ID NO: 2441 - DNA, 22 bp, Artificial Sequence
  chemically synthesized
agacccacgagtccaggcccca

SEQ ID NO: 2442 - DNA, 22 bp, Artificial Sequence
  chemically synthesized
ctccctcggacccaggagtcca

SEQ ID NO: 2443 - DNA, 22 bp, Artificial Sequence
  chemically synthesized
cctcggacccaggagtccaggc

SEQ ID NO: 2444 - DNA, 22 bp, Artificial Sequence
  chemically synthesized
ggacccaggagtccaggccccc

SEQ ID NO: 2445 - DNA, 22 bp, Artificial Sequence
  chemically synthesized
caccctcagacccaggagtcca

SEQ ID NO: 2446 - DNA, 22 bp, Artificial Sequence
  chemically synthesized
agacccaggagtccaggcccca

SEQ ID NO: 2447 - DNA, 22 bp, Artificial Sequence
  chemically synthesized
ctccctcggacccaggagtcca

SEQ ID NO: 2448 - DNA, 22 bp, Artificial Sequence
  chemically synthesized
cctcggacccaggagtccaggc

SEQ ID NO: 2449 - DNA, 22 bp, Artificial Sequence
  chemically synthesized
ggacccaggagtccaggcccca

SEQ ID NO: 2450 - DNA, 22 bp, Artificial Sequence
  chemically synthesized
ctctctcaaacccaggagccca

SEQ ID NO: 2451 - DNA, 22 bp, Artificial Sequence
  chemically synthesized
tctcaaacccaggagcccaggc

SEQ ID NO: 2452 - DNA, 22 bp, Artificial Sequence
  chemically synthesized
tcaaacccaggagcccaggccc

SEQ ID NO: 2453 - DNA, 22 bp, Artificial Sequence
  chemically synthesized
aaacccaggagcccaggccccc

SEQ ID NO: 2454 - DNA, 22 bp, Artificial Sequence
  chemically synthesized
ttctctgttcagccctaagaat

SEQ ID NO: 2455 - DNA, 22 bp, Artificial Sequence
  chemically synthesized
ctctgttcagccctaagaatcc

SEQ ID NO: 2456 - DNA, 22 bp, Artificial Sequence
  chemically synthesized
tctgttcagccctaagaatcct

SEQ ID NO: 2457 - DNA, 22 bp, Artificial Sequence
  chemically synthesized
tgttcagccctaagaatcctgg

SEQ ID NO: 2458 - DNA, 22 bp, Artificial Sequence
  chemically synthesized
ttcagccctaagaatcctggct

SEQ ID NO: 2459 - DNA, 22 bp, Artificial Sequence
  chemically synthesized
agccctaagaatcctggctcca

SEQ ID NO: 2460 - DNA, 22 bp, Artificial Sequence
  chemically synthesized
agaatcctggctccagcccctc

SEQ ID NO: 2461 - DNA, 22 bp, Artificial Sequence
  chemically synthesized
gctccagcccctcctactctag

SEQ ID NO: 2462 - DNA, 22 bp, Artificial Sequence
  chemically synthesized
cagcccctcctactctagcccc

SEQ ID NO: 2463 - DNA, 22 bp, Artificial Sequence
  chemically synthesized
ctactctagcccccaaccccct

SEQ ID NO: 2464 - DNA, 22 bp, Artificial Sequence
  chemically synthesized
ctctagcccccaaccccctagc

SEQ ID NO: 2465 - DNA, 22 bp, Artificial Sequence
  chemically synthesized
tagcccccaaccccctagccac

SEQ ID NO: 2466 - DNA, 22 bp, Artificial Sequence
  chemically synthesized
gcccccaaccccctagccacta

SEQ ID NO: 2467 - DNA, 22 bp, Artificial Sequence
  chemically synthesized
gccactaaggcaattggggtgc

SEQ ID NO: 2468 - DNA, 22 bp, Artificial Sequence
  chemically synthesized
aggcaattggggtgcaggaatg

SEQ ID NO: 2469 - DNA, 22 bp, Artificial Sequence
  chemically synthesized
gggtgcaggaatgggggcaggg

SEQ ID NO: 2470 - DNA, 22 bp, Artificial Sequence
  chemically synthesized
accaagtggttgataaacccac

SEQ ID NO: 2471 - DNA, 22 bp, Artificial Sequence
  chemically synthesized
ataaacccacgtggggtaccct

SEQ ID NO: 2472 - DNA, 22 bp, Artificial Sequence
  chemically synthesized
agaacttgggaacagccacagc

SEQ ID NO: 2473 - DNA, 22 bp, Artificial Sequence
  chemically synthesized
gggaacagccacagcagggggg

SEQ ID NO: 2474 - DNA, 22 bp, Artificial Sequence
  chemically synthesized
ggaacagccacagcaggggggc

SEQ ID NO: 2475 - DNA, 22 bp, Artificial Sequence
  chemically synthesized
ggggacctgcctggagaaggat

SEQ ID NO: 2476 - DNA, 22 bp, Artificial Sequence
  chemically synthesized
gggacctgcctggagaaggatg

SEQ ID NO: 2477 - DNA, 22 bp, Artificial Sequence
  chemically synthesized
cctggagaaggatgcaggacga

SEQ ID NO: 2478 - DNA, 22 bp, Artificial Sequence
  chemically synthesized
gagaaggatgcaggacgagaaa

SEQ ID NO: 2479 - DNA, 22 bp, Artificial Sequence
  chemically synthesized
gccgggaatcaagagtcaccca

SEQ ID NO: 2480 - DNA, 22 bp, Artificial Sequence
  chemically synthesized
ttttcctaggactgagggtttc

SEQ ID NO: 2481 - DNA, 22 bp, Artificial Sequence
  chemically synthesized
tcctaggactgagggtttcagt

SEQ ID NO: 2482 - DNA, 22 bp, Artificial Sequence
  chemically synthesized
cctaggactgagggtttcagtg

SEQ ID NO: 2483 - DNA, 22 bp, Artificial Sequence
  chemically synthesized
ctaggactgagggtttcagtgc

SEQ ID NO: 2484 - DNA, 22 bp, Artificial Sequence
  chemically synthesized
ggactgagggtttcagtgctaa

SEQ ID NO: 2485 - DNA, 22 bp, Artificial Sequence
  chemically synthesized
agggtttcagtgctaaaactag

SEQ ID NO: 2486 - DNA, 22 bp, Artificial Sequence
  chemically synthesized
cagtgctaaaactaggctgtcc

SEQ ID NO: 2487 - DNA, 22 bp, Artificial Sequence
  chemically synthesized
agtgctaaaactaggctgtcct

SEQ ID NO: 2488 - DNA, 22 bp, Artificial Sequence
  chemically synthesized
aaactaggctgtcctgggcaaa

SEQ ID NO: 2489 - DNA, 22 bp, Artificial Sequence
  chemically synthesized
ggctgtcctgggcaaacagcat

SEQ ID NO: 2490 - DNA, 22 bp, Artificial Sequence
  chemically synthesized
tcctgggcaaacagcataagct

SEQ ID NO: 2491 - DNA, 22 bp, Artificial Sequence
  chemically synthesized
ggcaaacagcataagctggtca

SEQ ID NO: 2492 - DNA, 22 bp, Artificial Sequence
  chemically synthesized
gtcaccccacacccagacctga

SEQ ID NO: 2493 - DNA, 22 bp, Artificial Sequence
  chemically synthesized
acccaaacccagctcccctgct

SEQ ID NO: 2494 - DNA, 22 bp, Artificial Sequence
  chemically synthesized
ccctgcttcttggccacgtaac

SEQ ID NO: 2495 - DNA, 22 bp, Artificial Sequence
  chemically synthesized
cttcttggccacgtaacctgag

SEQ ID NO: 2496 - DNA, 22 bp, Artificial Sequence
  chemically synthesized
cttggccacgtaacctgagaag

SEQ ID NO: 2497 - DNA, 22 bp, Artificial Sequence
  chemically synthesized
ttggccacgtaacctgagaagg

SEQ ID NO: 2498 - DNA, 22 bp, Artificial Sequence
  chemically synthesized
ggccacgtaacctgagaaggga

SEQ ID NO: 2499 - DNA, 22 bp, Artificial Sequence
  chemically synthesized
gccacgtaacctgagaagggaa

SEQ ID NO: 2500 - DNA, 22 bp, Artificial Sequence
  chemically synthesized
agaagggaatccctcctctctg

SEQ ID NO: 2501 - DNA, 22 bp, Artificial Sequence
  chemically synthesized
ctctctgaaccccagcccaccc

SEQ ID NO: 2502 - DNA, 22 bp, Artificial Sequence
  chemically synthesized
tctgaaccccagcccaccccaa

SEQ ID NO: 2503 - DNA, 22 bp, Artificial Sequence
  chemically synthesized
tgaaccccagcccaccccaatg

SEQ ID NO: 2504 - DNA, 22 bp, Artificial Sequence
  chemically synthesized
aaccccagcccaccccaatgct

SEQ ID NO: 2505 - DNA, 22 bp, Artificial Sequence
  chemically synthesized
caggcctcctgggataccccga

SEQ ID NO: 2506 - DNA, 22 bp, Artificial Sequence
  chemically synthesized
ctgggataccccgaagagtgag

SEQ ID NO: 2507 - DNA, 22 bp, Artificial Sequence
  chemically synthesized
ggataccccgaagagtgagttt

SEQ ID NO: 2508 - DNA, 22 bp, Artificial Sequence
  chemically synthesized
gccaagcagtcaccccacagtt

SEQ ID NO: 2509 - DNA, 22 bp, Artificial Sequence
  chemically synthesized
ccaagcagtcaccccacagttg

SEQ ID NO: 2510 - DNA, 22 bp, Artificial Sequence
  chemically synthesized
gaggagaatccacccaaaaggc

SEQ ID NO: 2511 - DNA, 22 bp, Artificial Sequence
  chemically synthesized
gtagacagggctggggtggcct

SEQ ID NO: 2512 - DNA, 22 bp, Artificial Sequence
  chemically synthesized
gggtggcctctcgtggggtcca

SEQ ID NO: 2513 - DNA, 22 bp, Artificial Sequence
  chemically synthesized
tcgtggggtccaggccaagtag

SEQ ID NO: 2514 - DNA, 22 bp, Artificial Sequence
  chemically synthesized
gtggggtccaggccaagtaggt

SEQ ID NO: 2515 - DNA, 22 bp, Artificial Sequence
  chemically synthesized
gggcctctgggggatgcagggg

SEQ ID NO: 2516 - DNA, 22 bp, Artificial Sequence
  chemically synthesized
tgggggatgcaggggaaggggg

SEQ ID NO: 2517 - DNA, 22 bp, Artificial Sequence
  chemically synthesized
ggggatgcaggggaagggggat

SEQ ID NO: 2518 - DNA, 22 bp, Artificial Sequence
  chemically synthesized
agtctgaagagcagagccagga

SEQ ID NO: 2519 - DNA, 22 bp, Artificial Sequence
  chemically synthesized
aagagcagagccaggaacccct

SEQ ID NO: 2520 - DNA, 22 bp, Artificial Sequence
  chemically synthesized
tagggaaggggcaggagagcca

SEQ ID NO: 2521 - DNA, 22 bp, Artificial Sequence
  chemically synthesized
agcgcctctcctgggcttgcca

SEQ ID NO: 2522 - DNA, 22 bp, Artificial Sequence
  chemically synthesized
tcctgggcttgccaaggactca

SEQ ID NO: 2523 - DNA, 22 bp, Artificial Sequence
  chemically synthesized
ctgggcttgccaaggactcaaa

SEQ ID NO: 2524 - DNA, 22 bp, Artificial Sequence
  chemically synthesized
ggcttgccaaggactcaaaccc

SEQ ID NO: 2525 - DNA, 22 bp, Artificial Sequence
  chemically synthesized
gccaaggactcaaacccagaag

SEQ ID NO: 2526 - DNA, 22 bp, Artificial Sequence
  chemically synthesized
ccaaggactcaaacccagaagc

SEQ ID NO: 2527 - DNA, 22 bp, Artificial Sequence
  chemically synthesized
aaacccagaagcccagagcagg

SEQ ID NO: 2528 - DNA, 22 bp, Artificial Sequence
  chemically synthesized
agggaagcgggaccctgctctg

SEQ ID NO: 2529 - DNA, 22 bp, Artificial Sequence
  chemically synthesized
gggaagcgggaccctgctctgg

SEQ ID NO: 2530 - DNA, 22 bp, Artificial Sequence
  chemically synthesized
ctctgggcggaggaatatgtcc

SEQ ID NO: 2531 - DNA, 22 bp, Artificial Sequence
  chemically synthesized
tgggcggaggaatatgtcccag

SEQ ID NO: 2532 - DNA, 22 bp, Artificial Sequence
  chemically synthesized
ggcggaggaatatgtcccagat

SEQ ID NO: 2533 - DNA, 22 bp, Artificial Sequence
  chemically synthesized
gggactctttaaggaaagaagg

SEQ ID NO: 2534 - DNA, 22 bp, Artificial Sequence
  chemically synthesized
tttaaggaaagaaggatggaga

SEQ ID NO: 2535 - DNA, 22 bp, Artificial Sequence
  chemically synthesized
taaggaaagaaggatggagaaa

SEQ ID NO: 2536 - DNA, 22 bp, Artificial Sequence
  chemically synthesized
aaggaaagaaggatggagaaag

SEQ ID NO: 2537 - DNA, 22 bp, Artificial Sequence
  chemically synthesized
aggaaagaaggatggagaaaga

SEQ ID NO: 2538 - DNA, 22 bp, Artificial Sequence
  chemically synthesized
gtgaacacctaggacgcaccat

SEQ ID NO: 2539 - DNA, 22 bp, Artificial Sequence
  chemically synthesized
ggacgcaccattctcacaaagg

SEQ ID NO: 2540 - DNA, 22 bp, Artificial Sequence
  chemically synthesized
tcacaaagggagttttccacac

SEQ ID NO: 2541 - DNA, 22 bp, Artificial Sequence
  chemically synthesized
acaaagggagttttccacacgg

SEQ ID NO: 2542 - DNA, 22 bp, Artificial Sequence
  chemically synthesized
tccacacggacacccccctcct

SEQ ID NO: 2543 - DNA, 22 bp, Artificial Sequence
  chemically synthesized
ccacacggacacccccctcctc

SEQ ID NO: 2544 - DNA, 22 bp, Artificial Sequence
  chemically synthesized
cacacggacacccccctcctca

SEQ ID NO: 2545 - DNA, 22 bp, Artificial Sequence
  chemically synthesized
ctcaccacagccctgccaggac

SEQ ID NO: 2546 - DNA, 22 bp, Artificial Sequence
  chemically synthesized
accacagccctgccaggacggg

SEQ ID NO: 2547 - DNA, 22 bp, Artificial Sequence
  chemically synthesized
ccaggacggggctggctactgg

SEQ ID NO: 2548 - DNA, 22 bp, Artificial Sequence
  chemically synthesized
gctactggccttatctcacagg

SEQ ID NO: 2549 - DNA, 22 bp, Artificial Sequence
  chemically synthesized
ctggccttatctcacaggtaaa

SEQ ID NO: 2550 - DNA, 22 bp, Artificial Sequence
  chemically synthesized
gccttatctcacaggtaaaact

SEQ ID NO: 2551 - DNA, 22 bp, Artificial Sequence
  chemically synthesized
atctcacaggtaaaactgacgc

SEQ ID NO: 2552 - DNA, 22 bp, Artificial Sequence
  chemically synthesized
tctcacaggtaaaactgacgca

SEQ ID NO: 2553 - DNA, 22 bp, Artificial Sequence
  chemically synthesized
acaggtaaaactgacgcacgga

SEQ ID NO: 2554 - DNA, 22 bp, Artificial Sequence
  chemically synthesized
acgcacggaggaacaatataaa

SEQ ID NO: 2555 - DNA, 22 bp, Artificial Sequence
  chemically synthesized
gggactagaaaggtgaagagcc

SEQ ID NO: 2556 - DNA, 22 bp, Artificial Sequence
  chemically synthesized
gaaaggtgaagagccaaagtta

SEQ ID NO: 2557 - DNA, 22 bp, Artificial Sequence
  chemically synthesized
gaactcaggaccaacttattct

SEQ ID NO: 2558 - DNA, 22 bp, Artificial Sequence
  chemically synthesized
aggaccaacttattctgatttt

SEQ ID NO: 2559 - DNA, 22 bp, Artificial Sequence
  chemically synthesized
attctgattttgtttttccaaa

SEQ ID NO: 2560 - DNA, 22 bp, Artificial Sequence
  chemically synthesized
ttctgattttgtttttccaaac

SEQ ID NO: 2561 - DNA, 22 bp, Artificial Sequence
  chemically synthesized
tgattttgtttttccaaactgc

SEQ ID NO: 2562 - DNA, 22 bp, Artificial Sequence
  chemically synthesized
attttgtttttccaaactgctt

SEQ ID NO: 2563 - DNA, 22 bp, Artificial Sequence
  chemically synthesized
tgtttttccaaactgcttctcc

SEQ ID NO: 2564 - DNA, 22 bp, Artificial Sequence
  chemically synthesized
gtttttccaaactgcttctcct

SEQ ID NO: 2565 - DNA, 22 bp, Artificial Sequence
  chemically synthesized
tttttccaaactgcttctcctc

SEQ ID NO: 2566 - DNA, 22 bp, Artificial Sequence
  chemically synthesized
ttccaaactgcttctcctcttg

SEQ ID NO: 2567 - DNA, 22 bp, Artificial Sequence
  chemically synthesized
tccaaactgcttctcctcttgg

SEQ ID NO: 2568 - DNA, 22 bp, Artificial Sequence
  chemically synthesized
ccaaactgcttctcctcttggg

SEQ ID NO: 2569 - DNA, 22 bp, Artificial Sequence
  chemically synthesized
caaactgcttctcctcttggga

SEQ ID NO: 2570 - DNA, 22 bp, Artificial Sequence
  chemically synthesized
cttctcctcttgggaagtgtaa

SEQ ID NO: 2571 - DNA, 22 bp, Artificial Sequence
  chemically synthesized
ctcctcttgggaagtgtaagga

SEQ ID NO: 2572 - DNA, 22 bp, Artificial Sequence
  chemically synthesized
tcctcttgggaagtgtaaggaa

SEQ ID NO: 2573 - DNA, 22 bp, Artificial Sequence
  chemically synthesized
ctcttgggaagtgtaaggaagc

SEQ ID NO: 2574 - DNA, 22 bp, Artificial Sequence
  chemically synthesized
ttgggaagtgtaaggaagctgc

SEQ ID NO: 2575 - DNA, 22 bp, Artificial Sequence
  chemically synthesized
gggaagtgtaaggaagctgcag

SEQ ID NO: 2576 - DNA, 22 bp, Artificial Sequence
  chemically synthesized
ggaagtgtaaggaagctgcagc

SEQ ID NO: 2577 - DNA, 22 bp, Artificial Sequence
  chemically synthesized
cagcaccaggatcagtgaaacg

SEQ ID NO: 2578 - DNA, 22 bp, Artificial Sequence
  chemically synthesized
aggttctgggagagggtagcgc

SEQ ID NO: 2579 - DNA, 22 bp, Artificial Sequence
  chemically synthesized
tgggagagggtagcgcagggtg

SEQ ID NO: 2580 - DNA, 22 bp, Artificial Sequence
  chemically synthesized
ggagagggtagcgcagggtggc

SEQ ID NO: 2581 - DNA, 22 bp, Artificial Sequence
  chemically synthesized
agaaccgggcaggtcacgcatc

SEQ ID NO: 2582 - DNA, 22 bp, Artificial Sequence
  chemically synthesized
ccctcccaccccctgccaagct

SEQ ID NO: 2583 - DNA, 22 bp, Artificial Sequence
  chemically synthesized
cctcccaccccctgccaagctc

SEQ ID NO: 2584 - DNA, 22 bp, Artificial Sequence
  chemically synthesized
ccaccccctgccaagctctccc

SEQ ID NO: 2585 - DNA, 22 bp, Artificial Sequence
  chemically synthesized
ccaagctctccctcccaggatc

SEQ ID NO: 2586 - DNA, 22 bp, Artificial Sequence
  chemically synthesized
tccctcccaggatcctctctgg

SEQ ID NO: 2587 - DNA, 22 bp, Artificial Sequence
  chemically synthesized
cctcccaggatcctctctggct

SEQ ID NO: 2588 - DNA, 22 bp, Artificial Sequence
  chemically synthesized
ccaggatcctctctggctccat

SEQ ID NO: 2589 - DNA, 22 bp, Artificial Sequence
  chemically synthesized
tctggctccatcgtaagcaaac

SEQ ID NO: 2590 - DNA, 22 bp, Artificial Sequence
  chemically synthesized
tggctccatcgtaagcaaacct

SEQ ID NO: 2591 - DNA, 22 bp, Artificial Sequence
  chemically synthesized
gctccatcgtaagcaaacctta

SEQ ID NO: 2592 - DNA, 22 bp, Artificial Sequence
  chemically synthesized
catcgtaagcaaaccttagagg

SEQ ID NO: 2593 - DNA, 22 bp, Artificial Sequence
  chemically synthesized
agaggttctggcaaggagagag

SEQ ID NO: 2594 - DNA, 22 bp, Artificial Sequence
  chemically synthesized
gaggttctggcaaggagagaga

SEQ ID NO: 2595 - DNA, 22 bp, Artificial Sequence
  chemically synthesized
tggcaaggagagagatggctcc

SEQ ID NO: 2596 - DNA, 22 bp, Artificial Sequence
  chemically synthesized
gcaaggagagagatggctccag

SEQ ID NO: 2597 - DNA, 22 bp, Artificial Sequence
  chemically synthesized
caggaaatgggggtgtgtcacc

SEQ ID NO: 2598 - DNA, 22 bp, Artificial Sequence
  chemically synthesized
cctaacaggaggtgggggttag

SEQ ID NO: 2599 - DNA, 22 bp, Artificial Sequence
  chemically synthesized
acaggaggtgggggttagaccc

SEQ ID NO: 2600 - DNA, 22 bp, Artificial Sequence
  chemically synthesized
gacccaatatcaggagactagg

SEQ ID NO: 2601 - DNA, 22 bp, Artificial Sequence
  chemically synthesized
ggaaggaggaggcctaaggatg

SEQ ID NO: 2602 - DNA, 22 bp, Artificial Sequence
  chemically synthesized
aggatggggcttttctgtcacc

SEQ ID NO: 2603 - DNA, 22 bp, Artificial Sequence
  chemically synthesized
ttctgtcaccaatcctgtccct

SEQ ID NO: 2604 - DNA, 22 bp, Artificial Sequence
  chemically synthesized
tctgtcaccaatcctgtcccta

SEQ ID NO: 2605 - DNA, 22 bp, Artificial Sequence
  chemically synthesized
ctgtcaccaatcctgtccctag

SEQ ID NO: 2606 - DNA, 22 bp, Artificial Sequence
  chemically synthesized
tgtcaccaatcctgtccctagt

SEQ ID NO: 2607 - DNA, 22 bp, Artificial Sequence
  chemically synthesized
tcaccaatcctgtccctagtgg

SEQ ID NO: 2608 - DNA, 22 bp, Artificial Sequence
  chemically synthesized
tccctagtggccccactgtggg

SEQ ID NO: 2609 - DNA, 22 bp, Artificial Sequence
  chemically synthesized
gtggccccactgtggggtggag

SEQ ID NO: 2610 - DNA, 22 bp, Artificial Sequence
  chemically synthesized
tggggtggaggggacagataaa

SEQ ID NO: 2611 - DNA, 22 bp, Artificial Sequence
  chemically synthesized
accggccctgggaatataaggt

SEQ ID NO: 2612 - DNA, 22 bp, Artificial Sequence
  chemically synthesized
ggaatataaggtggtcccagct

SEQ ID NO: 2613 - DNA, 22 bp, Artificial Sequence
  chemically synthesized
ggggacacaggatccctggagg

SEQ ID NO: 2614 - DNA, 22 bp, Artificial Sequence
  chemically synthesized
gaggcagcaaacatgctgtcct

SEQ ID NO: 2615 - DNA, 22 bp, Artificial Sequence
  chemically synthesized
tcctgaagtggacataggggcc

SEQ ID NO: 2616 - DNA, 22 bp, Artificial Sequence
  chemically synthesized
aagtggacataggggcccgggt

SEQ ID NO: 2617 - DNA, 22 bp, Artificial Sequence
  chemically synthesized
gaggaagaagactagctgagct

SEQ ID NO: 2618 - DNA, 22 bp, Artificial Sequence
  chemically synthesized
gctgagctctcggacccctgga

SEQ ID NO: 2619 - DNA, 22 bp, Artificial Sequence
  chemically synthesized
agctctcggacccctggaagat

SEQ ID NO: 2620 - DNA, 22 bp, Artificial Sequence
  chemically synthesized
tcggacccctggaagatgccat

SEQ ID NO: 2621 - DNA, 22 bp, Artificial Sequence
  chemically synthesized
ggacccctggaagatgccatga

SEQ ID NO: 2622 - DNA, 22 bp, Artificial Sequence
  chemically synthesized
gaagatgccatgacagggggct

SEQ ID NO: 2623 - DNA, 22 bp, Artificial Sequence
  chemically synthesized
gaagagctagcacagactagag

SEQ ID NO: 2624 - DNA, 22 bp, Artificial Sequence
  chemically synthesized
gcacagactagagaggtaaggg

SEQ ID NO: 2625 - DNA, 22 bp, Artificial Sequence
  chemically synthesized
gagaggtaaggggggtagggga

SEQ ID NO: 2626 - DNA, 22 bp, Artificial Sequence
  chemically synthesized
cccaaatgaaaggagtgagagg

SEQ ID NO: 2627 - DNA, 22 bp, Artificial Sequence
  chemically synthesized
aagccagggagacggggtactt

SEQ ID NO: 2628 - DNA, 22 bp, Artificial Sequence
  chemically synthesized
tggggttgtccagaaaaacggt

SEQ ID NO: 2629 - DNA, 22 bp, Artificial Sequence
  chemically synthesized
ggggttgtccagaaaaacggtg

SEQ ID NO: 2630 - DNA, 22 bp, Artificial Sequence
  chemically synthesized
gggttgtccagaaaaacggtga

SEQ ID NO: 2631 - DNA, 22 bp, Artificial Sequence
  chemically synthesized
tccagaaaaacggtgatgatgc

SEQ ID NO: 2632 - DNA, 22 bp, Artificial Sequence
  chemically synthesized
caagaaggggaggcgggacgca

SEQ ID NO: 2633 - DNA, 22 bp, Artificial Sequence
  chemically synthesized
agaaacgagagatggcacaggc

SEQ ID NO: 2634 - DNA, 22 bp, Artificial Sequence
  chemically synthesized
ggtgagggaggagagatgcccg

SEQ ID NO: 2635 - DNA, 22 bp, Artificial Sequence
  chemically synthesized
agaggacatcacgtggtgcagc

SEQ ID NO: 2636 - DNA, 22 bp, Artificial Sequence
  chemically synthesized
cggaaagagcatccttgggcag

SEQ ID NO: 2637 - DNA, 22 bp, Artificial Sequence
  chemically synthesized
gggcagcaacacagcagagagc

SEQ ID NO: 2638 - DNA, 22 bp, Artificial Sequence
  chemically synthesized
ggcagcaacacagcagagagca

SEQ ID NO: 2639 - DNA, 22 bp, Artificial Sequence
  chemically synthesized
aaggaggcggcagggaaggatc

SEQ ID NO: 2640 - DNA, 22 bp, Artificial Sequence
  chemically synthesized
ggccagccgtagaggtgaccca

SEQ ID NO: 2641 - DNA, 22 bp, Artificial Sequence
  chemically synthesized
cagacagaaagcggcacaggcc

SEQ ID NO: 2642 - DNA, 22 bp, Artificial Sequence
  chemically synthesized
cctgggaaggggaaacagtggg

SEQ ID NO: 2643 - DNA, 22 bp, Artificial Sequence
  chemically synthesized
ggaaggggaaacagtgggccag

SEQ ID NO: 2644 - DNA, 22 bp, Artificial Sequence
  chemically synthesized
aaagtggtccggactcaggaga

SEQ ID NO: 2645 - DNA, 22 bp, Artificial Sequence
  chemically synthesized
aggagagagacggcagcgttag

SEQ ID NO: 2646 - DNA, 22 bp, Artificial Sequence
  chemically synthesized
gagggcagagttccggcggcac

SEQ ID NO: 2647 - DNA, 22 bp, Artificial Sequence
  chemically synthesized
cggcggcacagcaagggcactc

SEQ ID NO: 2648 - DNA, 22 bp, Artificial Sequence
  chemically synthesized
gggggcgagaggagggcagcgc

SEQ ID NO: 2649 - DNA, 22 bp, Artificial Sequence
  chemically synthesized
agctatgggagctggctcaggt

SEQ ID NO: 2650 - DNA, 22 bp, Artificial Sequence
  chemically synthesized
tgggagctggctcaggttcagg

SEQ ID NO: 2651 - DNA, 22 bp, Artificial Sequence
  chemically synthesized
gctcaggttcaggagagggcag

SEQ ID NO: 2652 - DNA, 22 bp, Artificial Sequence
  chemically synthesized
aggttcaggagagggcagggca

SEQ ID NO: 2653 - DNA, 22 bp, Artificial Sequence
  chemically synthesized
aggagagggcagggcagggaag

SEQ ID NO: 2654 - DNA, 22 bp, Artificial Sequence
  chemically synthesized
gaggggctcaacatcggaagag

SEQ ID NO: 2655 - DNA, 22 bp, Artificial Sequence
  chemically synthesized
aacatcggaagaggggaagtcg

SEQ ID NO: 2656 - DNA, 22 bp, Artificial Sequence
  chemically synthesized
catgggtcagcacaggctgcca

SEQ ID NO: 2657 - DNA, 22 bp, Artificial Sequence
  chemically synthesized
ccaaagccagggccagttaaag

SEQ ID NO: 2658 - DNA, 22 bp, Artificial Sequence
  chemically synthesized
aagcgactccaatgcggaagag

SEQ ID NO: 2659 - DNA, 22 bp, Artificial Sequence
  chemically synthesized
caatgcggaagagagtaggtcg

SEQ ID NO: 2660 - DNA, 22 bp, Artificial Sequence
  chemically synthesized
gggcagagtggtcagcacagag

SEQ ID NO: 2661 - DNA, 22 bp, Artificial Sequence
  chemically synthesized
agcccagggccagttgaagcgg

SEQ ID NO: 2662 - DNA, 22 bp, Artificial Sequence
  chemically synthesized
aagcggctccaattcggaagtg

SEQ ID NO: 2663 - DNA, 22 bp, Artificial Sequence
  chemically synthesized
caattcggaagtggggtggtcg

SEQ ID NO: 2664 - DNA, 22 bp, Artificial Sequence
  chemically synthesized
ggaagtggggtggtcgaagggg

SEQ ID NO: 2665 - DNA, 22 bp, Artificial Sequence
  chemically synthesized
ggacggggtgtcagcatagggt

SEQ ID NO: 2666 - DNA, 22 bp, Artificial Sequence
  chemically synthesized
gcaacggggaaggaggatgccc

SEQ ID NO: 2667 - DNA, 22 bp, Artificial Sequence
  chemically synthesized
gccccgggagacgccgggcggg

SEQ ID NO: 2668 - DNA, 22 bp, Artificial Sequence
  chemically synthesized
acctggtgcagggcgctgatac

SEQ ID NO: 2669 - DNA, 22 bp, Artificial Sequence
  chemically synthesized
gtgcagggcgctgataccgtcg

SEQ ID NO: 2670 - DNA, 22 bp, Artificial Sequence
  chemically synthesized
ataccgtcggcgttggtggagt

SEQ ID NO: 2671 - DNA, 22 bp, Artificial Sequence
  chemically synthesized
gtggagtccagcacggcgcggg

SEQ ID NO: 2672 - DNA, 22 bp, Artificial Sequence
  chemically synthesized
ggcgccggggccagggtcggcg

SEQ ID NO: 2673 - DNA, 22 bp, Artificial Sequence
  chemically synthesized
gtccaggtcgccgcccgcacag

SEQ ID NO: 2674 - DNA, 22 bp, Artificial Sequence
  chemically synthesized
ggcggcgcgctcgaagcggacg

SEQ ID NO: 2675 - DNA, 22 bp, Artificial Sequence
  chemically synthesized
gaagcggacggtgcgggcgcgg

SEQ ID NO: 2676 - DNA, 22 bp, Artificial Sequence
  chemically synthesized
tccggggccaggctcggcgccc

SEQ ID NO: 2677 - DNA, 22 bp, Artificial Sequence
  chemically synthesized
cggggccaggctcggcgcccgc

SEQ ID NO: 2678 - DNA, 22 bp, Artificial Sequence
  chemically synthesized
ggcgcccgcccgcgccccccac

SEQ ID NO: 2679 - DNA, 22 bp, Artificial Sequence
  chemically synthesized
ccgcagctgctcccgtcgccgc

SEQ ID NO: 2680 - DNA, 22 bp, Artificial Sequence
  chemically synthesized
ctcccgtcgccgctcccgggca

SEQ ID NO: 2681 - DNA, 22 bp, Artificial Sequence
  chemically synthesized
ccgtcgccgctcccgggcagcc

SEQ ID NO: 2682 - DNA, 22 bp, Artificial Sequence
  chemically synthesized
ccgggcagccgccgccgccgcc

SEQ ID NO: 2683 - DNA, 22 bp, Artificial Sequence
  chemically synthesized
tccggacatcgcaccgcccgcc

SEQ ID NO: 2684 - DNA, 22 bp, Artificial Sequence
  chemically synthesized
cggacatcgcaccgcccgcccg

SEQ ID NO: 2685 - DNA, 22 bp, Artificial Sequence
  chemically synthesized
gggctcggcgctcgctcgctcg

SEQ ID NO: 2686 - DNA, 22 bp, Artificial Sequence
  chemically synthesized
ggcgctcgctcgctcgctgggc

SEQ ID NO: 2687 - DNA, 22 bp, Artificial Sequence
  chemically synthesized
gctcgctcgctgggcgggcggg

SEQ ID NO: 2688 - DNA, 22 bp, Artificial Sequence
  chemically synthesized
gctcgctgggcgggcgggcggt

SEQ ID NO: 2689 - DNA, 22 bp, Artificial Sequence
  chemically synthesized
gctgggcgggcgggcggtgcga

SEQ ID NO: 2690 - DNA, 22 bp, Artificial Sequence
  chemically synthesized
ggcgggcgggcggtgcgatgtc

SEQ ID NO: 2691 - DNA, 22 bp, Artificial Sequence
  chemically synthesized
gcccgggggcggcggcggcggc

SEQ ID NO: 2692 - DNA, 22 bp, Artificial Sequence
  chemically synthesized
cccgggagcggcgacgggagca

SEQ ID NO: 2693 - DNA, 22 bp, Artificial Sequence
  chemically synthesized
cggcagtggggggcgcgggcgg

SEQ ID NO: 2694 - DNA, 22 bp, Artificial Sequence
  chemically synthesized
gccccggagagcgccgcgcccg

SEQ ID NO: 2695 - DNA, 22 bp, Artificial Sequence
  chemically synthesized
cgagcgcgccgccgagttcctg

SEQ ID NO: 2696 - DNA, 22 bp, Artificial Sequence
  chemically synthesized
gagcgcgccgccgagttcctgg

SEQ ID NO: 2697 - DNA, 22 bp, Artificial Sequence
  chemically synthesized
ctggcggcctgtgcgggcggcg

SEQ ID NO: 2698 - DNA, 22 bp, Artificial Sequence
  chemically synthesized
gcggcctgtgcgggcggcgacc

SEQ ID NO: 2699 - DNA, 22 bp, Artificial Sequence
  chemically synthesized
tgcgggcggcgacctggacgag

SEQ ID NO: 2700 - DNA, 22 bp, Artificial Sequence
  chemically synthesized
gacgaggcgcgtctgatgctgc

SEQ ID NO: 2701 - DNA, 22 bp, Artificial Sequence
  chemically synthesized
atgctgcgcgccgccgaccctg

SEQ ID NO: 2702 - DNA, 22 bp, Artificial Sequence
  chemically synthesized
cgcgccgccgaccctggccccg

SEQ ID NO: 2703 - DNA, 22 bp, Artificial Sequence
  chemically synthesized
gccccggcgccgagctcgaccc

SEQ ID NO: 2704 - DNA, 22 bp, Artificial Sequence
  chemically synthesized
gaccccgccgcgccgccgcccg

SEQ ID NO: 2705 - DNA, 22 bp, Artificial Sequence
  chemically synthesized
gactccaccaacgccgacggta

SEQ ID NO: 2706 - DNA, 22 bp, Artificial Sequence
  chemically synthesized
caccaacgccgacggtatcagc

SEQ ID NO: 2707 - DNA, 22 bp, Artificial Sequence
  chemically synthesized
caccaggtcagcgccccccgcc

SEQ ID NO: 2708 - DNA, 22 bp, Artificial Sequence
  chemically synthesized
ccggggccaggtccaccctctg

SEQ ID NO: 2709 - DNA, 22 bp, Artificial Sequence
  chemically synthesized
tgctgcgccacctggggcatcc

SEQ ID NO: 2710 - DNA, 22 bp, Artificial Sequence
  chemically synthesized
ctgcgccacctggggcatcctc

SEQ ID NO: 2711 - DNA, 22 bp, Artificial Sequence
  chemically synthesized
cgccacctggggcatcctcctt

SEQ ID NO: 2712 - DNA, 22 bp, Artificial Sequence
  chemically synthesized
gggcatcctccttccccgttgc

SEQ ID NO: 2713 - DNA, 22 bp, Artificial Sequence
  chemically synthesized
cttccccgttgccagtctcgat

SEQ ID NO: 2714 - DNA, 22 bp, Artificial Sequence
  chemically synthesized
ccccgttgccagtctcgatccg

SEQ ID NO: 2715 - DNA, 22 bp, Artificial Sequence
  chemically synthesized
cccgttgccagtctcgatccgc

SEQ ID NO: 2716 - DNA, 22 bp, Artificial Sequence
  chemically synthesized
ccagtctcgatccgccccgtcg

SEQ ID NO: 2717 - DNA, 22 bp, Artificial Sequence
  chemically synthesized
gatccgccccgtcgttcctggc

SEQ ID NO: 2718 - DNA, 22 bp, Artificial Sequence
  chemically synthesized
ctggccctgggctttgccaccc

SEQ ID NO: 2719 - DNA, 22 bp, Artificial Sequence
  chemically synthesized
gccctgggctttgccaccctat

SEQ ID NO: 2720 - DNA, 22 bp, Artificial Sequence
  chemically synthesized
ggctttgccaccctatgctgac

SEQ ID NO: 2721 - DNA, 22 bp, Artificial Sequence
  chemically synthesized
tgccaccctatgctgacacccc

SEQ ID NO: 2722 - DNA, 22 bp, Artificial Sequence
  chemically synthesized
gccaccctatgctgacaccccg

SEQ ID NO: 2723 - DNA, 22 bp, Artificial Sequence
  chemically synthesized
ccaccctatgctgacaccccgt

SEQ ID NO: 2724 - DNA, 22 bp, Artificial Sequence
  chemically synthesized
tgctgacaccccgtcccagtcc

SEQ ID NO: 2725 - DNA, 22 bp, Artificial Sequence
  chemically synthesized
acaccccgtcccagtccccctt

SEQ ID NO: 2726 - DNA, 22 bp, Artificial Sequence
  chemically synthesized
accattccccttcgaccacccc

SEQ ID NO: 2727 - DNA, 22 bp, Artificial Sequence
  chemically synthesized
ccattccccttcgaccacccca

SEQ ID NO: 2728 - DNA, 22 bp, Artificial Sequence
  chemically synthesized
cccttcgaccaccccacttccg

SEQ ID NO: 2729 - DNA, 22 bp, Artificial Sequence
  chemically synthesized
cgaccaccccacttccgaattg

SEQ ID NO: 2730 - DNA, 22 bp, Artificial Sequence
  chemically synthesized
gaccaccccacttccgaattgg

SEQ ID NO: 2731 - DNA, 22 bp, Artificial Sequence
  chemically synthesized
ccgaattggagccgcttcaact

SEQ ID NO: 2732 - DNA, 22 bp, Artificial Sequence
  chemically synthesized
cgaattggagccgcttcaactg

SEQ ID NO: 2733 - DNA, 22 bp, Artificial Sequence
  chemically synthesized
gagccgcttcaactggccctgg

SEQ ID NO: 2734 - DNA, 22 bp, Artificial Sequence
  chemically synthesized
caactggccctgggcttagcca

SEQ ID NO: 2735 - DNA, 22 bp, Artificial Sequence
  chemically synthesized
aactggccctgggcttagccac

SEQ ID NO: 2736 - DNA, 22 bp, Artificial Sequence
  chemically synthesized
gccctgggcttagccactctgt

SEQ ID NO: 2737 - DNA, 22 bp, Artificial Sequence
  chemically synthesized
ggcttagccactctgtgctgac

SEQ ID NO: 2738 - DNA, 22 bp, Artificial Sequence
  chemically synthesized
agccactctgtgctgaccactc

SEQ ID NO: 2739 - DNA, 22 bp, Artificial Sequence
  chemically synthesized
gccactctgtgctgaccactct

SEQ ID NO: 2740 - DNA, 22 bp, Artificial Sequence
  chemically synthesized
tgtgctgaccactctgccccag

SEQ ID NO: 2741 - DNA, 22 bp, Artificial Sequence
  chemically synthesized
tgctgaccactctgccccaggc

SEQ ID NO: 2742 - DNA, 22 bp, Artificial Sequence
  chemically synthesized
accactctgccccaggcctcct

SEQ ID NO: 2743 - DNA, 22 bp, Artificial Sequence
  chemically synthesized
tgccccaggcctccttaccatt

SEQ ID NO: 2744 - DNA, 22 bp, Artificial Sequence
  chemically synthesized
ccccaggcctccttaccattcc

SEQ ID NO: 2745 - DNA, 22 bp, Artificial Sequence
  chemically synthesized
cttaccattccccttcgaccta

SEQ ID NO: 2746 - DNA, 22 bp, Artificial Sequence
  chemically synthesized
accattccccttcgacctactc

SEQ ID NO: 2747 - DNA, 22 bp, Artificial Sequence
  chemically synthesized
ccattccccttcgacctactct

SEQ ID NO: 2748 - DNA, 22 bp, Artificial Sequence
  chemically synthesized
cccttcgacctactctcttccg

SEQ ID NO: 2749 - DNA, 22 bp, Artificial Sequence
  chemically synthesized
cgacctactctcttccgcattg

SEQ ID NO: 2750 - DNA, 22 bp, Artificial Sequence
  chemically synthesized
gacctactctcttccgcattgg

SEQ ID NO: 2751 - DNA, 22 bp, Artificial Sequence
  chemically synthesized
ctctcttccgcattggagtcgc

SEQ ID NO: 2752 - DNA, 22 bp, Artificial Sequence
  chemically synthesized
tcttccgcattggagtcgcttt

SEQ ID NO: 2753 - DNA, 22 bp, Artificial Sequence
  chemically synthesized
ttccgcattggagtcgctttaa

SEQ ID NO: 2754 - DNA, 22 bp, Artificial Sequence
  chemically synthesized
ccgcattggagtcgctttaact

SEQ ID NO: 2755 - DNA, 22 bp, Artificial Sequence
  chemically synthesized
cgcattggagtcgctttaactg

SEQ ID NO: 2756 - DNA, 22 bp, Artificial Sequence
  chemically synthesized
gagtcgctttaactggccctgg

SEQ ID NO: 2757 - DNA, 22 bp, Artificial Sequence
  chemically synthesized
taactggccctggctttggcag

SEQ ID NO: 2758 - DNA, 22 bp, Artificial Sequence
  chemically synthesized
aactggccctggctttggcagc

SEQ ID NO: 2759 - DNA, 22 bp, Artificial Sequence
  chemically synthesized
actggccctggctttggcagcc

SEQ ID NO: 2760 - DNA, 22 bp, Artificial Sequence
  chemically synthesized
gccctggctttggcagcctgtg

SEQ ID NO: 2761 - DNA, 22 bp, Artificial Sequence
  chemically synthesized
gctttggcagcctgtgctgacc

SEQ ID NO: 2762 - DNA, 22 bp, Artificial Sequence
  chemically synthesized
tggcagcctgtgctgacccatg

SEQ ID NO: 2763 - DNA, 22 bp, Artificial Sequence
  chemically synthesized
ggcagcctgtgctgacccatgc

SEQ ID NO: 2764 - DNA, 22 bp, Artificial Sequence
  chemically synthesized
gcagcctgtgctgacccatgca

SEQ ID NO: 2765 - DNA, 22 bp, Artificial Sequence
  chemically synthesized
tgctgacccatgcagtcctcct

SEQ ID NO: 2766 - DNA, 22 bp, Artificial Sequence
  chemically synthesized
acccatgcagtcctccttacca

SEQ ID NO: 2767 - DNA, 22 bp, Artificial Sequence
  chemically synthesized
cttaccatccctccctcgactt

SEQ ID NO: 2768 - DNA, 22 bp, Artificial Sequence
  chemically synthesized
accatccctccctcgacttccc

SEQ ID NO: 2769 - DNA, 22 bp, Artificial Sequence
  chemically synthesized
ccatccctccctcgacttcccc

SEQ ID NO: 2770 - DNA, 22 bp, Artificial Sequence
  chemically synthesized
cctcgacttcccctcttccgat

SEQ ID NO: 2771 - DNA, 22 bp, Artificial Sequence
  chemically synthesized
gacttcccctcttccgatgttg

SEQ ID NO: 2772 - DNA, 22 bp, Artificial Sequence
  chemically synthesized
cccctcttccgatgttgagccc

SEQ ID NO: 2773 - DNA, 22 bp, Artificial Sequence
  chemically synthesized
ccctcttccgatgttgagcccc

SEQ ID NO: 2774 - DNA, 22 bp, Artificial Sequence
  chemically synthesized
ttccgatgttgagcccctccag

SEQ ID NO: 2775 - DNA, 22 bp, Artificial Sequence
  chemically synthesized
ccgatgttgagcccctccagcc

SEQ ID NO: 2776 - DNA, 22 bp, Artificial Sequence
  chemically synthesized
cgatgttgagcccctccagccg

SEQ ID NO: 2777 - DNA, 22 bp, Artificial Sequence
  chemically synthesized
agcccctccagccggtcctgga

SEQ ID NO: 2778 - DNA, 22 bp, Artificial Sequence
  chemically synthesized
cagccggtcctggactttgtct

SEQ ID NO: 2779 - DNA, 22 bp, Artificial Sequence
  chemically synthesized
gactttgtctccttccctgccc

SEQ ID NO: 2780 - DNA, 22 bp, Artificial Sequence
  chemically synthesized
tgtctccttccctgccctgccc

SEQ ID NO: 2781 - DNA, 22 bp, Artificial Sequence
  chemically synthesized
gtctccttccctgccctgccct

SEQ ID NO: 2782 - DNA, 22 bp, Artificial Sequence
  chemically synthesized
tctccttccctgccctgccctc

SEQ ID NO: 2783 - DNA, 22 bp, Artificial Sequence
  chemically synthesized
cttccctgccctgccctctcct

SEQ ID NO: 2784 - DNA, 22 bp, Artificial Sequence
  chemically synthesized
ccctgccctgccctctcctgaa

SEQ ID NO: 2785 - DNA, 22 bp, Artificial Sequence
  chemically synthesized
cctgccctgccctctcctgaac

SEQ ID NO: 2786 - DNA, 22 bp, Artificial Sequence
  chemically synthesized
ccctgccctctcctgaacctga

SEQ ID NO: 2787 - DNA, 22 bp, Artificial Sequence
  chemically synthesized
ccctctcctgaacctgagccag

SEQ ID NO: 2788 - DNA, 22 bp, Artificial Sequence
  chemically synthesized
tcctgaacctgagccagctccc

SEQ ID NO: 2789 - DNA, 22 bp, Artificial Sequence
  chemically synthesized
ctgaacctgagccagctcccat

SEQ ID NO: 2790 - DNA, 22 bp, Artificial Sequence
  chemically synthesized
aacctgagccagctcccatagc

SEQ ID NO: 2791 - DNA, 22 bp, Artificial Sequence
  chemically synthesized
agccagctcccatagctcagtc

SEQ ID NO: 2792 - DNA, 22 bp, Artificial Sequence
  chemically synthesized
ccatagctcagtctggtctatc

SEQ ID NO: 2793 - DNA, 22 bp, Artificial Sequence
  chemically synthesized
agtctggtctatctgcctggcc

SEQ ID NO: 2794 - DNA, 22 bp, Artificial Sequence
  chemically synthesized
gtctatctgcctggccctggcc

SEQ ID NO: 2795 - DNA, 22 bp, Artificial Sequence
  chemically synthesized
tctgcctggccctggccattgt

SEQ ID NO: 2796 - DNA, 22 bp, Artificial Sequence
  chemically synthesized
cctggccctggccattgtcact

SEQ ID NO: 2797 - DNA, 22 bp, Artificial Sequence
  chemically synthesized
gccctggccattgtcactttgc

SEQ ID NO: 2798 - DNA, 22 bp, Artificial Sequence
  chemically synthesized
gccattgtcactttgcgctgcc

SEQ ID NO: 2799 - DNA, 22 bp, Artificial Sequence
  chemically synthesized
tcactttgcgctgccctcctct

SEQ ID NO: 2800 - DNA, 22 bp, Artificial Sequence
  chemically synthesized
tgcgctgccctcctctcgcccc

SEQ ID NO: 2801 - DNA, 22 bp, Artificial Sequence
  chemically synthesized
gcgctgccctcctctcgccccc

SEQ ID NO: 2802 - DNA, 22 bp, Artificial Sequence
  chemically synthesized
cgctgccctcctctcgcccccg

SEQ ID NO: 2803 - DNA, 22 bp, Artificial Sequence
  chemically synthesized
ccctcctctcgcccccgagtgc

SEQ ID NO: 2804 - DNA, 22 bp, Artificial Sequence
  chemically synthesized
ctctcgcccccgagtgcccttg

SEQ ID NO: 2805 - DNA, 22 bp, Artificial Sequence
  chemically synthesized
tcgcccccgagtgcccttgctg

SEQ ID NO: 2806 - DNA, 22 bp, Artificial Sequence
  chemically synthesized
gcccccgagtgcccttgctgtg

SEQ ID NO: 2807 - DNA, 22 bp, Artificial Sequence
  chemically synthesized
gctgtgccgccggaactctgcc

SEQ ID NO: 2808 - DNA, 22 bp, Artificial Sequence
  chemically synthesized
ctgtgccgccggaactctgccc

SEQ ID NO: 2809 - DNA, 22 bp, Artificial Sequence
  chemically synthesized
tgccgccggaactctgccctct

SEQ ID NO: 2810 - DNA, 22 bp, Artificial Sequence
  chemically synthesized
tgccctctaacgctgccgtctc

SEQ ID NO: 2811 - DNA, 22 bp, Artificial Sequence
  chemically synthesized
ccctctaacgctgccgtctctc

SEQ ID NO: 2812 - DNA, 22 bp, Artificial Sequence
  chemically synthesized
taacgctgccgtctctctcctg

SEQ ID NO: 2813 - DNA, 22 bp, Artificial Sequence
  chemically synthesized
acgctgccgtctctctcctgag

SEQ ID NO: 2814 - DNA, 22 bp, Artificial Sequence
  chemically synthesized
ccgtctctctcctgagtccgga

SEQ ID NO: 2815 - DNA, 22 bp, Artificial Sequence
  chemically synthesized
tctcctgagtccggaccacttt

SEQ ID NO: 2816 - DNA, 22 bp, Artificial Sequence
  chemically synthesized
tcctgagtccggaccactttga

SEQ ID NO: 2817 - DNA, 22 bp, Artificial Sequence
  chemically synthesized
ctgagtccggaccactttgagc

SEQ ID NO: 2818 - DNA, 22 bp, Artificial Sequence
  chemically synthesized
agtccggaccactttgagctct

SEQ ID NO: 2819 - DNA, 22 bp, Artificial Sequence
  chemically synthesized
tgagctctactggcttctgcgc

SEQ ID NO: 2820 - DNA, 22 bp, Artificial Sequence
  chemically synthesized
gagctctactggcttctgcgcc

SEQ ID NO: 2821 - DNA, 22 bp, Artificial Sequence
  chemically synthesized
agctctactggcttctgcgccg

SEQ ID NO: 2822 - DNA, 22 bp, Artificial Sequence
  chemically synthesized
tactggcttctgcgccgcctct

SEQ ID NO: 2823 - DNA, 22 bp, Artificial Sequence
  chemically synthesized
ctggcttctgcgccgcctctgg

SEQ ID NO: 2824 - DNA, 22 bp, Artificial Sequence
  chemically synthesized
gcttctgcgccgcctctggccc

SEQ ID NO: 2825 - DNA, 22 bp, Artificial Sequence
  chemically synthesized
ctgcgccgcctctggcccactg

SEQ ID NO: 2826 - DNA, 22 bp, Artificial Sequence
  chemically synthesized
tgcgccgcctctggcccactgt

SEQ ID NO: 2827 - DNA, 22 bp, Artificial Sequence
  chemically synthesized
cgccgcctctggcccactgttt

SEQ ID NO: 2828 - DNA, 22 bp, Artificial Sequence
  chemically synthesized
tggcccactgtttccccttccc

SEQ ID NO: 2829 - DNA, 22 bp, Artificial Sequence
  chemically synthesized
gcccactgtttccccttcccag

SEQ ID NO: 2830 - DNA, 22 bp, Artificial Sequence
  chemically synthesized
tttccccttcccaggcaggtcc

SEQ ID NO: 2831 - DNA, 22 bp, Artificial Sequence
  chemically synthesized
ccccttcccaggcaggtcctgc

SEQ ID NO: 2832 - DNA, 22 bp, Artificial Sequence
  chemically synthesized
cccttcccaggcaggtcctgct

SEQ ID NO: 2833 - DNA, 22 bp, Artificial Sequence
  chemically synthesized
cccaggcaggtcctgctttctc

SEQ ID NO: 2834 - DNA, 22 bp, Artificial Sequence
  chemically synthesized
ccaggcaggtcctgctttctct

SEQ ID NO: 2835 - DNA, 22 bp, Artificial Sequence
  chemically synthesized
ctttctctgacctgcattctct

SEQ ID NO: 2836 - DNA, 22 bp, Artificial Sequence
  chemically synthesized
tctctgacctgcattctctccc

SEQ ID NO: 2837 - DNA, 22 bp, Artificial Sequence
  chemically synthesized
ctctgacctgcattctctcccc

SEQ ID NO: 2838 - DNA, 22 bp, Artificial Sequence
  chemically synthesized
tctgacctgcattctctcccct

SEQ ID NO: 2839 - DNA, 22 bp, Artificial Sequence
  chemically synthesized
tgacctgcattctctcccctgg

SEQ ID NO: 2840 - DNA, 22 bp, Artificial Sequence
  chemically synthesized
acctgcattctctcccctgggc

SEQ ID NO: 2841 - DNA, 22 bp, Artificial Sequence
  chemically synthesized
cattctctcccctgggcctgtg

SEQ ID NO: 2842 - DNA, 22 bp, Artificial Sequence
  chemically synthesized
tctcccctgggcctgtgccgct

SEQ ID NO: 2843 - DNA, 22 bp, Artificial Sequence
  chemically synthesized
tcccctgggcctgtgccgcttt

SEQ ID NO: 2844 - DNA, 22 bp, Artificial Sequence
  chemically synthesized
ccctgggcctgtgccgctttct

SEQ ID NO: 2845 - DNA, 22 bp, Artificial Sequence
  chemically synthesized
ggcctgtgccgctttctgtctg

SEQ ID NO: 2846 - DNA, 22 bp, Artificial Sequence
  chemically synthesized
tgccgctttctgtctgcagctt

SEQ ID NO: 2847 - DNA, 22 bp, Artificial Sequence
  chemically synthesized
tctgtctgcagcttgtggcctg

SEQ ID NO: 2848 - DNA, 22 bp, Artificial Sequence
  chemically synthesized
ctgtctgcagcttgtggcctgg

SEQ ID NO: 2849 - DNA, 22 bp, Artificial Sequence
  chemically synthesized
tgtctgcagcttgtggcctggg

SEQ ID NO: 2850 - DNA, 22 bp, Artificial Sequence
  chemically synthesized
tctgcagcttgtggcctgggtc

SEQ ID NO: 2851 - DNA, 22 bp, Artificial Sequence
  chemically synthesized
cagcttgtggcctgggtcacct

SEQ ID NO: 2852 - DNA, 22 bp, Artificial Sequence
  chemically synthesized
gtggcctgggtcacctctacgg

SEQ ID NO: 2853 - DNA, 22 bp, Artificial Sequence
  chemically synthesized
tggcctgggtcacctctacggc

SEQ ID NO: 2854 - DNA, 22 bp, Artificial Sequence
  chemically synthesized
ggtcacctctacggctggccca

SEQ ID NO: 2855 - DNA, 22 bp, Artificial Sequence
  chemically synthesized
tacggctggcccagatccttcc

SEQ ID NO: 2856 - DNA, 22 bp, Artificial Sequence
  chemically synthesized
cggctggcccagatccttccct

SEQ ID NO: 2857 - DNA, 22 bp, Artificial Sequence
  chemically synthesized
gcccagatccttccctgccgcc

SEQ ID NO: 2858 - DNA, 22 bp, Artificial Sequence
  chemically synthesized
ccctgccgcctccttcaggttc

SEQ ID NO: 2859 - DNA, 22 bp, Artificial Sequence
  chemically synthesized
cctgccgcctccttcaggttcc

SEQ ID NO: 2860 - DNA, 22 bp, Artificial Sequence
  chemically synthesized
ccgcctccttcaggttccgtct

SEQ ID NO: 2861 - DNA, 22 bp, Artificial Sequence
  chemically synthesized
cttcaggttccgtcttcctcca

SEQ ID NO: 2862 - DNA, 22 bp, Artificial Sequence
  chemically synthesized
caggttccgtcttcctccactc

SEQ ID NO: 2863 - DNA, 22 bp, Artificial Sequence
  chemically synthesized
aggttccgtcttcctccactcc

SEQ ID NO: 2864 - DNA, 22 bp, Artificial Sequence
  chemically synthesized
cgtcttcctccactccctcttc

SEQ ID NO: 2865 - DNA, 22 bp, Artificial Sequence
  chemically synthesized
cctccactccctcttccccttg

SEQ ID NO: 2866 - DNA, 22 bp, Artificial Sequence
  chemically synthesized
ctccactccctcttccccttgc

SEQ ID NO: 2867 - DNA, 22 bp, Artificial Sequence
  chemically synthesized
cactccctcttccccttgctct

SEQ ID NO: 2868 - DNA, 22 bp, Artificial Sequence
  chemically synthesized
cctcttccccttgctctctgct

SEQ ID NO: 2869 - DNA, 22 bp, Artificial Sequence
  chemically synthesized
ttccccttgctctctgctgtgt

SEQ ID NO: 2870 - DNA, 22 bp, Artificial Sequence
  chemically synthesized
ccccttgctctctgctgtgttg

SEQ ID NO: 2871 - DNA, 22 bp, Artificial Sequence
  chemically synthesized
cccttgctctctgctgtgttgc

SEQ ID NO: 2872 - DNA, 22 bp, Artificial Sequence
  chemically synthesized
gctctctgctgtgttgctgccc

SEQ ID NO: 2873 - DNA, 22 bp, Artificial Sequence
  chemically synthesized
ctctctgctgtgttgctgccca

SEQ ID NO: 2874 - DNA, 22 bp, Artificial Sequence
  chemically synthesized
tctgctgtgttgctgcccaagg

SEQ ID NO: 2875 - DNA, 22 bp, Artificial Sequence
  chemically synthesized
tgctgtgttgctgcccaaggat

SEQ ID NO: 2876 - DNA, 22 bp, Artificial Sequence
  chemically synthesized
ctgtgttgctgcccaaggatgc

SEQ ID NO: 2877 - DNA, 22 bp, Artificial Sequence
  chemically synthesized
tgttgctgcccaaggatgctct

SEQ ID NO: 2878 - DNA, 22 bp, Artificial Sequence
  chemically synthesized
ctgcccaaggatgctctttccg

SEQ ID NO: 2879 - DNA, 22 bp, Artificial Sequence
  chemically synthesized
cccaaggatgctctttccggag

SEQ ID NO: 2880 - DNA, 22 bp, Artificial Sequence
  chemically synthesized
tttccggagcacttccttctcg

SEQ ID NO: 2881 - DNA, 22 bp, Artificial Sequence
  chemically synthesized
tccggagcacttccttctcggc

SEQ ID NO: 2882 - DNA, 22 bp, Artificial Sequence
  chemically synthesized
ccggagcacttccttctcggcg

SEQ ID NO: 2883 - DNA, 22 bp, Artificial Sequence
  chemically synthesized
cggagcacttccttctcggcgc

SEQ ID NO: 2884 - DNA, 22 bp, Artificial Sequence
  chemically synthesized
ccttctcggcgctgcaccacgt

SEQ ID NO: 2885 - DNA, 22 bp, Artificial Sequence
  chemically synthesized
cttctcggcgctgcaccacgtg

SEQ ID NO: 2886 - DNA, 22 bp, Artificial Sequence
  chemically synthesized
ctcggcgctgcaccacgtgatg

SEQ ID NO: 2887 - DNA, 22 bp, Artificial Sequence
  chemically synthesized
tcggcgctgcaccacgtgatgt

SEQ ID NO: 2888 - DNA, 22 bp, Artificial Sequence
  chemically synthesized
ggcgctgcaccacgtgatgtcc

SEQ ID NO: 2889 - DNA, 22 bp, Artificial Sequence
  chemically synthesized
caccacgtgatgtcctctgagc

SEQ ID NO: 2890 - DNA, 22 bp, Artificial Sequence
  chemically synthesized
tgagcggatcctccccgtgtct

SEQ ID NO: 2891 - DNA, 22 bp, Artificial Sequence
  chemically synthesized
agcggatcctccccgtgtctgg

SEQ ID NO: 2892 - DNA, 22 bp, Artificial Sequence
  chemically synthesized
cccgtgtctgggtcctctccgg

SEQ ID NO: 2893 - DNA, 22 bp, Artificial Sequence
  chemically synthesized
ggtcctctccgggcatctctcc

SEQ ID NO: 2894 - DNA, 22 bp, Artificial Sequence
  chemically synthesized
tccgggcatctctcctccctca

SEQ ID NO: 2895 - DNA, 22 bp, Artificial Sequence
  chemically synthesized
cgggcatctctcctccctcacc

SEQ ID NO: 2896 - DNA, 22 bp, Artificial Sequence
  chemically synthesized
tcctccctcacccaaccccatg

SEQ ID NO: 2897 - DNA, 22 bp, Artificial Sequence
  chemically synthesized
ctccctcacccaaccccatgcc

SEQ ID NO: 2898 - DNA, 22 bp, Artificial Sequence
  chemically synthesized
cctcacccaaccccatgccgtc

SEQ ID NO: 2899 - DNA, 22 bp, Artificial Sequence
  chemically synthesized
acccaaccccatgccgtcttca

SEQ ID NO: 2900 - DNA, 22 bp, Artificial Sequence
  chemically synthesized
cactcgctgggttcccttttcc

SEQ ID NO: 2901 - DNA, 22 bp, Artificial Sequence
  chemically synthesized
actcgctgggttcccttttcct

SEQ ID NO: 2902 - DNA, 22 bp, Artificial Sequence
  chemically synthesized
gctgggttcccttttccttctc

SEQ ID NO: 2903 - DNA, 22 bp, Artificial Sequence
  chemically synthesized
ggttcccttttccttctccttc

SEQ ID NO: 2904 - DNA, 22 bp, Artificial Sequence
  chemically synthesized
ccttttccttctccttctgggg

SEQ ID NO: 2905 - DNA, 22 bp, Artificial Sequence
  chemically synthesized
ttccttctccttctggggcctg

SEQ ID NO: 2906 - DNA, 22 bp, Artificial Sequence
  chemically synthesized
tccttctccttctggggcctgt

SEQ ID NO: 2907 - DNA, 22 bp, Artificial Sequence
  chemically synthesized
ccttctccttctggggcctgtg

SEQ ID NO: 2908 - DNA, 22 bp, Artificial Sequence
  chemically synthesized
cttctccttctggggcctgtgc

SEQ ID NO: 2909 - DNA, 22 bp, Artificial Sequence
  chemically synthesized
ctccttctggggcctgtgccat

SEQ ID NO: 2910 - DNA, 22 bp, Artificial Sequence
  chemically synthesized
tccttctggggcctgtgccatc

SEQ ID NO: 2911 - DNA, 22 bp, Artificial Sequence
  chemically synthesized
cttctggggcctgtgccatctc

SEQ ID NO: 2912 - DNA, 22 bp, Artificial Sequence
  chemically synthesized
ctggggcctgtgccatctctcg

SEQ ID NO: 2913 - DNA, 22 bp, Artificial Sequence
  chemically synthesized
tggggcctgtgccatctctcgt

SEQ ID NO: 2914 - DNA, 22 bp, Artificial Sequence
  chemically synthesized
gggcctgtgccatctctcgttt

SEQ ID NO: 2915 - DNA, 22 bp, Artificial Sequence
  chemically synthesized
tgccatctctcgtttcttagga

SEQ ID NO: 2916 - DNA, 22 bp, Artificial Sequence
  chemically synthesized
tcgtttcttaggatggccttct

SEQ ID NO: 2917 - DNA, 22 bp, Artificial Sequence
  chemically synthesized
gtttcttaggatggccttctcc

SEQ ID NO: 2918 - DNA, 22 bp, Artificial Sequence
  chemically synthesized
cttaggatggccttctccgacg

SEQ ID NO: 2919 - DNA, 22 bp, Artificial Sequence
  chemically synthesized
ttaggatggccttctccgacgg

SEQ ID NO: 2920 - DNA, 22 bp, Artificial Sequence
  chemically synthesized
aggatggccttctccgacggat

SEQ ID NO: 2921 - DNA, 22 bp, Artificial Sequence
  chemically synthesized
ggatggccttctccgacggatg

SEQ ID NO: 2922 - DNA, 22 bp, Artificial Sequence
  chemically synthesized
ctccgacggatgtctcccttgc

SEQ ID NO: 2923 - DNA, 22 bp, Artificial Sequence
  chemically synthesized
tccgacggatgtctcccttgcg

SEQ ID NO: 2924 - DNA, 22 bp, Artificial Sequence
  chemically synthesized
cgacggatgtctcccttgcgtc

SEQ ID NO: 2925 - DNA, 22 bp, Artificial Sequence
  chemically synthesized
ccttgcgtcccgcctccccttc

SEQ ID NO: 2926 - DNA, 22 bp, Artificial Sequence
  chemically synthesized
gcgtcccgcctccccttcttgt

SEQ ID NO: 2927 - DNA, 22 bp, Artificial Sequence
  chemically synthesized
cgtcccgcctccccttcttgta

SEQ ID NO: 2928 - DNA, 22 bp, Artificial Sequence
  chemically synthesized
cccttcttgtaggcctgcatca

SEQ ID NO: 2929 - DNA, 22 bp, Artificial Sequence
  chemically synthesized
cttgtaggcctgcatcatcacc

SEQ ID NO: 2930 - DNA, 22 bp, Artificial Sequence
  chemically synthesized
ttgtaggcctgcatcatcaccg

SEQ ID NO: 2931 - DNA, 22 bp, Artificial Sequence
  chemically synthesized
gtaggcctgcatcatcaccgtt

SEQ ID NO: 2932 - DNA, 22 bp, Artificial Sequence
  chemically synthesized
taggcctgcatcatcaccgttt

SEQ ID NO: 2933 - DNA, 22 bp, Artificial Sequence
  chemically synthesized
catcatcaccgtttttctggac

SEQ ID NO: 2934 - DNA, 22 bp, Artificial Sequence
  chemically synthesized
ttctggacaaccccaaagtacc

SEQ ID NO: 2935 - DNA, 22 bp, Artificial Sequence
  chemically synthesized
tctggacaaccccaaagtaccc

SEQ ID NO: 2936 - DNA, 22 bp, Artificial Sequence
  chemically synthesized
ctggacaaccccaaagtacccc

SEQ ID NO: 2937 - DNA, 22 bp, Artificial Sequence
  chemically synthesized
tggacaaccccaaagtaccccg

SEQ ID NO: 2938 - DNA, 22 bp, Artificial Sequence
  chemically synthesized
gacaaccccaaagtaccccgtc

SEQ ID NO: 2939 - DNA, 22 bp, Artificial Sequence
  chemically synthesized
cctggctttagccacctctcca

SEQ ID NO: 2940 - DNA, 22 bp, Artificial Sequence
  chemically synthesized
gctttagccacctctccatcct

SEQ ID NO: 2941 - DNA, 22 bp, Artificial Sequence
  chemically synthesized
tagccacctctccatcctcttg

SEQ ID NO: 2942 - DNA, 22 bp, Artificial Sequence
  chemically synthesized
agccacctctccatcctcttgc

SEQ ID NO: 2943 - DNA, 22 bp, Artificial Sequence
  chemically synthesized
gccacctctccatcctcttgct

SEQ ID NO: 2944 - DNA, 22 bp, Artificial Sequence
  chemically synthesized
tccatcctcttgctttctttgc

SEQ ID NO: 2945 - DNA, 22 bp, Artificial Sequence
  chemically synthesized
catcctcttgctttctttgcct

SEQ ID NO: 2946 - DNA, 22 bp, Artificial Sequence
  chemically synthesized
ttgctttctttgcctggacacc

SEQ ID NO: 2947 - DNA, 22 bp, Artificial Sequence
  chemically synthesized
gctttctttgcctggacacccc

SEQ ID NO: 2948 - DNA, 22 bp, Artificial Sequence
  chemically synthesized
ctttctttgcctggacaccccg

SEQ ID NO: 2949 - DNA, 22 bp, Artificial Sequence
  chemically synthesized
tctttgcctggacaccccgttc

SEQ ID NO: 2950 - DNA, 22 bp, Artificial Sequence
  chemically synthesized
ctttgcctggacaccccgttct

SEQ ID NO: 2951 - DNA, 22 bp, Artificial Sequence
  chemically synthesized
tttgcctggacaccccgttctc

SEQ ID NO: 2952 - DNA, 22 bp, Artificial Sequence
  chemically synthesized
tgcctggacaccccgttctcct

SEQ ID NO: 2953 - DNA, 22 bp, Artificial Sequence
  chemically synthesized
gcctggacaccccgttctcctg

SEQ ID NO: 2954 - DNA, 22 bp, Artificial Sequence
  chemically synthesized
cctggacaccccgttctcctgt

SEQ ID NO: 2955 - DNA, 22 bp, Artificial Sequence
  chemically synthesized
gacaccccgttctcctgtggat

SEQ ID NO: 2956 - DNA, 22 bp, Artificial Sequence
  chemically synthesized
tcctgtggattcgggtcacctc

SEQ ID NO: 2957 - DNA, 22 bp, Artificial Sequence
  chemically synthesized
ctgtggattcgggtcacctctc

SEQ ID NO: 2958 - DNA, 22 bp, Artificial Sequence
  chemically synthesized
tggattcgggtcacctctcact

SEQ ID NO: 2959 - DNA, 22 bp, Artificial Sequence
  chemically synthesized
gggtcacctctcactcctttca

SEQ ID NO: 2960 - DNA, 22 bp, Artificial Sequence
  chemically synthesized
tcactcctttcatttgggcagc

SEQ ID NO: 2961 - DNA, 22 bp, Artificial Sequence
  chemically synthesized
actcctttcatttgggcagctc

SEQ ID NO: 2962 - DNA, 22 bp, Artificial Sequence
  chemically synthesized
ctttcatttgggcagctcccct

SEQ ID NO: 2963 - DNA, 22 bp, Artificial Sequence
  chemically synthesized
tcatttgggcagctcccctacc

SEQ ID NO: 2964 - DNA, 22 bp, Artificial Sequence
  chemically synthesized
catttgggcagctcccctaccc

SEQ ID NO: 2965 - DNA, 22 bp, Artificial Sequence
  chemically synthesized
atttgggcagctcccctacccc

SEQ ID NO: 2966 - DNA, 22 bp, Artificial Sequence
  chemically synthesized
gggcagctcccctacccccctt

SEQ ID NO: 2967 - DNA, 22 bp, Artificial Sequence
  chemically synthesized
ggcagctcccctacccccctta

SEQ ID NO: 2968 - DNA, 22 bp, Artificial Sequence
  chemically synthesized
ccctaccccccttacctctcta

SEQ ID NO: 2969 - DNA, 22 bp, Artificial Sequence
  chemically synthesized
ccccccttacctctctagtctg

SEQ ID NO: 2970 - DNA, 22 bp, Artificial Sequence
  chemically synthesized
acctctctagtctgtgctagct

SEQ ID NO: 2971 - DNA, 22 bp, Artificial Sequence
  chemically synthesized
cctctctagtctgtgctagctc

SEQ ID NO: 2972 - DNA, 22 bp, Artificial Sequence
  chemically synthesized
tctagtctgtgctagctcttcc

SEQ ID NO: 2973 - DNA, 22 bp, Artificial Sequence
  chemically synthesized
tagtctgtgctagctcttccag

SEQ ID NO: 2974 - DNA, 22 bp, Artificial Sequence
  chemically synthesized
gtctgtgctagctcttccagcc

SEQ ID NO: 2975 - DNA, 22 bp, Artificial Sequence
  chemically synthesized
tgctagctcttccagccccctg

SEQ ID NO: 2976 - DNA, 22 bp, Artificial Sequence
  chemically synthesized
gctcttccagccccctgtcatg

SEQ ID NO: 2977 - DNA, 22 bp, Artificial Sequence
  chemically synthesized
ttccagccccctgtcatggcat

SEQ ID NO: 2978 - DNA, 22 bp, Artificial Sequence
  chemically synthesized
ccagccccctgtcatggcatct

SEQ ID NO: 2979 - DNA, 22 bp, Artificial Sequence
  chemically synthesized
cagccccctgtcatggcatctt

SEQ ID NO: 2980 - DNA, 22 bp, Artificial Sequence
  chemically synthesized
tcatggcatcttccaggggtcc

SEQ ID NO: 2981 - DNA, 22 bp, Artificial Sequence
  chemically synthesized
ccaggggtccgagagctcagct

SEQ ID NO: 2982 - DNA, 22 bp, Artificial Sequence
  chemically synthesized
caggggtccgagagctcagcta

SEQ ID NO: 2983 - DNA, 22 bp, Artificial Sequence
  chemically synthesized
agctagtcttcttcctccaacc

SEQ ID NO: 2984 - DNA, 22 bp, Artificial Sequence
  chemically synthesized
gtcttcttcctccaacccgggc

SEQ ID NO: 2985 - DNA, 22 bp, Artificial Sequence
  chemically synthesized
cttcctccaacccgggccccta

SEQ ID NO: 2986 - DNA, 22 bp, Artificial Sequence
  chemically synthesized
ttcctccaacccgggcccctat

SEQ ID NO: 2987 - DNA, 22 bp, Artificial Sequence
  chemically synthesized
cctccaacccgggcccctatgt

SEQ ID NO: 2988 - DNA, 22 bp, Artificial Sequence
  chemically synthesized
ctccaacccgggcccctatgtc

SEQ ID NO: 2989 - DNA, 22 bp, Artificial Sequence
  chemically synthesized
caacccgggcccctatgtccac

SEQ ID NO: 2990 - DNA, 22 bp, Artificial Sequence
  chemically synthesized
tgtccacttcaggacagcatgt

SEQ ID NO: 2991 - DNA, 22 bp, Artificial Sequence
  chemically synthesized
caggacagcatgtttgctgcct

SEQ ID NO: 2992 - DNA, 22 bp, Artificial Sequence
  chemically synthesized
aggacagcatgtttgctgcctc

SEQ ID NO: 2993 - DNA, 22 bp, Artificial Sequence
  chemically synthesized
gctgcctccagggatcctgtgt

SEQ ID NO: 2994 - DNA, 22 bp, Artificial Sequence
  chemically synthesized
ctgcctccagggatcctgtgtc

SEQ ID NO: 2995 - DNA, 22 bp, Artificial Sequence
  chemically synthesized
cctccagggatcctgtgtcccc

SEQ ID NO: 2996 - DNA, 22 bp, Artificial Sequence
  chemically synthesized
cagggatcctgtgtccccgagc

SEQ ID NO: 2997 - DNA, 22 bp, Artificial Sequence
  chemically synthesized
tgtccccgagctgggaccacct

SEQ ID NO: 2998 - DNA, 22 bp, Artificial Sequence
  chemically synthesized
ggaccaccttatattcccaggg

SEQ ID NO: 2999 - DNA, 22 bp, Artificial Sequence
  chemically synthesized
atattcccagggccggttaatg

SEQ ID NO: 3000 - DNA, 22 bp, Artificial Sequence
  chemically synthesized
tattcccagggccggttaatgt

SEQ ID NO: 3001 - DNA, 22 bp, Artificial Sequence
  chemically synthesized
ccagggccggttaatgtggctc

SEQ ID NO: 3002 - DNA, 22 bp, Artificial Sequence
  chemically synthesized
atgtggctctggttctgggtac

SEQ ID NO: 3003 - DNA, 22 bp, Artificial Sequence
  chemically synthesized
tggttctgggtacttttatctg

SEQ ID NO: 3004 - DNA, 22 bp, Artificial Sequence
  chemically synthesized
gttctgggtacttttatctgtc

SEQ ID NO: 3005 - DNA, 22 bp, Artificial Sequence
  chemically synthesized
tgggtacttttatctgtcccct

SEQ ID NO: 3006 - DNA, 22 bp, Artificial Sequence
  chemically synthesized
ggtacttttatctgtcccctcc

SEQ ID NO: 3007 - DNA, 22 bp, Artificial Sequence
  chemically synthesized
ttatctgtcccctccaccccac

SEQ ID NO: 3008 - DNA, 22 bp, Artificial Sequence
  chemically synthesized
tatctgtcccctccaccccaca

SEQ ID NO: 3009 - DNA, 22 bp, Artificial Sequence
  chemically synthesized
atctgtcccctccaccccacag

SEQ ID NO: 3010 - DNA, 22 bp, Artificial Sequence
  chemically synthesized
tctgtcccctccaccccacagt

SEQ ID NO: 3011 - DNA, 22 bp, Artificial Sequence
  chemically synthesized
tcccctccaccccacagtgggg

SEQ ID NO: 3012 - DNA, 22 bp, Artificial Sequence
  chemically synthesized
caccccacagtggggccactag

SEQ ID NO: 3013 - DNA, 22 bp, Artificial Sequence
  chemically synthesized
gggacaggattggtgacagaaa

SEQ ID NO: 3014 - DNA, 22 bp, Artificial Sequence
  chemically synthesized
gtgacagaaaagccccatcctt

SEQ ID NO: 3015 - DNA, 22 bp, Artificial Sequence
  chemically synthesized
aggcctcctccttcctagtctc

SEQ ID NO: 3016 - DNA, 22 bp, Artificial Sequence
  chemically synthesized
ggcctcctccttcctagtctcc

SEQ ID NO: 3017 - DNA, 22 bp, Artificial Sequence
  chemically synthesized
ctccttcctagtctcctgatat

SEQ ID NO: 3018 - DNA, 22 bp, Artificial Sequence
  chemically synthesized
cttcctagtctcctgatattgg

SEQ ID NO: 3019 - DNA, 22 bp, Artificial Sequence
  chemically synthesized
cctagtctcctgatattgggtc

SEQ ID NO: 3020 - DNA, 22 bp, Artificial Sequence
  chemically synthesized
ctagtctcctgatattgggtct

SEQ ID NO: 3021 - DNA, 22 bp, Artificial Sequence
  chemically synthesized
gtctcctgatattgggtctaac

SEQ ID NO: 3022 - DNA, 22 bp, Artificial Sequence
  chemically synthesized
ctgatattgggtctaaccccca

SEQ ID NO: 3023 - DNA, 22 bp, Artificial Sequence
  chemically synthesized
atattgggtctaacccccacct

SEQ ID NO: 3024 - DNA, 22 bp, Artificial Sequence
  chemically synthesized
ggtctaacccccacctcctgtt

SEQ ID NO: 3025 - DNA, 22 bp, Artificial Sequence
  chemically synthesized
acccccacctcctgttaggcag

SEQ ID NO: 3026 - DNA, 22 bp, Artificial Sequence
  chemically synthesized
ctgttaggcagattccttatct

SEQ ID NO: 3027 - DNA, 22 bp, Artificial Sequence
  chemically synthesized
ttaggcagattccttatctggt

SEQ ID NO: 3028 - DNA, 22 bp, Artificial Sequence
  chemically synthesized
ggcagattccttatctggtgac

SEQ ID NO: 3029 - DNA, 22 bp, Artificial Sequence
  chemically synthesized
cttatctggtgacacaccccca

SEQ ID NO: 3030 - DNA, 22 bp, Artificial Sequence
  chemically synthesized
atctggtgacacacccccattt

SEQ ID NO: 3031 - DNA, 22 bp, Artificial Sequence
  chemically synthesized
tctggtgacacacccccatttc

SEQ ID NO: 3032 - DNA, 22 bp, Artificial Sequence
  chemically synthesized
gtgacacacccccatttcctgg

SEQ ID NO: 3033 - DNA, 22 bp, Artificial Sequence
  chemically synthesized
cctggagccatctctctccttg

SEQ ID NO: 3034 - DNA, 22 bp, Artificial Sequence
  chemically synthesized
ctggagccatctctctccttgc

SEQ ID NO: 3035 - DNA, 22 bp, Artificial Sequence
  chemically synthesized
gagccatctctctccttgccag

SEQ ID NO: 3036 - DNA, 22 bp, Artificial Sequence
  chemically synthesized
tctccttgccagaacctctaag

SEQ ID NO: 3037 - DNA, 22 bp, Artificial Sequence
  chemically synthesized
tccttgccagaacctctaaggt

SEQ ID NO: 3038 - DNA, 22 bp, Artificial Sequence
  chemically synthesized
cttgccagaacctctaaggttt

SEQ ID NO: 3039 - DNA, 22 bp, Artificial Sequence
  chemically synthesized
gccagaacctctaaggtttgct

SEQ ID NO: 3040 - DNA, 22 bp, Artificial Sequence
  chemically synthesized
ccagaacctctaaggtttgctt

SEQ ID NO: 3041 - DNA, 22 bp, Artificial Sequence
  chemically synthesized
taaggtttgcttacgatggagc

SEQ ID NO: 3042 - DNA, 22 bp, Artificial Sequence
  chemically synthesized
aggtttgcttacgatggagcca

SEQ ID NO: 3043 - DNA, 22 bp, Artificial Sequence
  chemically synthesized
gcttacgatggagccagagagg

SEQ ID NO: 3044 - DNA, 22 bp, Artificial Sequence
  chemically synthesized
cttacgatggagccagagagga

SEQ ID NO: 3045 - DNA, 22 bp, Artificial Sequence
  chemically synthesized
acgatggagccagagaggatcc

SEQ ID NO: 3046 - DNA, 22 bp, Artificial Sequence
  chemically synthesized
cgatggagccagagaggatcct

SEQ ID NO: 3047 - DNA, 22 bp, Artificial Sequence
  chemically synthesized
ggagggagagcttggcaggggg

SEQ ID NO: 3048 - DNA, 22 bp, Artificial Sequence
  chemically synthesized
ggcagggggtgggagggaaggg

SEQ ID NO: 3049 - DNA, 22 bp, Artificial Sequence
  chemically synthesized
gcagggggtgggagggaagggg

SEQ ID NO: 3050 - DNA, 22 bp, Artificial Sequence
  chemically synthesized
cccggttctcagtggccaccct

SEQ ID NO: 3051 - DNA, 22 bp, Artificial Sequence
  chemically synthesized
tcagtggccaccctgcgctacc

SEQ ID NO: 3052 - DNA, 22 bp, Artificial Sequence
  chemically synthesized
agtggccaccctgcgctaccct

SEQ ID NO: 3053 - DNA, 22 bp, Artificial Sequence
  chemically synthesized
cgctaccctctcccagaacctg

SEQ ID NO: 3054 - DNA, 22 bp, Artificial Sequence
  chemically synthesized
ccctctcccagaacctgagctg

SEQ ID NO: 3055 - DNA, 22 bp, Artificial Sequence
  chemically synthesized
tcccagaacctgagctgctctg

SEQ ID NO: 3056 - DNA, 22 bp, Artificial Sequence
  chemically synthesized
ccagaacctgagctgctctgac

SEQ ID NO: 3057 - DNA, 22 bp, Artificial Sequence
  chemically synthesized
agctgctctgacgcggccgtct

SEQ ID NO: 3058 - DNA, 22 bp, Artificial Sequence
  chemically synthesized
ctctgacgcggccgtctggtgc

SEQ ID NO: 3059 - DNA, 22 bp, Artificial Sequence
  chemically synthesized
tgacgcggccgtctggtgcgtt

SEQ ID NO: 3060 - DNA, 22 bp, Artificial Sequence
  chemically synthesized
acgcggccgtctggtgcgtttc

SEQ ID NO: 3061 - DNA, 22 bp, Artificial Sequence
  chemically synthesized
gtgcgtttcactgatcctggtg

SEQ ID NO: 3062 - DNA, 22 bp, Artificial Sequence
  chemically synthesized
cactgatcctggtgctgcagct

SEQ ID NO: 3063 - DNA, 22 bp, Artificial Sequence
  chemically synthesized
actgatcctggtgctgcagctt

SEQ ID NO: 3064 - DNA, 22 bp, Artificial Sequence
  chemically synthesized
atcctggtgctgcagcttcctt

SEQ ID NO: 3065 - DNA, 22 bp, Artificial Sequence
  chemically synthesized
gtgctgcagcttccttacactt

SEQ ID NO: 3066 - DNA, 22 bp, Artificial Sequence
  chemically synthesized
cagcttccttacacttcccaag

SEQ ID NO: 3067 - DNA, 22 bp, Artificial Sequence
  chemically synthesized
ccttacacttcccaagaggaga

SEQ ID NO: 3068 - DNA, 22 bp, Artificial Sequence
  chemically synthesized
cttacacttcccaagaggagaa

SEQ ID NO: 3069 - DNA, 22 bp, Artificial Sequence
  chemically synthesized
acacttcccaagaggagaagca

SEQ ID NO: 3070 - DNA, 22 bp, Artificial Sequence
  chemically synthesized
cacttcccaagaggagaagcag

SEQ ID NO: 3071 - DNA, 22 bp, Artificial Sequence
  chemically synthesized
cccaagaggagaagcagtttgg

SEQ ID NO: 3072 - DNA, 22 bp, Artificial Sequence
  chemically synthesized
ccaagaggagaagcagtttgga

SEQ ID NO: 3073 - DNA, 22 bp, Artificial Sequence
  chemically synthesized
ggaaaaacaaaatcagaataag

SEQ ID NO: 3074 - DNA, 22 bp, Artificial Sequence
  chemically synthesized
gaaaaacaaaatcagaataagt

SEQ ID NO: 3075 - DNA, 22 bp, Artificial Sequence
  chemically synthesized
gtcctgagttctaactttggct

SEQ ID NO: 3076 - DNA, 22 bp, Artificial Sequence
  chemically synthesized
agttctaactttggctcttcac

SEQ ID NO: 3077 - DNA, 22 bp, Artificial Sequence
  chemically synthesized
taactttggctcttcacctttc

SEQ ID NO: 3078 - DNA, 22 bp, Artificial Sequence
  chemically synthesized
actttggctcttcacctttcta

SEQ ID NO: 3079 - DNA, 22 bp, Artificial Sequence
  chemically synthesized
tggctcttcacctttctagtcc

SEQ ID NO: 3080 - DNA, 22 bp, Artificial Sequence
  chemically synthesized
ggctcttcacctttctagtccc

SEQ ID NO: 3081 - DNA, 22 bp, Artificial Sequence
  chemically synthesized
gctcttcacctttctagtcccc

SEQ ID NO: 3082 - DNA, 22 bp, Artificial Sequence
  chemically synthesized
ttcacctttctagtccccaatt

SEQ ID NO: 3083 - DNA, 22 bp, Artificial Sequence
  chemically synthesized
cacctttctagtccccaattta

SEQ ID NO: 3084 - DNA, 22 bp, Artificial Sequence
  chemically synthesized
acctttctagtccccaatttat

SEQ ID NO: 3085 - DNA, 22 bp, Artificial Sequence
  chemically synthesized
tctagtccccaatttatattgt

SEQ ID NO: 3086 - DNA, 22 bp, Artificial Sequence
  chemically synthesized
ctagtccccaatttatattgtt

SEQ ID NO: 3087 - DNA, 22 bp, Artificial Sequence
  chemically synthesized
tagtccccaatttatattgttc

SEQ ID NO: 3088 - DNA, 22 bp, Artificial Sequence
  chemically synthesized
gtccccaatttatattgttcct

SEQ ID NO: 3089 - DNA, 22 bp, Artificial Sequence
  chemically synthesized
atattgttcctccgtgcgtcag

SEQ ID NO: 3090 - DNA, 22 bp, Artificial Sequence
  chemically synthesized
tattgttcctccgtgcgtcagt

SEQ ID NO: 3091 - DNA, 22 bp, Artificial Sequence
  chemically synthesized
ttcctccgtgcgtcagttttac

SEQ ID NO: 3092 - DNA, 22 bp, Artificial Sequence
  chemically synthesized
ctccgtgcgtcagttttacctg

SEQ ID NO: 3093 - DNA, 22 bp, Artificial Sequence
  chemically synthesized
cgtgcgtcagttttacctgtga

SEQ ID NO: 3094 - DNA, 22 bp, Artificial Sequence
  chemically synthesized
tacctgtgagataaggccagta

SEQ ID NO: 3095 - DNA, 22 bp, Artificial Sequence
  chemically synthesized
acctgtgagataaggccagtag

SEQ ID NO: 3096 - DNA, 22 bp, Artificial Sequence
  chemically synthesized
cctgtgagataaggccagtagc

SEQ ID NO: 3097 - DNA, 22 bp, Artificial Sequence
  chemically synthesized
tgagataaggccagtagccagc

SEQ ID NO: 3098 - DNA, 22 bp, Artificial Sequence
  chemically synthesized
gcagggctgtggtgaggagggg

SEQ ID NO: 3099 - DNA, 22 bp, Artificial Sequence
  chemically synthesized
tggtgaggaggggggtgtccgt

SEQ ID NO: 3100 - DNA, 22 bp, Artificial Sequence
  chemically synthesized
cctttgtgagaatggtgcgtcc

SEQ ID NO: 3101 - DNA, 22 bp, Artificial Sequence
  chemically synthesized
tgtgagaatggtgcgtcctagg

SEQ ID NO: 3102 - DNA, 22 bp, Artificial Sequence
  chemically synthesized
gtgagaatggtgcgtcctaggt

SEQ ID NO: 3103 - DNA, 22 bp, Artificial Sequence
  chemically synthesized
tgagaatggtgcgtcctaggtg

SEQ ID NO: 3104 - DNA, 22 bp, Artificial Sequence
  chemically synthesized
ggtgttcaccaggtcgtggccg

SEQ ID NO: 3105 - DNA, 22 bp, Artificial Sequence
  chemically synthesized
accaggtcgtggccgcctctac

SEQ ID NO: 3106 - DNA, 22 bp, Artificial Sequence
  chemically synthesized
tactccctttctctttctccat

SEQ ID NO: 3107 - DNA, 22 bp, Artificial Sequence
  chemically synthesized
ctccctttctctttctccatcc

SEQ ID NO: 3108 - DNA, 22 bp, Artificial Sequence
  chemically synthesized
cctttctctttctccatccttc

SEQ ID NO: 3109 - DNA, 22 bp, Artificial Sequence
  chemically synthesized
tctctttctccatccttctttc

SEQ ID NO: 3110 - DNA, 22 bp, Artificial Sequence
  chemically synthesized
ctctttctccatccttctttcc

SEQ ID NO: 3111 - DNA, 22 bp, Artificial Sequence
  chemically synthesized
tctttctccatccttctttcct

SEQ ID NO: 3112 - DNA, 22 bp, Artificial Sequence
  chemically synthesized
tttctccatccttctttcctta

SEQ ID NO: 3113 - DNA, 22 bp, Artificial Sequence
  chemically synthesized
tctccatccttctttccttaaa

SEQ ID NO: 3114 - DNA, 22 bp, Artificial Sequence
  chemically synthesized
ctccatccttctttccttaaag

SEQ ID NO: 3115 - DNA, 22 bp, Artificial Sequence
  chemically synthesized
tccatccttctttccttaaaga

SEQ ID NO: 3116 - DNA, 22 bp, Artificial Sequence
  chemically synthesized
catccttctttccttaaagagt

SEQ ID NO: 3117 - DNA, 22 bp, Artificial Sequence
  chemically synthesized
ctttccttaaagagtccccagt

SEQ ID NO: 3118 - DNA, 22 bp, Artificial Sequence
  chemically synthesized
tttccttaaagagtccccagtg

SEQ ID NO: 3119 - DNA, 22 bp, Artificial Sequence
  chemically synthesized
tccttaaagagtccccagtgct

SEQ ID NO: 3120 - DNA, 22 bp, Artificial Sequence
  chemically synthesized
ccttaaagagtccccagtgcta

SEQ ID NO: 3121 - DNA, 22 bp, Artificial Sequence
  chemically synthesized
cttaaagagtccccagtgctat

SEQ ID NO: 3122 - DNA, 22 bp, Artificial Sequence
  chemically synthesized
aaagagtccccagtgctatctg

SEQ ID NO: 3123 - DNA, 22 bp, Artificial Sequence
  chemically synthesized
aagagtccccagtgctatctgg

SEQ ID NO: 3124 - DNA, 22 bp, Artificial Sequence
  chemically synthesized
tctgggacatattcctccgccc

SEQ ID NO: 3125 - DNA, 22 bp, Artificial Sequence
  chemically synthesized
ggacatattcctccgcccagag

SEQ ID NO: 3126 - DNA, 22 bp, Artificial Sequence
  chemically synthesized
ctccgcccagagcagggtcccg

SEQ ID NO: 3127 - DNA, 22 bp, Artificial Sequence
  chemically synthesized
cgcccagagcagggtcccgctt

SEQ ID NO: 3128 - DNA, 22 bp, Artificial Sequence
  chemically synthesized
ccctaaggccctgctctgggct

SEQ ID NO: 3129 - DNA, 22 bp, Artificial Sequence
  chemically synthesized
cctaaggccctgctctgggctt

SEQ ID NO: 3130 - DNA, 22 bp, Artificial Sequence
  chemically synthesized
aggccctgctctgggcttctgg

SEQ ID NO: 3131 - DNA, 22 bp, Artificial Sequence
  chemically synthesized
ctctgggcttctgggtttgagt

SEQ ID NO: 3132 - DNA, 22 bp, Artificial Sequence
  chemically synthesized
tgggcttctgggtttgagtcct

SEQ ID NO: 3133 - DNA, 22 bp, Artificial Sequence
  chemically synthesized
ggcttctgggtttgagtccttg

SEQ ID NO: 3134 - DNA, 22 bp, Artificial Sequence
  chemically synthesized
ctgggtttgagtccttggcaag

SEQ ID NO: 3135 - DNA, 22 bp, Artificial Sequence
  chemically synthesized
tgggtttgagtccttggcaagc

SEQ ID NO: 3136 - DNA, 22 bp, Artificial Sequence
  chemically synthesized
ggtttgagtccttggcaagccc

SEQ ID NO: 3137 - DNA, 22 bp, Artificial Sequence
  chemically synthesized
gagtccttggcaagcccaggag

SEQ ID NO: 3138 - DNA, 22 bp, Artificial Sequence
  chemically synthesized
agtccttggcaagcccaggaga

SEQ ID NO: 3139 - DNA, 22 bp, Artificial Sequence
  chemically synthesized
ggcaagcccaggagaggcgctc

SEQ ID NO: 3140 - DNA, 22 bp, Artificial Sequence
  chemically synthesized
gcaagcccaggagaggcgctca

SEQ ID NO: 3141 - DNA, 22 bp, Artificial Sequence
  chemically synthesized
aggcttccctgtcccccttcct

SEQ ID NO: 3142 - DNA, 22 bp, Artificial Sequence
  chemically synthesized
ccctgtcccccttcctcgtcca

SEQ ID NO: 3143 - DNA, 22 bp, Artificial Sequence
  chemically synthesized
cctgtcccccttcctcgtccac

SEQ ID NO: 3144 - DNA, 22 bp, Artificial Sequence
  chemically synthesized
tcccccttcctcgtccaccatc

SEQ ID NO: 3145 - DNA, 22 bp, Artificial Sequence
  chemically synthesized
cctcgtccaccatctcatgccc

SEQ ID NO: 3146 - DNA, 22 bp, Artificial Sequence
  chemically synthesized
ctcgtccaccatctcatgcccc

SEQ ID NO: 3147 - DNA, 22 bp, Artificial Sequence
  chemically synthesized
gtccaccatctcatgcccctgg

SEQ ID NO: 3148 - DNA, 22 bp, Artificial Sequence
  chemically synthesized
atgcccctggctctcctgcccc

SEQ ID NO: 3149 - DNA, 22 bp, Artificial Sequence
  chemically synthesized
gctctcctgccccttccctaca

SEQ ID NO: 3150 - DNA, 22 bp, Artificial Sequence
  chemically synthesized
tcctgccccttccctacagggg

SEQ ID NO: 3151 - DNA, 22 bp, Artificial Sequence
  chemically synthesized
ctgccccttccctacaggggtt

SEQ ID NO: 3152 - DNA, 22 bp, Artificial Sequence
  chemically synthesized
ccccttccctacaggggttcct

SEQ ID NO: 3153 - DNA, 22 bp, Artificial Sequence
  chemically synthesized
ccctacaggggttcctggctct

SEQ ID NO: 3154 - DNA, 22 bp, Artificial Sequence
  chemically synthesized
cctacaggggttcctggctctg

SEQ ID NO: 3155 - DNA, 22 bp, Artificial Sequence
  chemically synthesized
caggggttcctggctctgctct

SEQ ID NO: 3156 - DNA, 22 bp, Artificial Sequence
  chemically synthesized
ctggctctgctcttcagactga

SEQ ID NO: 3157 - DNA, 22 bp, Artificial Sequence
  chemically synthesized
gctctgctcttcagactgagcc

SEQ ID NO: 3158 - DNA, 22 bp, Artificial Sequence
  chemically synthesized
tgctcttcagactgagccccgt

SEQ ID NO: 3159 - DNA, 22 bp, Artificial Sequence
  chemically synthesized
ctcttcagactgagccccgttc

SEQ ID NO: 3160 - DNA, 22 bp, Artificial Sequence
  chemically synthesized
ttcagactgagccccgttcccc

SEQ ID NO: 3161 - DNA, 22 bp, Artificial Sequence
  chemically synthesized
cagactgagccccgttcccctg

SEQ ID NO: 3162 - DNA, 22 bp, Artificial Sequence
  chemically synthesized
agactgagccccgttcccctgc

SEQ ID NO: 3163 - DNA, 22 bp, Artificial Sequence
  chemically synthesized
agccccgttcccctgcatcccc

SEQ ID NO: 3164 - DNA, 22 bp, Artificial Sequence
  chemically synthesized
ccctgcatccccgttcccctgc

SEQ ID NO: 3165 - DNA, 22 bp, Artificial Sequence
  chemically synthesized
catccccgttcccctgcatccc

SEQ ID NO: 3166 - DNA, 22 bp, Artificial Sequence
  chemically synthesized
ccctgcatcccccttcccctgc

SEQ ID NO: 3167 - DNA, 22 bp, Artificial Sequence
  chemically synthesized
catcccccttcccctgcatccc

SEQ ID NO: 3168 - DNA, 22 bp, Artificial Sequence
  chemically synthesized
cccctgcatcccccagaggccc

SEQ ID NO: 3169 - DNA, 22 bp, Artificial Sequence
  chemically synthesized
ccctgcatcccccagaggcccc

SEQ ID NO: 3170 - DNA, 22 bp, Artificial Sequence
  chemically synthesized
catcccccagaggccccaggcc

SEQ ID NO: 3171 - DNA, 22 bp, Artificial Sequence
  chemically synthesized
cttggcctggaccccacgagag

SEQ ID NO: 3172 - DNA, 22 bp, Artificial Sequence
  chemically synthesized
ggcctggaccccacgagaggcc

SEQ ID NO: 3173 - DNA, 22 bp, Artificial Sequence
  chemically synthesized
gcctggaccccacgagaggcca

SEQ ID NO: 3174 - DNA, 22 bp, Artificial Sequence
  chemically synthesized
gaccccacgagaggccacccca

SEQ ID NO: 3175 - DNA, 22 bp, Artificial Sequence
  chemically synthesized
tctaccaggctgccttttgggt

SEQ ID NO: 3176 - DNA, 22 bp, Artificial Sequence
  chemically synthesized
ccaggctgccttttgggtggat

SEQ ID NO: 3177 - DNA, 22 bp, Artificial Sequence
  chemically synthesized
ccttttgggtggattctcctcc

SEQ ID NO: 3178 - DNA, 22 bp, Artificial Sequence
  chemically synthesized
ttgggtggattctcctccaact

SEQ ID NO: 3179 - DNA, 22 bp, Artificial Sequence
  chemically synthesized
tgggtggattctcctccaactg

SEQ ID NO: 3180 - DNA, 22 bp, Artificial Sequence
  chemically synthesized
gggtggattctcctccaactgt

SEQ ID NO: 3181 - DNA, 22 bp, Artificial Sequence
  chemically synthesized
ggtggattctcctccaactgtg

SEQ ID NO: 3182 - DNA, 22 bp, Artificial Sequence
  chemically synthesized
tcctccaactgtggggtgactg

SEQ ID NO: 3183 - DNA, 22 bp, Artificial Sequence
  chemically synthesized
ctccaactgtggggtgactgct

SEQ ID NO: 3184 - DNA, 22 bp, Artificial Sequence
  chemically synthesized
caactgtggggtgactgcttgg

SEQ ID NO: 3185 - DNA, 22 bp, Artificial Sequence
  chemically synthesized
tggggtgactgcttggcaaact

SEQ ID NO: 3186 - DNA, 22 bp, Artificial Sequence
  chemically synthesized
cttggcaaactcactcttcggg

SEQ ID NO: 3187 - DNA, 22 bp, Artificial Sequence
  chemically synthesized
ggcaaactcactcttcggggta

SEQ ID NO: 3188 - DNA, 22 bp, Artificial Sequence
  chemically synthesized
gcaaactcactcttcggggtat

SEQ ID NO: 3189 - DNA, 22 bp, Artificial Sequence
  chemically synthesized
actcttcggggtatcccaggag

SEQ ID NO: 3190 - DNA, 22 bp, Artificial Sequence
  chemically synthesized
ttcggggtatcccaggaggcct

SEQ ID NO: 3191 - DNA, 22 bp, Artificial Sequence
  chemically synthesized
cggggtatcccaggaggcctgg

SEQ ID NO: 3192 - DNA, 22 bp, Artificial Sequence
  chemically synthesized
ggggtatcccaggaggcctgga

SEQ ID NO: 3193 - DNA, 22 bp, Artificial Sequence
  chemically synthesized
gagcattggggtgggctggggt

SEQ ID NO: 3194 - DNA, 22 bp, Artificial Sequence
  chemically synthesized
gggtgggctggggttcagagag

SEQ ID NO: 3195 - DNA, 22 bp, Artificial Sequence
  chemically synthesized
gggttcagagaggagggattcc

SEQ ID NO: 3196 - DNA, 22 bp, Artificial Sequence
  chemically synthesized
agagaggagggattcccttctc

SEQ ID NO: 3197 - DNA, 22 bp, Artificial Sequence
  chemically synthesized
ccttctcaggttacgtggccaa

SEQ ID NO: 3198 - DNA, 22 bp, Artificial Sequence
  chemically synthesized
ctcaggttacgtggccaagaag

SEQ ID NO: 3199 - DNA, 22 bp, Artificial Sequence
  chemically synthesized
tcaggttacgtggccaagaagc

SEQ ID NO: 3200 - DNA, 22 bp, Artificial Sequence
  chemically synthesized
aggttacgtggccaagaagcag

SEQ ID NO: 3201 - DNA, 22 bp, Artificial Sequence
  chemically synthesized
cgtggccaagaagcaggggagc

SEQ ID NO: 3202 - DNA, 22 bp, Artificial Sequence
  chemically synthesized
ggtttgggtcaggtctgggtgt

SEQ ID NO: 3203 - DNA, 22 bp, Artificial Sequence
  chemically synthesized
gggtcaggtctgggtgtggggt

SEQ ID NO: 3204 - DNA, 22 bp, Artificial Sequence
  chemically synthesized
ggtcaggtctgggtgtggggtg

SEQ ID NO: 3205 - DNA, 22 bp, Artificial Sequence
  chemically synthesized
ggtgtggggtgaccagcttatg

SEQ ID NO: 3206 - DNA, 22 bp, Artificial Sequence
  chemically synthesized
atgctgtttgcccaggacagcc

SEQ ID NO: 3207 - DNA, 22 bp, Artificial Sequence
  chemically synthesized
tgctgtttgcccaggacagcct

SEQ ID NO: 3208 - DNA, 22 bp, Artificial Sequence
  chemically synthesized
tttgcccaggacagcctagttt

SEQ ID NO: 3209 - DNA, 22 bp, Artificial Sequence
  chemically synthesized
gcccaggacagcctagttttag

SEQ ID NO: 3210 - DNA, 22 bp, Artificial Sequence
  chemically synthesized
cccaggacagcctagttttagc

SEQ ID NO: 3211 - DNA, 22 bp, Artificial Sequence
  chemically synthesized
gttttagcactgaaaccctcag

SEQ ID NO: 3212 - DNA, 22 bp, Artificial Sequence
  chemically synthesized
tagcactgaaaccctcagtcct

SEQ ID NO: 3213 - DNA, 22 bp, Artificial Sequence
  chemically synthesized
agcactgaaaccctcagtccta

SEQ ID NO: 3214 - DNA, 22 bp, Artificial Sequence
  chemically synthesized
gcactgaaaccctcagtcctag

SEQ ID NO: 3215 - DNA, 22 bp, Artificial Sequence
  chemically synthesized
aaaccctcagtcctaggaaaac

SEQ ID NO: 3216 - DNA, 22 bp, Artificial Sequence
  chemically synthesized
agtcctaggaaaacagggatgg

SEQ ID NO: 3217 - DNA, 22 bp, Artificial Sequence
  chemically synthesized
ggaaaacagggatggttggtca

SEQ ID NO: 3218 - DNA, 22 bp, Artificial Sequence
  chemically synthesized
gtcactgtctctgggtgactct

SEQ ID NO: 3219 - DNA, 22 bp, Artificial Sequence
  chemically synthesized
tctctgggtgactcttgattcc

SEQ ID NO: 3220 - DNA, 22 bp, Artificial Sequence
  chemically synthesized
tgggtgactcttgattcccggc

SEQ ID NO: 3221 - DNA, 22 bp, Artificial Sequence
  chemically synthesized
ggtgactcttgattcccggcca

SEQ ID NO: 3222 - DNA, 22 bp, Artificial Sequence
  chemically synthesized
ttgattcccggccagtttctcc

SEQ ID NO: 3223 - DNA, 22 bp, Artificial Sequence
  chemically synthesized
gattcccggccagtttctccac

SEQ ID NO: 3224 - DNA, 22 bp, Artificial Sequence
  chemically synthesized
attcccggccagtttctccacc

SEQ ID NO: 3225 - DNA, 22 bp, Artificial Sequence
  chemically synthesized
ccggccagtttctccacctggg

SEQ ID NO: 3226 - DNA, 22 bp, Artificial Sequence
  chemically synthesized
ctccacctggggctgtgtttct

SEQ ID NO: 3227 - DNA, 22 bp, Artificial Sequence
  chemically synthesized
tccacctggggctgtgtttctc

SEQ ID NO: 3228 - DNA, 22 bp, Artificial Sequence
  chemically synthesized
cacctggggctgtgtttctcgt

SEQ ID NO: 3229 - DNA, 22 bp, Artificial Sequence
  chemically synthesized
gggctgtgtttctcgtcctgca

SEQ ID NO: 3230 - DNA, 22 bp, Artificial Sequence
  chemically synthesized
tgtttctcgtcctgcatccttc

SEQ ID NO: 3231 - DNA, 22 bp, Artificial Sequence
  chemically synthesized
ctcgtcctgcatccttctccag

SEQ ID NO: 3232 - DNA, 22 bp, Artificial Sequence
  chemically synthesized
tcgtcctgcatccttctccagg

SEQ ID NO: 3233 - DNA, 22 bp, Artificial Sequence
  chemically synthesized
gtcctgcatccttctccaggca

SEQ ID NO: 3234 - DNA, 22 bp, Artificial Sequence
  chemically synthesized
catccttctccaggcaggtccc

SEQ ID NO: 3235 - DNA, 22 bp, Artificial Sequence
  chemically synthesized
ctccaggcaggtccccaagcat

SEQ ID NO: 3236 - DNA, 22 bp, Artificial Sequence
  chemically synthesized
tccaggcaggtccccaagcatc

SEQ ID NO: 3237 - DNA, 22 bp, Artificial Sequence
  chemically synthesized
caggcaggtccccaagcatcgc

SEQ ID NO: 3238 - DNA, 22 bp, Artificial Sequence
  chemically synthesized
ctgtggctgttcccaagttctt

SEQ ID NO: 3239 - DNA, 22 bp, Artificial Sequence
  chemically synthesized
tggctgttcccaagttcttagg

SEQ ID NO: 3240 - DNA, 22 bp, Artificial Sequence
  chemically synthesized
ttcccaagttcttagggtaccc

SEQ ID NO: 3241 - DNA, 22 bp, Artificial Sequence
  chemically synthesized
ccaagttcttagggtaccccac

SEQ ID NO: 3242 - DNA, 22 bp, Artificial Sequence
  chemically synthesized
ttagggtaccccacgtgggttt

SEQ ID NO: 3243 - DNA, 22 bp, Artificial Sequence
  chemically synthesized
agggtaccccacgtgggtttat

SEQ ID NO: 3244 - DNA, 22 bp, Artificial Sequence
  chemically synthesized
gggtaccccacgtgggtttatc

SEQ ID NO: 3245 - DNA, 22 bp, Artificial Sequence
  chemically synthesized
atcaaccacttggtgaggctgg

SEQ ID NO: 3246 - DNA, 22 bp, Artificial Sequence
  chemically synthesized
tcaaccacttggtgaggctggt

SEQ ID NO: 3247 - DNA, 22 bp, Artificial Sequence
  chemically synthesized
ggtgaggctggtaccctgcccc

SEQ ID NO: 3248 - DNA, 22 bp, Artificial Sequence
  chemically synthesized
gtgaggctggtaccctgccccc

SEQ ID NO: 3249 - DNA, 22 bp, Artificial Sequence
  chemically synthesized
gtaccctgcccccattcctgca

SEQ ID NO: 3250 - DNA, 22 bp, Artificial Sequence
  chemically synthesized
cccccattcctgcaccccaatt

SEQ ID NO: 3251 - DNA, 22 bp, Artificial Sequence
  chemically synthesized
ctgcaccccaattgccttagtg

SEQ ID NO: 3252 - DNA, 22 bp, Artificial Sequence
  chemically synthesized
caccccaattgccttagtggct

SEQ ID NO: 3253 - DNA, 22 bp, Artificial Sequence
  chemically synthesized
ccttagtggctagggggttggg

SEQ ID NO: 3254 - DNA, 22 bp, Artificial Sequence
  chemically synthesized
agtggctagggggttgggggct

SEQ ID NO: 3255 - DNA, 22 bp, Artificial Sequence
  chemically synthesized
gtggctagggggttgggggcta

SEQ ID NO: 3256 - DNA, 22 bp, Artificial Sequence
  chemically synthesized
gggggttgggggctagagtagg

SEQ ID NO: 3257 - DNA, 22 bp, Artificial Sequence
  chemically synthesized
ggggctagagtaggaggggctg

SEQ ID NO: 3258 - DNA, 22 bp, Artificial Sequence
  chemically synthesized
gagtaggaggggctggagccag

SEQ ID NO: 3259 - DNA, 22 bp, Artificial Sequence
  chemically synthesized
gagccaggattcttagggctga

SEQ ID NO: 3260 - DNA, 22 bp, Artificial Sequence
  chemically synthesized
ttagggctgaacagagaagagc

SEQ ID NO: 3261 - DNA, 22 bp, Artificial Sequence
  chemically synthesized
agggctgaacagagaagagctg

SEQ ID NO: 3262 - DNA, 22 bp, Artificial Sequence
  chemically synthesized
gggctgaacagagaagagctgg

SEQ ID NO: 3263 - DNA, 22 bp, Artificial Sequence
  chemically synthesized
aacagagaagagctgggggcct

SEQ ID NO: 3264 - DNA, 22 bp, Artificial Sequence
  chemically synthesized
ggggcctgggctcctgggtttg

SEQ ID NO: 3265 - DNA, 22 bp, Artificial Sequence
  chemically synthesized
ggctcctgggtttgagagagga

SEQ ID NO: 3266 - DNA, 22 bp, Artificial Sequence
  chemically synthesized
ctgggtttgagagaggaggggc

SEQ ID NO: 3267 - DNA, 22 bp, Artificial Sequence
  chemically synthesized
ggtttgagagaggaggggctgg

SEQ ID NO: 3268 - DNA, 22 bp, Artificial Sequence
  chemically synthesized
gagagaggaggggctggggcct

SEQ ID NO: 3269 - DNA, 22 bp, Artificial Sequence
  chemically synthesized
agagaggaggggctggggcctg

SEQ ID NO: 3270 - DNA, 22 bp, Artificial Sequence
  chemically synthesized
gggcctggactcctgggtccga

SEQ ID NO: 3271 - DNA, 22 bp, Artificial Sequence
  chemically synthesized
gactcctgggtccgagggagga

SEQ ID NO: 3272 - DNA, 22 bp, Artificial Sequence
  chemically synthesized
ctgggtccgagggaggaggggc

SEQ ID NO: 3273 - DNA, 22 bp, Artificial Sequence
  chemically synthesized
ggtccgagggaggaggggctgg

SEQ ID NO: 3274 - DNA, 22 bp, Artificial Sequence
  chemically synthesized
gggcctggactcctgggtctga

SEQ ID NO: 3275 - DNA, 22 bp, Artificial Sequence
  chemically synthesized
gactcctgggtctgagggtgga

SEQ ID NO: 3276 - DNA, 22 bp, Artificial Sequence
  chemically synthesized
ctgggtctgagggtggagggac

SEQ ID NO: 3277 - DNA, 22 bp, Artificial Sequence
  chemically synthesized
ggtctgagggtggagggactgg

SEQ ID NO: 3278 - DNA, 22 bp, Artificial Sequence
  chemically synthesized
agggtggagggactgggggcct

SEQ ID NO: 3279 - DNA, 22 bp, Artificial Sequence
  chemically synthesized
ggggcctggactcctgggtccg

SEQ ID NO: 3280 - DNA, 22 bp, Artificial Sequence
  chemically synthesized
gactcctgggtccgagggagga

SEQ ID NO: 3281 - DNA, 22 bp, Artificial Sequence
  chemically synthesized
ctgggtccgagggaggaggggc

SEQ ID NO: 3282 - DNA, 22 bp, Artificial Sequence
  chemically synthesized
ggtccgagggaggaggggctgg

SEQ ID NO: 3283 - DNA, 22 bp, Artificial Sequence
  chemically synthesized
gggcctggactcgtgggtctga

SEQ ID NO: 3284 - DNA, 22 bp, Artificial Sequence
  chemically synthesized
gactcgtgggtctgagggagga

SEQ ID NO: 3285 - DNA, 22 bp, Artificial Sequence
  chemically synthesized
gtgggtctgagggaggaggggc

SEQ ID NO: 3286 - DNA, 22 bp, Artificial Sequence
  chemically synthesized
agggaggaggggctgggggcct

SEQ ID NO: 3287 - DNA, 22 bp, Artificial Sequence
  chemically synthesized
ggggcctggacttctgggtctt

SEQ ID NO: 3288 - DNA, 22 bp, Artificial Sequence
  chemically synthesized
gacttctgggtcttagggaggc

SEQ ID NO: 3289 - DNA, 22 bp, Artificial Sequence
  chemically synthesized
ctgggtcttagggaggcggggc

SEQ ID NO: 3290 - DNA, 22 bp, Artificial Sequence
  chemically synthesized
tgggtcttagggaggcggggct

SEQ ID NO: 3291 - DNA, 22 bp, Artificial Sequence
  chemically synthesized
ggtcttagggaggcggggctgg

SEQ ID NO: 3292 - DNA, 22 bp, Artificial Sequence
  chemically synthesized
agggaggcggggctgggcctgg

SEQ ID NO: 3293 - DNA, 22 bp, Artificial Sequence
  chemically synthesized
gggaggcggggctgggcctgga

SEQ ID NO: 3294 - DNA, 22 bp, Artificial Sequence
  chemically synthesized
ggcctggacccctgggtctgaa

SEQ ID NO: 3295 - DNA, 22 bp, Artificial Sequence
  chemically synthesized
gacccctgggtctgaatgggga

SEQ ID NO: 3296 - DNA, 22 bp, Artificial Sequence
  chemically synthesized
ggtctgaatggggagaggctgg

SEQ ID NO: 3297 - DNA, 22 bp, Artificial Sequence
  chemically synthesized
aatggggagaggctgggggcct

SEQ ID NO: 3298 - DNA, 22 bp, Artificial Sequence
  chemically synthesized
ggggcctggactccttcatctg

SEQ ID NO: 3299 - DNA, 22 bp, Artificial Sequence
  chemically synthesized
gactccttcatctgagggcgga

SEQ ID NO: 3300 - DNA, 22 bp, Artificial Sequence
  chemically synthesized
cttcatctgagggcggaagggc

SEQ ID NO: 3301 - DNA, 22 bp, Artificial Sequence
  chemically synthesized
catctgagggcggaagggctgg

SEQ ID NO: 3302 - DNA, 22 bp, Artificial Sequence
  chemically synthesized
atctgagggcggaagggctggg

SEQ ID NO: 3303 - DNA, 22 bp, Artificial Sequence
  chemically synthesized
agggcggaagggctggggcctg

SEQ ID NO: 3304 - DNA, 22 bp, Artificial Sequence
  chemically synthesized
gggcctggcctcctgggttgaa

SEQ ID NO: 3305 - DNA, 22 bp, Artificial Sequence
  chemically synthesized
gcctcctgggttgaatggggag

SEQ ID NO: 3306 - DNA, 22 bp, Artificial Sequence
  chemically synthesized
ctgggttgaatggggaggggtt

SEQ ID NO: 3307 - DNA, 22 bp, Artificial Sequence
  chemically synthesized
ggttgaatggggaggggttggg

SEQ ID NO: 3308 - DNA, 22 bp, Artificial Sequence
  chemically synthesized
aatggggaggggttgggcctgg

SEQ ID NO: 3309 - DNA, 22 bp, Artificial Sequence
  chemically synthesized
ggcctggactctggagtccctg

SEQ ID NO: 3310 - DNA, 22 bp, Artificial Sequence
  chemically synthesized
gactctggagtccctggtgccc

SEQ ID NO: 3311 - DNA, 22 bp, Artificial Sequence
  chemically synthesized
tggagtccctggtgcccaggcc

SEQ ID NO: 3312 - DNA, 22 bp, Artificial Sequence
  chemically synthesized
gagtccctggtgcccaggcctc

SEQ ID NO: 3313 - DNA, 22 bp, Artificial Sequence
  chemically synthesized
gtgcccaggcctcaggcatctt

SEQ ID NO: 3314 - DNA, 22 bp, Artificial Sequence
  chemically synthesized
aggcatctttcacagggatgcc

SEQ ID NO: 3315 - DNA, 22 bp, Artificial Sequence
  chemically synthesized
tcacagggatgcctgtactggg

SEQ ID NO: 3316 - DNA, 22 bp, Artificial Sequence
  chemically synthesized
cacagggatgcctgtactgggc

SEQ ID NO: 3317 - DNA, 22 bp, Artificial Sequence
  chemically synthesized
acagggatgcctgtactgggca

SEQ ID NO: 3318 - DNA, 22 bp, Artificial Sequence
  chemically synthesized
tactgggcaggtccttgaaagg

SEQ ID NO: 3319 - DNA, 22 bp, Artificial Sequence
  chemically synthesized
ggcaggtccttgaaagggaaag

SEQ ID NO: 3320 - DNA, 22 bp, Artificial Sequence
  chemically synthesized
gaaagggaaaggcccattgctc

SEQ ID NO: 3321 - DNA, 22 bp, Artificial Sequence
  chemically synthesized
aaagggaaaggcccattgctct

SEQ ID NO: 3322 - DNA, 22 bp, Artificial Sequence
  chemically synthesized
ctctccttgcccccctccccta

SEQ ID NO: 3323 - DNA, 22 bp, Artificial Sequence
  chemically synthesized
tccttgcccccctcccctatcg

SEQ ID NO: 3324 - DNA, 22 bp, Artificial Sequence
  chemically synthesized
cttgcccccctcccctatcgcc

SEQ ID NO: 3325 - DNA, 22 bp, Artificial Sequence
  chemically synthesized
gcccccctcccctatcgccatg

SEQ ID NO: 3326 - DNA, 22 bp, Artificial Sequence
  chemically synthesized
cccccctcccctatcgccatga

SEQ ID NO: 3327 - DNA, 22 bp, Artificial Sequence
  chemically synthesized
ccctatcgccatgacaactggg

SEQ ID NO: 3328 - DNA, 22 bp, Artificial Sequence
  chemically synthesized
tcgccatgacaactgggtggaa

SEQ ID NO: 3329 - DNA, 22 bp, Artificial Sequence
  chemically synthesized
ggtggaaataaacgagccgagt

SEQ ID NO: 3330 - DNA, 22 bp, Artificial Sequence
  chemically synthesized
atcccgttcccagggcacgtgc

SEQ ID NO: 3331 - DNA, 22 bp, Artificial Sequence
  chemically synthesized
ccagggcacgtgcggccccttc

SEQ ID NO: 3332 - DNA, 22 bp, Artificial Sequence
  chemically synthesized
cacagcccgagtttccatgacc

SEQ ID NO: 3333 - DNA, 22 bp, Artificial Sequence
  chemically synthesized
acagcccgagtttccatgacct

SEQ ID NO: 3334 - DNA, 22 bp, Artificial Sequence
  chemically synthesized
ccatgacctcatgctcttggcc

SEQ ID NO: 3335 - DNA, 22 bp, Artificial Sequence
  chemically synthesized
catgacctcatgctcttggccc

SEQ ID NO: 3336 - DNA, 22 bp, Artificial Sequence
  chemically synthesized
atgctcttggccctcgtagctc

SEQ ID NO: 3337 - DNA, 22 bp, Artificial Sequence
  chemically synthesized
ttggccctcgtagctccctccc

SEQ ID NO: 3338 - DNA, 22 bp, Artificial Sequence
  chemically synthesized
ggccctcgtagctccctcccgc

SEQ ID NO: 3339 - DNA, 22 bp, Artificial Sequence
  chemically synthesized
gccctcgtagctccctcccgcc

SEQ ID NO: 3340 - DNA, 22 bp, Artificial Sequence
  chemically synthesized
gtagctccctcccgcctcctcc

SEQ ID NO: 3341 - DNA, 22 bp, Artificial Sequence
  chemically synthesized
cctcccgcctcctccagatggg

SEQ ID NO: 3342 - DNA, 22 bp, Artificial Sequence
  chemically synthesized
ccgcctcctccagatgggcagc

SEQ ID NO: 3343 - DNA, 22 bp, Artificial Sequence
  chemically synthesized
ctccagatgggcagctttggag

SEQ ID NO: 3344 - DNA, 22 bp, Artificial Sequence
  chemically synthesized
cagatgggcagctttggagagg

SEQ ID NO: 3345 - DNA, 22 bp, Artificial Sequence
  chemically synthesized
tggagaggtgagggacttgggg

SEQ ID NO: 3346 - DNA, 22 bp, Artificial Sequence
  chemically synthesized
ggagaggtgagggacttggggg

SEQ ID NO: 3347 - DNA, 22 bp, Artificial Sequence
  chemically synthesized
gagaggtgagggacttgggggg

SEQ ID NO: 3348 - DNA, 22 bp, Artificial Sequence
  chemically synthesized
ggggggtaatttatcccgtgga

SEQ ID NO: 3349 - DNA, 22 bp, Artificial Sequence
  chemically synthesized
gggggtaatttatcccgtggat

SEQ ID NO: 3350 - DNA, 22 bp, Artificial Sequence
  chemically synthesized
atcccgtggatctaggagttta

SEQ ID NO: 3351 - DNA, 22 bp, Artificial Sequence
  chemically synthesized
tcccgtggatctaggagtttag

SEQ ID NO: 3352 - DNA, 22 bp, Artificial Sequence
  chemically synthesized
ggagtttagcttcactccttcc

SEQ ID NO: 3353 - DNA, 22 bp, Artificial Sequence
  chemically synthesized
agcttcactccttcctcagctc

SEQ ID NO: 3354 - DNA, 22 bp, Artificial Sequence
  chemically synthesized
gcttcactccttcctcagctcc

SEQ ID NO: 3355 - DNA, 22 bp, Artificial Sequence
  chemically synthesized
cactccttcctcagctccagtt

SEQ ID NO: 3356 - DNA, 22 bp, Artificial Sequence
  chemically synthesized
actccttcctcagctccagttc

SEQ ID NO: 3357 - DNA, 22 bp, Artificial Sequence
  chemically synthesized
cttcctcagctccagttcaggt

SEQ ID NO: 3358 - DNA, 22 bp, Artificial Sequence
  chemically synthesized
cctcagctccagttcaggtccc

SEQ ID NO: 3359 - DNA, 22 bp, Artificial Sequence
  chemically synthesized
ctcagctccagttcaggtcccg

SEQ ID NO: 3360 - DNA, 22 bp, Artificial Sequence
  chemically synthesized
agctccagttcaggtcccggag

SEQ ID NO: 3361 - DNA, 22 bp, Artificial Sequence
  chemically synthesized
cagttcaggtcccggagcccac

SEQ ID NO: 3362 - DNA, 22 bp, Artificial Sequence
  chemically synthesized
aggtcccggagcccacccagtg

SEQ ID NO: 3363 - DNA, 22 bp, Artificial Sequence
  chemically synthesized
gggcaagtccctcctccgaccc

SEQ ID NO: 3364 - DNA, 22 bp, Artificial Sequence
  chemically synthesized
ctccgaccccctggacttcggc

SEQ ID NO: 3365 - DNA, 22 bp, Artificial Sequence
  chemically synthesized
cgaccccctggacttcggcttt

SEQ ID NO: 3366 - DNA, 22 bp, Artificial Sequence
  chemically synthesized
gacttcggcttttgtcccccca

SEQ ID NO: 3367 - DNA, 22 bp, Artificial Sequence
  chemically synthesized
cggcttttgtccccccaagttt

SEQ ID NO: 3368 - DNA, 22 bp, Artificial Sequence
  chemically synthesized
ggcttttgtccccccaagtttt

SEQ ID NO: 3369 - DNA, 22 bp, Artificial Sequence
  chemically synthesized
ttgtccccccaagttttggacc

SEQ ID NO: 3370 - DNA, 22 bp, Artificial Sequence
  chemically synthesized
tgtccccccaagttttggaccc

SEQ ID NO: 3371 - DNA, 22 bp, Artificial Sequence
  chemically synthesized
gtccccccaagttttggacccc

SEQ ID NO: 3372 - DNA, 22 bp, Artificial Sequence
  chemically synthesized
tccccccaagttttggacccct

SEQ ID NO: 3373 - DNA, 22 bp, Artificial Sequence
  chemically synthesized
tggacccctaagggaagaatga

SEQ ID NO: 3374 - DNA, 22 bp, Artificial Sequence
  chemically synthesized
ggacccctaagggaagaatgag

SEQ ID NO: 3375 - DNA, 22 bp, Artificial Sequence
  chemically synthesized
gacccctaagggaagaatgaga

SEQ ID NO: 3376 - DNA, 22 bp, Artificial Sequence
  chemically synthesized
agggaagaatgagaaacggtgg

SEQ ID NO: 3377 - DNA, 22 bp, Artificial Sequence
  chemically synthesized
gctgcagggccccgtgcagagg

SEQ ID NO: 3378 - DNA, 22 bp, Artificial Sequence
  chemically synthesized
cagggccccgtgcagagggggc

SEQ ID NO: 3379 - DNA, 22 bp, Artificial Sequence
  chemically synthesized
agtgaactggagtgtgacagcc

SEQ ID NO: 3380 - DNA, 22 bp, Artificial Sequence
  chemically synthesized
gagtgtgacagcctggggccca

SEQ ID NO: 3381 - DNA, 22 bp, Artificial Sequence
  chemically synthesized
gggcccaggcacacaggtgtgc

SEQ ID NO: 3382 - DNA, 22 bp, Artificial Sequence
  chemically synthesized
tctcacccctctgggagtcccg

SEQ ID NO: 3383 - DNA, 22 bp, Artificial Sequence
  chemically synthesized
acccctctgggagtcccgccca

SEQ ID NO: 3384 - DNA, 22 bp, Artificial Sequence
  chemically synthesized
tgggagtcccgcccaggcccct

SEQ ID NO: 3385 - DNA, 22 bp, Artificial Sequence
  chemically synthesized
ggagtcccgcccaggcccctga

SEQ ID NO: 3386 - DNA, 22 bp, Artificial Sequence
  chemically synthesized
agtctgtcccagcacagggtgg

SEQ ID NO: 3387 - DNA, 22 bp, Artificial Sequence
  chemically synthesized
tcccagcacagggtggccttcc

SEQ ID NO: 3388 - DNA, 22 bp, Artificial Sequence
  chemically synthesized
cctccaccctgcatagccctgg

SEQ ID NO: 3389 - DNA, 22 bp, Artificial Sequence
  chemically synthesized
ctccaccctgcatagccctggg

SEQ ID NO: 3390 - DNA, 22 bp, Artificial Sequence
  chemically synthesized
caccctgcatagccctgggccc

SEQ ID NO: 3391 - DNA, 22 bp, Artificial Sequence
  chemically synthesized
catagccctgggcccacggctt

SEQ ID NO: 3392 - DNA, 22 bp, Artificial Sequence
  chemically synthesized
ggcccacggcttcgttcctgca

SEQ ID NO: 3393 - DNA, 22 bp, Artificial Sequence
  chemically synthesized
cgttcctgcagagtatctgctg

SEQ ID NO: 3394 - DNA, 22 bp, Artificial Sequence
  chemically synthesized
gttcctgcagagtatctgctgg

SEQ ID NO: 3395 - DNA, 22 bp, Artificial Sequence
  chemically synthesized
ctgcagagtatctgctggggtg

SEQ ID NO: 3396 - DNA, 22 bp, Artificial Sequence
  chemically synthesized
cagagtatctgctggggtggtt

SEQ ID NO: 3397 - DNA, 22 bp, Artificial Sequence
  chemically synthesized
ctggggtggtttccgagcttga

SEQ ID NO: 3398 - DNA, 22 bp, Artificial Sequence
  chemically synthesized
gggtggtttccgagcttgaccc

SEQ ID NO: 3399 - DNA, 22 bp, Artificial Sequence
  chemically synthesized
ccgagcttgacccttggaagga

SEQ ID NO: 3400 - DNA, 22 bp, Artificial Sequence
  chemically synthesized
cgagcttgacccttggaaggac

SEQ ID NO: 3401 - DNA, 22 bp, Artificial Sequence
  chemically synthesized
gacccttggaaggacctggctg

SEQ ID NO: 3402 - DNA, 22 bp, Artificial Sequence
  chemically synthesized
acccttggaaggacctggctgg

SEQ ID NO: 3403 - DNA, 22 bp, Artificial Sequence
  chemically synthesized
ggaaggacctggctgggtttaa

SEQ ID NO: 3404 - DNA, 22 bp, Artificial Sequence
  chemically synthesized
gaaggacctggctgggtttaag

SEQ ID NO: 3405 - DNA, 22 bp, Artificial Sequence
  chemically synthesized
gctgggtttaaggcaggagggg

SEQ ID NO: 3406 - DNA, 22 bp, Artificial Sequence
  chemically synthesized
ggtttaaggcaggaggggctgg

SEQ ID NO: 3407 - DNA, 22 bp, Artificial Sequence
  chemically synthesized
aaggcaggaggggctgggggcc

SEQ ID NO: 3408 - DNA, 22 bp, Artificial Sequence
  chemically synthesized
aggcaggaggggctgggggcca

SEQ ID NO: 3409 - DNA, 22 bp, Artificial Sequence
  chemically synthesized
ggggccaggactcctggctctg

SEQ ID NO: 3410 - DNA, 22 bp, Artificial Sequence
  chemically synthesized
ctggctctgaaggaggaggggc

SEQ ID NO: 3411 - DNA, 22 bp, Artificial Sequence
  chemically synthesized
gctctgaaggaggaggggctgg

SEQ ID NO: 3412 - DNA, 22 bp, Artificial Sequence
  chemically synthesized
tgaaggaggaggggctggaacc

SEQ ID NO: 3413 - DNA, 22 bp, Artificial Sequence
  chemically synthesized
aaggaggaggggctggaacctc

SEQ ID NO: 3414 - DNA, 22 bp, Artificial Sequence
  chemically synthesized
gaacctcttccctagtctgagc

SEQ ID NO: 3415 - DNA, 22 bp, Artificial Sequence
  chemically synthesized
ttccctagtctgagcactggaa

SEQ ID NO: 3416 - DNA, 22 bp, Artificial Sequence
  chemically synthesized
ccctagtctgagcactggaagc

SEQ ID NO: 3417 - DNA, 22 bp, Artificial Sequence
  chemically synthesized
cctagtctgagcactggaagcg

SEQ ID NO: 3418 - DNA, 22 bp, Artificial Sequence
  chemically synthesized
gtctgagcactggaagcgccac

SEQ ID NO: 3419 - DNA, 22 bp, Artificial Sequence
  chemically synthesized
agcactggaagcgccacctgtg

SEQ ID NO: 3420 - DNA, 22 bp, Artificial Sequence
  chemically synthesized
gaagcgccacctgtgggtggtg

SEQ ID NO: 3421 - DNA, 22 bp, Artificial Sequence
  chemically synthesized
tgggtggtgacgggggttttgc

SEQ ID NO: 3422 - DNA, 22 bp, Artificial Sequence
  chemically synthesized
tgccgtgtctaacaggtaccat

SEQ ID NO: 3423 - DNA, 22 bp, Artificial Sequence
  chemically synthesized
gccgtgtctaacaggtaccatg

SEQ ID NO: 3424 - DNA, 22 bp, Artificial Sequence
  chemically synthesized
ccgtgtctaacaggtaccatgt

SEQ ID NO: 3425 - DNA, 22 bp, Artificial Sequence
  chemically synthesized
acaggtaccatgtggggttccc

SEQ ID NO: 3426 - DNA, 22 bp, Artificial Sequence
  chemically synthesized
ccgcacccagatgagaagcccc

SEQ ID NO: 3427 - DNA, 22 bp, Artificial Sequence
  chemically synthesized
ccttccccgttcacttcctgtt

SEQ ID NO: 3428 - DNA, 22 bp, Artificial Sequence
  chemically synthesized
ccccgttcacttcctgtttgca

SEQ ID NO: 3429 - DNA, 22 bp, Artificial Sequence
  chemically synthesized
cccgttcacttcctgtttgcag

SEQ ID NO: 3430 - DNA, 22 bp, Artificial Sequence
  chemically synthesized
acttcctgtttgcagatagcca

SEQ ID NO: 3431 - DNA, 22 bp, Artificial Sequence
  chemically synthesized
cctgtttgcagatagccaggag

SEQ ID NO: 3432 - DNA, 22 bp, Artificial Sequence
  chemically synthesized
ctgtttgcagatagccaggagt

SEQ ID NO: 3433 - DNA, 22 bp, Artificial Sequence
  chemically synthesized
tttgcagatagccaggagtcct

SEQ ID NO: 3434 - DNA, 22 bp, Artificial Sequence
  chemically synthesized
gcagatagccaggagtcctttc

SEQ ID NO: 3435 - DNA, 22 bp, Artificial Sequence
  chemically synthesized
cagatagccaggagtcctttcg

SEQ ID NO: 3436 - DNA, 22 bp, Artificial Sequence
  chemically synthesized
tcgtggtttccactgagcactg

SEQ ID NO: 3437 - DNA, 22 bp, Artificial Sequence
  chemically synthesized
cgtggtttccactgagcactga

SEQ ID NO: 3438 - DNA, 22 bp, Artificial Sequence
  chemically synthesized
gtggtttccactgagcactgaa

SEQ ID NO: 3439 - DNA, 22 bp, Artificial Sequence
  chemically synthesized
ccactgagcactgaaggcctgg

SEQ ID NO: 3440 - DNA, 22 bp, Artificial Sequence
  chemically synthesized
cactgagcactgaaggcctggc

SEQ ID NO: 3441 - DNA, 22 bp, Artificial Sequence
  chemically synthesized
agcactgaaggcctggccggcc

SEQ ID NO: 3442 - DNA, 22 bp, Artificial Sequence
  chemically synthesized
aaggcctggccggcctgaccac

SEQ ID NO: 3443 - DNA, 22 bp, Artificial Sequence
  chemically synthesized
gccggcctgaccactgggcaac

SEQ ID NO: 3444 - DNA, 22 bp, Artificial Sequence
  chemically synthesized
accactgggcaaccaggcgtat

SEQ ID NO: 3445 - DNA, 22 bp, Artificial Sequence
  chemically synthesized
ggcaaccaggcgtatcttaaac

SEQ ID NO: 3446 - DNA, 22 bp, Artificial Sequence
  chemically synthesized
aaacagccagtggccagaggct

SEQ ID NO: 3447 - DNA, 22 bp, Artificial Sequence
  chemically synthesized
aacagccagtggccagaggctg

SEQ ID NO: 3448 - DNA, 22 bp, Artificial Sequence
  chemically synthesized
ttgggtcattttccccactgtc

SEQ ID NO: 3449 - DNA, 22 bp, Artificial Sequence
  chemically synthesized
ggtcattttccccactgtccta

SEQ ID NO: 3450 - DNA, 22 bp, Artificial Sequence
  chemically synthesized
tccccactgtcctagcaccgtg

SEQ ID NO: 3451 - DNA, 22 bp, Artificial Sequence
  chemically synthesized
ccccactgtcctagcaccgtgt

SEQ ID NO: 3452 - DNA, 22 bp, Artificial Sequence
  chemically synthesized
cccactgtcctagcaccgtgtc

SEQ ID NO: 3453 - DNA, 22 bp, Artificial Sequence
  chemically synthesized
tcctagcaccgtgtccctggat

SEQ ID NO: 3454 - DNA, 22 bp, Artificial Sequence
  chemically synthesized
gcaccgtgtccctggatctgtt

SEQ ID NO: 3455 - DNA, 22 bp, Artificial Sequence
  chemically synthesized
gatctgttttcgtggctccctc

SEQ ID NO: 3456 - DNA, 22 bp, Artificial Sequence
  chemically synthesized
ttttcgtggctccctctggagt

SEQ ID NO: 3457 - DNA, 22 bp, Artificial Sequence
  chemically synthesized
tcgtggctccctctggagtccc

SEQ ID NO: 3458 - DNA, 22 bp, Artificial Sequence
  chemically synthesized
cgtggctccctctggagtcccg

SEQ ID NO: 3459 - DNA, 22 bp, Artificial Sequence
  chemically synthesized
gtggctccctctggagtcccga

SEQ ID NO: 3460 - DNA, 22 bp, Artificial Sequence
  chemically synthesized
cctctggagtcccgacttgctg

SEQ ID NO: 3461 - DNA, 22 bp, Artificial Sequence
  chemically synthesized
tggagtcccgacttgctgggac

SEQ ID NO: 3462 - DNA, 22 bp, Artificial Sequence
  chemically synthesized
gagtcccgacttgctgggacac

SEQ ID NO: 3463 - DNA, 22 bp, Artificial Sequence
  chemically synthesized
gctgggacaccgtggctggggt

SEQ ID NO: 3464 - DNA, 22 bp, Artificial Sequence
  chemically synthesized
ctgggacaccgtggctggggta

SEQ ID NO: 3465 - DNA, 22 bp, Artificial Sequence
  chemically synthesized
ggacaccgtggctggggtaggt

SEQ ID NO: 3466 - DNA, 22 bp, Artificial Sequence
  chemically synthesized
gggtaggtgcggctgacggctg

SEQ ID NO: 3467 - DNA, 22 bp, Artificial Sequence
  chemically synthesized
acggctgtttcccacccccagg

SEQ ID NO: 3468 - DNA, 22 bp, Artificial Sequence
  chemically synthesized
tttcccacccccaggcctgcat

SEQ ID NO: 3469 - DNA, 22 bp, Artificial Sequence
  chemically synthesized
cccacccccaggcctgcattga

SEQ ID NO: 3470 - DNA, 22 bp, Artificial Sequence
  chemically synthesized
ccacccccaggcctgcattgat

SEQ ID NO: 3471 - DNA, 22 bp, Artificial Sequence
  chemically synthesized
cattgatgagaacctggaggtg

SEQ ID NO: 3472 - DNA, 22 bp, Artificial Sequence
  chemically synthesized
atgagaacctggaggtggtgcg

SEQ ID NO: 3473 - DNA, 22 bp, Artificial Sequence
  chemically synthesized
gaggtggtgcgcttcttggtgg

SEQ ID NO: 3474 - DNA, 22 bp, Artificial Sequence
  chemically synthesized
cttggtggagcagggcgccact

SEQ ID NO: 3475 - DNA, 22 bp, Artificial Sequence
  chemically synthesized
ttggtggagcagggcgccactg

SEQ ID NO: 3476 - DNA, 22 bp, Artificial Sequence
  chemically synthesized
ggtggagcagggcgccactgtg

SEQ ID NO: 3477 - DNA, 22 bp, Artificial Sequence
  chemically synthesized
gtggagcagggcgccactgtga

SEQ ID NO: 3478 - DNA, 22 bp, Artificial Sequence
  chemically synthesized
tgaaccaggcagacaacgaggg

SEQ ID NO: 3479 - DNA, 22 bp, Artificial Sequence
  chemically synthesized
gacgccactgcacgtggccgcc

SEQ ID NO: 3480 - DNA, 22 bp, Artificial Sequence
  chemically synthesized
cacgtggccgcctcctgtggct

SEQ ID NO: 3481 - DNA, 22 bp, Artificial Sequence
  chemically synthesized
ctgtggctacctagatatcgcc

SEQ ID NO: 3482 - DNA, 20 bp, Artificial Sequence
  chemically synthesized
taatttccctccgtttgtcc

SEQ ID NO: 3483 - DNA, 20 bp, Artificial Sequence
  chemically synthesized
ctgtcaaccccacacgcctt

SEQ ID NO: 3484 - DNA, 20 bp, Artificial Sequence
  chemically synthesized
cacacgcctttggcacaatg

SEQ ID NO: 3485 - DNA, 20 bp, Artificial Sequence
  chemically synthesized
acgcctttggcacaatgaag

SEQ ID NO: 3486 - DNA, 20 bp, Artificial Sequence
  chemically synthesized
cgcctttggcacaatgaagt

SEQ ID NO: 3487 - DNA, 20 bp, Artificial Sequence
  chemically synthesized
atttcccttctttttctctt

SEQ ID NO: 3488 - DNA, 20 bp, Artificial Sequence
  chemically synthesized
ccttctttttctctttagct

SEQ ID NO: 3489 - DNA, 20 bp, Artificial Sequence
  chemically synthesized
ctctttagctcggcttattc

SEQ ID NO: 3490 - DNA, 20 bp, Artificial Sequence
  chemically synthesized
tctttagctcggcttattcc

SEQ ID NO: 3491 - DNA, 20 bp, Artificial Sequence
  chemically synthesized
ctttagctcggcttattcca

SEQ ID NO: 3492 - DNA, 20 bp, Artificial Sequence
  chemically synthesized
tttagctcggcttattccag

SEQ ID NO: 3493 - DNA, 20 bp, Artificial Sequence
  chemically synthesized
ttccaggggtgtgtttcgtc

SEQ ID NO: 3494 - DNA, 20 bp, Artificial Sequence
  chemically synthesized
tgtttcgtcgagatgcacgt

SEQ ID NO: 3495 - DNA, 20 bp, Artificial Sequence
  chemically synthesized
caacttttattctattttcc

SEQ ID NO: 3496 - DNA, 20 bp, Artificial Sequence
  chemically synthesized
tctattttcccagtaaaata

SEQ ID NO: 3497 - DNA, 20 bp, Artificial Sequence
  chemically synthesized
ttcccagtaaaataaagttt

SEQ ID NO: 3498 - DNA, 20 bp, Artificial Sequence
  chemically synthesized
tagtaaactctgcatcttta

SEQ ID NO: 3499 - DNA, 20 bp, Artificial Sequence
  chemically synthesized
gcatctttaaagaattattt

SEQ ID NO: 3500 - DNA, 20 bp, Artificial Sequence
  chemically synthesized
tttggcatttatttctaaaa

SEQ ID NO: 3501 - DNA, 20 bp, Artificial Sequence
  chemically synthesized
catttatttctaaaatggca

SEQ ID NO: 3502 - DNA, 20 bp, Artificial Sequence
  chemically synthesized
catagtattttgtatttgtg

SEQ ID NO: 3503 - DNA, 20 bp, Artificial Sequence
  chemically synthesized
ttgtatttgtgaagtcttac

SEQ ID NO: 3504 - DNA, 20 bp, Artificial Sequence
  chemically synthesized
tgtatttgtgaagtcttaca

SEQ ID NO: 3505 - DNA, 20 bp, Artificial Sequence
  chemically synthesized
ttaataaaattcaaacatcc

SEQ ID NO: 3506 - DNA, 20 bp, Artificial Sequence
  chemically synthesized
taataaaattcaaacatcct

SEQ ID NO: 3507 - DNA, 20 bp, Artificial Sequence
  chemically synthesized
atcctaggtaaaaaaaaaaa

SEQ ID NO: 3508 - DNA, 20 bp, Artificial Sequence
  chemically synthesized
tcctaggtaaaaaaaaaaaa

SEQ ID NO: 3509 - DNA, 20 bp, Artificial Sequence
  chemically synthesized
aggtaaaaaaaaaaaaaggt

SEQ ID NO: 3510 - DNA, 20 bp, Artificial Sequence
  chemically synthesized
aaaaaaaggtcagaattgtt

SEQ ID NO: 3511 - DNA, 20 bp, Artificial Sequence
  chemically synthesized
gtaattttcttttgcgcact

SEQ ID NO: 3512 - DNA, 20 bp, Artificial Sequence
  chemically synthesized
taattttcttttgcgcacta

SEQ ID NO: 3513 - DNA, 20 bp, Artificial Sequence
  chemically synthesized
tttcttttgcgcactaagga

SEQ ID NO: 3514 - DNA, 20 bp, Artificial Sequence
  chemically synthesized
tgcgcactaaggaaagtgca

SEQ ID NO: 3515 - DNA, 20 bp, Artificial Sequence
  chemically synthesized
aaggaaagtgcaaagtaact

SEQ ID NO: 3516 - DNA, 20 bp, Artificial Sequence
  chemically synthesized
ggaaagtgcaaagtaactta

SEQ ID NO: 3517 - DNA, 20 bp, Artificial Sequence
  chemically synthesized
ttagagtgactgaaacttca

SEQ ID NO: 3518 - DNA, 20 bp, Artificial Sequence
  chemically synthesized
gtgactgaaacttcacagaa

SEQ ID NO: 3519 - DNA, 20 bp, Artificial Sequence
  chemically synthesized
tgactgaaacttcacagaat

SEQ ID NO: 3520 - DNA, 20 bp, Artificial Sequence
  chemically synthesized
gactgaaacttcacagaata

SEQ ID NO: 3521 - DNA, 20 bp, Artificial Sequence
  chemically synthesized
aacttcacagaatagggttg

SEQ ID NO: 3522 - DNA, 20 bp, Artificial Sequence
  chemically synthesized
ttgaattcataactatccca

SEQ ID NO: 3523 - DNA, 20 bp, Artificial Sequence
  chemically synthesized
tgtgctgttgatctcataaa

SEQ ID NO: 3524 - DNA, 20 bp, Artificial Sequence
  chemically synthesized
atttatatttattttcattt

SEQ ID NO: 3525 - DNA, 20 bp, Artificial Sequence
  chemically synthesized
ttcattttagtctgtcttct

SEQ ID NO: 3526 - DNA, 20 bp, Artificial Sequence
  chemically synthesized
gtcttcttggttgctgttga

SEQ ID NO: 3527 - DNA, 20 bp, Artificial Sequence
  chemically synthesized
ttgctgttgatagacactaa

SEQ ID NO: 3528 - DNA, 20 bp, Artificial Sequence
  chemically synthesized
gctgttgatagacactaaaa

SEQ ID NO: 3529 - DNA, 20 bp, Artificial Sequence
  chemically synthesized
gatagacactaaaagagtat

SEQ ID NO: 3530 - DNA, 20 bp, Artificial Sequence
  chemically synthesized
aagagtattagatattatct

SEQ ID NO: 3531 - DNA, 20 bp, Artificial Sequence
  chemically synthesized
tattatctaagtttgaatat

SEQ ID NO: 3532 - DNA, 20 bp, Artificial Sequence
  chemically synthesized
attatctaagtttgaatata

SEQ ID NO: 3533 - DNA, 20 bp, Artificial Sequence
  chemically synthesized
atatttaataatttttaaaa

SEQ ID NO: 3534 - DNA, 20 bp, Artificial Sequence
  chemically synthesized
aatttttaaaatagtattct

SEQ ID NO: 3535 - DNA, 20 bp, Artificial Sequence
  chemically synthesized
ttgaattattcttctgttta

SEQ ID NO: 3536 - DNA, 20 bp, Artificial Sequence
  chemically synthesized
tgaattattcttctgtttaa

SEQ ID NO: 3537 - DNA, 20 bp, Artificial Sequence
  chemically synthesized
attattcttctgtttaaagg

SEQ ID NO: 3538 - DNA, 20 bp, Artificial Sequence
  chemically synthesized
attcttctgtttaaaggcag

SEQ ID NO: 3539 - DNA, 20 bp, Artificial Sequence
  chemically synthesized
aaataattgaacatcatcct

SEQ ID NO: 3540 - DNA, 20 bp, Artificial Sequence
  chemically synthesized
catcatcctgagtttttctg

SEQ ID NO: 3541 - DNA, 20 bp, Artificial Sequence
  chemically synthesized
atcatcctgagtttttctgt

SEQ ID NO: 3542 - DNA, 20 bp, Artificial Sequence
  chemically synthesized
ctgagtttttctgtaggaat

SEQ ID NO: 3543 - DNA, 20 bp, Artificial Sequence
  chemically synthesized
gagtttttctgtaggaatca

SEQ ID NO: 3544 - DNA, 20 bp, Artificial Sequence
  chemically synthesized
ttgaaacaaatgcataatct

SEQ ID NO: 3545 - DNA, 20 bp, Artificial Sequence
  chemically synthesized
aatgcataatctaagtcaaa

SEQ ID NO: 3546 - DNA, 20 bp, Artificial Sequence
  chemically synthesized
cataatctaagtcaaatgga

SEQ ID NO: 3547 - DNA, 20 bp, Artificial Sequence
  chemically synthesized
caaatggaaagaaatataaa

SEQ ID NO: 3548 - DNA, 20 bp, Artificial Sequence
  chemically synthesized
ttattacttcttgttttctt

SEQ ID NO: 3549 - DNA, 20 bp, Artificial Sequence
  chemically synthesized
cttttttttcttcccttgcc

SEQ ID NO: 3550 - DNA, 20 bp, Artificial Sequence
  chemically synthesized
ttttcttcccttgcccagac

SEQ ID NO: 3551 - DNA, 20 bp, Artificial Sequence
  chemically synthesized
ttcttcccttgcccagacaa

SEQ ID NO: 3552 - DNA, 20 bp, Artificial Sequence
  chemically synthesized
tcccttgcccagacaagagt

SEQ ID NO: 3553 - DNA, 20 bp, Artificial Sequence
  chemically synthesized
cccttgcccagacaagagtg

SEQ ID NO: 3554 - DNA, 20 bp, Artificial Sequence
  chemically synthesized
acaagagtgaggttgctcat

SEQ ID NO: 3555 - DNA, 20 bp, Artificial Sequence
  chemically synthesized
tgaggttgctcatcggttta

SEQ ID NO: 3556 - DNA, 20 bp, Artificial Sequence
  chemically synthesized
tgctcatcggtttaaagatt

SEQ ID NO: 3557 - DNA, 20 bp, Artificial Sequence
  chemically synthesized
gctcatcggtttaaagattt

SEQ ID NO: 3558 - DNA, 20 bp, Artificial Sequence
  chemically synthesized
tcatcggtttaaagatttgg

SEQ ID NO: 3559 - DNA, 20 bp, Artificial Sequence
  chemically synthesized
tcggtttaaagatttgggag

SEQ ID NO: 3560 - DNA, 20 bp, Artificial Sequence
  chemically synthesized
tttgggagaagaaaatttca

SEQ ID NO: 3561 - DNA, 20 bp, Artificial Sequence
  chemically synthesized
tcccaaatctttaaaccgat

SEQ ID NO: 3562 - DNA, 20 bp, Artificial Sequence
  chemically synthesized
tgagcaacctcactcttgtc

SEQ ID NO: 3563 - DNA, 20 bp, Artificial Sequence
  chemically synthesized
gagcaacctcactcttgtct

SEQ ID NO: 3564 - DNA, 20 bp, Artificial Sequence
  chemically synthesized
aacctcactcttgtctgggc

SEQ ID NO: 3565 - DNA, 20 bp, Artificial Sequence
  chemically synthesized
acctcactcttgtctgggca

SEQ ID NO: 3566 - DNA, 20 bp, Artificial Sequence
  chemically synthesized
cctcactcttgtctgggcaa

SEQ ID NO: 3567 - DNA, 20 bp, Artificial Sequence
  chemically synthesized
cactcttgtctgggcaaggg

SEQ ID NO: 3568 - DNA, 20 bp, Artificial Sequence
  chemically synthesized
ctgggcaagggaagaaaaaa

SEQ ID NO: 3569 - DNA, 20 bp, Artificial Sequence
  chemically synthesized
tgggcaagggaagaaaaaaa

SEQ ID NO: 3570 - DNA, 20 bp, Artificial Sequence
  chemically synthesized
aaaaggattgttaaatactg

SEQ ID NO: 3571 - DNA, 20 bp, Artificial Sequence
  chemically synthesized
tgttaaatactgaagaaaac

SEQ ID NO: 3572 - DNA, 20 bp, Artificial Sequence
  chemically synthesized
taaatactgaagaaaacaag

SEQ ID NO: 3573 - DNA, 20 bp, Artificial Sequence
  chemically synthesized
atatttctttccatttgact

SEQ ID NO: 3574 - DNA, 20 bp, Artificial Sequence
  chemically synthesized
atgcatttgtttcaaaatat

SEQ ID NO: 3575 - DNA, 20 bp, Artificial Sequence
  chemically synthesized
tgcatttgtttcaaaatatt

SEQ ID NO: 3576 - DNA, 20 bp, Artificial Sequence
  chemically synthesized
atattgggctctgattccta

SEQ ID NO: 3577 - DNA, 20 bp, Artificial Sequence
  chemically synthesized
ctgattcctacagaaaaact

SEQ ID NO: 3578 - DNA, 20 bp, Artificial Sequence
  chemically synthesized
tgattcctacagaaaaactc

SEQ ID NO: 3579 - DNA, 20 bp, Artificial Sequence
  chemically synthesized
ttatttcttctgcctttaaa

SEQ ID NO: 3580 - DNA, 20 bp, Artificial Sequence
  chemically synthesized
tttcttctgcctttaaacag

SEQ ID NO: 3581 - DNA, 20 bp, Artificial Sequence
  chemically synthesized
agaagaataattcaattacc

SEQ ID NO: 3582 - DNA, 20 bp, Artificial Sequence
  chemically synthesized
taaaaattattaaatattta

SEQ ID NO: 3583 - DNA, 20 bp, Artificial Sequence
  chemically synthesized
tatagccttatattcaaact

SEQ ID NO: 3584 - DNA, 20 bp, Artificial Sequence
  chemically synthesized
gataatatctaatactcttt

SEQ ID NO: 3585 - DNA, 20 bp, Artificial Sequence
  chemically synthesized
actcttttagtgtctatcaa

SEQ ID NO: 3586 - DNA, 20 bp, Artificial Sequence
  chemically synthesized
agtgtctatcaacagcaacc

SEQ ID NO: 3587 - DNA, 20 bp, Artificial Sequence
  chemically synthesized
gtctatcaacagcaaccaag

SEQ ID NO: 3588 - DNA, 20 bp, Artificial Sequence
  chemically synthesized
atcaacagcaaccaagaaga

SEQ ID NO: 3589 - DNA, 20 bp, Artificial Sequence
  chemically synthesized
atgaaaataaatataaatac

SEQ ID NO: 3590 - DNA, 20 bp, Artificial Sequence
  chemically synthesized
taaatacaagttctatttat

SEQ ID NO: 3591 - DNA, 20 bp, Artificial Sequence
  chemically synthesized
agttctatttatgagatcaa

SEQ ID NO: 3592 - DNA, 20 bp, Artificial Sequence
  chemically synthesized
tatttatgagatcaacagca

SEQ ID NO: 3593 - DNA, 20 bp, Artificial Sequence
  chemically synthesized
atttatgagatcaacagcac

SEQ ID NO: 3594 - DNA, 20 bp, Artificial Sequence
  chemically synthesized
gatcaacagcacaggttttg

SEQ ID NO: 3595 - DNA, 20 bp, Artificial Sequence
  chemically synthesized
ggttttgtggtttttaaata

SEQ ID NO: 3596 - DNA, 20 bp, Artificial Sequence
  chemically synthesized
tgtggtttttaaataaagca

SEQ ID NO: 3597 - DNA, 20 bp, Artificial Sequence
  chemically synthesized
ttaaataaagcatagtgcaa

SEQ ID NO: 3598 - DNA, 20 bp, Artificial Sequence
  chemically synthesized
ataaagcatagtgcaatgga

SEQ ID NO: 3599 - DNA, 20 bp, Artificial Sequence
  chemically synthesized
taaagcatagtgcaatggat

SEQ ID NO: 3600 - DNA, 20 bp, Artificial Sequence
  chemically synthesized
tagtgcaatggataggtctt

SEQ ID NO: 3601 - DNA, 20 bp, Artificial Sequence
  chemically synthesized
agtgcaatggataggtcttt

SEQ ID NO: 3602 - DNA, 20 bp, Artificial Sequence
  chemically synthesized
caatggataggtctttggga

SEQ ID NO: 3603 - DNA, 20 bp, Artificial Sequence
  chemically synthesized
atcttcaaccctattctgtg

SEQ ID NO: 3604 - DNA, 20 bp, Artificial Sequence
  chemically synthesized
aaccctattctgtgaagttt

SEQ ID NO: 3605 - DNA, 20 bp, Artificial Sequence
  chemically synthesized
tgtgaagtttcagtcactct

SEQ ID NO: 3606 - DNA, 20 bp, Artificial Sequence
  chemically synthesized
aagttactttgcactttcct

SEQ ID NO: 3607 - DNA, 20 bp, Artificial Sequence
  chemically synthesized
gcactttccttagtgcgcaa

SEQ ID NO: 3608 - DNA, 20 bp, Artificial Sequence
  chemically synthesized
tagtgcgcaaaagaaaatta

SEQ ID NO: 3609 - DNA, 20 bp, Artificial Sequence
  chemically synthesized
gacctttttttttttttacc

SEQ ID NO: 3610 - DNA, 20 bp, Artificial Sequence
  chemically synthesized
acctttttttttttttacct

SEQ ID NO: 3611 - DNA, 20 bp, Artificial Sequence
  chemically synthesized
gatgtttgaattttattaat

SEQ ID NO: 3612 - DNA, 20 bp, Artificial Sequence
  chemically synthesized
tattaataagataaccttgt

SEQ ID NO: 3613 - DNA, 20 bp, Artificial Sequence
  chemically synthesized
tacaaaatactatgccattt

SEQ ID NO: 3614 - DNA, 20 bp, Artificial Sequence
  chemically synthesized
aatgccaaaataattcttta

SEQ ID NO: 3615 - DNA, 20 bp, Artificial Sequence
  chemically synthesized
aaaataattctttaaagatg

SEQ ID NO: 3616 - DNA, 20 bp, Artificial Sequence
  chemically synthesized
aataattctttaaagatgca

SEQ ID NO: 3617 - DNA, 20 bp, Artificial Sequence
  chemically synthesized
ttactaaaactttattttac

SEQ ID NO: 3618 - DNA, 20 bp, Artificial Sequence
  chemically synthesized
tactaaaactttattttact

SEQ ID NO: 3619 - DNA, 20 bp, Artificial Sequence
  chemically synthesized
actttattttactgggaaaa

SEQ ID NO: 3620 - DNA, 20 bp, Artificial Sequence
  chemically synthesized
ttactgggaaaatagaataa

SEQ ID NO: 3621 - DNA, 20 bp, Artificial Sequence
  chemically synthesized
atagaataaaagttgaacaa

SEQ ID NO: 3622 - DNA, 20 bp, Artificial Sequence
  chemically synthesized
aaagttgaacaatagaaaaa

SEQ ID NO: 3623 - DNA, 20 bp, Artificial Sequence
  chemically synthesized
atctcgacgaaacacacccc

SEQ ID NO: 3624 - DNA, 20 bp, Artificial Sequence
  chemically synthesized
acgaaacacacccctggaat

SEQ ID NO: 3625 - DNA, 20 bp, Artificial Sequence
  chemically synthesized
acacacccctggaataagcc

SEQ ID NO: 3626 - DNA, 20 bp, Artificial Sequence
  chemically synthesized
ccctggaataagccgagcta

SEQ ID NO: 3627 - DNA, 20 bp, Artificial Sequence
  chemically synthesized
ctggaataagccgagctaaa

SEQ ID NO: 3628 - DNA, 20 bp, Artificial Sequence
  chemically synthesized
taagccgagctaaagagaaa

SEQ ID NO: 3629 - DNA, 20 bp, Artificial Sequence
  chemically synthesized
gccgagctaaagagaaaaag

SEQ ID NO: 3630 - DNA, 20 bp, Artificial Sequence
  chemically synthesized
ccgagctaaagagaaaaaga

SEQ ID NO: 3631 - DNA, 20 bp, Artificial Sequence
  chemically synthesized
cgagctaaagagaaaaagaa

SEQ ID NO: 3632 - DNA, 20 bp, Artificial Sequence
  chemically synthesized
agagaaaaagaagggaaata

SEQ ID NO: 3633 - DNA, 20 bp, Artificial Sequence
  chemically synthesized
gagaaaaagaagggaaataa

SEQ ID NO: 3634 - DNA, 20 bp, Artificial Sequence
  chemically synthesized
ttacccacttcattgtgcca

SEQ ID NO: 3635 - DNA, 20 bp, Artificial Sequence
  chemically synthesized
tacccacttcattgtgccaa

SEQ ID NO: 3636 - DNA, 20 bp, Artificial Sequence
  chemically synthesized
ttcattgtgccaaaggcgtg

SEQ ID NO: 3637 - DNA, 20 bp, Artificial Sequence
  chemically synthesized
tcattgtgccaaaggcgtgt

SEQ ID NO: 3638 - DNA, 20 bp, Artificial Sequence
  chemically synthesized
cattgtgccaaaggcgtgtg

SEQ ID NO: 3639 - DNA, 20 bp, Artificial Sequence
  chemically synthesized
ccaaaggcgtgtggggttga

SEQ ID NO: 3640 - DNA, 20 bp, Artificial Sequence
  chemically synthesized
aaggcgtgtggggttgacag

SEQ ID NO: 3641 - DNA, 20 bp, Artificial Sequence
  chemically synthesized
ggcgtgtggggttgacagaa

SEQ ID NO: 3642 - DNA, 20 bp, Artificial Sequence
  chemically synthesized
gtggggttgacagaagagaa

SEQ ID NO: 3643 - DNA, 20 bp, Artificial Sequence
  chemically synthesized
ggttgacagaagagaaaagc

SEQ ID NO: 3644 - DNA, 20 bp, Artificial Sequence
  chemically synthesized
gttgacagaagagaaaagct

SEQ ID NO: 3645 - DNA, 20 bp, Artificial Sequence
  chemically synthesized
aagagaaaagctaggacaaa

SEQ ID NO: 3646 - DNA, 20 bp, Artificial Sequence
  chemically synthesized
gagaaaagctaggacaaacg

SEQ ID NO: 3647 - DNA, 20 bp, Artificial Sequence
  chemically synthesized
agaaaagctaggacaaacgg

SEQ ID NO: 3648 - DNA, 20 bp, Artificial Sequence
  chemically synthesized
gaaaagctaggacaaacgga

SEQ ID NO: 3649 - DNA, 20 bp, Artificial Sequence
  chemically synthesized
taggacaaacggagggaaat

SEQ ID NO: 3650 - DNA, 20 bp, Artificial Sequence
  chemically synthesized
cacgcctttggcacaatgaa

SEQ ID NO: 3651 - DNA, 20 bp, Artificial Sequence
  chemically synthesized
tctttagctcggcttattcc

SEQ ID NO: 3652 - DNA, 20 bp, Artificial Sequence
  chemically synthesized
tagtaaactctgcatcttta

SEQ ID NO: 3653 - DNA, 20 bp, Artificial Sequence
  chemically synthesized
aggtaaaaaaaaaaaaaggt

SEQ ID NO: 3654 - DNA, 20 bp, Artificial Sequence
  chemically synthesized
aaggaaagtgcaaagtaact

SEQ ID NO: 3655 - DNA, 20 bp, Artificial Sequence
  chemically synthesized
ttagagtgactgaaacttca

SEQ ID NO: 3656 - DNA, 20 bp, Artificial Sequence
  chemically synthesized
gtgactgaaacttcacagaa

SEQ ID NO: 3657 - DNA, 20 bp, Artificial Sequence
  chemically synthesized
tcacagaatagggttgaaga

SEQ ID NO: 3658 - DNA, 20 bp, Artificial Sequence
  chemically synthesized
ttgctgttgatagacactaa

SEQ ID NO: 3659 - DNA, 20 bp, Artificial Sequence
  chemically synthesized
gtattagatattatctaagt

SEQ ID NO: 3660 - DNA, 20 bp, Artificial Sequence
  chemically synthesized
taaaatagtattcttggtaa

SEQ ID NO: 3661 - DNA, 20 bp, Artificial Sequence
  chemically synthesized
agaaataattgaacatcatc

SEQ ID NO: 3662 - DNA, 20 bp, Artificial Sequence
  chemically synthesized
atcatcctgagtttttctgt

SEQ ID NO: 3663 - DNA, 20 bp, Artificial Sequence
  chemically synthesized
ttttcttcccttgcccagac

SEQ ID NO: 3664 - DNA, 20 bp, Artificial Sequence
  chemically synthesized
ctgggcaagggaagaaaaaa

SEQ ID NO: 3665 - DNA, 20 bp, Artificial Sequence
  chemically synthesized
ctgattcctacagaaaaact

SEQ ID NO: 3666 - DNA, 20 bp, Artificial Sequence
  chemically synthesized
tttcttctgcctttaaacag

SEQ ID NO: 3667 - DNA, 20 bp, Artificial Sequence
  chemically synthesized
agaagaataattcaattacc

SEQ ID NO: 3668 - DNA, 20 bp, Artificial Sequence
  chemically synthesized
tttaaataaagcatagtgca

SEQ ID NO: 3669 - DNA, 20 bp, Artificial Sequence
  chemically synthesized
tagtgcaatggataggtctt

SEQ ID NO: 3670 - DNA, 20 bp, Artificial Sequence
  chemically synthesized
gataggtctttgggatagtt

SEQ ID NO: 3671 - DNA, 20 bp, Artificial Sequence
  chemically synthesized
gacctttttttttttttacc

SEQ ID NO: 3672 - DNA, 20 bp, Artificial Sequence
  chemically synthesized
tttttttttacctaggatgt

SEQ ID NO: 3673 - DNA, 20 bp, Artificial Sequence
  chemically synthesized
aaaataattctttaaagatg

SEQ ID NO: 3674 - DNA, 20 bp, Artificial Sequence
  chemically synthesized
actttattttactgggaaaa

SEQ ID NO: 3675 - DNA, 20 bp, Artificial Sequence
  chemically synthesized
aaaagttgaacaatagaaaa

SEQ ID NO: 3676 - DNA, 20 bp, Artificial Sequence
  chemically synthesized
atctcgacgaaacacacccc

SEQ ID NO: 3677 - DNA, 20 bp, Artificial Sequence
  chemically synthesized
ttcattgtgccaaaggcgtg

SEQ ID NO: 3678 - DNA, 20 bp, Artificial Sequence
  chemically synthesized
gtgtttcgtcgagatgcacg

SEQ ID NO: 3679 - DNA, 20 bp, Artificial Sequence
  chemically synthesized
ttagtaaactctgcatcttt

SEQ ID NO: 3680 - DNA, 20 bp, Artificial Sequence
  chemically synthesized
taggtaaaaaaaaaaaaagg

SEQ ID NO: 3681 - DNA, 20 bp, Artificial Sequence
  chemically synthesized
cttagagtgactgaaacttc

SEQ ID NO: 3682 - DNA, 20 bp, Artificial Sequence
  chemically synthesized
tattcttctgtttaaaggca

SEQ ID NO: 3683 - DNA, 20 bp, Artificial Sequence
  chemically synthesized
gcataatctaagtcaaatgg

SEQ ID NO: 3684 - DNA, 20 bp, Artificial Sequence
  chemically synthesized
atcggtttaaagatttggga

SEQ ID NO: 3685 - DNA, 20 bp, Artificial Sequence
  chemically synthesized
tcactcttgtctgggcaagg

SEQ ID NO: 3686 - DNA, 20 bp, Artificial Sequence
  chemically synthesized
aaaaaggattgttaaatact

SEQ ID NO: 3687 - DNA, 20 bp, Artificial Sequence
  chemically synthesized
aatattgggctctgattcct

SEQ ID NO: 3688 - DNA, 20 bp, Artificial Sequence
  chemically synthesized
atttcttctgcctttaaaca

SEQ ID NO: 3689 - DNA, 20 bp, Artificial Sequence
  chemically synthesized
cagaagaataattcaattac

SEQ ID NO: 3690 - DNA, 20 bp, Artificial Sequence
  chemically synthesized
tgcactttccttagtgcgca

SEQ ID NO: 3691 - DNA, 20 bp, Artificial Sequence
  chemically synthesized
atacaaaatactatgccatt

SEQ ID NO: 3692 - DNA, 20 bp, Artificial Sequence
  chemically synthesized
aactttattttactgggaaa

SEQ ID NO: 3693 - DNA, 20 bp, Artificial Sequence
  chemically synthesized
aatagaataaaagttgaaca

SEQ ID NO: 3694 - DNA, 20 bp, Artificial Sequence
  chemically synthesized
cctggaataagccgagctaa

SEQ ID NO: 3695 - DNA, 20 bp, Artificial Sequence
  chemically synthesized
aggcgtgtggggttgacaga

SEQ ID NO: 3696 - DNA, 20 bp, Artificial Sequence
  chemically synthesized
cattgcactatgctttattt

SEQ ID NO: 3697 - DNA, 20 bp, Artificial Sequence
  chemically synthesized
tatgctttatttaaaaacca

SEQ ID NO: 3698 - DNA, 20 bp, Artificial Sequence
  chemically synthesized
aaggattgttaaatactgaa

SEQ ID NO: 3699 - DNA, 20 bp, Artificial Sequence
  chemically synthesized
ttgggctctgattcctacag

SEQ ID NO: 3700 - DNA, 20 bp, Artificial Sequence
  chemically synthesized
tttaaagatgcagagtttac

SEQ ID NO: 3701 - DNA, 20 bp, Artificial Sequence
  chemically synthesized
gtatattagtgctaatttcc

SEQ ID NO: 3702 - DNA, 20 bp, Artificial Sequence
  chemically synthesized
gctaatttccctccgtttgt

SEQ ID NO: 3703 - DNA, 20 bp, Artificial Sequence
  chemically synthesized
tcccttctttttctctttag

SEQ ID NO: 3704 - DNA, 20 bp, Artificial Sequence
  chemically synthesized
tagctcggcttattccaggg

SEQ ID NO: 3705 - DNA, 20 bp, Artificial Sequence
  chemically synthesized
attctattttcccagtaaaa

SEQ ID NO: 3706 - DNA, 20 bp, Artificial Sequence
  chemically synthesized
taaaaaaaaaaaaaggtcag

SEQ ID NO: 3707 - DNA, 20 bp, Artificial Sequence
  chemically synthesized
gaaacttcacagaatagggt

SEQ ID NO: 3708 - DNA, 20 bp, Artificial Sequence
  chemically synthesized
ccaaagacctatccattgca

SEQ ID NO: 3709 - DNA, 20 bp, Artificial Sequence
  chemically synthesized
aaaagagtattagatattat

SEQ ID NO: 3710 - DNA, 20 bp, Artificial Sequence
  chemically synthesized
tcttggtaattgaattattc

SEQ ID NO: 3711 - DNA, 20 bp, Artificial Sequence
  chemically synthesized
agaaataattgaacatcatc

SEQ ID NO: 3712 - DNA, 20 bp, Artificial Sequence
  chemically synthesized
taaaaagtaacattattact

SEQ ID NO: 3713 - DNA, 20 bp, Artificial Sequence
  chemically synthesized
agacaagagtgaggttgctc

SEQ ID NO: 3714 - DNA, 20 bp, Artificial Sequence
  chemically synthesized
agtgaggttgctcatcggtt

SEQ ID NO: 3715 - DNA, 20 bp, Artificial Sequence
  chemically synthesized
tctgggcaagggaagaaaaa

SEQ ID NO: 3716 - DNA, 20 bp, Artificial Sequence
  chemically synthesized
ttatatttctttccatttga

SEQ ID NO: 3717 - DNA, 20 bp, Artificial Sequence
  chemically synthesized
ccatttgacttagattatgc

SEQ ID NO: 3718 - DNA, 20 bp, Artificial Sequence
  chemically synthesized
atttgtttcaaaatattggg

SEQ ID NO: 3719 - DNA, 20 bp, Artificial Sequence
  chemically synthesized
ctatttatgagatcaacagc

SEQ ID NO: 3720 - DNA, 20 bp, Artificial Sequence
  chemically synthesized
gagatcaacagcacaggttt

SEQ ID NO: 3721 - DNA, 20 bp, Artificial Sequence
  chemically synthesized
caatcttcaaccctattctg

SEQ ID NO: 3722 - DNA, 20 bp, Artificial Sequence
  chemically synthesized
cctttttttttttttaccta

SEQ ID NO: 3723 - DNA, 20 bp, Artificial Sequence
  chemically synthesized
aaaataattctttaaagatg

SEQ ID NO: 3724 - DNA, 20 bp, Artificial Sequence
  chemically synthesized
taaaagttgaacaatagaaa

SEQ ID NO: 3725 - DNA, 22 bp, Artificial Sequence
  chemically synthesized
gtgctaatttccctccgtttgt

SEQ ID NO: 3726 - DNA, 22 bp, Artificial Sequence
  chemically synthesized
atttccctccgtttgtcctagc

SEQ ID NO: 3727 - DNA, 22 bp, Artificial Sequence
  chemically synthesized
ccctccgtttgtcctagctttt

SEQ ID NO: 3728 - DNA, 22 bp, Artificial Sequence
  chemically synthesized
cctccgtttgtcctagcttttc

SEQ ID NO: 3729 - DNA, 22 bp, Artificial Sequence
  chemically synthesized
cgtttgtcctagcttttctctt

SEQ ID NO: 3730 - DNA, 22 bp, Artificial Sequence
  chemically synthesized
gtcctagcttttctcttctgtc

SEQ ID NO: 3731 - DNA, 22 bp, Artificial Sequence
  chemically synthesized
tcctagcttttctcttctgtca

SEQ ID NO: 3732 - DNA, 22 bp, Artificial Sequence
  chemically synthesized
gcttttctcttctgtcaacccc

SEQ ID NO: 3733 - DNA, 22 bp, Artificial Sequence
  chemically synthesized
ttctcttctgtcaaccccacac

SEQ ID NO: 3734 - DNA, 22 bp, Artificial Sequence
  chemically synthesized
tctcttctgtcaaccccacacg

SEQ ID NO: 3735 - DNA, 22 bp, Artificial Sequence
  chemically synthesized
ctcttctgtcaaccccacacgc

SEQ ID NO: 3736 - DNA, 22 bp, Artificial Sequence
  chemically synthesized
tcttctgtcaaccccacacgcc

SEQ ID NO: 3737 - DNA, 22 bp, Artificial Sequence
  chemically synthesized
ttctgtcaaccccacacgcctt

SEQ ID NO: 3738 - DNA, 22 bp, Artificial Sequence
  chemically synthesized
ctgtcaaccccacacgcctttg

SEQ ID NO: 3739 - DNA, 22 bp, Artificial Sequence
  chemically synthesized
tgtcaaccccacacgcctttgg

SEQ ID NO: 3740 - DNA, 22 bp, Artificial Sequence
  chemically synthesized
tcaaccccacacgcctttggca

SEQ ID NO: 3741 - DNA, 22 bp, Artificial Sequence
  chemically synthesized
tggcacaatgaagtgggtaacc

SEQ ID NO: 3742 - DNA, 22 bp, Artificial Sequence
  chemically synthesized
ggcacaatgaagtgggtaacct

SEQ ID NO: 3743 - DNA, 22 bp, Artificial Sequence
  chemically synthesized
gcacaatgaagtgggtaacctt

SEQ ID NO: 3744 - DNA, 22 bp, Artificial Sequence
  chemically synthesized
tatttcccttctttttctcttt

SEQ ID NO: 3745 - DNA, 22 bp, Artificial Sequence
  chemically synthesized
atttcccttctttttctcttta

SEQ ID NO: 3746 - DNA, 22 bp, Artificial Sequence
  chemically synthesized
tttcccttctttttctctttag

SEQ ID NO: 3747 - DNA, 22 bp, Artificial Sequence
  chemically synthesized
cccttctttttctctttagctc

SEQ ID NO: 3748 - DNA, 22 bp, Artificial Sequence
  chemically synthesized
ccttctttttctctttagctcg

SEQ ID NO: 3749 - DNA, 22 bp, Artificial Sequence
  chemically synthesized
ctttttctctttagctcggctt

SEQ ID NO: 3750 - DNA, 22 bp, Artificial Sequence
  chemically synthesized
tttttctctttagctcggctta

SEQ ID NO: 3751 - DNA, 22 bp, Artificial Sequence
  chemically synthesized
tttctctttagctcggcttatt

SEQ ID NO: 3752 - DNA, 22 bp, Artificial Sequence
  chemically synthesized
ttctctttagctcggcttattc

SEQ ID NO: 3753 - DNA, 22 bp, Artificial Sequence
  chemically synthesized
tctctttagctcggcttattcc

SEQ ID NO: 3754 - DNA, 22 bp, Artificial Sequence
  chemically synthesized
ctctttagctcggcttattcca

SEQ ID NO: 3755 - DNA, 22 bp, Artificial Sequence
  chemically synthesized
tctttagctcggcttattccag

SEQ ID NO: 3756 - DNA, 22 bp, Artificial Sequence
  chemically synthesized
tttagctcggcttattccaggg

SEQ ID NO: 3757 - DNA, 22 bp, Artificial Sequence
  chemically synthesized
tagctcggcttattccaggggt

SEQ ID NO: 3758 - DNA, 22 bp, Artificial Sequence
  chemically synthesized
agctcggcttattccaggggtg

SEQ ID NO: 3759 - DNA, 22 bp, Artificial Sequence
  chemically synthesized
gctcggcttattccaggggtgt

SEQ ID NO: 3760 - DNA, 22 bp, Artificial Sequence
  chemically synthesized
ggcttattccaggggtgtgttt

SEQ ID NO: 3761 - DNA, 22 bp, Artificial Sequence
  chemically synthesized
attccaggggtgtgtttcgtcg

SEQ ID NO: 3762 - DNA, 22 bp, Artificial Sequence
  chemically synthesized
ttccaggggtgtgtttcgtcga

SEQ ID NO: 3763 - DNA, 22 bp, Artificial Sequence
  chemically synthesized
caggggtgtgtttcgtcgagat

SEQ ID NO: 3764 - DNA, 22 bp, Artificial Sequence
  chemically synthesized
cgtcgagatgcacgtaagaaat

SEQ ID NO: 3765 - DNA, 22 bp, Artificial Sequence
  chemically synthesized
gtcgagatgcacgtaagaaatc

SEQ ID NO: 3766 - DNA, 22 bp, Artificial Sequence
  chemically synthesized
ttctattgttcaacttttattc

SEQ ID NO: 3767 - DNA, 22 bp, Artificial Sequence
  chemically synthesized
tctattgttcaacttttattct

SEQ ID NO: 3768 - DNA, 22 bp, Artificial Sequence
  chemically synthesized
ctattgttcaacttttattcta

SEQ ID NO: 3769 - DNA, 22 bp, Artificial Sequence
  chemically synthesized
tattgttcaacttttattctat

SEQ ID NO: 3770 - DNA, 22 bp, Artificial Sequence
  chemically synthesized
ttgttcaacttttattctattt

SEQ ID NO: 3771 - DNA, 22 bp, Artificial Sequence
  chemically synthesized
ttcaacttttattctattttcc

SEQ ID NO: 3772 - DNA, 22 bp, Artificial Sequence
  chemically synthesized
aacttttattctattttcccag

SEQ ID NO: 3773 - DNA, 22 bp, Artificial Sequence
  chemically synthesized
ttattctattttcccagtaaaa

SEQ ID NO: 3774 - DNA, 22 bp, Artificial Sequence
  chemically synthesized
tattctattttcccagtaaaat

SEQ ID NO: 3775 - DNA, 22 bp, Artificial Sequence
  chemically synthesized
attctattttcccagtaaaata

SEQ ID NO: 3776 - DNA, 22 bp, Artificial Sequence
  chemically synthesized
ttctattttcccagtaaaataa

SEQ ID NO: 3777 - DNA, 22 bp, Artificial Sequence
  chemically synthesized
tattttcccagtaaaataaagt

SEQ ID NO: 3778 - DNA, 22 bp, Artificial Sequence
  chemically synthesized
ttttcccagtaaaataaagttt

SEQ ID NO: 3779 - DNA, 22 bp, Artificial Sequence
  chemically synthesized
tcccagtaaaataaagttttag

SEQ ID NO: 3780 - DNA, 22 bp, Artificial Sequence
  chemically synthesized
cccagtaaaataaagttttagt

SEQ ID NO: 3781 - DNA, 22 bp, Artificial Sequence
  chemically synthesized
ccagtaaaataaagttttagta

SEQ ID NO: 3782 - DNA, 22 bp, Artificial Sequence
  chemically synthesized
tagtaaactctgcatctttaaa

SEQ ID NO: 3783 - DNA, 22 bp, Artificial Sequence
  chemically synthesized
agtaaactctgcatctttaaag

SEQ ID NO: 3784 - DNA, 22 bp, Artificial Sequence
  chemically synthesized
gtaaactctgcatctttaaaga

SEQ ID NO: 3785 - DNA, 22 bp, Artificial Sequence
  chemically synthesized
tgcatctttaaagaattatttt

SEQ ID NO: 3786 - DNA, 22 bp, Artificial Sequence
  chemically synthesized
catctttaaagaattattttgg

SEQ ID NO: 3787 - DNA, 22 bp, Artificial Sequence
  chemically synthesized
taaagaattattttggcattta

SEQ ID NO: 3788 - DNA, 22 bp, Artificial Sequence
  chemically synthesized
aaagaattattttggcatttat

SEQ ID NO: 3789 - DNA, 22 bp, Artificial Sequence
  chemically synthesized
aagaattattttggcatttatt

SEQ ID NO: 3790 - DNA, 22 bp, Artificial Sequence
  chemically synthesized
ttttggcatttatttctaaaat

SEQ ID NO: 3791 - DNA, 22 bp, Artificial Sequence
  chemically synthesized
tggcatttatttctaaaatggc

SEQ ID NO: 3792 - DNA, 22 bp, Artificial Sequence
  chemically synthesized
ggcatttatttctaaaatggca

SEQ ID NO: 3793 - DNA, 22 bp, Artificial Sequence
  chemically synthesized
gcatttatttctaaaatggcat

SEQ ID NO: 3794 - DNA, 22 bp, Artificial Sequence
  chemically synthesized
atttctaaaatggcatagtatt

SEQ ID NO: 3795 - DNA, 22 bp, Artificial Sequence
  chemically synthesized
tttctaaaatggcatagtattt

SEQ ID NO: 3796 - DNA, 22 bp, Artificial Sequence
  chemically synthesized
ctaaaatggcatagtattttgt

SEQ ID NO: 3797 - DNA, 22 bp, Artificial Sequence
  chemically synthesized
taaaatggcatagtattttgta

SEQ ID NO: 3798 - DNA, 22 bp, Artificial Sequence
  chemically synthesized
aaatggcatagtattttgtatt

SEQ ID NO: 3799 - DNA, 22 bp, Artificial Sequence
  chemically synthesized
tgtatttgtgaagtcttacaag

SEQ ID NO: 3800 - DNA, 22 bp, Artificial Sequence
  chemically synthesized
gtatttgtgaagtcttacaagg

SEQ ID NO: 3801 - DNA, 22 bp, Artificial Sequence
  chemically synthesized
tatttgtgaagtcttacaaggt

SEQ ID NO: 3802 - DNA, 22 bp, Artificial Sequence
  chemically synthesized
gtgaagtcttacaaggttatct

SEQ ID NO: 3803 - DNA, 22 bp, Artificial Sequence
  chemically synthesized
tgaagtcttacaaggttatctt

SEQ ID NO: 3804 - DNA, 22 bp, Artificial Sequence
  chemically synthesized
acaaggttatcttattaataaa

SEQ ID NO: 3805 - DNA, 22 bp, Artificial Sequence
  chemically synthesized
caaggttatcttattaataaaa

SEQ ID NO: 3806 - DNA, 22 bp, Artificial Sequence
  chemically synthesized
tcttattaataaaattcaaaca

SEQ ID NO: 3807 - DNA, 22 bp, Artificial Sequence
  chemically synthesized
attaataaaattcaaacatcct

SEQ ID NO: 3808 - DNA, 22 bp, Artificial Sequence
  chemically synthesized
ttaataaaattcaaacatccta

SEQ ID NO: 3809 - DNA, 22 bp, Artificial Sequence
  chemically synthesized
ataaaattcaaacatcctaggt

SEQ ID NO: 3810 - DNA, 22 bp, Artificial Sequence
  chemically synthesized
aaacatcctaggtaaaaaaaaa

SEQ ID NO: 3811 - DNA, 22 bp, Artificial Sequence
  chemically synthesized
ggtaaaaaaaaaaaaaggtcag

SEQ ID NO: 3812 - DNA, 22 bp, Artificial Sequence
  chemically synthesized
tttagtgactgtaattttcttt

SEQ ID NO: 3813 - DNA, 22 bp, Artificial Sequence
  chemically synthesized
agtgactgtaattttcttttgc

SEQ ID NO: 3814 - DNA, 22 bp, Artificial Sequence
  chemically synthesized
gtgactgtaattttcttttgcg

SEQ ID NO: 3815 - DNA, 22 bp, Artificial Sequence
  chemically synthesized
taattttcttttgcgcactaag

SEQ ID NO: 3816 - DNA, 22 bp, Artificial Sequence
  chemically synthesized
tcttttgcgcactaaggaaagt

SEQ ID NO: 3817 - DNA, 22 bp, Artificial Sequence
  chemically synthesized
cttttgcgcactaaggaaagtg

SEQ ID NO: 3818 - DNA, 22 bp, Artificial Sequence
  chemically synthesized
ttttgcgcactaaggaaagtgc

SEQ ID NO: 3819 - DNA, 22 bp, Artificial Sequence
  chemically synthesized
ttgcgcactaaggaaagtgcaa

SEQ ID NO: 3820 - DNA, 22 bp, Artificial Sequence
  chemically synthesized
tgcgcactaaggaaagtgcaaa

SEQ ID NO: 3821 - DNA, 22 bp, Artificial Sequence
  chemically synthesized
gcgcactaaggaaagtgcaaag

SEQ ID NO: 3822 - DNA, 22 bp, Artificial Sequence
  chemically synthesized
cgcactaaggaaagtgcaaagt

SEQ ID NO: 3823 - DNA, 22 bp, Artificial Sequence
  chemically synthesized
aggaaagtgcaaagtaacttag

SEQ ID NO: 3824 - DNA, 22 bp, Artificial Sequence
  chemically synthesized
agagtgactgaaacttcacaga

SEQ ID NO: 3825 - DNA, 22 bp, Artificial Sequence
  chemically synthesized
gagtgactgaaacttcacagaa

SEQ ID NO: 3826 - DNA, 22 bp, Artificial Sequence
  chemically synthesized
aaacttcacagaatagggttga

SEQ ID NO: 3827 - DNA, 22 bp, Artificial Sequence
  chemically synthesized
cacagaatagggttgaagattg

SEQ ID NO: 3828 - DNA, 22 bp, Artificial Sequence
  chemically synthesized
acagaatagggttgaagattga

SEQ ID NO: 3829 - DNA, 22 bp, Artificial Sequence
  chemically synthesized
aagattgaattcataactatcc

SEQ ID NO: 3830 - DNA, 22 bp, Artificial Sequence
  chemically synthesized
aattcataactatcccaaagac

SEQ ID NO: 3831 - DNA, 22 bp, Artificial Sequence
  chemically synthesized
ataactatcccaaagacctatc

SEQ ID NO: 3832 - DNA, 22 bp, Artificial Sequence
  chemically synthesized
tcccaaagacctatccattgca

SEQ ID NO: 3833 - DNA, 22 bp, Artificial Sequence
  chemically synthesized
tccattgcactatgctttattt

SEQ ID NO: 3834 - DNA, 22 bp, Artificial Sequence
  chemically synthesized
cactatgctttatttaaaaacc

SEQ ID NO: 3835 - DNA, 22 bp, Artificial Sequence
  chemically synthesized
tgctttatttaaaaaccacaaa

SEQ ID NO: 3836 - DNA, 22 bp, Artificial Sequence
  chemically synthesized
tatttaaaaaccacaaaacctg

SEQ ID NO: 3837 - DNA, 22 bp, Artificial Sequence
  chemically synthesized
atttaaaaaccacaaaacctgt

SEQ ID NO: 3838 - DNA, 22 bp, Artificial Sequence
  chemically synthesized
tttaaaaaccacaaaacctgtg

SEQ ID NO: 3839 - DNA, 22 bp, Artificial Sequence
  chemically synthesized
aaaaaccacaaaacctgtgctg

SEQ ID NO: 3840 - DNA, 22 bp, Artificial Sequence
  chemically synthesized
aaaaccacaaaacctgtgctgt

SEQ ID NO: 3841 - DNA, 22 bp, Artificial Sequence
  chemically synthesized
tgctgttgatctcataaataga

SEQ ID NO: 3842 - DNA, 22 bp, Artificial Sequence
  chemically synthesized
ttgatctcataaatagaacttg

SEQ ID NO: 3843 - DNA, 22 bp, Artificial Sequence
  chemically synthesized
atctcataaatagaacttgtat

SEQ ID NO: 3844 - DNA, 22 bp, Artificial Sequence
  chemically synthesized
ataaatagaacttgtatttata

SEQ ID NO: 3845 - DNA, 22 bp, Artificial Sequence
  chemically synthesized
gtatttatatttattttcattt

SEQ ID NO: 3846 - DNA, 22 bp, Artificial Sequence
  chemically synthesized
tatttatatttattttcatttt

SEQ ID NO: 3847 - DNA, 22 bp, Artificial Sequence
  chemically synthesized
atatttattttcattttagtct

SEQ ID NO: 3848 - DNA, 22 bp, Artificial Sequence
  chemically synthesized
tatttattttcattttagtctg

SEQ ID NO: 3849 - DNA, 22 bp, Artificial Sequence
  chemically synthesized
attttcattttagtctgtcttc

SEQ ID NO: 3850 - DNA, 22 bp, Artificial Sequence
  chemically synthesized
ttttcattttagtctgtcttct

SEQ ID NO: 3851 - DNA, 22 bp, Artificial Sequence
  chemically synthesized
tcattttagtctgtcttcttgg

SEQ ID NO: 3852 - DNA, 22 bp, Artificial Sequence
  chemically synthesized
cattttagtctgtcttcttggt

SEQ ID NO: 3853 - DNA, 22 bp, Artificial Sequence
  chemically synthesized
attttagtctgtcttcttggtt

SEQ ID NO: 3854 - DNA, 22 bp, Artificial Sequence
  chemically synthesized
tagtctgtcttcttggttgctg

SEQ ID NO: 3855 - DNA, 22 bp, Artificial Sequence
  chemically synthesized
agtctgtcttcttggttgctgt

SEQ ID NO: 3856 - DNA, 22 bp, Artificial Sequence
  chemically synthesized
gtctgtcttcttggttgctgtt

SEQ ID NO: 3857 - DNA, 22 bp, Artificial Sequence
  chemically synthesized
tcttcttggttgctgttgatag

SEQ ID NO: 3858 - DNA, 22 bp, Artificial Sequence
  chemically synthesized
cttggttgctgttgatagacac

SEQ ID NO: 3859 - DNA, 22 bp, Artificial Sequence
  chemically synthesized
ttggttgctgttgatagacact

SEQ ID NO: 3860 - DNA, 22 bp, Artificial Sequence
  chemically synthesized
ggttgctgttgatagacactaa

SEQ ID NO: 3861 - DNA, 22 bp, Artificial Sequence
  chemically synthesized
gttgctgttgatagacactaaa

SEQ ID NO: 3862 - DNA, 22 bp, Artificial Sequence
  chemically synthesized
ctgttgatagacactaaaagag

SEQ ID NO: 3863 - DNA, 22 bp, Artificial Sequence
  chemically synthesized
ttgatagacactaaaagagtat

SEQ ID NO: 3864 - DNA, 22 bp, Artificial Sequence
  chemically synthesized
atagacactaaaagagtattag

SEQ ID NO: 3865 - DNA, 22 bp, Artificial Sequence
  chemically synthesized
aaagagtattagatattatcta

SEQ ID NO: 3866 - DNA, 22 bp, Artificial Sequence
  chemically synthesized
gatattatctaagtttgaatat

SEQ ID NO: 3867 - DNA, 22 bp, Artificial Sequence
  chemically synthesized
tctaagtttgaatataaggcta

SEQ ID NO: 3868 - DNA, 22 bp, Artificial Sequence
  chemically synthesized
agtttgaatataaggctataaa

SEQ ID NO: 3869 - DNA, 22 bp, Artificial Sequence
  chemically synthesized
gaatataaggctataaatattt

SEQ ID NO: 3870 - DNA, 22 bp, Artificial Sequence
  chemically synthesized
aatataaggctataaatattta

SEQ ID NO: 3871 - DNA, 22 bp, Artificial Sequence
  chemically synthesized
taaatatttaataatttttaaa

SEQ ID NO: 3872 - DNA, 22 bp, Artificial Sequence
  chemically synthesized
aataatttttaaaatagtattc

SEQ ID NO: 3873 - DNA, 22 bp, Artificial Sequence
  chemically synthesized
ataatttttaaaatagtattct

SEQ ID NO: 3874 - DNA, 22 bp, Artificial Sequence
  chemically synthesized
ttaaaatagtattcttggtaat

SEQ ID NO: 3875 - DNA, 22 bp, Artificial Sequence
  chemically synthesized
taaaatagtattcttggtaatt

SEQ ID NO: 3876 - DNA, 22 bp, Artificial Sequence
  chemically synthesized
aaaatagtattcttggtaattg

SEQ ID NO: 3877 - DNA, 22 bp, Artificial Sequence
  chemically synthesized
aaatagtattcttggtaattga

SEQ ID NO: 3878 - DNA, 22 bp, Artificial Sequence
  chemically synthesized
ttggtaattgaattattcttct

SEQ ID NO: 3879 - DNA, 22 bp, Artificial Sequence
  chemically synthesized
ggtaattgaattattcttctgt

SEQ ID NO: 3880 - DNA, 22 bp, Artificial Sequence
  chemically synthesized
gtaattgaattattcttctgtt

SEQ ID NO: 3881 - DNA, 22 bp, Artificial Sequence
  chemically synthesized
aattattcttctgtttaaaggc

SEQ ID NO: 3882 - DNA, 22 bp, Artificial Sequence
  chemically synthesized
ttcttctgtttaaaggcagaag

SEQ ID NO: 3883 - DNA, 22 bp, Artificial Sequence
  chemically synthesized
ttctgtttaaaggcagaagaaa

SEQ ID NO: 3884 - DNA, 22 bp, Artificial Sequence
  chemically synthesized
ctgtttaaaggcagaagaaata

SEQ ID NO: 3885 - DNA, 22 bp, Artificial Sequence
  chemically synthesized
tgtttaaaggcagaagaaataa

SEQ ID NO: 3886 - DNA, 22 bp, Artificial Sequence
  chemically synthesized
tttaaaggcagaagaaataatt

SEQ ID NO: 3887 - DNA, 22 bp, Artificial Sequence
  chemically synthesized
aaaggcagaagaaataattgaa

SEQ ID NO: 3888 - DNA, 22 bp, Artificial Sequence
  chemically synthesized
aaggcagaagaaataattgaac

SEQ ID NO: 3889 - DNA, 22 bp, Artificial Sequence
  chemically synthesized
aacatcatcctgagtttttctg

SEQ ID NO: 3890 - DNA, 22 bp, Artificial Sequence
  chemically synthesized
agtttttctgtaggaatcagag

SEQ ID NO: 3891 - DNA, 22 bp, Artificial Sequence
  chemically synthesized
ttctgtaggaatcagagcccaa

SEQ ID NO: 3892 - DNA, 22 bp, Artificial Sequence
  chemically synthesized
tctgtaggaatcagagcccaat

SEQ ID NO: 3893 - DNA, 22 bp, Artificial Sequence
  chemically synthesized
ctgtaggaatcagagcccaata

SEQ ID NO: 3894 - DNA, 22 bp, Artificial Sequence
  chemically synthesized
tgtaggaatcagagcccaatat

SEQ ID NO: 3895 - DNA, 22 bp, Artificial Sequence
  chemically synthesized
taggaatcagagcccaatattt

SEQ ID NO: 3896 - DNA, 22 bp, Artificial Sequence
  chemically synthesized
tgaaacaaatgcataatctaag

SEQ ID NO: 3897 - DNA, 22 bp, Artificial Sequence
  chemically synthesized
gaaacaaatgcataatctaagt

SEQ ID NO: 3898 - DNA, 22 bp, Artificial Sequence
  chemically synthesized
aaacaaatgcataatctaagtc

SEQ ID NO: 3899 - DNA, 22 bp, Artificial Sequence
  chemically synthesized
agtcaaatggaaagaaatataa

SEQ ID NO: 3900 - DNA, 22 bp, Artificial Sequence
  chemically synthesized
ttacttcttgttttcttcagta

SEQ ID NO: 3901 - DNA, 22 bp, Artificial Sequence
  chemically synthesized
cttcttgttttcttcagtattt

SEQ ID NO: 3902 - DNA, 22 bp, Artificial Sequence
  chemically synthesized
cttgttttcttcagtatttaac

SEQ ID NO: 3903 - DNA, 22 bp, Artificial Sequence
  chemically synthesized
ttgttttcttcagtatttaaca

SEQ ID NO: 3904 - DNA, 22 bp, Artificial Sequence
  chemically synthesized
gttttcttcagtatttaacaat

SEQ ID NO: 3905 - DNA, 22 bp, Artificial Sequence
  chemically synthesized
ttttcttcagtatttaacaatc

SEQ ID NO: 3906 - DNA, 22 bp, Artificial Sequence
  chemically synthesized
tcttcagtatttaacaatcctt

SEQ ID NO: 3907 - DNA, 22 bp, Artificial Sequence
  chemically synthesized
cttcagtatttaacaatccttt

SEQ ID NO: 3908 - DNA, 22 bp, Artificial Sequence
  chemically synthesized
ttcagtatttaacaatcctttt

SEQ ID NO: 3909 - DNA, 22 bp, Artificial Sequence
  chemically synthesized
cagtatttaacaatcctttttt

SEQ ID NO: 3910 - DNA, 22 bp, Artificial Sequence
  chemically synthesized
agtatttaacaatccttttttt

SEQ ID NO: 3911 - DNA, 22 bp, Artificial Sequence
  chemically synthesized
aacaatccttttttttcttccc

SEQ ID NO: 3912 - DNA, 22 bp, Artificial Sequence
  chemically synthesized
acaatccttttttttcttccct

SEQ ID NO: 3913 - DNA, 22 bp, Artificial Sequence
  chemically synthesized
ttttttcttcccttgcccagac

SEQ ID NO: 3914 - DNA, 22 bp, Artificial Sequence
  chemically synthesized
tttttcttcccttgcccagaca

SEQ ID NO: 3915 - DNA, 22 bp, Artificial Sequence
  chemically synthesized
ttttcttcccttgcccagacaa

SEQ ID NO: 3916 - DNA, 22 bp, Artificial Sequence
  chemically synthesized
tttcttcccttgcccagacaag

SEQ ID NO: 3917 - DNA, 22 bp, Artificial Sequence
  chemically synthesized
ttcttcccttgcccagacaaga

SEQ ID NO: 3918 - DNA, 22 bp, Artificial Sequence
  chemically synthesized
tcttcccttgcccagacaagag

SEQ ID NO: 3919 - DNA, 22 bp, Artificial Sequence
  chemically synthesized
cttcccttgcccagacaagagt

SEQ ID NO: 3920 - DNA, 22 bp, Artificial Sequence
  chemically synthesized
ttcccttgcccagacaagagtg

SEQ ID NO: 3921 - DNA, 22 bp, Artificial Sequence
  chemically synthesized
cccttgcccagacaagagtgag

SEQ ID NO: 3922 - DNA, 22 bp, Artificial Sequence
  chemically synthesized
ccttgcccagacaagagtgagg

SEQ ID NO: 3923 - DNA, 22 bp, Artificial Sequence
  chemically synthesized
gcccagacaagagtgaggttgc

SEQ ID NO: 3924 - DNA, 22 bp, Artificial Sequence
  chemically synthesized
cccagacaagagtgaggttgct

SEQ ID NO: 3925 - DNA, 22 bp, Artificial Sequence
  chemically synthesized
ctcatcggtttaaagatttggg

SEQ ID NO: 3926 - DNA, 22 bp, Artificial Sequence
  chemically synthesized
atcggtttaaagatttgggaga

SEQ ID NO: 3927 - DNA, 22 bp, Artificial Sequence
  chemically synthesized
aaagatttgggagaagaaaatt

SEQ ID NO: 3928 - DNA, 22 bp, Artificial Sequence
  chemically synthesized
aagatttgggagaagaaaattt

SEQ ID NO: 3929 - DNA, 22 bp, Artificial Sequence
  chemically synthesized
gggagaagaaaatttcaaagcc

SEQ ID NO: 3930 - DNA, 22 bp, Artificial Sequence
  chemically synthesized
ggagaagaaaatttcaaagcct

SEQ ID NO: 3931 - DNA, 22 bp, Artificial Sequence
  chemically synthesized
tgaaattttcttctcccaaatc

SEQ ID NO: 3932 - DNA, 22 bp, Artificial Sequence
  chemically synthesized
gaaattttcttctcccaaatct

SEQ ID NO: 3933 - DNA, 22 bp, Artificial Sequence
  chemically synthesized
aaattttcttctcccaaatctt

SEQ ID NO: 3934 - DNA, 22 bp, Artificial Sequence
  chemically synthesized
tcttctcccaaatctttaaacc

SEQ ID NO: 3935 - DNA, 22 bp, Artificial Sequence
  chemically synthesized
cttctcccaaatctttaaaccg

SEQ ID NO: 3936 - DNA, 22 bp, Artificial Sequence
  chemically synthesized
ttctcccaaatctttaaaccga

SEQ ID NO: 3937 - DNA, 22 bp, Artificial Sequence
  chemically synthesized
ctcccaaatctttaaaccgatg

SEQ ID NO: 3938 - DNA, 22 bp, Artificial Sequence
  chemically synthesized
tcccaaatctttaaaccgatga

SEQ ID NO: 3939 - DNA, 22 bp, Artificial Sequence
  chemically synthesized
ccaaatctttaaaccgatgagc

SEQ ID NO: 3940 - DNA, 22 bp, Artificial Sequence
  chemically synthesized
taaaccgatgagcaacctcact

SEQ ID NO: 3941 - DNA, 22 bp, Artificial Sequence
  chemically synthesized
aaaccgatgagcaacctcactc

SEQ ID NO: 3942 - DNA, 22 bp, Artificial Sequence
  chemically synthesized
aaccgatgagcaacctcactct

SEQ ID NO: 3943 - DNA, 22 bp, Artificial Sequence
  chemically synthesized
actcttgtctgggcaagggaag

SEQ ID NO: 3944 - DNA, 22 bp, Artificial Sequence
  chemically synthesized
ttgtctgggcaagggaagaaaa

SEQ ID NO: 3945 - DNA, 22 bp, Artificial Sequence
  chemically synthesized
gtctgggcaagggaagaaaaaa

SEQ ID NO: 3946 - DNA, 22 bp, Artificial Sequence
  chemically synthesized
tctgggcaagggaagaaaaaaa

SEQ ID NO: 3947 - DNA, 22 bp, Artificial Sequence
  chemically synthesized
ggcaagggaagaaaaaaaagga

SEQ ID NO: 3948 - DNA, 22 bp, Artificial Sequence
  chemically synthesized
ttaaatactgaagaaaacaaga

SEQ ID NO: 3949 - DNA, 22 bp, Artificial Sequence
  chemically synthesized
aatactgaagaaaacaagaagt

SEQ ID NO: 3950 - DNA, 22 bp, Artificial Sequence
  chemically synthesized
aagaaaacaagaagtaataatg

SEQ ID NO: 3951 - DNA, 22 bp, Artificial Sequence
  chemically synthesized
ctttttatatttctttccattt

SEQ ID NO: 3952 - DNA, 22 bp, Artificial Sequence
  chemically synthesized
tttatatttctttccatttgac

SEQ ID NO: 3953 - DNA, 22 bp, Artificial Sequence
  chemically synthesized
ttatatttctttccatttgact

SEQ ID NO: 3954 - DNA, 22 bp, Artificial Sequence
  chemically synthesized
tatatttctttccatttgactt

SEQ ID NO: 3955 - DNA, 22 bp, Artificial Sequence
  chemically synthesized
atatttctttccatttgactta

SEQ ID NO: 3956 - DNA, 22 bp, Artificial Sequence
  chemically synthesized
tatttctttccatttgacttag

SEQ ID NO: 3957 - DNA, 22 bp, Artificial Sequence
  chemically synthesized
ctttccatttgacttagattat

SEQ ID NO: 3958 - DNA, 22 bp, Artificial Sequence
  chemically synthesized
tttccatttgacttagattatg

SEQ ID NO: 3959 - DNA, 22 bp, Artificial Sequence
  chemically synthesized
tccatttgacttagattatgca

SEQ ID NO: 3960 - DNA, 22 bp, Artificial Sequence
  chemically synthesized
ccatttgacttagattatgcat

SEQ ID NO: 3961 - DNA, 22 bp, Artificial Sequence
  chemically synthesized
catttgacttagattatgcatt

SEQ ID NO: 3962 - DNA, 22 bp, Artificial Sequence
  chemically synthesized
gacttagattatgcatttgttt

SEQ ID NO: 3963 - DNA, 22 bp, Artificial Sequence
  chemically synthesized
acttagattatgcatttgtttc

SEQ ID NO: 3964 - DNA, 22 bp, Artificial Sequence
  chemically synthesized
agattatgcatttgtttcaaaa

SEQ ID NO: 3965 - DNA, 22 bp, Artificial Sequence
  chemically synthesized
gattatgcatttgtttcaaaat

SEQ ID NO: 3966 - DNA, 22 bp, Artificial Sequence
  chemically synthesized
tgcatttgtttcaaaatattgg

SEQ ID NO: 3967 - DNA, 22 bp, Artificial Sequence
  chemically synthesized
gtttcaaaatattgggctctga

SEQ ID NO: 3968 - DNA, 22 bp, Artificial Sequence
  chemically synthesized
tttcaaaatattgggctctgat

SEQ ID NO: 3969 - DNA, 22 bp, Artificial Sequence
  chemically synthesized
caaaatattgggctctgattcc

SEQ ID NO: 3970 - DNA, 22 bp, Artificial Sequence
  chemically synthesized
aaaatattgggctctgattcct

SEQ ID NO: 3971 - DNA, 22 bp, Artificial Sequence
  chemically synthesized
ggctctgattcctacagaaaaa

SEQ ID NO: 3972 - DNA, 22 bp, Artificial Sequence
  chemically synthesized
tgattcctacagaaaaactcag

SEQ ID NO: 3973 - DNA, 22 bp, Artificial Sequence
  chemically synthesized
attcctacagaaaaactcagga

SEQ ID NO: 3974 - DNA, 22 bp, Artificial Sequence
  chemically synthesized
ctacagaaaaactcaggatgat

SEQ ID NO: 3975 - DNA, 22 bp, Artificial Sequence
  chemically synthesized
cagaaaaactcaggatgatgtt

SEQ ID NO: 3976 - DNA, 22 bp, Artificial Sequence
  chemically synthesized
aggatgatgttcaattatttct

SEQ ID NO: 3977 - DNA, 22 bp, Artificial Sequence
  chemically synthesized
aattatttcttctgcctttaaa

SEQ ID NO: 3978 - DNA, 22 bp, Artificial Sequence
  chemically synthesized
tttcttctgcctttaaacagaa

SEQ ID NO: 3979 - DNA, 22 bp, Artificial Sequence
  chemically synthesized
cttctgcctttaaacagaagaa

SEQ ID NO: 3980 - DNA, 22 bp, Artificial Sequence
  chemically synthesized
ttctgcctttaaacagaagaat

SEQ ID NO: 3981 - DNA, 22 bp, Artificial Sequence
  chemically synthesized
ctgcctttaaacagaagaataa

SEQ ID NO: 3982 - DNA, 22 bp, Artificial Sequence
  chemically synthesized
tgcctttaaacagaagaataat

SEQ ID NO: 3983 - DNA, 22 bp, Artificial Sequence
  chemically synthesized
cctttaaacagaagaataattc

SEQ ID NO: 3984 - DNA, 22 bp, Artificial Sequence
  chemically synthesized
taaacagaagaataattcaatt

SEQ ID NO: 3985 - DNA, 22 bp, Artificial Sequence
  chemically synthesized
aaacagaagaataattcaatta

SEQ ID NO: 3986 - DNA, 22 bp, Artificial Sequence
  chemically synthesized
aacagaagaataattcaattac

SEQ ID NO: 3987 - DNA, 22 bp, Artificial Sequence
  chemically synthesized
aattaccaagaatactatttta

SEQ ID NO: 3988 - DNA, 22 bp, Artificial Sequence
  chemically synthesized
ccaagaatactattttaaaaat

SEQ ID NO: 3989 - DNA, 22 bp, Artificial Sequence
  chemically synthesized
ttttaaaaattattaaatattt

SEQ ID NO: 3990 - DNA, 22 bp, Artificial Sequence
  chemically synthesized
taaaaattattaaatatttata

SEQ ID NO: 3991 - DNA, 22 bp, Artificial Sequence
  chemically synthesized
aaaaattattaaatatttatag

SEQ ID NO: 3992 - DNA, 22 bp, Artificial Sequence
  chemically synthesized
aaaattattaaatatttatagc

SEQ ID NO: 3993 - DNA, 22 bp, Artificial Sequence
  chemically synthesized
ttaaatatttatagccttatat

SEQ ID NO: 3994 - DNA, 22 bp, Artificial Sequence
  chemically synthesized
aatatttatagccttatattca

SEQ ID NO: 3995 - DNA, 22 bp, Artificial Sequence
  chemically synthesized
atagccttatattcaaacttag

SEQ ID NO: 3996 - DNA, 22 bp, Artificial Sequence
  chemically synthesized
tagccttatattcaaacttaga

SEQ ID NO: 3997 - DNA, 22 bp, Artificial Sequence
  chemically synthesized
atattcaaacttagataatatc

SEQ ID NO: 3998 - DNA, 22 bp, Artificial Sequence
  chemically synthesized
tattcaaacttagataatatct

SEQ ID NO: 3999 - DNA, 22 bp, Artificial Sequence
  chemically synthesized
aaacttagataatatctaatac

SEQ ID NO: 4000 - DNA, 22 bp, Artificial Sequence
  chemically synthesized
agataatatctaatactctttt

SEQ ID NO: 4001 - DNA, 22 bp, Artificial Sequence
  chemically synthesized
gataatatctaatactctttta

SEQ ID NO: 4002 - DNA, 22 bp, Artificial Sequence
  chemically synthesized
atactcttttagtgtctatcaa

SEQ ID NO: 4003 - DNA, 22 bp, Artificial Sequence
  chemically synthesized
ttttagtgtctatcaacagcaa

SEQ ID NO: 4004 - DNA, 22 bp, Artificial Sequence
  chemically synthesized
ttagtgtctatcaacagcaacc

SEQ ID NO: 4005 - DNA, 22 bp, Artificial Sequence
  chemically synthesized
tagtgtctatcaacagcaacca

SEQ ID NO: 4006 - DNA, 22 bp, Artificial Sequence
  chemically synthesized
agtgtctatcaacagcaaccaa

SEQ ID NO: 4007 - DNA, 22 bp, Artificial Sequence
  chemically synthesized
gtgtctatcaacagcaaccaag

SEQ ID NO: 4008 - DNA, 22 bp, Artificial Sequence
  chemically synthesized
tcaacagcaaccaagaagacag

SEQ ID NO: 4009 - DNA, 22 bp, Artificial Sequence
  chemically synthesized
aaatgaaaataaatataaatac

SEQ ID NO: 4010 - DNA, 22 bp, Artificial Sequence
  chemically synthesized
tatttatgagatcaacagcaca

SEQ ID NO: 4011 - DNA, 22 bp, Artificial Sequence
  chemically synthesized
tttatgagatcaacagcacagg

SEQ ID NO: 4012 - DNA, 22 bp, Artificial Sequence
  chemically synthesized
atgagatcaacagcacaggttt

SEQ ID NO: 4013 - DNA, 22 bp, Artificial Sequence
  chemically synthesized
tgagatcaacagcacaggtttt

SEQ ID NO: 4014 - DNA, 22 bp, Artificial Sequence
  chemically synthesized
tgtggtttttaaataaagcata

SEQ ID NO: 4015 - DNA, 22 bp, Artificial Sequence
  chemically synthesized
gtggtttttaaataaagcatag

SEQ ID NO: 4016 - DNA, 22 bp, Artificial Sequence
  chemically synthesized
tggtttttaaataaagcatagt

SEQ ID NO: 4017 - DNA, 22 bp, Artificial Sequence
  chemically synthesized
ttaaataaagcatagtgcaatg

SEQ ID NO: 4018 - DNA, 22 bp, Artificial Sequence
  chemically synthesized
taaataaagcatagtgcaatgg

SEQ ID NO: 4019 - DNA, 22 bp, Artificial Sequence
  chemically synthesized
aaataaagcatagtgcaatgga

SEQ ID NO: 4020 - DNA, 22 bp, Artificial Sequence
  chemically synthesized
aataaagcatagtgcaatggat

SEQ ID NO: 4021 - DNA, 22 bp, Artificial Sequence
  chemically synthesized
tgggatagttatgaattcaatc

SEQ ID NO: 4022 - DNA, 22 bp, Artificial Sequence
  chemically synthesized
gggatagttatgaattcaatct

SEQ ID NO: 4023 - DNA, 22 bp, Artificial Sequence
  chemically synthesized
ggatagttatgaattcaatctt

SEQ ID NO: 4024 - DNA, 22 bp, Artificial Sequence
  chemically synthesized
tgaattcaatcttcaaccctat

SEQ ID NO: 4025 - DNA, 22 bp, Artificial Sequence
  chemically synthesized
aatcttcaaccctattctgtga

SEQ ID NO: 4026 - DNA, 22 bp, Artificial Sequence
  chemically synthesized
caaccctattctgtgaagtttc

SEQ ID NO: 4027 - DNA, 22 bp, Artificial Sequence
  chemically synthesized
aaccctattctgtgaagtttca

SEQ ID NO: 4028 - DNA, 22 bp, Artificial Sequence
  chemically synthesized
ttctgtgaagtttcagtcactc

SEQ ID NO: 4029 - DNA, 22 bp, Artificial Sequence
  chemically synthesized
tgtgaagtttcagtcactctaa

SEQ ID NO: 4030 - DNA, 22 bp, Artificial Sequence
  chemically synthesized
tgaagtttcagtcactctaagt

SEQ ID NO: 4031 - DNA, 22 bp, Artificial Sequence
  chemically synthesized
cagtcactctaagttactttgc

SEQ ID NO: 4032 - DNA, 22 bp, Artificial Sequence
  chemically synthesized
agtcactctaagttactttgca

SEQ ID NO: 4033 - DNA, 22 bp, Artificial Sequence
  chemically synthesized
taagttactttgcactttcctt

SEQ ID NO: 4034 - DNA, 22 bp, Artificial Sequence
  chemically synthesized
agttactttgcactttccttag

SEQ ID NO: 4035 - DNA, 22 bp, Artificial Sequence
  chemically synthesized
ctttgcactttccttagtgcgc

SEQ ID NO: 4036 - DNA, 22 bp, Artificial Sequence
  chemically synthesized
tgcactttccttagtgcgcaaa

SEQ ID NO: 4037 - DNA, 22 bp, Artificial Sequence
  chemically synthesized
gcactttccttagtgcgcaaaa

SEQ ID NO: 4038 - DNA, 22 bp, Artificial Sequence
  chemically synthesized
cactttccttagtgcgcaaaag

SEQ ID NO: 4039 - DNA, 22 bp, Artificial Sequence
  chemically synthesized
tccttagtgcgcaaaagaaaat

SEQ ID NO: 4040 - DNA, 22 bp, Artificial Sequence
  chemically synthesized
ccttagtgcgcaaaagaaaatt

SEQ ID NO: 4041 - DNA, 22 bp, Artificial Sequence
  chemically synthesized
cttagtgcgcaaaagaaaatta

SEQ ID NO: 4042 - DNA, 22 bp, Artificial Sequence
  chemically synthesized
agtgcgcaaaagaaaattacag

SEQ ID NO: 4043 - DNA, 22 bp, Artificial Sequence
  chemically synthesized
gtgcgcaaaagaaaattacagt

SEQ ID NO: 4044 - DNA, 22 bp, Artificial Sequence
  chemically synthesized
cagtcactaaacaattctgacc

SEQ ID NO: 4045 - DNA, 22 bp, Artificial Sequence
  chemically synthesized
aacaattctgaccttttttttt

SEQ ID NO: 4046 - DNA, 22 bp, Artificial Sequence
  chemically synthesized
tgacctttttttttttttacct

SEQ ID NO: 4047 - DNA, 22 bp, Artificial Sequence
  chemically synthesized
acctttttttttttttacctag

SEQ ID NO: 4048 - DNA, 22 bp, Artificial Sequence
  chemically synthesized
tttttttttttacctaggatgt

SEQ ID NO: 4049 - DNA, 22 bp, Artificial Sequence
  chemically synthesized
ttttttttttacctaggatgtt

SEQ ID NO: 4050 - DNA, 22 bp, Artificial Sequence
  chemically synthesized
tttttttttacctaggatgttt

SEQ ID NO: 4051 - DNA, 22 bp, Artificial Sequence
  chemically synthesized
ttttttttacctaggatgtttg

SEQ ID NO: 4052 - DNA, 22 bp, Artificial Sequence
  chemically synthesized
tttttttacctaggatgtttga

SEQ ID NO: 4053 - DNA, 22 bp, Artificial Sequence
  chemically synthesized
ttttttacctaggatgtttgaa

SEQ ID NO: 4054 - DNA, 22 bp, Artificial Sequence
  chemically synthesized
tttttacctaggatgtttgaat

SEQ ID NO: 4055 - DNA, 22 bp, Artificial Sequence
  chemically synthesized
ttttacctaggatgtttgaatt

SEQ ID NO: 4056 - DNA, 22 bp, Artificial Sequence
  chemically synthesized
tttacctaggatgtttgaattt

SEQ ID NO: 4057 - DNA, 22 bp, Artificial Sequence
  chemically synthesized
ttacctaggatgtttgaatttt

SEQ ID NO: 4058 - DNA, 22 bp, Artificial Sequence
  chemically synthesized
tacctaggatgtttgaatttta

SEQ ID NO: 4059 - DNA, 22 bp, Artificial Sequence
  chemically synthesized
acctaggatgtttgaattttat

SEQ ID NO: 4060 - DNA, 22 bp, Artificial Sequence
  chemically synthesized
cctaggatgtttgaattttatt

SEQ ID NO: 4061 - DNA, 22 bp, Artificial Sequence
  chemically synthesized
ggatgtttgaattttattaata

SEQ ID NO: 4062 - DNA, 22 bp, Artificial Sequence
  chemically synthesized
gaattttattaataagataacc

SEQ ID NO: 4063 - DNA, 22 bp, Artificial Sequence
  chemically synthesized
aattttattaataagataacct

SEQ ID NO: 4064 - DNA, 22 bp, Artificial Sequence
  chemically synthesized
tattaataagataaccttgtaa

SEQ ID NO: 4065 - DNA, 22 bp, Artificial Sequence
  chemically synthesized
attaataagataaccttgtaag

SEQ ID NO: 4066 - DNA, 22 bp, Artificial Sequence
  chemically synthesized
ttaataagataaccttgtaaga

SEQ ID NO: 4067 - DNA, 22 bp, Artificial Sequence
  chemically synthesized
ataagataaccttgtaagactt

SEQ ID NO: 4068 - DNA, 22 bp, Artificial Sequence
  chemically synthesized
gtaagacttcacaaatacaaaa

SEQ ID NO: 4069 - DNA, 22 bp, Artificial Sequence
  chemically synthesized
taagacttcacaaatacaaaat

SEQ ID NO: 4070 - DNA, 22 bp, Artificial Sequence
  chemically synthesized
cacaaatacaaaatactatgcc

SEQ ID NO: 4071 - DNA, 22 bp, Artificial Sequence
  chemically synthesized
acaaatacaaaatactatgcca

SEQ ID NO: 4072 - DNA, 22 bp, Artificial Sequence
  chemically synthesized
tgccattttagaaataaatgcc

SEQ ID NO: 4073 - DNA, 22 bp, Artificial Sequence
  chemically synthesized
tagaaataaatgccaaaataat

SEQ ID NO: 4074 - DNA, 22 bp, Artificial Sequence
  chemically synthesized
agaaataaatgccaaaataatt

SEQ ID NO: 4075 - DNA, 22 bp, Artificial Sequence
  chemically synthesized
gaaataaatgccaaaataattc

SEQ ID NO: 4076 - DNA, 22 bp, Artificial Sequence
  chemically synthesized
tttaaagatgcagagtttacta

SEQ ID NO: 4077 - DNA, 22 bp, Artificial Sequence
  chemically synthesized
taaagatgcagagtttactaaa

SEQ ID NO: 4078 - DNA, 22 bp, Artificial Sequence
  chemically synthesized
aaagatgcagagtttactaaaa

SEQ ID NO: 4079 - DNA, 22 bp, Artificial Sequence
  chemically synthesized
aagatgcagagtttactaaaac

SEQ ID NO: 4080 - DNA, 22 bp, Artificial Sequence
  chemically synthesized
actaaaactttattttactggg

SEQ ID NO: 4081 - DNA, 22 bp, Artificial Sequence
  chemically synthesized
ctaaaactttattttactggga

SEQ ID NO: 4082 - DNA, 22 bp, Artificial Sequence
  chemically synthesized
aaactttattttactgggaaaa

SEQ ID NO: 4083 - DNA, 22 bp, Artificial Sequence
  chemically synthesized
tattttactgggaaaatagaat

SEQ ID NO: 4084 - DNA, 22 bp, Artificial Sequence
  chemically synthesized
attttactgggaaaatagaata

SEQ ID NO: 4085 - DNA, 22 bp, Artificial Sequence
  chemically synthesized
ttttactgggaaaatagaataa

SEQ ID NO: 4086 - DNA, 22 bp, Artificial Sequence
  chemically synthesized
tactgggaaaatagaataaaag

SEQ ID NO: 4087 - DNA, 22 bp, Artificial Sequence
  chemically synthesized
actgggaaaatagaataaaagt

SEQ ID NO: 4088 - DNA, 22 bp, Artificial Sequence
  chemically synthesized
ctgggaaaatagaataaaagtt

SEQ ID NO: 4089 - DNA, 22 bp, Artificial Sequence
  chemically synthesized
ggaaaatagaataaaagttgaa

SEQ ID NO: 4090 - DNA, 22 bp, Artificial Sequence
  chemically synthesized
aacaatagaaaaatggatttct

SEQ ID NO: 4091 - DNA, 22 bp, Artificial Sequence
  chemically synthesized
cttacgtgcatctcgacgaaac

SEQ ID NO: 4092 - DNA, 22 bp, Artificial Sequence
  chemically synthesized
ttacgtgcatctcgacgaaaca

SEQ ID NO: 4093 - DNA, 22 bp, Artificial Sequence
  chemically synthesized
acgtgcatctcgacgaaacaca

SEQ ID NO: 4094 - DNA, 22 bp, Artificial Sequence
  chemically synthesized
cgtgcatctcgacgaaacacac

SEQ ID NO: 4095 - DNA, 22 bp, Artificial Sequence
  chemically synthesized
gacgaaacacacccctggaata

SEQ ID NO: 4096 - DNA, 22 bp, Artificial Sequence
  chemically synthesized
gaataagccgagctaaagagaa

SEQ ID NO: 4097 - DNA, 22 bp, Artificial Sequence
  chemically synthesized
aagagaaaaagaagggaaataa

SEQ ID NO: 4098 - DNA, 22 bp, Artificial Sequence
  chemically synthesized
cccacttcattgtgccaaaggc

SEQ ID NO: 4099 - DNA, 22 bp, Artificial Sequence
  chemically synthesized
cattgtgccaaaggcgtgtggg

SEQ ID NO: 4100 - DNA, 22 bp, Artificial Sequence
  chemically synthesized
attgtgccaaaggcgtgtgggg

SEQ ID NO: 4101 - DNA, 22 bp, Artificial Sequence
  chemically synthesized
tgccaaaggcgtgtggggttga

SEQ ID NO: 4102 - DNA, 22 bp, Artificial Sequence
  chemically synthesized
acagaagagaaaagctaggaca

SEQ ID NO: 4103 - DNA, 22 bp, Artificial Sequence
  chemically synthesized
ggacaaacggagggaaattagc

SEQ ID NO: 4104 - DNA, 20 bp, Artificial Sequence
  chemically synthesized
aataaatttacccaacaaaa

SEQ ID NO: 4105 - DNA, 20 bp, Artificial Sequence
  chemically synthesized
aatctcttaaaatcataaaa

SEQ ID NO: 4106 - DNA, 20 bp, Artificial Sequence
  chemically synthesized
aaatcataaaaaagtaaaat

SEQ ID NO: 4107 - DNA, 20 bp, Artificial Sequence
  chemically synthesized
gtaaaattagcttttaaaaa

SEQ ID NO: 4108 - DNA, 20 bp, Artificial Sequence
  chemically synthesized
taaaattagcttttaaaaac

SEQ ID NO: 4109 - DNA, 20 bp, Artificial Sequence
  chemically synthesized
aattagcttttaaaaacagg

SEQ ID NO: 4110 - DNA, 20 bp, Artificial Sequence
  chemically synthesized
ttaaaaacaggtagtcacca

SEQ ID NO: 4111 - DNA, 20 bp, Artificial Sequence
  chemically synthesized
tcaccatagcattgaatgtg

SEQ ID NO: 4112 - DNA, 20 bp, Artificial Sequence
  chemically synthesized
tgaatgtgtagtttataata

SEQ ID NO: 4113 - DNA, 20 bp, Artificial Sequence
  chemically synthesized
gtgtagtttataatacagca

SEQ ID NO: 4114 - DNA, 20 bp, Artificial Sequence
  chemically synthesized
acaatttcaaattacctatt

SEQ ID NO: 4115 - DNA, 20 bp, Artificial Sequence
  chemically synthesized
tttcaaattacctattaagt

SEQ ID NO: 4116 - DNA, 20 bp, Artificial Sequence
  chemically synthesized
ctcatttctttgatttcatt

SEQ ID NO: 4117 - DNA, 20 bp, Artificial Sequence
  chemically synthesized
agcattgatctaactcaatg

SEQ ID NO: 4118 - DNA, 20 bp, Artificial Sequence
  chemically synthesized
attgatctaactcaatgtgg

SEQ ID NO: 4119 - DNA, 20 bp, Artificial Sequence
  chemically synthesized
gatctaactcaatgtggaag

SEQ ID NO: 4120 - DNA, 20 bp, Artificial Sequence
  chemically synthesized
atctaactcaatgtggaaga

SEQ ID NO: 4121 - DNA, 20 bp, Artificial Sequence
  chemically synthesized
gaagaaggttacattcgtgc

SEQ ID NO: 4122 - DNA, 20 bp, Artificial Sequence
  chemically synthesized
tacattcgtgcaagttaaca

SEQ ID NO: 4123 - DNA, 20 bp, Artificial Sequence
  chemically synthesized
cctaccaaccttaccttttc

SEQ ID NO: 4124 - DNA, 20 bp, Artificial Sequence
  chemically synthesized
ctaccaaccttaccttttct

SEQ ID NO: 4125 - DNA, 20 bp, Artificial Sequence
  chemically synthesized
taccttttctgggcaaatat

SEQ ID NO: 4126 - DNA, 20 bp, Artificial Sequence
  chemically synthesized
tgggcaaatattggtatata

SEQ ID NO: 4127 - DNA, 20 bp, Artificial Sequence
  chemically synthesized
ggcaaatattggtatatata

SEQ ID NO: 4128 - DNA, 20 bp, Artificial Sequence
  chemically synthesized
atattggtatatatagagtt

SEQ ID NO: 4129 - DNA, 20 bp, Artificial Sequence
  chemically synthesized
ttggtatatatagagttaag

SEQ ID NO: 4130 - DNA, 20 bp, Artificial Sequence
  chemically synthesized
atatatagagttaagaagtc

SEQ ID NO: 4131 - DNA, 20 bp, Artificial Sequence
  chemically synthesized
tatatagagttaagaagtct

SEQ ID NO: 4132 - DNA, 20 bp, Artificial Sequence
  chemically synthesized
aagaagtctaggtctgcttc

SEQ ID NO: 4133 - DNA, 20 bp, Artificial Sequence
  chemically synthesized
aagtctaggtctgcttccag

SEQ ID NO: 4134 - DNA, 20 bp, Artificial Sequence
  chemically synthesized
ggtctgcttccagaagaaaa

SEQ ID NO: 4135 - DNA, 20 bp, Artificial Sequence
  chemically synthesized
gttgcttgaaattgaaaatc

SEQ ID NO: 4136 - DNA, 20 bp, Artificial Sequence
  chemically synthesized
agataaaaatgttcacaatt

SEQ ID NO: 4137 - DNA, 20 bp, Artificial Sequence
  chemically synthesized
ccttctttttattgttcctc

SEQ ID NO: 4138 - DNA, 20 bp, Artificial Sequence
  chemically synthesized
gttcctctagttatttcctc

SEQ ID NO: 4139 - DNA, 20 bp, Artificial Sequence
  chemically synthesized
tatttcctccagaattgatc

SEQ ID NO: 4140 - DNA, 20 bp, Artificial Sequence
  chemically synthesized
atcatttgattctctatctc

SEQ ID NO: 4141 - DNA, 20 bp, Artificial Sequence
  chemically synthesized
catttgattctctatctcca

SEQ ID NO: 4142 - DNA, 20 bp, Artificial Sequence
  chemically synthesized
ctatctccagagccaaaatc

SEQ ID NO: 4143 - DNA, 20 bp, Artificial Sequence
  chemically synthesized
aaaatcaagatttgctatgt

SEQ ID NO: 4144 - DNA, 20 bp, Artificial Sequence
  chemically synthesized
gttagacgatgtaaaaattt

SEQ ID NO: 4145 - DNA, 20 bp, Artificial Sequence
  chemically synthesized
gatgtaaaaattttagccaa

SEQ ID NO: 4146 - DNA, 20 bp, Artificial Sequence
  chemically synthesized
ttttagccaatggcctcctt

SEQ ID NO: 4147 - DNA, 20 bp, Artificial Sequence
  chemically synthesized
agccaatggcctccttcagt

SEQ ID NO: 4148 - DNA, 20 bp, Artificial Sequence
  chemically synthesized
gccaatggcctccttcagtt

SEQ ID NO: 4149 - DNA, 20 bp, Artificial Sequence
  chemically synthesized
ggcctccttcagttgggaca

SEQ ID NO: 4150 - DNA, 20 bp, Artificial Sequence
  chemically synthesized
tcagttgggacatggtctta

SEQ ID NO: 4151 - DNA, 20 bp, Artificial Sequence
  chemically synthesized
gtcttaaagactttgtccat

SEQ ID NO: 4152 - DNA, 20 bp, Artificial Sequence
  chemically synthesized
aagactttgtccataagacg

SEQ ID NO: 4153 - DNA, 20 bp, Artificial Sequence
  chemically synthesized
agactttgtccataagacga

SEQ ID NO: 4154 - DNA, 20 bp, Artificial Sequence
  chemically synthesized
gactttgtccataagacgaa

SEQ ID NO: 4155 - DNA, 20 bp, Artificial Sequence
  chemically synthesized
aaaaactcaacatatttgat

SEQ ID NO: 4156 - DNA, 20 bp, Artificial Sequence
  chemically synthesized
tatgatctatcgctgcaaac

SEQ ID NO: 4157 - DNA, 20 bp, Artificial Sequence
  chemically synthesized
gctgcaaaccagtgaaatca

SEQ ID NO: 4158 - DNA, 20 bp, Artificial Sequence
  chemically synthesized
gcaaaccagtgaaatcaaag

SEQ ID NO: 4159 - DNA, 20 bp, Artificial Sequence
  chemically synthesized
aaccagtgaaatcaaagaag

SEQ ID NO: 4160 - DNA, 20 bp, Artificial Sequence
  chemically synthesized
gtgaaatcaaagaagaagaa

SEQ ID NO: 4161 - DNA, 20 bp, Artificial Sequence
  chemically synthesized
tgaaatcaaagaagaagaaa

SEQ ID NO: 4162 - DNA, 20 bp, Artificial Sequence
  chemically synthesized
aaagaagaagaaaaggaact

SEQ ID NO: 4163 - DNA, 20 bp, Artificial Sequence
  chemically synthesized
gaagaagaaaaggaactgag

SEQ ID NO: 4164 - DNA, 20 bp, Artificial Sequence
  chemically synthesized
aagaactacatataaactac

SEQ ID NO: 4165 - DNA, 20 bp, Artificial Sequence
  chemically synthesized
taaactacaagtcaaaaatg

SEQ ID NO: 4166 - DNA, 20 bp, Artificial Sequence
  chemically synthesized
aactacaagtcaaaaatgaa

SEQ ID NO: 4167 - DNA, 20 bp, Artificial Sequence
  chemically synthesized
actacaagtcaaaaatgaag

SEQ ID NO: 4168 - DNA, 20 bp, Artificial Sequence
  chemically synthesized
aagtcaaaaatgaagaggta

SEQ ID NO: 4169 - DNA, 20 bp, Artificial Sequence
  chemically synthesized
gaactcaactcaaaacttga

SEQ ID NO: 4170 - DNA, 20 bp, Artificial Sequence
  chemically synthesized
ctcaaaacttgaaagcctcc

SEQ ID NO: 4171 - DNA, 20 bp, Artificial Sequence
  chemically synthesized
aaaacttgaaagcctcctag

SEQ ID NO: 4172 - DNA, 20 bp, Artificial Sequence
  chemically synthesized
aaaaattctacttcaacaaa

SEQ ID NO: 4173 - DNA, 20 bp, Artificial Sequence
  chemically synthesized
tcaacaaaaagtgaaatatt

SEQ ID NO: 4174 - DNA, 20 bp, Artificial Sequence
  chemically synthesized
acaaaaagtgaaatatttag

SEQ ID NO: 4175 - DNA, 20 bp, Artificial Sequence
  chemically synthesized
aaaaagtgaaatatttagaa

SEQ ID NO: 4176 - DNA, 20 bp, Artificial Sequence
  chemically synthesized
tcaaaatcaacctgaaactc

SEQ ID NO: 4177 - DNA, 20 bp, Artificial Sequence
  chemically synthesized
acctgaaactccagaacacc

SEQ ID NO: 4178 - DNA, 20 bp, Artificial Sequence
  chemically synthesized
tgaaactccagaacacccag

SEQ ID NO: 4179 - DNA, 20 bp, Artificial Sequence
  chemically synthesized
cccagaagtaacttcactta

SEQ ID NO: 4180 - DNA, 20 bp, Artificial Sequence
  chemically synthesized
gaagtaacttcacttaaagt

SEQ ID NO: 4181 - DNA, 20 bp, Artificial Sequence
  chemically synthesized
gtaacttcacttaaagtaag

SEQ ID NO: 4182 - DNA, 20 bp, Artificial Sequence
  chemically synthesized
cttaaagtaagtagaaaata

SEQ ID NO: 4183 - DNA, 20 bp, Artificial Sequence
  chemically synthesized
taaagtaagtagaaaataaa

SEQ ID NO: 4184 - DNA, 20 bp, Artificial Sequence
  chemically synthesized
aaagtaagtagaaaataaag

SEQ ID NO: 4185 - DNA, 20 bp, Artificial Sequence
  chemically synthesized
aagtaagtagaaaataaaga

SEQ ID NO: 4186 - DNA, 20 bp, Artificial Sequence
  chemically synthesized
tcatgtttatgttttcaatg

SEQ ID NO: 4187 - DNA, 20 bp, Artificial Sequence
  chemically synthesized
cttttaaaaaaaatatttct

SEQ ID NO: 4188 - DNA, 20 bp, Artificial Sequence
  chemically synthesized
ttttaaaaaaaatatttcta

SEQ ID NO: 4189 - DNA, 20 bp, Artificial Sequence
  chemically synthesized
gttgaaatacttttttttcc

SEQ ID NO: 4190 - DNA, 20 bp, Artificial Sequence
  chemically synthesized
tttccaagaaaaataatctc

SEQ ID NO: 4191 - DNA, 20 bp, Artificial Sequence
  chemically synthesized
aaatttcctattataatttc

SEQ ID NO: 4192 - DNA, 20 bp, Artificial Sequence
  chemically synthesized
ttcctattataatttcaagt

SEQ ID NO: 4193 - DNA, 20 bp, Artificial Sequence
  chemically synthesized
tttatatgaaaattacaaat

SEQ ID NO: 4194 - DNA, 20 bp, Artificial Sequence
  chemically synthesized
atcggttaaattatacaatc

SEQ ID NO: 4195 - DNA, 20 bp, Artificial Sequence
  chemically synthesized
tacactattgtaaattactg

SEQ ID NO: 4196 - DNA, 20 bp, Artificial Sequence
  chemically synthesized
acactattgtaaattactga

SEQ ID NO: 4197 - DNA, 20 bp, Artificial Sequence
  chemically synthesized
tattgtaaattactgaaggt

SEQ ID NO: 4198 - DNA, 20 bp, Artificial Sequence
  chemically synthesized
aattactgaaggtaagtaaa

SEQ ID NO: 4199 - DNA, 20 bp, Artificial Sequence
  chemically synthesized
aaaaatttaaaactattctc

SEQ ID NO: 4200 - DNA, 20 bp, Artificial Sequence
  chemically synthesized
ctattctccagtgtttaaaa

SEQ ID NO: 4201 - DNA, 20 bp, Artificial Sequence
  chemically synthesized
ttaaaacagattaaataata

SEQ ID NO: 4202 - DNA, 20 bp, Artificial Sequence
  chemically synthesized
agattaaataatacagtaaa

SEQ ID NO: 4203 - DNA, 20 bp, Artificial Sequence
  chemically synthesized
aaataatacagtaaatggaa

SEQ ID NO: 4204 - DNA, 20 bp, Artificial Sequence
  chemically synthesized
ttattcatatgaaaatatgc

SEQ ID NO: 4205 - DNA, 20 bp, Artificial Sequence
  chemically synthesized
tattcatatgaaaatatgct

SEQ ID NO: 4206 - DNA, 20 bp, Artificial Sequence
  chemically synthesized
tgggctttttcttttaattg

SEQ ID NO: 4207 - DNA, 20 bp, Artificial Sequence
  chemically synthesized
tttttcttttaattgaagtt

SEQ ID NO: 4208 - DNA, 20 bp, Artificial Sequence
  chemically synthesized
aagttcagaaaatcaaattt

SEQ ID NO: 4209 - DNA, 20 bp, Artificial Sequence
  chemically synthesized
gttcagaaaatcaaatttta

SEQ ID NO: 4210 - DNA, 20 bp, Artificial Sequence
  chemically synthesized
agaaaatcaaattttagaga

SEQ ID NO: 4211 - DNA, 20 bp, Artificial Sequence
  chemically synthesized
tacaatttaaataaaatgtt

SEQ ID NO: 4212 - DNA, 20 bp, Artificial Sequence
  chemically synthesized
acaatttaaataaaatgtta

SEQ ID NO: 4213 - DNA, 20 bp, Artificial Sequence
  chemically synthesized
caaaaatatgtgctatttga

SEQ ID NO: 4214 - DNA, 20 bp, Artificial Sequence
  chemically synthesized
aaatatgtgctatttgaaag

SEQ ID NO: 4215 - DNA, 20 bp, Artificial Sequence
  chemically synthesized
gctatttgaaagaagcatac

SEQ ID NO: 4216 - DNA, 20 bp, Artificial Sequence
  chemically synthesized
ctatttgaaagaagcataca

SEQ ID NO: 4217 - DNA, 20 bp, Artificial Sequence
  chemically synthesized
tatttgaaagaagcatacaa

SEQ ID NO: 4218 - DNA, 20 bp, Artificial Sequence
  chemically synthesized
atttgaaagaagcatacaag

SEQ ID NO: 4219 - DNA, 20 bp, Artificial Sequence
  chemically synthesized
tgaaagaagcatacaagggg

SEQ ID NO: 4220 - DNA, 20 bp, Artificial Sequence
  chemically synthesized
gaaagaagcatacaagggga

SEQ ID NO: 4221 - DNA, 20 bp, Artificial Sequence
  chemically synthesized
tcatttttcaaatccattat

SEQ ID NO: 4222 - DNA, 20 bp, Artificial Sequence
  chemically synthesized
ccattattagtttaaaaatt

SEQ ID NO: 4223 - DNA, 20 bp, Artificial Sequence
  chemically synthesized
tttaaaaatttagattatga

SEQ ID NO: 4224 - DNA, 20 bp, Artificial Sequence
  chemically synthesized
tttagattatgatagtgtta

SEQ ID NO: 4225 - DNA, 20 bp, Artificial Sequence
  chemically synthesized
ttagattatgatagtgttac

SEQ ID NO: 4226 - DNA, 20 bp, Artificial Sequence
  chemically synthesized
atagtgttacaggaaattaa

SEQ ID NO: 4227 - DNA, 20 bp, Artificial Sequence
  chemically synthesized
gttacaggaaattaatagaa

SEQ ID NO: 4228 - DNA, 20 bp, Artificial Sequence
  chemically synthesized
caggaaattaatagaaaaga

SEQ ID NO: 4229 - DNA, 20 bp, Artificial Sequence
  chemically synthesized
ggaaattaatagaaaagaaa

SEQ ID NO: 4230 - DNA, 20 bp, Artificial Sequence
  chemically synthesized
gaaattaatagaaaagaaag

SEQ ID NO: 4231 - DNA, 20 bp, Artificial Sequence
  chemically synthesized
ttaatagaaaagaaagagga

SEQ ID NO: 4232 - DNA, 20 bp, Artificial Sequence
  chemically synthesized
accaacctactctctatatc

SEQ ID NO: 4233 - DNA, 20 bp, Artificial Sequence
  chemically synthesized
tctctatatccagacttttg

SEQ ID NO: 4234 - DNA, 20 bp, Artificial Sequence
  chemically synthesized
ccagacttttgtagaaaaac

SEQ ID NO: 4235 - DNA, 20 bp, Artificial Sequence
  chemically synthesized
tttgtagaaaaacaagataa

SEQ ID NO: 4236 - DNA, 20 bp, Artificial Sequence
  chemically synthesized
aaaacaagataatagcatca

SEQ ID NO: 4237 - DNA, 20 bp, Artificial Sequence
  chemically synthesized
atagcatcaaagaccttctc

SEQ ID NO: 4238 - DNA, 20 bp, Artificial Sequence
  chemically synthesized
caaagaccttctccagaccg

SEQ ID NO: 4239 - DNA, 20 bp, Artificial Sequence
  chemically synthesized
agaccttctccagaccgtgg

SEQ ID NO: 4240 - DNA, 20 bp, Artificial Sequence
  chemically synthesized
aatataaacaattaaaccaa

SEQ ID NO: 4241 - DNA, 20 bp, Artificial Sequence
  chemically synthesized
aaacaattaaaccaacagca

SEQ ID NO: 4242 - DNA, 20 bp, Artificial Sequence
  chemically synthesized
ccaacagcatagtcaaataa

SEQ ID NO: 4243 - DNA, 20 bp, Artificial Sequence
  chemically synthesized
gcatagtcaaataaaagaaa

SEQ ID NO: 4244 - DNA, 20 bp, Artificial Sequence
  chemically synthesized
aaataaaagaaatagaaaat

SEQ ID NO: 4245 - DNA, 20 bp, Artificial Sequence
  chemically synthesized
aataaaagaaatagaaaatc

SEQ ID NO: 4246 - DNA, 20 bp, Artificial Sequence
  chemically synthesized
aaagaaatagaaaatcaggt

SEQ ID NO: 4247 - DNA, 20 bp, Artificial Sequence
  chemically synthesized
aaatagaaaatcaggtaagt

SEQ ID NO: 4248 - DNA, 20 bp, Artificial Sequence
  chemically synthesized
caggtaagtcagtattttaa

SEQ ID NO: 4249 - DNA, 20 bp, Artificial Sequence
  chemically synthesized
ggtatgtcccatctttcaca

SEQ ID NO: 4250 - DNA, 20 bp, Artificial Sequence
  chemically synthesized
gtatgtcccatctttcacac

SEQ ID NO: 4251 - DNA, 20 bp, Artificial Sequence
  chemically synthesized
tgaatcctaaaattatttac

SEQ ID NO: 4252 - DNA, 20 bp, Artificial Sequence
  chemically synthesized
aattatttacaagctttaac

SEQ ID NO: 4253 - DNA, 20 bp, Artificial Sequence
  chemically synthesized
acaagctttaactggatcat

SEQ ID NO: 4254 - DNA, 20 bp, Artificial Sequence
  chemically synthesized
catgagtaaaattatcacat

SEQ ID NO: 4255 - DNA, 20 bp, Artificial Sequence
  chemically synthesized
cagcataactgttaaaattg

SEQ ID NO: 4256 - DNA, 20 bp, Artificial Sequence
  chemically synthesized
agcataactgttaaaattgc

SEQ ID NO: 4257 - DNA, 20 bp, Artificial Sequence
  chemically synthesized
tgttaaaattgcaggctctg

SEQ ID NO: 4258 - DNA, 20 bp, Artificial Sequence
  chemically synthesized
aactacctgcatttaaacca

SEQ ID NO: 4259 - DNA, 20 bp, Artificial Sequence
  chemically synthesized
tacttcacccctttatctct

SEQ ID NO: 4260 - DNA, 20 bp, Artificial Sequence
  chemically synthesized
gtttcctcacatatactaca

SEQ ID NO: 4261 - DNA, 20 bp, Artificial Sequence
  chemically synthesized
atatactacaaagataataa

SEQ ID NO: 4262 - DNA, 20 bp, Artificial Sequence
  chemically synthesized
aaagataataacagaactta

SEQ ID NO: 4263 - DNA, 20 bp, Artificial Sequence
  chemically synthesized
aagataataacagaacttat

SEQ ID NO: 4264 - DNA, 20 bp, Artificial Sequence
  chemically synthesized
agaacttataggattattgt

SEQ ID NO: 4265 - DNA, 20 bp, Artificial Sequence
  chemically synthesized
taagaaaaaaaattaattca

SEQ ID NO: 4266 - DNA, 20 bp, Artificial Sequence
  chemically synthesized
gaaaaaaaattaattcatag

SEQ ID NO: 4267 - DNA, 20 bp, Artificial Sequence
  chemically synthesized
catcttactaaaattcaaat

SEQ ID NO: 4268 - DNA, 20 bp, Artificial Sequence
  chemically synthesized
ctttgctcaaaaccacacaa

SEQ ID NO: 4269 - DNA, 20 bp, Artificial Sequence
  chemically synthesized
gctttccatttcactcatat

SEQ ID NO: 4270 - DNA, 20 bp, Artificial Sequence
  chemically synthesized
tttcactcatattggctctt

SEQ ID NO: 4271 - DNA, 20 bp, Artificial Sequence
  chemically synthesized
tcatattggctctttagacc

SEQ ID NO: 4272 - DNA, 20 bp, Artificial Sequence
  chemically synthesized
ttgggtaatcttggtctaaa

SEQ ID NO: 4273 - DNA, 20 bp, Artificial Sequence
  chemically synthesized
ttggtctaaagagccaatat

SEQ ID NO: 4274 - DNA, 20 bp, Artificial Sequence
  chemically synthesized
aagagccaatatgagtgaaa

SEQ ID NO: 4275 - DNA, 20 bp, Artificial Sequence
  chemically synthesized
gccaatatgagtgaaatgga

SEQ ID NO: 4276 - DNA, 20 bp, Artificial Sequence
  chemically synthesized
tgaaatggaaagctattgtg

SEQ ID NO: 4277 - DNA, 20 bp, Artificial Sequence
  chemically synthesized
gaaagctattgtgtggtttt

SEQ ID NO: 4278 - DNA, 20 bp, Artificial Sequence
  chemically synthesized
ctattgtgtggttttgagca

SEQ ID NO: 4279 - DNA, 20 bp, Artificial Sequence
  chemically synthesized
attgtgtggttttgagcaaa

SEQ ID NO: 4280 - DNA, 20 bp, Artificial Sequence
  chemically synthesized
acatgatctaatttgaattt

SEQ ID NO: 4281 - DNA, 20 bp, Artificial Sequence
  chemically synthesized
gatctaatttgaattttagt

SEQ ID NO: 4282 - DNA, 20 bp, Artificial Sequence
  chemically synthesized
gaattttagtaagatgacat

SEQ ID NO: 4283 - DNA, 20 bp, Artificial Sequence
  chemically synthesized
ttttcttacaataatcctat

SEQ ID NO: 4284 - DNA, 20 bp, Artificial Sequence
  chemically synthesized
aagttctgttattatctttg

SEQ ID NO: 4285 - DNA, 20 bp, Artificial Sequence
  chemically synthesized
attatctttgtagtatatgt

SEQ ID NO: 4286 - DNA, 20 bp, Artificial Sequence
  chemically synthesized
ttatctttgtagtatatgtg

SEQ ID NO: 4287 - DNA, 20 bp, Artificial Sequence
  chemically synthesized
gtagtatatgtgaggaaact

SEQ ID NO: 4288 - DNA, 20 bp, Artificial Sequence
  chemically synthesized
agtatatgtgaggaaactga

SEQ ID NO: 4289 - DNA, 20 bp, Artificial Sequence
  chemically synthesized
tgtgaggaaactgagagata

SEQ ID NO: 4290 - DNA, 20 bp, Artificial Sequence
  chemically synthesized
gtgaggaaactgagagataa

SEQ ID NO: 4291 - DNA, 20 bp, Artificial Sequence
  chemically synthesized
tgaggaaactgagagataaa

SEQ ID NO: 4292 - DNA, 20 bp, Artificial Sequence
  chemically synthesized
gaggaaactgagagataaag

SEQ ID NO: 4293 - DNA, 20 bp, Artificial Sequence
  chemically synthesized
aactgagagataaaggggtg

SEQ ID NO: 4294 - DNA, 20 bp, Artificial Sequence
  chemically synthesized
aggggtgaagtaatttattc

SEQ ID NO: 4295 - DNA, 20 bp, Artificial Sequence
  chemically synthesized
ggggtgaagtaatttattca

SEQ ID NO: 4296 - DNA, 20 bp, Artificial Sequence
  chemically synthesized
aatttattcaaggtcacaca

SEQ ID NO: 4297 - DNA, 20 bp, Artificial Sequence
  chemically synthesized
ttcaaggtcacacaaagttt

SEQ ID NO: 4298 - DNA, 20 bp, Artificial Sequence
  chemically synthesized
caaggtcacacaaagtttta

SEQ ID NO: 4299 - DNA, 20 bp, Artificial Sequence
  chemically synthesized
cacacaaagttttagagcca

SEQ ID NO: 4300 - DNA, 20 bp, Artificial Sequence
  chemically synthesized
ttagagccatggtttaaatg

SEQ ID NO: 4301 - DNA, 20 bp, Artificial Sequence
  chemically synthesized
tagagccatggtttaaatgc

SEQ ID NO: 4302 - DNA, 20 bp, Artificial Sequence
  chemically synthesized
agccatggtttaaatgcagg

SEQ ID NO: 4303 - DNA, 20 bp, Artificial Sequence
  chemically synthesized
tttaaatgcaggtagtttat

SEQ ID NO: 4304 - DNA, 20 bp, Artificial Sequence
  chemically synthesized
tgcaggtagtttattagctt

SEQ ID NO: 4305 - DNA, 20 bp, Artificial Sequence
  chemically synthesized
caggtagtttattagcttca

SEQ ID NO: 4306 - DNA, 20 bp, Artificial Sequence
  chemically synthesized
ttcagagcctgcaattttaa

SEQ ID NO: 4307 - DNA, 20 bp, Artificial Sequence
  chemically synthesized
tgataattttactcatgatc

SEQ ID NO: 4308 - DNA, 20 bp, Artificial Sequence
  chemically synthesized
ttttactcatgatccagtta

SEQ ID NO: 4309 - DNA, 20 bp, Artificial Sequence
  chemically synthesized
ttaaagcttgtaaataattt

SEQ ID NO: 4310 - DNA, 20 bp, Artificial Sequence
  chemically synthesized
taaagcttgtaaataatttt

SEQ ID NO: 4311 - DNA, 20 bp, Artificial Sequence
  chemically synthesized
ttgtaaataattttaggatt

SEQ ID NO: 4312 - DNA, 20 bp, Artificial Sequence
  chemically synthesized
tttaggattcagtgttttta

SEQ ID NO: 4313 - DNA, 20 bp, Artificial Sequence
  chemically synthesized
gtttttacagacctgtgtga

SEQ ID NO: 4314 - DNA, 20 bp, Artificial Sequence
  chemically synthesized
ttacagacctgtgtgaaaga

SEQ ID NO: 4315 - DNA, 20 bp, Artificial Sequence
  chemically synthesized
tacagacctgtgtgaaagat

SEQ ID NO: 4316 - DNA, 20 bp, Artificial Sequence
  chemically synthesized
cttttatttgactatgctgt

SEQ ID NO: 4317 - DNA, 20 bp, Artificial Sequence
  chemically synthesized
gttggtttaattgtttatat

SEQ ID NO: 4318 - DNA, 20 bp, Artificial Sequence
  chemically synthesized
ttgtttatattggtcttcca

SEQ ID NO: 4319 - DNA, 20 bp, Artificial Sequence
  chemically synthesized
tatattggtcttccacggtc

SEQ ID NO: 4320 - DNA, 20 bp, Artificial Sequence
  chemically synthesized
tattggtcttccacggtctg

SEQ ID NO: 4321 - DNA, 20 bp, Artificial Sequence
  chemically synthesized
tggtcttccacggtctggag

SEQ ID NO: 4322 - DNA, 20 bp, Artificial Sequence
  chemically synthesized
ggtcttccacggtctggaga

SEQ ID NO: 4323 - DNA, 20 bp, Artificial Sequence
  chemically synthesized
attatcttgtttttctacaa

SEQ ID NO: 4324 - DNA, 20 bp, Artificial Sequence
  chemically synthesized
cttgtttttctacaaaagtc

SEQ ID NO: 4325 - DNA, 20 bp, Artificial Sequence
  chemically synthesized
tttctacaaaagtctggata

SEQ ID NO: 4326 - DNA, 20 bp, Artificial Sequence
  chemically synthesized
tctacaaaagtctggatata

SEQ ID NO: 4327 - DNA, 20 bp, Artificial Sequence
  chemically synthesized
tacaaaagtctggatataga

SEQ ID NO: 4328 - DNA, 20 bp, Artificial Sequence
  chemically synthesized
aaaagtctggatatagagag

SEQ ID NO: 4329 - DNA, 20 bp, Artificial Sequence
  chemically synthesized
aaagtctggatatagagagt

SEQ ID NO: 4330 - DNA, 20 bp, Artificial Sequence
  chemically synthesized
tctggatatagagagtaggt

SEQ ID NO: 4331 - DNA, 20 bp, Artificial Sequence
  chemically synthesized
atagagagtaggttggttat

SEQ ID NO: 4332 - DNA, 20 bp, Artificial Sequence
  chemically synthesized
ctaaatttttaaactaataa

SEQ ID NO: 4333 - DNA, 20 bp, Artificial Sequence
  chemically synthesized
tggatttgaaaaatgaatat

SEQ ID NO: 4334 - DNA, 20 bp, Artificial Sequence
  chemically synthesized
ccttgtatgcttctttcaaa

SEQ ID NO: 4335 - DNA, 20 bp, Artificial Sequence
  chemically synthesized
attttctgaacttcaattaa

SEQ ID NO: 4336 - DNA, 20 bp, Artificial Sequence
  chemically synthesized
tgaacttcaattaaaagaaa

SEQ ID NO: 4337 - DNA, 20 bp, Artificial Sequence
  chemically synthesized
ttcaattaaaagaaaaagcc

SEQ ID NO: 4338 - DNA, 20 bp, Artificial Sequence
  chemically synthesized
atttaatctgttttaaacac

SEQ ID NO: 4339 - DNA, 20 bp, Artificial Sequence
  chemically synthesized
ttaatctgttttaaacactg

SEQ ID NO: 4340 - DNA, 20 bp, Artificial Sequence
  chemically synthesized
ctgttttaaacactggagaa

SEQ ID NO: 4341 - DNA, 20 bp, Artificial Sequence
  chemically synthesized
tttaactttttacttacctt

SEQ ID NO: 4342 - DNA, 20 bp, Artificial Sequence
  chemically synthesized
ttaccttcagtaatttacaa

SEQ ID NO: 4343 - DNA, 20 bp, Artificial Sequence
  chemically synthesized
tttacaatagtgtaatgaca

SEQ ID NO: 4344 - DNA, 20 bp, Artificial Sequence
  chemically synthesized
agtgtaatgacatagtgttc

SEQ ID NO: 4345 - DNA, 20 bp, Artificial Sequence
  chemically synthesized
tcatataaaatgcaaatttt

SEQ ID NO: 4346 - DNA, 20 bp, Artificial Sequence
  chemically synthesized
agtgttttcatatataacat

SEQ ID NO: 4347 - DNA, 20 bp, Artificial Sequence
  chemically synthesized
gtgttttcatatataacatt

SEQ ID NO: 4348 - DNA, 20 bp, Artificial Sequence
  chemically synthesized
tgttttcatatataacatta

SEQ ID NO: 4349 - DNA, 20 bp, Artificial Sequence
  chemically synthesized
aaactaacttgaaattataa

SEQ ID NO: 4350 - DNA, 20 bp, Artificial Sequence
  chemically synthesized
aactaacttgaaattataat

SEQ ID NO: 4351 - DNA, 20 bp, Artificial Sequence
  chemically synthesized
taataggaaattttattttc

SEQ ID NO: 4352 - DNA, 20 bp, Artificial Sequence
  chemically synthesized
ataggaaattttattttctg

SEQ ID NO: 4353 - DNA, 20 bp, Artificial Sequence
  chemically synthesized
tttctggagattatttttct

SEQ ID NO: 4354 - DNA, 20 bp, Artificial Sequence
  chemically synthesized
attatttttcttggaaaaaa

SEQ ID NO: 4355 - DNA, 20 bp, Artificial Sequence
  chemically synthesized
agtatttcaacaatgcaaca

SEQ ID NO: 4356 - DNA, 20 bp, Artificial Sequence
  chemically synthesized
atgcaacaaagtatttcaaa

SEQ ID NO: 4357 - DNA, 20 bp, Artificial Sequence
  chemically synthesized
gtatttcaaatggcatgcct

SEQ ID NO: 4358 - DNA, 20 bp, Artificial Sequence
  chemically synthesized
cttagaaatattttttttaa

SEQ ID NO: 4359 - DNA, 20 bp, Artificial Sequence
  chemically synthesized
ctttattttctacttacttt

SEQ ID NO: 4360 - DNA, 20 bp, Artificial Sequence
  chemically synthesized
ttttctacttactttaagtg

SEQ ID NO: 4361 - DNA, 20 bp, Artificial Sequence
  chemically synthesized
actttaagtgaagttacttc

SEQ ID NO: 4362 - DNA, 20 bp, Artificial Sequence
  chemically synthesized
ctttaagtgaagttacttct

SEQ ID NO: 4363 - DNA, 20 bp, Artificial Sequence
  chemically synthesized
gaagttacttctgggtgttc

SEQ ID NO: 4364 - DNA, 20 bp, Artificial Sequence
  chemically synthesized
agttacttctgggtgttctg

SEQ ID NO: 4365 - DNA, 20 bp, Artificial Sequence
  chemically synthesized
ttctgggtgttctggagttt

SEQ ID NO: 4366 - DNA, 20 bp, Artificial Sequence
  chemically synthesized
tctgggtgttctggagtttc

SEQ ID NO: 4367 - DNA, 20 bp, Artificial Sequence
  chemically synthesized
tttcaggttgattttgaatt

SEQ ID NO: 4368 - DNA, 20 bp, Artificial Sequence
  chemically synthesized
aggttgattttgaattaagt

SEQ ID NO: 4369 - DNA, 20 bp, Artificial Sequence
  chemically synthesized
tgattttgaattaagttagt

SEQ ID NO: 4370 - DNA, 20 bp, Artificial Sequence
  chemically synthesized
aaatatttcactttttgttg

SEQ ID NO: 4371 - DNA, 20 bp, Artificial Sequence
  chemically synthesized
tatttcactttttgttgaag

SEQ ID NO: 4372 - DNA, 20 bp, Artificial Sequence
  chemically synthesized
tgaagtagaattttttcttc

SEQ ID NO: 4373 - DNA, 20 bp, Artificial Sequence
  chemically synthesized
gaagtagaattttttcttct

SEQ ID NO: 4374 - DNA, 20 bp, Artificial Sequence
  chemically synthesized
agtagaattttttcttctag

SEQ ID NO: 4375 - DNA, 20 bp, Artificial Sequence
  chemically synthesized
gtagaattttttcttctagg

SEQ ID NO: 4376 - DNA, 20 bp, Artificial Sequence
  chemically synthesized
ttttcttctaggaggctttc

SEQ ID NO: 4377 - DNA, 20 bp, Artificial Sequence
  chemically synthesized
ctaggaggctttcaagtttt

SEQ ID NO: 4378 - DNA, 20 bp, Artificial Sequence
  chemically synthesized
aggctttcaagttttgagtt

SEQ ID NO: 4379 - DNA, 20 bp, Artificial Sequence
  chemically synthesized
tcaagttttgagttgagttc

SEQ ID NO: 4380 - DNA, 20 bp, Artificial Sequence
  chemically synthesized
acctcttcatttttgacttg

SEQ ID NO: 4381 - DNA, 20 bp, Artificial Sequence
  chemically synthesized
tttgacttgtagtttatatg

SEQ ID NO: 4382 - DNA, 20 bp, Artificial Sequence
  chemically synthesized
agtttatatgtagttcttct

SEQ ID NO: 4383 - DNA, 20 bp, Artificial Sequence
  chemically synthesized
ttcttcttctttgatttcac

SEQ ID NO: 4384 - DNA, 20 bp, Artificial Sequence
  chemically synthesized
tctttgatttcactggtttg

SEQ ID NO: 4385 - DNA, 20 bp, Artificial Sequence
  chemically synthesized
atttcactggtttgcagcga

SEQ ID NO: 4386 - DNA, 20 bp, Artificial Sequence
  chemically synthesized
ttgcagcgatagatcataaa

SEQ ID NO: 4387 - DNA, 20 bp, Artificial Sequence
  chemically synthesized
aaagactgatcaaatatgtt

SEQ ID NO: 4388 - DNA, 20 bp, Artificial Sequence
  chemically synthesized
tttgaaatatgtcattaatt

SEQ ID NO: 4389 - DNA, 20 bp, Artificial Sequence
  chemically synthesized
taatttggcccttcgtctta

SEQ ID NO: 4390 - DNA, 20 bp, Artificial Sequence
  chemically synthesized
ggcccttcgtcttatggaca

SEQ ID NO: 4391 - DNA, 20 bp, Artificial Sequence
  chemically synthesized
gtcttatggacaaagtcttt

SEQ ID NO: 4392 - DNA, 20 bp, Artificial Sequence
  chemically synthesized
ttaagaccatgtcccaactg

SEQ ID NO: 4393 - DNA, 20 bp, Artificial Sequence
  chemically synthesized
taagaccatgtcccaactga

SEQ ID NO: 4394 - DNA, 20 bp, Artificial Sequence
  chemically synthesized
agaccatgtcccaactgaag

SEQ ID NO: 4395 - DNA, 20 bp, Artificial Sequence
  chemically synthesized
gaccatgtcccaactgaagg

SEQ ID NO: 4396 - DNA, 20 bp, Artificial Sequence
  chemically synthesized
tcccaactgaaggaggccat

SEQ ID NO: 4397 - DNA, 20 bp, Artificial Sequence
  chemically synthesized
aatttttacatcgtctaaca

SEQ ID NO: 4398 - DNA, 20 bp, Artificial Sequence
  chemically synthesized
aacatagcaaatcttgattt

SEQ ID NO: 4399 - DNA, 20 bp, Artificial Sequence
  chemically synthesized
gcaaatcttgattttggctc

SEQ ID NO: 4400 - DNA, 20 bp, Artificial Sequence
  chemically synthesized
aaatcttgattttggctctg

SEQ ID NO: 4401 - DNA, 20 bp, Artificial Sequence
  chemically synthesized
cttgattttggctctggaga

SEQ ID NO: 4402 - DNA, 20 bp, Artificial Sequence
  chemically synthesized
tgattttggctctggagata

SEQ ID NO: 4403 - DNA, 20 bp, Artificial Sequence
  chemically synthesized
tgaattgtcttgatcaattc

SEQ ID NO: 4404 - DNA, 20 bp, Artificial Sequence
  chemically synthesized
aattgtcttgatcaattctg

SEQ ID NO: 4405 - DNA, 20 bp, Artificial Sequence
  chemically synthesized
attgtcttgatcaattctgg

SEQ ID NO: 4406 - DNA, 20 bp, Artificial Sequence
  chemically synthesized
tcaattctggaggaaataac

SEQ ID NO: 4407 - DNA, 20 bp, Artificial Sequence
  chemically synthesized
aattctggaggaaataacta

SEQ ID NO: 4408 - DNA, 20 bp, Artificial Sequence
  chemically synthesized
attctggaggaaataactag

SEQ ID NO: 4409 - DNA, 20 bp, Artificial Sequence
  chemically synthesized
ataactagaggaacaataaa

SEQ ID NO: 4410 - DNA, 20 bp, Artificial Sequence
  chemically synthesized
actagaggaacaataaaaag

SEQ ID NO: 4411 - DNA, 20 bp, Artificial Sequence
  chemically synthesized
ctagaggaacaataaaaaga

SEQ ID NO: 4412 - DNA, 20 bp, Artificial Sequence
  chemically synthesized
agaggaacaataaaaagaag

SEQ ID NO: 4413 - DNA, 20 bp, Artificial Sequence
  chemically synthesized
ttatcttgattttcaatttc

SEQ ID NO: 4414 - DNA, 20 bp, Artificial Sequence
  chemically synthesized
attttcaatttcaagcaacg

SEQ ID NO: 4415 - DNA, 20 bp, Artificial Sequence
  chemically synthesized
aacgtggaactgttttcttc

SEQ ID NO: 4416 - DNA, 20 bp, Artificial Sequence
  chemically synthesized
gtggaactgttttcttctgg

SEQ ID NO: 4417 - DNA, 20 bp, Artificial Sequence
  chemically synthesized
gaactgttttcttctggaag

SEQ ID NO: 4418 - DNA, 20 bp, Artificial Sequence
  chemically synthesized
ttttcttctggaagcagacc

SEQ ID NO: 4419 - DNA, 20 bp, Artificial Sequence
  chemically synthesized
tatatataccaatatttgcc

SEQ ID NO: 4420 - DNA, 20 bp, Artificial Sequence
  chemically synthesized
ataccaatatttgcccagaa

SEQ ID NO: 4421 - DNA, 20 bp, Artificial Sequence
  chemically synthesized
taccaatatttgcccagaaa

SEQ ID NO: 4422 - DNA, 20 bp, Artificial Sequence
  chemically synthesized
aatatttgcccagaaaaggt

SEQ ID NO: 4423 - DNA, 20 bp, Artificial Sequence
  chemically synthesized
atatttgcccagaaaaggta

SEQ ID NO: 4424 - DNA, 20 bp, Artificial Sequence
  chemically synthesized
ttgcccagaaaaggtaaggt

SEQ ID NO: 4425 - DNA, 20 bp, Artificial Sequence
  chemically synthesized
cccagaaaaggtaaggttgg

SEQ ID NO: 4426 - DNA, 20 bp, Artificial Sequence
  chemically synthesized
ccagaaaaggtaaggttggt

SEQ ID NO: 4427 - DNA, 20 bp, Artificial Sequence
  chemically synthesized
gtaaggttggtaggtgaaca

SEQ ID NO: 4428 - DNA, 20 bp, Artificial Sequence
  chemically synthesized
ggtgaacatagttaatcatt

SEQ ID NO: 4429 - DNA, 20 bp, Artificial Sequence
  chemically synthesized
atgtaaccttcttccacatt

SEQ ID NO: 4430 - DNA, 20 bp, Artificial Sequence
  chemically synthesized
aaccttcttccacattgagt

SEQ ID NO: 4431 - DNA, 20 bp, Artificial Sequence
  chemically synthesized
atcaatgctaaatgaaatca

SEQ ID NO: 4432 - DNA, 20 bp, Artificial Sequence
  chemically synthesized
ctaaatgaaatcaaagaaat

SEQ ID NO: 4433 - DNA, 20 bp, Artificial Sequence
  chemically synthesized
gaaatgagcaactaacttaa

SEQ ID NO: 4434 - DNA, 20 bp, Artificial Sequence
  chemically synthesized
aaatgagcaactaacttaat

SEQ ID NO: 4435 - DNA, 20 bp, Artificial Sequence
  chemically synthesized
aaactacacattcaatgcta

SEQ ID NO: 4436 - DNA, 20 bp, Artificial Sequence
  chemically synthesized
tggtgactacctgtttttaa

SEQ ID NO: 4437 - DNA, 20 bp, Artificial Sequence
  chemically synthesized
ttttacttttttatgatttt

SEQ ID NO: 4438 - DNA, 20 bp, Artificial Sequence
  chemically synthesized
ttacttttttatgattttaa

SEQ ID NO: 4439 - DNA, 20 bp, Artificial Sequence
  chemically synthesized
tatgattttaagagatttac

SEQ ID NO: 4440 - DNA, 20 bp, Artificial Sequence
  chemically synthesized
tcaaaaataaacttttttgt

SEQ ID NO: 4441 - DNA, 20 bp, Artificial Sequence
  chemically synthesized
caaaaataaacttttttgtt

SEQ ID NO: 4442 - DNA, 20 bp, Artificial Sequence
  chemically synthesized
gttgggtaaatttattatta

SEQ ID NO: 4443 - DNA, 20 bp, Artificial Sequence
  chemically synthesized
gtaaatttattattaaagtt

SEQ ID NO: 4444 - DNA, 20 bp, Artificial Sequence
  chemically synthesized
taaatttattattaaagttg

SEQ ID NO: 4445 - DNA, 20 bp, Artificial Sequence
  chemically synthesized
aaatttattattaaagttga

SEQ ID NO: 4446 - DNA, 20 bp, Artificial Sequence
  chemically synthesized
aatttattattaaagttgag

SEQ ID NO: 4447 - DNA, 20 bp, Artificial Sequence
  chemically synthesized
tattaaagttgaggggaaaa

SEQ ID NO: 4448 - DNA, 20 bp, Artificial Sequence
  chemically synthesized
ggggaaaaaagtaatgaatt

SEQ ID NO: 4449 - DNA, 20 bp, Artificial Sequence
  chemically synthesized
aacaggtagtcaccatagca

SEQ ID NO: 4450 - DNA, 20 bp, Artificial Sequence
  chemically synthesized
tgggcaaatattggtatata

SEQ ID NO: 4451 - DNA, 20 bp, Artificial Sequence
  chemically synthesized
gttcctctagttatttcctc

SEQ ID NO: 4452 - DNA, 20 bp, Artificial Sequence
  chemically synthesized
aagtcaaaaatgaagaggta

SEQ ID NO: 4453 - DNA, 20 bp, Artificial Sequence
  chemically synthesized
taaagtaagtagaaaataaa

SEQ ID NO: 4454 - DNA, 20 bp, Artificial Sequence
  chemically synthesized
ttcatgtttatgttttcaat

SEQ ID NO: 4455 - DNA, 20 bp, Artificial Sequence
  chemically synthesized
gaaagaagcatacaagggga

SEQ ID NO: 4456 - DNA, 20 bp, Artificial Sequence
  chemically synthesized
cacacaggtctgtaaaaaca

SEQ ID NO: 4457 - DNA, 20 bp, Artificial Sequence
  chemically synthesized
aaattatttacaagctttaa

SEQ ID NO: 4458 - DNA, 20 bp, Artificial Sequence
  chemically synthesized
ttacaagctttaactggatc

SEQ ID NO: 4459 - DNA, 20 bp, Artificial Sequence
  chemically synthesized
ctctaaaactttgtgtgacc

SEQ ID NO: 4460 - DNA, 20 bp, Artificial Sequence
  chemically synthesized
aaagataataacagaactta

SEQ ID NO: 4461 - DNA, 20 bp, Artificial Sequence
  chemically synthesized
tcttggtctaaagagccaat

SEQ ID NO: 4462 - DNA, 20 bp, Artificial Sequence
  chemically synthesized
aaagagaaacatgatctaat

SEQ ID NO: 4463 - DNA, 20 bp, Artificial Sequence
  chemically synthesized
gtaagatgacattggctgct

SEQ ID NO: 4464 - DNA, 20 bp, Artificial Sequence
  chemically synthesized
gtgaggaaactgagagataa

SEQ ID NO: 4465 - DNA, 20 bp, Artificial Sequence
  chemically synthesized
ttaaagcttgtaaataattt

SEQ ID NO: 4466 - DNA, 20 bp, Artificial Sequence
  chemically synthesized
tcttgtttttctacaaaagt

SEQ ID NO: 4467 - DNA, 20 bp, Artificial Sequence
  chemically synthesized
tctacaaaagtctggatata

SEQ ID NO: 4468 - DNA, 20 bp, Artificial Sequence
  chemically synthesized
tctaaatttttaaactaata

SEQ ID NO: 4469 - DNA, 20 bp, Artificial Sequence
  chemically synthesized
actaataatggatttgaaaa

SEQ ID NO: 4470 - DNA, 20 bp, Artificial Sequence
  chemically synthesized
aaagcccagcatattttcat

SEQ ID NO: 4471 - DNA, 20 bp, Artificial Sequence
  chemically synthesized
ttaatctgttttaaacactg

SEQ ID NO: 4472 - DNA, 20 bp, Artificial Sequence
  chemically synthesized
tactttaagtgaagttactt

SEQ ID NO: 4473 - DNA, 20 bp, Artificial Sequence
  chemically synthesized
gaagttacttctgggtgttc

SEQ ID NO: 4474 - DNA, 20 bp, Artificial Sequence
  chemically synthesized
tctggagtttcaggttgatt

SEQ ID NO: 4475 - DNA, 20 bp, Artificial Sequence
  chemically synthesized
tatttcactttttgttgaag

SEQ ID NO: 4476 - DNA, 20 bp, Artificial Sequence
  chemically synthesized
ttctaggaggctttcaagtt

SEQ ID NO: 4477 - DNA, 20 bp, Artificial Sequence
  chemically synthesized
ggaggctttcaagttttgag

SEQ ID NO: 4478 - DNA, 20 bp, Artificial Sequence
  chemically synthesized
aaaaagactgatcaaatatg

SEQ ID NO: 4479 - DNA, 20 bp, Artificial Sequence
  chemically synthesized
tgattttggctctggagata

SEQ ID NO: 4480 - DNA, 20 bp, Artificial Sequence
  chemically synthesized
tggagatagagaatcaaatg

SEQ ID NO: 4481 - DNA, 20 bp, Artificial Sequence
  chemically synthesized
attaagccgtgttaacttgc

SEQ ID NO: 4482 - DNA, 20 bp, Artificial Sequence
  chemically synthesized
gaatgtaaccttcttccaca

SEQ ID NO: 4483 - DNA, 20 bp, Artificial Sequence
  chemically synthesized
gtcaaaaataaacttttttg

SEQ ID NO: 4484 - DNA, 20 bp, Artificial Sequence
  chemically synthesized
aagttgaggggaaaaaagta

SEQ ID NO: 4485 - DNA, 20 bp, Artificial Sequence
  chemically synthesized
gaagtctaggtctgcttcca

SEQ ID NO: 4486 - DNA, 20 bp, Artificial Sequence
  chemically synthesized
tgttcctctagttatttcct

SEQ ID NO: 4487 - DNA, 20 bp, Artificial Sequence
  chemically synthesized
aaaccagtgaaatcaaagaa

SEQ ID NO: 4488 - DNA, 20 bp, Artificial Sequence
  chemically synthesized
caagtcaaaaatgaagaggt

SEQ ID NO: 4489 - DNA, 20 bp, Artificial Sequence
  chemically synthesized
caaaacttgaaagcctccta

SEQ ID NO: 4490 - DNA, 20 bp, Artificial Sequence
  chemically synthesized
agtaacttcacttaaagtaa

SEQ ID NO: 4491 - DNA, 20 bp, Artificial Sequence
  chemically synthesized
tgttgaaatacttttttttc

SEQ ID NO: 4492 - DNA, 20 bp, Artificial Sequence
  chemically synthesized
ttttccaagaaaaataatct

SEQ ID NO: 4493 - DNA, 20 bp, Artificial Sequence
  chemically synthesized
ctttttcttttaattgaagt

SEQ ID NO: 4494 - DNA, 20 bp, Artificial Sequence
  chemically synthesized
gatagtgttacaggaaatta

SEQ ID NO: 4495 - DNA, 20 bp, Artificial Sequence
  chemically synthesized
tgttacaggaaattaataga

SEQ ID NO: 4496 - DNA, 20 bp, Artificial Sequence
  chemically synthesized
ctctctatatccagactttt

SEQ ID NO: 4497 - DNA, 20 bp, Artificial Sequence
  chemically synthesized
accaacagcatagtcaaata

SEQ ID NO: 4498 - DNA, 20 bp, Artificial Sequence
  chemically synthesized
agcatagtcaaataaaagaa

SEQ ID NO: 4499 - DNA, 20 bp, Artificial Sequence
  chemically synthesized
cagaacttataggattattg

SEQ ID NO: 4500 - DNA, 20 bp, Artificial Sequence
  chemically synthesized
tattgtgtggttttgagcaa

SEQ ID NO: 4501 - DNA, 20 bp, Artificial Sequence
  chemically synthesized
gattttctgaacttcaatta

SEQ ID NO: 4502 - DNA, 20 bp, Artificial Sequence
  chemically synthesized
tttaatctgttttaaacact

SEQ ID NO: 4503 - DNA, 20 bp, Artificial Sequence
  chemically synthesized
agtatttcaaatggcatgcc

SEQ ID NO: 4504 - DNA, 20 bp, Artificial Sequence
  chemically synthesized
atatttcactttttgttgaa

SEQ ID NO: 4505 - DNA, 20 bp, Artificial Sequence
  chemically synthesized
ttgattttggctctggagat

SEQ ID NO: 4506 - DNA, 20 bp, Artificial Sequence
  chemically synthesized
ctatatataccaatatttgc

SEQ ID NO: 4507 - DNA, 20 bp, Artificial Sequence
  chemically synthesized
gatcaatgctaaatgaaatc

SEQ ID NO: 4508 - DNA, 20 bp, Artificial Sequence
  chemically synthesized
aaaaagtaaaattagctttt

SEQ ID NO: 4509 - DNA, 20 bp, Artificial Sequence
  chemically synthesized
gtctaggtctgcttccagaa

SEQ ID NO: 4510 - DNA, 20 bp, Artificial Sequence
  chemically synthesized
ccaaattaatgacatatttc

SEQ ID NO: 4511 - DNA, 20 bp, Artificial Sequence
  chemically synthesized
tatgtcacttgaactcaact

SEQ ID NO: 4512 - DNA, 20 bp, Artificial Sequence
  chemically synthesized
gtttccctaatgttatatat

SEQ ID NO: 4513 - DNA, 20 bp, Artificial Sequence
  chemically synthesized
gtaaaaagttaaaaaaaatt

SEQ ID NO: 4514 - DNA, 20 bp, Artificial Sequence
  chemically synthesized
taaaactattctccagtgtt

SEQ ID NO: 4515 - DNA, 20 bp, Artificial Sequence
  chemically synthesized
ctatatccagacttttgtag

SEQ ID NO: 4516 - DNA, 20 bp, Artificial Sequence
  chemically synthesized
catctttcacacaggtctgt

SEQ ID NO: 4517 - DNA, 20 bp, Artificial Sequence
  chemically synthesized
ctgcatttaaaccatggctc

SEQ ID NO: 4518 - DNA, 20 bp, Artificial Sequence
  chemically synthesized
agatcatgtttctctttgct

SEQ ID NO: 4519 - DNA, 20 bp, Artificial Sequence
  chemically synthesized
tatataacattagggaaaca

SEQ ID NO: 4520 - DNA, 20 bp, Artificial Sequence
  chemically synthesized
ttttttaaaagatccacatt

SEQ ID NO: 4521 - DNA, 20 bp, Artificial Sequence
  chemically synthesized
ataataaatttacccaacaa

SEQ ID NO: 4522 - DNA, 20 bp, Artificial Sequence
  chemically synthesized
taaaatcataaaaaagtaaa

SEQ ID NO: 4523 - DNA, 20 bp, Artificial Sequence
  chemically synthesized
agtcaccatagcattgaatg

SEQ ID NO: 4524 - DNA, 20 bp, Artificial Sequence
  chemically synthesized
attaagttagttgctcattt

SEQ ID NO: 4525 - DNA, 20 bp, Artificial Sequence
  chemically synthesized
gttacattcgtgcaagttaa

SEQ ID NO: 4526 - DNA, 20 bp, Artificial Sequence
  chemically synthesized
tcgtgcaagttaacacggct

SEQ ID NO: 4527 - DNA, 20 bp, Artificial Sequence
  chemically synthesized
tatagagttaagaagtctag

SEQ ID NO: 4528 - DNA, 20 bp, Artificial Sequence
  chemically synthesized
tccagaagaaaacagttcca

SEQ ID NO: 4529 - DNA, 20 bp, Artificial Sequence
  chemically synthesized
attgatcaagacaattcatc

SEQ ID NO: 4530 - DNA, 20 bp, Artificial Sequence
  chemically synthesized
ctctatctccagagccaaaa

SEQ ID NO: 4531 - DNA, 20 bp, Artificial Sequence
  chemically synthesized
aagtagaaaataaagagggt

SEQ ID NO: 4532 - DNA, 20 bp, Artificial Sequence
  chemically synthesized
aaaataaagagggttcatgt

SEQ ID NO: 4533 - DNA, 20 bp, Artificial Sequence
  chemically synthesized
atttcctattataatttcaa

SEQ ID NO: 4534 - DNA, 20 bp, Artificial Sequence
  chemically synthesized
attataatttcaagttagtt

SEQ ID NO: 4535 - DNA, 20 bp, Artificial Sequence
  chemically synthesized
aaaaatttaaaactattctc

SEQ ID NO: 4536 - DNA, 20 bp, Artificial Sequence
  chemically synthesized
aactattctccagtgtttaa

SEQ ID NO: 4537 - DNA, 20 bp, Artificial Sequence
  chemically synthesized
ttaaataatacagtaaatgg

SEQ ID NO: 4538 - DNA, 20 bp, Artificial Sequence
  chemically synthesized
tttattcatatgaaaatatg

SEQ ID NO: 4539 - DNA, 20 bp, Artificial Sequence
  chemically synthesized
attcatttttcaaatccatt

SEQ ID NO: 4540 - DNA, 20 bp, Artificial Sequence
  chemically synthesized
atccattattagtttaaaaa

SEQ ID NO: 4541 - DNA, 20 bp, Artificial Sequence
  chemically synthesized
actgaatcctaaaattattt

SEQ ID NO: 4542 - DNA, 20 bp, Artificial Sequence
  chemically synthesized
attacttcacccctttatct

SEQ ID NO: 4543 - DNA, 20 bp, Artificial Sequence
  chemically synthesized
caaagataataacagaactt

SEQ ID NO: 4544 - DNA, 20 bp, Artificial Sequence
  chemically synthesized
ttactaaaattcaaattaga

SEQ ID NO: 4545 - DNA, 20 bp, Artificial Sequence
  chemically synthesized
ctctttgctcaaaaccacac

SEQ ID NO: 4546 - DNA, 20 bp, Artificial Sequence
  chemically synthesized
actcatattggctctttaga

SEQ ID NO: 4547 - DNA, 20 bp, Artificial Sequence
  chemically synthesized
agtgaaatggaaagctattg

SEQ ID NO: 4548 - DNA, 20 bp, Artificial Sequence
  chemically synthesized
gtaatttattcaaggtcaca

SEQ ID NO: 4549 - DNA, 20 bp, Artificial Sequence
  chemically synthesized
gtcacacaaagttttagagc

SEQ ID NO: 4550 - DNA, 20 bp, Artificial Sequence
  chemically synthesized
agagccatggtttaaatgca

SEQ ID NO: 4551 - DNA, 20 bp, Artificial Sequence
  chemically synthesized
ggtttaaatgcaggtagttt

SEQ ID NO: 4552 - DNA, 20 bp, Artificial Sequence
  chemically synthesized
aattttactcatgatccagt

SEQ ID NO: 4553 - DNA, 20 bp, Artificial Sequence
  chemically synthesized
gttaaagcttgtaaataatt

SEQ ID NO: 4554 - DNA, 20 bp, Artificial Sequence
  chemically synthesized
ttgtaaataattttaggatt

SEQ ID NO: 4555 - DNA, 20 bp, Artificial Sequence
  chemically synthesized
taccattaaaatactgactt

SEQ ID NO: 4556 - DNA, 20 bp, Artificial Sequence
  chemically synthesized
ttcttttatttgactatgct

SEQ ID NO: 4557 - DNA, 20 bp, Artificial Sequence
  chemically synthesized
tttgactatgctgttggttt

SEQ ID NO: 4558 - DNA, 20 bp, Artificial Sequence
  chemically synthesized
gaaggtctttgatgctatta

SEQ ID NO: 4559 - DNA, 20 bp, Artificial Sequence
  chemically synthesized
tagagagtaggttggttata

SEQ ID NO: 4560 - DNA, 20 bp, Artificial Sequence
  chemically synthesized
atctaaatttttaaactaat

SEQ ID NO: 4561 - DNA, 20 bp, Artificial Sequence
  chemically synthesized
attggcaattccttcccctt

SEQ ID NO: 4562 - DNA, 20 bp, Artificial Sequence
  chemically synthesized
taaattgtactatctctaaa

SEQ ID NO: 4563 - DNA, 20 bp, Artificial Sequence
  chemically synthesized
tccatttactgtattattta

SEQ ID NO: 4564 - DNA, 20 bp, Artificial Sequence
  chemically synthesized
atctgttttaaacactggag

SEQ ID NO: 4565 - DNA, 20 bp, Artificial Sequence
  chemically synthesized
atagtgtaatgacatagtgt

SEQ ID NO: 4566 - DNA, 20 bp, Artificial Sequence
  chemically synthesized
tgttctagattgtataattt

SEQ ID NO: 4567 - DNA, 20 bp, Artificial Sequence
  chemically synthesized
tcatataaaatgcaaatttt

SEQ ID NO: 4568 - DNA, 20 bp, Artificial Sequence
  chemically synthesized
taataggaaattttattttc

SEQ ID NO: 4569 - DNA, 20 bp, Artificial Sequence
  chemically synthesized
gaagttacttctgggtgttc

SEQ ID NO: 4570 - DNA, 20 bp, Artificial Sequence
  chemically synthesized
ctgggtgttctggagtttca

SEQ ID NO: 4571 - DNA, 20 bp, Artificial Sequence
  chemically synthesized
aagtagaattttttcttcta

SEQ ID NO: 4572 - DNA, 20 bp, Artificial Sequence
  chemically synthesized
ttttttcttctaggaggctt

SEQ ID NO: 4573 - DNA, 20 bp, Artificial Sequence
  chemically synthesized
ttacctcttcatttttgact

SEQ ID NO: 4574 - DNA, 20 bp, Artificial Sequence
  chemically synthesized
tctcagttccttttcttctt

SEQ ID NO: 4575 - DNA, 20 bp, Artificial Sequence
  chemically synthesized
ttttcttcttctttgatttc

SEQ ID NO: 4576 - DNA, 20 bp, Artificial Sequence
  chemically synthesized
aaaaagactgatcaaatatg

SEQ ID NO: 4577 - DNA, 20 bp, Artificial Sequence
  chemically synthesized
acatcgtctaacatagcaaa

SEQ ID NO: 4578 - DNA, 20 bp, Artificial Sequence
  chemically synthesized
ctagaggaacaataaaaaga

SEQ ID NO: 4579 - DNA, 20 bp, Artificial Sequence
  chemically synthesized
cttaattgtgaacattttta

SEQ ID NO: 4580 - DNA, 20 bp, Artificial Sequence
  chemically synthesized
ttcaatttcaagcaacgtgg

SEQ ID NO: 4581 - DNA, 20 bp, Artificial Sequence
  chemically synthesized
cattcaatgctatggtgact

SEQ ID NO: 4582 - DNA, 20 bp, Artificial Sequence
  chemically synthesized
taaaagctaattttactttt

SEQ ID NO: 4583 - DNA, 20 bp, Artificial Sequence
  chemically synthesized
ttttacttttttatgatttt

SEQ ID NO: 4584 - DNA, 22 bp, Artificial Sequence
  chemically synthesized
aattcattacttttttcccctc

SEQ ID NO: 4585 - DNA, 22 bp, Artificial Sequence
  chemically synthesized
attcattacttttttcccctca

SEQ ID NO: 4586 - DNA, 22 bp, Artificial Sequence
  chemically synthesized
attacttttttcccctcaactt

SEQ ID NO: 4587 - DNA, 22 bp, Artificial Sequence
  chemically synthesized
cttttttcccctcaactttaat

SEQ ID NO: 4588 - DNA, 22 bp, Artificial Sequence
  chemically synthesized
ttttcccctcaactttaataat

SEQ ID NO: 4589 - DNA, 22 bp, Artificial Sequence
  chemically synthesized
tttcccctcaactttaataata

SEQ ID NO: 4590 - DNA, 22 bp, Artificial Sequence
  chemically synthesized
ttcccctcaactttaataataa

SEQ ID NO: 4591 - DNA, 22 bp, Artificial Sequence
  chemically synthesized
tcccctcaactttaataataaa

SEQ ID NO: 4592 - DNA, 22 bp, Artificial Sequence
  chemically synthesized
cccctcaactttaataataaat

SEQ ID NO: 4593 - DNA, 22 bp, Artificial Sequence
  chemically synthesized
ccctcaactttaataataaatt

SEQ ID NO: 4594 - DNA, 22 bp, Artificial Sequence
  chemically synthesized
aactttaataataaatttaccc

SEQ ID NO: 4595 - DNA, 22 bp, Artificial Sequence
  chemically synthesized
taataataaatttacccaacaa

SEQ ID NO: 4596 - DNA, 22 bp, Artificial Sequence
  chemically synthesized
aataataaatttacccaacaaa

SEQ ID NO: 4597 - DNA, 22 bp, Artificial Sequence
  chemically synthesized
ataataaatttacccaacaaaa

SEQ ID NO: 4598 - DNA, 22 bp, Artificial Sequence
  chemically synthesized
acccaacaaaaaagtttatttt

SEQ ID NO: 4599 - DNA, 22 bp, Artificial Sequence
  chemically synthesized
cccaacaaaaaagtttattttt

SEQ ID NO: 4600 - DNA, 22 bp, Artificial Sequence
  chemically synthesized
atttttgacttgtaaatctctt

SEQ ID NO: 4601 - DNA, 22 bp, Artificial Sequence
  chemically synthesized
tttttgacttgtaaatctctta

SEQ ID NO: 4602 - DNA, 22 bp, Artificial Sequence
  chemically synthesized
ttgacttgtaaatctcttaaaa

SEQ ID NO: 4603 - DNA, 22 bp, Artificial Sequence
  chemically synthesized
tgacttgtaaatctcttaaaat

SEQ ID NO: 4604 - DNA, 22 bp, Artificial Sequence
  chemically synthesized
gacttgtaaatctcttaaaatc

SEQ ID NO: 4605 - DNA, 22 bp, Artificial Sequence
  chemically synthesized
acttgtaaatctcttaaaatca

SEQ ID NO: 4606 - DNA, 22 bp, Artificial Sequence
  chemically synthesized
gtaaatctcttaaaatcataaa

SEQ ID NO: 4607 - DNA, 22 bp, Artificial Sequence
  chemically synthesized
taaatctcttaaaatcataaaa

SEQ ID NO: 4608 - DNA, 22 bp, Artificial Sequence
  chemically synthesized
ttaaaatcataaaaaagtaaaa

SEQ ID NO: 4609 - DNA, 22 bp, Artificial Sequence
  chemically synthesized
aaaatcataaaaaagtaaaatt

SEQ ID NO: 4610 - DNA, 22 bp, Artificial Sequence
  chemically synthesized
aaatcataaaaaagtaaaatta

SEQ ID NO: 4611 - DNA, 22 bp, Artificial Sequence
  chemically synthesized
gcttttaaaaacaggtagtcac

SEQ ID NO: 4612 - DNA, 22 bp, Artificial Sequence
  chemically synthesized
ttaaaaacaggtagtcaccata

SEQ ID NO: 4613 - DNA, 22 bp, Artificial Sequence
  chemically synthesized
taaaaacaggtagtcaccatag

SEQ ID NO: 4614 - DNA, 22 bp, Artificial Sequence
  chemically synthesized
aaaaacaggtagtcaccatagc

SEQ ID NO: 4615 - DNA, 22 bp, Artificial Sequence
  chemically synthesized
aaaacaggtagtcaccatagca

SEQ ID NO: 4616 - DNA, 22 bp, Artificial Sequence
  chemically synthesized
aatgtgtagtttataatacagc

SEQ ID NO: 4617 - DNA, 22 bp, Artificial Sequence
  chemically synthesized
ataatacagcaaagttaaatac

SEQ ID NO: 4618 - DNA, 22 bp, Artificial Sequence
  chemically synthesized
taatacagcaaagttaaataca

SEQ ID NO: 4619 - DNA, 22 bp, Artificial Sequence
  chemically synthesized
aatacaatttcaaattacctat

SEQ ID NO: 4620 - DNA, 22 bp, Artificial Sequence
  chemically synthesized
caaattacctattaagttagtt

SEQ ID NO: 4621 - DNA, 22 bp, Artificial Sequence
  chemically synthesized
aaattacctattaagttagttg

SEQ ID NO: 4622 - DNA, 22 bp, Artificial Sequence
  chemically synthesized
cctattaagttagttgctcatt

SEQ ID NO: 4623 - DNA, 22 bp, Artificial Sequence
  chemically synthesized
ttaagttagttgctcatttctt

SEQ ID NO: 4624 - DNA, 22 bp, Artificial Sequence
  chemically synthesized
agttagttgctcatttctttga

SEQ ID NO: 4625 - DNA, 22 bp, Artificial Sequence
  chemically synthesized
gttgctcatttctttgatttca

SEQ ID NO: 4626 - DNA, 22 bp, Artificial Sequence
  chemically synthesized
ctcatttctttgatttcattta

SEQ ID NO: 4627 - DNA, 22 bp, Artificial Sequence
  chemically synthesized
atttctttgatttcatttagca

SEQ ID NO: 4628 - DNA, 22 bp, Artificial Sequence
  chemically synthesized
ctttgatttcatttagcattga

SEQ ID NO: 4629 - DNA, 22 bp, Artificial Sequence
  chemically synthesized
tttgatttcatttagcattgat

SEQ ID NO: 4630 - DNA, 22 bp, Artificial Sequence
  chemically synthesized
tgatttcatttagcattgatct

SEQ ID NO: 4631 - DNA, 22 bp, Artificial Sequence
  chemically synthesized
gatttcatttagcattgatcta

SEQ ID NO: 4632 - DNA, 22 bp, Artificial Sequence
  chemically synthesized
atttcatttagcattgatctaa

SEQ ID NO: 4633 - DNA, 22 bp, Artificial Sequence
  chemically synthesized
catttagcattgatctaactca

SEQ ID NO: 4634 - DNA, 22 bp, Artificial Sequence
  chemically synthesized
atttagcattgatctaactcaa

SEQ ID NO: 4635 - DNA, 22 bp, Artificial Sequence
  chemically synthesized
agcattgatctaactcaatgtg

SEQ ID NO: 4636 - DNA, 22 bp, Artificial Sequence
  chemically synthesized
gcattgatctaactcaatgtgg

SEQ ID NO: 4637 - DNA, 22 bp, Artificial Sequence
  chemically synthesized
atctaactcaatgtggaagaag

SEQ ID NO: 4638 - DNA, 22 bp, Artificial Sequence
  chemically synthesized
actcaatgtggaagaaggttac

SEQ ID NO: 4639 - DNA, 22 bp, Artificial Sequence
  chemically synthesized
aatgtggaagaaggttacattc

SEQ ID NO: 4640 - DNA, 22 bp, Artificial Sequence
  chemically synthesized
cattcgtgcaagttaacacggc

SEQ ID NO: 4641 - DNA, 22 bp, Artificial Sequence
  chemically synthesized
gtgcaagttaacacggcttaat

SEQ ID NO: 4642 - DNA, 22 bp, Artificial Sequence
  chemically synthesized
acacggcttaatgattaactat

SEQ ID NO: 4643 - DNA, 22 bp, Artificial Sequence
  chemically synthesized
aatgattaactatgttcaccta

SEQ ID NO: 4644 - DNA, 22 bp, Artificial Sequence
  chemically synthesized
atgattaactatgttcacctac

SEQ ID NO: 4645 - DNA, 22 bp, Artificial Sequence
  chemically synthesized
actatgttcacctaccaacctt

SEQ ID NO: 4646 - DNA, 22 bp, Artificial Sequence
  chemically synthesized
tgttcacctaccaaccttacct

SEQ ID NO: 4647 - DNA, 22 bp, Artificial Sequence
  chemically synthesized
acctaccaaccttaccttttct

SEQ ID NO: 4648 - DNA, 22 bp, Artificial Sequence
  chemically synthesized
ccaaccttaccttttctgggca

SEQ ID NO: 4649 - DNA, 22 bp, Artificial Sequence
  chemically synthesized
accttttctgggcaaatattgg

SEQ ID NO: 4650 - DNA, 22 bp, Artificial Sequence
  chemically synthesized
ccttttctgggcaaatattggt

SEQ ID NO: 4651 - DNA, 22 bp, Artificial Sequence
  chemically synthesized
ttctgggcaaatattggtatat

SEQ ID NO: 4652 - DNA, 22 bp, Artificial Sequence
  chemically synthesized
tctgggcaaatattggtatata

SEQ ID NO: 4653 - DNA, 22 bp, Artificial Sequence
  chemically synthesized
ctgggcaaatattggtatatat

SEQ ID NO: 4654 - DNA, 22 bp, Artificial Sequence
  chemically synthesized
tgggcaaatattggtatatata

SEQ ID NO: 4655 - DNA, 22 bp, Artificial Sequence
  chemically synthesized
ggcaaatattggtatatataga

SEQ ID NO: 4656 - DNA, 22 bp, Artificial Sequence
  chemically synthesized
gtatatatagagttaagaagtc

SEQ ID NO: 4657 - DNA, 22 bp, Artificial Sequence
  chemically synthesized
agaagtctaggtctgcttccag

SEQ ID NO: 4658 - DNA, 22 bp, Artificial Sequence
  chemically synthesized
ggtctgcttccagaagaaaaca

SEQ ID NO: 4659 - DNA, 22 bp, Artificial Sequence
  chemically synthesized
cttccagaagaaaacagttcca

SEQ ID NO: 4660 - DNA, 22 bp, Artificial Sequence
  chemically synthesized
ccagaagaaaacagttccacgt

SEQ ID NO: 4661 - DNA, 22 bp, Artificial Sequence
  chemically synthesized
cagaagaaaacagttccacgtt

SEQ ID NO: 4662 - DNA, 22 bp, Artificial Sequence
  chemically synthesized
cacgttgcttgaaattgaaaat

SEQ ID NO: 4663 - DNA, 22 bp, Artificial Sequence
  chemically synthesized
cttgaaattgaaaatcaagata

SEQ ID NO: 4664 - DNA, 22 bp, Artificial Sequence
  chemically synthesized
gaaattgaaaatcaagataaaa

(The sequence listing continues in the following parts.)

What is claimed is:

1. One or more guide ribonucleic acids (gRNAs) for editing exon 1, exon 2 or exon 5 of a glucose-6-phosphatase, catalytic (G6PC) gene in a cell, wherein the one or more gRNAs comprise a spacer sequence that is 10 to 30 nucleotides in length, wherein the spacer sequence is an RNA sequence corresponding to the full-length nucleic acid sequence selected from the group consisting of SEQ ID NOs: 57,319, 57,306, 52,935, 57,305, 52,938, 52,940, 57,296, 52,951, 52,918, 57,320, 52,919, 52,923, 57,308, 57,295, 56,893, 53,372, 53,374, 56,890, 56,883, 56,881, 53,380, 56,879, 56,878, 53,382, 56,876, 56,865, 56,863, 56,909, 56,898, 53,370, 56,860, 55,845, 55,842, 54,541, 55,820, 54,560, 53,360, 53,362, 59,984, 53,358, 55,838, 52,962, 53,369, 57,300, 52,910, 57,321, 57,312, 52,939, 57,299, 52,944, 52,957, 57,274, 53,364, 53,373, 53,375, 56,882, 56,873, 53,392, 53,403, 53,363, 54,506, 55,875, 55,874, 55,873, 55,872, 54,511, 55,861, 55,837, 54,542, 54,544, 54,558, 64,798, 64,799, 64,801, 56,893, 64,808, 64,809, 64,810, 64,811, 64,812, 64,813, 53,372, and 64,816, wherein the one or more gRNAs has an editing efficiency of at least 10%.

2. The one or more gRNAs of claim 1, wherein the one or more gRNAs are one or more single-molecule guide RNAs (sgRNAs).

3. The one or more gRNAs of claim 1, wherein the one or more gRNAs is one or more modified gRNA or one or more modified sgRNA.

4. The one or more gRNAs of claim 1, wherein the cell is a liver cell.

5. The one or more gRNAs of claim 1, wherein the gRNA is directed to one or more of the following pathological variants: rs80356479, rs80356486, rs606231368, rs80356488, rs587776757, rs104894565, rs104894566, rs1801175, rs1801176, rs104894567, rs104894571, rs80356482, rs80356483, rs104894563, rs367727229, rs387906505, rs104894568, rs104894569, rs80356487, rs764920787, rs80356485, rs780226142, and rs80356484.

6. The one or more gRNAs of claim 1, wherein the spacer sequence is an RNA sequence corresponding to the full-length nucleic acid sequence selected from the group consisting of the nucleic acid sequences of SEQ ID NOs: 57,319, 57,306, 52,935, 57,305, 52,938, 52,940, 57,296, 52,951, 52,918, 57,320, 52,919, 52,923, 57,308, 57,295, 56,893, 53,372, 53,374, 56,890, 56,883, 56,881, 53,380, 56,879, 56,878, 53,382, 56,876, 56,865, 56,863, 56,909, 56,898, 53,370, 56,860, 55,845, 55,842, 54,541, 55,820, and 54,560.

* * * * *